US009249196B2

(12) United States Patent
Fraser et al.

(10) Patent No.: US 9,249,196 B2
(45) Date of Patent: *Feb. 2, 2016

(54) *NEISSERIA MENINGITIDIS* ANTIGENS AND COMPOSITIONS

(75) Inventors: Claire Fraser, Potomac, MD (US); Cesira Galeotti, Poggibonsi (IT); Guido Grandi, Segratf (IT); Erin Hickey, Palatine, IL (US); Vega Masignani, Siena (IT); Marirosa Mora, Siena (IT); Jeremy Petersen, Arlington, VA (US); Mariagrazia Pizza, Siena (IT); Rino Rappuoli, Vagliagli (IT); Giulio Ratti, Siena (IT); Vincenzo Scarlato, Colle Val D'Elsa (IT); Maria Scarselli, Siena (IT); Herve Tettelin, Gaithersburg, MD (US); J. Craig Venter, Potomac, MD (US)

(73) Assignee: GlaxoSmithKline Biologicals SA, Rixensart (BE)

( * ) Notice: Subject to any disclaimer, the term of this patent is extended or adjusted under 35 U.S.C. 154(b) by 0 days.

This patent is subject to a terminal disclaimer.

(21) Appl. No.: 13/359,442

(22) Filed: Jan. 26, 2012

(65) Prior Publication Data

US 2012/0148616 A1 Jun. 14, 2012

Related U.S. Application Data

(60) Continuation of application No. 13/070,448, filed on Mar. 23, 2011, which is a division of application No. 12/013,047, filed on Jan. 11, 2008, now Pat. No. 7,988,979, which is a continuation of application No. 09/674,546, filed as application No. PCT/US99/09346 on Apr. 30, 1999, now Pat. No. 7,576,176.

(60) Provisional application No. 60/121,528, filed on Feb. 25, 1999, provisional application No. 60/103,749, filed on Oct. 9, 1998, provisional application No. 60/103,794, filed on Oct. 9, 1998, provisional application No. 60/103,796, filed on Oct. 9, 1998, provisional application No. 60/098,994, filed on Sep. 2, 1998, provisional application No. 60/099,062, filed on Sep. 2, 1998, provisional application No. 60/094,869, filed on Jul. 31, 1998, provisional application No. 60/083,758, filed on May 1, 1998.

(51) Int. Cl.
*A61K 39/095* (2006.01)
*A61K 39/00* (2006.01)
*C07K 14/22* (2006.01)
*A61K 38/00* (2006.01)

(52) U.S. Cl.
CPC .............. *C07K 14/22* (2013.01); *A61K 38/00* (2013.01); *A61K 39/00* (2013.01); *A61K 39/095* (2013.01); *Y10S 530/806* (2013.01); *Y10S 530/825* (2013.01)

(58) Field of Classification Search
None
See application file for complete search history.

(56) References Cited

U.S. PATENT DOCUMENTS

| | | | |
|---|---|---|---|
| 5,514,581 A | 5/1996 | Ferrari et al. | |
| 5,550,213 A | 8/1996 | Anderson et al. | |
| 5,554,372 A | 9/1996 | Hunter | |
| 5,668,004 A | 9/1997 | O'Donnell | |
| 6,060,065 A | 5/2000 | Barney et al. | |
| 6,214,566 B1 | 4/2001 | Asa et al. | |
| 6,472,518 B1 * | 10/2002 | Ribot et al. | 536/23.7 |
| 7,348,006 B2 | 3/2008 | Contorni et al. | |
| 7,576,176 B1 * | 8/2009 | Fraser et al. | 530/350 |
| 7,785,608 B2 | 8/2010 | Zlotnick et al. | |
| 7,862,827 B2 * | 1/2011 | Giuliani et al. | 424/250.1 |
| 8,101,194 B2 | 1/2012 | Zlotnick et al. | |
| 8,226,960 B2 | 7/2012 | Masignani et al. | |
| 8,273,360 B2 * | 9/2012 | Pizza et al. | 424/250.1 |
| 8,293,251 B2 | 10/2012 | Scarlato et al. | |
| 8,394,390 B2 | 3/2013 | Galeotti et al. | |
| 8,398,988 B2 | 3/2013 | Contorni et al. | |
| 8,398,999 B2 | 3/2013 | Masignani et al. | |
| 8,470,340 B2 | 6/2013 | Beernink et al. | |
| 8,524,251 B2 | 9/2013 | Fraser et al. | |
| 8,563,007 B1 | 10/2013 | Zlotnick et al. | |
| 8,574,597 B2 | 11/2013 | Zlotnick | |
| 8,663,656 B2 | 3/2014 | Pizza | |
| 8,734,812 B1 | 5/2014 | Galeotti et al. | |
| 8,834,888 B2 * | 9/2014 | Contorni et al. | 424/184.1 |
| 8,840,907 B2 | 9/2014 | Pizza | |
| 8,980,286 B2 | 3/2015 | Comanducci et al. | |
| 9,011,869 B2 | 4/2015 | Pizza | |
| 9,056,075 B2 | 6/2015 | Pizza | |
| 9,067,987 B2 | 6/2015 | Galeotti et al. | |
| 2004/0033234 A1 | 2/2004 | Berinstein et al. | |
| 2004/0092711 A1 | 5/2004 | Arico | |

(Continued)

FOREIGN PATENT DOCUMENTS

| | | |
|---|---|---|
| EP | 0467714 | 1/1992 |
| EP | 0818465 A1 | 1/1998 |

(Continued)

OTHER PUBLICATIONS

Gomez et al. Vaccine 14: 1340-1346, 1996.*
Malorny et al. J. Bacteriol. 180: 1323-1330, 1998.*
Teerlink et al. J. Exp. Med. 166: 63-76, 1987, abstract.*
Forest et al. Gene 192: 165-169, 1997.*
Ala'Aldeen et al. Vaccine 12: 535-541, 1994, abstract.*
Cruse et al., Illustrated Dictionary of Immunology, 2nd Edn., CRC Press, pp. 46, 166 and 382, 2003.*
McGuiness et al. Mol. Microbiol. 7: 505-514, Feb. 1993.*
Skolnick et al. Trends in Biotechnology 18: 34-39, 2000.*
Greenspan et al., Nature Biotechnology 17:936-937, 1999.*

(Continued)

*Primary Examiner* — S. Devi
(74) *Attorney, Agent, or Firm* — Morrison & Foerster LLP

(57) ABSTRACT

The invention provides proteins from *Neisseria meningitidis*, including the amino acid sequences and the corresponding nucleotide sequences. The proteins are predicted to be useful antigens for vaccines and/or diagnostics.

10 Claims, 31 Drawing Sheets

(56) References Cited

U.S. PATENT DOCUMENTS

Figure 5A:
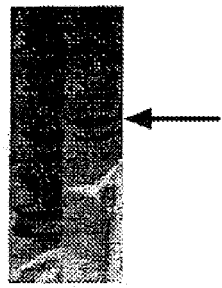
Figure 5B:
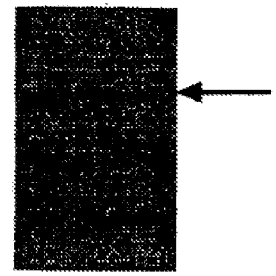
Figure 5C:
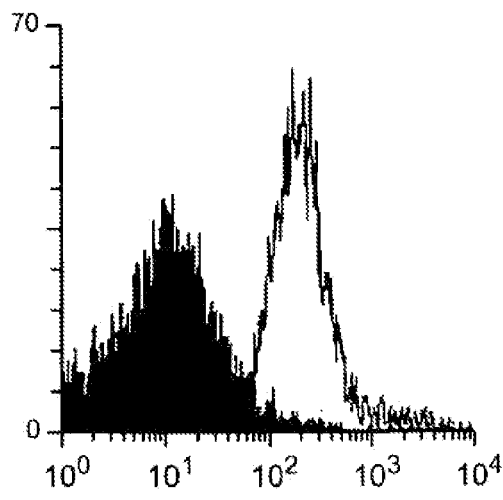
Figure 5D:
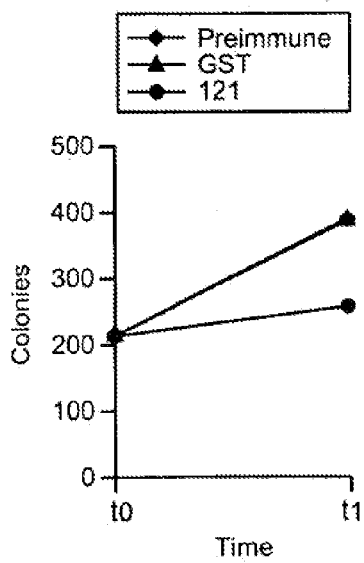
Figure 6A:
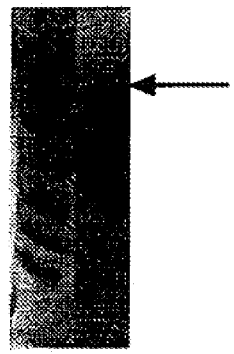
Figure 6B:
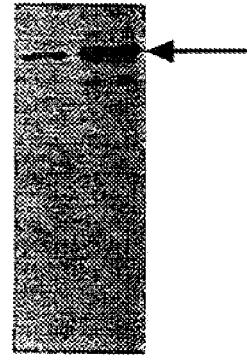
Figure 6C:
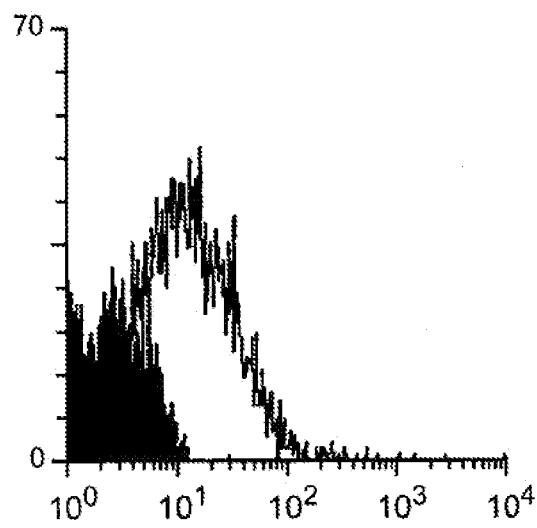
Figure 6D:
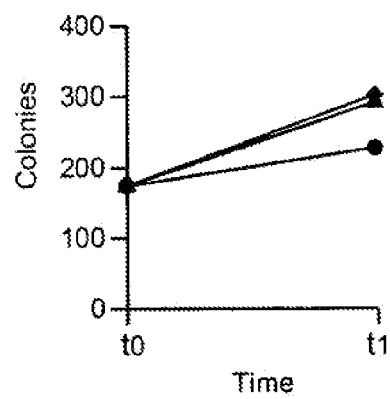
Figure 7A:
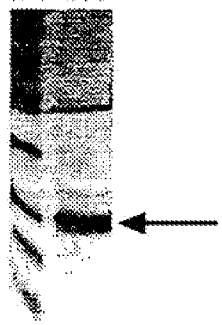
Figure 7B:
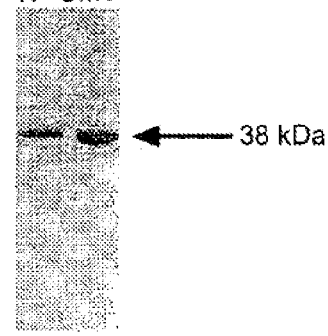
Figure 7C:
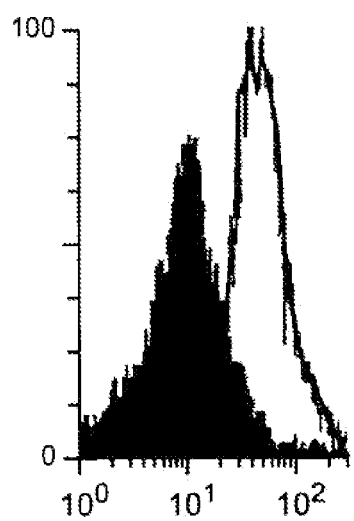
Figure 7D:
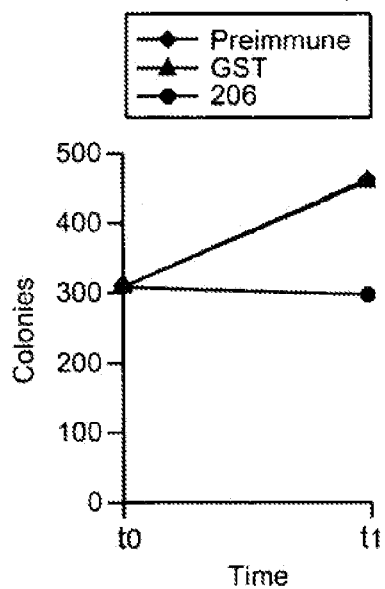

| | | |
|---|---|---|
| 2004/0110670 A1 | 6/2004 | Arico et al. |
| 2004/0167068 A1 | 8/2004 | Zlotnick et al. |
| 2005/0222385 A1 | 10/2005 | Pizza |
| 2006/0051840 A1 | 3/2006 | Arico et al. |
| 2006/0171957 A1 | 8/2006 | Pizza |
| 2006/0240045 A1 | 10/2006 | Berthet et al. |
| 2006/0251670 A1 | 11/2006 | Comanducci et al. |
| 2007/0026021 A1 | 2/2007 | Fraser et al. |
| 2007/0082014 A1 | 4/2007 | Costantino |
| 2007/0253984 A1 | 11/2007 | Khandke et al. |
| 2008/0241180 A1 | 10/2008 | Contorni |
| 2009/0285845 A1 | 11/2009 | Masignani et al. |
| 2010/0015151 A1 | 1/2010 | Rappuoli et al. |
| 2010/0267931 A1 | 10/2010 | Arico et al. |
| 2011/0020390 A1 | 1/2011 | Pizza et al. |
| 2012/0107339 A1 | 5/2012 | Granoff et al. |
| 2014/0037668 A1 | 2/2014 | Giuliani |
| 2014/0363462 A1 | 12/2014 | Arico et al. |
| 2015/0079124 A1 | 3/2015 | Fraser et al. |
| 2015/0086582 A1 | 3/2015 | Fraser et al. |

FOREIGN PATENT DOCUMENTS

| | | |
|---|---|---|
| EP | 1645631 A2 | 4/2006 |
| EP | 1790660 | 5/2007 |
| EP | 2351767 A2 | 8/2011 |
| JP | 01-144977 A | 6/1989 |
| WO | WO-92/13871 A1 | 8/1992 |
| WO | WO-94/08013 A1 | 4/1994 |
| WO | WO-96/01901 A1 | 1/1996 |
| WO | WO-96/29412 A1 | 9/1996 |
| WO | WO-96/33276 A1 | 10/1996 |
| WO | WO-97/37044 A1 | 10/1997 |
| WO | WO-98/17805 | 4/1998 |
| WO | WO-99/57280 A | 11/1999 |
| WO | WO-00/22430 A2 | 4/2000 |
| WO | WO-00/66791 | 11/2000 |
| WO | WO-01/31019 | 5/2001 |
| WO | WO-01/52885 | 7/2001 |
| WO | WO-01/64920 A | 9/2001 |
| WO | WO-01/64922 A2 | 9/2001 |
| WO | WO-03/009869 A1 | 2/2003 |
| WO | WO-03/020756 A | 3/2003 |
| WO | WO-03/063766 | 8/2003 |
| WO | WO-2004/032958 A1 | 4/2004 |
| WO | WO-2004/048404 | 6/2004 |
| WO | WO-2004/065603 A2 | 8/2004 |
| WO | WO-2004/094596 A2 | 11/2004 |
| WO | WO-2006/024954 A2 | 3/2006 |
| WO | WO-2006/081259 | 8/2006 |
| WO | WO-2007/060548 A2 | 5/2007 |
| WO | WO-2007/127665 A2 | 11/2007 |
| WO | WO-2008/125985 A2 | 10/2008 |
| WO | WO-2008/149238 A2 | 12/2008 |
| WO | WO-2009/104097 A2 | 8/2009 |
| WO | WO-2010/028859 A1 | 3/2010 |
| WO | WO-2010/046715 A1 | 4/2010 |

OTHER PUBLICATIONS

Zollinger et al. Infect. Immun. 40: 257-264, 1983.*
Griffiss et al. J. Biol. Chem. 275: 2716-2724, Mar. 31, 2000.*
1997-11-17-NM_shotgun.dbs and 1997-12-15-NM.dbs, located at <ftp://ftp.sanger.ac.uk/pub/pathogens/nm/old data/>.
Baumler, A. J. et al. (1993). "Hypothetical 29.6 kD Protein in PCP 5' Region (ORF1)," Database Swissprot AC P31485.
Baumler, A. J. and K. Hantke (1992). "A Lipoprotein of Yersinia enterocolitica Facilitates Ferrioxamine Uptake in Escherichia coli," Journal of Bacteriology 174(3):1029-1035.
Beernink et al (Jul. 2006). "Rapid Genetic Grouping of Factor H-Binding Protein (Genome-Derived Neisserial Antigen 1870), a Promising Group B Meningococcal Vaccine Candidate," Clinical and Vaccine Immunology 13(7):758-763.
Beernink et al. (Jun. 2008). "Bactericidal antibody responses, induced by meningococcal recombinant chimeric factor H-binding protein vaccines," Infection and Immunity 76(6):2568-2575.
Beernink et al. (Sep. 2008). "Fine antigenic specificity and cooperative bactericidal activity of monoclonal antibodies directed at the meningococcal vaccine candidate factor h-binding protein," Infection and Immunity 76(9):4232-4240.
Bernfield L. et al. (Sep. 2002). "Identification of a novel vaccine candidate for group B Neisseria meningitidis," Thirteenth International Pathogenic Neisseria Conference, Norwegian Institute of Public Health, Oslo, Norway, pp. 116 and 124.
Blake et al. (1995). "Vaccines for Gonorrhoea: Where are We on the Curve?" Trends in Microbiology 3(12):469-474.
Boslego et al. (1991). "Gonorrhea Vaccines," Chapter 17 in Vaccines and Immunotherapy, Cryz S.J. (Ed.), Pergamon Press: New York, NY, pp. 211-223.
Burland, V. et al. (1994). "Escherichia coli K-12 Chromosomal Region From 92.8 to 00.1 Minutes," Database Emprol AC U14003.
Campbell AM (1984). Monoclonal Antibody Technology. Elsevier Science Publishers, The Netherlands, Chapter 1, pp. 1-32.
Cannon (1989). "Conserved Lipoproteins of Pathogenic Neisseria Species Bearing the H.8 Epitope: Lipid-Modified Azurin and H.8 Outer Membrane Protein," Clinical Microbiology Reviews 2 (Suppl.):S1-S4.
Cantini et al. (Mar. 2006). "Solution Structure of the Immunodominant Domain of Protective Antigen GNA 1870 of Neisseria meningitidis," Journal of Biological Chemistry 281(11):7220-7227.
Conlin, C. A. et al. (1992). "Escherichia coli prlC Encodes an Endopeptidase and is Homologous to the Salmonella typhimurium opdA Gene," Journal of Bacteriology 174(18): 5881-5997.
Cowdery et al., (1996) "Bacterial DNA Induces NK Cells to Produce IFN-y In Vivo and Increases the Toxicity of Lipopolysaccharides," J. Immunol. 156:4570-4575.
Cox et al, "Adjuvants—a classification and review of their modes of action" Vaccine, 1997, 15(3):248-256.
Cruse et al. (2003). Illustrated Dictionary of Immunology, 2nd Ed. CRC Press, pp. 46, 166, and 382.
Database accession No. NMB1994 (cf. XP2231040) (Tettelin et al.), uploaded Oct. 1, 2000.
Davis et al., (1998) "CpG DNA Is a Potent Enhancer of Specific Immunity in Mice Immunized with Recombinant Hepatitis B Surtace Antigen," J. Immunol, 160:870-876.
Declaration by Dr. Julian Parkhill dated Jun. 12, 2008, submitted in opposition proceedings for EP1645631, 2 pages.
Dempsey J.A. et al. (Nov. 1995). "The physical map of the chromosome of a serogroup A strain of Neisseria meningitidis shows complex rearrangement relative to the chromosomes of the two mapped strains of the closely related species N. gonorrhoeae," Journal of Bacteriology 177(22):6390-6400.
Dillard, J. P. et al. (1997) "A Peptidoglcan Hydrolase Similar to Bacteriophage Endolysins Acts as an Autolysin in Neisseria gonorrhoeae," Molecular Microbiology 25(5):893-907.
Farley J. et al. (Sep. 2002). "Characterization, cloning and expression of different subfamilies of the ORF 2086 gene from Neisseria meningitidis," Thirteenth International Pathogenic Neisseria Conference, Norwegian Institute of Public Health, Oslo, Norway, p. 124.
Feavers et al. (2009). "Meningococcal protein antigens and vaccines," Vaccine 275:B42-B50.
Fleischmann et al. (1995). "Whole-Genome Random Sequencing and Assembly of Haemophilus influenzae Rd," Science 269:496-501.
Fleischmann, R. D. et al. (1995). "Hypothetical Protein HI0753," Database Swissprot AC P44861.
Fleischmann, R. D. et al. (1995). "Oligopeptidase A (EC 3.4.24.70)," Database Swissprot AC P44573.
Fletcher et al. (2004). "Vaccine Potential of the Neisseria meningitidis 2086 Lipoprotein," Infection and Immunity 72(4): 2088-2100.
Fontana et al. (2002). A genomic approach Abstract from the 13th International Pathogenic Neisseria Conference, Oslo, Norway, Sep. 1-6, 2002. p. 248.
Giuliani et al. (2006). "A universal vaccine for serogroup B meningococcus," PNAS 103(29):10834-10839.

(56) References Cited

OTHER PUBLICATIONS

Giuliani et al. (Feb. 2005). "The Region Comprising Amino Acids 100 to 255 of *Neisseria meningitidis* Lipoprotein GNA 1870 Elicits Bactericidal Antibodies," Infection and Immunity 73(2): 1151-1160.
Hacker, J. et al. (1993). "Immunophilins: structure-function relationship and possible role in microbial pathogenicity," Molecular Microbiology 10(3):445-456.
Hou et al. (2005) "Protective antibody responses elicited by a meningococcal outer membrane vesicle vaccine with overexpressed genome-derived neisserial antigen 1870," J Infect Dis 192(4):580-90.
Houghten et al. (1986) *New Approaches to Immunization*, Vaccines 86, Cold Spring Harbor Laboratory, p. 21-25.
Huang, M. et al. (1995). "A Stomatin-Like Protein Necessary for Mechanosensation in *C. Elegans*," Nature 378(6554):292-295.
Jacobsson et al. (2009). "Prevalence and sequence variations of the genes encoding the five antigens included in the novel 5CVMB vaccine covering group B meningococcal disease" Vaccine. 27:1579-1584.
JCVI-CMR website showing Z2491 Sanger sequence (http://cmr.jcvi.org/tigr-scripts/CMR/shared/Genomes.cgi and links). (2010).
Jiang et al., (2010) "Broad vaccine coverage predicted for a bivalent recombinant factor H binding protein based vaccine to prevent serogroup B meningococcal disease" Vaccine 28:6086-6093.
Koeberling et al. (2007). "Improved immunogenicity of a H44/76 group B outer membrane vesicle vaccine with over-expressed genome-derived Neisserial antigen 1870," Vaccine 25(10):1912-1920.
Kohara Y. (Aug. 12, 1994). "*Caenorhabditis elegans* cDNA clone yk26f2: 5' end, single read," Database accession No. D35881. Database EMBL [Online] EBI.
Lawrence, E. (1997). Henderson's Dictionary of Biological Terms, Eleventh Edition (1997). Longman Ltd. Defintion of "epitope," Cover pages, Table of Contents, and pp. 37 and 184.
Lommatzsch et al. (1997). "Outer membrane localization of murein hydrolases: MltA, a third lipoprotein lytic transglycosylase in *Escherichia coli*," Journal of Bacteriology 179(17):5465-5470.
Lucidarme et al., (Sep. 16, 2009) "Characterization of fHbp, nhba (gna2132), nadA, porA, sequence type (ST), and genomic presence of IS1301 in group B meningococcal ST269 clonal complex isolates from England and Wales" Journal of Clinical Microbiology, 47(11):3577-85.
Lucidarme et al., 2010 "Characterization of fHbp, nhba (gna2132), nadA, porA, and sequence type in group B meningococcal case isolates collected in England and Wales during Jan. 2008 and potential coverage of an investigational group B meningococcal vaccine" Clinical and Vaccine Immunology 17(6):919-929.
Masignani V. (Mar. 17, 2003). "Vaccination against *Neisseria meningitidis* using three variants of the lipoprotein GNA1870," J. Exp. Med. 197(6):789-799.
McAllister, C. F. and D. S. Stephens. (1993). "Analysis in *Neisseria meningitidis* and other *Neisseria* species of genes homologous to the FKBP immunophilin family," Molecular Microbiology 10(1)13-23.
McAllister, C. F. et al. (1993). "*Neisseria elongata* NRL FKBP Immunophilin Homolog Gene," Database Empro2 AC U001198.
McGuinness et al. (Mar. 1991). "Point mutation in meningococcal porA gene associated with increased endemic disease," Lancet 337:514-517.
Morley, S. et al. (Dec. 12, 2001). "Vaccine prevention of meningococcal disease, coming soon?" Vaccine 20(5-6):666-687.
Murphy et al., (2009) "Sequence diversity of the factor H binding protein vaccine candidate in epidemiologically relevant strains of serogroup B *Neisseria meningitidis*" J Infect Dis 200:379-389.
Nassif (2000). "A Furtive Pathogen Revealed," Science 287:1767-1768.
Notice of Opposition against European Patent EP 1645631, granted on Oct. 24, 2007. Opposition filed on Jul. 23, 2008. 20 pages.
Novartis (Oct. 9, 2008) "New Phase II data show Novartis investigational Meningitis B vaccine may also protect infants six months and older," Media Release, 4 pages.

Pajon et al., "Frequency of factor H-binding protein modular groups and susceptibility to cross-reactive bactericidal activity in invasive meningococcal isolates" Vaccine 28 (2010):2122-2129.
Parkhill, J. et al. (Mar. 2000). "Complete DNA Sequence of a Serogroup A Strain of *Neisseria meningitides* Z2491," Nature 404:502-505.
Parkhill, "*Campylobacter jejuni* genome sequence as the Sanger Centre," Post on BIOSCI/Bionet of May 8, 1998.
Patentees' Response to Opposition against European Patent EP 1645631, granted on Oct. 24, 2007. 13 pages.
Pizza et al. (2000). "Identification of Vaccine Candidates Against Serogroup B Meningococcus by Whole-Genome Sequencing," Science 287(5459):1816-1820.
Pizza et al. (2008) "Factor H-binding protein, a unique meningococcal vaccine antigen" Vaccine 26S:I46-8.
Poolman. (1995). "Development of a Meningococcal Vaccine," Infectious Agents and Disease 4:13-28.
Progress through the Sanger Institute FTP server (May 12, 2009), 15 pages.
PSORT analysis of 200 of the sequences disclosed in PCT/US99/09346 (Jan. 1, 2010), 209 pages.
PSORT analysis of SEQ ID Nos. 4 and 6, and of 'Contig295' 300mer (May 8, 2009), 5 pages.
PSORT prediction result for SEQ ID No. 2 (Mar. 30, 2010), 1 page.
Response to Communication, filed in EP Application No. 07075161.5. Oct. 28, 2009.
Richard, M.E. (Oct. 25, 1997). "Applications of molecular microbiology to vaccinology," Lancet (North American Edition) 350(9086):1240-1244.
Rinaudo et al. (2009). "Vaccinology in the genome era", The Journal of Clinical Investigation, 119(9):2515-2525.
Rudinger et al. (Jun. 1976). Peptide Hormones. (Ed) JA Parsons, University Park Press. pp. 5-7.
Sambrook et al. (1989). Molecular Cloning, A Laboratory Manual. Second Edition, Cold Spring Harbor, pp. 17.1-17.44.
Sampson, B. and E. C. Gotschlich. (1992). "*Neisseria meningitidis* encodes an FK506-inhibitable rotamase," Proc. Natl. Acad. Sci. USA 89(4): 1164-1168.
Sanger Centre's "Projects" website as of Dec. 10, 1997 as retrievable via http://web.archive.org.
Scarselli et al. (Feb. 13, 2009). "Epitope Mapping of a Bactericidal Monoclonal Antibody against the Factor H Binding Protein of *Neisseria meningitides*," Journal of Molecular Biology 386(1):97-108.
Schneider et al. (Apr. 16, 2009) "*Neisseria meningitidis* recruits factor H using protein mimicry of host carbohydrates," Nature 458(7240):890-893.
Sequence for "Putative Lipoprotein [*Neisseria meningitidis* Z2491]," NCBI Reference Sequence: YP_002342062.1, Mar. 30, 2000.
Serruto et al. (2009). "Genome-based approaches to develop vaccines against bacterial pathogens," Vaccine 27:3245-3250.
Smith C.J. et al. (1995). "Nucleotide sequence determination and genetic analysis of the Bacteroides plasmid, pBI143," Plasmid 34(3):211-222.
Supplemental Submissions in Opposition against European Patent EP 1645631, granted on Oct. 24, 2007. Opposition filed on May 25, 2010. 28 pages.
Supplementary Declaration by Dr. Julian Parkhill, dated May 10, 2010, submitted in opposition proceedings for EP1645631, 4 pages.
Telford et al. (2003). "Genomic and Proteomics in Vaccine Design", in New Bacterial Vaccines, edited by Ellis et al. Kleweur Academic/Plenum Publishers, USA. pp. 1-11.
Tettelin H et al. (Mar. 10, 2000). "Complete genome sequence of *Neisseria meningitidis* serogroup B strain MC58," Science 287(5459):789-799.
The printed output from the NCBI open reading frame finder (Oct. 20, 2008), 12 pages.
United States Office Action mailed on Feb. 11, 2009, for U.S. Appl. No. 10/181,600, filed Jan. 17, 2001, 5 pages.
United States Office Action mailed on Jul. 24, 2008, for U.S. Appl. No. 10/181,600, filed Jan. 17, 2001, 23 pages.
United States Office Action mailed on Jul. 7, 2009, for U.S. Appl. No. 10/181,600, filed Jan. 17, 2001, 23 pages.

(56) References Cited

OTHER PUBLICATIONS

U.S. Appl. No. 60/098,685, "*Neisseria* Spp, Polypeptide, Gene Sequence and Uses Thereof," filed Sep. 1, 1998.
Welsch et al. (2004). "Protective Activity of Monclonal Antibodies to Genome-Derived Neisserial Antigen 1870, a *Neisseria meningitidis* Candidate Vaccine," The Journal of Immunology 172: 5606-5615.
Welsch et al. (Oct. 30, 2006) "A novel mechanism for complement-mediated killing of encapsulated *Neisseria meningitidis* elicited by monoclonal antibodies to factor H-binding protein (genome-derived Neisserial antigen 1870)" Molecular Immunology 44(1-3):256.
Welsch et al. (Apr. 1, 2008). "Complement-dependent synergistic bactericidal activity of antibodies against factor H-binding protein, a sparsely distributed meningococcal vaccine antigen," J Infect Dis 197(7):1053-1061.
Wong, C. Y. et al. (1997). "Cloning and characterization of two immunophilin-like genes, ilpA and fkpA, on a single 3.9-kilobase fragment of *Aeromonas hydrophila* genomic DNA," Journal of Bacteriology 179(11): 3397-3403.
You, Z. et al. (1997). "Rhizobium Etli Stomatin like Protein (slp) gene, complete cds.," Database Empro1 AC AF034831.
You, Z. et al. (1998). "A Stomatin-Like Protein Encoded by the slp Gene of Rhizobium Etli is Required for Nodulation Competitiveness on the Common Bean," Microbiology 144(9): 2619-2627.
Zhu et al. (2005) "Evaluation of recombinant lipidated P2086 protein as a vaccine candidate for group B *Neisseria meningitidis* in a murine nasal challenge model," Infect Immun 73(10):6838-45.
Zollinger (1997). "New and Improved Vaccines Against Meningococcal Disease" in *New Generation Vaccines*, 2nd Ed., edited by Levine et al., Marcel Dekker, New York. pp. 469-488.
Beernick (Jul. 2010) "Impaired immungenicity of a meningococcal factor H-binding protein vaccine engineered to eliminate factor h binding," Clin Vac Immunol 17(7):1074-1078.
Granoff, DM. (2009). Relative importance of complement-mediated bactericidal and opsonic activity for protection against meningococcal disease. Vaccine 27(Supplement 2): B117-B125.
Adams (1996). "Should Non-Peer-Reviewed Raw DNA Sequence Data Release Be Forced on the Scientific Community?," Science, 274: 534-536.
Aderson et al. (2010). "Effectiveness of a bivalent factor H binding protein vaccine across *Neisseria meningitidis* serogroups," 17th International Pathogenic *Neisseria* Conference 2010, p. 196.
Ala'Aldeen et al. (2010) "Human antibody response to the meningococcal factor H binding protein (LP2086) during invasive disease, colonization and carriage," Vaccine 28:7667-75.
Ambrose et al. (2006). "Characterization of LP2086 expression in *Neisseria meningitidis*," 15th International Pathogenic *Neisseria* Conference 2006, p. 103.
Anderson et al. (2008). "Functional cross-reactive antibodies are elicited by a group B *Neisseria meningitidis* bivalent recombinant lipidated LP2086 vaccine in cynomolgusmacaques," 16th International Pathogenic *Neisseria* Conference (IPNC) P100, pp. 170-171.
Anderson et al. (2009). "Development of a factor H binding protein vaccine for borad protection against invasive *Neisseria meningitidis* serogroup B (MnB) disease," 10th European Meningococcal Disease Society Congress 2009, p. 39.
Anderson et al. (2009). "Epidemiology of the serogroup B *Neisseria meningitidis* (MnB) factor H binding protein and implications for vaccine development," European Society for Paediatric Infectious Disease Symposium 2009, p. 505.
Anderson et al. (2012). "Potential impact of the bivalent rLP2086 vaccine on *Neisseria meningitidis* invasive disease and carriage isolates in two adolescent populations," European Society for Paediatric Infectious Disease Symposium 2012, p. 807.
Anderson et al. (2013) "Potential impact of the bivalent rLP2086 vaccine on *Neisseria meningitidis* carriage and invasive serogroup B disease," Hum Vacc Immunotherap 9:471-9.
Appendix I to Statement of Grounds of Appeal filed by df-mp on Sep. 28, 2012, in relation to EP1645631, 1 pages.
Appendix II to Statement of Grounds of Appeal filed by df-mp on Sep. 28, 2012, in relation to EP1645631, 2 pages.

BenMohamed et al. (2002). "Lipopeptide vaccines-yesterday, today, and tomorrow," Lancet 2(7):425-431.
Bentley et al. (2004). Identification of two immunologically distinct domains on the LP2086 outer membrane lipoprotein of *Neisseria meningitidis*, 14th International Pathogenic Neisseria Conference 2004, p. 144.
Biswas et al. (1995). "Characterization of IbpA, the structural gene for a lactoferrin receptor in *Neisseria gonorrhoeae*," Infection and Immunity, 63(8): 2958-2967.
Blattner et al. (1997). "The complete genome sequence of *Escherichia coli* K-12," Science 277 (5331): 1453-1474.
Bouvier et al. (1991). "A gene for a new lipoprotein in the dapA-purC interval of the *Escherichia coli* chromosome," J Bacteriol 173(17):5523-5531.
Chen, et al. (1994). "Determination of the optimal aligned spacing between the Shine-Dalgarno sequence and the translation initiation codon of *Escherichia coli* mRNAs," Nucleic Acids Res. 22(23):4953-4957.
Clinical Trial No. NCT00500032, (2007). "Blood collection for use in serological assay development from healthy adult volunteers," U.S. National Institutes of Health, retrieved online at <http://clinicaltrials.gov/ct2/show/NCT00500032?term=NCT00500032&rank=1>.
Clinical Trial No. NCT00808028, (2008). "A study evaluating safety and immunogenicity of meningococcal B rlp2086 vaccine in adolescents," U.S. National Institutes of Health, retrieved online at <http://clinicaltrials.gov/ct2/show/NCT00808028?term=NCT00808028&rank=1>.
Cohn et al. (2010). "Potential Impact of Serogroup B Vaccines: Prevalence of candidate vaccine antigens among invasive *Neisseria meningitidis* isolates in the United States," 17th International Pathogenic *Neisseria* Conference 2010, p. 77.
CORDIS, "Preparation of meningococcal antigens," posted online on Feb. 2, 2005, 2 pages.
Database UniProt (Oct. 1, 2000), "SubName: Full=Uncharacterized protein" retrieved from EBI, accession No. Q9JXV4 Database accession No. Q9JXV4.
Decision revoking the European Patent, filed in opposition against EP1976990, dated Nov. 11, 2013, 15 pages.
Decision to refuse a patent application, filed in the Opposition against EP1645631, dated Apr. 28, 2009, 7 pages.
Declaration by Dr. Ellen Murphy, Ph.D., dated Sep. 14, 2011, submitted in opposition proceedings for EP1645631, 4 pages.
Declaration by Dr. Julian Parkhill, filed in the Opposition against EP1645631, dated Jul. 10, 2014, 5 pages.
Declaration by E. Richard Moxon dated Feb. 16, 2013, submitted in opposition proceedings for EP1645631, 5 pages.
Declaration by Ellen Murphy, filed in the Opposition against EP1645631, dated May 12, 2014, 3 pages.
Declaration by Emilio A. Emini, Ph.D., dated Nov. 2, 2011, submitted in opposition proceedings for EP1645631, 5 pages.
Declaration by Isabel Delany, dated Feb. 18, 2013, submitted in opposition proceedings for EP1645631, 5 pages.
Declaration by Prof. Paul Dunman, Ph.D., dated Sep. 25, 2012, submitted in opposition proceedings for EP1645631, 14 pages.
Declaration by Rino Rappuoli, dated Oct. 13, 2011, submitted in opposition proceedings for EP1645631, 5 pages.
Declaration by Vega Masignani dated Feb. 18, 2013, submitted in opposition proceedings for EP1645631, 4 pages.
Delgado et al. (2007). "Lipoprotein NMB0928 from *Neisseria meningitidis* serogroup B as a novel vaccine candidate," Vaccine 25:8420-8431.
Dinthilhac and Claverys (1997). "The adc locus, which affects competence for genetic transformation in *Streptococcus pneumoniae*, encodes an ABC transporter with a putative lipoprotein homologue to a family of streptococcal adhesins," Res Microbiol 148:119-131.
Dlawer et al. (2010). "Human antibody responses to the meningococcal factor H binding protein LP2086 during invasive disease," 17th International Pathogenic *Neisseria* Conference 2010, p. 130.
Elzanowski et al. (2013). "The Genetic Codes, a compilation," Retrived from http://www.bioinformatics.org/JaMBW/2/3/TranslationTables.html.

(56) References Cited

OTHER PUBLICATIONS

Experimental data: expression of NspA, '287' and '741' on 3 strains of bacteria, filed in opposition against EP1534326, dated Aug. 4, 2010. 2 pages.

Facts and Submissions dated May 21, 2012, in relation to EP1645631, 30 pages.

Fraser et al. (1997). "Genomic sequence of a lyme disease spirochaete, *Borrelia burgdorferi*," Nature 390:580-586.

Fraser et al. (1998). "Complete genome sequence of *Treponema pallidum*, the syphilis spirochete," Science 281:375-388.

Gene Browser, Nature Technology Corporation, filed in the Opposition against EP1645631, dated Jun. 26, 2013, 6 pages.

GenPept accession No. AAF42204, "hypothetical protein NMB1870 [*Neisseria meningitidis* MC58]," retrieved on Sep. 26, 2012, 2 pages.

Giuliani et al. (2010). "Measuring antigen-specific bactericidal responses to a multicomponent vaccine against serogroup B meningococcus," Vaccine 28:5023-5030.

Gold and Stormo (1987). "Translation Initiation", in *Escherichia* con and *Salmonella typhimurium*, Cellular and Molecular Biology, Ed. Neidhardt, pp. 1302-1307.

Gorringe et al. (2009). "16th International Pathogenic *Neisseria* Conference: recent progress towards effective meningococcal disease vaccines," Human Vaccines 5(2):53-56.

Grandi (2005). "Reverse vaccinology: a critical analysis," in Encyclopedia of Genetics, Genomics, Proteomics and Bioinformatics, pp. 1322-1326.

Harris et al. (2008). "Development and qualification of serum bactericidal assays for *Neisseria meningitidis* serogroup B," 16th International Pathogenic *Neisseria* Conference 2008, p. 268-269.

Harris et al. (2010). "Robustness of the Serum Bactericidal Activity (SBA) Assay for *Neisseria meningitidis* serogroup B," 17th International Pathogenic *Neisseria* Conference 2010, p. 169.

Harris et al. (2011) "Preclinical evidence for the potential of a bivalent fHBP vaccine to prevent *Neisseria meningitidis* serogroup C disease," Human Vaccines 7:1 (suppl) 1-7.

Hayashi and Wu, "Identification and characterization of lipid-modified proteins in bacteria," Chapter 10 in Lipid Modifications of Proteins: A Practical Approach, Hooper and Turner (eds.), published in 1992, 27 pages.

Hem et al. (1995). "Structure and properties of aluminum-containing adjuvants," Vaccine Design. Subunit and Adjuvant Approach, pp. 249-276.

Hodge et al. (2006). "Development of a luminex-based meningococcal rLP2086-specific human IgG assay," 15th International Pathogenic *Neisseria* Conference 2006, p. 113.

Hoiseth et al. (2008). "LP2086 and MLST distribution in epidemiologically relevant strains of serogroup B *Neisseria meningitidis*," 16th International Pathogenic *Neisseria* Conference 2008, p. 205.

Holst et al. (2014). "Variability of genes encoding surface proteins used as vaccine antigens in meningococcal endemic and epidemic strain panels from Norway," Vaccine 32:2722-2731.

Hung et al. (2011). "The *Neisseria meningitidis* macrophage infectivity potentiator protein induces cross-strain serum bactericidal sctivity and is a potential serogroup B vaccine candidate," Infect Immun 79(9):3784-3791.

Interlocutory decision in opposition proceedings, filed in the Opposition against EP1645631, dated May 21, 2012, 82 pages.

Jansen et al. (2008). "Bivalent recombinant LP2086 vaccine to provide broad protection against *Neisseria meningitidis* B disease: immunological correlates of protection and how to assess coverage against invasive MnB strains," 16th International Pathogenic *Neisseria* Conference 2008, p. 80-81.

Jansen et al. (2009). "Development of a bivalent factor H binding protein vaccine to broadly protect against invasive *Neisseria meningitides* serogroup B (MnB) disease," European Society for Paediatric Infectious Disease Symposium 2009, p. 311.

Jansen et al. (2010). "Estimating effectiveness for *Neisseria meningitidis* serogroup B (MnB) vaccine candidates composed of non-serogroup specific antigens," 17th International Pathogenic *Neisseria* Conference 2010, p. 37.

Jansen et al. (2011). "Monitoring the Breadth of Coverage of Meningococcal Vaccines: An Overview and Progress Update on the Pfizer Bivalent LP2086 Vaccine Program," 14th Annual Conference on Vaccine Research, 2011, p. 74.

Jiang et al. (2003). "Using rate of acid neutralization to characterize aluminum phosphate adjuvant," Pharma Dev Tech 8(4):349-356.

Jiang et al. (2006). "Serum IgG response induced by a bivalent recombinant LP2086 provides broad protection against serogroup B *Neisseria meningitidis*," 15th International Pathogenic *Neisseria* Conference 2006, p. 113.

Jiang et al. (2008). "Prediction of broad vaccine coverage for a bivalent rLP2086 based vaccine which elicits serum bactericidal activity against a diverse collection of serogroup B meningococci," 16th International Pathogenic *Neisseria* Conference 2008, p. 57-58.

Johnson et al. (1999). "Analysis of the human Ig isotype response to lactoferrin binding protein A from *Neisseria meningitidis*," FEMS Immun. Med. Microbial. 25(4): 349-354.

Jones et al. (2009). "Generation of human serum complement lots that perform consistently for use in *Neisseria meningitidis* serogroup B (MnB) vaccine clinical trials," European Society for Paediatric Infectious Disease Symposium 2009, p. 566.

Juncker et al. (2003). "Prediction of lipoprotein signal peptides in gram-negative bacteria," Protein Sci 12:1652-1662.

Koeberling et al. (2008). "Bactericidal antibody responses elicited by a meningococcal outer membrane vesicle vaccine with overexpressed factor H-binding protein and genetically attenuated endotoxin," J. Infect. Dis., 198(2):262-270.

Koeberling et al. (2009). "Meningococcal outer membrane vesicle vaccines derived from mutant strains engineered to express factor H binding proteins from antigenic variant groups 1 and 2," Clin Vac Immunol, 16(2):156-162.

Kovacs-Simon et al. (2011). "Lipoproteins of Bacterial Pathogens," Infect Immun 79(2):548-561.

Lewis et al. (2010). "The meningococcal vaccine candidate neisserial surface protein a (NspA) binds to factor H and enhances meningococcal resistance to complement," PLoS Pathogens 6(7):e1001027.

Liebl et al. (1997). "Properties and gene structure of the *Thermotoga maritima* alpha-amylase AmyA, a putative lipoprotein of a hyperthermophilic bacterium," J Bacteriol 179(3):941-948.

Liechti et al. (2012). "Outer membrane biogenesis in *Escherichia coli*, *Neisseria meningitidis*, and *Helicobacter pylori*: paradigm deviations in *H. pylori*," Front Cell and Infect Microbiol 2:article 29.

Lindblad, (2004). "Aluminium compounds for use in vaccines," Immunol Cell Biol.,82(5):497-505.

Madico et al. (2006). "The meningococcal vaccine candidate GNA1870 binds the complement regulatory protein factor H and enhances serum resistance," J Immunol 177(1):501-510.

Cole et al. (1998). "Deciphering the biology of *Mycobacterium tuberculosis* from the complete genome sequence," Nature 394:651-653.

Marshall et al. (2008). "A randomized, placebo-controlled, double-blind, phase 1 trial of ascending doses of meningococcal group B rLP2086 vaccine in healthy adults," 16th International Pathogenic Neisseria Conference 2008, p. 271-272.

Marshall et al. (2011). "Phase I randomised controlled clinical trial of safety and immunogenicity of a meningococcal B bivalent LP2086 vaccine in healthy toddlers," European Society for Paediatric Infectious Disease Symposium 2011, p. 189.

Marshall et al. (2012) "Safety and immunogenicity of a meningococcal B bivalent rLP2086 vaccine in healthy toddlers aged 18-36 months: A phase 1 randomized-controlled clinical trial," Ped Infect Dis J 31:1061-8.

Marshall et al. (2013) "A phase 2 open-label safety and immunogenicity study of a meningococcal B bivalent rLP2086 vaccine in healthy adults," Vaccine 31:1569-75.

Mascioni et al. (2008). "Determination of the domain and solution structure of rLP2086, a meningococcal vaccine candidate and human factor H binding protein," 16th International Pathogenic *Neisseria* Conference 2008, p. 77-78.

Mascioni et al. (2009) "Structural basis for the immunogenic properties of the meningococcal vaccine candidate LP2086," J Biol Chem 284:8738-46.

(56) References Cited

OTHER PUBLICATIONS

Mascioni et al. (2010) "NMR dynamics and antibody recognition of the meningococcal lipidated outer membrane protein LP2086 in micellar solution," Biochim Biophys Acta 1798:87-93.
McNeil et al. (2009) "Detection of LP2086 on the cell surface of *Neisseria meningitidis* and its accessibility in the presence of serogroup B capsular polysaccharide," Vaccine 27:3417-21.
McNeil et al. (2010). "Anti-fHBP antibodies elicited after immunization with a recombinant fHBP vaccine candidate (rLP2086) can displace human Factor H from the surface of Serogroup B Meningococci," 17th International Pathogenic *Neisseria* Conference 2010, p. 94.
McNeil et al. (2013) "Role of factor H binding protein in *Neisseria meningitidis* virulence and its potential as a vaccine candidate to broadly protect against meningococcal disease," Microbiol Mol Biol Rev 77:234.
Meyer et al. (1984). "Pilus genes of *Neisseria gonorrheae*: Chromosomal organization and DNA sequence," Proc. Nail. Acad. Sci. USA 81: 6110-6114.
Milagres et al. (1998). "Specificity of bactericidal antibody response to serogroup B meningococcal strains in Brazilian children after immunization with an outer membrane vaccine," Infection and Immun. 66(10): 4755-4781.
Minutes of the oral proceedings, filed in the Opposition against EP1645631, dated Feb. 11, 2014, 4 pages.
Munkley, et al. (1991). "Blocking of bactericidal killing of *Neisseria meningitidis* by antibodies directed against slacc 4 outer membrane proteins," Microbial Pathogenesis 11: 447-452.
Murphy et al. (2008). "Sequence diversity of vaccine candidate LP2086 in *Neisseria meningitidis* serogroup B strains causing invasive disease," 16th International Pathogenic *Neisseria* Conference 2008, p. 61.
Murphy et al. (2010). "Prevalence of Factor H Binding Protein (fHBP) Variants in *N. meningitidis* Carriage Isolates," 17th International Pathogenic *Neisseria* Conference 2010, p. 96.
Notice of Opposition against EP 1562983, filed on Jul. 1, 2014, 23 pages.
Notice of Opposition against EP1645631, filed in the Opposition against EP1645631, dated Jul. 23, 2008, 25 pages.
Notice of Opposition filed May 24, 2012, filed in opposition against EP1976990, 19 pages.
Novartis (Jan. 22, 2013) "Novartis receives EU approval for Bexsero®, first vaccine to prevent the leading cause of life-threatening meningitis across Europe," Media Release, 3 pages.
Novartis (Jun. 9, 2011). "Novartis candidate vaccine Bexsero® shows significant potential in providing broad coverage against meningococcal serogroup B infections." Media Release, 6 pages.
Opponent's Further Submission in Preparation of the Oral Proceedings, filed in the Opposition against EP1645631, dated Nov. 3, 2011, 6 pages.
Opponent's Response to the Patentee's Submission dated Feb. 18, 2013, filed in the Opposition against EP1645631, dated Jul. 24 2014, 34 pages.
Opponents Final Written Submission in Preparation of Oral Proceedings, filed in the Opposition against EP1645631, dated Sep. 14, 2011, 28 pages.
ORF Finder (2013). "Bacterial Code," Retrieved from http://www.ncbi.nlm.nih.gov/gorf/gorf.html, 3 pages.
Pajon et al. (2012). "Design of meningococcal factor H binding protein mutant vaccines that do not bind human complement factor H," Infect Immun 80:2667-2677.
Patentee's Submissions under Rule 116 EPC, filed in the Opposition against EP1645631, dated Sep. 13, 2011, 13 pages.
Pettersson, et al. (2006). "Vaccine potential of the *Neisseria meningitidis* lactoferrin-binding proteins LbpA and LbpB," Vaccine 24(17):3545-3557.
Pillai et al. (2005) "Outer membrane protein (OMP) based vaccine for *Neisseria meningitidis* serogroup B," Vaccine 23(17-18):2206-2209.
Prosite, "ScanProsite Results Viewer: USERSEQ1 (280aa)," retrieved on Jun. 21, 2012, 1 page.
Pugsley (1993). "The complete general secretory pathway in gram-negative bacteria," Microbiological Rev 5(1):50-108.
Response to Appeal filed by Carpmaels & Ransford on Feb. 18, 2013, in relation to EP1645631, 21 pages.
Response to Appeal filed by df-mp on Feb. 18, 2013, in relation to EP1645631, 28 pages.
Richmond et al. (2008). "A randomized, observer-blinded, active control, phase 1 trial of meningococcal serogroup B rLP2086 vaccine in healthy children and adolescents aged 8 to 14 years," 16th International Pathogenic *Neisseria* Conference 2008, p. 270-271.
Richmond et al. (2010). "Safety & immunogenicity of serogroup B *Neisseria meningitidis* (MnB) rLP2086 vaccine in adults and adolescent subjects: overview of 3 clinical trials," 17th International Pathogenic *Neisseria* Conference 2010, p. 37.
Richmond et al. (2011). "Phase II randomised controlled trial of safety and immunogenicity of a meningococcal B bivalent vaccine (rLP2086) in healthy adolescents," European Society for Paediatric Infectious Disease Symposium 2011, p. 192.
Richmond et al. (2012) "A bivalent *Neisseria meningitidis* recombinant lipidated factor H binding protein vaccine in young adults: Results of a randomized, controlled, dose-escalation phase 1 trial," Vaccine 30(43):6163-74.
Richmond et al. (2012a) "Safety, immunogenicity, and tolerability of meningococcal serogroup B bivalent recombinant lipoprotein 2086 vaccine in healthy adolescents: a randomized, single-blind, placebo-controlled, phase 2 trial," Lancet Infect Dis 12:597-607.
Seeber et al. (1991). "Predicting the adsorption of proteins by aluminum-containing adjuvants," Vaccine 9(3):201-203.
Seib et al. (2010). "Influence of serogroup B meningococcal vaccine antigens on growth and survival of the mengococcus in vitro and in ex vivo and in vivo models of infection," Vaccine 28(12):2416-2427.
Seib et al. (2011). "Characterization of Diverse Subvariants of the Meningococcal Factor H (fH) Binding Protein for Their Ability to Bind fH, to Mediate Serum Resistance, and to Induce Bactericidal Antibodies," Infect Immun, 79(2):970-81.
Sheldon et al. (2011). "Phase 1, Randomized, Open-Label, Study to Assess the Safety and Immunogenicity of Serogroup B *Neisseria meningitidis* (Mnb) rLP2086 Vaccine in Healthy Adults," 14th Annual Conference on Vaccine Research, 2011, p. 59-60.
Sheldon et al. (2012) "A phase 1, randomized, open-label, active-controlled trial to assess the safety of a meningococcal serogroup B bivalent rLP2086 vaccine in healthy adults," Hum Vacc Immunotherap 8:1-8.
Shevchik et al. (1996). "Characterization of pectin methylesterase B, an outer membrane lipoprotein of *Erwinia chrysanthemi* 3937," Mole Microbiol 19(3):455-466.
Sprengart et al. (1997). "Functional importance of RNA interactions in selection of translation initiation codons," Molecular Microbilogy, 24(1): 19-28.
Statement of Grounds of Appeal filed by Carpmaels & Ransford on Oct. 1, 2012, in relation to EP1645631, 9 pages.
Statement of Grounds of Appeal filed by df-mp on Sep. 28, 2012, in relation to EP1645631, 54 pages.
Submission of the Patentee of Jul. 6, 2012, filed Jun. 24, 2014, in the Opposition against EP1645631, 4 pages.
Summons to oral proceedings pursuant to Rule 115(1) EPC, filed in the Opposition against EP1645631, dated Nov. 11, 2013, 12 pages.
Supplementary declaration by Ellen Murphy dated Sep. 26, 2012, submitted in opposition proceedings for EP1645631, 3 pages.
Supplementary declaration by Prof. Paul Dunman, Ph.D., dated Sep. 25, 2012, submitted in opposition proceedings for EP1645631, 14 pages.
Supplementary Submission to the Grounds of Appeal, filed in the Opposition against EP1645631, dated Sep. 28, 2012, 2 pages.
Sutcliffe and Russell (1995). "Lipoproteins of gram-positive bacteria," J Bacteriol 177(5):1123-1128.
Swaminathan (1996). "Molecular cloning of the three base restriction endonuclease R.CviJI from eukaryotic *Chlorella* virus IL-3A," Nucleic Acids Research, 24(13): 2463-2469.
Tan et al. (2010). "Advances in the development of vaccines against *Neisseria meningitidis*," NEJM 362(16):1511-1520.

(56) References Cited

OTHER PUBLICATIONS

TIGR Microbal Database, filed in the Opposition against EP1645631, dated Jun. 20, 2012, 14 pages.
TIGR website as of 1998, 8 pages.
U.S. Appl. No. 60/647,911, "GNA 1870-based vesicle vaccines for broad spectrum protection against diseases caused by *Neisseria meningitidis*," filed Jan. 27, 2005.
Vesikari et al. (2013). "Immunogenicity and safety of an investigational multicomponent, recombinant, meningococcal serogroup B vaccine (4CMenB) administered concomitantly with routine infant and child vaccinations: results of two randomized trials," Lancet 381:625-35.
von Heijne (1989). "The structure of signal peptides from bacterial lipoproteins," Protein Engineering 2(7):531-534.
Voulhoux and Tommassen (2002). "Transport of lipoproteins to the cell surfac in *Neisseria meningitidis*," 13th International Pathogenic *Neisseria* Conference 2002, p. 31.
Wang et al. (2010). "Prevalence and genetic diversity of candidate vaccine antigens among invasive *Neisseria meningitidis* isolates in the United States," 17th International Pathogenic *Neisseria* Conference 2010, p. 122.
Woods, et al. (1987). "Resistance to meningococcemia apparently conferred by anti-H.8 monoclonal antibody is due to contaminating endotoxin and not to specific immunoprotection," Infection and Immunity 55(8):1927-1928.
Written Submission to Oral Proceedings, filed in opposition against EP1976990, dated Jul. 24, 2013, 11 pages.
Wu et al. (1996). "A protein class database organized with ProSite protein groups and PIR superfamilies," J Comp Biol 3(4):547-561.
York et al. (2010). "fHBP epidemiology of invasive meningococcal B isolates from Spain and Germany: age based," 17th International Pathogenic *Neisseria* Conference 2010, p. 109.
Zhu et al. (2004). "Evaluation of the purified recombinant lipidated P2086 protein as a vaccine candidate for group B *Neisseria meningitidis* in a murine nasal challenge model," 14th International Pathogenic *Neisseria* Conference 2004, p. 199.
Zhu et al. (2006) "Intranasal immunization of mice with recombinant lipidated P2086 protein reduces nasal colonization of group B *Neisseria meningitidis*," Vaccine 24:5420-5.
Zhu et al. (2006). "Effective immunization strategy against group B *Neisseria meningitidis* using purified recombinant lipidated P2086 protein," 15th International Pathogenic *Neisseria* Conference 2006, p. 47.
Zlotnick et al. (2009). "Epidemiology of the serogroup B *Neisseria meningitidis* (MnB) factor H binding protein in strains sampled from Spain and Germany in the years 2001-2006," 10th European Meningococcal Disease Society Congress 2009, p. 81.
Zlotnick et al. (2010). "Biochemical and biophysical analysis indicates conformation plays an important role in the binding of hfH and antibodies to the fHBP of *N. meningitidis*," 17th International Pathogenic *Neisseria* Conference 2010, p. 38.
Zollinger et al. (2010). "Design and evaluation in mice of a broadly protective meningococcal group B native outer membrane vesicle vaccine," Vaccine, 28(31):5057-5067.
Baylor, et al., "Aluminum salts in vaccines—US perspective," 2002, Vaccine, pp. S18-S23, vol. 20.
Haines, et al., "Complement Factor H Variant Increases the Risk of Age-Related Macular Degeneration," Science, Apr. 2005, pp. 419-421, vol. 308.
Józsi, et al., "Factor H and Atypical Hemolytic Uremic Syndrome: Mutations in the C-Terminus Cause Structural Changes and Defective Recognition Functions," Journal of the American Society of Nephrology, 2006, pp. 170-177, vol. 17.
Vermont, et al., "Cross-Reactivity of Antibodies against PorA after Vaccination with a Meningococcal B Outer Membrane Vesicle Vaccine," Infection and Immunity, Apr. 2003, pp. 1650-1655, vol. 71, No. 4.
Alignment of SEQ ID No. 19 of EP2327719 against SEQ ID Nos. 92, 94, 96, 98, 100, 102, 104, 106, and 108 of WO/2003/063766, filed in opposition against EP2327719, submitted May 20, 2015, 9 pages.

Alignment of SEQ ID No. 42 of EP2258716 against SEQ ID No. 41 of EP2258716, filed in opposition against EP2258716, submitted Apr. 16, 2015, 1 page.
Alignment of SEQ ID No. 42 of EP2258716 against SEQ ID Nos. 50, 52, 54, 56, 58, 60, 62, 64, 66, 68, 70, and 72 of WO/2003/063766, filed in opposition against EP2258716, submitted Apr. 16, 2015, 12 page.
Beernink et al. (2011). "A meningococcal factor H binding protein mutant that eliminates factor H binding enhances protective antibody responses to vaccination," J Immunol, 186(6):3606-14.
Brendish and Read. (2015). "Neisseria meningitidis serogroup B bivalent factor H binding protein vaccine," Expert Rev. Vaccines, 14(4):493-503.
CECMED (Dec. 2, 2011), "Resumen de las Caracteristicas del Producto: VA-MENGOC-BC," Ministerio de Salud Publica de Cuba, 4 pages. (3 page English translation included).
de Moraes JC, et al. (1992). Protective efficacy of a serogroup B meningococcal vaccine in Sao Paulo, Brazil. Lancet 340: 1074-1078.
Debbag et al. (1994). "Evaluacion de las reacciones adversas asociadas con la vacuna antimeningococcica BC. Informe perliminar sobre 8,117 vacunados." Rev Hosp Ninos BAires, No. 158/159, 6 pages. (6 page English translation included).
Donnelly et al. (2010). "Qualitative and quantitative assessment of meningococcal antigens to evaluate the potential strain coverage of protein-based vaccines," Proc Natl Acad Sci U S A, 107(45):19490-5.
Experimental Report, Submitted on Mar. 23, 2015, filed in relation to EP2411048, 2 pages.
Galeano et al. (1995). "Efectividad de una vacuna antimeningococcica en una cohorte de itagui, Colombia, 1995," Epidemiologico de Antioquia 20(2), 8 pages. (9 page English translation included).
Gil et al. (2009). "Proteomic study via a non-gel based approach of meningococcal outer membrane vesicle vaccine obtained from strain CU385," Human Vaccines 5(5):347-356.
International Preliminary Report on Patentability mailed Jan. 13, 2012, for PCT/IB2010/002260, 10 pages.
International Search Report mailed Apr. 13, 2011, for PCT/IB2010/002260, 7 pages.
Notice of opposition, filed in opposition against EP2258716, dated Apr. 16, 2015, 12 pages.
Notice of opposition, filed in opposition against EP2327719, dated May 20, 2015, 14 pages.
Novartis internal data, filed in relation to EP1902726, submitted on Apr. 13, 2015, 1 page.
Ochoa, Rolando (2008). "Main projects on research, development and manufacturing of human vaccines," excerpt from presentation at BioQatar Symposium 2008, 4 slides.
Patentee's response to notice of opposition, filed in opposition against EP1562983, dated Feb. 16, 2015, 9 pages.
Perez et al. (2010). "Community acquired bacterial meningitis in Cuba: a follow up of a decade," BMC Infectious Diseases 10:130, 9 pages.
Plikaytis et al. (2012). "Interlaboratory standardization of the sandwich enzyme-linked immunosorbent assay designed for MATS, a rapid, reproducible method for estimating the strain coverage of investigational vaccines," Clin Vaccine Immunol, (10):1609-17.
Rodriguez et al. (1999). "The epidemiological impact of antimeningococal B vaccination in Cuba," Mem Inst Oswaldo Cruz 94(4):433-440.
Sandbu et al. (2007). "Immunogenicity and safety of a combination of two serogroup B meningococcal outer membrane vesicle vaccines," Clin Vaccine Immunol, 14(9):1062-9.
Sierra GV, et al. (1991). Vaccine against group B Neisseria meningitidis: protection trial and mass vaccination results in Cuba. NIPH Ann 14: 195-207.
Statement of Grounds of Appeal, dated Mar. 23, 2015, filed in relation to EP2411048, 8 pages.
Statement of Grounds of Appeal, filed in relation to EP1902726, dated Apr. 13, 2015, 9 pages.
Submission in opposition proceedings by Carpmaels and Ransford filed in EP1737486 on Jun. 12, 2015, 2 pages.
Submission in opposition proceedings by Pfizer Inc. filed against EP1737486 on Jun. 12, 2015, 7 pages.

(56) References Cited

OTHER PUBLICATIONS

UniProt accession No. C0JF81, Murphy et al., Last modified on May 5, 2009. 4 pages.

U.S. Appl. No. 60/328,101, "Novel immunogenic compositions for the prevention and treatment of meningococcal disease," filed Oct. 11, 2001. 253 pages.

U.S. Appl. No. 60/406,934, "Novel immunogenic compositions for the prevention and treatment of meningococcal disease," filed Aug. 30, 2002. 190 pages.

Amended Defence and Counterclaim, Jul. 24, 2015, Claim No. HP-2015-000022, *Glaxosmithkline UK Ltd* v. *Wyeth Holdings LLC*, 4 pages.

Annex 1 to the Amended Defence and Counterclaim, Jun. 24, 2015, Claim No. HP-2015-000022, *Glaxosmithkline UK Ltd* v. *Wyeth Holdings LLC*, 40 pages.

Claimant's Amended Grounds of Invalidity under CPR 17.1 (2)(a) on Jul. 16, 2015, in respect of European Patent (UK) No. 2,343,308. In The High Court of Justice Chancery Division Patents Court, between GlaxoSmithKline UK Limited and Wyeth Holdings LLC. 9 pages.

European Examination Report mailed on May 2, 2006 for EP Application No. 99922752.3, filed Apr. 30, 1999, 5 pages.

European Examination Report mailed on Nov. 20, 2006 for EP 05077865.3, filed Apr. 30, 1999, 8 pages.

European Search Report mailed on Mar. 3, 2006 for EP Application No. 05077865.3, filed Apr. 30, 1999, 8 pages.

International Preliminary Examination Report mailed on Oct. 2, 2000 for PCT Application No. PCT/US99/09346 filed on Apr. 30, 1999, 11 pages.

International Search Report mailed on Jun. 15, 2000 for PCT Application No. PCT/US99/09346 filed on Apr. 30, 1999, 14 pages.

\* cited by examiner

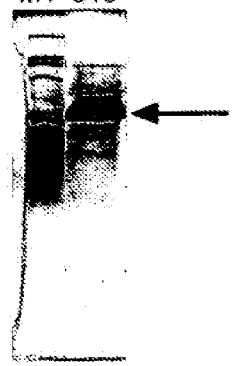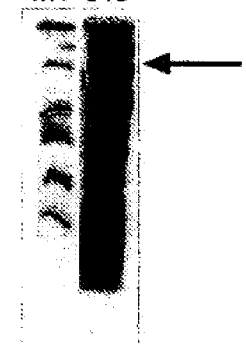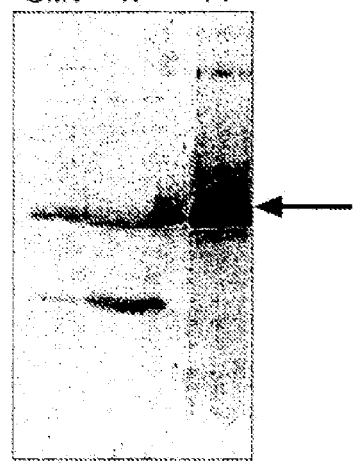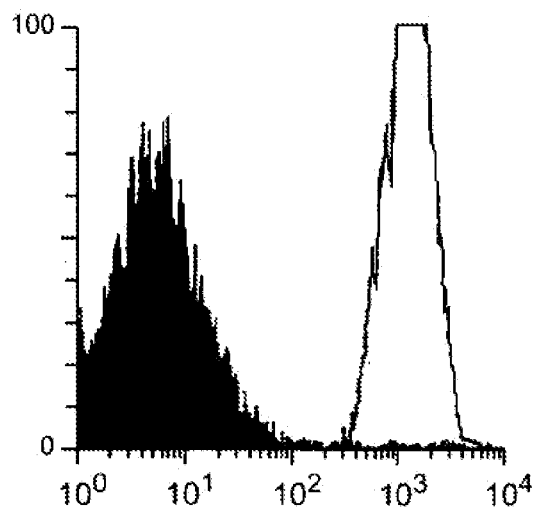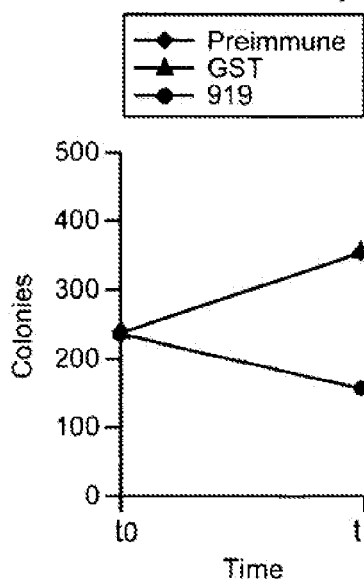

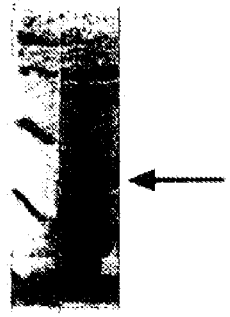
FIG. 2A
279 (10.5 kDa)
Purification
M1  279
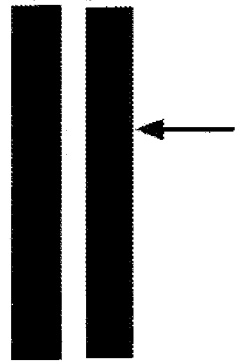
FIG. 2B
279 (10.5 kDa)
Western Blot
TP  OMV
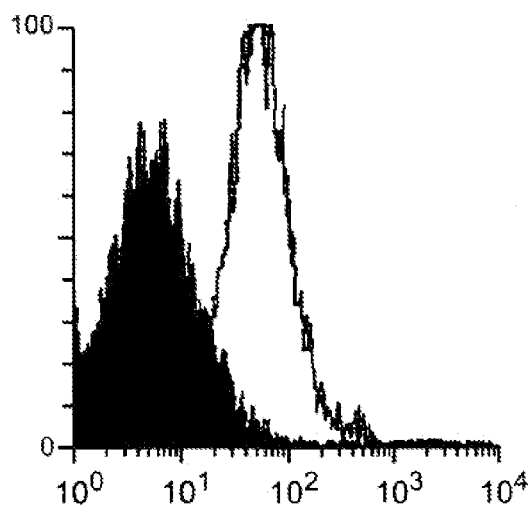
FIG. 2C
279 (10.5 kDa)
FACS
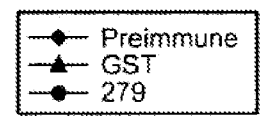
FIG. 2D
279 (10.5 kDa)
Bactericidal Assay
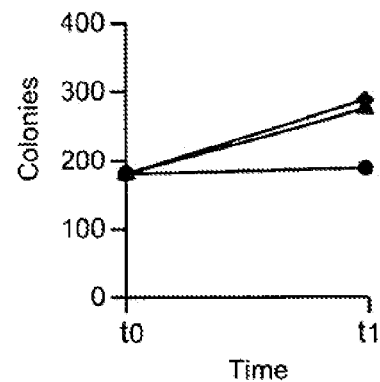

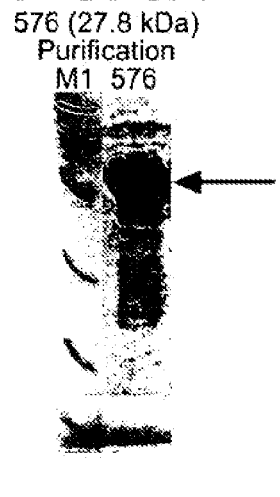
FIG. 3A
576 (27.8 kDa)
Purification
M1 576
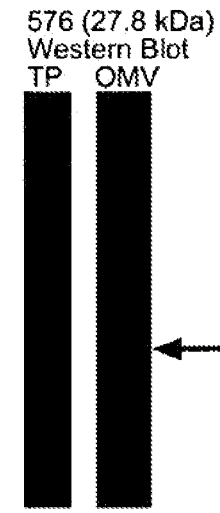
FIG. 3B
576 (27.8 kDa)
Western Blot
TP  OMV
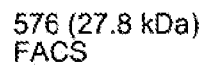
FIG. 3C
576 (27.8 kDa)
FACS
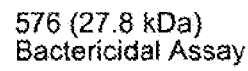
FIG. 3D
576 (27.8 kDa)
Bactericidal Assay
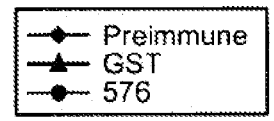
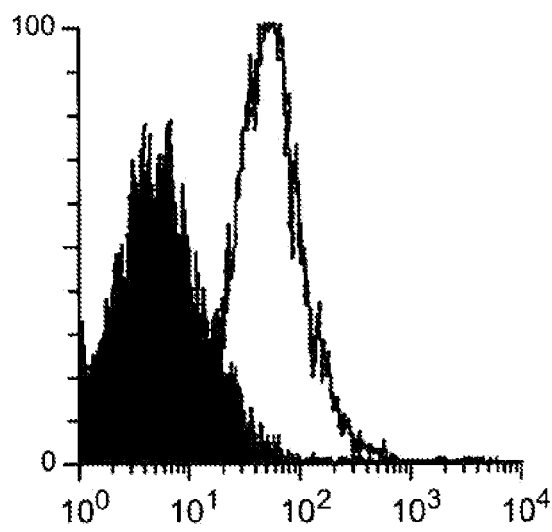
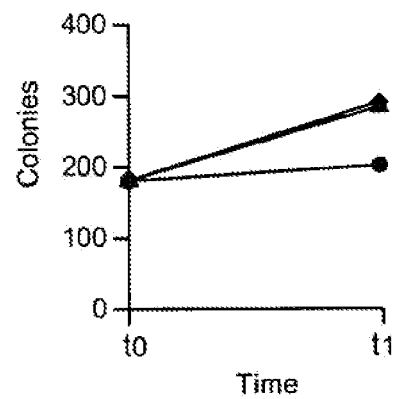

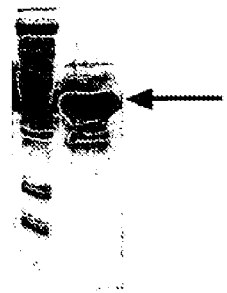
FIG. 4A 519 (33 kDa) Purification M1 519
FIG. 4B 519 (33 kDa) Western Blot TP OMV
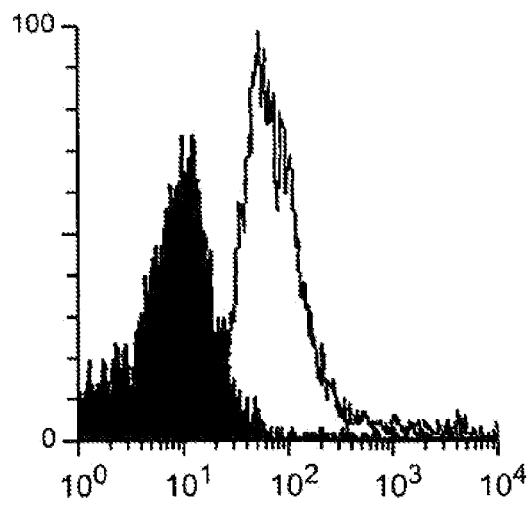
FIG. 4C 519 (33 kDa) FACS
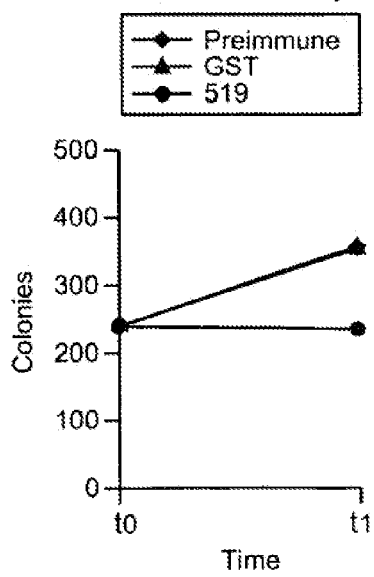
FIG. 4D 519 (33 kDa) Bactericidal Assay 121 (40 kDa)
Purification
M1 121

121 (40 kDa)
Western Blot
TP   OMV 121 (40 kDa)
FACS 121 (40 kDa)
Bactericidal Assay 128 (101 kDa)
Purification
M1 128

128 (101 kDa)
Western Blot
TP OMV 128 (101 kDa)
FACS 128 (101 kDa)
Bactericidal Assay 206 (17 kDa)
Purification 206 (17 kDa)
Western Blot
TP OMV 206 (17 kDa)
FACS 206 (17 kDa)
Bactericidal Assay 287 (78 kDa)
Purification 287 (78 kDa)
FACS 287 (78 kDa)
Bactericidal Assay 406 (33 kDa)
Purification
M1 406

406 (33 kDa)
Western Blot
TP    OMV 406 (33 kDa)
FACS 406 (33 kDa)
Bactericidal Assay

NEISSERIA MENINGITIDIS ANTIGENS AND COMPOSITIONS

RELATED APPLICATIONS

This application is a Continuation of U.S. patent application Ser. No. 13/070,448 (now pending), filed Mar. 23, 2011, which is a Divisional of U.S. patent application Ser. No. 12/013,047 (now U.S. Pat. No. 7,988,979), filed Jan. 11, 2008, which is continuation of U.S. patent application Ser. No. 09/674,546 (now U.S. Pat. No. 7,576,176), filed Nov. 4, 2002, which is the National Stage of International Application No. PCT/US99/09346, filed Apr. 30, 1999, which claims the benefit under 35 U.S.C. §119(e) of U.S. Provisional Patent Nos. 60/121,528, filed Feb. 25, 1999, 60/103,796, filed Oct. 9, 1998, 60/103,794, filed Oct. 9, 1998, 60/103,749, filed Oct. 9, 1998, 60/099,062, filed Sep. 2, 1998, 60/098,994, filed Sep. 2, 1998, 60/094,869, filed Jul. 31, 1998, and 60/083,758, filed May 1, 1998. Each of the foregoing patent applications is incorporated by reference in their entirety.

SUBMISSION OF SEQUENCE LISTING ON ASCII TEXT FILE

The content of the following submission on ASCII text file is incorporated herein by reference in its entirety: a computer readable form (CRF) of the Sequence Listing (file name: 303822000402SeqList.txt, date recorded: Aug. 26, 2015, size: 6317 KB).

FIELD OF THE INVENTION

This invention relates to antigens from the bacterial species: *Neisseria meningitidis* and *Neisseria gonorrhoeae*.

BACKGROUND

*Neisseria meningitidis* is a non-motile, gram negative *diplococcus* human pathogen. It colonizes the pharynx, causing meningitis and, occasionally, septicaemia in the absence of meningitis. It is closely related to *N. gonorrhoea*, although one feature that clearly differentiates meningococcus from gonococcus is the presence of a polysaccharide capsule that is present in all pathogenic meningococci.

*N. meningitidis* causes both endemic and epidemic disease. In the United States the attack rate is 0.6-1 per 100,000 persons per year, and it can be much greater during outbreaks. (see Lieberman et al. (1996) Safety and Immunogenicity of a Serogroups A/C *Neisseria meningitidis* Oligosaccharide-Protein Conjugate Vaccine in Young Children. *JAMA* 275 (19):1499-1503; Schuchat et al (1997) Bacterial Meningitis in the United States in 1995. *N Engl J Med* 337 (14):970-976). In developing countries, endemic disease rates are much higher and during epidemics incidence rates can reach 500 cases per 100,000 persons per year. Mortality is extremely high, at 10-20% in the United States, and much higher in developing countries. Following the introduction of the conjugate vaccine against *Haemophilus influenzae*, *N. meningitidis* is the major cause of bacterial meningitis at all ages in the United States (Schuchat et al (1997) supra).

Based on the organism's capsular polysaccharide, 12 serogroups of *N. meningitidis* have been identified. Group A is the pathogen most often implicated in epidemic disease in sub-Saharan Africa. Serogroups B and C are responsible for the vast majority of cases in the United States and in most developed countries. Serogroups W135 and Y are responsible for the rest of the cases in the United States and developed countries. The meningococcal vaccine currently in use is a tetravalent polysaccharide vaccine composed of serogroups A, C, Y and W135. Although efficacious in adolescents and adults, it induces a poor immune response and short duration of protection, and cannot be used in infants [eg. Morbidity and Mortality weekly report, Vol. 46, No. RR-5 (1997)]. This is because polysaccharides are T-cell independent antigens that induce a weak immune response that cannot be boosted by repeated immunization. Following the success of the vaccination against *H. influenzae*, conjugate vaccines against serogroups A and C have been developed and are at the final stage of clinical testing (Zollinger W D "New and Improved Vaccines Against Meningococcal Disease". In: *New Generation Vaccines*, supra, pp. 469-488; Lieberman et al (1996) supra; Costantino et al (1992) Development and phase I clinical testing of a conjugate vaccine against meningococcus A and C. *Vaccine* 10:691-698).

Meningococcus B (menB) remains a problem, however. This serotype currently is responsible for approximately 50% of total meningitis in the United States, Europe, and South America. The polysaccharide approach cannot be used because the menB capsular polysaccharide is a polymer of α(2-8)-linked N-acetyl neuraminic acid that is also present in mammalian tissue. This results in tolerance to the antigen; indeed, if an immune response were elicited, it would be anti-self, and therefore undesirable. In order to avoid induction of autoimmunity and to induce a protective immune response, the capsular polysaccharide has, for instance, been chemically modified substituting the N-acetyl groups with N-propionyl groups, leaving the specific antigenicity unaltered (Romero & Outschoorn (1994) Current status of Meningococcal group B vaccine candidates: capsular or non-capsular? *Clin Microbiol Rev* 7(4):559-575).

Alternative approaches to menB vaccines have used complex mixtures of outer membrane proteins (OMPs), containing either the OMPs alone, or OMPs enriched in porins, or deleted of the class 4 OMPs that are believed to induce antibodies that block bactericidal activity. This approach produces vaccines that are not well characterized. They are able to protect against the homologous strain, but are not effective at large where there are many antigenic variants of the outer membrane proteins. To overcome the antigenic variability, multivalent vaccines containing up to nine different porins have been constructed (eg. Poolman J T (1992) Development of a meningococcal vaccine. *Infect. Agents Dis.* 4:13-28). Additional proteins to be used in outer membrane vaccines have been the opa and opc proteins, but none of these approaches have been able to overcome the antigenic variability (eg. Ala'Aldeen & Borriello (1996) The meningococcal transferrin-binding proteins 1 and 2 are both surface exposed and generate bactericidal antibodies capable of killing homologous and heterologous strains. *Vaccine* 14(1):49-53).

A certain amount of sequence data is available for meningococcal and gonoccocal genes and proteins (eg. EP-A-0467714, WO96/29412), but this is by no means complete. The provision of further sequences could provide an opportunity to identify secreted or surface-exposed proteins that are presumed targets for the immune system and which are not antigenically variable. For instance, some of the identified proteins could be components of efficacious vaccines against meningococcus B, some could be components of vaccines against all meningococcal serotypes, and others could be components of vaccines against all pathogenic *Neisseriae* including *Neisseria meningitidis* or *Neisseria gonorrhoeae*.

Those sequences specific to *N. meningitidis* or *N. gonorrhoeae* that are more highly conserved are further preferred sequences.

It is thus an object of the invention is to provide Neisserial DNA sequences which encode proteins that are antigenic or immunogenic.

BRIEF DESCRIPTION OF THE DRAWINGS

FIG. 1A through FIG. 1E illustrate the products of (FIG. 1B) protein expression and (FIG. 1A) purification, (FIG. 1C) FACs analysis, (FIG. 1D) bactericidal assay, and (FIG. 1E) western blot. The result of the ELISA assay of the predicted ORF 919 as cloned and expressed in *E. coli* was positive.

FIG. 2A through FIG. 2D illustrate the products of (FIG. 2A) protein expression and purification, (FIG. 2B) western blot, (FIG. 2C) FACs analysis, and (FIG. 2D) bactericidal assay. The result of the ELISA assay of the predicted ORF 279 as cloned and expressed in *E. coli* was positive.

FIG. 3A through FIG. 3D illustrate the products of (FIG. 3A) protein expression and purification, (FIG. 3B) western blot, (FIG. 3C) FACs analysis, and (FIG. 3D) bactericidal assay. The result of the ELISA assay of the predicted ORF 576-1 as cloned and expressed in *E. coli* was positive.

FIG. 4A through FIG. 4D illustrate the products of (FIG. 4A) protein expression and purification, (FIG. 4B) western blot, (FIG. 4C) FACs analysis, and (FIG. 4D) bactericidal assay. The result of the ELISA assay of the predicted ORF 519-1 as cloned and expressed in *E. coli* was positive.

FIG. 5A through FIG. 5D illustrate the products of (FIG. 5A) protein expression and purification, (FIG. 5B) western blot, (FIG. 5C) FACs analysis, and (FIG. 5D) bactericidal assay. The result of the ELISA assay of the predicted ORF 121-1 as cloned and expressed in *E. coli* was positive.

FIG. 6A through FIG. 6D illustrate the products of (FIG. 6A) protein expression and purification, (FIG. 6B) western blot, (FIG. 6C) FACs analysis, and (FIG. 6D) bactericidal assay. The result of the ELISA assay of the predicted ORF 128-1 as cloned and expressed in *E. coli* was positive.

FIG. 7A through FIG. 7D illustrate the products of (FIG. 7A) protein expression and purification, (FIG. 7B) western blot, (FIG. 7C) FACs analysis, and (FIG. 7D) bactericidal assay. The result of the ELISA assay of the predicted ORF 206 as cloned and expressed in *E. coli* was positive.

FIG. 8A through FIG. 8C illustrate the products of (FIG. 8A) protein expression and purification, (FIG. 8B) FACs analysis, and (FIG. 8C) bactericidal assay. The result of the ELISA assay of the predicted ORF 287 as cloned and expressed in *E. coli* was positive.

FIG. 9A through FIG. 9D illustrate the products of (FIG. 9A) protein expression and purification, (FIG. 9B) western blot, (FIG. 9C) FACs analysis, and (FIG. 9D) bactericidal assay. The result of the ELISA assay of the predicted ORF 406 as cloned and expressed in *E. coli* was positive.

FIG. 10 illustrates the hydrophilicity plot, antigenic index and AMPHI regions of the products of protein expression the predicted ORF 919 as cloned and expressed in *E. coli.*

FIG. 11 illustrates the hydrophilicity plot, antigenic index and AMPHI regions of the products of protein expression the predicted ORF 279 as cloned and expressed in *E. coli.*

FIG. 12 illustrates the hydrophilicity plot, antigenic index and AMPHI regions of the products of protein expression the predicted ORF 576-1 as cloned and expressed in *E. coli.*

FIG. 13 illustrates the hydrophilicity plot, antigenic index and AMPHI regions of the products of protein expression the predicted ORF 519-1 as cloned and expressed in *E. coli.*

FIG. 14 illustrates the hydrophilicity plot, antigenic index and AMPHI regions of the products of protein expression the predicted ORF 121-1 as cloned and expressed in *E. coli.*

FIG. 15 illustrates the hydrophilicity plot, antigenic index and AMPHI regions of the products of protein expression the predicted ORF 128-1 as cloned and expressed in *E. coli.*

FIG. 16 illustrates the hydrophilicity plot, antigenic index and AMPHI regions of the products of protein expression the predicted ORF 206 as cloned and expressed in *E. coli.*

FIG. 17 illustrates the hydrophilicity plot, antigenic index and AMPHI regions of the products of protein expression the predicted ORF 287 as cloned and expressed in *E. coli.*

FIG. 18 illustrates the hydrophilicity plot, antigenic index and AMPHI regions of the products of protein expression the predicted ORF 406 as cloned and expressed in *E. coli.*

Figure 19A:
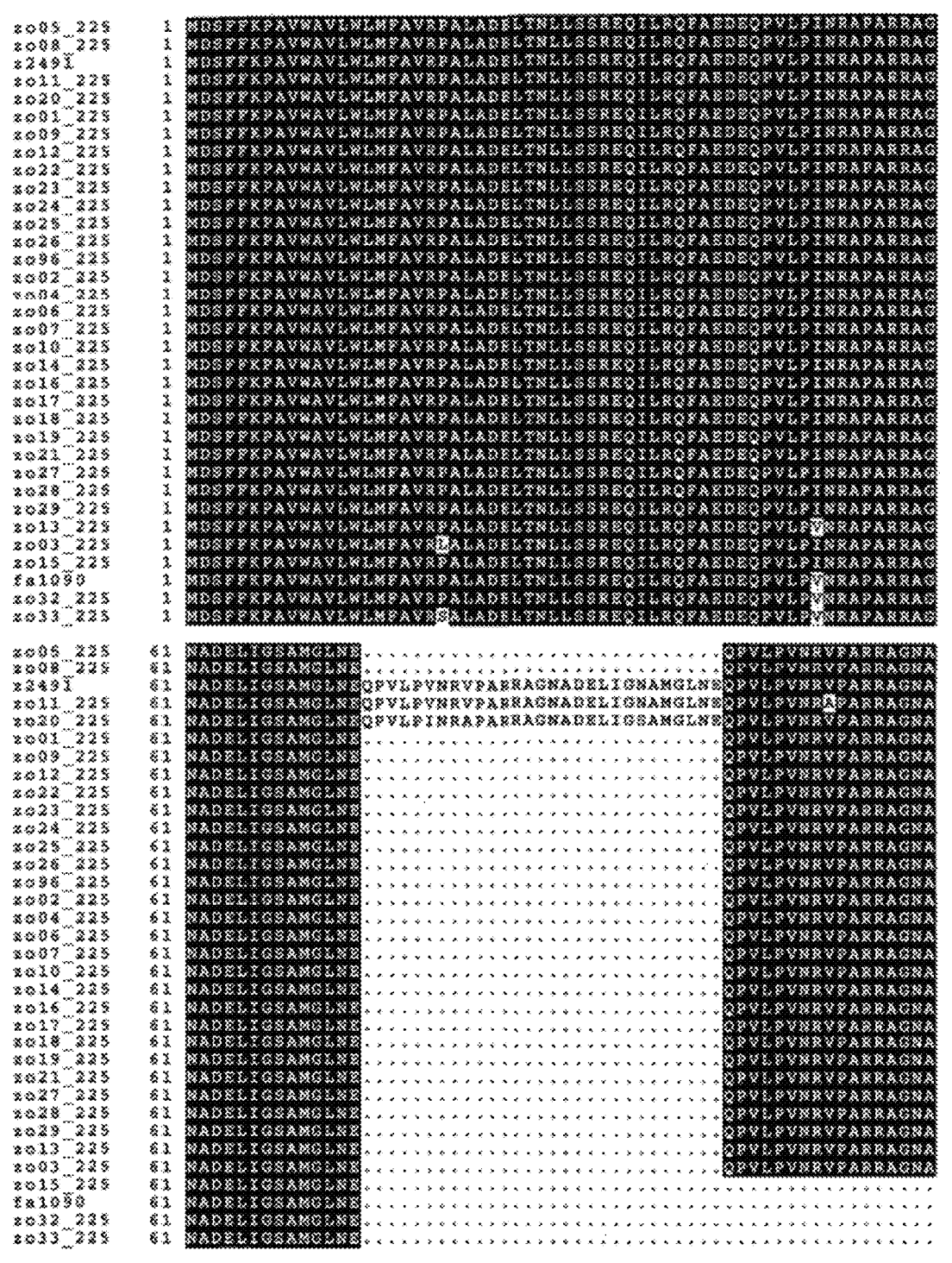
Figure 19B:
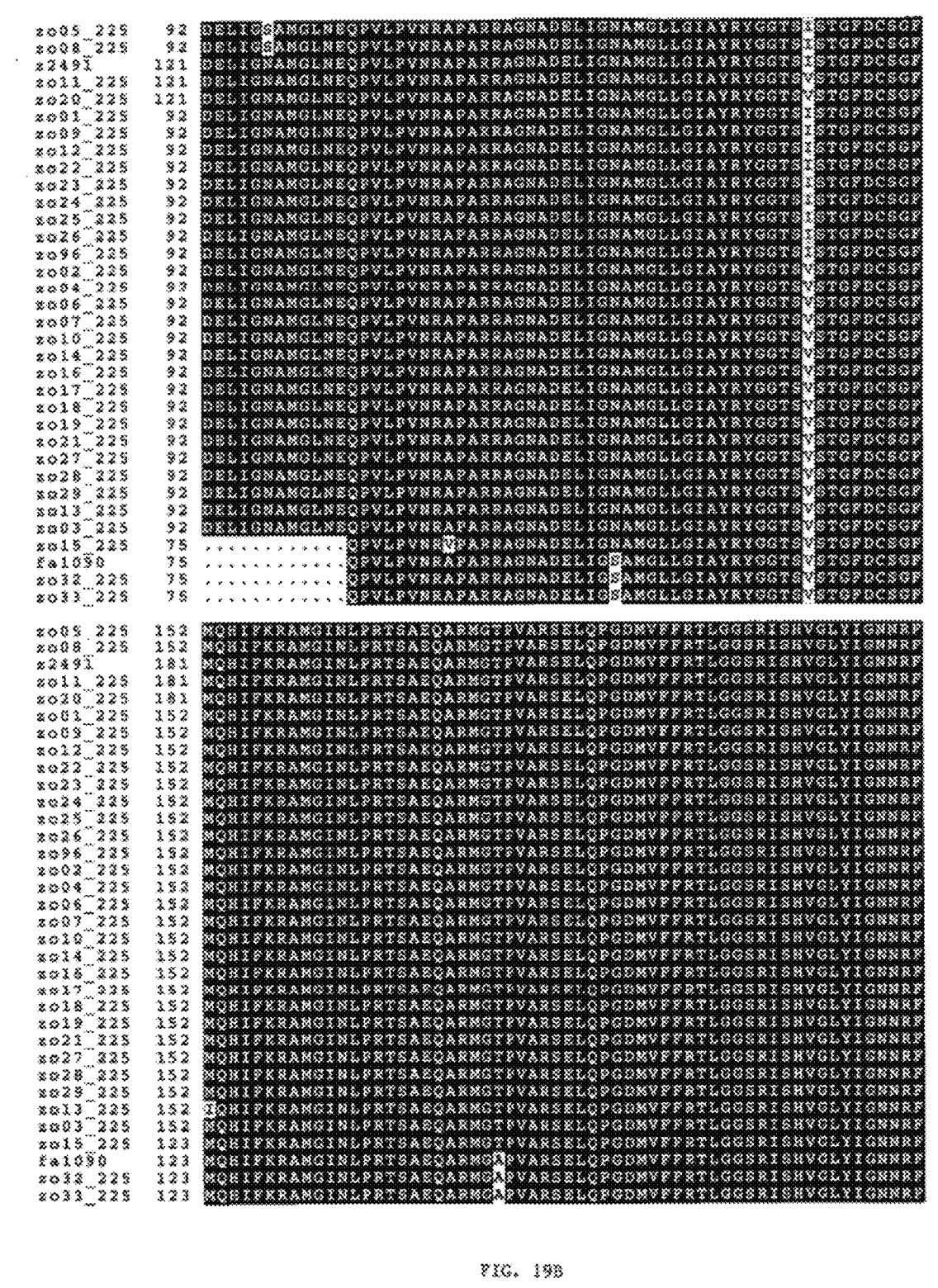
Figure 19C:
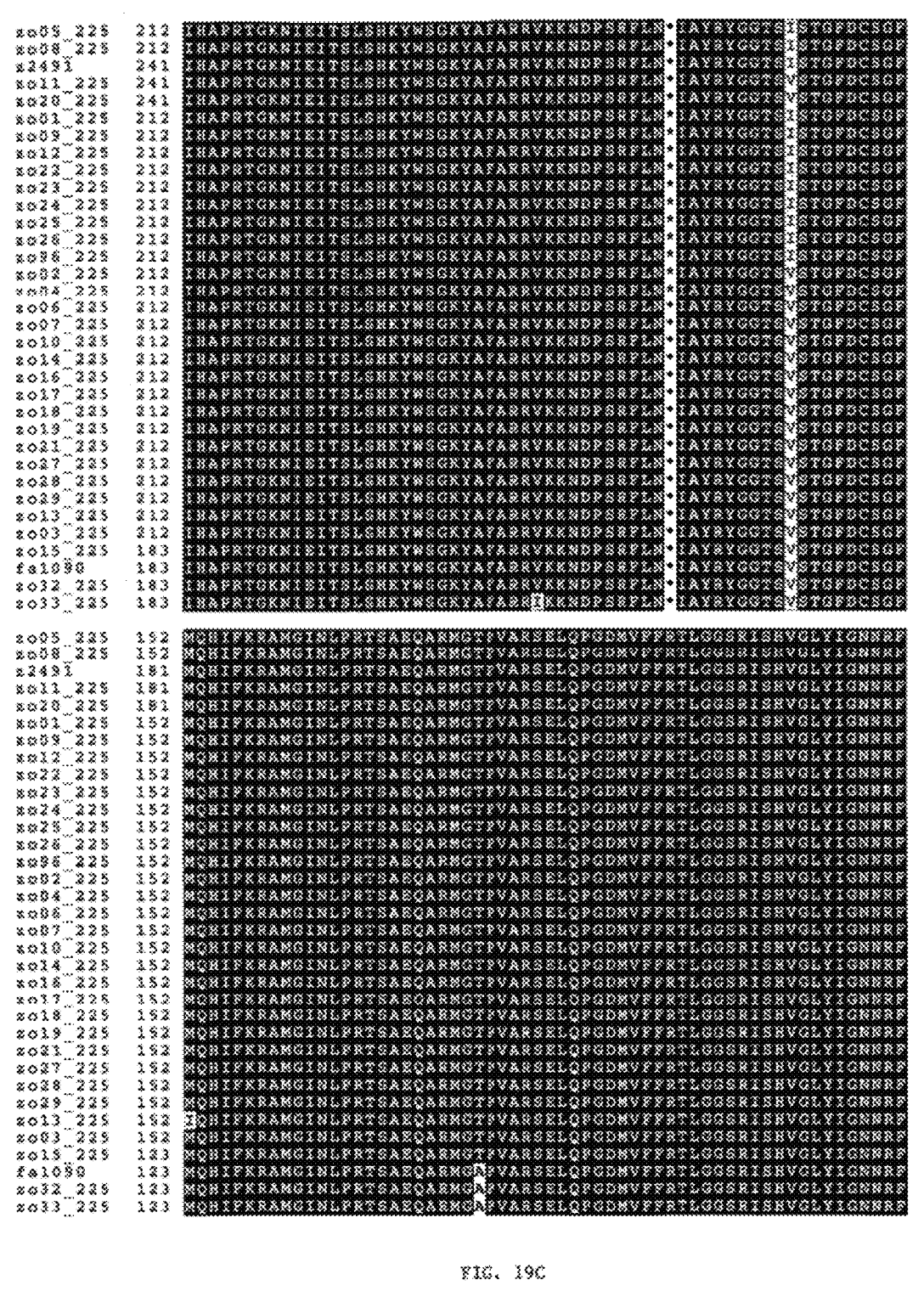

FIG. 19A, FIG. 19B, and FIG. 19C show an alignment comparison of amino acid sequences for ORF 225 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3115; Z2491 SEQ ID 3116; ZO01__225 SEQ ID 3117; ZO02__225 SEQ ID 3118; ZO03__225 SEQ ID 3119; ZO04__225 SEQ ID 3120; ZO05__225 SEQ ID 3121; ZO06__225 SEQ ID 3122; ZO07__225 SEQ ID 3123; ZO08__225 SEQ ID 3124; ZO09__225 SEQ ID 3125; ZO10__225 SEQ ID 3126; ZO11__225 SEQ ID 3127; ZO12__225 SEQ ID 3128; ZO13__225 SEQ ID 3129; ZO14__225 SEQ ID 3130; ZO15__225 <SEQ ID 3131; ZO16__225 SEQ ID 3132; ZO17__225 SEQ ID 3133; ZO18__225 SEQ ID 3134; ZO19__225 SEQ ID 3135; ZO20__225 SEQ ID 3136; ZO21__225 SEQ ID 3137; ZO22__225 SEQ ID 3138; ZO23__225 SEQ ID 3139; ZO24__225 SEQ ID 3140; ZO25__225 SEQ ID 3141; ZO26__225 SEQ ID 3142; ZO27__225 SEQ ID 3143; ZO28__225 SEQ ID 3144; ZO29__225 SEQ ID 3145; ZO32__225 SEQ ID 3146; ZO33__225 SEQ ID 3147; and ZO96__225 SEQ ID 3148.

Figure 20A:
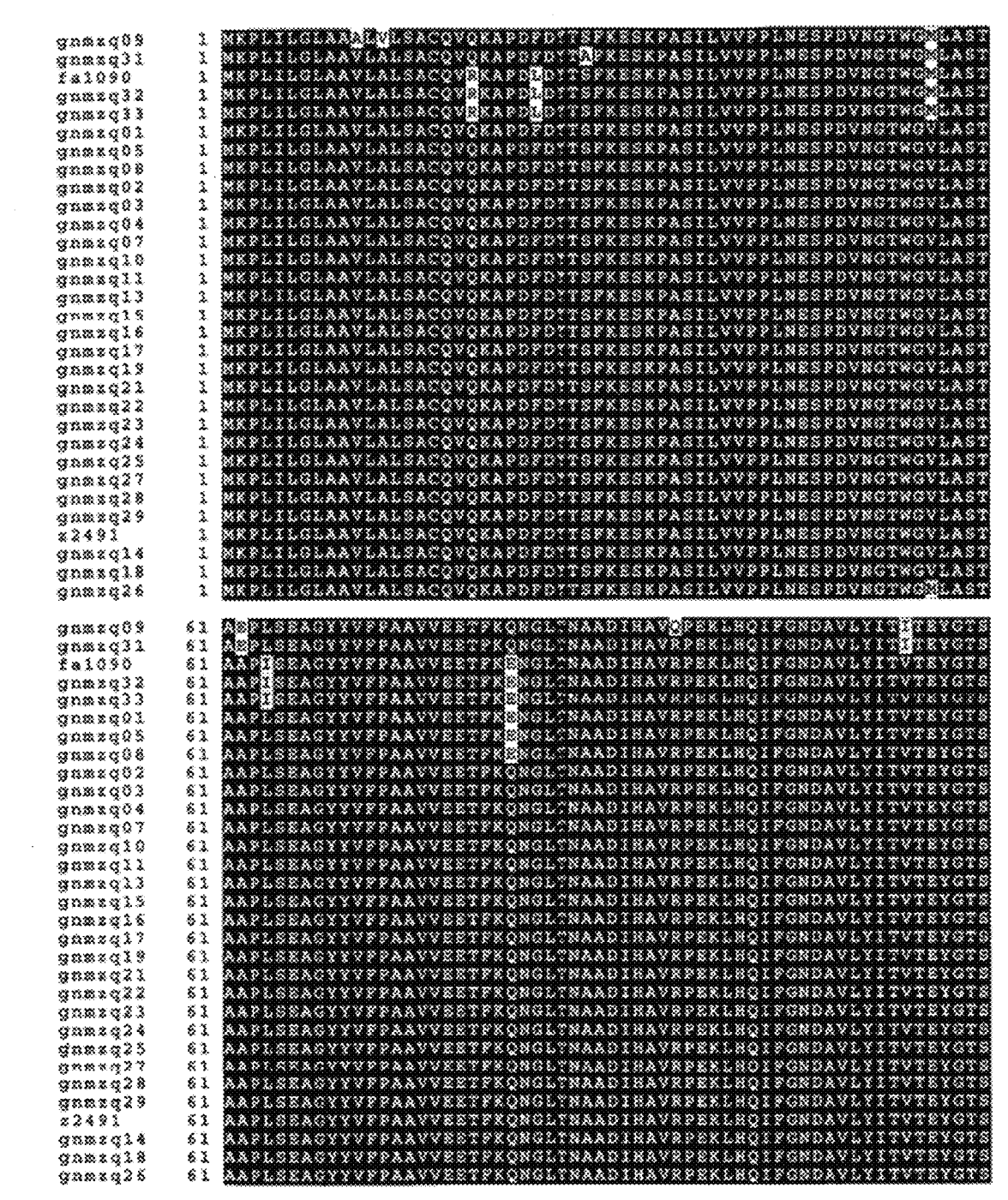
Figure 20B:
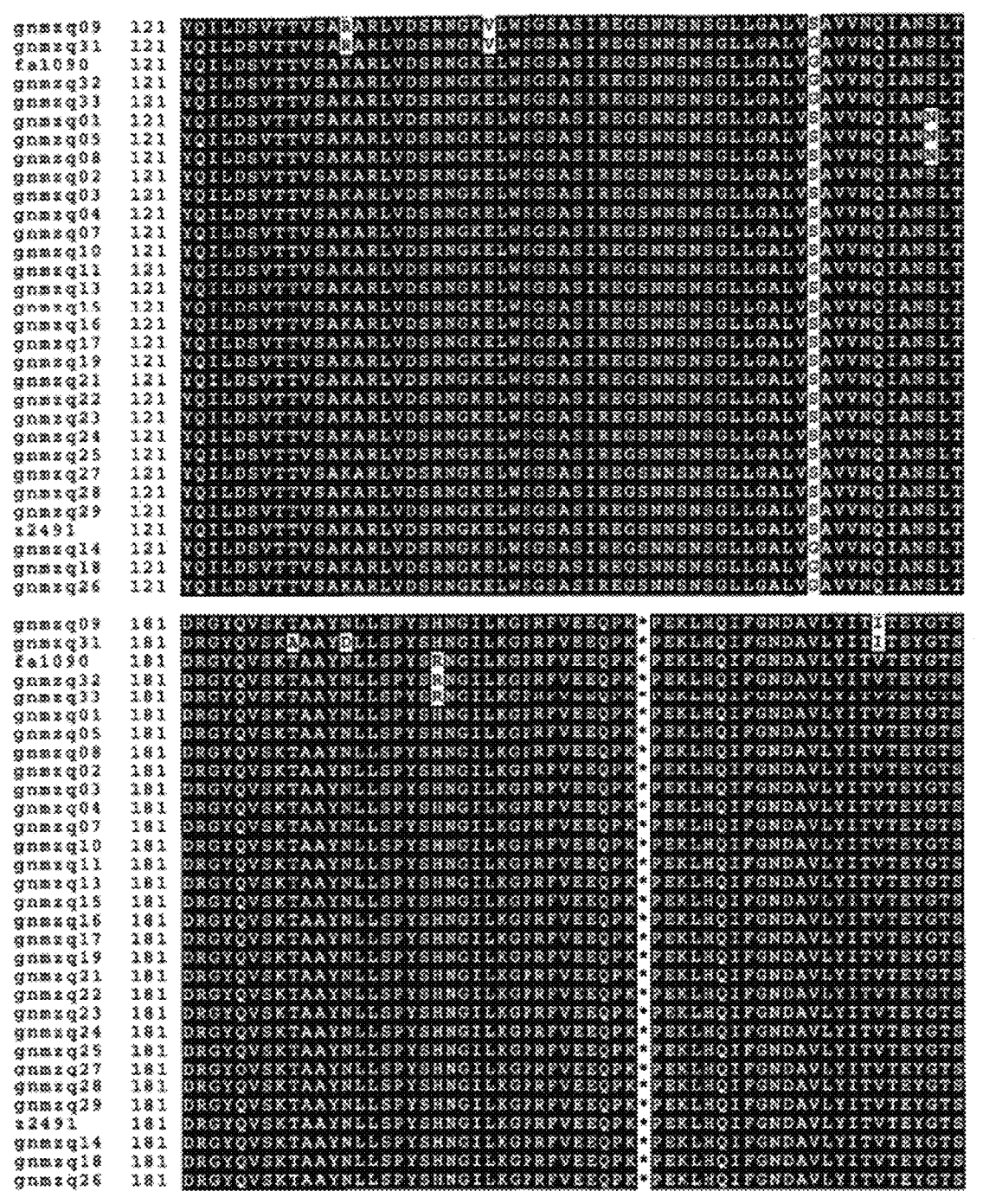

FIG. 20A and FIG. 20B show an alignment comparison of amino acid sequences for ORF 235 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3149; GNMZQ01 SEQ ID 3150; GNMZQ02 SEQ ID 3151; GNMZQ03 SEQ ID 31521; GNMZQ04 SEQ ID 3153; GNMZQ05 SEQ ID 3154; GNMZQ07 SEQ ID 3155; GNMZQ08 SEQ ID 3156; GNMZQ09 SEQ ID 3157; GNMZQ10 SEQ ID 3158; GNMZQ11 SEQ ID 3159; GNMZQ13 SEQ ID 3160; GNMZQ14 SEQ ID 3161; GNMZQ15 SEQ ID 3162; GNMZQ16 SEQ ID 3163; GNMZQ17 SEQ ID 3164; GNMZQ18 SEQ ID 3165; GNMZQ19 SEQ ID 3166; GNMZQ21 SEQ ID 3166; GNMZQ22 SEQ ID 3167; GNMZQ23 SEQ ID 3168; GNMZQ24 SEQ ID 3169; GNMZQ25 SEQ ID 3170; GNMZQ26 SEQ ID 3171; GNMZQ27 SEQ ID 3172; GNMZQ28 SEQ ID 3173; GNMZQ29 SEQ ID 3174; GNMZQ31 SEQ ID 3175; GNMZQ32 SEQ ID 3176; GNMZQ33 SEQ ID 3177; and Z2491 SEQ ID 3178.

Figure 21A:
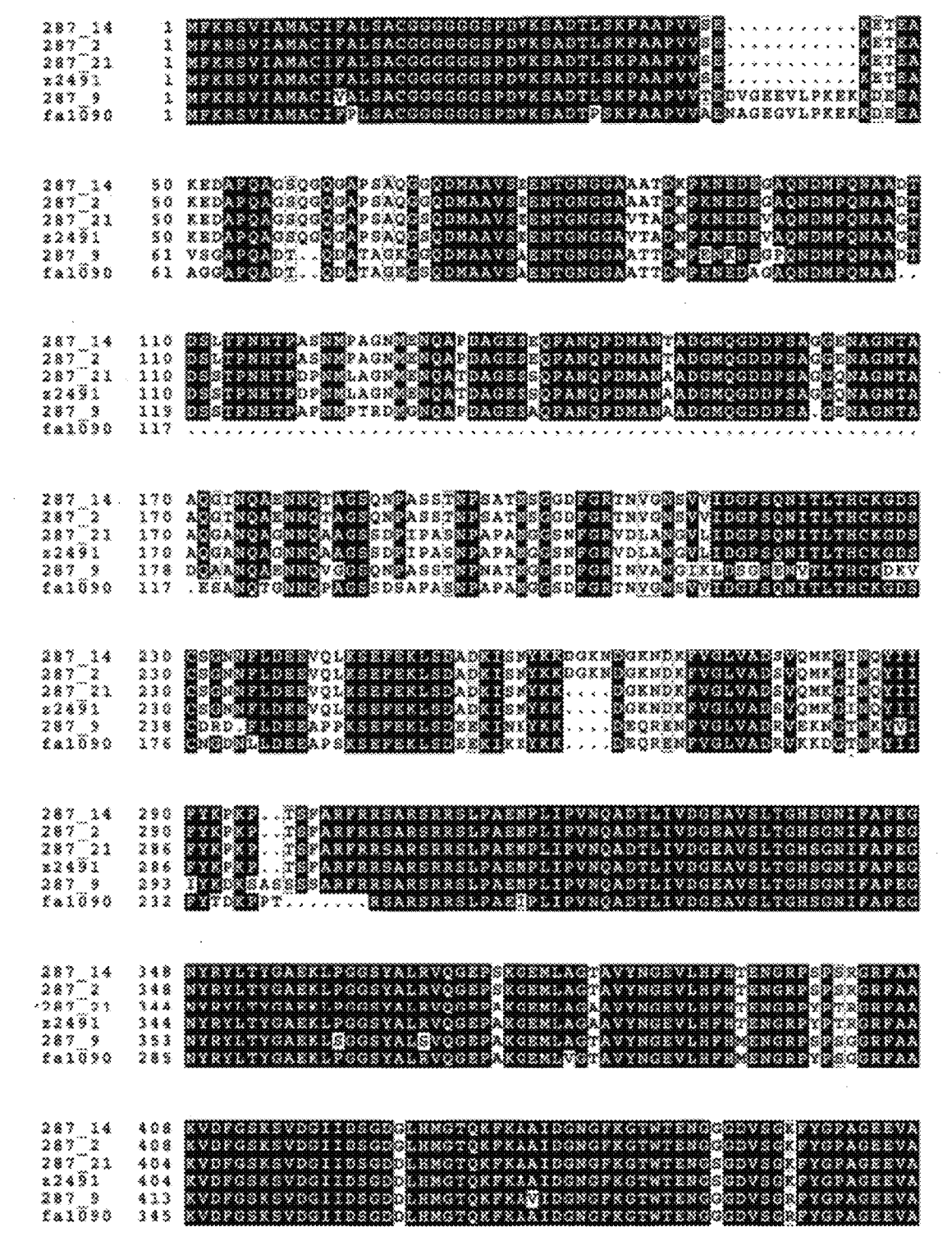
Figure 21B:
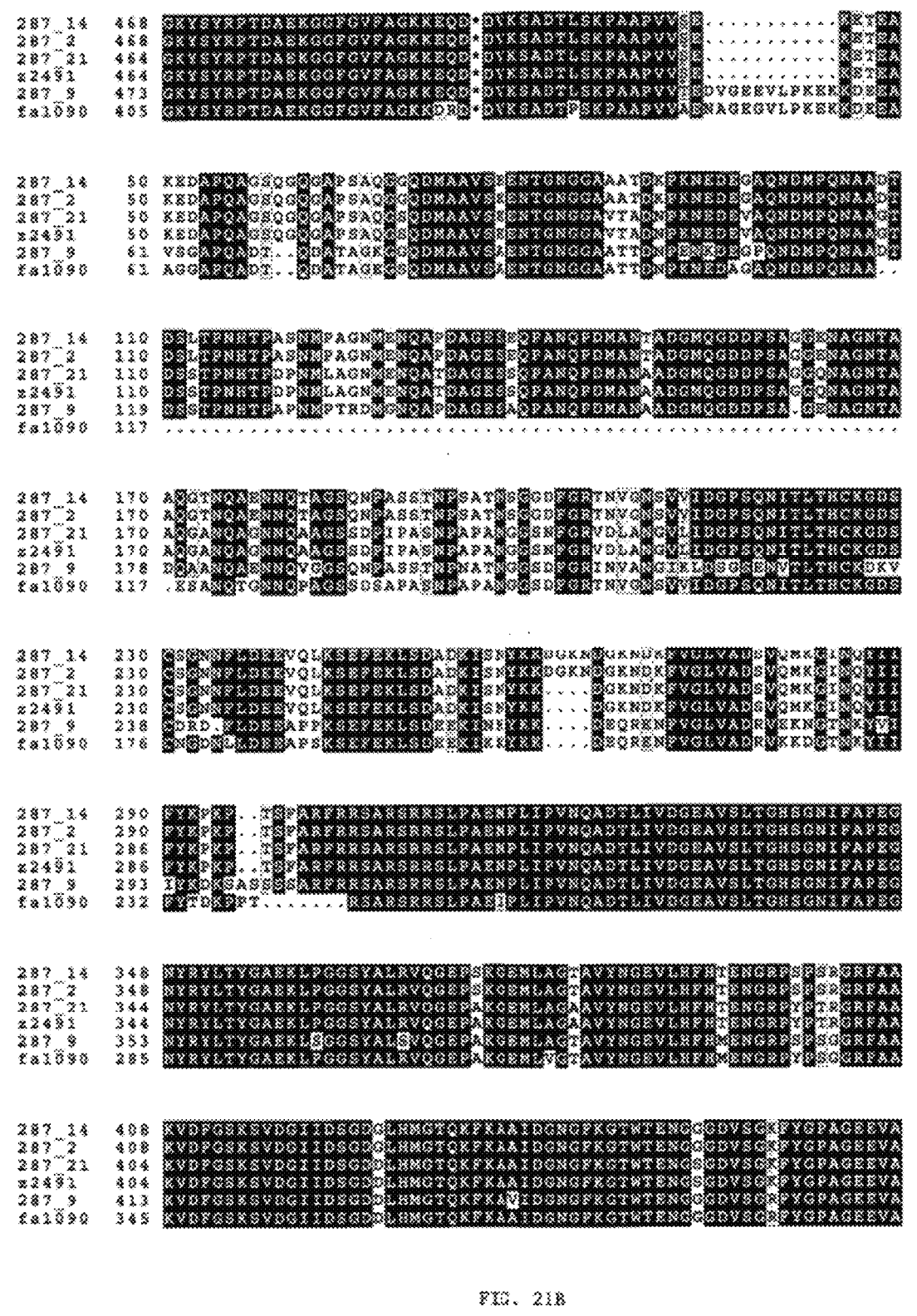

FIG. 21A and FIG. 21B show an alignment comparison of amino acid sequences for ORF 287 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: 287_14 SEQ ID 3179; 287_2 SEQ ID 3180; 287_21. SEQ ID 3181; 287_9 SEQ ID 3182; FA1090 SEQ ID 3183; and Z2491 SEQ ID 3184.

Figure 22A:
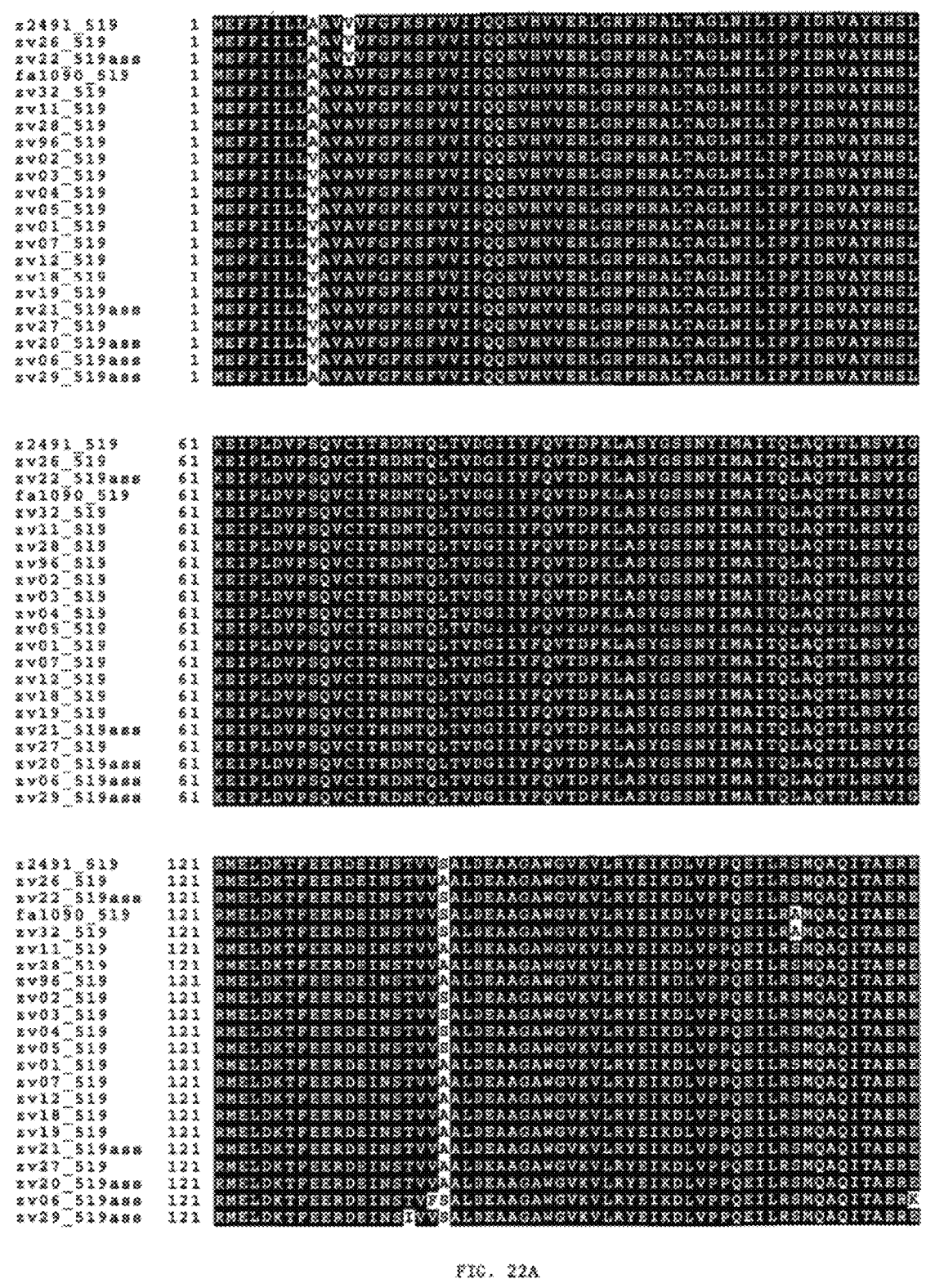
Figure 22B:
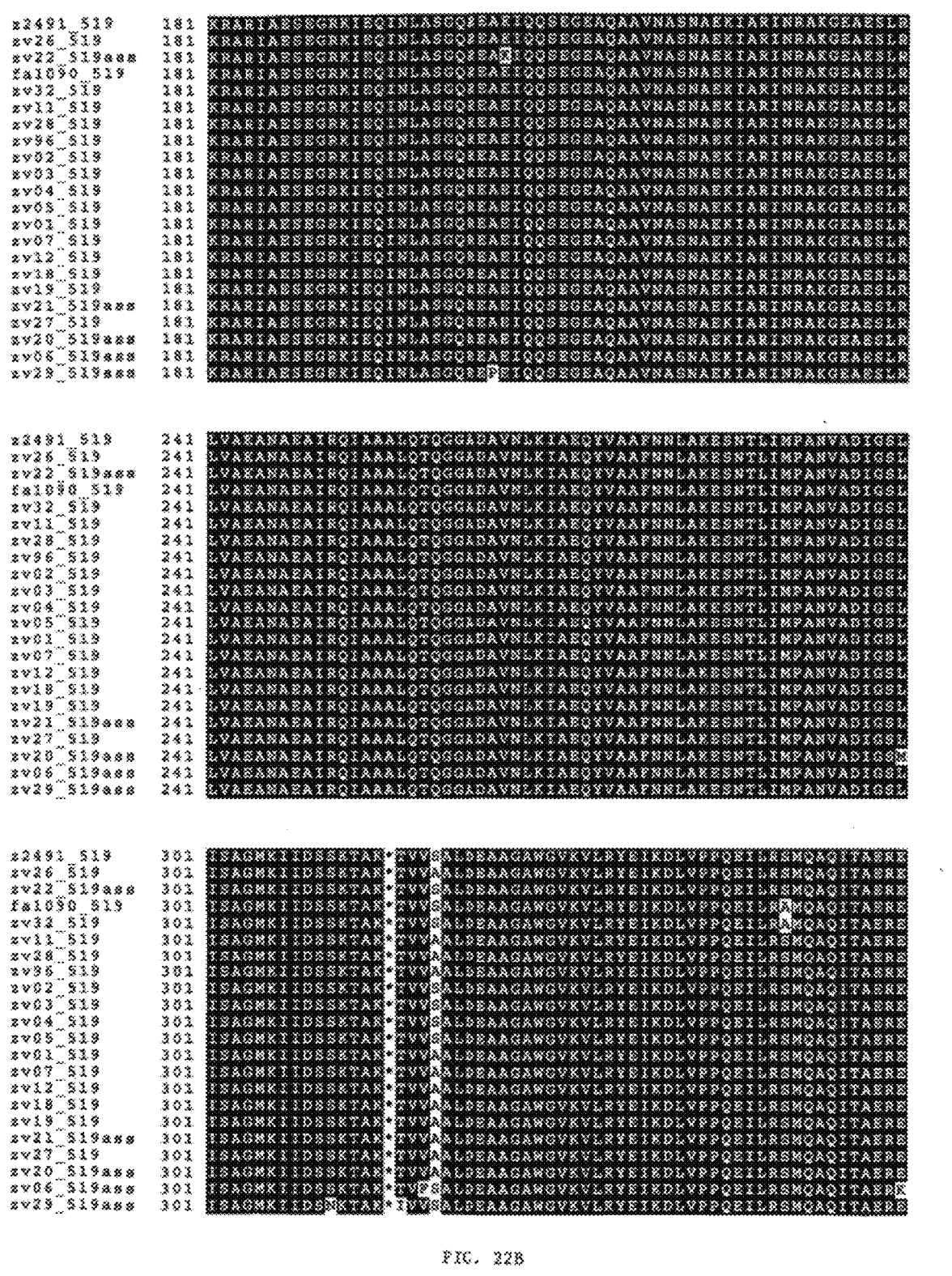

FIG. 22A and FIG. 22B show an alignment comparison of amino acid sequences for ORF 519 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090_519 SEQ ID 3185; Z2491_519 SEQ ID 3186; ZV01_519 SEQ ID 3187; ZV02_519 SEQ ID 3188; ZV03_519 SEQ ID 3189; ZV04_519 SEQ ID 3190; ZV05_519 SEQ ID 3191; ZV06_519ASS SEQ ID 3192; ZV07_519 SEQ ID 3193; ZV11_519 SEQ ID 3194; ZV12_519 SEQ ID 3195; ZV18_519 SEQ ID 3196; ZV19_519 SEQ ID 3197; ZV20_519ASS SEQ ID 3198; ZV21_519ASS SEQ ID 3199; ZV22_519ASS SEQ ID 3200; ZV26_519 SEQ ID 3201; ZV27_519 SEQ ID 3202; ZV28_519 SEQ ID 3203; ZV29_519ASS SEQ ID 3204; ZV32_519 SEQ ID 3205; and ZV96_519 SEQ ID 3206.

Figure 23A:
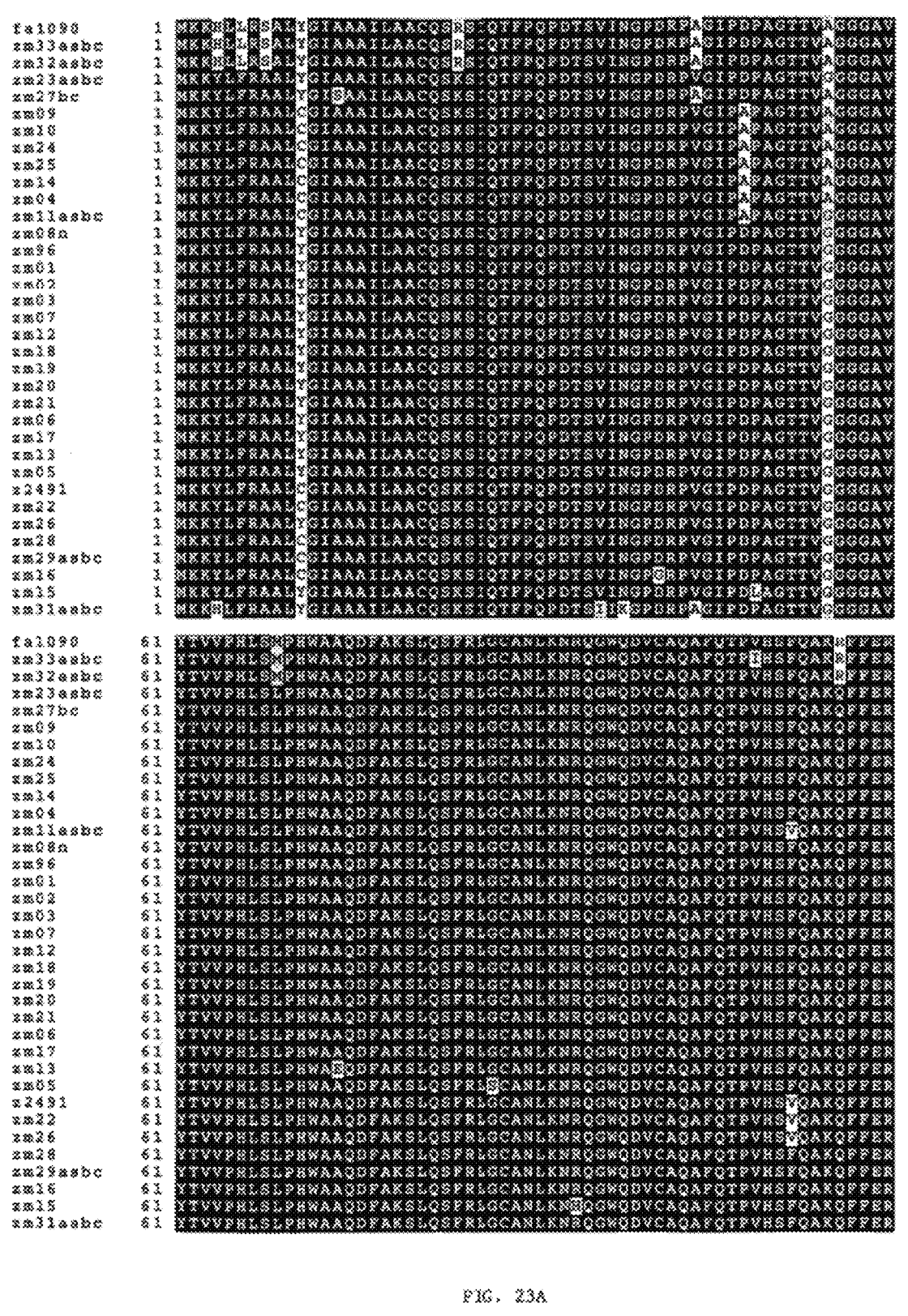
Figure 23B:
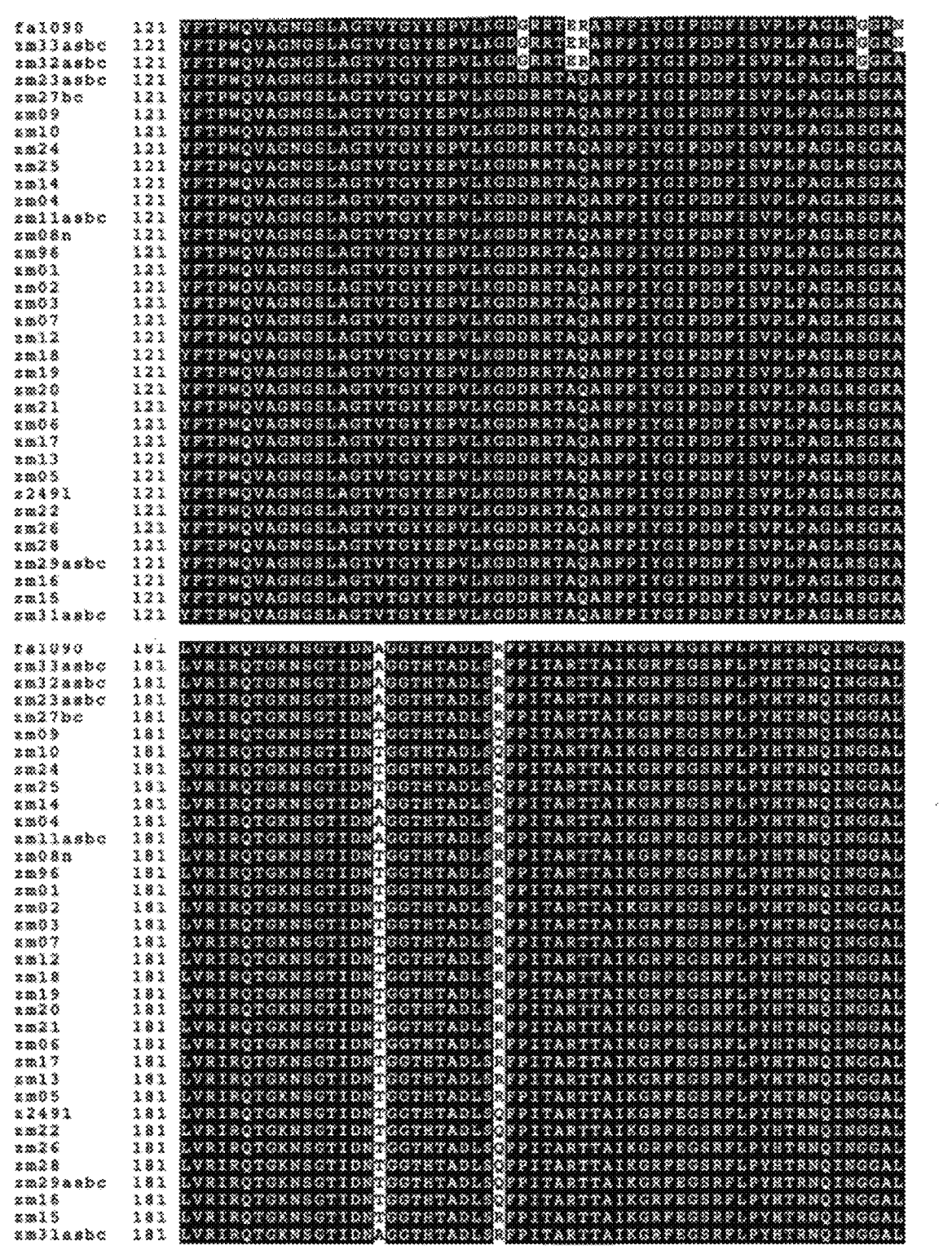
Figure 23C:
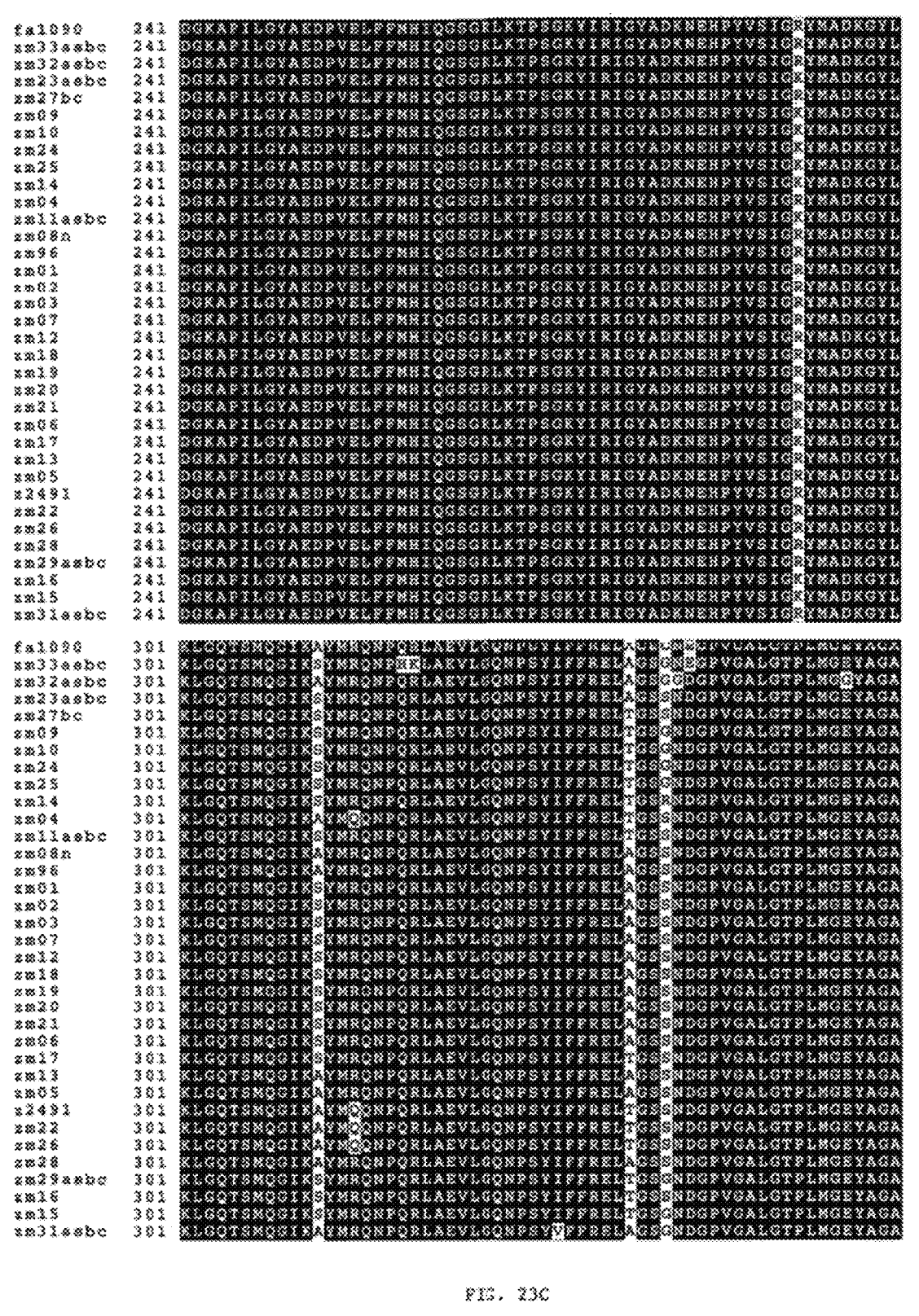
Figure 23D:
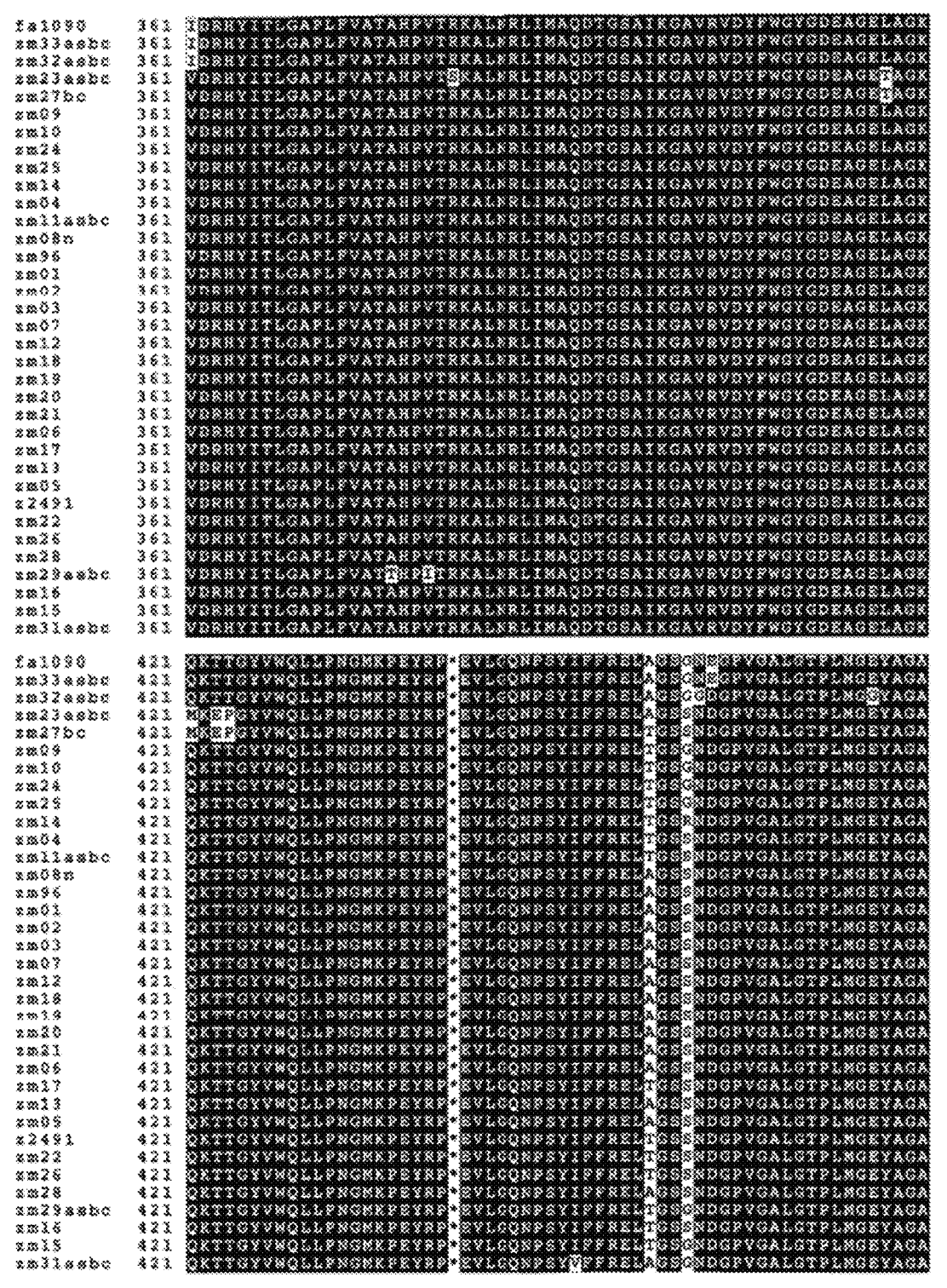

FIG. 23A, FIG. 23B, FIG. 23C, and FIG. 23D show an alignment comparison of amino acid sequences for ORF 919 for several strains of *Neisseria*. Dark shading indicates regions of homology, and gray shading indicates the conservation of amino acids with similar characteristics. The Figure demonstrates a high degree of conservation among the various strains, further confirming its utility as an antigen for both vaccines and diagnostics. The sequences in the Figure have the following SEQ ID NOs: FA1090 SEQ ID 3207; Z2491 <SEQ ID 3208; ZM01 SEQ ID 3209; ZM02 SEQ ID 3210; ZM03 SEQ ID 3211; ZM04 SEQ ID 3212; ZM05 SEQ ID 3213; ZM06 SEQ ID 3214; ZM07 SEQ ID 3215; ZM08N SEQ ID 3216; ZM09 SEQ ID 3217; ZM10 SEQ ID 3218; ZM11ASBC SEQ ID 3219; ZM12 SEQ ID 3220; ZM13 SEQ ID 3221; ZM14 SEQ ID 3222; ZM15 SEQ ID 3223; ZM16 SEQ ID 3224; ZM17 SEQ ID 3225; ZM18 SEQ ID 3226; ZM19 SEQ ID 3227; ZM20 SEQ ID 3228; ZM21 SEQ ID 3229; ZM22 SEQ ID 3230; ZM23ASBC SEQ ID 3231; ZM24 SEQ ID 3232; ZM25 SEQ ID 3233; ZM26 SEQ ID 3234; ZM27BC SEQ ID 3235; ZM28 SEQ ID 3236; ZM29ASBC SEQ ID 3237; ZM31ASBC SEQ ID 3238; ZM32ASBC SEQ ID 3239; ZM33ASBC SEQ ID 3240; ZM96 SEQ ID 3241.

THE INVENTION

The invention provides proteins comprising the *N. meningitidis* amino acid sequences and *N. gonorrhoeae* amino acid sequences disclosed in the examples.

It also provides proteins comprising sequences homologous (i.e., those having sequence identity) to the *N. meningitidis* amino acid sequences disclosed in the examples. Depending on the particular sequence, the degree of homology (sequence identity) is preferably greater than 50% (eg. 60%, 70%, 80%, 90%, 95%, 99% or more). These proteins include mutants and allelic variants of the sequences disclosed in the examples. Typically, 50% identity or more between two proteins is considered to be an indication of functional equivalence. Identity between proteins is preferably determined by the Smith-Waterman homology search algorithm as implemented in MPSRCH program (Oxford Molecular) using an affine gap search with parameters:gap penalty 12, gap extension penalty 1.

The invention further provides proteins comprising fragments of the *N. meningitidis* amino acid sequences and *N. gonorrhoeae* amino acid sequences disclosed in the examples. The fragments should comprise at least n consecutive amino acids from the sequences and, depending on the particular sequence, n is 7 or more (eg. 8, 10, 12, 14, 16, 18, 20 or more). Preferably the fragments comprise an epitope from the sequence.

The proteins of the invention can, of course, be prepared by various means (eg. recombinant expression, purification from cell culture, chemical synthesis etc.) and in various forms (eg. native, fusions etc.). They are preferably prepared in substantially pure or isolated form (i.e. substantially free from other *N. meningitidis* or *N. gonorrhoeae* host cell proteins)

According to a further aspect, the invention provides antibodies which bind to these proteins. These may be polyclonal or monoclonal and may be produced by any suitable means.

According to a further aspect, the invention provides nucleic acid comprising the *N. meningitidis* nucleotide sequences and *N. gonorrhoeae* nucleotide sequences disclosed in the examples.

According to a further aspect, the invention comprises nucleic acids having sequence identity of greater than 50% (e.g., 60%, 70%, 80%, 90%, 95%, 99% or more) to the nucleic acid sequences herein. Sequence identity is determined as above-discussed.

According to a further aspect, the invention comprises nucleic acid that hybridizes to the sequences provided herein. Conditions for hybridization are set forth herein.

Nucleic acid comprising fragments of these sequences are also provided. These should comprise at least n consecutive nucleotides from the *N. meningitidis* sequences or *N. gonorrhoeae* sequences and depending on the particular sequence, n is 10 or more (eg 12, 14, 15, 18, 20, 25, 30, 35, 40 or more).

According to a further aspect, the invention provides nucleic acid encoding the proteins and protein fragments of the invention.

It should also be appreciated that the invention provides nucleic acid comprising sequences complementary to those described above (eg. for antisense or probing purposes).

Nucleic acid according to the invention can, of course, be prepared in many ways (eg. by chemical synthesis, in part or in whole, from genomic or cDNA libraries, from the organism itself etc.) and can take various forms (eg. single stranded, double stranded, vectors, probes etc.).

In addition, the term "nucleic acid" includes DNA and RNA, and also their analogues, such as those containing modified backbones, and also protein nucleic acids (PNA) etc.

According to a further aspect, the invention provides vectors comprising nucleotide sequences of the invention (eg. expression vectors) and host cells transformed with such vectors.

According to a further aspect, the invention provides compositions comprising protein, antibody, and/or nucleic acid according to the invention. These compositions may be suitable as vaccines, for instance, or as diagnostic reagents or as immunogenic compositions.

The invention also provides nucleic acid, protein, or antibody according to the invention for use as medicaments (eg. as vaccines) or as diagnostic reagents. It also provides the use of nucleic acid, protein, or antibody according to the invention in the manufacture of (I) a medicament for treating or preventing infection due to Neisserial bacteria (ii) a diagnostic reagent for detecting the presence of Neisserial bacteria or of antibodies raised against Neisserial bacteria or (iii) for raising antibodies. Said Neisserial bacteria may be any species or strain (such as *N. gonorrhoeae*) but are preferably *N. meningitidis*, especially strain B or strain C.

The invention also provides a method of treating a patient, comprising administering to the patient a therapeutically effective amount of nucleic acid, protein, and/or antibody according to the invention.

According to further aspects, the invention provides various processes.

A process for producing proteins of the invention is provided, comprising the step of culturing a host cell according to the invention under conditions which induce protein expression.

A process for detecting polynucleotides of the invention is provided, comprising the steps of: (a) contacting a nucleic probe according to the invention with a biological sample under hybridizing conditions to form duplexes; and (b) detecting said duplexes.

A process for detecting proteins of the invention is provided, comprising the steps of: (a) contacting an antibody according to the invention with a biological sample under conditions suitable for the formation of an antibody-antigen complexes; and (b) detecting said complexes.

A summary of standard techniques and procedures which may be employed in order to perform the invention (eg. to utilize the disclosed sequences for vaccination or diagnostic purposes) is attached as an Appendix to the application. This summary is not a limitation on the invention but, rather, gives examples that may be used, but are not required.

Having now generally described the invention, the same will be more readily understood through reference to the following examples which are provided by way of illustration, and are not intended to be limiting of the present invention, unless specified.

Methodology—Summary of Standard Procedures and Techniques.

General

This invention provides *Neisseria meningitidis* menB nucleotide sequences, amino acid sequences encoded therein. With these disclosed sequences, nucleic acid probe assays and expression cassettes and vectors can be produced. The expression vectors can be transformed into host cells to produce proteins. The purified or isolated polypeptides (which may also be chemically synthesized) can be used to produce antibodies to detect menB proteins. Also, the host cells or extracts can be utilized for biological assays to isolate agonists or antagonists. In addition, with these sequences one can search to identify open reading frames and identify amino acid sequences. The proteins may also be used in immunogenic compositions, antigenic compositions and as vaccine components.

The practice of the present invention will employ, unless otherwise indicated, conventional techniques of molecular biology, microbiology, recombinant DNA, and immunology, which are within the skill of the art. Such techniques are explained fully in the literature e.g., Sambrook *Molecular Cloning; A Laboratory Manual, Second Edition* (1989); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology, Volumes I-IV* (D. M. Weir and C. C. Blackwell eds 1986).

Standard abbreviations for nucleotides and amino acids are used in this specification.

All publications, patents, and patent applications cited herein are incorporated in full by reference.

Expression Systems

The *Neisseria* menB nucleotide sequences can be expressed in a variety of different expression systems; for example those used with mammalian cells, plant cells, baculoviruses, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (e.g., structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation (Sambrook et al. (1989) "Expression of Cloned Genes in Mammalian Cells." In *Molecular Cloning: A Laboratory Manual, 2nd ed.*).

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallothionein gene, also provide useful promoter sequences. Expression may be either constitutive or regulated (inducible). Depending on the promoter selected, many promotes may be inducible using known substrates, such as the use of the mouse mammary tumor virus (MMTV) promoter with the glucocorticoid responsive element (GRE) that is induced by glucocorticoid in hormone-responsive transformed cells (see for example, U.S. Pat. No. 5,783,681).

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter (Maniatis et al. (1987) *Science* 236:1237; Alberts et al. (1989) *Molecular Biology of the Cell,* 2nd ed.). Enhancer elements derived from viruses may be particularly useful, because they usually have a broader host range. Examples include the SV40 early gene enhancer (Dijkema et al (1985) *EMBO J.* 4:761) and the enhancer/promoters derived from the long terminal repeat (LTR) of the Rous Sarcoma Virus (Gorman et al. (1982b)

*Proc. Natl. Acad. Sci.* 79:6777) and from human cytomegalovirus (Boshart et al. (1985) *Cell* 41:521). Additionally, some enhancers are regulatable and become active only in the presence of an inducer, such as a hormone or metal ion (Sassone-Corsi and Borelli (1986) *Trends Genet.* 2:215; Maniatis et al. (1987) *Science* 236:1237).

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus tripartite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation (Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105). These sequences direct the transcription of an mRNA which can be translated into the polypeptide encoded by the DNA. Examples of transcription terminator/polyadenylation signals include those derived from SV40 (Sambrook et al (1989) "Expression of cloned genes in cultured mammalian cells." In *Molecular Cloning: A Laboratory Manual*).

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (e.g., plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 (Gluzman (1981) *Cell* 23:175) or polyomavirus, replicate to extremely high copy number in the presence of the appropriate viral T antigen. Additional examples of mammalian replicons include those derived from bovine papillomavirus and Epstein-Barr virus. Additionally, the replicon may have two replication systems, thus allowing it to be maintained, for example, in mammalian cells for expression and in a prokaryotic host for cloning and amplification. Examples of such mammalian-bacteria shuttle vectors include pMT2 (Kaufman et al. (1989) *Mol. Cell. Biol.* 9:946) and pHEBO (Shimizu et al. (1986) *Mol. Cell. Biol.* 6:1074).

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (e.g., Hep G2), and a number of other cell lines.

ii. Plant Cellular Expression Systems

There are many plant cell culture and whole plant genetic expression systems known in the art. Exemplary plant cellular genetic expression systems include those described in patents, such as: U.S. Pat. No. 5,693,506; U.S. Pat. No. 5,659,122; and U.S. Pat. No. 5,608,143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:33-40 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., Nucleic Acids Research 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*, Malcolm B. Wilkins, ed., 1984 Pitman Publishing Limited, London, pp. 21-52. References that describe other metabolically-regulated genes: Sheen, *Plant Cell,* 2:1027-1038 (1990); Maas et al., *EMBO J.* 9:3447-3452 (1990); Benkel and Hickey, *Proc. Natl. Acad. Sci.* 84:1337-1339 (1987)

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr,* 11(2):165-185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet,* 202:179-185, 1985. The genetic material may also be transferred into the plant cell by using polyethylene glycol, Krens, et al., *Nature,* 296, 72-74, 1982. Another method of introduction of nucleic acid segments is high velocity ballistic penetration by small particles with the nucleic acid either within the matrix of small beads or particles, or on the surface, Klein, et al., *Nature,* 327, 70-73, 1987 and Knudsen and Muller, 1991, *Planta,* 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA,* 79, 1859-1863, 1982.

The vector may also be introduced into the plant cells by electroporation. (Fromm et al., *Proc. Natl. Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum,* and *Datura.*

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MAXBAC™" kit). These techniques are generally known to those skilled in the art and fully described in Summers and Smith, *Texas Agricultural Experiment Station Bulletin* No. 1555 (1987) (hereinafter "Summers and Smith").

Prior to inserting the DNA sequence encoding the protein into the baculovirus genome, the above described components, comprising a promoter, leader (if desired), coding sequence of interest, and transcription termination sequence, are usually assembled into an intermediate transplacement construct (transfer vector). This construct may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extrachromosomal element (e.g., plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.*, 42:177) and a prokaryotic ampicillin-resistance (amp) gene and origin of replication for selection and propagation in *E. coli*.

Baculovirus transfer vectors usually contain a baculovirus promoter. A baculovirus promoter is any DNA sequence capable of binding a baculovirus RNA polymerase and initiating the downstream (5' to 3') transcription of a coding sequence (e.g., structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene*, 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human (alpha) α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA*, 82:8404; mouse IL-3, (Miyajima et al., (1987) *Gene* 58:273; and human glucocerebrosidase, Martin et al. (1988) *DNA*, 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 μm in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. *Current Protocols in Microbiology* Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda*, and *Tri-*

*choplusia ni* (PCT Pub. No. WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) In Vitro *Cell. Dev. Biol.* 25:225).

Cells and cell culture media are commercially available for both direct and fusion expression of heterologous polypeptides in a baculovirus/expression system; cell culture technology is generally known to those skilled in the art. See, e.g., Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, e.g., HPLC, affinity chromatography, ion exchange chromatography, etc.; electrophoresis; density gradient centrifugation; solvent extraction, or the like. As appropriate, the product may be further purified, as required, so as to remove substantially any insect proteins which are also secreted in the medium or result from lysis of insect cells, so as to provide a product which is at least substantially free of host debris, e.g., proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iv. Bacterial Systems

Bacterial expression techniques are known in the art. A bacterial promoter is any DNA sequence capable of binding bacterial RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) (Raibaud et al. (1984) *Annu. Rev. Genet.* 18:173). Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) (Chang et al. (1977) *Nature* 198:1056), and maltose. Additional examples include promoter sequences derived from biosynthetic enzymes such as tryptophan (trp) (Goeddel et al. (1980) *Nuc. Acids Res.* 8:4057; Yelverton et al. (1981) *Nucl. Acids Res.* 9:731; U.S. Pat. No. 4,738,921; EPO Publ. Nos. 036 776 and 121 775). The beta-lactamase (bla) promoter system (Weissmann (1981) "The cloning of interferon and other mistakes." In *Interferon* 3 (ed. I. Gresser)), bacteriophage lambda PL (Shimatake et al. (1981) *Nature* 292:128) and T5 (U.S. Pat. No. 4,689,406) promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter (U.S. Pat. No. 4,551,433). For example, the tac promoter is a hybrid trp-lac promoter comprised of both trp promoter and lac operon sequences that is regulated by the lac repressor (Amann et al. (1983) *Gene* 25:167; de Boer et al. (1983) *Proc. Natl. Acad. Sci.* 80:21). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) *J. Mol. Biol.* 189:113; Tabor et al. (1985) *Proc Natl. Acad. Sci.* 82:1074). In addition, a hybrid promoter can also be comprised of a bacteriophage promoter and an *E. coli* operator region (EPO Publ. No. 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon (Shine et al. (1975) *Nature* 254:34). The SD sequence is thought to promote binding of mRNA to the ribosome by the pairing of bases between the SD sequence and the 3' end of *E. coli* 16S rRNA (Steitz et al. (1979) "Genetic signals and nucleotide sequences in messenger RNA." In *Biological Regulation and Development: Gene Expression* (ed. R. F. Goldberger)). To express eukaryotic genes and prokaryotic genes with weak ribosome-binding site, it is often necessary to optimize the distance between the SD sequence and the ATG of the eukaryotic gene (Sambrook et al. (1989) "Expression of cloned genes in *Escherichia coli*." In *Molecular Cloning: A Laboratory Manual*).

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo or in vitro incubation with a bacterial methionine N-terminal peptidase (EPO Publ. No. 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene (Nagai et al. (1984) *Nature* 309:810). Fusion proteins can also be made with sequences from the lacZ (Jia et al. (1987) *Gene* 60:197), trpE (Allen et al. (1987) *J. Biotechnol.* 5:93; Makoff et al. (1989) *J. Gen. Microbiol.* 135:11), and Chey (EPO Publ. No. 324 647) genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (e.g. ubiquitin specific processing-protease) to cleave the ubiquitin from the foreign protein. Through this method, native foreign protein can be isolated (Miller et al. (1989) *Bio/Technology* 7:698).

Alternatively, foreign proteins can also be secreted from the cell by creating chimeric DNA molecules that encode a fusion protein comprised of a signal peptide sequence fragment that provides for secretion of the foreign protein in bacteria (U.S. Pat. No. 4,336,336). The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) (Masui et al. (1983), in: *Experimental Manipulation of Gene Expression*; Ghrayeb et al. (1984) *EMBO J.* 3:2437) and the *E. coli* alkaline phosphatase signal sequence (phoA) (Oka et al. (1985) *Proc. Natl. Acad. Sci.* 82:7212). As an additional example, the signal sequence of the alpha-amylase gene from various *Bacillus* strains can be used to secrete heterologous proteins from *B. subtilis* (Palva et al. (1982) *Proc. Natl. Acad. Sci. USA* 79:5582; EPO Publ. No. 244 042).

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (e.g., plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EPO Publ. No. 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline (Davies et al. (1978) *Annu. Rev. Microbiol.* 32:469). Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* (Palva et al. (1982) *Proc. Natl. Acad. Sci. USA* 79:5582; EPO Publ. Nos. 036 259 and 063 953; PCT Publ. No. WO 84/04541), *Escherichia coli* (Shimatake et al. (1981) *Nature* 292:128; Amann et al. (1985) *Gene* 40:183; Studier et al. (1986) *J. Mol. Biol.* 189:113; EPO Publ. Nos. 036 776, 136 829 and 136 907), *Streptococcus cremoris* (Powell et al. (1988) *Appl. Environ. Microbiol.* 54:655); *Streptococcus lividans* (Powell et al. (1988) *Appl. Environ. Microbiol.* 54:655), *Streptomyces lividans* (U.S. Pat. No. 4,745,056).

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. (See e.g., use of *Bacillus*: Masson et al. (1989) *FEMS Microbiol. Lett.* 60:273; Palva et al. (1982) *Proc. Natl. Acad. Sci. USA* 79:5582; EPO Publ. Nos. 036 259 and 063 953; PCT Publ. No. WO 84/04541; use of *Campylobacter*: Miller et al. (1988) *Proc. Natl. Acad. Sci.* 85:856; and Wang et al. (1990) *J. Bacteriol.* 172:949; use of *Escherichia coli*: Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; use of *Lactobacillus*: Chassy et al. (1987) *FEMS Microbiol. Lett.* 44:173; use of *Pseudomonas*: Fiedler et al. (1988) *Anal. Biochem* 170:38; use of *Staphylococcus*: Augustin et al. (1990) *FEMS Microbiol. Lett.* 66:203; use of *Streptococcus*: Barany et al. (1980) *J. Bacteriol.* 144:698; Harlander (1987) "Transformation of *Streptococcus* lactis by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412.

v. Yeast Expression

Yeast expression systems are also known to one of ordinary skill in the art. A yeast promoter is any DNA sequence capable of binding yeast RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EPO Publ. No. 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO Publ. No. 329 203). The yeast PHO5 gene, encoding acid phosphatase, also provides useful promoter sequences (Myanohara et al. (1983) *Proc. Natl. Acad. Sci. USA* 80:1).

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876, 197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EPO Publ. No. 164 556). Furthermore, a yeast promoter can include naturally occurring promoters of non-yeast origin that have the ability to bind yeast RNA polymerase and initiate transcription. Examples of such promoters include, inter alia, (Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109).

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, plant, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See e.g., EPO Publ. No. 196056. Another example is a ubiquitin fusion protein. Such a fusion protein is made with the ubiquitin region that preferably retains a site for a processing enzyme (e.g. ubiquitin-specific processing protease) to cleave the ubiquitin from the foreign protein. Through this method, therefore, native foreign protein can be isolated (e.g., WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EPO Publ. No. 012 873; JPO Publ. No. 62:096,086) and the A-factor gene (U.S. Pat. No. 4,588,684). Alternatively, leaders of non-yeast origin, such as an interferon leader, exist that also provide for secretion in yeast (EPO Publ. No. 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EPO Publ. No. 324 274). Additional leaders employing an alpha-factor leader fragment that provides for secretion include hybrid alpha-factor leaders made with a presequence of a first yeast, but a pro-region from a second yeast alphafactor. (See e.g., PCT Publ. No. WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (e.g., plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 (Botstein et al. (1979) *Gene* 8:17-24), pC1/1 (Brake et al. (1984) *Proc. Natl. Acad. Sci USA* 81:4642-4646), and YRp17 (Stinchcomb et al. (1982) *J. Mol. Biol.* 158:157). In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See e.g., Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome (Orr-Weaver et al. (1983) *Methods in Enzymol*. 101:228-245). An integrating vector may be directed to a specific locus in yeast by selecting the appropriate homologous sequence for inclusion in the vector. See Orr-Weaver et al., supra. One or more expression construct may integrate, possibly affecting levels of recombinant protein produced (Rine et al. (1983) *Proc. Natl. Acad. Sci. USA* 80:6750). The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions (Butt et al. (1987) *Microbiol, Rev*. 51:351).

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors and methods of introducing exogenous DNA into yeast hosts have been developed for, inter alia, the following yeasts: *Candida albicans* (Kurtz, et al. (1986) *Mol. Cell. Biol*. 6:142); *Candida maltosa* (Kunze, et al. (1985) *J. Basic Microbiol*. 25:141); *Hansenula polymorpha* (Gleeson, et al. (1986) *J. Gen. Microbiol*. 132:3459; Roggenkamp et al. (1986) *Mol. Gen. Genet*. 202:302); *Kluyveromyces fragilis* (Das, et al. (1984) *J. Bacteriol*. 158:1165); *Kluyveromyces lactis* (De Louvencourt et al. (1983) *J. Bacteriol*. 154:737; Van den Berg et al. (1990) *Bio/Technology* 8:135); *Pichia guillerimondii* (Kunze et al. (1985) *J. Basic Microbiol*. 25:141); *Pichia pastoris* (Cregg, et al. (1985) *Mol. Cell. Biol*. 5:3376; U.S. Pat. Nos. 4,837,148 and 4,929,555); *Saccharomyces cerevisiae* (Hinnen et al. (1978) *Proc. Natl. Acad. Sci. USA* 75:1929; Ito et al. (1983) *J. Bacteriol*. 153:163); *Schizosaccharomyces pombe* (Beach and Nurse (1981) *Nature* 300:706); and *Yarrowia lipolytica* (Davidow, et al. (1985) *Curr. Genet*. 10:380471 Gaillardin, et al. (1985) *Curr. Genet*. 10:49).

Methods of introducing exogenous DNA into yeast hosts are well-known in the art, and usually include either the transformation of spheroplasts or of intact yeast cells treated with alkali cations. Transformation procedures usually vary with the yeast species to be transformed. See e.g., [Kurtz et al. (1986) *Mol. Cell. Biol*. 6:142; Kunze et al. (1985) *J. Basic Microbiol*. 25:141; *Candida*]; [Gleeson et al. (1986) *J. Gen. Microbiol*. 132:3459; Roggenkamp et al. (1986) *Mol. Gen. Genet*. 202:302; *Hansenula*]; [Das et al. (1984) *J. Bacteriol*. 158:1165; De Louvencourt et al. (1983) *J. Bacteriol*. 154: 1165; Van den Berg et al. (1990) *Bio/Technology* 8:135; *Kluyveromyces*]; [Cregg et al. (1985) *Mol. Cell. Biol*. 5:3376; Kunze et al. (1985) *J. Basic Microbiol*. 25:141; U.S. Pat. Nos. 4,837,148 and 4,929,555; *Pichia*]; [Hinnen et al. (1978) *Proc. Natl. Acad. Sci. USA* 75; 1929; Ito et al. (1983) *J. Bacteriol*. 153:163 *Saccharomyces*]; [Beach and Nurse (1981) *Nature* 300:706; *Schizosaccharomyces*]; [Davidow et al. (1985) *Curr. Genet*. 10:39; Gaillardin et al. (1985) *Curr. Genet*. 10:49; *Yarrowia*].

DEFINITIONS

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

A "conserved" *Neisseria* amino acid fragment or protein is one that is present in a particular Neisserial protein in at least x % of *Neisseria*. The value of x may be 50% or more, e.g., 66%, 75%, 80%, 90%, 95% or even 100% (i.e. the amino acid is found in the protein in question in all *Neisseria*). In order to determine whether an amino acid is "conserved" in a particular Neisserial protein, it is necessary to compare that amino acid residue in the sequences of the protein in question from a plurality of different *Neisseria* (a reference population). The reference population may include a number of different *Neisseria* species or may include a single species. The reference population may include a number of different serogroups of a particular species or a single serogroup. A preferred reference population consists of the 5 most common *Neisseria* The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a Neisserial sequence is heterologous to a mouse host cell.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as a DNA, RNA or amino acid sequence differing from but having homology with the native or disclosed sequence. Depending on the particular sequence, the degree of homology (sequence identity) between the native or disclosed sequence and the mutant sequence is preferably greater than 50% (e.g., 60%, 70%, 80%, 90%, 95%, 99% or more) which is calculated as described above. As used herein, an "allelic variant" of a nucleic acid molecule, or region, for which nucleic acid sequence is provided herein is a nucleic acid molecule, or region, that occurs at essentially the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions. (see, for example, U.S. Pat. No. 5,753,235).

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanized antibodies, altered antibodies, univalent antibodies, Fab proteins, and single domain antibodies.

Antibodies against the proteins of the invention are useful for affinity chromatography, immunoassays, and distinguishing/identifying Neisseria menB proteins. Antibodies elicited against the proteins of the present invention bind to antigenic polypeptides or proteins or protein fragments that are present and specifically associated with strains of Neisseria meningitidis menB. In some instances, these antigens may be associated with specific strains, such as those antigens specific for the menB strains. The antibodies of the invention may be immobilized to a matrix and utilized in an immunoassay or on an affinity chromatography column, to enable the detection and/or separation of polypeptides, proteins or protein fragments or cells comprising such polypeptides, proteins or protein fragments. Alternatively, such polypeptides, proteins or protein fragments may be immobilized so as to detect antibodies bindably specific thereto.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 μg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (e.g., 1,000 g for 10 minutes). About 20-50 ml per bleed may be obtained from rabbits.

Monoclonal antibodies are prepared using the standard method of Kohler & Milstein (Nature (1975) 256:495-96), or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells that express membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (e.g., hypoxanthine, aminopterin, thymidine medium, "HAT"). The resulting hybridomas are plated by limiting dilution, and are assayed for the production of antibodies which bind specifically to the immunizing antigen (and which do not bind to unrelated antigens). The selected MAb-secreting hybridomas are then cultured either in vitro (e.g., in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}P$ and $^{125}I$), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}I$ may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}I$, or with an anti-biotin MAb labeled with HRP. Other permutations and possibilities will be readily apparent to those of ordinary skill in the art, and are considered as equivalents within the scope of the instant invention.

Antigens, immunogens, polypeptides, proteins or protein fragments of the present invention elicit formation of specific binding partner antibodies. These antigens, immunogens, polypeptides, proteins or protein fragments of the present invention comprise immunogenic compositions of the present invention. Such immunogenic compositions may further comprise or include adjuvants, carriers, or other compositions that promote or enhance or stabilize the antigens, polypeptides, proteins or protein fragments of the present invention. Such adjuvants and carriers will be readily apparent to those of ordinary skill in the art.

Pharmaceutical Compositions

Pharmaceutical compositions can comprise (include) either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature, when given to a patient that is febrile. The precise effective amount for a subject will depend upon the subject's size and health, the nature and extent of the condition, and the therapeutics or combination of therapeutics selected for administration.

Thus, it is not useful to specify an exact effective amount in advance. However, the effective amount for a given situation can be determined by routine experimentation and is within the judgment of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal and transcutaneous applications, needles, and gene guns or hyposprays. Dosage treatment may be a single dose schedule or a multiple dose schedule.

Vaccines

Vaccines according to the invention may either be prophylactic (i.e., to prevent infection) or therapeutic (i.e., to treat disease after infection).

Such vaccines comprise immunizing antigen(s) or immunogen(s), immunogenic polypeptide, protein(s) or protein fragments, or nucleic acids (e.g., ribonucleic acid or deoxyribonucleic acid), usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the immunogen or antigen may be conjugated to a bacterial toxoid, such as a toxoid from diphtheria, tetanus, cholera, *H. pylori*, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59 (PCT Publ. No. WO 90/14837), containing 5% Squalene, 0.5% TWEEN 80™, and 0.5% SPAN 85™ (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% PLURONIC™-blocked polymer L121, and thr-MDP (see below) either microfluidized into a submicron emulsion or vortexed to generate a larger particle size emulsion, and (c) RIBI™ adjuvant system (RAS), (Ribi Immunochem, Hamilton, Mont.) containing 2% Squalene, 0.2% TWEEN 80™, and one or more bacterial cell wall components from the group consisting of monophosphorylipid A (MPL), trehalose dimycolate (TDM), and cell wall skeleton (CWS), preferably MPL+CWS (DETOX™); (3) saponin adjuvants, such as STIMULON™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (e.g., IL-1, IL-2, IL-4, IL-5, IL-6, IL-7, IL-12, etc.), interferons (e.g., gamma interferon), macrophage colony stimulating factor (M-CSF), tumor necrosis factor (TNF), etc; and (6) other substances that act as immunostimulating agents to enhance the effectiveness of the composition. Alum and MF59 are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-huydroxyphosphoryloxy)-ethylamine (MTP-PE), etc.

The vaccine compositions comprising immunogenic compositions (e.g., which may include the antigen, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles. Alternatively, vaccine compositions comprising immunogenic compositions may comprise an antigen, polypeptide, protein, protein fragment or nucleic acid in a pharmaceutically acceptable carrier.

More specifically, vaccines comprising immunogenic compositions comprise an immunologically effective amount of the immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (e.g., nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

Typically, the vaccine compositions or immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

The immunogenic compositions are conventionally administered parenterally, e.g., by injection, either subcutaneously or intramuscularly. Additional formulations suitable for other modes of administration include oral and pulmonary formulations, suppositories, and transdermal and transcutaneous applications. Dosage treatment may be a single dose schedule or a multiple dose schedule. The vaccine may be administered in conjunction with other immunoregulatory agents.

As an alternative to protein-based vaccines, DNA vaccination may be employed (e.g., Robinson & Torres (1997) *Seminars in Immunology* 9:271-283; Donnelly et al. (1997) *Annu Rev Immunol* 15:617-648).

Gene Delivery Vehicles

Gene therapy vehicles for delivery of constructs, including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51-64; Kimura (1994) *Human Gene Therapy* 5:845-852; Connelly (1995) *Human Gene Therapy* 6:185-193; and Kaplitt (1994) *Nature Genetics* 6:148-153.

Retroviral vectors are well known in the art, including B, C and D type retroviruses, xenotropic retroviruses (for example, NZB-X1, NZB-X2 and NZB9-1 (see O'Neill (1985) *J. Virol.* 53:160) polytropic retroviruses e.g., MCF and MCF-MLV (see Kelly (1983) *J. Virol.* 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (e.g., HT1080 cells) or mink parent cell lines, which eliminates inactivation in human serum.

Preferred retroviruses for the construction of retroviral gene therapy vectors include Avian Leukosis Virus, Bovine Leukemia Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. No. 5,219,740, U.S. Pat. No. 4,405,712, U.S. Pat. No. 4,861,719, U.S. Pat. No. 4,980,289, U.S. Pat. No. 4,777,127, U.S. Pat. No. 5,591,624. See also Vile (1993) *Cancer Res* 53:3860-3864; Vile (1993) *Cancer Res* 53:962-967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (i.e., there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. No. 5,354,678, U.S. Pat. No. 5,173,414, U.S. Pat. No. 5,139,941, and U.S. Pat. No. 5,252,479.

The gene therapy vectors comprising sequences of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3::pgC-lacZ described in Fink (1992) *Human Gene Therapy* 3:11-19 and HSV 7134, 2 RH 105 and GAL4 described in EP 0453242 (Breakefield), and those deposited with the ATCC as accession numbers ATCC VR-977 and ATCC VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. No. 5,091,309 and U.S. Pat. No. 5,217,879 are employable. Such alpha viruses may be obtained from depositories or collections such as the ATCC or isolated from known sources using commonly available techniques. Preferably, alphavirus vectors with reduced cytotoxicity are used (see U.S. Ser. No. 08/679,640).

DNA vector systems such as eukarytic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem* L401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569: 86, Flexner (1990) *Vaccine* 8:17; in U.S. Pat. No. 4,603,112 and U.S. Pat. No. 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and Nature (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed to transform a host cell. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033.

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a tumor or lesion. Other modes of administration include oral and pulmonary administration, suppositories, and transdermal applications, needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of *plasmodium falciparum* known as RII.

B. Hormones, Vitamins, Etc.

Other groups that can be included are, for example: hormones, steroids, androgens, estrogens, thyroid hormone, or vitamins, folic acid.

C. Polyalkylenes, Polysaccharides, Etc.

Also, polyalkylene glycol can be included with the desired polynucleotides or polypeptides. In a preferred embodiment, the polyalkylene glycol is polyethlylene glycol. In addition, mono-, di-, or polysaccharides can be included. In a preferred embodiment of this aspect, the polysaccharide is dextran or DEAE-dextran. Also, chitosan and poly(lactide-co-glycolide)

D. Lipids, and Liposomes

The desired polynucleotide or polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide or polypeptide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta*. 1097:1-17; Straubinger (1983) *Meth. Enzymol.* 101: 512-527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci. USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N[1-2,3-dioleyloxy)propyl]-N,N,N-triethylammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978) *Proc. Natl. Acad. Sci. USA*

75:4194-4198; WO90/11092 for a description of the synthesis of DOTAP (1,2-bis(oleoyloxy)-3-(trimethylammonio) propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide or polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C, and E, over time these lipoproteins lose A and acquire C and E apoproteins. VLDL comprises A, B, C, and E apoproteins, LDL comprises apoprotein B; and HDL comprises apoproteins A, C, and E.

The amino acid of these apoproteins are known and are described in, for example, Breslow (1985) *Annu Rev. Biochem* 54:699; Law (1986) *Adv. Exp Med. Biol.* 151:162; Chen (1986) *J Biol Chem* 261:12918; Kane (1980) *Proc Natl Acad Sci USA* 77:2465; and Utermann (1984) *Hum Genet* 65:232.

Lipoproteins contain a variety of lipids including, triglycerides, cholesterol (free and esters), and phopholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J Clin. Invest* 64:743-750.

Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443.

Lipoproteins can also be purchased from commercial suppliers, such as Biomedical Technologies, Inc., Stoughton, Mass., USA.

Further description of lipoproteins can be found in Zuckermann et al., PCT. Appln. No. US97/14465.

F. Polycationic Agents

Polycationic agents can be included, with or without lipoprotein, in a composition with the desired polynucleotide or polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic Polycationic Agents

Synthetic polycationic agents which are useful include, for example, DEAE-dextran, polybrene. LIPOFECTIN™, and LIPOFECTAMINE™ are monomers that form polycationic complexes when combined with polynucleotides or polypeptides.

Immunodiagnostic Assays

Neisserial antigens of the invention can be used in immunoassays to detect antibody levels (or, conversely, anti-Neisserial antibodies can be used to detect antigen levels). Immunoassays based on well defined, recombinant antigens can be developed to replace invasive diagnostics methods. Antibodies to Neisserial proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known;

examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 μg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 μg of yeast DNA, blotting for two hours, and hybridizing for 4-8 hours with a probe of $10^8$ cpm/μg. For a single-copy mammalian gene a conservative approach would start with 10 μg of DNA, blot overnight, and hybridize overnight in the presence of 10% dextran sulfate using a probe of greater than $10^8$ cpm/μg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm = 81 + 16.6(\log_{10} Ci) + 0.4[\% (G+C)] - 0.6(\% \text{formamide}) - 600/n - 1.5(\% \text{mismatch}).$$

where Ci is the salt concentration (monovalent ions) and n is the length of the hybrid in base pairs (slightly modified from Meinkoth & Wahl (1984) Anal. Biochem. 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the Neisserial nucleotide sequences of the invention (including both sense and antisense strands). Though many different nucleotide sequences will encode the amino acid sequence, the native Neisserial sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the Neisserial sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional Neisserial sequence may also be helpful as a label to detect the formed duplex. For example, a non-complementary nucleotide sequence may be attached to the 5' end of the probe, with the remainder of the probe sequence being complementary to a Neisserial sequence. Alternatively, non-complementary bases or longer sequences can be interspersed into the probe, provided that the probe sequence has sufficient complementarity with the Neisserial sequence in order to hybridize therewith and thereby form a duplex which can be detected.

The exact length and sequence of the probe will depend on the hybridization conditions, such as temperature, salt condition and the like. For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated eg. backbone modifications, such as phosphorothioates or methylphosphonates, can be used to increase in vivo half-life, alter RNA affinity, increase nuclease resistance etc. [eg. see Agrawal & Iyer (1995) *Curr Opin Biotechnol* 6:12-19; Agrawal (1996) *TIBTECH* 14:376-387]; analogues such as peptide nucleic acids may also be used [eg. see Corey (1997) *TIBTECH* 15:224-229; Buchardt et al. (1993) *TIBTECH* 11:384-386].

One example of a nucleotide hybridization assay is described by Urdea et al. in international patent application WO92/02526 [see also U.S. Pat. No. 5,124,246].

Alternatively, the polymerase chain reaction (PCR) is another well-known means for detecting small amounts of target nucleic acids. The assay is described in: Mullis et al. [*Meth. Enzymol.* (1987) 155: 335-350]; U.S. Pat. No. 4,683, 195; and U.S. Pat. No. 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired Neisserial sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the Neisserial sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

EXAMPLES

The examples describe nucleic acid sequences which have been identified in *N. meningitidis*, and *N. gonorrhoeae* along with their respective and putative translation products. Not all of the nucleic acid sequences are complete ie. they encode less than the full-length wild-type protein.

The examples are generally in the following format:

a nucleotide sequence which has been identified in *N. meningitidis* the putative translation product of said *N. meningitidis* sequence a computer analysis of said translation product based on database comparisons a corresponding nucleotide sequence identified from *N. gonorrhoeae* the putative translation product of said *N. gonorrhoeae* sequence a comparison of the percentage of identity between the translation product of the *N. meningitidis* sequence and the *N. gonorrhoeae* sequence a description of the characteristics of the protein which indicates that it might be suitably antigenic or immunogenic.

Sequence comparisons were performed at NCBI (ncbi.nlm.nih.gov) using the algorithms BLAST, BLAST2, BLASTn, BLASTp, tBLASTn, BLASTx, & tBLASTx [eg. see also Altschul et al. (1997) Gapped BLAST and PSI-BLAST: a new generation of protein database search programs. *Nucleic Acids Research* 25:2289-3402]. Searches were performed against the following databases: non-redundant GenBank+EMBL+DDBJ+PDB sequences and non-redundant GenBank CDS translations+PDB+SwissProt+SP-update+PIR sequences.

Dots within nucleotide sequences represent nucleotides which have been arbitrarily introduced in order to maintain a reading frame. In the same way, double-underlined nucleotides were removed. Lower case letters represent ambiguities which arose during alignment of independent sequencing reactions (some of the nucleotide sequences in the examples are derived from combining the results of two or more experiments).

Nucleotide sequences were scanned in all six reading frames to predict the presence of hydrophobic domains using an algorithm based on the statistical studies of Esposti et al. [Critical evaluation of the hydropathy of membrane proteins (1990) *Eur J Biochem* 190:207-219]. These domains represent potential transmembrane regions or hydrophobic leader sequences.

Open reading frames were predicted from fragmented nucleotide sequences using the program ORFFINDER (NCBI).

Underlined amino acid sequences indicate possible transmembrane domains or leader sequences in the ORFs, as predicted by the PSORT algorithm (psort.nibb.ac.jp). Functional domains were also predicted using the MOTIFS program (GCG Wisconsin & PROSITE).

For each of the following examples: based on the presence of a putative leader sequence and/or several putative transmembrane domains (single-underlined) in the gonococcal protein, it is predicted that the proteins from *N. meningitidis* and *N. gonorrhoeae*, and their respective epitopes, could be useful antigens or immunogenic compositions for vaccines or diagnostics.

The standard techniques and procedures which may be employed in order to perform the invention (e.g. to utilize the disclosed sequences for vaccination or diagnostic purposes) were summarized above. This summary is not a limitation on the invention but, rather, gives examples that may be used, but are not required.

In particular, the following methods were used to express, purify and biochemically characterize the proteins of the invention.

Chromosomal DNA Preparation

*N. meningitidis* strain 2996 was grown to exponential phase in 100 ml of GC medium, harvested by centrifugation, and resuspended in 5 ml buffer (20% Sucrose, 50 mM Tris- HCl, 50 mM EDTA, pH 8.0). After 10 minutes incubation on ice, the bacteria were lysed by adding 10 ml lysis solution (50 mM NaCl, 1% Na-SARKOSYL™, 50 µg/ml Proteinase K), and the suspension was incubated at 37° C. for 2 hours. Two phenol extractions (equilibrated to pH 8) and one CHCl$_3$/isoamylalcohol (24:1) extraction were performed. DNA was precipitated by addition of 0.3M sodium acetate and 2 volumes ethanol, and was collected by centrifugation. The pellet was washed once with 70% ethanol and redissolved in 4.0 ml TE buffer (10 mM Tris-HCl, 1 mM EDTA, pH 8). The DNA concentration was measured by reading the OD at 260 nm.

Oligonucleotide Design

Synthetic oligonucleotide primers were designed on the basis of the coding sequence of each ORF, using (a) the meningococcus B sequence when available, or (b) the gonococcus/meningococcus A sequence, adapted to the codon preference usage of meningococcus as necessary. Any predicted signal peptides were omitted, by designing the 5' primers to sequence immediately downstream from the predicted leader sequence.

For most ORFs, the 5' primers included two restriction enzyme recognition sites (BamHI-NdeI, BamHI-NheI, EcoRI-NdeI or EcoRI-NheI), depending on the restriction pattern of the gene of interest. The 3' primers included a XhoI or a HindIII restriction site (table 1). This procedure was established in order to direct the cloning of each amplification product (corresponding to each ORF) into two different expression systems: pGEX-KG (using either BamHI-XhoI, BamHI-HindIII, EcoRI-XhoI, or EcoRI-HindIII), and pET21b+ (using either NdeI-XhoI, NheI-XhoI, NdeI-HindIII, or NheI-HindIII).

```
5'-end primer tail:
CGCGGATCCCATATG            (BamHI-NdeI)

CGCGGATCCGCTAGC            (BamHI-NheI)

CCGGAATTCTAGATATC          (EcoRI-NdeI)

CCGGAATTCTAGCTAGC          (EcoRI-NheI)

3'-end primer tail:
CCCGCTCGAG                 (XhoI)

CCCGCTCGAG                 (HindIII)
```

For cloning ORFs into the pGEX-His Vector, the 5' and 3' primers contained only one restriction enzyme site (EcoRI, KpnI or SalI for the 5' primers and PstI, XbaI, SphI or SalI for the 3' primers). Again restriction sites were chosen according to the particular restriction pattern of the gene (table 1).

```
5'-end primer tail:
(AAA)AAAGAATTC             (EcoRI)

(AAA)AAAGGATCC             (KpnI)

3'-end primer tail:
(AAA)AAACTGCAG             (PstI)

(AAA)AAATCTAGA             (XbaI)

5' or 3'-end primer tail:
AAAGCATGC                  (SphI)

AAAAAAGAATCC               (PstI)
```

As well as containing the restriction enzyme recognition sequences, the primers included nucleotides which hybridized to the sequence to be amplified. The melting temperature depended on the number and type of hybridizing nucleotides in the whole primer, and was determined for each primer using the formulae:

$$Tm=4(G+C)+2(A+T) \text{ (tail excluded)}$$

$$T_m=64.9+0.41(\% \ GC)-600/N \text{ (whole primer)}$$

The melting temperature of the selected oligonucleotides were usually 65-70° C. for the whole oligo and 50-55° C. for the hybridising region alone.

Table 1 shows the forward and reverse primers used for each amplification. In certain cases, the sequences of the primer does not match exactly the sequence of the predicted ORF. This is because when initial amplifications were performed, the complete 5' and/or 3' sequences for some meningococcal B ORFs were not be known. However, the corresponding sequences had been identified in Gonococcus or in Meningococcus A. Hence, when the Meningococcus B sequence was incomplete or uncertain, Gonococcus or in Meningococcus A sequences were used as the basis for the primer design. These sequences were altered to take account of codon preference. It can be appreciated that, once the complete sequence is identified, this approach will no longer be necessary.

Oligonucleotides were synthesized using a Perkin Elmer 394 DNA/RNA SYNTHESIZER™, eluted from the columns in 2.0 ml NH$_4$OH, and deprotected by 5 hours incubation at 56° C. The oligos were precipitated by addition of 0.3M Na-Acetate and 2 volumes ethanol. The samples were centrifuged and the pellets resuspended in either 100 µl or 1.0 ml of water. The OD$_{260}$ was determined using a Perkin Elmer LAMBDA BIO™ spectophotometer and the concentration adjusted to 2-10 pmol/µl.

Amplification

The standard PCR protocol was as follows: 50-200 ng of genomic DNA was used as a template in the presence of 20-40 µM of each oligonucleotide primer, 400-800 µM dNTPs solution, 1×PCR buffer (including 1.5 mM MgCl$_2$), 2.5 units TaqI DNA polymerase (using Perkin-Elmer AMPLITAQ™, GIBCO Platinum, Pwo DNA polymerase, or Tahara Shuzo Taq polymerase). In some cases, PCR was optimised by the addition of 100 of DMSO or 500 of 2M Betaine.

After a hot start (adding the polymerase during a preliminary 3 minute incubation of the whole mix at 95° C.), each sample underwent a two-step amplification. The first 5 cycles were performed using the hybridization temperature that excluded the restriction enzyme tail of the primer (see above). This was followed by 30 cycles using the hybridization temperature calculated for the whole length oligos. The cycles were followed by a final 10 minute extension step at 72° C. The standard cycles were as follows:

|  | Denaturation | Hybridisation | Elongation |
|---|---|---|---|
| First 5 cycles | 30 seconds 95° C. | 30 seconds 50-55° C. | 30-60 seconds 72° C. |
| Last 30 cycles | 30 seconds 95° C. | 30 seconds 65-70° C. | 30-60 seconds 72° C. |

The elongation time varied according to the length of the ORF to be amplified. Amplifications were performed using either a 9600 or a 2400 Perkin Elmer GeneAmp PCR System. To check the results, 1/10 of the amplification volume was loaded onto a 1-1.5% (w/v) agarose gel and the size of each amplified fragment compared with a DNA molecular weight marker.

The amplified DNA was either loaded directly on a 1% agarose gel or first precipitated with ethanol and resuspended in a volume suitable to be loaded on a 1.0% agarose gel. The DNA fragment corresponding to the band of the correct size was purified using the Qiagen Gel Extraction Kit, following the manufacturer's protocol. DNA fragments were eluted in a volume of 30 µl or 50 µl of either H2O or 10 mM Tris, pH 8.5.

Digestion of PCR Fragments

The purified DNA corresponding to the amplified fragment was double-digested with the appropriate restriction enzymes for; cloning into pET-21b+ and expressing the protein as a C-terminus His-tagged fusion, for cloning into pGEX-KG and expressing the protein as a N-terminus GST-fusion, and for cloning into pGEX-His and expressing the protein as a N-terminus GST-his tagged fusion.

Each purified DNA fragment was incubated at 37° C. for 3 hours to overnight with 20 units of appropriate restriction enzyme (New England Biolabs) in a either 30 or 40 µl in the presence of suitable digestion buffer. Digested products were purified using the QIAquick PCR purification kit (following the manufacturer's instructions) and eluted in a final volume of 30 or 50 µl of either H2O or 10 mM Tris, pH 8.5. The DNA concentration was determined by quantitative agarose gel electrophoresis (1.0% gel) in the presence of a titrated molecular weight marker.

Digestion of the Cloning Vectors (pET22B, pGEX-KG, pTRC-His A, pET21b+, pGEX-KG, and pGEX-His)

The vector pGEX-His is a modified pGEX-2T vector carrying a region encoding six histidine residues upstream of the thrombin cleavage site and containing the multiple cloning site of the vector pTRC99 (Pharmacia). 10 µg plasmid was double-digested with 50 units of each restriction enzyme in 200 µl reaction volume in the presence of appropriate buffer by overnight incubation at 37° C. After loading the whole digestion on a 1% agarose gel, the band corresponding to the digested vector was purified from the gel using the Qiagen QIAquick Gel Extraction Kit and the DNA was eluted in 50 µl of 10 mM Tris-HCl, pH 8.5. The DNA concentration was evaluated by measuring $OD_{260}$ of the sample, and adjusted to 50 µl. 1 µl of plasmid was used for each cloning procedure.

10 µg plasmid was double-digested with 50 units of each restriction enzyme in 200 reaction volume in the presence of appropriate buffer by overnight incubation at 37° C. The digest was loaded onto a 1% agarose gel and the band corresponding to the digested vector purified using the Qiagen QIAquick Gel Extraction Kit. DNA was eluted in 50 µl of 10 mM Tris-HCl, pH 8.5. The DNA concentration was evaluated by measuring $OD_{260}$ and the concentration adjusted to 50 µg/µl. 1 µl of plasmid was used for each cloning procedure.

Cloning

For some ORFs, the fragments corresponding to each ORF, previously digested and purified, were ligated in both pET22b and pGEX-KG. In a final volume of 20 µl, a molar ratio of 3:1 fragment/vector was ligated using 0.5 µl of NEB T4 DNA ligase (400 units/µl), in the presence of the buffer supplied by the manufacturer. The reaction was incubated at room temperature for 3 hours. In some experiments, ligation was performed using the Boheringer "Rapid Ligation Kit", following the manufacturer's instructions.

In order to introduce the recombinant plasmid in a suitable strain, 100 µl *E. coli* DH5 competent cells were incubated with the ligase reaction solution for 40 minutes on ice, then at 37° C. for 3 minutes, then, after adding 800 µl LB broth, again at 37° C. for 20 minutes. The cells were then centrifuged at maximum speed in an Eppendorf microfuge and resuspended in approximately 200 µl of the supernatant. The suspension was then plated on LB ampicillin (100 mg/ml).

The screening of the recombinant clones was performed by growing 5 randomly-chosen colonies overnight at 37° C. in either 2 ml (pGEX or pTC clones) or 5 ml (pET clones) LB broth+100 µg/ml ampicillin. The cells were then pelletted and the DNA extracted using the Qiagen QIAprep Spin Miniprep Kit, following the manufacturer's instructions, to a final volume of 30 µl. 5 µl of each individual miniprep (approximately 1 g) were digested with either NdeI/XhoI or BamHI/XhoI and the whole digestion loaded onto a 1-1.5% agarose gel (depending on the expected insert size), in parallel with the molecular weight marker (1 Kb DNA Ladder, GIBCO). The screening of the positive clones was made on the base of the correct insert size.

For other ORFs, the fragments corresponding to each ORF, previously digested and purified, were ligated in both pET21b+ and pGEX-KG. A molar ratio of 3:1 fragment/vector was used in a final volume of 20 µl, that included 0.5 µl of T4 DNA ligase (400 units/µl, NEB) and ligation buffer supplied by the manufacturer. The reaction was performed at room temperature for 3 hours. In some experiments, ligation was performed using the Boheringer "Rapid Ligation Kit" and the manufacturer's protocol.

Recombinant plasmid was transformed into 100 µl of competent *E. coli* DH5 or HB101 by incubating the ligase reaction solution and bacteria for 40 minutes on ice then at 37° C. for 3 minutes. This was followed by addition of 800 µl LB broth and incubation at 37° C. for 20 minutes. The cells were then centrifuged at maximum speed in an Eppendorf microfuge, resuspended in approximately 200 µl of the supernatant, and plated on LB ampicillin (100 mg/ml) agar.

Screening for recombinant clones was performed by growing 5 randomly selected colonies overnight at 37° C. in either 2.0 ml (pGEX-KG clones) or 5.0 ml (pET clones) LB broth+100 µg/ml ampicillin. Cells were pelleted and plasmid DNA extracted using the Qiagen QIAprep Spin Miniprep Kit, following the manufacturer's instructions. Approximately 1 µg of each individual miniprep was digested with the appropriate restriction enzymes and the digest loaded onto a 1-1.5% agarose gel (depending on the expected insert size), in parallel with the molecular weight marker (1 kb DNA Ladder, GIBCO). Positive clones were selected on the basis of the size of the insert.

ORFs were cloned in PGEX-His, by doubly-digesting the PC product and ligating into similarly digested vector. After cloning, recombinant plasmids were transformed into the *E. coli* host W3110. Individual clones were grown overnight at 37° C. in LB broth with 50 µg/ml ampicillin.

Certain ORFs may be cloned into the pGEX-HIS vector using EcoRI-PstI cloning sites, or EcoRI-SalI, or SalI-PstI. After cloning, the recombinant plasmids may be introduced in the *E. coli* host W3110.

Expression

Each ORF cloned into the expression vector may then be transformed into the strain suitable for expression of the recombinant protein product. 1 µl of each construct was used to transform 30 µl of *E. coli* BL21 (pGEX vector), *E. coli* TOP 10 (pTRC vector) or *E. coli* BL21-DE3 (pET vector), as described above. In the case of the pGEX-His vector, the same *E. coli* strain (W3110) was used for initial cloning and expression. Single recombinant colonies were inoculated into 2 ml LB+Amp (100 µg/ml), incubated at 37° C. overnight, then diluted 1:30 in 20 ml of LB+Amp (100 µg/ml) in 100 ml flasks, making sure that the $OD_{600}$ ranged between 0.1 and 0.15. The flasks were incubated at 30° C. into gyratory water bath shakers until OD indicated exponential growth suitable for induction of expression (0.4-0.8 OD for pET and pTRC vectors; 0.8-1 OD for pGEX and pGEX-His vectors). For the pET, pTRC and pGEX-His vectors, the protein expression was induced by addiction of 1 mM IPTG, whereas in the case of pGEX system the final concentration of IPTG was 0.2 mM. After 3 hours incubation at 30° C., the final concentration of the sample was checked by OD. In order to check expression, 1 ml of each sample was removed, centrifuged in a microfuge, the pellet resuspended in PBS, and analysed by 12% SDS-PAGE with Coomassie Blue staining. The whole sample was centrifuged at 6000 g and the pellet resuspended in PBS for further use.

GST-Fusion Proteins Large-Scale Purification.

For some ORFs, a single colony was grown overnight at 37° C. on LB+Amp agar plate. The bacteria were inoculated into 20 ml of LB+Amp liquid culture in a water bath shaker and grown overnight. Bacteria were diluted 1:30 into 600 ml of fresh medium and allowed to grow at the optimal temperature (20-37° C.) to $OD_{550}$ 0.8-1. Protein expression was induced with 0.2 mM IPTG followed by three hours incubation. The culture was centrifuged at 8000 rpm at 4° C. The supernatant was discarded and the bacterial pellet was resuspended in 7.5 ml cold PBS. The cells were disrupted by sonication on ice for 30 sec at 40 W using a Branson sonifier B-15, frozen and thawed two times and centrifuged again. The supernatant was collected and mixed with 150 µl GLUTATHIONE-SEPHAROSE 4B™ resin (Pharmacia) (previously washed with PBS) and incubated at room temperature for 30 minutes. The sample was centrifuged at 700 g for 5 minutes at 4 C. The resin was washed twice with 10 ml cold PBS for 10 minutes, resuspended in 1 ml cold PBS, and loaded on a disposable column. The resin was washed twice with 2 ml cold PBS until the flow-through reached $OD_{280}$ of 0.02-0.06. The GST-fusion protein was eluted by addition of 700 µl cold Glutathione elution buffer (10 mM reduced glutathione, 50 mM Tris-HCl) and fractions collected until the $OD_{280}$ was 0.1. 21 µl of each fraction were loaded on a 12% SDS gel using either Biorad SDS-PAGE Molecular weight standard broad range (M1) (200, 116.25, 97.4, 66.2, 45, 31, 21.5, 14.4, 6.5 kDa) or Amersham Rainbow Marker (M") (220, 66, 46, 30, 21.5, 14.3 kDa) as standards. As the MW of GST is 26 kDa, this value must be added to the MW of each GST-fusion protein.

For other ORFs, for each clone to be purified as a GST-fusion, a single colony was streaked out and grown overnight at 37° C. on LB/Amp (100 µg/ml) agar plate. An isolated colony from this plate was inoculated into 20 ml of LB/Amp (100 µg/ml) liquid medium and grown overnight at 37° C. with shaking. The overnight culture was diluted 1:30 into 600 ml of LB/Amp (100 µg/ml) liquid medium and allowed to grow at the optimal temperature (20-37° C.) until the $OD_{550}$ reached 0.6-0.8. Recombinant protein expression was induced by addition of IPTG (final concentration 0.2 mM) and the culture incubated for a further 3 hours. The bacteria were harvested by centrifugation at 8000×g for 15 min at 4° C.

The bacterial pellet was resuspended in 7.5 ml cold PBS. Cells were disrupted by sonication on ice for 30 sec at 40 W using a Branson sonifier 450 and centrifuged at 13 000×g for 30 min at 4° C. The supernatant was collected and mixed with 150 µl GLUTATHIONE-SEPHAROSE 4B™ resin (Pharmacia), previously equilibrated with PBS, and incubated at room temperature with gentle agitation for 30 min. The batch-wise preparation was centrifuged at 700×g for 5 min at 4° C. and the supernatant discarded. The resin was washed twice (batchwise) with 10 ml cold PBS for 10 min, resuspended in 1 ml cold PBS, and loaded onto a disposable column. The resin continued to be washed twice with cold PBS, until the $OD_{280nm}$ of the flow-through reached 0.02-0.01. The GST-fusion protein was eluted by addition of 700 µl cold glutathione elution buffer (10 mM reduced glutathione, 50 mM Tris-HCl pH 8.0) and fractions collected, until the $OD_{280nm}$ of the eluate indicated all the recombinant protein was obtained. 20 µl aliquots of each elution fraction were analyzed by SDS-PAGE using a 12% gel. The molecular mass of the purified proteins was determined using either the Bio-Rad broad range molecular weight standard (M1) (200, 116, 97.4, 66.2, 45.0, 31.0, 21.5, 14.4, 6.5 kDa) or the Amersham Rainbow Marker (M2) (220, 66.2, 46.0, 30.0, 21.5, 14.3 kDa). The molecular weights of GST-fusion proteins are a combination of the 26 kDa GST protein and its fusion partner. Protein concentrations were estimated using the Bradford assay.

His-Fusion Soluble Proteins Large-Scale Purification.

For some ORFs, a single colony was grown overnight at 37° C. on a LB+Amp agar plate. The bacteria were inoculated into 20 ml of LB+Amp liquid culture and incubated overnight in a water bath shaker. Bacteria were diluted 1:30 into 600 ml fresh medium and allowed to grow at the optimal temperature (20-37° C.) to $OD_{550}$ 0.6-0.8. Protein expression was induced by addition of 1 mM IPTG and the culture further incubated for three hours. The culture was centrifuged at 8000 rpm at 4° C., the supernatant was discarded and the bacterial pellet was resuspended in 7.5 ml cold 10 mM imidazole buffer (300 mM NaCl, 50 mM phosphate buffer, 10 mM imidazole, pH 8). The cells were disrupted by sonication on ice for 30 sec at 40 W using a Branson sonifier B-15, frozen and thawed two times and centrifuged again. The supernatant was collected and mixed with 150 µl $Ni^{2+}$-resin (Pharmacia) (previously washed with 10 mM imidazole buffer) and incubated at room temperature with gentle agitation for 30 minutes. The sample was centrifuged at 700 g for 5 minutes at 4° C. The resin was washed twice with 10 ml cold 10 mM imidazole buffer for 10 minutes, resuspended in 1 ml cold 10 mM imidazole buffer and loaded on a disposable column. The resin was washed at 4° C. with 2 ml cold 10 mM imidazole buffer until the flow-through reached the $O.D_{280}$ of 0.02-0.06. The resin was washed with 2 ml cold 20 mM imidazole buffer (300 mM NaCl, 50 mM phosphate buffer, 20 mM imidazole, pH 8) until the flow-through reached the $O.D_{280}$ of 0.02-0.06. The His-fusion protein was eluted by addition of 700 µl cold 250 mM imidazole buffer (300 mM NaCl, 50 mM phosphate buffer, 250 mM imidazole, pH 8) and fractions collected until the $O.D_{280}$ was 0.1. 21 µl of each fraction were loaded on a 12% SDS gel.

His-Fusion Insoluble Proteins Large-Scale Purification.

A single colony was grown overnight at 37° C. on a LB+Amp agar plate. The bacteria were inoculated into 20 ml of LB+Amp liquid culture in a water bath shaker and grown overnight. Bacteria were diluted 1:30 into 600 ml fresh medium and let to grow at the optimal temperature (37° C.) to $O.D_{550}$ 0.6-0.8. Protein expression was induced by addition of 1 mM IPTG and the culture further incubated for three hours. The culture was centrifuged at 8000 rpm at 4° C. The supernatant was discarded and the bacterial pellet was resuspended in 7.5 ml buffer B (urea 8M, 10 mM Tris-HCl, 100 mM phosphate buffer, pH 8.8). The cells were disrupted by sonication on ice for 30 sec at 40 W using a Branson sonifier B-15, frozen and thawed twice and centrifuged again. The supernatant was stored at −20° C., while the pellets were resuspended in 2 ml guanidine buffer (6M guanidine hydrochloride, 100 mM phosphate buffer, 10 mM Tris-HCl, pH 7.5) and treated in a homogenizer for 10 cycles. The product was centrifuged at 13000 rpm for 40 minutes. The supernatant was mixed with 150 µl $Ni^{2+}$-resin (Pharmacia) (previously washed with buffer B) and incubated at room temperature with gentle agitation for 30 minutes. The sample was centrifuged at 700 g for 5 minutes at 4° C. The resin was washed twice with 10 ml buffer B for 10 minutes, resuspended in 1 ml buffer B, and loaded on a disposable column. The resin was washed at room temperature with 2 ml buffer B until the flow-through reached the $OD_{280}$ of 0.02-0.06. The resin was washed with 2 ml buffer C (urea 8M, 10 mM Tris-HCl, 100 mM phosphate buffer, pH 6.3) until the flow-through reached the $O.D_{280}$ of 0.02-0.06. The His-fusion protein was eluted by addition of 700 µl elution buffer (urea 8M, 10 mM Tris-HCl, 100 mM phosphate buffer, pH 4.5) and fractions collected until the $OD_{280}$ was 0.1. 21 µl of each fraction were loaded on a 12% SDS gel.

Purification of His-fusion Proteins.

For each clone to be purified as a His-fusion, a single colony was streaked out and grown overnight at 37° C. on LB/Amp (100 µg/ml) agar plate. An isolated colony from this plate was inoculated into 20 ml of LB/Amp (100 µg/ml) liquid medium and grown overnight at 37° C. with shaking. The overnight culture was diluted 1:30 into 600 ml of LB/Amp (100 µg/ml) liquid medium and allowed to grow at the optimal temperature (20-37° C.) until the $OD_{550}$ reached 0.6-0.8. Expression of recombinant protein was induced by addition of IPTG (final concentration 1.0 mM) and the culture incubated for a further 3 hours. The bacteria were harvested by centrifugation at 8000×g for 15 min at 4° C.

The bacterial pellet was resuspended in 7.5 ml either (i) cold buffer A (300 mM NaCl, 50 mM phosphate buffer, 10 mM imidazole, pH 8.0) for soluble proteins or (ii) buffer B (8M urea, 10 mM TrisHCl, 100 mM phosphate buffer, pH 8.8) for insoluble proteins. Cells were disrupted by sonication on ice four times for 30 sec at 40 W using a Branson sonifier 450 and centrifuged at 13 000×g for 30 min at 4° C. For insoluble proteins, pellets were resuspended in 2.0 ml buffer C (6M guanidine hydrochloride, 100 mM phosphate buffer, 10 mM Tris-HCl, pH 7.5) and treated with a Dounce homogenizer for 10 cycles. The homogenate was centrifuged at 13 000×g for 40 min and the supernatant retained.

Supernatants for both soluble and insoluble preparations were mixed with 150 µl $Ni^{2+}$-resin (previously equilibrated with either buffer A or buffer B, as appropriate) and incubated at room temperature with gentle agitation for 30 min. The resin was CHELATING SEPHAROSE FAST FLOW™ (Pharmacia), prepared according to the manufacturers protocol. The batch-wise preparation was centrifuged at 700×g for 5 min at 4° C. and the supernatant discarded. The resin was washed twice (batch-wise) with 10 ml buffer A or B for 10 min, resuspended in 1.0 ml buffer A or B and loaded onto a disposable column. The resin continued to be washed with either (i) buffer A at 4° C. or (ii) buffer B at room temperature, the $OD_{280nm}$ of the flow-through reached 0.02-0.01. The resin was further washed with either (i) cold buffer C (300 mM NaCl, 50 mM phosphate buffer, 20 mM imidazole, pH 8.0) or (ii) buffer D (8M urea, 10 mM Tris-HCl, 100 mM phosphate buffer, pH 6.3) until the $OD_{280nm}$ of the flow-through reached 0.02-0.01. The His-fusion protein was eluted by addition of 700 µl of either (1) cold elution buffer A (300 mM NaCl, 50 mM phosphate buffer, 250 mM imidazole, pH 8.0) or (ii) elution buffer B (8 M urea, 10 mM Tris-HCl, 100 mM phosphate buffer, pH 4.5) and fractions collected until the $O.D_{280nm}$ indicated all the recombinant protein was obtained. 20 µl aliquots of each elution fraction were analyzed by SDS-PAGE using a 12% gel. Protein concentrations were estimated using the Bradford assay.

His-Fusion Proteins Renaturation

In the cases where denaturation was required to solubilize proteins, a renaturation step was employed prior to immunization. Glycerol was added to the denatured fractions obtained above to a final concentration of 10% (v/v). The proteins were then diluted to 200 µg/ml using dialysis buffer I (10% (v/v) glycerol, 0.5M arginine, 50 mM phosphate buffer, 5 mM reduced glutathione, 0.5 mM oxidised glutathione, 2M urea, pH 8.8) and dialysed against the same buffer for 12-14 hours at 4° C. Further dialysis was performed with buffer II (10% (v/v) glycerol, 0.5M arginine, 50 mM phosphate buffer, 50 mM reduced glutathione, 5.0 mM oxidised glutathione, pH 8.8) for 12-14 hours at 4° C.

Alternatively, 10% glycerol was added to the denatured proteins. The proteins were then diluted to 20 µg/ml using dialysis buffer I (10% glycerol, 0.5M arginine, 50 mM phosphate buffer, 5 mM reduced glutathione, 0.5 mM oxidised glutathione, 2M urea, pH 8.8) and dialysed against the same buffer at 4° C. for 12-14 hours. The protein was further dialysed against dialysis buffer II (10% glycerol, 0.5M arginine, 50 mM phosphate buffer, 5 mM reduced glutathione, 0.5 mM oxidised glutathione, pH 8.8) for 12-14 hours at 4° C.

Protein concentration was evaluated using the formula:

$$\text{Protein (mg/ml)} = (1.55 \times OD_{280}) - (0.76 \times OD_{260})$$

Purification of Proteins

To analyse the solubility, pellets obtained from 3.0 ml cultures were resuspended in 500 µl buffer M1 (PBS pH 7.2). 25 µl of lysozyme (10 mg/ml) was added and the bacteria incubated for 15 min at 4° C. Cells were disrupted by sonication on ice four times for 30 sec at 40 W using a Branson sonifier 450 and centrifuged at 13 000×g for 30 min at 4° C. The supernatant was collected and the pellet resuspended in buffer M2 [8M urea, 0.5M NaCl, 20 mM imidazole and 0.1 M $NaH_2PO_4$] and incubated for 3 to 4 hours at 4° C. After centrifugation, the supernatant was collected and the pellet resuspended in buffer M3 [6M guanidinium-HCl, 0.5M NaCl, 20 mM imidazole and 0.1 M $NaH_2PO_4$] overnight at 4° C. The supernatants from all steps were analysed by SDS-PAGE. Some proteins were found to be soluble in PBS, others needed urea or guanidinium-HCl for solubilization.

For preparative scale purification, 500 ml cultures were induced and fusion proteins solubilized in either buffer M1, M2, or M3 using the procedure described above. Crude extracts were loaded onto a Ni-NTA superflow column (Qiagen) equilibrated with buffer M1, M2, or M3 depending on the solubilization buffer employed. Unbound material was eluted with the corresponding buffer containing 500 mM imidazole then dialysed against the same buffer in the absence of imidazole.

Mice Immunizations

20 µg of each purified protein are used to immunize mice intraperitoneally. In the case of some ORFs, Balb-C mice were immunised with $Al(OH)_3$ as adjuvant on days 1, 21 and 42, and immune response was monitored in samples taken on day 56. For other ORFs, CD1 mice could be immunised using the same protocol. For ORFs 25 and 40, CD1 mice were immunised using Freund's adjuvant, and the same immunisation protocol was used, except that the immune response was measured on day 42, rather than 56. Similarly, for still other ORFs, CD1 mice were immunised with Freund's adjuvant, but the immune response was measured on day 49. Alternatively, 20 µg of each purified protein was mixed with Freund's adjuvant and used to immunize CD1 mice intraperitoneally. For many of the proteins, the immunization was performed on days 1, 21 and 35, and immune response was monitored in samples taken on days 34 and 49. For some proteins, the third immunization was performed on day 28, rather than 35, and immune response was measured on days 20 and 42, rather than 34 and 49.

Elisa Assay (Sera Analysis)

The acapsulated MenB M7 strain was plated on chocolate agar plates and incubated overnight at 37° C. Bacterial colonies were collected from the agar plates using a sterile dracon swab and inoculated into 7 ml of Mueller-Hinton Broth (Difco) containing 0.25% Glucose. Bacterial growth was monitored every 30 minutes by following $OD_{620}$. The bacteria were let to grow until the OD reached the value of 0.3-0.4. The culture was centrifuged for 10 minutes at 10000 rpm. The supernatant was discarded and bacteria were washed once with PBS, resuspended in PBS containing 0.025% formaldehyde, and incubated for 2 hours at room temperature and then overnight at 4° C. with stiffing. 100 µl bacterial cells were added to each well of a 96 well Greiner plate and incubated overnight at 4° C. The wells were then washed three times with PBT washing buffer (0.1% TWEEN-20™ in PBS). 200 µl of saturation buffer (2.7% Polyvinylpyrrolidone 10 in water) was added to each well and the plates incubated for 2 hours at 37° C. Wells were washed three times with PBT. 200 µl of diluted sera (Dilution buffer: 1% BSA, 0.1% TWEEN-20™, 0.1% $NaN_3$ in PBS) were added to each well and the plates incubated for 90 minutes at 37° C. Wells were washed three times with PBT. 100 µl of HRP-conjugated rabbit anti-mouse (Dako) serum diluted 1:2000 in dilution buffer were added to each well and the plates were incubated for 90 minutes at 37° C. Wells were washed three times with PBT buffer. 100 µl of substrate buffer for HRP (25 ml of citrate buffer pH5, 10 mg of O-phenildiamine and 10 µl of $H_2O$) were added to each well and the plates were left at room temperature for 20 minutes. 100 µl $H_2SO_4$ was added to each well and $OD_{490}$ was followed. The ELISA was considered positive when OD490 was 2.5 times the respective pre-immune sera.

Alternatively, The acapsulated MenB M7 strain was plated on chocolate agar plates and incubated overnight at 37° C. Bacterial colonies were collected from the agar plates using a sterile dracon swab and inoculated into Mueller-Hinton Broth (Difco) containing 0.25% Glucose. Bacterial growth was monitored every 30 minutes by following $OD_{620}$. The bacteria were let to grow until the OD reached the value of 0.3-0.4. The culture was centrifuged for 10 minutes at 10 000 rpm. The supernatant was discarded and bacteria were washed once with PBS, resuspended in PBS containing 0.025% formaldehyde, and incubated for 1 hour at 37° C. and then overnight at 4° C. with stirring. 100 µl bacterial cells were added to each well of a 96 well Greiner plate and incubated overnight at 4° C. The wells were then washed three times with PBT washing buffer (0.1% TWEEN-20™ in PBS). 200 µl of saturation buffer (2.7% Polyvinylpyrrolidone 10 in water) was added to each well and the plates incubated for 2 hours at 37° C. Wells were washed three times with PBT. 200 µl of diluted sera (Dilution buffer: 1% BSA, 0.1% TWEEN-20™, 0.1% $NaN_3$ in PBS) were added to each well and the plates incubated for 2 hours at 37° C. Wells were washed three times with PBT. 100 µl of HRP-conjugated rabbit anti-mouse (Dako) serum diluted 1:2000 in dilution buffer were added to each well and the plates were incubated for 90 minutes at 37° C. Wells were washed three times with PBT buffer. 100 µl of substrate buffer for HRP (25 ml of citrate buffer pH5, 10 mg of O-phenildiamine and 10 µl of $H_2O_2$) were added to each well and the plates were left at room temperature for 20 minutes. 100 µl $H_2SO_4$ was added to each well and $OD_{490}$ was followed. The ELISA titers were calculated arbitrarily as the dilution of sera which gave an $OD_{490}$ value of 0.4 above the level of preimmune sera. The ELISA was considered positive when the dilution of sera with $OD_{490}$ of 0.4 was higher than 1:400.

FACScan Bacteria Binding Assay Procedure.

The acapsulated MenB M7 strain was plated on chocolate agar plates and incubated overnight at 37° C. Bacterial colonies were collected from the agar plates using a sterile dracon swab and inoculated into 4 tubes containing 8 ml each Mueller-Hinton Broth (Difco) containing 0.25% glucose. Bacterial growth was monitored every 30 minutes by following $OD_{620}$. The bacteria were let to grow until the OD reached the value of 0.35-0.5. The culture was centrifuged for 10 minutes at 4000 rpm. The supernatant was discarded and the pellet was resuspended in blocking buffer (1% BSA, 0.4% $NaN_3$) and centrifuged for 5 minutes at 4000 rpm. Cells were resuspended in blocking buffer to reach $OD_{620}$ of 0.07. 100 µl bacterial cells were added to each well of a Costar 96 well plate. 100 µl of diluted (1:200) sera (in blocking buffer) were added to each well and plates incubated for 2 hours at 4° C. Cells were centrifuged for 5 minutes at 4000 rpm, the supernatant aspirated and cells washed by addition of 200 µl/well of blocking buffer in each well. 100 µl of R-Phicoerytrin conjugated $F(ab)_2$ goat anti-mouse, diluted 1:100, was added to each well and plates incubated for 1 hour at 4° C. Cells were spun down by centrifugation at 4000 rpm for 5 minutes and washed by addition of 200 µl/well of blocking buffer. The supernatant was aspirated and cells resuspended in 200 µl/well of PBS, 0.25% formaldehyde. Samples were transferred to FACScan tubes and read. The condition for FACScan setting were: FL1 on, FL2 and FL3 off; FSC-H Treshold: 92; FSC PMT Voltage: E 02; SSC PMT: 474; Amp. Gains 7.1; FL-2 PMT: 539. Compensation values: 0.

OMV Preparations

Bacteria were grown overnight on 5 GC plates, harvested with a loop and resuspended in 10 ml 20 mM Tris-HCl. Heat inactivation was performed at 56° C. for 30 minutes and the bacteria disrupted by sonication for 10' on ice (50% duty cycle, 50% output). Unbroken cells were removed by centrifugation at 5000 g for 10 minutes and the total cell envelope fraction recovered by centrifugation at 50000 g at 4° C. for 75 minutes. To extract cytoplasmic membrane proteins from the crude outer membranes, the whole fraction was resuspended in 2% sarkosyl (Sigma) and incubated at room temperature for 20 minutes. The suspension was centrifuged at 10000 g for 10 minutes to remove aggregates, and the supernatant further ultracentrifuged at 50000 g for 75 minutes to pellet the outer membranes. The outer membranes were resuspended in 10 mM Tris-HCl, pH8 and the protein concentration measured by the Bio-Rad Protein assay, using BSA as a standard.

Whole Extracts Preparation

Bacteria were grown overnight on a GC plate, harvested with a loop and resuspended in 1 ml of 20 mM Tris-HCl. Heat inactivation was performed at 56° C. for 30' minutes.

Western Blotting

Purified proteins (500 ng/lane), outer membrane vesicles (5 µg) and total cell extracts (25 µl) derived from MenB strain 2996 were loaded onto a 12% SDS-polyacrylamide gel and transferred to a nitrocellulose membrane. The transfer was performed for 2 hours at 150 mA at 4° C., using transfer buffer (0.3% Tris base, 1.44% glycine, 20% (v/v) methanol). The membrane was saturated by overnight incubation at 4° C. in saturation buffer (10% skimmed milk, 0.1% TRITON X100™ in PBS). The membrane was washed twice with washing buffer (3% skimmed milk, 0.1% TRITON X100™ in PBS) and incubated for 2 hours at 37° C. with mice sera diluted 1:200 in washing buffer. The membrane was washed twice and incubated for 90 minutes with a 1:2000 dilution of horseradish peroxidase labeled anti-mouse Ig. The membrane was washed twice with 0.1% TRITON X100™ in PBS and developed with the OPTI-4CN SUBSTRATE KIT™ (Bio-Rad). The reaction was stopped by adding water.

Bactericidal Assay

MC58 and 2996 strains were grown overnight at 37° C. on chocolate agar plates. 5-7 colonies were collected and used to inoculate 7 ml Mueller-Hinton broth. The suspension was incubated at 37° C. on a nutator and let to grow until $OD_{620}$ was in between 0.5-0.8. The culture was aliquoted into sterile 1.5 ml Eppendorf tubes and centrifuged for 20 minutes at maximum speed in a microfuge. The pellet was washed once in Gey's buffer (Gibco) and resuspended in the same buffer to an $OD_{620}$ of 0.5, diluted 1:20000 in Gey's buffer and stored at 25° C.

50 µl of Gey's buffer/1% BSA was added to each well of a 96-well tissue culture plate. 25 µl of diluted (1:100) mice sera (dilution buffer: Gey's buffer/0.2% BSA) were added to each well and the plate incubated at 4° C. 25 µl of the previously described bacterial suspension were added to each well. 25 µl of either heat-inactivated (56° C. water bath for 30 minutes) or normal baby rabbit complement were added to each well. Immediately after the addition of the baby rabbit complement, 22 µl of each sample/well were plated on Mueller-Hinton agar plates (time 0). The 96-well plate was incubated for 1 hour at 37° C. with rotation and then 22 µl of each sample/well were plated on Mueller-Hinton agar plates (time 1). After overnight incubation the colonies corresponding to time 0 and time 1 h were counted.

Gene Variability

The ORF4 and 919 genes were amplified by PCR on chromosomal DNA extracted from various *Neisseria* strains (see list of strains). The following oligonucleotides used as PCR primers were designed in the upstream and downstream regions of the genes:

```
                                        (SEQ ID NO: 3266)
orf 4.1 (forward)  CGAATCCGGACGGCAGGACTC (SEQ ID NO: 3267)
orf 4.3 (reverse)  GGCAGGGAATGGCGGATTAAAG (SEQ ID NO: 3268)
919.1 (forward)    AAAATGCCTCTCCACGGCTG
or
                                        (SEQ ID NO: 3269)
CTGCGCCCTGTGTTAAAATCCCCT (SEQ ID NO: 3270)
919.6 (reverse)    CAAATAAGAAAGGAATTTTG
or
                                        (SEQ ID NO: 3271)
GGTATCGCAAAACTTCGCCTTAATGCG
```

The PCR cycling conditions were:

| 1 cycle | 2 min. at 94° |
|---|---|
| 30 cycles | 30 sec. at 94° |
| | 30 sec. at ~54° or ~60° (in according to Tm of the primers) |
| | 40 sec. at 72° |
| 1 cycle | 7 min. at 72° |

The PCR products were purified from 1% agarose gel and sequenced using the following primers:

```
                                        (SEQ ID NO: 3272)
orf 4.1   (forward)   CGAATCCGGACGGCAGGACTC (SEQ ID NO: 3273)
orf 4.2   (forward)   CGACCGCGCCTTTGGGACTG (SEQ ID NO: 3274)
orf 4.3   (reverse)   GGCAGGGAATGGCGGATTAAAG (SEQ ID NO: 3275)
orf 4.4   (reverse)   TCTTTGAGTTTGATCCAACC (SEQ ID NO: 3276)
919.1     (forward)   AAAATGCCTCTCCACGGCTG
or
                                        (SEQ ID NO: 3277)
                      CTGCGCCCTGTGTTAAAATCCCCT (SEQ ID NO: 3278)
919.2     (forward)   ATCCTTCCGCCTCGGCTGCG (SEQ ID NO: 3279)
919.3     (forward)   AAAACAGCGGCACAATCGAC (SEQ ID NO: 3280)
919.4     (forward)   ATAAGGGCTACCTCAAACTC (SEQ ID NO: 3281)
919.5     (forward)   GCGCGTGGATTATTTTGGG (SEQ ID NO: 3282)
919.6     (reverse)   CAAATAAGAAAGGAATTTTG
or
                                        (SEQ ID NO: 3283)
                      GGTATCGCAAAACTTCGCCTTAATGCG (SEQ ID NO: 3284)
919.7     (reverse)   CCCAAGGTAATGTAGTGCCG (SEQ ID NO: 3285)
919.8     (reverse)   TAAAAAAAGTTCGACAGGG (SEQ ID NO: 3286)
919.9     (reverse)   CCGTCCGCCTGTCGTCGCCC (SEQ ID NO: 3287)
919.10    (reverse)   TCGTTCCGGCGGGGTCGGGG
```

All documents cited herein are incorporated by reference in their entireties.

The following Examples are presented to illustrate, not limit, the invention.

Example 1

Using the above-described procedures, the following oligonucleotide primers were employed in the polymerase chain reaction (PCR) assay in order to clone the ORFs as indicated:

TABLE 1

Oligonucleotides used for PCR for Examples 2-10

| ORF | Primer | Sequence | Restriction sites |
|---|---|---|---|
| 279 | Forward | CGC<u>GGATCCCATATG</u>-TTGCCTGCAATCACGATT <SEQ ID 3021> | BamHI-NdeI |
| | Reverse | CCCG<u>CTCGAG</u>-TTTAGAAGCGGGCGGCAA <SEQ ID 3022> | XhoI |
| 519 | Forward | CGC<u>GGATCCCATATG</u>-TTCAAATCCTTTGTCGTCA <SEQ ID 3023> | BamHI-NdeI |

TABLE 1-continued

Oligonucleotides used for PCR for Examples 2-10

| ORF | Primer | Sequence | Restriction sites |
|---|---|---|---|
| | Reverse | CCCGCTCGAG-TTTGGCGGTTTTGCTGC <SEQ ID 3024> | XhoI |
| 576 | Forward | CGCGGATCCCATATG-GCCGCCCCCGCATCT <SEQ ID 3025> | BamHI-NdeI |
| | Reverse | CCCGCTCGAG-ATTTACTTTTTTGATGTCGAC <SEQ ID 3026> | XhoI |
| 919 | Forward | CGCGGATCCCATATG-TGCCAAAGCAAGAGCATC <SEQ ID 3027> | BamHI-NdeI |
| | Reverse | CCCGCTCGAG-CGGGCGGTATTCGGG <SEQ ID 3028> | XhoI |
| 121 | Forward | CGCGGATCCCATATG-GAAACACAGCTTTACAT <SEQ ID 3029> | BamHI-NdeI |
| | Reverse | CCCGCTCGAG-ATAATAATATCCCGCGCCC <SEQ ID 3030> | XhoI |
| 128 | Forward | CGCGGATCCCATATG-ACTGACAACGCACT <SEQ ID 3031> | BamHI-NdeI |
| | Reverse | CCCGCTCGAG-GACCGCGTTGTCGAAA <SEQ ID 3032> | XhoI |
| 206 | Forward | CGCGGATCCCATATG-AAACACCGCCAACCGA <SEQ ID 3033> | BamHI-NdeI |
| | Reverse | CCCGCTCGAG-TTCTGTAAAAAAAGTATGTGC <SEQ ID 3034> | XhoI |
| 287 | Forward | CCGGAATTCTAGCTAGC-CTTTCAGCCTGCGGG <SEQ ID 3035> | EcoRI-NheI |
| | Reverse | CCCGCTCGAG-ATCCTGCTCTTTTTTGCC <SEQ ID 3036> | XhoI |
| 406 | Forward | CGCGGATCCCATATG-TGCGGGACACTGACAG <SEQ ID 3037> | BamHI-NdeI |
| | Reverse | CCCGCTCGAG-AGGTTGTCCTTGTCTATG <SEQ ID 3038> | XhoI |

Localization of the ORFs

The following DNA and amino acid sequences are identified by titles of the following form: [g, m, or a] [#].[seq or pep], where "g" means a sequence from *N. gonorrhoeae*, "m" means a sequence from *N. meningitidis* B, and "a" means a sequence from *N. meningitidis* A; "#" means the number of the sequence; "seq" means a DNA sequence, and "pep" means an amino acid sequence. For example, "g001.seq" refers to an *N. gonorrhoeae* DNA sequence, number 1. The presence of the suffix "-1" to these sequences indicates an additional sequence found for the same ORF, thus, data for an ORF having both an unsuffixed and a suffixed sequence designation applies to both such designated sequences. Further, open reading frames are identified as ORF #, where "#" means the number of the ORF, corresponding to the number of the sequence which encodes the ORF, and the ORF designations may be suffixed with ".ng" or ".a", indicating that the ORF corresponds to a *N. gonorrhoeae* sequence or a *N. meningitidis* A sequence, respectively. The word "partial" before a sequence indicates that the sequence may be partial or a complete ORF. Computer analysis was performed for the comparisons that follow between "g", "m", and "a" peptide sequences; and therein the "pep" suffix is implied where not expressly stated. Further, in the event of a conflict between the text immediately preceding and describing which sequences are being compared, and the designated sequences being compared, the designated sequence controls and is the actual sequence being compared ORF: contig:
279 gnm4.seq The following partial DNA sequence was identified in *N. meningitidis* <SEQ ID 3039>:

```
m279.seq
  1 ATAACGCGGA TTTGCGGCTG CTTGATTTCA ACGGTTTTCA GGGCTTCGGC

51 AAGTTTGTCG GCGGCGGGTT TCATCAGGCT GCAATGGGAA GGTACGGACA
```

-continued

```
101 CGGGCAGCGG CAGGGCGCGT TTGGCACCGG CTTCTTTGGC GGCAGCCATG

151 GCGCGTCCGA CGGCGGCGGC GTTGCCTGCA ATCACGATTT GTCCGGGTGA

201 GTTGAAGTTG ACGGCTTCGA CCACTTCGCT TTGGGCGGCT TCGGCACAAA

251 TGGCTTTAAC CTGCTCATCT TCCAAGCCGA GAATCGCCGC CATTGCGCCC

301 ACGCCTTGCG GTACGGCGGA CTGCATCAGT TCGGCGCGCA GGCGCACGAG

351 TTTGACCGCG TCGGCAAAAT TCAATGCGCC GGCGGCAACG AGTGCGGTGT

401 ATTCGCCGAG GCTGTGTCCG GCAACGGCGG CAGGCGTTTT GCCGCCCGCT

451 TCTAAATAG
```

This corresponds to the amino acid sequence <SEQ ID 3040; ORF 279>:

```
m279.pep
  1 ITRICGCLIS TVFRASASLS AAGFIRLQWE GTDTGSGRAR LAPASLAAAM

51 ARPTAAALPA ITICPGELKL TASTTSLWAA SAQMALTCSS SKPRIAAIAP

101 TPCGTADCIS SARRRTSLTA SAKFNAPAAT SAVYSPRLCP ATAAGVLPPA

151 SK*
```

The following partial DNA sequence was identified in *N. gonorrhoeae* <SEQ ID 3041>:

```
g279.seq
  1 atgacgcgga tttgcggctg cttgatttca acggttttga gtgtttcggc 51 aagtttgtcg gcggcgggtt tcatcaggct gcaatgggaa ggaacggata 101 ccggcagcgg cagggcgcgt ttggctccgg cttctttggc ggcagccatg 151 gtgcgtccga cggcggcggc gttgcctgca atcacgactt gtccgggcga 201 gttgaagttg acggcttcga ccacttcgcc ctgtgcggat tcggcacaaa 251 tctgcctgac ctgttcatct tccaaaccca aaatggccgc cattgcgcct 301 acgccttgcg gtacggcgga ctgcatcagt tcggcgcgca ggcggacgag 351 tttgacggca tcggcaaaat ccaatgcttc ggcggcgaca agcgcggtgt 401 attcgccgag gctgtgtccg gcaacggcgg caggcgtttt gccgcccact 451 tccaaatag
```

This corresponds to the amino acid sequence <SEQ ID 3042; ORF 279.ng>:

```
g279.pep
  1 MTRICGCLIS TVLSVSASLS AAGFIRLQWE GTDTGSGRAR LAPASLAAAM

51 VRPTAAALPA ITTCPGELKL TASTTSPCAD SAQICLTCSS SKPKMAAIAP

101 TPCGTADCIS SARRRTSLTA SAKSNASAAT SAVYSPRLCP ATAAGVLPPT

151 SK*
```

ORF 279 shows 89.5% identity over a 152 aa overlap with a predicted ORF (ORF 279.ng) from *N. gonorrhoeae*:

```
                  10        20        30        40        50        60
     m279.pep ITRICGCLISTVFRASASLSAAGFIRLQWEGTDTGSGRARLAPASLAAAMARPTAAALPA
              :|||||||||||::|||||||||||||||||||||||||||||||||:|||||||||||
     g279     MTRICGCLISTVLSVSASLSAAGFIRLQWEGTDTGSGRARLAPASLAAAMVRPTAAALPA
                  10        20        30        40        50        60

70        80        90       100       110       120
     m279.pep ITICPGELKLTASTTSLWAASAQMALTCSSSKPRIAAIAPTPCGTADCISSARRRTSLTA
              || |||||||||||||  |||: ||||||||::|||||||||||||||||||||||||||
     g279     ITTCPGELKLTASTTSPCADSAQICLTCSSSKPKMAAIAPTPCGTADCISSARRRTSLTA
                  70        80        90       100       110       120

130       140       150
     m279.pep SAKFNAPAATSAVYSPRLCPATAAGVLPPASKX
              ||| || ||||||||||||||||||||||||:|||
     g279     SAKSNASAATSAVYSPRLCPATAAGVLPPTSKX
                 130       140       150
```

The following partial DNA sequence was identified in *N. meningitidis* <SEQ ID 3043>:

```
a279.seq
  1 ATGACNCNGA TTTGCGGCTG CTTGATTTCA ACGGTTTNNA GGGCTTCGGC

51 GAGTTTGTCG GCGGCGGGTT TCATGAGGCT GCAATGGGAA GGTACNGACA

101 CNGGCAGCGG CAGGGCGCGT TTGGCGCCGG CTTCTTTGGC GGCAAGCATA

151 GCGCGCTCGA CGGCGGCGGC ATTGCCTGCA ATCACGACTT GTCCGGGCGA

201 GTTGAAGTTG ACGGCTTCAA CCACTTCATC CTGTGCGGAT TCGGCGCAAA

251 TTTGTTTTAC CTGTTCATCT TCCAAGCCGA GAATCGCCGC CATTGCGCCC

301 ACGCCTTGCG GTACGGCGGA CTGCATCAGT TCGGCGCGCA NGCGCACGAG

351 TTTGACCGCG TCGGCAAAAT CCAATGCGCC GGCGGCAACN AGTGCGGTGT

401 ATTCGCCGAN GCTGTGTCCG GCAACGGCGG CAGGCGTTTT GCCGCCCGCT

451 TCCGAATAG
```

This corresponds to the amino acid sequence <SEQ ID 3044; ORF 279.a>:

```
a279.pep
  1 MTXICGCLIS TVXRASASLS AAGFMRLQWE GTDTGSGRAR LAPASLAASI

51 ARSTAAALPA ITTCPGELKL TASTTSSCAD SAQICFTCSS SKPRIAAIAP

101 TPCGTADCIS SARXRTSLTA SAKSNAPAAT SAVYSPXLCP ATAAGVLPPA

151 SE*
``` m279/a279 ORFs 279 and 279.a showed a 88.2% identity in 152 aa overlap

```
                  10        20        30        40        50        60
     m279.pep ITRICGCLISTVFRASASLSAAGFIRLQWEGTDTGSGRARLAPASLAAAMARPTAAALPA
              :| ||||||||| |||||||||||:|||||||||||||||||||||||||::|||||||
     a279     MTXICGCLISTVXRASASLSAAGFMRLQWEGTDTGSGRARLAPASLAASIARSTAAALPA
                  10        20        30        40        50        60

70        80        90       100       110       120
     m279.pep ITICPGELKLTASTTSLWAASAQMALTCSSSKPRIAAIAPTPCGTADCISSARRRTSLTA
              || ||||||||||||||  |  |||: :||||||||||||||||||||||||||||  ||||||
     a279     ITTCPGELKLTASTTSSCADSAQICFTCSSSKPRIAAIAPTPCGTADCISSARXRTSLTA
                  70        80        90       100       110       120

130       140       150
     m279.pep SAKFNAPAATSAVYSPRLCPATAAGVLPPASKX
              ||| |||||||||||||| |||||||||||||||:|
     a279     SAKSNAPAATSAVYSPXLCPATAAGVLPPASEX
                 130       140       150
```

519 and 519-1 gnm7.seq

The following partial DNA sequence was identified in *N. meningitidis* <SEQ ID 3045>:

```
m519.seq (partial)
    1 . . . TCCGTTATCG GCCGTATGGA GTTGGACAAA ACGTTTGAAG AACGCGACGA 51        AATCAACAGT ACTGTTGTTG CGGCTTTGGA CGAGGCGGCC GGGgCTTgGG

101        GTGTGAAGGT TTTGCGTTAT GAGATTAAAG ACTTGGTTCC GCCGCAAGAA

151        ATCCTTCGCT CAATGCAGGC GCAAATTACT GCCGAACGCG AAAAACGCGC

201        CCGTATCGCC GAATCCGAAG GTCGTAAAAT CGAACAAATC AACCTTGCCA

251        GTGGTCAGCG CGAAGCCGAA ATCCAACAAT CCGAAGGCGA GGCTCAGGCT

301        GCGGTCAATG CGTCAAATGC CGAGAAAATC GCCCGCATCA ACCGCGCCAA

351        AGGTGAAGCG GAATCCTTGC GCCTTGTTGC CGAAGCCAAT GCCGAAGCCA

401        TCCGTCAAAT TGCCGCCGCC CTTCAAACCC AAGGCGGTGC GGATGCGGTC

451        AATCTGAAGA TTGCGGAACA ATACGTCGCT GCGTTCAACA ATCTTGCCAA

501        AGAAAGCAAT ACGCTGATTA TGCCCGCCAA TGTTGCCGAC ATCGGCAGCC

551        TGATTTCTGC CGGTATGAAA ATTATCGACA GCAGCAAAAC CGCCAAaTAA
                                                                    25
```

This corresponds to the amino acid sequence <SEQ ID 3046; ORF 519>:

```
m519.pep (partial)
    1 . . . SVIGRMELDK TFEERDEINS TVVAALDEAA GAWGVKVLRY EIKDLVPPQE

51        ILRSMQAQIT AEREKRARIA ESEGRKIEQI NLASGQREAE IQQSEGEAQA

101        AVNASNAEKI ARINRAKGEA ESLRLVAEAN AEAIRQIAAA LQTQGGADAV

151        NLKIAEQYVA AFNNLAKESN TLIMPANVAD IGSLISAGMK IIDSSKTAK*
```

The following partial DNA sequence was identified in *N. gonorrhoeae* <SEQ ID 3047>:

```
g519.seq
    1 atggaatttt tcattatctt gttggcagcc gtcgccgttt tcggcttcaa 51 atcctttgtc gtcatccccc agcaggaagt ccacgttgtc gaaaggctcg 101 ggcgtttcca tcgcgccctg acggccggtt tgaatatttt gattcccttt 151 atcgaccgcg tcgcctaccg ccattcgctg aaagaaatcc ctttagacgt 201 acccagccag gtctgcatca cgcgcgataa tacgcaattg actgttgacg 251 gcatcatcta tttccaagta accgatccca aactcgcctc atacggttcg 301 agcaactaca ttatggcaat tacccagctt gcccaaacga cgctgcgttc 351 cgttatcggg cgtatggagt tggacaaaac gtttgaagaa cgcgacgaaa 401 tcaacagtac cgtcgtctcc gccctcgatg aagccgccgg ggcttggggt 451 gtgaaagtcc tccgttacga aatcaaggat ttggttccgc cgcaagaaat 501 ccttcgcgca atgcaggcac aaattaccgc cgaacgcgaa aaacgcgccc 551 gtattgccga atccgaaggc cgtaaaatcg aacaaatcaa ccttgccagt 601 ggtcagcgtg aagccgaaat ccaacaatcc gaaggcgagg ctcaggctgc 651 ggtcaatgcg tccaatgccg agaaaatcgc ccgcatcaac cgcgccaaag 701 gcgaagcgga atccctgcgc cttgttgccg aagccaatgc cgaagccaac 751 cgtcaaattg ccgccgccct tcaaacccaa agcggggcgg atgcggtcaa
```

```
801 tctgaagatt gcgggacaat acgttaccgc gttcaaaaat cttgccaaag 851 aagacaatac gcggattaag cccgccaagg ttgccgaaat cgggaaccct 901 aattttcggc ggcatgaaaa attttcgcca gaagcaaaaa cggccaaata 951 a
```

This corresponds to the amino acid sequence <SEQ ID 3048; ORF 519.ng>:

```
g519.pep
  1 MEFFIILLAA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRA MQAQITAERE KRARIAESEG RKIEQINLAS

201 GQREAEIQQS EGEAQAAVNA SNAEKIARIN RAKGEAESLR LVAEANAEAN

251 RQIAAALQTQ SGADAVNLKI AGQYVTAFKN LAKEDNTRIK PAKVAEIGNP

301 NFRRHEKFSP EAKTAK*
```

ORF 519 shows 87.5% identity over a 200 aa overlap with a predicted ORF (ORF 519.ng) from *N. gonorrhoeae*:

```
m519/g519
                                    10        20        30
      m519.pep                      SVIGRMELDKTFEERDEINSTVVAALDEAA
                                    ||||||||||||||||||||||||:|||||
          g519   YFQVTDPKLASYGSSNYIMAITQLAQTTLRSVIGRMELDKTFEERDEINSTVVSALDEAA
                 90       100       110       120       130       140
                40        50        60        70        80        90
      m519.pep  GAWGVKVLRYEIKDLVPPQEILRSMQAQITAEREKRARIAESEGRKIEQINLASGQREAE
                ||||||||||||||||||||||||:|||||||||||||||||||||||||||||||||||
          g519  GAWGVKVLRYEIKDLVPPQEILRAMQAQITAEREKRARIAESEGRKIEQINLASGQREAE
                150       160       170       180       190       200
                         100       110       120       130       140       150
      m519.pep  IQQSEGEAQAAVNASNAEKIARINRAKGEAESLRLVAEANAEAIRQIAAALQTQGGADAV
                ||||||:||||||||||||||||||||||||||||||||||||| ||||||||||:|||||
          g519  IQQSESEAQAAVNASNAEKIARINRAKGEAESLRLVAEANAEANRQIAAALQTQSGADAV
                210       220       230       240       250       260
                         160       170       180       190       200
      m519.pep  NLKIAEQYVAAFNNLAKESNTLIMPANVADIGSL-ISAGMKIIDSSKTAK
                ||||| |||:||:||||||:|| |  ||:||:||:  :    |:   :||||
          g519  NLKIAGQYVTAFKNLAKEDNTRIKPAKVAEIGNPNFRRHEKFSPEAKTAK
                270       280       290       300       310
```

The following partial DNA sequence was identified in *N. meningitidis* <SEQ ID 3049>:

```
a519.seq
  1 ATGGAATTTT TCATTATCTT GCTGGCAGCC GTCGTTGTTT TCGGCTTCAA

51 ATCCTTTGTT GTCATCCCAC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GTATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA
```

```
401 TCAACAGCAC CGTCGTCTCC GCCCTCGATG AAGCCGCCGG AGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC TGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCCGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 3050; ORF 519.a>:

```
a519.pep

1  MEFFIILLAA VVVFGFKSFV VIPQQEVHVV ERLGRFHRAL TAGLNILIPF
  51  IDRVAYRHSL KEIPLDVPSQ VCITRDNTQL TVDGIIYFQV TDPKLASYGS
 101  SNYIMAITQL AQTTLRSVIG RMELDKTFEE RDEINSTVVS ALDEAAGAWG
 151  VKVLRYEIKD LVPPQEILRS MQAQITAERE KRARIAESEG RKIEQINLAS
 201  GQREAEIQQS EGEAQAAVNA SNAEKIARIN RAKGEAESLR LVAEANAEAI
 251  RQIAAALQTQ GGADAVNLKI AEQYVAAFNN LAKESNTLIM PANVADIGSL
 301  ISAGMKIIDS SKTAK* m519/a519 ORFs 519 and 519.a showed a 99.5% identity in 199 aa overlap 10         20         30
m519.pep                SVIGRMELDKTFEERDEINSTVVAALDEAA
                        ||||||||||||||||||||||||:|||||
a519        YFQVTDPKLASYGSSNYIMAITQLAQTTLRSVIGRMELDKTFEERDEINSTVVSALDEAA
               90        100       110       120       130       140
                   40         50         60         70         80         90
m519.pep    GAWGVKVLRYEIKDLVPPQEILRSMQAQITAEREKRARIAESEGRKIEQINLASGQREAE
            ||||||||||||||||||||||||||||||||||||||||||||||||||||||||||||
a519        GAWGVKVLRYEIKDLVPPQEILRSMQAQITAEREKRARIAESEGRKIEQINLASGQREAE
               150       160       170       180       190       200
                   100       110       120       130       140       150
m519.pep    IQQSEGEAQAAVNASNAEKIARINRAKGEAESLRLVAEANAEAIRQIAAALQTQGGADAV
            ||||||||||||||||||||||||||||||||||||||||||||||||||||||||||||
a519        IQQSEGEAQAAVNASNAEKIARINRAKGEAESLRLVAEANAEAIRQIAAALQTQGGADAV
               210       220       230       240       250       260
                   160       170       180       190       200
m519.pep    NLKIAEQYVAAFNNLAKESNTLIMPANVADIGSLISAGMKIIDSSKTAKX
            ||||||||||||||||||||||||||||||||||||||||||||||||||
a519        NLKIAEQYVAAFNNLAKESNTLIMPANVADIGSLISAGMKIIDSSKTAKX
               270       280       290       300       310
```

Further work revealed the DNA sequence identified in *N. meningitidis* <SEQ ID 3051>:

```
m519-1.seq
   1 ATGGAATTTT TCATTATCTT GTTGGTAGCC GTCGCCGTTT TCGGTTTCAA

51 ATCCTTTGTT GTCATCCCAC AACAGGAAGT CCACGTTGTC GAAAGGCTGG

101 GGCGTTTCCA TCGCGCCCTG ACGGcCGGTT TGAATATTTT GATTCCCTTT
```

```
151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GCATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC TGTTGTTGCG GCTTTGGACG AGGCGGCCGG GGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC CGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCTGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 3052; ORF 519-1>:

```
m519-1.
    1 MEFFIILLVA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVA ALDEAAGAWG

151 VKVLRYEIKD LVPPQEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK*
```

The following partial DNA sequence was identified in *N. gonorrhoeae* <SEQ ID 3053>:

```
g519-1.seq
    1 ATGGAATTTT TCATTATCTT GTTGGCAGCC GTCGCCGTTT TCGGCTTCAA

51 ATCCTTTGTC GTCATCCCCC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGATAA TACGCAATTG ACTGTTGACG

251 GCATCATCTA TTTCCAAGTA ACCGATCCCA AACTCGCCTC ATACGGTTCG

301 AGCAACTACA TTATGGCAAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC CGTCGTCTCC GCCCTCGATG AAGCCGCCGG GGCTTGGGGT

451 GTGAAAGTCC TCCGTTACGA AATCAAGGAT TTGGTTCCGC CGCAAGAAAT

501 CCTTCGCGCA ATGCAGGCAC AAATTACCGC CGAACGCGAA AAACGCGCCC
```

```
551  GTATTGCCGA ATCCGAAGGC CGTAAAATCG AACAAATCAA CCTTGCCAGT

601  GGTCAGCGTG AAGCCGAAAT CCAACAATCC GAAGGCGAGG CTCAGGCTGC

651  GGTCAATGCG TCCAATGCCG AGAAAATCGC CCGCATCAAC CGCGCCAAAG

701  GCGAAGCGGA ATCCCTGCGC CTTGTTGCCG AAGCCAATGC CGAAGCCATC

751  CGTCAAATTG CCGCCGCCCT TCAAACCCAA GGCGGGGCGG ATGCGGTCAA

801  TCTGAAGATT GCGGAACAAT ACGTAGCCGC GTTCAACAAT CTTGCCAAAG

851  AAAGCAATAC GCTGATTATG CCCGCCAATG TTGCCGACAT CGGCAGCCTG

901  ATTTCTGCCG GCATGAAAAT TATCGACAGC AGCAAAACCG CCAAATAA
```

This corresponds to the amino acid sequence <SEQ ID 3054; ORF 519-1.ng>:

```
g519-1.pep

1  MEFFIILLAA VAVFGFKSFV VIPQQEVHVV ERLGRFHRAL TAGLNILIPF
    51  IDRVAYRHSL KEIPLDVPSQ VCITRDNTQL TVDGIIYFQV TDPKLASYGS
   101  SNYIMAITQL AQTTLRSVIG RMELDKTFEE RDEINSTVVS ALDEAAGAWG
   151  VKVLRYEIKD LVPPQEILRA MQAQITAERE KRARIAESEG RKIEQINLAS
   201  GQREAEIQQS EGEAQAAVNA SNAEKIARIN RAKGEAESLR LVAEANAEAI
   251  RQIAAALQTQ GGADAVNLKI AEQYVAAFNN LAKESNTLIM PANVADIGSL
   301  ISAGMKIIDS SKTAK*
``` m519-1/g519-1 99.0% identity in 315 aa overlap

```
                    10         20         30         40         50         60
g519-1.pep  MEFFIILLAAVAVFGFKSFVVIPQQEVHVVERLGRFHRALTAGLNILIPFIDRVAYRHSL
            ||||||||:|||||||||||||||||||||||||||||||||||||||||||||||||||
m519-1      MEFFIILLVAVAVFGFKSFVVIPQQEVHVVERLGRFHRALTAGLNILIPFIDRVAYRHSL
                    10         20         30         40         50         60

70         80         90        100        110        120
g519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                    70         80         90        100        110        120

130        140        150        160        170        180
g519-1.pep  RMELDKTFEERDEINSTVVSALDEAAGAWGVKVLRYEIKDLVPPQEILRAMQAQITAERE
            |||||||||||||||||||:||||||||||||||||||||||||||||||:|||||||||
m519-1      RMELDKTFEERDEINSTVVAALDEAAGAWGVKVLRYEIKDLVPPQEILRSMQAQITAERE
                   130        140        150        160        170        180

190        200        210        220        230        240
g519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                   190        200        210        220        230        240

250        260        270        280        290        300
g519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                   250        260        270        280        290        300

310
g519-1.pep  ISAGMKIIDSSKTAKX
            ||||||||||||||||
m519-1      ISAGMKIIDSSKTAKX
                   310
```

The following DNA sequence was identified in *N. meningitidis* <SEQ ID 3055>:

```
a519-1.seq
     1  ATGGAATTTT TCATTATCTT GCTGGCAGCC GTCGTTGTTT TCGGCTTCAA

51  ATCCTTTGTT GTCATCCCAC AGCAGGAAGT CCACGTTGTC GAAAGGCTCG
```

```
101   GGCGTTTCCA TCGCGCCCTG ACGGCCGGTT TGAATATTTT GATTCCCTTT

151   ATCGACCGCG TCGCCTACCG CCATTCGCTG AAAGAAATCC CTTTAGACGT

201   ACCCAGCCAG GTCTGCATCA CGCGCGACAA TACGCAGCTG ACTGTTGACG

251   GTATCATCTA TTTCCAAGTA ACCGACCCCA AACTCGCCTC ATACGGTTCG

301   AGCAACTACA TTATGGCGAT TACCCAGCTT GCCCAAACGA CGCTGCGTTC

351   CGTTATCGGG CGTATGGAAT TGGACAAAAC GTTTGAAGAA CGCGACGAAA

401   TCAACAGCAC CGTCGTCTCC GCCCTCGATG AAGCCGCCGG AGCTTGGGGT

451   GTGAAGGTTT TGCGTTATGA GATTAAAGAC TTGGTTCCGC CGCAAGAAAT

501   CCTTCGCTCA ATGCAGGCGC AAATTACTGC TGAACGCGAA AAACGCGCCC

551   GTATCGCCGA ATCCGAAGGT CGTAAAATCG AACAAATCAA CCTTGCCAGT

601   GGTCAGCGCG AAGCCGAAAT CCAACAATCC GAAGGCGAGG CTCAGGCTGC

651   GGTCAATGCG TCAAATGCCG AGAAAATCGC CCGCATCAAC CGCGCCAAAG

701   GTGAAGCGGA ATCCTTGCGC CTTGTTGCCG AAGCCAATGC CGAAGCCATC

751   CGTCAAATTG CCGCCGCCCT TCAAACCCAA GGCGGTGCGG ATGCGGTCAA

801   TCTGAAGATT GCGGAACAAT ACGTCGCCGC GTTCAACAAT CTTGCCAAAG

851   AAAGCAATAC GCTGATTATG CCCGCCAATG TTGCCGACAT CGGCAGCCTG

901   ATTTCTGCCG GTATGAAAAT TATCGACAGC AGCAAAACCG CCAAATAA
```

This corresponds to the amino acid sequence <SEQ ID 3056; ORF 519-1.a>:

```
a519-1.pep.

1   MEFFIILLAA VVVFGFKSFV VIPQQEVHVV ERLGRFHRAL TAGLNILIPF

51   IDRVAYRHSL KEIPLDVPSQ VCITRDNTQL TVDGIIYFQV TDPKLASYGS

101   SNYIMAITQL AQTTLRSVIG RMELDKTFEE RDEINSTVVS ALDEAAGAWG

151   VKVLRYEIKD LVPPQEILRS MQAQITAERE KRARIAESEG RKIEQINLAS

201   GQREAEIQQS EGEAQAAVNA SNAEKIARIN RAKGEAESLR LVAEANAEAI

251   RQIAAALQTQ GGADAVNLKI AEQYVAAFNN LAKESNTLIM PANVADIGSL

301   ISAGMKIIDS SKTAK* m519-1/a519-1  ORFs 519-1 and 519-1.a showed a 99.0% identity in 315 aa overlap 10         20         30         40         50         60
a519-1.pep  MEFFIILLAAVVVFGFKSFVVIPQQEVHVVERLGRFHRALTAGLNILIPFIDRVAYRHSL
            |||||||:||:|||||||||||||||||||||||||||||||||||||||||||||||||
m519-1      MEFFIILLVAVAVFGFKSFVVIPQQEVHVVERLGRFHRALTAGLNILIPFIDRVAYRHSL
                    10         20         30         40         50         60

70         80         90        100        110        120
a519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                    70         80         90        100        110        120

130        140        150        160        170        180
a519-1.pep  RMELDKTFEERDEINSTVVSALDEAAGAWGVKVLRYEIKDLVPPQEILRSMQAQITAERE
            |||||||||||||||||||:||||||||||||||||||||||||||||||||||||||||
m519-1      RMELDKTFEERDEINSTVVAALDEAAGAWGVKVLRYEIKDLVPPQEILRSMQAQITAERE
                   130        140        150        160        170        180

190        200        210        220        230        240
a519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                   190        200        210        220        230        240
```

-continued

```
                       250        260        270        280        290        300
    a519-1.pep    LVAEANAEAIRQIAAALQTQGGADAVNLKIAEQYVAAFNNLAKESNTLIMPANVADIGSL
                  ||||||||||||||||||||||||||||||||||||||||||||||||||||||||||||
    m519-1        LVAEANAEAIRQIAAALQTQGGADAVNLKIAEQYVAAFNNLAKESNTLIMPANVADIGSL
                       250        260        270        280        290        300

310
    a519-1.pep    ISAGMKIIDSSKTAKX
                  |||||||||||||||
    m519-1        ISAGMKIIDSSKTAKX
                       310
```

576 and 576-1 gnm22.seq

The following partial DNA sequence was identified in *N. meningitidis* <SEQ ID 3057>:

```
m576.seq . . . (partial)
    1 . . . ATGCAGCAGG CAAGCTATGC GATGGGCGTG GACATCGGAC GCTCCCTGAA

51       GCAAATGAAG GAACAGGGCG CGGAAATCGA TTTGAAAGTC TTTACCGAAG

101       CCATGCAGGC AGTGTATGAC GGCAAAGAAA TCAAAATGAC CGAAGAGCAG

151       GCTCAGGAAG TCATGATGAA ATTCCTTCAG GAACAACAGG CTAAAGCCGT

201       AGAAAAACAC AAGGCGGACG CGAAGGCCAA TAAAGAAAAA GGCGAAGCCT

251       TTCTGAAAGA AAATGCCGCC AAAGACGGCG TGAAGACCAC TGCTTCCGGC

301       CTGCAATACA AAATCACCAA ACAGGGCGAA GGCAAACAGC CGACCAAAGA

351       CGACATCGTT ACCGTGGAAT ACGAAGGCCG CCTGATTGAC GGTACGGTAT

401       TCGACAGCAG CAAAGCCAAC GGCGGCCCGG TCACCTTCCC TTTGAGCCAA

451       GTGATTCCGG GTTGGACCGA AGgCGTACAG CTTCTGAAAG AAGGCGGCGA

501       AGCCACGTTC TACATCCCGT CCAACCTTGC CTACCGCGAA CAGGGTGCGG

551       GCGACAAAAT CGGTCCGAAC GCCACTTTGG TATTTGATGT GAAACTGGTC

601       AAAATCGGCG CACCCGAAAA CGCGCCCGCC AAGCAGCCGG CTCAAGTCGA

651       CATCAAAAAA GTAAATTAA
```

This corresponds to the amino acid sequence <SEQ ID 3058; ORF 576>:

```
m576.pep . . . (partial)
    1 . . . MQQASYAMGV DIGRSLKQMK EQGAEIDLKV FTEAMQAVYD GKEIKMTEEQ

51       AQEVMMKFLQ EQQAKAVEKH KADAKANKEK GEAFLKENAA KDGVKTTASG

101       LQYKITKQGE GKQPTKDDIV TVEYEGRLID GTVFDSSKAN GGPVTFPLSQ

151       VIPGWTEGVQ LLKEGGEATF YIPSNLAYRE QGAGDKIGPN ATLVFDVKLV

201       KIGAPENAPA KQPAQVDIKK VN*
```

The following partial DNA sequence was identified in *N. gonorrhoeae* <SEQ ID 3059>:

```
g576.seq . . . (partial)
    1 . . . atgggcgtgg acatcggacg ctccctgaaa caaatgaagg aacagggcgc 51       ggaaatcgat ttgaaagtct ttaccgatgc catgcaggca gtgtatgacg 101       gcaaagaaat caaaatgacc gaagagcagg cccaggaagt gatgatgaaa 151       ttcctgcagg agcagcaggc taaagccgta gaaaaacaca aggcggatgc 201       gaaggccaac aaagaaaaag gcgaagcctt cctgaaggaa aatgccgccg
```

```
251      aagacggcgt gaagaccact gcttccggtc tgcagtacaa aatcaccaaa 301      cagggtgaag gcaaacagcc gacaaaagac gacatcgtta ccgtggaata 351      cgaaggccgc ctgattgacg gtaccgtatt cgacagcagc aaagccaacg 401      gcggcccggc caccttccct ttgagccaag tgattccggg ttggaccgaa 451      ggcgtacggc ttctgaaaga aggcggcgaa gccacgttct acatcccgtc 501      caaccttgcc taccgcgaac agggtgcggg cgaaaaaatc ggtccgaacg 551      ccactttggt atttgacgtg aaactggtca aaatcggcgc acccgaaaac 601      gcgcccgcca agcagccgga tcaagtcgac atcaaaaaag taaattaa
```

This corresponds to the amino acid sequence <SEQ ID 3060; ORF 576.ng>:

```
g576.pep . . . (partial)
    1 . . . MGVDIGRSLK QMKEQGAEID LKVFTDAMQA VYDGKEIKMT EEQAQEVMMK

51      FLQEQQAKAV EKHKADAKAN KEKGEAFLKE NAAEDGVKTT ASGLQYKITK

101      QGEGKQPTKD DIVTVEYEGR LIDGTVFDSS KANGGPATFP LSQVIPGWTE

151      GVRLLKEGGE ATFYIPSNLA YREQGAGEKI GPNATLVFDV KLVKIGAPEN

201      APAKQPDQVD IKKVN*
```

Computer analysis of this amino acid sequence gave the following results:
Homology with a Predicted ORF from *N. gonorrhoeae*

```
    m576/g576 97.2% identity in 215 aa overlap
                    10         20         30         40         50         60
    m576.pep MQQASYAMGVDIGRSLKQMKEQGAEIDLKVFTEAMQAVYDGKEIKMTEEQAQEVMMKFLQ
                       ||||||||||||||||||||||||:||||||||||||||||||||||||
    g576             MGVDIGRSLKQMKEQGAEIDLKVFTDAMQAVYDGKEIKMTEEQAQEVMMKFLQ
                             10         20         30         40         50

70         80         90        100        110        120
    m576.pep EQQAKAVEKHKADAKANKEKGEAFLKENAAKDGVKTTASGLQYKITKQGEGKQPTKDDIV
             ||||||||||||||||||||||||||||||:|||||||||||||||||||||||||||||
    g576     EQQAKAVEKHKADAKANKEKGEAFLKENAAEDGVKTTASGLQYKITKQGEGKQPTKDDIV
                     60         70         80         90        100        110

130        140        150        160        170        180
    m576.pep TVEYEGRLIDGTVFDSSKANGGPVTFPLSQVIPGWTEGVQLLKEGGEATFYIPSNLAYRE
             ||||||||||||||||||||||:|||||||||||||||:|||||||||||||||||||||
    g576     TVEYEGRLIDGTVFDSSKANGGPATFPLSQVIPGWTEGVRLLKEGGEATFYIPSNLAYRE
                    120        130        140        150        160        170

190        200        210        220
    m576.pep QGAGDKIGPNATLVFDVKLVKIGAPENAPAKQPAQVDIKKVNX
             ||||:|||||||||||||||||||||||||||| ||||||||
    g576     QGAGEKIGPNATLVFDVKLVKIGAPENAPAKQPDQVDIKKVNX
                    180        190        200        210
```

The following partial DNA sequence was identified in *N. meningitidis* <SEQ ID 3061>:

```
a576.seq
    1    ATGAACACCA TTTTCAAAAT CAGCGCACTG ACCCTTTCCG CCGCTTTGGC

51    ACTTTCCGCC TGCGGCAAAA AAGAAGCCGC CCCCGCATCT GCATCCGAAC

101    CTGCCGCCGC TTCTTCCGCG CAGGGCGACA CCTCTTCGAT CGGCAGCACG

151    ATGCAGCAGG CAAGCTATGC GATGGGCGTG GACATCGGAC GCTCCCTGAA

201    GCAAATGAAG GAACAGGGCG CGGAAATCGA TTTGAAAGTC TTTACCGAAG

251    CCATGCAGGC AGTGTATGAC GGCAAAGAAA TCAAAATGAC CGAAGAGCAG
```

```
301  GCTCAGGAAG TCATGATGAA ATTCCTTCAG GAACAACAGG CTAAAGCCGT

351  AGAAAAACAC AAGGCGGACG CGAAGGCCAA TAAAGAAAAA GGCGAAGCCT

401  TTCTGAAAGA AAATGCCGCC AAAGACGGCG TGAAGACCAC TGCTTCCGGC

451  CTGCAATACA AAATCACCAA ACAGGGCGAA GGCAAACAGC CGACCAAAGA

501  CGACATCGTT ACCGTGGAAT ACGAAGGCCG CCTGATTGAC GGTACGGTAT

551  TCGACAGCAG CAAAGCCAAC GGCGGCCCGG TCACCTTCCC TTTGAGCCAA

601  GTGATTCTGG GTTGGACCGA AGGCGTACAG CTTCTGAAAG AAGGCGGCGA

651  AGCCACGTTC TACATCCCGT CCAACCTTGC CTACCGCGAA CAGGGTGCGG

701  GCGACAAAAT CGGCCCGAAC GCCACTTTGG TATTTGATGT GAAACTGGTC

751  AAAATCGGCG CACCCGAAAA CGCGCCCGCC AAGCAGCCGG CTCAAGTCGA

801  CATCAAAAAA GTAAATTAA
```

This corresponds to the amino acid sequence <SEQ ID 3062; ORF 576.a>:

```
a576.pep

1   MNTIFKISAL TLSAALALSA CGKKEAAPAS ASEPAAASSA QGDTSSIGST

51   MQQASYAMGV DIGRSLKQMK EQGAEIDLKV FTEAMQAVYD GKEIKMTEEQ

101   AQEVMMKFLQ EQQAKAVEKH KADAKANKEK GEAFLKENAA KDGVKTTASG

151   LQYKITKQGE GKQPTKDDIV TVEYEGRLID GTVFDSSKAN GGPVTFPLSQ

201   VILGWTEGVQ LLKEGGEATF YIPSNLAYRE QGAGDKIGPN ATLVFDVKLV

251   KIGAPENAPA KQPAQVDIKK VN* m576/a576   99.5% identity in 222 aa overlap 10         20         30
m576.pep                       MQQASYAMGVDIGRSLKQMKEQGAEIDLKV
                               |||||||||||||||||||||||||||||
a576      CGKKEAAPASASEPAAASSAQGDTSSIGSTMQQASYAMGVDIGRSLKQMKEQGAEIDLKV
                   30        40        50        60        70        80

40        50        60        70        80        90
m576.pep  FTEAMQAVYDGKEIKMTEEQAQEVMMKFLQEQQAKAVEKHKADAKANKEKGEAFLKENAA
          ||||||||||||||||||||||||||||||||||||||||||||||||||||||||||||
a576      FTEAMQAVYDGKEIKMTEEQAQEVMMKFLQEQQAKAVEKHKADAKANKEKGEAFLKENAA
                 90       100       110       120       130       140

100       110       120       130       140       150
m576.pep  KDGVKITASGLQYKITKQGEGKQPTKDDIVTVEYEGRLIDGTVFDSSKANGGPVTFPLSQ
          ||||||||||||||||||||||||||||||||||||||||||||||||||||||||||||
a576      KDGVKITASGLQYKITKQGEGKQPTKDDIVTVEYEGRLIDGTVFDSSKANGGPVTFPLSQ
                150       160       170       180       190       200

160       170       180       190       200       210
m576.pep  VIPGWTEGVQLLKEGGEATFYIPSNLAYREQGAGDKIGPNATLVFDVKLVKIGAPENAPA
          || |||||||||||||||||||||||||||||||||||||||||||||||||||||||||
a576      VILGWTEGVQLLKEGGEATFYIPSNLAYREQGAGDKIGPNATLVFDVKLVKIGAPENAPA
                210       220       230       240       250       260

220
m576.pep  KQPAQVDIKKVNX
          |||||||||||||
a576      KQPAQVDIKKVNX
                270
```

The following partial DNA sequence was identified in *N. meningitidis* <SEQ ID 3063>:

```
m576-1.seq
  1   ATGAACACCA TTTTCAAAAT CAGCGCACTG ACCCTTTCCG CCGCTTTGGC

51   ACTTTCCGCC TGCGGCAAAA AAGAAGCCGC CCCCGCATCT GCATCCGAAC
```

```
101    CTGCCGCCGC TTCTTCCGCG CAGGGCGACA CCTCTTCGAT CGGCAGCACG

151    ATGCAGCAGG CAAGCTATGC GATGGGCGTG GACATCGGAC GCTCCCTGAA

201    GCAAATGAAG GAACAGGGCG CGGAAATCGA TTTGAAAGTC TTTACCGAAG

251    CCATGCAGGC AGTGTATGAC GGCAAAGAAA TCAAAATGAC CGAAGAGCAG

301    GCTCAGGAAG TCATGATGAA ATTCCTTCAG GAACAACAGG CTAAAGCCGT

351    AGAAAAACAC AAGGCGGACG CGAAGGCCAA TAAAGAAAAA GGCGAAGCCT

401    TTCTGAAAGA AAATGCCGCC AAAGACGGCG TGAAGACCAC TGCTTCCGGC

451    CTGCAATACA AAATCACCAA ACAGGGCGAA GGCAAACAGC CGACCAAAGA

501    CGACATCGTT ACCGTGGAAT ACGAAGGCCG CCTGATTGAC GGTACGGTAT

551    TCGACAGCAG CAAAGCCAAC GGCGGCCCGG TCACCTTCCC TTTGAGCCAA

601    GTGATTCCGG GTTGGACCGA AGGCGTACAG CTTCTGAAAG AAGGCGGCGA

651    AGCCACGTTC TACATCCCGT CCAACCTTGC CTACCGCGAA CAGGGTGCGG

701    GCGACAAAAT CGGTCCGAAC GCCACTTTGG TATTTGATGT GAAACTGGTC

751    AAAATCGGCG CACCCGAAAA CGCGCCCGCC AAGCAGCCGG CTCAAGTCGA

801    CATCAAAAAA GTAAATTAA
```

This corresponds to the amino acid sequence <SEQ ID 3064; ORF 576-1>:

```
m576-1.pep.
     1    MNTIFKISAL TLSAALALSA CGKKEAAPAS ASEPAAASSA QGDTSSIGST

51    MQQASYAMGV DIGRSLKQMK EQGAEIDLKV FTEAMQAVYD GKEIKMTEEQ

101    AQEVMMKFLQ EQQAKAVEKH KADAKANKEK GEAFLKENAA KDGVKTTASG

151    LQYKITKQGE GKQPTKDDIV TVEYEGRLID GTVFDSSKAN GGPVTFPLSQ

201    VIPGWTEGVQ LLKEGGEATF YIPSNLAYRE QGAGDKIGPN ATLVFDVKLV

251    KIGAPENAPA KQPAQVDIKK VN*
```

The following partial DNA sequence was identified in *N. gonorrhoeae* <SEQ ID 3065>:

```
g576-1.seq
     1    ATGAACACCA TTTTCAAAAT CAGCGCACTG ACCCTTTCCG CCGCTTTGGC

51    ACTTTCCGCC TGCGGCAAAA AAGAAGCCGC CCCCGCATCT GCATCCGAAC

101    CTGCCGCCGC TTCTGCCGCG CAGGGCGACA CCTCTTCAAT CGGCAGCACG

151    ATGCAGCAGG CAAGCTATGC AATGGGCGTG GACATCGGAC GCTCCCTGAA

201    ACAAATGAAG GAACAGGGCG CGGAAATCGA TTTGAAAGTC TTTACCGATG

251    CCATGCAGGC AGTGTATGAC GGCAAAGAAA TCAAAATGAC CGAAGAGCAG

301    GCCCAGGAAG TGATGATGAA ATTCCTGCAG GAGCAGCAGG CTAAAGCCGT

351    AGAAAAACAC AAGGCGGATG CGAAGGCCAA CAAAGAAAAA GGCGAAGCCT

401    TCCTGAAGGA AAATGCCGCC AAAGACGGCG TGAAGACCAC TGCTTCCGGT

451    CTGCAGTACA AAATCACCAA ACAGGGTGAA GGCAAACAGC CGACAAAAGA

501    CGACATCGTT ACCGTGGAAT ACGAAGGCCG CCTGATTGAC GGTACCGTAT

551    TCGACAGCAG CAAAGCCAAC GGCGGCCCGG CCACCTTCCC TTTGAGCCAA
```

```
601  GTGATTCCGG GTTGGACCGA AGGCGTACGG CTTCTGAAAG AAGGCGGCGA

651  AGCCACGTTC TACATCCCGT CCAACCTTGC CTACCGCGAA CAGGGTGCGG

701  GCGAAAAAAT CGGTCCGAAC GCCACTTTGG TATTTGACGT GAAACTGGTC

751  AAAATCGGCG CACCCGAAAA CGCGCCCGCC AAGCAGCCGG ATCAAGTCGA

801  CATCAAAAAA GTAAATTAA
```

This corresponds to the amino acid sequence <SEQ ID 3066; ORF 576-1.ng>:

```
g576-1.pep

1  MNTIFKISAL TLSAALALSA CGKKEAAPAS ASEPAAASAA QGDTSSIGST

51  MQQASYAMGV DIGRSLKQMK EQGAEIDLKV FTDAMQAVYD GKEIKMTEEQ

101  AQEVMMKFLQ EQQAKAVEKH KADAKANKEK GEAFLKENAA KDGVKTTASG

151  LQYKITKQGE GKQPTKDDIV TVEYEGRLID GTVFDSSKAN GGPATFPLSQ

201  VIPGWTEGVR LLKEGGEATF YIPSNLAYRE QGAGEKIGPN ATLVFDVKLV

251  KIGAPENAPA KQPDQVDIKK VN* g576-1/m576-1 ORFa 576-1 and 567-1.a showed a 97.8% identity in 272 aa overlap 10        20        30        40        50        60
g576-1.pep MNTIFKISALTLSAALALSACGKKEAAPASASEPAAASAAQGDTSSIGSTMQQASYAMGV
           |||||||||||||||||||||||||||||||||||||||:||||||||||||||||||||
m576-1     MNTIFKISALTLSAALALSACGKKEAAPASASEPAAASSAQGDTSSIGSTMQQASYAMGV
                   10        20        30        40        50        60

70        80        90       100       110       120
g576-1.pep DIGRSLKQMKEQGAEIDLKVFTDAMQAVYDGKEIKMTEEQAQEVMMKFLQEQQAKAVEKH
           |||||||||||||||||||||:||||||||||||||||||||||||||||||||||||||
m576-1     DIGRSLKQMKEQGAEIDLKVFTEAMQAVYDGKEIKMTEEQAQEVMMKFLQEQQAKAVEKH
                   70        80        90       100       110       120

130       140       150       160       170       180
g576-1.pep KADAKANKEKGEAFLKENAAKDGVKTTASGLQYKITKQGEGKQPTKDDIVTVEYEGRLID
           ||||||||||||||||||||||||||||||||||||||||||||||||||||||||||||
m576-1     KADAKANKEKGEAFLKENAAKDGVKTTASGLQYKITKQGEGKQPTKDDIVTVEYEGRLID
                  130       140       150       160       170       180

190       200       210       220       230       240
g576-1.pep GTVFDSSKANGGPATFPLSQVIPGWTEGVRLLKEGGEATFYIPSNLAYREQGAGEKIGPN
           ||||||||||||||:|||||||||||||||:|||||||||||||||||||||||||:|||
m576-1     GTVFDSSKANGGPVTFPLSQVIPGWTEGVQLLKEGGEATFYIPSNLAYREQGAGDKIGPN
                  190       200       210       220       230       240

250       260       270
g576-1.pep ATLVFDVKLVKIGAPENAPAKQPDQVDIKKVNX
           |||||||||||||||||||||||| ||||||||
m576-1     ATLVFDVKLVKIGAPENAPAKQPAQVDIKKVNX
                  250       260       270
```

The following DNA sequence was identified in *N. meningitidis* <SEQ ID 3067>:

```
a576-1.seq
   1  ATGAACACCA TTTTCAAAAT CAGCGCACTG ACCCTTTCCG CCGCTTTGGC

51  ACTTTCCGCC TGCGGCAAAA AAGAAGCCGC CCCCGCATCT GCATCCGAAC

101  CTGCCGCCGC TTCTTCCGCG CAGGGCGACA CCTCTTCGAT CGGCAGCACG

151  ATGCAGCAGG CAAGCTATGC GATGGGCGTG ACATCGGAC GCTCCCTGAA

201  GCAAATGAAG GAACAGGGCG CGGAAATCGA TTTGAAAGTC TTTACCGAAG

251  CCATGCAGGC AGTGTATGAC GGCAAAGAAA TCAAAATGAC CGAAGAGCAG

301  GCTCAGGAAG TCATGATGAA ATTCCTTCAG GAACAACAGG CTAAAGCCGT

351  AGAAAAACAC AAGGCGGACG CGAAGGCCAA TAAGAAAAA GGCGAAGCCT

401  TTCTGAAAGA AAATGCCGCC AAAGACGGCG TGAAGACCAC TGCTTCCGGC
```

```
451  CTGCAATACA AAATCACCAA ACAGGGCGAA GGCAAACAGC CGACCAAAGA

501  CGACATCGTT ACCGTGGAAT ACGAAGGCCG CCTGATTGAC GGTACGGTAT

551  TCGACAGCAG CAAAGCCAAC GGCGGCCCGG TCACCTTCCC TTTGAGCCAA

601  GTGATTCTGG GTTGGACCGA AGGCGTACAG CTTCTGAAAG AAGGCGGCGA

651  AGCCACGTTC TACATCCCGT CCAACCTTGC CTACCGCGAA CAGGGTGCGG

701  GCGACAAAAT CGGCCCGAAC GCCACTTTGG TATTTGATGT GAAACTGGTC

751  AAAATCGGCG CACCCGAAAA CGCGCCCGCC AAGCAGCCGG CTCAAGTCGA

801  CATCAAAAAA GTAAATTAA
                                                       15
```

This corresponds to the amino acid sequence <SEQ ID 3068; ORF 576-1.a>:

```
a576-1.pep

1  MNTIFKISAL TLSAALALSA CGKKEAAPAS ASEPAAASSA QGDTSSIGST

51  MQQASYAMGV DIGRSLKQMK EQGAEIDLKV FTEAMQAVYD GKEIKMTEEQ

101  AQEVMMKFLQ EQQAKAVEKH KADAKANKEK GEAFLKENAA KDGVKTTASG

151  LQYKITKQGE GKQPTKDDIV TVEYEGRLID GTVFDSSKAN GGPVTFPLSQ

201  VIPGWTEGVQ LLKEGGEATF YIPSNLAYRE QGAGDKIGPN ATLVFDVKLV

251  KIGAPENAPA KQPAQVDIKK VN* a576-1/m576-1 99.6% identity in 272 aa overlap 10         20         30         40         50         60
a576-1.pep  MNTIFKISALTLSAALALSACGKKEAAPASASEPAAASSAQGDTSSIGSTMQQASYAMGV
            ||||||||||||||||||||||||||||||||||||||||||||||||||||||||||||
m576-1      MNTIFKISALTLSAALALSACGKKEAAPASASEPAAASSAQGDTSSIGSTMQQASYAMGV
                    10         20         30         40         50         60

70         80         90        100        110        120
a576-1.pep  DIGRSLKQMKEQGAEIDLKVFTEAMQAVYDGKEIKMTEEQAQEVMMKFLQEQQAKAVEKH
            ||||||||||||||||||||||||||||||||||||||||||||||||||||||||||||
m576-1      DIGRSLKQMKEQGAEIDLKVFTEAMQAVYDGKEIKMTEEQAQEVMMKFLQEQQAKAVEKH
                    70         80         90        100        110        120

130        140        150        160        170        180
a576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                   130        140        150        160        170        180

190        200        210        220        230        240
a576-1.pep  GTVFDSSKANGGPVTFPLSQVILGWTEGVQLLKEGGEATFYIPSNLAYREQGAGDKIGPN
            |||||||||||||||||||| |||||||||||||||||||||||||||||||||||||||
m576-1      GTVFDSSKANGGPVTFPLSQVIPGWTEGVQLLKEGGEATFYIPSNLAYREQGAGDKIGPN
                   190        200        210        220        230        240

250        260        270
a576-1.pep  ATLVFDVKLVKIGAPENAPAKQPAQVDIKKVNX
            |||||||||||||||||||||||||||||||||
m576-1      ATLVFDVKLVKIGAPENAPAKQPAQVDIKKVNX
                   250        260        270
```

919 gnm43.seq

The following partial DNA sequence was identified in *N. meningitidis* <SEQ ID 3069>:

```
m919.seq
    1  ATGAAAAAAT ACCTATTCCG CGCCGCCCTG TACGGCATCG CCGCCGCCAT

51  CCTCGCCGCC TGCCAAAGCA AGAGCATCCA AACCTTTCCG CAACCCGACA

101  CATCCGTCAT CAACGGCCCG GACCGGCCGG TCGGCATCCC CGACCCCGCC

151  GGAACGACGG TCGGCGGCGG CGGGGCCGTC TATACCGTTG TACCGCACCT

201  GTCCCTGCCC CACTGGGCGG CGCAGGATTT CGCCAAAAGC CTGCAATCCT
```

```
 251 TCCGCCTCGG CTGCGCCAAT TTGAAAAACC GCCAAGGCTG GCAGGATGTG

301 TGCGCCCAAG CCTTTCAAAC CCCCGTCCAT TCCTTTCAGG CAAAACAGTT

351 TTTTGAACGC TATTTCACGC CGTGGCAGGT TGCAGGCAAC GGAAGCCTTG

401 CCGGTACGGT TACCGGCTAT TACGAACCGG TGCTGAAGGG CGACGACAGG

451 CGGACGGCAC AAGCCCGCTT CCCGATTTAC GGTATTCCCG ACGATTTTAT

501 CTCCGTCCCC CTGCCTGCCG GTTTGCGGAG CGGAAAAGCC CTTGTCCGCA

551 TCAGGCAGAC GGGAAAAAAC AGCGGCACAA TCGACAATAC CGGCGGCACA

601 CATACCGCCG ACCTCTCCcG ATTCCCCATC ACCGCGCGCA CAACAGCAAT

651 CAAAGGCAGG TTTGAAGGAA GCCGCTTCCT CCCCTACCAC ACGCGCAACC

701 AAATCAACGG CGGCGCGCTT GACGGCAAAG CCCCGATACT CGGTTACGCC

751 GAAGACCCTG TCGAACTTTT TTTTATGCAC ATCCAAGGCT CGGGCCGTCT

801 GAAAACCCCG TCCGGCAAAT ACATCCGCAT CGGCTATGCC GACAAAAACG

851 AACATCCyTA CGTTTCCATC GGACGCTATA TGGCGGATAA GGGCTACCTC

901 AAACTCGGAC AAACCTCCAT GCAGGGCATT AAGTCTTATA TGCGGCAAAA

951 TCCGCAACGC CTCGCCGAAG TTTTGGGTCA AAACCCCAGC TATATCTTTT

1001 TCCGCGAGCT TGCCGGAAGC AGCAATGACG GCCCTGTCGG CGCACTGGGC

1051 ACGCCGCTGA TGGGGGAATA TGCCGGCGCA GTCGACCGGC ACTACATTAC

1101 CTTGGGTGCG CCCTTATTTG TCGCCACCGC CCATCCGGTT ACCCGCAAAG

1151 CCCTCAACCG CCTGATTATG GCGCAGGATA CCGGCAGCGC GATTAAAGGC

1201 GCGGTGCGCG TGGATTATTT TTGGGGATAC GGCGACGAAG CCGGCGAACT

1251 TGCCGGCAAA CAGAAAACCA CGGGATATGT CTGGCAGCTC CTACCCAACG

1301 GTATGAAGCC CGAATACCGc CCGTAA
```

This corresponds to the amino acid sequence <SEQ ID 3070; ORF 919>:

```
m919.pep
   1 MKKYLFRAAL YGIAAAILAA CQSKSIQTFP QPDTSVINGP DRPVGIPDPA

51 GTTVGGGGAV YTVVPHLSLP HWAAQDFAKS LQSFRLGCAN LKNRQGWQDV

101 CAQAFQTPVH SFQAKQFFER YFTPWQVAGN GSLAGTVTGY YEPVLKGDDR

151 RTAQARFPIY GIPDDFISVP LPAGLRSGKA LVRIRQTGKN SGTIDNTGGT

201 HTADLSRFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KSYMRQNPQR LAEVLGQNPS YIFFRELAGS SNDGPVGALG

351 TPLMGEYAGA VDRHYITLGA PLFVATAHPV TRKALNRLIM AQDTGSAIKG

401 AVRVDYFWGY GDEAGELAGK QKTTGYVWQL LPNGMKPEYR P*
```

The following partial DNA sequence was identified in *N. gonorrhoeae* <SEQ ID 3071>:

```
g919.seq
   1 ATGAAAAAAC ACCTGCTCCG CTCCGCCCTG TACGGcatCG CCGCCgccAT

51 CctcgCCGCC TGCCAAAgca gGAGCATCCA AACCTTTCCG CAACCCGACA

101 CATCCGTCAT CAACGGCCCG GACCGGCCGG CCGGCATCCC CGACCCCGCC
```

-continued

```
 151 GGAACGACGG TTGCCGGCGG CGGGGCCGTC TATACCGTTG TGCCGCACCT

201 GTCCATGCCC CACTGGGCGG CGCaggATTT TGCCAAAAGC CTGCAATCCT

251 TCCGCCTCGG CTGCGCCAAT TTGAAAAACC GCCAAGGCTG GCAGGATGTG

301 TGCGCCCAAG CCTTTCAAAC CCCCGTGCAT TCCTTTCAGG CAAAGcGgTT

351 TTTTGAACGC TATTTCACGC cgtGGCaggt tgcaggcaAC GGAAGcCTTG

401 Caggtacggt TACCGGCTAT TACGAACCGG TGCTGAAGGG CGACGGCAGG

451 CGGACGGAAC GGGCCCGCTT CCCGATTTAC GGTATTCCCG ACGATTTTAT

501 CTCCGTCCCG CTGCCTGCCG GTTTGCGGGG CGGAAAAAAC CTTGTCCGCA

551 TCAGGCAGac ggGGAAAAAC AGCGGCACGA TCGACAATGC CGGCGGCACG

601 CATACCGCCG ACCTCTCCCG ATTCCCCATC ACCGCGCGCA CAACGGcaat 651 caaaGGCAGG TTTGAaggAA GCCGCTTCCT CCCTTACCAC ACGCGCAACC 701 AAAtcaacGG CGGCgcgcTT GACGGCAAag cccCCATCCT CggttacgcC 751 GAagaccCcG tcgaactttT TTTCATGCAC AtccaaggCT CGGGCCGCCT 801 GAAAACCCcg tccggcaaat acatCCGCAt cggaTacgcc gacAAAAACG 851 AACAtccgTa tgtttccatc ggACGctaTA TGGCGGACAA AGGCTACCTC 901 AAGctcgggc agACCTCGAT GCAGGgcatc aaagcCTATA TGCGGCAAAA

951 TCCGCAACGC CTCGCCGAAG TTTTGGGTCA AAACCCCAGC TATATCTTTT

1001 TCCGCGAGCT TGCCGGAAGC GGCAATGAGG GCCCCGTCGG CGCACTGGGC

1051 ACGCCACTGA TGGGGGAATA CGCCGGCGCA ATCGACCGGC ACTACATTAC

1101 CTTGGGCGCG CCCTTATTTG TCGCCACCGC CCATCCGGTT ACCCGCAAAG

1151 CCCTCAACCG CCTGATTATG GCGCAGGATA CAGGCAGCGC GATCAAAGGC

1201 GCGGTGCGCG TGGATTATTT TTGGGGTTAC GGCGACGAAG CCGGCGAACT

1251 TGCCGGCAAA CAGAAAACCA CGGGATACGT CTGGCAGCTC CTGCCCAACG

1301 GCATGAAGCC CGAATACCGC CCGTGA
```

This corresponds to the amino acid sequence <SEQ ID 3072; ORF 919.ng>:

```
g919.pep
   1 MKKHLLRSAL YGIAAAILAA CQSRSIQTFP QPDTSVINGP DRPAGIPDPA

51 GTTVAGGGAV YTVVPHLSMP HWAAQDFAKS LQSFRLGCAN LKNRQGWQDV

101 CAQAFQTPVH SFQAKRFFER YFTPWQVAGN GSLAGTVTGY YEPVLKGDGR

151 RTERARFPIY GIPDDFISVP LPAGLRGGKN LVRIRQTGKN SGTIDNAGGT

201 HTADLSRFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KAYMRQNPQR LAEVLGQNPS YIFFRELAGS GNEGPVGALG

351 TPLMGEYAGA IDRHYITLGA PLFVATAHPV TRKALNRLIM AQDTGSAIKG

401 AVRVDYFWGY GDEAGELAGK QKTTGYVWQL LPNGMKPEYR P*
```

ORF 919 shows 95.9% identity over a 441 aa overlap with a predicted ORF (ORF 919.ng) from *N. gonorrhoeae*:

```
m919/g919

10        20        30        40        50        60
m919.pep  MKKYLFRAALYGIAAAILAACQSKSIQTFPQPDTSVINGPDRPVGIPDPAGTTVGGGGAV
          |||:|:|:|||||||||||||||:|||||||||||||||||||:||||||||||:|||||
g919      MKKHLLRSALYGIAAAILAACQSRSIQTFPQPDTSVINGPDRPAGIPDPAGTTVAGGGAV
                  10        20        30        40        50        60

70        80        90       100       110       120
m919.pep  YTVVPHLSLPHWAAQDFAKSLQSFRLGCANLKNRQGWQDVCAQAFQTPVHSFQAKQFFER
          ||||||||:||||||||||||||||||||||||||||||||||||||||||||||:||||
g919      YTVVPHLSMPHWAAQDFAKSLQSFRLGCANLKNRQGWQDVCAQAFQTPVHSFQAKRFFER
                  70        80        90       100       110       120

130       140       150       160       170       180
m919.pep  YFTPWQVAGNGSLAGTVTGYYEPVLKGDDRRTAQARFPIYGIPDDFISVPLPAGLRSGKA
          |||||||||||||||||||||||||||| ||| :||||||||||||||||||||||:|| 
g919      YFTPWQVAGNGSLAGTVTGYYEPVLKGDGRRTERARFPIYGIPDDFISVPLPAGLRGGKN
                 130       140       150       160       170       180

190       200       210       220       230       240
m919.pep  LVRIRQTGKNSGTIDNTGGTHTADLSRFPITARTTAIKGRFEGSRFLPYHTRNQINGGAL
          ||||||||||||||||:|||||||||||||||||||||||||||||||||||||||||||
g919      LVRIRQTGKNSGTIDNAGGTHTADLSRFPITARTTAIKGRFEGSRFLPYHTRNQINGGAL
                 190       200       210       220       230       240

250       260       270       280       290       300
m919.pep  DGKAPILGYAEDPVELFFMHIQGSGRLKTPSGKYIRIGYADKNEHPYVSIGRYMADKGYL
          ||||||||||||||||||||||||||||||||||||||||||||||||||||||||||||
g919      DGKAPILGYAEDPVELFFMHIQGSGRLKTPSGKYIRIGYADKNEHPYVSIGRYMADKGYL
                 250       260       270       280       290       300

310       320       330       340       350       360
m919.pep  KLGQTSMQGIKSYMRQNPQRLAEVLGQNPSYIFFRELAGSSNDGPVGALGTPLMGEYAGA
          |||||||||||:|||||||||||||||||||||||||||||:|:||||||||||||||||
g919      KLGQTSMQGIKAYMRQNPQRLAEVLGQNPSYIFFRELAGSGNEGPVGALGTPLMGEYAGA
                 310       320       330       340       350       360

370       380       390       400       410       420
m919.pep  VDRHYITLGAPLFVATAHPVTRKALNRLIMAQDTGSAIKGAVRVDYFWGYGDEAGELAGK
          :|||||||||||||||||||||||||||||||||||||||||||||||||||||||||||
g919      IDRHYITLGAPLFVATAHPVTRKALNRLIMAQDTGSAIKGAVRVDYFWGYGDEAGELAGK
                 370       380       390       400       410       420

430       440
m919.pep  QKTTGYVWQLLPNGMKPEYRPX
          |||||||||||||||||||||
g919      QKTTGYVWQLLPNGMKPEYRPX
                 430       440
```

The following partial DNA sequence was identified in *N. meningitidis* <SEQ ID 3073>:

```
a919.seq
   1  ATGAAAAAAT ACCTATTCCG CGCCGCCCTG TGCGGCATCG CCGCCGCCAT

51  CCTCGCCGCC TGCCAAAGCA AGAGCATCCA AACCTTTCCG CAACCCGACA

101  CATCCGTCAT CAACGGCCCG GACCGGCCGG TCGGCATCCC CGACCCCGCC

151  GGAACGACGG TCGGCGGCGG CGGGGCCGTT TATACCGTTG TGCCGCACCT

201  GTCCCTGCCC CACTGGGCGG CGCAGGATTT CGCCAAAAGC CTGCAATCCT

251  TCCGCCTCGG CTGCGCCAAT TTGAAAAACC GCCAAGGCTG GCAGGATGTG

301  TGCGCCCAAG CCTTTCAAAC CCCCGTCCAT TCCGTTCAGG CAAAACAGTT

351  TTTTGAACGC TATTTCACGC CGTGGCAGGT TGCAGGCAAC GGAAGCCTTG

401  CCGGTACGGT TACCGGCTAT TACGAGCCGG TGCTGAAGGG CGACGACAGG

451  CGGACGGCAC AAGCCCGCTT CCCGATTTAC GGTATTCCCG ACGATTTTAT

501  CTCCGTCCCC CTGCCTGCCG GTTTGCGGAG CGGAAAAGCC CTTGTCCGCA

551  TCAGGCAGAC GGGAAAAAAC AGCGGCACAA TCGACAATAC CGGCGGCACA

601  CATACCGCCG ACCTCTCCCA ATTCCCCATC ACTGCGCGCA CAACGGCAAT

651  CAAAGGCAGG TTTGAAGGAA GCCGCTTCCT CCCCTACCAC ACGCGCAACC
```

```
 701 AAATCAACGG CGGCGCGCTT GACGGCAAAG CCCCGATACT CGGTTACGCC

751 GAAGACCCCG TCGAACTTTT TTTTATGCAC ATCCAAGGCT CGGGCCGTCT

801 GAAACCCCG TCCGGCAAAT ACATCCGCAT CGGCTATGCC GACAAAAACG

851 AACATCCCTA CGTTTCCATC GGACGCTATA TGGCGGACAA AGGCTACCTC

901 AAGCTCGGGC AGACCTCGAT GCAGGGCATC AAAGCCTATA TGCAGCAAAA

951 CCCGCAACGC CTCGCCGAAG TTTTGGGGCA AAACCCCAGC TATATCTTTT

1001 TCCGAGAGCT TACCGGAAGC AGCAATGACG GCCCTGTCGG CGCACTGGGC

1051 ACGCCGCTGA TGGGCGAGTA CGCCGGCGCA GTCGACCGGC ACTACATTAC

1101 CTTGGGCGCG CCCTTATTTG TCGCCACCGC CCATCCGGTT ACCCGCAAAG

1151 CCCTCAACCG CCTGATTATG GCGCAGGATA CCGGCAGCGC GATTAAAGGC

1201 GCGGTGCGCG TGGATTATTT TTGGGGATAC GGCGACGAAG CCGGCGAACT

1251 TGCCGGCAAA CAGAAAACCA CGGGATATGT CTGGCAGCTT CTGCCCAACG

1301 GTATGAAGCC CGAATACCGC CCGTAA
```

This corresponds to the amino acid sequence <SEQ ID 3074; ORF 919.a>:

```
a919.pep
   1 MKKYLFRAAL CGIAAAILAA CQSKSIQTFP QPDTSVINGP DRPVGIPDPA

51 GTTVGGGGAV YTVVPHLSLP HWAAQDFAKS LQSFRLGCAN LKNRQGWQDV

101 CAQAFQTPVH SVQAKQFFER YFTPWQVAGN GSLAGTVTGY YEPVLKGDDR

151 RTAQARFPIY GIPDDFISVP LPAGLRSGKA LVRIRQTGKN SGTIDNTGGT

201 HTADLSQFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KAYMQQNPQR LAEVLGQNPS YIFFRELTGS SNDGPVGALG

351 TPLMGEYAGA VDRHYITLGA PLFVATAHPV TRKALNRLIM AQDTGSAIKG

401 AVRVDYFWGY GDEAGELAGK QKTTGYVWQL LPNGMKPEYR P*
``` m919/a919 98.6% identity in 441 aa overlap

```
                10         20         30         40         50         60
    m919.pep MKKYLFRAALYGIAAAILAACQSKSIQTFPQPDTSVINGPDRPVGIPDPAGTTVGGGGAV
             ||||||||||  |||||||||||||||||||||||||||||||||||||||||||||||
    a919     MKKYLFRAALCGIAAAILAACQSKSIQTFPQPDTSVINGPDRPVGIPDPAGTTVGGGGAV
                10         20         30         40         50         60

70         80         90        100        110        120
    m919.pep YTVVPHLSLPHWAAQDFAKSLQSFRLGCANLKNRQGWQDVCAQAFQTPVHSFQAKQFFER
             |||||||||||||||||||||||||||||||||||||||||||||||||| ||||||||
    a919     YTVVPHLSLPHWAAQDFAKSLQSFRLGCANLKNRQGWQDVCAQAFQTPVHSVQAKQFFER
                70         80         90        100        110        120

130        140        150        160        170        180
    m919.pep YFTPWQVAGNGSLAGTVTGYYEPVLKGDDRRTAQARFPIYGIPDDFISVPLPAGLRSGKA
             ||||||||||||||||||||||||||||||||||||||||||||||||||||||||||||
    a919     YFTPWQVAGNGSLAGTVTGYYEPVLKGDDRRTAQARFPIYGIPDDFISVPLPAGLRSGKA
               130        140        150        160        170        180

190        200        210        220        230        240
    m919.pep LVRIRQTGKNSGTIDNTGGTHTADLSRFPITARTTAIKGRFEGSRFLPYHTRNQINGGAL
             |||||||||||||||||||||||||||:||||||||||||||||||||||||||||||||
    a919     LVRIRQTGKNSGTIDNTGGTHTADLSQFPITARTTAIKGRFEGSRFLPYHTRNQINGGAL
               190        200        210        220        230        240
```

-continued

```
                  250        260        270        280        290        300
m919.pep  DGKAPILGYAEDPVELFFMHIQGSGRLKTPSGKYIRIGYADKNEHPYVSIGRYMADKGYL
          ||||||||||||||||||||||||||||||||||||||||||||||||||||||||||||
a919      DGKAPILGYAEDPVELFFMHIQGSGRLKTPSGKYIRIGYADKNEHPYVSIGRYMADKGYL
                  250        260        270        280        290        300

310        320        330        340        350        360
m919.pep  KLGQTSMQGIKSYMRQNPQRLAEVLGQNPSYIFFRELAGSSNDGPVGALGTPLMGEYAGA
          ||||||||||:||:||||||||||||||||||||||:|||||||||||||||||||||||
a919      KLGQTSMQGIKAYMQQNPQRLAEVLGQNPSYIFFRELTGSSNDGPVGALGTPLMGEYAGA
                  310        320        330        340        350        360

370        380        390        400        410        420
m919.pep  VDRHYITLGAPLFVATAHPVTRKALNRLIMAQDTGSAIKGAVRVDYFWGYGDEAGELAGK
          ||||||||||||||||||||||||||||||||||||||||||||||||||||||||||||
a919      VDRHYITLGAPLFVATAHPVTRKALNRLIMAQDTGSAIKGAVRVDYFWGYGDEAGELAGK
                  370        380        390        400        410        420

430        440
m919.pep  QKTTGYVWQLLPNGMKPEYRPX
          ||||||||||||||||||||||
a919      QKTTGYVWQLLPNGMKPEYRPX
          430       440
```

121 and 121-1
The following partial DNA sequence was identified in *N. meningitidis* <SEQ ID 3075>:

```
m121.seq
     1  ATGGAAACAC AGCTTTACAT CGGCATCATG TCGGGAACCA GCATGGACGG

51  GGCGGATGCC GTACTGATAC GGATGGACGG CGGCAAATGG CTGGGCGCGG

101  AAGGGCACGC CTTTACCCCC TACCCCGGCA GGTTACGCCG CCAATTGCTG

151  GATTTGCAGG ACACAGGCGC AGACGAACTG CACCGCAGCA GGATTTTGTC

201  GCAAGAACTC AGCCGCCTAT ATGCGCAAAC CGCCGCCGAA CTGCTGTGCA

251  GTCAAAACCT CGCACCGTCC GACATTACCG CCCTCGGCTG CCACGGGCAA

301  ACCGTCCGAC ACGCGCCGGA ACACGGTTAC AGCATACAGC TTGCCGATTT

351  GCCGCTGCTG GCGxxxxxxx xxxxxxxxxx xxxxxxxxxx xxxxxxxxxx 401  xxxxxxxxxx xxxxxxxxxx xxxxxxxxxx xxxxxxxxxx xxxxxxxxxx 451  xxxxxxxxxx xxxxxxxxxx xxxxxxxxxx xxxxxxxxxx xxxxxxxxxx 501  xxxxxxxxxx xxxxxxxxxx xxxxxxxxxx xxxxxxxxxx xxxxxxxxxx 551  xxxxxxxxxx xxxxxxxxxx xxxxxxxxxx xxxxxxxxxx xxxxxxxxxx 601  xxxxxxCAGC TTCCTTACGA CAAAAACGGT GCAAAGTCGG CACAAGGCAA

651  CATATTGCCG CAACTGCTCG ACAGGCTGCT CGCCCACCCG TATTTCGCAC

701  AACGCCACCC TAAAAGCACG GGGCGCGAAC TGTTTGCCAT AAATTGGCTC

751  GAAACCTACC TTGACGGCGG CGAAAACCGA TACGACGTAT TGCGGACGCT

801  TTCCCGTTTT ACCGCGCAAA CCGTTTGCGA CGCCGTCTCA CACGCAGCGG

851  CAGATGCCCG TCAAATGTAC ATTTGCGACG GCGGCATCCG CAATCCTGTT

901  TTAATGGCGG ATTTGGCAGA ATGTTTCGGC ACACGCGTTT CCCTGCACAG

951  CACCGCCGAC CTGAACCTCG ATCCGCAATG GGTGGAAGCC GCCGnATTTG

1001  CGTGGTTGGC GGCGTGTTGG ATTAATCGCA TTCCCGGTAG TCCGCACAAA

1051  GCAACCGGCG CATCCAAACC GTGTATTCTG AnCGCGGGAT ATTATTATTG

1101  A
```

This corresponds to the amino acid sequence <SEQ ID 3076; ORF 121>:

```
m121.pep
    1   METQLYIGIM SGTSMDGADA VLIRMDGGKW LGAEGHAFTP YPGRLRRQLL

51   DLQDTGADEL HRSRILSQEL SRLYAQTAAE LLCSQNLAPS DITALGCHGQ

101   TVRHAPEHGY SIQLADLPLL Axxxxxxxxx xxxxxxxxxx xxxxxxxxxx 151   xxxxxxxxxx xxxxxxxxxx xxxxxxxxxx xxxxxxxxxx xxxxxxxxxx 201   xxQLPYDKNG AKSAQGNILP QLLDRLLAHP YFAQRHPKST GRELFAINWL

251   ETYLDGGENR YDVLRTLSRF TAQTVCDAVS HAAADARQMY ICDGGIRNPV

301   LMADLAECFG TRVSLHSTAD LNLDPQWVEA AXFAWLAACW INRIPGSPHK

351   ATGASKPCIL XAGYYY*
```

The following partial DNA sequence was identified in *N. gonorrhoeae* <SEQ ID 3077>:

```
g121.seq
    1   ATGGAAACAC AGCTTTACAT CGGCATTATG TCGGGAACCA GTATGGACGG

51   GGCGGATGCC GTGCTGGTAC GGATGGACGG CGGCAAATGG CTGGGCGCGG

101   AAGGGCACGC CTTTACCCCC TACCCTGACC GGTTGCGCCG CAAATTGCTG

151   GATTTGCAGG ACACAGGCAC AGACGAACTG CACCGCAGCA GGATGTTGTC

201   GCAAGAACTC AGCCGCCTGT ACGCGCAAAC CGCCGCCGAA CTGCTGTGCA

251   GTCAAAACCT CGCTCCGTGC GACATTACCG CCCTCGGCTG CCACGGGCAA

301   ACCGTCCGAC ACGCGCCGGA ACACGGTtac AGCATACAGC TTGCCGATTT

351   GCCGCTGCTG GCGGAACTGa cgcggatttT TACCGTCggc gacttcCGCA

401   GCCGCGACCT TGCTGCCGGC GGacaAGGTG CGCCGCTCGT CCCCGCCTTT

451   CACGAAGCCC TGTTCCGCGA TGACAGGGAA ACACGCGTGG TACTGAACAT

501   CGGCGGGATT GCCAACATCA GCGTACTCCC CCCCGGCGCA CCCGCCTTCG

551   GCTTCGACAC AGGGCCGGGC AATATGCTGA TGGAcgcgtg gacgcaggca 601   cacTGGcagc TGCCTTACGA CAAAAacggt gcAAAGgcgg cacAAGGCAA 651   catatTGCcg cAACTGCTCG gcaggctGCT CGCCcaccCG TATTTCTCAC 701   AACCCcaccc aaAAAGCACG GGgcGCGaac TgtttgcccT AAattggctc 751   gaaacctAcc ttgacggcgg cgaaaaccga tacgacgtat tgcggacgct 801   ttcccgattc accgcgcaaA ccgTttggga cgccgtctca CACGCAGCGG

851   CAGATGCCCG TCAAATGTAC ATTTGCGGCG GCGGCATCCG CAATCCTGTT

901   TTAATGGCGG ATTTGGCAGA ATGTTTCGGC ACACGCGTTT CCCTGCACAG

951   CACCGCCGAA CTGAACCTCG ATCCTCAATG GGTGGAGGCG gccgCATTtg 1001   cgtggttggC GGCGTGTTGG ATTAACCGCA TTCCCGGTAG TCCGCACAAA

1051   GCGACCGGCG CATCCAAACC GTGTATTCTG GGCGCGGGAT ATTATTATTG

1101   A
```

This corresponds to the amino acid sequence <SEQ ID 3078; ORF 121.ng>:

```
g121.pep
    1   METQLYIGIM SGTSMDGADA VLVRMDGGKW LGAEGHAFTP YPDRLRRKLL

51   DLQDTGTDEL HRSRMLSQEL SRLYAQTAAE LLCSQNLAPC DITALGCHGQ
```

```
101  TVRHAPEHGY  SIQLADLPLL  AELTRIFTVG  DFRSRDLAAG  GQGAPLVPAF

151  HEALFRDDRE  TRVVLNIGGI  ANISVLPPGA  PAFGFDTGPG  NMLMDAWTQA

201  HWQLPYDKNG  AKAAQGNILP  QLLGRLLAHP  YFSQPHPKST  GRELFALNWL

251  ETYLDGGENR  YDVLRTLSRF  TAQTVWDAVS  HAAADARQMY  ICGGGIRNPV

301  LMADLAECFG  TRVSLHSTAE  LNLDPQWVEA  AAFAWLAACW  INRIPGSPHK

351  ATGASKPCIL  GAGYYY*
```

ORF 121 shows 73.5% identity over a 366 aa overlap with a predicted ORF (ORF121.ng) from *N. gonorrhoeae*:

```
m121/g121

10         20         30         40         50         60
m121.pep  METQLYIGIMSGTSMDGADAVLIRMDGGKWLGAEGHAFTPYPGRLRRQLLDLQDTGADEL
          ||||||||||||||||||||||||:||||||||||||||||| ||||:||||||||:|||
g121      METQLYIGIMSGTSMDGADAVLVRMDGGKWLGAEGHAFTPYPDRLRRKLLDLQDTGTDEL
                  10         20         30         40         50         60
                  70         80         90        100        110        120
m121.pep  HRSRILSQELSRLYAQTAAELLCSQNLAPSDITALGCHGQTVRHAPEHGYSIQLADLPLL
          ||||:||||||||||||||||||||||||||| |||||||||||||||||||||||||||
g121      HRSRMLSQELSRLYAQTAAELLCSQNLAPCDITALGCHGQTVRHAPEHGYSIQLADLPLL
                  70         80         90        100        110        120
                 130        140        150        160        170        180
m121.pep  AXXXXXXXXXXXXXXXXXXXXXXXXXXXXXXXXXXXXXXXXXXXXXXXXXXXXXXXXXXX
          |  :    :                                                   
g121      AELTRIFTVGDFRSRDLAAGGQGAPLVPAFHEALFRDDRETRVVLNIGGIANISVLPPGA
                 130        140        150        160        170        180
                 190        200        210        220        230        240
m121.pep  XXXXXXXXXXXXXXXXXXXXXXXQLPYDKNGAKSAQGNILPQLLDRLLAHPYFAQRHPKST
              :          :        ||||||||||:||||||||||  ||||||||:| |||||
g121      PAFGFDTGPGNMLMDAWTQAHWQLPYDKNGAKAAQGNILPQLLGRLLAHPYFSQPHPKST
                 190        200        210        220        230        240
                 250        260        270        280        290        300
m121.pep  GRELFAINWLETYLDGGENRYDVLRTLSRFTAQTVCDAVSHAAADARQMYICDGGIRNPV
          ||||||:|||||||||||||||||||||||||||| ||||||||||||||||| ||||||
g121      GRELFALNWLETYLDGGENRYDVLRTLSRFTAQTVWDAVSHAAADARQMYICGGGIRNPV
                 250        260        270        280        290        300
                 310        320        330        340        350        360
m121.pep  LMADLAECFGTRVSLHSTADLNLDPQWVEAAXFAWLAACWINRIPGSPHKATGASKPCIL
          ||||||||||||||||||||:|||||||||| ||||||||||||||||||||||||||||
g121      LMADLAECFGTRVSLHSTAELNLDPQWVEAAAFAWLAACWINRIPGSPHKATGASKPCIL
                 310        320        330        340        350        360 m121.pep  XAGYYYX
            ||||||
g121      GAGYYYX
```

The following partial DNA sequence was identified in *N. meningitidis* <SEQ ID 3079>:

```
a121.seq
    1  ATGGAAACAC  AGCTTTACAT  CGGCATCATG  TCGGGAACCA  GCATGGACGG

51  GGCGGATGCC  GTACTGATAC  GGATGGACGG  CGGCAAATGG  CTGGGCGCGG

101  AAGGGCACGC  CTTTACCCCC  TACCCCGGCA  GGTTACGCCG  CAAATTGCTG

151  GATTTGCAGG  ACACAGGCGC  GGACGAACTG  CACCGCAGCA  GGATGTTGTC

201  GCAAGAACTC  AGCCGCCTGT  ACGCGCAAAC  CGCCGCCGAA  CTGCTGTGCA

251  GTCAAAACCT  CGCGCCGTCC  GACATTACCG  CCCTCGGCTG  CCACGGGCAA

301  ACCGTCAGAC  ACGCGCCGGA  ACACAGTTAC  AGCGTACAGC  TTGCCGATTT
```

-continued

```
 351 GCCGCTGCTG GCGGAACGGA CTCAGATTTT TACCGTCGGC GACTTCCGCA

401 GCCGCGACCT TGCGGCCGGC GGACAAGGCG CGCCGCTCGT CCCCGCCTTT

451 CACGAAGCCC TGTTCCGCGA CGACAGGGAA ACACGCGCGG TACTGAACAT

501 CGGCGGGATT GCCAACATCA GCGTACTCCC CCCCGACGCA CCCGCCTTCG

551 GCTTCGACAC AGGACCGGGC AATATGCTGA TGGACGCGTG GATGCAGGCA

601 CACTGGCAGC TTCCTTACGA CAAAAACGGT GCAAAGGCGG CACAAGGCAA

651 CATATTGCCG CAACTGCTCG ACAGGCTGCT CGCCCACCCG TATTTCGCAC

701 AACCCCACCC TAAAAGCACG GGGCGCGAAC TGTTTGCCCT AAATTGGCTC

751 GAAACCTACC TTGACGGCGG CGAAAACCGA TACGACGTAT TGCGGACGCT

801 TTCCCGATTC ACCGCGCAAA CCGTTTTCGA CGCCGTCTCA CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 3080; ORF 121.a>:

```
a121.pep

1   METQLYIGIM SGTSMDGADA VLIRMDGGKW LGAEGHAFTP YPGRLRRKLL

51   DLQDTGADEL HRSRMLSQEL SRLYAQTAAE LLCSQNLAPS DITALGCHGQ

101   TVRHAPEHSY SVQLADLPLL AERTQIFTVG DFRSRDLAAG GQGAPLVPAF

151   HEALFRDDRE TRAVLNIGGI ANISVLPPDA PAFGFDTGPG NMLMDAWMQA

201   HWQLPYDKNG AKAAQGNILP QLLDRLLAHP YFAQPHPKST GRELFALNWL

251   ETYLDGGENR YDVLRTLSRF TAQTVFDAVS HAAADARQMY ICGGGIRNPV

301   LMADLAECFG TRVSLHSTAE LNLDPQWVEA AARAWMAACW VNRIPGSPHK

351   ATGASKPCIL GAGYY* m121/a121   74.0% identity in 366 aa overlap 10         20         30         40         50         60
   m121.pep    METQLYIGIMSGTSMDGADAVLIRMDGGKWLGAEGHAFTPYPGRLRRQLLDLQDTGADEL
               ||||||||||||||||||||||||||||||||||||||||||||||||:|||||||||||
   a121        METQLYIGIMSGTSMDGADAVLIRMDGGKWLGAEGHAFTPYPGRLRRKLLDLQDTGADEL
                       10         20         30         40         50         60

70         80         90        100        110        120
   m121.pep    HRSRILSQELSRLYAQTAAELLCSQNLAPSDITALGCHGQTVRHAPEHGYSIQLADLPLL
               ||||:|||||||||||||||||||||||||||||||||||||||||||:||:||||||||
   a121        HRSRMLSQELSRLYAQTAAELLCSQNLAPSDITALGCHGQTVRHAPEHSYSVQLADLPLL
                       70         80         90        100        110        120

130        140        150        160        170        180
   m121.pep    AXXXXXXXXXXXXXXXXXXXXXXXXXXXXXXXXXXXXXXXXXXXXXXXXXXXXXXXXXX
               | :
   a121        AERTQIFTVGDFRSRDLAAGGQGAPLVPAFHEALFRDDRETRAVLNIGGIANISVLPPDA
                      130        140        150        160        170        180

190        200        210        220        230        240
   m121.pep    XXXXXXXXXXXXXXXXXXXXXXXQLPYDKNGAKSAQGNILPQLLDRLLAHPYFAQRHPKST
                                      ||||||||||:||||||||||||||||||||| ||||
   a121        PAFGFDTGPGNMLMDAWMQAHWQLPYDKNGAKAAQGNILPQLLDRLLAHPYFAQPHPKST
                      190        200        210        220        230        240
```

-continued

```
                   250       260       270       280       290       300
m121.pep    GRELFAINWLETYLDGGENRYDVLRTLSRFTAQTVCDAVSHAAADARQMYICDGGIRNPV
            ||||||:|||||||||||||||||||||||||||| |||||||||||||||| |||||||
a121        GRELFALNWLETYLDGGENRYDVLRTLSRFTAQTVFDAVSHAAADARQMYICGGGIRNPV
                   250       260       270       280       290       300

310       320       330       340       350       360
m121.pep    LMADLAECFGTRVSLHSTADLNLDPQWVEAAXFAWLAACWINRIPGSPHKATGASKPCIL
            ||||||||||||||||||:|||||||||||| |||:||||:|||||||||||||||||||
a121        LMADLAECFGTRVSLHSTAELNLDPQWVEAAAFAWMAACWVNRIPGSPHKATGASKPCIL
                   310       320       330       340       350       360 m121.pep    XAGYYYX
             ||||||
a121        GAGYYYX
```

The following partial DNA sequence was identified in *N. meningitidis* <SEQ ID 3081>:

```
m121-1.seq
   1 ATGGAAACAC AGCTTTACAT CGGCATCATG TCGGGAACCA GCATGGACGG

51 GGCGGATGCC GTACTGATAC GGATGGACGG CGGCAAATGG CTGGGCGCGG

101 AAGGGCACGC CTTTACCCCC TACCCCGGCA GGTTACGCCG CCAATTGCTG

151 GATTTGCAGG ACACAGGCGC AGACGAACTG CACCGCAGCA GGATTTTGTC

201 GCAAGAACTC AGCCGCCTAT ATGCGCAAAC CGCCGCCGAA CTGCTGTGCA

251 GTCAAAACCT CGCACCGTCC GACATTACCG CCCTCGGCTG CCACGGGCAA

301 ACCGTCCGAC ACGCGCCGGA ACACGGTTAC AGCATACAGC TTGCCGATTT

351 GCCGCTGCTG GCGGAACGGA CGCGGATTTT TACCGTCGGC GACTTCCGCA

401 GCCGCGACCT TGCGGCCGGC GGACAAGGCG CGCCACTCGT CCCCGCCTTT

451 CACGAAGCCC TGTTCCGCGA CAACAGGGAA ACACGCGCGG TACTGAACAT

501 CGGCGGGATT GCCAACATCA GCGTACTCCC CCCCGACGCA CCCGCCTTCG

551 GCTTCGACAC AGGGCCGGGC AATATGCTGA TGGACGCGTG GACGCAGGCA

601 CACTGGCAGC TTCCTTACGA CAAAAACGGT GCAAAGGCGG CACAAGGCAA

651 CATATTGCCG CAACTGCTCG ACAGGCTGCT CGCCCACCCG TATTTCGCAC

701 AACCCCACCC TAAAAGCACG GGGCGCGAAC TGTTTGCCCT AAATTGGCTC

751 GAAACCTACC TTGACGGCGG CGAAAACCGA TACGACGTAT TGCGGACGCT

801 TTCCCGTTTT ACCGCGCAAA CCGTTTGCGA CGCCGTCTCA CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAC CTGAACCTCG ATCCGCAATG GGTGGAAGCC GCCGNATTTG

1001 CGTGGTTGGC GGCGTGTTGG ATTAATCGCA TTCCCGGTAG TCCGCACAAA

1051 GCAACCGGCG CATCCAAACC GTGTATTCTG ANCGCGGGAT ATTATTATTG

1101 A
```

This corresponds to the amino acid sequence <SEQ ID 3082; ORF 121-1>:

```
m121-1.pep

1 METQLYIGIM SGTSMDGADA VLIRMDGGKW LGAEGHAFTP YPGRLRRQLL

51 DLQDTGADEL HRSRILSQEL SRLYAQTAAE LLCSQNLAPS DITALGCHGQ

101 TVRHAPEHGY SIQLADLPLL AERTRIFTVG DFRSRDLAAG GQGAPLVPAF
```

-continued

```
151  HEALFRDNRE TRAVLNIGGI ANISVLPPDA PAFGFDTGPG NMLMDAWTQA

201  HWQLPYDKNG AKAAQGNILP QLLDRLLAHP YFAQPHPKST GRELFALNWL

251  ETYLDGGENR YDVLRTLSRF TAQTVCDAVS HAAADARQMY ICGGGIRNPV

301  LMADLAECFG TRVSLHSTAD LNLDPQWVEA AXFAWLAACW INRIPGSPHK

351  ATGASKPCIL XAGYYY*
```

```
m121-1/g121 95.6% identity in 366 aa overlap 10        20        30        40        50        60
m121-1.pep  METQLYIGIMSGTSMDGADAVLIRMDGGKWLGAEGHAFTPYPGRLRRQLLDLQDTGADEL
            ||||||||||||||||||||:|||||||||||||||||| ||||:||||||||:|||
g121        METQLYIGIMSGTSMDGADAVLVRMDGGKWLGAEGHAFTPYPDRLRRKLLDLQDTGTDEL
                    10        20        30        40        50        60

70        80        90       100       110       120
m121-1.pep  HRSRILSQELSRLYAQTAAELLCSQNLAPSDITALGCHGQTVRHAPEHGYSIQLADLPLL
            ||||:||||||||||||||||||||||| ||||||||||||||||||||||||||||||
g121        HRSRMLSQELSRLYAQTAAELLCSQNLAPCDITALGCHGQTVRHAPEHGYSIQLADLPLL
                    70        80        90       100       110       120

130       140       150       160       170       180
m121-1.pep  AERTRIFTVGDFRSRDLAAGGQGAPLVPAFHEALFRDNRETRAVLNIGGIANISVLPPDA
            || ||||||||||||||||||||||||||||||||:||||:|||||||||||||||| |
g121        AELTRIFTVGDFRSRDLAAGGQGAPLVPAFHEALFRDDRETRVVLNIGGIANISVLPPGA
                   130       140       150       160       170       180

190       200       210       220       230       240
m121-1.pep  PAFGFDTGPGNMLMDAWTQAHWQLPYDKNGAKAAQGNILPQLLDRLLAHPYFAQPHPKST
            ||||||||||||||||||||||||||||||||||||||||| |||||||:|||||||
g121        PAFGFDTGPGNMLMDAWTQAHWQLPYDKNGAKAAQGNILPQLLGRLLAHPYFSQPHPKST
                   190       200       210       220       230       240

250       260       270       280       290       300
m121-1.pep  GRELFALNWLETYLDGGENRYDVLRTLSRFTAQTVCDAVSHAAADARQMYICGGGIRNPV
            |||||||||||||||||||||||||||||||||| |||||||||||||||||||||||||
g121        GRELFALNWLETYLDGGENRYDVLRTLSRFTAQTVWDAVSHAAADARQMYICGGGIRNPV
                   250       260       270       280       290       300

310       320       330       340       350       360
m121-1.pep  LMADLAECGFTRVSLHSTADLNLDPQWVEAAXFAWLAACWINRIPGSPHKATGASKPCIL
            ||||||||||||||||||:|||||||||| ||||||||||||||||||||||||||||||
g121        LMADLAECGFTRVSLHSTAELNLDPQWVEAAAFAWLAACWINRIPGSPHKATGASKPCIL
                   310       320       330       340       350       360 m121-1.pep  XAGYYYX
             ||||||
g121        GAGYYYX
```

The following partial DNA sequence was identified in *N. meningitidis* <SEQ ID 3083>:

```
a121-1.seq
  1  ATGGAAACAC AGCTTTACAT CGGCATCATG TCGGGAACCA GCATGGACGG

51  GGCGGATGCC GTACTGATAC GGATGGACGG CGGCAAATGG CTGGGCGCGG

101  AAGGGCACGC CTTTACCCCC TACCCCGGCA GGTTACGCCG CAAATTGCTG

151  GATTTGCAGG ACACAGGCGC GGACGAACTG CACCGCAGCA GGATGTTGTC

201  GCAAGAACTC AGCCGCCTGT ACGCGCAAAC CGCCGCCGAA CTGCTGTGCA

251  GTCAAAACCT CGCGCCGTCC GACATTACCG CCCTCGGCTG CCACGGGCAA

301  ACCGTCAGAC ACGCGCCGGA ACACAGTTAC AGCGTACAGC TTGCCGATTT

351  GCCGCTGCTG GCGGAACGGA CTCAGATTTT TACCGTCGGC GACTTCCGCA

401  GCCGCGACCT TGCGGCCGGC GGACAAGGCG CGCCGCTCGT CCCCGCCTTT

451  CACGAAGCCC TGTTCCGCGA CGACAGGGAA ACACGCGCGG TACTGAACAT

501  CGGCGGGATT GCCAACATCA GCGTACTCCC CCCCGACGCA CCCGCCTTCG

551  GCTTCGACAC AGGACCGGGC AATATGCTGA TGGACGCGTG GATGCAGGCA

601  CACTGGCAGC TTCCTTACGA CAAAAACGGT GCAAAGGCGG CACAAGGCAA

651  CATATTGCCG CAACTGCTCG ACAGGCTGCT CGCCCACCCG TATTTCGCAC
```

```
-continued
 701 AACCCCACCC TAAAAGCACG GGGCGCGAAC TGTTTGCCCT AAATTGGCTC

751 GAAACCTACC TTGACGGCGG CGAAAACCGA TACGACGTAT TGCGGACGCT

801 TTCCCGATTC ACCGCGCAAA CCGTTTTCGA CGCCGTCTCA CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 3084; ORF 121-1.a>:

```
a121-1.pep
     1  METQLYIGIM SGTSMDGADA VLIRMDGGKW LGAEGHAFTP YPGRLRRKLL
    51  DLQDTGADEL HRSRMLSQEL SRLYAQTAAE LLCSQNLAPS DITALGCHGQ
   101  TVRHAPEHSY SVQLADLPLL AERTQIFTVG DFRSRDLAAG GQGAPLVPAF
   151  HEALFRDDRE TRAVLNIGGI ANISVLPPDA PAFGFDTGPG NMLMDAWMQA
   201  HWQLPYDKNG AKAAQGNILP QLLDRLLAHP YFAQPHPKST FRELFALNWL
   251  ETYLDGGENR YDVLRTLSRF TAWTVFDAVS HAAADARQMY ICGGGIRNPV
   301  LMADLAECFG TRVSLHSTAE LNLDPQWVEA AAFAWMAACW VNRIPGSPHK
   351  ATGASKPCIL GAGYYY* m121-1/a121-1  96.4% identity in 366 aa overlap
                    10         20         30         40         50         60
m121-1.pep  METQLYIGIMSGTSMDGADAVLIRMDGGKWLGAEGHAFTPYPGRLRRQLLDLQDTGADEL
            ||||||||||||||||||||||||||||||||||||||||||||||:||||||||||||
a121-1      METQLYIGIMSGTSMDGADAVLIRMDGGKWLGAEGHAFTPYPGRLRRKLLDLQDTGADEL
                    10         20         30         40         50         60

70         80         90        100        110        120
m121-1.pep  HRSRILSQELSRLYAQTAAELLCSQNLAPSDITALGCHGQTVRHAPEHGYSIQLADLPLL
            ||||:|||||||||||||||||||||||||||||||||||||||||||:||:||||||||
a121-1      HRSRMLSQELSRLYAQTAAELLCSQNLAPSDITALGCHGQTVRHAPEHSYSVQLADLPLL
                    70         80         90        100        110        120

130        140        150        160        170        180
m121-1.pep  AERTRIFTVGDFRSRDLAAGGQGAPLVPAFHEALFRDNRETRAVLNIGGIANISVLPPDA
            ||||:|||||||||||||||||||||||||||||||:|||||||||||||||||||||||
a121-1      AERTQIFTVGDFRSRDLAAGGQGAPLVPAFHEALFRDDRETRAVLNIGGIANISVLPPDA
                   130        140        150        160        170        180

190        200        210        220        230        240
m121-1.pep  PAFGFDTGPGNMLMDAWTQAHWQLPYDKNGAKAAQGNILPQLLDRLLAHPYFAQPHPKST
            |||||||||||||||||| |||||||||||||||||||||||||||||||||||||||||
a121-1      PAFGFDTGPGNMLMDAWMQAHWQLPYDKNGAKAAQGNILPQLLDRLLAHPYFAQPHPKST
                   190        200        210        220        230        240

250        260        270        280        290        300
m121-1.pep  GRELFALNWLETYLDGGENRYDVLRTLSRFTAQTVCDAVSHAAADARQMYICGGGIRNPV
            |||||||||||||||||||||||||||||||||||| |||||||||||||||||||||||
a121-1      GRELFALNWLETYLDGGENRYDVLRTLSRFTAQTVFDAVSHAAADARQMYICGGGIRNPV
                   250        260        270        280        290        300

310        320        330        340        350        360
m121-1.pep  LMADLAECFGTRVSLHSTADLNLDPQWVEAAXFAWLAACWINRIPGSPHKATGASKPCIL
            ||||||||||||||||||||:|||||||||| |||:||||:|||||||||||||||||||
a121-1      LMADLAECFGTRVSLHSTAELNLDPQWVEAAAFAWMAACWVNRIPGSPHKATGASKPCIL
                   310        320        330        340        350        360 m121-1.pep  XAGYYYX
            ||||||
a121-1      GAGYYYX
```

128 and 128-1

The following partial DNA sequence was identified in *N. meningitidis* <SEQ ID 3085>:

```
m128.seq (partial)
     1 ATGACTGACA ACGCACTGCT CCATTTGGGC GAAGAACCCC GTTTTGATCA

51 AATCAAAACC GAAGACATCA AACCCGCCCT GCAAACCGCC ATCGCCGAAG

101 CGCGCGAACA AATCGCCGCC ATCAAAGCCC AAACGCACAC CGGCTGGGCA

151 AACACTGTCG AACCCCTGAC CGGCATCACC GAACGCGTCG GCAGGATTTG

201 GGGCGTGGTG TCGCACCTCA ACTGCGTCGC CGACACGCCC GAACTGCGCG

251 CCGTCTATAA CGAACTGATG CCCGAAATCA CCGTCTTCTT CACCGAAATC

301 GGACAAGACA TCGAGCTGTA CAACCGCTTC AAAACCATCA AAAATTCCCC

351 CGAATTCGAC ACCCTCTCCC CCGCACAAAA AACCAAACTC AACCAC

1 TACGCCAGCG AAAAACTGCG CGAAGCCAAA TACGCGTTCA GCGAAACCGA 51 wGTCAAAAAA TAyTTCCCyG TCGGCAAwGT ATTAAACGGA CTGTTCGCCC

101 AAmTCAAAAA ACTmTACGGC ATCGGATTTA CCGAAAAAAC yGTCCCCGTC

151 TGGCACAAAG ACGTGCGCTA TTkTGAATTG CAACAAAACG GCGAAmCCAT

201 AGGCGGCGTT TATATGGATT TGTACGCACG CGAAGGCAAA CGCGGCGGCG

251 CGTGGATGAA CGACTACAAA GGCCGCCGCC GTTTTTCAGA CGGCACGCTG

301 CAAyTGCCCA CCGCCTACCT CGTCTGCAAC TTCGCCCCAC CCGTCGGCGG

351 CAGGGAAGCC CGCyTGAGCC ACGACGAAAT CCTCATCCTC TTCCACGAAA

401 CCGGACACGG GCTGCACCAC CTGCTTACCC AAGTGGACGA ACTGGGCGTA

451 TCCGGCATCA ACGGCGTAkA ATGGGACGCG GTCGAACTGC CCAGCCAGTT

501 TATGGAAAAT TTCGTTTGGG AATACAATGT CTTGGCACAA mTGTCAGCCC

551 ACGAAGAAAC CGGcgTTCCC yTGCCGAAAG AACTCTTsGA CAAAwTGCTC

601 GCCGCCAAAA ACTTCCAAsG CGGCATGTTC yTsGTCCGGC AAwTGGAGTT

651 CGCCCTCTTT GATATGATGA TTTACAGCGA AGACGACGAA GGCCGTCTGA

701 AAAACTGGCA ACAGGTTTTA GACAGCGTGC GCAAAAAAGT CGCCGTCATC

751 CAGCCGCCCG AATACAACCG CTTCGCCTTG AGCTTCGGCC ACATCTTCGC

801 AGGCGGCTAT TCCGCAGCTn ATTACAGCTA CGCGTGGGCG GAAGTATTGA

851 GCGCGGACGC ATACGCCGCC TTTGAAGAAA GCGACGATGT CGCCGCCACA

901 GGCAAACGCT TTTGGCAGGA AATCCTCGCC GTCGGGGnAT CGCGCAGCGG 951 nGCAGAATCC TTCAAAGCCT TCCGCGGCCG CGAACCGAGC ATAGACGCAC

1001 TCTTGCGCCA CAGCGGTTTC GACAACGCGG TCTGA
```

This corresponds to the amino acid sequence <SEQ ID 3086; ORF 128>:

```
m128.pep (partial)
     1 MTDNALLHLG EEPRFDQIKT EDIKPALQTA IAEAREQIAA IKAQTHTGWA

51 NTVEPLTGIT ERVGRIWGVV SHLNCVADTP ELRAVYNELM PEITVFFTEI

101 GQDIELYNRF KTIKNSPEFD TLSPAQKTKL NH
//

1 YASEKLREAK YAFSETXVKK YFPVGXVLNG LFAQXKKLYG IGFTEKTVPV

51 WHKDVRYXEL QQNGEXIGGV YMDLYAREGK RGGAWMNDYK GRRRFSDGTL
```

-continued

```
101 QLPTAYLVCN FAPPVGGREA RLSHDEILIL FHETGHGLHH LLTQVDELGV

151 SGINGVXWDA VELPSQFMEN FVWEYNVLAQ XSAHEETGVP LPKELXDKXL

201 AAKNFQXGMF XVRQXEFALF DMMIYSEDDE GRLKNWQQVL DSVRKKVAVI

251 QPPEYNRFAL SFGHIFAGGY SAAXYSYAWA EVLSADAYAA FEESDDVAAT

301 GKRFWQEILA VGXSRSGAES FKAFRGREPS IDALLRHSGF DNAV*
```

The following partial DNA sequence was identified in *N. gonorrhoeae* <SEQ ID 3087>:

```
g128.seq
    1 atgattgaca acgCActgct ccacttgggc gaagaaccCC GTTTTaatca 51 aatccaaacc gaagACAtca AACCCGCCGT CCAAACCGCC ATCGCCGAAG

101 CGCGCGGACA AATCGCCGCC GTCAAAGCGC AAACGCACAC CGGCTGGGCG

151 AACACCGTCG AGCGTCTGAC CGGCATCACC GAACGCGTCG GCAGGATTTG

201 GGGCGTCGTG TCCCATCTCA ACTCCGTCGT CGACACGCCC GAACTGCGCG

251 CCGTCTATAA CGAACTGATG CCTGAAATCA CCGTCTTCTT CACCGAAATC

301 GGACAAGACA TCGAACTGTA CAACCGCTTC AAAACCATCA AAAATTCCCC

351 CGAATTTGCA ACGCTTTCCC CCGCACAAAA AACCAAGCTC GATCACGACC

401 TGCGCGATTT CGTATTGAGC GGCGCGGAAC TGCCGCCCGA ACGGCAGGCA

451 GAACTGGCAA AACTGCAAAC CGAAGGCGCG CAACTTTCCG CCAAATTCTC

501 CCAAAACGTC CTAGACGCGA CCGACGCGTT CGGCATTTAC TTTGACGATG

551 CCGCACCGCT TGCCGGCATT CCCGAAGACG CGCTCGCCAT GTTTGCCGCC

601 GCCGCGCAAA GCGAAGGCAA AACAGGTTAC AAAATCGGCT TGCAGATTCC

651 GCACTACCTT GCCGTTATCC AATACGCCGG CAACCGCGAA CTGCGCGAAC

701 AAATCTACCG CGCCTACGTT ACCCGTGCCA GCGAACTTTC AAACGACGGC

751 AAATTCGACA ACACCGCCAA CATCGACCGC ACGCTCGAAA ACGCATTGAA

801 AACCGccaaa cTGCTCGGCT TTAAAAATTA CGCCGAATTG TCGCTGGCAA

851 CCAAAATGGC GGACACGCCC GAACAGGTTT TAAACTTCCT GCACGACCTC

901 GCCCGCCGCG CCAAACCCTA CGCCGAAAAA GACCTCGCCG AAGTCAAAGC

951 CTTCGCCCGC GAACACCTCG GTCTCGCCGA CCCGCAGCCG TGGGACTTGA

1001 GCTACGCCGG CGAAAAACTG CGCGAAGCCA AATACGCATT CAGCGAAACC

1051 GAAGTCAAAA AATACTTCCC CGTCGGCAAA GTTCTGGCAG GCCTGTTCGC

1101 CCAAATCAAA AAACTCTACG GCATCGGATT CGCCGAAAAA ACCGTTCCCG

1151 TCTGGCACAA AGACGTGCGC TATTTTGAAT GCAACAAAA CGGCAAAACC

1201 ATCGGCGGCG TTTATATGGA TTTGTACGCA CGCGAAGGCA AACGCGGCGG

1251 CGCGTGGATG AACGACtaca AAGGCCGCCG CCGCTTTGCC GACGgcacGC

1301 TGCAACTGCC CACCGCCTAC CTCGTCTGCA ACTTCGCCCC GCCCGTCGGC

1351 GGCAAAGAAG CGCGTTTAAG CCACGACGAA ATCCTCACCC TCTTCCACGA

1401 AacCGGCCAC GGACTGCACC ACCTGCTTAC CCAAGTGGAC GAACTGGGCG

1451 TGTCCGGCAT CAAcggcgtA GAATGGGACG CGGTCGAACT GCCCAGCCAG

1501 TTTATGGAAA ACTTCGTTTG GGAATACAAT GTATTGGCAC AAATGTCCGC

1551 CCACGAAGAA AccgGCGAGC CCCTGCCGAA AGAACTCTTC GACAAAATGC
```

-continued

```
1601  TcgcCGCCAA AAACTTCCAG CGCGGTATGT TCCTCGTCCG GCAAATGGAG

1651  TTCGCCCTCT TCGATATGAT GATTTACAGT GAAAGCGACG AATGCCGTCT

1701  GAAAAACTGG CAGCAGGTTT TAGACAGCGT GCGCAAAGAA GTcGCCGTCA

1751  TCCAACCGCC CGAATACAAC CGCTTCGCCA ACAGCTTCGG CCacatctTC

1801  GCcggcGGCT ATTCCGCAGG CTATTACAGC TACGCATGGG CCGAAGTCCt 1851  cAGCACCGAT GCCTACGCCG CCTTTGAAGA AAGcGACGac gtcGCCGCCA 1901  CAGGCAAACG CTTCTGGCAA GAAAtccttg ccgtcggcgg ctCCCGCAGC 1951  gcgGCGGAAT CCTTCAAAGC CTTCCGCGGA CGCGAACCGA GCATAGACGC 2001  ACTGCTGCGC CAaagcggtT TCGACAACGC gGCttgA
```

This corresponds to the amino acid sequence <SEQ ID 3088; ORF 128.ng>:

```
g128.pep
    1  MIDNALLHLG EEPRFNQIQT EDIKPAVQTA IAEARGQIAA VKAQTHTGWA

51  NTVERLTGIT ERVGRIWGVV SHLNSVVDTP ELRAVYNELM PEITVFFTEI

101  GQDIELYNRF KTIKNSPEFA TLSPAQKTKL DHDLRDFVLS GAELPPERQA

151  ELAKLQTEGA QLSAKFSQNV LDATDAFGIY FDDAAPLAGI PEDALAMFAA

201  AAQSEGKTGY KIGLQIPHYL AVIQYAGNRE LREQIYRAYV TRASELSNDG

251  KFDNTANIDR TLENALKTAK LLGFKNYAEL SLATKMADTP EQVLNFLHDL

301  ARRAKPYAEK DLAEVKAFAR EHLGLADPQP WDLSYAGEKL REAKYAFSET

351  EVKKYFPVGK VLAGLFAQIK KLYGIGFAEK TVPVWHKDVR YFELQQNGKT

401  IGGVYMDLYA REGKRGGAWM NDYKGRRRFA DGTLQLPTAY LVCNFAPPVG

451  GKEARLSHDE ILTLFHETGH GLHHLLTQVD ELGVSGINGV EWDAVELPSQ

501  FMENFVWEYN VLAQMSAHEE TGEPLPKELF DKMLAAKNFQ RGMFLVRQME

551  FALFDMMIYS ESDECRLKNW QQVLDSVRKE VAVIQPPEYN RFANSFGHIF

601  AGGYSAGYYS YAWAEVLSTD AYAAFEESDD VAATGKRFWQ EILAVGGSRS

651  AAESFKAFRG REPSIDALLR QSGFDNAA*
```

ORF 128 shows 91.7% identity over a 475 aa overlap with a predicted ORF (ORF 128.ng) from *N. gonorrhoeae*:

```
m128/g128
                    10         20         30         40         50         60
    g128.pep  MIDNALLHLGEEPRFNQIQTEDIKPAVQTAIAEARGQIAAVKAQTHTGWANTVERLTGIT
              | ||||||||||||:||:|||||||:||||||| ||||:|||||||||||| |||||
    m128      MTDNALLHLGEEPRFDQIKTEDIKPALQTAIAEAREQIAAIKAQTHTGWANTVEPLTGIT
                    10         20         30         40         50         60

70         80         90        100        110        120
    g128.pep  ERVGRIWGVVSHLNSVVDTPELRAVYNELMPEITVFFTEIGQDIELYNRFKTIKNSPEFA
              |||||||||||||| |:|||||||||||||||||||||||||||||||||||||||||
    m128      ERVGRIWGVVSHLNCVADTPELRAVYNELMPEITVFFTEIGQDIELYNRFKTIKNSPEFD
                    70         80         90        100        110        120

130        140        150        160        170        180
    g128.pep  TLSPAQKTKLDHDLRDFVLSGAELPPERQAELAKLQTEGAQLSAKFSQNVLDATDAFGIY
              ||||||||||:|
    m128      TLSPAQKTKLNH
                   130
              //
```

```
                                340        350        360
g128.pep                        YAGEKLREAKYAFSETEVKKYFPVGKVLAG
                                ||:||||||||||||| |||||||| || |
m128                            YASEKLREAKYAFSETXVKKYFPVGXVLNG
                                 10         20         30

370        380        390        400        410        420
g128.pep      LFAQIKKLYGIGFAEKTVPVWHKDVRYFELQQNGKTIGGVYMDLYAREGKRGGAWMNDYK
              ||||  |||||||||:|||||||||| ||||||::|||||||||||||||||||||||||
m128          LFAQXKKLYGIGFTEKTVPVWHKDVRYXELQQNGEXIGGVYMDLYAREGKRGGAWMNDYK
               40         50         60         70         80         90

430        440        450        460        470        480
g128.pep      GRRRFADGTLQLPTAYLVCNFAPPVGGKEARLSHDEILTLFHETGHGLHHLLTQVDELGV
              |||||:||||||||||||||||||||||:|||||||||||| ||||||||||||||||||
m128          GRRRFSDGTLQLPTAYLVCNFAPPVGGREARLSHDEILILFHETGHGLHHLLTQVDELGV
               100        110        120        130        140        150

490        500        510        520        530        540
g128.pep      SGINGVEWDAVELPSQFMENFVWEYNVLAQMSAHEETGEPLPKELFDKMLAAKNFQRGMF
              ||||||  ||||||||||||||||||||||| |||||||| |||||| || ||||||  |||
m128          SGINGVXWDAVELPSQFMENFVWEYNVLAQXSAHEETGVPLPKELXDKXLAAKNFQXGMF
               160        170        180        190        200        210

550        560        570        580        590        600
g128.pep      LVRQMEFALFDMMIYSESDECRLKNWQQVLDSVRKEVAVIQPPEYNRFANSFGHIFAGGY
              |||  ||||||||||||||:|| |||||||||||||:|||||||||||||| |||||||||
m128          XVRQXEFALFDMMIYSEDDEGRLKNWQQVLDSVRKKVAVIQPPEYNRFALSFGHIFAGGY
               220        230        240        250        260        270

610        620        630        640        650        660
g128.pep      SAGYYSYAWAEVLSTDAYAAFEESDDVAATGKRFWQEILAVGGSRSAAESFKAFRGREPS
              ||: |||||||||||:||||||||||||||||||||||||||||| |||:|||||||||||
m128          SAAXYSYAWAEVLSADAYAAFEESDDVAATGKRFWQEILAVGXSRSGAESFKAFRGREPS
               280        290        300        310        320        330

670        679
g128.pep      IDALLRQSGFDNAAX
              ||||||:|||||||:
m128          IDALLRHSGFDNAVX
               340
```

The following partial DNA sequence was identified in *N. meningitidis* <SEQ ID 3089>:

```
a128.seq
   1  ATGACTGACA ACGCACTGCT CCATTTGGGC GAAGAACCCC GTTTTGATCA

51  AATCAAAACC GAAGACATCA AACCCGCCCT GCAAACCGCC ATTGCCGAAG

101  CGCGCGAACA AATCGCCGCC ATCAAAGCCC AAACGCACAC CGGCTGGGCA

151  AACACTGTCG AACCCCTGAC CGGCATCACC GAACGCGTCG GCAGGATTTG

201  GGGCGTGGTG TCGCACCTCA ACTCCGTCAC CGACACGCCC GAACTGCGCG

251  CCGCCTACAA TGAATTAATG CCCGAAATTA CCGTCTTCTT CACCGAAATC

301  GGACAAGACA TCGAGCTGTA CAACCGCTTC AAAACCATCA AAAACTCCCC

351  CGAGTTCGAC ACCCTCTCCC ACGCGCAAAA AACCAAACTC AACCACGATC

401  TGCGCGATTT CGTCCTCAGC GGCGCGGAAC TGCCGCCCGA ACAGCAGGCA

451  GAATTGGCAA AACTGCAAAC CGAAGGCGCG CAACTTTCCG CCAAATTCTC

501  CCAAAACGTC CTAGACGCGA CCGACGCGTT CGGCATTTAC TTTGACGATG

551  CCGCACCGCT TGCCGGCATT CCCGAAGACG CGCTCGCCAT GTTTGCCGCT

601  GCCGCGCAAA GCGAAGGCAA AACAGGCTAC AAAATCGGTT TGCAGATTCC

651  GCACTACCTC GCCGTCATCC AATACGCCGA CAACCGCAAA CTGCGCGAAC

701  AAATCTACCG CGCCTACGTT ACCCGCGCCA GCGAGCTTTC AGACGACGGC

751  AAATTCGACA ACACCGCCAA CATCGACCGC ACGCTCGAAA ACGCCCTGCA

801  AACCGCCAAA CTGCTCGGCT TCAAAAACTA CGCCGAATTG TCGCTGGCAA
```

```
 851 CCAAAATGGC GGACACCCCC GAACAAGTTT TAAACTTCCT GCACGACCTC

901 GCCCGCCGCG CCAAACCCTA CGCCGAAAAA GACCTCGCCG AAGTCAAAGC

951 CTTCGCCCGC GAAAGCCTCG GCCTCGCCGA TTTGCAACCG TGGGACTTGG

1001 GCTACGCCGG CGAAAAACTG CGCGAAGCCA AATACGCATT CAGCGAAACC

1051 GAAGTCAAAA AATACTTCCC CGTCGGCAAA GTATTAAACG GACTGTTCGC

1101 CCAAATCAAA AAACTCTACG GCATCGGATT TACCGAAAAA ACCGTCCCCG

1151 TCTGGCACAA AGACGTGCGC TATTTTGAAT GCAACAAAA CGGCGAAACC

1201 ATAGGCGGCG TTTATATGGA TTTGTACGCA CGCGAAGGCA AACGCGGCGG

1251 CGCGTGGATG AACGACTACA AAGGCCGCCG CCGTTTTTCA GACGGCACGC

1301 TGCAACTGCC CACCGCCTAC CTCGTCTGCA ACTTCACCCC GCCCGTCGGC

1351 GGCAAAGAAG CCCGCTTGAG CCATGACGAA ATCCTCACCC TCTTCCACGA

1401 AACCGGACAC GGCCTGCACC ACCTGCTTAC CCAAGTCGAC GAACTGGGCG

1451 TATCCGGCAT CAACGGCGTA GAATGGGACG CAGTCGAACT GCCCAGTCAG

1501 TTTATGGAAA ATTTCGTTTG GGAATACAAT GTCTTGGCGC AAATGTCCGC

1551 CCACGAAGAA ACCGGCGTTC CCATGACGAA AGAACTCTTC GACAAAATGC

1601 TCGCCGCCAA AAACTTCCAA CGCGGAATGT TCCTCGTCCG CCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAGAA GTCGCCGTCG

1751 TCCGACCGCC CGAATACAAC CGCTTCGCCA ACAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGA CGCGAACCGA GCATAGACGC

2001 ACTCTTGCGC CACAGCGGCT TCGACAACGC GGCTTGA
```

This corresponds to the amino acid sequence <SEQ ID 40 3090; ORF 128.a>:

```
a128.pep
   1 MTDNALLHLG EEPRFDQIKT EDIKPALQTA IAEAREQIAA IKAQTHTGWA

51 NTVEPLTGIT ERVGRIWGVV SHLNSVTDTP ELRAAYNELM PEITVFFTEI

101 GQDIELYNRF KTIKNSPEFD TLSHAQKTKL NHDLRDFVLS GAELPPEQQA

151 ELAKLQTEGA QLSAKFSQNV LDATDAFGIY FDDAAPLAGI PEDALAMFAA

201 AAQSEGKTGY KIGLQIPHYL AVIQYADNRK LREQIYRAYV TRASELSDDG

251 KFDNTANIDR TLENALQTAK LLGFKNYAEL SLATKMADTP EQVLNFLHDL

301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF
```

-continued

```
601   AGGYSAGYYS YAWAEVLSAD AYAAFEESDD VAATGKRFWQ EILAVGGSRS

651   AAESFKAFRG REPSIDALLR HSGFDNAA*
``` m128/a128 66.0% identity in 677 aa overlap

```
                  10         20         30         40         50         60
m128.pep  MTDNALLHLGEEPRFDQIKTEDIKPALQTAIAEAREQIAAIKAQTHTGWANTVEPLTGIT
          |||||||||||||||||||||||||||||||||||||||||||||||||||||||||||
a128      MTDNALLHLGEEPRFDQIKTEDIKPALQTAIAEAREQIAAIKAQTHTGWANTVEPLTGIT
                  10         20         30         40         50         60

70         80         90        100        110        120
m128.pep  ERVGRIWGVVSHLNCVADTPELRAVYNELMPEITVFFTEIGQDIELYNRFKTIKNSPEFD
          ||||||||||||| :|||||||:|||||||||||||||||||||||||||||||||||
a128      ERVGRIWGVVSHLNSVTDTPELRAAYNELMPEITVFFTEIGQDIELYNRFKTIKNSPEFD
                  70         80         90        100        110        120

130
m128.pep  TLSPAQKTKLNH------------------------------------------------
          ||| ||||||||
a128      TLSHAQKTKLNHDLRDFVLSGAELPPEQQAELAKLQTEGAQLSAKFSQNVLDATDAFGIY
                 130        140        150        160        170        180 m128.pep  ------------------------------------------------------------
a128      FDDAAPLAGIPEDALAMFAAAAQSEGKTGYKIGLQIPHYLAVIQYADNRKLREQIYRAYV
                 190        200        210        220        230        240 m128.pep  ------------------------------------------------------------
a128      TRASELSDDGKFDNTANIDRTLENALQTAKLLGFKNYAELSLATKMADTPEQVLNFLHDL
                 250        260        270        280        290        300

140        150
m128.pep  ---------------------------------YASEKLREAKYAFSETXVKKYFPVGX
                                           ||:|||||||||||| ||||||||
a128      ARRAKPYAEKDLAEVKAFARESLGLADLQPWDLGYAGEKLREAKYAFSETEVKKYFPVGK
                 310        320        330        340        350        360

160        170        180        190        200        210
m128.pep  VLNGLFAQXKKLYGIGFTEKTVPVWHKDVRYXELQQNGEXIGGVYMDLYAREGKRGGAWM
          ||||||||  |||||||||||||||||||||| |||||||| ||||||||||||||||||
a128      VLNGLFAQIKKLYGIGFTEKTVPVWHKDVRYFELQQNGETIGGVYMDLYAREGKRGGAWM
                 370        380        390        400        410        420

220        230        240        250        260        270
m128.pep  NDYKGRRRFSDGTLQLPTAYLVCNFAPPVGGREARLSHDEILILFHETGHGLHHLLTQVD
          ||||||||||||||||||||||||||:||||:||||||||||| ||||||||||||||||
a128      NDYKGRRRFSDGTLQLPTAYLVCNFTPPVGGKEARLSHDEILTLFHETGHGLHHLLTQVD
                 420        440        450        460        470        480

280        290        300        310        320        330
m128.pep  ELGVSGINGVXWDAVELPSQFMENFVWEYNVLAQXSAHEETGVPLPKELXDKXLAAKNFQ
          |||||||||| ||||||||||||||||||||||| |||||||||||||| | |||||||
a128      ELGVSGINGVEWDAVELPSQFMENFVWEYNVLAQMSAHEETGVPLPKELFDKMLAAKNFQ
                 490        500        510        520        530        540

340        350        360        370        380        390
m128.pep  XGMFXVRQXEFALFDMMIYSEDDEGRLKNWQQVLDSVRKKVAVIQPPEYNRFALSFGHIF
          ||| ||| |||||||||||||||||||||||||||||||:|::||||||||||| |||||
a128      RGMFLVRQMEFALFDMMIYSEDDEGRLKNWQQVLDSVRKEVAVVRPPEYNRFANSFGHIF
                 550        560        570        580        590        600

400        410        420        430        440        450
m128.pep  AGGYSAAXYSYAWAEVLSADAYAAFEESDDVAATGKRFWQEILAVGXSRSGAESFKAFRG
          ||||||: |||||||||||||||||||||||||||||||||||||| |||:|||||||
a128      AGGYSAGYYSYAWAEVLSADAYAAFEESDDVAATGKRFWQEILAVGGSRSAAESFKAFRG
                 610        620        630        640        650        660

460        470
m128.pep  REPSIDALLRHSGFDNAVX
          ||||||||||||||||||:
a128      REPSIDALLRHSGFDNAAX
                 670
```

The following partial DNA sequence was identified in *N. meningitidis* <SEQ ID 3091>:

```
m128-1.seq
   1 ATGACTGACA ACGCACTGCT CCATTTGGGC GAAGAACCCC GTTTTGATCA

51 AATCAAAACC GAAGACATCA AACCCGCCCT GCAAACCGCC ATCGCCGAAG

101 CGCGCGAACA AATCGCCGCC ATCAAAGCCC AAACGCACAC CGGCTGGGCA

151 AACACTGTCG AACCCCTGAC CGGCATCACC GAACGCGTCG GCAGGATTTG

201 GGGCGTGGTG TCGCACCTCA ACTCCGTCGC CGACACGCCC GAACTGCGCG

251 CCGTCTATAA CGAACTGATG CCCGAAATCA CCGTCTTCTT CACCGAAATC

301 GGACAAGACA TCGAGCTGTA CAACCGCTTC AAAACCATCA AAAATTCCCC

351 CGAATTCGAC ACCCTCTCCC CCGCACAAAA AACCAAACTC AACCACGATC

401 TGCGCGATTT CGTCCTCAGC GGCGCGGAAC TGCCGCCCGA ACAGCAGGCA

451 GAACTGGCAA AACTGCAAAC CGAAGGCGCG CAACTTTCCG CCAAATTCTC

501 CCAAAACGTC CTAGACGCGA CCGACGCGTT CGGCATTTAC TTTGACGATG

551 CCGCACCGCT TGCCGGCATT CCCGAAGACG CGCTCGCCAT GTTTGCCGCC

601 GCCGCGCAAA GCGAAAGCAA AACAGGCTAC AAAATCGGCT TGCAGATTCC

651 ACACTACCTC GCCGTCATCC AATACGCCGA CAACCGCGAA CTGCGCGAAC

701 AAATCTACCG CGCCTACGTT ACCCGCGCCA GCGAACTTTC AGACGACGGC

751 AAATTCGACA ACACCGCCAA CATCGACCGC ACGCTCGCAA ACGCCCTGCA

801 AACCGCCAAA CTGCTCGGCT TCAAAAACTA CGCCGAATTG TCGCTGGCAA

851 CCAAAATGGC GGACACGCCC GAACAAGTTT TAAACTTCCT GCACGACCTC

901 GCCCGCCGCG CCAAACCCTA CGCCGAAAAA GACCTCGCCG AAGTCAAAGC

951 CTTCGCCCGC GAAAGCCTGA ACCTCGCCGA TTTGCAACCG TGGGACTTGG

1001 GCTACGCCAG CGAAAAACTG CGCGAAGCCA AATACGCGTT CAGCGAAACC

1051 GAAGTCAAAA AATACTTCCC CGTCGGCAAA GTATTAAACG GACTGTTCGC

1101 CCAAATCAAA AAACTCTACG GCATCGGATT TACCGAAAAA ACCGTCCCCG

1151 TCTGGCACAA AGACGTGCGC TATTTTGAAT TGCAACAAAA CGGCGAAACC

1201 ATAGGCGGCG TTTATATGGA TTTGTACGCA CGCGAAGGCA AACGCGGCGG

1251 CGCGTGGATG AACGACTACA AAGGCCGCCG CCGTTTTTCA GACGGCACGC

1301 TGCAACTGCC CACCGCCTAC CTCGTCTGCA ACTTCGCCCC ACCCGTCGGC

1351 GGCAGGGAAG CCCGCCTGAG CCACGACGAA ATCCTCATCC TCTTCCACGA

1401 AACCGGACAC GGGCTGCACC ACCTGCTTAC CCAAGTGGAC GAACTGGGCG

1451 TATCCGGCAT CAACGGCGTA GAATGGGACG CGGTCGAACT GCCCAGCCAG

1501 TTTATGGAAA ATTTCGTTTG GGAATACAAT GTCTTGGCAC AAATGTCAGC

1551 CCACGAAGAA ACCGGCGTTC CCCTGCCGAA AGAACTCTTC GACAAAATGC

1601 TCGCCGCCAA AAACTTCCAA CGCGGCATGT TCCTCGTCCG GCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAAAA GTCGCCGTCA

1751 TCCAGCCGCC CGAATACAAC CGCTTCGCCT TGAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC
```

-continued

```
1951 GCGGCAGAAT CCTTCAAAGC CTTCCGCGGC CGCGAACCGA GCATAGACGC

2001 ACTCTTGCGC CACAGCGGTT TCGACAACGC GGTCTGA
```

This corresponds to the amino acid sequence <SEQ ID 3092; ORF 128-1>:

```
m128-1.pep.
   1 MTDNALLHLG EEPRFDQIKT EDIKPALQTA IAEAREQIAA IKAQTHTGWA

51 NTVEPLTGIT ERVGRIWGVV SHLNSVADTP ELRAVYNELM PEITVFFTEI

101 GQDIELYNRF KTIKNSPEFD TLSPAQKTKL NHDLRDFVLS GAELPPEQQA

151 ELAKLQTEGA QLSAKFSQNV LDATDAFGIY FDDAAPLAGI PEDALAMFAA

201 AAQSESKTGY KIGLQIPHYL AVIQYADNRE LREQIYRAYV TRASELSDDG

251 KFDNTANIDR TLANALQTAK LLGFKNYAEL SLATKMADTP EQVLNFLHDL

301 ARRAKPYAEK DLAEVKAFAR ESLNLADLQP WDLGYASEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFAPPVG

451 GREARLSHDE ILILFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKK VAVIQPPEYN RFALSFGHIF

601 AGGYSAGYYS YAWAEVLSAD AYAAFEESDD VAATGKRFWQ EILAVGGSRS

651 AAESFKAFRG REPSIDALLR HSGFDNAV*
```

The following partial DNA sequence was identified in N. gonorrhoeae <SEQ ID 3093>:

```
g128-1.seq (partial)
   1 ATGATTGACA ACGCACTGCT CCACTTGGGC GAAGAACCCC GTTTTAATCA

51 AATCAAAACC GAAGACATCA AACCCGCCGT CCAAACCGCC ATCGCCGAAG

101 CGCGCGGACA AATCGCCGCC GTCAAAGCGC AAACGCACAC CGGCTGGGCG

151 AACACCGTCG AGCGTCTGAC CGGCATCACC GAACGCGTCG GCAGGATTTG

201 GGGCGTCGTG TCCCATCTCA ACTCCGTCGT CGACACGCCC GAACTGCGCG

251 CCGTCTATAA CGAACTGATG CCTGAAATCA CCGTCTTCTT CACCGAAATC

301 GGACAAGACA TCGAACTGTA CAACCGCTTC AAAACCATCA AAAATTCCCC

351 CGAATTTGCA ACGCTTTCCC CCGCACAAAA AACCAAGCTC GATCACGACC

401 TGCGCGATTT CGTATTGAGC GGCGCGGAAC TGCCGCCCGA ACGGCAGGCA

451 GAACTGGCAA AACTGCAAAC CGAAGGCGCG CAACTTTCCG CCAAATTCTC

501 CCAAAACGTC CTAGACGCGA CCGACGCGTT CGGCATTTAC TTTGACGATG

551 CCGCACCGCT TGCCGGCATT CCCGAAGACG CGCTCGCCAT GTTTGCCGCC

601 GCCGCGCAAA GCGAAGGCAA AACAGGTTAC AAAATCGGCT TGCAGATTCC

651 GCACTACCTT GCCGTTATCC AATACGCCGG CAACCGCGAA CTGCGCGAAC

701 AAATCTACCG CGCCTACGTT ACCCGTGCCA GCGAACTTTC AAACGACGGC

751 AAATTCGACA ACACCGCCAA CATCGACCGC ACGCTCGAAA ACGCATTGAA

801 AACCGCCAAA CTGCTCGGCT TTAAAAATTA CGCCGAATTG TCGCTGGCAA

851 CCAAAATGGC GGACACGCCC GAACAGGTTT TAAACTTCCT GCACGACCTC
```

```
 901 GCCCGCCGCG CCAAACCCTA CGCCGAAAAA GACCTCGCCG AAGTCAAAGC

951 CTTCGCCCGC GAACACCTCG GTCTCGCCGA CCCGCAGCCG TGGGACTTGA

1001 GCTACGCCGG CGAAAAACTG CGCGAAGCCA AATACGCATT CAGCGAAACC

1051 GAAGTCAAAA AATACTTCCC CGTCGGCAAA GTTCTGGCAG CCTGTTCGC

1101 CCAAATCAAA AAACTCTACG GCATCGGATT CGCCGAAAAA ACCGTTCCCG

1151 TCTGGCACAA AGACGTGCGC TATTTTGAAT TGCAACAAAA CGGCAAAACC

1201 ATCGGCGGCG TTTATATGGA TTTGTACGCA CGCGAAGGCA AACGCGGCGG

1251 CGCGTGGATG AACGACTACA AAGGCCGCCG CCGCTTTGCC GACGGCACGC

1301 TGCAACTGCC CACCGCCTAC CTCGTCTGCA ACTTCGCCCC GCCCGTCGGC

1351 GGCAAAGAAG CGCGTTTAAG CCACGACGAA ATCCTCACCC TCTTCCACGA

1401 AACCGGCCAC GGACTGCACC ACCTGCTTAC CCAAGTGGAC GAACTGGGCG

1451 TGTCCGGCAT CAACGGCGTA AAA
```

This corresponds to the amino acid sequence <SEQ ID 3094; ORF 128-1.ng>:

```
g128-1.pep (partial)

1  MIDNALLHLG EEPRFNQIKT EDIKPAVQTA IAEARGQIAA VKAQTHTGWA

51  NTVERLTGIT ERVGRIWGVV SHLNSVVDTP ELRAVYNELM PEITVFFTEI

101  GQDIELYNRF KTIKNSPEFA TLSPAQKTKL DHDLRDFVLS GAELPPERQA

151  ELAKLQTEGA QLSAKFSQNV LDATDAFGIY FDDAAPLAGI PEDALAMFAA

201  AAQSEGKTGY KIGLQIPHYL AVIQYAGNRE LREQIYRAYV TRASELSNDG

251  KFDNTANIDR TLENALKTAK LLGFKNYAEL SLATKMADTP EQVLNFLHDL

301  ARRAKPYAEK DLAEVKAFAR EHLGLADPQP WDLSYAGEKL REAKYAFSET

351  EVKKYFPVGK VLAGLFAQIK KLYGIGFAEK TVPVWHKDVR YFELQQNGKT

401  IGGVYMDLYA REGKRGGAWM NDYKGRRRFA DGTLQLPTAY LVCNFAPPVG

451  GKEARLSHDE ILTLFHETGH GLHHLLTQVD ELGVSGINGV K m128-1/g128-1  94.5% identity in 491 aa overlap 10         20         30         40         50         60
g128-1.pep  MIDNALLHLGEEPRFNQIKTEDIKPAVQTAIAEARGQIAAVKAQTHTGWANTVERLTGIT
            | ||||||||||||||||:|||||||||:|||||| ||||:||||||||||||| |||||
m128-1      MTDNALLHLGEEPRFDQIKTEDIKPALQTAIAEAREQIAAIKAQTHTGWANTVEPLTGIT
                    10         20         30         40         50         60

70         80         90        100        110        120
g128-1.pep  ERVGRIWGVVSHLNSVVDTPELRAVYNELMPEITVFFTEIGQDIELYNRFKTIKNSPEFA
            ||||||||||||||||:|||||||||||||||||||||||||||||||||||||||||||
m128-1      ERVGRIWGVVSHLNSVADTPELRAVYNELMPEITVFFTEIGQDIELYNRFKTIKNSPEFA
                    70         80         90        100        110        120

130        140        150        160        170        180
g128-1.pep  TSLPAQKTKLDHDLRDFVLSGAELPPERQAELAKLQTEGAQLSAKFSQNVLDATDAFGIY
            |||||||||:||||||||||||||||:|||||||||||||||||||||||||||||||||
m128-1      TSLPAQKTKLNHDLRDFVLSGAELPPEQQAELAKLQTEGAQLSAKFSQNVLDATDAFGIY
                   130        140        150        160        170        180

190        200        210        220        230        240
g128-1.pep  FDDAAPLAGIPEDALAMFAAAAQSEGKTGYKIGLQIPHYLAVIQYAGNRELREQIYRAYV
            |||||||||||||||||||||||:|||||||||||||||||||||||:||||||||||||
m128-1      FDDAAPLAGIPEDALAMFAAAAQSESKTGYKIGLQIPHYLAVIQYADNRELREQIYRAYV
                   190        200        210        220        230        240
```

-continued

```
                    250       260       270       280       290       300
g128-1.pep   TRASELSNDGKFDNTANIDRTLENALKTAKLLGFKNYAELSLATKMADTPEQVLNFLHDL
             |||||||:||||||||||||||| |||:||||||||||||||||||||||||||||||||||
m128-1       TRASELSDDGKFDNTANIDRTLANALQTAKLLGFKNYAELSLATKMADTPEQVLNFLHDL
                    250       260       270       280       290       300

310       320       330       340       350       360
g128-1.pep   ARRAKPYAEKDLAEVKAFAREHLGLADPQPWDLSYAGEKLREAKYAFSETEVKKYFPVGK
             |||||||||||||||||||| |:||| |||||:||:|||||||||||||||||||||||
m128-1       ARRAKPYAEKDLAEVKAFARESLNLADLQPWDLGYASEKLREAKYAFSETEVKKYFPVGK
                    310       320       330       340       350       360

370       380       390       400       410       420
g128-1.pep   VLAGLFAQIKKLYGIGFAEKTVPVWHKDVRYFELQQNGKTIGGVYMDLYAREGKRGGAWM
             || ||||||||||||||:||||||||||||||||||||:||||||||||||||||||||
m128-1       VLNGLFAQIKKLYGIGFTEKTVPVWHKDVRYFELQQNGETIGGVYMDLYAREGKRGGAWM
                    370       380       390       400       410       420

430       440       450       460       470       480
g128-1.pep   NDYKGRRRFADGTLQLPTAYLVCNFAPPVGGKEARLSHDEILTLFHETGHGLHHLLTQVD
             ||||||||:||||||||||||||||||||||:|||||||||| ||||||||||||||||
m128-1       NDYKGRRRFSDGTLQLPTAYLVCNFAPPVGGREARLSHDEILILFHETGHGLHHLLTQVD
                    430       440       450       460       470       480

490
g128-1.pep   ELGVSGINGVK
             ||||||||||:
m128-1       ELGVSGINGVEWDAVELPSQFMENFVWEYNVLAQMSAHEETGVPLPKELFDKMLAAKNFQ
                    490       500       510       520       530       540
```

The following partial DNA sequence was identified in *N. meningitidis* <SEQ ID 3095>:

```
a128-1.seq
   1 ATGACTGACA ACGCACTGCT CCATTTGGGC GAAGAACCCC GTTTTGATCA

51 AATCAAAACC GAAGACATCA AACCCGCCCT GCAAACCGCC ATTGCCGAAG

101 CGCGCGAACA AATCGCCGCC ATCAAAGCCC AAACGCACAC CGGCTGGGCA

151 AACACTGTCG AACCCCTGAC CGGCATCACC GAACGCGTCG GCAGGATTTG

201 GGGCGTGGTG TCGCACCTCA ACTCCGTCAC CGACACGCCC GAACTGCGCG

251 CCGCCTACAA TGAATTAATG CCCGAAATTA CCGTCTTCTT CACCGAAATC

301 GGACAAGACA TCGAGCTGTA CAACCGCTTC AAAACCATCA AAAACTCCCC

351 CGAGTTCGAC ACCCTCTCCC ACGCGCAAAA AACCAAACTC AACCACGATC

401 TGCGCGATTT CGTCCTCAGC GGCGCGGAAC TGCCGCCCGA ACAGCAGGCA

451 GAATTGGCAA AACTGCAAAC CGAAGGCGCG CAACTTTCCG CCAAATTCTC

501 CCAAAACGTC CTAGACGCGA CCGACGCGTT CGGCATTTAC TTTGACGATG

551 CCGCACCGCT TGCCGGCATT CCCGAAGACG CGCTCGCCAT GTTTGCCGCT

601 GCCGCGCAAA GCGAAGGCAA AACAGGCTAC AAAATCGGTT TGCAGATTCC

651 GCACTACCTC GCCGTCATCC AATACGCCGA CAACCGCAAA CTGCGCGAAC

701 AAATCTACCG CGCCTACGTT ACCCGCGCCA GCGAGCTTTC AGACGACGGC

751 AAATTCGACA ACACCGCCAA CATCGACCGC ACGCTCGAAA ACGCCCTGCA

801 AACCGCCAAA CTGCTCGGCT TCAAAAACTA CGCCGAATTG TCGCTGGCAA

851 CCAAAATGGC GGACACCCCC GAACAAGTTT TAAACTTCCT GCACGACCTC

901 GCCCGCCGCG CCAAACCCTA CGCCGAAAAA GACCTCGCCG AAGTCAAAGC

951 CTTCGCCCGC GAAAGCCTCG GCCTCGCCGA TTTGCAACCG TGGGACTTGG

1001 GCTACGCCGG CGAAAAACTG CGCGAAGCCA AATACGCATT CAGCGAAACC
```

-continued

```
1051 GAAGTCAAAA AATACTTCCC CGTCGGCAAA GTATTAAACG GACTGTTCGC

1101 CCAAATCAAA AAACTCTACG GCATCGGATT TACCGAAAAA ACCGTCCCCG

1151 TCTGGCACAA AGACGTGCGC TATTTTGAAT TGCAACAAAA CGGCGAAACC

1201 ATAGGCGGCG TTTATATGGA TTTGTACGCA CGCGAAGGCA AACGCGGCGG

1251 CGCGTGGATG AACGACTACA AAGGCCGCCG CCGTTTTTCA GACGGCACGC

1301 TGCAACTGCC CACCGCCTAC CTCGTCTGCA ACTTCACCCC GCCCGTCGGC

1351 GGCAAAGAAG CCCGCTTGAG CCATGACGAA ATCCTCACCC TCTTCCACGA

1401 AACCGGACAC GGCCTGCACC ACCTGCTTAC CCAAGTCGAC GAACTGGGCG

1451 TATCCGGCAT CAACGGCGTA GAATGGGACG CAGTCGAACT GCCCAGTCAG

1501 TTTATGGAAA ATTTCGTTTG GGAATACAAT GTCTTGGCGC AAATGTCCGC

1551 CCACGAAGAA ACCGGCGTTC CCCTGCCGAA AGAACTCTTC GACAAAATGC

1601 TCGCCGCCAA AAACTTCCAA CGCGGAATGT TCCTCGTCCG CCAAATGGAG

1651 TTCGCCCTCT TTGATATGAT GATTTACAGC GAAGACGACG AAGGCCGTCT

1701 GAAAAACTGG CAACAGGTTT TAGACAGCGT GCGCAAAGAA GTCGCCGTCG

1751 TCCGACCGCC CGAATACAAC CGCTTCGCCA ACAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGA CGCGAACCGA GCATAGACGC

2001 ACTCTTGCGC CACAGCGGCT TCGACAACGC GGCTTGA
```

This corresponds to the amino acid sequence <SEQ ID 3096; ORF 128-1.a>:

```
a128-1.pep
   1 MTDNALLHLG EEPRFDQIKT EDIKPALQTA IAEAREQIAA IKAQTHTGWA

51 NTVEPLTGIT ERVGRIWGVV SHLNSVTDTP ELRAAYNELM PEITVFFTEI

101 GQDIELYNRF KTIKNSPEFD TLSHAQKTKL NHDLRDFVLS GAELPPEQQA

151 ELAKLQTEGA QLSAKFSQNV LDATDAFGIY FDDAAPLAGI PEDALAMFAA

201 AAQSEGKTGY KIGLQIPHYL AVIQYADNRK LREQIYRAYV TRASELSDDG

251 KFDNTANIDR TLENALQTAK LLGFKNYAEL SLATKMADTP EQVLNFLHDL

301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF

601 AGGYSAGYYS YAWAEVLSAD AYAAFEESDD VAATGKRFWQ EILAVGGSRS

651 AAESFKAFRG REPSIDALLR HSGFDNAA*
``` m128-1/a128-1 97.8% identity in 677 aa overlap

```
                   10         20         30         40         50         60
a128-1.pep  MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
m128-1      MTDNALLHLGEEPRFDQIKTEDIKPALQTAIAEAREQIAAIKAQTHTGWANTVEPLTGIT
                   10         20         30         40         50         60

70         80         90        100        110        120
a128-1.pep  ERVGRIWGVVSHLNSVTDTPELRAAYNELMPEITVFFTEIGQDIELYNRFKTIKNSPEFD
            |||||||||||||||:||||||:|||||||||||||||||||||||||||||||||||||
m128-1      ERVGRIWGVVSHLNSVADTPELRAVYNELMPEITVFFTEIGQDIELYNRFKTIKNSPEFD
                   70         80         90        100        110        120

130        140        150        160        170        180
a128-1.pep  TLSHAQKTKLNHDLRDFVLSGAELPPEQQAELAKLQTEGAQLSAKFSQNVLDATDAFGIY
            |||  |||||||||||||||||||||||||||||||||||||||||||||||||||||||
m128-1      TLSPAQKTKLNHDLRDFVLSGAELPPEQQAELAKLQTEGAQLSAKFSQNVLDATDAFGIY
                  130        140        150        160        170        180

190        200        210        220        230        240
a128-1.pep  FDDAAPLAGIPEDALAMFAAAQSEGKTGYKIGLQIPHYLAVIQYADNRKLREQIYRAYV
            |||||||||||||||||||||||:|||||||||||||||||||||||||:||||||||||
m128-1      FDDAAPLAGIPEDALAMFAAAQSESKTGYKIGLQIPHYLAVIQYADNRELREQIYRAYV
                  190        200        210        220        230        240

250        260        270        280        290        300
a128-1.pep  TRASELSDDGKFDNTANIDRTLENALQTAKLLGFKNYAELSLATKMADTPEQVLNFLHDL
            ||||||||||||||||||||||| ||||||||||||||||||||||||||||||||||||
m128-1      TRASELSDDGKFDNTANIDRTLANALQTAKLLGFKNYAELSLATKMADTPEQVLNFLHDL
                  250        260        270        280        290        300

310        320        330        340        350        360
a128-1.pep  ARRAKPYAEKDLAEVKAFAREHLGLADPQPWDLSYAGEKLREAKYAFSETEVKKYFPVGK
            ||||||||||||||||||||||||:|||||||||||:|||||||||||||||||||||||
m128-1      ARRAKPYAEKDLAEVKAFAREHLNLADPQPWDLSYASEKLREAKYAFSETEVKKYFPVGK
                  310        320        330        340        350        360

370        380        390        400        410        420
a128-1.pep  VLNGLFAQIKKLYGIGFTEKTVPVWHKDVRYFELQQNGETIGGVYMDLYAREGKRGGAWM
            ||||||||||||||||||||||||||||||||||||||||||||||||||||||||||||
m128-1      VLNGLFAQIKKLYGIGFTEKTVPVWHKDVRYFELQQNGETIGGVYMDLYAREGKRGGAWM
                  370        380        390        400        410        420

430        440        450        460        470        480
a128-1.pep  NDYKGRRRFSDGTLQLPTAYLVCNFTPPVGGKEARLSHDEILTLFHETGHGLHHLLTQVD
            |||||||||||||||||||||||||:|||||:|||||||||||:||||||||||||||||
m128-1      NDYKGRRRFSDGTLQLPTAYLVCNFAPPVGGREARLSHDEILILFHETGHGLHHLLTQVD
                  430        440        450        460        470        480

490        500        510        520        530        540
a128-1.pep  ELGVSGINGVEWDAVELPSQFMENFVWEYNVLAQMSAHEETGVPLPKELFDKMLAAKNFQ
            ||||||||||||||||||||||||||||||||||||||||||||||||||||||||||||
m128-1      ELGVSGINGVEWDAVELPSQFMENFVWEYNVLAQMSAHEETGVPLPKELFDKMLAAKNFQ
                  490        500        510        520        530        540

550        560        570        580        590        600
a128-1.pep  RGMFLVRQMEFALFDMMIYSEDDEGRLKNWQQVLDSVRKEVAVVRPPEYNRFANSFGHIF
            |||||||||||||||||||||||||||||||||||||||:|||::|||||||||:||||||
m128-1      RGMFLVRQMEFALFDMMIYSEDDEGRLKNWQQVLDSVRKKVAVIQPPEYNRFALSFGHIF
                  550        560        570        580        590        600

610        620        630        640        650        660
a128-1.pep  AGGYSAGYYSYAWAEVLSADAYAAFEESDDVAATGKRFWQEILAVGGSRSAAESFKAFRG
            ||||||||||||||||||||||||||||||||||||||||||||||||||||||||||||
m128-1      AGGYSAGYYSYAWAEVLSADAYAAFEESDDVAATGKRFWQEILAVGGSRSAAESFKAFRG
                  610        620        630        640        650        660

670       679
a128-1.pep  REPSIDALLRHSGFDNAAX
            ||||||||||||||||||:
m128-1      REPSIDALLRHSGFDNAVX
                  670
```

206

The following partial DNA sequence was identified in *N. meningitidis* <SEQ ID 3097>:

```
m206.seq
   1 ATGTTTCCCC CCGACAAAAC CCTTTTCCTC TGTCTCAGCG CACTGCTCCT

51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAr AACGCCCTCA ACGTCAAGCT GCCGCGCACC

301 GCCCGCGACA TGGCGGCGGC AAGCCGsAAA ATCCCCGAcA GCCGCyTCAA

351 GGCCGGCGAC CTCGTATTCT TCAACACCGG CGGCGCACAC CGCTACTCAC

401 ACGTCGGACT CTACATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TTTTTACAGA ATGA
```

This corresponds to the amino acid sequence <SEQ ID 3098; ORF 206>:

```
m206.pep . . .
   1 MFPPDKTLFL CLSALLLASC GTTSGKHRQP KPKQTVRQI QAVRISHIDRT

51 QGSQELMLHS LGLIGTPYKW GGSSTATGFD CSGMIQFVY KNALNVKLPRT

101 ARDMAAASRK IPDSRXKAGD LVFFNTGGAH RYSHVGLYI GNGEFIHAPSS

151 GKTIKTEKLS TPFYAKNYLG AHTFFTE*
```

35

The following partial DNA sequence was identified in *N. gonorrhoeae* <SEQ ID 3099>:

```
g206.seq.
   1 atgttttccc ccgacaaaac cctttccctc tgtctcggcg cactgctcct 51 cgcctcatgc ggcacgacct ccggcaaaca ccgccaaccg aaacccaaac 101 agacagtccg gcaaatccaa gccgtccgca tcagccacat cggccgcaca 151 caaggctcgc aggaactcat gctccacagc ctcggactca tcggcacgcc 201 ctacaaatgg ggcggcagca gcaccgcaac cggcttcgac tgcagcggca 251 tgattcaatt ggtttacaaa aacgccctca acgtcaagct gccgcgcacc 301 gcccgcgaca tggcggcggc aagccgcaaa atccccgaca gccgcctcaa 351 ggccggcgac atcgtattct tcaacaccgg cggcgcacac cgctactcac 401 acgtcggact ctacatcggc aacggcgaat tcatccatgc ccccggcagc 451 ggcaaaacca tcaaaaccga aaaactctcc acaccgtttt acgccaaaaa 501 ctaccttgga gcgcatacgt tttttacaga atga
```

This corresponds to the amino acid sequence <SEQ ID 3100; ORF 206.ng>:

```
g206.pep
   1 MFSPDKTLFL CLGALLLASC GTTSGKHRQP KPKQTVRQIQ AVRISHIGRT

51 QGSQELMLHS LGLIGTPYKW GGSSTATGFD CSGMIQLVYK NALNVKLPRT
```

```
101 ARDMAAASRK IPDSRLKAGD IVFFNTGGAH RYSHVGLYIG NGEFIHAPGS

151 GKTIKTEKLS TPFYAKNYLG AHTFFTE*
```

ORF 206 shows 96.0% identity over a 177 aa overlap with a predicted ORF (ORF 206.ng) from *N. gonorrhoeae*:

```
m206/g206
                    10         20         30         40         50         60
        m206.pep MFPPDKTLFLCLSALLLASCGTTSGKHRQPKPKQTVRQIQAVRISHIDRTQGSQELMLHS
                 || |||||||||:||||||||||||||||||||||||||||||||| |||||||||||
            g206 MFSPDKTLFLCLGALLLASCGTTSGKHRQPKPKQTVRQIQAVRISHIGRTQGSQELMLHS
                    10         20         30         40         50         60

70         80         90        100        110        120
        m206.pep LGLIGTPYKWGGSSTATGFDCSGMIQFVYKNALNVKLPRTARDMAAASRKIPDSRXKAGD
                 |||||||||||||||||||||||||||:||||||||||||||||||||||||||| ||||
            g206 LGLIGTPYKWGGSSTATGFDCSGMIQLVYKNALNVKLPRTARDMAAASRKIPDSRLKAGD
                    70         80         90        100        110        120

130        140        150        160        170
        m206.pep LVFFNTGGAHRYSHVGLYIGNGEFIHAPSSGKTIKTEKLSTPFYAKNYLGAHTFFTEX
                 :||||||||||||||||||||||||||||:||||||||||||||||||||||||||||
            g206 IVFFNTGGAHRYSHVGLYIGNGEFIHAPGSGKTIKTEKLSTPFYAKNYLGAHTFFTE
                   130        140        150        160        170
```

The following partial DNA sequence was identified in *N. meningitidis* <SEQ ID 3101>:

```
a206.seq
  1 ATGTTTCCCC CCGACAAAAC CCTTTTCCTC TGTCTCAGCG CACTGCTCCT

51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAA AACGCCCTCA ACGTCAAGCT GCCGCGCACC

301 GCCCGCGACA TGGCGGCGGC AAGCCGCAAA ATCCCCGACA GCCGCCTTAA

351 GGCCGGCGAC CTCGTATTCT TCAACACCGG CGGCGCACAC CGCTACTCAC

401 ACGTCGGACT CTATATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TCTTTACAGA ATGA
```

This corresponds to the amino acid sequence <SEQ ID 3102; ORF 206.a>:

```
a206.pep
  1 MFPPDKTLFL CLSALLLASC GTTSGKHRQP KPKQTVRQIQ AVRISHIDRT

51 QGSQELMLHS LGLIGTPYKW GGSSTATGFD CSGMIQFVYK NALNVKLPRT

101 ARDMAAASRK IPDSRLKAGD LVFFNTGGAH RYSHVGLYIG NGEFIHAPSS

151 GKTIKTEKLS TPFYAKNYLG AHTFFTE*
``` m206/a206 99.4% identity in 177 aa overlap

```
                    10         20         30         40         50         60
        m206.pep MFPPDKTLFLCLSALLLASCGTTSGKHRQPKPKQTVRQIQAVRISHIDRTQGSQELMLHS
                 ||||||||||||||||||||||||||||||||||||||||||||||||||||||||||||
            g206 MFPPDKTLFLCLSALLLASCGTTSGKHRQPKPKQTVRQIQAVRISHIDRTQGSQELMLHS
                    10         20         30         40         50         60
```

-continued

```
               70        80        90       100       110       120
m206.pep LGLIGTPYKWGGSSTATGFDCSGMIQFVYKNALNVKLPRTARDMAAASRKIPDSRXKAGD
         |||||||||||||||||||||||||||||||||||||||||||||||||||||||| ||||
g206     LGLIGTPYKWGGSSTATGFDCSGMIQFVYKNALNVKLPRTARDMAAASRKIPDSRLKAGD
               70        80        90       100       110       120

130       140       150       160       170
m206.pep LVFFNTGGAHRYSHVGLYIGNGEFIHAPSSGKTIKTEKLSTPFYAKNYLGAHTFFTEX
         ||||||||||||||||||||||||||||||||||||||||||||||||||||||||||
g206     LVFFNTGGAHRYSHVGLYIGNGEFIHAPSSGKTIKTEKLSTPFYAKNYLGAHTFFTEX
              130       140       150       160       170
```

287

The following partial DNA sequence was identified in *N. meningitidis* <SEQ ID 3103>:

```
m287.seq
   1 ATGTTTAAAC GCAGCGTAAT CGCAATGGCT TGTATTTTTG CCCTTTCAGC
  51 CTGCGGGGGC GGCGGTGGCG GATCGCCCGA TGTCAAGTCG GCGGACACGC
 101 TGTCAAAACC TGCCGCCCCT GTTGTTTCTG AAAAAGAGAC AGAGGCAAAG
 151 GAAGATGCGC CACAGGCAGG TTCTCAAGGA CAGGGCGCGC CATCCGCACA
 201 AGGCAGTCAA GATATGGCGG CGGTTTCGGA AGAAAATACA GGCAATGGCG
 251 GTGCGGTAAC AGCGGATAAT CCCAAAAATG AAGACGAGGT GGCACAAAAT
 301 GATATGCCGC AAAATGCCGC CGGTACAGAT AGTTCGACAC CGAATCACAC
 351 CCCGGATCCG AATATGCTTG CCGGAAATAT GGAAAATCAA GCAACGGATG
 401 CCGGGGAATC GTCTCAGCCG GCAAACCAAC CGGATATGGC AAATGCGGCG
 451 GACGGAATGC AGGGGGACGA TCCGTCGGCA GGCGGGCAAA ATGCCGGCAA
 501 TACGGCTGCC CAAGGTGCAA ATCAAGCCGG AAACAATCAA GCCGCCGGTT
 551 CTTCAGATCC CATCCCCGCG TCAAACCCTG CACCTGCGAA TGGCGGTAGC
 601 AATTTTGGAA GGGTTGATTT GGCTAATGGC GTTTTGATTG ACGGGCCGTC
 651 GCAAAATATA ACGTTGACCC ACTGTAAAGG CGATTCTTGT AGTGGCAATA
 701 ATTTCTTGGA TGAAGAAGTA CAGCTAAAAT CAGAATTTGA AAAATTAAGT
 751 GATGCAGACA AAATAAGTAA TTACAAGAAA GATGGGAAGA ATGATAAATT
 801 TGTCGGTTTG GTTGCCGATA GTGTGCAGAT GAAGGGAATC AATCAATATA
 851 TTATCTTTTA TAAACCTAAA CCCACTTCAT TTGCGCGATT TAGGCGTTCT
 901 GCACGGTCGA GGCGGTCGCT TCCGGCCGAG ATGCCGCTGA TTCCCGTCAA
 951 TCAGGCGGAT ACGCTGATTG TCGATGGGGA AGCGGTCAGC CTGACGGGGC
1001 ATTCCGGCAA TATCTTCGCG CCCGAAGGGA ATTACCGGTA TCTGACTTAC
1051 GGGGCGGAAA AATTGCCCGG CGGATCGTAT GCCCTTCGTG TTCAAGGCGA
1101 ACCGGCAAAA GGCGAAATGC TTGCGGGCGC GGCCGTGTAC AACGGCGAAG
1151 TACTGCATTT CCATACGGAA AACGGCCGTC CGTACCCGAC CAGGGGCAGG
1201 TTTGCCGCAA AAGTCGATTT CGGCAGCAAA TCTGTGGACG GCATTATCGA
1251 CAGCGGCGAT GATTTGCATA TGGGTACGCA AAAATTCAAA GCCGCCATCG
1301 ATGGAAACGG CTTTAAGGGG ACTTGGACGG AAAATGGCAG CGGGGATGTT
1351 TCCGGAAAGT TTTACGGCCC GGCCGGCGAG GAAGTGGCGG GAAAATACAG
1401 CTATCGCCCG ACAGATGCGG AAAAGGGCGG ATTCGGCGTG TTTGCCGGCA
1451 AAAAAGAGCA GGATTGA
```

This corresponds to the amino acid sequence <SEQ ID 3104; ORF 287>:

```
m287.pep
  1 MFKRSVIAMA CIFALSACGG GGGGSPDVKS ADTLSKPAAP VVSEKETEAK

51 EDAPQAGSQG QGAPSAQGSQ DMAAVSEENT GNGGAVTADN PKNEDEVAQN

101 DMPQNAAGTD SSTPNHTPDP NMLAGNMENQ ATDAGESSQP ANQPDMANAA

151 DGMQGDDPSA GGQNAGNTAA QGANQAGNNQ AAGSSDPIPA SNPAPANGGS

201 NFGRVDLANG VLIDGPSQNI TLTHCKGDSC SGNNFLDEEV QLKSEFEKLS

251 DADKISNYKK DGKNDKFVGL VADSVQMKGI NQYIIFYKPK PTSFARFRRS

301 ARSRRSLPAE MPLIPVNQAD TLIVDGEAVS LTGHSGNIFA PEGNYRYLTY

351 GAEKLPGGSY ALRVQGEPAK GEMLAGAAVY NGEVLHFHTE NGRPYPTRGR

401 FAAKVDFGSK SVDGIIDSGD DLHMGTQKFK AAIDGNGFKG TWTENGSGDV

451 SGKFYGPAGE EVAGKYSYRP TDAEKGGFGV FAGKKEQD*
```

The following partial DNA sequence was identified in *N. gonorrhoeae* <SEQ ID 3105>:

```
g287.seq
    1 atgtttaaac gcagtgtgat tgcaatggct tgtattttc ccctttcagc 51 ctgtggggc ggcggtggcg gatcgcccga tgtcaagtcg gcggacacgc 101 cgtcaaaacc ggccgccccc gttgttgctg aaaatgccgg ggaagggtg 151 ctgccgaaag aaaagaaaga tgaggaggca gcgggcggtg cgccgcaagc 201 cgatacgcag gacgcaaccg ccggagaagg cagccaagat atggcggcag 251 tttcggcaga aaatacaggc aatggcggtg cggcaacaac ggacaacccc 301 aaaaatgaag acgcgggggc gcaaaatgat atgccgcaaa atgccgccga 351 atccgcaaat caaacaggga acaaccaacc cgccggttct tcagattccg 401 cccccgcgtc aaaccctgcc cctgcgaatg gcggtagcga ttttggaagg 451 acgaacgtgg gcaattctgt tgtgattgac ggaccgtcgc aaaatataac 501 gttgacccac tgtaaaggcg attcttgtaa tggtgataat ttattggatg 551 aagaagcacc gtcaaaatca gaatttgaaa aattaagtga tgaagaaaaa 601 attaagcgat ataaaaaaga cgagcaacgg gagaattttg tcggtttggt 651 tgctgacagg gtaaaaaagg atggaactaa caaatatatc atcttctata 701 cggacaaacc acctactcgt tctgcacggt cgaggaggtc gcttccggcc 751 gagattccgc tgattcccgt caatcaggcc gatacgctga ttgtggatgg 801 ggaagcggtc agcctgacgg ggcattccgg caatatcttc gcgcccgaag 851 ggaattaccg gtatctgact tacggggcgg aaaaattgcc cggcggatcg 901 tatgccctcc gtgtgcaagg cgaaccggca aaaggcgaaa tgcttgttgg 951 cacggccgtg tacaacggcg aagtgctgca tttccatatg gaaaacggcc 1001 gtccgtaccc gtccggaggc aggtttgccg caaagtcga tttcggcagc 1051 aaatctgtgg acggcattat cgacagcggc gatgatttgc atatgggtac 1101 gcaaaaattc aaagccgcca tcgatggaaa cggctttaag gggacttgga 1151 cggaaaatgg cggcggggat gtttccggaa ggttttacgg cccggccggc
```

-continued
1201 gaggaagtgg cgggaaaata cagctatcgc ccgacagatg ctgaaaaggg 1251 cggattcggc gtgtttgccg gcaaaaaaga tcgggattga This corresponds to the amino acid sequence <SEQ ID 3106; ORF 287.ng>:

```
g287.pep.
  1 MFKRSVIAMA CIFPLSACGG GGGGSPDVKS ADTPSKPAAP VVAENAGEGV

51 LPKEKKDEEA AGGAPQADTQ DATAGEGSQD MAAVSAENTG NGGAATTDNP

101 KNEDAGAQND MPQNAAESAN QTGNNQPAGS SDSAPASNPA PANGGSDFGR

151 TNVGNSVVID GPSQNITLTH CKGDSCNGDN LLDEEAPSKS EFEKLSDEEK

201 IKRYKKDEQR ENFVGLVADR VKKDGTNKYI IFYTDKPPTR SARSRRSLPA

251 EIPLIPVNQA DTLIVDGEAV SLTGHSGNIF APEGNYRYLT YGAEKLPGGS

301 YALRVQGEPA KGEMLVGTAV YNGEVLHFHM ENGRPYPSGG RFAAKVDFGS

351 KSVDGIIDSG DDLHMGTQKF KAAIDGNGFK GTWTENGGGD VSGRFYGPAG

401 EEVAGKYSYR PTDAEKGGFG VFAGKKDRD*
``` m287/g287 70.1% identity in 499 aa overlap

```
                10        20        30        40         49
m287.pep  MFKRSVIAMACIFALSACGGGGGSPDVKSADTLSKPAAPVVSE----------KETEA
          ||||||||||| ||||||||||||||||||||| ||||||:|          |: ||
g287      MFKRSVIAMACIFPLSACGGGGGGSPDVKSADTPSKPAAPVVAENAGEGVLPKEKKDEEA
                10        20        30        40        50        60

50        60        70        80        90       100       109
m287.pep  KEDAPQAGSQGQGAPSAQGSQDMAAVSEENTGNGGAVTADNPKNEDEVAQNDMPQNAAGT
           ||||  :|     |  :::|||||||||  ||||||||:|:||||||| ||||||||
g287      AGGAPQADTQD--ATAGEGSQDMAAVSAENTGNGGAATTDNPKNEDAGAQNDMPQNAA--
            70        80        90       100       110

110       120       130       140       150       160       169
m287.pep  DSSTPNHTPDPNMLAGNMENQATDAGESSQPANQPDMANAADGMQGDDPSAGGQNAGNTA g287      ------------------------------------------------------------

170       180       190       200       210       220       229
m287.pep  AQGANQAGNNQAAGSSDPIPASNPAPANGGSNFGRVDLANGVLIDGPSQNITLTHCKGDS
          ::|||:||||  |||||  ||||||||||||:|||::::|:|:||||||||||||||||
g287      -ESANQTGNNQPAGSSDSAPASNPAPANGGSDFGRTNVGNSVVIDGPSQNITLTHCKGDS
           120       130       140       150       160       170

230       240       250       260       270       280       289
m287.pep  CSGNNFLDEEVQLKSEFEKLSDADKISNYKKDGKNDKFVGLVADSVQMKGINQYIIFYKP
          |:|:|:|||:  |||||||||| :||: |||  :  ::||||||  |: |  | |:||||
g287      CNGDNLLDEEAPSKSEFEKLSDEEKIKRYKKDEQRENFVGLVADRVKKDGTNKYIIFYTD
           180       190       200              220       230

290       300       310       320       330       340       349
m287.pep  KPTSFARFRRSARSRRSLPAEMPLIPVNQADTLIVDGEAVSLTGHSGNIFAPEGNYRYLT
          || :      |||||||||||:|:||||||||||||||||||||||||||||||||||||
g287      KPPT-----RSARSRRSLPAEIPLIPVNQADTLIVDGEAVSLTGHSGNIFAPEGNYRYLT
                 240       250       260       270       280       290

350       360       370       380       390       400       409
m287.pep  YGAEKLPGGSYALRVQGEPAKGEMLAGAAVYNGEVLHFHTENGRPYPTRGRFAAKVDFGS
          |||||||||||||||||||||||||:|:||||||||||| |||||||: ||||||||||
g287      YGAEKLPGGSYALRVQGEPAKGEMLVGTAVYNGEVLHFHMENGRPYPSGGRFAAKVDFGS
                 300       310       320       330       340       350

410       420       430       440       450       460       469
m287.pep  KSVDGIIDSGDDLHMGTQKFKAAIDGNGFKGTWTENGSGDVSGKFYGPAGEEVAGKYSYR
          |||||||||||||||||||||||||||||||||||||:||||:||||||||||||||||
g287      KSVDGIIDSGDDLHMGTQKFKAAIDGNGFKGTWTENGGGDVSGRFYGPAGEEVAGKYSYR
                 360       370       380       390       400       410

470       480       489
m287.pep  PTDAEKGGFGVFAGKKEQDX
          ||||||||||||||||::||
g287      PTDAEKGGFGVFAGKKDRDX
                 420       430
```

The following partial DNA sequence was identified in *N. meningitidis* <SEQ ID 3107>:

```
a287.seq
   1 ATGTTTAAAC GCAGTGTGAT TGCAATGGCT TGTATTGTTG CCCTTTCAGC
  51 CTGTGGGGGC GGCGGTGGCG GATCGCCCGA TGTTAAGTCG GCGGACACGC
 101 TGTCAAAACC TGCCGCCCCT GTTGTTACTG AAGATGTCGG GGAAGAGGTG
 151 CTGCCGAAAG AAAAGAAAGA TGAGGAGGCG GTGAGTGGTG CGCCGCAAGC
 201 CGATACGCAG GACGCAACCG CCGGAAAAGG CGGTCAAGAT ATGGCGGCAG
 251 TTTCGGCAGA AAATACAGGC AATGGCGGTG CGGCAACAAC GGATAATCCC
 301 GAAAATAAAG ACGAGGGACC GCAAAATGAT ATGCCGCAAA ATGCCGCCGA
 351 TACAGATAGT TCGACACCGA ATCACACCCC TGCACCGAAT ATGCCAACCA
 401 GAGATATGGG AAACCAAGCA CCGGATGCCG GGGAATCGGC ACAACCGGCA
 451 AACCAACCGG ATATGGCAAA TGCGGCGGAC GGAATGCAGG GGGACGATCC
 501 GTCGGCAGGG GAAAATGCCG GCAATACGGC AGATCAAGCT GCAAATCAAG
 551 CTGAAAACAA TCAAGTCGGC GGCTCTCAAA ATCCTGCCTC TTCAACCAAT
 601 CCTAACGCCA CGAATGGCGG CAGCGATTTT GGAAGGATAA ATGTAGCTAA
 651 TGGCATCAAG CTTGACAGCG GTTCGGAAAA TGTAACGTTG ACACATTGTA
 701 AAGACAAAGT ATGCGATAGA GATTTCTTAG ATGAAGAAGC ACCACCAAAA
 751 TCAGAATTTG AAAAATTAAG TGATGAAGAA AAAATTAATA AATATAAAAA
 801 AGACGAGCAA CGAGAGAATT TTGTCGGTTT GGTTGCTGAC AGGGTAGAAA
 851 AGAATGGAAC TAACAAATAT GTCATCATTT ATAAAGACAA GTCCGCTTCA
 901 TCTTCATCTG CGCGATTCAG GCGTTCTGCA CGGTCGAGGC GGTCGCTTCC
 951 GGCCGAGATG CCGCTGATTC CCGTCAATCA GGCGGATACG CTGATTGTCG
1001 ATGGGGAAGC GGTCAGCCTG ACGGGGCATT CCGGCAATAT CTTCGCGCCC
1051 GAAGGGAATT ACCGGTATCT GACTTACGGG GCGGAAAAAT TGTCCGGCGG
1101 ATCGTATGCC CTCAGTGTGC AAGGCGAACC GGCAAAAGGC GAAATGCTTG
1151 CGGGCACGGC CGTGTACAAC GGCGAAGTGC TGCATTTCCA TATGGAAAAC
1201 GGCCGTCCGT CCCCGTCCGG AGGCAGGTTT GCCGCAAAAG TCGATTTCGG
1251 CAGCAAATCT GTGGACGGCA TTATCGACAG CGGCGATGAT TTGCATATGG
1301 GTACGCAAAA ATTCAAAGCC GTTATCGATG GAAACGGCTT TAAGGGGACT
1351 TGGACGGAAA ATGGCGGCGG GGATGTTTCC GGAAGGTTTT ACGGCCCGGC
1401 CGGCGAAGAA GTGGCGGGAA AATACAGCTA TCGCCCGACA GATGCGGAAA
1451 AGGGCGGATT CGGCGTGTTT GCCGGCAAAA AAGAGCAGGA TTGA
```

This corresponds to the amino acid sequence <SEQ ID 3108; ORF 287.a>:

```
a287.pep
  1 MFKRSVIAMA CIVALSACGG GGGGSPDVKS ADTLSKPAPP VVTEDVGEEV
 51 LPKEKKDEEA VSGAPQADTQ DATAGKGGQD MAAVSAENTG NGGAATTDNP
101 ENKDEGPQND MPQNAADTDS STPNHTPAPN MPTRDMGNQA PDAGESAQPA
151 NQPDMANAAD GMQGDDPSAG ENAGNTADQA ANQAENNQVG GSQNPASSTN
201 PNATNGGSDF GRINVANGIK LDSGSENVTL THCKDKVCDR DFLDEEAPPK
```

-continued

```
251  SEFEKLSDEE KINKYKKDEQ RENFVGLVAD RVEKNGTNKY VIIYKDKSAS

301  SSSARFRRSA RSRRSLPAEM PLIPVNQADT LIVDGEAVSL TGHSGNIFAP

351  EGNYRYLTYG AEKLSGGSYA LSVQGEPAKG EMLAGTAVYN GEVLHFHMEN

401  GRPSPSGGRF AAKVDFGSKS VDGIIDSGDD LHMGTQKFKA VIDGNGFKGT

451  WTENGGGDVS GRFYGPAGEE VAGKYSYRPT DAEKGGFGVF AGKKEQD*
```

```
m287/a287   77.2% identity in 501 aa overlap 10        20        30        40                  49
m287.pep    MFKRSVIAMACIFALSACGGGGGGSPDVKSADTLSKPAAPVVSE----------KETEA
            |||||||||||| |||||||||||||||||||||||||:|          |: ||
a287        MFKRSVIAMACIVALSACGGGGGGSPDVKSADTLSKPAPPVVTEDVGEEVLPKEKKDEEA
                    10        20        30        40        50        60

50        60        70        80        90       100      109
m287.pep    KEDAPQAGSQGQGAPSAQGSQDMAAVSEENTGNGGAVTADNPKNEDEVAQNDMPQNAAGT
              |||| :|    | :::|:|||||||| ||||||||:|:|||:|:||  ||||||||| |
a287        VSGAPQADTQ--DATAGKGGQDMAAVSAENTGNGGAATTDNPENKDEGPQNDMPQNAADT
                  70        80        90       100       110

110       120       130       140       150       160      169
m287.pep    DSSTPNHTPDPNMLAGNMENQATDAGESSQPANQPDMANAADGMQGDDPSAGGQNAGNTA
            |||||||| ||| : :| ||| |||||:|||||||||||||||||||||||| :||||||
a287        DSSTPNHTPAPNMPTRDMGNQAPDAGESAQPANQPDMANAADGMQGDDPSAG-ENAGNTA
             120       130       140       150       160       170

170       180       190       200       210       220      229
m287.pep    AQGANQAGNNQAAGSSDPIPASNPAPANGGSNFGRVDLANGVLIDGPSQNITLTHCKGDS
              |:|||| |||::||::|  ::||  :||||:|||:::|||: :|: |:|:|||||||
a287        DQAANQAENNQVGGSQNPASSTNPNATNGGSDFGRINVANGIKLDSGSENVTLTHCKDKV
             180       190       200       210       220       230

230       240       250       260       270       280      289
m287.pep    CSGNNFLDEEVQLKSEFEKLSDADKISNYKKDGKNDKFVGLVADSVQMKGINQYIIFYKP
            |:  :|||||:  |||||||| :||::|||| : ::|||||| |: :| |:|:|:||
a287        CD-RDFLDEEAPPKSEFEKLSDEEKINKYKKDEQRENFVGLVADRVEKNGTNKYVIIYKD
               240       250       260       270       280       290

290       300       310       320       330       340      349
m287.pep    KP--TSFARFRRSARSRRSLPAEMPLIPVNQADTLIVDGEAVSLTGHSGNIFAPEGNYRY
            |    :| |||||||||||||||||||||||||||||||||||||||||||||||||||||
a287        KSASSSSARFRRSARSRRSLPAEMPLIPVNQADTLIVDGEAVSLTGHSGNIFAPEGNYRY
             300       310       320       330       340       350

350       360       370       380       390       400
m287.pep    LTYGAEKLPGGSYALRVQGEPAKGEMLAGAAVYNGEVLHFHTENGRPYPTRGRFAAKVDF
            |||||||| |||||| |||||||||||||:||||||||||| ||||| |: |||||||||
a287        LTYGAEKLSGGSYALSVQGEPAKGEMLAGTAVYNGEVLHFHMENGRPSPSGGRFAAKVDF
             360       370       380       390       400       410

410       420       430       440       450       460
m287.pep    GSKSVDGIIDSGDDLHMGTQKFKAAIDGNGFKGTWTENGSGDVSGKFYGPAGEEVAGKYS
            ||||||||||||||||||||||||:|||||||||||||||:||||||:||||||||||||||
a287        GSKSVDGIIDSGDDLHMGTQKFKAVIDGNGFKGTWTENGGGDVSGRFYGPAGEEVAGKYS
             420       430       440       450       460       470

470       480       489
m287.pep    YRPTDAEKGGFGVFAGKKEQDX
            ||||||||||||||||||||||
a287        YRPTDAEKGGFGVFAGKKEQDX
             480       490
```

406

The following partial DNA sequence was identified in *N. meningitidis* <SEQ ID 3109>:

```
m406.seq
  1 ATGCAAGCAC GGCTGCTGAT ACCTATTCTT TTTTCAGTTT TTATTTTATC

51 CGCCTGCGGG ACACTGACAG GTATTCCATC GCATGGCGGA GGTAAACGCT

101 TTGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 CACTATGGGC GACCAAGGTT CAGGCAGTTT GACAGGGGGT CGCTACTCCA
```

-continued

```
251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CTCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCAA AAACCAATGC GTTTGAAGCT

751 GCCTATAAAG AAAATTACGC ATTGTGGATG GGGCCGTATA AGTAAGCAA

801 AGGAATTAAA CCGACGGAAG GATTAATGGT CGATTTCTCC GATATCCGAC

851 CATACGGCAA TCATACGGGT AACTCCGCCC CATCCGTAGA GGCTGATAAC

901 AGTCATGAGG GGTATGGATA CAGCGATGAA GTAGTGCGAC AACATAGACA

951 AGGACAACCT TGA
```

This corresponds to the amino acid sequence <SEQ ID 3110; ORF 406>:

```
m406.pep
  1 MQARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSKSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIRPYGNHTG NSAPSVEADN

301 SHEGYGYSDE VVRQHRQGQP *
```

The following partial DNA sequence was identified in *N. gonorrhoeae* <SEQ ID 3111>:

```
g406.seq
  1 ATGCGGGCAC GGCTGCTGAT ACCTATTCTT TTTTCAGTTT TTATTTTATC

51 CGCCTGCGGG ACACTGACAG GTATTCCATC GCATGGCGGA GGCAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA

251 TTGATGCACT GATTCGCGGC GAATACATAA ACAGCCCTGC CGTCCGCACC

301 GATTACACCT ATCCGCGTTA CGAAACCACC GCTGAAACAA CATCAGGCGG

351 TTTGACGGGT TTAACCACTT CTTTATCTAC ACTTAATGCC CCTGCACTCT

401 CGCGCACCCA ATCAGACGGT AGCGGAAGTA GGAGCAGTCT GGGCTTAAAT

451 ATTGGCGGGA TGGGGGATTA TCGAAATGAA ACCTTGACGA CCAACCCGCG

501 CGACACTGCC TTTCTTTCCC ACTTGGTGCA GACCGTATTT TTCCTGCGCG

551 GCATAGACGT TGTTTCTCCT GCCAATGCCG ATACAGATGT GTTTATTAAC
```

-continued

```
601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCCA AAACCAATGC GTTTGAAGCT

751 GCCTATAAAG AAAATTACGC ATTGTGGATG GGGCCGTATA AAGTAAGCAA

801 AGGAATCAAA CCGACGGAAG GATTGATGGT CGATTTCTCC CGATATCCAA

851 CATACGGCAA TCATACGGGT AACTCCGCCC ATCCGTAGA GGCTGATAAC

901 AGTCATGAGG GGTATGGATA CAGCGATGAA GCAGTGCGAC AACATAGACA

951 AGGGCAACCT TGA
```

This corresponds to the amino acid sequence <SEQ ID 3112; ORF 406>:

```
g406.pep
  1 MRARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSRSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIQPYGNHTG NSAPSVEADN

301 SHEGYGYSDE AVRQHRQGQP *
```

ORF 406 shows 98.8% identity over a 320 aa overlap with a predicted ORF (ORF406.a) from *N. gonorrhoeae*:

```
g406/m406
                   10         20         30         40         50         60
       g406.pep   MRARLLIPILFSVFILSACGTLTGIPSHGGGKRFAVEQELVAASARAAVKDMDLQALHGR
                  |:||||||||||||||||||||||||||||||||||||||||||||||||||||||||||
           m406   MQARLLIPILFSVFILSACGTLTGIPSHGGGKRFAVEQELVAASARAAVKDMDLQALHGR
                   10         20         30         40         50         60

70         80         90        100        110        120
       g406.pep   KVALYIATMGDQGSGSLTGGRYSIDALIRGEYINSPAVRTDYTYPRYETTAETTSGGLTG
                  ||||||||||||||||||||||||||||||||||||||||||||||||||||||||||||
           m406   KVALYIATMGDQGSGSLTGGRYSIDALIRGEYINSPAVRTDYTYPRYETTAETTSGGLTG
                   70         80         90        100        110        120

130        140        150        160        170        180
       g406.pep   LTTSLSTLNAPALSRTQSDGSGSRSSLGLNIGGMGDYRNETLTTNPRDTAFLSHLVQTVF
                  |||||||||||||||||||||||:||||||||||||||||||||||||||||||||||||
           m406   LTTSLSTLNAPALSRTQSDGSGSKSSLGLNIGGMGDYRNETLTTNPRDTAFLSHLVQTVF
                  130        140        150        160        170        180

190        200        210        220        230        240
       g406.pep   FLRGIDVVSPANADTDVFINIDVFGTIRNRTEMHLYNAETLKAQTKLEYFAVDRTNKKLL
                  ||||||||||||||||||||||||||||||||||||||||||||||||||||||||||||
           m406   FLRGIDVVSPANADTDVFINIDVFGTIRNRTEMHLYNAETLKAQTKLEYFAVDRTNKKLL
                  190        200        210        220        230        240

250        260        270        280        290        300
       g406.pep   IKPKTNAFEAAYKENYALWMGPYKVSKGIKPTEGLMVDFSDIQPYGNHTGNSAPSVEADN
                  ||||||||||||||||||||||||||||||||||||||||:|||||||||||||||||||
           m406   IKPKTNAFEAAYKENYALWMGPYKVSKGIKPTEGLMVDFSDIRPYGNHTGNSAPSVEADN
                  250        260        270        280        290        300

310        320
       g406.pep   SHEGYGYSDEAVRQHRQGQPX
                  ||||||||||:||||||||||
           m406   SHEGYGYSDEVVRQHRQGQPX
                  310        320
```

The following partial DNA sequence was identified in *N. meningitidis* <SEQ ID 3113>:

```
a406.seq.
   1 ATGCAAGCAC GGCTGCTGAT ACCTATTCTT TTTTCAGTTT TTATTTTATC

51 CGCCTGCGGG ACACTGACAG GTATTCCATC GCATGGCGGA GGTAAACGCT

101 TCGCGGTCGA ACAAGAACTT GTGGCCGCTT CTGCCAGAGC TGCCGT

```
                    130       140       150       160       170       180
m406.pep    LTTSLSTLNAPALSRTQSDGSGSKSSLGLNIGGMGDYRNETLTTNPRDTAFLSHLVQTVF
            ||||||||||||||||||:|||||||||||||||||||||||||||||||||||||||
a406        LTTSLSTLNAPALSRTQSDGSGSKSSLGLNIGGMGDYRNETLTTNPRDTAFLSHLVQTVF
                    130       140       150       160       170       180

190       200       210       220       230       240
m406.pep    FLRGIDVVSPANADTDVFINIDVFGTIRNRTEMHLYNAETLKAQTKLEYFAVDRTNKKLL
            ||||||||||||||||||||||||||||||||||||||||||||||||||||||||||||
a406        FLRGIDVVSPANADTDVFINIDVFGTIRNRTEMHLYNAETLKAQTKLEYFAVDRTNKKLL
                    190       200       210       220       230       240

250       260       270       280       290       300
m406.pep    IKPKTNAFEAAYKENYALWMGPYKVSKGIKPTEGLMVDFSDIRPYGNHTGNSAPSVEADN
            |||||||||||||||||||||||||||||||||||||||||||:||||| ||||||||||
a406        IKPKTNAFEAAYKENYALWMGPYKVSKGIKPTEGLMVDFSDIQPYGNHMGNSAPSVEADN
                    250       260       270       280       290       300

310       320
m406.pep    SHEGYGYSDEVVRQHRQGQPX
            |||||||||:||:|||||||
a406        SHEGYGYSDEAVRRHRQGQPX
                    310       320
```

Example 2

Expression of ORF 919

Figure 10:
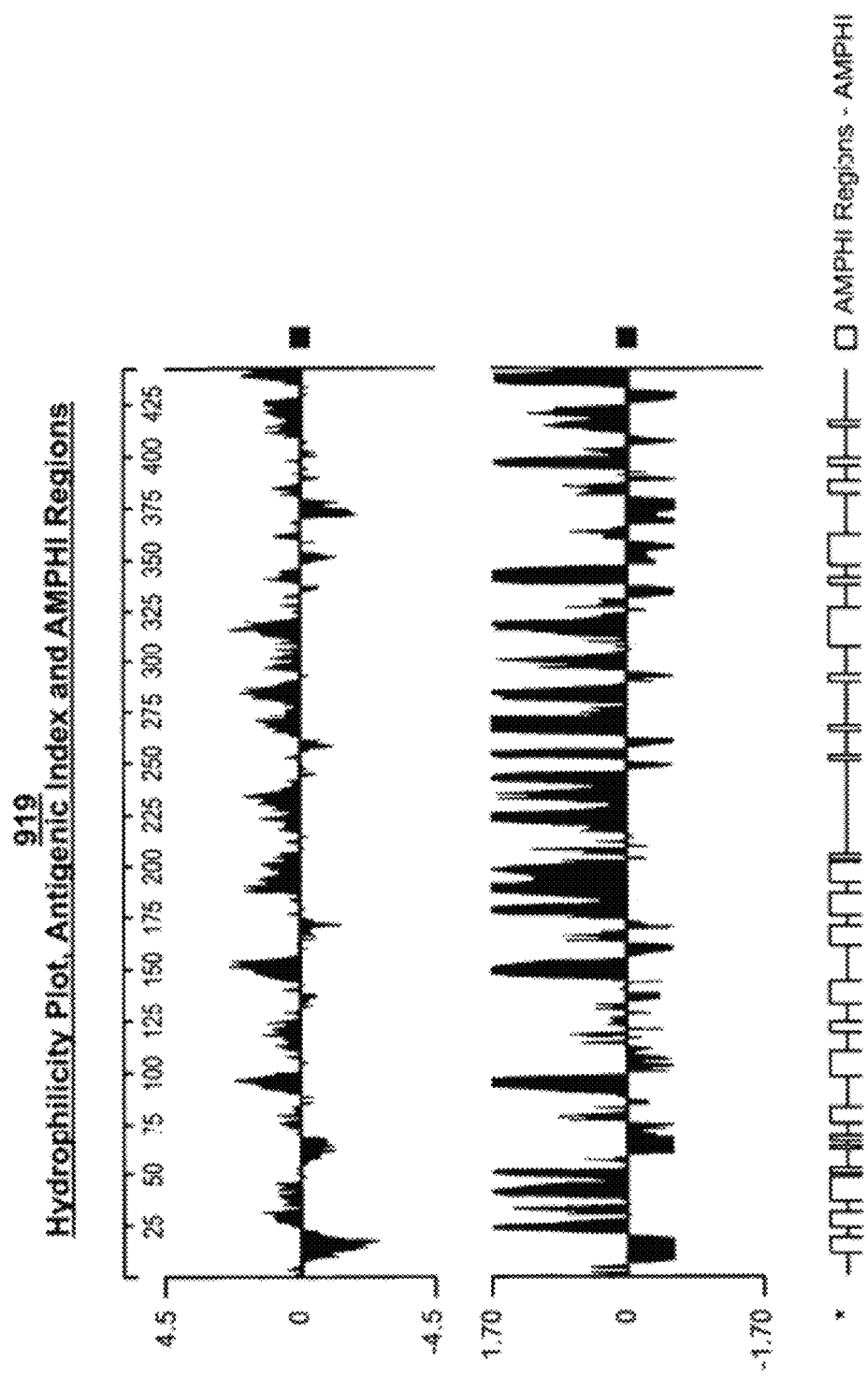

The primer described in Table 1 for ORF 919 was used to locate and clone ORF 919. The predicted gene 919 was cloned in pET vector and expressed in *E. coli*. The product of protein expression and purification was analyzed by SDS-PAGE. In panel A) is shown the analysis of 919-His fusion protein purification. Mice were immunized with the purified 919-His and sera were used for Western blot (panel B), FACS analysis (panel C), bactericidal assay (panel D), and ELISA assay (panel E). Symbols: M1, molecular weight marker; PP, purified protein, TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 919 is a surface-exposed protein and that it is a useful immunogen. The hydrophilicity plots, antigenic index, and amphipatic regions of ORF 919 are provided in FIG. 10. The AMPHI program is used to predict putative T-cell epitopes (Gao et al 1989, *J. Immunol.* 143:3007; Roberts et al. 1996, *AIDS Res Human Retroviruses* 12:593; Quakyi et al. 1992, *Scand J Immunol Suppl* 11:9). The nucleic acid sequence of ORF 919 and the amino acid sequence encoded thereby is provided in Example 1.

Example 3

Expression of ORF 279

Figure 11:
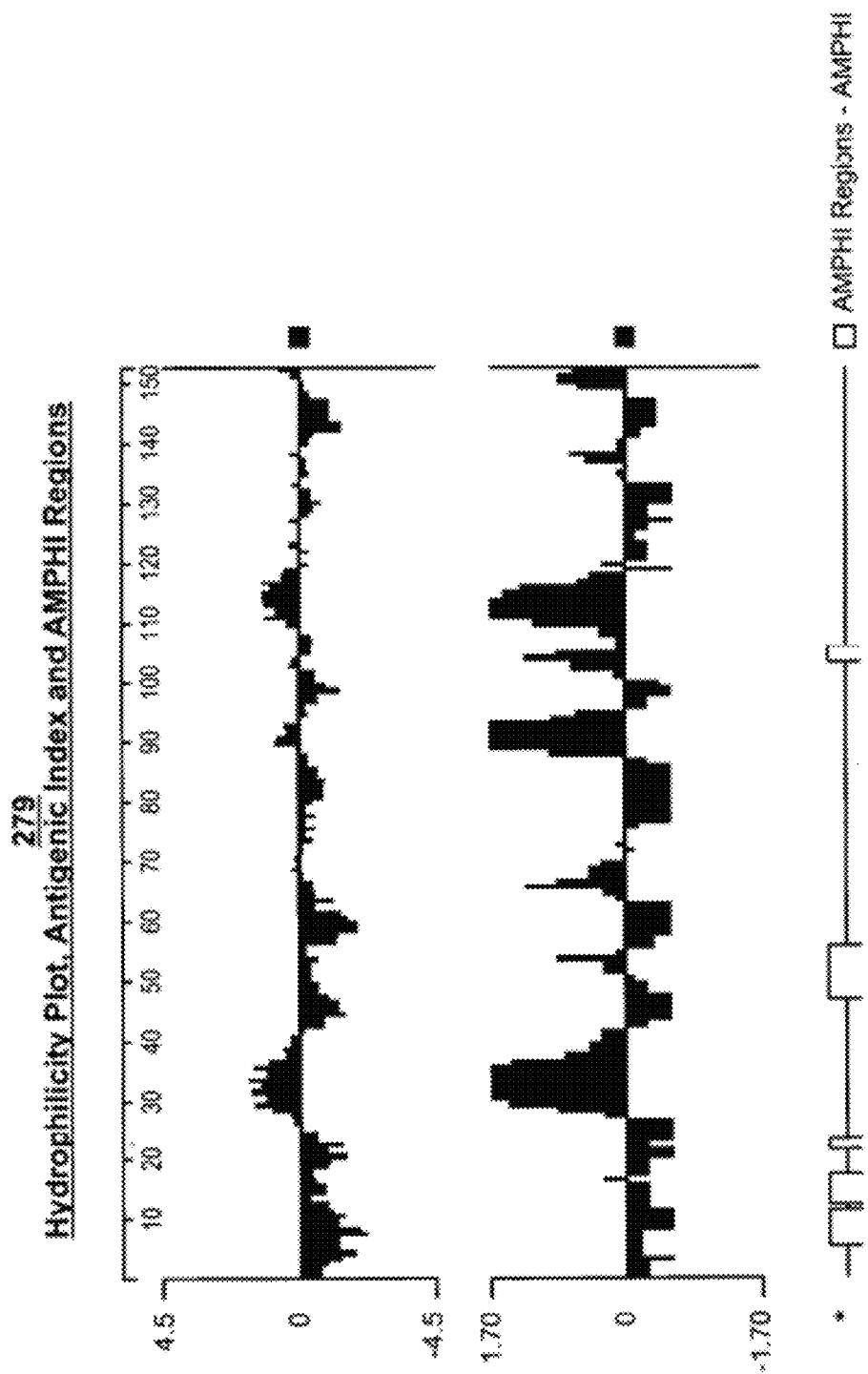

The primer described in Table 1 for ORF 279 was used to locate and clone ORF 279. The predicted gene 279 was cloned in pGex vector and expressed in *E. coli*. The product of protein expression and purification was analyzed by SDS-PAGE. In panel A) is shown the analysis of 279-GST purification. Mice were immunized with the purified 279-GST and sera were used for Western blot analysis (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 279 is a surface-exposed protein and that it is a useful immunogen. The hydrophilicity plots, antigenic index, and amphipatic regions of ORF 279 are provided in FIG. 11. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 279 and the amino acid sequence encoded thereby is provided in Example 1.

Example 4

Expression of ORF 576 and 576-1

Figure 12:
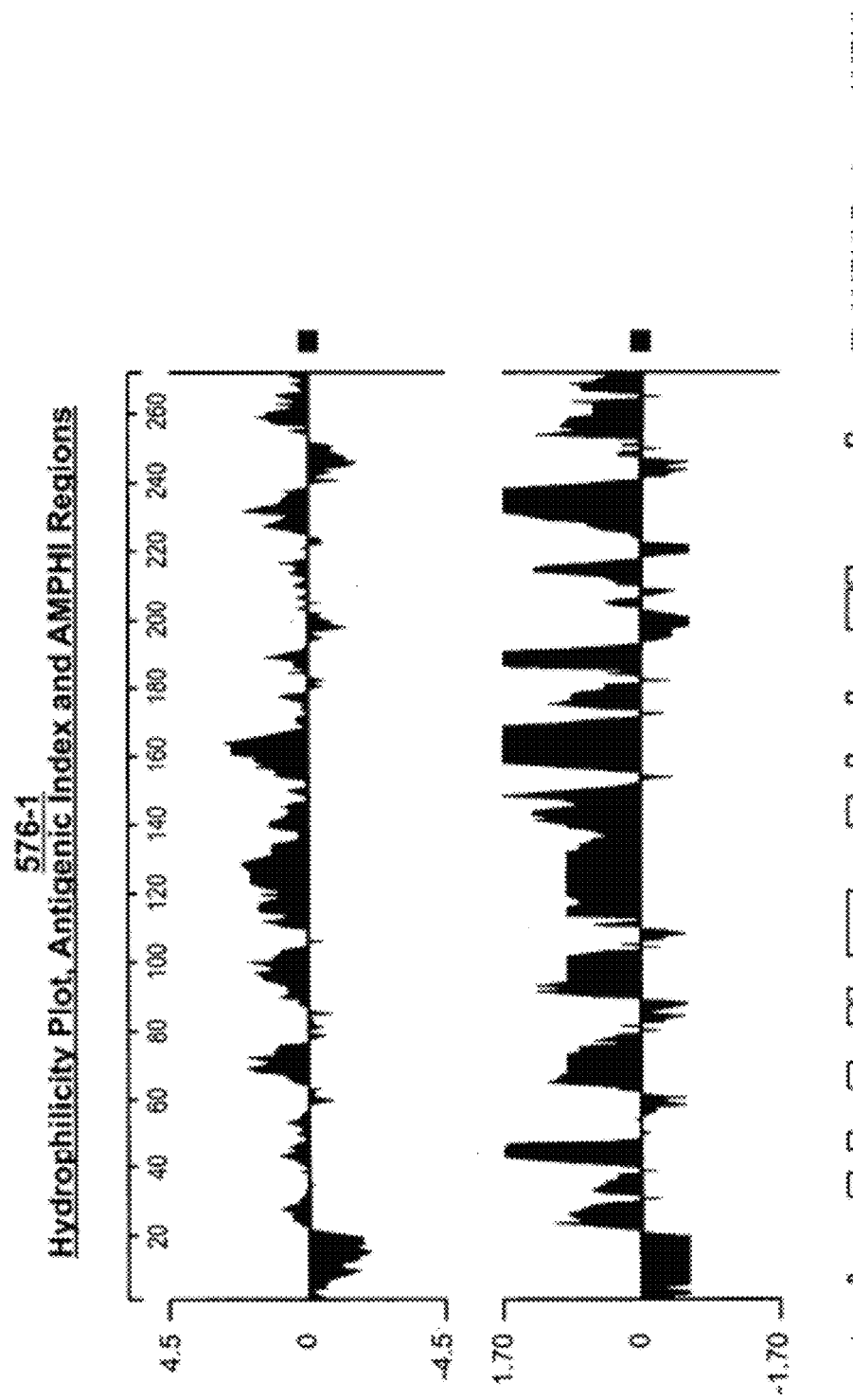

The primer described in Table 1 for ORF 576 was used to locate and clone ORF 576. The predicted gene 576 was cloned in pGex vector and expressed in *E. coli*. The product of protein purification was analyzed by SDS-PAGE. In panel A) is shown the analysis of 576-GST fusion protein purification. Mice were immunized with the purified 576-GST and sera were used for Western blot (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that ORF 576 is a surface-exposed protein and that it is a useful immunogen. The hydrophilicity plots, antigenic index, and amphipatic regions of ORF 576 are provided in FIG. 12. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 576 and the amino acid sequence encoded thereby is provided in Example 1.

Example 5

Expression of ORF 519 and 519-1

The primer described in Table 1 for ORF 519 was used to locate and clone ORF 519. The predicted gene 519 was cloned in pET vector and expressed in *E. coli*. The product of protein purification was analyzed by SDS-PAGE. In panel A) is shown the analysis of 519-His fusion protein purification.

Figure 13:
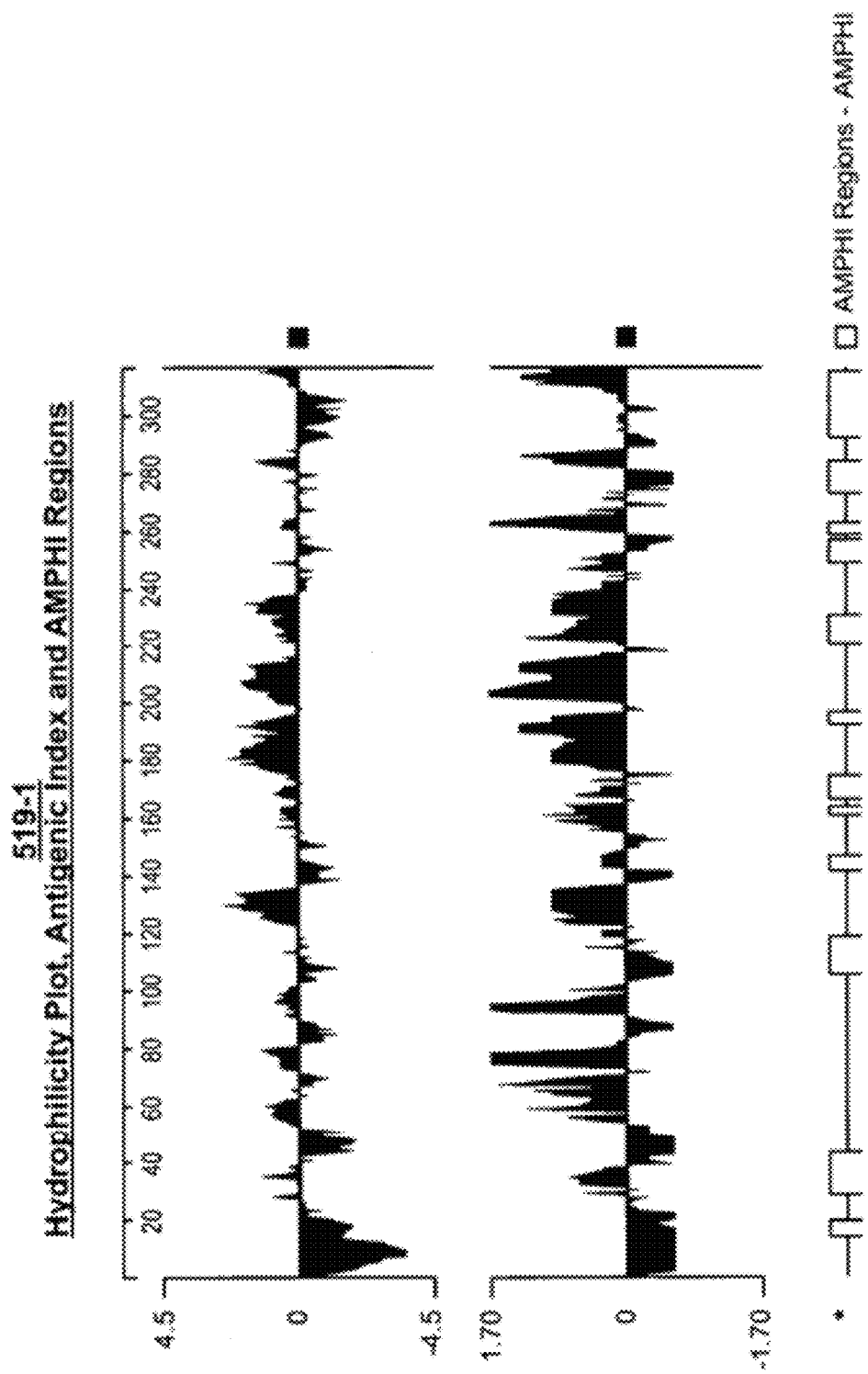

Mice were immunized with the purified 519-His and sera were used for Western blot (panel B), FACS analysis (panel C), bactericidal assay (panel D), and ELISA assay (panel E). Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 519 is a surface-exposed protein and that it is a useful immunogen. The hydrophilicity plots, antigenic index, and amphipatic regions of ORF 519 are provided in FIG. 13. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand Immunol Suppl* 11:9). The nucleic acid sequence of ORF 519 and the amino acid sequence encoded thereby is provided in Example 1.

Example 6

Expression of ORF 121 and 121-1

Figure 14:
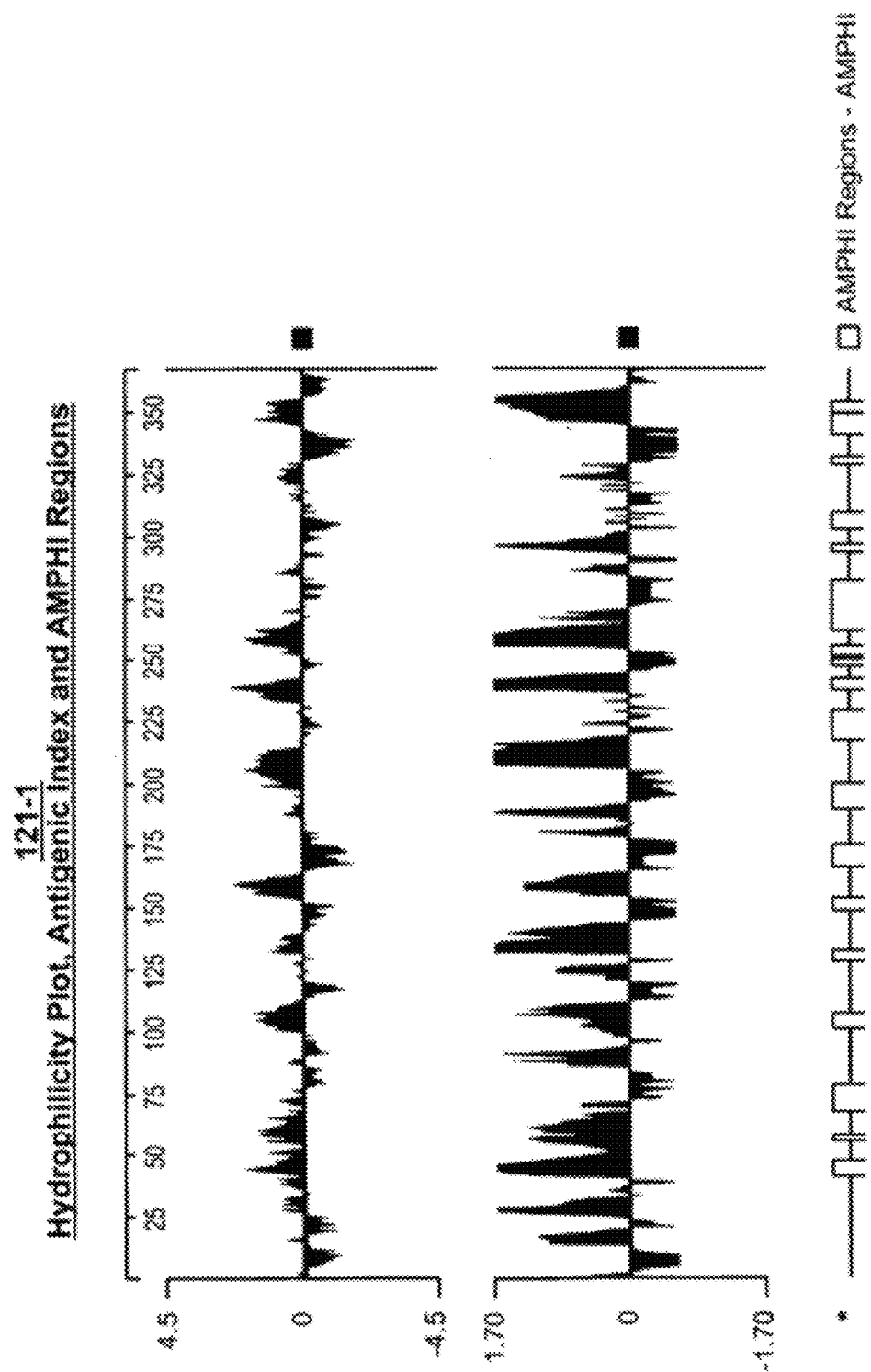

The primer described in Table 1 for ORF 121 was used to locate and clone ORF 121. The predicted gene 121 was cloned in pET vector and expressed in *E. coli*. The product of protein purification was analyzed by SDS-PAGE. In panel A) is shown the analysis of 121-His fusion protein purification. Mice were immunized with the purified 121-His and sera were used for Western blot analysis (panel B), FACS analysis (panel C), bactericidal assay (panel D), and ELISA assay (panel E). Results show that 121 is a surface-exposed protein. Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 121 is a surface-exposed protein and that it is a useful immunogen. The hydrophilicity plots, antigenic index, and amphipatic regions of ORF 121 are provided in FIG. 14. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 121 and the amino acid sequence encoded thereby is provided in Example 1.

Example 7

Expression of ORF 128 and 128-1

Figure 15:
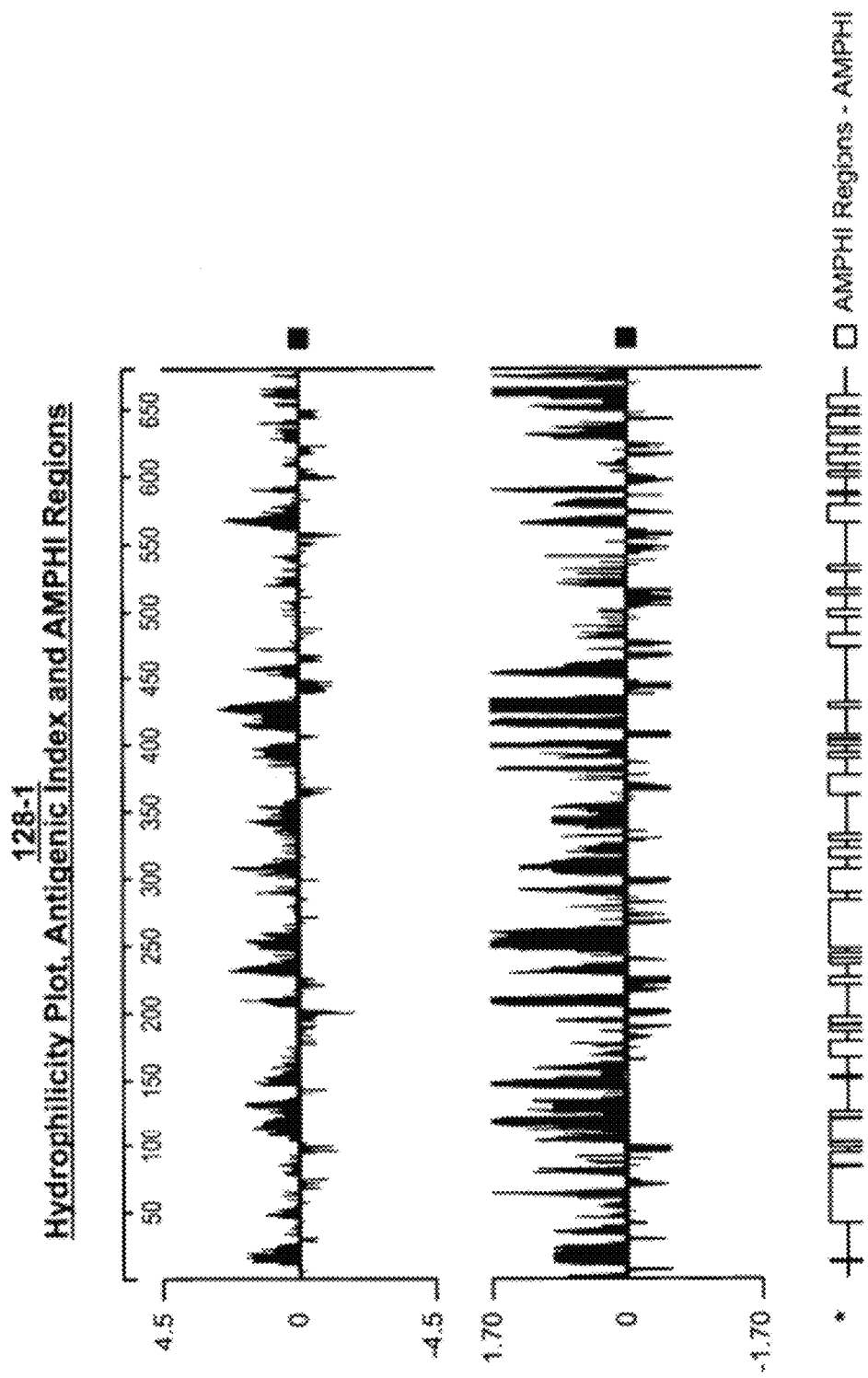

The primer described in Table 1 for ORF 128 was used to locate and clone ORF 128. The predicted gene 128 was cloned in pET vector and expressed in *E. coli*. The product of protein purification was analyzed by SDS-PAGE. In panel A) is shown the analysis of 128-His purification. Mice were immunized with the purified 128-His and sera were used for Western blot analysis (panel B), FACS analysis (panel C), bactericidal assay (panel D) and ELISA assay (panel E). Results show that 128 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 128 is a surface-exposed protein and that it is a useful immunogen. The hydrophilicity plots, antigenic index, and amphipatic regions of ORF 128 are provided in FIG. 15. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 128 and the amino acid sequence encoded thereby is provided in Example 1.

Example 8

Expression of ORF 206

Figure 16:
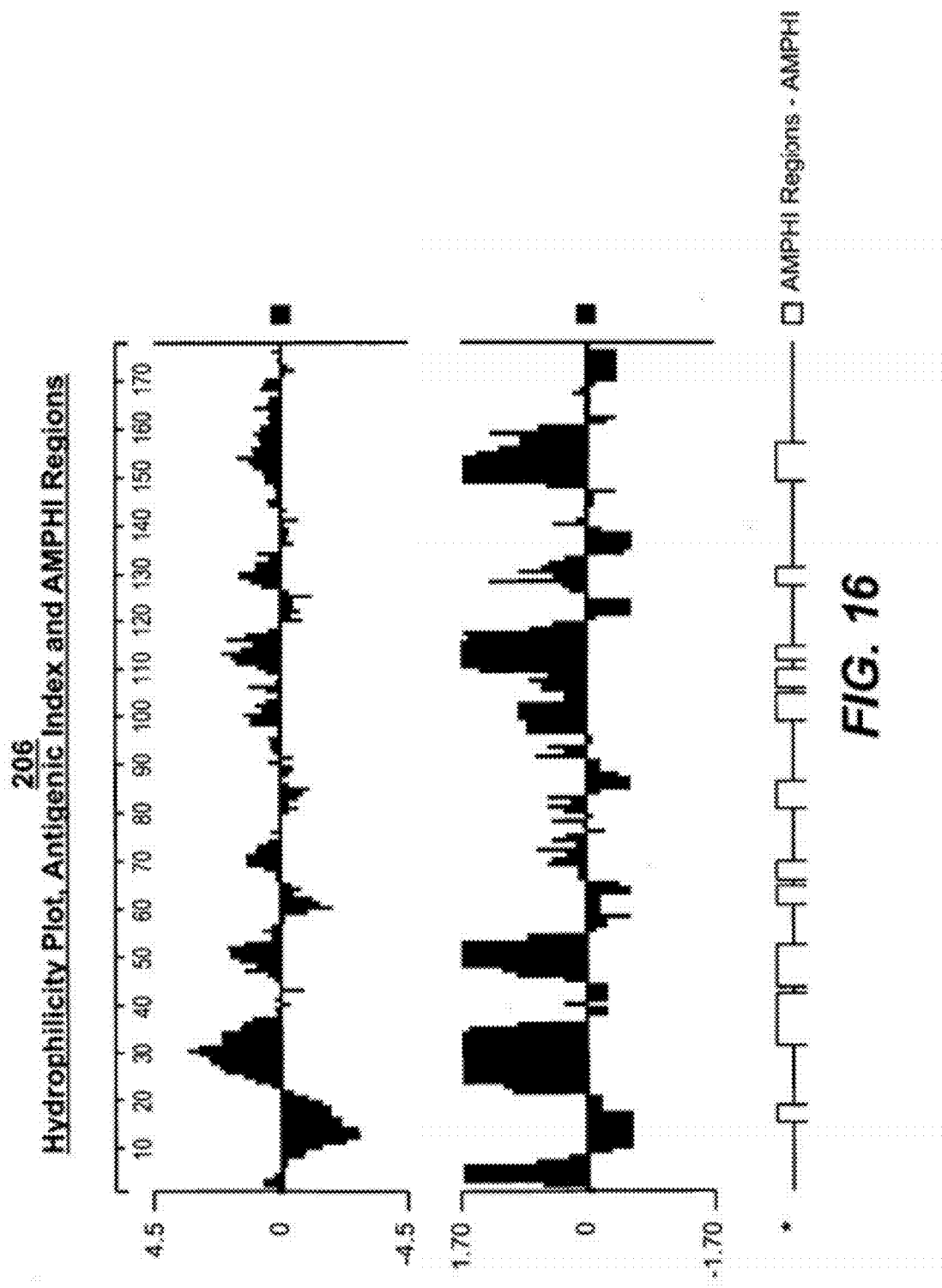

The primer described in Table 1 for ORF 206 was used to locate and clone ORF 206. The predicted gene 206 was cloned in pET vector and expressed in *E. coli*. The product of protein purification was analyzed by SDS-PAGE. In panel A) is shown the analysis of 206-His purification. Mice were immunized with the purified 206-His and sera were used for Western blot analysis (panel B). It is worthnoting that the immunoreactive band in protein extracts from meningococcus is 38 kDa instead of 17 kDa (panel A). To gain information on the nature of this antibody staining we expressed ORF 206 in *E. coli* without the His-tag and including the predicted leader peptide. Western blot analysis on total protein extracts from *E. coli* expressing this native form of the 206 protein showed a reactive band at a position of 38 kDa, as observed in meningococcus. We conclude that the 38 kDa band in panel B) is specific and that anti-206 antibodies, likely recognize a multimeric protein complex. In panel C is shown the FACS analysis, in panel D the bactericidal assay, and in panel E) the ELISA assay. Results show that 206 is a surface-exposed protein. Symbols: M1, molecular weight marker; TP, *N. meningitidis* total protein extract; OMV, *N. meningitidis* outer membrane vesicle preparation. Arrows indicate the position of the main recombinant protein product (A) and the *N. meningitidis* immunoreactive band (B). These experiments confirm that 206 is a surface-exposed protein and that it is a useful immunogen. The hydrophilicity plots, antigenic index, and amphipatic regions of ORF 519 are provided in FIG. 16. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 206 and the amino acid sequence encoded thereby is provided in Example 1.

Example 9

Expression of ORF 287

Figure 17:
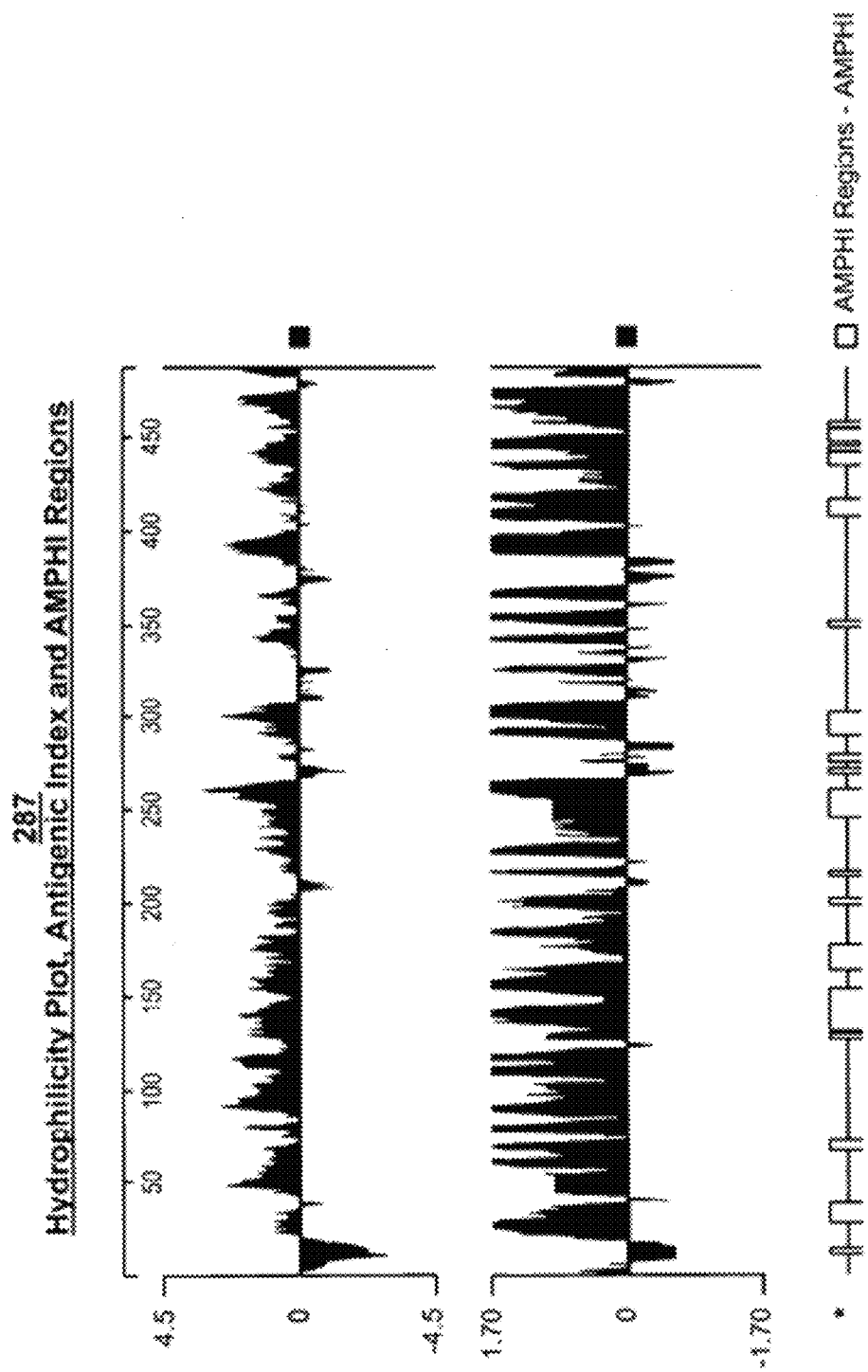

The primer described in Table 1 for ORF 287 was used to locate and clone ORF 287. The predicted gene 287 was cloned in pGex vector and expressed in *E. coli*. The product of protein purification was analyzed by SDS-PAGE. In panel A) is shown the analysis of 287-GST fusion protein purification. Mice were immunized with the purified 287-GST and sera were used for FACS analysis (panel B), bactericidal assay (panel C), and ELISA assay (panel D). Results show that 287 is a surface-exposed protein. Symbols: M1, molecular weight marker. Arrow indicates the position of the main recombinant protein product (A). These experiments confirm that 287 is a surface-exposed protein and that it is a useful immunogen. The hydrophilicity plots, antigenic index, and amphipatic regions of ORF 287 are provided in FIG. 17. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J*

*Immunol Suppl* 11:9). The nucleic acid sequence of ORF 287 and the amino acid sequence encoded thereby is provided in Example 1.

Example 10

Expression of ORF 406

Figure 18:
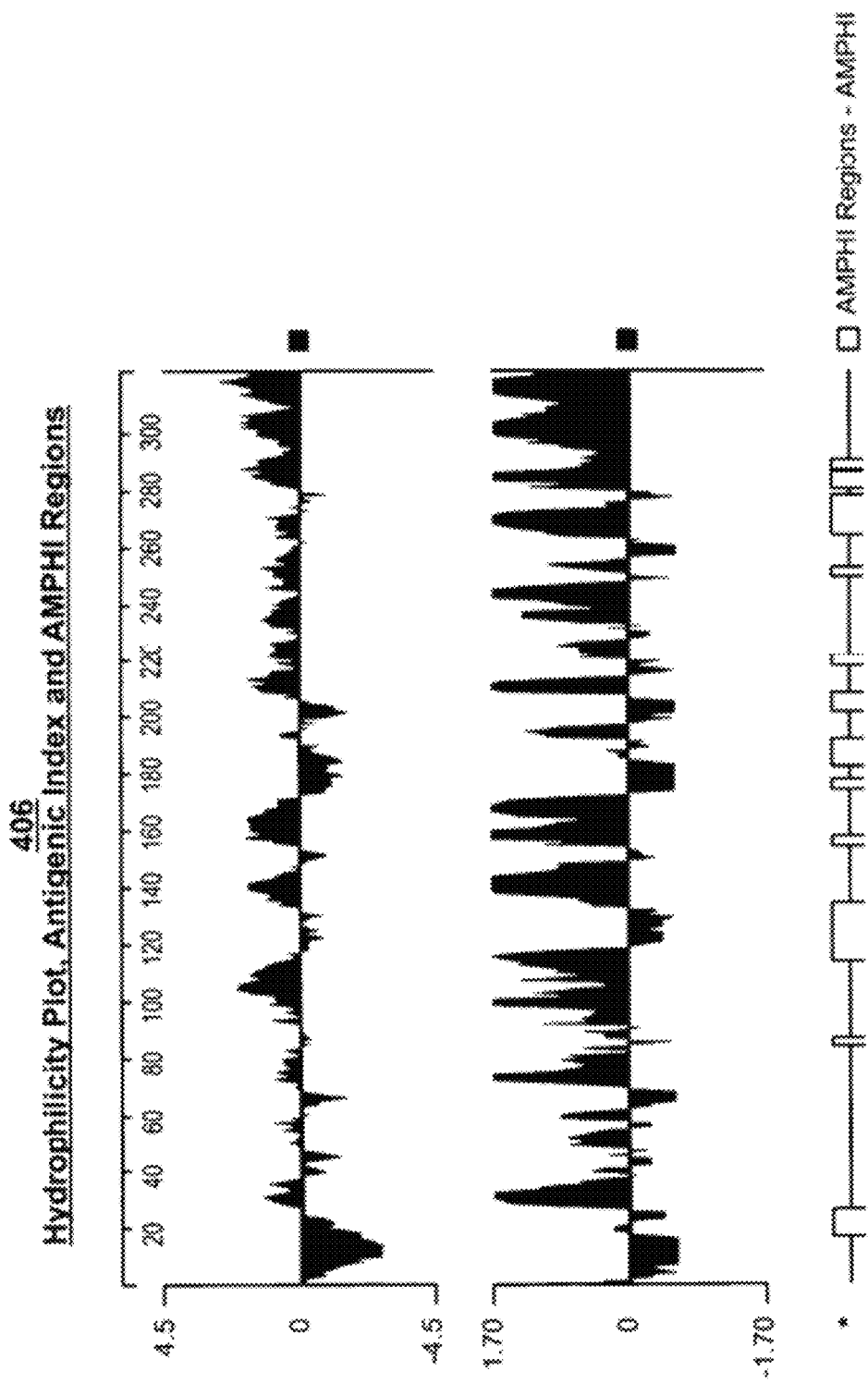

The primer described in Table 1 for ORF 406 was used to locate and clone ORF 406. The predicted gene 406 was cloned in pET vector and expressed in *E. coli*. The product of protein purification was analyzed by SDS-PAGE. In panel A) is shown the analysis of 406-His fusion protein purification. Mice were immunized with the purified 406-His and sera were used for Western blot analysis (panel B), FACS analysis (panel C), bactericidal assay (panel D), and ELISA assay (panel E). Results show that 406 is a surface-exposed protein. Symbols: M1, molecular weight marker; TP, *N. meningitidis* total protein extract; OMV, *N. meningitidis* outer membrane vescicle preparation. Arrows indicate the position of the main recombinant protein product (A) and the *N. meningitidis* immunoreactive band (B). These experiments confirm that 406 is a surface-exposed protein and that it is a useful immunogen. The hydrophilicity plots, antigenic index, and amphipatic regions of ORF 406 are provided in FIG. 18. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 406 and the amino acid sequence encoded thereby is provided in Example 1.

Example 11

Table 2 lists several *Neisseria* strains which were used to assess the conservation of the sequence of ORF 225 among different strains.

TABLE 2

225 gene variability: List of used *Neisseria* strains

| Identification Strains number | Source/reference |
|---|---|
| Group B | |
| zo01_225 NG6/88 | R. Moxon/Seiler et al., 1996 |
| zo02_225 BZ198 | R. Moxon/Seiler et al., 1996 |

TABLE 2-continued

225 gene variability: List of used *Neisseria* strains

| Identification Strains number | Source/reference |
|---|---|
| zo03_225 NG3/88 | R. Moxon/Seiler et al., 1996 |
| zo04_225 297-0 | R. Moxon/Seiler et al., 1996 |
| zo05_225 1000 | R. Moxon/Seiler et al., 1996 |
| zo06_225 BZ147 | R. Moxon/Seiler et al., 1996 |
| zo07_225 BZ169 | R. Moxon/Seiler et al., 1996 |
| zo08_225 528 | R. Moxon/Seiler et al., 1996 |
| zo09_225 NGP165 | R. Moxon/Seiler et al., 1996 |
| zo10_225 BZ133 | R. Moxon/Seiler et al., 1996 |
| zo11_225 NGE31 | R. Moxon/Seiler et al., 1996 |
| zo12_225 NGF26 | R. Moxon/Seiler et al., 1996 |
| zo13_225 NGE28 | R. Moxon/Seiler et al., 1996 |
| zo14_225 NGH38 | R. Moxon/Seiler et al., 1996 |
| zo15_225 SWZ107 | R. Moxon/Seiler et al., 1996 |
| zo16_225 NGH15 | R. Moxon/Seiler et al., 1996 |
| zo17_225 NGH36 | R. Moxon/Seiler et al., 1996 |
| zo18_225 BZ232 | R. Moxon/Seiler et al., 1996 |
| zo19_225 BZ83 | R. Moxon/Seiler et al., 1996 |
| zo20_225 44/76 | R. Moxon/Seiler et al., 1996 |
| zo21_225 MC58 | R. Moxon |
| zo96_225 2996 | Our collection |
| Group A | |
| zo22_225 205900 | R. Moxon |
| zo23_225 F6124 | R. Moxon |
| z2491 Z2491 | R. Moxon/Maiden et al., 1998 |
| Group C | |
| zo24_225 90/18311 | R. Moxon |
| zo25_225 93/4286 | R. Moxon |
| Others | |
| zo26_225 A22 (group W) | R. Moxon/Maiden et al., 1998 |
| zo27_225 E26 (group X) | R. Moxon/Maiden et al., 1998 |
| zo28_225 860800 (group Y) | R. Moxon/Maiden et al., 1998 |
| zo29_225 E32 (group Z) | R. Moxon/Maiden et al., 1998 |
| Gonococcus | |
| zo32_225 Ng F62 | R. Moxon/Maiden et al., 1998 |
| zo33_225 Ng SN4 | R. Moxon |
| fa1090 FA1090 | R. Moxon |

References:
Seiler A. et al., Mol. Microbiol., 1996, 19(4): 841-856.
Maiden et al., Proc. Natl. Acad. Sci. USA, 1998, 95: 3140-3145.

The amino acid sequences for each listed strain are as follows:

```
>FA1090
                                                      <SEQ ID 3115>
MDSFFKPAVWAVLWLMFAVRPALADELTNLLSSREQILRQFAEDEQPVLPVNRAPARRAG

NADELIGSAMGLNEQPVLPVNRAPARRAGNADELIGSAMGLLGIAYRYGGTSVSTGFDCS

GFMQHIFKRAMGINLPRTSAEQARMGAPVARSELQPGDMVFFRTLGGSRISHVGLYIGNN

RFIHAPRTGKNIEITSLSHKYWSGKYAFARRVKKNDPSRFLN*

Z2491
                                                      <SEQ ID 3116>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRVPARRAGNA

DELIGNAMGLNEQPVLPVNRAPARRAGNADELIGNAMGLLGIAYRYGGTSISTGFDCSGF

MQHIFKRAMGINLPRISAEQARMGTPVARSELQPGDMVFFRTLGGSRISHVGLYIGNNRF

IHAPRTGKNIEITSLSHKYWSGKYAFARRVKKNDPSRFLN*
```

-continued

ZO01_225
<SEQ ID 3117>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO02_225
<SEQ ID 3118>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO03_225
<SEQ ID 3119>
MDSFFKPAVWAVLWLMFAVRLALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO04_225
<SEQ ID 3120>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO05_225
<SEQ ID 3121>
MDSFFKPAVWAVLWLMFAVRPALADELTNLLSSREQILRQFAEDEQPVLPINRAPARRAG
NADELIGSAMGLNEQPVLPVNRVPARRAGNADELIGSAMGLNEQPVLPVNRAPARRAGNA
DELIGNAMGLLGIAYRYGGTSISTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO06_225
<SEQ ID 3122>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR
SELQPGDMVFFRTLGGSRISHVGLYIGNNRFIHAPRTGKNIEITSLSHKYWSGKYAFARR
VKKNDPSRFLN*

ZO07_225
<SEQ ID 3123>
MDSFFKPAVWAVLWLMFAVRPALADELTNLLSSREQILRQFAEDEQPVLPINRAPARRAG
NADELIGSAMGLNEQPVLPVNRVPARRAGNADELIGNAMGLNEQPVLPVNRAPARRAGNA
DELIGNAMGLLGIAYRYGGTSVSTGFDCSGFMQHIFKRAMGINLPRTSAEQARMGTPVAR

```
SELQPGDMVFFRTLGGSRISHVGLYIGNNRFIHAPRTGKNIEITSLSHKYWSGKYAFARR

VKKNDPSRFLN*

ZO08_225
                                                <SEQ ID 3124>
MDSFFKPAVWAVLWLMFAVRPALADELTNLLSSREQILRQFAEDEQPVLPINRAPARRAG

NADELIGSAMGLNEQPVLPVNRVPARRAGNADELIGSAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO09_225
                                                <SEQ ID 3125>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO10_225
                                                <SEQ ID 3126>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO11_225
                                                <SEQ ID 3127>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLNEQPVLPVNRAPARRAGNADELIGNAMGLLGIAYRYGGTSVSTGFDCSGF

MQHIFKRAMGINLPRTSAEQARMGTPVARSELQPGDMVFFRTLGGSRISHVGLYIGNNRF

IHAPRTGKNIEITSLSHKYWSGKYAFARRVKKNDPSRFLN*

ZO12_225
                                                <SEQ ID 3128>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO13_225
                                                <SEQ ID 3129>
MDSFFKPAVWAVLWLMFAVRPALADELTNLLSSREQILRQFAEDEQPVLPVNRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFIQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO14_225
                                                <SEQ ID 3130>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA
```

-continued

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO15_225
<SEQ ID 3131>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLLGIAYRYGGTSVSTGFDCS

GFMQHIFKRAMGINLPRTSAEQARMGTPVARSELQPGDMVFFRTLGGSRISHVGLYIGNN

RFIHAPRTGKNIEITSLSHKYWSGKYAFARRVKKNDPSRFLN*

ZO16_225
<SEQ ID 3132>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO17_225
<SEQ ID 3133>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO18_225
<SEQ ID 3134>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO19_225
<SEQ ID 3135>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO20_225
<SEQ ID 3136>
MDSFFKPAVWAVLWLMFAVRPALADELTNLLSSREQILRQFAEDEQPVLPINRAPARRAG

NADELIGSAMGLNEQPVLPINRAPARRAGNADELIGSAMGLNEQPVLPVNRVPARRAGNA

DELIGNAMGLNEQPVLPVNRAPARRAGNADELIGNAMGLLGIAYRYGGTSVSTGFDCSGF

MQHIFKRAMGINLPRTSAEQARMGTPVARSELQPGDMVFFRTLGGSRISHVGLYIGNNRF

IHAPRTGKNIEITSLSHKYWSGKYAFARRVKKNDPSRFLN*

ZO21_225
<SEQ ID 3137>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

-continued

```
DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO22_225
                                                           <SEQ ID 3138>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO23_225
                                                           <SEQ ID 3139>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO24_225
                                                           <SEQ ID 3140>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO25_225
                                                           <SEQ ID 3141>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO26_225
                                                           <SEQ ID 3142>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO27_225
                                                           <SEQ ID 3143>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*
```

```
ZO28_225
                                                          <SEQ ID 3144>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO29_225
                                                          <SEQ ID 3145>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSVSTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*

ZO32_225
                                                          <SEQ ID 3146>
MDSFFKPAVWAVLWLMFAVRPALADELTNLLSSREQILRQFAEDEQPVLPVNRAPARRAG

NADELIGSAMGLNEQPVLPVNRAPARRAGNADELIGSAMGLLGIAYRYGGTSVSTGFDCS

GFMQHIFKRAMGINLPRTSAEQARMGAPVARSELQPGDMVFFRTLGGSRISHVGLYIGNN

RFIHAPRTGKNIEITSLSHKYWSGKYAFARRVKKNDPSRFLN*

ZO33_225
                                                          <SEQ ID 3147>
MDSFFKPAVWAVLWLMFAVRSALADELTNLLSSREQILRQFAEDEQPVLPVNRAPARRAG

NADELIGSAMGLNEQPVLPVNRAPARRAGNADELIGSAMGLLGIAYRYGGTSVSTGFDCS

GFMQHIFKRAMGINLPRTSAEQARMGAPVARSELQPGDMVFFRTLGGSRISHVGLYIGNN

RFIHAPRTGKNIEITSLSHKYWSGKYAFARRIKKNDPSRFLN*

ZO96_225
                                                          <SEQ ID 3148>
MDSFFKPAVWAVLWLMFAVRPALADELTNLLSSREQILRQFAEDEQPVLPINRAPARRAG

NADELIGSAMGLNEQPVLPVNRVPARRAGNADELIGNAMGLNEQPVLPVNRAPARRAGNA

DELIGNAMGLLGIAYRYGGTSISTGFDCSGFMQHIFKRAMGINLPRTSAEQARMGTPVAR

SELQPGDMVFFRTLGGSRISHVGLYIGNNRFIHAPRTGKNIEITSLSHKYWSGKYAFARR

VKKNDPSRFLN*
```

FIG. 19 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 12

Table 3 lists several *Neisseria* strains which were used to assess the conservation of the sequence of ORF 235 among different strains.

TABLE 3

235 gene variability: List of used *Neisseria* strains

| Identification Strains number | Reference |
|---|---|
| Group B | |
| gnmzq01 NG6/88 | Seiler et al., 1996 |
| gnmzq02 BZ198 | Seiler et al., 1996 |
| gnmzq03 NG3/88 | Seiler et al., 1996 |
| gnmzq04 1000 | Seiler et al., 1996 |
| gnmzq05 1000 | Seiler et al., 1996 |
| gnmzq07 BZ169 | Seiler et al., 1996 |
| gnmzq08 528 | Seiler et al., 1996 |
| gnmzq09 NGP165 | Seiler et al., 1996 |

TABLE 3-continued

235 gene variability: List of used Neisseria strains

| Identification Strains number | Reference |
|---|---|
| gnmzq10 BZ133 | Seiler et al., 1996 |
| gnmzq11 NGE31 | Seiler et al., 1996 |
| gnmzq13 NGE28 | Seiler et al., 1996 |
| gnmzq14 NGH38 | Seiler et al., 1996 |
| gnmzq15 SWZ107 | Seiler et al., 1996 |
| gnmzq16 NGH15 | Seiler et al., 1996 |
| gnmzq17 NGH36 | Seiler et al., 1996 |
| gnmzq18 BZ232 | Seiler et al., 1996 |
| gnmzq19 BZ83 | Seiler et al., 1996 |
| gnmzq21 MC58 | Virji et al., 1992 |
| Group A | |
| gnmzq22 205900 | Our collection |
| gnmzq23 F6124 | Our collection |
| z2491 Z2491 | Maiden et al., 1998 |
| Group C | |
| gnmzq24 90/18311 | Our collection |
| gnmzq25 93/4286 | Our collection |
| Others | |
| gnmzq26 A22 (group W) | Maiden et al., 1998 |
| gnmzq27 E26 (group X) | Maiden et al., 1998 |
| gnmzq28 860800 (group Y) | Maiden et al., 1998 |
| gnmzq29 E32 (group Z) | Maiden et al., 1998 |
| gnmzq31 N. lactamica | Our collection |
| Gonococcus | |
| gnmzq32 Ng F62 | Maiden et al., 1998 |
| gnmzq33 Ng SN4 | Our collection |
| fa1090 FA1090 | Dempsey et al. 1991 |

References:
Seiler A. et al., Mol. Microbiol., 1996, 19(4): 841-856.
Maiden R. et al., Proc. Natl. Acad. Sci. USA, 1998, 95: 3140-3145.
Virji M. et al., Mol. Microbiol., 1992, 6: 1271-1279
Dempsey J. F. et al., J. Bacteriol., 1991, 173: 5476-5486

The amino acid sequences for each listed strain are as follows:

```
FA1090
                                                   <SEQ ID 3149>
MKPLILGLAAVLALSACQVRKAPDLDYTSFKESKPASILVVPPLNESPDVNGTWGMLAST

AAPISEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSRNGILKGPRFVEEQPK*

GNMZQ01
                                                   <SEQ ID 3150>
MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

GNMZQ02
                                                   <SEQ ID 3151>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ03
                                                   <SEQ ID 3152>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ04
                                                   <SEQ ID 3153>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*
```

-continued

GNMZQ05

<SEQ ID 3154>

MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

GNMZQ07

<SEQ ID 3155>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ08

<SEQ ID 3156>

MKPLILGLAAVLALSACQVQKAPDFDYTSFKESKPASILVVPPLNESPDVNGTWGVLAST

AAPLSEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVSAVVNQIANNLT

DRGYQVSKTAAYNLLSPYSHNGILKGPRFVEEQPK*

GNMZQ09

<SEQ ID 3157>

MKPLILGLAAALVLSACQVQKAPDFDYTSFKESKPASILVVPPLNESPDVNGTWGMLAST

AEPLSEAGYYVFPAAVVEETFKQNGLTNAADIHAVQPEKLHQIFGNDAVLYITITEYGTS

YQILDSVTTVSARARLVDSRNGKVLWSGSASIREGSNNSNSGLLGALVSAVVNQIANSLT

DRGYQVSKTAAYNLLSPYSHNGILKGPRFVEEQPK*

GNMZQ10

<SEQ ID 3158>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ11

<SEQ ID 3159>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ13

<SEQ ID 3160>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ14

<SEQ ID 3161>

MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSHNGILKGPRFVEEQPK*

-continued

GNMZQ15
<SEQ ID 3162>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ16
<SEQ ID 3163>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ17
<SEQ ID 3164>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ18
<SEQ ID 3165>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSHNGILKGPRFVEEQPK*

GNMZQ19
<SEQ ID 3166>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ21
<SEQ ID 3166>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ22
<SEQ ID 3167>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ23
<SEQ ID 3168>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ24
<SEQ ID 3169>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ25
<SEQ ID 3170>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ26
<SEQ ID 3171>
MKPLILGLAAVLALSACQVQKAPDFDYTSFKESKPASILVVPPLNESPDVNGTWGMLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSHNGILKGPRFVEEQPK*

GNMZQ27
<SEQ ID 3172>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ28
<SEQ ID 3173>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ29
<SEQ ID 3174>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*

GNMZQ31
<SEQ ID 3175>
MKPLILGLAAVLALSACQVQKAPDFDYTAFKESKPASILVVPPLNESPDVNGTWGMLAST

AEPLSEAGYYVFPAAVVEETFKQNGLTNAADIHAVRPEKLHQIFGNDAVLYITITEYGTS

YQILDSVTTVSARARLVDSRNGKVLWSGSASIREGSNNSNSGLLGALVGAVVNQIANSLT

DRGYQVSKAAAYDLLSPYSHNGILKGPRFVEEQPK*

GNMZQ32
<SEQ ID 3176>
MKPLILGLAAVLALSACQVRKAPDLDYTSFKESKPASILVVPPLNESPDVNGTWGMLAST

AAPISEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSRNGILKGPRFVEEQPK*

```
GNMZQ33
                                                            <SEQ ID 3177>
MKPLILGLAAVLALSACQVRKAPDLDYTSFKESKPASILVVPPLNESPDVNGTWGMLAST

AAPISEAGYYVFPAAVVEETFKENGLTNAADIHAVRPEKLHQIFGNDAVLYITVTEYGTS

YQILDSVTTVSAKARLVDSRNGKELWSGSASIREGSNNSNSGLLGALVGAVVNQIANSLT

DRGYQVSKTAAYNLLSPYSRNGILKGPRFVEEQPK*

Z2491
                                                            <SEQ ID 3178>
MKPLILGLAAVLALSACQVQKAPDFDYTSFKESKPASILVVPPLNESPDVNGTWGVLAST

AAPLSEAGYYVFPAAVVEETFKQNGLTNAADIHAVRPEKLHQIFGNDAVLYITVTEYGTS

YQILDSVTTVSAKARLVDSRNGKELWSGSASIREGSNNSNSGLLGALVSAVVNQIANSLT

DRGYQVSKTAAYNLLSPYSHNGILKGPRFVEEQPK*
```

FIG. 20 shows the results of aligning the sequences of each of these strains. Dark shading indicates regions of homology, and gray shading indicates the conservation of amino acids with similar characteristics. As is readily discernible, there is significant conservation among the various strains of ORF 235, further confirming its utility as an antigen for both vaccines and diagnostics.

Example 13

Table 4 lists several *Neisseria* strains which were used to assess the conservation of the sequence of ORF 287 among different strains.

TABLE 4

**287 gene variability: List of used *Neisseria* strains**

| Identification Strains number | Reference |
|---|---|
| Group B | |
| 287_2 BZ198 | Seiler et al., 1996 |
| 287_9 NGP165 | Seiler et al., 1996 |
| 287_14 NGH38 | Seiler et al., 1996 |
| 287_21 MC58 | Virji et al., 1992 |
| Group A | |
| z2491 Z2491 | Maiden et al., 1998 |
| Gonococcus | |
| fa1090 FA1090 | Dempsey et al. 1991 |

References:
Seiler A. et al., Mol. Microbiol., 1996, 19(4): 841-856.
Maiden R. et al., Proc. Natl. Acad. Sci. USA, 1998, 95: 3140-3145.
Virji M. et al., Mol. Microbiol., 1992, 6: 1271-1279
Dempsey J. F. et al., J. Bacteriol., 1991, 173: 5476-5486

The amino acid sequences for each listed strain are as follows:

```
287_14
                                                            <SEQ ID 3179>
MFKRSVIAMACIFALSACGGGGGGSPDVKSADTLSKPAAPVVSEKETEAKEDAPQAGSQG

QGAPSAQGGQDMAAVSEENTGNGGAAATDKPKNEDEGAQNDMPQNAADTDSLTPNHTPAS

NMPAGNMENQAPDAGESEQPANQPDMANTADGMQGDDPSAGGENAGNTAAQGTNQAENNQ

TAGSQNPASSTNPSATNSGGDFGRTNVGNSVVIDGPSQNITLTHCKGDSCSGNNFLDEEV

QLKSEFEKLSDADKISNYKKDGKNDGKNDKFVGLVADSVQMKGINQYIIFYKPKPTSFAR

FRRSARSRRSLPAEMPLIPVNQADTLIVDGEAVSLTGHSGNIFAPEGNYRYLTYGAEKLP

GGSYALRVQGEPSKGEMLAGTAVYNGEVLHFHTENGRPSPSRGRFAAKVDFGSKSVDGII

DSGDGLHMGTQKFKAAIDGNGFKGTWTENGGGDVSGKFYGPAGEEVAGKYSYRPTDAEKG

GFGVFAGKKEQD*

287_2
                                                            <SEQ ID 3180>
MFKRSVIAMACIFALSACGGGGGGSPDVKSADTLSKPAAPVVSEKETEAKEDAPQAGSQG

QGAPSAQGGQDMAAVSEENTGNGGAAATDKPKNEDEGAQNDMPQNAADTDSLTPNHTPAS

NMPAGNMENQAPDAGESEQPANQPDMANTADGMQGDDPSAGGENAGNTAAQGTNQAENNQ

TAGSQNPASSTNPSATNSGGDFGRTNVGNSVVIDGPSQNITLTHCKGDSCSGNNFLDEEV
```

```
QLKSEFEKLSDADKISNYKKDGKNDGKNDKFVGLVADSVQMKGINQYIIFYKPKPTSFAR

FRRSARSRRSLPAEMPLIPVNQADTLIVDGEAVSLTGHSGNIFAPEGNYRYLTYGAEKLP

GGSYALRVQGEPSKGEMLAGTAVYNGEVLHFHTENGRPSPSRGRFAAKVDFGSKSVDGII

DSGDGLHMGTQKFKAAIDGNGFKGTWTENGGGDVSGKFYGPAGEEVAGKYSYRPTDAEKG

GFGVFAGKKEQD*

287_21.                                                   <SEQ ID 3181>
MFKRSVIAMACIFALSACGGGGGGSPDVKSADTLSKPAAPVVSEKETEAKEDAPQAGSQG

QGAPSAQGSQDMAAVSEENTGNGGAVTADNPKNEDEVAQNDMPQNAAGTDSSTPNHTPDP

NMLAGNMENQATDAGESSQPANQPDMANAADGMQGDDPSAGGQNAGNTAAQGANQAGNNQ

AAGSSDPIPASNPAPANGGSNFGRVDLANGVLIDGPSQNITLTHCKGDSCSGNNFLDEEV

QLKSEFEKLSDADKISNYKKDGKNDKFVGLVADSVQMKGINQYIIFYKPKPTSFARFRRS

ARSRRSLPAEMPLIPVNQADTLIVDGEAVSLTGHSGNIFAPEGNYRYLTYGAEKLPGGSY

ALRVQGEPAKGEMLAGAAVYNGEVLHFHTENGRPYPTRGRFAAKVDFGSKSVDGIIDSGD

DLHMGTQKFKAAIDGNGFKGTWTENGSGDVSGKFYGPAGEEVAGKYSYRPTDAEKGGFGV

FAGKKEQD*

287_9                                                      <SEQ ID 3182>
MFKRSVIAMACIVALSACGGGGGGSPDVKSADTLSKPAAPVVTEDVGEEVLPKEKKDEEA

VSGAPQADTQDATAGKGGQDMAAVSAENTGNGGAATTDNPENKDEGPQNDMPQNAADTDS

STPNHTPAPNMPTRDMGNQAPDAGESAQPANQPDMANAADGMQGDDPSAGENAGNTADQA

ANQAENNQVGGSQNPASSTNPNATNGGSDFGRINVANGIKLDSGSENVTLTHCKDKVCDR

DFLDEEAPPKSEFEKLSDEEKINKYKKDEQRENFVGLVADRVEKNGTNKYVIIYKDKSAS

SSSARFRRSARSRRSLPAEMPLIPVNQADTLIVDGEAVSLTGHSGNIFAPEGNYRYLTYG

AEKLSGGSYALSVQGEPAKGEMLAGTAVYNGEVLHFHMENGRPSPSGGRFAAKVDFGSKS

VDGIIDSGDDLHMGTQKFKAVIDGNGFKGTWTENGGGDVSGRFYGPAGEEVAGKYSYRPT

DAEKGGFGVFAGKKEQD*

FA1090                                                     <SEQ ID 3183>
MFKRSVIAMACIFPLSACGGGGGGSPDVKSADTPSKPAAPVVAENAGEGVLPKEKKDEEA

AGGAPQADTQDATAGEGSQDMAAVSAENTGNGGAATTDNPKNEDAGAQNDMPQNAAESAN

QTGNNQPAGSSDSAPASNPAPANGGSDFGRTNVGNSVVIDGPSQNITLTHCKGDSCNGDN

LLDEEAPSKSEFEKLSDEEKIKRYKKDEQRENFVGLVADRVKKDGTNKYIIFYTDKPPTR

SARSRRSLPAEIPLIPVNQADTLIVDGEAVSLTGHSGNIFAPEGNYRYLTYGAEKLPGGS

YALRVQGEPAKGEMLVGTAVYNGEVLHFHMENGRPYPSGGRFAAKVDFGSKSVDGIIDSG

DDLHMGTQKFKAAIDGNGFKGTWTENGGGDVSGRFYGPAGEEVAGKYSYRPTDAEKGGFG

VFAGKKDRD*

Z2491                                                      <SEQ ID 3184>
MFKRSVIAMACIFALSACGGGGGGSPDVKSADTLSKPAAPVVSEKETEAKEDAPQAGSQG

QGAPSAQGSQDMAAVSEENTGNGGAVTADNPKNEDEVAQNDMPQNAAGTDSSTPNHTPDP

NMLAGNMENQATDAGESSQPANQPDMANAADGMQGDDPSAGGQNAGNTAAQGANQAGNNQ

AAGSSDPIPASNPAPANGGSNFGRVDLANGVLIDGPSQNITLTHCKGDSCSGNNFLDEEV

QLKSEFEKLSDADKISNYKKDGKNDKFVGLVADSVQMKGINQYIIFYKPKPTSFARFRRS
```

-continued
```
ARSRRSLPAEMPLIPVNQADTLIVDGEAVSLTGHSGNIFAPEGNYRYLTYGAEKLPGGSY

ALRVQGEPAKGEMLAGAAVYNGEVLHFHTENGRPYPTRGRFAAKVDFGSKSVDGIIDSGD

DLHMGTQKFKAAIDGNGFKGTWTENGSGDVSGKFYGPAGEEVAGKYSYRPTDAEKGGFGV

FAGKKEQD*
```

FIG. 21 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 14

Table 5 lists several *Neisseria* strains which were used to assess the conservation of the sequence of ORF 519 among different strains.

TABLE 5

519 gene variability: List of used *Neisseria* strains

| Identification Strains number | Source/reference |
|---|---|
| Group B | |
| zv01_519 NG6/88 | R. Moxon/Seiler et al., 1996 |
| zv02_519 BZ198 | R. Moxon/Seiler et al., 1996 |
| zv03_519ass NG3/88 | R. Moxon/Seiler et al., 1996 |
| zv04_519 297-0 | R. Moxon/Seiler et al., 1996 |
| zv05_519 1000 | R. Moxon/Seiler et al., 1996 |
| zv06_519ass BZ147 | R. Moxon/Seiler et al., 1996 |
| zv07_519 BZ169 | R. Moxon/Seiler et al., 1996 |
| zv11_519 NGE31 | R. Moxon/Seiler et al., 1996 |

TABLE 5-continued 519 gene variability: List of used *Neisseria* strains

| Identification Strains number | Source/reference |
|---|---|
| zv12_519 NGF26 | R. Moxon/Seiler et al., 1996 |
| zv18_519 BZ232 | R. Moxon/Seiler et al., 1996 |
| zv19_519 BZ83 | R. Moxon/Seiler et al., 1996 |
| zv20_519ass 44/76 | R. Moxon/Seiler et al., 1996 |
| zv21_519ass MC58 | R. Moxon |
| zv96_519 2996 | Our collection |
| Group A | |
| zv22_519ass 205900 | R. Moxon |
| z2491_519 Z2491 | R. Moxon/Maiden et al., 1998 |
| Others | |
| zv26_519 A22 (group W) | R. Moxon/Maiden et al., 1998 |
| zv27_519 E26 (group X) | R. Moxon/Maiden et al., 1998 |
| zv28_519 860800 (group Y) | R. Moxon/Maiden et al., 1998 |
| zv29_519ass E32 (group Z) | R. Moxon/Maiden et al., 1998 |
| Gonococcus | |
| zv32_519 Ng F62 | R. Moxon/Maiden et al., 1998 |
| fa1090_519 FA1090 | R. Moxon |

References:
Seiler A. et al., Mol. Microbiol., 1996, 19(4): 841-856.
Maiden et al., Proc. Natl. Acad. Sci. USA, 1998, 95: 3140-3145.

The amino acid sequences for each listed strain are as follows:

```
FA1090_519
                                                  <SEQ ID 3185>
MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRAMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

Z2491_519
                                                  <SEQ ID 3186>
MEFFIILLAAVVVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV01_519
                                                  <SEQ ID 3187>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG
```

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV02_519
<SEQ ID 3188>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV03_519
<SEQ ID 3189>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV04_519
<SEQ ID 3190>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV05_519
<SEQ ID 3191>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV06_519ASS
<SEQ ID 3192>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVFSALDEAAGAWGVKVLRYEIKDLVPPQEILRSMQAQITAERK

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV07_519
<SEQ ID 3193>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV11_519
<SEQ ID 3194>
MEFFIILLAAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV12_519
<SEQ ID 3195>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV18_519
<SEQ ID 3196>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV19_519
<SEQ ID 3197>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR
LVAEANAEAIRQIAAALQTQGGADAVNLKIAEQYVAAFNNLAKESNTLIMPANVADIGSL
ISAGMKIIDSSKTAK*

ZV20_519ASS
<SEQ ID 3198>
MEFFIILLVAVAVFGFKSFVVIPQQEVHVVERLGRFHRALTAGLNILIPFIDRVAYRHSL
KEIPLDVPSQVCITRDNTQLTVDGIIYFQVTDPKLASYGSSNYIMAITQLAQTTLRSVIG
RMELDKTFEERDEINSTVVAALDEAAGAWGVKVLRYEIKDLVPPQEILRSMQAQITAERE
KRARIAESEGRKIEQINLASGQREAEIQQSEGEAQAAVNASNAEKIARINRAKGEAESLR

-continued

LVAEANAEAIRQIAAALQTQGGADAVNLKIAEQYVAAFNNLAKESNTLIMPANVADIGSM

ISAGMKIIDSSKTAK*

ZV21_519ASS
<SEQ ID 3199>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV22_519ASS
<SEQ ID 3200>
MEFFIILLAAVVVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRSMQAQITAERE

KRARIAESEGRKIEQINLASGQREAKIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV26_519
<SEQ ID 3201>
MEFFIILLAAVVVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV27_519
<SEQ ID 3202>
MEFFIILLVAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV28_519
<SEQ ID 3203>
MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*

ZV29_519ASS
<SEQ ID 3204>
MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSIVVSALDEAAGAWGVKVLRYEIKDLVPPQEILRSMQAQITAERE

-continued

ZV32_519
```
                                                              <SEQ ID 3205>
MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVSALDEAAGAWGVKVLRYEIKDLVPPQEILRAMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*
```

ZV96_519
```
                                                              <SEQ ID 3206>
MEFFIILLAAVAVFGFKSFVVIPQQEVHVVERLGRFHRALTAGLNILIPFIDRVAYRHSL

KEIPLDVPSQVCITRDNTQLTVDGIIYFQVTDPKLASYGSSNYIMAITQLAQTTLRSVIG

RMELDKTFEERDEINSTVVAALDEAAGAWGVKVLRYEIKDLVPPQEILRSMQAQITAERE

KRARIAESEGRKIEQINLASGQREAEIQQSEGEAQAAVNASNAEKIARINRAKGEAESLR

LVAEANAEAIRQIAAALQTQGGADAVNLKIAEQYVAAFNNLAKESNTLIMPANVADIGSL

ISAGMKIIDSSKTAK*
```

FIG. 22 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 15

Table 6 lists several *Neisseria* strains which were used to assess the conservation of the sequence of ORF 919 among different strains.

TABLE 6

919 gene variability: List of used *Neisseria* strains

| Identification Strains number | Source/reference |
|---|---|
| Group B | |
| zm01 NG6/88 | R. Moxon/Seiler et al., 1996 |
| zm02 BZ198 | R. Moxon/Seiler et al., 1996 |
| zm03 NG3/88 | R. Moxon/Seiler et al., 1996 |
| zm04 297-0 | R. Moxon/Seiler et al., 1996 |
| zm05 1000 | R. Moxon/Seiler et al., 1996 |
| zm06 BZ147 | R. Moxon/Seiler et al., 1996 |
| zm07 BZ169 | R. Moxon/Seiler et al., 1996 |
| zm08n 528 | R. Moxon/Seiler et al., 1996 |
| zm09 NGP165 | R. Moxon/Seiler et al., 1996 |
| zm10 BZ133 | R. Moxon/Seiler et al., 1996 |
| zm11asbc NGE31 | R. Moxon/Seiler et al., 1996 |
| zm12 NGF26 | R. Moxon/Seiler et al., 1996 |
| zm13 NGE28 | R. Moxon/Seiler et al., 1996 |
| zm14 NGH38 | R. Moxon/Seiler et al., 1996 |
| zm15 SWZ107 | R. Moxon/Seiler et al., 1996 |
| zm16 NGH15 | R. Moxon/Seiler et al., 1996 |
| zm17 NGH36 | R. Moxon/Seiler et al., 1996 |
| zm18 BZ232 | R. Moxon/Seiler et al., 1996 |

TABLE 6-continued 919 gene variability: List of used *Neisseria* strains

| Identification Strains number | Source/reference |
|---|---|
| zm19 BZ83 | R. Moxon/Seiler et al., 1996 |
| zm20 44/76 | R. Moxon/Seiler et al., 1996 |
| zm21 MC58 | R. Moxon |
| zm96 2996 | Our collection |
| Group A | |
| zm22 205900 | R. Moxon |
| zm23asbc F6124 | R. Moxon |
| z2491 Z2491 | R. Moxon/Maiden et al., 1998 |
| Group C | |
| zm24 90/18311 | R. Moxon |
| zm25 93/4286 | R. Moxon |
| Others | |
| zm26 A22 (group W) | R. Moxon/Maiden et al., 1998 |
| zm27bc E26 (group X) | R. Moxon/Maiden et al., 1998 |
| zm28 860800 (group Y) | R. Moxon/Maiden et al., 1998 |
| zm29asbc E32 (group Z) | R. Moxon/Maiden et al., 1998 |
| zm31asbc *N. lactamica* | R. Moxon |
| Gonococcus | |
| zm32asbc Ng F62 | R. Moxon/Maiden et al., 1998 |
| zm33asbc Ng SN4 | R. Moxon |
| fa1090 FA1090 | R. Moxon |

References:
Seiler A. et al., Mol. Microbiol., 1996, 19(4): 841-856.
Maiden et al., Proc. Natl. Acad. Sci. USA, 1998, 95: 3140-3145.

The amino acid sequences for each listed strain are as follows:

FA1090 <SEQ ID 3207>
MKKHLLRSALYGIAAAILAACQSRSIQTFPQPDTSVINGPDRPAGIPDPAGTTVAGGGAV
YTVVPHLSMPHWAAQDFAKSLQSFRLGCANLKNRQGWQDVCAQAFQTPVHSFQAKRFFER
YFTPWQVAGNGSLAGTVTGYYEPVLKGDGRRTERARFPIYGIPDDFISVPLPAGLRGGKN
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMRQNPQRLAEVLGQNPSYIFFRELAGSGNEGPVGALGTPLMGEYAGA
IDRHYITLGAPLFVATAHPVTRKALNRLIMAQDTGSAIKGAVRVDYFWGYGDEAGELAGK
QKTTGYVWQLLPNGMKPEYRP*

Z2491 <SEQ ID 3208>
MKKYLFRAALCGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSVQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMQQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM01 <SEQ ID 3209>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM02 <SEQ ID 3210>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM03 <SEQ ID 3211>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER

-continued

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM04                                                   <SEQ ID 3212>
MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM05                                                   <SEQ ID 3213>
MKKYLFRAALYGIAAAILAACQSKSIQTFPQPDTSVINGPDRPVGIPDPAGTTVGGGGAV

YTVVPHLSLPHWAAQDFAKSLQSFRLSCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM06                                                   <SEQ ID 3214>
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM07                                                   <SEQ ID 3215>
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

```
VDRHYITLGAPLFVATAHPVTRKALNRLIMAQDTGSAIKGAVRVDYFWGYGDEAGELAGK

QKTTGYVWQLLPNGMKPEYRP*

ZM08N
                                                       <SEQ ID 3216>
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM09
                                                       <SEQ ID 3217>
MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM10
                                                       <SEQ ID 3218>
MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM11ASBC
                                                       <SEQ ID 3219>
MKKYLFRAALCGIAAAILAACQSKSIQTFPQPDTSVINGPDRPVGIPAPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*
```

ZM12

<SEQ ID 3220>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM13

<SEQ ID 3221>

MKKYLFRAALYGIAAAILAACQSKSIQTFPQPDTSVINGPDRPVGIPDPAGTTVGGGGAV

YTVVPHLSLPHWAEQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM14

<SEQ ID 3222>

MKKYLFRAALCGIAAAILAACQSKSIQTFPQPDTSVINGPDRPVGIPAPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSRNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM15

<SEQ ID 3223>

MKKYLFRAALYGIAAAILAACQSKSIQTFPQPDTSVINGPDRPVGIPDLAGTTVGGGGAV

YTVVPHLSLPHWAAQDFAKSLQSFRLGCANLKNHQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM16

<SEQ ID 3224>

MKKYLFRAALCGIAAAILAACQSKSIQTFPQPDTSVINGPGRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

-continued

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM17 <SEQ ID 3225>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM18 <SEQ ID 3226>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM19 <SEQ ID 3227>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM20 <SEQ ID 3228>

MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM21

<SEQ ID 3229>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSRFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKSYMRQNPQRLAEVLGQNPSYIFFRELAGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM22

<SEQ ID 3230>
MKKYLFRAALCGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSVQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGRYMADKGYL
KLGQTSMQGIKAYMQQNPQRLAEVLGQNPSYIFFRELTGSSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM23ASBC

<SEQ ID 3231>
MKKYLFRAALYGIAAAILAACQSKSIQTFPQPDTSVINGPDRPVGIPDPAGTTVGGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNAGGTHTADLSRFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELAGSSNDGPVGALGTPLMGEYAGA
VDRHYITLGAPLFVATAHPVTSKALNRLIMAQDTGSAIKGAVRVDYFWGYGDEAGETAGK
MKEPGYVWQLLPNGMKPEYRP*

ZM24

<SEQ ID 3232>
MKKYLFRAALCGIAAAILAACQSKSIQTFPQPDTSVINGPDRPVGIPAPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA
LVRIRQTGKNSGTIDNTGGTHTADLSQFPITARTTAIKGRFEGSRFLPYHTRNQINGGAL
DGKAPILGYAEDPVELFFMHIQGSGRLKTPSGKYIRIGYADKNEHPYVSIGKYMADKGYL
KLGQTSMQGIKSYMRQNPQRLAEVLGQNPSYIFFRELTGSNDGPVGALGTPLMGEYAGA
VDRHYITLGAPLFVATAHPVTRKALNRLIMAQDTGSAIKGAVRVDYFWGYGDEAGELAGK
QKTTGYVWQLLPNGMKPEYRP*

ZM25

<SEQ ID 3233>
MKKYLFRAALCGIAAAILAACQSKSIQTFPQPDTSVINGPDRPVGIPAPAGTTVAGGGAV
YTVVPHLSLPHWAAQDFAKSLQSFRLGCANLKNRQGWQDVCAQAFQTPVHSFQAKQFFER
YFTPWQVAGNGSLAGTVTGYYEPVLKGDDRRTAQARFPIYGIPDDFISVPLPAGLRSGKA

```
LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGKYMADKGYL

KLGQTSMQGIKSYMRQNPQRLAEVLGQNPSYIFFRELTGSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM26                                              <SEQ ID 3234>
MKKYLFRAALYGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSVQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMQQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM27BC                                            <SEQ ID 3235>
MKKYLFRAALYGISAAILAACQSKSIQTFPQPDTSVINGPDRPAGIPDPAGTTVAGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELTGSSNDGPVGALGTPLMGEYAGA

VDRHYITLGAPLFVATAHPVTRKALNRLIMAQDTGSAIKGAVRVDYFWGYGDEAGETAGK

MKEPGYVWQLLPNGMKPEYRP*

ZM28                                              <SEQ ID 3236>
MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM29ASBC                                          <SEQ ID 3237>
MKKYLFRAALCGIAAAILAACQSKSIQTFPQPDTSVINGPDRPVGIPDPAGTTVGGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSQFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPQRLAEVLGQNPSYIFFRELTGSGNDGPVGALGTPLMGEYAGA

VDRHYITLGAPLFVATTHPITRKALNRLIMAQDTGSAIKGAVRVDYFWGYGDEAGELAGK

QKTTGYVWQLLPNGMKPEYRP*
```

ZM31ASBC
<SEQ ID 3238>
MKKHLFRAALYGIAAAILAACQSKSIQTFPQPDTSIIKGPDRPAGIPDPAGTTVGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYVFFRELAGSGNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

ZM32ASBC
<SEQ ID 3239>
MKKHLLRSALYGIAAAILAACQSRSIQTFPQPDTSVINGPDRPAGIPDPAGTTVAGGGAV

YTVVPHLSMPHWAAQDFAKSLQSFRLGCANLKNRQGWQDVCAQAFQTPVHSFQAKRFFER

YFTPWQVAGNGSLAGTVTGYYEPVLKGDGRRTERARFPIYGIPDDFISVPLPAGLRGGKA

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSGGDGPVGALGTPLMGGYAGA

IDRHYITLGAPLFVATAHPVTRKALNRLIMAQDTGSAIKGAVRVDYFWGYGDEAGELAGK

QKTTGYVWQLLPNGMKPEYRP*

ZM33ASBC
<SEQ ID 3240>
MKKHLLRSALYGIAAAILAACQSRSIQTFPQPDTSVINGPDRPAGIPDPAGTTVAGGGAV

YTVVPHLSMPHWAAQDFAKSLQSFRLGCANLKNRQGWQDVCAQAFQTPIHSFQAKRFFER

YFTPWQVAGNGSLAGTVTGYYEPVLKGDGRRTERARFPIYGIPDDFISVPLPAGLRGGKN

LVRIRQTGKNSGTIDNAGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKSYMRQNPHKLAEVLGQNPSYIFFRELAGSGNEGPVGALGTPLMGEYAGA

IDRHYITLGAPLFVATAHPVTRKALNRLIMAQDTGSAIKGAVRVDYFWGYGDEAGELAGK

QKTTGYVWQLLPNGMKPEYRP*

ZM96
<SEQ ID 3241>
MKKYLFRAALYGIAAAILAACQSKSIQTFPQPDTSVINGPDRPVGIPDPAGTTVGGGAV

YTVVPHLSLPHWAAQDFAKSLQSFRLGCANLKNRQGWQDVCAQAFQTPVHSFQAKQFFER

YFTPWQVAGNGSLAGTVTGYYEPVLKGDDRRTAQARFPIYGIPDDFISVPLPAGLRSGKA

LVRIRQTGKNSGTIDNTGGTHTADLSRFPITARTTAIKGRFEGSRFLPYHTRNQINGGAL

DGKAPILGYAEDPVELFFMHIQGSGRLKTPSGKYIRIGYADKNEHPYVSIGRYMADKGYL

KLGQTSMQGIKAYMRQNPQRLAEVLGQNPSYIFFRELAGSSNDGPVGALGTPLMGEYAGA

VDRHYITLGAPLFVATAHPVTRKALNRLIMAQDTGSAIKGAVRVDYFWGYGDEAGELAGK

QKTTGYVWQLLPNGMKPEYRP*

FIG. 23 shows the results of aligning the sequences of each of these strains. Dark shading indicates regions of homology, and gray shading indicates the conservation of amino acids with similar characteristics. As is readily discernible, there is significant conservation among the various strains of ORF 225, further confirming its utility as an antigen for both vaccines and diagnostics.

Example 16

Using the above-described procedures, the following oligonucleotide primers were employed in the polymerase chain reaction (PCR) assay in order to clone the ORFs as indicated:

TABLE 7

Oligonucleotides used for PCR to amplify complete or partial ORFs

| ORF | SEQ ID | primer | Sequence | Restriction sites |
|---|---|---|---|---|
| 001 | 3300 | Forward | CGCGGATCCCATATG-TGGATGGTGCTGGTCAT | BamHI-NdeI |
|  | 3301 | Reverse | CCCGCTCGAG-TGCCGTCTTGTCCCAC | XhoI |
| 003 | 3302 | Forward | CGCGGATCCCATATG-GTCGTATTCGTGGC | BamHI-NdeI |
|  | 3303 | Reverse | CCCGCTCGAG-AAAATCATGAACACGCGC | XhoI |
| 005 | 3304 | Forward | CGCGGATCCCATATG-GACAATATTGACATGT | BamHI-NdeI |
|  | 3305 | Reverse | CCCGCTCGAG-CATCACATCCGCCCG | XhoI |
| 006 | 3306 | Forward | CGCGGATCCCATATG-CTGCTGGTGCTGG | BamHI-NdeI |
|  | 3307 | Reverse | CCCGCTCGAG-AGTTCCGGCTTTGATGT | XhoI |
| 007 | 3308 | Forward | CGCGGATCCCATATG-GCCGACAACAGCATCAT | BamHI-NdeI |
|  | 3309 | Reverse | CCCGCTCGAG-AAGGCGTTCATGATATAAG | XhoI |
| 008 | 3310 | Forward | CGCGGATCCCATATG-AACAACAGACATTTTG | BamHI-NdeI |
|  | 3311 | Reverse | CCCGCTCGAG-CCTGTCCGGTAAAAGAC | XhoI |
| 009 | 3312 | Forward | CGCGGATCCCATATG-CCCCGCGCTGCT | BamHI-NdeI |
|  | 3313 | Reverse | CCCGCTCGAG-TGGCTTTTGCCACGTTTT | XhoI |
| 011 | 3314 | Forward | CGCGGATCCCATATG-AAGACACACCGCAAG | BamHI-NdeI |
|  | 3315 | Reverse | CCCGCTCGAG-GGCGGTCAGTACGGT | XhoI |
| 012 | 3316 | Forward | CGCGGATCCCATATG-CTCGCCCGTTGCC | BamHI-NdeI |
|  | 3317 | Reverse | CCCGCTCGAG-AGCGGGGAAGAGGCAC | XhoI |
| 013 | 3318 | Forward | CGCGGATCCCATATG-CCTTTGACCATGCT | BamHI-NdeI |
|  | 3319 | Reverse | CCCGCTCGAG-CTGATTCGGCAAAAAATCT | XhoI |
| 018 | 3320 | Forward | CGCGGATCCCATATG-CAGCAGAGGCAGTT | BamHI-NdeI |
|  | 3321 | Reverse | CCCGCTCGAG-GACGAGGCGAACGCC | XhoI |
| 019 | 3322 | Forward | AAAGAATTC-CTGCCAGCCGGCAAGACCCCGGC | Eco RI |
|  | 3323 | Reverse | AAACTGCAG-TCAGCGGGCGGGACAATGCCCAT | Pst I |
| 023 | 3324 | Forward | AAAGAATTC-AAAGAATATTCGGCATGGCAGGC | Eco RI |
|  | 3325 | Reverse | AAACTGCAG-TTACCCCCAAATCACTTTAACTGA | Pst I |
| 025 | 3326 | Forward | AAAGAATTC-TGCGCCACCCAACAGCCTGCTCC | Eco RI |
|  | 3327 | Reverse | AAACTGCAG-TCAGAACGCGATATAGCTGTTCGG | Pst I |
| 031 | 3328 | Forward | CGCGGATCCCATATG-GTCTCCCTTCGCTT | BamHI-NdeI |
|  | 3329 | Reverse | CCCGCTCGAG-ATGTAAGACGGGGACAAC | XhoI |
| 032 | 3330 | Forward | CGCGGATCCCATATG-CGGCGAAACGTGC | BamHI-NdeI |
|  | 3331 | Reverse | CCCGCTCGAG-CTGGTTTTTTGATATTTGTG | XhoI |
| 033 | 3332 | Forward | CGCGGATCCCATATG-GCGGCGGCAGACA | BamHI-NdeI |
|  | 3333 | Reverse | CCCGCTCGAG-ATTTGCCGCATCCCGAT | XhoI |
| 034 | 3334 | Forward | CGCGGATCCCATATG-GCCGAAAACAGCTACGG | BamHI-NdeI |
|  | 3335 | Reverse | CCCGCTCGAG-TTTGACGATTTGGTTCAATT | XhoI |
| 036 | 3336 | Forward | CGCGGATCCCATATG-CTGAAGCCGTGCG | BamHI-NdeI |
|  | 3337 | Reverse | CCCGCTCGAG-CCGGACTGCGTATCGG | XhoI |
| 038 | 3338 | Forward | CGCGGATCCCATATG-ACCGATTTCCGCCA | BamHI-NdeI |
|  | 3339 | Reverse | CCCGCTCGAG-TTCTACGCCGTACTGCC | XhoI |
| 039 | 3340 | Forward | CGCGGATCCCATATG-CCGTCCGAACCGC | BamHI-NdeI |
|  | 3341 | Reverse | CCCGCTCGAG-TAGGATGACGAGGTAGG | XhoI |
| 041 | 3342 | Forward | CGCGGATCCCATATG-TTCGTGCGCGAACCG | BamHI-NdeI |
|  | 3343 | Reverse | CCCGCTCGAG-GCCCAAAAACTCTTTCAAA | XhoI |

TABLE 7-continued

Oligonucleotides used for PCR to amplify complete or partial ORFs

| ORF | SEQ ID | primer | Sequence | Restriction sites |
|---|---|---|---|---|
| 042 | 3344 | Forward | CGC<u>GGATCCCATATG</u>-ACGATGATTTGCTTGC | BamHI-NdeI |
|  | 3345 | Reverse | CCCG<u>CTCGAG</u>-TTTGCAGCCTGCATTTGAC | XhoI |
| 043 | 3346 | Forward | AAAAAA<u>GGTACC</u>-ATGGTTGTTTCAAATCAAAATATC | Kpn I |
|  | 3347 | Reverse | AAA<u>CTGCAG</u>-TTATTGCGCTTCACCTTCCGCCGC | Pst I |
| 043a | 3348 | Forward | AAAAAA<u>GGTACC</u>-GCAAAAGTGCATGGCGGCTTGGACGGTGC | Kpn I |
|  | 3349 | Reverse | AAAAAA<u>CTGCAG</u>-TTAATCCTGCAACACGAATTCGCCCGTCCG | Pst I |
| 044 | 3350 | Forward | CGC<u>GGATCCCATATG</u>-CCGTCCGACTAGAG | BamHI-NdeI |
|  | 3351 | Reverse | CCCG<u>CTCGAG</u>-ATGCGCTACGGTAGCCA | XhoI |
| 046 | 3352 | Forward | AAA<u>GAATTC</u>-ATGTCGGCAATGCTCCCGACAAG | Eco RI |
|  | 3353 | Reverse | AAA<u>CTGCAG</u>-TCACTCGGCGACCCACACCGTGAA | Pst I |
| 047 | 3354 | Forward | CGC<u>GGATCCCATATG</u>-GTCATCATACAGGCG | BamHI-NdeI |
|  | 3355 | Reverse | CCCG<u>CTCGAG</u>-TCCGAAAAGCCCATTTTG | XhoI |
| 048 | 3356 | Forward | AAA<u>GAATTC</u>-ATGCTCAACAAAGGCGAAGAATTGCC | Eco RI |
|  | 3357 | Reverse | AAA<u>CTGCAG</u>-TCAAGATTCGACGGGGATGATGCC | Pst I |
| 049 | 3358 | Forward | AAA<u>GAATTC</u>-ATGGGGCGCAGGCGTTTGATCAGCC | Eco RI |
|  | 3359 | Reverse | AAA<u>CTGCAG</u>-AAGGCGTATCTGAAAAAATGGCAG | Pst I |
| 050 | 3360 | Forward | CGC<u>GGATCCCATATG</u>-GGCGCGGGCTGG | BamHI-NdeI |
|  | 3361 | Reverse | CCCG<u>CTCGAG</u>-AATCGGGCCATCTTCGA | XhoI |
| 052 | 3362 | Forward | AAAAAA<u>GAATTC</u>-ATGGCTTTGGTGGCGGAGGAAAC | Eco RI |
|  | 3363 | Reverse | AAAAAA<u>GTCGAC</u>-TCAGGCGGCGTTTTTCACCTTCCT | Sal I |
| 052a | 3364 | Forward | AAAAAA<u>GAATTC</u>-GTGGCGGAGGAAACGGAAATATCCGC | Eco RI |
|  | 3365 | Reverse | AAAAAA<u>CTGCAG</u>-TTAGCTGTTTTTGGAAACGCCGTCCAACCC | Pst I |
| 073 | 3366 | Forward | CGC<u>GGATCCCATATG</u>-TGTATGCCATATAAGAT | BamHI-NdeI |
|  | 3367 | Reverse | CCCG<u>CTCGAG</u>-CACCGGATTGTCCGAC | XhoI |
| 075 | 3368 | Forward | CGC<u>GGATCCCATATG</u>-CCGTCTTACTTCATC | BamHI-NdeI |
|  | 3369 | Reverse | CCCG<u>CTCGAG</u>-ATCACCAATGCCGATTATTT | XhoI |
| 077a | 3370 | Forward | AAAAAA<u>GAATTC</u>-GGCGGCATTTTCATCGACACCTTCCT | Eco RI |
|  | 3371 | Reverse | AAAAAA<u>CTGCAG</u>-TCAGACGAACATCTGCACAAACGCAAT | Pst I |
| 080 | 3372 | Forward | AAA<u>GAATTC</u>-GCGTCCGGGCTGGTTTGGTTTTACAATTC | Eco RI |
|  | 3373 | Reverse | AAA<u>CTGCAG</u>-CTATTCTTCGGATTCTTTTTCGGG | Pst I |
| 081 | 3374 | Forward | AAA<u>GAATTC</u>-ATGAAACCACTGGACCTAAATTTCATCTG | Eco RI |
|  | 3375 | Reverse | AAA<u>CTGCAG</u>-TCACTTATCCTCCAATGCCTC | Pst I |
| 082 | 3376 | Forward | AAA<u>GAATTC</u>-ATGTGGTTGTTGAAGTTGCCTGC | Eco RI |
|  | 3377 | Reverse | AAA<u>CTGCAG</u>-TTACGCGGATTCGGCAGTTGG | Pst I |
| 084 | 3378 | Forward | AAA<u>GAATTC</u>-TATCACCCAGAATATGAATACGGCTACCG | Eco RI |
|  | 3379 | Reverse | AAA<u>CTGCAG</u>-TTATACTTGGGCGCAACATGA | Pst I |
| 085 | 3380 | Forward | CGC<u>GGATCCCATATG</u>-GGTAAAGGGCAGGACT | BamHI-NdeI |
|  | 3381 | Reverse | CCCG<u>CTCGAG</u>-CAAAGCCTTAAACGCTTCG | XhoI |
| 086 | 3382 | Forward | AAAAAA<u>GGTACC</u>-TATTTGGCATCAAAAGAAGGCGG | Kpn I |
|  | 3383 | Reverse | AAA<u>CTGCAG</u>-TTACTCCACCCGATAACCGCG | Pst I |
| 087 | 3384 | Forward | AAA<u>GAATTC</u>-ATGGGCGGTAAAACCTTTATGC | Eco RI |
|  | 3385 | Reverse | AAA<u>CTGCAG</u>-TTACGCCGCACACGCAATCGC | Pst I |
| 087a | 3386 | Forward | AAAAAAA<u>GAATTC</u>-AAGCTATTAGGCGTGCCGATTGTGATTCA | Eco RI |
|  | 3387 | Reverse | AAAAAA<u>CTGCAG</u>-TTACGCCTGCAAGATGCCCAGCTTGCC | Pst I |
| 088 | 3388 | Forward | AAAAAA<u>GAATTC</u>-ATGTTTTTATGGCTCGCACATTTCAG | Eco RI |
|  | 3389 | Reverse | AAAAAA<u>CTGCAG</u>-TCAGCGGATTTTGAGGGTACTCAAACC | Pst I |
| 089 | 3390 | Forward | CGC<u>GGATCCCATATG</u>-CCGCCCAAAATCAC | BamHI-NdeI |
|  | 3391 | Reverse | CCCG<u>CTCGAG</u>-TGCGCATACCAAAGCCA | XhoI |
| 090 | 3392 | Forward | CGC<u>GGATCCCATATG</u>-CGCATAGTCGAGCA | BamHI-NdeI |
|  | 3393 | Reverse | CCCG<u>CTCGAG</u>-AGCAAAACGGCGGTACG | XhoI |
| 091 | 3394 | Forward | AAA<u>GAATTC</u>-ATGGAAATACCCGTACCGCCGAGTCC | Eco RI |
|  | 3395 | Reverse | AAA<u>CTGCAG</u>-TCAGCGCAGGGGGTAGCCCAAGCC | Pst I |
| 092 | 3396 | Forward | AAA<u>GAATTC</u>-ATGTTTTTTATTTCAATCCG | Eco RI |
|  | 3397 | Reverse | AAA<u>CTGCAG</u>-TCAAATCTGTTTCGACAATGC | Pst I |
| 093 | 3398 | Forward | AAA<u>GAATTC</u>-ATGCAGAATTTTGGCAAAGTGGC | Eco RI |
|  | 3399 | Reverse | AAA<u>CTGCAG</u>-CTATGGCTCGTCATACCGGGC | Pst I |
| 094 | 3400 | Forward | AAA<u>GAATTC</u>-ATGCCGTCACGGAAGCGCATCAACTC | Eco RI |
|  | 3401 | Reverse | AAA<u>CTGCAG</u>-TTATCCCGGCCATACCGCCGAACA | Pst I |
| 095 | 3402 | Forward | AAA<u>GAATTC</u>-ATGTCCTTTCATTTGAACATGGACGG | Eco RI |
|  | 3403 | Reverse | AAA<u>CTGCAG</u>-TCAACGCCGCAGGCACTAACGCCC | Pst I |
| 096 | 3404 | Forward | AAA<u>GAATTC</u>-ATGCTCGTCATACCGGGCAGGG | Eco RI |
|  | 3405 | Reverse | AAA<u>CTGCAG</u>-TCAAAGGAAAAGGCCGTCTGAAAAGCG | Pst I |
| 097 | 3406 | Forward | AAA<u>GAATTC</u>-ATGGACACTTCAAAACAAACACTGTTG | Eco RI |
|  | 3407 | Reverse | AAA<u>CTGCAG</u>-TCAGCCCAAATACCAGAATTTCAG | Pst I |

TABLE 7-continued

Oligonucleotides used for PCR to amplify complete or partial ORFs

| ORF | SEQ ID | primer | Sequence | Restriction sites |
|---|---|---|---|---|
| 098 | 3408 | Forward | AAAGAATTC-GATGAACGCAGCCCAGCATGGATACG | Eco RI |
|  | 3409 | Reverse | AAACTGCAG-TTACGACATTCTGATTTGGCA | Pst I |
| 102 | 3410 | Forward | AAAAAAGAATTC-GGCCTGATGATTTTGGAAGTCAACAC | Eco RI |
|  | 3411 | Reverse | AAAAAACTGCAG-TTATCCTTTAAATACGGGGACGAGTTC | Pst I |
| 105 | 3412 | Forward | CGCGGATCCCATATG-TCCGCAAACGAATACG | BamHI-NdeI |
|  | 3413 | Reverse | CCCGCTCGAG-GTGTTCTGCCAGTTTCAG | XhoI |
| 107 | 3414 | Forward | AAAAAGAATTC-CTGATGATTTTGGAAGTCAACACCCATTATCC | Eco RI |
|  | 3415 | Reverse | AAAAAACTGCAG-TTATCCTTTAAATACGGGGACGAGTTC | Pst I |
| 107b | 3416 | Forward | AAAAAAGAATTC-GATACCCAAGCCCCCGCCGGCACAAACTACTG | Eco RI |
|  | 3417 | Reverse | AAAAAACTGCAG-TTACGCGTCGCCTTTAAAGTATTTGAGCAGGCTGGAGAC | Pst I |
| 108 | 3418 | Forward | AAAGAATTC-ATGTTGCCGGGCTTCAACCG | Eco RI |
|  | 3419 | Reverse | AAACTGCAG-TTAGCGGTACAGGTGTTTGAAGCA | Pst I |
| 108a | 3420 | Forward | AAAAAAGAATTC-GGTAACACATTCGGCAGCTTAGACGGTGG | Eco RI |
|  | 3421 | Reverse | AAACTGCAG-TTAGCGGTACAGGTGTTTGAAGCA | Pst I |
| 109 | 3422 | Forward | AAAGAATTC-ATGTATTATCGCCGGGTTATGGG | Eco RI |
|  | 3423 | Reverse | AAACTGCAG-CTAGCCCAAAGATTTGAAGTGTTC | Pst I |
| 111 | 3424 | Forward | CGCGGATCCCATATG-TGTTCGGAACAAACCGC | BamHI-NdeI |
|  | 3425 | Reverse | CCCGCTCGAG-GCGGAGCAGTTTTTCAAA | XhoI |
| 114 | 3426 | Forward | CGCGGATCCCATATG-GCTTCCATCACTTCGC | BamHI-NdeI |
|  | 3427 | Reverse | CCCGCTCGAG-CATCCGCGAAATCGTC | XhoI |
| 117 | 3428 | Forward | AAAAAAGGTACC-ATGGTCGAAGAACTGGAACTGCTG | Kpn I |
|  | 3429 | Reverse | AAACTGCAG-TTAAAGCCGGGTAACGCTCAATAC | Pst I |
| 118 | 3430 | Forward | AAAGTCGAC-ATGTGTGAGTTCAAGGATATTATAAG | Sal I |
|  | 3431 | Reverse | AAAGCATGC-CTATTTTTTGTTGTAATAATCAAATC | Sph I |
| 121 | 3432 | Forward | CGCGGATCCCATATG-GAAACACAGCTTTACAT | BamHI-NdeI |
|  | 3433 | Reverse | CCCGCTCGAG-ATAATAATATCCCGCGCCC | XhoI |
| 122 | 3434 | Forward | CGCGGATCCCATATG-GTCATGATTAAAATCCGCA | BamHI-NdeI |
|  | 3435 | Reverse | CCCGCTCGAG-AATCTTGGTAGATTGGATTT | XhoI |
| 125 | 3436 | Forward | AAAGAATTC-ATGTCGGGCAATGCCTCCTCC | Eco RI |
|  | 3437 | Reverse | AAACTGCAG-TCACGCCGTTTCAAGACG | Pst I |
| 125a | 3438 | Forward | AAAAAAGAATTC-ACGGCAGGCAGCACCGCCGCACAGGTTTC | Eco RI |
|  | 3439 | Reverse | AAAAAACTGCAG-TTATTTTGCCACGTCGGTTTCTCCGGTGAACAACGC | Pst I |
| 126 | 3440 | Forward | CGCGGATCCCATATG-CCGTCTGAAACCC | BamHI-NdeI |
|  | 3441 | Reverse | CCCGCTCGAG-ATATTCCGCCGAATGCC | XhoI |
| 127 | 3442 | Forward | AAAGAATTC-ATGGAAATATGGAATATGTTGGACACTTG | Eco RI |
|  | 3443 | Reverse | AAACTGCAG-TTAAAGTGTTTCGGAGCCGGC | Pst I |
| 127a | 3444 | Forward | AAAAAAGAATTC-AAGGAACTGATTATGTGTCTGTCGGG | Eco RI |
|  | 3445 | Reverse | AAACTGCAG-TTAAAGTGTTTCGGAGCCGGC | Pst I |
| 128 | 3446 | Forward | CGCGGATCCCATATG-ACTGACAACGCACT | BamHI-NdeI |
|  | 3447 | Reverse | CCCGCTCGAG-GACCGCGTTGTCGAAA | XhoI |
| 130 | 3448 | Forward | CGCGGATCCCATATG-AAACAACTCCGCGA | BamHI-NdeI |
|  | 3449 | Reverse | CCCGCTCGAG-GAATTTTGCACCGGATTG | XhoI |
| 132 | 3450 | Forward | AAAGAATTC-ATGGAACCCTTCAAAACCTTAATTTG | Eco RI |
|  | 3451 | Reverse | AAAAAACTGCAG-TCACCATGTCGGCATTTGAAAAAC | Pst I |
| 134 | 3452 | Forward | CGCGGATCCCATATG-TCCCAAGAAATCCTC | BamHI-NdeI |
|  | 3453 | Reverse | CCCGCTCGAG-CAGTTTGACCGAATGTTC | XhoI |
| 135 | 3454 | Forward | CGCGGATCCCATATG-AAATACAAAGAATCGTATT | BamHI-NdeI |
|  | 3455 | Reverse | CCCGCTCGAG-AAATTCGGTCAGAAGCAGG | XhoI |
| 137 | 3456 | Forward | AAAAAAGGTACC-ATGATTACCCATCCCCAATTCGATCC | Kpn I |
|  | 3457 | Reverse | AAAAAACTGCAG-TCAGTGCTGTTTTTTCATGCCGAA | Pst I |
| 137a | 3458 | Forward | AAAAAAGAATTC-GGCCGCAAACACGGCATCGGCTTCCT | Eco RI |
|  | 3459 | Reverse | AAAAAACTGCAG-TTAAGCGGATGACGCGGCAGCATACC | Pst I |
| 138 | 3460 | Forward | AAAAAAGAATTC-AACTCAGGCGAAGGAGTGCTTGTGGC | Eco RI |
|  | 3461 | Reverse | AAAAAATCTAGA-TCAGTTTAGGGATAGCAGGCGTAC | Xba I |
| 141 | 3462 | Forward | AAAGAATTC-ATGAGCTTCAAAACCGATGCCGAAATCGC | Eco RI |
|  | 3463 | Reverse | AAACTGCAG-TCAGAACAAGCCGTGAATCACGCC | Pst I |
| 142 | 3464 | Forward | CGCGGATCCCATATG-CGTGCCGATTTCATG | BamHI-NdeI |
|  | 3465 | Reverse | CCCGCTCGAG-AAACTGCTGCACATGGG | XhoI |
| 143 | 3466 | Forward | AAAAAAGAATTC-ATGCTCAGTTTCGGCTTTCTCGGCGTTCAGAC | Eco RI |
|  | 3467 | Reverse | AAAAAACTGCAG-TCAAACCCCGCCGTGTGTTTCTTTAAT | Pst I |

TABLE 7-continued

Oligonucleotides used for PCR to amplify complete or partial ORFs

| ORF | SEQ ID | primer | Sequence | Restriction sites |
|---|---|---|---|---|
| 144 | 3468 | Forward | AAAAAAGAATTC-GGTCTGATCGACGGGCGTGCCGTAAC | Eco RI |
| | 3469 | Reverse | AAAAAATCTAGA-TCGGCATCGGCCGGCATATGTCCG | Xba I |
| 146 | 3470 | Forward | AAAAAAGAATTC-CGCCAAGTCGTCATTGACCACGACAAAGTC | Eco RI |
| | 3471 | Reverse | AAAAAACTGCAG-TTAGGCATCGGCAAATAGGAAACTGGG | Pst I |
| 147 | 3472 | Forward | AAAAAAGAATTC-ACTGAGCAATCGGTGGATTTGGAAAC | Eco RI |
| | 3473 | Reverse | AAAAAATCTAGA-TTAGGTAAAGCTGCGGCCCATTTGCGG | Xba I |
| 148 | 3474 | Forward | AAAAAAGAATTC-ATGGCGTTAAAAACATCAAACTTGGAACACGC | Eco RI |
| | 3475 | Reverse | AAAAAATCTAGA-TCAGCCCTTCATACAGCCTTCGTTTTG | Xba I |
| 149 | 3476 | Forward | CGCGGATCCCATATG-CTGCTTGACAACAAAGT | BamHI-NdeI |
| | 3477 | Reverse | CCCGCTCGAG-AAACTTCACGTTCACGCC | XhoI |
| 150 | 3478 | Forward | CGCGGATCCCATATG-CAGAACACAAATCCG | BamHI-NdeI |
| | 3479 | Reverse | CCCGCTCGAG-ATAAACATCACGCTGATAGC | XhoI |
| 151 | 3480 | Forward | AAAAAAGAATTC-ATGAAACAAATCCGCAACATCGCCATCATCGC | Eco RI |
| | 3481 | Reverse | AAAAAACTGCAG-TCAATCCAGCTTTTTAAAGTGGCGGCG | Pst I |
| 152 | 3482 | Forward | AAAAAAGAATTC-ATGAAAAACAAAACCAAAGTCTGGGACCTCCC | Eco RI |
| | 3483 | Reverse | AAAAAACTGCAG-TCAGGACAGGAGCAGGATGGCGGC | Pst I |
| 153 | 3484 | Forward | AAAAAAGAATTC-ATGGCGTTTGCTTACGGTATGAC | Eco RI |
| | 3485 | Reverse | AAAAAACTGCAG-TCAGTCATGTTTTTCCGTTTCATT | Pst I |
| 153a | 3486 | Forward | AAAAAAGAATTC-CGGACTTCGGTATCGGTTCCCCAGCATTG | Eco RI |
| | 3487 | Reverse | AAAAAACTGCAG-TTACGCCGACGAAATACTCAGACTTTTCGG | Pst I |
| 154 | 3488 | Forward | CGCGGATCCCATATG-ACTGACAACAGCCC | BamHI-NdeI |
| | 3489 | Reverse | CCCGCTCGAG-TCGGCTTCCTTTCGGG | XhoI |
| 155 | 3490 | Forward | AAAAAAGAATTC-ATGAAAATCGGTATCCCACGCGAGTC | Eco RI |
| | 3491 | Reverse | AAAAAACTGCAG-TTACCCTTTCTTAAACATATTCAGCAT | Pst I |
| 156 | 3492 | Forward | AAAAAAGAATTC-GCACAGCAAAACGGTTTTGAAGC | Eco RI |
| | 3493 | Reverse | AAAAAACTGCAG-TCAAGCAGCCGCGACAAACAGCCC | Pst I |
| 157 | 3494 | Forward | CGCGGATCCCATATG-AGGAACGAGGAAAAAC | BamHI-NdeI |
| | 3495 | Reverse | CCCGCTCGAG-AAAACACAATATCCCCGC | XhoI |
| 158 | 3496 | Forward | AAAAAAGAATTC-GCGGAGCAGTTGGCGATGGCAAATTCTGC | Eco RI |
| | 3497 | Reverse | AAAAAATCTAGA-TTATCCACAGAGATTGTTTCCCAGTTC | Xba I |
| 160 | 3498 | Forward | CGCGGATCCCATATG-GACATTCTGGACAAAC | BamHI-NdeI |
| | 3499 | Reverse | CCCGCTCGAG-TTTTTGCCCGCCTTCTTT | XhoI |
| 163 | 3500 | Forward | AAAAAAGGTACC-ACCGTGCCGGATCAGGTGCAGATGTG | Kpn I |
| | 3501 | Reverse | AAAAAATCTAGA-TTACTCTGCCAATTCCACCTGCTCGTG | Xba I |
| 163a | 3502 | Forward | AAAAAAGAATTC-CGGCTGGTGCAGATAATGAGCCAGAC | Eco RI |
| | 3503 | Reverse | AAAAAATCTAGA-TTACTCTGCCAATTCCACCTGCTCGTG | Xba I |
| 164 | 3504 | Forward | CGCGGATCCCATATG-AACCGGACTTATGCC | BamHI-NdeI |
| | 3505 | Reverse | CCCGCTCGAG-TTTGTTTCCGTCAAACTGC | XhoI |
| 165 | 3506 | Forward | CGCGGATCCGCTAGC-GCTGAAGCGACAGACG | BamHI-NheI |
| | 3507 | Reverse | CCCGCTCGAG-AATATCCAATACTTTCGCG | XhoI |
| 206 | 3508 | Forward | CGCGGATCCCATATG-AAACACCGCCAACCGA | BamHI-NdeI |
| | 3509 | Reverse | CCCGCTCGAG-TTCTGTAAAAAAGTATGTGC | XhoI |
| 209 | 3510 | Forward | CGCGGATCCCATATG-CTGCGGCATTTAGGA | BamHI-NdeI |
| | 3511 | Reverse | CCCGCTCGAG-TACCCCTGAAGGCAAC | XhoI |
| 211 | 3512 | Forward | AAAAAAGAATTC-ATGTTGCGGGTTGCTGCTGC | Eco RI |
| | 3513 | Reverse | AAAAAACTGCAG-CTATCCTGCGGATTGGCATTGAAA | Pst I |
| 212 | 3514 | Forward | CGCGGATCCCATATG-GACAATCTCGTATGG | BamHI-NdeI |
| | 3515 | Reverse | CCCGCTCGAG-AGGGGTTAGATCCTTCC | XhoI |
| 215 | 3516 | Forward | CGCGGATCCCATATG-GCATGGTTGGGTCGT | BamHI-NdeI |
| | 3517 | Reverse | CCCGCTCGAG-CATATCTTTTGTATCATAAATC | XhoI |
| 216 | 3518 | Forward | CGCGGATCCCATATG-GCAATGGCAGAAAACG | BamHI-NdeI |
| | 3519 | Reverse | CCCGCTCGAG-TACAATCCGTGCCGCC | XhoI |
| 217 | 3520 | Forward | CGCGGATCCCATATG-GCGGATGACGGTGTG | BamHI-NdeI |
| | 3521 | Reverse | CCCGCTCGAG-ACCCCGAATATCGAATCC | XhoI |
| 218 | 3522 | Forward | CGCGGATCCCATATG-GTCGCGGTCGATC | BamHI-NdeI |
| | 3523 | Reverse | CCCGCTCGAG-TAACTCATAGAATCCTGC | XhoI |

TABLE 7-continued

Oligonucleotides used for PCR to amplify complete or partial ORFs

| ORF | SEQ ID | primer | Sequence | Restriction sites |
|---|---|---|---|---|
| 219 | 3524 | Forward | CGCGGATCCGCTAGC-ACGGCAAGGTTAAG | BamHI-NheI |
|  | 3525 | Reverse | CCCGCTCGAG-TTTAAACCATCTCCTCAAAAC | XhoI |
| 223 | 3526 | Forward | CGCGGATCCCATATG-GAATTCAGGCACCAAGTA | BamHI-NdeI |
|  | 3527 | Reverse | CCCGCTCGAG-GGCTTCCCGCGTGTC | XhoI |
| 225 | 3528 | Forward | CGCGGATCCCATATG-GACGAGTTGACCAACC | BamHI-NdeI |
|  | 3529 | Reverse | CCCGCTCGAG-GTTCAGAAAGCGGGAC | XhoI |
| 226 | 3530 | Forward | AAAGAATTC-CTTGCGATTATCGTGCGCACGCG | Eco RI |
|  | 3531 | Reverse | AAACTGCAG-TCAAAATCCCAAAACGGGGAT | Pst I |
| 228 | 3532 | Forward | CGCGGATCCCATATG-TCGCAAGAAGCCAAACAG | BamHI-NdeI |
|  | 3533 | Reverse | CCCGCTCGAG-TTTGGCGGCATCTTTCAT | XhoI |
| 229 | 3534 | Forward | CGCGGATCCCATATG-CAAGAGGTTTTGCCC | BamHI-NdeI |
|  | 3535 | Reverse | CCCGCTCGAG-ACACAATATAGCGGATGAAC | XhoI |
| 230 | 3536 | Forward | CGCGGATCCCATATG-CATCCGGGTGCCGAC | BamHI-NdeI |
|  | 3537 | Reverse | CCCGCTCGAG-AAGTTTGGCGGCTTCGG | XhoI |
| 232 | 3538 | Forward | AAAAAAGAATTC-ATGTACGCTAAAAAAGGCGGTTTGGG | Eco RI |
|  | 3539 | Reverse | AAAAAACTGCAG-TCAAGGTTTTTTCCTGATTGCCGCCGC | Pst I |
| 232a | 3540 | Forward | AAAAAAGAATTC-GCCAAGGCTGCCGATACACAAATTGA | Eco RI |
|  | 3541 | Reverse | AAAAAACTGCAG-TTAAACATTGTCGTTGCCGCCCAGATG | Pst I |
| 233 | 3542 | Forward | CGCGGATCCCATATG-GCGGACAAACCCAAG | BamHI-NdeI |
|  | 3543 | Reverse | CCCGCTCGAG-GACGGCATTGAGCAG | XhoI |
| 234 | 3544 | Forward | CGCGGATCCCATATG-GCCGTTTCACTGACCG | BamHI-NdeI |
|  | 3545 | Reverse | GCCCAAGCTT-ACGGTTGGATTGCCATG | Hind III |
| 235 | 3546 | Forward | CGCGGATCCCATATG-GCCTGCCAAGTTCAAA | BamHI-NdeI |
|  | 3547 | Reverse | CCCGCTCGAG-TTTGGGCTGCTCTTC | XhoI |
| 236 | 3548 | Forward | CGCGGATCCCATATG-GCGCGTTTCGCCTT | BamHI-NdeI |
|  | 3549 | Reverse | CCCGCTCGAG-ATGGGTCGCGCGCCGT | XhoI |
| 238 | 3550 | Forward | CGCGGATCCGCTAGC-AACGGTTTGGATGCCCG | BamHI-NheI |
|  | 3551 | Reverse | CCCGCTCGAG-TTTGTCTAAGTTCCTGATATG | XhoI |
| 239 | 3552 | Forward | CCGGAATTCTACATATG-CTCCACCATAAAGGTATTG | EcoRI-NdeI |
|  | 3553 | Reverse | CCCGCTCGAG-TGGTGAAGAGCGGTTTAG | XhoI |
| 240 | 3554 | Forward | CGCGGATCCCATATG-GACGTTGGACGATTTC | BamHI-NdeI |
|  | 3555 | Reverse | CCCGCTCGAG-AAACGCCATTACCCGATG | XhoI |
| 241 | 3556 | Forward | CCGGAATTCTACATATG-CCAACACGTCCAACT | EcoRI-NdeI |
|  | 3557 | Reverse | CCCGCTCGAG-GAATGCGCCTGTAATTAATC | XhoI |
| 242 | 3558 | Forward | CGCGGATCCCATATG-ATCGGCAAACTTGTTG | BamHI-NdeI |
|  | 3559 | Reverse | GCCCAAGCTT-ACCGATACGGTCGCAG | HindIII |
| 243 | 3560 | Forward | CGCGGATCCCATATG-ACGATTTTTCGATGCTGC | BamHI-NdeI |
|  | 3561 | Reverse | CCCGCTCGAG-CGACTTGGTTACCGCG | XhoI |
| 244 | 3562 | Forward | CGCGGATCCCATATG-CCGTCTGAAGCCC | BamHI-NdeI |
|  | 3563 | Reverse | CCCGCTCGAG-TTTTTTCGGTAGGGGATTT | XhoI |
| 246 | 3564 | Forward | CGCGGATCCCATATG-GACATCGGCAGTGC | BamHI-NdeI |
|  | 3565 | Reverse | CCCGCTCGAG-CCCGCGCTGCTGGAG | XhoI |
| 247 | 3566 | Forward | CGCGGATCCCATATG-GTCGGATCGAGTTAC | BamHI-NdeI |
|  | 3567 | Reverse | CCCGCTCGAG-AAGTGTTCTGTTTGCGCA | XhoI |
| 248 | 3568 | Forward | CGCGGATCCCATATG-CGCAAACAGAACACT | BamHI-NdeI |
|  | 3569 | Reverse | CCCGCTCGAG-CTCATCATTATTGCTAACA | XhoI |
| 249 | 3570 | Forward | CGCGGATCCCATATG-AAGAATAATGATTGCTTC | BamHI-NdeI |
|  | 3571 | Reverse | CCCGCTCGAG-TTCCCGACCTCCGAC | XhoI |
| 251 | 3572 | Forward | CGCGGATCCCATATG-CGTGCTGCGGTAGT | BamHI-NdeI |
|  | 3573 | Reverse | CCCGCTCGAG-TACGAAAGCCGGTCGTG | XhoI |
| 253 | 3574 | Forward | AAAAAAGAATTC-ATGATTGACAGGAACCGTATGCTGCG | Eco RI |
|  | 3575 | Reverse | AAAAAACTGCAG-TTATTGGTCTTTCAAACGCCCTTCCTG | Pst I |

TABLE 7-continued

Oligonucleotides used for PCR to amplify complete or partial ORFs

| ORF | SEQ ID | primer | Sequence | Restriction sites |
|---|---|---|---|---|
| 253a | 3576 | Forward | AAAAAAGAATTC-AAAATCCTTTTGAAAACAAGCGAAAACGG | Eco RI |
|  | 3577 | Reverse | AAAAAACTGCAG-TTATTGGTCTTTCAAACGCCCTTCCTG | Pst I |
| 254 | 3578 | Forward | AAAAAAGAATTC-ATGTATACAGGCGAACGCTTCAATAC | Eco RI |
|  | 3579 | Reverse | AAAAAATCTAGA-TCAGATTACGTAACCGTACACGCTGAC | Xba I |
| 255 | 3580 | Forward | CGCGGATCCCATATG-GCCGCGTTGCGTTAC | BamHI-NdeI |
|  | 3581 | Reverse | CCCGCTCGAG-ATCCGCAATACCGACCAG | XhoI |
| 256 | 3582 | Forward | CGCGGATCCGCTAGC-TTTTAACACCGCCGGAC | BamHI-NheI |
|  | 3583 | Reverse | CCCGCTCGAG-ACGCCTGTTTGTGCGG | XhoI |
| 257 | 3584 | Forward | CGCGGATCCCATATG-GCGGTTTCTTTCCTG | BamHI-NdeI |
|  | 3585 | Reverse | CCCGCTCGAG-GCGCGTGAATATCGCG | XhoI |
| 258 | 3586 | Forward | AAAAAAGAATTC-GATTATTTCTGGTGGATTGTTGCGTTCAG | Eco RI |
|  | 3587 | Reverse | AAAAAACTGCAG-CTACGCATAAGTTTTTACCGTTTTTGG | Pst I |
| 258a | 3588 | Forward | AAAAAAGAATTC-GCGAAGGCGGTGGCGCAAGGCGA | Eco RI |
|  | 3589 | Reverse | AAAAAACTGCAG-CTACGCATAAGTTTTTACCGTTTTTGG | Pst I |
| 259 | 3590 | Forward | CGCGGATCCCATATG-GAAGAGCTGCCTCCG | BamHI-NdeI |
|  | 3591 | Reverse | CCCGCTCGAG-GGCTTTTCCGGCGTTT | XhoI |
| 260 | 3592 | Forward | CGCGGATCCCATATG-GGTGCGGGTATGGT | BamHI-NdeI |
|  | 3593 | Reverse | CCCGCTCGAG-AACAGGGCGACACCCT | XhoI |
| 261 | 3594 | Forward | AAAAAAGAATTC-CAAGATACAGCTCGGGCATTCGC | Eco RI |
|  | 3595 | Reverse | AAAAAACTGCAG-TCAAACCAACAAGCCTTGGTCACT | Pst I |
| 263 | 3596 | Forward | CGCGGATCCCATATG-GCACGTTTAACCGTA | BamHI-NdeI |
|  | 3597 | Reverse | CCCGCTCGAG-GGCGTAAGCCTGCAATT | XhoI |
| 264 | 3598 | Forward | AAAAAAGGTACC-GCCGACGCAGTGGTCAAGGCAGAA | Kpn I |
|  | 3599 | Reverse | AAACTGCAG-TCAGCCGGCGGTCAATACCGCCCG | Pst I |
| 265 | 3600 | Forward | AAAAAAGAATTC-GCGGAGGTCAAGAGAAGGTGTTTG | Eco RI |
|  | 3601 | Reverse | AAAAAACTGCAG-TTACGAATACGTCGTCAAAATGGG | Pst I |
| 266 | 3602 | Forward | AAAGAATTC-CTCATCTTTGCCAACGCCCCCTTC | Eco RI |
|  | 3603 | Reverse | AAACTGCAG-CTATTCCCTGTTGCGCGTGTGCCA | Pst I |
| 267 | 3604 | Forward | AAAGAATTC-TTCTTCCGATTCGATGTTAATCG | Eco RI |
|  | 3605 | Reverse | AAACTGCAG-TTAGTAAAAACCTTTCTGCTTGGC | Pst I |
| 269 | 3606 | Forward | AAAGAATTC-TGCAAACCTTGCGCCACGTGCC | Eco RI |
|  | 3607 | Reverse | AAACTGCAG-TTACGAAGACCGCAACGAAAGGCAGAG | Pst I |
| 269a | 3608 | Forward | AAAAAAGAATTC-GACTTTATCCAAAACACGGCTTCGCC | Eco RI |
|  | 3609 | Reverse | AAACTGCAG-TTACGAAGACCGCAACGAAAGGCAGAG | Pst I |
| 270 | 3610 | Forward | AAAAAAGAATTC-GCCGTCAAGCTCGTTTTGTTGCAATG | Eco RI |
|  | 3611 | Reverse | AAACTGCAG-TTATTCGGCGGTAAATGCCGTCTG | Pst I |
| 271 | 3612 | Forward | CGCGGATCCCATATG-CCTGTGTGCAGCTCGAC | BamHI-NdeI |
|  | 3613 | Reverse | CCCGCTCGAG-TCCCAGCCCCGTGGAG | XhoI |
| 272 | 3614 | Forward | AAAGAATTC-ATGACCGCAAAGGAAGAACTGTTCGC | Eco RI |
|  | 3615 | Reverse | AAACTGCAG-TCAGAGCAGTTCCAAATCGGGGCT | Pst I |
| 273 | 3616 | Forward | AAAGAATTC-ATGAGTCTTCAGGCGGTATTTATATACCC | Eco RI |
|  | 3617 | Reverse | AAACTGCAG-TTACGCGTAAGAAAAAACTGC | Pst I |
| 274 | 3618 | Forward | CGCGGATCCCATATG-ACAGATTTGGTTACGGAC | BamHI-NdeI |
|  | 3619 | Reverse | CCCGCTCGAG-TTTGCTTTCAGTATTATTGAA | XhoI |
| 276 | 3620 | Forward | AAAAAAGAATTC-ATGATTTTGCCGTCGTCCATCACGATGATGCG | Eco RI |
|  | 3621 | Reverse | AAAAAACTGCAG-CTACACCACCATCGGCGAATTTATGGC | Pst I |
| 277 | 3622 | Forward | AAAAAAGAATTC-ATGCCCGCTTTGAGGACAAGCTCGTAGG | Eco RI |
|  | 3623 | Reverse | AAAAAACTGCAG-TCATAAGCCATGCTTACCTTCCAACAA | Pst I |
| 277a | 3624 | Forward | AAAAAAGAATTC-GGGGCGGCGGCTGGGTTGGACGTAGG | Eco RI |
|  | 3625 | Reverse | AAAAAACTGCAG-TCATAAGCCATGCTTACCTTCCAACAA | Pst I |
| 278 | 3626 | Forward | AAAAAAGGTACC-GTCAAAGTTGTATTAATCGGGCCTTTGCC | Kpn I |
|  | 3627 | Reverse | AAAAAACTGCAG-TCATTCAACCATATCAAATCTGCC | Pst I |
| 278a | 3628 | Forward | AAAAAAGAATTC-AAAACTCTCCTAATTCGTCATAGTCG | Eco RI |
|  | 3629 | Reverse | AAAAAACTGCAG-TCATTCAACCATATCAAATCTGCC | Pst I |
| 279 | 3630 | Forward | CGCGGATCCCATATG-TTGCCTGCAATCACGATT | BamHI-NdeI |
|  | 3631 | Reverse | CCCGCTCGAG-TTTAGAAGCGGGCGGCAA | XhoI |
| 280 | 3632 | Forward | AAAAAAGGTACC-GCCCCCCTGCCGGTTGTAACCAG | Kpn I |
|  | 3633 | Reverse | AAAAAACTGCAG-TTATTGCTTCATCGCGTTGGTCAAGGC | Pst I |
| 281 | 3634 | Forward | AAAAAAGAATTC-GCACCCGTCGGCGTATTCCTCGTCATGCG | Eco RI |
|  | 3635 | Reverse | AAAAAATCTAGA-GGTCAGAATGCCGCCTTCTTTGCCGAG | Xba I |
| 281a | 3636 | Forward | AAAAAAGAATTC-TCCTACCACATCGAAATTCCTTCCGG | Eco RI |
|  | 3637 | Reverse | AAAAAATCTAGA-GGTCAGAATGCCGCCTTCTTTGCCGAG | Xba I |
| 282 | 3638 | Forward | AAAAAAGAATTC-CTTTACCTTGACCTGACCAACGGGCACAG | Eco RI |
|  | 3639 | Reverse | AAAAAACTGCAG-TCAACCTGCCAGTTGCGGGAATATCGT | Pst I |

TABLE 7-continued

Oligonucleotides used for PCR to amplify complete or partial ORFs

| ORF | SEQ ID | primer | Sequence | Restriction sites |
|---|---|---|---|---|
| 283 | 3640 | Forward | CGC<u>GGATCCCATATG</u>-GCCGTCTTTACTTGGAAG | BamHI-NdeI |
| | 3641 | Reverse | CCCG<u>CTCGAG</u>-ACGGCAGTATTTGTTTACG | XhoI |
| 284 | 3642 | Forward | CGC<u>GGATCCCATATG</u>-TTTGCCTGCAAAAGAATCG | BamHI-NdeI |
| | 3643 | Reverse | CCCG<u>CTCGAG</u>-CCGACTTTGCAAAAACTG | XhoI |
| 286 | 3644 | Forward | CGC<u>GGATCCCATATG</u>-GCCGACCTTTCCGAAAA | BamHI-NdeI |
| | 3645 | Reverse | CCCG<u>CTCGAG</u>-GAAGCGCGTTCCCAAG | XhoI |
| 287 | 3646 | Forward | CCG<u>GAATTCTAGCTAGC</u>-CTTTCAGCCTGCGGG | EcoRI-NheI |
| | 3647 | Reverse | CCCG<u>CTCGAG</u>-ATCCTGCTCTTTTTTGCC | XhoI |
| 288 | 3648 | Forward | CGC<u>GGATCCCATATG</u>-CACACCGGACAGG | BamHI-NdeI |
| | 3649 | Reverse | CCCG<u>CTCGAG</u>-CGTATCAAAGACTTGCGT | XhoI |
| 290 | 3650 | Forward | CGC<u>GGATCCCATATG</u>-GCGGTTTGGGGCGGA | BamHI-NdeI |
| | 3651 | Reverse | CCCG<u>CTCGAG</u>-TCGGCGCGGCGGGC | XhoI |
| 292 | 3652 | Forward | CGC<u>GGATCCCATATG</u>-TGCGGGCAAACGCCC | BamHI-NdeI |
| | 3653 | Reverse | CCCG<u>CTCGAG</u>-TTGATTTTTGCGGATGATTT | XhoI |
| 294 | 3654 | Forward | AAAAAA<u>GAATTC</u>-GTCTGGTCGATTCGGTTGTCAGAAC | Eco RI |
| | 3655 | Reverse | AAAAAA<u>CTGCAG</u>-TTACCAGCTGATATAAAACATCGCTTT | Pst I |
| 295 | 3656 | Forward | CGC<u>GGATCCCATATG</u>-AACCGGCCGGCCTCC | BamHI-NdeI |
| | 3657 | Reverse | CCCG<u>CTCGAG</u>-CGATATTTGATTCCGTTGC | XhoI |
| 297 | 3658 | Forward | AAAAAA<u>GAATTC</u>-GCATACATTGCTTCGACAGAGAG | Eco RI |
| | 3659 | Reverse | AAAAAA<u>CTGCAG</u>-TCAATCCGATTGCGACACGGT | Pst I |
| 298 | 3660 | Forward | AAAAAA<u>GAATTC</u>-CTGATTGCCGTGTGGTTCAGCCAAAACCC | Eco RI |
| | 3661 | Reverse | AAAAAA<u>CTGCAG</u>-TCATGGCTGTGTACTTGATGGTTGCGT | Pst I |
| 299 | 3662 | Forward | CGC<u>GGATCCGCTAGC</u>-CTACCTGTCGCCTCCG | BamHI-NheI |
| | 3663 | Reverse | CCCG<u>CTCGAG</u>-TTGCCTGATTGCAGCGG | XhoI |
| 302 | 3664 | Forward | AAAAAA<u>GAATTC</u>-ATGAGTCAAACCGATACGCAACG | Eco RI |
| | 3665 | Reverse | AAAAAA<u>CTGCAG</u>-TTAAGGTGCGGGATAGAATGTGGGCGC | Pst I |
| 305 | 3666 | Forward | AAAAAA<u>GGTACC</u>-GAATTTTTACCGATTTCCAGCACCGGA | Kpn I |
| | 3667 | Reverse | AAAAAA<u>CTGCAG</u>-TCATTCCCAACTTATCCAGCCTGACAG | Pst I |
| 305a | 3668 | Forward | AAAAAA<u>GGTACC</u>-TCCCGTTCGGGCAGTACGATTATGGG | Kpn I |
| | 3669 | Reverse | AAAAAA<u>CTGCAG</u>-TTACAAACCGACATCATGCAGGGTGAA | Pst I |
| 306 | 3670 | Forward | CGC<u>GGATCCCATATG</u>-TTTATGAACAAATTTTCCC | BamHI-NdeI |
| | 3671 | Reverse | CCCG<u>CTCGAG</u>-CCGCATCGGCAGAC | XhoI |
| 308 | 3672 | Forward | CGC<u>GGATCCCATATG</u>-TTAAATCGGGTATTTTATC | BamHI-NdeI |
| | 3673 | Reverse | CCCG<u>CTCGAG</u>-ATCCGCCATTCCCTGC | XhoI |
| 311 | 3674 | Forward | AAAAAA<u>GGTACC</u>-ATGTTCAGTTTTGGCTGGGTGTTT | Kpn I |
| | 3675 | Reverse | AAA<u>CTGCAG</u>-ATGTTCATATTCCCTGCCTTCGGC | Pst I |
| 312 | 3676 | Forward | AAAAAA<u>GGTACC</u>-ATGAGTATCCCATCCGGCGAAATT | Kpn I |
| | 3677 | Reverse | AAA<u>CTGCAG</u>-TCAGTTTTTCATCGATTGAACCGG | Pst I |
| 313 | 3678 | Forward | AAAAAA<u>GAATTC</u>-ATGGACGACCCGCGCACCTACGGATC | Eco RI |
| | 3679 | Reverse | AAAAAA<u>CTGCAG</u>-TCAGCGGCTGCCGCCGATTTTGCT | Pst I |
| 401 | 3680 | Forward | CGC<u>GGATCCCATATG</u>-AAGGCGGCAACACAGC | BamHI-NdeI |
| | 3681 | Reverse | CCCG<u>CTCGAG</u>-CCTTACGTTTTTCAAAGCC | XhoI |
| 402 | 3682 | Forward | AAAAAA<u>GAATTC</u>-GTGCCTCAGGCATTTTCATTTACCCTTGC | Eco RI |
| | 3683 | Reverse | AAAAAA<u>TCTAGA</u>-TTAAATCCCTCTGCCGTATTTGTATTC | Xba I |
| 402a | 3684 | Forward | AAAAAA<u>GAATTC</u>-AGGCTGATTGAAAACAAACACGG | Eco RI |
| | 3685 | Reverse | AAAAAA<u>TCTAGA</u>-TTAAATCCCTCTGCCGTATTTGTATTC | Xba I |
| 406 | 3686 | Forward | CGC<u>GGATCCCATATG</u>-TGCGGGACACTGACAG | BamHI-NdeI |
| | 3687 | Reverse | CCCG<u>CTCGAG</u>-AGGTTGTCCTTGTCTATG | XhoI |
| 501 | 3688 | Forward | CGC<u>GGATCCCATATG</u>-GCAGGCGGAGATGGC | BamHI-NdeI |
| | 3689 | Reverse | CCCG<u>CTCGAG</u>-GGTGTGATGTTCACCC | XhoI |
| 502 | 3690 | Forward | CGC<u>GGATCCCATATG</u>-GTAGACGCGCTTAAGCA | BamHI-NdeI |
| | 3691 | Reverse | CCCG<u>CTCGAG</u>-AGCTGCATGGCGGCG | XhoI |
| 503 | 3692 | Forward | CGC<u>GGATCCCATATG</u>-TGTTCGGGGAAAGGCG | BamHI-NdeI |
| | 3693 | Reverse | CCCG<u>CTCGAG</u>-CCGCGCATTCCTCGCA | XhoI |
| 504 | 3694 | Forward | CGC<u>GGATCCCATATG</u>-AGCGATATTGAAGTGACG | BamHI-NdeI |
| | 3695 | Reverse | GCCC<u>AAGCTT</u>-TGATTCAAGTCCTTGCCG | HindIII |

TABLE 7-continued

Oligonucleotides used for PCR to amplify complete or partial ORFs

| ORF | SEQ ID | primer | Sequence | Restriction sites |
|---|---|---|---|---|
| 505 | 3696 | Forward | CGC<u>GGATCCCATATG</u>-TTTCGTTTACAATTCAGG | BamHI-NdeI |
|  | 3697 | Reverse | CCCG<u>CTCGAG</u>-CGGCGTTTTATAGCGG | XhoI |
| 510 | 3698 | Forward | CGC<u>GGATCCCATATG</u>-CCTTCGCGGACAC | BamHI-NdeI |
|  | 3699 | Reverse | CCCG<u>CTCGAG</u>-GCGCACTGGCAGCG | XhoI |
| 512 | 3700 | Forward | CGC<u>GGATCCCATATG</u>-GGACATGAAGTAACGGT | BamHI-NdeI |
|  | 3701 | Reverse | CCCG<u>CTCGAG</u>-AGGAATAGCCTTTGACG | XhoI |
| 515 | 3702 | Forward | CGC<u>GGATCCCATATG</u>-GAGGAAATAGCCTTCGA | BamHI-NdeI |
|  | 3703 | Reverse | CCCG<u>CTCGAG</u>-AAATGCCGCAAAGCATC | XhoI |
| 516 | 3704 | Forward | CGC<u>GGATCCCATATG</u>-TGTACGTTGATGTTGTGG | BamHI-NdeI |
|  | 3705 | Reverse | CCCG<u>CTCGAG</u>-TTTGCGGGCGGCATC | XhoI |
| 517 | 3706 | Forward | CGC<u>GGATCCCATATG</u>-GGTAAAGGTGTGAAATA | BamHI-NdeI |
|  | 3707 | Reverse | CCCG<u>CTCGAG</u>-GTGCGCCCAGCCGT | XhoI |
| 518 | 3708 | Forward | AAA<u>GAATTC</u>-GCTTTTTTACTGCTCCGACCGGAAGG | Eco RI |
|  | 3709 | Reverse | AAA<u>CTGCAG</u>-TCAAATTTCAGACTCTGCCAC | Pst I |
| 519 | 3710 | Forward | CGC<u>GGATCCCATATG</u>-TTCAAATCCTTTGTCGTCA | BamHI-NdeI |
|  | 3711 | Reverse | CCCG<u>CTCGAG</u>-TTTGGCGGTTTTGCTGC | XhoI |
| 520 | 3712 | Forward | CGC<u>GGATCCCATATG</u>-CCTGCGCTTCTTTCA | BamHI-NdeI |
|  | 3713 | Reverse | CCCG<u>CTCGAG</u>-ATATTTACATTTCAGTCGGC | XhoI |
| 521 | 3714 | Forward | CGC<u>GGATCCCATATG</u>-GCCAAAATCTATACCTGC | BamHI-NdeI |
|  | 3715 | Reverse | CCCG<u>CTCGAG</u>-CATACGCCCCAGTTCC | XhoI |
| 522 | 3716 | Forward | CGC<u>GGATCCCATATG</u>-ACTGAGCCGAAACAC | BamHI-NdeI |
|  | 3717 | Reverse | GCCC<u>AAGCTT</u>-TTCTGATTTCAAATCGGCA | HindIII |
| 523 | 3718 | Forward | CGC<u>GGATCCCATATG</u>-GCTCTGCTTTCCGCG | BamHI-NdeI |
|  | 3719 | Reverse | CCCG<u>CTCGAG</u>-AGGGTGTGTGATAATAAGAAG | XhoI |
| 525 | 3720 | Forward | CGC<u>GGATCCCATATG</u>-GCCGAAATGGTTCAAATC | BamHI-NdeI |
|  | 3721 | Reverse | CCCG<u>CTCGAG</u>-GCCCGTGCATATCATAAA | XhoI |
| 527 | 3722 | Forward | AAA<u>GAATTC</u>-TTCCCTCAATGTTGCCGTTTTCG | Eco RI |
|  | 3723 | Reverse | AAA<u>CTGCAG</u>-TTATGCTAAACTCGAAACAAATTC | Pst I |
| 529 | 3724 | Forward | CGC<u>GGATCCGCTAGC</u>-TGCTCCGGCAGCAAAAC | BamHI-NheI |
|  | 3725 | Reverse | GCCC<u>AAGCTT</u>-ACGCAGTTCGGAATGGAG | HindIII |
| 530 | 3726 | Forward | CGC<u>GGATCCCATATG</u>-AGTGCGAGCGCGG | BamHI-NdeI |
|  | 3727 | Reverse | CCCG<u>CTCGAG</u>-ACGACCGACTGATTCCG | XhoI |
| 531 | 3728 | Forward | AAAAAA<u>GAATTC</u>-TATGCCGCCGCCTACCAAATCTACGG | Eco RI |
|  | 3729 | Reverse | AAAAAA<u>CTGCAG</u>-TTAAAACAGCGCCGTGCCGACGACAAG | Pst I |
| 532 | 3730 | Forward | AAAAAA<u>GAATTC</u>-ATGAGCGGTCAGTTGGGCAAAGGTGC | Eco RI |
|  | 3731 | Reverse | AAAAAA<u>CTGCAG</u>-TCAGTGTTCCAAGTGGTCGGTATCAAA | Pst I |
| 532a | 3732 | Forward | AAAAAA<u>GAATTC</u>-TTGGGTGTCGCGTTTGAGCCGGAAGT | Eco RI |
|  | 3733 | Reverse | AAAAAA<u>CTGCAG</u>-TCAGTGTTCCAAGTGGTCGGTATCAAA | Pst I |
| 535 | 3734 | Forward | AAA<u>GAATTC</u>-ATGCCCTTTCCCGTTTTCAGAC | Eco RI |
|  | 3735 | Reverse | AAA<u>CTGCAG</u>-TCAGACGACCCCGCCTTCCCC | Pst I |
| 537 | 3736 | Forward | CGC<u>GGATCCCATATG</u>-CATACCCAAAACCAATCC | BamHI-NdeI |
|  | 3737 | Reverse | CCCG<u>CTCGAG</u>-ATCCTGCAAATAAAGGGTT | XhoI |
| 538 | 3738 | Forward | CGC<u>GGATCCCATATG</u>-GTCGAGCTGGTCAAAGC | BamHI-NdeI |
|  | 3739 | Reverse | CCCG<u>CTCGAG</u>-TGGCATTTCGGTTTCGTC | XhoI |
| 539 | 3740 | Forward | CGC<u>GGATCCGCTAGC</u>-GAGGATTTGCAGGAAA | BamHI-NheI |
|  | 3741 | Reverse | CCCG<u>CTCGAG</u>-TACCAATGTCGGCAAATC | XhoI |
| 542 | 3742 | Forward | AAA<u>GAATTC</u>-ATGCCGTCTGAAACCGTGTC | Eco RI |
|  | 3743 | Reverse | AAA<u>CTGCAG</u>-TTACCGCGAACCGGTCAGGAT | Pst I |
| 543 | 3744 | Forward | AAAAAA<u>GAATTC</u>-GCCTTCGATGGCGACGTTGTAGGTAC | Eco RI |
|  | 3745 | Reverse | AAAAAA<u>TCTAGA</u>-TTAATGAAGAAGAACATATTGGAATTTTGG | Xba I |
| 543a | 3746 | Forward | AAAAAA<u>GAATTC</u>-GGCAAAACTCGTCATGAATTTGC | Eco RI |
|  | 3747 | Reverse | AAAAAA<u>TCTAGA</u>-TTAATGAAGAAGAACATATTGGAATTTTGG | Xba I |
| 544 | 3748 | Forward | AAA<u>GAATTC</u>-GCGCCCGCCTTCTCCCTGCCCGACCTGCACGG | Eco RI |
|  | 3749 | Reverse | AAA<u>CTGCAG</u>-CTATTGCGCCACGCGCGTATCGAT | Pst I |

TABLE 7-continued

Oligonucleotides used for PCR to amplify complete or partial ORFs

| ORF | SEQ ID | primer | Sequence | Restriction sites |
|---|---|---|---|---|
| 544a | 3750 | Forward | AAAAAAGAATTC-GCAAATGACTATAAAAACAAAAACTTCCAAGTACTTGC | Eco RI |
|  | 3751 | Reverse | AAACTGCAG-CTATTGCGCCACGCGTATCGAT | Pst I |
| 547 | 3752 | Forward | AAAGAATTC-ATGTTCGTAGATAACGGATTTAATAAAAC | Eco RI |
|  | 3753 | Reverse | AAACTGCAG-TTAACAACAAAAAACAAACCGCTT | Pst I |
| 548 | 3754 | Forward | AAAGAATTC-GCCTGCAAACCTCAAGACAACAGTGCGGC | Eco RI |
|  | 3755 | Reverse | AAACTGCAG-TCAGAGCAGGGTCCTTACATCGGC | Pst I |
| 550 | 3756 | Forward | AAAAAAGTCGAC-ATGATAACGGACAGGTTTCATCTCTTTCATTTTCC | Sal I |
|  | 3757 | Reverse | AAACTGCAG-TTACGCAAACGCTGCAAAATCCCC | Pst I |
| 550a | 3758 | Forward | AAAAAAGAATTC-GTAAATCACGCCTTTGGAGTCGCAAACGG | Eco RI |
|  | 3759 | Reverse | AAACTGCAG-TTACGCAAACGCTGCAAAATCCCC | Pst I |
| 552 | 3760 | Forward | AAAAAAGAATTC-TTGGCGCGTTGGCTGGATAC | Eco RI |
|  | 3761 | Reverse | AAACTGCAG-TTATTTCTGATGCCTTTTCCCAAC | Pst I |
| 554 | 3762 | Forward | CGCGGATCCCATATG-TCGCCCGCGCCCAAC | BamHI-NdeI |
|  | 3763 | Reverse | CCCGCTCGAG-CTGCCCTGTCAGACAC | XhoI |
| 556 | 3764 | Forward | AAAGAATTC-GCGGGCGGTTTTGTTTGGACATCCCG | Eco RI |
|  | 3765 | Reverse | AAACTGCAG-TTAACGGTGCGGACGTTTCTGACC | Pst I |
| 557 | 3766 | Forward | CGCGGATCCCATATG-TGCGGTTTCCACCTGAA | BamHI-NdeI |
|  | 3767 | Reverse | CCCGCTCGAG-TTCCGCCTTCAGAAAGG | XhoI |
| 558 | 3768 | Forward | AAAGAATTC-GAGCTTTATATGTTTCAACAGGGGACGG | Eco RI |
|  | 3769 | Reverse | AAACTGCAG-CTAAACAATGCCGTCTGAAAGTGGAGA | Pst I |
| 558a | 3770 | Forward | AAAAAAGAATTC-ATTAGATTCTATCGCCATAAACAGACGG | Eco RI |
|  | 3771 | Reverse | AAAAAACTGCAG-CTAAACAATGCCGTCTGAAAGTGGAGA | Pst I |
| 560 | 3772 | Forward | AAAAAAGAATTC-TCGCCTTTCCGGGACGGGGCGCACAAGATGGC | Eco RI |
|  | 3773 | Reverse | AAAAAACTGCAG-TCATGCGGTTTCAGACGGCATTTTGGC | Pst I |
| 561 | 3774 | Forward | CCGGAATTCTACATATG-ATACTGCCAGCCGT | EcoRI-NdeI |
|  | 3775 | Reverse | CCCGCTCGAG-TTTCAAGCTTTCTTCAGATG | XhoI |
| 562 | 3776 | Forward | CGCGGATCCCATATG-GCAAGCCCGTCGAG | BamHI-NdeI |
|  | 3777 | Reverse | CCCGCTCGAG-AGACCAACTCCAACTCGT | XhoI |
| 565 | 3778 | Forward | CGCGGATCCCATATG-AAGTCGAGCGCGAAATAC | BamHI-NdeI |
|  | 3779 | Reverse | CCCGCTCGAG-GGCATTGATCGGCGGC | XhoI |
| 566 | 3780 | Forward | CGCGGATCCCATATG-GTCGGTGGCGAAGAGG | BamHI-NdeI |
|  | 3781 | Reverse | CCCGCTCGAG-CGCATGGGCGAAGTCA | XhoI |
| 567 | 3782 | Forward | CCGGAATTCTACATATG-AGTGCGAACATCCTTG | EcoRI-NdeI |
|  | 3783 | Reverse | CCCGCTCGAG-TTTCCCCGACACCCTCG | XhoI |
| 568 | 3784 | Forward | CGCGGATCCCATATG-CTCAGGGTCAGACC | BamHI-NdeI |
|  | 3785 | Reverse | CCCGCTCGAG-CGGCGCGGCGTTCAG | XhoI |
| 569 | 3786 | Forward | AAAAAAGAATTC-CTGATTGCCTTGTGGGAATATGCCCG | Eco RI |
|  | 3787 | Reverse | AAAAAACTGCAG-TTATGCATAGACGCTGATAACGGCAAT | Pst I |
| 570 | 3788 | Forward | CGCGGATCCCATATG-GACACCTTCCAAAAAATCG | BamHI-NdeI |
|  | 3789 | Reverse | CCCGCTCGAG-GCGGGCGTTCATTTCTTT | XhoI |
| 571 | 3790 | Forward | AAAAAAGAATTC-ATGGGTATTGCCGGCGCCGTAAATGTTTTGAACCC | Eco RI |
|  | 3791 | Reverse | AAAAAACTGCAG-TTATGGCCGACGCGCGGCTACCTGACG | Pst I |
| 572 | 3792 | Forward | CGCGGATCCCATATG-GCGCAAAAAGGCAAAACC | BamHI-NdeI |
|  | 3793 | Reverse | CCCGCTCGAG-GCGCAGTGTGCCGATA | XhoI |
| 573 | 3794 | Forward | CGCGGATCCCATATG-CCCTGTTTGTGCCG | BamHI-NdeI |
|  | 3795 | Reverse | CCCGCTCGAG-GACGGTGTCATTTCGCC | XhoI |
| 574 | 3796 | Forward | CGCGGATCCCATATG-TGGTTTGCCGCCCGC | BamHI-NdeI |
|  | 3797 | Reverse | CCCGCTCGAG-AACTTCGATTTTATTCGGG | XhoI |
| 575 | 3798 | Forward | CGCGGATCCCATATG-GTTTCGGGCGAGG | BamHI-NdeI |
|  | 3799 | Reverse | CCCGCTCGAG-CATTCCGAATCTGAACAG | XhoI |
| 576 | 3800 | Forward | CGCGGATCCCATATG-GCCGCCCCCGCATCT | BamHI-NdeI |
|  | 3801 | Reverse | CCCGCTCGAG-ATTTACTTTTTGATGTCGAC | XhoI |
| 577 | 3802 | Forward | CGCGGATCCCATATG-GAAAGGAACGGTGTATTT | BamHI-NdeI |
|  | 3803 | Reverse | CCCGCTCGAG-AGGCTGTTTGGTAGATTCG | XhoI |

TABLE 7-continued

Oligonucleotides used for PCR to amplify complete or partial ORFs

| ORF | SEQ ID | primer | Sequence | Restriction sites |
|---|---|---|---|---|
| 578 | 3804 | Forward | CGC<u>GGATCCCATATG</u>-AGAAGGTTCGTACAG | BamHI-NdeI |
|  | 3805 | Reverse | CCCG<u>CTCGAG</u>-GCCAACGCCTCCACG | XhoI |
| 579 | 3806 | Forward | CGC<u>GGATCCCATATG</u>-AGATTGGGCGTTTCCAC | BamHI-NdeI |
|  | 3807 | Reverse | CCCG<u>CTCGAG</u>-AGAATTGATGATGTGTATGT | XhoI |
| 580 | 3808 | Forward | CGC<u>GGATCCCATATG</u>-AGGCAGACTTCGCCGA | BamHI-NdeI |
|  | 3809 | Reverse | CCCG<u>CTCGAG</u>-CACTTCCCCCGAAGTG | XhoI |
| 581 | 3810 | Forward | CGC<u>GGATCCCATATG</u>-CACTTCGCCCAGC | BamHI-NdeI |
|  | 3811 | Reverse | CCCG<u>CTCGAG</u>-CGCCGTTTGGCTTTGG | XhoI |
| 582 | 3812 | Forward | AAAAAA<u>GAATTC</u>-TTTGGAGAGACCGCGCTGCAATGCGC | Eco RI |
|  | 3813 | Reverse | AAAAAA<u>TCTAGA</u>-TCAGATGCCGTCCCAGTCGTTGAA | Xba I |
| 583 | 3814 | Forward | AAAAAA<u>GAATTC</u>-ACTGCCGGCAATCGACTGCATAATCG | Eco RI |
|  | 3815 | Reverse | AAAAAA<u>CTGCAG</u>-TTAACGGAGGTCAATATGATGAAATTG | Pst I |
| 584 | 3816 | Forward | AAAAAA<u>GAATTC</u>-GCGGCTGAAGCATTGAATTACAATATTGTC | Eco RI |
|  | 3817 | Reverse | AAAAAA<u>CTGCAG</u>-TCAGAACTGAACCGTCCCATTGACGCT | Pst I |
| 585 | 3818 | Forward | AAAAAA<u>GGTACC</u>-TCTTTCTGGCTGGTGCAGAACACCCTTGC | Eco RI |
|  | 3819 | Reverse | AAAAAA<u>CTGCAG</u>-TCAGTTCGCACTTTTTTCTGTTTTGGA | Pst I |
| 586 | 3820 | Forward | CGC<u>GGATCCCATATG</u>-GCAGCCCATCTCG | BamHI-NdeI |
|  | 3821 | Reverse | CCCG<u>CTCGAG</u>-TTTCAGCGAATCAAGTTTC | XhoI |
| 587 | 3822 | Forward | CGC<u>GGATCCCATATG</u>-GACCTGCCCTTGACGA | BamHI-NdeI |
|  | 3823 | Reverse | CCCG<u>CTCGAG</u>-AAATGTATGCTGTACGCC | XhoI |
| 588 | 3824 | Forward | AAAAAA<u>GAATTC</u>-GCCGTCCTGACTTCCTATCAAGAACCAGG | Eco RI |
|  | 3825 | Reverse | AAAAAA<u>CTGCAG</u>-TTATTTGTTTTTGGGCAGTTTCACTTC | Pst I |
| 589 | 3826 | Forward | AAAAAA<u>GAATTC</u>-ATGCAACAAAAAATCCGTTTCCAAATCGAAGG | Eco RI |
|  | 3827 | Reverse | AAAAAA<u>CTGCAG</u>-CTAATCGATTTTTACCCGTTTCAGGCG | Pst I |
| 590 | 3828 | Forward | AAAAAA<u>GAATTC</u>-ATGAAAAAACCTTTGATTTCAGTTGCGGC | Eco RI |
|  | 3829 | Reverse | AAAAAA<u>CTGCAG</u>-TTACTGCTGCGGCTCTGAAACCAT | Pst I |
| 591 | 3830 | Forward | AAAAAA<u>GAATTC</u>-CACTACATCGTTGCCAGATTGTGCGG | Eco RI |
|  | 3831 | Reverse | AAAAAA<u>CTGCAG</u>-CTAACCGAGCAGCCGGGTAACGTCGTT | Pst I |
| 592a | 3832 | Forward | AAAAAA<u>GAATTC</u>-CGCGATTACACCGCCAAGCTGAAAATGGG | Eco RI |
|  | 3833 | Reverse | AAAAAA<u>CTGCAG</u>-TTACCAAACGTCGGATTTGATACG | Pst I |
| 593 | 3834 | Forward | CGC<u>GGATCCGCTAGC</u>-CTTGAACTGAACGGACTC | BamHI-NheI |
|  | 3835 | Reverse | CCCG<u>CTCGAG</u>-GCGGAAGCGGACGATT | XhoI |
| 594a | 3836 | Forward | AAAAAA<u>GAATTC</u>-GGTAAGTTCGCCGTTCAGGCCTTTCA | Eco RI |
|  | 3837 | Reverse | AAAAAA<u>CTGCAG</u>-TTACGCCGCCGTTTCCTGACACTCGCG | Pst I |
| 595 | 3838 | Forward | AAAAAA<u>GAATTC</u>-TGCCAGCCGCCGGAGGCGGAGAAAGC | Eco RI |
|  | 3839 | Reverse | AAAAAA<u>CTGCAG</u>-TTATTTCAAGCCGAGTATGCCGCG | Pst I |
| 596 | 3840 | Forward | CGC<u>GGATCCCATATG</u>-TCCCAACAATACGTC | BamHI-NdeI |
|  | 3841 | Reverse | CCCG<u>CTCGAG</u>-ACGCGTTACCGGTTTGT | XhoI |
| 597 | 3842 | Forward | CGC<u>GGATCCCATATG</u>-CTGCTTCATGTCAGC | BamHI-NdeI |
|  | 3843 | Reverse | GCCCAAGCTT-ACGTATCCAGCTCGAAG | HindIII |
| 601 | 3844 | Forward | CGC<u>GGATCCCATATG</u>-ATATGTTCCCAACCGGCAAT | BamHI-NdeI |
|  | 3845 | Reverse | CCCG<u>CTCGAG</u>-AAAACAATCCTCAGGCAC | XhoI |
| 602 | 3846 | Forward | CGC<u>GGATCCGCTAGC</u>-TTGCTCCATCAATGC | BamHI-NheI |
|  | 3847 | Reverse | CCCG<u>CTCGAG</u>-ATGCAGCTGCTAAAAGCG | XhoI |
| 603 | 3848 | Forward | AAAAAA<u>GAATTC</u>-CTGTCCTCGCGTAGGCGGGGACGGG | Eco RI |
|  | 3849 | Reverse | AAAAAA<u>CTGCAG</u>-CTACAAGATGCCGGCAAGTTCGGC | Pst I |
| 604 | 3850 | Forward | CGC<u>GGATCCGCTAGC</u>-CCCGAAGCGCACTT | BamHI-NheI |
|  | 3851 | Reverse | CCCG<u>CTCGAG</u>-GACGGCATCTGCACGG | XhoI |
| 606a | 3852 | Forward | AAAAAA<u>GAATTC</u>-CGCGAATACCGCCGATGCGGGCGC | Eco RI |
|  | 3853 | Reverse | AAAAAA<u>CTGCAG</u>-TTAAAGCGATTTGAGGCGGGCGATACG | Pst I |
| 607 | 3854 | Forward | AAAAAA<u>GAATTC</u>-ATGCTGCTCGACCTCAACCGCTTTTC | Eco RI |
|  | 3855 | Reverse | AAAAAA<u>CTGCAG</u>-TCAGACGGCCTTATGCGATCTGAC | Pst I |
| 608 | 3856 | Forward | AAAAAA<u>GAATTC</u>-ATGTCCGCCCTCCTCCCCATCATCAACCG | Eco RI |
|  | 3857 | Reverse | AAAAAA<u>CTGCAG</u>-TTAGTCTATCAAATGTGCGTTC | Pst I |
| 609 | 3858 | Forward | CGC<u>GGATCCCATATG</u>-GTTGTGGATAGACTCG | BamHI-NdeI |
|  | 3859 | Reverse | CCCG<u>CTCGAG</u>-CTGGATTATGATGTCTGTC | XhoI |
| 610 | 3860 | Forward | CGC<u>GGATCCCATATG</u>-ATTGGAGGGCTTATGCA | BamHI-NdeI |
|  | 3861 | Reverse | CCCG<u>CTCGAG</u>-ACGCTTCAACATCTTTGCC | XhoI |

TABLE 7-continued

Oligonucleotides used for PCR to amplify complete or partial ORFs

| ORF | SEQ ID | primer | Sequence | Restriction sites |
|---|---|---|---|---|
| 611 | 3862 | Forward | CGC<u>GGATCCCATATG</u>-CCGTCTCAAAACGGG | BamHI-NdeI |
|  | 3863 | Reverse | CCCG<u>CTCGAG</u>-AACGACTTTGAACGCGCAA | XhoI |
| 613 | 3864 | Forward | CGC<u>GGATCCCATATG</u>-TCGCGTTCGAGCCG3 | BamHI-NdeI |
|  | 3865 | Reverse | CCCG<u>CTCGAG</u>-AGCCTGTAAAATAAGCGGC | XhoI |
| 614 | 3866 | Forward | CGC<u>GGATCCCATATG</u>-TCCGTCGTGAGCGGC | BamHI-NdeI |
|  | 3867 | Reverse | CCCG<u>CTCGAG</u>-CCATACTGCGGCGTTC | XhoI |
| 616 | 3868 | Forward | AAAAAA<u>GAATTC</u>-ATGTCAAACACAATCAAAATGGTTGTCGG | Eco RI |
|  | 3869 | Reverse | AAAAAA<u>TCTAGA</u>-TTAGTCCGGGCGGCAGGCAGCTCG | Xba I |
| 619a | 3870 | Forward | AAAAAA<u>GAATTC</u>-GGGCTTCTCGCCGCCTCGCTTGC | Eco RI |
|  | 3871 | Reverse | AAAAAA<u>CTGCAG</u>-TCATTTTTTGTGTTTTAAAACGAGATA | Pst I |
| 622 | 3872 | Forward | CGC<u>GGATCCCATATG</u>-GCCGCCCTGCCTAAAG | BamHI-NdeI |
|  | 3873 | Reverse | CCCG<u>CTCGAG</u>-TTTGTCCAAATGATAAATCTG | XhoI |
| 624 | 3874 | Forward | CGC<u>GGATCCCATATG</u>-TCCCCGCGCTTTTACCG | BamHI-NdeI |
|  | 3875 | Reverse | CCCG<u>CTCGAG</u>-AGATTCGGGCCTGCGC | XhoI |
| 625 | 3876 | Forward | CGC<u>GGATCCCATATG</u>-TTTGCAACCAGGAAAATG | BamHI-NdeI |
|  | 3877 | Reverse | CCCG<u>CTCGAG</u>-CGGCAAAATTACCGCCTT | XhoI |
| 627a | 3878 | Forward | AAAAAA<u>GAATTC</u>-AAAGCAGGCGAGGCAGGCGCGCTGGG | Eco RI |
|  | 3879 | Reverse | AAAAAA<u>CTGCAG</u>-TTACGAATGAAACAGGGTACCGTCATCAAGGC | Pst I |
| 628 | 3880 | Forward | AAAAAA<u>GGTACC</u>-GCCTTACAAACATGGATTTTGCGTTC | Kpn I |
|  | 3881 | Reverse | AAAAAA<u>CTGCAG</u>-CTACGCACCTGAAGCGCTGGCAAA | Pst I |
| 629a | 3882 | Forward | AAAAAA<u>GAATTC</u>-GCCACCTTTATCGCGTATGAAAACGA | Eco RI |
|  | 3883 | Reverse | AAAAAA<u>CTGCAG</u>-TTACAACACCGCCGTCCGGTTCAAACC | Pst I |
| 630a | 3884 | Forward | AAAAAA<u>GAATTC</u>-GCGGCTTTGGGTATTTCTTTCGG | Eco RI |
|  | 3885 | Reverse | AAAAAA<u>CTGCAG</u>-TTAGGAGACTTCGCCAATGGAGCCGGG | Pst I |
| 635 | 3886 | Forward | AAAAAA<u>GAATTC</u>-ATGACCCAGCGACGGGTCGGCAAGCAAAACCG | Eco RI |
|  | 3887 | Reverse | AAAAAA<u>CTGCAG</u>-TTAATCCACTATAATCCTGTTGCT | Pst I |
| 638 | 3888 | Forward | AAAAAA<u>GAATTC</u>-ATGATTGGCGAAAAGTTTATCGTAGTTGG | Eco RI |
|  | 3889 | Reverse | AAAAAA<u>CTGCAG</u>-TCACGAACCGATTATGCTGATCGG | Pst I |
| 639 | 3890 | Forward | CGC<u>GGATCCCATATG</u>-ATGCTTTATTTTGTTCG | BamHI-NdeI |
|  | 3891 | Reverse | CCCG<u>CTCGAG</u>-ATCGCGGCTGCCGAC | XhoI |
| 642 | 3892 | Forward | CGC<u>GGATCCCATATG</u>-CGGTATCCGCCGCAAT | BamHI-NdeI |
|  | 3893 | Reverse | CCCG<u>CTCGAG</u>-AGGATTGCGGGCATTA | XhoI |
| 643 | 3894 | Forward | CGC<u>GGATCCCATATG</u>-GCTTCGCCGTCGGCAG | BamHI-NdeI |
|  | 3895 | Reverse | CCCG<u>CTCGAG</u>-AACCGAAAAACAGACCGC | XhoI |
| 644 | 3896 | Forward | AAAAAA<u>GAATTC</u>-ATGCCGTCTGAAAGGTCGGCGGATTGTTGCCC | Eco RI |
|  | 3897 | Reverse | AAAAAA<u>TCTAGA</u>-CTACCCGCAATATCGGCAGTCCAATAT | Pst I |
| 645 | 3898 | Forward | AAAAAA<u>GAATTC</u>-GTGGAACAGAGCAACACGTTAAATCG | Eco RI |
|  | 3899 | Reverse | AAAAAA<u>CTGCAG</u>-CTACGAGGAAACCGAAGACCAGGCCGC | Pst I |
| 647 | 3900 | Forward | AAAAAA<u>GAATTC</u>-ATGCAAAGGCTCGCCGCAGACGG | Eco RI |
|  | 3901 | Reverse | AAAAAA<u>CTGCAG</u>-TTAGATTATCAGGGATATCCGGTAGAA | Pst I |
| 648 | 3902 | Forward | AAAAAA<u>GAATTC</u>-ATGAACAGGCGCGACGCGCGGATCGAACG | Eco RI |
|  | 3903 | Reverse | AAAAAA<u>CTGCAG</u>-TCAAGCTGTGTGCTGATTGAATGCGAC | Pst I |
| 649 | 3904 | Forward | AAAAAA<u>GAATTC</u>-GGTACGTCAGAACCCGCCCACCG | Eco RI |
|  | 3905 | Reverse | AAAAAA<u>CTGCAG</u>-TTAACGGCGGAAACTGCCGCCGTC | Pst I |
| 650 | 3906 | Forward | AAAAAA<u>GAATTC</u>-ATGTCCAAACTCAAAACCATCGC | Eco RI |
|  | 3907 | Reverse | AAAAAA<u>CTGCAG</u>-TCAGACGGCATGGCGGTCTGTTTT | Pst I |
| 652 | 3908 | Forward | AAAAAA<u>GGTACC</u>-GCTGCCGAAGACTCAGGCCTGCCGCTTTACCG | Kpn I |
|  | 3909 | Reverse | AAAAAA<u>CTGCAG</u>-TTATTTGCCCAGTTGGTAGAATGCGGC | Pst I |
| 653 | 3910 | Forward | AAAAAA<u>GAATTC</u>-GCGGCTTTGCCGGTAATTTTCATCGG | Eco RI |
|  | 3911 | Reverse | AAAAAA<u>CTGCAG</u>-CTATGCCGGTCTGGTTGCCGGCGGCGA | Pst I |
| 656a | 3912 | Forward | AAAAAA<u>GAATTC</u>-CGGCCGACGTCGTTGCGTCCTAAGTC | Eco RI |
|  | 3913 | Reverse | AAAAAA<u>CTGCAG</u>-CTACGATTTCGGCGATTTCCACATCGT | Pst I |
| 657 | 3914 | Forward | AAAAAA<u>GAATTC</u>-GCAGAATTTGCCGACCGCCATTTGTGCGC | Eco RI |
|  | 3915 | Reverse | AAAAAA<u>CTGCAG</u>-TTATAGGGACTGATGCAGTTTTTTTGC | Pst I |
| 658 | 3916 | Forward | CGC<u>GGATCCCATATG</u>-GTGTCCGGAATTGTG | BamHI-NdeI |
|  | 3917 | Reverse | CCCG<u>CTCGAG</u>-GGCAGAATGTTTACCGTT | XhoI |
| 661 | 3918 | Forward | AAAAAA<u>GAATTC</u>-ATGCACATCGGCGGCTATTTTATCGACAACCC | Eco RI |
|  | 3919 | Reverse | AAAAAA<u>CTGCAG</u>-TCACGACGTGTCTGTTCGCCGTCGGGC | Pst I |

TABLE 7-continued

Oligonucleotides used for PCR to amplify complete or partial ORFs

| ORF | SEQ ID | primer | Sequence | Restriction sites |
|---|---|---|---|---|
| 663 | 3920 | Forward | CGCGGATCCCATATG-TGTATCGAGATGAAATT | BamHI-NdeI |
|  | 3921 | Reverse | CCCGCTCGAG-GTAAAAATCGGGGCTGC | XhoI |
| 664 | 3922 | Forward | CGCGGATCCCATATG-GCGGCTGGCGCGGT | BamHI-NdeI |
|  | 3923 | Reverse | CCCGCTCGAG-AAATCGAGTTTTACACCAC | XhoI |
| 665 | 3924 | Forward | AAAAAAGAATTC-ATGAAATGGGACGAAACGCGCTTCGG | Eco RI |
|  | 3925 | Reverse | AAAAAACTGCAG-TCAATCCAAAATTTTGCCGACGATTTC | Pst I |
| 666 | 3926 | Forward | AAAAAAGAATTC-AACTCAGGCGAAGGAGTGCTTGTGGC | Eco RI |
|  | 3927 | Reverse | AAAAAATCTAGA-TCAGTTTAGGGATAGCAGGCGTAC | Xba I |
| 667 | 3928 | Forward | AAAAAAGAATTC-CCGCATCCGTTTGATTTCCATTTCGTATTCGTCCG | Eco RI |
|  | 3929 | Reverse | AAAAAACTGCAG-TTAATGACACAATAGGCGCAAGTC | Pst I |
| 669 | 3930 | Forward | AAAAAAGAATTC-ATGCGCCGCATCATTAAAAAACACCAGCC | Eco RI |
|  | 3931 | Reverse | AAAAAACTGCAG-TTACAGTATCCGTTTGATGTCGGC | Pst I |
| 670a | 3932 | Forward | AAAAAAGAATTC-AAAAACGCTTCGGGCGTTTCGTCTTC | Eco RI |
|  | 3933 | Reverse | AAAAAACTGCAG-TTAGGAGCTTTTGGAACGCGTCGGACTGGC | Pst I |
| 671 | 3934 | Forward | CGCGGATCCCATATG-ACCAGCAGGGTAAC | BamHI-NdeI |
|  | 3935 | Reverse | CCCGCTCGAG-AGCAACTATAAAACGCAAG | XhoI |
| 672 | 3936 | Forward | CGCGGATCCCATATG-AGGAAAATCCGCACC | BamHI-NdeI |
|  | 3937 | Reverse | CCCGCTCGAG-ACGGGATAGGCGGTTG | XhoI |
| 673 | 3938 | Forward | AAAAAAGAATTC-ATGGATATTGAAACCTTCCTTGCAGG | Eco RI |
|  | 3939 | Reverse | AAAAAACTGCAG-CTACAAACCCAGCTCGCGCAGGAA | Pst I |
| 674 | 3940 | Forward | AAAAAAGAATTC-ATGAAAACAGCCCGCCGCCGTTCCG | Eco RI |
|  | 3941 | Reverse | AAAAAACTGCAG-TCAACGGCGTTTGGGCTCGTCGGG | Pst I |
| 675 | 3942 | Forward | CGCGGATCCCATATG-AACACCATCGCCCC | BamHI-NdeI |
|  | 3943 | Reverse | CCCGCTCGAG-TTCTTCGTCTTCAAACTGT | XhoI |
| 677a | 3944 | Forward | AAAAAAGAATTC-AGACGGCATTCCCGATCAGTCGATTTTGA | Eco RI |
|  | 3945 | Reverse | AAAAAACTGCAG-TTACGTATGCGCGAAATCGACCGCCGC | Pst I |
| 680 | 3946 | Forward | CGCGGATCCGCTAGC-ACGAAGGGCAGTTCGG | BamHI-NheI |
|  | 3947 | Reverse | CCCGCTCGAG-CATCAAAAACCTGCCGC | XhoI |
| 681 | 3948 | Forward | AAAAAAGAATTC-ATGACGACGCCGATGGCAATCAGTGC | Eco RI |
|  | 3949 | Reverse | AAAAAACTGCAG-TTACCGTCTTCCGCAAAAACAGC | Pst I |
| 683 | 3950 | Forward | CGCGGATCCCATATG-TGCAGCACACCGGACAA | BamHI-NdeI |
|  | 3951 | Reverse | CCCGCTCGAG-GAGTTTTTTCCGCATACG | XhoI |
| 684 | 3952 | Forward | CGCGGATCCCATATG-TGCGGTACTGTGCAAAG | BamHI-NdeI |
|  | 3953 | Reverse | CCCGCTCGAG-CTCGACCATCTGTTGCG | XhoI |
| 685 | 3954 | Forward | CGCGGATCCCATATG-TGTTTGCTTAATAATAAACATT | BamHI-NdeI |
|  | 3955 | Reverse | CCCGCTCGAG-CTTTTTCCCCGCCGCA | XhoI |
| 686 | 3956 | Forward | CGCGGATCCCATATG-TGCGGCGGTTCGGAAG | BamHI-NdeI |
|  | 3957 | Reverse | CCCGCTCGAG-CATTCCGATTCTGATGAAG | XhoI |
| 687 | 3958 | Forward | CGCGGATCCCATATG-TGCGACAGCAAAGTCCA | BamHI-NdeI |
|  | 3959 | Reverse | CCCGCTCGAG-CTGCGCGGCTTTTTGTT | XhoI |
| 690 | 3960 | Forward | CGCGGATCCCATATG-TGTTCTCCGAGCAAAGAC | BamHI-NdeI |
|  | 3961 | Reverse | CCCGCTCGAG-TATTCGCCCCGTGTTTGG | XhoI |
| 691 | 3962 | Forward | CGCGGATCCCATATG-GCCACGGCTTATATCCC | BamHI-NdeI |
|  | 3963 | Reverse | CCCGCTCGAG-TTTGAGGCAGGAAGAAAG | XhoI |
| 694 | 3964 | Forward | CGCGGATCCCATATG-TTGGTTTCCGCATCCGG | BamHI-NdeI |
|  | 3965 | Reverse | CCCGCTCGAG-TCTGCGTCGGTGCGGT | XhoI |
| 695 | 3966 | Forward | CGCGGATCCCATATG-TTGCCTCAAACTCGTCCG | BamHI-NdeI |
|  | 3967 | Reverse | CCCGCTCGAG-TCGTTTGCGCACGGCT | XhoI |
| 696 | 3968 | Forward | CGCGGATCCCATATG-TTGGGTTGCCGGCAGG | BamHI-NdeI |
|  | 3969 | Reverse | CCCGCTCGAG-TTGATTGCCGCAATGATG | XhoI |
| 700a | 3970 | Forward | AAAAAAGAATTC-GCATCGACAGACGGTGTGTCGTGGAC | Eco RI |
|  | 3971 | Reverse | AAAAAACTGCAG-TTACGTACCGGCACGACTTCCAAACC | Pst I |
| 701 | 3972 | Forward | CGCGGATCCCATATG-AAGACTTGTTTGGATACTTC | BamHI-NdeI |
|  | 3973 | Reverse | CCCGCTCGAG-TGCCGACAACAGCCTC | XhoI |
| 702 | 3974 | Forward | AAAAAAGAATTC-ATGCCGTGTTCCAAAGCCAGTTGGATTTC | Eco RI |
|  | 3975 | Reverse | AAAAAACTGCAG-TTAACCCCATTCCACCCGGAGAACCGA | Pst I |

TABLE 7-continued

Oligonucleotides used for PCR to amplify complete or partial ORFs

| ORF | SEQ ID | primer | Sequence | Restriction sites |
|---|---|---|---|---|
| 703 | 3976 | Forward | CGCGGATCCGCTAGC-CAAACGCTGGCAACCG | BamHI-NheI |
|  | 3977 | Reverse | CCCGCTCGAG-TTTTGCAGGTTTGATGTTTG | XhoI |
| 704a | 3978 | Forward | AAAAAAGAATTC-GCTTCTACCGGTACGCTGGCGCG | Eco RI |
|  | 3979 | Reverse | AAAAAACTGCAG-TTAGTTTTGCCGGATAATATGGCGGGTGCG | Pst I |
| 707 | 3980 | Forward | CGCGGATCCGCTAGC-GAAATTATTAACGATGCAGA | BamHI-NheI |
|  | 3981 | Reverse | CCCGCTCGAG-GAAACTGTAATTCAAGTTGA | XhoI |
| 708 | 3982 | Forward | CGCGGATCCGCTAGC-CCTTTTAAGCCATCCAAAA | BamHI-NheI |
|  | 3983 | Reverse | CCCGCTCGAG-TTGACCGGTGAGGACG | XhoI |
| 710 | 3984 | Forward | CGCGGATCCCATATG-GAAACCCACGAAAAAATC | BamHI-NdeI |
|  | 3985 | Reverse | CCCGCTCGAG-AACGGTTTCGGTCAG | XhoI |
| 714 | 3986 | Forward | CGCGGATCCCATATG-AGCTATCAAGACATCTT | BamHI-NdeI |
|  | 3987 | Reverse | CCCGCTCGAG-GCGGTAGGTAAATCGGAT | XhoI |
| 716 | 3988 | Forward | CGCGGATCCCATATG-GCCAACAAACCGGCAAG | BamHI-NdeI |
|  | 3989 | Reverse | CCCGCTCGAG-TTTAGAACCGCATTTGCC | XhoI |
| 718 | 3990 | Forward | CGCGGATCCCATATG-GAGCCGATAATGGCAAA | BamHI-NdeI |
|  | 3991 | Reverse | CCCGCTCGAG-GGCGCGGGCATGGTCTTGTCC | XhoI |
| 720 | 3992 | Forward | CGCGGATCCCATATG-AGCGGATGGCATACC | BamHI-NdeI |
|  | 3993 | Reverse | CCCGCTCGAG-TTTTGCATAGCTGTTGACCA | XhoI |
| 723 | 3994 | Forward | CGCGGATCCCATATG-CGACCCAAGCCCC | BamHI-NdeI |
|  | 3995 | Reverse | CCCGCTCGAG-AATGCGAATCCGCCGCC | XhoI |
| 725 | 3996 | Forward | CGCGGATCCCATATG-GTGCGCACGGTTAAA | BamHI-NdeI |
|  | 3997 | Reverse | CCCGCTCGAG-TTGCTTATCCTTAAGGGTTA | XhoI |
| 726 | 3998 | Forward | CGCGGATCCCATATG-ACCATCTATTTCAAAAAC | BamHI-NdeI |
|  | 3999 | Reverse | CCCGCTCGAG-GCCGATGTTTAGCGTCC | XhoI |
| 728 | 4000 | Forward | CGCGGATCCCATATG-TTTTGGCTGGGAACGGG | BamHI-NdeI |
|  | 4001 | Reverse | CCCGCTCGAG-GTGAGAAAGGTCGCGC | XhoI |
| 729 | 4002 | Forward | CGCGGATCCCATATG-TGCACCATGATTCCCCA | BamHI-NdeI |
|  | 4003 | Reverse | GCCCAAGCTT-TTTGTCGGTTTGGGTATC | HindIII |
| 731 | 4004 | Forward | CGCGGATCCGCTAGC-GCCGTGCCGGAGG | BamHI-NheI |
|  | 4005 | Reverse | CCCGCTCGAG-ACGGGCGCGGCAG | XhoI |
| 732 | 4006 | Forward | CCGGAATTCTACATATG-TCGAAACCTGTTTTTAAGAA | EcoRI-NdeI |
|  | 4007 | Reverse | CCCGCTCGAG-CTTCTTATCTTTTTATCTTTC | XhoI |
| 733 | 4008 | Forward | CGCGGATCCCATATG-GCCTGCGGCGGCAA | BamHI-NdeI |
|  | 4009 | Reverse | CCCGCTCGAG-TCGCTTGCCTCCTTTAC | XhoI |
| 734 | 4010 | Forward | CGCGGATCCCATATG-GCCGATACTTACGGCTAT | BamHI-NdeI |
|  | 4011 | Reverse | CCCGCTCGAG-TTTGAGATTTTGAATCAAAGAG | XhoI |
| 735 | 4012 | Forward | CGCGGATCCCATATG-AAGCAGCAGGCGGTCA | BamHI-NdeI |
|  | 4013 | Reverse | CCCGCTCGAG-ATTTCCGTAGCCGAGGG | XhoI |
| 737 | 4014 | Forward | CGCGGATCCCATATG-CACCACGACGGACACG | BamHI-NdeI |
|  | 4015 | Reverse | CCCGCTCGAG-GTCGTCGCGGCGGGA | XhoI |
| 739 | 4016 | Forward | CGCGGATCCCATATG-GCAAAAAAACCGAACA | BamHI-NdeI |
|  | 4017 | Reverse | CCCGCTCGAG-GAAGAGTTTGTCGAGAATT | XhoI |
| 740 | 4018 | Forward | CGCGGATCCCATATG-GCCAATCCGCCCGAAG | BamHI-NdeI |
|  | 4019 | Reverse | CCCGCTCGAG-AAACGCGCCAAAATAGTG | XhoI |
| 741 | 4020 | Forward | CGCGGATCCCATATG-TGCAGCAGCGGAGGG | BamHI-NdeI |
|  | 4021 | Reverse | CCCGCTCGAG-TTGCTTGGCGGCAAGGC | XhoI |
| 743 | 4022 | Forward | CGCGGATCCCATATG-GACGGTGTTGTGCCTGTT | BamHI-NdeI |
|  | 4023 | Reverse | CCCGCTCGAG-CTTACGGATCAAATTGACG | XhoI |
| 745 | 4024 | Forward | CGCGGATCCCATATG-TTTTGGCAACTGACCG | BamHI-NdeI |
|  | 4025 | Reverse | CCCGCTCGAG-CAAATCAGATGCCTTTAGG | XhoI |

TABLE 7-continued

Oligonucleotides used for PCR to amplify complete or partial ORFs

| ORF | SEQ ID | primer | Sequence | Restriction sites |
|---|---|---|---|---|
| 746 | 4026 | Forward | CGC<u>GGATCCCATATG</u>-TCCGAAAACAAACAAAAC | BamHI-NdeI |
|  | 4027 | Reverse | CCCG<u>CTCGAG</u>-TTCATTCGTTACCTGACC | XhoI |
| 747 | 4028 | Forward | CCG<u>GAATTCTAGCTAGC</u>-CTGACCCCTTGGG | EcoRI-NheI |
|  | 4029 | Reverse | GCCC<u>AAGCTT</u>-TTTTGATTTTAATTGACTATAGAAC | HindIII |
| 749 | 4030 | Forward | CGC<u>GGATCCCATATG</u>-TGCCAGCCGCCG | BamHI-NdeI |
|  | 4031 | Reverse | CCCG<u>CTCGAG</u>-TTTCAAGCCGAGTATGC | XhoI |
| 750 | 4032 | Forward | CGC<u>GGATCCCATATG</u>-TGTTCGCCCGAACCTG | BamHI-NdeI |
|  | 4033 | Reverse | CCCG<u>CTCGAG</u>-CTTTTTCCCCGCCGCAA | XhoI |
| 758 | 4034 | Forward | CGC<u>GGATCCCATATG</u>-AACAATCTGACCGTGTT | BamHI-NdeI |
|  | 4035 | Reverse | CCCG<u>CTCGAG</u>-TGGCTCAATCCTTTCTGC | XhoI |
| 759 | 4036 | Forward | CGC<u>GGATCCGCTAGC</u>-CGCTTCACACACACCAC | BamHI-NheI |
|  | 4037 | Reverse | CCCG<u>CTCGAG</u>-CCAGTTGTAGCCTATTTTG | XhoI |
| 763 | 4038 | Forward | CGC<u>GGATCCCATATG</u>-CTGCCTGAAGCATGGCG | BamHI-NdeI |
|  | 4039 | Reverse | CCCG<u>CTCGAG</u>-TTCCGCAAATACCGTTTCC | XhoI |
| 764 | 4040 | Forward | CGC<u>GGATCCCATATG</u>-TTTTTCTCCGCCCTGA | BamHI-NdeI |
|  | 4041 | Reverse | CCCG<u>CTCGAG</u>-TCGCTCCCTAAAGCTTTC | XhoI |
| 765 | 4042 | Forward | CGC<u>GGATCCCATATG</u>-TTAAGATGCCGTCCG | BamHI-NdeI |
|  | 4043 | Reverse | CCCG<u>CTCGAG</u>-ACGCCGACGTTTTTATTAA | XhoI |
| 767 | 4044 | Forward | CGC<u>GGATCCCATATG</u>-CTGACGGAAGGGGAAG | BamHI-NdeI |
|  | 4045 | Reverse | CCCG<u>CTCGAG</u>-TTTCTGTACAGCAGGGG | XhoI |
| 768 | 4046 | Forward | CGC<u>GGATCCCATATG</u>-GCCCCGCAAAAACCCG | BamHI-NdeI |
|  | 4047 | Reverse | CCCG<u>CTCGAG</u>-TTTCATCCCTTTTTTGAGC | XhoI |
| 770 | 4048 | Forward | CGC<u>GGATCCCATATG</u>-TGCGGCAGCGGCGAA | BamHI-NdeI |
|  | 4049 | Reverse | CCCG<u>CTCGAG</u>-GCGTTTGTCGAGATTTTC | XhoI |
| 771 | 4050 | Forward | CGC<u>GGATCCCATATG</u>-TCCGTATATCGCACCTTC | BamHI-NdeI |
|  | 4051 | Reverse | CCCG<u>CTCGAG</u>-CGGTTCTTTAGGTTTGAG | XhoI |
| 772 | 4052 | Forward | CGC<u>GGATCCCATATG</u>-TTTGCGGCGTTGGTGG | BamHI-NdeI |
|  | 4053 | Reverse | CCCG<u>CTCGAG</u>-CAATGCCGACATCAAACG | XhoI |
| 774 | 4054 | Forward | CGC<u>GGATCCCATATG</u>-TCCGTTTCACCCGTTCC | BamHI-NdeI |
|  | 4055 | Reverse | CCCG<u>CTCGAG</u>-TCGTTTGCGCACGGCT | XhoI |
| 790 | 4056 | Forward | CGC<u>GGATCCCATATG</u>-GCAAGAAGGTCAAAAAC | BamHI-NdeI |
|  | 4057 | Reverse | CCCG<u>CTCGAG</u>-GGCGTTGTTCGGATTTCG | XhoI |
| 900 | 4058 | Forward | CGC<u>GGATCCCATATG</u>-CCGTCTGAAATGCCG | BamHI-NdeI |
|  | 4059 | Reverse | CCCG<u>CTCGAG</u>-ATATGGAAAAGTCTGTTGTC | XhoI |
| 901 | 4060 | Forward | CGC<u>GGATCCCATATG</u>-CCCGATTTTTCGATG | BamHI-NdeI |
|  | 4061 | Reverse | CCCG<u>CTCGAG</u>-AAAATGGAACAATACCAGG | XhoI |
| 902 | 4062 | Forward. 2 | CCG<u>GAATTCTACATATG</u>-TTGCACTTTCAAAGGATAATC | EcoRI-NdeI |
|  | 4063 | Reverse | CCCG<u>CTCGAG</u>-AAAAATGTACAATGGCGTAC | XhoI |
| 903 | 4064 | Forward | CCG<u>GAATTCTAGCTAGC</u>-CAGCGTCAGCAGCACAT | EcoRI-NheI |
|  | 4065 | Reverse | CCCG<u>CTCGAG</u>-GAAACTGTAATTCAAGTTGAA | XhoI |
| 904 | 4066 | Forward | AAAAAA<u>GGTACC</u>-ATGATGCAGCACAATCGTTTC | Kpn I |
|  | 4067 | Reverse | AAA<u>CTGCAG</u>-TTAATATCGATAGGTTATATG | Pst I |
| 904a | 4068 | Forward | AAAAAA<u>GAATTC</u>-CGGCTCGGCATTGTGCAGATGTTGCA | Eco RI |
|  | 4069 | Reverse | AAA<u>CTGCAG</u>-TTAATATCGATAGGTTATATG | Pst I |
| 905 | 4070 | Forward | CGC<u>GGATCCCATATG</u>-AACAAAATATACCGCATC | BamHI-NdeI |
|  | 4071 | Reverse | CCCG<u>CTCGAG</u>-CCACTGATAACCGACAGAT | XhoI |
| 907 | 4072 | Forward | CGC<u>GGATCCCATATG</u>-GGCGCGCAACGTGAG | BamHI-NdeI |
|  | 4073 | Reverse | CCCG<u>CTCGAG</u>-ACGCCACTGCCAGCG | XhoI |
| 908 | 4074 | Forward | AAA<u>GAATTC</u>-GCAGAGTTAGTAGGCGTTAATAAAAATAC | Eco RI |
|  | 4075 | Reverse | AAA<u>CTGCAG</u>-TTAATATGGTTTTGTCGTTCG | Pst I |
| 909 | 4076 | Forward | CGC<u>GGATCCCATATG</u>-TGCGCGTGGGAAACTTAT | BamHI-NdeI |
|  | 4077 | Reverse | CCCG<u>CTCGAG</u>-TCGGTTTTGAAACTTTGGTTTT | XhoI |

TABLE 7-continued

Oligonucleotides used for PCR to amplify complete or partial ORFs

| ORF | SEQ ID | primer | Sequence | Restriction sites |
|---|---|---|---|---|
| 910 | 4078 | Forward | AAAGAATTC-GCATTTGCCGGCGACTCTGCCGAGCG | Eco RI |
|  | 4079 | Reverse | AAACTGCAG-TCAGCGATCGAGCTGCTCTTT | Pst I |
| 911 | 4080 | Forward | AAAGAATTC-GCTTTCCGCGTGGCCGGCGGTGC | Eco RI |
|  | 4081 | Reverse | AAAAAACTGCAG-GTCGACTTATTCGGCGGCTTTTTCCGC | Pst I |
| 912 | 4082 | Forward | AAAAAAGAATTC-CAAATCCGTCAAAACGCCACTCAAGTATTGAG | Eco RI |
|  | 4083 | Reverse | AAAAAACTGCAG-TTACAGTCCGTCCACGCCTTTCGC | Pst I |
| 913 | 4084 | Forward | CGCGGATCCCATATG-GAAACCCGCCCCGC | BamHI-NdeI |
|  | 4085 | Reverse | CCCGCTCGAG-AGGTTGTGTTCCAGGTTG | XhoI |
| 915 | 4086 | Forward | CGCGGATCCCATATG-TGCCGGCAGGCGGAA | BamHI-NdeI |
|  | 4087 | Reverse | CCCGCTCGAG-TTTGAAAATATAGGTATCAGG | XhoI |
| 914 | 4088 | Forward | AAAGAATTC-GACAGAATCGGCGATTTGGAAGCACG | Eco RI |
|  | 4089 | Reverse | AAACTGCAG-CTATATGCGCGGCAGGACGCTCAACGG | Pst I |
| 916 | 4090 | Forward | CGCGGATCCCATATG-GCAATGATGGCGGCTG | BamHI-NdeI |
|  | 4091 | Reverse | CCCGCTCGAG-TTTGGCGGCATCTTTCAT | XhoI |
| 917 | 4092 | Forward | AAAAAGAATTC-CCTGCCGAAAAACCGGCACCGGC | Eco RI |
|  | 4093 | Reverse | AAAAAACTGCAG-TTATTTCCCCGCCTTCACATCCTG | Pst I |
| 919 | 4094 | Forward | CGCGGATCCCATATG-TGCCAAAGCAAGAGCATC | BamHI-NdeI |
|  | 4095 | Reverse | CCCGCTCGAG-CGGGCGGTATTCGGG | XhoI |
| 920 | 4096 | Forward | CGCGGATCCCATATG-CACCGCGTCTGGGTC | BamHI-NdeI |
|  | 4097 | Reverse | CCCGCTCGAG-ATGGTGCGAATGACCGA | XhoI |
| 921 | 4098 | Forward | AAAAAAGAATTC-TTGACGGAAATCCCCGTGAATCC | Eco RI |
|  | 4099 | Reverse | AAAAAACTGCAG-TCATTTCAAGGGCTGCATCTTCAT | Pst I |
| 922 | 4100 | Forward.2 | CGCGGATCCGCTAGC-TGTACGGCGATGGAGGC | BamHI-NheI |
|  | 4101 | Reverse | CCCGCTCGAG-CAATCCCGGGCCGCC | XhoI |
| 923 | 4102 | Forward | CGCGGATCCCATATG-TGTTACGCAATATTGTCCC | BamHI-NheI |
|  | 4103 | Reverse | CCCGCTCGAG-GGACAAGGCGACGAAG | XhoI |
| 925 | 4104 | Forward | CGCGGATCCCATATG-AAACAAATGCTTTTAGCCG | BamHI-NdeI |
|  | 4105 | Reverse | CCCGCTCGAG-GCCGTTGCATTTGATTTC | XhoI |
| 926 | 4106 | Forward | CGCGGATCCCATATG-TGCGCGCAATTACCTC | BamHI-NdeI |
|  | 4107 | Reverse | CCCGCTCGAG-TCTCGTGCGCGCCG | XhoI |
| 927 | 4108 | Forward | CGCGGATCCCATATG-TGCAGCCCCGCAGC | BamHI-NdeI |
|  | 4109 | Reverse | CCCGCTCGAG-GTTTTTTGCTGACGTAGT | XhoI |
| 929a | 4110 | Forward | AAAAAAGAATTC-CGCGGTTTGCTCAAAACAGGGCTGGG | Eco RI |
|  | 4111 | Reverse | AAAAAATCTAGA-TTAAGAAAGACGGAAACTACTGCC | Xba I |
| 931 | 4112 | Forward | AAAAAAGAATTC-GCAACCCATGTTTTGATGGAAAC | Eco RI |
|  | 4113 | Reverse | AAAAAACTGCAG-TTACTGCCCGACAACAACGCGACG | Pst I |
| 935 | 4114 | Forward | AAAAAAGAATTC-GCGGATGCGCCCGCGATTTTGGATGACAAGGC | Eco RI |
|  | 4115 | Reverse | AAAAAACTGCAG-TCAAAACCGCCAATCCGCCGACAC | Pst I |
| 936 | 4116 | Forward | CGCGGATCCCATATG-GCCGCCGTCGGCGC | BamHI-NdeI |
|  | 4117 | Reverse | CCCGCTCGAG-GCGTTGGACGTAGTTTTG | XhoI |
| 937 | 4118 | Forward | AAAAAAGAATTC-CCGGTTTACATTCAAACCGGCGCAAC | Eco RI |
|  | 4119 | Reverse | AAAAAACTGCAG-TTAAAATGTATGCTGTACGCCAAA | Pst I |
| 939a | 4120 | Forward | AAAAAAGAATTC-GGTTCGGCAGCTGTGATGAAACC | Eco RI |
|  | 4121 | Reverse | AAAAAACTGCAG-TTAACGCAAACCTTGGATAAAGTTGGC | Pst I |
| 950 | 4122 | Forward | CGCGGATCCCATATG-GCCAACAAACCGGCAAG | BamHI-NdeI |
|  | 4123 | Reverse | CCCGCTCGAG-TTTAGAACCGCATTTGCC | XhoI |
| 953 | 4124 | Forward | CGCGGATCCCATATG-GCCACCTACAAAGTGGAC | BamHI-NdeI |
|  | 4125 | Reverse | CCCGCTCGAG-TTGTTTGGCTGCCTCGAT | XhoI |
| 957 | 4126 | Forward | CGCGGATCCCATATG-TTTTGGCTGGGAACGGG | BamHI-NdeI |
|  | 4127 | Reverse | CCCGCTCGAG-GTGAGAAAGGTCGCGC | XhoI |
| 958 | 4128 | Forward | CGCGGATCCCATATG-GCCGATGCCGTTGCG | BamHI-NdeI |
|  | 4129 | Reverse | GCCCAAGCTT-GGGTCGTTTGTTGCGTC | HindIII |
| 959 | 4130 | Forward | CGCGGATCCCATATG-CACCACGACGGACACG | BamHI-NdeI |
|  | 4131 | Reverse | CCCGCTCGAG-GTCGTCGCGGCGGGA | XhoI |
| 961 | 4132 | Forward | CGCGGATCCCATATG-GCCACAAGCGACGACG | BamHI-NdeI |
|  | 4133 | Reverse | CCCGCTCGAG-CCACTCGTAATTGACGC | XhoI |

TABLE 7-continued

Oligonucleotides used for PCR to amplify complete or partial ORFs

| ORF | SEQ ID | primer | Sequence | Restriction sites |
|---|---|---|---|---|
| 972 | 4134 | Forward | AAAAAAGAATTC-TTGACTAACAGGGGGGAGCGAAATTAAAAAC | Eco RI |
|  | 4135 | Reverse | AAAAAATCTAGA-TTAAAAATAATCATAATCTACATTTTG | Xba I |
| 973 | 4136 | Forward | AAAAAAGAATTC-ATGGACGGCGCACAACCGAAAAC | Eco RI |
|  | 4137 | Reverse | AAAAAACTGCAG-TTACTTCACGCGGGTCGCCATCAGCGT | Pst I |
| 982 | 4138 | Forward | CGCGGATCCCATATG-GCAGCAAAAGACGTAC | BamHI-NdeI |
|  | 4139 | Reverse | CCCGCTCGAG-CATCATGCCGCCCATCC | XhoI |
| 983 | 4140 | Forward | CGCGGATCCCATATG-TTAGCTGTTGCAACAACAC | BamHI-NdeI |
|  | 4141 | Reverse | CCCGCTCGAG-GAACCGGTAGCCTACG | XhoI |
| 987 | 4142 | Forward | CGCGGATCCCATATG-CCCCCACTGGAAGAAC | BamHI-NdeI |
|  | 4143 | Reverse | CCCGCTCGAG-TAATAAACCTTCTATGGGC | XhoI |
| 988 | 4144 | Forward | CGCGGATCCCATATG-TCTTTAAATTTACGGGAAAAG | BamHI-NdeI |
|  | 4145 | Reverse | GCCCAAGCTT-TGATTTGCCTTTCCGTTTT | HindIII |
| 989 | 4146 | Forward | CCGGAATTCTACATATG-GTCCACGCATCCGGCTA | EcoRI-NdeI |
|  | 4147 | Reverse | CCCGCTCGAG-TTTGAATTTGTAGGTGTATTGC | XhoI |
| 990 | 4148 | Forward 2 | CGCGGATCCGCTAGC-TTCAGAGCTCAGCTT | BamHI-NheI |
|  | 4149 | Reverse | CCCGCTCGAG-AAACAGCCATTTGAGCGA | XhoI |
| 992 | 4150 | Forward | CGCGGATCCCATATG-GACGCGCCCGCCCG | BamHI-NdeI |
|  | 4151 | Reverse | CCCGCTCGAG-CCAAATGCCCAACCATTC | XhoI |
| 993 | 4152 | Forward | CGCGGATCCCATATG-GCAATGCTGATTGAAATCA | BamHI-NdeI |
|  | 4153 | Reverse | CCCGCTCGAG-GAACACATCGCGCCCG | XhoI |
| 996 | 4154 | Forward | CGCGGATCCCATATG-TGCGGCAGAAAATCCGC | BamHI-NdeI |
|  | 4155 | Reverse | CCCGCTCGAG-TCTAAACCCTGTTTTCTC | XhoI |
| 997 | 4156 | Forward | CCGGAATTCTAGCTAGC-CGGCACGCCGACGTT | EcoRI-NheI |
|  | 4157 | Reverse | CCCGCTCGAG-GACGGCATCGCTCAGG | XhoI |

Underlined sequences indicate restriction recognition sites.

The following DNA and amino acid sequences are identified by titles of the following form: [g, m, or a] [#].[seq or pep], where "g" means a sequence from *N. gonorrhoeae*, "m" means a sequence from *N. meningitidis* B, and "a" means a sequence from *N. meningitidis* A; "#" means the number of the sequence; "seq" means a DNA sequence, and "pep" means an amino acid sequence. For example, "g001.seq" refers to an *N. gonorrohoeae* DNA sequence, number 1. The presence of the suffix "-1" to these sequences indicates an additional sequence found for the same ORF. Further, open reading frames are identified as ORF #, where "#" means the number of the ORF, corresponding to the number of the sequence which encodes the ORF, and the ORF designations may be suffixed with ".ng" or ".a", indicating that the ORF corresponds to a *N. gonorrhoeae* sequence or a *N. meningitidis* A sequence, respectively. Computer analysis was performed for the comparisons that follow between "g", "m", and "a" peptide sequences; and therein the "pep" suffix is implied where not expressly stated.

The following partial DNA sequence was identified in *N. gonorrhoeae* <SEQ ID 1>:

```
g001.seq
  1 ATGCTGCCGC AGGGGAAGGC GGCGCGGAGG GTGTCGGCGA ACGAGGTGTC
 51 CGGCAGGGCT TGCGCCCGGA TGGTGCTGGT CATCTGCCAG ACGCTGCCGA
101 AACGCGATAC TTTAAACGGC TCGGGTACGC ATACTTTACC GGTTTGGGCG
151 ATTTTGCCGA GGTCGTTGCG CAGCAAATCG ACAATCATCA CGTTTTCGGC
201 GCGGTTTTTC GGGTCGGTTT GTAACTCGGC GGCGCGGCGT TCGTCTTGTC
251 CGTCGCCCAA AATCGGCGCG GTGCCTTTCA TCGGTTCGGT GCTGATGGTG
301 CCGTCTGAAG CGATGTTGAG GAAGAGTTCG GGCGAGAAAC ACAGCGTCCA
351 CGCGGATTGC CCGGCTTCAT CGGGCAGGTG GGACAATACG GCATAG
```

This corresponds to the amino acid sequence <SEQ ID 2; ORF 001.ng>:

```
g001.pep
    1 MLPQGKAARR VSANEVSGRA CARMVLVICQ TLPKRDTLNG SGTHTLPVWA

51 ILPRSLRSKS TIITFSARFF GSVCNSAARR SSCPSPKIGA VPFIGSVLMV

101 PSEAMLRKSS GEKHSVHADC PASSGRWDNT A*
```

The following partial DNA sequence was identified in *N. meningitidis* <SEQ ID 3>:

```
m001.seq
    1 ATGCTGCCGC AGGGGAAGGC GGCGCGGAGG ATGTCGGCGA ACGAGGTGTG

51 CGGcAssCTT ss.GCTTGGA yGGTGCTGGT CATCTGCCAA ACGCTGCCGA

101 AACGCGATAC TTTAAACGGT TCGGGTACGC ATACTGTGCC GGTTTGGGCG

151 ATTTTGCCGA GATCGTTACG CAGCAAATCG ACAATCATCA CGTTTTCGGC

201 GCGGTTTTTC GGGTCTGCTT GCAACTCGGC GGCGCGGCGT TCGTCTTGTC

251 CGTCGCCCAA AATCGGCGCG GTGCCTTTCA TCGGTTCGGT GCTGATGGTG

301 CCGTCCGAAC CGATTTTGAG GAAGAGTTCG GGCGAGAAAC ACAGCGTCCA

351 CGCGGATTGC CCCTCCGCAT CGGGCAGGTG GGACAAGACG GCATAG
```

This corresponds to the amino acid sequence <SEQ ID 4; ORF 001>:

```
m001.pep
    1 MLPQGKAARR MSANEVCGXL XAWXVLVICQ TLPKRDTLNG SGTHTVPVWA

51 ILPRSLRSKS TIITFSARFF GSACNSAARR SSCPSPKIGA VPFIGSVLMV

101 PSEPILRKSS GEKHSVHADC PSASGRWDKT A*
```

The following partial DNA sequence was identified in *N. meningitidis* <SEQ ID 5>:

```
a001.seq
    1 ATGCTGCCGC AGGGGAAGGC GGCGCGGAGG ATGTCGGCGA ACGAGGTGTG

51 CGGCAAGGCT TGGGCTTGGA TGGTGCTGGT CATCTGCCAA ACGCTGCCGA

101 AACGCGATAC TTTAAACGGT TCGGGTACGC ATACTGTGCC GGTTTGGGCG

151 ATTTTGCCGA GGTCGTTACG CAGCAAATCG ACAATCATCA CGTTTTCGGC

201 GCGGTTTTTC GGGTCTGCTT GCAACTCGGC GGCGCGGCGT TCGTCTTGTC

251 CGTCGCCCAA AATCGGCGCG GTGCCTTTCA TCGGTTCGGT GCTGATGGTG

301 CCGTCCGAAC CGATTTTGAG GAAGAGTTCG GGCGAGAAAC ACAGCGTCCA

351 CGCGGATTGC CCTTGTGCAT CGGGCAGGTG GGACAAAACG GCATAG
```

This corresponds to the amino acid sequence <SEQ ID 6; ORF 001.a>:

```
a001.pep
    1 MLPQGKAARR MSANEVCGKA WAWMVLVICQ TLPKRDTLNG SGTHTVPVWA

51 ILPRSLRSKS TIITFSARFF GSACNSAARR SSCPSPKIGA VPFIGSVLMV

101 PSEPILRKSS GEKHSVHADC PCASGRWDKT A*
```

```
m001/a001   96.2% identity over a 131 aa overlap 10         20         30         40         50         60
    m001.pep  MLPQGKAARRMSANEVCGXLXAWXVLVICQTLPKRDTLNGSGTHTVPVWAILPRSLRSKS
              ||||||||||||||||||    ||  ||||||||||||||||||||||||||||||||||
    a001.pep  MLPQGKAARRMSANEVCGKAWAWMVLVICQTLPKRDTLNGSGTHTVPVWAILPRSLRSKS
                    10         20         30         40         50         60

70         80         90        100        110        120
    m001.pep  TIITFSARFFGSACNSAARRSSCPSPKIGAVPFIGSVLMVPSEPILRKSSGEKHSVHADC
              ||||||||||||||||||||||||||||||||||||||||||||||||||||||||||||
    a001.pep  TIITFSARFFGSACNSAARRSSCPSPKIGAVPFIGSVLMVPSEPILRKSSGEKHSVHADC
                    70         80         90        100        110        120

130
    m001.pep  PSASGRWDKTAX
              |  |||||||||
    a001.pep  PCASGRWDKTAX
                   130
```

Computer analysis of this amino acid sequence gave the following results:

Homology with a Predicted ORF from *N. Gonorrhoeae*

ORF 001 shows 89.3% identity over a 131 aa overlap with a predicted ORF (ORF 001.ng) from *N. gonorrhoeae*:

```
m001/g001
                    10         20         30         40         50         60
    m001.pep  MLPQGKAARRMSANEVCGXLXAWXVLVICQTLPKRDTLNGSGTHTVPVWAILPRSLRSKS
              ||||||||||:|||||  |    ||||||||||||||||||:||||||||||||||
    g001      MLPQGKAARRVSANEVSGRACARMVLVICQTLPKRDTLNGSGTHTLPVWAILPRSLRSKS
                    10         20         30         40         50         60

70         80         90        100        110        120
    m001.pep  TIITFSARFFGSACNSAARRSSCPSPKIGAVPFIGSVLMVPSEPILRKSSGEKHSVHADC
              ||||||||||||:||||||||||||||||||||||||||||||:||||||||||||||||
    g001      TIITFSARFFGSVCNSAARRSSCPSPKIGAVPFIGSVLMVPSEAMLRKSSGEKHSVHADC
                    70         80         90        100        110        120

130
    m001.pep  PSASGRWDKTAX
              |::||||| :|||
    g001      PASSGRWDNTAX
                   130
```

The following partial DNA sequence was identified in *N. gonorrhoeae* <SEQ ID 7>:

```
g003.seq
    1  ATGGTCGTAT TCGTGGCTGA AGGCGTATTC GGTCGCGCTG TTTTGGGTCA

51  CTTGGTATTG CTCTTCGGTC AGGGTGCGTT TGAGTTCGGC GTCACTCGGT

101  TTTTTATACG TTGCCGCGTC GAAGCCTTTG CCTTGCGGTG CGGCTTTGGT

151  TTTGCCCGGC AGCGGTTCGT CGGCTTTGCG GATGTCGATG TGGCAGTAGC

201  CGTTGGGGTT TTTAATCAGG TAGTCCTGAT GGTATTCCTC GGCGTCGTAG

251  AAGTTTTTCA GCGGTTCGTT TTCAACAACG AGGGGCAGTT GGTATTTTTG

301  CTGCTCGCGT TTGAGGGCGG CGGCGATGAC GGCTTTTTCG GCGGGGTCGG

351  TGTAGTACAC GCCGCTGCGG TATTGCGTGC CGGTGTCGTT ACCCTGTTTG

401  TTGAGGCTGG TCGGATCAAC GACGCGGAAA TAATATTGCA GGATGTCGTC

451  CAGgCTGagt TTGTCGGCAT CGTaggtcac tTTGACGGTC TCGGCATGAC

501  CCGTATGGCG GTaggacact tctTCgtanc TcGGGtTTTC CGTGttGCCG

551  TTGGCgttac cGGATACCGC gtcaACCACG CCGTcgatgc gttggaAATa 601  ggCTTCCAAg ccccaaaagc agccgccggc gaagtaaatg gtgcccgtgt 651  tcatgattGC TGa
```

This corresponds to the amino acid sequence <SEQ ID 8; ORF 003.ng>:

```
g003.pep
    1  MVVFVAEGVF GRAVLGHLVL LFGQGAFEFG VTRFFIRCRV EAFALRCGFG

51  FARQRFVGFA DVDVAVAVGV FNQVVLMVFL GVVEVFQRFV FNNEGQLVFL

101  LLAFEGGGDD GFFGGVGVVH AAAVLRAGVV TLFVEAGRIN DAEIILQDVV

151  QAEFVGIVGH FDGLGMTRMA VGHFFVRVFR VAVGVTGYRV NHAVDALEIG

201  FQAPKAAAGE VNGARVHDC
```

The following partial DNA sequence was identified in *N. meningitidis* <SEQ ID 9>:

```
m003.sq
    1  ATGGTCGTAT TCGTGGCTGA AGGCATATTC GGTCGCGCTG TTTTGGGTAA

51  CTTGsTATTG CTCTTCGGTC AGGGTGCGTT TGAGTTCGGC GTCACTCGGT

101  TTTTTATACG TTGCCGCGTC GAAGCCTTTG CCTTGCGGGG CGGTCTTGGT

151  TTTGCCCGGC AGCGGTTCGT CAGCkTTGCG GATGTCGATG TGGCAGTAGC

201  CGTTGGGGTT TTTAATCAAG TAGTCCTGAT GGTATTCCTC GGCATCGTAG

251  AAGTTTTtCA GCGGCTCGTT TTCAACAACG AGGGGCAGTT GGTATTTTTG

301  CTGCTCGCGT TTGAGGGCGk CGGCGATGAC GGCTTTTTCG kCGGGGTCGG

351  TGTAGTACAC GCCGCTGCGG TATTGCGTAC CGGTGTCGTT GCCCTGTTTG

401  TTGAGGCTGG TCGGATCAAC GACGCGGAAG AAATATTGCA GGATGTCGTC

451  TAGGCTGAGT TTGTCGGCAT CGTAGGTCAC TTTGACGGTT TCGGCGTGGC

501  CCGTATGGCG GTAGGACACG TCTTCATAGC TCGGATTTTT CGTGTTGCCG

551  TTGGCGTAGC CGGATACCGC GTCAACCACG CCGTCGATGC GTTGGAAATA

601  GGCTTCCAAG CCCCAGAAGC AGCg.CCGGC GAGGTAAATG GTGCGCGTGT

651  TCATGATTTT TGA
                                                            40
```

This corresponds to the amino acid sequence <SEQ ID 10; ORF 003>:

```
m003.pep Length: 221
    1  MVVFVAEGIF GRAVLGNLXL LFGQGAFEFG VTRFFIRCRV EAFALRGGLG

51  FARQRFVSXA DVDVAVAVGV FNQVVLMVFL GIVEVFQRLV FNNEGQLVFL

101  LLAFEGXGDD GFFXGVGVVH AAAVLRTGVV ALFVEAGRIN DAEEILQDVV

151  *AEFVGIVGH FDGFGVARMA VGHVFIARIF RVAVGVAGYR VNHAVDALEI

201  GFQAPEAAXG EVNGARVHDF *
```

The following partial DNA sequence was identified in *N. meningitidis* <SEQ ID 11>:

```
a003.seq
    1  ATGGTCGTAT TCGTGGCTGA AGGCATATTC GGTCGCGCTG TTTTGGGTAA

51  CTTGGTATTG CTCTTCGGTC AGGGTGCGTT TGAGTTCGGC GTCACTCGGT

101  TTTTTATACG TTGCCGCGTC GAAGCCTTTG CCTTGCGGTG CGGTCTTGGT

151  TTTGCCCGGC AGCGGTTCGT CGGCTTTGCG GATATCGATG TGGCAGTAGC

201  CGTTGGGGTT TTTAATCAAG TAGTCCTGAT GGTATTCCTC GGCATCGTAG
```

```
251  AAGTTTTTCA GCGGCTCGTT TTCAACAACG AGGGGCAGTT GGTATTTTTG

301  CTGCTCGCGT TTGAGGGCGG CGGCGATGAC GGCTTTTTCG GCGGGGTCGG

351  TGTAGTACAC GCCGCTGCGG TATTGCGTAC CGGTGTCGTT GCCCTGTTTG

401  TTGAGGCTGG TCGGATCAAC GACGCGGAAG AAATATTGCA GGATGTCGTC

451  TAGGCTGAGT TTGTCGGCAT CGTAGGTCAC TTTGACGGTT TCGGCGTGGC

501  CCGTATGGCG GTAGGACACG TCTTCATAGC TCGGATTTTT CGTGTTGCCG

551  TTGGCGTAGC CGGATACCGC GTCAACCACG CCGTCGATGC GTTGGAAATA

601  GGCTTCCAAG CCCCAGAAGC AGCCGCCGGC GAGGTAGATG GTGCGCGTGT

651  TCATGATTTT TGA
```

This corresponds to the amino acid sequence <SEQ ID 12; ORF 003.a>:

```
a003.pep
   1 MVVFVAEGIF GRAVLGNLVL LFGQGAFEFG VTRFFIRCRV EAFALRCGLG

51 FARQRFVGFA DIDVAVAVGV FNQVVLMVFL GIVEVFQRLV FNNEGQLVFL

101 LLAFEGGGDD GFFGGVGVVH AAAVLRTGVV ALFVEAGRIN DAEEILQDVV

151 *AEFVGIVGH FDGFGVARMA VGHVFIARIF RVAVGVAGYR VNHAVDALEI

201 GFQAPEAAAG EVDGARVHDF *
``` m003/a003 95.9% identity over a 220 aa overlap

```
                 10         20         30         40         50         60
   m003.pep  MVVFVAEGIFGRAVLGNLXLLFGQGAFEFGVTRFFIRCRVEAFALRGGLGFARQRFVSXA
             ||||||||||||||||||| |||||||||||||||||||||||||||| ||||||||: |
      a003  MVVFVAEGIFGRAVLGNLVLLFGQGAFEFGVTRFFIRCRVEAFALRCGLGFARQRFVGFA
                 10         20         30         40         50         60

70         80         90        100        110        120
   m003.pep  DVDVAVAVGVFNQVVLMVFLGIVEVFQRLVFNNEGQLVFLLLAFEGXGDDGFFXGVGVVH
             |:||||||||||||||||||||||||||||||||||||||||||| |||||| ||||||
      a003  DIDVAVAVGVFNQVVLMVFLGIVEVFQRLVFNNEGQLVFLLLAFEGGGDDGFFGGVGVVH
                 70         80         90        100        110        120

130        140        150        160        170        180
   m003.pep  AAAVLRTGVVALFVEAGRINDAEEILQDVVXAEFVGIVGHFDGFGVARMAVGHVFIARIF
             ||||||||||||||||||||||||||||||||||||||||||||||||||||||||||||
      a003  AAAVLRTGVVALFVEAGRINDAEEILQDVVXAEFVGIVGHFDGFGVARMAVGHVFIARIF
                130        140        150        160        170        180

190        200        210        220
   m003.pep  RVAVGVAGYRVNHAVDALEIGFQAPEAAXGEVNGARVHDFX
             |||||||||||||||||||||||||||||||:||||||||
      a003  RVAVGVAGYRVNHAVDALEIGFQAPEAAXGEVDGARVHDFX
                190        200        210        220
```

Computer analysis of this amino acid sequence gave the following results:

Homology with a Predicted ORF from *N. Gonorrhoeae*

ORF 003 shows 88.6% identity over a 219 aa overlap with a predicted ORF (ORF 003.ng) from *N. gonorrhoeae*:

```
m003/g003
                 10         20         30         40         50         60
   m003.pep  MVVFVAEGIFGRAVLGNLXLLFGQGAFEFGVTRFFIRCRVEAFALRGGLGFARQRFVSXA
             ||||||||:||||||:| ||||||||||||||||||||||||||||:|||||||||: |
      g003  MVVFVAEGVFGRAVLGHLVLLFGQGAFEFGVTRFFIRCRVEAFALRCGFGFARQRFVGFA
                 10         20         30         40         50         60

70         80         90        100        110        120
   m003.pep  DVDVAVAVGVFNQVVLMVFLGIVEVFQRLVFNNEGQLVFLLLAFEGXGDDGFFXGVGVVH
             ||||||||||||||||||||:|||||:|||||||||||||||||||| |||||| ||||||
      g003  DVDVAVAVGVFNQVVLMVFLGVVEVFQRFVFNNEGQLVFLLLAFEGGGDDGFFGGVGVVH
                 70         80         90        100        110        120
```

```
                 130        140        150        160        170        180
m003.pep  AAAVLRTGVVALFVEAGRINDAEEILQDVVXAEFVGIVGHFDGFGVARMAVGHVFIARIF
          ||||||:|||:|||||||||||  ||||||  ||||||||||||||  |:::||||||  |:  |:|
g003      AAAVLRAGVVTLFVEAGRINDAEIILQDVVQAEFVGIVGHFDGLGMTRMAVGHFFV-RVF
                 130        140        150        160        170        180

190        200        210        220
m003.pep  RVAVGVAGYRVNHAVDALEIGFQAPEAAXGEVNGARVHDFX
          ||||||:||||||||||||||||||||:||  ||||||||||
g003      RVAVGVTGYRVNHAVDALEIGFQAPKAAAGEVNGARVHDC
                 190        200        210
```

The following partial DNA sequence was identified in *N. gonorrhoeae* <SEQ ID 13>:

```
g004.seq
    1  ATGgtagAAC GGCATATCCA GCATTTGCGG AACGGTCATC TTCATTTGAT

51  GCGCCCATGC CAACAagtga gccaAAtgtT CGGCGGCAGG GCCTacgatT

101  TCCGCGCCGA TAAagcggcc gGTGgctTTT tcgGCataca ggcgcaTatg 151  gCCTTTGTTT ACCAgcatca cgcggctgcg accttgaTTT TTGAACGATA 201  CTTCGCCgaT GACAAATTCG TCGGCTTGGT ATTGCGCGGC AACCTGCGCG 251  TATTTCAAAC CGACAAAGCC GATTTGCgga ctggtaaACA CCACGCCAAT 301  GGTgctgcgg cGCAAACCGC TGCCGATATt cgGgtagcgg ccccgcgtta 351  ttgcccggca atcttacctt ggtcggcggc ttcatGCAGC AGGGGCagtt 401  ggttggacgc gtcgcccgca ataAAGATAT GCGGAATgct ggtCTGCATg 451  gtCAGCGGAT CGGCAACGGG tacgccgcgc gcgtctttgT CGATATTGAT 501  GTTTTCCAAA CCGATATtgT CAACGTTCGG ACGGCgACCT ACGGCTGCCA

551  ACATATATTC GGCAACAAAT ACGCCTTTTT CGCCATCCTG CTCCCAATGG

601  ACTtctACAT TGCCGTCTGC GTCGAGTTTG ACCTCGGTTT TAGCATCCAG

651  ATGCAGTTTC AATtctTCTC CGAACACGGC TTTCGCCTCG TCTGAAACAA

701  CGGGGTCGGA AATGCCGCCG ATGATTCCGC CCAAACCGAA AATTTCAACT

751  TTCACACCCA AACGGTGCAA TGCCTGA
```

This corresponds to the amino acid sequence <SEQ ID 14; ORF 004.ng>:

```
g004.pep
    1  MVERHIQHLR NGHLHLMRPC QQVSQMFGGR AYDFRADKAA GGFFGIQAHM

51  AFVYQHHAAA TLIFERYFAD DKFVGLVLRG NLRVFQTDKA DLRTGKHHAN

101  GAAAQTAADI RVAAPRYCPA ILPWSAASCS RGSWLDASPA IKICGMLVCM

151  VSGSATGTPR ASLSILMFSK PILSTFGRRP TAANIYSATN TPFSPSCSQW

201  TSTLPSASSL TSVLASRCSF NSSPNTAFAS SETTGSEMPP MIPPKPKIST

251  FTPKRCNA*
```

The following partial DNA sequence was identified in *N. meningitidis* <SEQ ID 15>:

```
m004.seq
    1  ATGGTAGAAC GGCATATCCA GCATTTGCGG AACGGTCATC TTCATTTGAT

51  GTGCCCAAGC CAACAGGTGC GCCAAATGTT CGGCGGCAGG GCCTACGATT

101  TCCGCGCCGA TAAAGCGGCC GGTGGCTTTT TCGGCATACA GGCGCATATG
```

-continued

```
151 GCCTTTGTTC ACCAGCATCA CGCGGCTGCG GCCTTGGTTT TTGAACGATA

201 CTTCGCCGAT GACAAATTCG TCGGCTTGGT ATTGCGCGGC AACCTGCGCG

251 TATTTCAGAC CGACAAAGCC GATTTGCGGA CTGGTAAACA CCACGCCGAT

301 GGTGCTGCGC CGCAAACCGC CGCCGATATT CGGGTAGCGG CCGCGTTATC

351 GCCGGCAATC TTGCCTTGGT CGGCAGCTTC ATGCAGCAGA GGCAGTTGGT

401 TGGACGCATC GCCTGCGATG AAGATATGCG GAATACTGGT CTGCATGGTC

451 AGCGGGTCGG CAACAGGTAC GCCGCGCGCA TCTTTTTCGA TATTGATATT

501 TTCCAAACCG ATATTGTCAA CGTTCGGACG GCGGCCCACG GCTGCCAGCA

551 TATATTCGGC AACAAATACG CCTTTTTCGC CATCCTGCTC CCAATGGACT

601 TCTACATTGC CGTCTGCATC GAGTTTGACC TCGGTTTTAG CATCCAGATG

651 CAGTTTCAAT TCTTCGCCGA ACACGGCGTT CGCCTCGTCT GAAACGACGG

701 GGTCGGAAAT GCCGCCGATG ATTCCGCCCA AACCGAAAAT TTCAACTTTC

751 ACGCCCAAAC GGTGCAATGC CTGA
```

This corresponds to the amino acid sequence <SEQ ID 16; ORF 004>:

```
m004.pep
  1 MVERHIQHLR NGHLHLMCPS QQVRQMFGGR AYDFRADKAA GGFFGIQAHM

51 AFVHQHHAAA ALVFERYFAD DKFVGLVLRG NLRVFQTDKA DLRTGKHHAD

101 GAAPQTAADI RVAAALSPAI LPWSAASCSR GSWLDASPAM KICGILVCMV

151 SGSATGTPRA SFSILIFSKP ILSTFGRRPT AASIYSATNT PFSPSCSQWT

201 STLPSASSLT SVLASRCSFN SSPNTAFASS ETTGSEMPPM IPPKPKISTF

251 TPKRCNA*
```

The following partial DNA sequence was identified in *N. meningitidis* <SEQ ID 17>:

```
a004.seq
  1 ATGGTAGAAC GGCATATCCA GCATTTGCGG AACGGTCATC TTCATTTGAT

51 GTGCCCAAGC CAACAGGTGC GCCAAATGTT CGGCGGCCGG ACCTACGATT

101 TCTGCGCCGA TGAAGCGGCC GGTGGCTTTT TCGGCATACA GGCGCATATG

151 GCCTTTGTTT ACCAGCATCA CGCGGCTGCG GCCTTGGTTT TTGAACGATA

201 CTTCGCCGAT GACAAATTCG TCGGCTTGGT ATTGCGCGGC AACCTGCGCG

251 TATTTCAAAC CGACAAAGCC GATTTGCGGA CTGGTGAACA CTACGCCGAT

301 GGTGCTGCGG CGCAAACCGC CGCCGATATT CGGGTAGCGG CCGCGTTATC

351 GCCGGCAATC TTGCCTTGGT CGGCGGCTTC ATGCAGCAGG GGCAGTTGGT

401 TGGACGCGTC GCCCGCAATA AAGATATGCG GAATACTGGT CTGCATAGTC

451 AGCGGATCGG CAACGGGTAC GCCGCGCGCA TCTTTTTCGA TATTGATGTT

501 TTCCAAACCG ATATTGTCAA CGTTCGGACG GCGGCCTACG GCTGCCAGCA

551 TATATTCGGC AACAAATACG CCTTTTTCGC CATCCTGCTC CCAATGGACT

601 TCTACATTGC CGTCTGCGTC GAGTTTGGCC TCGGTTTTAG CATCCAAATG

651 CAGTTTCAAT TCTTCACCGA ACACGGCTTT CGCCTCGTCT GAAACGACGG
```

-continued

```
701 GGTCGGAAAT GCCGCCGATG ATGCCACCCA AACCGAAAAT TTCAACTTTC

751 ACGCCCAAAC GGTGCAATGC CTGA
```

This corresponds to the amino acid sequence <SEQ ID 18; ORF 004.a>:

```
a004.pep
  1 MVERHIQHLR NGHLHLMCPS QQVRQMFGGR TYDFCADEAA GGFFGIQAHM

51 AFVYQHHAAA ALVFERYFAD DKFVGLVLRG NLRVFQTDKA DLRTGEHYAD

101 GAAAQTAADI RVAAALSPAI LPWSAASCSR GSWLDASPAI KICGILVCIV

151 SGSATGTPRA SFSILMFSKP ILSTFGRRPT AASIYSATNT PFSPSCSQWT

201 STLPSASSLA SVLASKCSFN SSPNTAFASS ETTGSEMPPM MPPKPKISTF

251 TPKRCNA*
``` m004/a004 94.9% identity over a 257 aa overlap

```
                  10        20        30        40        50        60
   m004.pep MVERHIQHLRNGHLHLMCPSQQVRQMFGGRAYDFRADKAAGGFFGIQAHMAFVHQHHAAA
            |||||||||||||||||||||||||||||| ||| ||:|||||||||||||||:||||||
   a004     MVERHIQHLRNGHLHLMCPSQQVRQMFGGRTYDFCADEAAGGFFGIQAHMAFVYQHHAAA
                  10        20        30        40        50        60

70        80        90       100       110       120
   m004.pep ALVFERYFADDKFVGLVLRGNLRVFQTDKADLRTGKHHADGAAPQTAADIRVAAALSPAI
            ||||||||||||||||||||||||||||||||||||:|:|||| ||||||||||||||||
   a004     ALVFERYFADDKFVGLVLRGNLRVFQTDKADLRTGEHYADGAAAQTAADIRVAAALSPAI
                  70        80        90       100       110       120

130       140       150       160       170       180
   m004.pep LPWSAASCSRGSWLDASPAMKICGILVCMVSGSATGTPRASFSILIFSKPILSTFGRRPT
            |||||||||||||||||||||:||||||||:|||||||||||||||:|||||||||||||
   a004     LPWSAASCSRGSWLDASPAIKICGILVCIVSGSATGTPRASFSILMFSKPILSTFGRRPT
                 130       140       150       160       170       180

190       200       210       220       230       240
   m004.pep AASIYSATNTPFSPSCSQWTSTLPSASSLTSVLASRCSFNSSPNTAFASSETTGSEMPPM
            |||||||||||||||||||||||||||||||:|||||:||||||||||||||||||||||
   a004     AASIYSATNTPFSPSCSQWTSTLPSASSLASVLASKCSFNSSPNTAFASSETTGSEMPPM
                 190       200       210       220       230       240

250
   m004.pep IPPKPKISTFTPKRCNAX
            :|||||||||||||||||
   a004     MPPKPKISTFTPKRCNAX
                 250
```

Computer analysis of this amino acid sequence gave the following results:

Homology with a Predicted ORF from *N. Gonorrhoeae*

ORF 004 shows 93.4% identity over a 258 aa overlap with a predicted ORF (ORF 004.ng) from *N. gonorrhoeae*:

```
m004/g004

10        20        30        40        50        60
   m004.pep MVERHIQHLRNGHLHLMCPSQQVRQMFGGRAYDFRADKAAGGFFGIQAHMAFVHQHHAAA
            |||||||||||||||| | ||| ||||||||||||||||||||||||||||||:||||||
   g004     MVERHIQHLRNGHLHLMRPCQQVSQMFGGRAYDFRADKAAGGFFGIQAHMAFVYQHHAAA
                  10        20        30        40        50        60

70        80        90       100       110       120
   m004.pep ALVFERYFADDKFVGLVLRGNLRVFQTDKADLRIGKHHADGAAPQTAADIRVAAA-LSPA
            :|:|||||||||||||||||||||||||||||||:|||||||:||| ||||||||||  ||
   g004     TLIFERYFADDKFVGLVLRGNLRVFQTDKADLRTGKHHANGAAAQTAADIRVAAPRYCPA
                  70        80        90       100       110       120
```

```
                  120        130        140        150        160        170       179
    m004.pep   ILPQSAASCSRGSWLDASPAMKICGILVCMVSGSATGTPRASFSILIFSKPILSTFGRRP
               ||||||||||||||||||:||||:||||||||||||||||||:|||:|||||||||||||
    g004       ILPWSAASCSRGSWLDASPAIKICGMLVCMVSGSATGTPRASLSILMFSKPILSTFGRRP
                  130        140        150        160        170       180

180        190        200        210        220        230       239
    m004.pep   TAASIYSATNTPFSPSCSQWTSTLPSASSLTVLASRCSFNSSPNTAFASSETTGTSEMPP
               |||:||||||||||||||||||||||||||||:|||||||||||||||||||||:||||
    g004       TAANIYSATNTPFSPSCSQWTSTLPSASSLTSVLASRCSFNSSPNTAFASSETTGSEMPP
                  190        200        210        220        230       240

240        250
    m004.pep   MIPPKPKISTFTPKRCNAX
               ||||||||||||||||||
    g004       MIPPKPKISTFTPKRCNA
                          250
```

The following partial DNA sequence was identified in *N. gonorrhoeae* <SEQ ID 19>:

```
g005.seq
    1 ATGGGGATGG ACAATATTGA TATGTTCATG CCTGAACAAG AGGAAATCCA

51 ATCAATGTGG AAAGAAATTT TACTGAATTA CGGTATTTTC CTGCTCGAAC

101 TGCTTACCGT GTTCGGCGCA ATTGCGCTGA TTGTGTTGGC TATCGTACAG

151 AGTAAGAAAC AGTCGGAAAG CGGCAGTGTC GTACTGACAG ATTTTTCGGA

201 AAATTATAAA AAACAGCGGC AATCGTTTGA ACATTCTTT TTAAGCGAGG

251 AAGAGACAAA ACATCAGGAA AAAAAGAAA AGAAAAAGGA AAAGGCGGAA

301 GCCAAAGCAG AGAAAAAGCG TTTGAAGGAG GGCGGGGAGA AATCTGCCGA

351 AACGCAAAAA TCCCGCCTTT TTGTGTTGGA TTTTGACGGC GATTTGTATG

401 CACACGCCGT AGAATCCTTG CGTCATGAGA TTACGGCGGT GCTTTTGATT

451 GCCAAGCCTG AAGATGAGGT TCTGCTCAGA TTGGAAAGTC CGGGCGGCGT

501 GGTTCACGGT TACGGTTTGG CGGCTTCGCA GCTTAGGCGT TTGCGCGAAC

551 GCAATATTCC GCTGAccgtc gccgTCGATA AGGTCGCGGC AAGCGgcggc 601 tatatgatgg cgtgtgtgGC GGATAAAATT GTTTCCGCtc cgtttgcggt 651 catcggttcg gtgggtgtgg tgGcggaagt gcCGAATATC CAccgCctGT

701 TGAAAAAACA TGATATTGAT GTGGATGTGA TGACGGCGGG CGAATTTAAG

751 CGCACGGTTA CTTTTATGGG TGAAAATACG GAAAAGGGCA AACAGAAATT

801 CCGGCAGGAA CTGGAGGAAA CGCATCAGTT GTTCAAGCAG TTTGTCAGTG

851 AAAACCGCCC CGGGTTGGAT ATTGAAAAAA TAGCGACGGG CGAGCATTGG

901 TTCGGCCGGC AGGCGTTGGC GTTGAACTTG ATTGACGAGA TTTCGACCAG

951 TGATGATTTG TTGTTGAAAG CGTTTGAAAA CAAACAGGtt aTCGAAGTGA

1001 AATATCAGGA GAAGCGAAGC CTGATCCAGC GCATTGGTTT GCAGGCGGAA

1051 GCTTCCGTTG AAAAGTTGTT TGCCAAACTT GTCAACCGGC GAGCGGATGT

1101 GATGTAG
```

This corresponds to the amino acid sequence <SEQ ID 20; ORF 005.ng>:

```
g005.pep
    1 MGMDNIDMFM PEQEEIQSMW KEILLNYGIF LLELLTVFGA IALIVLAIVQ

51 SKKQSESGSV VLTDFSENYK KQRQSFETFF LSEEETKHQE KKEKKKEKAE
```

-continued

```
101 AKAEKKRLKE GGEKSAETQK SRLFVLDFDG DLYAHAVESL RHEITAVLLI

151 AKPEDEVLLR LESPGGVVHG YGLAASQLRR LRERNIPLTV AVDKVAASGG

201 YMMACVADKI VSAPFAVIGS VGVVAEVPNI HRLLKKHDID VDVMTAGEFK

251 RTVTFMGENT EKGKQKFRQE LEETHQLFKQ FVSENRPGLD IEKIATGEHW

301 FGRQALALNL IDEISTSDDL LLKAFENKQV IEVKYQEKRS LIQRIGLQAE

351 ASVEKLFAKL VNRRADVM*
```

The following partial DNA sequence was identified in *N. meningitidis* <SEQ ID 21>:

```
m005.seq
   1 ATGGACAATA TTGACATGTT CATGCCTGAA CAAGAGGAAA TCCAATCAAT

51 GTGGAAAGAA ATTTTACTGA ATTACGGTAT TTTCCTGCTC GAACTGCTTA

101 CCGTGTTCGG CGCAATTGCG CTGATTGTGT TGGCTATCGT ACAGAGTAAG

151 AAACAGTCGG AwAGCGGCAG TGTCGTACTG ACGGATTTTT CGGAAAATTA

201 TAAAAAACAG CGGCAATCGT TTGAAGCATT CTTTTTAAGC GGGGAAGAGG

251 CACAACATCA GGAAAAAGAG GAAAAGAAAA AGGAAAAGGC GGAAGCCAAA

301 GCAGAGAAAA A.CGTTTGAA GGAGGGTGGG GAGAAATCTG CCGAAACGCA 351 nAAATCACGC CTTTTTGTGT TGGANNNNNN NNNNNNNNNN NNNNNNNNNN

401 NNNNNNNNNN NNNNNNNNNN NNNNNNNNNN NNNNNNNNNN NNNNNNNNNN

451 NNNNNNNNNN NNNNNNNNNN NNNNNNNNNN NNNNNNNNNN NNNNNNNNNN

501 NNNNNNNNNN NNNNNNNNNN NNNNNNNNNN NNNNNNNNNN NNNNNNNNNN

551 NNNNNNNNNN NNNNNNNNNN NNNNNNNNNN NNGCGAGCGG CGGTTATATG

601 ATGGCGTGTG TGGCGGATAA AATTGCTTCC GCTCCGTTTG CGATTGTCGG

651 TTCGGTGGGT GTGGTGGCGG AAGTACCGAA TATCCACCGC CTGTTGAAAA

701 AACATGATAT TGATGTGGAT GTGATGACGG CGGGCGAATT TAAGCGCACG

751 GTTACTTTTA TGGGTGAAAA TACGGAAAAG GGCAAACAGA AATTCCGACA

801 GGAACTGGAG GAAACGCATC AGTTGTTCAA GCAGTTTGTC AGCGAGAACC

851 GCCCTCAATT GGATATTGAG GAAGTGGCAA CGGGCGAGCA TTGGTTCGGT

901 CGGCAGGCGT TGGCGTTGAA CTTGATTGAC GAGATTTCGA CCAGTGATGA

951 TTTGTTGTTG AAAGCGTTTG AAAACAAACA GGTTATCGAA GTGAAATATC

1001 AGGAGAAGCA AAGCCTGATC CAGCGCATTG GTTTGCAGGC GGAAGCTTCT

1051 GTTGAAAAGT TGTTTGCCAA ACTTGTCAAC CGGCGGGCGG ATGTGATGT A

1101 G
```

This corresponds to the amino acid sequence <SEQ ID 22; ORF 005>:

```
m005.pep
   1 MDNIDMFMPE QEEIQSMWKE ILLNYGIFLL ELLTVFGAIA LIVLAIVQSK

51 KQSXSGSVVL TDFSENYKKQ RQSFEAFFLS GEEAQHQEKE EKKKEKAEAK

101 AEKXRLKEGG EKSAETXKSR LFVLXXXXXX XXXXXXXXXX XXXXXXXXXX

151 XXXXXXXXXX XXXXXXXXXX XXXXXXXXXX XXXXXXXXXX XXXXASGGYM

201 MACVADKIAS APFAIVGSVG VVAEVPNIHR LLKKHDIDVD VMTAGEFKRT
```

```
251 VTFMGENTEK GKQKFRQELE ETHQLFKQFV SENRPQLDIE EVATGEHWFG

301 RQALALNLID EISTSDDLLL KAFENKQVIE VKYQEKQSLI QRIGLQAEAS

351 VEKLFAKLVN RRADVM*
```

The following partial DNA sequence was identified in *N. meningitidis* <SEQ ID 23>:

```
a005.seq
    1 ATGGACAATA TTGACATGTT CATGCCTGAA CAAGAGGAAA TCCAATCAAT

51 GTGGAAAGAA ATTTTACTGA ATTACGGTAT TTTCCTGCTC GAACTGCTTA

101 CCGTGTTCGG CGCAATTGCG CTGATTGTGT TGGCTATCGT ACAGAGTAAG

151 AAACAGTCGG AAAGCGGCAG TGTCGTACTG ACGGATTTTT CGGAAAATTA

201 TAAAAACAG CGGCAATCGT TTGAAGCATT CTTTTTAAGC GGGGAAGAGG

251 CAAAACATCA GGAAAAAGAG GAAAAGAAAA AGGAAAAGGC GGAAGCCAAA

301 GCAGAGAAAA AGCGTTTGAA GGAGGGTGGG GAGAAATCTT CCGAAACGCA

351 AAAATCCCGC CTTTTTGTGT TGGATTTTGA CGGCGATTTG TATGCACACG

401 CCGTAGAATC CTTGCGTCAT GAGATTACGG CGGTGCTTTT GATTGCCAAG

451 CCTGAAGATG AGGTTCTGCT TAGATTGGAA AGTCCGGGCG GCGTGGTTCA

501 CGGTTACGGT TTGGCGGCTT CGCAGCTTAG GCGTTTGCGC GAACGCAATA

551 TTCCGCTGAC CGTCGCCGTC GATAAGGTGG CGGCGAGCGG TGGTTATATG

601 ATGGCGTGTG TGGCGGATAA AATTGTTTCC GCTCCGTTTG CGATTGTCGG

651 TTCGGTGGGT GTTGTAGCGG AAGTACCGAA TATCCACCGC CTGTTGAAAA

701 AACATGATAT TGATGTGGAT GTGATGACGG CGGGCGAATT TAAGCGCACG

751 GTTACTTTTA TGGGTGAAAA TACGGAAAAG GGCAAACAGA AATTCCGACA

801 GGAACTGGAG GAAACGCATC AGTTGTTCAA GCAGTTTGTC AGCGAGAACC

851 GCCCTCAATT GGATATTGAG GAAGTGGCAA CGGGCGAGCA TTGGTTCGGT

901 CGGCAGGCGT TGGCGTTGAA CTTGATTGAC GAGATTTCGA CCAGTGATGA

951 TTTGTTGTTG AAAGCGTTTG AAAACAAACA GGTTATCGAA GTGAAATATC

1001 AGGAGAAGCA AAGCCTGATC CAGCGCATTG GTTTGCAGGC GGAAGCTTCT

1051 GTTGAAAAGT TGTTTGCCAA ACTTGTCAAC CGGCGGGCGG ATGTGATGTA

1101 G
```

This corresponds to the amino acid sequence <SEQ ID 24; ORF 005.a>:

```
a005.pep
    1 MDNIDMFMPE QEEIQSMWKE ILLNYGIFLL ELLTVFGAIA LIVLAIVQSK

51 KQSESGSVVL TDFSENYKKQ RQSFEAFFLS GEEAKHQEKE EKKKEKAEAK

101 AEKKRLKEGG EKSSETQKSR LFVLDFDGDL YAHAVESLRH EITAVLLIAK

151 PEDEVLLRLE SPGGVVHGYG LAASQLRRLR ERNIPLTVAV DKVAASGGYM

201 MACVADKIVS APFAIVGSVG VVAEVPNIHR LLKKHDIDVD VMTAGEFKRT

251 VTFMGENTEK GKQKFRQELE ETHQLFKQFV SENRPQLDIE EVATGEHWFG

301 RQALALNLID EISTSDDLLL KAFENKQVIE VKYQEKQSLI QRIGLQAEAS

351 VEKLFAKLVN RRADVM*
``` m005/a005 79.2% identity over a 366 aa overlap

```
                 10        20        30        40        50        60
m005.pep  MDNIDMFMPEQEEIQSMWKEILLNYGIFLLELLTVFGAIALIVLAIVQSKKQSXSGSVVL
          ||||||||||||||||||||||||||||||||||||||||||||||||||||| ||||
a005      MDNIDMFMPEQEEIQSMWKEILLNYGIFLLELLTVFGAIALIVLAIVQSKKQSESGSVVL
                 10        20        30        40        50        60

70        80        90       100       110       120
m005.pep  TDFSENYKKQRQSFEAFFLSGEEAQHQEKEEKKKEKAEAKAEKXRLKEGGEKSAETXKSR
          ||||||||||||||||||||||||||:||||||||||||||| ||||||||||: || ||
a005      TDFSENYKKQRQSFEAFFLSGEEAKHQEKEEKKKEKAEAKAEKKRLKEGGEKSSETQKSR
                 70        80        90       100       110       120

130       140       150       160       170       180
m005.pep  LFVLXXXXXXXXXXXXXXXXXXXXXXXXXXXXXXXXXXXXXXXXXXXXXXXXXXXXXXXX
          ||||                            :
a005      LFVLDFDGDLYAHAVESLRHEITAVLLIAKPEDEVLLRLESPGGVVHGYGLAASQLRRLR
                130       140       150       160       170       180

190       200       210       220       230       240
m005.pep  XXXXXXXXXXXXXXASGGYMMACVADKIASAPFAIVGSVGVVAEVPNIHRLLKKHDIDVD
                :         ||||||||||||||:|||||||||||||||||||||||||||||
a005      ERNIPLTVAVDKVAASGGYMMACVADKIVSAPFAIVGSVGVVAEVPNIHRLLKKHDIDVD
                190       200       210       220       230       240

250       260       270       280       290       300
m005.pep  VMTAGEFKRTVTFMGENTEKGKQKFRQELEETHQLFKQFVSENRPQLDIEEVATGEHWFG
          ||||||||||||||||||||||||||||||||||||||||||||||||||||||||||
a005      VMTAGEFKRTVTFMGENTEKGKQKFRQELEETHQLFKQFVSENRPQLDIEEVATGEHWFG
                250       260       270       280       290       300

310       320       330       340       350       360
m005.pep  RQALALNLIDEISTSDDLLLKAFENKQVIEVKYQEKQSLIQRIGLQAEASVEKLFAKLVN
          ||||||||||||||||||||||||||||||:|||||:|||||||||||||||||||||
a005      RQALALNLIDEISTSDDLLLKAFENKQVIEVKYQEKQSLIQRIGLQAEASVEKLFAKLVN
                310       320       330       340       350       360 m005.pep  RRADVMX
          |||||||
a005      RRADVMX
```

Computer analysis of this amino acid sequence gave the following results:

Homology with a Predicted ORF from *N. Gonorrhoeae*

ORF 005 shows 77.0% identity over a 366 aa overlap with a predicted ORF (ORF 005.ng) from *N. gonorrhoeae*:

```
m005/g005
                 10        20        30        40        50
m005.pep    MDNIDMFMPEQEEIQSMWKEILLNYGIFLLELLTVFGAIALIVLAIVQSKKQSXSGSV
            ||||||||||||||||||||||||||||||||||||||||||||||||||||| ||||
g005      MGMDNIDMFMPEQEEIQSMWKEILLNYGIFLLELLTVFGAIALIVLAIVQSKKQSESGSV
                 10        20        30        40        50        60

60        70        80        90       100       110
m005.pep  VLTDFSENYKKQRQSFEAFFLSGEEAQHQEKEEKKKEKAEAKAEKKRLKEGGEKSAETXK
          |||||||||||||||||||:||||  ||::||||:|||||||||||||||||||||| |
g005      VLTDFSENYKKQRQSFETFFLSEEETKHQEKEKKKEKAEAKAEKKRLKEGGEKSAETQK
                 70        80        90       100       110       120

120       130       140       150       160       170
m005.pep  SRLFVLXXXXXXXXXXXXXXXXXXXXXXXXXXXXXXXXXXXXXXXXXXXXXXXXXXXXX
          ||||||                                 :
g005      SRLFVLDFDGDLYAHAVESLRHEITAVLLIAKPEDEVLLRLESPGGVVHGYGLAASQLRR
                130       140       150       160       170       180

180       190       200       210       220       230
m005.pep  XXXXXXXXXXXXXXXXXXASGGYMMACVADKIASAPFAIVGSVGVVAEVPNIHRLLKKHDID
               :            ||||||||||||::|||||:||||||||||||||||||||
g005      LRERNIPLTVAVDKVAASGGYMMACVADKIVSAPFAVIGSVGVVAEVPNIHRLLKKHDID
                190       200       210       220       230       240

240       250       260       270       280       290
m005.pep  VDVMTAGEFKRTVTFMGENTEKGKQKFRQELEETHQLFKQFVSENRPQLDIEEVATGEHW
          |||||||||||||||||||||||||||||||||||||||||||||||||||::||||||
g005      VDVMTAGEFKRTVTFMGENTEKGKQKFRQELEETHQLFKQFVSENRPGLDIEKIATGEHW
                250       260       270       280       290       300

300       310       320       330       340       350
m005.pep  FGRQALALNLIDEISTSDDLLLKAFENKQVIEVKYQEKQSLIQRIGLQAEASVEKLFAKL
          ||||||||||||||||||||||||||||||||||||||:|||||||||||||||||||
g005      FGRQALALNLIDEISTSDDLLLKAFENKQVIEVKYQEKRSLIQRIGLQAEASVEKLFAKL
                310       320       330       340       350       360
```

-continued

```
                    360
m005.pep    VNRRADVMX
            |||||||||
g005        VNRRADVMX
```

The following partial DNA sequence was identified in *N. gonorrhoeae* <SEQ ID 25>:

```
g006.seq
    1 ATGCTGCTGG TGCTggaatt ttggttCGGc gtGtCGGCGG TGGGCatact
   51 tgCGTTGTTT TTATGGCttt TGCCACGTTT TGCCGCCATC AGCGAAAACC
  101 TGTATTTCCG CCTGAACAAC AGCTTGGAAC gcgACAACCA CTTTATCCGA
  151 AAAGGCGACG AGCGGCAGCT GTACCGCCAT TACGGACTGG TTTCGCGCCT
  201 GCGTGTGCTG ATTTCCAACC GCGAAGCCTT CGGCTATCTC TGCGTCGGCG
  251 CGGCGATGGG TATTTTGTTC GGCTTTGCTT TTGTGATGAT GACGCTCAAA
  301 GGCTACGGCA GCGCGGGGCA TATTTATTCG GTCGGCACTT ATCTGTGGAT
  351 GTTTGCCATG AGTTTGGACG ATGTGCCGCG ATTGGTCGAA CAATATTCCA
  401 ATTTGAAAGA CATCGGACAA CGGATAGAGT GGTCGGAACG GAACATCAAA
  451 GCCGGAACTT GA
```

This corresponds to the amino acid sequence <SEQ ID 26; ORF 006.ng>:

```
g006.pep
    1 MLLVLEFWFG VSAVGILALF LWLLPRFAAI SENLYFRLNN SLERDNHFIR
   51 KGDERQLYRH YGLVSRLRVL ISNREAFGYL CVGAAMGILF GFAFVMMTLK
  101 GYGSAGHIYS VGTYLWMFAM SLDDVPRLVE QYSNLKDIGQ RIEWSERNIK
  151 AGT*
```

The following partial DNA sequence was identified in *N. meningitidis* <SEQ ID 27>:

```
m006.seq
    1 ATGCTGCTGG TGCTGGAATT TTGGGTCGGC GTGTCGGCGG TGGGCATACT
   51 TGCGTTGTTT TTATGGCTTT TGCCACGTTT TGCCGCCATC AGCGAAAACC
  101 TGTATTTCCG CCTGAACAAC AGCTTGGAAC GCGACAACCA CTTTATCCGA
  151 AAAGGCGACC GGCGGCAGCT GTACCGCCAT TACGGACTGC TTGCGCGCCT
  201 GCGTGTGCTG ATTTCCAACC GCGAAGCCTT CGGCTATCTC TGCGTCGGCA
  251 CGGCGATGGG TATTTTGTTC GGCTTTGCTT TTGTGATGAT GACGCTCAAA
  301 GGCTACAGCA GCGCGGGGCA TGTCTATTCG GTCGGCACTT ATCTGTGGAT
  351 GTTTGCCATG AGTTTGGACG ACGTGCCGCG ATTGGTCGAA CAATATTCCA
  401 ATTTGAAAGA CATCGGACAA CGGATAGAGT GGTCGGAACG GAACATCAAA
  451 GCCGGAACTTGA
```

This corresponds to the amino acid sequence <SEQ ID 28; ORF 006>:

```
m006.pep
    1 MLLVLEFWVG VSAVGILALF LWLLPRFAAI SENLYFRLNN SLERDNHFIR

51 KGDRRQLYRH YGLLARLRVL ISNREAFGYL CVGTAMGILF GFAFVMMTLK

101 GYSSAGHVYS VGTYLWMFAM SLDDVPRLVE QYSNLKDIGQ RIEWSERNIK

151 AGT*
```

The following partial DNA sequence was identified in *N. meningitidis* <SEQ ID 29>:

```
a006.seq
    1 ATGCTGCTGG TGCTGGAATT TTGGGTCGGC GTGTCGGCGG TGGGCATACT

51 TGCGTTGTTT TTATGGCTTT TGCCACGTTT TGCCGCCATC AGCGAAAACC

101 TGTATTTCCG CCTGAAGAAC AGCTTGGAAC GCGACAACCA CTTTATCCGA

151 AAAGGCGACG AGCGGCAGCT GGACCGCCAT TACGGACTGC TTGCGCGCCT

201 GCGTGTGCTG ATTTCCAACC GCGAAGCCTT CGGCTATCTC TGCGTCGGCA

251 CGGCGATGGG TATTTTGTTC GGCTTTGCTT TTGTGATGAT GACGCTCAAA

301 GGCTACAGCA GCGCGGGGCA TGTCTATTCG GTCGGCACTT ATCTGTGGAT

351 GTTTGCCATA AGTTTGGACG ACGTGCCGCG ATTGGTCGAA CAATATTCCA

401 ATTTGAAAGA CATCGGACAA CGGATAGAGT GGTCGAAACG GAACATCAAA

451 GCCGGAACTT GA
```

This corresponds to the amino acid sequence <SEQ ID 30; ORF 006.a>:

```
a006.pep
    1 MLLVLEFWVG VSAVGILALF LWLLPRFAAI SENLYFRLKN SLERDNHFIR

51 KGDERQLDRH YGLLARLRVL ISNREAFGYL CVGTAMGILF GFAFVMMTLK

101 GYSSAGHVYS VGTYLWMFAI SLDDVPRLVE QYSNLKDIGQ RIEWSKRNIK

151 AGT*
``` m006/a006 96.7% identity over a 153 aa overlap

```
                   10         20         30         40         50         60
    m006.pep  MLLVLEFWVGVSAVGILALFLWLLPRFAAISENLYFRLNNSLERDNHFIRKGDRRQLYRH
              ||||||||||||||||||||||||||||||||||||||:||||||||||||:|||:|||||
    a006      MLLVLEFWVGVSAVGILALFLWLLPRFAAISENLYFRLKNSLERDNGFIRKGDERQLDRH
                   10         20         30         40         50         60

70         80         90        100        110        120
    m006.pep  YGLLARLRVLISNREAFGYLCVGTAMGILFGFAFVMMTLKGYSSAGHVYSVGTYLWMFAM
              |||||||||||||||||||||||||||||||||||||||||||||||||||||||||||:
    a006      YGLLARLRVLISNREAFGYLCVGTAMGILFGFAFVMMTLKGYSSAGHVYSVGTYLWMFAI
                   70         80         90        100        110        120

130        140        150
    m006.pep  SLDDVPRLVEQYSNLKDIGQRIEWSERNIKAGTX
              ||||||||||||||||||||||||:|||||||||
    a006      SLDDVPRLVEQYSNLKDIGQRIEWSKRNIKAGTX
                  130        140        150
```

Computer analysis of this amino acid sequence gave the following results:
Homology with a Predicted ORF from *N. Gonorrhoeae*
ORF 006 shows 95.4% identity over a 153 aa overlap with a predicted ORF (ORF 006.ng) from *N. gonorrhoeae*:

```
m006/g006
                 10         20         30         40         50         60
   m006.pep  MLLVLEFWVGVSAVGILALFLWLLPRFAAISENLYFRLNNSLERDNHFIRKGDRRQLYRH
             ||||||||| |||||||||||||||||||||||||||||||||||||||||||:||||||
   g006      MLLVLEFWFGVSAVGILALFLWLLPRFAAISENLYFRLNNSLERDNHFIRKGDERQLYRH
                 10         20         30         40         50         60
                 70         80         90        100        110        120
   m006.pep  YGLLARLRVLISNREAFGYLCVGTAMGILFGFAFVMMTLKGYSSAGHVYSVGTYLWMFAM
             |||::||||||||||||||||||:|||||||||||||||||:||||:|||||||||||||
   g006      YGLVSRLRVLISNREAFGYLCVGAAMGILFGFAFVMMTLKGYGSAGHIYSVGTYLWMFAM
                 70         80         90        100        110        120
                130        140        150
   m006.pep  SLDDVPRLVEQYSNLKDIGQRIEWSERNIKAGTX
             |||||||||||||||||||||||||||||||||
   g118      SLDDVPRLVEQYSNLKDIGQRIEWSERNIKAGT
                130        140        150
```

The following partial DNA sequence was identified in *N. gonorrhoeae* <SEQ ID 31>:

```
g006-1.seq
    1 ATGTGGAAAA TGTTGAAACA CATAGCCAAA ACCCACCGCA AGCGATTGAT
   51 TGGCACATTT TCCCCGGTCG GACTGGAAAA CCTTTTGATG CTGGGGTATC
  101 CGGTGTTTGG CGGCTGGGCG ATTAATGCCG TGATTGCGGG GAGGGTGTGG
  151 CAGGCGTTGC TGTACGCTTT GGTTGTATTT TTGATGTGGC TGGTCGGTGC
  201 GGCACGGCGG ATTGCCGATA CGCGCACGTT TACGCGGATT TATACCGAAA
  251 TCGCCGTGCC GGTTGTGTTG GAACAACGGC AGCGGCAAGT CCCGCATTCA
  301 GCGGTAACTG CACGGGTTGC CCTGTCGCGT GAATTTGTCA GCTTTTTTGA
  351 AGAACACCTG CCGATTGCCG CGACATCCGT CGTATCCATA TTCGGCGCGT
  401 GCATCATGCT GCTGGTGCTG GAATTTTGGG TCGGCGTGTC GGCGGTGGGC
  451 ATACTTGCGT TGTTTTTATG GCTTTTGCCA CGTTTTGCCG CCATCAGCGA
  501 AAACCTGTAT TTCCGCCTGA ACAACAGCTT GGAACGCGAC AACCACTTTA
  551 TCCGAAAAGG CGACGAGCGG CAGCTGTACC GCCATTACGG ACTGGTTTCG
  601 CGCCTGCGTG TGCTGATTTC CAACCGCGAA GCCTTCGGCT ATCTCTGCGT
  651 CGGCGCGGCG ATGGGTATTT TGTTCGGCTT TGCTTTTGTG ATGATGACGC
  701 TCAAAGGCTA CGGCAGCGCG GGGCATATTT ATTCGGTCGG CACTTATCTG
  751 TGGATGTTTG CCATGAGTTT GGACGATGTG CCGCGATTGG TCGAACAATA
  801 TTCCAATTTG AAAGACATCG GACAACGGAT AGAGTGGTCG GAACGGAACA
  851 TCAAAGCCGG AACTTGA
```

This corresponds to the amino acid sequence <SEQ ID 32; ORF 006-1.ng>:

```
g006-1.pep
    1 MWKMLKHIAK THRKRLIGTF SPVGLENLLM LGYPVFGGWA INAVIAGRVW

51 QALLYALVVF LMWLVGAARR IADTRTFTRI YTEIAVPVVL EQRQRQVPHS

101 AVTARVALSR EFVSFFEEHL PIAATSVVSI FGACIMLLVL EFWVGVSAVG
```

```
151 ILALFLWLLP RFAAISENLY FRLNNSLERD NHFIRKGDER QLYRHYGLVS

201 RLRVLISNRE AFGYLCVGAA MGILFGFAFV MMTLKGYGSA GHIYSVGTYL

251 WMFAMSLDDV PRLVEQYSNL KDIGQRIEWS ERNIKAGT*
```

The following partial DNA sequence was identified in *N. meningitidis* <SEQ ID 33>:

```
m006-1.seq
    1 ATGTGGAAAA TGTTGAAACA CATAGCCCAA ACCCACCGCA AGCGATTGAT

51 TGGCACATTT TCCCTGGTCG GACTGGAAAA CCTTTTGATG CTGGTGTATC

101 CGGTGTTTGG CGGCCGGGCG ATCAATGCCG TGATTGCGGG GGAGGTGTGG

151 CAGGCGTTGC TGTACGCTTT GGTTGTGCTT TTGATGTGGC TGGTCGGTGC

201 GGTGCGGCGG ATTGCCGATA CGCACGTT TACGCGGATT TATACCGAAA

251 TCGCCGTGCC GGTCGTGTTG AACAGCGGC AGCGACAAGT CCCGCATTCG

301 GCGGTAACTG CGCGGGTTGC CCTGTCGCGT GAGTTTGTCA GCTTTTTTGA

351 AGAACACCTG CCGATTGCCG CGACATCCGT CGTATCCATA TTCGGCGCGT

401 GCATCATGCT GCTGGTGCTG GAATTTTGGG TCGGCGTGTC GGCGGTGGGC

451 ATACTTGCGT TGTTTTTATG GCTTTTGCCA CGTTTTGCCG CCATCAGCGA

501 AAACCTGTAT TTCCGCCTGA ACAACAGCTT GGAACGCGAC AACCACTTTA

551 TCCGAAAAGG CGACCGGCGG CAGCTGTACC GCCATTACGG ACTGCTTGCG

601 CGCCTGCGTG TGCTGATTTC CAACCGCGAA GCCTTCGGCT ATCTCTGCGT

651 CGGCACGGCG ATGGGTATTT TGTTCGGCTT TGCTTTTGTG ATGATGACGC

701 TCAAAGGCTA CAGCAGCGCG GGGCATGTCT ATTCGGTCGG CACTTATCTG

751 TGGATGTTTG CCATGAGTTT GGACGACGTG CCGCGATTGG TCGAACAATA

801 TTCCAATTTG AAAGACATCG GACAACGGAT AGAGTGGTCG GAACGGAACA

851 TCAAAGCCGG AACTTGA
```
                                                                    40

This corresponds to the amino acid sequence <SEQ ID 34; ORF 006-1>:

```
m006-1.pep
    1 MWKMLKHIAQ THRKRLIGTF SLVGLENLLM LVYPVFGGRA INAVIAGEVW

51 QALLYALVVL LMWLVGAVRR IADTRTFTRI YTEIAVPVVL EQRQRQVPHS

101 AVTARVALSR EFVSFFEEHL PIAATSVVSI FGACIMLLVL EFWVGVSAVG

151 ILALFLWLLP RFAAISENLY FRLNNSLERD NHFIRKGDRR QLYRHYGLLA

201 RLRVLISNRE AFGYLCVGTA MGILFGFAFV MMTLKGYSSA GHVYSVGTYL

251 WMFAMSLDDV PRLVEQYSNL KDIGQRIEWS ERNIKAGT*
```
                                                                    55 m006-1/g006-1 95.5% identity in 288 aa overlap

```
                    10         20         30         40         50         60
    m006-1.pep  MWKMLKHIAQTHRKRLIGTFSLVGLENLLMLVYPVFGGRAINAVIAGEVWQALLYALVVL
                |||||||||:||||||||||| ||||||||||||||:|||||||||:|||||||||||:
    g006-1      MWKMLKHIAKTHRKRLIGTFSPVGLENLLMLGYPVFGGWAINAVIAGRVWQALLYALVVF
                    10         20         30         40         50         60

70         80         90        100        110        120
    m006-1.pep  LMWLVGAVRRIADTRTFTRIYTEIAVPVVLEQRQRQVPHSAVTARVALSREFVSFFEEHL
                ||||||||:|||||||||||||||||||||||||||||||||||||||||||||||||||
    g006-1      LMWLVGAARRIADTRTFTRIYTEIAVPVVLEQRQRQVPHSAVTARVALSREFVSFFEEHL
                    70         80         90        100        110        120
```

```
                   130        140        150        160        170        180
m006-1.pep  PIAATSVVSIFGACIMLLVLEFWVGVSAVGILALFLWLLPRFAAISENLYFRLNNSLERD
            ||||||||||||||||||||||||||||||||||||||||||||||||||||||||||||
g006-1      PIAATSVVSIFGACIMLLVLEFWVGVSAVGILALFLWLLPRFAAISENLYFRLNNSLERD
                   130        140        150        160        170        180

190        200        210        220        230        240
m006-1.pep  NHFIRKGDRRQLYRHYGLLARLRVLISNREAFGYLCVGTAMGILFGFAFVMMTLKGYSSA
            |||||||||:|||||||||::|||||||||||||||||:|||||||||||||||||||:|
g006-1      NHFIRKGDERQLYRHYGLVSRLRVLISNREAFGYLCVGAAMGILFGFAFVMMTLKGYSA
                   190        200        210        220        230        240

250        260        270        280        289
m006-1.pep  GHVYSVGTYLWMFAMSLDDVPRLVEQYSNLKDIGQRIEWSERNIKAGTX
            ||:||||||||||||||||||||||||||||||||||||||||||||||
g006-1      GHIYSVGTYLWMFAMSLDDVPRLVEQYSNLKDIGQRIEWSERNIKAGTX
                   250        260        270        280
```

15

The following partial DNA sequence was identified in *N. meningitidis* <SEQ ID 35>:

```
a006-1.seq(partial)
    1   ..AGCCAAAACC ACCGCAAGCG ATTGATTGGC ACATTTTTTC TGGTCGGACT

51   GGAAAACCTT TTGATGCTGG TGTATCCGGT GTTTGGCGGC TGGGCGATTA

101   ATGCCGTGAT TGCGGGGCAG GCGTGGCAGG CGTTGCTGTA CGCTTTGGTT

151   GTGCTTTTGA TGTGGCTGGT CGGTGCGGCG CGGCGGATTG CCGATACGCG

201   CACGTTTACG CGGATTTATA CCGAAATCGC CGTGCCGGTT GTGTTGGAAC

251   AGCGGCAGCG GCAAGTCCCG CATTCGGCGG TAACTGCGCG GGTTGCCCTG

301   TCGCGTGAGT TTGTCAGCTT TTTTGAAGAA CACCTGCCGA TTGCCGCGAC

351   ATCCGTCGTA TCCATATTCG GCGCGTGCAT CATGCTGCTG GTGCTGGAAT

401   TTTGGGTCGG CGTGTCGGCG GTGGGCATAC TTGCGTTGTT TTTATGGCTT

451   TTGCCACGTT TTGCCGCCAT CAGCGAAAAC CTGTATTTCC GCCTGAAGAA

501   CAGCTTGGAA CGCGACAACC ACTTTATCCG AAAAGGCGAC GAGCGGCAGC

551   TGGACCGCCA TTACGGACTG CTTGCGCGCC TGCGTGTGCT GATTTCCAAC

601   CGCGAAGCCT TCGGCTATCT CTGCGTCGGC ACGGCGATGG GTATTTTGTT

651   CGGCTTTGCT TTTGTGATGA TGACGCTCAA AGGCTACAGC AGCGCGGGGC

701   ATGTCTATTC GGTCGGCACT TATCTGTGGA TGTTTGCCAT AAGTTTGGAC

751   GACGTGCCGC GATTGGTCGA ACAATATTCC AATTTGAAAG ACATCGGACA

801   ACGGATAGAG TGGTCGAAAC GGAACATCAA AGCCGGAACT TGA
```

This corresponds to the amino acid sequence <SEQ ID 36; ORF 006-1.a>:

```
a006-1.pep (partial)

1   ..SQNHRKRLIG TFFLVGLENL LMLVYPVFGG WAINAVIAGQ AWQALLYALV

51   VLLMWLVGAA RRIADTRTFT RIYTEIAVPV VLEQRQRQVP HSAVTARVAL

101   SREFVSFFEE HLPIAATSVV SIFGACIMLL VLEFWVGVSA VGILALFLWL

151   LPRFAAISEN LYFRLKNSLE RDNHFIRKGD ERQLDRHYGL LARLRVLISN

201   REAFGYLCVG TAMGILFGFA FVMMTLKGYS SAGHVYSVGT YLWMFAISLD

251   DVPRLVEQYS NLKDIGQRIE WSKRNIKAGT * a006-1/m006-1 95.7% identity in 280 aa overlap
```

```
            10         20         30         40         50
a006-1.pep        SQNHRKRLIGTFFLVGLENLLMLVYPVFGGWAINAVIAGQAWQALLYALVVL
                 :|:|||||||||  |||||||||||||||||| |||||||::||||||||||
m006-1     MWKMLKHIAQTHRKRLIGTFSLVGLENLLMLVYPVFGGRAINAVIAGEVWQALLYALVVL
           10         20         30         40         50         60

60         70         80         90        100        110
a006-1.pep  LMWLVGAARRIADTRTFTRIYTEIAVPVVLEQRQRQVPHSAVTARVALSREFVSFFEEHL
            ||||||:|||||||||||||||||||||||||||||||||||||||||||||||||||||
m006-1      LMWLVGAVRRIADTRTFTRIYTEIAVPVVLEQRQRQVPHSAVTARVALSREFVSFFEEHL
                   70         80         90        100        110        120

120        130        140        150        160        170
a006-1.pep  PIAATSVVSIFGACIMLLVLEFWVGVSAVGILALFLWLLPRFAAISENLYFRLKNSLERD
            ||||||||||||||||||||||||||||||||||||||||||||||||||||:|||||||
m006-1      PIAATSVVSIFGACIMLLVLEFWVGVSAVGILALFLWLLPRFAAISENLYFRLNNSLERD
                  130        140        150        160        170        180

180        190        200        210        220        230
a006-1.pep  NHFIRKGDERQLDRHYGLLARLRVLISNREAFGYLCVGTAMGILFGFAFVMMTLKGYSSA
            ||||||||::|||  ||||||||||||||||||||||||||||||||||||||||||||
m006-1      NHFIRKGDRRQLYRHYGLLARLRVLISNREAFGYLCVGTAMGILFGFAFVMMTLKGYSSA
                  190        200        210        220        230        240

240        250        260        270        280
a006-1.pep  GHVYSVGTYLWMFAISLDDVPRLVEQYSNLKDIGQRIEWSKRNIKAGTX
            ||||||||||||||:|||||||||||||||||||||||||:||||||||
m006-1      GHVYSVGTYLWMFAMSLDDVPRLVEQYSNLKDIGQRIEWSERNIKAGTX
                  250        260        270        280
```

The following partial DNA sequence was identified in *N. gonorrhoeae* <SEQ ID 37>:

```
g007.seq
   1  atgaACACAA CCCGACTGCC GACCGCCTTC ATCTTGTGCT GCCTCTGcgC

51  CGCcGCTTCT GCCGccgaca acAGCatcat gaCaAAAGGG CAAAAAGTGT

101  ACGAATCcAa ctGCATCGCC TGCCACGGCA AGAAAGGGGA AGGGCGCGGC

151  ACTGCGtTTC CTccgctTTT CCggtcgGac tgtattatga acaAACCGCa 201  cgTCCtgctg cacagcatgg tcaaaggcAt cgacgggaca ttcaaagtgg 251  agcggcaaaa cctacgacgg atttatgCcc gcaaccgcca tcagcgATGC

301  GGACATTGCC GCCGTCGCCA CTTATATCAT GAACGCCTTT GA
```

This corresponds to the amino acid sequence <SEQ ID 38; ORF 007.ng>:

```
g007.pep
   1  MNTTRLPTAF ILCCLCAAAS AADNSIMTKG QKVYESNCIA CHGKKGEGRG

51  TAFPPLFRSD CIMNKPHVLL HSMVKGIDGT FKVERQNLRR IYARNRHQRC

101  GHCRRRHLYH ERL*
```

The following partial DNA sequence was identified in *N. meningitidis* <SEQ ID 39>:

```
m007.seq
   1  ATGAACACAA CCCGACTGCC GACCGCCCTC GTCTTGGGCT GCTTCTGCGC

51  CGCCGCTTCT GCCGCCGACA ACAGCATCAT GACAAAAGGG CAAAAAGTGT

101  ACGAATCCAA CTGCGTCGCC TGCCACGGCA AAAGGGCGA AGGCCGCGGA

151  ACCATGTTTC CGCCGCTCTA CCGCTCCGAC TTCATCATGA AAAACCGCA

201  GGTGCTGCTG CACAGCATGG TCAAAGGCAT CAACGGTACA ATCAAAGTC.

251  AACGGCAAAA CCTACAACGG ATTCATGCCC GCAACCGCCA TCAGCGATGC

301  GGACATTGCC GCCGTCGCCA CTTATATCAT GAACGCCTTT GA
```

This corresponds to the amino acid sequence <SEQ ID 40; ORF 007>:

```
m007.pep
    1  MNTTRLPTAL VLGCFCAAAS AADNSIMTKG QKVYESNCVA CHGKKGEGRG

51  TMFPPLYRSD FIMKKPQVLL HSMVKGINGT IKVXRQNLQR IHARNRHQRC

101  GHCRRRHLYH ERL*
```

The following partial DNA sequence was identified in *N. meningitidis* <SEQ ID 41>:

```
a007.seq
    1  ATGAACACAA CCCGACTGCC GACCGCCCTC GTCTTGGGCT GCCTCTGCGC

51  CGCCGCTTCT GCCGCCGACA ACAGCATCAT GACAAAAGGG CAAAAAGTGT

101  ACGAATCCAA CTGCGTCGCC TGCCACGGCA AAAAGGGCGA AGGCCGCGGA

151  ACCATGTTTC CGCCGCTCTA CCGCTCCGAC TTCATCATGA AAAAACCGCA

201  GGTGCTGCTG CACAGCATGG TCAAAGGCAT CAACGGTACA ATCAAAGTC.

251  AACGGCAAAA CCTACAACGG ATTCATGCCC GCCACTGCCA TCAGCGATGC

301  GGACATTGCC GCCGTCGCCA CTTATATCAT GAACGCCTTT GA
```

This corresponds to the amino acid sequence <SEQ ID 42; ORF 007.a>:

```
a007.pep
    1  MNTTRLPTAL VLGCLCAAAS AADNSIMTKG QKVYESNCVA CHGKKGEGRG

51  TMFPPLYRSD FIMKKPQVLL HSMVKGINGT IKVXRQNLQR IHARHCHQRC

101  GHCRRRHLYH ERL*
``` m007/a007 97.3% identity over a 113 aa overlap

```
                 10         20         30         40         50         60
    m007.pep  MNTTRLPTALVLGCFCAAASAADNSIMTKGQKVYESNCVACHGKKGEGRGTMFPPLYRSD
              ||||||||||||||:|||||||||||||||||||||||||||||||||||||||||||||
    a007      MNTTRLPTALVLGCLCAAASAADNSIMTKGQKVYESNCVACHGKKGEGRGTMFPPLYRSD
                 10         20         30         40         50         60

70         80         90        100        110
    m007.pep  FIMKKPQVLLHSMVKGINGTIKVXRQNLQRIHARNRHQRCGHCRRRHLYHERLX
              |||||||||||||||||||||||||||||||||||:|||||||||||||||||
    a007      FIMKKPQVLLHSMVKGINGTIKVXRQNLQRIHARHCHQRCGHCRRRHLYHERLX
                 70         80         90        100        110
```

Computer analysis of this amino acid sequence gave the following results:
Homology with a Predicted ORF from *N. gonorrhoeae*
ORF 007 shows 86.7% identity over a 113 aa overlap with a predicted ORF (ORF 007.ng) from *N. gonorrhoeae*:

```
    m007/g007
                 10         20         30         40         50         60
    m007.pep  MNTTRLPTALVLGCFCAAASAADNSIMTKGQKVYESNCVACHGKKGEGRGTMFPPLYRSD
              ||||||||::|  |:|||||||||||||||||||||||:||||||||||||  ||:|||
    g007      MNTTRLPTAFILCCLCAAASAADNSIMTKGQKVYESNCIACHGKKGEGRGTAFPPLFRSD
                 10         20         30         40         50         60

70         80         90        100        110
    m007.pep  FIMKKPQVLLHSMVKGINGTIKVXRQNLQRIHARNRHQRCGHCRRRHLYHERLX
              ||:|||||||||||||:|| ||||:||  ||||||:||||||||||||||||||
    g007      CIMNKPHVLLHSMVKGIDGTFKVERQNLRRIYARNRHQRCGHCRRRHLYHERL
                 70         80         90        100        110
```

The following partial DNA sequence was identified in *N. gonorrhoeae* <SEQ ID 43>:

```
g007-1.seq (partial)
    1 ATGAACACAA CCCGACTGCC GACCGCCTTC ATCTTGTGCT GCCTCTGCGC
   51 CGCCGCTTCT GCCGCCGACA ACAGCATCAT GACAAAAGGG CAAAAAGTGT
  101 ACGAATCCAA CTGCATCGCC TGCCACGGCA AGAAAGGGGA AGGGCGCGGC
  151 ACTGCGTTTC CTCCGCTTTT CCGGTCGGAC TATATTATGA ACAAACCGCA
  201 CGTCCTGCTG CACAGCATGG TCAAAGGCAT CAACGGTACA ATCAAAGTCA
  251 ACGGCAAAAC CTACAACGGA TTCATGCCCG CAACCGCCAT CAGCGATGCG
  301 GACATTGCCG CCGTCGCCAC TTATATCATG AACGCCTTTG ACAACGGCGG
  351 CGGAAGCGTT ACCGAAAAAG ACGTAAAACA GGCAAAAGGC AAAAAAAAC.
```

This corresponds to the amino acid sequence <SEQ ID 44; ORF 007-1.ng>:

```
g007-1.pep (partial)
    1 MNTTRLPTAF ILCCLCAAAS AADNSIMTKG QKVYESNCIA CHGKKGEGRG
   51 TAFPPLFRSD YIMNKPHVLL HSMVKGINGT IKVNGKTYNG FMPATAISDA
  101 DIAAVATYIM NAFDNGGGSV TEKDVKQAKGKKN...
```

The following partial DNA sequence was identified in *N. meningitidis* <SEQ ID 45>:

```
m007-1.seq
    1 ATGAACACAA CCCGACTGCC GACCGCCCTC GTCTTGGGCT GCTTCTGCGC
   51 CGCCGCTTCT GCCGCCGACA ACAGCATCAT GACAAAAGGG CAAAAAGTGT
  101 ACGAATCCAA CTGCGTCGCC TGCCACGGCA AAAAGGGCGA AGGCCGCGGA
  151 ACCATGTTTC CGCCGCTCTA CCGCTCCGAC TTCATCATGA AAAAACCGCA
  201 GGTGCTGCTG CACAGCATGG TCAAAGGCAT CAACGGTACA ATCAAAGTCA
  251 ACGGCAAAAC CTACAACGGA TTCATGCCCG CAACCGCCAT CAGCGATGCG
  301 GACATTGCCG CCGTCGCCAC TTATATCATG AACGCCTTTG ACAACGGCGG
  351 CGGAAGCGTT ACCGAAAAAG ACGTAAAACA GGCAAAAAGC AAAAAAAACT
  401 AA
```

This corresponds to the amino acid sequence <SEQ ID 46; ORF 007-1>

```
m007-1.pep
    1 MNTTRLPTAL VLGCFCAAAS AADNSIMTKG QKVYESNCVA CHGKKGEGRG
   51 TMFPPLYRSD FIMKKPQVLL HSMVKGINGT IKVNGKTYNG FMPATAISDA
  101 DIAAVATYIM NAFDNGGGSV TEKDVKQAKS KKN*
``` m007-1/g007-1 91.7% identity in 133 aa overlap

```
                    10         20         30         40         50         60
     m007-1.pep  MNTTRLPTALVLGCFCAAASAADNSIMTKGQKVYESNCVACHGKKGEGRGTMFPPLYRSD
                 ||||||||||::| |:||||||||||||||||||||||:|||||||||||| ||||:|||
         g007-1  MNTTRLPTAFILCCLCAAASAADNSIMTKGQKVYESNCIACHGKKGEGRGTAFPPLFRSD
                    10         20         30         40         50         60
```

```
             70        80        90       100       110       120
m007-1.pep  FIMKKPQVLLHSMVKGINGTIKVNGKTYNGFMPATAISDADIAAVATYIMNAFDNGGGSV
            :||:||:|||||||||||||||||||||||||||||||||||||||||||||||||||
g007-1      YIMNKPHVLLHSMVKGINGTIKVNGKTYNGFMPATAISDADIAAVATYIMNAFDNGGGSV
             70        80        90       100       110       120

130
m007-1.pep  TEKDVKQAKSKKNX
            ||||||||||:|||
g007-1      TEKDVKQAKGKKN
            130
```

The following partial DNA sequence was identified in *N. meningitidis* <SEQ ID 47>:

```
a007-1.seq (partial)
   1  ATGAACACAA CCCGACTGCC GACCGCCCTC GTCTTGGGCT GCCTCTGCGC

51  CGCCGCTTCT GCCGCCGACA ACAGCATCAT GACAAAAGGG CAAAAAGTGT

101  ACGAATCCAA CTGCGTCGCC TGCCACGGCA AAAAGGGCGA AGGCCGCGGA

151  ACCATGTTTC CGCCGCTCTA CCGCTCCGAC TTCATCATGA AAAAACCGCA

201  GGTGCTGCTG CACAGCATGG TCAAAGGCAT CAACGGTACA ATCAAAGTCA

251  ACGGCAAAAC CTACAACGGA TTCATGCCCG CCACTGCCAT CAGCGATGCG

301  GACATTGCCG CCGTCGCCAC TTATATCATG AACGCCTTTG ACAACGGCGG

351  CGGAAGCGTT ACCGAAAAAG ACGTAAAACA GGCAAAAAAC AAAAA..
```

This corresponds to the amino acid sequence <SEQ ID 48; ORF 007-1.a>:

```
a007-1.pep (partial)
   1  MNTTRLPTAL VLGCLCAAAS AADNSIMTKG QKVYESNCVA CHGKKGEGRG

51  TMFPPLYRSD FIMKKPQVLL HSMVKGINGT IKVNGKTYNG FMPATAISDA

101  DIAAVATYIM NAFDNGGGSV TEKDVKQAKN KK..
``` m007-1/a007-1 98.5% identity in 132 aa overlap

```
             10        20        30        40        50        60
m007-1.pep  MNTTRLPTALVLGCFCAAASAADNSIMTKGQKVYESNCVACHGKKGEGRGTMFPPLYRSD
            ||||||||||||||:|||||||||||||||||||||||||||||||||||||||||||||
a007-1      MNTTRLPTALVLGCLCAAASAADNSIMTKGQKVYESNCVACHGKKGEGRGTMFPPLYRSD
             10        20        30        40        50        60

70        80        90       100       110       120
m007-1.pep  FIMKKPQVLLHSMVKGINGTIKVNGKTYNGFMPATAISDADIAAVATYIMNAFDNGGGSV
            ||||||||||||||||||||||||||||||||||||||||||||||||||||||||||||
a007-1      FIMKKPQVLLHSMVKGINGTIKVNGKTYNGFMPATAISDADIAAVATYIMNAFDNGGGSV
             70        80        90       100       110       120

130
m007-1.pep  TEKDVKQAKSKKNX
            ||||||||||:||
a007-1      TEKDVKQAKNKK
            130
```

The following partial DNA sequence was identified in *N. gonorrhoeae* <SEQ ID 49>:

```
g008.seq
   1  ATGAACAACA GACATTTTGC CGTCAtcgCC TTGGGCAGCA ACCTTGACAA

51  CCCCGCACAA CAAATacgcg gcgcattaga cgcgctctcg tcccatcctg 101  acatccggct tgaaCaggtt tcctcactgt aTatgaccgc acctgtcggt
```

-continued

```
151 tacgAcaaTC agcccgATTT CATCaatgcc gTCTgcaccg TTTCCACCAC

201 CtTGGACGGC ATTGcccTGC TTGCCgaACT CAAccgTATC GAAGCCGATT

251 TCGGACGCGA aCGCAGTTTC CGCAATGCAC CGCGCACATT GGATTTGGAC

301 ATTATCGACT TTGACGGCAT CTCCAGCGAC GACCCCCGCC TTACCCTGCC

351 GCATCCGCGC GCGCACGAAC GCAGTTTCGT CATACGCCCT TTGGCAGAAA

401 TCCTCCCTGA TTTTATTTTG GGAAAATACG GAAAGGTTGT CGAATTGTCA

451 AAACGGCTGG GCAATCAAGG CATCCGTCTT TTACCGGACA GGTAA
```

This corresponds to the amino acid sequence <SEQ ID 50; ORF 008.ng>:

```
g008.pep
    1 MNNRHFAVIA LGSNLDNPAQ QIRGALDALS SHPDIRLEQV SSLYMTAPVG

51 YDNQPDFINA VCTVSTTLDG IALLAELNRI EADFGRERSF RNAPRTLDLD

101 IIDFDGISSD DPRLTLPHPR AHERSFVIRP LAEILPDFIL GKYGKVVELS

151 KRLGNQGIRL LPDR*
```

The following partial DNA sequence was identified in N. meningitidis <SEQ ID 51>:

```
m008.seq
    1 ATGAACAACA GACATTTTGC CGTCATCGCC CTGGGCAGTA ATCTTGAAAA

51 CCCTGCTCAA CAGGTACGCG CCGCATTGGA CACGCTGTCG TCCCATCCTG

101 ACATCCGTCT TAAACAGGCT TCCTCACTGT ATATGACCGC GCCCGTCGGT

151 TACGACAATC AGCCCGATTT TGTCAATGCC GTCTGCACCG TTTCCACCAC

201 TCTGGACGGC ATTGCCyTGC TTGCCGAACT CAACCGTATC GAGGCTGATT

251 TCGGACGCGA ACGCAGCTTC CGCAACGCGC CGCGCACATT GkATTTGGAC

301 ATTATCGACT TTGACGGCAT CTCCAGCGAC GACACsCGAC TcACCtTGCC

351 GCATCCGCGC GCGCACGAAC GCAGTTTCGT CATCCGCCCT TTGGCAGAAA

401 TCCTCCCTGA TTTTGTTTTA GGAAAACACG GAAAGGTTGC CGAATTGTCA

451 AAACGGyTGG GCAATCAAGG TATCCGTCTT TTACCGGACA GGTAATT
```

This corresponds to the amino acid sequence <SEQ ID 52; ORF 008>:

```
m008.pep
    1 MNNRHFAVIA LGSNLENPAQ QVRAALDTLS SHPDIRLKQAS SLYMTAPVG

51 YDNQPDFVNA VCTVSTTLDG IALLAELNRI EADFGRERSFR NAPRTLXLD

101 IIDFDGISSD DTRLTLPHPR AHERSFVIRP LAEILPDFVLG KHGKVAELS

151 KRLGNQGIRL LPDR*
```

The following partial DNA sequence was identified in N. meningitidis<SEQ ID 53>:

```
a008.seq
    1 ATGAACAACA GACATTTTGC CGTCATCGCC CTGGGCAGTA ATCTTGAAAA

51 CCCTGCCCAA CAGGTACGCG CCGCATTGGA CACGCTGTCG TCCCATCCTG

101 ACATCCGTCT TAAACAGGCT TCCTCACTGT ATATGACCGC GCCCGTCGGT
```

```
151   TACGACAATC AGCCCGATTT CGTCAATGCC GTCTGCACCG TTTCCACCAC

201   CTTGGACGGC ATTGCCCTGC TTGCCGAACT CAACCGTATC GAAGCCGATT

251   TCGGACGCGA ACGCAGCTTC CGCAACGCGC CGCGCACATT GGATTTGGAC

301   ATTATCGACT TTGACGGCAT CTCCAGCGAC GACCCCGAC TCACCCTGCC

351   GCATCCGCGC GCGCACGAAC GCAGTTTCGT CATACGCCCT TTGGCAGAAA

401   TCCTCCCTGA TTTTATTTTG GGAAAACACG GAAAGGTTGC CGAATTGTCA

451   AAACGGCTGG GCAATCAAGG CATCCGTCTT TTACCGGATA AGTAA
```

This corresponds to the amino acid sequence <SEQ ID 54; ORF 008.a>:

```
a008.pep
    1  MNNRHFAVIA LGSNLENPAQ QVRAALDTLS SHPDIRLKQA SSLYMTAPVG

51  YDNQPDFVNA VCTVSTTLDG IALLAELNRI EADFGRERSF RNAPRTLDLD

101  IIDFDGISSD PRLTLPHPRA HERSFVIRPL LAEILPDFIL GKHGKVAELS

151  KRLGNQGIRL LPDK*
``` m008/a008 97.6% identity over a 164 aa overlap

```
                 10         20         30         40         50         60
    m008.pep  MNNRHFAVIALGSNLENPAQQVRAALDTLSSHPDIRLKQASSLYMTAPVGYDNQPDFVNA
              ||||||||||||||||||||||||||||||||||||||||||||||||||||||||||||
        a008  MNNRHFAVIALGSNLENPAQQVRAALDTLSSHPDIRLKQASSLYMTAPVGYDNQPDFVNA
                 10         20         30         40         50         60

70         80         90        100        110        120
    m008.pep  VCTVSTTLDGIALLAELNRIEADFGRERSFRNAPRTLXLDIIDFDGISSDDTRLTLPHPR
              ||||||||||||||||||||||||||||||||||||||| |||||||||||| |||||||
        a008  VCTVSTTLDGIALLAELNRIEADFGRERSFRNAPRTLDLDIIDFDGISSDDPRLTLPHPR
                 70         80         90        100        110        120

130        140        150        160
    m008.pep  AHERSFVIRPLAEILPDFVLGKHGKVAELSKRLGNQGIRLLPDRX
              ||||||||||||||||||||:|||||||||||||||||||||||:|
        a008  AHERSFVIRPLAEILPDFILGKHGKVAELSKRLGNQGIRLLPDKX
                130        140        150        160
```

Computer analysis of this amino acid sequence gave the following results:

Homology with a Predicted ORF from *N. gonorrhoeae*

ORF 008 shows 92.7% identity over a 164 aa overlap with a predicted ORF (ORF008.ng) from *N. gonorrhoeae*:

```
    m008/g008
                 10         20         30         40         50         60
    m008.pep  MNNRHFAVIALGSNLENPAQQVRAALDTLSSHPDIRLKQASSLYMTAPVGYDNQPDFVNA
              ||||||||||||||:||||:|:|||:|||||||:|:|||||||||||||||||||||:||
        g008  MNNRHFAVIALGSNLDNPAQQIRGALDALSSHPDIRLEQVSSLYMTAPVGYDNQPDFINA
                 10         20         30         40         50         60

70         80         90        100        110        120
    m008.pep  VCTVSTTLDGIALLAELNRIEADFGRERSFRNAPRTLXLDIIDFDGISSDDTRLTLPHPR
              |||||||||||||||||||||||||||||||||||||  |||||||||||||| ||||||
        g008  VCTVSTTLDGIALLAELNRIEADFGRERSFRNAPRTLDLDIIDFDGISSDDPRLTLPHPR
                 70         80         90        100        110        120

130        140        150        160
    m008.pep  AHERSFVIRPLAEILPDFVLGKHGKVAELSKRLGNQGIRLLPDRX
              |||||||||||||||||:|||:|||:||||||||||||||||||X
        g008  AHERSFVIRPLAEILPDFILGKYGKVVELSKRLGNQGIRLLPDRX
                130        140        150        160
```

The following partial DNA sequence was identified in *N. gonorrhoeae* <SEQ ID 55>:

```
g009.seq
    1 ATGCCCCGCG CTGCCGTAGC CTTTGAGCGT CATCATCACA AAAGCAAAGC

51 CGAACAAAAT ACCCATCGCC GCGCCGACGC AGAGATAGCC GAAGGCTTCG

101 CGGTTGGAAA TCAGCACACG CAGGCGCGAA ACCAGTCCGT AATGGCGGTA

151 CAGCTGCCGC TCGTCGCCTT TTCGGATAAA GTGGTTGTcg cGTTCCAAGC

201 TGTTGTTCAG GCGGAAATAC AGGTTTTCGC TGATGGCGGC AAAACGTGGC

251 AaaaGCCATA A
```

This corresponds to the amino acid sequence <SEQ ID 56;15 ORF 009.ng>:

```
g009.pep
    1 MPRAAVAFER HHHKSKAEQN THRRADAEIA EGFAVGNQHT QARNQSVMAV

51 QLPLVAFSDK VVVAFQAVVQ AEIQVFADGG KTWQKP*
```

The following partial DNA sequence was identified in *N. meningitidis* <SEQ ID 57>:

```
m009.seq
    1 ATGCCCCGCG CTGCTGTAGC CTTTGAGCGT CATCATCACA AAAGCAAAGC

51 CGAACAAAAT ACCCATCGCC GTGCCGACGC AGAGATAGCC GAAGGCTTCG

101 CGGTTGGAAA TCAGCACACG CAGGCGCGCA AGCAGTCCGT AATGGCGGTA

151 CAGCTGCCGC CGGTCGCCTT TTCGGATAAA GTGGTTGTCG CGTTCCAAGC

201 TGTTGTTCAG GCGGAAATAC AGGTTTTCGC TGATGGCGGC AAAACGTGGC

251 AAAAGCCATA A
```

This corresponds to the amino acid sequence <SEQ ID 58; ORF 009>:

```
m009.pep
    1 MPRAAVAFER HHHKSKAEQN THRRADAEIA EGFAVGNQHT QARKQSVMAV

51 QLPPVAFSDK VVVAFQAVVQ AEIQVFADGG KTWQKP*
```

Computer analysis of this amino acid sequence gave the following results:
Homology with a Predicted ORF from *N. gonorrhoeae*
ORF 009 shows 97.7% identity over a 86 aa overlap with a predicted ORF (ORF 009.ng) from *N. gonorrhoeae*:

```
m009/g009

10         20         30         40         50         60
m009.pep  MPRAAVAFERHHHKSKAEQNTHRRADAEIAEGFAVGNQHTQARKQSVMAVQLPPVAFSDK
          |||||||||||||||||||||||||||||||||||||||||||:|||||||||| ||||||
g009      MPRAAVAFERHHHKSKAEQNTHRRADAEIAEGFAVGNQHTQARNQSVMAVQLPLVAFSDK
                 10         20         30         40         50         60

70         80
m009.pep  VVVAFQAVVQAEIQVFADGGKTWQKPX
          |||||||||||||||||||||||||||
g009      VVVAFQAVVQAEIQVFADGGKTWQKPX
                 70         80
```

The following partial DNA sequence was identified in *N. meningitidis* <SEQ ID 59>:

```
a009.seq
    1 ATGCCCCGCG CTGCTGTAGC CTTTGAGCGT CATCATCACA AAAGCAAAGC

51 CGAACAAAAT ACCCATCGCC GTGCCGACGC AGAGATAGCC GAAGGCTTCG

101 CGGTTGGAAA TCAGCACACG CAGGCGCGCA AGCAGTCCGT AATGGCGGTC

151 CAGCTGCCGC TCGTCGCCTT TTCGGATAAA GTGGTTGTCG CGTTCCAAGC

201 TGTTCTTCAG GCGGAAATAC AGGTTTTCGC TGATGGCGGC AAAACGTGGC

251 AAAAGCCATA A
```

This corresponds to the amino acid sequence <SEQ ID 60; ORF 009.a>:

```
a009.pep
    1 MPRAAVAFER HHHKSKAEQN THRRADAEIA EGFAVGNQHT QARKQSVMAV

51 QLPLVAFSDK VVVAFQAVLQ AEIQVFADGG KTWQKP*
``` m005/a009 97.7% identity over a 86 aa overlap

```
                   10        20        30        40        50        60
   m009.pep  MPRAAVAFERHHHKSKAEQNTHRRADAEIAEGFAVGNQHTQARKQSVMAVQLPPVAFSDK
             ||||||||||||||||||||||||||||||||||||||||||||||||||| ||||||
   a009      MPRAAVAFERHHHKSKAEQNTHRRADAEIAEGFAVGNQHTQARKQSVMAVQLPLVAFSDK
                   10        20        30        40        50        60

70        80
   m009.pep  VVVAFQAVVQAEIQVFADGGKTWQKPX
             ||||||||:||||||||||||||||||
   a009      VVVAFQAVLQAEIQVFADGGKTWQKPX
                   70        80
```

The following partial DNA sequence was identified in *N. gonorrhoeae* <SEQ ID 61>:

```
g010.seq
    1 ATGGGTTTTC CTGTTCGCAA GTTTGATGCC GTGATTGTCG GCGGTGGCGG

51 TGCAGGTTTA CGTGCAGCCC TCCAATTATC CAAATCCGGT TTGAATTGTG

101 CCGTTTTGTC TAAAGTGTTC CCGACCCGCT CGCATACCGT AGCGGCGCAG

151 GGCGGTATTT CCGCCTCTCT GGGTAATGTG CAGGAGGACC GTTGGGACTG

201 GCACATGTAC GATACCGTGA AAGGTTCCGA CTGGCTGGGC GACCAAGATG

251 CGATTGAGTT TATGTGTCGC GCTGCGCCTG AAGCGGTGAT TGAGTTGGAA

301 CACATGGGTA TGCCTTTTGA CCGCGTTGAA AGCGGCAAAA TTTATCAGCG

351 TCCTTTCGGC GGACATACTG CCGAACATGG TAAACGTGCG GTAGAACGTG

401 CATGTGCGGT TGCCGACCGT ACCGGTCATG CGATGTTGCA TACTTTGTAC

451 CAACAAAACG TCCGTGCCAA TACACAATTC TTTGTGGAAT GGACGGCGCA

501 AGATTTGATT CGTGATGAAA ACGGCGATGT CGTCGGCGTA ACCGCCATGG

551 AAATGGAAAC GGGCGAAGTT TATATTTTCC ACGCCAAGGC CGTGATGTTT

601 GCTACCGGTG GCGGCGGTCG TATTTATGCT TCTTCTACCA ATGCTTATAT

651 GAATACCGGT GACGGTTTGG GCATTTGCGC CCGTGCGGGC ATTCCGTTGG

701 AAGATATGGA ATTCTGGCAA TTCCACCCGA CCGGCGTGGC GGGTGCGGGC

751 GTGTTGATTA CCGAAGGCGT ACGCGGCGAG GGCGGTATTC TGTTGAacgc
```

-continued

```
 801 cgacggcgaA cgcTTTATGG AAcgctatgc GCcgACCGta aAagaCTTGG

851 CTTCTCGCga cgtGGTTTCA CgcgcGatgG CGatggaAAt ctatgaaggt 901 cgcggctgTG GtaaAAAcaA agaCCacgtC TTACTGAAAA TCGACcAtAt 951 cggtGCAGAA AAAATTATGG AAAAACTGCC GGGCATCCGC GAGATTTCCA 1001 TTCagtttgc cGGTATCGAT CCGATTAAAG ACCCGATTcc ggttgTGCCG 1051 ACTACCCACT ATATGATGGG CGGCATTCcg aCCAATTATC ACGGTGAAGT

1101 TGTTGTTCCG CAAGGCGACG AGTACGAAGT ACCTGTAAAA GGCCTGTATG

1151 CCGCAGGTGA GTGCGCCTGT GCTTCCGTAC ACGGTGCGAA CCGTTTGGGT

1201 ACGAACTCCC TGCTGGACTT GGTGGTGTTC cgcccaaccc cccggtga
```

This corresponds to the amino acid sequence <SEQ ID 62; ORF 010.ng>:

```
g010.pep
   1 MGFPVRKFDA VIVGGGGAGL RAALQLSKSG LNCAVLSKVF PTRSHTVAAQ

51 GGISASLGNV QEDRWDWHMY DTVKGSDWLG DQDAIEFMCR AAPEAVIELE

101 HMGMPFDRVE SGKIYQRPFG GHTAEHGKRA VERACAVADR TGHAMLHTLY

151 QQNVRANTQF FVEWTAQDLI RDENGDVVGV TAMEMETGEV YIFHAKAVMF

201 ATGGGGRIYA SSTNAYMNTG DGLGICARAG IPLEDMEFWQ FHPTGVAGAG

251 VLITEGVRGE GGILLNADGE RFMERYAPTV KDLASRDVVS RAMAMEIYEG

301 RGCGKNKDHV LLKIDHIGAE KIMEKLPGIR EISIQFAGID PIKDPIPVVP

351 TTHYMMGGIP TNYHGEVVVP QGDEYEVPVK GLYAAGECAC ASVHGANRLG

401 TNSLLDLVVF RPTPR*
```

The following partial DNA sequence was identified in *N. meningitidis* <SEQ ID 63>:

```
m010.seq (PARTIAL)
   1 ..nTCCAATTAT CCAAATCCGG TCTGAATTGT GCCGTTTTGT CTAAAGTGTT 51    CCCGACCCGT TCGCATACCG TAGCGGCGCA GGGCGGTATT TCCGCCTCTn

101    TGGGTAATGT GCAGGAAGAC CGTTGGGACT GGCACATGTA CGATACCGTG

151    AAAGGTTCCG ACTGGTTGGG CGACCAAGAT GCGATTGAGT TTATGTGCCG

201    CGCCGCGCCT GAAGCCGTAA TTGAGTTGGA ACACATGGGT ATGCCTTTTG

251    ACCGTGTGGA AAGCGGTAAA ATTTATCAGC GTCCTTTCGG CGGCCATACT

301    GCCGAACACG GTAAACGCGC GGTAGAACGC GyCTGTGCGG TTGCCGACCG

351    TACAGGTCAT GCGATGCTGC ATACTTTGTA CCAACAAAAC GTCCGTGCCA

401    ATACGCAATT CTTTGTGGAA TGGACGGCAC AAGATTTGAT TCGTGATGAA

451    AACGGCGATG TCGTCGGCGT AACCGCCATG GAAATGGAAA CCGGCGAAgT

501    TTATATTTTC CACGCTAAAG CTGTGATGTT TGCTACCGGC GGCGGCGGTC

551    GTATTTATGC GTCTTCTACC AATGCCTATA TGAATACCGG CGATGGTTTG

601    GGTATTTGTG CGCGTGCAGG TATCCCGTTG GAAGACATGG AATTCTGGCA

651    ATTCCAGCCG ACCGGCGTGG CGGGTGCGGG CGTGTTGATT ACCGAA....
```

This corresponds to the amino acid sequence <SEQ ID 64; ORF 010>:

```
m010.pep (PARTIAL)
    1  ..XQLSKSGLNC AVLSKVFPTR SHTVAAQGGI SASXGNVQED RWDWHMYDTV

51    KGSDWLGDQD AIEFMCRAAP EAVIELEHMG MPFDRVESGK IYQRPFGGHT

101    AEHGKRAVER XCAVADRTGH AMLHTLYQQN VRANTQFFVE WTAQDLIRDE

151    NGDVVGVTAM EMETGEVYIF HAKAVMFATG GGGRIYASST NAYMNTGDGL

201    GICARAGIPL EDMEFWQFQP TGVAGAGVLI TE...
```

The following partial DNA sequence was identified in *N. meningitidis* <SEQ ID 65>:

```
a010.seq
     1 ATGGGCTTTC CTGTTCGCAA GTTTGATGCC GTGATTGTCG GCGGTGGTGG

51 TGCAGGTTTA CGCGCANCCC TCCAATTATC CAAATCCGGT CTGAATTGTG

101 CCGTTTTGTC TAAAGTGTTC CCGACCCGTT CGCATACCGT AGCGGCGCAG

151 GGCGGTATTT CCGCCTCTCT GGGTAATGTG CAGGAAGACC GTTGGGACTG

201 GCACATGTAC GATACCGTGA AAGGTTCCGA CTGGTTGGGC GACCAAGATG

251 CGATTGAGTT TATGTGCCGC GCCGCGCCTG AAGCCGTAAT TGAGTTGGAA

301 CACATGGGTA TGCCTTTTGA CCGTGTGGAA AGCGGTAAAA TTTATCAGCG

351 TCCTTTCGGC GGCCATACTG CCGAACACGG TAAACGCGCG GTAGAACGCG

401 CCTGTGCNGT TGCCGACCGT ACAGGTCATG CGATGCTGCA TACTTTGTAC

451 CAACAAAATG TCCGTGCCAA TACGCAATTC TTTGTGGAAT GGACGGCACA

501 AGATTTGATT CGTGATGAAA ACGGCGATGT CGTCGGCGTA ACCGCCATGG

551 AAATGGAAAC CGGCGAAGTT TATATTTTCC ACGCTAAAGC TGTGATGTTT

601 GCTACCGGCG GCGGCGGCCG TATTTATGCG TCTTCTACCA ATGCCTATAT

651 GAATACCGGC GATGGTTTGG GTATTTGTGC GCGTGCAGGT ATCCCGTTGG

701 AAGACATGGA ATTCTGGCAA TTCCACCCGA CCGGCGTGGC AGGTGCGGGC

751 GTGTTGATTA CCGAAGGCGT ACGCGGCGAG GGCGGTATTC TGTTGAATGC

801 CGACGGCGAA CGCTTTATGG AACGCTATGC GCCGACCGTA AAAGACTTGG

851 CTTCTCGCGA CGTTGTTTCC CGCGCGATGG CGATGGAAAT CTACGAAGGT

901 CGCGGCTGCG GTAAAAACAA AGACCATGTC TTACTGAAAA TCGACCATAT

951 CGGCGCAGAA AAAATTATGG AAAAACTGCC GGGCATCCGC GAGATTTCCA

1001 TTCAGTTCGC CGGTATCGAT CCGATTAAAG ACCCGATTCC CGTTGTGCCG

1051 ACTACCCACT ATATGATGGG CGGTATTCCG ACCAACTACC ATGGCGAAGT

1101 TGTCGTTCCT CAAGGCGACG AATACGAAGT GCCTGTAAAA GGTCTGTATG

1151 CGGCAGGTGA GTGCGCCTGT GCTTCCGTAC ACGGTGCGAA CCGCTTGGGT

1201 ACGAACTCCC TGCTGGACTT AGTGGTATTC GGTAAAGCTG CCGGCGACAG

1251 CATGATTAAA TTCATCAAAG AGCAAAGCGA CTGGAAACCT TTGCCTGCTA

1301 ATGCCGGCGA ACTGACCCGC CAACGTATCG AGCGTTTGGA CAATCAAACT

1351 GATGGTGAAA ACGTTGATGC ATTGCGCCGC GAACTGCAAC GCTCCGTACA

1401 ATTGCACGCC GGCGTGTTCC GTACTGATGA GATTCTGAGC AAAGGCGTTC

1451 GAGAAGTCAT GGCGATTGCC GAGCGTGTGA AACGTACCGA AATCAAAGAC
```

```
1501 AAGAGCAAAG TGTGGAATAC CGCGCGTATC GAGGCTTTGG AATTGGATAA

1551 CCTAATTGAA GTGGCGAAAG CGACTTTGGT GTCTGCCGAA GCACGTAAAG

1601 AATCACGCGG TGCGCACGCT TCAGACGACC ATCCTGAGCG CGATGATGAA

1651 AACTGGATGA AACATACGCT GTACCATTCA GATGCCAATA CCTTGTCCTA

1701 CAAACCGGTG CACACCAAGC CTTTGAGCGT GGAATACATC AAACCGGCCA

1751 AGCGCGTTTA TTGA
```

This corresponds to the amino acid sequence <SEQ ID 66; ORF 010.a>:

```
a010.pep
    1 MGFPVRKFDA VIVGGGGAGL RAXLQLSKSG LNCAVLSKVF PTRSHTVAAQ

51 GGISASLGNV QEDRWDWHMY DTVKGSDWLG DQDAIEFMCR AAPEAVIELE

101 HMGMPFDRVE SGKIYQRPFG GHTAEHGKRA VERACAVADR TGHAMLHTLY

151 QQNVRANTQF FVEWTAQDLI RDENGDVVGV TAMEMETGEV YIFHAKAVMF

201 ATGGGGRIYA SSTNAYMNTG DGLGICARAG IPLEDMEFWQ FHPTGVAGAG

251 VLITEGVRGE GGILLNADGE RFMERYAPTV KDLASRDVVS RAMAMEIYEG

301 RGCGKNKDHV LLKIDHIGAE KIMEKLPGIR EISIQFAGID PIKDPIPVVP

351 TTHYMMGGIP TNYHGEVVVP QGDEYEVPVK GLYAAGECAC ASVHGANRLG

401 TNSLLDLVVF GKAAGDSMIK FIKEQSDWKP LPANAGELTR QRIERLDNQT

451 DGENVDALRR ELQRSVQLHA GVFRTDEILS KGVREVMAIA ERVKRTEIKD

501 KSKVWNTARI EALELDNLIE VAKATLVSAE ARKESRGAHA SDDHPERDDE

551 NWMKHTLYHS DANTLSYKPV HTKPLSVEYI KPAKRVY*
``` m010/a010 98.7% identity over a 231 aa overlap

```
                          10         20         30
       m010.pep           XQLSKSGLNCAVLSKVFPTRSHTVAAQGGISASXGNV
                          |||||||||||||||||||||||||||||||| |||
       a010     MGFPVRKFDAVIVGGGGAGLRAXLQLSKSGLNCAVLSKVFPTRSHTVAAQGGISASLGNV
                        10         20         30         40         50         60

40         50         60         70         80         90
       m010.pep QEDRWDWHMYDTVKGSDWLGDQDAIEFMCRAAPEAVIELEHMGMPFDRVESGKIYQRPFG
                ||||||||||||||||||||||||||||||||||||||||||||||||||||||||||||
       a010     QEDRWDWHMYDTVKGSDWLGDQDAIEFMCRAAPEAVIELEHMGMPFDRVESGKIYQRPFG
                        70         80         90        100        110        120

100        110        120        130        140        150
       m010.pep GHTAEHGKRAVERXCAVADRTGHAMLHTLYQQNVRANTQFFVEWTAQDLIRDENGDVVGV
                |||||||||||||| |||||||||||||||||||||||||||||||||||||||||||||
       a010     GHTAEHGKRAVERACAVADRTGHAMLHTLYQQNVRANTQFFVEWTAQDLIRDENGDVVGV
                       130        140        150        160        170        180

160        170        180        190        200        210
       m010.pep TAMEMETGEVYIFHAKAVMFATGGGGRIYASSTNAYMNTGDGLGICARAGIPLEDMEFWQ
                ||||||||||||||||||||||||||||||||||||||||||||||||||||||||||||
       a010     TAMEMETGEVYIFHAKAVMFATGGGGRIYASSTNAYMNTGDGLGICARAGIPLEDMEFWQ
                       190        200        210        220        230        240

220        230
       m010.pep FQPTGVAGAGVLITE
                |:|||||||||||||
       a010     FHPTGVAGAGVLITEGVRGEGGILLNADGERFMERYAPTVKDLASRDVVSRAMAMEIYEG
                       250        260        270        280        290        300
```

Computer analysis of this amino acid sequence gave the following results:

Homology with a Predicted ORF from *N. gonorrhoeae*
ORF 010 shows 98.7% identity over a 231 aa overlap with a predicted ORF (ORF 010.ng) from *N. gonorrhoeae*:

```
m010.pep/g010.pep 10        20        30
m010.pep              XQLSKSGLNCAVLSKVFPTRSHTVAAQGGISASXGNV
                      |||||||||||||||||||||||||||||||| |||
a010     MGFPVRKFDAVIVGGGAGLRAXLQLSKSGLNCAVLSKVFPTRSHTVAAQGGISASLGNV
              10        20        30        40        50        60

40        50        60        70        80        90
m010.pep QEDRWDWHMYDTVKGSDWLGDQDAIEFMCRAAPEAVIELEHMGMPFDRVESGKIYQRPFG
         ||||||||||||||||||||||||||||||||||||||||||||||||||||||||||||
a010     QEDRWDWHMYDTVKGSDWLGDQDAIEFMCRAAPEAVIELEHMGMPFDRVESGKIYQRPFG
              70        80        90       100       110       120

100       110       120       130       140       150
m010.pep GHTAEHGKRAVERXCAVADRTGHAMLHTLYQQNVRANTQFFVEWTAQDLIRDENGDVVGV
         ||||||||||||| ||||||||||||||||||||||||||||||||||||||||||||||
a010     GHTAEHGKRAVERACAVADRTGHAMLHTLYQQNVRANTQFFVEWTAQDLIRDENGDVVGV
             130       140       150       160       170       180

160       170       180       190       200       210
m010.pep TAMEMETGEVYIFHAKAVMFATGGGGRIYASSTNAYMNTGDGLGICARAGIPLEDMEFWQ
         ||||||||||||||||||||||||||||||||||||||||||||||||||||||||||||
a010     TAMEMETGEVYIFHAKAVMFATGGGGRIYASSTNAYMNTGDGLGICARAGIPLEDMEFWQ
             190       200       210       220       230       240

220       230
m010.pep FQPTGVAGAGVLITE
         |:|||||||||||||
a010     FHPTGVAGAGVLITEGVRGEGGILLNADGERFMERYAPTVKDLASRDVVSRAMAMEIYEG
             250       260       270       280       290       300
```

The following partial DNA sequence was identified in *N. gonorrhoeae* <SEQ ID 67>:

```
g010-1.seq..
    1 ATGGGTTTTC CTGTTCGCAA GTTTGATGCC GTGATTGTCG GCGGTGGCGG

51 TGCAGGTTTA CGTGCAGCCC TCCAATTATC CAAATCCGGT TTGAATTGTG

101 CCGTTTTGTC TAAAGTGTTC CCGACCCGCT CGCATACCGT AGCGGCGCAG

151 GGCGGTATTT CCGCCTCTCT GGGTAATGTG CAGGAGGACC GTTGGGACTG

201 GCACATGTAC GATACCGTGA AGGTTCCGA CTGGCTGGGC GACCAAGATG

251 CGATTGAGTT TATGTGTCGC GCTGCGCCTG AAGCGGTGAT TGAGTTGGAA

301 CACATGGGTA TGCCTTTTGA CCGCGTTGAA AGCGGCAAAA TTTATCAGCG

351 TCCTTTCGGC GGACATACTG CCGAACATGG TAAACGTGCG GTAGAACGTG

401 CATGTGCGGT TGCCGACCGT ACCGGTCATG CGATGTTGCA TACTTTGTAC

451 CAACAAAACG TCCGTGCCAA TACACAATTC TTTGTGGAAT GGACGGCGCA

501 AGATTTGATT CGTGATGAAA ACGGCGATGT CGTCGGCGTA ACCGCCATGG

551 AAATGGAAAC GGGCGAAGTT TATATTTTCC ACGCCAAGGC CGTGATGTTT

601 GCTACCGGTG GCGGCGGTCG TATTTATGCT TCTTCTACCA ATGCTTATAT

651 GAATACCGGT GACGGTTTGG GCATTTGCGC CCGTGCGGGC ATTCCGTTGG

701 AAGATATGGA ATTCTGGCAA TTCCACCCGA CCGGCGTGGC GGGTGCGGGC

751 GTGTTGATTA CCGAAGGCGT ACGCGGCGAG GGCGGTATTC TGTTGAACGC

801 CGACGGCGAA CGCTTTATGG AACGCTATGC GCCGACCGTA AAAGACTTGG

851 CTTCTCGCGA CGTGGTTTCA CGCGCGATGG CGATGGAAAT CTATGAAGGT

901 CGCGGCTGTG GTAAAAACAA AGACCACGTC TTACTGAAAA TCGACCATAT
```

```
 951 CGGTGCAGAA AAAATTATGG AAAAACTGCC GGGCATCCGC GAGATTTCCA

1001 TTCAGTTTGC CGGTATCGAT CCGATTAAAG ACCCGATTCC GGTTGTGCCG

1051 ACTACCCACT ATATGATGGG CGGCATTCCG ACCAATTATC ACGGTGAAGT

1101 TGTTGTTCCG CAAGGCGACG AGTACGAAGT ACCTGTAAAA GGCCTGTATG

1151 CCGCAGGTGA GTGCGCCTGT GCTTCCGTAC ACGGTGCGAA CCGTTTGGGT

1201 ACGAACTCCC TGCTGGACTT GGTGGTGTTC cgcccaaccc cccggtga
```

This corresponds to the amino acid sequence <SEQ ID 68; ORF 010-1.ng>:

```
g010-1.pep
    1   MGFPVRKFDA VIVGGGGAGL RAALQLSKSG LNCAVLSKVF PTRSHTVAAQ

51   GGISASLGNV QEDRWDWHMY DTVKGSDWLG DQDAIEFMCR AAPEAVIELE

101   HMGMPFDRVE SGKIYQRPFG GHTAEHGKRA VERACAVADR TGHAMLHTLY

151   QQNVRANTQF FVEWTAQDLI RDENGDVVGV TAMEMETGEV YIFHAKAVMF

201   ATGGGGRIYA SSTNAYMNTG DGLGICARAG IPLEDMEFWQ FHPTGVAGAG

251   VLITEGVRGE GGILLNADGE RFMERYAPTV KDLASRDVVS RAMAMEIYEG

301   RGCGKNKDHV LLKIDHIGAE KIMEKLPGIR EISIQFAGID PIKDPIPVVP

351   TTHYMMGGIP TNYHGEVVVP QGDEYEVPVK GLYAAGECAC ASVHGANRLG

401   TNSLLDLVVF RPTPR*
```

```
g010-1 (SEQ ID 68)/P10444 (SEQ ID 4158)
sp|P10444|DHSA_ECOLI SUCCINATE DEHYDROGENASE FLAVOPROTEIN SUBUNIT
gnl|PID|d101527.0 (D90711) Succinate dehydrogenase, flavoprotein [Escherichia coli] gi|1786942
(AE000175) succinate dehydrogenase flavoprotein subunit [Escherichia coli] Length = 588
Score = 1073 (495.6 bits), Expect = 6.7e-169, Sum P(2) = 6.7e-169
Identities = 191/303 (63%), Positives = 238/303 (78%)
Query:      1 MGFPVRKFDAVIVXXXXXXXXXXXXXXSKSGLNCAVLSKVFPTRSHTVAAQGGISASLGNV 60
              M  PVR FDAV++              S+SG  CA+LSKVFPTRSHTV+AQGGI+ +LGN 
Sbjct:      1 MKLPVREFDAVVIGAGGAGMRAALQISQSGQTCALLSKVFPTRSHTVSAQGGITVALGNT 60

Query:     61 QEDRWDWHMYDTVKGSDWLGDQDAIEFMCRAAPEAVIELEHMGMPFDRVESGKIYQRPFG 120
                 ED W+WHMYDTVKGSD++GDQDAIE+MC+  PEA++ELEHMG+PF R++ G+IYQRPFG
Sbjct:     61 HEDNWEWHMYDTVKGSDYIGDQDAIEYMCKTGPEAILELEHMGLPFSRLDDGRIYQRPFG 120

Query:    121 GHTAEHGKRAVERACAVADRTGHAMLHTLYQQNVRANTQFFVEWTAQDLIRDENGDVVGV 180
                G +    G    R A ADRTGHA+LHTLYQQN++   +T F EW A DL+++++G VVG
Sbjct:    121 GQSKNFGGEQAARTAAAADRTGHALLHTLYQQNLKNHTTIFSEWYALDLVKNQDGAVVGC 180

Query:    181 TAMEMETGEVYIFHAKAVMFATGGGGRIYASSTNAYMNTGDGLGICARAGIPLEDMEFWQ 240
              TA+ +ETGEV  F A+A  ATGG GRIY S+TNA++NTGDG+G+ +RAG+P++DME WQ
Sbjct:    181 TALCIETGEVVYFKARATVLATGGAGRIYQSTTNAHINTGDGVGMAIRAGVPVQDMEMWQ 240

Query:    241 FHPTGVAGAGVLITEGVRGEGGILLNADGERFMERYAPTVKDLASRDVVSRAMAMEIYEG 300
              FHPTG+AGAGVL+TEG RGEGG LLN   GERFMERYAP  KDLA RDVV+R++ +EI EG
Sbjct:    241 FHPTGIAGAGVLVTEGCRGEGGYLLNKHGERFMERYAPNAKDLAGRDVVARSIMIEIREG 300

Query:    301 RGC 303
              RGC
Sbjct:    301 RGC 303

Score = 249 (115.0 bits), Expect = 6.7e-169, Sum P(2) = 6.7e-169
Identities = 53/102 (51%), Positives = 62/102 (60%)
Query:    309 HVLLKIDHIGAEKIMEKLPGIREISIQFAGXXXXXXXXXXXXXXTTHYMMGGIPTNYHGEVV 368
              H  LK+DH+G E +  +LPGI E+S  FA              T HYMMGGIPT  G+ +
Sbjct:    310 HAKLKLDHLGKEVLESRLPGILELSRTFAHVDPVKEPIPVIPTCHYMMGGIPTKVTGQAL 369

Query:    369 VPQGDEYEVPVKGLYAAGECACASVHGANRLGTNSLLDLVVF 410
              +V V GL+A GE AC SVHGANRLG NSLLDLVVF
Sbjct:    370 TVNEKGEDVVVPGLFAVGEIACVSVHGANRLGGNSLLDLVVF 411
```

The following partial DNA sequence was identified in *N. meningitidis* <SEQ ID 69>:

```
m010-1.seg..
   1  ATGGGTTTTC CTGTTCGCAA GTTTGATGCC GTGATTGTCG GCGGTGGTGG

51  TGCAGGTTTA CGCGCAGCCC TCCAATTATC CAAATCCGGT CTGAATTGTG

101  CCGTTTTGTC TAAAGTGTTC CCGACCCGTT CGCATACCGT AGCGGCGCAg

151  GGCGGTATTT CCGCCTCTCT GGGTAATGTG CAGGAAGACC GTTGGGACTG

201  GCACATGTAC GATACCGTGA AAGGTTCCGA CTGGTTGGGC GACCAAGATG

251  CGATTGAGTT TATGTGCCGC GCCGCGCCTG AAGCCGTAAT TGAGTTGGAA

301  CACATGGGTA TGCCTTTTGA CCGTGTGGAA AGCGGTAAAA TTTATCAGCG

351  TCCTTTCGGC GGCCATACTG CCGAACACGG TAAACGCGCG GTAGAACGCG

401  CCTGTGCGGT TGCCGACCGT ACAGGTCATG CGATGCTGCA TACTTTGTAC

451  CAACAAAACG TCCGTGCCAA TACGCAATTC TTTGTGGAAT GGACGGCACA

501  AGATTTGATT CGTGATGAAA ACGGCGATGT CGTCGGCGTA ACCGCCATGG

551  AAATGGAAAC CGGCGAAGTT TATATTTTCC ACGCTAAAGC TGTGATGTTT

601  GCTACCGGCG GCGGCGGTCG TATTTATGCG TCTTCTACCA ATGCCTATAT

651  GAATACCGGC GATGGTTTGG GTATTTGTGC GCGTGCAGGT ATCCCGTTGG

701  AAGACATGGA ATTCTGGCAA TTCCACCCGA CCGGCGTGGC GGGTGCGGGC

751  GTGTTGATTA CCGAAGGCGT ACGCGGCGAG GGCGGTATTC TGTTGAATGC

801  CGACGGCGAA CGCTTTATGG AACGCTATGC GCCGACCGTA AAAGACTTGG

851  CTTCTCGCGA CGTTGTTTCC CGCGCGATGG CGATGGAAAT CTACGAAGGT

901  CGCGGCTGCG GTAAAAACAA AGACCATGTC TTACTGAAAA TCGACCATAT

951  CGGCGCAGAA AAAATTATGG AAAAACTGCC GGGCATCCGC GAGATTTCCA

1001  TTCAGTTCGC CGGTATCGAT CCGATTAAAG ACCCGATTCC CGTTGTGCCG

1051  ACTACCCACT ATATGATGGG CGGCATTCCG ACCAATTACC ACGGCGAAGT

1101  TGTCGTTCCG CAAGGTGAAG ATTACGAAGT GCCTGTAAAA GGTCTGTATG

1151  CGGCAGGTGA GTGCGCTTGT GCTTCCGTAC ACGGTGCGAA CCGCTTGGGT

1201  ACCAATTACC TGTTGGACTT GGTGGTATTC GGTAAAGCTG CCGGCGACAG

1251  CATGATTAAA TTCATCAAAG AGCAAAGCGA CTGGAAACCT TTGCCTGCTA

1301  ATGCAGGTGA GTTGACCCGC CAACGTATCG AGCGTTTGGA CAACCAAACC

1351  GATGGTGAAA ACGTTGATGC ATTGCGTCGC GAACTGCAAC GCTCTGTACA

1401  ACTGCACGCC GGCGTGTTCC GTACTGATGA GATTCTGAGC AAAGGCGTTC

1451  GAGAAGTCAT GGCGATTGCC GAGCGTGTGA AACGTACCGA AATCAAAGAC

1501  AAGAGCAAAG TGTGGAATAC CGCGCGTATC GAGGCTTTGG AATTGGATAA

1551  CCTGATTGAA GTGGCGAAAG CGACTTTGGT GTCTGCCGAA GCACGTAAAG

1601  AATCACGCGG TGCGCACGCT TCAGACGACC ATCCTGAGCG CGATGATGAA

1651  AACTGGATGA AACATACGCT GTACCATTCA GATATCAATA CCTTGTCCTA

1701  CAAACCGGTG CACACCAAGC CTTTGAGCGT GGAATACATC AAACCGGCCA

1751  AGCGCGTTTA TTGATGA
```

This corresponds to the amino acid sequence <SEQ ID 70; ORF 010-1>:

```
m010-1.pep...
         1   MGFPVRKFDA VIVGGGGAGL RAALQLSKSG LNCAVLSKVF PTRSHTVAAQ
        51   GGISASLGNV QEDRWDWHMY DTVKGSDWLG DQDAIEFMCR AAPEAVIELE
       101   HHGMPFDRVE SGKIYQRPFG GHTAEHGKRA VERACAVADR TGHAMLHTLY
       151   QQNVRANTQF FVEWTAQDLI RDENGDVVGV TAMEMETGEV YIFHAKAVMF
       201   ATGGGGRIYA SSTNAYMNTG DGLGICARAG IPLEDMEFWQ FHPTGVAGAG
       251   VLITEGVRGE GGILLNADGE RFMERYAPTV KDLASRDVVS RAMAMEIYEG
       301   RGCGKNKDHV LLKIDGIGAE KIMEKLPGIR EISIQFAGID PIKDPIPVVP
       351   TTHYMMGGIP TNYHGEVVVP QGDEYEVPVK GLYAAGECAC ASVHGANRLG
       401   TNSLLDLVVF GKAAGDSMIK FIKEQSDWKP LPANAGELTR QRIERLDNQT
       451   DGENVDALRR ELQRSVQLHA GVFRTDEILS KGVREVMAIA ERVKRTEIKD
       501   KSKVWNTARI EALELDNLIE VAKATLVSAE ARKESRGAHA SDDHPERDDE
       551   NWMKHTLYHS DANTLSYKPV HTKPLSVEYI KPAKRVY* m010-1/g010-1    99.5% identity in 410 aa overlap 10         20         30         40         50         60
m010-1.pep     MGFPVRKFDAVIVGGGGAGLRAALQLSKSGLNCAVLSKVFPTRSHTVAAQGGISASLGNV
               ||||||||||||||||||||||||||||||||||||||||||||||||||||||||||||
a010-1         MGFPVRKFDAVIVGGGGAGLRAALQLSKSGLNCAVLSKVFPTRSHTVAAQGGISASLGNV
                    10         20         30         40         50         60

70         80         90        100        110        120
m010-1.pep     QEDRWDWHMYDTVKGSDWLGDQDAIEFMCRAAPEAVIELEHMGMPFDRVESGKIYQRPFG
               ||||||||||||||||||||||||||||||||||||||||||||||||||||||||||||
g010-1         QEDRWDWHMYDTVKGSDWLGDQDAIEFMCRAAPEAVIELEHMGMPFDRVESGKIYQRPFG
                    70         80         90        100        110        120

130        140        150        160        170        180
m010-1.pep     GHTAEHGKRAVERACAVADRTGHAMLHTLYQQNVRANTQFFVEWTAQDLIRDENGDVVGV
               ||||||||||||||||||||||||||||||||||||||||||||||||||||||||||||
g010-1         GHTAEHGKRAVERACAVADRTGHAMLHTLYQQNVRANTQFFVEWTAQDLIRDENGDVVGV
                   130        140        150        160        170        180

190        200        210        220        230        240
m010-1.pep     TAMEMETGEVYIFHAKAVMFATGGGGRIYASSTNAYMNTGDGLGICARAGIPLEDMEFWQ
               ||||||||||||||||||||||||||||||||||||||||||||||||||||||||||||
g010-1         TAMEMETGEVYIFHAKAVMFATGGGGRIYASSTNAYMNTGDGLGICARAGIPLEDMEFWQ
                   190        200        210        220        230        240

250        260        270        280        290        300
m010-1.pep     FHPTGVAGAGVLITEGVRGEGGILLNADGERFMERYAPTVKDLASRDVVSRAMAMEIYEG
               ||||||||||||||||||||||||||||||||||||||||||||||||||||||||||||
g010-1         FHPTGVAGAGVLITEGVRGEGGILLNADGERFMERYAPTVKDLASRDVVSRAMAMEIYEG
                   250        260        270        280        290        300

310        320        330        340        350        360
m010-1.pep     RGCGKNKDHVLLKIDHIGAEKIMEKLPGIREISIQFAGIDPIKDPIPVVPTTHYMMGGIP
               ||||||||||||||||||||||||||||||||||||||||||||||||||||||||||||
g010-1         RGCGKNKDHVLLKIDHIGAEKIMEKLPGIREISIQFAGIDPIKDPIPVVPTTHYMMGGIP
                   310        320        330        340        350        360

370        380        390        400        410        420
m010-1.pep     TNYHGEVVVPQGEDYEVPVKGLYAAGECACASVHGANRLGTNSLLDLVVFGKAAGDSMIK
               ||||||||||||::||||||||||||||||||||||||||||||||||||||||
g010-1         TNYHGEVVVPQGDEYEVPVKGLYAAGECACASVHGANRLGTNSLLDLVVFRPTPRX
                   370        380        390        400        410

430        440        450        460        470        480
m010-1.pep     FIKEQSDWKPLPANAGELTRQRIERLDNQTDGENVDALRRELQRSVQLHAGVFRTDEILS
```

The following partial DNA sequence was identified in *N. meningitidis* <SEQ ID 71>:

```
a010-1.seq..
         1   ATGGGCTTTC CTGTTCGCAA GTTTGATGCC GTGATTGTCG GCGGTGGTGG
        51   TGCAGGTTTA CGCGCANCCC TCCAATTATC CAAATCCGGT CTGAATTGTG
```

-continued

```
 101 CCGTTTTGTC TAAAGTGTTC CCGACCCGTT CGCATACCGT AGCGGCGCAG
 151 GGCGGTATTT CCGCCTCTCT GGGTAATGTG CAGGAAGACC GTTGGGACTG
 201 GCACATGTAC GATACCGTGA AAGGTTCCGA CTGGTTGGGC GACCAAGATG
 251 CGATTGAGTT TATGTGCCGC GCCGCGCCTG AAGCCGTAAT TGAGTTGGAA
 301 CACATGGGTA TGCCTTTTGA CCGTGTGGAA AGCGGTAAAA TTTATCAGCG
 351 TCCTTTCGGC GGCCATACTG CCGAACACGG TAAACGCGCG GTAGAACGCG
 401 CCTGTGCNGT TGCCGACCGT ACAGGTCATG CGATGCTGCA TACTTTGTAC
 451 CAACAAAATG TCCGTGCCAA TACGCAATTC TTTGTGGAAT GGACGGCACA
 501 AGATTTGATT CGTGATGAAA ACGGCGATGT CGTCGGCGTA ACCGCCATGG
 551 AAATGGAAAC CGGCGAAGTT TATATTTTCC ACGCTAAAGC TGTGATGTTT
 601 GCTACCGGCG GCGGCGGCCG TATTTATGCG TCTTCTACCA ATGCCTATAT
 651 GAATACCGGC GATGGTTTGG GTATTTGTGC GCGTGCAGGT ATCCCGTTGG
 701 AAGACATGGA ATTCTGGCAA TTCCACCCGA CCGGCGTGGC AGGTGCGGGC
 751 GTGTTGATTA CCGAAGGCGT ACGCGGCGAG GCGGTATTC TGTTGAATGC
 801 CGACGGCGAA CGCTTTATGG AACGCTATGC GCCGACCGTA AAAGACTTGG
 851 CTTCTCGCGA CGTTGTTTCC CGCGCGATGG CGATGGAAAT CTACGAAGGT
 901 CGCGGCTGCG GTAAAAACAA AGACCATGTC TTACTGAAAA TCGACCATAT
 951 CGGCGCAGAA AAAATTATGG AAAAACTGCC GGGCATCCGC GAGATTTCCA
1001 TTCAGTTCGC CGGTATCGAT CCGATTAAAG ACCCGATTCC CGTTGTGCCG
1051 ACTACCCACT ATATGATGGG CGGTATTCCG ACCAACTACC ATGGCGAAGT
1101 TGTCGTTCCT CAAGGCGACG AATACGAAGT GCCTGTAAAA GGTCTGTATG
1151 CGGCAGGTGA GTGCGCCTGT GCTTCCGTAC ACGGTGCGAA CCGCTTGGGT
1201 ACGAACTCCC TGCTGGACTT AGTGGTATTC GGTAAAGCTG CCGGCGACAG
1251 CATGATTAAA TTCATCAAAG AGCAAAGCGA CTGGAAACCT TTGCCTGCTA
1301 ATGCCGGCGA ACTGACCCGC CAACGTATCG AGCGTTTGGA CAATCAAACT
1351 GATGGTGAAA ACGTTGATGC ATTGCGCCGC GAACTGCAAC GCTCCGTACA
1401 ATTGCACGCC GGCGTGTTCC GTACTGATGA GATTCTGAGC AAAGGCGTTC
1451 GAGAAGTCAT GGCGATTGCC GAGCGTGTGA AACGTACCGA AATCAAAGAC
1501 AAGAGCAAAG TGTGGAATAC CGCGCGTATC GAGGCTTTGG AATTGGATAA
1551 CCTAATTGAA GTGGCGAAAG CGACTTTGGT GTCTGCCGAA GCACGTAAAG
1601 AATCACGCGG TGCGCACGCT TCAGACGACC ATCCTGAGCG CGATGATGAA
1651 AACTGGATGA ACATACGCT GTACCATTCA GATGCCAATA CCTTGTCCTA
1701 CAAACCGGTG CACACCAAGC CTTTGAGCGT GGAATACATC AAACCGGCCA
1751 AGCGCGTTTA TTGA
```

This corresponds to the amino acid sequence <SEQ ID 72; ORF 010-1.a>:

```
a010-1.pep...
     1  MGFPVRKFDA VIVGGGGAGL RAXLQLSKSG LNCAVLSKVF PTRSHTVAAQ
    51  GGISASLGNV QEDRWDWHMY DTVKGSDWLG DQDAIEFMCR AAPEAVIELE
```

```
101  HHGMPFDRVE SGKIYQRPFG GHTAEHGKRA VERACAVADR TGHAMLHTLY

151  QQNVRANTQF FVEWTAQDLI RDENGDVVGV TAMEMETGEV YIFHAKAVMF

201  ATGGGGRIYA SSTNAYMNTG DGLGICARAG IPLEDMEFWQ FHPTGVAGAG

251  VLITEGVRGE GGILLNADGE RFMERYAPTV KDLASRDVVS RAMAMEITEG

301  RGCGKNKDHV LLKIDGIGAE KIMEKLPGIR EISIQFAGID PIKDPIPVVP

351  TTHYMMGGIP TNYHGEVVVP QGDEYEVPVK GLYAAGECAC ASVHGANRLG

401  TNSLLDLVVF GKAAGDSMIK FIKEQSDWKP LPANAGELTR QRIERLDNQT

451  DGENVDALRR ELQRSVQLHA GVFRTDEILS KGVREVMAIA ERVKRTEIKD

501  KSKVWNTARI EALELDNLIE VAKATLVSAE ARKESRGAHA SDDHPERDDE

551  NWMKHTLYHS DANTLSYKPV HTKPLSVEYI KPAKRVY*
``` m010-1/a010-1  99.3% identity in 587 aa overlap

```
                  10         20         30         40         50         60
a010-1.pep  MGFPVRKFDAVIVGGGGAGLRAXLQLSKSGLNCAVLSKVFPTRSHTVAAQGGISASLGNV
            ||||||||||||||||||||||| |||||||||||||||||||||||||||||||||||
a010-1      MGFPVRKFDAVIVGGGGAGLRAALQLSKSGLNCAVLSKVFPTRSHTVAAQGGISASLGNV
                  10         20         30         40         50         60

70         80         90        100        110        120
a010-1.pep  QEDRWDWHMYDTVKGSDWLGDQDAIEFMCRAAPEAVIELEHMGMPFDRVESGKIYQRPFG
            ||||||||||||||||||||||||||||||||||||||||||||||||||||||||||||
m010-1      QEDRWDWHMYDTVKGSDWLGDQDAIEFMCRAAPEAVIELEHMGMPFDRVESGKIYQRPFG
                  70         80         90        100        110        120

130        140        150        160        170        180
a010-1.pep  GHTAEHGKRAVERACAVADRTGHAMLHTLYQQNVRANTQFFVEWTAQDLIRDENGDVVGV
            ||||||||||||||||||||||||||||||||||||||||||||||||||||||||||||
m010-1      GHTAEHGKRAVERACAVADRTGHAMLHTLYQQNVRANTQFFVEWTAQDLIRDENGDVVGV
                 130        140        150        160        170        180

190        200        210        220        230        240
a010-1.pep  TAMEMETGEVYIFHAKAVMFATGGGGRIYASSTNAYMNTGDGLGICARAGIPLEDMEFWQ
            ||||||||||||||||||||||||||||||||||||||||||||||||||||||||||||
m010-1      TAMEMETGEVYIFHAKAVMFATGGGGRIYASSTNAYMNTGDGLGICARAGIPLEDMEFWQ
                 190        200        210        220        230        240

250        260        270        280        290        300
a010-1.pep  FHPTGVAGAGVLITEGVRGEGGILLNADGERFMERYAPTVKDLASRDVVSRAMAMEIYEG
            ||||||||||||||||||||||||||||||||||||||||||||||||||||||||||||
m010-1      FHPTGVAGAGVLITEGVRGEGGILLNADGERFMERYAPTVKDLASRDVVSRAMAMEIYEG
                 250        260        270        280        290        300

310        320        330        340        350        360
a010-1.pep  RGCGKNKDHVLLKIDHIGAEKIMEKLPGIREISIQFAGIDPIKDPIPVVPTTHYMMGGIP
            ||||||||||||||||||||||||||||||||||||||||||||||||||||||||||||
m010-1      RGCGKNKDHVLLKIDHIGAEKIMEKLPGIREISIQFAGIDPIKDPIPVVPTTHYMMGGIP
                 310        320        330        340        350        360

370        380        390        400        410        420
a010-1.pep  TNYHGEVVVPQGDEYEVPVKGLYAAGECACASVHGANRLGTNSLLDLVVFGKAAGDSMIK
            ||||||||||||::||||||||||||||||||||||||||||||||||||||||||||||
m010-1      TNYHGEVVVPQGEDEYEVPVKGLYAAGECACASVHGANRLGTNSLLDLVVFGKAAGDSMIK
                 370        380        390        400        410        420

430        440        450        460        470        480
a010-1.pep  FIKEQSDWKPLPANAGELTRQRIERLDNQTDGENVDALRRELQRSVQLHAGVFRTDEILS
            ||||||||||||||||||||||||||||||||||||||||||||||||||||||||||||
m010-1      FIKEQSDWKPLPANAGELTRQRIERLDNQTDGENVDALRRELQRSVQLHAGVFRTDEILS
                 430        440        450        460        470        480

490        500        510        520        530        540
a010-1.pep  KGVREVMAIAERVKRTEIKDKSKVWNTARIEALELDNLIEVAKATLVSAEARKESRGAHA
            ||||||||||||||||||||||||||||||||||||||||||||||||||||||||||||
m010-1      KGVREVMAIAERVKRTEIKDKSKVWNTARIEALELDNLIEVAKATLVSAEARKESRGAHA
                 490        500        510        520        530        540

550        560        570        580
a010-1.pep  SDDHPERDDENWMKHTLYHSDANTLSYKPVHTKPLSVEYIKPAKRVYX
            |||||||||||||||||||||| |||||||||||||||||||||||||
m010-1      SDDHPERDDENWMKHTLYHSDINTLSYKPVHTKPLSVEYIKPAKRVYX
                 550        560        570        580
```

The following partial DNA sequence was identified in *N. gonorrhoeae* <SEQ ID 73>:

```
g011.seq
    1 ATGAAGACAC ACCGCAAGAC CTGCTCTGCG GTGTGTTTTG CTTTTCAGAC
   51 GGCATCGAAA CCCGCCGTTT CCATCCGACA TCCCAGCGAG GACATCATGA
  101 GCCTGAAAAC CCGCCTTACC GAAGATATGA AAACCGCGAT GCGCGCCAAA
  151 GATCAAGTTT CCCTCGGCAC CATCCGCCTC ATCAATGCCG CCGTCAAACA
  201 GTTTGAAGTA GACGAACGCA CCGAAGCCGA CGATGCCAAA ATCACCGCCA
  251 TCCTGACCAA AATGGTCAAA CAGCGCAAAG ACGGCGCGAA AATCTACACT
  301 GAAGCCGGCC GTCAGGATTT GGCAGACAAA GAAAACGCCG AAATCGACGT
  351 GCTGCACCGC TACCTGCCGC AAATGCTCTC CGCCGGCGAA ATCCGCACCG
  401 CCGTCGAAGC AGCCGTTGCC GAAACCGGCG CGGCAGGTAT GGCGGATATG
  451 GGCAAAGTGA TGGTCGTATT GAAAAcccGC CTCGCCGGCA AAGccgATAT
  501 GGGCGAAGTC AACAAAATCT TGAAAAccGt aCTGACCGCC tga
```

This corresponds to the amino acid sequence <SEQ ID 74; ORF 011.ng>:

```
g011.pepr
    1 MKTHRKTCSA VCFAFQTASK PAVSIRHPSE DIMSLKTRLT EDMKTAMRAK
   51 DQVSLGTIRL INAAVKQFEV DERTEADDAK ITAILTKMVK QRKDGAKIYT
  101 EAGRQDLADK ENAEIDVLHR YLPQMLSAGE IRTAVEAAVA ETGAAGMADM
  151 GKVMVVLKTR LAGKADMGEV NKILKTVLTA *
```

The following partial DNA sequence was identified in *N. meningitidis* <SEQ ID 75>:

```
m011.seq (partial)
    1 ATGAGGACAC ACCGCAAGAC CTGCTCTGCG GTGTGTTTTG CTTTTCAGAC
   51 GGCATCGAAA CCCGCCGTTT CCATCCGACA TCCCAGCGAG GACATCATGA
  101 GCCTGAAAAT CCGCCTTACC GAAGACATGA AAACCGCGAT GCGCGCCAAA
  151 GACCAAGTTT CCCTCGGCAC CATCCGCCTC ATCAACGCCG CCGTCAAACA
  201 GTTTGAAGTG GACGAACGCA CCGAAGCCGA CGATGCCAAA ATCACCGCCA
  251 TCCTGACCAA AATGGTCAAA CAGCGAAAAG ACAGCGCGAA AATCTACACT
  301 GAAGCCGGCC GTCAGGATTT GGCAGACAAA GAAAACGCCG AAATCGAGGT
  351 ACTGCACCGC TACCTTCCCC AAATGCTTTC CGCCGGCGAA ATCCGTACCG
  401 AGGTCGAAGC TGCCGTTGCC GAAACCGGCG CGGCAGGTAT GGCGGATATG
  451 GGTAAAGTCA TGGGGCTGCT GAAAACCCGC CTCGCAGGTA AAGCCGA...
```

This corresponds to the amino acid sequence <SEQ ID 76; ORF 011>:

```
m011.pep (partial)
    1 MRTHRKTCSA VCFAFQTASK PAVSIRHPSE DIMSLKIRLT EDMKTAMRAK
   51 DQVSLGTIRL INAAVKQFEV DERTEADDAK ITAILTKMVK QRKDSAKIYT
  101 EAGRQDLADK ENAEIEVLHR YLPQMLSAGE IRTEVEAAVA ETGAAGMADM
  151 GKVMGLLKTR LAGKA.....
```

Computer analysis of this amino acid sequence gave the following results:

Homology with a Predicted ORF from *N. gonorrhoeae*
ORF 011 shows 95.8% identity over a 165 aa overlap with a predicted ORF (ORF 011.ng) from *N. gonorrhoeae*:

```
m011/g011

10         20         30         40         50         60
    m011.pep  MRTHRKTCSAVCFAFQTASKPAVSIRHPSEDIMSLKIRLTEDMKTAMRAKDQVSLGTIRL
              |:||||||||||||||||||||||||||||||||| ||||||||||||||||||||||||
        g011  MKTHRKTCSAVCFAFQTASKPAVSIRHPSEDIMSLKTRLTEDMKTAMRAKDQVSLGTIRL
                  10         20         30         40         50         60

70         80         90        100        110        120
    m011.pep  INAAVKQFEVDERTEADDAKITAILTKMVKQRKDSAKIYTEAGRQDLADKENAEIEVLHR
              |||||||||||||||||||||||||||||||||| ||||||||||||||||||||:||||
        g011  INAAVKQFEVDERTEADDAKITAILTKMVKQRKDGAKIYTEAGRQDLADKENAEIDVLHR
                  70         80         90        100        110        120

130        140        150        160
    m011.pep  YLPQMLSAGEIRTEVEAAVAETGAAGMADMGKVMGLLKTRLAGKA
              ||||||||||||| ||||||||||||||||||||  ||||||||
        g011  YLPQMLSAGEIRTAVEAAVAETGAAGMADMGKVMVVLKTRLAGKADMGEVNKILKTVLTA
                 130        140        150        160        170        180 g011  X
```

The following partial DNA sequence was identified in *N. gonorrhoeae* <SEQ ID 77>:

```
g012.seq
    1  ATGCTCGCCC GTCGCTATTT TTTCAATATC CAACCCGGGG CGGTTTTCAC

51  TGACAAACTG CTTGAACAAC TGATGCGTTT CCTCCAGTTC CTGCCGGAAT

101  TTCTGTTTGC CCTTTTCCGT ATTTTCACCC ATAAAAGTAA CCGTGCGCTT

151  AAATTCGCCC GCCGTCATCA CATCCACATC AATATCATGT TTTTTCAACa 201  gGcggTGGAT ATTCGgcact tccgCcacca cacccaccga accgatgacc 251  gcaaacggaG CGGAAACAAT TTTATCCGCc acacacgcca tcatatagcc 301  gcCGCTTGCC GCGACCTTAT CGAcggcgac ggTCAGCGGA ATATTGCGTT

351  CGCGCAAACG CCTAAGCTGC GAAGCCGCCA AACCGTAACC GTGAACCACG

401  CCGCCCGGAC TTTCCAATCT GAGCAGAACC TCATCTTCAG GCTTGGCAAT

451  CAAAAGCACC GCCGTAATCT CATGACGCAA GGATTCTACG GCGTGTGCAT

501  ACAAATCGCC GTCAAAATCC AACACAAAAA GGCGGGATTT TTGCGTTTCG

551  GCAGATTTCT CCCCGCCCTC CTTCAAACGC TTTTTCTCTG CTTTGGCTTC

601  CGCCTTTTCC TTTTTCTTTT CTTTTTTTTC CTGATGTTTT GTCTCTTCCT

651  CGCTTAA
```

This corresponds to the amino acid sequence <SEQ ID 78; ORF 012.ng>:

```
g012.pep
    1  MLARRYFFNI QPGAVFTDKL LEQLMRFLQF LPEFLFALFR IFTHKSNRAL

51  KFARRHHIHI NIMFFQQAVD IRHFRHHTHR TDDRKRSGNN FIRHTRHHIA

101  AACRDLIDGD GQRNIAFAQT PKLRSRQTVT VNHAARTFQS EQNLIFRLGN

151  QKHRRNLMTQ GFYGVCIQIA VKIQHKKAGF LRFGRFLPAL LQTLFLCFGF

201  RLFLFLFFFF LMFCLFLA*
```

The following partial DNA sequence was identified in *N. meningitidis* <SEQ ID 79>:

```
m012.seq
    1  ATGCTCGCCC GTTGCCACTT CCTCAATATC CAATTGAGGG CGGTTCTCGC

51  TGACAAACTG CTTGAACAAC TGATGCGTTT CCTCCAGTTC CTGTCGGAAT

101  TTCTGTTTGC CCTTTTCCGT ATTTTCACCC ATAAAAGTAA CCGTGCGCTT

151  AAATTCGCCC GCCGTCATCA CATCCACATC AATATCATGT TTTTTCAACA

201  GGCGGTGGAT ATTCGGTACT TCCGCCACCA CACCCACCGA ACCGACAATC

251  GCAAACGGAG CGGAAGCAAT TTTATCCGCC ACACACGCCA TCATATAACC

301  GCCGCTCGCn nnnnnnnnnn nnnnnnnnnn nnnnnnnnnn nnnnnnnnnn 351  nnnnnnnnnn nnnnnnnnnn nnnnnnnnnn nnnnnnnnnn nnnnnnnnnn 401  nnnnnnnnnn nnnnnnnnnn nnnnnnnnnn nnnnnnnnnn nnnnnnnnnn 451  nnnnnnnnnn nnnnnnnnnn nnnnnnnnnn nnnnnnnnnn nnnnnnnnnn 501  nnnnnnnnnn nnnnnnnnnC AACACAAAAA GGCGTGATTT nTGCGTTTCG 551  GCAGATTTCT CCCCACCCTC CTTCAAACGT TTTTCcTCTG CTTTGGCTTC

601  CGCCTTTTCC TTTTTCTTTT CCTCTTTTTC CTGATGTTGT GCCTCTTCCC

651  CGCTTAA
```

This corresponds to the amino acid sequence <SEQ ID 80; ORF 012>:

```
m012.pep
    1  MLARCHFLNI QLRAVLADKL LEQLMRFLQF LSEFLFALFR IFTHKSNRAL

51  KFARRHHIHI NIMFFQQAVD IRYFRHHTHR TDNRKRSGSN FIRHTRHHIT

101  AARXXXXXXX XXXXXXXXXX XXXXXXXXXX XXXXXXXXXX XXXXXXXXXX

151  XXXXXXXXXX XXXXXXXXXX XXXQHKKA*F XRFGRFLPTL LQTFFLCFGF

201  RLFLFLFLFF LMLCLFPA*
```

The following partial DNA sequence was identified in *N. meningitidis* <SEQ ID 81>:

```
a012.seq
    1  ATGCTCGCCC GTTGCCACTT CCTCAATATC CAATTGAGGG CGGTTCTCGC

51  TGACAAACTG CTTGAACAAC TGATGCGTTT CCTCCAGTTC CTGTCGGAAT

101  TTCTGTTTGC CCTTTTCCGT ATTTTCACCC ATAAAAGTAA CCGTGCGCTT

151  AAATTCGCCC GCCGTCATCA CATCCACATC AATATCATGT TTTTTCAACA

201  GGCGGTGGAT ATTCGGTACT TCCGCTACAA CACCCACCGA ACCGACAATC

251  GCAAACGGAG CGGAAACAAT TTTATCCGCC ACACACGCCA TCATATAACC

301  ACCGCTCGCC GCCACCTTAT CGACGGCGAC GGTCAGCGGA ATATTGCGTT

351  CGCGCAAACG CCTAAGCTGC GAAGCCGCCA AACCGTAACC GTGAACCACG

401  CCGCCCGGAC TTTCCAATCT AAGCAGAACC TCATCTTCAG GCTTGGCAAT

451  CAAAAGCACC GCCGTAATCT CATGACGCAA GGATTCTACG GCGTGTGCAT

501  ACAAATCGCC GTCAAAATCC AACACAAAAA GGCGGGATTT TTGCGTTTCG

551  GAAGATTTCT CCCCACCCTC CTTCAAACGC TTTTTCTCTG CTTTGGCTTC
```

-continued

```
601  CGCCTTTTCC TTTTTCTTTT CCTCTTTTTC CTGATGTTTT GCCTCTTCCC

651  CGCTTAA
```

This corresponds to the amino acid sequence <SEQ ID 82; ORF 012.a>:

```
a012.pep.
  1  MLARCHFLNI QLRAVLADKL LEQLMRFLQF LSEFLFALFR IFTHKSNRAL

51  KFARRHHIHI NIMFFQQAVD IRYFRYNTHR TDNRKRSGNN FIRHTRHHIT

101  TARRHLIDGD GQRNIAFAQT PKLRSRQTVT VNHAARTFQS KQNLIFRLGN

151  QKHRRNLMTQ GFYGVCIQIA VKIQHKKAGF LRFGRFLPTL LQTLFLCFGF

201  RLFLFLFLFF LMFCLFPA*
``` m012/a012 64.2% identity over a 218 aa overlap

```
                      10         20         30         40         50         60
      m012.pep   MLARCHFLNIQLRAVLADKLLEQLMRFLQFLSEFLFALFRIFTHKSNRALKFARRHHIHI
                 ||||||||||||||||||||||||||||||||||||||||||||||||||||||||||||
      a012       MLARCHFLNIQLRAVLADKLLEQLMRFLQFLSEFLFALFRIFTHKSNRALKFARRHHIHI
                      10         20         30         40         50         60

70         80         90        100        110        120
      m012.pep   NIMFFQQAVDIRYFRHHTHRTDNRKRSGSNFIRHTRHHITAARXXXXXXXXXXXXXXXXX
                 |||||||||||||::|||||||||||:||||||||||:||                   :
      a012       NIMFFQQAVDIRYFRYNTHRTDNRKRSGNNFIRHTRHHITTARRHLIDGDGQRNIAFAQT
                      70         80         90        100        110        120

130        140        150        160        170        180
      m012.pep   XXXXXXXXXXXXXXXXXXXXXXXXXXXXXXXXXXXXXXXXXXXXXXXXXQHKKAXF
                 : :           :                        :           ||||| |
      a012       PKLRSRQTVTVNHAARTFQSKQNLIFRLGNQKHRRNLMTQGFYGVCIQIAVKIQHKKAGF
                     130        140        150        160        170        180

190        200        210        200
      m012.pep   XRFGRFLPTLLQTFFLCFGFRLFLFLFLFFLMLCLFPAX
                  ||||||||||:||||||||||||||||||||:|||||
      a012       LRFGRFLPTLLQTLFLCFGFRLFLFLFLFFLMFCLFPAX
                     190        200        210
```

Computer analysis of this amino acid sequence gave the following results:
Homology with a Predicted ORF from *N. gonorrhoeae*
ORF 012 shows 58.7% identity over a 218 aa overlap with a predicted ORF (ORF 012.ng) from *N. gonorrhoeae*:

```
      m012/g012

10         20         30         40         50         60
      m012.pep   MLARCHFLNIQLRAVLADKLLEQLMRFLQFLSEFLFALFRIFTHKSNRALKFARRHHIHI
                 ||||  :|:|||  ||::||||||||||||||| ||||||||||||||||||||||||||
      g012       MLARRYFFNIQPGAVFTDKLLEQLMRFLQFLPEFLFALFRIFTHKSNRALKFARRHHIHI
                      10         20         30         40         50         60

70         80         90        100        110        120
      m012.pep   NIMFFQQAVDIRYFRHHTHRTDNRKRSGSNFIRHTRHHITAARXXXXXXXXXXXXXXXXX
                 ||||||||||||:|||||||||:|||||:|||||||||||:||                :
      g012       NIMFFQQAVDIRHFRHHTHRTDDRKRSGNNFIRHTRHHIAAACRDLIDGDGQRNIAFAQT
                      70         80         90        100        110        120

130        140        150        160        170        180
      m012.pep   XXXXXXXXXXXXXXXXXXXXXXXXXXXXXXXXXXXXXXXXXXXXXXXXXQHKKAXF
                 : :           :                        :           ||||| |
      g012       PKLRSRQTVTVNHAARTFQSEQNLIFRLGNQKHRRNLMTQGFYGVCIQIAVKIQHKKAGF
                     130        140        150        160        170        180
```

```
                   190        200        210   219
m012.pep    XRFGRFLPTLLQTFFLCFGFRLFLFLFLFFLMLCLFPAX
            ||||||||:||||:|||||||||||||:||||:||| ||
g012        LRFGRFLPALLQTLFLCFGFRLFLFLFFFFLMFCLFLAX
                   190        200        210
```

The following partial DNA sequence was identified in *N. meningitidis* <SEQ ID 83>:

```
m012-1.seq
  1 ATGCTCGCCC GTTGCCACTT CCTCAATATC CAATTGAGGG CGGTTCTCGC

51 TGACAAACTG CTTGAACAAC TGATGCGTTT CCTCCAGTTC CTGTCGGAAT

101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACA

201 GGCGGTGGAT ATTCGGTACT TCCGCCACCA CACCCACCGA ACCGACAATC

251 GCAAACGGAG CGGAAGCAAT TTTATCCGCC ACACACGCCA TCATATAACC

301 GCCGCTCGCC GCCACCTTAT CGACGGCGAC GGTCAGCGGA ATATTGCGTT

351 CGCGCAAACG CyTAAGCTGC GAAGCCGCCA AACCGTAACC GTGAACCACG

401 CCGCCCGGAC TTTCCAATCT GAGCAGAACC TCATCTTCAG GCTTGGCAAT

451 CAAAAGCACC GCCGTAATCT CATGACGCAA GGATTCTACG GCGTGTGCAT

501 ACAAATCGCC GTCAAAATCC AACACAAAAA GGCGGGATTT TTGCGTTTCG

551 GCAGATTTCT CCCCACCCTC CTTCAAACGC TTTTTCTCTG CTTTGGCTTC

601 CGCCTTTTCC TTTTTCTTTT CCTCTTTTTC CTGATGTTTT GCCTCTTCCC

651 CGCTTAA
```

This corresponds to the amino acid sequence <SEQ ID 84; ORF 012-1>:

```
m012-1.pep

1 MLARCHFLNI QLRAVLADKL LEQLMRFLQF LSEFLFALFR IFTHKSNRAL

51 KFARRHHIHI NIMFFQQAVD IRYFRHHTHR TDNRKRSGSN FIRHTRHHIT

101 AARRHLIDGD GQRNIAFAQT XKLRSRQTVT VNHAARTFQS EQNLIFRLGN

151 QKHRRNLMTQ GFYGVCIQIA VKIQHKKAGF LRFGRFLPTL LQTLFLCFGF

201 RLFLFLFLFF LMFCLFPA* m012-1/g012 91.7% identity in 218 aa overlap 10         20         30         40         50         60
m012-1.pep MLARCHFLNIQLRAVLADKLLEQLMRFLQFLSEFLFALFRIFTHKSNRALKFARRHHIHI
           ||||  :|:||   ||::||||||||||||||||| |||||||||||||||||||||||
g012       MLARRYFFNIQPGAVFTDKLLEQLMRFLQFLPEFLFALFRIFTHKSNRALKFARRHHIHI
                  10         20         30         40         50         60

70         80         90        100        110        120
m012-1.pep NIMFFQQAVDIRYFRHHTHRTDNRKRSGSNFIRHTRHHITAARRHLIDGDGQRNIAFAQT
           ||||||||||||:||||||||||:|||||:|||||||||  |   ||||||||||||||
g012       NIMFFQQAVDIRHFRHHTHRTDDRKRSGNNFIRHTRHHIAAACRDLIDGDGQRNIAFAQT
                  70         80         90        100        110        120

130        140        150        160        170        180
m012-1.pep XKLRSRQTVTVNHAARTFQSEQNLIFRLGNQKHRRNLMTQGFYGVCIQIAVKIQHKKAGF
            |||||||||||||||||||||||||||||||||||||||||||||||||||||||||||
g012       PKLRSRQTVTVNHAARTFQSEQNLIFRLGNQKHRRNLMTQGFYGVCIQIAVKIQHKKAGF
                 130        140        150        160        170        180
```

```
                       190        200        210   219
m012-1.pep  LRFGRFLPTLLQTLFLCFGFRLFLFLFLFFLMFCLFPAX
            ||||||||:||||||||||||||||:||||||||| ||
g012        LRFGRFLPALLQTLFLCFGFRLFLFLFFFLMFCLFLAX
                       190        200        210
```

The following partial DNA sequence was identified in *N. meningitidis* <SEQ ID 85>:

```
a012-1.seq
  1 ATGCTCGCCC GTTGCCACTT CCTCAATATC CAATTGAGGG CGGTTCTCGC

51 TGACAAACTG CTTGAACAAC TGATGCGTTT CCTCCAGTTC CTGTCGGAAT

101 TTCTGTTTGC CCTTTTCCGT ATTTTCACCC ATAAAAGTAA CCGTGCGCTT

151 AAATTCGCCC GCCGTCATCA CATCCACATC AATATCATGT TTTTTCAACA

201 GGCGGTGGAT ATTCGGTACT TCCGCTACAA CACCCACCGA ACCGACAATC

251 GCAAACGGAG CGGAAACAAT TTTATCCGCC ACACACGCCA TCATATAACC

301 ACCGCTCGCC GCCACCTTAT CGACGGCGAC GGTCAGCGGA ATATTGCGTT

351 CGCGCAAACG CCTAAGCTGC GAAGCCGCCA AACCGTAACC GTGAACCACG

401 CCGCCCGGAC TTTCCAATCT AAGCAGAACC TCATCTTCAG GCTTGGCAAT

451 CAAAAGCACC GCCGTAATCT CATGACGCAA GGATTCTACG GCGTGTGCAT

501 ACAAATCGCC GTCAAAATCC AACACAAAAA GGCGGGATTT TTGCGTTTCG

551 GAAGATTTCT CCCCACCCTC CTTCAAACGC TTTTTCTCTG CTTTGGCTTC

601 CGCCTTTTCC TTTTTCTTTT CCTCTTTTTC CTGATGTTTT GCCTCTTCCC

651 CGCTTAA
```

This corresponds to the amino acid sequence <SEQ ID 86; ORF 012-1.a>:

```
a012-1.pep

1 MLARCHFLNI QLRAVLADKL LEQLMRFLQF LSEFLFALFR IFTHKSNRAL

51 KFARRHHIHI NIMFFQQAVD IRYFRYNTHR TDNRKRSGNN FIRHTRHHIT

101 TARRHLIDGD GQRNIAFAQT PKLRSRQTVT VNHAARTFQS KQNLIFRLGN

151 QKHRRNLMTQ GFYGVCIQIA VKIQHKKAGF LRFGRFLPTL LQTLFLCFGF

201 RLFLFLFLFF LMFCLFPA* a012-1/m012-1 97.2% identity in 218 aa overlap 10         20         30         40         50         60
a012-1.pep  MLARCHFLNIQLRAVLADKLLEQLMRFLQFLSEFLFALFRIFTHKSNRALKFARRHHIHI
            ||||||||||||||||||||||||||||||||||||||||||||||||||||||||||||
m012-1      MLARCHFLNIQLRAVLADKLLEQLMRFLQFLSEFLFALFRIFTHKSNRALKFARRHHIHI
                  10         20         30         40         50         60

70         80         90        100        110        120
a012-1.pep  NIMFFQQAVDIRYFRYNTHRTDNRKRSGNNFIRHTRHHITTARRHLIDGDGQRNIAFAQT
            ||||||||||||||::||||||||||||||:||||||||||:||||||||||||||||||
m012-1      NIMFFQQAVDIRYFRHHTHRTDNRKRSGSNFIRHTRHHITAARRHLIDGDGQRNIAFAQT
                  70         80         90        100        110        120

130        140        150        160        170        180
a012-1.pep  PKLRSRQTVTVNHAARTFQSKQNLIFRLGNQKHRRNLMTQGFYGVCIQIAVKIQHKKAGF
            ||||||||||||||||||||:|||||||||||||||||||||||||||||||||||||||
m012-1      XKLRSRQTVTVNHAARTFQSEQNLIFRLGNQKHRRNLMTQGFYGVCIQIAVKIQHKKAGF
                 130        140        150        160        170        180
```

```
                        190        200        210     219
a012-1.pep  LRFGRFLPTLLQTLFLCFGFRLFLFLFLFFLMFCLFPAX
            ||||||||||||||||||||||||||||||||||||||
m012-1      LRFGRFLPTLLQTLFLCFGFRLFLFLFLFFLMFCLFPAX
                        190        200        210
```

The following partial DNA sequence was identified in *N. gonorrhoeae* <SEQ ID 87>:

```
g013.seq
  1 aTgcctttga ccatgctgtg cagcaGGAcg tGCGGTTtgt tcataataca 51 gtCcgaccGG AAAagcggAG GAAaCGCAGT GCCGCGCCCT TCCCCTTTCT 101 TGCCGTGGCA GGCGATGCag tTgGATTCGT ACACTTTTTG CCCTTTtGtc 151 atgatGCTgt tgtcggCGGC AGAAGCgGCG GcgCAGAGGC AGCACAAGAT 201 GAAGGCGGTC GGCAGTCGGG TTGTGTtcat tGgcgTTTCC cctaatgttt 251 tgaaaccttg tttttttgatt Ttgcctttac ggggtgaaaa gttttttTtgg 301 cccaaatccg gaatttag
```

This corresponds to the amino acid sequence <SEQ ID 88; ORF 013.ng:

```
g013.pep
  1 MPLTMLCSRT CGLFIIQSDR KSGGNAVPRP SPFLPWQAMQ LDSYTFCPFV

51 MMLLSAAEAA AQRQHKMKAV GSRVVFIGVS PNVLKPCFLI LPLRGEKFFW

101 PKSGI*
```

The following partial DNA sequence was identified in *N. meningitidis* <SEQ ID 89>:

```
m013.seq
  1 ATGCCTTTGA CCATGCTGTG CAGCAGCACC TGCGGTTTTT TCATGATGAA

51 GTCGGAGCGG TAGAGCGGCG GAAACATGGT TCCGCGGCCT TCGCCCTTTT

101 TGCCGTGGCA GGCGACGCAG TTGGATTCGT ACACTTTTTG CCCTTTTGTC

151 ATGATGCTGT TGTCGGCGGC AGAAGCGGCG GCGCAGAAGC AGCCCAAGAC

201 GAGGGCGGTC GGCAGTCGGG TTGTGTTCAT TGGTGTTTCC TTCATGTTTG

251 AAACCTTGTT GTTGATTTTG CGTAGCGGGT GAAAGATTTT TTTGCCGAAT

301 CAGTAG
```

This corresponds to the amino acid sequence <SEQ ID 90; ORF 013>:

```
m013.pep
  1 MPLTMLCSST CGFFMMKSER XSGGNMVPRP SPFLPWQATQ LDSYTFCPFV

51 MMLLSAAEAA AQKQPKTRAV GSRVVFIGVS FMFETLLLIL RSGXKIFLPN

101 Q*
```

The following partial DNA sequence was identified in *N. meningitidis* <SEQ ID 91>:

```
a013.seq
  1 ATGCCTTTGA CCATGCTGTG CAGCAGCACC TGCGGTTTTT TCATGATGAA

51 GTCGGAGCGG TAGAGCGGCG GAAACATGGT TCCGCGGCCT TCGCCCTTTT

101 TGCCGTGGCA GGCGACGCAG TTGGATTCGT ACACTTTTTG CCCTTTTGTC

151 ATGATGCTGT TGTCGGCGGC AGAAGCGGCG GCGCAGAGGC AGCCCAAGAC

201 GAGGGCGGTC GGCAGTCGGG TTGTGTTCAT TGGTGTTTCC TTAATGTTTG

251 AAACCTTGTT GTTGATTTTG CGTAGCGGGT GAAAGATTTT CTTGCCGAAT

301 CGGTAG
```

This corresponds to the amino acid sequence <SEQ ID 92; ORF 013.a>:

```
a013.pep
  1 MPLTMLCSST CGFFMMKSER *SGGNMVPRP SPFLPWQATQ LDSYTFCPFV

51 MMLLSAAEAA AQRQPKTRAV GSRVVFIGVS LMFETLLLIL RSG*KIFLPN

101 R*
``` m013/a013 97.0% identity over a 101 aa overlap

```
                  10         20         30         40         50         60
    m013.pep  MPLTMLCSSTCGFFMMKSERXSGGNMVPRPSPFLPWQATQLDSYTFCPFVMMLLSAAEAA
              ||||||||||||||||||||||||||||||||||||||||||||||||||||||||||||
    a013      MPLTMLCSSTCGFFMMKSERXSGGNMVPRPSPFLPWQATQLDSYTFCPFVMMLLSAAEAA
                  10         20         30         40         50         60
                  70         80         90        100
    m013.pep  AQKQPKTRAVGSRVVFIGVSFMFETLLLILRSGXKIFLPNQX
              ||:|||||||||||||||||:|||||||||||||||||||:|
    a013      AQRQPKTRAVGSRVVFIGVSLMFETLLLILRSGXKIFLPNRX
                  70         80         90        100
```

Computer analysis of this amino acid sequence gave the following results:
Homology with a Predicted ORF from *N. gonorrhoeae*
ORF 013 shows 73.3% identity over a 101 aa overlap with a predicted ORF (ORF 013.ng) from *N. gonorrhoeae*:

```
    m013/g013
                  10         20         30         40         50         60
    m013.pep  MPLTMLCSSTCGFFMMKSERXSGGNMVPRPSPFLPWQATQLDSYTFCPFVMMLLSAAEAA
              ||||||||| |||:|:::|:|  |||  |||||||||||| |||||||||||||||||||
    g013      MPLTMLCSRTCGLFIIQSDRKSGGNAVPRPSPFLPWQAMQLDSYTFCPFVMMLLSAAEAA
                  10         20         30         40         50         60
                  70         80         90        100
    m013.pep  AQKQPKTRAVGSRVVFIGVSF-MFETLLLILR-SGXKIFLPNQX
              ||:| |:||||||||||||||  :::  |||   ||:| |:| |:
    g013      AQRQHKMKAVGSRVVFIGVSPNVLKPCFLILPLRGEKFFWPKSGIX
                  70         80         90        100
```

The following partial DNA sequence was identified in *N. gonorrhoeae* <SEQ ID 93>:

```
g015.seq
  1 ATGCAGTATC TGATTGTCAA ATACAGCCAT CAAATCTTCG TTACCATCAC

51 CATTTTGGTA TTCAACATCC GTTTTTTCCT ACTTTGGAAA AATCCAGAAA

101 AGCCCTTGGT CGGCTTTTGG AAAGCACTGC CCCACCTCAA CGACACGATG
```

```
151 CTGCTGTTTA CGGGATTGTG GCTGATGAAG ATTACCCATT TCTCCCCGTT

201 CAACGCGCCT TGGCTCGGCA CAAAAATCCT GCTCCTGTTC GCCTACATCG

251 CACTGGGCAT GGTAATGATG CGCGCCCGTC CGCGTTCGAC CAAGTTCTAC

301 ACCGTTTACC TGCTCGCTAT GTGTTGCATC GCCTGCATCG TTTACCTTGC

351 CAAAACCAAA GTCCTGCCAT TCTGA
```

This corresponds to the amino acid sequence <SEQ ID 94; ORF 015.ng>:

```
g015.pep
  1 MQYLIVKYSH QIFVTITILV FNIRFFLLWK NPEKPLVGFW KALPHLNDTM

51 LLFTGLWLMK ITHFSPFNAP WLGTKILLLF AYIALGMVMM RARPRSTKFY

101 TVYLLAMCCI ACIVYLAKTK VLPF*
```

The following partial DNA sequence was identified in *N. meningitidis* <SEQ ID 95>:

```
m015.seq (partial)
  1 . . . AAAATCAGAA AAGCCTTGGC GGGCTTTTGG AAGGCACTGC CCCACCTTAA

51         CGACACCAT GCTGCTGTTTA CGGGATTGTG GCTGATGAAA ATTACCCATT

101         TCTCCCCGT TCAACGCGCCT TGGCTCGGTA CAAAAATCCT GCTTCTGCTC

151         GCCTATATC GCATTGGGTAT GATGATGATG CGCGCCCGTC CGCGTTCGAC

201         CAAGTTCTA CACCGTTTACC TGCTCGCCAT GTGTTGCGTC GCCTGCATCG

251         TTTACCTTG CCAAAACCAAA GTCCTGCCTT TCTGA
```

This corresponds to the amino acid sequence <SEQ ID 96; ORF 015:

```
m015.pep (partial)
  1 . . . KIRKALAGFW KALPHLNDTM LLFTGLWLMK ITHFSPFNAP WLGTKILLLL

51         AYIALGMMMM RARPRSTKFY TVYLLAMCCV ACIVYLAKTK VLPF*
```

The following partial DNA sequence was identified in *N. meningitidis* <SEQ ID 97>:

```
a015.seq
  1 ATGCAGTATC TGATTGTCAA ATACAGCCAT CAAATCTTCG TTACCATCAC

51 CATTTTGGTA TTCAACATCC GTGTTTTCNT ACTTTGGAAA AATCCAGAAA

101 AGCCCTTGGC GGGCTTTTGG AAGGCACTGC CCCACCTTAA CGACACCATG

151 CTGCTGTTTA CGGGATTGTG GCTGATGAAA ATTACCCATT TCTCCCCGTT

201 CAACGCGCCT TGGCTCGGTA CAAAAATCCT GCTTCTGCTC GCCTATATCG

251 CATTGGGTAT GATGATGATG CGCGCCCGTC CGCGTTCGAC CAAGTTCTAC

301 ACCGTTTACC TGCTCGCCAT GTGTTGCCTC ACCTGCATCG TTTACCTTGC

351 CAAAACCAAA GTCCTGCCTT TCTGA
```

This corresponds to the amino acid sequence <SEQ ID 98; ORF 015.a>:

```
a015.pep
   1 MQYLIVKYSH QIFVTITILV FNIRVFXLWK NPEKPLAGFW KALPHLNDTM

51 LLFTGLWLMK ITHFSPFNAP WLGTKILLLL AYIALGMMMM RARPRSTKFY

101 TVYLLAMCCL TCIVYLAKTK VLPF*
``` m015/a015 96.7% identity over a 91 aa overlap

```
                                        10          20         30
    m015.pep                     KIRKALAGFWKALPHLNDTMLLFTGLWLMKITH
                                 ||||||||||||||||||||||||||||||||
        a015     LIVKYSHQIFVTITILVFNIRVFXLWKNPEKPLAGFWKALPHLNDTMLLFTGLWLMKITH
                         10         20         30         40         50         60
                         40         50         60         70         80         90
    m015.pep  FSPFNAPWLGTKILLLLAYIALGMMMMRARPRSTKFYTVYLLAMCCVACIVYLAKTKVLP
              |||||||||||||||||||||||||||||||||||||||||||||||::|||||||||||
        a015  FSPFNAPWLGTKILLLLAYIALGMMMMRARPRSTKFYTVYLLAMCCLTCIVYLAKTKVLP
                         70         80         90        100        110        120 m015.pep  FX
              ||
        a015  FX
```

Computer analysis of this amino acid sequence gave the following results:
Homology with a Predicted ORF from *N. gonorrhoeae*
ORF 015 shows 94.5% identity over a 91 aa overlap with a predicted ORF (ORF 015.ng) from *N. gonorrhoeae*:

```
    m015/g015
                                        10          20         30
    m015.pep                     KIRKALAGFWKALPHLNDTMLLFTGLWLMKITH
                                 ||:|||||||||||||||||||||||||||||
        g015     LIVKYSHQIFVTITILVFNIRFFLLWKNPEKPLVGFWKALPHLNDTMLLFTGLWLMKITH
                         10         20         30         40         50         60
                         40         50         60         70         80         90
    m015.pep  FSPFNAPWLGTKILLLLAYIALGMMMMRARPRSTKFYTVYLLAMCCVACIVYLAKTKVLP
              |||||||||||||||||:|||||||:|||||||||||||||||||||:||||||||||||
        g015  FSPFNAPWLGTKILLLFAYIALGMVMMRARPRSTKFYTVYLLAMCCIACIVYLAKTKVLP
                         70         80         90        100        110        120 m015.pep  FX
              ||
        g015  FX
```

The following partial DNA sequence was identified in *N. gonorrhoeae* <SEQ ID 99>:

```
g018.seq
   1 atGCAGCAGG GGCagttggt tggacgcgtc gcccgcaata AAGATATGCG

51 GAATgctggt CTGCATggtC AGCGGATCGG CAACGGGtac gccgcgcgcg 101 tctttgTCGA TATTGATGTT TTCCAAACCG ATATtgTCAA CGTTCGGACG 151 GCgACCTACG GCTGCCAACA TATATTCGGC AACAAATACG CCTTTTTCGC 201 CATCCTGCTC CCAATGGACT tctACATTGC CGTCTGCGTC GAGTTTGACC 251 TCGGTTTTAG CATCCAGATG CAGTTTCAAT tctTCTCCGA ACACGGCTTT

301 CGCCTCGTCT GA
```

This corresponds to the amino acid sequence <SEQ ID 100; ORF 018.ng>:

```
g018.pep
  1 MQQGQLVGRV ARNKDMRNAG LHGQRIGNGY AARVFVDIDV FQTDIVNVRT

51 ATYGCQHIFG NKYAFFAILL PMDFYIAVCV EFDLGFSIQM QFQFFSEHGF

101 RLV*
```

The following partial DNA sequence was identified in *N. meningitidis* <SEQ ID 101>:

```
m018.seq
  1 ATGCAGCAGA GGCAGTTGGT TGGACGCATC GCCTGCGATG AAGATATGCG

51 GAATACTGGT CTGCATGGTC AGCGGGTCGG CAACAGGTAC GCCGCGCGCA

101 TCTTTTTCGA TATTGATATT TTCCAAACCG ATATTGTCAA CGTTCGGACG

151 GCGGCCCACG GCTGCCAGCA TATATTCGGC AACAAATACG CCTTTTTCGC

201 CATCCTGCTC CCAATGGACT TCTACATTGC CGTCTGCATC GAGTTTGACC

251 TCGGTTTTAG CATCCAGATG CAGTTTCAAT TCTTCGCCGA ACACGGCGTT

301 CGCCTCGTCT GA
```

This corresponds to the amino acid sequence <SEQ ID 102; ORF 018>:

```
m018.pepr
  1 MQQRQLVGRI ACDEDMRNTG LHGQRVGNRY AARIFFDIDI FQTDIVNVRT

51 AAHGCQHIFG NKYAFFAILL PMDFYIAVCI EFDLGFSIQM QFQFFAEHGV

101 RLV*
```

The following partial DNA sequence was identified in *N. meningitidis* <SEQ ID 103>:

```
a018.seq
  1 ATGCAGCAGG GGCAGTTGGT TGGACGCGTC GCCCGCAATA AAGATATGCG

51 GAATACTGGT CTGCATAGTC AGCGGATCGG CAACGGGTAC GCCGCGCGCA

101 TCTTTTTCGA TATTGATGTT TTCCAAACCG ATATTGTCAA CGTTCGGACG

151 GCGGCCTACG GCTGCCAGCA TATATTCGGC AACAAATACG CCTTTTTCGC

201 CATCCTGCTC CCAATGGACT TCTACATTGC CGTCTGCGTC GAGTTTGGCC

251 TCGGTTTTAG CATCCAAATG CAGTTTCAAT TCTTCACCGA ACACGGCTTT

301 CGCCTCGTCT GA
```

This corresponds to the amino acid sequence <SEQ ID 104; ORF 018.a>.

```
a018.pep
  1 MQQGQLVGRV ARNKDMRNTG LHSQRIGNGY AARIFFDIDV FQTDIVNVRT

51 AAYGCQHIFG NKYAFFAILL PMDFYIAVCV EFGLGFSIQM QFQFFTEHGF

101 RLV*
``` m018/a018 86.4% identity over a 103 aa overlap

```
                 10        20        30        40        50        60
m018.pep  MQQRQLVGRIACDEDMRNTGLHGQRVGNRYAARIFFDIDIFQTDIVNVRTAAHGCQHIFG
          |||  |||||:|  ::||||:|||||||:||  ||||:|  |||:|||||||||::||||||
a018      MQQGQLVGRVARNKDMRNTGLHSQRIGNGYAARIFFDIDVFQTDIVNVRTAAYGCQHIFG
                 10        20        30        40        50        60

70        80        90       100
m018.pep  NKYAFFAILLPMDFYIAVCIEFDLGFSIQMQFQFFAEHGVRLVX
          |||||||||||||||||||:||  |||||||||||||||:|||  ||||
a018      NKYAFFAILLPMDFYIAVCVEFGLGFSIQMQFQFFTEHGFRLVX
                 70        80        90       100
```

Computer analysis of this amino acid sequence gave the following results:

Homology with a Predicted ORF from *N. gonorrhoeae*

ORF 018 shows 84.5% identity over a 103 aa overlap with a predicted ORF (ORF 018.ng) from *N. gonorrhoeae*:

```
m018/g018
                 10        20        30        40        50        60
m018.pep  MQQRQLVGRIACDEDMRNTGLHGQRVGNRYAARIFFDIDIFQTDIVNVRTAAHGCQHIFG
          |||  |||||:| ::||||:|||||||:|| ||||:| |||:||||||||||::||||||
g018      MQQGQLVGRVARNKDMRNAGLHGQRIGNGYAARVFVDIDVFQTDIVNVRTATYGCQHIFG
                 10        20        30        40        50        60

70        80        90       100
m018.pep  NKYAFFAILLPMDFYIAVCIEFDLGFSIQMQFQFFAEHGVRLVX
          |||||||||||||||||||:|||||||||||||||||:||| ||||
g018      NKYAFFAILLPMDFYIAVCVEFDLGFSIQMQFQFFSEHGFRLVX
                 70        80        90       100
```

The following partial DNA sequence was identified in *N. gonorrhoeae* <SEQ ID 105>:

```
g019.seq (partial)
  1 . . . ctgctggcgg ccctggtgct tgccgcgtgt tcttcgACAA ACAcacTGCC 51       AGCCGGCAAG ACCCCGGCAG ACAATATAGA AActgcCgAC CTTTCGGCAA 101       GCGTTCCCAC ccgcCCTGCC GAACCGGAAG GAAAAACGCT GGCAGATTAC

151       GGCGGCTACC CGTCCGCACT GGATGCAGTG AAACAGAACA ACGATGCGGC

201       AGCCGCCGCC TATTTGGAAA AcgcaggaGA cagCGcgatg gcGGAAAatg 251       tccgcaagga gtgGCTGa
```

This corresponds to the amino acid sequence <SEQ ID 106; ORF 019.ng>:

```
g019.pep (partial)
  1 . . . LLAALVLAAC SSTNTLPAGK TPADNIETAD LSASVPTRPA EPEGKTLADY

51       GGYPSALDAV KQNNDAAAAA YLENAGDSAM AENVRKEWL*
```

The following partial DNA sequence was identified in *N. meningitidis* <SEQ ID 107>:

```
m019.seq.(partial)
  1 ATGTACCTAC CCTCTATGAA GCATTCCCTG CCGCTGCTGG CGGCCCTGGT

51 GCTTGCCGCG TGTTCTTCGA CAAACACACT GCCAGCCGGC AAGACCCCGG

101 CAGACAATAT AGAAACTGCC GACCTTTCGG CAAGCGTTCC CACCCGCCCT
```

```
-continued
 151 GCCGAACCCG AAAGAAAAAC GCTGGCAGAT TACGGCGGCT ACCCGTCCGC

201 ACTGGATGCA GTGAAACAGA AAAACGATGC CGCCGTCGCC GCCTATTTGG

251 AAAACGCCGG CGACAGCGCG ATGGCGGAAA ATGTCCGCAA CGAGTGGCTG

301 AAGTCTTTGG GCGCACGCAG ACAGTGGACG CTGTTTGCAC AGGAATACGC

351 CAAACTCGAA CCGGCAGGGC GCGCCCAAGA AGTCGAATGC TACGCCGATT

401 CGAGCCGCAA CGACTATACG CGTGCCGCTG AACTGGTCAA AAATACGGGC

451 AAACTGCCTT CGGGCTGCAC CAAACTGTTG GAACAGGCAG CCGCATCCGG

501 CTTGTTGGAC GGCAACGACG CCTGGAGGCG CGTGCGCGGA CTGCTGGCCG

551 GCCGCCAAAC CACAGACGCA CGCAACCTTG CCGCCGCATT GGGCAGCCCG

601 TTTGACGGCG GTACACAAGG TTCGCGCGAA TATGCCCTGT TGAACGTCAT

651 CGGCAAAGAA GCACGCAAAT CGCCGAATGC CGCCGCCCTG CTGTCCGAAA

701 TGGAAAGCGG TTTAAGCCTC GAACAACGCA GTTTCGCGTG GGGCGTATTG

751 GGGCATTATC AGTCGCAAAA CCTCAATGTG CCTGCCGCCT TGGACTATTA

801 CGGCAAGGTT GCCGACCGCC GCCAACTGAC CGACGACCAA ATCGAGTGGT

851 ACGCCCGCGC CGCCTTGCGC GCCCGACGTT GGGACGAGCT GGCCTCCGTT

901 ATCTCGCATA TGCCCGAAAA ACTGCAAAAA AGCCCGACCT GGCTCTACTG

951 GCTGGCACGC AGCCGCGCCG CAACGGGCAA CACGCAAGAG GCGGAAAAAC

1001 TTTACAAACA GGCGGCAGCG ACGGGCAGGA ATTTTTATGC GGTGCTGGCA

1051 GGGGAAGAAT TGGGTCGGAA AATCGATACG CGCAACAATG TGCCCGATGC

1101 CGGCAAAAAC AGCGTCCGCC GCATGGCGGA AGACGGTGCA GTCAAACGCG

1151 CACTGGTACT GTTCCAAAAC AGCCAATCTG CCGGTGATGC AAAAATGCGC

1201 CGTCAGGCTC AGGCGGAATG GCGTTTTGCC ACACGCGGCT TTGACGAAGA

1251 CAAGCTGCTG ACCGCCGCGC AAACCGCGTT CGACCACGGT TTTTACGATA

1301 TGGCGGTCAA CAGCGCGGAA CGCACCGACC GCAAACTCAA CTACACCTTG

1351 CGCTATATTT CGCCGTTTAA AGACACGGTA ATCCGCCACG CGCAAAATGT

1401 TAATGTCGAT CCGGCTTGGG TTTATGGGCT GATTCGTCAG GAAAGCCGCT

1451 TCGTTATAGG CGCGCAATCC CGCGTAGGCG CGCAGGGGCT GATGCAGGTT

1501 ATGCCTGCCA CCGCGCGCGA AATCGCCGGC AAAATCGGTA TGGATGCCGC

1551 ACAACTTTAC ACCGCCGACG GG . . .
```

This corresponds to the amino acid sequence <SEQ ID 108; ORF 019>:

```
m019.pep (partial)
  1 MYLPSMKHSL PLLAALVLAA CSSTNTLPAG KTPADNIETA DLSASVPTRP

51 AEPERKTLAD YGGYPSALDA VKQKNDAAVA AYLENAGDSA MAENVRNEWL

101 KSLGARRQWT LFAQEYAKLE PAGRAQEVEC YADSSRNDYT RAAELVKNTG

151 KLPSGCTKLL EQAAASGLLD GNDAWRRVRG LLAGRQTTDA RNLAAALGSP

201 FDGGTQGSRE YALLNVIGKE ARKSPNAAAL LSEMESGLSL EQRSFAWGVL

251 GHYQSQNLNV PAALDYYGKV ADRRQLTDDQ IEWYARAALR ARRWDELASV

301 ISHMPEKLQK SPTWLYWLAR SRAATGNTQE AEKLYKQAAA TGRNFYAVLA

351 GEELGRKIDT RNNVPDAGKN SVRRMAEDGA VKRALVLFQN SQSAGDAKMR
```

```
401 RQAQAEWRFA TRGFDEDKLL TAAQTAFDHG FYDMAVNSAE RTDRKLNYTL

451 RYISPFKDTV IRHAQNVNVD PAWVYGLIRQ ESRFVIGAQS RVGAQGLMQV

501 MPATAREIAG KIGMDAAQLY TADG . . .
```

The following partial DNA sequence was identified in *N. meningitidis* <SEQ ID 109>:

```
a019.seq
   1 ATGTACCCAC CCTCTCTGAA GCATTCCCTG CCGCTGCTGG TGGNCCTGGT

51 GCTTGCCGCG TGTTCTTNGA CAAACACACT GTCAGCCGAC AAGACCCCGG

101 CAGACAATAT AGAAACTGCC GACCTTTCGG CAAGCGTTCC CACCNGCCCT

151 GCCGAACCCG AANGAAAAAC GTNGGCAGAT TACGGCGGCT ACCCGTCCGC

201 ACTGGATGCA GTGAAACAGA AAAACGATGC CGCCGTCGCC GCCTATTTGG

251 AAAACGCCGG CGACAGCGCG ATGGCGGAAA ATGTCCGCAA CGAGTGGCTG

301 AAGTCTTTGG GCGCGCGCAG ACAGTGGACG CTGTNTGCAC ANGAATATGC

351 NAAACTCGAA CCGGCANGGC GCGCCCAAGA AGTCGAATGC TACGCCGATT

401 CGAGCCGCAA CGACTATACG CGTGCCGCCG AACTGGTCAA AAATACGGGC

451 AAACTGCCTT CGGGCTGCAC CAAACTGTTG AACAGGCAG CCGCATCCGG

501 CTTGTTGGAC GGCAACGACG CCTGGAGGCG CGTGCGCGGA CTGCTGGCCG

551 GCCGCCAAAC CACAGACGCA CGCAACCTTG CCGCCGCATT GGGCAGCCCG

601 TTTGACGGCG GTACACAAGG TTCGCGCGAA TATGCCCTGT TGAACGTCAT

651 CGGCAAAGAA GCACGCAAAT CGCCGAATGC CGCCGCCCTG CTGTCCGAAA

701 TGGAAAGCGG TTTAAGCCTC GAACAACGCA GTTTCGCGTG GGGCGTATTG

751 GGGCATTATC AGTCGCAAAA CCTCAATGTG CCTGCCGCCT TGGACTATTA

801 NGGCAAGGTT GCCGACCGCC GCCAACTGAC CGACGACCAA ATCGAGTGGT

851 ACGCCCGCGC CGCNNTNNGC NNNCGNNGTT NGNANGANNT GGCNNCCGNN

901 ANCNCGNNNN TGCNNGANAA ACNNNNNNAN AGNCNNANNT NGNTNNANTG

951 NNTGGCACGC AGCCGCGCCG CNACGGGCAA CACGCAANAN GCGGANAAAC

1001 TNTACAAACA GGCGGCAGCA NCGGGCANGA ATTTTTATGC NGTGCTGNCN

1051 GGGGAAGAGT TGGGGCGCAN AATCGATACG CGCAACAATG TGCCCGATGC

1101 CGGCAAAANC AGCGTCCTCC GTATGGCGGA AGACGGCGCG ATTAAGCGCG

1151 CGCTGGTGCT GTTCCGAAAC AGCCGAACCG CCGGCGATGC GAAAATGCGC

1201 CGTCNGGCTC AGGCGGAATG GCGTTTCGCC ACACGCGGCT TCGATGAAGA

1251 CAAGCTGCTG ACCGCCGCGC AAACCGCGTT CGACCACGGT TTTTACGATA

1301 TGGCGGTCAA CAGCGCGGAA CGCACCGACC GCAAACTCAA CTACACCTTG

1351 CGCTACATTT CGNNNNNTNA NGACACGGTA ATCCGCCACG CGCAAAATGT

1401 TAATGTCGAT CCGGCGTGGG TTTACGGGCT GATTCGTCAG GAAAGCCGCT

1451 TCGTTATGGG CGCGCAATCC CGCGTAGGCG CGCAGGGGCT GATGCAGGTT

1501 ATGCCTGCCA CCGCGCGCGA AATCGCCGGC AAAATCGGTA TGGATGCCGC

1551 ACAACTTTAC ACCGCCGACG GCAATATCCG TATGGGGACG TGGTATATGG

1601 CGGACACCAA ACGCCGCCTG CAAAACAACG AAGTCCTCGC CACCGCAGGC

1651 TATAACGCCG GTCCCGGCAG GGCGCGCCGA TGGCAGGCGG ACACGCGGCT
```

-continued

```
1701 CGAAGGCGCG GTATATGCCG AAACCATCCC GTTTTCCGAA ACGCGCGACT

1751 ATGTCAAAAA AGTGATGGCC AATGCCGCCT ACTACGCCTC CCTCTTCGGC

1801 GCGCCGCACA TCCCGCTCAA ACAGCGTATG GGCATTGTCC CCGCCCGCTG

1851 A
```

This corresponds to the amino acid sequence <SEQ ID 110; ORF 019.a>:

```
a019.pep
  1 MYPPSLKHSL PLLVXLVLAA CSXTNTLSAD KTPADNIETA DLSASVPTXP

51 AEPEXKTXAD YGGYPSALDA VKQKNDAAVA AYLENAGDSA MAENVRNEWL

101 KSLGARRQWT LXAXEYAKLE PAXRAQEVEC YADSSRNDYT RAAELVKNTG

151 KLPSGCTKLL EQAAASGLLD GNDAWRRVRG LLAGRQTTDA RNLAAALGSP

201 FDGGTQGSRE YALLNVIGKE ARKSPNAAAL LSEMESGLSL EQRSFAWGVL

251 GHYQSQNLNV PAALDYXGKV ADRRQLTDDQ IEWYARAAXX XRXXXXXAXX

301 XXXXXXKXXX XXXXXXXXAR SRAATGNTQX AXKLYKQAAA XGXNFYAVLX

351 GEELGRXIDT RNNVPDAGKX SVLRMAEDGA IKRALVLFRN SRTAGDAKMR

401 RXAQAEWRFA TRGFDEDKLL TAAQTAFDHG FYDMAVNSAE RTDRKLNYTL

451 RYISXXXDTV IRHAQNVNVD PAWVYGLIRQ ESRFVMGAQS RVGAQGLMQV

501 MPATAREIAG KIGMDAAQLY TADGNIRMGT WYMADTKRRL QNNEVLATAG

551 YNAGPGRARR WQADTPLEGA VYAETIPFSE TRDYVKKVMA NAAYYASLFG

601 APHIPLKQRM GIVPAR*
``` m019/a019 88.9% identity over a 524 aa overlap

```
                   10         20         30         40         50         60
        m019.pep   MYLPSMKHSLPLLAALVLAACSSTNTLPAGKTPADNIETADLSASVPTRPAEPERKTLAD
                   || ||:||||||:||||||||| ||||||||||||||||||||||||| ||||| || ||
        a019       MYPPSLKHSLPLLVXLVLAACSXTNTLSADKTPADNIETADLSASVPTXPAEPEXKTXAD
                            10         20         30         40         50         60

70         80         90        100        110        120
        m019.pep   YGGYPSALDAVKQKNDAAVAAYLENAGDSAMAENVRNEWLKSLGARRQWTLFAQEYAKLE
                   ||||||||||||||||||||||||||||||||||||||||||||||||||| | ||||||
        a019       YGGYPSALDAVKQKNDAAVAAYLENAGDSAMAENVRNEWLKSLGARRQWTLXAXEYAKLE
                            70         80         90        100        110        120

130        140        150        160        170        180
        m019.pep   PAGRAQEVECYADSSRNDYTRAAELVKNTGKLPSGCTKLLEQAAASGLLDGNDAWRRVRG
                   || |||||||||||||||||||||||||||||||||||||||||||||||||||||||||
        a019       PAXRAQEVECYADSSRNDYTRAAELVKNTGKLPSGCTKLLEQAAASGLLDGNDAWRRVRG
                           130        140        150        160        170        180

190        200        210        220        230        240
        m019.pep   LLAGRQTTDARNLAAALGSPFDGGTQGSREYALLNVIGKEARKSPNAAALLSEMESGLSL
                   ||||||||||||||||||||||||||||||||||||||||||||||||||||||||||||
        a019       LLAGRQTTDARNLAAALGSPFDGGTQGSREYALLNVIGKEARKSPNAAALLSEMESGLSL
                           190        200        210        220        230        240

250        260        270        280        290        300
        m019.pep   EQRSFAWGVLGHYQSQNLNVPAALDYYGKVADRRQLTDDQIEWYARAALRARRWDELASV
                   ||||||||||||||||||||||||||| ||||||||||||||||||||   |   |
        a019       EQRSFAWGVLGHYQSQNLNVPAALDYXGKVADRRQLTDDQIEWYARAAXXXRXXXXXAXX
                           250        260        270        280        290        300

310        320        330        340        350        360
        m019.pep   ISHMPEKLQKSPTWLYWLARSRAATGNTQEAEKLYKQAAATGRNFYAVLAGEELGRKIDT
                      |     :          ||||||||||| | |||||||||:| ||||||  ||||| |||
        a019       XXXXXXKXXXXXXXXXXXXARSRAATGNTQXAXKLYKQAAAXGXNFYAVLXGEELGRXIDT
                           310        320        330        340        350        360
```

```
                    370        380        390        400        410        420
m019.pep  RNNVPDAGKNSVRRMAEDGAVKRALVLFQNSQSAGDAKMRRQAQAEWRFATRGFDEDKLL
          |||||||||  || ||||||||:||||||:||::||||||| ||||||||||||||||||
a019      RNNVPDAGKXSVLRMAEDGAIKRALVLFRNSRTAGDAKMRRXAQAEWRFATRGFDEDKLL
                    370        380        390        400        410        420

430        440        450        460        470        480
m019.pep  TAAQTAFDHGFYDMAVNSAERTDRKLNYTLRYISPFKDTVIRHAQNVNVDPAWVYGLIRQ
          |||||||||||||||||||||||||||||||||||   |||||||||||||||||||||
a019      TAAQTAFDHGFYDMAVNSAERTDRKLNYTLRYISXXXDTVIRHAQNVNVDPAWVYGLIRQ
                    430        440        450        460        470        480

490        500        510        520
m019.pep  ESRFVIGAQSRVGAQGLMQVMPATAREIAGKIGMDAAQLYTADG
          |||||:|||||||||||||||||||||||||||||||||||||
a019      ESRFVMGAQSRVGAQGLMQVMPATAREIAGKIGMDAAQLYTADGNIRMGTWYMADTKRRL
                    490        500        510        520        530        540 a019      QNNEVLATAGYNAGPGRARRWQADTPLEGAVYAETIPFSETRDYVKKVMANAAYYASLFG
                    550        560        570        580        590        600
```

Computer analysis of this amino acid sequence gave the following results:
Homology with a Predicted ORF from *N. gonorrhoeae*
ORF 019 shows 95.5% identity over a 89 aa overlap with a predicted ORF (ORF 019.ng) from *N. gonorrhoeae*:

```
g019/m019
                              10         20         30         40         49
g019.pep            LLAALVLAACSSTNTLPAGKTPADNIETADLSASVPTRPAEPEGKTLAD
                    |||||||||||||||||||||||||||||||||||||||||||| ||||
m019      MYLPSMKHSLPLLAALVLAACSSTNTLPAGKTPADNIETADLSASVPTRPAEPERKTLAD
                    10         20         30         40         50         60

50         60         70         80         89
g019.pep  YGGYPSALDAVKQNNDAAAAAYLENAGDSAMAENVRKEWL
          ||||||||||||||:||||:||||||||||||||||:|||
m019      YGGYPSALDAVKQKNDAAVAAYLENAGDSAMAENVRNEWLKSLGARRQWTLFAQEYAKLE
                    70         80         90        100        110        120
```

The following partial DNA sequence was identified in *N. gonorrhoeae* <SEQ ID 111>:

```
g023.seq
  1 ATGGTAGAAC GTAAATTGAC CGGTGCCCAT TACGGTTTGC GCGATTGGGT

51 AATGCAGCGT GCGACTGCGG TTATTATGTT GATTTATACC GTTGCACTTT

101 TAGTGGTTCT ATTTGCCCTG CCTAAAGAAT ATCCGGCATG GCAGGCATTT

151 TTTAGTCAAG CTTGGGTAAA AGTATTTACC CAAGTGAGCT TTATCGCCGT

201 ATTCTTGCAC GCTTGGGTGG GTATCCGCGA TTTGTGGATG GACTATATCA

251 AACCCTTCGG CGTGCGTTTG TTTTTGCAGG TTGCCACCAT TGtctGGCTG

301 GTCGGCTGCC TCGTGTATTC AGTTAAAGTG ATTTGGGGGT AA
```

This corresponds to the amino acid sequence <SEQ ID 112; ORF 023.ng>:

```
g023.pep
  1 MVERKLTGAH YGLRDWVMQR ATAVIMLIYT VALLVVLFAL PKEYPAWQAF

51 FSQAWVKVFT QVSFIAVFLH AWVGIRDLWM DYIKPFGVRL FLQVATIVWL

101 VGCLVYSVKV IWG*
```

The following partial DNA sequence was identified in *N. meningitidis* <SEQ ID 113>:

```
m023.seq
  1 ATGGTAGAAC GTAAATTGAC CGGTGCCCAT TACGGTTTGC GCGATTGGGT
 51 GATGCAACGT GCGACTGCGG TTATTATGTT GATTTATACC GTTGCACTTT
101 TAGTGGTTCT ATTTTCCCTG CCTAAAGAAT ATTCGGCATG GCAGGCATTT
151 TTTAGTCAAA CTTGGGTAAA AGTATTTACC CAAGTGAGCT TCATCGCCGT
201 ATTCTTGCAC GCTTGGGTGG GTATCCGCGA TTTGTGGATG GACTATATCA
251 AACCCTTCGG CGTGCGTTTG TTTTTGCAGG TTGCCACCAT CGTTTGGCTG
301 GTCGGCTGTC TCGTGTATTC AGTTAAAGTG ATTTGGGGGT AA
```

This corresponds to the amino acid sequence <SEQ ID 114; ORF 023>:

```
m023.pep
  1 MVERKLTGAH YGLRDWVMQR ATAVIMLIYT VALLVVLFSL PKEYSAWQAF
 51 FSQTWVKVFT QVSFIAVFLH AWVGIRDLWM DYIKPFGVRL FLQVATIVWL
101 VGCLVYSVKV IWG*
```

The following partial DNA sequence was identified in *N. meningitidis* <SEQ ID 115>:

```
a023.seq
  1 ATGGTAGAAC GTAAATTGAC CGGTGCCCAT TACGGTTTGC GGGATTGGGC
 51 GATGCAACGT GCGACCGCGG TTATTATGTT GATTTATACC GTTGCACTTT
101 TAGTGGTTCT ATTTGCTCTG CCTAAAGAAT ATTCGGCATG GCAGGCATTT
151 TTTAGTCAAA CTTGGGTAAA AGTATTTACC CAAGTGAGCT TCATCGCCGT
201 ATTCTTGCAC GCTTGGGTGG GTATCCGCGA TTTGTGGATG GACTATATNA
251 AACCCTTCGG CGTGCGTTTG TTTTTGCAGG TTGCCACCAT CGTCTGGCTG
301 GTCGGCTGCT TGGTGTATTC AATTAAAGTA ATTTGGGGGT AA
```

This corresponds to the amino acid sequence <SEQ ID 116; ORF 023.a>:

```
a023.pep
  1 MVERKLTGAH YGLRDWAMQR ATAVIMLIYT VALLVVLFAL PKEYSAWQAF
 51 FSQTWVKVFT QVSFIAVFLH AWVGIRDLWM DYXKPFGVRL FLQVATIVWL
101 VGCLVYSIKV IWG*
``` m023/a023 96.5% identity over a 113 aa overlap

```
                   10        20        30        40        50        60
m023.pep   MVERKLTGAHYGLRDWVMQRATAVIMLIYTVALLVVLFSLPKEYSAWQAFFSQTWVKVFT
           ||||||||||||||||:|||||||||||||||||||||:|||||||||||||||||||||
a023       MVERKLTGAHYGLRDWAMQRATAVIMLIYTVALLVVLFALPKEYSAWQAFFSQTWVKVFT
                   10        20        30        40        50        60

70        80        90       100       110
m023.pep   QVSFIAVFLHAWVGIRDLWMDYIKPFGVRLFLQVATIVWLVGCLVYSVKVIWGX
           |||||||||||||||||||||| |||||||||||||||||||||||||:||||||
a023       QVSFIAVFLHAWVGIRDLWMDYXKPFGVRLFLQVATIVWLVGCLVYSIKVIWGX
                   70        80        90       100       110
```

Computer analysis of this amino acid sequence gave the following results:

Homology with a Predicted ORF from *N. gonorrhoeae*

ORF 023 shows 97.3% identity over a 113 aa overlap with a predicted ORF (ORF 023.ng) from *N. gonorrhoeae*:

```
g023/m023
                    10         20         30         40         50         60
    g023.pep    MVERKLTGAHYGLRDWVMQRATAVIMLIYTVALLVVLFALPKEYPAWQAFFSQAWVKVFT
                ||||||||||||||||||||||||||||||||||||||:|||| ||||||||:||||||
    m023        MVERKLTGAHYGLRDWVMQRATAVIMLIYTVALLVVLFSLPKEYSAWQAFFSQTWVKVFT
                    10         20         30         40         50         60
                    70         80         90        100        110
    g023.pep    QVSFIAVFLHAWVGIRDLWMDYIKPFGVRLFLQVATIVWLVGCLVYSVKVIWGX
                |||||||||||||||||||||||||||||||||||||||||||||||||||||
    m023        QVSFIAVFLHAWVGIRDLWMDYIKPFGVRLFLQVATIVWLVGCLVYSVKVIWGX
                    70         80         90        100        110
```

The following partial DNA sequence was identified in *N. gonorrhoeae* <SEQ ID 117>:

```
g025.seq
   1 ATGTTGAAAC AAAcgACACT TTTGGCAGCT TGTACCGCCG TTGCCGCTCT
  51 GTTGGGCGGT TGcgCCACCC AACAGCCTGC TccTGTCATT GCAGGCAATT
 101 CAGGTATGCA GACCGTATCG TCTGCGCCGG TTTACAATCC TTATGGCGCA
 151 ACGCCGTACA ATGCCGCTCC TGCCGCCAac gatgcGCCgT ATGTGCCGCC
 201 CGTGCAAact gcgccggttT ATTCGCCTCC TGCTTATGTT CCGCcgtCTG
 251 CACCTGCCGT TTCGGgtaca tatgtTCCTT CTTACGCACC CgtcgACATC
 301 aacgCGGCGa cgCataCTAT TGTGCGTGGC GACACgGtgt acaACATTTc
 351 caaAcgCtac CATATCTCTC AAGACGATTT CCGTGCGTGG AACGGCATGA
 401 CCGACAATAC GTTGAGCATC GGTCAGATTG TTAAAGTCAA ACCGGCaggA
 451 TATGCCGCAC CGAAAACCGC AGCCGTAGAA AGCAGGCCCG CCGTACCGGC
 501 TGCCGCGCAA ACCCCTGTGA AACCCGCCGC gcaACCGCCC GTTCAGTCCG
 551 CGCCGCAACC TGCCGCGCCC GCTGCGGAAA ATAAAGCGGT TCCCGCCCCC
 601 GCGCCCGCCC CGCAATCTCC TGCCGCTTCG CCTTCCGGCA CGCGTTCGGT
 651 CGGCGGCATT GTTTGGCAGC GTCCGACCCA AGGTAAAGTG GTTGCCGATT
 701 TCGGCGGCGG CAACAAGGGT GTCGATATTG CCGGCAATGC CGGACAACCC
 751 GTTTTGGCGG CGGCTGACGG CAAAGTGGTT TATGCCGGTT CAGGTTTGAG
 801 GGGATACGGA AACTTGGTCA TCATCCAGCA CAATTCCTCT TTCCTGACCG
 851 CGTACGGGCA CAACCAAAAA TTGCTGGTCG GCGAAGGTCA GCAGGTCAAA
 901 CGCGGTCAGC AGGTTGCTTT GATGGGTAAT ACCGATGCTT CCAGAACGCA
 951 GCTTCATTTC GAGGTGCGTC AAAACGGCAA ACCGGTTAAC CCGAACAGCT
1001 ATATCGCGTT CTGA
```

This corresponds to the amino acid sequence <SEQ ID 118; ORF 025.ng>:

```
g025.pep
   1 MLKQTTLLAA CTAVAALLGG CATQQPAPVI AGNSGMQTVS SAPVYNPYGA
  51 TPYNAAPAAN DAPYVPPVQT APVYSPPAYV PPSAPAVSGT YVPSYAPVDI
```

-continued

```
101 NAATHTIVRG DTVYNISKRY HISQDDFRAW NGMTDNTLSI GQIVKVKPAG

151 YAAPKTAAVE SRPAVPAAAQ TPVKPAAQPP VQSAPQPAAP AAENKAVPAP

201 APAPQSPAAS PSGTRSVGGI VWQRPTQGKV VADFGGGNKG VDIAGNAGQP

251 VLAAADGKVV YAGSGLRGYG NLVIIQHNSS FLTAYGHNQK LLVGEGQQVK

301 RGQQVALMGN TDASRTQLHF EVRQNGKPVN PNSYIAF*
```

The following partial DNA sequence was identified in *N. meningitidis* <SEQ ID 119>:

```
m025.seq1 (partial)
   1 ...GTGCCGCCGG TGCAAAGCGC GCCGGTTTAT ACGCCTCCTG CTTATGTTCC

51    GCCGTCTGCA CCTGCCGTTT CGGGTACATA CGTTCCTTCT TACGCACCCG

101    TCGACATCAA CGCGGCGACG CATACTATTG TGCGCGGCGA CACGGTGTAC

151    AACATTTCCA AACGCTACCA TATCTCTCAA GACGATTTCC GTGCGTGGAA

201    CGGCATGACC GACAATACGT TGAGCATCGG TCAGATTGTT AAAGTCAAAC

251    CGGCAGGATA TGCCGCACCG AAAGCCGCAG CCGTAAAAAG CAGGCCCGCC

301    GTACCGGCTG CCGCGCAACC GCCCGTACAG TCCGCACCCG TCGACATTAA

351    CGCGGCGACG CATACTATTG TGCGCGGCGA CACGGTGTAC AACATTTCCA

401    AACGCTACCA TATCTCTCAA GACGATTTCC GTGCGTGGAA CGGCATGACC

451    GACAATATGT TGAGCATCGG TCAGATTGTT AAAGTCAAAC CGGCAGGATA

501    TGCCGCACCG AAAACCGCAG CCGTAGAAAG CAGGCCCGCC GTACCGGCTG

551    CCGTGCAAAC CCCTGTGAAA CCCGCCGCGC AACCGCCTGT GCAGTCCGCG

601    CCGCAACCTG CCGCGCCCGC TGCGGAAAAT AAAGCGGTTC CCGCGCCCGC

651    CCCGCAATCT CCTGCCGCTT CGCCTTCCGG CACGCGTTCG GTCGGCGGCA

701    TTGTTTGGCA GCGTCCGACG CAAGGTAAAG TGGTTGCCGA TTTCGGCGGC

751    AACAACAAGG GTGTCGATAT TGCCGGTAAT GCGGGACAGC CCGTTTTGGC

801    GGCGGCTGAC GGCAAAGTGG TTTATGCCGG TTCAGGTTTG AGGGGATACG

851    GAAACTTGGT CATCATCCAG CATAATTCTT CTTTCCTGAC CGCATACGGG

901    CACAACCAAA AATTGCTGGT CGGCGAGGGG CAGCAGGTCA AACGCGGTCA

951    GCAGGTTGCT TTGATGGGCA ATACCGATGC TTCCAGAACG CAGCTTCATT

1001    TCGAGGTGCG TCAAAACGGC AAACCGGTTA ACCCGAACAG CTATATCGCG

1051    TTCTGA
```

This corresponds to the amino acid sequence <SEQ ID 110; ORF 025>:

```
m025.pep (partial)
  1 ...VPPVQSAPVY TPPAYVPPSA PAVSGTYVPS YAPVDINAAT HTIVRGDTVY

51    NISKRYHISQ DDFRAWNGMT DNTLSIGQIV KVKPAGYAAP KAAAVKSRPA

101    VPAAAQPPVQ SAPVDINAAT HTIVRGDTVY NISKRYHISQ DDFRAWNGMT

151    DNMLSIGQIV KVKPAGYAAP KTAAVESRPA VPAAVQTPVK PAAQPPVQSA

201    PQPAAPAAEN KAVPAPAPQS PAASPSGTRS VGGIVWQRPT QGKVVADFGG

251    NNKGVDIAGN AGQPVLAAAD GKVVYAGSGL RGYGNLVIIQ HNSSFLTAYG
```

```
301    HNQKLLVGEG QQVKRGQQVA LMGNTDASRT QLHFEVRQNG KPVNPNSYIA

351    F*
```

The following partial DNA sequence was identified in *N. meningitidis* <SEQ ID 111>:

```
a025.seq
   1 ATGTTGACAC CAACAACACT TTAGGTAGCT TGTACCGCCC TTGCCGCTCA
  51 GTTGGGCGGA TGCCCCACCC AACACCCTTC TCCTGTCATT GCAGGCAATT
 101 CAGGTATGCA GACCGTACCG TCTGCGCCGG TTTACAATCC TTATGGCGCA
 151 ACGCCGTACA ATGCCGCTCC TGCCGCCAAC GATGCGCCGT ATGTGCCGCC
 201 GGTGCAAAGC GCGCCGGTTT ATANGCCTCC TGCTTATGTT CCGCCGTCTG
 251 CACCTGCCGT TTCGGGTACA TACGTTCCTT CTTACGCANC CGTCGACATC
 301 AACGCGGCGA CGCATACTAT TGTGCGCGGC GACACCGTGT ACAAGATTTC
 351 CAAATGCTAC CATATCTCTC AAGACGATTT CCGTGCGTGG AACGGCATGA
 401 CCGACAATAC GTTGAGCATC GGTCAGATTG TTAAAGTCAA ACCGGCAGGA
 451 TATGCCGCAC CGAAAGCCGC AGCCGTAAAA AGCAGGCCCG CCGTACCGGC
 501 TGCCGCGCAA CCGCTCGTAC AGTCCGCACC CGTCGACATC AACGCGGCGA
 551 CGCATACTAT TGTGCGCGGC GACACGGTGT ACAACATTTC CAAACGCTAC
 601 CATATCTCTC AAGACGATTT CCGTGCGTGG AACGGCATGA CCGACAATAC
 651 GTTGAGCATC GGTCAGATTG TTAAAGTCAA ACCGGCAGGA TATGCCGCAC
 701 CGAAAGCCGC AGCCGTAAAA AGCAGGCCCG CCGTACCGGC TGCCGTGCAA
 751 ACCCCTGTGA AACCCGCCGC GCAACCGCCT GTGCAGTCCG CGCCGCAACC
 801 TGCCGCGCCC GCTGCGGAAA ATAAAGCGGT TCCCGCGCCC GCCCCGCAAT
 851 CTCCTGCCGC TTCGCCTTCC GGCACGCGTT CGGTCGGCGG CATTGTTTGG
 901 CAGCGTCCGA CGCAAGGTAA AGTGGTTGCC GATTTCGGCG GCAACAACAA
 951 GGGTGTCGAT ATTGCAGGAA ATGCGGGACA GCCCGTTTTG GCGGCGGCTG
1001 ACGGCAAAGT GGTTTATGCA GGTTCCGGTT TGAGGGGATA CGGCAATTTG
1051 GTCATCATCC AGCATAATTC TTCCTTCCTG ACCGCATACG GCACAACCA
1101 AAAATTGCTG GTCGGCGAAG GCCAGCAGGT CAAACGCGGG CAGCAGGTCG
1151 CTTTGATGGG CAATACCGAG GCTTCTAGAA CGCAGCTTCA TTTCGAGGTG
1201 CGGCAAAACG GCAAACCGGT TAATCCGAAC AGCTATATCG CGTTCTGA
```

This corresponds to the amino acid sequence <SEQ ID 112; ORF 025.a>:

```
a025.pep
   1 MLTPTTL*VA CTALAAQLGG CPTQHPSPVI AGNSGMQTVP SAPVYNPYGA
  51 TPYNAAPAAN DAPYVPPVQS APVYXPPAYV PPSAPAVSGT YVPSYAXVDI
 101 NAATHTIVRG DTVYKISKCY HISQDDFRAW NGMTDNTLSI GQIVKVKPAG
 151 YAAPKAAAVK SRPAVPAAAQ PLVQSAPVDI NAATHTIVRG DTVYNISKRY
 201 HISQDDFRAW NGMTDNTLSI GQIVKVKPAG YAAPKAAAVK SRPAVPAAVQ
 251 TPVKPAAQPP VQSAPQPAAP AAENKAVPAP APQSPAASPS GTRSVGGIVW
```

```
301 QRPTQGKVVA DFGGNNKGVD IAGNAGQPVL AAADGKVVYA GSGLRGYGNL

351 VIIQHNSSFL TAYGHNQKLL VGEGQQVKRG QQVALMGNTE ASRTQLHFEV

401 RQNGKPVNPN SYIAF*
``` m025/a025 97.4% identity over a 351 aa overlap

```
                                    10         20         30
m025.pep                             VPPVQSAPVYTPPAYVPPSAPAVSGTYVPS
                                     ||||||||||:||||||||||||||||||
a025        GMQTVPSAPVYNPYGATPYNAAPAANDAPYVPPVQSAPVYXPPAYVPPSAPAVSGTYVPS
                 40         50         60         70         80         90

40         50         60         70         80         90
m025.pep    YAPVDINAATHTIVRGDTVYNISKRYHISQDDFRAWNGMTDNTLSIGQIVKVKPAGYAAP
            || ||||||||||||||||||:||| ||||||||||||||||||||||||||||||||||
a025        YAXVDINAATHTIVRGDTVYKISKCYHISQDDFRAWNGMTDNTLSIGQIVKVKPAGYAAP
                100        110        120        130        140        150

100        110        120        130        140        150
m025.pep    KAAAVKSRPAVPAAAQPPVQSAPVDINAATHTIVRGDTVYNISKRYHISQDDFRAWNGMT
            |||||||||||||||||| |||||||||||||||||||||||||||||||||||||||||
a025        KAAAVKSRPAVPAAAQPLVQSAPVDINAATHTIVRGDTVYNISKRYHISQDDFRAWNGMT
                160        170        180        190        200        210

160        170        180        190        200        210
m025.pep    DNMLSIGQIVKVKPAGYAAPKTAAVESRPAVPAAVQTPVKPAAQPPVQSAPQPAAPAAEN
            || |||||||||||||||||:|||:|||||||||||||||||||||||||||||||||||
a025        DNTLSIGQIVKVKPAGYAAPKAAAVKSRPAVPAAVQTPVKPAAQPPVQSAPQPAAPAAEN
                220        230        240        250        260        270

220        230        240        250        260        270
m025.pep    KAVPAPAPQSPAASPSGTRSVGGIVWQRPTQGKVVADFGGNNKGVDIAGNAGQPVLAAAD
            ||||||||||||||||||||||||||||||||||||||||||||||||||||||||||||
a025        KAVPAPAPQSPAASPSGTRSVGGIVWQRPTQGKVVADFGGNNKGVDIAGNAGQPVLAAAD
                280        290        300        310        320        330

280        290        300        310        320        330
m025.pep    GKVVYAGSGLRGYGNLVIIQHNSSFLTAYGHNQKLLVGEGQQVKRGQQVALMGNTDASRT
            |||||||||||||||||||||||||||||||||||||||||||||||||||||||:||||
a025        GKVVYAGSGLRGYGNLVIIQHNSSFLTAYGHNQKLLVGEGQQVKRGQQVALMGNTEASRT
                340        350        360        370        380        390

340        350
m025.pep    QLHFEVRQNGKPVNPNSYIAFX
            ||||||||||||||||||||||
a025        QLHFEVRQNGKPVNPNSYIAFX
                400        410
```

Computer analysis of this amino acid sequence gave the following results:

Homology with a Predicted ORF from *N. gonorrhoeae*

ORF 025 shows 75.6% identity over a 353 aa overlap with a predicted ORF (ORF 025.ng) from *N. gonorrhoeae*:

```
m025/g025

10         20         30
m025.pep                             VPPVQSAPVYTPPAYVPPSAPAVSGTYVPS
                                     |||||:||||:|||||||||||||||||||
g025        GMQTVSSAPVYNPYGATPYNAAPAANDAPYVPPVQTAPVYSPPAYVPPSAPAVSGTYVPS
                 40         50         60         70         80         90

40         50         60         70         80         90
m025.pep    YAPVDINAATHTIVRGDTVYNISKRYHISQDDFRAWNGMTDNTLSIGQIVKVKPAGYAAP
            ||||||||||||||||||||||||||||||||||||||||||||||||||||||||||||
g025        YAPVDINAATHTIVRGDTVYNISKRYHISQDDFRAWNGMTDNTLSIGQIVKVKPAGYAAP
                100        110        120        130        140        150

100        110        120        130        140        150
m025.pep    KAAAVKSRPAVPAAAQPPVQSAPVDINAATHTIVRGDTVYNISKRYHISQDDFRAWNGMT
            |
g025        K-----------------------------------------------------------
```

-continued

```
                    160        170        180        190        200        210
   m025.pep   DNMLSIGQIVKVKPAGYAAPKTAAVESRPAVPAAVQTPVKPAAQPPVQSAPQPAAPAAEN
                                 ||||||||||||:||||||||||||||||||||||||||
   g025       --------------------TAAVESRPAVPAAAQTPVKPAAQPPVQSAPQPAAPAAEN
                                   160        170        180        190

220         230        240        250        260
   m025.pep   KAVPAPAP--QSPAASPSGTRSVGGIVWQRPTQGKVVADFGGNNKGVDIAGNAGQPVLAA
              ||||||||   ||||||||||||||||||||||||||||||:||||||||||||||||
   g025       KAVPAPAPAPQSPAASPSGTRSVGGIVWQRPTQGKVVADFGGGNKGVDIAGNAGQPVLAA
                      200        210        220        230        240        250

270        280        290        300        310        320
   m025.pep   ADGKVVYAGSGLRGYGNLVIIQHNSSFLTAYGHNQKLLVGEGQQVKRGQQVALMGNTDAS
              ||||||||||||||||||||||||||||||||||||||||||||||||||||||||||||
   g025       ADGKVVYAGSGLRGYGNLVIIQHNSSFLTAYGHNQKLLVGEGQQVKRGQQVALMGNTDAS
                      260        270        280        290        300        310

330        340        350
   m025.pep   RTQLHFEVRQNGKPVNPNSYIAFX
              ||||||||||||||||||||||||
   g025       RTQLHFEVRQNGKPVNPNSYIAFX
                      320        330
```

The following partial DNA sequence was identified in *N. gonorrhoeae* <SEQ ID 113>:

```
g031.seq
  1 ATGGTGTCCC TCCGCTTCAG ATTCGGCAAC CACTTTAAAC GCCGACATTC

51 TGACAATTTC CTTTTCCGCC AGCCAAATAT CATGCGTATC TTTCGGTTCG

101 GGCTTGTTGG GCATGGCAAC CTTCAACAGC CGCGCCATCA CAGGAATCGT

151 CGTTCCCTGA ATCAGCAGCG ACAGCACCAC CACGGCAAAC GCCACATCAA

201 ACAGCAGGTG CGAATTGGGA ACGCCCATCA CCAGCGGCAT CATCGCCAGC

251 GAAATCGGTA CGGCTCCTCG CAAGCCCAAC CAACTGATAT ACGCCTTTTC

301 ACGCAGGCTG TAATTGAATT TCCACAAACC GCCGAACACT GCCAGCGGAC

351 GCGCGACCAG CATCAGGAAC GCCGCAATCG CCAAGGCTTC CGCCGCCCTG

401 TCCAACACGC CGGCGGGAGA AACCAGCAGA CCGAGCATGA CGAACAAAGT

451 TGCCTGCGCC AGCCAAGCCA AACCGTCCAT CACACGCAAA ACGTGTTCCG

501 TcgcACGGTT GCGCTGGTTA CCGACAATGA TGCCGGCAAG GTAAACCGCC

551 AAAAAGCCGC TGCCGCCTAT GGTATTGGTA ACGCAAACA CAAGCAGCCC

601 GCCCGACACA ATCATCAGCG CGTACAGACC TTCCGtacac acctccaatt 651 cccaatcaac gtcatagctg tctcccgtgt taaaatgttc ttcacttcag 701 aatccccccc ttcttcccag cccgaaacct tcatgtgtta naccctgggg 751 tgccccaacg gatttagtaa cctcccaatg actctgcttg tcgccccctt 801 cgcccgcttt ctccttccgg gaaaacttgt tgtccccgtc ttacattaa
```

This corresponds to the amino acid sequence <SEQ ID 114; ORF 031.ng>:

```
g031.pep
  1 MVSLRFRFGN HFKRRHSDNF LFRQPNIMRI FRFGLVGHGN LQQPRHHRNR

51 RSLNQQRQHH HGKRHIKQQV RIGNAHHQRH HRQRNRYGSS QAQPTDIRLF

101 TQAVIEFPQT AEHCQRTRDQ HQERRNRQGF RRPVQHAGGR NQQTEHDEQS
```

-continued
```
151 CLRQPSQTVH HTQNVFRRTV ALVTDNDAGK VNRQKAAAAY GIGKRKHKQP

201 ARHNHQRVQT FRTHLQFPIN VIAVSRVKMF FTSESPPSSQ PETFMCXTLG

251 CPNGFSNLPM TLLVAPFARF LLPGKLVVPV LH*
```

The following partial DNA sequence was identified in *N. meningitidis* <SEQ ID 115>:

```
m031.seq (partial)
  1 ...CGCCTGAAGC ACGGTGTCGG ACTGCATTTC TATTCGGCTA TACGCCTTTT

51     CACGCAGGCT GTAATTGAAT TTCCACAAAC CGCCGAACAC TGCCGACGGA

101     CGCGCGACCA GCATCAGGAA CGCCGCAATC GCCAAgGCTT CCGCCGCCCT

151     GTCCAACACG TTGGCAGGAG AAACCAGCAG CAAAGGCATT CCCAAACGTG

201     CGGACAAAGT GGTCGAAACC ACGCTCAGAA ACAACAGTGC GCCACCCGGC

251     AG...
```

This corresponds to the amino acid sequence <SEQ ID 116; ORF 031>:

```
m031.pep (partial)
  1 ...RLKHGVGLHF YSAIRLFTQA VIEFPQTAEH CRRTRDQHQE RRNRQGFRRP

51    VQHVGRRNQQ QRHSQTCGQS GRNHAQKQQC ATRQ....
```

The following partial DNA sequence was identified in *N. meningitidis* <SEQ ID 117>:

```
a031.seq
  1 ATACGCCTTT TCACGCAGGC TGTAATTGAA TTTCCACAAA CCGCCGAACA

51 CTGCCGGCGG ACGCGCGACC AGCATCAGGA ACGCCGCAAT CGCCAAGGCT

101 TCCGCCGCCC CGTCCAACAC GTTGGCAGGA GAAACCAGCA GCAAAGGCAT

151 TCCCAAACGT GCGGACAAAG TGGTCGAAAC CACGCTCAGA ACAACAGTG

201 CGCCACCCGG CAG
```

This corresponds to the amino acid sequence <SEQ ID 118; ORF 031.a>:

```
a031.pep (partial)
  1 IRLFTQAVIE FPQTAEHCRR TRDQHQERRN RQGFRRPVQH VGRRNQQQRH

51 SQTCGQSGRN HAQKQQCATR Q
``` m031/a031 100.0% identity over a 71 aa overlap

```
                   10        20        30        40        50        60
    m031.pep RLKHGVGLHFYSAIRLFTQAVIEFPQTAEHCRRTRDQHQERRNRQGFRRPVQHVGRRNQQ
                      ||||||||||||||||||||||||||||||||||||||||||||||
    a031            IRLFTQAVIEFPQTAEHCRRTRDQHQERRNRQGFRRPVQHVGRRNQQ
                           10        20        30        40

70        80
    m031.pep QRHSQTCGQSGRNHAQKQQCATRQ
             ||||||||||||||||||||||||
    a031     QRHSQTCGQSGRNHAQKQQCATRQ
                 50        60        70
```

Computer analysis of this amino acid sequence gave the following results:
Homology with a Predicted ORF from *N. gonorrhoeae*
ORF 031 shows 60.0% identity over a 85 aa overlap with a predicted ORF (ORF 031.ng) from *N. gonorrhoeae*:

```
m031/g031

10        20        30
     m031.pep                     RLKHGVGLHFYSAIRLFTQAVIEFPQTAEH
                                  | ::| :      : |||||||||||||||
     g031      NQQRQHHHGKRHIKQQVRIGNAHHQRHHRQRNRYGSSQAQPTDIRLFTQAVIEFPQTAEH
                     60        70        80        90       100       110

40        50        60        70        80
     m031.pep   CRRTRDQHQERRNRQGFRRPVQHVGRRNQQQRHS-QTCGQSGRNHAQKQQCATRQ
                |:||||||||||||||||||||||||:| |||| :|: |:|  ::   ::: | : |:
     g031      CQRTRDQHQERRNRQGFRRPVQHAGGRNQQTEHDEQSCLRQPSQTVHHTQNVFRRTVALV
                    120       130       140       150       160       170 g031      TDNDAGKVNRQKAAAAYGIGKRKHKQPARHNHQRVQTFRTHLQFPINVIAVSRVKMFFTS
                    180       190       200       210       220       230
```

The following partial DNA sequence was identified in *N. gonorrhoeae* <SEQ ID 119>:

```
g032.seq
  1 ATGCGGCGAA ACGTGCCTGC CGTCGCCGTA TTGCGCCGCC CACGATTCGA

51 GGCGTTTTTG GATTTGGCGT TGGCTCAGGC GCGTGCCGTT CCTGCCGGTA

101 AACAGGGCTT TGCCGTCCGA TGCCGTCTGA CGCAGCGGCA GATAGTTTTT

151 CAAGGCTTCC ACGCTTTTGC CGGTCAGCGG AACCTGACGC TGCTTGCGCC

201 CTTTGCCGGT AACGTGTACC CACGCTTCGT CCAAATATAC ATCATCTGCA

251 TTCAAGCCGT GTATCTCGCT CACGCGCAAA CCGCTGCCGT ACATCAGCTC

301 GAACAGCGCG TGGTCGCGCA CCGCCAGCGG GTCGCCGCCG TCCACGGGCA

351 AATCCAACAT CCGGTTCAGC CATTCCTGCG GCAGGGCTTT GGGTACGCGC

401 TCGGGCTGCT TCGGCGGTTT GATGTCGGCG GTCGGGTCGG CGCGCATCAG

451 CCCGCGTTTG ACCAGCCAGG CGCAATACTG CCGCCACGCC GACAGCTTGC

501 GCGCCAGCGT CCGACCGTCC AAACCGCGCT GCGACAGCCG CCGCAACGCC

551 GCcgTAAAAT CGCGCCGCGA CAAGTCCTGC GGCACGCcgc ctgcaTCTTC

601 AGACGGCATT TGTGCCAACA GTGCAAACAG TTCTTCCAAA TCGCGCCGGT

651 ATGCCGCAAC CGTGTGCTCC GACTTGCCCT CGCGCACGAT GTTTTCCAAA

701 TAAGCGTCAA AATacgccgC AAACccgTCC AAAACCATAA CCGTCCCACA

751 CAAATATCAA AAACCAGTG A
```

This corresponds to the amino acid sequence <SEQ ID 110; ORF 032.ng>:

```
g032.pep
  1 MRRNVPAVAV LRRPRFEAFL DLALAQARAV PAGKQGFAVR CRLTQRQIVF

51 QGFHAFAGQR NLTLLAPFAG NVYPRFVQIY IICIQAVYLA HAQTAAVHQL

101 EQRVVAHRQR VAAVHGQIQH PVQPFLRQGF GYALGLLRRF DVGGRVGAHQ

151 PAFDQPGAIL PPRRQLARQR PTVQTALRQP PQRRRKIAPR QVLRHAACIF
```

```
201 RRHLCQQCKQ FFQIAPVCRN RVLRLALAHD VFQISVKIRR KPVQNHNRPT

251 QISKNQ*
```

The following partial DNA sequence was identified in *N. meningitidis* <SEQ ID 111>:

```
m032.seq (partial)
  1 ATGCGGCGAA ACGTGCmTGC mGTCGCCGTT kTGCGCCGCC CATTGCGCCA

51 AACGTTTTTG GATTTGGCGT TGGCTCAGGC GCGTGCCGTT CCTGCCGGTA

101 AACAGGGCTT TGCCGTCCGA TGCCGTCTGA CGCAGCGGCA GATAGTTTTT

151 CAGGGCTTCC ACGCTTTTGC CGACCAGCGG CACCTGCCGC TgTT.GCGCC

201 CTTTGCCGAT AAcGTGTACC CACGCyTCGT CCAAATAGAC ATCATCTGCA

251 TTCAAGCCGT GTATCTCGCT CACGCGCAAA CCGCTGCCGT ACATCAGTTC

301 GAACAGGGCG TGGTCGCGCA CCGCCAGCGG GTCGCCGCCG TCCACGGGCA

351 AATCCAGCAT CCGGTTCAGC CATTCCTGCG GCAGGGCTTT GGGTACGCGC

401 TCGGGCTGCT TCGGCGGTTT GATGTCGGCG GTCGGGTCGG CGTGCATCAG

451 GCCGCGCTTT ACCAGCCAAA CGCAATACTG CCGCCAAGAC GAAAGCTTGC

501 GAGCCAGCGT CCGTTCCCCC AAACCGCG...
```

This corresponds to the amino acid sequence <SEQ ID 112; ORF 032>:

```
m032.pep (partial)
  1 MRRNVXAVAV XRRPLRQTFL DLALAQARAV PAGKQGFAVR CRLTQRQIVF

51 QGFHAFADQR HLPLXAPFAD NVYPRXVQID IICIQAVYLA HAQTAAVHQF

101 EQGVVAHRQR VAAVHGQIQH PVQPFLRQGF GYALGLLRRF DVGGRVGVHQ

151 AALYQPNAIL PPRRKLASQR PFPQTA . . .
```

The following partial DNA sequence was identified in *N. meningitidis* <SEQ ID 113>:

```
a032.seq
  1 ATGCGGCGAA ACGTGCCTGC CGTCGCCGTT TTGCGCCGCC CATTGCGCCA

51 AACGTTTTTG GATTTGGCGT TGGCTCAGGC GCGTGCCGTT CCTGCCGGTA

101 AACAGGGCTT TGCCGTCCGA TGCCGTCTGA CGCAGCGGCA GATAGTTTTT

151 CAGGGCTTCC ACGCTTTTGC CGGTCAGCGG AACCTGCCGC TGCTTGCGTC

201 CTTTGCCGGT AACGTGTACC CACGCCTCGT CCAAATATAC ATCATCTGCA

251 TTCAAGCCGT GTATCTCGCT CACGCGCAAA CCGCTGCCGT ACATCAGTTC

301 GAACAGCGCG TGATCGCGCA CCGCCAGCGG GTCGCCGCCG TCCACGGGCA

351 AATCCAGCAT CCGGTTCAGC CATTCCTGCG GCAGGGCTTT GGGTACGCGC

401 TCGGGCTGCT TCGGCGGTTT GATGTCGGCG GTCGGGTCGG TATGCAGCAG

451 ACCGCGTTTG ACCAGCCAGG CGCAATACTG CCGCCAAGAC GACAGCTTGC

501 GCGCCAGCGT CCGCGCATTC AAACCGCGCT GCGACAGCCG CCGCAACGCC

551 GCCGTAAAAT CGCGCTGCGA CAAGCCCTGC GGCACGCCGC CTGCATCTTC

601 AGACGGCATT TGTGCCAACA GCGCAAACAG TTCTTCCAAA TCGCGCCGGT

651 ATGCCGCCAC CGTGTGCTCC GACTTGCCCT CGCGCACGAT GTTTTCCAAA
```

-continued

```
701 TAAGCGTCAA AATGCGCCGC AAACCCGTCC AAAACCATAA CCGCCCCACA

751 CAAATATCAA AAAAACAGTG A
```

This corresponds to the amino acid sequence <SEQ ID 114; ORF 032.a>:

```
a032.pep
  1 MRRNVPAVAV LRRPLRQTFL DLALAQARAV PAGKQGFAVR CRLTQRQIVF

51 QGFHAFAGQR NLPLLASFAG NVYPRLVQIY IICIQAVYLA HAQTAAVHQF

101 EQRVIAHRQR VAAVHGQIQH PVQPFLRQGF GYALGLLRRF DVGGRVGMQQ

151 TAFDQPGAIL PPRRQLARQR PRIQTALRQP PQRRRKIALR QALRHAACIF

201 RRHLCQQRKQ FFQIAPVCRH RVLRLALAHD VFQISVKMRR KPVQNHNRPT

251 QISKKQ*
``` m032/a032 88.1% identity over a 176 aa overlap

```
                 10         20         30         40         50         60
    m032.pep MRRNVXAVAVXRRPLRQTFLDLALAQARAVPAGKQGFAVRCRLTQRQIVFQGFHAFADQR
            |||||  ||||  ||| ||||||||||||||||||||||||||||||||||||||||||  ||
       a032 MRRNVPAVAVLRRPLRQTFLDLALAQARAVPAGKQGFAVRCRLTQRQIVFQGFHAFAGQR
                 10         20         30         40         50         60
                 70         80         90        100        110        120
    m032.pep HLPLXAPFADNVYPRXVQIDIICIQAVYLAHAQTAAVHQFEQGVVAHRQRVAAVHGQIQH
            :|||  |  ||  |||||  |||  ||||||||||||||||||||||  |:|||||||||||||
       a032 NLPLLASFAGNVYPRLVQIYIICIQAVYLAHAQTAAVHQFEQRVIAHRQRVAAVHGQIQH
                 70         80         90        100        110        120
                130        140        150        160        170
    m032.pep PVQPFLRQGFGYALGLLRRFDVGGRVGVHQAALYQPNAILPPRRKLASQRPFPQTA
            ||||||||||||||||||||||||||||::|:|: ||:||||||:|| |||   |||
       a032 PVQPFLRQGFGYALGLLRRFDVGGRVGMQQTAFDQPGAILPPRRQLARQRPRIQTALRQP
                130        140        150        160        170        180
       a032 PQRRRKIALRQALRHAACIFRRHLCQQRKQFFQIAPVCRHRVLRLALAHDVFQISVKMRR
                190        200        210        220        230        240
```

Computer analysis of this amino acid sequence gave the following results:

Homology with a Predicted ORF from *N. gonorrhoeae*
ORF 032 shows 86.4% identity over a 176 aa overlap with a predicted ORF (ORF 032.ng) from *N. gonorrhoeae*:

```
    m032/g032
                 10         20         30         40         50         60
    m032.pep MRRNVXAVAVXRRPLRQTFLDLALAQARAVPAGKQGFAVRCRLTQRQIVFQGFHAFADQR
            |||||  ||||  |||  ::|||||||||||||||||||||||||||||||||||||  ||
       g032 MRRNVPAVAVLRRPRFEAFLDLALAQARAVPAGKQGFAVRCRLTQRQIVFQGFHAFAGQR
                 10         20         30         40         50         60
                 70         80         90        100        110        120
    m032.pep HLPLXAPFADNVYPRXVQIDIICIQAVYLAHAQTAAVHQFEQGVVAHRQRVAAVHGQIQH
            :|   ||||  |||||  |||  |||||||||||||||||||:|| |||||||||||||||
       g032 NLTLLAPFAGNVYPRFVQIYIICIQAVYLAHAQTAAVHQLEQRVVAHRQRVAAVHGQIQH
                 70         80         90        100        110        120
                130        140        150        160        170
    m032.pep PVQPFLRQGFGYALGLLRRFDVGGRVGVHQAALYQPNAILPPRRKLASQRPFPQTA
            ||||||||||||||||||||||||||||:|| |:   ||:||||||:|| |||   |||
       g032 PVQPFLRQGFGYALGLLRRFDVGGRVGAHQPAFDQPGAILPPRRQLARQRPTVTALRQP
                130        140        150        160        170        180
       g032 PQRRRKIAPRQVLRHAACIFRRHLCQQCKQFFQIAPVCRNRVLRLALAHDVFQISVKIRR
                190        200        210        220        230        240
```

The following partial DNA sequence was identified in *N. gonorrhoeae* <SEQ ID 115>:

```
g033.seq
    1 ATGGCGGCGG CGGACAAACT CTTGGGCGGC GACCGCCGCA GCGTCGCCAT

51 CATCGGAGAC GGCGCGATGA CGGCGGGGCA GGCGTTTGAA GCCTTGAATT

101 GCGCGGGCGA TATGGATGTG GATTTGCTGG TCGTCCTCAA CGACAACGAA

151 ATGTCGATTT CCCCCAACGT CGGCGCGTTG CCCAAATATC TTGCCAGCAA

201 CGTCGTGCGC GATATGCACG GACTGTTGAG TACCGTCAAA GCGCAAAcgg

251 GCAAGGTATT AGACAAAATA CCCGGCGCGA TGGagtTTGC CCAAAAAGTC

301 GAACAcaaaA TCAAAACCCT TGCCGAAGAA GCCGAACACG CCAAACAGTC

351 GCTGTCGCTG TTTGAAAATT TCGGCTTCCG CTACACCGGC CCCGTGGACG

401 GACACAACGT CGAGAATCTG GTGGACGTAT TGAAAGACTT GCGCAGCCGC

451 AAAGGCCCTC AGTTGCTGCA CGTCATCACC AAAAAGGGCA ACGGCTACAA

501 ACTCGCCGAA AACGACCCCg tcaAATACCA CGCCGTCGCc aACCTGCCta

551 AAGAAGGCGG GGCGCAAATg ccGTCTGAAA AAGAACCCAA GCCCGCCgCc 601 aaaccgACCT ATACCCAAGT ATTCGGCAAA TGGCTGTGCG ACCGGGCGGC

651 GGCAGATTCC CGACTGGTTG CGATTACCCC CGCCATGCGC GAGGGCAGCG

701 GACTGGTGGA GTTTGAACAA CGATTCCCCG ACCGCTATTT CGATGTCGGC

751 ATCGCCGAGC AGCACGCCGT tacCTTTGCC GGCGGTTTGG CGTGCGAAGG

801 CATGAAGCCC GTCGTGGCGA TTTATTCCAC CTTTTTACAA CGCGCCTACG

851 ACCAACTGGT GCACGACATC GCCCTGCAAA ACCTGCCCGT TTTGTTTGCC

901 GTCGACCGTG CGGGCATCGT CGGCGCGGAC GGTCCGACCC ATGCCGGCTT

951 GTACGATTTG AGCTTCTTGC GCTGTGTGCC GAACATGATT GTTGCCGCGC

1001 CGAGCGATGA AAACGAATGC CGCCTGCTGC TTTCGACCTG CTATCAGGCG

1051 GATGCGCCCG CCGCCGTCCG CTATCCGCGC GGCACGGGTA CGGGCGCGCC

1101 GGTTTCAGAC GGCATGGAAA CCGTGGAAAT CGGCAAGGGC ATTATCCGCC

1151 GCGAAGGTGA AAAACCGCC TTcatTGCCT TCGGCAGTAT GGTCGCCACC

1201 GCATTGGCGG TTGCCGAAAA ACTGAACGCC ACCGTCGCCG ATATGCGCTt 1251 cgtcaaacCG ATAGACGAAG AGTTGATTGT CCGCCTTGCC CGAAGCCAcg 1301 accGCATCGT TACCCTTGAA GAAAACGCCG AACAGGGCGG CGCAGGCGGC

1351 GCGGTCTTGG AAGTGTTGGC GAAACACGGC ATCTGCAAAC CCGTTTTGCT

1401 TTTGGGCGTT GCCGATACCG TAACCGAACA CGGCGATCCG AAAAAACTTT

1451 TGGACGATTT GGGTTTGAGT GCCGAAGCGG TGGAACGCCG GGTGCGCGAG

1501 TGGCTGCCGG ACCGTGATGC GGCAAATTAA
```

This corresponds to the amino acid sequence <SEQ ID 116; ORF 033.ng>:

```
g033.pep
    1 MAAADKLLGG DRRSVAIIGD GAMTAGQAFE ALNCAGDMDV DLLVVLNDNE

51 MSISPNVGAL PKYLASNVVR DMHGLLSTVK AQTGKVLDKI PGAMEFAQKV

101 EHKIKTLAEE AEHAKQSLSL FENFGFRYTG PVDGHNVENL VDVLKDLRSR

151 KGPQLLHVIT KKGNGYKLAE NDPVKYHAVA NLPKEGGAQM PSEKEPKPAA
```

-continued

```
201 KPTYTQVFGK WLCDRAAADS RLVAITPAMR EGSGLVEFEQ RFPDRYFDVG

251 IAEQHAVTFA GGLACEGMKP VVAIYSTFLQ RAYDQLVHDI ALQNLPVLFA

301 VDRAGIVGAD GPTHAGLYDL SFLRCVPNMI VAAPSDENEC RLLLSTCYQA

351 DAPAAVRYPR GTGTGAPVSD GMETVEIGKG IIRREGEKTA FIAFGSMVAT

401 ALAVAEKLNA TVADMRFVKP IDEELIVRLA RSHDRIVTLE ENAEQGGAGG

451 AVLEVLAKHG ICKPVLLLGV ADTVTEHGDP KKLLDDLGLS AEAVERRVRE

501 WLPDRDAAN*
```

The following partial DNA sequence was identified in *N. meningitidis* <SEQ ID 117>:

```
m033.seq
   1 ATGGCGGCGG CAGACAAACT CTTGGGCAGC GACCGCCGCA GCGTCGCCAT

51 CATCGGCGAC GGCGCGATGA CGGCGGGGCA GGCGTTTGAA GCCTTGAATT

101 GCGCaG.CGA TATGGATGTr GATTTGCTrG TCGTCCTCAA CGACAACGAA

151 ATGTCGATTT CCCCCAACGT CGGCGCGCTG CCGAAATACC TTGCCAGCAA

201 CGTCGTGCGC GATATGCACG GCCTGTTGAG TACCGTCAAA GCGCAAACGG

251 GCAAGGTATT AGACAAAATA CCCGGCGCGA TGGAGTTTGC CCAAAAAGTC

301 GAACACAAAA TCAAAACCCT TGCCGAAGAA GCCGAACACG CCAAACAGTC

351 GCTGTCTTTG TTTGAAAACT TCGGCTTCCG CTACACCGGC CCCGTGGACG

401 GACACAACGT CGAAAATCTG GTGGACGTAT TGAAAGACTT GCGCAGCCGC

451 AAAGGCCCTC AGTTGCTGCA CGTCATCACC AAAAAGGGCA ACGGCTACAA

501 ACTCGCCGAA AACGACCCCG TCAAATACCA CGCCGTCGCC AACCTGCCTA

551 AAGAAAGCGC GGCGCAAATG CCGTCTGAAA AAGAACCCAA GCCCGCCGCC

601 AAACCGACCT ATACCCAAGT GTTCGGCAAA TGGCTGTGCG ACCGGGCGGC

651 GGCAGATTCC CGACTGGTTG CGATTACCCC CGCCATGCGC GAGGGCAGCG

701 GCTTGGTTGA GTTTGAACAA CGATTCCCCG ACCGCTATTT CGATGTCGGC

751 ATCGCCGAGC AGCACGCCGT TACCTTTGCC GGCGGTTTGG CTTGCGAAGG

801 GATGAAGCCC GTCGTGGCGA TTTATTCCAC CTTTTTACAA CGCGCCTACG

851 ACCAACTGGT GCACGACATC GCCCTGCAAA ACCTACCCGT TTTGTTTGCC

901 GTCGACCGCG CGGGCATCGT CGGCGCGGAC GGCCCGACCC ATGCCGGTCT

951 GTACGATTTG AGCTTTTTGC GCTGCGTGCC GAACATGATT GTCGCCGCGC

1001 CGAGCGATGA AAACGAATGC CGCCTGTTGC TTTCGACCTG CTATCAGGCA

1051 GACGCGCCCG CCGCCGTCCG CTATCCGCGC GGCACGGGTA CGGGCGCGCC

1101 GGTTTCAGAC GGCATGGAAA CCGTGGAAAT CGGCAAGGGC ATTATCCGCC

1151 GCGAAGGTGA GAAAACCGCA TTCATTGCCT TCGGCAGTAT GGTCGCCCCC

1201 GCATTGGCGG TTGCCGAAAA ACTGAACGCC ACCGTCGCCG ATATGCGCTT

1251 CGTCAAACCG ATAGACGAAG AGTTGATTGT CCGCCTTGCC CGAAGCCACG

1301 ACCGCATCGT TACCCTTGAA GAAAACGCCG AACAGGGCGG CGCAGGCGGC

1351 GCGGTGCTGG AAGTATTGGC GAAACACGGC ATCTGCAAAC CCGTTTTGCT

1401 TTTGGGCGTT GCCGATACCG TAACCGGACA CGGCGATCCG AAAAAACTTT
```

-continued

```
1451 TAGACGATTT GGGCTTGAGT GCCGAAGCGG TGGAACGGCG TGTGCGCGCG

1501 TGGCTGTCGG ATCGGGATGC GGCAAATTAA
```

This corresponds to the amino acid sequence <SEQ ID 118; ORF 033>:

```
m033.pep
   1 MAAADKLLGS DRRSVAIIGD GAMTAGQAFE ALNCAXDMDV DLLVVLNDNE

51 MSISPNVGAL PKYLASNVVR DMHGLLSTVK AQTGKVLDKI PGAMEFAQKV

101 EHKIKTLAEE AEHAKQSLSL FENFGFRYTG PVDGHNVENL VDVLKDLRSR

151 KGPQLLHVIT KKGNGYKLAE NDPVKYHAVA NLPKESAAQM PSEKEPKPAA

201 KPTYTQVFGK WLCDRAAADS RLVAITPAMR EGSGLVEFEQ RFPDRYFDVG

251 IAEQHAVTFA GGLACEGMKP VVAIYSTFLQ RAYDQLVHDI ALQNLPVLFA

301 VDRAGIVGAD GPTHAGLYDL SFLRCVPNMI VAAPSDENEC RLLLSTCYQA

351 DAPAAVRYPR GTGTGAPVSD GMETVEIGKG IIRREGEKTA FIAFGSMVAP

401 ALAVAEKLNA TVADMRFVKP IDEELIVRLA RSHDRIVTLE ENAEQGGAGG

451 AVLEVLAKHG ICKPVLLLGV ADTVTGHGDP KKLLDDLGLS AEAVERRVRA

501 WLSDRDAAN*
```

The following partial DNA sequence was identified in *N. meningitidis* <SEQ ID 119>:

```
a033.seq
    1 ATGGCGGCGG CGGACAAACA GTTGGGCAGC GACCGCCGCA GCGTCGCCAT

51 CATCGGCGAC GGCGCGATGA CGGCGGGTCA GGCGTTTGAA GCCTTGAACT

101 GCGCGGGCGA TATGGATGTG GATTTGCTGG TCGTCCTCAA CGACAACGAA

151 ATGTCGATTT CCCCCAACGT CGGTGCGTTG CCCAAATACC TTGCCAGCAA

201 CGTCGTGCGC GATATGCACG GACTGTTGAG TACCGTCAAA GCGCAAACGG

251 GCAAGGTATT AGACAAAATA CCCGGCGCGA TGGAGTTTGC CCAAAAAGTC

301 GAACATAAAA TCAAAACCCT TGCCGAAGAA GCCGAACACG CCAAACAGTC

351 ACTGTCTTTG TTTGAAAACT TCGGCTTCCG CTATACCGGC CCCGTGGACG

401 GACACAACGT CGAAAATCTG GTCGATGTAT GGAAGACCT GCGCGGACGC

451 AAAGGCCCGC AGCTTCTGCA CGTCATCACC AAAAAGGGCA ACGGCTACAA

501 ACTCGCCGAA AACGATCCCG TCAAATACCA CGCCGTCGCC AACCTGCCTA

551 AGAAAGCGC GGCGCAAATG CCGTCTGAAA AGAACCCAA GCCCGCCGCC

601 AAACCGACCT ATACCCAAGT GTTCGGCAAA TGGCTGTGCG ACCGGGCGGC

651 GGCAGATTCC CGACTGGTTG CGATTACCCC CGCCATGCGC GAGGGCAGCG

701 GCTTGGTTGA GTTTGAACAA CGATTCCCCG ACCGCTATTT CGATGTCGGC

751 ATCGCCGAGC AGCACGCCGT TACCTTTGCC GGCGGTTTGG CTTGCGAAGG

801 GATGAAGCCC GTCGTGGCGA TTTATTCCAC CTTTTTACAA CGCGCCTACG

851 ACCAACTGGT GCACGACATC GCCCTGCAAA ACCTGCCCGT TTTGTTTGCC

901 GTCGACCGCG CGGGCATCGT CGGCGCGGAC GGCCCGACCC ATGCCGGTTT

951 GTACGATTTA AGCTTTTTGC GCTGCATTCC GAATATGATT GTCGCCGCGC

1001 CGAGCGATGA AAATGAATGC CGCCTGCTGC TTTCGACCTG CTATCAGGCA
```

-continued

```
1051 GACGCGCCCG CCGCCGTCCG CTATCCGCGC GGCACGGGTA CGGGCGTGCC

1101 GGTTTCAGAC GGCATGGAAA CCGTGGAAAT CGGCAAGGGC ATTATCCGCC

1151 GCGAAGGTGA GAAAACCGCA TTCATTGCCT TCGGCAGTAT GGTCGCCCCT

1201 GCATTGGCGG TCGCCGGAAA ACTGAACGCC ACCGTCGCCG ATATGCGCTT

1251 CGTCAAACCG ATAGACGAAG AGTTGATTGT CCGCCTTGCC CGAAGCCACG

1301 ACCGCATCGT TACCCTTGAA GAAAACGCCG AACAGGGCGG CGCAGGCAGC

1351 GCGGTGCTGG AAGTGTTGGC GAAACACGGC ATCTGCAAAC CCGTCTTGCT

1401 TTTGGGCGTT GCCGATACCG TAACCGGACA CGGCGATCCG AAAAAACTTT

1451 TAGACGATTT GGGCTTGAGT GCCGAAGCGG TGGAACGGCG TGTGCGCGCG

1501 TGGCTGTCGG ATCGGGATGC GGCAAATTAA
```

This corresponds to the amino acid sequence <SEQ ID 120; ORF 033.a>:

```
a033.pep
  1 MAAADKQLGS DRRSVAIIGD GAMTAGQAFE ALNCAGDMDV DLLVVLNDNE

51 MSISPNVGAL PKYLASNVVR DMHGLLSTVK AQTGKVLDKI PGAMEFAQKV

101 EHKIKTLAEE AEHAKQSLSL FENFGFRYTG PVDGHNVENL VDVLEDLRGR

151 KGPQLLHVIT KKGNGYKLAE NDPVKYHAVA NLPKESAAQM PSEKEPKPAA

201 KPTYTQVFGK WLCDRAAADS RLVAITPAMR EGSGLVEFEQ RFPDRYFDVG

251 IAEQHAVTFA GGLACEGMKP VVAIYSTFLQ RAYDQLVHDI ALQNLPVLFA

301 VDRAGIVGAD GPTHAGLYDL SFLRCIPNMI VAAPSDENEC RLLLSTCYQA

351 DAPAAVRYPR GTGTGVPVSD GMETVEIGKG IIRREGEKTA FIAFGSMVAP

401 ALAVAGKLNA TVADMRFVKP IDEELIVRLA RSHDRIVTLE ENAEQGGAGS

451 AVLEVLAKHG ICKPVLLLGV ADTVTGHGDP KKLLDDLGLS AEAVERRVRA

501 WLSDRDAAN*
``` m033/a033 98.4% identity over a 509 aa overlap

```
                  10         20         30         40         50         60
m033.pep MAAADKLLGSDRRSVAIIGDGAMTAGQAFEALNCAXDMDVDLLVVLNDNEMSISPNVGAL
         ||||||  |||||||||||||||||||||||||| ||||||||||||||||||||||||
a033     MAAADKQLGSDRRSVAIIGDGAMTAGQAFEALNCAGDMDVDLLVVLNDNEMSISPNVGAL
                  10         20         30         40         50         60

70         80         90        100        110        120
m033.pep PKYLASNVVRDMHGLLSTVKAQTGKVLDKIPGAMEFAQKVEHKIKTLAEEAEHAKQSLSL
         ||||||||||||||||||||||||||||||||||||||||||||||||||||||||||||
a033     PKYLASNVVRDMHGLLSTVKAQTGKVLDKIPGAMEFAQKVEHKIKTLAEEAEHAKQSLSL
                  70         80         90        100        110        120

130        140        150        160        170        180
m033.pep FENFGFRYTGPVDGHNVENLVDVLKDLRSRKGPQLLHVITKKGNGYKLAENDPVKYHAVA
         |||||||||||||||||||||||| :|||:||||||||||||||||||||||||||||||
a033     FENFGFRYTGPVDGHNVENLVDVLEDLRGRKGPQLLHVITKKGNGYKLAENDPVKYHAVA
                 130        140        150        160        170        180

190        200        210        220        230        240
m033.pep NLPKESAAQMPSEKEPKPAAKPTYTQVFGKWLCDRAAADSRLVAITPAMREGSGLVEFEQ
         ||||||||||||||||||||||||||||||||||||||||||||||||||||||||||||
a033     NLPKESAAQMPSEKEPKPAAKPTYTQVFGKWLCDRAAADSRLVAITPAMREGSGLVEFEQ
                 190        200        210        220        230        240

250        260        270        280        290        300
m033.pep RFPDRYFDVGIAEQHAVTFAGGLACEGMKPVVAIYSTFLQRAYDQLVHDIALQNLPVLFA
         ||||||||||||||||||||||||||||||||||||||||||||||||||||||||||||
a033     RFPDRYFDVGIAEQHAVTFAGGLACEGMKPVVAIYSTFLQRAYDQLVHDIALQNLPVLFA
                 250        260        270        280        290        300
```

```
              310        320        330        340        350        360
m033.pep  VDRAGIVGADGPTHAGLYDLSFLRCVPNMIVAAPSDENECRLLLSTCYQADAPAAVRYPR
          |||||||||||||||||||||||||:||||||||||||||||||||||||||||||||
a033      VDRAGIVGADGPTHAGLYDLSFLRCIPNMIVAAPSDENECRLLLSTCYQADAPAAVRYPR
              310        320        330        340        350        360

370        380        390        400        410        420
m033.pep  GTGTGAPVSDGMETVEIGKGIIRREGEKTAFIAFGSMVAPALAVAEKLNATVADMRFVKP
          |||||:||||||||||||||||||||||||||||||||||||||||| ||||||||||||
a033      GTGTGVPVSDGMETVEIGKGIIRREGEKTAFIAFGSMVAPALAVAGKLNATVADMRFVKP
              370        380        390        400        410        420

430        440        450        460        470        480
m033.pep  IDEELIVRLARSHDRIVTLEENAEQGGAGGAVLEVLAKHGICKPVLLLGVADTVTGHGDP
          |||||||||||||||||||||||||||||:||||||||||||||||||||||||||||||
a033      IDEELIVRLARSHDRIVTLEENAEQGGAGSAVLEVLAKHGICKPVLLLGVADTVTGHGDP
              430        440        450        460        470        480

490        500        510
m033.pep  KKLLDDLGLSAEAVERRVRAWLSDRDAANX
          |||||||||||||||||||||||||||||
a033      KKLLDDLGLSAEAVERRVRAWLSDRDAANX
              490        500        510
```

Computer analysis of this amino acid sequence gave the following results:

Homology with a Predicted ORF from *N. gonorrhoeae*

ORF 033 shows 98.4% identity over a 509 aa overlap with a predicted ORF (ORF 033.ng) from *N. gonorrhoeae*:

```
m033/g033 m033.pep  MAAADKLLGSDRRSVAIIGDGAMTAGQAFEALNCAXDMDVDLLVVLNDNEMSISPNVGAL   60
          ||||||||:||||||||||||||||||||||||||| |||||||||||||||||||||||
g033      MAAADKLLGGDRRSVAIIGDGAMTAGQAFEALNCAGDMDVDLLVVLNDNEMSISPNVGAL   60
m033.pep  PKYLASNVVRDMHGLLSTVKAQTGKVLDKIPGAMEFAQKVEHKIKTLAEEAEHAKQSLSL  120
          ||||||||||||||||||||||||||||||||||||||||||||||||||||||||||||
g033      PKYLASNVVRDMHGLLSTVKAQTGKVLDKIPGAMEFAQKVEHKIKTLAEEAEHAKQSLSL  120
m033.pep  FENFGFRYTGPVDGHNVENLVDVLKDLRSRKGPQLLHVITKKGNGYKLAENDPVKYHAVA  180
          ||||||||||||||||||||||||||||||||||||||||||||||||||||||||||||
g033      FENFGFRYTGPVDGHNVENLVDVLKDLRSRKGPQLLHVITKKGNGYKLAENDPVKYHAVA  180
m033.pep  NLPKESAAQMPSEKEPKPAAKPTYTQVFGKWLCDRAAADSRLVAITPAMREGSGLVEFEQ  240
          |||||::|||||||||||||||||||||||||||||||||||||||||||||||||||||
g033      NLPKEGGAQMPSEKEPKPAAKPTYTQVFGKWLCDRAAADSRLVAITPAMREGSGLVEFEQ  240
m033.pep  RFPDRYFDVGIAEQHAVTFAGGLACEGMKPVVAIYSTFLQRAYDQLVHDIALQNLPVLFA  300
          ||||||||||||||||||||||||||||||||||||||||||||||||||||||||||||
g033      RFPDRYFDVGIAEQHAVTFAGGLACEGMKPVVAIYSTFLQRAYDQLVHDIALQNLPVLFA  300
m033.pep  VDRAGIVGADGPTHAGLYDLSFLRCVPNMIVAAPSDENECRLLLSTCYQADAPAAVRYPR  360
          ||||||||||||||||||||||||||||||||||||||||||||||||||||||||||||
g033      VDRAGIVGADGPTHAGLYDLSFLRCVPNMIVAAPSDENECRLLLSTCYQADAPAAVRYPR  360
m033.pep  GTGTGAPVSDGMETVEIGKGIIRREGEKTAFIAFGSMVAPALAVAEKLNATVADMRFVKP  420
          |||||||||||||||||||||||||||||||||||||||| |||||||||||||||||||
g033      GTGTGAPVSDGMETVEIGKGIIRREGEKTAFIAFGSMVATALAVAEKLNATVADMRFVKP  420
m033.pep  IDEELIVRLARSHDRIVTLEENAEQGGAGGAVLEVLAKHGICKPVLLLGVADTVTGHGDP  480
          ||||||||||||||||||||||||||||||||||||||||||||||||||||||||  ||
g033      IDEELIVRLARSHDRIVTLEENAEQGGAGGAVLEVLAKHGICKPVLLLGVADTVTEHGDP  480
m033.pep  KKLLDDLGLSAEAVERRVRAWLSDRDAANX                               510
          |||||||||||||||||||||| || ||||||
g033      KKLLDDLGLSAEAVERRVREWLPDRDAANX                               510
```

The following partial DNA sequence was identified in *N. gonorrhoeae* <SEQ ID 121>:

```
g034.seq
  1 ATGAGCCGTT TATGGTTTTT TGCCGTAAAA AACATTATAA TCCGCCTTAT

51 TTACCTATTG CCCAAGGAGA CACAAATGGC ACTCGTATCC ATGCGCCAAC

101 TGCTTGACCA CGCCGCCGAA AACAGCTACG GCCTGCCCGC GTTCAACGTC

151 AACAACCTCG AACAAATGCG CGCCATTATG GAAGCCGCCG ACCAAGTCAA

201 CGCGCCCGTC ATCGTACAGG CGAGCGCAGG TGCGCGCAAA TACGcggGCG
```

```
251 CGCCGTTTTT GCGCCACCTG ATTCTGGCGG CAGTCGAAGA ATTTCCGCAC

301 ATCCCCGTCG TGATGCACCA AGACCACGGC GCATCGCCCG ACGTgtgCCA

351 ACGCTCCATC CAACTGGGCT TCTCCTCCGT GATGATGGAC GGCTCTTTGC

401 TCGAAGACGG CAAAACCCCT TCTTCTTACG AATACAACGT CAACGCCACC

451 CGTACCGTCG TCAACTTCTC CCACGCCTGC GGCGTGTCCG TCGAAGGCGA

501 AATCGGCGTA TTGGGCAACC TCGAAACCGG CGAAGCAGGC GAAGAAGACG

551 GAGTGGGCGC GGCAGGCAAA CTCTCACACG ACCAAATGCT CACCAGCGTT

601 GAAGATGCCG TGCGTTTCGT TAAAGATACC GGCGTTGACG CATTGGCGAT

651 TGCCGTCGGC ACCAGCCACG GCGCATACAA ATTCACCCGT CCGCCCACAG

701 GCGACGTATT GCGTATCGAC CGCATCAAGG AAATCCACCA AGCCCTGCCC

751 AATACACACA TCGTGATGCA CGgctCCAGC TCCGTTCCGC AAGAatgGCT

801 GAAAGTCATC AACGAATACG GCGGCAATAT CGGCGAAACC TACGGCGTGC

851 CGGTTGAAGA AATCGTCGAA GGCATCAAAC ACGGCGTGCG CAAAGTCAAC

901 ATCGATACCG ACCTGCGCCT CGCTTCCACC GGCGCGGGTAC GCCGCTACCT

951 TGCCGAAAAC CCGTCCGACT TTGATCCGCG CAAATACTTG GGCAAAACCA

1001 TTGAAGCGAT GAAGCAAATC TGCCTCGACC GTTATCTTGC GTTCGGTTGC

1051 GAAGGTCAGG CAGGCAAAAT CAAACCTGTT TCGTTGGAAA AAATGGCAAG

1101 CCCTTATCCC AAGGGCGAAT TGAACCAAAT CGTCAAATAA
```

This corresponds to the amino acid sequence <SEQ ID 122; ORF 034.ng>:

```
g034.pep
  1 MSRLWFFAVK NIIIRLIYLL PKETOMALVS MRQLLDHAAE NSYGLPAFNV

51 NNLEQMRAIM EAADQVNAPV IVQASAGARK YAGAPFLRHL ILAAVEEFPH

101 IPVVMHQDHG ASPDVCQRSI QLGFSSVMMD GSLLEDGKTP SSYEYNVNAT

151 RTVVNFSHAC GVSVEGEIGV LGNLETGEAG EEDGVGAAGK LSHDQMLTSV

201 EDAVRFVKDT GVDALAIAVG TSHGAYKFTR PPTGDVLRID RIKEIHQALP

251 NTHIVMHGSS SVPQEWLKVI NEYGGNIGET YGVPVEEIVE GIKHGVRKVN

301 IDTDLRLAST GAVRRYLAEN PSDFDPRKYL GKTIEAMKQI CLDRYLAFGC

351 EGQAGKIKPV SLEKMASRYA KGELNQIVK*
```

The following partial DNA sequence was identified in N. meningitidis <SEQ ID 123>:

```
m034.seq (partial)
  1 ATGAGCTGTT TATGGTTTTT TGCTGTAAAA AACATTATAA TCCGCCTTAT

51 TTACCTATTG CCCAAGGAGA CACAAATGGC ACTCGTATCC ATGCGCCAAC

101 TGCTTGATCA TGCTGCCGAA wACAGCTACG GCyTGCCGGC GTTCAACGTC

151 AACAACCTCG wACAGATGCG CGCCATCATG GAGGCTGCAG ACCAAGTCGA

201 CGCCCCCGTC ATCGTACAGG CGAGTGCCGG TGCGCGCAAA TATGCGGGTG

251 CGCCGTTTTT ACGCCACCTG ATTTTGGCGG CTGTCGAAGT ATTTCCACAC

301 ATCCCCGTCG TCATGCACCA AGACCACGGC GCATCACCCG ACGTGTGCCA

351 ACGCTCCATC CAACTGGGCT TCTCCTCTGT AATGATGGAC GGCTCGCTGA
```

```
401 TGGAAGACGG CAAAACCCCT TCTTCTTACG AATACAACGT CAACGCCACA

451 CGTACCGTGG TTAACTTCTC CCACGCTTGC GGCGTATCCG TTGAAGGCGA

501 AATCGGCGTA TTGGGCAACC TCGAAACCGG CGATGCAGGC GAAGAAGACG

551 GTGTAGGCGC AGTGGGCAAA CTTTCCCACG ACCAAATGCT GACCAGCGTC

601 GAAGATGCCG TATGTTTCGT TAAAGATACC GGCGTTGACG CATTGGCTAT

651 TGCCGTCGGC ACCAGCCACG GCGCATACAA ATTCACCCGT CCGCCCACAG

701 GCGATGTATT ACGTATCGAC CGCATCAAAG AAATCCACCA AGCCCTGCCC

751 AATACACACA TCGTGATGCA C . . .
```

This corresponds to the amino acid sequence <SEQ ID 124; ORF 034>:

```
m034.pep (partial)
  1 MSCLWFFAVK NIIIRLIYLL PKETQMALVS MRQLLDHAAE XSYGLPAFNV

51 NNLXQMRAIM EAADQVDAPV IVQASAGARK YAGAPFLRHL ILAAVEVFPH

101 IPVVMHQDHG ASPDVCQRSI QLGFSSVMMD GSLMEDGKTP SSYEYNVNAT

151 RTVVNFSHAC GVSVEGEIGV LGNLETGDAG EEDGVGAVGK LSHDQMLTSV

201 EDAVCFVKDT GVDALAIAVG TSHGAYKFTR PPTGDVLRID RIKEIHQALP

251 NTHIVMH . . .
```

The following partial DNA sequence was identified in *N. meningitidis* <SEQ ID 125>:

```
a034.seq
    1 ATGAGCCGTT TATGGTTTTT TGCCGCAAAA AACATTATAA TCCGCCTTAT

51 TTACCTATTG CCCAAGGAGA CACAAATGGC ACTCGTATCC ATGCGCCAAC

101 TGCTTGATCA TGCTGCCGAA AACAGCTACG GCCTGCCCGC GTTCAACGTC

151 AACAACCTCG AACAAATGCG CGCCATTATG GAAGCCGCCG ACCAAGTCAA

201 CGCGCCCGTC ATCGTACAGG CGAGCGCAGG TGCGCGCAAA TACGCGGGCG

251 CGCCGTTTTT GCGCCACCTG ATTTTGGCGG CTGTCGAAGA ATTTCCGCAC

301 ATCCCCGTCG TGATGCACCA AGACCACGGC GCATCGCCCG ACGTGTGCCA

351 ACGCTCCATC CAACTGGGCT TTTCCTCCGT GATGATGGAC GGCTCGCTGA

401 TGGAAGACGG CAAAACCCCT TCTTCTTATG AATACAACGT CAACGCCACC

451 CGTACCGTGG TTAATTTCTC CCACGCCTGC GGCGTATCCG TTGAAGGCGA

501 AATCGGCGTA TTGGGCAACC TCGAAACTGG CGAAGCCGGC GAAGAAGACG

551 GTGTAGGCGC AGTGGGCAAA CTTTCCCACG ACCAAATGCT CACCAGCGTC

601 GAAGATGCCG TGCGTTTCGT TAAAGATACC GGCGTTGACG CATTGGCGAT

651 TGCCGTCGGC ACCAGCCACG GCGCGTACAA ATTCACCCGT CCGCCCACAG

701 GCGACGTGTT GCGTATCGAC CGCATCAAAG AAATCCACCA AGCCCTGCCC

751 AATACACACA TCGTGATGCA CGGCTCCAGC TCCGTTCCGC AAGAATGGCT

801 GAAAGTCATC AACGAATACG GCGGCAATAT CGGCGAAACC TACGGCGTGC

851 CGGTTGAAGA AATCGTCGAA GGCATCAAAC ACGGCGTGCG TAAAGTCAAC

901 ATCGATACCG ACTTGCGCCT TGCTTCCACC GGCGCGGTAC GCCGCTACCT

951 TGCCGAAAAC CCGTCCGACT TCGATCCGCG CAAATATTTG AGCAAAACCA
```

```
1001 TTGAAGCGAT GAAGCAAATC TGCCTCGACC GCTACCTCGC GTTCGGTTGC

1051 GAAGGTCAGG CAGGCAAAAT CAAACCGGTT TCCTTGGAAA AAATGGCAAA

1101 CCGTTATGCC AAGGGCGAAT TGAACCAAAT CGTCAAATAA
```

This corresponds to the amino acid sequence <SEQ ID 126; ORF 034.a>:

```
a034.pep
    1 MSRLWFFAAK NIIIRLIYLL PKETQMALVS MRQLLDHAAE NSYGLPAFNV

51 NNLEQMRAIM EAADQVNAPV IVQASAGARK YAGAPFLRHL ILAAVEEFPH

101 IPVVMHQDHG ASPDVCQRSI QLGFSSVMMD GSLMEDGKTP SSYEYNVNAT

151 RTVVNFSHAC GVSVEGEIGV LGNLETGEAG EEDGVGAVGK LSHDQMLTSV

201 EDAVRFVKDT GVDALAIAVG TSHGAYKFTR PPTGDVLRID RIKEIHQALP

251 NTHIVMHGSS SVPQEWLKVI NEYGGNIGET YGVPVEEIVE GIKHGVRKVN

301 IDTDLRLAST GAVRRYLAEN PSDFDPRKYL SKTIEAMKQI CLDRYLAFGC

351 EGQAGKIKPV SLEKMANRYA KGELNQIVK*
``` m034/a034 96.9% identity over a 257 aa overlap

```
                   10         20         30         40         50         60
   m034.pep   MSCLWFFAVKNIIIRLIYLLPKETQMALVSMRQLLDHAAEXSYGLPAFNVNNLXQMRAIM
              ||  |||| :||||||||||||||||||||||||||||| ||||||||||||| ||||||
       a034   MSRLWFFAAKNIIIRLIYLLPKETQMALVSMRQLLDHAAENSYGLPAFNVNNLEQMRAIM
                   10         20         30         40         50         60

70         80         90        100        110        120
   m034.pep   EAADQVDAPVIVQASAGARKYAGAPFLRHLILAAVEVFPHIPVVMHQDHGASPDVCQRSI
              ||||||:||||||||||||||||||||||||||||||| |||||||||||||||||||||
       a034   EAADQVNAPVIVQASAGARKYAGAPFLRHLILAAVEEFPHIPVVMHQDHGASPDVCQRSI
                   70         80         90        100        110        120

130        140        150        160        170        180
   m034.pep   QLGFSSVMMDGSLMEDGKTPSSYEYNVNATRTVVNFSHACGVSVEGEIGVLGNLETGDAG
              |||||||||||||||||||||||||||||||||||||||||||||||||||||||||:||
       a034   QLGFSSVMMDGSLMEDGKTPSSYEYNVNATRTVVNFSHACGVSVEGEIGVLGNLETGEAG
                  130        140        150        160        170        180

190        200        210        220        230        240
   m034.pep   EEDGVGAVGKLSHDQMLTSVEDAVCFKKDTGVDALAIAVGTSHGAYKFTRPPTGDVLRID
              |||||||||||||||||||||||| |:|||||||||||||||||||||||||||||||||
       a034   EEDGVGAVGKLSHDQMLTSVEDAVRFVKDTGVDALAIAVGTSHGAYKFTRPPTGDVLRID
                  190        200        210        220        230        240

250
   m034.pep   RIKEIHQALPNTHIVMH
              |||||||||||||||||
       a034   RIKEIHQALPNTHIVMHGSSSVPQEWLKVINEYGGNIGETYGVPVEEIVEGIKHGVRKVN
                  250        260        270        280        290        300
```

Computer analysis of this amino acid sequence gave the following results:

Homology with a Predicted ORF from *N. gonorrhoeae*

ORF 034 shows 96.5% identity over a 257 aa overlap with a predicted ORF (ORF 034.ng) from *N. gonorrhoeae*:

```
   m034/g034 m034.pep   MSCLWFFAVKNIIIRLIYLLPKETQMALVSMRQLLDHAAEXSYGLPAFNVNNLXQMRAIM    60
              || |||||||||||||||||||||||||||||||||||| ||||||||||||| ||||||
       g034   MSRLWFFAVKNIIIRLIYLLPKETQMALVSMRQLLDHAAENSYGLPAFNVNNLEQMRAIM    60
```

```
m034.pep    EAADQVDAPVIVQASAGARKYAGAPFLRHLILAAVEVFPHIPVVMHQDHGASPDVCQRSI    120
            ||||||:|||||||||||||||||||||||||||| ||||||||||||||||||||||||
g034        EAADQVNAPVIVQASAGARKYAGAPFLRHLILAAVEEFPHIPVVMHQDHGASPDVCQRSI    120 m034.pep    QLGFSSVMMDGSLMEDGKTPSSYEYNVNATRTVVNFSHACGVSVEGEIGVLGNLETGDAG    180
            ||||||||||||:||||||||||||||||||||||||||||||||||||||||||||:||
g034        QLGFSSVMMDGSLLEDGKTPSSYEYNVNATRTVVNFSHACGVSVEGEIGVLGNLETGEAG    180 m034.pep    EEDGVGAVGKLSHDQMLTSVEDAVCFVKDTGVDALAIAVGTSHGAYKFTRPPTGDVLRID    240
            |||||||:|||||||||||||||| |||||||||||||||||||||||||||||||||||
g034        EEDGVGAAGKLSHDQMLTSVEDAVRFVKDTGVDALAIAVGTSHGAYKFTRPPTGDVLRID    240 m034.pep    RIKEIHQALPNTHIVMH                                              257
            |||||||||||||||||
g034        RIKEIHQALPNTHIVMHGSSSVPQEWLKVINEYGGNIGETYGVPVEEIVEGIKHGVRKVN    300
```

The following partial DNA sequence was identified in *N. gonorrhoeae* <SEQ ID 127>:

```
g036.seq
   1 ATGCTGAAGC CGTGTTTGGT ATACAGTGCC TGTGCGGCGG cgttgcCTGC

51 GCGGACTTCG AGCAGCAGGC GTTGCGTGCC TTCGGGCAGA TGTGCGTACC

101 AATATTCGAG CAGGGCGGAC GCAACGCCCC GTCGGCGGCA TTCGGGCGCG

151 GTGGCAATCA GGTGCAGTTC GGATTCGTCG GCAGGTTCT GCCAAACGAT

201 AAAGGCGGCA ATCCTGCCGT CTTTTTCCGC AAGGAAAACC TGTTCGGACG

251 GCGAAACAAG CGCGGACTCA AATTGGCGTT GCGTCCACGC GGACGGGTTG

301 CAGACGGTAT CGAGCGCGGC CAGTGCGGCG CAGTCGGACG GTGAGGCTGG

351 GCGGATGTTC ATGTTCGTGC CTTCCGTTCC GCCTGTTCTT TGGCAGTCAG

401 GGCGATTTTG TTGCGGACGT AGAGCAGTTC GGCGTGTGCC GCGCCAGTTG

451 CGGGATAGCC GCCGCCGAGG GCGAGCGCGA GAAAATCGGC GGCGGTCGGC

501 ATATCGGGTT TGCCTGAGAA GGGCGGACGG TTTTCCAGTG CGAACGCACT

551 GCCGATGCCG TCTGAAAAGA CGTACCCCTC GGGGAGGGCA ATGTCTGCCG

601 CCCTACCGAC TTGATAATCG CTCAAACGGC GGCGGTTCAG CGTGTCGAAC

651 CACGCATAAA ACACTTCGCC CATACGCGCG TCCGCAGCGG CGAGTATGCA

701 GCTTTGCGGC GGCGGCAGCG AGGCGGCGGC ATCGAGCGTG GGGATGCCGA

751 TTAAAGGCGT GTCGAACGGC GTTGCCAAAC CTTGCGCCAC GCCGATGCCG

801 ATACGCAGTC CGGTAA
```

This corresponds to the amino acid sequence <SEQ ID 128; ORF 036.ng>:

```
g036.pep
   1 MLKPCLVYSA CAAALPARTS SSRRCVPSGR CAYQYSSRAD ATPRRRHSGA

51 VAIRCSSDSS GRFCQTIKAA ILPSFSARKT CSDGETSADS NWRCVHADGL

101 QTVSSAASAA QSDGEAGRMF MFVPSVPPVL WQSGRFCCGR RAVRRVPRQL

151 RDSRRRGRAR ENRRRSAYRV CLRRADGFPV RTHCRCRLKR RTPRGGQCLP

201 PYRLDNRSNG GGSACRTTHK TLRPYARPQR RVCSFAAAAA RRRHRAWGCR

251 LKACRTALPN LAPRRCRYAV R*
```

The following partial DNA sequence was identified in *N. meningitidis* <SEQ ID 129>:

```
m036.seq
  1 ATGCTGAAGC CGTGCGCCGT GTACAGTGCC TGTGCGGCGG TGTTGCCTGC
 51 ACGGACTTCG AGCAGCAGGC GTTGCGTGTC TTCGGGCAGA TGTGTGAACC
101 AATATTCGAG CAGGGCGGAC GCAATTCCTT GGCGGCGGCA TTCGGGCGCG
151 GTGGCAATCA GGTGCAGTTC GGATTCGTCG GGCAGGTTCT GCCAAACGAT
201 AAAGGCGGCA ATCCCg.CGT CTTTTTCCGC AAGGAAAACC TGTTCGGACG
251 GCGAAACCAG TGCGGACTCA AATTGGCGTT GCGTCCATGC GGACGGGTTG
301 CAGACGGCAT CGAGTGCGGC CAGCTCCTCA CAATCGGCAC AAACGGCACG
351 GCGGATGTTC ACGGGCGCGC TCTCCGTTCG GCCTGTTCTT TGGCAGTCAG
401 GGCGATTTTG TTGCGGACGT AGAGCAAACC GGCGTGTGCG GCATGGACGG
451 CAGGATAACC GCCCTTGGCT GCCAATGCGA GAAAGTCGGC GGCAGTCGGC
501 ATATCCGGTC TGCCTGAGAA CGGCGGAGCT TCTTCCAGCG CGAACGCGCT
551 GCCTATGCCG TCTGAAAAGG CGCATCCCTC CGGCAGCCGG ATGTCTGCCG
601 CCCGCCCGAC CTGATAATCG CTCAAACGGT GGCAGTTCAG CGTATCGAAC
651 CATGCATAAA ACACTTCGCC CATACGAGCG TCCGTAGCGG CAAGGATGCA
701 GCTTTGCGGC GGCGGCAGCG AGGCGGCGGC ATCGAGCGAG GGTACGCCGA
751 TTAAGGGGGT ATCAAACGGC GTTGCCAAAC CCTGAGCTAC ACCGATGCCG
801 ATACGCAGTC CGGTAA
```

This corresponds to the amino acid sequence <SEQ ID 130; ORF 036>:

```
m036.pep
  1 MLKPCAVYSA CAAVLPARTS SSRRCVSSGR CVNQYSSRAD AIPWRRHSGA
 51 VAIRCSSDSS GRFCQTIKAA IPXSFSARKT CSDGETSADS NWRCVHADGL
101 QTASSAASSS QSAQTARRMF TGALSVRPVL WQSGRFCCGR RANRRVRHGR
151 QDNRPWLPMR ESRRQSAYPV CLRTAELLPA RTRCLCRLKR RIPPAAGCLP
201 PARPDNRSNG GSSAYRTMHK TLRPYERP*R QGCSFAAAAA RRRHRARVRR
251 LRGYQTALPN PELHRCRYAV R*
```

The following partial DNA sequence was identified in *N. meningitidis* <SEQ ID 131>:

```
a036.seq
  1 ATGCTGAAGC CGTGCGCCGT GTACAGTGCC TGTGCGGCGG TGTTGCCTGC
 51 ACGGACTTCG AGCAGCAGGC GTTGCGTGTC TTCGGGCAGA TGTGTGAACC
101 AATATTCGAG CAGGGCGGAC GCAATTCCTT GGCGGCGGCA TTCGGGCGCG
151 GTGGCAATCA GGTGCAGTTC GGATTCGTCG GGCAGGTTCT GCCAAACGAT
201 AAAGGCGGCA ATCCCGCCGT CTTTTTCCGC AAGGAAAACC TGTTCGGACG
251 GCGAAACCAG TGCGGACTCA AATTGGCGTT GCGTCCACGC GGACGGGTTG
301 CAGACGGCAT CGAGCGCGGC GAGTGCGGCG CAATCGGCAT AAACGGCGCG
351 GCGGATGTTC ACAGGCGCGC CCTCCGTTCC GCCTGTTCTT TGGCAGTCAA
```

```
401 GGCGATTTTG TTGCGGACGT AGAGCAGCTC GGCGTGTGCC GCAGCGACGG

451 CGGGAAAACC GCCTTCAGCC GCCAGATTGA GGAAGTCGGC GGCGGTCGGC

501 ATATCGGGTT TGCCTGAGAA GGGCGGACGG TTTTCCAGCG CGAACGCATT

551 GCCGATGCCG TCTGAAAAGG CGCATCCTTC CGGCAGCCGG ATGTCTGCCG

601 CCCGACCGAC CTGATAATCG CTCAAACGGC GGCGGTTCAG CGTGTCGAAC

651 CATGCATAAA ACACTTCGCC CATACGTGCG TCCGCAGCGG CAAGGATGCA

701 GCTTTGCGGC GGCGGCAGCG AGGCGGCGGC ATCGAGCGAG GTACGCCGA

751 TTAAAGGAGT ATCAAACGGC GTTGCCAAAC CTTGCGCCAC GCCGATGCCG

801 ATACGCAGTC CCGTAA
```

This corresponds to the amino acid sequence <SEQ ID 132; ORF 036.a>:

```
a036.pep
  1 MLKPCAVYSA CAAVLPARTS SSRRCVSSGR CVNQYSSRAD AIPWRRHSGA

51 VAIRCSSDSS GRFCQTIKAA IPPSFSARKT CSDGETSADS NWRCVHADGL

101 QTASSAASAA QSA*TARRMF TGAPSVPPVL WQSRRFCCGR RAARRVPQRR

151 RENRLQPPD* GSRRRSAYRV CLRRADGFPA RTHCRCRLKR RILPAAGCLP

201 PDRPDNRSNG GGSACRTMHK TLRPYVRPQR QGCSFAAAAA RRRHRARVRR

251 LKEYQTALPN LAPRRCRYAV P*
``` m036/a036 85.6% identity over a 270 aa overlap

```
                    10         20         30         40         50         60
    m036.pep  MLKPCAVYSACAAVLPARTSSSRRCVSSGRCVNQYSSRADAIPWRRHSGAVAIRCSSDSS
              ||||||||||||||||||||||||||||||||||||||||||||||||||||||||||||
        a036  MLKPCAVYSACAAVLPARTSSSRRCVSSGRCVNQYSSRADAIPWRRHSGAVAIRCSSDSS
                    10         20         30         40         50         60

70         80         90        100        110        120
    m036.pep  GRFCQTIKAAIPXSFSARKTCSDGETSADSNWRCVHADGLQTASSAASSSQSAQTARRMF
              |||||||||||| |||||||||||||||||||||||||||||||||||  :||| |||||
        a036  GRFCQTIKAAIPPSFSARKTCSDGETSADSNWRCVHADGLQTASSAASAAQSAXTARRMF
                    70         80         90        100        110        120

130        140        150        160        170        180
    m036.pep  TGALSVRPVLWQSGRFCCGRRANRRVRHGRQDNRPWLPMRESRRQSAYPVCLRTAELLPA
              ||| || |||||||| :||||||||| ||| : |::||   |   |||:||| |||| :||
        a036  TGAPSVPPVLWQSRRFCCGRRAARRVPQRRRENRLQPPDXGSRRRSAYRVCLRRADGFPA
                   130        140        150        160        170        180

190        200        210        220        230        240
    m036.pep  RTRCLCRLKRRIPPAAGCLPPARPDNRSNGGSSAYRTMHKTLRPYERPXRQGCSFAAAAA
              ||:| |||||||| |||||||||:|| |||||||||:|| |||||||| || ||||||||||
        a036  RTHCRCRLKRRILPAAGCLPPDRPDNRSNGGGSACRTMHKTLRPYVRPQRQGCSFAAAAA
                   190        200        210        220        230        240

250        260        270
    m036.pep  RRRHRARVRRLRGYQTALPNPELHRCYAVRX
              ||||||||||||: ||||||||   :||||||
        a036  RRRHRARVRRLKEYQTALPNLAPRRCRYAVPX
                   250        260        270
```

Computer analysis of this amino acid sequence gave the following results:
Homology with a Predicted ORF from *N. gonorrhoeae*
ORF 036 shows 74.9% identity over a 271 aa overlap with a predicted ORF (ORF 036.ng) from *N. gonorrhoeae*:

```
m036/g036
                 10        20        30        40        50        60
   m036.pep  MLKPCAVYSACAAVLPARTSSSRRCVSSGRCVNQYSSRADAIPWRRHSGAVAIRCSSDSS
             |||||  ||||||||:||||||||||  ||: ||||||| | ||||||||||||||||||
   g036      MLKPCLVYSACAAALPARTSSSRRCVPSGRCAYQYSSRADATPRRRHSGAVAIRCSSDSS
                 10        20        30        40        50        60

70        80        90       100       110       120
   m036.pep  GRFCQTIKAAIPXSFSARKTCSDGETSADSNWRCVHADGLQTASSAASSSQSAQTARRMF
             |||||||||||  ||||||||||||||||||||||||||||||:::||   |   |||
   g036      GRFCQTIKAAILPSFSARKTCSDGETSADSNWRCVHADGLQTVSSAASAAQSDGEAGRMF
                 70        80        90       100       110       120

130       140       150       160       170       180
   m036.pep  TGALSVRPVLWQSGRFCCGRRANRRVRHGRQDNRPWLPMRESRRQSAYPVCLRTAELLPA
             :  || ||||||||||||||||| |||  : :|      ||:||:||| ||||  : :|:
   g036      MFVPSVPPVLWQSGRFCCGRRAVRRVPRQLRDSRRRGRARENRRSAYRVCLRRADGFPV
                130       140       150       160       170       180

190       200       210       220       230       240
   m036.pep  RTRCLCRLKRRIPPAAGCLPPARPDNRSNGGSSAYRTMHKTLRPYERPXRQGCSFAAAAA
             ||:| ||||||  | :: ||||  ||||||||:|| || |||||||| |: |||||||||
   g036      RTHCRCRLKRRTPRGGQCLPPYRLDNRSNGGGSACRTTHKTLRPYARPQRRVCSFAAAAA
                190       200       210       220       230       240

250       260       270
   m036.pep  RRRHRARVRRLRGYQTALPNPELHRCRYAVRX
             ||||||   ||:: :|||||   :||||||||
   g036      RRRHRAWGCRLKACRTALPNLAPRRCRYAVRX
                250       260       270
```

The following partial DNA sequence was identified in *N. meningitidis* <SEQ ID 133>:

```
m036-1.seq
  1 ATGCTGAAGC CGTGCGCCGT GTACAGTGCC TGTGCGGCGG TGTTGCCTGC

51 ACGGACTTCG AGCAGCAGGC GTTGCGTGTC TTCGGGCAGA TGTGTGAACC

101 AATATTCGAG CAGGGCGGAC GCAATTCCTT GGCGGCGGCA TTCGGGCGCG

151 GTGGCAATCA GGTGCAGTTC GGATTCGTCG GCAGGTTCT GCCAAACGAT

201 AAAGGCGGCA ATCCCGCCGT CTTTTTCCGC AAGGAAAACC TGTTCGGACG

251 GCGAAACCAG TGCGGACTCA AATTGGCGTT GCGTCCATGC GGACGGGTTG

301 CAGACGGCAT CGAGTGCGGC CAGCTCCTCA CAATCGGCAC AAACGGCACG

351 GCGGATGTTC ACGGGCGCGC TCTCCGTTCG GCCTGTTCTT TGGCAGTCAG

401 GGCGATTTTG TTGCGGACGT AGAGCAAACC GGCGTGTGCG CATGGACGG

451 CAGGATAACC GCCCTTGGCT GCCAATGCGA GAAAGTCGGC GGCAGTCGGC

501 ATATCCGGTC TGCCTGAGAA CGGCGGAGCT TCTTCCAGCG CGAACGCGCT

551 GCCTATGCCG TCTGAAAAGG CGCATCCCTC CGGCAGCCGG ATGTCTGCCG

601 CCCGCCCGAC CTGATAATCG CTCAAACGGT GGCAGTTCAG CGTATCGAAC

651 CATGCATAAA ACACTTCGCC CATACGAGCG TCCGTAG
```

This corresponds to the amino acid sequence <SEQ ID 134; ORF 0036-1>:

```
m036-1.pep
  1 MLKPCAVYSA CAAVLPARTS SSRRCVSSGR CVNQYSSRAD AIPWRRHSGA

51 VAIRCSSDSS GRFCQTIKAA IPPSFSARKT CSDGETSADS NWRCVHADGL
```

```
101 QTASSAASSS QSAQTARRMF TGALSVRPVL WQSGRFCCGR RANRRVRHGR

151 QDNRPWLPMR ESRRQSAYPV CLRTAELLPA RTRCLCRLKR RIPPAAGCLP

201 PARPDNRSNG GSSAYRTMHK TLRPYERP*
``` m036-1/g036 76.8% identity in 228 aa overlap

```
                    10        20        30        40        50        60
   m036-1.pep MLKPCAVYSACAAVLPARTSSSRRCVSSGRCVNQYSSRADAIPWRRHSGAVAIRCSSDSS
               ||||| |||||||::|||||||||| |||:| ||||||||| ||||||||||||||||||
          g036 MLKPCLVYSACAAALPARTSSSRRCVPSGRCAYQYSSRADATPRRRHSGAVAIRCSSDSS
                    10        20        30        40        50        60

70        80        90       100       110       120
   m036-1.pep GRFCQTIKAAIPPSFSARKTCSDGETSADSNWRCVHADGLQTASSAASSSQSAQTARRMF
               ||||||||||| |||||||||||||||||||||||||||||||::|| | ||  | |||
          g036 GRFCQTIKAAILPSFSARKTCSDGETSADSNWRCVHADGLQTVSSAASAAQSDGEAGRMF
                    70        80        90       100       110       120

130       140       150       160       170       180
   m036-1.pep TGALSVRPVLWQSGRFCCGRRANRRVRHGRQDNRPWLPMRESRRQSAYPVCLRTAELLPA
               : || ||||||||||||||||| ||:  :|:|   ||:||| |||| |:: :|:
          g036 MFVPSVPPVLWQSGRFCCGRRAVRRVPRQLRDSRRGRARENRRSAYRVCLRRADGFPV
                   130       140       150       160       170       180

190       200       210       220       229
   m036-1.pep RTRCLCRLKRRIPPAAGCLPPARPDNRSNGGSSAYRTMHKTLRPYERPX
               ||:| |||||| |:: |||| | ||||||||::|| ||||||||| ||
          g036 RTHCRCRLKRRTPRGGQCLPPYRLDNRSNGGGSACRTTHKTLRPYARPQRRVCSFAAAAA
                   190       200       210       220       230       240 g036 RRRHRAWGCRLKACRTALPNLAPRRCRYAVRX
                   250       260       270
```

The following partial DNA sequence was identified in *N. gonorrhoeae* <SEQ ID 135>:

```
g038.seq
  1 ATGACTGATT TCCGCCAAGA TTTCCTCAAA TTCTCCCTCG CCCAAAATGT

51 TTTGAAATTC GGCGAATTTA CCACCAAAGC CGGACGGCGG TCGCCCTATT

101 TCTTCAATGC CGGCCTCTTC AACGACGGCG CGTCCACGCT GCAACTGGCA

151 AAATTCTATG CACAATCCAT CATTGAAAGC GGCATCCGAT TCGATATGCT

201 GTTCGGCCCC GCCTACAAAG GCATTATTTT GGCGGCGGCA ACCGCGATGA

251 TGCTGGCGGA AAAAGGCGTG AACGTCCCGT TTGCCTACAA CCGCAAAGAA

301 GCCAAAGACC GCGGCGAAGG CGGCGTGTTG GTCGGCGCGC CGCTTAAAGG

351 GCGCGTGCTG ATTATCGACG ACGTGATTTC CGCCGGCACA TCCGTACGCG

401 AATCAATCAA ACTGATTGAA GCGGAGGGTG CAACCCCCGC CGGTGTCGCC

451 ATCGCGCTCG ACCGCATGGA AAAAGGCACG GGTAAATTGT CCGCCGTTCA

501 GGAAGTGGAA AAACAATACG GCCTGCCCGT CGCCCCCATC GCCAGCCTGA

551 ACGATTTGTT TATCCTGTTG CAAAACAACC CCGAATTCGG ACAGTTCCTC

601 GAACCCGTCC GCACCTACCG CCGGCAGTAC GGCGTAGAAT AA
```

This corresponds to the amino acid sequence <SEQ ID 136; ORF 038.ng>:

```
g038.pep
  1 MTDFRQDFLK FSLAQNVLKF GEFTTKAGRR SPYFFNAGLF NDGASTLQLA

51 KFYAQSIIES GIRFDMLFGP AYKGIILAAA TAMMLAEKGV NVPFAYNRKE

101 AKDRGEGGVL VGAPLKGRVL IIDDVISAGT SVRESIKLIE AEGATPAGVA
```

-continued

```
151 IALDRMEKGT GKLSAVQEVE KQYGLPVAPI ASLNDLFILL QNNPEFGQFL

201 EPVRTYRRQY GVE*
```

The following partial DNA sequence was identified in *N. meningitidis* <SEQ ID 137>:

```
m038.seq
  1 ATGACCGATT TCCGCCAAGA TTTCCTCAAA TTCTCCCTCG CCCAAAATGT

51 TTTGAAATTC GGCGAATTTA CCACCAAGGC AGGACGGCGG TCGCCCTATT

101 TCTTCAATGC CGGCCTCTTT AACGACGGCT TGTCCACGCT GCAACTGGCA

151 AAATTTTACG CACAATCCAT CATTGAAAGC GGCATCCGAT TCGATATGCT

201 GTTCGGTCCC GCCTACAAAG GCATTATTTT GGCGGCGGCA ACCGCGATGA

251 TGCTGGCGGA AAAAGGCGTG AACGTCCCGT TGCCTACAA CCGCAAAGAA

301 GCCAAAGACC ACGGCGAAGG CGGCGTGTTG GTCGGCGCGC CGCTTAAAGG

351 GCGCGTGCTG ATTATCGACG ACGTGATTTC CGCCGGCACA TCCGTACGCG

401 AATCGATCAA ACTGATTGAA GCGGAGGGTG CAACCCCcGC CGGTGTCGCC

451 ATCGCGCTCG ATCGCATGGA AAAAGGCACG GGTGAATTGA GCGCGGTTCA

501 GGAAGTGGAr AAACAATACG GkCTGCCCGT CGCCCCCATC GCCAGCCTGA

551 ACGATTTGTT TATTCTGTTG CAAAACAACC CCGAATTCGG ACAGTTCCTC

601 GAACCCGTCC GAGCCTACCG TCGGCAGTAC GGCGTAGAAT AA
```

This corresponds to the amino acid sequence <SEQ ID 138; ORF 038>:

```
m038.pep
    1 MTDFRQDFLK FSLAQNVLKF GEFTTKAGRR SPYFFNAGLF NDGLSTLQLA

51 KFYAQSIIES GIRFDMLFGP AYKGIILAAA TAMMLAEKGV NVPFAYNRKE

101 AKDHGEGGVL VGAPLKGRVL IIDDVISAGT SVRESIKLIE AEGATPAGVA

151 IALDRMEKGT GELSAVQEVE KQYGLPVAPI ASLNDLFILL QNNPEFGQFL

201 EPVRAYRRQY GVE*
```

The following partial DNA sequence was identified in *N. meningitidis* <SEQ ID 139>:

```
a038.seq
  1 ATGACCGATT TCCGCCAAGA TTTCCTCAAA TTCTCCCTCG CCCAAAATGT

51 TTTGAAATTC GGCGAATTCA CCACCAAAGC CGGACGGCGG TCGCCCTATT

101 TCTTCAATGC CGGCCTCTTT AACGACGGCT TGTCCACGCT GCAACTGGCA

151 AAATTTTACG CACAATCCAT CATTGAAAGC GGCATCCGAT TCGATATGCT

201 GTTCGGCCCC GCCTACAAAG GCATTATTTT GGCGGCGGCA ACCGCGATGA

251 TGCTGGCGGA AAAAGGCGTG AACGTCCCGT TGCCTACAA CCGCAAAGAA

301 GCCAAAGACC ACGGCGAAGG CGGCGTGTTG GTCGGCGCGC CGCTTAAAGG

351 GCGCGTGCTG ATTATCGACG ACGTGATTTC CGCCGGCACA TCCGTACGCG

401 AATCGATCAA ACTGATTGAA GCGGAGGGTG CAACCCCCGC CGGTGTCGCC

451 ATCGCGCTCG ACCGCATGGA AAAAGGCACG GGTGAATTGA GCGCGGTTCA

501 GGAAGTGGAA AAACAATACG GCCTGCCCGT CGCCCCCATC GCCAGCCTGA
```

-continued

```
551 ACGATTTGTT TATTCTGTTG CAAAACAACC CCGAATTCGG ACAGTTCCTC

601 GAACCCGTCC GAGCCTACCG TCGGCAGTAC GGCGTAGAAT AA
```

This corresponds to the amino acid sequence <SEQ ID 140; ORF 038.a>:

```
a038.pep
  1 MTDFRQDFLK FSLAQNVLKF GEFTTKAGRR SPYFFNAGLF NDGLSTLQLA

51 KFYAQSIIES GIRFDMLFGP AYKGIILAAA TAMMLAEKGV NVPFAYNRKE

101 AKDHGEGGVL VGAPLKGRVL IIDDVISAGT SVRESIKLIE AEGATPAGVA

151 IALDRMEKGT GELSAVQEVE KQYGLPVAPI ASLNDLFILL QNNPEFGQFL

201 EPVRAYRRQY GVE*
``` m038/a038 100.0% identity over a 213 aa overlap

```
                    10         20         30         40         50         60
    m038.pep  MTDFRQDFLKFSLAQNVLKFGEFTTKAGRRSPYFFNAGLFNDGLSTLQLAKFYAQSIIES
              ||||||||||||||||||||||||||||||||||||||||||||||||||||||||||||
    a038      MTDFRQDFLKFSLAQNVLKFGEFTTKAGRRSPYFFNAGLFNDGLSTLQLAKFYAQSIIES
                    10         20         30         40         50         60

70         80         90        100        110        120
    m038.pep  GIRFDMLFGPAYKGIILAAATAMMLAEKGVNVPFAYNRKEAKDHGEGGVLVGAPLKGRVL
              ||||||||||||||||||||||||||||||||||||||||||||||||||||||||||||
    a038      GIRFDMLFGPAYKGIILAAATAMMLAEKGVNVPFAYNRKEAKDHGEGGVLVGAPLKGRVL
                    70         80         90        100        110        120

130        140        150        160        170        180
    m038.pep  IIDDVISAGTSVRESIKLIEAEGATPAGVAIALDRMEKGTGELSAVQEVEKQYGLPVAPI
              ||||||||||||||||||||||||||||||||||||||||||||||||||||||||||||
    a038      IIDDVISAGTSVRESIKLIEAEGATPAGVAIALDRMEKGTGELSAVQEVEKQYGLPVAPI
                   130        140        150        160        170        180

190        200        210
    m038.pep  ASLNDLFILLQNNPEFGQFLEPVRAYRRQYGVEX
              |||||||||||||||||||||||||||||||||
    a038      ASLNDLFILLQNNPEFGQFLEPVRAYRRQYGVEX
                   190        200        210
```

Computer analysis of this amino acid sequence gave the following results:
Homology with a Predicted ORF from *N. gonorrhoeae*
ORF 038 shows 98.1% identity over a 213 aa overlap with a predicted ORF (ORF 038.ng) from *N. gonorrhoeae*:
m038/g038

```
                    10         20         30         40         50         60
    m038.pep  MTDFRQDFLKFSLAQNVLKFGEFTTKAGRRSPYFFNAGLFNDGLSTLQLAKFYAQSIIES
              |||||||||||||||||||||||||||||||||||||||||||| |||||||||||||||
    g038      MTDFRQDFLKFSLAQNVLKFGEFTTKAGRRSPYFFNAGLFNDGASTLQLAKFYAQSIIES
                    10         20         30         40         50         60

70         80         90        100        110        120
    m038.pep  GIRFDMLFGPAYKGIILAAATAMMLAEKGVNVPFAYNRKEAKDHGEGGVLVGAPLKGRVL
              |||||||||||||||||||||||||||||||||||||||||||:||||||||||||||||
    g038      GIRFDMLFGPAYKGIILAAATAMMLAEKGVNVPFAYNRKEAKDRGEGGVLVGAPLKGRVL
                    70         80         90        100        110        120
```

-continued

```
                      130        140        150        160        170        180
    m038.pep   IIDDVISAGTSVRESIKLIEAEGATPAGVAIALDRMEKGTGELSAVQEVEKQYGLPVAPI
               ||||||||||||||||||||||||||||||||||||||||:|||||||||||||||||||
    g038       IIDDVISAGTSVRESIKLIEAEGATPAGVAIALDRMEKGTGKLSAVQEVEKQYGLPVAPI
                      130        140        150        160        170        180
                      190        200        210
    m038.pep   ASLNDLFILLQNNPEFGQFLEPVRAYRRQYGVEX
               |||||||||||||||||||||||||:||||||||
    g038       ASLNDLFILLQNNPEFGQFLEPVRTYRRQYGVEX
                      190        200        210
```

The following partial DNA sequence was identified in *N. gonorrhoeae* <SEQ ID 141>:

```
g039.seq
    1 ATGCCGTCCG AACCACCTGC CGCTTCAGAC GGCATCAAAC CGACACACAC
   51 CGAGAAAACA TCATGCCCGC CTGTTTCTGT CCGCACTGCA AAACCCGCCT
  101 CTGGGTCAAA GAAAcccagC TCAAcgtCgC ccaagGCTTC GTCGTCTgcc
  151 aaAAAtgcga agGGCTgttt aaAgccaaaG accAtctggc aaGcacGAAA
  201 gaacctatat tcaacgattg gcccgaagct gtttcgggat TcaaaCTCGg
  251 TCcaccgcaT cggcacgcac gccattagca aGAaacagat gtcccgcgac
  301 gaaatCgccg atatcctcaa cggcggtaca acCCTGCACG ATACGCCGCC
  351 CGCAACCGCC GCTGCCGCac ctGCCGCCGC ACCGCAggTT TCCGTACCGC
  401 CCGCCCGTCA GGAAGGGCTC AACTGGACTA TTGCAACCCT GTTCGCACTT
  451 ATCGTCCTCA TTATGCAGCT TTCCTACCTC TTCATCCTAT GA
```

This corresponds to the amino acid sequence <SEQ ID 142; ORF 039.ng>:

```
g039.pep
    1 MPSEPPAASD GIKPTHTEKT SCPPVSVRTA KPASGSKKPS STSPKASSSA
   51 KNAKGCLKPK TIWQARKNLY STIGPKLFRD VKLVHRIGTH AISKKQMSRD
  101 EIADILNGGT TLHDTPPATA AAAPAAAPQV SVPPARQEGL NWTIATLFAL
  151 IVLIMQLSYL FIL*
```

The following partial DNA sequence was identified in *N. meningitidis* <SEQ ID 143>:

```
m039.seq
    1 ATGCCGTCCG AACCGCCTTA CGCCTCAGAC GGCATCAAAC CTGACACACA
   51 CGAGGAAATA CCATGCCCGC CTGTTTCTGC CCCCACTGCA AAACCCGTCT
  101 CTGGGTCAAA GAAACCCAAC TCAATGTCGC CGnnnnnnnn nnnnnnnnnn
  151 nnnnnnnnnn nnnnnnnnnn nnnnnnnnnn nnnnnnnnnn nnnnnnnnnn
  201 nnnnnnnnnn nnnnnnnnnn nnnnnnnnnn nnnnnnnCCC GAGGCTGTTT
  251 CGGATGTCAA ACTCGTTCAC CGTATCGGCA CGCGCGCCAT CGGCAAGAAA
  301 CAGATTTCCC GTGACGAAAT CGCCGGCATC CTCAACGGCG GTACAACCCA
  351 GCCCGATATT CCGCCCGCAA CCGCCGCCAC CCCTGCTGCC GCACCGCAGG
  401 TTACCGTACC GCCCGCCGCG CCCGCCCGTC AGGATGGGTT CAACTGGACG
```

```
451 ATTGCAACCC TGTTTGCCCT TATCGTCCTC ATTATGCAGC TTTCCTACCT

501 CGTCATCCTA TGA
```

This corresponds to the amino acid sequence <SEQ ID 144; ORF 039>:

```
m039.pep
   1 MPSEPPYASD GIKPDTHEEI PCPPVSAPTA KPVSGSKKPN SMSPXXXXXX

51 XXXXXXXXXX XXXXXXXXXX XXXXXXXXXP EAVSDVKLVH RIGTRAIGKK

101 QISRDEIAGI LNGGTTQPDI PPATAATPAA APQVTVPPAA PARQDGFNWT

151 IATLFALIVL IMQLSYLVIL *
```

The following partial DNA sequence was identified in *N. meningitidis* <SEQ ID 145>:

```
a039.seq
   1 ATGCCGTCTG AACCGCCTTA CGCCTCAGAC GGCATCAAAC CTGACACACA

51 CGAGGAAATA CCATGCCCGC CTGTTTCTGC CCCCACTGCA AAACCCGTCT

101 CTGGGTCAAA GAAACCCAAC TCAATGTCGC CCAAGGCTTC GTCGTCTGCC

151 AAAAATGCGA AGGAATGTTT AAAGCCAAAG ACCATCTGGC AAGCACGAAA

201 GAACCCATAT TCAACGATT. TGCCCGAAGC TGTTTCGGAT GTCAAACTCG

251 TTCACCGCAT CGGCACGAGC GCCATCGGCA AGAAACAGAT TTCCCGTGAC

301 GAAATCGCCG GCATCCTCAA CGGCGGCACA ACCCAGCCCG ATATTCCGCC

351 CGCAACCGCC GCCACCCCTG CTGCCGCACC GCAGGTTACC GTACCGCCCG

401 CCGCGCCCGC CCGTCAGGAT GGGTTCAACT GGACGATTGC AACCCTGTTT

451 GCCCTTATCG TCCTCATTAT GCAGCTTTCC TACCTCGTCA TCCTATGA
```

This corresponds to the amino acid sequence <SEQ ID 146; ORF 039.a>:

```
a039.pep
   1 MPSEPPYASD GIKPDTHEEI PCPPVSAPTA KPVSGSKKPN SMSPKASSSA

51 KNAKECLKPK TIWQARKNPY STIXPEAVSD VKLVHRIGTS AIGKKQISRD

101 EIAGILNGGT TQPDIPPATA ATPAAAPQVT VPPAAPARQD GFNWTIATLF

151 ALIVLIMQLS YLVIL*
``` m039/a039 79.4% identity over a 170 aa overlap

```
                    10         20         30         40         50         60
    m039.pep   MPSEPPYASDGIKPDTHEEIPCPPVSAPTAKPVSGSKKPNSMSPXXXXXXXXXXXXXXXXX
               |||||||||||||||||||||||||||||||||||||||||||
        a039   MPSEPPYASDGIKPDTHEEIPCPPVSAPTAKPVSGSKKPNSMSPKASSSAKNAKECLKPK
                    10         20         30         40         50         60

70         80         90        100        110        120
    m039.pep   XXXXXXXXXXXXXXXXXXPEAVSDVKLVHRIGTRAIGKKQISRDEIAGILNGGTTQPDI
                 :       : |      ||||||||||||| |||||||||||||||||||||||||
        a039   TIWQARKNPYSTIX-----PEAVSDVKLVHRIGTSAIGKKQISRDEIAGILNGGTTQPDI
                    70         80         90        100        110
```

```
                     130        140        150        160        170
    m039.pep    PPATAATPAAAPQVTVPPAAPARQDGFNWTIATLFALIVLIMQLSYLVILX
                ||||||||||||||||||||||||||||||||||||||||||||||||||
    a039        PPATAATPAAAPQVTVPPAAPARQDGFNWTIATLFALIVLIMQLSYLVILX
                     120        130        140        150        160
```

Computer analysis of this amino acid sequence gave the following results:

Homology with a Predicted ORF from *N. gonorrhoeae*

ORF 039 shows 60.8% identity over a 171 aa overlap with a predicted ORF (ORF 039.ng) from *N. gonorrhoeae*:

```
    m039/g039

10         20         30         40         50         60
    m039.pep    MPSEPPYASDGIKPDTHEEIPCPPVSAPTAKPVSGSKKPNSMSPXXXXXXXXXXXXXXXX
                ||||||  |||||||  |:   |||||: ||||:|||||||:| ||
    g039        MPSEPPAASDGIKPTHTEKTSCPPVSVRTAKPASGSKKPSSTSPKASSSAKNAKGCLKPK
                     10         20         30         40         50         60

70         80         90        100        110        120
    m039.pep    XXXXXXXXXXXXXXXXXXXXPEAVSDVKLVHRIGTRAIGKKQISRDEIAGILNGGTTQPDI
                                     |:  ||||||||||:||:||| |||||| |||||||  |
    g039        TIWQARKNLYSTIG-----PKLFRDVKLVHRIGTHAISKKQMSRDEIADILNGGTTLHDT
                     70         80         90        100        110

130        140        150        160        170
    m039.pep    PPATAAT-PAAAPQVTVPPAAPARQDGFNWTIATLFALIVLIMQLSYLVILX
                ||||||: |||||| :||||    ||:|:||||||||||||||||||| |||
    g039        PPATAAAAPAAAPQVSVPPA---RQEGLNWTIATLFALIVLIMQLSYLFILX
                     120        130        140        150        160
```

The following partial DNA sequence was identified in *N. gonorrhoeae* <SEQ ID 147>:

```
    g040.seq
         1 ATGAACGCGC CCGACAGCTT TGTCGCCCAC TTCCGCGAAG CCGCCCCCTA 51 CATCCGCCAA ATGCGCGGCA CGACACTGGT CGCCGGCATA GAcggCCGCC

101 TGCTCGAAGG CGGCACCTTA AATAAGCTCG CCGCCGACAT CGGGCTGTTG

151 TCGCAACTGG GCATCCGACT CGTCCTCATC CACGGCGCGT ACCACTTCCT

201 CGAccgCCTC GCCGCCGCGC AAGgccGCAC GCCGCATTAT TGCCGgggtt 251 tGCGCGTTAC CGACGaAACc tcGctcgGAC AGGCGCAGCA GtttGCCGGC 301 AccgTCCGCA GCCGTTTTGA agcCGCATTG tgcggcagCG tttcaggatt 351 cgcgCGCGCG CCTTCCGTCC CGCTCGTAtc gggcaacttc ctgacCGCCC 401 GTCcgatggg cgtgattgac ggaACCGata tggaatacgc gggggttatc 451 cgcaaaaccg ACACCGCCGC CCTCCGTTTC CAACTCGACG CGGGCAATAT

501 CGTCTGGATG CCGCCGCTCG GGCATTCCTA CGGCGGCAAA ACCTTCAATC

551 TCGATATGGT GCAGGCCGCC GCTTCCGTCG CCGTCTCGCT TCAGGCCGAA

601 AAACTCGTTT ACCTGACCCT TTCAGACGGC ATTTCCCGCC CCGACGGCAC

651 GCTCGCCGAA ACCCTCTCGG CACAGGAAGC GCAATCGCTG GCGGAACACG

701 CCGCCAGCGA AACCCGACGA CTGATTTCGT CCGCCGTTGC CGCGCTCGAA

751 GGCGGCGTGC ATCGCGTCCA AATCCTCAAC GGGGCCGCCG ACGGCAGCCT

801 GCTGCAAGAA CTCTTCACCC GCAACGGCAT CGGCACGTCC ATTGCCAAAG

851 AAGCCTTCGT CTCCATCCGG CAGGCGCACA GCGGCGACAT CCCGCACATC

901 GCCGCACTCA TCCGCCCGCT GGAAGAACAG GGCGTCCTAT TGCACCGCAG
```

-continued
```
 951 CCGCGAATAC CTCGAAAACC ACATTTCCGA ATTTTCCATC CTCGAACACG

1001 ACGGCGACCT GTACGGCTGT GCCGCACTCA AAACCTTTGC CGAAGCCGAT

1051 TGCGGCGAAA TCGCCTGCCT TGCCGTCTCG CCGCAGGCAC AGGACGGCCGg 1101 ctACGGCGAA CGCCTGCTTG CCCACATTAT CGATAAGGCG CGCGGCATAG

1151 GCATAAGCAG GCTGTTCGCA CTGTCCACAA ATACCGGCGA ATGGTTTGCC

1201 GAACGCGGCT TTCAGACGGC ATCGGAAGAC GAGCTGCCCG AAACGCGGCG

1251 CAAAGACTAC CGCAGCAACG GACGAAACCC GCATATTCTG GTGCGTCGCC

1301 TGCACCGCTG A
```

This corresponds to the amino acid sequence <SEQ ID 148; ORF 040.ng>:

```
g040.pep 1
    1 MNAPDSFVAH FREAAPYIRQ MRGTTLVAGI DGRLLEGGTL NKLAADIGLL

51 SQLGIRLVLI HGAYHFLDRL AAAQGRTPHY CRGLRVTDET SLGQAQQFAG

101 TVRSRFEAAL CGSVSGFARA PSVPLVSGNF LTARPMGVID GTDMEYAGVI

151 RKTDTAALRF QLDAGNIVWM PPLGHSYGGK TFNLDMVQAA ASVAVSLQAE

201 KLVYLTLSDG ISRPDGTLAE TLSAQEAQSL AEHAASETRR LISSAVAALE

251 GGVHRVQILN GAADGSLLQE LFTRNGIGTS IAKEAFVSIR QAHSGDIPHI

301 AALIRPLEEQ GVLLHRSREY LENHISEFSI LEHDGDLYGC AALKTFAEAD

351 CGEIACLAVS PQAQDGGYGE RLLAHIIDKA RGIGISRLFA LSTNTGEWFA

401 ERGFQTASED ELPETRRKDY RSNGRNPHIL VRRLHR*
```

The following partial DNA sequence was identified in *N. meningitidis* <SEQ ID 149>:

```
m040.seq
    1 ATGAGCGCGC CCGACCTCTT TGTCGCCCAC TTCCGCGAAG CCGTCCCCTA

51 CATCCGCCAA ATGCGCGGCA AAACGCTGGT CGCCGGCATA GACGACCGCC

101 TGCTCGAAGG TGATACCTTA AACAAGCTCG CCGCCGACAT CGGGCTGTTG

151 TCGCAACTGG GCATCAGGCT CGTCCTCATC CACGGCGCGC GCCACTTCCT

201 CGACCGCCAC GCCGCCGCTC AAGGCCGCAC GCCGCATTAT TGCCGGGGCT

251 TGCGCGTTAC CGACGAAACC TCGCTCGAAC AGGCGCAgCA GTTTGCCGGC

301 ACCGTCCGCA GCCGTTTTGA AGCCGCATTG TGCGGCAGCG TTTCCGGGTT

351 CGCGCGCGCG CCTTCCGTCC CGCTCGTATC GGGCAACTTC CTGACCGCCC

401 GTCCGATAGG TGTGATTGAC GGAACCGATA TGGAATACGC GGGCGTTATC

451 CGCAAAACCG ACACCGCCGC CCTCCGTTTC CAACTCGACG CGGGCAATAT

501 CGTCTGGCTG CCGCCGCTCG GACATTCCTA CAGCGGCAAG ACCTTCTATC

551 TCGATATGCT TCAAACCGCC GCCTCCGCCG CCGTCTCGCT TCAGGCCGAA

601 AAACTCGTTT ACCTGACCCT TTCAGACGGC ATTTCCCGCC CCGACGGCAC

651 GCTCGCCGAA ACCCTCTCGG CACAGGAAGC GCAATCGCTG GCGGAACACG

701 CCGGCGGGCA AACGCGACGG CTGATTTCGT CCGCCGAACT CTTCACCCGC

751 AACGGCATCG GCACGTCCAT TGCCAAAGAA GCCTTCGTCT CCATCCGGCA 801 rGCGCAywgG G.CGACATCC CGCACATCGC CGCCCTCATC CGCCCGCTGG
```

```
 851 AAGAACAGGG CATCCTGCTG CACCGCAs.c GCGAATACCT CGAAAACCAC

901 ATTTCCGAAT TTTCCATCCT CGAACACGAC GGCAACCTGT ACGGTTGCGC

951 CGCCCTGAAA ACCTTTGCCG AAGCCGATTG CGGCGAAATC GCCTGCCTTG

1001 CCGTCTCGCC GCag.cACAG GACGGCGGCT ACGGCGAACG CnTGCTTGCC

1051 CACATTATCG ATAAGGCGCG CGGCATAGGC ATAAGCAGGC TGTTCGCACT

1101 GTCCACAAAT ACCGGCGAAT GGTTTGCCGA ACGCGGCTTT CAGACGGCAT

1151 CGGAAGACGA GTTGCCCGAA ACGCGGCGCA AAGACTACCG CAGCAACGGA

1201 CGGAACTCGC ATATTCTGGT ACGTCGCCTG CACCGCTGA
```

This corresponds to the amino acid sequence <SEQ ID 150; ORF 040>:

```
m040.pep
  1 MSAPDLFVAH FREAVPYIRQ MRGKTLVAGI DDRLLEGDTL NKLAADIGLL

51 SQLGIRLVLI HGARHFLDRH AAAQGRTPHY CRGLRVTDET SLEQAQQFAG

101 TVRSRFEAAL CGSVSGFARA PSVPLVSGNF LTARPIGVID GTDMEYAGVI

151 RKTDTAALRF QLDAGNIVWL PPLGHSYSGK TFYLDMLQTA ASAAVSLQAE

201 KLVYLTLSDG ISRPDGTLAE TLSAQEAQSL AEHAGGQTRR LISSAELFTR

251 NGIGTSIAKE AFVSIRQAHX XDIPHIAALI RPLEEQGILL HRXREYLENH

301 ISEFSILEHD GNLYGCAALK TFAEADCGEI ACLAVSPQXQ DGGYGERXLA

351 HIIDKARGIG ISRLFALSTN TGEWFAERGF QTASEDELPE TRRKDYRSNG

401 RNSHILVRRL HR*
```

The following partial DNA sequence was identified in *N. meningitidis* <SEQ ID 151>:

```
a040.seq
    1 ATGATCGTGC CCGACCTCTT TGTCGCCCAC TTCCGCGAAG CCGCCCCTA

51 CATCCGCCAA ATGCGCGGCA AAACGCTGGT CGCCGGCATA GACGACCGCC

101 TGCTCGAAGG TGATACCTTA AACAAGTTCG CCGCCGACAT CGGGCTTTTG

151 TCGCAACTGG GCATCAGGCT CGTCCTCATC CACGGCGCGC GCCACTTCCT

201 CGACCGCCAC GCCGCCGCGC AAGGCCGCAC GCCGCATTAT TGCCGGGGCT

251 TGCGCGTTAC CGACGAAACC TCGCTCGAAC AGGCGCAGCA GTTTGCCGGC

301 ACCGTCCGCA GCCGTTTTGA AGCCGCATTG TGCGGCAGCG TTTCCGGGTT

351 CGCGCGCGCG CCTTCCGTCC CGCTCGTATC GGGCAACTTC CTGACCGCCC

401 GTCCGATAGG TGTGATTGAC GGAACCGATA TGGAATACGC GGGCGTTATC

451 CGCAAAACCG ACACCGCCGC CCTCCGTTTC CAACTCGACG CGGGCAATAT

501 CGTCTGGCTG CCGCCGCTCG GACATTCCTA CAGCGGCAAG ACCTTCCATC

551 TCGATATGCT TCAAACCGCC GCCTCCGTCG CCGTCTCGCT TCAGGCCGAA

601 AAACTCGTTT ACCTGACCCT TTCAGACGGC ATTTCCCGCC CCGACGGCAC

651 GCTCGCCGTA ACCCTCTCGG CACAGGAAGC GCAATCGCTG GCGGAACACG

701 CCGGCGGCGA AACGCGACGG CTGATTTCGT CCGCCGTTGC CGCGCTCGAA

751 GGCGGCGTGC ATCGCGTCCA AATCCTCAAC GGAGCCGCCG ACGGCAGCCT

801 GCTGCAAGAA CTCTTCACCC GCAACGGCAT CGGCACGTCC ATTGCCAAAG
```

```
-continued
 851 AAGCCTTCGT CTCCATCCGG CAGGCGCACA GCGGCGACAT CCCGCACATT

901 GCCGCCCTCA TCCGCCCGCT GGAAGAACAG GGCATCCTGC TGCACCGCAG

951 CCGCGAATAC CTCGAAAACC ACATTTCCGA ATTTTCCATC CTCGAACACG

1001 ACGGCAACCT GTACGGTTGC GCCGCCCTGA AAACCTTTGC CGAAGCCGAT

1051 TGCGGCGAAA TCGCCTGCCT TGCCGTCTCG CCGCAGGCAC AGGACGGCGG

1101 CTACGGCGAA CGCCTGCTTG CCCACATTAT CGATAAGGCG CGCGGCATAG

1151 GCATAAGCAG GCTGTTCGCA CTGTCCACAA ATACCGGCGA ATGGTTTGCC

1201 GAACGCGGCT TTCAGACGGC ATCGGAAGAC GAGTTGCCCG AAACGCGGCG

1251 CAAAGACTAC CGCAGCAACG GACGGAACTC GCATATTCTG GTGCGTCGCC

1301 TGCACCGCTG A
```

This corresponds to the amino acid sequence <SEQ ID 152; ORF 040.a>:

```
a040.pep

1 MIVPDLFVAH FREAAPYIRQ MRGKTLVAGI DDRLLEGDTL NKFAADIGLL

51 SQLGIRLVLI HGARGFLDRH AAAQGRTPHY CRGLRVTDET SLEQAQQFAG

101 TVESRFEAAL CGSVSGFARA PSVPLVSGNF LTARPIGVID GTDMEYAGVI

151 RKTDTAALRF QLDAGNIVWL PPLGHSYSGK TFHLDMLQTA ASVAVSLQAE

201 KLVYLTLSDG ISRPDGTLAV TLSAQEAQSL AEHAGGETRR LISSAVAALE

251 GGVHRVQILN GAADGSLLQE LFTRNGIGTS IAKEAFVSIR QAHSGDIPHI

301 AALIRPLEEQ GILLHRSREY LENHISEFSI LEHDGNLYGC AALKTFAEAD

351 CGEIACLAVS PQAQDGGYGE RLLAHIIDKA RGIGISRLFA LSTNTGEWFA

401 ERGFQTASED ELPETRRKDY RSNGRNSHIL VRRLHR* m040/a040 91.5% identity in 436 aa overlap 10         20         30         40         50         60
   m040.pep    MSAPDLFVAHFREAVPYIRQMRGKTLVAGIDDRLLEGDTLNKLAADIGLLSQLGIRLVLI
               | :||||||||||:||||||||||||||||||||||||||||:|||||||||||||||||
       a040    MIVPDLFVAHFREAAPYIRQMRGKTLVAGIDDRLLEGDTLNKFAADIGLLSQLGIRLVLI
               10         20         30         40         50         60

70         80         90        100        110        120
   m040.pep    HGARHFLDRHAAAQGRTPHYCRGLRVTDETSLEQAQQFAGTVRSRFEAALCGSVSGFARA
               ||||||||||||||||||||||||||||||||||||||||||||||||||||||||||||
       a040    HGARHFLDRHAAAQGRTPHYCRGLRVTDETSLEQAQQFAGTVRSRFEAALCGSVSGFARA
               70         80         90        100        110        120

130        140        150        160        170        180
   m040.pep    PSVPLVSGNFLTARPIGVIDGTDMEYAGVIRKTDTAALRFQLDAGNIVWLPPLGHSYSGK
               ||||||||||||||||||||||||||||||||||||||||||||||||||||||||||||
       a040    PSVPLVSGNFLTARPIGVIDGTDMEYAGVIRKTDTAALRFQLDAGNIVWLPPLGHSYSGK
              130        140        150        160        170        180

190        200        210        220        230        240
   m040.pep    TFYLDMLQTAASAAVSLQAEKLVYLTLSDGISRPDGTLAETLSAQEAQSLAEHAGGQTRR
               ||:|||||||||:|||||||||||||||||||||||||||| ||||||||||||||:|||
       a040    TFHLDMLQTAASVAVSLQAEKLVYLTLSDGISRPDGTLAVTLSAQEAQSLAEHAGGETRR
              190        200        210        220        230        240

250        260        270
   m040.pep    LISSA----------------------ELFTRNGIGTSIAKEAFVSIRQAHXXDIPHI
               |||||                      |||||||||||||||||||||||||  |||||
       a040    LISSAVAALEGGVHRVQILNGAADGSLLQELFTRNGIGTSIAKEAFVSIRQAHSGDIPHI
              250        260        270        280        290        300
```

```
                280       290       300       310       320       330
m040.pep    AALIRPLEEQGILLHRXREYLENHISEFSILEHDGNLYGCAALKTFAEADCGEIACLAVS
            ||||||||||||||| |||||||||||||||||||||||||||||||||||||||||||
a040        AALIRPLEEQGILLHRSREYLENHISEFSILEHDGNLYGCAALKTFAEADCGEIACLAVS
                310       320       330       340       350       360

340       350       360       370       380       390
m040.pep    PQXQDGGYGERXLAHIIDKARGIGISRLFALSTNTGEWFAERGFQTASEDELPETRRKDY
            || ||||||||| ||||||||||||||||||||||||||||||||||||||||||||||
a040        PQAQDGGYGERLLAHIIDKARGIGISRLFALSTNTGEWFAERGFQTASEDELPETRRKDY
                370       380       390       400       410       420

400       410
m040.pep    RSNGRNSHILVRRLHRX
            |||||||||||||||||
a040        RSNGRNSHILVRRLHRX
                430
```

Computer analysis of this amino acid sequence gave the following results:

Homology with a Predicted ORF from *N. gonorrhoeae*

ORF 040 shows 88.3% identity over a 436 aa overlap with a predicted ORF (ORF 040.ng) from *N. gonorrhoeae*:

```
m040/g040 m040.pep    MSAPDLFVAHFREAVPYIRQMRGKTLVAGIDDRLLEGDTLNKLAADIGLLSQLGIRLVLI    60
            |:||| ||||||||: ||||||||| |||||||| ||||| |||||||||||||||||||
g040        MNAPDSFVAHFREAAPYIRQMRGTTLVAGIDGRLLEGGTLNKLAADIGLLSQLGIRLVLI    60
m0404.pep   HGARHFLDRHAAAQGRTPHYCRGLRVTDETSLEQAQQFAGTVRSRFEAALCGSVSGFARA   120
            ||| ||||| ||||||||||||||||||||||| ||||||||||||||||||||||||||
g040        HGAYHFLDRLAAAQGRTPHYCRGLRVTDETSLGQAQQFAGTVRSRFEAALCGSVSGFARA   120
m040.pep    PSVPLVSGNFLTARPIGVIDGTDMEYAGVIRKTDTAALRFQLDAGNIVWLPPLGHSYSGK   180
            ||||||||||||||| |||||||||||||||||||||||||||||||| |||||||:||
g040        PSVPLVSGNFLTARPMGVIDGTDMEYAGVIRKTDTAALRFQLDAGNIVWMPPLGHSYGGK   180
m040.pep    TFYLDMLQTAASAAVSLQAEKLVYLTLSDGISRPDGTLAETLSAQEAQSLAEHAGGQTRR   240
            || |||:|:|||:||||||||||||||||||||||||||||||||||||||:::|||
g040        TFNLDMVQAAASVAVSLQAEKLVYLTLSDGISRPDGTLAETLSAQEAQSLAEHAASETRR   240
m040.pep    LISSA-----------------------ELFTRNGIGTSIAKEAFVSIRQAHXXDIPHI   276
            |||||                        |||||||||||||||||||||||| |||||
g040        LISSAVAALEGGVHRVQILNGAADGSLLQELFTRNGIGTSIAKEAFVSIRQAHSGDIPHI   300
m040.pep    AALIRPLEEQGILLHRXREYLENHISEFSILEHDGNLYGCAALKTFAEADCGEIACLAVS   336
            |||||||||||:|||| |||||||||||||||:|||||||||||||||||||||||||||
g040        AALIRPLEEQGVLLHRSREYLENHISEFSILEHDGDLYGCAALKTFAEADCGEIACLAVS   360
m040.pep    PQXQDGGYGERXLAHIIDKARGIGISRLFALSTNTGEWFAERGFQTASEDELPETRRKDY   396
            || ||||||||| ||||||||||||||||||||||||||||||||||||||||||||||
g040        PQAQDGGYGERLLAHIIDKARGIGISRLFALSTNTGEWFAERGFQTASEDELPETRRKDY   420
m040.pep    RSNGRNSHILVRRLHRX   413
            |||||| |||||||||||
g040        RSNGRNPHILVRRLHRX   437
```

The following partial DNA sequence was identified in *N. gonorrhoeae* <SEQ ID 153>:

```
g041.seq
  1 ATGAGTTCGC CCAAACACAT CGGCTTGCAG GGCGGCAGCA ACGGCGGCCT

51 GATTACCGCC GCCGCCTTCG TGCGCGAACC GCAAAGCATC GGTGCGCTGG

101 TGTGCGAAGT ACCGCTGACC GATATGATCC GTTATCCGCT GCTGTCCGCC

151 GGTTCAAGTT GGACGGACGA ATACGGCAAT CCGCAGAAAT ACGAAGCCTG

201 CAAACGCCGG CTGGGCGAAT TGTCGCCGTA TCACAATCTT TCAGACGGCA
```

-continued

```
251 TCGATTATCC GCCCGCACTC ATTACCACCA GCCTCAGCGA CGACCGCGTC

301 CATCCCGCCC ACGCGCTCAA ATTCTACGCC AAACTGCGCG AAACCTCGCC

351 GCAATCTTGG CTCTACTCGC CTGACGGCGG CGGCCATACC GGCAACGGCA

401 CCCAACGCGA ATCCGCCGAC AAACTCGCCT GCGTGTTGCT GTTTTTGAAA

451 GAATTTTTGG GATAA
```

This corresponds to the amino acid sequence <SEQ ID 154; ORF 041.ng>:

```
g041.pep
    1 MSSPKHIGLQ GGSNGGLITA AAFVREPQSI GALVCEVPLT DMIRYPLLSA

51 GSSWTDEYGN PQKYEACKRR LGELSPYHNL SDGIDYPPAL ITTSLSDDRV

101 HPAHALKFYA KLRETSPQSW LYSPDGGGHT GNGTQRESAD KLACVLLFLK

151 EFLG*
```

The following partial DNA sequence was identified in *N. meningitidis* <SEQ ID 155>:

```
m041.seq
    1 ATCAGTTCGC CCGAACACAT CGGCTTGCAG GGCGGCAGCA ACGGCGGACT

51 GATTACTGCC GCCGCCTTCG TGCGCGAACC GCAAAGCATC GGCGCGCTGG

101 TGTGCGAAGT GCCGCTGACC GACATGATCC GTTATCCGCT GCTCTCCGCC

151 GGTTCAAGCT GGACAGACGA ATACGGCAAT CCGCAAAAAT ACGAAGTCTG

201 CAAACGCCGG TTGGGCGAAT TGTCGCCGTA TCACAATCTT TCAGACGGCA

251 TCGATTATCC GCCCGCGCTC ATTACCACCA GCCTGTCCGA CGATCGCGTC

301 CATCCCGCCC ACGCGCTCAA GTTCTACGCC AAACTGCGCG AAACCTCCGC

351 GCAATCTTGG CTCTACTCGC CTGACGGCGG CGGCCATACC GGCAACGGCA

401 CCCAACGCGA ATCCGCCGAC GAACTCGCCT GCGTCTTGCT GTTTTTGAAA

451 GAGTTTTTGG GCTAA
```

This corresponds to the amino acid sequence <SEQ ID 156; ORF 041>:

```
m041.pep
    1 ISSPEHIGLQ GGSNGGLITA AAFVREPQSI GALVCEVPLT MIRYPLLSAD

51 GSSWTDEYGN PQKYEVCKRR LGELSPYHNL SDGIDYPPAL ITTSLSDDRV

101 HPAHALKFYA KLRETSAQSW LYSPDGGGHT GNGTQRESAD ELACVLLFLK

151 EFLG*
```

The following partial DNA sequence was identified in *N. meningitidis* <SEQ ID 157>:

```
a041.seq
    1 ATCAGTTCGC CCGAACACAT CGGCTTGCAG GGCGGCAGCA ACGGCGGACT

51 GATTACTGCC GCCGCCTTCG TGCGCGAACC GCAAAGCATA GGCGCGCTGG

101 TGTGCGAAGT GCCGCTGACC GACATGATCC GTTATCCGCT GCTCTCCGCC

151 GGTTCAAGCT GGACAGACGA ATACGGCAAT CCGCAAAAAT ACGAAGTCTG
```

```
-continued
201 CAAACGCCGG TTGGGCGAAT TGTCGCCGTA TCACAATCTT TCAGACGGCA

251 TCGATTATCC GCCCGCGCTC ATTACCACCA GCCTGTCCGA CGATCGCGTC

301 CATCCCGCCC ACGCGCTCAA GTTCTACGCC AAACTGCGCG AAACCTCGCC

351 GCAATCTTGG CTCTACTCGC CTGACGGCGG CGGCCATACC GGCAACGGCA

401 CGCAGCGCGA AGCCGCCGAC GAACTCGCCT GCGTGTTGCT GTTTTTGAAA

451 GAGTTTTTGG GCTAA
```

This corresponds to the amino acid sequence <SEQ ID 158; ORF 041.a>:

```
a041.pep
  1 ISSPEHIGLQ GGSNGGLITA AAFVREPQSI GALVCEVPLT DMIRYPLLSA

51 GSSWTDEYGN PQKYEVCKRR LGELSPYHNL SDGIDYPPAL ITTSLSDDRV

101 HPAHALKFYA KLRETSPQSW LYSPDGGGHT GNGTQREAAD ELACVLLFLK

151 EFLG*
``` m041/a041 98.7% identity over a 154 aa overlap

```
                 10         20         30         40         50         60
    m041.pep  ISSPEHIGLQGGSNGGLITAAAFVREPQSIGALVCEVPLTDMIRYPLLSAGSSWTDEYGN
              ||||||||||||||||||||||||||||||||||||||||||||||||||||||||||||
    a041      ISSPEHIGLQGGSNGGLITAAAFVREPQSIGALVCEVPLTDMIRYPLLSAGSSWTDEYGN
                 10         20         30         40         50         60

70         80         90        100        110        120
    m041.pep  PQKYEVCKRRLGELSPYHNLSDGIDYPPALITTSLSDDRVHPAHALKFYAKLRETSAQSW
              |||||||||||||||||||||||||||||||||||||||||||||||||||||||| |||
    a041      PQKYEVCKRRLGELSPYHNLSDGIDYPPALITTSLSDDRVHPAHALKFYAKLRETSPQSW
                 70         80         90        100        110        120

130        140        150
    m041.pep  LYSPDGGGHTGNGTQRESADELACVLLFLKEFLGX
              |||||||||||||||||||:|||||||||||||||
    a041      LYSPDGGGHTGNGTQREAADELACVLLFLKEFLGX
                130        140        150
```

Computer analysis of this amino acid sequence gave the following results:

Homology with a Predicted ORF from *N. gonorrhoeae*

ORF 041 shows 96.8% identity over a 154 aa overlap with a predicted ORF (ORF 041.ng) from *N. gonorrhoeae*:

```
    m041/g041

10         20         30         40         50         60
    m041.pep  ISSPEHIGLQGGSNGGLITAAAFVREPQSIGALVCEVPLTDMIRYPLLSAGSSWTDEYGN
              :|||:|||||||||||||||||||||||||||||||||||||||||||||||||||||||
    g041      MSSPKHIGLQGGSNGGLITAAAFVREPQSIGALVCEVPLTDMIRYPLLSAGSSWTDEYGN
                 10         20         30         40         50         60

70         80         90        100        110        120
    m041.pep  PQKYEVCKRRLGELSPYHNLSDGIDYPPALITTSLSDDRVHPAHALKFYAKLRETSAQSW
              |||||:||||||||||||||||||||||||||||||||||||||||||||||||| |||
    g041      PQKYEACKRRLGELSPYHNLSDGIDYPPALITTSLSDDRVHPAHALKFYAKLRETSPQSW
                 70         80         90        100        110        120

130        140        150
    m041.pep  LYSPDGGGHTGNGTQRESADELACVLLFLKEFLGX
              |||||||||||||||||||||:|||||||||||||
    g041      LYSPDGGGHTGNGTQRESADKLACVLLFLKEFLGX
                130        140        150
```

The following partial DNA sequence was identified in *N. gonorrhoeae* <SEQ ID 159>:

```
g041-1.seq
    1 ATGAAATCCT ACCCCGACCC CTACCGCCAT TTTGAAAACC TCGATTCCGC
   51 CGAAACGCAA AACTTCGCTG CTGAAGCGAA TGCCGAAACG CGCGCGCGTT
  101 TTTTAAACAA CGACAAGGCG CGCGCACTTT CAGACGGCAT TTTGAATCAA
  151 ATGCAGGACA CGCGGCAGAT TCCGTTTTGT CAGGAACACC GCGCGCGGAT
  201 GTACCATTTC CATCAGAATG CGGAATATCC GAAGGGCGTG TACCGCATGT
  251 GTACGGCGGC GACCTACCGT TCCGGCTATC CCGAGTGGAA AATCCTGTTT
  301 TCGGTGGCGG ATTTCGATGA GTTGCTCGGC GACGATGTGT ATTTGGGCGG
  351 CGTGTCGCAC TTGGTGGAGC AGCCCAACCG CGCGCTGCTG ACTTTGAACA
  401 AATCGGGCGG CGATACGGCG TATACGCTGG AAGTGGATTT GGAAGCAGGG
  451 GAATTGGTAG AGGGCGGTTT TCACTTTCCG GCAGGCAAAA ACCATGTGTC
  501 GTGGCGCGAT GAAAACAGCG TGTGGGTGTG TCCGGCTTGG GACGAACGCC
  551 AGTTGACCGA ATCGGGCTAT CCGCGCGAAG TGTGGCTGGT GGAACGCGGC
  601 AAGAGTTTCG AGGAAAGCCT GCCGGCGTAC CAAATCGATA AAGGCGCGAT
  651 GATGGTAAAC GCGTGGCGTT ACCTCGATCC GCAGGGTTCG CCGATTGATT
  701 TGATTGAAGC GTCGGACGGT TTTTACACCA AGACGTATTT GCAGGTGTCG
  751 TCCGAAGGCG GGGCGAAACC GTTGAACCTG CCTAATGATT GCGATGTGGT
  801 CGGCTATCTG GCGGGACATC TTTTGCTGAC GCTGCGCAAG GACTGGCACC
  851 GCGCGAACCA AAGCTATCCG AGTGGCGCGT TGGTGGCGGT GAAACTGAAT
  901 CGGGGCGAAC TCGGGGCGGC GCAGCTTTTG TTTGCGCCCG ATGAAACGCA
  951 GGCATTGGAA AGCGTGGAAA CGACCAAGCG TTTTGTGGTG GCAAGCCTGC
 1001 TGGAGAATGT ACAAGGCCGT CTGAAAGCGT GGCGGTTTGC CGACAGCAAA
 1051 TGGCAGGAAG CCGAGTTGCC GCACCTGCCC TCGGGCGCGT TGGAAATGAC
 1101 CGACCAACCG TGGGGCGGCG ACGTGGTTTA TCTTGCCGCC AGCGATTTCA
 1151 CCACGCCGCT GACGCTGTTT GCGCTGGATT TGAACGTGAT GGAACTGACC
 1201 GTCATGCGCC TCCAGCCGCA GCAGTTTGTT TCAGACGGCA TCGAAGTGCG
 1251 GCAGTTTTGG GCGGTGTCGT CCGACGGCGA ACGCATTCCT TATTTCCACG
 1301 TCGGCAAAAA CGCCGCGCCC GACACGCCGA CCTTAGTCTA TGCTTACGGA
 1351 GGTTTCGGCA TTCCTGAATT GCCGCATTAT CTGGGCAGCG TCGGCAAATA
 1401 TTGGCTGGAA GAGGGCAATG CCTTTGTATT GGCAAACATC CGCGGCGGCG
 1451 GAGAATTCGG CCCGCGCTGG CATCAGGCGG CGCAGGGAAT CAGCAAACAC
 1501 AAAAGCGTTG ATGATTTGTT GGCAGTCGTG CGTGATTTGT CCGAACGCGG
 1551 CATGAGTTCG CCCAAACACA TCGGCTTGCA GGGCGGCAGC AACGGCGGCC
 1601 TGATTACCGC CGCCGCCTTC GTGCGCGAAC CGCAAAGCAT CGGTGCGCTG
 1651 GTGTGCGAAG TACCGCTGAC CGATATGATC CGTTATCCGC TGCTGTCCGC
 1701 CGGTTCAAGT TGGACGGACG AATACGGCAA TCCGCAGAAA TACGAAGCCT
 1751 GCAAACGCCG GCTGGGCGAA TTGTCGCCGT ATCACAATCT TTCAGACGGC
 1801 ATCGATTATC CGCCCGCACT CATTACCACC AGCCTCAGCG ACGACCGCGT
 1851 CCATCCCGCC CACGCGCTCA AATTCTACGC CAAACTGCGC GAAACCTCGC
 1901 CGCAATCTTG GCTCTACTCG CCTGACGGCG GCGGCCATAC CGGCAACGGC
```

-continued

```
1951 ACCCAACGCG AATCCGCCGA CAAACTCGCC TGCGTGTTGC TGTTTTTGAA

2001 AGAATTTTTG GGATAA
```

This corresponds to the amino acid sequence <SEQ ID 160; ORF 041-1.>:

```
g041-1.pep
   1 MKSYPDPYRH FENLDSAETQ NFAAEANAET RARFLNNDKA RALSDGILNQ

51 MQDTRQIPFC QEHRARMYHF HQNAEYPKGV YRMCTAATYR SGYPEWKILF

101 SVADFDELLG DDVYLGGVSH LVEQPNRALL TLNKSGGDTA YTLEVDLEAG

151 ELVEGGFHFP AGKNHVSWRD ENSVWVCPAW DERQLTESGY PREVWLVERG

201 KSFEESLPAY QIDKGAMMVN AWRYLDPQGS PIDLIEASDG FYTKTYLQVS

251 SEGGAKPLNL PNDCDVVGYL AGHLLLTLRK DWHRANQSYP SGALVAVKLN

301 RGELGAAQLL FAPDETQALE SVETTKRFVV ASLLENVQGR LKAWRFADSK

351 WQEAELPHLP SGALEMTDQP WGGDVVYLAA SDFTTPLTLF ALDLNVMELT

401 VMRLQPQQFV SDGIEVRQFW AVSSDGERIP YFHVGKNAAP DTPTLVYAYG

451 GFGIPELPHY LGSVGKYWLE EGNAFVLANI RGGGEFGPRW HQAAQGISKH

501 KSVDDLLAVV RDLSERGMSS PKHIGLQGGS NGGLITAAAF VREPQSIGAL

551 VCEVPLTDMI RYPLLSAGSS WTDEYGNPQK YEACKRRLGE LSPYHNLSDG

601 IDYPPALITT SLSDDRVHPA HALKFYAKLR ETSPQSWLYS PDGGGHTGNG

651 TQRESADKLA CVLLFLKEFL G*
```

The following partial DNA sequence was identified in *N. meningitidis* <SEQ ID 161>:

```
m041-1.seq
   1 ATGAAATCCT ACCCCGACCC CTACCGCCAT TTTGAAAACC TCGATTCCGC

51 CGAAACGCAA AACTTCGCTG CTGAAGCGAA TGCCGAAACG CGCGCGCGTT

101 TTTTAGAAAA CGACAAGGCG CGCGCGCTTT CAGACGGCAT TTTGGCGCAG

151 TTGCAGGACA CGCGGCAGAT TCCGTTTTGT CAGGAACACC GCGCGCGGAT

201 GTACCATTTC CATCAGGACG CGGAGTATCC GAAGGGCGTG TACCGCGTGT

251 GTACCGCGGC GACGTATCGT TCCGGCTATC CGAGTGGAA ATCCTGTTT

301 TCGGTGGCGG ATTTCGACGA ATTGCTTGGC GACGATGTGT ATTTGGGCGG

351 CGTGTCGCAC TTGGTGGAAC AGCCCAACCG CGCGTTGTTA ACACTGAGCA

401 AATTGGGCAG CGATACGGCG TACACGCTGG AAGTGGATTT GGAAGCAGGG

451 GAGTTGGTCG AAGGCGGTTT TCACTTTCCG GCAGGCAAAA ACCATGTGTC

501 GTGGCGCGAT GAAACAGCG TGTGGGTGTG TCCGGCTTGG AACGAACGCC

551 AGTTGACCCA ATCGGGCTAT CCGCGCGAAG TATGGCTGGT GGAACGCGGC

601 AAGAGTTTCG AGGAAAGCCT GCCTGTGTAT CAAATCGGCG AAGACGGCAT

651 GATGGTGAAC GCGTGGCGTT ATCTCGATCC GCAGGGTTCG CCGATTGATT

701 TGATTGAAGC GTCGGACGGT TTTTACACCA AAACCTATTT GCGGGTCTCA

751 GCCGAAGGCG AGGCGAAACC GTTAAACCTG CCCAACGATT GCGACGTGGT

801 CGGCTATCTG GCGGGGCATC TTTTGCTGAC GCTGCGCAAG GACTGGAACC

851 GCGCGAACCA AAGCTATCCG AGCGGCGCGC TGGTGGCGGT GAAGCTGAAT
```

```
 901 CGGGGCGAAC TCGGGGCGGC GCAGCTTTTG TTTGCGCCCG ATGAAACGCA

951 GGCATTGGAA AGCGTGGAAA CGACCAAGCG TTTTGTGGTG GCGAGCCTGT

1001 TGGAGAACGT ACAAGGCCGT CTGAAAGCAT GGCGGTTTGC CGACGGCAAA

1051 TGGCAGGAAG TCGAATTGCC GCGCCTGCCT TCGGGCGCGT GGAAATGAC

1101 CGACCAACCT TGGGGCGGCG ACGTGGTTTA CCTTGCCGCC AGCGATTTCA

1151 CCACGCCGCT GACGCTGTTT GCGCTGGATT TGAACGTGAT GGAACTGACC

1201 GTCATGCGCC GCCAGCCGCA GCAGTTTGAT TCAGACGGCA TTAACGTGCA

1251 GCAGTTTTGG ACGACTTCGG CTGACGGCGA GCGCATTCCT TATTTCCACG

1301 TCGGCAAAAA CGCCGCGCCC GACATGCCGA CGCTGGTCTA TGCCTACGGC

1351 GGTTTCGGCA TTCCCGAATT GCCGCATTAT CTGGGCAGCA TTGGCAAATA

1401 TTGGCTGGAA GAGGGCAATG CCTTTGTATT GGCGAACATC CGCGGCGGCG

1451 GCGAGTTCGG CCCGCGCTGG CATCAGGCGG CGCAGGGAAT CAGCAAACAT

1501 AAAAGCGTTG ATGATTTATT GGCAGTCGTG CGCGATTTGT CCGAACGCGG

1551 TATCAGTTCG CCCGAACACA TCGGCTTGCA GGGCGGCAGC AACGGCGGAC

1601 TGATTACTGC CGCCGCCTTC GTGCGCGAAC CGCAAAGCAT CGGCGCGCTG

1651 GTGTGCGAAG TGCCGCTGAC CGACATGATC CGTTATCCGC TGCTCTCCGC

1701 CGGTTCAAGC TGGACAGACG AATACGGCAA TCCGCAAAAA TACGAAGTCT

1751 GCAAACGCCG GTTGGGCGAA TTGTCGCCGT ATCACAATCT TTCAGACGGC

1801 ATCGATTATC CGCCCGCGCT CATTACCACC AGCCTGTCCG ACGATCGCGT

1851 CCATCCCGCC CACGCGCTCA AGTTCTACGC CAAACTGCGC GAAACCTCCG

1901 CGCAATCTTG GCTCTACTCG CCTGACGGCG GCGGCCATAC CGGCAACGGC

1951 ACCCAACGCG AATCCGCCGA CGAACTCGCC TGCGTCTTGC TGTTTTTGAA

2001 AGAGTTTTTG GGCTAA
```

This corresponds to the amino acid sequence <SEQ ID 162; ORF 041-1>:

```
m041-1.pep

1 MKSYPDPYRH FENLDSAETQ NFAAEANAET RARFLENDKA RALSDGILAQ

51 LQDTRQIPFC QEHRARMYHF HQDAEYPKGV YRVCTAATYR SGYPEWKILF

101 SVADFDELLG DDVYLGGVSH LVEQPNRALL TLSKLGSDTA YTLEVDLEAG

151 ELVEGGFHFP AGKNHVSWRD ENSVWVCPAW NERQLTQSGY PREVWLVERG

201 KSFEESLPVY QIGEDGMMVN AWRYLDPQGS PIDLIEASDG FYTKTYLRVS

251 AEGEAKPLNL PNDCDVVGYL AGHLLLTLRK DWNRANQSYP SGALVAVKLN

301 RGELGAAQLL FAPDETQALE SVETTKRFVV ASLLENVQGR LKAWRFADGK

351 WQEVELPRLP SGALEMTDQP WGGDVVYLAA SDFTTPLTLF ALDLNVMELT

401 VMRRQPQQFD SDGINVQQFW TTSADGERIP YFHVGKNAAP DMPTLVYAYG

451 GFGIPELPHY LGSIGKYWLE EGNAFVLANI RGGGEFGPRW HQAAQGISKH

501 KSVDDLLAVV RDLSERGISS PEHIGLQGGS NGGLITAAAF VREPQSIGAL

551 VCEVPLTDMI RYPLLSAGSS WTDEYGNPQK YEVCKRRLGE LSPYHNLSDG

601 IDYPPALITT SLSDDRVHPA HALKFYAKLR ETSAQSWLYS PDGGGHTGNG

651 TQRESADELA CVLLFLKEFL G*
```

-continued m041-1/g041-1 94.6% identity in 671 aa overlap

```
                   10        20        30        40        50        60
m041-1.pep MKSYPDPYRHFENLDSAETQNFAAEANAETRARFLENDKARALSDGILAQLQDTRQIPFC
           ||||||||||||||||||||||||||||||||||| ||||||||||||| :|||||||||
g041-1     MKSYPDPYRHFENLDSAETQNFAAEANAETRARFLNNDKARALSDGILNQMQDTRQIPFC
                   10        20        30        40        50        60

70        80        90       100       110       120
m041-1.pep QEHRARMYHFHQDAEYPKGVYRVCTAATYRSGYPEWKILFSVADFDELLGDDVYLGGVSH
           ||||||||||||:||||||||||:||||||||||||||||||||||||||||||||||||
g041-1     QEHRARMYHFHQNAEYPKGVYRMCTAATYRSGYPEWKILFSVADFDELLGDDVYLGGVSH
                   70        80        90       100       110       120

130       140       150       160       170       180
m041-1.pep LVEQPNRALLTLSKLGSDTAYTLEVDLEAGELVEGGFHFPAGKNHVSWRDENSVWVCPAW
           |||||||||||||:| |:||||||||||||||||||||||||||||||||||||||||||
g041-1     LVEQPNRALLTLNKSGGDTAYTLEVDLEAGELVEGGFHFPAGKNHVSWRDENSVWVCPAW
                  130       140       150       160       170       180

190       200       210       220       230       240
m041-1.pep NERQLTQSGYPREVWLVERGKSFEESLPVYQIGEDGMMVNAWRYLDPQGSPIDLIEASDG
           :||||:|||||||||||||||||||||:|||  : :||||||||||||||||||||||||
g041-1     DERQLTESGYPREVWLVERGKSFEESLPAYQIDKGAMMVNAWRYLDPQGSPIDLIEASDG
                  190       200       210       220       230       240

250       260       270       280       290       300
m041-1.pep FYTKTYLRVSAEGEAKPLNLPNDCDVVGYLAGHLLLTLRKDWNRANQSYPSGALVAVKLN
           |||||||:||:||||||||||||||||||||||||||||||||||:|||||||||||||||
g041-1     FYTKTYLQVSSEGGAKPLNLPNDCDVVGYLAGHLLLTLRKDWHRANQSYPSGALVAVKLN
                  250       260       270       280       290       300

310       320       330       340       350       360
m041-1.pep RGELGAAQLLFAPDETQALESVETTKRFVVASLLENVQGRLKAWRFADGKWQEVELPRLP
           ||||||||||||||||||||||||||||||||||||||||||||||:||||:|||:|:||
g041-1     RGELGAAQLLFAPDETQALESVETTKRFVVASLLENVQGRLKAWRFADSKWQEAELPHLP
                  310       320       330       340       350       360

370       380       390       400       410       420
m041-1.pep SGALEMTDQPWGGDVVYLAASDFTTPLTLFALDLNVMELTVMRRQPQQFDSDGINVQQFW
           |||||||||||||||||||||||||||||||||||||||||||| ||||  ||||:|:|||
g041-1     SGALEMTDQPWGGDVVYLAASDFTTPLTLFALDLNVMELTVMRLQPQQFVSDGIEVRQFW
                  370       380       390       400       410       420

430       440       450       460       470       480
m041-1.pep TTSADGERIPYFHVGKNAAPDMPTLVYAYGGFGIPELPHYLGSIGKYWLEEGNAFVLANI
           ::|:||||||||||||||||||| ||||||||||||||||||||:|||||||||||||||
g041-1     AVSSDGERIPYFHVGKNAAPDTPTLVYAYGGFGIPELPHYLGSVGKYWLEEGNAFVLANI
                  430       440       450       460       470       480

490       500       510       520       530       540
m041-1.pep RGGGEFGPRWHQAAQGISKHKSVDDLLAVVRDLSERGISSPEHIGLQGGSNGGLITAAAF
           |||||||||||||||||||||||||||||||||||||:||:|||||||||||||||||||
g041-1     RGGGEFGPRWHQAAQGISKHKSVDDLLAVVRDLSERGMSSPKHIGLQGGSNGGLITAAAF
                  490       500       510       520       530       540

550       560       570       580       590       600
m041-1.pep VREPQSIGALVCEVPLTDMIRYPLLSAGSSWTDEYGNPQKYEVCKRRLGELSPYHNLSDG
           ||||||||||||||||||||||||||||||||||||||||||| ||||||||||||||||
g041-1     VREPQSIGALVCEVPLTDMIRYPLLSAGSSWTDEYGNPQKYEACKRRLGELSPYHNLSDG
                  550       560       570       580       590       600

610       620       630       640       650       660
m041-1.pep IDYPPALITTSLSDDRVHPAHALKFYAKLRETSAQSWLYSPDGGHTGNGTQRESADELA
           |||||||||||||||||||||||||||||||| |||||||||:|||||||||||||:||
g041-1     IDYPPALITTSLSDDRVHPAHALKFYAKLRETSPQSWLYSPDGGGHTGNGTQRESADKLA
                  610       620       630       640       650       660

670
m041-1.pep CVLLFLKEFLGX
           ||||||||||||
g041-1     CVLLFLKEFLGX
                  670
``` m041-1 (SEQ ID 162)/P55577 (SEQ ID 4159)
sp|P55577|Y4NA_RHISN PROBABLE PEPTIDASE Y4NA > gi|2182536 (AE000086) Y4nA
[*Rhizobium* sp. NGR234] Length = 726
Score = 370 bits (940), Expect = e-101
Indentities = 217/682 (31%), Positives = 331/682 (47%), Gaps = 22/682 (3%)

```
Query:   2 KSYPDPYRHFENLDSAETQNFAAEANAETRARFLENDKARALSDGILAQLQDTRQIPFCQ 61
           K    DP  +    +D  +  +    N   T +   ++ +          L  LQ T +I
Sbjct:  42 KDASDPRAYLNEIDGDKAMTWVEAHNLSTVDKLSKDPRYSEYQADALTILQATDRIASPS 101

Query:  62 EHRARMY-HFHQDAEYPKGVYRVCTAATYRSGYPEWKILFSVADFDELLGDDVYLGGVSH 120
              R  M  +F QD + +G++R   T    +YRSG P+W+ +       V      +  G
Sbjct: 102 FARDGMIDNFWQDGTHVQGLWRRTTWESYRSGNPQWRTILDVDALSKAEGKTWVFEGGDC 161

Query: 121 LVEQPNRALLTLSKLGSDTAYTLEVDLEAGELVEGGFHFPAGKNHVSWRDENSVWVCPAW 180
               L    N  L+ LS  G D        E  D+   GE V+   GF  P GK  V+W  DEN+++V    W
Sbjct: 162 LPPTSNLCLIRLSDGGKDADVVREFDIAKGEFVKEGFVLPEGKQSVTWVDENTIYVTREW 221
```

```
Query: 181 NERQLTQSGYPREVWLVERGKSFEESLPVYQ------IGEDGMM--VNAWRYLDPQGSPI 232
            ++T SGY   +V+RG+S ++++ +++      E G++  ++    +D  +
Sbjct: 222 TPGEVTSSGYAYVTKVVKRGQSLDQAVEIFRGQKKDVSAERGVLRDIDGKYVMDTSYRGL 281

Query: 233 DLIEASDGFYTKTYLRVSAEGEAKPLNLPNDCDVVGYLAGHLLLTLRKDWNRANQS-YPS 291
            D    FY   +    L LP    GY  G + L+ DW A + + +
Sbjct: 282 DFFNTELAFYPNGH----PDTRKVVLPLPTTAVFSGYYKGQAIYWLKSDWTSAKGTVFHN 337

Query: 292 GALVAVKLNRGELGAAQL----LFAPDETQALESVETTKRFVVASLLENVQGRLKAWRFA 347
            GA++A L    A++    LF P+E Q++    TK +V S+L NV    ++++ F
Sbjct: 338 GAIIAFDLKAALADPARVEPLVLFMPNEHQSVAGTTQTKNRLVLSILSNVTSEVRSFDFG 397

Query: 348 DGKWQEVELPRLPSGALEMTDQPWGGDVVYLAASDFTTPLTLFALDLNVMELTVMRRQPQ 407
            G W   +L  + L +T   D +++ + F  P TLF D   ++ +   P
Sbjct: 398 KGGWSSFKLALPENSTLSLTSSDDESDQLFVFSEGFLEPSTLFCADAATGQVEKITSTPA 457

Query: 408 QFDSDGINVQQFWTTSADGERIPYFHVGKNAAP---DMPTLVYAYGGFGIPELPHYLGSI 464
            +FD+ G+ QQFW TS DG ++PYF V +       PT++YAYGGF IP  P Y   +
Sbjct: 458 RFDAGGLQAQQFWATSKDGTKVPYFLVARKDVKLDGTNPTILYAYGGFQIPMQPSYSAVL 517

Query: 465 GKYWLEEGNAFVLANIRGGGEFGPRWHQAAQGISKHKSVDDLLAVVRDLSERGISSPEHI 524
            GK WLE+G A+ LANIRGGGEFGP+WH A   ++ +  DD  AV +DL  + ++S H+
Sbjct: 518 GKLWLEKGGAYALANIRGGGEFGPKWHDAGLKTNRQRVYDDFQAVAQDLIAKKVTSTPHL 577

Query: 525 GLQGGSNGGLITAAAFVREPQSIGALVCEVPLTDMIRYPLLSAGSSWTDEYGNPQKYEVC 584
            G+ GGWSNGGL+   ++  P    A+V +VPL DM+  +   +SAG+SW  EYG+P   V
Sbjct: 578 GIMGGSNGGLLMGVQMIQRPDLWNAVVIQVPLLDMVNFTRMSAGASWQAEYGSPDD-PVE 636

Query: 585 KRRLGELSPYHNLSDGIDYPPALITTSLSDDRVHPAHALKFYAKLRETSAQSWLYSPDGG 644
            L  +SPYHN   G+ YP    TS DDRV P HA K  A   +  + Y    G
Sbjct: 637 GAFLRSISPYHNVKAGVAYPEPFFETSTKDDRVGPVHARKMAALFEDMGLPFYYYENIEG 696

Query: 645 GHTGNGTQRESADELACVLLFL                                       666
            GH     +E A         +++
Sbjct: 697 GHAAAANLQEHARRYALEYIYM                                       718
```

25

The following partial DNA sequence was identified in *N. meningitidis* <SEQ ID 163>:

```
a041-1.seq
   1 ATGAAATCCT ACCCCGACCC CTACCGCCAT TTTGAAAACC TCGATTCCGC
  51 CGAAACGCAA AACTTCGCTG CTGAAGCGAA TGCCGAAACG CGCGCGCGTT
 101 TTTTAAACAA CGACAAGGCA CGCGCATTGT CTGACGGCAT TTTGGCGCAG
 151 TTGCAGGACA CGCGGCAAAT TCCGTTTTGT CAGGAACACC GCGCGCGGAT
 201 GTACCATTTC CATCAAGATG CGGAATATCC GAAAGGCGTG TACCGCGTGT
 251 GTACCGCGGC GACTTACCGT TCGGGCTATC CTGAGTGGAA AATCCTGTTT
 301 TCGGTGGCGG ATTTCGACGA ATTGCTCGGT GACGATGTAT ATCTAGGCGG
 351 CGTGTCGCAC CTGGTGGAAC AGCCCAACCG CGCGTTGTTA ACACTGAGCA
 401 AATCGGGCGG CGATACCGCG TACACGCTGG AAGTGGATTT GGAAGCAGGG
 451 GAGTTGGTAG AAGGCGGTTT TCACTTTCCG GCAGGCAAAA ACCATGTGTC
 501 GTGGCGCGAT GAAAACAGCG TGTGGGTGTG TCCGGCTTGG GACGAACGCC
 551 AGTTGACCGA ATCGGGCTAT CCGCGCGAGG TGTGGCTGGT GGAACGCGGC
 601 AAGAGTTTCG AGGAAAGCCT GCCGGTGTAC CAAATTGCTG AAGACGGCAT
 651 GATGGTGAAC GCGTGGCGTT ACCTCGATCC GCAGGGTTCG CCGATTGATT
 701 TGATTGAAGC GTCTGACGGT TTTTACACCA AAACCTATTT GCAGGTCTCA
 751 GCCGAAGGCG AAGCGAAACC GTTAAACCTG CCCAACGATT GCGACGTAGT
 801 CGGCTATCTG GCCGGACATC TTTTGCTGAC CTTGCGTAAA GACTGGCACC
 851 GCGCGAACCA AAGCTATCCG AGTGGCGCAT TGGTAGCAGT AAAATTAAAC
 901 CGCGGCGAAT TGGGCGCGGC GCAGCTTTTG TTTGCGCCCA ATGAAACGCA
 951 GGCATTGGAA AGCGTGGAAA CGACCAAGCG TTTTGTCGTG GCGAGCCTGC
1001 TGGAAAACGT ACAGGGTCGT CTGAAAGCGT GGCGTTTTAC TGATGGCAAA
1051 TGGCAGGAAA CCGAGTTGCC GCGCCTGCCT TCGGGCGCGT TGGAAATGAC
1101 CGACCAACCG TGGGGGGGCG ACGTAGTTTA CCTTGCCGCC AGCGATTTCA
```

```
-continued
1151 CCACGCCGCT GACGCTGTTT GCATTGGATT TGAACGTGAT GGAACTGACC

1201 GTCATGCGCC GCCAGCCGCA GCAGTTTGAT TCAGACGGCA TTAACGTGCA

1251 GCAGTTTTGG ACGACTTCGG CTGACGGCGA GCGCATTCCT TATTTCCACG

1301 TCGGCAAAAA CGCCGCGCCC GACATGCCGA CGCTGGTCTA TGCCTACGGC

1351 GGTTTCGGCA TTCCCGAATT GCCGCATTAT CTGGGCAGCA TTGGCAAATA

1401 TTGGCTGGAA GAGGGCAATG CCTTTGTATT GGCGAACATC CGCGGCGGCG

1451 GCGAGTTCGG CCCGCGCTGG CATCAGGCGG CGCAGGGAAT CAGCAAACAT

1501 AAAAGCGTTG ATGATTTATT GGCAGTCGTG AGCGATTTGT CCGAACGCGG

1551 TATCAGTTCG CCCGAACACA TCGGCTTGCA GGGCGGCAGC AACGGCGGAC

1601 TGATTACTGC CGCCGCCTTC GTGCGCGAAC CGCAAAGCAT AGGCGCGCTG

1651 GTGTGCGAAG TGCCGCTGAC CGACATGATC CGTTATCCGC TGCTCTCCGC

1701 CGGTTCAAGC TGGACAGACG AATACGGCAA TCCGCAAAAA TACGAAGTCT

1751 GCAAACGCCG GTTGGGCGAA TTGTCGCCGT ATCACAATCT TTCAGACGGC

1801 ATCGATTATC CGCGCGCGTT CATTACCACC AGCCTGTCCG ACGATCGCGT

1851 CCATCCCGCC CACGCGCTCA AGTTCTACGC CAAACTGCGC GAAACCTCGC

1901 CGCAATCTTG GCTCTACTCG CCTGACGGCG GCGGCCATAC CGGCAACGGC

1951 ACGCAGCGCG AAGCCGCCGA CGAACTCGCC TGCGTGTTGC TGTTTTTGAA

2001 AGAGTTTTTG GGCTAA
```

This corresponds to the amino acid sequence <SEQ ID 164; ORF 041-1.a>:

```
a041-1.pep

1 MKSYPDPYRH FENLDSAETQ NFAAEANAET RARFLNNDKA RALSDGILAQ

51 LQDTRQIPFC QEHRARMYHF HQDAEYPKGV YRVCTAATYR SGYPEWKILF

101 SVADFDELLG DDVYLGGVSH LVEQPNRALL TLSKSGGDTA YTLEVDLEAG

151 ELVEGGFHFP AGKNHVSWRD ENSVWVCPAW DERQLTESGY PREVWLVERG

201 KSFEESLPVY QIAEDGMMVN AWRYLDPQGS PIDLIEASDG FYTKTYLQVS

251 AEGEAKPLNL PNDCDVVGYL AGHLLLTLRK DWHRANQSYP SGALVAVKLN

301 RGELGAAQLL FAPNETQALE SVETTKRFVV ASLLENVQGR LKAWRFTDGK

351 WQETELPRLP SGALEMTDQP WGGDVVYLAA SDFTTPLTLF ALDLNVMELT

401 VMRRQPQQFD SDGINVQQFW TTSADGERIP YFHVGKNAAP DMPTLVYAYG

451 GFGIPELPHY LGSIGKYWLE EGNAFVLANI RGGGEFGPRW HQAAQGISKH

501 KSVDDLLAVV SDLSERGISS PEHIGLQGGS NGGLITAAAF VREPQSIGAL

551 VCEVPLTDMI RYPLLSAGSS WTDEYGNPQK YEVCKRRLGE LSPYHNLSDG

601 IDYPPALITT SLSDDRVHPA HALKFYAKLR ETSPQSWLYS PDGGGHTGNG

651 TQREAADELA CVLLFLKEFL G* a041-1/m041-1  97.9% identity in 671 aa overlap 10         20         30         40         50         60
m041-1.pep  MKSYPDPYRHFENLDSAETQNFAAEANAETRARFLNNDKARALSDGILAQLQDTRQIPFC
            ||||||||||||||||||||||||||||||||||||||:|||||||||||||||||||||
m041-1      MKSYPDPYRHFENLDSAETQNFAAEANAETRARFLENDKARALSDGILAQLQDTRQIPFC
                     10         20         30         40         50         60
```

-continued

```
                   70         80         90        100        110        120
m041-1.pep QEHRARMYHFHQDAEYPKGVYRVCTAATYRSGYPEWKILFSVADFDELLGDDVYLGGVSH
           ||||||||||||||||||||||||||||||||||||||||||||||||||||||||||||
m041-1     QEHRARMYHFHQDAEYPKGVYRVCTAATYRSGYPEWKILFSVADFDELLGDDVYLGGVSH
                   70         80         90        100        110        120

130        140        150        160        170        180
m041-1.pep LVEQPNRALLTLSKSGGDTAYTLEVDLEAGELVEGGFHFPAGKNHVSWRDENSVWVCPAW
           |||||||||||||| |:|||||||||||||||||||||||||||||||||||||||||||
m041-1     LVEQPNRALLTLSKLGSDTAYTLEVDLEAGELVEGGFHFPAGKNHVSWRDENSVWVCPAW
                  130        140        150        160        170        180

190        200        210        220        230        240
m041-1.pep DERQLTESGYPREVWLVERGKSFEESLPVYQIAEDGMMVNAWRYLDPQGSPIDLIEASDG
           :|||||:|||||||||||||||||||||||||:|||||||||||||||||||||||||||
m041-1     NERQLTQSGYPREVWLVERGKSFEESLPVYQIGEDGMMVNAWRYLDPQGSPIDLIEASDG
                  190        200        210        220        230        240

250        260        270        280        290        300
m041-1.pep FYTKTYLQVSAEGEAKPLNLPNDCDVVGYLAGHLLLTLRKDWHRANQSYPSGALVAVKLN
           |||||||:||||||||||||||||||||||||||||||||||:|||||||||||||||||
m041-1     FYTKTYLRVSAEGEAKPLNLPNDCDVVGYLAGHLLLTLRKDWNRANQSYPSGALVAVKLN
                  250        260        270        280        290        300

310        320        330        340        350        360
m041-1.pep RGELGAAQLLFAPNETQALESVETTKRFVVASLLENVQGRLKAWRFTDGKWQETELPRLP
           |||||||||||||:||||||||||||||||||||||||||||||||:||||||:||||||
m041-1     RGELGAAQLLFAPDETQALESVETTKRFVVASLLENVQGRLKAWRFADGKWQEVELPRLP
                  310        320        330        340        350        360

370        380        390        400        410        420
m041-1.pep SGALEMTDQPWGGDVVYLAASDFTTPLTLFALDLNVMELTVMRRQPQQFDSDGINVQQFW
           ||||||||||||||||||||||||||||||||||||||||||||||||||||||||||||
m041-1     SGALEMTDQPWGGDVVYLAASDFTTPLTLFALDLNVMELTVMRRQPQQFDSDGINVQQFW
                  370        380        390        400        410        420

430        440        450        460        470        480
m041-1.pep TTSADGERIPYFHVGKNAAPDMPTLVYAYGGFGIPELPHYLGSIGKYWLEEGNAFVLANI
           ||||||||||||||||||||||||||||||||||||||||||||||||||||||||||||
m041-1     TTSADGERIPYFHVGKNAAPDMPTLVYAYGGFGIPELPHYLGSIGKYWLEEGNAFVLANI
                  430        440        450        460        470        480

490        500        510        520        530        540
m041-1.pep RGGGEFGPRWHQAAQGISKHKSVDDLLAVVSDLSERGISSPEHIGLQGGSNGGLITAAAF
           |||||||||||||||||||||||||||||| |||||||||||||||||||||||||||||
m041-1     RGGGEFGPRWHQAAQGISKHKSVDDLLAVVRDLSERGISSPEHIGLQGGSNGGLITAAAF
                  490        500        510        520        530        540

550        560        570        580        590        600
m041-1.pep VREPQSIGALVCEVPLTDMIRYPLLSAGSSWTDEYGNPQKYEVCKRRLGELSPYHNLSDG
           ||||||||||||||||||||||||||||||||||||||||||||||||||||||||||||
m041-1     VREPQSIGALVCEVPLTDMIRYPLLSAGSSWTDEYGNPQKYEVCKRRLGELSPYHNLSDG
                  550        560        570        580        590        600

610        620        630        640        650        660
m041-1.pep IDYPPALITTSLSDDRVHPAHALKFYAKLRETSPQSWLYSPDGGGHTGNGTQREAADELA
           ||||||||||||||||||||||||||||||||| ||||||||||||||||||||:|||||
m041-1     IDYPPALITTSLSDDRVHPAHALKFYAKLRETSAQSWLYSPDGGGHTGNGTQRESADELA
                  610        620        630        640        650        660

670
m041-1.pep CVLLFLKEFLGX
           ||||||||||||
m041-1     CVLLFLKEFLGX
                  670
```

The following partial DNA sequence was identified in *N. gonorrhoeae* <SEQ ID 165>:

```
g042.seq
  1  ATGACGATGA TTTGCTTGCG CTTCCAagcG TTCGTGCCGC ATACCAGCGC

51  GTTATCCAAC ACTTCCACGG CAGCCGGCCC TTCCTGCCCG ATGGCGGCGG

101  TGCGGTCGAT GATGAAAATC CAGCCGGGGT TTTTCTCTTT GATGTATTCG

151  AAGGAAACGG GCTGCCCGTG CCCTTCGTTG CGTAAAGATT CGTCCACGGG

201  CGGCAGGCCG ATGTCGCCGT GTATCCAACT TGCCAACCGC GATTGCGTGC

251  CGAAGGCGGA CACCTTGTTG CCTGTAACCG ACAGCACCAG CCCGCGTCCT

301  TTGCCTTTGG cggCTTCGCG CTTTTGGGCG AACAGCGCGT CAATCTGCGC

351  ATTCAATTCC GCCACGCGCG CTTCCTTACC GAAAATCCGC GACAGGGTCT
```

-continued

```
401 CCATCTGCTT CTCGCCGCTG GTGCGGATAT TGCCGTTGTC CACCGTCAAA

451 TCTATGgtgG TCGCGTTTTT CGCCAACTGT TCATACGCTT CCGCACCCGG

501 CCCGCCGGTA ATGACAAACT GCGGATTGTG GCGGTGCAGG GATTCGCAAT

551 CGGGCTCAAA CAGCGTCCCC ACCGTTGCCG CCTTGTCAAA TGCAGGCTGC

601 AAATAG
```

This corresponds to the amino acid sequence <SEQ ID 166; ORF 042.ng>:

```
g042.pep
  1 MTMICLRFQA FVPHTSALSN TSTAAGPSCP MAAVRSMMKI QPGFFSLMYS

51 KETGCPCPSL RKDSSTGGRP MSPCIQLANR DCVPKADTLL PVTDSTSPRP

101 LPLAASRFWA NSASICAFNS ATRASLPKIR DRVSICFSPL VRILPLSTVK

151 SMVVAFFANC SYASAPGPPV MTNCGLWRCR DSQSGSNSVP TVAALSNAGC

201 K*
```

The following partial DNA sequence was identified in *N. meningitidis* <SEQ ID 167>:

```
m042.seq
  1 ATGACGATGA TTTGCTTGCG CTTCCAAGCG TTCGTGCCGC GTACCAGCGC

51 GTTATCCAmT ACTTCGACAG CCGcCGGCCy TTCyTGCCCG ATGGCGGCGG

101 TACGGTCGAT GATGAAAATC CAATCGGGGT TTTTCTCTTT GATGTATTCG

151 AAGGAAACAG GCTGCCCGTG CACCTTGTTG CGTAAAGATT CGTCTACAGG

201 CGGTAGGCCG ATGTCGCCGT GTATCCAACT TGCCAACCGC GACTGCGTGC

251 CGAAGGCGGA CACCTTGTTG CCCGTAACCG ACAGCACCAG CCCGCGTCCT

301 TTGCCTTTGG CGGCTTCGCG CGTTTGGGCG AACAGCGCGT CAATCTGCGC

351 CTTCAATTCC GCCGCGCGCG CTTCCTTGCC GAAAATCCGC GCCAAGGTCT

401 CCATCTGCTT TTCGCCGCTG GTGCGGATAT TGCCGTTGTC CACCGTCAGA

451 TCTATGGTGG TCGCGTTTTT CGCTAACTGT TCATACGCTT CCGCGCCCGG

501 CCCGCCGGTA ATGACAAGCT GAGGATTGTA GCGGTGCAGG GCTTCGTAAT

551 CGGGCTCGAA CAGCGTCCCC ACCGTTGCCG CCTTGTCAAA TGCAGGCTGC

601 AAATAA
```

This corresponds to the amino acid sequence <SEQ ID 168; ORF 042>:

```
m042.pep
  1 MTMICLRFQA FVPRTSALSX TSTAAGXSCP MAAVRSMMKI QSGFFSLMYS

51 KETGCPCPSL RKDSSTGGRP MSPCIQLANR DCVPKADTLL PVTDSTSPRP

101 LPLAASRVWA NSASICAFNS AARASLPKIR AKVSICFSPL VRILPLSTVR

151 SMVVAFFANC SYASAPGPPV MTSXGLXRCR ASXSGSNSVP TVAALSNAGC

201 K*
```

The following partial DNA sequence was identified in *N. meningitidis* <SEQ ID 169>:

```
a042.seq
  1 ATGACGATGA TTTGCTTGCG CTTCCAA

Computer analysis of this amino acid sequence gave the following results:
Homology with a Predicted ORF from *N. gonorrhoeae*
ORF 042 shows 93.0% identity over a 201 aa overlap with a predicted ORF (ORF 042.ng) from *N. gonorrhoeae*:

```
m042/g042

10         20         30         40         50         60
  m042.pep  MTMICLRFQAFVPRTSALSXTSTAAGXSCPMAAVRSMMKIQSGFFSLMYSKETGCPCPSL
            ||||||||||||:|||||||||||:||||||||||||||||:||||||||||||||||||
  g042      MTMICLRFQAFVPHTSALSNTSTAAGPSCPMAAVRSMMKIQPGFFSLMYSKETGCPCPSL
                  10         20         30         40         50         60

70         80         90        100        110        120
  m042.pep  RKDSSTGGRPMSPCIQLANRDCVPKADTLLPVTDSTSPRPLPLAASRVWANSASICAFNS
            ||||||||||||||||||||||||||||||||||||||||||||||:|||||||||||||
  g042      RKDSSTGGRPMSPCIQLANRDCVPKADTLLPVTDSTSPRPLPLAASRFWANSASICAFNS
                  70         80         90        100        110        120

130        140        150        160        170        180
  m042.pep  AARASLPKIRAKVSICFSPLVRILPLSTVRSMVVAFFANCSYASAPGPPVMTSXGLXRCR
            |:||||||||:||||||||||||||||||:||||||||||||||||||||||||:|||||
  g042      ATRASLPKIRDRVSICFSPLVRILPLSTVKSMVVAFFANCSYASAPGPPVMTNCGLWRCR
                 130        140        150        160        170        180

190        200
  m042.pep  ASXSGSNSVPTVAALSNAGCKX
            |  |||||||||||||||||||
  g042      DSQSGSNSVPTVAALSNAGCKX
                 190        200
```

The following partial DNA sequence was identified in *N. meningitidis* <SEQ ID 171>:

```
m042-1.seq
  1  ATGACGATGA TTTGCTTGCG CTTCCAAGCG TTCGTGCCGC GTACCAGCGC

51  GTTATCCAAT ACTTCGACAG CCGCCGGCCC TTCCTGCCCG ATGGCGGCGG

101  TACGGTCGAT GATGAAAATC CAATCGGGGT TTTTCTCTTT GATGTATTCG

151  AAGGAAACAG GCTGCCCGTG CACCTTGTTG CGTAAAGATT CGTCTACAGG

201  CGGTAGGCCG ATGTCGCCGT GTATCCAACT TGCCAACCGC GACTGCGTGC

251  CGAAGGCGGA CACCTTGTTG CCCGTAACCG ACAGCACCAG CCCGCGTCCT

301  TTGCCTTTGG CGGCTTCGCG CGTTTGGGCG AACAGCGCGT CAATCTGCGC

351  CTTCAATTCC GCCGCGCGCG CTTCCTTGCC GAAAATCCGC GCCAAGGTCT

401  CCATCTGCTT TTCGCCGCTG GTGCGGATAT TGCCGTTGTC CACCGTCAGA

451  TCTATGGTGG TCGCGTTTTT CGCTAACTGT TCATACGCTT CCGCGCCCGG

501  CCCGCCGGTA A
```

This corresponds to the amino acid sequence <SEQ ID 172; ORF 042-1>:

```
m042-1.pep

1  MTMICLRFQA FVPRTSALSN TSTAAGPSCP MAAVRSMMKI QSGFFSLMYS

51  KETGCPCPSL RKDSSTGGRP MSPCIQLANR DCVPKADTLL PVTDSTSPRP

101  LPLAASRVWA NSASICAFNS AARASLPKIR AKVSICFSPL VRILPLSTVR
                                                ‾‾‾‾‾‾‾‾‾‾‾‾‾‾‾‾‾‾‾‾‾

151  SMVVAFFANC SYASAPGPPV MTS* m042-1/g042 95.4% identity in 173 aa overlap 10         20         30         40         50         60
  m042-1.pep MTMICLRFQAFVPRTSALSNTSTAAGPSCPMAAVRSMMKIQSGFFSLMYSKETGCPCPSL
             ||||||||||||:|||||||||||||||||||||||||||:|||||||||||||||||||
  g042       MTMICLRFQAFVPHTSALSNTSTAAGPSCPMAAVRSMMKIQPGFFSLMYSKETGCPCPSL
                  10         20         30         40         50         60
```

```
                    70         80         90        100        110        120
m042-1.pep  RKDSSTGGRPMSPCIQLANRDCVPKADTLLPVTDSTSPRPLPLAASRVWANSASICAFNS
            ||||||||||||||||||||||||||||||||||||||||||| ||||||||||||||||
g042        RKDSSTGGRPMSPCIQLANRDCVPKADTLLPVTDSTSPRPLPLAASRFWANSASICAFNS
                    70         80         90        100        110        120

130        140        150        160        170
m042-1.pep  AARASLPKIRAKVSICFSPLVRILPLSTVRSMVVAFFANCSYASAPGPPVMTSX
            |:||||||| :|||||||||||||||||||:|||||||||||||||||||||:
g042        ATRASLPKIRDRVSICFSPLVRILPLSTVKSMVVAFFANCSYASAPGPPVMTNCGLWRCR
                   130        140        150        160        170        180 g042        DSQSGSNSVPTVAALSNAGCKX
                   190        200
```

The following partial DNA sequence was identified in *N. meningitidis* <SEQ ID 173>:

```
a042-1.seq
  1  ATGACGATGA TTTGCTTGCG CTTCCAAGCG TTCGTGCCGC GTACCAGCGC

51  GTTATCCAAT ACTTCGACAG CCGCCGGCCC TTCCTGCCCG ATGGCGGCGG

101  TACGGTCGAT GATGAAAATC AATCGGGGT TTTTCTCTTT GATGTATTCG

151  AAGGAAACAG GCTGCCCGTG CACCTTGTTG CGTAAAGATT CGTCTACAGG

201  CGGTAGGCCG ATGTCGCCGT GTATCCAACT TGCCAACCGC GACTGCGTGC

251  CGAAGGCGGA CACCTTGTTG CCCGTAACCG ACAGCACCAG CCCGCGTCCT

301  TTGCCTTTGG CGGCTTCGCG CGTTTGGGCG AACAGCGCGT CAATCTGCGC

351  CTTCAATTCC GCCGCGCGCG CTTCCTTGCC GAAAATCCGC GCCAAGGTCT

401  CCATCTGCTT TTCGCCGCTG GTGCGGATAT TGCCGTTGTC CACCGTCAGA

451  TCTATGGTGG TCGCGTTTTT CGCCAACTGT TCATACGCTT CCGCGCCCGG

501  CCCGCCGGTA A
```

This corresponds to the amino acid sequence <SEQ ID 174; ORF 042-1.a>:

```
a042-1.pep

1   MTMICLRFQA FVPRTSALSN TSTAAGPSCP MAAVRSMMKI QSGFFSLMYS

51   KETGCPCPSL RKDSSTGGRP MSPCIQLANR DCVPKADTLL PVTDSTSPRP

101   LPLAASRVWA NSASICAFNS AARASLPKIR AKVSICFSPL VRILPLSTVR

151   SMVVAFFANC SYASAPGPPV MTS* m042-1/a042-1  100.0% identity in 173 aa overlap 10         20         30         40         50         60
m042-1.pep  MTMICLRFQAFVPRTSALSNTSTAAGPSCPMAAVRSMMKIQSGFFSLMYSKETGCPCPSL
            ||||||||||||||||||||||||||||||||||||||||||||||||||||||||||||
a042-1      MTMICLRFQAFVPRTSALSNTSTAAGPSCPMAAVRSMMKIQSGFFSLMYSKETGCPCPSL
                    10         20         30         40         50         60

70         80         90        100        110        120
m042-1.pep  RKDSSTGGRPMSPCIQLANRDCVPKADTLLPVTDSTSPRPLPLAASRVWANSASICAFNS
            ||||||||||||||||||||||||||||||||||||||||||||||||||||||||||||
a042-1      RKDSSTGGRPMSPCIQLANRDCVPKADTLLPVTDSTSPRPLPLAASRVWANSASICAFNS
                    70         80         90        100        110        120

130        140        150        160        170
m042-1.pep  AARASLPKIRAKVSICFSPLVRILPLSTVRSMVVAFFANCSYASAPGPPVMTSX
            |||||||||||||||||||||||||||||||||||||||||||||||||||||
a042-1      AARASLPKIRAKVSICFSPLVRILPLSTVRSMVVAFFANCSYASAPGPPVMTSX
                   130        140        150        160        170
```

The following partial DNA sequence was identified in *N. gonorrhoeae* <SEQ ID 175>:

```
g043.seq
  1  ATGGTTGTTT CAAATCAAAA TATCTATGCC GTCGGCCCAT CAGCACTTTT

51  TCACATCCGA AGGCAAAAAT CCGTAATGCC GCCTGAACGC TTCgttgaAC

101  CGTCCCGCGT ggcggtagcc gcAAAAGTGC ATcGCGGCTT GGATGGTGCT

151  GCCCGATTCG ATGAGGGcga gcGCGTGTTC CAGCCGCAGG CGGCGCAGGC

201  GTCCGGCGAC GGTTTCGCCG GTTTGCGCTT TGAAATAGCG TTTCAGGTAG

251  CATTCGTTCA GCCCGACGCG GCGGGCGATT TCGGCGATGG TCAGCGGGCG

301  GGCGAATTCG CTGTTCAAAA TATCGGCGGC TTCGTCTATG CGCCGGCGGC

351  GGTAGCCGTT GTCGTGGCGG CGGAAGGTGA AGCGTAA
```

This corresponds to the amino acid sequence <SEQ ID 176; ORF 043.ng>:

```
g043.pep
  1  MVVSNQNIYA VGPSALFHIR RQKSVMPPER FVEPSRVAVA AKVHRGLDGA

51  ARFDEGERVF QPQAAQASGD GFAGLRFEIA FQVAFVQPDA AGDFGDGQRA

101  GEFAVQNIGG FVYAPAAVAV VVAAEGEA*
```

The following partial DNA sequence was identified in *N. meningitidis* <SEQ ID 177>:

```
m043.seq
  1  ATGGTTGTTT CAAATCAAAA TATCTATGCC GCCGGCCCCT CAGCACTTCT

51  TCACATCCGA AGGCAAAAAT CCGTAATGCC GTCTGAACGC TTCGTTGAAC

101  CGTCCCGCGT GGCGGTAGCC GCAAAAGTGC ATGGCGGCTT GGACGGTGCT

151  GCCGGATTCG ATGAGGGCGA GCGCGTGTTC CAGCCGCAGG CGGCGCAgGC

201  ATCCGGCGAC GGTTTCGCCG GTTTGCGCTT TGAAATAGCG TTTCAGGTAG

251  CATTCGTTCA GTCCGACGCG GCGGGCGATT TCGGCGATGG TCAGCGGACG

301  GGCGAATTCG TGTTGCAGGA TGTCGGCGGC TTCGTCTATG CGCCGACGGC

351  GGTAACCGTT GTCGTGGCGG CGGAAGGTGA AGCGCAATAA
```

This corresponds to the amino acid sequence <SEQ ID 178; ORF 043>:

```
m043.pep
  1  MVVSNQNIYA AGPSALLHIR RQKSVMPSER FVEPSRVAVA AKVHGGLDGA

51  AGFDEGERVF QPQAAQASGD GFAGLRFEIA FQVAFVQSDA AGDFGDGQRT

101  GEFVLQDVGG FVYAPTAVTV VVAAEGEAQ*
```

Computer analysis of the amino acid sequences gave the following results:

Homology with a Predicted ORF from *N. meningitidis* menA with menB

ORF 043 shows 89.8% identity over a 128 aa overlap with a predicted ORF (ORF043.a) from *N. gonorrhoeae*:

```
m043/g043
                    10         20         30         40         50         60
    m043.pep  MVVSNQNIYAAGPSALLHIRRQKSVMPSERFVEPSRVAVAAKVHGGLDGAAGFDEGERVF
              ||||||||||:|||||:||||||||||||||||||||||||||:|||||||||||||||
    g043      MVVSNQNIYAVGPSALFHIRRQKSVMPPERFVEPSRVAVAAKVHRGLDGAARFDEGERVF
                    10         20         30         40         50         60

70         80         90        100        110        120
    m043.pep  QPQAAQASGDGFAGLRFEIAFQVAFVQSDAAGDFGDGQRTGEFVLQDVGGFVYAPTAVTV
              |||||||||||||||||||||||||||||  ||||||||||:|||::|:::||||||:|
    g043      QPQAAQASGDGFAGLRFEIAFQVAFVQPDAAGDFGDGQRAGEFAVQNIGGFVYAPAAVAV
                    70         80         90        100        110        120

130
    m043.pep  VVAAEGEAQX
              ||||||||
    g043      VVAAEGEAXX
                    130
```

The following partial DNA sequence was identified in *N. meningitidis* <SEQ ID 179>:

```
a043.seq
  1  ATGGTTGTTT CAAATCAAAA TATCTATGCC GCCGGCCCCT CAGCACTTCT

51  TCACATCCGA AGGCAAAAAT CCGTAATGCC GTCTGAACGC TTCGTTGAAC

101  CGTCCCGCGT GGCGGTAGCC GCAAAAGTGC ATGGCGGCTT GGACGGTGCT

151  GCCGGATTCG ATGAGGGCGA GCGCGTGTTC CAGCCGCAGG CGGCGCAGGC

201  ATCCGGCGAC GGTTTCGCCG GTTTGCGCTT TGAAATAGCG TTTCAGGTAG

251  CATTCGTTCA GTCCGACGCG GCGGGCGATT TCGGCGATGG TCAGCGGACG

301  GGCGAATTCG TGTTGCAGGA TGTCGGCGGC TTCGTCTATG CGCCGACGGC

351  GGTAACCGTT GTCGTGGCGG CGGAAGGTGA AGCGCAATAA
```

This corresponds to the amino acid sequence <SEQ ID 180; ORF 043.a>:

```
a043.pep
         1   MVVSNQNIYA AGPSALLHIR RQKSVMPSER FVEPSRVAVA AKVHGGLDGA

51   AGFDEGERVF QPQAAQASGD GFAGLRFEIA FQVAFVQSDA AGDFGDGQRT

101   GEFVLQDVGG FVYAPTAVTV VVAAEGEAQ* m043/a043   100.0% identity in 129 aa overlap
                    10         20         30         40         50         60
    m043.pep  MVVSNQNIYAAGPSALLHIRRQKSVMPSERFVEPSRVAVAAKVHGGLDGAAGFDEGERVF
              ||||||||||||||||||||||||||||||||||||||||||||||||||||||||||||
    a043      MVVSNQNIYAAGPSALLHIRRQKSVMPSERFVEPSRVAVAAKVHGGLDGAAGFDEGERVF
                    10         20         30         40         50         60

70         80         90        100        110        120
    m043.pep  QPQAAQASGDGFAGLRFEIAFQVAFVQSDAAGDFGDGQRTGEFVLQDVGGFVYAPTAVTV
              ||||||||||||||||||||||||||||||||||||||||||||||||||||||||||||
    a043      QPQAAQASGDGFAGLRFEIAFQVAFVQSDAAGDFGDGQRTGEFVLQDVGGFVYAPTAVTV
                    70         80         90        100        110        120

130
    m043.pep  VVAAEGEAQX
              ||||||||||
    a043      VVAAEGEAQX
                    130
```

The following partial DNA sequence was identified in *N. gonorrhoeae* <SEQ ID 181>:

```
g044.seq
   1 ATGCTGCCCG ACCAGAGCGT CGAGTTCTTG CCACAAGTCG TCGTTTTTGA
  51 CGGGCTGTTT GGCGGCGGTT TTCCAGCCGT TGCGCTTCCA ACCGTGTATC
 101 CAGTTTTCCA TGCCGTTTTT GACGTATTGC GAGTCGGTGC AGATGATGAC
 151 GGTGCAGCGG CGTTTGAGCG ATTTCAGCCC TTCGATAACG GCGGTCAGCT
 201 CCATGCGGTT GTTGGTGGTT TGCGCTTCGC CGCCGAAAAG TTCTTTTTCG
 251 CGGCTGCCGT AGCGCATTAA
```

This corresponds to the amino acid sequence <SEQ ID 182; ORF 044.ng>:

```
g044.pep
   1 MLPDQSVEFL PQVVVFDGLF GGGFPAVALP TVYPVFHAVF DVLRVGADDD
  51 GAAAFERFQP FDNGGQLHAV VGGLRFAAEK FFFAAAVAH*
```

The following partial DNA sequence was identified in *N. meningitidis* <SEQ ID 183>:

```
m044.seq
   1 ATGCCGTCCG ACTAGAGCGT CGAGTTCTTT CCAGAAGTCG TCGTTTTTGA
  51 CGGGCTGTTT GGAGGCGGTT TTCCAGCCGT TGCGCTTCCA ACCGTGTATC
 101 CAGTTTTCCA TGCCATTTTT GACGTATTGC GAGTCGGTGC AGATGATGAC
 151 GGTGCAGCGG CGTTTGAGCG ATTTCAGTCC TTCGATGACG GCAGTCAGTT
 201 CCATGCGGTT GTTGGTGGTT TGCGCTTCGC CGCCGAAAAG TTCTTTTTCG
 251 TGGCTACCGT AGCGCAyTAa
```

This corresponds to the amino acid sequence <SEQ ID 184; ORF 044>:

```
m044.pep
   1 MPSDXSVEFF PEVVVFDGLF GGGFPAVALP TVYPVFHAIF DVLRVGADDD
  51 GAAAFERFQS FDDGSQFHAV VGGLRFAAEK FFFVATVAH*
```

The following partial DNA sequence was identified in *N. meningitidis* <SEQ ID 185>:

```
a044.seq
   1 GTGCCGTCCG ACCAGCGCGT CGAGTTCTTT CCACAAGTCG TCGTTTTTGA
  51 CGGGCTGTTT GGCGGCGGTT TTCCAGCCGT TGCGCTTCCA ACCGTGTATC
 101 CAGTTTTCCA TGCCGTTTTT GACGTATTGC GAGTCGGTGC AGATGATGAC
 151 GGTGCAGCGG CGTTTGAGCG ATTTCAGTCC TTCGATGACG GCGGTCAGTT
 201 CCATACGGTT GTTGGTGGTT TGCGCTTCGC CGCCGAAAAG TTCTTTTTCG
 251 TGGCTGCCGT AGCGCATTAA
```

This corresponds to the amino acid sequence <SEQ ID 186; ORF 044.a>:

```
a044.pep
  1 VPSDQRVEFF PQVVVFDGLF GGGFPAVALP TVYPVFHAVF DVLRVGADDD

51 GAAAFERFQS FDDGGQFHTV VGGLRFAAEK FFFVAAVAH*
``` m044/a044 91.0% identity over a 89 aa overlap

```
                     10         20         30         40         50         60
    m044.pep  MPSDXSVEFFPEVVVFDGLFGGGFPAVALPTVYPVFHAIFDVLRVGADDDGAAAFERFQS
              :|||  |||||:|||||||||||||||||||||||||:||||||||||||||||||||||
        a044  VPSDQRVEFFPQVVVFDGLFGGGFPAVALPTVYPVFHAVFDVLRVGADDDGAAAFERFQS
                     10         20         30         40         50         60

70         80         90
    m044.pep  FDDGSQFHAVVGGLRFAAEKFFFVATVAHX
              ||||:|||:||||||||||||||||:||||
        a044  FDDGGQFHTVVGGLRFAAEKFFFVAAVAHX
                     70         80         90
```

Computer analysis of this amino acid sequence gave the following results:
Homology with a Predicted ORF from *N. gonorrhoeae*

ORF 044 shows 86.5% identity over a 89 aa overlap with a predicted ORF (ORF 044.ng) from *N. gonorrhoeae*:

```
    m044/g044
                     10         20         30         40         50         60
    m044.pep  MPSDXSVEFFPEVVVFDGLFGGGFPAVALPTVYPVFHAIFDVLRVGADDDGAAAFERFQS
              |  | ||||:|:||||||||||||||||||||||||||:|||||||||||||||||||||
        g044  MLPDQSVEFLPQVVVFDGLFGGGFPAVALPTVYPVFHAVFDVLRVGADDDGAAAFERFQP
                     10         20         30         40         50         60

70         80         90
    m044.pep  FDDGSQFHAVVGGLRFAAEKFFFVATVAHX
              ||:|:|:||||||||||||||||:|:||||
        g044  FDNGGQLHAVVGGLRFAAEKFFFAAAVAHX
                     70         80         90
```

The following partial DNA sequence was identified in *N. gonorrhoeae* <SEQ ID 187>:

```
g046.seq
  1 ATGTCGGCAA TGCTGCGTCC GACAAGCAGC CCGCCGCgcc gCGCCTGTAT

51 GATGACCATC CGCACGCGGT CGTCTGCAAA ACGTAAAACC TGCAATGCGC

101 CCGGGCAGTC TATCAGGCCG GCAAGCTGTT CGGTAACGAG CTGTTCGGGG

151 CTGATGGTTT CGGTTATGCC gaATATGGAA AGGCTGCCGt TTTcGTTGTT

201 TTCGAGCTTG GGGCTGAGGT ATTCGAGGTA TtcgctGGAA CGGACGCGCG

251 CGATGCGGCC GGGGATGTTG AACAGGTCGG CGGCAACTTT GCAGGCGACG

301 ATGTTGGTTT CGTCGCTGCG GGagaGCGCG AGcagcaagt cggcatcttC

351 CgcgccggcG Cgttataatg tgAAGGGGGA TGCGccgttg ccgaAAACGG

401 TTTGGacatc gaggcggctg CCTGTTTCCT GCAATGCTTT TTCGTCGATG

451 TCGATAAcgg TTACGTCGTT GTTGGTGATG GCGGCAAGGT TTTGCGCGAC

501 GGTAGAACCT ACCTGCCCGT TGCCTAAAAT GAGGATTTTC ACGGTATGGG

551 TCGCCGGGTG A
```

This corresponds to the amino acid sequence <SEQ ID 188; ORF 046.ng>:

```
g046.pep
   1 MSAMLRPTSS PPRRACMMTI RTRSSAKRKT CNAPGQSIRP ASCSVTSCSG

51 LMVSVMPNME RLPFSLFSSL GLRYSRYSLE RTRAMRPGML NRSAATLQAT

101 MLVSSLRESA SSKSASSAPA RYNVKGDAPL PKTVWTSRRL PVSCNAFSSM

151 SITVTSLLVM AARFCATVEP TCPLPKMRIF TVWVAG*
```

The following partial DNA sequence was identified in *N. meningitidis* <SEQ ID 189>:

```
m046.seg
   1 ATGTCGGCAA TGCTGCGTCC GACAAGCAsT CCGC.r.sGC gCGcCTGTAT

51 GATGACCATC CGCACGCGGT CGTCTGCAAA ACGTAAAACC TGCAATGCGC

101 CCGGGCAGTC TATCAGGCCG GCAAGCTGTT CGGTAACGAG CTGTTCGGGG

151 CTGATGGTTT CGGTTATGCC GAATATGGAA AGGCTGCCGT TTTCGTTGTT

201 TTCGAGCTTG GGGCTGAGGT ATTCGAGGTA TTCGCTGGAA CGGACGCGCG

251 CGATGCGGCC GGGGATGTTG AACAGGTCGG CGGCAACTTT GCAGGCGACG

301 ATGTTGGTTT CGTCGCTGCG GGAGAGCGCG AGCAGCAAGT CGGCATCTTC

351 CGCGCCGGCG CGTTCTAATG TGAAGGGGGA TGCGCCGTTG CCGAAAACGG

401 TTTGGACATC GAGGCGGCTG CCTGTTTCCT GCAATGCTTT TTCGTCGATG

451 TCGATAACGG TTACGTCGTT GTTGGGTATG GCGGCAAGGT TTTGTGCGAC

501 GGTAGAACCT ACCTGTCCGT TGCCTAAAAT GAGGATTTTC ACGGTGTGGG

551 TCGCCGAGTG A
```

This corresponds to the amino acid sequence <SEQ ID 190; ORF 046>:

```
m046.pep
   1 MSAMLRPTSX PXXRACMMTI RTRSSAKRKT CNAPGQSIRP ASCSVTSCSG

51 LMVSVMPNME RLPFSLFSSL GLRYSRYSLE RTRAMRPGML NRSAATLQAT

101 MLVSSLRESA SSKSASSAPA RSNVKGDAPL PKTVWTSRRL PVSCNAFSSM

151 SITVTSLLGM AARFCATVEP TCPLPKMRIF TVWVAE*
```

The following partial DNA sequence was identified in *N. meningitidis* <SEQ ID 191>:

```
a046.seq
   1 ATGTCGGCAA TGCTGCGTCC GACAAGCAGT CCGCCGCGCC GCGCCTGTAT

51 GATGACCATC CGCACGCGGT CGTCTGCAAA ACGTAAAACC TGCAATGCGC

101 CCGGGCAGTC TATCAGGCCG GCAAGCTGTT CGGTAACGAG CTGTTCGGGG

151 CTGATGGTTT CGGTTATGCC GAATATGGAA AGGCTGCCGT TTTCGTTGTT

201 TTCGAGCTTG GGGCTGAGGT ATTCGAGGTA TTCGCTGGAA CGGACGCGCG

251 CGATGCGGCC GGGGATGTTG AACAGGTCGG CGGCAACTTT GCAGGCGACG

301 ATGTTGGTTT CGTCGCTGCG GGAGAGCGCG AGCAGCAAGT CGGCATCTTC

351 CGCGCCGGCG CGTTCTAATG TGAAGGGGGA TGCGCCGTTG CCGAAAACGG

401 TTTGGACATC GAGGCGGCTG CCTGTTTCCT GCAATGCTTT TTCGTCGATG
```

-continued
```
451 TCGATAACGG TTACGTCGTT GTTGGGTATG GCGGCAAGGT TTTGTGCGAC

501 GGTAGAACCT ACCTGTCCGT TGCCTAAAAT GAGGATTTTC ACGGTGTGGG

551 TCGCCGAGTG A
```

This corresponds to the amino acid sequence <SEQ ID 192; ORF 046.a>:

```
a046.pep
  1 MSAMLRPTSS PPRRACMMTI RTRSSAKRKT CNAPGQSIRP ASCSVTSCSG

51 LMVSVMPNME RLPFSLFSSL GLRYSRYSLE RTRAMRPGML NRSAATLQAT

101 MLVSSLRESA SSKSASSAPA RSNVKGDAPL PKTVWTSRRL PVSCNAFSSM

151 SITVTSLLGM AARFCATVEP TCPLPKMRIF TVWVAE*
``` m046/a046 98.4% identity over a 186 aa overlap

```
                   10         20         30         40         50         60
     m046.pep MSAMLRPTSXPXXRACMMTIRTRSSAKRKTCNAPGQSIRPASCSVTSCSGLMVSVMPNME
              ||||||||| |  ||||||||||||||||||||||||||||||||||||||||||||||
         a046 MSAMLRPTSSPPRRACMMTIRTRSSAKRKTCNAPGQSIRPASCSVTSCSGLMVSVMPNME
                   10         20         30         40         50         60

70         80         90        100        110        120
     m046.pep RLPFSLFSSLGLRYSRYSLERTRAMRPGMLNRSAATLQATMLVSSLRESASSKSASSAPA
              ||||||||||||||||||||||||||||||||||||||||||||||||||||||||||||
         a046 RLPFSLFSSLGLRYSRYSLERTRAMRPGMLNRSAATLQATMLVSSLRESASSKSASSAPA
                   70         80         90        100        110        120

130        140        150        160        170        180
     m046.pep RSNVKGDAPLPKTVWTSRRLPVSCNAFSSMSITVTSLLGMAARFCATVEPTCPLPKMRIF
              ||||||||||||||||||||||||||||||||||||||||||||||||||||||||||||
         a046 RSNVKGDAPLPKTVWTSRRLPVSCNAFSSMSITVTSLLGMAARFCATVEPTCPLPKMRIF
                  130        140        150        160        170        180 m046.pep TVWVAEX
              |||||||
         a046 TVWVAEX
```

Computer analysis of this amino acid sequence gave the following results:
Homology with a Predicted ORF from *N. gonorrhoeae*
ORF 046 shows 97.3% identity over a 185 aa overlap with a predicted ORF (ORF 046.ng) from *N. gonorrhoeae*:

```
     m046/g046
                   10         20         30         40         50         60
     m046.pep MSAMLRPTSXPXXRACMMTIRTRSSAKRKTCNAPGQSIRPASCSVTSCSGLMVSVMPNME
              ||||||||| |  ||||||||||||||||||||||||||||||||||||||||||||||
         g046 MSAMLRPTSSPPRRACMMTIRTRSSAKRKTCNAPGQSIRPASCSVTSCSGLMVSVMPNME
                   10         20         30         40         50         60

70         80         90        100        110        120
     m046.pep RLPFSLFSSLGLRYSRYSLERTRAMRPGMLNRSAATLQATMLVSSLRESASSKSASSAPA
              ||||||||||||||||||||||||||||||||||||||||||||||||||||||||||||
         g046 RLPFSLFSSLGLRYSRYSLERTRAMRPGMLNRSAATLQATMLVSSLRESASSKSASSAPA
                   70         80         90        100        110        120

130        140        150        160        170        180
     m046.pep RSNVKGDAPLPKTVWTSRRLPVSCNAFSSMSITVTSLLGMAARFCATVEPTCPLPKMRIF
              | |||||||||||||||||||||||||||||||||||||| |||||||||||||||||||
         g046 RYNVKGDAPLPKTVWTSRRLPVSCNAFSSMSITVTSLLVMAARFCATVEPTCPLPKMRIF
                  130        140        150        160        170        180 m046.pep TVWVAEX
              |||||
         g046 TVWVAGX
```

The following partial DNA sequence was identified in *N. gonorrhoeae* <SEQ ID 193>:

```
g047.seq
    1 ATGGTCATCA TACAGGCGcg gcGCGGCGGG CTGCTTGTCG GACGCAGCAT

51 TGCCGACATC GCCCAAGATT TGCCCGACGG GGCCGACTGC CAAATCTGCG

101 CCGTTTACCG CAACAACCGC CTCATCGTCC CCGCGCCGCA AACCGTCATC

151 ATCGAAGGCG ACGAAATCCT GTTTGCCGCC GCCGCCGAAA ACATCGGGGC

201 GGTCATACCc gaATTGCGCC CCAAAGAAAC CAGCACCCGC CGCATCATGA

251 TTGCCGGCGG CGGCAACATc tgctACCGCC TCGCCAAGCA GCTCGAACAC

301 GCATAcaacG TCAAAATCAT CGAATGCCGG CCGCGCcgtg ccgaATGGAT

351 AGCCGAAAAC ctcgAcaaCA CCCTCGTCCT GCAAGGTTCG Gcaaccgacg 401 aAaccctgct cgAcaacgaa tacatcgacg aaatcgaCGT ATTCTGCGCC 451 CTGACCAACG ACGACGAAAG CAACATTAtg tCCGCCCTTT TGGCGAAAAA 501 CCTcggcgCG AAGCgcgtca tcggCATCGT CAACCGCTCA AGCTACGTCG

551 ATTTGCTCGA AGGCAACAAA ATCGACATCG TCGTCTCCCC CCACCTCATC

601 ACCATCGGCT CGATACTCGC CCACATCCGG CGCGGCGACA TCGTTGCCGT

651 CCACCTCATC CGGCGCGGCA CGGCGGAAGC CATCGAAGTC GTCGCGCACG

701 GCGACAAAAA AACTTCCGCC ATCATCGGCA GGCGCATCAG CGGCATCAAA

751 TGGCCCGAAG GCTGCCACAT TGCCGCCGTC GTCCGCGCCG GAACCGGCGA

801 AACCATTATG GGACACCATA CCGAAACCGT CATCCAAGAC GGTGACCACA

851 TCATCTTTTT CGTCTCGCGC CGGCGCATCC TGAACGAACT GGAGAAACTC

901 ATCCAAGTCA AATGGGCTT TTTCGGATAA
                                       35
```

This corresponds to the amino acid sequence <SEQ ID 194; ORF 047.ng>:

```
g047.pep
    1 MVIIQARRGG LLVGRSIADI AQDLPDGADC QICAVYRNNR LIVPAPQTVI

51 IEGDEILFAA AAENIGAVIP ELRPKETSTR RIMIAGGGNI CYRLAKQLEH

101 AYNVKIIECR PRRAEWIAEN LDNTLVLQGS ATDETLLDNE YIDEIDVFCA

151 LTNDDESNIM SALLAKNLGA KRVIGIVNRS SYVDLLEGNK IDIVVSPHLI

201 TIGSILAHIR RGDIVAVHPI RRGTAEAIEV VAHGDKKTSA IIGRRISGIK

251 WPEGCHIAAV VRAGTGETIM GHHTETVIQD GDHIIFFVSR RRILNELEKL

301 IQVKMGFFG*
```

The following partial DNA sequence was identified in *N. meningitidis* <SEQ ID 195>:

```
m047.seq
    1 ATGGTCATCA TACAGgCGcG C..syGCGGA sTGCTTGTCG GACGCAGCAT

51 TGCCGACATC GCCCAAGATT TGCCCGACGG GGCCGACTGC CAAATCTGCG

101 CCGTTTACCG CAACAACCGC CTCATCGTCC CCGCGCCGCA AACCGTCATC

151 ATCGAAGGCG ACGAAATCCT ATTTGCCGCC GCCGCCGAAA ACATCGGCGC

201 GGTCATACCC GAATTGCGCC CCAAAGAAAC CAAAGAAAC CAGCcCmgmm

251 GcATCATGAT TkCCGGCGGC GGCAACATCG GCTACCGTCT CGCCAAGCAG
```

-continued
```
301 CTCGAACACG CATACAACGT yAAAATCATC GAATGCCGGC CGCGCCGTGC

351 CGAATGGATA GCCGAAAACC TCGACAACAC CCTCGTCyTG CAAGGTTCGG

401 CAACCGACGA AACCCTGCTC GACAACGAAT ACATCGACGA AATCGACGTA

451 TTCTGCGCCC TGACCAACGA CGACGAAAGC AACATTATGT CCGCCCTTTT

501 GGCGAaAAAC CTCGGCGCGA AGCGCGTCAT CGGCATCGTC AACCGCTCAA

551 GCTACGTCGA TTTGCTCGAA GGCAACAAAA TCGACATCGT CGTCTCCCCC

601 CACCTCATCA CCATCGGCTC GATACTCGCC CACATCCGGC GCGGCGACAT

651 CGTTGCCGTC CACCCCATCC GGCGCGGCAC GGCGGAAGCC ATCGAAGTCG

701 TCGCACACGG CGACAAAAAA ACTTCCGCCA TCATCGGCAG GCGCATCAGC

751 GGCATCAAAT GGCCCGAAGG CTGCCACATT GCCGCCGTCG TCCGCGCCGG

801 AACCGGCGAA ACCATTATGG GACACCATAC CGAAACCGTC ATCCAAGACG

851 GCGACCACAT CATCTTTTTC GTCTCGCGCC GGCGCATCCT GAACGAACTG

901 GAAAAACTCA TCCAGGTCAA AATGGGCTTT TTCGGATAA
```

This corresponds to the amino acid sequence <SEQ ID 196; ORF 047>:

```
m047.pep
   1 MVIIQARXXG XLVGRSIADI AQDLPDGADC QICAVYRNNR LIVPAPQTVI

51 IEGDEILFAA AAENIGAVIP ELRPKETQRN QPXXIMIXGG GNIGYRLAKQ

101 LEHAYNVKII ECRPRRAEWI AENLDNTLVL QGSATDETLL DNEYIDEIDV

151 FCALTNDDES NIMSALLAKN LGAKRVIGIV NRSSYVDLLE GNKIDIVVSP

201 HLITIGSILA HIRRGDIVAV HPIRRGTAEA IEVVAHGDKK TSAIIGRRIS

251 GIKWPEGCHI AAVVRAGTGE TIMGHHTETV IQDGDHIIFF VSRRRILNEL

301 EKLIQVKMGF FG*
```

The following partial DNA sequence was identified in *N. meningitidis* <SEQ ID 197>:

```
a047.seq
   1 ATGGTCATCA TACAGGCGCG GCGCGGCGGA CTGCTTGTCG GACGCAGCAT

51 TGCCGACATC GCCCAAGATT TGCCCGACGG GGCCGACTGC CAAATCTGCG

101 CCGTTTACCG CAACAACCGC CTCATCGTCC CCGCGCCGCA AACCGTCATC

151 ATCGAAGGCG ACGAAATCCT ATTTGCCGCC GCCGCCGAAA ACATCGGCGC

201 GGTCATACCC GAATTGCGCC CCAAAGAAAC CAGCACCCGC CGCATCATGA

251 TTGCCGGCGG CGGCAACATC GGCTACCGTC TCGCCAAGCA GCTCGAACAC

301 GCATACAACG TCAAAATCAT CGAATGCCGG CCGCGCCGTG CCGAATGGAT

351 AGCCGAAAAC CTCGACAACA CCCTCGTCCT GCAAGGTTCG GCAACCGACG

401 AAACCCTGCT CGACAACGAA TACATCGACG AAATCGACGT ATTCTGCGCC

451 CTGACCAACG ACGACGAAAG CAACATTATG TCCGCCCTTT TGGCGAAAAA

501 CCTCGGCGCG AAGCGCGTCA TCGGCATCGT CAACCGCTCA AGCTACGTCG

551 ATTTGCTCGA AGGCAACAAA ATCGACATCG TCGTCTCCCC CCACCTCATC

601 ACCATCGGCT CGATACTCGC CCACATCCGG CGCGGCGACA TCGTTGCCGT

651 CCACCTCATC CGGCGCGGCA CGGCGGAAGC CATCGAAGTC GTCGCACACG
```

```
701 GCGACAAAAA AACTTCCGCC ATCATCGGCA GGCGCATCAG CGGCATCAAA

751 TGGCCCGAAG GCTGCCACAT TGCCGCCGTC GTCCGCGCCG GAACCGGCGA

801 AACCATTATG GGACACCATA CCGAAACCGT CATCCAAGAC GGCGACCACA

851 TCATCTTTTT CGTCTCGCGC CGGCGCATCC TGAACGAACT GGAAAAACTC

901 ATCCAAGTCA AAATGGGCTT TTTCGGATAA
```

This corresponds to the amino acid sequence <SEQ ID 198; ORF 047.a>:

```
a047.pep
  1 MVIIQARRGG LLVGRSIADI AQDLPDGADC QICAVYRNNR LIVPAPQTVI

51 IEGDEILFAA AAENIGAVIP ELRPKETSTR RIMIAGGGNI GYRLAKQLEH

101 AYNVKIIECR PRRAEWIAEN LDNTLVLQGS ATDETLLDNE YIDEIDVFCA

151 LTNDDESNIM SALLAKNLGA KRVIGIVNRS SYVDLLEGNK IDIVVSPHLI

201 TIGSILAHIR RGDIVAVHPI RRGTAEAIEV VAHGDKKTSA IIGRRISGIK

251 WPEGCHIAAV VRAGTGETIM GHHTETVIQD GDHIIFFVSR RRILNELEKL

301 IQVKMGFFG*
``` m047/a047 96.5% identity over a 312 aa overlap

```
                 10        20        30        40        50        60
m047.pep  MVIIQARXXGXLVGRSIADIAQDLPDGADCQICAVYRNNRLIVPAPQTVIIEGDEILFAA
          |||||||  |  |||||||||||||||||||||||||||||||||||||||||||||||
a047      MVIIQARRGGLLVGRSIADIAQDLPDGADCQICAVYRNNRLIVPAPQTVIIEGDEILFAA
                 10        20        30        40        50        60
                 70        80        90       100       110       120
m047.pep  AAENIGAVIPELRPKETQRNQPXXIMIXGGGNIGYRLAKQLEHAYNVKIIECRPRRAEWI
          ||||||||||||||||||:   :   ||| ||||||||||||||||||||||||||||||
a047      AAENIGAVIPELRPKETSTRR---IMIAGGGNIGYRLAKQLEHAYNVKIIECRPRRAEWI
                 70        80        90       100       110
                130       140       150       160       170       180
m047.pep  AENLDNTLVLQGSATDETLLDNEYIDEIDVFCALTNDDESNIMSALLAKNLGAKRVIGIV
          ||||||||||||||||||||||||||||||||||||||||||||||||||||||||||||
a047      AENLDNTLVLQGSATDETLLDNEYIDEIDVFCALTNDDESNIMSALLAKNLGAKRVIGIV
                120       130       140       150       160       170
                190       200       210       220       230       240
m047.pep  NRSSYVDLLEGNKIDIVVSPHLITIGSILAHIRRGDIVAVHPIRRGTAEAIEVVAHGDKK
          ||||||||||||||||||||||||||||||||||||||||||||||||||||||||||||
a047      NRSSYVDLLEGNKIDIVVSPHLITIGSILAHIRRGDIVAVHPIRRGTAEAIEVVAHGDKK
                180       190       200       210       220       230
                250       260       270       280       290       300
m047.pep  TSAIIGRRISGIKWPEGCHIAAVVRAGTGETIMGHHTETVIQDGDHIIFFVSRRRILNEL
          ||||||||||||||||||||||||||||||||||||||||||||||||||||||||||||
a047      TSAIIGRRISGIKWPEGCHIAAVVRAGTGETIMGHHTETVIQDGDHIIFFVSRRRILNEL
                240       250       260       270       280       290
                310
m047.pep  EKLIQVKMGFFGX
          |||||||||||||
a047      EKLIQVKMGFFGX
                300       310
```

Computer analysis of this amino acid sequence gave the following results:

Homology with a Predicted ORF from *N. gonorrhoeae*

ORF 047 shows 96.2% identity over a 312 aa overlap with a predicted ORF (ORF 047.ng) from *N. gonorrhoeae*:

```
m047/g045 m047.pep  MVIIQARXXGXLVGRSIADIAQDLPDGADCQICAVYRNNRLIVPAPQTVIIEGDEILFAA   60
          |||||||  |  |||||||||||||||||||||||||||||||||||||||||||||||
g047      MVIIQARRGGLLVGRSIADIAQDLPDGADCQICAVYRNNRLIVPAPQTVIIEGDEILFAA   60
```

```
m047.pep  AAENIGAVIPELRPKETQRNQPXXIMIXGGGNIGYRLAKQLEHAYNVKIIECRPRRAEWI  120
          ||||||||||||||||: :   |||  |||||  ||||||||||||||||||||||||
g047      AAENIGAVIPELRPKETSTRR---IMIAGGGNICYRLAKQLEHAYNVKIIECRPRRAEWI  117 m047.pep  AENLDNTLVLQGSATDETLLDNEYIDEIDVFCALTNDDESNIMSALLAKNLGAKRVIGIV  180
          ||||||||||||||||||||||||||||||||||||||||||||||||||||||||||
g047      AENLDNTLVLQGSATDETLLDNEYIDEIDVFCALTNDDESNIMSALLAKNLGAKRVIGIV  177 m047.pep  NRSSYVDLLEGNKIDIVVSPHLITIGSILAHIRRGDIVAVHPIRRGTAEAIEVVAHGDKK  240
          ||||||||||||||||||||||||||||||||||||||||||||||||||||||||||
g047      NRSSYVDLLEGNKIDIVVSPHLITIGSILAHIRRGDIVAVHPIRRGTAEAIEVVAHGDKK  237 m047.pep  TSAIIGRRISGIKWPEGCHIAAVVRAGTGETIMGHHTETVIQDGDHIIFFVSRRRILNEL  300
          ||||||||||||||||||||||||||||||||||||||||||||||||||||||||||
g047      TSAIIGRRISGIKWPEGCHIAAVVRAGTGETIMGHHTETVIQDGDHIIFFVSRRRILNEL  297 m047.pep  EKLIQVKMGFFGX  313
          |||||||||||||
g047      EKLIQVKMGFFGX  310
```

The following partial DNA sequence was identified in *N. gonorrhoeae* <SEQ ID 199>:

```
g048.seq
   1 ATGCTCGACA AAGGCGAGGA GTTGCCCGTC GATTTCACCA ACCGCCTGAT

51 TTACTACGTc ggcCCcgTCG ATCCGGTCGG CGATGAAGTC GTCGGTCCCG

101 CAGGTCCGAC CACAGCCACC CGCATGGACA AATTTACCCG CCAAATGCTC

151 AAACAAACCG GCCTCTTGGG CATGATCGGC AAATCCGagc gcgGcgcggc 201 cacctGCGAA GCcatCGCCG ACAACAAGGC CGTGTACCTC ATGGCAGTCG

251 GCGGCGCGGC ATACCTCGTG GCAAAAGCCA TCAAATCTTC CAAAGTCTTG

301 GCGTTCCCCG AATTGGGTAT GGAAGCCGTT TACGAATTTG AAGTCAAAGA

351 TATGCCCGTA ACCGTCGCCG TGGACAGCAA AGGCGAATCC ATCCACGCCA

401 CCGCCCCGCG CAAATGGCAG GCGAAAATCG GCATCATCCC CGTCGAGTCT

451 TGA
```

This corresponds to the amino acid sequence <SEQ ID 200; ORF 048.ng>:

```
g048.pep
   1 MLDKGEELPV DFTNRLIYYV GPVDPVGDEV VGPAGPTTAT RMDKFTRQML

51 KQTGLLGMIG KSERGAATCE AIADNKAVYL MAVGGAAYLV AKAIKSSKVL

101 AFPELGMEAV YEFEVKDMPV TVAVDSKGES IHATAPRKWQ AKIGIIPVES

151 *
```

The following partial DNA sequence was identified in *N. meningitidis* <SEQ ID 201>:

```
m048.seq
   1 ATGCTCAACA AAGGCGAAGA ATTGCCCGTC GATTTCACCA ACCGCCTGAT

51 TTACTACGTC GGCCCCGTCG ATCCGGTCGG CGATGAAGTC GTCGGTCCGG

101 CAGGTCCGAC CACAGCCACC CGCATGGACA AATTCACCCG CCAAATGCTC

151 GAACAAACCG ACCTCTTGGG CATGATCGGC AAATCCGAGC GCGGCGTGGC

201 CACCTGCGAA GCCATCGCCG ACAACAAAGC CGTGTACCTC ATGGCAGTCG

251 GCGGCGCGGC GTATCTCGTG GCAAAAGCCA TCAAATCTTC CAAAGTCTTG

301 GCGTTCCCCG AATTGGGCAT GGAAGCCATT TACGAATTTG AAGTCAAAGA

351 CATGCCCGTA ACCGTCGCCG TAGATAGCAA AGGCGAATCC ATCCACGCCA
```

```
401 CCGCCCCGCG CAAATGGCAG GCGAAAATCG GCATCATCCC CGTCGAATCT

451 TGA
```

This corresponds to the amino acid sequence <SEQ ID 202; ORF 048>:

```
m048.pep
  1 MLNKGEELPV DFTNRLIYYV GPVDPVGDEV VGPAGPTTAT RMDKFTRQML

51 EQTDLLGMIG KSERGVATCE AIADNKAVYL MAVGGAAYLV AKAIKSSKVL

101 AFPELGMEAI YEFEVKDMPV TVAVDSKGES IHATAPRKWQ AKIGIIPVES

151 *
```

The following partial DNA sequence was identified in *N. meningitidis* <SEQ ID 203>:

```
a048.seq
  1 ATGCTCGACA AAGGCGAAGA ATTGCCCGTC GATTTCACCA ACCGCCTGAT

51 TTACTACGTC GGCCCCGTCG ATCCGGTCGG CGACGAAATC GTCGGCCCAG

101 CAGGTCCGAC CACCGCCACC CGCATGGACA AATTCACCCG CCAAATGCTC

151 GAACAAACCG ACCTCTTGGG CATGATCGGC AAATCCGAGC GCGGCGCGGC

201 CACCTGCGAA GCCATCGCCG ACAACAAAGC CGTGTACCTC ATGGCAGTCG

251 GCGGCGCGGC GTATCTCGTG GCAAAAGCCA TCAAATCTTC CAAAGTCTTG

301 GCGTTCCCCG AATTGGGCAT GGAAGCCATT TACGAATTTG AAGTCAAAGA

351 CATGCCCGTA ACCGTCGCCG TAGACAGCAA AGGCGAATCC ATCCACGCCA

401 CCGCCCCGCC CCAATGGCAG GCGAAAATCG GCATCATCCC CGTCAAATCT

451 TGA
```

This corresponds to the amino acid sequence <SEQ ID 204; ORF 048.a>:

```
a048.pep
  1 MLDKGEELPV DFTNRLIYYV GPVDPVGDEI VGPAGPTTAT RMDKFTRQML

51 EQTDLLGMIG KSERGAATCE AIADNKAVYL MAVGGAAYLV AKAIKSSKVL

101 AFPELGMEAI YEFEVKDMPV TVAVDSKGES IHATAPPQWQ AKIGIIPVKS

151 *
``` m048/a048 96.0% identity over a 150 aa overlap

```
                  10         20         30         40         50         60
       m048.pep   MLNKGEELPVDFTNRLIYYVGPVDPVGDEVVGPAGPTTATRMDKFTRQMLEQTDLLGMIG
                  ||:|||||||||||||||||||||||||||:|||||||||||||||||||||||||||||
           a048   MLDKGEELPVDFTNRLIYYVGPVDPVGDEIVGPAGPTTATRMDKFTRQMLEQTDLLGMIG
                  10         20         30         40         50         60

70         80         90        100        110        120
       m048.pep   KSERGVATCEAIADNKAVYLMAVGGAAYLVAKAIKSSKVLAFPELGMEAIYEFEVKDMPV
                  |||||:||||||||||||||||||||||||||||||||||||||||||||||||||||||
           a048   KSERGAATCEAIADNKAVYLMAVGGAAYLVAKAIKSSKVLAFPELGMEAIYEFEVKDMPV
                  70         80         90        100        110        120

130        140        150
       m048.pep  TVAVDSKGESIHATAPRKWQAKIGIIPVESX
                 ||||||||||||||||:|||||||||:||
           a048  TVAVDSKGESIHATAPPQWQAKIGIIPVKSX
                 130        140        150
```

Computer analysis of this amino acid sequence gave the following results:

Homology with a Predicted ORF from *N. gonorrhoeae*

ORF 048 shows 96.4% identity over a 150 aa overlap with a predicted ORF (ORF 048.ng) from *N. gonorrhoeae*:

```
m048/g048

10        20        30        40        50        60
   m048.pep  MLNKGEELPVDFTNRLIYYVGPVDPVGDEVVGPAGPTTATRMDKFTRQMLEQTDLLGMIG
             ||:|||||||||||||||||||||||||||||||||||||||||||:|| ||||||
   g048      MLDKGEELPVDFTNRLIYYVGPVDPVGDEVVGPAGPTTATRMDKFTRQMLKQTGLLGMIG
                  10        20        30        40        50        60

70        80        90       100       110       120
   m048.pep  KSERGVATCEAIADNKAVYLMAVGGAAYLVAKAIKSSKVLAFPELGMEAIYEFEVKDMPV
             |||||:||||||||||||||||||||||||||||||||||||||||||:|||||||||||
   g048      KSERGAATCEAIADNKAVYLMAVGGAAYLVAKAIKSSKVLAFPELGMEAVYEFEVKDMPV
                  70        80        90       100       110       120

130       140       150
   m048.pep  TVAVDSKGESIHATAPRKWQAKIGIIPVESX
             ||||||||||||||||||||||||||||||
   g048      TVAVDSKGESIHATAPRKWQAKIGIIPVESX
                 130       140       150
```

The following partial DNA sequence was identified in *N. gonorrhoeae* <SEQ ID 205>:

```
g049.seq
   1 ATGCGGGCGC AGGCGTTTGA TCAACCGTTC GGTCAGCTCC TGTTCGGACA

51 GGCAGAACAC TTCGCGCCGG TTGACGGCTT TCGGGTTCAG GATATTGATT

101 TGGACGGGCA TCAACGCCTC TTCCGCACCG CCTTCGCCGT TTTCCGCAAC

151 CCCGTCTGCC GCCGTACCGG ATTCTGCCGC ATCGGCGTTT TCCCCGCCCT

201 CAATCTGTGC GGTTTCAAAT TCGGCACTGT CTTTTTTGGC ATCGAACCGG

251 ATTCTCCGCC GCGATTCGAT GTGTTTTTCC GAAAccggca tTTGCAGGGA

301 AGCCTgcgcg TTGAGCCAGT TTTCCTGAAG GACGATCATC GGGTCGGTTT

351 CGACTTCCTC GCCGCAATCG GCAACGGCgc tGTTGTGTTC TTCCTGCCAT

401 TTCTTCAGAT ACGCCTTTAA
```

This corresponds to the amino acid sequence <SEQ ID 206; ORF 049.ng>:

```
g049.pep
   1 MRAQAFDQPF GQLLFGQAEH FAPVDGFRVQ DIDLDGHQRL FRTAFAVFRN

51 PVCRRTGFCR IGVFPALNLC GFKFGTVFFG IEPDSPPRFD VFFRNRHLQG

101 SLRVEPVFLK DDHRVGFDFL AAIGNGAVVF FLPFLQIRL*
```

The following partial DNA sequence was identified in *N. meningitidis* <SEQ ID 207>:

```
m049.seq (partial)
   1 ATGCGGGCGC AGGCGTTTGA TCAGCCGTTC GGTCAGCTCC TGTTCGGACA

51 GGCAGAACAC TTCGCGCCGG TTGACGGCTT TCGGGTTCAG GATATTGATT

101 TGGACGGGCA TCAACGTTTC TTCCGCATCG TTTTCCCCGT TTTCCGAAAC

151 CGCCGGCTCA TTCGTGCCGG ATTCTGCCTC GTCGGCGTTT TCCCCGCTTT

201 CAATCTGTCC GGTTTCAAAT TCGACACTGT CTTTTTTGGT ATCAAACCGG

251 ATTCTCCGCC GCGATTCGAT GTGTTTTTCC GAAACCGACA TTTGCAGGGA

301 AGCCTGCGCG TTGAGCCAGT TTTCCTGAAG GACGATCATC GGGTCGGTTT
```

-continued

```
351 CGACTTCCTC GCCGCAATCG GCAACGGCGG CATTGTGTTC CTCCTGCCAT

401 TTTTTCAGAT ACGCCTT...
```

This corresponds to the amino acid sequence <SEQ ID 208; ORF 049>:

```
m049.pep (partial)
  1 MRAQAFDQPF GQLLFGQAEH FAPVDGFRVQ DIDLDGHQRF FRIVFPVFRN

51 RRLIRAGFCL VGVFPAFNLS GFKFDTVFFG IKPDSPPRFD VFFRNRHLQG

101 SLRVEPVFLK DDHRVGFDFL AAIGNGGIVF LLPFFQIRL...
```

The following partial DNA sequence was identified in *N. meningitidis* <SEQ ID 209>:

```
a049.seq
  1 ATGCGGGCGC AGGCGTTTGA TCAGCCGTTC GGTCAGCTCC TGTTCGGACA

51 GGCAGAACAC TTCGCGCCGG TTGACGGCTT TCGGGTTCAG AATATTGATT

101 TGGACGGGCA TCAACGCTTC TTCCGCACCG CCTTCGCCGT TTTCCGCAAC

151 CCCGTCTGCC GCCGTACCCG ATTCTGCCGC ATCGGCGTTT TCCCCGCCTT

201 CAATCTGTCC GGTTTCAAAT TCGGCACTGT CTTTTTTGGC ATCAAACCGG

251 ATTCTCCGCC GCGATTCGAT GTGTTTTTCC GAAACCGACA TTTGCAGGGA

301 AGCCTGCGCG TTGAGCCAGT TTTCCTGAAG GACGATCATC GGGTCGGTTT

351 CGACTTCCTC GCCGCAATCG GCAACGGCGG CATTGTGTTC CTCCTGCCAT

401 TTTTTCAGAT ACGCCTT
```

This corresponds to the amino acid sequence <SEQ ID 210; ORF 049.a>:

```
a049.pep
  1 MRAQAFDQPF GQLLFGQAEH FAPVDGFRVQ NIDLDGHQRF FRTAFAVFRN

51 PVCRRTRFCR IGVFPAFNLS GFKFGTVFFG IKPDSPPRFD VFFRNRHLQG

101 SLRVEPVFLK DDHRVGFDFL AAIGNGGIVF LLPFFQIRL
``` m049/a049 90.6% identity over a 139 aa overlap

```
                    10         20         30         40         50         60
       m049.pep     MRAQAFDQPFGQLLFGQAEHFAPVDGFRVQDIDLDGHQRFFRIVFPVFRNRRLIRAGFCL
                    ||||||||||||||||||||||||||||||:||||||||||:|||||   |:  ||
       a049         MRAQAFDQPFGQLLFGQAEHFAPVDGFRVQNIDLDGHQRFFRTAFAVFRNPVCRRTRFCR
                    10         20         30         40         50         60

70         80         90        100        110        120
       m049.pep     VGVFPAFNLSGFKFDTVFFGIKPDSPPRFDVFFRNRHLQGSLRVEPVFLKDDHRVGFDFL
                    :||||||||||| |||||||||||||||||||||||||||||||||||||||||||||||
       a049         IGVFPAFNLSGFKFGTVFFGIKPDSPPRFDVFFRNRHLQGSLRVEPVFLKDDHRVGFDFL
                    70         80         90        100        110        120

130      139
       m049.pep     AAIGNGGIVFLLPFFQIRL
                    |||||||||||||||||||
       a049         AAIGNGGIVFLLPFFQIRL
                    130
```

Computer analysis of this amino acid sequence gave the following results:

Homology with a Predicted ORF from *N. gonorrhoeae*

ORF 049 shows 86.3% identity over a 139 aa overlap with a predicted ORF (ORF 049.ng) from *N. gonorrhoeae*:

```
m049/g049
                 10         20         30         40         50         60
   m049.pep  MRAQAFDQPFGQLLFGQAEHFAPVDGFRVQDIDLDGHQRFFRIVFPVFRNRRLIRAGFCL
             ||||||||||||||||||||||||||||||||||||||:||  :|  ||||     |:|||
   g049      MRAQAFDQPFGQLLFGQAEHFAPVDGFRVQDIDLDGHQRLFRTAFAVFRNPVCRRTGFCR
                 10         20         30         40         50         60

70         80         90        100        110        120
   m049.pep  VGVFPAFNLSGFKFDTVFFGIKPDSPPRFDVFFRNRHLQGSLRVEPVFLKDDHRVGFDFL
             :||||| :||  ||||  ||||||:||||||||||||||||||||||||||||||||||
   g049      IGVFPALNLCGFKFGTVFFGIEPDSPPRFDVFFRNRHLQGSLRVEPVFLKDDHRVGFDFL
                 70         80         90        100        110        120

130        139
   m049.pep  AAIGNGGIVFLLPFFQIRL
             ||||||::||:|||:||||
   g049      AAIGNGAVVFFLPFLQIRLX
                130        140
```

The following partial DNA sequence was identified in *N. gonorrhoeae* <SEQ ID 211>:

```
g050.seq
    1 atgggcgCGG GCTGGTGTCC TCCCGGCATC TTGGGCATCG GCATCGGCGg 51 cacgcccGAA AAAGccgtgt TGATGGcaaA AGAATCCCTG ATGAGCCACA 101 TCGAcatCca aGaATTGCAG GAAAAAGCCG CGTccggggc ggaattgtcc 151 accaccgaAG ccCTGCGCCT cGAACTCTTT GAAAAGGTCA ACGCGCTGGG

201 CATCGGCGCG CAAGGCTTGG GCGGTCTGAC CACCGTGTTG GACGTGAAAA

251 TCCTCGATTA CCCGACCCAT GCCGCCTCCA AACCGATTGC CATGATTCCC

301 AACTGTGCcg ccacCCGcca cgtcgAATTT GAATTGgACG GCTCAGGtcc

351 TGTCGAactc acgccGCcgc gtgtCGAAGA CTGA
```

This corresponds to the amino acid sequence <SEQ ID 212; ORF 050.ng>:

```
g050.pep
    1 MGAGWCPPGI LGIGIGGTPE KAVLMAKESL MSHIDIQELQ EKAASGAELS

51 TTEALRLELF EKVNALGIGA QGLGGLTTVL DVKILDYPTH AASKPIAMIP

101 NCAATRHVEF ELDGSGPVEL TPPRVED*
```

The following partial DNA sequence was identified in *N. meningitidis* <SEQ ID 213>:

```
m050.seq
    1 ATGGGCGCGG GCTGGTGTCC TCCCGGCATC TTGGGTATCG GCATCGGCGG

51 C..agCCgAA AAAGCCGTGC TGATGGCAAA AGAGTCCCTG ATGAGCCACA

101 TCGACATTCA AGAATTGCAG GAAAAGGCCG CGTCCGGCGC GgAATTGTCC

151 ACCACCGAAG CCCTGCGCCT CGAACTCTTT GAAAAAGTCA ACGCGCTGGG

201 CATCGGCGCA CAAGGCTTGG GCGGACTGAC CACCGTGTTG GACGTGAAAA
```

-continued

```
251 TCCTCGATTA TCCGACCCAC GCCGCCTCCA AACCGATTGC CATGATTCCG

301 AACTGCGCCG CCACCCGCCA CGTCGAATTT GAATTGGACG GCTCAGGCCC

351 TGTCGAACTC ACGCCGCCGC GCGTCGAAGA TGGCCCGATT TGA
```

This corresponds to the amino acid sequence <SEQ ID 214; ORF 050>:

```
m050.pep
  1 MGAGWCPPGI LGIGIGGXAE KAVLMAKESL MSHIDIQELQ EKAASGAELS

51 TTEALRLELF EKVNALGIGA QGLGGLTTVL DVKILDYPTH AASKPIAMIP

101 NCAATRHVEF ELDGSGPVEL TPPRVEDGPI *
```

The following partial DNA sequence was identified in *N. meningitidis* <SEQ ID 215>:

```
a050.seq
  1 ATGGGCGCGG GCTGGTGTCC TCCCGGCATC TTGGGCATCG GCATCGGCGG

51 TACGCCCGAA AAAGCCGTGT TGATGGCGAA AGAATCCCTG ATGAGCCACA

101 TCGACATCCA AGAATTGCAG GAAAAAGCCG CGTCCGGCGC GGAATTGTCC

151 ACCACCGAAG CCCTGCGCCT CGAACTCTTT GAAAAAGTCA ACGCGCTAGG

201 CATCGGCGCG CAAGGCTTGG GCGGTCTGAC CACCGTGTTG GACGTGAAAA

251 TCCTCGATTA CCCGACCCAC GCCGCCTCCA AACCGATTGC CATGATTCCG

301 AACTGCGCCG CCACCCGCCA CGTCGAATTT GAATTGGACG GCTCAGGCCC

351 TGTCGAACTC ACGCCGCCGC GCGTCGAAGA CTGGCCC
```

This corresponds to the amino acid sequence <SEQ ID 216; ORF 050.a>:

```
a050.pep
  1 MGAGWCPPGI LGIGIGGTPE KAVLMAKESL MSHIDIQELQ EKAASGAELS

51 TTEALRLELF EKVNALGIGA QGLGGLTTVL DVKILDYPTH AASKPIAMIP

101 NCAATRHVEF ELDGSGPVEL TPPRVEDWP
``` m050/a050 97.7% identity over a 129 aa overlap

```
                  10         20         30         40         50         60
      m050.pep  MGAGWCPPGILGIGIGGXAEKAVLMAKESLMSHIDIQELQEKAASGAELSTTEALRLELF
                ||||||||||||||||| :|||||||||||||||||||||||||||||||||||||||||
          a050  MGAGWCPPGILGIGIGGTPEKAVLMAKESLMSHIDIQELQEKAASGAELSTTEALRLELF
                  10         20         30         40         50         60

70         80         90        100        110        120
      m050.pep  EKVNALGIGAQGLGGLTTVLDVKILDYPTHAASKPIAMIPNCAATRHVEFELDGSGPVEL
                ||||||||||||||||||||||||||||||||||||||||||||||||||||||||||||
          a050  EKVNALGIGAQGLGGLTTVLDVKILDYPTHAASKPIAMIPNCAATRHVEFELDGSGPVEL
                  70         80         90        100        110        120

130
      m050.pep  TPPRVEDGPIX
                ||||||| |
          a050  TPPRVEDWP
```

Computer analysis of this amino acid sequence gave the following results:
Homology with a Predicted ORF from *N. gonorrhoeae*
ORF 050 shows 98.4% identity over a 127 aa overlap with a predicted ORF (ORF 050.ng) from *N. gonorrhoeae*:

```
    m050/g050

10        20        30        40        50        60
        m050.pep  MGAGWCPPGILGIGIGGXAEKAVLMAKESLMSHIDIQELQEKAASGAELSTTEALRLELF
                  ||||||||||||||||:|||||||||||||||||||||||||||||||||||||||||||
        g050      MGAGWCPPGILGIGIGGTPEKAVLMAKESLMSHIDIQELQEKAASGAELSTTEALRLELF
                      10        20        30        40        50        60
                      70        80        90       100       110       120
        m050.pep  EKVNALGIGAQGLGGLTTVLDVKILDYPTHAASKPIAMIPNCAATRHVEFELDGSGPVEL
                  ||||||||||||||||||||||||||||||||||||||||||||||||||||||||||||
        g050      EKVNALGIGAQGLGGLTTVLDVKILDYPTHAASKPIAMIPNCAATRHVEFELDGSGPVEL
                      70        80        90       100       110       120
                     130
        m050.pep  TPPRVEDGPIX
                  |||||||
        g050      TPPRVEDX
```

The following partial DNA sequence was identified in *N. gonorrhoeae* <SEQ ID 217>:

```
g050-1.seq
    1 ATGACCGTTA TCAAGCAAGA AGACTTTATT CAAAGTATCT GCGATGCCTT

51 CCAATTCATC AGCTACTACC ATCCAAAAGA CTACATCGAC GCGCTTTATA

101 AGGCGTGGCA GAAGGAAGAA AATCCCGCCG CCAAAGACGC GATGACGCAG

151 ATTTTGGTCA ACAGCCGTAT GTGTGCCGAA ACAACCGCC CCATCTGCCA

201 AGACACAGGT ATCGCAACCG TCTTCCTCAA AGTCGGTATG GATGTGCAAT

251 GGGATGCGGA CATGAGCGTG GAAAAGATGG TTAACGAAGG CGTACGCCGC

301 GCCTACACTT GGGAAGGCAA CACCCTGCGC GCTTCCGTCC TCGCCGATCC

351 GGCCGGCAAA CGCCAAAACA CCAAAGACAA CACCCCCGCC GTCATCCACA

401 TGAGCATCGT GCCGGGCGGT AAAGTCGAAG TAACCTGCGC GGCAAAAGGC

451 GGCGGCTCTG AAAACAAATC CAAACTCGCT ATGCTCAACC CTTCCGACAA

501 CATCGTCGAT TGGGTATTGA AAACCATCCC GACGATGGGC GCGGGCTGGT

551 GTCCTCCCGG CATCTTGGGC ATCGGCATCG GCGGCAcgcC CGAAAAAGCC

601 GTGTTGATGG cgaAAGAATC CCTGATGAGC CACATCGACA TCCAAGAATT

651 GCAGGAAAAA GCCGCGTCCG GCGCGGAATT GTCCACCACC GAAGCCCTGC

701 GCCTCGAACT CTTTGAAAAG GTCAACGCGC TGGGCATCGG CGCGCAAGGC

751 TTGGGCGGTC TGACCACCGT GTTGGACGTG AAAATCCTCG ATTACCCGAC

801 CCATGCCGCC TCCAAACCGA TTGCCATGAT TCCCAACTGT GCCGCCACCC

851 GCCACGTCGA ATTTGAATTG GACGGCTCAG GTCCTGTCGA ACTCACGCCG

901 CCGCGCGTCG AAGACTGACC CGATCTGACT TACAGCCCCG ACAACGGCAA

951 ACGCGTCGAT GTCGATAAGC TGACCAAAGA AGAAGTGGCA AGCTGGAAAA

1001 CCGGCGACGT ATTGCTGTTG AACGGCAAAA TCCTCACCGG CCGCGATGCC

1051 GCGCACAAAC GCCTCGTCAA TATGCTCGAC AAAGGCGAGG AGTTGCCCGT

1101 CGATTTCACC AACCGCCTGA TTTACTACGT CGGCCCCGTC GATCCGGTCG

1151 GCGATGAAGT CGTCGGTCCC GCAGGTCCGA CCACAGCCAC CCGCATGGAC

1201 AAATTTACCC GCCAAATGCT CAAACAAACC GGCCTCTTGG GCATGATCGG
```

```
1251 CAAATCCGAG CGCGGCGCGG CCACCTGCGA AGCCATCGCC GACAACAAGG

1301 CCGTGTACCT CATGGCAGTC GGCGGCGCGG CATACCTCGT GGCAAAAGCC

1351 ATCAAATCTT CCAAAGTCTT GGCGTTCCCC GAATTGGGTA TGGAAGCCGT

1401 TTACGAATTT GAAGTCAAAG ATATGCCCGT AACCGTCGCC GTGGACAGCA

1451 AAGGCGAATC CATCCACGCC ACCGCCCCGC GCAAATGGCA GGCGAAAATC

1501 GGCATCATCC CCGTCGAGTC TTGA
```

This corresponds to the amino acid sequence <SEQ ID 218; ORF 050-1.ng>:

```
g050-1.pep

1 MTVIKQEDFI QSICDAFQFI SYYHPKDYID ALYKAWQKEE NPAAKDAMTQ

51 ILVNSRMCAE NNRPICQDTG IATVFLKVGM DVQWDADMSV EKMVNEGVRR

101 AYTWEGNTLR ASVLADPAGK RQNTKDNTPA VIHMSIVPGG KVEVTCAAKG

151 GGSENKSKLA MLNPSDNIVD WVLKTIPTMG AGWCPPGILG IGIGGTPEKA

201 VLMAKESLMS HIDIQELQEK AASGAELSTT EALRLELFEK VNALGIGAQG

251 LGGLTTVLDV KILDYPTHAA SKPIAMIPNC AATRHVEFEL DGSGPVELTP

301 PRVED*PDLT YSPDNGKRVD VDKLTKEEVA SWKTGDVLLL NGKILTGRDA

351 AHKRLVNMLD KGEELPVDFT NRLIYYVGPV DPVGDEVVGP AGPTTATRMD

401 KFTRQMLKQT GLLGMIGKSE RGAATCEAIA DNKAVYLMAV GGAAYLVAKA

451 IKSSKVLAFP ELGMEAVYEF EVKDMPVTVA VDSKGESIHA TAPRKWQAKI

501 GIIPVES*
```

```
g050-1 (SEQ ID NO: 218)/p14407 (SEQ ID NO: 4160)
 sp|P14407|FUMB_ECOLI FUMARATE HYDRATASE CLASS I, ANAEROBIC (FUMARASE)
>gi|280063|pir||B44511 fumarate hydratase (EC 4.2.1.2) fumB, iron-dependent-Escherichia coli
>gi|146048 (M27058) anaerobic class I fumarase (EC 4.2.1.2) [Escherichia coli] Length = 548
 Score = 172 bits (432), Expect = 4e-42
 Identities = 138/488 (28%), Positives = 216/488 (43%), Gaps = 22/488 (4%)

Query:  11 QSICDAFQFISYYHPKDYIDALYKAWQKEENPAAKDAMTQILVNSRMCAENNRPICQDTG  70
           Q+  DA  +    H K    L+   E + K   Q LNS + A+   P CQDTG
Sbjct:  53 QAFHDASFMLRPAHQKQVAAILHDPEASEND---KYVALQFLRNSEIAAKGVLPTCQDTG 109

Query:  71 IATVFLKVGMDVQWDADMSVEKMVNEGVRRAYTWEGNTLRASVLADPAGKRQNTKDNTPA 130
           A +  KG V W      E+ +++GV  Y E N    A   K NT N PA
Sbjct: 110 TAIIVGKKGQRV-WTGGGD-EETLSKGVYNTYI-EDNLRYSQNAALDMYKEVNTGTNLPA 166

Query: 131 VIHMSIVPGGKVEVTCAAKGGGSENKSKL-----AMLNPSDNIVDWVLKTIPTMGAGWCP 185
            I +  V G + +  C AKGGGS NK+ L      A+L P   + ++++  + T+G  CP
Sbjct: 167 QIDLYAVDGDEYKFLCVAKGGGSANKTYLYQETKALLTPG-KLKNFLVEKMRTLGTAACP 225

Query: 186 PXXXXXXXXXTPEKAVLMAKESLMSHIDIQELQEKAASGAELSTTEALRLELFEKVNXXX 245
           P          T   + L  +   +H    EL +        L    EL+
Sbjct: 226 PYHIAFVIGGTSAETNLKTVKLASAHY-YDELPTEGNEHGQAFRDVQLEQELLEEAQKLG 284

Query: 246 XXXXXXXXXTTVLDVKILDYPTHAASKPIAMIPNCAATRHVEFELDGSG----PVELTPP 301
                    D++++  P H AS P+ M  +C+A R+++ +++  G      +E P
Sbjct: 285 LGAQFGGKYFAH-DIRVIRLPRHGASCPVGMGVSCSADRNIKAKINREGIWIEKLEHNPG 343

Query: 302 RVEDXPDLTYSPDNGKRVDVDKLTKE---EVASWKTGDVLLLNGKILTGRDAAHKRLVNM 358
             +        +VD+++  KE    +  +      L  L G I+ GRD  AH  +L   +
Sbjct: 344 QYIPQELRQAGEGEAVKVDLNRPMKEILAQLSQYPVSTRLSLTGTIIVGRDIAHAKLKEL 403

Query: 359 LDKGEELPVDFTNRLIYYXXXXXXXXXXXXXXXXXXXTTATRMDKFTRQMLKQTGLLGMIGK 418
           +D G+ELP    + IYY                     TTA RMD +    + G + M+ K
Sbjct: 404 IDAGKELPQYIKDHPIYYAGPAKTPAGYPSGSLGPTTAGRMDSYVDLLQSHGGSMIMLAK 463

Query: 419 SERGAATCEAIADNKAVYLMAVGG-AAYLVAKAIKSSKVLAFPELGMEAVYEFEVKDMPV 477
               R     +A   YL ++GG AA L   ++IK   +A+PELGMEA+++ EV+D P
Sbjct: 464 GNRSQQVTDACHKHGGFYLGSIGGPAAVLAQQSIKHLECVAYPELGMEAIWKIEVEDFPA 523

Query: 478 TVAVDSKG                                                     485
           +  VD KG
Sbjct: 524 FILVDDKG                                                     531
```

The following partial DNA sequence was identified in *N. meningitidis* <SEQ ID 219>:

```
m050-1.seq
   1 ATGACCGTCA TCAAACAGGA AGACTTTATC CAAAGCATTT GCGATGCCTT

51 CCAATTCATC AGCTACTATC ATCCCAAAGA CTACATCGAC GCGCTTTATA

101 AGGCGTGGCA GAAGGAAGAA AATCCTGCCG CCAAAGACGC GATGACGCAG

151 ATTTTGGTCA ACAGCCGTAT GTGTGCGGAA AACAACCGCC CCATCTGCCA

201 AGACACAGGT ATCGCAACCG TCTTCCTCAA AGTCGGTATG AACGTCCAAT

251 GGGATGCGGA CATGAGCGTG GAAGAGATGG TTAACGAAGG CGTACGCCGC

301 GCCTACACTT GGGAAGGCAA TACGCTGCGC GCTTCCGTCC TCGCCGATCC

351 GGCCGGCAAA CGCCAAAACA CCAAAGACAA CACCCCCGCC GTCATCCATA

401 TGAGCATCGT GCCGGGCGGT AAAGTCGAAG TAACCTGCGC GGCAAAAGGC

451 GGCGGCTCTG AAAACAAATC CAAACTCGCC ATGCTCAATC CTTCCGACAA

501 CATCGTCGAT TGGGTATTGA AAACCATCCC GACCATGGGC GCGGGCTGGT

551 GTCCTCCCGG CATCTTGGGT ATCGGCATCG GCGGCACGCC CGAAAAAGCC

601 GTGCTGATGG CAAAAGAGTC CCTGATGAGC CACATCGACA TTCAAGAATT

651 GCAGGAAAAG GCCGCGTCCG GCGCGGAATT GTCCACCACC GAAGCCCTGC

701 GCCTCGAACT CTTTGAAAAA GTCAACGCGC TGGGCATCGG CGCACAAGGC

751 TTGGGCGGAC TGACCACCGT GTTGGACGTG AAAATCCTCG ATTATCCGAC

801 CCACGCCGCC TCCAAACCGA TTGCCATGAT TCCGAACTGC GCCGCCACCC

851 GCCACGTCGA ATTTGAATTG GACGGCTCAG GCCCTGTCGA ACTCACGCCG

901 CCGCGCGTCG AAGACTGGCC CGATTTGACT TACAGCCCCG ACAACGGCAA

951 ACGCGTCGAT GTCGACAAGC TGACCAAAGA AGAAGTGGCA AGCTGGAAAA

1001 CCGGCGACGT ATTGCTGTTG AACGGCAAAA TCCTCACCGG CCGCGATGCC

1051 GCACACAAAC GCCTCGTCGA TATGCTCAAC AAAGGCGAAG AATTGCCCGT

1101 CGATTTCACC AACCGCCTGA TTTACTACGT CGGCCCCGTC GATCCGGTCG

1151 GCGATGAAGT CGTCGGTCCG GCAGGTCCGA CCACAGCCAC CCGCATGGAC

1201 AAATTCACCC GCCAAATGCT CGAACAAACC GACCTCTTGG GCATGATCGG

1251 CAAATCCGAG CGCGGCGTGG CCACCTGCGA AGCCATCGCC GACAACAAAG

1301 CCGTGTACCT CATGGCAGTC GGCGGCGCGG CGTATCTCGT GGCAAAAGCC

1351 ATCAAATCTT CCAAAGTCTT GGCGTTCCCC GAATTGGGCA TGGAAGCCAT

1401 TTACGAATTT GAAGTCAAAG ACATGCCCGT AACCGTCGCC GTAGATAGCA

1451 AAGGCGAATC CATCCACGCC ACCGCCCCGC GCAAATGGCA GGCGAAAATC

1501 GGCATCATCC CCGTCGAATC TTGA
```

This corresponds to the amino acid sequence <SEQ ID 220; ORF 050-1>:

```
m050-1.pep

1  MTVIKQEDFI QSICDAFQFI SYYHPKDYID ALYKAWQKEE NPAAKDAMTQ

51  ILVNSRMCAE NNRPICQDTG IATVFLKVGM NVQWDADMSV EKMVNEGVRR

101  AYTWEGNTLR ASVLADPAGK RQNTKDNTPA VIHMSIVPGG KVEVTCAAKG

151  GGSENKSKLA MLNPSDNIVD WVLKTIPTMG AGWCPPGILG IGIGGTPEKA
```

-continued

```
201  VLMAKESLMS HIDIQELQEK AASGAELSTT EALRLELFEK VNALGIGAQG

251  LGGLTTVLDV KILDYPTHAA SKPIAMIPNC AATRHVEFEL DGSGPVELTP

301  PRVEDWPDLT YSPDNGKRVD VDKLTKEEVA SWKTGDVLLL NGKILTGRDA

351  AHKRLVDMLN KGEELPVDFT NRLIYYVGPV DPVGDEVVGP AGPTTATRMD

401  KFTRQMLEQT DLLGMIGKSE RGVATCEAIA DNKAVYLMAV GGAAYLVAKA

451  IKSSKVLAFP ELGMEAIYEF EVKDMPVTVA VDSKGESIHA TAPRKWQAKI

501  GIIPVES*
``` m050-1/g050-1 98.2% identity in 507 aa overlap

```
                    10        20        30        40        50        60
m050-1.pep  MTVIKQEDFIQSICDAFQFISYYHPKDYIDALYKAWQKEENPAAKDAMTQILVNSRMCAE
            ||||||||||||||||||||||||||||||||||||||||||||||||||||||||||||
g050-1      MTVIKQEDFIQSICDAFQFISYYHPKDYIDALYKAWQKEENPAAKDAMTQILVNSRMCAE
                    10        20        30        40        50        60

70        80        90       100       110       120
m050-1.pep  NNRPICQDTGIATVFLKVGMNVQWDADMSVEEMVNEGVRRAYTWEGNTLRASVLADPAGK
            |||||||||||||||||||:||||||||||:|||||||||||||||||||||||||||||
g050-1      NNRPICQDTGIATVFLKVGMDVQWDADMSVEKMVNEGVRRAYTWEGNTLRASVLADPAGK
                    70        80        90       100       110       120

130       140       150       160       170       180
m050-1.pep  RQNTKDNTPAVIHMSIVPGGKVEVTCAAKGGGSENKSKLAMLNPSDNIVDWVLKTIPTMG
            ||||||||||||||||||||||||||||||||||||||||||||||||||||||||||||
g050-1      RQNTKDNTPAVIHMSIVPGGKVEVTCAAKGGGSENKSKLAMLNPSDNIVDWVLKTIPTMG
                   130       140       150       160       170       180

190       200       210       220       230       240
m050-1.pep  AGWCPPGILGIGIGGTPEKAVLMAKESLMSHIDIQELQEKAASGAELSTTEALRLELFEK
            ||||||||||||||||||||||||||||||||||||||||||||||||||||||||||||
g050-1      AGWCPPGILGIGIGGTPEKAVLMAKESLMSHIDIQELQEKAASGAELSTTEALRLELFEK
                   190       200       210       220       230       240

250       260       270       280       290       300
m050-1.pep  VNALGIGAQGLGGLTTVLDVKILDYPTHAASKPIAMIPNCAATRHVEFELDGSGPVELTP
            ||||||||||||||||||||||||||||||||||||||||||||||||||||||||||||
g050-1      VNALGIGAQGLGGLTTVLDVKILDYPTHAASKPIAMIPNCAATRHVEFELDGSGPVELTP
                   250       260       270       280       290       300

310       320       330       340       350       360
m050-1.pep  PRVEDWPDLTYSPDNGKRVDVDKLTKEEVASWKTGDVLLLNGKILTGRDAAHKRLVDMLN
            ||||| ||||||||||||||||||||||||||||||||||||||||||||||||:||:
g050-1      PRVEDXPDLTYSPDNGKRVDVDKLTKEEVASWKTGDVLLLNGKILTGRDAAHKRLVNMLD
                   310       320       330       340       350       360

370       380       390       400       410       420
m050-1.pep  KGEELPVDFTNRLIYYVGPVDPVGDEVVGPAGPTTATRMDKFTRQMLEQTDLLGMIGKSE
            ||||||||||||||||||||||||||||||||||||||||||||||:|| ||||||||
g050-1      KGEELPVDFTNRLIYYVGPVDPVGDEVVGPAGPTTATRMDKFTRQMLKQTGLLGMIGKSE
                   370       380       390       400       410       420

430       440       450       460       470       480
m050-1.pep  RGVATCEAIADNKAVYLMAVGGAAYLVAKAIKSSKVLAFPELGMEAIYEFEVKDMPVTVA
            ||:|||||||||||||||||||||||||||||||||||||||||||:|||||||||||||
g050-1      RGAATCEAIADNKAVYLMAVGGAAYLVAKAIKSSKVLAFPELGMEAVYEFEVKDMPVTVA
                   430       440       450       460       470       480

490       500
m050-1.pep  VDSKGESIHATAPRKWQAKIGIIPVESX
            ||||||||||||||||||||||||||||
g050-1      VDSKGESIHATAPRKWQAKIGIIPVESX
                   490       500
```

The following partial DNA sequence was identified in *N. meningitidis* <SEQ ID 221>:

```
a050-1.seq
   1 ATGACCGTCA TCAAACAGGA AGACTTTATC CAAAGCATTT GCGATGCCTT

51 CCAATTCATC AGCTACTACC ATCCCAAAGA CTACATCGAC GCGCTTTATA

101 AGGCGTGGCA GAAGGAAGAA AACCCCGCCG CCAAAGACGC GATGACGCAG

151 ATTTTGGTCA ACAGCCGCAT GTGTGCCGAA AACAACCGCC CCATCTGCCA

201 AGATACCGGT ATCGCGACCG TGTTTTTGAA AGTCGGTATG GATGTGCAAT

251 GGGATGCAGA CATGAGCGTC GAAGAGATGG TTAACGAAGG CGTGCGCCGC
```

```
-continued
 301 GCCTACACTT GGGAAGGCAA TACGCTGCGC GCTTCCGTTC TCGCCGACCC

351 CGCCGGCAAA CGCCAAAATA CCAAAGACAA CACGCCCGCC GTCATCCATA

401 TGAGCATCGT GCCGGGCGAC AAAGTCGAAG TAACCTGCGC GGCAAAAGGC

451 GGCGGTTCTG AAAACAAATC CAAACTCGCC ATGCTCAACC CTTCCGACAA

501 CATCGTCGAT TGGGTATTGA AAACCATTCC GACCATGGGC GCGGGCTGGT

551 GTCCTCCCGG CATCTTGGGC ATCGGCATCG GCGGTACGCC CGAAAAAGCC

601 GTGTTGATGG CGAAAGAATC CCTGATGAGC ACATCGACA TCCAAGAATT

651 GCAGGAAAAA GCCGCGTCCG GCGCGGAATT GTCCACCACC GAAGCCCTGC

701 GCCTCGAACT CTTTGAAAAA GTCAACGCGC TAGGCATCGG CGCGCAAGGC

751 TTGGGCGGTC TGACCACCGT GTTGGACGTG AAAATCCTCG ATTACCCGAC

801 CCACGCCGCC TCCAAACCGA TTGCCATGAT TCCGAACTGC GCCGCCACCC

851 GCCACGTCGA ATTTGAATTG GACGGCTCAG GCCCTGTCGA ACTCACGCCG

901 CCGCGCGTCG AAGACTGGCC CGATTTGACT TACAGCCCCG ACAACGGCAA

951 ACGCGTCGAT GTCGACAAGC TGACCAAAGA AGAAGTGGCA AGCTGGAAAA

1001 CCGGCGACGT ATTGCTGTTG AACGGCAAAA TCCTCACCGG CCGCGATGCC

1051 GCACACAAAC GCCTCGTCGA TATGCTCGAC AAAGGCGAAG AATTGCCCGT

1101 CGATTTCACC AACCGCCTGA TTTACTACGT CGGCCCCGTC GATCCGGTCG

1151 GCGACGAAAT CGTCGGCCCA GCAGGTCCGA CCACCGCCAC CCGCATGGAC

1201 AAATTCACCC GCCAAATGCT CGAACAAACC GACCTCTTGG GCATGATCGG

1251 CAAATCCGAG CGCGGCGCGG CCACCTGCGA AGCCATCGCC GACAACAAAG

1301 CCGTGTACCT CATGGCAGTC GGCGGCGCGG CGTATCTCGT GGCAAAAGCC

1351 ATCAAATCTT CCAAAGTCTT GGCGTTCCCC GAATTGGGCA TGGAAGCCAT

1401 TTACGAATTT GAAGTCAAAG ACATGCCCGT AACCGTCGCC GTAGACAGCA

1451 AAGGCGAATC CATCCACGCC ACCGCCCCGC CCCAATGGCA GGCGAAAATC

1501 GGCATCATCC CCGTCAAATC TTGA
```

This corresponds to the amino acid sequence <SEQ ID 222; ORF 050-1.a>:

```
a050-1.pep

1 MTVIKQEDFI QSICDAFQFI SYYHPKDYID ALYKAWQKEE NPAAKDAMTQ

51 ILVNSRMCAE NNRPICQDTG IATVFLKVGM DVQWDADMSV EEMVNEGVRR

101 AYTWEGNTLR ASVLADPAGK RQNTKDNTPA VIHMSIVPGD KVEVTCAAKG

151 GGSENKSKLA MLNPSDNIVD WVLKTIPTMG AGWCPPCILG IGIGGTPEKA

201 VLMAKESLMS HIDIQELQEK AASGAELSTT EALRLELFEK VNALGIGAQG

251 LGGLTTVLDV KILDYPTHAA SKPIAMIPNC AATRHVEFEL DGSGPVELTP

301 PRVEDWPDLT YSPDNGKRVD VDKLTKEEVA SWKTGDVLLL NGKILTGRDA

351 AHKRLVDMLD KGEELPVDFT NRLIYYVGPV DPVGDEIVGP AGPTTATRMD

401 KFTRQMLEQT DLLGMIGKSE RGAATCEAIA DNKAVYLMAV GGAAYLVAKA

451 IKSSVKLAFP ELGMEAIYEF EVKDMPVTVA VDSKGESIHA TAPPQWQAKI

501 GIIPVKS*
```

```
a050-1/m050-1 98.4% identity in 507 aa overlap 10        20        30        40        50        60
a050-1.pep  MTVIKQEDPIQSICDAFQFISYYHPKDYIDALYKAWQKEENPAAKDAMTQILVNSRMCAE
            ||||||||||||||||||||||||||||||||||||||||||||||||||||||||||||
m050-1      MTVIKQEDPIQSICDAFQFISYYHPKDYIDALYKAWQKEENPAAKDAMTQILVNSRMCAE
                 10        20        30        40        50        60

70        80        90       100       110       120
a050-1.pep  NNRPICQDTGIATVFLKVGMDVQWDADMSVEEMVNEGVRRAYTWEGNTLRASVLADPAGK
            ||||||||||||||||||||||:|||||||||||||||||||||||||||||||||||||
m050-1      NNRPICQDTGIATVFLKVGMNVQWDADMSVEEMVNEGVRRAYTWEGNTLRASVLADPAGK
                 70        80        90       100       110       120

130       140       150       160       170       180
a050-1.pep  RQNTKDNTPAVIHMSIVPGDKVEVTCAAKGGGSENKSKLAMLNPSDNIVDWVLKTIPTMG
            |||||||||||||||||||||:||||||||||||||||||||||||||||||||||||||
m050-1      RQNTKDNTPAVIHMSIVPGGKVEVTCAAKGGGSENKSKLAMLNPSDNIVDWVLKTIPTMG
                130       140       150       160       170       180

190       200       210       220       230       240
a050-1.pep  AGWCPPGILGIGIGGTPEKAVLMAKESLMSHIDIQELQEKAASGAELSTTEALRLELFEK
            ||||||||||||||||||||||||||||||||||||||||||||||||||||||||||||
m050-1      AGWCPPGILGIGIGGTPEKAVLMAKESLMSHIDIQELQEKAASGAELSTTEALRLELFEK
                190       200       210       220       230       240

250       260       270       280       290       300
a050-1.pep  VNALGIGAQGLGGLTTVLDVKILDYPTHAASKPIAMIPNCAATRHVEFELDGSGPVELTP
            ||||||||||||||||||||||||||||||||||||||||||||||||||||||||||||
m050-1      VNALGIGAQGLGGLTTVLDVKILDYPTHAASKPIAMIPNCAATRHVEFELDGSGPVELTP
                250       260       270       280       290       300

310       320       330       340       350       360
a050-1.pep  PRVEDWPDLTYSPDNGKRVDVDKLTKEEVASWKTGDVLLLNGKILTGRDAAHKRLVDMLD
            |||||||||||||||||||||||||||||||||||||||||||||||||||||||||||:
m050-1      PRVEDWPDLTYSPDNGKRVDVDKLTKEEVASWKTGDVLLLNGKILTGRDAAHKRLVDMLN
                310       320       330       340       350       360

370       380       390       400       410       420
a050-1.pep  KGEELPVDFTNRLIYYVGPVDPVGDEIVGPAGPTTATRMDKFTRQMLEQTDLLGMIGKSE
            |||||||||||||||||||||||||||:||||||||||||||||||||||||||||||||
m050-1      KGEELPVDFTNRLIYYVGPVDPVGDEVVGPAGPTTATRMDKFTRQMLEQTDLLGMIGKSE
                370       380       390       400       410       420

430       440       450       460       470       480
a050-1.pep  RGAATCEAIADNKAVYLMAVGGAAYLVAKAIKSSKVLAFPELGMEAIYEFEVKDMPVTVA
            ||:|||||||||||||||||||||||||||||||||||||||||||||||||||||||||
m050-1      RGVATCEAIADNKAVYLMAVGGAAYLVAKAIKSSKVLAFPELGMEAIYEFEVKDMPVTVA
                430       440       450       460       470       480

490       500
a050-1.pep  VDSKGESIHATAPPQWQAKIGIIPVKSX
            ||||||||||||::|||||||||:||
m050-1      VDSKGESIHATAPRKWQAKIGIIPVESX
                490       500
```

The following partial DNA sequence was identified in *N. gonorrhoeae* <SEQ ID 223>:

```
g052.seq
  1 ATGGCTTTGG TGGCGGAGGA AACGGAAATA TCCGCGCCGT GTTTCAAAGG

51 CTGCGAGCCG ACGGGCGACA GCAGGCTGTT GTCCACCACC AAGAGCGCGC

101 CGATGCCGTG CGCCAATTCC GCCAAGGCTT CCAAGTCGGC CACTTCGCCC

151 AAGGGGTTGG ACGGCGTTTC CAAAAACAGC AGTTTGGTGT TGGCTTTGAC

201 GGCGGCTTTC CATTCATTTA TATCAGTCGG CGACACGCGG CTCACTCCGA

251 TGCCGAATTT GGTAACGATG TTATTGATAA AGCCGACGGT CGTGCCGAAC

301 AGGCTGCGGC TGGAAACCAC ATGGTCGCCC GCCTGCAGGA AGGTGAAAAA

351 CGCCGCCTGA
```

This corresponds to the amino acid sequence <SEQ ID 224; ORF 052.ng>:

```
g052.pep
    1 MALVAEETEI SAPCFKGCEP TGDSRLLSTT KSAPMPCANS AKASKSATSP

51 KGLDGVSKNS SLVLALTAAF HSFISVGDTR LTPMPNLVTM LLIKPTVVPN

101 RLRLETTWSP ACRKVKNAA*
```

The following partial DNA sequence was identified in *N. meningitidis* <SEQ ID 225>:

```
m052.seq
    1 ATGGCTTTGG TGGCGGAGGA AACGGAAATA TCCGCGCCGT GTTTCAAAGG

51 CTGCGAGCCG ACGGGCGACA GCAGGCTGTT GTCCACCACC AAGAGCGCGC

101 CGATGCCGTG CGCCAATTCC GCCAAGGCTT CCAAGTCGGC CACTTCGCCC

151 AAGGGGTTGG ACGGCGTTTC CAAAAACAGC AGTTTGGTGT TGGCTTTGAC

201 GGCGGCTTTC CATTCATTTA TATCAGTCGG CGACACGCGG CTCACTCCGA

251 TGCCGAATTT GGTAACGATG TTATTGATAA AGCCGACGGT CGTGCCGAAC

301 AGGCTGCGGC TGGAAACCAC ATGGTCGCCC GCCTGCAGGA AGGTGAAAAA

351 CGCCGCCTGA
```

This corresponds to the amino acid sequence <SEQ ID 226; ORF 052>:

```
m052.pep
    1 MALVAEETEI SAPCFKGCEP TGDSRLLSTT KSAPMPCANS AKASKSATSP

51 KGLDGVSKNS SLVLALTAAF HSFISVGDTR LTPMPNLVTM LLIKPTVVPN

101 RLRLETTWSP ACRKVKNAA*
```

The following partial DNA sequence was identified in *N. meningitidis* <SEQ ID 227>:

```
a052.seq
    1 ATGGCTTTGG TCGCGGAGGA AACGGAAATA TCCGCGCCGT GTTTCAAAGG

51 CTGAGAGCCG ACAGGCGACA GCAGGCTGTT GTCCACCACC AAGAGCGCGC

101 CGATGCCGTG CGCCAATTCC GCCAAGGCTT CCAAGTCGGC CACTTCTCCC

151 AAGGGATTGG ACGGCGTTTC CAAAAACAGC AGTTTGGTGT TGGCTTTGAC

201 GGCGGCTTTC CATTCGTTTA TATCAGTCGG CGACACGTGA CTCACTTCGA

251 TGCCGAATTT GGTAACGATG TTATTGATAA AGCCGACGGT CGTGCCGAAC

301 AGGCTGCGGC TGGAAATCAC ATGGTCGCCC GCCTGCAAAA AGGTGAAAAA

351 CGCCGCCTGA
```

This corresponds to the amino acid sequence <SEQ ID 228; ORF 052.a>:

```
a052.pep
    1 MALVAEETEI SAPCFKG*EP TGDSRLLSTT KSAPMPCANS AKASKSATSP

51 KGLDGVSKNS SLVLALTAAF HSFISVGDT* LTSMPNLVTM LLIKPTVVPN

101 RLRLEITWSP ACKKVKNAA*
``` m052/a052 95.8% identity over a 119 aa overlap

```
               10        20        30        40        50        60
m052.pep  MALVAEETEISAPCFKGCEPTGDSRLLSTTKSAPMPCANSAKASKSATSPKGLDGVSKNS
          ||||||||||||||||||| |||||||||||||||||||||||||||||||||||||||
a052      MALVAEETEISAPCFKGXEPTGDSRLLSTTKSAPMPCANSAKASKSATSPKGLDGVSKNS
               10        20        30        40        50        60

70        80        90       100       110       120
m052.pep  SLVLALTAAFHSFISVGDTRLTPMPNLVTMLLIKPTVVPNRLRLETTWSPACRKVKNAAX
          |||||||||||||||||||||| |||||:|||||||||||||||||||| ||||:|||||
a052      SLVLALTAAFHSFISVGDTXLTSMPNLVTMLLIKPTVVPNRLRLEITWSPACKKVKNAAX
               70        80        90       100       110       120
```

Computer analysis of this amino acid sequence gave the following results:
Homology with a Predicted ORF from *N. gonorrhoeae*
ORF 052 shows 95.8% identity over a 119 aa overlap with a predicted ORF (ORF 052.ng) from *N. gonorrhoeae*:

```
m052/g052
               10        20        30        40        50        60
m052.pep  MALVAEETEISAPCFKGCEPTGDSRLLSTTKSAPMPCANSAKASKSATSPKGLDGVSKNS
          ||||||||||||||||||||||||||||||||||||||||||||||||||||||||||||
g052      MALVAEETEISAPCFKGCEPTGDSRLLSTTKSAPMPCANSAKASKSATSPKGLDGVSKNS
               10        20        30        40        50        60

70        80        90       100       110       120
m052.pep  SLVLALTAAFHSFISVGDTWLTSMPNLATMLLIKPTVVPNRLRLEITWSPACKKVKNAAX
          |||||||||||||||||||| || ||||:||||||||||||||||| ||||||:||||||
g052      SLVLALTAAFHSFISVGDTRLTPMPNLVTMLLIKPTVVPNRLRLETTWSPACRKVKNAAX
               70        80        90       100       110       120
```

The following partial DNA sequence was identified in *N. gonorrhoeae* <SEQ ID 229>:

```
g073.seq
    1 ATGTGTATGC CATACGCAAT AAGGGTTTCA GACGGCATCT GCCGCATTTT

51 TCCGCCGATG CCGTCTGAAA CACGCAATCA GCGCGCGAGT GCCTGTTTCA

101 AATCGTCAAT CAAATCGCCA ACATATTCCA AACCGACCGA CAGGCGCACC

151 AGTCCGGGGC GGatacCGGC GGCGAGTTTT TCTTCGGGCT GCATCCTGCC

201 GTGCGTGGTT GTCCACGGAT TGGTGATGGT CGAGCGCACG TCGCCGAGGT

251 TGGCGGTACG GGAAAAGAGT TCCACGACTT TCCACGCGGC TGCTTGGTCG

301 GCGACTTCAA AACCGATGAC GATGCCGCCG CCGTTTTGCT GTTTGCGGAT

351 AAGCTCCGCC TGCGGATGGT CGGGCAATCC GGTGTAG
```

This corresponds to the amino acid sequence <SEQ ID 230; ORF 073.ng>:

```
g073.pep
    1 MCMPYAIRVS DGICRIFPPM PSETRNQRAS ACFKSSIKSP TYSKPTDRRT

51 SPGRIPAASF SSGCILPCVV VHGLVMVERT SPRLAVREKS STTFHAAAWS

101 ATSKPMTMPP PFCCLRISSA CGWSGNPV*
```

The following partial DNA sequence was identified in *N. meningitidis* <SEQ ID 231>:

```
m073.seq
    1 ATGTGTATGC CATATAAGAT AAGGGTTTCA GACGGCATCT GCTGTCCAAT

51 GCCGTCTGAA ACACGCAATC AGCGTGCGAG TGCCTGTTTC AAATCGTCAA
```

```
101 TCAAATCGCC AACATATTCC AAACCGACCG ACAGGCGCAC CAATCCGGGG

151 CGGATGTTGG CGGCGAGTTT TCTTCGGGC TGCATCCTGC CGTGCGTGGT

201 TGTCCACGGG TGGGTAATGG TCGAGCGCAC GTCACCGAGG TTGGCGGTGC

251 GGGAAAAGAG TTCCACGCCG TCCACAACTT TCCACGCCGC TTCTTGATCG

301 GCAACTTCAA AGCCGATGAC GATGCCGCCG CCGTTTTGCT GTTTGCGGAT

351 AAGCGCCGCC TGAGGATGGT CGGACAATCC GGTGTAG
```

This corresponds to the amino acid sequence <SEQ ID 232; ORF 073>:

```
m073.pep
   1 MCMPYKIRVS DGICCPMPSE TRNQRASACF KSSIKSPTYS KPTDRRTNPG

51 RMLAASFSSG CILPCVVVHG WVMVERTSPR LAVREKSSTP STTFHAASXS

101 ATSKPMTMPP PFCCLRISAA XGWSDNPV*
```

The following partial DNA sequence was identified in *N. meningitidis* <SEQ ID 233>:

```
a073.seq
   1 ACGTGTATGT CATATAAGAT AAGGGTTTCA GACGGCATTT GCGGTGTTTT

51 TCCGCCGATG CCGTCTGAA. CACGCAATCA GCGCGCGAGT GCCTGTTTCA

101 AATCGTCAAT CAAATCGCCA ACATATTCCA AACCGACCGA CAGGCGCACC

151 AATCCGGGGC GGATGTTGGC GGCGAGTTTT CTTCGGGCT GCATCCTGCC

201 GTGCGTGGTT GTCCACGGAT GGGTAATGGT CGAGCGCACG TCGCCGAGGT

251 TGGCGGTACG GGAGAAAAGT TCGACGCCGT CCACGACTTT CCACGCGGCT

301 GCTTGGTCGG CGACTTCAAA GCCGATGACG ATGCCGCCGC CGTTTTGCTG

351 TTTGCGGATA AGCTCCGCCT GAGGATGGTC GGGTAATCCG GTGTAA
```

This corresponds to the amino acid sequence <SEQ ID 234; ORF 073.a>:

```
a073.pep
   1 TCMSYKIRVS DGICGVFPPM PSEXRNQRAS ACFKSSIKSP TYSKPTDRRT

51 NPGRMLAASF SSGCILPCVV VHGWVMVERT SPRLAVREKS STPSTTFHAA

101 AWSATSKPMT MPPPFCCLRI SSA*GWSGNP V*
``` m073/a073 92.3% identity over a 130 aa overlap

```
                  10         20         30         40         50
   m073.pep  MCMPYKIRVSDGICC---PMPSETRNQRASACFKSSIKSPTYSKPTDRRTNPGRMLAASF
             ||  ||||||||||     |||||:||||||||||||||||||||||||||||||||||||
   a073      TCMSYKIRVSDGICGVFPPMPSEXRNQRASACFKSSIKSPTYSKPTDRRTNPGRMLAASF
                  10         20         30         40         50         60

60         70         80         90        100        110
   m073.pep  SSGCILPCVVVHGWVMVERTSPRLAVREKSSTPSTTFHAASXSATSKPMTMPPPFCCLRI
             |||||||||||||||||||||||||||||||||||||||||: |||||||||||||||||
   a073      SSGCILPCVVVHGWVMVERTSPRLAVREKSSTPSTTFHAAAWSATSKPMTMPPPFCCLRI
                  70         80         90        100        110        120

120        129
   m073.pep  SAAXGWSDNPVX
             |:||||  ||||
   a073      SSAXGWSGNPVX
                 130
```

Computer analysis of this amino acid sequence gave the following results:
Homology with a Predicted ORF from *N. gonorrhoeae*
ORF 073 shows 87.0% identity over a 131 aa overlap with a predicted ORF (ORF 073.ng) from *N. gonorrhoeae*:

```
m073/g073
                     10        20        30        40        50
    m073.pep MCMPYKIRVSDGICC---PMPSETRNQRASACFKSSIKSPTYSKPTDRRTNPGRMLAASF
             |||||  ||||||||      ||||||||||||||||||||||||||||||:|||: ||||
    g073     TCMSYAIRVSDGICRIFPPMPSETRNQRASACFKSSIKSPTYSKPTDRRTSPGRIPAASF
                     10        20        30        40        50        60

60        70        80        90       100       110
    m073.pep SSGCILPCVVVHGWVMVERTSPRLAVREKSSTPSTTFHAASXSATSKPMTMPPPFCCLRI
             |||||||||||||||||||||||||||||||   |||||:||||||||||||||||||||
    g073     SSGCILPCVVVHGWVMVERTSPRLAVREKSST---TFHAAAWSATSKPMTMPPPFCCLRI
                     70        80        90       100       110

120       129
    m073.pep SAAXGWSDNPVX
             |:| ||| ||||
    g073     SSACGWSGNPVX
                    120
```

The following partial DNA sequence was identified in *N. gonorrhoeae* <SEQ ID 235>:

```
g075.seq
    1 ATGCCGCCTT ACTTCATCAC CCTCTTAACG ATGGAAAATA CAAAAGCGC

51 GGCGAAAACG CCCACTACAA TCCAACCGGC TTCCATACCG TCCGCTTTTG

101 CGGCTTCCAA AGCGTTTTTT GCCGTTTCGG GCAACGCTGC GTTTGCCTGT

151 GCCGCCAAAG CCAGCGGGGC GGCTGTTACA ACAGCCAGTT TTGCGCCGTA

201 TTTACGGCAG GTGTTAATAA ATTTCATGAT ATTTTCCTTT ACGAAATTTT

251 TAAAAAATG TGTTTGCGGG CTTTGTGAAG GTTTTAGAGA CCGCCTGCCG

301 GGCCTCTTAA ACTTAATCTT CTTTTTCGTA GAATCCGAAA ATTACAAATT

351 CCCCGCCTAT CTCTTCCAAT GCCGAGCTAA AAGCGTCTTC ATAGCTGTCA

401 TATTTACCGG CTGA
```

This corresponds to the amino acid sequence <SEQ ID 236; ORF 075.ng>:

```
g075.pep
    1 MPPYFITLLT MENTKSAAKT PTTIQPASIP SAFAASKAFF AVSGNAAFAC

51 AAKASGAAVT TASFAPYLRQ VLINFMIFSF TKFLKKCVCG LCEGFRDRLP

101 GLLNLIFFFV ESENYKFPAY LFQCRAKSVF IAVIFTG*
```

The following partial DNA sequence was identified in *N. meningitidis* <SEQ ID 237>:

```
m075.seq
    1 ATGCCGTCTT ACTTCATCAC TCTCTTAACG ATGGAAAATA CAAAAGCGC

51 GGCGAAAATG CCCACTACAA TCCAACCGGC TTCCATACCG TCCGCTTTTG

101 CGGCTTCCAA AGCGTTTTTT GCCGTATCGG GCAACGTTGC ATTTGCATGT

151 GCGGCCAAAG CCAGGGGAGC AGCTGTTACA ACAGCCAGTT TTGCGCCGTA

201 TTTACGGCAG GTGTTAATAA ATTTCATGAT ATTTTCCTTC AAAAAGTGTT

251 TGGCGGTAAT GGATGGAGCG TTTTTCAGAC GACCGCCGAA CATCCGAAAA
```

```
301 TCAGTCTTTC AAAAATCCGA ATACGACAAA TTCGTATTGG TTGCCGATTT

351 CTTCCAAACC TGCGTTAATC GCTTCTTCGA AGTCGTAGAA ATAATCGGCA

401 TTGGTGATTA A
```

This corresponds to the amino acid sequence <SEQ ID 238; ORF 075>:

```
m075.pep
   1 MPSYFITLLT MENTKSAAKM PTTIQPASIP SAFAASKAFF AVSGNVAFAC

51 AAKARGAAVT TASFAPYLRQ VLINFMIFSF KKCLAVMDGA FFRRPPNIRK

101 SVFQKSEYDK FVLVADFFQT CVNRFFEVVE IIGIGD*
```

Computer analysis of this amino acid sequence gave the following results:
Homology with a Predicted ORF from *N. gonorrhoeae*    20
ORF 075 shows 65.7% identity over a 137 aa overlap with a predicted ORF (ORF 075.ng) from *N. gonorrhoeae*:

```
    m075/g075

10         20         30         40         50         60
    m075.pep MPSYFITLLTMENTKSAAKMPTTIQPASIPSAFAASKAFFAVSGNVAFACAAKARGAAVT
             ||  |||||||||||||||| ||||||||||||||||||||||||:|||||||  |||||
    g075     MPPYFITLLTMENTKSAAKTPTTIQPASIPSAFAASKAFFAVSGNAAFACAAKASGAAVT
                    10         20         30         40         50         60

70         80         90        100        110
    m075.pep TASFAPYLRQVLINFMIFSF----KKCLAVMDGAFFRRPPNIRKSVFQKSEYDKFVLVAD
             ||||||||||||||||||||    |||:  :|  | |::  :|   |:::  :|
    g075     TASFAPYLRQVLINFMIFSFTKFLKKCVCGLCEGFRDRLPGLLNLIFFFVESENYKFPAY
                    70         80         90        100        110        120

120        130
    m075.pep FFQTCVNRFFEVVEIIGIGDX
             :||  ::   | :|  : |
    g075     LFQCRAKSVFIAVIFTGX
                    130
                                                                     40
```

The following partial DNA sequence was identified in *N. meningitidis* <SEQ ID 239>:

```
a075.seq
   1 ATGCCGTCTT ACTTCATCAC TCTCTTAACG ATGGAAAAGA CAAAAAGCGC

51 GGCGAAAACG CCCACTACAA TCCAACCGGC TTCCATACCG TCCGCTTTTG

101 CGGCTTCCAA AGCGTTTTTT GCTGTATCGG GCAACGTTGC ATTTGCATGT

151 GCGGCCAAAG CCAGGGGAGC AGCTGTTACA ACAGCCAGTT TTGCGCCGTA

201 TTTACGGCAG GTGTTAATAA ATTTCATGAT ATTTTCCTTC AAAAAGTGTT

251 TGGCGGTAAT GGATGGAGCG TTTTTCAGAC GACCGCCGAA CATCCGAAAA

301 TCAGTCTTTC AAAAATCCGA ATACGACAAA TTCGTATTGG TTGCCGATTT

351 CTTCCAAACC TGCGTTAATC GCTTCTTCGA AGTCGTAGAA ATAATCGGCA

401 TTGGTGATTA A
```

This corresponds to the amino acid sequence <SEQ ID 240; ORF 075.a>:

```
a075.pep
   1 MPSYFITLLT MEKTKSAAKT PTTIQPASIP SAFAASKAFF AVSGNVAFAC

51 AAKARGAAVT TASFAPYLRQ VLINFMIFSF KKCLAVMDGA FFRRPPNIRK

101 SVFQKSEYDK FVLVADFFQT CVNRFFEVVE IIGIGD*
``` m075/a075 98.5% identity over a 136 aa overlap

```
                 10        20        30        40        50        60
m075.pep MPSYFITLLTMENTKSAAKMPTTIQPASIPSAFAASKAFFAVSGNVAFACAAKARGAAVT
         ||||||||||| ||||| ||||||||||||||||||||||||||||||||||||||||||
a075     MPSYFITLLTMEKTKSAAKTPTTIQPASIPSAFAASKAFFAVSGNVAFACAAKARGAAVT
                 10        20        30        40        50        60

70        80        90       100       110       120
m075.pep TASFAPYLRQVLINFMIFSFKKCLAVMDGAFFRRPPNIRKSVFQKSEYDKFVLVADFFQT
         ||||||||||||||||||||||||||||||||||||||||||||||||||||||||||||
a075     TASFAPYLRQVLINFMIFSFKKCLAVMDGAFFRRPPNIRKSVFQKSEYDKFVLVADFFQT
                 70        80        90       100       110       120

130
m075.pep CVNRFFEVVEIIGIGDX
         |||||||||||||||||
a075     CVNRFFEVVEIIGIGDX
                130
```

The following partial DNA sequence was identified in *N. gonorrhoeae* <SEQ ID 241>:

```
g080.seq
   1 ATGTGGGATA ATGCCGAAGC GATGGAACGG CTGACGCGCT GGCTGCTTGT

51 CATGATGGCG ATGCTGCTTG CTGCGTCCGG GCTGGTTTGG TTTTACAATT

101 CGAATCATCT GCCCGTCAAG CAGGTGTCGC TGAAGGGCAA CCTGGTTTAT

151 TCCGATAAGA AGGCATTGGG CAGTTTGGCG AAAGAATACA TCCATGGGAA

201 TATTTTGAGG ACGGACATCA ATGGCGCACA GGAAGCCTAC CGCCGGTATC

251 CGTGGATTGC GTCGGTCATG GTGCGCCGCC GTTTTCCCGA TACGGTTGAG

301 GTCGTCCTGA CCGAGCGCAA GCCGGTTGCA CGTTGGGGCG ACCATGCCTT

351 GGTGGACGGC GAAGGCAATG TTTTTGAAGC CCGCTTGGAC AGACCCGGAA

401 TGCCGGTATT CAGAGGCGCG GAAGGAACGT CTGCCGAAAT GCTCCGCCGT

451 TATGACGAAT TTTCGACTGT TTTGGCAAAA CAGGGTTTGG GCATCAAAGA

501 GATGACCTAT ACGGCACGTT CGGCGTGGAA TGTCGTTTTG GACAACGGCA

551 TCACCGTCAG GCTCGGACGG GAAAAcgaGA TGAAACGCCT CCgGCTTTTT

601 ACcgAAGCGT GGCAGCATCT gttgcGTAAG AATAAAAATC GGTTATCCTA

651 TGTGGATATG Aggtataagg acggatttTC agtcccccat gctCCCGACG

701 GTTTACCCGA AAAGAATcc gAAGAATatt gggaacaggt ttgggacata 751 ttacggcctg gcgtcggaaa cggttcgacg caaatttcaa tcagttatAA 801 GGGCAGacga acaatggaac AGcagtaa
```

This corresponds to the amino acid sequence <SEQ ID 242; ORF 080.ng>:

```
g080.pep
   1 MWDNAEAMER LTRWLLVMMA MLLAASGLVW FYNSNHLPVK QVSLKGNLVY

51 SDKKALGSLA KEYIHGNILR TDINGAQEAY RRYPWIASVM VRRRFPDTVE
```

-continued

```
101 VVLTERKPVA RWGDHALVDG EGNVFEARLD RPGMPVFRGA EGTSAEMLRR

151 YDEFSTVLAK QGLGIKEMTY TARSAWNVVL DNGITVRLGR ENEMKRLRLF

201 TEAWQHLLRK NKNRLSYVDM RYKDGFSVPH APDGLPEKES EEYWEQVWDI

251 LRPGVGNGST QISISYKGRR TMEQQ*
```

The following partial DNA sequence was identified in *N. meningitidis* <SEQ ID 243>:

```
m080.seq
  1 ATGTGGGATA ATGCCGAAGC GATGGAACGG CTGACGCGCT GGCTGCTTGT

51 CATGATGGCG ATGCTGCTTG CTGCGTCCGG GCTGGTTTGG TTTTACAATT

101 CGAATCATCT GCCCGTCAAG CAGGTGTCGC TGAAGGGCAA CCTGGTTTAT

151 TCCGATAAGA AGACATTGGG CAGTTTGGCG AAAGAATACA TCCATGGGAA

201 TATTTTGAGG ACGGACATCA ATGGCGCACA GGAGGCCTAC CGCCGGTATC

251 CGTGGATTGC GTCGGTCATG GTGCGCCGCC GTTTTCCCGA CACGGTTGAG

301 GTCGTCCTGA CCGAGCGCAA GCCGGTCGCG CGTTGGGGCG ACCATGCCTT

351 GGTGGACGGC GAAGGCAATG TTTTTGAAGC CCGCTTGGAC AGACCCGGAA

401 TGCCGGTATT CAGAGGCGCG GAAGGAACGT CTGCCGAAAT GCTCCGCCGT

451 TATGACGAAT TTTCGACTGT TTTGGCAAAA CAGGGTTTGG GCATCAAAGA

501 GATGACCTAT ACGGCACGTT CGGCGTGGAT TGTCGTTTTG GACAACGGCA

551 TCACCGTCAG GCTCGGACGG GAAAACGAGA TGAAACGCCT CCGGCTTTTT

601 ACCGAAGCGT GGCAGCATCT GTTGCGTAAA AATAAAAATC GGTTATCCTA

651 TGTGGATATG AGGTATAAGG ACGGATTTTC AGTCCGCTAT GCTTCCGACG

701 GTTTACCCGA AAAGAATCC GAAGAATAG
```

This corresponds to the amino acid sequence <SEQ ID 2441; ORF 080>:

```
m080.pep
  1 MWDNAEAMER LTRWLLVMMA MLLAASGLVW FYNSNHLPVK QVSLKGNLVY

51 SDKKTLGSLA KEYIHGNILR TDINGAQEAY RRYPWIASVM VRRRFPDTVE

101 VVLTERKPVA RWGDHALVDG EGNVFEARLD RPGMPVFRGA EGTSAEMLRR

151 YDEFSTVLAK QGLGIKEMTY TARSAWIVVL DNGITVRLGR ENEMKRLRLF

201 TEAWQHLLRK NKNRLSYVDM RYKDGFSVRY ASDGLPEKES EE*
```

Computer analysis of this amino acid sequence gave the following results:
Homology with a Predicted ORF from *N. gonorrhoeae*
ORF 080 shows 97.9% identity over a 242 aa overlap with a predicted ORF (ORF 080.ng) from *N. gonorrhoeae*:

```
m080/g080

10         20         30         40         50         60
    m080.pep MWDNAEAMERLTRWLLVMMAMLLAASGLVWFYNSNHLPVKQVSLKGNLVYSDKKTLGSLA
             ||||||||||||||||||||||||||||||||||||||||||||||||||:|||||
         080 MWDNAEAMERLTRWLLVMMAMLLAASGLVWFYNSNHLPVKQVSLKGNLVYSDKKALGSLA
                    10         20         30         40         50         60
```

```
                    70         80         90        100        110        120
m080.pep   KEYIHGNILRTDINGAQEAYRRYPWIASVMVRRRFPDTVEVVLTERKPVARWGDHALVDG
           ||||||||||||||||||||||||||||||||||||||||||||||||||||||||||||
080        KEYIHGNILRTDINGAQEAYRRYPWIASVMVRRRFPDTVEVVLTERKPVARWGDHALVDG
                    70         80         90        100        110        120

130        140        150        160        170        180
m080.pep   EGNVFEARLDRPGMPVFRGAEGTSAEMLRRYDEFSTVLAKQGLGIKEMTYTARSAWIVVL
           |||||||||||||||||||||||||||||||||||||||||||||||||||||||| |||
080        EGNVFEARLDRPGMPVFRGAEGTSAEMLRRYDEFSTVLAKQGLGIKEMTYTARSAWNVVL
                   130        140        150        160        170        180

190        200        210        220        230        240
m080.pep   DNGITVRLGRENEMKRLRLFTEAWQHLLRKNKNRLSYVDMRYKDGFSVRYASDGLPEKES
           |||||||||||||||||||||||||||||||||||||||||||||||||||: ||||||||
080        DNGITVRLGRENEMKRLRLFTEAWQHLLRKNKNRLSYVDMRYKDGFSVPHAPDGLPEKES
                   190        200        210        220        230        240 m080.pep   EEX
           ||
080        EEYWEQVWDILRPGVGNGSTQISISYKGRRTMEQQX
                   250        260        270
```

The following partial DNA sequence was identified in *N. meningitidis* <SEQ ID 245>:

```
a080.seq
   1  ATGTGGGATA ATGCCGAAGC GATGGAACGG CTGACGCGCT GGCTGCTTGT

51  CATGATGGCG ATGCTGCTTG CTGCGTCCGG GCTGGTTTGG TTTTACAATT

101  CGAATCATCT GCCCGTCAAG CAGGTGTCGC TGAAGGGCAA CCTAGTTTAT

151  TCCGATAAGA AAGCATTGGG CAGTTTGGCG AAAGAATACA TCCATGGGAA

201  TATTTTGAGG ACGGACATCA ATGGCGCACA GGAGGCCTAC CGCCGGTATC

251  CGTGGATTGC GTCGGTCATG GTGCGCCGCC GTTTTCCCGA CACGGTTGAG

301  GTCGTCCTGA CCGAGCGCAA GCCGGTCGCG CGTTGGGGCG ACCATGCCTT

351  GGTGGACGGC GAAGGCAATG TTTTTGAAGC CCGTTTGGAC AGACCCGGAA

401  TGCCGGTATT CAGAGGCGCG GAAGGAACGT CTGCCGAAAT GCTCCGCCGT

451  TATGACGAAT TTTCGACTGT TTTGGCAAAA CAGGGTTTGG GCATCAAAGA

501  GATGACCTAT ACGGCACGTT CGGCGTGGAT TGTCGTTTTG GACAACGGCA

551  TCACCGTCAG GCTCGGACGG GAAAACGAGA TGAAACGCCT CCGGCTTTTT

601  ACCGAAGCGT GGCAACATCT GTTGCGTAAA AATAAAAATC GGTTATCCTA

651  TGTGGATATG AGGTATAAGG ACGGATTTTC AGTCCGCTAT GCTCCCGACG

701  GTTTACCCGA AAAAGAATCC GAAGAATAG
```

This corresponds to the amino acid sequence <SEQ ID 246; ORF 080.a>:

```
a080.pep
   1  MWDNAEAMER LTRWLLVMMA MLLAASGLVW FYNSNHLPVK QVSLKGNLVY

51  SDKKALGSLA KEYIHGNILR TDINGAQEAY RRYPWIASVM VRRRFPDTVE

101  VVLTERKPVA RWGDHALVDG EGNVFEARLD RPGMPVFRGA EGTSAEMLRR

151  YDEFSTVLAK QGLGIKEMTY TARSAWIVVL DNGITVRLGR ENEMKRLRLF

201  TEAWQHLLRK NKNRLSYVDM RYKDGFSVRY APDGLPEKES EE*
``` m080/a080 99.2% identity over a 242 aa overlap

```
                10         20         30         40         50         60
m080.pep  MWDNAEAMERLTRWLLVMMAMLLAASGLVWFYNSNHLPVKQVSLKGNLVYSDKKTLGSLA
          ||||||||||||||||||||||||||||||||||||||||||||||||||||:|||||
a080      MWDNAEAMERLTRWLLVMMAMLLAASGLVWFYNSNHLPVKQVSLKGNLVYSDKKALGSLA
                10         20         30         40         50         60

70         80         90        100        110        120
m080.pep  KEYIHGNILRTDINGAQEAYRRYPWIASVMVRRRFPDTVEVVLTERKPVARWGDHALVDG
          ||||||||||||||||||||||||||||||||||||||||||||||||||||||||||||
a080      KEYIHGNILRTDINGAQEAYRRYPWIASVMVRRRFPDTVEVVLTERKPVARWGDHALVDG
                70         80         90        100        110        120

130        140        150        160        170        180
m080.pep  EGNVFEARLDRPGMPVFRGAEGTSAEMLRRYDEFSTVLAKQGLGIKEMTYTARSAWIVVL
          ||||||||||||||||||||||||||||||||||||||||||||||||||||||||||||
a080      EGNVFEARLDRPGMPVFRGAEGTSAEMLRRYDEFSTVLAKQGLGIKEMTYTARSAWIVVL
               130        140        150        160        170        180

190        200        210        220        230        240
m080.pep  DNGITVRLGRENEMKRLRLFTEAWQHLLRKNKNRLSYVDMRYKDGFSVRYASDGLPEKES
          |||||||||||||||||||||||||||||||||||||||||||||||||||| |||||||
a080      DNGITVRLGRENEMKRLRLFTEAWQHLLRKNKNRLSYVDMRYKDGFSVRYAPDGLPEKES
               190        200        210        220        230        240 m080.pep  EEX
          |||
a080      EEX
```

The following partial DNA sequence was identified in *N. gonorrhoeae* <SEQ ID 247>:

```
g081.seq
   1 ATGAAACCAC TGGACCTAAA TTTCATCTGC CAAGGCTTCA AGCTTCCGAT

51 GCCGTCTGAA ACAAACCCG TGTCGCGCAT CGTAACCGAC AGCCGCGATA

101 TTCGGGAAGG CGATGTGTTT TTCGCATTGG CGGGCGGGCG GTTTGACGCG

151 CATGATTTTG TTGGAGGCGT ATTGTCTGCG GGCGCGGCGG CGGTTGTGGT

201 TTCGCGCGAA GATTGCGCGG CTTTGGGCGG CGCGTTGAAA GTCGATGACA

251 CGCTTGCCGC GTTGCAAACG TTGGCGAAGG CGTGGCGCGA TAATGTGAAC

301 CCGTTTGTGT TCGGCATTAC CGGTTCGGGC GGCAAGACGA CGGTGAAGGA

351 GATGCTGGCT GCGGTATTGC GCCGCCGTTT CGGCGATGAT GCCGTTTCGG

401 CGACGGCAGG CAACTTCAAC AACCACAtcg gaTTGCCGCT GACTTTATTG

451 AAATtaaAcg aAAAACACCG CTATGCCGTG ATTGAAATGG CATGAACCA

501 TTTTGGcgaa ctggcggtTt taacgcaaaT CGCCAAACCC GATGCCGCTT

551 TGGtcaACAA CGCCCTGCGC GCCCATGTCG GATGCGGTTt cgacggagtg

601 GGCGATATTG CCAAAGcgaa aagcGAGATT TatgcagGct tATGTTCAGA

651 CGGCATGGCA CTGATTCCTC AAGAAGATGC CAATATGGCT GTCTTCAAAA

701 CGGCAACGTT TAATTTGAAT ACGTGCACTT TCGGCGTCGA TAGCGGCGAT

751 GTCCGCGCGG AAAATATCGT GCTGAAACCT TTGTCGTGCG AATTTGATTT

801 GGTGTGCGGC GACGAGCGCA CTGCCGTGGT GCTGCCTGTT CCCGGCCGCC

851 ACAATGTCCA CAACGCCGCC GCTGCCGCCG CGCTGGCTTT GGCTGCCGGT

901 TTGAGTTTGA ACGATGTGGC GGAAGGTTTG CAAGGCTTCA GCAACATCAA

951 AGGCCGTCTG AACGTCAAAG CCGGCATCAA GGGCGCAACC CTGATTGACG

1001 ATACTTATAA TGCGAATCCC GACAGTATGA AGCCGCGGT TGACGTGTTG

1051 GCGCGTATGC CTGCGCCGCG CATTTCGTG ATGGGCGATA TGGGCGAACT

1101 GGGCGAGGAc gaAGCCGCCG CCATGCACGC CGAAgtcgGC GCGTACGCCC
```

-continued

```
1151 GCGACCAAGG CATCGAAGCG GCTTATTTTG TCGGCGACAA CAGCGTCGAA

1201 GCGGcggaAA AATTTGGCGC GGACGGTTTG TGGTTCGCCG CCAAAGACCC

1251 GTTGATTCAA GTGTTGAGCC ACGATTTGCC CGAACGCGCC ACCGTGTTGG

1301 TGAAAGGTTC GCGCTTTATG CAGAtggAAG AAGTGGTCGA GGCATTGGAG

1351 GATAAGTga
```

This corresponds to the amino acid sequence <SEQ ID 248; ORF 081.ng>:

```
g081.pep
    1 MKPLDLNFIC QALKLPMPSE NKPVSRIVTD SRDIREGDVF FALAGGRFDA

51 HDFVGGVLSA GAAAVVVSRE DCAALGGALK VDDTLAALQT LAKAWRDNVN

101 PFVFGITGSG GKTTVKEMLA AVLRRRFGDD AVSATAGNFN NHIGLPLTLL

151 KLNEKHRYAV IEMGMNHFGE LAVLTQIAKP DAALVNNALR AHVGCGFDGV

201 GDIAKAKSEI YAGLCSDGMA LIPQEDANMA VFKTATFNLN TCTFGVDSGD

251 VRAENIVLKP LSCEFDLVCG DERTAVVLPV PGRHNVHNAA AAAALALAAG

301 LSLNDVAEGL QGFSNIKGRL NVKAGIKGAT LIDDTYNANP DSMKAAVDVL

351 ARMPAPRIFV MGDMGELGED EAAAMHAEVG AYARDQGIEA AYFVGDNSVE

401 AAEKFGADGL WFAAKDPLIQ VLSHDLPERA TVLVKGSRFM QMEEVVEALE

451 DK*
```

The following partial DNA sequence was identified in *N. meningitidis* <SEQ ID 249>:

```
m081.seq
    1 ATGAAACCAC TGGACCTAAA TTTCATCTGC CAAGCCCTCA AGCTTCCGAT

51 GCCGTCTGAA AGCAAACCCG TGTCGCGCAT CGTAACCGAC AGCCGCGACA

101 TCCGCGCGGG CGATGTGTTT TTCGCATTGG CGGGCGAGCG GTTTGACGCG

151 CATGATTTTG TTGAAGACGT ATTGGCTGCT GGTGCGGCGG CGGTTGTGGT

201 TTCGCGCGAA GATTGTGCTG CAATGGATGG CGCGTTGAAA GTCGATGACA

251 CGCTTGCCGC ATTGCAAACG CTGGCAAAGG CGTGGCGTGA AAATGTGAAT

301 CCGTTTGTGT TCGGCATTAC CGGTTCGGGC GGCAAGACGA CGGTGAAGGA

351 AATGCTGGCT GCGGTATTGC GCCgCCGTTT CGGCGATGAT GCCGTGTTGG

401 CGACGGCAGG CAACTTCAAC AACCATATCG GATTGCCGCT GACTTTGTTG

451 AAGTTAAACG AAAAACACCG CTATGCCGTG ATTGAAATGG CATGAACCA

501 TTTCGGCGAA CTGGCGGTTT TAACGCAmAT CGCCAAACCA AATGCCGCAT

551 TGGTCAACAA CGCCATGCGC GCCCATGTCG GCTGCGGTTT CGACGGAGTG

601 GGCGATATTG CCAAAGCGAA AAGCGAGATT TACCAAGGTT TATGTTCAGA

651 CGGCATTGCA CTGATTCCTC AAGAAGATGC CAATATGGCT GTCTTCAAAA

701 CGGCAACGCT TAATTTGAAT ACGCGCACTT TCGGCATCGA TAGCGGCGAT

751 GTTCACGCGG AAAATATTGT GCTGAAACCG TTGTCGTGCG AATTTGATTT

801 GGTGTGCGGC GATGAGCGCG CCGCCGTGGT GCTGCCTGTT CCCGGCCGCC

851 ACAATGTCCA CAACGCCGCC GCTGCCGCCG CGCTGGCTTT GGCTGCGGGT

901 TTGAGTTTGA ACGATGTGGC GGAAGGTTTG AAAGGCTTCA GCAATATCAA
```

```
                                  -continued
 951  AGGCCGTCTG  AACGTCAAAT  CCGGAATCAA  GGGCGCAACC  CTGATTGACG

1001  ATACTTATAA  TGCGAACCCT  GACAGCATGA  AAGCTGCGAT  TGACGTGTTG

1051  GCGCGTATGC  CTGCGCCGCG  TATTTTCGTG  ATGGGCGATA  TGGGCGAACT

1101  GGGCGAACTG  GGCGAGGACG  AAGCCGCCGC  TATGCACGCC  GAAGTCGGCG

1151  CGTATGCCCG  CGACCAAGGC  ATCGAAGCGG  CTTATTTTGT  CGGCGACAAC

1201  AGCGTCGAAG  CGGCGGAAAA  ATTTGGCGCG  GACGGTTTGT  GGTTCGCCGC

1251  CAAAGACCCG  TTGATTCAAG  TGTTGCGCCA  CGATTTGCCC  GAACGCGCCA

1301  CCGTGTTGGT  GAAAGGTTCG  CGCTTTATGC  AGATGGAAGA  AGTGGTCGAG

1351  GCATTGGAGG  ATAAGTGA
```

This corresponds to the amino acid sequence <SEQ ID 250; ORF 081>:

```
m081.pep
    1  MKPLDLNFIC  QALKLPMPSE  SKPVSRIVTD  SRDIRAGDVF  FALAGERFDA

51  HDFVEDVLAA  GAAAVVVSRE  DCAAMDGALK  VDDTLAALQT  LAKAWRENVN

101  PFVFGITGSG  GKTTVKEMLA  AVLRRRFGDD  AVLATAGNFN  NHIGLPLTLL

151  KLNEKHRYAV  IEMGMNHFGE  LAVLTXIAKP  NAALVNNAMR  AHVGCGFDGV

201  GDIAKAKSEI  YQGLCSDGIA  LIPQEDANMA  VFKTATLNLN  TRTFGIDSGD

251  VHAENIVLKP  LSCEFDLVCG  DERAAVVLPV  PGRHNVHNAA  AAAALALAAG

301  LSLNDVAEGL  KGFSNIKGRL  NVKSGIKGAT  LIDDTYNANP  DSMKAAIDVL

351  ARMPAPRIFV  MGDMGELGEL  GEDEAAAMHA  EVGAYARDQG  IEAAYFVGDN

401  SVEAAEKFGA  DGLWFAAKDP  LIQVLRHDLP  ERATVLVKGS  RFMQMEEVVE

451  ALEDK*
```

Computer analysis of this amino acid sequence gave the following results:
Homology with a Predicted ORF from N. gonorrhoeae    40
  ORF 081 shows 94.1% identity over a 455 aa overlap with a predicted ORF (ORF 081.ng) from N. gonorrhoeae:

```
  m081/g081

10         20         30         40         50         60
     m081.pep  MKPLDLNFICQALKLPMPSESKPVSRIVTDSRDIRAGDVFFALAGERFDAHDFVEDVLAA
               ||||||||||||||||||||:||||||||||||||| |||||||| ||||||||  :|
     g081      MKPLDLNFICQALKLPMPSENKPVSRIVTDSRDIREGDVFFALAGGRFDAHDFVGGVLSA
                     10         20         30         40         50         60

70         80         90        100        110        120
     m081.pep  GAAAVVSREDCAAMDGALKVDDTLAALQTLAKAWRENVNPFVFGITGSGGKTTVKEMLA
               ||||||||||||||:|||||||||||||||||||||:||||||||||||||||||||||
     g081      GAAAVVSREDCAALGGALKVDDTLAALQTLAKAWRDNVNPFVFGITGSGGKTTVKEMLA
                     70         80         90        100        110        120

130        140        150        160        170        180
     m081.pep  AVLRRRFGDDAVLATAGNFNNHIGLPLTLLKLNEKHRYAVIEMGMNHFGELAVLTXIAKP
               |||||||||||| |||||||||||||||||||||||||||||||||||||||||| ||||
     g081      AVLRRRFGDDAVSATAGNFNNHIGLPLTLLKLNEKHRYAVIEMGMNHFGELAVLTQIAKP
                    130        140        150        160        170        180

190        200        210        220        230        240
     m081.pep  NAALVNNAMRAHVGCGFDGVGDIAKAKSEIYQGLCSDGIALIPQEDANMAVFKTATLNLN
               :|||||||:||||||||||||||||||||||| ||||||:||||||||||||||||:|||
     g081      DAALVNNALRAHVGCGFDGVGDIAKAKSEIYAGLCSDGMALIPQEDANMAVFKTATFNLN
                    190        200        210        220        230        240

190        200        210        220        230        240
     m081.pep  TRTFGIDSGDVHAENIVLKPLSCEFDLVCGDERAAVVLPVPGRHNVHNAAAAAALALAAG
               | |||:|||||:|||||||||||||||||||||:||||||||||||||||||||||||||
     g081      TCTFGVDSGDVRAENIVLKPLSCEFDLVCGDERTAVVLPVPGRHNVHNAAAAAALALAAG
                    190        200        210        220        230        240
```

-continued

```
              310        320        330        340        350        360
m081.pep LSLNDVAEGLKGFSNIKGRLNVKSGIKGATLIDDTYNANPDSMKAAIDVLARMPAPRIFV
         ||||||||||:|||||||||||||:||||||||||||||||||||:|||||||||||||
g081     LSLNDVAEGLQGFSNIKGRLNVKAGIKGATLIDDTYNANPDSMKAAVDVLARMPAPRIFV
              310        320        330        340        350        360

370        380        390        400        410        420
m081.pep MGDMGELGELGEDEAAAMHAEVGAYARDQGIEAAYFVGDNSVEAAEKFGADGLWFAAKDP
         |||||||||   ||||||||||||||||||||||||||||||||||||||||||||||||
g081     MGDMGELGE---DEAAAMHAEVGAYARDQGIEAAYFVGDNSVEAAEKFGADGLWFAAKDP
              370        380        390        400        410

430        440        450
m081.pep LIQVLRHDLPERATVLVKGSRFMQMEEVVEALEDKX
         |||||||||||||||||||||||||||||||||||
g081     LIQVLSHDLPERATVLVKGSRFMQMEEVVEALEDKX
              430        440        450
```

The following partial DNA sequence was identified in *N. meningitidis* <SEQ ID 251>:

```
a081.seq
    1 ATGAAACCAC TGGACCTAAA TTTCATCTGC CAAGCCCTCA AGCTTCCGAT

51 GCCGTCTGAA AGCAAACCCG TGTCGCGCAT CGTAACCGAC AGCCGCGACA

101 TCCGCGCGGG CGATGTGTTT TTCGCATTGG CGGGCGGGCG GTTTGATGCG

151 CATGATTTTG TTGAAGACGT ATTGGCTGCG GGTGCGGCGG CGGTTGTGGT

201 TTCGCGCGAA GATTGCGTTG CAATGGATGG CGCGTTGAAA GTCGATGACA

251 CGCTTACCGC GTTGCAAATG TTGGCGAAGG CGTGGCGCGA GAATGTGAAC

301 CCGTTTGTGT TCGGTATTAC CGGCTCGGGC GGCAAGACGA CGGTGAAGGA

351 AATGTTGGCT GCGGTATTGC GCCGCCGTTT CGGCGATAAT GCCGTTTTGG

401 CGACGGCAGG CAACTTCAAC AACCACATCG GATTGCCGTT GACTTTGTTG

451 AAATTAAACG AAAAACACCG CTATGCCGTG ATTGAAATGG GTATGAACCA

501 TTTTGGCGAA CTGGCGGTTT TGACACAAAT CGCCAAACCC GATGCCGCAT

551 TGGTCAACAA CGCCATGCGC GCCCATGTCG GCTGCGGTTT CGACGGAGTG

601 GGCGATATTG CCAAAGCGAA AAGCGAGATT TATCAAGGCT TATGTTCAGA

651 CGGCATGGCG CTGATTCCTC AAGAAGATGC CAATATGGCT GTCTTCAAAA

701 CGGCAACGCT TAATTTGAAT ACGCGCACTT TCGGCATCGA TAGCGGCGAT

751 GTCCACGCGG AAAATATCGT GCTGAAACCG TTGTCGTGCG AATTTGATTT

801 GGTGTGCGGC AACGAGTGCG CAGCCGTGGT TCTGCCCGTT CCCGGCCGCC

851 ACAATGTCCA CAACGCCGCC GCCGCCGCCG CGCTGTCTTT GGCTGCAGGT

901 TTGAGTTTGA ACGATGTGGC GGAAGGTTTG AAAGGCTTCA GCAATATCAA

951 AGGCCGTCTG AACGTCAAAT CCGGAATCAA GGGCGCAACC CTGATTGACG

1001 ATACTTATAA TGCGAACCCT GACAGCATGA AAGCTGCGGT TGACGTGTTG

1051 GCGCGTATGC CTGCGCCGCG TATTTTCGTG ATGGGCGATA TGGGCGAACT

1101 GGGTGAGGAC GAAGCCGCCG CCATGCACGC CGAAGTCGGC GCGTACGCCC

1151 GCGACCAAGG CATCGAAGCG GCTTATTTTG TCGGCGACAA CAGCGTCGAA

1201 GCGGCGGAAA AATTTGGCGC GGACGGTTTG TGGTTCGCCG CCAAAGACCC

1251 GTTGATTCAA GTGTTGCGCC ACGATTTGCC CGAACGCGCC ACCGTGTTGG

1301 TGAAAGGTTC GCGCTTTATG CAGATGGAAG AAGTGGTCGA GGCATTGGAG

1351 GATAAGTGA
```

This corresponds to the amino acid sequence <SEQ ID 252; ORF 081.a>:

```
a081.pep
    1  MKPLDLNFIC QALKLPMPSE SKPVSRIVTD SRDIRAGDVF FALAGGRFDA

51  HDFVEDVLAA GAAAVVVSRE DCVAMDGALK VDDTLTALQM LAKAWRENVN

101  PFVFGITGSG GKTTVKEMLA AVLRRRFGDN AVLATAGNFN NHIGLPLTLL

151  KLNEKHRYAV IEMGMNHFGE LAVLTQIAKP DAALVNNAMR AHVGCGFDGV

201  GDIAKAKSEI YQGLCSDGMA LIPQEDANMA VFKTATLNLN TRTFGIDSGD

251  VHAENIVLKP LSCEFDLVCG NECAAVVLPV PGRHNVHNAA AAAALSLAAG

301  LSLNDVAEGL KGFSNIKGRL NVKSGIKGAT LIDDTYNANP DSMKAAVDVL

351  ARMPAPRIFV MGDMGELGED EAAAMHAEVG AYARDQGIEA AYFVGDNSVE

401  AAEKFGADGL WFAAKDPLIQ VLRHDLPERA TVLVKGSRFM QMEEVVEALE

451  DK*
``` m081/a081 96.7% identity over a 455 aa overlap

```
                  10         20         30         40         50         60
  m081.pep  MKPLDLNFICQALKLPMPSESKPVSRIVTDSRDIRAGDVFFALAGERFDAHDFVEDVLAA
            ||||||||||||||||||||||||||||||||||||||||||| ||||||||||||||||
  a081      MKPLDLNFICQALKLPMPSESKPVSRIVTDSRDIRAGDVFFALAGGRFDAHDFVEDVLAA
                  10         20         30         40         50         60

70         80         90        100        110        120
  m081.pep  GAAAVVVSREDCAAMDGALKVDDTLAALQTLAKAWRENVNPFVFGITGSGGKTTVKEMLA
            |||||||||||:|||||||||||||||:|||:|||||||||||||||||||||||||||
  a081      GAAAVVVSREDCVAMDGALKVDDTLTALQMLAKAWRENVNPFVFGITGSGGKTTVKEMLA
                  70         80         90        100        110        120

130        140        150        160        170        180
  m081.pep  AVLRRRFGDDAVLATAGNFNNHIGLPLTLLKLNEKHRYAVIEMGMNGFGELAVLTXIAKP
            ||||||||:|||||||||||||||||||||||||||||||||||||| ||||||| |||
  a081      AVLRRRFGDNAVLATAGNFNNHIGLPLTLLKLNEKHRYAVIEMGMNHFGELAVLTQIAKP
                 130        140        150        160        170        180

190        200        210        220        230        240
  m081.pep  NAALVNNAMRAHVGCGFDGVGDIAKAKSEIYQGLCSDGIALIPQEDANMAVFKTATLNLN
            :||||||||||||||||||||||||||||||||||||:||||||||||||||||||||||
  a081      DAALVNNAMRAHVGCGFDGVGDIAKAKSEIYQGLCSDGMALIPQEDANMAVFKTATLNLN
                 190        200        210        220        230        240

250        260        270        280        290        300
  m081.pep  TRTFGIDSGDVHAENIVLKPLSCEFDLVCGDERAAVVLPVPGRHNVHNAAAAAALALAAG
            ||||||||||||||||||||||||||||||:| ||||||||||||||||||||||:||||
  a081      TRTFGIDSGDVHAENIVLKPLSCEFDLVCGNECAAVVLPVPGRHNVHNAAAAAALSLAAG
                 250        260        270        280        290        300

310        320        330        340        350        360
  m081.pep  LSLNDVAEGLKGFSNIKGRLNVKSGIKGATLIDDTYNANPDSMKAAIDVLARMPAPRIFV
            ||||||||||||||||||||||||||||||||||||||||||||||:|||||||||||||
  a081      LSLNDVAEGLKGFSNIKGRLNVKSGIKGATLIDDTYNANPDSMKAAVDVLARMPAPRIFV
                 310        320        330        340        350        360

370        380        390        400        410        420
  m081.pep  MGDMGELGELGEDEAAAMHAEVGAYARDQGIEAAYFVGDNSVEAAEKFGADGLWFAAKDP
            ||||||||| |||||||||||||||||||||||||||||||||||||||||||||||
  a081      MGDMGELGE---DEAAAMHAEVGAYARDQGIEAAYFVGDNSVEAAEKFGADGLWFAAKDP
                           370        380        390        400        410

430        440        450
  m081.pep  LIQVLRHDLPERATVLVKGSRFMQMEEVVEALEDKX
            |||||||||||||||||||||||||||||||||||
  a081      LIQVLRHDLPERATVLVKGSRFMQMEEVVEALEDKX
                 420        430        440        450
```

The following partial DNA sequence was identified in *N. gonorrhoeae* <SEQ ID 253>:

```
g082.seq
    1  aTGTGGTTGT TGAAGTTGCC TGCCGTCGCC GAAACGGCAT CATCGCCGAA

51  ACGGCGGCGC AATACCGCAG CCAGCATCTC CTTCACCGTC GTCTTGCCGC
```

-continued

```
101  CCGAACCGGT AATGCCGAAC ACAAACGGGT TCACATTATC GCGCCACGCC

151  TTCGCCAACG TTTGCAACGC GGCAAGCGTG TCATCGACTT TCAACGCGCC

201  GCCCAAAGCC GCGCAATCTT CGCGCGAAAC CACAACCGCC GCCGCGCCCG

251  CAGACAATAC GCCTCCAACA AAATCATGCG CGTCAAACCG CCCGCCCGCC

301  AATGCGAAAA ACACATCGCC TTCCCGAATA TCGCGGCTGT CGGTTACGAT

351  GCGCGACACG GGTTTGTTTT CAGACGGCAT CGGAAGCTTG AGGGCTTGGC

401  AGATGAAATT TAGGTCCAGT GGTTTCATAT TTGCTTTCGT TAATATTCGG

451  GCGGCGGACA CATCGGTAGC GGCTGATTTT TTTATCGCCT GTTTTGCTGT

501  GGTAAAACAC AGATTATTTT CCCATTCTCA TTCGGCATTT TTTCTGTACG

551  TATCATTTTT TAGACGTATT TTTAGCCGAT TTGCCTTTTC CCGCATACCA

601  CGGCGCGGGG TCGTCGGACT GTCTGTCGAT AAAGGCAAGG TTATTGCCTT

651  CGCCCGGCAC ATCGGGGACA TTCCCCCAAA AATCATAGCC GTCATCGGGC

701  AACTCGTCGG TTTCGATACC CGTCCAACTG CCGAATCCGC GTAA
```

This corresponds to the amino acid sequence <SEQ ID 254; ORF 082.ng>:

```
g082.pep
  1  MWLLKLPAVA ETASSPKRRR NTAASISFTV VLPPEPVMPN TNGFTLSRHA

51  FANVCNAASV SSTFNAPPKA AQSSRETTTA AAPADNTPPT KSCASNRPPA

101  NAKNTSPSRI SRLSVTMRDT GLFSDGIGSL RAWQMKFRSS GFIFAFVNIR

151  AADTSVAADF FIACFAVVKH RLFSHSHSAF FLYVSFFRRI FSRFAFSRIP

201  RRGVVGLSVD KGKVIAFARH IGDIPPKIIA VIGQLVGFDT RPTAESA*
```

The following partial DNA sequence was identified in *N. meningitidis* <SEQ ID 255>:

```
m082.seq
  1  ATGnnGTTGT TGAAGTTGCC TGCCGTCGCC AACACGGCAT CATCGCCGAA

51  ACGGcGGCGC AATACCGCAG CCAGCATTTC CTTCACCGTC GTCTTGCCGC

101  CCGAACCGGT AATGCCGAAC ACAAACGGAT TCACATTTTC ACGCCACGCC

151  TTTGCCAGCG TTTGCAATGC GGCAAGCGTG TCATCGACTT TCAACGCGCC

201  ATCCATTGCA GCACAATCTT CGCGCGAAAC CACAACCGCC GCCGCACCAG

251  CAGCCAATAC GTCTTCAACA AAATCATGCG CGTCAAACCG CTCGCCCGCC

301  AATGCGAAAA ACACATCGCC CGCGCGGATG TCGCGGCTGT CGGTTACGAT

351  GCGCGACACG GGTTTGCTTT CAGACGGCAT CGGAAGCTTG AGGGCTTGGC

401  AGATGAAATT TAGGTCCAGT GGTTTCATAT TTACTTTCGT TAATATTCGG

451  GCGGCGGACA CATCGGTAGC GGCTGATTTT TTTATCGCCT GTTTTGCTGT

501  GGTAAAACAC AGATTATTTT CCCATTCTCA TTCGGsATTT TTTCTGTACG

551  TATCATTTTT TAGACGTATT TTTAGTCGAT TTGCCTTTTC CCGCATACCA

601  CGGCGCGGGG TCGTCGGGCA GTCCGTCGAT AAAGGCAAGG TTATTGCCTT

651  CGCCCTGCAC ATCGGGAACA TTCCCCCAAA AATCATAGCC GTCATCGGGC

701  AACTCGTCGG TTTCGATACC CGTCCAACTG CCGAATCCGC GTAA
```

This corresponds to the amino acid sequence <SEQ ID 256; ORF 082>:

```
m082.pep
    1 MXLLKLPAVA NTASSPKRRR NTAASISFTV VLPPEPVMPN TNGFTFSRHA

51 FASVCNAASV SSTFNAPSIA AQSSRETTTA AAPAANTSST KSCASNRSPA

101 NAKNTSPARM SRLSVTMRDT GLLSDGIGSL RAWQMKFRSS GFIFTFVNIR

151 AADTSVAADF FIACFAVVKH RLFSHSHSXF FLYVSFFRRI FSRFAFSRIP

201 RRGVVGQSVD KGKVIAFALH IGNIPPKIIA VIGQLVGFDT RPTAESA*
```

Computer analysis of this amino acid sequence gave the following results:
Homology with a Predicted ORF from *N. gonorrhoeae*
ORF 082 shows 92.7% identity over a 247 aa overlap with a predicted ORF (ORF 082.ng) from *N. gonorrhoeae*:

```
    m082/g082
                  10         20         30         40         50         60
    m082.pep  MXLLKLPAVANTASSPKRRRNTAASISFTVVLPPEPVMPNTNGFTFSRHAFASVCNAASV
              | ||||||||:|||||||||||||||||||||||||||||||||||:||||||:|||||||
    g082      MWLLKLPAVAETASSPKRRRNTAASISFTVVLPPEPVMPNTNGFTLSRHAFANVCNAASV
                  10         20         30         40         50         60
                  70         80         90        100        110        120
    m082.pep  SSTFNAPSIAAQSSRETTTAAAPAANTSSTKSCASNRSPANAKNTSPARMSRLSVTMRDT
              |||||||  ||||||||||||||| || ||||||||| |||||||||:|:|||||||||||
    g082      SSTFNAPPKAAQSSRETTTAAAPADNTPPTKSCASNRPPANAKNTSPSRISRLSVTMRDT
                  70         80         90        100        110        120
                 130        140        150        600        170        180
    m082.pep  GLLSDGIGSLRAWQMKFRSSGFIFTFVNIRAADTSVAADFFIACFAVVKHRLFSHSHSXF
              ||:|||||||||||||||||||||:||||||||||||||||||||||||||||||||| |
    g082      GLFSDGIGSLRAWQMKFRSSGFIFAFVNIRAADTSVAADFFIACFAVVKHRLFSHSHSAF
                 130        140        150        600        170        180
                 190        200        210        220        230        240
    m082.pep  FLYVSFFRRIFSRFAFSRIPRRGVVGQSVDKGKVIAFALHIGNIPPKIIAVIGQLVGFDT
              |||||||||||||||||||||||||| ||||||||||| :|| ||||||||||||||||
    g082      FLYVSFFRRIFSRFAFSRIPRRGVVGLSVDKGKVIAFARHIGDIPPKIIAVIGQLVGFDT
                 190        200        210        220        230        240
    m082.pep  RPTAESAX
              ||||||||
    g082      RPTAESAX
```

The following partial DNA sequence was identified in *N. meningitidis* <SEQ ID 257>:

```
a082.seq
    1 ATGTGGTTGT TGAAGTTGCC TGCCGTCGCC AAAACGGCAT TATCGCCGAA

51 ACGGCGGCGC AATACCGCAG CCAACATTTC CTTCACCGTC GTCTTGCCGC

101 CCGAGCCGGT AATACCGAAC ACAAACGGGT TCACATTCTC GCGCCACGCC

151 TTCGCCAACA TTTGCAACGC GGTAAGCGTG TCATCGACTT TCAACGCGCC

201 ATCCATTGCA ACGCAATCTT CGCGCGAAAC CACAACCGCC GCCGCACCCG

251 CAGCCAATAC GTCTTCAACA AAATCATGCG CATCAAACCG CCCGCCCGCC

301 AATGCGAAAA ACACATCGCC CGCGCGGATG TCGCGGCTGT CGGTTACGAT

351 GCGCGACACG GGTTTGCTTT CAGACGGCAT CGGAAGCTTG AGGGCTTGGC

401 AGATGAAATT TAGGTCCAGT GGTTTCATAT TTACTTTCGT TAATATTCGG

451 GCGGCGGACA CATCGGTAGC GGCTGATTTT TTTATCGCCT GTTTTGCTGT

501 GGTAAAACAC AGATTATTTT CCCATTCTCA TTCGGCATTT TTTCTGTACG

551 TATCATTTTT TAGACGTATT TTTAGTCGAT TTGCCTTTTC CCGCATACCA
```

```
-continued
601 CGGCGCGGGG TCGTCGGGCA GTCCGTCGAT AAAGGCAAGG TTATTGCCTT

651 CGCCCTGCAC ATCGGGAACA TTCCCCCAAA AATCATAGCC GTCATCGGGC

701 AACTCGTCGG TTTCGATACC CGTCCAACTG CCGAATCCGC GTAA
```

This corresponds to the amino acid sequence <SEQ ID 258; ORF 082.a>:

```
a082.pep
  1 MWLLKLPAVA KTALSPKRRR NTAANISFTV VLPPEPVIPN TNGFTFSRHA

51 FANICNAVSV SSTFNAPSIA TQSSRETTTA AAPAANTSST KSCASNRPPA

101 NAKNTSPARM SRLSVTMRDT GLLSDGIGSL RAWQMKFRSS GFIFTFVNIR

151 AADTSVAADF FIACFAVVKH RLFSHSHSAF FLYVSFFRRI FSRFAFSRIP

201 RRGVVGQSVD KGKVIAFALH IGNIPPKIIA VIGQLVGFDT RPTAESA*
``` m082/a082 95.5% identity over a 247 aa overlap

```
                  10         20         30         40         50         60
    m082.pep MXLLKLPAVANTASSPKRRRNTAASISFTVVLPPEPVMPNTNGFTFSRHAFASVCNAASV
             | ||||||||:|| |||||||||||:||||||||||||:|||||||||||||::|||:||
        a082 MWLLKLPAVAKTALSPKRRRNTAANISFTVVLPPEPVIPNTNGFTFSRHAFANICNAVSV
                  10         20         30         40         50         60

70         80         90        100        110        120
    m082.pep SSTFNAPSIAAQSSRETTTAAAPAANTSSTKSCASNRSPANAKNTSPARMSRLSVTMRDT
             |||||||||:|||||||||||:|||||||||||||||| |||||||||||||||||||||
        a082 SSTFNAPSIATQSSRETTTAAAPAANTSSTKSCASNRPPANAKNTSPARMSRLSVTMRDT
                  70         80         90        100        110        120

130        140        150        160        170        180
    m082.pep GLLSDGIGSLRAWQMKFRSSGFIFTFVNIRAADTSVAADFFIACFAVVKHRLFSHSHSXF
             |||||||||||||||||||||||||||||||||||||||||||||||||||||||||| |
        a082 GLLSDGIGSLRAWQMKFRSSGFIFTFVNIRAADTSVAADFFIACFAVVKHRLFSHSHSAF
                 130        140        150        160        170        180

190        200        210        220        230        240
    m082.pep FLYVSFFRRIFSRFAFSRIPRRGVVGQSVDKGKVIAFALHIGNIPPKIIAVIGQLVGFDT
             ||||||||||||||||||||||||||||||||||||||||||||||||||||||||||||
        a082 FLYVSFFRRIFSRFAFSRIPRRGVVGQSVDKGKVIAFALHIGNIPPKIIAVIGQLVGFDT
                 190        200        210        220        230        240 m082.pep RPTAESAX
             ||||||||
        a082 RPTAESAX
```

The following partial DNA sequence was identified in *N. gonorrhoeae* <SEQ ID 259>:

```
g084.seq
  1 ATGAAacaAT CCGcccgaat aAAAAATATG GATCAGACAT TAAAAAATAc 51 attgggcatt tGCGCGctttt tagcctTTTG TTTTggcgcG gccaTCGCAT

101 CAGGTTATCA CTTGGAATAT GAATACGGCT ACCGTTATTC TGCCGTGGGC

151 GCTTTGGCTT CGGTTGTATT TTTATTATTA TTGGCACGCG GCTTCCCGCG

201 CGTTTCTTCA GTTGTTTTAC TGATTTACGT CGGCACAACC GCCCTATATT

251 TGCCGGTCGG CTGGCTGTAT GGTGCGCCTT CTTATCAGAT AGTCGGTTCG

301 ATATTGGAAA GCAATCCTGC CGAGGCGCGT GAATTTGTCG GCAATCTTCC

351 CGGGTCGCTT TATTTTGTGC AGGCATTATT TTTCATTTTT GGCTTGACAG

401 TTTGGAAATA TTGTGTATCT GTGGGGGTAT TTGCTGACGT AAAAAACTAT

451 AAACGTCGCA GCAAATATG GCTGACCATA TTATTGACTT TGATTTTGTC

501 CTGCGCGGTG ATGGAGAAAA TCGccggcga taaAGATTGG CGAGaacctg
```

-continued
```
551 atgccggcct gttgttgaat ATTTTcgacc tgtattaCga cttggctttc 601 cgcgccggca cAATATGCCG CCAAGCGCGC CCAcattttg gaagCagcaa 651 aaaaaacatC AACATGGCAt atccaccaac ttacacccaa aTAtaa
```

This corresponds to the amino acid sequence <SEQ ID 260; ORF 084.ng>:

```
g084.pep
  1 MKQSARIKNM DQILKNTLGI CALLAFCFGA AIASGYHLEY EYGYRYSAVG

51 ALASVVFLLL LARGFPRVSS VVLLIYVGTT ALYLPVGWLY GAPSYQIVGS

101 ILESNPAEAR EFVGNLPGSL YFVQALFFIF GLTVWKYCVS VGVFADVKNY

151 KRRSKIWLTI LLTLILSCAV MEKIAGDKDW REPDAGLLLN IFDLYYDLAF

201 RAGTICRQAR PHFGSSKKSV NMAYPPTCAQ V*
```

The following partial DNA sequence was identified in *N. meningitidis* <SEQ ID 261>:

```
m084.seq
  1 ATGAAACAAT CCGCCcGAAT AAAa.ATATG AATCAGACAT TACTTTATAC

51 ATTGGGCATT TGCGCGCTTT TAACCTTTnn nnnnnnnnnn nnnnnnnnnn 101 nnnnnTATCA CCCnGAATAT GAATACGGCT ACCGTTATTC TGCCGTGGGT

151 GCTTTGGCTT CGGTTGTATT TTTATTATTA TTGGCACGCG GTTTCCCGCG

201 CGTTTCTTCA GTTGTTTTAC TGATTTACGT CGGCACAACC GCCCTATATT

251 TGCCGGTCGG CTGGCTGTAT GGTGCGCCGT CTTATCAGAT AGTCGGTTCG

301 ATATTGGAAA GCAATCCTGC CGAGGCGCGT GAATTTGTCG GCAATCTTCC

351 CGGGTCGCTT TATTTTGTGC AGGCATTATT TTTCATTTTT GGCTTGACAG

401 TTTGGAAATA TTGTGTATCG GGGGGGGTAT TTGCTGACGT AAAAAACTAT

451 AAACGCCGCA GCAAAATATG GCTGACTATA TTATTGACTT TGATTTTGTC

501 CTGCGCGGTG ATGGATAAAA TCGCCAGCGA TAAAGATTTG CGAGAACCTG

551 ATGCCGGCCT GTTGTTGAAT ATTTTCGACC TGTATTACGA TTTGGCT.TC

601 CGCGCCGGCA CAATATGCCG CCAAGCGCGC CCACATTTTG GAAGCAGCAA

651 AAAAAGCGTC AACATGGCAT ATCCGTCATG TTGCGCCCAA GTATAA
```

This corresponds to the amino acid sequence <SEQ ID 262; ORF 084>:

```
m084.pep
  1 MKQSARIKXM NQTLLYTLGI CALLTFXXXX XXXXXYHPEY EYGYRYSAVG

51 ALASVVFLLL LARGFPRVSS VVLLIYVGTT ALYLPVGWLY GAPSYQIVGS

101 ILESNPAEAR EFVGNLPGSL YFVQALFFIF GLTVWKYCVS GGVFADVKNY

151 KRRSKIWLTI LLTLILSCAV MDKIASDKDL REPDAGLLLN IFDLYYDLAX

201 RAGTICRQAR PHFGSSKKSV NMAYPSCCAQ V*
```

Computer analysis of this amino acid sequence gave the following results:

Homology with a Predicted ORF from *N. gonorrhoeae*

ORF 084 shows 90.5% identity over a 231 aa overlap with a predicted ORF (ORF 084.ng) from *N. gonorrhoeae*:

```
m084/g084

10        20        30        40        50
   m084.pep  MKQSARIKXMNQTLLYTLGICALLTF---------YHPEYEYGYRYSAVGALASVVFLLL
             ||||||||  :|||  ||||||||:|         ||  ||||||||||||||||||||||
      g084   MKQSARIKNMDQTLKNTLGICALLAFCFGAAIASGYHLEYEYGYRYSAVGALASVVFLLL
                    10        20        30        40        50        60

60        70        80        90       100       110
   m084.pep  LARGFPRVSSVVLLIYVGTTALYLPVGWLYGAPSYQIVGSILESNPAEAREFVGNLPGSL
             ||||||||||||||||||||||||||||||||||||||||||||||||||||||||||||
      g084   LARGFPRVSSVVLLIYVGTTALYLPVGWLYGAPSYQIVGSILESNPAEAREFVGNLPGSL
                    70        80        90       100       110       120

120       130       140       150       160       170
   m084.pep  YFVQALFFIFGLTVWKYCVSGGVFADVKNYKRRSKIWLTILLTLILSCAVMDKIASDKDL
             ||||||||||||||||||||| ||||||||||||||||||||||||||||| : ||| :|||
      g084   YFVQALFFIFGLTVWKYCVSVGVFADVKNYKRRSKIWLTILLTLILSCAVMEKIAGDKDW
                   130       140       150       160       170       180

180       190       200       210       220
   m084.pep  REPDAGLLLNIFDLYYDLAXRAGTICRQARPHFGSSKKSVNMAYPSCCAQVX
             ||||||||||||||||||||| |||||||||||||||||||||||  ||||
      g084   REPDAGLLLNIFDLYYDLAFRAGTICRQARPHFGSSKKSVNMAYPPTCAQVX
                   190       200       210       220       230
```

The following partial DNA sequence was identified in *N. meningitidis* <SEQ ID 263>:

```
a084.seq
  1 ATGAAACAAT CCGCCCGAAT AAAAAATATG GATCAGACAT TAAAAAATAC

51 ATTGGGCATT TGCGCGCTTT TAGCCTTTTG TTTTGGCGCG GCCATCGCAT

101 CAGGTTATCA CTTGGAATAT GAATACGGCT ACCGTTATTC TGCCGTGGGT

151 GCTTTGGCTT CGGTTGTATT TTTATTATTA TTGGCACGCG GTTTCCCGCG

201 CGTTTCTTCA GTTGTTTTAC TGATTTACGT CGGCACAACC GCCCTATATT

251 TGCCGGTCGG CTGGCTGTAT GGTGCGCCGT CTTATCAGAT AGTCGGTTCG

301 ATATTGGAAA GCAATCCTGC CGAGGCGCGT GAATTTGTCG GCAATCTTCC

351 CGGGTCGCTT TATTTTGTGC AGGCATTATT TTTCATTTTT GGCTTGACAG

401 TTTGGAGATA TTGTGTATCG GGGGGGGTAT TTGCTGACGT AAAAAACTAT

451 AAACGCCGCA GCAAAATATG GCTGACTATA TTATTGACTT TGATTTTGTC

501 CTGCGCGGTG ATGGATAAAA TCGCCAGCGA TAAAGATTTG CGAGAACCTG

551 ATGCCGGCCT GTTGTTGAAT ATTTTCGACC TGTATTACGA TTTGGCTTCC

601 .GCGCCGGCA CAATATGCCG CCAAGCGCGC CCACATTTTG GAAGCAGCAA

651 AAAAAGCGTC AACATGGCAT ATCCGTCATG TTGCGCCCAA GTATAA
```

This corresponds to the amino acid sequence <SEQ ID 264; ORF 084.a>:

```
a084.pep
  1 MKQSARIKNM DQTLKNTLGI CALLAFCFGA AIASGYHLEY EYGYRYSAVG

51 ALASVVFLLL LARGFPRVSS VVLLIYVGTT ALYLPVGWLY GAPSYQIVGS

101 ILESNPAEAR EFVGNLPGSL YFVQALFFIF GLTVWRYCVS GGVFADVKNY
```

```
151 KRRSKIWLTI LLTLILSCAV MDKIASDKDL REPDAGLLLN IFDLYYDLAS

201 XAGTICRQAR PHFGSSKKSV NMAYPSCCAQ V*
``` m084/a084 92.2% identity over a 231 aa overlap

```
                   10         20         30         40         50         60
m084.pep   MKQSARIKXMNQTLLYTLGICALLTFXXXXXXXXXXYHPEYEYGYRYSAVGALASVVFLLL
           ||||||||| :||| ||||||||:|          || |||||||||||||||||||||||
a084       MKQSARIKNMDQTLKNTLGICALLAFCFGAAIASGYHLEYEYGYRYSAVGALASVVFLLL
                   10         20         30         40         50         60

70         80         90        100        110        120
m084.pep   LARGFPRVSSVVLLIYVGTTALYLPVGWLYGAPSYQIVGSILESNPAEAREFVGNLPGSL
           ||||||||||||||||||||||||||||||||||||||||||||||||||||||||||||
a084       LARGFPRVSSVVLLIYVGTTALYLPVGWLYGAPSYQIVGSILESNPAEAREFVGNLPGSL
                   70         80         90        100        110        120

130        140        150        160        170        180
m084.pep   YFVQALFFIFGLTVWKYCVSGGVFADVKNYKRRSKIWLTILLTLILSCAVMDKIASDKDL
           ||||||||||||||||:|||||||||||||||||||||||||||||||||||||||||||
a084       YFVQALFFIFGLTVWRYCVSGGVFADVKNYKRRSKIWLTILLTLILSCAVMDKIASDKDL
                  130        140        150        160        170        180

190        200        210        220        230
m084.pep   REPDAGLLLNIFDLYYDLAXRAGTICRQARPHFGSSKKSVNMAYPSCCAQVX
           |||||||||||||||||||| |||||||||||||||||||||||||||||||
a084       REPDAGLLLNIFDLYYDLASXAGTICRQARPHFGSSKKSVNMAYPSCCAQVX
                  190        200        210        220        230
```

The following partial DNA sequence was identified in *N. gonorrhoeae* <SEQ ID 265>:

```
g085.seq
  1 ATGGGCAAAG GGCAGGACTT CACGCCCCTG CGCGACGCGT TGAAAGATAA

51 GGCAAAAGGC GTGTTCCTGA TCGGCGTCGA TGCGCCGCAA ATCCGCCGCG

101 ATTTGGACGG CTGCGGCTTG AACCTGACCG ACTGCGTCAC TTTGGAAGAG

151 GCGGTTCAGA CGGCATACGC CCAAGCCGAA GCGGGCGATA TTGTCTTGCT

201 CAGCCCCGCC TGCGCGAGTT TCGATATGTT TAAAGGCTAC GCGCACCGTT

251 CGGAAGTGTT tatCGAAGCG TTTAAGGCTT GTGA
```

This corresponds to the amino acid sequence <SEQ ID 266; ORF 085.ng>:

```
g085.pep
  1 MGKGQDFTPL RDALKDKAKG VFLIGVDAPQ IRRDLDGCGL NLTDCVTLEE

51 AVQTAYAQAE AGDIVLLSPA CASFDMFKGY AHRSEVFIEA FKAL*
```

The following partial DNA sequence was identified in *N. meningitidis* <SEQ ID 267>:

```
m085.seq
  1 ATGGGTAAAG GGCAGGACTT CACGCCCCTG CGCGATGCAC TGGTAGGCAA

51 GGCAAAAGGC GTGTTCTTGA TTGGTGTCGA TGCGCCGCAA ATCCGCCGCG

101 ATTTGGACGG CTGCGGCTTG AATATGACCG ACTGCGCCAC TTTGGGAGAA

151 GCCGTTCAGA CGGCATATGC CCAAGCCGAA GCAGGCGATA TTGTGTTGCT

201 CAGCCCCGCC TGCGCGAGCT TTGATATGTT CAAAGGCTAC GCGCACCGTT

251 CGGAAGTGTT TATCGAAGCG TTTAAGGCTT GTGA
```

This corresponds to the amino acid sequence <SEQ ID 268; ORF 085>:

```
m085.pep
  1 MGKGQDFTPL RDALVGKAKG VFLIGVDAPQ IRRDLDGCGL NMTDCATLGE

51 AVQTAYAQAE AGDIVLLSPA CASFDMFKGY AHRSEVFIEA FKAL*
```

Computer analysis of this amino acid sequence gave the following results:
Homology with a Predicted ORF from *N. gonorrhoeae*
ORF 085 shows 94.7% identity over a 94 aa overlap with a predicted ORF (ORF 085.ng) from *N. gonorrhoeae*:

```
    m085/g085
                    10         20         30         40         50         60
      m085.pep  MGKGQDFTPLRDALVGKAKGVFLIGVDAPQIRRDLDGCGLNMTDCATLGEAVQTAYAQAE
                ||||||||||||| ||||||||||||||||||||||||||||:|||:|| ||||||||||
         g085  MGKGQDFTPLRDALKDKAKGVFLIGVDAPQIRRDLDGCGLNLTDCVTLEEAVQTAYAQAE
                    10         20         30         40         50         60

70         80         90
      m085.pep  AGDIVLLSPACASFDMFKGYAHRSEVFIEAFKALX
                ||||||||||||||||||||||||||||||||||
         g085  AGDIVLLSPACASFDMFKGYAHRSEVFIEAFKALX
                    70         80         90
```

The following partial DNA sequence was identified in *N. meningitidis* <SEQ ID 269>:

```
a085.seq
  1 ATGGGCAAAG GGCAGGACTT CACGCCCCTG CGCGACGCGC TTGCCGGCAA

51 GGCAAAAGGC GTGTTCCTGA TCGGTGTCGA TGCGCCGCAA ATCCGCCGCG

101 ATTTGGACGG CTGCGATCTG AATATGACCG ACTGCGCCAC TTTGGAAGAA

151 GCGGTTCAGA AGGCATATGC CCAAGCCGAA GCGGGCGATA TCGTGCTGCT

201 CAGCCCCGCC TGCGCGAGTT TCGATATGTT TAAAGGCTAC GCGCACCGTT

251 CGGAAGTGTT TATCGGGGCG TTTAAGGCTT TGTGA
```

This corresponds to the amino acid sequence <SEQ ID 270; ORF 085.a>:

```
a085.pep
  1 MGKGQDFTPL RDALAGKAKG VFLIGVDAPQ IRRDLDGCDL NMTDCATLEE

51 AVQKAYAQAE AGDIVLLSPA CASFDMFKGY AHRSEVFIGA FKAL*
``` m085/a085 94.7% identity over a 94 aa overlap

```
                    10         20         30         40         50         60
      m085.pep  MGKGQDFTPLRDALVGKAKGVFLIGVDAPQIRRDLDGCGLNMTDCATLGEAVQTAYAQAE
                |||||||||||||:||||||||||||||||||||||||| ||||||| ||||| |||||
         a085  MGKGQDFTPLRDALAGKAKGVFLIGVDAPQIRRDLDGCDLNMTDCATLEEAVQKAYAQAE
                    10         20         30         40         50         60

70         80         90
      m085.pep  AGDIVLLSPACASFDMFKGYAHRSEVFIEAFKALX
                ||||||||||||||||||||||||||||| ||||
         a085  AGDIVLLSPACASFDMFKGYAHRSEVFIGAFKALX
                    70         80         90
```

The following partial DNA sequence was identified in *N. gonorrhoeae* <SEQ ID 271>:

```
g086.seq
    1 ATGGTGGTGC TGATGACGGC GTTCGGCCTG CTGATGATTT ATTCGGCTTC

51 TGTGTATTTG GCATCGAAGG AAGGCGGCGA TCAGTTTTTC TATTTGACCA

101 GGCAGGCGGG GTTCGTCGTT GCCGGCCTTA TAGCGAGCGG TTTTTTATGG

151 TTTCTTTGCA GGATGAGGAC ATGGCGGCGG CTTGTGCCGT GGATTTTTGC

201 CTTATCCGGC CTGTTGCTGG TAGCCGTATT GATTGCCGGG CGCGAAATCA

251 ATGGCGCGAC CCGTTGGATA CCTTTGGGTC CGTTGAATTT CCAGCCGACC

301 GAGCTGTTCA AGCTGGCAGT CATCCTTTAT TTGGCAAGCC TGTTCACGCG

351 CCGTGAAGAA GTGTTGCGCA GCATGGAAAG TTTGGGTTGG CAGTCGATTT

401 GGCGGGGGAC GGCCAACCTG ATTATGTCCG CCACCAATCC GCAGGCACGT

451 CGTGAAACAT TAGAAATGTA CGgcCGTTTC CGGGCGATCA TCCTGCCGAT

501 TATGCTGGTG GCGTTCGGTT TGGTGCTGAT AATGGTACAG CCGGATTTCG

551 GTTCGTTTGT CGTCATTACC GTCATTACCG TTGGAATGCT GTTTCTGGCA

601 GGATTGCCGT GGAAATATTT TTTTGTCCTG GTAGGCAGCG TCTTGGGTGG

651 GATGGTGCTG ATGATTACCG CCGCTCCCTA CCGTGTGCAG CGGGTAGTGG

701 CATTTTTGGA CCCGTGGAAA GACCCGCAGG GTGCCGGCTA CCAGCTTACC

751 CACTCTCTGA TGGCAATCGG GCGCGGAGAG TGGTTCGGTA TGGGTTTGGG

801 TGCGAGTTTG AGCAAACGCG GCTTTCTGCC GGAAGCGCAT ACCGATTTTA

851 TTTTTGCCAT CATCGCTGAA GAATTCGGCT TCTTCGGGAT GTGCGTGCTG

901 ATATTCTGTT ACGGCTGGCT GGTGGTGCGG GCGTTTTCCA TCGGCAAGCA

951 GTCGCGCGAT TTGGGtttgA CTTTCAACGC CTATATCGCT TCGGGTATCG

1001 GCATTTGGAT CGGTATCCAA AGTTTCTTCA ATATCGGTGT GAACATCGGT

1051 GCTTTGCCGA CCAAAGGTCT GACGctgCcg tTGATGTCCT ATGGcggTTC

1101 GTCAGTCTTT TTCATGCTGA TCAGCATGAT GCTGCTGTTG CGTATCGATT

1151 ATGATTACCG CCAGAAAATG CGCGGTTACC GGGTGGAGTA AA
```

This corresponds to the amino acid sequence <SEQ ID 272; ORF 086.ng>:

```
g086.pep
  1MVVLMTAFGL LMIYSASVYL ASKEGGDQFF YLTRQAGFVV AGLIASGFLW

51FLCRMRTWRR LVPWIFALSG LLLVAVLIAG REINGATRWI PLGPLNFQPT

101ELFKLAVILY LASLFTRREE VLRSMESLGW QSIWRGTANL IMSATNPQAR

151RETLEMYGRF RAIILPIMLV AFGLVLIMVQ PDFGSFVVIT VITVGMLFLA

201GLPWKYFFVL VGSVLGGMVL MITAAPYRVQ RVVAFLDPWK DPQGAGYQLT

251HSLMAIGRGE WFGMGLGASL SKRGFLPEAH TDFIFAIIAE EFGFFGMCVL

301IFCYGWLVVR AFSIGKQSRD LGLTFNAYIA SGIGIWIGIQ SFFNIGVNIG

351ALPTKGLTLP LMSYGGSSVF FMLISMMLLL RIDYENRQKM RGYRVE*
```

The following partial DNA sequence was identified in *N. meningitidis* <SEQ ID 273>:

```
m086.seq
   1 ATGGTGGTGC TGATGACGGC GTTCAGCCTG CTGATGATTT ATTCGGCTTC
  51 TGTGTATTTG GCATCAAAAG AAGGCGGCGA TCAGTTTTTC TATTTGACCA
 101 GACAGGCGGG GTTCGTCGTT GCCGGCTTGA TAGCGAGCGG TTTGTTATGG
 151 TTTCTTTGCA GGATGAGGAC ATGGCGGCGG CTTGTGCCGT GGATTTTTGC
 201 CCTATCCGGC CTGTTGCTGG TAGTCGTATT GATTGCCGGG CGCGAAATCA
 251 ATGGCGCGAC CCGTTGGATA CCTTTGGGTC CGTTGAATTT CCAGCCGACc
 301 GAGCTGTTCA AGCtGGCGGT CATCCTTTAT TTGGCAAGCC TGTTCACGCG
 351 CCGTGAAGAA GTGTTGcGCA GCATGGAAAG TTTGGGTTGG CAGTCGATTT
 401 GGCGGGGGAC GGCCAATCTG ATCATGTCCG CCACCAATCC GCAGrCACGT
 451 CGTGAaACAT TAGAAATGTA CGGCCGTwTC CGGGCGATCA TCCTGCCGAT
 501 TATGCTGGTG GCGTTCGGTT TGGTGCTGAT AATGGTACAG CCGGATTTCG
 551 GTTCGTTTGT CGTCATTACC GTCATTGCCG TTGGAATGCT GTTTTTGGCA
 601 GGATTGCCGT GGAAATATTT TTTCGTCCTG GTAGGCAGCG TCTTGGGCGG
 651 GATGGTGCTG ATGATTACCG CCGCTCCCTA CCGTGTGCAG CGGGTAGTGG
 701 CATTTTTGGA CCCGTGGAAA GACCCGCAGG GTGCCGGCTA CCAGCTTACC
 751 CACTCTCTGA TGGCAATCGG GCGCGGAGAG TGGTTCGGTA TGGGTTTGGG
 801 TGCGAGTTTG AGCAAACGCG GCTTTCTGCC GGAAGCGCAT ACCGATTTTA
 851 TTTTTGCCAT CATCGCCGAA GAATTCGGTT TCTTCGGTAT GTGCGTGCTG
 901 ATATTCTGTT ACGGCTGGCT GGTGGTGCGG GCGTTTTCCA TCGGCAAGCA
 951 GTCGCGCGAT TTGGGTTTGA CTTTCAACGC CTATATCGCT TCGGGTATCG
1001 GCATTTGGAT CGGkrTCCAA AGTTTCTTCA ATATCGGTGT GAACATCGGT
1051 GCTTTGCCGA mCAAAgGyCT GACGCyGCCG Tg.AtGTCCw ATGGCGGTTC
1101 GTCAGTCTTT TTCATGCTGA TCAGCATGAT GCTGCTGTkG CGTATAGATT
1151 ATGAAAACCG CCGGAAAATG CGCGGTTATC GGGTGGAGTA A
```

This corresponds to the amino acid sequence <SEQ ID 274; ORF 086>:

```
m086.pep
   1 MVVLMTAFSL LMIYSASVYL ASKEGGDQFF YLTRQAGFVV AGLIASGLLW
  51 FLCRMRTWRR LVPWIFALSG LLLVVVLIAG REINGATRWI PLGPLNFQPT
 101 ELFKLAVILY LASLFTRREE VLRSMESLGW QSIWRGTANL IMSATNPQXR
 151 RETLEMYGRX RAIILPIMLV AFGLVLIMVQ PDFGSFVVIT VIAVGMLFLA
 201 GLPWKYFFVL VGSVLGGMVL MITAAPYRVQ RVVAFLDPWK DPQGAGYQLT
 251 HSLMAIGRGE WFGMGLGASL SKRGFLPEAH TDFIFAIIAE EFGFFGMCVL
 301 IFCYGWLVVR AFSIGKQSRD LGLTFNAYIA SGIGIWIGXQ SFFNIGVNIG
 351 ALPXKGLTXP XMSXGGSSVF FMLISMMLLX RIDYENRRKM RGYRVE*
```

Computer analysis of this amino acid sequence gave the following results:

Homology with a Predicted ORF from *N. gonorrhoeae*

ORF 086 shows 96.7% identity over a 396 aa overlap with a predicted ORF (ORF 086.ng) from *N. gonorrhoeae*:

```
m086/g086

10        20        30        40        50        60
    m086.pep MVVLMTAFSLLMIYSASVYLASKEGGDQFFYLTRQAGFVVAGLIASGLLWFLCRMRTWRR
             ||||||||:||||||||||||||||||||||||||||||||||||:||||||||||||
        g086 MVVLMTAFGLLMIYSASVYLASKEGGDQFFYLTRQAGFVVAGLIASGFLWFLCRMRTWRR
                    10        20        30        40        50        60

70        80        90       100       110       120
    m086.pep LVPWIFALSGLLLVVVLIAGREINGATRWIPLGPLNFQPTELFKLAVILYLASLFTRREE
             |||||||||||||:||||||||||||||||||||||||||||||||||||||||||||||
        g086 LVPWIFALSGLLLVAVLIAGREINGATRWIPLGPLNFQPTELFKLAVILYLASLFTRREE
                    70        80        90       100       110       120

130       140       150       160       170       180
    m086.pep VLRSMESLGWQSIWRGTANLIMSATNPQXRRETLEMYGRXRAIILPIMLVAFGLVLIMVQ
             |||||||||||||||||||||||||||| |||||||||| ||||||||||||||||||||
        g086 VLRSMESLGWQSIWRGTANLIMSATNPQARRETLEMYGRFRAIILPIMLVAFGLVLIMVQ
                   130       140       150       160       170       180

190       200       210       220       230       240
    m086.pep PDFGSFVVITVIAVGMLFLAGLPWKYFFVLVGSVLGGMVLMITAAPYRVQRVVAFLDPWK
             |||||||||||:||||||||||||||||||||||||||||||||||||||||||||||||
        g086 PDFGSFVVITVITVGMLFLAGLPWKYFFVLVGSVLGGMVLMITAAPYRVQRVVAFLDPWK
                   190       200       210       220       230       240

250       260       270       280       290       300
    m086.pep DPQGAGYQLTHSLMAIGRGEWFGMGLGASLSKRGFLPEAHTDFIFAIIAEEFGFFGMCVL
             ||||||||||||||||||||||||||||||||||||||||||||||||||||||||||||
        g086 DPQGAGYQLTHSLMAIGRGEWFGMGLGASLSKRGFLPEAHTDFIFAIIAEEFGFFGMCVL
                   250       260       270       280       290       300

310       320       330       340       350       360
    m086.pep IFCYGWLVVRAFSIGKQSRDLGLTFNAYIASGIGIWIGXQSFFNIGVNIGALPXKGLTXP
             |||||||||||||||||||||||||||||||||||||| |||||||||||||||:|||| |
        g086 IFCYGWLVVRAFSIGKQSRDLGLTFNAYIASGIGIWIGIQSFFNIGVNIGALPTKGLTLP
                   310       320       330       340       350       360

370       380       390
    m086.pep XMSXGGSSVFFMLISMMLLXRIDYENRRKMRGYRVEX
             || ||||||||||||||| |||||||:|||||||||
        g086 LMSYGGSSVFFMLISMMLLLRIDYENRQKMRGYRVEX
                   370       380       390
```

The following partial DNA sequence was identified in *N. meningitidis* <SEQ ID 275>:

```
a086.seq
    1 ATGGTGGTGC TGATGACGGC GTTCAGCCTG CTGATGATTT ATTCGGCTTC

51 TGTGTATTTG GCATCAAAAG AAGGCGGCGA TCAGTTTTTC TATTTGACCA

101 GACAGGCGGG GTTCGTCGTT GCCGGCTTGA TAGCGAGCGG TTTGTTATGG

151 TTTCTTTGCA GGATGAGGAC ATGGCGGCGG CTTGTGCCGT GGATTTTTGC

201 CCTATCCGGC CTGTTGCTGG TAGTCGTATT GATTGCCGGG CGCGAAATCA

251 ATGGCGCGAC CCGTTGGATA CCTTTGGGTC CGTTGAATTT CCAGCCGACC

301 GAGCTGTTCA AGCTGGCGGT CATCCTTTAT TTGGCAAGCC TGTTCACGCG

351 CCGTGAAGAA GTGTTGCGCA GCATGGAAAG TTTGGGTTGG CAGTCGATTT

401 GGCGGGGGAC GGCCAATCTG ATCATGTCCG CCACCAATCC GCAGGCACGT

451 CGTGAAACAT TAGAAATGTA CGGCCGTTTC CGGGCGATCA TCCTGCCGAT

501 TATGCTGGTG GCGTTCGGTT TGGTGCTGAT AATGGTACAG CCGGATTTCG

551 GTTCGTTTGT CGTCATTACC GTCATTGCCG TTGGAATGCT GTTTTTGGCA

601 GGATTGCCGT GGAAATATTT TTTCGTCCTG GTAGGCAGCG TCTTGGGCGG

651 GATGGTGCTG ATGATTACCG CCGCTCCCTA CCGTGTGCAG CGGGTAGTGG
```

```
 701 CATTTTTGGA CCCGTGGAAA GACCCGCAGG GTGCCGGCTA CCAGCTTACC

751 CACTCTCTGA TGGCAATCGG GCGCGGAGAG TGGTTCGGTA TGGGTTTGGG

801 TGCGAGTTTG AGCAAACGCG GCTTTCTGCC GGAAGCGCAT ACCGATTTTA

851 TTTTTGCCAT CATCGCCGAA GAATTCGGTT TCTTCGGTAT GTGCGTGCTG

901 ATATTCTGTT ACGGCTGGCT GGTGGTGCGG GCGTTTTCCA TCGGCAAGCA

951 GTCGCGCGAT TTGGGTTTGA CTTTCAACGC CTATATCGCT TCGGGTATCG

1001 GCATTTGGAT CGGTATCCAA AGTTTCTTCA ATATCGGTGT GAACATCGGT

1051 GCTTTGCCGA CCAAAGGTCT GACGCTGCCG TTGATGTCCT ATGGCGGTTC

1101 GTCAGTCTTT TTCATGCTGA TCAGCATGAT GCTGCTGTTG CGTATAGATT

1151 ATGAAAACCG CCGGAAAATG CGCGGTTACC GGGTGGAGTA A
```

This corresponds to the amino acid sequence <SEQ ID 276; ORF 086.a>:

```
a086.pep
   1 MVVLMTAFSL LMIYSASVYL ASKEGGDQFF YLTRQAGFVV AGLIASGLLW

51 FLCRMRTWRR LVPWIFALSG LLLVVVLIAG REINGATRWI PLGPLNFQPT

101 ELFKLAVILY LASLFTRREE VLRSMESLGW QSIWRGTANL IMSATNPQAR

151 RETLEMYGRF RAIILPIMLV AFGLVLIMVQ PDFGSFVVIT VIAVGMLFLA

201 GLPWKYFFVL VGSVLGGMVL MITAAPYRVQ RVVAFLDPWK DPQGAGYQLT

251 HSLMAIGRGE WFGMGLGASL SKRGFLPEAH TDFIFAIIAE EFGFFGMCVL

301 IFCYGWLVVR AFSIGKQSRD LGLTFNAYIA SGIGIWIGIQ SFFNIGVNIG

351 ALPTKGLTLP LMSYGGSSVF FMLISMMLLL RIDYENRRKM RGYRVE*
``` m086/a086 98.0% identity over a 396 aa overlap

```
                 10         20         30         40         50         60
    m086.pep  MVVLMTAFSLLMIYSASVYLASKEGGDQFFYLTRQAGFVVAGLIASGLLWFLCRMRTWRR
              ||||||||||||||||||||||||||||||||||||||||||||||||||||||||||||
        a086  MVVLMTAFSLLMIYSASVYLASKEGGDQFFYLTRQAGFVVAGLIASGLLWFLCRMRTWRR
                 10         20         30         40         50         60
                 70         80         90        100        110        120
    m086.pep  LVPWIFALSGLLLVVVLIAGREINGATRWIPLGPLNFQPTELFKLAVILYLASLFTRREE
              ||||||||||||||||||||||||||||||||||||||||||||||||||||||||||||
        a086  LVPWIFALSGLLLVVVLIAGREINGATRWIPLGPLNFQPTELFKLAVILYLASLFTRREE
                 70         80         90        100        110        120
                130        140        150        160        170        180
    m086.pep  VLRSMESLGWQSIWRGTANLIMSATNPQXRRETLEMYGRXRAIILPIMLVAFGLVLIMVQ
              |||||||||||||||||||||||||||| |||||||||| ||||||||||||||||||||
        a086  VLRSMESLGWQSIWRGTANLIMSATNPQARRETLEMYGRXRAIILPIMLVAFGLVLIMVQ
                130        140        150        160        170        180
                190        200        210        220        230        240
    m086.pep  PDFGSFVVITVIAVGMLFLAGLPWKYFFVLVGSVLGGMVLMITAAPYRVQRVVAFLDPWK
              ||||||||||||||||||||||||||||||||||||||||||||||||||||||||||||
        a086  PDFGSFVVITVIAVGMLFLAGLPWKYFFVLVGSVLGGMVLMITAAPYRVQRVVAFLDPWK
                190        200        210        220        230        240
                250        260        270        280        290        300
    m086.pep  DPQGAGYQLTHSLMAIGRGEWFGMGLGASLSKRGFLPEAHTDFIFAIIAEEFGFFGMCVL
              ||||||||||||||||||||||||||||||||||||||||||||||||||||||||||||
        a086  DPQGAGYQLTHSLMAIGRGEWFGMGLGASLSKRGFLPEAHTDFIFAIIAEEFGFFGMCVL
                250        260        270        280        290        300
                310        320        330        340        350        360
    m086.pep  IFCYGWLVVRAFSIGKQSRDLGLTFNAYIASGIGIWIGXQSFFNIGVNIGALPXKGLTXP
              |||||||||||||||||||||||||||||||||||||| |||||||||||||:|||| |
        a086  IFCYGWLVVRAFSIGKQSRDLGLTFNAYIASGIGIWIGIQSFFNIGVNIGALPTKGLTLP
                310        320        330        340        350        360
```

```
                      370        380        390
m086.pep    XMSXGGSSVFFMLISMMLLXRIDYENRRKMRGYRVEX
            ||  ||||||||||||||| |||||||||||||||||
a086        LMSYGGSSVFFMLISMMLLLRIDYENRRKMRGYRVEX
                      370        380        390
```

The following partial DNA sequence was identified in *N. gonorrhoeae* <SEQ ID 277>:

```
g087.seq
    1 ATGGGCGGTA AAACCTTTAT GCTGATGGCG GGCGGAACGG GCGGACACAT

51 TTTCCCAGCT CTGGCTGTGG CGGATTCATT GCGCGTGCGC GGTCATCATG

101 TAATTTGGCT GGGCAGCAAG GATTCGATGG AAGAGCGCAT CGTGCCGCAA

151 TACGGCATAC GCTTGGAAAC GCTGGCGATT AAAGGAATAC GCGGCAACGG

201 CATCAAACGC AAGCTGATGC TTCCGTTTAC TCTGTACAAA ACCGTCCGCG

251 AAGCGCAGCG GATTATCCGC AAACACCGTG TCGAGTGCGT CATCGGCTTC

301 GGCGGTTTTG TTACCTTTCC CGGCGGTCTG GCGGCGAAAC TCTTGGGCGT

351 GCCGATTGTG ATTCACGAGC AAAACGCCGT GGCAGGCTTG TCCAACCGCC

401 AccTGTCGCg ctGGGCGAAA CGGGTGTTGT ACGCTTTTCC GAAAGCGTTC

451 AGCCACGAAG GCGGTTTGGT CGGCAACCCC GTCCGCGCCG ATATTAGCAA

501 CCTGCCCGTG CCTGCCGAAC GCTTCCAAGG GCGCGAAGGC CGTCTGAAAA

551 TTTTGGTGGT CGGCGGCAGT TTGGGTGCGG ACGTTTTGAA CAAAACCGTA

601 CCGCAGGCGT TGGCACTGCT GCCTGAAGAG GTGCGCCCGC AGATGTACCA

651 CCAGTCGGGG CGTAACAAGC TGGGCAATCT TCAGGCGGAT TATGACGCGT

701 TGGGCGTGAA AGCGGAATGC GTGGAATTTA TTACCGACAT GGTGTCCGCC

751 TACCGTGATG CCGATTTGGT GATTTGCCGT GCCGGCGCGC TGACGATTGC

801 CGAGTTGACG GCGGCGGGGC TGGGCGCGTT GTTAGTGCCG TATCCTCACG

851 CCGTTGATGA CCATCAAACC GCCAACGCGC GTTTCATGGT GCAGGCAGAA

901 GCGGGGCTGC TGTTGCCGCA AACCCAGTTG ACGGCGGAAA AACTCGCCGA

951 AATCCTCGGC AGCCTCAACC GCGAAAAATG CCTCAAATGG GCGGAAAACG

1001 CCCGTACGTT GGCATTGCCG CACAGCGCGG ATGACGTTGC CGAAGCCGCG

1051 ATTGCGTGTG CGGCGTAAA
```

This corresponds to the amino acid sequence <SEQ ID 278; ORF 087.ng>:

```
g087.pep
    1 MGGKTFMLMA GGTGGHIFPA LAVADSLRVR GHHVIWLGSK DSMEERIVPQ

51 YGIRLETLAI KGIRGNGIKR KLMLPFTLYK TVREAQRIIR KHRVECVIGF

101 GGFVTFPGGL AAKLLGVPIV IHEQNAVAGL SNRHLSRWAK RVLYAFPKAF

151 SHEGGLVGNP VRADISNLPV PAERFQGREG RLKILVVGGS LGADVLNKTV

201 PQALALLPEE VRPQMYHQSG RNKLGNLQAD YDALGVKAEC VEFITDMVSA

251 YRDADLVICR AGALTIAELT AAGLGALLVP YPHAVDDHQT ANARFMVQAE

301 AGLLLPQTQL TAEKLAEILG SLNREKCLKW AENARTLALP HSADDVAEAA

351 IACAA*
```

The following partial DNA sequence was identified in *N. meningitidis* <SEQ ID 279>:

```
m087.seq
    1 ATGGGCGGTA AAACCTTTAT GCTGAwkkCG GCGGAACGG  GCGGACATAT

51 TTTCCCCGCG CTGGCGGTGG CGGATTCATT GCGCGCGCGC GGCCATCATG

101 TGATTTGGCT GGGCAGCAAG GATTCGATGG AAGAGCGTAT CGTGCCGCAA

151 TACGGCATAC GCTTGGAAAC GCTGGCGATT AAAGGCGTGC GCGGCAACGG

201 CATCAAACGC AAACTGATGC TGCCGGTTAC TTTGTATCAA ACCGTCCGCG

251 AAGCGCAGCG GATTATCCGC AAACACCGTG TCGAGTGCGT CATCGGCTTC

301 GGCGGCTTCG TTACCTTCCC CGGCGGTTTG GCGGCGAAGC TATTArGCGT

351 GCCGATTGTG ATTCACGAGC AAAACGCCGT GGCAGGTTTG TCCAACCGCC

401 ACCTGTCGCG CTGGGCGAAG CGGGTGTTGT ACGCTTTTCC GAAAGCGTTC

451 AGCCACGAAG GCGGCTTGGT CGGCAACCCC GTCCGCGCCG ATATTAGCAA

501 CCTGCCCGTG CCTGCCGAAC GCTTCCAAGG GCGTGAAGGC CGTCTGAAAA

551 TTTTGGTGGT CGGCGGCAGT TTGGGCGCGG ACGTTTTGAA CAAAACCGTA

601 CCGCATGCAT TGGCTTTGCT GCCCGACAAT GCGCGTCCGC ATATGTACCA

651 CCAATCGGGA CGGGGCAAGC TGGGCATCTT GCAGGCGnnn nnnnnnnnnn 701 nnnnnnnnnn nnnnnnnnnn nnnnnnnnnn nnnnnnnnnn nnnnnnnnnn 751 nnnGCGGGAT TGGGTGCGTT GTTAGTGCCG TATCCTCACG CGGTTGACGA

801 TCACCAAACC GCCAACGCGC GTTTTATGGT GCAGGCGGAG GCGGGATTGC

851 TGTTGCCGCA AACCCAGTTG ACGGCGGAAA AACTCGCCGA GATTCTCGGC

901 GGCTTAAACC GCGAAAAATG CCTCAAATGG GCAGAAAACG CCCGTACGTT

951 GGCACTGCCG CACAGTGCGG ACGACGTGGC GGAAGCCGCG ATTGCGTGTG

1001 CGGCGTAA
```

This corresponds to the amino acid sequence <SEQ ID 280; ORF 087>:

```
m087.pep
    1 MGGKTFMLXX GGTGGHIFPA LAVADSLRAR GHHVIWLGSK DSMEERIVPQ

51 YGIRLETLAI KGVRGNGIKR KLMLPVTLYQ TVREAQRIIR KHRVECVIGF

101 GGFVTFPGGL AAKLLXVPIV IHEQNAVAGL SNRHLSRWAK RVLYAFPKAF

151 SHEGGLVGNP VRADISNLPV PAERFQGREG RLKILVVGGS LGADVLNKTV

201 PHALALLPDN ARPHMYHQSG RGKLGILQAX XXXXXXXXXX XXXXXXXXXX

251 XAGLGALLVP YPHAVDDHQT ANARFMVQAE AGLLLPQTQL TAEKLAEILG

301 GLNREKCLKW AENARTLALP HSADDVAEAA IACAA*
```

Computer analysis of this amino acid sequence gave the following results:
Homology with a Predicted ORF from *N. gonorrhoeae*
ORF 087 shows 83.9% identity over a 355 aa overlap with a predicted ORF (ORF 087.ng) from *N. gonorrhoeae*:

```
m087/g087
                   10         20         30         40         50         60
      m087.pep  MGGKTFMLXXGGTGGHIFPALAVADSLRARGHHVIWLGSKDSMEERIVPQYGIRLETLAI
                ||||||||   |||||||||||||||||||:||||||||||||||||||||||||||||
         g087  MGGKTFMLMAGGTGGHIFPALAVADSLRVRGHHVIWLGSKDSMEERIVPQYGIRLETLAI
                   10         20         30         40         50         60
```

-continued

```
                 70        80        90       100       110       120
m087.pep    KGVRGNGIKRKLMLPVTLYQTVREAQRIIRKHRVECVIGFGGFVTFPGGLAAKLLXVPIV
            ||:|||||||||||| |||:|||||||||||||||||||||||||||||||||||| ||||
g087        KGIRGNGIKRKLMLPFTLYKTVREAQRIIRKHRVECVIGFGGFVTFPGGLAAKLLGVPIV
                 70        80        90       100       110       120

130       140       150       160       170       180
m087.pep    IHEQNAVAGLSNRHLSRWAKRVLYAFPKAFSHEGGLVGNPVRADISNLPVPAERFQGREG
            ||||||||||||||||||||||||||||||||||||||||||||||||||||||||||||
g087        IHEQNAVAGLSNRHLSRWAKRVLYAFPKAFSHEGGLVGNPVRADISNLPVPAERFQGREG
                130       140       150       160       170       180

190       200       210       220      229
m087.pep    RLKILVVGGSLGADVLNKTVPHALALLPDNARPHMYHQSGRGKLGILQA-----------
            ||||||||||||||||||||:||||||:::||:|||||||:||| |||
g087        RLKILVVGGSLGADVLNKTVPQALALLPEEVRPQMYHQSGRNKLGNLQADYDALGVKAEC
                190       200       210       220       230       240

230       240       250
m087.pep    -------------------------------AGLGALLVPYPHAVDDHQTANARFMVQAE
                                           |||||||||||||||||||||||||||||
g087        VEFITDMVSAYRDADLVICRAGALTIAELTAAGLGALLVPYPHAVDDHQTANARFMVQAE
                250       260       270       280       290       300

260       270       280       290       300       310
m087.pep    AGLLLPQTQLTAEKLAEILGGLNREKCLKWAENARTLALPHSADDVAEAAIACAAX
            ||||||||||||||||||:|||||||||||||||||||||||||||||||||||||
g087        AGLLLPQTQLTAEKLAEILGSLNREKCLKWAENARTLALPHSADDVAEAAIACAAX
                310       320       330       340       350
```

The following partial DNA sequence was identified in *N. meningitidis* <SEQ ID 281>:

```
a087.seq
   1 ATGGGCGGTA AAACCTTTAT GCTGATGGCG GGCGGAACGG GCGGACATAT

51 TTTCCCCGCG CTGGCGGTGG CGGATTCATT GCGCGCGCGC GGCCATCATG

101 TAATTTGGCT GGGCAGCAAG GATTCGATGG AAGAGCGCAT CGTGCCGCAA

151 TACGACATCC TGCTCGAAAC GCTGGCGATT AAAGGCGTGC GCGGCAACGG

201 CATCAAACGC AAGCTGATGC TGCCGTTTAC TTTGTATCAA ACTGTCCGCG

251 AAGCGCAGCA GATTATCCGC AAACACCGTG TCGAGTGCGT CATCGGCTTC

301 GGCGGCTTCG TTACCTTTCC CGGCGGTTTG GCGGCGAAGT TATTAGGCGT

351 GCCGATTGTG ATTCACGAGC AAAACGCCGT GGCAGGTTTG TCCAACCGCC

401 ACCTGTCGCG CTGGGCGAAG CGGGTGTTGT ACGCTTTTCC GAAAGCGTTC

451 AGCCACGAAG GCGGCTTGGT CGGCAACCCC GTCCGCGCCG ATATTAGCAA

501 CCTGCCCGTG CCTGCCGAAC GCTTCCAAGG GCGTGAAGGC CGTCTGAAAA

551 TTTTGGTGGT CGGCGGCAGT TTGGGCGCGG ACGTTTTGAA CAAAACCGTA

601 CCGCAGGCAT TGGCTTTGCT GCCCGACAAT GCGCGTCCGC AGATGTACCA

651 CCAATCGGGA CGGGGCAAGC TGGGCAGCTT GCAGGCGGAT TACGACGCGC

701 TGGGCGTGCA AGCGGAATGC GTGGAATTTA TTACCGATAT GGTGTCCGCC

751 TACCGCGATG CCGATTTGGT GATTTGCCGT GCCGGCGCGC TGACGATTGC

801 CGAGTTGACG GCGGCGGGAT TGGGTGCGTT GTTAGTGCCG TATCCTCACG

851 CCGTTGATGA CCATCAAACC GCCAACGCGC GTTTTATGGT GCAGGCGGAG

901 GCGGGATTGC TGTTGCCGCA AACCCAGTTG ACGGCGGAAA AACTCGCCGA

951 GATTCTCGGC GGCTTAAACC GCGAAAAATG CCTCAAATGG GCAGAAAACG

1001 CCCGTACGTT GGCACTGCCG CACAGTGCGG ACGACGTTGC CGAAGCCGCG

1051 ATTGCGTGTG CGGCGTAA
```

This corresponds to the amino acid sequence <SEQ ID 282; ORF 087.a>:

```
a087.pep
    1 MGGKTFMLMA GGTGGHIFPA LAVADSLRAR GHHVIWLGSK DSMEERIVPQ

51 YDILLETLAI KGVRGNGIKR KLMLPFTLYQ TVREAQQIIR KHRVECVIGF

101 GGFVTFPGGL AAKLLGVPIV IHEQNAVAGL SNRHLSRWAK RVLYAFPKAF

151 SHEGGLVGNP VRADISNLPV PAERFQGREG RLKILVVGGS LGADVLNKTV

201 PQALALLPDN ARPQMYHQSG RGKLGSLQAD YDALGVQAEC VEFITDMVSA

251 YRDADLVICR AGALTIAELT AAGLGALLVP YPHAVDDHQT ANARFMVQAE

301 AGLLLPQTQL TAEKLAEILG GLNREKCLKW AENARTLALP HSADDVAEAA

351 IACAA*
``` m087/a087 85.4% identity over a 355 aa overlap

```
                    10         20         30         40         50         60
    m087.pep MGGKTFMLXXGGTGGHIFPALAVADSLRARGHHVIWLGSKDSMEERIVPQYGIRLETLAI
             ||||||||  |||||||||||||||||||||||||||||||||||||||||| | ||||||
    a087    MGGKTFMLMAGGTGGHIFPALAVADSLRARGHHVIWLGSKDSMEERIVPQYDILLETLAI
                    10         20         30         40         50         60
                    70         80         90        100        110        120
    m087.pep KGVRGNGIKRKLMLPVTLYQTVREAQRIIRKHRVECVIGFGGFVTFPGGLAAKLLXVPIV
             ||||||||||||||||  ||||||||||  |||||||||||||||||||||||||| ||||
    a087    KGVRGNGIKRKLMLPFTLYQTVREAQQIIRKHRVECVIGFGGFVTFPGGLAAKLLGVPIV
                    70         80         90        100        110        120
                   130        140        150        160        170        180
    m087.pep IHEQNAVAGLSNRHLSRWAKRVLYAFPKAFSHEGGLVGNPVRADISNLPVPAERFQGREG
             ||||||||||||||||||||||||||||||||||||||||||||||||||||||||||||
    a087    IHEQNAVAGLSNRHLSRWAKRVLYAFPKAFSHEGGLVGNPVRADISNLPVPAERFQGREG
                   130        140        150        160        170        180
                   190        200        210        220        230        240
    m087.pep RLKILVVGGSLGADVLNKTVPHALALLPDNARPHMYHQSGRGKLGILQAXXXXXXXXXXX
             ||||||||||||||||||||| ||||||||||| |||||||||||||  |||
    a087    RLKILVVGGSLGADVLNKTVPQALALLPDNARPQMYHQSGRGKLGSLQADYDALGVQAEC
                   190        200        210        220        230        240
                                                250        260        270        280
    m087.pep XX-------------------XXXXXXXXXAGLGALLVPYPHAVDDHQTANARFMVQAE
                                 :      :  ||||||||||||||||||||||||||||
    a087    VEFITDMVSAYRDADLVICRAGALTIAELTAAGLGALLVPYPHAVDDHQTANARFMVQAE
                   250        260        270        280        290        300
                   290        300        310        320        330
    m087.pep AGLLLPQTQLTAEKLAEILGGLNREKCLKWAENARTLALPHSADDVAEAAIACAAX
             |||||||||||||||||||||||||||||||||||||||||||||||||||||||
    a087    AGLLLPQTQLTAEKLAEILGGLNREKCLKWAENARTLALPHSADDVAEAAIACAAX
                   310        320        330        340        350
```

The following partial DNA sequence was identified in *N. gonorrhoeae* <SEQ ID 283>:

```
g088.seq
    1 ATGTTTTTAT GGCTCGCACA TTTCAGCAAC TGGTTAACCG GTCTGAATAT

51 TTTTCAATAC ACCACATTCC GCGCCGTTAT GGCGGCGTTG ACCGCCTTGG

101 CGTTTTCCCT GATGTTCGGC CCGTGGACGA TACGCAGGCT GACCGCGCTC

151 AAATGCGGGC AGGCAGTGCG TACCGACGGC CCGCAAACCC ACCTCGTCAA

201 AAACGGCACG CCGACGATGG GCGGTTCGCT GATTCTGACC GCCATTACCG

251 TGTCCACCCT GTTGTGGGGC AACTGGGCGA ACCCGTATAT CTGGATTCTC

301 TTGGGCGTAC TGCTTGCCAC CGGTGCGCTC GGTTTTTACG ACGACTGGCG
```

-continued

```
 351 CAAAGTCGTT TATAAAGACC CCAACGGCGT GTCCGCCAAA TTCAAAATGG

401 TGTGGCAGTC AAGCGTTGCC GTTatcgcCG GTtttggcaTT GTTTTACctt 451 gCcgcCAATT CCGCCAACAA TATTTTGATT GTCCCGtttT TCAAACAAAT 501 CGCCCTGCCG CTGGGCGTGG TCGGCTTttt gGtgttgTCT TACCTGACCA 551 TCGTCGGCAC ATCCAACGCC GTCAACCTCA CcgaCGGCTT GGACGGCCTT 601 GCCGCcttcc cgttcgtcct cgttgccgcC GGGCTCGCCA ttttcgccTA

651 CGTCAGCGGA CACTACCAAT TTTCCCAATA CCTCCAGCTT CCCTATGTCG

701 CCGGCGCGAA CGAAGTCGCT ATATTCTGCA CCGCCATGTG CGGCGCGTGC

751 CTCGGATTTT TGTGGTTCAA CGCCTATCCC GCGCAAGTCT TTATGGGCGA

801 TGTCGGCGCG CTGGCATTGG GTGCCGCGCT CGGTaccGtt gCCGTcaTcg 851 tCCGCCAAGA ATTTGTcctc gtcattaTGG GCGGTCTGTT cgtcgtagaa 901 gccgtgTCCG TTATGCTTCa tgtcggCTGG TACAAGAAAA Ccaaaaaacg 951 CATCTTcCTg acgGcaccga ttcatcacca ttaCCaactt cgatgCTGGa 1001 aagaaacgca agtcgtcgtc CGTTtCTGGA TTAtTAccat cgtcgtggtt 1051 tTgataggtt tGagtacccT caAAattcgc ggaaactatg ccgTCCGAAC

1101 ACCTTTCAGA CGGCATTTGA ACGCGCAATA A
```

This corresponds to the amino acid sequence <SEQ ID 284; ORF 088.ng>:

```
g088.pep
   1 MFLWLAHFSN WLTGLNIFQY TTFRAVMAAL TALAFSLMFG PWTIRRLTAL

51 KCGQAVRTDG PQTHLVKNGT PTMGGSLILT AITVSTLLWG NWANPYIWIL

101 LGVLLATGAL GFYDDWRKVV YKDPNGVSAK FKMVWQSSVA VIAGLALFYL

151 AANSANNILI VPFFKQIALP LGVVGFLVLS YLTIVGTSNA VNLTDGLDGL

201 AAFPFVLVAA GLAIFAYVSG HYQFSQYLQL PYVAGANEVA IFCTAMCGAC

251 LGFLWFNAYP AQVFMGDVGA LALGAALGTV AVIVRQEFVL VIMGGLFVVE

301 AVSVMLHVGW YKKTKKRIFL TAPIHHHYQL RCWKETQVVV RFWIITIVVV

351 LIGLSTLKIR GNYAVRTPFR RHLNAQ*
```
                                                                45

The following partial DNA sequence was identified in *N. meningitidis* <SEQ ID 285>:

```
m088.seq
   1 ATGTTTTTAT GGCTCGCACA TTTCAGCAnC TGGTTAACCG GTCTGAATnn 51 nnnnnnnnnn nnnnnnnnnn nnnnnnnnnn nnnnnnnnnn nnnnnnnnnn 101 nnnnnnnnnn nnnnnnnnnn nnnnnnnnnn nnnnnnnnnn nnnnnnnnnn 151 nnnnnnnnnn nnnnnnnnnn nnnnnnnnnn nnnnnnnnnn nnnnnnnnnn 201 nnnnnnnnnn nnnnnnnnnn nnnnnnnnnn nnnnnnnnnn nnnnnnnnnn 251 nnnnnnnnnn nnnnnnnnnn nnnnnnnnnn nnnnnnnnnn nnnnnnnnnn 301 nnnnnnnnnn nnnnnnnnnn nnnnnnnnnn nnnnnnnnnn nnnnnnnnnn 351 nnnnnnnnnn nnnnnnnnnn nnnnnnnnnn nnnnnnnnnn nnnnnnnnnn 401 nnnnnnnnnn nnnnnnnnnn nnnnnnnnnn nnnnnnnnnn nnnnnnnnnn 451 nnnnnnnnnn nnnnnnnnnn nnnnnnnnnn nnnnnnnnnn nnnnnnnnnn
```

```
 501 nnnnnnnnnn nnnGGCGTGG TCGGCTTTTT GGTGTTGTCT TACCTGACCA

551 TCGTCGGCAC ATCCAATGCC GTCAACCTCA CCGACGGCTT GGACGGCCTT

601 GCGACCTTCC CCGTCGTCCT CGTTGCCGCC GGCCTCGCCA TCTTCGCCTA

651 TGCCAGCGGC CACTCACAAT TTGCCCAATA CCTGCAATTA CCTTACGTTG

701 CCGGCGCAAA CGAAGTGGTG ATTTTCTGTA CCGCCATGTG CGGCGCGTGC

751 CTCGGTTTCT TGTGGTTTAA CGCCTATCCC GCGCAAGTCT TTATGGGCGA

801 TGTCGGTGCA TTGGCATTGG GTGCCGCGCT CGGTACCGTC GCCGTTATCG

851 TCCGCCAAGA GTTTGTCCTC GTCATTATGG GCGGATTATT TGTCGTAGAA

901 GCCGTATCCG TTATGCTTCA GGTTGGCTGG TATAAGAAAA CCAAAAAACG

951 CATCTTCCTG ATGGCGCCCA TCCATCACCA CTACGAACAA AAAGGCTGGA

1001 AAGAAACCCA AGTCGTCGTC CGCTTTTGGA TTATTACCAT CGTCTTGGTG

1051 TTGATCGGTT TGAGTACCCT CAAAATCCGC TGAACCTATG CCGTCTGAAC

1101 ATCTTTCAGA CGGCATTTGA ACGCGCAATA A

1 MFLWLAHFSN WLTGLNIFQY TTFRAVMAAL TALAFSLMFG PWTIRRLTAL

51 KCGQAVRTDG PQTHLVKNGT PTMGGSLILT AITVSTLLWG NWANPYIWIL

101 LGVLLATGAL GFYDDWRKVV YKDPNGVSAK FKMVWQSSVA VIAGLALFYL

151 AANSANNILI VPFFKQIALP LGVVGFLVLS YLTIVGTSNA VNLTDGLDGL

201 AAFPFVLVAA GLAIFAYVSG HYQFSQYLQL PYVAGANEVA IFCTAMCGAC

251 LGFLWFNAYP AQVFMGDVGA LALGAALGTV AVIVRQEFVL VIMGGLFVVE

301 AVSVMLHVGW YKKTKKRIFL TAPIHHHYQL RCWKETQVVV RFWIITIVVV

351 LIGLSTLKIR GNYAVRTPFR RHLNAQ*
```

This corresponds to the amino acid sequence <SEQ ID 286; ORF 088>:

```
m088.pep
   1 MFLWLAHFSX WLTGLNXXXX XXXXXXXXXX XXXXXXXXXX XXXXXXXXXX

51 XXXXXXXXXX XXXXXXXXXX XXXXXXXXXX XXXXXXXXXX XXXXXXXXXX

101 XXXXXXXXXX XXXXXXXXXX XXXXXXXXXX XXXXXXXXXX XXXXXXXXXX

151 XXXXXXXXXX XXXXXXXXXX XGVVGFLVLS YLTIVGTSNA VNLTDGLDGL

201 ATFPVVLVAA GLAIFAYASG HSQFAQYLQL PYVAGANEVV IFCTAMCGAC

251 LGFLWFNAYP AQVFMGDVGA LALGAALGTV AVIVRQEFVL VIMGGLFVVE

301 AVSVMLQVGW YKKTKKRIFL MAPIHHHYEQ KGWKETQVVV RFWIITIVLV

351 LIGLSTLKIR XTYAVXTSFR RHLNAQ*
```

Computer analysis of this amino acid sequence gave the following results:

Homology with a Predicted ORF from *N. gonorrhoeae*

ORF 088 shows 91.7% identity over a 205 aa overlap with a predicted ORF (ORF 088.ng) from *N. gonorrhoeae*:

```
m088/g088

10         20         30
   m088.pep                   GVVGFLVLSYLTIVGTSNAVNLTDGLDGLA
                              ||||||||||||||||||||||||||||||
     g088  IAGLALFYLAANSANNILIVPFFKQIALPLGVVGFLVLSYLTIVGTSNAVNLTDGLDGLA
                 150       160       170       180       190       200
```

-continued

```
                 40         50         60         70         80         90
m088.pep  TFPVVLVAAGLAIFAYASGHSQFAQYLQLPYVAGANEVVIFCTAMCGACLGFLWFNAYPA
          :|| ||||||||||||:||| ||:|||||||||||||||:||||||||||||||||||||
g088      AFPFVLVAAGLAIFAYVSGHYQFSQYLQLPYVAGANEVAIFCTAMCGACLGFLWFNAYPA
                210        220        230        240        250        260

100        110        120        130        140        150
m088.pep  QVFMGDVGALALGAALGTVAVIVRQEFVLVIMGGLFVVEAVSVMLQVGWYKKTKKRIFLM
          ||||||||||||||||||||||||||||||||||||||||||||:|||||||||||||:
g088      QVFMGDVGALALGAALGTVAVIVRQEFVLVIMGGLFVVEAVSVMLHVGWYKKTKKRIFLT
                270        280        290        300        310        320

160        170        180        190        200
m088.pep  APIHHHYEQKGWKETQVVVRFWIITIVLVLIGLSTLKIRXTYAVXTSFRRHLNAQX
          ||||||:  : |||||||||||||||||:|||||||||| :||| | |||||||||
g088      APIHHHYQLRCWKETQVVVRFWIITIVVVLIGLSTLKIRGNYAVRTPFRRHLNAQX
                330        340        350        360        370
```

The following partial DNA sequence was identified in *N. meningitidis* <SEQ ID 287>:

```
a088.seq
    1 ATGTTTTTAT GGCTCGCACA TTTCAGCAAC TGGTTAACCG GTCTGAATAT

51 TTTTCAATAC ACCACATTCC GCGCCGTCAT GGCGGCGTTG ACCGCCTTGG

101 CGTTTTCCCT GATGTTCGGC CCGTGGACGA TACGCAGGCT GACCGCGCTC

151 AAATGCGGGC AGGCAGTGCG TACCGACGGT CCGCAAACCC ACCTCGTCAA

201 AAACGGCACG CCGACGATGG GCGGTTCGCT GATTCTGACC GCCATTACCG

251 TGTCCACCCT GTTGTGGGGC AACTGGGCAA ACCCGTATAT CTGGATTCTC

301 TTGGGCGTAT TGCTCGCCAC GGGCGCACTC GGTTTTTACG ACGACTGGCG

351 CAAAGTCGTC TATAAAGACC CCAACGGCGT GTCCGCCAAA TTCAAAATGG

401 TGTGGCAGTC AAGCGTTGCC ATTATCGCCG GTTTGGCATT GTTTTACCTT

451 GCCGCCAATT CCGCCAACAA TATTTTGATT GTCCCGTTCT TCAAACAAAT

501 CGCCCTGCCG CTGGGCGTGG TCGGCTTTTT GGTGTTGTCT TACCTGACCA

551 TCGTCGGCAC ATCCAATGCC GTCAACCTCA CCGACGGCTT GGACGGCCTT

601 GCGACCTTCC CCGTCGTCCT CGTTGCCGCC GGCCTCGCCA TCTTCGCCTA

651 TGCCAGCGGC CACTCACAAT TTGCCCAATA CCTGCAATTA CCTTACGTTG

701 CCGGCGCAAA CGAAGTGGTG ATTTTCTGTA CCGCCATGTG CGGCGCGTGC

751 CTCGGTTTCT TGTGGTTTAA CGCCTATCCC GCGCAAGTCT TTATGGGCGA

801 TGTCGGTGCA TTGGCATTGG GTGCCGCGCT CGGTACCGTC GCCGTCATCG

851 TCCGCCAAGA GTTTGTCCTC GTCATTATGG GCGGATTATT TGTCGTAGAA

901 GCCGTATCCG TTATGCTTCA GGTCGGCTGG TATAAGAAAA CCAAAAAACG

951 CATCTTCCTG ATGGCGCCCA TCCATCACCA CTACGAACAA AAAGGCTGGA

1001 AAGAAACCCA AGTCGTCGTC CGCTTTTGGA TTATTACCAT CGTCTTGGTG

1051 TTGATCGGTT TGAGTACCCT CAAAATCCGC TGAACCTATG CCGTCTGAAC

1101 ACCTTTCAGA CGGCATTTGA ACGCGCAATA A
```

This corresponds to the amino acid sequence <SEQ ID 288; ORF 088.a>:

```
a088.pep
    1 MFLWLAHFSN WLTGLNIFQY TTFRAVMAAL TALAFSLMFG PWTIRRLTAL

51 KCGQAVRTDG PQTHLVKNGT PTMGGSLILT AITVSTLLWG NWANPYIWIL
```

```
    -continued
101 LGVLLATGAL GFYDDWRKVV YKDPNGVSAK FKMVWQSSVA IIAGLALFYL

151 AANSANNILI VPFFKQIALP LGVVGFLVLS YLTIVGTSNA VNLTDGLDGL

201 ATFPVVLVAA GLAIFAYASG HSQFAQYLQL PYVAGANEVV IFCTAMCGAC

251 LGFLWFNAYP AQVFMGDVGA LALGAALGTV AVIVRQEFVL VIMGGLFVVE

301 AVSVMLQVGW YKKTKKRIFL MAPIHHHYEQ KGWKETQVVV RFWIITIVLV

351 LIGLSTLKIR *TYAV*TPFR RHLNAQ*
``` m088/a088 99.5% identity over a 205 aa overlap

```
                   150        160        170        180        190        200
   m088.pep  XXXXXXXXXXXXXXXXXXXXXXXXXXXXXXGVVGFLVLSYLTIVGTSNAVNLTDGLDGLA
                                         ||||||||||||||||||||||||||||||
        a088 IAGLALFYLAANSANNILIVPFFKQIALPLGVVGFLVLSYLTIVGTSNAVNLTDGLDGLA
                   150        160        170        180        190        200

210        220        230        240        250        260
   m088.pep  TFPVVLVAAGLAIFAYASGHSQFAQYLQLPYVAGANEVVIFCTAMCGACLGFLWFNAYPA
             ||||||||||||||||||||||||||||||||||||||||||||||||||||||||||||
        a088 TFPVVLVAAGLAIFAYASGHSQFAQYLQLPYVAGANEVVIFCTAMCGACLGFLWFNAYPA
                   210        220        230        240        250        260

270        280        290        300        310        320
   m088.pep  QVFMGDVGALALGAALGTVAVIVRQEFVLVIMGGLFVVEAVSVMLQVGWYKKTKKRIFLM
             ||||||||||||||||||||||||||||||||||||||||||||||||||||||||||||
        a088 QVFMGDVGALALGAALGTVAVIVRQEFVLVIMGGLFVVEAVSVMLQVGWYKKTKKRIFLM
                   270        280        290        300        310        320

330        340        350        360        370
   m088.pep  APIHHHYEQKGWKETQVVVRFWIITIVLVLIGLSTLKIRXTYAVXTSFRRHLNAQX
             |||||||||||||||||||||||||||||||||||||||||||||| ||||||||
        a088 APIHHHYEQKGWKETQVVVRFWIITIVLVLIGLSTLKIRXTYAVXTPFRRHLNAQX
                   330        340        350        360        370
```

The following partial DNA sequence was identified in *N. gonorrhoeae* <SEQ ID 289>:

```
g089.seq
    1 ATGCCGCCCA AAATCACGAA GAGCGGGTTT TGCAAACCGG CAATCGCGGC

51 GGCGGTCGCG CCGACATTCG TGCCTTTGCT GTCGTCGATG AATACCACGC

101 CGTTTTTCTC GCCGATTTTT TCCACACGGT GCGGCAAGCC TTGGAAGGTT

151 TTGACGTGTT CCAGCAATGC TTCGCGCGGC AAACCGACGG CCTCGCACAA

201 AGCCACGGCA GCCATAACGT TGGCGGCGTT GTGCAAACCT GCAGCGGGA

251 TGTCTTGCGT AGAAATCAAA TCTTCATTGC CTTGTTTTAA ACAGCCCGTC

301 CCGCGTTCCA ACCAAAAATC GGCTTCGTGT TCCAAGGAAA ACCGTTTCAC

351 TTCACGCCCT GCCCGTTTCA TGGCGCGGCA GAACACGTCG TCCGCATTCA

401 AAACCTGCAC TCCATCGCCA CGGAAAATCT CGGCTTTGGT ATGCGCGTAG
```

This corresponds to the amino acid sequence <SEQ ID 290; ORF 089.ng>:

```
g089.pep
    1 MPPKITKSGF CKPAIAAAVA PTFVPLLSSM NTTPFFSPIF STRCGKPWKV

51 LTCSSNASRG KPTASHKATA AITLAALCKP CSGMSCVEIK SSLPCFKQPV

101 PRSNQKSASC SKENRFTSRP ARFMARQNTS SAFKTCTPSP RKISALVCA*
```

The following partial DNA sequence was identified in *N. meningitidis* <SEQ ID 291>:

```
m089.seq
    1 ATGCCGCCCA AAATCACkAw GAGCGGATTT TGCAAACCGG CAATCGCGGC

51 GGCAGTCGCG CCGACATTCG TGCCTTTGCT GTCGTCGATA ACACCACGC

101 CGTTTTCTC GCCGATTTTT TCCACGCGGT GCGGCAGGCC TTGGAAGGTT

151 TTGACGTGTT CGAGCAATGC TTCGCGCGAC AAACCGATGG CCTCACACAA

201 AGCCACkGCA GCCATGACGT TAGCGGCGTT GTGCAkACCT TGCAACGGwA

251 TGTCTTGCGT GACAATCAAA TCTTCATTGC CTTGTTTCAG GCGGCCTGTC

301 TCGCGTTCCA ACCAGAAATC AGCTTCGTGT TCCAACGAAA ACCATTTTAC

351 CTCGCGCCCG GCACGCTTCA TCGCGCGGCA GAACGCATCG TCCGCATTCA

401 AAACCTGCAC GCCGTCGCCA CGGAAAATCT TGGCTTTGGT ATGCGCATAG
```

This corresponds to the amino acid sequence <SEQ ID 292; ORF 089>:

```
m089.pep
    1 MPPKITXSGF CKPAIAAAVA PTFVPLLSSI NTTPFFSPIF STRCGRPWKV

51 LTCSSNASRD KPMASHKATA AMTLAALCXP CNGMSCVTIK SSLPCFRRPV

101 SRSNQKSASC SNENHFTSRP ARFIARQNAS SAFKTCTPSP RKILALVCA*
```

Computer analysis of this amino acid sequence gave the following results:
Homology with a Predicted ORF from *N. gonorrhoeae*
ORF 089 shows 88.6% identity over a 149 aa overlap with a predicted ORF (ORF 089.ng) from *N. gonorrhoeae*:

```
m089/g089
                    10         20         30         40         50         60
       m089.pep  MPPKITXSGFCKPAIAAAVAPTFVPLLSSINTTPFFSPIFSTRCGRPWKVLTCSSNASRD
                 ||||||  |||||||||||||||||||||||:||||||||||||||||:||||||||||||
       g089      MPPKITKSGFCKPAIAAAVAPTFVPLLSSMNTTPFFSPIFSTRCGKPWKVLTCSSNASRG
                    10         20         30         40         50         60

70         80         90        100        110        120
       m089.pep  KPMASHKATAAMTLAALCXPCNGMSCVTIKSSLPCFRRPVSRSNQKSASCSNENHFTSRP
                 || |||||||||:||||||||:|||||||||||||||::|| ||||||||||||:||:|||||
       g089      KPTASHKATAAITLAALCKPCSGMSCVEIKSSLPCFKQPVPRSNQKSASCSKENRFTSRP
                    70         80         90        100        110        120

130        140        150
       m089.pep  ARFIARQNASSAFKTCTPSPRKILALVCAX
                 |||:||||:|||||||||||||||| |||||||
       g089      ARFMARQNTSSAFKTCTPSPRKISALVCAX
                   130        140        150
```

The following partial DNA sequence was identified in *N. meningitidis* <SEQ ID 293>:

```
a089.seq
    1 ATGCCGCCTA AAATCACGAA GAGCGGATTT TGCAAACCGG CAATCGCGGC

51 GGCGGTCGCA CCGACGTTCG TGCCTTTGCT GTCGTCGATG AACACCACGC

101 CATTTTCTC GCCGATTTTT TCCACGCGGT GCGGCAGGCC TTGAAAGGTT

151 TTGACGTGTT CGAGCAATGC TTCGCGCGGC AAACCGACGG CTTCGCACAA

201 GGCAACGGCA GCCATCACGT TAGTGGCGTT GTGCAAGCCT TGCAGCGGAA

251 TATCTTGCGT GGCAATCAAA TCTTCATTGC CTTGTTTCAG GCGACCTGTC
```

-continued

```
301 TCACGTTCCA ACCAAAAATC GGCTTCGTAT TCCAACGAAA ACCATTTCAC

351 CTCGCGCCCG GCGCGCTTCA TCGCACGACA GAACGCATCG TCCGCATTCA

401 AAACCTGCAC ACCGTCGCCA CGGAAAATCT TGGCTTTGGT ATGCGCGTAG
```

This corresponds to the amino acid sequence <SEQ ID 294; ORF 089.a>:

```
a089.pep
   1 MPPKITKSGF CKPAIAAAVA PTFVPLLSSM NTTPFFSPIF STRCGRP*KV

51 LTCSSNASRG KPTASHKATA AITLVALCKP CSGISCVAIK SSLPCFRRPV

101 SRSNQKSASY SNENHFTSRP ARFIARQNAS SAFKTCTPSP RKILALVCA*
``` m089/a089 91.9% identity over a 149 aa overlap

```
                  10         20         30         40         50         60
m089.pep  MPPKITXSGFCKPAIAAAVAPTFVPLLSSINTTPFFSPIFSTRCGRPWKVLTCSSNASRD
          ||||||  ||||||||||||||||||||||:||||||||||||||||| |||||||||||
a089      MPPKITKSGFCKPAIAAAVAPTFVPLLSSMNTTPFFSPIFSTRCGRPXKVLTCSSNASRG
                  10         20         30         40         50         60

70         80         90        100        110        120
m089.pep  KPMASHKATAAMTLAALCXPCNGMSCVTIKSSLPCFRRPVSRSNQKSASCSNENHFTSRP
          || |||||||:||:|||  ||:|:|||:|||||||||||||||||||||| |||||||||
a089      KPTASHKATAAITLVALCKPCSGISCVAIKSSLPCFRRPVSRSNQKSASYSNENHFTSRP
                  70         80         90        100        110        120

130        140        150
m089.pep  ARFIARQNASSAFKTCTPSPRKILALVCAX
          |||||||||||||||||||||||||||||
a089      ARFIARQNASSAFKTCTPSPRKILALVCAX
                 130        140        150
```

The following partial DNA sequence was identified in *N. gonorrhoeae* <SEQ ID 295>:

```
g090.seq
   1 ATGCGCGTAG TCGAGCAAAT CGTCGTAGCG GTCGAGATGG TCTTCGGAAA

51 TGTTCATCAC CGTCGCCGCA GTCGGGCGCA GGCTTTCGGT GTTTTCCAGT

101 TGGAAGCTGG AAAGCTCcca CACCCACACG TCCGCCTTTT TGCCTTCgcg 151 ctgCAATtct gcctccaaga cgggcgtacc gatATTGCCC GCAATGAcgg 201 tatccagccc gcacttgatg CAGAGatagc ggaccaggct ggttaccgTG 251 GTTtttgccg tgctgCcggt aatcgCaatc accttgtcgC CGCGGCGGtt 301 cAcaaTGTCc gccaGCAATt ggATGTCGCC TAgCACGCGC .ccgccgTTT 351 TGCttga
```

This corresponds to the amino acid sequence <SEQ ID 296; ORF 090.ng>:

```
g090.pep
   1 MRVVEQIVVA VEMVFGNVHH RRRSRAQAFG VFQLEAGKLP HPHVRLFAFA

51 LQFCLQDGRT DIARNDGIQP ALDAEIADQA GYRGFAVAAG NRNHLVAAAV

101 HNVRQQLDVA XHAXRRFA*
```

The following partial DNA sequence was identified in *N. meningitidis* <SEQ ID 297>:

```
m090.seq.
    1 ATGCGCATAG TCGAGCAAGT CGTCGTAGCG GTCGAGATGG TCTTCGGAAA

51 TGTTCAGCAC CGTCGCCGCA GTCGGACGCA GGCTTTCGGT GTTTTCCAGT

101 TGGAAGCTGG AAAGCTCCAA CACCCACACG TCCGCCTTTT TGCCTTCGCG

151 CTGCCATTCC GCCTCCAAAA CCGGCGTGCC GATATTGCCC GCGATAACGG

201 TATCCAGCCC GCACTTGATA CAGAGATAGC CGACCAGGCT CGTTACCGTG

251 GTTTTGCCGT TGCTGCCGGT AATCGCAATT ACCTTGTCGT CCCGGCGGTT

301 CACAATGTCC GCCAGCAATT CGATGTCGCC CAACACGCGT .CCGCCGTTT

351 TGCTTGA
```

This corresponds to the amino acid sequence <SEQ ID 298; ORF 090>:

```
m090.pep
    1 MRIVEQVVVA VEMVFGNVQH RRRSRTQAFG VFQLEAGKLQ HPHVRLFAFA

51 LPFRLQNRRA DIARDNGIQP ALDTEIADQA RYRGFAVAAG NRNYLVVPAV

101 HNVRQQFDVA QHAXRRFA*
```

Computer analysis of this amino acid sequence gave the following results:

Homology with a Predicted ORF from *N. gonorrhoeae*

ORF 090 shows 83.9% identity over a 118 aa overlap with a predicted ORF (ORF 090.ng) from *N. gonorrhoeae*:

```
m090/g090

10        20        30        40        50        60
m090.pep    MRIVEQVVVAVEMVFGNVQHRRRSRTQAFGVFQLEAGKLQHPHVRLFAFALPFRLQNRRA
            ||:|||:|||||||||||:||||||:||||||||||||| ||||||||||| | ||: |:
g090        MRVVEQIVVAVEMVFGNVHHRRRSRAQAFGVFQLEAGKLPHPHVRLFAFALQFCLQDGRT
                      10        20        30        40        50        60

70        80        90       100       110       119
m090.pep    DIARDNGIQPALDTEIADQARYRGFAVAAGNRNYLVVPAVHNVRQQFDVAQHAXRRFAX
            ||||::|||||||:|||||| ||||||||||||:||: ||||||||:||| ||||||||
g090        DIARNDGIQPALDAEIADQAGYRGFAVAAGNRNHLVAAAVHNVRQQLDVAXHAXRRFAX
                      70        80        90       100       110
```

The following partial DNA sequence was identified in *N. meningitidis* <SEQ ID 299>:

```
a090.seq
    1 ATGCGCGTAG TCGAGCAAGT CGTCGTAGCG GTCGAGATGG TCTTCGGAAA

51 TGTTCAGCAC TGTCGCCGCA GTCGGGCGCA GGCTTTCGGT GTTTTCCAGT

101 TGGAAACTGG AAAGCTCCAA CACCCACACG TCCGCCTTTT TGCCTTCGCG

151 CTGCAATTCC GCCTCCAAAA CCGGCGCGCC GATATTGCCC GCGATAACGG

201 TATCCAGCCC ACACTTGATG CAGAGATAGC CGACCAGGCT CGTTACCGTG

251 GTTTTGCCGT TGCTGCCGGT AATCGCAATC ACCTTGTCGC CGCGGCGGTT

301 CACAATGTCC GCCAGCAATT CGATGTCGCC CAACACGCGT C.CGCCGTTT

351 CGCTTAA
```

This corresponds to the amino acid sequence <SEQ ID 300; ORF 090.a>:

```
a090.pep
    1 MRVVEQVVVA VEMVFGNVQH CRRSRAQAFG VFQLETGKLQ HPHVRLFAFA

51 LQFRLQNRRA DIARDNGIQP TLDAEIADQA RYRGFAVAAG NRNHLVAAAV

101 HNVRQQFDVA QHAXRRFA*
``` m09/a090 91.5% identity over a 117 aa overlap

```
                   10         20         30         40         50         60
    m090.pep   MRIVEQVVVAVEMVFGNVQHRRRSRTQAFGVFQLEAGKLQHPHVRLFAFALPFRLQNRRA
               ||:|||||||||||||||| ||||:|||||||||:|||||||||||||||| ||||||||
    a090       MRVVEQVVVAVEMVFGNVQHCRRSRAQAFGVFQLETGKLQHPHVRLFAFALQFRLQNRRA
                   10         20         30         40         50         60

70         80         90        100        110        119
    m090.pep   DIARDNGIQPALDTEIADQARYRGFAVAAGNRNYLVVPAVHNVRQQFDVAQHAXRRFAX
               |||||||||:||:||||||||||||||||||||||:||: |||||||||||||||||||
    a090       DIARDNGIQPTLDAEIADQARYRGFAVAAGNRNHLVAAVHNVRQQFDVAQHAXRRFAX
                   70         80         90        100        110
```

The following partial DNA sequence was identified in *N. gonorrhoeae* g090-1.seq This sequence contains multiple stop codons (not shown)

This corresponds to the amino acid sequence <ORF 090-1.ng>:
g090-1.pep (not shown)

The following partial DNA sequence was identified in *N. meningitidis* <SEQ ID 2>:

```
m090-1.seq
    1 ATGACGGCGT TTGCATTTCA GACGGCATCA CAAAGCCTTA AACGCTTCGA

51 TAAACACTTC CGAACGGTGC GCGTAGCCTT TGAACATATC AAAGCTCGCG

101 CAGGCGGGGC TGAGCAACAC AATATCGCCT GCTTCGGCTT GGGCATATGC

151 CGTCTGAACG GCTTCTCCCA AGTGGCGCA GTCGGTCATA TTCAAGCCGC

201 AGCCGTCCAA ATCGCGGCGG ATTTGCGGCG CATCGACACC AATCAAGAAC

251 ACGCCTTTTG CCTTGCCTAC CAGTGCATCG CGCAGGGGCG TGAAGTCCTG

301 CCCTTTACCC ATGCCGCCCA AAATCACGAA GAGCGGATTT TGCAAACCGG

351 CAATCGCGGC GGCAGTCGCG CCGACATTCG TGCCTTTGCT GTCGTCGATA

401 AACACCACGC CGTTTTTCTC GCCGATTTTT TCCACGCGGT GCGGCAGGCC

451 TTGGAAGGTT TTGACGTGTT CGAGCAATGC TTCGCGCGAC AAACCGATGG

501 CCTCACACAA AGCCACGGCA GCCATGACGT TAGCGGCGTT GTGCAGACCT

551 TGCAACGGAA TGTCTTGCGT GACAATCAAA TCTTCATTGC CTTGTTTCAG

601 GCGGCCTGTC TCGCGTTCCA ACCAGAAATC AGCTTCGTGT TCCAACGAAA

651 ACCATTTTAC CTCGCGCCCG GCACGCTTCA TCGCGCGGCA GAACGCATCG

701 TCCGCATTCA AAACCTGCAC GCCGTCGCCA CGGAAAATCT TGGCTTTGGT

751 ATGCGCATAG TCGAGCAAGT CGTCGTAGCG GTCGAGATGG TCTTCGGAAA

801 TGTTCAGCAC CGTCGCCGCA GTCGGACGCA GGCTTTCGGT GTTTTCCAGT

851 TGGAAGCTGG AAAGCTCCAA CACCCACACG TCCGCCTTTT TGCCTTCGCG

901 CTGCCATTCC GCCTCCAAAA CCGGCGTGCC GATATTGCCC GCGATAACGG

951 TATCCAGCCC GCACTTGATA CAGAGATAGC CGACCAGGCT CGTTACCGTG
```

-continued

```
1001 GTTTTGCCGT TGCTGCCGGT AATCGCAATT ACCTTGTCGT CCCGGCGGTT

1051 CACAATGTCC GCCAGCAATT CGATGTCGCC CAACACGCGT CCGCCGTTTT

1101 GCTTGAACGC CTCAATATCC GGCTGCCGCT CGCTGATGCC GGGACTGAGA

1151 GCCAGAATAT CGAAACCGTT GTCCAGCGCA TCTTTCAGAC GGCCCGTGTA

1201 AAACACCAAC CCGTCAAACA TCTTACCGAT TTGCGACACG CGTTCCGGCT

1251 TCAGCTCCGC ATCATACGCA GCAACCTCCG CGCCGTTTTT GCGCAGGTAG

1301 GCAATCATGG AAATACCCGT ACCGCCGAGT CCGGCGACGA GGATTTTTTT

1351 GTTTTGAAAA GTCATTTTGG TTTGTCCTAA
```

15

This corresponds to the amino acid sequence <SEQ ID 3; ORF 090-1>:

```
m090-1.pep
   1 MTAFAFQTAS QSLKRFDKHF RTVRVAFEHI KARAGGAEQH NIACFGLGIC

51 RLNGFSQSGA VGHIQAAAVQ IAADLRRIDT NQEHAFCLAY QCIAQGREVL

101 PFTHAAQNHE ERILQTGNRG GSRADIRAFA VVDKHHAVFL ADFFHAVRQA

151 LEGFDVFEQC FARQTDGLTQ SHGSHDVSGV VQTLQRNVLR DNQIFIALFQ

201 AACLAFQPEI SFVFQRKPFY LAPGTLHRAA ERIVRIQNLH AVATENLGFG

251 MRIVEQVVVA VEMVFGNVQH RRRSRTQAFG VFQLEAGKLQ HPHVRLFAFA

301 LPFRLQNRRA DIARDNGIQP ALDTEIADQA RYRGFAVAAG NRNYLVVPAV

351 HNVRQQFDVA QHASAVLLER LNIRLPLADA GTESQNIETV VQRIFQTARV

401 KHQPVKHLTD LRHAFRLQLR IIRSNLRAVF AQVGNHGNTR TAESGDEDFF

451 VLKSHFGLS*
```

The following partial DNA sequence was identified in *N. gonorrhoeae* <SEQ ID 303>:

```
g091.seq
   1 ATGGAAATAC CCGTGCCGCC AAGTCCGGCG ACGAGGATTT TTTTGTTTGA

51 AAGTCATTTT GGTTTTGTCC TAAAACAAAT CATATTGGGC AGGAGACGTC

101 CGCCCTTGCC CAAGCCGCTT TCAGACGGCA TCGCGAGCCG ATTAATAACC

151 CGCCTTCAGG CGTTGGTCAT TGTCGCAGCT GTTTTGGTCT CCGTTTTGAC

201 AAGCCTTGCC AAGCCATTGT TGAGCGAGCG CAAGGTCTTG GCGCACGCCG

251 CGTCCATCGT AATACATCAA GCCCAAATTG TATTGGGCTT GGGCATCCCC

301 TTGTTCTGA
```

This corresponds to the amino acid sequence <SEQ ID 304; ORF 091.ng>:

```
g091.pep
   1 MEIPVPPSPA TRIFLFESHF GFVLKQIILG RRRPPLPKPL SDGIASRLIT

51 RLQALVIVAA VLVSVLTSLA KPLLSERKVL AHAASIVIHQ AQIVLGLGIP

101 LF*
```

The following partial DNA sequence was identified in *N. meningitidis* <SEQ ID 305>:

```
m091.seq
    1 ATGGAAATAC CCGTACCGCC GAGTCCGGCG ACGAGGATTT TTTTGTTTGA

51 AAAGTCATT TTGGTTTGTCC TAAAACAAAT CATATTGAGC AGGAGATGTC

101 CGCCCCTGC CCAAGCCGCTT TCAGACGGCA TCGCGAGCTG TTCAATAACC

151 CGCCTTCAG GCGTTGGTCAT TGTCGCAGCC GTCTTGGTCT CCGTTTTGAC

201 AAGCCTTGC CAAACCATTCT TGTGCAAGGG CGCGGTCTTG GCGCACGCCG

251 CGTCTTTCG GCATACATCAC GCCCAAATTG TTTTGGGCTT GGGCTACCCC

301 CTGCGC...
```

This corresponds to the amino acid sequence <SEQ ID 306; ORF 091>:

```
m091.pep
    1 MEIPVPPSPA TRIFLFEKSF WFVLKQIILS RRCPPLPKPL SDGIASCSIT

51 RLQALVIVAA VLVSVLTSLA KPFLCKGAVL AHAASFGIHH ACIVLGLGYP

101 LR.
```

Computer analysis of this amino acid sequence gave the following results:
Homology with a Predicted ORF from *N. gonorrhoeae*
ORF 091 shows 84.2% identity over a 101 aa overlap with a predicted ORF (ORF 091.ng) from *N. gonorrhoeae*:

```
m091/g091
                 10         20         30         40         50         60
    m091.pep    MEIPVPPSPATRIFLFEKSFWFVLKQIILSRRCPPLPKPLSDGIASCSITRLQALVIVAA
                ||||||||||||||||:| ||||||||:|| |||||||||||| ||||||||||||
    g091        MEIPVPPSPATRIFLFESHFGFVLKQIILGRRRPPLPKPLSDGIASRLITRLQALVIVAA
                 10         20         30         40         50         60

70         80         90        100
    m091.pep    VLVSVLTSLAKPFLCKGAVLAHAASFGIHHAQIVLGLGYPLR
                |||||||||||:| :  ||||||: ||:||||||| ||
    g091        VLVSVLTSLAKPLLSERKVLAHAASIVIHQAQIVLGLGIPLFX
                 70         80         90        100
```

The following partial DNA sequence was identified in *N. meningitidis* <SEQ ID 307>:

```
a091.seq
    1 ATGGAAATAC CCGTGCCGCC AAGTCCGGCG ACGAGGATTT TTTTGTTTTG

51 GAAATCATTT TGGTTTGTCC TAAAACAAAT CATATTGAGC AGGGGATGTC

101 TGATCCTGCT CAAGCCGCTT TCAGACGGCA TCGCGAGCTG TTCAATAACC

151 CGCTTTCAGG CGTTGGTCAT TGTCGCAGCT GTCTTGGTAT CCGTTTTGAC

201 AAGCCTTGCC AAGCCATTCT TGTGCAAGGG CGCGGTCTTG GCGCACGCCG

251 CGTCTTTCGG CATACATCAC GCCCAAATTG TTTTGGGC
```

This corresponds to the amino acid sequence <SEQ ID 308; ORF 091.a>:

```
a091.pep.
    1 MEIPVPPSPA TRIFLFWKSF WFVLKQIILS RGCLILLKPL SDGIASCSIT

51 RFQALVIVAA VLVSVLTSLA KPFLCKGAVL AHAASFGIHH AQIVLG
``` m091/a091 93.8% identity over a 96 aa overlap

```
               10        20        30        40        50        60
m091.pep   MEIPVPPSPATRIFLFEKSFWFVLKQIILSRRCPPLPKPLSDGIASCSITRLQALVIVAA
           ||||||||||||||||| |||||||||||| |  | ||||||||||||:||||||||
a091       MEIPVPPSPATRIFLFWKSFWFVLKQIILSRGCLILLKPLSDGIASCSITRFQALVIVAA
               10        20        30        40        50        60

70        80        90       100
m091.pep   VLVSVLTSLAKPFLCKGAVLAHAASFGIHHAQIVLGLGYPLR
           |||||||||||||||||||||||||||||||||||||
a091       VLVSVLTSLAKPFLCKGAVLAHAASFGIHHAQIVLG
               70        80        90
```

The following partial DNA sequence was identified in *N. gonorrhoeae* <SEQ ID 309>:

```
g092.seq
    1 ATGTTTTTTA TTTCAATCCG CTATATATTT GTCAGAAAAC TATGGTGCGC
   51 AAACGGTCAG ACCTTTAAAA TAACGCCTTT ACGCACTAAA AACCAACCGG
  101 AACGCAACAT TATGATGAAA ATCGAGTAA GCAACATCCA TTTTGTCGGT
  151 ATCGGCGGCG TCGGCATGAG CGGTATCGCC GAAGTCTTGC ACAATTTGGG
  201 CTTTAAAGTT TCCGGTTCGG ATCAGGCGCG AAATGCCGCT ACCGAGCATT
  251 TGAGCAGCCT GGGCATTCAA GTTTATCCCG GCCATACCGC AGAACACGTT
  301 AACGGTgcgg ATGTCGTCGT TGCCTCTACC GCCGTCAAGA AGAAaatcC
  351 CGAAGTtgtc gcTGCGTTGG AGCGGCAAAT TCCCGTTATT CCGCGCGCCT
  401 TGATGCTGGC AGAGCTGATG CGCTTCCGTG ACGgcatcgc cattgccggT
  451 ACGCACGGCA AAACCACGAC CACCAGCCTG ACCGCCTCCA TCCTCGGCGC
  501 GGCAGGACTC GACCCCACTT TCGTTATCGG CGGCAAACTC AACGCCGCAG
  551 GCACCAACGC CCGCTTGGGC AAAGGCGAAT ACATCGTTGC CGAAGCCGAC
  601 GAATCCGATG CCTCTTTCCT ACATCTGACC CCGATTATGT CCGTCGTTAC
  651 CAATATCGAC GAAGACCATA TGGATACCTA CGGCACAGC GTCGAAAAAC
  701 TGCATCAGGC GTTTATCGAT TCATCCACC GTATGCCCTT CTACGGCAAA
  751 GCCTTTTTGT GTGTTGACAG CGAACACGTC CGCGCGATTT TGCCCAAAGT
  801 GAGCAAACCT TATGCTACTT ACGGTTTGGA CGATACCGCC GACATCTACG
  851 CCACCGACAT CGAAAACGTC GGCGCGCAAA TGAAATTCAC CGTCCATGTT
  901 CAAATGAAAG ACATGAGCA GGGGTCGTTT GAAGTCGTGC TGAATATGCC
  951 CGGCAGACAC AACGTGCTGA ACGCATTGGC AGCCATCGGc gtggcGCTgg
 1001 aagtcGgCGC ATcggttgAA GCGAtcCAAA AaggCTTGCT CGGCTTTGAA
 1051 GGCGTCGGCC GCCGCTTCCA AAAATAcggc gacatCAagt tgccaaacgg
 1101 cggGaccgCT TTgctGGTGG ACGATTAcgg ACACCACCCC GTCGAAATGG
 1151 CGGcaaccct tgccgcTGCA CGCGGCGCGT ATCCGGAAAA acgtTTGGTG
 1201 CtcgCCTTCC AGCCGCACCG CTATACCCGC ACGCGCGATT TGTTTGAAGA
 1251 CTTTACCAAA GTACTCAATA CCGTTGatgC GCTGGTACTG ACCGAAGTTT
 1301 AtgccgccgG CGAAGAGCCG GTTGCCGCCG CCGactcCCG CGCCTTGGCG
 1351 CGTGCTATCC GCGTATTGGG CAAACTTGAG CCGATTTACT GCGAAAatgt
 1401 cgccgACCTG CCGCAAATGC TGATGAATGT TTTACAGGAT Ggcgatgttg
 1451 tgttgAATAT GggTgcggga agcatcaacc gcgttccttc cgcgctgttg
 1501 gaattgtcga AACAGAtttg A
```

This corresponds to the amino acid sequence <SEQ ID 310; ORF 092.ng>:

```
g092.pep
     1 MFFISIRYIF VRKLWCANGQ TFKITPLRTK NQPERNIMMK NRVSNIHFVG

51 IGGVGMSGIA EVLHNLGFKV SGSDQARNAA TEHLSSLGIQ VYPGHTAEHV

101 NGADVVVAST AVKKENPEVV AALERQIPVI PRALMLAELM RFRDGIAIAG

151 THGKTTTTSL TASILGAAGL DPTFVIGGKL NAAGTNARLG KGEYIVAEAD

201 ESDASFLHLT PIMSVVTNID EDHMDTYGHS VEKLHQAFID FIHRMPFYGK

251 AFLCVDSEHV RAILPKVSKP YATYGLDDTA DIYATDIENV GAQMKFTVHV

301 QMKGHEQGSF EVVLNMPGRH NVLNALAAIG VALEVGASVE AIQKGLLGFE

351 GVGRRFQKYG DIKLPNGGTA LLVDDYGHHP VEMAATLAAA RGAYPEKRLV

401 LAFQPHRYTR TRDLFEDFTK VLNTVDALVL TEVYAAGEEP VAAADSRALA

451 RAIRVLGKLE PIYCENVADL PQMLMNVLQD GDVVLNMGAG SINRVPSALL

501 ELSKOI*
```

The following partial DNA sequence was identified in N. meningitidis <SEQ ID 311>:

```
m092.seq
     1 ATGTTTTTTA TTTCAATCCG CTATATATTT GTCAGAAAAC TATGGCGCGC

51 AAACGGTCAG CCCTTTAAAA TAACGCCTTT ACGCATCGAA AATCCACCGG

101 AACGCAACAT TATGATGAAA AATCGAGTTA CCAACATCCA TTTTGTCGGT

151 ATCGGCGGCG TCGGCATGAG CGGCATCGCC GAAGTCTTGC ACAATTTGGG

201 CTTTAAAGTT TCCGGTTCGG ATCAgGCGCG AAATGCCGCT ACCGAGCATT

251 TGGGCAGCCT GGGCATTCAA GTTTATCCCG GCCATACCGC CGAACACGTT

301 AACGGTGCGG ATGTCGTCGT TACCTCTACC GCCGTCAAAA AGAAAATCC

351 CGAAGTTGTC GCTGCGTTGG AGCAGCAAAT TCCCGTTATT CCGCGCGCCC

401 TGATGTTGGC GGAGTTGATG CGCTTCCGTG ACGGCATCGC CATTGCCGGC

451 ACGCACGGCA AAACCACGAC CACCAGCCTG ACCGCCTCCA TCCTCGGCGC

501 GGCAGGACTT GACCCGACTT TCGTTATCGG CGGCAAACTC AACGCCGCAG

551 GCACTAACGC CCGCTTGGGC AAAGGCGAAT ACATCGTTGC CGAAGCCGAC

601 GAGTCGGATG CATCCTTTCT GCACCTGACA CCGATTATGT CCGTCGTTAC

651 CAATATCGAC GAAGACCATA TGGATACCTA CGGGCACAGC GTCGAAAAAC

701 TGCATCAGGC GTTTATCGAT TTCATCCACC GTATGCCCTT CTACGGCAAA

751 GCCTTTTTGT GTATTGACAG CGAACACGTC CGCGCGATTT TGCCCAAAGT

801 GAGCAAACCT TATGCTACTT ACGGTTTGGA CGATACCGCC GACATCTACG

851 CCACCGACAT CGAAAACGTC GGCGCGCAAA TGAAATTCAC CGTCCATGTT

901 CAAATGAAAG GACATGAGCA GGGGTCGTTT GAAGTCGTGC TGAATATGCC

951 CGGCAGACAC AACGTGCTGA ACGCATTGGC AGCCATCGGC GTGGCGCTGG

1001 AAGTCGGCGC ATCGGTTGAA GCGATCCAAA AAGGCTTGCT CGGCTTTGAA

1051 GGCGTCGGCC GCCGCTTCCA AAAATACGGC GACATCAAGT TGCCAAACGG

1101 CGGGACCGCG CTCTTGGTGG ACGACTACGG ACACCACCCC GTCGAAATGG

1151 CGGCGACCCT TGCCGCCGCA CGCGGCGCGT ATCTGGAAAA ACGTTTGGTA
```

```
-continued
1201 CTCGCCTTCC AGCCGCACCG CTATACCCGC ACGCGCGATT TGTTTGAAGA

1251 CTTTACCAAA GTCCTCAATA CCGTTGACGC GCTGGTGCTG ACCGAAGTTT

1301 ATGCCGCCGG TGAAGAGCCG ATTGCCGCCG CCGATTCCCG CGCTCTTGCC

1351 CGCGCCATCC GCGTGTTGGG CAAACTCGAG CCGATTTACT GCGAAAACGT

1401 TGCCGATCTG CCCGAAATGC TGTTGAACGT TTTGCAGGAC GGCGACATCG

1451 TGTTGAATAT GGGCGCGGGA AGCATCAACC GCGTCCCCGC CGCGCTGCTG

1501 GCATTGTCGA AACAGATTTG A
```

This corresponds to the amino acid sequence <SEQ ID 312; ORF 092>:

```
m092.pep
    1 MFFISIRYIF VRKLWRANGQ PFKITPLRIE NPPERNIMMK NRVTNIHFVG

51 IGGVGMSGIA EVLHNLGFKV SGSDQARNAA TEHLGSLGIQ VYPGHTAEHV

101 NGADVVVTST AVKKENPEVV AALEQQIPVI PRALMLAELM RFRDGIAIAG

151 THGKTTTTSL TASILGAAGL DPTFVIGGKL NAAGTNARLG KGEYIVAEAD

201 ESDASFLHLT PIMSVVTNID EDHMDTYGHS VEKLHQAFID FIHRMPFYGK

251 AFLCIDSEHV RAILPKVSKP YATYGLDDTA DIYATDIENV GAQMKFTVHV

301 QMKGHEQGSF EVVLNMPGRH NVLNALAAIG VALEVGASVE AIQKGLLGFE

351 GVGRRFQKYG DIKLPNGGTA LLVDDYGHHP VEMAATLAAA RGAYLEKRLV

401 LAFQPHRYTR TRDLFEDFTK VLNTVDALVL TEVYAAGEEP IAAADSRALA

451 RAIRVLGKLE PIYCENVADL PEMLLNVLQD GDIVLNMGAG SINRVPAALL

501 ALSKQI*
```

Computer analysis of this amino acid sequence gave the following results:
Homology with a Predicted ORF from *N. gonorrhoeae*
ORF 092 shows 96.6% identity over a 506 aa overlap with a predicted ORF (ORF 092.ng) from *N. gonorrhoeae*:

```
m092/g092
                    10         20         30         40         50         60
    m092.pep  MFFISIRYIFVRKLWRANGQPFKITPLRIENPPERNIMMKNRVTNIHFVGIGGVGMSGIA
              |||||||||||||| |||| ||||||| :| ||||||||||:||||||||||||||||||
    g092      MFFISIRYIFVRKLWCANGQTFKITPLRTKNQPERNIMMKNRVSNIHFVGIGGVGMSGIA
                    10         20         30         40         50         60

70         80         90        100        110        120
    m092.pep  EVLHNLGFKVSGSDQARNAATEHLGSLGIQVYPGHTAEHVNGADVVVTSTAVKKENPEVV
              |||||||||||||||||||||||||:|||||||||||||||||||||||:||||||||||
    g092      EVLHNLGFKVSGSDQARNAATEHLSSLGIQVYPGHTAEHVNGADVVVASTAVKKENPEVV
                    70         80         90        100        110        120

130        140        150        160        170        180
    m092.pep  AALEQQIPVIPRALMLAELMRFRDGIAIAGTHGKTTTTSLTASILGAAGLDPTFVIGGKL
              ||||:|||||||||||||||||||||||||||||||||||||||||||||||||||||||
    g092      AALERQIPVIPRALMLAELMRFRDGIAIAGTHGKTTTTSLTASILGAAGLDPTFVIGGKL
                   130        140        150        160        170        180

190        200        210        220        230        240
    m092.pep  NAAGTNARLGKGEYIVAEADESDASFLHLTPIMSVVTNIDEDHMDTYGHSVEKLHQAFID
              ||||||||||||||||||||||||||||||||||||||||||||||||||||||||||||
    g092      NAAGTNARLGKGEYIVAEADESDASFLHLTPIMSVVTNIDEDHMDTYGHSVEKLHQAFID
                   190        200        210        220        230        240

250        260        270        280        290        300
    m092.pep  FIHRMPFYGKAFLCIDSEHVRAILPKVSKPYATYGLDDTADIYATDIENVGAQMKFTVHV
              ||||||||||||||:|||||||||||||||||||||||||||||||||||||||||||||
    g092      FIHRMPFYGKAFLCVDSEHVRAILPKVSKPYATYGLDDTADIYATDIENVGAQMKFTVHV
                   250        260        270        280        290        300
```

-continued

```
                310       320       330       340       350       360
m092.pep   QMKGHEQGSFEVVLNMPGRHNVLNALAAIGVALEVGASVEAIQKGLLGFEGVGRRFQKYG
           ||||||||||||||||||||||||||||||||||||||||||||||||||||||||||||
g092       QMKGHEQGSFEVVLNMPGRHNVLNALAAIGVALEVGASVEAIQKGLLGFEGVGRRFQKYG
                310       320       330       340       350       360

370       380       390       400       410       420
m092.pep   DIKLPNGGTALLVDDYGHHPVEMAATLAAARGAYLEKRLVLAFQPHRYTRTRDLFEDFTK
           |||||||||||||||||||||||||||||||||| |||||||||||||||||||||||||
g092       DIKLPNGGTALLVDDYGHHPVEMAATLAAARGAYPEKRLVLAFQPHRYTRTRDLFEDFTK
                370       380       390       400       410       420

430       440       450       460       470       480
m092.pep   VLNTVDALVLTEVYAAGEEPIAAADSRALARAIRVLGKLEPIYCENVADLPEMLLNVLQD
           ||||||||||||||||||||:||||||||||||||||||||||||||||||||:||:|||||
g092       VLNTVDALVLTEVYAAGEEPVAAADSRALARAIRVLGKLEPIYCENVADLPQMLMNVLQD
                430       440       450       460       470       480

490       500
m092.pep   GDIVLNMGAGSINRVPAALLALSKQIX
           ||:|||||||||||||:||| ||||||
g092       GDVVLNMGAGSINRVPSALLELSKQIX
                490       500
```

The following partial DNA sequence was identified in *N. meningitidis* <SEQ ID 313>:

```
a092.seq
   1 ATGTTTTTTA TTTCAATCCG CTATATATTT GTCAGAAAAC TATGGCGCGC

51 AAACGGTCAG CCCTTTAAAA TAACGCCTTT ACGCATCGAA AATCCACCGG

101 AACGCAACAT TATGATGAAA AATCGAGTGA CCAACATCCA TTTTGTCGGT

151 ATCGGCGGCG TCGGCATGAG CGGTATCGCC GAAGTCTTGC ACAATTTGGG

201 TTTTAAAGTT TCCGGTTCGG ATCAGGCGCG AAATGCCGCT ACCGAGCATT

251 TGGGCAGCCT GGGCATTCAA GTTTATCCCG GCCATACCGC AGAACACGTT

301 AACGGTGCGG ATGTCGTCGT TACCTCTACC GCCGTCAAAA AAGAAAATCC

351 CGAAGTTGTC GCTGCGTTGG AGCAGCAAAT TCCCGTTATT CCGCGCGCCC

401 TGATGTTGGC GGAGTTGATG CGCTTCCGTG ACGGCATCGC CATTGCCGGC

451 ACGCACGGCA AAACCACGAC CACCAGCCTG ACCGCCTCCA TCCTCGGCGC

501 GGCAGGACTT GACCCGACTT TCGTTATCGG CGGCAAACTC AACGCCGCAG

551 GCACCAACGC CCGCTTGGGC AAAGGCGAAT ACATCGTTGC CGAAGCCGAC

601 GAGTCGGATG CATCCTTTCT GCACCTGACA CCGATTATGT CCGTCGTTAC

651 CAATATCGAC GAAGACCATA TGGATACCTA CGGGCACAGT GTTGAGAAGC

701 TGCATCAGGC GTTTATCGAT TTCATCCACC GTATGCCCTT CTACGGCAAA

751 GCCTTTTTGT GTATTGACAG CGAACACGTC CGCGCGATTT TGCCCAAAGT

801 GAGCAAACCT TATGCTACTT ACGGTTTGGA CGATACCGCC GACATCTACG

851 CCACCGACAT CGAAAACGTC GGCGCGCAAA TGAAATTCAC CGTCCATGTT

901 CAAATGAAAG GACATGAGCA GGGGTCGTTT GAAGTCGTGC TGAATATGCC

951 CGGCAGACAC AACGTGCTGA ACGCATTGGC AGCCATCGGC GTGGCGCTGG

1001 AAGTCGGCGC ATCGGTTGAA GCGATCCAAA AAGGCTTGCT CGGCTTTGAA

1051 GGTGTCGGCC GCCGCTTCCA AAAATACGGC GACATCAAGT TGCCAAACGG

1101 TGGAACCGCG CTCTTGGTGG ACGACTACGG ACACCACCCC GTCGAAATGG

1151 CGGCGACCCT TTCCGCCGCA CGCGGCGCGT ATCCGGAAAA ACGTTTGGTA

1201 CTCGCCTTCC AGCCGCACCG CTATACCCGC ACGCGCGATT TGTTTGAAGA

1251 CTTTACCAAA GTCCTCAATA CCGTTGACGC GCTGGTGCTG ACCGAAGTTT
```

```
1301 ATGCCGCCGG TGAAGAGCCG ATTGCCGCCG CTGATTCCCG CGCTCTTGCC

1351 CGCGCCATCC GCGTGTTGGG CAAACTCGAG CCGATTTACT GCGAAAACGT

1401 TGCCGATCTG CCCGAAATGC TGTTGAACGT TTTGCAGGAC GGCGACATCG

1451 TGTTGAATAT GGGTGCGGGA AGCATCAACC GCGTCCCCGC CGCGCTGCTG

1501 GAATTGTCGA AACAGATTTG A
```

This corresponds to the amino acid sequence <SEQ ID 10 314; ORF 092.a>:

```
a092.pep
    1 MFFISIRYIF VRKLWRANGQ PFKITPLRIE NPPERNIMMK NRVTNIHFVG

51 IGGVGMSGIA EVLHNLGFKV SGSDQARNAA TEHLGSLGIQ VYPGHTAEHV

101 NGADVVVTST AVKKENPEVV AALEQQIPVI PRALMLAELM RFRDGIAIAG

151 THGKTTTTSL TASILGAAGL DPTFVIGGKL NAAGTNARLG KGEYIVAEAD

201 ESDASFLHLT PIMSVVTNID EDHMDTYGHS VEKLHQAFID FIHRMPFYGK

251 AFLCIDSEHV RAILPKVSKP YATYGLDDTA DIYATDIENV GAQMKFTVHV

301 QMKGHEQGSF EVVLNMPGRH NVLNALAAIG VALEVGASVE AIQKGLLGFE

351 GVGRRFQKYG DIKLPNGGTA LLVDDYGHHP VEMAATLSAA RGAYPEKRLV

401 LAFQPHRYTR TRDLFEDFTK VLNTVDALVL TEVYAAGEEP IAAADSRALA

451 RAIRVLGKLE PIYCENVADL PEMLLNVLQD GDIVLNMGAG SINRVPAALL

501 ELSKQI*
``` m092/a092 99.4% identity over a 506 aa overlap

```
                       10         20         30         40         50         60
       m092.pep  MFFISIRYIFVRKLWRANGQPFKITPLRIENPPERNIMMKNRVTNIHFVGIGGVGMSGIA
                 ||||||||||||||||||||||||||||||||||||||||||||||||||||||||||||
       a092      MFFISIRYIFVRKLWRANGQPFKITPLRIENPPERNIMMKNRVTNIHFVGIGGVGMSGIA
                       10         20         30         40         50         60

70         80         90        100        110        120
       m092.pep  EVLHNLGFKVSGSDQARNAATEHLGSLGIQVYPGHTAEHVNGADVVVTSTAVKKENPEVV
                 ||||||||||||||||||||||||||||||||||||||||||||||||||||||||||||
       a092      EVLHNLGFKVSGSDQARNAATEHLGSLGIQVYPGHTAEHVNGADVVVTSTAVKKENPEVV
                       70         80         90        100        110        120

130        140        150        160        170        180
       m092.pep  AALEQQIPVIPRALMLAELMRFRDGIAIAGTHGKTTTTSLTASILGAAGLDPTFVIGGKL
                 ||||||||||||||||||||||||||||||||||||||||||||||||||||||||||||
       a092      AALEQQIPVIPRALMLAELMRFRDGIAIAGTHGKTTTTSLTASILGAAGLDPTFVIGGKL
                      130        140        150        160        170        180

190        200        210        220        230        240
       m092.pep  NAAGTNARLGFGEYIVAEADESDASFLHLTPIMSVVTNIDEDHMDTYGHSVEKLHQAFID
                 ||||||||||| ||||||||||||||||||||||||||||||||||||||||||||||||
       a092      NAAGTNARLGKGEYIVAEADESDASFLHLTPIMSVVTNIDEDHMDTYGHSVEKLHQAFID
                      190        200        210        220        230        240

250        260        270        280        290        300
       m092.pep  FIHRMPFYGKAFLCIDSEHVRAILPKVSKPYATYGLDDTADIYATDIENVGAQMKFTVHV
                 ||||||||||||||||||||||||||||||||||||||||||||||||||||||||||||
       a092      FIHRMPFYGKAFLCIDSEHVRAILPKVSKPYATYGLDDTADIYATDIENVGAQMKFTVHV
                      250        260        270        280        290        300

310        320        330        340        350        360
       m092.pep  QMKGHEQGSFEVVLNMPGRHNVLNALAAIGVALEVGASVEAIQKGLLGFEGVGRRFQKYG
                 ||||||||||||||||||||||||||||||||||||||||||||||||||||||||||||
       a092      QMKGHEQGSFEVVLNMPGRHNVLNALAAIGVALEVGASVEAIQKGLLGFEGVGRRFQKYG
                      310        320        330        340        350        360
```

```
                  370        380        390        400        410        420
m092.pep    DIKLPNGGTALLVDDYGHHPVEMAATLAAARGAYLEKRLVLAFQPHRYTRTRDLFEDFTK
            ||||||||||||||||||||||||||||:||||||||||||||||||||||||||||||
a092        DIKLPNGGTALLVDDYGHHPVEMAATLSAARGAYPEKRLVLAFQPHRYTRTRDLFEDFTK
                  370        380        390        400        410        420

430        440        450        460        470        480
m092.pep    VLNTVDALVLTEVYAAGEEPIAAADSRALARAIRVLGKLEPIYCENVADLPEMLLNVLQD
            ||||||||||||||||||||||||||||||||||||||||||||||||||||||||||||
a092        VLNTVDALVLTEVYAAGEEPIAAADSRALARAIRVLGKLEPIYCENVADLPEMLLNVLQD
                  430        440        450        460        470        480

490        500
m092.pep    GDIVLNMGAGSINRVPAALLALSKQIX
            |||||||||||||||||||| ||||||
a092        GDIVLNMGAGSINRVPAALLELSKQIX
                  490        500
```

The following partial DNA sequence was identified in *N. gonorrhoeae* <SEQ ID 315>:

```
g093.seq
   1 aTGCAGAATt ttgGCAAAGT ggccgtATTG ATGGGtggtT TTTCCAGCGA

51 ACGAGAaatc tcgcTGGACA GCgGTACCGC CATTTTGAAC GCCTTAAAAA

101 GCAAAGGCAT AGACGCATAC GCCTTCGACC CTAAGGAAAC GCCGTTATCC

151 GAACTGAAGG AGCGGGGCTT TCAGACGGCA TTCAACATCC TTCACGGTAC

201 TTACGGCGAA GACGGGGCTG TTCAGGGTGC ATTGGAACTG TTGGGCATTC

251 CCTATACCGG CAGCGGTGTC GCCGCCTCCG CCATCGGCAT GGACAAATAC

301 CGCTGCAAAC TGATTTGGCA GGCATTGGGA TTACCCGTTC CCGAGTTCGC

351 CGTACTGTAC GATGATACCG ATTTCGATGC CGTCGAAGAA AAATTGGGTC

401 TGCCGATGTT TGTGAAGCCG GCGGCCGAAG GCAGCAGCgt cggcgtggta 451 aAAGTCAAAG AAAaaggccg TCTGAAAAGC GTTtacgaag aatTGAaaCA 501 CCTTcagggg cgaAAtcatt gccgAacgTT TTATCGGCGG CGGCGAATAT

551 TCCTGCCCCG TCCTGAACGG CAAAGGGCTG CCCGGCATAC ACATCATCCC

601 CGCAACCGAG TTTTACGAct acgaagccaa GtacaaCCGA GACGAcacca 651 tttaTCAATG TCCTTCGGAA GATTTGACCG AAGCCGAAGA AAGCCTGATG

701 CGCGAACTGG CGGTTCGCGG CGCACAGGCA ATCGGTGCGG AAGGCTGCGT

751 GCGCGTCGAT TTCCTCAAAG ATACCGACGG CAAACTCTAT CTGTTGGAAA

801 TCAACACCCT GCCCGGTATG ACCGGCCATA G
```

This corresponds to the amino acid sequence <SEQ ID 316; ORF 093.ng>:

```
g093.pep
   1 MQNFGKVAVL MGGFSSEREI SLDSGTAILN ALKSKGIDAY AFDPKETPLS

51 ELKERGFQTA FNILHGTYGE DGAVQGALEL LGIPYTGSGV AASAIGMDKY

101 RCKLIWQALG LPVPEFAVLY DDTDFDAVEE KLGLPMFVKP AAEGSSVGVV

151 KVKEKGRLKS VYEELKHLQG RNHCRTFYRR RRIFLPRPER QRAARHTHHP

201 RNRVLRLRSQ VQPRRHHLSM SFGRFDRSRR KPDARTGGSR RTGNRCGRLR

251 ARRFPQRYRR QTLSVGNQHP ARYDRP*
```

The following partial DNA sequence was identified in *N. meningitidis* <SEQ ID 317>:

```
m093.seq
    1 ATGCAGAATT TTGGCAAAGT GGCCGTATTG ATGGGCGGTT TTTCCAGCGA

51 ACGAGAAATC TCGCTGGACA GCGGCACCGC CATTTTGAAT GCTTTAAAAA

101 GCAAAGGCAT AGACGCATAC GCCTTCGATC CTAAAGAAAC CCCATTGTCT

151 GAATTGAAGG CACAAGGTTT TCAGACGGCA TTCAACATCC TTCACGGTAC

201 TTACGGCrAA GACGGGCGG TTCAGGGTGC ATTGGAACTG TTGGGCATTC

251 CCTATACCGG CAGCGGTGTC GCCGCATCCG CCATCGGCAT GGACAAATAC

301 CGCTGCAAAC TGATTTGGCA GGCATTGGGA TTGCCCGTTC CCGAGTTCGC

351 CGTCCTGCAC GACGACACTG ATTTCGATGC CGTCGAAGAA AAATTGGGCC

401 TGCCGATGTT TGTGAAACCG GCGGCCGAAG GCAGCAGCGT AGGCGTGGTA

451 AAAGTCAAAG GAAAAGGCCG TCTGAAAAGC GTTTACGAAG AATTGAAACA

501 CCTTCAGGG. CGAAATCATT GCCGAACGTT TTATCGGCGG CGGCGAATAT

551 TCCTGCCCCG TCCTGAACGG CAAAGGGCTG CCCGGCATAC ACATCATTCC

601 CGCAACCGAG TTTTACGACT ACGAAGCCAA GTACAACCGC GACGACACCA

651 TTTATCAATG TCCTTCGGAA GATTTGACCG AAGCCGAAGA AAGCCTGATG

701 CGCGAACTGG CGGTTCGCGG CGCGCAGGCA ATCGGTGCGG AAGGCTGCGT

751 GCGCGTCGAT TTCCTCAAAG ATACCGACGG CAAACTCTAT CTGTTGGAAA

801 TCAACACCCT GCCCGGTATG ACGAGCCATA G
```

This corresponds to the amino acid sequence <SEQ ID 318; ORF 093>:

```
m093.pep
    1 MQNFGKVAVL MGGFSSEREI SLDSGTAILN ALKSKGIDAY AFDPKETPLS

51 ELKAQGFQTA FNILHGTYGX DGAVQGALEL LGIPYTGSGV AASAIGMDKY

101 RCKLIWQALG LPVPEFAVLH DDTDFDAVEE KLGLPMFVKP AAEGSSVGVV

151 KVKGKGRLKS VYEELKHLQX RNHCRTFYRR RRIFLPRPER QRAARHTHHS

201 RNRVLRLRSQ VQPRRHHLSM SFGRFDRSRR KPDARTGGSR RAGNRCGRLR

251 ARRFPQRYRR QTLSVGNQHP ARYDEP*
```

Computer analysis of this amino acid sequence gave the following results:
Homology with a Predicted ORF from *N. gonorrhoeae*
ORF 093 shows 96.7% identity over a 276 aa overlap with a predicted ORF (ORF 093.ng) from *N. gonorrhoeae*:

```
m093/g093
                   10         20         30         40         50         60
       m093.pep    MQNFGKVAVLMGGFSSEREISLDSGTAILNALKSKGIDAYAFDPKETPLSELKAQGFQTA
                   ||||||||||||||||||||||||||||||||||||||||||||||||||| :|||||
           g093    MQNFGKVAVLMGGFSSEREISLDSGTAILNALKSKGIDAYAFDPKETPLSELKERGFQTA
                   10         20         30         40         50         60

70         80         90        100        110        120
       m093.pep    FNILHGTYGXDGAVQGALELLGIPYTGSGVAASAIGMDKYRCKLIWQALGLPVPEFAVLH
                   ||||||||| ||||||||||||||||||||||||||||||||||||||||||||||||:
           g093    FNILHGTYGEDGAVQGALELLGIPYTGSGVAASAIGMDKYRCKLIWQALGLPVPEFAVLY
                   70         80         90        100        110        120
```

```
                  130        140        170        160        180
m093.pep   DDTDFDAVEEKLGLPMFVKPAAEGSSVGVVKVKGKGRLKSVYEELKHLQXRNHCRTFYRR
           ||||||||||||||||||||||||||||||||||| |||||||||||| ||||||||||
g093       DDTDFDAVEEKLGLPMFVKPAAEGSSVGVVKVKEKGRLKSVYEELKHLQGRNHCRTFYRR
                  130        140        150        160        170        180

190        200        210        220        230        240
m093.pep   RRIFLPRPERQRAARHTHHSRNRVLRLRSQVQPRRHHLSMSFGRFDRSRRKPDARTGGSR
           ||||||||||||||||||||| ||||||||||||||||||||||||||||||||||||
g093       RRIFLPRPERQRAARHTHHPRNRVLRLRSQVQPRRHHLSMSFGRFDRSRRKPDARTGGSR
                  190        200        210        220        230        240

250        260        270
m093.pep   RAGNRCGRLRARRFPQRYRRQTLSVGNQHPARYDEPX
           |:|||||||||||||||||||||||||||||||:||
g093       RTGNRCGRLRARRFPQRYRRQTLSVGNQHPARYDRPX
                  250        260        270
```

The following partial DNA sequence was identified in *N. meningitidis* <SEQ ID 319>:

```
a093.seq
    1 ATGCAGAATT TTGGCAAAGT GGCCGTATTG ATGGGCGGTT TTTCCAGCGA

51 ACGAGAAATC TCGCTGGACA GCGGCACCGC CATTTTGAAT GCTTTAAAAA

101 GCAAAGGCAT AGACGCATAC GCCTTCGATC CCAAGGAAAC CCCATTGTCT

151 GAATTGAAGG CACAAGGTTT TCAGACGGCA TTCAACATCC TTCACGGTAC

201 TTACGGCGAA GACGGGGCTG TTCAGGGTGC ATTGGAACTG TTGGGCATTC

251 CCTATACCGG CAGCGGTGTC GCCGCATCCG CCATCGGCAT GGACAAATAC

301 CGCTGCAAAC TGATTTGGCA GGCATTGGGA TTGCCCGTTC CCGAGTTCGC

351 CGTCCTGCAC GACGACACTG ATTTCGATGC CGTCGAAGAA AAATTGGGCC

401 TGCCGATGTT TGTGAAACCG GCGGCCGAAG GCAGCAGCGT AGGCGTGGTA

451 AAAGTCAAAG GAAAAGGCCG TCTGAAAAGC GTTTACGAAG AATTGAAACA

501 CTTTCAGGG. CGAAATCATT GCCGAACGGT TTATCGGCGG CGGCGAATAT

551 TCCTGCCCTG TGTTGAACGG CAAAGGCCTG CCCGGCATAC ACATCATCCC

601 CGCGACCGAG TTTTATGACT ACGAAGCCAA GTACAACCGC AACGACACCA

651 TTTATCAATG TCCTTCGGAA GATCTGACCG AAGCCGAAGA AAGCCTGATG

701 CGCGAACTGG CGGTTCGCGG CGCGCAGGCA ATCGGTGCGG AAGGCTGCGT

751 GCGCGTCGAT TTCCTCAAAG ATACCGACGG CAAACTCTAT CTGTTGGAAA

801 TCAACACCCT GCCCGGTATG ACCGGCCATA G
```

This corresponds to the amino acid sequence <SEQ ID 320; ORF 093.a>:

```
a093.pep
    1 MQNFGKVAVL MGGFSSEREI SLDSGTAILN ALKSKGIDAY AFDPKETPLS

51 ELKAQGFQTA FNILHGTYGE DGAVQGALEL LGIPYTGSGV AASAIGMDKY

101 RCKLIWQALG LPVPEFAVLH DDTDFDAVEE KLGLPMFVKP AAEGSSVGVV

151 KVKGKGRLKS VYEELKHFQX RNHCRTVYRR RRIFLPCVER QRPARHTHHP

201 RDRVL*LRSQ VQPQRHHLSM SFGRSDRSRR KPDARTGGSR RAGNRCGRLR

251 ARRFPQRYRR QTLSVGNQHP ARYDRP*
``` m093/a093 95.7% identity over a 276 aa overlap

```
                   10         20         30         40         50         60
m093.pep   MQNFGKVAVLMGGFSSEREISLDSGTAILNALKSKGIDAYAFDPKETPLSELKAQGFQTA
           ||||||||||||||||||||||||||||||||||||||||||||||||||||||||||||
a093       MQNFGKVAVLMGGFSSEREISLDSGTAILNALKSKGIDAYAFDPKETPLSELKAQGFQTA
                   10         20         30         40         50         60

70         80         90        100        110        120
m093.pep   FNILHGTYGXDGAVQGALELLGIPYTGSGVAASAIGMDKYRCKLIWQALGLPVPEFAVLH
           |||||||||  |||||||||||||||||||||||||||||||||||||||||||||||||
a093       FNILHGTYGEDGAVQGALELLGIPYTGSGVAASAIGMDKYRCKLIWQALGLPVPEFAVLH
                   70         80         90        100        110        120

130        140        150        160        170        180
m093.pep   DDTDFDAVEEKLGLPMFVKPAAEGSSVGVVKVKGKGRLKSVYEELKHLQXRNHCRTFYRR
           |||||||||||||||||||||||||||||||||||||||||||||||:|||||||| |||
a093       DDTDFDAVEEKLGLPMFVKPAAEGSSVGVVKVKGKGRLKSVYEELKHFQXRNHCRTVYRR
                  130        140        150        160        170        180

190        200        210        220        230        240
m093.pep   RRIFLPRPERQRAARHTHHSRNRVLRLRSQVQPRRHHLSMSFGRFDRSRRKPDARTGGSR
           ||||||  ||||  ||||||| :|||  ||||||||:||||||||| |||||||||||||
a093       RRIFLPCVERQRPARHTHHPRDRVLXLRSQVQPQRHHLSMSFGRSDRSRRKPDARTGGSR
                  190        200        210        220        230        240

250        260        270
m093.pep   RAGNRCGRLRARRFPQRYRRQTLSVGNQHPARYDEPX
           |||||||||||||||||||||||||||||||||||:||
a093       RAGNRCGRLRARRFPQRYRRQTLSVGNQHPARYDRPX
                  250        260        270
```

The following partial DNA sequence was identified in *N. gonorrhoeae* <SEQ ID 321>:

```
g094.seq
    1   ATGTATTCGC CTTTGCCCAA GCGGGCGTTG GTGCCTGCGG CGTTGAGTTT
   51   GCCGCCGATA ACGAAAGTGG GGTCGAGTCC TGCCGCGCCG AGGATGGAGG
  101   CGGTCAGGCT GGTGGTCGTG GTTTTGCCGT GCGTAccggc aatggcgatg
  151   cCGTCACGGA AGCGCATCAG CTCTGCCAGC ATCAAGGCGC GCGGAATAAC
  201   GGGAATTTGC CGCTCCAACG CAgcgacaAC TTCGGgattT TCTTTCTTGA
  251   CGGCGGTAGA GGCAACGACG ACATCcgcAC CGTTAACGTG TTCTGCGGTA
  301   TGGCCGGGAT AA
```

This corresponds to the amino acid sequence <SEQ ID 322; ORF 094.ng>:

```
g094.pep
    1   MYSPLPKRAL VPAALSLPPI TKVGSSPAAP RMEAVRLVVV VLPCVPAMAM
   51   PSRKRISSAS IKARGITGIC RSNAATTSGF SFLTAVEATT TSAPLTCSAV
  101   WPG*
```

The following partial DNA sequence was identified in *N. meningitidis* <SEQ ID 323>:

```
m094.seq
    1   ATGTATTCGC CTTTGCCCAA GCGGGCGTTA GTGCCTGCGG CGTTGAGTTT
   51   GCCGCCGATA ACGAAAGTCG GGTCAAGTCC TGCCGCGCCG AGGATGGAGG
  101   CGGTCAGGCT GGTGGTCGTG GTTTTGCCGT GCGTGCCGGC AATGGCGATG
  151   CCGTCACGGA AGCGCATCAA CTCCGCCAAC ATCAGGGCGC GCGGAATAAC
  201   GGGAATTTGC TGCTCCAACG CAGCGACAAC TTCGGGATTT TCTTTTTTGA
```

```
251  CGGCGGTAGA GGTAACGACG ACATCCGCAC CGTTAACGTG TTCGGCGGTA

301  TGGCCGGGAT AA
```

This corresponds to the amino acid sequence <SEQ ID 324; ORF 094>:

```
m094.pep
  1  MYSPLPKRAL VPAALSLPPI TKVGSSPAAP RMEAVRLVVV VLPCVPAMAM

51  PSRKRINSAN IRARGITGIC CSNAATTSGF SFLTAVEVTT TSAPLTCSAV

101  WPG*
```

Computer analysis of this amino acid sequence gave the following results:
Homology with a Predicted ORF from *N. gonorrhoeae*
ORF 094 shows 95.1% identity over a 103 aa overlap with a predicted ORF (ORF 094.ng) from *N. gonorrhoeae*:

```
m094/g094
                   10         20         30         40         50         60
   m094.pep   MYSPLPKRALVPAALSLPPITKVGSSPAAPRMEAVRLVVVVLPCVPAMAMPSRKRINSAN
              |||||||||||||||||||||||||||||||||||||||||||||||||||||||:||:
   g094       MYSPLPKRALVPAALSLPPITKVGSSPAAPRMEAVRLVVVVLPCVPAMAMPSRKRISSAS
                   10         20         30         40         50         60

70         80         90        100
   m094.pep   IRARGITGICCSNAATTSGFSFLTAVEVTTTSAPLTCSAVWPGX
              |:|||||||| |||||||||||||||:||||||||||||||||
   g094       IKARGITGICRSNAATTSGFSFLTAVEATTTSAPLTCSAVWPGX
                   70         80         90        100
```

The following partial DNA sequence was identified in *N. meningitidis* <SEQ ID 325>:

```
a094.seq
  1  ATGTATTCGC CTTTGCCCAA GCGGGCGTTG GTGCCTGCGG CGTTGAGTTT

51  GCCGCCGATA ACGAAAGTCG GGTCAAGTCC TGCCGCGCCG AGGATGGAGG

101  CGGTCAGGCT GGTGGTCGTG GTTTTGCCGT GCGTGCCGGC AATGGCGATG

151  CCGTCACGGA AGCGCATCAA CTCCGCCAAC ATCAGGGCGC GCGGAATAAC

201  GGGAATTTGC TGCTCCAACG CAGCGACAAC TTCGGGATTT TCTTTTTTGA

251  CGGCGGTAGA GGTAACGACG ACATCCGCAC CGTTAACGTG TTCTGCGGTA

301  TGGCCGGGAT AA
```

This corresponds to the amino acid sequence <SEQ ID 326; ORF 094.a>:

```
a094.pep
  1  MYSPLPKRAL VPAALSLPPI TKVGSSPAAP RMEAVRLVVV VLPCVPAMAM

51  PSRKRINSAN IRARGITGIC CSNAATTSGF SFLTAVEVTT TSAPLTCSAV

101  WPG*
``` m094/a094 100.0% identity over a 103 aa overlap

```
                 10         20         30         40         50         60
m094.pep   MYSPLPKRALVPAALSLPPITKVGSSPAAPRMEAVRLVVVVLPCVPAMAMPSRKRINSAN
           ||||||||||||||||||||||||||||||||||||||||||||||||||||||||||||
a094       MYSPLPKRALVPAALSLPPITKVGSSPAAPRMEAVRLVVVVLPCVPAMAMPSRKRINSAN
                 10         20         30         40         50         60

70         80         90        100
m094.pep   IRARGITGICCSNAATTSGFSFLTAVEVTTTSAPLTCSAVWPGX
           |||||||||||||||||||||||||||||||||||||||||||
a094       IRARGITGICCSNAATTSGFSFLTAVEVTTTSAPLTCSAVWPGX
                 70         80         90        100
```

The following partial DNA sequence was identified in *N. gonorrhoeae* <SEQ ID 327>:

```
g095.seq
    1   ATGTCCTTTC ATTTGAACAT GGACGGTGAA TTTCATTTGC GCGCCGACGT
   51   TTTCGATGTC GGTGGCGTAG ATGTCGGCGG TATCGTCCAA ACCGTAAGTA
  101   GCATAAGGTT TGCTCACTTT GGGCAAAATC GCGCGGACGT GTTCGCTGTC
  151   AACACACAAA AAGGCTTTGC CGTAGAAGGG CATACGGTGG ATGAAATCGA
  201   TAAACGCCTG ATGCAGTTTT TCGACGCTGT GCCCGTAGGT ATCCATATGG
  251   TCTTCGTCGA TATTGGTAAC GACGGACATA ATCGGGGTCA GTGTAGGAAA
  301   GAGGCATCGG ATCGTCGGCT TCGGCAACGA TGTATTCGCC TTTGCCCAAG
  351   CGGGCGTTGG TGCCTGCGGC GTTGA
```

This corresponds to the amino acid sequence <SEQ ID 328; ORF 095.ng>:

```
g095.pep
    1   MSFHLNMDGE FHLRADVFDV GGVDVGGIVQ TVSSIRFAHF GQNRADVFAV
   51   NTQKGFAVEG HTVDEIDKRL MQFFDAVPVG IHMVFVDIGN DGHNRGQCRK
  101   EASDRRLRQR CIRLCPSGRW CLRR*
```

The following partial DNA sequence was identified in *N. meningitidis* <SEQ ID 329>:

```
m095.seq
    1   ATGTCCTTTC ATTTGAACAT GGACGGTGAA TTTCATTTGC GCGCCGACGT
   51   TTTCGATGTC GGTGGCGTAG ATGTCGGCGG TATCGTCCAA ACCGTAAGTA
  101   GCATAAGGTT TGCTCACTTT GGGCAAAATC GCGCGGACGT GTTCGCTGTC
  151   AATACACAAA AAGGCTTTGC CGTAGAAGGG CATACGGTGG ATGAAATCGA
  201   TAAACGCCTG ATGCAGTTTT TCGACGCTGT GCCCGTAGGT ATCCATATGG
  251   TCTTCGTCGA TATTGGTAAC GACGGACATA ATCGGTGTCA GTGCAGAAAG
  301   GATGCATCCG ACCGTCGGCT TCGGCAACGA TGTATTCGCC TTTGCCCAAG
  351   CGGGCGTTAG TGCCTGCGGC GTTGA
```

This corresponds to the amino acid sequence <SEQ ID 330; ORF 095>:

```
m095.pep
    1   MSFHLNMDGE FHLRADVFDV GGVDVGGIVQ TVSSIRFAHF GQNRADVFAV
   51   NTQKGFAVEG HTVDEIDKRL MQFFDAVPVG IHMVFVDIGN DGHNRCQCRK
  101   DASDRRLRQR CIRLCPSGRX CLRR*
```

Computer analysis of this amino acid sequence gave the following results:

Homology with a Predicted ORF from *N. gonorrhoeae*
ORF 095 shows 97.6% identity over a 124 aa overlap with a predicted ORF (ORF 095.ng) from *N. gonorrhoeae*:

```
m095/g095
                      10         20         30         40         50         60
     m095.pep    MSFHLNMDGEFHLRADVFDVGGVDVGGIVQTVSSIRFAHFGQNRADVFAVNTQKGFAVEG
                 ||||||||||||||||||||||||||||||||||||||||||||||||||||||||||||
     g095        MSFHLNMDGEFHLRADVFDVGGVDVGGIVQTVSSIRFAHFGQNRADVFAVNTQKGFAVEG
                      10         20         30         40         50         60
                      70         80         90        100        110        120
     m095.pep    HTVDEIDKRLMQFFDAVPVGIHMVFVDIGNDGHNRCQCRKDASDRRLRQRCIRLCPSGRX
                 ||||||||||||||||||||||||||||||||||||| |||:||||||||||||||||||
     g095        HTVDEIDKRLMQFFDAVPVGIHMVFVDIGNDGHNRGQCRKEASDRRLRQRCIRLCPSGRW
                      70         80         90        100        110        120
     m095.pep    CLRRX
                 |||||
     g095        CLRRX
```

The following partial DNA sequence was identified in *N. meningitidis* <SEQ ID 331>:

```
a095.seq
     1   ATGTCCTTTC ATTTGAACAT GGACGGTGAA TTTCATTTGC GCGCCGACGT

51   TTTCGATGTC GGTGGCGTAG ATGTCGGCGG TATCGTCCAA ACCGTAAGTA

101   GCATAAGGTT TGCTCACTTT GGGCAAAATC GCGCGGACGT GTTCGCTGTC

151   AATACACAAA AAGGCTTTGC CGTAGAAGGG CATACGGTGG ATGAAATCGA

201   TAAACGCCTG ATGCAGCTTC TCAACACTGT GCCCGTAGGT ATCCATATGG

251   TCTTCGTCGA TATTGGTAAC GACGGACATA ATCGGTGTCA GTGCAGAAAG

301   GATGCATCCG ACCGTCGGCT TCGGCAACGA TGTATTCGCC TTTGCCCAAG

351   CGGGCGTTGG TGCCTGCGGC GTTGA
```

This corresponds to the amino acid sequence <SEQ ID 332; ORF 095.a>:

```
a095.pep

1    MSFHLNMDGE FHLRADVFDV GGVDVGGIVQ TVSSIRFAHF GQNRADVFAV

51    NTQKGFAVEG HTVDEIDKRL MQLLNTVPVG IHMVFVDIGN DGHNRCQCRK

101    DASDRRLRQR CIRLCPSGRW CLRR* m095/a095    96.0% identity in 124 aa overlap 10         20         30         40         50         60
     m095.pep    MSFHLNMDGEFHLRADVFDVGGVDVGGIVQTVSSIRFAHFGQNRADVFAVNTQKGFAVEG
                 ||||||||||||||||||||||||||||||||||||||||||||||||||||||||||||
     a095        MSFHLNMDGEFHLRADVFDVGGVDVGGIVQTVSSIRFAHFGQNRADVFAVNTQKGFAVEG
                      10         20         30         40         50         60
                      70         80         90        100        110        120
     m095.pep    HTVDEIDKRLMQFFDAVPVGIHMVFVDIGNDGHNRCQCRKDASDRRLRQRCIRLCPSGRX
                 ||||||||||:::::|||||||||||||||||||||||||||||||||||||||||||||
     a095        HTVDEIDKRLMQLLNTVPVGIHMVFVDIGNDGHNRCQCRKDASDRRLRQRCIRLCPSGRW
                      70         80         90        100        110        120
```

```
m095.pep    CLRRX
            |||||
a095        CLRRX
```

The following partial DNA sequence was identified in *N. gonorrhoeae* <SEQ ID 333>:

```
g096.seq
    1 ATGGCCGGTC ATACCGGGCA GGGTGTTGAT TTCCAACAGA TAGAGTTTGC

51 CGTCGGTATC TTTGAGGAAA TCGACGCGCA CGCAGCCTTC CGCACCGATT

101 GCCTGTGCGC CGCGAACCGC CAGTTCGCGC ATCAGGCTTT CTTCGGCTTC

151 GGTCAAATCT TCCGAAGGAC ATTGAtaaat ggtgTCGTCT CGGttgtaCt 201 tggcttcgta gTCGTAAAAC TCGGTTGCGG GGATGATGTG TATGCCGGGC

251 AGCCCTTTGC CGTTCAGGAC GGGGCAGGAA TATTCGCCGC CGCCGATAAA

301 AcgtTcggca atgaTTtcgc ccctgAAGGT GttTCAattc ttcgtaAACG

351 CTTTTCAGAc ggcctTTTTC TTTGA
```

This corresponds to the amino acid sequence <SEQ ID 334; ORF 096.ng>:

```
g096.pep
    1 MAGHTGQGVD FQQIEFAVGI FEEIDAHAAF RTDCLCAANR QFAHQAFFGF

51 GQIFRRTLIN GVVSVVLGFV VVKLGCGDDV YAGQPFAVQD GAGIFAAADK

101 TFGNDFAPEG VSILRKRFSD GLFL*
```

The following partial DNA sequence was identified in *N. meningitidis* <SEQ ID 335>:

```
m096.seq
    1 ATGGCTCGTC ATACCGGGCA GGGTGTTGAT TTCCAACAGA TAGAGTTTGC

51 CGTCGGTATC TTTGAGGAAA TCGACGCGCA CGCAGCCTTC CGCACCGATT

101 GCCTGCGCGC CGCGAACCGC CAGTTCGCGC ATCAGGCTTT CTTCGGCTTC

151 GGTCAAATCT TCCGAAGGAC ATTGATAAAT GGTGTCGTCG CGGTTGTACT

201 TGGCTTCGTA GTCGTAAAAC TCGGTTGCGG GAATGATGTG TATGCCGGGC

251 AGCCCTTTGC CGTTCAGGAC GGGGCAGGAA TATTCGCCGC CGCCGATAAA

301 ACGTTCGGCA ATGATTTCGC CC.TGAAGGT GTTTCAATTC TTCGTAAACG

351 CTTTTCAGAC GGCCTTTTCC TTTGA
```

This corresponds to the amino acid sequence <SEQ ID 336; ORF 096>:

```
m096.pep
    1 MARHTGQGVD FQQIEFAVGI FEEIDAHAAF RTDCLRAANR QFAHQAFFGF

51 GQIFRRTLIN GVVAVVLGFV VVKLGCGNDV YAGQPFAVQD GAGIFAAADK

101 TFGNDFAXEG VSILRKRFSD GLFL* m096/g096  96.0% identity in 124 aa overlap
```

```
                     10         20         30         40         50         60
   m096.pep   MARHTGQGVDFQQIEFAVGIFEEIDAHAAFRTDCLRAANRQFAHQAFFGFGQIFRRTLIN
              ||  ||||||||||||||||||||||||||||||| ||||||||||||||||||||||||
   g096       MAGHTGQGVDFQQIEFAVGIFEEIDAHAAFRTDCLCAANRQFAHQAFFGFGQIFRRTLIN
                     10         20         30         40         50         60

70         80         90        100        110        120
   m096.pep   GVVAVVLGFVVVKLGCGNDVYAGQPFAVQDGAGIFAAADKTFGNDFAXEGVSILRKRFSD
              |||:|||||||||:|||||||||||||||||||||||||||||||||:||||||||||
   g096       GVVSVVLGFVVVKLGCGDDVYAGQPFAVQDGAGIFAAADKTFGNDFAPEGVSILRKRFSD
                     70         80         90        100        110        120 m096.pep   GLFLX
              |||||
   g096       GLFLX
```

The following partial DNA sequence was identified in *N. meningitidis* <SEQ ID 337>:

```
a096.seq
   1 ATGGCCGGTC ATACCGGGCA GGGTGTTGAT TTCCAACAGA TAGAGTTTGC

51 CGTCGGTATC TTTGAGGAAA TCGACGCGCA CGCAGCCTTC CGCACCGATT

101 GCCTGCGCGC CGCGAACCGC CAGTTCGCGC ATCAGGCTTT CTTCGGCTTC

151 GGTCAGATCT TCCGAAGGAC ATTGATAAAT GGTGTCGTTG CGGTTGTACT

201 TGGCTTCGTA GTCATAAAAC TCGGTCGCGG GGATGATGTG TATGCCGGGC

251 AGGCCTTTGC CGTTCAACAC AGGGCAGGAA TATTCGCCGC CGCCGATAAA

301 CCGTTCGGCA ATGATTTCGC CCT.GAAAGT GTTTCAATTC TTCGTAAACG

351 CTTTTCAGAC GGCCTTTTCC TTTGA
```

This corresponds to the amino acid sequence <SEQ ID 338; ORF 096.ng>:

```
a096.pep

1   MAGHTGQGVD FQQIEFAVGI FEEIDAHAAF RTDCLRAANR QFAHQAFFGF

51   GQIFRRTLIN GVVAVVLGFV VIKLGRGDDV YAGQAFAVQH RAGIFAAADK

101   PFGNDFAXES VSILRKRFSD GLFL*
``` m096/a096   92.7% identity in 124 aa overlap

```
                     10         20         30         40         50         60
   m096.pep   MARHTGQGVDFQQIEFAVGIFEEIDAHAAFRTDCLRAANRQFAHQAFFGFGQIFRRTLIN
              ||  ||||||||||||||||||||||||||||||||||||||||||||||||||||||||
   a096       MAGHTGQGVDFQQIEFAVGIFEEIDAHAAFRTDCLRAANRQFAHQAFFGFGQIFRRTLIN
                     10         20         30         40         50         60

70         80         90        100        110        120
   m096.pep   GVVAVVLGFVVVKLGCGNDVYAGQPFAVQDGAGIFAAADKTFGNDFAXEGVSILRKRFSD
              ||||||||||:|||  |:||||||  ||||||   ||||||:||||||||:||||||||||
   a096       GVVAVVLGFVVIKLGRGDDVYAGQAFAVQHRAGIFAAADKPFGNDFAXESVSILRKRFSD
                     70         80         90        100        110        120 m096.pep   GLFLX
              |||||
   a096       GLFLX
```

The following partial DNA sequence was identified in *N. gonorrhoeae* <SEQ ID 339>:

```
g097.seq
   1 ATGGATATTT CAAAACAAAC ATTGCTGGAT AGGGTTTTTA ACCTGAAGGC

51 AAACGGTACG ACGGTACGTA CCGAGTTGAT GGCGGGTTTG ACGACCTTTT

101 TGACGATGTG CTACATCGTT ATCGTCAATC CCCTGATTTT GGGCGAGACC
```

-continued

```
 151 GGAATGGATA TGGGGGCGGT ATTCGTCGCT ACCTGTATCG CATCCGCCAT

201 CGGCTGTTTT GTCATGGGTT TTATCGGCAA CTATCCGATT GCGCTTGCCC

251 CGGGGATGGG GCTGAATGCC TATTTCACCT TTGCCGTCGT TAAGGGTATG

301 GGCGTGCCTT GGCAGGTGGC GTTGGGTGCG GTGTTCATTT CCGGTCTGAT

351 TTTCATCCTG TTCAGCTTTT TTAAAGTCAG GGAAATGCTG GTCAACGCAC

401 TGCCTATGGG TTTGAAAATG TCGATTGCCG CCGGTATCGG TTTGTTTTTG

451 GCACTGATTT CCCTGAAAGG CGCAGGCATT ATCGTTGCCA ATCCGGCAAC

501 CTTGGTCGGC TTGGGCGATA TTCATCAGCC CAGCGCACTG TTGGCATTGT

551 TCGGTTTTGT CATGGTGGTC GTATTGGGGT ATTTCCGCGT TCAAGGCGCA

601 ATCATCATCA CCATTCTGAC GATTACCGTC ATTGCCAGCC TGATGGGTTT

651 GAACGAGTTT CACGGCGTGG TCGGCGAAGT ACCGGGCATT GCGCCGACCT

701 TTATGCAGAT GGATTTTAAA GGTCTGTTTA CCGTCAGCAT GGTCAGCGTG

751 ATTTTCGTCT TCTTCTTGGT CGATTTGTTC GACAGTACCG GAACGCTGGT

801 CGGCGTATCC CACCGTGCCG GACTGCTGGT GGACGGTAAG CTGCCCCGCC

851 TGAAACGCGC ACTGCTTGCA GACTCTACCG CCATTGTGGC AGGTGCGGCT

901 TTGGGTACTT CTTCAACCAC GCCTTATGTG GAAAGCGCGG CGGGCGTATC

951 GGCAGGCGGA CGGACCGGCC TGACGGCGGT TACCGTCGGC GTATTGATGC

1001 TGGCGTGTCT GATGTTCTCC CCATTGGCGA AAAGTGTTCC GGTATTTGCC

1051 ACCGCGCCCG CACTGCTTTA TGTCGGCACG CAGATGCTCC GCAGTGCGAG

1101 GGACATTGAT TGGGACGATA TGACTGAAGC CGCGCCCGCG TTCCTGACCA

1151 TTGTCTTCAT GCCGTTTACC TATTCGATTG CAGACGGCAT CGCCTTCGGC

1201 TTCATCAGCT ATGCCGTGGT CAAACTTTTG TGTCGCCGGA CTGGGGACGT

1251 GCCGCCTATG GTATGGGTTG TTGCCGTATT GTGGGCATTG AAATTCTGGT

1301 ATTTGGGCTG A
```

This corresponds to the amino acid sequence <SEQ ID 340; ORF 097.ng>:

```
g097.pep
   1 MDISKQTLLD RVFNLKANGT TVRTELMAGL TTFLTMCYIV IVNPLILGET

51 GMDMGAVFVA TCIASAIGCF VMGFIGNYPI ALAPGMGLNA YFTFAVVKGM

101 GVPWQVALGA VFISGLIFIL FSFFKVREML VNALPMGLKM SIAAGIGLFL

151 ALISLKGAGI IVANPATLVG LGDIHQPSAL LALFGFVMVV VLGYFRVQGA

201 IIITILTITV IASLMGLNEF HGVVGEVPGI APTFMQMDFK GLFTVSMVSV

251 IFVFFLVDLF DSTGTLVGVS HRAGLLVDGK LPRLKRALLA DSTAIVAGAA

301 LGTSSTTPYV ESAAGVSAGG RTGLTAVTVG VLMLACLMFS PLAKSVPVFA

351 TAPALLYVGT QMLRSARDID WDDMTEAAPA FLTIVFMPFT YSIADGIAFG

401 FISYAVVKLL CRRTGDVPPM VWVVAVLWAL KFWYLG*
```

The following partial DNA sequence was identified in *N. meningitidis* <SEQ ID 341>:

```
m097.seq
   1 ATGGACACTT CAAAACAAAC ACTGTTGGAC GGGATTTTTA AGCTGAAGGC

51 AAACGGTACk ACGGTGCGTA CCGAGTTGAT GGCGGGTTTG ACAACTTTTT
```

-continued

```
 101 TGACGATGTG CTACATCGTT ATCGTCAACC CTCyGATTTT GGGCGAGACC

151 GGCATGGATA TGGGGGCGGT ATTCGTCGCT ACCTGTATCG CGTCTGCCAT

201 CGGCTGTTTT GTTATGGGTT TTGTCGGCAA CTATCCGATT GCACTCGCAC

251 CGGGGATGGG GCTGAATGCC TATTTCACCT TTGCCGTCGT TAAGGGTATG

301 GGCGTGCCTT GGCAGGTTGC GTTGGGTGCG GTGTTCATCT CCGGTCTGAT

351 TTTTATCCTG TTCAGCTTTT TTAAAGTCAG GGAAATGCTG GTCAACGCAC

401 TGCCTATGGG TTTGAAAATG TCGATTGCTG CCGGTATCGG TTTGTTTTTG

451 GCACTGATTT CCCTGAAAGG CGCAGGCATT ATCGTTGCCA ATCCGGCAAC

501 CTTGGTCGGT TTGGGCGATA TTCATCAGCC GTCCGCGTTG TTGGCATTGT

551 TCGGTTTTGC TATGGTGGTC GTATTGGGAC ATTTCCGCGT TCAAGGCGCA

601 ATCATCATCA CCATCTTGAC CATTACCGTC ATTGCCAGCC TGATGGGTTT

651 GAATGAATTT CACGGCATCA TCGGCGAAGT ACCGAGCATT GCGCCGACTT

701 TTATGCAGAT GGATTTTGAA GGCCTGTTTA CCGTCAGCAT GGTCAGTGTG

751 ATTTTCGTCT TCTTCTTGGT CGATCTATTT GACAGTACCG GAACGCTGGT

801 CGGCATATCC CACCGTGCCG GGCTGCTGGT GGACGGTAAG CTGCCCCGCC

851 TGAAACGCGC ACTGCTTGCA GACTCTACCG CCATTGTGGC AGGTGCGGCT

901 TTGGGTACTT CTTCCACCAC GCCTTATGTG GAAAGCGCGG CGGGCGTATC

951 GGCAGGCGGA CGGACCGGCC TGACGGCGGT TACCGTCGGC GTATTGATGC

1001 TCGCCTGCCT GATGTTTTCA CCTTTGGCGA AAAGTGTTCC CGCTTTTGCC

1051 ACCGCGCCCG CCCTGCTTTA TGTCGGCACG CAGATGCTCC GCAGTGCGAG

1101 GGATATTGAT TGGGACGATA TGACGGAAGC CGCACCTGCG TTCCTGACCA

1151 TTGTTTTCAT GCCGTTTACT TATTCGATTG CAGACGGCAT CGCTTTCGGC

1201 TTCATCAGTT ATGCCGTGGT TAAACTTTTA TGCCGCCGCA CCAAAGACGT

1251 TCCGCCTATG GTATGGATTG TTGCCGTATT GTGGGCACTG AAATTCTGGT

1301 ATTTGGGCTG A
```

This corresponds to the amino acid sequence <SEQ ID 342; ORF 097>:

```
m097.pep
   1 MDTSKQTLLD GIFKLKANGT TVRTELMAGL TTFLTMCYIV IVNPXILGET

51 GMDMGAVFVA TCIASAIGCF VMGFVGNYPI ALAPGMGLNA YFTFAVVKGM

101 GVPWQVALGA VFISGLIFIL FSFFKVREML VNALPMGLKM SIAAGIGLFL

151 ALISLKGAGI IVANPATLVG LGDIHQPSAL LALFGFAMVV VLGHFRVQGA

201 IIITILTITV IASLMGLNEF HGIIGEVPSI APTFMQMDFE GLFTVSMVSV

251 IFVFFLVDLF DSTGTLVGIS HRAGLLVDGK LPRLKRALLA DSTAIVAGAA

301 LGTSSTTPYV ESAAGVSAGG RTGLTAVTVG VLMLACLMFS PLAKSVPAFA

351 TAPALLYVGT QMLRSARDID WDDMTEAAPA FLTIVFMPFT YSIADGIAFG

401 FISYAVVKLL CRRTKDVPPM VWIVAVLWAL KFWYLG*
```

Computer analysis of this amino acid sequence gave the following results:

Homology with a Predicted ORF from *N. gonorrhoeae*
ORF 097 shows 96.3% identity over a 436 aa overlap with a predicted ORF (ORF 097.ng) from *N. gonorrhoeae*:

```
m097/g097

10         20         30         40         50         60
    m097.pep   MDTSKQTLLDGIFKLKANGTTVRTELMAGLTTFLTMCYIVIVNPXILGETGMDMGAVFVA
               || ||||||| :|:|||||||||||||||||||||||||||| |||||||||||||||
    g097       MDISKQTLLDRVFNLKANGTTVRTELMAGLTTFLTMCYIVIVNPLILGETGMDMGAVFVA
                       10         20         30         40         50         60

70         80         90        100        110        120
    m097.pep   TCIASAIGCFVMGFVGNYPIALAPGMGLNAYFTFAVVKGMGVPWQVALGAVFISGLIFIL
               ||||||||||||||:|||||||||||||||||||||||||||||||||||||||||||||
    g097       TCIASAIGCFVMGFIGNYPIALAPGMGLNAYFTFAVVKGMGVPWQVALGAVFISGLIFIL
                       70         80         90        100        110        120

130        140        150        160        170        180
    m097.pep   FSFFKVREMLVNALPMGLKMSIAAGIGLFLALISLKGAGIIVANPATLVGLGDIHQPSAL
               ||||||||||||||||||||||||||||||||||||||||||||||||||||||||||||
    g097       FSFFKVREMLVNALPMGLKMSIAAGIGLFLALISLKGAGIIVANPATLVGLGDIHQPSAL
                      130        140        150        160        170        180

190        200        210        220        230        240
    m097.pep   LALFGFAMVVVLGHFRVQGAIIITILTITVIASLMGLNEFHGIIGEVPSIAPTFMQMDFE
               ||||||:||||||:||||||||||||||||||||||||||||::|||| :|||||||||:
    g097       LALFGFVMVVVLGYFRVQGAIIITILTITVIASLMGLNEFHGVVGEVPGIAPTFMQMDFK
                      190        200        210        220        230        240

250        260        270        280        290        300
    m097.pep   GLFTVSMVSVIFVFFLVDLFDSTGTLVGISHRAGLLVDGKLPRLKRALLADSTAIVAGAA
               ||||||||||||||||||||||||||||||:|||||||||||||||||||||||||||||
    g097       GLFTVSMVSVIFVFFLVDLFDSTGTLVGVSHRAGLLVDGKLPRLKRALLADSTAIVAGAA
                      250        260        270        280        290        300

310        320        330        340        350        360
    m097.pep   LGTSSTTPYVESAAGVSAGGRTGLTAVTVGVLMLACLMFSPLAKSVPAFATAPALLYVGT
               ||||||||||||||||||||||||||||||||||||||||||||||:|||||||||||||
    g097       LGTSSTTPYVESAAGVSAGGRTGLTAVTVGVLMLACLMFSPLAKSVPVFATAPALLYVGT
                      310        320        330        340        350        360

370        380        390        400        410        420
    m097.pep   QMLRSARDIDWDDMTEAAPAFLTIVFMPFTYSIADGIAFGFISYAVVKLLCRRTKDVPPM
               |||||||||||||||||||||||||||||||||||||||||||||||||||||||:||||
    g097       QMLRSARDIDWDDMTEAAPAFLTIVFMPFTYSIADGIAFGFISYAVVKLLCRRTGDVPPM
                      370        380        390        400        410        420

430
    m097.pep   VWIVAVLWALKFWYLGX
               ||:||||||||||||||
    g097       VWVVAVLWALKFWYLGX
                      430
```

The following partial DNA sequence was identified in *N. meningitidis* <SEQ ID 343>

```
a097.seq
    1 ATGGACACTT CAAAACAAAC ACTGTTGGAC GGGATTTTTA AGCTGAAGGC

51 AAACGGTACG ACGGTGCGTA CCGAGTTGAT GGCGGGTTTG ACAACTTTTT

101 TGACGATGTG CTACATCGTT ATCGTCAACC CTCTGATTTT GGGCGAGACC

151 GGCATGGATA TGGGGGCGGT ATTCGTCGCT ACCTGTATCG CGTCTGCCAT

201 CGGCTGTTTT GTTATGGGTT TTGTCGGCAA CTATCCGATT GCACTCGCAC

251 CGGGGATGGG GCTGAATGCC TATTTCACCT TTGCCGTCGT TAAGGGTATG

301 GGCGTGCCTT GGCAGGTTGC GTTGGGTGCG GTGTTCATCT CCGGTCTGAT

351 TTTCATCCTG TTCAGCTTTT TTAAAGTCAG GGAAATGCTG GTCAACGCAC

401 TGCCTATGGG TTTGAAAATG TCGATTGCTG CCGGTATCGG TTTGTTTTTG
```

-continued

```
 451 GCACTGATTT CCCTGAAAGG CGCAGGCATT ATCGTTGCCA ATCCGGCAAC

501 CTTGGTCGGC TTGGGCGATA TTCATCAGCC GTCCGCGTTG TTGGCACTGT

551 TCGGTTTTGC CATGGTGGTC GTATTGGGAC ATTTCCGCGT TCAAGGCGCA

601 ATCATCATCA CCATTTTGAC GATTACCGTC ATTGCCAGCC TGATGGGTTT

651 GAACGAATTT CACGGCATCA TCGGCGAAGT GCCGAGCATT GCGCCGACTT

701 TTATGCAGAT GGATTTTAAA GGGTTGTTTA CCGTCAGCAT GGTCAGCGTG

751 ATTTTCGTCT TTTTCCTAGT CGATCTGTTC GACAGTACCG GAACACTGGT

801 CGGTGTATCG CATCGTGCCG GACTGCTGGT GGACGGTAAG CTGCCCCGCC

851 TGAAACGCGC ACTGCTTGCA GACTCTACCG CTATTGTGGC AGGTGCGGCT

901 TTGGGTACTT CTTCAACCAC GCCTTATGTG GAAAGTGCGG CGGGCGTATC

951 GGCAGGCGGG CGGACAGGTC TGACGGCGGT TACCGTCGGC GTATTGATGC

1001 TCGCCTGCCT GATGTTTTCA CCTTTGGCGA AAAGTGTTCC CGCTTTTGCC

1051 ACCGCGCCCG CCCTGCTTTA TGTCGGCACG CAGATGCTCC GCAGTGCGAG

1101 GGACATCGAT TGGGACGATA TGACGGAAGC CGCACCCGCA TTCCTGACCA

1151 TTGTCTTCAT GCCGTTTACC TATTCGATTG CAGACGGCAT CGCTTTCGGC

1201 TTCATCAGTT ATGCCGTGGT TAAACTTTTA TGCCGCCGCA CCAAAGACGT

1251 TCCGCCTATG GTATGGATTG TTGCCGTATT GTGGGCACTG AAATTCTGGT

1301 ATTTGGGCTG A
```

This corresponds to the amino acid sequence <SEQ ID 344; ORF 097.a>:

```
a097.pep

1 MDTSKQTLLD GIFKLKANGT TVRTELMAGL TTFLTMCYIV IVNPLILGET

51 GMDMGAVFVA TCIASAIGCF VMGFVGNYPI ALAPGMGLNA YFTFAVVKGM

101 GVPWQVALGA VFISGLIFIL FSFFKVREML VNALPMGLKM SIAAGIGLFL

151 ALISLKGAGI IVANPATLVG LFGIHQPSAL LALFGFAMVV VLGHFRVQGA

201 IIITILTITV IASLMGLNEF HGIIGEVPSI APTFMQMDFK GLFTVSMVSV

251 IFVFFLVDLF DSTGTLVGVS HRAGLLVDGK LPRLKRALLA DSTAIVAGAA

301 LGTSSTTPYV ESAAGVSAGG RTGLTAVTVG VLMLACLMFS PLAKSVPAFA

351 TAPALLYVGT QMLRSARDID WDDMTEAAPA FLTIVFMPFT YSIADGIAFG

401 FISYAVVKLL CRRTKDVPPM VWIVAVLWAL KFWYLG* m097/a097  99.3% identity in 436 aa overlap 10         20         30         40         50         60
m097.pep   MDTSKQTLLDGIFKLKANGTTVRTELMAGLTTFLTMCYIVIVNPXILGETGMDMGAVFVA
           ||||||||||||||||||||||||||||||||||||||||||| ||||||||||||||||
a097       MDTSKQTLLDGIFKLKANGTTVRTELMAGLTTFLTMCYIVIVNPLILGETGMDMGAVFVA
                    10         20         30         40         50         60

70         80         90        100        110        120
m097.pep   TCIASAIGCFVMGFVGNYPIALAPGMGLNAYFTFAVVKGMGVPWQVALGAVFISGLIFIL
           ||||||||||||||||||||||||||||||||||||||||||||||||||||||||||||
a097       TCIASAIGCFVMGFVGNYPIALAPGMGLNAYFTFAVVKGMGVPWQVALGAVFISGLIFIL
                    70         80         90        100        110        120

130        140        150        160        170        180
m097.pep   FSFFKVREMLVNALPMGLKMSIAAGIGLFLALISLKGAGIIVANPATLVGLGDIHQPSAL
           ||||||||||||||||||||||||||||||||||||||||||||||||||||||||||||
a097       FSFFKVREMLVNALPMGLKMSIAAGIGLFLALISLKGAGIIVANPATLVGLGDIHQPSAL
                   130        140        150        160        170        180
```

```
              190        200        210        220        230        240
m097.pep    LALFGFAMVVVLGHFRVQGAIIITILTITVIASLMGLNEFHGIIGEVPSIAPTFMQMDFE
            ||||||||||||||||||||||||||||||||||||||||||||||||||||||||||:
a097        LALFGFAMVVVLGHFRVQGAIIITILTITVIASLMGLNEFHGIIGEVPSIAPTFMQMDFK
              190        200        210        220        230        240

250        260        270        280        290        300
m097.pep    GLFTVSMVSVIFVFFLVDLFDSTGTLVGISHRAGLLVDGKLPRLKRALLADSTAIVAGAA
            ||||||||||||||||||||||||||||||:|||||||||||||||||||||||||||||
a097        GLFTVSMVSVIFVFFLVDLFDSTGTLVGVSHRAGLLVDGKLPRLKRALLADSTAIVAGAA
              250        260        270        280        290        300

310        320        330        340        350        360
m097.pep    LGTSSTTPYVESAAGVSAGGRTGLTAVTVGVLMLACLMFSPLAKSVPAFATAPALLYVGT
            ||||||||||||||||||||||||||||||||||||||||||||||||||||||||||||
a097        LGTSSTTPYVESAAGVSAGGRTGLTAVTVGVLMLACLMFSPLAKSVPAFATAPALLYVGT
              310        320        330        340        350        360

370        380        390        400        410        420
m097.pep    QMLRSARDIDWDDMTEAAPAFLTIVFMPFTYSIADGIAFGFISYAVVKLLCRRTKDVPPM
            |||||||||||||||||||||||||||||||||||||||||||||||||||||| |||||
a097        QMLRSARDIDWDDMTEAAPAFLTIVFMPFTYSIADGIAFGFISYAVVKLLCRRT GDVPPM
              370        380        390        400        410        420

430
m097.pep    VWIVAVLWALKFWYLGX
            |||||||||||||||||
a097        VWIVAVLWALKFWYLGX
              430
```

The following partial DNA sequence was identified in *N. gonorrhoeae* <SEQ ID 345>:

```
g098.seq
   1  ATGACCGCCG ACGGTCTCTT CGTCGCTTTC AACTTCAATA CGTTTGCCGT

51  TGTGCGAATA TTGATACCAG TACAGCAGGA TGCTGCCCAG GCTGGCGATC

101  AGTTTGTCGG CGATGTCGCG CGCTTCGCTG TCGGGATGGC TTTTCGCGTTC

151  GGGATGAACG CAGCCGAGCA TGGACACGCC GGTACGCATC ACGTCCATCG

201  GATGGGTATG TGCAGGCAGG CTTTCCAAAA CTTTAATCAC ACGGATAGGC

251  AGGCCGCGCA TGGATTTGAG CTTGGTTTTA TAAGCGGCCA GCTCGAATTT

301  GTTGGGCAGA TGGCCGTGAA TCAGCAAGTG TGCGACTTCT TCAAACTCGC

351  ATTTTTGTGC CAAATTAGAA TGTCGTAA
```

This corresponds to the amino acid sequence <SEQ ID 346; ORF 098.ng>:

```
g098.pep
   1  MTADGLFVAF NFNTFAVVRI LIPVQQDAAQ AGDQFVGDVA RFAVGMAFAF

51  GMNAAEHGHA GTHHVHRMGM CRQAFQNFNH TDRQAAHGFE LGFISGQLEF

101  VGQMAVNQQV CDFFKLAFLC QIRMS*
```

The following partial DNA sequence was identified in *N. meningitidis* <SEQ ID 347>:

```
m098.seq
   1  ATGACCGCCG ATGGTCTCTT CGTCGCTTTC AACCTCAATG CGTTTGCCGT

51  TGTGCGAATA TTGATACCAG TACAAGAGGA TGCTGCCGAG GCTGGCGATC

101  AGTTTGTCGG CGATGTCGCG CGCTTCACTT TCCGGATGGC TTTCACGTTC

151  AGGATGAACG CAGCCCAGCA TGGATACGCC GGTACGCATT ACGTCCATCG

201  GATGGGTATG TGCAGGCAGG CTTTCCAAAA CTTTAATCAC ACGGATAGGC
```

-continued

```
251 AGGCCGCGCA TGGATTTGAG CTTGGTTTTA TAAGCGGCCA GCTCGAATTT

301 GTTGGGCAGA TGGCCGTGAA TCAGCAGGTG GGCGACTTCT TCAAACTCGC

351 ATTTTTGTGC CAAATCAGAA TGTCGTAA
```

This corresponds to the amino acid sequence <SEQ ID 348; ORF 098>:

```
m098.pep.
  1 MTADGLFVAF NLNAFAVVRI LIPVCEDAAE AGDQFVGDVA RFTFRMAFTF

51 RMNAAQHGYA GTHYVHRMGM CRQAFQNFNH TDRQAAHGFE LGFISGQLEF

101 VGQMAVNQQV GDFFKLAFLC QIRMS*
```

Computer analysis of this amino acid sequence gave the following results:
Homology with a Predicted ORF from *N. gonorrhoeae* 20
ORF 098 shows 89.6% identity over a 125 aa overlap with a predicted ORF (ORF 098.ng) from *N. gonorrhoeae*:

```
m098/g098
                    10        20        30        40        50        60
   m098.pep   MTADGLFVAFNLNAFAVVRILIPVQEDAAEAGDQFVGDVARFTFRMAFTFRMNAAQHGYA
              ||||||||||:|:||||||||||||:|||:||||||||||:  |||:| ||||:||:|
       g098   MTADGLFVAFNFNTFAVVRILIPVQQDAAQAGDQFVGDVARFAVGMAFAFGMNAAEHGHA
                    10        20        30        40        50        60

70        80        90       100       110       120
   m098.pep   GTHYVHRMGMCRQAFQNFNHTDRQAAHGFELGFISGQLEFVGQMAVNQQVGDFFKLAFLC
              |||:|||||||||||||||||||||||||||||||||||||||||||||| |||||||||
       g098   GTHHVHRMGMCRQAFQNFNHTDRQAAHGFELGFISGQLEFVGQMAVNQQVCDFFKLAFLC
                    70        80        90       100       110       120 m098.pep   QIRMSX
              ||||||
       g098   QIRMSX
```

The following partial DNA sequence was identified in *N. meningitidis* <SEQ ID 349>:

```
a098.seq
  1 ATGACCGCCG ATGGTCTCTT CGTCGCTTTC AACCTCAATG CGTTTGCCGT

51 TGTGCGAATA TTGATACCAG TACAAGAGGA TGCTGCCGAG GCTGGCGATC

101 AGTTTGTCGG CGATGTCGCG CGCTTCACTT TCCGGATGGC TTTCACGTTC

151 AGGATGAACG CAGCCCAGCA TGGATACGCC GGTACGCATT ACGTCCATCG

201 GATGGGTATG TGCAGGCAGG CTTTCCAAAA CTTTAATCAC ACGGATAGGC

251 AGGCCGCGCA TGGATTTGAG CTTGGTTTTA TAAGCGGCCA GCTCGAATTT

301 GTTGGGCAGA TGGCCGTGAA TCAGCAGGTG GGCGACTTCT TCAAACTCGC

351 ATTTTTGTGC CAAATCAGAA TGTCGTAA
```

This corresponds to the amino acid sequence <SEQ ID 350; ORF 098.a>:

```
a098.pep
  1 MTADGLFVAF NLNAFAVVRI LIPVQEDAAE AGDQFVGDVA RFTFRMAFTF

51 RMNAAQHGYA GTHYVHRMGM CRQAFQNFNH TDRQAAHGFE LGFISGQLEF

101 VGQMAVNQQV GDFFKLAFLC QIRMS*
```

```
m098/a098  100.0% identity in 125 aa overlap 10        20        30        40        50        60
m098.pep    MTADGLFVAFNLNAFAVVRILIPVQEDAAEAGDQFVGDVARFTFRMAFTFRMNAAQHGYA
            ||||||||||||||||||||||||||||||||||||||||||||||||||||||||||||
a098        MTADGLFVAFNLNAFAVVRILIPVQEDAAEAGDQFVGDVARFTFRMAFTFRMNAAQHGYA
                     10        20        30        40        50        60

70        80        90       100       110       120
m098.pep    GTHYVHRMGMCRQAFQNFNHTDRQAAHGFELGFISGQLEFVGQMAVNQQVGDFFKLAFLC
            ||||||||||||||||||||||||||||||||||||||||||||||||||||||||||||
a098        GTHYVHRMGMCRQAFQNFNHTDRQAAHGFELGFISGQLEFVGQMAVNQQVGDFFKLAFLC
                     70        80        90       100       110       120 m098.pep    QIRMSX
            ||||||
a098        QIRMSX
```

The following partial DNA sequence was identified in *N. gonorrhoeae* <SEQ ID 351>:

```
g099.seg
   1 ATGCTGGGAC GCGCGTCCAT GATGCGCCTG CCCGATATTG TCGGCGTGGA

51 GCTGACGGGC AAACGGCAGG CGGGCATTAC TGCCACAGAC ATCGTGTTGG

101 CACTGACCGA ATTCTTGCGT AAAGAGCGCG TGGTCGGGGC GTTTGTCGAA

151 TTTTTCGGCG AGGGCGCGAG AAGCCTGTCT ATCGGCGACC GCGCGACCAT

201 TTCCAACATG ACGCCGGAGT TCGGCGCGAC TGCCGCCATG TTCGCCATCG

251 ACGCGCAAAC TATTGATTAT TTGAAACTGA CCGGACGTGA CGACGCGCAG

301 GTGAAATTGG TGGAAACCTA CGCCAAAACC GCAGGCTTAT GGGCAGGTGG

351 CTTGAAAACC GCCGTTTATC CGCGCGTTTT GAAATTTGAT TTGAGCAGCG

401 TAACGCGCAA TATGGCAGGC CCGAGCAACC CGCACGCGCG TTTTGCCACC

451 GCCGATTTGG CGGCGAAAGG GCTGGCGAAG CCTTACGAAG AGCCTTCAGA

501 CGGCCAAATG CCTGACGGTG CAGTGATTAT TGCCGCGATT ACTTCGTGTA

551 CCAATACTTC CAACCCGCGC AACGTTGTCG CCGCCGCACT GTTGGCACGC

601 AATGCCAACC GCCTCGGCTT GAAACGCAAA CCTTGGGTGA AATCTTCGTT

651 TGCCCCGGGT TCAAAAGTAG CCGGAATCTA TTTGAAAGAA GCAGGCTTGT

701 TGCCCGAAAT GGAAAAACTC GGCTTCGGTA TCGTCGCCTT CGCATGTACC

751 ACCTGTAACG GCATGAgcgG CGCGCTcgaC CCGAAAATCC AACAAGAAAT

801 CATCGACCGC GAtttgtacg cCACCGCCGT ATTGTCAGGC AACCGCAACT

851 TCGACGGCCG TATCCATCCG TATGCGAAAC AGGCTTTCCT CGCTTCGCCT

901 CCTTTGGTCG TTGCCTACGC ATTGGCAGGT AGCATCCGTT TCGATATTGA

951 AAACGACGTA CTCGGCGTTG CAGACGGCCG CGAAATCCGC CTGAAAGATA

1001 TCTGGCCGAC AGACGAAGAA ATCGATGCCA TCGTTGCCGA ATATGTGAAA

1051 CCGCAACAAT TCCGCGACAT TTATATCCCG ATGTCCGACA CCGGCACAGC

1101 GCAAAAGCA CCAAGCCCGC TGTACGACTG GCGACCGATG TCCACCTACA

1151 TCCGCCGTCC GCCCTATTGG GAAGGCGCAC TGGCAGGGGA ACGTACATTA

1201 AGAGGTATGC GTCCGCCGGC GATTTTGCCC GACAACATCA CCACCGACCA

1251 CATCTCgcca tCCAATGCGA TTTTGGCCGG cagTGCcgca ggtgaATATT

1301 TGGCGAAAAT GGGTTTGCCT GAAGAagaCT TCAACTCTTA CGCAACCCAC

1351 CGCGGCGACC ACTTGACCGC CCAACGCGCA ACCTTCGCCA ATCCGAAACT
```

-continued

```
1401 GTTTAACGAA ATGGTGAGAA ACGAAGACGG CAGCGTACGC CAAGGTtcgt 1451 tggcacgcgT tgaacCAGAA GGCCAAACCA TGCGCATGTG GGAAGCCATC

1501 GAAACCTATA TGAACCGCAA ACAGCCGCTT ATCATCATTG CCGGTGCGGA

1551 CTATGGTCAA GGCTCAAGCC GCGACTGGGC GGCGAAGGGC GTGCGGCTGG

1601 CGGGTGTGGA AGCCATCGCC GCCGAAGGTT TCGAGCGCAT CCACCGCACC

1651 AACCTCATCG GCATGGGCGT CTTGCCGCTG CAATTCAAAC CCGGCACCAA

1701 CCGCCATACC CTGCAACTGG ACGGTACGGA AACCTACGAC GTTGTCGGCG

1751 AACGCACACC GCGCTGCGGC CTGACCCTCG TGATTCACCG TAAAAACGGA

1801 GAAACCGTCG AAGTTCCGGT TACCTGCCGC CCCGATACCG CAGAAGAAGC

1851 ATTGGTATAT GAAGCCGGCG GCGTATTGCA ACGGTTTGCA CAGGACTTTT

1901 TGGAAGGGAA CGCGGCTTAG
```

This corresponds to the amino acid sequence <SEQ ID 352; ORF 099.ng>:

```
g099.pep
   1 MLGRASMMRL PDIVGVELTG KRQAGITATD IVLALTEFLR KERVVGAFVE

51 FFGEGARSLS IGDRATISNM TPEFGATAAM FAIDAQTIDY LKLTGRDDAQ

101 VKLVETYAKT AGLWAGGLKT AVYPRVLKFD LSSVTRNMAG PSNPHARFAT

151 ADLAAKGLAK PYEEPSDGQM PDGAVIIAAI TSCTNTSNPR NVVAAALLAR

201 NANRLGLKRK PWVKSSFAPG SKVAGIYLKE AGLLPEMEKL GFGIVAFACT

251 TCNGMSGALD PKIQQEIIDR DLYATAVLSG NRNFDGRIHP YAKQAFLASP

301 PLVVAYALAG SIRFDIENDV LGVADGREIR LKDIWPTDEE IDAIVAEYVK

351 PQQFRDIYIP MSDTGTAQKA PSPLYDWRPM STYIRRPPYW EGALAGERTL

401 RGMRPPAILP DNITTDHISP SNAILAGSAA GEYLAKMGLP EEDFNSYATH

451 RGDHLTAQRA TFANPKLFNE MVRNEDGSVR QGSLARVEPE GQTMRMWEAI

501 ETYMNRKQPL IIIAGADYGQ GSSRDWAAKG VRLAGVEAIA AEGFERIHRT

551 NLIGMGVLPL QFKPGTNRHT LQLDGTETYD VVGERTPRCG LTLVIHRKNG

601 ETVEVPVTCR PDTAEEALVY EAGGVLQRFA QDFLEGNAA*
```

The following partial DNA sequence was identified in *N. meningitidis* <SEQ ID 353>:

```
m099.seq
   1 ATGCTGGGAC GCGCGTCCAT GATGCGCCTG CCCGATATTG TCGGCGTTGA

51 GCTGAACGGC AAACGGCAGG CGGGCATTAC GGCGACGGAT ATTGTGTTGG

101 CACTGACCGA GTTTCTGCGC AAAGAACGCG TGGTCGGGGC GTTTGTCGAA

151 TTCTTCGGCG AGGGCGCGAG AAGCCTGTCT ATCGGCGACC GCGCGACCAT

201 TTCCAACATG ACGCCGGAGT TCGGCGCGAC TGCCGCGATG TTCGCTATTG

251 ATGAGCAAAC CATTGATTAT TTGAAACTGA CCGGACGCGA CGACGCGCAG

301 GTGAAATTGG TGGAAACCTA CGCCAAAACC GCAGGCTTGT GGGCAGATGC

351 CTTGAAAACC GCCGTTTATC CTCGCGTTTT GAAATTTGAT TTGAGCAGCG

401 TAACGCGCAA TATGGCAGGC CCAAGTAACC CGCATGCCCG TTTTGCGACC

451 GCCGATTTGG CGGCGAAAGG GCTGGCGAAG CCTTACGAAG AGCCTTCGGA
```

-continued
```
 501 CGGCCAAATG CCCGACGGCT CGGTCATCAT CGCCGCGATT ACCAGTTGCA

551 CCAACACTTC CAACCCGCGC AACGTTGTTG CCGCCGCGCT CTTGGCACGC

601 AATGCCAACC GTCTCGGCTT GAAACGCAAA CCTTGGGTGA AATCTTCGTT

651 TGCCCCGGGT TCAAAAGTAG CCGAAATCTA TTTGAAAGAA GCGGGCCTGT

701 TGCCCGAAAT GGAAAAACTC GGCTTCGGTA TCGTCGCCTT CGCCTGCACC

751 ACCTGCAACG GCATGAGTGG CGCGCTGGAT CCGAAAATCC AGAAAGAAAT

801 CATCGACCGC GATTTGTACG CCACCGCCGT ATTATCAGGC AACCGCAACT

851 TCGACGGCCG TATCCACCCG TATGCGAAAC AGGCTTTCCT CGCTTCGCCT

901 CCGTTGGTCG TTGCCTACGC GCTGGCAGGC AGTATCCGTT TCGATATTGA

951 AAACGACGTA CTCGGCGTTG CAGACGGCAA GGAAATCCGC CTGAAAGACA

1001 TTTGGCCTGC CGATGAAGAA ATCGATGCCG TCGTTGCCGA ATATGTGAAA

1051 CCGCAGCAGT TCCGCGATGT GTATGTACCG ATGTTCGACA CCGGCACAGC

1101 GCAAAAAGCA CCCAGTCCGC TGTACGATTG GCGTCCGATG TCCACCTACA

1151 TCCGCCGTCC GCCTTACTGG GAAGGCGCGC TGGCAGGGGA ACGCACATTA

1201 AGAGGTATGC GTCCGCTGGC GATTTTGCCC GACAACATCA CCACCGACCA

1251 CCTCTCGCCG TCCAATGCGA TTTTGGCCGT CAGTGCCGCA GGCGAGTATT

1301 TGGCGAAAAT GGGTTTGCCT GAAGAAGACT TCAACTCTTA CGCAACCCAC

1351 CGCGGCGACC ACTTGACCGC CCAACGCGCT ACCTTCGCCA ATCCGAAACT

1401 GTTTAACGAA ATGGTGAAAA ACGAAGACGG CAGCGTGCGC CAAGGCTCGT

1451 TCGCCCGCGT CGAACCCGAA GGCGAAACCA TGCGCATGTG GAAGCCATC

1501 GAAACCTATA TGAACCGCAA ACAGCCGCTC ATCATCATTG CCGGTGCGGA

1551 CTATGGTCAA GGCTCAAGCC GCGACTGGGC TGCAAAAGGC GTACGCCTCG

1601 CCGGCGTAGA AGCGATTGTT GCCGAAGGCT TCGAGCGTAT CCACCGCACC

1651 AACCTTATCG GCATGGGCGT GTTGCCGCTG CAGTTCAAAC CCGACACCAA

1701 CCGCCATACC CTGCAACTGG ACGGTACGGA AACCTACGAC GTGGTCGGCG

1751 AACGCACACC GCGCTGCGAC CTGACCCTCG TGATTCACCG TAAAAACGGC

1801 GAAACCGTTG AAGTTCCCGT TACCTGCTGC CTCGATACTG CAGAAGAAGT

1851 ATTGGTATAT GAAGCCGGCG GCGTGTTGCA ACGGTTTGCA CAGGATTTTT

1901 TGGAAGGGAA CGCGGCTTAG
```

This corresponds to the amino acid sequence <SEQ ID 354; ORF 099>:

```
m099.pep
   1 MLGRASMMRL PDIVGVELNG KRQAGITATD IVLALTEFLR KERVVGAFVE

51 FFGEGARSLS IGDRATISNM TPEFGATAAM FAIDEQTIDY LKLTGRDDAQ

101 VKLVETYAKT AGLWADALKT AVYPRVLKFD LSSVTRNMAG PSNPHARFAT

151 ADLAAKGLAK PYEEPSDGQM PDGSVIIAAI TSCTNTSNPR NVVAAALLAR

201 NANRLGLKRK PWVKSSFAPG SKVAEIYLKE AGLLPEMEKL GFGIVAFACT

251 TCNGMSGALD PKIQKEIIDR DLYATAVLSG NRNFDGRIHP YAKQAFLASP

301 PLVVAYALAG SIRFDIENDV LGVADGKEIR LKDIWPADEE IDAVVAEYVK

351 PQQFRDVYVP MFDTGTAQKA PSPLYDWRPM STYIRRPPYW EGALAGERTL
```

-continued

```
401  RGMRPLAILP DNITTDHLSP SNAILAVSAA GEYLAKMGLP EEDFNSYATH

451  RGDHLTAQRA TFANPKLFNE MVKNEDGSVR QGSFARVEPE GETMRMWEAI

501  ETYMNRKQPL IIIAGADYGQ GSSRDWAAKG VRLAGVEAIV AEGFERIHRT

551  NLIGMGVLPL QFKPDTNRHT LQLDGTETYD VVGERTPRCD LTLVIHRKNG

601  ETVEVPVTCC LDTAEEVLVY EAGGVLQRFA QDFLEGNAA*
```

Computer analysis of this amino acid sequence gave the following results:

Homology with a Predicted ORF from *N. gonorrhoeae*

ORF 099 shows 96.2% identity over a 639 aa overlap with a predicted ORF (ORF 099.ng) from *N. gonorrhoeae*:

```
m099/g099

10         20         30         40         50         60
m099.pep   MLGRASMMRLPDIVGVELNGKRQAGITATDIVLALTEFLRKERVVGAFVEFFGEGARSLS
           ||||||||||||||||||:|||||||||||||||||||||||||||||||||||||||||
g099       MLGRASMMRLPDIVGVELTGKRQAGITATDIVLALTEFLRKERVVGAFVEFFGEGARSLS
                   10         20         30         40         50         60

70         80         90        100        110        120
m099.pep   IGDRATISNMTPEFGATAAMFAIDEQTIDYLKLTGRDDAQVKLVETYAKTAGLWADALKT
           |||||||||||||||||||||||| ||||||||||||||||||||||||||||| :|||
g099       IGDRATISNMTPEFGATAAMFAIDAQTIDYLKLTGRDDAQVKLVETYAKTAGLWAGGLKT
                   70         80         90        100        110        120

130        140        150        160        170        180
m099.pep   AVYPRVLKFDLSSVTRNMAGPSNPHARFATADLAAKGLAKPYEEPSDGQMPDGSVIIAAI
           |||||||||||||||||||||||||||||||||||||||||||||||||||||:||||||
g099       AVYPRVLKFDLSSVTRNMAGPSNPHARFATADLAAKGLAKPYEEPSDGQMPDGAVIIAAI
                  130        140        150        160        170        180

190        200        210        220        230        240
m099.pep   TSCTNTSNPRNVVAAALLARNANRLGLKRKPWVKSSFAPGSKVAEIYLKEAGLLPEMEKL
           ||||||||||||||||||||||||||||||||||||||||||| |||||||||||||||
g099       TSCTNTSNPRNVVAAALLARNANRLGLKRKPWVKSSFAPGSKVAGIYLKEAGLLPEMEKL
                  190        200        210        220        230        240

250        260        270        280        290        300
m099.pep   GFGIVAFACTTCNGMSGALDPKIQKEIIDRDLYATAVLSGNRNFDGRIHPYAKQAFLASP
           |||||||||||||||||||||||||:||||||||||||||||||||||||||||||||||
g099       GFGIVAFACTTCNGMSGALDPKIQQEIIDRDLYATAVLSGNRNFDGRIHPYAKQAFLASP
                  250        260        270        280        290        300

310        320        330        340        350        360
m099.pep   PLVVAYALAGSIRFDIENDVLGVADGKEIRLKDIWPADEEIDAVVAEYVKPQQFRDVYVP
           |||||||||||||||||||||||||:|||||||||:||||||:||||||||||||:|:|
g099       PLVVAYALAGSIRFDIENDVLGVADGREIRLKDIWPTDEEIDAIVAEYVKPQQFRDIYIP
                  310        320        330        340        350        360

370        380        390        400        410        420
m099.pep   MFDTGTAQKAPSPLYDWRPMSTYIRRPPYWEGALAGERTLRGMRPLAILPDNITTDHLSP
           | |||||||||||||||||||||||||||||||||||||||||| ||||||||||||:||
g099       MSDTGTAQKAPSPLYDWRPMSTYIRRPPYWEGALAGERTLRGMRPPAILPDNITTDHISP
                  370        380        390        400        410        420

430        440        450        460        470        480
m099.pep   SNAILAVSAAGEYLAKMGLPEEDFNSYATHRGDHLTAQRATFANPKLFNEMVKNEDGSVR
           |||||| |||||||||||||||||||||||||||||||||||||||||||||:|||||||
g099       SNAILAGSAAGEYLAKMGLPEEDFNSYATHRGDHLTAQRATFANPKLFNEMVRNEDGSVR
                  430        440        450        460        470        480

490        500        510        520        530        540
m099.pep   QGSFARVEPEGETMRMWEAIETYMNRKQPLIIIAGADYGQGSSRDWAAKGVRLAGVEAIV
           |||:|||||||:||||||||||||||||||||||||||||||||||||||||||||||:
g099       QGSLARVEPEGQTMRMWEAIETYMNRKQPLIIIAGADYGQGSSRDWAAKGVRLAGVEAIA
                  490        500        510        520        530        540

550        560        570        580        590        600
m099.pep   AEGFERIHRTNLIGMGVLPLQFKPDTNRHTLQLDGTETYDVVGERTPRCDLTLVIHRKNG
           ||||||||||||||||||||||||| ||||||||||||||||||||||| |||||||||
g099       AEGFERIHRTNLIGMGVLPLQFKPGTNRHTLQLDGTETYDVVGERTPRCGLTLVIHRKNG
                  550        560        570        580        590        600
```

```
             610        620        630        640
m099.pep  ETVEVPVTCCLDTAEEVLVYEAGGVLQRFAQDFLEGNAAX
          |||||||||  |||||:||||||||||||||||||||||
g099      ETVEVPVTCRPDTAEEALVYEAGGVLQRFAQDFLEGNAAX
             610        620        630        640
```

The following partial DNA sequence was identified in *N. meningitidis* <SEQ ID 355>:

```
a099.seq
   1 ATGCTGGGAC GCGCGTCCAT GATGCGCCTG CCCGATATTG TCGGCGTTGA
  51 GCTGAACGGC AAACGGAAGG CGGGCATTAC GGCGACGGAT ATTGTGTTGG
 101 CACTGACCGA GTTTCTGCGC AAAGAACGCG TGGTCGGGGC GTTTGTCGAA
 151 TTCTTCGGCG AGGGCGCGAG AAGCCTGTCT ATCGGCGACC GCGCGACCAT
 201 TTCCAACATG ACGCCGGAGT TCGGCGCGAC TGCCGCGATG TTCGCTATTG
 251 ATGAGCAAAC CATTGATTAT TTGAAACTGA CCGGACGCGA CGACGCGCAG
 301 GTGAAATTGG TGGAAACCTA CGCCAAAACC GCAGGCTTGT GGGCAGATGC
 351 CTTGAAAACC GCCGTTTATC CGCGCGTTTT GAAATTTGAT TTGAGCAGCG
 401 TAACGCGCAA TATGGCAGGC CCGAGCAACC CGCACGCGCG TTTTGCGACC
 451 GCCGATTTGG CCGGCAAAGG CTTGGCTAAA CCTTACGAAG AGCCTTCAGA
 501 CGGCCAAATG CCTGACGGTG CAGTGATTAT TGCCGCGATT ACTTCCTGTA
 551 CCAATACTTC CAATCCGCGC AACGTTGTCG CCGCCGCGCT GTTGGCACGC
 601 AATGCCAACC GCCTCGGCTT GCAACGCAAA CCTTGGGTGA AATCTTCGTT
 651 TGCCCCGGGT TCAAAAGTAG CCGAAATCTA TTTGAAAGAA GCAGATCTGC
 701 TGCCCGAAAT GGAAAAACTC GGCTTCGGTA TCGTTGCCTT CGCATGTACC
 751 ACCTGTAACG GCATGAGCGG CGCGCTGGAT CCGAAAATCC AGAAAGAAAT
 801 CATCGACCGC GATTTGTACG CCACCGCCGT ATTGTCAGGC AACCGCAACT
 851 TTGACGGCCG TATCCATCCG TATGCGAAAC AGGCTTTCCT CGCTTCGCCT
 901 CCGTTGGTCG TTGCCTACGC GCTGGCAGGC AGCATCCGTT TCGATATTGA
 951 AAACGACGTA CTCGGCGTTG CAGACGGCAA AGAAATCCGC CTGAAAGACA
1001 TTTGGCCTAC CGATGAAGAA ATCGATGCCA TCGTTGCCGA ATATGTGAAA
1051 CCGCAGCAAT TTCGCGACGT TTATATCCCG ATGTTCGACA CCGGCACAGC
1101 GCAAAAAGCA CCAAGCCCGC TGTACGACTG GCGTCCAATG TCTACCTATA
1151 TCCGCCGCCC ACCTTACTGG GAAGGCGCAC TGGCAGGGGA ACGCACATTA
1201 AGCGGTATGC GTCCGCTGGC GATTTTGCCC GACAACATCA CCACCGACCA
1251 TCTCTCGCCA TCCAATGCGA TTTTGGCAAG CAGTGCCGCA GGCGAATATT
1301 TGGCAAAAAT GGGTTTGCCT GAAGAAGACT TCAACTCTTA CGCAACCCAC
1351 CGTGGCGACC ACTTGACCGC CCAACGCGCA ACCTTCGCCA ATCCGAAACT
1401 GTTTAACGAA ATGGTGAGAA ACGAAGACGG CAGCGTACGC CAAGGTTCGC
1451 TGGCACGCGT TGAACCCGAA GGCCAAACCA TGCGCATGTG GGAAGCCATC
1501 GAAACCTATA TGAACCGCAA ACAGCCGCTC ATCATCATTG CCGGCGCGGA
1551 CTACGGTCAA GGCTCAAGCC GCGACTGGGC TGCAAAAGGC GTACGCCTCG
1601 CCGGCGTGGA AGCGATTGTT GCCGAAGGCT TCGAGCGTAT CCACCGCACC
1651 AACTTGATCG GTATGGGCGT GTTGCCGCTG CAGTTCAAAC CGGGTACCAA
```

-continued

```
1701 CCGCCACACC CTGCAACTGG ACGGTACGGA AACCTACGAC GTTGTCGGCG

1751 AACGCACACC GCGCTGCGAC CTGACCCTTG TGATTCACCG TAAAAACGGC

1801 GAGACCGTCG AAGTCCCCAT TACCTGCCGC CTCGATACCG CAGAAGAAGT

1851 GTTGGTATAT GAAGCCGGTG GCGTATTGCA ACGGTTTGCA CAGGATTTTT

1901 TGGAAGGGAA CGCGGCTTAG
```

This corresponds to the amino acid sequence <SEQ ID 356; ORF 099.a>:

```
a099.pep

1 MLGRASMMRL PDIVGVELNG KRKAGITATD IVLALTEFLR KERVVGAFVE

51 FFGEGARSLS IGDRATISNM TPEFGATAAM FAIDEQTIDY LKLTGRDDAQ

101 VKLVETYAKT AGLWADALKT AVYPRVLKFD LSSVTRNMAG PSNPHARFAT

151 ADLAGKGLAK PYEEPSDGQM PDGAVIIAAI TSCTNTSNPR NVVAAALLAR

201 NANRLGLQRK PWVKSSFAPG SKVAEIYLKE ADLLPEMEKL GFGIVAFACT

251 TCNGMSGALD PKIQKEIIDR DLYATAVLSG NRNFDGRIHP YAKQAFLASP

301 PLVVAYALAG SIRFDIENDV LGVADGKEIR LKDIWPTDEE IDAIVAEYVK

351 PQQFRDVYIP MFDTGTAQKA PSPLYDWRPM STYIRRPPYW EGALAGERTL

401 SGMRPLAILP DNITTDHLSP SNAILASSAA GEYLAKMGLP EEDFNSYATH

451 RGDHLTAQRA TFANPKLFNE MVRNEDGSVR QGSLARVEPE GQTMRMWEAI

501 ETYMNRKQPL IIIAGADYGQ GSSRDWAAKG VRLAGVEAIV AEGFERIHRT

551 NLIGMGVLPL QFKPGTNRHT LQLDGTETYD VVGERTPRCD LTLVIHRKNG

601 ETVEVPITCR LDTAEEVLVY EAGGVLQRFA QDFLEGNAA* m099/a099 97.5% identity in 639 aa overlap 10         20         30         40         50         60
m099.pep  MLGRASMMRLPDIVGVELNGKRQAGITATDIVLALTEFLRKERVVGAFVEFFGEGARSLS
          ||||||||||||||||||||||:|||||||||||||||||||||||||||||||||||||
a099      MLGRASMMRLPDIVGVELNGKRKAGITATDIVLALTEFLRKERVVGAFVEFFGEGARSLS
                  10         20         30         40         50         60

70         80         90        100        110        120
m099.pep  IGDRATISNMTPEFGATAAMFAIDEQTIDYLKLTGRDDAQVKLVETYAKTAGLWADALKT
          ||||||||||||||||||||||||||||||||||||||||||||||||||||||||||||
a099      IGDRATISNMTPEFGATAAMFAIDEQTIDYLKLTGRDDAQVKLVETYAKTAGLWADALKT
                  70         80         90        100        110        120

130        140        150        160        170        180
m099.pep  AVYPRVLKFDLSSVTRNMAGPSNPHARFATADLAAKGLAKPYEEPSDGQMPDGSVIIAAI
          ||||||||||||||||||||||||||||||||||||:||||||||||||||||:||||||
a099      AVYPRVLKFDLSSVTRNMAGPSNPHARFATADLAGKGLAKPYEEPSDGQMPDGAVIIAAI
                 130        140        150        160        170        180

190        200        210        220        230        240
m099.pep  TSCTNTSNPRNVVAAALLARNANRLGLKRKPWVKSSFAPGSKVAEIYLKEAGLLPEMEKL
          |||||||||||||||||||||||||||:||||||||||||||||||||||||||||||||
a099      TSCTNTSNPRNVVAAALLARNANRLGLQRKPWVKSSFAPGSKVAEIYLKEADLLPEMEKL
                 190        200        210        220        230        240

250        260        270        280        290        300
m099.pep  GFGIVAFACTTCNGMSGALDPKIQKEIIDRDLYATAVLSGNRNFDGRIHPYAKQAFLASP
          ||||||||||||||||||||||||||||||||||||||||||||||||||||||||||||
a099      GFGIVAFACTTCNGMSGALDPKIQKEIIDRDLYATAVLSGNRNFDGRIHPYAKQAFLASP
                 250        260        270        280        290        300

310        320        330        340        350        360
m099.pep  PLVVAYALAGSIRFDIENDVLGVADGKEIRLKDIWPADEEIDAVVAEYVKPQQFRDVYVP
          |||||||||||||||||||||||||||||||||||:||||||:|||||||||||||||:|
a099      PLVVAYALAGSIRFDIENDVLGVADGKEIRLKDIWPTDEEIDAIVAEYVKPQQFRDVYIP
                 310        320        330        340        350        360
```

-continued

```
                  370        380        390        400        410        420
m099.pep    MFDTGTAQKAPSPLYDWRPMSTYIRRPPYWEGALAGERTLRGMRPLAILPDNITTDHLSP
            ||||||||||||||||||||||||||||||||||||||| ||||||||||||||||||||
a099        MFDTGTAQKAPSPLYDWRPMSTYIRRPPYWEGALAGERTLSGMRPLAILPDNITTDHLSP
                  370        380        390        400        410        420

430        440        450        460        470        480
m099.pep    SNAILAVSAAGEYLAKMGLPEEDFNSYATHRGDHLTAQRATFANPKLFNEMVKNEDGSVR
            |||||| |||||||||||||||||||||||||||||||||||||||||||:||||||||
a099        SNAILASSAAGEYLAKMGLPEEDFNSYATHRGDHLTAQRATFANPKLFNEMVRNEDGSVR
                  430        440        450        460        470        480

490        500        510        520        530        540
m099.pep    QGSFARVEPEGETMRMWEAIETYMNRKQPLIIAGADYGQGSSRDWAAKGVRLAGVEAIV
            |||:||||||||:|||||||||||||||||||||||||||||||||||||||||||||
a099        QGSLARVEPEGQTMRMWEAIETYMNRKQPLIIAGADYGQGSSRDWAAKGVRLAGVEAIV
                  490        500        510        520        530        540

550        560        570        580        590        600
m099.pep    AEGFERIHRTNLIGMGVLPLQFKPDTNRHTLQLDGTETYDVVGERTPRCDLTLVIHRKNG
            ||||||||||||||||||||||||||| ||||||||||||||||||||||||||||||||
a099        AEGFERIHRTNLIGMGVLPLQFKPGTNRHTLQLDGTETYDVVGERTPRCDLTLVIHRKNG
                  550        560        570        580        590        600

610        620        630        640
m099.pep    ETVEVPVTCCLDTAEEVLVYEAGGVLQRFAQDFLEGNAAX
            ||||||:|| ||||||||||||||||||||||||||||||
a099        ETVEVPITCRLDTAEEVLVYEAGGVLQRFAQDFLEGNAAX
                  610        620        630        640
```

The following partial DNA sequence was identified in *N. gonorrhoeae* <SEQ ID 357>:

```
g102.seq
   1 AtgtCCGCCA AAactccgtc gctcttcggc ggcgcgatga Ttatcgccgg
  51 gaaggttatc ggcgcAGgta tgttccccaa ccccaccgcc aacttggggg
 101 acgggttaat aggctcgctg attgtgctgc tgtacacctg gtttccattc
 151 tcctccggcg ccctcatgat tttggaagtc aacacccata acCCccgagg
 201 ggcaAGtttt gacaccATGg tcAAagacct gctcgGaCGc ggctggaaca
 251 tcatcaacgg catcgccgtc gctttggTCc tatacggctc gacctacgcg
 301 tacattttag tcggcggtga cctGACCGCC AAAGGCAtcg GCAgCGCAGT
 351 AGGCGGCAAA ATTTCgctca CCGTCGGACA actcgtcttc tTCGGCATCC
 401 TCGCCTTTTG CGTATGGGCA TCCGCACGCT TGGTCGACCG CTTTACCGGC
 451 GTCCTCATCG GCGGCATGGT ATTAACCTTT ATTTGGGCAA CCGGCGGCCT
 501 GGTTGCCGAT GCCAAACCGT CCGTCCTCTT CGACACCCAA GCCCCCGTCG
 551 GCACCGGCTA CTGGATTTAC GCCGCCACCG CCCTGCCCGT CTGCCTCGCT
 601 TCCTTCGGCT TCCACGGCAA CGTTTCCAGC CTGCTCAAAT ACTTTAAAGG
 651 CGACGcgcCc aaagtGgCGA aATCcatctg gGcaggtaca ttggTTGCCt
 701 tggtaattta cgtccTCTgg caaaccgcca tCcaaagcaa ccTGCcgcgc
 751 aacgagttcg cCCCcgtgat tgccgccgag aggcaactCT CCGTCCTgaa
 801 tgaaacccTG tccaaattcg cccaaaccgg cgatatggat aAaatattgt
 851 ccctatttcc ctacatggca atcgccacct ccttttagg cgTAACctta
 901 ggcctgtttg acaacatcgc cgacatcttc aaatggaacg acagtatgtc
 951 cgggcggggc accaaaaccg tcgcgctgaa cttcctgccg CCCCtgattt
1001 cctggctgct cctccccacc ggcttcttta ccgccattgg tgcgtccggc
1051 ctggcggcaa ccgtctggga ccaagGcatc atccccgcca tgctgctcta
1101 cgtttccccc caaaaaattG gcGcaggcaa gacttataAa gtttaCGGCG
```

-continued

```
1151 gcttgtggct gatgttagtc ttccttttcg gcatcgccaa catcgccgca

1201 CAGGTATTGA GccaAatgGa ACtcgtCccc GTATTTAAAG GATAA
```

This corresponds to the amino acid sequence <SEQ ID 358; ORF 102.ng>:

```
g102.pep
  1 MSAKTPSLFG GAMIIAGKVI GAGMFPNPTA NLGDGLIGSL IVLLYTWFPF

51 SSGALMILEV NTHNPRGASF DTMVKDLLGR GWNIINGIAV ALVLYGSTYA

101 YILVGGDLTA KGIGSAVGGK ISLTVGQLVF FGILAFCVWA SARLVDRFTG

151 VLIGGMVLTF IWATGGLVAD AKPSVLFDTQ APVGTGYWIY AATALPVCLA

201 SFGFHGNVSS LLKYFKGDAP KVAKSIWAGT LVALVIYVLW QTAIQSNLPR

251 NEFAPVIAAE RQLSVLNETL SKFAQTGDMD KILSLFPYMA IATSFLGVTL

301 GLFDNIADIF KWNDSMSGRG TKTVALNFLP PLISWLLLPT GFFTAIGASG

351 LAATVWDQGI IPAMLLYVSP QKIGAGKTYK VYGGLWLMLV FLFGIANIAA

401 QVLSQMELVP VFKG*
```

The following partial DNA sequence was identified in *N. meningitidis* <SEQ ID 359>:

```
m102.seq
   1 ATGCCCAACA AAACCCCTTC ACTGTTCGGC GGCGCGATGA TTATCGCCGG

51 CACGGTCATC GGCGCAGGCA TGCTCGCCAA CCCGACCGCC ACATCCGGCG

101 TATGGTTTAC CGGCTCGCTG GCCGTGTTGC TGTACACCTG GTTTTCTATG

151 CTTTCCAGCG GCCTGATGAT TTTGGAAGTC AACACCCATT ATCCGCACGG

201 CGCAAGTTTC GACACGATGG TCAAAGACCT GCTCGGACGC GGCTGGAACA

251 TCATCAACGG CATCGCCGTC GCCTTCGTTT TATACCTGCT TACTTACGCT

301 TATATCTTCG TCGGCGGCGA CCTGACCGCC AAAGGCTTAG GCAGCGCGGC

351 AGGCGGCGAC GTTTCACTCA CCGTCGGACA ACTCGTCTTC TTCGGCATCC

401 TCGCCTTTTG CGTATGGGCA TCCGCACGCT TGGTCGACCG CTTCACCGGC

451 GTCCTTATCG GCGGCATGGT ATTGACCTTT ATTTGGGCGG CCGGCGGGCT

501 GATTGCCGAT GCCAAGCCGT CCGTCCTCTT CGATACCCAA GCCCCGCCG

551 GCACAAACTA CTGGATTTAC GCCGCCACCG CCCTGCCCGT CTGCCTCGCT

601 TCCTTCGGCT TCCACGGCAA CGTCTCCAGC CTGCTCAAAT ACTTTAAAGG

651 CGACGCGCCC AAAGTGGCTA AATCCATCTG GACGGGCACA CTGATTGCGC

701 TGGTAATTTA CGTCCTCTGG CAAACCGCCA TCCAAGGCAA CCTGCCGCGC

751 AACGAGTTCG CCCCCGTCAT CGCCGCCGAA GGGCAAGTCT CCGTCCTCAT

801 CGAAACCCTG TCCAAATTCG CCCAAACCGG CAATATGGAC AAAATATTGT

851 CCCTGTTTTC CTATATGGCG ATCGCCACCT CGTTTTTAGG CGTAACGCTC

901 GGACTCTTCG ACTACATCGC CGACATCTTC AAATGGAACG ACAGCATCTC

951 CGGCCGCACC AAAACCGCCG CGCTGACCTT CCTGCCGCCC CTGATTTCCT

1001 GCCTGCTCTT CCCCACCGGC TTCGTTACCG CCATCGGCTA CGTCGGCCTG

1051 GCGGCAACCG TCTGGACAGG CATCATCCCC GCCATGCTGC TCTACCGTTC

1101 GCGCAAAAAA TTCGGCGCAG GCAAAACCTA TAAAGTTTAC GGCGGCTTGT
```

-continued

```
1151 GGCTGATGGT TTGGGTCTTC CTTTTCGGCA TCGTCAACAT CGCCGCACAG

1201 GTATTGAGCC AAATGGAACT CGTCCCCGTA TTTAAAGGAT AA
```

This corresponds to the amino acid sequence <SEQ ID 360; ORF 102>:

```
m102.pep..

1 MPNKTPSLFG GAMIIAGTVI GAGMLANPTA TSGVWFTGSL AVLLYTWFSM

51 LSSGLMILEV NTHYPHGASF DTMVKDLLGR GWNIINGIAV AFVLYLLTYA

101 YIFVGGDLTA KGLGSAAGGD VSLTVGQLVF FGILAFCVWA SARLVDRFTG

151 VLIGGMVLTF IWAAGGLIAD AKPSVLFDTQ APAGTNYWIY AATALPVCLA

201 SFGFHGNVSS LLKYFKGDAP KVAKSIWTGT LIALVIYVLW QTAIQGNLPR

251 NEFAPVIAAE GQVSVLIETL SKFAQTGNMD KILSLFSYMA IATSFLGVTL

301 GLFDYIADIF KWNDSISGRT KTAALTFLPP LISCLLFPTG FVTAIGYVGL

351 AATVWTGIIP AMLLYRSRKK FGAGKTYKVY GGLWLMVWVF LFGIVNIAAQ

401 VLSQMELVPV FKG* m102/g102  86.0% identity in 415 aa overlap 10         20         30         40         50         60
m102.pep  MPNKTPSLFGGAMIIAGTVIGAGMLANPTATSGVWFTGSLAVLLYTWFSMLSSGLMILEV
          |  |||||||||||| ||||||:||||: |||: |  ||| ||||| : |::|||||
g102      MSAKTPSLFGGAMIIAGKVIGAGMFPNPTANLGDGLIGSLIVLLYTWFPFSSGALMILEV
                 10         20         30         40         50         60
                 70         80         90        100        110        120
m102.pep  NTHYPHGASFDTMVKDLLGRGWNIINGIAVAFVLYLLTYAYIFVGGDLTAKGLGSAAGGD
          |||  :||||||||||||||||||||||||| |||| :|||  ||||||||||:|||:||
g102      NTHNPRGASFDTMVKDLLGRGWNIINGIAVALVLYGSTYAYILVGGDLTAKGIGSAVGGK
                 70         80         90        100        110        120
                130        140        150        160        170        180
m102.pep  VSLTVGQLVFFGILAFCVWASARLVDRFTGVLIGGMVLTFIWAAGGLIADAKPSVLFDTQ
          :|||||||||||||||||||||||||||||||||||||||||:|||:||||||||||||
g102      ISLTVGQLVFFGILAFCVWASARLVDRFTGVLIGGMVLTFIWATGGLIADAKPSVLFDTQ
                130        140        150        160        170        180
                190        200        210        220        230        240
m102.pep  APAGTNYWIYAATALPVCLASFGFHGNVSSLLKYFKGDAPKVAKSIWTGTLIALVIYVLW
          ||:||:|||||||||||||||||||||||||||||||||||||||||||:|||:||||||
g102      APVGTGYWIYAATALPVCLASFGFHGNVSSLLKYFKGDAPKVAKSIWAGTLVALVIYVLW
                190        200        210        220        230        240
                250        260        270        280        290        300
m102.pep  QTAIQGNLPRNEFAPVIAAEGQVSVLIETLSKFAQTGNMDKILSLFSYMAIATSFLGVTL
          |||||:|||||||||||||:||| |||||||||||||:||||||||| ||||||||||||
g102      QTAIQSNLPRNEFAPVIAAERQLSVLNETLSKFAQTGDMDKILSLFPYMAIATSFLGVTL
                250        260        270        280        290        300
                310        320        330        340        350
m102.pep  GLFDYIADIFKWNDSISGR-TKTAALTFLPPLISCLLFPTGFVTAIGYVGLAATVWT-GI
          ||||  ||||||||||| ||  |  |:|||||||||| ||:|||| |||| |||||| ||
g102      GLFDNIADIFKWNDSMSGRGTKTVALNFLPPLISWLLLPTGFFTAIGASGLAATVWDQGI
                310        320        330        340        350        360
                360        370        380        390        400        410
m102.pep  IPAMLLYRSRKKFGAGKTYKVYGGLWLMVWVFLFGIVNIAAQVLSQMELVPVFKGX
          ||||||| |  :|:|||||||||||||||| :||||||:||||||||||||||||||
g102      IPAMLLYVSPQKIGAGKTYKVYGGLWLML-VFLFGIANIAAQVLSQMELVPVFKGX
                370        380        390        400        410
```

The following partial DNA sequence was identified in *N. meningitidis* <SEQ ID 361>:

```
a102.seq
  1 ATGCCCACCA AAACCCCTTC ACTGTTCGGC GGCGCGATGA TTATCGCCGG

51 CACGNTCATC GGCGCAGGTA TGCTCGCCAA CCTGACCGCC ACATCCGGCG
```

```
-continued
101 TATGGTTTAC CGGCTCGCTG GCCGTGTTGC TGTACACCTG GTTTTCCATG

151 CTCTCCAGCG GCCTGATGAT TTTGGAAGTC AACACCCACT ACCCCCACGG

201 CGCGANCTTC GACACCATGG TTAAAGACCT GCTCGGACGG AGCTGGAACA

251 TCATCAACGG CATCGCCGTC GCCTTCGTTT TATACCTGCT TACTTACGCT

301 TATATCTTCG TCGGCGGCGA CCTGACCGCC AAAGGCTTAG GCAGCGCGGC

351 AGGCGGCAAT GTTTCACTCA CCGTCGGACA ACTCGTCTTC TTCGGCATTC

401 TCGCCTTTTG CGTATGGGCA TCCGCACGCT TGGTCGACCG ATTCACCAGC

451 GTCCTCATCG GCGGCATGGT ATTAACCTTT ATTTGGGCAA CCGGCGGCCT

501 GATTGCCGAT GCCAAACTGC CCGTCCTCTT CGACACCCAA GCCCCTACCG

551 GCACCAACTA CTGGATTTAT GTCGCCACCG CCCTGCCCGT CTGCCTTGCG

601 TCATTCGGTT CCACGGCAA CGTCTCCAGC CTGCTCAAAT ACTTTAAAGG

651 CGACGCGCCC AAAGTGGCTA AATCCATCTG GACGGGCACA CTGATTGCGC

701 TGGTAATTTA CGTCCTCTGG CAAACCGCCA TCCAANGCAA CCTGCCGCGC

751 AACGAGTTCG CCCCCGTGAT TGCCGCCGAA GGGCAAGTCT CCGTCNTGAT

801 TGAAACCCTG TCCAAATTCG CCCAAACCGG CAATATGGAC AAAATATTGT

851 CCCTGTTTTC CTATATGGCG ATCGCCACCT CGTTTTTAGG CGTAACGCTC

901 GGACTCTTCG ACTACATCGC CGACATCTTC AAATGGAACG ACAGCGTGTC

951 CGGCCGCACC AAAACCGCCG CGCTGACCTT CCTGCCGCCT NTAATTTCCT

1001 GCCTGCTCTT CCCCACCGGC TTTGTTACCG CCATCGGNTA CGTCGGCCTG

1051 GCGGCAACCG TCTGGACAGG CATCATCCCC GCCATGCTGC TNTACCGTTC

1101 GCGCAAAAAA TTCGGCGCAG GCAAAACCTA TAAAGTTTAC GGCGGCTTGT

1151 GGCTGATGGT TTGGGTCTTC CTTTTCGGCA TCNTCAACAT CGCCGCACAN

1201 GTATTGAGCC AAATGGAACT CGTCCCCGTA TTTAAAGGAT AA

1202
```

This corresponds to the amino acid sequence <SEQ ID 362; ORF 102.a>:

```
a102.pep

1   MPTKTPSLFG GAMIIAGTXI GAGMLANPTA TSGVWFTGSL AVLLYTWFSM
   51   LSSGLMILEV NTHYPHGAXF DTMVKDLLGR SWNIINGIAV AFVLYLLTYA
  101   YIFVGGDLTA KGLGSAAGGN VSLTVGQLVF FGILAFCVWA SARLVDRFTS
  151   VLIGGMVLTF IWATGGLIAD AKLPVLFDTQ APTGTNYWIY VATALPVCLA
  201   SFGFHGNVSS LLKYFKGDAP KVAKSIWTGT LIALVIYVLW QTAIQXNLPR
  251   NEFAPVIAAE GQVSVXIETL SKFAQTGNMD KILSLFSYMA IATSFLGVTL
  301   GLFDYIADIF KWNDSVSGRT KTAALTFLPP XISCLLFPTG FVTAIGYVGL
  351   AATVWTGIIP AMLLYRSRKK FGAGKTYKVY GGLWLMVWVF LFGIXNIAAX
  401   VLSQMELVPV FKG* m102/a102  95.9% identity in 413 aa overlap 10         20         30         40         50         60
m102.pep  MPNKTPSLFGGAMIIAGTVIGAGMLANPTATSGVWFTGSLAVLLYTWFSMLSSGLMILEV
          ||:|||||||||||||||| ||||||||||||||||||||||||||||||||||||||||
a102      MPTKTPSLFGGAMIIAGTXIGAGMLANPTATSGVWFTGSLAVLLYTWFSMLSSGLMILEV
                 10         20         30         40         50         60
```

```
                    70         80         90        100        110        120
    m102.pep NTHYPHGASFDTMVKDLLGRGWNIINGIAVAFVLYLLTYAYIFVGGDLTAKGLGSAAGGD
             |||||||| |||||||||||:||||||||||||||||||||||||||||||||||||||:
    a102     NTHYPHGAXFDTMVKDLLGRSWNIINGIAVAFVLYLLTYAYIFVGGDLTAKGLGSAAGGN
                    70         80         90        100        110        120

130        140        150        160        170        180
    m102.pep VSLTVGQLVFFGILAFCVWASARLVDRFTGVLIGGMVLTFIWAAGGLIADAKPSVLFDTQ
             ||||||||||||||||||||||||||||||:|||||||||||:||||||||| ||||||
    a102     VSLTVGQLVFFGILAFCVWASARLVDRFTSVLIGGMVLTFIWATGGLIADAKLPVLFDTQ
                   130        140        150        160        170        180

190        200        210        220        230        240
    m102.pep APAGTNYWIYAATALPVCLASFGFHGNVSSLLKYFKGDAPKVAKSIWTGTLIALVIYVLW
             ||:|||||||:|||||||||||||||||||||||||||||||||||||||||||||||
    a102     APTGTNYWIYVATALPVCLASFGFHGNVSSLLKYFKGDAPKVAKSIWTGTLIALVIYVLW
                   190        200        210        220        230        240

250        260        270        280        290        300
    m102.pep QTAIQGNLPRNEFAPVIAAEGQVSVLIETLSKFAQTGNMDKILSLFSYMAIATSFLGVTL
             |||||  |||||||||||||||||| ||||||||||||||||||||||||||||||||
    a102     QTAIQXNLPRNEFAPVIAAEGQVSVXIETLSKFAQTGNMDKILSLFSYMAIATSFLGVTL
                   250        260        270        280        290        300

310        320        330        340        350        360
    m102.pep GLFDYIADIFKWNDSISGRTKTAALTFLPPLISCLLFPTGFVTAIGYVGLAATVWTGIIP
             |||||||||||||||| |||||||||||||| ||||||||||||||||||||||||||
    a102     GLFDYIADIFKWNDSVSGRTKTAALTFLPPXISCLLFPTGFVTAIGYVGLAATVWTGIIP
                   310        320        330        340        350        360

370        380        390        400        410
    m102.pep AMLLYRSRKKFGAGKTYKVYGGLWLMVWVFLFGIVNIAAQVLSQMELVPVFKGX
             ||||||||||||||||||||||||||||||||||| |||| |||||||||||||
    a102     AMLLYRSRKKFGAGKTYKVYGGLWLMVWVFLFGIXNIAAXVLSQMELVPVFKGX
                   370        380        390        400        410
```

The following partial DNA sequence was identified in *N. gonorrhoeae* <SEQ ID 363>:

```
g105.seq
  1 Atgtccgcag aaaCATACAc acAAAtcggc tGGgtaggct taggGcaaat 51 gGgtctgcct atgGTAACGC GGCTCTTGGA CGGCGGCATC GAAGTCGGCG 101 TATACAACCG CTCGCCCGAC AAAACTGCCC CCATCTCcgc CAAAGGAGCA 151 AAAGTTTACG GCagcACCGC CGAACTCGTC CGCGCCTGCC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG ACCCGCCACC AACGGCACAC

401 TGCTGATTCT GTTCGGCGGC AGCGAAGCCG TTTTAAACCC GCTGCAAAAA

451 ATATTTTCCC TTGTCGGCAA AAAACCTTC CATTTCGGCG ATGTCGGCAA

501 AGGCTCGGGC GCGAAACTCG TCTTGAACTC GCTCTTAGGC ATTTTCGGCG

551 AAGCGTACAG CGAAGCGATG CTGATGGCGC GGCAGTTCGG CATCGATACC

601 GACACCATCG TCGAAGCCAT CGGCGGCTCG GCAATGGACT CGCCTATGTT

651 TCAAACAAAA AAATCACTAT GGGCAAACCG TGAGTTCCCC CCTGCCTTTG

701 CACTCAAACA CGCTTCCAAA GAcctTAACC TCGccgtcAA AGAGCTTGAA

751 CAGGCAGGCA ACACCCTGCC CGCCGTCGAA ACCGTTGCTG CCAGCTACCG

801 CAAAGCAGTT GAAGCCGGCT ACGGCGAACA GGACGTTTCC GGCGTTTACC

851 TGAAATTGGC AGAACACTGA
```

This corresponds to the amino acid sequence <SEQ ID 364; ORF 105.ng>:

```
g105.pep
  1 MSAETYTQIG WVGLGQMGLP MVTRLLDGGI EVGVYNRSPD KTAPISAKGA

51 KVYGSTAELV RACPVIFLMV SDYAAVCDIL NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH
```

The following partial DNA sequence was identified in *N. meningitidis* <SEQ ID 365>:

```
m105.seq
  1 ATGTCCGCAA ACGAATACGC ACAAATCGGC TGGaTAGGCT TAGGGCAAAT

51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGCGCA

151 AAAGTTTACG GCAACACCGC CGAACTCGTC CGCGACTATC CCGTCATTTT

201 CCTGATGGTT TCCGACTATG CCGCCGTGTG CGACATCCTG AACGGAGTCC

251 GCGACGGATT GGCCGGCAAm ATCATCGTCA ACATGAGCAC CATCTCCCCG

301 ACCGAAAaGC TCGCCGTCAA AGCACTTGTC GAAGCGCAGm GaCAGTTTGC

351 CGAAGCACCC GTTTCCGGAT CGGTCGGGCC CGCCACCAAC GGCACGCTGC

401 TGATTCTGTT CGGCGGCAGC GAAcCGtTTT AAACCCGCTG CAAAAAATAT

451 TTTCCCTCGT CGGCAAAAAA ACCTTCCATT TCGGCGATGT CGGCAAAGGT

501 TCGGGCGCGA AACTCGTCTT GAACTCGCTC TTGGGCATTT TCGGCGAaCG

551 TAcAGCGAAs GmTgCTGATG GCGCGGCAGT TCGGCATCGA TACCGACACC

601 ATCGTCGAAG CCATCGGsGA CTCGGCAATG GACTCGCCCA TGTTCCAAAC

651 CAAAAAATCC CTGTGGGCAA ACCGCGAATT CCCGmCCGmC TTCGCCCTCA

701 AACACGCCTC CAAAGACCTC AACCTCGCCG TCAAAGAGCT TGAACAGGCA

751 GGCAACACCC TGCCCGCCGT CGAAACCGTT GCTGCCAGCT ACCGCAAAGC

801 AGTCGAAGCC GGCTACGGGA CACAGGACGT TTCCGGCGTT TACCTGAAAC

851 TGGCAGAACA CTGA
```

This corresponds to the amino acid sequence <SEQ ID 366; ORF 105>:

```
m105.pep
  1 MSANEYAQIG WIGLGQMGLP MVTRLLDGGI EVGVYNRSPD KTAPISAKGA

51 KVYGNTAELV RDYPVIFLMV SDYAAVCDIL NGVRDGLAGX IIVNMSTISP

101 TEKLAVKALV EAQRQFAEAP VSGSVGPATN GTLLILFGGS EPFXTRCKKY

151 FPSSAKKPSI SAMSAKVRAR NSSXTRSWAF SANVQRXXLM ARQFGIDTDT

201 IVEAIGDSAM DSPMFQTKKS LWANREFPXX FALKHASKDL NLAVKELEQA

251 GNTLPAVETV AASYRKAVEA GYGTQDVSGV YLKLAEH
```

Computer analysis of this amino acid sequence gave the following results:

Homology with a Predicted ORF from *N. gonorrhoeae*

ORF 105 shows 79.9% identity over a 289 aa overlap with a predicted ORF (ORF 105.ng) from *N. gonorrhoeae*:

```
m105/g105

10        20        30        40        50        60
  g105.pep  MSAETYTQIGWVGLGQMGLPMVTRLLDGGIEVGVYNRSPDKTAPISAKGAKVYGSTAELV
            ||| : |:||||:|||||||||||||||||||||||||||||||||||||||| :|||||
  m105      MSANEYAQIGWIGLGQMGLPMVTRLLDGGIEVGVYNRSPDKTAPISAKGAKVYGNTAELV
                  10        20        30        40        50        60
                  70        80        90       100       110       120
  g105.pep  RACPVIFLMVSDYAAVCDILNGVRDGLAGKIIVNMSTISPTENLAVKALVEAAGGQFAEA
            |  ||||||||||||||||||||||||||||| |||||||||||:|||||||||  ||||
  m105      RDYPVIFLMVSDYAAVCDILNGVRDGLAGXIIVNMSTISPTEKLAVKALVEAQR-QFAEA
                  70        80        90       100       110
                 130       140       150       160       170       180
  g105.pep  PVSGSVGPATNGTLLILFGGSEAVLNPLQKIFSLVGKKTFHFGDVGKGSGAKLVLNSLLG
            |||||||||||||||||||||  :|| |   :||  : : ::   |:     |:    :
  m105      PVSGSVGPATNGTLLILFGGSEPFXTRCKKYGPSSAKKP-SISAMSAKVRARNSSXTRSW
                 120       130       140       150       160       170
                 190       200       210       220       230       240
  g105.pep  IFGEAYSEAMLMARQFGIDTDTIVEAIGGSAMDSPMFQTKKSLWANREFPPAFALKHASK
            |:    ::   ||||||||||||||||| ||||||||||||||||||||||  |||||||
  m105      AFSANVQRXXLMARQFGIDTDTIVEAIGDSAMDSPMFQTKKSLWANREFPXXFALKHASK
                 180       190       200       210       220       230
                 250       260       270       280     289
  g105.pep  DLNLAVKELEQAGNTLPAVETVAASYRKAVEAGYGEQDVSGVYLKLAEH
            |||||||||||||||||||||||||||||||||| ||||||||||||||
  m105      DLNLAVKELEQAGNTLPAVETVAASYRKAVEAGYGTQDVSGVYLKLAEH
                 240       250       260       270       280
```

The following partial DNA sequence was identified in *N. meningitidis* <SEQ ID 367>:

```
a105.seq
  1 ATGTCCGCAA ACGAATACAC ACAAATCGGC TGGATAGGCT TAGGGCAAAT

51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGCGCA

151 AAAGTTTACG GCAACACCGC CGAACTCGTC CGCGACTATC CGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG GCCGCCACC AACGGCACGC

401 TGCTGATTCT GTTCGGCGGC AGCGAAGCCG TTTTAAACCC GCTGCAAAAA

451 ATATTTTCCC TCGTCGGCAA AAAAACCTTC CATTTCGGCG ATGTCGGCAA

501 AGGTTCGGGC GCGAAACTCG TCTTGAACTC GCTCTTGGGC ATTTTCGGCG

551 AAGCGTACAG CGAAGCGATG CTGATGGCGC GGCAGTTCGG CATCGATACC

601 GACACCATCG TCGAAGCCAT CGGCGGCTCG GCAATGGACT CGCCCATGTT

651 CCAAACCAAA AAATCCCTGT GGGCAAACCG CGAATTCCCA CCCGCCTTCG

701 CCCTCAAACA CGCCTCCAAA GACCTCAACC TCGCCGTCAA AGAGCTTGAA

751 CAGGCAGGCA ACACCCTGCC CGCCGTCGAA ACCGTTGCTG CCAGCTACCG

801 CAAAGCAGTC GAAGCCGGCT ACGGCGAACA GGACGTTTCC GGCGTTTACC

851 TGAAATTGGC AGAACACTGA
```

This corresponds to the amino acid sequence <SEQ ID 368; ORF 105.a>:

```
a105.pep

1 MSANEYTQIG WIGLGQMGLP MVTRLLDGGI EVGVYNRSPD KTAPISAKGA

51 KVYGNTAELV RDYPVIFLMV SDYAAVCDIL NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH* m105/a105  96.5% identity in 289 aa overlap 10         20         30         40         50         60
    m105.pep  MSANEYAQIGWIGLGQMGLPMVTRLLDGGIEVGVYNRSPDKTAPISAKGAKVYGNTAELV
              ||||||:|||||||||||||||||||||||||||||||||||||||||||||||||||||
    a105      MSANEYTQIGWIGLGQMGLPMVTRLLDGGIEVGVYNRSPDKTAPISAKGAKVYGNTAELV
                   10         20         30         40         50         60

70         80         90        100        110       119
    m105.pep  RDYPVIFLMVSDYAAVCDILNGVRDGLAGKIIVNMSTISPTENLAVKALVEAAG-QFAEA
              |||||||||||||||||||||||||||||||||||||||||||||||||||||| |||||
    a105      RDYPVIFLMVSDYAAVCDILNGVRDGLAGKIIVNMSTISPTENLAVKALVEAAGGQFAEA
                   70         80         90        100        110       120

120        130        140        150        160        170        179
    m105.pep  PVSGSVGPATNGTLLILFGGSEAVLNPLQKIFSLVGKKTFHFGDVGKGSGAKLVLNSLLG
              ||||||||||||||||||||||||||||||||||||||||||||||||||||||||||||
    a105      PVSGSVGPATNGTLLILFGGSEAVLNPLQKIFSLVGKKTFHFGDVGKGSGAKLVLNSLLG
                 130        140        150        160        170        180

180        190        200        210        220        230
    m105.pep  IFGDV-QRXMLMARQFGIDTDTIVEAIGDSAMDSPMFQTKKSLWANREFPXAFALKHASK
              |||::  :: ||||||||||||||||||| ||||||||||||||||||||| ||||||||
    a105      IFGEAYSEAMLMARQFGIDTDTIVEAIGGSAMDSPMFQTKKSLWANREFPPAFALKHASK
                  190        200        210        220        230        240

240        250        260        270        280
    m105.pep  DLNLAVKELEQAGNTLPAVETVAASYRKAVEAGYGEQDVSGVYLKLAEHX
              ||||||||||||||||||||||||||||||||||||||||||||||||||
    a105      DLNLAVKELEQAGNTLPAVETVAASYRKAVEAGYGEQDVSGVYLKLAEHX
                  250        260        270        280        290
```

The following partial DNA sequence was identified in *N. gonorrhoeae* <SEQ ID 369>:

```
g105-1.seq
  1 ATGTCCGCAG AAACATACAC ACAAATCGGC TGGGTAGGCT TAGGGCAAAT

51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGAGCA

151 AAAGTTTACG GCAGCACCGC CGAACTCGTC CGCGCCTGCC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG ACCCGCCACC AACGGCACAC

401 TGCTGATTCT GTTCGGCGGC AGCGAAGCCG TTTTAAACCC GCTGCAAAAA

451 ATATTTTCCC TTGTCGGCAA AAAAACCTTC CATTTCGGCG ATGTCGGCAA

501 AGGCTCGGGC GCGAAACTCG TCTTGAACTC GCTCTTAGGC ATTTTCGGCG

551 AAGCGTACAG CGAAGCGATG CTGATGGCGC GGCAGTTCGG CATCGATACC

601 GACACCATCG TCGAAGCCAT CGGCGGCTCG GCAATGGACT CGCCTATGTT
```

-continued

```
651 TCAAACAAAA AAATCACTAT GGGCAAACCG TGAGTTCCCC CCTGCCTTTG

701 CACTCAAACA CGCTTCCAAA GACCTTAACC TCGCCGTCAA AGAGCTTGAA

751 CAGGCAGGCA ACACCCTGCC CGCCGTCGAA ACCGTTGCTG CCAGCTACCG

801 CAAAGCAGTT GAAGCCGGCT ACGGCGAACA GGACGTTTCC GGCGTTTACC

851 TGAAATTGGC AGAACACTGA
```

This corresponds to the amino acid sequence <SEQ ID 370; ORF 105-1.ng>:

```
g105-1.pep
  1 MSAETYTQIG WVGLGQMGLP MVTRLLDGGI EVGVYNRSPD KTAPISAKGA

51 KVYGSTAELV RACPVIFLMV SDYAAVCDIL NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH*
```

The following partial DNA sequence was identified in *N. meningitidis* <SEQ ID 371>:

```
m105-1.seq
  1 ATGTCCGCAA ACGAATACGC ACAAATCGGC TGGATAGGCT TAGGGCAAAT

51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGCGCA

151 AAAGTTTACG GCAACACCGC CGAACTCGTC CGCGACTATC CGGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG GCCCGCCACC AACGGCACGC

401 TGCTGATTCT GTTCGGCGGC AGCGAAGCcG TTTTAAACCC GCTGCAAAAA

451 ATATTTTCCC TCGTCGGCAA AAAAACCTTC CATTTCGGCG ATGTCGGCAA

501 AGGTTCGGGC GCGAAACTCG TCTTGAACTC GCTCTTGGGC ATTTTCGGCG

551 AAGCGTACAG CGAAnCGATG CTGATGGCGC GGCAGTTCGG CATCGATACC

601 GACACCATCG TCGAAGCCAT CGGsGACTCG GCAATGGACT CGCCCATGTT

651 CCAAACCAAA AAATCCCTGT GGGCAAACCG CGAATTCCCG CCCGCCTTCG

701 CCCTCAAACA CGCCTCCAAA GACCTCAACC TCGCCGTCAA AGAGCTTGAA

751 CAGGCAGGCA ACACCCTGCC CGCCGTCGAA ACCGTTGCTG CCAGCTACCG

801 CAAAGCAGTC GAAGCCGGCT ACGGCGAACA GGACGTTTCC GGCGTTTACC

851 TGAAACTGGC AGAACACTGA
```

This corresponds to the amino acid sequence <SEQ ID 372; ORF 105-1>:

```
m105-1.pep
      1 MSANEYAQIG WIGLGQMGLP MVTRLLDGGI EVGVYNRSPD KTAPISAKGA

51 KVYGNTAELV RDYPVIFLMV SDYAAVCDIL NGVRDGLAGK IIVNMSTISP
```

-continued

```
101  TENLAVKALV EAAGGQFAEA PVSGSVGPAT NGTLLILFGG SEAVLNPLQK

151  IFSLVGKKTF HFGDVGKGSG AKLVLNSLLG IFGEAYSEXM LMARQFGIDT

201  DTIVEAIGDS AMDSPMFQTK KSLWANREFP PAFALKHASK DLNLAVKELE

251  QAGNTLPAVE TVAASYRKAV EAGYGEQDVS GVYLKLAEH*
```

```
mA05-1/g105-1  96.9% identity in 289 aa overlap 10        20        30        40        50        60
m105-1.pep  MSANEYAQIGWIGLGQMGLPMVTRLLDGGIEVGVYNRSPDKTAPISAKGAKVYGNTAELV
            |||: |:||||:||||||||||||||||||||||||||||||||||||||||||:|||||
g105-1      MSAETYTQIGWVGLGQMGLPMVTRLLDGGIEVGVYNRSPDKTAPISAKGAKVYGSTAELV
                    10        20        30        40        50        60

70        80        90       100       110       120
m105-1.pep  RDYPVIFLMVSDYAAVCDILNGVRDGLAGKIIVNMSTIPTENLAVKALVEAAGGQFAEA
            |  ||||||||||||||||||||||||||||||||||||||||||||||||||||||||
g105-1      RACPVIFLMVSDYAAVCDILNGVRDGLAGKIIVNMSTIPTENLAVKALVEAAGGQFAEA
                    70        80        90       100       110       120

130       140       150       160       170       180
m105-1.pep  PVSGSVGPATNGTLLILFGGSEAVLNPLQKIFSLVGKKTFHFGDVGKGSGAKLVLNSLLG
            ||||||||||||||||||||||||||||||||||||||||||||||||||||||||||||
g105-1      PVSGSVGPATNGTLLILFGGSEAVLNPLQKIFSLVGKKTFHFGDVGKGSGAKLVLNSLLG
                   130       140       150       160       170       180

190       200       210       220       230       240
m105-1.pep  IFGEAYSEXMLMARQFGIDTDTIVEAIGDSAMDSPMFQTKKSLWANREFPPAFALKHASK
            |||||||| ||||||||||||||||||| |||||||||||||||||||||||||||||||
g105-1      IFGEAYSEAMLMARQFGIDTDTIVEAIGGSAMDSPMFQTKKSLWANREFPPAFALKHASK
                   190       200       210       220       230       240

250       260       270       280       290
m105-1.pep  DLNLAVKELEQAGNTLPAVETVAASYRKAVEAGYGEQDVSGVYLKLAEHX
            |||||||||||||||||||||||||||||||||||||||||||||||||
g105-1      DLNLAVKELEQAGNTLPAVETVAASYRKAVEAGYGEQDVSGVYLKLAEHX
                   250       260       270       280       290
```

The following partial DNA sequence was identified in *N. meningitidis* <SEQ ID 373>:

```
a105-1.seq
  1 ATGTCCGCAA ACGAATACAC ACAAATCGGC TGGATAGGCT TAGGGCAAAT

51 GGGTCTGCCT ATGGTAACGC GGCTCTTGGA CGGCGGCATC GAAGTCGGCG

101 TATACAACCG CTCGCCCGAC AAAACTGCCC CCATCTCCGC CAAAGGCGCA

151 AAAGTTTACG GCAACACCGC CGAACTCGTC CGCGACTATC CCGTCATTTT

201 CCTGATGGTT TCCGACTATG CCGCCGTGTG CGACATCCTG AACGGAGTCC

251 GCGACGGATT GGCCGGCAAA ATCATCGTCA ACATGAGCAC CATCTCCCCG

301 ACCGAAAACC TCGCCGTCAA AGCACTTGTC GAAGCCGCAG GCGGACAGTT

351 TGCCGAAGCA CCCGTTTCCG GATCGGTCGG GCCCGCCACC AACGGCACGC

401 TGCTGATTCT GTTCGGCGGC AGCGAAGCCG TTTTAAACCC GCTGCAAAAA

451 ATATTTTCCC TCGTCGGCAA AAAAACCTTC CATTTCGGCG ATGTCGGCAA

501 AGGTTCGGGC GCGAAACTCG TCTTGAACTC GCTCTTGGGC ATTTTCGGCG

551 AAGCGTACAG CGAAGCGATG CTGATGGCGC GGCAGTTCGG CATCGATACC

601 GACACCATCG TCGAAGCCAT CGGCGGCTCG GCAATGGACT CGCCCATGTT

651 CCAAACCAAA AAATCCCTGT GGGCAAACCG CGAATTCCCA CCCGCCTTCG

701 CCCTCAAACA CGCCTCCAAA GACCTCAACC TCGCCGTCAA AGAGCTTGAA

751 CAGGCAGGCA ACACCCTGCC CGCCGTCGAA ACCGTTGCTG CCAGCTACCG

801 CAAAGCAGTC GAAGCCGGCT ACGGCGAACA GGACGTTTCC GGCGTTTACC

851 TGAAATTGGC AGAACACTGA
```

This corresponds to the amino acid sequence <SEQ ID 374; ORF 105-1.a>:

```
a105-1.pep

1 MSANEYTQIG WIGLGQMGLP MVTRLLDGGI EVGVYNRSPD KTAPISAKGA

51 KVYGNTAELV RDYPVIFLMV SDYAAVCDIL NGVRDGLAGK IIVNMSTISP

101 TENLAVKALV EAAGGQFAEA PVSGSVGPAT NGTLLILFGG SEAVLNPLQK

151 IFSLVGKKTF HFGDVGKGSG AKLVLNSLLG IFGEAYSEAM LMARQFGIDT

201 DTIVEAIGGS AMDSPMFQTK KSLWANREFP PAFALKHASK DLNLAVKELE

251 QAGNTLPAVE TVAASYRKAV EAGYGEQDVS GVYLKLAEH* a105-1/m105-1  99.0% identity in 289 aa overlap 10         20         30         40         50         60
    a105-1•pep MSANEYAQIGWIGLGQMGLPMVTRLLDGGIEVGVYNRSPDKTAPISAKGAKVYGNTAELV
               ||||||:||||||||||||||||||||||||||||||||||||||||||||||||||||
        m105-1 MSANEYTQIGWIGLGQMGLPMVTRLLDGGIEVGVYNRSPDKTAPISAKGAKVYGNTAELV
                    10         20         30         40         50         60

70         80         90        100        110        120
    a105-1.pep RDYPVIFLMVSDYAAVCDILNGVRDGLAGKIIVNMSTISPTENLAVKALVEAAGGQFAEA
               ||||||||||||||||||||||||||||||||||||||||||||||||||||||||||||
        m105-1 RDYPVIFLMVSDYAAVCDILNGVRDGLAGKIIVNMSTISPTENLAVKALVEAAGGQFAEA
                    70         80         90        100        110        120

130        140        150        160        170        180
    a105-1.pep PVSGSVGPATNGTLLILFGGSEAVLNPLQKIFSLVGKKTFHFGDVGKGSGAKKVLNSLLG
               ||||||||||||||||||||||||||||||||||||||||||||||||||||||||||||
        m105-1 PVSGSVGPATNGTLLILFGGSEAVLNPLQKIFSLVGKKTFHFGDVGKGSGAKLVLNSLLG
                   130        140        150        160        170        180

190        200        210        220        230        240
    a105-1.pep    IFGEAYSEAMLMARQFGIDTDTIVEAIGGSAMDSPMFQTKKSLWANREFPPAFALKHASK
               ||||||||   |||||||||||||||||||   |||||||||||||||||||||||||||
        m105-1 IFGEAYSEXMLMARQFGIDTDTIVEAIGDSAMDSPMFQTKKSLWANREFPPAFALKHASK
                   190        200        210        220        230        240

250        260        270        280        290
    a105-1.pep DLNLAVKELEQAGNTLPAVETVAASYRKAVEAGYGEQDVSGVYLKLAEHX
               ||||||||||||||||||||||||||||||||||||||||||||||||||
        m105-1 DLNLAVKELEQAGNTLPAVETVAASYRKAVEAGYGEQDVSGVYLKLAEHX
                   250        260        270        280        290
```

40

The following partial DNA sequence was identified in *N. gonorrhoeae* <SEQ ID 375>:

```
g107.seq
  1 ATGGTATTAA CCTTTATTTG GGCAACCGGC GGCCTGGTTG CCGATGCCAA

51 ACCGTCCGTC CTCTTCGACA CCCAAGCCCC CGTCGGCACC GGCTACTGGA

101 TTTACGCCGC CACCGCCCTG CCCGTCTGCC TCGCTTCCTT CGGCTTCCAC

151 GGCAACGTTT CCAGCCTGCT CAAATACTTT AAAGGCGACG cgcCcaaagt

201 GgCGAaATCc atctggGcag gtacattggT TGCCttggta atttacgtcc

251 TCTggcaaac cgccatCcaa agcaaccTGC cgcgcaacga gttcgcCCCc 301 gtgattgccg ccgagaggca actCTCCGTC CTgaatgaaa cccTGtccaa 351 attcgcccaa accggcgata tggataAaat attgtcccta tttccctaca 401 tggcaatcgc cacctccttt ttaggcgTAA Ccttaggcct gtttgacaac 451 atcgccggac atcttcaaat ggaacgacag tatgtccggg cggcaccaaa 501 accgtcgcgc tga
```

This corresponds to the amino acid sequence <SEQ ID 376; ORF 107.ng>:

```
g107.pep
  1 MVLTFIWATG GLVADAKPSV LFDTQAPVGT GYWIYAATAL PVCLASFGFH

51 GNVSSLLKYF KGDAPKVAKS IWAGTLVALV IYVLWQTAIQ SNLPRNEFAP

101 VIAAERQLSV LNETLSKFAQ TGDMDKILSL FPYMAIATSF LGVTLGLFDN

151 IAGHLQMERQ YVRAAPKPSR *
```

The following partial DNA sequence was identified in *N. meningitidis* <SEQ ID 377>:

```
m107.seq
  1 ATGGTATTGA CCTTTATTTG GGCGGCCGGC GGGCTGATTG CCGATGCCAA

51 GCCGTCCGTC CTCTTCGATA CCCAAGCCCC CGCCGGCACA AACTACTGGA

101 TTTACGCCGs CACCGCCCTG CCCGTCTGCC TCGCTTCCTT CGGCTTCCAC

151 GGCAACGTCT CCAGCCTGCT CAAATACTTT AAAGGCGACG CGCCCAAAGT

201 GGCTAAATCC ATCTGGACGG GCACACTGAT TGCGCTGGTA ATTTACGTCC

251 TCTGGCAAAC CGCCATCCAA GGCAACCTGC CGCGCAACGA GTTCGCCCCC

301 GTCATCGCCG CCGAAGGGCA AGTCTCCGTC CTCATCGAAA CCCTGTCCAA

351 ATTCGCCCAA ACCGGCAATA TGGACAAAAT ATTGTCCCTG TTTTCCTATA

401 TGGCGATCGC CACCTCGTTT TTAGGCGTAA CGCTCGGACT CTTCGACTAC

451 ATCGCCCATC TTCAAATGGA ACGACAGCAT CTCCGGgCCG CACCAAAACC

501 GCCGCGCTGA
```

This corresponds to the amino acid sequence <SEQ ID 378; ORF 107>:

```
m107.pep . . .
  1 MVLTFIWAAG GLIADAKPSV LFDTQAPAGT NYWIYAXTAL PVCLASFGFH

51 GNVSSLLKYF KGDAPKVAKS IWTGTLIALV IYVLWQTAIQ GNLPRNEFAP

101 VIAAEGQVSV LIETLSKFAQ TGNMDKILSL FSYMAIATSF LGVTLGLFDY

151 IAHLQMERQH LRAAPKPPR*
```

Computer analysis of this amino acid sequence gave the following results:
Homology with a Predicted ORF from *N. gonorrhoeae*
ORF 107 shows 89.4% identity over a 170 aa overlap with a predicted ORF (ORF 107.ng) from *N. gonorrhoeae*:

```
m107/g107

10         20         30         40         50         60
    m107.pep  MVLTFIWAAGGLIADAKPSVLFDTQAPAGTNYWIYAXTALPVCLASFGFHGNVSSLLKYF
              ||||||||:|||:||||||||||||||:||:||||| ||||||||||||||||||||||
    g107      MVLTFIWATGGLVADAKPSVLFDTQAPVGTGYWIYAATALPVCLASFGFHGNVSSLLKYF
                 10         20         30         40         50         60

70         80         90        100        110        120
    m107.pep  KGDAPKVAKSIWTGTLIALVIYVLWQTAIQGNLPRNEFAPVIAAEGQVSVLIETLSKFAQ
              |||||||||||| :|||:||||||||||||:|||||||||||||| |:|||||||||||
    g107      KGDAPKVAKSIWAGTLVALVIYVLWQTAIQSNLPRNEFAPVIAAERQLSVLNETLSKFAQ
                 70         80         90        100        110        120
```

-continued

```
                130       140       150        160       170
m107.pep   TGNMDKILSLFSYMAIATSFLGVTLGLFDYIA-HLQMERQHLRAAPKPPR
           ||:|||||||| ||||||||||||||||| || |||||||::|||||| |
g107       TGGMDKILSLFPYMAIATSFLGVTLGLFDNIAGHLQMERQYVRAAPKPPR
                130       140       150       160       170
```

The following partial DNA sequence was identified in *N. meningitidis* <SEQ ID 379>:

```
a107.seq
  1 ATGGTATTAA CCTTTATTTG GGCAACCGGC GGCCTGATTG CCGATGCCAA

51 ACTGCCCGTC CTCTTCGACA CCCAAGCCCC TACCGGCACC AACTACTGGA

101 TTTATGTCGC CACCGCCCTG CCCGTCTGCC TTGCGTCATT CGGTTTCCAC

151 GGCAACGTCT CCAGCCTGCT CAAATACTTT AAAGGCGACG CGCCCAAAGT

201 GGCTAAATCC ATCTGGACGG GCACACTGAT TGCGCTGGTA ATTTACGTCC

251 TCTGGCAAAC CGCCATCCAA GGCAACCTGC CGCGCAACGA GTTCGCCCCC

301 GTGATTGCCG CCGAAGGGCA AGTCTCCGTC CTGATTGAAA CCCTGTCCAA

351 ATTCGCCCAA ACCGGCAATA TGGACAAAAT ATTGTCCCTG TTTTCCTATA

401 TGGCGATCGC CACCTCGTTT TTAGGCGTAA CGCTCGGACT CTTCGACTAC

451 ATCGCCGACA TCTTCAAATG GAACGACAGC GTGTCCGGCC GCACCAAAAC

501 CGCCGCGCTG ACCTTCCTGC CGCCTCTAAT TTCCTGCCTG CTCTTCGACA

551 CCGGCTTTGT TACCGCCATC GGCTACGTCG GCCTGGCGGC AACCGTCTGG

601 ACAGGCATCA TCCCCGCCAT GCTGCTCTAC CGTTCGCGCA AAAAATTCGG

651 CGCAGGCAAA ACCTATAAAG TTTACGGCGG CTTGTGGCTG ATGGTTTGGG

701 TCTTCCTTTT CGGCATCGTC AACATCGCCG CACAGGTATT GAGCCAAATG

751 GAACTCGTCC CCGTATTTAA AGGATAA
```

This corresponds to the amino acid sequence <SEQ ID 380; ORF 107.a>:

```
a107.pep

1 MVLTFIWATG GLIADAKLPV LFDTQAPTGT NYWIYVATAL PVCLASFGFH

51 GNVSSLLKYF KGDAPKVAKS IWTGTLIALV IYVLWQTAIQ GNLPRNEFAP

101 VIAAEGQVSV LIETLSKFAQ TGNMDKILSL FSYMAIATSF LGVTLGLFDY

151 IADIFKWNDS VSGRTKTAAL TFLPPLISCL LFPTGFVTAI GYVGLAATVW

201 TGIIPAMLLY RSRKKFGAGK TYKVYGGLWL MVWVFLFGIV NIAAQVLSQM

251 ELVPVFKG* m107/a107  94.8% identity in 154 aa overlap 10        20        30        40        50        60
m107.pep    MVLTFIWAAGGLIADAKPSVLFDTQAPAGTNYWIYAXTALPVCLASFGFHGNVSSLLKYF
            ||||||||:||||||||  ||||||||:|||||||: |||||||||||||||||||||||
a107        MVLTFIWATGGLIADAKLPVLFDTQAPTGTNYWIYVATALPVCLASFGFHGNVSSLLKYF
                    10        20        30        40        50        60

70        80        90       100       110       120
m107.pep    KGDAPKVAKSIWTGTLIALVIYVLWQTAIQGNLPRNEFAPVIAAEGQVSVLIETLSKFAQ
            ||||||||||||||||||||||||||||||||||||||||||||||||||||||||||||
a107        KGDAPKVAKSIWTGTLIALVIYVLWQTAIQGNLPRNEFAPVIAAEGQVSVLIETLSKFAQ
                    70        80        90       100       110       120
```

```
                   130         140         150         160         170
m107.pep    TGNMDKILSLFSYMAIATSFLGVTLGLFDYIAHLQMERQHLRAAPKPPRX
            ||||||||||||||||||||||||||||||||||| :
a107        TGNMDKILSLFSYMAIATSFLGVTLGLFDYIADIFKWNDSVSGRTKTAALTFLPPLISCL
                   130         140         150         160         170         180 a107        LFPTGFVTAIGYVGLAATVWTGIIPAMLLYRSRKKFGAGKTYKVYGGLWLMVWVFLFGIV
                   190         200         210         220         230         240
```

The following partial DNA sequence was identified in *N. gonorrhoeae* <SEQ ID 381>:

```
g108.seq
   1 ATGttgccgg gCTTCAACCG GATATTCAaa cggTTTGCTC CAACACTCGG

51 AAcggCGCAT AAAACGCCgc ccTTCGCGTT ATCCCGAACG GGGCGGCTAA

101 TCAGATCCTA TCGCCATAAA AGGCGGGGTT TCAACCGAAA AGGAATTGAG

151 ATGAATAAAA CCTTGTCTAT TTTGCCGGCG GCAATCTTAC TCGGCGGGTG

201 CGCCGCCGGC GGCAACACAT TCGGCAGCTT AGACGGCGGC ACGGGTATGG

251 GTGGCAGCAT CGTCAAAATG ACGGTAGAAA gccAATGCCG TGCGGAATTG

301 GACAGGCGCA GCGAATGGCG TTTGACCGCG CTGGCGATGA GTGCCGAAAA

351 ACAGGCGGAA TGGGAAAACA AGATTTGCGG CTGCGCTACC GAAGAAGCAC

401 CTAACCAGCT GACCGGCAAC GATGTGATGC AGATGCTGAa ccagtccacG

451 CGCaatcagg cacTtgccgc CCtgaccgTC AAAacggtTT CcgcctgcTT

501 CAaacgcctg tACCGCTAa
```

This corresponds to the amino acid sequence <SEQ ID 382; ORF 108.ng>:

```
g108.pep
   1 MLPGFNRIFK RFAPTLGTAH KTPPFALSRT GRLIRSYRHK RRGFNRKGIE

51 MNKTLSILPA AILLGGCAAG GNTFGSLDGG TGMGGSIVKM TVESQCRAEL

101 DRRSEWRLTA LAMSAEKQAE WENKICGCAT EEAPNQLTGN DVMQMLNQST

151 RNQALAALTV KTVSACFKRL YR*
```

The following partial DNA sequence was identified in *N. meningitidis* <SEQ ID 383>:

```
m108.seq
   1 ATGTTGCCGG GCTTCAACCG GATATTCAAA CGGTTTGTTC CAACACTCGG

51 AACGGCGCAT AAAACGCCGC CCTTCGCGTT ATCCCGAACG GGGCGGCTAA

101 TCAGATTCTA TCGCCATAAA AGGCGGGGTT TCAACCGAAA AGGAATTGAG

151 ATGAATAAAA CCTTGTCTAT TTTGCCGGTG GCAATCTTAC TCGGCGGCTG

201 CGCCGCCGGA GGCGGTAACA CATTCGGCAG CTTAGACGGT GGCACAGGCA

251 TGGGCGGCAG CATCGTCAAA ATGGCGGTTG GGAGCCAATG CCGTGCGGAA

301 TTGGACAAAC GCAGCGAATG GCGTTTGACC GCGCTGGCGA TGAGTGCCGA

351 AAAACAGGCG GAGTGGGAAA ACAAGATTTG CGCTTGCGTC GCCCAAGAAG

401 CACCCGAACG GATGACCGGC AACGATGTGA TGCAGATGCT GGCTCCGTCC

451 ACGCGCAATC AGGCACTTGC CGCCCTGACC GCCAAAACGG TTTCCGCCTG

501 CTTCAAACAC CTGTACCGCT AA
```

This corresponds to the amino acid sequence <SEQ ID 384; ORF 108>:

```
m108.pep
  1 MLPGFNRIFK RFVPTLGTAH KTPPFALSRT GRLIRFYRHK RRGFNRKGIE

51 MNKTLSILPV AILLGGCAAG GGNTFGSLDG GTGMGGSIVK MAVGSQCRAE

101 LDKRSEWRLT ALAMSAEKQA EWENKICACV AQEAPERMTG NDVMQMLAPS

151 TRNQALAALT AKTVSACFKH LYR*
```

Computer analysis of this amino acid sequence gave the following results:
Homology with a Predicted ORF from *N. gonorrhoeae*
ORF 108 shows 89.6% identity over a 173 aa overlap with a predicted ORF (ORF 108.ng) from *N. gonorrhoeae*:

```
m108/g108

10         20         30         40         50         60
    m108.pep  MLPGFNRIFKRFVPTLGTAHKTPPFALSRTGRLIRFYRHKRRGFNRKGIEMNKTLSILPV
              ||||||||||:||||||||||||||||||||||| ||||||||||||||||||||||||:
    g108      MLPGFNRIFKRFAPTLGTAHKTPPFALSRTGRLIRSYRHKRRGFNRKGIEMNKTLSILPA
                    10         20         30         40         50         60

70         80         90        100        110        120
    m108.pep  AILLGGCAAGGGNTFGSLDGGTGMGGSIVKMAVGSQCRAELDKRSEWRLTALAMSAEKQA
              ||||||||||||  |||||||||||||||||||:|  ||||||||:||||||||||||||
    g108      AILLGGCAAGG-NTFGSLDGGTGMGGSIVKMTVESQCRAELDRRSEWRLTALAMSAEKQA
                    70         80         90        100        110

130        140        150        160        170
    m108.pep  EWENKICACVAQEAPERMTGNDVMQMLAPSTRNQALAALTAKTVSACFKHLYRX
              ||||||:|:::|||::|||||||||||||:||||||||||||:||||||||:|||
    g108      EWENKICGCATEEAPNQLTGNDVMQMLNQSTRNQALAALTVKTVSACFKRLYRX
                   120        130        140        150        160        170
```

The following partial DNA sequence was identified in *N. meningitidis* <SEQ ID 385>:

```
a108.seq
  1 ATGTTGCCGG GCTTCAACCG GATATTCAAA CGGTTTGTTC CAACACTCGG

51 AACGGCGCAT AAAACGCCGC CCTTCGCGTT ATCCCGAACG GGGCGGCTAA

101 TCAGATTCTA TCGCCATAAA AGGCGGGGTT TCAACCGAAA AGGAATTGAG

151 ATGAATAAAA CCTTGTCTAT TTTGCCGGTG GCAATCTTAC TCGGCGGCTG

201 CGCCGCCGGG GGCGGTAACA CATTCGGCAG CTTAGACGGC GGCACAGGTA

251 TGGGCGGCAG CATCGTCAAA ATGGCGGTAG AAAGCCAATG CCGTGCGGAA

301 TTGAACAAAC GCAGCGAATG GCGTTTGACC GCGCTGGCGA TGAGTGCCGA

351 AAAACAGGCG GAATGGGAAA ACAAGATTTG CGCTTGCGTC GCCCAAGAAG

401 CACCCAACCA GCTGACCGGC AACGATGTGA TGCAGATGCT GGATCCGTCC

451 ACGCGCAATC AGGCACTTGC CGCCCTGACC GCCAAAACGG TTTCCGCCTG

501 CTTCAAACAC CTGTACCGCT AA
```

This corresponds to the amino acid sequence <SEQ ID 386; ORF 108.a>:

```
a108.pep
  1 MLPGFNRIFK RFVPTLGTAH KTPPFALSRT GRLIRFYRHK RRGFNRKGIE

51 MNKTLSILPV AILLGGCAAG GGNTFGSLDG GTGMGGSIVK MAVESQCRAE
```

```
101 LNKRSEWRLT ALAMSAEKQA EWENKICACV AQEAPNQLTG NDVMQMLDPS

151 TRNQALAALT AKTVSACFKH LYR*
``` m108/a108   96.5% identity in 173 aa overlap

```
                 10         20         30         40         50         60
m108.pep  MLPGFNRIFKRFVPTLGTAHKTPPFALSRTGRLIRFYRHKRRGFNRKGIEMNKTLSILPV
          ||||||||||||||||||||||||||||||||||||||||||||||||||||||||||||
a108      MLPGFNRIFKRFVPTLGTAHKTPPFALSRTGRLIRFYRHKRRGFNRKGIEMNKTLSILPV
                 10         20         30         40         50         60

70         80         90        100        110        120
m108.pep  AILLGGCAAGGGNTFGSLDGGTGMGGSIVKMAVGSQCRAELDKRSEWRLTALAMSAEKQA
          |||||||||||||||||||||||||||||||||| ||||||:||||||||||||||||||
a108      AILLGGCAAGGGNTFGSLDGGTGMGGSIVKMAVESQCRAELNKRSEWRLTALAMSAEKQA
                 70         80         90        100        110        120

130        140        150        160        170
m108.pep  EWENKICACVAQEAPERMTGNDVMQMLAPSTRNQALAALTAKTVSACFKHLYRX
          |||||||||||||||:::||||||||| |||||||||||||||||||||||||
a108      EWENKICACVAQEAPNQLTGNDVMQMLDPSTRNQALAALTAKTVSACFKHLYRX
                130        140        150        160        170
```

The following partial DNA sequence was identified in *N. gonorrhoeae* <SEQ ID 387>:

```
g109.seq
  1 ATGTATTATC GCCGGGTTGT GGGGCTATCC GATGGACTTG GCGATTTGGC

51 AGCCGGTATT GATCGTAGGC GTATGCTTAC CGCTTTTGGA AGCGGGCATG

101 GAAATGACGC GCAAAGGCAA AACCACCCAA TCCGCCGCCA TCGTGGTGTT

151 CTCTTCCGTC TGGTCAATCC GGTTTTCGGC TGGGCGTTGA CGATGCTGTT

201 GGATAATTTG GCTTAATCG GCTGCAAAGA ACGCAGCGCG CAATTAGGTT

251 TTGTCGGACG AGTATTGATA CCCGCAGTAG GTTTCTTAAT CTTGTGTGTG

301 GCGATGGGTG CGGTCGGGAT GCTGCCCGGT ATCCCTCCGT TTTTGGAGCA

351 GTTCAAATCT TTGGGCTAG
```

This corresponds to the amino acid sequence <SEQ ID 388; ORF 109.ng>:

```
g109.pep
  1 MYYRRVVGLS DGLGDLAAGI DRRRMLTAFG SGHGNDAQRQ NHPIRRHRGV

51 LFRLVNPVFG WALTMLLDNL GLIGCKERSA QLGFVGRVLI PAVGFLILCV

101 AMGAVGMLPG IPPFLEQFKS LG
```

The following partial DNA sequence was identified in *N. meningitidis* <SEQ ID 389>:

```
m109.seq
  1 ATGTATTATC GCCGGGTTAT GGGGCTATCC GATGGACTTG GCGATTTGGC

51 AGCCGGTATT GAGCGTAGCC TTGGTCGTAG GCGTATACTT ACCGCTTTTG

101 GAAGCGGGCA TGGAAATGAC GCGCAAAGGC AAAACCACCC AATCCGCCGC

151 CATCGTGGTG TTCTCTTCCG CCTTGTCAAT CCGGTTTTCG GCTGGGCGTT

201 GACGATGCTG TTGGATAATT TGGGCTTAAT CGGCTGCAAA GAGCGCAGTG

251 CGCAATTAGG TTTCGCCGGA CGCGTGTTGA TACCCGCAGT AGGTTTCTTG

301 ATCTTGTGTG TGGCGATGGG TGCGGTCGGG ATGCTGCCCG GTATCCCGCC

351 GTTTTTGGAA CACTTCAAAT CTTTGGGCTA G
```

This corresponds to the amino acid sequence <SEQ ID 4; ORF 109>:

```
m109.pep
  1 MYYRRVMGLS DGLGDLAAGI ERSLGRRRIL TAFGSGHGND AQRQNHPIRR

51 HRGVLFRLVN PVFGWALTML LDNLGLIGCK ERSAQLGFAG RVLIPAVGFL

101 ILCVAMGAVG MLPGIPPFLE HFKSLG*
```

Computer analysis of this amino acid sequence gave the following results:
Homology with a Predicted ORF from *N. gonorrhoeae*
ORF 109 shows 92.9% identity over a 126 aa overlap with a predicted ORF (ORF 109.ng) from *N. gonorrhoeae*:

```
    m109/g109

10         20         30         40         50         60
       m109.pep  MYYRRVMGLSDGLGDLAAGIERSLGRRRILTAFGSGHGNDAQRQNHPIRRHRGVLFRLVN
                 ||||||:||||||||||||||:|    ||:||||||||||||||||||||||||||||||
       g109      MYYRRVVGLSDGLGDLAAGIDR----RRMLTAFGSGHGNDAQRQNHPIRRHRGVLFRLVN
                    10         20         30         40         50

70         80         90        100        110        120
       m109.pep  PVFGWALTMLLDNLGLIGCKERSAQLGFAGRVLIPAVGFLILCVAMGAVGMLPGIPPFLE
                 ||||||||||||||||||||||||||||||:|||||||||||||||||||||||||||||
       g109      PVFGWALTMLLDNLGLIGCKERSAQLGFVGRVLIPAVGFLILCVAMGAVGMLPGIPPFLE
                    60         70         80         90        100        110 m109.pep  HFKSLGX
                 :|||||
       g109      QFKSLGX
                    120
```

The following partial DNA sequence was identified in *N. meningitidis* <SEQ ID 391>:

```
a109.seq
  1 ATGTATTATC GCCGGGTTGT GGGGCTATCC GATGGACTTG GCGATTTGGC

51 AGCCGGTATT GAGCGTAGCC TTGGTCGTAG GCGTATACTT ACCGCTTTTG

101 GAAGCGGGCA TGGAAATGAC GCGCAAAGGC AAAACCACCC AATCCGCCGC

151 CACCGTGGTG TTCTCTTCCG CTTGGTCAAT CCGGTTTTCG GCTGGGCGTT

201 GACGATGCTG TTGGATAATT TGGGCTTAAT CGGCTGCAAA GAGCGCAGCG

251 CGCAATTAGG TTTCACCGGA CGCGTATTGA TACCCGTAGT AGGTTTCTTG

301 ATCTTGTGTG TGGCGATGGG TGCGGTCGGG ATGCTGCCCG GTATCCCGCC

351 GTTTTTGGAG CACTTCAAAT CTTTGGGCTA G
```

This corresponds to the amino acid sequence <SEQ ID 392; ORF 109>:

```
a109.pep
  1 MYYRRVVGLS DGLGDLAAGI ERSLGRRRIL TAFGSGHGND AQRQNHPIRR

51 HRGVLFRLVN PVFGWALTML LDNLGLIGCK ERSAQLGFTG RVLIPVVGFL

101 ILCVAMGAVG MLPGIPPFLE HFKSLG*
```

-continued
m109/a109 97.6% identity in 126 aa overlap

```
                 10        20        30        40        50        60
   m109.pep  MYYRRVMGLSDGLGDLAAGIERSLGRRRILTAFGSGHGNDAQRQNHPIRRHRGVLFRLVN
             ||||||:||||||||||||||||||||||||||||||||||||||||||||||||||||
   a109      MYYRRVVGLSDGLGDLAAGIERSLGRRRILTAFGSGHGNDAQRQNHPIRRHRGVLFRLVN
                 10        20        30        40        50        60

70        80        90       100       110       120
   m109.pep  PVFGWALTMLLDNLGLIGCKERSAQLGFAGRVLIPAVGFLILCVAMGAVGMLPGIPPFLE
             |||||||||||||||||||||||||||||||:||||:|||||||||||||||||||||||
   a109      PVFGWALTMLLDNLGLIGCKERSAQLGFTGRVLIPVVGFLILCVAMGAVGMLPGIPPFLE
                 70        80        90       100       110       120 m109.pep  HFKSLGX
             |||||||
   a109      HFKSLGX
```

The following partial DNA sequence was identified in *N. gonorrhoeae* <SEQ ID 393>:

```
g111.seq
   1 ATGCCGTCTG AAACACGCCT GCCGAACCTT ATCCGCGCCT TGATATTTGC

51 CCTGGGTTTC ATCTTCCTGA ACGCCTGTTC GGaacaaacC GCGCAaaccg

101 TTACCCTGCA AGGCGAAACG ATGGGTACGA CCtATACCGT CAAATACCTT

151 TCAAATAATC GGGACAAACT CCCCTCCCCT GCCAAAATAC AAAAGCGCAT

201 TGATGATGCG CTTAAAGAAG TCAACCGGCA GATGtccaCC TACCAGACCG

251 ATTCCGAAAT CAGCCGGTTt atacagacan atgctggaga gctcttcgcg 301 tntcatgcag nttctataac tgattccgcc gaagactgtc tgcctaatac 351 gcctatctca tcggcgctct ga
```

This corresponds to the amino acid sequence <SEQ ID 394; ORF 111.ng>:

```
g111.pep
   1 MPSETRLPNL IRALIFALGF IFLNACSEQT AQTVTLQGET MGTTYTVKYL

51 SNNRDKLPSP AKIQKRIDDA LKEVNRQMST YQTDSEISRF IQTAGELFAH

101 ASITDSAEDC LPNTPISSAL *
```

The following partial DNA sequence was identified in *N. meningitidis* <SEQ ID 395>:

```
m111.seq
   1 ATGCCGTCTG AAACACGCCT GCCGAACTTT ATCCGCGTCT TGATATTTGC

51 CCTGGGTTTC ATCTTCCTGA ACGCCTGTTC GGAACAAACC GCGCAAACCG

101 TTACCCTGCA AGGCGAAACG ATGGGCACGA CCTATAyCGT CAAATACCTT

151 TCAAATAATC GGGACAAACT CCCCTCACCT GCCGAAATAC AwAAACGCAT

201 CGATGACGCG CTTAAAGAAk TCAACCGGyA GATGTCCACC TATCAGCCCG

251 ACTCCGAAAT CAGCCGGTTC AACCAACACA CAGCCGGCAA GCCCCTCCGC

301 ATTTCAAGCG ACTTCGCACA CGTTACTGCC GAAGCCGTCC GCCTGAACCG

351 CCTGACACAC GGCGCGCTGG ACGTAACCGT CGGCCCCTTG GTCAACCTTT

401 GGGGATTCGG CCCCGACAAA TCCGTTACCC GTGAACCGTC GCCGGAACAA

451 ATCAAACAGG CGGCATCTTA TACGGGCATA GACAAAATCA TTTTGAAACA
```

```
-continued
 501 AGGCAAAGAT TACGCTTCCT TGAGCAAAAC CCACCCCAAG GCCTATTTGG

551 ATTTATCTTC GATTGCCAAA GGCTTCGGCG TTGATAAAGT TGCGGGCGAA

601 CTGGAAAAAT ACGGCATTCA AAATTATCTG GTCGAAATCG GCGGCGAGTT

651 GCACGGCAAA GGCAAAAACG CGCGCGGCGA ACCGTGGCGC ATCGGTATCG

701 AGCAGCCCAA TATCGTCCAA GGCGGCAATA CGCAGATTAT CGTCCCGCTG

751 AACAACCGTT CGCTTGCCAC TTCCGGCGAT TACCGTATTT TCCACGTCGA

801 TAAAAACGGC AAACGCCTCT CCCATATCAT CAACCCGAAC AACAAACGAC

851 CCATCAGCCA CAACCTCGCC TCCATCAGCG TGGTCGCAGA CAGTGCGATG

901 ACGGCGGACG GCTTGTCCAC AGGATTATTC GTATTGGGCG AAACCGAAGC

951 CTTAAAGCTG GCAGAGCGCG AAAAACTCGC TGTTTTCCTG ATTGTCAGGG

1001 ATAAAGGCGG cTACCGCACC GCCATGTCTT CCGAATTTGA AAAACTGcTC

1051 CGCTAA
```

This corresponds to the amino acid sequence <SEQ ID 396; ORF 111>:

```
m111.pep
  1 MPSETRLPNF IRVLIFALGF IFLNACSEQT AQTVTLQGET MGTTYXVKYL

51 SNNRDKLPSP AEIXKRIDDA LKEXNRXMST YQPDSEISRF NQHTAGKPLR

101 ISSDFAHVTA EAVRLNRLTH GALDVTVGPL VNLWGFGPDK SVTREPSPEQ

151 IKQAASYTGI DKIILKQGKD YASLSKTHPK AYLDLSSIAK GFGVDKVAGE

201 LEKYGIQNYL VEIGGELHGK GKNARGEPWR IGIEQPNIVQ GGNTQIIVPL

251 NNRSLATSGD YRIFHVDKNG KRLSHIINPN NKRPISHNLA SISVVADSAM

301 TADGLSTGLF VLGETEALKL AEREKLAVFL IVRDKGGYRT AMSSEFEKLL

351 R*
```

ORF 111 shows 88.7% identity over a 97 aa overlap with a predicted ORF (ORF 111.ng) from *N. gonorrhoeae*:

```
m111.pep/g111.pep
                  10         20         30         40         50         60
      m111.pep  MPSETRLPNFIRVLIFALGFIFLNACSEQTAQTVTLQGETMGTTYXVKYLSNNRDKLPSP
                ||||||||||:||:||||||||||||||||||||||||||||||:|||||||||||||||
      g111      MPSETRLPNLIRALIFALGFIFLNACSEQTAQTVTLQGETMGTTYTVKYLSNNRDKLPSP
                  10         20         30         40         50         60

70         80         90        100        110        120
      m111.pep  AEIXKRIDDALKEXNRXMSTYQPDSEISRFNQHTAGKPLRISSDFAHVTAEAVRLNRLTH
                |:| ||||||||||  || |||||  |||||||  |  | |   :||:
      g111      AKIQKRIDDALKEVNRQMSTYQTDSEISRFIQTXAGELFAXHAXSITDSAEDCLPNTPIS
                  70         80         90        100        110        120

130        140        150        160        170        180
      m111.pep  GALDVTVGPLVNLWGFGPDKSVTREPSPEQIKQAASYTGIDKIILKQGKDYASLSKTHPK g111      SALX
```

The following partial DNA sequence was identified in *N. meningitidis* <SEQ ID 397>:

```
a111.seq
  1 ATGCCGTCTG AAACACGCCT GCCGAACTTT ATCCGCACCT TGATATTTGC

51 CCTGAGTTTT ATCTTCCTGA ACGCCTGTTC GGAACAAACC GCGCAAACCG
```

```
 101 TTACCCTGCA AGGTGAAACG ATGGGCACGA CCTATACCGT CAAATACCTT

151 TCAAATAATC GGGACAAACT CCCCTCACCT GCCGAAATAC AAAAGCGCAT

201 CGATGACGCG CTTAAAGAAG TCAACCGGCA GATGTCCACC TATCAGCCCG

251 ACTCCGAAAT CAGCCGGTTC AACCAACACA CAGCCGGCAA GCCCCTCCGC

301 ATTTCAAGCG ACTTCGCACA CGTTACTGCC GAAGCCGTCC ACCTGAACCG

351 CCTGACACAC GGCGCGCTGG ACGTAACCGT CGGCCCCTTG GTCAACCTTT

401 GGGGATTCGG CCCCGACAAA TCCGTTACCC GTGAACCGTC GCCGGAACAA

451 ATCAAACAAG CAGCATCTTA TACGGGCATA GACAAAATCA TTTTGAAACA

501 AGGCAAAGAT TACGCTTCCT TGAGCAAAAC CCACCCCAAG GCCTATTTGG

551 ATTTATCTTC GATTGCCAAA GGCTTCGGCG TTGATAAAGT TGCGGGCGAA

601 CTGGAAAAAT ACGGCATTCA AAATTATCTG GTCGAAATCG GCGGCGAGTT

651 GCACGGCAAA GGCAAAAACG CGCGCGGCGA ACCTTGGCGC ATCGGCATCG

701 AACAGCCCAA CATCGTCCAA GGCGGCAATA CGCAGATTAT CGTCCCGCTG

751 AACAACCGTT CGCTTGCCAC TTCCGGCGAT TACCGTATTT TCCACGTCGA

801 TAAAAGCGGC AAACGCCTCT CCCATATCAT TAATCCGAAC AACAAACGAC

851 CCATCAGCCA CAACCTCGCC TCCATCAGCG TGGTCGCAGA CAGTGCGATG

901 ACGGCGGACG GCTTGTCCAC AGGATTATTC GTATTGGGCG AAACCGAAGC

951 CTTAAAGCTG GCAGAGCGCG AAAAACTCGC TGTTTTCCTG ATTGTCAGGG

1001 ATAAAGGCGG CTACCGCACC GCCATGTCTT CCGAATTTGA AAAACTGCTC

1051 CGCTAA
```

This corresponds to the amino acid sequence <SEQ ID 398; ORF 111.a>:

```
a111.pep
   1 MPSETRLPNF IRTLIFALSF IFLNACSEQT AQTVTLQGET MGTTYTVKYL
  51 SNNRDKLPSP AEIQKRIDDA LKEVNRQMST YQPDSEISRF NQHTAGKPLR
 101 ISSDFAHVTA EAVHLNRLTH GALDVTVGPL VNLWGFGPDK SVTREPSPEQ
 151 IKQAASYTGI DKIILKQGKD YASLSKTHPK AYLDLSSIAK GFGVDKVAGE
 201 LEKYGIQNYL VEIGGELHGK GKNARGEPWR IGIEQPNIVQ GGNTQIIVPL
 251 NNRSLATSGD YRIFHVDKSG KRLSHIINPN NKRPISHNLA SISVVADSAM
 301 TADGLSTGLF VLGETEALKL AEREKLAVFL IVRDKGGYRT AMSSEFEKLL
 351 R* m111/a111  97.7% identity in 351 aa overlap 10         20         30         40         50         60
   m111.pep   MPSETRLPNFIRVLIFALGFIFLNACSEQTAQTVTLQGETMGTTYXVKYLSNNRDKLPSP
              ||||||||||:|||| :||||:|||||||||||||||||||||||| ||||||||||||
   a111       MPSETRLPNFIRTLIFALSFIFLNACSEQTAQTVTLQGETMGTTYTVKYLSNNRDKLPSP
                      10         20         30         40         50         60

70         80         90        100        110        120
   m111.pep   AEIXKRIDDALKEXNRXMSTYQPDSEISRFNQHTAGKPLRISSDFAHVTAEAVRLNRLTH
              |||  ||||||||| ||  ||||||||||||||||||||||||||||||||||:|||||
   a111       AEIQKRIDDALKEVNRQMSTYQPDSEISRFNQHTAGKPLRISSDFAHVTAEAVHLNRLTH
                      70         80         90        100        110        120

130        140        150        160        170        180
   m111.pep   GALDVTVGPLVNLWGFGPDKSVTREPSPEQIKQAASYTGIDKIILKQGKDYASLSKTHPK
              ||||||||||||||||||||||||||||||||||||||||||||||||||||||||||||
   a111       GALDVTVGPLVNLWGFGPDKSVTREPSPEQIKQAASYTGIDKIILKQGKDYASLSKTHPK
                     130        140        150        160        170        180
```

```
                       190        200        210        220        230        240
   m111.pep  AYLDLSSIAKGFGVDKVAGELEKYGIQNYLVEIGGELHGKGKNARGEPWRIGIEQPNIVQ
              ||||||||||||||||||||||||||||||||||||||||||||||||||||||||||||
   a111      AYLDLSSIAKGFGVDKVAGELEKYGIQNYLVEIGGELHGKGKNARGEPWRIGIEQPNIVQ
                       190        200        210        220        230        240

250        260        270        280        290        300
   m111.pep  GGNTQIIVPLNNRSLATSGDYRIFHVDKNGKRLSHIINPNNKRPISHNLASISVVADSAM
              |||||||||||||||||||||||||||||||:||||||||||||||||||||||||||||
   a111      GGNTQIIVPLNNRSLATSGDYRIFHVDKSGKRLSHIINPNNKRPISHNLASISVVADSAM
                       250        260        270        280        290        300

310        320        330        340        350
   m111.pep  TADGLSTGLFVLGETEALKLAEREKLAVFLIVRDKGGYRTAMSSEFEKLLRX
              ||||||||||||||||||||||||||||||||||||||||||||||||||||
   a111      TADGLSTGLFVLGETEALKLAEREKLAVFLIVRDKGGYRTAMSSEFEKLLRX
                       310        320        330        340        350
```

The following partial DNA sequence was identified in *N. gonorrhoeae* <SEQ ID 399>:

```
g111-1.seq
   1 ATGCCGTCTG AAACACGCCT GCCGAACCTT ATCCGCGCCT TGATATTTGC

51 CCTGGGTTTC ATCTTCCTGA ACGCCTGTTC GGAACAAACC GCGCAAacCG

101 TTACCCTGCA AGGCGAAACG ATGGGTACGA CCTATACCGT CAAATACCTT

151 TCAAATAATC GGGACAAACT CCCCTCCCCT GCCAAAATAC AAAAGCGCAT

201 TGATGATGCG CTTAAAGAAG TCAACCGGCA GATGTCCACC TACCAGACCG

251 ATTCCGAAAT CAGCCGGTTC AACCAACACA CAGCCGGCAA GCCCCTCCGC

301 ATTTCAAGCG ATTTCGCACA CGTTACCGCC GAAGCCGTCC GCCTGAACCG

351 CCTGACTCAC GGCGCACTGG ACGTAACCGT CGGCCCTTTG GTCAACCTTT

401 GGGGGTTCGG CCCCGACAAA TCCGTTACCC GTGAACCGTC GCCGGAACAA

451 ATCAAACAGG CGGCATCTTA TACGGGCATA GACAAAATCA TTTTGCAACA

501 AGGCAAAGAT TACGCTTCCT TGAGCAAAAC CCACCCCAAA GCCTATTTGG

551 ATTTATCTTC GATTGCCAAA GGCTTCGGCG TTGATAAAGT TGCGGGCGAA

601 CTGGAAAAAT ACGGCATTCA AAATTATCTG GTCGAAATCG GCggcGAGTT

651 GCACGGCAAA GGCAAAAATG CGCACGGCGA ACCGTGGCGC ATCGGTATAG

701 AGCAACCCAA TATcatccaa ggcggcaata cgcAGattat cgtcccgctg 751 aaCaaccgtt cgcttgccac ttccggcgAT taccgtaTTT tccacgtcgA 801 TAAAAACGGC Aaacgcccttt cccacATCAT CAATCCCAAC AACAAACGAC 851 CCATCAGcCA CAAcctcgcc tcCATCAgCg TGGTCTCAGA CAGTGCAATG

901 ACGGCGGACG GTTTATCCAC AGGATTATTT GTTTTAGGCG AAACCGAAGC

951 CTTAAGGCTG GCAGAACAAG AAAAACTCGC TGTTTTCCTA ATTGTCCGGG

1001 ATAAGGACGG CTACCGCACC GCCATGTCTT CCGAATTTGC CAAGCTGCTC

1051 CGCTAA
```

This corresponds to the amino acid sequence <SEQ ID 400; ORF 111-1.ng>:

```
g111-1.pep
   1 MPSETRLPNL IRALIFALGF IFLNACSEQT AQTVTLQGET MGTTYTVKYL

51 SNNRDKLPSP AKIQKRIDDA LKEVNRQMST YQTDSEISRF NQHTAGKPLR

101 ISSDFAHVTA EAVRLNRLTH GALDVTVGPL VNLWGFGPDK SVTREPSPEQ
```

```
151  IKQAASYTGI DKIILQQGKD YASLSKTHPK AYLDLSSIAK GFGVDKVAGE

201  LEKYGIQNYL VEIGGELHGK GKNAHGEPWR IGIEQPNIIQ GGNTQIIVPL

251  NNRSLATSGD YRIFHVDKNG KRLSHIINPN NKRPISHNLA SISVVSDSAM

301  TADGLSTGLF VLGETEALRL AEQEKLAVFL IVRDKDGYRT AMSSEFAKLL

351  R*
```

The following partial DNA sequence was identified in *N. meningitidis* <SEQ ID 401>:

```
m111-1.seq
   1 ATGCCGTCTG AAACACGCCT GCCGAACTTT AT

-continued

```
301 TADGLSTGLF VLGETEALKL AEREKLAVFL IVRDKGGYRT AMSSEFEKLL

351 R* m111-1/g111-1  96.6% identity in 351 aa overlap 10         20         30         40         50         60
m111-1.pep  MPSETRLPNFIRVLIFALGFIFLNACSEQTAQTVTLQGETMGTTYTVKYLSNNRDKLPSP
            ||||||||||:||:||||||||||||||||||||||||||||||||||||||||||||||
g111-1      MPSETRLPNLIRALIFALGFIFLNACSEQTAQTVTLQGETMGTTYTVKYLSNNRDKLPSP
                     10         20         30         40         50         60

70         80         90        100        110        120
m111-1.pep  AEIQKRIDDALKEVNRQMSTYQPDSEISRFNQHTAGKPLRISSDFAHVTAEAVRLNRLTH
            |:|||||||||||||||||||||:||||||||||||||||||||||||||||||||||||
g111-1      AKIQKRIDDALKEVNRQMSTYQTDSEISRFNQHTAGKPLRISSDFAHVTAEAVRLNRLTH
                     70         80         90        100        110        120

130        140        150        160        170        180
m111-1.pep  GALDVTVGPLVNLWGFGPDKSVTREPSPEQIKQAASYTGIDKIILKQGKDYASLSKTHPK
            ||||||||||||||||||||||||||||||||||||||||||||:|||||||||||||||
g111-1      GALDVTVGPLVNLWGFGPDKSVTREPSPEQIKQAASYTGIDKIILQQGKDYASLSKTHPK
                    130        140        150        160        170        180

190        200        210        220        230        240
m111-1.pep  AYLDLSSIAKGFGVDKVAGELEKYGIQNYLVEIGGELHGKGKNARGEPWRIGIEQPNIVQ
            ||||||||||||||||||||||||||||||||||||||||||||:|||||||||||||:|
g111-1      AYLDLSSIAKGFGVDKVAGELEKYGIQNYLVEIGGELHGKGKNAHGEPWRIGIEQPNIIQ
                    190        200        210        220        230        240

250        260        270        280        290        300
m111-1.pep  GGNTQIIVPLNNRSLATSGDYRIFHVDKNGKRLSHIINPNNKRPISHNLASISVVADSAM
            ||||||||||||||||||||||||||||||||||||||||||||||||||||||:||||
g111-1      GGNTQIIVPLNNRSLATSGDYRIFHVDKNGKRLSHIINPNNKRPISHNLASISVVSDSAM
                    250        260        270        280        290        300

310        320        330        340        350
m111-1.pep  TADGLSTGLFVLGETEALKLAEREKLAVFLIVRDKGGYRTAMSSEFEKLLRX
            ||||||||||||||||||:|||:|||||||||||||| ||||||||:||||||
g111-1      TADGLSTGLFVLGETEALRLAEQEKLAVFLIVRDKDGYRTAMSSEFAKLLRX
                    310        320        330        340        350 g111-1 (SEQ ID 400)/p44550 (SEQ ID 4161)
sp|P44550|YOJL_HAEIN HYPOTHETICAL LIPOPROTEIN HI0172 PRECURSOR >gi|1074292|pir||C64144
hypothetical protein HI0172 - Haemophilus influenzae (strain Rd KW20) > gi|1573128 (U32702)
lipoprotein, putative [Haemophilus influenzae Rd] Length = 346
Score = 349 bits (885), Expect = 2e - 95
Identities = 177/328 (53%), Positives = 240/328 (72%), Gaps = 4/328 (1%)

Query:  23  LNACSEQTAQTVTLQGETMGTTYXVKYLSNNRDKLPSPAEIXKRIDDALKEXNRXMSTYQ   82
            L AC ++T + ++L G+TMGTTY VKYL +     S +  + I+  LK+ N  MSTY+
Sbjct:  17  LAACQKET-KVISLSGKTMGTTYHVKYLDDGSITATS-EKTHEEIEAILKDVNAKMSTYK   74

Query:  83  PDSEISRFNQHT-AGKPLRISSDFAHVTAEAVRLNRLTHGALDVTVGPLVNLWGFGPDKS  141
              DSE+SRFNQ+T   P+ IS+DFA V AEA+RLN++T GALDVTVGP+VNLWGFGP+K
Sbjct:  75  KDSELSRFNQNTQVNTPIEISADFAKVLAEAIRLNKVTEGALDVTVGPVVNLWGFGPEKR  134

Query: 142  VTREPSPEQIKQAASYTGIDKIILKQGKDYASLSKTHPKAYLDLSSIAKGFGVDKVAGEL  201
             ++P+PEQ+ +  ++ GIDKI L   K+ A+LSK  P+ Y+DLSSIAKGFGVD+VA +L
Sbjct: 135  PEKQPTPEQLAERQAWVGIDKITLDTNKEKATLSKALPQVYVDLSSIAKGFGVDQVAEKL  194

Query: 202  EKYGIQNYLVEIGGELHGKGKNARGEPWRIGIEQPNIVQGGNTQIIVPLNNRSLATSGDY  261
            E+   QNY+VEIGGE+  KGKN  G+PW+I IE+P    ++ LNN  +A+SGDY
Sbjct: 195  EQLNAQNYMVEIGGEIRAKGKNIEGKPWQIAIEKPTTTGERAVEAVIGLNNMGMASSGDY  254

Query: 262  RIFHVDKNGKRLSHIINPNNKRPISHNLASISVVADSAMTADGLSTGLFVLGETEALKLA  321
            RI+  ++NGKR +H I+P    PI H+LASI+V+A ++MTADGLSTGLFVLGE +AL++A
Sbjct: 255  RIY-FEENGKRFAHEIDPKTGYPIQHHLASITVLAPTSMTADGLSTGLFVLGEDKALEVA  313

Query: 322  EREKLAVFLIVRDKGGYRTAMSSEFEKL  349
            E+  LAV+LI+R   G+ T  SS F+KL
Sbjct: 314  EKNNLAVYLIIRTDNGFVTKSSSAFKKL  341
```

The following partial DNA sequence was identified in *N. meningitidis* <SEQ ID 403>:

```
a111-1.seq
  1 ATGCCGTCTG AAACACGCCT GCCGAACTTT ATCCGCACCT TGATATTTGC

51 CCTGAGTTTT ATCTTCCTGA ACGCCTGTTC GGAACAAACC GCGCAAACCG

101 TTACCCTGCA AGGTGAAACG ATGGGCACGA CCTATACCGT CAAATACCTT

151 TCAAATAATC GGGACAAACT CCCCTCACCT GCCGAAATAC AAAAGCGCAT
```

```
-continued
 201 CGATGACGCG CTTAAAGAAG TCAACCGGCA GATGTCCACC TATCAGCCCG

251 ACTCCGAAAT CAGCCGGTTC AACCAACACA CAGCCGGCAA GCCCCTCCGC

301 ATTTCAAGCG ACTTCGCACA CGTTACTGCC GAAGCCGTCC ACCTGAACCG

351 CCTGACACAC GGCGCGCTGG ACGTAACCGT CGGCCCCTTG GTCAACCTTT

401 GGGGATTCGG CCCCGACAAA TCCGTTACCC GTGAACCGTC GCCGGAACAA

451 ATCAAACAAG CAGCATCTTA TACGGGCATA GACAAAATCA TTTTGAAACA

501 AGGCAAAGAT TACGCTTCCT TGAGCAAAAC CCACCCCAAG GCCTATTTGG

551 ATTTATCTTC GATTGCCAAA GGCTTCGGCG TTGATAAAGT TGCGGGCGAA

601 CTGGAAAAAT ACGGCATTCA AAATTATCTG GTCGAAATCG GCGGCGAGTT

651 GCACGGCAAA GGCAAAAACG CGCGCGGCGA ACCTTGGCGC ATCGGCATCG

701 AACAGCCCAA CATCGTCCAA GGCGGCAATA CGCAGATTAT CGTCCCGCTG

751 AACAACCGTT CGCTTGCCAC TTCCGGCGAT TACCGTATTT CCACGTCGA

801 TAAAAGCGGC AAACGCCTCT CCCATATCAT TAATCCGAAC AACAAACGAC

851 CCATCAGCCA CAACCTCGCC TCCATCAGCG TGGTCGCAGA CAGTGCGATG

901 ACGGCGGACG GCTTGTCCAC AGGATTATTC GTATTGGGCG AAACCGAAGC

951 CTTAAAGCTG GCAGAGCGCG AAAAACTCGC TGTTTTCCTG ATTGTCAGGG

1001 ATAAAGGCGG CTACCGCACC GCCATGTCTT CCGAATTTGA AAAACTGCTC

1051 CGCTAA
```

This corresponds to the amino acid sequence <SEQ ID 404; ORF 111-1.a>:

```
a111-1.pep

1   MPSETRLPNF IRTLIFALSF IFLNACSEQT AQTVTLQGET MGTTYTVKYL

51   SNNRDKLPSP AEIQKRIDDA LKEVNRQMST YQPDSEISRF NQHTAGKPLR

101   ISSDFAHVTA EAVHLNRLTH GALDVTVGPL VNLWGFGPDK SVTREPSPEQ

151   IKQAASYTGI DKIILKQGKD YASLSKTHPK AYLDLSSIAK GFGVDKVAGE

201   LEKYGIQNYL VEIGGELHGK GKNARGEPWR IGIEQPNIVQ GGNTQIIVPL

251   NNRSLATSGD YRIFHVDKSG KRLSHIINPN NKRPISHNLA SISVVADSAM

301   TADGLSTGLF VLGETEALKL AEREKLAVFL IVRDKGGYRT AMSSEFEKLL

351   R* a111-1/m111-1  98.9% identity in 351 aa overlap 10         20         30         40         50         60
     a111-1.pep  MPSETRLPNFIRTLIFALSFIFLNACSEQTAQTVTLQGETMGTTYTVKYLSNNRDKLPSP
                 ||||||||||:||||:|||||||||||||||||||||||||||||||||||||||||||
     m111-1      MPSETRLPNFIRVLIFALGFIFLNACSEQTAQTVTLQGETMGTTYTVKYLSNNRDKLPSP
                      10         20         30         40         50         60

70         80         90        100        110        120
     a111-1.pep  AEIQKRIDDALKEVNRQMSTYQPDSEISRFNQHTAGKPLRISSDFAHVTAEAVHLNRLTH
                 |||||||||||||||||||||||||||||||||||||||||||||||||||||:|||||
     m111-1      AEIQKRIDDALKEVNRQMSTYQPDSEISRFNQHTAGKPLRISSDFAHVTAEAVRLNRLTH
                      70         80         90        100        110        120

130        140        150        160        170        180
     a111-1.pep  GALDVTVGPLVNLWGFGPDKSVTREPSPEQIKQAASYTGIDKIILKQGKDYASLSKTHPK
                 ||||||||||||||||||||||||||||||||||||||||||||||||||||||||||||
     m111-1      GALDVTVGPLVNLWGFGPDKSVTREPSPEQIKQAASYTGIDKIILKQGKDYASLSKTHPK
                     130        140        150        160        170        180
```

```
                     190        200        210        220        230        240
a111-1.pep  AYLDLSSIAKGFGVDKVAGELEKYGIQNYLVEIGGELHGKGKNARGEPWRIGIEQPNIVQ
            ||||||||||||||||||||||||||||||||||||||||||||||||||||||||||||
m111-1      AYLDLSSIAKGFGVDKVAGELEKYGIQNYLVEIGGELHGKGKNARGEPWRIGIEQPNIVQ
                     190        200        210        220        230        240

250        260        270        280        290        300
a111-1.pep  GGNTQIIVPLNNRSLATSGDYRIFHVDKSGKRLSHIINPNNKRPISHNLASISVVADSAM
            ||||||||||||||||||||||||||||||||:|||||||||||||||||||||||||||
m111-1      GGNTQIIVPLNNRSLATSGDYRIFHVDKNGKRLSHIINPNNKRPISHNLASISVVADSAM
                     250        260        270        280        290        300

310        320        330        340        350
a111-1.pep  TADGLSTGLFVLGETEALKLAEREKLAVFLIVRDKGGYRTAMSSEFEKLLRX
            |||||||||||||||||||||||||||||||||||||||||||||||||||
m111-1      TADGLSTGLFVLGETEALKLAEREKLAVFLIVRDKGGYRTAMSSEFEKLLRX
                     310        320        330        340        350
```

The following partial DNA sequence was identified in *N. gonorrhoeae* <SEQ ID 405>:

```
g114.seq
  1  ATGGCTTCCA TCACTTCGCC GCTGCACGGGG CGCAGCAGG AATGCAGCAA

51  GACTTTTTTA TGTCCGCCGG GCGGGACGAGT ATGGGGCGG TCAATGTCGG

101  TAACGGTAGG TTTGTTTTGT GTTTCCATTAA CTTAACAAT ATCTGTCGAA

151  TACGGTCAAA GCGGCTATTT TACCAGAGCCG CCGAATGTA AAACAGGGTG

201  TCAGGGCATC AGCCCGAGCT GCCTGAACGAA CGGACGGTT TGCGAGGTAA

251  CGATAAAATG GTCGAGCAGC GAAACATCAAC CAGCGACAT GGCCTGTGCC

301  AGCCGCCTTG TGAACATGAT GTCTTCCTGCG AAGGTTCAG GCGAGCCGCC

351  CGGATGGTTG TGCGCGATAA TCAGGCTGTCG GCATATTCG TCCAATGCCA

401  GTTTGACGAT TTCGCGGATG TAA
```

This corresponds to the amino acid sequence <SEQ ID 406; ORF 114.ng>:

```
g114.pep
  1  MASITSPLHG AQQECSKTFL CPPGGTSMGR SMSVTVGLFC VSINLTISVE

51  YGQSGYFTRA AECKTGCQGI SPSCLNERTV CEVTIKWSSS ETSTSDMACA

101  SRLVNMMSSC EGSGEPPGWL CAIIRLSAYS SNASLTISRM *
```

The following partial DNA sequence was identified in *N. meningitidis* <SEQ ID 407>:

```
m114.seq
  1  ATGGCTTCCA TCACTTCGCC GCTGCACGGG GCGCACAGAG AATGCAGCAA

51  GACTTTTTTA TGTCCACCGG GCGGGACGAG TATAGGGCGG TCAATGTCGG

101  TAACGGTAGG TTTGTTTTGT GTTTCCATTA ACTTAACAAT ATCTGTTGAA

151  TACGGTTGAA GCGGCTATTT TATCAGAGCC GCCGCATGTA AAACAGAGTG

201  TCAGGGCATC AACCCGAGCT GTCTGAACGA ACAGACGCTT GCGAkGTAA

251  CGATAAAATG GTCGAGCAGC GACACATCGA CCAGCGACAT TGCCTGTGCC

301  AGCCGCCTTG TGAACATGAT GTCTTCCTGC GAArGTTCsG GCGAGCCGcC

351  CGgATGGTTG TGCGCAATAA TCAGGCTGTC GGCATATTCG TCCAATGCCA

401  GTTTGACGAT TTCGCGGATG TAA
```

This corresponds to the amino acid sequence <SEQ ID 408; ORF 114>:

```
m114.pep

1  MASITSPLHG AHRECSKTFL CPPGGTSIGR SMSVTVGLFC VSINLTISVE
       51  YGXSGYFIRA AACKTECQGI NPSCLNEQTL CXVTIKWSSS DTSTSDIACA
      101  SRLVNMMSSC EXSGEPPGWL CAIIRLSAYS SNASLTISRM * m114/g114  90.0%  identity over a 140 aa overlap 10         20         30         40         50         60
     m114.pep   MASITSPLHGAHRECSKTFLCPPGGTSIGRSMSVTVGLFCVSINLTISVEYGXSGYFIRA
                ||||||||||::||||||||||||||||||:||||||||||||||||||||||| |||||
     g114       MASITSPLHGAQQECSKTFLCPPGGTSMGRSMSVTVGLFCVSINLTISVEYGQSGYFTRA
                  10         20         30         40         50         60

70         80         90        100        110        120
     m114.pep   AACKTECQGINPSCLNEQTLCXVTIKWSSSDTSTSDIACASRLVNMMSSCEXSGEPPGWL
                | ||| ||||:||||||:|:| ||||||||:||||::|||||||||||||| ||||||||
     g114       AECKTGCQGISPSCLNERTVCEVTIKWSSSETSTSDMACASRLVNMMSSCEGSGEPPGWL
                  70         80         90        100        110        120

130        140
     m114.pep   CAIIRLSAYSSNASLTISRMX
                |||||||||||||||||||||
     g114       CAIIRLSAYSSNASLTISRMX
                 130        140
```

The following partial DNA sequence was identified in *N. gonorrhoeae* <SEQ ID 409>:

```
a114.seq
  1  ATGCCGGAGG CAAGCATCGC CTCCATCACT TCGCCGCTGC ACGGGCGCA

51  ACAGGAATGC AGCAAGACTT TTTTATGTCC GCCGGGCGGG ACGAGTATGG

101  GGCGGTCAAT GTCGGTAACG GTAGGTTTGT TTTGTGTTTC CATTAACTTA

151  ACGATATCTG TCGAATACGG TTGAAGCGGC TATTTTATCA GAGCCGCCGC

201  ATGTAAAACA GGGTGTCAGG GCATCAGCCC GAGCTGCCTG AACGAACGGA

251  CGGTTTGCGC CGTTACGATA AAATGGTCGA GCAGCGACAC ATCGACCAGC

301  GACATTGCCT GTGCCAGCCG CCTTGTGAAC ATGATGTCTT CCTGCGAAGG

351  TTCGGGCGAG CCGCCCGGAT GGTTGTGCGC GATAATCAGG CTGTCGGCAT

401  ATTCGTCCAA TGCCAGTTTG ACAATTTCAC GGATGTAA
```

This corresponds to the amino acid sequence <SEQ ID 410; ORF 114.a>:

```
a114.pep

1 MPEASIASIT SPLHGAQQEC SKTFLCPPGG TSMGRSMSVT VGLFCVSINL

51 TISVEYG*SG YFIRAAACKT GCQGISPSCL NERTVCAVTI KWSSSDTSTS

101 DIACASRLVN MMSSCEGSGE PPGWLCAIIR LSAYSSNASL TISRM* m114/a114 92.9% identity in 140 aa overlap 10         20         30         40         50
   m114.pep      MASITSPLHGAHRECSKTFLCPPGGTSIGRSMSVTVGLFCVSINLTISVEYGXSG
                 :||||||||||::||||||||||||||||:||||||||||||||||||||||||||
   a114       MPEASIASITSPLHGAQQECSKTFLCPPGGTSMGRSMSVTVGLFCVSINLTISVEYGXSG
                        10         20         30         40         50         60
```

```
                   60         70         80         90        100        110
m114.pep   YFIRAAACKTECQGINPSCLNEQTLCXVTIKWSSSDTSTSDIACASRLVNMMSSCEXSGE
           ||||||||||| |||:|||||:|:| |||||||||||||||||||||||||||||| |||
a114       YFIRAAACKTGCQGISPSCLNERTVCAVTIKWSSSDTSTSDIACASRLVNMMSSCEGSGE
                   70         80         90        100        110        120

120        130        140
m114.pep   PPGWLCAIIRLSAYSSNASLTISRMX
           ||||||||||||||||||||||||||
a114       PPGWLCAIIRLSAYSSNASLTISRMX
                   130        140
```

The following partial DNA sequence was identified in *N. gonorrhoeae* <SEQ ID 411>:

```
g117.seq
   1 atggtcgacg aactcgacCT GCTGCCCGAT GCCGTCGCCG CCACCCTGCT
  51 TGCCGACATC GGACGCTACG TCCCCGATTG GAACCTATTG GTTTCCGAGC
 101 GCTGCAACAG CACCGTCGCC GAGCTGGTCA AAGGTGtgga CGAAGTGCAG
 151 AAACTTACCC ACTTCGCCCG GGTGGACAGC CTCGCCACGC CGGAAGAACG
 201 CGCACAGCAA GCGGAAACCA TGCGGAAAAT GCTGCTGGCg atggttaccg
 251 Acatccgcgt cgtaTTAATC AAACTGGCGA TGCGTacgcg caccCTGcta
 301 ttTTTaaGCA ACGCCCCCGA CAGCCCTGAA AAACgcgccG TCgccaaAga
 351 aacccTCGAC ATCTTCGCCC CGCTCGCCAA CCGCTTGGGC GTGTGGCAGC
 401 TCAAATGGCA GCTCGAAGAT TTGGGCTTCC GCCATCAAGA ACCCGAAAAA
 451 TACCGCGAAA TCGCCCTGCT TTTGGACGAA AAACGCACCG AACGCCTCGA
 501 ATACATCGAA AACTTCCTCG ATATCCTGCG TACGGAACTC AAAAAATACA
 551 ATATCCACTT TGAAGTCGCC GGCCGTCCGA ACACATCTA CTCCATTTAC
 601 AAAAAAATGG TGAAGAAAAA ACTCAGCTTC GACGgccTGT TCGACATCCG
 651 CGCCGTGCGG ATTCTGGTCG ATACCGTCCC CGaGTGTTAC ACCACGCTGG
 701 gcaTCGTCCA CAGCCTCTGG CAGCCCATTC CCGGCGagtt CGAcgactAC
 751 ATCGCCAACC CCAAAGgcaA CGgttATAAA AGtTTGCACA CCGTCATCGT
 801 cggcccGGAa gacaaaggtg tggaaGtgCA AATCCGCACC TTCGAtatGC
 851 accAATTCaa CgaatTcggT gtcgccgCCC ACTGGCGtta caagaaggc
 901 ggcaaaggcg attccGCCtA cgaacaaAAA ATcgccTggt TGCgccaACT
 951 CTTGGACTGG CGCGAAAATA TGGCGGAAAG CGGCAAGGAA GACCTCGCCG
1001 CCGCCTTCAA AACCGAGCTT TTCAACGACA CGATTTATGT TTTGACCCCG
1051 CACGGCAAAG TCCTCTCTCT GCCAACGGGC GCAACCCCCA TCGACTTCGC
1101 CTACGCCCTG CACAGCAGCA TcggCGACCG CTGCCGGGGC GCGAAAGTCG
1151 AaggGCAGAT TGTGCCGCTG TCCACCCCGC TCGAAAACGG ACAGCGCGTC
1201 GAAATcatta cCGCcaaAGA AGGGCATCCT TCCGTCAACT GGCTTTACGA
1251 AGGctgGGtc aAATCCGGCA AGGCCATCGG caaAATCCGC GCCTAcatCC
1301 GCCAGcaaAa cgCcgaCACC GTGCGCGAAG AAGGCCGTGT CCAACTCGAC
1351 AAGCAGCTTG CCAAACTCAC GCCCAAACCC AACCTGCAAG AGCTTgccga
1401 aaATCTCGGC tacaaAAAGC cagaagacct ctacacCGCc gtcggacaag
```

```
1451 gcgaaatttc caaccgcgcc atCcaaaaag cctgcggcac GCTgaacgaa 1501 ccgccccCCG TGCCCGTCAG CGCAACCACC ATCGTCAAAC AGTCCAAAAT

1551 CAAAAAAGGT GGCAAAACCG GCGTGCTCAT CGACGGCGAA GACGGCTTGA

1601 TGACCACGCT TGCCAAATGC TGCAAACCCG CGCCGCCCGA CGATATTGCC

1651 GGCTTCGTTA CCCGCGAGCG CGGCATTTCC GTCCACCGCA AAACCTGCCC

1701 CTCTTTCCGA CACCTTGCCG AACACGCGCC CGAAAAAGTA CTGGACGCAA

1751 GTTGGGCGGC GTTGCAGGAA GGGCAAGTGT TCGCCGTCGA TATCGAAATC

1801 CGCGCCCAAG ACCGCTCCGG GCTTTTGCGC GACGTATCCG ACGCGCTCGC

1851 CCGCCACAAA CTCAACGTTA CCGCCGTGCA AACCCAGTCC CGCGACTTGG

1901 AAGCCAGCAT GAGGTTCACG CTCGAAGTCA AACAAGtCAA CGacCTCCCG

1951 CGCGTCCTCG CCGGCCTCGG CGATGTCAAA GGCGTATTGA GCGTTACCCG

2001 GCTTTAA
```

This corresponds to the amino acid sequence <SEQ ID 412; ORF 117.ng>:

```
g117.pep
  1 MVDELDLLPD AVAATLLADI GRYVPDWNLL VSERCNSTVA ELVKGVDEVQ

51 KLTHFARVDS LATPEERAQQ AETMRKMLLA MVTDIRVVLI KLAMRTRTLL

101 FLSNAPDSPE KRAVAKETLD IFAPLANRLG VWQLKWQLED LGFRHQEPEK

151 YREIALLLDE KRTERLEYIE NFLDILRTEL KKYNIHFEVA GRPKHIYSIY

201 KKMVKKKLSF DGLFDIRAVR ILVDTVPECY TTLGIVHSLW QPIPGEFDDY

251 IANPKGNGYK SLHTVIVGPE DKGVEVQIRT FDMHQFNEFG VAAHWRYKEG

301 GKGDSAYEQK IAWLRQLLDW RENMAESGKE DLAAAFKTEL FNDTIYVLTP

351 HGKVLSLPTG ATPIDFAYAL HSSIGDRCRG AKVEGQIVPL STPLENGQRV

401 EIITAKEGHP SVNWLYEGWV KSGKAIGKIR AYIRQQNADT VREEGRVQLD

451 KQLAKLTPKP NLQELAENLG YKKPEDLYTA VGQGEISNRA IQKACGTLNE

501 PPPVPVSATT IVKQSKIKKG GKTGVLIDGE DGLMTTLAKC CKPAPPDDIA

551 GFVTRERGIS VHRKTCPSFR HLAEHAPEKV LDASWAALQE GQVFAVDIEI

601 RAQDRSGLLR DVSDALARHK LNVTAVQTQS RDLEASMRFT LEVKQVNDLP

651 RVLAGLGDVK GVLSVTRL*
```

The following partial DNA sequence was identified in N. meningitidis <SEQ ID 413>:

```
m117.seq (partial)
  1 . . . GTGAAACTCA AGAAATACAA TGTCCATTTC GAAGTCGCCG GCCGTGCGAA

51        ACACATCTAC TCCATTTACA AAAAAATGGT GAAGAAAAAA CTCAGCTTCG

101        ACGGCCTCTT TGACATCCGC GCCGTGCGAA TTCTGGTTGA TATCGTCCAC

151        GAGTGTTACA CCACGCTGGG TATCGTCCAC AGCCTCTGGC AGCCCATTCC

201        CGGCGAGTTC GACGACTACA TCGCCAATCC CAAAGGCAAC GGCTATAAAA

251        GTTTGCACAC CGTCATCGTC GGCAAGGAAG ACAAAGGCGT GGAAGTACAA
```

```
301        ATCCGCACCT TCGATATGCA CCAATTCAAC GAATTCGGTG TCGCCGCCCA
351        CTGgCGTTAC AAAGAGGGCG GCAAGGGCGA TTCCGCCTAC GAACAGAAAA
401        TCGCCTGGTT GCGCCAACTC TTGGACTGGC GCGAAAACAT GGCGGAAAGC
451        GGCAAGGAAG ACCTCGCCGC CGCCTTCAAA ACCGAGCTTT TCAACGACAC
501        GATTTATGTT TTGACCCCGC ACGGCAAAGT CCTCTCCCTG CCCACGGGCG
551        CGACCCCCAT CGACTTCGCC TACGCCCTGC ACAGCAGCAT CGGCGACCGT
601        TGCCGCGGTG CGAAAGTCGA AGGGCAGATT GTGCCGCTGT CCACCCCGCT
651        CGAAAACGGA CAGCGCGTCG AAATCATTAC CGCCAAAGAA GGGCATCCTT
701        CCGTCAACTG GCTTTACGAA GGCTGGGTCA AATCCAACAA GGCAATCGGC
751        AAAATCCGCG CCTACATCCG CCAGCAAAAC GCCGACACCG TGCGCGAAGA
801        AGGCCGCGTC CAACTCGACA AACAGCTTGC CAAACTCACG CCCAAACCCA
851        ACCTGCAAGA GCTTGCCGAA AATCTCGGCT ACAAAAAGCC AGAAGACCTC
901        TACACCGCCG TCGGACAAGG CGAAATTTCC AACCGCGCCA TCCAAAAAGC
951        CTGCGGCACg CTGAACGAAC CGGCGACCGT ACCCGTCAGC GAAACCACCA
1001       TCGTCAAACA GTCCAAAATC AAAAAAGGCG GCAAAAACGG CGTGCTCATC
1051       GACGGCGAAG ACGGTCTGAT GACCACGCTT GCCAAATGCT GCAAACCCGC
1101       GCCGCCCGAC GATATTATCG GCTTCGTTAC CCGCGAGCGC GgCATTTCAG
1151       TGCACCGCAA AwyyTkCyCG TCTTTCCAAC ACCTCGCCGA ACACGCGCCC
1201       GAwAAAGTGC TGGACGCAAG CTGGGCGGCA TTGCAGGAAG GACAAGTATT
1251       CGCCGTCGAT ATCGAAATCC GCGCCCAAGA CCGCTCCGGG CTTTTGCGCG
1301       ACGTATCCGA CGCGCTCGCC CGCCACAAAC TCAACGTTAC CGCCGTGCAA
1351       ACCCAGTCCC GCGACTTGGA AGCCAGCATG AGGTTCACGC TCGAAGTCAA
1401       ACAAGTCAAC GACCTCCCGC GCGTCCTCGC CAGCCTCGGC GACGTCAAAG
1451       GCGTATTGAG CGTTACCCGG CTTTAA
```

This corresponds to the amino acid sequence <SEQ ID 414; ORF 117>:

```
m117.pep (partial)
  1 . . . VKLKKYNVHF EVAGRPKHIY SIYKKMVKKK LSFDGLFDIR AVRILVDTVP

51        ECYTTLGIVH SLWQPIPGEF DDYIANPKGN GYKSLHTVIV GPEDKGVEVQ

101        IRTFDMHQFN EFGVAAHWRY KEGGKGDSAY EQKIAWLRQL LDWRENMAES

151        GKEDLAAAFK TELFNDTIYV LTPHGKVLSL PTGATPIDFA YALHSSIGDR

201        CRGAKVEGQI VPLSTPLENG QRVEIITAKE GHPSVNWLYE GWVKSNKAIG

251        KIRAYIRQQN ADTVREEGRV QLDKQLAKLT PKPNLQELAE NLGYKKPEDL

301        YTAVGQGEIS NRAIQKACGT LNEPPPVPVS ETTIVKQSKI KKGGKNGVLI

351        DGEDGLMTTL AKCCKPAPPD DIIGFVTRER GISVHRKXXX SFQHLAEHAP

401        XKVLDASWAA LQEGQVFAVD IEIRAQDRSG LLRDVSDALA RHKLNVTAVQ

451        TQSRDLEASM RFTLEVKQVN DLPRVLASLG DVKGVLSVTR L*
```

Computer analysis of this amino acid sequence gave the following results:
Homology with a Predicted ORF from *N. gonorrhoeae*
ORF 117 shows 97.6% identity over a 490 aa overlap with a predicted ORF (ORF 117.ng) from *N. gonorrhoeae*:

```
m117/g117
                                    10        20        30
    m117.pep                 VKLKKYNVHFEVAGRPKHIYSIYKKMVKKKL
                             :|||||:|||||||||||||||||||||||
    g117       EKYREIALLLDEKRTERLEYIENFLDILRTELKKYNIHFEVAGRPKHIYSIYKKMVKKKL
               150       160       170       180       190       200

40        50        60        70        80        90
    m117.pep   SFDGLFDIRAVRILVDTVPECYTTLGIVHSLWQPIPGEFDDYIANPKGNGYKSLHTVIVG
               ||||||||||||||||||||||||||||||||||||||||||||||||||||||||||||
    g117       SFDGLFDIRAVRILVDTVPECYTTLGIVHSLWQPIPGEFDDYIANPKGNGYKSLHTVIVG
               210       220       230       240       250       260

100       110       120       130       140       150
    m117.pep   PEDKGVEVQIRTFDMHQFNEFGVAAHWRYKEGGKGDSAYEQKIAWLRQLLDWRENMAESG
               ||||||||||||||||||||||||||||||||||||||||||||||||||||||||||||
    g117       PEDKGVEVQIRTFDMHQFNEFGVAAHWRYKEGGKGDSAYEQKIAWLRQLLDWRENMAESG
               270       280       290       300       310       320

160       170       180       190       200       210
    m117.pep   KEDLAAAFKTELFNDTIYVLTPHGKVLSLPTGATPIDFAYALHSSIGDRCRGAKVEGQIV
               ||||||||||||||||||||||||||||||||||||||||||||||||||||||||||||
    g117       KEDLAAAFKTELFNDTIYVLTPHGKVLSLPTGATPIDFAYALHSSIGDRCRGAKVEGQIV
               330       340       350       360       370       380

220       230       240       250       260       270
    m117.pep   PLSTPLENGQRVEIITAKEGHPSVNWLYEGWVKSNKAIGKIRAYIRQQNADTVREEGRVQ
               |||||||||||||||||||||||||||||||||:||||||||||||||||||||||||||
    g117       PLSTPLENGQRVEIITAKEGHPSVNWLYEGWVKSGKAIGKIRAYIRQQNADTVREEGRVQ
               390       400       410       420       430       440

280       290       300       310       320       330
    m117.pep   LDKQLAKLTPKPNLQELAENLGYKKPEDLYTAVGQGEISNRAIQKACGTLNEPPPVPVSE
               ||||||||||||||||||||||||||||||||||||||||||||||||||||||||||||
    g117       LDKQLAKLTPKPNLQELAENLGYKKPEDLYTAVGQGEISNRAIQKACGTLNEPPPVPVSA
               450       460       470       480       490       500

340       350       360       370       380       390
    m117.pep   TTIVKQSKIKKGGKNGVLIDGEDGLMTTLAKCCKPAPPDDIIGFVTRERGISVHRKXXXS
               ||||||||||||:||||||||||||||||||||||||||| ||||||||||||||||: |
    g117       TTIVKQSKIKKGGKTGVLIDGEDGLMTTLAKCCKPAPPDDIAGFVTRERGISVHRKTCPS
               510       520       530       540       550       560

400       410       420       430       440       450
    m117.pep   FQHLAEHAPXKVLDASWAALQEGQVFAVDIEIRAQDRSGLLRDVSDALARHKLNVTAVQT
               |:|||||| |||||||||||||||||||||||||||||||||||||||||||||||||||
    g117       FRHLAEHAPEKVLDASWAALQEGQVFAVDIEIRAQDRSGLLRDVSDALARHKLNVTAVQT
               570       580       590       600       610       620

460       470       480       490
    m117.pep   QSRDLEASMRFTLEVKQVNDLPRVLASLGDVKGVLSVTRLX
               |||||||||||||||||||||||||||:||||||||||||
    g117       QSRDLEASMRFTLEVKQVNDLPRVLAGLGDVKGVLSVTRLX
               630       640       650       660
```

The following partial DNA sequence was identified in *N. meningitidis* <SEQ ID 415>:

```
a117.seq
   1 ATGGTTCATG AACTCGACCT GCTCCCCGAT GCCGTCGCCG CCACCCTGCT

51 TGCCGACATC GGACGCTACG TCCCCGACTG GAACCTATTG GTTTCCGAAC

101 GCTGCAACAG TACCGTCGCC GAGCTGGTCA AAGGTGTGGA CGAAGTGCAG

151 AAACTCACCC ACTTCGCCCG GGTGGACAGC CTCGCCACGC CGGAAGAACG
```

-continued

```
 201 CGCCCAGCAG GCAGAAACTA TGCGGAAAAT GCTGCTGGCG ATGGTTACCG
 251 ACATCCGCGT CGTGTTAATC AAACTGGCGA TGCGTACGCG CACCCTGCAA
 301 TTTTTAAGCA ACGCCCCGA CAGCCCCGAA AAACGCGCCG TCGCCAAAGA
 351 AACCCTCGAC ATCTTCGCCC CGCTCGCCAA CCGTTTGGGC GTGTGGCAGC
 401 TCAAATGGCA GCTCGAAGAT TTGGGCTTCC GCCATCAAGA ACCCGAAAAA
 451 TACCGCGAAA TCGCCCTGCT TTTGGACGAA AAACGCACCG AACGCCTCGA
 501 ATACATCGAA AACTTCCTTA ATATCCTGCG TACGGAACTC AAAAAATACA
 551 ATATCCACTT TGAAGTCGCC GGCCGTCCGA ACACATCTA CTCCATTTAC
 601 AAAAAAATGG TGAAGAAAAA ACTCAGCTTC GACGGGTTGT CGACATCCG
 651 CGCCGTGCGG ATTCTGGTTG ATACCGTCCC CGAGTGTTAC ACCACACTGG
 701 GCATTGTCCA CAGCCTCTGG CAGCCCATTC CCGGCGAGTT CGACGACTAC
 751 ATCGCCAACC CGAAAGGCAA CGGCTATAAA AGTTTGCACA CCGTCATCGT
 801 CGGCAAGGAA GACAAAGGCG TGGAAGTGCA AATCCGCACC TTCGATATGC
 851 ACCAATTCAA CGAATTCGGT GTCGCCGCGC ACTGGCGTTA CAAAGAGGGC
 901 GGCAAAGGCG ATTCCGCCTA CGAACAAAAA ATCGCCTGGT TACGCCAACT
 951 TTTGGACTGG CGCGAAAACA TGGCGGAAAG CGGCAAGGAA GACCTCGCCG
1001 CCGCCTTCAA AACCGAGCTT TTCAACGACA CGATTTATGT TTTGACCCCG
1051 CACGGCAAAG TCCTCTCCCT GCCCACAGGC GCGACCCCCA TCGACTTCGC
1101 CTACGCCCTG CACAGCAGCA TCGGCGACCG TTGCCGCGGT GCGAAAGTCG
1151 AAGGGCAGAT TGTGCCGCTG TCCACCCCGC TCGAAAACGG ACAGCGTGTC
1201 GAAATCATTA CCGCCAAAGA AGGGCATCCT TCCGTCAACT GGCTTTACGA
1251 AGGCTGGGTC AAATCCAACA AGGCAATCGG CAAAATCCGC GCCTACATCC
1301 GCCAGCAAAA CGCCGACACC GTGCGCGAAG AAGGCCGCGT CCAACTCGAC
1351 AAACAGCTTG CCAAACTCAC GCCCAAACCC AACCTGCAAG AGCTTGCCGA
1401 AAATCTCGGC TACAAAAAGC CAGAAGACCT CTACACCGCC GTCGGACAAG
1451 GCGAAATTTC CAACCGCGCC ATCCAAAAAG CCTGCGGCAC GCTGAACGAA
1501 CCGCCGCCCG TACCCGTCAG CGAAACCACC ATCGTCAAAC AGTCCAAAAT
1551 CAAAAAGGC GGCAAAAACG GCGTGCTCAT CGACGGCGAA GACGGTCTGA
1601 TGACCACGCT TGCCAAATGC TGCAAACCCG CGCCGCCCGA CGACATTGTC
1651 GGCTTCGTTA CCCGCGATCG CGGCATTTCG GTACACCGCA AAACCTGCCC
1701 CTCTTTCCGA CACCTCGCCG AACACGCGCC CGAAAAAGTA CTGGACGCAA
1751 GTTGGGCGGC GTTGCAGGAA GGACAAGTGT CGCCGTCGA TATCGAAATC
1801 CGCGCCCAAG ACCGCTCCGG GCTTTTGCGC GACGTATCCG ACGCGCTCGC
1851 CCGCCACAAA CTCAACGTTA CCGCCGTGCA AACCCAGTCC CGCGACTTGG
1901 AAGCCAGCAT GAGGTTCACG CTCGAAGTCA AACAAGTTAC CGACCTCCCA
1951 CGCGTCCTCG CCAGCCTCGG CGACGTCAAA GGCGTATTGA GCGTTACCCG
2001 GCTTTAA
```

This corresponds to the amino acid sequence <SEQ ID 416; ORF 117.a>:

```
a117.pep

1 MVHELDLLPD AVAATLLADI GRYVPDWNLL VSERCNSTVA ELVKGVDEVQ

51 KLTHFARVDS LATPEERAQQ AETMRKMLLA MVTDIRVVLI KLAMRTRTLQ

101 FLSNAPDSPE KRAVAKETLD IFAPLANRLG VWQLKWQLED LGFRHQEPEK

151 YREIALLLDE KRTERLEYIE NFLNILRTEL KKYNIHFEVA GRPKHIYSIY

201 KKMVKKKLSF DGLFDIRAVR ILVDTVPECY TTLGIVHSLW QPIPGEFDDY

251 IANPKGNGYK SLHTVIVGPE DKGVEVQIRT FDMHQFNEFG VAAHWRYKEG

301 GKGDSAYEQK IAWLRQLLDW RENMAESGKE DLAAAFKTEL FNDTIYVLTP

351 HGKVLSLPTG ATPIDFAYAL HSSIGDRCRG AKVEGQIVPL STPLENGQRV

401 EIITAKEGHP SVNWLYEGWV KSNKAIGKIR AYIRQQNADT VREEGRVQLD

451 KQLAKLTPKP NLQELAENLG YKKPEDLYTA VGQGEISNRA IQKACGTLNE

501 PPPVPVSETT IVKQSKIKKG GKNGVLIDGE DGLMTTLAKC CKPAPPDDIV

551 GFVTRDRGIS VHRKTCPSFR HLAEHAPEKV LDASWAALQE GQVFAVDIEI

601 RAQDRSGLLR DVSDALARHK LNVTAVQTQS RDLEASMRFT LEVKQVTDLP

651 RVLASLGDVK GVLSVTRL*
``` m117/a117 98.0% identity in 490 aa overlap

```
                       10         20         30
m117.pep               VKLKKYNVHFEVAGRPKHIYSIYKKMVKKKL
                       :||||:||||||||||||||||||||||||
a114       EKYREIALLLDEKRTERLEYIENFLNILRTELKKYNIHFEVAGRPKHIYSIYKKMVKKKL
             150       160       170       180       190       200

40         50         60         70         80         90
m117.pep   SFDGLFDIRAVRILVDTVPECYTTLGIVHSLWQPIPGEFDDYIANPKGNGYKSLHTVIVG
           ||||||||||||||||||||||||||||||||||||||||||||||||||||||||||||
a117       SFDGLFDIRAVRILVDTVPECYTTLGIVHSLWQPIPGEFDDYIANPKGNGYKSLHTVIVG
             210       220       230       240       250       260

100        110        120        130        140        150
m117.pep   PEDKGVEVQIRTFDMHQFNEFGVAAHWRYKEGGKGDSAYEQKIAWLRQLLDWRENMAESG
           ||||||||||||||||||||||||||||||||||||||||||||||||||||||||||||
a117       PEDKGVEVQIRTFDMHQFNEFGVAAHWRYKEGGKGDSAYEQKIAWLRQLLDWRENMAESG
             270       280       290       300       310       320

160        170        180        190        200        210
m117.pep   KEDLAAAFKTELFNDTIYVLTPHGKVLSLPTGATPIDFAYALHSSIGDRCRGAKVEGQIV
           ||||||||||||||||||||||||||||||||||||||||||||||||||||||||||||
a117       KEDLAAAFKTELFNDTIYVLTPHGKVLSLPTGATPIDFAYALHSSIGDRCRGAKVEGQIV
             330       340       350       360       370       380

220        230        240        250        260        270
m117.pep   PLSTPLENGQRVEIITAKEGHPSVNWLYEGWVKSNKAIGKIRAYIRQQNADTVREEGRVQ
           ||||||||||||||||||||||||||||||||||||||||||||||||||||||||||||
a117       PLSTPLENGQRVEIITAKEGHPSVNWLYEGWVKSNKAIGKIRAYIRQQNADTVREEGRVQ
             390       400       410       420       430       440

280        290        300        310        320        330
m117.pep   LDKQLAKLTPKPNLQELAENLGYKKPEDLYTAVGQGEISNRAIQKACGTLNEPPPVPVSE
           ||||||||||||||||||||||||||||||||||||||||||||||||||||||||||||
a117       LDKQLAKLTPKPNLQELAENLGYKKPEDLYTAVGQGEISNRAIQKACGTLNEPPPVPVSE
             450       460       470       480       490       500

340        350        360        370        380        390
m117.pep   TTIVKQSKIKKGGKNGVLIDGEDGLMTTLAKCCKPAPPDDIIGFVTRERGISVHRKXXXS
           ||||||||||||||||||||||||||||||||||||||||:||||:|||||||||:  |
a117       TTIVKQSKIKKGGKNGVLIDGEDGLMTTLAKCCKPAPPDDIVGFVTRDRGISVHRKTCPS
             510       520       530       540       550       560
```

```
            400        410        420        430        440        450
m117.pep  FQHLAEHAPXKVLDASWAALQEGQVFAVDIEIRAQDRSGLLRDVSDALARHKLNVTAVQT
          |:||||||| |||||||||||||||||||||||||||||||||||||||||||||||||
a117      FRHLAEHAPEKVLDASWAALQEGQVFAVDIEIRAQDRSGLLRDVSDALARHKLNVTAVQT
            570        580        590        600        610        620
                    460        470        480        490
m117.pep  QSRDLEASMRFTLEVKQVNDLPRVLASLGDVKGVLSVTRLX
          ||||||||| |||||||||:||||||||||||||||||||
a117      QSRDLEASMRFTLEVKQVTDLPRVLASLGDVKGVLSVTRLX
                    630        640        650        660
```

The following partial DNA sequence was identified in *N. gonorrhoeae* <SEQ ID 417>:

```
g117-1.seq
   1 ATGACCGCCA TCAGCCCGAT TCAAGACACG CAAAGCGCGA CCCTGCAAGA
  51 ATTGCGCGAA TGGTTCGACA GCTACTGCGC CGCTCTGCCG GACAACGATA
 101 AAAACCTCAT CGGTACCGCA TGGTCGCTGG CGCAGGAACA TTATCCTGCC
 151 GATGCCGCCA CGCCGTATGG CGAGCCGCTG CCCGACCACT TCCTCGGCGC
 201 GGCGCAAATG GTCGACGAAC TCGACCTGCT GCCCGATGCC GTCGCCGCCA
 251 CCCTGCTTGC CGACATCGGA CGCTACGTCC CCGATTGGAA CCTATTGGTT
 301 TCCGAGCGCT GCAACAGCAC CGTCGCCGAG CTGGTCAAAG GTGTGGACGA
 351 AGTGCAGAAA CTTACCCACT CGCCCGGGT GGACAGCCTC GCCACGCCGG
 401 AAGAACGCGC ACAGCAAGCG GAAACCATGC GGAAAATGCT GCTGGCGATG
 451 GTTACCGACA TCCGCGTCGT ATTAATCAAA CTGGCGATGC GTACGCGCAC
 501 CCTGCAATTT TTAAGCAACG CCCCCGACAG CCCTGAAAAA CGCGCCGTCG
 551 CCAAAGAAAC CCTCGACATC TTCGCCCCGC TCGCCAACCG CTTGGGCGTG
 601 TGGCAGCTCA AATGGCAGCT CGAAGATTTG GCTTCCGCC ATCAAGAACC
 651 CGAAAAATAC CGCGAAATCG CCCTGCTTTT GGACGAAAAA CGCACCGAAC
 701 GCCTCGAATA CATCGAAAAC TTCCTCGATA TCCTGCGTAC GGAACTCAAA
 751 AAATACAATA TCCACTTTGA AGTCGCCGGC CGTCCGAAAC ACATCTACTC
 801 CATTTACAAA AAAATGGTGA AGAAAAAACT CAGCTTCGAC GGCCTGTTCG
 851 ACATCCGCGC CGTGCGGATT CTGGTCGATA CCGTCCCCGA GTGTTACACC
 901 ACGCTGGGCA TCGTCCACAG CCTCTGGCAG CCCATTCCCG GCGagttCGA
 951 cgactACATC GCCAACCCCA AAGgcaACGg ttATAAAAGt TTGCACACCG
1001 TCATCGTCgg cccGGAagaa aaaggtgtgg aagtgcAAAT CCGCACCTTC
1051 GATATGCacc AATTCaaCga ATTCGGTGTC GCCGCCCACT GGCGTTACAA
1101 AGAAGGCGGC AAAGGCGATT CCGCCTACGA ACAAAAAATC GCCTGGTTGC
1151 GCCAACTCTT GGACTGGCGC GAAAATATGG CGGAAAGCGG CAAGGAAGAC
1201 CTCGCCGCCG CCTTCAAAAC CGAGCTTTTC AACGACACGA TTTATGTTTT
1251 GACCCCGCAC GGCAAAGTCC TCTCTCTGCC AACGGGCGCA ACCCCCATCG
1301 ACTTCGCCTA CGCCCTGCAC AGCAGCATCG GCGACCGCTG CCGGGGCGCG
1351 AAAGTCGAAG GCAGATTGT GCCGCTGTCC ACCCCGCTCG AAAACGGACA
1401 GCGCGTCGAA ATCATTACCG CCAAAGAAGG GCATCCTTCC GTCAACTGGC
1451 TTTACGAAGG CTGGGTCAAA TCCGGCAAGG CCATCGGCAA AATCCGCGCC
```

-continued

```
1501 TACATCCGCC AGCAAAACGC CGACACCGTG CGCGAAGAAG GCCGTGTCCA

1551 ACTCGACAAG CAGCTTGCCA AACTCACGCC CAAACCCAAC CTGCAAGAGC

1601 TTGCCGAAAA TCTCGGCTAC AAAAAGCCAG AAGACCTCTA CACCGCCGTC

1651 GGACAAGGCG AAATTTCCAA CCGCGCCATC CAAAAAGCCT GCGGCACGCT

1701 GAACGAACCG CCGCCCGTGC CCGTCAGCGC AACCACCATC GTCAAACAGT

1751 CCAAAATCAA AAAAGGTGGC AAAACCGGCG TGCTCATCGA CGGCGAAGAC

1801 GGCTTGATGA CCACGCTTGC CAAATGCTGC AAACCCGCGC CGCCCGACGA

1851 TATTGCCGGC TTCGTTACCC GCGAGCGCGG CATTTCCGTC CACCGCAAAA

1901 CCTGCCCCTC TTTCCGACAC CTTGCCGAAC ACGCGCCCGA AAAAGTACTG

1951 GACGCAAGTT GGGCGGCGTT GCAGGAAGGG CAAGTGTTCG CCGTCGATAT

2001 CGAAATCCGC GCCCAAGACC GCTCCGGGCT TTTGCGCGAC GTATCCGACG

2051 CGCTCGCCCG CCACAAACTC AACGTTACCG CCGTGCAAAC CCAGTCCCGC

2101 GACTTGGAAG CCAGCATGAG GTTCACGCTC GAAGTCAAAC AAGTCAACGA

2151 CCTCCCGCGC GTCCTCGCCG GCCTCGGCGA TGTCAAAGGC GTATTGAGCG

2201 TTACCCGGCT TTAA
```

This corresponds to the amino acid sequence <SEQ ID 418; ORF 117-1.ng>:

```
g117-1.pep
  1  MTAISPIQDT QSATLQELRE WFDSYCAALP DNDKNLIGTA WSLAQEHYPA

51  DAATPYGEPL PDHFLGAAQM VDELDLLPDA VAATLLADIG RYVPDWNLLV

101  SERCNSTVAE LVKGVDEVQK LTHFARVDSL ATPEERAQQA ETMRKMLLAM

151  VTDIRVVLIK LAMRTRTLQF LSNAPDSPEK RAVAKETLDI FAPLANRLGV

201  WQLKWQLEDL GFRHQEPEKY REIALLLDEK RTERLEYIEN FLDILRTELK

251  KYNIHFEVAG RPKHIYSIYK KMVKKKLSFD GLFDIRAVRI LVDTVPECYT

301  TLGIVHSLWQ PIPGEFDDYI ANPKGNGYKS LHTVIVGPEE KGVEVQIRTF

351  DMHQFNEFGV AAHWRYKEGG KGDSAYEQKI AWLRQLLDWR ENMAESGKED

401  LAAAFKTELF NDTIYVLTPH GKVLSLPTGA TPIDFAYALH SSIGDRCRGA

451  KVEGQIVPLS TPLENGQRVE IITAKEGHPS VNWLYEGWVK SGKAIGKIRA

501  YIRQQNADTV REEGRVQLDK QLAKLTPKPN LQELAENLGY KKPEDLYTAV

551  GQGEISNRAI QKACGTLNEP PPVPVSATTI VKQSKIKKGG KTGVLIDGED

601  GLMTTLAKCC KPAPPDDIAG FVTRERGISV HRKTCPSFRH LAEHAPEKVL

651  DASWAALQEG QVFAVDIEIR AQDRSGLLRD VSDALARHKL NVTAVQTQSR

701  DLEASMRFTL EVKQVNDLPR VLAGLGDVKG VLSVTRL*
```

The following partial DNA sequence was identified in *N. meningitidis* <SEQ ID 419>:

```
m117-1.seq
   1 ATGACCGCCA TCAGCCCGAT TCAAGACACG CAAAGCGCGA CTCTGCAAGA

51 ATTGCGCGAA TGGTTCGACA GCTACTGCGC CGCTCTGCCG GACAACGATA

101 AAAACCTCAT CGGTACCGCA TGGTTGCTGG CGCAGGAACA TTACCCCGCC

151 GATGCCGCCA CGCCGTATGG CGAGCCGCTG CCCGACCACT TCCTCGGCGC
```

```
201 GGCGCAAATG GTTCATGAAC TCGACCTGCT CCCCGATGCC GTCGCCGCCA

251 CCCTGCTTGC CGACATCGGA CGCTACGTCC CCGACTGGAA CCTATTGGTT

301 TCCGAACGCT GCAACAGTAC CGTCGCCGAG CTGGTCAAAG GTGTGGACGA

351 AGTGCAGAAA CTCACCCACT TCGCCCGGGT GGACAGCCTC GCCACGCCGG

401 AAGAACGCGC CCAGCAGGCA GAAACTATGC GGAAAATGCT GCTGGCGATG

451 GTTACCGACA TCCGCGTCGT GTTAATCAAA CTGGCGATGC GTACGCGCAC

501 CCTGCAATTT TTAAGCAACG CCCCCGACAG CCCCGAAAAA CGCGCCGTCG

551 CCAAAGAAAC CCTCGACATC TTCGCCCCGC TCGCCAACCG TTTGGGCGTG

601 TGGCAGCTCA AATGGCAGCT CGAAGATTTG GGCTTCCGCC ATCAAAAGCC

651 CGAAAAATAC CGCGAAATCG CGCTGCTTTT GGACGAAAAA CGCACCGAAC

701 GCCTCGAATA CATCGAAAAC TTCCTCAACA TCCTGCGCGG TGAACTCAAG

751 AAATACAATG TCCATTTCGA AGTCGCCGGC CGCCCGAAAC ACATCTACTC

801 CATTTACAAA AAAATGGTGA AGAAAAAACT CAGCTTCGAC GGCCTCTTTG

851 ACATCCGCGC CGTGCGAATT CTGGTTGATA CCGTCCCCGA GTGTTACACC

901 ACGCTGGGTA TCGTCCACAG CCTCTGGCAG CCCATTCCCG GCGAGTTCGA

951 CGACTACATC GCCAATCCCA AAGGCAACGG CTATAAAAGT TTGCACACCG

1001 TCATCGTCGG CCCGGAAGAC AAAGGCGTGG AAGTACAAAT CCGCACCTTC

1051 GATATGCACC AATTCAACGA ATTCGGTGTC GCCGCCCACT GGCGTTACAA

1101 AGAGGGCGGC AAGGGCGATT CCGCCTACGA ACAGAAAATC GCCTGGTTGC

1151 GCCAACTCTT GGACTGGCGC GAAAACATGG CGGAAAGCGG CAAGGAAGAC

1201 CTCGCCGCCG CCTTCAAAAC CGAGCTTTTC AACGACACGA TTTATGTTTT

1251 GACCCCGCAC GGCAAAGTCC TCTCCCTGCC CACGGGCGCG ACCCCCATCG

1301 ACTTCGCCTA CGCCCTGCAC AGCAGCATCG GCGACCGTTG CCGCGGTGCG

1351 AAAGTCGAAG GCAGATTGT GCCGCTGTCC ACCCCGCTCG AAAACGGACA

1401 GCGCGTCGAA ATCATTACCG CCAAAGAAGG GCATCCTTCC GTCAACTGGC

1451 TTTACGAAGG CTGGGTCAAA TCCAACAAGG CAATCGGCAA AATCCGCGCC

1501 TACATCCGCC AGCAAAACGC CGACACCGTG CGCGAAGAAG GCCGCGTCCA

1551 ACTCGACAAA CAGCTTGCCA AACTCACGCC CAAACCCAAC CTGCAAGAGC

1601 TTGCCGAAAA TCTCGGCTAC AAAAAGCCAG AAGACCTCTA CACCGCCGTC

1651 GGACAAGGCG AAATTTCCAA CCGCGCCATC CAAAAAGCCT GCGGCACGCT

1701 GAACGAACCG CCGCCCGTAC CCGTCAGCGA ACCACCATC GTCAAACAGT

1751 CCAAAATCAA AAAGGCGGC AAAAACGGCG TGCTCATCGA CGGCGAAGAC

1801 GGTCTGATGA CCACGCTTGC CAAATGCTGC AAACCCGCGC CGCCCGACGA

1851 TATTATCGGC TTCGTTACCC GCGAGCGCGG CATTTCAGTG CACCGCAAAA

1901 CCTGCCCGTC TTTCCAACAC CTCGCCGAAC ACGCGCCCGA AAAAGTGCTG

1951 GACGCAAGCT GGGCGGCATT GCAGGAAGGA CAAGTATTCG CCGTCGATAT

2001 CGAAATCCGC GCCCAAGACC GCTCCGGGCT TTTGCGCGAC GTATCCGACG

2051 CGCTCGCCCG CCACAAACTC AACGTTACCG CCGTGCAAAC CCAGTCCCGC

2101 GACTTGGAAG CCAGCATGAG GTTCACGCTC GAAGTCAAAC AAGTCAACGA

2151 CCTCCCGCGC GTCCTCGCCA GCCTCGGCGA CGTCAAAGGC GTATTGAGCG

2201 TTACCCGGCT TTAA
```

This corresponds to the amino acid sequence <SEQ ID 420; ORF 117-1>:

```
m117-1.pep

1 MTAISPIQDT QSATLQELRE WFDSYCAALP DNDKNLIGTA WLLAQEHYPA

51 DAATPYGEPL PDHFLGAAQM VHELDLLPDA VAATLLADIG RYVPDWNLLV

101 SERCNSTVAE LVKGVDEVQK LTHFARVDSL ATPEERAQQA ETMRKMLLAM

151 VTDIRVVLIK LAMRTRTLQF LSNAPDSPEK RAVAKETLDI FAPLANRLGV

201 WQLKWQLEDL GFRHQKPEKY REIALLLDEK RTERLEYIEN FLNILRGELK

251 KYNVHFEVAG RPKHIYSIYK KMVKKKLSFD GLFDIRAVRI LVDTVPECYT

301 TLGIVHSLWQ PIPGEFDDYI ANPKGNGYKS LHTVIVGPED KGVEVQIRTF

351 DMHQFNEFGV AAHWRYKEGG KGDSAYEQKI AWLRQLLDWR ENMAESGKED

401 LAAAFKTELF NDTIYVLTPH GKVLSLPTGA TPIDFAYALH SSIGDRCRGA

451 KVEGQIVPLS TPLENGQRVE IITAKEGHPS VNWLYEGWVK SNKAIGKIRA

501 YIRQQNADTV REEGRVQLDK QLAKLTPKPN LQELAENLGY KKPEDLYTAV

551 GQGEISNRAI QKACGTLNEP PPVPVSETTI VKQSKIKKGG KNGVLIDGED

601 GLMTTLAKCC KPAPPDDIIG FVTRERGISV HRKTCPSFQH LAEHAPEKVL

651 DASWAALQEG QVFAVDIEIR AQDRSGLLRD VSDALARHKL NVTAVQTQSR

701 DLEASMRFTL EVKQVNDLPR VLASLGDVKG VLSVTRL* m117-1/g117-1 98.2% identity in 737 aa overlap 10         20         30         40         50         60
m117-1.pep   MTAISPIQDTQSATLQELREWFDSYCAALPDNDKNLIGTAWLLAQEHYPADAATPYGEPL
             ||||||||||||||||||||||||||||||||||||||| ||||||||||||||||||||
g117-1       MTAISPIQDTQSATLQELREWFDSYCAALPDNDKNLIGTAWSLAQEHYPADAATPYGEPL
                     10         20         30         40         50         60

70         80         90        100        110        120
m117-1.pep   PDHFLGAAQMVHELDLLPDAVAATLLADIGRYVPDWNLLVSERCNSTVAELVKGVDEVQK
             |||||||||| |||||||||||||||||||||||||||||||||||||||||||||||||
g117-1       PDHFLGAAQMVDELDLLPDAVAATLLADIGRYVPDWNLLVSERCNSTVAELVKGVDEVQK
                     70         80         90        100        110        120

130        140        150        160        170        180
m117-1.pep   LTHFARVDSLATPEERAQQAETMRKMLLAMVTDIRVVLIKLAMRTRTLQFLSNAPDSPEK
             ||||||||||||||||||||||||||||||||||||||||||||||||||||||||||||
g117-1       LTHFARVDSLATPEERAQQAETMRKMLLAMVTDIRVVLIKLAMRTRTLQFLSNAPDSPEK
                    130        140        150        160        170        180

190        200        210        220        230        240
m117-1.pep   RAVAKETLDIFAPLANRLGVWQLKWQLEDLGFRHQKPEKYREIALLLDEKRTERLEYIEN
             |||||||||||||||||||||||||||||||||||:||||||||||||||||||||||||
g117-1       RAVAKETLDIFAPLANRLGVWQLKWQLEDLGFRHQEPEKYREIALLLDEKRTERLEYIEN
                    190        200        210        220        230        240

250        260        270        280        290        300
m117-1.pep   FLNILRGELKKYNVHFEVAGRPKHIYSIYKKMVKKKLSFDGLFDIRAVRILVDTVPECYT
             ||:|||  ||||||:|||||||||||||||||||||||||||||||||||||||||||||
g117-1       FLDILRTELKKYNIHFEVAGRPKHIYSIYKKMVKKKLSFDGLFDIRAVRILVDTVPECYT
                    250        260        270        280        290        300

310        320        330        340        350        360
m117-1.pep   TLGIVHSLWQPIPGEFDDYIANPKGNGYKSLHTVIVGPEDKGVEVQIRTFDMHQFNEFGV
             |||||||||||||||||||||||||||||||||||||||:||||||||||||||||||||
g117-1       TLGIVHSLWQPIPGEFDDYIANPKGNGYKSLHTVIVGPEEKGVEVQIRTFDMHQFNEFGV
                    310        320        330        340        350        360

370        380        390        400        410        420
m117-1.pep   AAHWRYKEGGKGDSAYEQKIAWLRQLLDWRENMAESGKEDLAAAFKTELFNDTIYVLTPH
             ||||||||||||||||||||||||||||||||||||||||||||||||||||||||||||
g117-1       AAHWRYKEGGKGDSAYEQKIAWLRQLLDWRENMAESGKEDLAAAFKTELFNDTIYVLTPH
                    370        380        390        400        410        420
```

```
               430        440        450        460        470        480
m117-1.pep GKVLSLPTGATPIDFAYALHSSIGDRCRGAKVEGQIVPLSTPLENGQRVEIITAKEGHPS
           ||||||||||||||||||||||||||||||||||||||||||||||||||||||||||||
g117-1     GKVLSLPTGATPIDFAYALHSSIGDRCRGAKVEGQIVPLSTPLENGQRVEIITAKEGHPS
               430        440        450        460        470        480

490        500        510        520        530        540
m117-1.pep VNWLYEGWVKSNKAIGKIRAYIRQQNADTVREEGRVQLDKQLAKLTPKPNLQELAENLGY
           |||||||||||| ||||||||||||||||||||||||||||||||||||||||||||||
g117-1     VNWLYEGWVKSGKAIGKIRAYIRQQNADTVREEGRVQLDKQLAKLTPKPNLQELAENLGY
               490        500        510        520        530        540

550        560        570        580        590        600
m117-1.pep KKPEDLYTAVGQGEISNRAIQKACGTLNEPPPVPVSETTIVKQSKIKKGGKNGVLIDGED
           ||||||||||||||||||||||||||||||||||||:|||||||||||||||:|||||||
g117-1     KKPEDLYTAVGQGEISNRAIQKACGTLNEPPPVPVSATTIVKQSKIKKGGKTGVLIDGED
               550        560        570        580        590        600

610        620        630        640        650        660
m117-1.pep GLMTTLAKCCKPAPPDDIIGFVTRERGISVHRKTCPSFQHLAEHAPEKVLDASWAALQEG
           |||||||||||||||||| |||||||||||||||||:|||||||||||||||||||||||
g117-1     GLMTTLAKCCKPAPPDDIAGFVTRERGISVHRKTCPSFRHLAEHAPEKVLDASWAALQEG
               610        620        630        640        650        660

670        680        690        700        710        720
m117-1.pep QVFAVDIEIRAQDRSGLLRDVSDALARHKLNVTAVQTQSRDLEASMRFTLEVKQVNDLPR
           ||||||||||||||||||||||||||||||||||||||||||||||||||||||||||||
g117-1     QVFAVDIEIRAQDRSGLLRDVSDALARHKLNVTAVQTQSRDLEASMRFTLEVKQVNDLPR
               670        680        690        700        710        720

730
m117-1.pep VLASLGDVKGVLSVTRLX
           |||:||||||||||||||
g117-1     VLAGLGDVKGVLSVTRLX
               730 m117-1 (SEQ ID 420)/RelA (SEQ ID 4162)
sp|P55133|RELA_VIBSS GTP PYROPHOSPHOKINASE (ATP:GTP 3'-PYROPHOSPHOTRANSFERASE) (PPGPP SYNTHETASEI)
>gi|537617 (U13769) ppGpp synthetase I [Vibrio sp.] Length = 744 Score = 536 bits (1366),
Expect = e-151 Identities = 288/685 (42%), Positives = 432/685 (63%), Gaps = 31/685 (4%)
Query:  74 LDLLPDAVAATLLADI---GRYVPDWNLLVSERCNSTVAELVKGVDEVQKLTHFARVDSL 130
           L + D+ALL +    GY D   + E + T+ LV+GV+++  ++    ++ S
Sbjct:  68 LSMDADTLIAALLYPLVEGGCYSTD---ALKEEYSGTILHLVQGVEQMCAIS---QLKST 121

Query: 131 ATPEERAQQAETMRKMLLAMVTDIRVVLIKLAMRTRTLQFLSNAPDSPEKRAVAKETLDI 190
           A   +A Q + +R+MLL+MV D R V+IKLA R   L+ + + PD  +RA A+E  +I
Sbjct: 122 AEETAQAAQVDNIRRMLLSMVDDFRCVVIKLAERICNLREVKDQPDEV-RRAAAQECANI 180

Query: 191 FAPLANRLGVWQLKWQLEDLGFRHQKPEKYREIALLLDEKRTERLEYIENFLNILRGELK 250
           +APLANRLG+ QLKW++ED  FR+Q P+ Y++IA L E+R +R +YI +F++ L   +K
Sbjct: 181 YAPLANRLGIGQLKWEIEDYAFRYQHPDTYKQIAKQLSERRIDREDYITHFVDDLSDAMK 240

Query: 251 KYNVHFEVAGRPKHIYSIYKKMVKKKLSFDGLFDIRAVRILVDTVPECYTTLGIVHSLWQ 310
           +N+  EV GRPKHIYSI++KM KK L FD LFD+RAVRI+ + + +CY  LG+VH+ ++
Sbjct: 241 ASNIRAEVQGRPKHIYSIWRKMQKKSLEFDELFDVRAVRIVAEELQDCYAALGVVHTKYR 300

Query: 311 PIPGEFDDYIANPKGNGYKSLHTVIVGPEDKGVEQIRTFDMHQFNEFGVAAHWRYKEG- 369
            +P EFDDY ANPK NGY+S+HTV++GPE K +E+QIRT MH+ +E GVAAHW YKEG
Sbjct: 301 HLPKEFDDYVANPKPNGYQSIHTVVLGPEGKTIEIQIRTKQMHEESELGVAAHWKYKEGT 360

Query: 370 --GKGDSAYEQKIAWLRQLLDWRENMAESGKEDLAAAFKTELFNDTIYVLTPHGKVLSLP 427
             G   SAY++KI WLR+LL W+E M++SG ++      ++++F+D +Y  TP G V+ LP
Sbjct: 361 ASGGAQSAYDEKINWLRKLLAWQEEMSDSG--EMLDELRSQVFDDRVYAFTPKGDVVDLP 418

Query: 428 TGATPIDFAYALHSSIGDRCRGAKVEGQIVPLSTPLENGQRVEIITAKEGHPSVNWLYE- 486
           + ATP+DFAY +HS +G RC GAKVEG+IVP    L+  G +VEIIT KE +PS +WL
Sbjct: 419 SNATPLDFAYHIHSEVGHRCIGAKVEGRIVPFTYHLQMGDQVEIITQKEPNPSRDWLNPN 478

Query: 487 -GWVKSNKAIGKIRAYIRQQNADTVREEGRVQLDKQLAKL--TPKPNLQELAENLGYKKP 543
            G+V S++A K+ A+ R+Q+ D    G+ L+ +L K+    T K    A+     K P
Sbjct: 479 LGFVTSSRARAKVHAWFRKQDRDKNIIAGKEILEAELVKIHATLKDAQYYAAKRFNVKSP 538

Query: 544 EDLYTAVGQGEIS-NRAIQKACGTLNEPPPVPVSETTIVKQSKI--------KKGGKNGV 594
           E+LY  +G G++  N+ I +N+P    + K S+        KK  ++ V
Sbjct: 539 EELYAGIGSGDLRINQVINHINALVNKPTAEEEDQQLLEKLSEASNKQATSHKKPQRDAV 598

Query: 595 LIDGEDGLMTTLAKCCKPAPPDDIIGFVTRERGISVHRKTCPSFQHLAEHAPEKVLDASW 654
           +++G D LMT LA+CC+P P DDI GFVT+ RGISVHR    C   + L  HAPE+++D W
Sbjct: 599 VVEGVDNLMTHLARCCQPIPGDDIQGFVTQGRGISVHRMDCEQLEELRHHAPERIIDTVW 658

Query: 655 AALQEGQVFAVDIEIRAQDRSGLLRDVSDALARHKLNVTAVQTQ--SRDLEASMRFTLEV 712
              G + + + A +R+GLL++++   L K+ V ++++    + M F LE+
Sbjct: 659 GGGFVGN-YTITVRVTASERNGLLKELTNTLMNEKVKVAGMKSRVDYKKQMSIMDFELEL 717

Query: 713 KQVNDLPRVLASLGDVKGVLSVTRL                                    737
           +  L RVL + VK V    RL
Sbjct: 718 TDLEVLGRVLKRIEQVKDVAEAKRL                                    742
```

The following partial DNA sequence was identified in *N. meningitidis* <SEQ ID 421>:

```
a117-1.seq
   1 ATGACCGCCA TCAGCCCGAT TCAAGACACG CAAAGCGCGA CTCTGCAAGA
  51 ATTGCGCGAA TGGTTCGACA GCTACTGCAC CGCGCTGCCG AACAACGATA
 101 AAAAACTTGT CTTAGCCGCC CGTTCGCTGG CGGAAGCACA TTACCCCGCC
 151 GATGCCGCCA CGCCGTATGG CGAACCGCTG CCCGACCACT TCCTCGGCGC
 201 GGCGCAAATG GTTCATGAAC TCGACCTGCT CCCCGATGCC GTCGCCGCCA
 251 CCCTGCTTGC CGACATCGGA CGCTACGTCC CCGACTGGAA CCTATTGGTT
 301 TCCGAACGCT GCAACAGTAC CGTCGCCGAG CTGGTCAAAG GTGTGGACGA
 351 AGTGCAGAAA CTCACCCACT TCGCCCGGGT GGACAGCCTC GCCACGCCGG
 401 AAGAACGCGC CCAGCAGGCA GAAACTATGC GGAAAATGCT GCTGGCGATG
 451 GTTACCGACA TCCGCGTCGT GTTAATCAAA CTGGCGATGC GTACGCGCAC
 501 CCTGCAATTT TTAAGCAACG CCCCCGACAG CCCCGAAAAA CGCGCCGTCG
 551 CCAAAGAAAC CCTCGACATC TTCGCCCCGC TCGCCAACCG TTTGGGCGTG
 601 TGGCAGCTCA AATGGCAGCT CGAAGATTTG GGCTTCCGCC ATCAAGAACC
 651 CGAAAAATAC CGCGAAATCG CCCTGCTTTT GGACGAAAAA CGCACCGAAC
 701 GCCTCGAATA CATCGAAAAC TTCCTTAATA TCCTGCGTAC GGAACTCAAA
 751 AAATACAATA TCCACTTTGA AGTCGCCGGC CGTCCGAAAC ACATCTACTC
 801 CATTTACAAA AAAATGGTGA AGAAAAAACT CAGCTTCGAC GGGTTGTTCG
 851 ACATCCGCGC CGTGCGGATT CTGGTTGATA CCGTCCCCGA GTGTTACACC
 901 ACACTGGGCA TTGTCCACAG CCTCTGGCAG CCCATTCCCG GCGAGTTCGA
 951 CGACTACATC GCCAACCCGA AAGGCAACGG CTATAAAAGT TTGCACACCG
1001 TCATCGTCGG CCCGGAAGAC AAAGGCGTGG AAGTGCAAAT CCGCACCTTC
1051 GATATGCACC AATTCAACGA ATTCGGTGTC GCCGCGCACT GGCGTTACAA
1101 AGAGGGCGGC AAAGGCGATT CCGCCTACGA ACAAAAAATC GCCTGGTTAC
1151 GCCAACTTTT GGACTGGCGC GAAAACATGG CGGAAAGCGG CAAGGAAGAC
1201 CTCGCCGCCG CCTTCAAAAC CGAGCTTTTC AACGACACGA TTTATGTTTT
1251 GACCCCGCAC GGCAAAGTCC TCTCCCTGCC CACAGGCGCG ACCCCCATCG
1301 ACTTCGCCTA CGCCCTGCAC AGCAGCATCG GCGACCGTTG CCGCGGTGCG
1351 AAAGTCGAAG GGCAGATTGT GCCGCTGTCC ACCCCGCTCG AAAACGGACA
1401 GCGTGTCGAA ATCATTACCG CCAAAGAAGG GCATCCTTCC GTCAACTGGC
1451 TTTACGAAGG CTGGGTCAAA TCCAACAAGG CAATCGGCAA AATCCGCGCC
1501 TACATCCGCC AGCAAAACGC CGACACCGTG CGCGAAGAAG GCCGCGTCCA
1551 ACTCGACAAA CAGCTTGCCA AACTCACGCC CAAACCCAAC CTGCAAGAGC
1601 TTGCCGAAAA TCTCGGCTAC AAAAAGCCAG AAGACCTCTA CACCGCCGTC
1651 GGACAAGGCG AAATTTCCAA CCGCGCCATC CAAAAAGCCT GCGGCACGCT
1701 GAACGAACCG CCGCCCGTAC CCGTCAGCGA AACCACCATC GTCAAACAGT
1751 CCAAAATCAA AAAAGGCGGC AAAAACGGCG TGCTCATCGA CGGCGAAGAC
1801 GGTCTGATGA CCACGCTTGC CAAATGCTGC AAACCCGCGC CGCCCGACGA
1851 CATTGTCGGC TTCGTTACCC GCGATCGCGG CATTTCGGTA CACCGCAAAA
1901 CCTGCCCCTC TTTCCGACAC CTCGCCGAAC ACGCGCCCGA AAAAGTACTG
```

```
1951 GACGCAAGTT GGGCGGCGTT GCAGGAAGGA CAAGTGTTCG CCGTCGATAT

2001 CGAAATCCGC GCCCAAGACC GCTCCGGGCT TTTGCGCGAC GTATCCGACG

2051 CGCTCGCCCG CCACAAACTC AACGTTACCG CCGTGCAAAC CCAGTCCCGC

2101 GACTTGGAAG CCAGCATGAG GTTCACGCTC GAAGTCAAAC AAGTTACCGA

2151 CCTCCCACGC GTCCTCGCCA GCCTCGGCGA CGTCAAAGGC GTATTGAGCG

2201 TTACCCGGCT TTAA
```

This corresponds to the amino acid sequence <SEQ ID 422; ORF 117-1.a>:

```
a117-1.pep

1 MTAISPIQDT QSATLQELRE WFDSYCTALP NNDKKLVLAA RSLAEAHYPA

51 DAATPYGEPL PDHFLGAAQM VHELDLLPDA VAATLLADIG RYVPDWNLLV

101 SERCNSTVAE LVKGVDEVQK LTHFARVDSL ATPEERAQQA ETMRKMLLAM

151 VTDIRVVLIK LAMRTRTLQF LSNAPDSPEK RAVAKETLDI FAPLANRLGV

201 WQLKWQLEDL GFRHQEPEKY REIALLLDEK RTERLEYIEN FLNILRTELK

251 KYNIHFEVAG RPKHIYSIYK KMVKKKLSFD GLFDIRAVRI LVDTVPECYT

301 TLGIVHSLWQ PIPGEFDDYI ANPKGNGYKS LHTVIVGPED KGVEVQIRTF

351 DMHQFNEFGV AAHWRYKEGG KGDSAYEQKI AWLRQLLDWR ENMAESGKED

401 LAAAFKTELF NDTIYVLTPH GKVLSLPTGA TPIDFAYALH SSIGDRCRGA

451 KVEGQIVPLS TPLENGQRVE IITAKEGHPS VNWLYEGWVK SNKAIGKIRA

501 YIRQQNADTV REEGRVQLDK QLAKLTPKPN LQELAENLGY KKPEDLYTAV

551 GQGEISNRAI QKACGTLNEP PPVPVSETTI VKQSIKKGG KNGVLIDGED

601 GLMTTLAKCC KPAPPDDIVG FVTRDRGISV HRKTCPSFRH LAEHAPEKVL

651 DASWAALQEG QVFAVDIEIR AQDRSGLLRD VSDALARHKL NVTAVQTQSR

701 DLEASMRFTL EVKQVNDLPR VLASLGDVKG VLSVTRL* a117-1/m117-1 97.7% identity in 737 aa overlap
                      10        20        30        40        50        60
m117-1.pep MTAISPIQDTQSATLQELREWFDSYCAALPDNDKNLIGTAWLLAQEHYPADAATPYGEPL
           ||||||||||||||||||||||||| :|||:|||:: :|   ||: ||||||||||||||
a117-1     MTAISPIQDTQSATLQELREWFDSYCTALPNNDKKLVLAARSLAEAHYPADAATPYGEPL
                      10        20        30        40        50        60
                      70        80        90       100       110       120
m117-1.pep PDHFLGAAQMVHELDLLPDAVAATLLADIGRYVPDWNLLVSERCNSTVAELVKGVDEVQK
           ||||||||||||||||||||||||||||||||||||||||||||||||||||||||||||
a117-1     PDHFLGAAQMVHELDLLPDAVAATLLADIGRYVPDWNLLVSERCNSTVAELVKGVDEVQK
                      70        80        90       100       110       120
                     130       140       150       160       170       180
m117-1.pep LTHFARVDSLATPEERAQQAETMRKMLLAMVTDIRVVLIKLAMRTRTLQFLSNAPDSPEK
           ||||||||||||||||||||||||||||||||||||||||||||||||||||||||||||
a117-1     LTHFARVDSLATPEERAQQAETMRKMLLAMVTDIRVVLIKLAMRTRTLQFLSNAPDSPEK
                     130       140       150       160       170       180
                     190       200       210       220       230       240
m117-1.pep RAVAKETLDIFAPLANRLGVWQLKWQLEDLGFRHQKPEKYREIALLLDEKRTERLEYIEN
           |||||||||||||||||||||||||||||||||||:||||||||||||||||||||||||
a117-1     RAVAKETLDIFAPLANRLGVWQLKWQLEDLGFRHQEPEKYREIALLLDEKRTERLEYIEN
                     190       200       210       220       230       240
                     250       260       270       280       290       300
m117-1.pep FLNILRGELKKYNVHFEVAGRPKHIYSIYKKMVKKKLSFDGLFDIRAVRILVDTVPECYT
           |||||| |||||||:|||||||||||||||||||||||||||||||||||||||||||||
a117-1     FLNILRTELKKYNIHFEVAGRPKHIYSIYKKMVKKKLSFDGLFDIRAVRILVDTVPECYT
                     250       260       270       280       290       300
```

```
              310        320        330        340        350        360
m117-1.pep  TLGIVHSLWQPIPGEFDDYIANPKGNGYKSLHTVIVGPEDKGVEVQIRTFDMHQFNEFGV
            ||||||||||||||||||||||||||||||||||||||||||||||||||||||||||||
a117-1      TLGIVHSLWQPIPGEFDDYIANPKGNGYKSLHTVIVGPEDKGVEVQIRTFDMHQFNEFGV
              310        320        330        340        350        360

370        380        390        400        410        420
m117-1.pep  AAHWRYKEGGKGDSAYEQKIAWLRQLLDWRENMAESGKEDLAAAFKTELFNDTIYVLTPH
            ||||||||||||||||||||||||||||||||||||||||||||||||||||||||||||
a117-1      AAHWRYKEGGKGDSAYEQKIAWLRQLLDWRENMAESGKEDLAAAFKTELFNDTIYVLTPH
              370        380        390        400        410        420

430        440        450        460        470        480
m117-1.pep  GKVLSLPTGATPIDFAYALHSSIGDRCRGAKVEGQIVPLSTPLENGQRVEIITAKEGHPS
            ||||||||||||||||||||||||||||||||||||||||||||||||||||||||||||
a117-1      GKVLSLPTGATPIDFAYALHSSIGDRCRGAKVEGQIVPLSTPLENGQRVEIITAKEGHPS
              430        440        450        460        470        480

490        500        510        520        530        540
m117-1.pep  VNWLYEGWVKSNKAIGKIRAYIRQQNADTVREEGRVQLDKQLAKLTPKPNLQELAENLGY
            ||||||||||||||||||||||||||||||||||||||||||||||||||||||||||||
a117-1      VNWLYEGWVKSNKAIGKIRAYIRQQNADTVREEGRVQLDKQLAKLTPKPNLQELAENLGY
              490        500        510        520        530        540

550        560        570        580        590        600
m117-1.pep  KKPEDLYTAVGQGEISNRAIQKACGTLNEPPPVPVSETTIVKQSKIKKGGKNGVLIDGED
            ||||||||||||||||||||||||||||||||||||||||||||||||||||||||||||
a117-1      KKPEDLYTAVGQGEISNRAIQKACGTLNEPPPVPVSETTIVKQSKIKKGGKNGVLIDGED
              550        560        570        580        590        600

610        620        630        640        650        660
m117-1.pep  GLMTTLAKCCKPAPPDDIIGFVTRERGISVHRKTCPSFQHLAEHAPEKVLDASWAALQEG
            ||||||||||||||||||:|||||:|||||||||||||:|||||||||||||||||||||
a117-1      GLMTTLAKCCKPAPPDDIVGFVTRDRGISVHRKTCPSFRHLAEHAPEKVLDASWAALQEG
              610        620        630        640        650        660

670        680        690        700        710        720
m117-1.pep  QVFAVDIEIRAQDRSGLLRDVSDALARHKLNVTAVQTQSRDLEASMRFTLEVKQVNDLPR
            |||||||||||||||||||||||||||||||||||||||||||||||||||||:||||
a117-1      QVFAVDIEIRAQDRSGLLRDVSDALARHKLNVTAVQTQSRDLEASMRFTLEVKQVTDLPR
              670        680        690        700        710        720

730
m117-1.pep  VLASLGDVKGVLSVTRLX
            ||||||||||||||||||
a117-1      VLASLGDVKGVLSVTRLX
              730
```

The following partial DNA sequence was identified in *N. gonorrhoeae* <SEQ ID 423>:

```
g118.seq
  1  ATGTGCGAGT TCAAGGATTT TAGAAGAAAC ATCCCTTGTT TTGAAGAGTA

51  TGACGAAAAT TCATTTATTG GCAAATGGTA TGATGACGGG GTGTGGGATG

101  ATGAAGAATA TTGGAAGCTG GAGAATGATT TAATcgaGGT TAGGAGAAAA

151  TATCCTTATC CGATGGATAT ACCAAGGGAT ATTGTGATTG GAATCGGTAC

201  CATTATTGAT TTTTTAATGG TTCCAAATTG GGAGCTTTTT GAAATTAAAG

251  CTTCCCCTTG GTTGCCTGAT AGCGTGGGAA TTCATGAACG TTATGAAAGA

301  TTCACAACGA TGCTCCGTTA TATTTTTACC GAGAAAGACA TAGTCAACGT

351  GCGATTTGAT TATTACAaCA AAAAATAG
```

This corresponds to the amino acid sequence <SEQ ID 424; ORF 118.ng>:

```
g118.pep
  1  MCEFKDFRRN IPCFEEYDEN SFIGKWYDDG VWDDEEYWKL ENDLIEVRRK

51  YPYPMDIPRD IVIGIGTIID FLMVPNWELF EIKASPWLPD SVGIHERYER

101  FTTMLRYIFT EKDIVNVRFD YYNKK*
```

The following partial DNA sequence was identified in *N. meningitidis* <SEQ ID 425>:

```
m118.seq
  1  ATGTGTGAGT TCAAGGATAT TATAAGAAAC GTTCCTTATT TTGAGGGGTA

51  TGACGAAAAT TCATTTATTG GCAAATGGTA TGATGACGGG GTGTGGGATG

101  ATGAAGAATA TTGGAAGTTG GAGAATGATT TAATCGAGGT TAGAAAAAAA

151  TATCCTTATC CGATGGACAT ACCAAGATAT GTTGTCATTG GAATCGGTAC

201  CATTATTGAT TTCTTAATGG TTCCAAATTG GAAACTTTTT GAAATTAAAG

251  CTTCCCCTTG GTTGCCTGAT AGTGTGGGAA TTCATGAACG TTATGAAAGA

301  TTCACAACGA TGCTCCGTTA TATTTTTACC GAGAAAGACA TAGTCAACGT

351  GCGATTTGAT TATTACAACA AAAAATAG
```

This corresponds to the amino acid sequence <SEQ ID 426; ORF 118>:

```
m118.pep
  1  MCEFKDIIRN VPYFEGYDEN SFIGKWYDDG VWDDEEYWKL ENDLIEVRKK

51  YPYPMDIPRY VVIGIGTIID FLMVPNWKLF EIKASPWLPD SVGIHERYER

101  FTTMLRYIFT EKDIVNVRFD YYNKK*
```

Computer analysis of this amino acid sequence gave the following results:
Homology with a Predicted ORF from *N. gonorrhoeae*
ORF 118 shows 92.8% identity over a 125 aa overlap with a predicted ORF (ORF 118.ng) from *N. gonorrhoeae*:

```
m118/g118
                    10         20         30         40         50         60
     m118.pep   MCEFKDIIRNVPYFEGYDENSFIGKWYDDGVWDDEEYWKLENDLIEVRKKYPYPMDIPRY
                ||||||: ||:| || ||||||||||||||||||||||||||||||:||||||||||
     g118       MCEFKDFRRNIPCFEEYDENSFIGKWYDDGVWDDEEYWKLENDLIEVRRKYPYPMDIPRD
                    10         20         30         40         50         60

70         80         90        100        110        120
     m118.pep   VVIGIGTIIDFLMVPNWKLFEIKASPWLPDSVGIHERYERFTTMLRYIFTEKDIVNVRFD
                :|||||||||||||||||:|||||||||||||||||||||||||||||||||||||||||
     g118       IVIGIGTIIDFLMVPNWELFEIKASPWLPDSVGIHERYERFTTMLRYIFTEKDIVNVRFD
                    70         80         90        100        110        120 m118.pep   YNKKX
                |||||
     g118       YNKKX
```

The following partial DNA sequence was identified in *N. meningitidis* <SEQ ID 427>:

```
a118.seq
  1  ATGTGTGAGT TCAAGGATTT TAGAAGAAAC ATCCCTTGTT TTGAAGAGTA

51  TGACGAAAAT TCATTTATTG GCAAATGGTA TGATGACGGG GTGTGGGATG
```

-continued

```
101  ATGAAGAATA TTGGAAATTG GAGAATGATT TAATCGAGGT TAGAAAAAAA
151  TATCCTTATC CGATGGATAT ACCAAGGGAT ATTGTGATTG GAATCGGTAC
201  CATTATTGAT TTTTTAATGG TTCCAAATTG GGAGCTTTTT GAAATTAAAG
251  CTTCCCCTTG GTTGCCTGAT AGTGTGGGAA TTCATGAACG TTATGAAGA
301  TTCACAACGA TGCTCCGTTA TATTTTTACC GAGAAAGACA TAGTCAACGT
351  GCGATTTGAT TATTACAACA AAAAATAG
```

This corresponds to the amino acid sequence <SEQ ID 428; ORF 118.a>:

```
a118.pep

1   MCEFKDFRRN IPCFEEYDEN SFIGKWYDDG VWDDEEYWKL ENDLIEVRKK
       51   YPYPMDIPRD IVIGIGTIID FLMVPNWELF EIKASPWLPD SVGIHERYER
      101   FTTMLRYIFT EKDIVNVRFD YYNKK* m118/a118  93.6% identity in 125 aa overlap 10         20         30         40         50         60
    m118.pep   MCEFKDIIRNVPYFEGYDENSFIGKWYDDGVWDDEEYWKLENDLIEVRKKYPYPMDIPRY
               ||||||:||:|||||||||||||||||||||||||||||||||||||||||||||||||
    a118       MCEFKDFRRNIPCFEEYDENSFIGKWYDDGVWDDEEYWKLENDLIEVRKKYPYPMDIPRD
                       10         20         30         40         50         60
                       70         80         90        100        110        120
    m118.pep   VVIGIGTIIDFLMVPNWKLFEIKASPWLPDSVGIHERYERFTTMLRYIFTEKDIVNVRFD
               :|||||||||||||||||:|||||||||||||||||||||||||||||||||||||||||
    a118       IVIGIGTIIDFLMVPNWELFEIKASPWLPDSVGIHERYERFTTMLRYIFTEKDIVNVRFD
                       70         80         90        100        110        120 m118.pep   YYNKKX
               ||||||
    a118       YYNKKX
```

The following partial DNA sequence was identified in *N. gonorrhoeae* <SEQ ID 429>:

```
g120.seq
  1  ATGATGAAGA CTTTTAAAAA TATATTTTCC GCCGCCATTT TGTCCGCCGC
 51  CCTGCCGTGC GCGTATGCGG CAAGGCTACC CCAATCCGCC GTGCTGCACT
101  ATTCCGGCAG CTACGGCATT CCCGCCACGA TGACATTTGA ACGCAGCGGC
151  AATGCTTACA AAATCGTTTC GACGATTAAA GTGCCGCTAT ACAATATCCG
201  TTTCGAATCC GGCGGTACGG TTGTCGGCAA TACCCTGCAC CCTGCCTACT
251  ATAAAGACAT ACGCAGGGGC AAACTGTATG CGGAAGCCAA ATTCGCCGAC
301  GGCAGCGTAA CCTACGGCAA AGCGGGCGAG AGCAAAACCG AGCAAAGCCC
351  CAAGGCTATG GATTTGTTCA CGCTTGCCTG GCAGTTGGCG GCAAATGACG
401  CGAAACTCCC CCCGGGTCTG AAAATCACCA ACGGCAAAAA ACTTTATTCC
451  GTCGGCGGCC TGAATAAGGC GGGTACGGGA AAATACAGCA Taggcggcgt
501  gGAAACCGAA GTCGTCAAAT ATCGGGTGCG GCGCGGCGAC GATACGGTAA
551  CGTATTTCTT CGCACCGTCC CTGAACAATA TTCCGGCACA AATCGGCTAT
601  ACCGAcgaCG GCAAAACCTA TACGCTGAAG CTCAATCGG TGCAGATCAA
651  CGGACAGGCC GCCAAACCGT AA
```

This corresponds to the amino acid sequence <SEQ ID 430; ORF 120.ng>:

```
g120.pep
  1  MMKTFKNIFS AAILSAALPC AYAARLPQSA VLHYSGSYGI PATMTFERSG

51  NAYKIVSTIK VPLYNIRFES GGTVVGNTLH PAYYKDIRRG KLYAEAKFAD

101  GSVTYGKAGE SKTEQSPKAM DLFTLAWQLA ANDAKLPPGL KITNGKKLYS

151  VGGLNKAGTG KYSIGGVETE VVKYRVRRGD DTVTYFFAPS LNNIPAQIGY

201  TDDGKTYTLK LKSVQINGQA AKP*
```

The following partial DNA sequence was identified in *N. meningitidis* <SEQ ID 431>:

```
m120.seq
  1  ATGATGAAGA CTTTTAAAAA TATATTTTCC GCCGCCATTT TGTCCGCCGC

51  CCTGCCGTGC GCGTATGCGG CAGGGCTGCC CCAATCCGCC GTGCTGmACT

101  ATTCCGGCAG CTACGGCATT CCCGCCACGA TGACATTTGA ACGCAGCGGC

151  AATGCTTACA AAATCGTTTC GACGATTAAA GTGCCGCTAT ACAATATCCG

201  TTTCGAGTCC GGCGGTACGG TTGTCGGCAA TACCCTGCAC CCTACCTACT

251  ATAGAGACAT ACGCAGGGGC AAACTGTATG CGGAAGCcAA ATTCGCCGAC

301  GGCAGCGTAA CTTACGGCAA AGCGGGCGAG AGCAAAACCG AGCAAAGCCC

351  CAAGGCTATG GATTTGTTCA CGCTTGCCTG GCAGTTGGCG GCAAATGACG

401  CGAAACTCCC CCCGGGGCTG AAAATCACCA ACGGCAAAAA ACTTTATTCC

451  GTCGGCGGTT TGAATAAGGC GGGTACAGGA AAATACAGCA TAGGCGGCGT

501  GGAAACCGAA GTCGTCAAAT ATCGGGTGCG GCGCGGCGAC GATGCGGTAA

551  TGTATTTCTT CGCACCGTCC CTGAACAATA TTCCGGCACA AATCGGCTAT

601  ACCGACGACG GCAAAACCTA TACGCTGAAA CTCAAATCGG TGCAGATCAA

651  CGGCCAGGCA GCCAAACCG
                                              40
```

This corresponds to the amino acid sequence <SEQ ID 432; ORF 120>:

```
m120.pep
  1  MMKTFKNIFS AAILSAALPC AYAAGLPQSA VLXYSGSYGI PATMTFERSG

51  NAYKIVSTIK VPLYNIRFES GGTVVGNTLH PTYYRDIRRG KLYAEAKFAD

101  GSVTYGKAGE SKTEQSPKAM DLFTLAWQLA ANDAKLPPGL KITNGKKLYS

151  VGGLNKAGTG KYSIGGVETE VVKYRVRRGD DAVMYFFAPS LNNIPAQIGY

201  TDDGKTYTLK LKSVQINGQA AKP
```

Computer analysis of this amino acid sequence gave the following results:
Homology with a Predicted ORF from *N. gonorrhoeae*
ORF 120 shows 97.3% identity over a 223 aa overlap with a predicted ORF (ORF 120.ng) from *N. gonorrhoeae*:

```
m120/g120

10         20         30         40         50         60
m120.pep    MMKTFKNIFSAAILSAALPCAYAAGLPQSAVLXYSGSYGIPATMTFERSGNAYKIVSTIK
            ||||||||||||||||||||||| ||||||| |||||||||||||||||||||||||||||
g120        MMKTFKNIFSAAILSAALPCAYAARLPQSAVLHYSGSYGIPATMTFERSGNAYKIVSTIK
                      10         20         30         40         50         60
```

```
                       70        80        90       100       110       120
m120.pep  VPLYNIRFESGGTVVGNTLHPTYYRDIRRGKLYAEAKFADGSVTYGKAGESKTEQSPKAM
          |||||||||||||||||||||||:||:|||||||||||||||||||||||||||||||||
g120      VPLYNIRFESGGTVVGNTLHPAYYKDIRRGKLYAEAKFADGSVTYGKAGESKTEQSPKAM
                       70        80        90       100       110       120

130       140       150       160       170       180
m120.pep  DLFTLAWQLAANDAKLPPGLKITNGKKLYSVGGLNKAGTGKYSIFFVETEVVKYRVRRGD
          ||||||||||||||||||||||||||||||||||||||||||||||||||||||||||||
g120      DLFTLAWQLAANDAKLPPGLKITNGKKLYSVGGLNKAGTGKYSIFFVETEVVKYRVRRGD
                      130       140       150       160       170       180

190       200       210       220
m120.pep  DAVMYFFAPSLNNIPAQIGYTDDGKTYTLKLKSVQINGQAAKP
          |:||||||||||||||||||||||||||||||||||||||||
g120      DTVTYFFAPSLNNIPAQIGYTDDGKTYTLKLKSVQINGQAAKPX
                      190       200       210       220
```

The following partial DNA sequence was identified in *N. meningitidis* <SEQ ID 433>:

```
a120.seq
  1  ATGATGAAGA CTTTTAAAAA TATATTTTCC GCCGCCATTT TGTCCGCCGC

51  CCTGCCGTGC GCGTATGCGG C

```
                  70         80         90        100        110        120
m120.pep  VPLYNIRFESGGTVVGNTLHPTYYRDIRRGKLYAEAKFADGSVTYGKAGESKTEQSPKAM
          ||||||||||||||||||||||||||||||||||||||||||||||||||||||||||||
a120      VPLYNIRFESGGTVVGNTLHPTYYRDIRRGKLYAEAKFADGSVTYGKAGESKTEQSPKAM
                  70         80         90        100        110        120

130        140        150        160        170        180
m120.pep  DLFTLAWQLAANDAKLPPGLKITNGKKLYSVGGLNKAGTGKYSIGGVETEVVKYRVRRGD
          ||||||||||||||||||||||||||||||||||||||||||||||||||||||||||||
a120      DLFTLAWQLAANDAKLPPGLKITNGKKLYSVGGLNKAGTGKYSIGGVETEVVKYRVRRGD
                 130        140        150        160        170        180

190        200        210        220
m120.pep  DAVMYFFAPSLNNIPAQIGYTDDGKTYTLKLKSVQINGQAKPX
          ||||||||||||||||||||||||||||||||||||||||||
a120      DAVMYFFAPSLNNIPAQIGYTDDGKTYTLKLKSVQINGQAKPX
                 190        200        210        220
```

The following partial DNA sequence was identified in *N. gonorrhoeae* <SEQ ID 435>:

```
g121.seq
   1 ATGGAAACAC AGCTTTACAT CGGCATTATG TCGGGAACCA GTATGGACGG

51 GGCGGATGCC GTGCTGGTAC GGATGGACGG CGGCAAATGG CTGGGCGCGG

101 AAGGGCACGC CTTTACCCCC TACCCTGACC GGTTGCGCCG CAAATTGCTG

151 GATTTGCAGG ACACAGGCAC AGACGAACTG CACCGCAGCA GGATGTTGTC

201 GCAAGAACTC AGCCGCCTGT ACGCGCAAAC CGCCGCCGAA CTGCTGTGCA

251 GTCAAAACCT CGCTCCGTGC GACATTACCG CCCTCGGCTG CCACGGGCAA

301 ACCGTCCGAC ACGCGCCGGA ACACGGTtac AGCATACAGC TTGCCGATTT

351 GCCGCTGCTG GCGGAACTGa cgcggatttT TACCGTCggc gacttcCGCA

401 GCCGCGACCT TGCTGCCGGC GGacaAGGTG CGCCGCTCGT CCCCGCCTTT

451 CACGAAGCCC TGTTCCGCGA TGACAGGGAA ACACGCGTGG TACTGAACAT

501 CGGCGGGATT GCCAACATCA GCGTACTCCC CCCCGGCGCA CCCGCCTTCG

551 GCTTCGACAC AGGGCCGGGC AATATGCTGA TGGAcgcgtg gacgcaggca 601 cacTGGcagc TGCCTTACGA CAAAAacggt gcAAAGgcgg cacAAGGCAA 651 catatTGCcg cAACTGCTCG gcaggctGCT CGCCcaccCG TATTTCTCAC 701 AACCCcaccc aaAAAGCACG GGgcGCGaac TgtttgcccT AAattggctc 751 gaaacctAcc ttgacggcgg cgaaaaccga tacgacgtat tgcggacgct 801 ttcccgattc accgcgcaaA ccgTttggga cgccgtctca CACGCAGCGG

851 CAGATGCCCG TCAAATGTAC ATTTGCGGCG CGGCATCCG CAATCCTGTT

901 TTAATGGCGG ATTTGGCAGA ATGTTTCGGC ACACGCGTTT CCCTGCACAG

951 CACCGCCGAA CTGAACCTCG ATCCTCAATG GGTGGAGGCG gccgCATTtg 1001 cgtggttggC GGCGTGTTGG ATTAACCGCA TTCCCGGTAG TCCGCACAAA

1051 GCGACCGGCG CATCCAAACC GTGTATTCTG GGCGCGGGAT ATTATTATTG

1101 A
```

This corresponds to the amino acid sequence <SEQ ID 436; ORF 121.ng>:

```
g121.pep
   1 METQLYIGIM SGTSMDGADA VLVRMDGGKW LGAEGHAFTP YPDRLRRKLL

51 DLQDTGTDEL HRSRMLSQEL SRLYAQTAAE LLCSQNLAPC DITALGCHGQ
```

-continued

```
101  TVRHAPEHGY SIQLADLPLL AELTRIFTVG DFRSRDLAAG GQGAPLVPAF

151  HEALFRDDRE TRVVLNIGGI ANISVLPPGA PAFGFDTGPG NMLMDAWTQA

201  HWQLPYDKNG AKAAQGNILP QLLGRLLAHP YFSQPHPKST GRELFALNWL

251  ETYLDGGENR YDVLRTLSRF TAQTVWDAVS HAAADARQMY ICGGGIRNPV

301  LMADLAECFG TRVSLHSTAE LNLDPQWVEA AAFAWLAACW INRIPGSPHK

351  ATGASKPCIL GAGYYY*
```

The following partial DNA sequence was identified in *N. meningitidis* <SEQ ID 437>:

```
m121.seq
   1  ATGGAAACAC AGCTTTACAT CGGCATCATG TCGGGAACCA GCATGGACGG

51  GGCGGATGCC GTACTGATAC GGATGGACGG CGGCAAATGG CTGGGCGCGG

101  AAGGGCACGC CTTTACCCCC TACCCCGGCA GGTTACGCCG CCAATTGCTG

151  GATTTGCAGG ACACAGGCGC AGACGAACTG CACCGCAGCA GGATTTTGTC

201  GCAAGAACTC AGCCGCCTAT ATGCGCAAAC CGCCGCCGAA CTGCTGTGCA

251  GTCAAAACCT CGCACCGTCC GACATTACCG CCCTCGGCTG CCACGGGCAA

301  ACCGTCCGAC ACGCGCCGGA ACACGGTTAC AGCATACAGC TTGCCGATTT

351  GCCGCTGCTG GCGxxxxxxx xxxxxxxxxx xxxxxxxxxx xxxxxxxxxx 401  xxxxxxxxxx xxxxxxxxxx xxxxxxxxxx xxxxxxxxxx xxxxxxxxxx 451  xxxxxxxxxx xxxxxxxxxx xxxxxxxxxx xxxxxxxxxx xxxxxxxxxx 501  xxxxxxxxxx xxxxxxxxxx xxxxxxxxxx xxxxxxxxxx xxxxxxxxxx 551  xxxxxxxxxx xxxxxxxxxx xxxxxxxxxx xxxxxxxxxx xxxxxxxxxx 601  xxxxxxCAGC TTCCTTACGA CAAAAACGGT GCAAAGTCGG CACAAGGCAA

651  CATATTGCCG CAACTGCTCG ACAGGCTGCT CGCCCACCCG TATTTCGCAC

701  AACGCCACCC TAAAAGCACG GGGCGCGAAC TGTTTGCCAT AAATTGGCTC

751  GAAACCTACC TTGACGGCGG CGAAAACCGA TACGACGTAT TGCGGACGCT

801  TTCCCGTTTT ACCGCGCAAA CCGTTTGCGA CGCCGTCTCA CACGCAGCGG

851  CAGATGCCCG TCAAATGTAC ATTTGCGACG GCGGCATCCG CAATCCTGTT

901  TTAATGGCGG ATTTGGCAGA ATGTTTCGGC ACACGCGTTT CCCTGCACAG

951  CACCGCCGAC CTGAACCTCG ATCCGCAATG GGTGGAAGCC GCCGnATTTG

1001  CGTGGTTGGC GGCGTGTTGG ATTAATCGCA TTCCCGGTAG TCCGCACAAA

1051  GCAACCGGCG CATCCAAACC GTGTATTCTG AnCGCGGGAT ATTATTATTG

1101  A
```

This corresponds to the amino acid sequence <SEQ ID 438; ORF 121>:

```
m121.pep
   1  METQLYIGIM SGTSMDGADA VLIRMDGGKW LGAEGHAFTP YPGRLRRQLL

51  DLQDTGADEL HRSRILSQEL SRLYAQTAAE LLCSQNLAPS DITALGCHGQ

101  TVRHAPEHGY SIQLADLPLL Axxxxxxxxx xxxxxxxxxx xxxxxxxxxx 151  xxxxxxxxxx xxxxxxxxxx xxxxxxxxxx xxxxxxxxxx xxxxxxxxxx 201  xxQLPYDKNG AKSAQGNILP QLLDRLLAHP YFAQRHPKST GRELFAINWL
```

```
-continued
251 ETYLDGGENR YDVLRTLSRF TAQTVCDAVS HAAADARQMY ICDGGIRNPV

301 LMADLAECFG TRVSLHSTAD LNLDPQWVEA AXFAWLAACW INRIPGSPHK

351 ATGASKPCIL XAGYYY*
```

Computer analysis of the amino acid sequences gave the following results:
Homology with a Predicted ORF from *N. meningitidis* menA with menB 10

ORF 121 shows 73.5% identity over a 366 aa overlap with a predicted ORF (ORF121.ng) from *N. gonorrhoeae*:

```
    m121/g121

10         20         30         40         50         60
        m121.pep    METQLYIGIMSGTSMDGADAVLIRMDGGKWLGAEGHAFTPYPGRLRRQLLDLQDTGADEL
                    |||||||||||||||||||||||:|||||||||||||||||| ||||:||||||||:|||
        g121        METQLYIGIMSGTSMDGADAVLVRMDGGKWLGAEGHAFTPYPDRLRRKLLDLQDTGTDEL
                    10         20         30         40         50         60
                    70         80         90        100        110        120
        m121.pep    HRSRILSQELSRLYAQTAAELLCSQNLAPSDITALGCHGQTVRHAPEHGYSIQLADLPLL
                    ||||:||||||||||||||||||||||||| |||||||||||||||||||||||||||||
        g121        HRSRMLSQELSRLYAQTAAELLCSQNLAPCDITALGCHGQTVRHAPEHGYSIQLADLPLL
                    70         80         90        100        110        120
                    130        140        150        160        170        180
        m121.pep    AXXXXXXXXXXXXXXXXXXXXXXXXXXXXXXXXXXXXXXXXXXXXXXXXXXXXXXXXXX
                    |    :                                           :
        g121        AELTRIFTVGDFRSRDLAAGGQGAPLVPAFHEALFRDDRETRVVLNIGGIANISVLPPGA
                    130        140        150        160        170        180
                    190        200        210        220        230        240
        m121.pep    XXXXXXXXXXXXXXXXXXXXXXXXQLPYDKNGAKSAQGNILPQLLDRLLAHPYFAQRHPKST
                            :          :        ||||||||||:||||||||||  |||||||:| |||||
        g121        PAFGFDTGPGNMLMDAWTQAHWQLPYDKNGAKAAQGNILPQLLGRLLAHPYFSQPHPKST
                    190        200        210        220        230        240
                    250        260        270        280        290        300
        m121.pep    GRELFAINWLETYLDGGENRYDVLRTLSRFTAQTVCDAVSHAAADARQMYICDGGIRNPV
                    ||||||:||||||||||||||||||||||||||||| |||||||||||||||| |||||||
        g121        GRELFALNWLETYLDGGENRYDVLRTLSRFTAQTVWDAVSHAAADARQMYICGGGIRNPV
                    250        260        270        280        290        300
                    310        320        330        340        350        360
        m121.pep    LMADLAECFGTRVSLHSTADLNLDPQWVEAAXFAWLAACWINRIPGSPHKATGASKPCIL
                    |||||||||||||||||||:||||||||||| ||||||||||||||||||||||||||||
        g121        LMADLAECFGTRVSLHSTAELNLDPQWVEAAAFAWLAACWINRIPGSPHKATGASKPCIL
                    310        320        330        340        350        360
        m121.pep    XAGYYYX
                    ||||||
        g121        GAGYYYX
```

The following partial DNA sequence was identified in *N. meningitidis* <SEQ ID 439>:

```
a121.seq
    1 ATGGAAACAC AGCTTTACAT CGGCATCATG TCGGGAACCA GCATGGACGG

51 GGCGGATGCC GTACTGATAC GGATGGACGG CGGCAAATGG CTGGGCGCGG

101 AAGGGCACGC CTTTACCCCC TACCCCGGCA GGTTACGCCG CAAATTGCTG

151 GATTTGCAGG ACACAGGCGC GGACGAACTG CACCGCAGCA GGATGTTGTC

201 GCAAGAACTC AGCCGCCTGT ACGCGCAAAC CGCCGCCGAA CTGCTGTGCA

251 GTCAAAACCT CGCGCCGTCC GACATTACCG CCCTCGGCTG CCACGGGCAA

301 ACCGTCAGAC ACGCGCCGGA ACACAGTTAC AGCGTACAGC TTGCCGATTT
```

-continued

```
 351  GCCGCTGCTG GCGGAACGGA CTCAGATTTT TACCGTCGGC GACTTCCGCA

401  GCCGCGACCT TGCGGCCGGC GGACAAGGCG CGCCGCTCGT CCCCGCCTTT

451  CACGAAGCCC TGTTCCGCGA CGACAGGGAA ACACGCGCGG TACTGAACAT

501  CGGCGGGATT GCCAACATCA GCGTACTCCC CCCCGACGCA CCCGCCTTCG

551  GCTTCGACAC AGGACCGGGC AATATGCTGA TGGACGCGTG GATGCAGGCA

601  CACTGGCAGC TTCCTTACGA CAAAAACGGT GCAAAGGCGG CACAAGGCAA

651  CATATTGCCG CAACTGCTCG ACAGGCTGCT CGCCCACCCG TATTTCGCAC

701  AACCCCACCC TAAAAGCACG GGGCGCGAAC TGTTTGCCCT AAATTGGCTC

751  GAAACCTACC TTGACGGCGG CGAAAACCGA TACGACGTAT TGCGGACGCT

801  TTCCCGATTC ACCGCGCAAA CCGTTTTCGA CGCCGTCTCA CACGCAGCGG

851  CAGATGCCCG TCAAATGTAC ATTTGCGGCG GCGGCATCCG CAATCCTGTT

901  TTAATGGCGG ATTTGGCAGA ATGTTTCGGC ACACGCGTTT CCCTGCACAG

951  CACCGCCGAA CTGAACCTCG ATCCGCAATG GGTAGAAGCC GCCGCGTTCG

1001  CATGGATGGC GGCGTGTTGG GTCAACCGCA TTCCCGGTAG TCCGCACAAA

1051  GCAACCGGCG CATCCAAACC GTGTATTCTG GGCGCGGGAT ATTATTATTG

1101  A
```

This corresponds to the amino acid sequence <SEQ ID 440; ORF 121.a>:

```
a121.pep

1  METQLYIGIM SGTSMDGADA VLIRMDGGKW LGAEGHAFTP YPGRLRRKLL

51  DLQDTGADEL HRSRMLSQEL SRLYAQTAAE LLCSQNLAPS DITALGCHGQ

101  TVRHAPEHSY SVQLADLPLL AERTQIFTVG DFRSRDLAAG GQGAPLVPAF

151  HEALFRDDRE TRAVLNIGGI ANISVLPPDA PAFGFDTGPG NMLMDAWMQA

201  HWQLPYDKNG AKAAQGNILP QLLDRLLAHP YFAQPHPKST GRELFALNWL

251  ETYLDGGENR YDVLRTLSRF TAQTVFDAVS HAAADARQMY ICGGGIRNPV

301  LMADLAECFG TRVSLHSTAE LNLDPQWVEA AAFAWMAACW VNRIPGSPHK

351  ATGASKPCIL GAGYYY* m121/a121  74.0% identity in 366 aa overlap 10         20         30         40         50         60
m121.pep  METQLYIGIMSGTSMDGADAVLIRMDGGKWLGAEGHAFTPYPGRLRRQLLDLQDTGADEL
          |||||||||||||||||||||||||||||||||||||||||||||||:||||||||||||
a121      METQLYIGIMSGTSMDGADAVLIRMDGGKWLGAEGHAFTPYPGRLRRKLLDLQDTGADEL
                10         20         30         40         50         60

70         80         90        100        110        120
m121.pep  HRSRILSQELSRLYAQTAAELLCSQNLAPSDITALGCHGQTVRHAPEHGYSIQLADLPLL
          ||||:|||||||||||||||||||||||||||||||||||||||||||:||:||||||||
a121      HRSRMLSQELSRLYAQTAAELLCSQNLAPSDITALGCHGQTVRHAPEHSYSVQLADLPLL
                70         80         90        100        110        120

130        140        150        160        170        180
m121.pep  AXXXXXXXXXXXXXXXXXXXXXXXXXXXXXXXXXXXXXXXXXXXXXXXXXXXXXXXXXXX
          |  :                                    :
a121      AERTQIFTVGDFRSRDLAAGGQGAPLVPAFHEALFRDDRETRAVLNIGGIANISVLPPDA
               130        140        150        160        170        180

190        200        210        220        230        240
m121.pep  XXXXXXXXXXXXXXXXXXXXXXQLPYDKNGAKSAQGNILPQLLDRLLAHPYFAQRHPKST
              :                     ||||||||||:|||||||||||||||||||||||||
a121      PAFGFDTGPGNMLMDAWMQAHWQLPYDKNGAKAAQGNILPQLLDRLLAHPYFAQPHPKST
               190        200        210        220        230        240
```

-continued

```
                250         260         270         280         290         300
m121.pep  GRELFAINWLETYLDGGENRYDVLRTLSRFTAQTVCDAVSHAAADARQMYICDGGIRNPV
          ||||||:|||||||||||||||||||||||||||| ||||||||||||||| |||||||
a121      GRELFALNWLETYLDGGENRYDVLRTLSRFTAQTVFDAVSHAAADARQMYICGGGIRNPV
                250         260         270         280         290         300

310         320         330         340         350         360
m121.pep  LMADLAECFGTRVSLHSTADLNLDPQWVEAAXFAWLAACWINRIPGSPHKATGASKPCIL
          ||||||||||||||||||:|||||||||| |||:||||:||||||||||||||||||
a121      LMADLAECFGTRVSLHSTAELNLDPQWVEAAAFAWMAACWVNRIPGSPHKATGASKPCIL
                310         320         330         340         350         360 m121.pep  XAGYYYX
           ||||||
a121      GAGYYYX
```

The following partial DNA sequence was identified in *N. meningitidis* <SEQ ID 441>:

```
m121-1.seq
   1  ATGGAAACAC AGCTTTACAT CGGCATCATG TCGGGAACCA GCATGGACGG

51  GGCGGATGCC GTACTGATAC GGATGGACGG CGGCAAATGG CTGGGCGCGG

101  AAGGGCACGC CTTTACCCCC TACCCCGGCA GGTTACGCCG CCAATTGCTG

151  GATTTGCAGG ACACAGGCGC AGACGAACTG CACCGCAGCA GGATTTTGTC

201  GCAAGAACTC AGCCGCCTAT ATGCGCAAAC CGCCGCCGAA CTGCTGTGCA

251  GTCAAAACCT CGCACCGTCC GACATTACCG CCCTCGGCTG CCACGGGCAA

301  ACCGTCCGAC ACGCGCCGGA ACACGGTTAC AGCATACAGC TTGCCGATTT

351  GCCGCTGCTG GCGGAACGGA CGCGGATTTT TACCGTCGGC GACTTCCGCA

401  GCCGCGACCT TGCGGCCGGC GGACAAGGCG CGCCACTCGT CCCCGCCTTT

451  CACGAAGCCC TGTTCCGCGA CAACAGGGAA ACACGCGCGG TACTGAACAT

501  CGGCGGGATT GCCAACATCA GCGTACTCCC CCCCGACGCA CCCGCCTTCG

551  GCTTCGACAC AGGGCCGGGC AATATGCTGA TGGACGCGTG GACGCAGGCA

601  CACTGGCAGC TTCCTTACGA CAAAAACGGT GCAAAGGCGG CACAAGGCAA

651  CATATTGCCG CAACTGCTCG ACAGGCTGCT CGCCCACCCG TATTTCGCAC

701  AACCCCACCC TAAAAGCACG GGGCGCGAAC TGTTTGCCCT AAATTGGCTC

751  GAAACCTACC TTGACGGCGG CGAAAACCGA TACGACGTAT TGCGGACGCT

801  TTCCCGTTTT ACCGCGCAAA CCGTTTGCGA CGCCGTCTCA CACGCAGCGG

851  CAGATGCCCG TCAAATGTAC ATTTGCGGCG GCGGCATCCG CAATCCTGTT

901  TTAATGGCGG ATTTGGCAGA ATGTTTCGGC ACACGCGTTT CCCTGCACAG

951  CACCGCCGAC CTGAACCTCG ATCCGCAATG GGTGGAAGCC GCCGNATTTG

1001  CGTGGTTGGC GGCGTGTTGG ATTAATCGCA TTCCCGGTAG TCCGCACAAA

1051  GCAACCGGCG CATCCAAACC GTGTATTCTG ANCGCGGGAT ATTATTATTG

1101  A
```

This corresponds to the amino acid sequence <SEQ ID 442; ORF 121-1>:

```
m121-1.pep

1 METQLYIGIM SGTSMDGADA VLIRMDGGKW LGAEGHAFTP YPGRLRRQLL

51 DLQDTGADEL HRSRILSQEL SRLYAQTAAE LLCSQNLAPS DITALGCHGQ

101 TVRHAPEHGY SIQLADLPLL AERTRIFTVG DFRSRDLAAG GQGAPLVPAF
```

-continued

```
151 HEALFRDNRE TRAVLNIGGI ANISVLPPDA PAFGFDTGPG NMLMDAWTQA

201 HWQLPYDKNG AKAAQGNILP QLLDRLLAHP YFAQPHPKST GRELFALNWL

251 ETYLDGGENR YDVLRTLSRF TAQTVCDAVS HAAADARQMY ICGGGIRNPV

301 LMADLAECFG TRVSLHSTAD LNLDPQWVEA AXFAWLAACW INRIPGSPHK

351 ATGASKPCIL XAGYYY*
```

```
m121-1/g121  95.6% identity in 366 aa overlap 10        20        30        40        50        60
m121-1.pep   METQLYIGIMSGTSMDGADAVLIRMDGGKWLGAEGHAFTPYPGRLRRQLLDLQDTGADEL
             ||||||||||||||||||||||:||||||||||||||||||| ||||:||||||||:|||
g121         METQLYIGIMSGTSMDGADAVLVRMDGGKWLGAEGHAFTPYPDRLRRKLLDLQDTGTDEL
                     10        20        30        40        50        60

70        80        90       100       110       120
m121-1.pep   HRSRILSQELSRLYAQTAAELLCSQNLAPSDITALGCHGQTVRHAPEHGYSIQLADLPLL
             ||||:||||||||||||||||||||||||| |||||||||||||||||||||||||||||
g121         HRSRMLSQELSRLYAQTAAELLCSQNLAPCDITALGCHGQTVRHAPEHGYSIQLADLPLL
                     70        80        90       100       110       120

130       140       150       160       170       180
m121-1.pep   AERTRIFTVGDFRSRDLAAGGQGAPLVPAFHEALFRDNRETRAVLNIGGIANISVLPPDA
             || ||||||||||||||||||||||||||||||||||:||||:||||||||||||||| |
g121         AELTRIFTVGDFRSRDLAAGGQGAPLVPAFHEALFRDDRETRVVLNIGGIANISVLPPGA
                    130       140       150       160       170       180

190       200       210       220       230       240
m121-1.pep   PAFGFDTGPGNMLMDAWTQAHWWLPYDKNGAKAAQGNILPQLLDRLLAHPYFAQPHPKST
             |||||||||||||||||||||||||||||||||||||||||||| ||||||||:||||||
g121         PAFGFDTGPGNMLMDAWTQAHWQLPYDKNGAKAAQGNILPQLLGRLLAHPYFSQPHPKST
                    190       200       210       220       230       240

250       260       270       280       290       300
m121-1.pep   GRELFALNWLETYLDGGENRYDVLRTLSRFTAQTVCDAVSHAAADARQMYICGGGIRNPV
             ||||||||||||||||||||||||||||||||||| ||||||||||||||||||||||||
g121         GRELFALNWLETYLDGGENRYDVLRTLSRFTAQTVWDAVSHAAADARQMYICGGGIRNPV
                    250       260       270       280       290       300

310       320       330       340       350       360
m121-1.pep   LMADLAECFGTRVSLHSTADLNLDPQWVEAAXFAWLAACWINRIPGSPHKATGASKPCIL
             ||||||||||||||||||:|||||||||||| ||||||||||||||||||||||||||||
g121         LMADLAECFGTRVSLHSTAELNLDPQWVEAAAFAWLAACWINRIPGSPHKATGASKPCIL
                    310       320       330       340       350       360 m121-1.pep   XAGYYYX
              ||||||
g121         GAGYYYX
```

The following partial DNA sequence was identified in *N. meningitidis* <SEQ ID 443>:

```
a121-1.seq
   1  ATGGAAACAC AGCTTTACAT CGGCATCATG TCGGGAACCA GCATGGACGG

51  GGCGGATGCC GTACTGATAC GGATGGACGG CGGCAAATGG CTGGGCGCGG

101  AAGGGCACGC CTTTACCCCC TACCCCGGCA GGTTACGCCG CAAATTGCTG

151  GATTTGCAGG ACACAGGCGC GGACGAACTG CACCGCAGCA GGATGTTGTC

201  GCAAGAACTC AGCCGCCTGT ACGCGCAAAC CGCCGCCGAA CTGCTGTGCA

251  GTCAAAACCT CGCGCCGTCC GACATTACCG CCCTCGGCTG CCACGGGCAA

301  ACCGTCAGAC ACGCGCCGGA ACACAGTTAC AGCGTACAGC TTGCCGATTT

351  GCCGCTGCTG GCGGAACGGA CTCAGATTTT TACCGTCGGC GACTTCCGCA

401  GCCGCGACCT TGCGGCCGGC GGACAAGGCG CGCCGCTCGT CCCCGCCTTT

451  CACGAAGCCC TGTTCCGCGA CGACAGGGAA ACACGCGCGG TACTGAACAT

501  CGGCGGGATT GCCAACATCA GCGTACTCCC CCCCGACGCA CCCGCCTTCG

551  GCTTCGACAC AGGACCGGGC AATATGCTGA TGGACGCGTG GATGCAGGCA

601  CACTGGCAGC TTCCTTACGA CAAAAACGGT GCAAAGGCGG CACAAGGCAA
```

-continued

```
 651 CATATTGCCG CAACTGCTCG ACAGGCTGCT CGCCCACCCG TATTTCGCAC

701 AACCCCACCC TAAAAGCACG GGGCGCGAAC TGTTTGCCCT AAATTGGCTC

751 GAAACCTACC TTGACGGCGG CGAAAACCGA TACGACGTAT TGCGGACGCT

801 TTCCCGATTC ACCGCGCAAA CCGTTTTCGA CGCCGTCTCA CACGCAGCGG

851 CAGATGCCCG TCAAATGTAC ATTTGCGGCG GCGGCATCCG CAATCCTGTT

901 TTAATGGCGG ATTTGGCAGA ATGTTTCGGC ACACGCGTTT CCCTGCACAG

951 CACCGCCGAA CTGAACCTCG ATCCGCAATG GGTAGAAGCC GCCGCGTTCG

1001 CATGGATGGC GGCGTGTTGG GTCAACCGCA TTCCCGGTAG TCCGCACAAA

1051 GCAACCGGCG CATCCAAACC GTGTATTCTG GGCGCGGGAT ATTATTATTG

1101 A
```

This corresponds to the amino acid sequence <SEQ ID 444; ORF 121-1.a>:

```
a114.pep

1 METQLYIGIM SGTSMDGADA VLIRMDGGKW LGAEGHAFTP YPGRLRRKLL

51 DLQDTGADEL HRSRMLSQEL SRLYAQTAAE LLCSQNLAPS DITALGCHGQ

101 TVRHAPEHSY SVQLADLPLL AERTQIFTVG DFRSRDLAAG GQGAPLVPAF

151 HEALFRDDRE TRAVLNIGGI ANISVLPPDA PAFGFDTGPG NMLMDAWMQA

201 HWQLPYDKNG AKAAQGNILP QLLDRLLAHP YFAQPHPKST GRELFALNWL

251 ETYLDGGENR YDVLRTLSRF TAQTVFDAVS HAAADARQMY ICGGGIRNPV

301 LMADLARCFG TRVSLHSTAE LNLDPQWVEA AFAWMAACW VNRIPGSPHK

351 ATGASKPCIL GAGYYY* m121-1/a121-1 96.4% identity in 366 aa overlap 10         20         30         40         50         60
m121-1.pep METQLYIGIMSGTSMDGADAVLIRMDGGKWLGAEGHAFTPYPGRLRRQLLDLQDTGADEL
           ||||||||||||||||||||||||||||||||||||||||||||||||:||||||||||
a121-1     METQLYIGIMSGTSMDGADAVLIRMDGGKWLGAEGHAFTPYPGRLRRKLLDLQDTGADEL
                   10         20         30         40         50         60

70         80         90        100        110        120
m114.pep   HRSRILSQELSRLYAQTAAELLCSQNLAPSDITALGCHGQTVRHAPEHGYSIQLADLPLL
           ||||:|||||||||||||||||||||||||||||||||||||||||||:||:|||||||
a121-1     HRSRMLSQELSRLYAQTAAELLCSQNLAPSDITALGCHGQTVRHAPEHSYSVQLADLPLL
                   70         80         90        100        110        120

130        140        150        160        170        180
m114.pep   AERTRIFTVGDFRSRDLAAGGQGAPLVPAFHEALFRDNRETRAVLNIGGIANISVLPPDA
           ||||:|||||||||||||||||||||||||||||||:|||||||||||||||||||||
a121-1     AERTQIFTVGDFRSRDLAAGGQGAPLVPAFHEALFRDDRETRAVLNIGGIANISVLPPDA
                  130        140        150        160        170        180

190        200        210        220        230        240
m114.pep   PAFGFDTGPGNMLMDAWTQAHWQLPYDKNGAKAAQGNILPQLLDRLLAHPYFAQPHPKST
           |||||||||||||||||| ||||||||||||||||||||||||||||||||||||||||
a121-1     PAFGFDTGPGNMLMDAWMQAHWQLPYDKNGAKAAQGNILPQLLDRLLAHPYFAQPHPKST
                  190        200        210        220        230        240

250        260        270        280        290        300
m114.pep   GRELFALNWLETYLDGGENRYDVLRTLSRFTAQTVCDAVSHAAADARQMYICGGGIRNPV
           |||||||||||||||||||||||||||||||||| |||||||||||||||||||||||
a121-1     GRELFALNWLETYLDGGENRYDVLRTLSRFTAQTVFDAVSHAAADARQMYICGGGIRNPV
                  250        260        270        280        290        300
```

```
                   310        320        330        340        350        360
m114.pep   LMADLAECFGTRVSLHSTADLNLDPQWVEAAXFAWLAACWINRIPGSPHKATGASKPCIL
           ||||||||||||||||||:||||||||||| |||:||||:||||||||||||||||||||
a121-1     LMADLAECFGTRVSLHSTAELNLDPQWVEAAAFAWMAACWVNRIPGSPHKATGASKPCIL
                   310        320        330        340        350        360 m114.pep   XAGYYYX
           ||||||
a121-1     GAGYYYX
```

The following partial DNA sequence was identified in *N. gonorrhoeae* <SEQ ID 445>:

```
g122.seq
    1  ATGGCTTTAC TGAGCATCCG CAAGCTGCAC AAACAATACG GCAGCGTAAC

51  CGCCATCCAA TCCTTAGACT TGGACTTGGA AAAAGGCGAA GtcatCGTAC

101  TGCTGGGCCC gTccggctgc ggCAAATCCA CCCTcctgcg ctgcgtcaaC

151  GGTTTGGAGC CGCACCAagg cgGCAGCATC GTGATGGACG GTgtcgGCGA

201  ATTCggcAAA GACGTTTCCT GGCAAACCGC CCGGCAAAAa gtcggtatgg 251  tctttcaaag taacgAactg Tttgcccaca tgaccgtcat cgAaaacatc 301  ttcttAggcC CGGTAAagga aCAAAAcCgc gaccgtgccg aagcaGAGGC 351  gCAAGCCGGC AAactGttgg aacgcgTCGG actgctAGAC CGCAAAAACG

401  CCTATCCGCG CGAACTTTCC GGCGGTCAGA ACAGCGCAT CGCCATTGTC

451  CGCGCCCTGT GCCTGAATCC GGAAGTCATC CTGCTGGACG AAATCACCGC

501  CGCACTTGAC CCCGAAATGG TGCGCGAAGT CTTGGAAGTG GTTTTGGAAC

551  TCGCCCGCGA AGGGATGAGT ATGCTCATCG TAACCCACGA AATGGGGTTC

601  GCACGCAAAG TTGCCGACCG CATCGTCTTT ATGGACAAAG GCGGCATCGT

651  CGAATCGTCC GACCCCGAAA CCTTTTTTTC CGCACCAAAA AGCGAACGCG

701  CCCGCCAATT TCTGGCAGGT ATGGACTACT GA
                                                    40
```

This corresponds to the amino acid sequence <SEQ ID 446; ORF 122.ng>:

```
g122.pep
    1  MALLSIRKLH KQYGSVTAIQ SLDLDLEKGE VIVLLGPSGC GKSTLLRCVN

51  GLEPHQGGSI VMDGVGEFGK DVSWQTARQK VGMVFQSNEL FAHMTVIENI

101  FLGPVKEQNR DRAEAEAQAG KLLERVGLLD RKNAYPRELS GGQKQRIAIV

151  RALCLNPEVI LLDEITAALD PEMVREVLEV VLELAREGMS MLIVTHEMGF

201  ARKVADRIVF MDKGGIVESS DPETFFSAPK SERARQFLAG MDY*
```

The following partial DNA sequence was identified in *N. meningitidis* <SEQ ID 447>:

```
m122.seq
    1  GTTGTCATGA TTAAAATCCG CAATATCCAT AAGACCTTTG GCGAAAACAC

51  TATTTTGCGC GGCATCGATT TGGATGTGTG CAAAGGGCAG GTGGTCGTCA

101  TCCTCGGGcC TTCCGGCTCA GGCAAAACGA CGTTTCTGCG ATGCCTAAAC

151  GCGTTGGAAA TGCCCGAAGA CGGACAAATC GAGTTCGACA ACGAGCGACC

201  GCTGAAAATC GATTTTTCTA AAAAACCAAG CAAACACGAT ATTTTGGCAC
```

```
251  TGCGCCGCAA ATCAkGCATG GTGTTTCAAC AATACAAyCT CTTTCCGCAC

301  AAAACCGCCT TGGAAAACGT AATGGAAGGA CCGGTTGCCG TACAgGGCAA

351  GCCTGCCGCC CAAGCGCGCG AAGAGGCTCT GAAACTGCTG GAAAAAGTCG

401  GCTTGGGCGA CAAAGTGGAT TTGTATCCCT ACCAGCTTTC CGGCGGTCAG

451  CAGCAGCGCG TCGGCATTGC CCGCGCATTG GCGATTCAGC CTGAACTGAT

501  GCTGTTTGAC GAACCGACTT CCGCGCTCGA TCCTGAATTG GTGCAAGATG

551  TTTTGGATmC CATGAAGGAA TTGGCGCAAG AAGGCTGGAC CATGGTTGTC

601  GTTACGCATG AAATCAAGTT CGCCTTAGAA GTGGCAACCA CCGwCGTCGT

651  GATGGACrGC GGCGTTATTG TCGAACAAGG CAGCCCGCAA GATTTGTTCG

701  ACCACCCCAA ACACGAACGG ACGCGGAGAT TTTTAAGCCA AATCCAATCT

751  ACCAAGATTT GA
```

This corresponds to the amino acid sequence <SEQ ID 448; ORF 122>:

```
m122.pep
   1  VVMIKIRNIH KTFGENTILR GIDLDVCKGQ VVVILGPSGS GKTTFLRCLN

51  ALEMPEDGQI EFDNERPLKI DFSKKPSKHD ILALRRKSXM VFQQYNLFPH

101  KTALENVMEG PVAVQGKPAA QAREEALKLL EKVGLGDKVD LYPYQLSGGQ

151  QQRVGIARAL AIQPELMLFD EPTSALDPEL VQDVLDXMKE LAQEGWTMVV

201  VTHEIKFALE VATTXVVMDX GVIVEQGSPQ DLFDHPKHER TRRFLSQIQS

251  TKI*
```

Computer analysis of this amino acid sequence gave the following results:
Homology with a Predicted ORF from *N. gonorrhoeae*
ORF 122 shows 47.2% identity over a 246 aa overlap with a predicted ORF (ORF 122.ng) from *N. gonorrhoeae*:

```
   m122/g122
                    10         20         30         40         50         60
     m122.pep   VVMIKIRNIHKTFGENTILRGIDLDVCKGQVVVILGPSGSGKTTFLRCLNALEMPEDGQI
                ::::::||::||  :|   | ::::|||: ||::|:|:||||| ||:||||:|:||   : |:|
     g122       MALLSIRKLHKQYGSVTAIQSLDLDLEKGEVIVLLGPSGCGKSTLLRCVNGLEPHQGGSI
                    10         20         30         40         50         60

70         80         90        100        110        120
     m122.pep   EFDNERPLKIDFSKKPSKHDILALRRKSXMVFQQYNLFPHKTALENVMEGPVAVQGKPAA
                :|:  :    |   |  :     |:|  ||||  :||   |  | |::||::  |||   |
     g122       VMDGVGEFGKDVSWQTA-------RQKVGMVFQSNELFAHMTVIENIFLGPVKEQNRDRA
                    70         80                90        100        110

130        140        150        160        170        180
     m122.pep   QAREEALKLLEKVGLGDKVDLYPYQLSGGQQQRVGIARALAIQPELMLFDEPTSALDPEL
                :|:  :|  ||||:|||  |:  :  ||  :|||||:|||::|:|||   ::||::|:||  |:|||||:
     g122       EAEAQAGKLLERVGLLDRKNAYPRELSGGQKQRIAIVRALCLNPEVILLDEITAALDPEM
                   120        130        140        150        160        170

190        200        210        220        230        240
     m122.pep   VQDVLDXMKELAQEGWTMVVVTHEIKFALEVATTXVVMDXGVIVEQGSPQDLFDHPKHER
                |:::||: :  |||:||  :|::||||: ||  ||    |||  |||  ||:::|:  :|:  || ||
     g122       VREVLEVVLELAREGMSMLIVTHEMGFARKVADRIVFMDKGGIVESSDPETFFSAPKSER
                   180        190        200        210        220        230

250
     m122.pep   TRRFLSQIQSTKIX
                :|:|||:
     g122       ARQFLAGMDYX
                   240
```

The following partial DNA sequence was identified in *N. meningitidis* <SEQ ID 449>:

```
a122.seq
    1  GTTGTCATGA TTAAAATCCG CAATATCCAT AAGACCTTCG GCAAAAATAC

51  CATTTTGCGC GGCATCAATT TGGATGTGTG CAAAGGGCAG GTGGTCGTCA

101  TCCTCGGGCC TTCCGGCTCA GGCAAAACGA CGTTTCTGCG ATGCCTAAAC

151  GCGTTGGAAA TGCCCGAAGA CGGACAAATC GAGTTCGACA ACGAGCGACC

201  GCTGAAAATC GATTTTTCTA AAAAACCAAG CAAACACGAT ATTTTGGCAC

251  TGCGCCGCAA ATCAGGCATG GTGTTTCAAC AATACAACCT CTTTCCGCAC

301  AAAACCGCCT TGGAAAACGT GATGGAAGGA CCGGTTGCCG TACAGGGCAA

351  GCCTGCCGCC CAAGCGCGCG AAGAGGCTCT GAAACTGCTG GAAAAAGTCG

401  GCTTGGGCGA CAAAGTGGAT TTGTATCCCT ACCAGCTTTC CGGCGGTCAG

451  CAGCAGCGCG TCGGCATTGC CCGAGCATTG GCGATTCAGC CCGAGCTGAT

501  GTTGTTTGAC GAACCCACTT CCGCGCTTGA CCCCGAGTTG GTGCAAGACG

551  TGTTGAACGC CATGAAGGAA TTGGCGCGGG AAGGTTGGAC GATGGTCGTC

601  GTTACCCACG AAATCAAGTT CGCGCTGGAA GTTGCCACGA CCGTTGTCGT

651  GATGGACGGC GGCGTTATCG TAGAGCAGGG CAGCCCGAAA GAGTTGTTCG

701  ACCACCCCAA ACACGAACGG ACGCGGAGAT TTTTAAGCCA AATCCAATCT

751  ACCAAGATTT GA
```

This corresponds to the amino acid sequence <SEQ ID 450; ORF 122.a>:

```
a122.pep
    1  VVMIKIRNIH KTFGKNTILR GINLDVCKGQ VVVILGPSGS GKTTFLRCLN

51  ALEMPEDGQI EFDNERPLKI DFSKKPSKHD ILALRRKSGM VFQQYNLFPH

101  KTALENVMEG PVAVQGKPAA QAREEALKLL EKVGLGDKVD LYPYQLSGGQ

151  QQRVGIARAL AIQPELMLFD EPTSALDPEL VQDVLNAMKE LAREGWTMVV

201  VTHEIKFALE VATTVVVMDG GVIVEQGSPK ELFDHPKHER TRRFLSQIQS

251  TKI*
``` m122/a122 96.0% identity in 253 aa overlap

```
                   10        20        30        40        50        60
m122.pep   VVMIKIRNIHKTFGENTILRGIDLDVCKGQVVVILGPSGSGKTTFLRCLNALEMPEDGQI
           ||||||||||||||:|||||||:||||||||||||||||||||||||||||||||||||||
a122       VVMIKIRNIHKTFGKNTILRGINLDVCKGQVVVILGPSGSGKTTFLRCLNALEMPEDGQI
                   10        20        30        40        50        60

70        80        90       100       110       120
m122.pep   EFDNERPLKIDFSKKPSKHDILALRRKSXMVFQQYNLFPHKTALENVMEGPVAVQGKPAA
           ||||||||||||||||||||||||||||| ||||||||||||||||||||||||||||||
a122       EFDNERPLKIDFSKKPSKHDILALRRKSGMVFQQYNLFPHKTALENVMEGPVAVQGKPAA
                   70        80        90       100       110       120

130       140       150       160       170       180
m122.pep   QAREEALKLLEKVGLGDKVDLYPYQLSGGQQQRVGIARALAIQPELMLFDEPTSALDPEL
           ||||||||||||||||||||||||||||||||||||||||||||||||||||||||||||
a122       QAREEALKLLEKVGLGDKVDLYPYQLSGGQQQRVGIARALAIQPELMLFDEPTSALDPEL
                  130       140       150       160       170       180
```

```
              190        200        210        220        230        240
m122.pep  VQDVLDXMKELAQEGWTMVVVTHEIKFALEVATTXVVMDXGVIVEQGSPQDLFDHPKHER
          |||||: ||||||:||||||||||||||||||||| |||| ||||||||||::||||||||
a122      VQDVLNAMKELAREGWTMVVVTHEIKFALEVATTVVVMDGGVIVEQGSPKELFDHPKHER
              190        200        210        220        230        240
              250
m122.pep  TRRFLSQIQSTKIX
          ||||||||||||||
a122      TRRFLSQIQSTKIX
              250
```

The following partial DNA sequence was identified in *N. gonorrhoeae* <SEQ ID 451>:

```
g122-1.seq
    1  ATGATTAAAA TCCGCAATAT CCATAAGACC TTTGGCGAAA ACACCATTTT
   51  GCGCGGCATC GATTTGGATG TGGGCAAAGG GCAGGTGGTC GTCATCCTCG
  101  GGCCTTCCGG CTCGGGTAAA ACAACATTTC TGCGCTGCCT AAACGCGTTG
  151  GAAATGCCCG AAGACGGACA AATCGAGTTC GACAACGCGC GGCCGTTACG
  201  CATTGATTTT TCCAAAAAAA CAAGCAAACA CGATATTTTG GCACTGCGCC
  251  GCAAGTCCGG AATGGTATTC CAACAATACA ACCTCTTCCC GCATAAAACC
  301  GTGTTGGAAA ACGTGATGGA AGGGCCGGTT GCCGTACAGG GCAAGCCTGC
  351  CGCCCAAGCG CGCGAAGAGG CTTTGAAACT GCTGGAAAAA GTCGGCTTGG
  401  GCGATAAAGT GGATTTGTAT CCCTACCAGC TTTCCGGCGG TCAGCAGCAG
  451  CGTGTCGGTA TCGCCCGCGC ACTGGCGATT CAGCCTGAAT TGATGCTGTT
  501  TGACGAACCC ACTTCCGCGC TGGACCCCGA GTTGGTGCAA GACGTGTTGG
  551  ACGCCATGAA GGAATTGGCG CGGGAAGGTT GGACGATGGT CGTCGTTACC
  601  CACGAAATCA AGTTCACGCT GGAAGTTGCC ACGAACGTCG TCGTGATGGA
  651  CGGCGGCGTT ATCGTAGAGC AGGGCAGCCC GAAAGAGTTG TTCGACCACC
  701  TCAAACACGA ACGGACGCGG AGATTTTTAA GCCAAATCCA ATCTGCCAAG
  751  ATTTGA
```

This corresponds to the amino acid sequence <SEQ ID 452; ORF 122-1.ng>:

```
g122-1.pep
    1  MIKIRNIHKT FGENTILRGI DLDVGKGQVV VILGPSGSGK TTFLRCLNAL
   51  EMPEDGQIEF DNARPLRIDF SKKTSKHDIL ALRRKSGMVF QQYNLFPHKT
  101  VLENVMEGPV AVQGKPAAQA REEALKLLEK VGLGDKVDLY PYQLSGGQQQ
  151  RVGIARALAI QPELMLFDEP TSALDPELVQ DVLDAMKELA REGWTMVVVT
  201  HEIKFTLEVA TNVVVMDGGV IVEQGSPKEL FDHLKHERTR RFLSQIQSAK
  251  I*
```

The following partial DNA sequence was identified in *N. meningitidis* <SEQ ID 453>:

```
m122-1.seq
    1  ATGATTAAAA TCCGCAATAT CCATAAGACC TTTGGCGAAA ACACTATTTT
   51  GCGCGGCATC GATTTGGATG TGTGCAAAGG GCAGGTGGTC GTCATCCTCG
```

```
101  GGCCTTCCGG CTCAGGCAAA ACGACGTTTC TGCGATGCCT AAACGCGTTG

151  GAAATGCCCG AAGACGGACA AATCGAGTTC GACAACGAGC GACCGCTGAA

201  AATCGATTTT TCTAAAAAAC CAAGCAAACA CGATATTTTG GCACTGCGCC

251  GCAAATCAGG CATGGTGTTT CAACAATACA ACCTCTTTCC GCACAAAACC

301  GCCTTGGAAA ACGTAATGGA AGGACCGGTT GCCGTACAGG GCAAGCCTGC

351  CGCCCAAGCG CGCGAAGAGG CTCTGAAACT GCTGGAAAAA GTCGGCTTGG

401  GCGACAAAGT GGATTTGTAT CCCTACCAGC TTTCCGGCGG TCAGCAGCAG

451  CGCGTCGGCA TTGCCCGCGC ATTGGCGATT CAGCCTGAAC TGATGCTGTT

501  TGACGAACCG ACTTCCGCGC TCGATCCTGA ATTGGTGCAA GATGTTTTGG

551  ATACCATGAA GGAATTGGCG CAAGAAGGCT GGACCATGGT TGTCGTTACG

601  CATGAAATCA AGTTCGCCTT AGAAGTGGCA ACCACCGTCG TCGTGATGGA

651  CGGCGGCGTT ATTGTCGAAC AAGGCAGCCC GCAAGATTTG TTCGACCACC

701  CCAAACACGA ACGGACGCGG AGATTTTTAA GCCAAATCCA ATCTACCAAG

751  ATTTGA
```

This corresponds to the amino acid sequence <SEQ ID 454; ORF 122-1>:

```
m122-1.pep

1 MIKIRNIHKT FGENTILRGI DLDVCKGQVV VILGPSGSGK TTFLRCLNAL

51 EMPEDGQIEF DNERPLKIDF SKKPSKHDIL ALRRKSGMVF QQYNLFPHKT

101 ALENVMEGPV AVQGKPAAQA REEALKLLEK VGLGDKVDLY PYQLSGGQQQ

151 RVGIARALAI QPELMLFDEP TSALDPELVQ DVLDTMKELA QEGWTMVVVT

201 HEIKFALEVA TTVVVMDGGV IVEQGSPQDL FDHPKHERTR RFLSQIQSTK

251 I* m122-1/g122-1  94.8% identity in 251 aa overlap 10         20         30         40         50         60
m122-1.pep   MIKIRNIHKTFGENTILRGIDLDVCKGQVVVILGPSGSGKTTFLRCLNALEMPEDGQIEF
             ||||||||||||||||||||||| |||||||||||||||||||||||||||||||||||
g122-1       MIKIRNIHKTFGENTILRGIDLDVGKGQVVVILGPSGSGKTTFLRCLNALEMPEDGQIEF
                     10         20         30         40         50         60

70         80         90        100        110        120
m122-1.pep   DNERPLKIDFSKKPSKHDILALRRKSGMVFQQYNLFPHKTALENVMEGPVAVQGKPAAQA
             || |||:||||| |||||||||||||||||||||||||||: ||||||||||||||||||
g122-1       DNARPLRIDFSKKTSKHDILALRRKSGMVFQQYNLFPHKTVLENVMEGPVAVQGKPAAQA
                     70         80         90        100        110        120

130        140        150        160        170        180
m122-1.pep   REEALKLLEKVGLGDKVDLYPYQLSGGQQQRVGIARALAIQPELMLFDEPTSALDPELVQ
             ||||||||||||||||||||||||||||||||||||||||||||||||||||||||||||
g122-1       REEALKLLEKVGLGDKVDLYPYQLSGGQQQRVGIARALAIQPELMLFDEPTSALDPELVQ
                    130        140        150        160        170        180

190        200        210        220        230        240
m122-1.pep   DVLDTMKELAQEGWTMVVVTHEIKFALEVATTVVVMDGGVIVEQGSPQDLFDHPKHERTR
             ||||:||||:||||||||||||||||:|||||:|||||||||||||||::||||  |||||
g122-1       DVLDAMKELAREGWTMVVVTHEIKFTLEVATNVVVMDGGVIVEQGSPKELFDHLKHERTR
                    190        200        210        220        230        240

250
m122-1.pep   RFLSQIQSTKIX
             ||||||||:|||
g122-1       RFLSQIQSAKIX
                    250
```

The following partial DNA sequence was identified in *N. meningitidis* <SEQ ID 455>:

```
a122-1.seq
   1 ATGATTAAAA TCCGCAATAT CCATAAGACC TTCGGCAAAA ATACCATTTT

51 GCGCGGCATC AATTTGGATG TGTGCAAAGG GCAGGTGGTC GTCATCCTCG

101 GGCCTTCCGG CTCAGGCAAA ACGACGTTTC TGCGATGCCT AAACGCGTTG

151 GAAATGCCCG AAGACGGACA AATCGAGTTC GACAACGAGC GACCGCTGAA

201 AATCGATTTT TCTAAAAAAC CAAGCAAACA CGATATTTTG GCACTGCGCC

251 GCAAATCAGG CATGGTGTTT CAACAATACA ACCTCTTTCC GCACAAAACC

301 GCCTTGGAAA ACGTGATGGA AGGACCGGTT GCCGTACAGG GCAAGCCTGC

351 CGCCCAAGCG CGCGAAGAGG CTCTGAAACT GCTGGAAAAA GTCGGCTTGG

401 GCGACAAAGT GGATTTGTAT CCCTACCAGC TTTCCGGCGG TCAGCAGCAG

451 CGCGTCGGCA TTGCCCGAGC ATTGGCGATT CAGCCCGAGC TGATGTTGTT

501 TGACGAACCC ACTTCCGCGC TTGACCCCGA GTTGGTGCAA GACGTGTTGA

551 ACGCCATGAA GGAATTGGCG CGGGAAGGTT GGACGATGGT CGTCGTTACC

601 CACGAAATCA AGTTCGCGCT GGAAGTTGCC ACGACCGTTG TCGTGATGGA

651 CGGCGGCGTT ATCGTAGAGC AGGGCAGCCC GAAAGAGTTG TTCGACCACC

701 CCAAACACGA ACGGACGCGG AGATTTTTAA GCCAAATCCA ATCTACCAAG

751 ATTTGA
```

This corresponds to the amino acid sequence <SEQ ID 456; ORF 122-1.a>:

```
a122-1.pep

1 MIKIRNIHKT FGENTILRGI NLDVCKGQVV VILGPSGSGK TTFLRCLNAL

51 EMPEDGQIEF DNERPLKIDF SKKPSKHDIL ALRRKSGMVF QQYNLFPHKT

101 ALENVMEGPV AVQGKPAAQA REEALKLLEK VGLGDKVDLY PYQLSGGQQQ

151 RVGIARALAI QPELMLFDEP TSALDPELVQ DVLDTMKELA REGWTMVVVT

201 HEIKFALEVA TTVVVMDGGV IVEQGSPKEL FDHPKHERTR RFLSQIQSTK

251 I* a122-1/m122-1   97.2% identity in 251 aa overlap 10         20         30         40         50         60
     a122-1.pep  MIKIRNIHKTFGKNTILRGINLDVCKGQVVVILGPSGSGKTTFLRCLNALEMPEDGQIEF
                 ||||||||||||:||||||:||||||||||||||||||||||||||||||||||||||||
     m122-1     MIKIRNIHKTFGENTILRGIDLDVGKGQVVVILGPSGSGKTTFLRCLNALEMPEDGQIEF
                      10         20         30         40         50         60

70         80         90        100        110        120
     a122-1.pep  DNERPLKIDFSKKPSKHDILALRRKSGMVFQQYNLFPHKTALENVMEGPVAVQGKPAAQA
                 ||||||||||||||||||||||||||||||||||||||||||||||||||||||||||||
     m122-1     DNERPLKIDFSKKPSKHDILALRRKSGMVFQQYNLFPHKTALENVMEGPVAVQGKPAAQA
                      70         80         90        100        110        120

130        140        150        160        170        180
     a122-1.pep  REEALKLLEKVGLGDKVDLYPYQLSGGQQQRVGIARALAIQPELMLFDEPTSALDPELVQ
                 ||||||||||||||||||||||||||||||||||||||||||||||||||||||||||||
     m122-1     REEALKLLEKVGLGDKVDLYPYQLSGGQQQRVGIARALAIQPELMLFDEPTSALDPELVQ
                     130        140        150        160        170        180

190        200        210        220        230        240
     a122-1.pep  DVLNAMKELAREGWTMVVVTHEIKFALEVATTVVVMDGGVIVEQGSPKELFDHPKHERTR
                 |||::||||:|||||||||||||||||||||||||||||||||||||||::|||||||||
     m122-1     DVLDTMKELAQEGWTMVVVTHEIKFALEVATTVVVMDGGVIVEQGSPQDLFDHPKHERTR
                     190        200        210        220        230        240
```

```
                                    250
a122-1.pep    RFLSQIQSTKIX
              ||||||||||||
m122-1        RFLSQIQSTKIX
                                    250
```

The following partial DNA sequence was identified in *N. gonorrhoeae* <SEQ ID 457>:

```
g125.seq.
    1 ATGTCGGGCA ATGCCTCCTC TCCTTCATCT TCCGCCGCCA TCGGGCTGGT

51 TTGGTTCGGC GCGGCGGTAT CGATTGCCGA AATCAGCACG GGTACGCTGC

101 TCGCCCCCTT GGGCTGGCAG CGCGGTCTGG CGGCCCTGCT TTTGGGTCAT

151 GCCGTCGGCG GCGCGCTGTT TTTTGCGGCG GCGTATATCG GCGCACTGAC

201 CGGACGCAGC TCGATGGAAA GTGTGCGCCT GTCGTTCGGC AAATGCGGTT

251 CAGTGCTGTT TTCCGTGGCG AATATGCTGC AACTGGCCGG CTGGACGGCG

301 GTGATGATTT ACGTCGGCGC AacggTCAGC TCCGCTTTGG GCAAAGTGTT

351 GTGGGACggc gaATCCTTTG TCTGGTGGGC ATTGGCAAAC GGCGCACTGA

401 TCGTGCTGTG GCTGGTTTTC GGCGCACGCA GAACGGGCGG GCTGAAAACC

451 GTTTCGATGC TGCTGATGCT GCTTGCCGTG TTGTGGTTGA GCGTCGAAGT

501 GTTCGCTTCG TCCGGCACAA ACGCCGCGCC CGCCGTTTCA GACGGCATGA

551 CCTTCGGAAC GGCAGTCGAA CTGTCCGCCG TCATGCCGCT TTCCTGGCTG

601 CCGCTGGCCG CCGACTACAC GCGCCAAGCA CGCCGCCCGT TTGCGGCAAC

651 CCTGACGGCA ACGCTCGCCT ATACGCTGAC GGGCTGCTGG ATGTATGCCT

701 TGGGTTTGGC GGCGGCTCTG TTTACCGGAG AAACCGACGT GGCGAAAATC

751 CTGTTGGGCG CGGGCTTGGG CATAACGGGC ATTCTGGCAG TCGTCCTCTC

801 CACCGTTACC ACAACGTTTC TCGATACCTA TTCCGCCGGC GCGAGTGCGA

851 ACAACATTTC CGCGCGTTTT GCGGAAATAC CCGTCGCTGT CGGCGTTACC

901 CTGatccgca ccgtgcttgc cgtcatgctg cccgttaccg aatataaaaa 951 cttcctgctg cttatccgct cggtatttgg gccgatggcg ggtggttttg 1001 attgccgaCT TTTttgtctt AAAACGGCGT GA
```

This corresponds to the amino acid sequence <SEQ ID 458; ORF 125.ng>:

The following partial DNA sequence was identified in *N. meningitidis* <SEQ ID 459>:

```
m125.seq
    1 ATGTCGGGCA ATGCCTCCTC TCCTTCATCT TCCTCCGCCA TCGGGCTGAT

51 TTGGTTCGGC GCGGCGGTAT CGATTGCCGA AATCAGCACG GGTACGCTGC

101 TTGCGCCTTT GGGCTGGCAG CGCGGTCTGG CGGCTCTACT TTTGGGTCAT

151 GCCGTCGGCG GCGCGCTGTT TTTTGCGGCG GCGTATATCG GCGCACTGAC

201 CGGACGCAGC TCGATGGAAA GCGTGCGCCT GTCGTTCGGC AAACGCGGTT

251 CAGTGCTGTT TTCCGTGGCG AATATGCTGC AACTGGCCGG CTGGACGGCG

301 GTGATGATTT ACGCCGGCGC AACGGTCAGC TCCGCTTTGG GCAAAGTGTT

351 GTGGGACGGC GAATCTTTTG TCTGGTGGGC ATTGGCAAAC GGCGCGCTGA
```

```
401 TTGTGCTGTG GCTGGTTTTC GGCGCACGCA AAACAGGCGG GCTGAAAACC

451 GTTTCGATGC TGCTGATGCT GTTGGCGGTT CTGTGGCTGA GTGCCGAAGT

501 CTTTTCCACG GCAGGCAGCA CCGCCGCACA GGTTTCAGAC GGCATGAGTT

551 TCGGAACGGC AGTCGAGCTG TCCGCCGTGA TGCCGCTTTC CTGGCTGCCG

601 CTTGCCGCCG ACTACACGCG CCACGCGCGC CGCCCGTTTG CGGCAACCCT

651 GACGGCAACG CTCGCCTACA CGCTGACCGG CTGCTGGATG TATGCCTTGG

701 GTTTGGCAGC GGCGTTGTTC ACCGGAGAAA CCGACGTGGC AAAAATCCTG

751 CTGGGCGCAr GTTTGgGTGC GGCAGGCATT TTGGCGGTCG TCCTCTCCAC

801 CGTTACCACA ACGTTTCTCG ATGCCTATTC CGCCGGCGCG AGTGCGAACA

851 ACATTTCCGC GCGTTTTGCG GAAACACCCG TCGCTGTCrG CGTTACCCTG

901 ATCGGCACGG TACTTGCCGT CATGCTGCCC GTTACCGAAT ATGAAAACTT

951 CCTGCTGCTT ATCGGCTCGG TATTTGCGCC GATGGCGGgC GGTTTTGATT

1001 GCCGACTTTT TCGTCTTGAA ACGGCGTGA
```

This corresponds to the amino acid sequence <SEQ ID 460; ORF 125>:

```
m125.pep
   1 MSGNASSPSS SSAIGLIWFG AAVSIAEIST GTLLAPLGWQ RGLAALLLGH

51 AVGGALFFAA AYIGALTGRS SMESVRLSFG KRGSVLFSVA NMLQLAGWTA

101 VMIYAGATVS SALGKVLWDG ESFVWWALAN GALIVLWLVF GARKTGGLKT

151 VSMLLMLLAV LWLSAEVFST AGSTAAQVSD GMSFGTAVEL SAVMPLSWLP

201 LAADYTRHAR RPFAATLTAT LAYTLTGCWM YALGLAAALF TGETDVAKIL

251 LGAXLGAAGI LAVVLSTVTT TFLDAYSAGA SANNISARFA ETPVAVXVTL

301 IGTVLAVMLP VTEYENFLLL IGSVFAPMAG GFDCRLFRLE TA*
```

Computer analysis of this amino acid sequence gave the following results:

Homology with a Predicted ORF from *N. gonorrhoeae*

ORF 125 shows 92.1% identity over a 343 aa overlap with a predicted ORF (ORF 125.ng) from *N. gonorrhoeae*:

```
m125/g125
                 10         20         30         40         50         60
    m125.pep  MSGNASSPSSSSAIGLIWFGAAVSIAEISTGTLLAPLGWQRGLAALLLGHAVGGALFFAA
              ||||||||||:||||:||||||||||||||||||||||||||||||||||||||||||||
        g125  MSGNASSPSSSAAIGLVWFGAAVSIAEISTGTLLAPLGWQRGLAALLLGHAVGGALFFAA
                 10         20         30         40         50         60

70         80         90        100        110        120
    m125.pep  AYIGALTGRSSMESVRLSFGKRGSVLFSVANMLQLAGWTAVMIYAGATVSSALGKVLWDG
              ||||||||||||||||||||| ||||||||||||||||||||||:|||||||||||||||
        g125  AYIGALTGRSSMESVRLSFGKCGSVLFSVANMLQLAGWTAVMIYVGATVSSALGKVLWDG
                 70         80         90        100        110        120

130        140        150        160        170        179
    m125.pep  ESFVWWALANGALIVLWLVFGARKTGGLKTVSMLLMLLAVLWLSAEVFSTAGSTAAQ-VS
              |||||||||||||||||||||||:||||||||||||||||||||||:|||:::|::|| ||
        g125  ESFVWWALANGALIVLWLVFGARRTGGLKTVSMLLMLLAVLWLSVEVFASSGTNAAPAVS
                130        140        150        160        170        180
```

```
              180        190        200        210        220        230      239
   m125.pep   DGMSFGTAVELSAVMPLSWLPLAADYTRHARRPFAATLTATLAYTLTGCWMYALGLAAAL
              |||:||||||||||||||||||||||||:||||||||||||||||||||||||||||||
   g125       DGMTFGTAVELSAVMPLSWLPLAADYTRQARRPFAATLTATLAYTLTGCWMYALGLAAAL
                         190        200        210        220        230      240

240        250        260        270        280        290      299
   m125.pep   FTGETDVAKILLGAXLGAAGILAVVLSTVTTTFLDAYSAGASANNISARFAETPVAVXVT
              |||||||||||||| ||:||||||||||||||||:|||||||||||||||||| |||||| ||
   g125       FTGETDVAKILLGAGLGITGILAVVLSTVTTTFLDTYSAGASANNISARFAEIPVAVGVT
                         250        260        270        280        290      300

300        310        320        330        340
   m125.pep   LIGTVLAVMLPVTEYENFLLLIGSVFAPMAGGFDCRLFRLETAX
              || |||||||||||:|||||| |||:|||||||||||| |:|||
   g125       LIRTVLAVMLPVTEYKNFLLLIRSVFGPMAGGFDCRLFCLKTAX
                         310        320        330        340
```

The following partial DNA sequence was identified in *N. meningitidis* <SEQ ID 461>:

```
a125.seq
    1 ATGTCGGGCA ATGCCTCCTC TCCTTCATCT TCCGCCGCCA TCGGGCTGAT

51 TTGGTTCGGC GCGGCGGTAT CGATTGCCGA AATCAGCACG GGTACACTGC

101 TTGCGCCTTT GGGCTGGCAG CGCGGTCTGG CGGCTCTGCT TTTGGGTCAT

151 GCCGTCGGCG GCGCGCTGTT TTTTGCGGCG GCGTATATCG GCGCACTGAC

201 CGGACGCAGC TCGATGGAAA GCGTGCGCCT GTCGTTCGGC AAACGCGGTT

251 CAGTGCTGTT TTCCGTGGCG AATATGCTGC AACTGGCCGG CTGGACGGCG

301 GTGATGATTT ACGCCGGCGC AACGGTCAGC TCCGCTTTGG GCAAAGTGTT

351 GTGGGACGGC GAATCTTTTG TCTGGTGGGC ATTGGCAAAC GGCGCGCTGA

401 TTGTGCTGTG GCTGGTTTTC GGCGCACGCA AAACAGGCGG GCTGAAAACC

451 GTTTCGATGC TGCTGATGCT GTTGGCGGTT CTGTGGCTGA GTGCCGAAGT

501 CTTTTCCACG GCAGGCAGCA CCGCCGCACA GGTTTCAGAC GGCATGAGTT

551 TCGGAACGGC AGTCGAGCTG TCCGCCGTGA TGCCGCTTTC TTGGCTGCCG

601 CTGGCCGCCG ACTACACGCG CCACGCGCGC CGCCCGTTTG CGGCAACCCT

651 GACGGCAACG CTCGCCTACA CGCTGACCGG CTGCTGGATG TATGCCTTGG

701 GTTTGGCAGC GGCGTTGTTC ACCGGAGAAA CCGACGTGGC AAAAATCCTG

751 CTGGGCGCAG GTTTGGGTGC GGCAGGCATT TTGGCGGTCG TCCTGTCGAC

801 CGTTACCACC ACTTTTCTCG ATGCCTACTC CGCCGGCGTA AGTGCCAACA

851 ATATTTCCGC CAAACTTTCG GAAATACCCA TCGCCGTTGC CGTCGCCGTT

901 GTCGGCACAC TGCTTGCCGT CCTCCTGCCC GTTACCGAAT ATGAAAACTT

951 CCTGCTGCTT ATCGGCTCGG TATTTGCGCC GATGGCG.GC GGTTTTGATT

1001 GCCGACTTTT TCGTCTTGAA ACGGCGTGA
```

This corresponds to the amino acid sequence <SEQ ID 462; ORF 125.a>:

```
a125.pep.
    1 MSGNASSPSS SAAIGLIWFG AAVSIAEIST GTLLAPLGWQ RGLAALLLGH

51 AVGGALFFAA AYIGALTGRS SMESVRLSFG KRGSVLFSVA NMLQLAGWTA

101 VMIYAGATVS SALGKVLWDG ESFVWWALAN GALIVLWLVF GARKTGGLKT
```

```
151 VSMLLMLLAV LWLSAEVFST AGSTAAQVSD GMSFGTAVEL SAVMPLSWLP

201 LAADYTRHAR RPFAATLTAT LAYTLTGCWM YALGLAAALF TGETDVAKIL

251 LGAGLGAAGI LAVVLSTVTT TFLDAYSAGV SANNISAKLS EIPIAVAVAV

301 VGTLLAVLLP VTEYENFLLL IGSVFAPMAX GFDCRLFRLE TA*
``` m125/a125 95.6% identity in 342 aa overlap

```
                     10         20         30         40         50         60
    m125.pep MSGNASSPSSSSAIGLIWFGAAVSIAEISTGTLLAPLGWQRGLAALLLGHAVGGALFFAA
             ||||||||||:|||||||||||||||||||||||||||||||||||||||||||||||||
        a125 MSGNASSPSSSAAIGLIWFGAAVSIAEISTGTLLAPLGWQRGLAALLLGHAVGGALFFAA
                     10         20         30         40         50         60
                     70         80         90        100        110        120
    m125.pep AYIGALTGRSSMESVRLSFGKRGSVLFSVANMLQLAGWTAVMIYAGATVSSALGKVLWDG
             ||||||||||||||||||||||||||||||||||||||||||||||||||||||||||||
        a125 AYIGALTGRSSMESVRLSFGKRGSVLFSVANMLQLAGWTAVMIYAGATVSSALGKVLWDG
                     70         80         90        100        110        120
                    130        140        150        160        170        180
    m125.pep ESFVWWALANGALIVLWLVFGARKTGGLKTVSMLLMLLAVLWLSAEVFSTAGSTAAQVSD
             ||||||||||||||||||||||||||||||||||||||||||||||||||||||||||||
        a125 ESFVWWALANGALIVLWLVFGARKTGGLKTVSMLLMLLAVLWLSAEVFSTAGSTAAQVSD
                    130        140        150        160        170        180
                    190        200        210        220        230        240
    m125.pep GMSFGTAVELSAVMPLSWLPLAADYTRHARRPFAATLTATLAYTLTGCWMYALGLAAALF
             ||||||||||||||||||||||||||||||||||||||||||||||||||||||||||||
        a125 GMSFGTAVELSAVMPLSWLPLAADYTRHARRPFAATLTATLAYTLTGCWMYALGLAAALF
                    190        200        210        220        230        240
                    250        260        270        280        290        300
    m125.pep TGETDVAKILLGAXLGAAGILAVVLSTVTTTFLDAYSAGASANNISARFAETPVAVXVTL
             |||||||||||||   |||||||||||||||||||||||:||||||:::|  |:|| |::
        a125 TGETDVAKILLGAGLGAAGILAVVLSTVTTTFLDAYSAGVSANNISAKLSEIPIAVAVAV
                    250        260        270        280        290        300
                    310        320        330        340
    m125.pep IGTVLAVMLPVTEYENFLLLIGSVFAPMAGGFDCRLFRLETAX
             :||:|||:||||||||||||||||||||| |||||||||||||
        a125 VGTLLAVLLPVTEYENFLLLIGSVFAPMAXGFDCRLFRLETAX
                    310        320        330        340
```

The following partial DNA sequence was identified in *N. gonorrhoeae* <SEQ ID 463>:

```
g126.seq
   1 AtgccgtcTG AAaccCcaaa ggcACGCCGC CGGCTTTCAG ACGGCATCGC

51 GTCCGACAAC CATACCAAAG AATCCATCAT GCTCACCctg tacggcGAAA

101 CTTTCCCTTC GCGGCTGCTg ctcggcacgG cggcctacCC GACCCCTGAA

151 ATCCTCAAAC AATCCGTCCG AACCGCCCGG CCCGCGATGA ttaccGTCTC

201 GCTGCGCCGC ACGGGATGCG GCGGCGAGGC GCACGGTCAG GGGTTTTGGT

251 CGCTGCTTCA AGAAACCGGC GTTCCCGTCC TGCCGAACAC GGCAGGCTGC

301 CAAAGCGTGC AGGAAGCGGT AACGACGGCG CAAATGGCGC GCGAAGTGTT

351 TGAAACCGAT TGGATAAAAT TGGAACTCAT CGGCGACGAC GACACCTTGC

401 AGCCGGACGT GTTCCAACTC GTCGAAGCGG CGGAAATCCT GATTAAAGAC

451 GGCTTCAAAG TGCTGCCTTA TTGCACCGAA GACCTGATTG CCTGCCGCCG

501 CCTGCTCGAT GCGGCTGTC AGGCGTTGAT GCCGTGGGCG GCTCCCATCG

551 GCACGGGTTT GGGGGCGGTT CACGCCTATG CGCTCAAAAT CCTGCGCGAA
```

-continued

```
601   CGCCTGCCCG ACACGCCGCT GATTATCGAC GCGGGCTTGG GTTTGCCTTC

651   CCAAGCGGCA CAAGTGATGG AATGGGGTTT TGACGGCGTA TTGTTAAACA

701   CCGCCGTTTC CCGCAGCGGC GACCCCGTCA ACATGGCGCG CGCCTTCGCA

751   CTCGCCGTCG AATCCGGACG GCTGGCATTT GAAGCCGGGC CGGTCGAAGC

801   GCGAACCAAA GCCCAAGCCA GCACGCCGAC AGTCGGACAA CCGTTTTGGC

851   ATTCGGCGGA ATATTGA
```

This corresponds to the amino acid sequence <SEQ ID 464; ORF 126.ng>:

```
g126.pep
  1  MPSETPKARR RLSDGIASDN HTKESIMLTL YGETFPSRLL LGTAAYPTPE

51  ILKQSVRTAR PAMITVSLRR TGCGGEAHGQ GFWSLLQETG VPVLPNTAGC

101  QSVQEAVTTA QMAREVFETD WIKLELIGDD DTLQPDVFQL VEAAEILIKD

151  GFKVLPYCTE DLIACRRLLD AGCQALMPWA APIGTGLGAV HAYALKILRE

201  RLPDTPLIID AGLGLPSQAA QVMEWGFDGV LLNTAVSRSG DPVNMARAFA

251  LAVESGRLAF EAGPVEARTK AQASTPTVGQ PFWHSAEY*
```

The following partial DNA sequence was identified in N. meningitidis <SEQ ID 465>:

```
m126.seq. (partial)
  1  ..CACTATACAA AGGAACCCAT TATGCTCACC CTATACGGCG AAACTTTCCC

51  CTCGCGGCTG CTGCTCGGCA CGGCTGCCTA CCCGACCCCC GAAATCCTCA

101  AACAATCCAT CCAAACCGCC CAGCCTGCGA TGATTACCGT CTCGCTGCGC

151  CGCGCGGGAA GCGGCGGCGA GGCGCACGGT CAGGGGTTTT GGTCGCTGCT

201  TCAAGAAACC GGCGTTCCCG TCCTGCCGAA CACGGCAGGC TGCCAAAGCG

251  TGCAGGAAGC GGTAACGACG GCGCAAATGG CGCGCGAAGT GTTTGAAACC

301  GATTGGATAA AATTGGAACT CATCGGAGAT GACGACACCT TGCAGCCGGA

351  TGTGTTCCAG CTTGTCGAAG CGGCGGAAAT CCTGATTAAA GACGGCTTCA

401  AAGTGCTGCC TTATTGCACC GAAGACCTGA TTGCCTGCCG CCGCCTGCTC

451  GACGCGGGCT GTCAGGCGTT GATGCCGTGG GCGGCGGCGA TCGGCACGGG

501  TTTGGGCGCG GTTCACGCCT ACGCGTTGAA CGTCCTGCGC GAACGCCTGC

551  CCGACACGCC GCTGATTATC GACGCGGGCT TGGGTTTGCC CTCACAGGCG

601  GCACAAGTGA TGGAATGGGG CTTTGACGGC GTGCTTTTGA ATACTGCCGT

651  TTCCCGCAGC GGCGATCCGG TCAATATGGC ACGCGCCTTC GCACTCGCCG

701  TCGAATCCGG ACGGCTGGCA TTTGAAGCCG GACCGGTCGA AGCACGCGAC

751  AAAGCGCAAG CCAGCACGCC GACAGTCGGA CAACCGTTTT GGCATTCGGC

801  GGAATATTGA
```

This corresponds to the amino acid sequence <SEQ ID 466; ORF 126>:

```
m126.pep (partial)
  1  ..HYTKEPIMLT LYGETFPSRL LLGTAAYPTP EILKQSIQTA QPAMITVSLR

51  RAGSGGEAHG QGFWSLLQET GVPVLPNTAG CQSVQEAVTT AQMAREVFET
```

-continued

```
101    DWIKLELIGD DDTLQPDVFQ LVEAAEILIK DGFKVLPYCT EDLIACRRLL

151    DAGCQALMPW AAPIGTGLGA VHAYALNVLR ERLPDTPLII DAGLGLPSQA

201    AQVMEWGFDG VLLNTAVSRS GDPVNMARAF ALAVESGRLA FEAGPVEARD

251    KAQASTPTVG QPFWHSAEY*
```

Computer analysis of this amino acid sequence gave the following results:
Homology with a Predicted ORF from *N. gonorrhoeae*
ORF 126 shows 95.9% identity over a 269 aa overlap with a predicted ORF (ORF 126.ng) from *N. gonorrhoeae*:

```
m126/g126

10         20         30         40
    m126.pep               HYTKEPIMLTLYGETFPSRLLLGTAAYPTPEILKQSIQTAQ
                           ::|||||||||||||||||||||||||||||||||:: ||:
    g126       MPSETPKARRRLSDGIASDNHTKESIMLTLYGETFPSRLLLGTAAYPTPEILKQSVRTAR
               10         20         30         40         50         60

50         60         70         80         90        100
    m126.pep    PAMITVSLRRAGSGGEAHGQGFWSLLQETGVPVLPNTAGCQSVQEAVTTAQMAREVFETD
                ||||||||||:| ||||||||||||||||||||||||||||||||||||||||||||||
    g126        PAMITVSLRRTGCGGEAHGQGFWSLLQETGVPVLPNTAGCQSVQEAVTTAQMAREVFETD
                    70         80         90        100        110        120

110        120        130        140        150        160
    m126.pep    WIKLELIGDDDTLQPDVFQLVEAAEILIKDGFKVLPYCTEDLIACRRLLDAGCQALMPWA
                ||||||||||||||||||||||||||||||||||||||||||||||||||||||||||||
    g126        WIKLELIGDDDTLQPDVFQLVEAAEILIKDGFKVLPYCTEDLIACRRLLDAGCQALMPWA
                   130        140        150        160        170        180

170        180        190        200        210        220
    m126.pep    APIGTGLGAVHAYALNVLRERLPDTPLIIDAGLGLPSQAAQVMEWGFDGVLLNTAVSRSG
                ||||||||||||||||::|||||||||||||||||||||||||||||||||||||||||
    g126        APIGTGLGAVHAYALKILRERLPDTPLIIDAGLGLPSQAAQVMEWGFDGVLLNTAVSRSG
                   190        200        210        220        230        240

230        240        250        260        270
    m126.pep    DPVNMARAFALAVESGRLAFEAGPVEARDKAQASTPTVGQPFWHSAEYX
                |||||||||||||||||||||||||||| ||||||||||||||||||||
    g126        DPVNMARAFALAVESGRLAFEAGPVEARTKAQASTPTVGQPFWHSAEYX
                   250        260        270        280
```

The following partial DNA sequence was identified in *N. meningitidis* <SEQ ID 467>:

```
a126.seq
    1  TTGTTAATCC ACTATACAAA GGAACCCATT ATGCTCACCC TGTACAGCGA

51  AACTTTCCCT TCGCGGCTGC TGCTCGGCAC AGCCGCCTAC CCGACCCCTG

101  AAATCCTCAA ACAATCCGTC CGAACCGCCC GGCCCGCGAT GATTACCGTC

151  TCGCTGCGCC GCGCGGGATG CGGCGGCGAG GCGCACGGTC AGGGGTTTTG

201  GTCGCTGCTT CAAGAAACCG GCGTTCCCGT CCTGCCGAAC ACGGCAGGCT

251  GCCAAAGCGT GCAGGAAGCG GTAACGACGG CGCAAATGGC GCGCGAAGTG

301  TTTGAAACCG ATTGGATTAA ACTCGAACTC ATCGGCGACG ACGACACCTT

351  GCAGCCGGAT GTGTTCCAAC TTGTCGAAGC GGCGGAAATC CTGATTAAAG

401  ACGGCTTCAA AGTGCTGCCT TATTGCACCG AAGACCTGAT TGCCTGCCGC

451  CGCCTGCTCG ACGCGGGCTG TCAGGCGTTG ATGCCGTGGG CGGCCCCGAT

501  CGGCACGGGT TTGGGCGCGG TTCACGCCTA CGCGTTGAAC GTCCTGCGCG

551  AACGCCTGCC CGACACGCCG CTGATTATCG ACGCGGGCTT GGGTTTGCCC

601  TCACAGGCGG CACAAGTGAT GGAATGGGGC TTTGACGGCG TGCTTTTGAA
```

-continued

```
 651  TACTGCCGTT TCCCGCAGCG GCGATCCGGT CAATATGGCA CGCGCCTTCG

701  CACTCGCCGT CGAATCCGGA CGGCTGGCAT TTGAAGCCGG ACCGGTCGAA

751  GCACGCGACA AAGCGCAAGC CAGCACGCCG ACAGTCGGAC AACCGTTTTG

801  GCATTCGGCG AATATTGA
```

This corresponds to the amino acid sequence <SEQ ID 468; ORF 126.a>:

```
a126.pep
  1   LLIHYTKEPI MLTLYSETFP SRLLLGTAAY PTPEILKQSV RTARPAMITV

51   SLRRAGCGGE AHGQGFWSLL QETGVPVLPN TAGCQSVQEA VTTAQMAREV

101   FETDWIKLEL IGDDDTLQPD VFQLVEAAEI LIKDGFKVLP YCTEDLIACR

151   RLLDAGCQAL MPWAAPIGTG LGAVHAYALN VLRERLPDTP LIIDAGLGLP

201   SQAAQVMEWG FDGVLLNTAV SRSGDPVNMA RAFALAVESG RLAFEAGPVE

251   ARDKAQASTP TVGQPFWHSA EY*
``` m126/a126 98.1% identity in 269 aa overlap

```
                  10         20         30         40         50
m126.pep   HYTKEPIMLTLYGETFPSRLLLGTAAYPTPEILKQSIQTAQPAMITVSLRRAGSGGE
           ||||||||||||:|||||||||||||||||||||||::||:||||||||||||| |||
a126     LLIHYTKEPIMLTLYSETFPSRLLLGTAAYPTPEILKQSVRTARPAMITVSLRRAGCGGE
              10         20         30         40         50         60

60         70         80         90        100        110
m126.pep   AHGQGFWSLLQETGVPVLPNTAGCQSVQEAVTTAQMAREVFETDWIKLELIGDDDTLQPD
           ||||||||||||||||||||||||||||||||||||||||||||||||||||||||||||
a126       AHGQGFWSLLQETGVPVLPNTAGCQSVQEAVTTAQMAREVFETDWIKLELIGDDDTLQPD
              70         80         90        100        110        120

120        130        140        150        160        170
m126.pep   VFQLVEAAEILIKDGFKVLPYCTEDLIACRRLLDAGCQALMPWAAPIGTGLGAVHAYALN
           ||||||||||||||||||||||||||||||||||||||||||||||||||||||||||||
a126       VFQLVEAAEILIKDGFKVLPYCTEDLIACRRLLDAGCQALMPWAAPIGTGLGAVHAYALN
             130        140        150        160        170        180

180        190        200        210        220        230
m126.pep   VLRERLPDTPLIIDAGLGLPSQAAQVMEWGFDGVLLNTAVSRSGDPVNMARAFALAVESG
           ||||||||||||||||||||||||||||||||||||||||||||||||||||||||||||
a126       VLRERLPDTPLIIDAGLGLPSQAAQVMEWGFDGVLLNTAVSRSGDPVNMARAFALAVESG
             190        200        210        220        230        240

240        250        260        270
m126.pep   RLAFEAGPVEARDKAQASTPTVGQPFWHSAEYX
           |||||||||||||||||||||||||||||||||
a126       RLAFEAGPVEARDKAQASTPTVGQPFWHSAEYX
             250        260        270
```

The following partial DNA sequence was identified in *N. gonorrhoeae* <SEQ ID 469>:

```
g126-1.seq
  1   ATGCTCACCC TGTACGGCGA AACTTTCCCT TCGCGGCTGC TGCTCGGCAC

51   GGCCGCCTAC CCGACCCCTG AAATCCTCAA ACAATCCGTC CGAACCGCCC

101   GGCCCGCGAT GATTACCGTC TCGCTGCGCC GCACGGGATG CGGCGGCGAG

151   GCGCACGGTC AGGGGTTTTG GTCGCTGCTT CAAGAAACCG GCGTTCCCGT

201   CCTGCCGAAC ACGGCAGGCT GCCAAAGCGT GCAGGAAGCG GTAACGACGG

251   CGCAAATGGC GCGCGAAGTG TTTGAAACCG ATTGGATAAA ATTGGAACTC
```

```
301 ATCGGCGACG ACGACACCTT GCAGCCGGAC GTGTTCCAAC TCGTCGAAGC

351 GGCGGAAATC CTGATTAAAG ACGGCTTCAA AGTGCTGCCT TATTGCACCG

401 AAGACCTGAT TGCCTGCCGC CGCCTGCTCG ATGCGGGCTG TCAGGCGTTG

451 ATGCCGTGGG CGGCTCCCAT CGGCACGGGT TTGGGGCGG TTCACGCCTA

501 TGCGCTCAAA ATCCTGCGCG AACGCCTGCC CGACACGCCG CTGATTATCG

551 ACGCGGGCTT GGGTTTGCCT TCCCAAGCGG CACAAGTGAT GGAATGGGGT

601 TTTGACGGCG TATTGTTAAA CACCGCCGTT TCCCGCAGCG GCGACCCCGT

651 CAACATGGCG CGCGCCTTCG CACTCGCCGT CGAATCCGGA CGGCTGGCAT

701 TTGAAGCCGG GCCGGTCGAA GCGCGAACCA AAGCCCAAGC CAGCACGCCG

751 ACAGTCGGAC AACCGTTTTG GCATTCGGCG GAATATTGA
```

This corresponds to the amino acid sequence <SEQ ID 470; ORF 126-1.ng>:

```
g126-1.pep.
  1 MLTLYGETFP SRLLLGTAAY PTPEILKQSV RTARPAMITV SLRRTGCGGE

51 AHGQGFWSLL QETGVPVLPN TAGCQSVQEA VTTAQMAREV FETDWIKLEL

101 IGDDDTLQPD VFQLVEAAEI LIKDGFKVLP YCTEDLIACR RLLDAGCQAL

151 MPWAAPIGTG LGAVHAYALK ILRERLPDTP LIIDAGLGLP SQAAQVMEWG

201 FDGVLLNTAV SRSGDPVNMA RAFALAVESG RLAFEAGPVE ARTKAQASTP

251 TVGQPFWHSA EY*
```

The following partial DNA sequence was identified in *N. meningitidis* <SEQ ID 471>:

```
m126-1.seq
  1 ATGCTCACCC TATACGGCGA AACTTTCCCC TCGCGGCTGC TGCTCGGCAC

51 GGCTGCCTAC CCGACCCCCG AAATCCTCAA ACAATCCATC CAAACCGCCC

101 AGCCTGCGAT GATTACCGTC TCGCTGCGCC GCGCGGGAAG CGGCGGCGAG

151 GCGCACGGTC AGGGGTTTTG GTCGCTGCTT CAAGAAACCG GCGTTCCCGT

201 CCTGCCGAAC ACGGCAGGCT GCCAAAGCGT GCAGGAAGCG GTAACGACGG

251 CGCAAATGGC GCGCGAAGTG TTTGAAACCG ATTGGATAAA ATTGGAACTC

301 ATCGGAGATG ACGACACCTT GCAGCCGGAT GTGTTCCAGC TTGTCGAAGC

351 GGCGGAAATC CTGATTAAAG ACGGCTTCAA AGTGCTGCCT TATTGCACCG

401 AAGACCTGAT TGCCTGCCGC CGCCTGCTCG ACGCGGGCTG TCAGGCGTTG

451 ATGCCGTGGG CGGCCCCGAT CGGCACGGGT TTGGGCGCGG TTCACGCCTA

501 CGCGTTGAAC GTCCTGCGCG AACGCCTGCC CGACACGCCG CTGATTATCG

551 ACGCGGGCTT GGGTTTGCCC TCACAGGCGG CACAAGTGAT GGAATGGGGC

601 TTTGACGGCG TGCTTTTGAA TACTGCCGTT TCCCGCAGCG GCGATCCGGT

651 CAATATGGCA CGCGCCTTCG CACTCGCCGT CGAATCCGGA CGGCTGGCAT

701 TTGAAGCCGG ACCGGTCGAA GCACGCGACA AAGCGCAAGC CAGCACGCCG

751 ACAGTCGGAC AACCGTTTTG GCATTCGGCG GAATATTGA
```

This corresponds to the amino acid sequence <SEQ ID 5; ORF 126-1>:

```
m126-1.pep

1 MLTLYGETFP SRLLLGTAAY PTPEILKQSI QTAQPAMITV SLRRAGSGGE

51 AHGQGFWSLL QETGVPVLPN TAGCQSVQEA VTTAQMAREV FETDWIKLEL

101 IGDDDTLQPD VFQLVEAAEI LIKDGFKVLP YCTEDLIACR RLLDAGCQAL

151 MPWAAPIGTG LGAVHAYALN VLRERLPDTP LIIDAGLGLP SQAAQVMEWG

201 FDGVLLNTAV SRSGDPVNMA RAFALAVESG RLAFEAGPVE ARDKAQASTP

251 TVGQPFWHSA EY* m126-1/g126-1  96.9% identity in 262 aa overlap 10         20         30         40         50         60
  m126-1.pep   MLTLYGETFPSRLLLGTAAYPTPEILKQSIQTAQPAMITVSLRRAGSGGEAHGQGFWSLL
               |||||||||||||||||||||||||||||::||:|||||||||||:||||||||||||||
  g126-1       MLTLYGETFPSRLLLGTAAYPTPEILKQSVRTARPAMITVSLRRTGCGGEAHGQGFWSLL
                  10         20         30         40         50         60

70         80         90        100        110        120
  m126-1.pep   QETGVPVLPNTAGCQSVQEAVTTAQMAREVFETDWIKLELIGDDDTLQPDVFQLVEAAEI
               ||||||||||||||||||||||||||||||||||||||||||||||||||||||||||||
  g126-1       QETGVPVLPNTAGCQSVQEAVTTAQMAREVFETDWIKLELIGDDDTLQPDVFQLVEAAEI
                  70         80         90        100        110        120

130        140        150        160        170        180
  m126-1.pep   LIKDGFKVLPYCTEDLIACRRLLDAGCQALMPWAAPIGTGLGAVHAYALNVLRERLPDTP
               ||||||||||||||||||||||||||||||||||||||||||||||||||::||||||||
  g126-1       LIKDGFKVLPYCTEDLIACRRLLDAGCQALMPWAAPIGTGLGAVHAYALKILRERLPDTP
                 130        140        150        160        170        180

190        200        210        220        230        240
  m126-1.pep   LIIDAGLGLPSQAAQVMEWGFDGVLLNTAVSRSGDPVNMARAFALAVESGRLAFEAGPVE
               ||||||||||||||||||||||||||||||||||||||||||||||||||||||||||||
  g126-1       LIIDAGLGLPSQAAQVMEWGFDGVLLNTAVSRSGDPVNMARAFALAVESGRLAFEAGPVE
                 190        200        210        220        230        240

250        260
  m126-1.pep   ARDKAQASTPTVGQPFWHSAEYX
               ||:||||||||||||||||||||
  g126-1       ARTKAQASTPTVGQPFWHSAEYX
                 250        260
```

The following partial DNA sequence was identified in *N. meningitidis* <SEQ ID 473>:

```
a126-1.seq
    1 ATGCTCACCC TGTACAGCGA AACTTTCCCT TCGCGGCTGC TGCTCGGCAC

51 AGCCGCCTAC CCGACCCCTG AAATCCTCAA ACAATCCGTC CGAACCGCCC

101 GGCCCGCGAT GATTACCGTC TCGCTGCGCC GCGCGGGATG CGGCGGCGAG

151 GCGCACGGTC AGGGGTTTTG GTCGCTGCTT CAAGAAACCG GCGTTCCCGT

201 CCTGCCGAAC ACGGCAGGCT GCCAAAGCGT GCAGGAAGCG GTAACGACGG

251 CGCAAATGGC GCGCGAAGTG TTTGAAACCG ATTGGATTAA ACTCGAACTC

301 ATCGGCGACG ACGACACCTT GCAGCCGGAT GTGTTCCAAC TTGTCGAAGC

351 GGCGGAAATC CTGATTAAAG ACGGCTTCAA AGTGCTGCCT TATTGCACCG

401 AAGACCTGAT TGCCTGCCGC CGCCTGCTCG ACGCGGGCTG TCAGGCGTTG

451 ATGCCGTGGG CGGCCCCGAT CGGCACGGGT TTGGGCGCGG TTCACGCCTA

501 CGCGTTGAAC GTCCTGCGCG AACGCCTGCC CGACACGCCG CTGATTATCG

551 ACGCGGGCTT GGGTTTGCCC TCACAGGCGG CACAAGTGAT GGAATGGGGC

601 TTTGACGGCG TGCTTTTGAA TACTGCCGTT TCCCGCAGCG GCGATCCGGT

651 CAATATGGCA CGCGCCTTCG CACTCGCCGT CGAATCCGGA CGGCTGGCAT
```

```
701  TTGAAGCCGG ACCGGTCGAA GCACGCGACA AAGCGCAAGC CAGCACGCCG

751  ACAGTCGGAC AACCGTTTTG GCATTCGGCG GAATATTGA
```

This corresponds to the amino acid sequence <SEQ ID 474; ORF 126-1.a>:

```
a126-1.pep

1 MLTLYGETFP SRLLLGTAAY PTPEILKQSV RTAQPAMITV SLRRAGSGGE

51 AHGQGFWSLL QETGVPVLPN TAGCQSVQEA VTTAQMAREV FETDWIKLEL

101 IGDDDTLQPD VFQLVEAAEI LIKDGFKVLP YCTEDLIACR RLLDAGCQAL

151 MPWAAPIGTG LGAVHAYALN VLRERLPDTP LIIDAGLGLP SQAAQVMEWG

201 FDGVLLNTAV SRSGDPVNMA RAFALAVESG RLAFEAGPVE ARDKAQASTP

251 TVGQPFWHSA EY* a126-1/m126-1  98.1% identity in 262 aa overlap 10         20         30         40         50         60
   a126-1.pep  MLTLYSETFPSRLLLGTAAYPTPEILKQSVRTARPAMITVSLRRAGCGGEAHGQGFWSLL
               |||||:||||||||||||||||||||||||||::||:||||||||||  ||||||||||
   m126-1      MLTLYGETFPSRLLLGTAAYPTPEILKQSIQTAQPAMITVSLRRTGSGGEAHGQGFWSLL
                     10         20         30         40         50         60

70         80         90        100        110        120
   a126-1.pep  QETGVPVLPNTAGCQSVQEAVTTAQMAREVFETDWIKLELIGDDDTLQPDVFQLVEAAEI
               ||||||||||||||||||||||||||||||||||||||||||||||||||||||||||||
   m126-1      QETGVPVLPNTAGCQSVQEAVTTAQMAREVFETDWIKLELIGDDDTLQPDVFQLVEAAEI
                     70         80         90        100        110        120

130        140        150        160        170        180
   a126-1.pep  LIKDGFKVLPYCTEDLIACRRLLDAGCQALMPWAAPIGTGLGAVHAYALNVLRERLPDTP
               ||||||||||||||||||||||||||||||||||||||||||||||||||||||||||||
   m126-1      LIKDGFKVLPYCTEDLIACRRLLDAGCQALMPWAAPIGTGLGAVHAYALNVLRERLPDTP
                    130        140        150        160        170        180

190        200        210        220        230        240
   a126-1.pep  LIIDAGLGLPSQAAQVMEWGFDGVLLNTAVSRSGDPVNMARAFALAVESGRLAFEAGPVE
               ||||||||||||||||||||||||||||||||||||||||||||||||||||||||||||
   m126-1      LIIDAGLGLPSQAAQVMEWGFDGVLLNTAVSRSGDPVNMARAFALAVESGRLAFEAGPVE
                    190        200        210        220        230        240

250        260
   a126-1.pep  ARDKAQASTPTVGQPFWHSAEYX
               |||||||||||||||||||||||
   m126-1      ARDKAQASTPTVGQPFWHSAEYX
                    250        260
```

The following partial DNA sequence was identified in *N. gonorrhoeae* <SEQ ID 475>:

```
g127.seq
     1 ATGGAAATAT GGAATATGTT GAACACTTGG CCCGATGCCG TCCCGATACG

51 CGCGGAGGCG GCCGAATCCG TGGCGGCGGT CGCGGCTTTG CTGCTGGCGC

101 GCGCCCTTCT GTTGAATATC CACTTCAGAC GGCATCCGGA TTTCGGCATC

151 GAAAGCAAGC GGCGGTTTTT GGTTGCCAGC CGCAATATAA CGCTGCTTTT

201 GGTGCTGTTT TCGCTGGCAT TTATCTGGTC GGCGCAAATT CAAACGCTGG

251 CTTTGTCGAT GTTTGCGGTG GCGGCGGCGG TCGTCGTGGC GACAAAAGAA

301 CTGATTATGT GTCTGTCGGG CAGTATTTTA aggtctGCCA CCCAGCAATA

351 CTCGGTCGGC GACTATATCG AAATCAACGG CCTGCGCGGG CGCGTGGTCG

401 ACATCAATCT GTTGAACACG CTGATGATGC AGGTCGGTCC GAACCCCTTG

451 GTCGGACAGC TTGCGGGAAC CACCGTTTCT TTCCCCAACA GCCTGTTGTT
```

```
501 GAGCCACCCC GTGCGCCGCG ACAATATTTT GGGCGACTAT GTCATCCATA

551 CGGTCGAAAT CCCCGTTCCC ATCCATTTGG ATTCGGATGA AGCCGTATGC

601 CGTCTGAAAG CCGTACTCGA GCCCTTGTGC GCGCCCTACA TCCCCGCCAT

651 TCAGCGGTAT TTGGAAAACG TGCAGGCGGA AAAACTGTTT ATCACGCCCG

701 CCGCCAGGCC GCGCGTTACC CGCGTACCGT ACGACGACAA GGCATACCGC

751 ATCATCGTCC GCTTCGCCTC CCCCGTTTCA AAGCGGCTGG AAATCCAACA

801 GGCGGTTATG GACGAATTTT TGCGCGTACA ATACCGCCTG TTAAATCATC

851 CCGCCGcfct cccrAAACAC TTTAA
```

This corresponds to the amino acid sequence <SEQ ID 476; ORF 127.ng>:

```
g127.pep
   1 MEIWNMLNTW PDAVPIRAEA AESVAAVAAL LLARALLLNI HFRRHPDFGI

51 ESKRRFLVAS RNITLLLVLF SLAFIWSAQI QTLALSMFAV AAAVVVATKE

101 LIMCLSGSIL RSATQQYSVG DYIEINGLRG RVVDINLLNT LMMQVGPNPL

151 VGQLAGTTVS FPNSLLLSHP VRRDNILGDY VIHTVEIPVP IHLDSDEAVC

201 RLKAVLEPLC APYIPAIQRY LENVQAEKLF ITPAARPRVT RVPYDDKAYR

251 IIVRFASPVS KRLEIQQAVM DEFLRVQYRL LNHPAGSETL *
```

The following partial DNA sequence was identified in *N. meningitidis* <SEQ ID 477>:

```
m127.seq
   1 ATGGAAATAT GGAATATGTT GGACACTTGG CTCGGTGCCG TCCCGATACG

51 TGCGGAGGCG GTCGAATCCG TGGCGGCGGT TGCGGCTTTG CTGCTGGCGC

101 GCGCCCTTCT GTTGAATATC CACTTCAAAC GGCATCCGGA TTTCGGCATC

151 GAAAGCAAGC GGCGGTTTTT GGTTGCCAGC CGCAATATAA CGCTGCTTTT

201 GGTGCTGTTT TCGCTGGCAT TTATCTGGTC GGCGCAAATC CAAACGCTGG

251 CTTTGTCGAT GTTTGCGGTG GCGGCGGCGG TCGTCGTGGC GACGAAGGAA

301 CTGATTATGT GTCTGTCGGG CAGTATTTTA AGGTCTGCCA CCCAGCAATA

351 CTCGGTCGGC GACTATATCG AAATCAACGG CCTGCGCGGG CGCGTGGTCG

401 ACATCAACCT GTTGAACACG CTGATGATGC AGGTCGGTCC GAACCCCTTG

451 GTCGGACAGC TTGCGGGAAC CACCGTTTCT TTCCCCAACA GCCTGTTGTT

501 GAGCCACCCC GTGCGCCGCG ACAATATTTT GGGCGACTAT GTCATCCATA

551 CGGTCGAAAT CCCCGTTCCC ATCCATTTGG ATTCGGATGA AGCCGTATGC

601 CGTCTGAAAG CCGTACTCGA GCCCTTGTGC GCGCCCTACA TCCCCGCCAT

651 CCAACGGsAT TTGGAAAACG TGCAGGCGGA AAAACTGTTT ATCACGCCCG

701 CCGCCAGACC GCGCGTTACC CGCGTGCCGT ACGATGACAA GGCATACCGC

751 ATCATCGTCC GCTTCGCTTC CCCCGTTTCA AAGCGGCTGG AAATCCAACA

801 GGCGGTTATG GACGAATTTT TGCGCGTACA ATACCGCCTG TTAAATCACC

851 CCGCCGGCTC CGAAACACTT TAA
```

This corresponds to the amino acid sequence <SEQ ID 478; ORF 127>:

```
m127.pep
    1 MEIWNMLDTW LGAVPIRAEA VESVAAVAAL LLARALLLNI HFKRHPDFGI

51 ESKRRFLVAS RNITLLLVLF SLAFIWSAQI QTLALSMFAV AAAVVVATKE

101 LIMCLSGSIL RSATQQYSVG DYIEINGLRG RVVDINLLNT LMMQVGPNPL

151 VGQLAGTTVS FPNSLLLSHP VRRDNILGDY VIHTVEIPVP IHLDSDEAVC

201 RLKAVLEPLC APYIPAIQRX LENVQAEKLF ITPAARPRVT RVPYDDKAYR

251 IIVRFASPVS KRLEIQQAVM DEFLRVQYRL LNHPAGSETL *
```

Computer analysis of this amino acid sequence gave the following results:
Homology with a Predicted ORF from *N. gonorrhoeae*
ORF 127 shows 97.9% identity over a 290 aa overlap with a predicted ORF (ORF 127.ng) from *N. gonorrhoeae*:

```
    m127/g127
                        10         20         30         40         50         60
        m127.pep   MEIWNMLDTWLGAVPIRAEAVESVAAVAALLLARALLLNIHFKRHPDFGIESKRRFLVAS
                   |||||||:||  |||||||||:||||||||||||||||||||:||||||||||||||||
            g127   MEIWNMLNTWPDAVPIRAEAAESVAAVAALLLARALLLNIHFRRHPDFGIESKRRFLVAS
                        10         20         30         40         50         60

70         80         90        100        110        120
        m127.pep   RNITLLLVLFSLAFIWSAQIQTLALSMFAVAAAVVVATKELIMCLSGSILRSATQQYSVG
                   ||||||||||||||||||||||||||||||||||||||||||||||||||||||||||||
            g127   RNITLLLVLFSLAFIWSAQIQTLALSMFAVAAAVVVATKELIMCLSGSILRSATQQYSVG
                        70         80         90        100        110        120

130        140        150        160        170        180
        m127.pep   DYIEINGLRGRVVDINLLNTLMMQVGPNPLVGQLAGTTVSFPNSLLLSHPVRRDNILGDY
                   ||||||||||||||||||||||||||||||||||||||||||||||||||||||||||||
            g127   DYIEINGLRGRVVDINLLNTLMMQVGPNPLVGQLAGTTVSFPNSLLLSHPVRRDNILGDY
                       130        140        150        160        170        180

190        200        210        220        230        240
        m127.pep   VIHTVEIPVPIHLDSDEAVCRLKAVLEPLCAPYIPAIQRXLENVQAEKLFITPAARPRVT
                   ||||||||||||||||||||||||||||||||||||||| ||||||||||||||||||||
            g127   VIHTVEIPVPIHLDSDEAVCRLKAVLEPLCAPYIPAIQRYLENVQAEKLFITPAARPRVT
                       190        200        210        220        230        240

250        260        270        280        290
        m127.pep   RVPYDDKAYRIIVRFASPVSKRLEIQQAVMDEFLRVQYRLLNHPAGSETLX
                   ||||||||||||||||||||||||||||||||||||||||||||||||||
            g127   RVPYDDKAYRIIVRFASPVSKRLEIQQAVMDEFLRVQYRLLNHPAGSETLX
                       250        260        270        280        290
```

The following partial DNA sequence was identified in *N. meningitidis* <SEQ ID 479>:

```
a127.seq
    1 ATGGAAATAT GGAATATGTT GGACACTTGG CTCGGTGCCG TCCCGATACG

51 TGCGGAGGCG GTCGAATCCG TGGCGGTGGT CGCGGCTTTG CTGCTGGCGC

101 GCGCCCTTCT GTTGAATATC CACTTCAAAC GGCATCCGGA TTTCGGCATC

151 GAAAGCAAGC GGCGGTTTTT GGTTGCCAGC CGCAATATAA CGCTGCTTTT

201 GGTGCTGTTT TCGCTGGCAT TTATCTGGTC GGCGCAAATC CAAACGCTGG

251 CTTTGTCGAT GTTTGCGGTG GCGGCGGCGG TCGTCGTGGC GACGAAGGAA

301 CTGATTATGT GTCTGTCGGG CAGCATTTTA AGGTCTGCCA CCCAGCAATA
```

```
351 CTCGGTCGGC GACTATATCG AAATCAACGG CCTGCGCGGG CGCGTGGTCG

401 ACATCAACCT GTTGAACACG CTGATGATGC AGGTCGGTCC GAACCCCTTG

451 GTCGGACAGC TTGCGGGAAC CACCGTTTCT TCCCCAACA GCCTGTTGTT

501 GAGCCACCCC GTGCGCCGCG ACAATATTTT GGGCGACTAC GTCATCCATA

551 CGGTCGAAAT CCCGGTTCCC ATCCATTTGG ATTCGGATGA AGCCGTATGC

601 CGTCTGAAAG CCGTACTCGA GCCCTTGTGC GCGCCCTACA TCCCCGCCAT

651 CCAACGGCAT TTGGAAAACG TGCAGGCGGA AAAACTGTTT ATCACGCCCG

701 CCGCCAAACC GCGCGTTACC CGCGTGCCGT ACGATGACAA GGCATACCGC

751 ATCATCGTCC GCTTCGCCTC CCCCGTTTCA AAGCGGCTGG AAATCCAACA

801 GGCGGTTATG GACGAATTTT TGCGCGTACA ATACCGCCTG TTAAATTACC

851 CCGCCGGCTC CGAAACACTT TAA
```

This corresponds to the amino acid sequence <SEQ ID 480; ORF 127.a>:

```
a127.pep.
    1 MEIWNMLDTW LGAVPIRAEA VESVAVVAAL LLARALLLNI HFKRHPDFGI

51 ESKRRFLVAS RNITLLLVLF SLAFIWSAQI QTLALSMFAV AAAVVVATKE

101 LIMCLSGSIL RSATQQYSVG DYIEINGLRG RVVDINLLNT LMMQVGPNPL

151 VGQLAGTTVS FPNSLLLSHP VRRDNILGDY VIHTVEIPVP IHLDSDEAVC

201 RLKAVLEPLC APYIPAIQRH LENVQAEKLF ITPAAKPRVT RVPYDDKAYR

251 IIVRFASPVS KRLEIQQAVM DEFLRVQYRL LNYPAGSETL *
``` m127/a127 98.6% identity in 290 aa overlap

```
                 10         20         30         40         50         60
m127.pep  MEIWNMLDTWLGAVPIRAEAVESVAAVAALLLARALLLNIHFKRHPDFGIESKRRFLVAS
          ||||||||||||||||||||||:|||||||||||||||||||||||||||||||||||||
a127      MEIWNMLDTWLGAVPIRAEAVESVAVVAALLLARALLLNIHFKRHPDFGIESKRRFLVAS
                 10         20         30         40         50         60

70         80         90        100        110        120
m127.pep  RNITLLLVLFSLAFIWSAQIQTLALSMFAVAAAVVVATKELIMCLSGSILRSATQQYSVG
          ||||||||||||||||||||||||||||||||||||||||||||||||||||||||||||
a127      RNITLLLVLFSLAFIWSAQIQTLALSMFAVAAAVVVATKELIMCLSGSILRSATQQYSVG
                 70         80         90        100        110        120

130        140        150        160        170        180
m127.pep  DYIEINGLRGRVVDINLLNTLMMQVGPNPLVGQLAGTTVSFPNSLLLSHPVRRDNILGDY
          ||||||||||||||||||||||||||||||||||||||||||||||||||||||||||||
a127      DYIEINGLRGRVVDINLLNTLMMQVGPNPLVGQLAGTTVSFPNSLLLSHPVRRDNILGDY
                130        140        150        160        170        180

190        200        210        220        230        240
m127.pep  VIHTVEIPVPIHLDSDEAVCRLKAVLEPLCAPYIPAIQRXLENVQAEKLFITPAARPRVT
          |||||||||||||||||||||||||||||||||||||||| |||||||||||||||:|||
a127      VIHTVEIPVPIHLDSDEAVCRLKAVLEPLCAPYIPAIQRHLENVQAEKLFITPAAKPRVT
                190        200        210        220        230        240

250        260        270        280        290
m127.pep  RVPYDDKAYRIIVRFASPVSKRLEIQQAVMDEFLRVQYRLLNHPAGSETLX
          ||||||||||||||||||||||||||||||||||||||||||:|||||||
a127      RVPYDDKAYRIIVRFASPVSKRLEIQQAVMDEFLRVQYRLLNYPAGSETLX
                250        260        270        280        290
```

The following partial DNA sequence was identified in *N. gonorrhoeae* <SEQ ID 481>:

```
g128.seq
    1 atgattgaca acgCActgct ccacttgggc gaagaaccCC GTTTTaatca 51 aatccaaacc gaagACAtca AACCCGCCGT CCAAACCGCC ATCGCCGAAG
```

-continued

```
 101 CGCGCGGACA AATCGCCGCC GTCAAAGCGC AAACGCACAC CGGCTGGGCG
 151 AACACCGTCG AGCGTCTGAC CGGCATCACC GAACGCGTCG GCAGGATTTG
 201 GGGCGTCGTG TCCCATCTCA ACTCCGTCGT CGACACGCCC GAACTGCGCG
 251 CCGTCTATAA CGAACTGATG CCTGAAATCA CCGTCTTCTT CACCGAAATC
 301 GGACAAGACA TCGAACTGTA CAACCGCTTC AAAACCATCA AAAATTCCCC
 351 CGAATTTGCA ACGCTTTCCC CCGCACAAAA AACCAAGCTC GATCACGACC
 401 TGCGCGATTT CGTATTGAGC GGCGCGGAAC TGCCGCCCGA ACGGCAGGCA
 451 GAACTGGCAA AACTGCAAAC CGAAGGCGCG CAACTTTCCG CCAAATTCTC
 501 CCAAAACGTC CTAGACGCGA CCGACGCGTT CGGCATTTAC TTTGACGATG
 551 CCGCACCGCT TGCCGGCATT CCCGAAGACG CGCTCGCCAT GTTTGCCGCC
 601 GCCGCGCAAA GCGAAGGCAA AACAGGTTAC AAAATCGGCT TGCAGATTCC
 651 GCACTACCTT GCCGTTATCC AATACGCCGG CAACCGCGAA CTGCGCGAAC
 701 AAATCTACCG CGCCTACGTT ACCCGTGCCA GCGAACTTTC AAACGACGGC
 751 AAATTCGACA ACACCGCCAA CATCGACCGC ACGCTCGAAA ACGCATTGAA
 801 AACCGccaaa cTGCTCGGCT TTAAAAATTA CGCCGAATTG TCGCTGGCAA
 851 CCAAAATGGC GGACACGCCC GAACAGGTTT TAAACTTCCT GCACGACCTC
 901 GCCCGCCGCG CCAAACCCTA CGCCGAAAAA GACCTCGCCG AAGTCAAAGC
 951 CTTCGCCCGC GAACACCTCG GTCTCGCCGA CCCGCAGCCG TGGGACTTGA
1001 GCTACGCCGG CGAAAAACTG CGCGAAGCCA ATACGCATT CAGCGAAACC
1051 GAAGTCAAAA ATACTTCCC CGTCGGCAAA GTTCTGGCAG GCCTGTTCGC
1101 CCAAATCAAA AAACTCTACG GCATCGGATT CGCCGAAAAA ACCGTTCCCG
1151 TCTGGCACAA AGACGTGCGC TATTTTGAAT TGCAACAAAA CGGCAAAACC
1201 ATCGGCGGCG TTTATATGGA TTTGTACGCA CGCGAAGGCA AACGCGGCGG
1251 CGCGTGGATG AACGACtaca AAGGCCGCCG CCGCTTTGCC GACGgcacGC
1301 TGCAACTGCC CACCGCCTAC CTCGTCTGCA ACTTCGCCCC GCCCGTCGGC
1351 GGCAAAGAAG CGCGTTTAAG CCACGACGAA ATCCTCACCC TCTTCCACGA
1401 AacCGGCCAC GGACTGCACC ACCTGCTTAC CCAAGTGGAC GAACTGGGCG
1451 TGTCCGGCAT CAAcggcgtA GAATGGGACG CGGTCGAACT GCCCAGCCAG
1501 TTTATGGAAA ACTTCGTTTG GGAATACAAT GTATTGGCAC AAATGTCCGC
1551 CCACGAAGAA AccgGCGAGC CCCTGCCGAA AGAACTCTTC GACAAAATGC
1601 TcgcCGCCAA AAACTTCCAG CGCGGTATGT TCCTCGTCCG GCAAATGGAG
1651 TTCGCCCTCT TCGATATGAT GATTTACAGT GAAAGCGACG AATGCCGTCT
1701 GAAAAACTGG CAGCAGGTTT TAGACAGCGT GCGCAAAGAA GTcGCCGTCA
1751 TCCAACCGCC CGAATACAAC CGCTTCGCCA ACAGCTTCGG CCacatctTC
1801 GCcggcGGCT ATTCCGCAGG CTATTACAGC TACGCATGGG CCGAAGTCCt
1851 cAGCACCGAT GCCTACGCCG CCTTTGAAGA AAGcGACGac gtcGCCGCCA
1901 CAGGCAAACG CTTCTGGCAA GAAAtccttg ccgtcggcgg ctCCCGCAGC
1951 gcgGCGGAAT CCTTCAAAGC CTTCCGCGGA CGCGAACCGA GCATAGACGC
2001 ACTGCTGCGC CAaagcggtT TCGACAACGC gGCttgA
```

This corresponds to the amino acid sequence <SEQ ID 482; ORF 128.ng>:

```
g128.pep
    1 MIDNALLHLG EEPRFNQIQT EDIKPAVQTA IAEARGQIAA VKAQTHTGWA

51 NTVERLTGIT ERVGRIWGVV SHLNSVVDTP ELRAVYNELM PEITVFFTEI

101 GQDIELYNRF KTIKNSPEFA TLSPAQKTKL DHDLRDFVLS GAELPPERQA

151 ELAKLQTEGA QLSAKFSQNV LDATDAFGIY FDDAAPLAGI PEDALAMFAA

201 AAQSEGKTGY KIGLQIPHYL AVIQYAGNRE LREQIYRAYV TRASELSNDG

251 KFDNTANIDR TLENALKTAK LLGFKNYAEL SLATKMADTP EQVLNFLHDL

301 ARRAKPYAEK DLAEVKAFAR EHLGLADPQP WDLSYAGEKL REAKYAFSET

351 EVKKYFPVGK VLAGLFAQIK KLYGIGFAEK TVPVWHKDVR YFELQQNGKT

401 IGGVYMDLYA REGKRGGAWM NDYKGRRRFA DGTLQLPTAY LVCNFAPPVG

451 GKEARLSHDE ILTLFHETGH GLHHLLTQVD ELGVSGINGV EWDAVELPSQ

501 FMENFVWEYN VLAQMSAHEE TGEPLPKELF DKMLAAKNFQ RGMFLVRQME

551 FALFDMMIYS ESDECRLKNW QQVLDSVRKE VAVIQPPEYN RFANSFGHIF

601 AGGYSAGYYS YAWAEVLSTD AYAAFEESDD VAATGKRFWQ EILAVGGSRS

651 AAESFKAFRG REPSIDALLR QSGFDNAA*
```

The following partial DNA sequence was identified in *N. meningitidis* <SEQ ID 483>:

```
m128.seq (partial)
    1 ATGACTGACA ACGCACTGCT CCATTTGGGC GAAGAACCCC GTTTTGATCA

51 AATCAAAACC GAAGACATCA AACCCGCCCT GCAAACCGCC ATCGCCGAAG

101 CGCGCGAACA AATCGCCGCC ATCAAAGCCC AAACGCACAC CGGCTGGGCA

151 AACACTGTCG AACCCCTGAC CGGCATCACC GAACGCGTCG GCAGGATTTG

201 GGGCGTGGTG TCGCACCTCA ACTGCGTCGC CGACACGCCC GAACTGCGCG

251 CCGTCTATAA CGAACTGATG CCCGAAATCA CCGTCTTCTT CACCGAAATC

301 GGACAAGACA TCGAGCTGTA CAACCGCTTC AAAACCATCA AAAATTCCCC

351 CGAATTCGAC ACCCTCTCCC CCGCACAAAA AACCAAACTC AACCAC

1 TACGCCAGCG AAAAACTGCG CGAAGCCAAA TACGCGTTCA GCGAAACCGA 51 wGTCAAAAAA TAyTTCCCyG TCGGCAAwGT ATTAAACGGA CTGTTCGCCC

101 AAmTCAAAAA ACTmTACGGC ATCGGATTTA CCGAAAAAAC yGTCCCCGTC

151 TGGCACAAAG ACGTGCGCTA TTkTGAATTG CAACAAAACG GCGAAmCCAT

201 AGGCGGCGTT TATATGGATT TGTACGCACG CGAAGGCAAA CGCGGCGGCG

251 CGTGGATGAA CGACTACAAA GGCCGCCGCC GTTTTTCAGA CGGCACGCTG

301 CAAyTGCCCA CCGCCTACCT CGTCTGCAAC TTCGCCCCAC CCGTCGGCGG

351 CAGGGAAGCC CGCyTGAGCC ACGACGAAAT CCTCATCCTC TTCCACGAAA

401 CCGGACACGG GCTGCACCAC CTGCTTACCC AAGTGGACGA ACTGGGCGTA

451 TCCGGCATCA ACGGCGTAkA ATGGGACGCG GTCGAACTGC CCAGCCAGTT

501 TATGGAAAAT TTCGTTTGGG AATACAATGT CTTGGCACAA mTGTCAGCCC

551 ACGAAGAAAC CGGcgTTCCC yTGCCGAAAG AACTCTTsGA CAAAwTGCTC

601 GCCGCCAAAA ACTTCCAAsG CGGCATGTTC yTsGTCCGGC AAwTGGAGTT
```

```
 651 CGCCCTCTTT GATATGATGA TTTACAGCGA AGACGACGAA GGCCGTCTGA

701 AAAACTGGCA ACAGGTTTTA GACAGCGTGC GCAAAAAAGT CGCCGTCATC

751 CAGCCGCCCG AATACAACCG CTTCGCCTTG AGCTTCGGCC ACATCTTCGC

801 AGGCGGCTAT TCCGCAGCTn ATTACAGCTA CGCGTGGGCG GAAGTATTGA

851 GCGCGGACGC ATACGCCGCC TTTGAAGAAA GCGACGATGT CGCCGCCACA

901 GGCAAACGCT TTTGGCAGGA AATCCTCGCC GTCGGGnAT CGCGCAGCGG 951 nGCAGAATCC TTCAAAGCCT TCCGCGGCCG CGAACCGAGC ATAGACGCAC

1001 TCTTGCGCCA CAGCGGTTTC GACAACGCGG TCTGA
```

This corresponds to the amino acid sequence <SEQ ID 484; ORF 128>.

```
m128.pep (partial)
   1 MTDNALLHLG EEPRFDQIKT EDIKPALQTA IAEAREQIAA IKAQTHTGWA

51 NTVEPLTGIT ERVGRIWGVV SHLNCVADTP ELRAVYNELM PEITVFFTEI

101 GQDIELYNRF KTIKNSPEFD TLSPAQKTKL NH
//

1 YASEKLREAK YAFSETXVKK YFPVGXVLNG LFAQXKKLYG IGFTEKTVPV

51 WHKDVRYXEL QQNGEXIGGV YMDLYAREGK RGGAWMNDYK GRRRFSDGTL

101 QLPTAYLVCN FAPPVGGREA RLSHDEILIL FHETGHGLHH LLTQVDELGV

151 SGINGVXWDA VELPSQFMEN FVWEYNVLAQ XSAHEETGVP LPKELXDKXL

201 AAKNFQXGMF XVRQXEFALF DMMIYSEDDE GRLKNWQQVL DSVRKKVAVI

251 QPPEYNRFAL SFGHIFAGGY SAAXYSYAWA EVLSADAYAA FEESDDVAAT

301 GKRFWQEILA VGXSRSGAES FKAFRGREPS IDALLRHSGF DNAV*
```

Computer analysis of this amino acid sequence gave the following results:
Homology with a Predicted ORF from *N. gonorrhoeae*
ORF 128 shows 91.7% identity over a 475 aa overlap with a predicted ORF (ORF 128.ng) from *N. gonorrhoeae*:

```
   m128/g128
                    10         20         30         40         50         60
     g128.pep MIDNALLHLGEEPRFNQIQTEDIKPAVQTAIAEARGQIAAVKAQTHTGWANTVERLTGIT
              | ||||||||||||||| :|:||||||:|||||| |||||:|||||||||||| |||||
         m128 MTDNALLHLGEEPRFDQIKTEDIKPALQTAIAEAREQIAAIKAQTHTGWANTVEPLTGIT
                    10         20         30         40         50         60

70         80         90        100        110        120
     g128.pep ERVGRIWGVVSHLNSVVDTPELRAVYNELMPEITVFFTEIGQDIELYNRFKTIKNSPEFA
              |||||||||||||| |:|||||||||||||||||||||||||||||||||||||||||
         m128 ERVGRIWGVVSHLNCVADTPELRAVYNELMPEITVFFTEIGQDIELYNRFKTIKNSPEFD
                    70         80         90        100        110        120

130        140        150        160        170        180
     g128.pep TLSPAQKTKLDHDLRDFVLSGAELPPERQAELAKLQTEGAQLSAKFSQNVLDATDAFGIY
              |||||||||||:|
         m128 TLSPAQKTKLNH
                   130
                        //

340        350        360
     g128.pep                           YAGEKLREAKYAFSETEVKKYFPVGKVLAG
                                        ||:||||||||||||| |||||||| || |
         m128                           YASEKLREAKYAFSETXVKKYFPVGXVLNG
                                                 10         20         30
```

-continued

```
              370       380       390       400       410       420
g128.pep LFAQIKKLYGIGFAEKTVPVWHKDVRYFELQQNGKTIGGVYMDLYAREGKRGGAWMNDYK
         |||| ||||||||:||||||||||||| ||||||::||||||||||||||||||||||||
m128     LFAQXKKLYGIGFTEKTVPVWHKDVRYXELQQNGEXIGGVYMDLYAREGKRGGAWMNDYK
                   40        50        60        70        80        90

430       440       450       460       470       480
g128.pep GRRRFADGTLQLPTAYLVCNFAPPVGGKEARLSHDEILTLFHETGHGLHHLLTQVDELGV
         |||||:|||||||||||||||||||||:|||||||||| |||||||||||||||||||||
m128     GRRRFSDGTLQLPTAYLVCNFAPPVGGREARLSHDEILILFHETGHGLHHLLTQVDELGV
                  100       110       120       130       140       150

490       500       510       520       530       540
g128.pep SGINGVEWDAVELPSQFMENFVWEYNVLAQMSAHEETGEPLPKELFDKMLAAKNFQRGMF
         |||||| ||||||||||||||||||||||| ||||||| |||||| || ||||||| |||
m128     SGINGVXWDAVELPSQFMENFVWEYNVLAQXSAHEETGVPLPKELXDKXLAAKNFQXGMF
                  160       170       180       190       200       210

550       560       570       580       590       600
g128.pep LVRQMEFALFDMMIYSESDECRLKNWQQVLDSVRKEVAVIQPPEYNRFANSFGHIFAGGY
          ||| ||||||||||||:|| ||||||||||||||:||||||||||||| ||||||||||
m128     XVRQXEFALFDMMIYSEDDEGRLKNWQQVLDSVRKKVAVIQPPEYNRFALSFGHIFAGGY
                  220       230       240       250       260       270

610       620       630       640       650       660
g128.pep SAGYYSYAWAEVLSTDAYAAFEESDDVAATGKRFWQEILAVGGSRSAAESFKAFRGREPS
         ||: ||||||||||:||||||||||||||||||||||||||| |||:|||||||||||||
m128     SAAXYSYAWAEVLSADAYAAFEESDDVAATGKRFWQEILAVGXSRSGAESFKAFRGREPS
                  280       290       300       310       320       330

670      679
g128.pep IDALLRQSGFDNAAX
         ||||||:||||||:
m128     IDALLRHSGFDNAVX
                  340
```

The following partial DNA sequence was identified in *N. meningitidis* <SEQ ID 485>:

```
a128.seq
   1  ATGACTGACA ACGCACTGCT CCATTTGGGC GAAGAACCCC GTTTTGATCA

51  AATCAAAACC GAAGACATCA AACCCGCCCT GCAAACCGCC ATTGCCGAAG

101  CGCGCGAACA AATCGCCGCC ATCAAAGCCC AAACGCACAC CGGCTGGGCA

151  AACACTGTCG AACCCCTGAC CGGCATCACC GAACGCGTCG GCAGGATTTG

201  GGGCGTGGTG TCGCACCTCA ACTCCGTCAC CGACACGCCC GAACTGCGCG

251  CCGCCTACAA TGAATTAATG CCCGAAATTA CCGTCTTCTT CACCGAAATC

301  GGACAAGACA TCGAGCTGTA CAACCGCTTC AAAACCATCA AAAACTCCCC

351  CGAGTTCGAC ACCCTCTCCC ACGCGCAAAA AACCAAACTC AACCACGATC

401  TGCGCGATTT CGTCCTCAGC GGCGCGGAAC TGCCGCCCGA ACAGCAGGCA

451  GAATTGGCAA AACTGCAAAC CGAAGGCGCG CAACTTTCCG CCAAATTCTC

501  CCAAAACGTC CTAGACGCGA CCGACGCGTT CGGCATTTAC TTTGACGATG

551  CCGCACCGCT TGCCGGCATT CCCGAAGACG CGCTCGCCAT GTTTGCCGCT

601  GCCGCGCAAA GCGAAGGCAA AACAGGCTAC AAAATCGGTT TGCAGATTCC

651  GCACTACCTC GCCGTCATCC AATACGCCGA CAACCGCAAA CTGCGCGAAC

701  AAATCTACCG CGCCTACGTT ACCCGCGCCA GCGAGCTTTC AGACGACGGC

751  AAATTCGACA ACACCGCCAA CATCGACCGC ACGCTCGAAA ACGCCCTGCA

801  AACCGCCAAA CTGCTCGGCT TCAAAAACTA CGCCGAATTG TCGCTGGCAA

851  CCAAAATGGC GGACACCCCC GAACAAGTTT TAAACTTCCT GCACGACCTC

901  GCCCGCCGCG CCAAACCCTA CGCCGAAAAA GACCTCGCCG AAGTCAAAGC

951  CTTCGCCCGC GAAAGCCTCG GCCTCGCCGA TTTGCAACCG TGGGACTTGG

1001  GCTACGCCGG CGAAAAACTG CGCGAAGCCA AATACGCATT CAGCGAAACC
```

```
-continued
1051  GAAGTCAAAA AATACTTCCC CGTCGGCAAA GTATTAAACG GACTGTTCGC

1101  CCAAATCAAA AAACTCTACG GCATCGGATT TACCGAAAAA ACCGTCCCCG

1151  TCTGGCACAA AGACGTGCGC TATTTTGAAT TGCAACAAAA CGGCGAAACC

1201  ATAGGCGGCG TTTATATGGA TTTGTACGCA CGCGAAGGCA AACGCGGCGG

1251  CGCGTGGATG AACGACTACA AAGGCCGCCG CCGTTTTTCA GACGGCACGC

1301  TGCAACTGCC CACCGCCTAC CTCGTCTGCA ACTTCACCCC GCCCGTCGGC

1351  GGCAAAGAAG CCCGCTTGAG CCATGACGAA ATCCTCACCC TCTTCCACGA

1401  AACCGGACAC GGCCTGCACC ACCTGCTTAC CCAAGTCGAC GAACTGGGCG

1451  TATCCGGCAT CAACGGCGTA GAATGGGACG CAGTCGAACT GCCCAGTCAG

1501  TTTATGGAAA ATTTCGTTTG GGAATACAAT GTCTTGGCGC AAATGTCCGC

1551  CCACGAAGAA ACCGGCGTTC CCATGACGAA AGAACTCTTC GACAAAATGC

1601  TCGCCGCCAA AAACTTCCAA CGCGGAATGT TCCTCGTCCG CCAAATGGAG

1651  TTCGCCCTCT TTGATATGAT GATTTACAGC GAAGACGACG AAGGCCGTCT

1701  GAAAAACTGG CAACAGGTTT TAGACAGCGT GCGCAAAGAA GTCGCCGTCG

1751  TCCGACCGCC CGAATACAAC CGCTTCGCCA ACAGCTTCGG CCACATCTTC

1801  GCAGGCGGCT ATTCCGCAGG CTATTACAGC TACGCGTGGG CGGAAGTATT

1851  GAGCGCGGAC GCATACGCCG CCTTTGAAGA AAGCGACGAT GTCGCCGCCA

1901  CAGGCAAACG CTTTTGGCAG GAAATCCTCG CCGTCGGCGG ATCGCGCAGC

1951  GCGGCAGAAT CCTTCAAAGC CTTCCGCGGA CGCGAACCGA GCATAGACGC

2001  ACTCTTGCGC CACAGCGGCT TCGACAACGC GGCTTGA
```

This corresponds to the amino acid sequence <SEQ ID 486; ORF 128.a>:

```
a128.pep
   1  MTDNALLHLG EEPRFDQIKT EDIKPALQTA IAEAREQIAA IKAQTHTGWA

51  NTVEPLTGIT ERVGRIWGVV SHLNSVTDTP ELRAAYNELM PEITVFFTEI

101  GQDIELYNRF KTIKNSPEFD TLSHAQKTKL NHDLRDFVLS GAELPPEQQA

151  ELAKLQTEGA QLSAKFSQNV LDATDAFGIY FDDAAPLAGI PEDALAMFAA

201  AAQSEGKTGY KIGLQIPHYL AVIQYADNRK LREQIYRAYV TRASELSDDG

251  KFDNTANIDR TLENALQTAK LLGFKNYAEL SLATKMADTP EQVLNFLHDL

301  ARRAKPYAEK DLAEVKAFAR ESLGLADLQP WDLGYAGEKL REAKYAFSET

351  EVKKYFPVGK VLNGLFAQIK KLYGIGFTEK TVPVWHKDVR YFELQQNGET

401  IGGVYMDLYA REGKRGGAWM NDYKGRRRFS DGTLQLPTAY LVCNFTPPVG

451  GKEARLSHDE ILTLFHETGH GLHHLLTQVD ELGVSGINGV EWDAVELPSQ

501  FMENFVWEYN VLAQMSAHEE TGVPLPKELF DKMLAAKNFQ RGMFLVRQME

551  FALFDMMIYS EDDEGRLKNW QQVLDSVRKE VAVVRPPEYN RFANSFGHIF

601  AGGYSAGYYS YAWAEVLSAD AYAAFEESDD VAATGKRFWQ EILAVGGSRS

651  AAESFKAFRG REPSIDALLR HSGFDNAA*
``` m128/a128 66.0% identity in 677 aa overlap

```
              10         20         30         40         50         60
m128.pep  MTDNALLHLGEEPRFDQIKTEDIKPALQTAIAEAREQIAAIKAQTHTGWANTVEPLTGIT
          ||||||||||||||||||||||||||||||||||||||||||||||||||||||||||||
a128      MTDNALLHLGEEPRFDQIKTEDIKPALQTAIAEAREQIAAIKAQTHTGWANTVEPLTGIT
              10         20         30         40         50         60

70         80         90        100        100        120
m128.pep  ERVGRIWGVVSHLNCVADTPELRAVYNELMPEITVFFTEIGQDIELYNRFKTINKSPEFD
          |||||||||||||| :|||||||||:||||||||||||||||||||||||||| |||||
a128      ERVGRIWGVVSHLNSVTDTPELRAAYNELMPEITVFFTEIGQDIELYNRFKTIKNSPEFD
              70         80         90        100        110        120

130
m128.pep  TLSPAQKTKLNH------------------------------------------------
          ||| ||||||||
a128      TLSHAQKTKLNHDLRDFVLSGAELPPEQQAELAKLQTEGAQLSAKFSQNVLDATDAFGIY
             130        140        150        160        170        180 m128.pep  ------------------------------------------------------------ a128      FDDAAPLAGIPEDALAMFAAAQSEGKTGYKIGLQIPHYLAVIQYADNRKLREQIYRAYV
             190        200        210        220        230        240 m128.pep  ------------------------------------------------------------ a128      TRASELSDDGKFDNTANIDRTLENALQTAKLLGFKNYAELSLATKMADTPEQVLNFLHDL
             250        260        270        280        290        300

140        150
m128.pep  --------------------------------YASEKLREAKYAFSETXVKKYFPVGX
                                          ||:||||||||||||| ||||||||||
a128      ARRAKPYAEKDLAEVKAFARESLGLADLQPWDLGYAGEKLREAKYAFSETEVKKYFPVGK
             310        320        330        340        350        360

160        170        180        190        200        210
m128.pep  VLNGLFAQXKKLYGIGFTEKTVPVWHKDVRYXELQQNGEXIGGVYMDLYAREGKRGGAWM
          ||||||||| ||||||||||||||||||||||| |||||||:||||||||||||||||||
a128      VLNGLFAQIKKLYGIGFTEKTVPVWHKDVRYFELQQNGETIGGVYMDLYAREGYRGGAWM
             370        380        390        400        410        420

220        230        240        250        260        270
m128.pep  NDYKGRRRFSDGTLQLPTAYLVCNFAPPVGGREARLSHDEILILFHETGHGLHHLLTQVD
          ||||||||||||||||||||||||||:||||:|||||||||||||:||||||||||||||
a128      NDYKGRRRFSDGTLQLPTAYLVCNFTPPVGGKEARLSHDEILTLFHETGHGLHHLLTQVD
             430        440        450        460        470        480

280        290        300        310        320        330
m128.pep  ELGVSGINGVXWDAVELPSQFMENFVWEYNVLAQXSAHEETGVPLPKELXDKXLAAKNFQ
          |||||||||| ||||||||||||||||||||||| |||||||||||||| || |||||||
a128      ELGVSGINGVEWDAVELPSQFMENFVWEYNVLAQMSAHEETGVPLPKELFDKMLAAKNFQ
             490        500        510        520        530        540

340        350        360        370        380        390
m128.pep  XGMFXVRQXEFALFDMMIYSEDDEGRLKNWQQVLDSVRKKVAVIQPPEYNRFALSFGHIF
           |||  ||| ||||||||||||||||||||||||||||::|||::|||||||||| |||||
a128      RGMFLVRQMEFALFDMMIYSEDDEGRLKNWQQVLDSVRKEVAVVRPPEYNRFANSFGHIF
             550        560        570        580        590        600

400        410        420        430        440        450
m128.pep  AGGYSAAXYSYAWAEVLSADAYAAFEESDDVAATGKRFWQEILAVGXSRSGAESFKAFRG
          ||||||: ||||||||||||||||||||||||||||||||||||||| |||:||||||||
a128      AGGYSAGYYSYAWAEVLSADAYAAFEESDDVAATGKRFWQEILAVGGSRSAAESFKAFRG
             610        620        630        640        650        660

460        470
m128.pep  REPSIDALLRHSGFDNAVX
          ||||||||||||||||||:
a128      REPSIDALLRHSGFDNAAX
             670
```

The following partial DNA sequence was identified in *N. gonorrhoeae* <SEQ ID 487>:

```
g128-1.seq (partial)
   1 ATGATTGACA ACGCACTGCT CCACTTGGGC GAAGAACCCC GTTTTAATCA

51 AATCAAAACC GAAGACATCA AACCCGCCGT CCAAACCGCC ATCGCCGAAG

101 CGCGCGGACA AATCGCCGCC GTCAAAGCGC AAACGCACAC CGGCTGGGCG

151 AACACCGTCG AGCGTCTGAC CGGCATCACC GAACGCGTCG GCAGGATTTG

201 GGGCGTCGTG TCCCATCTCA ACTCCGTCGT CGACACGCCC GAACTGCGCG
```

-continued

```
 251 CCGTCTATAA CGAACTGATG CCTGAAATCA CCGTCTTCTT CACCGAAATC

301 GGACAAGACA TCGAACTGTA CAACCGCTTC AAAACCATCA AAAATTCCCC

351 CGAATTTGCA ACGCTTTCCC CCGCACAAAA AACCAAGCTC GATCACGACC

401 TGCGCGATTT CGTATTGAGC GGCGCGGAAC TGCCGCCCGA ACGGCAGGCA

451 GAACTGGCAA AACTGCAAAC CGAAGGCGCG CAACTTTCCG CCAAATTCTC

501 CCAAAACGTC CTAGACGCGA CCGACGCGTT CGGCATTTAC TTTGACGATG

551 CCGCACCGCT TGCCGGCATT CCCGAAGACG CGCTCGCCAT GTTTGCCGCC

601 GCCGCGCAAA GCGAAGGCAA ACAGGTTAC AAAATCGGCT TGCAGATTCC

651 GCACTACCTT GCCGTTATCC AATACGCCGG CAACCGCGAA CTGCGCGAAC

701 AAATCTACCG CGCCTACGTT ACCCGTGCCA GCGAACTTTC AAACGACGGC

751 AAATTCGACA ACACCGCCAA CATCGACCGC ACGCTCGAAA ACGCATTGAA

801 AACCGCCAAA CTGCTCGGCT TTAAAAATTA CGCCGAATTG TCGCTGGCAA

851 CCAAAATGGC GGACACGCCC GAACAGGTTT AAACTTCCT GCACGACCTC

901 GCCCGCCGCG CCAAACCCTA CGCCGAAAAA GACCTCGCCG AAGTCAAAGC

951 CTTCGCCCGC GAACACCTCG GTCTCGCCGA CCCGCAGCCG TGGGACTTGA

1001 GCTACGCCGG CGAAAAACTG CGCGAAGCCA AATACGCATT CAGCGAAACC

1051 GAAGTCAAAA AATACTTCCC CGTCGGCAAA GTTCTGGCAG CCTGTTCGC

1101 CCAAATCAAA AAACTCTACG GCATCGGATT CGCCGAAAAA ACCGTTCCCG

1151 TCTGGCACAA AGACGTGCGC TATTTTGAAT TGCAACAAAA CGGCAAAACC

1201 ATCGGCGGCG TTTATATGGA TTTGTACGCA CGCGAAGGCA AACGCGGCGG

1251 CGCGTGGATG AACGACTACA AAGGCCGCCG CCGCTTTGCC GACGGCACGC

1301 TGCAACTGCC CACCGCCTAC CTCGTCTGCA ACTTCGCCCC GCCCGTCGGC

1351 GGCAAAGAAG CGCGTTTAAG CCACGACGAA ATCCTCACCC TCTTCCACGA

1401 AACCGGCCAC GGACTGCACC ACCTGCTTAC CCAAGTGGAC GAACTGGGCG

1451 TGTCCGGCAT CAACGGCGTA AAA
```

This corresponds to the amino acid sequence <SEQ ID 488; ORF 128-1.ng>:

```
g128-1.pep.(partial)
   1 MIDNALLHLG EEPRFNQIKT EDIKPAVQTA IAEARGQIAA VKAQTHTGWA

51 NTVERLTGIT ERVGRIWGVV SHLNSVVDTP ELRAVYNELM PEITVFFTEI

101 GQDIELYNRF KTIKNSPEFA TLSPAQKTKL DHDLRDFVLS GAELPPERQA

151 ELAKLQTEGA QLSAKFSQNV LDATDAFGIY FDDAAPLAGI PEDALAMFAA

201 AAQSEGKTGY KIGLQIPHYL AVIQYAGNRE LREQIYRAYV TRASELSNDG

251 KFDNTANIDR TLENALKTAK LLGFKNYAEL SLATKMADTP EQVLNFLHDL

301 ARRAKPYAEK DLAEVKAFAR EHLGLADPQP WDLSYAGEKL REAKYAFSET

351 EVKKYFPVGK VLAGLFAQIK KLYGIGFAEK TVPVWHKDVR YFELQQNGKT

401 IGGVYMDLYA REGKRGGAWM NDYKGRRRFA DGTLQLPTAY LVCNFAPPVG

451 GKEARLSHDE ILTLFHETGH GLHHLLTQVD ELGVSGINGV K
```

The following partial DNA sequence was identified in *N. meningitidis* <SEQ ID 489>:

```
m128-1.seq
   1 ATGACTGACA ACGCACTGCT CCATTTGGGC GAAGAACCCC GTTTTGATCA
  51 AATCAAAACC GAAGACATCA AACCCGCCCT GCAAACCGCC ATCGCCGAAG
 101 CGCGCGAACA AATCGCCGCC ATCAAAGCCC AAACGCACAC CGGCTGGGCA
 151 AACACTGTCG AACCCCTGAC CGGCATCACC GAACGCGTCG GCAGGATTTG
 201 GGGCGTGGTG TCGCACCTCA ACTCCGTCGC CGACACGCCC GAACTGCGCG
 251 CCGTCTATAA CGAACTGATG CCCGAAATCA CCGTCTTCTT CACCGAAATC
 301 GGACAAGACA TCGAGCTGTA CAACCGCTTC AAAACCATCA AAAATTCCCC
 351 CGAATTCGAC ACCCTCTCCC CCGCACAAAA AACCAAACTC AACCACGATC
 401 TGCGCGATTT CGTCCTCAGC GGCGCGGAAC TGCCGCCCGA ACAGCAGGCA
 451 GAACTGGCAA AACTGCAAAC CGAAGGCGCG CAACTTTCCG CCAAATTCTC
 501 CCAAAACGTC CTAGACGCGA CCGACGCGTT CGGCATTTAC TTTGACGATG
 551 CCGCACCGCT TGCCGGCATT CCCGAAGACG CGCTCGCCAT GTTTGCCGCC
 601 GCCGCGCAAA GCGAAAGCAA AACAGGCTAC AAAATCGGCT TGCAGATTCC
 651 ACACTACCTC GCCGTCATCC AATACGCCGA CAACCGCGAA CTGCGCGAAC
 701 AAATCTACCG CGCCTACGTT ACCCGCGCCA GCGAACTTTC AGACGACGGC
 751 AAATTCGACA ACACCGCCAA CATCGACCGC ACGCTCGCAA ACGCCCTGCA
 801 AACCGCCAAA CTGCTCGGCT TCAAAAACTA CGCCGAATTG TCGCTGGCAA
 851 CCAAAATGGC GGACACGCCC GAACAAGTTT TAAACTTCCT GCACGACCTC
 901 GCCCGCCGCG CCAAACCCTA CGCCGAAAAA GACCTCGCCG AAGTCAAAGC
 951 CTTCGCCCGC GAAAGCCTGA ACCTCGCCGA TTTGCAACCG TGGGACTTGG
1001 GCTACGCCAG CGAAAAACTG CGCGAAGCCA AATACGCGTT CAGCGAAACC
1051 GAAGTCAAAA AATACTTCCC CGTCGGCAAA GTATTAAACG GACTGTTCGC
1101 CCAAATCAAA AAACTCTACG GCATCGGATT TACCGAAAAA ACCGTCCCCG
1151 TCTGGCACAA AGACGTGCGC TATTTTGAAT TGCAACAAAA CGGCGAAACC
1201 ATAGGCGGCG TTTATATGGA TTTGTACGCA CGCGAAGGCA AACGCGGCGG
1251 CGCGTGGATG AACGACTACA AAGGCCGCCG CCGTTTTTCA GACGGCACGC
1301 TGCAACTGCC CACCGCCTAC CTCGTCTGCA ACTTCGCCCC ACCCGTCGGC
1351 GGCAGGGAAG CCCGCCTGAG CCACGACGAA ATCCTCATCC TCTTCCACGA
1401 AACCGGACAC GGGCTGCACC ACCTGCTTAC CCAAGTGGAC GAACTGGGCG
1451 TATCCGGCAT CAACGGCGTA GAATGGGACG CGGTCGAACT GCCCAGCCAG
1501 TTTATGGAAA ATTTCGTTTG GGAATACAAT GTCTTGGCAC AAATGTCAGC
1551 CCACGAAGAA ACCGGCGTTC CCCTGCCGAA AGAACTCTTC GACAAAATGC
1601 TCGCCGCCAA AAACTTCCAA CGCGGCATGT TCCTCGTCCG GCAAATGGAG
1651 TTCGCCCTCT TTGATATGAT GATTTACAGC GAAGACGACG AAGGCCGTCT
1701 GAAAAACTGG CAACAGGTTT TAGACAGCGT GCGCAAAAAA GTCGCCGTCA
1751 TCCAGCCGCC CGAATACAAC CGCTTCGCCT TGAGCTTCGG CCACATCTTC
1801 GCAGGCGGCT ATTCCGCAGG CTATTACAGC TACGCGTGGG CGGAAGTATT
1851 GAGCGCGGAC GCATACGCCG CCTTTGAAGA AAGCGACGAT GTCGCCGCCA
1901 CAGGCAAACG CTTTTGGCAG GAAATCCTCG CCGTCGGCGG ATCGCGCAGC
```

-continued

```
1951 GCGGCAGAAT CCTTCAAAGC CTTCCGCGGC CGCGAACCGA GCATAGACGC

2001 ACTCTTGCGC CACAGCGGTT TCGACAACGC GGTCTGA
```

This corresponds to the amino acid sequence <SEQ ID 490; ORF 128-1>:

```
m128-1.pep.

1 MTDNALLHLG EEPRFDQIKT EDIKPALQTA IAEAREQIAA IKAQTHTGWA

51 NTVEPLTGIT ERVGRIWGVV SHLNSVADTP ELRAVYNELM PEITVFFTEI

101 GQDIELYNRF KTIKNSPEFD TLSPAQKTKL NHDLRDFVLS GAELPPEQQA

151 ELAKLQTEGA QLSAKFSQNV LDATDAFGIY FDDAAPLAGI PEDALAMFAA

201 AAQSESKTGY KIGLQIPHYL AVIQYADNRE LREQIYRAYV TRASELSDDG

251 KFDNTANIDR TLANALQTAK LLGFKNYAEL SLATKMADTP EQVLNFLHDL

301 ARRAKPYAEK DLAEVKAFAR ESLNLADLQP WDLGYASEKL REAKYAFSET

351 EVKKYFPVGH VLNGLFAQIK KLYGIGFTEK TVPVWHKDVR YFELQQNGET

401 IGGVYMDLYA REGKRGGAWM NDYKGRRRFS DGTLQLPTAY LVCNFAPPVG

451 GREARLSHDE ILILFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKK VAVIQPPEYN RFALSFGHIF

601 AGGYSAGYYS YAWAEVLSAD AYAAFEESDD VAATGKRFWQ EILAVGGSRS

651 AAESFKAFRG REPSIDALLR HSGFDNAV* m128-1/g128-1 94.5% identity in 491 aa overlap 10         20         30         40         50         60
g128-1.pep  MIDNALLHLGEEPRFNQIKTEDIKPAVQTAIAEARGQIAAVKAQTHTGWANTVERLTGIT
            | ||||||||||||||:|||||||||||:|||||| |||||:|||||||||| ||||||
m128-1      MTDNALLHLGEEPRFDQIKTEDIKPALQTAIAEAREQIAAIKAQTHTGWANTVEPLTGIT
                    10         20         30         40         50         60

70         80         90        100        110        120
g128-1.pep  ERVGRIWGVVSHLNSVVDTPELRAVYNELMPEITVFFTEIGQDIELYNRFKTIKNSPEFA
            ||||||||||||||||:|||||||||||||||||||||||||||||||||||||||||:
m128-1      ERVGRIWGVVSHLNSVADTPELRAVYNELMPEITVFFTEIGQDIELYNRFKTIKNSPEFD
                    70         80         90        100        110        120

130        140        150        160        170        180
g128-1.pep  TLSPAQKTKLDHDLRDFVLSGAELPPERQAELAKLQTEGAQLSAKFSQNVLDATDAFGIY
            ||||||||||:|||||||||||||||:|||||||||||||||||||||||||||||||
m128-1      TLSPAQKTKLNHDLRDFVLSGAELPPEQQAELAKLQTEGAQLSAKFSQNVLDATDAFGIY
                   130        140        150        160        170        180

190        200        210        220        230        240
g128-1.pep  FDDAAPLAGIPEDALAMFAAAAQSEGKTGYKIGLQIPHYLAVIQYAGNRELREQIYRAYV
            |||||||||||||||||||||||||:||||||||||||||||||||| |||||||||||
m128-1      FDDAAPLAGIPEDALAMFAAAAQSESKTGYKIGLQIPHYLAVIQYADNRELREQIYRAYV
                   190        200        210        220        230        240

250        260        270        280        290        300
g128-1.pep  TRASELSNDGKFDNTANIDRTLENALKTAKLLGFKNYAELSLATKMADTPEQVLNFLHDL
            |||||||:|||||||||||||| |:|||||||||||||||||||||||||||||||||
m128-1      TRASELSDDGKFDNTANIDRTLANALQTAKLLGFKNYAELSLATKMADTPEQVLNFLHDL
                   250        260        270        280        290        300

310        320        330        340        350        360
g128-1.pep  ARRAKPYAEKDLAEVKAFAREHLGLADPQPWDLSYAGEKLREAKYAFSETEVKKYFPVGK
            |||||||||||||||||||||:|||    ||:|| |||||||||||||||||||||||
m128-1      ARRAKPYAEKDLAEVKAFARESLNLADLQPWDLGYASEKLREAKYAFSETEVKKYFPVGK
                   310        320        330        340        350        360

370        380        390        400        410        420
g128-1.pep  VLAGLFAQIKKLYGIGFAEKTVPVWHKDVRYFELQQNGKTIGGVYMDLYAREGKRGGAWM
            || |||||||||||||||:|||||||||||||||||||:|||||||||||||||||||
m128-1      VLNGLFAQIKKLYGIGFTEKTVPVWHKDVRYFELQQNGETIGGVYMDLYAREGKRGGAWM
                   370        380        390        400        410        420

430        440        450        460        470        480
g128-1.pep  NDYKGRRRFADGTLQLPTAYLVCNFAPPVGGKEARLSHDEILTLFHETGHGLHHLLTQVD
            ||||||||||:|||||||||||||||||||||:|||||||| ||||||||||||||||
m128-1      NDYKGRRRFSDGTLQLPTAYLVCNFAPPVGGREARLSHDEILILFHETGHGLHHLLTQVD
                   430        440        450        460        470        480
```

-continued

```
               490
g128-1.pep   ELGVSGINGVK
             ||||||||||:
m128-1       ELGVSGINGVEWDAVELPSQFMENFVWEYNVLAQMSAHEETGVPLPKELFDKMLAAKNFQ
                   490       500       510       520       530       540
```

The following partial DNA sequence was identified in *N. meningitidis* <SEQ ID 491>:

```
a128-1.seq
   1 ATGACTGACA ACGCACTGCT CCATTTGGGC GAAGAACCCC GTTTTGATCA
  51 AATCAAAACC GAAGACATCA AACCCGCCCT GCAAACCGCC ATTGCCGAAG
 101 CGCGCGAACA AATCGCCGCC ATCAAAGCCC AAACGCACAC CGGCTGGGCA
 151 AACACTGTCG AACCCCTGAC CGGCATCACC GAACGCGTCG GCAGGATTTG
 201 GGGCGTGGTG TCGCACCTCA ACTCCGTCAC CGACACGCCC GAACTGCGCG
 251 CCGCCTACAA TGAATTAATG CCCGAAATTA CCGTCTTCTT CACCGAAATC
 301 GGACAAGACA TCGAGCTGTA CAACCGCTTC AAAACCATCA AAAACTCCCC
 351 CGAGTTCGAC ACCCTCTCCC ACGCGCAAAA AACCAAACTC AACCACGATC
 401 TGCGCGATTT CGTCCTCAGC GGCGCGGAAC TGCCGCCCGA ACAGCAGGCA
 451 GAATTGGCAA AACTGCAAAC CGAAGGCGCG CAACTTTCCG CCAAATTCTC
 501 CCAAAACGTC CTAGACGCGA CCGACGCGTT CGGCATTTAC TTTGACGATG
 551 CCGCACCGCT TGCCGGCATT CCCGAAGACG CGCTCGCCAT GTTTGCCGCT
 601 GCCGCGCAAA GCGAAGGCAA AACAGGCTAC AAAATCGGTT TGCAGATTCC
 651 GCACTACCTC GCCGTCATCC AATACGCCGA CAACCGCAAA CTGCGCGAAC
 701 AAATCTACCG CGCCTACGTT ACCCGCGCCA GCGAGCTTTC AGACGACGGC
 751 AAATTCGACA ACACCGCCAA CATCGACCGC ACGCTCGAAA ACGCCCTGCA
 801 AACCGCCAAA CTGCTCGGCT TCAAAAACTA CGCCGAATTG TCGCTGGCAA
 851 CCAAAATGGC GGACACCCCC GAACAAGTTT TAAACTTCCT GCACGACCTC
 901 GCCCGCCGCG CCAAACCCTA CGCCGAAAAA GACCTCGCCG AAGTCAAAGC
 951 CTTCGCCCGC GAAAGCCTCG GCCTCGCCGA TTTGCAACCG TGGGACTTGG
1001 GCTACGCCGG CGAAAAACTG CGCGAAGCCA AATACGCATT CAGCGAAACC
1051 GAAGTCAAAA AATACTTCCC CGTCGGCAAA GTATTAAACG GACTGTTCGC
1101 CCAAATCAAA AAACTCTACG GCATCGGATT TACCGAAAAA ACCGTCCCCG
1151 TCTGGCACAA AGACGTGCGC TATTTTGAAT TGCAACAAAA CGGCGAAACC
1201 ATAGGCGGCG TTTATATGGA TTTGTACGCA CGCGAAGGCA AACGCGGCGG
1251 CGCGTGGATG AACGACTACA AAGGCCGCCG CCGTTTTTCA GACGGCACGC
1301 TGCAACTGCC CACCGCCTAC CTCGTCTGCA ACTTCACCCC GCCCGTCGGC
1351 GGCAAAGAAG CCCGCTTGAG CCATGACGAA ATCCTCACCC TCTTCCACGA
1401 AACCGGACAC GGCCTGCACC ACCTGCTTAC CCAAGTCGAC GAACTGGGCG
1451 TATCCGGCAT CAACGGCGTA GAATGGGACG CAGTCGAACT GCCCAGTCAG
1501 TTTATGGAAA ATTTCGTTTG GGAATACAAT GTCTTGGCGC AAATGTCCGC
1551 CCACGAAGAA ACCGGCGTTC CCCTGCCGAA AGAACTCTTC GACAAAATGC
1601 TCGCCGCCAA AAACTTCCAA CGCGGAATGT TCCTCGTCCG CCAAATGGAG
1651 TTCGCCCTCT TTGATATGAT GATTTACAGC GAAGACGACG AAGGCCGTCT
```

```
1701 GAAAAACTGG CAACAGGTTT TAGACAGCGT GCGCAAAGAA GTCGCCGTCG

1751 TCCGACCGCC CGAATACAAC CGCTTCGCCA ACAGCTTCGG CCACATCTTC

1801 GCAGGCGGCT ATTCCGCAGG CTATTACAGC TACGCGTGGG CGGAAGTATT

1851 GAGCGCGGAC GCATACGCCG CCTTTGAAGA AAGCGACGAT GTCGCCGCCA

1901 CAGGCAAACG CTTTTGGCAG GAAATCCTCG CCGTCGGCGG ATCGCGCAGC

1951 GCGGCAGAAT CCTTCAAAGC CTTCCGCGGA CGCGAACCGA GCATAGACGC

2001 ACTCTTGCGC CACAGCGGCT TCGACAACGC GGCTTGA
```

This corresponds to the amino acid sequence <SEQ ID 492; ORF 128-1.a>:

```
a128-1.pep.

1 MTDNALLHLG EEPRFDQIKT EDIKPALQTA IAEAREQIAA IKAQTHTGWA

51 NTVEPLTGIT ERVGRIWGVV SHLNSVTDTP ELRAAYNELM PEITVFFTEI

101 GQDIELYNRF KTIKNSPEFD TLSHAQKTKL NHDLRDFVLS GAELPPEQQA

151 ELAKLQTEGA QLSAKFSQNV LDATDAFGIY FDDAAPLAGI PEDALAMFAA

201 AAQSESGTGY KIGLQIPHYL AVIQYADNRK LREQIYRAYV TRASELSDDG

251 KFDNTANIDR TLENALQTAK LLGFKNYAEL SLATKMADTP EQVLNFLHDL

301 ARRAKPYAEK DLAEVKAFAR ESLGLADLQP WDLGYAGEKL REAKYAFSET

351 EVKKYFPVGK VLNGLFAQIK KLYGIGFTEK TVPVWHKDVR YFELQQNGET

401 IGGVYMDLYA REGKRGGAWM NDYKGRRRFS DGTLQLPTAY LVCNFTPPVG

451 GKEARLSHDE ILTLFHETGH GLHHLLTQVD ELGVSGINGV EWDAVELPSQ

501 FMENFVWEYN VLAQMSAHEE TGVPLPKELF DKMLAAKNFQ RGMFLVRQME

551 FALFDMMIYS EDDEGRLKNW QQVLDSVRKE VAVVRPPEYN RFANSFGHIF

601 AGGYSAGYYS YAWAEVLSAD AYAAFEESDD VAATGKRFWQ EILAVGGSRS

651 AAESFKAFRG REPSIDALLR HSGFDNAA* m128-1/a128-1 97.8% identity in 677 aa overlap 10         20         30         40         50         60
a128-1.pep. MTDNALLHLGEEPRFDQIKTEDIKPALQTAIAEAREQIAAIKAQTHTGWANTVEPLTGIT
            ||||||||||||||||||||||||||||||||||||||||||||||||||||||||||||
m128-1      MTDNALLHLGEEPRFDQIKTEDIKPALQTAIAEAREQIAAIKAQTHTGWANTVEPLTGIT
                 10         20         30         40         50         60

70         80         90        100        110        120
a128-1.pep. ERVGRIWGVVSHLNSVTDTPELRAAYNELMPEITVFFTEIGQDIELYNRFKTIKNSPEFD
            |||||||||||||||:|||||||:||||||||||||||||||||||||||||||||||||
m128-1      ERVGRIWGVVSHLNSVADTPELRAVYNELMPEITVFFTEIGQDIELYNRFKTIKNSPEFD
                 70         80         90        100        110        120

130        140        150        160        170        180
a128-1.pep. TLSHAQKTKLNHDLRDFVLSGAELPPEQQAELAKLQTEGAQLSAKFSQNVLDATDAFGIY
            |||:||||||||||||||||||||||||||||||||||||||||||||||||||||||||
m128-1      TLSPAQKTKLNHDLRDFVLSGAELPPEQQAELAKLQTEGAQLSAKFSQNVLDATDAFGIY
                130        140        150        160        170        180

190        200        210        220        230        240
a128-1.pep. FDDAAPLAGIPEDALAMFAAAAQSEGKTGYKIGLQIPHYLAVIQYADNRKLREQIYRAYV
            ||||||||||||||||||||||||||:|||||||||||||||||||||:|||||||||||
m128-1      FDDAAPLAGIPEDALAMFAAAAQSESKTGYKIGLQIPHYLAVIQYADNRELREQIYRAYV
                190        200        210        220        230        240

250        260        270        280        290        300
a128-1.pep. TRASELSDDGKFDNTANIDRTLENALQTAKLLGFKNYAELSLATKMADTPEQVLNFLHDL
            |||||||||||||||||||||||:||||||||||||||||||||||||||||||||||||
m128-1      TRASELSDDGKFDNTANIDRTLANALQTAKLLGFKNYAELSLATKMADTPEQVLNFLHDL
                250        260        270        280        290        300

310        320        330        340        350        360
a128-1.pep. ARRAKPYAEKDLAEVKAFARESLGLADLQPWDLGYAGEKLREAKYAFSETEVKKYFPVGK
            |||||||||||||||||||||:|||||||||||||||:||||||||||||||||||||||
m128-1      ARRAKPYAEKDLAEVKAFARESLNLADLQPWDLGYASEKLREAKYAFSETEVKKYFPVGK
                310        320        330        340        350        360
```

```
                  370       380       390       400       410       420
a128-1.pep.   VLNGLFAQIKKLYGIGFTEKTVPVWHKDVRYFELQQNGETIGGVYMDLYAREGKRGGAWM
              ||||||||||||||||||||||||||||||||||||||||||||||||||||||||||||
m128-1        VLNGLFAQIKKLYGIGFTEKTVPVWHKDVRYFELQQNGETIGGVYMDLYAREGKRGGAWM
                  370       380       390       400       410       420

430       440       450       460       470       480
a128-1.pep.   NDYKGRRRFSDGTLQLPTAYLVCNFTPPVGGKEARLSHDEILTLFHETGHGLHHLLTQVD
              ||||||||||||||||||||||||||||||:||||:||||||||||||||||||||||||
m128-1        NDYKGRRRFSDGTLQLPTAYLVCNFAPPVGGREARLSHDEILILFHETGHGLHHLLTQVD
                  430       440       450       460       470       480

490       500       510       520       530       540
a128-1.pep    ELGVSGINGVEWDAVELPSQFMENFVWEYNVLAQMSAHEETGVPLPKELFDKMLAAKNFQ
              ||||||||||||||||||||||||||||||||||||||||||||||||||||||||||||
m128-1        ELGVSGINGVEWDAVELPSQFMENFVWEYNVLAQMSAHEETGVPLPKELFDKMLAAKNFQ
                  490       500       510       520       530       540

550       560       570       580       590       600
a128-1.pep    RGMFLVRQMEFALFDMMIYSEDDEGRLKNWQQVLDSVRKEVAVVRPPEYNRFANSFGHIF
              ||||||||||||||||||||||||||||||||||||||||:|||::|||||||:|||||
m128-1        RGMFLVRQMEFALFDMMIYSEDDEGRLKNWQQVLDSVRKKVAVIQPPEYNRFALSFGHIF
                  550       560       570       580       590       600

610       620       630       640       650       660
a128-1.pep    AGGYSAGYYSYAWAEVLSADAYAAFEESDDVAATGKRFWQEILAVGGSRSAAESFKAFRG
              ||||||||||||||||||||||||||||||||||||||||||||||||||||||||||||
m128-1        AGGYSAGYYSYAWAEVLSADAYAAFEESDDVAATGKRFWQEILAVGGSRSAAESFKAFRG
                  610       620       630       640       650       660

670       679
a128-1.pep    REPSIDALLRHSGFDNAAX
              ||||||||||||||||||:
m128-1        REPSIDALLRHSGFDNAVX
                  670 a128-1 (SEQ ID 492)/P44573 (SEQ ID 4163)

sp|P44573|OPDA_HAELIN OLIGOPEPTIDASE A >gi|1075082|pir||C64055 oligopeptidase A (prlC)
homolog - Haemophilus influenzae (strain Rd KW20)
>gi|1573174 (U32706) oligopeptidase A (prlC) [Haemophilus influenzae Rd] Length = 681
Score = 591 bits (1507), Expect = e-168
Identities = 309/677 (45%), Positives = 415/677 (60%), Gaps = 4/677 (0%)

Query:   4  NALLHLGEEPRFDQIKTEDIKPALQTXXXXXXXXXXXXXXXXTHTGWANTVEPLTGITERV   63
            N LL+    P F QIK E I+PA++                  H  W N + PLT +R+
Sbjct:   5  NPLLNIQGLPPFSQIKPEHIRPAVEKLIQDCRNTIEQVLKQPHFTWENFILPLTETNDRL   64

Query:  64  GRIWGVVSHLNSVTDTPELRAAYNELMPEITVFFTEIGQDIELYNRFKTIKNSPEFDTLS  123
              R W  VSHLNSV ++ ELR AY  +P ++ +  T +GQ    LYN +  +KNS EF   S
Sbjct:  65  NRAWSPVSHLNSVKNSTELREAYQTCLPLLSEYSTWVGQHKGLYNAYLALKNSAEFADYS  124

Query: 124  HAQKTKLNHDLRDFVLSGAELPPEQQAELAKLQTEGAQLSAKFSQNVLDATDAFGIYFDD  183
               AQK + + LRDF LSG  L  E+Q    ++    ++L+++FS NVLDAT  +   ++
Sbjct: 125  IAQKKAIENSLRDFELSGIGLSEEKQQRYGEIVARLSELNSQFSNNVLDATMGWEKLIEN  184

Query: 184  AAPLAGIPEDALAMFAAAAQSEGKTGYKIGLQIPHYLAVIQYADNRKLREQIYRAYVTRA  243
              A  LAG+PE AL      +A+S+G  GY+     L+IP YL V+ y  +NR LRE++YRAY TRA
Sbjct: 185  EAELAGLPESALQAAQQSAESKGLKGYRFTLEIPSYLPVMTYCENRALREEMYRAYATRA  244

Query: 244  SELSDD-GKFDNTANIDRTLENALQTAKLLGFKNYAELSLATKMADTPEQVLNFLHDLAR  302
              SE   + GK+DN+ ++   L   ++ AKLLGF Y ELSLATKMA+ P+QVL FL  LA
Sbjct: 245  SEQGPNAGKWDNSKVMEEILTLRVELAKLLGFNTYTELSLATKMAENPQQVLDFLDHLAE  304

Query: 303  RAKPYAEKDLAEVKAFARESLGLADLQPWDLGYAGEKLREAKYAFSETEVKKYFPVGKVL  362
              RAKP  EK+L E+K +   +  G+ +L PWD+G+  EK ++    YA ++  E++  YFP +V+
Sbjct: 305  RAKPQGEKELQELKGYCEKEFGVTELAPWDIGFYSEKQQHLYAINDEELRPYFPPENRVI  364

Query: 363  NGLFAQIKKLYGIGFTE-KTVPVWHKDVRYFEL-QQNGETIGGVYMDLYAREGKRGGAWM  420
             +GLF  IK+++  i       E  K V  WHKDVR+F L  +N +   G Y+DLYARE KRGGAWM
Sbjct: 365  SGLFELIKRIFNIRAVERKGVDTWHKDVRFFDLIDENDQLRGSFYLDLYAREHKRGGAWM  424

Query: 421  NDYKGRRRFSDGTLQLPTAYLVCNFTPPVGGKEARLSHDEIXXXXXXXXXXXXXXXXQVD  480
             +D  GR+R  DG+++ P AYL CNF P+G K A  +H+E+                Q+D
Sbjct: 425  DDCIGRKRKLDGSIETPVAYLTCNFNAPIGNKPALFTHNEVTTLFHEFGHGIHHMLTQID  484

Query: 481  ELGVSGINGVEWDAVELPSQFMENFVWEYNVLAQMSAHEETGVPLPKELFDKMLAAKNFQ  540
               V+GINGV WDAVELPSQFMEN+ WE    LA  +S H  ETG PLPKE   ++L AKNFQ
Sbjct: 485  VSDVAGINGVPWDAVELPSQFMENWCWEEEALAFISGHYETGEPLPKEKLTQLLKAKNFQ  544

Query: 541  RGMFLVRQMEFALFDMMIYSEDDEGRLKNWQQVLDSVRKEVAVVRPPEYNRFANSFGHIF  600
               MF++RQ+EF +FD ++    D       + L SV+ +VAV++  ++  R  +SF HIF
Sbjct: 545  AAMFILRQLEFGIFDFRLHHTEDAEKTNQILDTLKSVKSQVAVIKGVDWARAPHSFSHIF  604

Query: 601  XXXXXXXXXXXXWAEVLSADAYAAFEESDDV-AATGKRFWQEILAVGGSRSAAESFKAFR  659
                          WAEVLSADAY+ FEE     TGK F EIL GGS   E FK FR
Sbjct: 605  AGGYYAGYYSYLWAEVLSADAYSRFEEEGIFNPITGKSFLDEILTRGGSEEPMELFKRFR  664

Query: 660  GREPSIDALLRHSGFDN  676
            GREP +DALLRH G N
Sbjct: 665  GREPQLDALLRHKGIMN  681
```

The following partial DNA sequence was identified in *N. gonorrhoeae* <SEQ ID 493>:

```
g129.seq
    1 ATGCTTTCAC CTCCTCGGCG TAAAACGGCG GCACATCAAT CAAGCCGTCT

51 TTCATTTGCG TGCGGAAAAA ATGCGGCGTG TTGCCGTGAT CAAAATCAAT

101 ATCGTGCAGC ATCCAGCCCA AATCGCGGTT TGCCTCGCTT TCCGATAACG

151 CCGACGGCGG CAGCGGTTCA CCCTTATCCG CGCTTTCGCC ATTTGCCCTT

201 TCAGGCTGCG GGCATAGGGG CGGAACAGGC GGCGGTCGAA TCCTGTTTCA

251 TCCGGACAAA CGCGTTGGCA GTCGGAAAAT CCGGCCGGCC GTGTCAAATA

301 ATGCGTTACT TTGGCCGGGT CTTGTCCTTT GTAAGCGGCG GTCTTTTTTT

351 GCGCGCCATC CGCATCTGTT TGGGCGCATG GCAAACGGCG GCTGCCGTAC

401 AATCAAAATG TTTGGCGATT TCATGCAGAC AGGCATCCGG ATGCCGCCCG

451 ACATATCGAG CCGGTTTTTG CCTATCCGAT TTGGCGGCAT TTAGGCCGGT

501 AACTTGA
```

This corresponds to the amino acid sequence <SEQ ID 494; ORF 129.ng>:

```
g129.pep
    1 MLSPPRRKTA AHQSSRLSFA CGKNAACCRD QNQYRAASSP NRGLPRFPIT

51 PTAAAVHPYP RFRHLPFQAA GIGAEQAAVE SCFIRTNALA VGKSGRPCQI

101 MRYFGRVLSF VSGGLFLRAI RICLGAWQTA AAVQSKCLAI SCRQASGCRP

151 TYRAGFCLSD LAAFRPVT*
```

The following partial DNA sequence was identified in *N. meningitidis* <SEQ ID 495>:

```
m129.seq (partial)
    1 ..TATCTGCGCT TCACTATTT GCCCTTTCAG GCTGCGGGCA TAGGGACGGA

51   ACAGGTAGCG GTCAAATCCT GTTTCATCCA AATAAACACG TTGGTAGTCG

101   GAAAATTCGG CCGGCTGTGT CAAATAATGC GTTACTTTGG CCGGGTCTTG

151   TTCTTTGTAA GTGGTGGTCT TTTTTTGCGC GTTATCCCCA TCTGTTTGAG

201   TGCATAGCAA ATGGTGGCTG CCGTACAATC AAAATGTTTG GCGATTTCAT

251   GCAGATAGGC ATCCGGGTGT TGCCCAACAT ATTGAGCCGG TTTTTGCCTA

301   TCCGATTTGA CGGCATTTAG ACCGGTAACT TGA
```

This corresponds to the amino acid sequence <SEQ ID 496; ORF 129>:

```
m129.pep (partial)
    1 ..YLRFHYLPFQ AAGIGTEQVA VKSCFIQINT LVVGKFGRLC QIMRYFGRVL

51   FFVSGGLFLR VIPICLSAXQ MVAAVQSKCL AISCRXASGC CPTYXAGFCL

101   SDLTAFRPVT *
```

Computer analysis of this amino acid sequence gave the following results:

Homology with a Predicted ORF from *N. gonorrhoeae*

ORF 129 shows 79.1% identity over a 110 aa overlap with a predicted ORF (ORF 129.ng) from *N. gonorrhoeae*:

```
m129/g129

10         20         30
    m129.pep                       YLRFHYLPFQAAGIGTEQVAVKSCFIQINT
                                   | ||::||||||||:||:||||: |:
    g129       RDQNQYRAASSPNRGLPRFPITPTAAAVHPYPRFRHLPFQAAGIGAEQAAVESCFIRTNA
               30        40        50        60        70        80

40         50         60         70         80         90
    m129.pep   LVVGKFGRLCQIMRYFGRVLFFVSGGLFLRVIPICLSAXQMVAAVQSKCLAISCRXASGC
               |:|||  || ||||||||||| ||||||||:| |||:|  :||||||||||||| ||||
    g129       LAVGKSGRPCQIMRYFGRVLSFVSGGLFLRAIRICLGAWQTAAAVQSKCLAISCRQASGC
               90        100       110       120       130       140

100        110
    m129.pep   CPTYXAGFCLSDLTAFRPVTX
               |||  ||||||||:|||||||
    g129       RPTYRAGFCLSDLAAFRPVTX
               150       160
```

The following partial DNA sequence was identified in *N. meningitidis* <SEQ ID 497>:

```
a129.seq (partial)
   1 TATCTGCGCT TTCACTATTT GCCCTTTCAG GCTGCGGGCA TAGGGACGGA

51 ACAGGTAGCG GTCAAATCCT GTTTCATCCA AATAAACACG TTGGTAGTCG

101 GAAAATTCGG CCAGCTGTGT CAAATAATGC GTTACTTTGG CCGGGTCTTG

151 TTCTTTGTAA GTGGTGGTCT TTTTTTGCGC GTTATCCCCA TCTGTTTGAG

201 TGCATAGCAA ATGGTGGCTG CCGTACAATC AAAATGTTTG GCGATTTCAT

251 GCAGATAGGC ATCCTGGTGT TGCCCAACAT ATTGAGCCGG TTTTTGCCTA

301 TCCGATTTGA CGGCATTTAG ACCGGTAACT TGA
                                           40
```

This corresponds to the amino acid sequence <SEQ ID 498; ORF 129.a>:

```
a129.pep (partial)
   1 YLRFHYLPFQ AAGIGTEQVA VKSCFIQINT LVVGKFGQLC QIMRYFGRVL

51 FFVSGGLFLR VIPICLSA*Q MVAAVQSKCL AISCR*ASWC CPTY*AGFCL

101 SDLTAFRPVT *
``` m129/a129 98.2% identity in 110 aa overlap

```
                          10         20         30         40         50         60
    m129-1.pep   YLRFHYLPFQAAGIGTEQVAVKSCFIQINTLVVGKFGRLCQIMRYFGRVLFFVSGGLFLR
                 ||||||||||||||||||||||||||||||:|||||||||||||||||||||||||||||
    a129         YLRFHYLPFQAAGIGTEQVAVKSCFIQINTLVVGKFGQLCQIMRYFGRVLFFVSGGLFLR
                          10         20         30         40         50         60

70         80         90        100        110
    m129-1.pep   VIPICLSAXQMVAAVQSKCLAISCRXASGCCPTYXAGFCLSDLTAFRPVTX
                 |||||||||||||||||||||||||||||| |||| ||||||||||||||||
    a129         VIPICLSAXQMVAAVQSKCLAISCRXASWCCPTYXCFCLSDLTAFRPVTX
                          70         80         90        100        110
```

The following partial DNA sequence was identified in *N. gonorrhoeae* <SEQ ID 499>:

```
g130.seq
    1 ATGAAACAAC TCCGCGACAA CAAAGCCCAA GGCTCTGCAC TGTTTACCCT
   51 TGTGAGCGGT ATCGTTATTG TTATTGCAGT CCTTTATTTC CTGATTAAGC
  101 TGGCGGGCAG TGGATCGTTC GGCGATGTCG ATGCCACTAC GGAAGCGGCA
  151 ACGCAGACCC GCATCCAGCC TGTCGGACAA TTGACGATGG GTGACGGCAT
  201 CCCCGTCGGC GAACGCCAAG GCGAACAGAT TTTCGGCAAA ATCTGTATCC
  251 AATGCCACGC GGCGGACAGC AATGTGCCGA ACGCTCCGAA ACTGGAACAC
  301 AACGGCGACT GGGCGCCGCG TATCGCGCAA GGCTTCGATA CCTTGTTCCA
  351 ACACGCGCTG AACGGCTTTA ACGCCATGCC TGCCAAAGGC GGTGCGGCAG
  401 ACCTGACCGA TCAGGAACTC AAACGGGCGA TTACCTACAT GGCGAATAAA
  451 AGCGGCGGTT CTTTCCCGAA TCCTGATGAG GCTGCGCCTG CCGACAATGC
  501 CGCTTCAGGA ACAGCTTCTG CTCCTGCCGA TAGTGCAGCT CCGGCAGAAG
  551 CGAAGGCAGA AGACAAGGGT GCGGCAGCCC CTGCGGTCGG CGTTGACGGT
  601 AAAAAAGTCT TCGAAGCAAC CTGTCAGGTG TGCCACGGCG GTTCGATTCC
  651 CGGTATTCCC GGCATAGGCA AAAAGACGA TTGGGCACCG CGTATCAAAA
  701 AAGGCAAAGA AACCTTGCAC AAACATGCCC TTGAAGGCTT TAACGCGATG
  751 CCGGCCAAAG GCGGCAATGC AGGTTTGAGC GATGACGAAG TCAAAGCGGC
  801 TGTTGACTAT ATGGCAAACC AATCCGGTGC AAAATTCTAA
```

This corresponds to the amino acid sequence <SEQ ID 500; ORF 130.ng>:

```
g130.pep
    1 MKQLRDNKAQ GSALFTLVSG IVIVIAVLYF LIKLAGSGSF GDVDATTEAA
   51 TQTRIQPVGQ LTMGDGIPVG ERQGEQIFGK ICIQCHAADS NVPNAPKLEH
  101 NGDWAPRIAQ GFDTLFQHAL NGFNAMPAKG GAADLTDQEL KRAITYMANK
  151 SGGSFPNPDE AAPADNAASG TASAPADSAA PAEAKAEDKG AAAPAVGVDG
  201 KKVFEATCQV CHGGSIPGIP GIGKKDDWAP RIKKGKETLH KHALEGFNAM
  251 PAKGGNAGLS DDEVKAAVDY MANQSGAKF*
```

The following partial DNA sequence was identified in *N. meningitidis* <SEQ ID 501>:

```
m130.seq (partial)
    1 ..GGCGAACAGA TTTTCGGCAA AATCTGTATC CAATGCCACG CGGCGGACAG
   51    CAATGTGCCG AACGCTCCGA AACTGGAACA CAACGGCGAT TrGGCACCGC
  101    GTATCGgCAA GGCTTCGATA CCTTGTTCCA ACACGCGCTG AACGGCTTTA
  151    ACGCCATGCC TGCAAAAGGC GGTGCGGCAG ACCTGACCGA TCAGGAACTT
  201    AAACGGGCGA TTACTTACAT GGCGAACAAA AGCGGCGGTT CTTTCCCGAA
  251    TCCTGATGAG GCTGCGCCTG CCGACAATGC CGCTTCAGGA ACAGCTTCTG
  301    CTCCTGCCGA TAGTGCAGCT CCGGCAGAAG CGAAGGCAGA AGACAAGGGT
  351    GCGGCAcCCC TGCGGTCGGC GTTGACGGTA AAAAGTCTT CGAAGCAACC
  401    TGTCAGGTGT GCCACGGCGG TTCGATTCCC GGTATTCCCG GCATAGGCAA
```

```
451  AAAAGACGAT TGGGCACCGC GTATCAAAAA AGGCAAAGAA ACCTTGCACA

501  AACACGCCCT TGAAGGCTTT AACGCGATGC CTGCCAAArG CGgCAATGCA

551  GGTTTGAGCG ATGACGAAgT CAAAGCGGCT GTTGACTATA TGGCAAACCA

601  ATCCGGTGCA AAATTCTAA
```

This corresponds to the amino acid sequence <SEQ ID 502; ORF 130>:

```
m130.pep (partial)
  1  ..GEQIFGKICI QCHAADSNVP NAPKLEHNGD XAPRIQGFDT LFQHALNGFN

51  AMPAKGGAAD LTDQELKRAI TYMANKSGGS FPNPDEAAPA DNAASGTASA

101  PADSAAPAEA KAEDKGAAPA VGVDGKKVFE ATCQVCHGGS IPGIPGIGKK

151  DDWAPRIKKG KETLHKHALE GFNAMPAKXG NAGLSDDEVK AAVDYMANQS

201  GAKF*
```

Computer analysis of this amino acid sequence gave the following results:
Homology with a Predicted ORF from *N. gonorrhoeae*
ORF 130 shows 98.1% identity over a 206 aa overlap with a predicted ORF (ORF 130.ng) from *N. gonorrhoeae*:

```
m130/g130

10         20         30
m130.pep                        GEQIFGKICIQCHAADSNVPNAPKLEHNGD
                                ||||||||||||||||||||||||||||||
g130     DATTEAATQTRIQPVGQLTMGDGIPVGERQGEQIFGKICIQCHAADSNVPNAPKLEHNGD
             50        60        70        80        90       100

40        50        60        70        80        89
m130.pep XAPRI-QGFDTLFQHALNGFNAMPAKGGAADLTDQELKRAITYMANKSGGSFPNPDEAAP
         ||||  ||||||||||||||||||||||||||||||||||||||||||||||||||||||
g130     WAPRIAQGFDTLFQHALNGFNAMPAKGGAADLTDQELKRAITYMANKSGGSFPNPDEAAP
             110       120       130       140       150       160

90       100       110       120       130       140
m130.pep ADNAASGTASAPADSAAPAEAKAEDKGAA-PAVGVDGKKVFEATCQVCHGGSIPGIPGIG
         ||||||||||||||||||||||||||||| ||||||||||||||||||||||||||||||
g130     ADNAASGTASAPADSAAPAEAKAEDKGAAAPAVGVDGKKVFEATCQVCHGGSIPGIPGIG
             170       180       190       200       210       220

150       160       170       180       190       200
m130.pep KKDDWAPRIKKGKETLHKHALEGFNAMPAKXGNAGLSDDEVKAAVDYMANQSGAKFX
         |||||||||||||||||||||||||||||| |||||||||||||||||||||||||
g130     KKDDWAPRIKKGKETLHKHALEGFNAMPAKGGNAGLSDDEVKAAVDYMANQSGAKFX
             230       240       250       260       270       280
```

The following partial DNA sequence was identified in *N. meningitidis* <SEQ ID 503>:

```
a130.seq
  1  ATGAAACAAC TCCGCGACAA CAAAGCCCAA GGCTCTGCAC TGTTTACCCT

51  TGTGAGCGGT ATCGTTATTG TTATTGCAGT CCTTTATTTC CTGATTAAGC

101  TGGCGGGCAG CGGCTCGTTC GGCGATGTCG ATGCCACTAC GGAAGCAGCA

151  ACGCAGACCC GTATCCAGCC TGTCGGACAA TTGACGATGG GCGACGGCAT

201  CCCCGTCGGC GAACGCCAAG GCGAACAGAT TTTCGGCAAA ATCTGTATCC

251  AATGCCACGC GGCGGACAGC AATGTGCCGA ACGCTCCGAA ACTGGAACAC

301  AACGGCGATT GGGCGCCGCG TATCGCGCAA GGCTTCGATA CCTTGTTCCA

351  ACACGCGCTG AACGGCTTTA ACGCCATGCC TGCCAAAGGC GGTGCGGTAG
```

```
-continued
401 ACCTGACCGA TCAGGAACTC AAACGGGCGA TTACTTACAT GGCGAACAAA

451 AGCGGCGGTT CTTTCCCGAA TCCTGATGAG GCTGCGCCTG CCGACAATGC

501 CGCTTCAGGA ACAGCTTCTG CTCCTGCCGA TAGTGCAGCT CCGGCAGAAG

551 CGAAGGCAGA AGACAAGGGT GCGGCAGCCC CTGCGGTCGG CGTTGACGGT

601 AAAAAAGTCT TCGAAGCAAC CTGTCAGGTG TGCCACGGCG GTTCGATTCC

651 CGGTATTCCC GGCATAGGCA AAAAGACGA TTGGGCACCG CGTATCAAAA

701 AAGGCAAAGA AACCTTGCAC AAACACGCCC TTGAAGGCTT TAACGCGATG

751 CCTGCCAAAG GCGGCAATGC AGGTTTGAGC GATGACGAAG TCAAAGCGGC

801 TGTTGACTAT ATGGCAAACC AATCCGGTGC AAAATTCTAA
```

This corresponds to the amino acid sequence <SEQ ID 504; ORF 130.a>:

```
a130.pep
  1 MKQLRDNKAQ GSALFTLVSG IVIVIAVLYF LIKLAGSGSF GDVDATTEAA

51 TQTRIQPVGQ LTMGDGIPVG ERQGEQIFGK ICIQCHAADS NVPNAPKLEH

101 NGDWAPRIAQ GFDTLFQHAL NGFNAMPAKG GAVDLTDQEL KRAITYMANK

151 SGGSFPNPDE AAPADNAASG TASAPADSAA PAEAKAEDKG AAAPAVGVDG

201 KKVFEATCQV CHGGSIPGIP GIGKKDDWAP RIKKGKETLH KHALEGFNAM

251 PAKGGNAGLS DDEVKAAVDY MANQSGAKF*
``` m130/a130 97.6% identity in 206 aa overlap

```
                                  10         20         30
m130.pep                          GEQIFGKICIQCHAADSNVPNAPKLEHNGD
                                  ||||||||||||||||||||||||||||||
a130     DATTEAATQTRIQPVGQLTMGDGIPVGERQGEQIFGKICIQCHAADSNVPNAPKLEHNGD
         50        60        70        80        90        100
                 40        50        60        70        80        89
m130.pep XAPRI-QGFDTLFQHALNGFNAMPAKGGAADLTDQELKRAITYMANKSGGSFPNPDEAAP
         ||||  ||||||||||||||||||||||||:|||||||||||||||||||||||||||||
a130     WAPRIAQGFDTLFQHALNGFNAMPAKGGAVDLTDQELKRAITYMANKSGGSFPNPDEAAP
         110       120       130       140       150       160
         90        100       110       120       130       140
m130.pep ADNAASGTASAPADSAAPAEAKAEDKGAA-PAVGVDGKKVFEATCQVCHGGSIPGIPGIG
         ||||||||||||||||||||||||||||| ||||||||||||||||||||||||||||||
a130     ADNAASGTASAPADSAAPAEAKAEDKGAAAPAVGVDGKKVFEATCQVCHGGSIPGIPGIG
         170       180       190       200       210       220
         150       160       170       180       190       200
m130.pep KKDDWAPRIKKGKETLHKHALEGFNAMPAKXGNAGLSDDEVKAAVDYMANQSGAKFX
         |||||||||||||||||||||||||||||| |||||||||||||||||||||||||
a130     KKDDWAPRIKKGKETLHKHALEGFNAMPAKGGNAGLSDDEVKAAVDYMANQSGAKFX
         230       240       250       260       270       280
```

The following partial DNA sequence was identified in *N. gonorrhoeae* <SEQ ID 505>:

```
g132.seq
  1 ATGGAAGCCT TCAAAACCCT AATTTGGATT ATTAATATTA TTTCCGCTTT

51 GGCCGTCATC GTGTTAGTAT TGCTCCAACA CGGCAAAGGC GCGGATGCCG

101 GCGCGACCTT CGGATCGGGA AGCGGCAGCG CGCAAGGCGT ATTCGGCTCT

151 GCCGGCAACG CCAACTTcct CAgccGCTCG AccGccGTTG CAGCAACAtt
```

```
201 tttcttTGca acctgcAtgg gctatggTgt atattcacac CCACACGACA

251 AAACACGGTT TGGACTtcag caacataCGA CAGACTCAGC AagcACCCAA

301 ACCcgtAAGC AATACCGAAC CTTCTGCCCC TGTTCCTCAG CAGCAGAAAT

351 AACagtTTTT CAAATgccga caTGgtga
```

This corresponds to the amino acid sequence <SEQ ID 506; ORF 132.ng>:

```
g132.pep
  1 MEAFKTLIWI INIISALAVI VLVLLQHGKG ADAGATFGSG SGSAQGVFGS

51 AGNANFLSRS TAVAATFFFA TCMGYGVYSH PHDKTRFGLQ QHTTDSASTQ

101 TRKQYRTFCP CSSAAEITVF QMPTW*
```

The following partial DNA sequence was identified in N. meningitidis <SEQ ID 507>:

```
m132.seq (partial)
   1 ATGGAACCCT TCAAAACCTT AATTTGGATT GTTAATTTAA TTTCCGCTTT

51 GGCCGTCTTC GTGTTAGTAT TGCTCCAACA CGGCAAAGGC GCGGATGCCG

101 GCGCGACTTT CGGA...
```

This corresponds to the amino acid sequence <SEQ ID 508; ORF 132>:

```
m132.pep (partial)
1 MEPFKTLIWI VNLISALAVF VLVLLQHGKG ADAGATFG...
```

Computer analysis of this amino acid sequence gave the following results:

Homology with a Predicted ORF from N. gonorrhoeae

ORF 132 shows 89.5% identity over a 38 aa overlap with a predicted ORF (ORF 132.ng) from N. gonorrhoeae:

```
    m132/g132

10        20        30
     m132.pep  MEPFKTLIWIVNLISALAVFVLVLLQHGKGADAGATFG
               || ||||||||:|:||||||:|||||||||||||||||
     g132      MEAFKTLIWIINIISALAVIVLVLLQHGKGADAGATFGSGSGSAQGVFGSAGNANFLSRS
                     10        20        30        40        50        60
```

The following partial DNA sequence was identified in N. meningitidis <SEQ ID 509>:

```
a132.seq
   1 ATGGAAGCCT TCAAAACCCT AATTTGGATT GTTAATATAA TTTCCGCTTT

51 GGCCGTCATC GTGTTAGTAT TGCTCCAACA CGGCAAAGGC GCGGATGCCG

101 GCGCGACTTT CGGATCGGGA AGCGGCAGCG CGCAAGGCGT ATTCGGCTCT

151 GCCGGCAACG CTAACTTCCT CAGCCGCTCG ACCGCCGTTG CAGCAACATT

201 TTTCTTTGCA ACCTGCATGg GCTATGGTGT ATATTCACAC CCACACGACA

251 AAACACGGTT TGGACTTCAG CAACGTACAA CAAACTCAGC AAGCACCCAA
```

-continued
```
301 ACCCGTAAGC AATACCGAAC CTTCTGCCCC TGTTCCTCAG CAGCAGAAAT

351 AACAGTTTTT CAAATGCCGA CATGGTGA
```

This corresponds to the amino acid sequence <SEQ ID 510; ORF 132.a>:

```
a132.pep
  1 MEAFKTLIWI VNIISALAVI VLVLLQHGKG ADAGATFGSG SGSAQGVFGS

51 AGNANFLSRS TAVAATFFFA TCMGYGVYSH PHDKTRFGLQ QRTTNSASTQ

101 TRKQYRTFCP CSSAAEITVF QMPTW*
``` m132/a132 92.1% identity in 38 aa overlap

```
                    10        20        30
    m132.pep    MEPFKTLIWIVNLISALAVFVLVLLQHGKGADAGATFG
                || |||||||||| :||||||:|||||||||||||||||
    a132        MEAFKTLIWIINIISALAVIVLVLLQHGKGADAGATFGSGSGSAQGVFGSAGNANFLSRS
                    10        20        30        40        50        60
```

The following partial DNA sequence was identified in *N. gonorrhoeae* <SEQ ID 511>:

```
g134.seq
    1 ATGTCCCAAG AAATCCTCGA CCAAGTGCGC CGCCGCCGCA CGTTTGCCAT

51 CATCTCCCAC CCCGATGCGG GTAAAACCAC GCTGACCGAA AAACTGCTGC

101 TGTTTTCGGG CGCGATTCAA AGCGCAGGCA CGGTGAAAGG TAAGAAAACC

151 GGCAAATTCG CCACCTCCGA CTGGATGGAC ATCGAGAAGC AGCGCGGCAT

201 TTCCGTGGCA TCAAGCGTGA TGCAGTTCGA CTACAAAGAC CACACCGTCA

251 ACCTCTTGGA CACGCCGGGA CACCAAGACT TCTCCGAAGA CACCTACCGC

301 GTTTTAACCG CAGTGGACAG CGCCTTGATG GTCATCGACG CGGCAAAAGG

351 CGTGGAAGCG CAAACCATCA AACTCTTGAA CGTCTGCCGC CTGCGCGATA

401 CGCCGATTGT TACCTTCATG AACAAATACG ACCGCGAAGT GCGCGATTCT

451 TTGGAACTCT TGGACGAAGT GGAAGACATC CTGCAAATCC GCTGCGCGCC

501 CGTTACCTGG CCGATCGGTA TGGGCAAAAA CTTCAAGGGC GTGTACCACA

551 TCCTGAACGA CGAAATCTAT CTCTTTGAAG CGGGCGGCGA ACGCCTGCCG

601 CACGAGTTCG ACATCATCAA AGGCATAAAC AATCCCGAAT GGAACAACG

651 CTTTCCGTTG GAAATCCAGC AGTTGCGCGA CGAAATCGAA TTGGTGCAGG

701 CGGCTTCCAA CGAATTTAAT CTCGacgaAT TTCTCGccgG CGAACTCACG

751 CCAGTGTTCT TCGGCTCTGC GATTAACAAC TTCGGCATTC AGGAAATCCT

801 CAATTCATTG ATTGACTGGG CACCCGCACC GAAACCGCGC GACGCGACCA

851 TGCGCATGGT CGGGCCGGAC GAGCCGAAAT TTTCCGGATT TATCTTTAAA

901 ATCCAAGCCA ATATGGACCC GAAACACCGC GACCGTATCG CCTTCTTGCG

951 CGTCTGCTCC GGTAAATTCG AGCGCGGCAT GAAGATGAAA CACCTGCGTA

1001 TCAACCGCGA AATCGCCGCC TCCAGCGTAG TAACCTTCAT GTCGCACGAC

1051 CGCGAACTGG CGGAAGAAGC CTACGCCGGC GACATCATCG GCATCCCGAA

1101 CCACGGCAAC ATCCAAATCG GCGACAGCTT CTCCGAAGGC GAACAACTGG

1151 CGTTTACCGG CATCCCATTC TTCGCGCCCG AACTGTTCCG CAGCGTCCGC
```

-continued

```
1201 ATCAAAAACC CGCTGAAAAT CAAACAACTG CAAAAAGGTT TGCAACAACT

1251 CGGCGAAGAA GGTGCGGTTC AAGTATTCAA ACCGATGAGC GGCGCGGATT

1301 TGATTTTGGG TGCGGTCGGC GTGTTGCAGT TTGAAGTCGT AACCTCACGC

1351 CTCGCCAACG AATACGGCGT GGAAGCCGTG TTCGACAGCG CATCCATCTG

1401 GTCGGCGCGC TGGGTATCGT GCGACGACAA GAAAAAACTG GCGGAATTTG

1451 AAAAAGCCAA CGCAGGCAAC CTCGCCATCG ACGCAGGCGG CAACCTCGCC

1501 TACCTCGCCC CCAACCGCGT GAATTTGGGG TTGACGCAAG AACGCTGGCC

1551 GGACATCGTG TTCCACGAAA CGCGCGAACA TTCGGTCAAA CTCTAA
```

This corresponds to the amino acid sequence <SEQ ID 512; ORF 134.ng>:

```
g134.pep.
   1 MSQEILDQVR RRRTFAIISH PDAGKTTLTE KLLLFSGAIQ SAGTVKGKKT

51 GKFATSDWMD IEKQRGISVA SSVMQFDYKD HTVNLLDTPG HQDFSEDTYR

101 VLTAVDSALM VIDAAKGVEA QTIKLLNVCR LRDTPIVTFM NKYDREVRDS

151 LELLDEVEDI LQIRCAPVTW PIGMGKNFKG VYHILNDEIY LFEAGGERLP

201 HEFDIIKGIN NPELEQRFPL EIQQLRDEIE LVQAASNEFN LDEFLAGELT

251 PVFFGSAINN FGIQEILNSL IDWAPAPKPR DATMRMVGPD EPKFSGFIFK

301 IQANMDPKHR DRIAFLRVCS GKFERGMKMK HLRINREIAA SSVVTFMSHD

351 RELAEEAYAG DIIGIPNHGN IQIGDSFSEG EQLAFTGIPF FAPELFRSVR

401 IKNPLKIKQL QKGLQQLGEE GAVQVFKPMS GADLILGAVG VLQFEVVISR

451 LANEYGVEAV FDSASIWSAR WVSCDDKKKL AEFEKANAGN LAIDAGGNLA

501 YLAPNRVNLG LTQERWPDIV FHETREHSVK L*
```

The following partial DNA sequence was identified in *N. meningitidis* <SEQ ID 513>:

```
m134.seq
   1 ATGTCCCAAG AAATCCTCGA CCAAGTGCGC CGCCGCCGCA CGTTTGCCAT

51 CATCTCCCAC CCTGACGCAG GTAAAACCAC GTTGACTGAA AAACTCTTGC

101 TGTTTTCGGG CGCGATTCAG AGCGCGGGTA CGGTAAAAGG CAAGAAAACC

151 GGCAAATTCG CCACTTCCGA CTGGATGGAA ATCGAGAAGC AGCGCGGCAT

201 TTCCGTGGCA TCAAGTGTGA TGCAGTTCGA TTACAAAGAC CACACCGTCA

251 ACCTCTTGGA CACGCCGGGA CACCAAGACT TCTCCGAAGA CACCTACCGC

301 GTTTTAACCG CCGTGGACAG CGCATTAATG GTCATCGACG CGGCAAAAGG

351 CGTGGAAGCG CAAACCATCA AGCTCTTAAA CGTCTGCCGC CTGCGCGATA

401 CACCGATTGT TACGTTTATG AACAAATACG ACCGCGAAGT GCGCGATTCC

451 CTGGAACTTT TGGACGAAGT GGAAAACATT TTAAAAATCC GCTGCGCGCC

501 CGTTACCTGG CCGATCGGTA TGGGCAAAAA CTTCAAGGGC GTGTACCACA

551 TCCTGAACGA TGAAATTTAT CTCTTTGAAG CTGGCGGCGA ACGCCTGCCG

601 CACGAGTTCG ACATCATCAA AGGCATCGAT AATCCTGAAT TGGAACAACG

651 CTTTCCGTTG GAAATCCAGC AGTTGCGCGA CGAAATCGAA TTGGTGCAGG

701 CGGCTTCCAA CGAGTTTAAT CTCGACGAAT TCCTCGCCGG CGAACTCACG
```

```
-continued
 751 CCCGTATTCT TCGGCTCTGC GATTAACAAC TTCGGTATTC AGGAAATCCT

801 CAATTCATTG ATTGACTGGG CGCCCGCGCC GAAACCGCGC GACGCGACCG

851 TACGTATGGT CGAGCCGGAC GAGCCGAAGT TTTCCGGATT TATCTTCAAA

901 ATCCAAGCCA ATATGGACCC GAAACACCGC GACCGTATTG CCTTCTTGCG

951 CGTCTGCTCC GGCAAATTCG AGCGCGGCAT GAAGATGAAA CACCTGCGTA

1001 TCAACCGCGA AATCGCCGCC TCCAGCGTGG TTACCTTCAT GTCGCACGAC

1051 CGCGAGCTGG TTGAAGAAGC CTACGCCGGC GACATTATCG GCATCCCGAA

1101 CCACGGCAAC ATCCAAATCG GCGACAGCTT CTCCGAAGGC GAACAACTGG

1151 CGTTCACCGG CATCCCATTC TTCGCACCCG AACTGTTCCG CAGCGTACGC

1201 ATCAAAAACC CGCTGAAAAT CAAACAACTG CAAAAAGGCT TGCAACAGCT

1251 CGGCGAAGAA GGCGCGGTGC AGGTGTTCAA ACCGATGAGC GGCGCGGATT

1301 TGATTTTGGG CGCGGTCGGC GTGTTGCAGT TTGAAGTCGT TACCTCGCGC

1351 CTCGCCAACG AATACGGCGT AGAAGCCGTG TTCGACAGCG CATCCATCTG

1401 GTCGGCGCGC TGGGTATCGT GCGACGACAA GAAAAAACTG GCTGAATTTG

1451 AAAAAGCCAA CGCGGGCAAC CTCGCCATCG ACGCAGGCGG CAACCTCGCC

1501 TACCTCGCGC CCAACCGCGT GAATTTGGGA CTCACGCAAG AACGTTGGCC

1551 GGACATCGTG TTCCACGAAA CACGCGAACA TTCGGTCAAA CTGTAA
```

This corresponds to the amino acid sequence <SEQ ID 514; ORF 134>:

```
m134.pep
  1 MSQEILDQVR RRRTFAIISH PDAGKTTLTE KLLLFSGAIQ SAGTVKGKKT

51 GKFATSDWME IEKQRGISVA SSVMQFDYKD HTVNLLDTPG HQDFSEDTYR

101 VLTAVDSALM VIDAAKGVEA QTIKLLNVCR LRDTPIVTFM NKYDREVRDS

151 LELLDEVENI LKIRCAPVTW PIGMGKNFKG VYHILNDEIY LFEAGGERLP

201 HEFDIIKGID NPELEQRFPL EIQQLRDEIE LVQAASNEFN LDEFLAGELT

251 PVFFGSAINN FGIQEILNSL IDWAPAPKPR DATVRMVEPD EPKFSGFIFK

301 IQANMDPKHR DRIAFLRVCS GKFERGMKMK HLRINREIAA SSVVTFMSHD

351 RELVEEAYAG DIIGIPNHGN IQIGDSFSEG EQLAFTGIPF FAPELFRSVR

401 IKNPLKIKQL QKGLQQLGEE GAVQVFKPMS GADLILGAVG VLQFEVVTSR

451 LANEYGVEAV FDSASIWSAR WVSCDDKKKL AEFEKANAGN LAIDAGGNLA

501 YLAPNRVNLG LTQERWPDIV FHETREHSVK L*
```

Computer analysis of this amino acid sequence gave the following results:
Homology with a Predicted ORF from *N. gonorrhoeae*
ORF 134 shows 98.7% identity over a 531 aa overlap with a predicted ORF (ORF 134.ng) from *N. gonorrhoeae*:

```
m134/g134

10         20         30         40         50         60
m134.pep  MSQEILDQVRRRRTFAIISHPDAGKTTLTEKLLLFSGAIQSAGTVKGKKTGKFATSDWME
          ||||||||||||||||||||||||||||||||||||||||||||||||||||||||||:
g134      MSQEILDQVRRRRTFAIISHPDAGKTTLTEKLLLFSGAIQSAGTVKGKKTGKFATSDWMD
                   10         20         30         40         50         60
```

-continued

```
                   70        80        90       100       110       120
m134.pep  IEKQRGISVASSVMQFDYKDHTVNLLDTPGHQDFSEDTYRVLTAVDSALMVIDAAKGVEA
          ||||||||||||||||||||||||||||||||||||||||||||||||||||||||||||
g134      IEKQRGISVASSVMQFDYKDHTVNLLDTPGHQDFSEDTYRVLTAVDSALMVIDAAKGVEA
                   70        80        90       100       110       120

130       140       150       160       170       180
m134.pep  QTIKLLNVCRLRDTPIVTFMNKYDREVRDSLELLDEVENILKIRCAPVTWPIGMGKNFKG
          ||||||||||||||||||||||||||||||||||||||:|||:|||||||||||||||||
g134      QTIKLLNVCRLRDTPIVTFMNKYDREVRDSLELLDEVEDILQIRCAPVTWPIGMGKNFKG
                  130       140       150       160       170       180

190       200       210       220       230       240
m134.pep  VYHILNDEIYLFEAGGERLPHEFDIIKGIDNPELEQRFPLEIQQLRDEIELVQAASNEFN
          |||||||||||||||||||||||||||||:||||||||||||||||||||||||||||||
g134      VYHILNDEIYLFEAGGERLPHEFDIIKGINNPELEQRFPLEIQQLRDEIELVQAASNEFN
                  190       200       210       220       230       240

250       260       270       280       290       300
m134.pep  LDEFLAGELTPVFFGSAINNFGIQEILNSLIDWAPAPKPRDATVRMVEPDEPKFSGFIFK
          |||||||||||||||||||||||||||||||||||||||||||:||| ||||||||||||
g134      LDEFLAGELTPVFFGSAINNFGIQEILNSLIDWAPAPKPRDATMRMVGPDEPKFSGFIFK
                  250       260       270       280       290       300

310       320       330       340       350       360
m134.pep  IQANMDPKHRDRIAFLRVCSGKFERGMKMKHLRINREIAASSVVTFMSHDRELVEEAYAG
          |||||||||||||||||||||||||||||||||||||||||||||||||||||:||||||
g134      IQANMDPKHRDRIAFLRVCSGKFERGMKMKHLRINREIAASSVVTFMSHDRELAEEAYAG
                  310       320       330       340       350       360

370       380       390       400       410       420
m134.pep  DIIGIPNHGNIQIGDSFSEGEQLAFTGIPFFAPELFRSVRIKNPLKIKQLQKGLQQLGEE
          ||||||||||||||||||||||||||||||||||||||||||||||||||||||||||||
g134      DIIGIPNHGNIQIGDSFSEGEQLAFTGIPFFAPELFRSVRIKNPLKIKQLQKGLQQLGEE
                  370       380       390       400       410       420

430       440       450       460       470       480
m134.pep  GAVQVFKPMSGADLILGAVGVLQFEVVTSRLANEYGVEAVFDSASIWSARWVSCDDKKKL
          ||||||||||||||||||||||||||||||||||||||||||||||||||||||||||||
g134      GAVQVFKPMSGADLILGAVGVLQFEVVTSRLANEYGVEAVFDSASIWSARWVSCDDKKKL
                  430       440       450       460       470       480

490       500       510       520       530
m134.pep  AEFEKANAGNLAIDAGGNLAYLAPNRVNLGLTQERWPDIVFHETREHSVKLX
          |||||||||||||||||||||||||||||||||||||||||||||||||||
g134      AEFEKANAGNLAIDAGGNLAYLAPNRVNLGLTQERWPDIVFHETREHSVKLX
                  490       500       510       520       530
```

The following partial DNA sequence was identified in *N. meningitidis* <SEQ ID 515>:

```
a134.seq
  1 ATGTCCCAAG AAATCCTCGA CCAAGTGCGC CGCCGCCGCA CGTTTGCCAT
 51 CATCTCCCAC CCTGACGCAG GTAAAACCAC GTTGACTGAA AAACTCTTGC
101 TGTTTTCAGG TGCGATTCAA AGCGCGGGTA CGGTAAAAGG CAAGAAAACC
151 GGCAAATTCG CCACCTCCGA CTGGATGGAC ATCGAGAAGC AGCGCGGCAT
201 TTCCGTGGCA TCAAGCGTGA TGCAGTTCGA CTATAAAGAC CACACCGTCA
251 ACCTTTTGGA CACGCCGGGA CACCAAGACT TCTCCGAAGA CACCTACCGC
301 GTTTTGACCG CCGTCGATAG TGCCTTGATG GTCATCGACG CGGCAAAAGG
351 CGTGGAAGCG CAAACCATCA AACTCTTGAA CGTCTGCCGC CTGCGCAATA
401 CGCCGATTGT TACGTTCATG AACAAATACG ACCGCGAAGT GCGCGATTCC
451 CTGGAATTGC TGGACGAAGT GGAAAACATC CTGCAAATCC GCTGCGCGCC
501 CGTAACCTGG CCGATCGGCA TGGGCAAAAA CTTCAAAGGC GTGTACCACA
551 TCCTGAACGA CGAAATCTAT CTCTTTGAAG CGGGCGGCGA ACGCTTGCCG
601 CACGAGTTCG ACATCATCAA AGGCATCGAT AATCCCGAAT TGGAACAACG
651 CTTTCCGTTA GAAATACAGC AGTTGCGCGA CGAAATCGAA TTGGTGCAGG
```

```
-continued
 701 CGGCTTCCAA CGAGTTCAAT CTCGACGAAT TCCTCGCCGG CGAACTCACG

751 CCCGTATTCT TCGGCTCTGC GATTAACAAC TTCGGTATTC AGGAAATCCT

801 CAATTCATTG ATTGAATGGG CGCCCGCGCC GAAACCACGC GATGCGACCG

851 TGCGTATGGT CGAGCCGGAC GAGCCGAAGT TTTCCGGATT TATCTTCAAA

901 ATCCAAGCCA ATATGGACCC GAAACACCGC GACCGTATTG CCTTCTTGCG

951 CGTCTGCTCC GGCAAATTCG AGCGCGGCAT GAAAATGAAA CACCTGCGTA

1001 TCAACCGCGA AATCGCCGCC TCCAGCGTGG TAACCTTCAT GTCCCACGAC

1051 CGCGAGCTGG TTGAAGAAGC CTACGCCGGC GACATTATCG GTATCCCAAA

1101 CCACGGCAAC ATCCAAATCG GCGACAGCTT CTCCGAAGGC GAACAACTGA

1151 CGTTTACCGG CATCCCATTC TTCGCGCCCG AACTGTTCCG CAGCGTTCGC

1201 ATCAAAAACC CGCTGAAAAT CAAGCAACTG CAAAAAGGTT TGCAACAGCT

1251 TGGCGAAGAA GGTGCGGTGC AGGTGTTCAA ACCAATGAGC GGCGCGGATT

1301 TGATTTTGGG CGCGGTCGGC GTGTTGCAGT TTGAAGTCGT TACCTCGCGC

1351 CTTGCCAACG AATACGGCGT GGAAGCCGTG TTCGACAACG CATCCATCTG

1401 GTCGGCGCGC TGGGTATCGT GCGACGACAA GAAAAAACTG GCGGAATTTG

1451 AAAAAGCCAA CGCGGGCAAC CTCGCCATCG ACGCGGGCGG CAACCTCGCC

1501 TACCTCGCGC CTAACCGCGT GAATCTGGGA CTCACGCAAG AACGCTGGCC

1551 GGACATCGTG TTCCACGAAA CGCGCGAGCA TTCGGTCAAA CTTTAA
```

This corresponds to the amino acid sequence <SEQ ID 516; ORF 134.a>:

```
a134.pep
  1 MSQEILDQVR RRRTFAIISH PDAGKTTLTE KLLLFSGAIQ SAGTVKGKKT

51 GKFATSDWMD IEKQRGISVA SSVMQFDYKD HTVNLLDTPG HQDFSEDTYR

101 VLTAVDSALM VIDAAKGVEA QTIKLLNVCR LRNTPIVTFM NKYDREVRDS

151 LELLDEVENI LQIRCAPVTW PIGMGKNFKG VYHILNDEIY LFEAGGERLP

201 HEFDIIKGID NPELEQRFPL EIQQLRDEIE LVQAASNEFN LDEFLAGELT

251 PVFFGSAINN FGIQEILNSL IEWAPAPKPR DATVRMVEPD EPKFSGFIFK

301 IQANMDPKHR DRIAFLRVCS GKFERGMKMK HLRINREIAA SSVVTFMSHD

351 RELVEEAYAG DIIGIPNHGN IQIGDSFSEG EQLTFTGIPF FAPELFRSVR

401 IKNPLKIKQL QKGLQQLGEE GAVQVFKPMS GADLILGAVG VLQFEVVTSR

451 LANEYGVEAV FDNASIWSAR WVSCDDKKKL AEFEKANAGN LAIDAGGNLA

501 YLAPNRVNLG LTQERWPDIV FHETREHSVK L*
``` m134/a134 98.9% identity in 531 aa overlap

```
                    10         20         30         40         50         60
     m134.pep  MSQEILDQVRRRRTFAIISHPDAGKTTLTEKLLLFSGAIQSAGTVKGKKTGKFATSDWME
               ||||||||||||||||||||||||||||||||||||||||||||||||||||||||||||:
     a134      MSQEILDQVRRRRTFAIISHPDAGKTTLTEKLLLFSGAIQSAGTVKGKKTGKFATSDWMD
                    10         20         30         40         50         60

70         80         90        100        110        120
     m134.pep  IEKQRGISVASSVMQFDYKDHTVNLLDTPGHQDFSEDTYRVLTAVDSALMVIDAAKGVEA
               ||||||||||||||||||||||||||||||||||||||||||||||||||||||||||||
     a134      IEKQRGISVASSVMQFDYKDHTVNLLDTPGHQDFSEDTYRVLTAVDSALMVIDAAKGVEA
                    70         80         90        100        110        120
```

```
                130       140       150       160       170       180
m134.pep    QTIKLLNVCRLRDTPIVTFMNKYDREVRDSLELLDEVENILKIRCAPVTWPIGMGKNFKG
            ||||||||||||:||||||||||||||||||||||||||||:||||||||||||||||||
a134        QTIKLLNVCRLRNTPIVTFMNKYDREVRDSLELLDEVENILQIRCAPVTWPIGMGKNFKG
                130       140       150       160       170       180

190       200       210       220       230       240
m134.pep    VYHILNDEIYLFEAGGERLPHEFDIIKGIDNPELEQRFPLEIQQLRDEIELVQAASNEFN
            ||||||||||||||||||||||||||||||||||||||||||||||||||||||||||||
a134        VYHILNDEIYLFEAGGERLPHEFDIIKGIDNPELEQRFPLEIQQLRDEIELVQAASNEFN
                190       200       210       220       230       240

250       260       270       280       290       300
m134.pep    LDEFLAGELTPVFFGSAINNFGIQEILNSLIDWAPAPKPRDATVRMVEPDEPKFSGFIFK
            |||||||||||||||||||||||||||||||:||||||||||||||||||||||||||||
a134        LDEFLAGELTPVFFGSAINNFGIQEILNSLIEWAPAPKPRDATVRMVEPDEPKFSGFIFK
                250       260       270       280       290       300

310       320       330       340       350       360
m134.pep    IQANMDPKHRDRIAFLRVCSGKFERGMKMKHLRINREIAASSVVTFMSHDRELVEEAYAG
            ||||||||||||||||||||||||||||||||||||||||||||||||||||||||||||
a134        IQANMDPKHRDRIAFLRVCSGKFERGMKMKHLRINREIAASSVVTFMSHDRELVEEAYAG
                310       320       330       340       350       360

370       380       390       400       410       420
m134.pep    DIIGIPNHGNIQIGDSFSEGEQLAFTGIPFFAPELFRSVRIKNPLKIKQLQKGLQQLGEE
            |||||||||||||||||||||||:||||||||||||||||||||||||||||||||||||
a134        DIIGIPNHGNIQIGDSFSEGEQLTFTGIPFFAPELFRSVRIKNPLKIKQLQKGLQQLGEE
                370       380       390       400       410       420

430       440       450       460       470       480
m134.pep    GAVQVFKPMSGADLILGAVGVLQFEVVTSRLANEYGVEAVFDSASIWSARWVSCDDKKKL
            |||||||||||||||||||||||||||||||||||||||||||:||||||||||||||||
a134        GAVQVFKPMSGADLILGAVGVLQFEVVTSRLANEYGVEAVFDNASIWSARWVSCDDKKKL
                430       440       450       460       470       480

490       500       510       520       530
m134.pep    AEFEKANAGNLAIDAGGNLAYLAPNRVNLGLTQERWPDIVFHETREHSVKLX
            ||||||||||||||||||||||||||||||||||||||||||||||||||||
a134        AEFEKANAGNLAIDAGGNLAYLAPNRVNLGLTQERWPDIVFHETREHSVKLX
                490       500       510       520       530
```

The following partial DNA sequence was identified in *N. gonorrhoeae* <SEQ ID 517>:

```
g135.seq
   1 ATGAAATACA AAAGAATCGT ATTTAAAGTC GGCACATCTT CGATTACCCG

51 TTCGGAcgGC AGCCTCTCGC GCGGCAAAAT CCAAACCATC ACCCGCCAGC

101 TTGCCGCATT GCATCATGCG GGACACGAGC TGGTCTTGGT GTCTTCCGGC

151 GCGGTTGCTG CAGGGTTCGG CGCGCTGGGT TTCAAAAAAC GTCCGGTCAA

201 AATCGCCGAC AAACAGGCTT CCGCCGCCGT CGGGCAGGGG CTGCTGATGG

251 AAGAATATAC GGCAAACCTG TCTTCAGACG GCATCGTGTC CGCACAAATC

301 CTGCTCAGCC GTGCCGACTT TGCCGACAAA CGCCGCTACC AAAATGCCGG

351 CGGCGCACTT TCCGTGCTGC TGCAACGCCG CGCGATTCCC ATCATCAATG

401 AAAACGACAC GGTTTCGGTT GAGGAGTTGA AAATCGGCGA CAACGACACA

451 TTGAGTGCGC AAGTGGCGGC GATGATACAG GCAGACCTCT TGGTGCTGCT

501 GACCGACATA GACGGTCTTT ACACCGGCAA CCCGAACAGC AATCCCGATG

551 CCGTACGGCT GGACAAAATC GAACACATCA ACCATGAAAT CATCGAAATG

601 GCGGGCGGCT CGGGTTCGGC AAACGGCACG GCGGTATGC TGACCAAAAT

651 CAAAGCGGCA ACCATCGCCG CCGAATCCGG CGTACCGGTG TATATCTGTT

701 CCTCACTCAA ACCCGATTCA TTGGCCGAAG CCGCCGAACA TCAGGCGGAC

751 GGCTCGTTTT TCGTcccCcg tgCCAAAGGT TTGCGGACAC AGAAGCAATG

801 GctggCGTTC TATTCCgaaa gcggGGgcag cgttTAtgtg gacgaaagtg 851 cggaacacgc tTtgtccgaa caagggaaag cctgCTGA
```

This corresponds to the amino acid sequence <SEQ ID 518; ORF 135.ng>:

```
g135.pep
    1 MKYKRIVFKV GTSSITRSDG SLSRGKIQTI TRQLAALHHA GHELVLVSSG

51 AVAAGFGALG FKKRPVKIAD KQASAAVGQG LLMEEYTANL SSDGIVSAQI

101 LLSRADFADK RRYQNAGGAL SVLLQRRAIP IINENDTVSV EELKIGDNDT

151 LSAQVAAMIQ ADLLVLLTDI DGLYTGNPNS NPDAVRLDKI EHINHEIIEM

201 AGGSGSANGT GGMLTKIKAA TIAAESGVPV YICSSLKPDS LAEAAEHQAD

251 GSFFVPRAKG LRTQKQWLAF YSESGGSVYV DESAEHALSE QGKAC*
```

The following partial DNA sequence was identified in *N. meningitidis* <SEQ ID 519>:

```
m135.seq.
    1 ATGAAATACA AAAGAATCGT ATTTAAAGTC GGCACATCTT CGATTACCCA

51 TTCGGACGGC AGTCTCTCGC GCGGCAAAAT CCAAACCATC ACCTGCCAGC

101 TTGCCGCATT GCATCATGCG GGACACGAGC TGGTCTTGGT GTCTTCCGGC

151 GCGGTTGCGG CAGGGTTCGG TGCGCTGGGT TTCAAAAAAC GTCCGGTCAA

201 AATCGCCGAC AAACAGGCTT CCGCCGCCGT CGGGCAGGGG CTGCTGATGG

251 AAGAATATAC GGCAAACCTG TCTTCAGACG GCATCGTGTC CGCGCAAATC

301 CTGCTCAGCC GCGCCGACTT TGCCGACAAA CGCCGCTACC AAAATGCCGG

351 CGGCGCACTT TCCGTGCTGC TGCAACGCCG CGCCGTCCCC ATCATCAATG

401 AAAACGATAC GGTTTCGGTT GAGGAATTGA AAATCGGCGA CAACGACACA

451 TTGAGTGCGC AAGTGGCGGC GATGATACAG GCAGACCTCT TGGTGCTGCT

501 GACCGACATA GACGGTCTTT ACACGGGCAA CCCGAACAGC AATCCCGATG

551 CCGTACGGCT GGACAAAATC GAACACATCA ACCATGAAAT CATCGAAATG

601 GCGGGCGGCT CGGGTTCGGC AAACGGCACG GGCGGTATGC TGACCAAAAT

651 CAAAGCGGCA ACCATCGCCG CCGAATCCGG CGTACCGGTG TATATCTGTT

701 CCTCGCTCAA ACCCGATGCA CTTGCCGAAG CTGCCGAACA TCAGGCGGAC

751 GGCTCGTTTT TCGTCCCCCG TGCCAAAGGT TTGCGGACGC AGAAGCAATG

801 GCTGGCGTTC TATTCCGAAA GCGGGGGCAG CGTTTATGTG GACGAAGGTG

851 CGGAACACGC TTTGTCCGAA CAGGGGAAAA GCCTGCTGAT GTCGGGCATT

901 GCCGGAATCG AAGGGCATTT TTCCCGTATG GACACCGTAA CCGTGTACAG

951 CAAGGCAACC AAACAGCCCC TGGGCAAAGG GCGCGTCCTG TTCGGCTCTG

1001 CCGCCGCCGA AGACCTGCTC AAATCGCGTA AGGCGAAAGG CGTGTTCATC

1051 CATCGGGACG ACTGGATTTC CATCACGCCC GAAATACGCC TGCTTCTGAC

1101 CGAATTTTAG
```

This corresponds to the amino acid sequence <SEQ ID 520; ORF 135>:

```
m135.pep
    1 MKYKRIVFKV GTSSITHSDG SLSRGKIQTI TCQLAALHHA GHELVLVSSG

51 AVAAGFGALG FKKRPVKIAD KQASAAVGQG LLMEEYTANL SSDGIVSAQI

101 LLSRADFADK RRYQNAGGAL SVLLQRRAVP IINENDTVSV EELKIGDNDT
```

-continued

```
151 LSAQVAAMIQ ADLLVLLTDI DGLYTGNPNS NPDAVRLDKI EHINHEIIEM

201 AGGSGSANGT GGMLTKIKAA TIAAESGVPV YICSSLKPDA LAEAAEHQAD

251 GSFFVPRAKG LRTQKQWLAF YSESRGSVYV DEGAEHALSE QGKSLLMSGI

301 AGIEGHFSRM DTVTVYSKAT KQPLGKGRVL FGSAAAEDLL KSRKAKGVFI

351 HRDDWISITP EIRLLLTEF*
```

Computer analysis of this amino acid sequence gave the following results:

Homology with a Predicted ORF from *N. gonorrhoeae*

ORF 135 shows 97.6% identity over a 294 aa overlap with a predicted ORF (ORF 135.ng) from *N. gonorrhoeae*:

```
    m135/g135

10         20         30         40         50         60
      m135.pep    MKYKRIVFKVGTSSITHSDGSLSRGKIQTITCQLAALHHAGHELVLVSSGAVAAGFGALG
                  ||||||||||||||||:||||||||||||||| |||||||||||||||||||||||||||
      g135        MKYKRIVFKVGTSSITRSDGSLSRGKIQTITRQLAALHHAGHELVLVSSGAVAAGFGALG
                     10         20         30         40         50         60

70         80         90        100        110        120
      m135.pep    FKKRPVKIADKQASAAVGQGLLMEEYTANLSSDGIVSAQILLSRADFADKRRYQNAGGAL
                  ||||||||||||||||||||||||||||||||||||||||||||||||||||||||||||
      g135        FKKRPVKIADKQASAAVGQGLLMEEYTANLSSDGIVSAQILLSRADFADKRRYQNAGGAL
                     70         80         90        100        110        120

130        140        150        160        170        180
      m135.pep    SVLLQRRAVPIINENDTVSVEELKIGDNDTLSAQVAAMIQADLLVLLTDIDGLYTGNPNS
                  |||||||||:||||||||||||||||||||||||||||||||||||||||||||||||||
      g135        SVLLQRRAIPIINENDTVSVEELKIGDNDTLSAQVAAMIQADLLVLLTDIDGLYTGNPNS
                    130        140        150        160        170        180

190        200        210        220        230        240
      m135.pep    NPDAVRLDKIEHINHEIIEMAGGSGSANGTGGMLTKIKAATIAAESGVPVYICSSLKPDA
                  |||||||||||||||||||||||||||||||||||||||||||||||||||||||||||:
      g135        NPDAVRLDKIEHINHEIIEMAGGSGSANGTGGMLTKIKAATIAAESGVPVYICSSLKPDS
                    190        200        210        220        230        240

250        260        270        280        290        300
      m135.pep    LAEAAEHQADGSFFVPRAKGLRTQKQWLAFYSESRGSVYVDEGAEHALSEQGKSLLMSGI
                  ||||||||||||||||||||||||||||||||||||||:|||||||||||:
      g135        LAEAAEHQADGSFFVPRAKGLRTQKQWLAFYSESGGSVYVDESAEHALSEQGKACX
                    250        260        270        280        290

310        320        330        340        350        360
      m135.pep    AGIEGHFSRMDTVTVYSKATKQPLGKGRVLFGSAAAEDLLKSRKAKGVFIHRDDWISITP
```

The following partial DNA sequence was identified in *N. meningitidis* <SEQ ID 521>:

```
    a135.seq
      1 ATGAAATACA AAAGAATCGT ATTTAAAGTC GGCACATCTT CGATTACCCA

51 TTCGGACGGC AGTCTCTCGC GCGGCAAAAT CCAAACCATC ACCCGCCAGC

101 TTGCCGCATT GCATCATGCG GGACACGAGC TGGTCTTGGT GTCTTCCGGC

151 GCGGTTGCGG CAGGGTTCGG TGCGCTGGGT TTCAAAAAAC GTCCGGTCAA

201 AATCGCCGAC AAACAGGCTT CCGCCGCCGT CGGGCAGGGG CTGCTGATGG

251 AAGAATATAC GGCAAACCTG TCTTCAGACG GCATCGTGTC CGCACAAATC

301 CTGCTCAGCC GCGCCGACTT TGCCGACAAA CGCCGCTACC AAAATGCCGG

351 CGGCGCACTT TCCGTGCTGC TGCAACGCCG CGCCGTCCCC ATCATCAATG

401 AAAACGATAC GGTTTCGGTT GAGGAATTGA AAATCGGCGA CAACGACACA

451 TTGAGTGCGC AAGTGGCGGC GATGATACAG GCAGACCTCT TGGTGCTGCT

501 GACCGACATA GACGGTCTTT ACACCGGCAA CCCGAACAGC AATCCCGATG
```

```
 551 CCGTACGGCT GGACAAAATC GAACACATCA ACCATGAAAT CATCGAAATG

601 GCGGGCGGCT CGGGTTCGGC AAACGGCACA GGCGGTATGC TGACTAAAAT

651 CAAAGCGGCG ACGATTGCGA CCGAGTCCGG CGTACCGGTC TATATCTGTT

701 CCTCGCTCAA ACCCGATGCA CTTGCCGAAG CGGCAGATAA TCAGGCGGAC

751 GGCTCGTTTT TCGTCCCCCG TGCCAAAGGT TGCGGACGC AGAAGCAATG

801 GCTGGCGTTC TATTCCGAAA GCAGGGGCGG CGTTTATGTG GACGAAGGTG

851 CGGAACACGC TTTGTCCGAA CAGGGAAAAA GCCTGCTGAT GTCGGGCATT

901 GCCGGAATCG AAGGGCATTT TTCCCGTATG GACACCGTAA CCGTGTACAG

951 CAAGGCAACC AAACAGCCTT TGGGCAAAGG GCGAGTCCTG TTCGGCTCTG

1001 CCGCCGCCGA AGACCTGCTC AAATTGCGTA AGGCGAAAGG CGTGTTCATC

1051 CATCGGGACG ACTGGATTTC CATCACGCCC GAAATACGCC TGCTTCTGAC

1101 CGAATTTTAG
```

This corresponds to the amino acid sequence <SEQ ID 522; ORF 135.a>:

```
a135.pep
   1 MKYKRIVFKV GTSSITHSDG SLSRGKIQTI TRQLAALHHA GHELVLVSSG

51 AVAAGFGALG FKKRPVKIAD KQASAAVGQG LLMEEYTANL SSDGIVSAQI

101 LLSRADFADK RRYQNAGGAL SVLLQRRAVP IINENDTVSV EELKIGDNDT

151 LSAQVAAMIQ ADLLVLLTDI DGLYTGNPNS NPDAVRLDKI EHINHEIIEM

201 AGGSGSANGT GGMLTKIKAA TIATESGVPV YICSSLKPDA LAEAADNQAD

251 GSFFVPRAKG LRTQKQWLAF YSESRGGVYV DEGAEHALSE QGKSLLMSGI

301 AGIEGHFSRM DTVTVYSKAT KQPLGKGRVL FGSAAAEDLL KLRKAKGVFI

351 HRDDWISITP EIRLLLTEF*
``` m135/a135 98.4% identity in 369 aa overlap

```
                 10         20         30         40         50         60
m135.pep MKYKRIVFKVGTSSITHSDGSLSRGKIQTITCQLAALHHAGHELVLVSSGAVAAGFGALG
         ||||||||||||||||||||||||||||||  |||||||||||||||||||||||||||
a135     MKYKRIVFKVGTSSITHSDGSLSRGKIQTITRQLAALHHAGHELVLVSSGAVAAGFGALC
                 10         20         30         40         50         60

70         80         90        100        110        120
m135.pep FKKRPVKIADKQASAAVGQGLIMEEYTANLSSDGIVSAQILLSRADFADKRRYQNAGGAL
         ||||||||||||||||||||||||||||||||||||||||||||||||||||||||||||
a135     FKKRPVKIADKQASAAVGQGLIMEEYTANLSSDGIVSAQILLSRADFADKRRYQNAGGAL
                 70         80         90        100        110        120

130        140        150        160        170        180
m135.pep SVLLQRRAVPIINENDTVSVEELKIGDNDTLSAQVAAMIQADLLVLLTDIDGLYTGNPNS
         ||||||||||||||||||||||||||||||||||||||||||||||||||||||||||||
a135     SVLLQRRAVPIINENDTVSVEELKIGDNDTLSAQVAAMIQADLLVLLTDIDGLYTGNPNS
                130        140        150        160        170        180

190        200        210        220        230        240
m135.pep NPDAVRLDKIEHINHEIIEMAGGSGSANGTGGMLTKIKAATIAAESGVPVYICSSLKPDA
         |||||||||||||||||||||||||||||||||||||||||||:||||||||||||||||
a135     NPDAVRLDKIEHINHEIIEMAGGSGSANGTGGMLTKIKAATIATESGVPVYICSSLKPDA
                190        200        210        220        230        240

250        260        270        280        290        300
m135.pep LAEAAEHQADGSFFVPRAKGLRTQKQWLAFYSESRGVYVDEGAEHALSEQGKSLLMSGI
         |||||::|||||||||||||||||||||||||||||||||||||||||||||||||||||
a135     LAEAADNQADGSFFVPRAKGLRTQKQWLAFYSESRGGVYVDEGAEHALSEQGKSLLMSGI
                250        260        270        280        290        300
```

-continued

```
                 310        320        330        340        350        360
m135.pep  AGIEGHFSRMDTVTVYSKATKQPLGKGRVLFGSAAEDLLKSRAKAKGVFIHRDDWISITP
          ||||||||||||||||||||||||||||||||||||||| ||||||||||||||||||||
a135      AGIEGHFSRMDTVTVYSKATKQPLGKGRVLFGSAAEDLLKLRAKAKGVFIHRDDWISITP
                 310        320        330        340        350        360

370
m135.pep  EIRLLLTEFX
          ||||||||||
a135      EIRLLLTEFX
                 370
```

The following partial DNA sequence was identified in *N. gonorrhoeae* <SEQ ID 523>:

```
g136.seq
    1 ATGGAAATCC GGTTTCAGAC AGCATTTTTA CGTTTGGTTC AGatgaAAAC

51 AAACGCTtca aTTCTtaccg caACACGCCT TGTATTTCCT GccgCTGCCG

101 CACGGACAGG GATCGTTCCT GCCGgtTTTT TCCCCTTCCC TGCGGACGGT

151 TTGCGGTTTG TTGATGACCG CCTGCCAGTA GCGGTAGATG TCtgccagcg 201 cgTAAGGCag tTCGGAcgca agttccgcca gctcgccttc ggTGAATTGC 251 AGgcggataa cgccgttttC CTCTTCGTCg taaatgccgc ccactgccat 301 cacgGGGTAA AACAGCTCTT CAAACGCTTC ATCATCGGCG GCTTCAAACC

351 AATCGGTCGG CACAATGTCC AAACCGTAAA GATAGGCGTT GCACCAAGTG

401 TAAAAATCGC TGCCGCCCTC GCCGTCGTCG TAGAGCCACA AATCGGGCAG

451 CTTTTTATCC GACATCGCGG CGGTTGTTTC CATCGCCATT GCCAAAACCA

501 GCCGTTCGAT TTCGGAACGT TCGGCGGCGG TAAATTGCGA TTCGTCGCCC

551 AACACTTCGG GCAGCCAGTC GAGCGGTGCC AATTTGTCCG GCCCGCTCAA

601 CAGCGCCGTC ATAAAACCTT GAACCTCGTC GCAACGCATC GTGTTGCCTT

651 GTTCGCTTTT GGCATCCAAT AA
```

This corresponds to the amino acid sequence <SEQ ID 524; ORF 136.ng>:

```
g136.pep
    1 MEIRFQTAFL RLVQMKTNAS ILTATRLVFP AAAARTGIVP AGFFPFPADG

51 LRFVDDRLPV AVDVCQRVRQ FGRKFRQLAF GELQADNAVF LFVVNAAHCH

101 HGVKQLFKRF IIGGFKPIGR HNVQTVKIGV APSVKIAAAL AVVVEPQIGQ

151 LFIRHRGGCF HRHCQNQPFD FGTFGGGKLR FVAQHFGQPV ERCQFVRPAQ

201 QRRHKTLNLV ATHRVALFAF GIQ*
```

The following partial DNA sequence was identified in *N. meningitidis* <SEQ ID 525>:

```
m136.seq
    1 ATGGAAACAA ACGCTTCAAT TCTTACCGCA ACACGCCTTG TATTTCTGC

51 CGCTGCCGCA CGGACAGGGA TCGTTCCTGC CTGTTTTTC GCCTTCCCTG

101 CGGACGGTTT GCGGTTTGTT GATGACTGCC TGCCAGTAGC GGTAGATATC

151 CGCCAATGCA TAAGGCAACT CGGATTCCAG TTCCGCCAGC TCGCCTTCTG

201 TGAATTGCAG ACGGATAGCG CCGTTTTCCT CTTCGTCGTA AATACCGCCC

251 AATGCCATGA TGGGATAAAA CAACTCTTCA AACGCTTCAT CATCGACGGC
```

-continued

```
301 TTCAAACCAA TCGGTCGGCA CAATATCCAA ACCGTAAAGA TAAGCATTGC

351 ACCATGTGTA AAAATCGCTG CCGCCGTCTT CGTTTTCATA CAGCCACAAA

401 TCGGGCAGTT TTTTATCCGA CATCGCGGCG GTTGTTTCCA TCGCCATTGC

451 CAAAACCAGC CGTTCGATTT CGGAACGTTC GGCGGCGGTA AATTGCGATT

501 CGTCGCCCAA CACTTCGGGC AGCCAGTCGA GCGGTGTCAA TTTGTCCGGC

551 CCGCTCAACA GCGCCGTCAT AAAACCTTGA ACCTCGTCGC AACGCATCGT

601 GTTGCCTTGT TCGCTTTTGG CATCCAACAA TTCGCTCAAC CGCCGTTTGG

651 ATGCTTCGGT AAATTTTCGG GAATCCATCA TTTTCCTTTT CAAATGGGTT

701 TTGCGCCCTA TTATCGCCGC AATGCCGTCT GA
```

This corresponds to the amino acid sequence <SEQ ID 526; ORF 136>:

```
m136.pep
  1 METNASILTA TRLVFSAAAA RTGIVPACFF AFPADGLRFV DDCLPVAVDI

51 RQCIRQLGFQ FRQLAFCELQ TDSAVFLFVV NTAQCHDGIK QLFKRFIIDG

101 FKPIGRHNIQ TVKISIAPCV KIAAAVFVFI QPQIGQFFIR HRGGCFHRHC

151 QNQPFDFGTF GGGKLRFVAQ HFGQPVERCQ FVRPAQQRRH KTLNLVATHR

201 VALFAFGIQQ FAQPPFGCFG KFSGIHHFPF QMGFAPYYRR NAV*
```

Computer analysis of this amino acid sequence gave the following results:
Homology with a Predicted ORF from *N. gonorrhoeae*
ORF 136 shows 85.6% identity over a 209 aa overlap with a predicted ORF (ORF 136.ng) from *N. gonorrhoeae*:

```
m136/g136

10         20         30         40
     m136.pep               METNASILTATRLVFSAAAARTGIVPACFFAFPADGLRFVDDCLPV
                            |:||||||||||| ||||||||||| || |||||||||||| |||
     g136       MEIRFQTAFLRLVQMKTNASILTATRLVFPAAAARTGIVPAGFPFPPADGLRFVDDRLPV
                10         20         30         40         50         60
                50         60         70         80         90        100
     m136.pep   AVDIRQCIRQLGFQFRQLAFCELQTDSAVFLFVVNTAQCHDGIKQLFKRFIIDGFKPIGR
                |||:  |  :||:| :||||||  |||:|:|||||||::|| |:|||||||| ||||||
     g136       AVDVCQRVRQFGRKFRQLAFGELQADNAVFLVVNAAHCHHGVKQLFKRFITGGFKPIGR
                70         80         90        100        110        120
                110        120        130        140        150        160
     m136.pep   HNIQTVKISIAPCVKIAAAVFVFIQPGIGQFFIRHRGGCFHRHCQNQPFDFGTFGGGKLR
                ||:|||||::||  ||||||:  |  ::|||| :||||||||||||||||||||||||||
     g136       HNVQTVKIGVAPSVKIAAALAVVVEPQIGQLFIRHRGGCFHRHCQNQPFDGTFGGGKLR
                130        140        150        160        170        180
                170        180        190        200        210        220
     m136.pep   FVAQHFGQPVERCQFVRPAQQRRHKTLNLVATHRVALFAFGIQQFAQPPFGCFGKFSGIH
                |||||||||||||||||||||||||||||||||||||||||||||
     g136       FVAQHFGQPVERCQFVRPAQQRRHKTLNLVATHRVALFAFGIQX
                            190        200        210        220
                230        240
     m136.pep   HFPFQMGFAPYYRRNAVX
```

The following partial DNA sequence was identified in *N. meningitidis* <SEQ ID 527>:

```
a136.seq
  1 ATGGAAACAA ACGCTTCAAT TCTTACCGCA ACACGCCTTG TATTTTCTGC

51 CGCTGCCGCA CGGACAGGGA TCGTTCCTGC CTGTTTTTTC GCCTTCCCTG
```

-continued
```
101 CGGACGGTTT GCGGCTTGTT GATGACCGCC TGCCAGTAGC GGTAGATATC

151 CGCCAATGCA TAAGGCAACT CGGATTCCAG TTCCGCCAGC TCGCCTTCTG

201 TGAATTGCAG ACGGATAGTG CCGTTGTCCT CTTCGTCGTA AATACCGCCC

251 AATGCCATGA TGGGATAAAA CAACTCTTCA AACGCTTCAT CATCGACGGC

301 TTCAAACCAA TCGGTCGGCA CAATATCCAA ACCGTAAAGA TAAGCATTGC

351 ACCATGTGTA AAAATCGCTG CCGCCGTCTT CGTTTTCATA CAGCCACAAA

401 TCGGGCAGTT TTTTATCCGA CATCGCGGCG GTTGTTTCCA TCGCCATTGC

451 CAAAACCAGC CGTTCGATTT CGGAACGTTC GGCGGCGGTA AATTGCGATT

501 CGTCGCCCAA CACTTCGGGC AGCCAGTCGA GCGGTGTCAA TTTGTCCGGC

551 CCGCTCAACA GCGCCGTCAT AAAACCTTGA ACCTCGTCGC AACGCATCGT

601 GTTGCCTTGT TCGCTTTTGG CATCCAACAA TTCGCTCAAC CGCCGTTTGG

651 ATGCTTCGGT AAATTTTCGG GAATCCATCA TTTTCCTTTT CCAATGGGTT

701 TTGCGCCCTA TTATAGTGGA TTAAATTTAA ATCAGGACAA GGCGACGAAG

751 CCGCAGACAG TACAAATAGT ACGGCAAGGC GAGGCAACGC CGTACTGGTT

801 TAAATTTAAT CCACTATATC GCCGCAATGC CGTCTGA
```

This corresponds to the amino acid sequence <SEQ ID 528; ORF 136.a>:

```
a136.pep
   1 METNASILTA TRLVFSAAAA RTGIVPACFF AFPADGLRLV DDRLPVAVDI

51 RQCIRQLGFQ FRQLAFCELQ TDSAVVLFVV NTAQCHDGIK QLFKRFIIDG

101 FKPIGRHNIQ TVKISIAPCV KIAAAVFVFI QPQIGQFFIR HRGGCFHRHC

151 QNQPFDFGTF GGGKLRFVAQ HFGQPVERCQ FVRPAQQRRH KTLNLVATHR

201 VALFAFGIQQ FAQPPFGCFG KFSGIHHFPF PMGFAPYYSG LNLNQDKATK

251 PQTVQIVRQG EATPYWFKFN PLYRRNAV*
``` m136/a136 98.3% identity in 238 aa overlap

```
                 10         20         30         40         50         60
   m136.pep METNASILTATRLVFSAAAARTGIVPACFFAFPADGLRFVDDCLPVAVDIRQCIRQLGFQ
            ||||||||||||||||||||||||||||||||||||||:|||  |||||||||||||||
       a136 METNASILTATRLVFSAAAARTGIVPACFFAFPADGLRLVDDRLPVAVDIRQCIRQLGFQ
                 10         20         30         40         50         60

70         80         90        100        110        120
   m136.pep FRQLAFCELQTDSAVFLFVVNTAQCHDGIKQLFKRFIIDGFKPIGRHNIQTVKISIAPCV
            |||||||||||||||  |||||||||||||||||||||||||||||||||||||||||
       a136 FRQLAFCELQTDSAVVLFVVNTAQCHDGIKQLFKRFIIDGFKPIGRHNIQTVKISIAPCV
                 70         80         90        100        110        120

130        140        150        160        170        180
   m136.pep KIAAAVFVFIQPQIGQFFIRHRGGCFHRHCQNQPFDFGTFGGGKLRFVAQHFGQPVERCQ
            ||||||||||||||||||||||||||||||||||||||||||||||||||||||||||||
       a136 KIAAAVFVFIQPQIGQFFIRHRGGCFHRHCQNQPFDFGTFGGGKLRFVAQHFGQPVERCQ
                130        140        150        160        170        180

190        200        210        220        230        240
   m136.pep FVRPAQQRRHKTLNLVATHRVALFAFGIQQFAQPPFGCFGKFSGIHHFPFQMGFAPYYRR
            ||||||||||||||||||||||||||||||||||||||||||||||||||| ||||||
       a136 FVRPAQQRRHKTLNLVATHRVALFAFGIQQFAQPPFGCFGKFSGIHHFPFPMGFAPYYSG
                190        200        210        220        230        240 m136.pep NAVX a136 LNLNQDKATKPQTVQIVRQGEATPYWFKFNPLYRRNAVX
                250        260        270
```

The following partial DNA sequence was identified in *N. gonorrhoeae* <SEQ ID 529>:

```
g137.seq
    1 ATGATTATCC ATCACcaaTT CGATCCCGTC CTCATCAGTA TCGGCCCGCT

51 TGCCGTCCGC TGGTATGCCT TAAGCTACAT CCTCGGATTT ATTCTTTTTA

101 CCTTTCTCGG CAGAAGGCGC ATCGCGCAAG GCTTGTCCGT TTTTACCAAA

151 GAATCGCTCG ACGACTTCCT GACATGGGGC ATTTTGGGCG TGATTTTGGG

201 CGGACGCTTG GGCTATGTCC TGTTTTACAA ATTCTCCGAC TACCTCGCCC

251 ATCCGCTTGA TATTTTCAAG GTATGGGAAG GCGGAATGTC GTTCCACGGC

301 GGCTTTTTGG GTGTAGTTAT TGCCATATGG TTGTTCAGCC GCAAGCACGG

351 CATCGGCTTC CTCAAACTGA TGGACACGGT CGCGCCGCTC GTTCCGCTGG

401 GTCTCGCTTC GGGACGTATC GGCAACTTTA TCAACGGCGA ACTTTGGGGA

451 CGCATTACCG ACATTAACGC ATTTTGGGCA ATGGGCTTCC CGCAAGCGCA

501 TTACGAAGAT GCCGAAGCCG CCGCGCACAA TCCGCTTTGG GCAGAATGGC

551 TGCAACAATA CGGTATGCTG CCGCGTCATC CCTCGCAGCT TTATCAGTTT

601 GCCCTTGAAG GCATCTGCCT GTTCGCCGTC GTTTGGCTGT TTTCCAAAAA

651 ACCGCGCCCG ACCGGGCAGA CTGCCGCGCT TTTTCTCGGC GGCTACGGCG

701 TGTTCCGCTT TATTGCCGAA TTTGCGCGCC AACCCGACGA CTATCTCGGG

751 CTGCTGACCT TGGGGCTGTC GATGGGGCAA TGGTTGAGCG TCCCGATGAT

801 TGTTTTGGGT ATCGTCGGCT TTGTCCGGTT CGGCATGAAA AAACAGCACT

851 GA
```

This corresponds to the amino acid sequence <SEQ ID 530; ORF 137.ng>:

```
g137.pep
    1 MIIHHQFDPV LISIGPLAVR WYALSYILGF ILFTFLGRRR IAQGLSVFTK

51 ESLDDFLTWG ILGVILGGRL GYVLFYKFSD YLAHPLDIFK VWEGGMSFHG

101 GFLGVVIAIW LFSRKHGIGF LKLMDTVAPL VPLGLASGRI GNFINGELWG

151 RITDINAFWA MGFPQAHYED AEAAAHNPLW AEWLQQYGML PRHPSQLYQF

201 ALEGICLFAV VWLFSKKPRP TGQTAALFLG GYGVFRFIAE FARQPDDYLG

251 LLTLGLSMGQ WLSVPMIVLG IVGFVRFGMK KQH*
```

The following partial DNA sequence was identified in *N. meningitidis* <SEQ ID 531>:

```
m137.seq
    1 ATGATTACCC ATCCCCAATT CGATCCCGTC CTTATCAGTA TCGGCCCGCT

51 TGCCGTCCGC TGGTATGCCC TAAGCTACAT CCTCGGATTT ATTCTTTTTA

101 CCTTTCTCGG CAGAAGGCGC ATCGCGCAAG GCTTGTCCGT TTTTACCAAA

151 GAATCGCTCG ACGACTTCCT GACATGGGGC ATTTTGGGCG TAATTTTGGG

201 CGGGCGTTTG GGTTACGTCC TGTTTTACAA GTTTTCCGAC TACCTCGCCC

251 ATCCGCTTGA TATTTTCAAG GTATGGGAAG GCGGAATGTC GTTCCACGGC

301 GGCTTTTTGG GTGTAGTTAT TGCCATACGG TTGTTCGGCC GCAAACACGG

351 CATCGGCTTC CTCAAACTGA TGGATACGGT CGCACCGCTC GTTCCGCTGG
```

```
-continued
401 GTCTCGCTTC GGGACGTATC GGCAACTTCA TCAACGGCGA ACTTTGGGGA

451 CGCGTTACCG ACATCAACGC ATTTTGGGCA ATGGGCTTCC CGCAGGCGCG

501 TTACGAAGAT GCCGAAGCCG CCGCGCACAA TCCGCTTTGG GCAGAATGGC

551 TGCAACAATA CGGTATGCTG CCGCGTCATC CCTCGCAGCT TTATCAGTTT

601 GCACTTGAAG GCATCTGCCT GTTCACCGTC ATTTGGCTGT TCTCTAAAAA

651 ACAGCGGTCG ACCGGACAAG TCGCCTCGCT CTTCCTCGGC GGCTACGGCA

701 TATTCCGCTT CATTGCCGAA TTCGCACGCC AACCCGACGA CTATCTCGGG

751 CTGCTGACCT TGGGGCTGTC GATGGGGCAA TGGTTGAGCG TCCCGATGAT

801 TGTTTTGGGT ATCGTCGGCT TTGTCCGGTT CGGCATGAAA AAACAGCACT

851 GA
```

This corresponds to the amino acid sequence <SEQ ID 532; ORF 137>:

```
m137.pep
  1 MITHPQFDPV LISIGPLAVR WYALSYILGF ILFTFLGRRR IAQGLSVFTK

51 ESLDDFLTWG ILGVILGGRL GYVLFYKFSD YLAHPLDIFK VWEGGMSFHG

101 GFLGVVIAIR LFGRKHGIGF LKLMDTVAPL VPLGLASGRI GNFINGELWG

151 RVTDINAFWA MGFPQARYED AEAAAHNPLW AEWLQQYGML PRHPSQLYQF

201 ALEGICLFTV IWLFSKKQRS TGQVASLFLG GYGIFRFIAE FARQPDDYLG

251 LLTLGLSMGQ WLSVPMIVLG IVGFVRFGMK KQH*
```

Computer analysis of this amino acid sequence gave the following results:
Homology with a Predicted ORF from *N. gonorrhoeae*
ORF 137 shows 95.4% identity over a 283 aa overlap with a predicted ORF (ORF 137.ng) from *N. gonorrhoeae*:

```
m137/g137

10         20         30         40         50         60
m137.pep MITHPQFDPVLISIGPLAVRWYALSYILGFILFTFLGRRRIAQGLSVFTKESLDDFLTWG
         || | ||||||||||||||||||||||||||||||||||||||||||||||||||||||
g137     MIIHHQFDPVLISIGPLAVRWYALSYILGFILFTFLGRRRIAQGLSVFTKESLDDFLTWG
                 10         20         30         40         50         60

70         80         90        100        110        120
m137.pep ILGVILGGRLGYVLFYKFSDYLAHPLDIFKVWEGGMSFHGGFLGVVIAIRLFGRKHGIGF
         |||||||||||||||||||||||||||||||||||||||||||||| |||||| ||||||
g133     ILGVILGGRLGYVLFYKFSDYLAHPLDIFKVWEGGMSFHGGFLGVVIAIWLFSRKHGIGF
                 70         80         90        100        110        120

130        140        150        160        170        180
m137.pep LKLMDTVAPLVPLGLASGRIGNFINGELWGRVTDINAFWAMGFPQARYEDAEAAAHNPLW
         |||||||||||||||||||||||||||||||:||||||||||||||:|||||||||||||
g137     LKLMDTVAPLVPLGLASGRIGNFINGELWGRITDINAFWAMGFPQAHYEDAEAAAHNPLW
                130        140        150        160        170        180

190        200        210        220        230        240
m137.pep AEWLQQYGMLPRHPSQLYQFALEGICLFTVIWLFSKKQRSTGQVASLFLGGYGIFRFIAE
         ||||||||||||||||||||||||||||:|:||||||| || :|:||||||:||||||
g137     AEWLQQYGMLPRHPSQLYQFALEGICLFAVVWLFSKKPRPTGQTAALFLGGYGVFRFIAE
                190        200        210        220        230        240

250        260        270        280
m137.pep FARQPDDYLGLLTLGLSMGQWLSVPMIVLGIVGFVRFGMKKQHX
         |||||||||||||||||||||||||||||||||||||||||||
g137     FARQPDDYLGLLTLGLSMGQWLSVPMIVLGIVGFVRFGMKKQHX
                250        260        270        280
```

The following partial DNA sequence was identified in *N. meningitidis* <SEQ ID 533>:

```
a137.seq
   1 ATGATTACCC ATCCCCAATT CGACCCCGTC CTTATCAGTA TCGGCCCGCT

51 TGCCGTCCGC TGGTATGCCC TAAGCTACAT CCTCGGATTT ATTCTTTTTA

101 CCTTTCTCGG CAGAAGGCGC ATCGCGCAAG GCTTGTCCGT TTTTACCAAA

151 GAATCGCTCG ACGACTTCCT GACATGGGGC ATTTTGGGCG TAATTTTGGG

201 CGGGCGTTTG GGTTACGTCC TGTTTTACAA GTTTTCCGAC TACCTCGCCC

251 ATCCGCTTGA TATTTTCAAG GTATGGGAAG GCGGAATGTC GTTCCACGGC

301 GGCTTTTTGG GTGTAGTTAT TGCCATATGG TTGTTCGGTC GCAAACACGG

351 CATCGGCTTC CTCAAACTGA TGGACACGGT CGCACCGCTC GTTCCACTGG

401 GTCTCGCTTC GGGACGTATC GGCAACTTCA TCAACGGCGA ACTTTGGGGA

451 CGCGTTACCG ACATCAACGC ATTTTGGGCA ATGGGCTTCC CGCAGGCGCG

501 TTACGAAGAC CTCGAAGCCG CCGCGCACAA TCCGCTTTGG GCAGAATGGC

551 TGCAACAATA CGGTATGCTG CCGCGTCATC CCTCGCAGCT TTATCAGTTT

601 GCACTTGAAG GCATCTGCCT GTTCGCCGTC GTTTGGCTGT TCTCTAAAAA

651 ACAGCGGCCG ACCGGACAAG TCGCCTCACT CTTCCTCGGC GGCTACGGCA

701 TATTCCGCTT CATTGCCGAA TTTGCACGCC AACCCGACGA CTATCTCGGG

751 CTGCTGACCT TGGGGCTGTC GATGGGGCAA TGGTTGAGCG TCCCGATGAT

801 TGTTTTGGGT ATCGTCGGCT TTGTCCGGTT CGGCATGAAA AAACAGCACT

851 GA
```

This corresponds to the amino acid sequence <SEQ ID 534; ORF 137.a>:

```
a137.pep
   1 MITHPQFDPV LISIGPLAVR WYALSYILGF ILFTFLGRRR IAQGLSVFTK

51 ESLDDFLTWG ILGVILGGRL GYVLFYKFSD YLAHPLDIFK VWEGGMSFHG

101 GFLGVVIAIW LFGRKHGIGF LKLMDTVAPL VPLGLASGRI GNFINGELWG

151 RVTDINAFWA MGFPQARYED LEAAAHNPLW AEWLQQYGML PRHPSQLYQF

201 ALEGICLFAV VWLFSKKQRP TGQVASLFLG GYGIFRFIAE FARQPDDYLG

251 LLTLGLSMGQ WLSVPMIVLG IVGFVRFGMK KQH*
``` m137/a137 98.2% identity in 283 aa overlap

```
                 10        20        30        40        50        60
m137.pep MITHPQFDPVLISIGPLAVRWYALSYILGFILFTFLGRRRIAQGLSVFTKESLDDFLTWG
         ||||||||||||||||||||||||||||||||||||||||||||||||||||||||||||
a137     MIIHPQFDPVLISIGPLAVRWYALSYILGFILFTFLGRRRIAQGLSVFTKESLDDFLTWG
                 10        20        30        40        50        60

70        80        90       100       110       120
m137.pep ILGVILGGRLGYVLFYKFSDYLAHPLDIFKVWEGGMSFHGGFLGVVIAIRLFGRKHGIGF
         ||||||||||||||||||||||||||||||||||||||||||||||||| ||||||||||
a137     ILGVILGGRLGYVLFYKFSDYLAHPLDIFKVWEGGMSFHGGFLGVVIAIWLFGRKHGIGF
                 70        80        90       100       110       120

130       140       150       160       170       180
m137.pep LKLMDTVAPLVPLGLASGRIGNFINGELWGRVTDINAFWAMGFPQARYEDAEAAAHNPLW
         ||||||||||||||||||||||||||||||||||||||||||||||||||| |||||||||
a137     LKLMDTVAPLVPLGLASGRIGNFINGELWGRVTDINAFWAMGFPQARYEDLEAAAHNPLW
                130       140       150       160       170       180
```

-continued

```
            190        200        210        220        230        240
m137.pep  AEWLQQYGMLPRHPSQLYQFALEGICLFTVIWLFSKKQRSTGQVASLFLGGYGIFRFIAE
          ||||||||||||||||||||||||||:   :||||||||  ||||||||||||||||||||
a137      AEWLQQYGMLPRHPSQLYQFALEGICLFAVVWLFSKKQRPTGQVASLFLGGYGIFRFIAE
            190        200        210        220        230        240

250        260        270        280
m137.pep  FARQPDDYLGLLTLGLSMGQWLSVPMIVLGIVGFVRFGMKKQHX
          |||||||||||||||||||||||||||||||||||||||||||
a137      FARQPDDYLGLLTLGLSMGQWLSVPMIVLGIVGFVRFGMKKQHX
            250        260        270        280
```

The following partial DNA sequence was identified in *N. gonorrhoeae* <SEQ ID 535>:

```
g138.seq
    1 ATGGAGTTTG AAAACATTAT TTCCGCCGCc gaCAAGGCGC GTATCCTTGC

51 CGAAGCACTG CCTTACAtcc gccgGTTTTC CGGTTCGGTC GCCGTCATCA

101 AGTATGGCGG CAACGCGATG ACCGAACCTG CCTTGAAAGA AGGGTTTGCC

151 CGCGATGTCG TGCTGCTGAA GCTGGTCGGC ATTCATCCCG TCATCGTTCA

201 CGGCGGCGGG CCGCAGATCA ATGCGATGCT TGAAAAAGTC GGCAAAAAGG

251 GCGAATTTGT CCAAGGAATG CGCGTTACCG ACAAAGAGAC GATGGATATT

301 GTCGAAATGG TATTGGGCGG GCACGTCAAC AAGGAAATCG TGTCGATGAT

351 TAACACATAT GGAGGGCACG CGGTCGGCGT GAGCGGGCGC GACGACCATT

401 TCATTAAGGC GAAGAAACTT TTGGTCGATA CGCCCGAACA GAATAGCGTG

451 GACATCGGAC AGGTCGGTAC GGTGGAAAGC ATCGATACCG GTTTGGTTAA

501 AGGGCTGATA GAACGCGGCT GCATTCCCGT CGTCGCCCCC GTCGGCGTAG

551 GTGAAAAAGG CGAAGCGTTC AACATCAACG CCGATTTGGT GGCAGGCAAA

601 TTGGCGGAAG AATTGAACGC CGAAAAACTC TTGATGATGA CGAAtatcgc 651 cgGTGTGATG GACAAAACGG GCAATCTGCT GACCAAACTC acgCCGAAAC

701 GGATTGATGG GCTGATTGCC GACGGCACGC TGTATGGCGG TATGCTGCCG

751 AAAATCGCTT CTGCGGTCGA AGCcgccgtc aACGGTGTGA AAGCCACGCA

801 CATCATCGAC GGCAGGTTGC CCAACGCGCT TTTGCTGGAA ATCTTTACCG

851 ATGCCGGTAT CGGGTCGATG ATTTTAGGCA GAGGGGAAGA TGCCTGA
                                                       45
```

This corresponds to the amino acid sequence <SEQ ID 536; ORF 138.ng>:

```
g138.pep
    1 MEFENIISAA DKARILAEAL PYIRRFSGSV AVIKYGGNAM TEPALKEGFA

51 RDVVLLKLVG IHPVIVHGGG PQINAMLEKV GKKGEFVQGM RVTDKETMDI

101 VEMVLGGHVN KEIVSMINTY GGHAVGVSGR DDHFIKAKKL LVDTPEQNSV

151 DIGQVGTVES IDTGLVKGLI ERGCIPVVAP VGVGEKGEAF NINADLVAGK

201 LAEELNAEKL LMMTNIAGVM DKTGNLLTKL TPKRIDGLIA DGTLYGGMLP

251 KIASAVEAAV NGVKATHIID GRLPNALLLE IFTDAGIGSM ILGRGEDA*
                                                       60
```

The following partial DNA sequence was identified in *N. meningitidis* <SEQ ID 537>:

```
m138.seq
    1 ATGGAGTCTG AAAACATTAT TTCCGCCGCC GACAAGGCGC GTATCCTTGC

51 CGAAGCGCTG CCTTACATCC GCCGGTTTTC CGGTTCGGTC GCCGTCATCA
```

-continued

```
101 AATACGGCGG CAACGCGATG ACCGAACCTG CCTTGAAAGA AGGGTTTGCC

151 CGCGATGTCG TGCTGCTGAA GCTGGTCGGC ATTCATCCCG TCATCGTTCA

201 CGGCGGCGGG CCGCAGATCA ATGCGATGCT TGAAAAAGTC GGCAAAAAGG

251 GTGAGTTTGT CCAAGGAATG CGCGTTACCG ACAAAGAGGC GATGGATATT

301 GTCGAAATGG TGTTGGGCGG GCATGTCAAT AAAGAAATCG TGTCGATGAT

351 TAACACATAT GGCGGACACG CGGTCGGCGT AAGCGGACGC GACGACCATT

401 TCATTAAGGC GAAGAAACTT TTGATCGATA CGCCCGAACA GAATGGCGTG

451 GACATCGGAC AGGTCGGTAC GGTGGAAAGC ATCGATACCG GTTTGGTTAA

501 AGGGCTGATA GAACGTGGCT GCATTCCCGT CGTCGCCCCC GTCGGCGTAG

551 GTGAAAAAGG CGAAGCGTTC AACATCAACG CCGATTTGGT AGCAGGCAAA

601 TTGGCGGAAG AATTGAACGC CGAAAAACTC TTGATGATGA CGAATATCGC

651 CGGTGTGATG GACAAAACGG GCAATCTGCT GACCAAACTC ACGCCGAAAC

701 GGATTGATGA ACTGATTGCC GACGGCACGC TGTATGGCGG TATGCTGCCG

751 AAAATCGCTT CTGCGGTCGA AGCCGCCGTC AACGGTGTGA AAGCCACGCA

801 TATCATCGAC GGCAGGTTGC CCAACGCGCT TTTGCTGGAA ATCTTTACCG

851 ATGCCGGTAT CGGTTCGATG ATTTTGGGCG GTGGGGAAGA TGCCTGA
```

This corresponds to the amino acid sequence <SEQ ID 538; ORF 138>:

```
m138.pep
  1 MESENIISAA DKARILAEAL PYIRRFSGSV AVIKYGGNAM TEPALKEGFA

51 RDVVLLKLVG IHPVIVHGGG PQINAMLEKV GKKGEFVQGM RVTDKEAMDI

101 VEMVLGGHVN KEIVSMINTY GGHAVGVSGR DDHFIKAKKL LIDTPEQNGV

151 DIGQVGTVES IDTGLVKGLI ERGCIPVVAP VGVGEKGEAF NINADLVAGK

201 LAEELNAEKL LMMTNIAGVM DKTGNLLTKL TPKRIDELIA DGTLYGGMLP

251 KIASAVEAAV NGVKATHIID GRLPNALLLE IFTDAGIGSM ILGGGEDA*
```

Computer analysis of this amino acid sequence gave the following results:

Homology with a Predicted ORF from *N. gonorrhoeae*

ORF 138 shows 98.0% identity over a 298 aa overlap with a predicted ORF (ORF 138.ng) from *N. gonorrhoeae*:

```
m138/g138

10         20         30         40         50         60
   m138.pep  MESENIISAADKARILAEALPYIRRFSGSVAVIKYGGNAMTEPALKEGFARDVVLLKLVG
             || |||||||||||||||||||||||||||||||||||||||||||||||||||||||||
       g138  MEFENIISAADKARILAEALPYIRRFSGSVAVIKYGGNAMTEPALKEGFARDVVLLKLVG
                  10         20         30         40         50         60

70         80         90        100        110        120
   m138.pep  IHPVIVHGGGPQINAMLEKVGKKGEFVQGMRVTDKEAMDIVEMVLGGHVNKEIVSMINTY
             ||||||||||||||||||||||||||||||||||||:|||||||||||||||||||||||
       g138  IHPVIVHGGGPQINAMLEKVGKKGEFVQGMRVTDKETMDIVEMVLGGHVNKEIVSMINTY
                  70         80         90        100        110        120

130        140        150        160        170        180
   m138.pep  GGHAVGVSGRDDHFIKAKKLLIDTPEQNGVDIGQVGTVESIDTGLVKGLIERGCIPVVAP
             |||||||||||||||||||||:||||||:|||||||||||||||||||||||||||||||
       g138  GGHAVGVSGRDDHFIKAKKLLVDTPEQNSVDIGQVGTVESIDTGLVKGLIERGCIPVVAP
                 130        140        159        160        170        180
```

-continued

```
                  190        200        210        220        230        240
m138.pep  VGVGEKGEAFNINADLVAGKLAEELNAEKLLMMTNIAGVMDKTGNLLTKLTPKRIDELIA
          |||||||||||||||||||||||||||||||||||||||||||||||||||||||| |||
g138      VGVGEKGEAFNINADLVAGKLAEELNAEKLLMMTNIAGVMDKTGNLLTKLTPKRIDGLIA
                  190        200        210        220        230        240

250        260        270        280        290       299
m138.pep  DGTLYGGMLPKIASAVEAAVNGVKATHIIDGRLPNALLLEIFTDAGIGSMILGGGEDAX
          ||||||||||||||||||||||||||||||||||||||||||||||||||||| |||||
g138      DGTLYGGMLPKIASAVEAAVNGVKATHIIDGRLPNALLLEIFTDAGIGSMILGRGEDAX
                  250        260        270        280        290
```

The following partial DNA sequence was identified in *N. meningitidis* <SEQ ID 539>:

```
a138.seq
   1 ATGGAGTCTG AAAACATTAT TTCCGCCGCC GACAAGGCGC GTATCCTTGC

51 CGAAGCGCTG CCTTACATCC GCCGGTTTTC CGGTTCGGTC GCCGTCATCA

101 AATACGGCGG CAACGCGATG ACCGAACCTG CCTTGAAAGA AGGGTTTGCC

151 CGCGATGTCG TGCTGCTGAA GCTGGTCGGC ATTCATCCCG TCATCGTTCA

201 CGGCGGCGGG CCGCAGATCA ATGCGATGCT TGAAAAAGTC GGCAAAAAGG

251 GTGAGTTTGT CCAAGGAATG CGCGTTACCG ACAAAGAGGC GATGGATATT

301 GTCGAAATGG TGTTGGGCGG GCATGTCAAT AAAGAAATCG TGTCGATGAT

351 TAACACATAT GGCGGACACG CGGTCGGCGT AAGCGGACGC GACGACCATT

401 TCATTAAGGC GAAGAAACTT TTGATCGATA CGCCCGAACA GAATGGCGTG

451 GACATCGGAC AGGTCGGTAC GGTGGAAAGC ATCGATACCG GTTTGGTTAA

501 AGGGCTGATA GAACGTGGCT GCATTCCCGT CGTCGCCCCC GTCGGCGTAG

551 GTGAAAAAGG CGAAGCGTTC AACATCAACG CCGATTTGGT AGCAGGCAAA

601 TTGGCGGAAG AATTGAACGC CGAAAAACTC TTGATGATGA CGAATATCGC

651 CGGTGTGATG GACAAAACGG GCAATCTGCT GACCAAACTC ACGCCGAAAC

701 GGATTGATGA ACTGATTGCC GACGGCACGC TGTATGGCGG TATGCTGCCG

751 AAAATCGCTT CTGCGGTCGA AGCCGCCGTC AACGGCGTGA AAGCCACGCA

801 TATCATCGAC GGCAGGGTGC CCAACGCGCT TTTGCTGGAA ATCTTTACCG

851 ATGCCGGTAT CGGTTCGATG ATTTTGGGCG GTGGGGAAGA TGCCTGA
```

This corresponds to the amino acid sequence <SEQ ID 540; ORF 138.a>:

```
a138.pep
   1 MESENIISAA DKARILAEAL PYIRRFSGSV AVIKYGGNAM TEPALKEGFA

51 RDVVLLKLVG IHPVIVHGGG PQINAMLEKV GKKGEFVQGM RVTDKEAMDI

101 VEMVLGGHVN KEIVSMINTY GGHAVGVSGR DDHFIKAKKL LIDTPEQNGV

151 DIGQVGTVES IDTGLVKGLI ERGCIPVVAP VGVGEKGEAF NINADLVAGK

201 LAEELNAEKL LMMTNIAGVM DKTGNLLTKL TPKRIDELIA DGTLYGGMLP

251 KIASAVEAAV NGVKATHIID GRVPNALLLE IFTDAGIGSM ILGGGEDA*
``` m138/a138 99.7% identity in 298 aa overlap

```
                  10         20         30         40         50         60
m138.pep  MESENIISAADKARILAEALPYIRRFSGSVAVIKYGGNAMTEPALKEGFARDVVLLKLVG
          ||||||||||||||||||||||||||||||||||||||||||||||||||||||||||||
g138      MESENIISAADKARILAEALPYIRRFSGSVAVIKYGGNAMTEPALKEGFARDVVLLKLVG
                  10         20         30         40         50         60
```

-continued

```
               70         80         90        100        110        120
m138.pep  IHPVIVHGGGPQINAMLEKVGKKGEFVQGMRVTDKEAMDIVEMVLGGHVNKEIVSMINTY
          ||||||||||||||||||||||||||||||||||||||||||||||||||||||||||||
g138      IHPVIVHGGGPQINAMLEKVGKKGEFVQGMRVTDKEAMDIVEMVLGGHVNKEIVSMINTY
               70         80         90        100        110        120

130        140        150        160        170        180
m138.pep  GGHAVGVSGRDDHFIKAKKLLIDTPEQNGVDIGQVGTVESIDTGLVKGLIERGCIPVVAP
          ||||||||||||||||||||||||||||||||||||||||||||||||||||||||||||
g138      GGHAVGVSGRDDHFIKAKKLLIDTPEQNGVDIGQVGTVESIDTGLVKGLIERGCIPVVAP
              130        140        159        160        170        180

190        200        210        220        230        240
m138.pep  VGVGEKGEAFNINADLVAGKLAEELNAEKLLMMTNIAGVMDKTGNLLTKLTPKRIDELIA
          |||||||||||||||||||||||||||||||||||||||||||||||||||||||| |||
g138      VGVGEKGEAFNINADLVAGKLAEELNAEKLLMMTNIAGVMDKTGNLLTKLTPKRIDGLIA
              190        200        210        220        230        240

250        260        270        280        290        299
m138.pep  DGTLYGGMLPKIASAVEAAVNGVKATHIIDGRLPNALLLEIFTDAGIGSMILGGGEDAX
          ||||||||||||||||||||||||||||||||||||:|||||||||||||||||||||
g138      DGTLYGGMLPKIASAVEAAVNGVKATHIIDGRVPNALLLEIFTDAGIGSMILGGGEDAX
              250        260        270        280        290
```

The following partial DNA sequence was identified in *N. gonorrhoeae* <SEQ ID 541>:

```
g139.seq
  1 ATGCGAACCA CCTCAACCTT CCCTACAAAA ACTTTCAAAC CGGCTGCCAT

51 GGCGTTAGCT GTTGCAACAA CACTTTCTGC CTGCTTAggc ggcggcggag 101 gcGGCACTTC TGCTCCCGAC TTTAATGCAG GCGGCACCGG TATCGGCAGC

151 AACAGCAGGG CAACGATAGC GGAATCAGCA GCAGTATCTT ACGCCGGTAT

201 AAAAAACGAA ATGTGCAAAG ACAGAAGCAT GCTCTGTGCC GGTCGGGATG

251 ACGTTGCGGT TACAGACAGG GATGCCAAAA TCAAAGCCCC CCGAATCTGC

301 ATACCGGAGA CTTTTCAAAC CCAAATGACC AATATTAAGA ATATGATCAA

351 CCTCAAACCT GCAATTGAAG CAGGCTATAC AGGACGCGGG GTAGAGGTAG

401 GTATCGTCGA TACAGGCGAA TCCGTCGGCA GCATATCCTT TCCCGAACTG

451 TATGGCAGAA AAGAACACGG CTATAACGAA AATTACAAAA ACAAATTACA

501 AAAACTATAC GGCGTATATG CGGAAGGAAG CGCCTGA
```

This corresponds to the amino acid sequence <SEQ ID 542; ORF 138.ng>:

```
g139.pep
  1 MRTTSTFPTK TFKPAAMALA VATTLSACLG GGGGGTSAPD FNAGGTGIGS

51 NSRATIAESA AVSYAGIKNE MCKDRSMLCA GRDDVAVTDR DAKIKAPRIC

101 IPETFQTQMT NIKNMINLKP AIEAGYTGRG VEVGIVDTGE SVGSISFPEL

151 YGRKEHGYNE NYKNKLQKLY GVYAEGSA*
```

The following partial DNA sequence was identified in *N. meningitidis* <SEQ ID 543>:

```
m139.seq
  1 ATGCGAACGA CCCCAACCTT CCCTACAAAA ACTTTCAAAC CGACTGCCAT

51 GGCGTTAGCT GTTGCAACAA CACTTTCTGC CTGCTTAGGC GGCGGCGGAG

101 GCGGCACTTC TGCGCCCGAC TTCAATGCAG GCGGTACCGG TATCGGCAGC

151 AACAGCAGAG CAACAACAGC GAAATCAGCA GCAGTATCTT ACGCCGGTAT
```

```
                       -continued
201 CAAGAACGAA ATGTGCAAAG ACAGAAGCAT GCTCTGTGCC GGTCGGGATG

251 ACGTTGCGGT TACAGACAGG GATGCCAAAA TCAATGCCCC CCCCCGAATC

301 TGCATACCGG AGACTTTCCA AACCCAAATG ACGCATtACA AGAATTTGAT

351 CAACCTCAAA CCTGCAATTG AAGCAGGCTA TACAGGACGC GGGGTAGAGG

401 TAGGTATCGT CGACACAGGC GAATCCGTCG GCAGCATATC CTTTCCCGAA

451 CTGTATGGCA GAAAAGAACA CGGCTATAAC GAAAATTACG AAAAACTATA

501 CGGCGTATAT GCGGAAGGAA GCGCCTGA
```

This corresponds to the amino acid sequence <SEQ ID 544; ORF 138>:

```
m139.pep
  1 MRTTPTFPTK TFKPTAMALA VATTLSACLG GGGGGTSAPD FNAGGTGIGS

51 NSRATTAKSA AVSYAGIKNE MCKDRSMLCA GRDDVAVTDR DAKINAPPRI

101 CIPETFQTQM THYKNLINLK PAIEAGYTGR GVEVGIVDTG ESVGSISFPE

151 LYGRKEHGYN ENYEKLYGVY AEGSA*
```

Computer analysis of this amino acid sequence gave the following results:
Homology with a Predicted ORF from *N. gonorrhoeae*
ORF 138 shows 92.2% identity over a 179 aa overlap with a predicted ORF (ORF 138.ng) from *N. gonorrhoeae*:

```
   m139/g139
                    10         20         30         40         50         60
    m139.pep  MRTTPTFPTKTFKPTAMALAVATTLSACLGGGGGGTSAPDFNAGGTGIGSNSRATTAKSA
              |||||||  ||||||:||||||||||||||||||||||||||||||||||||||||:||
        g139  MRTTSTFPTKTFKPAAMALAVATTLSACLGGGGGGTSAPDFNAGGTGIGSNSRATIAESA
                    10         20         30         40         50         60
                    70         80         90        100        110        120
    m139.pep  AVSYAGIKNEMCKDRSMLCAGRDDVAVTDRDAKINAPPRICIPETFQTQMTHYKNLINLK
              ||||||||||||||||||||||||||||||||||:|| |||||||||||||: ||:||||
        g139  AVSYAGIKNEMCKDRSMLCAGRDDVAVTDRDAKIKAP-RICIPETFQTQMTNIKNMINLK
                    70         80         90        100        110
                   130        140        150        160        170
    m139.pep  PAIEAGYTGRGVEVGIVDTGESVGSISFPELYGRKEHGYNENY----EKLYGVYAEGSAX
              ||||||||||||||||||||||||||||||||||||||||||||    :|||||||||||
        g139  PAIEAGYTGRGVEVGIVDTGESVGSISFPELYGRKEHGYNENYKNLQKLYGVYAEGSAX
                   120        130        140        150        160        170
```

The following partial DNA sequence was identified in *N. meningitidis* <SEQ ID 545>:

```
a139.seq
  1 ATGCGAACGA CCCCAACCTT CCCTACAAAA ACTTTCAAAC CGGCTGCCAT

51 GGCGTTAGCT GTTGCAACAA CACTTTCTGC CTGCTTAGGC GGCGGCGGAG

101 GCGGCACTTC TGCGCCCGAC TTCAATGCAG GCGGCACCGG TATCGGCAGC

151 AACAGCAGGG CAACAACAGC GAAATCAGCA GCAATATCTT ACGCCGGTAT

201 CAAGAACGAA ATGTGCAAAG ACAGAAGCAT GCTCTGTGCC GGTCGGGATG

251 ACGTTGCGGT TACAGACAGG GATGCCAAAA TCAATGCCCC CCCCCGAATC

301 TGCATACCGG AGACTTTACA AACCCAAATG ACGCAT.ACA AGAATTTGAT

351 CAACCTCAAA CCTGCAATTG AAGCAGGCTA TACAGGACGC GGGGTAGAGG

401 TAGGTATCGT CGACACAGGC GAATCCGTCG GCAGCATATC CTTTCCCGAA
```

-continued

```
451 CTGTATGGCA GAAAAGAACA CGGCTATAAC GAAAATTAC. AAAAACTATA

501 CGGCGTATAT GCGGAAGGAA GCGCCTGA
```

This corresponds to the amino acid sequence <SEQ ID 546; ORF 139.a>:

```
a139.pep
  1 MRTTPTFPTK TFKPAAMALA VATTLSACLG GGGGGTSAPD FNAGGTGIGS

51 NSRATTAKSA AISYAGIKNE MCKDRSMLCA GRDDVAVTDR DAKINAPPRI

101 CIPETLQTQM THXKNLINLK PAIEAGYTGR GVEVGIVDTG ESVGSISFPE

151 LYGRKEHGYN ENYXKLYGVY AEGSA*
``` m139/a139 97.1% identity in 175 aa overlap

```
                 10        20        30        40        50        60
  m139.pep MRTTPTFPTKTFKPTAMALAVATTLSACLGGGGGGTSAPDFNAGGTGIGSNSRATTAKSA
           ||||||||||||:|||||||||||||||||||||||||||||||||||||||||||||||
      a139 MRTTPTFPTKTFKPAAMALAVATTLSACLGGGGGGTSAPDFNAGGTGIGSNSRATTAKSA
                 10        20        30        40        50        60
                 70        80        90       100       110       120
  m139.pep AVSYAGIKNEMCKDRSMLCAGRDDVAVTDRDAKINAPPRICIPETFQTQMTHYKNLINLK
           |:||||||||||||||||||||||||||||||||||||||||||||:||||| |||||||
      a139 AISYAGIKNEMCKDRSMLCAGRDDVAVTDRDAKINAPPRICIPETLQTQMTHXKNLINLK
                 70        80        90       100       110       120
                130       140       150       160       170
  m139.pep PAIEAGYTGRGVEVGIVDTGESVGSISFPELYGRKEHGYNENYEKLYGVYAEGSAX
           ||||||||||||||||||||||||||||||||||||||||||| ||||||||||||
      a139 PAIEAGYTGRGVEVGIVDTGESVGSISFPELYGRKEHGYNENYXKLYGVYAEGSAX
                130       140       150       160       170
```

The following partial DNA sequence was identified in *N. gonorrhoeae* <SEQ ID 547>:

```
g140.seq
  1 Atgtcggcac gCGGCAAGGG GGCAGgctat ctcAACAGTA CCGGACGACa

51 TGTTCCCTTC CTGAGTGCCG CCAAAATCGG GCAGGATTAT TCTTTCTTCA

101 AAAATATCAA AACCGACGGC GGTCTGCTGG CTTCCCTCGA CAGCGTCGAA

151 AAAACAGCGG GCAGTGAAGG CGACACGCCG TCCTATTATG TCCGTCGCGG

201 CAATGCGGCA CGGACTGCTT CGGCAGCGGC ACATTCCGCG CCCGCCGGTC

251 TGAAACACGC CGTAGAACAG GGCGGCAGCA ATCTGGAAAA CCTGATGGTC

301 GAGCTGGATG CCTCCGAATC ATCCGCAACA CCCGAGACGG TTGAAACTGC

351 GGTCGCCGAC CGCACAGATA TGCCGGGCAT CCGCCTACGG CGCACAACTT

401 TCCGCACAGC GGCAGCCGTA CAGCATGCGA ATACCGCCGA CGGCGTACGc 451 aTCTTcaaCA GTCTCGCCGC TAccgTCTAt GccgACAGTG CCGCCGCCCA 501 TGccgATATG CAGGGACGCC GCCTGAAAGC CGTATCGGAC GGGTTGGACC

551 ACAACGGTAC GGGTCTGCGC GTCATCGCGC AAACCCAACA GGACGGTGGA

601 ACGTGGGAAC AGGGCGGTGT CGAAGGCAAA ATGCGCGGCA GTACCCAAAC

651 TATCGGCATT GCCGCGAAAA CCGGCGAAAA TACGACAGCA GCCGCCACAC

701 TGGGCATAGG ACGCAGCACA TGGAGCGAAA ACAGTGCAAA TGCAAAAACC

751 GACAGCATTA GTCTGTTTGC AGGCATACGG CACGATGTGG GCGATATCGG

801 CTATCTCAAA GGCCTGTTCT CctaCGGACG CTACAAAAAC AGCATCAGCC
```

```
 851 GCAGCACCGG TGCGGATGAA TATGCGGAAG GCAGCGTCAA CGGCACGCTG

901 ATGCAGCTGG GCGCACTGGG TGGTGTCAAC GTTCCGTTTG CCGCAACGGG

951 AGATTTGACG GTTGAAGGCG GTCTGCGCCA CGACCTGCTC AAACAGGATG

1001 CATTCGCCGA AAAAGGCagt GCTTTGGGCT GGAGCGGCAA CAGCCTCACT

1051 GAAGGCACAC TGGTCGGACT CGCGGGTCTG AAACTGTCGC AACCCTTGAG

1101 CGATAAAGCC GTCCTGTCTG CGACGGCGGG CGTGGAACGC GACCTGAACG

1151 GACGCGACTA CGCGGTAACG GGCGGCTTTA CCGGCGCGGC TGCAGCAACC

1201 GGCAAGACGG GTGCACGCAA TATGCCGCAC ACCCGCCGGG TTGCCGGTCT

1251 GGGGGTGGAT GTCGAATTCG GCAACGGCTG GAACGGCTTG GCACGTTACA

1301 GCTACACCGG TTCCAAACAG TACGGCAACC ACAGCGGACA AATCGGCGTA

1351 GGCTACCGGT TCTGA
```

This corresponds to the amino acid sequence <SEQ ID 548; ORF 140.ng>:

```
g140.pep
   1 MSARGKGAGY LNSTGRHVPF LSAAKIGQDY SFFKNIKTDG GLLASLDSVE

51 KTAGSEGDTP SYYVRRGNAA RTASAAAHSA PAGLKHAVEQ GGSNLENLMV

101 ELDASESSAT PETVETAVAD RTDMPGIRLR RTTFRTAAAV QHANTADGVR

151 IFNSLAATVY ADSAAAHADM QGRRLKAVSD GLDHNGTGLR VIAQTQQDGG

201 TWEQGGVEGK MRGSTQTIGI AAKTGENTTA AATLGIGRST WSENSANAKT

251 DSISLFAGIR HDVGDIGYLK GLFSYGRYKN SISRSTGADE YAEGSVNGTL

301 MQLGALGGVN VPFAATGDLT VEGGLRHDLL KQDAFAEKGS ALGWSGNSLT

351 EGTLVGLAGL KLSQPLSDKA VLSATAGVER DLNGRDYAVT GGFTGAAAAT

401 GKTGARNMPH TRRVAGLGVD VEFGNGWNGL ARYSYTGSKQ YGNHSGQIGV

451 GYRF*
```

The following partial DNA sequence was identified in N. meningitidis <SEQ ID 549>:

```
m140.seq
   1 ATGTCGGCAC GCGGCAAGGG GGCAGGCTAT CTCAACAGTA CCGGACGACG

51 TGTTCCCTTC CTGAGTGCCG CCAAAATCGG GCAGGATTAT TCTTTCTTCA

101 CAAACATCGA AACCGACGGC GGCCTGCTGG CTTCCCTCGA CAGCGTCGAA

151 AAAACAGCGG GCAGTGAAGG CGACACGCTG TCCTATTATG TCCGTCGCGG

201 CAATGCGGCA CGGACTGCTT CGGCAGCGGC ACATTCCGCG CCCGCCGGTC

251 TGAAACACGC CGTAGAACAG GGCGGCAGCA ATCTGGAAAA CCTGATGGTC

301 GAACTGGATG CCTCCGAATC ATCCGCAACA CCCGAGACGG TTGAAACTGC

351 GGCAGCCGAC CGCACAGATA TGCCGGGCAT CCGCCCCTAC GGCGCAACTT

401 TCCGCGCAGC GGCAGCCGTA CAGCATGCGA ATGCCGCCGA CGGTGTACGC

451 ATCTTCAACA GTCTCGCCGC TACCGTCTAT GCCGACAGTA CCGCCGCCCA

501 TGCCGATATG CAGGGACGCC GCCTGAAAGC CGTATCGGAC GGGTTGGACC

551 ACAACGGCAC GGGTCTGCGC GTCATCGCGC AAACCCAACA GGACGGTGGA

601 ACGTGGGAAC AGGGCGGTGT TGAAGGCAAA ATGCGCGGCA GTACCCAAAC
```

-continued
```
 651 CGTCGGCATT GCCGCGAAAA CCGGCGAAAA TACGACAGCA GCCGCCACAC

701 TGGGCATGGG ACGCAGCACA TGGAGCGAAA ACAGTGCAAA TGCAAAAACC

751 GACAGCATTA GTCTGTTTGC AGGCATACGG CACGATGCGG GCGATATCGG

801 CTATCTCAAA GGCCTGTTCT CCTACGGACG CTACAAAAAC AGCATCAGCC

851 GCAGCACCGG TGCGGACGAA CATGCGGAAG GCAGCGTCAA CGGCACGCTG

901 ATGCAGCTGG GCGCACTGGG CGGTGTCAAC GTTCCGTTTG CCGCAACGGG

951 AGATTTGACG GTCGAAGGCG GTCTGCGCTA CGACCTGCTC AAACAGGATG

1001 CATTCGCCGA AAAAGGCAGT GCTTTGGGCT GGAGCGGCAA CAGCCTCACT

1051 GAAGGCACGC TGGTCGGACT CGCGGGTCTG AAGCTGTCGC AACCCTTGAG

1101 CGATAAAGCC GTCCTGTTTG CAACGGCGGG CGTGGAACGC GACCTGAACG

1151 GACGCGACTA CACGGTAACG GGCGGCTTTA CCGGCGCGAC TGCAGCAACC

1201 GGCAAGACGG GGGCACGCAA TATGCCGCAC ACCCGTCTGG TTGCCGGCCT

1251 GGGCGCGGAT GTCGAATTCG GCAACGGCTG GAACGGCTTG GCACGTTACA

1301 GCTACGCCGG TTCCAAACAG TACGGCAACC ACAGCGGACG AGTCGGCGTA

1351 GGCTACCGGT TCTGA
```

This corresponds to the amino acid sequence <SEQ ID 550; ORF 140>:

```
m140.pep
   1 MSARGKGAGY LNSTGRRVPF LSAAKIGQDY SFFTNIETDG GLLASLDSVE

51 KTAGSEGDTL SYYVRRGNAA RTASAAAHSA PAGLKHAVEQ GGSNLENLMV

101 ELDASESSAT PETVETAAAD RTDMPGIRPY GATFRAAAAV QHANAADGVR

151 IFNSLAATVY ADSTAAHADM QGRRLKAVSD GLDHNGTGLR VIAQTQQDGG

201 TWEQGGVEGK MRGSTQTVGI AAKTGENTTA AATLGMGRST WSENSANAKT

251 DSISLFAGIR HDAGDIGYLK GLFSYGRYKN SISRSTGADE HAEGSVNGTL

301 MQLGALGGVN VPFAATGDLT VEGGLRYDLL KQDAFAEKGS ALGWSGNSLT

351 EGTLVGLAGL KLSQPLSDKA VLFATAGVER DLNGRDYTVT GGFTGATAAT

401 GKTGARNMPH TRLVAGLGAD VEFGNGWNGL ARYSYAGSKQ YGNHSGRVGV

451 GYRF*
```

Computer analysis of this amino acid sequence gave the following results:
Homology with a Predicted ORF from *N. gonorrhoeae*
ORF 140 shows 94.5% identity over a 454 aa overlap with a predicted ORF (ORF 140.ng) from *N. gonorrhoeae*:

```
    m140/g140

10         20         30         40         50         60
        m140.pep  MSARGKGAGYLNSTGRRVPFLSAAKIGQDYSFFTNIETDGGLLASLDSVEKTAGSEGDTL
                  ||||||||||||||||:|||||||||||||||| |:|||||||||||||||||||||||||
        g140      MSARGKGAGYLNSTGRHVPFLSAAKIGQDYSFFKNIKTDGGLLASLDSVEKTAGSEGDTP
                     10         20         30         40         50         60

70         80         90        100        110        120
        m140.pep  SYYVRRGNAARTASAAAHSAPAGLKHAVEQGGSNLENLMVELDASESSATPETVETAAAD
                  ||||||||||||||||||||||||||||||||||||||||||||||||||||||||||:||
        g140      SYYVRRGNAARTASAAAHSAPAGLKHAVEQGGSNLENLMVELDASESSATPETVETAVAD
                     70         80         90        100        110        120
```

-continued

```
                130       140       150       160       170       180
m140.pep RTDMPGIRPYGATFRAAAAVQHANAADGVRIFNSLAATVYADSTAAHADMQGRRLKAVSD
         ||||||||   :|||:||||||||:|||||||||||||||||:|||||||||||||||||
g140     RTDMPGIRLRRTTFRTAAAVQHANTADGVRIFNSLAATVYADSAAAHADMQGRRLKAVSD
                130       140       150       160       170       180

190       200       210       220       230       240
m140.pep GLDHNGTGLRVIAQTQQDGGTWEQGGVEGKMRGSTQTVGIAAKTGENTTAAATLGMGRST
         |||||||||||||||||||||||||||||||||||||:|||||||||||||||||:||||
g140     GLDHNGTGLRVIAQTQQDGGTWEQGGVEGKMRGSTQTIGIAAKTGENTTAAATLGIGRST
                190       200       210       220       230       240

250       260       270       280       290       300
m140.pep WSENSANAKTDSISLFAGIRHDAGDIGYLKGLFSYGRYKNSISRSTGADEHAEGSVNGTL
         ||||||||||||||||||||||:|||||||||||||||||||||||||||:|||||||||
g140     WSENSANAKTDSISLFAGIRHDVGDIGYLKGLFSYGRYKNSISRSTGADEYAEGSVNGTL
                250       260       270       280       290       300

310       320       330       340       350       360
m140.pep MQLGALGGVNVPFAATGDLTVEGGLRYDLLKQDAFAEKGSALGWSGNSLTEGTLVGLAGL
         ||||||||||||||||||||||||||:|||||||||||||||||||||||||||||||||
g140     MQLGALGGVNVPFAATGDLTVEGGLRHDLLKQDAFAEKGSALGWSGNSLTEGTLVGLAGL
                310       320       330       340       350       360

370       380       390       400       410       420
m140.pep KLSQPLSDKVALFATAGVERDLNGRDYTVTGGFTGATAATGKTGARNMPHTRLVAGLGAD
         |||||||||||| ||||||||||||||:||||||||:||||||||||||||| |||||:|
g140     KLSQPLSDKAVLSATAGVERDLNGRDYAVTGGFTGAAAATGKTGARNMPHTRRVAGLGVD
                370       380       390       400       410       420

430       440       450
m140.pep VEFGNGWNGLARYSYAGSKQYGNHSGRVGVGYRFX
         |||||||||||||||:||||||||||::|||||||
g140     VEFGNGWNGLARYSYTGSKQYGNHSGQIGVGYRFX
                430       440       450
```

The following partial DNA sequence was identified in *N. meningitidis* <SEQ ID 551>:

```
a140.seq
   1 ATGTCGGCAG GCGGTAAGGG GGCAGGCTAT CTCAACCGTA CCGGACAACG

51 TGTTCCCTTC CTGAGTGCCG CCAAAATCGG GCGGGATTAT TCTTTCTTCA

101 CAAACATCGA AACCGACGGC GGTCTGCTGG CTTCCCTCGA CAGCGTCGAA

151 AAAACAGCGG GTAGTGAAGG CGACACGCTG TCCTATTATG TCCGTCGCGG

201 CAATGCGGCA CGGACTGCTT CGGCAGCGGC ACATTCCGCG CCCGCCGGTC

251 TGAAACACGC CGTAGAACAG GGCGGCAGCA ATCTGGAAAA CCTGATGGTC

301 GAACTGGATG CCTCCGAATC ATCCGCAACA CCCGAGACGG TTGAAACTGC

351 GGCCGCCGAC CGCACAGATA TGCCGGGCAT CCGCCCCTAC GGCGCAACTT

401 TCCGCGCAGC GGCAGCCGTA CAGCATGCGA ATGCCGCCGA CGGTGTACGC

451 ATCTTCAACA ATCTCGCCGC TACCGTCTAT GCCGACAGTA CCGCCGCCCA

501 TGCCGATATG CAGGGACGCC GCCTGAAAGC CGTATCGGAC GGGTTGGACC

551 ACAACGCTAC GGGTCTGCGC GTCATCGCGC AAACCCAACA GGACGGTGGA

601 ACGTGGGAAC AGGGCGGTGT TGAAGGCAAA ATGCGCGGCA GTACCCAAAC

651 CGTCGGCATT GCCGCGAAAA CCGGCGAAAA TACGACAGCA GCCGCCACAC

701 TGGGCATGGG ACACAGCACA TGGAGCGAAA ACAGTGCAAA TGCAAAAACC

751 GACAGCATTA GTCTGTTTGC AGGCATACGG CACGATGCGG GCGATATCGG

801 CTATCTCAAA GGCCTGTTCT CCTACGGACG CTACAAAAAC AGCATCAGCC

851 GCAGCACCGG TGCGGACGAA CATGCGGAAG GCAGCGTCAA CGGCACGCTG

901 ATGCAGCTGG GCGCACTGGG CGGTGTCAAC GTTCCGTTTG CCGCAACGGG

951 AGATTTGACG GTCGAAGGCG GTCTGCGCTA CGACCTGCTC AAACAGGATG

1001 CATTCGCCGA AAAAGGCAGT GCTTTGGGCT GGAGCGGCAA CAGCATCACT
```

```
-continued
1051 GAAGGCACAC TGGTCGGACT CGCGGGTCTG AAGCTGTCGC AACCCTTGAG

1101 CGATAAAGCC GTCCTGTTTG CAACGGCGGG CGTGGAACGC GACCTGAACG

1151 GACGCGACTA CACGGTAACG GGCGGCTTTA CCGGCGCGAC TGCAGCAACC

1201 GGCAAGACGG GGGCACGCAA TATGCCGCAC ACCCGCCTGG TTGCCGGTCT

1251 GGGCGCGGAT GTCGAATTCG GCAACGGCTG GAACGGCTTG GCACGTTACA

1301 GCTACGCCGG TTCCAAACAG TACGGCAACC ACAGCGGACG AGTCGGCGTA

1351 GGCTACCGGT TCTGA
```

This corresponds to the amino acid sequence <SEQ ID 552; ORF 140.a>:

```
a140.pep
    1 MSAGGKGAGY LNRTGQRVPF LSAAKIGRDY SFFTNIETDG GLLASLDSVE

51 KTAGSEGDTL SYYVRRGNAA RTASAAAHSA PAGLKHAVEQ GGSNLENLMV

101 ELDASESSAT PETVETAAAD RTDMPGIRPY GATFRAAAAV QHANAADGVR

151 IFNNLAATVY ADSTAAHADM QGRRLKAVSD GLDHNATGLR VIAQTQQDGG

201 TWEQGGVEGK MRGSTQTVGI AAKTGENTTA AATLGMGHST WSENSANAKT

251 DSISLFAGIR HDAGDIGYLK GLFSYGRYKN SISRSTGADE HAEGSVNGTL

301 MQLGALGGVN VPFAATGDLT VEGGLRYDLL KQDAFAEKGS ALGWSGNSIT

351 EGTLVGLAGL KLSQPLSDKA VLFATAGVER DLNGRDYTVT GGFTGATAAT

401 GKTGARNMPH TRLVAGLGAD VEFGNGWNGL ARYSYAGSKQ YGNHSGRVGV

451 GYRF*
``` m140/a140 98.2% identity in 454 aa overlap

```
                  10         20         30         40         50         60
m140.pep  MSARGKGAGYLNSTGRRVPFLSAAKIGQDYSFFTNIETDGGLLASLDSVEKTAGSEGDTL
          ||| ||||||||| ||:||||||||||||:|||||||||||||||||||||||||||||
a140      MSAGGKGAGYLNRTGQRVPFLSAAKIGRDYSFFTNIETDGGLLASLDSVEKTAGSEGDTL
                  10         20         30         40         50         60

70         80         90        100        110        120
m140.pep  SYYVRRGNAARTASAAAHSAPAGLKHAVEQGGSNLENLMVELDASESSATPETVETAAAD
          ||||||||||||||||||||||||||||||||||||||||||||||||||||||||||||
a140      SYYVRRGNAARTASAAAHSAPAGLKHAVEQGGSNLENLMVELDASESSATPETVETAAAD
                  70         80         90        100        110        120

130        140        150        160        170        180
m140.pep  RTDMPGIRPYGATFRAAAAVQHANAADGVRIFNSLAATVYADSTAAHADMQGRRLKAVSD
          |||||||||||||||||||||||||||||||:||||||||||||||||||||||||||||
a140      RTDMPGIRPYGATFRAAAAVQHANAADGVRIFNNLAATVYADSTAAHADMQGRRLKAVSD
                 130        140        150        160        170        180

190        200        210        220        230        240
m140.pep  GLDHNGTGLRVIAQTQQDGGTWEQGGVEGKMRGSTQTVGIAAKTGENTTAAATLGMGRST
          |||||:||||||||||||||||||||||||||||||||||||||||||||||||||||:||
a140      GLDHNATGLRVIAQTQQDGGTWEQGGVEGKMRGSTQTVGIAAKTGENTTAAATLGMGHST
                 190        200        210        220        230        240

250        260        270        280        290        300
m140.pep  WSENSANAKTDSISLFAGIRHDAGDIGYLKGLFSYGRYKNSISRSTGADEHAEGSVNGTL
          ||||||||||||||||||||||||||||||||||||||||||||||||||||||||||||
a140      WSENSANAKTDSISLFAGIRHDAGDIGYLKGLFSYGRYKNSISRSTGADEHAEGSVNGTL
                 250        260        270        280        290        300

310        320        330        340        350        360
m140.pep  MQLGALGGVNVPFAATGDLTVEGGLRYDLLKQDAFAEKGSALGWSGNSLTEGTLVGLAGL
          ||||||||||||||||||||||||||||||||||||||||||||||||:|||||||||||
a140      MQLGALGGVNVPFAATGDLTVEGGLRYDLLKQDAFAEKGSALGWSGNSITEGTLVGLAGL
                 310        320        330        340        350        360
```

```
                    370        380        390        400        410        420
m140.pep    KLSQPLSDKAVLFATAGVERDLNGRDYTVTGGFTGATAATGKTGARNMPHTRLVAGLGAD
            ||||||||||||||||||||||||||||||||||||||||||||||||||||||||||||
a140        KLSQPLSDKAVLFATAGVERDLNGRDYTVTGGFTGATAATGKTGARNMPHTRLVAGLGAD
                    370        380        390        400        410        420

430        440        450
m140.pep    VEFGNGWNGLARYSYAGSKQYGNHSGRVGVGYRFX
            ||||||||||||||||||||||||||||||||||
a140        VEFGNGWNGLARYSYAGSKQYGNHSGRVGVGYRFX
                    430        440        450
```

The following partial DNA sequence was identified in *N. gonorrhoeae* <SEQ ID 553>:

```
g141.seq
    1 atgagcttca aAAccgATGC CGAAACCGCC CAATCCTCCA CCATGCGCCC

51 GATTGGCGAA ATTGCCGCCA AGCTGGGTTT GAACGTTGAC AACATTGAGC

101 CTTACGGTCA TTACAAAGCC AAAATCAATC CTGCCGAAGC GTTCAAGCTG

151 CCGCAAAAAC AAGGCAGGCT GATTTTGGTT ACCGCCATCA ACCCGACTCC

201 GGCGGGCGAA GGCAAAACCA CCGTAACCAT CGGTTTGGCG GACGCATTGC

251 GCCATATCGG CAAAGACTCT GTGATTGCTT TGCGCGAGCC TTCTTTGGGT

301 CCGGTGTTCG GCGTGAAAGG CGGCGCGGCA GGCGGCGGCT ACGCGCAAGT

351 TTTGCCGATG GAAGACATCA ACCTGCACTT CACCGGCGAC TTCCACGCCA

401 TCGGTGCGGC GAATAACCTC CTCGCCGCCA TGCTCGACAA CCATATCTAC

451 CAAGGTAACG AGTTGAACAT CGACCCCAAA CGCGTGCTGT GGCGGCGCGT

501 GGTCGATATG AACGACCGCC AGTTGCGCAA CATCATCGAC GGTATGGGCA

551 AGCCTGTtga cggCGTGATG CGtcccGACG GCTTCGACAT CACCGTCGCC

601 TCCGAAGTGa tggcgGTATT CTGCCTTGCC AAAGACATCA GCGATTTGAA

651 AGAGCGTTtt gGCAATATTC TCGTCGCCTA CGCCAAAGAC GGCAGCCCCG

701 TTTACGCCAA AGATTTGAAG CACACGGCG CGATGGCGGC ATTGCTAAAA

751 GATGCGATTA AGCCCAATTT GGTGCAAACC ATCGAAGGCA CTCCGGCCTT

801 TGTACACGGC GGCCCGTTCG CCAACATCGC CCACGGCTGC AACTCCGTTA

851 CCGCAACCCG TCTGGCGAAA CACCTTGCCG ATTACGCCGT AACCGAAGCA

901 GGCTTCGGCG CGGACTTGGG TGCGGAAAAA TTCTGCGACA TCAAATGCCG

951 CCTTGCCGGT TTGAAACCTG ATGCGGCAGT CGTCGTGGCG ACTGTCCGCG

1001 CCCTGAAATA CAACGGCGGC GTGGAACGCG CCAACCTTGG TGAAGAAAAC

1051 CTCGAAGCCT TGGCAAAAGG TTTGCCCAAC CTGTTGAAAC ACATTTCCAA

1101 CCTGAAAAAC GTATTCGGAC TGCCCGTCGT CGTTGCGCTC AACCGCTTCG

1151 TGTCCGACTC CGATGCCGAG TTGGCGATGA TTGAAAAAGC CTGTGCCGAA

1201 CACGGCGTTG AAGTTTCCCT GACCGAAGTG TGGGGCAAAG CGGCGCGGG

1251 CGGCGCGGAT TTGGCGCGCA AAGTCGTCAA TGCCATCGAC AACCAACCTA

1301 ATAACTTCGG TTTCGCCTAC GATGTCGAGT TGGGCATCAA AGACAAAATC

1351 CGTGCGATTG CCCAAAAAGT GTACGGCGCG GAAGATGTCG ATTTCAGCGC

1401 GGAAGCGTCT GCCGAAATCG CCTCGCTGGA AAAACTGGGC TTGGACAAAA

1451 TGCCGATCTG CATGGCGAAA ACCCAATATT CATTGAGCGA CAACGCCAAA

1501 CTCTTGGGCT GCCCCGAAGG CTTCCGCATC GCCGTACGCG GTATCACTGT
```

-continued
```
1551 TTCCGCCGGC GCGGGCTTCA TCGTTGCGTT GTGCGGCAAT ATGATGAAAA

1601 TGCCGGGCCT GCCGAAAGTT CCGGCTGCCG AGAAAATCGA TGTGGACGAA

1651 CACGGCGTGA TTCACGGCTT GTTCTGA
```

This corresponds to the amino acid sequence <SEQ ID 554; ORF 141.ng>:

```
g141.pep
    1 MSFKTDAETA QSSTMRPIGE IAAKLGLNVD NIEPYGHYKA KINPAEAFKL

51 PQKQGRLILV TAINPTPAGE GKTTVTIGLA DALRHIGKDS VIALREPSLG

101 PVFGVKGGAA GGGYAQVLPM EDINLHFTGD FHAIGAANNL LAAMLDNHIY

151 QGNELNIDPK RVLWRRVVDM NDRQLRNIID GMGKPVDGVM RPDGFDITVA

201 SEVMAVFCLA KDISDLKERF GNILVAYAKD GSPVYAKDLK AHGAMAALLK

251 DAIKPNLVQT IEGTPAFVHG GPFANIAHGC NSVTATRLAK HLADYAVTEA

301 GFGADLGAEK FCDIKCRLAG LKPDAAVVVA TVRALKYNGG VERANLGEEN

351 LEALAKGLPN LLKHISNLKN VFGLPVVVAL NRFVSDSDAE LAMIEKACAE

401 HGVEVSLTEV WGKGGAGGAD LARKVVNAID NQPNNFGFAY DVELGIKDKI

451 RAIAQKVYGA EDVDFSAEAS AEIASLEKLG LDKMPICMAK TQYSLSDNAK

501 LLGCPEGFRI AVRGITVSAG AGFIVALCGN MMKMPGLPKV PAAEKIDVDE

551 HGVIHGLF*
```

The following partial DNA sequence was identified in *N. meningitidis* <SEQ ID 555>:

```
m141.seq
    1 ATGAGCTTCA AAACCGATGC CGAAATCGCC CAATCCTCCA CCATGCGCCC

51 GATTGGCGAA ATTGCCGCCA AGCTTGGTCT GAATGCCGAC AACATTGAGC

101 CTTACGGTCA TTACAAGGCG AAAATCAATC CTGCCGAAGC GTTCAAACTG

151 CCGCAAAAAC AGGGCAGGCT GATTTTGGTT ACCGCCATCA ACCCGACTCC

201 GGCGGGCGAA GGCAAAACCA CCGTAACCAT CGGTTTGGCG GACGCGTTGC

251 GCCACATCGG CAAAGATGCC GTGATTGCCC TGCGCGAACC TTCTCTGGGG

301 CCGGTGTTCG GCGTGAAAGG CGGCGCGGCA GGCGGCGGCT ATGCCCAAGT

351 TTTGCCGATG GAAGACATCA ACCTGCACTT CACCGGAGAT TTTCACGCCA

401 TCGGTGCGGC AAATAATCTG CTTGCCGCGA TGCTCGACAA CCATATCTAC

451 CAAGGCAACG AGTTGAACAT CGACCCCAAA CGCGTGCTGT GGCGGCGCGT

501 GGTCGATATG AACGACCGCC AGTTGCGCAA CATCATCGAC GGCATGGGTA

551 AACCCGTTGA CGGCGTGATG CGTCCTGACG GTTTCGATAT TACCGTTGCT

601 TCCGAAGTGA TGGCGGTATT CTGTCTTGCC AAAGACATCA GCGATTTGAA

651 AGAGCGTTTG GGCAACATCC TTGTCGCCTA CGCCAAAGAC GGCAGCCCCG

701 TTTACGCCAA AGATTTGAAA GCGAATGGCG CGATGGCGGC ATTGCTTAAA

751 GATGCGATTA AGCCCAACTT GGTGCAAACC ATCGAAGGCA CGCCCGCCTT

801 CGTACACGGC GGCCCGTTCG CCAACATCGC CCACGGCTGC AACTCCGTAA

851 CCGCAACCCG TCTGGCGAAA CACCTTGCCG ATTACGCCGT AACCGAAGCA

901 GGCTTCGGCG CGGACTTGGG CGCGGAAAAA TTCTGCGACA TCAAATGCCG
```

```
-continued
 951 CCTTGCCGGT TTGAAACCTG ATGCGGCTGT TGTCGTGGCG ACTGTCCGCG

1001 CGTTGAAATA TAACGGCGGC GTGGAACGCG CCAACCTCGG CGAAGAAAAT

1051 TTAGACGCTT TGGAAAAAGG TTTGCCCAAC CTGCTGAAAC ACATTTCCAA

1101 CCTGAAAAAC GTATTCGGAC TGCCCGTCGT CGTTGCGCTC AACCGCTTCG

1151 TGTCCGACGC CGATGCCGAG TTGGCGATGA TTGAAAAAGC CTGTGCCGAA

1201 CACGGCGTTG AAGTTTCCCT GACCGAAGTG TGGGGCAAAG GTGGTGCGGG

1251 CGGCGCGGAT TTGGCGCGCA AAGTCGTCAA CGCCATTGAA AGTCAAACCA

1301 ATAACTTCGG TTTCGCCTAC GATGTCGAGT TGGGCATCAA AGACAAAATC

1351 CGTGCGATTG CCCAAAAAGT GTACGGCGCG GAAGATGTTG ATTTCAGCGC

1401 GGAAGCGTCT GCCGAAATCG CTTCACTGGA AAAACTGGGC TTGGACAAAA

1451 TGCCGATCTG CATGGCGAAA ACCCAATACT CTTTGAGCGA CAACGCCAAA

1501 CTGTTGGGCT GCCCCGAAGA CTTCCGCATC GCCGTGCGCG GCATCACCGT

1551 TTCCGCAGGC GCAGGTTTCA TCGTCGCCCT GTGCGGCAAC ATGATGAAAA

1601 TGCCCGGCCT GCCCAAAGTT CCGGCTGCCG AGAAAATCGA TGTGGACGCA

1651 GAAGGCGTGA TTCACGGCTT GTTCTGA
```

This corresponds to the amino acid sequence <SEQ ID 556; ORF 141>:

```
m141.pep
   1 MSFKTDAEIA QSSTMRPIGE IAAKLGLNAD NIEPYGHYKA KINPAEAFKL

51 PQKQGRLILV TAINPTPAGE GKTTVTIGLA DALRHIGKDA VIALREPSLG

101 PVFGVKGGAA GGGYAQVLPM EDINLHFTGD FHAIGAANNL LAAMLDNHIY

151 QGNELNIDPK RVLWRRVVDM NDRQLRNIID GMGKPVDGVM RPDGFDITVA

201 SEVMAVFCLA KDISDLKERL GNILVAYAKD GSPVYAKDLK ANGAMAALLK

251 DAIKPNLVQT IEGTPAFVHG GPFANIAHGC NSVTATRLAK HLADYAVTEA

301 GFGADLGAEK FCDIKCRLAG LKPDAAVVVA TVRALKYNGG VERANLGEEN

351 LDALEKGLPN LLKHISNLKN VFGLPVVVAL NRFVSDADAE LAMIEKACAE

401 HGVEVSLTEV WGKGGAGGAD LARKVVNAIE SQTNNFGFAY DVELGIKDKI

451 RAIAQKVYGA EDVDFSAEAS AEIASLEKLG LDKMPICMAK TQYSLSDNAK

501 LLGCPEDFRI AVRGITVSAG AGFIVALCGN MMKMPGLPKV PAAEKIDVDA

551 EGVIHGLF*
```

Computer analysis of this amino acid sequence gave the following results:

Homology with a Predicted ORF from *N. gonorrhoeae*

ORF 141 shows 97.5% identity over a 558 aa overlap with a predicted ORF (ORF 141.ng) from *N. gonorrhoeae*:

```
m141/g141

10         20         30         40         50         60
    m141.pep    MSFKTDAEIAQSSTMRPIGEIAAKLGLNADNIEPYGHYKAKINPAEAFKLPQKQGRLILV
                |||||||| |||||||||||||||||||||:|||||||||||||||||||||||||||||
    g141        MSFKTDAETAQSSTMRPIGEIAAKLGLNVDNIEPYGHYKAKINPAEAFKLPQKQGRLILV
                    10         20         30         40         50         60
```

```
                 70         80         90        100        110        120
m141.pep  TAINPTPAGEGKTTVTIGLADALRHIGKDAVIALREPSLGPVFGVKGGAAGGGYAQVLPM
          ||||||||||||||||||||||||||||:|||||||||||||||||||||||||||||||
g141      TAINPTPAGEGKTTVTIGLADALRHIGKDSVIALREPSLGPVFGVKGGAAGGGYAQVLPM
                 70         80         90        100        110        120

130        140        150        160        170        180
m141.pep  EDINLHFTGDFHAIGAANNLLAAMLDNHIYQGNELNIDPKRVLWRRVVDMNDRQLRNIID
          ||||||||||||||||||||||||||||||||||||||||||||||||||||||||||||
g141      EDINLHFTGDFHAIGAANNLLAAMLDNHIYQGNELNIDPKRVLWRRVVDMNDRQLRNIID
                130        140        150        160        170        180

190        200        210        220        230        240
m141.pep  GMGKPVDGVMRPDGFDITVASEVMAVFCLAKDISDLKERLGNILVAYAKDGSPVYAKDLK
          |||||||||||||||||||||||||||||||||||||||:||||||||||||||||||||
g141      GMGKPVDGVMRPDGFDITVASEVMAVFCLAKDISDLKERFGNILVAYAKDGSPVYAKDLK
                190        200        210        220        230        240

250        260        270        280        290        300
m141.pep  ANGAMAALLKDAIKPNLVQTIEGTPAFVHGGPFANIAHGCNSVTATRLAKHLADYAVTEA
          |:||||||||||||||||||||||||||||||||||||||||||||||||||||||||||
g141      AHGAMAALLKDAIKPNLVQTIEGTPAFVHGGPFANIAHGCNSVTATRLAKHLADYAVTEA
                250        260        270        280        290        300

310        320        330        340        350        360
m141.pep  GFGADLGAEKFCDIKCRLAGLKPDAAVVVATVRALKYNGGVERANLGEENLDALEKGLPN
          ||||||||||||||||||||||||||||||||||||||||||||||||||||:|| |||||
g141      GFGADLGAEKFCDIKCRLAGLKPDAAVVVATVRALKYNGGVERANLGEENLEALAKGLPN
                310        320        330        340        350        360

370        380        390        400        410        420
m141.pep  LLKHISNLKNVFGLPVVVALNRFVSDADAELAMIEKACAEHGVEVSLTEVWGKGGAGGAD
          ||||||||||||||||||||||||||||||:|||||||||||||||||||||||||||||
g141      LLKHISNLKNVFGLPVVVALNRFVSDADSELAMIEKACAEHGVEVSLTEVWGKGGAGGAD
                370        380        390        400        410        420

430        440        450        460        470        480
m141.pep  LARKVVNAIESQTNNFGFAYDVELGIKDKIRAIAQKVYGAEDVDFSAEASAEIASLEKLG
          |||||||||::|||||||||||||||||||||||||||||||||||||||||||||||||
g141      LARKVVNAIDNQPNNFGFAYDVELGIKDKIRAIAQKVYGAEDVDFSAEASAEIASLEKLG
                430        440        450        460        470        480

490        500        510        520        530        540
m141.pep  LDKMPICMAKTQYSLSDNAKLLGCPEDFRIAVRGITVSAGAGFIVALCGNMMKMPGLPKV
          |||||||||||||||||||||||||||| |||||||||||||||||||||||||||||||
g141      LDKMPICMAKTQYSLSDNAKLLGCPEGFRIAVRGITVSAGAGFIVALCGNMMKMPGLPKV
                490        500        510        520        530        540

550        559
m141.pep  PAAEKIDVDAEGVIHGLFX
          |||||||||:|||||||||
g141      PAAEKIDVDEHGVIHGLFX
                550        559
```

The following partial DNA sequence was identified in *N. meningitidis* <SEQ ID 557>:

```
a141.seq
   1 ATGAGTTTCA AAACCGATGC CGAAATCGCC CAATCCTCCA CCATGCGCCC

51 GATTGGCGAA ATTGCCGCCA AGCTGGGTTT GAACGTTGAC AACATTGAGC

101 CTTACGGTCA TTACAAAGCC AAAATCAATC CTGCCGAAGC GTTCAAACTG

151 CCGCAAAAAC AGGGCAGGCT GATTTTGGTT ACCGCCATCA ACCCGACTCC

201 GGCGGGCGAA GGTAAAACCA CCGTAACCAT CGGTTTGGCG GACGCATTGC

251 GCCATATCGG CAAAGACTCT GTGATTGCTT TGCGCGAGCC TTCTTTGGGT

301 CCGGTGTTCG GCGTGAAAGG CGGCGCGGCA GGCGGCGGCT ATGCCCAAGT

351 TTTGCCGATG GAAGACATCA ACCTGCACTT CACCGGAGAT TTTCACGCCA

401 TCGGTGCGGC AAATAATCTG CTTGCCGCGA TGCTCGACAA CCATATCTAC

451 CAAGGCAACG AGTTGAACAT CGACCCCAAA CGCGTGCTGT GGCGGCGCGT

501 GGTCGATATG AACGACCGCC AGTTGCGCAA CATCATCGAC GGCATGGGCA

551 AGCCTGTTGA CGGCGTGATG CGTCCTGACG GTTTCGATAT TACCGTTGCT

601 TCCGAAGTGA TGGCGGTATT CTGTCTTGCC AAAGACATCA GCGATTTGAA
```

```
 651 AGAGCGTTTG GGCAACATCC TTGTCGCCTA CGCCAAAGAC GGCAGCCCCG

701 TTTACGCCAA AGATTTGAAA GCGAATGGCG CGATGGCGGC ATTGCTTAAA

751 GATGCGATTA AGCCCAACTT GGTGCAAACC ATCGAAGGCA CGCCCGCCTT

801 CGTACACGGC GGCCCGTTCG CCAACATCGC CCACGGCTGC AACTCCGTAA

851 CCGCAACCCG TCTGGCGAAA CACCTTGCCG ATTACGCCGT AACCGAAGCA

901 GGCTTCGGCG CGGACTTGGG CGCGGAAAAA TTCTGCGACA TCAAATGCCG

951 CCTTGCCGGT TTGAAACCTG ATGCGGCTGT TGTCGTGGCG ACTGTCCGCG

1001 CGTTGAAATA TAACGGCGGC GTGGAACGCG CCAACCTCGG CGAAGAAAAT

1051 TTAGACGCTT TGGAAAAAGG TTTGCCCAAC CTGCTGAAAC ACATTTCCAA

1101 CCTGAAAAAC GTATTCGGAC TGCCCGTCGT CGTTGCGCTC AACCGCTTCG

1151 TGTCCGACTC CGATGCCGAG TTGGCGATGA TTGAAAAAGC CTGTGCCGAA

1201 CACGGCGTTG AAGTTTCCCT GACCGAAGTG TGGGGCAAAG GTGGTGCGGG

1251 CGGCGCGGAT TTGGCGCGCA AAGTCGTCAA CGCCATTGAA AGTCAAACCA

1301 ATAACTTCGG TTTCGCCTAC GATGTCGAGT TGGGCATCAA AGACAAAATC

1351 CGTGCGATTG CCCAAAAAGT GTACGGCGCG GAAGATGTTG ATTTCAGCGC

1401 GGAAGCGTCT GCCGAAATCG CTTCACTGGA AAAACTGGGC TTGGACAAAA

1451 TGCCGATCTG CATGGCGAAA ACCCAATACT CTTTGAGCGA CAACGCCAAA

1501 CTGTTGGGCT GCCCCGAAGA CTTCCGCATC GCCGTGCGCG GCATCACCGT

1551 TTCCGCAGGC GCAGGTTTCA TCGTCGCCCT GTGCGGCAAC ATGATGAAAA

1601 TGCCCGGCCT GCCCAAAGTT CCGGCTGCCG AGAAAATCGA TGTGGACGCA

1651 GAAGGCGTGA TTCACGGCTT GTTCTGA
```

This corresponds to the amino acid sequence <SEQ ID 558; ORF 141.a>:

```
a141.pep
    1 MSFKTDAEIA QSSTMRPIGE IAAKLGLNVD NIEPYGHYKA KINPAEAFKL

51 PQKQGRLILV TAINPTPAGE GKTTVTIGLA DALRHIGKDS VIALREPSLG

101 PVFGVKGGAA GGGYAQVLPM EDINLHFTGD FHAIGAANNL LAAMLDNHIY

151 QGNELNIDPK RVLWRRVVDM NDRQLRNIID GMGKPVDGVM RPDGFDITVA

201 SEVMAVFCLA KDISDLKERL GNILVAYAKD GSPVYAKDLK ANGAMAALLK

251 DAIKPNLVQT IEGTPAFVHG GPFANIAHGC NSVTATRLAK HLADYAVTEA

301 GFGADLGAEK FCDIKCRLAG LKPDAAVVVA TVRALKYNGG VERANLGEEN

351 LDALEKGLPN LLKHISNLKN VFGLPVVVAL NRFVSDSDAE LAMIEKACAE

401 HGVEVSLTEV WGKGGAGGAD LARKVVNAIE SQTNNFGFAY DVELGIKDKI

451 RAIAQKVYGA EDVDFSAEAS AEIASLEKLG LDKMPICMAK TQYSLSDNAK

501 LLGCPEDFRI AVRGITVSAG AGFIVALCGN MMKMPGLPKV PAAEKIDVDA

551 EGVIHGLF*
``` m141/a141 99.5% identity in 558 aa overlap

```
                 10         20         30         40         50         60
    m141.pep   MSFKTDAEIAQSSTMRPIGEIAAKLGLNADNIEPYGHYKAKINPAEAFKLPQKQGRLILV
               ||||||||||||||||||||||||||||||:||||||||||||||||||||||||||||||
    a141       MSFKTDAEIAQSSTMRPIGEIAAKLGLNVDNIEPYGHYKAKINPAEAFKLPQKQGRLILV
                 10         20         30         40         50         60
```

-continued

```
                70         80         90        100        110        120
m141.pep  TAINPTPAGEGKTTVTIGLADALRHIGKDAVIALREPSLGPVFGVKGGAAGGGYAQVLPM
          ||||||||||||||||||||||||||||:|||||||||||||||||||||||||||||||
a141      TAINPTPAGEGKTTVTIGLADALRHIGKDSVIALREPSLGPVFGVKGGAAGGGYAQVLPM
                70         80         90        100        110        120

130        140        150        160        170        180
m141.pep  EDINLHFTGDFHAIGAANNLLAAMLDNHIYQGNELNIDPKRVLWRRVVDMNDRQLRNIID
          ||||||||||||||||||||||||||||||||||||||||||||||||||||||||||||
a141      EDINLHFTGDFHAIGAANNLLAAMLDNHIYQGNELNIDPKRVLWRRVVDMNDRQLRNIID
               130        140        150        160        170        180

190        200        210        220        230        240
m141.pep  GMGKPVDGVMRPDGFDITVASEVMAVFCLAKDISDLKERLGNILVAYAKDGSPVYAKDLK
          ||||||||||||||||||||||||||||||||||||||||||||||||||||||||||||
a141      GMGKPVDGVMRPDGFDITVASEVMAVFCLAKDISDLKERLGNILVAYAKDGSPVYAKDLK
               190        200        210        220        230        240

250        260        270        280        290        300
m141.pep  ANGAMAALLKDAIKPNLVQTIEGTPAFVHGGPFANIAHGCNSVTATRLAKHLADYAVTEA
          ||||||||||||||||||||||||||||||||||||||||||||||||||||||||||||
a141      ANGAMAALLKDAIKPNLVQTIEGTPAFVHGGPFANIAHGCNSVTATRLAKHLADYAVTEA
               250        260        270        280        290        300

310        320        330        340        350        360
m141.pep  GFGADLGAEKFCDIKCRLAGLKPDAAVVVATVRALKYNGGVERANLGEENLDALEKGLPN
          ||||||||||||||||||||||||||||||||||||||||||||||||||||||||||||
a141      GFGADLGAEKFCDIKCRLAGLKPDAAVVVATVRALKYNGGVERANLGEENLDALEKGLPN
               310        320        330        340        350        360

370        380        390        400        410        420
m141.pep  LLKHISNLKNVFGLPVVVALNRFVSDADAELAMIEKACAEHGVEVSLTEVWGKGGAGGAD
          ||||||||||||||||||||||||||||||||||:|||||||||||||||||||||||||
a141      LLKHISNLKNVFGLPVVVALNRFVSDADSELAMIEKACAEHGVEVSLTEVWGKGGAGGAD
               370        380        390        400        410        420

430        440        450        460        470        480
m141.pep  LARKVVNAIESQTNNFGFAYDVELGIKDKIRAIAQKVYGAEDVDFSAEASAEIASLEKLG
          ||||||||||||||||||||||||||||||||||||||||||||||||||||||||||||
a141      LARKVVNAIESQTNNFGFAYDVELGIKDKIRAIAQKVYGAEDVDFSAEASAEIASLEKLG
               430        440        450        460        470        480

490        500        510        520        530        540
m141.pep  LDKMPICMAKTQYSLSDNAKLLGCPEDFRIAVRGITVSAGAGFIVALCGNMMKMPGLPKV
          ||||||||||||||||||||||||||||||||||||||||||||||||||||||||||||
a141      LDKMPICMAKTQYSLSDNAKLLGCPEDFRIAVRGITVSAGAGFIVALCGNMMKMPGLPKV
               490        500        510        520        530        540

550        559
m141.pep  PAAEKIDVDAEGVIHGLFX
          |||||||||||||||||||
a141      PAAEKIDVDAEGVIHGLFX
               550
```

The following partial DNA sequence was identified in *N. gonorrhoeae* <SEQ ID 559>:

```
g142.seq
   1 ATGCGTGCCG ATTTCATGTT TGCCGACAAT ATGCCCGTGC AGGTGCGCCA

51 ACGCGCCTTC TATTTCAAGT TGTCCCGTTT TGCCGCGATG CCAAATATGG

101 TAGGCAAACC GCTCTTCGGG CGACAGGCCG GTCAGCCCGG CAAAATGTTC

151 GGCAACATCC TGATGTTCGT CCGCCAGCAT ATTGATGCAG AGgCTGCCGT

201 TTTCCGACAG GATcggaATG AttcgCGCAC TCCGGTTTAT GCACAGCATC

251 ACGGTCGGCG GCTCGTCGGT AACCGGCGCA ACCGCCGTCA TTGTAATGCC

301 GTAACGCCCT GCCGCACCGT CTGTCGTGAT GACATGAACG CCTGCCGCAC

351 AGGATGCCAT CGCATCACGG AACGAAGTTT GAAAAGTTTT CTGCAAATCC

401 GCCATTTTTC CCCTTTAAAC CGTCCCCTAT ATAAGAATGC TGCACACAAG

451 GCATCCCCCC ATGTGCAGCA GTTCTGA
```

This corresponds to the amino acid sequence <SEQ ID 560; ORF 142.ng>:

```
g142.pep
    1 MRADFMFADN MPVQVRQRAF YFKLSRFAAM PNMVGKPLFG RQAGQPGKMF

51 GNILMFVRQH IDAEAAVFRQ DRNDSRTPVY AQHHGRRLVG NRRNRRHCNA

101 VTPCRTVCRD DMNACRTGCH RITERSLKSF LQIRHFSPLN RPLYKNAAHK

151 ASPHVQQF*
```

The following partial DNA sequence was identified in *N. meningitidis* <SEQ ID 561>:

```
m142.seq
    1 ATGCGTGCCG ATTTCATGTT TGCCGACAAT ATGCCCGTGC AGGTGCGCCA

51 ACGCGCCCTC TATTTCAAGT TGTCCCGTTT TGCCGCGATG CCAGATGTGG

101 TAGGCAAACC GCTCTTCGGG CGACAGGCCG GTCAGCCCGG CAAAATGTTC

151 GGCAACATCC TGATGTTCGT CCGCCAGCGT ATTGATGCAG AGGCTGCCGT

201 TTTCCGACAG GATCGGAATG ATTCGCGCAC TCCGGTTGAT GCACAGCATC

251 ACGGTCGGCG GCTCGTCGGT AACCGGCGCG ACCGCCGTCA TTGTAATGCC

301 GTAACGCCCT GCCGCACCGT CTGTCGTGAT GACATGAACG CCTGCCGCGC

351 AAGATGCCAT CGCATCACGG AACGAAGTTT GAAAATTTTT CTGCAAATCC

401 GCCATTTTTC CCCTTTAAAC TGTCCCCTAT ATAAGAATGC TGCACACAAG

451 GCATCCCCcC ATGTGCAGCA GTTTTGA
```

This corresponds to the amino acid sequence <SEQ ID 562; ORF 142>:

```
m142.pep
    1 MRADFMFADN MPVQVRQRAL YFKLSRFAAM PDVVGKPLFG RQAGQPGKMF

51 GNILMFVRQR IDAEAAVFRQ DRNDSRTPVD AQHHGRRLVG NRRDRRHCNA

101 VTPCRTVCRD DMNACRARCH RITERSLKIF LQIRHFSPLN CPLYKNAAHK

151 ASPHVQQF*
```

Computer analysis of this amino acid sequence gave the following results:
Homology with a Predicted ORF from *N. gonorrhoeae*
ORF 142 shows 93.7% identity over a 158 aa overlap with a predicted ORF (ORF 142.ng) from *N. gonorrhoeae*:

```
m142/g142

10         20         30         40         50         60
     m142.pep MRADFMFADNMPVQVRQRALYFKLSRFAAMPDVVGKPLFGRQAGQPGKMFGNILMFVRQR
             ||||||||||||||||||||:||||||||||::||||||||||||||||||||||||||:
     g142    MRADFMFADNMPVQVRQRAFYFKLSRFAAMPNMVGKPLFGRQAGQPGKMFGNILMFVRQH
                  10         20         30         40         50         60

70         80         90        100        110        120
     m142.pep IDAEAAVFRQDRNDSRTPVDAQHHGRRLVGNRRDRRHCNAVTPCRTVCRDDMNACRARCH
             ||||||||||||||||||||| ||||||||||:||||||||||||||||||||||||:||
     g142    IDAEAAVFRQDRNDSRTPVYAQHHGRRLVGNRRNRRHCNAVTPCRTVCRDDMNACRTGCH
                  70         80         90        100        110        120

130        140        150    159
     m142.pep RITERSLKIFLQIRHFSPLNCPLYKNAAHKASPHVQQFX
             |||||||| |||||||||||| |||||||||||||||||
     g142    RITERSLKSFLQIRHFSPLNRPLYKNAAHKASPHVQQFX
                 130        140        150
```

The following partial DNA sequence was identified in *N. meningitidis* <SEQ ID 563>:

```
  1 ATGCGTGCCG ATTTCATGTT TGCCGACAAT ATGCCCGTGC AGGTGCGCCA
 51 ACGCGCCCTC TATTTCAAGT TGTCCCGTTT TGCCGCGATG CCAGATGTGG
101 TAGGCAAACC GCTCTTCGGG CGACAGGCCG GTCAGCCCGG CAAAATGTTC
151 GGCAACATCC TGATGTTCGT CCGCCAGCGT ATTGATGCAG AGGCTGCCGT
201 TTTCCGACAG GATCGGAATG ATTCGCGCAC TCCGGTTGAT GCACAGCATC
251 ACGGTCGGCG GCTCGTCCGT AACCGGCGCA ACCGCCGTCA TTGTAATGCC
301 GTAACGCCCT GCCGCACCGT CTGTCGTGAT GACATGAACG CCTGCCGCAC
351 AGGATGCCAT CGCATCACGG AACGAAGTTT GAAAAGTTTT CTGCAAATCC
401 GCCATTTTTC CCCTTTAAAC TGTCCCCTAT ATAAGAATGC TGCACACAAG
451 GCACCCCCCA TGTGCAGCAG TTCTGATTCA AAAAGCCGTC GGTCGGACAT
501 TTCCGCGCGT TACGGCGTAT TACGAGTTCA ACGCATCCTC GATTTTGGCA
551 AGTTCTGCCA ACAGGTCTTT AAGCAGCAGC ATTTTCTCGC GGCCCAGCAC
601 TTCCTCGATA GCGTCGTAAC GCTCGTCCAC TTCTTCGCCG ATTTCCTCAT
651 ACAGCTTCTC GCCCTCGGCA GTCAGCTTCA GAAAAACACG TCGTTGGTCG
701 TTGGAAGGTT TCAGGCGGAC AACCAAACCC GCTTTTTCAA GGCGGGTCAG
751 GATACCGGTC AGGCTGGGGC GCAAAATGCA CGCCTGATTC GCCAAATCTT
801 GAAAGTCCAG CGTGCCGTTT TCCGCCAAAA GACGGATAAT CCGCCATTGC
851 TGATCGGTAA TATTCGCCTG ATTCAGAATA GGCCTGAATT GGGTCATCAG
901 GGCTTCCCTT GCCTGTATCA GACCGATATT GATAGACGCA TGTTTTGA
```

This corresponds to the amino acid sequence <SEQ ID 564; ORF 142.a>:

```
a142.pep
  1 MRADFMFADN MPVQVRQRAL YFKLSRFAAM PDVVGKPLFG RQAGQPGKMF
 51 GNILMFVRQR IDAEAAVFRQ DRNDSRTPVD AQHHGRRLVR NRRNRRHCNA
101 VTPCRTVCRD DMNACRTGCH RITERSLKSF LQIRHFSPLN CPLYKNAAHK
151 APPMCSSSDS KSRRSDISAR YGVLRVQRIL DFGKFCQQVF KQQHFLAAQH
201 FLDSVVTLVH FFADFLIQLL ALGSQLQKNT SLVVGRFQAD NQTRFFKAGQ
251 DTGQAGAQNA RLIRQILKVQ RAVFRQKTDN PPLLIGNIRL IQNRPELGHQ
301 GFPCLYQTD IDRRMF*
``` m142/a142 96.1% identity in 153 aa overlap

```
                    10        20        30        40        50        60
m142.pep    MRADFMFADNMPVQVRQRALYFKLSRFAAMPDVVGKPLFGRQAGQPGKMFGNILMFVRQR
            ||||||||||||||||||||||||||||||||||||||||||||||||||||||||||||
a142        MRADFMFADNMPVQVRQRALYFKLSRFAAMPDVVGKPLFGRQAGQPGKMFGNILMFVRQR
                    10        20        30        40        50        60

70        80        90       100       110       120
m142.pep    IDAEAAVFRQDRNDSRTPVDAQHHGRRLVGNRRDRRHCNAVTPCRTVCRDDMNACRARCH
            |||||||||||||||||||||||||||| |||:||||||||||||||||||||||: ||
a142        IDAEAAVFRQDRNDSRTPVDAQHHGRRLVRNRRNRRHCNAVTPCRTVCRDDMNACRTGCH
                    70        80        90       100       110       120
```

```
                  130        140        150       159
m142.pep  RITERSLKIFLQIRHFSPLNCPLYKNAAHKASPHVQQFX
          ||||||||| |||||||||||||||||||||||||| |
a142      RITERSLKSFLQIRHFSPLNCPLYKNAAHKAPPMCSSSDSKSRRSDISARYGVLRVQRIL
                  130        140        150       160       170       180 a142      DFGKFCQQVFKQQHFLAAQHFLDSVVTLVHFFADFLIQLLALGSQLQKNTSLVVGRFQAD
                  190        200        210       220       230       240
```

The following partial DNA sequence was identified in *N. gonorrhoeae* <SEQ ID 565>:

```
g143.seq
    1 ATGTTGAGCT TCGGCTATCT CGGCGTTCAG ACGGCCTTTA CCCTGCAAAG

51 CTCGCAGATG AGCCGCATTT TCAAACGCT AGGCGCAGAC CCGCACAATT

101 TGGGCTGGTT TTTCATCCTG CCGCCGCTGG CGGGGATGCT GGTTCAGCCG

151 ATAGTGgGCT ACTACTCAGA CCGCACTTGG AAGCCGCGCT TGGGCGGCCG

201 CCGCCTGCCG TATCTGCTTT ACGGCACGCT GATTGCGGTC ATCGTGATGA

251 TTTTGATGCC GAACTCGGGC AGCTTCGGTT TCGGCTATGC GTCGCTGGCG

301 GCCTTGTCGT TCGGCGCGCT GATGATTGCG CTGTTGGACG TGTCGTCGAA

351 TATGGCGATG CAGCCGTTTA AGATGATGGT CGGCGATATG GTCAACGAGG

401 AGCAGAAAAG CTACGCCTAC GGGATTCAAA GTTTCTTAGC GAATACGGAC

451 GCGGTTGTGG CAGCGATTCT GCCGTTTGTG TTcgcgtata TCGGTTTGGC

501 GAACACTGCC GAGAAGGCG TTGTGCCACA AACCGTGGTC GTAGCATTCT

551 ATGTGGGTGC GGCGTTACTG ATTATTACCA GTGCGTTCAC AATCTCCAAA

601 GTCAAAGAAT ACGACCCGGA AACCTACGCC CGTTACCACG GCATCGATGT

651 CGCCGCGAAT CAGGAAAAAG CCAACTGGTT CGAACTCTTA AAAACCGCGC

701 CTAAAGTGTT TTGGACGGTT ACTCCGGTAC AGTTTTTCTG CTGGTTCGCC

751 TTCCGGTATA TGTGGACTTA CTCGGCAGGC GCGATTGCAG AAAACGTCTG

801 GCACACTACC GATGCGTCTT CCGTAGGCCA TCAGGAGGCG GGCAACCGGT

851 ACGGCGTTTT GGCGGCGGTG TAGTCGGTTG CGGCGGTGAT TTGTTCGTTT

901 ATTCTGGCAA AAGTACCGAA TAAATACCAT AAGGCGGGTT ATTTCGGCTG

951 TTTGGCTTTG GGCGCGCTCG GTTTCTTCTC TATCTTCTTC ATCTACAATC

1001 AATACGCACT CATCCTGTCT TATATCTTAA TCGGCATCGC TTGGGCGGGC

1051 ATTATCACTT ATCCGCTGAC GATTGTGGCC AACGCTTTGT CGGGCAAACA

1101 CATGGATACT TATTTGGGCC TGTttaacgg ctctgtCTGT ATGCcgcaaa 1151 tcgTcgctTC GctgttgAGT TTCGTGCTTT TCCCGATGCT GGGCGGCCAT

1201 CAGGCAACCA TGTTCTTGGT TGCAGGCGCA GTCTTGCTGC TGGGAGCCTT

1251 CTCAGTCTGT CTGATTAAAG AGATCCACGG CGGGGTTTGA
```

This corresponds to the amino acid sequence <SEQ ID 566; ORF 143.ng>:

```
g143.pep
    1 MLSFGYLGVQ TAFTLQSSQM SRIFQTLGAD PHNLGWFFIL PPLAGMLVQP

51 IVGYYSDRTW KPRLGGRRLP YLLYGTLIAV IVMILMPNSG SFGFGYASLA

101 ALSFGALMIA LLDVSSNMAM QPFKMMVGDM VNEEQKSYAY GIQSFLANTD
```

-continued

```
151 AVVAAILPFV FAYIGLANTA EKGVVPQTVV VAFYVGAALL IITSAFTISK

201 VKEYDPETYA RYHGIDVAAN QEKANWFELL KTAPKVFWTV TPVQFFCWFA

251 FRYMWTYSAG AIAENVWHTT DASSVGHQEA GNRYGVLAAV *SVAAVICSF

301 ILAKVPNKYH KAGYFGCLAL GALGFFSIFF IYNQYALILS YILIGIAWAG

351 IITYPLTIVA NALSGKHMDT YLGLFNGSVC MPQIVASLLS FVLFPMLGGH

401 QATMFLVAGA VLLLGAFSVC LIKEIHGGV*
```

The following partial DNA sequence was identified in *N. meningitidis* <SEQ ID 567>:

```
m143.seq
   1 ATGCTCAGTT TCGGCTTTCT CGGCGTTCAG ACGGCCTTTA CCCTGCAAAG

51 CTCGCAAATG AGCCGCATTT TTCAAACGCT AGGCGCAGAC CCGCACAATT

101 TGGGCTGGTT TTTCATCCTG CCGCCGCTGG CGGGGATGCT GGTGCAGCCG

151 ATTGTCGGCC ATTACTCCGA CCGCACTTGG AAGCCGCGTT TGGGCGGCCG

201 CCGTCTGCCG TATCTGCTTT ATGGCACGCT GATTGCGGTT ATTGTGATGA

251 TTTTGATGCC GAACTCGGGC AGCTTCGGTT TCGGCTATGC GTCGCTGGCG

301 GCTTTGTCGT TCGGCGCGCT GATGATTGCG CTGTTAGACG TGTCGTCAAA

351 TATGGCGATG CAGCCGTTTA AGATGATGGT CGGCGACATG GTCAACGAGG

401 AGCAGAAAGG CTACGCCTAC GGGATTCAAA GTTTCTTAGC AAATACGGGC

451 GCGGTCGTGG CGGCGATTCT GCCGTTTGTG TTTGCGTATA TCGGTTTGGC

501 GAACACCGCC GAGAAAGGCG TTGTGCCGCA GACCGTGGTC GTGGCGTTTT

551 ATGTGGGTGC GGCGTTGCTG GTGATTACCA GCGCGTTCAC GATTTTCAAA

601 GTGAAGGAAT ACGATCCGGA AACCTACGCC CGTTACCACG GCATCGATGT

651 CGCCGCGAAT CAGGAAAAAG CCAACTGGAT CGAACTCTTG AAAACCGCGC

701 CTAAGGCGTT TGGACGGTT ACTTTGGTGC AATTCTTCTG CTGGTTCGCC

751 TTCCAATATA TGTGGACTTA CTCGGCAGGC GCGATTGCGG AAAACGTCTG

801 GCACACCACC GATGCGTCTT CCGTAGGTTA TCAGGAGGCG GGTAACTGGT

851 ACGGCGTTTT GGCGGCGGTG CAGTCGGTTG CGGCGGTGAT TTGTTCGTTT

901 GTATTGGCGA AAGTGCCGAA TAAATACCAT AAGGCGGGTT ATTTCGGCTG

951 TTTGGCTTTG GGCGCGCTCG GCTTTTTCTC CGTTTTCTTC ATCGGCAACC

1001 AATACGCGCT GGTGTTGTCT TATACCTTAA TCGGCATCGC TTGGGCGGGC

1051 ATTATCACTT ATCCGCTGAC GATTGTGACC AACGCCTTGT CGGGCAAGCA

1101 TATGGGCACT TACTTGGGCT TGTTTAACGG CTCTATCTGT ATGCCTCAAA

1151 TCGTCGCTTC GCTGTTGAGT TTCGTGCTTT TCCCTATGCT GGGCGGCTTG

1201 CAGGCCACTA TGTTCTTGGT AGGGGGCGTC GTCCTGCTGC TGGGCGCGTT

1251 TTCCGTGTTC CTGATTAAAG AAACACACGG CGGGGTTTGA
```

This corresponds to the amino acid sequence <SEQ ID 568; ORF 143>:

```
m143.pep
  1 MLSFGFLGVQ TAFTLQSSQM SRIFQTLGAD PHNLGWFFIL PPLAGMLVQP

51 IVGHYSDRTW KPRLGGRRLP YLLYGTLIAV IVMILMPNSG SFGFGYASLA
```

```
101 ALSFGALMIA LLDVSSNMAM QPFKMMVGDM VNEEQKGYAY GIQSFLANTG

151 AVVAAILPFV FAYIGLANTA EKGVVPQTVV VAFYVGAALL VITSAFTIFK

201 VKEYDPETYA RYHGIDVAAN QEKANWIELL KTAPKAFWTV TLVQFFCWFA

251 FQYMWTYSAG AIAENVWHTT DASSVGYQEA GNWYGVLAAV QSVAAVICSF

301 VLAKVPNKYH KAGYFGCLAL GALGFFSVFF IGNQYALVLS YTLIGIAWAG

351 IITYPLTIVT NALSGKHMGT YLGLFNGSIC MPQIVASLLS FVLFPMLGGL

401 QATMFLVGGV VLLLGAFSVF LIKETHGGV*
```

Computer analysis of this amino acid sequence gave the following results:
Homology with a Predicted ORF from *N. gonorrhoeae*

```
m143/g143  93.9% identity in 429 aa overlap 10         20         30         40         50         60
m143.pep    MLSFGFLGVQTAFTLQSSQMSRIFQTLGADPHNLGWFFILPPLAGMLVQPIVGHYSDRTW
            |||||:||||||||||||||||||||||||||||||||||||||||||||||:||||||
g143        MLSFGYLGVQTAFTLQSSQMSRIFQTLGADPHNLGWFFILPPLAGMLVQPIVGYYSDRTW
                    10         20         30         40         50         60

70         80         90        100        110        120
m143.pep    KPRLGGRRLPYLLYGTLIAVIVMILMPNSGSFGFGYASLAALSFGALMIALLDVSSNMAM
            ||||||||||||||||||||||||||||||||||||||||||||||||||||||||||||
g143        KPRLGGRRLPYLLYGTLIAVIVMILMPNSGSFGFGYASLAALSFGALMIALLDVSSNMAM
                    70         80         90        100        110        120

130        140        150        160        170        180
m143.pep    QPFKMMVGDMVNEEQKGYAYGIQSFLANTGAVVAAILPFVFAYIGLANTAEKGVVPQTVV
            ||||||||||||||||||:|||||||||||| ||||||||||||||||||||||||||||
g143        QPFKMMVGDMVNEEQKSYAYGIQSFLANTDAVVAAILPFVFAYIGLANTAEKGVVPQTVV
                   130        140        150        160        170        180

190        200        210        220        230        240
m143.pep    VAFYVGAALLVITSAFTIFKVKEYDPETYARYHGIDVAANQEKANWIELLKTAPKAFWTV
            ||||||||||:||||||| |||||||||||||||||||||||||||:||||||||:||||
g143        VAFYVGAALLIITSAFTISKVKEYDPETYARYHGIDVAANQEKANWFELLKTAPKVFWTV
                   190        200        210        220        230        240

250        260        270        280        290        300
m143.pep    TLVQFFCWFAFQYMWTYSAGAIAENVWHTTDASSVGYQEAGNWYGVLAAVQSVAAVICSF
            | ||||||||:|||||||||||||||||||||||||:|||| ||||||| |||||||||
g143        TPVQFFCWFAFRYMWTYSAGAIAENVWHTTDASSVGHQEAGNRYGVLAAVXSVAAVICSF
                   250        260        270        280        290        300

310        320        330        340        350        360
m143.pep    VLAKVPNKYHKAGYFGCLALGALGFFSVFFIGNQYALVLSYTLIGIAWAGIITYPLTIVT
            :|||||||||||||||||||||||||||:||| |||||:||| |||||||| |||||||:
g143        ILAKVPNKYHKAGYFGCLALGALGFFSIFFIYNQYALILSYILIGIAWAGIITYPLTIVA
                   310        320        330        340        350        360

370        380        390        400        410        420
m143.pep    NALSGKHMGTYLGLFNGSICMPQIVASLLSFVLFPMLGGLQATMFLVGGVVLLLGAFSVF
            ||||||||| |||||||||:|||||||||||||||||||| ||||||:|:||||||||||
g143        NALSGKHMDTYLGLFNGSVCMPQIVASLLSFVLFPMLGGHQATMFLVAGAVLLLGAFSVC
                   370        380        390        400        410        420

430
m143.pep    LIKETHGGVX
            |||| |||||
g143        LIKEIHGGVX
                   430
```

The following partial DNA sequence was identified in *N. meningitidis* <SEQ ID 569>:

```
a143.seq
   1 ATGCTCAGTT TCGGCTTTCT CGGCGTTCAG ACGGCCTTTA CCCTGCAAAG

51 CTCGCAGATG AGCCGCATCT TCCAGACGCT CGGTGCCGAT CCGCACAGCC

101 TCGGCTGGTT CTTTATCCTG CCGCCGCTGG CGGGGATGCT GGTGCAGCCG

151 ATTGTCGGCC ATTACTCCGA CCGCACTTGG AAGCCGCGTT TGGGCGGCCG

201 CCGTCTGCCG TATCTGCTTT ATGGCACGCT GATTGCGGTT ATTGTGATGA
```

-continued

```
 251 TTTTGATGCC GAACTCGGGC AGCTTCGGTT TCGGCTATGC GTCGCTGGCG
 301 GCTTTGTCGT TCGGCGCGCT GATGATTGCG CTGTTAGACG TGTCGTCAAA
 351 TATGGCGATG CAGCCGTTTA AGATGATGGT CGGCGACATG GTCAACGAGG
 401 AGCAGAAAGG CTACGCCTAC GGGATTCAAA GTTTCTTAGC GAATACGGGC
 451 GCGGTCGTGG CGGCGATTCT GCCGTTTGTG TTTGCGTATA TCGGTTTGGC
 501 GAACACCGCC GAGAAAGGCG TTGTGCCGCA GACCGTGGTC GTGGCGTTTT
 551 ATGTGGGTGC GGCGTTGCTG GTGATTACCA GCGCGTTCAC GATTTTCAAA
 601 GTGAAGGAAT ACAATCCGGA AACCTACGCC CGTTACCACG GCATCGATGT
 651 CGCCGCGAAT CAGGAAAAAG CCAACTGGAT CGAACTCTTG AAAACCGCGC
 701 CTAAGGCGTT TTGGACGGTT ACTTTGGTGC AATTCTTCTG CTGGTTCGCC
 751 TTCCAATATA TGTGGACTTA CTCGGCAGGC GCGATTGCGG AAAACGTCTG
 801 GCACACCACC GATGCGTCTT CCGTAGGTTA TCAGGAGGCG GGTAACTGGT
 851 ACGGCGTTTT GGCGGCGGTG CAGTCGGTTG CGGCGGTGAT TTGTTCGTTT
 901 GTATTGGCGA AAGTGCCGAA TAAATACCAT AAGGCGGGTT ATTTCGGCTG
 951 TTTGGCTTTG GGCGCGCTCG GCTTTTTCTC CGTTTTCTTC ATCGGCAACC
1001 AATACGCGCT GGTGTTGTCT TATACCTTAA TCGGCATCGC TTGGGCGGGC
1051 ATTATCACTT ATCCGCTGAC GATTGTGACC AACGCCTTGT CGGGCAAGCA
1101 TATGGGCACT TACTTGGGCC TGTTTAACGG CTCTATCTGT ATGCCGCAAA
1151 TCGTCGCTTC GCTGTTGAGT TTCGTGCTTT TCCCTATGCT GGGCGGCTTG
1201 CAGGCCACTA TGTTCTTGGT AGGGGGCGTC GTCCTGCTGC TGGGCGCGTT
1251 TTCCGTGTTC CTGATTAAAG AAACACACGG CGGGGTTTGA
```

This corresponds to the amino acid sequence <SEQ ID 570; ORF 143.a>:

```
a143.pep

1 MLSFGFLGVQ TAFTLQSSQM SRIFQYLGAD PHSLGWFFIL PPLAGMLVQP

51 IVGHYSDRTW KPRLGGRRLP YLLYGTLIAV IVMILMPNSG SFGFGYASLA

101 ALSFGALMIA LLDVSSNMAM QPFKMMVGDM VNEEQKGYAY GIOQSLANTG

151 AVVAAILPFV FAYIGLANTA EKGVVPQTVV VAFYVGAALL VITSAFTIFK

201 VKEYNPETYA RYHGIDVAAN QEKANWIELL KTAPKAFWTV TLVQFFCWFA

251 FQYMWTYSAG AIAENVWHTT DASSVGYQEA GNWYGVLAAV QSVAAVICSF

301 VLAKVPNKYH KAGYFGCLAL GALGFFSVFF IGNQYALVLS YTLIGIAWAG

351 IITYPLTIVT NALSGKHMGT YLGLFNGSIC MPQIVASLLS FVLFPMLGGL

401 QATMFLVGGV VLLGAFSVF LIKETHGGV* m143/a143 99.5% identity in 429 aa overlap 10         20         30         40         50         60
m143.pep  MLSFGFLGVQTAFTLQSSQMSRIFQTLGADPHNLGWFFILPPLAGMLVQPIVGHYSDRTW
          ||||||||||||||||||||||||||||:|||||||||||||||||||||||||||||||
a143      MLSFGFLGVQTAFTLQSSQMSRIFQTLGADPHSLGWFFILPPLAGMLVQPIVGHYSDRTW
                 10         20         30         40         50         60

70         80         90        100        110        120
m143.pep  KPRLGGRRLPYLLYGTLIAVIVMILMPNSGSFGFGYASLAALSFGALMIALLDVSSNMAM
          ||||||||||||||||||||||||||||||||||||||||||||||||||||||||||||
a143      KPRLGGRRLPYLLYGTLIAVIVMILMPNSGSFGFGYASLAALSFGALMIALLDVSSNMAM
                 70         80         90        100        110        120
```

```
              130       140       150       160       170       180
m143.pep  QPFKMMVGDMVNEEQKGYAYGIQSFLANTGAVVAAILPFVFAYIGLANTAEKGVVPQTVV
          ||||||||||||||||||||||||||||||||||||||||||||||||||||||||||||
a143      QPFKMMVGDMVNEEQKGYAYGIQSFLANTGAVVAAILPFVFAYIGLANTAEKGVVPQTVV
              130       140       150       160       170       180

190       200       210       220       230       240
m143.pep  VAFYVGAALLVITSAFTIFKVKEYDPETYARYHGIDVAANQEKANWIELLKTAPKAFWTV
          |||||||||||||||||||||||||:||||||||||||||||||||||||||||||||||
a143      VAFYVGAALLVITSAFTIFKVKEYNPETYARYHGIDVAANQEKANWIELLKTAPKAFWTV
              190       200       210       220       230       240

250       260       270       280       290       300
m143.pep  TLVQFFCWFAFQYMWTYSAGAIAENVWHTTDASSVGYQEAGNWYGVLAAVQSVAAVICSF
          ||||||||||||||||||||||||||||||||||||||||||||||||||||||||||||
a143      TLVQFFCWFAFQYMWTYSAGAIAENVWHTTDASSVGYQEAGNWYGVLAAVQSVAAVICSF
              250       260       270       280       290       300

310       320       330       340       350       360
m143.pep  VLAKVPNKYHKAGYFGCLALGALGFFSVFFIGNQYALVLSYTLIGIAWAGIITYPLTIVT
          ||||||||||||||||||||||||||||||||||||||||||||||||||||||||||||
a143      VLAKVPNKYHKAGYFGCLALGALGFFSVFFIGNQYALVLSYTLIGIAWAGIITYPLTIVT
              310       320       330       340       350       360

370       380       390       400       410       420
m143.pep  NALSGKHMGTYLGLFNGSICMPQIVASLLSFVLFPMLGGLQATMFLVGGVVLLLGAFSVF
          ||||||||||||||||||||||||||||||||||||||||||||||||||||||||||||
a143      NALSGKHMGTYLGLFNGSICMPQIVASLLSFVLFPMLGGLQATMFLVGGVVLLLGAFSVF
              370       380       390       400       410       420

430
m143.pep  LIKETHGGVX
          ||||||||||
a143      LIKETHGGVX
              430
```

The following partial DNA sequence was identified in *N. gonorrhoeae* <SEQ ID 571>:

```
g144.seq
  1 ATGAGCGATA CCCCCGCTAC CCGCGATTTC GGCCTGATCG ACGGGCGGGC

51 CGTAACCGGC TATGTGCTGT CCAACCGGCG TGGTACGTGC GTCTTCGTGC

101 TGGACTTGGG CGGGATTGTG CAGGAATTTT CCGTTTTGGC AGACGGCGTG

151 CGCGAAAACC CCGTGGTGTC GTTCGACGAT GCGGCTTCCT ATGCGGACAA

201 TCCGTTTCAG ATTAACAAGC AGATAGGGCG CGTGGCCGGA CGCATCCGCG

251 GTGCGGCGTT CGACATCAAC GGTAGGACTT ACCGCGTGGA GGCCAACGAA

301 GGCAGGAACG CGCTGCACGG CGGTTCGCAC GGGCTGGCCG TTACCcgtTT

351 CAACGCGGTG GCGGCAGACG GccgacggTt atCCCAACGA TTTGGatatT

401 TCctaccgCT TGGACGAGGA CGGCCGGCTT ACCGTtaccT ATCGCGCCAC

451 CGCgctCGGC GACACGGTGT CGACCCGAC GCTGCACATT TACTGGCGGC

501 TGGACGCGGG CCTGCACGAT GCGGTTCTGC ATATTCCGCA GGGCGGACAT

551 ATTCCGGCCG ATGCCGAAAA ACTGCCCGTC TTAACGGTTT CAGACGGCCT

601 CGAAGTATTT GA
```

This corresponds to the amino acid sequence <SEQ ID 572; ORF 144.ng>:

```
g144.pep
  1 MSDTPATRDF GLIDGRAVTG YVLSNRRGTC VFVLDLGGIV QEFSVLADGV

51 RENPVVSFDD AASYADNPFQ INKQIGRVAG RIRGAAFDIN GRTYRVEANE

101 GRNALHGGSH GLAVTRFNAV AADGRRLSQR FGYFLPLGRG RPAYRYLSRH
```

-continued

```
151 RARRHGVRPD AAHLLAAGRG PARCGSAYSA GRTYSGRCRK TARLNGFRRP

201 RSI*
```

The following partial DNA sequence was identified in *N. meningitidis* <SEQ ID 573>:

```
m144.seq
  1 ATGAGCGATA CCCCCGCTAC CCGCGATTTC GGTCTGATCG ACGGGCGTGC

51 CGTAACCGGC TATGTGCTGT CCAACCGGCG TGGTACGCGT GTCTGCGTGC

101 TGGACTTGGG CGGGATTGTG CAGGAATTTT CCGTTTTGGC AGACGGCGTG

151 CGCGAAAACC TCGTGGTGTC GTTCGATGAT GCGGCTTCCT ATGCGGACAA

201 TCCGTTTCAG ATTAACAAAC AGATAGGGCG CGTGGCCGGA CGCATCCGCG

251 GTGCGGCGTT CGACATCAAC GGCAGGACTT ACCGCGTGGA GGCCAACGAA

301 GGCAGGAACG CGCTGCACGG CGGTTCGCAC GGGCTGGCCG TTACCCGTTT

351 CAACGCGGTG GCGGCAGACG GCCGTTCGGT GGTGCTGCGC AGCCGCCTGg

401 CAACAGTCGG CCGACGGTTA TCCCAACGAT TTGGATTTGG ATATTTCCTA

451 CCGCTTGGAC GAGGACGACC GGCTTACCGT TAcCTATCGC GCCACCGCGC

501 TCGGCGACAC GGTGTTCGAC CCGACGCTGC ACATTTACTG GCGGCTGGAC

551 GCGGGCCTGC ACGATGCGGT TCTGCATATT CCGCAGGGCG GACATATGCC

601 GGCCGATGCC GAAAAACTGC CCGTCTCAAC GGTTTCAGAC GACCTCGAAG

651 TATTTGA
```

This corresponds to the amino acid sequence <SEQ ID 574; ORF 144>:

```
m144.pep
  1 MSDTPATRDF GLIDGRAVTG YVLSNRRGTR VCVLDLGGIV QEFSVLADGV

51 RENLVVSFDD AASYADNPFQ INKQIGRVAG RIRGAAFDIN GRTYRVEANE

101 GRNALHGGSH GLAVTRFNAV AADGRSVVLR SRLATVGRRL SQRFGFGYFL

151 PLGRGRPAYR YLSRHRARRH GVRPDAAHLL AAGRGPARCG SAYSAGRTYA

201 GRCRKTARLN GFRRPRSI*
```

Computer analysis of this amino acid sequence gave the following results:
Homology with a Predicted ORF from *N. gonorrhoeae*

```
    m144/g144  91.3% identity in 218 aa overlap 10         20         30         40         50         60
    m144.pep  MSDTPATRDFFLIDGRAVTGYVLSNRRGTRVCVLDLGGIVQEFSVLADGVRENLVVSFDD
              ||||||||||||||||||||||||||||| |||||||||||||||||||||| ||||||
    g144      MSDTPATRDFFLIDGRAVTGYVLSNRRGTCVFVLDLGGIVQEFSVLADGVRENPVVSFDD
                   10         20         30         40         50         60

70         80         90        100        110        120
    m144.pep  AASYADNPFQINKQIGRVAGRIRGAAFDINGRTYRVEANEGRNALHGGSHGLAVTRFNAV
              ||||||||||||||||||||||||||||||||||||||||||||||||||||||||||||
    g144      AASYADNPFQINKQIGRVAGRIRGAAFDINGRTYRVEANEGRNALHGGSHGLAVTRFNAV
                   70         80         90        100        110        120

130        140        150        160        170        180
    m144.pep  AADGRSVVLRSRLATVGRRLSQRFGFGYFLPLGRGRPAYRYLSRHRARRHGVRPDAAHLL
              |||             ||||||||| |||||||||||||||||||||||||||||||||
    g144      AAD------------GRRLSQRFG--YFLPLGRGRPAYRYLSRHRARRHGVRPDAAHLL
                              130        140        150        160
```

```
                    190        200        210      219
m144.pep  AAGRGPARCGSAYSAGRTYAGRCRKTARLNGFRRPRSIX
          ||||||||||||||||||||:||||||||||||||||||
g144      AAGRGPARCGSAYSAGRTYSGRCRKTARLNGFRRPRSIX
              170        180        190        200
```

The following partial DNA sequence was identified in *N. meningitidis* <SEQ ID 575>:

```
a144.seq
  1 ATGAGCGATA CCCCCGCTAC CCGCGATTTC GGCCTGATCG ACGGGCGTGC

51 CGTAACCGGC TATGTGCTGT CCAACCGGCG TGGTACGCGT GTCTGCGTGC

101 TGGACTTGGG CGGGATTGTG CAGGAATTTT CCGTTTTGGC AGACGGCGTG

151 CGCGAAAACC TCGTGGTGTC GTTCGACGAT GCGGCTTCCT ATGCGGACAA

201 TCCGTTTCAG ATTAACAAGC AGATAGGGCG CGTGGCCGGA CGCATCCGCG

251 GTGCGGCGTT CGACATCAAC GGCAGGACTT ACCGCGTGGA GGCCAACGAA

301 GGCAGGAACG CGCTGCACGG CGGTTCGCAC GGGCTGGCCG TTACCCGTTT

351 CAACGCGGTG GCGGCAGACG GCCGTTCGGT GGTGCTGCGC AGCCGCCTG.

401 CAACAGTCGG CCGACGGTTA TCCCAACGAT TTGGATTTGG ATATTTCCTA

451 CCGCTTGGAC GAGGACGACC GGCTTACCGT TACCTATCGC GCCACCGCGC

501 TCGGCGACAC GGTGTTCGAC CCGACGCTGC ACATTTACTG GCGGCTGGAC

551 GCGGGCCTGC ACGATGCGGT TCTGCATATT CCGCAGGGCG GACATATTCC

601 GGCCGATGCC GAAAAACTGC CCGTCTCAAC GGTTTCAGAC GACCTCGAAG

651 TATTTGA
```

This corresponds to the amino acid sequence <SEQ ID 576; ORF 144.a>:

```
a144.pep

1 MSDTPATRDF GLIDGRAVTG YVLSNRRGTR VCVLDLGGIV QEFSVLADGV

51 RENLVVSFDD AASYADNPFQ INKQIGRVAG RIRGAAFDIN GRTYRVEANE

101 GRNALHGGSH GLAVTRFNAV AADGRSVVLR SRLXTVGRRL SQRFGFGYFL

151 PLGRGRPAYR YLSRHRARRH GVRPDAAHLL AAGRGPARCG SAYSAGRTYS

201 GRCRKTARLN GFRRPRSI* m144/a144 99.1% identity in 218 aa overlap 10         20         30         40         50         60
m144.pep  MSDTPATRDFGLIDGRAVTGYVLSNRRGTRVCVLDLGGIVQEFSVLADGVRENLVVSFDD
          ||||||||||||||||||||||||||||||||||||||||||||||||||||||||||||
a144      MSDTPATRDFGLIDGRAVTGYVLSNRRGTRVCVLDLGGIVQEFSVLADGVRENLVVSFDD
                10         20         30         40         50         60

70         80         90        100        110        120
m144.pep  AASYADNPFQINKQIGRVAGRIRGAAFDINGRTYRVEANEGRNALHGGSHGLAVTRFNAV
          ||||||||||||||||||||||||||||||||||||||||||||||||||||||||||||
a144      AASYADNPFQINKQIGRVAGRIRGAAFDINGRTYRVEANEGRNALHGGSHGLAVTRFNAV
                70         80         90        100        110        120

130        140        150        160        170        180
m144.pep  AADGRSVVLRSRLATVGRRLSQRFGFGYFLPLGRGRPAYRYLSRHRARRHGVRPDAAHLL
          ||||||||||||| ||||||||||||||||||||||||||||||||||||||||||||||
a144      AADGRSVVLRSRLXTVGRRLSQRFGFGYFLPLGRGRPAYRYLSRHRARRHGVRPDAAHLL
               130        140        150        160        170        180
```

```
                       190        200        210       219
m144.pep  AAGRGPARCGSAYSAGRTYAGRCRKTARLNGFRRPRSIX
          ||||||||||||||||||:||||||||||||||||||
a144      AAGRGPARCGSAYSAGRTYSGRCRKTARLNGFRRPRSIX
                       190        200        210
```

The following partial DNA sequence was identified in *N. gonorrhoeae* <SEQ ID 577>:

```
g146.seq
  1 ATGAAGCAAA TCCCCCTCCG CCTTCTCCAG GTCGTCATTG ACCACGACAA

51 AGTCGAACAA TACGGACTGT TCGATTTCAT GCCTTGCCTT CGACAGCCTC

101 CTTTGGATAa ctTCCCGACT GTCCGTCCCG CGCcctTTGA GGCGCGCGGC

151 AAGCACGTCG AAAGAAGGCG GCAGGATAAA GATACCGACA GCTTCCGGCA

201 GCGCGTTGCG AACCTGCGCC GCGCCCTGAA CGTCGATTTC AAAATCACG

251 TCATAGCCTG CCGCCGCCAA CGCATTCACG CCCTCCGTGC TTGTGCCGTA

301 ATAGTTGCCG AATACGTCTG CGTATTCCAA AAAGCCTCC TGCGCGATAA

351 GCGATTCAAA CTCTTCTTTG GAAACAAAGT GATAATGTAC GCCGTTTGCT

401 TCGCCTTCAC GCGGCGGGCG CGTCGTATGC GACACGGAAA CGCGCAAACC

451 GTTATGGTTT GCCAACAGCC GCGACACCAG CGTGGTTTTG CCCGTGCCGG

501 AAGCGGCCGA AATGATAAAG ATGTTGCCTT TTCGATAAGC GGACATATTT

551 TTTACCTGTA TATTTTCCAA CCGATTGTAT CACAACGGAC ACCCTATTTC

601 ATATTTGCCG ATGCCCATAT TTTGCCGCTA TTGTTTTGA
```

This corresponds to the amino acid sequence <SEQ ID 578; ORF 146.ng>:

```
g146.pep
  1 MKQIPLRLLQ VVIDHDKVEQ YGLFDFMPCL RQPPLDNFPT VRPAPFEARG

51 KHVERRRQDK DTDSFRQRVA NLRRALNVDF QNHVIACRRQ RIHALRACAV

101 IVAEYVCVFQ KSLLRDKRFK LFFGNKVIMY AVCFAFTRRA RRMRHGNAQT

151 VMVCQQPRHQ RGFARAGSGR NDKDVAFSIS GHIFYLYIFQ PIVSQRTPYF

201 IFADAHILPL LF*
```

The following partial DNA sequence was identified in *N. meningitidis* <SEQ ID 579>:

```
m146.seq
  1 ATGGCGCAAA TCCTCCTCCG CTCGCGCCAA GTCGTCATTG ACCACGACAA

51 AGTCAAACAA TACGGACTGC TCGATTTCAT GCCTTGCCTT CGACAGCCTC

101 CTTTGGATAA CTTCCCGACT GTCCGTCCCG CGTCCGTTGA GGCGCGCGGC

151 AAGTACGTCG AAAGAAGGCG GCAGGATAAA GATGCCGACG GCTTCGGGCA

201 GCGCGTCGCG AACCTGCGCC GCGCCCTGAA CGTCGATTTC AAAATCACG

251 TCATAGCCTG CCGCCGCCAA CGCATTCACA CCCTCCGCGC CTGTGCCGTA

301 ATAGTTGCCA AATACGTCGG CGTATTCCAA AAAGCTTCC TGCGCGATAA

351 GCGACTCAAA CTCTTCTTTG GAAACAAAGT GATAATGTAC GCCGTTTGCT

401 TCGCCTTCAC GCGGCGGGCG CGTCGTGTGC GACACGGAAA CGCGCAAACC

451 GTTATGGTTT GCCAACAGCC GCGACACCAG CGTGGTTTTG CCCGTGCCGG
```

```
501 AAGCGGCCGA AATGATAAAG ATGTTGCCTT TTCGATAAGC GGACATATTT

551 TTTACCTGTA TATTTTCCAG CCGATTGTAT CACAATGGAC ACCCAGTTTC

601 CTATTTGCCG ATGCCCATAT TTTGCCGCTA TTGTTTTGA
```

This corresponds to the amino acid sequence <SEQ ID 580; ORF 146>:

```
m146.pep
  1 MAQILLRSRQ VVIDHDKVKQ YGLLDFMPCL RQPPLDNFPT VRPASVEARG

51 KYVERRRQDK DADGFGQRVA NLRRALNVDF QNHVIACRRQ RIHTLRACAV

101 IVAKYVGVFQ KSFLRDKRLK LFFGNKVIMY AVCFAFTRRA RRVRHGNAQT

151 VMVCQQPRHQ RGFARAGSGR NDKDVAFSIS GHIFYLYIFQ PIVSQWTPSF

201 LFADAHILPL LF*
```

Computer analysis of this amino acid sequence gave the following results:
Homology with a Predicted ORF from *N. gonorrhoeae*

```
    m146/g146  90.1% identity in 212 aa overlap 10         20         30         40         50         60
       m146.pep  MAQILLRSRQVVIDHDKVKQYGLLDFMPCLRQPPLDNFPTVRPASVEARGKYVERRRQDK
                 | || ||  ||||||||:||||:||||||||||||||||||||   |||||:||||||||
           g146  MKQIPLRLLQVVIDHDEVKQYGLFDFMPCLRQPPLDNFPTVRPAPFEARGKHVERRRQDK
                   10         20         30         40         50         60

70         80         90        100        110        120
       m146.pep  DADGFGQRVANLRRALNVDFQNHVIACRRQRIHTLRACAVIVAKYVGVFQKSFLRDKRLK
                 |:|:|  ||||||||||||||||||||||||||:||||||||||:||  |||||:||||:|
           g146  DTDSFRQRVANLRRALNVDFQNHVIACRRQRIHALRACAVIVAEYVCVFQKSLLRDKRFK
                   70         80         90        100        110        120

130        140        150        160        170        180
       m146.pep  LFFGNKVIMYAVCFAFTRRARRVRHGNAQTVMVCQQPRHQRGFARAGSGRNDKDVAFSIS
                 |||||||||||||||||||||:|||||||||||||||||||||||||||||||||||||
           g146  LFFGNKVIMYAVCFAFTRRARRMRHGNAQTVMVCQQPRHQRGFARAGSGRNDKDVAFSIS
                  130        140        150        160        170        180

190        200        210
       m146.pep  GHIFYLYIFQPIVSQWTPSFLFADAHILPLLFX
                 ||||||||||||||  || |:|||||||||||
           g146  GHIFYLYIFQPIVSQRTPYFIFADAHILPLLFX
                  190        200        210
```

The following partial DNA sequence was identified in *N. meningitidis* <SEQ ID 581>:

```
a146.seq
  1 ATGGCGCAAA TCCTCCTCCG CCCGCGCCAA GTCATCATTG ACCACGACAA

51 AATCGAACAA TACGGACTGT TCGATTTCAT GCCTTGCCTT CGACAGCCTC

101 CTTTGGATAA CTTCCCGACT GTCCGTCCCG CGTCCGTTGA GACGCGCAGC

151 AAGCACATCG AAAGACGGCG GCAGGATAAA GATGCCGACG GCTTCGGGCA

201 GCGCATCTCG AACCTGAGCC GCGCCCTGAA CGTCGATTTC CAAAATCACG

251 TCATAACCTG CCGCCGCCAA CGCATTCACA CCCTCCGCGC TTGTGCCGTA

301 ATAGTTGCCG AACACGTCCG CGTATTCCAA AAAGCCTCC TGCGCGATAA

351 GCGACTCAAA CTCTTCTTTG GAAACAAAGT GATAATGTAC GCCGTTTGCT

401 TCGCCTTCAC GCGGCGGACG CGTCGTGTGC GACACGGAAA CGCGCAAACC

451 GTTATGGTTT GCCAACAGCC GCGACACCAG CGTGGTTTTG CCCGTGCCGG
```

```
501 AAGCGGCCGA AATGATAAAG ATGTTGCCTT TTCGATAAGC GGACATATTT

551 TTTACCTGTA TATTTTCCAG CCGATTGTAT CACAACGGAC ACCCGGTTTC

601 CTATTTGCCG ATGCCCATAT TTTGCCGCTA TTGTTTTGA
```

This corresponds to the amino acid sequence <SEQ ID 582; ORF 146.a>:

```
a146.pep
        1 MAQILLRPRQ VIIDHDKIEQ YGLFDFMPCL RQPPLDNFPT VRPASVETRS

51 KHIERRRQDK DADGFGQRIS NLSRALNVDF QNHVITCRRQ RIHTLRACAV

101 IVAEHVRVFQ KSLLRDKRLK LFFGNKVIMY AVCFAFTRRT RRVRHGNAQT

151 VMVCQQPRHQ RGFARAGSGR NDKDVAFSIS GHIFYLYIFQ PIVSQRTPGF

201 LFADAHILPL LF* m146/a146  90.6% identity in 212 aa overlap 10         20         30         40         50         60
     m146.pep MAQILLRSRQVVIDHDKVKQYGLLDFMPCLRQPPLDNFPTVRPASVEARGKYVERRRQDK
             ||||||| |||:||||::||||:|||||||||||||||||||||||:|:|::||||||
        a146 MAQILLRPRQVIIDHDKIEQYGLFDFMPCLRQPPLDNFPTVRPASVETRSKHIERRRQDK
                  10         20         30         40         50         60

70         80         90        100        110        120
     m146.pep DADGFGQRVANLRRALNVDFQNHVIACRRQRIHTLRACAVIVAKYVGVFQKSFLRDKRLK
             ||||||||::||  |||||||||||:|||||||||||||:| ||||:||||:||||||
        a146 DADGFGQRVISLRSALNVDFQNHVITCRRQRIHTLRACAVIVAEHVRVFQKSLLRDKRLK
                  70         80         90        100        110        120

130        140        150        160        170        180
     m146.pep LFFGNKVIMYAVCFAFTRRARRVRHGNAQTVMVCQQPRHQRGFARAGSGRNDKDVAFSIS
             |||||||||||||||||||: ||||||||||||||||||| |||||:|||||||||||
        a146 LFFGNKVIMYAVCFAFTRRTRRVRHGNAQTVMVCQQPRHQRGFARAGSGRNDKDVAFSIS
                 130        140        150        160        170        180

190        200        210
     m146.pep GHIFYLYIFQPIVSQWTPSFLFADAHILPLLFX
             ||||||||||||||| ||:||||||||||||
        a146 GHIFYLYIFQPIVSQRTPGFLFADAHILPLLFX
                 190        200        210
```

The following partial DNA sequence was identified in *N. gonorrhoeae* <SEQ ID 583>:

```
g147.seq (partial)
  1 ..ATGCGACGAG AAGCCAAAAT GGCACAAATC ACACTCAAAC CCATTGTTTT

51   ATCAATTCTT TTAATCAACA CACCCCTCCT CGCCCAAGCG CATGAAACTG

101   AGCAATCGGT GGGCTTGGAA ACGGTCAGCG TCGTCGGCAA AAGCCGTCCG

151   CGCGCGACTT CGGGGCTGCT GCACACTTCG ACCGCCTCCG ACAAAATCAT

201   CTCCGGCGAT ACTTTGCGCC AAAAAGCCGT CAACTTGGGC GACGCTTTGG

251   ACGGCGTACC GGGCATCCAC GCTTCGCAAT ACGGCGGCGG CGCATCCGCT

301   CCCGTTATTC GCGGTCAAAC GGGCAGACGG ATTAAAGTAT TGAACCATCA

351   CGGCGAAACG GGCGATATGG CGGACTTTTC TCCCGATCAC GCCATTATGG

401   TAGATACCGC CTTGTCGCAA CAGGTTGAAA TCCTGCGCGG GCCGGTTACG

451   CTCTTGTACA GCTCGGgcaa tgtggccgGG GCTGGtcaat gttgccgatg 501   gAAAAtccc ccaaaaAAtg cc..
```

This corresponds to the amino acid sequence <SEQ ID 584; ORF 147.ng>:

```
g147.pep (partial)
  1 . . . MRREAKMAQI TLKPIVLSIL LINTPLLAQA HETEQSVGLE TVSVVGKSRP

51       RATSGLLHTS TASDKIISGD TLRQKAVNLG DALDGVPGIH ASQYGGGASA

101       PVIRGQTGRR IKVLNHHGET GDMADFSPDH AIMVDTALSQ QVEILRGPVT

151       LLYSSGNVAG AGQCCRWKNP PKNA . . .
```

The following partial DNA sequence was identified in *N. meningitidis* <SEQ ID 585>:

```
m147.seq (partial)
   1 . . . CCGCATAAAA CTGAGCAATC GGTGGATTTG GAAACGGTCA GCGTCGTCGG

51       CAAAAGCCGT CCGCGCGCCA CGTCGGGGCT GTTGCACACT TCGACCGCCT

101       CCGACAAAAT CATCTCCGGC GATACCTTGC GCCAAAAAGC CGTCAACTTG

151       GGCGACGCTT TAGACGGCGT ACCGGGCATC CACGCTTCGC AATACGGCGG

201       CGGCGCGTCT GCTCCCGTCA TTCGCGGTCA AACAGGCAGG CGGATTAAAG

251       TGTTGAACCA TCACGGCGAA ACAGGCGATA TGGCGGATTT TTCGCCCGAT

301       CACGCCATTA TGGTAGATAC CGCCTTGTCG CAACAGGTCG AAATCCTGCG

351       CGGGCCGGTT ACGCTCTTGT ACAGCTCGGG CAATGTGGCG GGGCTGGTCG

401       ATGTTGCCGA TGGCAAAATC CCCGAAAAAA TGCCTGAAAA CGGCGTATCG

451       GGCGAACTCG GATTGCGTTT GAGCAGCGGC AATCTGGAAA AACTCACGTC

501       CGGCGGCATC AATATCGGTT TGGGCAAAAA CTTTGTATTG CACACGGAAG

551       GGCTGTACCG CAAATCGGGG GATTACGCCG TACCGCGTTA CCGCAATCTG

601       AAACGCCTGC CCGACAGCCA CGCCGATTCG CAAACGGGCA GCATCGGGCT

651       GTCTTGGGTT GGCGAAAAAG GTTTTATCGG CGTAGCGTAC AGCGACCGTC

701       GCGACCAATA TGGTCTGCCT GCCCACAGCC ACGAATACGA TGATTGCCAC

751       GCCGACATCA TCTGGCAAAA GAGCTTGATT AACAAACGCT ATTTACAGCT

801       TTATCCGCAC CTGTTGACCG AAGAAGACAT CGATTACGAC AATCCGGGCT

851       TGAGCTGCGG CTTCCACGAC GACGATAATG CACACGCACA CACCCACAGC

901       GGCAGACCGT GGATAGACCT GCGCAACAAA CGCTACGAAC TCCGTGCCGA

951       ATGGAAGCAA CCGTTCCCCG GTTTTGAAGC CCTGCGCGTA CACCTGAACC

1001       GCAACGACTA CCGCCACGAC GAAAAAGCAG GCGATGCAGT CGAAAACTTT

1051       TTTAACAACC AAACGCAAAA CGGCGGCATC GAGTTGCGCC AACAACCGAT

1101       AGGTCGTCTG AAAGGCAGCT GGGGCGTGCA ATATTTACAA CAAAAATCCA

1151       GTGCTTTATC TGCCATATCC GAAGCGGTTA AACAACCGAT GCTGCTTGAC

1201       AACAAAGTGC AACATTACAG CTTTTTCGGT GTAGAACAGG CAAACTGGGA

1251       CAACTTCACG CTTGAAGGAG GCGTACGCGT GGAAAAACAA AAAGCCTCCA

1301       TTCAGTACGA CAAAGCATTG ATTGATCGGG AAAACTACTA CAACCACCCC

1351       CTGCCCGACC TCGGCGCGCA CCGCCAAACC GCCCGCTCAT TCGCACTTTC

1401       GGGCAACTGG TATTTCACGC CACAACACAA ACTCAGCCTG ACCGCCTCCC

1451       ATCAGGAACG CCTGCCGTCA ACGCAAGAGC TGTACGCACA CGGCAAACAC

1501       GTCGCCACCA ACACCTTTGA AGTCGGCAAC AAACACCTCA ACAAAGAGCG
```

```
-continued
1551      TTCCAACAAT ATCGAACTCG CGCTGGGCTA CGAAGGCGAC CGCTGGCAAT

1601      ACAATCTGGC ACTCTACCGC AACCGCTTCG GTAACTACAT TTACGCCCAA

1651      ACCTTAAACG ACGGACGCGG CCCCAAATCC ATCGAAGACG ACAGCGAAAT

1701      GAAGCTCGTG CGCTACAACC AATCCGGCGC CGACTTCTAC GGCGCGGAAG

1751      GCGAAATCTA CTTCAAACCG ACACCGCGCT ACCGCATCGG CGTTTCCGGC

1801      GACTATGTAC GAGGCCGTCT GAAAAACCTG CCTTCCCTAC CCGGCAGAGA

1851      AGATGCCTAC GGCAACCGTC CTTTCATCGC ACAGGACGAC CAAAATGCCC

1901      CCCGTGTTCC GGCTGCGCGC CTCGGCTTCC ACCTGAAAGC CTCGCTGACC

1951      GACCGTATCG ATGCCAATTT GGACTACTAC CGCGTGTTCG CCCAAAACAA

2001      ACTCGCCCGC TACGAAACGC GCACGCCCGG ACACCATATG CTCAACCTCG

2051      GCGCAAACTA CCGCCGCAAT ACGCGCTATG GCGAGTGGAA TTGGTACGTC

2101      AAAGCCGACA ACCTGCTCAA CCAATCCGTT TACGCCCACA GCAGCTTTCT

2151      CTCTGATACG CCGCAAATGG GCCGCAGCTT TACCGGCGGC GTGAACGTGA

2201      AGTTTTAA
```

This corresponds to the amino acid sequence <SEQ ID 586; ORF 147>:

```
m147.pep (partial)
  1. . .    PHKTEQSVDL ETVSVVGKSR PRATSGLLHT STASDKIISG DTLRQKAVNL

51       GDALDGVPGI HASQYGGGAS APVIRGQTGR RIKVLNHHGE TGDMADFSPD

101       HAIMVDTALS QQVEILRGPV TLLYSSGNVA GLVDVADGKI PEKMPENGVS

151       GELGLRLSSG NLEKLTSGGI NIGLGKNFVL HTEGLYRKSG DYAVPRYRNL

201       KRLPDSHADS QTGSIGLSWV GEKGFIGVAY SDRRDQYGLP AHSHEYDDCH

251       ADIIWQKSLI NKRYLQLYPH LLTEEDIDYD NPGLSCGFHD DDNAHAHTHS

301       GRPWIDLRNK RYELRAEWKQ PFPGFEALRV HLNRNDYRHD EKAGDAVENF

351       FNNQTQNARI ELRHQPIGRL KGSWGVQYLQ QKSSALSAIS EAVKQPMLLD

401       NKVQHYSFFG VEQANWDNFT LEGGVRVEKQ KASIQYDKAL IDRENYYNHP

451       LPDLGAHRQT ARSFALSGNW YFTPQHKLSL TASHQERLPS TQELYAHGKH

501       VATNTFEVGN KHLNKERSNN IELALGYEGD RWQYNLALYR NRFGNYIYAQ

551       TLNDGRGPKS IEDDSEMKLV RYNQSGADFY GAEGEIYFKP TPRYRIGVSG

601       DYVRGRLKNL PSLPGREDAY GNRPFIAQDD QNAPRVPAAR LGFHLKASLT

651       DRIDANLDYY RVFAQNKLAR YETRTPGHHM LNLGANYRRN TRYGEWNWYV

701       KADNLLNQSV YAHSSFLSDT PQMGRSFTGG VNVKF*
```

Computer analysis of this amino acid sequence gave the following results:

Homology with a Predicted ORF from *N. gonorrhoeae*

```
   m147/g147 92.3% identity in 142 aa overlap 10        20        30
    m147.pep               PHKTEQSVDLETVSVVGKSRPRATSGLLHTS
                           |:||||| ||||||||||||||||||||||
    g147       MRREAKMAQITLKPIVLSILLINTPLLAQAHETEQSVGLETVSVVGKSRPRATSGLLHTS
                   10        20        30        40        50        60
```

-continued

```
                 40         50         60         70         80         90
m147.pep TASDKIISGDTLRQKAVNLGDALDGVPGIHASQYGGGASAPVIRGQTGRRIKVLNHHGET
         ||||||||||||||||||||||||||||||||||||||||||||||||||||||||||||
g147     TASDKIISGDTLRQKAVNLGDALDGVPGIHASQYGGGASAPVIRGQTGRRIKVLNHHGET
                   70         80         90        100        110        120

100        110        120        130        140        150
m147.pep GDMADFSPDHAIMVDTALSQQVEILRGPVTLLYSSGNVAGLVDVADGKIPEKMPENGVSG
         ||||||||||||||||||||||||||||||||||||||||   :     | | |
g147     GDMADFSPDHAIMVDTALSQQVEILRGPVTLLYSSGNVAGAGQCCRWKNPPKNA
```

The following partial DNA sequence was identified in *N. meningitidis* <SEQ ID 587>:

```
a147.seq
   1 ATGCGACGAG AAGCCAAAAT GGCACAAACT ACACTCAAAC CCATTGTTTT

51 ATCAATTCTT TTAATCAACA CACCCCTCCT CTCCCAAGCG CATGGAACTG

101 AGCAATCAGT GGGCTTGGAA ACGGTCAGCG TCGTCGGCAA AAGCCGTCCG

151 CGCGCCACTT CGGGGCTGCT GCACACTTCT ACCGCCTCCG ACAAAATCAT

201 CAGCGGCGAC ACCTTGCGAC AAAAAGCCGT CAACTTGGGT GATGCTTTAG

251 ACGGCGTACC GGGCATTCAT GCCTCGCAAT ACGGCGGCGG CGCATCCGCT

301 CCCGTTATTC GCGGTCAAAC AGGCAGACGG ATTAAAGTGT TGAACCATCA

351 CGGCGAAACG GGCGACATGG CGGACTTCTC TCCAGACCAT GCAATCATGG

401 TGGACAGCGC CTTGTCGCAA CAGGTCGAAA TCCTGCGCGG TCCGGTTACG

451 CTCTTGTACA GCTCGGGCAA TGTGGCGGGG CTGGTCGATG TTGCCGATGG

501 CAAAATCCCC GAAAAAATGC CTGAAAACGG CGTATCGGGC GAACTCGGAT

551 TGCGTTTGAG CAGCGGCAAT CTGGAAAAAC TCACGTCCGG CGGCATCAAT

601 ATCGGTTTGG GCAAAAACTT TGTATTGCAC ACGGAAGGGC TGTACCGCAA

651 ATCGGGGGAT TACGCCGTAC CGCGTTACCG CAATCTGAAA CGCCTGCCCG

701 ACAGCCACGC CGATTCGCAA ACGGGCAGCA TCGGGCTGTC TTGGGTTGGC

751 GAAAAAGGCT TTATCGGCGC AGCATACAGC GACCGTCGCG ACCAATATGG

801 TCTGCCTGCC CACAGCCACG AATACGATGA TTGCCACGCC GACATCATCT

851 GGCAAAAGAG TTTGATTAAC AAACGCTATT TGCAGCTTTA TCCGCACCTG

901 TTGACCGAAG AAGACATCGA TTACGACAAT CCGGGCTTGA GCTGCGGCTT

951 TCACGACGAC GATGATGCAC ACGCCCATGC CCACAACGGC AAACCTTGGA

1001 TAGACCTGCG CAACAAACGC TACGAACTCC GCGCCGAATG GAAGCAACCG

1051 TTCCCCGGTT TTGAAGCCCT GCGCGTACAC CTGAACCGCA ACGACTACCG

1101 CCACGACGAA AAAGCAGGCG ATGCAGTAGA AAACTTTTTT AACAACCAAA

1151 CGCAAAACGC CCGTATCGAG TTGCGCCACC AACCCATAGG CCGTCTGAAA

1201 GGCAGCTGGG GCGTGCAATA TTTGGGACAA AAATCCAGTG CTTTATCTGC

1251 CACATCCGAA GCGGTCAAAC AACCGATGCT GCTTGACAAT AAAGTGCAAC

1301 ATTACAGCTT TTTCGGTGTA GAACAGGCAA ACTGGGACAA CTTCACGCTT

1351 GAAGGCGGCG TACGCGTGGA AAAACAAAAA GCCTCCATCC GCTACGACAA

1401 AGCATTGATT GATCGGGAAA ACTACTACAA CCATCCCCTG CCCGACCTCG

1451 GCGCGCACCG CCAAACCGCC CGCTCATTCG CACTTTCGGG CAACTGGTAT
```

-continued

```
1501 TTCACGCCAC AACACAAACT CAGCCTGACC GCCTCCCATC AGGAACGCCT

1551 GCCGTCAACG CAAGAGCTGT ACGCACACGG CAAACACGTC GCCACCAACA

1601 CCTTTGAAGT CGGCAACAAA CACCTCAACA AGAGCGTTC CAACAATATC

1651 GAACTCGCGC TGGGCTACGA AGGCGACCGC TGGCAATACA ATCTGGCACT

1701 CTACCGCAAC CGCTTCGGCA ACTACATTTA CGCCCAAACC TTAAACGACG

1751 GACGCGGCCC CAAATCCATC GAAGACGACA GCGAAATGAA GCTCGTGCGC

1801 TACAACCAAT CCGGTGCGGA CTTCTACGGC GCGGAAGGCG AAATCTACTT

1851 CAAACCGACA CCGCGCTACC GCATCGGCGT TTCCGGCGAC TATGTACGAG

1901 GCCGTCTGAA AAACCTGCCT TCCCTACCCG GCAGGGAAGA CGCCTACGGC

1951 AACCGCCCAC TCATTGCCCA AGCCGACCAA AACGCCCCTC GCGTTCCGGC

2001 TGCGCGCCTC GGCGTCCACC TGAAAGCCTC GCTGACCGAC CGCATCGATG

2051 CCAATTTGGA CTACTACCGC GTGTTCGCCC AAAACAAACT CGCCCGCTAC

2101 GAAACGCGCA CGCCCGGACA CCATATGCTC AACCTCGGCG CAAACTACCG

2151 CCGCAATACG CGCTATGGCG AGTGGAATTG GTACGTCAAA GCCGACAACC

2201 TGCTCAACCA ATCCGTTTAC GCCCACAGCA GCTTCCTCTC TGATACGCCG

2251 CAAATGGGCC GCAGCTTTAC CGGCGGCGTG AACGTGAAGT TTTAA
```

This corresponds to the amino acid sequence <SEQ ID 588; ORF 147.a>:

```
a147.pep

1 MRREAKMAQT TLKPIVLSIL LINTPLLSQA HGTEQSVGLE TVSVVGKSRP

51 RATSGLLHTS TASDKIISGD TLRQKAVNLG DALDGVPGIH ASQYGGGASA

101 PVIRGQTGRR IKVLNHHGET GDMADFSPDH AIMVDSALSQ QVEILRGPVT

151 LLYSSGNVAG LVDVADGKIP EKMPENGVSG ELGLRLSSGN LEKLTSGGIN

201 IGLGKNFVLH TEGLYRKSGD YAVPRYRNLK RLPDSHADSQ TGSIGLSWVG

251 EKGFIGAAYS DRRDQYGLPA HSHEYDDCHA DIIWQKSLIN KRYLQLYPHL

301 LTEEDIDYDN PGLSCGFHDD DDAHAHAHNG KPWIDLRNKR YELRAEWKQP

351 FPGFEALRVH LNRNDYRHDE KAGDAVENFF NNQTQNARIE LRHQPIGRLK

401 GSWGVQYLGQ KSSALSATSE AVKQPMLLDN KVQHYSFFGV EQANWDNFTL

451 EGGVRVEKQK ASIRYDKALI DRENYYNHPL PDLGAHRQTA RSFALSGNWY

501 FTPQHKLSLT ASHQERLPST QELYAHGKHV ATNTFEVGNK HLNKERSNNI

551 ELALGYEGDR WQYNLALYRN RFGNYIYAQT LNDGRGPKSI EDDSEMKLVR

601 YNQSGADFYG AEGEIYFKPT PRYRIGVSGD YVRGRLKNLP SLPGREDAYG

651 NRPLIAQADQ NAPRVPAARL GVHLKASLTD RIDANLDYYR VFAQNKLARY

701 ETRTPGHHML NLGANYRRNT RYGEWNWYVK ADNLLNQSVY AHSSFLSDTP

751 QMGRSFTGGV NVKF* m147/a147 98.1% identity in 734 aa overlap 10         20        30
      m147.pep               PHKTEQSVDLETVSVVGKSRPRATSGLLHTS
                              ||||||  ||||||||||||||||||||||
      a147        MRREAKMAQTTLKPIVLSILLINTPLLSQAHGTEQSVGLETVSVVGKSRPRATSGLLHTS
                          10        20        30        40        50        60
```

```
                40         50         60         70         80         90
m147.pep  TASDKIISGDTLRQKAVNLGDALDGVPGIHASQYGGGASAPVIRGQTGRRIKVLNHHGET
          ||||||||||||||||||||||||||||||||||||||||||||||||||||||||||||
a147      TASDKIISGDTLRQKAVNLGDALDGVPGIHASQYGGGASAPVIRGQTGRRIKVLNHHGET
                70         80         90        100        110        120

100        110        120        130        140        150
m147.pep  GDMADFSPDHAIMVDTALSQQVEILRGPVTLLYSSGNVAGLVDVADGKIPEKMPENGVSG
          ||||||||||||||||:|||||||||||||||||||||||||||||||||||||||||||
a147      GDMADFSPDHAIMVDSALSQQVEILRGPVTLLYSSGNVAGLVDVADGKIPEKMPENGVSG
               130        140        150        160        170        180

160        170        180        190        200        210
m147.pep  ELGLRLSSGNLEKLTSGGINIGLGKNFVLHTEGLYRKSGDYAVPRYRNLKRLPDSHADSQ
          ||||||||||||||||||||||||||||||||||||||||||||||||||||||||||||
a147      ELGLRLSSGNLEKLTSGGINIGLGKNFVLHTEGLYRKSGDYAVPRYRNLKRLPDSHADSQ
               190        200        210        220        230        240

220        230        240        250        260        270
m147.pep  TGSIGLSWVGEKGFIGVAYSDRRDQYGLPAHSHEYDDCHADIIWQKSLINKRYLQLYPHL
          ||||||||||||||||:|||||||||||||||||||||||||||||||||||||||||||
a147      TGSIGLSWVGEKGFIGAAYSDRRDQYGLPAHSHEYDDCHADIIWQKSLINKRYLQLYPHL
               250        260        270        280        290        300

280        290        300        310        320        330
m147.pep  LTEEDIDYDNPGLSCGFHDDDNAHAHTHSGRPWIDLRNKRYELRAEWKQPFPGFEALRVH
          |||||||||||||||||||||:||||:|:|||||||||||||||||||||||||||||||
a147      LTEEDIDYDNPGLSCGFHDDDDAHAHAHNGKPWIDLRNKRYELRAEWKQPFPGFEALRVH
               310        320        330        340        350        360

340        350        360        370        380        390
m147.pep  LNRNDYRHDEKAGDAVENFFNNQTQNARIELRHQPIGRLKGSWGVQYLQQKSSALSAISE
          ||||||||||||||||||||||||||||||||||||||||||||||||  |||||| ||
a147      LNRNDYRHDEKAGDAVENFFNNQTQNARIELRHQPIGRLKGSWGVQYLGQKSSALSATSE
               370        380        390        400        410        420

400        410        420        430        440        450
m147.pep  AVKQPMLLDNKVQHYSFFGVEQANWDNFTLEGGVRVEKQKASIQYDKALIDRENYYNHPL
          ||||||||||||||||||||||||||||||||||||||||||||:|||||||||||||||
a147      AVKQPMLLDNKVQHYSFFGVEQANWDNFTLEGGVRVEKQKASIRYDKALIDRENYYNHPL
               430        440        450        460        470        480

460        470        480        490        500        510
m147.pep  PDLGAHRQTARSFALSGNWYFTPQHKLSLTASHQERLPSTQELYAHGKHVATNTFEVGNK
          |||||||||||||||||||||||||||||||||||||||||||:||||||||||||||||
a147      PDLGAHRQTARSFALSGNWYFTPQHKLSLTASHQERLPSTQELYAHGKHVATNTFEVGNK
               490        500        510        520        530        540

520        530        540        550        560        570
m147.pep  HLNKERSNNIELALGYEGDRWQYNLALYRNRFGNYIYAQTLNDGRGPKSIEDDSEMKLVR
          ||||||||||||||||||||||||||||||||||||||||||||||||||||||||||||
a147      HLNKERSNNIELALGYEGDRWQYNLALYRNRFGNYIYAQTLNDGRGPKSIEDDSEMKLVR
               550        560        570        580        590        600

580        590        600        610        620        630
m147.pep  YNQSGADFYGAEGEIYFKPTPRYRIGVSGDYVRGRLKNLPSLPGREDAYGNRPFIAQDDQ
          ||||||||||||||||||||||||||||||||||||||||||||||||||||:|||  ||
a147      YNQSGADFYGAEGEIYFKPTPRYRIGVSGDYVRGRLKNLPSLPGREDAYGNRPLIAQADQ
               610        620        630        640        650        660

640        650        660        670        680        690
m147.pep  NAPRVPAARLGFHLKASLTDRIDANLDYYRVFAQNKLARYETRTPGHHMLNLGANYRRNT
          |||||||||||| |||||||||||||||||||||||||||||||||||||||||||||||
a147      NAPRVPAARLGVHLKASLTDRIDANLDYYRVFAQNKLARYETRTPGHHMLNLGANYRRNT
               670        680        690        700        710        720

700        710        720        730
m147.pep  RYGEWNWYVKADNLLNQSVYAHSSFLSDTPQMGRSFTGGVNVKFX
          ||||||||||| ||||||||||||||||||||||||||||||||
a147      RYGEWNWYVKADNLLNQSVYAHSSFLSDTPQMGRSFTGGVNVKFX
               730        740        750        760
```

The following partial DNA sequence was identified in *N. gonorrhoeae* <SEQ ID 589>:

```
g148.seq
  1  ATGGCGTTAA AAACATCAAA CTTGGAACAC GCAATGctgg ttcaTCCCGA

51  AgctATgagt gtcggcgCGC TTGccgAcaa AATCCGCAAA AtcgaAAact 101  gGCCGCAAAA AGgcaTCTTA TTCCACGACA TCACGCCCGT CCTGCAAAGT

151  GCGGAATACT TCCGCCTTTT GGTCGATTTG CTGGTTTACC GCTATATGGA

201  TCAGAAAATC GACATCGTTG CCGGCTTGGA CGCGCGCGGC TTCATTATCG
```

-continued

```
251 GCGCGGCACT CGCCTACCAG CTCAaCGtcg gctTCGTCCC CATCCGCAAA

301 AAAGGCAAGC TGCCTTTTGA AACCGTATCG CAAAGCTAcg cgcTCGAATA

351 CGGGGAAGCT GCGGTGGAAA TCCACACCGa tgccgTCAAA CCCGGTTCGC

401 GCGTCCTGCT GGTCGATGAT TTGGTTGCCA CGGGCGGCAC AATGCTTGCC

451 GGGCTGGAAC TGATCCGCAA ACTCGGCGGG GAAATTGTCG AAgccgccgC

501 CATTTTGGAA TTTACCGACC TTCAAGGCGG CAAGAATATC CGCGCAAGTG

551 GCGCGCCCTT ATTTACCCTG CTTCAAAACG AAGGCTGCAT GAAAGGCTGA
```

This corresponds to the amino acid sequence <SEQ ID 590; ORF 148.ng>:

```
g148.pep
  1 MALKTSNLEH AMLVHPEAMS VGALADKIRK IENWPQKGIL FHDITPVLQS

51 AEYFRLLVDL LVYRYMDQKI DIVAGLDARG FIIGAALAYQ LNVGFVPIRK

101 KGKLPFETVS QSYALEYGEA AVEIHTDAVK PGSRVLLVDD LVATGGTMLA

151 GLELIRKLGG EIVEAAAILE FTDLQGGKNI RASGAPLFTL LQNEGCMKG*
```
                                                          25

The following partial DNA sequence was identified in *N. meningitidis* <SEQ ID 591>:

```
m148.seq
  1 ATGGCGTTAA AAACATCAAA CTTGGAACAC GCAATGCTGG TTCATCCCGA

51 AGCTATGAGT GTCGGCGCGC TTGCCGACAA AATCCGCAAA ATCGAAAACT

101 GGCCGCAAAA AGGCATCTTA TTCCACGACA TCACGCCCGT CCTTCAAAGC

151 GCGGAATACT TCCGCCTTTT GGTTGATTTA TTGGTTTACC GCTATATGGA

201 TCAGAAAATC GACATCGTTG CCGGTTTGGA CGCGCGCGGC TTCATTATCG

251 GCGCGGCACT CGCCTACCAG CTCAACGTCG GTTTCGTCCC CATCCGCAAA

301 AAAGGCAAGC TGCCTTTTGA AACCGTATCG CAAAGCTACG CGCTCGAATA

351 CGGGGAAGCT GCGGTGGAAA TCCACACCGA TGCCGTCAAA CTCGGTTCGC

401 GCGTGCTGCT GGTCGATGAT TTGATTGCCA CGGGCGGCAC GATGCTTGCC

451 GGACTGGAAC TGATCCGCAA ACTCGGCGGA GAAATTGTCG AAGCCGCCGC

501 CATTTTGGAA TTTACCGACC TTCAAGGCGG CAAGAATATC CGTGCAAGCG

551 GCGCGCCCTT ATTTACCCTG CTTCAAAACG AAGGCTGTAT GAAGGGCTGA
```

This corresponds to the amino acid sequence <SEQ ID 592; ORF 148>:

```
m148.pep
  1 MALKTSNLEH AMLVHPEAMS VGALADKIRK IENWPQKGIL FHDITPVLQS

51 AEYFRLLVDL LVYRYMDQKI DIVAGLDARG FIIGAALAYQ LNVGFVPIRK

101 KGKLPFETVS QSYALEYGEA AVEIHTDAVK LGSRVLLVDD LIATGGTMLA

151 GLELIRKLGG EIVEAAAILE FTDLQGGKNI RASGAPLFTL LQNEGCMKG*
```

Computer analysis of this amino acid sequence gave the following results:
Homology with a Predicted ORF from *N. gonorrhoeae*

```
m148/g148  99.0% identity in 199 aa overlap 10        20        30        40        50        60
m148.pep  MALKTSNLEHAMLVHPEAMSVGALADKIRKIENWPQKGILFHDITPVLQSAEYFRLLVDL
          ||||||||||||||||||||||||||||||||||||||||||||||||||||||||||||
g148      MALKTSNLEHAMLVHPEAMSVGALADKIRKIENWPQKGILFHDITPVLQSAEYFRLLVDL
                 10        20        30        40        50        60

70        80        90       100       110       120
m148.pep  LVYRYMDQKIDIVAGLDARGFIIGAALAYQLNVGFVPIRKKGKLPFETVSQSYALEYGEA
          ||||||||||||||||||||||||||||||||||||||||||||||||||||||||||||
g148      LVYRYMDQKIDIVAGLDARGFIIGAALAYQLNVGFVPIRKKGKLPFETVSQSYALEYGEA
                 70        80        90       100       110       120

130       140       150       160       170       180
m148.pep  AVEIHTDAVKLGSRVLLVDDLIATGGTMLAGLELIRKLGGEIVEAAAILEFTDLQGGKNI
          |||||||||| ||||||||||:||||||||||||||||||||||||||||||||||||||
g148      AVEIHTDAVKPGSRVLLVDDLVATGGTMLAGLELIRKLGGEIVEAAAILEFTDLQGGKNI
                130       140       150       160       170       180

190       200
m148.pep  RASGAPLFTLLQNEGCMKGX
          ||||||||||||||||||||
g148      RASGAPLFTLLQNEGCMKGX
                190       200
```

The following partial DNA sequence was identified in *N. meningitidis* <SEQ ID 593>:

```
a148.seq
  1  ATGGCGTTAA AAACATCAAA CTTGGAACAC GCAATGCTGG TTCATCCCGA

51  AGCTATGAGT GTCGGTGCGC TTGCCGACAA AATCCGCAAA ATCGAAAACT

101  GGCCGCAAAA AGGCATCTTA TTCCACGACA TCACGCCCGT CCTGCAAAGC

151  GCGGAATACT TCCGACTTTT GGTTGATTTA TTGGTTTACC GCTATATGGA

201  TCAGAAAATC GACATCGTTG CCGGTTTGGA CGCGCGCGGC TTCATTATCG

251  GCGCGGCACT CGCCTACCAG CTCAACGTCG GTTTCGTCCC CATCCGCAAA

301  AAAGGCAAGC TGCCTTTTGA AACCGTATCG CAAAGCTACG CGCTCGAATA

351  CGGGGAAGCT GCGGTGGAAA TCCACACCGA TGCCGTCAAA CTCGGTTCGC

401  GCGTGCTGCT GGTCGATGAT TTGGTTGCCA CGGGCGGCAC GATGCTTGCC

451  GGACTGGAGC TGATCCGCAA ACTCGGCGGG GAAATTGTCG AAGCCGCCGC

501  CATTTTGGAA TTTACCGACC TTCAAGGCGG CAAGAATATC CGTGCAAGCG

551  GCGCGCCCTT ATTTACCCTG CTTCAAAACG AAGGCTGTAT GAAGGGCTGA
```

This corresponds to the amino acid sequence <SEQ ID 594; ORF 148.a>:

```
a148.pep

1  MALKTSNLEH AMLVHPEAMS VGALADKIRK IENWPQKGIL FHDITPVLQS

51  AEYFRLLVDL LVYRYMDQKI DIVAGLDARG FIIGAALAYQ LNVGFVPIRK

101  KGKLPFETVS QSYALEYGEA AVEIHTDAVK LGSRVLLVDD LVATGGTMLA

151  GLELIRKLGG EIVEAAAILE FTDLQGGKNI RASGAPLFTL LQNEGCMKG* m148/a148  99.5% identity in 199 aa overlap 10        20        30        40        50        60
m148.pep  MALKTSNLEHAMLVHPEAMSVGALADKIRKIENWPQKGILFHDITPVLQSAEYFRLLVDL
          ||||||||||||||||||||||||||||||||||||||||||||||||||||||||||||
a148      MALKTSNLEHAMLVHPEAMSVGALADKIRKIENWPQKGILFHDITPVLQSAEYFRLLVDL
                 10        20        30        40        50        60
```

```
                   70         80         90        100        110        120
m148.pep    LVYRYMDQKIDIVAGLDARGFIIGAALAYQLNVGFVPIRKKGKLPFETVSQSYALEYGEA
            ||||||||||||||||||||||||||||||||||||||||||||||||||||||||||||
a148        LVYRYMDQKIDIVAGLDARGFIIGAALAYQLNVGFVPIRKKGKLPFETVSQSYALEYGEA
                   70         80         90        100        110        120

130        140        150        160        170        180
m148.pep    AVEIHTDAVKLGSRVLLVDDLIATGGTMLAGLELIRKLGGEIVEAAAILEFTDLQGGKNI
            |||||||||||||||||||||:||||||||||||||||||||||||||||||||||||||
a148        AVEIHTDAVKLGSRVLLVDDLVATGGTMLAGLELIRKLGGEIVEAAAILEFTDLQGGKNI
                  130        140        150        160        170        180

190        200
m148.pep    RASGAPLFTLLQNEGCMKGX
            ||||||||||||||||||||
a148        RASGAPLFTLLQNEGCMKGX
                  190        200
```

The following partial DNA sequence was identified in *N. gonorrhoeae* <SEQ ID 595>:

```
g149.seq
   1 ATGTTGATTG ACAACAATGT CCGCCATTAC AGCTTTTTCG GTGTAGAACA

51 GGCAAATTGG GACAACTTCA CGCTTGAAGG CGGCGTACGC GTGGAAAAAC

101 AAAAAGCCTC CATCCGGTAC GACAAAGCAT TGATTGATCG AGAAAACTAC

151 TACAACCAGC CCCTGCCCGA CCTCGGCGCG CACCGCCAAA CCGCCCGCTC

201 GTTCGCACTT TCGGGCAACT GGTATTTCAC GCCACACCAC AAACTCAGCC

251 TGACCGCCTC CCATCAGGAa cgCCTGCCGT CAACGCaagA actGtACgca 301 cacggcAAGC ACGtcgccac CAACACCTTT GAagtcggca acaaACACCT 351 CAACAAAGaG CgttccaacA atatcgaACT CGCGCTGGgc tAcaaaggcg 401 accGCTGGCA ATACAATCTG GCAGCCTACC GCAACCGAtT CGGCAACTAC 451 ATTTACGCCC AAACCTTAaa cgacggacgC GGCCCCAAAT CCATCgaaga 501 cgacagcgaA ATGaagcTCG TGCGCTACAA CCAATCCGGT GCCGACTTCT 551 ACGgcgcggA aggcgaaatc tACTTcaaaC CGAcACCGCG CTACCGCATC 601 GGTGTTTCCG GCGACTatgt acgaggccgT CTGAAAAACC TGCCGTCCCT 651 ACCCGGCAGG gaagatccCT AcggcAAACG TCccttcaTC GCACAAGCCG 701 ACCAAAACGC CCCCCGCATT ccggctGCGC GCCTCGGCTT CCACCTGAAA

751 ACCTCGCTAA CCGACCGTAT CGATGCCAAT TTGGACTACT ACCGCGTGTT

801 CGCCCAAAAC AAACTCGCCC GCTACGAAAC GCGTACGCCC GGACACCATA

851 TGCTCAACCT CGGTGCAAAC TACCGCCGCA ATACGCGCTA TGGCGAGTGG

901 AATTGGTACG TCAAAGCCGA CAACCTGCtc aACcaatCcg tTTACGCCCa 951 cAGCAGCTTC CTCTCTGATA CGCCGCAAAt gGGCCGCAGC TTtgccgGCg 1001 gcgtaAACGT GaAGTTttaA
```

This corresponds to the amino acid sequence <SEQ ID 596; ORF 149.ng>:

```
g149.pep
   1 MLIDNNVRHY SFFGVEQANW DNFTLEGGVR VEKQKASIRY DKALIDRENY

51 YNQPLPDLGA HRQTARSFAL SGNWYFTPHH KLSLTASHQE RLPSTQELYA

101 HGKHVATNTF EVGNKHLNKE RSNNIELALG YKGDRWQYNL AAYRNRFGNY

151 IYAQTLNDGR GPKSIEDDSE MKLVRYNQSG ADFYGAEGEI YFKPTPRYRI
```

```
201  GVSGDYVRGR LKNLPSLPGR EDPYGKRPFI AQADQNAPRI PAARLGFHLK

251  TSLTDRIDAN LDYYRVFAQN KLARYETRTP GHHMLNLGAN YRRNTRYGEW

301  NWYVKADNLL NQSVYAHSSF LSDTPQMGRS FAGGVNVKF*
```

The following partial DNA sequence was identified in *N. meningitidis* <SEQ ID 597>:

```
m149.seq
    1  ATGCTGCTTG ACAACAAAGT GCAACATTAC AGCTTTTTCG GTGTAGAACA

51  GGCAAACTGG GACAACTTCA CGCTTGAAGG AGGCGTACGC GTGGAAAAAC

101  AAAAAGCCTC CATTCAGTAC GACAAAGCAT TGATTGATCG GGAAAACTAC

151  TACAACCACC CCCTGCCCGA CCTCGGCGCG CACCGCCAAA CCGCCCGCTC

201  ATTCGCACTT TCGGGCAACT GGTATTTCAC GCCACAACAC AAACTCAGCC

251  TGACCGCCTC CCATCAGGAA CGCCTGCCGT CAACGCAAGA GCTGTACGCA

301  CACGGCAAAC ACGTCGCCAC CAACACCTTT GAAGTCGGCA ACAAACACCT

351  CAACAAAGAG CGTTCCAACA ATATCGAACT CGCGCTGGGC TACGAAGGCG

401  ACCGCTGGCA ATACAATCTG GCACTCTACC GCAACCGCTT CGGTAACTAC

451  ATTTACGCCC AAACCTTAAA CGACGGACGC GGCCCCAAAT CCATCGAAGA

501  CGACAGCGAA ATGAAGCTCG TGCGCTACAA CCAATCCGGC GCCGACTTCT

551  ACGGCGCGGA AGGCGAAATC TACTTCAAAC CGACACCGCG CTACCGCATC

601  GGCGTTTCCG GCGACTATGT ACGAGGCCGT CTGAAAAACC TGCCTTCCCT

651  ACCCGGCAGA GAAGATGCCT ACGGCAACCG TCCTTTCATC GCACAGGACG

701  ACCAAAATGC CCCCCGTGTT CCGGCTGCGC GCCTCGGCTT CCACCTGAAA

751  GCCTCGCTGA CCGACCGTAT CGATGCCAAT TTGGACTACT ACCGCGTGTT

801  CGCCCAAAAC AAACTCGCCC GCTACGAAAC GCGCACGCCC GGACACCATA

851  TGCTCAACCT CGGCGCAAAC TACCGCCGCA ATACGCGCTA TGGCGAGTGG

901  AATTGGTACG TCAAAGCCGA CAACCTGCTC AACCAATCCG TTTACGCCCA

951  CAGCAGCTTT CTCTCTGATA CGCCGCAAAT GGGCCGCAGC TTTACCGGCG

1001  GCGTGAACG TGAAGTTTTA A
```

This corresponds to the amino acid sequence <SEQ ID 598; ORF 149>:

```
m149.pep
    1  MLLDNKVQHY SFFGVEQANW DNFTLEGGVR VEKQKASIQY DKALIDRENY

51  YNHPLPDLGA HRQTARSFAL SGNWYFTPQH KLSLTASHQE RLPSTQELYA

101  HGKHVATNTF EVGNKHLNKE RSNNIELALG YEGDRWQYNL ALYRNRFGNY

151  IYAQTLNDGR GPKSIEDDSE MKLVRYNQSG ADFYGAEGEI YFKPTPRYRI

201  GVSGDYVRGR LKNLPSLPGR EDAYGNRPFI AQDDQNAPRV PAARLGFHLK

251  ASLTDRIDAN LDYYRVFAQN KLARYETRTP GHHMLNLGAN YRRNTRYGEW

301  NWYVKADNLL NQSVYAHSSF LSDTPQMGRS FTGGVNVKF*
```

Computer analysis of this amino acid sequence gave the following results:

Homology with a Predicted ORF from *N. gonorrhoeae*

ORF 149 shows 95.9% identity over a 339 aa overlap with a predicted ORF (ORF 149.ng) from *N. gonorrhoeae*:

```
m149/g149

10        20        30        40        50        60
m149.pep    MLLDNKVQHYSFFGVEQANWDNFTLEGGVRVEKQKASIQYDKALIDRENYYNHPLPDLGA
            ||:||:|:||||||||||||||||||||||||:|||||||||||||:||||||
g149        MLIDNNVRHYSFFGVEQANWDNFTLEGGVRVEKQKASIRYDKALIDRENYYNQPLPDLGA
                10        20        30        40        50        60

70        80        90       100       110       120
m149.pep    HRQTARSFALSGNWYFTPQHKLSLTASHQERLPSTQELYAHGKHVATNTFEVGNKHLNKE
            ||||||||||||||||||:|||||||||||||||||||||||||||||||||||||||||
g149        HRQTARSFALSGNWYFTPHHKLSLTASHQERLPSTQELYAHGKHVATNTFEVGNKHLNKE
                70        80        90       100       110       120

130       140       150       160       170       180
m149.pep    RSNNIELALGYEGDRWQYNLALYRNRFGNYIYAQTLNDGRGPKSIEDDSEMKLVRYNQSG
            |||||||||||:||||||||| ||||||||||||||||||||||||||||||||||||||
g149        RSNNIELALGYKGDRWQYNLAAYRNRFGNYIYAQTLNDGRGPKSIEDDSEMKLVRYNQSG
               130       140       150       160       170       180

190       200       210       220       230       240
m149.pep    ADFYGAEGEIYFKPTPRYRIGVSGDYVRGRLKNLPSLPGREDAYGNRPFIAQDDQNAPRV
            |||||||||||||||||||||||||||||||||||||||||| ||:||||| ||||||:
g149        ADFYGAEGEIYFKPTPRYRIGVSGDYVRGRLKNLPSLPGREDPYGKRPFIAQADONAPRI
               190       200       210       220       230       240

250       260       270       280       290       300
m149.pep    PAARLGFHLKASLTDRIDANLDYYRVFAQNKLARYETRTPGHHMLNLGANYRRNTRYGEW
            |||||||||||:||||||||||||||||||||||||||||||||||||||||||||||||
g149        PAARLGFHLKTSLTDRIDANLDYYRVFAQNKLARYETRTPGHHMLNLGANYRRNTRYGEW
               250       260       270       280       290       300

310       320       330       340
m149.pep    NWYVKADNLLNQSVYAHSSFLSDTPQMGRSFTGGVNVKFX
            ||||||||||||||||||||||||||||||:||||||||
g149        NWYVKADNLLNQSVYAHSSFLSDTPQMGRSFAGGVNVKFX
               310       320       330       340
```

The following partial DNA sequence was identified in *N. meningitidis* <SEQ ID 599>:

```
a149.seq
   1 ATGCTGCTTG ACAATAAAGT GCAACATTAC AGCTTTTTCG GTGTAGAACA

51 GGCAAACTGG GACAACTTCA CGCTTGAAGG CGGCGTACGC GTGGAAAAAC

101 AAAAAGCCTC CATCCGCTAC GACAAAGCAT TGATTGATCG GGAAAACTAC

151 TACAACCATC CCCTGCCCGA CCTCGGCGCG CACCGCCAAA CCGCCCGCTC

201 ATTCGCACTT TCGGGCAACT GGTATTTCAC GCCACAACAC AAACTCAGCC

251 TGACCGCCTC CCATCAGGAA CGCCTGCCGT CAACGCAAGA GCTGTACGCA

301 CACGGCAAAC ACGTCGCCAC CAACACCTTT GAAGTCGGCA ACAAACACCT

351 CAACAAAGAG CGTTCCAACA ATATCGAACT CGCGCTGGGC TACGAAGGCG

401 ACCGCTGGCA ATACAATCTG GCACTCTACC GCAACCGCTT CGGCAACTAC

451 ATTTACGCCC AAACCTTAAA CGACGGACGC GGCCCCAAAT CCATCGAAGA

501 CGACAGCGAA ATGAAGCTCG TGCGCTACAA CCAATCCGGT GCGGACTTCT

551 ACGGCGCGGA AGGCGAAATC TACTTCAAAC CGACACCGCG CTACCGCATC

601 GGCGTTTCCG GCGACTATGT ACGAGGCCGT CTGAAAAACC TGCCTTCCCT

651 ACCCGGCAGG GAAGACGCCT ACGGCAACCG CCCACTCATT GCCCAAGCCG

701 ACCAAAACGC CCCTCGCGTT CCGGCTGCGC GCCTCGGCGT CCACCTGAAA

751 GCCTCGCTGA CCGACCGCAT CGATGCCAAT TTGGACTACT ACCGCGTGTT

801 CGCCCAAAAC AAACTCGCCC GCTACGAAAC GCGCACGCCC GGACACCATA
```

-continued

```
851 TGCTCAACCT CGGCGCAAAC TACCGCCGCA ATACGCGCTA TGGCGAGTGG

901 AATTGGTACG TCAAAGCCGA CAACCTGCTC AACCAATCCG TTTACGCCCA

951 CAGCAGCTTC CTCTCTGATA CGCCGCAAAT GGGCCGCAGC TTTACCGGCG

1001 GCGTGAACGT GAAGTTTTAA
```

This corresponds to the amino acid sequence <SEQ ID 600; ORF 149.a>:

```
a149.pep
  1 MLLDNKVQHY SFFGVEQANW DNFTLEGGVR VEKQKASIRY DKALIDRENY

51 YNHPLPDLGA HRQTARSFAL SGNWYFTPQH KLSLTASHQE RLPSTQELYA

101 HGKHVATNTF EVGNKHLNKE RSNNIELALG YEGDRWQYNL ALYRNRFGNY

151 IYAQTLNDGR GPKSIEDDSE MKLVRYNQSG ADFYGAEGEI YFKPTPRYRI

201 GVSGDYVRGR LKNLPSLPGR EDAYGNRPLI AQADQNAPRV PAARLGVHLK

251 ASLTDRIDAN LDYYRVFAQN KLARYETRTP GHHMLNLGAN YRRNTRYGEW

301 NWYVKADNLL NQSVYAHSSF LSDTPQMGRS FTGGVNVKF*
``` m149/a149 98.8% identity in 339 aa overlap

```
                  10         20         30         40         50         60
m149.pep  MLLDNKVQHYSFFGVEQANWDNFTLEGGVRVEKQKASIQYDKALIDRENYYNHPLPDLGA
          ||||||||||||||||||||||||||||||||||||| ||||||||||||||||||||||
a149      MLLDNKVQHYSFFGVEQANWDNFTLEGGVRVEKQKASIRYDKALIDRENYYNHPLPDLGA
                  10         20         30         40         50         60

70         80         90        100        110        120
m149.pep  HRQTARSFALSGNWYFTPQHKLSLTASHQERLPSTQELYAHGKHVATNTFEVGNKHLNKE
          ||||||||||||||||||||||||||||||||||||||||||||||||||||||||||||
a149      HRQTARSFALSGNWYFTPQHKLSLTASHQERLPSTQELYAHGKHVATNTFEVGNKHLNKE
                  70         80         90        100        110        120

130        140        150        160        170        180
m149.pep  RSNNIELALGYEGDRWQYNLALYRNRFGNYIYAQTLNDGRGPKSIEDDSEMKLVRYNQSG
          ||||||||||||||||||||||||||||||||||||||||||||||||||||||||||||
a149      RSNNIELALGYEGDRWQYNLALYRNRFGNYIYAQTLNDGRGPKSIEDDSEMKLVRYNQSG
                 130        140        150        160        170        180

190        200        210        220        230        240
m149.pep  ADFYGAEGEIYFKPTPRYRIGVSGDYVRGRLKNLPSLPGREDAYGNRPFIAQDDQNAPRV
          ||||||||||||||||||||||||||||||||||||||||||||||||| |||  |||||
a149      ADFYGAEGEIYFKPTPRYRIGVSGDYVRGRLKNLPSLPGREDAYGNRPLIAQADQNAPRV
                 190        200        210        220        230        240

250        260        270        280        290        300
m149.pep  PAARLGFHLKASLTDRIDANLDYYRVFAQNKLARYETRTPGHHMLNLGANYRRNTRYGEW
          |||||| |||||||||||||||||||||||||||||||||||||||||||||||||||||
a149      PAARLGVHLKASLTDRIDANLDYYRVFAQNKLARYETRTPGHHMLNLGANYRRNTRYGEW
                 250        260        270        280        290        300

310        320        330        340
m149.pep  NWYVKADNLLNQSVYAHSSFLSDTPQMGRSFTGGVNVKFX
          ||||||||||||||||||||||||||||||||||||||||
a149      NWYVKADNLLNQSVYAHSSFLSDTPQMGRSFTGGVNVKFX
                 310        320        330        340
```

The following partial DNA sequence was identified in *N. gonorrhoeae* <SEQ ID 601>:

```
g149-1.seq
  1 ATGGCACAAA TCACACTCAA ACCCATTGTT TTATCAATTC TTTTAATCAA

51 CACACCCCTC CTCGCCCAAG CGCATGAAAC TGAGCAATCG GTGGGCTTGG

101 AAACGGTCAG CGTCGTCGGC AAAAGCCGTC CGCGCGCGAC TTCGGGGCTG

151 CTGCACACTT CGACCGCCTC CGACAAAATC ATCTCCGGCG ATACTTTGCG

201 CCAAAAAGCC GTCAACTTGG GCGACGCTTT GGACGGCGTA CCGGGCATCC
```

```
 251 ACGCTTCGCA ATACGGCGGC GGCGCATCCG CTCCCGTTAT TCGCGGTCAA

301 ACGGGCAGAC GGATTAAAGT ATTGAACCAT CACGGCGAAA CGGGCGATAT

351 GGCGGACTTT TCTCCCGATC ACGCCATTAT GGTAGATACC GCCTTGTCGC

401 AACAGGTTGA ATCCTGCGC GGGCCGGTTA CGCTCTTGTA CAGCTCGGGC

451 AATGTGGCGG GGCTGGTCGA TGTTGCCGAT GGAAAAATCC CCGAAAAAAT

501 GCCTGAAAAC GGCGTATCGG GCGaagccgG ATTGCGTTTG AGCAGCGGCA

551 ATTTAGAAAA ACTGACATCC GCAGGCATCA ATATCGGACT GGGCAAAAAC

601 TTCGTGCTGC ATACCGAAGG CTTGTACCGC AAATCGGGCG ATTACGCCGT

651 ACCGCGTTAC CGCAATCTGA AACGCCTGCC CGACAGCCAT GCCGATTCGC

701 AAACGGGCAG CATCGGGCTG TCTTGGGTGG GCGAAAAAGG CTTTATCGGC

751 GCAGCATACA GCGACCGTCG CGACCGCTAC GGCCTGCCTG CCCACAGCCA

801 CGAATACGAT GATTGCCACG CCGACATCAT CTGGCAAAAG AGTTTGATCA

851 ACAAACGCTA TTTGCAGCTT TATCCGCACT TGTTGACCGA AGAAGACATC

901 GATTACGACA ATCCGGGCTT GAGCTGCGGC TTCCACGACG GCGACGGTGC

951 ACACGCACAC ACCCACAACG GCAAACCGTG GATAGACCTG CGCAACAAAC

1001 GCTACGAACT CCGCGCCGAA TGGAAGCAGC CATTCCCCGG TTTTGAAGCC

1051 CTGCGCGTAC ATCTGAACCG CAATGACTAC CACCACGACG AAAAAGCAGG

1101 CGATGCAGTA GAAAACTTCT TCAACAACAA AACACACAAC GCCCGTATCG

1151 AGTTGCGCCA CCAACCCATA GGCCGTCTGA AAGGCAGCTG GGGCGTGCAA

1201 TATTTGGGAC AAAAATCCAG CGCGCTTTCC GCCATTCCCG AAACCGTCCA

1251 ACAACCGATG TTGATTGACA ACAATGTCCG CCATTACAGC TTTTTCGGTG

1301 TAGAACAGGC AAATTGGGAC AACTTCACGC TTGAAGGCGG CGTACGCGTG

1351 GAAAAACAAA AAGCCTCCAT CCGGTACGAC AAAGCATTGA TTGATCGAGA

1401 AAACTACTAC AACCAGCCCC TGCCCGACCT CGGCGCGCAC CGCCAAACCG

1451 CCCGCTCGTT CGCACTTTCG GGCAACTGGT ATTTCACGCC ACACCACAAA

1501 CTCAGCCTGA CCGCCTCCCA TCAGGAACGC CTGCCGTCAA CGCAAGAACT

1551 GTACGCACAC GGCAAGCACG TCGCCACCAA CACCTTTGAA GTCGGCAACA

1601 AACACCTCAA CAAAGAGCGT TCCAACAATA TCGAACTCGC GCTGGGCTAC

1651 GAAGGCGACC GCTGGCAATA CAATCTGGCA GCCTACCGCA ACCGATTCGG

1701 CAACTACATT TACGCCCAAA CCTTAAACGA CGGACGCGGC CCCAAATCCA

1751 TCGAAGACGA CAGCGAAATG AAGCTCGTGC GCTACAACCA ATCCGGTGCC

1801 GACTTCTACG GCGCGGAAGG CGAAATCTAC TTCAAACCGA CACCGCGCTA

1851 CCGCATCGGT GTTTCCGGCG ACTATGTACG AGGCCGTCTG AAAAACCTGC

1901 CGTCCCTACC CGGCAGGGAA GATCCCTACG GCAAACGTCC CTTCATCGCA

1951 CAAGCCGACC AAAACGCCCC CCGCATTCCG GCTGCGCGCC TCGGCTTCCA

2001 CCTGAAAACC TCGCTAACCG ACCGTATCGA TGCCAATTTG GACTACTACC

2051 GCGTGTTCGC CCAAAACAAA CTCGCCCGCT ACGAAACGCG TACGCCCGGA

2101 CACCATATGC TCAACCTCGG TGCAAACTAC CGCCGCAATA CGCGCTATGG

2151 CGAGTGGAAT TGGTACGTCA AAGCCGACAA CCTGCTCAAC CAATCCGTTT

2201 ACGCCCACAG CAGCTTCCTC TCTGATACGC CGCAAATGGG CCGCAGCTTT

2251 ACCGGCGGCG TAAACGTGAA GTTTTAA
```

This corresponds to the amino acid sequence <SEQ ID 602; ORF 149-1.ng>:

```
g149-1.pep
    1  MAQITLKPIV LSILLINTPL LAQAHETEQS VGLETVSVVG KSRPRATSGL

51  LHTSTASDKI ISGDTLRQKA VNLGDALDGV PGIHASQYGG GASAPVIRGQ

101  TGRRIKVLNH HGETGDMADF SPDHAIMVDT ALSQQVEILR GPVTLLYSSG

151  NVAGLVDVAD GKIPEKMPEN GVSGEAGLRL SSGNLEKLTS AGINIGLGKN

201  FVLHTEGLYR KSGDYAVPRY RNLKRLPDSH ADSQTGSIGL SWVGEKGFIG

251  AAYSDRRDRY GLPAHSHEYD DCHADIIWQK SLINKRYLQL YPHLLTEEDI

301  DYDNPGLSCG FHDGDGAHAH THNGKPWIDL RNKRYELRAE WKQPFPGFEA

351  LRVHLNRNDY HHDEKAGDAV ENFFNNKTHN ARIELRHQPI GRLKGSWGVQ

401  YLGQKSSALS AIPETVQQPM LIDNNVRHYS FFGVEQANWD NFTLEGGVRV

451  EKQKASIRYD KALIDRENYY NQPLPDLGAH RQTARSFALS GNWYFTPHHK

501  LSLTASHQER LPSTQELYAH GKHVATNTFE VGNKHLNKER SNNIELALGY

551  EGDRWQYNLA AYRNRFGNYI YAQTLNDGRG PKSIEDDSEM KLVRYNQSGA

601  DFYGAEGEIY FKPTPRYRIG VSGDYVRGRL KNLPSLPGRE DPYGKRPFIA

651  QADQNAPRIP AARLGFHLKT SLTDRIDANL DYYRVFAQNK LARYETRTPG

701  HHMLNLGANY RRNTRYGEWN WYVKADNLLN QSVYAHSSFL SDTPQMGRSF

751  TGGVNVKF*
```

The following partial DNA sequence was identified in *N. meningitidis* <SEQ ID 603>:

```
m149-1.seq
    1  ATGGCACAAA CTACACTCAA ACCCATTGTT TTATCAATTC TTTTAATCAA

51  CACACCCCTC CTCGCCCAAG CGCATGAAAC TGAGCAATCG GTGGATTTGG

101  AAACGGTCAG CGTCGTCGGC AAAAGCCGTC CGCGCGCCAC GTCGGGGCTG

151  TTGCACACTT CGACCGCCTC CGACAAAATC ATCTCCGGCG ATACCTTGCG

201  CCAAAAAGCC GTCAACTTGG GCGACGCTTT AGACGGCGTA CCGGGCATCC

251  ACGCTTCGCA ATACGGCGGC GGCGCGTCTG CTCCCGTCAT TCGCGGTCAA

301  ACAGGCAGGC GGATTAAAGT GTTGAACCAT CACGGCGAAA CAGGCGATAT

351  GGCGGATTTT TCGCCCGATC ACGCCATTAT GGTAGATACC GCCTTGTCGC

401  AACAGGTCGA AATCCTGCGC GGGCCGGTTA CGCTCTTGTA CAGCTCGGGC

451  AATGTGGCGG GGCTGGTCGA TGTTGCCGAT GGCAAAATCC CCGAAAAAAT

501  GCCTGAAAAC GGCGTATCGG GCGAACTCGG ATTGCGTTTG AGCAGCGGCA

551  ATCTGGAAAA ACTCACGTCC GGCGGCATCA ATATCGGTTT GGGCAAAAAC

601  TTTGTATTGC ACACGGAAGG GCTGTACCGC AAATCGGGGG ATTACGCCGT

651  ACCGCGTTAC CGCAATCTGA AACGCCTGCC CGACAGCCAC GCCGATTCGC

701  AAACGGGCAG CATCGGGCTG TCTTGGGTTG GCGAAAAAGG TTTTATCGGC

751  GTAGCGTACA GCGACCGTCG CGACCAATAT GGTCTGCCTG CCCACAGCCA

801  CGAATACGAT GATTGCCACG CCGACATCAT CTGGCAAAAG AGCTTGATTA

851  ACAAACGCTA TTTACAGCTT TATCCGCACC TGTTGACCGA AGAAGACATC

901  GATTACGACA ATCCGGGCTT GAGCTGCGGC TTCCACGACG ACGATAATGC
```

-continued

```
 951 ACACGCACAC ACCCACAGCG GCAGACCGTG GATAGACCTG CGCAACAAAC
1001 GCTACGAACT CCGTGCCGAA TGGAAGCAAC CGTTCCCCGG TTTTGAAGCC
1051 CTGCGCGTAC ACCTGAACCG CAACGACTAC CGCCACGACG AAAAAGCAGG
1101 CGATGCAGTC GAAAACTTTT TTAACAACCA AACGCAAAAC GCCCGCATCG
1151 AGTTGCGCCA CCAACCCATA GGTCGTCTGA AAGGCAGCTG GGGCGTGCAA
1201 TATTTACAAC AAAAATCCAG TGCTTTATCT GCCATATCCG AAGCGGTTAA
1251 ACAACCGATG CTGCTTGACA ACAAAGTGCA ACATTACAGC TTTTTCGGTG
1301 TAGAACAGGC AAACTGGGAC AACTTCACGC TTGAAGGAGG CGTACGCGTG
1351 GAAAAACAAA AAGCCTCCAT TCAGTACGAC AAAGCATTGA TTGATCGGGA
1401 AAACTACTAC AACCACCCCC TGCCCGACCT CGGCGCGCAC CGCCAAACCG
1451 CCCGCTCATT CGCACTTTCG GGCAACTGGT ATTTCACGCC ACAACACAAA
1501 CTCAGCCTGA CCGCCTCCCA TCAGGAACGC TGCCGTCAA CGCAAGAGCT
1551 GTACGCACAC GGCAAACACG TCGCCACCAA CACCTTTGAA GTCGGCAACA
1601 AACACCTCAA CAAAGAGCGT TCCAACAATA TCGAACTCGC GCTGGGCTAC
1651 GAAGGCGACC GCTGGCAATA CAATCTGGCA CTCTACCGCA ACCGCTTCGG
1701 TAACTACATT TACGCCCAAA CCTTAAACGA CGGACGCGGC CCCAAATCCA
1751 TCGAAGACGA CAGCGAAATG AAGCTCGTGC GCTACAACCA ATCCGGCGCC
1801 GACTTCTACG GCGCGGAAGG CGAAATCTAC TTCAAACCGA CACCGCGCTA
1851 CCGCATCGGC GTTTCCGGCG ACTATGTACG AGGCCGTCTG AAAAACCTGC
1901 CTTCCCTACC CGGCAGAGAA GATGCCTACG GCAACCGTCC TTTCATCGCA
1951 CAGGACGACC AAAATGCCCC CCGTGTTCCG GCTGCGCGCC TCGGCTTCCA
2001 CCTGAAAGCC TCGCTGACCG ACCGTATCGA TGCCAATTTG GACTACTACC
2051 GCGTGTTCGC CCAAAACAAA CTCGCCCGCT ACGAAACGCG CACGCCCGGA
2101 CACCATATGC TCAACCTCGG CGCAAACTAC CGCCGCAATA CGCGCTATGG
2151 CGAGTGGAAT TGGTACGTCA AGCCGACAA CCTGCTCAAC CAATCCGTTT
2201 ACGCCCACAG CAGCTTTCTC TCTGATACGC CGCAAATGGG CCGCAGCTTT
2251 ACCGGCGGCG TGAACGTGAA GTTTTAA
```

This corresponds to the amino acid sequence <SEQ ID 604; ORF 149-1>:

```
m149-1.pep

1 MAQTTLKPIV LSILLINTPL LAQAHETEQS VDLETVSVVG KSRPRATSGL
    51 LHTSTASDKI ISGDTLRQKA VNLGDALDGV PGIHASQYGG GASAPVIRGQ
   101 TGRRIKVLNH HGETGDMADF SPDHAIMVDT ALSQQVEILR GPVTLLYSSG
   151 NVAGLVDVAD GKIPEKMPEN GVSGELGLRL SSGNLEKLTS GGINIGLGKN
   201 FVLHTEGLYR KSGDYAVPRY RNLKRLPDSH ADSQTGSIGL SWVGEKGFIG
   251 VAYSDRRDQY GLPAHSHEYD DCHADIIWQK SLINKRYLQL YPHLLTEEDI
   301 DYDNPGLSCG FHDDDNAHAH THSGRPWIDL RNKRYELRAE WKQPFPGFEA
   351 LRVHLNRNDY RHDEKAGDAV ENFFNNQTQN ARIELRHQPI GRLKGSWGVQ
   401 YLQQKSSALS AISEAVKQPM LLDNKVQHYS FFGVEQANWD NFTLEGGVRV
   451 EKQKASIQYD KALIDRENYY NHPLPDLGAH RQTARSFALS GNWYFTPQHK
```

```
501 LSLTASHQER LPSTQELYAH GKHVATNTFE VGNKHLNKER SNNIELALGY

551 EGDRWQYNLA LYRNRFGNYI YAQTLNDGRG PKSIEDDSEM KLVRYNQSGA

601 DFYGAEGEIY FKPTPRYRIG VSGDYVRGRL KNLPSLPGRE DAYGNRPFIA

651 QDDQNAPRVP AARLGFHLKA SLTDRIDANL DYYRVFAQNK LARYETRTPG

701 HHMLNLGANY RRNTRYGEWN WYVKADNLLN QSVYAHSSFL SDTPQMGRSF

751 TGGVNVKF*
``` m149-1/g149-1 96.2% identity in 758 aa overlap

```
                    10         20         30         40         50         60
m149-1.pep  MAQTTLKPIVLSILLINTPLLAQAHETEQSVDLETVSVVGKSRPRATSGLLHTSTASDKI
            |||  |||||||||||||||||||||||||| |||||||||||||||||||||||||||
g149-1      MAQITLKPIVLSILLINTPLLAQAHETEQSVGLETVSVVGKSRPRATSGLLHTSTASDKI
                    10         20         30         40         50         60

70         80         90        100        110        120
m149-1.pep  ISGDTLRQKAVNLGDALDGVPGIHASQYGGGASAPVIRGQTGRRIKVLNHHGETGDMADF
            ||||||||||||||||||||||||||||||||||||||||||||||||||||||||||||
g149-1      ISGDTLRQKAVNLGDALDGVPGIHASQYGGGASAPVIRGQTGRRIKVLNHHGETGDMADF
                    70         80         90        100        110        120

130        140        150        160        170        180
m149-1.pep  SPDHAIMVDTALSQQVEILRGPVTLLYSSGNVAGLVDVADGKIPEKMPENGVSGELGLRL
            ||||||||||||||||||||||||||||||||||||||||||||||||||||||||||||
g149-1      SPDHAIMVDTALSQQVEILRGPVTLLYSSGNVAGLVDVADGKIPEKMPENGVSGELGLRL
                   130        140        150        160        170        180

190        200        210        220        230        240
m149-1.pep  SSGNLEKLTSGGINIGLGKNFVLHTEGLYRKSGDYAVPRYRNLKRLPDSHADSQTGSIGL
            |||||||||||:||||||||||||||||||||||||||||||||||||||||||||||||
g149-1      SSGNLEKLTSAGINIGLGKNFVLHTEGLYRKSGDYAVPRYRNLKRLPDSHADSQTGSIGL
                   190        200        210        220        230        240

250        260        270        280        290        300
m149-1.pep  SWVGEKGFIGVAYSDRRDQYGLPAHSHEYDDCHADIIWQKSLINKRYLQLYPHLLTEEDI
            ||||||||||:|||||||:|||||||||||||||||||||||||||||||||||||||||
g149-1      SWVGEKGFIGAAYSDRRDRYGLPAHSHEYDDCHADIIWQKSLINKRYLQLYPHLLTEEDI
                   250        260        270        280        290        300

310        320        330        340        350        360
m149-1.pep  DYDNPGLSCGFHDDDNAHAHTHSGRPWIDLRNKRYELRAEWKQPFPGFEALRVHLNRNDY
            |||||||||||||: ||||||:|:||||||||||||||||||||||||||||||||||||
g149-1      DYDNPGLSCGFHDGDGAHAHTHNGKPWIDLRNKRYELRAEWKQPFPGFEALRVHLNRNDY
                   310        320        330        340        350        360

370        380        390        400        410        420
m149-1.pep  RHDEKAGDAVENFFNNQTQNARIELRHQPIGRLKGSWGVQYLQQKSSALSAISEAVKQPM
            :||||||||||||||||:|:||||||||||||||||||||||||| |||||||:|:|||
g149-1      HHDEKAGDAVENFFNNKTHNARIELRHQPIGRLKGSWGVQYLGQKSSALSAIPETVQQPM
                   370        380        390        400        410        420

430        440        450        460        470        480
m149-1.pep  LLDNKVQHYSFFGVEQANWDNFTLEGGVRVEKQKASIQYDKALIDRENYYNHPLPDLGAH
            |:||:|:||||||||||||||||||||||||||||||:||||||||||||:||||||||
g149-1      LIDNNVRHYSFFGVEQANWDNFTLEGGVRVEKQKASIRYDKALIDRENYYNQPLPDLGAH
                   430        440        450        460        470        480

490        500        510        520        530        540
m149-1.pep  RQTARSFALSGNWYFTPQHKLSLTASHQERLPSTQELYAHGKHVATNTFEVGNKHLNKER
            ||||||||||||||||||:|||||||||||||||||||||||||||||||||||||||||
g149-1      RQTARSFALSGNWYFTPHHKLSLTASHQERLPSTQELYAHGKHVATNTFEVGNKHLNKER
                   490        500        510        520        530        540

550        560        570        580        590        600
m149-1.pep  SNNIELALGYEGDRWQYNLALYRNRFGNYIYAQTLNDGRGPKSIEDDSEMKLVRYNQSGA
            |||||||||||||||||||| |||||||||||||||||||||||||||||||||||||||
g149-1      SNNIELALGYEGDRWQYNLAAYRNRFGNYIYAQTLNDGRGPKSIEDDSEMKLVRYNQSGA
                   550        560        570        580        590        600

610        620        630        640        650        660
m149-1.pep  DFYGAEGEIYFKPTPRYRIGVSGDYVRGRLKNLPSLPGREDAYGNRPFIAQDDQNAPRVP
            ||||||||||||||||||||||||||||||||||||||||||: |||||| ||||||:|
g149-1      DFYGAEGEIYFKPTPRYRIGVSGDYVRGRLKNLPSLPGREDPYGKRPFIAQADQNAPRIP
                   610        620        630        640        650        660

670        680        690        700        710        720
m149-1.pep  AARLGFHLKASLTDRIDANLDYYRVFAQNKLARYETRTPGHHMLNLGANYRRNTRYGEWN
            ||||||||||:|||||||||||||||||||||||||||||||||||||||||||||||||
g149-1      AARLGFHLKTSLTDRIDANLDYYRVFAQNKLARYETRTPGHHMLNLGANYRRNTRYGEWN
                   670        680        690        700        710        720
```

```
                        730       740       750   759
m149-1.pep    WYVKADNLLNQSVYAHSSFLSDTPQMGRSFTGGVNVKFX
              ||||||||||||||||||||||||||||||||||||||
g149-1        WYVKADNLLNQSVYAHSSFLSDTPQMGRSFTGGVNVKFX
                        730       740       750
```

The following partial DNA sequence was identified in *N. meningitidis* <SEQ ID 605>:

```
a149-1.seq
   1 ATGGCACAAA CTACACTCAA ACCCATTGTT TTATCAATTC TTTTAATCAA
  51 CACACCCCTC CTCTCCCAAG CGCATGGAAC TGAGCAATCA GTGGGCTTGG
 101 AAACGGTCAG CGTCGTCGGC AAAAGCCGTC CGCGCGCCAC TTCGGGGCTG
 151 CTGCACACTT CTACCGCCTC CGACAAAATC ATCAGCGGCG ACACCTTGCG
 201 ACAAAAGCC GTCAACTTGG GTGATGCTTT AGACGGCGTA CCGGGCATTC
 251 ATGCCTCGCA ATACGGCGGC GGCGCATCCG CTCCCGTTAT TCGCGGTCAA
 301 ACAGGCAGAC GGATTAAAGT GTTGAACCAT CACGGCGAAA CGGGCGACAT
 351 GGCGGACTTC TCTCCAGACC ATGCAATCAT GGTGGACAGC GCCTTGTCGC
 401 AACAGGTCGA AATCCTGCGC GGTCCGGTTA CGCTCTTGTA CAGCTCGGGC
 451 AATGTGGCGG GGCTGGTCGA TGTTGCCGAT GGCAAAATCC CCGAAAAAAT
 501 GCCTGAAAAC GGCGTATCGG GCGAACTCGG ATTGCGTTTG AGCAGCGGCA
 551 ATCTGGAAAA ACTCACGTCC GGCGGCATCA ATATCGGTTT GGGCAAAAAC
 601 TTTGTATTGC ACACGGAAGG GCTGTACCGC AAATCGGGGG ATTACGCCGT
 651 ACCGCGTTAC CGCAATCTGA AACGCCTGCC CGACAGCCAC GCCGATTCGC
 701 AAACGGGCAG CATCGGGCTG TCTTGGGTTG GCGAAAAAGG CTTTATCGGC
 751 GCAGCATACA GCGACCGTCG CGACCAATAT GGTCTGCCTG CCCACAGCCA
 801 CGAATACGAT GATTGCCACG CCGACATCAT CTGGCAAAAG AGTTTGATTA
 851 ACAAACGCTA TTTGCAGCTT TATCCGCACC TGTTGACCGA AGAAGACATC
 901 GATTACGACA ATCCGGGCTT GAGCTGCGGC TTTCACGACG ACGATGATGC
 951 ACACGCCCAT GCCCACAACG GCAAACCTTG GATAGACCTG CGCAACAAAC
1001 GCTACGAACT CCGCGCCGAA TGGAAGCAAC CGTTCCCCGG TTTTGAAGCC
1051 CTGCGCGTAC ACCTGAACCG CAACGACTAC CGCCACGACG AAAAAGCAGG
1101 CGATGCAGTA GAAAACTTTT TTAACAACCA AACGCAAAAC GCCCGTATCG
1151 AGTTGCGCCA CCAACCCATA GGCCGTCTGA AAGGCAGCTG GGGCGTGCAA
1201 TATTTGGGAC AAAAATCCAG TGCTTTATCT GCCACATCCG AAGCGGTCAA
1251 ACAACCGATG CTGCTTGACA ATAAAGTGCA ACATTACAGC TTTTTCGGTG
1301 TAGAACAGGC AAACTGGGAC AACTTCACGC TTGAAGGCGG CGTACGCGTG
1351 GAAAACAAA AAGCCTCCAT CCGCTACGAC AAAGCATTGA TTGATCGGGA
1401 AAACTACTAC AACCATCCCC TGCCCGACCT CGGCGCGCAC CGCCAAACCG
1451 CCCGCTCATT CGCACTTTCG GCAACTGGT ATTTCACGCC ACAACACAAA
1501 CTCAGCCTGA CCGCCTCCCA TCAGGAACGC CTGCCGTCAA CGCAAGAGCT
1551 GTACGCACAC GGCAAACACG TCGCCACCAA CACCTTTGAA GTCGGCAACA
1601 AACACCTCAA CAAAGAGCGT TCCAACAATA TCGAACTCGC GCTGGGCTAC
1651 GAAGGCGACC GCTGGCAATA CAATCTGGCA CTCTACCGCA ACCGCTTCGG
```

```
1701 CAACTACATT TACGCCCAAA CCTTAAACGA CGGACGCGGC CCCAAATCCA

1751 TCGAAGACGA CAGCGAAATG AAGCTCGTGC GCTACAACCA ATCCGGTGCG

1801 GACTTCTACG GCGCGGAAGG CGAAATCTAC TTCAAACCGA CACCGCGCTA

1851 CCGCATCGGC GTTTCCGGCG ACTATGTACG AGGCCGTCTG AAAAACCTGC

1901 CTTCCCTACC CGGCAGGGAA GACGCCTACG GCAACCGCCC ACTCATTGCC

1951 CAAGCCGACC AAAACGCCCC TCGCGTTCCG GCTGCGCGCC TCGGCGTCCA

2001 CCTGAAAGCC TCGCTGACCG ACCGCATCGA TGCCAATTTG GACTACTACC

2051 GCGTGTTCGC CCAAAACAAA CTCGCCCGCT ACGAAACGCG CACGCCCGGA

2101 CACCATATGC TCAACCTCGG CGCAAACTAC CGCCGCAATA CGCGCTATGG

2151 CGAGTGGAAT TGGTACGTCA AAGCCGACAA CCTGCTCAAC CAATCCGTTT

2201 ACGCCCACAG CAGCTTCCTC TCTGATACGC CGCAAATGGG CCGCAGCTTT

2251 ACCGGCGGCG TGAACGTGAA GTTTTAA
```

This corresponds to the amino acid sequence <SEQ ID 606; ORF 149-1.a>:

```
a149-1.pep

1 MAQTTLKPIV LSILLINTPL LSQAHGTEQS VGLETVSVVG KSRPRATSGL
   51 LHTSTASDKI ISGDTLRQKA VNLGDALDGV PGIHASQYGG GASAPVIRGQ
  101 TGRRIKVLNH HGETGDMADF SPDHAIMVDS ALSQQVEILR GPVTLLYSSG
  151 NVAGLVDVAD GKIPEKMPEN GVSGELGLRL SSGNLEKLTS GGINIGLGKN
  201 FVLHTEGLYR KSGDYAVPRY RNLKRLPDSH ADSQTGSIGL SWVGEKGFIG
  251 AAYSDRRDQY GLPAHSHEYD DCHADIIWQK SLINKRYLQL YPHLLTEEDI
  301 DYDNPGLSCG FHDDDDAHAH AHNGKPWIDL RNKRYELRAE WKQPFPGFEA
  351 LRVHLNRNDY RHDEKAGDAV ENFFNNQTQN ARIELRHQPI GRLKGSWGVQ
  401 YLGQKSSALS ATSEAVKQPM LLDNKVQHYS FFGVEQANWD NFTLEGGVRV
  451 EKQKASIRYD KALIDRENYY NHPLPDLGAH RQTARSFALS GNWYFTPQHK
  501 LSLTASHQER LPSTQELYAH GKHVATNTFE VGNKHLNKER SNNIELALGY
  551 EGDRWQYNLA LYRNRFGNYI YAQTLNDGRG PKSIEDDSEM KLVRYNQSGA
  601 DFYGAEGEIY FKPTPRYRIG VSGDYVRGRL KNLPSLPGRE DAYGNRPLIA
  651 QADQNAPRVP AARLGVHLKA SLTDRIDANL DYYRVFAQNK LARYETRTPG
  701 HHMLNLGANY RRNTRYGEWN WYVKADNLLN QSVYAHSSFL SDTPQMGRSF
  751 TGGVNVKF* a149-1/m149-1 98.0% identity in 758 aa overlap 10         20         30         40         50         60
a149-1.pep  MAQTTLKPIVLSILLINTPLLSQAHGTEQSVDLETVSVVGKSRPRATSGLLHTSTASDKI
            |||||||||||||||||||||:|||  ||||| ||||||||||||||||||||||||||
m149-1      MAQTTLKPIVLSILLINTPLLAQAHETEQSVGLETVSVVGKSRPRATSGLLHTSTASDKI
                    10         20         30         40         50         60

70         80         90        100        110        120
a149-1.pep  ISGDTLRQKAVNLGDALDGVPGIHASQYGGGASAPVIRGQTGRRIKVLNHHGETGDMADF
            ||||||||||||||||||||||||||||||||||||||||||||||||||||||||||||
m149-1      ISGDTLRQKAVNLGDALDGVPGIHASQYGGGASAPVIRGQTGRRIKVLNHHGETGDMADF
                    70         80         90        100        110        120

130        140        150        160        170        180
a149-1.pep  SPDHAIMVDSALSQQVEILRGPVTLLYSSGNVAGLVDVADGKIPEKMPENGVSGELGLRL
            ||||||||||:|||||||||||||||||||||||||||||||||||||||||||||||||
m149-1      SPDHAIMVDTALSQQVEILRGPVTLLYSSGNVAGLVDVADGKIPEKMPENGVSGELGLRL
                   130        140        150        160        170        180
```

```
                  190       200       210       220       230       240
a149-1.pep  SSGNLEKLTSGGINIGLGKNFVLHTEGLYRKSGDYAVPRYRNLKRLPDSHADSQTGSIGL
            ||||||||||||||||||||||||||||||||||||||||||||||||||||||||||||
m149-1      SSGNLEKLTSGGINIGLGKNFVLHTEGLYRKSGDYAVPRYRNLKRLPDSHADSQTGSIGL
                  190       200       210       220       230       240

250       260       270       280       290       300
a149-1.pep  SWVGEKGFIGAAYSDRRDQYGLPAHSHEYDDCHADIIWQKSLINKRYLQLYPHLLTEEDI
            ||||||||||:|||||||||||||||||||||||||||||||||||||||||||||||||
m149-1      SWVGEKGFIGVAYSDRRDQYGLPAHSHEYDDCHADIIWQKSLINKRYLQLYPHLLTEEDI
                  250       260       270       280       290       300

310       320       330       340       350       360
a149-1.pep  DYDNPGLSCGFHDDDDAHAHAHNGKPWIDLRNKRYELRAEWKQPFPGFEALRVHLNRNDY
            |||||||||||||||:||||:|:|:|||||||||||||||||||||||||||||||||||
m149-1      DYDNPGLSCGFHDDDGAHAHTHSGRPWIDLRNKRYELRAEWKQPFPGFEALRVHLNRNDY
                  310       320       330       340       350       360

370       380       390       400       410       420
a149-1.pep  RHDEKAGDAVENFFNNQTQNARIELRHQPIGRLKGSWGVQYLGQKSSALSATSEAVKQPM
            |||||||||||||||||||||||||||||||||||||||||||| |||||| |||||||
m149-1      RHDEKAGDAVENFFNNQTQNARIELRHQPIGRLKGSWGVQYLQQKSSALSAISEAVKQPM
                  370       380       390       400       410       420

430       440       450       460       470       480
a149-1.pep  LLDNKVQHYSFFGVEQANWDNFTLEGGVRVEKQKASIRYDKALIDRENYYNHPLPDLGAH
            ||||||||||||||||||||||||||||||||||||||:|||||||||||||||||||||
m149-1      LLDNKVQHYSFFGVEQANWDNFTLEGGVRVEKQKASIQYDKALIDRENYYNHPLPDLGAH
                  430       440       450       460       470       480

490       500       510       520       530       540
a149-1.pep  RQTARSFALSGNWYFTPQHKLSLTASHQERLPSTQELYAHGKHVATNTFEVGNKHLNKER
            ||||||||||||||||||||||||||||||||||||||||||||||||||||||||||||
m149-1      RQTARSFALSGNWYFTPQHKLSLTASHQERLPSTQELYAHGKHVATNTFEVGNKHLNKER
                  490       500       510       520       530       540

550       560       570       580       590       600
a149-1.pep  SNNIELALGYEGDRWQYNLALYRNRFGNYIYAQTLNDGRGPKSIEDDSEMKLVRYNQSGA
            |||||||||||||||||||| |||||||||||||||||||||||||||||||||||||||
m149-1      SNNIELALGYEGDRWQYNLAAYRNRFGNYIYAQTLNDGRGPKSIEDDSEMKLVRYNQSGA
                  550       560       570       580       590       600

610       620       630       640       650       660
a149-1.pep  DFYGAEGEIYFKPTPRYRIGVSGDYVRGRLKNLPSLPGREDPYGKRPLIAQADQNAPRVP
            ||||||||||||||||||||||||||||||||||||||||||||||:|||  ||||||||
m149-1      DFYGAEGEIYFKPTPRYRIGVSGDYVRGRLKNLPSLPGREDPYGKRPFIAQDDQNAPRVP
                  610       620       630       640       650       660

670       680       690       700       710       720
a149-1.pep  AARLGVHLKASLTDRIDANLDYYRVFAQNKLARYETRTPGHHMLNLGANYRRNTRYGEWN
            ||||| ||||||||||||||||||||||||||||||||||||||||||||||||||||||
m149-1      AARLGFHLKASLTDRIDANLDYYRVFAQNKLARYETRTPGHHMLNLGANYRRNTRYGEWN
                  670       680       690       700       710       720

730       740       750       759
a149-1.pep  WYVKADNLLNQSVYAHSSFLSDTPQMGRSFTGGVNVKFX
            |||||||||||||||||||||||||||||||||||||||
m149-1      WYVKADNLLNQSVYAHSSFLSDTPQMGRSFTGGVNVKFX
                  730       740       750
```

The following partial DNA sequence was identified in *N. gonorrhoeae* <SEQ ID 607>:

```
g150.seq (partial)
    1 ..TACTGCAAGG CAGACCCCTT TCCCGCCGCC CTGCTGGCCA ATCAGAAAAT

51   CACCGCCCGC CAATCCGATA AAGACGTGCG CCACATCGAA ATCGATTTGA

101   GCGGTTCGGA TTTGCACTAC CTCCCGGGCG ACGCGCTCGG CGTTTGGTTT

151   GACAACGATC CGGCACTGGT CGGGGAAATC CTAGACCTGC TCGGCATCAA

201   TCCGGCAACG GAAATACAGG CGGGCGGAAA AACCCTGCCG GTTGCCTCCG

251   CACTGTTATC CCATTTCGAA CTCACGCAAA ACACCCCCGC CTTTGTCAAA

301   GGCTATGCCA CGTTCGCCGA TAATGACGAA CTCGACCGTA TTGCTGCCGA

351   CAACGCCGTT TTGCAAGGCT TGTGCAAAG CACGCCGATT GCCGGTGTGC
```

-continued

```
 401    TGCACCGCTT CCCGGCAAAA CTGACGGCGG AACAATTCGC CGGCCTGCTG
 451    CGCCCGCTTG CGCCGCGCCT GTATTCGATT TCCTCGTCGC AGGCGGAAGC
 501    GGGGGACGAA GTGCACCTGA CCGTCGGCGC AGTGCGTTTC GAACACGAAG
 551    GGCGCGCCAG GGCGGGCGGC GCATCGGGTT TCTTTGCCGA CCGGCTGGAA
 601    GAGGACGGCA CGGTGCGCGT GTTTGCGGAA CGCAACGACG GCTTCAGGCT
 651    GCCCGAAGAC AGCCGCAAGC CGATTGTGAT GATCGGCTCC GGTACCGGCG
 701    TCGCACCGTT CCGCGCCTTC GTCCAACAAC GTGCCGCAGA AAATGCGGAA
 751    GGCAGAAACT GGCTGATTTT CGGCAATCCG CATTTTGCCG CCGACTTCCT
 801    CTATCAGACC GAATGGCAGC AGTTTGCCAA AGACGGCTTC CTGCACAGAT
 851    ATGACTTCGC CTGGTCGCGC GATCAGGAAG AAAAAATCTA TGTGCAGGAC
 901    AAAATCCGCG AACAGGCGGA AGGACTTTGG CAATGGCTGC AGGAAGGCGC
 951    GCATATCTAT GTGTGCGGCG ATGCGGCAAA AATGGCAAAA GAAGTGGAAG
1001    CCGCCTTGCT GGATGTGATT ATCGGGGCAG GGCATTCGGA CGAAGACGGC
1051    GCAGAAGGAT ATTTGGATAT GCTGCGCGAA GAAAAACGCT ATCAGCGTGA
1101    TGTTTATTGA
```

This corresponds to the amino acid sequence <SEQ ID 608; ORF 150.ng>:

```
g150.pep (partial)
   1    ..YCKADPFPAA LLANQKITAR QSDKDVRHIE IDLSGSDLHY LPGDALGVWF
  51    DNDPALVGEI LDLLGINPAT EIQAGGKTLP VASALLSHFE LTQNTPAFVK
 101    GYATFADNDE LDRIAADNAV LQGFVQSTPI AGVLHRFPAK LTAEQFAGLL
 151    RPLAPRLYSI SSSQAEAGDE VHLTVGAVRF EHEGRARAGG ASGFFADRLE
 201    EDGTVRVFAE RNDGFRLPED SRKPIVMIGS GTGVAPFRAF VQQRAAENAE
 251    GRNWLIFGNP HFAADFLYQT EWQQFAKDGF LHRYDFAWSR DQEEKIYVQD
 301    KIREQAEGLW QWLQEGAHIY VCGDAAKMAK EVEAALLDVI IGAGHSDEDG
 351    AEGYLDMLRE EKRYQRDVY*
```

The following partial DNA sequence was identified in N. meningitidis <SEQ ID 609>:

```
m150.seq
   1    ATGCAGAACA CAAATCCGCC ATTACCGCCT CTGCCGCCCG AAATCACGCA
  51    GCTCCTGTCG GGGCTGGACG CGGCACAATG GCGTGGCTG TCCGGCTACG
 101    CTTGGGCAAA AGCAGGAAAC GGGGCATCTG CAGGACTGCC CGCGCTTCAG
 151    ACGGCATTGC CGGCGGCAGA ACCTTTTTCC GTAACCGTCC TTTCCGCCTC
 201    GCAAACCGGC AATGCGAAAT CCGTTGCCGA CAAAGCGGCG GACAGCCTGG
 251    AAGCCGCCGG CATCCAAGTC AGTCGCGCCG AACTGAAAGA CTATAAGGCG
 301    AAAACATCG CCGGCGAACG CCGCCTGCTG CTGGTTACCT CCACCCAAGG
 351    CGAAGGCGAA CCGCCGAAAG AAGCCGTCGT GCTGCACAAA CTGCTGAACG
 401    GCAAAAAGC CCCGAAATTG GACAAACTCC AATTTGCCGT ACTGGGTTTG
 451    GGCGACAGTT CCTATCCGAA TTTCTGTCAG GCAGGTAAAG ATTTCGACCG
 501    GCGTTTTGAA GAATTGGGCG CAAAACGGCT GCTCGAACGC GTTGATGCGG
```

```
 551 ATTTGGACTT TACCGCCTCC GCAAACGCCT GGACAGATAA TATCGCCGCA

601 CTCTTAAAAG AAGAAGCCGC AAAAAACCGG GCAACGCCCG CGCCGCAGAC

651 AACGCCCCCC GCCGGCCTTC AGACGGCACC GGATGGCAGG TACTGCAAGG

701 CAGCCCCCTT TCCCGCCGCC CTGCTGGCCA ATCAGAAAAT CACCGCCCGC

751 CAATCCGATA AAGACGTGCG CCACATCGAA ATCGATTTGA GCGGTTCGGA

801 TTTGCACTAC CTCCCGGGCG ACGCGCTCGG CGTTTGGTTT GACAACGATC

851 CGGCACTGGT CAGGGAAATC CTAGACCTGC TCGGCATCGA TCCGGCAACG

901 GAAATACAGG CGGGCGGAAA GATGATGCCG GTTGCGCGCG CACTTTCATC

951 TCATTTCGAA CTCACGCAAA ACACTCCGGC TTTCGTCAAA GGCTATGCCG

1001 CGTTCGCCCA TTATGAAGAA CTCGATAAAA TCATTGCCGA TAACGCCGTT

1051 TTGCAGGATT TCGTGCAAAA CACGCCTATT GTCGATGTGC TGCACCGCTT

1101 CCCGGCAAGC CTGACGGCAG AACAATTCAT CCGTTTACTG CGTCCGCTTG

1151 CACCCCGTTT GTATTCGATT TCTTCAGCAC AGGCGGAAGT GGGCGATGAA

1201 GTGCATTTAA CTGTCGGCGT GGTTCGTTTT GAACACGAAG GCCGCGCCAG

1251 AACGGGCGGC GCATCGGGTT TCCTTGCCGA CCGGCTGGAA GAGGACGGCA

1301 CGGTGCGCGT GTTTGTGGAA CGCAACGACG GCTTCAGGCT GCCCGAAGAC

1351 AGCCGCAAGC CGATTGTGAT GATCGGCTCG GGCACCGGCG TCGCACCGTT

1401 CCGCGCTTTC GTCCAACAAC GTGCCGCAGA AAATGCGGAA GGCAAAAACT

1451 GGCTGATTTT CGGCAATCCG CATTTTGCCC GTGATTTTCT CTATCAAACC

1501 GAATGGCAGC AGTTTGCCAA AGACGGCTTC CTGCACAGGT ACGATTTCGC

1551 CTGGTCCCGC GATCAGGAAG AAAAAATCTA TGTGCAGGAC AAAATCCGCG

1601 AACAGGCGGA AGGACTTTGG CAATGGCTGC AGGAAGGCGC GCATATCTAT

1651 GTGTGCGGCG ATGCGGCAAA AATGGCAAAA GACGTGGAAG CCGCCTTGCT

1701 GGATGTGATT ATCGGGGCAG GACATTTGGA CGAAGAGGGC GCAGAAGAAT

1751 ATTTGGATAT GCTGCGCGAA GAAAAACGCT ATCAGCGTGA TGTTTATTGA
```

This corresponds to the amino acid sequence <SEQ ID 610; ORF 150>:

```
m150.pep
   1 MQNTNPPLPP LPPEITQLLS GLDAAQWAWL SGYAWAKAGN GASAGLPALQ

51 TALPAAEPFS VTVLSASQTG NAKSVADKAA DSLEAAGIQV SRAELKDYKA

101 KNIAGERRLL LVTSTQGEGE PPKEAVVLHK LLNGKKAPKL DKLQFAVLGL

151 GDSSYPNFCQ AGKDFDRRFE ELGAKRLLER VDADLDFTAS ANAWTDNIAA

201 LLKEEAAKNR ATPAPQTTPP AGLQTAPDGR YCKAAPFPAA LLANQKITAR

251 QSDKDVRHIE IDLSGSDLHY LPGDALGVWF DNDPALVREI LDLLGIDPAT

301 EIQAGGKMMP VARALSSHFE LTQNTPAFVK GYAAFAHYEE LDKIIADNAV

351 LQDFVQNTPI VDVLHRFPAS LTAEQFIRLL RPLAPRLYSI SSAQAEVGDE

401 VHLTVGVVRF EHEGRARTGG ASGFLADRLE EDGTVRVFVE RNDGFRLPED

451 SRKPIVMIGS GTGVAPFRAF VQQRAAENAE GKNWLIFGNP HFARDFLYQT

501 EWQQFAKDGF LHRYDFAWSR DQEEKIYVQD KIREQAEGLW QWLQEGAHIY

551 VCGDAAKMAK DVEAALLDVI IGAGHLDEEG AEEYLDMLRE EKRYQRDVY*
```

Computer analysis of this amino acid sequence gave the following results:

Homology with a Predicted ORF from *N. gonorrhoeae*
ORF 150 shows 91.3% identity over a 369 aa overlap with a predicted ORF (ORF 150.ng) from *N. gonorrhoeae*:

```
m150/g150

210       220       230       240       250       260
      m150.pep LLKEEAAKNRATPAPQTTPPAGLQTAPDGRYCKAAPFPAALLANQKITARQSDKDVRHIE
                                        ||| ||||||||||||||||||||||||||
      g150                              YCKADPFPAALLANQKITARQSDKDVRHIE
                                              10        20        30

270       280       290       300       310       320
      m150.pep IDLSGSDLHYLPGDALGVWFDNDPALVREILDLLGIDPATEIQAGGKMMPVARALSSHFE
              ||||||||||||||||||||||||||| |||||||| :||||||||:||| || ||||
      g150    IDLSGSDLHYLPGDALGVWFDNDPALVGEILDLLGINPATEIQAGGKTLPVASALLSHFE
                  40        50        60        70        80        90

330       340       350       360       370       380
      m150.pep LTQNTPAFVKGYAAFAHYEELDKIIADNAVLQDFVQNTPIVDVLHRFPASLTAEQFIRLL
              |||||||||||||:||  :|||:| ||||||||| |||||: |||||||:|||||  |||
      g150    LTQNTPAFVKGYATFADNDELDRIAADNAVLQGFVQSTPIAGVLHRFPAKLTAEQFAGLL
                  100       110       120       130       140       150

390       400       410       420       430       440
      m150.pep RPLAPRLYSISSAQAEVGDEVHLTVGVVRFEHEGRARTGGASGFLADRLEEDGTVRVFVE
              ||||||||||:|||:||||||||||||:|||||||||:|||||||:||||||||||||:|
      g150    RPLAPRLYSISSSQAEAGDEVHLTVGAVRFEHEGRARAGGASGFFADRLEEDGTVRVFAE
                  160       170       180       190       200       210

450       460       470       480       490       500
      m150.pep RNDGFRLPEDSRKPIVMIGSGTGVAPFRAFVQQRAAENAEGKNWLIFGNPHFARDFLYQT
              ||||||||||||||||||||||||||||||||||||||||||:||||||||||| |||||
      g150    RNDGFRLPEDSRKPIVMIGSGTGVAPFRAFVQQRAAENAEGRNWLIFGNPHFAADFLYQT
                  220       230       240       250       260       270

510       520       530       540       550       560
      m150.pep EWQQFAKDGFLHRYDFAWSRDQEEKIYVQDKIREQAEGLWQWLQEGAHIYVCGDAAKMAK
              ||||||||||||||||||||||||||||||||||||||||||||||||||||||||||||
      g150    EWQQFAKDGFLHRYDFAWSRDQEEKIYVQDKIREQAEGLWQWLQEGAHIYVCGDAAKMAK
                  280       290       300       310       320       330

570       580       590       600
      m150.pep DVEAALLDVIIGAGHLDEEGAEEYLDMLREEKRYQRDVYX
              :||||||||||||||  ||:||| |||||||||||||||
      g150    EVEAALLDVIIGAGHSDEDGAEGYLDMLREEKRYQRDVYX
                  340       350       360       370
```

The following partial DNA sequence was identified in *N. meningitidis* <SEQ ID 611>:

```
a150.seq
    1 ATGCAGAACA CAAATCCGCC ATTACCGCCT ATGCCGCCCG AAATCACGCA

51 GCTCCTGTCG GGGCTGGACG CGGCACAATG GGCGTGGCTG TCCGGCTACG

101 CTTGGGCAAA AGCAGGAAAC GGGGCATCTG CAGGACTGCC CGCGCTTCAG

151 ACGGCATTGC CGACGGCAGA ACCTTTTTCC GTAACCGTCC TTTCCGCCTC

201 GCAAACCGGC AATGCGAAAT CCGTTGCCGA CAAAGCGGCG GACAGCCTGG

251 AAGCCGCCGG CATCCAAGTC AGTCGCGCCG AACTGAAAGA CTATAAGGCG

301 AAAAACATCG CCGGCGAACG CCGCCTGCTG CTGGTTACCT CCACCCAAGG

351 CGAAGGCGAA CCGCCGGAAG AAGCCGTCGT GCTGCACAAA CTGCTGAACG

401 GCAAAAAAGC CCCGAAATTG GACAAACTCC AATTTGCCGT ACTGGGTTTG

451 GGCGACAGCT CCTATCCGAA TTTCTGCCGG GCGGGCAAAG ATTTCGACAA

501 ACGTTTTGAA GAATTGGGCG CAAACGCCT GCTCGAACGC GTTGATGCGG

551 ATTTGGACTT TGCCGCCGCC GCAGACGGAT GGACAGATAA TATCGCCGCA

601 CTCTTAAAAG AAGAAGCCGC AAAAACCGG GCAACGCCCG CGCCGCAGAC

651 AACGCCCCCC GCCGGCCTTC AGACGGCACC GGATGGCAGG TACTGCAAGG
```

```
 701 CAGACCCCTT TGCCGCCGCC CTGCTGGCCA ATCAGAAAAT CACCGCCCGC

751 CAATCCGATA AAGACGTGCG CCACATCGAA ATCGATTTGA GCGGTTCGGA

801 TTTGCACTAC CTCCCGGGCG ACGCGCTCGG CGTTTGGTTT GACAACGATC

851 CGGCACTGGT CAGGGAAATC CTAGACCTGC TCGGCATCGA TCAGGCAACG

901 GAAATACAGG CGGGCGGAAA AACCCTGCCG GTTGCCTCCG CACTGTTATC

951 CCATTTTGAA CTCACGCAAA ACACCCCCGC CTTTGTCAAA GGCTATGCCC

1001 CGTTCGCCGA TGATGACGAA CTCGACCGTA TTGCTGCCGA CAACGCCGTT

1051 TTGCAAGGCT TTGTGCAAAG CACGCCGATT GCCGATGTGC TGCACCGCTT

1101 CCCGGCAAAA CTGACAGCGG AACAATTCGC CGGCCTACTG CGCCCGCTTG

1151 CGCCGCGCCT GTATTCGATT TCCTCGTCGC AGGCGGAAGT GGGGGACGAA

1201 GTGCACCTGA CCGTCGGCGC GGTGCGTTTC GAACACGAAG GCGCGCCAG

1251 GCGGGCGGC GCATCGGGTT TCCTTGCCGA CCGGCTGAA GAGGACGGCA

1301 CGGTGCGCGT GTTTGTGGAA CGCAACGACG GCTTCAGGCT GCCCGAAGAC

1351 AGCCGCAAGC CGATTGTGAT GATCGGCTCG GGCACCGGCG TCGCACCGTT

1401 CCGCGCTTTC GTCCAACAAC GTGCCGCAGA AAATGCGGAA GGCAAAAACT

1451 GGCTGTTTTT CGGCAATCCG CATTTTGCCC GTGATTTTCT CTATCAAACC

1501 GAATGGCAGC AGTTTGCCAA AGACGGCTTC CTGCACAGAT ACGATTTCGC

1551 CTGGTCGCGC GATCAGGAAG AAAAAATCTA TGTGCAGGAC AAAATCCGCG

1601 AACAGGCGGA AGGACTTTGG CAATGGCTGC AGGAAGGCGC GCATATCTAT

1651 GTGTGCGGCG ATGCGGCAAA AATGGCAAAA GACGTGGAAG CCGCCTTGCT

1701 GGATGTGATT ATCGGGCAG GACATTTGGA CGAAGAGGGC GCAGAAGAAT

1751 ATTTGGATAT GCTGCGCGAA GAAAACGCT ATCAGCGTGA TGTTTATTGA
```

This corresponds to the amino acid sequence <SEQ ID 612; ORF 150.a>:

```
a150.pep

1 MQNTNPPLPP MPPEITQLLS GLDAAQWAWL SGYAWAKAGN GASAGLPALQ

51 TALPTAEPFS VTVLSASQTG NAKSVADKAA DSLEAAGIQV SRAELKDYKA

101 KNIAGERRLL LVTSTQGEGE PPEEAVVLHK LLNGKKAPKL DKLQFAVLGL

151 GDSSYPNFCR AGKDFDKRFE ELGAKRLLER VDADLDFAAA ADGWTDNIAA

201 LLKEEAAKNR ATPAPQTTPP AGLQTAPDGR YCKADPFPAA LLANQKITAR

251 QSDKDVRHIE IDLSGSDLHY LPGDALGVWF DNDPALVREI LDLLGIDQAT

301 EIQAGGKTLP VASALLSHFE LTQNTPAFVK GYAPFADDDE LDRIAADNAV

351 LQGFVQSTPI ADVLHRFPAK LTAEQFAGLL RPLAPRLYSI SSSQAEVGDE

401 VHLTVGAVRF EHEGRARAGG ASGFLADRLE EDGTVRVFVE RNDGFRLPED

451 SRKPIVMIGS GTGVAPFRAF VQQRAAENAE GKNWLFFGNP HFARDFLYQT

501 EWQQFAKDGF LHRYDFAWSR DQEEKIYVQD KIREQAEGLW QWLQEGAHIY

551 VCGDAAKMAK DVEAALLDVI IGAGHLDEEG AEEYLDMLRE EKRYQRDVY* m150/a150 94.8% identity in 599 aa overlap 10         20         30         40         50         60
m150.pep MQNTNPPLPPLPPEITQLLSGLDAAQWAWLSGYAWAKAGNGASAGLPALQTALPAAEPFS
         ||||||||||:||||||||||||||||||||||||||||||||||||||||||:||||
a150     MQNTNPPLPPMPPEITQLLSGLDAAQWAWLSGYAWAKAGNGASAGLPALQTALPTAEPFS
                10         20         30         40         50         60
```

```
                  70        80        90       100       110       120
m150.pep  VTVLSASQTGNAKSVADKAADSLEAAGIQVSRAELKDYKAKNIAGERRLLLVTSTQGEGE
          ||||||||||||||||||||||||||||||||||||||||||||||||||||||||||||
a150      VTVLSASQTGNAKSVADKAADSLEAAGIQVSRAELKDYKAKNIAGERRLLLVTSTQGEGE
                  70        80        90       100       110       120

130       140       150       160       170       180
m150.pep  PPKEAVVLHKLLNGKKAPKLDKLQFAVLGLGDSSYPNFCQAGKDFDRRFEELGAKRLLER
          ||:|||||||||||||||||||||||||||||||||||:||||||:||||||||||||||
a150      PPEEAVVLHKLLNGKKAPKLDKLQFAVLGLGDSSYPNFCRAGKDFDKRFEELGAKRLLER
                 130       140       150       160       170       180

190       200       210       220       230       240
m150.pep  VDADLDFTASANAWTDNIAALLKEEAAKNRATPAPQTTPPAGLQTAPDGRYCKAAPFPAA
          |||||||:|:|::|||||||||||||||||||||||||||||||||||||||||||||||
a150      VDADLDFAAAADGWTDNIAALLKEEAAKNRATPAPQTTPPAGLQTAPDGRYCKADPFPAA
                 190       200       210       220       230       240

250       260       270       280       290       300
m150.pep  LLANQKITARQSDKDVRHIEIDLSGSDLHYLPGDALGVWFDNDPALVREILDLLGIDPAT
          |||||||||||||||||||||||||||||||||||||||||||||||||||||||||||
a150      LLANQKITARQSDKDVRHIEIDLSGSDLHYLPGDALGVWFDNDPALVREILDLLGIDQAT
                 250       260       270       280       290       300

310       320       330       340       350       360
m150.pep  EIQAGGKMMPVARALSSHFELTQNTPAFVKGYAAFAHYEELDKIIADNAVLQDFVQNTPI
          |||||||:|||  ||   :|||||||||||||||  :|  |:|:|||||||||:| :|||
a150      EIQAGGKTLPVASALLSHFELTQNTPAFVKGYAPFADDDELDRIAADNAVLQGFVQSTPI
                 310       320       330       340       350       360

370       380       390       400       410       420
m150.pep  VDVLHRFPASLTAEQFIRLLRPLAPRLYSISSAQAEVGDEVHLTVGVVRFEHEGRARTGG
          :||||||||:|||   ||   ||||||||||||||:||||||||||||:|||||||:||
a150      ADVLHRFPAKLTAEQFAGLLRPLAPRLYSISSSQAEVGDEVHLTVGAVRFEHEGRARAGG
                 370       380       390       400       410       420

430       440       450       460       470       480
m150.pep  ASGFLADRLEEDGTVRVFVERNDGFRLPEDSRKPIVMIGSGTGVAPFRAFVQQRAAENAE
          ||||||||||||||||||||||||||||||||||||||||||||||||||||||||||||
a150      ASGFLADRLEEDGTVRVFVERNDGFRLPEDSRKPIVMIGSGTGVAPFRAFVQQRAAENAE
                 430       440       450       460       470       480

490       500       510       520       530       540
m150.pep  GKNWLIFGNPHFARDFLYQTEWQQFAKDGFLHRYDFAWSRDQEEKIYVQDKIREQAEGLW
          |||||:||||||||||||||||||||||||||||||||||||||||||||||||||||||
a150      GKNWLFFGNPHFARDFLYQTEWQQFAKDGFLHRYDFAWSRDQEEKIYVQDKIREQAEGLW
                 490       500       510       520       530       540

550       560       570       580       590       600
m150.pep  QWLQEGAHIYVCGDAAKMAKDVEAALLDVIIGAGHLDEEGAEEYLDMLREEKRYQRDVYX
          ||||||||||||||||||||||||||||||||||||||||||||||||||||||||||||
a150      QWLQEGAHIYVCGDAAKMAKDVEAALLDVIIGAGHLDEEGAEEYLDMLREEKRYQRDVYX
                 550       560       570       580       590       600
```

40

The following partial DNA sequence was identified in *N. gonorrhoeae* <SEQ ID 613>:

```
g151.seq
    1 ATGAAACAAA TCCGCAACAT CGCCATCATC GCACACGTCG ACCACGGCAA

51 AACCACATTG GTCGACCAAC TGCTGCGCCA ATCCGGCACA TTCCGCGCCA

101 ACCAGCAGGT TGACGAGCGC GTGATGGACA GCAACGACCT TGAAAAGAA

151 CGCGGCATCA CCATCCTCGC CAAAAACACC GCCATCGATT ACGAAGGCTG

201 CCACATCAAT ATCGTCGACA CGCCGGGACA CGCCGACTTC GGCGGCGAAG

251 TGGAGCGCGT TTTGGGGATG GTGGATTGCG TCGTCTTGTT GGTGGACGCA

301 CAGGAAGGTC CGATGCCGCA AACCCGTTTC GTGACCAAAA AAGCCTTGGC

351 TTTGGGGCTG AAACCGATTG TCGTCATCAA CAAAATCGAC AAACCGTCCG

401 CCCGTCCGAG CTGGGTTATC GACCAGACTT TCGAGTTGTT CGACAACTTG

451 GGTGCGACCG ACGAGCAGTT GGATTTCCCG ATTGTTTACG CTTCAGGTTT

501 GAGCGGCTTT GCCAAGCTGG AAGAAAccga CGAGAGCAGC GATATGCGCC

551 CGCtgttcgA CACCATCCTA AAATACAcgc tgCACCGAG CGGCAGCGCG

601 GACGAGCCGC TGCAACTGCA AATTTCCCAA CTCGACTACG ACAACTACAC

651 CGGCCGCCTC GGTATCGGTC GTATCTTGAA CGGACGCATC AAACCCGGCC
```

```
 701 AAACCGTTGC CGTGATGAAC CACGAGCAGC AAATCGCCCA AGGCCGCATC

751 AACCAGCTTT TGGGTTTCAA AGGCTTGGAA CGCGTGCCGC TTGAAGAAGC

801 CGAAGCCGGC GACATTGTGA TTATTTCCGG TATCGAAGAC ATCGGCATCG

851 GCGTAACCAT CACCGACAAA GACAACCCCA AAGGCCTGCC GATGTTGAGC

901 GTGGACGAAC CGACGCTGAC GATGGACTTT ATGGTAAACA CCAGCCCGCT

951 CGCAGGTACA GAAGGCAAAT TCGTGACCAG CCGCCAAATC CGCGACCGCC

1001 TGCAAAAAGA ATTGCTGACC AACGTTGCCC TGCGCGTGGA AGACACCGCC

1051 GatgCCGACG TGTTCCGCGT ATCcgGGCGC GGCGAACTGC ACCTGACGAT

1101 TTTGCTGGAA AATATGCGCC GCGAAGGCTA CGAACTCGCC GTCGGCAAGC

1151 CGCGCGTCGT GTACCGAGAC ATCGACGGTC AAAAATGCGA ACCTTATGAA

1201 AACCTGACTG TGGACGTACc cgacgacAAC CAAGGCGCGG TAATGGAAGA

1251 ACTCGGCCGC CGCCGTGGCG AACTGACCAA TATGGAAAGC GACGGCAACG

1301 GacgCACCCG CCTCGAATAC CATATTCCAG CGCGCGGCTT GATCGGTTTC

1351 CAAGGCGAAT TCATGACCCT GACGCGCGGC GTCGGGCTGA TGAgccacGT

1401 GTTCgacgac tacgcgcccg tcaAACCCGA TATGCCCGGC CGCCACAACG

1451 GCGTactggt GtcccaAGAG CAGGGCGAGG CGGTTGCTTA CGCCTTGTGG

1501 AATCTTGAAG ACCGCGGCCG TATGTTCGTA TCGCCCAACG ACAAAATCTA

1551 CGAAGGTATG ATTATCGGCA TCCACAGCCG CGACAACGAT TTGGTGGTCA

1601 ACCCGCTCAA AGGCAAAAAA CTCACCAATA TCCGTGCCAG CGGTACCGAC

1651 GAAGCGGTGC GCCTGACCAC GCCGATCAAA CTGAcgcTGG AAGGCGCGGT

1701 CGAGTTTATC GACGATGACG AGCTGGTGGA AATCACGCCG CAAtccatcc 1751 gcctgcgcat gcgttacctG AGCGaattgg aacgccgccg tcaTTTTAAA 1801 AagctgGATT AA
```

This corresponds to the amino acid sequence <SEQ ID 614; ORF 151.ng>:

```
g151.pep
   1 MKQIRNIAII AHVDHGKTTL VDQLLRQSGT FRANQQVDER VMDSNDLEKE

51 RGITILAKNT AIDYEGCHIN IVDTPGHADF GGEVERVLGM VDCVVLLVDA

101 QEGPMPQTRF VTKKALALGL KPIVVINKID KPSARPSWVI DQTFELFDNL

151 GATDEQLDFP IVYASGLSGF AKLEETDESS DMRPLFDTIL KYTPAPSGSA

201 DEPLQLQISQ LDYDNYTGRL GIGRILNGRI KPGQTVAVMN HEQQIAQGRI

251 NQLLGFKGLE RVPLEEAEAG DIVIISGIED IGIGVTITDK DNPKGLPMLS

301 VDEPTLTMDF MVNTSPLAGT EGKFVTSRQI RDRLQKELLT NVALRVEDTA

351 DADVFRVSGR GELHLTILLE NMRREGYELA VGKPRVVYRD IDGQKCEPYE

401 NLTVDVPDDN QGAVMEELGR RRGELTNMES DGNGRTRLEY HIPARGLIGF

451 QGEFMTLTRG VGLMSHVFDD YAPVKPDMPG RHNGVLVSQE QGEAVAYALW

501 NLEDRGRMFV SPNDKIYEGM IIGIHSRDND LVVNPLKGKK LTNIRASGTD

551 EAVRLTTPIK LTLEGAVEFI DDDELVEITP QSIRLRMRYL SELERRRHFK

601 KLD*
```

The following partial DNA sequence was identified in *N. meningitidis* <SEQ ID 615>:

```
m151.seq
   1 ATGAAACAAA TCCGCAACAT CGCCATCATC GCCCACGTCG ACCACGGCAA
  51 AACCACATTG GTCGACCAAC TGCTGCGCCA ATCCGGCACA TTCCGCGCCA
 101 ACCAGCAGGT TGACGAGCGC GTGATGGACA GCAACGACCT TGAAAAAGAA
 151 CGCGGCATCA CCATCCTCGC CAAAAACACC GCCATCGATT ACGAAGGCTA
 201 CCACATCAAT ATCGTCGACA CGCCGGGACA CGCCGACTTC GGCGGCGAAG
 251 TAGAGCGCGT TTTGGGGATG GTGGACTGCG TCGTCTTGTT GGTGGACGCG
 301 CAGGAAGGCC CGATGCCGCA AACCCGTTTC GTGACCAAAA AAGCCTTGGC
 351 TTTGGGGCTG AAACCGATTG TCGTCATCAA CAAAATCGAC AAGCCGTCCG
 401 CTCGTCCGAG CTGGGTTATC GACCAAACTT TCGAGCTGTT CGACAACTTG
 451 GGCGCGACCG ACGAGCAGTT GGATTTCCCG ATTGTTTACG CTTCAGGGTT
 501 GAGCGGTTTC GCCAAATTGG AAGAAACCGA CGAGAGCAAC GACATGCGTC
 551 CGCTGTTCGA TACTATCTTA AAATATACGC CTGCACCGAG CGGCAGCGCG
 601 GACGAAACGC TGCAACTGCA AATTTCCCAA CTCGACTACG ACAACTACAC
 651 CGGCCGCCTC GGTATCGGTC GTATCTTGAA CGGACGCATC AAACCCGGCC
 701 AAACCGTTGC CGTCATGAAC CACGATCAGC AAATCGCCCA AGGCCGCATC
 751 AACCAGCTTT TGGGTTTCAA AGGTTTGGAA CGCGTGCCGC TTGAAGAAGC
 801 CGAAGCCGGC GACATCGTGA TTATTTCCGG TATCGAAGAC ATCGGTATCG
 851 GCGTAACCAT CACCGACAAA GACAATCCCA AAGGCCTACC GATGTTGAGC
 901 GTGGACGAAC CGACGCTGAC GATGGACTTT ATGGTCAACA CCAGCCCGCT
 951 GGCGGGTACG GAAGGCAAAT TCGTAACCAG CCGCCAAATC CGCGACCGCC
1001 TGCAAAAAGA ATTGCTGACC AACGTCGCCC TGCGCGTGGA AGATACCGCC
1051 GATGCCGACG TGTTCCGCGT ATCCGGGCGC GGCGAGCTGC ACCTGACCAT
1101 TTTGCTGGAA AACATGCGCC GCGAAGGCTA CGAACTCGCC GTCGGCAAAC
1151 CGCGCGTCGT GTACCGCGAC ATCGACGGTC AAAAATGCGA ACCGTATGAA
1201 AACCTGACCG TGGATGTACC CGACGACAAC CAAGGCGCGG TAATGGAAGA
1251 ACTCGGCCGC CGCCGTGGCG AACTGACTAA TATGGAAAGC GACGGCAACG
1301 GACGCACCCG CCTCGAATAC CATATTCCAG CGCGCGGCTT GATCGGTTTC
1351 CAAGGCGAAT TTATGACCCT GACGCGCGGG GTCGGGCTGA TGAGCCACGT
1401 GTTCGACGAT TACGCGCCCG TCAAACCCGA TATGCCCGGC CGCCACAACG
1451 GCGTGCTGGT GTCCCAAGAG CAGGGCGAGG CAGTCGCTTA CGCCTTGTGG
1501 AATCTGGAAG ACCGCGGCCG TATGTTCGTA TCGCCCAACG ACAAAATCTA
1551 CGAAGGCATG ATTATCGGCA TCCACAGTCG CGACAACGAT TTGGTGGTCA
1601 ACCCGCTCAA AGGCAAAAAA CTTACCAACA TCCGTGCCAG CGGTACCGAC
1651 GAAGCCGTTC GCCTGACCAC GCCAATCAAG CTGACGCTGG AAGGTGCGGT
1701 TGAGTTTATC GACGATGACG AACTCGTTGA AATCACGCCG CAATCCATCC
1751 GTCTGCGCAA GCGTTACTTG AGCGAATTGG AACGCCGCCG CCACTTTAAA
1801 AAGCTGGATT GA
```

This corresponds to the amino acid sequence <SEQ ID 616; ORF 151>:

```
m151.pep
    1 MKQIRNIAII AHVDHGKTTL VDQLLRQSGT FRANQQVDER VMDSNDLEKE

51 RGITILAKNT AIDYEGYHIN IVDTPGHADF GGEVERVLGM VDCVVLLVDA

101 QEGPMPQTRF VTKKALALGL KPIVVINKID KPSARPSWVI DQTFELFDNL

151 GATDEQLDFP IVYASGLSGF AKLEETDESN DMRPLFDTIL KYTPAPSGSA

201 DETLQLQISQ LDYDNYTGRL GIGRILNGRI KPGQTVAVMN HDQQIAQGRI

251 NQLLGFKGLE RVPLEEAEAG DIVIISGIED IGIGVTITDK DNPKGLPMLS

301 VDEPTLTMDF MVNTSPLAGT EGKFVTSRQI RDRLQKELLT NVALRVEDTA

351 DADVFRVSGR GELHLTILLE NMRREGYELA VGKPRVVYRD IDGQKCEPYE

401 NLTVDVPDDN QGAVMEELGR RRGELTNMES DGNGRTRLEY HIPARGLIGF

451 QGEFMTLTRG VGLMSHVFDD YAPVKPDMPG RHNGVLVSQE QGEAVAYALW

501 NLEDRGRMFV SPNDKIYEGM IIGIHSRDND LVVNPLKGKK LTNIRASGTD

551 EAVRLTTPIK LTLEGAVEFI DDDELVEITP QSIRLRKRYL SELERRRHFK

601 KLD*
```

Computer analysis of this amino acid sequence gave the following results:
Homology with a Predicted ORF from *N. gonorrhoeae*
ORF 151 shows 99.2% identity over a 603 aa overlap with a predicted ORF (ORF 151.ng) from *N. gonorrhoeae*:

```
m151/g151

10         20         30         40         50         60
m151.pep  MKQIRNIAIIAHVDHGKTTLVDQLLRQSGTFRANQQVDERVMDSNDLEKERGITILAKNT
          ||||||||||||||||||||||||||||||||||||||||||||||||||||||||||||
g151      MKQIRNIAIIAHVDHGKTTLVDQLLRQSGTFRANQQVDERVMDSNDLEKERGITILAKNT
                  10         20         30         40         50         60

70         80         90        100        110        120
m151.pep  AIDYEGYHINIVDTPGHADFGGEVERVLGMVDCVVLLVDAQEGPMPQTRFVTKKALALGL
          ||||| ||||||||||||||||||||||||||||||||||||||||||||||||||||||
g151      AIDYEGCHINIVDTPGHADFGGEVERVLGMVDCVVLLVDAQEGPMPQTRFVTKKALALGL
                  70         80         90        100        110        120

130        140        150        160        170        180
m151.pep  KPIVVINKIDKPSARPSWVIDQTFELFDNLGATDEQLDFPIVYASGLSGFAKLEETDESN
          |||||||||||||||||||||||||||||||||||||||||||||||||||||||||||:
a151      KPIVVINKIDKPSARPSWVIDQTFELFDNLGATDEQLDFPIVYASGLSGFAKLEETDESS
                 130        140        150        160        170        180

190        200        210        220        230        240
m151.pep  DMRPLFDTILKYTPAPSGSADETLQLQISQLDYDNYTGRLGIGRILNGRIKPGQTVAVMN
          ||||||||||||||||||||||| ||||||||||||||||||||||||||||||||||||
g151      DMRPLFDTILKYTPAPSGSADEPLQLQISQLDYDNYTGRLGIGRILNGRIKPGQTVAVMN
                 190        200        210        220        230        240

250        260        270        280        290        300
m151.pep  HDQQIAQGRINQLLGFKGLERVPLEEAEAGDIVIISGIEDIGIGVTITDKDNPKGLPMLS
          |:||||||||||||||||||||||||||||||||||||||||||||||||||||||||||
g151      HEQQIAQGRINQLLGFKGLERVPLEEAEAGDIVIISGIEDIGIGVTITDKDNPKGLPMLS
                 250        260        270        280        290        300

310        320        330        340        350        360
m151.pep  VDEPTLTMDFMVNTSPLAGTEGKFVTSRQIRDRLQKELLTNVALRVEDTADADVFRVSGR
          ||||||||||||||||||||||||||||||||||||||||||||||||||||||||||||
g151      VDEPTLTMDFMVNTSPLAGTEGKFVTSRQIRDRLQKELLTNVALRVEDTADADVFRVSGR
                 310        320        330        340        350        360

370        380        390        400        410        420
m151.pep  GELHLTILLENMRREGYELAVGKPRVVYRDIDGQKCEPYENLTVDVPDDNQGAVMEELGR
          ||||||||||||||||||||||||||||||||||||||||||||||||||||||||||||
g151      GELHLTILLENMRREGYELAVGKPRVVYRDIDGQKCEPYENLTVDVPDDNQGAVMEELGR
                 370        380        390        400        410        420
```

```
                    430        440        450        460        470        480
m151.pep  RRGELTNMESDGNGRTRLEYHIPARGLIGFQGEFMTLTRGVGLMSHVFDDYAPVKPDMPG
          ||||||||||||||||||||||||||||||||||||||||||||||||||||||||||||
g151      RRGELTNMESDGNGRTRLEYHIPARGLIGFQGEFMTLTRGVGLMSHVFDDYAPVKPDMPG
                    430        440        450        460        470        480

490        500        510        520        530        540
m151.pep  RHNGVLVSQEQGEAVAYALWNLEDRGRMFVSPNDKIYEGMIIGIHSRDNDLVVNPLKGKK
          ||||||||||||||||||||||||||||||||||||||||||||||||||||||||||||
g151      RHNGVLVSQEQGEAVAYALWNLEDRGRMFVSPNDKIYEGMIIGIHSRDNDLVVNPLKGKK
                    490        500        510        520        530        540

550        560        570        580        590        600
m151.pep  LTNIRASGTDEAVRLTTPIKLTLEGAVEFIDDDELVEITPQSIRLRKRYLSELERRRHFK
          |||||||||||||||||||||||||||||||||||||||||||| |||||||||||||||
g151      LTNIRASGTDEAVRLTTPIKLTLEGAVEFIDDDELVEITPQSIRLRMRYLSELERRRHFK
                    550        560        570        580        590        600 m151.pep  KLDX
          ||||
g151      KLDX
```

The following partial DNA sequence was identified in *N. meningitidis* <SEQ ID 617>:

```
a151.seq
    1  ATGAAACAAA TCCGCAACAT CGCCATCATC GCCCACGTCG ACCACGGCAA

51  AACCACATTG GTCGACCAAC TGCTGCGCCA ATCCGGCACA TTCCGCGCCA

101  ACCAGCAGGT TGACGAGCGC GTGATGGACA GCAACGACCT TGAAAAGAA

151  CGCGGCATCA CCATCCTCGC CAAAAACACC GCCATCGATT ACGAAGGCTA

201  CCACATCAAT ATCGTCGACA CGCCGGGACA CGCCGACTTC GGCGGCGAAG

251  TAGAGCGAGT TTTGGGGATG GTGGACTGCG TCGTCTTGTT GGTGGACGCG

301  CAGGAAGGCC CGATGCCGCA AACCCGTTTC GTGACCAAAA AAGCCTTGGC

351  TTTGGGGCTG AAACCGATTG TCGTCATCAA TAAAATCGAC AAACCGTCCG

401  CCCGTCCGAG CTGGGTCATC GACCAAACTT TCGAGCTGTT CGACAACTTG

451  GGCGCGACCG ACGAGCAGTT GGATTTCCCG ATTGTTTATG CTTCCGGTCT

501  GTCCGGTTTC GCCAAATTGG AAGAAACCGA CGAGAGCAAC GACATGCGTC

551  CGCTGTTCGA TACTATCTTA AAATATACGC CTGCACCGAG CGGCAGCGCG

601  GACGAAACGC TGCAACTGCA AATTTCCCAA CTCGACTACG ACAACTACAC

651  CGGCCGCCTC GGTATCGGTC GTATCTTGAA CGGACGTATC AAGCCCGGTC

701  AAGTTGTTGC CGTCATGAAC CACGATCAAC AAATCGCCCA AGGCCGCATC

751  AACCAGCTTT TGGGTTTCAA AGGTTTAGAA CGCGTGCCGC TTGAAGAAGC

801  CGAAGCCGGC GACATCGTGA TTATTTCCGG TATTGAAGAC ATCGGCATCG

851  GCGTAACCAT CACCGACAAA GACAACCCCA AAGGCCTGCC GATGTTGAGC

901  GTGGACGAAC CGACGCTGAC GATGGACTTT ATGGTCAACA CCAGCCCGTT

951  GGCAGGTACG GAAGGCAAAT TCGTAACCAG CCGCCAAATC CGCGACCGCC

1001  TGCAAAAAGA ATTGCTGACC AACGTCGCCC TGCGCGTGGA AGATACCGCC

1051  GATGCCGACG TGTTCCGCGT ATCCGGGCGC GGCGAGCTGC ACCTGACCAT

1101  TTTGCTGGAA AACATGCGCC GCGAAGGCTA CGAACTCGCC GTCGGCAAAC

1151  CGCGCGTCGT GTACCGCGAC ATCGACGGTC AAAAATGCGA ACCGTATGAA

1201  AACCTGACCG TGGACGTACC CGACGACAAC CAAGGCGCGG TAATGGAAGA

1251  ACTCGGCCGC CGCCGTGGCG AACTGACTAA TATGGAAAGC GACGGCAACG

1301  GACGCACCCG CCTCGAATAC CATATTCCAG CGCGCGGCTT GATCGGCTTC
```

-continued
```
1351 CAAGGCGAAT TTATGACCCT GACGCGCGGG GTCGGGCTGA TGAGCCACGT

1401 GTTCGACGAT TACGCGCCCG TCAAACCCGA TATGCCTGGC CGCCACAACG

1451 GCGTGCTGGT GTCCCAAGAG CAGGGCGAGG CAGTCGCTTA CGCCTTGTGG

1501 AATCTGGAAG ACCGCGGCCG TATGTTCGTA TCGCCCAACG ACAAAATCTA

1551 CGAAGGTATG ATTATCGGCA TCCACAGTCG CGACAACGAT TTGGTGGTCA

1601 ACCCGCTCAA AGGCAAAAAA CTTACCAACA TCCGTGCCAG CGGTACCGAC

1651 GAAGCCGTTC GCCTGACCAC GCCGATTAAG CTGACGCTGG AAGGTGCGGT

1701 CGAGTTTATC GACGATGATG AGCTGGTAGA AATCACGCCG CAATCCATCC

1751 GTCTGCGCAA GCGTTACTTG AGCGAATTGG AACGCCGCCG CCATTTCAAA

1801 AAGCTAGATT GA
```

This corresponds to the amino acid sequence <SEQ ID 618; ORF 151.a>:

```
a151.pep

1 MKQIRNIAII AHVDHGKTTL VDQLLRQSGT FRANQQVDER VMDSNDLEKE

51 RGITILAKNT AIDYEGYHIN IVDTPGHADF GGEVERVLGM VDCVVLLVDA

101 QEGPMPQTRF VTKKALALGL KPIVVINKID KPSARPSWVI DQTFELFDNL

151 GATDEQLDFP IVYASGLSGF AKLEETDESN DMRPLFDTIL KYTPAPSGSA

201 DETLQLQISQ LDYDNYTGRL GIGRILNGRI KPGQVVAVMN HDQQIAQGRI

251 NQLLGFKGLE RVPLEEAEAG DIVIISGIED IGIGVTITDK DNPKGLPMLS

301 VDEPTLTMDF MVNTSPLAGT EGKFVTSRQI RDRLQKELLT NVALRVEDTA

351 DADVFRVSGR GELHLTILLE NMRREGYELA VGKPRVVYRD IDGQKCEPYE

401 NLTVDVPDDN QGAVMEELGR RRGELTNMES DGNGRTRLEY HIPARGLIGF

451 QGEFMTLTRG VGLMSHVFDD YAPVKPDMPG RHNGVLVSQE QGEAVAYALW

501 NLEDRGRMFV SPNDKIYEGM IIGIHSRDND LVVNPLKGKK LTNIRASGTD

551 EAVRLTTPIK LTLEGAVEFI DDDELVEITP QSIRLRKRYL SELERRRHFK

601 KLD*
``` m151/a151 99.8% identity in 603 aa overlap

```
                 10         20         30         40         50         60
m151.pep MKQIRNIAIIAHVDHGKTTLVDQLLRQSGTFRANQQVDERVMDSNDLEKERGITILAKNT
         ||||||||||||||||||||||||||||||||||||||||||||||||||||||||||||
a151     MKQIRNIAIIAHVDHGKTTLVDQLLRQSGTFRANQQVDERVMDSNDLEKERGITILAKNT
                 10         20         30         40         50         60

70         80         90        100        110        120
m151.pep AIDYEGYHINIVDTPGHADFGGEVERVLGMVDCVVLLVDAQEGPMPQTRFVTKKALALGL
         ||||||||||||||||||||||||||||||||||||||||||||||||||||||||||||
a151     AIDYEGYHINIVDTPGHADFGGEVERVLGMVDCVVLLVDAQEGPMPQTRFVTKKALALGL
                 70         80         90        100        110        120

130        140        150        160        170        180
m151.pep KPIVVINKIDKPSARPSWVIDQTFELFDNLGATDEQLDFPIVYASGLSGFAKLEETDESN
         ||||||||||||||||||||||||||||||||||||||||||||||||||||||||||||
a151     KPIVVINKIDKPSARPSWVIDQTFELFDNLGATDEQLDFPIVYASGLSGFAKLEETDESN
                130        140        150        160        170        180

190        200        210        220        230        240
m151.pep DMRPLFDTILKYTPAPSGSADETLQLQISQLDYDNYTGRLGIGRILNGRIKPGQTVAVMN
         |||||||||||||||||||||||||||||||||||||||||||||||||||||:|||||
a151     DMRPLFDTILKYTPAPSGSADETLQLQISQLDYDNYTGRLGIGRILNGRIKPGQVVAVMN
                190        200        210        220        230        240

250        260        270        280        290        300
m151.pep HDQQIAQGRINQLLGFKGLERVPLEEAEAGDIVIISGIEDIGIGVTITDKDNPKGLPMLS
         ||||||||||||||||||||||||||||||||||||||||||||||||||||||||||||
a151     HDQQIAQGRINQLLGFKGLERVPLEEAEAGDIVIISGIEDIGIGVTITDKDNPKGLPMLS
                250        260        270        280        290        300
```

```
                  310        320        330        340        350        360
m151.pep  VDEPTLTMDFMVNTSPLAGTEGKFVTSRQIRDRLQKELLTNVALRVEDTADADVFRVSGR
          ||||||||||||||||||||||||||||||||||||||||||||||||||||||||||||
a151      VDEPTLTMDFMVNTSPLAGTEGKFVTSRQIRDRLQKELLTNVALRVEDTADADVFRVSGR
                  310        320        330        340        350        360

370        380        390        400        410        420
m151.pep  GELHLTILLENMRREGYELAVGKPRVVYRDIDGQKCEPYENLTVDVPDDNQGAVMEELGR
          ||||||||||||||||||||||||||||||||||||||||||||||||||||||||||||
a151      GELHLTILLENMRREGYELAVGKPRVVYRDIDGQKCEPYENLTVDVPDDNQGAVMEELGR
                  370        380        390        400        410        420

430        440        450        460        470        480
m151.pep  RRGELTNMESDGNGRTRLEYHIPARGLIGFQGEFMTLTRGVGLMSHVFDDYAPVKPDMPG
          ||||||||||||||||||||||||||||||||||||||||||||||||||||||||||||
a151      RRGELTNMESDGNGRTRLEYHIPARGLIGFQGEFMTLTRGVGLMSHVFDDYAPVKPDMPG
                  430        440        450        460        470        480

490        500        510        520        530        540
m151.pep  RHNGVLVSQEQGEAVAYALWNLEDRGRMFVSPNDKIYEGMIIGIHSRDNDLVVNPLKGKK
          ||||||||||||||||||||||||||||||||||||||||||||||||||||||||||||
a151      RHNGVLVSQEQGEAVAYALWNLEDRGRMFVSPNDKIYEGMIIGIHSRDNDLVVNPLKGKK
                  490        500        510        520        530        540

550        560        570        580        590        600
m151.pep  LTNIRASGTDEAVRLTTPIKLTLEGAVEFIDDDELVEITPQSIRLRKRYLSELERRRHFK
          ||||||||||||||||||||||||||||||||||||||||||||||||||||||||||||
a151      LTNIRASGTDEAVRLTTPIKLTLEGAVEFIDDDELVEITPQSIRLRKRYLSELERRRHFK
                  550        560        570        580        590        600 m151.pep  KLDX
          ||||
a151      KLDX
```

The following partial DNA sequence was identified in *N. gonorrhoeae* <SEQ ID 619>:

```
g152.seq
    1  ATGAAAAaca aAACCaaagt ctgGGacttc cCcacccgcc ttTTCCactG

51  GctgcttgCC gCATCCctgc CCTTTATGTG gtatagCGCA AAAGCCGGCG

101  GcgataTGCT GcaatgGCAC ACGCGCGTCG GGCTGCTCGT CCTTTTCCTG

151  CTCGTATTCC GCCTCTGCTG GGGCATTTGG GGCAgcgATA CCGCCCGTTT

201  CTCccgTtTC GTCCGAGGTT GGGCAGGTAT ACGCGGCTAT CTGAAAAAcg 251  gCATTCCCGA ACAtatcCAG CCCGGACACA ACCCCTTGGG CGCACTgatg 301  gtcGTTGCGC TTTTGgccgc cgtcTCATTT CAagtcggcA CGGGGCTTTT 351  Tgccgccaat gaaaacacct tcagcaCCAa cggctacctc aaccatttgg 401  tttccgaaca tacgGGCAGC CTTATACGGA AAATCCACCT CAACTTTTTC

451  AAGCTGCTCG CCGTTTTTTC CGCAGTCCAC ATCGCCGCCG TCGCCGCATA

501  CCGCATATTC AAAAAGAAAA ACCTCGTCCG CCCGATGATA ACCGGCTTCA

551  AATACATCGA AGGCAAAACC TCAATCCGCT TTGCCGGCAA AGCCGCGCTT

601  GCCGCCGCAT TATCGGTTGC CGCGCTTGCC GCAGCCGCCA TCCTGCTCCT

651  GTCCTGA
```

This corresponds to the amino acid sequence <SEQ ID 620; ORF 152.ng>:

```
g152.pep
    1  MKNKTKVWDF PTRLFHWLLA ASLPFMWYSA KAGGDMLQWH TRVGLLVLFL

51  LVFRLCWGIW GSDTARFSRF VRGWAGIRGY LKNGIPEHIQ PGHNPLGALM

101  VVALLAAVSF QVGTGLFAAN ENTFSTNGYL NHLVSEHTGS LIRKIHLNFF

151  KLLAVFSAVH IAAVAAYRIF KKKNLVRPMI TGFKYIEGKT SIRFAGKAAL

201  AAALSVAALA AAAILLLS*
```

The following partial DNA sequence was identified in *N. meningitidis* <SEQ ID 621>:

```
m152.seq
   1 ATGAAAAACA AAACCAAAGT CTGGGACCTC CCCACCCGCC TTTTCCACTG

51 GCTGCTTGCC GCGTCCCTGC CCTTTATGTG GTATAGCGCG AAAGCCGGCG

101 GCGATATGCT GCAATGGCAC ACGCGCGTCG GGCTGTTCGT CCTTTTCCTG

151 CTCGTATTTC GCCTCTGCTG GGGCATTTGG GGCAGCGATA CCGCCCGTTT

201 TTCCCGTTTC GTCCAAGGCT GGGCAGGCAT ACGCGGCTAT CTGAAAAACG

251 GTATTCCCGA ACACATCCAG CCCGGACACA ACCCCTTGGG CGCACTGATG

301 GTCGTTGCGC TTTTGGCCGC CGTGTCCTTC CAAGTCGGCA CCGGGCTTTT

351 TGCCGCCGAT GAAAACACCT TCAGCACCAA CGGCTACCTC AACCATTTGG

401 TTTCCGAACA TACGGGCAGC CTTATGCGGA AAATCCACCT CAACTTTTTC

451 AAGCTGCTCG CCGTTTTTTC TGCAATCCAC ATCGCCGCCG TCGCCGCATA

501 CCGCGTATTC AAAAAGAAAA ACCTCATCCT CCCGATGATA ACCGGCTTCA

551 AATACATCGA AGGCAAAACC TCAATCCGCT TGCAGGCAA AGCCGCGCTT

601 GCCGCCGCAT TATCGGTTGC CTCGCTTGCC GCAGCCGCCA TCCTGCTCCT

651 GTCCTGA
```

This corresponds to the amino acid sequence <SEQ ID 622; ORF 152>:

```
m152.pep
   1 MKNKTKVWDL PTRLFHWLLA ASLPFMWYSA KAGGDMLQWH TRVGLFVLFL

51 LVFRLCWGIW GSDTARFSRF VQGWAGIRGY LKNGIPEHIQ PGHNPLGALM

101 VVALLAAVSF QVGTGLFAAD ENTFSTNGYL NHLVSEHTGS LMRKIHLNFF

151 KLLAVFSAIH IAAVAAYRVF KKKNLILPMI TGFKYIEGKT SIRFAGKAAL

201 AAALSVASLA AAILLLS*
```

Computer analysis of this amino acid sequence gave the following results:
Homology with a Predicted ORF from *N. gonorrhoeae*
ORF 152 shows 95.4% identity over a 218 aa overlap with a predicted ORF (ORF 152.ng) from *N. gonorrhoeae*:

```
    m152/g152
                    10         20         30         40         50         60
    m152.pep MKNKTKVWDLPTRLFHWLLAASLPFMWYSAKAGGDMLQWHTRVGLFVLFLLVFRLCWGIW
             ||||||||||:|||||||||||||||||||||||||||||||:||||||||||||||||
    g152     MKNKTKVWDFPTRLFHWLLAASLPFMWYSAKAGGDMLQWHTRVGLLVLFLLVFRLCWGIW
                    10         20         30         40         50         60
                    70         80         90        100        110        120
    m152.pep GSDTARFSRFVQGWAGIRGYLKNGIPEHIQPGHNPLGALMVVALLAAVSFQVGTGLFAAD
             ||||||||||:|||||||||||||||||||||||||||||||||||||||||||||||:
    g152     GSDTARFSRFVRGWAGIRGYLKNGIPEHIQPGHNPLGALMVVALLAAVSFQVGTGLFAAN
                    70         80         90        100        110        120
                   130        140        150        160        170        180
    m152.pep ENTFSTNGYLNHLVSEHTGSLMRKIHLNFFKLLAVFSAIHIAAVAAYRVFKKKNLILPMI
             ||||||||||||||||||||:|||||||||||||||:||||||||:|||||:||||:|||
    g152     ENTFSTNGYLNHLVSEHTGSLIRKIHLNFFKLLAVFSAVHIAAVAAYRIFKKKNLVRPMI
                   130        140        150        160        170        180
                   190        200        210  219
    m152.pep TGFKYIEGKTSIRFAGKAALAAALSVASLAAAILLLSX
             ||||||||||||||||||||||||||:|||||||||||
    g152     TGFKYIEGKTSIRFAGKAALAAALSVAALAAAILLLSX
                   190        200        210
```

The following partial DNA sequence was identified in *N. meningitidis* <SEQ ID 623>:

```
a152.seq
    1  ATGAAAAACA AAACCAAAGT CTGGGACTTC CCCACCCGCC TTTTCCACTG

51  GCTGCTTGCC GCATCCCTAC CCTTTATGTG GTATAGCGCG AAAACCGGCG

101  GCGATATGCT GCAATGGCAC ACGCGCGTCG GGCTGTTTAT CCTTTTCCTG

151  CTCGTATTCC GCCTCTGCTG GGGCATTTGG GGCAGCGATA CCGCCCGTTT

201  CTCCCGTTTC GTCCGCGGAT GGTCGGGTAT CAGAGAGTAT ATGAAAAACG

251  GTATTCCCGA ACACGTCCAA CCCGGACACA ACCCCTTGGG CGCACTGATG

301  GTCGTTGCGC TTTTGGCCGC CGTGTCGTTC CAAGTCGGCA CAGGGCTTTT

351  TGCCGCCGAT GTAAACACCT TCAGCACCAA CGGCTACCTC AACCATTTGG

401  TTTCCGAACA TACGGGCAGC CTTATGCGGA AAATCCATCT CAACTTTTTC

451  AAACTGCTCG CCGTTTTTTC CGCAGTCCAC ATCGCCGNCG TCGCCGCATA

501  CCGCGTGTTC AAAAAGAAAA ACCTCGTCCT CCCGATGATA ACCGGCTTCA

551  AATACATCGA AGGCAAAACC TCAATCCGCT TTGCCGGCAA AGCCGCGCTT

601  GCCGCCGCAT TATCGGTTGC CGCGCTTGCC GCAGCCGCCA TCCTGCTCCT

651  GTCCTGA
```

This corresponds to the amino acid sequence <SEQ ID 624; ORF 152.a>:

```
a152.pep
    1  MKNKTKVWDF PTRLFHWLLA ASLPFMWYSA KTGGDMLQWH TRVGLFILFL

51  LVFRLCWGIW GSDTARFSRF VRGWSGIREY MKNGIPEHVQ PGHNPLGALM

101  VVALLAAVSF QVGTGLFAAD VNTFSTNGYL NHLVSEHTGS LMRKIHLNFF

151  KLLAVFSAVH IAXVAAYRVF KKKNLVLPMI TGFKYIEGKT SIRFAGKAAL

201  AAALSVAALA AAAILLLS*
``` m152/a152 94.0% identity in 218 aa overlap

```
                 10        20        30        40        50        60
m152.pep MKNKTKVWDLPTRLFHWLLAASLPFMWYSAKAGGDMLQWHTRVGLFVLFLLVFRLCWGIW
         |||||||||:|||||||||||||||||||||:||||||||||||||:|||||||||||||
a152     MKNKTKVWDFPTRLFHWLLAASLPFMWYSAKTGGDMLQWHTRVGLFILFLLVFRLCWGIW
                 10        20        30        40        50        60

70        80        90       100       110       120
m152.pep GSDTARFSRFVQGWAGIRGYLKNGIPEHIQPGHNPLGALMVVALLAAVSFQVGTGLFAAD
         |||||||||||:||:||| |:|||||||:|||||||||||||||||||||||||||||||
a152     GSDTARFSRFVRGWSGIREYMKNGIPEHVQPGHNPLGALMVVALLAAVSFQVGTGLFAAD
                 70        80        90       100       110       120

130       140       150       160       170       180
m152.pep ENTFSTNGYLNHLVSEHTGSLMRKIHLNFFKLLAVFSAIHIAAVAAYRVFKKKNLILPMI
          |||||||||||||||||||||||||||||||||||||:||| ||||||||||||:||||
a152     VNTFSTNGYLNHLVSEHTGSLMRKIHLNFFKLLAVFSAVHIAXVAAYRVFKKKNLVLPMI
                130       140       150       160       170       180

190       200       210      219
m152.pep TGFKYIEGKTSIRFAGKAALAAALSVASLAAAAILLLSX
         |||||||||||||||||||||||||||:|||||||||||
a152     TGFKYIEGKTSIRFAGKAALAAALSVAALAAAAILLLSX
                190       200       210
```

The following partial DNA sequence was identified in *N. gonorrhoeae* <SEQ ID 625>:

```
g153.seq
    1 atggggtttg cttaCAgtat gacgtatatc gaggtCGGGa taccggaggc 51 ggcatccgtc ctttCgctGC CCGAGATgat gcgcctgatG GTGTTtCagg 101 attATGGTTT TttggcCGAA GTGATGTTTG TGctgaCTTT cGGCGcgcCG 151 GTTCTGTTtC TGCTGCTGTG CCTGTATGTC TATGCCGCGC TGATACGGAA

201 ACAGGCGTAT CCTGCGCTGC GTTTGGCAAC GCGTGTGATG GTGCGCTTGA

251 GGCAGGCGAT GATGGTGGAT GTGTTTTTTG TTTCCACTCT GGTGGCGTAT

301 ATCAAGCTCT CGTCTGTGGC AAAGGTTCGC TTCGGGCCGG CGTTTTATCT

351 GATGTTCGCG CTGTCGGTTA TGCTGATTCG GACTTCGGTA TCGGTTCCCC

401 AGCATTGGGT GTATTTCCAA ATCGGGCGGC TGACGGGGAA TAATGCGGTT

451 CAGACGGCAT CGGAAGGCAA AACCTGTTGC AGCCGCTGCC TGTATTTccg 501 cgacAGTgcc gaatccCCCT GCGGGGTGTg cgGCGcggaA CTgtacggcg 551 gacggccgaa aagtCTGAGt atttCgtCGG CGTTTCTgac ggcggcggTT 601 GTTTTGTATT TCCctgCcaa TATCctgccg attaTGAttt cgtccAATCc 651 tgccgccacg GAGGcCAACA CCATCTTTAG CGGCATCGCT TATATGTGGG 701 ACGagggcgA CAGGCTGATT GCGGCGGTTA TTTTCAGCGC GAGTATTTTG

751 GTGCCGGTGC TGAAGATTGC GGCAATGTCG GTTTTGATTG CGGCGGCACG

801 GTTCGCTTTG CCGGCGGGCG CAAAGAAATT GTCGCACCTC tacCGCATCA

851 CCGAAGCGGT CGGCCGCTGG TCGATGATTG ATATTTTTGT GATTATTATT

901 TTGATGTGTT CGTTCCacaC TTATGCCGCG CGCGTCATTC CGGGCAGTGC

951 GGCAGTCTAT TTCTGCCTGG TCGTGATTTT GACGATGCTG TCCGCCTATT

1001 ATTTCGACCC GCGCCTGCTT TGGGACAAAC GCGCTTCAGA CGGCATTGCT

1051 TTCAACGAAA CGGAAAAATA TGACTGA
```

40

This corresponds to the amino acid sequence <SEQ ID 626; ORF 153.ng>:

```
g153.pep
    1 MGFAYSMTYI EVGIPEAASV LSLPEMMRLM VFQDYGFLAE VMFVLTFGAP

51 VLFLLLCLYV YAALIRKQAY PALRLATRVM VRLRQAMMVD VFFVSTLVAY

101 IKLSSVAKVR FGPAFYLMFA LSVMLIRTSV SVPQHWVYFQ IGRLTGNNAV

151 QTASEGKTCC SRCLYFRDSA ESPCGVCGAE LYGGRPKSLS ISSAFLTAAV

201 VLYFPANILP IMISSNPAAT EANTIFSGIA YMWDEGDRLI AAVIFSASIL

251 VPVLKIAAMS VLIAAARFAL PAGAKKLSHL YRITEAVGRW SMIDIFVIII

301 LMCSFHTYAA RVIPGSAAVY FCLVVILTML SAYYFDPRLL WDKRASDGIA

351 FNETEKYD*
```

The following partial DNA sequence was identified in *N. meningitidis* <SEQ ID 627>:

```
m153.seq
    1 ATGGCGTTTG CTTACGGTAT GACGTATATC GAGGTCGGGA TACCGGGTGC

51 GGCATCCGTC CTTTCGCTGC CCGAGATGAT GCGCCTGATG GTGTTTCAGG
```

-continued

```
 101 ATTATGGTTT TTTGGCCGAA GTGATGTTTG TGCTGACTTT CGGCGCGCCG

151 GTTCTGTTTC TGCTGCTGTG CCTGTATGTC TATGCCGCGC TGATACGGAA

201 ACAGGCGTAT CCTGCGCTGC GTTTGGCAAC GCGTGTGATG GTGCGCTTGA

251 GACAGGCGAT GATGGTGGAT GTGTTTTTTG TTTCCACTTT GGTGGCGTAT

301 ATCAAGCTCT CGTCTGTGGC AGAGGTTCGC TTCGGGCCGG CGTTTTATCT

351 GATGTTCGCG CTGTCAGTTA TGCTGATTCG GACTTCGGTA TCGGTTCCCC

401 AGCATTGGGT GTATTTTCAA ATCGGGCGGC TGACGGGGGA TAATGCGGTT

451 CAGACGGCAT CGGAAGGTAA AACCTGTTGC AGCCGCTGCC TGTATTTCCG

501 CGACAGTGCC GAATCCCCCT GCGGCGTGTG CGGTGCGGAA CTGTACCGCC

551 GACGGCCGAA AAGTCTGAGT ATTTCGTCGG CGTTTCTGAC GGCGGCGGTT

601 ATTTTGTATT TCCCTGCCAA TATCCTGCCG ATTATGATTT CGTCCAATCC

651 TGCCGCCACG GAGGTCAATA CCATCCTTAA CGGCATCGCT TATATGTGGG

701 ACGAGGGCGA CAGGCTGATT GCGGCGGTTA TTTTCAGCGC GAGTATTTTG

751 GTGCCGGTAC TGAAGATTGC GGCAATGTCG GTTTTGATTG CGTCCGCCCG

801 CTTCGCTTTG CCAACGGGTG CAAAGAAATT GTCGCACCTC TACCGCATCA

851 CCGAAGCGGT CGGCCGCTGG TCGATGATTG ATATTTTTGT GATTATTATT

901 TTGATGTGTT CGTTCCACAC TTATGCCGCG CGCGTCATTC CGGGCAGTGC

951 GGCAGTCTAT TTCTGCCTGG TCGTGATTCT GACGATGCTG TCCGCCTATT

1001 ATTTCGACCC GCGCCTGCTT TGGGACAAAC GCGCTTCAGA CGGCATTGCT

1051 TTCAATGAAA CGGAAAAACA TGACTGA
```

This corresponds to the amino acid sequence <SEQ ID 628; ORF 153>:

```
m153.pep
      1 MAFAYGMTYI EVGIPGAASV LSLPEMMRLM VFQDYGFLAE VMFVLTFGAP
     51 VLFLLLCLYV YAALIRKQAY PALRLATRVM VRLRQAMMVD VFFVSTLVAY
    101 IKLSSVAEVR FGPAFYLMFA LSVMLIRTSV SVPQHWVYFQ IGRLTGDNAV
    151 QTASEGKTCC SRCLYFRDSA ESPCGVCGAE LYRRRPKSLS ISSAFLTAAV
    201 ILYFPANILP IMISSNPAAT EVNTILNGIA YMWDEGDRLI AAVIFSASIL
    251 VPVLKIAAMS VLIASARFAL PTGAKKLSHL YRITEAVGRW SMIDIFVIII
    301 LMCSFHTYAA RVIPGSAAVY FCLVVILTML SAYYFDPRLL WDKRASDGIA
    351 FNETEKHD* m153/g153  96.1% identity in 358 aa overlap 10         20         30         40         50         60
m153.pep MAFAYGMTYIEVGIPGAASVLSLPEMMRLMVFQDYGFLAEVMFVLTFGAPVLFLLLCLYV
         |:|||:||||||||||| |||||||||||||||||||||||||||||||||||||||||
g153     MGFAYSMTYIEVGIPEAASVLSLPEMMRLMVFQDYGFLAEVMFVLTFGAPVLFLLLCLYV
                 10         20         30         40         50         60

70         80         90        100        110        120
m153.pep YAALIRKQAYPALRLATRVMVRLRQAMMVDVFFVSTLVAYIKLSSVAEVRFGPAFYLMFA
         ||||||||||||||||||||||||||||||||||||||||||||||:|||||||||||||
g153     YAALIRKQAYPALRLATRVMVRLRQAMMVDVFFVSTLVAYIKLSSVAKVRFGPAFYLMFA
                 70         80         90        100        110        120

130        140        150        160        170        180
m153.pep LSVMLIRTSVSVPQHWVYFQIGRLTGDNAVQTASEGKTCCSRCLYFRDSAESPCGVCGAE
         |||||||||||||||||||||||||||:||||||||||||||||||||||||||||||||
g153     LSVMLIRTSVSVPQHWVYFQIGRLTGNNAVQTASEGKTCCSRCLYFRDSAESPCGVCGAE
                130        140        150        160        170        180
```

```
                     190        200        210        220        230        240
m153.pep   LYRRRPKSLSISSAFLTAAVILYFPANILPIMISSNPAATEVNTILNGIAYMWDEGDRLI
           || ||||||||||||||||:|||||||||||||||||||:|||::|||||||||||||
g153       LYGGRPKSLSISSAFLTAAVVLYFPANILPIMISSNPAATEANTIFSGIAYMWDEGDRLI
                     190        200        210        220        230        240

250        260        270        280        290        300
m153.pep   AAVIFSASILVPVLKIAAMSVLIASARFALPTGAKKLSHLYRITEAVGRWSMIDIFVIII
           ||||||||||||||||||||||||:||||||:||||||||||||||||||||||||||||
g153       AAVIFSASILVPVLKIAAMSVLIAAARFALPAGAKKLSHLYRITEAVGRWSMIDIFVIII
                     250        260        270        280        290        300

310        320        330        340        350     359
m153.pep   LMCSFHTYAARVIPGSAAVYFCLVVILTMLSAYYFDPRLLWDKRASDGIAFNETEKHDX
           |||||||||||||||||||||||||||||||||||||||||||||||||||||||:||
g153       LMCSFHTYAARVIPGSAAVYFCLVVILTMLSAYYFDPRLLWDKRASDGIAFNETEKYDX
                     310        320        330        340        350
```

The following partial DNA sequence was identified in *N. meningitidis* <SEQ ID 629>:

```
a153.seq
    1  ATGGCGTTTG CTTACGGTAT GACGTATATC GAGGTCGGGA TACCGGGTGC

51  GGCATCCGTC CTTTCGCTGC CCGAGATGAT GCGCCTGATG GTGTTTCAGG

101  ATTATGGTTT TTTGGCCGAA GTGATGTTTG TGCTGACCTT CGGCGCGCCG

151  GTTCTGTTTC TGCTGCTGTG CCTGTATGTC TATGCCGCGC TGATACGGAA

201  ACAGGCGTAT CCTGCGCTGC GTTTGGCAAC GCGTGTGATG GTGCGCTTGA

251  GACAGGCGAT GATGGTGGAT GTGTTTTTTG TTTCCACTTT GGTGGCGTAT

301  ATCAAGCTCT CGTCTGTGGC AGAGGTTCGC TTCGGATCGG CGTTTTATCT

351  GATGTTCGCG CTGTCGGTTA TGCTGATTCG GACTTCGGTA TCGGTTCCCC

401  AGCATTGGGT GTATTTTCAA ATCGGGCGGC TGACGGGGGA TAATGCGGTT

451  CAGACGGCAT CGGAAGGTAA AACCTGTTGC AGCCGCTGCC TGTATTTCCG

501  CGACAGTGCC GAATCCCCCT GCGGCGTGTG CGGTGCGGAA CTGTACCGCC

551  GACGGCCGAA AAGTCTGAGT ATTTCGTCGG CGTTTCTGAC GGCGGCGGTT

601  ATTTTGTATT TCCCTGCCAA TATCCTGCCG ATTATGATTT CGTCCAATCC

651  TGCCGCCACG GAGGTCAATA CCATCCTTAA CGGCATCGCT TATATGTGGG

701  ACGAGGGCGA CAGGCTGATT GCGGCGGTTA TTTTCAGCGC GAGTATTTTG

751  GTGCCGGTAC TGAAGATTGC GGCAATGTCG GTTTTGATTG CGTCCGCCCG

801  CTTCGCTTTG CCAACGGGTG CAAAGAAATT GTCGCACCTC TACCGCATCA

851  CCGAAGCGGT CGGCCGCTGG TCGATGATTG ATATTTTTGT GATTATTATT

901  TTGATGTGTT CGTTCCACAC TTATGCCGCG CGCGTCATTC CGGGCAGTGC

951  GGCAGTCTAT TTCTGCCTGG TCGTGATTCT GACGATGCTG TCCGCCTATT

1001  ATTTCGACCC GCGCCTGCTT TGGGACAAAC GCGCTTCAGA CGGCATTGCT

1051  TTCAATGAAA CGGAAAAACA TGACTGA
```

This corresponds to the amino acid sequence <SEQ ID 630; ORF 153.a>:

```
a153.pep
    1  MAFAYGMTYI EVGIPGAASV LSLPEMMRLM VFQDYGFLAE VMFVLTFGAP

51  VLFLLLCLYV YAALIRKQAY PALRLATRVM VRLRQAMMVD VFFVSTLVAY

101  IKLSSVAEVR FGSAFYLMFA LSVMLIRTSV SVPQHWVYFQ IGRLTGDNAV

151  QTASEGKTCC SRCLYFRDSA ESPCGVCGAE LYRRRPKSLS ISSAFLTAAV
```

-continued

```
201 ILYFPANILP IMISSNPAAT EVNTILNGIA YMWDEGDRLI AAVIFSASIL

251 VPVLKIAAMS VLIASARFAL PTGAKKLSHL YRITEAVGRW SMIDIFVIII

301 LMCSFHTYAA RVIPGSAAVY FCLVVILTML SAYYFDPRLL WDKRASDGIA

351 FNETEKHD*
``` m153/a153 99.7% identity in 358 aa overlap

```
                  10         20         30         40         50         60
m153.pep  MAFAYGMTYIEVGIPGAASVLSLPEMMRLMVFQDYGFLAEVMFVLTFGAPVLFLLLCLYV
          ||||||||||||||||||||||||||||||||||||||||||||||||||||||||||||
a153      MAFAYGMTYIEVGIPGAASVLSLPEMMRLMVFQDYGFLAEVMFVLTFGAPVLFLLLCLYV
                  10         20         30         40         50         60
                  70         80         90        100        110        120
m153.pep  YAALIRKQAYPALRLATRVMVRLRQAMMVDVFFVSTLVAYIKLSSVAEVRFGPAFYLMFA
          |||||||||||||||||||||||||||||||||||||||||||||||||||| ||||||
a153      YAALIRKQAYPALRLATRVMVRLRQAMMVDVFFVSTLVAYIKLSSVAEVRFGSAFYLMFA
                  70         80         90        100        110        120
                 130        140        150        160        170        180
m153.pep  LSVMLIRTSVSVPQHWVYFQIGRLTGDNAVQTASEGKTCCSRCLYFRDSAESPCGVCGAE
          ||||||||||||||||||||||||||||||||||||||||||||||||||||||||||||
a153      LSVMLIRTSVSVPQHWVYFQIGRLTGDNAVQTASEGKTCCSRCLYFRDSAESPCGVCGAE
                 130        140        150        160        170        180
                 190        200        210        220        230        240
m153.pep  LYRRRPKSLSISSAFLTAAVILYFPANILPIMISSNPAATEVNTILNGIAYMWDEGDRLI
          ||||||||||||||||||||||||||||||||||||||||||||||||||||||||||||
a153      LYRRRPKSLSISSAFLTAAVILYFPANILPIMISSNPAATEVNTILNGIAYMWDEGDRLI
                 190        200        210        220        230        240
                 250        260        270        280        290        300
m153.pep  AAVIFSASILVPVLKIAAMSVLIASARFALPTGAKKLSHLYRITEAVGRWSMIDIFVIII
          ||||||||||||||||||||||||||||||||||||||||||||||||||||||||||||
a153      AAVIFSASILVPVLKIAAMSVLIASARFALPTGAKKLSHLYRITEAVGRWSMIDIFVIII
                 250        260        270        280        290        300
                 310        320        330        340        350       359
m153.pep  LMCSFHTYAARVIPGSAAVYFCLVVILTMLSAYYFDPRLLWDKRASDGIAFNETEKHDX
          |||||||||||||||||||||||||||||||||||||||||||||||||||||||||
a153      LMCSFHTYAARVIPGSAAVYFCLVVILTMLSAYYFDPRLLWDKRASDGIAFNETEKHDX
                 310        320        330        340        350
```

The following partial DNA sequence was identified in *N. gonorrhoeae* <SEQ ID 631>:

```
g154.seq
    1 ATGACTGACA ACAGCCCTCC TCCAAACGGA CACGCTCAAG CACGCGTCCG

51 CAAAAACAAC accttcctCT CCGCCGTCTG GCTGGTCCCG CTGATCGCGC

101 TGATTGCCGG CGGCTGGCTT TGGGTTAAGG AAATCCGCAA CAGGGGGCCT

151 GTGGTTACGC TCTTGATGGA CAGCGCGGAA GGCATCGAAG TCAACAATAC

201 GGTCATTAAG GTATTGAGCA TCGATGTCGG ACGCGTTACC CGAATCAAAC

251 TGCGCGACGA CCAAAAAGGC GTGGAAGTTA CTGCCCAACT CAATGCGGAC

301 GTATCCGGCC TCATCCGCAG CGATACCCAG TTTTGGGTGG TCAAGCCGCG

351 TATCGACCAA AGCGGcgtAA CCGGTTTGGG TACGCTGCTT TCGGGTTCGT

401 ACATCGCTTT TACACCCGGC AAAAGCGGCG AGGCAAAAGA CGTGTTCCAA

451 GTGCAGGACA TTCCGCCCGT TACCGCCATC GGGCAAAgcg GGCTGCGCTT

501 GAATTTGATT GGTAAAAACG AccgCATCCT CAACGTcaaC AGCCCTGTTT

551 TGTATGAAAA CTTTATGGTC GGGCAAATCG AAAGCGCGCA TTTCGAcccG

601 TCCGACCAAA GCGTGCATTA CACCATCTTC ATCCAAAGCC CCAACGACAA

651 ACTGATTCAT TCCGCCAGCC GTTTTTGGCT GGAAAGCGGC ATCAATATCG

701 AAACCACAGG CAGCGGCATC AAACTCAATT CCGCCCCTCT GCCTGCCCTG
```

-continued

```
 751 CTGTCAGGCG CGATTTCATT TGATTCGCCG AAAACCAAAA ACAGTAAAAA
 801 CGTCAAAAGC GAGGACAGCT TCACGCTTTA CGACAGCCGC AGCGAAATCG
 851 CCAACCTGCC TGACGACCGC TCGCTGTACT ACACCGCGTT TTTCAAACAA
 901 TCCGTGCGCG GACTGACCGT cggTTCGCCT GTcgaATACA AAGGGCtgaA
 951 TGTcggCATG GTTTCCGATG TCCCTTATTT TGACCGCAAt gacagCCTGC
1001 ACCtgtTTGA aaacggctgg aTTcccGtac gCATCCGCAT cgagccTTCC

1051 CGTTTGGAAA TCAATGCCGA CGAGCAAAGC AAAGAGCATT GGAAACAACA

1101 ATTCCAGACG GCCTTAAACA AAGGCCTGAC CGCCACCATC TCCAGCAACA

1151 ACCTGCTGAC CGGCGGCAAA ATGATTGAGT TGAACGATCA GCCTTCCGCC

1201 TCGCCCAAGC TGCGACCGCA TACCGTTTAT GCAGGCGATA CCGTCATCGC

1251 CACACGGGGC GGCGGTTTGG ATGACTTGCA GGTCAAATTG GCGGATTTGC

1301 TGGACaaatT CAACAATCTG CCATTggata aAACCGTTGC CGAATTGAAC

1351 GGCTCGCTCG CCGAACTCAA GTCCGCACTC AAATCCGCCA ATGCCGCCCT
1401 AAGCTCCATT GacaAACTGG TCGgcaaTCC GCAGACGCAA AACATCCCGA
1451 ACGAACTGAA CCAAACTCTG AAAGAGTTGC GCATAACCCT GCAAGGCGTA
1501 TCGcctCAAT CGCCTATCTa cggGAgacgta caAAATAcgc tgCaAAGTTT
1551 GGACAAAACC TTAAAagacg TtcaACCCGT CATTAACACT TTGAaAGAAa
1601 aacCCaaCgc actGATTTtc aacaACAGCA GCAAAGAccc tATCCCGAAA
1651 GGAAGCCGAT AA
```

This corresponds to the amino acid sequence <SEQ IS 632; ORF 154.ng>:

```
g154.pep
   1 MTDNSPPPNG HAQARVRKNN TFLSAVWLVP LIALIAGGWL WVKEIRNRGP
  51 VVTLLMDSAE GIEVNNTVIK VLSIDVGRVT RIKLRDDQKG VEVTAQLNAD
 101 VSGLIRSDTQ FWVVKPRIDQ SGVTGLGTLL SGSYIAFTPG KSGEAKDVFQ
 151 VQDIPPVTAI GQSGLRLNLI GKNDRILNVN SPVLYENFMV GQIESAHFDP
 201 SDQSVHYTIF IQSPNDKLIH SASRFWLESG INIETTGSGI KLNSAPLPAL
 251 LSGAISFDSP KTKNSKNVKS EDSFTLYDSR SEIANLPDDR SLYYTAFFKQ
 301 SVRGLTVGSP VEYKGLNVGM VSDVPYFDRN DSLHLFENGW IPVRIRIEPS
 351 RLEINADEQS KEHWKQQFQT ALNKGLTATI SSNNLLTGGK MIELNDQPSA
 401 SPKLRPHTVY AGDTVIATRG GGLDDLQVKL ADLLDKFNNL PLDKTVAELN
 451 GSLAELKSAL KSANAALSSI DKLVGNPQTQ NIPNELNQTL KELRITLQGV
 501 SPQSPIYGDV QNTLQSLDKT LKDVQPVINT LKEKPNALIF NNSSKDPIPK
 551 GSR*
```

The following partial DNA sequence was identified in *N. meningitidis* <SEQ ID 633>:

```
m154.seq
   1 ATGACTGACA ACAGCCCTCC TCCAAACGGA CACGCCCAAG CACGCGTCCG
  51 CAAAAACAAC ACCTTCCTCT CTGCCGTCTG GCTGGTTCCG CTGATCGCGC
 101 TGATTGCCGG CGGCTGGCTT TGGGTTAAGG AAATCCGCAA CAGGGGGCCT
```

-continued

```
 151 GTGGTTACGC TCTTGATGGA CAGCGCGGAA GGCATTGAGG TCAACAATAC
 201 GGTCATCAAA GTATTGAGCA TCGATGTCGG ACGCGTTACC CGAATCAAAC
 251 TGCGCGACGA CCAAAAAGGC GTGGAAGTAA CCGCCCAACT CAATGCGGAC
 301 GTATCCGGCC TCATCCGCAG CGATACCCAG TTTTGGGTGG TCAAGCCGCG
 351 TATCGACCAA AGCGGCGTAA CCGGTTTGGG TACGCTGCTT TCGGGTTCGT
 401 ACATCGCCTT TACACCCGGC AAAAGCGACG AGGCAAAAGA CGTGTTCCAA
 451 GTGCAGGACA TTCCGCCCGT TACCGCCATC GGGCAAAGCG GGCTGCGCTT
 501 GAATTTGATT GGTAAAAACG ACCGCATCCT CAACGTCAAC AGCCCTGTTT
 551 TGTATGAAAA TTTTATGGTC GGGCAAGTCG AAAGCGCGCA TTTCGACCCG
 601 TCCGACCAAA GCGTGCATTA CCACCATCTTC ATCCAAAGCC CCAACGACAA
 651 ACTGATTCAT TCCGCCAGCC GTTTTTGGCT GGAAAGCGGC ATCAATATCG
 701 AAACCACAGG CAGCGGCATC AAACTCAATT CCGCCCCTCT GCCTGCCCTG
 751 CTGTCGGGCG CGATTTCATT TGATTCGCCG AAAACCAAAA ACAGTAAAAA
 801 CGTCAAAAGC GAAGACAGCT TCACGCTTTA CGACAGCCGC AGCGAAGTCG
 851 CCAACCTGCC TGACGACCGC TCGCTGTACT ACACCGCGTT TTTCAAACAA
 901 TCCGTGCGCG GCCTGACCGT CGGTTCGCCC GTCGAGTACA AAGGGCTGAA
 951 TGTCGGCGTG GTTTCCGACG TTCCTTATTT CGACCGCAAC GACAGCCTGC
1001 ACCTGTTTGA AAACGGCTGG ATACCCGTAC GCATCCGCAT TGAACCTTCC
1051 CGTTTGGAAA TCAATGCCGA CGAACAAAGC AAAGAACATT GGAAACAACA
1101 ATTTCAGACG GCCTTAAACA AAGGCCTGAC CGCCACCATC TCCAGCAACA
1151 ACCTGCTGAC CGGAAGCAAA ATGATTGAGT TGAACGATCA GCCTTCCGCA
1201 TCACCTAAGC TGCGACCGCA TACCGTTTAT GCAGGCGATA CCGTTATCGC
1251 GACCCAGGGC GGCGGTTTGG ACGATTTGCA GGTCAAATTG GCGGATTTGC
1301 TGGACAAGTT CGACAAACTG CCTTTAGATA AGACGGTTGC CGAATTGAAC
1351 GGTTCGCTTG CCGAGCTCAA ATCCACACTC AAATCTGCCA ATGCCGCCCT
1401 AAGCTCCATC GACAAACTGG TCGGCAAACC GCAGACACAA ACATTCCGA
1451 ACGAACTGAA CCAAACCCTG AAAGAGTTGC GCACAACCCT GCAAGGCGTA
1501 TCGCCGCAAT CGCCTATCTA CGGCGACGTA CAAAATACGC TGCAAAGTTT
1551 GGACAAAACT TTAAAAGACG TTCAACCCGT GATTAATACT TTGAAAGAAA
1601 AACCCAACGC GCTGATTTTC AACAGCAGCA GCAAAGACCC TATCCCGAAA
1651 GGAAGCCGAT AA
```

This corresponds to the amino acid sequence <SEQ ID 634 ORF 154.a>:

```
m154.pep

1 MTDNSPPPNG HAQARVRKNN TFLSAVWLVP LIALIAGGWL WVKEIRNRGP
 51 VVTLLMDSAE GIEVNNTVIK VLSIDVGRVT RIKLRDDQKG VEVTAQLNAD
101 VSGLIRSDTQ FWVVKPRIDQ SGVTGLGTLL SGSYIAFTPG KSDEAKDVFQ
151 VQDIPPVTAI GQSGLRLNLI GKNDRILNVN SPVLYENFMV GQVESAHFDP
201 SDQSVHYTIF IQSPNDKLIH SASRFWLESG INIETTGSGI KLNSAPLPAL
```

-continued

```
    251 LSGAISFDSP KTKNSKNVKS EDSFTLYDSR SEVANLPDDR SLYYTAFFKQ

301 SVRGLTVGSP VEYKGLNVGV VSDVPYFDRN DSLHLFENGW IPVRIRIEPS

351 RLEINADEQS KEHWKQQFQT ALNKGLTATI SSNNLLTGSK MIELNDQPSA

401 SPKLRPHTVY AGDTVIATQG GGLDDLQVKL ADLLDKFDKL PLDKTVAELN

451 GSLAELKSTL KSANAALSSI DKLVGKPQTQ NIPNELNQTL KELRTTLQGV

501 SPQSPIYGDV QNTLQSLDKT LKDVQPVINT LKEKPNALIF NSSSKDPIPK

551 GSR* m154/g154 97.8% identity in 553 aa overlap 10         20         30         40         50         60
m154.pep MTDNSPPPNGHAQARVRKNNTFLSAVWLVPLIALIAGGWLWVKEIRNRGPVVTLLMDSAE
         ||||||||||||||||||||||||||||||||||||||||||||||||||||||||||||
g154     MTDNSPPPNGHAQARVRKNNTFLSAVWLVPLIALIAGGWLWVKEIRNRGPVVTLLMDSAE
                 10         20         30         40         50         60
                 70         80         90        100        110        120
m154.pep GIEVNNTVIKVLSIDVGRVTRIKLRDDQKGVEVTAQLNADVSGLIRSDTQFWVVKPRIDQ
         ||||||||||||||||||||||||||||||||||||||||||||||||||||||||||||
g154     GIEVNNTVIKVLSIDVGRVTRIKLRDDQKGVEVTAQLNADVSGLIRSDTQFWVVKPRIDQ
                 70         80         90        100        110        120
                130        140        150        160        170        180
m154.pep SGVTGLGTLLSGSYIAFTPGKSDEAKDVFQVQDIPPVTAIGQSGLRLNLIGKNDRILNVN
         |||||||||||||||||||||||||| |||||||||||||||||||||||||||||||||
g154     SGVTGLGTLLSGSYIAFTPGKSGEAKDVFQVQDIPPVTAIGQSGLRLNLIGKNDRILNVN
                130        140        150        160        170        180
                190        200        210        220        230        240
m154.pep SPVLYENFMVGQVESAHFDPSDQSVHYTIFIQSPNDKLIHSASRFWLESGINIETTGSGI
         |||||||||||| :||||||||||||||||||||||||||||||||||||||||||||||
g154     SPVLYENFMVGQIESAHFDPSDQSVHYTIFIQSPNDKLIHSASRFWLESGINIETTGSGI
                190        200        210        220        230        240
                250        260        270        280        290        300
m154.pep KLNSAPLPALLSGAISFDSPKTKNSKNVKSEDSFTLYDSRSEVANLPDDRSLYYTAFFKQ
         ||||||||||||||||||||||||||||||||||||||||||:|||||||||||||||||
g154     KLNSAPLPALLSGAISFDSPKTKNSKNVKSEDSFTLYDSRSEIANLPDDRSLYYTAFFKQ
                250        260        270        280        290        300
                310        320        330        340        350        360
m154.pep SVRGLTVGSPVEYKGLNVGVVSDVPYFDRNDSLHLFENGWIPVRIRIEPSRLEINADEQS
         |||||||||||||||||||| :||||||||||||||||||||||||||||||||||||||
g154     SVRGLTVGSPVEYKGLNVGMVSDVPYFDRNDSLHLFENGWIPVRIRIEPSRLEINADEQS
                310        320        330        340        350        360
                370        380        390        400        410        420
m154.pep KEHWKQQFQTALNKGLTATISSNNLLTGSKMIELNDQPSASPKLRPHTVYAGDTVIATQG
         ||||||||||||||||||||||||||||| |||||||||||||||||||||||||||| |
g154     KEHWKQQFQTALNKGLTATISSNNLLTGGKMIELNDQPSASPKLRPHTVYAGDTVIATRG
                370        380        390        400        410        420
                430        440        450        460        470        480
m154.pep GGLDDLQVKLADLLDKFDKLPLDKTVAELNGSLAELKSTLKSANAALSSIDKLVGKPQTQ
         ||||||||||||||||::|||||||||||||||||||:|||||||||||||||||:||||
g154     GGLDDLQVKLADLLDKFNNLPLDKTVAELNGSLAELKSALKSANAALSSIDKLVGNPQTQ
                430        440        450        460        470        480
                490        500        510        520        530        540
m154.pep NIPNELNQTLKELRTTLQGVSPQSPIYGDVQNTLQSLDKTLKDVQPVINTLKEKPNALIF
         |||||||||||||| |||||||||||||||||||||||||||||||||||||||||||||
g154     NIPNELNQTLKELRITLQGVSPQSPIYGDVQNTLQSLDKTLKDVQPVINTLKEKPNALIF
                490        500        510        520        530        540
                550
m154.pep NSSSKDPIPKGSRX
         |:||||||||||||
g154     NNSSKDPIPKGSRX
                550
```

The following partial DNA sequence was identified in *N. meningitidis* <SEQ ID 635>:

```
a154.seq
    1 ATGACTGACA ACAGCCCTCC TCCAAACGGA CACGCCCAAG CACGCGTCCG

51 CAAAACAAC ACCTTCCTCT CTGCCGTCTG GCTGGTTCCG CTGATCGCGC

101 TGATTGCCGG CGGCTGGCTT TGGGTTAAGG AAATCCGCAA CAGGGGGCCT

151 GTGGTTACGC TCTTGATGGA CAGCGCGGAA GGCATTGAGG TCAACAATAC
```

-continued

```
 201 GGTCATCAAA GTATTGAGCA TCGATGTCGG ACGCGTTACC CGAATCAAAC
 251 TGCGCGACGA CCAAAAAGGC GTGGAAGTAA CCGCCCAACT CAATGCGGAC
 301 GTATCCGGCC TCATCCGCAG CGATACCCAG TTTTGGGTGG TCAAGCCGCG
 351 TATCGACCAA AGCGGCGTAA CCGGTTTGGG TACGCTGCTT TCGGGTTCGT
 401 ACATCGCCTT TACACCCGGC AAAAGCGACG AGGCAAAAGA CGTGTTCCAA
 451 GTGCAGGACA TTCCGCCCGT TACCGCCATC GGGCAAAGCG GGCTGCGCTT
 501 GAATTTGATT GGTAAAAACG ACCGCATCCT CAACGTCAAC AGCCCTGTTT
 551 TGTATGAAAA CTTTATGGTC GGGCAAGTCG AAAGCGCGCA TTTCGACCCG
 601 TCCGACCAAA GCGTGCATTA CACCATCTTC ATCCAAAGCC CAACGACAA
 651 ACTGATTCAT TCCGCCAGCC GTTTCTGGCT GGAAAGCGGC ATCAATATCG
 701 AAACCACAGG CAGCGGCATC AAACTCAATT CCGCCCCTCT GCCTGCCCTG
 751 CTGTCGGGCG CGATTTCATT TGATTCGCCG AAAACCAAAA ACAGTAAAAA
 801 CGTCAAAAGC GAAGACAGCT TCACGCTTTA CGACAGCCGC AGCGAAGTCG
 851 CCAACCTGCC TGATGACCGT TCGCTGTACT ACACCGCGTT TTTCAAACAA
 901 TCCGTGCGCG GACTGACCGT CGGTTCGCCT GTCGAGTACA AAGGGCTGAA
 951 TGTCGGCGTG GTTTCCGATG TTCCTTATTT CGACCGCAAC GACAGCCTGC
1001 ACCTGTTTGA AAACGGCTGG ATTCCCGTAC GCATCCGTAT TGAGCCTTCC
1051 CGTTTGGAAA TCAATGCCGA CGAACAAAGC AAAGAACATT GGAAACAACA
1101 ATTTCAGACG GCCTTAAACA AAGGCCTGAC CGCCACCATC TCCAGCAACA
1151 ACCTGCTGAC CGGCAGCAAA ATGATTGAGT TGAACGATCA GCCTTCCGCC
1201 TCGCCCAAGC TGCGACCGCA TACCGTTTAT GCAGGCGATA CCGTTATCGC
1251 GACCCAGGGC GGCGGTTTGG ACGATTTGCA GGTCAAATTG GCGGATTTGC
1301 TGGACAAGTT CGACAAACTG CCTTTAGATA AGACGGTTGC CGAATTGAAC
1351 GGTTCGCTTG CCGAGCTCAA ATCCACACTC AAATCTGCCA ATGCCGCCCT
1401 AAGCTCCATC GACAAACTGG TCGGCAAACC GCAGACACAA AACATTCCGA
1451 ACGAACTGAA CCAAACCCTG AAAGAGTTGC GCACAACCCT GCAAGGCGTA
1501 TCGCCTCAAT CGCCTATCTA CGGCGACGTA CAAAATACGC TGCAAAGTTT
1551 GGACAAAACC TTAAAAGACG TTCAACCCGT CATTAACACT TTGAAAGAAA
1601 AACCCAACGC GCTGATTTTC AACAGCAGCA GCAAAGACCC TATCCCGAAA
1651 GGAAGCCGAT AA
```

This corresponds to the amino acid sequence <SEQ ID 636; ORF 154.a>:

```
a154.pep
   1 MTDNSPPPNG HAQARVRKNN TFLSAVWLVP LIALIAGGWL WVKEIRNRGP

51 VVTLLMDSAE GIEVNNTVIK VLSIDVGRVT RIKLRDDQKG VEVTAQLNAD

101 VSGLIRSDTQ FWVVKPRIDQ SGVTGLGTLL SGSYIAFTPG KSDEAKDVFQ

151 VQDIPPVTAI GQSGLRLNLI GKNDRILNVN SPVLYENFMV GQVESAHFDP

201 SDQSVHYTIF IQSPNDKLIH SASRFWLESG INIETTGSGI KLNSAPLPAL

251 LSGAISFDSP KTKNSKNVKS EDSFTLYDSR SEVANLPDDR SLYYTAFFKQ

301 SVRGLTVGSP VEYKGLNVGV VSDVPYFDRN DSLHLFENGW IPVRIRIEPS
```

-continued

```
351  RLEINADEQS KEHWKQQFQT ALNKGLTATI SSNNLLTGSK MIELNDQPSA

401  SPKLRPHTVY AGDTVIATQG GGLDDLQVKL ADLLDKFDKL PLDKTVAELN

451  GSLAELKSTL KSANAALSSI DKLVGKPQTQ NIPNELNQTL KELRTTLQGV

501  SPQSPIYGDV QNTLQSLDKT LKDVQPVINT LKEKPNALIF NSSSKDPIPK

551  GSR*
``` m154/a154 100.0% identity in 553 aa overlap

```
                  10         20         30         40         50         60
m154.pep  MTDNSPPPNGHAQARVRKNNTFLSAVWLVPLIALIAGGWLWVKEIRNRGPVVTLLMDSAE
          ||||||||||||||||||||||||||||||||||||||||||||||||||||||||||||
a154      MTDNSPPPNGHAQARVRKNNTFLSAVWLVPLIALIAGGWLWVKEIRNRGPVVTLLMDSAE
                  10         20         30         40         50         60

70         80         90        100        110        120
m154.pep  GIEVNNTVIKVLSIDVGRVTRIKLRDDQKGVEVTAQLNADVSGLIRSDTQFWVVKPRIDQ
          ||||||||||||||||||||||||||||||||||||||||||||||||||||||||||||
a154      GIEVNNTVIKVLSIDVGRVTRIKLRDDQKGVEVTAQLNADVSGLIRSDTQFWVVKPRIDQ
                  70         80         90        100        110        120

130        140        150        160        170        180
m154.pep  SGVTGLGTLLSGSYIAFTPGKSDEAKDVFQVQDIPPVTAIGQSGLRLNLIGKNDRILNVN
          ||||||||||||||||||||||||||||||||||||||||||||||||||||||||||||
a154      SGVTGLGTLLSGSYIAFTPGKSDEAKDVFQVQDIPPVTAIGQSGLRLNLIGKNDRILNVN
                 130        140        150        160        170        180

190        200        210        220        230        240
m154.pep  SPVLYENFMVGQVESAHFDPSDQSVHYTIFIQSPNDKLIHSASRFWLESGINIETTGSGI
          ||||||||||||||||||||||||||||||||||||||||||||||||||||||||||||
a154      SPVLYENFMVGQVESAHFDPSDQSVHYTIFIQSPNDKLIHSASRFWLESGINIETTGSGI
                 190        200        210        220        230        240

250        260        270        280        290        300
m154.pep  KLNSAPLPALLSGAISFDSPKTKNSKNVKSEDSFTLYDSRSEVANLPDDRSLYYTAFFKQ
          ||||||||||||||||||||||||||||||||||||||||||||||||||||||||||||
a154      KLNSAPLPALLSGAISFDSPKTKNSKNVKSEDSFTLYDSRSEVANLPDDRSLYYTAFFKQ
                 250        260        270        280        290        300

310        320        330        340        350        360
m154.pep  SVRGLTVGSPVEYKGLNVGVVSDVPYFDRNDSLHLFENGWIPVRIRIEPSRLEINADEQS
          ||||||||||||||||||||||||||||||||||||||||||||||||||||||||||||
a154      SVRGLTVGSPVEYKGLNVGVVSDVPYFDRNDSLHLFENGWIPVRIRIEPSRLEINADEQS
                 310        320        330        340        350        360

370        380        390        400        410        420
m154.pep  KEHWKQQFQTALNKGLTATISSNNLLTGSKMIELNDQPSASPKLRPHTVYAGDTVIATQG
          ||||||||||||||||||||||||||||||||||||||||||||||||||||||||||||
a154      KEHWKQQFQTALNKGLTATISSNNLLTGSKMIELNDQPSASPKLRPHTVYAGDTVIATQG
                 370        380        390        400        410        420

430        440        450        460        470        480
m154.pep  GGLDDLQVKLADLLDKFDKLPLDKTVAELNGSLAELKSTLKSANAALSSIDKLVGKPQTQ
          ||||||||||||||||||||||||||||||||||||||||||||||||||||||||||||
a154      GGLDDLQVKLADLLDKFDKLPLDKTVAELNGSLAELKSTLKSANAALSSIDKLVGKPQTQ
                 430        440        450        460        470        480

490        500        510        520        530        540
m154.pep  NIPNELNQTLKELRTTLQGVSPQSPIYGDVQNTLQSLDKTLKDVQPVINTLKEKPNALIF
          ||||||||||||||||||||||||||||||||||||||||||||||||||||||||||||
a154      NIPNELNQTLKELRTTLQGVSPQSPIYGDVQNTLQSLDKTLKDVQPVINTLKEKPNALIF
                 490        500        510        520        530        540

550
m154.pep  NSSSKDPIPKGSRX
          ||||||||||||||
a154      NSSSKDPIPKGSRX
                 550
```

The following partial DNA sequence was identified in *N. gonorrhoeae* <SEQ ID 637>:

```
g155.seq
   1  atGAAaatcg GtatcCCACG CGAGTCAtta tcCGGCGAAA cccgcgtagc 51  ctgcAcgccc gCCACCGTTG CCctgctggg caAactAGGC TTTGAAACCG 101  TTGtcgaAAG CGGTGCAggt TTGGCGGCAA GTTTggaCGA TGCCGCTTAC
```

-continued
```
 151 CAAACAGCAG GCGCAACCGT TGCCGACAAA GCGGCGGTTT GGGCCTGCCC

201 TTTAATTTAT AAGGTCAACG CGCCGTCCGA AGGCGAGCTG CCGCTGCTCA

251 AAGAAGGTCA AACCATCGTC AGCTTCCTGT GGCCGCGCCA AAACGAGGCT

301 TTGGTCGAGG CCTTGCGCGC CAAGAAAGTC AACGCGCTGG CGATGGACAT

351 GGTTCCCCGC ATTTCCGCG CTCAGGCCTT GGACGCTTTG TCTTCAATGG

401 CAAACATCAG CGGCTACCGC GCCGTGATTG AAGCCGCCAA CGCCTTCGGC

451 CGTTTCTTCA CCGGTCAAAT CACTGCCGCC GGCAAAGTGC CGCCTGCGCA

501 GGTTTTGGTG ATTGGCGCCG GTGTGGCGGG TTTGGCGGCA ATCGGTACGG

551 CAAATTCGCT CGGCGCAGTG GTGCGCGCGT TCGATACCCG CTTGGAAGTG

601 GCGGAACAAA TCGAATCGAT GGGCGGTAAG TTcctGAAAC TCGACTTCCT

651 GCAAGAATCG GGCGGCAGCG GAGACGgctA CGCCAAAGTG ATGAGCGACG

701 AATTTATCGC CGCCGAAATG AAGCTCTTTG CCGAACAGGC GAAAGAAGTG

751 GACATCATCA TCACCACCGC CGCCATTCCG GGCAAACCCG CTCCCAAGCT

801 GATTACCAAA GAAATGGTGG AAAGCATGAA ATCCGGATCC GTCATCGTCG

851 ATTTGGCGGC GACGGGCGGC AACTGCGAAC TCACCCGACC GGGCGAATTG

901 TCCGTAACCG GCAACGGCGT GAAAATCATC GGCTACACCG ACATGGCAAA

951 CCGCCTTGCC GGACAGTCTT CCCAGCTTTA CGCCACCAAC TTGGTGAACC

1001 TGACCAAGCT GTTAAGCCCG AACAAAGAcg gcgaAATCAC GCTGGACTTC

1051 GAAGacgtGA TTATCCGCAA TATGACCGTT ACCCGcgacg gcgaaATCAC

1101 CTTCCCGCCT CCGccgaTTc aggtTTCcgc ccggccgCAG CAAAcgccgt 1151 ctgaAAAagc cgcGCCTGCC GCCAagcccg AgccGaaacc tgttCCcctg 1201 tggaAAAaac tcgCGCCCGC CGCcatcgCC GCCGTATTGG tgctgtgGgt 1251 cggCgcggtc gcacccgcag CATTCTTGAA CCACTTTATC GTCTTCGTCC 1301 TCGCCTGCGT CATCGGCTAC CATGTCGTTT GgaacgTCAG CCACTCGCTG 1351 CACACACCGC TGAtgtcggt aaccaaCgcc atctccGGCA tcatggtcgt 1401 cggCGCGCTG CTGCAAATCG GTCAGGGcaa cggcttcgtT TCgctGCTGT

1451 CGTTTGTTGC CATCCTGATT GCCGGCATCA ATATCTTCGG CGGCTTTGCG

1501 GTTACACGGC GTATGCTGAA TATGTTTAAG AAAGGGTAA
```

This corresponds to the amino acid sequence <SEQ ID 638; ORF 155.ng>:

g155.pep
```
   1 MKIGIPRESL SGETRVACTP ATVALLGKLG FETVVESGAG LAASLDDAAY

51 QTAGATVADK AAVWACPLIY KVNAPSEGEL PLLKEGQTIV SFLWPRQNEA

101 LVEALRAKKV NALAMDMVPR ISRAQALDAL SSMANISGYR AVIEAANAFG

151 RFFTGQITAA GKVPPAQVLV IGAGVAGLAA IGTANSLGAV VRAFDTRLEV

201 AEQIESMGGK FLKLDFLQES GGSGDYAKV MSDEFIAAEM KLFAEQAKEV

251 DIIITTAAIP GKPAPKLITK EMVESMKSGS VIVDLAATGG NCELTRPGEL

301 SVTGNGVKII GYTDMANRLA GQSSQLYATN LVNLTKLLSP NKDGEITLDF

351 EDVIIRNMTV TRDGEITFPP PIQVSARPQ QTPSEKAAPA AKPEPKPVPL

401 WKKLAPAAIA AVLVLWVGAV APAAFLNHFI VFVLACVIGY HVVWNVSHSL
```

```
451 HTPLMSVTNA ISGIMVVGAL LQIGQGNGFV SLLSFVAILI AGINIFGGFA

501 VTRRMLNMFK KG*
```

The following partial DNA sequence was identified in *N. meningitidis* <SEQ ID 639>:

```
m155.seq
   1 ATGAAAATCG GTATCCCACG CGAGTCATTA TCCGGCGAAA CCCGCGTCGC

51 CTGTACGCCC GCCACCGTCG CCCTGCTGGG CAAACTGGGC TTTGAAACCG

101 TTGTCGAAAG CGGTGCAGGT TTGGCGGCAA GTTTGGACGA TGCCGCTTAC

151 CAAACAGCAG GCGCAACCGT TGCCGACAAA GCGGCGGTTT GGGTCTGCCC

201 TTTGATTTAT AAGGTCAACG CGCCGTCCGA ACAGGAACTG CCGCTTTTGA

251 ACGAAGGTCA AACCATCGTC AGCTTCCTGT GGCCGCGCCA AAACGAGGCT

301 TTGGTCGAAG CCTTGCGCGC CAAGAAAGTG AACGCGCTGG CGATGGATAT

351 GGTGCCCCGC ATTTCGCGCG CGCAGGCTTT GGACGCTTTG TCTTCGATGG

401 CAAACATCAG CGGCTACCGC GCCGTAATTG AAGCCGCCAA CGCCTTCGGC

451 CGTTTCTTCA CCGGTCAAAT TACCGCCGCC GGCAAAGTGC CGCCCGCGCA

501 GGTTTTGGTG ATTGGTGCAG GTGTGGCAGG TTTGGCGGCG ATCGGTACGG

551 CAAACTCGCT CGGCGCAGTG GTACGCGCGT TCGATACCCG CTTGGAAGTG

601 GCGGAACAAA TCGAATCGAT GGGCGGCAAG TTCCTGAAAC TCGACTTCCC

651 ACAAGAATCG GCGGCAGCG GAGACGGCTA CGCCAAAGTG ATGAGCGACG

701 AATTTATCGC AGCCGAGATG AAGCTCTTTG CCGAGCAGGC GAAAGAAGTG

751 GACATCATCA TCACCACCGC CGCCATTCCG GGCAAACCCG CGCCCAAGCT

801 GATTACCAAA GAAATGGTGG AAAGCATGAA ATCCGGCTCC GTCATCGTCG

851 ATTTGGCGGC GGCGACGGGC GGCAACTGCG AACTCACCCG CCCGGGCGAA

901 TTGTCCGTAA CCGGCAACGG CGTGAAAATC ATCGGCTACA CCGACATGGC

951 AAACCGCCTT GCCGGACAGT CTTCCCAGCT TTACGCCACC AACTTGGTCA

1001 ACCTGACCAA GCTGTTAAGC CCGAACAAAG ACGGCGAAAT CACGTTGGAC

1051 TTCGAAGACG TGATTATCCG CAACATGACC GTTACCCACG ACGGCGAAAT

1101 CACCTTCCCG CCTCCGCCGA TTCAAGTTTC CGCCCAGCCG CAGCAAACGC

1151 CGTCTGAAAA AGCCGTGCCT GCCGCCAAGC CCGAGCCAAA ACCCGTTCCC

1201 CTGTGGAAAA AACTCGCGCC CGCCGTCATC GCCGCCGTCT TGGTACTGTG

1251 GGTCGGCGCG GTCGCACCCG CAGCATTCCT GAACCACTTT ATCGTGTTCG

1301 TTCTCGCCTG CGTCATCGGC TACTACGTCG TCTGGAACGT CAGCCACTCG

1351 CTGCACACAC CGCTGATGTC GGTAACCAAC GCCATCTCCG GCATCATCGT

1401 CGTCGGCGCG CTGCTGCAAA TCGGTCAGGG CAACGGCTTC GTTTCGCTGC

1451 TGTCGTTTGT TGCCATCCTG ATTGCCGGCA TCAACATCTT CGGCGGCTTT

1501 GCGGTAACAC GGCGTATGCT GAATATGTTT AAGAAAGGGT AA
```

This corresponds to the amino acid sequence <SEQ ID 640; ORF 155>:

```
m155.pep
   1 MKIGIPRESL SGETRVACTP ATVALLGKLG FETVVESGAG LAASLDDAAY

51 QTAGATVADK AAVWVCPLIY KVNAPSEQEL PLLNEGQTIV SFLWPRQNEA
```

```
101 LVEALRAKKV NALAMDMVPR ISRAQALDAL SSMANISGYR AVIEAANAFG

151 RFFTGQITAA GKVPPAQVLV IGAGVAGLAA IGTANSLGAV VRAFDTRLEV

201 AEQIESMGGK FLKLDFPQES GGSGDGYAKV MSDEFIAAEM KLFAEQAKEV

251 DIIITTAAIP GKPAPKLITK EMVESMKSGS VIVDLAAATG GNCELTRPGE

301 LSVTGNGVKI IGYTDMANRL AGQSSQLYAT NLVNLTKLLS PNKDGEITLD

351 FEDVIIRNMT VTHDGEITFP PPPIQVSAQP QQTPSEKAVP AAKPEPKPVP

401 LWKKLAPAVI AAVLVLWVGA VAPAAFLNHF IVFVLACVIG YYVVWNVSHS

451 LHTPLMSVTN AISGIIVVGA LLQIGQGNGF VSLLSFVAIL IAGINIFGGF

501 AVTRRMLNMF KKG*
```

Computer analysis of this amino acid sequence gave the following results:

Homology with a Predicted ORF from *N. gonorrhoeae*

ORF 155 shows 97.9% identity over a 513 aa overlap with a predicted ORF (ORF 155.ng) from *N. gonorrhoeae*:

```
    m155/g155 97.9% identity in 513 aa overlap 10        20        30        40        50        60
m155.pep  MKIGIPRESLSGETRVACTPATVALLGKLGFETVVESGAGLAASLDDAAYQTAGATVADK
          ||||||||||||||||||||||||||||||||||||||||||||||||||||||||||||
g155      MKIGIPRESLSGETRVACTPATVALLGKLGFETVVESGAGLAASLDDAAYQTAGATVADK
                  10        20        30        40        50        60

70        80        90       100       110       120
m155.pep  AAVWVCPLIYKVNAPSEQELPLLNEGQTIVSFLWPRQNEALVEALRAKKVNALAMDMVPR
          ||||:||||||||||||| |||||:|||||||||||||||||||||||||||||||||||
g155      AAVWACPLIYKVNAPSEGELPLLKEGQTIVSFLWPRQNEALVEALRAKKVNALAMDMVPR
                  70        80        90       100       110       120

130       140       150       160       170       180
m155.pep  ISRAQALDALSSMANISGYRAVIEAANAFGRFFTGQITAAGKVPPAQVLVIGAGVAGLAA
          ||||||||||||||||||||||||||||||||||||||||||||||||||||||||||||
g155      ISRAQALDALSSMANISGYRAVIEAANAFGRFFTGQITAAGKVPPAQVLVIGAGVAGLAA
                 130       140       150       160       170       180

190       200       210       220       230       240
m155.pep  IGTANSLGAVVRAFDTRLEVAEQIESMGGKFLKLDFPQESGGSGDGYAKVMSDEFIAAEM
          ||||||||||||||||||||||||||||||||||||| ||||||||||||||||||||||
g155      IGTANSLGAVVRAFDTRLEVAEQIESMGGKFLKLDFLQESGGSGDGYAKVMSDEFIAAEM
                 190       200       210       220       230       240

250       260       270       280       290       300
m155.pep  KLFAEQAKEVDIIITTAAIPGKPAPKLITKEMVESMKSGSVIVDLAAATGGNCELTRPGE
          |||||||||||||||||||||||||||||||||||||||||||||| |||||||||||||
g155      KLFAEQAKEVDIIITTAAIPGKPAPKLITKEMVESMKSGSVIVDLAA-TGGNCELTRPGE
                 250       260       270       280       290

310       320       330       340       350       360
m155.pep  LSVTGNGVKIIGYTDMANRLAGQSSQLYATNLVNLTKLLSPNKDGEITLDFEDVIIRNMT
          |||||||||||||||||||||||||||||||||||:||||||||||||||||||||||||
g155      LSVTGNGVKIIGYTDMANRLAGQSSQLYATNLVLLTKLLSPNKDGEITLDFEDVIIRNMT
                300       310       320       330       340       350

370       380       390       400       410       420
m155.pep  VTHDGEITFPPPPIQVSAQPQQTPSEKAVPAAKPEPKPVPLWKKLAPAVIAAVLVLWVGA
          ||:|||||||||||||||:|||||||||:|||||||||||||||||||||:|||||||||
g155      VTRDGEITFPPPPIQVSARPQQTPSEKAAPAAKPEPKPVPLWKKLAPAAIAAVLVLWVGA
                 360       370       380       390       400       410

430       440       450       460       470       480
m155.pep  VAPAAFLNHFIVFVLACVIGYYVVWNVSHSLHTPLMSVTNAISGIIVVGALLQIGQGNGF
          |||||||||||||||||||||:||||||||||||||||||||||:|||||||||||||||
g155      VAPAAFLNHFIVFVLACVIGYHVVWNVSHSLHTPLMSVTNAISGIMVVGALLQIGQGNGF
                 420       430       440       450       460       470

490       500       510
m155.pep  VSLLSFVAILIAGINIFGGFAVTRRMLNMFKKGX
          ||||||||||||||||||||||||||||||||||
g155      VSLLSFVAILIAGINIFGGFAVTRRMLNMFKKGX
                 480       490       500       510
```

The following partial DNA sequence was identified in *N. meningitidis* <SEQ ID 641>:

```
a155.seq
   1  ATGAAAATCG GTATCCCACG TGAGTCATTA TCCGGCGAAA CCCGCGTCGC
  51  CTGTACGCCC GCCACCGTCG CCCTGCTGGG CAAACTGGGC TTTGAAACCG
 101  TTGTCGAAAG CGGCGCAGGT TTGGCGGCAA GTTTGGACGA TGCCGCTTAC
 151  CAAGCAGCAG GCGCAACCGT TGCCGACAAA GCAGCGGTTT GGGCATACCC
 201  TTTAATTTAT AAGGTTAACG CGCCGTCCGA AGACGAGCTG CCGCTGCTCA
 251  AAGAAGGACA GACCATCGTC AGCTTCCTGT GGCCGCGCCA AAACGAGGCT
 301  TTGGTCGAAG CCTTGCGCGC CAAGAAAGTG AACGCGCTGG CAATGGACAT
 351  GGTGCCCCGC ATTTCGCGCG CGCAGGCTTT GGACGNTTTG TCTTNGATGG
 401  CAAACATCAG CGGCTACCGC GCCGTGATTG AAGCCGCCAA CGCCTTCGGC
 451  CGTTTNTTCA CCGGCCAAAT TACTGCCGCA GGCAAAGTGC CGCCCGCGCA
 501  GGTTTTGGTG ATTGGTGCAG GTGTGGCAGG TTTGGCGGCG ATCGGTACGG
 551  CAAACTCGCT CGGCGCAGTG GTACGCGTGT TCGATACCCG CCTG.AAGTG
 601  GCGGAACAAT TAGAATCGAT GGGCGGCAAG TTCCTGAAAC TCGACTTCCC
 651  GCAAGAATCG GGCGGCAGCG GCGACGGCTA CGCCAAAGTG ATGAGCGACG
 701  AATTTATCGC CGCCGAGATG AAGCTTTTTG CCGAGCAGGC GAAAGAAGTG
 751  GACATCATCA TCACCACCGC CGCCATTCCG GGCAAACCCG CGCCCAAGCN
 801  NNTNANCAAA GAAATGGTCG AAAGCATGAA ACCCGGCTCC GTCATCGTCG
 851  ATTTGGCGGC GGCGACGGGC GGCAACTGCG AACTCACCAA ACAGGGCGAA
 901  TTGTTCGTAA CCGGCAACGG CGTGAAAATC ATCGGCTACA CCGACATGGC
 951  AAACCGCCTT GCCGGACAGT CTTCGCAGCT TTACGCCACC AACTTGGTCA
1001  ACCTGACCAA GCTGTTAAGC CCGAACAAAG ACGGCGAAAT CACGCTGGAC
1051  TTCGAAGACG TGATTATCCG CAACATGACC GTTACCCGCG ACGGCGAAAT
1101  CACCTTCCCG CCTCCGCCGA TTCAAGTTTC CGCCCAACCG CAGCAAACGC
1151  CGTCTGAAAA AGCCGCGCCT GCCGCCAAGC CCGAACCGAA ACCCGTTCCC
1201  CTGTGGAAAA AACTCGCGCC CGCCNTNATC GCCGCCGTGT TGGTACTGTG
1251  GGTCGGCGCG GTCGCACCCG CAGCATTCCT GAACCACTTT ATCGTCTTCG
1301  TCCTCGCCTG CGTCATCGGC TACTATGTCG TTTGGAACGT CAGCCACTCG
1351  CTGCACACAC CGCTGATGTC GGTGACCAAC GCCATTTCCG GCATCATCGT
1401  CGTCGGCGCG CTGCTGCAAA TCGGTCAGGG CAACGGCTTC GTTTCGCTGC
1451  TGTCGTTTGT TGCCATCCTG ATTGCCAGCA TCAACATCTT CGGCGGCTTC
1501  TTTGTAACGC GGCGGATGCT GAATATGTTT AGGAAAGGGT AA
```

This corresponds to the amino acid sequence <SEQ ID 642; ORF 155.a>:

```
a155.pep
  1  MKIGIPRESL SGETRVACTP ATVALLGKLG FETVVESGAG LAASLDDAAY
 51  QAAGATVADK AAVWAYPLIY KVNAPSEDEL PLLKEGQTIV SFLWPRQNEA
101  LVEALRAKKV NALAMDMVPR ISRAQALDXL SXMANISGYR AVIEAANAFG
151  RXFTGQITAA GKVPPAQVLV IGAGVAGLAA IGTANSLGAV VRVFDTRLXV
```

```
201 AEQLESMCCK FLKLDFPQES CCSCDCYAKV MSDEFIAAEM KLFAEQAKEV

251 DIIITTAAIP GKPAPKXXXK EMVESMKPGS VIVDLAAATG GNCELTKQGE

301 LFVTGNGVKI IGYTDMANRL AGQSSQLYAT NLVNLTKLLS PNKDGEITLD

351 FEDVIIRNMT VTRDGEITFP PPPIQVSAQP QQTPSEKAAP AAKPEPKPVP

401 LWKKLAPAXI AAVLVLWVGA VAPAAFLNHF IVFVLACVIG YYVVWNVSHS

451 LHTPLMSVTN AISGIIVVGA LLQIGQGNGF VSLLSFVAIL IASINIFGGF

501 FVTRRMLNMF RKG* m155/a155 95.3% identity in 513 aa overlap 10         20         30         40         50         60
m155.pep  MKIGIPRESLSGETRVACTPATVALLGKLGFETVVESGAGLAASLDDAAYQTAGATVADK
          |||||||||||||||||||||||||||||||||||||||||||||||| :|||||||||
a155      MKIGIPRESLSGETRVACTPATVALLGKLGFETVVESGAGLAASLDDAAYQAAGATVADK
                10         20         30         40         50         60

70         80         90        100        110        120
m155.pep  AAVWVCPLIYKVNAPSEQELPLLNEGQTIVSFLWPRQNEALVEALRAKKVNALAMDMVPR
          ||||: |||||||||||:|||||:||||||||||||||||||||||||||||||||||||
a155      AAVWAYPLIYKVNAPSEDELPLLKEGQTIVSFLWPRQNEALVEALRAKKVNALAMDMVPR
                70         80         90        100        110        120

130        140        150        160        170        180
m155.pep  ISRAQALDALSSMANISGYRAVIEAANAFGRFFTGQITAAGKVPPAQVLVIGAGVAGLAA
          |||||||| || |||||||||||||||||| ||||||||||||||||||||||||||||
a155      ISRAQALDXLSXMANISGYRAVIEAANAFGRXFTGQITAAGKVPPAQVLVIGAGVAGLAA
               130        140        150        160        170        180

190        200        210        220        230        240
m155.pep  IGTANSLGAVVRAFDTRLEVAEQIESMGGKFLKLDFPQESGGSGDGYAKVMSDEFIAAEM
          |||||||||||| ||||| |||||||||||||||||||||||||||||||||||||||
a155      IGTANSLGAVVRVFDTRLXVAEQIESMGGKFLKLDFPQESGGSGDGYAKVMSDEFIAAEM
               190        200        210        220        230        240

250        260        270        280        290        300
m155.pep  KLFAEQAKEVDIIITTAAIPGKPAPKLITKEMVESMKSGSVIVDLAAATGGNCELTRPGE
          |||||||||||||||||||||||||||   :||||||| |||||||||||||||: ||
a155      KLFAEQAKEVDIIITTAAIPGKPAPKXXXXKEMVESMKPGSVIVDLAAATGGNCELTKQGE
               250        260        270        280        290        300

310        320        330        340        350        360
m155.pep  LSVTGNGVKIIGYTDMANRLAGQSSQLYATNLVNLTKLLSPNKDGEITLDFEDVIIRNMT
          | ||||||||||||||||||||||||||||||||||||||||||||||||||||||||
a155      LFVTGNGVKIIGYTDMANRLAGQSSQLYATNLVNLTKLLSPNKDGEITLDFEDVIIRNMT
               310        320        330        340        350        360

370        380        390        400        410        420
m155.pep  VTHDGEITFPPPPIQVSAQPQQTPSEKAVPAAKPEPKPVPLWKKLAPAVIAAVLVLWVGA
          ||:|||||||||||||||||||||||||: |||||||||||||||||||| |||||||||
a155      VTRDGEITFPPPPIQVSAQPQQTPSEKAAPAAKPEPKPVPLWKKLAPAXIAAVLVLWVGA
               370        380        390        400        410        420

430        440        450        460        470        480
m155.pep  VAPAAFLNHFIVFVLACVIGYYVVWNVSHSLHTPLMSVTNAISGIIVVGALLQIGQGNGF
          ||||||||||||||||||||||||||||||||||||||||||||||||||||||||||
g155      VAPAAFLNHFIVFVLACVIGYYVVWNVSHSLHTPLMSVTNAISGIIVVGALLQIGQGNGF
               430        440        450        460        470        480

490        500        510
m155.pep  VSLLSFVAILIAGINIFGGFAVTRRMLNMFKKGX
          |||||||||||:|||||||| ||||||||||:|||
a155      VSLLSFVAILIASINIFGGFFVTRRMLNMFRKGX
               490        500        510
```

The following partial DNA sequence was identified in *N. gonorrhoeae* <SEQ ID 643>:

```
g156.seq
   1  ATGACTTTCG CCTATTGGTG CATTCTGATT GCCTGCCTAT TGCCGCTTTT

51  TTGTGCGGCG TATGCCAAAA AAGCGGGCGG ATTCCGGTTT AAAGACAACC

101  ACAATCCTCG CGGTTTTCTG GCACATACGC AAGGCGCAGC CGCCCGTGCC

151  CACGCCGCGC AGCAAAACGG TTTTGAAGCC TTTGCACCGT TGCCGCCGC

201  CGTTTTGACG GCACACGCAA CCGGCAATGC CGGACAAGCA ACCGTCAACA

251  CGCTTGCCGG ATTGTTCATC CTGTTCCGCC TCGCCTTTAT CTGGTGCTAC
```

-continued
```
301 ATCGCAGACA AAGCAGCATT GCGCTCGCTG ATGTGGGCGG GCGGATTTGC

351 CTGCACCGTC GGACTGTTTG TCGCGGCTGC TTGA
```

This corresponds to the amino acid sequence <SEQ ID 644; ORF 156.ng>:

```
g156.pep
    1 MTFAYWCILI ACLLPLFCAA YAKKAGGFRF KDNHNPRGFL AHTQGAAARA

51 HAAQQNGFEA FAPFAAAVLT AHATGNAGQA TVNTLAGLFI LFRLAFIWCY

101 IADKAALRSL MWAGGFACTV GLFVAAA*
```

The following partial DNA sequence was identified in *N. meningitidis* <SEQ ID 645>:

```
m156.seq.
    1 ATGACTTTCG CCTATTGGTG TATTCTGATT GCCTGCCTAT TGCCGCTTTT

51 TTGTGCGGCG TATGCCAAAA AAGCGGGCGG ATTCCGGTTT AAAGACAACC

101 ACAATCCGCG CGGTTTTCTA GCGCACACGC AAGGCGCAGC CGCCCGTGCC

151 CACGCCGCAC AGCAAAACGG TTTTGAAGCC TTTGCACCGT TTGCCGCCGC

201 CGTTTTGACG GCACACGCAA CCGGCAATGC GGCGCAATCG ACCATCAACA

251 CGCTTGCCTG CCTGTTCATC CTGTTCCGCC TCGCCTTTAT CTGGTGCTAT

301 ATCGCCGACA AAGCCGCTAT GCGCTCACTG ATGTGGGCAG GCGGATTTGC

351 CTGCACCGTC GGGCTGTTTG TCGCGGCTGC TTGA
```

This corresponds to the amino acid sequence <SEQ ID 646; ORF 156>:

```
m156.pep
    1 MTFAYWCILI ACLLPLFCAA YAKKAGGFRF KDNHNPRGFL AHTQGAAARA

51 HAAQQNGFEA FAPFAAAVLT AHATGNAAQS TINTLACLFI LFRLAFIWCY

101 IADKAAMRSL MWAGGFACTV GLFVAAA*
```

Computer analysis of this amino acid sequence gave the following results:
Homology with a Predicted ORF from *N. gonorrhoeae*

```
   m156/g156 96.1% identity in 127 aa overlap 10         20        30        40        50        60
    m156.pep MTFAYWCILIACLLPLFCAAYAKKAGGFRFKDNHNPRGFLAHTQGAAARAHAAQQNGFEA
             ||||||||||||||||||||||||||||||||||||||||||||||||||||||||||||
        g156 MTFAYWCILIACLLPLFCAAYAKKAGGFRFKDNHNPRGFLAHTQGAAARAHAAQQNGFEA
                   10         20        30        40        50        60

70         80        90       100       110       120
    m156.pep FAPFAAAVLTAHATGNAAQSTINTLACLFILFRLAFIWCYIADKAAMRSLMWAGGFACTV
             ||||||||||||||||:|:|:||| ||||||||||||||||||||||:|||||||||||
        g156 FAPFAAAVLTAHATGNAGQATVNTLAGLFILFRLAFIWCYIADKAALRSLMWAGGFACTV
                   70         80        90       100       110       120 m156.pep GLFVAAAX
             ||||||||
        g156 GLFVAAAX
```

The following partial DNA sequence was identified in *N. meningitidis* <SEQ ID 647>:

```
a156.seq
    1 ATGACTTTCG CCTATTGGTG TATTCTGATT GCCTACCTAT TGCCGCTTTT

51 TTGTGCGGCG TATGCCAAAA AAGCGGGCGG ATTCCGGTTT AAAGACAACC

101 ACAATCCGCG CGATTTTCTG GCGCGCACGC AAGGCACAGC CGCCCGTGCC

151 CACGCCGCGC AGCAAAACGG TTTTGAAGCC TTTGCACCGT TGCAGCCGC

201 CGTTTTGACG GCACACGCAA CCGGCAATGC CGGACAAGCA ACCGTCAACA

251 CGCTTGCCGG CCTGTTCATC CTGTTCCGCC TCGCCTTTAT CTGGTGCTAC

301 ATCGCAGACA AAGCAGCATT ACGCTCGCTG ATGTGGGTGG GCGGATTTGT

351 CTGCACCGTC GGGCTGTTTG TCGTGGCTGC TTGA
```

This corresponds to the amino acid sequence <SEQ ID 648; ORF 156.a>:

```
a156.pep
        1 MTFAYWCILI AYLLPLFCAA YAKKAGGFRF KDNHNPRDFL ARTQGTAARA

51 HAAQQNGFEA FAPFAAAVLT AHATGNAGQA TVNTLAGLFI LFRLAFIWCY

101 IADKAALRSL MWVGGFVCTV GLFVVAA* m156/a156 90.6% identity in 127 aa overlap 10        20        30        40        50        60
    m156.pep MTFAYWCILIACLLPLFCAAYAKKAGGFRFKDNHNPRGFLAHTQGAAARAHAAQQNGFEA
             ||||||||||   |||||||||||||||||||||||||| |||:|||:||||||||||||
    a156     MTFAYWCILIAYLLPLFCAAYAKKAGGFRFKDNHNPRDFLARTQGTAARAHAAQQNGFEA
                      10        20        30        40        50        60

70        80        90       100       110       120
    m156.pep FAPFAAAVLTAHATGNAAQSTINTLACLFILFRLAFIWCYIADKAAMRSLMWAGGFACTV
             |||||||||||||||||| :|:|:|||| ||||||||||||||||:||||:|||:|||
    a156     FAPFAAAVLTAHATGNAGQATVNTLAGLFILFRLAFIWCYIADKAALRSLMWVGGFVCTV
                      70        80        90       100       110       120 m156.pep GLFVAAAX
             ||||:|||
    a156     GLFVVAAX
```

The following partial DNA sequence was identified in *N. gonorrhoeae* <SEQ ID 649>:

```
g157.seq
    1 atgaggaacg aggAAAAACg cgccctgcgc cgcgaattgC gCgGgcggcg 51 ttcgcAAATg GGgcgagacg tGCGggCGGC GGCGgCgatA Aaaatcaacc 101 gcctgctcaa aCGTtatatc AAGCGCggtc gGaAaatcgG CGTGTATTgg 151 cCGATGGGCA AGGAATTGcg TTTGGGCGgc tTtgtcCGCG CGGCGCAAAA 201 ACGCgGCGCA AAactctatc tgccttATAT CGAACCGCAC ACGCGGCGGA

251 TGTGGTTTAC GCCGTATCCT GAACGCGGAA TGGAACGGGA ACGCAAGCGC

301 GGTAGGGCGA AGCTGCATGT CCCTCAGTTT GCAGGGCGCA AAATCCGCGT

351 GCACGGTTTG TCGGTATTGC TCGTCCCGCT TGTCGGCATA GACCGCGAAG

401 GCTACCGTTT GGGGCAGGCA GGCGGCTATT ACGATGCGAC GCTTTCGGCG

451 ATGAAATACC GTTTGCAGGC GAAAACCGTG GGCGTGGGCT TTGCCTGCCA

501 GTTGGTGGAC AGGCTCCCAC GCGAGGCGCA CGACCTGCCG CTGGACGGTT

551 TTGTATCGGA AGCGGGGATA TTGTGTTTTT AG
```

This corresponds to the amino acid sequence <SEQ ID 650; ORF 157.ng>:

```
g157.pep
    1 MRNEEKRALR RELRGRRSQM GRDVRAAAAI KINRLLKRYI KRGRKIGVYW

51 PMGKELRLGG FVRAAQKRGA KLYLPYIEPH TRRMWFTPYP ERGMERERKR

101 GRAKLHVPQF AGRKIRVHGL SVLLVPLVGI DREGYRLGQA GGYYDATLSA

151 MKYRLQAKTV GVGFACQLVD RLPREAHDLP LDGFVSEAGI LCF*
```

The following partial DNA sequence was identified in *N. meningitidis* <SEQ ID 651>:

```
m157.seq
    1 ATGAGGAACG AGGAAAAACG CGCCCTGCGC CGCGAATTGC GCGGGCGGCG

51 TTCGCAAATG GGGCGGGACG TGCGGGCGGC GGCAACGGTA AAAATCAACC

101 ACCTGCTCAA ACGTTATATT AAAAAAGGGC GGAAAATCGG CGTGTATTGG

151 CCGATGGGCA AGGAATTGCG TTTGGACGGC TTTGTCCGCG CGGCGCAAAA

201 ACGCGGTGCG GAACTCTACC TGCCTTATAT CGAACCGCGT TCGCGGCGGA

251 TGTGGTTTAC GCCGTATCCT GCCGATGGAG TAAAACAAGA ACGCAAGCGC

301 GGTAGGGCGA AGCTGCATGT CCCTCAGTTT GCAGGTCGGA AAAAGCGTGT

351 GCATGATTTG AACCTCCTGC TTGTGCCAGT GGTCGGTATG GACAGGCTGG

401 GCTACCGCTT GGGACAGGCA GGCGGCTATT ACGATGCGAC GCTTTCAGCG

451 ATGAAATACC GTTTGCAGGC AAAAACCGTG GGCGTGGGCT TTGCCTGCCA

501 GTTGGTGGAC AGGCTGCCGG TCGAGGCGCA CGACCGGTCT TTGGACGGTT

551 TTGTGTCGGA GGCGGGGATA TTGTGTTTTT AG
```

This corresponds to the amino acid sequence <SEQ ID 652; ORF 157>:

```
m157.pep
    1 MRNEEKRALR RELRGRRSQM GRDVRAAATV KINHLLKRYI KKGRKIGVYW

51 PMGKELRLDG FVRAAQKRGA ELYLPYIEPR SRRMWFTPYP ADGVKQERKR

101 GRAKLHVPQF AGRKKRVHDL NLLLVPVVGM DRLGYRLGQA GGYYDATLSA

151 MKYRLQAKTV GVGFACQLVD RLPVEAHDRS LDGFVSEAGI LCF*
```

Computer analysis of this amino acid sequence gave the following results:
Homology with a Predicted ORF from *N. gonorrhoeae*

```
    m157/g157 88.1% identity in 193 aa overlap 10         20         30         40         50         60
    m157.pep MRNEEKRALRRELRGRRSQMGRDVRAAATVKINHLLKRYIKKGRKIGVYWPMGKELRLDG
             ||||||||||||||||||||||||||||::|||:||||||:||||||||||||||||| |
    g157     MRNEEKRALRRELRGRRSQMGRDVRAAAAIKINRLLKRYIKRGRKIGVYWPMGKELRLGG
                  10         20         30         40         50         60

70         80         90        100        110        120
    m157.pep FVRAAQKRGAELYLPYIEPRSRRMWFTPYPADGVKQERKRGRAKLHVPQFAGRKKRVHDL
             ||||||||||:||||||||::|||||||||  |:::||||||||||||||||||| ||| |
    g157     FVRAAQKRGAKLYLPYIEPHTRRMWFTPYPERGMERERKRGRAKLHVPQFAGRKIRVHGL
                  70         80         90        100        110        120

130        140        150        160        170        180
    m157.pep NLLLVPVVGMDRLGYRLGQAGGYYDATLSAMKYRLQAKTVGVGFACQLVDRLPVEAHDRS
             ::||||:||:|| ||||||||||||||||||||||||||||||||||||||||||||||| ||||
    g157     SVLLVPLVGIDREGYRLGQAGGYYDATLSAMKYRLQAKTVGVGFACQLVDRLPREAHDLP
                 130        140        150        160        170        180
```

```
                     190
    m157.pep  LDGFVSEAGILCFX
              ||||||||||||||
    g157      LDGFVSEAGILCFX
                     190
```

The following partial DNA sequence was identified in *N. meningitidis* <SEQ ID 653>:

```
a157.seq
   1  ATGAGGAACG AGGAAAAACA CGCCTTGCGC CGAGAGTTGC GCCGCGCCCG

51  CGCGCAGATG GGGCATCAAG GGCGGTTGGC GGCGGGGCAA ACGATTAACC

101  GCCTGCTCAA ACGTTATATC AAGCGTGGTC GGAAAATCGG CGTGTATTGG

151  CCGATGGGCA AGGAATTGCG TTTGGACGGC TTTGTCCGCG CGGCGCAAAA

201  ACGCGGTGCA AAACTTTATC TGCCTTATAT CGAACCGCGT TCGCGGCGGA

251  TGTGGTTTAC GCCGTATCCT GAAAGCGGAA TGGAACGGGA GCGCATACGG

301  GGCAGGGCGA AGTTGAACGT GCCGCAGTTT GCAGGGCGCA AAATCCGCGT

351  GCACGGTTTG TCGGTATTGC TCGTCCCGCT TGTCGGCATA GACCGCGAGG

401  GCTACCGCTT AGGACAGGCA GGCGGCTATT ACGATGCGAC GCTTGCGGCG

451  ATGAAATACC GTTTGCAGGC AAAAACCGTG GGCGTGGGCT TTGCCTGCCA

501  GTTTGTGGAC AGGCTGCCGC GCGAACCGCA CGATCTGCTG CTGGACGGTT

551  TTGTGTCGGA GGCGGGGATA TTGTGCTTTT AG
```

This corresponds to the amino acid sequence <SEQ ID 654; ORF 157.a>:

```
a157.pep

1  MRNEEKHALR RELRRARAQM GHQGRLAAGQ TINRLLKRYI KRGRKIGVYW

51  PMGKELRLDG FVRAAQKRGA KLYLPYIEPR SRRMWFTPYP ESGMERERIR

101  GRAKLNVPQF AGRKIRVHGL SVLLVPLVGI DREGYRLGQA GGYYDATLAA

151  MKYRLQAKTV GVGFACQFVD RLPREPHDLL LDGFVSEAGI LCF* m157/a157 82.4% identity in 193 aa overlap 10         20         30         40         50         60
    m157.pep  MRNEEKRALRRELRGRRSQMGRDVRAAATVKINHLLKRYIKKGRKIGVYWPMGKELRLDG
              ||||||:||||||| |:|||::| || ||:||||||:||||||||||||||||||||||
    a157      MRNEEKHALRRELRRARAQMGHQGRLAAGQTINRLLKRYIKRGRKIGVYWPMGKELRLDG
                 10         20         30         40         50         60

70         80         90        100        110        120
    m157.pep  FVRAAQKRGAELYLPYIEPRSRRMWFTPYPADGVKQERKRGRAKLHVPQFAGRKKRVHDL
              ||||||||||:||||||||||||||||||| :|:::|| ||||||:|||||||| ||| |
    a157      FVRAAQKRGAKLYLPYIEPRSRRMWFTPYPESGMERERIRGRAKLNVPQFAGRKIRVHGL
                 70         80         90        100        110        120

130        140        150        160        170        180
    m157.pep  NLLLVPVVGMDRLGYRLGQAGGYYDATLSAMKYRLQAKTVGVGFACQLVDRLPVEAHDRS
              ::||||:||:|| |||||||||||||||||:|||||||||||||||||:| ||| | ||
    a157      SVLLVPLVGIDREGYRLGQAGGYYDATLAAMKYRLQAKTVGVGFACQFVDRLPREPHDLL
                130        140        150        160        170        180

190
    m157.pep  LDGFVSEAGILCFX
              ||||||||||||||
    a157      LDGFVSEAGILCFX
                     190
```

The following partial DNA sequence was identified in *N. gonorrhoeae* <SEQ ID 655>:

```
g158.seq
    1 ATGAAAACCA ATTCAGAAGA ACTGACCGTA TTTGTTCAAG TGGTGGAAAG

51 CGGCAGCTTC AGCCGTGCGG CGgagcAGTT GGAGAtggCA AATTCTGCCG

101 TAAGCCGCAT CGTCAAACGG CTGGAGGAAA AGTTGGGCGT GAAcCTGCtc 151 aACCGCACCA CGCGGCAACT CAATCTGACG GAAGAAGGCG CGCAATATTT

201 CCGCCGCGCG CAGAGAATCC TGCAAGAAAT GGCAGCGGCG GAAACCGAAA

251 TGCTGGCAGT GCACGAAGTA CCGCAAGGCG TGTTGCGCGT GGATTCCGCG

301 ATGCcgatgg TGCTGCATCT GCTGGCGCCG CTGGCAGCAA AATTCAACGA

351 ACGCTATCCG CATATCcgaC TTTCGCTCGT TTCTTCCGAa ggctatatca 401 atctGattGA AcgcaaagtC gAtatTGCCT TACGGGCCGA AGAATTGGAC 451 GATTCCGGGC TGCGTGCACG CCATCTGTTT GACAGCCACT TCCGCGtagt 501 cgCCAGTCCT GAATATTTAG CAAAACACGG CACGCCACAA TCTGCAGAAG 551 atcTTGCCAA CCATCAATGT TTAGGCTTCA CAGAACCCGG TTCTCTAAAT 601 ACATGGGCGG TTTTAGAtgC GCAGGGAAAT CCCTATAAAA TTTCACCGCA 651 CTTTACCGCC AGCAGCGGTG AAATCTTACG CTCGTTGTGC CTTTCAAGtt 701 gCGGTATTGC TTGCTTATCA GATTTTTTGG TTGACAACGA CATCACTGAA 751 GGAAAGTTAA TTCCcctatt cgCCGAACAA ACCTCCAATA AAACACACCC

801 CTTTAATGCT GTTTATTACA GCGATAAAGC CGTCAACCTC CGCTTACGCG

851 TATTTTTGGA TTTTTTAGTG AAGGAACTGG GAAAAAATAT GAATAGAACG

901 AATACCAAAT AA
                                                      35
```

This corresponds to the amino acid sequence <SEQ ID 656; ORF 158.ng>:

```
g158.pep
    1 MKTNSEELTV FVQVVESGSF SRAAEQLEMA NSAVSRIVKR LEEKLGVNLL

51 NRTTRQLNLT EEGAQYFRRA QRILQEMAAA ETEMLAVHEV PQGVLRVDSA

101 MPMVLHLLAP LAAKFNERYP HIRLSLVSSE GYINLIERKV DIALRAGELD

151 DSGLRARHLF DSHFRVVASP EYLAKHGTPQ SAEDLANHQC LGFTEPGSLN

201 TWAVLDAQGN PYKISPHFTA SSGEILRSLC LSSCGIACLS DFLVDNDITE

251 GKLIPLFAEQ TSNKTHPFNA VYYSDKAVNL RLRVFLDFLV KELGKNMNRT

301 NTK*
```

The following partial DNA sequence was identified in *N. meningitidis* <SEQ ID 657>:

```
m158.seq
    1 ATGAAAACCA ATTCAGAAGA ACTGACCGTA TTTGTTCAAG TGGTGGAAAG

51 CGGCAGCTTC AGCCGTGCGG CGGAGCAGTT GGCGATGGCA AATTCTGCCG

101 TAAGCCGCAT CGTCAAACGG CTGGAGGAAA AGTTGGGTGT GAACCTGCTC

151 AACCGCACCA CGCGGCAACT CAGTCTGACG GAAGAAGGCG CGCAATATTT

201 CCGCCGCGCG CAGAGAATCC TGCAAGAAAT GGCAGCGGCG GAAACCGAAA

251 TGCTGGCAGT GCACGAAATA CCGCAAGGCG TGTTGAGCGT GGATTCCGCG
```

-continued
```
301 ATGCCGATGG TGCTGCATCT GCTGGCGCCG CTGGCAGCAA AATTCAACGA

351 ACGCTATCCG CATATCCGAC TTTCGCTCGT TTCTTCCGAA GGCTATATCA

401 ATCTGATTGA ACGCAAAGTC GATATTGCCT TACGGGCCGG AGAATTGGAC

451 GATTCCGGGC TGCGTGCACG CCATCTGTTT GACAGCCGCT TCCGCGTAAT

501 CGCCAGTCCT GAATACCTGG CAAAACACGG CACGCCGCAA TCTACAGAAG

551 AGCTTGCCGG CCACCAATGT TTAGGCTTCA CCGAACCCGG TTCTCTAAAT

601 ACATGGGCGG TTTTAGATGC GCAGGGAAAT CCCTATAAGA TTTCACCGCA

651 CTTTACCGCC AGCAGCGGTG AAATCTTACG CTCGTTGTGC CTTTCAGGTT

701 GCGGTATTGT TTGCTTATCA GATTTTTTGG TTGACAACGA CATCGCTGAA

751 GGAAAGTTAA TTCCCCTGCT CGCCGAACAA ACCTCCGATA AAACACACCC

801 CTTTAATGCT GTTTATTACA GCGATAAAGC CGTCAATCTC CGCTTACGCG

851 TATTTTTGGA TTTTTTAGTG GAGGAACTGG GAAACAATCT CTGTGGATAA
```

This corresponds to the amino acid sequence <SEQ ID 658; ORF 158>:

```
m158.pep
  1 MKTNSEELTV FVQVVESGSF SRAAEQLAMA NSAVSRIVKR LEEKLGVNLL

51 NRTTRQLSLT EEGAQYFRRA QRILQEMAAA ETEMLAVHEI PQGVLSVDSA

101 MPMVLHLLAP LAAKFNERYP HIRLSLVSSE GYINLIERKV DIALRAGELD

151 DSGLRARHLF DSRFRVIASP EYLAKHGTPQ STEELAGHQC LGFTEPGSLN

201 TWAVLDAQGN PYKISPHFTA SSGEILRSLC LSGCGIVCLS DFLVDNDIAE

251 GKLIPLLAEQ TSDKTHPFNA VYYSDKAVNL RLRVFLDFLV EELGNNLCG*
```

Computer analysis of this amino acid sequence gave the following results:
Homology with a Predicted ORF from *N. gonorrhoeae*

```
    m158/g158 94.3% identity in 297 aa overlap 10         20         30         40         50         60
    m158.pep MKTNSEELTVFVQVVESGSFSRAAEQLAMANSAVSRIVKRLEEKLGVNLLNRTTRQLSLT
            ||||||||||||||||||||||||| ||||||||||||||||||||||||||||||:||
    g158    MKTNSEELTVFVQVVESGSFSRAAEQLEMANSAVSRIVKRLEEKLGVNLLNRTTRQLNLT
                10         20         30         40         50         60

70         80         90        100        110        120
    m158.pep EECAQYFRRAQRILQEMAAAETEMLAVHEIPQCVLSVDSAMPMVLHLLAPLAAKFNERYP
            ||||||||||||||||||||||||||||||:|||| ||||||||||||||||||||||||
    g158    EEGAQYFRRAQRILQEMAAAETEMLAVHEVPQGVLRVDSAMPMVLHLLAPLAAKFNERYP
                70         80         90        100        110        120

130        140        150        160        170        180
    m158.pep HIRLSLVSSEGYINLIERKVDIALRAGELDDSGLRARHLFDSRFRVIASPEYLAKHGTPQ
            ||||||||||||||||||||||||||||||||||||||||||:|||:|||||||||||||
    g158    HIRLSLVSSEGYINLIERKVDIALRAGELDDSGLRARHLFDSHFRVVASPEYLAKHGTPQ
                130        140        150        160        170        180

190        200        210        220        230        240
    m158.pep STEELAGHQCLGFTEPGSLNTWAVLDAQGNPYKISPHFTASSGEILRSLCLSGCGIVCLS
            |:|:||:|||||||||||||||||||||||||||||||||||||||||||:|||:|||
    g158    SAEDLANHQCLGFTEPGSLNTWAVLDAQGNPYKISPHFTASSGEILRSLCLSSCGIACLS
                190        200        210        220        230        240

250        260        270        280        290        300
    m158.pep DFLVDNDIAEGKLIPLLAEQTSDKTHPFNAVYYSDKAVNLRLRVFLDFLVEELGNNLCGX
            ||||||||:|||||||:||||:||||||||||||||||||||||||||||:|||:|:
    g158    DFLVDNDITEGKLIPLFAEQTSNKTHPFNAVYYSDKAVNLRLRVFLDFLVKELGKNMNRT
                250        260        270        280        290        300 g158    NTKX
```

The following partial DNA sequence was identified in *N. meningitidis* <SEQ ID 659>:

```
a158.seq
   1 ATGAAAACCA ATTCAGAAGA ACTGACCGTA TTTGTTCAAG TGGTGGAAAG

51 CGGCAGCTTC AGCCGTGCGG CGGAGCAGTT GGCGATGGCA AATTCTGCCG

101 TAAGCCGCAT CGTCAAACGG CTGGAGGAAA AGTTGGGTGT GAACCTGCTC

151 AACCGCACCA CGCGGCAACT CAGTCTGACG GAAGAAGGCG CGCAATATTT

201 CCGCCGCGCG CAGAGAATCC TGCAAGAAAT GGCAGCGGCG GAAACCGAAA

251 TGCTGGCAGT GCACGAAATA CCGCAAGGCG TGTTGCGCGT GGATTCCGCG

301 ATGCCGATGG TGCTGCATCT GCTGGCGCCG CTGGCAGCAA AATTCAACGA

351 ACGCTATCCG CATATCCGAC TTTCGCTCGT TTCTTCCGAA GGCTATATCA

401 ATCTGATTGA ACGCAAAGTC GATATTGCCT TACGGGCCGG AGAATTGGAC

451 GATTCCGGGC TGCGTGCACG CCATCTGTTT GACAGCCGCT TCCGCGTAAT

501 CGCCAGTCCT GAATACCTGG CAAAACACGG CACGCCGCAA TCTACAGAAG

551 AGCTTGCCGG CCACCAATGT TTAGGCTTCA CCGAACCCGG TTCTCTAAAT

601 ACATGGGCGG TTTTAGATGC GCAGGGAAAT CCCTATAAGA TTTCACCGCA

651 CTTTACCGCC AGCAGCGGTG AAATCTTACG CTCGTTGTGC CTTTCAGGTT

701 GCGGTATTGC TTGCTTATCA GATTTTTTGG TTGACAACGA CATCGCTGAA

751 GGAAAGTTAA TTCCCCTGCT CGCCGAACAA ACCTCCAATA AAACGCACCC

801 CTTTAATGCT GTTTATTACA GCGATAAAGC CGTCAACCTC CGCTTACGCG

851 TATTTTTGGA TTTTTTAGTG GAGGAACTGG GAAACAATCT CTGTGGATAA
```

This corresponds to the amino acid sequence <SEQ ID 660; ORF 158.a>:

```
a158.pep

1 MKTNSEELTV FVQVVESCSF SRAAEQLAMA NSAVSRIVKR LEEKLCVNLL

51 NRTTRQLSLT EEGAQYFRRA QRILQEMAAA ETEMLAVHEI PQGVLRVDSA

101 MPMVLHLLAP LAAKFNERYP HIRLSLVSSE GYINLIERKV DIALRAGELD

151 DSGLRARHLF DSRFRVIASP EYLAKHGTPQ STEELAGHQC LGFTEPGSLN

201 TWAVLDAQGN PYKISPHFTA SSGEILRSLC LSGGGIACLS DFLVDNDIAE

251 GKLIPLLAEQ TSNKTHPFNA VYYSDKAVNL RLRVFLDFLV EELGNNLCG* m158/a158 99.0% identity in 299 aa overlap 10        20        30        40        50        60
m158.pep  MKTNSEELTVFVQVVESGSFSRAAEQLAMANSAVSRIVKRLEEKLGVNLLNRTTRQLSLT
          ||||||||||||||||||||||||||||||||||||||||||||||||||||||||||||
a158      MKTNSEELTVFVQVVESGSFSRAAEQLAMANSAVSRIVKRLEEKLGVNLLNRTTRQLSLT
                  10        20        30        40        50        60

70        80        90       100       110       120
m158.pep  EEGAQYFRRAQRILQEMAAAETEMLAVHEIPQGVLSVDSAMPMVLHLLAPLAAKFNERYP
          ||||||||||||||||||||||||||||||||||| ||||||||||||||||||||||||
a158      EEGAQYFRRAQRILQEMAAAETEMLAVHEIPQGVLRVDSAMPMVLHLLAPLAAKFNERYP
                  70        80        90       100       110       120

130       140       150       160       170       180
m158.pep  HIRLSLVSSEGYINLIERKVDIALRAGELDDSGLRARHLFDSRFRVIASPEYLAKHGTPQ
          ||||||||||||||||||||||||||||||||||||||||||||||||||||||||||||
a158      HIRLSLVSSEGYINLIERKVDIALRAGELDDSGLRARHLFDSRFRVIASPEYLAKHGTPQ
                 130       140       150       160       170       180

190       200       210       220       230       240
m158.pep  STEELAGHQCLGFTEPGSLNTWAVLDAQGNPYKISPHFTASSGEILRSLCLSGCGIVCLS
          ||||||||||||||||||||||||||||||||||||||||||||||||||||||||:|||
a158      STEELAGHQCLGFTEPGSLNTWAVLDAQGNPYKISPHFTASSGEILRSLCLSGCGIACLS
                 190       200       210       220       230       240
```

-continued

```
                    250        260        270        280        290        300
       m158.pep  DFLVDNDIAEGKLIPLLAEQTSDKTHPFNAVYYSDKAVNLRLRVFLDFLVEELGNNLCGX
                 |||||||||||||||||||||||||:||||||||||||||||||||||||||||||||||
       a158      DFLVDNDIAEGKLIPLLAEQTSNKTHPFNAVYYSDKAVNLRLRVFLDFLVEELGNNLCGX
                    250        260        270        280        290        300
```

The following partial DNA sequence was identified in *N. gonorrhoeae* <SEQ ID 661>:

```
g160.seq
    1 ATGGAcattc tgGACAAact ggtcgatCTC GCccaATTGA CGGGCAGTGC
   51 GGATGTGCAG TgcctTTTGG GCGGACAATG gcATGaaacc TTGCAACGCG
  101 AAGGGCTGGT ACACATTGTT ACGGCGGGCA GCGGTTATCT CTGCATCGAC
  151 GGCGAAACTT CCCCGCGTCC GGTCGGCACG GGCGATATTG TATTTTTCCC
  201 GCGCGGCTTG GGTCATGTGT TGAGCCACGA CGGAAAATAC GGAGAAAGTT
  251 TACAACCGGA CATACGACAA AACGGCACAT TTATGGTCAA ACAGTGCGGC
  301 AACGGGCTGG ATATGAGCCT GTTTTGCGCC CGTTTCCGCT ACGACACCCA
  351 CGCCGATTTG ATGAACGGGC TGCCGGAAAC CGTTTTTCTG AACATTGCCC
  401 ATCCAAGTTT GCAGTATGTG GTTTCAATGC TGCAACTGGA AAGCGAAAAA
  451 CCTTTGACGG GGACGGTTTC CGTGGTCAAC GCATTACCGT CCGTCCTGCT
  501 GGTGCTTATC CTGCGCGCCT ATCTCGAACA GGATAAGGAT GTCGAACTCT
  551 CGGGCGTATT GAAAGGTTGG CAGGACAAAC GTTTGGGACA TTTGATCCAA
  601 AAGGTGATAG ACAAACCGGA AGACGAATGG AATATTGACA AAATGGTTGC
  651 CGCCGCCAAT ATGTCGCGCG CGCAACTGAT GCGCCGCTTC AAAAGCCAAG
  701 TCGGACTCAG CCCGCACGCC TTTGTGAACC ATATCCGCCT GCAAAAAGGC
  751 GCATTGCTGC TGAAGAAAAC CCCGGATTCG GTTTTGGAGG TCGCGCTGTC
  801 GGTGGGCTTT CAGTCGGAAA CGCATTTCGG CAAGGCGTTC AAACGGCAAT
  851 ATCACGTTTC GCCGGGGCAA TACCGGAAAG AAGGCGGGCA AAAATAA
```

This corresponds to the amino acid sequence <SEQ ID 662; ORF 160.ng>:

```
g160.pep
    1 MDILDKLVDL AQLTGSADVQ CLLGGQWHET LQREGLVHIV TAGSGYLCID
   51 GETSPRPVGT GDIVFFPRGL GHVLSHDGKY GESLQPDIRQ NGTFMVKQCG
  101 NGLDMSLFCA RFRYDTHADL MNGLPETVFL NIAHPSLQYV VSMLQLESEK
  151 PLTGTVSVVN ALPSVLLVLI LRAYLEQDKD VELSGVLKGW QDKRLGHLIQ
  201 KVIDKPEDEW NIDKMVAAAN MSRAQLMRRF KSQVGLSPHA FVNHIRLQKG
  251 ALLLKKTPDS VLEVALSVGF QSETHFGKAF KRQYHVSPGQ YRKEGGQK*
```

The following partial DNA sequence was identified in *N. meningitidis* <SEQ ID 663>:

```
m160.seq
    1 ATGGACATTC TGGACAAACT GGTCGATTTC GCCCAATTGA CGGGCAGTGT
   51 GGATGTGCAG TGCCTTTTGG GCGGACAATG GTCGGTACGG CATGAAACCT
  101 TGCAACGCGA AGGATTGGTA CACATTGTTA CATCGGGCAG CGGCTATCTC
  151 TGCATCGACG GCGAAACTTC CCCGCGTCCG GTCAGTACAG GGGATATTGT
```

```
201 ATTTTTCCCG CGCGGCTTGG GTCATGTGTT GAGCCACGAC GGAAAATGCG

251 GAGAAAGTTT ACAACCGGAT ATGCGGCAGC ACGGTGCGTT TACGGTCAAG

301 CAGTGCGGCA ACGGACAGGA TATGAGCCTG TTTTGCGCCC GTTTCCGCTA

351 CGACACCCAC GCCGATTTGA TGAACGGGCT GCCTGAAACC GTTTTTCTGA

401 ACATTGCCCA TCCGAGTTTA CAGTATGTGG TTTCAATGCT GCAACTGGAA

451 AGCAAAAAAC CTTTGACGGG GACGGTTTCC ATGGTCAACG CATTGTCGTC

501 CGTCCTGCTG GTGCTTATCC TGCGCGCCTA TCTCGAACAG GATAAGGATG

551 TCGAACTCTC GGGCGTATTG AAAGGTTGGC AGGACAAACG TTTGGGACAT

601 TTAATCCAAA AGGTGATAGA CAAACCGGAA GACGAATGGA ATGTCGACAA

651 AATGGTGGCG GCTGCCAATA TGTCGCGCGC GCAACTGATG CGCCGTTTCA

701 AAAGCCGGGT CGGACTCAGC CCGCACGCCT TTGTGAACCA TATCCGCCTG

751 CAAAAAGGCG CGTTGCTGCT GAAAAAAAAC CCGGATTCGG TTTTGTCGGT

801 CGCACTGTCG GTAGGCTTTC AGTCGGAAAC GCACTTCGGC AAGGCGTTCA

851 AACGGCAATA TCACGTTTCG CCGGGTCAAT ACCGGAAAGA AggCGGGCAA

901 AAATAA
```

This corresponds to the amino acid sequence <SEQ ID 664; ORF 160>:

```
m160.pep
   1 MDILDKLVDF AQLTGSVDVQ CLLGGQWSVR HETLQREGLV HIVTSGSGYL

51 CIDGETSPRP VSTGDIVFFP RGLGHVLSHD GKCGESLQPD MRQHGAFTVK

101 QCGNGQDMSL FCARFRYDTH ADLMNGLPET VFLNIAHPSL QYVVSMLQLE

151 SKKPLTGTVS MVNALSSVLL VLILRAYLEQ DKDVELSGVL KGWQDKRLGH

201 LIQKVIDKPE DEWNVDKMVA AANMSRAQLM RRFKSRVGLS PHAFVNHIRL

251 QKGALLLKKN PDSVLSVALS VGFQSETHFG KAFKRQYHVS PGQYRKEGGQ

301 K*
```

Computer analysis of this amino acid sequence gave the following results:
Homology with a Predicted ORF from *N. gonorrhoeae*

```
    m160/g160    93.4% identity in 301 aa overlap
                        10         20         30         40         50         60
        m160.pep MDILDKLVDFAQLTGSVDVQCLLGGQWSVRHETLQREGLVHIVTSGSGYLCIDGETSPRP
                ||||||||||:||||||:|||||||||||   ||||||||||||||:|||||||||||||
        g160    MDILDKLVDLAQLTGSADVQCLLGGQW---HETLQREGLVHIVTAGSGYLCIDGETSPRP
                        10         20         30            40         50

70         80         90        100        110        120
        m160.pep VSTGDIVFFPRGLGHVLSHDGKCGESLQPDMRQHGAFTVKQCGNGQDMSLFCARFRYDTH
                |:||||||||||||||||||||:|||||||||:|:|:|:|||||:|||||||||||||||
        g160    VGTGDIVFFPRGLGHVLSHDGKYGESLQPDIRONGTFMVKOCGNGLDMSLFCARFRYDTH
                        60         70         80         90        100        110

130        140        150        160        170        180
        m160.pep ADLMNGLPETVFLNIAHPSLQYVVSMLQLESKKPLTGTVSMVNALSSVLLVLILRAYLEQ
                |||||||||||||||||||||||||||||||:|||||||||:||||:|||||||||||||
        g160    ADLMNGLPETVFLNIAHPSLQYVVSMLQLESEKPLTGTVSVVNALPSVLLVLILRAYLEQ
                       120        130        140        150        160        170

190        200        210        220        230        240
        m160.pep DKDVELSGVLKGWQDKRLGHLIQKVIDKPEDEWNVDKMVAAANMSRAQLMRRFKSRVGLS
                ||||||||||||||||||||||||||||||||||:|||||||||||||||||||:||||
        g160    DKDVELSGVLKGWQDKRLGHLIQKVIDKPEDEWNIDKMVAAANMSRAQLMRRFKSQVGLS
                       180        190        200        210        220        230
```

```
                   250        260        270        280        290        300
m160.pep   PHAFVNHIRLQKGALLLKKNPDSVLSVALSVGFQSETHFGKAFKRQYHVSPGQYRKEGGQ
           ||||||||||||||||||||:||||||||||||||||||||||||||||||||||||||
g160       PHAFVNHIRLQKGALLLKKTPDSVLEVALSVGFQSETHFGKAFKRQYHVSPGQYRKEGGQ
                   240        250        260        270        280        290 m160.pep   KX
           ||
g160       KX
```

The following partial DNA sequence was identified in *N. meningitidis* <SEQ ID 665>:

```
a160.seq
    1 ATGGACATTC TGGACAAACT GGTCGATTTC GCCCAATTGA CGGGCAGTGT
   51 GGATGTGCAG TGCCTTTTGG GCGGACAATG GTCGGTACGG CATGAAACCT
  101 TGCAACGCGA AGGATTGGTA CACATTGTTA CATCGGGCAG CGGCTATC

```
m160/a160   100.0% identity in 301 aa overlap 10         20         30         40         50         60
m160.pep    MDILDKLVDFAQLTGSVDVQCLLGGQWSVRHETLQREGLVHIVTSGSGYLCIDGETSPRP
            ||||||||||||||||||||||||||||||||||||||||||||||||||||||||||||
g160        MDILDKLVDFAQLTGSVDVQCLLGGQWSVRHETLQREGLVHIVTSGSGYLCIDGETSPRP
                    10         20         30         40         50         60

70         80         90        100        110        120
m160.pep    VSTGDIVFFPRGLGHVLSHDGKCGESLQPDMRQHGAFTVKQCGNGQDMSLFCARFRYDTH
            ||||||||||||||||||||||||||||||||||||||||||||||||||||||||||||
a160        VSTGDIVFFPRGLGHVLSHDGKCGESLQPDMRQHGAFTVKQCGNGQDMSLFCARFRYDTH
                    70         80         90        100        110        120

130        140        150        160        170        180
m160.pep    ADLMNGLPETVFLNIAHPSLQYVVSMLQLESKKPLTGTVSMVNALSSVLLVLILRAYLEQ
            ||||||||||||||||||||||||||||||||||||||||||||||||||||||||||||
a160        ADLMNGLPETVFLNIAHPSLQYVVSMLQLESKKPLTGTVSMVNALSSVLLVLILRAYLEQ
                   130        140        150        160        170        180

190        200        210        220        230        240
m160.pep    DKDVELSGVLKGWQDKRLGHLIQKVIDKPEDEWNVDKMVAAANMSRAQLMRRFKSRVGLS
            ||||||||||||||||||||||||||||||||||||||||||||||||||||||||||||
a160        DKDVELSGVLKGWQDKRLGHLIQKVIDKPEDEWNVDKMVAAANMSRAQLMRRFKSRVGLS
                   190        200        210        220        230        240

250        260        270        280        290        300
m160.pep    PHAFVNHIRLQKGALLLKKNPDSVLSVALSVGFQSETHFGKAFKRQYHVSPGQYRKEGGQ
            ||||||||||||||||||||||||||||||||||||||||||||||||||||||||||||
a160        PHAFVNHIRLQKGALLLKKNPDSVLSVALSVGFQSETHFGKAFKRQYHVSPGQYRKEGGQ
                   250        260        270        280        290        300 m160.pep    KX
            ||
a160        KX
```

The following partial DNA sequence was identified in *N. gonorrhoeae* <SEQ ID 667>:

```
g161.seq
   1 ATGGATACCG CAAAAAAGA  CATTTTAGGA TCGGGCTGGA TGCTGGTGGC

51 GGCGGCCTGC TTCACCGTTA TGAACGTATT GATTAAAGAG GCATCGGCAA

101 AATTTGCCCT CGGCAGCGGC GAATTGGTCT TTTGGCGCAT GCTGTTTTCA

151 ACCGTTACGC TCGGTGCTGC CGCCGTATTG CGGCGCGACA CCTTCCGCAC

201 GCCCCATTGG AAAAACCACT TAAACCGCAG TATGGTCGGG ACGGGGCGA

251 TGCTGCTGCT GTTTTACGCG GTAACGCATC TGCCTTTGAC AACCGGCGTT

301 ACCCTGAGTT ACACCTCGTC GATTTTTttg GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 CCGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGCAACC GGCGTGGCGA TGTCGTCggt ttgggcgacg

601 Ctgaccggct ggCACAcccT GTCCTTTcca tcggcagttt ATCtgtCGGG

651 CATCGGCGTG tccgcgCtgA TTGCCCAaCT GtcgatgAcg cGCGcctaca 701 aaGTCGGCGA CAAATTCACG GTTGCCTCGC tttcctaTAt gaccgtcGTC 751 TTTTCCGCCC TGTCTGCCGC ATTTTTTCTg ggcgaagagc ttttctggCA 801 GGAAATACTC GGTATGTGCA TCATTATcct CAGCGGCATT TGAGCAGCA

851 TCCGCCCCAT TGCCTTCAAA CAGCGGCTGC AAGCCCTCTT CCGCCAAAGA

901 TAA
```

This corresponds to the amino acid sequence <SEQ ID 668; ORF 161.ng>:

```
g161.pep
   1 MDTAKKDILG SGWMLVAAAC FTVMNVLIKE ASAKFALGSG ELVFWRMLFS

51 TVTLGAAAVL RRDTFRTPHW KNHLNRSMVG TGAMLLLFYA VTHLPLTTGV

101 TLSYTSSIFL AVFSFLILKE RISVYTQAVL LLGFAGVVLL LNPSFRSGQE

151 PAALAGLAGG AMSGWAYLKV RELSLAGEPG WRVVFYLSAT GVAMSSVWAT

201 LTGWHTLSFP SAVYLSGIGV SALIAQLSMT RAYKVGDKFT VASLSYMTVV

251 FSALSAAFFL GEELFWQEIL GMCIIILSGI LSSIRPIAFK QRLQALFRQR

301 *
```

The following partial DNA sequence was identified in *N. meningitidis* <SEQ ID 669>:

```
m161.seq
   1 ATGGATACCG CAAAAAAGA CATTTTAGGA TCGGGCTGGA TGCTGGTGGC

51 GGCGGCCTGC TTTACCATTA TGAACGTATT GATTAAAGAG GCATCGGCAA

101 AATTTGCCCT CGGCAGCGGC GAATTGGTCT TTTGGCGCAT GCTGTTTTCA

151 ACCGTTGCGC TCGGGCTGC CGCCGTATTG CGTCGGGACA mCTTCCGCAC

201 GCCCCATTGG AAAAACCACT TAAACCGCAG TATGGTCGGG ACGGGGCGA

251 TGCTGCTGCT GTTTTACGCG GTAACGCATC TGCCTTTGGC CACTGGCGTT

301 ACCCTGAGTT ACACCTCGTC GATTTTTTTG GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 ACGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGTGACA GGTGTGGCGA TGTCGTCGGT TTGGGCGACG

601 CTGACCGGCT GGCACACCCT GTCCTTTCCA TCGGCAGTTT ATCTGTCGTG

651 CATCGGCGTG TCCGCGCTGA TTGCCCAACT GTCGATGACG CGCGCCTACA

701 AAGTCGGCGA CAAATTCACG GTTGCCTCGC TTTCCTATAT GACCGTCGTT

751 TTTTCCGCTC TGTCTGCCGC ATTTTTTCTG GGCGAAGAGC TTTTCTGGCA

801 GGAAATACTC GGTATGTGCA TCATCATCCT CAGCGGTATT TTGAGCAGCA

851 TCCGCCCCAC TGCCTTCAAA CAGCGGCTGC AATCCCTGTT CCGCCAAAGA

901 TAA
```

This corresponds to the amino acid sequence <SEQ ID 670; ORF 161>:

```
m161.pep
   1 MDTAKKDILG SGWMLVAAAC FTIMNVLIKE ASAKFALGSG ELVFWRMLFS

51 TVALGAAAVL RRDXFRTPHW KNHLNRSMVG TGAMLLLFYA VTHLPLATGV

101 TLSYTSSIFL AVFSFLILKE RISVYTQAVL LLGFAGVVLL LNPSFRSGQE

151 TAALAGLAGG AMSGWAYLKV RELSLAGEPG WRVVFYLSVT GVAMSSVWAT

201 LTGWHTLSFP SAVYLSCIGV SALIAQLSMT RAYKVGDKFT VASLSYMTVV
```

-continued

```
251 FSALSAAFFL GEELFWQEIL GMCIIILSGI LSSIRPTAFK QRLQSLFRQR

301 *
```

Computer analysis of this amino acid sequence gave the following results:
Homology with a Predicted ORF from *N. gonorrhoeae*

```
   m161/g161    97.0% identity in 300 aa overlap 10         20         30         40         50         60
     m161.pep   MDTAKKDILGSGWMLVAAACFTIMNVLIKEASAKFALGSGELVFWRMLFSTVALGAAAVL
                ||||||||||||||||||||||| :|||||||||||||||||||||||||||| :|||||
         g161   MDTAKKDILGSGWMLVAAACFTVMNVLIKEASAKFALGSGELVFWRMLFSTVTLGAAAVL
                        10         20         30         40         50         60
                        70         80         90        100        110        120
     m161.pep   RRDXFRTPHWKNHLNRSMVGTGAMLLLFYAVTHLPLATGVTLSYTSSIFLAVFSFLILKE
                ||| :|||||||||||||||||||||||||||||||| :|||||||||||||||||||||
         g161   RRDTFRTPHWKNHLNRSMVGTGAMLLLFYAVTHLPLTTGVTLSYTSSIFLAVFSFLILKE
                        70         80         90        100        110        120
                       130        140        150        160        170        180
     m161.pep   RISVYTQAVLLLGFAGVVLLLNPSFRSGQETAALAGLAGGAMSGWAYLKVRELSLAGEPG
                |||||||||||||||||||||||||||| :|||||||||||||||||||||||||||||
         g161   RISVYTQAVLLLGFAGVVLLLNPSFRSGQEPAALAGLAGGAMSGWAYLKVRELSLAGEPG
                       130        140        150        160        170        180
                       190        200        210        220        230        240
     m161.pep   WRVVFYLSVTGVAMSSVWATLTGWHTLSFPSAVYLSCIGVSALIAQLSMTRAYKVGDKFT
                |||||||| :|||||||||||||||||||||||||| :||||||||||||||||||||||
         g161   WRVVFYLSATGVAMSSVWATLTGWHTLSFPSAVYLSGIGVSALIAQLSMTRAYKVGDKFT
                       190        200        210        220        230        240
                       250        260        270        280        290        300
     m161.pep   VASLSYMTVVFSALSAAFFLGEELFWQEILGMCIIILSGILSSIRPTAFKQRLQSLFRQR
                ||||||||||||||||||||||||||||||||||||||||||||| ||| ||||:||||
         g161   VASLSYMTVVFSALSAAFFLGEELFWQEILGMCIIILSGILSSIRPIAFKQRLQALFRQR
                       250        260        270        280        290        300 m161.pep   X
                |
         g161   X
```

The following partial DNA sequence was identified in *N. meningitidis* <SEQ ID 671>:

```
a161.seq
    1 ATGGATACCG CAAAAAAGA  CATTTTAGGA TCGGGCTGGA TGCTGGTGGC

51 GGCGGCCTGC TTTACCATTA TGAACGTATT GATTAAAGAG GCATCGGCAA

101 AATTTGCCCT CGGCAGCGGC GAATTGGTCT TTTGGCGCAT GCTGTTTTCA

151 ACCGTTGCGC TCGGGCTGC  CGCCGTATTG CGTCGGGACA CCTTCCGCAC

201 GCCCCATTGG AAAAACCACT TAAACCGCAG TATGGTCGGG ACGGGGGCGA

251 TGCTGCTGCT GTTTTACGCG GTAACGCATC TGCCTTTGGC CACCGGCGTT

301 ACCCTGAGTT ACACCTCGTC GATTTTTTTG GCGGTATTTT CCTTCCTGAT

351 TTTGAAAGAA CGGATTTCCG TTTACACGCA GGCGGTGCTG CTCCTTGGTT

401 TTGCCGGCGT GGTATTGCTG CTTAATCCCT CGTTCCGCAG CGGTCAGGAA

451 ACGGCGGCAC TCGCCGGGCT GGCGGGCGGC GCGATGTCCG GCTGGGCGTA

501 TTTGAAAGTG CGCGAACTGT CTTTGGCGGG CGAACCCGGC TGGCGCGTCG

551 TGTTTTACCT TTCCGTGACA GGTGTGGCGA TGTCATCGGT TTGGGCGACG

601 CTGACCGGCT GGCACACCCT GTCCTTTCCA TCGGCAGTTT ATCTGTCGTG

651 CATCGGCGTG TCCGCGCTGA TTGCCCAACT GTCGATGACG CGCGCCTACA

701 AAGTCGGCGA CAAATTCACG GTTGCCTCGC TTTCCTATAT GACCGTCGTT
```

```
751 TTTTCCGCTC TGTCTGCCGC ATTTTTTCTG GCCGAAGAGC TTTTCTGGCA

801 GGAAATACTC GGTATGTGCA TCATCATCCT CAGCGGTATT TTGAGCAGCA

851 TCCGCCCCAC TGCCTTCAAA CAGCGGCTGC AATCCCTGTT CCGCCAAAGA

901 TAA
```

This corresponds to the amino acid sequence <SEQ ID 672; ORF 161.a>:

```
a161.pep

1 MDTAKKDILG SGWMLVAAAC FTIMNVLIKE ASAKFALGSG ELVFWRMLFS

51 TVALGAAAVL RRDTFRTPHW KNHLNRSMVG TGAMLLLFYA VTHLPLATGV

101 TLSYTSSIFL AVFSPLILKE RISVYTQAVL LLGFAGVVLL LNPSFRSGQE

151 TAALAGLAGG AMSGWAYLKV RELSLAGEPG WRVVFYLSVT GVAMSSVWAT

201 LTGWHTLSFP SAVYLSCIGV SALIAQLSMT RAYKVGDKFT VASLSYMTVV

251 FSALSAAFFL AEELFWQEIL GMCIIILSGI LSSIRPTAFK QRLQSLFRQR

301 * m161/a161    99.3% identity in 300 aa overlap 10         20         30         40         50         60
m161.pep   MDTAKKDILGSGWMLVAAACFTIMNVLIKEASAKFALGSGELVFWRMLFSTVALGAAAVL
           ||||||||||||||||||||||||||||||||||||||||||||||||||||||||||||
a161       MDTAKKDILGSGWMLVAAACFTIMNVLIKEASAKFALGSGELVFWRMLFSTVALGAAAVL
                  10         20         30         40         50         60

70         80         90        100        110        120
m161.pep   RRDXFRTPHWKNHLNRSMVGTGAMLLLFYAVTHLPLATGVTLSYTSSIFLAVFSFLILKE
           |||:||||||||||||||||||||||||||||||||||||||||||||||||||||||||
a161       RRDTFRTPHWKNHLNRSMVGTGAMLLLFYAVTHLPLATGVTLSYTSSIFLAVFSFLILKE
                  70         80         90        100        110        120

130        140        150        160        170        180
m161.pep   RISVYTQAVLLLGFAGVVLLLNPSFRSGQETAALAGLAGGAMSGWAYLKVRELSLAGEPG
           ||||||||||||||||||||||||||||||||||||||||||||||||||||||||||||
a161       RISVYTQAVLLLGFAGVVLLLNPSFRSGQETAALAGLAGGAMSGWAYLKVRELSLAGEPG
                 130        140        150        160        170        180

190        200        210        220        230        240
m161.pep   WRVVFYLSVTGVAMSSVWATLTGWHTLSFPSAVYLSCIGVSALIAQLSMTRAYKVGDKFT
           ||||||||||||||||||||||||||||||||||||||||||||||||||||||||||||
a161       WRVVFYLSVTGVAMSSVWATLTGWHTLSFPSAVYLSCIGVSALIAQLSMTRAYKVGDKFT
                 190        200        210        220        230        240

250        260        270        280        290        300
m161.pep   VASLSYMTVVFSALSAAFFLGEELFWQEILGMCIIILSGILSSIRPTAFKQRLQSLFRQR
           |||||||||||||||||||||||:||||||||||||||||||||||||||||||||||||
a161       VASLSYMTVVFSALSAAFFLAEELFWQEILGMCIIILSGILSSIRPTAFKQRLQSLFRQR
                 250        260        270        280        290        300 m161.pep   X
           |
a161       X
```

The following partial DNA sequence was identified in *N. gonorrhoeae* <SEQ ID 673>:

```
g163.seq
    1 ATGGTTATTT TGACGACTTT GTTTTTTGTG TGTGTTTTGG TGGTATTGGT

51 TTTAACCGTG CCGGATCAGG TGCAGATGTG gctCGACCGG GCAAAAGAAG

101 TCATTTTTAC CGAGTTCAGC TGGTTTTATG TTTTAACGTT TTCCATTTTt 151 ctgGGTTTtc tgctGATACT CTCGGTCAGC GGTTTGGGAA ACATcagGCT

201 AGGACGGGAT GAAGATGTGC CGGAATTCGG CTTCCTGTCG TGGCTGGCGA

251 TGCTGTTTGC GGCCGGGATG GGCGTGGGCC TGATGTTTTT CGGCGTGGCA

301 GAGCCGTTGA TGCATTATTT TTCGGACATT ACGGTCGGCG CGCCGGAACA
```

```
 351 CAGGCAGCAG CAGGCATTGC TGCACACGGT GTTCCATTGG GGCGTTCACG

401 CCTGGTCGGT GTACGGTACG ATTGCATTGG CTTTGGCTTA TTTCGGTTTC

451 CGCTACAAAC TGCCGCTTGC CCTGCGTTCT TGTTTTTACC CCCTGTTGAA

501 AGAAAAAATT TCCGGAAGGT TCGGCGATGC CATTGATATT ATGGCGTTGC

551 TTGCTACTTT TTTCGGCATC ATCACCACAT TGGGGTTCGG GGCTTCGCAA

601 CTGGGCGCCG GATTGCAGGA AATGGGCTGG ATTGCCGAAA ACAGCTTCGG

651 CGTGCAGGTC TTGATTATCG CCGCCGTAAT GTCCCTCGCC GTCGTTTCGG

701 CAATATCCGG CGTGGGGAAG GGCGTGAAGG TGTTGAGCGA GTTGAACCTG

751 GGCCTTGCGT TTTTGCTGCT GTTTTTTGTT TTGGCGGCGG ACCCCACTGT

801 TTACCTGTTG TCGGCATTCG GCGACAACAT AGGGAACTAC CTCGGAAATC

851 TGGTGCGCCT CAGTTTGAAA ACTTATGCGT ACGAACGGGA ACACAAGCCG

901 TGGTTTGAAT CTTGGACGGT GCTTTATTGG GCGTGGTGG GTTCTTGGgc 951 gcCGTTTGTG GGTTTGTTTA TCGCGCGCAT TTCAAAGGGg cgcaccatCc 1001 gcgagtttgt CTTCGGGGTT TTGCTCATCC CCGGCCTGTT CGGCGTTTTG

1051 TGGTTTACCG TCTTCGGCAA TACGGCGATT TGGCTGAATG ACGGGGTTGC

1101 GGGGGGAATG CTCGAAAAGA TGACCTCCTC TCCGGAAACG CTGCTTTTTA

1151 AATTCTTTAA TTACCTCCCC CTGCCCGAAC TGACGAGCAT CGTCAGCCTG

1201 CTGGTCATTT CCCTGTTTTT TGTAACTTCT GCCGACTCCG GGATTTATGT

1251 CCTGAACAAT ATTACCTCTC GGGACAAAGG CTTGAGCGCG CCACGGTGGC

1301 AGGCGGTTAT GTGGGCGTG CTGatgtcTG CCGTTGCCGT TTTGCTGATG

1351 CGCTCGGGCG GACTCGGCAA CCTGCAGTCT ATGACCCTGA TTGTTTCCCT

1401 GCCGTTTGCC CTGCTGATGC TGATAATGTG TTTCAGCCTG TGGAAAGGCT

1451 TGAGTGCGGA TAAGAAATAT TTTGAGACCC GGGTCAACCC TACCAGTGTA

1501 TTTTGGACGG GCGGCAAGTG GAAAGAACGG CTGGTGCGGA TAATGAGCCA

1551 GACGCAGGAG CAGGATATTT TAAAATTCCT CAAACATACC GCATCGCCCG

1601 CTATGCACGA GTTGCAACGG GAGCTTTCGG AAGAATACGG CTTGAGCGTC

1651 CGGGTCGATA AGATGTTTCA TCAGGACGAG CCCGCAATCG AGTTCGTCAT

1701 TCGGAAAGAG ACGATGCGCG ATTTTATGTA CGGGATTAAG TCTGTCGGGC

1751 AGGATGTATC CGACCAGTTG ATTAACGACG GCAAGCTGCC GCATATCCGG

1801 CACCAGACAA CTTACAAACC CTACGCTTAT TTTTTCGACG GGCGCGTCGG

1851 GTACGATGTG CAGTATATGA ACAAGGACGA GCTGATTGCC GACATTTTGA

1901 AAAACTACGA ACGTTATTTG ATGTTGTTGG ATGATGTCGG TCAGGAACTG

1951 ATGGCGCACG AGCAGGTGGA ATTGGCAGAG TAA
                                                      55
```

This corresponds to the amino acid sequence <SEQ ID 674; ORF 163.ng>:

```
g163.pep
  1 MVILTTLFFV CVLVVLVLTV PDQVQMWLDR AKEVIFTEFS WFYVLTFSIF

51 LGFLLILSVS GLGNIRLGRD EDVPEFGFLS WLAMLFAAGM GVGLMFFGVA

101 EPLMHYFSDI TVGAPEHRQQ QALLHTVFHW GVHAWSVYGT IALALAYFGF

151 RYKLPLALRS CFYPLLKEKI SGRFGDAIDI MALLATFFGI ITTLGFGASQ
```

-continued

```
201 LGAGLQEMGW IAENSFGVQV LIIAAVMSLA VVSAISGVGK GVKVLSELNL
251 GLAFLLLFFV LAADPTVYLL SAFGDNIGNY LGNLVRLSLK TYAYEREHKP
301 WFESWTVLYW AWWCSWAPFV GLFIARISKG RTIREFVFGV LLIPGLFGVL
351 WFTVFGNTAI WLNDGVAGGM LEKMTSSPET LLFKFFNYLP LPELTSIVSL
401 LVISLFFVTS ADSGIYVLNN ITSRDKGLSA PRWQAVMWGV LMSAVAVLLM
451 RSGGLGNLQS MTLIVSLPFA LLMLIMCFSL WKGLSADKKY FETRVNPTSV
501 FWTGGKWKER LVRIMSQTQE QDILKFLKHT ASPAMHELQR ELSEEYGLSV
551 RVDKMFHQDE PAIEFVIRKE TMRDFMYGIK SVGQDVSDQL INDGKLPHIR
601 HQTTYKPYAY FFDGRVGYDV QYMNKDELIA DILKNYERYL MLLDDVGQEL
651 MAHEQVELAE *
```

The following partial DNA sequence was identified in *N. meningitidis* <SEQ ID 675>:

```
m163.seq
   1 ATGGTTATTT TGACGACTTT GTTTTTTGTG TGTGTTTTGG TGGTATTGGT
  51 TTTAACCGTG CCGGATCAGG TGCAGATGTG GCTCGATCGG GCAAAAGAAG
 101 TCATTTTTAC CGAGTTCAGC TGGTTTTATG TTTTAACGTT TTCCATTTTT
 151 CTGGGTTTCC TGCTGATACT CTCGGTCAGC AGTTTGGGAA ACATCAGGCT
 201 CGGACGGGAT GAAGATGTGC CGGAATTCGG CTTCCTGTCG TGGCTGGCGA
 251 TGCTGTTTGC GGCCGGGATG GGCGTGGGTC TGATGTTTTT CGGCGTGGCA
 301 GAGCCGTTGA TGCATTATTT TTCGGACATT ACGGCCGGCA CGCCGGAACA
 351 CAGGCAGCAG CAGGCATTGC TGCACACGGT GTTCCATTGG GGCGTTCACG
 401 CTTGGTCGGT GTACGGTACG ATTGCATTGG CTTTGGCTTA TTTCGGTTTC
 451 CGCTACAAGC TGCCGCTTGC CCTGCGTTCT TGTTTTTACC CCCTGTTGAA
 501 AGAAAAAATT TCCGGAAGGT TCGGCGATGC CATTGATATT ATGGCGTTGC
 551 TTGCTACTTT TTTCGGCATC ATCACCACAT TGGGGTTCGG GGCTTCGCAA
 601 CTGGGCGCCG GATTGCAGGA AATGGGCTGG ATTGCCGAAA ACAGCTTCAG
 651 CGTGCAGGTT TTGATTATCG CCGCCGTCAT GTCCCTCGCC GTCGTTTCGG
 701 CAATATCCGG CGTGGGGAAG GGCGTGAAGG TGTTGAGCGA GTTGAACCTG
 751 GGCCTTGCGT TTTTGCTGCT GTTTTTTGTT TTGGCGGCGG GACCCACTGT
 801 TTACCTGTTG TCGGCATTCG GCGACAACAT AGGGAACTAC CTCGGAAATC
 851 TGGTGCGCCT CAGTTTTAAA ACTTATGCGT ACGAACGGGA ACACAAGCCG
 901 TGGTTTGAAT CTTGGACGGT GCTTTATTGG GCGTGGTGGT GTTCTTGGGC
 951 GCCGTTTGTG GGTTTGTTTA TCGCGCGCAT TTCAAAGGGG CGCACCATCC
1001 GCGAGTTTGT CTTCGGGGTT TTGCTCATCC CCGGCCTGTT CGGCGTTTTG
1051 TGGTTTACCG TCTTCGGCAA TACGGCGATT TGGCTGAATG ACGGGGTTGC
1101 GGGGGGAATG CTCGAAAAGA TGACCTCCTC TCCGGAAACG CTGCTTTTTA
1151 AATTCTTTAA TTACCTCCCC CTGCCCGAAT TGACGAGCAT CGTCAGCCTG
1201 CTGGTCATTT CTCTGTTTTT TGTAACTTCT GCCGATTCCG GGATTTATGT
1251 CCTGAACAAT ATTACCTCTC GGGACAAAGG CTTGAGCGCG CCACGGTGGC
1301 AGGCGGTTAT GTGGGGCGTG CTGATGTCTG CCGTTGCCGT TTTGCTGATG
```

```
1351 CGCTCGGGCG GACTCGGCAA CCTGCAGTCT ATGACCCTGA TTGTTTCCCT

1401 GCCGTTTGCC CTGCTGATGC TGATAATGTG TTTCAGCCTG TGGAAAGGCT

1451 TGAGTGCGGA TAAGAAATAT TTTGAGACCC GGGTTAACCC TACCAGTGTA

1501 TTTTGGACGG GCGGCAAGTG GAAAGAACGG CTGGTGCAGA TAATGAGCCA

1551 GACGCAGGAG CAGGATATTT TAAAATTCCT CAAACAGACT GCATCGCCCG

1601 CTATGCACGA GTTGCAACGG GAGCTTTCGG AAGAATACGG CTTGAGCGTC

1651 CGGGTCGATA AAATGTTTCA TCGGGACGAG CCCGCAATCG AGTTCGTCAT

1701 TCGGAAAGAG ACGATGCGCG ATTTTATGTA CGGGATTAAG TCTGTCGGGC

1751 AGGATGTATC CGACCAGTTG ATTAACGACG GCAAGCTGCC GCATATCCGG

1801 CATCAGACAA CTTACAAACC CTACGCTTAT TTTTTCGACG GGCGCGTCGG

1851 GTACGATGTG CAGTATATGA ACAAGGACGA GCTGATTGCC GACATTTTGA

1901 AAAACTACGA ACGTTATTTG ATGTTGTTGG ATGATGTCGG TCAGGAACTG

1951 ATGGCGCACG AGCAGGTGGA ATTGGCAGAG TAA
```

This corresponds to the amino acid sequence <SEQ ID 676; ORF 163>:

```
m163.pep
  1 MVILTTLFFV CVLVVLVLTV PDQVQMWLDR AKEVIFTEFS WFYVLTFSIF

51 LGFLLILSVS SLGNIRLGRD EDVPEFGFLS WLAMLFAAGM GVGLMFFGVA

101 EPLMHYFSDI TAGTPEHRQQ QALLHTVFHW GVHAWSVYGT IALALAYFGF

151 RYKLPLALRS CFYPLLKEKI SGRFGDAIDI MALLATFFGI ITTLGFGASQ

201 LGAGLQEMGW IAENSFSVQV LIIAAVMSLA VVSAISGVGK GVKVLSELNL

251 GLAFLLLFFV LAAGPTVYLL SAFGDNIGNY LGNLVRLSFK TYAYEREHKP

301 WFESWTVLYW AWWCSWAPFV GLFIARISKG RTIREFVFGV LLIPGLFGVL

351 WFTVFGNTAI WLNDGVAGGM LEKMTSSPET LLFKFFNYLP LPELTSIVSL

401 LVISLFFVTS ADSGIYVLNN ITSRDKGLSA PRWQAVMWGV LMSAVAVLLM

451 RSGGLGNLQS MTLIVSLPFA LLMLIMCFSL WKGLSADKKY FETRVNPTSV

501 FWTGGKWKER LVQIMSQTQE QDILKFLKQT ASPAMHELQR ELSEEYGLSV

551 RVDKMFHRDE PAIEFVIRKE TMRDFMYGIK SVGQDVSDQL INDGKLPHIR

601 HQTTYKPYAY FFDGRVGYDV QYMNKDELIA DILKNYERYL MLLDDVGQEL

651 MAHEQVELAE *
```

Computer analysis of this amino acid sequence gave the following results:
Homology with a Predicted ORF from *N. gonorrhoeae*

```
    m163/g163    98.6% identity in 660 aa overlap
                      10         20         30         40         50         60
    m163.pep   MVILTTLFFVCVLVVLVLTVPDQVQMWLDRAKEVIFTEFSWFYVLTFSIFLGFLLILSVS
               ||||||||||||||||||||||||||||||||||||||||||||||||||||||||||||
    g163       MVILTTLFFVCVLVVLVLTVPDQVQMWLDRAKEVIFTEFSWFYVLTFSIFLGFLLILSVS
                      10         20         30         40         50         60

70         80         90        100        110        120
    m163.pep   SLGNIRLGRDEDVPEFGFLSWLAMLFAAGMGVGLMFFGVAEPLMHYFSDITAGTPEHRQQ
               :||||||||||||||||||||||||||||||||||||||||||||||||||||:::||||
    g163       GLGNIRLGRDEDVPEFGFLSWLAMLFAAGMGVGLMFFGVAEPLMHYFSDITVGAPEHRQQ
                      70         80         90        100        110        120
```

```
              130       140       150       160       170       180
m163.pep  QALLHTVFHWGVHAWSVYGTIALALAYFGFRYKLPLALRSCFYPLLKEKISGRFGDAIDI
          ||||||||||||||||||||||||||||||||||||||||||||||||||||||||||||
g163      QALLHTVFHWGVHAWSVYGTIALALAYFGFRYKLPLALRSCFYPLLKEKISGRFGDAIDI
              130       140       150       160       170       180

190       200       210       220       230       240
m163.pep  MALLATFFGIITTLGFGASQLGAGLQEMGWIAENSFSVQVLIIAAVMSLAVVSAISGVGK
          |||||||||||||||||||||||||||||||||||||:||||||||||||||||||||||
g163      MALLATFFGIITTLGFGASQLGAGLQEMGWIAENSFGVQVLIIAAVMSLAVVSAISGVGK
              190       200       210       220       230       240

250       260       270       280       290       300
m163.pep  GVKVLSELNLGLAFLLLFFVLAAGPTVYLLSAFGDNIGNYLGNLVRLSFKTYAYEREHKP
          ||||||||||||||||||||||||:|||||||||||||||||||||||||:|||||||||
g163      GVKVLSELNLGLAFLLLFFVLAADPTVYLLSAFGDNIGNYLGNLVRLSLKTYAYEREHKP
              250       260       270       280       290       300

310       320       330       340       350       360
m163.pep  WFESWTVLYWAWWCSWAPFVGLFIARISKGRTIREFVFGVLLIPGLFGVLWFTVFGNTAI
          ||||||||||||||||||||||||||||||||||||||||||||||||||||||||||||
g163      WFESWTVLYWAWWCSWAPFVGLFIARISKGRTIREFVFGVLLIPGLFGVLWFTVFGNTAI
              310       320       330       340       350       360

370       380       390       400       410       420
m163.pep  WLNDGVAGGMLEKMTSSPETLLFKFFNYLPLPELTSIVSLLVISLFFVTSADSGIYVLNN
          ||||||||||||||||||||||||||||||||||||||||||||||||||||||||||||
g163      WLNDGVAGGMLEKMTSSPETLLFKFFNYLPLPELTSIVSLLVISLFFVTSADSGIYVLNN
              370       380       390       400       410       420

430       440       450       460       470       480
m163.pep  ITSRDKGLSAPRWQAVMWGVLMSAVAVLLMRSGGLGNLQSMTLIVSLPFALLMLIMCFSL
          ||||||||||||||||||||||||||||||||||||||||||||||||||||||||||||
g163      ITSRDKGLSAPRWQAVMWGVLMSAVAVLLMRSGGLGNLQSMTLIVSLPFALLMLIMCFSL
              430       440       450       460       470       480

490       500       510       520       530       540
m163.pep  WKGLSADKKYFETRVNPTSVFWTGGKWKERLVQIMSQTQEQDILKFLKQTASPAMHELQR
          ||||||||||||||||||||||||||||||||:|||||||||||||:|||||||||||||
g163      WKGLSADKKYFETRVNPTSVFWTGGKWKERLVRIMSQTQEQDILKFLKHTASPAMHELQR
              490       500       510       520       530       540

550       560       570       580       590       600
m163.pep  ELSEEYGLSVRVDKMFHRDEPAIEFVIRKETMRDFMYGIKSVGQDVSDQLINDGKLPHIR
          ||||||||||||||||||:|||||||||||||||||||||||||||||||||||||||||
g163      ELSEEYGLSVRVDKMFHQDEPAIEFVIRKETMRDFMYGIKSVGQDVSDQLINDGKLPHIR
              550       560       570       580       590       600

610       620       630       640       650       660
m163.pep  HQTTYKPYAYFFDGRVGYDVQYMNKDELIADILKNYERYLMLLDDVGQELMAHEQVELAE
          ||||||||||||||||||||||||||||||||||||||||||||||||||||||||||||
g163      HQTTYKPYAYFFDGRVGYDVQYMNKDELIADILKNYERYLMLLDDVGQELMAHEQVELAE
              610       620       630       640       650       660 m163.pep  X
          |
g163      X
```

The following partial DNA sequence was identified in *N. meningitidis* <SEQ ID 677>:

```
a163.seq
  1 ATGGTTATTT TGACGACTTT GTTTTTTGTG TGTGTTTTGG TGGTATTGGT

51 TTTAACCGTG CCGGATCAGG TGCAGATGTG GCTCGATCGG GCAAAAGAAG

101 TCATTTTTAC CGAGTTCAGC TGGTTTTATG TTTTAACGTT TTCCATTTTT

151 CTGGGTTTCC TGCTGATACT CTCGGTCAGC AGTTTGGGAA ACATCAGGCT

201 CGGACGGGAT GAAGATGTGC CGGAATTCGG CTTCCTGTCG TGGCTGGCGA

251 TGCTGTTTGC GGCCGGGATG GGCGTGGGTC TGATGTTTTT CGGCGTGGCA

301 GAGCCGTTGA TGCATTATTT TTCGGACATT ACGGCCGGCA CGCCGGAACA

351 CAGGCAGCAG CAGGCATTGC TGCACACGGT GTTCCATTGG GGCGTTCACG

401 CTTGGTCGGT GTACGGTACG ATTGCATTGG CTTTGGCTTA TTTCGGTTTC

451 CGCTACAAGC TGCCGCTTGC CCTGCGTTCT TGTTTTTACC CCCTGTTGAA

501 AGAAAAAATT TCCGGAAGGT TCGGCGATGC CATTGATATT ATGGCGTTGC
```

```
                                     -continued
 551 TTGCTACTTT TTTCGGCATC ATCACCACAT TGGGGTTCGG GGCTTCGCAA

601 CTGGGCGCCG GATTGCAGGA AATAGGCTGG ATTGCCGAAA ACAGCTTCAG

651 CGTGCAGGTT TTGATTATCG CCGCCGTCAT GTCCCTCGCC GTCGTTTCGG

701 CAATATCCGG CGTGGGGAAG GGTGTGAAGG TGTTGAGCGA GTTGAACCTG

751 GGTCTTGCGT TTTTGCTGCT GTTTTTTGTT TTGGCGGCGG GTCCCACTGT

801 TTACCTGTTG TCGGCATTCG GCGACAACAT AGGGAACTAC CTCGGAAATC

851 TGGTGCGCCT CAGTTTTAAA ACTTATGCGT ACGAACGGGA ACACAAGCCG

901 TGGTTTGAAT CTTGGACGGT GCTTTATTGG GCGTGGTGGT GTTCTTGGGC

951 GCCGTTTGTG GGTTTGTTTA TCGCGCGCAT TTCAAAGGGG CGCACCATCC

1001 GCGAGTTTGT CTTCGGGGTT TTGCTCATCC CCGGCCTGTT CGGCGTTTTG

1051 TGGTTTACCG TCTTCGGCAA TACGGCGATT TGGCTGAATG ACGGGGTTGC

1101 GGGGGGAGTG CTCGAAAAGA TGACCTCCTC TCCGGAAACG CTGCTTTTTA

1151 AATTCTTTAA TTACCTCCCC CTGCCCGAAT TGACGAGCAT CGTCAGCCTG

1201 CTGGTCATTT CTCTGTTTTT TGTAACTTCT GCCGATTCCG GGATTTATGT

1251 CCTGAACAAT ATTACCTCTC GGGACAAAGG CTTGAGCGCG CCACGGTGGC

1301 AGGCGGTTAT GTGGGGCGTG CTGATGTCTG CCGTTGCCGT TTTGCTGATG

1351 CGCTCGGGCG GACTCGGCAA CCTGCAGTCT ATGACCCTGA TTGTTTCCCT

1401 GCCGTTTGCC CTGCTGATGC TGATAATGTG TTTCAGCCTG TGGAAAGGAT

1451 TGAGTGCGGA TAAGAAATAT TTTGAGACCC GGGTTAACCC TACCAGTGTA

1501 TTTTGGACGG GCGGCAAGTG GAAAGAACGG CTGGTGCAGA TAATGAGCCA

1551 GACGCAGGAG CAGGATATTT TAAAATTCCT CAAACATACC GCATCGCCCG

1601 CTATGCACGA GTTACAACGG GAGCTTTCGG AAGAATACGG CTTGAGCGTC

1651 CGGGTCGATA AGATGTTTCA TCAGGACGAG CCCGCAATCG AGTTCGTCAT

1701 TCGGAAAGAG ACGATGCGCG ATTTTATGTA CGGGATTAAG TCTGTCGGGC

1751 AGGATGTATC CGACCAGTTG ATTAACGACG GCAAGCTGCC GCATATCCGG

1801 CATCAGACAA CTTACAAACC CTACGCTTAT TTTTTCGACG GGCGCGTCGG

1851 GTACGATGTG CAGTATATGA ACAAGGACGA GCTGATTGCC GACATTTTGA

1901 AAAACTACGA ACGTTATTTG ATGTTGTTGG ATGATGTCGG TCAGGAACTG

1951 ATGGCGCACG AGCAGGTGGA ATTGGCAGAG TAA
```

This corresponds to the amino acid sequence <SEQ ID 678; ORF 163.a>:

```
    a163.pep

1 MVILTTLFFV CVLVVLVLTV PDQVQMWLDR AKEVIFTEFS WFYVLTFSIF

51 LGFLLILSVS SLGNIRLGRD EDVPEFGFLS WLAMLFAAGM GVGLMFFGVA

101 EPLMHYFSDI TAGTPEHRQQ QALLHTVFHW GVHAWSVYGT IALALAYFGF

151 RYKLPLALRS CFYPLLKEKI SGRFGDAIDI MALLATFFGI ITTLGFGASQ

201 LGAGLQEIGW IAENSFSVQV LIIAAVMSLA VVSAISGVGK GVKVLSELNL

251 GLAFLLLFFV LAAGPTVYLL SAFGDNIGNY LGNVRLSFK TYAYEREHKP

301 WFESWTVLYW AWWCSWAPFV GLFIARISKG RTIREVFGV LLIPGLFGVL

351 WFTVFGNTAI WLNDGVAGGV LEKMTSSPET LLFKFFNYLP LPELTSIVSL
```

```
401 LVISLFFVTS ADSGIYVLNN ITSRDKGLSA PRWQAVMWGV LMSAVAVLLM

451 RSGGLGNLQS MTLIVSLPFA LLMLIMCFSL WKGLSADKKY FETRVNPTSV

501 FWTGGKWKER LVQIMSQTQE QDILKFLKHT ASPAMHELQR ELSEEYGLSV

551 RVDKMFHQDE PAIEFVIRKE TMRDFMYGIK SVGQDVSDQL INDGKLPHIR

601 HQTTYKPYAY FFDGRVGYDV QYMNKDELIA DILKNYERYL MLLDDVGQEL

651 MAHEQVELAE *
```

```
m163/a163   99.4% identity in 660 aa overlap 10        20        30        40        50        60
m163.pep   MVILTTLFFVCVLVVLVLTVPDQVQMWLDRAKEVIFTEFSWFYVLTFSIFLGFLLILSVS
           ||||||||||||||||||||||||||||||||||||||||||||||||||||||||||||
a163       MVILTTLFFVCVLVVLVLTVPDQVQMWLDRAKEVIFTEFSWFYVLTFSIFLGFLLILSVS
                   10        20        30        40        50        60

70        80        90       100       110       120
m163.pep   SLGNIRLGRDEDVPEFGFLSWLAMLFAAGMGVGLMFFGVAEPLMHYFSDITAGTPEHRQQ
           ||||||||||||||||||||||||||||||||||||||||||||||||||||||||||||
a163       SLGNIRLGRDEDVPEFGFLSWLAMLFAAGMGVGLMFFGVAEPLMHYFSDITAGTPEHRQQ
                   70        80        90       100       110       120

130       140       150       160       170       180
m163.pep   QALLHTVFHWGVHAWSVYGTIALALAYFGFRYKLPLALRSCFYPLLKEKISGRFGDAIDI
           ||||||||||||||||||||||||||||||||||||||||||||||||||||||||||||
a163       QALLHTVFHWGVHAWSVYGTIALALAYFGFRYKLPLALRSCFYPLLKEKISGRFGDAIDI
                  130       140       150       160       170       180

190       200       210       220       230       240
m163.pep   MALLATFFGIITTLGFGASQLGAGLQEMGWIAENSFSVQVLIIAAVMSLAVVSAISGVGK
           |||||||||||||||||||||||||||||||:||||||||||||||||||||||||||||
a163       MALLATFFGIITTLGFGASQLGAGLQEIGWIAENSFSVQVLIIAAVMSLAVVSAISGVGK
                  190       200       210       220       230       240

250       260       270       280       290       300
m163.pep   GVKVLSELNLGLAFLLLFFVLAAGPTVYLLSAFGDNIGNYLGNLVRLSFKTYAYEREHKP
           ||||||||||||||||||||||||||||||||||||||||||||||||||||||||||||
a163       GVKVLSELNLGLAFLLLFFVLAAGPTVYLLSAFGDNIGNYLGNLVRLSFKTYAYEREHKP
                  250       260       270       280       290       300

310       320       330       340       350       360
m163.pep   WFESWTVLYWAWWCSWAPFVGLFIARISKGRTIREFVFGVLLIPGLFGVLWFTVFGNTAI
           ||||||||||||||||||||||||||||||||||||||||||||||||||||||||||||
a163       WFESWTVLYWAWWCSWAPFVGLFIARISKGRTIREFVFGVLLIPGLFGVLWFTVFGNTAI
                  310       320       330       340       350       360

370       380       390       400       410       420
m163.pep   WLNDGVAGGMLEKMTSSPETLLFKFFNYLPLPELTSIVSLLVISLFFVTSADSGIYVLNN
           ||||||||||:|||||||||||||||||||||||||||||||||||||||||||||||||
a163       WLNDGVAGGVLEKMTSSPETLLFKFFNYLPLPELTSIVSLLVISLFFVTSADSGIYVLNN
                  370       380       390       400       410       420

430       440       450       460       470       480
m163.pep   ITSRDKGLSAPRWQAVMWGVLMSAVAVLLMRSGGLGNLQSMTLIVSLPFALLMLIMCFSL
           ||||||||||||||||||||||||||||||||||||||||||||||||||||||||||||
a163       ITSRDKGLSAPRWQAVMWGVLMSAVAVLLMRSGGLGNLQSMTLIVSLPFALLMLIMCFSL
                  430       440       450       460       470       480

490       500       510       520       530       540
m163.pep   WKGLSADKKYFETRVNPTSVFWTGGKWKERLVQIMSQTQEQDILKFLKQTASPAMHELQR
           |||||||||||||||||||||||||||||||||||||||||||||||:||||||||||||
a163       WKGLSADKKYFETRVNPTSVFWTGGKWKERLVQIMSQTQEQDILKFLKHTASPAMHELQR
                  490       500       510       520       530       540

550       560       570       580       590       600
m163.pep   ELSEEYGLSVRVDKMFHRDEPAIEFVIRKETMRDFMYGIKSVGQDVSDQLINDGKLPHIR
           |||||||||||||||||:||||||||||||||||||||||||||||||||||||||||||
a163       ELSEEYGLSVRVDKMFHQDEPAIEFVIRKETMRDFMYGIKSVGQDVSDQLINDGKLPHIR
                  550       560       570       580       590       600

610       620       630       640       650       660
m163.pep   HQTTYKPYAYFFDGRVGYDVQYMNKDELIADILKNYERYLMLLDDVGQELMAHEQVELAE
           ||||||||||||||||||||||||||||||||||||||||||||||||||||||||||||
a163       HQTTYKPYAYFFDGRVGYDVQYMNKDELIADILKNYERYLMLLDDVGQELMAHEQVELAE
                  610       620       630       640       650       660 m163.pep   X
           |
a163       X
```

The following partial DNA sequence was identified in *N. gonorrhoeae* <SEQ ID 679>:

```
g164.seq (partial)
    1 . . . ATGAACACAT TTTTGAAAAA CAGCGAATAC GCGTATATCC TGAACGACTG
   51       CAAGGCGCGC TTCCTGTTCG CCTCGGCCGG CCTGTCAAAA GAATTGGCGG
  101       GCCTGAAGGC GCAAACGCCC GTCGAAAAAA TCATTTGGAC GGACAAAAGC
  151       CGGCCGGCCG GCGAAACGGC GGAAGGCGAT GCCTTTTTTG AAAACGTGCG
  201       CCGCTTCCCC GAAAAACCCG ACTTGGGCCG CCAACCCCGG ATAAATGATT
  251       TGGCACACAT CATCTACACC TCCGGCACGA CGGGGCATCC CAAAGGCGCG
  301       CTAATCAGTT ACGCCAACCT GTTCGCCAAC CTGAACGGCA TCGAACGCAT
  351       CTTtaaAATT TCCAAACGCG ACCGCTTTAT CGTTTTCctg ccgatgTTCC
  401       ACAGCTTCAC GCTGACGGCT ATGGTGCTGC TGCCGATTTA TATGGCGTGT
  451       TCGATTATTT TGGTCAAAtc cgttttCCCc ttttccaacG TTTTGAAACA
  501       GGCCCTGCTC AAACGCGCAA CCGTGTTTTT GGGCGTACCC GCGATTTACA
  551       CCGCGATGAG CAAGGCAAAA ATCCCTTGGT ATTTCAGATG GTTCAACCGC
  601       ATCCGCCTGT TTATCAGCGG CGGCGCGCCT TTGGCGGAAC AAACCATCCT
  651       CGATTTTAAA GCCAAGTTCC CCCGCGCCAA ATTGCTGGAA GGCTACGGAC
  701       TGAGCGAAGC CTCGCCCGTC GTCGCCGTCA ATACGCCCGA ACGGCAAAAA
  751       GCCCGCAGCG TCGGCATCCC CCTGCCCGGT TTGGAAGCCA AGCCGTCGA
  801       TGAAGAATTG GTCGAAGTGC CGCGCGGCGA AGTGGGCGAA CTGATCGTCA
  851       GGGGCGGTTC GGTGATGCGG GGCTACCTCA ATATGCCTGC CGCCACCGAT
  901       GAAACCATCG TCAACGGCTG GTTGAAAACG GGCGATTTCG TTACCATAGA
  951       CGAGGACGGC TTTATCTTTA TCGTCGACCG CAAAAAAGAT TTGATTATTT
 1001       CCAAAGGTCA AAACGTCTAT CCGCGCGAGA TCGAAGAAGA AATCCACAAA
 1051       CTCGATGCCG TCGAAGCCGC CGCCGTCATC GGCGTGAAAG ACCGTTATGC
 1101       CGACGAGGAA ATCGTCGCCT TCGTCCAATT GAAGGAAGGT ATGGATTTGG
 1151       GCGAGGACGA aatccgccgc caccTGCGTA CCGTGCTGGC AAATTTCAAA
 1201       ATCCCCAAAC AGATCCACTT TAAAGACGGG CTGCCGCGCA ACGCTACGGG
 1251       CAAAGTATTG AAACGGGTGC TGAAGGAGCA GTTTGAAGGA AACAAATGA
```

This corresponds to the amino acid sequence <SEQ ID 680; ORF 164.ng>:

```
g164.pep (partial)
    1 . . . MNTFLKNSEY AYILNDCKAR FLFASAGLSK ELAGLKAQTP VEKIIWTDKS
   51       RPAGETAEGD AFFENVRRFP EKPDLGRQPR INDLAHIIYT SGTTGHPKGA
  101       LISYANLFAN LNGIERIFKI SKRDRFIVFL PMFHSFTLTA MVLLPIYMAC
  151       SIILVKSVFP FSNVLKQALL KRATVFLGVP AIYTAMSKAK IPWYFRWFNR
  201       IRLFISGGAP LAEQTILDFK AKFPRAKLLE GYGLSEASPV VAVNTPERQK
  251       ARSVGIPLPG LEAKAVDEEL VEVPRGEVGE LIVRGGSVMR GYLNMPAATD
  301       ETIVNGWLKT GDFVTIDEDG FIFIVDRKKD LIISKGQNVY PREIEEEIHK
  351       LDAVEAAAVI GVKDRYADEE IVAFVQLKEG MDLGEDEIRR HLRTVLANFK
  401       IPKQIHFKDG LPRNATGKVL KRVLKEQFEG NK*
```

The following partial DNA sequence was identified in *N. meningitidis* <SEQ ID 681>:

```
m164.seq
   1 ATGAACCGGA CTTATGCCAA TTTCTACGAA ATGCTCGCCG CCGCCTGCCG

51 CAAAAACGGA AACGGCACGG CAGTGTTCGA CGGCAAGGAA AAAACCGCCT

101 ACCGCGCGCT CAAGCAGGAG GCCGAAGCCG TCGCGGCGTA TCTGCAAAAT

151 ATCGGCGTGA AGTTCGGCGA CACGGTCGCG CTGGCGGTTT CCAATTCCAC

201 AGAATTTATT ACCGCCTATT TCGCCATCTC CGCCATCGGC GCGGTCGCCG

251 TACCGATGAA CACATTTTTG AAAAACAGCG AATACGCGTA TATCCTGAAC

301 GACTGCAAGG CGCGCTTCCT GTTCGCCTCG GCCGGCCTGT CAAAAGAATT

351 GGCGGGCTTG AAGGCGCAAA CGCCCGTCGA AAAAATCATT TGGACGGACA

401 AAAGCCGTCC GACCGGCGAA ACGGCGGAAG GCGATGCCTT TTTTGAAGAC

451 GTGCGCCGCT TCCCCGAAAA ACCCGACTTG GGCCGCCAAC CCCGGATAAA

501 TGATTTGGCA CACATCATCT ACACCTCCGG CACGACGGGG CATCCCAAAG

551 GCGCGCTAAT CAGTTACGCC AACCTGTTCG CCAACCTGAA CGGCATCGAA

601 CGCATCTTTA AAATTTCCAA GCGCGACCGC TTTATCGTTT TCCTGCCGAT

651 GTTCCACAGC TTCACGCTGA CGGCTATGGT GCTGCTGCCG ATTTATATGG

701 CGTGTTCGAT TATTTTGGTC AAATCCGTTT TTCCGTTTTC CAACGTTTTG

751 AAACAGACAC TGCTCAAACG CGCGACCGTG TTTTTGGGCG TACCCGCGAT

801 TTACACCGCG ATGAGCAAGG CGAAAATCCC TTGGTATTTC AGATGGTTCA

851 ACCGCATTCG CCTGTTTATC AGCGGCGGCG CGCCTTTGGC GGAACAAACC

901 ATCCTCGATT TCAAAGCCAA GTTCCCCCGC GCCAAATTGC TGGAAGGCTA

951 CGGACTGAGC GAAGCCTCTC CCGTCGTCGC CGTCAATACG CCCGAGAGGC

1001 AAAAAGCCCG CAGCGTCGGC ATCCCCCTGC CCGGTTTGGA AGCCAAAGCC

1051 GTCGATGAAG AATTGGTCGA AGTGCCGCGC GGCGAAGTGG GCGAACTGAT

1101 CGTCAGGGGC GGTTCGGTGA TGCGGGGCTA CCTCAATATG CCTGCCGCCA

1151 CCGATGAAAC CATCGTCAAC GGCTGGTTGA AAACGGGCGA TTTCGTTACC

1201 ATAGACGAAG ACGGCTTTAT CTTTATCGTC GACCGCAAAA AAGATTTGAT

1251 TATTTCCAAA GGTCAAAATG TCTATCCGCG CGAGATTGAA GAAGAAATCT

1301 ACAAACTCGA TGCCGTCGAA GCCGCCGCCG TCATCGGCGT GAAAGACCGT

1351 TATGCCGACG AGGAAATCGT CGCCTTCGTC CAATTGAAGG AAGGTATGGA

1401 TTTGGGCGAG AACGAAATCC GCCGCCACCT GCGTACCGTG CTGGCAAATT

1451 TCAAAATCCC CAAACAAATC CACTTTAAAG ACGGGCTGCC GCGCAACGCT

1501 ACGGGCAAGG TATTGAAACG GGTGTTGAAG GAGCAGTTTG ACGGAAACAA

1551 ATGA
```

This corresponds to the amino acid sequence <SEQ ID 682; ORF 164>:

```
m164.pep
  1  MNRTYANFYE MLAAACRKNG NGTAVFDGKE KTAYRALKQE AEAVAAYLQN

51  IGVKFGDTVA LAVSNSTEFI TAYFAISAIG AVAVPMNTFL KNSEYAYILN

101  DCKARFLFAS AGLSKELAGL KAQTPVEKII WTDKSRPTGE TAEGDAFFED
```

```
151 VRRFPEKPDL GRQPRINDLA HIIYTSGTTG HPKGALISYA NLFANLNGIE

201 RIFKISKRDR FIVFLPMFHS FTLTAMVLLP IYMACSIILV KSVFPFSNVL

251 KQTLLKRATV FLGVPAIYTA MSKAKIPWYF RWFNRIRLFI SGGAPLAEQT

301 ILDFKAKFPR AKLLEGYGLS EASPVVAVNT PERQKARSVG IPLPGLEAKA

351 VDEELVEVPR GEVGELIVRG GSVMRGYLNM PAATDETIVN GWLKTGDFVT

401 IDEDGFIFIV DRKKDLIISK GQNVYPREIE EEIYKLDAVE AAAVIGVKDR

451 YADEEIVAFV QLKEGMDLGE NEIRRHLRTV LANFKIPKQI HFKDGLPRNA

501 TGKVLKRVLK EQFDGNK*
```

Computer analysis of this amino acid sequence gave the following results:
Homology with a Predicted ORF from *N. gonorrhoeae* m164/g164 98.6% identity in 432 aa overlap

```
                60         70         80         90        100        110
m164.pep GDTVALAVSNSTEFITAYFAISAIGAVAVPMNTFLKNSEYAYILNDCKARFLFASAGLSK
                                        ||||||||||||||||||||||||||||||
g164                                    MNTFLKNSEYAYILNDCKARFLFASAGLSK
                                                10        20        30
               120        130        140        150        160        170
m164.pep ELACLKAQTPVEKIIWTDKSRPTCETAECDAFFEDVRRFPEKPDLCRQPRINDLAHIIYT
         |||| |||||||||||||||||||| ||| |||||| |||||||||| |||||||||||
g164     ELAGLKAQTPVEKIIWTDKSRPAGETAEGDAFFENVRRFPEKPDLGRQPRINDLAHIIYT
                 40        50        60        70        80        90
               180        190        200        210        220        230
m164.pep SGTTGHPKGALISYANLFANLNGIERIFKISKRDRFIVFLPMFHSFTLTAMVLLPIYMAC
         ||||||||||||||||||||||||||||||||||||||||||||||||||||||||||||
g164     SGTTGHPKGALISYANLFANLNGIERIFKISKRDRFIVFLPMFHSFTLTAMVLLPIYMAC
                100       110       120       130       140       150
               240        250        260        270        280        290
m164.pep SIILVKSVFPFSNVLKQTLLKRATVFLGVPAIYTAMSKAKIPWYFRWFNRIRLFISGGAP
         ||||||||||||||||| |||||||||||||||||||||||||||||||||||||||||
g164     SIILVKSVFPFSNVLKQALLKRATVFLGVPAIYTAMSKAKIPWYFRWFNRIRLFISGGAP
                160       170       180       190       200       210
               300        310        320        330        340        350
m164.pep LAEQTILDFKAKFPRAKLLEGYGLSEASPVVAVNTPERQKARSVGIPLPGLEAKAVDEEL
         ||||||||||||||||||||||||||||||||||||||||||||||||||||||||||||
g164     LAEQTILDFKAKFPRAKLLEGYGLSEASPVVAVNTPERQKARSVGIPLPGLEAKAVDEEL
                220       230       240       250       260       270
               360        370        380        390        400        410
m164.pep VEVPRGEVGELIVRGGSVMRGYLNMPAATDETIVNGWLKTGDFVTIDEDGFIFIVDRKKD
         ||||||||||||||||||||||||||||||||||||||||||||||||||||||||||||
g164     VEVPRGEVGELIVRGGSVMRGYLNMPAATDETIVNGWLKTGDFVTIDEDGFIFIVDRKKD
                280       290       300       310       320       330
               420        430        440        450        460        470
m164.pep LIISKGQNVYPREIEEEIYKLDAVEAAAVIGVKDRYADEEIVAFVQLKEGMDLGENEIRR
         ||||||||||||||||||||| ||||||||||||||||||||||||||||||||| ||||
g164     LIISKGQNVYPREIEEEIHKLDAVEAAAVIGVKDRYADEEIVAFVQLKEGMDLGEDEIRR
                340       350       360       370       380       390
               480        490        500        510
m164.pep HLRTVLANFKIPKQIHFKDGLPRNATGKVLKRVLKEQFDGNKX
         |||||||||||||||||||||||||||||||||||| ||||
g164     HLRTVLANFKIPKQIHFKDGLPRNATGKVLKRVLKEQFEGNKX
                400       410       420       430
```

The following partial DNA sequence was identified in *N. meningitidis* <SEQ ID 683>:

```
a164.seq
   1 ATGAACCGGA CTTATGCCAA TTTCTACGAA ATGCTGACCG CCGCCTGCCG

51 CAAAAACGGC AACGGCACGG CAGTGTTCGA CGGCAAGGAA AAAACCGCCT

101 ACCGCGCGCT CAAGCAGGAA GCCGAAGCCG TTGCGGCGTA TCTGCAAAAT

151 ATCGGCGTGA AGTTCGGCGA CACGGTCGCG CTGGCGGTTT CCAATTCCAC
```

```
 201 GGAATTTATT ACCGCCTATT TCGCCGTATC CGCCATCGGC GCGGTTGCCG

251 TACCGATGAA CACATTTTTG AAAAACAGCG AATACGCGTA TATCCTGAAC

301 GACTGCAAGG CGCGCTTCCT GTTCGCCTCG GCCGGCCTGT CAAAGAATT

351 GGCGGGCTTG AAGGCGCAAA CGCCCGTCGA AAAAATCATT TGGACGGGCC

401 AAAGCCGTCC GGACGGCGAA ATGGCGGAAG GCGATGCCTT TTTTGAAGAC

451 GTGCGCCGCT TCCCCGAAAA ACCCGACTTG GGCCGCCAAC CCCGGATAAA

501 TGATTTGGCA CACATCATCT ACACCTCCGG CACGACGGGG CATCCCAAAG

551 GTGCGCTAAT CAGCTACGCC AACCTGTTCG CCAACCTGAA CGGCATCGAA

601 CGCATCTTTA AAATCTCCAA GCGCGACCGC TTTATCGTTT TCCTGCCGAT

651 GTTCCACAGC TTCACGCTGA CGGCTATGGT GCTGCTGCCG ATTTATATGG

701 CGTGTTCGAT TATTTTGGTC AAATCCGTTT TCCCCTTTTC CAACGTTTTG

751 AAACAGGCAC TGCTCAAACG CGCGACCGTG TTTTTGGGCG TGCCCGCGAT

801 TTACACCGCG ATGAGCAAGA CGAAAATCCC TTGGTATTTC AGATGGTTCA

851 ACCGCATCCG CCTGTTTATC AGCGGCGGAG CACCTTTGGC GGAACAAACC

901 ATCCTCGATT TCAAAGCCAA GTTCCCCCGC GCCAATTGC TGGAAGGCTA

951 CGGACTGAGC GAAGCCTCGC CCGTCGTCGC CGTCAATACG CCCGAGAGGC

1001 AAAAGCCCG CAGCGTCGGC ATCCCCCTGC CCGGTTTGGA AGTCAAAGCC

1051 GTCGATGAAG AATTGGTCGA AGTGCCGCGC GGCGAAGTGG GCGAACTGAT

1101 CGTCAGGGGC GGTTCGGTGA TGCGGGGCTA CCTCAATATG CCTGCCGCCA

1151 CCGATGAAAC CATCGTCAAC GGCTGGTTGA AAACGGGCGA TTTCGTTACC

1201 ATAGACGAAG ACGGCTTTAT CTTTATCGTC GACCGCAAAA AAGATTTGAT

1251 TATTTCCAAA GGTCAAAATG TCTATCCGCG CGAAATCGAA GAAGAAATCT

1301 ACAAACTCGA TGCCGTCGAA GCCGCCGCCG TCATCGGCGT GAAAGACCGT

1351 TATGCCGACG AGGAAATCGT CGCCTTCGTC CAATTGAAGG AAGGTATGGA

1401 TTTGGGCGAG AACGAAATCC GCCGCCACCT GCGTACCGTG CTGGCAAATT

1451 TCAAAATCCC CAAACAAATC CACTTTAAAG ACGGGCTGCC GCGCAACGCT

1501 ACGGGCAAGG TATTGAAACG GGTGTTGAAG GAGCAGTTTG ACGGAAACAA

1551 ATGA
```

This corresponds to the amino acid sequence <SEQ ID 684; ORF 164.a>:

```
a164.pep

1 MNRTYANFYE MLTAACRKNG NGTAVFDGKE KTAYRALKQE AEAVAAYLQN

51 IGVKFGDTVA LAVSNSTEFI TAYFAVSAIG AVAVPMNTFL KNSEYAYILN

101 DCKARFLFAS AGLSKELAGL KAQTPVEKII WTGQSRPDGE MAEGDAFFED

151 VRRFPEKPDL GRQPRINDLA HITYTSGTTG HPKGALISYA NLFANLNGIE

201 RIFKISKRDR FIVFLPMFHS FTLTAMVLLP IYMACSIILV KSVFPFSNVL

251 KQALLKRATV FLGVPAIYTA MSKTKIPWYF RWFNRIRLFI SGGAPLAEQT

301 ILDFKAKFPR AKLLEGYGLS EASPVVAVNT PERQKARSVG IPLPGLEVKA

351 VDEELVEVPR GEVGELIVRG GSVMRGYLNM PAATDETIVN GWLKTGDFVT

401 IDEDGFIFIV DRKKDLIISK GQNVYPREIE EEIYKLDAVE AAAVIGVKDR
```

```
451 YADEEIVAFV QLKEGMDLGE NEIRRHLRTV LANFKIPKQI HFKDGLPRNA

501 TGKVLKRVLK EQFDGNK*
```

```
m164/a164   98.3% identity in 517 aa overlap 10         20         30         40         50         60
m164.pep  MNRTYANFYEMLAAACRKNGNGTAVFDGKEKTAYRALKQEAEAVAAYLQNIGVKFGDTVA
          ||||||||||||:||||||||||||||||||||||||||||||||||||||||||||||
a164      MNRTYANFYEMLTAACRKNGNGTAVFDGKEKTAYRALKQEAEAVAAYLQNIGVKFGDTVA
                 10         20         30         40         50         60

70         80         90        100        110        120
m164.pep  LAVSNSTEFITAYFAISAIGAVAVPMNTFLKNSEYAYILNDCKARFLFASAGLSKELAGL
          ||||||||||||||||:|||||||||||||||||||||||||||||||||||||||||
a164      LAVSNSTEFITAYFAVSAIGAVAVPMNTFLKNSEYAYILNDCKARFLFASAGLSKELAGL
                 70         80         90        100        110        120

130        140        150        160        170        180
m164.pep  KAQTPVEKIIWTDKSRPTGETAEGDAFFEDVRRFPEKPDLGRQPRINDLAHITYTSGTTG
          |||||||||||| :|||  ||  |||||||||||||||||||||||||||||:||||||
a164      KAQTPVEKIIWTGQSPRDGEMAEGDAFFEDVRRFPEKPDLGRQPRINDLAHIIYTSGTTG
                130        140        150        160        170        180

190        200        210        220        230        240
m164.pep  HPKGALISYANLFANLNGIERIFKISKRDRFIVFLPMFHSFTLTAMVLLPIYMACSIILV
          ||||||||||||||||||||||||||||||||||||||||||||||||||||||||||||
a164      HPKGALISYANLFANLNGIERIFKISKRDRFIVFLPMFHSFTLTAMVLLPIYMACSIILV
                190        200        210        220        230        240

250        260        270        280        290        300
m164.pep  KSVFPFSNVLKQTLLKRATVFLGVPAIYTAMSKAKIPWYFRWFNRIRLFISGGAPLAEQT
          |||||||||||:|||||||||||||||||||||:||||||||||||||||||||||||||
a164      KSVFPFSNVLKQALLKRATVFLGVPAIYTAMSKTKIPWYFRWFNRIRLFISGGAPLAEQT
                250        260        270        280        290        300

310        320        330        340        350        360
m164.pep  ILDFKAKFPRAKLLEGYGLSEASPVVAVNTPERQKARSVGIPLPGLEAKAVDEELVEVPR
          |||||||||||||||||||||||||||||||||||||||||||||||:||||||||||||
a164      ILDFKAKFPRAKLLEGYGLSEASPVVAVNTPERQKARSVGIPLPGLEVKAVDEELVEVPR
                310        320        330        340        350        360

370        380        390        400        410        420
m164.pep  GEVGELIVRGGSVMRGYLNMPAATDETIVNGWLKTGDFVTIDEDGFIFIVDRKKDLIISK
          ||||||||||||||||||||||||||||||||||||||||||||||||||||||||||||
a164      GEVGELIVRGGSVMRGYLNMPAATDETIVNGWLKTGDFVTIDEDGFIFIVDRKKDLIISK
                370        380        390        400        410        420

430        440        450        460        470        480
m164.pep  GQNVYPREIEEEIYKLDAVEAAAVIGVKDRYADEEIVAFVQLKEGMDLGENEIRRHLRTV
          ||||||||||||||||||||||||||||||||||||||||||||||||||||||||||||
a164      GQNVYPREIEEEIYKLDAVEAAAVIGVKDRYADEEIVAFVQLKEGMDLGENEIRRHLRTV
                430        440        450        460        470        480

490        500        510
m164.pep  LANFKIPKQIHFKDGLPRNATGKVLKRVLKEQFDGNKX
          |||||||||||||||||||||||||||||||||||||
a164      LANFKIPKQIHFKDGLPRNATGKVLKRVLKEQFDGNKX
                490        500        510
```

The following partial DNA sequence was identified in *N. gonorrhoeae* <SEQ ID 685>:

```
g165.seq
   1 ATGGCTGAAG CGACAGACGT TGTCTTGGTG GCGGCGGCA TTATGAGCGC

51 GACTTTGGGC GTTTTGCTCA AGAACTCGA ACCGTCTTGG GAAATCACCC

101 TGATTGAACG CTTGGAagat gTGGCGTTGG AATCGTCAAA cGCGTGGAAC

151 AACGcCGgca CGGGGCATTC CGcGCTGTGc GAATTGAACT AtgcgccGCT

201 GGGtgcggac ggcgtcatCA ATCCGGCGCg cgCCCTGAAT ATTGCCGAAC

251 AGTTTCATGT CAGCCGCCAG TTTTGGGcga cgctgGTCGC GGAAGGCAAG

301 TTGGAagaCA ATTCCTTCAT CAATGCcgtg ccgcatatGT Ctttggtgat 351 gAacgaagac cactgCCgtt acCTGCAAAA ACGCTATGAT GTGTTTAAAA

401 CGCAGAAACT TTTTGAAAAT ATGGAATTTT CCACCGATCG GAACAAAATT

451 TCCGATTGGG CtccgCTGAT TATGCGCGGC CGGgacgaaA ACCAACCCGT
```

-continued
```
 501 CGCCGCCAAC TATTCCGCCG Aaggcacgga tgtcgATTTC GGACGGCTGA

551 CGCGCCAGAT GGTGAAATAT TTGCAGGGCA AGGGCGTAAA AACCGAGTTC

601 AACCGCCACG TCGAAGACAT CAAACGCGAA TCCGACGGCG CGTGGGTGCT

651 CAAAACCGCC GATACCCGCA ACCCAGACTG GCAGCTCACC CTCCGCACCC

701 GCTTCCTCTT CCTCGGCGCG GGCGGCGGCG CACTGACCCT GCTGCAAAAA

751 TCCGGCATCC CCGAAGGCAA AGGCTACGGC GGCTTACCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC

901 GACACACGCA ACGTAGACGG CAAACGACAC CTTATGTTCG GTCCTTACGC

951 AGGTTTCCGT TCCAACTTCC TCAAGCAAGG CTCGTTTATG GATTTGCCGC

1001 TGTCCATCCA TATGGACAAC CTCTATCCTA TGCTGCGCGC CGGCTGGGCG

1051 AATATGCCGC TGACCAAATA CcTGCTGGgC gAaTTGCgtt aa
```

This corresponds to the amino acid sequence <SEQ ID 686; ORF 165.ng>:

```
g165.pep
  1 MAEATDVVLV GGGIMSATLG VLLKELEPSW EITLIERLED VALESSNAWN

51 NAGTGHSALC ELNYAPLGAD GVINPARALN IAEQFHVSRQ FWATLVAEGK

101 LEDNSFINAV PHMSLVMNED HCRYLQKRYD VFKTQKLFEN MEFSTDRNKI

151 SDWAPLIMRG RDENQPVAAN YSAEGTDVDF GRLTRQMVKY LQGKGVKTEF

201 NRHVEDIKRE SDGAWVLKTA DTRNPDWQLT LRTRFLFLGA GGGALTLLQK

251 SGIPEGKGYG GLPVSGLFFR NSNPETAEQH NAKVYGQASV GAPPMSVPHL

301 DTRNVDGKRH LMFGPYAGFR SNFLKQGSFM DLPLSIHMDN LYPMLRAGWA

351 NMPLTKYLLG ELR*
```

The following partial DNA sequence was identified in *N. meningitidis* <SEQ ID 687>:

```
m165.seq (partial)
   1 ATGGCTGAAG CGACAGACGT TGTCTTGGTG GGCGGCGGCA TTATGAGCGC

51 GACTTTGGGC GTTTTGCTCA AAGAACTCGA ACCGTCTTGG GAAATCACCC

101 TGATTGAACG CTTGGAAGAT GTGGCGTTGG AATCGTCAAA CGCGTGGAAC

151 AACGCCGGCA CGGGGCATTC CGCGCTGTGC GAATTGAACT ATGCGCCGTT

201 GGGTGCAAAT GGGATTATCG ATCCGGCGCG CGCCCTCAAT ATTGCCGAAC

251 AGTTTCATGT CAGCCGCCAG TTTTGGGCGA CGCTGGTCGC GGAAGGCAAG

301 TTGGAAGACA ATTCCTTCAT CAATGCCGTG CCGCATATGT CTTTGGTGAT

351 GAATGAAGAC CATTGTTCTT ATCTTCAAAA ACGTTATGAC GCGTTTAAAA

401 CCCAAAAACT TTTTGAAAAT ATGGAATTTT CCACCGATCG GAACAAAATT

451 TCCGATTGGG CTCCGCTGAT GATGCGCGGC CGGGACGAAA ACCAACCCGT

501 CGCCGCCAAC TACTCCGCCG AAGgTACGGA TGTCGATTTC GGACGGCTGA

551 CGCGCCAAAT GGTGAAATAT TTGCAGGGCA AGGGCGTAAA AACCGAGTTC

601 AACCGCCACG TCGAAGACAT CAAACGCGAA TCCGACGGCG CGTGGGTGCT

651 CAAAACCGCC GATACCCGCA ACCCCGACGG GCAGCTCACC CTCCGTACCC
```

```
 701 GCTTCCTCTT CCTCGGCGCG GGCGGCGGCG CGCTGACCCT GCTGCAAAAA

751 TCCGGCATCC CCGAAGGCAA AGGCTACGGC GGCTTCCCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC

901 GACACACGCA ACGTGGACGG CAAACGCCAC CTTATGTTCG GCCCTTACGC

951 AGGCTTCCGT TCCAACTTCC TCAAGCAAGG CTCGCTTATG GATTTGCCGC

1001 TGTCCATCCA TATGGACAAC CTCTATCCTA TGCTGTGCGC CGGCTGGGCG

1051 AATATGCCGC TGACCAAA . . .
```

This corresponds to the amino acid sequence <SEQ ID 688; ORF 165>:

```
m165.pep (partial)
  1 MAEATDVVLV GGGIMSATLG VLLKELEPSW EITLIERLED VALESSNAWN

51 NAGTGHSALC ELNYAPLGAN GIIDPARALN IAEQFHVSRQ FWATLVAEGK

101 LEDNSFINAV PHMSLVMNED HCSYLQKRYD AFKTQKLFEN MEFSTDRNKI

151 SDWAPLMMRG RDENQPVAAN YSAEGTDVDF GRLTRQMVKY LQGKGVKTEF

201 NRHVEDIKRE SDGAWVLKTA DTRNPDGQLT LRTRFLFLGA GGGALTLLQK

251 SGIPEGKGYG GFPVSGLFFR NSNPETAEQH NAKVYGQASV GAPPMSVPHL

301 DTRNVDGKRH LMFGPYAGFR SNFLKQGSLM DLPLSIHMDN LYPMLCAGWA

351 NMPLTK . . .
```

Computer analysis of this amino acid sequence gave the following results:
Homology with a Predicted ORF from *N. gonorrhoeae*

```
    m165/g165    97.2% identity in 356 aa overlap
                          10         20         30         40         50         60
          m165.pep  MAEATDVVLVGGGIMSATLGVLLKELEPSWEITLIERLEDVALESSNAWNNAGTGHSALC
                    ||||||||||||||||||||||||||||||||||||||||||||||||||||||||||||
              g165  MAEATDVVLVGGGIMSATLGVLLKELEPSWEITLIERLEDVALESSNAWNNAGTGHSALC
                          10         20         30         40         50         60
                          70         80         90        100        110        120
          m165.pep  ELNYAPLGANGIIDPARALNIAEQFHVSRQFWATLVAEGKLEDNSFINAVPHMSLVMNED
                    ||||||||||:|:|:|||||||||||||||||||||||||||||||||||||||||||||
              g165  ELNYAPLGADGVINPARALNIAEQFHVSRQFWATLVAEGKLEDNSFINAVPHMSLVMNED
                          70         80         90        100        110        120
                         130        140        150        160        170        180
          m165.pep  HCSYLQKRYDAFKTQKLFENMEFSTDRNKISDWAPLMMRGRDENQPVAANYSAEGTDVDF
                    ||:|||||||:||||||||||||||||||||||||:|||||||||||||||||||||||
              g165  HCRYLQKRYDVFKTQKLFENMEFSTDRNKISDWAPLIMRGRDENQPVAANYSAEGTDVDF
                         130        140        150        160        170        180
                         190        200        210        220        230        240
          m165.pep  GRLTRQMVKYLQGKGVKTEFNRHVEDIKRESDGAWVLKTADTRNPDGQLTLRTRFLFLGA
                    ||||||||||||||||||||||||||||||||||||||||||||||:|||||||||||||
              g165  GRLTRQMVKYLQGKGVKTEFNRHVEDIKRESDGAWVLKTADTRNPDWQLTLRTRFLFLGA
                         190        200        210        220        230        240
                         250        260        270        280        290        300
          m165.pep  GGGALTLLQKSGIPEGKGYGGFPVSGLFFRNSNPETAEQHNAKVYGQASVGAPPMSVPHL
                    ||||||||||||||||||||||:|||||||||||||||||||||||||||||||||||||
              g165  GGGALTLLQKSGIPEGKGYGGLPVSGLFFRNSNPETAEQHNAKVYGQASVGAPPMSVPHL
                         250        260        270        280        290        300
                         310        320        330        340        350
          m165.pep  DTRNVDGKRHLMFGPYAGFRSNFLKQGSLMDLPLSIHMDNLYPMLCAGWANMPLTK
                    ||||||||||||||||||||||||||||||:|||||||||||||:|||||||||||
              g165  DTRNVDGKRHLMFGPYAGFRSNFLKQGSFMDLPLSIHMDNLYPMLRAGWANMPLTKYLLG
                         310        320        330        340        350        360 g165  ELRX
```

The following partial DNA sequence was identified in *N. meningitidis* <SEQ ID 689>:

```
a165.seq
   1 ATGGCTGAAG CGACAGACGT T

```
251 SGIPEGKGYG GFPVSGLFFR NSNPETAEQH NAKVYGQASV GAPPMSVPHL

301 DTRNVDGKRH LMFGPYAGFR SNFLKQGSLM DLPLSIHMDN LYPMLRAGWA

351 NMPLTKYLLG ELRKTKEERF ASLLEYYPEA NPDDWELITA GQRVQIIKKD

401 SEKGGVLQFG TEIVAHADGS LAALLGASPG ASTAVPLMIR LMHQCFPERT

451 PSWEGRLKEL VPGYGIKLNE NPERADEIIA YTAKVLDI*
``` m165/a165  99.7% identity in 365 aa overlap

```
                    10         20         30         40         50         60
m165.pep    MAEATDVVLVGGGIMSATLGVLLKELEPSWEITLIERLEDVALESSNAWNNAGTGHSALC
            ||||||||||||||||||||||||||||||||||||||||||||||||||||||||||||
a165        MAEATDVVLVGGGIMSATLGVLLKELEPSWEITLIERLEDVALESSNAWNNAGTHGSALC
                    10         20         30         40         50         60

70         80         90        100        110        120
m165.pep    ELNYAPLGANGIIDPARALNIAEQFHVSRQFWATLVAEGKLEDNSFINAVPHMSLVMNED
            ||||||||||||||||||||||||||||||||||||||||||||||||||||||||||||
a165        ELNYAPLGANGIIDPARALNIAEQFHVSRQFWATLVAEGKLEDNSFINAVPHMSLVMNED
                    70         80         90        100        110        120

130        140        150        160        170        180
m165.pep    HCSYLQKRYDAFKTQKLFENMEFSTDRNKISDWARLMMRGRDENQPVAANYSAEGTDVDF
            ||||||||||||||||||||||||||||||||||||||||||||||||||||||||||||
a165        HCSYLQKRYDAFKTQKLFENMEFSTDRNKISDWARLMMRGRDENQPVAANYSAEGTDVDF
                   130        140        150        160        170        180

190        200        210        220        230        240
m165.pep    GRLTRQMVKYLQGKGVKTEFNRHVEDIKRESDGAWVLKTADTRNPDGQLTLRTRFLFLGA
            ||||||||||||||||||||||||||||||||||||||||||||||||||||||||||||
a165        GRLTRQMVKYLQGKGVKTEFNRHVEDIKRESDGAWVLKTADTRNPDGQLTLRTRFLFLGA
                   190        200        210        220        230        240

250        260        270        280        290        300
m165.pep    GGGALTLLQKSGIPEGKGYGGFPVSGLFFRNSNPETAEQHNAKVYGQASVGAPPMSVPHL
            ||||||||||||||||||||||||||||||||||||||||||||||||||||||||||||
a165        GGGALTLLQKSGIPEGKGYGGFPVSGLFFRNSNPETAEQHNAKVYGQASVGAPPMSVPHL
                   250        260        270        280        290        300

310        320        330        340        350
m165.pep    DTRNVDGKRHLMFGPYAGFRSNFLKQGSLMDLPLSIHMDNLYPMLRAGWANMPLTK
            |||||||||||||||||||||||||||||||||||||||||||||||||||||||
a165        DTRNVDGKRHLMFGPYAGFRSNFLKQGSLMDLPLSIHMDNLYPMLRAGWANMPLTKYLLG
                   310        320        330        340        350        360 a165        ELRKTKEERFASLLEYYPEANPDDWELITAGQRVQIIKKDSEKGGVLQFGTEIVAHADGS
                   370        380        390        400        410        420
```

The following partial DNA sequence was identified in *N. gonorrhoeae* <SEQ ID 691>:

```
g165-1.seq
  1 ATGGCTGAAG CGACAGACGT TGTCTTGGTG GGCGGCGGCA TTATGAGCGC

51 GACTTTGGGC GTTTTGCTCA AGAACTCGA ACCGTCTTGG GAAATCACCC

101 TGATTGAACG CTTGGAagat gTGGCGTTGG AATCGTCAAA cGCGTGGAAC

151 AACGcCGgca CGGGGCATTC CGcGCTGTGc GAATTGAACT AtgcgccGCT

201 GGGtgcggac ggcgtcatCA ATCCGGCGCg cgCCCTGAAT ATTGCCGAAC

251 AGTTTCATGT CAGCCGCCAG TTTTGGGcga cgctggTCGC GGAAGGCAAG

301 TTGGAAGACA ATTCCTTCAT CAATGCCGTG CCGCATATGT CTTTGGTGAT

351 GAACGAAGAC CACTGCCGTT ACCTGCAAAA ACGCTATGAT GTGTTTAAAA

401 CGCAGAAACT TTTTGAAAAT ATGGAATTTT CCACCGATCG GAACAAAATT

451 TCCGATTGGG CtccgCTGAT TATGCGCGGC CGGGACGAAA ACCAACCCGT

501 CGCCGCCAAC TATTCCGCCG AAGGCACGGA TGTCGATTTC GGACGGCTGA

551 CGCGCCAGAT GGTGAAATAT TTGCAGGGCA AGGGCGTAAA AACCGAGTTC

601 AACCGCCACG TCGAAGACAT CAAACGCGAA TCCGACGGCG CGTGGGTGCT

651 CAAAACCGCC GATACCCGCA ACCCAGACTG GCAGCTCACC CTCCGCACCC
```

```
 701 GCTTCCTCTT CCTCGGCGCG GGCGGCGGCG CACTGACCCT GCTGCAAAAA

751 TCCGGCATCC CCGAAGGCAA AGGCTACGGC GGCTTACCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC

901 GACACACGCA ACGTAGACGG CAAACGACAC CTTATGTTCG GTCCTTACGC

951 AGGTTTCCGT TCCAACTTCC TCAAGCAAGG CTCGTTTATG GATTTGCCGC

1001 TGTCCATCCA TATGGACAAC CTCTATCCTA TGCTGCGCGC CGGCTGGGCG

1051 AATATGCCGC TGACCAAATA CCTGCTGGGC GAATTGCGTA AAACCAAAGA

1101 AGAACGCTtt gCCTCCCTGC TGgaatacta cccGaggcag acccGACGAc 1151 tggtactcat cacgcaggnc acGCGTcata tcattanata tgactCgaaa 1201 ctgcgcgtgc tgcagttgta cgagattgtg ccaCGCGacg ctcgctcgcg 1251 cattctggag cgtcgcggcg catcacgctn tgcgctgata tccgctgatg 1301 acactgctcc gaGCGcgccc gtcttggaaa gtgtctga
```

This corresponds to the amino acid sequence <SEQ ID 692; ORF 165-1.ng>:

```
g165-1.pep
  1 MAEATDVVLV GGGIMSATLG VLLKELEPSW EITLIERLED VALESSNAWN

51 NAGTGHSALC ELNYAPLGAD GVINPARALN IAEQFHVSRQ FWATLVAEGK

101 LEDNSFINAV PHMSLVMNED HCRYLQKRYD VFKTQKLFEN MEFSTDRNKI

151 SDWAPLIMRG RDENQPVAAN YSAEGTDVDF GRLTRQMVKY LQGKGVKTEF

201 NRHVEDIKRE SDGAWVLKTA DTRNPDWQLT LRTRFLFLGA GGGALTLLQK

251 SGIPEGKGYG GLPVSGLFFR NSNPETAEQH NAKVYGQASV GAPPMSVPHL

301 DTRNVDGKRH LMFGPYAGFR SNFLKQGSFM DLPLSIHMDN LYPMLRAGWA

351 NMPLTKYLLG ELRKTKEERF ASLLEYYPRQ TRRLVLITQX TRHIIXYDSK

401 LRVLQLYEIV PRDARSRILE RRGASRXALI SADDTAPSAP VLESV*
```

The following partial DNA sequence was identified in *N. meningitidis* <SEQ ID 693>:

```
m165-1.seq
  1 ATGGCTGAAG CGACAGACGT TGTCTTGGTG GGCGGCGGCA TTATGAGCGC

51 GACTTTGGGC GTTTTGCTCA AGAAACTCGA ACCGTCTTGG GAAATCACCC

101 TGATTGAACG CTTGGAAGAT GTGGCGTTGG AATCGTCAAA CGCGTGGAAC

151 AACGCCGGCA CGGGGCATTC CGCGCTGTGC GAATTGAACT ATGCGCCGTT

201 GGGTGCAAAT GGGATTATCG ATCCGGCGCG CGCCCTCAAT ATTGCCGAAC

251 AGTTTCATGT CAGCCGCCAG TTTTGGGCGA CGCTGGTCGC GGAAGGCAAG

301 TTGGAAGACA ATTCCTTCAT CAATGCCGTG CCGCATATGT CTTTGGTGAT

351 GAATGAAGAC CATTGTTCTT ATCTTCAAAA ACGTTATGAC GCGTTTAAAA

401 CCCAAAAACT TTTTGAAAAT ATGGAATTTT CCACCGATCG GAACAAAATT

451 TCCGATTGGG CTCCGCTGAT GATGCGCGGC CGGGACGAAA ACCAACCCGT

501 CGCCGCCAAC TACTCCGCCG AAGGTACGGA TGTCGATTTC GGACGGCTGA

551 CGCGCCAAAT GGTGAAATAT TTGCAGGGCA AGGGCGTAAA AACCGAGTTC
```

```
 601 AACCGCCACG TCGAAGACAT CAAACGCGAA TCCGACGGCG CGTGGGTGCT

651 CAAAACCGCC GATACCCGCA ACCCGACGG GCAGCTCACC CTCCGTACCC

701 GCTTCCTCTT CCTCGGCGCG GGCGGCGGCG CGCTGACCCT GCTGCAAAAA

751 TCCGGCATCC CCGAAGGCAA AGGCTACGGC GGCTTCCCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC

901 GACACACGCA ACGTGGACGG CAAACGCCAC CTTATGTTCG GCCCTTACGC

951 AGGCTTCCGT TCCAACTTCC TCAAGCAAGG CTCGCTTATG GATTTGCCGC

1001 TGTCCATCCA TATGGACAAC CTCTATCCTA TGCTGTGCGC CGGCTGGGCG

1051 AATATGCCGC TGACCAAATA CCTGCTGGGC GAATTGCGTA AAACCAAAGA

1101 AGAACGCTTC GCCTCCCTGC TGGAATACTA CCCCGAGGCA AACCCCGACG

1151 ACTGGGAACT CATCACCGCA GGGCAACGCG TCCAAATCAT TAAAAAAGAC

1201 TCCGAAAAAG GCGGCGTGCT CCAGTTTGGT ACGGAGATTG TCGCCCACGC

1251 CGACGGCTCA CTCGCCGCAT TGCTGGGCGC GTCGCCGGGC GCATCGACCG

1301 CTGTGCCGCT GATGATCCGG CTGATGCACC AATGCTTCCC CGAGCGCGCC

1351 CCGTCTTGGG AAGACCGTCT GAAAGAGCTG GTACCGGGTT ACGGCATCAA

1401 GTTGAACGAA AACCCTGAAA GGGCGGATGA AATTATCGCC TATACCGCGA

1451 AAGTATTGGA TATTTAA
```

This corresponds to the amino acid sequence <SEQ ID 694; ORF 165-1>:

```
m165-1.PEP

1 MAEATDVVLV GGGIMSATLG VLLKELEPSW EITLIERLED VALESSNAWN

51 NAGTGHSALC ELNYAPLGAN GIIDPARALN IAEQFHVSRQ FWATLVAEGK

101 LEDNSFINAV PHMSLVMNED HCSYLQKRYD AFKTQKLFEN MEFSTDRNKI

151 SDWAPLMMRG RDENQPVAAN YSAEGTDVDF GRLTRQMVKY LQGKGVKTEF

201 NRHVEDIKRE SDGAWVLKTA DTRNPDGQLT LRTRFLFLGA GGGALTLLQK

251 SGIPEGKGYG GFPVSGLFFR NSNPETAEQH NAKVYGQASV GAPPMSVPHL

301 DTRNVDGKRH LMFGPYAGFR SNFLKQGSLM DLPLSIHMDN LYPMLCAGWA

351 NMPLTKYLLG ELRKTKEERF ASLLEYYPEA NPDDWELITA GQRVQIIKKD

401 SEKGGVLQFG TEIVAHADGS LAALLGASPG ASTAVPLMIR LMHQCFPERA

451 PSWEDRLKEL VPGYGIKLNE NPERADEIIA YTAKVLDI* m165-1/g165-1 89.7% identity in 428 aa overlap 10        20         30         40          50         60
m165-1.pep   MAEATDVVLVGGGIMSATLGVLLKELEPSWEITLIERLEDVALESSNAWNNAGTGHSALC
             ||||||||||||||||||||||||||||||||||||||||||||||||||||||||||||
g165-1       MAEATDVVLVGGGIMSATLGVLLKELEPSWEITLIERLEDVALESSNAWNNAGTGHSALC
                       10        20         30         40          50         60

70        80         90        100         110        120
m165-1.PEP   ELNYAPLGANGIIDPARALNIAEQFHVSRQFWATLVAEGKLEDNSKINAVPHMSLVMNED
             ||||||||||:|:|||||||||||||||||||||||||||||||||:||||||||||||
g165-1       ELNYAPLGADGVINPARALNIAEQFHVSRQFWATLVAEGKLEDNSFINAVPHMSLVMNED
                       70        80         90        100         110        120

130       140         150       160         170        180
m165-1.pep   HCSYLQKRYDAFKTQKLFENMEFSTDRNKISDWAPLMMRGRDENQPVAANYSAEGTDVDF
             ||:|||||||:|||||||||||||||||||||||||:|||||||||||||||||||||||
g165-1       HCRYLQKRYDVFKTQKLFENMEFSTDRNKISDWAPLIMRGRDENQPVAANYSAEGTDVDF
                      130       140         150       160         170        180
```

-continued

```
                      190       200       210       220       230       240
m165-1.pep     GRLTRQMVKYLQGKGVKTEFNRHVEDIKRESDGAWVLKTADTRNPDGQLTLRTRFLFLGA
               |||||||||||||||||||||||||||||||||||||||||||||| |||||||||||||
g165-1         GRLTRQMVKYLQGKGVKTEFNRHVEDIKRESDGAWVLKTADTRNPDWQLTLRTRFLFLGA
                      190       200       210       220       230       240

250       260       270       280       290       300
m165-1.pep     GGGALTLLQKSGIPEGKGYGGFPVSGLFFRNSNPETAEQHNAKVYGQASVGAPPMSVPHL
               |||||||||||||||||||||:||||||||||||||||||||||||||||||||||||||
g165-1         GGGALTLLQKSGIPEGKGYGGLPVSGLFFRNSNPETAEQHNAKVYGQASVGAPPMSVPHL
                      250       260       270       280       290       300

310       320       330       340       350       360
m165-1.pep     DTRNVDGKRHLMFGPYAGFRSNFLKQGSLMDLPLSIHMDNLYPMLCAGWANMPLTKYLLG
               ||||||||||||||||||||||||||||:|||||||||||||||| ||||||||||||||
g165-1         DTRNVDGKRHLMFGPYAGFRSNFLKQGSFMDLPLSIHMDNLYPMLRAGWANMPLTKYLLG
                      310       320       330       340       350       360

370       380       390       400       410       420
m165-1.pep     ELRKTKEERFASLLEYYPEANPDDWELITAGQRVQIIKKDSEKGGVLQFGTEIVAHADGS
               ||||||||||||||||||: :     |||   | :||  || |  |||:   :   | :
g165-1         ELRKTKEERFASLLEYYRR-QTRRLVLITQXTR-HIIXYDS-KLRVLQLYEIVPRDARSR
                      370       380       390       400       410

430       440       450       460       470       480
m165-1.pep     LAALLGASPGASTAVPLMIRLMHQCFPERAPSWEDRLKELVPGYGIKLNENPERADEIIA
               :    |||
g165-1         ILERRGASRXALISADDTAPSAPVLESVX
               420       430       440
```

The following partial DNA sequence was identified in *N. meningitidis* <SEQ ID 695>:

```
a165-1.seq
   1 ATGGCTGAAG CGACAGACGT TGTCTTGGTG GGCGGCGGCA TTATGAGCGC

51 GACTTTGGGC GTTTTGCTCA AAGAACTCGA ACCGTCTTGG GAAATCACCC

101 TGATTGAACG CTTGGAAGAT GTGGCGTTGG AATCGTCAAA CGCGTGGAAC

151 AACGCCGGCA CGGGGCATTC CGCGCTGTGC GAATTGAACT ATGCGCCGTT

201 GGGTGCAAAT GGGATTATCG ATCCGGCGCG CGCCCTCAAT ATTGCCGAAC

251 AGTTTCATGT CAGCCGCCAG TTTTGGGCGA CGTTGGTCGC GGAAGGCAAG

301 TTGGAAGACA ATTCCTTCAT CAATGCCGTG CCGCATATGT CTTTGGTGAT

351 GAATGAAGAC CATTGTTCTT ATCTTCAAAA ACGTTATGAC GCGTTTAAAA

401 CCCAAAAACT TTTTGAAAAT ATGGAATTTT CCACCGATCG GAACAAAATT

451 TCCGATTGGG CTCCGCTGAT GATGCGCGGC CGGGACGAAA ACCAACCCGT

501 CGCCGCCAAC TACTCCGCCG AAGGCACGGA TGTCGATTTC GGACGGCTGA

551 CGCGCCAAAT GGTGAAATAT TTGCAGGGCA AGGGCGTAAA AACCGAGTTC

601 AACCGCCACG TCGAAGACAT CAAACGCGAA TCCGACGGCG CGTGGGTGCT

651 CAAAACCGCC GATACCCGCA ACCCCGACGG GCAGCTCACC CTCCGTACCC

701 GCTTCCTCTT CCTCGGCGCG GGCGGCGGCG CGCTGACCCT GCTGCAAAAA

751 TCCGGCATCC CCGAAGGCAA AGGCTACGGT GGCTTTCCCG TGTCCGGCCT

801 GTTCTTCCGC AACAGCAACC CCGAAACCGC CGAACAACAC AACGCCAAAG

851 TGTACGGGCA GGCTTCCGTC GGCGCGCCGC CGATGTCCGT CCCGCACCTC

901 GACACACGCA ACGTGGACGG CAAACGCCAC CTTATGTTCG GCCCTTACGC

951 AGGCTTCCGT TCCAACTTCC TCAAGCAAGG CTCACTTATG GATTTGCCGC

1001 TGTCCATCCA TATGGACAAC CTCTATCCTA TGCTGCGCGC CGGCTGGGCG

1051 AATATGCCGC TGACCAAATA CCTGCTGGGC GAATTGCGTA AAACCAAAGA

1101 AGAACGCTTC GCCTCCCTGC TGGAATACTA CCCCGAGGCA AACCCCGACG
```

```
-continued
1151 ACTGGGAACT CATCACCGCA GGGCAACGCG TTCAAATCAT TAAAAAAGAC

1201 TCCGAAAAAG GCGGCGTGTT GCAGTTTGGT ACGGAGATTG TCGCACACGC

1251 CGACGGCTCG CTCGCCGCAT TGCTGGGCGC GTCGCCGGGC GCATCGACCG

1301 CCGTGCCGCT GATGATCCGG CTGATGCACC AATGCTTCCC CGAACGCACC

1351 CCGTCTTGGG AAGGCCGTCT GAAAGAGCTG GTACCGGGTT ACGGCATCAA

1401 GTTGAACGAA AACCCCGAAA GGGCGGATGA AATTATCGCC TATACCGCGA

1451 AAGTGTTGGA TATTTAA
```

This corresponds to the amino acid sequence <SEQ ID 696; ORF 165-1.a>:

```
a165-1.pep

1  MAEATDVVLV GGGIMSATLG VLLKELEPSW EITLIERLED VALESSNAWN

51  NAGTGHSALC ELNYAPLGAN GIIDPARALN IAEQFHVSRQ FWATLVAEGK

101  LEDNSFINAV PHMSLVMNED HCSYLQKRYD AFKTQKLFEN MEFSTDRNKI

151  SDWAPLMMRG RDENQPVAAN YSAEGTDVDF GRLTRQMVKY LQGKGVKTEF

201  NRHVEDIKRE SDGAWVLKTA DTRNPDGQLT LRTRFLFLGA GGGALTLLQK

251  SGIPEGKGYG GFPVSGLFFR NSNPETAEQH NAKVYGQASV GAPPMSVPHL

301  DTRNVDGKRH LMFGPYAGFR SNFLKQGSLM DLPLSIHMDN LYPMLRAGWA

351  NMPLTKYLLG ELRKTKEERF ASLLEYYPEA NPDDWELITA GQRVQIIKKD

401  SEKGGVLQFG TEIVAHADGS LAALLGASPG ASTAVPLMIR LMHQCFPERT

451  PSWEGRLKEL VPGYGIKLNE NPERADEIIA YTAKVLDI* a165-1/m165-1  99.4% identity in 488 aa overlap 10         20         30         40         50         60
a165-1.pep  MAEATDVVLVGGGIMSATLGVLLKELEPSWEITLIERLEDVALESSNAWNNAGTGHSALC
            ||||||||||||||||||||||||||||||||||||||||||||||||||||||||||||
m165-1      MAEATDVVLVGGGIMSATLGVLLKELEPSWEITLIERLEDVALESSNAWNNAGTGHSALC
                    10         20         30         40         50         60

70         80         90        100        110        120
a165-1.pep  ELNYAPLGANGIIDPARALNIAEQFHVSRQFWATLVAEGKLEDNSFINAVPHMSLVMNED
            ||||||||||||||||||||||||||||||||||||||||||||||||||||||||||||
m165-1      ELNYAPLGANGIIDPARALNIAEQFHVSRQFWATLVAEGKLEDNSFINAVPHMSLVMNED
                    70         80         90        100        110        120

130        140        150        160        170        180
a165-1.pep  HCSYLQKRYDAFKTQKLFENMEFSTDRNKISDWAPLMMRGRDENQPVAANYSAEGTDVDF
            ||||||||||||||||||||||||||||||||||||||||||||||||||||||||||||
m165-1      HCSYLQKRYDAFKTQKLFENMEFSTDRNKISDWAPLMMRGRDENQPVAANYSAEGTDVDF
                   130        140        150        160        170        180

190        200        210        220        230        240
a165-1.pep  GRLTRQMVKYLQGKGVKTEFNRHVEDIKRESDGAWVLKTADTRNPDGQLTLRTRFLFLGA
            ||||||||||||||||||||||||||||||||||||||||||||||||||||||||||||
m165-1      GRLTRQMVKYLQGKGVKTEFNRHVEDIKRESDGAWVLKTADTRNPDGQLTLRTRFLFLGA
                   190        200        210        220        230        240

250        260        270        280        290        300
a165-1.pep  GGGALTLLQKSGIPEGKGYGGFPVSGLFFRNSNPETAEQHNAKVYGQASVGAPPMSVPHL
            ||||||||||||||||||||||||||||||||||||||||||||||||||||||||||||
m165-1      GGGALTLLQKSGIPEGKGYGGFPVSGLFFRNSNPETAEQHNAKVYGQASVGAPPMSVPHL
                   250        260        270        280        290        300

310        320        330        340        350        360
a165-1.pep  DTRNVDGKRHLMFGPYAGFRSNFLKQGSLMDLPLSIHMDNLYPMLRAGWANMPLTKYLLG
            |||||||||||||||||||||||||||||||||||||||||||| |||||||||||||||
m165-1      DTRNVDGKRHLMFGPYAGFRSNFLKQGSLMDLPLSIHMDNLYPMLCAGWANMPLTKYLLG
                   310        320        330        340        350        360

370        380        390        400        410        420
a165-1.pep  ELRKTKEERFASLLEYYPEANPDDWELITAGQRVQIIKKDSEKGGVLQFGTEIVAHADGS
            ||||||||||||||||||||||||||||||||||||||||||||||||||||||||||||
m165-1      ELRKTKEERFASLLEYYPEANPDDWELITAGQRVQIIKKDSEKGGVLQFGTEIVAHADGS
                   370        380        390        400        410        420
```

-continued

```
                   430        440        450        460        470        480
a165-1.pep   LAALLGASPGASTAVPLMIRLMHQCFPERTPSWEGRLKELVPGYGIKLNENPERADEIIA
             ||||||||||||||||||||||||||||||:||| |||||||||||||||||||||||||
m165-1       LAALLGASPGASTAVPLMIRLMHQCFPERAPSWEDRLKELVPGYGIKLNENPERADEIIA
                   430        440        450        460        470        480

489
a165-1.pep   YTAKVLDIX
             |||||||||
m165-1       YTAKVLDIX a165-1 (SEQ ID 696)/p33940 (SEQ ID 4164)
 sp|P33940|YOJH_ECOLI HYPOTHETICAL 60.2 KD PROTEIN IN ECO-ALKB INTERGENIC
REGION >gi|1736851|gln|PID|d1016718 (D90850) ORF_ID:o372#5; similar to
[SwissProt Accession Number P33940] [Escherichia coli] >gi|1788539 (AE000310)
f548; This 548 aa ORF is 100 pct identical to 490 residues of
YOJH_ECOLI SW: P33940 (492 aa) but contains 56 additional N-ter aa; 100 pct
identical to GB: ECOHU49_33
ACCESSION: U00008 (490 aa) but contains 58 aditional N-term resi... Length = 548
  Score = 458 bits (1167), Expect = e-128
  Identities = 233/490 (47%), Positives = 303/490 (61%), Gaps = 5/490 (1%)

Query:   3 EATDVVLVGGGIMSATLGVLLKELEPSWEITLIERLEDVALESSNAWNNAGTGHSALCEL   62
           + TDV+L+GGGIMSATLG  L+ELEP W +T++ERLE VA ESSN WNNAGTGHSAL EL
Sbjct:  30 QETDVLLIGGGIMSATLGTYLRELEPEWSMTMVERLEGVAQESSNGWNNAGTGHSALMEL   89

Query:  63 NYAPLGANGIIDPARALNIAEQFHVSRQFWATLVAEGKLED-NSFINAVPHMSLVMNEDH  121
           NY P  A+G I  +A+ I E F +SRQFWA  V  G L   SFIN VPHMS V   ED+
Sbjct:  90 NYTPQNADGSISIEKAVAINEAFQISRQFWAHQVERGVLRTPRSFINTVPHMSFVWGEDN  149

Query: 122 CSYLQKRYDAFKTQKLFENMEFSTDRNKISDWAPLMMRGRDENQPVAANYSAEGTDVDFG  181
           ++L+ RY A +   LF  M +S D  +I +WAPL+M GRD  Q VAA  +   GTDV++G
Sbjct: 150 VNFLRARYAALQQSSLFRGMRYSEDHAQIKEWAPLVMEGRDPQQKVAATRTEIGTDVNYG  209

Query: 182 RLTRQMVKYLQGKG-VKTEFNRHVEDIKRESDGAWVLKTADTRNPDGQLTXXXXXXXXXX  240
           +TRQ++  LQ K     + V +KR  D W +   AD +N   Q
Sbjct: 210 EITRQLIASLQKKSNFSLQLSSEVRALKRNDDNTWTVTVADLKNGTAQ-NIRAKFVFIGA  268

Query: 241 XXXXXXXQKSGIPEGKGYGGFPVSGLFFRNSNPETAEQHNAKVYGQASVGAPPMSVPHL  300
                  Q+SGIPE K Y GFPV G F  + NP+   H AKVYG+ASVGAPPMSVPH+
Sbjct: 269 GGAALKLLQESGIPEAKDYAGFPVGGQFLVSENPDVVNHHLAKVYGKASVGAPPMSVPHI  328

Query: 301 DTRNVDGKRHLMFGPYAGFRSNFLKQGSLMDLPLSIHMDNLYPMLRAGWANMPLTKYLLG  360
           DTR +DGKR ++FGP+A F + FLK GSL DL  S    N+ PM+  G   N  L KYL+
Sbjct: 329 DTRVLDGKRVVLFGPFATFSTKFLKNGSLWDLMSSTTTSNVMPMMHVGLDNFDLVKYLVS  388

Query: 361 ELRKTKEERFASLLEYYPEANPDDWELITAGQRVQIIKKDSEKGGVLQFGTEIVXXXXXX  420
           ++  ++E+RF +L EYYP+A  +DW L  AGQRVQIIK+D+EDGGVL+ GTE+V
Sbjct: 389 QVMLSEEDRFEALKEYYPQAKKEDWRLWQAGQRVQIIKRDAEKGGVLRLGTEVVSDQQGT  448

Query: 421 XXXXXXXXXXXXXXVPLMIRLMHQCFPER--TPSWEGRLKELVPGYGIKLNENPERADEI  478
                         P+M+ L+ + F +R  +P W+  LK +VP YG KLN +   +
Sbjct: 449 IAALLGASPGASTAAPIMLNLLEKVFGDRVSSPQWQATLKAIVPSYGRKLNGDVAATERE  508

Query: 479 IAYTAKVLDI                                                    488
           + YT++VL +
Sbjct: 509 LQYTSEVLGL                                                    518
```

The following partial DNA sequence was identified in *N. gonorrhoeae* <SEQ ID 697>:

```
g204.seq
  1 atggcggcgg cggaaataaa acgcccctc gctgtcgatt tccagcacat 51 agcgtccgtt ctgcacggcg gcatagccgc ttttgcctgc ctgatagggt 101 tgcagggcgg aatgcgaaat caggtaatca gtcagtttgc cgccgtcttc 151 ggcgatattg cccaccagtt tggcaaacaa ggtatggcac acgccgtttt 201 ccgcccagcc cgaaggcgcg tcctttccgt cggtttccat acatttgccg 251 acgacggctt ccaagtcgtt gggatgcttt ccggtcagcc ggacggcgtt 301 ttgttccggc aagcctttaa tcggataact gatttgtttt tgccgtcgt 351 tggttttgcc ttcgctactt tgtcccaaag ccaaaccggc aatcgccgta 401 ttgtcgatgt atttgacttt gaaaaccggt tcggcgcgc tttgtgccgc 451 attttgcggc tgttccgccg tatttcgga tttgccgcag gcggcaagca 501 gcaggcagcc gcccaacacg gcaaaaggta ttttcagcat tccgcactcc 551 tgatggtttc aaaatgccgt ctgaaatgcc gtctgaaacg tggcaggcgg
```

-continued

```
601 aggttcggac ggcattgggt ttatttcaac gggcggatgc cgaccgcatc 651 gcgtacttta tccaacaatt cgcgcgcttc tttgcgcgct ttttgcgcgc 701 ctgcctgcaa aatctcttcg atttgcgaag gattagaggt caatgcgttg 751 tag
```

This corresponds to the amino acid sequence <SEQ ID 698; ORF 204.ng>:

```
g204.pep
  1 MAAAEIKRPL AVDFQHIASV LHGGIAAFAC LIGLQGGMRN QVISQFAAVF

51 GDIAHQFGKQ GMAHAVFRPA RRRVLSVGFH TFADDGFQVV GMLSGQPDGV

101 LFRQAFNRIT DLFFAVVGFA FATLSQSQTG NRRIVDVFDF ENRFRRALCR

151 ILRLFRRIFG FAAGGKQQAA AQHGKRYFQH SALLMVSKCR LKCRLKRGRR

201 RFGRHWVYFN GRMPTASRTL SNNSRASLRA FCAPACKISS ICEGLEVNAL

251 *
```

The following partial DNA sequence was identified in *N. meningitidis* <SEQ ID 699>:

```
m204.seq
  1 ATGGCGGCGG CGGAAATAAA ACGCCCCTTC GCTGTCGATT TCCAGCACAT

51 AGCGTCCGTT CTGCACGGCG GCATAGCCGC TTTTGCCTGC CTGATAGGGT

101 TGCAGGGCGG CATGCGAAAC TAGGTAATCC GTCAGTTTGC CGCCGTCTTC

151 GGCGATATTG CCCACCAGTT TGGCAAACAA GGTATGGCAC ACGCCGTTTT

201 CTGCCCAACC TGCCGGACTG TCCTTATCAT CGGTTTCCAT ACATTTGCCG

251 CTGACGGCTT CCAAGTCGCC GGGATGCTTG CCGATCAGTC GGATAACATT

301 TTGTTCCGGC AAGCCTTTAA TCGGATAACT GATTTGTTTT TTGCCGTCGT

351 TGGTTTTGCC TTCGCTGCTT TGTCCCAAAT CCAAACCGGC AATCGCCGTA

401 TTGTCGATAT ATATGACTTT GAAAACCGGT TCGGCGCGC TTTGTACCGC

451 GTTTTGCGGC TGTACCGCCG TATTTwCGGA TTTGCCGCaC GGCaArGCAG

501 CAGGCAGCCG CCCAATACGG CAAAArAwGT wTTCAGCATT CCACAyTCCT

551 GATGGTTTCA AAATGCCGTC TGAAACGCGG CAGGCGGAGG TTCGGACGGC

601 ATCGGGTTCA TTTCAACGGG CGGATGcCGA CCGCATCgGT ACTTTGTCCA

651 ATAATTCGCG TGCTTCTTTA CGCGCTTTCG CCGCGCCTGC CTGCAAAATC

701 TCTTCGATTT GCGAAGGGTC GGCGGTCAGC TCGTTGTAG
```

This corresponds to the amino acid sequence <SEQ ID 700; ORF 204>:

```
m204.pep
  1 MAAAEIKRPF AVDFQHIASV LHGGIAAFAC LIGLQGGMRN *VIRQFAAVF

51 GDIAHQFGKQ GMAHAVFCPT CRTVLIIGFH TFADDGFQVA GMLADQSDNI

101 LFRQAFNRIT DLFFAVVGFA FAALSQIQTG NRRIVDIYDF ENRFRRALYR

151 VLRLYRRIXG FAATAXQQAA AQYGKXXXQH STXLMVSKCR LKRGRRRFGR

201 HRVHFNGRMP TASGTLSNNS RASLRAFAAP ACKISSICEG SAVSSL*
```

Computer analysis of this amino acid sequence gave the following results:

Homology with a Predicted ORF from *N. gonorrhoeae*
ORF 204 shows 82.0% identity over a 250 aa overlap with a predicted ORF (ORF 204.ng) from *N. gonorrhoeae*:

```
    m204/g204
                       10         20         30         40         50         60
         m204.pep   MAAAEIKRPFAVDFQHIASVLHGGIAAFACLIGLQGGMRNXVIRQFAAVFGDIAHQFGKQ
                   ||||||||:||||||||||||||||||||||||||||||:|||||||||||||||||||
         g204      MAAAEIKRPLAVDFQHIASVLHGGIAAFACLIGLQGGMRNQVISQFAAVFGDIAHQFGKQ
                       10         20         30         40         50         60

70         80         90        100        110        120
         m204.pep   GMAHAVFCPTCRTVLIIGFHTFAADGFQVAGMLADQSDNILFRQAFNRITDLFFAVVGFA
                   |||||||| |: | || :|||||| ||||:||| | |::|||||||||||||||||||||
         g204      GMAHAVFRPARRRVLSVGFHTFADDGFQVVGMLSGQPDGVLFRQARNRITDLFFAVVGFA
                       70         80         90        100        110        120

130        140        150        160        170        180
         m204.pep   FAALSQIQTGNRRIVDIYDFENRFRRALYRVLRLYRRIXGFAATAXQQAAAQYGKXXXQH
                   ||:||| |||||||||||::|||||||||| |:|||:||| |||| : |||||:|| ||
         g204      FATLSQSQTGNRRIVDVFDFENRFRRALCRILRLFRRIFGFAAGGKQQAAAQHGKRYFQH
                      130        140        150        160        170        180

190        200        210        220        230
         m204.pep   STXLMVSKCRLK----RGRRRFGRHRVHFNGRMPTASGTLSNNSRASLRAFAAPACKISS
                   |: |||||||||    ||||||||| |:|||||||||| ||||||||||||| ||||||
         g204      SALLMVSKCRLKCRLKRGRRRFGRHWVYFNGRMPTASRTLSNNSRASLRAFCAPACKISS
                      190        200        210        220        230        240

240
         m204.pep   ICEGSAVSSLX
                   ||||   |::|
         g204      ICEGLEVNAL
                      250
```

The following partial DNA sequence was identified in *N. meningitidis* <SEQ ID 701>:

```
a204.seq
  1  ATGGCGGCGG CGGAAATAAA ACGCCCCCTC GCTGTCGATT TCCAGCACAT

51  AGCGTCCGTT CTGCACGGCG GCATAGCCGC TTTTGCCTGC CTGATAGGGT

101  TGCAGGGCGG AATGCGAAAT CAGGTAATCC GTCAGTTTGC CGCCGTCTTC

151  GGCGATATTG CCCACCAGTT TGGCAAACAA GGTATGGCAC ACGCCGTTTG

201  CCGGTCAGCC CGAAGGCGCG CCCTTTCCGT CGGTTTCCAT ACATTTGCCG

251  ACGACGGCTT CCAAGTCGTT GGGATGCTTG CCGGTCAGCC GGACGACGTT

301  TTGTTCCGGC AAGCCTTT.. .......... .......... ..........

351  .......... .......... .......... .......... ..........

401  .......... .......... .......... .......... ..........

451  .......... .......... .......... .......... ..........

501  .......... .......... .......... .......... ..........

551  .......... .......... .......... ......AAGAG GTTCGGACGG

601  CATTGGGTTT ATTTCAACGG GCGGATACCG ACCGCATCAC GTACTTTGCC

651  CAATAATTCG CGTGCTTCTT TACGCGCTTT TTGCGCGCCT GCCTGCAAAA

701  TCTCTTCGAT TTGCGAAGGG TCGGCGGTCA GCTCGTTGTA G
```

This corresponds to the amino acid sequence <SEQ ID 702; ORF 204.a>:

```
a204.pep
  1  MAAAEIKRPL AVDFQHIASV LHGGIAAFAC LIGLQGGMRN QVIRQFAAVF

51  GDIAHQFGKQ GMAHAVCRPA RRRALSVGFH TFADDGFQVV GMLAGQPDDV
```

-continued

```
101  LFRQAF....  ..........  ..........  ..........  ..........

151  ..........  ..........  ..........  ..........  .....KRFGR

201  HWVYFNGRIP  TASRTLPNNS  RASLRAFCAP  ACKISSICEG  SAVSSL*
``` m204/a204 54.5% identity in 246 aa overlap

```
                    10         20         30         40         50         60
    m204.pep  MAAAEIKRPFAVDFQHIASVLHGGIAAFACLIGLQGGMRNXVIRQFAAVFGDIAHQFGKQ
              ||||||||||:|||||||||||||||||||||||||||| ||||||||||||||||||||
    a204      MAAAEIKRPLAVDFQHIASVLHGGIAAFACLIGLQGGMRNQVIRQFAAVFGDIAHQFGKQ
                    10         20         30         40         50         60

70         80         90        100        110        120
    m204.pep  GMAHAVFCPTCRTVLIIGFHTFAADGFQVAGMLADQSDNILFRQAFNRITDLFFAVVGFA
              |||||| |: | :|:||||||:|||||:|||||:|||| | |::||||||
    a204      GMAHAVCRPARRRALSVGFHTFADDGFQVVGMLAGQPDGVLFRQAR--------------
                    70         80         90        100

130        140        150        160        170        180
    m204.pep  FAALSQIQTGNRRIVDIYDFENRFRRALYRVLRLYRRIXGFAATAXQQAAAQYGKXXXQH a204      ------------------------------------------------------------

190        200        210        220        230        240
    m204.pep  STXLMVSKCRLKRGRRRFGRHRVHFNGRMPTASGTLSNNSRASLRAFAAPACKISSICEG
                          :|||||  |:||||:||||  || |||||||||||||  ||||||||||||
    a204      --------------KRFGRHWVYFNGRIPTASRTLPNNSRASLRAFCAPACKISSICEG
                             110        120        130        140        150 m204.pep  SAVSSLX
              |||||||
    a204      SAVSSLX
```

The following partial DNA sequence was identified in *N. gonorrhoeae* <SEQ ID 703>:

```
g205.seq
  1  atgctgaaaa tacctttgc  cgtgttgggc ggctgcctgc tgcttgccgc 51  ctgcggcaaa tccgaaaata cggcggaaca gccgcaaaat gcggcacaaa 101  gcgcgccgaa accggttttc aaagtcaaat acatcgacaa tacggcgatt 151  gccggttttgg ctttgggaca aagtagcgaa ggcaaaacca cgacggcaa 201  aaaacaaatc agttatccga ttaaaggctt gccggaacaa aacgccgtcc 251  ggctgaccgg aaagcatccc aacgacttgg aagccgtcgt cggcaaatgt 301  atggaaaccg acggaaagga cgcgccttcg ggctgggcgg aaaacggcgt 351  gtgccatacc ttgtttgcca aactggtggg caatatcgcc gaagacggcg 401  gcaaactgac tgattacctg atttcgcatt ccgccctgca accctatcag 451  gcaggcaaaa gcggctatgc cgccgtgcag aacggacgct atgtgctgga 501  aatcgacagc gagggggcgt tttatttccg ccgccgccat tattga
```

This corresponds to the amino acid sequence <SEQ ID 704; ORF 205.ng>:

```
g205.pep
  1  MLKIPFAVLG GCLLLAACGK SENTAEQPQN AAQSAPKPVF KVKYIDNTAI

51  AGLALGQSSE GKTNDGKKQI SYPIKGLPEQ NAVRLTGKHP NDLEAVVGKC

101  METDGKDAPS GWAENGVCHT LFAKLVGNIA EDGGKLTDYL ISHSALQPYQ

151  AGKSGYAAVQ NGRYVLEIDS EGAFYFRRRH Y
```

The following partial DNA sequence was identified in *N. meningitidis* <SEQ ID 705>:

```
m205.seq
    1 ATGCTGAAwA CwTyTTTTGC CGTATTGGGC GGCTGCCTGC TGCyTtGCCG 51 tGCGGCAAAT CCGwAAATAC GGCGGTACAG CCGCAAAACG CGGTACAAAG

101 CGCGCCGAAA CCGGTTTTCA AAGTCATATA TATCGACAAT ACGGCGATTG

151 CCGGTTTGGA TTTGGGACAA AGCAGCGAAG GCAAAACCAA CGACGGCAAA

201 AAACAAATCA GTTATCCGAT TAAAGGCTTG CCGGAACAAA ATGTTATCCG

251 ACTGATCGGC AAGCATCCCG GCGACTTGGA AGCCGTCAGC GGCAAATGTA

301 TGGAAACCGA TGATAAGGAC AGTCCGGCAG GTTGGGCAGA AAACGGCGTG

351 TGCCATACCT TGTTTGCCAA ACTGGTGGGC AATATCGCCG AAGACGGCGG

401 CAAACTGACG GATTACCTAG TTTCGCATGC CGCCCTGCAA CCCTATCAGG

451 CAGGCAAAAG CGGCTATGCC GCCGTGCAGA ACGGACGCTA TGTGCTGGAA

501 ATCGACAGCG AAGGGGCGTT TTATTTCCGC CGCCGCCATT ATTGA
```

This corresponds to the amino acid sequence <SEQ ID 706; ORF 205>:

```
m205.pep
    1 MLXTXFAVLG GCLLXCRCGK SXNTAVQPQN AVQSAPKPVF KVIYIDNTAI

51 AGLDLGQSSE GKTNDGKKQI SYPIKGLPEQ NVIRLIGKHP GDLEAVSGKC

101 METDDKDSPA GWAENGVCHT LFAKLVGNIA EDGGKLTDYL VSHAALQPYQ

151 AGKSGYAAVQ NGRYVLEIDS EGAFYFRRRH Y*
```

Computer analysis of this amino acid sequence gave the following results:

Homology with a Predicted ORF from *N. gonorrhoeae*

ORF 205 shows 88.4% identity over a 181 aa overlap with a predicted ORF (ORF 205.ng) from *N. gonorrhoeae*:

```
m205/g205

10         20         30         40         50         60
     m205.pep   MLXTXFAVLGGCLLXCRCGKSXNTAVQPQNAVQSAPKPVFKVIYIDNTAIAGLDLGQSSE
                ||  ||||||||| |||| ||| ||||| :||||||||||| |||||||||| ||||||
     g205       MLKIPFAVLGGCLLLAACGKSENTAEQPQNAAQSAPKPVFKVKYIDNTAIAGLALGQSSE
                     10         20         30         40         50         60

70         80         90        100        110        120
     m205.pep   GKTNDGKKQISYPIKGLPEQNVIRLIGKHPGDLEAVSGKCMETDDKDSPAGWAENGVCHT
                ||||||||||||||||||||||::|| ||||:|||| |||||||||| ||:|:||||||||
     g205       GKTNDGKKQISYPIKGLPEQNAVRLTGKHPNDLEAVVGKCMETDGKDAPSGWAENGVCHT
                     70         80         90        100        110        120

130        140        150        160        170        180
     m205.pep   LFAKLVGNIAEDGGKLTDYLVSHAALQPYQAGKSGYAAVQNGRYVLEIDSEGAFYFRRRH
                ||||||||||||||||||||:||:||||||||||||||||||||||||||||||||||||
     g205       LFAKLVGNIAEDGGKLTDYLISHSALQPYQAGKSGYAAVQNGRYVLEIDSEGAFYFRRRH
                    130        140        150        160        170        180 m205.pep   YX
                |
     g205       Y
```

The following partial DNA sequence was identified in *N. meningitidis* <SEQ ID 707>:

```
a205.seq (partial)
    1 TCCGAACCTC TTAAAGGCTT GCCGGAACAA AACGTCGTCC GGCTGACCGG

51 CAAGCATCCC AACGACTTGG AAGCCGTCGT CGGCAAATGT ATGGAAACCG
```

```
101 ACGGAAAGGG CGCGCCTTCG GGCTGGGCGG CAAACGGCGT GTGCCATACC

151 TTGTTTGCCA AACTGGTGGG CAATATCGCC GAAGACGGCG GCAAACTGAC

201 GGATTACCTG ATTTCGCATT CCGCCCTGCA ACCCTATCAG GCAGGCAAAA

251 GCGGCTATGC CGCCGTGCAG AACGGACGCT ATGTGCTGGA AATCGACAGC

301 GAGGGGGCGT TTTATTTCCG CCGCCGCCAT TATTGA
```

This corresponds to the amino acid sequence <SEQ ID 708; ORF 205.a>:

```
a205.pep (partial)
  1 SEPLKGLPEQ NVVRLTGKHP NDLEAVVGKC METDGKGAPS GWAANGVCHT

51 LFAKLVGNIA EDGGKLTDYL ISHSALQPYQ AGKSGYAAVQ NGRYVLEIDS

101 EGAFYFRRRH Y*
``` m205/a205 88.3% identity in 111 aa overlap

```
                    50         60         70         80         90        100
    m205.pep  KVIYIDNTAIAGLDLGQSSEGKTNDGKKQISYPIKGLPEQNVIRLIGKHPGDLEAVSGKC
                                        | |:||||||||:|| ||||:||||| |||
    a205                                SEPLKGLPEQNVVRLTGKHPNDLEAVVGKC
                                                 10         20         30
                   110        120        130        140        150        160
    m205.pep  METDDKDSPAGWAENGVCHTLFAKLVGNIAEDGGKLTDYLVSHAALQPYQAGKSGYAAVQ
              |||| | :|:||| ||||||||||||||||||||||||||:||:|||||||||||||||
    a205      METDGKGAPSGWAANGVCHTLFAKLVGNIAEDGGKLTDYLISHSALQPYQAGKSGYAAVQ
                        40         50         60         70         80         90
                   170        180
    m205.pep  NGRYVLEIDSEGAFYFRRRHYX
              ||||||||||||||||||||||
    a205      NGRYVLEIDSEGAFYFRRRHYX
                       100        110
```

The following partial DNA sequence was identified in *N. gonorrhoeae* <SEQ ID 709>:

```
g205-1.seq (partial)
  1 ATGCTGAAAA TAcCTTTTGC CGTGTTGGGC GGCTGCCTGC TGCTTGCCGC

51 CTGCGGCAAA TCCGAAAATA CGGCGGAACA GCCGCAAAAT GCGGCACAAA

101 GCGCGCCGAA ACCGGTTTTC AAAGTCAAAT ACATCGACAA TACGGCGATT

151 GCCGGTTTGG CTTTGGGACA AAGTAGCGAA GGCAAAACCA ACGACGGCAA

201 AAAACAAATC AGTTATCCGA TTAAAGGCTT GCCGGAACAA AACGCCGTCC

251 GGCTGACCGG AAAGCATCCC AACGACTTGG AAGCCGTCGT CGGCAAATGT

301 ATGGAAACCG ACGGAAAGGA CGCGCCTTCG GGCTGGGCGG AAAACGGCGT

351 GTGCCATACC TTGTTTGCCA AACTGGTGGG CAATATCGCC GAAGACGGCG

401 GCAAACTGAC TGATTACCTG ATTTCGCATT CCGCCCTGCA ACCCTATCAG

451 GCAGGCAAAA GCGGCTATGC CGCCGTGCAG AACGGACGCT ATGTGCTGGA

501 AATCGACAGC GAGGGGGCGT TTTA
```

This corresponds to the amino acid sequence <SEQ ID 710; ORF 205-1.ng>:

```
g205-1.pep (partial).
  1 MLKIPFAVLG GCLLLAACGK SENTAEQPQN AAQSAPKPVF KVKYIDNTAI

51 AGLALGQSSE GKTNDGKKQI SYPIKGLPEQ NAVRLTGKHP NDLEAVVGKC
```

-continued

```
101 METDGKDAPS GWAENGVCHT LFAKLVGNIA EDGGKLTDYL ISHSALQPYQ

151 AGKSGYAAVQ NGRYVLEIDS EGAF
```

The following partial DNA sequence was identified in *N. meningitidis* <SEQ ID 711>:

```
m205-1.seq . . .
  1 ATGCTGAAAA CATCTTTTGC CGTATTGGGC GGCTGCCTGC TGCTTGCCGC

51 CTGCGGCAAA TCCGAAAATA CGGCGGAACA GCCGCAAAAC GCGGTACAAA

101 GCGCGCCGAA ACCGGTTTTC AAAGTCAAAT ATATCGACAA TACGGCGATT

151 GCCGGTTTGG ATTTGGGACA AAGCAGCGAA GGCAAAACCA ACGACGGCAA

201 AAAACAAATC AGTTATCCGA TTAAAGGCTT GCCGGAACAA AATGTTATCC

251 GACTGATCGG CAAGCATCCC GGCGACTTGG AAGCCGTCAG CGGCAAATGT

301 ATGGAAACCG ATGATAAGGA CAGTCCGGCA GGTTGGGCAG AAAACGGCGT

351 GTGCCATACC TTGTTTGCCA AACTGGTGGG CAATATCGCC GAAGACGGCG

401 GCAAACTGAC GGATTACCTA GTTTCGCATG CCGCCCTGCA ACCCTATCAG

451 GCAGGCAAAA GCGGCTATGC CGCCGTGCAG AACGGACGCT ATGTGCTGGA

501 AATCGACAGC GAAGGGGCGT TTATTTCCG CCGCCGCCAT TATTGA
```

This corresponds to the amino acid sequence <SEQ ID 712; ORF 205-1>:

```
m205-1.pep

1   MLKTSFAVLG GCLLLAACGK SENTAEQPQN AVQSAPKPVF KVKYIDNTAI

51   AGLDLGQSSE GKTNDGKKQI SYPIKGLPEQ NVIRLIGKHP GDLEAVSGKC

101   METDDKDSPA GWAENGVCHT LFAKLVGNIA EDGGKLTDYL VSHAALQPYQ

151   AGKSGYAAVQ NGRYVLEIDS EGAFYFRRRH Y* m205/g205-1 92.0% identity in 174 aa overlap 10         20         30         40         50         60
    g205-1.pep  MLKIPFAVLGGCLLLAACGKSENTAEQPQNAAQSAPKPVFKVKYIDNTAIAGLALGQSSE
                |||  |||||||||||||||||||||||||||:||||||||||||||||||||| ||||||
    m205-1      MLKTSFAVLGGCLLLAACGKSENTAEQPQNAVQSAPKPVFKVKYIDNTAIAGLDLGQSSE
                    10         20         30         40         50         60

70         80         90        100        110        120
    g205-1.pep  GKTNDGKKQISYPIKGLPEQNAVRLTGKHPNDLEAVVGKCMETDGKDAPSGWAENGVCHT
                ||||||||||||||||||||||::||  ||||:|||| |||||| ||:|:||||||||||
    m205-1      GKTNDGKKQISYPIKGLPEQNVIRLIGKHPGDLEAVSGKCMETDDKDSPAGWAENGVCHT
                    70         80         90        100        110        120

130        140        150        160        170
    g205-1.pep  LFAKLVGNIAEDGGKLTDYLISHSALPYQAGKSGYAAVQNGRYVLEIDSEGAF
                ||||||||||||||||||||:||:|||||||||||||||||||||||||||||
    m205-1      LFAKLVGNIAEDGGKLTDYLVSHAALQPYQAGKSGYAAVQNGRYVLEIDSEGAFYFRRRH
                   130        140        150        160        170        180
    m205-1      YX
```

The following partial DNA sequence was identified in *N. meningitidis* <SEQ ID 713>:

```
a205-1.seq (partial)
  1 CCTCTTAAAG GCTTGCCGGA ACAAAACGTC GTCCGGCTGA CCGGCAAGCA

51 TCCCAACGAC TTGGAAGCCG TCGTCGGCAA ATGTATGGAA ACCGACGGAA
```

-continued
```
101 AGGGCGCGCC TTCGGGCTGG GCGGCAAACG GCGTGTGCCA TACCTTGTTT

151 GCCAAACTGG TGGGCAATAT CGCCGAAGAC GGCGGCAAAC TGACGGATTA

201 CCTGATTTCG CATTCCGCCC TGCAACCCTA TCAGGCAGGC AAAAGCGGCT

251 ATGCCGCCGT GCAGAACGGA CGCTATGTGC TGGAAATCGA CAGCGAGGGG

301 GCGTTTTATT TCCGCCGCCG CCATTATTGA
```

This corresponds to the amino acid sequence <SEQ ID 714; ORF 205-1.a>:

```
    a205-1.pep (partial)

1  PLKGLPEQNV VRLTGKHPND LEAVVGKCME TDGKGAPSGW AANGVCHTLF

51  AKLVGNIAED GGKLTDYLIS HSALQPYQAG KSGYAAVQNG RYVLEIDSEG

101  AFYFRRRHY* m205-1/a205-1  89.0% identity in 109 aa overlap 50         60         70         80         90        100
    m205-1.pep  KYIDNTAIAGLDLGQSSEGKTNDGKKQISYPIKGLPEQNVIRLIGKHPGDLEAVSGKCME
                                              |:||||||||:||  ||||:|||||  |||||
    a205-1                                    PLKGLPEQNVVRLTGKHPNDLEAVVGKCME
                                                       10         20         30

110        120        130        140        150        160
    m205-1.pep  TDDKDSPAGWAENGVCHTLFAKLVGNIAEDGGKLTDYLVSHAALQPYQAGKSGYAAVQNG
                ||  | :|:|||  |||||||||||||||||||||||||:||:|||||||||||||||||
    a205-1      TDGKGAPSGWAANGVCHTLFAKLVGNIAEDGGKLTDYLISHSALQPYQAGKSGYAAVQNG
                       40         50         60         70         80         90

170        180
    m205-1.pep  RYVLEIDSEGAFYFRRRHYX
                ||||||||||||||||||||
    a205-1      RYVLEIDSEGAFYFRRRHYX
                       100        110
```

The following partial DNA sequence was identified in *N. gonorrhoeae* <SEQ ID 715>:

```
g206.seq
  1 atgttttccc ccgacaaaac ccttttcctc tgtctcggcg cactgctcct 51 cgcctcatgc ggcacgacct ccggcaaaca ccgccaaccg aaacccaaac 101 agacagtccg gcaaatccaa gccgtccgca tcagccacat cggccgcaca 151 caaggctcgc aggaactcat gctccacagc ctcggactca tcggcacgcc 201 ctacaaatgg ggcggcagca gcaccgcaac cggcttcgac tgcagcggca 251 tgattcaatt ggtttacaaa aacgccctca acgtcaagct gccgcgcacc 301 gcccgcgaca tggcggcggc aagccgcaaa atccccgaca gccgcctcaa 351 ggccggcgac atcgtattct tcaacaccgg cggcgcacac cgctactcac 401 acgtcggact ctacatcggc aacggcgaat tcatccatgc cccggcagc 451 ggcaaaacca tcaaaaccga aaaactctcc acaccgtttt acgccaaaaa 501 ctaccttgga gcgcatacgt ttttacaga atga
```

This corresponds to the amino acid sequence <SEQ ID 716; ORF 206.ng>:

```
g206.pep
  1  MFSPDKTLFL CLGALLLASC GTTSGKHRQP KPKQTVRQIQ AVRISHIGRT

51  QGSQELMLHS LGLIGTPYKW GGSSTATGFD CSGMIQLVYK NALNVKLPRT
```

```
101 ARDMAAASRK IPDSRLKAGD IVFFNTGGAH RYSHVGLYIG NGEFIHAPGS

151 GKTIKTEKLS TPFYAKNYLG AHTFFTE*
```

The following partial DNA sequence was identified in *N. meningitidis* <SEQ ID 717>:

```
m206.seq
   1 ATGTTTCCCC CCGACAAAAC CCTTTTCCTC TGTCTCAGCG CACTGCTCCT

51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAr AACGCCCTCA ACGTCAAGCT GCCGCGCACC

301 GCCCGCGACA TGGCGGCGGC AAGCCGsAAA ATCCCCGAcA GCCGCyTCAA

351 GGCCGGCGAC CTCGTATTCT TCAACACCGG CGGCGCACAC CGCTACTCAC

401 ACGTCGGACT CTACATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TTTTTACAGA ATGA
```

This corresponds to the amino acid sequence <SEQ ID 718; ORF 206>:

```
m206.pep . . .
   1 MFPPDKTLFL CLSALLLASC GTTSGKHRQP KPKQTVRQIQ AVRISHIDRT

51 QGSQELMLHS LGLIGTPYKW GGSSTATGFD CSGMIQFVYK NALNVKLPRT

101 ARDMAAASRK IPDSRXKAGD LVFFNTGGAH RYSHVGLYIG NGEFIHAPSS

151 GKTIKTEKLS TPFYAKNYLG AHTFFTE*
```

Computer analysis of this amino acid sequence gave the following results:
Homology with a Predicted ORF from *N. gonorrhoeae*
ORF 206 shows 96.0% identity over a 177 aa overlap with a predicted ORF (ORF 206.ng) from *N. gonorrhoeae*:

```
    m206/g206
                         10        20        30        40        50        60
         m206.pep    MFPPDKTLFLCLSALLLASCGTTSGKHRQPKPKQTVRQIQAVRISHIDRTQGSQELMLHS
                     || |||||||||:||||||||||||||||||||||||||||||||||| ||||||||||
         g206        MFSPDKTLFLCLGALLLASCGTTSGKHRQPKPKQTVRQIQAVRISHIGRTQGSQELMLHS
                         10        20        30        40        50        60

70        80        90       100       110       120
         m206.pep    LGLIGTPYKWGGSSTATGFDCSGMIQFVYKNALNVKLPRTARDMAAASRKIPDSRXKAGD
                     |||||||||||||||||||||||||||:||||||||||||||||||||||||||| |||
         g206        LGLIGTPYKWGGSSTATGFDCSGMIQLVYKNALNVKLPRTARDMAAASRKIPDSRLKAGD
                         70        80        90       100       110       120

130       140       150       160       170
         m206.pep    LVFFNTGGAHRYSHVGLYIGNGEFIHAPSSGKTIKTEKLSTPFYAKNYLGAHTFFTEX
                     :||||||||||||||||||||||||||||:||||||||||||||||||||||||||||
         g206        IVFFNTGGAHRYSHVGLYIGNGEFIHAPGSGKTIKTEKLSTPFYAKNYLGAHTFFTE
                        130       140       150       160       170
```

The following partial DNA sequence was identified in *N. meningitidis* <SEQ ID 719>:

```
a206.seq
   1 ATGTTTCCCC CCGACAAAAC CCTTTTCCTC TGTCTCAGCG CACTGCTCCT

51 CGCCTCATGC GGCACGACCT CCGGCAAACA CCGCCAACCG AAACCCAAAC

101 AGACAGTCCG GCAAATCCAA GCCGTCCGCA TCAGCCACAT CGACCGCACA

151 CAAGGCTCGC AGGAACTCAT GCTCCACAGC CTCGGACTCA TCGGCACGCC

201 CTACAAATGG GGCGGCAGCA GCACCGCAAC CGGCTTCGAT TGCAGCGGCA

251 TGATTCAATT CGTTTACAAA AACGCCCTCA ACGTCAAGCT GCCGCGCACC

301 GCCCGCGACA TGGCGGCGGC AAGCCGCAAA ATCCCCGACA GCCGCCTTAA

351 GGCCGGCGAC CTCGTATTCT TCAACACCGG CGGCGCACAC CGCTACTCAC

401 ACGTCGGACT CTATATCGGC AACGGCGAAT TCATCCATGC CCCCAGCAGC

451 GGCAAAACCA TCAAAACCGA AAAACTCTCC ACACCGTTTT ACGCCAAAAA

501 CTACCTCGGC GCACATACTT TCTTTACAGA ATGA
```

This corresponds to the amino acid sequence <SEQ ID 720; ORF 206.a>:

```
a206.pep
   1 MFPPDKTLFL CLSALLLASC GTTSGKHRQP KPKQTVRQIQ AVRISHIDRT

51 QGSQELMLHS LGLIGTPYKW GGSSTATGFD CSGMIQFVYK NALNVKLPRT

101 ARDMAAASRK IPDSRLKAGD LVFFNTGGAH RYSHVGLYIG NGEFIHAPSS

151 GKTIKTEKLS TPFYAKNYLG AHTFFTE*
``` m206/a206 99.4% identity in 177 aa overlap

```
                10         20         30         40         50         60
m206.pep MFPPDKTLFLCLSALLLASCGTTSGKHRQPKPKQTVRQIQAVRISHIDRTQGSQELMLHS
         ||||||||||||||||||||||||||||||||||||||||||||||||||||||||||||
a206     MFPPDKTLFLCLSALLLASCGTTSGKHRQPKPKQTVRQIQAVRISHIDRTQGSQELMLHS
                10         20         30         40         50         60

70         80         90        100        110        120
m206.pep LGLIGTPYKWGGSSTATGFDCSGMIQFVYKNALNVKLPRTARDMAAASRKIPDSRXKAGD
         ||||||||||||||||||||||||||||||||||||||||||||||||||||||| ||||
a206     LGLIGTPYKWGGSSTATGFDCSGMIQFVYKNALNVKLPRTARDMAAASRKIPDSRLKAGD
                70         80         90        100        110        120

130        140        150        160        170
m206.pep LVFFNTGGAHRYSHVGLYIGNGEFIHAPSSGKTIKTEKLSTPFYAKNYLGAHTFFTEX
         |||||||||||||||||||||||||||||||||||||||||||||||||||||||||
a206     LVFFNTGGAHRYSHVGLYIGNGEFIHAPSSGKTIKTEKLSTPFYAKNYLGAHTFFTEX
               130        140        150        160        170
```

The following partial DNA sequence was identified in *N. gonorrhoeae* <SEQ ID 721>:

```
g209.seq
   1 atgctgcggc atttaggaaa cgacttcgcc ttgggcgcgt tgttttttcga 51 tgctgcggtt gatgtgccac tgctgggcga tggtcaggag gttgttgacc 101 acccagtaga gaaccaaacc ggcagggaag aagaagaaca tgacggagaa 151 aaccaacggc atgattttca tcattttcgc ctgcatcggg tcggtcggcg 201 gcgggttcag ataggtttgg gcgaacatcg ttgccgccat aatgatgggc 251 aggatgtagt aggggtcggc gcggctgagg tcggtaatcc agcccagcca
```

-continued
```
301 aggtgcctgg cgcaattcta cggaggcgaa caatgcccag tacaagccga 351 tgaagacggg gatttgcaac agcataggca gacagccgcc cagcgggttg 401 atttcctcgt cttcgaaaag ctgcatcatc gcttgctgtt gcgccatacg 451 gtcgtcgccg tatttttctt tgatggtctg cagttcgggt gcggcggcac 501 gcattttcgc catcgaacgg taggaggcgt tggtcaatgg atacagtacg 551 gctttgacga tgatggtcaa aacgacgatt gcccagcccc agttgccgat 601 aatgttgtgc agttggttca ggagccagaa gagcggcgat gcgaaccagt 651 gtactttacc gtagtctttt gccagttgca ggttgtcggc gatgtttgcg 701 ataacggatg tggtttgcgg accggcatac aggttgaccg ccattttcgg 751 ttttggcccc cgggttggga tagcggttaa
```

This corresponds to the amino acid sequence <SEQ ID 722; ORF 209.ng>:

```
g209.pep
  1 MLRHLGNDFA LGALFFDAAV DVPLLGDGQE VVDHPVENQT GREEEEHDGE

51 NQRHDFHHFR LHRVGRRRVQ IGLGEHRCRH NDGQDVVGVG AAEVGNPAQP

101 RCLAQFYGGE QCPVQADEDG DLQQHRQTAA QRVDFLVFEK LHHRLLLRHT

151 VVAVFFFDGL QFGCGGTHFR HRTVGGVGQW IQYGFDDDGQ NDDCPAPVAD

201 NVVQLVQEPE ERRCEPVYFT VVFCQLQVVG DVCDNGCGLR TGIQVDRHFR

251 FWPPGWDSG*
```

The following partial DNA sequence was identified in *N. meningitidis* <SEQ ID 723>:

```
m209.seq
  1 ATGCTGCGGC ATTTAGGAAA CGACTTCGCC TTGGgGCGTT GTTTTTCGAT

51 GCTGCGGTTG ATGTGCCATT GCTGGGCGAT GGTCAGGAGG TTGTTGACTA

101 CCCAGTACAA TACCAGACCG GCAGGGAAGA AGAAGAACAT GACGGAGAAA

151 ACCAACGGCA TGATTTTCAT CATTTTCGCC TGCATCGGGT CGGTCGGCGG

201 CGGGTTCAGA TAAGTTTGGG CGAACATCGT TGCCGCCATA ATGATGGGCA

251 GGATGTAGTA GGGGTCGGCG CGGCTGAGGT CGGTAATCCA ACCCAGCCAA

301 GGTGCCTGGC GCAATTCTAC GGAGGCGAAC AATGCCCAAT ACAATCCGAT

351 GAAGACGGGG ATTTGCAACA GCATAGGCAG GCAGCCGCCC AGCGGGTTGA

401 TTTTCTCGTC TGTGTAAAGC TGCATCATCG CCTGTTGTTG CGCCATACGG

451 TCGTCGCCGT ATTTCTCTTT GATGGCTTGC AGTTTGGGTG CGGCGGCACG

501 CATTTTCGCC ATAGAGCGGT AAGAGGCGTT GGTCAATGGA TACAGTACGG

551 CTTTGACGAT GATGGTTAAA ACGATAATCG CCCAGCCCCA GTTGCCGATG

601 ATGTTGTGCA GTTGGTTCAG GAGCCAGAAG AGCGGGGAGG CGAACCAGTG

651 TACTTTGCCG TAGTCTTTGG CCAGTTGCAG GTTGTCGGCG ATGTTTGCGA

701 TGACGGATGT GGTCTGCGGG CCGGCGTAGA GGTTGATGGA GGCTTCGgTT

751 TCGCGCCGTT TTGGATGGCG GCTAAAGGCA CGCTGACGCT GGTGCTGTAC

801 AGCTTGTCGT TGCGGCGTTT GATGTCGATG TTGCACTCGC CTGCGGCGCA

851 AACGCTTTGT CTGCCTTTAG GTTGGAGAAT CCAGGTGGAC ATGAAGTGGT
```

-continued
```
 901 GTTCAATCAT GCCGAGCCAG CCGGTCGGGG TTTTGCGGAT GTATTCGGCC

951 TCGGATTTGC CGGATTTGGC ATCGTCGTCC AAGTCGGAAA AGCTGACTTT

1001 TTGGAAGTTG CCTTCAGGGG TATAA
```

This corresponds to the amino acid sequence <SEQ ID 724; ORF 209>:

```
m209.pep
   1 MLRHLGNDFA LGALFFDAAV DVPLLGDGQE VVDYPVQYQT GREEEEHDGE

51 NQRHDFHHFR LHRVGRRRVQ ISLGEHRCRH NDGQDVVGVG AAEVGNPTQP

101 RCLAQFYGGE QCPIQSDEDG DLQQHRQAAA QRVDFLVCVK LHHRLLLRHT

151 VVAVFLFDGL QFGCGGTHFR HRAVRGVGQW IQYGFDDDG* NDNRPAPVAD

201 DVVQLVQEPE ERGGEPVYFA VVFGQLQVVG DVCDDGCGLR AGVEVDGGFG

251 FAPFWMAAKG TLTLVLYSLS LRRLMSMLHS PAAQTLCLPL GWRIQVDMKW

301 CSIMPSQPVG VLRMYSASDL PDLASSSKSE KLTFWKLPSG V*
```

Computer analysis of this amino acid sequence gave the following results:
Homology with a Predicted ORF from *N. gonorrhoeae*
ORF 209 shows 88.5% identity over a 253 aa overlap with a predicted ORF (ORF 209.ng) from *N. gonorrhoeae*:

```
   m209/g209
                        10         20         30         40         50         60
      m209.pep    MLRHLGNDFALGALFFDAAVDVPLLGDGQEVVDYPVQYQTGREEEEHDGENQRHDFHHFR
                  |||||||||||||||||||||||||||||||:||: ||||||||||||||||||||||||
      g209        MLRHLGNDFALGALFFDAAVDVPLLGDGQEVVDHPVENQTGREEEEHDGENQRHDFHHFR
                        10         20         30         40         50         60

70         80         90        100        110        120
      m209.pep    LHRVGRRRVQISLGEHRCRHNDGQDVVGVGAAEVGNPTQPRCLAQFYGGEQCPIQSDEDG
                  |||||||||||:||||||||||||||||||||||||||||:|||||||||||:|:||||
      g209        LHRVGRRRVQIGLGEHRCRHNDGQDVVGVGAAEVGNPAQPRCLAQFYGGEQCPVQADEDG
                        70         80         90        100        110        120

130        140        150        160        170        180
      m209.pep    DLQQHRQAAAQRVDFLVCVKLHHRLLLRHTVVAVFLFDGLQFGCGGTHFRHRAVRGVGQW
                  |||||||:|||||||||| |||||||||||||||||:|||||||||||||||:| |||||
      g209        DLQQHRQTAAQRVDFLVFEKLHHRLLLRHTVVAVFFFDGLQFGCGGTHFRHRTVGGVGQW
                       130        140        150        160        170        180

190        200        210        220        230        240
      m209.pep    IQYGFDDDGXNDNRPAPVADDVVQLVQEPEERGGEPVYFAVVFGQLQVVGDVCDDGCGLR
                  |||||||||  ||: ||||||:|||||||||| |||||:||| ||||||||||:|||||
      g209        IQYGRDDDGQNDDCPAPVADNVVQLVQEPEERRCEPVYFTVVFCQLQVVGDVCDNGCGLR
                       190        200        210        220        230        240

250        260        270        280        290        299
      m209.pep    AGVEVDGGFGF-APFWMAAKGTLTLVLYSLSLRRLMSMLHSPAAQTLCLPLGWRIQVDMK
                  :|::||  |  |  |
      g209        TGIQVDRHFRFWPPGWDSG
                       250
```

The following partial DNA sequence was identified in *N. meningitidis* <SEQ ID 725>:

```
a209.seq
   1 ATGCTGCGGC ATTTAGGAAA CGACTTCGCC TTGGGCGCGT TGTTTTTCGA

51 TGCTGCGGTT GATGTGCCAT TGCTGGGCGA TGGTCAGGAG GTTGTTGATC

101 ACCCAGTACA ATACCAGACC GGCAGGGAAG AAGAAGAACA TGACGGAGAA

151 AACCAAAGGC ATGATTTTCA TCATTTTCGC CTGCATCGGG TCGGTCGGCG

201 GCGGGTTCAG ATAGGTTTGG GCGAACATCG TTGCCGCCAT AATGATGGGC

251 AGGATGTAGT AGGGGTCGGC GCGGCTGAGG TCGGTAATCC AACCCAGCCA
```

```
-continued
 301 AGGTGCCTGG CGCAATTCTA CGGAGGCGAA CAATGCCCAA TACAATCCGA

351 TGAAGACGGG GATTTGCAAC AGCATAGGCA GGCAGCCGCC CAGCGGGTTG

401 ATTTTCTCGT CTGTGTAAAG CTGCATCATG GCTTGTTGCT GCGCCATACG

451 GTCGTCGCCG TATTTCTCTT TGATGGCTTG CAGTTTGGGC GCGGCGGCAC

501 GCATTTTCGC CATCGAACGG TAAGAGGCGT TGGTCAATGG ATACAGTACG

551 GCTTTGACGA TGATGGTTAA AACGATAATC GCCCAGCCCC AGTTGCCGAT

601 GATGTTGTGC AGTTGGTTCA AAAGCCAAAA GAGGGGGGAG GCGAACCAGT

651 GTACTTTGCC GTAGTCTTTG GCCAGTTGCA GGTTGTCGGC GATGTTTGCG

701 ATAACGGATG TGGTCTGTGG GCCGGCGTAG AGGTTGATGG AGGCTTCGGT

751 TTCGCACCGT TTTGGATAGC GGCTAAAGGC ACGCTGACGC TGGTGCTGTA

801 CAGCTTGTCG TTGCGGCGTT TGATGTCGAT ACGGCAGTCG CCAGCGGCGC

851 AAACGCTTTG TCCGCCTTTG GGTTGGAGGA TCCAGGTGGA CATGAAGTGG

901 TGTTCAATCA TGCCGAGCCA GCCGGTCGGG GTTTTGCGGA TGTATTCGGC

951 CTCGGATTTG CCGGATTTGG CATCGTCGTC CAAGTCGGAG AAGCTGACTT

1001 TTTGGAAGTT GCCTTCAGGG GTATAA
```

This corresponds to the amino acid sequence <SEQ ID 726; ORF 209.a>:

```
a209.pep
   1 MLRHLGNDFA LGALFFDAAV DVPLLGDGQE VVDHPVQYQT GREEEEHDGE

51 NQRHDFHHFR LHRVGRRRVQ IGLGEHRCRH NDGQDVVGVG AAEVGNPTQP

101 RCLAQFYGGE QCPIQSDEDG DLQQHRQAAA QRVDFLVCVK LHHGLLLRHT

151 VVAVFLFDGL QFGRGGTHFR HRTVRGVGQW IQYGFDDDG* NDNRPAPVAD

201 DVVQLVQKPK EGGGEPVYFA VVFGQLQVVG DVCDNGCGLW AGVEVDGGFG

251 FAPFWIAAKG TLTLVLYSLS LRRLMSIRQS PAAQTLCPPL GWRIQVDMKW

301 CSIMPSQPVG VLRMYSASDL PDLASSSKSE KLTFWKLPSG V*
``` m209/a209 95.6% identity in 341 aa overlap

```
                  10         20         30         40         50         60
    m209.pep  MLRHLGNDFALGALFFDAAVDVPLLGDGQEVVDYPVQYQTGREEEEHDGENQRHDFHHFR
              ||||||||||||||||||||||||||||||||| :||||||||||||||||||||||||
    a209      MLRHLGNDFALGALFFDAAVDVPLLGDGQEVVDHPVQYQTGREEEEHDGENQRHDFHHFR
                  10         20         30         40         50         60

70         80         90        100        110        120
    m209.pep  LHRVGRRRVQISLGEHRCRHNDGQDVVGVGAAEVGNPTQPRCLAQFYGGEQCPIQSDEDG
              ||||||||||:|||||||||||||||||||||||||||||||||||||||||||||||||
    a209      LHRVGRRRVQIGLGEHRCRHNDGQDVVGVGAAEVGNPTQPRCLAQFYGGEQCPIQSDEDG
                  70         80         90        100        110        120

130        140        150        160        170        180
    m209.pep  DLQQHRQAAAQRVDFLVCVKLHHRLLLRHTVVAVFLFDGLQFGCGGTHFRHRAVRGVGQW
              |||||||||||||||||||||||:|||||||||||||||||| |||||||:||||||||
    a209      DLQQHRQAAAQRVDFLVCVKLHHGLLLRHTVVAVFLFDGLQFGRGGTHFRHRTVRGVGQW
                 130        140        150        160        170        180

190        200        210        220        230        240
    m209.pep  IQYGFDDDGXNDNRPAPVADDVVQLVQEPEERGGEPVYFAVVFGQLQVVGDVCDDGCGLR
              |||| ||||||||||||||||||||||:|:| ||||||||||||||||||||||:||||
    a209      IQYGRDDDGXNDNRPAPVADDVVQLVQKPKEGGGEPVYFAVVFGQLQVVGDVCDNGCGLW
                 190        200        210        220        230        240

250        260        270        280        290        300
    m209.pep  AGVEVDGGFGFAPFWMAAKGTLTLVLYSLSLRRLMSMLHSPAAQTLCLPLGWRIQVDMKW
              ||||||||||| |||| ||||||||||||||||||||: :|||||||| ||||||||||
    a209      AGVEVDGGFGRAPFWIAAKGTLTLVLYSLSLRRLMSIRQSPAAQTLCPPLGWRIQVDMKW
                 250        260        270        280        290        300
```

```
              310        320        330        340
m209.pep   CSIMPSQPVGVLRMYSASDLPDLASSSKSEKLTFWKLPSGVX
           |||||||||||||||||||||||||||||||||||||||||
a209       CSIMPSQPVGVLRMYSASDLPDLASSSKSEKLTFWKLPSGVX
              310        320        330        340
```

The following partial DNA sequence was identified in *N. gonorrhoeae* <SEQ ID 727>:

```
g211.seq
   1 atgttgcgga ttgctgctgc caatcagttg ggcggtcgaa atggtgcggc 51 ggtgggaaac ggggtcgata agtttgggcg tggtgctgat aatcaggttg 101 agtttttgga aggaaacctg attgtagtcg gcgcgtccgg gcgtgccgct 151 gtaacggtag ccgtggcgca attcgagcgt gcgtttgttg tccttcagcg 201 agaagttacc ttctttggcg aagatgatgt tgtcgccgcc gtttttgtcc 251 tgttcgcgca ggaacaggtt tttcatgatg ccggattcgg tgtcaaaggt 301 ttcgacgaaa taaaccctgc cgttgcgctt gcccaagtta ttgaactcgc 351 cggcttccac caaagacaat tcctgcttct gcttcaaaat ttcggcatat 401 tcgcggctgc gcagctctgc ccacggtatc acccaaagct gcatgacggc 451 aatcaggatg gcaaacggca cggcaaactg catgacgggg cgtatccact 501 gtttcaacgc caatccgcag gatag
```

This corresponds to the amino acid sequence <SEQ ID 728; ORF 211.ng>:

```
g211.pep
   1 MLRIAAANQL GGRNGAAVGN GVDKFGRGAD NQVEFLEGNL IVVGASGRAA

51 VTVAVAQFER AFVVLQREVT FFGEDDVVAA VFVLFAQEQV FHDAGFGVKG

101 FDEINPAVAL AQVIELAGFH QRQFLLLLQN FGIFAAAQLC PRYHPKLHDG

151 NQDGKRHGKL HDGAYPLFQR QSAG*
```

The following partial DNA sequence was identified in *N. meningitidis* <SEQ ID 729>:

```
m211.seq
   1 ATGTTGCGGG TTGCTGCTGC CAATCAGTTG GGCGGTCGGA ATGGTACGGC

51 GGTGGGAAAC GGGGTCGATG AGTTTGGGCG TGGTGCTGAT AATCAGGTTG

101 AGTTTTTGGA AGGAAACCTG ATTGTAGTCG GCGCGTCCGG GCGTGCCGCT

151 GTAACGGTAG CCGTGGCGCA ATTCGAGCGT GCGTTTGTTG TCGTTCAGCG

201 AGAAGTTACC TTCTTTGGCG AAGATGATGT TGTCGCCGCC GTTTTTGTCC

251 TGTTCGCGCA GGAACAGGTT TTTCATGATG CCGGATTCGG TATCGAAGGT

301 TTCGACAAAA TAAACCCTGC CGTTGCGCTT GCCCAAACTG TTGAACTCGC

351 CTGCCTCCAC CAAAGACAAT TCCTGCTTCT GCTTCAGGAT TTCAGCGTAT

401 TCGCGGCTGC GTAGCTCTGC CCACGGTATC ACCCAAAGCT GCATGACGGC

451 AACCAAAACG GCAAACGGCA CGGCAAACTG CATCACCGGG CGTATCCATT

501 GTTTCAATGC CAATCCGCAg GATAG
```

This corresponds to the amino acid sequence <SEQ ID 730; ORF 211>:

```
m211.pep
   1 MLRVAAANQL GGRNGTAVGN GVDEFGRGAD NQVEFLEGNL IVVGASGRAA

51 VTVAVAQFER AFVVVQREVT FFGEDDVVAA VFVLFAQEQV FHDAGFGIEG

101 FDKINPAVAL AQTVELACLH QRQFLLLLQD FSVFAAAXLC PRYHPKLHDG

151 NQNGKRHGKL HHRAYPLFQC QSAG*
```

Computer analysis of this amino acid sequence gave the following results:
Homology with a Predicted ORF from *N. gonorrhoeae*
ORF 211 shows 89.1% identity over a 174 aa overlap with a predicted ORF (ORF 211.ng) from *N. gonorrhoeae*:

```
m211/g211

10         20         30         40         50         60
m211.pep  MLRVAAANQLGGRNGTAVGNGVDEFGRGADNQVEFLEGNLIVVGASGRAAVTVAVAQFER
          ||| :||||||||||| :||||||: |||||||||||||||||||||||||||||||||
g211      MLRIAAANQLGGRNGAAVGNGVDKFGRGADNQVEFLEGNLIVVGASGRAAVTVAVAQFER
                  10         20         30         40         50         60
                  70         80         90        100        110        120
m211.pep  AFVVVQREVTFFGEDDVVAAVFVLFAQEQVFHDAGFGIEGFDKINPAVALAQTVELACLH
          |||: ||||||||||||||||||||||||||||||||::|||:||||||||: ||| :|
g211      AFVVLQREVTFFGEDDVVAAVFVLFAQEQVFHDAGFGVKGFDEINPAVALAQVIELAGFH
                  70         80         90        100        110        120
                 130        140        150        160        170
m211.pep  QRQFLLLLQDFSVFAAAXLCPRYHPKLHDGNQNGKRHGKLHHRAYPLFQCQSAGX
          ||||||||::|:|||| |||||||||||||||||||||:|||| ||||:||||X
g211      QRQFLLLLQNFGIFAAAQLCPRYHPKLHDGNQNGKRHGKLHDGAYPLFQRQSAGX
                 130        140        150        160        170
```

The following partial DNA sequence was identified in *N. meningitidis* <SEQ ID 731>:

```
a211.seq
   1 ATGTTGCGGG TTGCTGCTGC CAATCAGTTG GGCGGTCGGA ATGGTACGGC

51 GGTGGGAAAC GGGGTCGATG AGTTTGGGCG TGGTGCTGAT AATCAGGTTG

101 AGTTTTTGGA AGGAAACCTG ATTGTAGTCG GCGCGTCCGG GCGTGCCGCT

151 GTAACGGTAG CCGTGGCGCA ATTCGAGCGT GCGTTTGTTG TCGTTCAGCG

201 AGAAGTTACT TTCTTTGGCG AAGATGATGT TGTCGCCGCC GTTTTTGTCC

251 TGTTCGCGCA GGAACAGGTT TTTCATGATG CCGGATTCGG TATCGAAGGT

301 TTCGACAAAA TAAACCCTGC CGTTGCGCTT GCCCAAACTG TTGAACCCGC

351 CTGCCTCCAC CAAAGACAAT TCCTGCTTCT GCTTCAGGAT TTCAGCGTAT

401 TCGCGGCTGC GTAGCTCTGC CCACGGTATC ACCCAAAGCT GCATGACGGC

451 AACCAAAACG GCAAACGGCA CGGCAAACTG CATCACCGGG CGTATCCATT

501 GTTTCAATGC CAATCCGCAG GATAG
```

This corresponds to the amino acid sequence <SEQ ID 732; ORF 211.a>:

```
a211.pep
   1 MLRVAAANQL GGRNGTAVGN GVDEFGRGAD NQVEFLEGNL IVVGASGRAA

51 VTVAVAQFER AFVVVQREVT FFGEDDVVAA VFVLFAQEQV FHDAGFGIEG
```

```
-continued
101 FDKINPAVAL AQTVEPACLH QRQFLLLLQD FSVFAAA*LC PRYHPKLHDG

151 NQNGKRHGKL HHRAYPLFQC QSAG*
```

5
m211/a211 99.4% identity in 174 aa overlap

```
                 10        20        30        40        50        60
m211.pep  MLRVAAANQLGGRNGTAVGNGVDEFGRGADNQVEFLEGNLIVVGASGRAAVTVAVAQFER
          ||||||||||||||||||||||||||||||||||| ||||||||||||||||||||||||
a211      MLRVAAANQLGGRNGTAVGNGVDEFGRGADNQVERLEGNLIVVGASGRAAVTVAVAQFER
                 10        20        30        40        50        60

70        80        90       100       110       120
m211.pep  AFVVVQREVTFFGEDDVVAAVFVLFAQEQVFHDAGFGIEGFDKINPAVALAQTVELACLH
          |||||||||||||||||||||||||||||||||||||||||||||||||||||| ||||
a211      AFVVVQREVTFFGEDDVVAAVFVLFAQEQVFHDAGFGIEGFDKINPAVALAQTVEPACLH
                 70        80        90       100       110       120

130       140       150       160       170
m211.pep  QRQFLLLLQDFSVFAAAXLCPRYHPKLHDGNQNGKRHGKLHHRAYPLFQCQSAGX
          |||||||||||||||||||||||||||||||||||||||||||||||||||||||
a211      QRQFLLLLQDFSVFAAAXLCPRYHPKLHDGNQNGKRHGKLHHRAYPLFQCQSAGX
                130       140       150       160       170
```

The following partial DNA sequence was identified in *N. gonorrhoeae* <SEQ ID 733>:

```
g212.seq (partial)
    1 atggacaatc tcgtatggga cggcattccc gacatccgca cactcgacca 51 aaccatccgc aaacacgcac acccgctcaa cctgattgtc tgcctccccg 101 ataatcagat tcccgatttt caaaccgcac aagatgcttc ggactcggaa 151 tgccgtctga agcaccgttt ggatcaggca acccagtgcc tccagttcga 201 cagcatcaac ctcatcgaac acatcctgcc cgatgtccgc ttctggctgg 251 ttcccccttc acgcacccgc cgcctgcacg aacacttcca ccacatttcc 301 tggcagaccg aagccatccc gcaaaccgaa agcaagtccg acaaaccctg 351 gtttgcactt ccacaaacat ccgaacggaa aaaaccggaa cacgtcctcg 401 tcatcggtgc aggcattgcc ggcgcatcga ccgcccacgc cttagcatca 451 cacggcattt ccgttaccgt attggaagcc gaaaagccg ctcaagccgc 501 cagcggcaac cggcaagggc tgctttacgc caaaatctcg ccgcacgaca 551 ccggacagac cgaactgctg cttgccggct acggctacac caaacgcctg 601 ctcggacaca tcctgcccga ctccgacact tggggcggca acggcatcat 651 ccacctcaat tacagccgca ccgaacaaca acgcaatcac gaattgggtt 701 tgcaaaaaca ccataaccac ctctaccgca gcatcacgtc tgcagaagcc 751 gaaaaaatcg ccggcatccc gctgaacacg ccctacgccg aaccattatg 801 cggactctac tggcaacacg gcgtatggct caatccgccc gcattcgtcc 851 gcaccctcct cagccatccg ctgatcgaac tatatgaaaa cacaacgtta 901 accggcattt cccacgacgg agaaaagtgg attgcaagca cgccaaacgg 951 cacatttacc gccacacaca tcatctactg caccggcgcg cacagcccct 1001 gcctgcccga aaccaacctc gccgccctac ccctcaggca aatacgcgga 1051 caaaccggcc tcacaccgtc cacccgttt tccgaacaac tgcgttgcgc 1101 cgtttcaggc gaaagctaca tcagcccgtc gtggcacgga ctgcactgct 1151 acggcgcgag ttttattccc aacagcagca ataccggatg gaacgaagcc
```

-continued

```
1201 gaagaagcct caaaccgcca agcattggca caccttaacc ccgcccttgc 1251 cgaatcattg ttt...
```

This corresponds to the amino acid sequence <SEQ ID 734; ORF 212.ng>:

```
g212.pep (partial)
   1 MDNLVWDGIP DIRTLDQTIR KHAHPLNLIV CLPDNQIPDF QTAQDASDSE

51 CRLKHRLDQA TQCLQFDSIN LIEHILPDVR FWLVPPSRTR RLHEHFHHIS

101 WQTEAIPQTE SKSDKPWFAL PQTSERKKPE HVLVIGAGIA GASTAHALAS

151 HGISVTVLEA RKAAQAASGN RQGLLYAKIS PHDTGQTELL LAGYGYTKRL

201 LGHILPDSDT WGGNGIIHLN YSRTEQQRNH ELGLQKHHNH LYRSITSAEA

251 EKIAGIPLNT PYAEPLCGLY WQHGVWLNPP AFVRTLLSHP LIELYENTTL

301 TGISHDGEKW IASTPNGTFT ATHIIYCTGA HSPCLPETNL AALPLRQIRG

351 QTGLTPSTPF SEQLRCAVSG ESYISPSWHG LHCYGASFIP NSSNTGWNEA

401 EEASNRQALA HLNPALAESL F...
```

The following partial DNA sequence was identified in *N. meningitidis* <SEQ ID 735>:

```
m212.seq
    1 ATGGACAATC TCGTATGGGA CGGCATTCCC GACATCCGCA CACTCGACCA

51 AGCCATCCGC AAACACGCAC CCCCGCTCAA CCTGATTATC TGCCTCCCCG

101 ATAATCAGAT TCCCGATTTT CAAACCGCAC AAGATGCTTC GGACGCGGAA

151 TGCCGTCTGA AGCACCGTTT GGATCAGGCA ATGCAGTGCC TCCAGTTCGA

201 CAGCATCAAC CTCATCGAAC ACATCCTGCC CGATGTCCGC TTCTGGCTGG

251 TTCCCCCTTC ACGCAATCAC CACCTGCACG AACATTTCCA CCACATTTCC

301 TGGCAGACCG AAGCCATCCC GCAAACCGAA AGCAAGCCCG ACAAACCCTG

351 GTTTGCACTT CCACAAACAT CCGAACGGCA AAAACCGGAA CACATCCTCG

401 TTATCGGCGC GGGCATATCC GGCGCGGCAA CCGCCCACGC CTTAGCATCA

451 CACGGCATTT CCGTTACCGT ATTGGAAGCC CGAAAAGCCG CCCAAGCCGC

501 CAGCGGCAAC CGCCAAGGGC TGCTCTACGC CAAAATCTCG CCGCACGACA

551 CCGAACAGAC CGAACTTTTG CTTGCCGGCT ACGGCTACAC CAAACGCCTG

601 CTCGGACACA TCCTGCCCGA ATCCGAAACC TGGGGCGGCA ACGGCATCAT

651 CCACCTCAAT TACAGCCGCA CCGAACAACA ACGCAATCAC GAATTGGGTT

701 TGCAAAAACA CCATAACCAC CTCTACCGCA GCATCACATC TGCAGAAGCC

751 GAAAAAATCG CCGGTATCCC ACTGTCCGTC CCATACGACC ACCCTTCATG

801 CGGACTCTAC TGGCAACACG GCGTATGGCT CAATCCACCC GCATTCGTCC

851 GCACCCTCCT CAACCATCCG CTCATTGGAC TACACGAAGA CACACCCTTG

901 ACCGACATTT CCCACGACGG GGaAAAGTGG ATTGCAAGCA CGCCAAACGG

951 CACATTTACC GCCACACACA TCATCTACTG CACCGGTGCG AACAGCCCCT

1001 ACCTACCCGA AACCAACCTC GCCGCCCTGC CTCTCAGGCA AATACGCGGA

1051 CAAACCGGCC TCACACCGTC CACCCCGTTT TCCGAACAAC TGCGTTGCGC

1101 CGTTTCAGGC GAAAGCTACA TCAGCCCGTC GTGGCACGGA CTGCACTGCT
```

-continued

```
1151 ACGGCGCGAG TTTTATTCCC AACAGCAGCC ATACCGGATG GAACGAAGCC

1201 GAAGAAGCCT CAAACCGCCA AGCATTGGCA CACCTTAACC CCGCCCTTTC

1251 CGAATCATTG TTTGCCGCCA ACCCAAACCC CCAAAAACAC CAAGGGCACG

1301 CCGCCATACG CTGCGACAGC CCCGACCACC TTCCCCTAGT CGGCGCACTC

1351 GGCGACATTG CCGCCATGCG GCAGACCTAC ACCAAACTCG CGCTGGACAA

1401 AAACTACCGC ATCGACACCC CATGCCCATA CCTGCCTAAT GCCTACGTCA

1451 ACACCGCGCA CGGCACCCGC GGACTCGCCA CCGCCCCCAT CTGCGCCGCC

1501 GmCAwTGCAG CCCAAATCsT AGGCyTGCCC CATCCCTTTT yAcAAcGCCT 1551 gCGCCACGCC cTAcACCCCA ACCGCACCAT CATCCGCGCC ATCGTCAGAA

1601 GGAAGGATCT AACCCCTTAA
```

This corresponds to the amino acid sequence <SEQ ID 736; ORF 212>:

```
m212.pep
   1 MDNLVWDGIP DIRTLDQAIR KHAPPLNLII CLPDNQIPDF QTAQDASDAE

51 CRLKHRLDQA MQCLQFDSIN LIEHILPDVR FWLVPPSRTH HLHEHFHHIS

101 WQTEAIPQTE SKPDKPWFAL PQTSERQKPE HILVIGAGIS GAATAHALAS

151 HGISVTVLEA RKAAQAASGN RQGLLYAKIS PHDTEQTELL LAGYGYTKRL

201 LGHILPESET WGGNGIIHLN YSRTEQQRNH ELGLQKHHNH LYRSITSAEA

251 EKIAGIPLSV PYDHPSCGLY WQHGVWLNPP AFVRTLLNHP LIGLHEDTPL

301 TDISHDGEKW IASTPNGTFT ATHIIYCTGA NSPYLPETNL AALPLRQIRG

351 QTGLTPSTPF SEQLRCAVSG ESYISPSWHG LHCYGASFIP NSSHTGWNEA

401 EEASNRQALA HLNPALSESL FAANPNPQKH QGHAAIRCDS PDHLPLVGAL

451 GDIAAMRQTY TKLALDKNYR IDTPCPYLPN AYVNTAHGTR GLATAPICAA

501 XXAAQIXGLP HPFXQRLRHA LHPNRTIIRA IVRRKDLTP*
```

Computer analysis of this amino acid sequence gave the following results:

Homology with a Predicted ORF from *N. gonorrhoeae*

ORF 212 shows 92.9% identity over a 421 aa overlap with a predicted ORF (ORF 212.ng) from *N. gonorrhoeae*:

```
    m212/g212
                      10         20         30         40         50         60
      m212.pep   MDNLVWDGIPDIRTLDQAIRKHAPPLNLIICLPDNQIPDFQTAQDASDAECRLKHRLDQA
                 ||||||||||||||||||:|||| |||| ||||:||||||||||||||||:|||||||||
          g212   MDNLVWDGIPDIRTLDQTIRKHAHPLNLIVCLPDNQIPDFQTAQDASDSECRLKHRLDQA
                      10         20         30         40         50         60

70         80         90        100        110        120
      m212.pep   MQCLQFDSINLIEHILPDVRFWLVPPSRTHHLHEHFHHISWQTEAIPQTESKPDKPWFAL
                 :||||||||||||||||||||||||||||::|||||||||||||||||||||:||||||
          g212   TQCLQFDSINLIEHILPDVRFWLVPPSRTRRLHEHFHHISWQTEAIPQTESKSDKPWFAL
                      70         80         90        100        110        120

130        140        150        160        170        180
      m212.pep   PQTSERQKPEHILVIGAGISGAATAHALASHGISVTVLEARKAAQAASGNRQGLLYAKIS
                 ||||||:||||:|||||||:||:|||||||||||||||||||||||||||||||||||||
          g212   PQTSERKKPEHVLVIGAGIAGASTAHALASHGISVTVLEARKAAQAASGNRQGLLYAKIS
                     130        140        150        160        170        180

190        200        210        220        230        240
      m212.pep   PHDTEQTELLLAGYGYTKRLLGHILPESETWGGNGIIHLNYSRTEQQRNHELGLQKHHNH
                 ||||  |||||||||||||||||||||:|:||||||||||||||||||||||||||||||
          g212   PHDTGQTELLLAGYGYTKRLLGHILPDSDTWGGNGIIHLNYSRTEQQRNHELGLQKHHNH
                     190        200        210        220        230        240
```

```
                    250        260        270        280        290        300
m212.pep    LYRSITSAEAEKIAGIPLSVPYDHPSCGLYWQHGVWLNPPAFVRTLLNHPLIGLHEDTPL
            ||||||||||||||||||||  :|    :|  ||||||||||||||||||||:|||  |:|:| |
g212        LYRSITSAEAEKIAGIPLNTPYAEPLCGLYWQHGVWLNPPAFVRTLLSHPLIELYENTTL
                    250        260        270        280        290        300

310        320        330        340        350        360
m212.pep    TDISHDGEKWIASTPNGTFTATHIIYCTGANSPYLPETNLAALPLRQIRGQTGLTPSTPF
            |  |||||||||||||||||||||||||||:||  ||||||||||||||||||||||||||
g212        TGISHDGEKWIASTPNGTFTATHIIYCTGAHSPCLPETNLAALPLRQIRGQTGLTPSTPF
                    310        320        330        340        350        360

370        380        390        400        410        420
m212.pep    SEQLRCAVSGESYISPSWHGLHCYGASFIPNSSHTGWNEAEEASNRQALAHLNPALSESL
            |||||||||||||||||||||||||||||||||:||||||||||||||||||||||||:|||
g212        SEQLRCAVSGESYISPSWHGLHCYGASFIPNSSNTGWNEAEEASNRQALAHLNPALAESL
                    370        380        390        400        410        420

430        440        450        460        470        480
m212.pep    FAANPNPQKHQGHAAIRCDSPDHLPLVGALGDIAAMRQTYTKLALDKNYRIDTPCPYLPN
            |
g212        F
```

The following partial DNA sequence was identified in *N. meningitidis* <SEQ ID 737>:

```
a212.seq
   1 ATGGACAATC TCGCATGGAA CGGCATTCCC GACATCCGCA CACTCGACCA
  51 AACCATCCGC AAACACGCAC ACCCGCTCAA CCTGATTGTC TGCCTCCCCG
 101 ATAATCAGAT TCCCAATTTT CAAACCGCAC AAGATGCTTC GGACGCGGAA
 151 TGCCGTCTGA AGCACCGTTT GGATCAGGCA ACCCAGTGCC TCCAGTTCGA
 201 CAGCATCAAC CTGATTGAAC ACATCCTGCC CGATGTCCGC TTCTGGCTGG
 251 TTCCCCCTTC ACGCACCCGC CGCCTGCACG AACACTTCCA CCACATTTCC
 301 TGGCAGACCG AAGCCATCCC GCAAACCGAA AGTAAGCCCG ACAAACCCTG
 351 GTTTGCACTT CCACAAACAT CCGAACGGCA AAAACCGGAA CACATCCTCG
 401 TTATCGGAGC GGGCATATCC GGCGCGGCAA CCGCCCACGC CTTAGCATCA
 451 TACGGCATTT CCGTTACCGT ATTGGAAGCC CGAAAAGCCG CCCAAGCCGC
 501 CAGCGGCAAC CGCCAAGGGC TGCTCTACGC CAAAATCTCG CCGCACGACA
 551 CCGAACAAAC CGAACTGCTG CTTGCCGGCT ACGGCTACAC CAAACGCCTG
 601 CTCGGACATA TCCTGCCCGA ATCCGAAACC TGGGGCGGCA ACGGCATCAT
 651 CCACCTCAAT TACAGCCGCA CCGAACAACA ACGCAATCAC GAATTGGGTT
 701 TGCAAAAACA CCATAACCAC CTCTACCGCA GCATCACGCA GGCAGAAGCC
 751 GAAAAAATCG CCGGCATCCC TCTGAACACG CCCTACGCCG AACCATTATG
 801 CGGACTGTTT TGGCAGTACG GCGTATGGCT CAATCCTCCC ACATTCGTCC
 851 GCGCCCTCCT CAGCCATCCG CTCATTGGAC TACACGAAGA CACACCGTTA
 901 ACCGACATTT CCCACGACGG GGAAAAGTGG ATTGCAAGCA CGCCAAACGG
 951 CACATTTACC GCCACACACA TCATCTACTG CACCGGTGCG AACAGCCCCT
1001 ACCTACCCGA AACCAACCTC GCCACCCTGC CCCTCAGGCA AATACGCGGA
1051 CAAACCGGCC TCACACCGTC CACCCCGTTT TCCGAACAAC TGCGTTGCGC
1101 CGTTTCAGGC GAAAGCTACA TCAGCCCGTC GTGGCACGGA CTGCACTGCT
1151 ACGGCGCGAG TTTTATTCCC AACAGCAGCC ATACCGGATG GAACGAAGCC
1201 GAAGAAGCCT CAAACCGCCA AGCATTGGCA CACCTTAACC CCGCCCTTTC
1251 CGAATCATTG TTTGCCGCCA ACCCAAACCC CCAAAAACAC CAAGGGCACG
1301 CCGCCATACG CTGCGACAGC CCCGACCACC TTCCCCTAGT CGGCGCACTC
```

-continued

```
1351 GGCGACATTG CCGCTATGCA ACAAACTTAC GCCAAACTCG CGCTGGACAA

1401 AAACTATCGC ATCGATGCCC CCTGCCCGTA CCTGCCCAAT GCCTACGCCA

1451 ACACCGCCCA CGGCACACGC GGGCTTGCCA CCGCCCCCAT CTGCGCCGCC

1501 GCCGTTGCAG CCGAAATCCT AGGCTTGCCC CATCCCCTCT CAAAACGCCT

1551 GCGCCACGCC CTACACCCCA ACCGCGCCAT CATCCGCGCC ATCGTCAGAA

1601 GGAAGGATCT AACCCCTTAA
```

This corresponds to the amino acid sequence <SEQ ID 738; ORF 212.a>:

```
a212.pep
  1 MDNLAWNGIP DIRTLDQTIR KHAHPLNLIV CLPDNQIPNF QTAQDASDAE

51 CRLKHRLDQA TQCLQFDSIN LIEHILPDVR FWLVPPSRTR RLHEHFHHIS

101 WQTEAIPQTE SKPDKPWFAL PQTSERQKPE HILVIGAGIS GAATAHALAS

151 YGISVTVLEA RKAAQAASGN RQGLLYAKIS PHDTEQTELL LAGYGYTKRL

201 LGHILPESET WGGNGIIHLN YSRTEQQRNH ELGLQKHHNH LYRSITQAEA

251 EKIAGIPLNT PYAEPLCGLF WQYGVWLNPP TFVRALLSHP LIGLHEDTPL

301 TDISHDGEKW IASTPNGTFT ATHIIYCTGA NSPYLPETNL ATLPLRQIRG

351 QTGLTPSTPF SEQLRCAVSG ESYISPSWHG LHCYGASFIP NSSHTGWNEA

401 EEASNRQALA HLNPALSESL FAANPNPQKH QGHAAIRCDS PDHLPLVGAL

451 GDIAAMQQTY AKLALDKNYR IDAPCPYLPN AYANTAHGTR GLATAPICAA

501 AVAAEILGLP HPLSKRLRHA LHPNRAIIRA IVRRKDLTP*
``` m212/a212 93.7% identity in 539 aa overlap

```
                    10         20         30         40         50         60
    m212.pep MDNLVWDGIPDIRTLDQAIRKHAPPLNLIICLPDNQIPDFQTAQDASDAECRLKHRLDQA
            ||||:|:|||||||||||:|||||:|||||||||:||||||||||||||||||||||||
    a212    MDNLAWNGIPDIRTLDQTIRKHAHPLNLIVCLPDNQIPNFQTAQDASDSECRLKHRLDQA
                    10         20         30         40         50         60

70         80         90        100        110        120
    m212.pep MQCLQFDSINLIEHILPDVRFWLVPPSRTHHLHEHFHHISWQTEAIPQTESKPDPWFAL
            :||||||||||||||||||||||||||||::|||||||||||||||||||||:||||||
    a212    TQCLQFDSINLIEHILPDVRFWLVPPSRTRRLHEHFHHISWQTEAIPQTESKPDKPWFAL
                    70         80         90        100        110        120

130        140        150        160        170        180
    m212.pep PQTSERQKPEHILVIGAGISGAATAHALASHGISVTVLEARKAAQAASGNRQGLLYAKIS
            |||||||||||||||||||||||||||||||:|||||||||||||||||||||||||||
    a212    PQTSERQKPEHILVIGAGISGAATAHALASYGISVTVLEARKAAQAASGNRQGLLYAKIS
                   130        140        150        160        170        180

190        200        210        220        230        240
    m212.pep PHDTEQTELLLAGYGYTKRLLGHILPESETWGGNGIIHLNYSRTEQQRNHELGLQKHHNH
            ||||||||||||||||||||||||||||||||||||||||||||||||||||||||||||
    a212    PHDTEQTELLLAGYGYTKRLLGHILPESETWGGNGIIHLNYSRTEQQRNHELGLQKHHNH
                   190        200        210        220        230        240

250        260        270        280        290        300
    m212.pep LYRSITSAEAEKIAGIPLSVPYDHPSCGLYWQHGVWLNPPAFVRTLLNHPLIGLHEDTPL
            ||||||:||||||||||||:::||  :|  |||:|:||||||:|||:||:|||||||||
    a212    LYRSITQAEAEKIAGIPLNTPYAEPLCGLFWQYGVWLNPPTFVRALLSHPLIGLHEDTPL
                   250        260        270        280        290        300

310        320        330        340        350        360
    m212.pep TDISHDGEKWIASTPNGTFTATHIIYCTGANSPYLPETNLAALPLRQIRGQTGLTPSTPF
            |||||||||||||||||||||||||||||||||||||||||:||||||||||||||||||
    a212    TDISHDGEKWIASTPNGTFTATHIIYCTGANSPYLPETNLATLPLRQIRGQTGLTPSTPF
                   310        320        330        340        350        360

370        380        390        400        410        420
    m212.pep SEQLRCAVSGESYISPSWHGLHCYGASFIPNSSHTGWNEAEEASNRQALAHLNPALSESL
            ||||||||||||||||||||||||||||||||||||||||||||||||||||||||||||
    a212    SEQLRCAVSGESYISPSWHGLHCYGASFIPNSSHTGWNEAEEASNRQALAHLNPALSESL
                   370        380        390        400        410        420
```

-continued

```
                     430        440        450        460        470        480
m212.pep     FAANPNPQKHQGHAAIRCDSPDHLPLVGALGDIAAMRQTYTKLALDKNYRIDTPCPYLPN
             ||||||||||||||||||||||||||||||||||||:|||:||||||||||:||||||
a212         FAANPNPQKHQGHAAIRCDSPDHLPLVGALGDIAAMQQTYAKLALDKNYRIDAPCPYLPN
                     430        440        450        460        470        480

490        500        510        520        530        540
m212.pep     AYVNTAHGTRGLATAPICAAXXAAQIXGLPHPFXQRLRHALHPNRTIIRIAVRRKDLTPX
             ||:||||||||||||||||   ||:|  |||||: :||||||||||:|||||||||||||
a212         AYANTAHGTRGLATAPICAAAVAAEILGLPHPLSKRLRHALHPNRAIIRAIVRRKDLTPX
                     490        500        510        520        530        540
```

The following partial DNA sequence was identified in *N. gonorrhoeae* <SEQ ID 739>:

```
g214.seq
   1 atgatacaaa agatatgtaa gctatttgtt ttaattgtaa tttttgcaac 51 ttctcccgct tttgcccttc aaagcgacag cagacggccc atccaaatcg 101 aagccgacca aggttcgctc gatcaagcca accaaaggac cacatttagc 151 ggcaatgtca tcatcagaca gggtacgctc aacatttccg cctcgtgtgt 201 caacgtcaca cgcggcaggc aaaggcggcg aatccgtgag ggcggaaggt 251 tcgcccgtcc gcttcagcca aacgttggac ggggcaaag ggacggtgcg 301 cggtcaggca aacaacgtta cctattcctc cgcaggaagc actgtcgttc 351 tgaccggcaa tgccaaagtg cagcgcggcg gcgacgttgc cgaaggtgcg 401 gtcattacct acaacaccaa aaccgaagtc tataccatca acggcagcac 451 gaaatcgggt gcgaaatccg cttccaaaac cggcagggtc agcgtcgtca 501 tccagccttc aagcacacaa aaaaccgaat aaccccgatg ccgtctgaaa 551 cggaaacgca gttcagacgg catttgccga ccgaaatgcc gagaagagat 601 tattga
```

This corresponds to the amino acid sequence <SEQ ID 740; ORF 214.ng>:

```
g214.pep
   1 MIQKICKLFV LIVIFATSPA FALQSDSRRP IQIEADQGSL DQANQRTTFS

51 GNVIIRQGTL NISASCVNVT RGRQRRRIRE GGRFARPLQP NVGRGQRDGA

101 RSGKQRYLFL RRKHCRSDRQ CQSAARRRRC RRCGHYLQHQ NRSLYHQRQH

151 EIGCEIRFQN RQGQRRHPAF KHTKNRITPM PSETETQFRR HLPTEMPRRD

201 Y
```

The following partial DNA sequence was identified in *N. meningitidis* <SEQ ID 741>:

```
m214.seq (partial)
   1 ATGATACAAA AGATATGTAA GCTATTTGTT TTAATAGCAT TTTTTTCGGC

51 GTCCCCCGCT TTTGCCCTTC AAAGCGACAG CAGGCAGCCT ATTCAGATTG

101 AGGCCGACCA AGGTTCGCTC GATCAAGCCA ACCAAAGCAC CACATTCAGC

151 GGAAACGTCG TCATCAGACA GGGTACGCTC AATATTTCCG CCGCCCGCGT

201 CAATGTTACA CGCGGCGGCA AAGGCGGCGA ATCCGTGAGG GCGGAAGGTT

251 CGCCAGTCCG CTTCAGCCAG ACATTGGACG GCGGCAAAGG CACGGTGCGC

301 GGACAGGCAA ACAACGTTGC TTATTCATCT GCAGGCAGCA CCGTAGTCTT
```

```
351 AACCGGTAAT GCCAAAGTAC AGCGCGGCGG CGATGTCGCC GAAGGTGCGG

401 TGATTACATA CAACACCAAA ACCGAAGTCT ATACCATCAG CGGCAGCACA

451 AAATT...
```

This corresponds to the amino acid sequence <SEQ ID 742; ORF 214>:

```
m214.pep (partial)
    1 MICKICKLFV LIAFFSASPA FALQSDSRQP IQIEADQGSL DQANQSTTFS

51 GNVVIRQGTL NISAARVNVT RGRQRRRIRE GGRFASPLQP DIGRRQRHGA

101 RTGKQRCLFI CRQHRSLNR* CQSTARRRCR RRCGDYIQHQ NRSLYHQRQH

151 KI...
```

Computer analysis of this amino acid sequence gave the following results:
Homology with a Predicted ORF from *N. gonorrhoeae*
ORF 214 shows 80.3% identity over a 152 aa overlap with a predicted ORF (ORF 214.ng) from *N. gonorrhoeae*:

```
    m214/g214

10         20         30         40         50         60
   m214.pep  MIQKICKLFVLIAFFSASPAFALQSDSRQPIQIEADQGSLDQANQSTTFSGNVVIRQGTL
             ||||||||||||::|::||||||||||||:||||||||||||||| |||||||:||||||
   g214      MIQKICKLFVLIVIFATSPAFALQSDSRRPIQIEADQGSLDQANQRTTFSGNVIIRQGTL
                      10         20         30         40         50         60

70         80         90        100        110        120
   m214.pep  NISAARVNVTRGRQRRRIREGGRFASPLQPDIGRRQRHGARTGKQRCLFICRQHRSLNRX
             ||||:|||||||||||||||||||||||||||| ||::|| || |||:|||| ||: :|  :|
   g214      NISASCVNVTRGRQRRRIREGGRFARPLQPNVGRGQRDGARSGKQRYLFLRRKHCRSDRQ
                      70         80         90        100        110        120

130        140        150
   m214.pep  CQSTARRRCRRRCGDYIQHQNRSLYHQRQHKI
             |||:|||| |||| |:||||||||||||||:|
   g214      CQSAARRRCRRRCGHYLQHQNRSLYHQRQHEIGCEIRFQNRQGQRRHPAFKHTKNRITPM
                     130        140        150        160        170        180 g214      PSETETQFRRHLPTEMPRRDY
                     190        200
```

The following partial DNA sequence was identified in *N. meningitidis* <SEQ ID 743>:

```
a214.seq
    1 ATGATACAAA AGATATGTAA GCTATTTGTT TTAATAGCAT TTTTTTCGGC

51 GTCCCCCGCT TTTGCCCTTC AAAGCGACAG CAGGCAGCCT ATTCAGATTG

101 AGGCCGACCA AGGTTCGCTC GATCAAGCCA ACCAAAGCAC CACATTCAGC

151 GGAAACGTCG TCATCAGACA GGGTACGCTC AATATTTCCG CCGCCCGCGT

201 CAATGTTACA CGCGGC.GGC AAAGGCGGCG AATCCGTGAG GCGGAAGGT

251 TCGCCAGTCC GCTTCAGCCA GACATTGGAC GGCGGCAAAG CACGGTGCG

301 CGGACAGGCA AACAACGTTG CTTATTCATC TGCAGGCAGC ACCGTAGTCT

351 TAACCGGTAA TGCCAAAGTA CAGCGCGGCG GCGATGTCGC CGAAGGTGCG

401 GTGATTACAT ACAACACCAA AACCGAAGTC TATACCATCA GCGGCAGCAC

451 AAAATCCGGC GCAAAATCCG CTTCCAAATC CGGCAGGGTC AGCGTCGTTA

501 TCCAGCCTTC GAGTACGCAA AAATCCGAAT AATCCCAATG CCGTCTGAAA
```

-continued
```
551 CATAAACCTG GTTCGGACGG CATTTGCCGA CCGAAATATT GAAGAGATAT

601 TTATGA
```

This corresponds to the amino acid sequence <SEQ ID 744; ORF 214.a>:

```
a214.pep
  1 MIQKICKLFV LIAFFSASPA FALQSDSRQP IQIEADQGSL DQANQSTTFS

51 GNVVIRQGTL NISAARVNVT RGXQRRRIRE GGRFASPLQP DIGRRQRHGA

101 RTGKQRCLFI CRQHRSLNR* CQSTARRRCR RRCGDYIQHQ NRSLYHQRQH

151 KIRRKIRFQI RQGQRRYPAF EYAKIRIIPM PSET*TWFGR HLPTEILKRY

201 L*
``` m214/a214 99.3% identity in 152 aa overlap

```
                  10         20         30         40         50         60
   m214.pep MIQKICKLFVLIAFFSASPAFALQSDSRQPIQIEADQGSLDQANQSTTFSGNVVIRQGTL
            ||||||||||||||||||||||||||||||||||||||||||||||||||||||||||||
   a214     MIQKICKLFVLIAFFSASPAFALQSDSRQPIQIEADQGSLDQANQSTTFSGNVVIRQGTL
                  10         20         30         40         50         60

70         80         90        100        110        120
   m214.pep NISAARVNVTRGRQRRRIREGGRFASPLQPDIGRRQRHGARTGKQRCLFICRQHRSLNRX
            |||||||||||| |||||||||||||||||||||||||||||||||||||||||||||||
   a214     NISAARVNVTRGXQRRRIREGGRFASPLQPDIGRRQRHGARTGKQRCLFICRQHRSLNRX
                  70         80         90        100        110        120

130        140        150
   m214.pep CQSTARRRCRRRCGDYIQHQNRSLYHQRQHKI
            |||||||||||||||||||||||||||||||
   a214     CQSTARRRCRRRCGDYIQHQNRSLYHQRQHKIRRKIRFQIRQGQRRYPAFEYAKIRIIPM
                 130        140        150        160        170        180 a214     PSETXTWFGRHLPTEILKRYLX
                 190        200
```

The following partial DNA sequence was identified in *N. gonorrhoeae* <SEQ ID 745>:

```
g214-1.seq
  1 ATGATACAAA AGATATGTAA GCTATTTGTT TTAATTGTAA TTTTTGCAAC

51 TTCTCCCGCT TTTGCCCTTC AAAGCGACAG CAGACGGCCC ATCCAAATCG

101 AAGCCGACCA AGGTTCGCTC GATCAAGCCA ACCAAAGTAC ACATTTAGC

151 GGCAATGTCA TCATCAGACA GGGTACGCTC AACATTTCCG CCTCGCGCGT

201 CAACGTCACA CGCGGCGGCA AAGGCGGCGA ATCCGTGAGG GCGGAAGGTT

251 CGCCCGTCCG CTTCAGCCAA ACGTTGGACG GGGGCAAAGG GACGGTGCGC

301 GGTCAGGCAA CAACGTTAC CTATTCCTCC GCAGGAAGCA CCGTCGTTCT

351 GACCGGCAAT GCCAAAGTGC AGCGCGGCGG CGACGTTGCC GAAGGTGCGG

401 TCATTACCTA CAACACCAAA ACCGAAGTCT ATACCATCAA CGGCAGCACG

451 AAATCGGGTG CGAAATCCGC TTCCAAAACC GGCAGGGTCA GCGTCGTCAT

501 CCAGCCTTCA AGCACACAAA AAACCGAATA A
```

This corresponds to the amino acid sequence <SEQ ID 746; ORF 214-1.ng>:

```
g214-1.pep
  1 MIQKICKLFV LIVIFATSPA FALQSDSRRP IQIEADQGSL DQANQSTTFS

51 GNVIIRQGTL NISASRVNVT RGGKGGESVR AEGSPVRFSQ TLDGGKGTVR
```

```
101 GQANNVTYSS AGSTVVLTGN AKVQRGGDVA EGAVITYNTK TEVYTINGST

151 KSGAKSASKT GRVSVVIQPS STQKTE*
```

The following partial DNA sequence was identified in *N. meningitidis* <SEQ ID 747>:

```
m214-1.seq
   1 ATGATACAAA AGATATGTAA GCTATTTGTT TTAATAGCAT TTTTTTCGGC

51 GTCCCCCGCT TTTGCCCTTC AAAGCGACAG CAGGCAGCCT ATTCAGATTG

101 AGGCCGACCA AGGTTCGCTC GATCAAGCCA ACCAAAGCAC CACATTCAGC

151 GGAAACGTCG TCATCAGACA GGGTACGCTC AATATTTCCG CCGCCCGCGT

201 CAATGTTACA CGCGGCGGCA AAGGCGGCGA ATCCGTGAGG GCGGAAGGTT

251 CGCCAGTCCG CTTCAGCCAG ACATTGGACG GCGGCAAAGG CACGGTGCGC

301 GGACAGGCAA ACAACGTTGC TTATTCATCT GCAGGCAGCA CCGTAGTCTT

351 AACCGGTAAT GCCAAAGTAC AGCGCGGCGG CGATGTCGCC GAAGGTGCGG

401 TGATTACATA CAACACCAAA ACCGAAGTCT ATACCATCAG CGGCAGCACA

451 AAATCCGGCG CAAAATCCGC TTCCAAATCC GGCAGGGTCA GCGTCGTTAT

501 CCAGCCTTCG AGTACGCAAA AATCCGAATA A
```

This corresponds to the amino acid sequence <SEQ ID 748; ORF 214-1>:

```
m214-1.pep

1   MIQKICKLFV LIAFFSASPA FALQSDSRQP IQIEADQGSL DQANASTTFS

51   GNVVIRQGTL NISAARVNVT RGGKGGESVR AEGSPVRFSQ TLDGGKGTVR

101   GQANNVAYSS AGSTVVLTGN AKVQRGGDVA EGAVITYNTK TEVYTISGST

151   KSGAKSASKS GRVSVVIQPS STQKSE* m214-1/g214-1  93.8% identity in 176 aa overlap 10         20         30         40         50         60
m214-1.pep   MIQKICKLFVLIAFFSASPAFALQSDSRQPIQIEADQGSLDQANQSTTFSGNVVIRQGTL
             ||||||||||::|::|||||||||||||||:||||||||||||||||||||||:||||||
g214-1       MIQKICKLFVLIVIFATSPAFALQSDSRRPIQIEADQGSLDQANQSTTFSGNVIIRQGTL
                    10         20         30         40         50         60

70         80         90        100        110        120
m214-1.pep   NISAARVNVTRGGKGGESVRAEGSPVRFSQTLDGGKGTVRGQANNVAYSSAGSTVVLTGN
             ||||:|||||||||||||||||||||||||||||||||||||||||:|||||||||||||
g214-1       NISASRVNVTRGGKGGESVRAEGSPVRFSQTLDGGKGTVRGQANNVTYSSAGSTVVLTGN
                    70         80         90        100        110        120

130        140        150        160        170
m214-1.pep   AKVQRGGDVAEGAVITYNTKTEVYTISGSTKSGAKSASKSGRVSVVIQPSSTQKSEX
             ||||||||||||||||||||||||||:|||||||||||:||||||||||||||||:||
g214-1       AKVQRGGDVAEGAVITYNTKTEVYTINGSTKSGAKSASKTGRVSVVIQPSSTQKTEX
                   130        140        150        160        170 g214-1(SEQ ID 746)/p38685 (SEQ ID 4165)
sp|P38685|YHBN_ECOLI 17.3 KD PROTEIN IN MURA-RPON INTERGENIC REGION PRECURSOR (ORF185)
>gi|551336 (U12684) orf185 [Escherichia coli] >gi|606139 (U18997_ ORF_o185 [Escherichia coli]
>gi|1789592 (AE000399) orf, hypothetical protein [Escherichia coli] Length = 185
 Score = 97.1 bits (238), Expect = 6e-20
 Identities = 57/126 (45%), Positives = 74/126 (58%), Gaps = 3/126 (2%)

Query: 19  PAFALQSDSRQPIQIEADQGSLDQANQSTTFSGNVVIRQGTLNISAARVNVTR--GGKGG 76
           PAFA+  D+ QPI IE+DQ SLD    TF+GNV++ QGT+ I+A +V VTR  G +G
Sbjct: 24  PAFAVTGDTDQPIHIESDQQSLDMQGNVVTFTGNVIVTQGTIKINADKVVVTRPGGEQGK 83

Query: 77  ESVRAEGSPVRFSQTLDGGKGTVRGQANNVAYSSAGSTVVLTGNAKVQRGGDVAEGAVIT 136
           E +   G P  F Q  D GK   VGA+ + Y A   VVLTGNA +Q+       +G  IT
Sbjct: 84  EVIDGYGKPATFYQMQDNGK-PVEGHASQMHYELAKDFVVLTGNAYLQQVDSNIKGDKIT 142
```

```
Query: 137 YNTKTE 142
            Y  K +
Sbjct: 143 YLVKEQ 148
```

-continued

The following partial DNA sequence was identified in *N. meningitidis* <SEQ ID 749>:

```
a214-1.seq
    1 ATGATACAAA AGATATGTAA GCTATTTGTT TTAATAGCAT TTTTTTCGGC

51 GTCCCCCGCT TTTGCCCTTC AAAGCGACAG CAGGCAGCCT ATTCAGATTG

101 AGGCCGACCA AGGTTCGCTC GATCAAGCCA ACCAAAGCAC CACATTCAGC

151 GGAAACGTCG TCATCAGACA GGGTACGCTC AATATTTCCG CCGCCCGCGT

201 CAATGTTACA CGCGGCGGCA AAGGCGGCGA ATCCGTGAGG GCGGAAGGTT

251 CGCCAGTCCG CTTCAGCCAG ACATTGGACG GCGGCAAAGG CACGGTGCGC

301 GGACAGGCAA ACAACGTTGC TTATTCATCT GCAGGCAGCA CCGTAGTCTT

351 AACCGGTAAT GCCAAAGTAC AGCGCGGCGG CGATGTCGCC GAAGGTGCGG

401 TGATTACATA CAACACCAAA ACCGAAGTCT ATACCATCAG CGGCAGCACA

451 AAATCCGGCG CAAAATCCGC TTCCAAATCC GGCAGGGTCA GCGTCGTTAT

501 CCAGCCTTCG AGTACGCAAA AATCCGAATA A
```

This corresponds to the amino acid sequence <SEQ ID 750; ORF 214-1.a>:

```
a214-1.pep
    1 MIQKICKLFV LIAFFSASPA FALQSDSRQP IQIEADQGSL DQANQSTTFS

51 GNVVIRQGTL NISAARVNVT RGGKGGESVR AEGSPVRFSQ TLDGGKGTVR

101 GQANNVAYSS AGSTVVLTGN AKVQRGGDVA EGAVITYNTK TEVYTISGST

151 KSGAKSASKS GRVSVVIQPS STQKSE* a214-1/m214-1  100.0% identity in 176 aa overlap 10         20         30         40         50         60
a214-1.pep MIQKICKLFVLIAFFSASPAFALQSDSRQPIQIEADQGSLDQANQSTTFSGNVVIRQGTL
           ||||||||||||||||||||||||||||||||||||||||||||||||||||||||||||
m214-1     MIQKICKLFVLIAFFSASPAFALQSDSRQPIQIEADQGSLDQANQSTTFSGNVVIRQGTL
                  10         20         30         40         50         60

70         80         90        100        110        120
a214-1.pep NISAARVNVTRGGKGGESVRAEGSPVRFSQTLDGGKGTVRGQANNVAYSSAGSTVVLTGN
           ||||||||||||||||||||||||||||||||||||||||||||||||||||||||||||
m214-1     NISAARVNVTRGGKGGESVRAEGSPVRFSQTLDGGKGTVRGQANNVAYSSAGSTVVLTGN
                  70         80         90        100        110        120

130        140        150        160        170
a214-1.pep AKVQRGGDVAEGAVITYNTKTEVYTISGSTKSGAKSASKSGRVSVVIQPSSTQKSEX
           |||||||||||||||||||||||||||||||||||||||||||||||||||||||||
m214-1     ARVQRGGDVAEGAVITYNTKTEVYTISGSTKSGAKSASKSGRVSVVIQPSSTQKSEX
                 130        140        150        160        170
```

The following partial DNA sequence was identified in *N. gonorrhoeae* <SEQ ID 751>:

```
g215.seq
    1 atgaaagtaa gatggcggta cggaattgcg ttcccattga tattggcggt 51 tgccttgggc agcctgtcgg catggttggg ccgtatcagc gaagtcgaaa 101 tcgaggaagt caggctcaat cccgacgaac ctcaatacac aatggacggc 151 ttggacggaa ggcggtttga cgaacaggga tacttgaaag aacatttgag
```

-continued

```
201 cgcgaaaggt gcgaaacagt ttcccgaaaa cagcgacatc cattttgatt 251 cgccgcatct cgtgttcttc caagaaggca ggctgttgta cgaagtcggc 301 agcgatgaag ccgtttacca taccgaaaac aaacaggttc tttttaaaaa 351 caacgttgtg ctgaccaaaa ccgccgacgg caggcggcag gcgggtaaag 401 tcgaaaccga aaaactgcac gtcgataccg aatctcaata tgcccaaacc 451 gatacgcctg tcagtttcca atatggcgcg tcgcacggtc aggcgggcgg 501 tatgacctac aaccacaaaa caggcatgtt gaacttctca tctaaagtga 551 aaaccacaat ttataataca aaaatatat aa
```
15

This corresponds to the amino acid sequence <SEQ ID 752; ORF 215.ng>:

```
g215.pep
   1 MKVRWRYGIA FPLILAVALG SLSAWLGRIS EVEIEEVRLN PDEPQYTMDG

51 LDGRRFDEQG YLKEHLSAKG AKQFPENSDI HFDSPHLVFF QEGRLLYEVG

101 SDEAVYHTEN KQVLFKNNVV LTKTADGRRQ AGKVETEKLH VDTESQYAQT

151 DTPVSFQYGA SHGQAGGMTY NHKTGMLNFS SKVKAAIYDT KDM*
```

The following partial DNA sequence was identified in *N. meningitidis* <SEQ ID 753>:

```
m215.seq (partial)
   1 ..AGCCTGTCGG CATGGTTGGG TCGTATCAGC GAAGTCGAGA TTGAAGAAGT

51   CAGGCTCAAT CCCGACGAAC CGCAATACAC AATGGACAGC TTGGACGGCA

101   GGCGGTTTGA CGAACAGGGA TACTTGAAAG AACATTTGAG CGCGAAGGGC

151   GCGAAACAGT TTCCGGAAAG CAGCGACATC CATTTTGATT CGCCGCATCT

201   CGTGTTCTTC CAAGAAGGCA GGTTGTTGTA CGAAGTCGGC AGCGACGAAG

251   CCGTTTACCA TACCGAAAAC AAACAGGTTC TTTTTAAAAA CAACGTTGTG

301   CTGACCAAAA CCGCCGACGG CAAACGGCAG GCGGGTAAAG TTGAAGCCGA

351   AAAGCTGCAC GTCGATACCG AATCTCAATA TGCCCAAACC GATACGCCTG

401   CAGTTTCCA ATATGGTGCA TCGCACGGTC AGGCGGGCGG CATGACTTAC

451   GACCACAwwA CAGGCATGTT GAACTTCTCA TCTAAAGTGA AAGCCACGAT

501   TTATGATACA AAAGATATGT AA
```

This corresponds to the amino acid sequence <SEQ ID 754; ORF 215>:

```
m215.pep (partial)
   1 ..SLSAWLGRIS EVEIEEVRLN PDEPQYTMDS LDGRRFDEQG YLKEHLSAKG

51   AKQFPESSDI HFDSPHLVFF QEGRLLYEVG SDEAVYHTEN KQVLFKNNVV

101   LTKTADGKRQ AGKVEAEKLH VDTESQYAQT DTPVSFQYGA SHGQAGGMTY

151   DHXTGMLNFS SKVKATIYDT KDM*
```

Computer analysis of this amino acid sequence gave the following results:

Homology with a Predicted ORF from *N. gonorrhoeae*
ORF 215 shows 96.0% identity over a 173 aa overlap with a predicted ORF (ORF 215.ng) from *N. gonorrhoeae*:

```
m215/g215

10         20         30         40
    m215.pep            SLSAWLGRISEVEIEEVRLNPDEPQYTMDSLDGRRFDEQG
                        ||||||||||||||||||||||||||||:|||||||||||
       g215   MKVRWRYGIAFPLILAVALGSLSAWLGRISEVEIEEVRLNPDEPQYTMDGLDGRRFDEQG
                 10         20         30         40         50         60

50         60         70         80         90        100
    m215.pep   YLKEHLSAKGAKQFPESSDIHFDSPHLVFFQEGRLLYEVGSDEAVYHTENKQVLFKNNVV
               ||||||||||||||||:|||||||||||||||||||||||||||||||||||||||||||
       g215   YLKEHLSAKGAKQFPENSDIHFDSPHLVFFQEGRLLYEVGSDEAVYHTENKQVLFKNNVV
               70         80         90        100        110        120

110        120        130        140        150        160
    m215.pep   LTKTADGKRQAGKVEAEKLHVDTESQYAQTDTPVSFQYGASHGQAGGMTYDHXTGMLNFS
               ||||||||:|||||||:|||||||||||||||||||||||||||||||||||:|||||||
       g215   LTKTADGRRQAGKVETEKLHVDTESQYAQTDTPVSFQYGASHGQAGGMTYNHXTGMLNFS
              130        140        150        160        170        180

170
    m215.pep   SKVKATIYDTKDMX
               |||||:||||||||
       g215   SKVKAAIYDTKDMX
              190
```

The following partial DNA sequence was identified in *N. meningitidis* <SEQ ID 755>:

```
a215.seq
    1 ATGAAAGTAA GATGGCGGTA CGGAATTGCG TTCCCATTGA TATTGGCGGT

51 TGCCTTGGGC AGCCTGTCGG CATGGTTGGG ACGCATCAGC GAAGTCGAGA

101 TTGAAGAAGT CAGGCTCAAT CCCGACGAAC CGCAATACAC AATGGACGGA

151 TTGGATGGCA GGCGGTTTGA CGAACAGGGA TACTTGAAAG AACATTTGAG

201 TTCGAAGGGC GCGAAACAGT TCCCGAAAG CAGCGACATT CATTTCGACT

251 CACCGCATCT CGTGTTCTTC CAAGAAGGCA GGTTGTTGTA CGAAGTCGGC

301 AGCGATGAAG CCGTTTACCA TACCGAAAAC AAACAGGTTC TTTTTAAAAA

351 CAACGTTGTG CTGACCAAAA CCGCCGACGG CAAACGGCAG GCGGGTAAAG

401 TTGAAGCCGA AAAGCTGCAC GTCGATACCG AATCTCAATA TGCCCAAACC

451 GATACGCCTG TCAGTTTCCA ATATGGTGCA TCGCACGGTC AGGCGGGCGG

501 CATGACTTAC GACCACAAAA CAGGCATGTT GAACTTCTCA TCTAAAGTGA

551 AAGCCACGAT TTATGATACA AAAGATATGT AA
```

This corresponds to the amino acid sequence <SEQ ID 756; ORF 215.a>:

```
a215.pep
    1 MKVRWRYGIA FPLILAVALG SLSAWLGRIS EVEIEEVRLN PDEPQYTMDG

51 LDGRRFDEQG YLKEHLSSKG AKQFPESSDI HFDSPHLVFF QEGRLLYEVG

101 SDEAVYHTEN KQVLFKNNVV LTKTADGKRQ AGKVEAEKLH VDTESQYAQT

151 DTPVSFQYGA SHGQAGGMTY DHKTGMLNFS SKVKATIYDT KDM*
``` m215/a215 98.3% identity in 173 aa overlap

```
                        10         20         30         40
m215.pep                         SLSAWLGRISEVEIEEVRLNPDEPQYTMDSLDGRRFDEQG
                                 ||||||||||||||||||||||||||||:|||||||||||
a215       MKVRWRYGIAFPLILAVALGSLSAWLGRISEVEIEEVRLNPDEPQYTMDGLDGRRFDEQG
                10         20         30         40         50         60

50         60         70         80         90        100
m215.pep   YLKEHLSAKGAKQFPESSDIHFDSPHLVFFQEGRLLYEVGSDEAVYHTENKQVLFKNNVV
           |||||||:|||||:||||||||||||||||||||||||||||||||||||||||||||||
a215       YLKEHLSSKGAKQRPESSDIHFDSPHLVFFQEGRLLYEVGSDEAVYHTENKQVLFKNNVV
                  70         80         90        100        110        120

110        120        130        140        150        160
m215.pep   LTKTADGKRQAGKVEAEKLHVDTESQYAQTDTPVSFQYGASHGQAGGMTYDHXTGMLNFS
           |||||||||||||||||||||||||||||||||||||||||||||||||||| ||||||
a215       LTKTADGKRQAGKVEAEKLHVDTESQYAQTDTPVSFQYGASHGQAGGMTYDHKTGMLNFS
                  130        140        150        160        170        180

170
m215.pep   SKVKATIYDTKDMX
           ||||||||||||||
a215       SKVKATIYDTKDMX
                  190
```

The following partial DNA sequence was identified in *N. gonorrhoeae* <SEQ ID 757>:

```
g216.seq (partial)
   1 . . . atgatatcga tttcgagctc ggtacccagc gacgaaatca ccgccatcat 51        ccccgcactc aaacgcaaag acattaccct cgtctgcatc accgcccgcc 101        ccgattcaac catggcgcgc catgccgata tccacatcac cgcatcggtt 151        tcgcaagaag cctgcccgtt ggggcttgcc ccgaccacca gcaccaccgc 201        cgttatggct ttgggcgacg cgttggcggt cgtcctgctg cgcgcccgcg 251        cgttcacgcc cgacgacttc gccttgatcc accctgccgg cagcctcggc 301        aaacgcctgc ttttgcgcgt tgccgacatt atgcacaaag gcggcggcct 351        gcccgccgtc cgactcggca cgcccttgaa aggagccatc gtcagcatga 401        gcgagaaagg tttgggcatg tgggcgggaa cggacgggca aaggctgtct 451        gaaaggcctt tttactga
```

This corresponds to the amino acid sequence <SEQ ID 758; ORF 216.ng>:

```
g216.pep (partial)
   1 . . . MISISSSVPS DEITAIIPAL KRKDITLVCI TARPDSTMAR HADIHITASV

51        SQEACPLGLA PTTSTTAVMA LGDALAVVLL RARAFTPDDF ALIHPAGSLG

101        KRLLLRVADI MHKGGGLPAV RLGTPLKGAI VSMSEKGLGM WAGTDGQRLS

151        ERPFY*
```

The following partial DNA sequence was identified in *N. meningitidis* <SEQ ID 759>:

```
m216.seq
   1 ATGGCAATGG CAGAAAACGG AAAATATCTC GACTGGGCAC GCGAAGTGTT

51 GCACGCCGAA GCGGAAGGCT TGCGCGAAAT TGCAGCGGAA TTGsACAAAA

101 ACTTCGTCCT TGCGGCAGAC GCGTTGTTGC ACTGCAAGGG CAGGGTCGTT

151 ATCACGGGCA TGGTCAAGTC GGGACATATC GGGCGCAAAA TGGCGGCAAC

201 TATGGCCTCG ACCGGCACGC CTGCGTTTTT CGTCCACCCT GCGGAAGCGG
```

-continued

```
251   CACACGgCGA TTTGGGTATG ATTGTGGACA rCGACGTGGT CGTCGCGATT

301   TCCAATTCCG GCGAAAGCGA CGAAATCGCC GCCATCATCC CCGCACTCAA

351   ACGCAAAGAC ATCACGCTTG TCTGCATCAC CGCCCGCCCC GATTCAACCA

401   TGGCGCGCCA TGCCGACATC CACATCACGG CGTCGGTTTC CAAAGAAGCC

451   TGCCCGCTGG GGCTTGCCCC GACCACCAGC ACCACCGCCG TCATGGCTTT

501   GGGCGATGCG TTGGCGGTCG TCCtGCTGCG CgcACGCGCG TTCACGCCCG

551   ACGATTTCGC CTTGAGCCAT CCTGCCGGCA GCCTCGGCAA ACGCCTACTT

601   TTGCGCGTTG CCGACATTAT GCACAAAGGC GGCGGCCTGC CTGCCGTCCG

651   ACTCGGCACG CCCTTGAAAG AAGCCATCGT CAGCATGAGT GAAAAAGGGC

701   TGGGCATGTT GGCGGTAACG GACGGGCAAG GCCGTCTGAA AGGCGTATTC

751   ACCGACGGCG ATTTGCGCCG CCTGTTTCAA GAATGCGACA ATTTTACCGG

801   TCTTTCGATA GACGAAGTCA TGCATACGCA TCCTAAAACC ATCTCCGCCG

851   AACGTCTCGC CACCGAAGCC CTGAAAGTCA TGCAGGCAAA CCATGTGAAC

901   GGGCTTCTGG TTACCGATGC AGATGGCGTG CTGATCGGCG CGCTGAATAT

951   GCACGACCTG CTGGCGGCAC GGATTGTATA G
```

This corresponds to the amino acid sequence <SEQ ID 760; ORF 216>:

```
m216.pep
    1 MAMAENGKYL DWAREVLHAE AEGLREIAAE LXKNFVLAAD ALLHCKGRVV

51 ITGMVKSGHI GRKMAATMAS TGTPAFFVHP AEAAHGDLGM IVDXDVVVAI

101 SNSGESDEIA AIIPALKRKD ITLVCITARP DSTMARHADI HITASVSKEA

151 CPLGLAPTTS TTAVMALGDA LAVVLLRARA FTPDDFALSH PAGSLGKRLL

201 LRVADIMHKG GGLPAVRLGT PLKEAIVSMS EKGLGMLAVT DGQGRLKGVF

251 TDGDLRRLFQ ECDNFTGLSI DEVMHTHPKT ISAERLATEA LKVMQANHVN

301 GLLVTDADGV LIGALNMHDL LAARIV*
```

Computer analysis of this amino acid sequence gave the following results:

Homology with a Predicted ORF from *N. gonorrhoeae*

ORF 216 shows 91.8% identity over a 147 aa overlap with a predicted ORF (ORF 216.ng) from *N. gonorrhoeae*:

```
m216/g216

70         80         90        100        110        120
m216.pep TMASTGTPAFFVHPAEAAHGDLGMIVDXDVVVAISNSGESDEIAAIIPALKRKDITLVCI
                         :::||:|   ||||:|||||||||||||||||
g216                              MISISSSVPSDEITAIIPALKRKDITLVCI
                                           10         20         30

130        140        150        160        170        180
m216.pep TARPDSTMARHADIHITASVSKEACPLGLAPTTSTTAVMALGDALAVVLLRARAFTPDDF
         ||||||||||||||||||||||:|||||||||||||||||||||||||||||||||||||
g216     TARPDSTMARHADIHITASVSQEACPLGLAPTTSTTAVMALGDALAVVLLRARAFTPDDF
                 40         50         60         70         80         90

190        200        210        220        230        240
m216.pep ALSHPAGSLGKRLLLRVADIMHKGGGLPAVRLGTPLKEAIVSMSEKGLGMLAVTDGQGRL
         ||  ||||||||||||||||||||||||||||||||| ||||||||||||  ||||| |
g216     ALIHPAGSLGKRLLLRVADIMHKGGGLPAVRLGTPLKGAIVSMSEKGLGMWAGTDGQRLS
                100        110        120        130        140        150
```

The following partial DNA sequence was identified in *N. meningitidis* <SEQ ID 761>:

```
a216.seq
   1  ATGGCGATGG CAGGAAACGA AAAATATCTT GATTGGGCAC GCGAAGTGTT

51  GCACACCGAA GCGGAAGGCT TGCGCGAAAT TGCGGCGGAT TTGGACGAAA

101  ACTTCGCCCT TGCGGCGGAC GCGTTGTTGC ACTGCAAAGG CAGGGTCGTT

151  ATCACGGGCA TGGGCAAGTC GGGACATATC GGGCGCAAAA TGGCGGCAAC

201  CATGGCCTCG ACCGGCACGC CCGCGTTTTT CGTCCACCCT GCGGAAGCGG

251  CACACGGCGA TTTGGGCATG ATTGTGGACA ACGACGTGGT CGTCGCGATT

301  TCCAATTCCG GTGAAAGCGA CGAAATCGCC GCCATCATCC CCGCGCTCAA

351  ACGCAAAGAT ATCACGCTTG TCTGCATCAC CGCCCGCCCC GATTCAACCA

401  TGGCGCGCCA TGCCGACATC CACATCACGG CGTCGGTTTC CAAAGAAGCC

451  TGCCCGCTGG GGCTTGCCCC GACCACCAGC ACCACCGCCG TTATGGCTTT

501  GGGCGATGCG TTGGCGGTTG TCCTGCTGCG CGCCCGCGCG TTCACGCCCG

551  ACGACTTCGC CTTGAGCCAC CCTGCCGGCA GCCTCGGCAA ACGCCTACTT

601  TTGCGCGTTG CCGACATTAT GCACAAAGGC GGCGGCCTGC CTGCCGTCCG

651  ACTCGGCACG CCCTTGAAAG AAGCCATCGT CAGCATGAGT GAAAAAGGGC

701  TGGGCATGTT GGCGGTAACG GACGGGCAAG GCCGTCTGAA AGGCGTATTC

751  ACCGACGGCG ATTTGCGCCG CCTGTTTCAA GAATGCGACA ATTTTACCGG

801  TCTTTCGATA GACGAAGTCA TGCATACGCA TCCTAAAACC ATCTCCGCCG

851  AACGTCTCGC CACCGAAGCC CTGAAAGTCA TGCAGGCAAA CCATGTGAAC

901  GGGCTTCTGG TTACCGATGC AGATGGCGTG CTGATCGGCG CGCTGAATAT

951  GCACGACCTT TTGGCGGCGC GGATTGTATA G
```

This corresponds to the amino acid sequence <SEQ ID 762; ORF 216.a>:

```
a216.pep
   1  MAMAGNEKYL DWAREVLHTE AEGLREIAAD LDENFALAAD ALLHCKGRVV

51  ITGMGKSGHI GRKMAATMAS TGTPAFFVHP AEAAHGDLGM IVDNDVVVAI

101  SNSGESDEIA AIIPALKRKD ITLVCITARP DSTMARHADI HITASVSKEA

151  CPLGLAPTTS TTAVMALGDA LAVVLLRARA FTPDDFALSH PAGSLGKRLL

201  LRVADIMHKG GGLPAVRLGT PLKEAIVSMS EKGLGMLAVT DGQGRLKGVF

251  TDGDLRRLFQ ECDNFTGLSI DEVMHTHPKT ISAERLATEA LKVMQANHVN

301  GLLVTDADGV LIGALNMHDL LAARIV*
``` m216/a216 971% identity in 326 aa overlap

```
                    10        20        30        40        50        60
m216.pep   MAMAENGKYLDWAREVLHAEAEGLREIAAELXKNFVLAADALLHCKGRVVITGMVKSGHI
           |||| | |||||||||||:||||||||||:| :||:|||||||||||||||||| |||||
a216       MAMAGNEKYLDWAREVLHTEAEGLREIAADLDENFALAADALLHCKGRVVITGMGKSGHI
                    10        20        30        40        50        60

70        80        90       100       110       120
m216.pep   GRKMAATMASTGTPAFFVHPAEAAHGDLGMIVDXDVVVAISNSGESDEIAAIIPALKRKD
           ||||||||||||||||||||||||||||||||| ||||||||||||||||||||||||||
a216       GRKMAATMASTGTPAFFVHPAEAAHGDLGMIVDNDVVVAISNSGESDEIAAIIPALKRKD
                    70        80        90       100       110       120
```

-continued

```
              130        140        150        160        170        180
m216.pep  ITLVCITARPDSTMARHADIHITASVSKEACPLGLAPTTSTTAVMALGDALAVVLLRARA
          ||||||||||||||||||||||||||||||||||||||||||||||||||||||||||||
a216      ITLVCITARPDSTMARHADIHITASVSKEACPLGLAPTTSTTAVMALGDALAVVLLRARA
              130        140        150        160        170        180

190        200        210        220        230        240
m216.pep  FTPDDFALSHPAGSLGKRLLLRVADIMHKGGGLPAVRLGTPLKEAIVSMSEKGLGMLAVT
          ||||||||||||||||||||||||||||||||||||||||||||||||||||||||||||
a216      FTPDDFALSHPAGSLGKRLLLRVADIMHKGGGLPAVRLGTPLKEAIVSMSEKGLGMLAVT
              190        200        210        220        230        240

250        260        270        280        290        300
m216.pep  DGQGRLKGVFTDGDLRRLFQECNDFTGLSIDEVMHTHPKTISAERLATEALKVMQANHVN
          ||||||||||||||||||||||||||||||||||||||||||||||||||||||||||||
a216      DGQGRLKGVFTDGDLRRLFQECNDFTGLSIDEVMHTHPKTISAERLATEALKVMQANHVN
              250        260        270        280        290        300

310        320
m216.pep  GLLVTDADGVLIGALNMHDLLAARIVX
          |||||||||||||||||||||||||||
a216      GLLVTDADGVLIGALNMHDLLAARIVX
              310        320
```

The following partial DNA sequence was identified in *N. gonorrhoeae* <SEQ ID 763>:

```
g217.seq
  1  atggcggatg acggtttgtt gcggcaactg tccgaaaaac ccagccaaag 51  tgctctcttc ctgccatttg acccattcgt tttcgaggtt ttggactgcc 101  ttttggtcat cgggcccggc ttgaaacaat gtttcaagca aatcccggca 151  acgcgccacc cattcgccga ccgtcgcagg ttgccgccat atccgggcaa 201  tatccgacag ggtttcgagg aaggcggcaa aacgtccgaa catggcggtt 251  tgattcacgt cggcatacca cgcgctgaca tcctgccaca tcgggttgcc 301  gccttcgggc agcatccagc ccaatatcat acggtctgcc gcctgcttcc 351  aggtaaacag ctgatccgtg ccgccgcgca tttctccgtc caatccccaa 401  tggacgttca aatcggcaac catatcgtgc aaaagcggca aatcgtcccc 451  ggtcagtccg aaacggcgca acacgggcgc ggtttccaaa agcgcgagca 501  ctttgccgac ttcaaaacgg ctttccagca agtcggacac gcactccaac 551  gcataaaaaa acggttgccg gcggctgatt ttcacgtccg aaacggaata 601  cggcaatgcc tgcgcgccgg gttgcgcctg tccgaacacg gcttccataa 651  aaggcgtata gggttcgata ttcggggtta a
```

This corresponds to the amino acid sequence <SEQ ID 764; ORF 217.ng>:

```
g217.pep..
  1  MADDGLLRQL SEKPSQSALF LPFDPFVFEV LDCLLVIGPG LKQCFKQIPA

51  TRHPFADRRR LPPYPGNIRQ GFEEGGKTSE HGGLIHVGIP RADILPHRVA

101  AFGQHPAQYH TVCRLLPGKQ LIRAAAHFSV QSPMDVQIGN HIVQKRQIVP

151  GQSETAQHGR GFQKREHFAD FKTAFQQVGH ALQRIKKRLP AADFHVRNGI

201  RQCLRAGLRL SEHGFHKRRI GFDIRG*
```

The following partial DNA sequence was identified in *N. meningitidis* <SEQ ID 765>:

```
m217.seq
  1  ATGGCGGATG ACGGTGTGCG GCGGCAACTG TCCGGAAAAT TGCGCCAATT

51  CGGTTTCCGC CTrCCATTTG ACCCATTCGT TTTCAAGGTT TTGGACTGAC
```

```
101  TTTTGGTCAT CGGCTTCAGC TTGGAACAAT GTTTCAAGCA AATCCCGGCA

151  ACGCGCCACC CATTCGCCGA CCGTTGCGGG CTGCCGCCAT ATCCGTACAA

201  TATCCGTCAG GGTTTCGAGG AAGGCGGCAA AACGTCCGAA CATGGCGGTT

251  TGATTCACGT CGGCATACCA CGCGCTGACA TCCTGCCACA TCGGATTGCC

301  GCCTTTGGGC AGCATCCAGC CCAATATCAT GCGTTCTACC GCCTGCTTCC

351  AGGTGAACAG CTGATCCGTG CCGCCGCGCA TTTCTCCGTC CAAACCCCAG

401  TGGACGTTCA AATCGGCAAC CATGTCGTGC AAAAGCGGTA AATCGTCCTC

451  AGTCAGTCCG AAACGGCGCA ACACGGGCGC GGTTTCTAAA AGCACAAGCA

501  CTTTATCGAC TTCAAATCGG CTTTCCAACA AGTCGAACAG GCATGACAAA

551  GCATGAAACA GCGGTTGGCG GCGGCTGATT TTCACGTCTG CACGGAATA

601  CGGCAATGCC TGCGCACCgG GctGCGCCTG TCCGAACACG GCTTCGATAA

651  AAGGCGTATA GGATTCGATA TTCGGGGTTA A
```

This corresponds to the amino acid sequence <SEQ ID 766; ORF 217>:

```
m217.pep
  1  MADDGVRRQL SGKLRQFGFR LPFDPFVFKV LDXLLVIGFS LEQCFKQIPA

51  TRHPFADRCG LPPYPYNIRQ GFEEGGKTSE HGGLIHVGIP RADILPHRIA

101  AFGQHPAQYH AFYRLLPGEQ LIRAAAHFSV QTPVDVQIGN HVVQKRXIVL

151  SQSETAQHGR GFXKHKHFID FKSAFQQVEQ AXQSMKQRLA AADFHVXHGI

201  RQCLRTGLRL SEHGFDKRRI GFDIRG*
```

Computer analysis of this amino acid sequence gave the following results:

Homology with a Predicted ORF from *N. gonorrhoeae*

ORF 217 shows 80.5% identity over a 226 aa overlap with a predicted ORF (ORF 217.ng) from *N. gonorrhoeae*:

```
m217/g217
                  10         20         30         40         50         60
    m217.pep  MADDGVRRQLSGKLRQFGFRLPFDPFVFKVLDXLLVIGFSLEQCFKQIPATRHPFADRCG
              |||||:|||| |   |  ::||||||||:||| ||||| :|:||||||||||||||||
    g217      MADDGLLRQLSGKPSQSALFLPFDPFVFEVLDCLLVIGPGLKQCFKQIPATRHPFADRRR
                  10         20         30         40         50         60

70         80         90        100        110        120
    m217.pep  LPPYPYNIRQGFEEGGKTSEHGGLIHVGIPRADILPHRIAAFGQHPAQYHAFYRLLPGEQ
              ||||  |||||||||||||||||||||||||||||||||:||||||||||:   |||| |
    g217      LPPGPYNIRQGFEEGGKTSEHGGLIHVGIPRADILPHRVAAFGQHPAQYHTVCRLLPGKQ
                  70         80         90        100        110        120

130        140        150        160        170        180
    m217.pep  LIRAAAHFSVQTPVDVQIGNHVVQKRXIVLSQSETAQHGRGFXKHKHFIDFKSAFQQVEQ
              |||||||||||:|:|||||||:|||| ||  :||||||||||||:|::||  |||||||  :
    g217      LIRAAAHFSVQSPMDVQIGNHIVQKRQIVPGQSETAQHGRGFQKREHFADFKTAFQQVGH
                 130        140        150        160        170        180

190        200        210        220
    m217.pep  AXQSMKQRLAAADFHVXHGIRQCLRTGLRLSEHGFDKRRIGFDIRGX
              | |  :|:|| |||||| :|||||||:|||||||||| ||||||||
    g217      ALQRIKQRLPAADFHVRNGIRQCLRAGLRLSEHGFHKRRIGFDIRG
                 190        200        210        220
```

The following partial DNA sequence was identified in *N. meningitidis* <SEQ ID 767>:

```
a217.seq
  1  GTGGCGGATG ACGGTGTGCA GCGGCAACTG TCCGGAAAAT TGCGCCAATT

51  CGGTTTCCGC CTGCCATTTG ACCCATTCGT TTTCGAGGCT TTGGACTGCC
```

-continued

```
101 TTTTGGTCAT CGCCTTCGAC TTGGAACAAT GTTTCAAGCA AATCCCGGCA

151 ACGCGCCACC CATTCGTCAA CCGTCGCAGG TTGCCGCCAT ATCCGTACAA

201 TATCCGTCAG GGTTTCGAGG AAGGCGGCAA AACGTCCGAA CAGGGCGGTT

251 TGGTTCACGT CGGCATACCA CGCGCTGACC CCCTGCCACA TCGGATTGCC

301 GCCTTCGGGC AGCATCCAGC CCAATATCAT GCGTTCTACC GCCTGCTTCC

351 AGGTGAACAG CTGATCCGTG CCGCCGCGCA TTTCTCCGTC CAAACCCCAG

401 CGGACGTTCA AATCGGCAAC CATGTCGTGC AAAAGCGGCA AATCGTCCTC

451 AGTCAGTCCG AAATGGCGCA ACACGGGCGC GGTTTCTAAA AGCACAAGCA

501 CTTTATCGAC TTCAAATCGG CTTTCCAACA AGTCGAACAG GCATGACAAA

551 GCATGAAACA GCGGTTGTCG GCGGCTGATT TTCACATCCG AAACGGAATA

601 CGGCAATGCC TGCGCGCCGG GCTGCGCCTG TCCGAACACG GCTTCGATAA

651 AAGGCGTATA GGATTCGATA TTCGGGGTTA A
```

This corresponds to the amino acid sequence <SEQ ID 768; ORF 217.a>:

```
a217.pep
   1 VADDGVQRQL SGKLRQFGFR LPFDPFVFEA LDCLLVIAFD LEQCFKQIPA

51 TRHPFVNRRR LPPYPYNIRQ GFEEGGKTSE QGGLVHVGIP RADPLPHRIA

101 AFGQHPAQYH AFYRLLPGEQ LIRAAAHFSV QTPADVQIGN HVVQKRQIVL

151 SQSEMAQHGR GF*KHKHFID FKSAFQQVEQ A*QSMKQRLS AADFHIRNGI

201 RQCLRAGLRL SEHGFDKRRI GFDIRG*
``` m217/a217 90.1% identity in 226 aa overlap

```
                 10         20         30         40         50         60
    m217.pep MADDGVRRQLSGKLRQFGFRLPFDPFVFKVLDXLLVIGFSLEQCFKQIPATRHPFADRCG
             :||||:||||||||||||||||||||::||  |||::|||||||||||||||||::|
    a217     VADDGVQRQLSGKLRQFGFRLPFDPFVFEALDCLLVIAFDLEQCFKQIPATRHPFVNRRR
                 10         20         30         40         50         60

70         80         90        100        110        120
    m217.pep LPPYPYNIRQGFEEGGKTSEHGGLIHVGIPRADILPHRIAAFGQHPAQYHAFYRLLPGEQ
             ||||||||||||||||||||:|||:||||||||| |||||||||||||||||||||||||
    a217     LPPYPYNIRQGFEEGGKTSEQGGLVHVGIPRADPLPHRIAAFGQHPAQYHAFYRLLPGEQ
                 70         80         90        100        110        120

130        140        150        160        170        180
    m217.pep LIRAAAHFSVQTPVDVQIGNHVVQKRXIVLSQSETAQHGRGFXKHKHFIDFKSAFQQVEQ
             ||||||||||||:|||||||||||||| |||||||:||||||||||||||||||||||||
    a217     LIRAAAHFSVQTPADVQIGNHVVQKRQIVLSQSEMAQHGRGFXKHKHFIDFKSAFQQVEQ
                130        140        150        160        170        180

190        200        210        220
    m217.pep AXQSMKQRLAAADFHVXHGIRQCLRTGLRLSEHGFDKRRIGFDIRGX
             ||||||||||:|||| : :|||||||:||||||||||||||||||||
    a217     AXQSMKQRLSAADFHIRNGIRQCLRAGLRLSEHGFDKRRIGFDIRGX
                190        200        210        220
```

The following partial DNA sequence was identified in *N. gonorrhoeae* <SEQ ID 769>:

```
g218.seq
   1 atggttgcgg tggatcctta tacggcaaaa gtggtcaaca ccatgccgcg 51 caatcagggt tggtatcaca ctatggatga atccacggc gatatgatgc 101 tcggtgcggc aggcgattat cttttggaaa cggcagcttc actgaccatt 151 attatggttg tcagcggctt gtacctttgg tgggcgaaac agcgcggcat
```

-continued

```
 201  taaagcgatg ctgctgccgc caaaaagcag ggcgcgttct tggtggcgga
 251  atctgcacgg cgcgtttgga acttgggtgt cgttgatttt actgttgttc
 301  tgcctgtcgg gtattgcttg ggcaggtatt tggggcggca aattcgtgca
 351  ggcttggaat cagttcccgg ccggcaaatg gggtgtcgaa ccgaacccg
 401  tttcaatcgt gccgacccac ggcgaggtat tgaatgacgg caaggttaag
 451  gaagtgccgt ggattttgga gcttatgcct atgcctgtct cagggacgac
 501  tgtgggtgaa aacggcatta accccaccga gcccaataac attggaaacc
 551  gtcgaccgtt tcgcgcggga aatcggtttc aaagggcgtt atcagttgaa
 601  tttgcccaaa ggcgaggacg gggtatggac tttgtcgcag gattctatga
 651  gttatga
```

This corresponds to the amino acid sequence <SEQ ID 770; ORF 218.ng>:

```
g218.pep
   1  MVAVDPYTAK VVNTMPRNQG WYHTMDEIHG DMMLGAAGDY LLETAASLTI
  51  IMVVSGLYLW WAKQRGIKAM LLPPKSRARS WWRNLHGAFG TWVSLILLLF
 101  CLSGIAWAGI WGGKFVQAWN QFPAGKWGVE PNPVSIVPTH GEVLNDGKVK
 151  EVPWILELMP MPVSGTTVGE NGINPTEPNN IGNRRPFRAG NRFQRALSVE
 201  FAQRRGRGMD FVAGFYEL*
```

The following partial DNA sequence was identified in *N. meningitidis* <SEQ ID 771>:

```
m218.seq
   1  ATGGTCGCGG TCGATCCTTA TACGGCAAAA GTGGTCAGTA CCATGCCGCG
  51  CAATCAGGGT TGGTATTACA CGATGGATGA AATCCACAGC GATATGATGC
 101  TCGGTGCGGC AGGCGATTAT CTTTTGGAAA CGGCAGCTTC ACTGACCATT
 151  ATTATGGTTG TCAGCGGCTT GTACCTTTGG TGGGTGAAAC GGCGCGGCAT
 201  CAAGGCGATG CTGCTGCCGT CAAAAGGCAr GGCGCGTTCT TGGTGGCGGA
 251  ATCTGCACGG CACGTTTGGA ACTTGGGTGT CGTTGATTTT GCTGTTGTTC
 301  TGCCTGTCGG GTATTGCTTG GGCGGGTATT TGGGGCGGCA AGTTCGTACA
 351  GGCTTGGAGT CAGTTCCCTG CCGGTAAATG GGGTGTCGAA CCGAACCCCG
 401  TTTCAGTCGT GCCGACCCAC GGCGAGGTAT TGAATGACGG CAAGGTTAAG
 451  GAAGTGCCGT GGGTTTTGGA GCTTACGCCT ATGCCTGTTT CAGGGACGaC
 501  yGtgGGCAAA GACGGCATTA ACCCTGACGA GCCGATGACA TTGGAAACCG
 551  TCGACCGCTT TGCGCGGnGA AATCGGTTTC AAAGGGCGTT ATCAGTTGAA
 601  TTTGCCCAAA GGCGAGGACG GCGTATGGAC TTTGTCGCAG GATTCTATGA
 651  GTTA
```

This corresponds to the amino acid sequence <SEQ ID 772; ORF 218>:

```
m218.pep
   1  MVAVDPYTAK VVSTMPRNQG WYYTMDEIHS DMMLGAAGDY LLETAASLTI
  51  IMVVSGLYLW WVKRRGIKAM LLPSKGXARS WWRNLHGTFG TWVSLILLLF
```

```
101 CLSGIAWAGI WGGKFVQAWS QFPAGKWGVE PNPVSVVPTH GEVLNDGKVK

151 EVPWVLELTP MPVSGTTVGK DGINPDEPMT LETVDRFARX NRFQRALSVE

201 FAQRRGRRMD FVAGFYEL
```

Computer analysis of this amino acid sequence gave the following results:
Homology with a Predicted ORF from *N. gonorrhoeae*
ORF 218 shows 87.2% identity over a 218 aa overlap with a predicted ORF (ORF 218.ng) from *N. gonorrhoeae*:

```
    m218/g218
                    10         20         30         40         50         60
        m218.pep    MVAVDPYTAKVVSTMPRNQGWYYTMDEIHSDMMLGAAGDYLLETAASLTIIMVVSGLYLW
                    ||||||||||:|||||||||:||||||:||||||||||||||||||||||||||||||||
        g218        MVAVDPYTAKVVNTMPRNQGWYHTMDEIHGDMMLGAAGDYLLETAASLTIIMVVSGLYLW
                    10         20         30         40         50         60

70         80         90        100        110        120
        m218.pep    WVKRRGIKAMLLPSKGXARSWWRNLHGTFGTWVSLILLLFCLSGIAWAGIWGGKFVQAWS
                    |:|:||||||||| |: |||||||||||||:|||||||||||||||||||||||||||:
        g218        WAKQRGIKAMLLPPKSRARSWWRNLHGAFGTWVSLILLLFCLSGIAWAGIWGGKFVQAWN
                    70         80         90        100        110        120

130        140        150        160        170        180
        m218.pep    QFPAGKWGVEPNPVSVVPTHGEVLNDGKVKEVPWVLELTPMPVSGTTVGKDGINPDEPMT
                    |||||||||||||||:||||||||||||||||||:|||||||||||||||::||||  :
        g218        QFPAGKWGVEPNPVSIVPTHGEVLNDGKVKEVPWILELTPMPVSGTTVGENGINPTEPNN
                   130        140        150        160        170        180

190        200        210
        m218.pep    LETVDRFARXNRFQRALSVEFAQRRGRRMDFVAGFYEL
                    ::    |    ||||||||||||||| |||||||||||
        g218        IGNRRPFRAGNRFQRALSVEFAQRRGRGMDFVAGFYEL
                   190        200        210
```

The following partial DNA sequence was identified in *N. meningitidis* <SEQ ID 773>:

```
a218.seq
  1 ATGGTCGCGG TCGATCCTTA TACGGCAAAA GTGGTCAGTA CCATGCCGCG

51 CAATCAGGGT TGGTATTACG CGATGGATGA AATCCACAGC GATATGATGC

101 TCGGTTCGAC AGGTGATTAT CTTTTGGAAA CGGCTGCATC GCTGACGATT

151 ATCATGATAA TCAGCGGTTT GTACCTTTGG TGGGTGAAAC GGCGCGGCAT

201 CAAGGCGATG CTGCTGCCGC CAAAAGGCAG GGCGCGTTCT TGGTGGCGGA

251 ATCTGCACGG CGCGTTTGGA ACTTGGGTGT CGTTGATTTT ACTGTTGTTC

301 TGCCTGTCGG GTATTGCTTG GGCAGGTATT TGGGGCGGCA AGTTCGTGCA

351 GGCTTGGAGT CAGTTCCCGG CAGGCAAATG GGGTGTCGAA CCGAACCCTG

401 TTTCAGTCGT GCCGACCCAC GGCGAGGTAT TGAATGACGG CAAGGTTAAG

451 GAAGTGCCGT GGGTTTTGGA GCTTACGCCT ATGCCTGTTT CAGGGACGAC

501 TGTGGGCAAA GACGGTATTA ACCCTGACGA GCCGATGACA TTGGAAACCG

551 TCGACCGTTT TGCGCGG.GA AATCGGTTTC AAAGGGCGTT ATCAGCTGAA

601 TTTGCCCAAA GGCGAGGACG GCGTATGGAC TTTGTCGCAG GATTCTATGA

651 GTTA
```

This corresponds to the amino acid sequence <SEQ ID 774; ORF 218.a>:

```
a218.pep
  1 MVAVDPYTAK VVSTMPRNQG WYYAMDEIHS DMMLGSTGDY LLETAASLTI

51 IMIISGLYLW WVKRRGIKAM LLPPKGRARS WWRNLHGAFG TWVSLILLLF
```

-continued

```
101 CLSGIAWAGI WGGKFVQAWS QFPAGKWGVE PNPVSVVPTH GEVLNDGKVK

151 EVPWVLELTP MPVSGTTVGK DGINPDEPMT LETVDRFARX NRFQRALSAE

201 FAQRRGRRMD FVAGFYEL
``` m218/a218 95.9% identity in 218 aa overlap

```
                    10         20         30         40         50         60
   m218.pep MVAVDPYTAKVVSTMPRNQGWYYTMDEIHSDMMLGAAGDYLLETAASLTIIMVVSGLYGW
            ||||||||||||||||||||||||:|||||||||::|||||||||||||||::|||||
       a218 MVAVDPYTAKVVSTMPRNQGWYYAMDEIHSDMMLGSTGDYLLETAASLTIIMIISGLYGW
                    10         20         30         40         50         60

70         80         90        100        110        120
   m218.pep WVKRRGIKAMLLPSKGXARSWWRNLHGTFGTWVSLILLLFCLSGIAWAGIWGGKFVQAWS
            ||||||||||||||  ||||||||||||:|||||||||||||||||||||||||||||
       a218 WVKRRGIKAMLLPPKGRARSWWRNLHGAFGTWVSLILLLFCLSGIAWAGIWGGKFVQAWS
                    70         80         90        100        110        120

130        140        150        160        170        180
   m218.pep QFPAGKWGVEPNPVSVVPTHGEVLNDGKVKEVPWVLELTPMPVSGTTVGKDGINPDEPMT
            ||||||||||||||||||||||||||||||||||||||||||||||||||||||||||
       a218 QFPAGKWGVEPNPVSVVPTHGEVLNDGKVKEVPWVLELTPMPVSGTTVGKDGINPDEPMT
                   130        140        150        160        170        180

190        200        210
   m218.pep LETVDRFARXNRFQRALSVEFAQRRGRRMDFVAGFYEL
            ||||||||||||||||||:||||||||||||||||||
       a218 LETVDRFARXNRFQRALSAEFAQRRGRRMDFVAGFYEL
                   190        200        210
```

The following partial DNA sequence was identified in *N. gonorrhoeae* <SEQ ID 775>:

```
g219.seq
   1 atgacggcaa ggttaaggaa gtgccgtgga ttttggagct tatgcctatg 51 cctgtctcag ggacgactgt gggtgaaaac ggcattaacc ccaccgagcc 101 caataacatt ggaaaccgtc gaccgtttcg cgcgggaaat cggtttcaaa 151 gggcgttatc agttgaattt gcccaaaggc gaggacgggg tatggacttt 201 gtcgcaggat tctatgagtt atgacatgat cagcccgttt gccgaccgca 251 cggtacatat cgaccagtac agcggcgaga ttcttgccga catccgtttt 301 gacgattaca acccgttcgg caaatttatg gcggcaagca ttgcgctgca 351 tatgggggact tgggctggt ggagcgtgtt ggcgaacgtc gtgttctgcc 401 ttgccgtgat ttttatcggc atcagcggct gcgtgatgtg gtggaaacgc 451 cgtccgtccg gcgtggcggg cattgttcct ccggcgcaaa aaatcaaact 501 gcccgtctgg tgggcgatgg cattgccgct gctgttgatt gcactgcttt 551 tcccgaccgc gctgcttgcc attgccgtga tttggctgtt ggataccttg 601 ctgctgtcgc ggattcctgt gttgaggaaa tggtttaaat ga
```

This corresponds to the amino acid sequence <SEQ ID 776; ORF 219.ng>:

```
g219.pep
   1 MTARLRKCRG FWSLCLCLSQ GRLWVKTALT PPSPITLETV DRFAREIGFK

51 GRYQLNLPKG EDGVWTLSQD SMSYDMISPF ADRTVHIDQY SGEILADIRF

101 DDYNPFGKFM AASIALHMGT LGWWSVLANV VFCLAVIFIG ISGCVMWWKR

151 RPSGVAGIVP PAQKIKLPVW WAMALPLLLI ALLFPTALLA IAVIWLLDTL

201 LLSRIPVLRK WFK*
```

The following partial DNA sequence was identified in *N. meningitidis* <SEQ ID 777>:

```
m219.seq
   1 ATGACGGCAA GGTTAAGGAA GTGCCGTGGG TTTTGGAGCT TACGCCTATG

51 CCTGTTTCAG GGACGaCyGt gGGCAAAGAC GGCATTAACC CTGACGAGCC

101 GATGACATTG GAAACCGTCG ACCGCTTTGC GCGGnGAAAT CGGTTTCAAA

151 GGGCGTTATC AGTTGAATTT GCCCAAAGGC GAGGACGGCG TATGGACTTT

201 GTCGCAGGAT TCTATGAGTT ACGACATGAT CAGCCCGTTT GCCGACCGCA

251 CGGTACATAT CGACCAGTAC AGCGGCAAAA TCCTTGCCGA CATCCGTTTT

301 GACGATTACA ACCCGTTCGG CAAATTTATG GCGGCAAGCA TTGCGCTGCA

351 TATGGGGACT CTGGGCTGGT GGAGCGTGTT GGCGAACGTC TTGTTCTGCC

401 TTGCCGTCAT TTTTATCGGT ATCAGCGGCT GCGTGATGTG GTGGAAACGC

451 CGTCCGACCG GAGCGGTGGG CATCGTTCCG CCGGCGCAGA AAGTCAAGCT

501 GCCGGTTTGG TGGATGATGG CATTGCCGCT ATTGGCAATC GCACTGCTCT

551 TCCCGACCTC ACTGCTTGCC ATTGCCGTGA TTTGGCTGTT GGATACGCTG

601 CTGTTGTCGC GGATTCCTGT TTTGAGGAGA TGGTTTAAAT GA
```

This corresponds to the amino acid sequence <SEQ ID 778; ORF 219>:

```
m219.pep
   1 MTARLRKCRG FWSLRLCLFQ GRXWAKTALT LTSRXHWKPS TALRGEIGFK

51 GRYQLNLPKG EDGVWTLSQD SMSYDMISPF ADRTVHIDQY SGKILADIRF

101 DDYNPFGKFM AASIALHMGT LGWWSVLANV LFCLAVIFIG ISGCVMWWKR

151 RPTGAVGIVP PAQKVKLPVW WMMALPLLAI ALLFPTSLLA IAVIWLLDTL

201 LLSRIPVLRR WFK*
```

Computer analysis of this amino acid sequence gave the following results:

Homology with a Predicted ORF from *N. gonorrhoeae*

ORF 219 shows 86.9% identity over a 213 aa overlap with a predicted ORF (ORF 219.ng) from *N. gonorrhoeae*:

```
m219/g219

10        20        30        40        50        60
m219.pep MTARLRKCRGFWSLRLCLFQGRXWAKTALTLTSRXHWKPSTALRGEIGFKGRYQLNLPKG
         |||||||||||||| ||| ||| |:|||||  |    :    :  |||||||||||||||
g219     MTARLRKCRGFWSLCLCLSQGRLWVKTALTPPSPITLETVDRFAREIGFKGRYQLNLPKG
                10        20        30        40        50        60

70        80        90       100       110       120
m219.pep EDGVWTLSQDSMSYDMISPFADRTVHIDQYSGKILADIRFDDYNPFGKFMAASIALHMGT
         |||||||||||||||||||||||||||||||||:||||||||||||||||||||||||||
g219     EDGVWTLSQDSMSYDMISPFADRTVHIDQYSGEILADIRFDDYNPFGKFMAASIALHMGT
                70        80        90       100       110       120

130       140       150       160       170       180
m219.pep LGWWSVLANVLFCLAVIFIGISGCVMWWKRRPTGAVGIVPPAQKVKLPVWWMMALPLLAI
         ||||||||||:|||||||||||||||||||||:|::||||||||:|||||| |||||| |
g219     LGWWSVLANVVFCLAVIFIGISGCVMWWKRRPSGVAGIVPPAQKIKLPVWWAMALPLLLI
               130       140       150       160       170       180

190       200       210
m219.pep ALLFPTSLLAIAVIWLLDTLLLSRIPVLRRWFKX
         ||||||:||||||||||||||||||||||:|||
g219     ALLFPTALLAIAVIWLLDTLLLSRIPVLRKWFK
               190       200       210
```

The following partial DNA sequence was identified in *N. meningitidis* <SEQ ID 779>:

```
a219.seq
   1 ATGACGGCAA GGTTAAGGAA GTGCCGTGGG TTTTGGAGCT TACGCCTATG

51 CCTGTTTCAG GGACGACTGT GGGCAAAGAC GGTATTAACC CTGACGAGCC

101 GATGACATTG GAAACCGTCG ACCGTTTTGC GCGG.GAAAT CGGTTTCAAA

151 GGGCGTTATC AGCTGAATTT GCCCAAAGGC GAGGACGGCG TATGGACTTT

201 GTCGCAGGAT TCTATGAGTT ACGACATGAT CAGCCCGTTT GCTGACCGCA

251 CGGTGCATAT CGACCAGTAC AGCGGCAAGA TTCTTGCCGA CATCCGTTTT

301 GACGATTACA ACCCGTTCGG CAAATTTATG GCGGCAAGCA TTGCGCTGCA

351 TATGGGGACT TTGGGCTGGT GGAGCGTGTT GGCGAACGTT TTGTTCTGCC

401 TTGCCGTGAT TTTTATCGGC ATCAGCGGCT GCGTGATGTG GTGGAAACGC

451 CGTCCGTCCG GCGCGGTGGG CATGGTTCCG CCGGCGCAAA AAATCAAGCT

501 GCCCGTCTGG TGGGCAATGG CGGTGCCGCT GCTGCTGATT GCATTGCTTT

551 TCCCGACCGC GTTGCTTGCC ATTGCCGTGA TTTGGCTGTT GGATACGCTG

601 CTGTTGTCGC GGATTCCTGT TTTGAGGAGA TGGTTTAAAT GA
```

This corresponds to the amino acid sequence <SEQ ID 780; ORF 219.a>:

```
a219.pep
   1 MTARLRKCRG FWSLRLCLFQ GRLWAKTVLT LTSR*HWKPS TVLRXEIGFK

51 GRYQLNLPKG EDGVWTLSQD SMSYDMISPF ADRTVHIDQY SGKILADIRF

101 DDYNPFGKFM AASIALHMGT LGWWSVLANV LFCLAVIFIG ISGCVMWWKR

151 RPSGAVGMVP PAQKIKLPVW WAMAVPLLLI ALLFPTALLA IAVIWLLDTL

201 LLSRIPVLRR WFK*
``` m219/a219 94.8% identity in 213 aa overlap

```
                    10         20         30         40         50         60
  m219.pep  MTARLRKCRGFWSLRLCLFQGRXWAKTALTLTSRXHWKPSTALRGEIGFKGRYQLNLPKG
            ||||||||||||||||||||||| ||||:||||||||||:|| ||||||||||||||||
  a219      MTARLRKCRGFWSLRLCLFQGRLWAKTVLTLTSRXHWKPSTVLRXEIGFKGRYQLNLPKG
                    10         20         30         40         50         60

70         80         90        100        110        120
  m219.pep  EDGVWTLSQDSMSYDMISPFADRTVHIDQYSGKILADIRFDDYNPFGKFMAASIALHMGT
            ||||||||||||||||||||||||||||||||||||||||||||||||||||||||||||
  a219      EDGVWTLSQDSMSYDMISPFADRTVHIDQYSGKILADIRFDDYNPFGKFMAASIALHMGT
                    70         80         90        100        110        120

130        140        150        160        170        180
  m219.pep  LGWWSVLANVLFCLAVIFIGISGCVMWWKRRPTGAVGIVPPAQKVKLPVWWMMALPLLAI
            |||||||||||||||||||||||||||||||:||||:||||||:||||| ||:||| |
  a219      LGWWSVLANVLFCLAVIFIGISGCVMWWKRRPSGAVGMVPPAQKIKLPVWWAMAVPLLLI
                   130        140        150        160        170        180

190        200        210
  m219.pep  ALLFPTSLLAIAVIWLLDTLLLSRIPVLRRWFKX
            ||||||:|||||||||||||||||||||||||||
  a219      ALLFPTALLAIAVIWLLDTLLLSRIPVLRRWFKX
                   190        200        210
```

60

The following partial DNA sequence was identified in *N. gonorrhoeae* <SEQ ID 781>:

```
g221.seq
   1 atgcacgacc acggcgccat ggatcgccgc ctccccgctt tcggaagtct 51 gatgcggcga gccgtaaatc adatcgacgc tgacggattt gaaccctgcc
```

-continued

```
101 tcacgggcgg catcgatgac ttctttggtt tcttcgtagc tttggatgcg 151 gttgactgcc gcctgcactt tggggtcgaa atcctgaatg ccgacgctca 201 tgcggttgaa gccgagtctg ccgagcatga ggacggtgtc gcggctgact 251 ttgcgcgggt cgatttcgat ggaatattcg ccggacggta tcagttcgaa 301 atgtttgcgg atcatgcgga agacacgttc gatctgttcg tcgctcaaaa 351 aggtcggcgt gccgccgccg aagtgcagtt gggcaagctg gtgccgtccg 401 ttcagatgtg gagcgagcag ttccatttct ttttcaagat attcgatgta 451 ggtatcggcg cggcttttgt ctttggtgat gattttgttg cagccgcagt 501 agtagcagat ggtgttgcaa acggaatgt gaatgtaaag ggaaagcggt 551 ttgtttaa
```

This corresponds to the amino acid sequence <SEQ ID 782; ORF 221.ng>:

```
g221.pep
  1 MHDHGAMDRR LPAFGSLMRR AVNXIDADGF EPCLTGGIDD FFGFFVALDA

51 VDCRLHFGVE ILNADAHAVE AESAEHEDGV AADFARVDFD GIFAGRYQFE

101 MFADHAEDTF DLFVAQKGRR AAAEVQLGKL VPSVQMWSEQ FHFFFKIFDV

151 GIGAAFVFGD DFVAAAVVAD GVAKRNVNVK GKRFV*
```

30

The following partial DNA sequence was identified in *N. meningitidis* <SEQ ID 783>:

```
m221.seq
  1 ATGGyGGTTT TGATGcwcmg AAGTCTGGTG CGGCAGGCCG TAAATCAAAT

51 CGACGCTGAC GGATTTGAAC CCCGCTTCGC GCGCCGCATC GATGACTTCT

101 TTGGTTTCTT CGTAACTTTG GATGCGGTTG ACCGCCGCCT GCACTTTGGG

151 GTCGAAATCC TGAATGCCGA TGCTCATGCG GTTGAAGCCG AGTCTGCCGA

201 GCATGAGGAC GGTGTCGCGG CTGACTTTGC GCGGGTCGAT TTCGATGGAG

251 TATTCGCCGG TGGGGATTAA CTCGAAATGT TTGCGTATCA TGCGGAAGAC

301 ACGTTCGATC TGTTCGTCGC TCAAAAAGGt GCGTGCcCCG CCGAAGTGCA

351 GTTGGGCAAG CTGGTGCCGT CCGTTCAGAT GTGGAGCGAG CAGTTCCATT

401 TCTTTTTCAA GATATTCGAT GTAGGCATCG GCGCGGCTTT TGTCTTTGGT

451 GATGATTTTG TTGCAGCCGC AGTAGTAGCA GATGGTGTTG CAGAACGGAA

501 TGTGAATGTA AAGGGAAAGC GGTTTGTTTA A
```

This corresponds to the amino acid sequence <SEQ ID 784; ORF 221>:

```
m221.pep
  1 MXVLMXRSLV RQAVNQIDAD GFEPRFARRI DDFFGFFVTL DAVDRRLHFG

51 VEILNADAHA VEAESAEHED GVAADFARVD FDGVFAGGDX LEMFAYHAED

101 TFDLFVAQKG ACPAEVQLGK LVPSVQMWSE QFHFFFKIFD VGIGAAFVFG

151 DDFVAAAVVA DGVAERNVNV KGKRFV*
```

Computer analysis of this amino acid sequence gave the following results:

Homology with a Predicted ORF from *N. gonorrhoeae*

ORF 221 shows 87.6% identity over a 170 aa overlap with a predicted ORF (ORF 221.ng) from *N. gonorrhoeae*:

```
m221/g221
                       10        20        30        40        50
       m221.pep      MXVLMXRSLVRQAVNQIDADGFEPRFARRIDDFFGFFVTLDAVDRRLHFGVE
                    ||:|:|||  ||||||||  ::   ||||||||||:||||  ||||||
       g221     MHDHGAMDRRLPAFGSLMRRAVNXIDADGFEPCLTGGIDDFFGFFVALDAVDCRLHFGVE
                     10        20        30        40        50        60

60        70        80        90       100       110
       m221.pep      ILNADAHAVEAESAEHEDGVAADFARVDFDGVFAGGDXLEMFAYHAEDTFDLFVAQKGA-
                    |||||||||||||||||||||||||||||||:|||   :||||  ||||||||||||||
       g221         ILNADAHAVEAESAEHEDGVAADFARVDFDGIFAGRYQFEMFADHAEDTFDLFVAQKGRR
                       70        80        90       100       110       120

120       130       140       150       160       170
       m221.pep      CPAEVQLGKLVPSVQMWSEQFHFFFKIFDVGIGAAFVFGDDGVAAAVVADGVAERNVNVK
                     |||||||||||||||||||||||||||||||||||||||||||||||||||:||||||
       g221         AAAEVQLGKLVPSVQMWSEQFHFFFKIFDVGIGAAFVFGDDGVAAAVVADGVAKRNVNVK
                       130       140       150       160       170       180 m221.pep     GKRFVX
                    ||||||
       g221        GKRFVX
```

The following partial DNA sequence was identified in *N. meningitidis* <SEQ ID 785>:

```
a221.seq
  1 ATGGTGGTTT TGATGCTCCG AAGTCTGGTG CGGCAGGCCG TAAATCAAAT

51 CGACGCTGAC GGATTTGAAC CCCGCTTCGC GCGCCGCATC GATGACTTCT

101 TTGGTTTCTT CGTAACTTTG GATGCGGTTG ACCGCCGCCT GCACTTTGGG

151 GTCGAAATCC TGAATGCCGA TGCTCATGCG GTTGAAGCCG AGTCTGCCGA

201 GCATGAGGAC GGTGTCGCGG CTGACTTTGC GCGGGTCGAT TTCGATGGAG

251 TATTCGCCGG TGGGGATTAA CTCGAAATGT TTGCGTATCA TGCGGAAGAC

301 ACGTTCGATT TGGTCGTCGC TCAAAAAGGT CGGCGTGCCG CCGCCGAAGT

351 GCAGTTGGGC AAGCTGGTGC CGTCCGTTCA GATGTGGAGC GAGCAGTTCC

401 ATTTCTTTTT CAAGAAATTC GATGTAGGCA TCGGCGCGGC TTTTGTCTTT

451 GGTGATGATT TTGTTGCAGC CGCAGTAGTA GCAGATGGTG TTGCAGAACG

501 GAATGTGAAT GTAAAGGGAA AGCGGTTTGT TTAA
```

This corresponds to the amino acid sequence <SEQ ID 786; ORF 221.a>:

```
a221.pep
  1 MVVLMLRSLV RQAVNQIDAD GFEPRFARRI DDFFGFFVTL DAVDRRLHFG

51 VEILNADAHA VEAESAEHED GVAADFARVD FDGVFAGGD* LEMFAYHAED

101 TFDLVVAQKG RRAAAEVQLG KLVPSVQMWS EQFHFFFKKF DVGIGAAFVF

151 GDDFVAAAVV ADGVAERNVN VKGKRFV*
``` m221/a221 95.5% identity in 177 aa overlap

```
                       10        20        30        40        50        60
      m221.pep      MXVLMXRSLVRQAVNQIDADGFEPRFARRIDDFFGFFVTLDAVDRRLHFGVEILNADAHA
                    | ||| |||||||||||||||||||||||||||||||||||||||||||||||||||||
      a221         MVVLMLRSLVRQAVNQIDADGFEPRFARRIDDFFGFFVTLDAVDRRLHFGVEILNADAHA
                       10        20        30        40        50        60
```

-continued

```
                  70         80         90        100        110       119
m221.pep     VEAESAEHEDGVAADFARVDFDGVFAGGDXLEMFAYHAEDTFDLFVAQKGA-CPAEVQLG
             ||||||||||||||||||||||||||||||||||||||||||||| |||||  ||||||
a221         VEAESAEHEDGVAADFARVDFDGVFAGGDXLEMFAYHAEDTFDLVVAQKGRRAAAEVQLG
                  70         80         90        100        110       120

120        130        140        150        160        170
m221.pep     KLVPSVQMWSEQFHFFFKIFDVGIGAAFVFGDDFVAAAVVADGVAERNVNVKGKRFVX
             ||||||||||||||||||| ||||||||||||||||||||||||||||||||||||||
a221         KLVPSVQMWSEQFHFFFKKFDVGIGAAFVFGDDFVAAAVVADGVAERNVNVKGKRFVX
                 130        140        150        160        170
```

The following partial DNA sequence was identified in *N. gonorrhoeae* <SEQ ID 787>:

```
g223.seq
   1 atggaattca ggcaccaggt agtggtagtt ggtgtcgaac catttggtca 51 tttcgatggc gaattggtct tgttgccgc gcgccagttg aagaattgt 101 tccaaaggca ggttttggct atcgaagccg aaacgggcgg gaatcgcgcc 151 cgtggatact tgcaggtcga ggatgtgatg gtagaaagtg aaatcacgta 201 cagcaacgta atcagcgtta ggagcagctt ggtgtttcca gttttctcg 251 cgcaggtctt tggcaacgtc gagcagctct tgttcactga tctctttgcg 301 ccagtatttt tcttgggcga atttcaattc acggaaggcg ccgacacgcg 351 ggaagcctga
```

This corresponds to the amino acid sequence <SEQ ID 788; ORF 223.ng>:

```
g223.pep..
   1 MEFRHQVVVV GVEPFGHFDG ELVFVAARQL EELFQRQVLA IEAETGGNRA

51 RGYLQVEDVM VESEITYSNV ISVRSSLVFP VFLAQVFGNV EQLLFTDLFA

101 PVFFLGEFQF TEGADTREA*
```

The following partial DNA sequence was identified in *N. meningitidis* <SEQ ID 789>:

```
m223.seq
   1 GTGGAATTCA GGCACCAAGT AGTGGTAGTT GGTGTCGAAC CATTTGGTCA

51 TTTCGATAGC GAATTGGTCT TGTTACCGC GCGCCAGTTG AAGAATTGT

101 TCCAAAGACA GGTTTTGGCT GTCGAAGCCG AAGCGGGCGG GAATCGCGCC

151 GGTGGCGACT TGCAGGTCGA GGATGTGGTC GTAGAAAGTG AAATCsCTAC

201 GGCAACGAAA TCGGCGTTGG CAGCGACCTG GTGTTCCAG TTTTTCTCGC

251 GCAAGTCTTT AGCAACAGCC AGCAATTCTT GCTCGCTGAT TTCTTTGCGC

301 CAGTATTTTT CTTGTGCGAA TTTCAATTCG CGGAAGGCGC CGACACGCGG

351 GAAGCCTGA
```

This corresponds to the amino acid sequence <SEQ ID 790; ORF 223>:

```
m223.pep
   1 VEFRHQVVVV GVEPFGHFDS ELVFVTARQL EELFQRQVLA VEAEAGGNRA

51 GGDLQVEDVV VESEIXYGNE IGVGSDLVFP VFLAQVFSNS QQFLLADFFA

101 PVFFLCEFQF AEGADTREA*
```

Computer analysis of this amino acid sequence gave the
following results:
Homology with a Predicted ORF from *N. gonorrhoeae*
ORF 223 shows 80.7% identity over a 119 aa overlap with
a predicted ORF (ORF 223.ng) from *N. gonorrhoeae*:

```
    m223/g223

10        20        30        40        50        60
    m223.pep    VEFRHQVVVVGVEPFGHFDSELVFVTARQLEELFQRQVLAVEAEAGGNRAGGDLQVEDVV
                :||||||||||||||||:|||||:||||||||||||||:|||:|||||  |||||||:
    g223        MEFRHQVVVVGVEPFGHFDGELVFVAARQLEELFQRQVLAIEAETGGNRARGYLQVEDVM
                        10        20        30        40        50        60

70        80        90       100       110       119
    m223.pep    VESEIXYGNEIGVGSDLVFPVFLAQVFSNSQQFLLADFFAPVFFLCEFQFAEGADTREAX
                |||||:|:|  |:|  |:||||||||||||:|  :|:|::|:||||||  ||||:||||||||||
    g223        VESEITYSNVISVRSSLVFPVFLAQVFGNVEQLLFTDLFAPVFFLGEFQFTEGADTREAX
                        70        80        90       100       110       120
```

The following partial DNA sequence was identified in *N. meningitidis* <SEQ ID 791>:

```
a223.seq
   1 GTGGAATTCA GGCACCAAGT AGTGGTAGTT GGTGTCGAAC CATTTGGTCA

51 TTTCGATAGC GAATTGGTCT TTGTTACCGC GCGCCAGTTG GAAGAATTGT

101 TCCAAAGATA GGTTTTGGCT GTCGAAGCCG AAGCGGGCGG GAATCGCGCC

151 GGTGGCGACT TGCAGGTCGA GGATGTGGTC GTAGAAAGTG AAATCGCCTA

201 CGGCAACGTA ATCGGCGTTG GCAGCGGCCT GGTGTTTCCA GTTTTTCTCG

251 CGCAAGTCTT TAGCAACAGC CAGCAATTCT TGCTCGCTGA TTTCTTTGCG

301 CCAGTATTTT TCTTGTGCGA ATTTCAATTC GCGGAAGGCA CCGACACGCG

351 GGAAGCCTGA
```

This corresponds to the amino acid sequence <SEQ ID 792; ORF 223.a>:

```
a223.pep
   1 VEFRHQVVVV GVEPFGHFDS ELVFVTARQL EELFQR*VLA VEAEAGGNRA

51 GGDLQVEDVV VESEIAYGNV IGVGSGLVFP VFLAQVFSNS QQFLLADFFA

101 PVFFLCEFQF AEGTDTREA*
``` m223/a223 95.8% identity in 119 aa overlap

```
                        10        20        30        40        70        60
    m223.pep    VEFRHQVVVVGVEPFGHFDSELVFVTARQLEELFQRQVLAVEAEAGGNRAGGDLQVEDVV
                |||||||||||||||||||||||||||||||||||| |||||||||||||||||||||||
    a223        VEFRHQVVVVGVEPFGHFDSELVFVTARQLEELFQRXVLAVEAEAGGNRAGGDLQVEDVV
                        10        20        30        40        70        60

70        80        90       100       110       120
    m223.pep    VESEIXYGNEIGVGSDLVFPVFLAQVFSNSQQFLLADFFAPVFFLCEFQFAEGADTREAX
                ||||| ||| |||||||||||||||||||||||||||||||||||:||||||
    a223        VESEIAYGNVIGVGSGLVFPVFLAQVFSNSQQFLLADFFAPVFFLCEFQFAEGTDTREAX
                        70        80        90       100       110       120
```

The following partial DNA sequence was identified in *N. gonorrhoeae* <SEQ ID 793>:

```
g225.seq
   1 atggattctt ttttcaaacc ggcagtttgg gcggttttgt ggctgatgtt 51 tgccgtccgc cccgcccttg ccgacgagtt gaccaacctg ctcagcagcc
```

-continued

```
101 gcgagcagat tctcagacag tttgccgaag acgaacagcc cgttttaccc 151 gtcaaccgag cccccgcccg gcgggcgggc aatgccgacg aactcatcgg 201 cggcgcgatg gggcttaacg aacagcccgt tgtacgcgtc aaccgagccn 251 ccgcccggcg ggcgggcaat gccgacaaac tcatcggcag cgcgatgcgg 301 cttttgggta ttgcctaccg ctacggcggc acatcggtgt ctaccggttt 351 tgactgcagc ggattcatgc agcacatctt caaacgcgcc atgggcatca 401 acctgccgcg cacgtcggcg gaacaggcgc ggatgggcgc acccgttgcc 451 cgaagcgaat tgcagcccgg ggatatggtg ttttttccgca cgctcggcgg 501 cagccgcatt tcccatgtcg gactttatat cggcaacaac cgcttcatcc 551 acgcgccgcg cacggggaaa aatatcgaaa tcaccagcct gagccacaaa 601 tattggagcg gcaaatatgc gttcgcccgc cgggtcaaga aaaacgaccc 651 gtcacgcttt ctgaactga
```

This corresponds to the amino acid sequence <SEQ ID 794; ORF 225.ng>:

```
g225.pep
  1 MDSFFKPAVW AVLWLMFAVR PALADELTNL LSSREQILRQ FAEDEQPVLP

51 VNRAPARRAG NADELIGGAM GLNEQPVVRV NRAXARRAGN ADKLIGSAMR

101 LLGIAYRYGG TSVSTGFDCS GFMQHIFKRA MGINLPRTSA EQARMGAPVA

151 RSELQPGDMV FFRTLGGSRI SHVGLYIGNN RFIHAPRTGK NIEITSLSHK

201 YWSGKYAFAR RVKKNDPSRF LN*
```

The following partial DNA sequence was identified in *N. meningitidis* <SEQ ID 795>:

```
m225.seq (partial)
   1 ..TTTTCAAACC CGGCAGTTTG GCGGTTTTG TGGCTGAwGT TTGCCGTCCG

51    CCCCGCCCTT GCCGACGAGT TGACCAACCT GCTCAGCAGC CGCGAGCAGA

101    TTCTCAGACA GTTTGCCGAA GACGAACAGC CCGTTTTACC CATCAACCGA

151    GCCCCCGCCC GGCGGGCGGG CAATGCCGAC GAACTCATCG GCAGCGCGAT

201    GGGGCTTAAC GAACAGCCCG TTTTACCCGT CAACCGAGTC CCCGCCCGGC

251    GGGCGGGCAA TGCCGACGAA CTCATCGGCA CGCGATGGG GCTTAACGAA

301    CAGCCCGTTT TACCCGTCAA CCGAGCCCCC GGCGGGCGGG CGGGCAATGC

351    CGACGAACTC ATCGGCAACG CGATGGGACT TTTGGGTATT GCCTACCGCT

401    ACGGCGGCAC ATCGGTTTCT ACCGGTTTTG ACTGCAGCGG CTTCATGCAG

451    CACATCTTCA AACGCGCCAT GGGCATCAAC CTGCCGCGCA CGTCGGCAGA

501    ACAGGCACGG ATGGGTACGC CGGTTGCCCG AAGCGAATTG CAGCCCGGAG

551    ATATGGTGTT TTTCCGCACG CTCGGCGGCA GCCGCATTTC CCATGTCGGA

601    CTTTATATCG GCAACAACCG CTTCATCCAC GCGCCGCGCA CGGGGAAAAA

651    TATCGAAATC ACCAGCCTGA GCCACAAATA TTGGAGCGG AAATACGCGT

701    TCGCCCGCCG GGTCAAGAAA AACGACCCGT CCCGCTTTCT GAACTGA
```

This corresponds to the amino acid sequence <SEQ ID 796; ORF 225>:

```
m225.pep (partial)
  1 ..FSNPAVWAVL WLXFAVRPAL ADELTNLLSS REQILRQFAE DEQPVLPINR

51   APARRAGNAD ELIGSAMGLN EQPVLPVNRV PARRAGNADE LIGNAMGLNE

101   QPVLPVNRAP ARRAGNADEL IGNAMGLLGI AYRYGGTSVS TGFDCSGFMQ

151   HIFKRAMGIN LPRTSAEQAR MGTPVARSEL QPGDMVFFRT LGGSRISHVG

201   LYIGNNRFIH APRTGKNIEI TSLSHKYWSG KYAFARRVKK NDPSRFLN*
```

Computer analysis of this amino acid sequence gave the following results:
Homology with a Predicted ORF from *N. gonorrhoeae*
ORF 225 shows 83.5% identity over a 248 aa overlap with a predicted ORF (ORF 225.ng) from *N. gonorrhoeae*:

```
    m225/g225

10         20         30         40         50
       m225.pep    FSNPAVWAVLWLXFAVRPALADELTNLLSSREQILRQFAEDEQPVLPINRAPARRAG
                     :|||||||| ||||||||||||||||||||||||||||||||||:||||||||
       g225        MDSFFKPAVWAVLWLMFAVRPALADELTNLLSSREQILRQFAEDEQPVLPVNRAPARRAG
                          10         20         30         40         50         60
                     60         70         80         90        100        110
       m225.pep    NADELIGSAMGLNEQPVLPVNRVPARRAGNADELIGNAMGLNEQPVLPVNRAPARRAGNA
                   |||||||                              :||||||||: |||| |||||||
       g225        NADELIG--------------------------GAMGLNEQPVVRVNRAXARRAGNA
                                                          70         80         90
                    120        130        140        150        160        170
       m225.pep    DELIGNAMGLLGIAYRYGGTSVSTGFDCSGFMQHIFKRAMGINLPRTSAEQARMGTPVAR
                   |:|||:|| ||||||||||||||||||||||||||||||||||||||||||||:||||
       g225        DKLIGSAMRLLGIAYRYGGTSVSTGFDCSGFMQHIFKRAMGINLPRTSAEQARMGAPVAR
                           100        110        120        130        140        150
                    180        190        200        210        210        230
       m225.pep    SELQPGDMVFFRTLGGSRISHVGLYIGNNRFIHAPRTGKNIEITSLSHKYWSGKYAFARR
                   ||||||||||||||||||||||||||||||||||||||||||||||||||||||||||||
       g225        SELQPGDMVFFRTLGGSRISHVGLYIGNNRFIHAPRTGKNIEITSLSHKYWSGKYAFARR
                           160        170        180        190        200        210
                    240      249
       m225.pep    VKKNDPSRFLNX
                   ||||||||||
       g225        VKKNDPSRFLN
                           220
```

The following partial DNA sequence was identified in *N. meningitidis* <SEQ ID 797>:

```
a225.seq
  1 ATGGATTCTT TTTTCAAACC GGCAGTTTGG GCGGTTTTGT GGCTGATGTT

51 TGCCGTCCGC CCCGCCCTTG CCGACGAGTT GACCAACCTG CTCAGCAGCC

101 GCGAGCAGAT TCTCAGACAG TTTGCCGAAG ACGAACAGCC CGTTTTACCC

151 ATCAACCGAN CCCCCGCCCG GCGGGCGGGC AATGCCGACG AACTCATCGG

201 CAGCGCGATG GGGCTTAACG AACAGCCCGT TTTACCCGTC AACCGANTCC

251 CCGCCCGGCG GCGGGCAAT GCCGACNAAC TCATCGGCAA CGCGATGGGG

301 CTTAACGAAC AGCCCGTTTT ACCCGTCAAC CGAGTCCCCG CCCGGCGGGC

351 GGGCAATGCC GACGAACTCA TCGGCAACGC GATGGGGCTT AACGAACAGC

401 CCGTTTTACC CGTCAACCGA GCCCCCGCCC GGCGGGCGGG CAATGCCGAC

451 GAACTCATCG GCAACGCGAT GGGACTTTTG GGTATTGCCT ACCGCTACGG

501 CGGCACATCG ATTTCTACCG GTTTTGACTG CAGCGGCTTC ATGCAGCACA
```

```
-continued
551 TCTTCAAACG CGCCATGGGC ATCAACCTGC CGCGCACGTC GGCAGAACAG

601 GCGCGGATGG GTACGCCGGT TGCCCGAAGC GAATTGCAGC CCGGGGATAT

651 GGTGTNTTTC CGCACGCTCG GCGGCAGCCG CATTTCCCAT GTCGGACTTT

701 ATATCGGCAA CAACCGCTTC ATCCACGCGC CGCGCACGGG GAAAAATATC

751 GAAATCACCA GCCTGAGCCA CAAATATTGG AGCGGCAAAT ACGCGTTCGC

801 CCGCCGGGTC AAGAAAAACG ACCCGTCCCG CTTTCTGAAC TGA
```

This corresponds to the amino acid sequence <SEQ ID 798; ORF 225.a>:

```
a225.pep
  1 MDSFFKPAVW AVLWLMFAVR PALADELTNL LSSREQILRQ FAEDEQPVLP

51 INRXPARRAG NADELIGSAM GLNEQPVLPV NRXPARRAGN ADXLIGNAMG

101 LNEQPVLPVN RVPARRAGNA DELIGNAMGL NEQPVLPVNR APARRAGNAD

151 ELIGNAMGLL GIAYRYGGTS ISTGFDCSGF MQHIFKRAMG INLPRTSAEQ

201 ARMGTPVARS ELQPGDMVXF RTLGGSRISH VGLYIGNNRF IHAPRTGKNI

251 EITSLSHKYW SGKYAFARRV KKNDPSRFLN *
``` m225/a225 87.4% identity in 277 aa overlap

```
                10         20         30         40         50
   m225.pep  FSNPAVWAVLWLXFAVRPALADELTNLLSSREQILRQFAEDEQPVLPINRAPARRAG
             | :||||||||| |||||||||||||||||||||||||||||||||||| ||||||
   a225      MDSFFKPAVWAVLWLMFAVRPALADELTNLLSSREQILRQFAEDEQPVLPVNRXPARRAG
                10         20         30         40         50         60

60         70        79                              80
   m225.pep  NADELIGSAMGLNEQPVLPVNR----------------------------VPARRAGNA
             |||||||||||||||||||||||                          ||||||||
   a225      NADELIGSAMGLNEQPVLPVNRXPARRAGNADXLIGNAMGLNEQPVLPVNRVPARRAGNA
                        70         80         90        100        110        120

90        100        110        120        130        140
   m225.pep  DELIGNAMGLNEQPVLPVNRAPARRAGNADELIGNAMGLLGIAYRYGGTSVSTGFDCSGF
             |||||||||||||||||||||||||||||||||||||||||||||||||:||||||||
   a225      DELIGNAMGLNEQPVLPVNRAPARRAGNADELIGNAMGLLGIAYRYGGTSISTGFDCSGF
                       130        140        150        160        170        180

150        160        170        180        190        200
   m225.pep  MQHIFKRAMGINLPRTSAEQARMGTPVARSELQPGDMVFFRTLGGSRISHVGLYIGNNRF
             ||||||||||||||||||||||||||||||||||||||| |||||||||||||||||||
   a225      MQHIFKRAMGINLPRTSAEQARMGTPVARSELQPGDMVXFRTLGGSRISHVGLYIGNNRF
                       190        200        210        220        230        240

210        220        230        240    249
   m225.pep  IHAPRTGKNIEITSLSHKYWSGKYAFARRVKKNDPSRFLNX
             ||||||||||||||||||||||||||||||||||||||||
   a225      IHAPRTGKNIEITSLSHKYWSGKYAFARRVKKNDPSRFLNX
                       250        260        270        280
```

The following partial DNA sequence was identified in N. gonorrhoeae <SEQ ID 799>:

```
g225-1.seq
  1 atggattctt ttttcaaacc ggcagtttgg gcggttttgt ggctgatgtt 51 tgccgtccgc cccgcccttg ccgacgagtt gaccaacctg ctcagcagcc 101 gcgagcagat tctcagacag tttgccgaag acgaacagcc cgttttaccc 151 gtcaaccgag ccccgcccg gcgggcgggc aatgccgacg aactcatcgg 201 cggcgcgatg gggcttaacg aacagcccgt tgtacgcgtc aaccgagccn 251 ccgcccggcg ggcgggcaat gccgacaaac tcatcggcag cgcgatgcgg 301 cttttgggta ttgcctaccg ctacggcggc acatcggtgt ctaccggttt
```

-continued

```
351 tgactgcagc ggattcatgc agcacatctt caaacgcgcc atgggcatca 401 acctgccgcg cacgtcggcg aacaggcgc ggatgggcgc acccgttgcc 451 cgaagcgaat tgcagcccgg ggatatggtg ttttccgca cgctcggcgg 501 cagccgcatt tcccatgtcg gactttatat cggcaacaac cgcttcatcc 551 acgcgccgcg cacggggaaa aatatcgaaa tcaccagcct gagccacaaa 601 tattggagcg gcaaatatgc gttcgcccgc cgggtcaaga aaaacgaccc 651 gtcacgcttt ctgaactga
```

This corresponds to the amino acid sequence <SEQ ID 800; ORF 225-1.ng>:

```
g225-1.pep
  1 MDSFFKPAVW AVLWLMFAVR PALADELTNL LSSREQILRQ FAEDEQPVLP

51 VNRAPARRAG NADELIGGAM GLNEQPVVRV NRAXARRAGN ADKLIGSAMR

101 LLGIAYRYGG TSVSTGFDCS GFMQHIFKRA MGINLPRTSA EQARMGAPVA

151 RSELQPGDMV FFRTLGGSRI SHVGLYIGNN RFIHAPRTGK NIEITSLSHK

201 YWSGKYAFAR RVKKNDPSRF LN*
```

The following partial DNA sequence was identified in *N. meningitidis* <SEQ ID 801>:

```
m225-1.seq
  1 ATGGATTCTT TTTTCAAACC GGCAGTTTGG GCGGTTTTGT GGCTGATGTT

51 TGCCGTCCGC CCCGCCCTTG CCGACGAGTT GACCAACyTG CTCAGCAGCC

101 GCGAGCAGAT TCTCAGACAG TTTGCCGAAG ACGAACAGCC CGTTTTACCC

151 ATCAACCGAG CCCCCGCCCG GCGGGCGGGC AATGCCGACG AACTCATCGG

201 CAGCGCGATG GGGCTTAACG AACAGCCCGT TTTACCCGTC AACCGAGTCC

251 CCGCCCGGCG GGCGGGCAAT GCCGACGAAC TCATCGGCAA CGCGATGGGG

301 CTTAACGAAC AGCCCGTTTT ACCCGTCAAC CGAGCCCCCG CCCGGCGGGC

351 GGGCAATGCC GACGAACTCA TCGGCAACGC GATGGGACTT TTGGGTATTG

401 CCTACCGCTA CGGCGGCACA TCGGTTTCTA CCGGTTTTGA CTGCAGCGGC

451 TTCATGCAGC ACATCTTCAA ACGCGCCATG GGCATCAACC TGCCGCGCAC

501 GTCGGCAGAA CAGGCACGGA TGGGTACGCC GGTTGCCCGA AGCGAATTGC

551 AGCCCGGAGA TATGGTGTTT TTCCGCACGC TCGGCGGCAG CCGCATTTCC

601 CATGTCGGAC TTTATATCGG CAACAACCGC TTCATCCACG CGCCGCGCAC

651 GGGGAAAAAT ATCGAAATCA CCAGCCTGAG CCACAAATAT GGAGCGGCA

701 AATACGCGTT CGCCCGCCGG GTCAAGAAAA ACGACCCGTC CCGCTTTCTG

751 AACTGA
```

This corresponds to the amino acid sequence <SEQ ID 802; ORF 217>:

```
m225-1.pep
      1 MDSFFKPAVW AVLWLMFAVR PALADELTNL LSSREQILRQ FAEDEQPVLP

51 INRAPARRAG NADELIGSAM GLNEQPVLPV NRVPARRAGN ADELIGNAMG
```

```
    101 LNEQPVLPVN RAPARRAGNA DELIGNAMGL LGIAYRYGGT SVSTGFDCSG

151 FMQHIFKRAM GINLPRTSAE QARMGTPVAR SELQPGDMVF FRTLGGSRIS

201 HVGLYIGNNR FIHAPRTGKN IEITSLSHKY WSGKYAFARR VKKNDPSRFL

251 N* m225-1/g225-1 84.9% identity in 251 aa overlap 10         20         30         40         50         60
m225-1.pep    MDSFFKPAVWAVLWLMFAVRPALADELTNLLSSREQILRQFAEDEQPVLPINRAPARRAG
              ||||||||||||||||||||||||||||||||||||||||||||||||||||:|||||||
g225-1        MDSFFKPAVWAVLWLMFAVRPALADELTNLLSSREQILRQFAEDEQPVLPVNRAPARRAG
                  10         20         30         40         50         60

70         80         90        100        110        120
m225-1.pep    NADELIGSAMGLNEQPVLPVNRVPARRAGNADELIGNAMGLNEQPVLPVNRAPARRAGNA
              ||||                        |||:||||||||:||||  ||||  |||||||
g225-1        NADE---------------------------LIGGAMGLNEQPVVRVNRAXARRAGNA
                                                         70         80         90

130        140        150        160        170        180
m225-1.pep    DELIGNAMGLLGIAYRYGGTSVSTGFDCSGFMQHIFKRAMGINLPRTSAEQARMGTPVAR
              |:|||:|| ||||||||||||||||||||||||||||||||||||||||||||||:|||
g225-1        DKLIGSAMRLLGIAYRYGGTSVSTGFDCSGFMQHIFKRAMGINLPRTSAEQARMGAPVAR
                 100        110        120        130        140        150

190        200        210        220        230        240
m225-1.pep    SELQPGDMVFFRTLGGSRISHVGLYIGNNRFIHAPRTGKNIEITSLSHKYWSGKYAFARR
              ||||||||||||||||||||||||||||||||||||||||||||||||||||||||||||
g225-1        SELQPGDMVFFRTLGGSRISHVGLYIGNNRFIHAPRTGKNIEITSLSHKYWSGKYAFARR
                 160        170        180        190        200        210

250
m225-1.pep    VKKNDPSRFLNX
              ||||||||||||
g225-1        VKKNDPSRFLNX
                 220
```

The following partial DNA sequence was identified in *N. meningitidis* <SEQ ID 803>:

```
a225-1.seq
   1 ATGGATTCTT TTTTCAAACC GGCAGTTTGG GCGGTTTTGT GGCTGATGTT

51 TGCCGTCCGC CCCGCCCTTG CCGACGAGTT GACCAACCTG CTCAGCAGCC

101 GCGAGCAGAT TCTCAGACAG TTTGCCGAAG ACGAACAGCC CGTTTTACCC

151 ATCAACCGAN CCCCCGCCCG GCGGGCGGGC AATGCCGACG AACTCATCGG

201 CAGCGCGATG GGGCTTAACG AACAGCCCGT TTTACCCGTC AACCGANTCC

251 CCGCCCGGCG GCGGGCAAT GCCGACNAAC TCATCGGCAA CGCGATGGGG

301 CTTAACGAAC AGCCCGTTTT ACCCGTCAAC CGAGTCCCCG CCCGGCGGGC

351 GGGCAATGCC GACGAACTCA TCGGCAACGC GATGGGGCTT AACGAACAGC

401 CCGTTTTACC CGTCAACCGA GCCCCCGCCC GGCGGGCGGG CAATGCCGAC

451 GAACTCATCG GCAACGCGAT GGGACTTTTG GTATTGCCT ACCGCTACGG

501 CGGCACATCG ATTTCTACCG GTTTTGACTG CAGCGGCTTC ATGCAGCACA

551 TCTTCAAACG CGCCATGGGC ATCAACCTGC CGCGCACGTC GGCAGAACAG

601 GCGCGGATGG GTACGCCGGT TGCCCGAAGC GAATTGCAGC CCGGGGATAT

651 GGTGTNTTTC CGCACGCTCG GCGGCAGCCG CATTTCCCAT GTCGGACTTT

701 ATATCGGCAA CAACCGCTTC ATCCACGCGC CGCACGGG GAAAAATATC

751 GAAATCACCA GCCTGAGCCA CAAATATTGG AGCGGCAAAT ACGCGTTCGC

801 CCGCCGGGTC AAGAAAAACG ACCCGTCCCG CTTTCTGAAC TGA
```

This corresponds to the amino acid sequence <SEQ ID 804; ORF 225-1.a>:

```
a225-1.pep

1 MDSFFKPAVW AVLWLMFAVR PALADELTNL LSSREQILRQ FAEDEQPVLP

51 INRXPARRAG NADELIGSAM GLNEQPVLPV NRXPARRAGN ADXLIGNAMG

101 LNEQPVLPVN RVPARRAGNA DELIGNAMGL NEQPVLPVNR APARRAGNAD

151 ELIGNAMGLL GIAYRYGGTS ISTGFDCSGF MQHIFKRAMG INLPRTSAEQ

201 ARMGTPVARS ELQPGDMVXF RTLGGSRISH VGLYIGNNRF IHAPRTGKNI

251 EITSLSHKYW SGKYAFARRV KKNDPSRFLN * a225-1/m225-1 88.6% identity in 280 aa overlap 10         20         30         40         50         60
a225-1.pep  MDSFFKPAVWAVLWLMFAVRPALADELTNLLSSREQILRQFAEDEQPVLPINRXPARRAG
            |||||||||||||||||||||||||||||||||||||||||||||||||| ||||||
m225-1      MDSFFKPAVWAVLWLMFAVRPALADELTNLLSSREQILRQFAEDEQPVLPINRAPARRAG
                    10         20         30         40         50         60

70         80         90        100        110        120
a225-1.pep  NADELIGSAMGLNEQPVLPVNRXPARRAGNADXLIGNAMGLNEQPVLPVNRVPARRAGNA
            |||||||||||||||                              ||||||||||||||
m225-1      NADELIGSAMGLNEQP-----------------------------VLPVNRVPARRAGNA
                    70                                           80         90

130        140        150        160        170        180
a225-1.pep  DELIGNAMGLNEQPVLPVNRAPARRAGNADELIGNAMGLLGIAYRYGGTSISTGFDCSGF
            |||||||||||||||||||||||||||||||||||||||||||||||||:||||||||
m225-1      DELIGNAMGLNEQPVLPVNRAPARRAGNADELIGNAMGLLGIAYRYGGTSVSTGFDCSGF
                   100        110        120        130        140        150

190        200        210        220        230        240
a225-1.pep  MQHIFKRAMGINLPRTSAEQARMGTPVARSELQPGDMVXFRTLGGSRISHVGLYIGNNRF
            ||||||||||||||||||||||||||||||||||||||| ||||||||||||||||||||
m225-1      MQHIFKRAMGINLPRTSAEQARMGTPVARSELQPGDMVFFRTLGGSRISHVGLYIGNNRF
                   160        170        180        190        200        210

250        260        270        280
a225-1.pep  IHAPRTGKNIEITSLSHKYWSGKYAFARRVKKNDPSRFLNX
            ||||||||||||||||||||||||||||||||||||||||
m225-1      IHAPRTGKNIEITSLSHKYWSGKYAFARRVKKNDPSRFLNX
                   220        230        240        250
```

The following partial DNA sequence was identified in *N. gonorrhoeae* <SEQ ID 805>:

```
g226.seq
    1 ATGAGCGAAA TCCTCAGGCA GCCCAGCGTT CTGCTTTTCC TCACGCTTGC

51 CGTGTACGCG CTTGCGATTA TCGTGCGCAC GCGCACGGGC AATATCTTCT

101 GCAACCCCGT ACTCGTCAGC ACTATCGTGC TGATTGCCTA CCTGAAAATC

151 CTCGGTATCG ATTATGCGGT GTACCACAAC GCCGCGCAAT TCATTGATTT

201 TCGGCTGAAA cccGccgtCG TCGTGCTTGC CGTGCCGCTC TACCAAAACC

251 GCCGTAAAAT CTTCAACCAG TGGCTGCCCG TCATCGTTTC GCAGCTTGCG

301 GGCAGCGTTA cggGCATTGT tacggggATG TATTTTgccg cttggctcgg 351 gccggatacc caattctcct tcccgcctcg tcttcaatat ctgttattta 401 caccctctgg aatcccaatt cacaccctgt atgcgcgggt tctcccgcca 451 tttctgttgc ctccgcctct cctgccgcgc ctcggcccgc atacattgcg 501 ccggttcaca atacttccaa aaaaactacg gccgtttaag cccctcctcc 551 cagttgtggt cctttctcct Ccgggcctcg cccctccccct cttataa
```

This corresponds to the amino acid sequence <SEQ ID 806; ORF 226.ng>:

```
g226.pep
  1 MSEILRQPSV LLFLTLAVYA LAIIVRTRTG NIFCNPVLVS TIVLIAYLKI

51 LGIDYAVYHN AAQFIDFRLK PAVVVLAVPL YQNRRKIFNQ WLPVIVSQLA

101 GSVTGIVTGM YFAAWLGPDT QFSFPPRLQY LLFTPSGIPI HTLYARVLPP

151 FLLPPPLLPR LGPHTLRRFT ILPKKLRPFK PLLPVVVLSP PGLAPPLL*
```

The following partial DNA sequence was identified in *N. meningitidis* <SEQ ID 807>:

```
m226.seq
  1 ATGAACGAAA TCCTCAGGCA GCCCAGCGTT CTGCTTTTCC TCACGCTTGC

51 CGTGTACGCG CTTGCGATTA TCGtGCGCAC GCGCACGGGC AATATCTTCT

101 GCAACCCCGT ACTCGTCAGC ACTATCGTGC TGATTGCCTA CCTGAAAATC

151 CTCGGTATCG ATTATGCGGT GTACCACAAC GCCGCGCAAT TCATTGATTT

201 TTGGCTGAAA CCCGCCGTCG TCGTGCTTGC CGTGCCGCTC TACCAAAACC

251 GCCGTAAAAT CTTCAACCAG TGGCTGCCCG TCATCGTTTC ACAGCTTGCG

301 GGCAGCGTTA CGGGCATTGT TACAGGGATG TATTTTGCCA AATGGCTGGG

351 CGCGGAACGC GAAGTCGTCC TCTCGCTCGC GTCCAAATCT GTTACCAACC

401 CCATCGCTAT TGAAATCACC CGCTCCATCG GCGGCATTCC CGCCATTACC

451 GCCGCCACCG TCATCATTGC CGGTCTGGTC GGACAGATTG CCGGTTACAA

501 AATGCTGAAG AACACGGTCG TCATGCCCTC GTCCGTGGGT ATGTCGCTCG

551 GCACGGCTTC GCACGCGATG GGGATTGCCG CCTCGCTCGA ACGCAGCCGC

601 CGTATGGCGG CATACGCGGG GCTGGGGCTG ACGTTCAACG GCGTACTGAC

651 CGCGCTGATT GCGCCGCTGC TCATCCCCGT TTTGGGATTT TGA
```

This corresponds to the amino acid sequence <SEQ ID 808; ORF 226>:

```
m226.pep
  1 MNEILRQPSV LLFLTLAVYA LAIIVRTRTG NIFCNPVLVS TIVLIAYLKI

51 LGIDYAVYHN AAQFIDFWLK PAVVVLAVPL YQNRRKIFNQ WLPVIVSQLA

101 GSVTGIVTGM YFAKWLGAER EVVLSLASKS VTNPIAIEIT RSIGGIPAIT

151 AATVIIAGLV GQIAGYKMLK NTVVMPSSVG MSLGTASHAM GIAASLERSR

201 RMAAYAGLGL TFNGVLTALI APLLIPVLGF *
```

Computer analysis of this amino acid sequence gave the following results:

Homology with a Predicted ORF from *N. gonorrhoeae*
ORF 226 shows 94.2% identity over a 121 aa overlap with a predicted ORF (ORF 226.ng) from *N. gonorrhoeae*:

```
m226/g226

10         20         30         40         50         60
m226 pep MNEILRQPSVLLFLTLAVYALAIIVRTRTGNIFCNPVLVSTIVLIAYLKILGIDYAVYHN
         |:||||||||||||||||||||||||||||||||||||||||||||||||||||||||||
    g226 MSEILRQPSVLLFLTLAVYALAIIVRTRTGNIFCNPVLVSTIVLIAYLKILGIDYAVYHN
                  10         20         30         40         50         60
```

-continued

```
                 70        80        90       100       110       120
m226 pep AAQFIDFWLKPAVVVLAVPLYQNRRKIFNQWLPVIVSQLAGSVTGIVTGMYFAKWLGAER
         ||||||| ||||||||||||||||||||||||||||||||||||||||||||| ||| :
g226     AAQFIDFRLKPAVVVLAVPLYQNRRKIFNQWLPVIVSQLAGSVTGIVTGMYFAAWLGPDT
                 70        80        90       100       110       120

130       140       150       160       170       180
m226 pep EVVLSLASKSVTNPIAIEITRSIGGIPAITAATVIIAGLVGQIAGYKMLKNTVVMPSSVG
         :
g226     QFSFPPRLQYLLFTPSGIPIHTLYARVLPPFLLPPPLLPRLGPHTLRRFTILPKKLRPFK
                130       140       150       160       170       180
```

The following partial DNA sequence was identified in *N. meningitidis* <SEQ ID 809>:

```
a226.seq
  1 ATGAACGAAA TCCTCAGGCA GCCGAGCATC CTGCTTTTCC TCACGCTTGC

51 CGTGTACGCG CTTGCGATTA TCGTGCGCAC GCGCACGGGT AATATCTTCT

101 GCAACCCCGT ACTCGTCAGC ACTATCGTGC TGATTGCCTA CCTGAAAATC

151 CTCGGTATCG ATTATGCGGT GTACCACAAC GCCGCGCAGT TTATCGATTT

201 CTGGCTCAAG CCCGCCGTCG TCGTGCTTGC CGTGCCGCTC TACCAAAACC

251 GCCGTAAAAT CTTCAACCAA TGGCTGCCCG TCATCGTTTC GCAGCTTGCG

301 GGCAGCGTTA CGGGCATTGT TACGGGGATG TATTTTGCCA AATGGCTGGG

351 CGCGGAACGC GAAGTCGTCC TCTCGCTCGC GTCCAAATCT GTTACCAATC

401 CTATCGCCAT CGAAATCACC CGCTCCATCG GCGGCATTCC CGCCATTACC

451 GCCGCCACCG TCATCATTGC CGGCCTGGTC GGACAGATTG CCGGTTACAA

501 AATGTTGAAA AACACGGTCG TTATGCCCTC ATCTGTCGGA ATGTCGCTCG

551 GCACGGCTTC GCACGCGATG GGCATTGCCG CCTCGCTCGA ACGCAGCCGC

601 CGCATGGCGG CATACGCGGG GCTGGGGCTG ACGTTCAACG GCGTACTGAC

651 CGCGCTGATT GCGCCGCTGC TTATCCCCGT TTTGGGATTT TGA
```

This corresponds to the amino acid sequence <SEQ ID 810; ORF 226.a>:

```
a226.pep
  1 MNEILRQPSI LLFLTLAVYA LAIIVRTRTG NIFCNPVLVS TIVLIAYLKI

51 LGIDYAVYHN AAQFIDFWLK PAVVVLAVPL YQNRRKIFNQ WLPVIVSQLA

101 GSVTGIVTGM YFAKWLGAER EVVLSLASKS VTNPIAIEIT RSIGGIPAIT

151 AATVIIAGLV GQIAGYKMLK NTVVMPSSVG MSLGTASHAM GIAASLERSR

201 RMAAYAGLGL TFNGVLTALI APLLIPVLGF *
``` m226/a226 99.6% identity in 230 aa overlap

```
                 10        20        30        40        50        60
m226.pep MNEILRQPSVLLFLTLAVYALAIIVRTRTGNIFCNPVLVSTIVLIAYLKILGIDYAVYHN
         |||||||||:||||||||||||||||||||||||||||||||||||||||||||||||||
a226     MNEILRQPSILLFLTLAVYALAIIVRTRTGNIFCNPVLVSTIVLIAYLKILGIDYAVYHN
                 10        20        30        40        50        60

70        80        90       100       110       120
m226.pep AAQFIDFWLKPAVVVLAVPLYQNRRKIFNQWLPVIVSQLAGSVTGIVTGMYFAKWLGAER
         ||||||||||||||||||||||||||||||||||||||||||||||||||||||||||||
a226     AAQFIDFWLKPAVVVLAVPLYQNRRKIFNQWLPVIVSQLAGSVTGIVTGMYFAKWLGAER
                 70        80        90       100       110       120
```

-continued

```
                    130        140        150        160        170        180
    m226.pep EVVLSLASKSVTNPIAIEITRSIGGIPAITAATVIIAGLVGQIAGYKMLKNTVVMPSSVG
             ||||||||||||||||||||||||||||||||||||||||||||||||||||||||||||
    a226     EVVLSLASKSVTNPIAIEITRSIGGIPAITAATVIIAGLVGQIAGYKMLKNTVVMPSSVG
                    130        140        150        160        170        180

190        200        210        220        230
    m226.pep MSLGTASHAMGIAASLERSRRMAAYAGLGLTFNGVLTALIAPLLIPVLGFX
             |||||||||||||||||||||||||||||||||||||||||||||||||||
    a226     MSLGTASHAMGIAASLERSRRMAAYAGLGLTFNGVLTALIAPLLIPVLGFX
                    190        200        210        220        230
```

The following partial DNA sequence was identified in *N. gonorrhoeae* <SEQ ID 811>:

```
g227.seq
  1 atgaacatca tccgcgcgct cctcatcatc ctcggctgcc tcgccgccgg 51 cgaaaccgcc gttttcctag caggcatcaa actgcccggc agcatcgtcg 101 gcatgggcgt gctgtttgcg cttttgcagg cgggttggct caaaacgtct 151 tggctgcaac agcttaccga cgcgctgatg gcaaacctga cgctgttcct 201 cgtgccgccc tgcgtggcgg tcatcagcta tttggatttg attgccgacg 251 attggttttc gatactggtt tccgcctccg ccagcacttt gtgcgtactg 301 ctggttacgg gcaaggttca ccgctggata cggagcatta tctga
```
                                                                30

This corresponds to the amino acid sequence <SEQ ID 812; ORF 227.ng>:

```
g227.pep
  1 MNIIRALLII LGCLAAGETA VFLAGIKLPG SIVGMGVLFA LLQAGWLKTS

51 WLQQLTDALM ANLTLFLVPP CVAVISYLDL IADDWFSILV SASASTLCVL

101 LVTGKVHRWI RSII*
```

The following partial DNA sequence was identified in *N. meningitidis* <SEQ ID 813>:

```
m227.seq (partial)
  1 ..ACGTCTTkGC TGCAACAGCT TACCGACGCG CTGATGTCGA ACCTGACGCT 51    GTtCCTCGTG CCgCC.TGCG TGGCGGTCAT CAGCTATTTG GATTTGATTG 101    CCGACGATTG GTTTTCGATA CTGGTTTCCG CCTCCGCCAG cACTTTGTGC

151    GTACTGCTGG TTACGGGCAA AGTCCACCGG TGGATACGGG GTATTATCCG

201    ATGA
```
                                                                55

This corresponds to the amino acid sequence <SEQ ID 814; ORF 227>:

```
m227.pep (partial)
  1 ..TSXLQQLTDA LMSNLTLFLV PPCVAVISYL DLIADDWFSI LVSASASTLC

51    VLLVTGKVHR WIRGIIR*
```

Computer analysis of this amino acid sequence gave the following results:

Homology with a Predicted ORF from *N. gonorrhoeae*

ORF 227 shows 95.5% identity over a 66 aa overlap with a predicted ORF (ORF 227.ng) from *N. gonorrhoeae*:

```
m227/g227

10        20        30
    m227.pep                    TSXLQQLTDALMSNLTLFLVPPCVAVISYL
                                || |||||||||:|||||||||||||||||
    g227     TAVFLAGIKLPGSIVGMGVLFALLQAGWLKTSWLQQLTDALMANLTLFLVPPCVAVISYL
              20        30        40        50        60        70        60
                          40        50        60
    m227.pep DLIADDWFSILVSASASTLCVLLVTGKVHRWIRGIIRX
             ||||||||||||||||||||||||||||||||||:|||
    g227     DLIADDWFSILVSASASTLCVLLVTGKVHRWIRSIIX
              80        90       100       110
```

The following partial DNA sequence was identified in *N. meningitidis* <SEQ ID 815>:

```
a227.seq
   1 ATGAACATCA TCCGCGCGCT CCTCATCATC CTCGGCTGCC TCGCCACCGG

51 CGAAACCGCC GTTTTCCTAG CAGGCATCAA ACTGCCCGGC AGCATCGTCG

101 GCATGGGCGT ACTGTTTGCG CTTTTGCAGG CGGGTTGGGT CAAAACGTCT

151 TGGCTGCAAC AGCTTACCGA CGCGCTGATG GCGAATCTGA CGTTGTTTCT

201 CGTGCCGCCC TGCGTGGCGG TCATCAGCTA TTTGGATTTG ATTGCCGACG

251 ATTGGTTTTC GATACTGGTT TCCGCCTCCG CCAGCACTTT GTGCGTACTG

301 CTGGTTACAG GCAAGGTTCA CCGCTGGATA CGGAGCATTA TCTGA
```

This corresponds to the amino acid sequence <SEQ ID 816; ORF 227.a>:

```
a227.pep
   1 MNIIRALLII LGCLATGETA VFLAGIKLPG SIVGMGVLFA LLQAGWVKTS

51 WLQQLTDALM ANLTLFLVPP CVAVISYLDL IADDWFSILV SASASTLCVL

101 LVTGKVHRWI RSII*
``` m227/a227 95.5% identity in 66 aa overlap

```
                                        10        20        30
    m227.pep                    TSXLQQLTDALMSNLTLFLVPPCVAVISYL
                                || |||||||||:|||||||||||||||||
    a227     TAVFLAGIKLPGSIVGMGVLFALLQAGWVKTSWLQQLTDALMANLTLFLVPPCVAVISYL
              20        30        40        50        60        70        60
                          40        50        60
    m227.pep DLIADDWFSILVSASASTLCVLLVTGKVHRWIRGIIRX
             ||||||||||||||||||||||||||||||||||:||
    a227     DLIADDWFSILVSASASTLCVLLVTGKVHRWIRSIIX
              80        90       100       110
```

The following partial DNA sequence was identified in *N. meningitidis* <SEQ ID 817>:

```
m228.seq
   1 ATGAAAAAAT TATTGATTGC CGCAATGATG GCGGCTGCCT TGGCAGCTTG

51 TTCGCAAGAA GCCAAACAGG AGGTTAAGGA AGCGGTTCAA GCCGTTGAGT
```

-continued
```
101 CCGATGTTAA AGACACTGCG GCTTCTGCCG CCGAGTCTGC CGCTTCTGCC

151 GTCGAAGAAG CGAAAGACCA AGTCAAAGAT GCTGCGGCTG ATGCAAAGGC

201 AAGTGCCGAG GAAGCTGTAA CTGAAGCCAA AGAAGCTGTA ACTGAAGCAG

251 CTAAAGATAC TTTGAACAAA GCTGCCGACG CGACTCAGGA AGCGGCAGAC

301 AAAATGAAAG ATGCCGCCAA ATAA
```

This corresponds to the amino acid sequence <SEQ ID 818; ORF 228>:

```
m228.pep
  1 MKKLLIAAMM AAALAACSQE AKQEVKEAVQ AVESDVKDTA ASAAESAASA

51 VEEAKDQVKD AAADAKASAE EAVTEAKEAV TEAAKDTLNK AADATQEAAD

101 KMKDAAK*
```

Computer analysis of this amino acid sequence gave the following results:

The following partial DNA sequence was identified in N. meningitidis <SEQ ID 819>:

```
a228.seq
  1 ATGAAAAAAT TATTGATTGC CGCAATGATG GCGGCTGCCT TGGCAGCTTG

51 TTCGCAAGAA GCCAAACAGG AGGTTAAGGA AGCGGTTCAA GCCGTTGAGT

101 CCGATGTTAA AGACACTGCG GCTTCTGCCG CCGAGTCTGC CGCTTCTGCC

151 GTCGAAGAAG CGAAAGACCA AGTCAAAGAT GCTGCGGCTG ATGCAAAGGC

201 AAGTGCCGAG GAAGCTGTAA CTGAAGCCAA AGAAGCTGTA ACTGAAGCAG

251 CTAAAGATAC TTTGAACAAA GCTGCCGACG CGACTCAGGA AGCGGCAGAC

301 AAAATGAAAG ATGCCGCCAA ATAA
```

This corresponds to the amino acid sequence <SEQ ID 820; ORF 228.a>:

```
a228.pep
  1 MKKLLIAAMM AAALAACSQE AKQEVKEAVQ AVESDVKDTA ASAAESAASA

51 VEEAKDQVKD AAADAKASAE EAVTEAKEAV TEAAKDTLNK AADATQEAAD

101 KMKDAAK*
``` m228/a228 100.0% identity in 107 aa overlap

```
                  10        20        30        40        50        60
    m228.pep  MKKLLIAAMMAAALAACSQEAKQEVKEAVQAVESDVKDTAASAAESAASAVEEAKDQVKD
              ||||||||||||||||||||||||||||||||||||||||||||||||||||||||||||
    a228      MKKLLIAAMMAAALAACSQEAKQEVKEAVQAVESDVKDTAASAAESAASAVEEAKDQVKD
                  10        20        30        40        50        60

70        80        90       100
    m228.pep  AAADAKASAEEAVTEAKEAVTEAAKDTLNKAADATQEAADKMKDAAKX
              ||||||||||||||||||||||||||||||||||||||||||||||||
    a228      AAADAKASAEEAVTEAKEAVTEAAKDTLNKAADATQEAADKMKDAAKX
                  70        80        90       100
```

The following partial DNA sequence was identified in N. gonorrhoeae <SEQ ID 821>:

```
g229.seq
  1 atggctgccg tatcgggcgg cggtgcggtc ttcctgataa tgcttccaca 51 tattgcccgc gttcagcgtc agccgccagc gttcgcccaa gcgtcgggag
```

-continued

```
101 aaatcggcat tgaagccgcc ggcgaaattg tatcggctgc cgcccaagag 151 gttttgcccg acaaacggca cggtgccgaa cgagcgcgtt accgaacggt 201 tttgatggcc gaacgacagg cgcaggttct gttcgctgaa atctttgtta 251 tcccaataat gcacgccgcg gctgatgccg ccgtagagga aatgatgccc 301 gcccgcattg atttcgcgcg acacgcccaa gccgtagcgc aaaccgtgtg 351 ccttttgcgg caggctgtcg gcggttttcg tccagcttct gcccgcaaat 401 tcaatcgttt tttcggacga agcgttgttt atagcggatt aacaaaaatc 451 aggacaaggc ggcgggccgc aggcagtacg gatggtacgg aaccggttcg 501 cccggtgctt ggacgcctta gggaaccgtt ccctttgagc cggggcgggg 551 caacccgtac cggttttttgt tcatccgcca tattgtgttg a
```

This corresponds to the amino acid sequence <SEQ ID 822; ORF 229.ng>:

```
g229.pep
  1 MAAVSGGGAV FLIMLPHIAR VQRQPPAFAQ ASGEIGIEAA GEIVSAAAQE

51 VLPDKRHGAE RARYRTVLMA ERQAQVLFAE IFVIPIMHAA ADAAVEEMMP

101 ARIDFARHAQ AVAQTVCLLR QAVGGFRPAS ARKFNRFFGR SVVYSGLTKI

151 RTRRRAAGST DGTEPVRPVL GRLREPFPLS RGGATRTGFC SSAILC*
```

The following partial DNA sequence was identified in *N. meningitidis* <SEQ ID 823>:

```
m229.seq (partial)
  1 ..GCTCAAGCGT TGGGAGAAAT CGGCATTGAA GCCGCCGACG AAATTGTATC

51    GGCTGCCGCC TAAGAGGTTT TGCTCGACAA ACGGCACGAT GCCGAACGAG

101    CGCGTTACCG AACGGTTTTT ATAGCCGAAC GACAGGCGCA GGCTCTGTTC

151    GCTGAAATCT TTGTTATCCC AATAATGCAC GCCGCCGCCG CTGATGCCGC

201    CGTAGAGGAA ATGATGCCTG CCCGCATTGA TTTCGCGCGA CACGCCTAAG

251    CCCTAGCGCA AACCGTGTGC CTTTTGCGGC AGGCTGTCGG CGGTTTTCGT

301    CCAGCTTCTG CCCGCAAATT CAATCGTTTT TTCGGACGAA GCGTTGTTTA

351    TAGCGGATTA ACAAAAATCA GGACAAGGCA ACGAAGCCGC AGACAGTACA

401    AATAGTACGG AACCGATTCA CTTGGTGCTT CAGCACcTTA GAGAATCGTT

451    CTCTTTTTTG TTCATCCGCT ATATTGTGTT GA
```

This corresponds to the amino acid sequence <SEQ ID 824; ORF 229>:

```
m229.pep (partial)
  1 ..AQALGEIGIE AADEIVSAAA XEVLLDKRHD AERARYRTVF IAERQAQALF

51    AEIFVIPIMH AAAADAAVEE MMPARIDFAR HAXALAQTVC LLRQAVGGFR

101    PASARKFNRF FGRSVVYSGL TKIRTRQRSA DSTNSTEPIH LVLQHLRESR

151    SLFCSSAILC *
```

Computer analysis of this amino acid sequence gave the following results:
Homology with a Predicted ORF from *N. gonorrhoeae*
ORF 229 shows 80.5% identity over a 169 aa overlap with a predicted ORF (ORF 229.ng) from *N. gonorrhoeae*:

```
m229/g209

10        20        30
    m229.pep                AQALGEIGIEAADEIVSAAAXEVLLDKRHDAE
                            ||| |||||||| |||||| ||| |||| ||
    g229        MAAVSGGGAVFLIMLPHIARVQRQPPAFAQASGEIGIEAAGEIVSAAAQEVLPDKRHGAE
                        10        20        30        40        50        60

40        50        60        70        80        90
    m229.pep    RARYRTVFIAERQAQALFAEIFVIPIMHAAAADAAVEEMMPARIDFARHAXALAQTVCLL
                ||||||| ::||||||:||||||||||||||| ||||||||||||||||| |:||||||
    g229        RARYRTVLMAERQAQVLFAEIFVIPIMHAAA-DAAVEEMMPARIDFARHAQAVAQTVCLL
                        70        80        90       100       110

100       110       120       130       140
    m229.pep    RQAVGGFRPASARKFNRFFGRSVVYSGLTKIRTRQRSADSTNSTEPIHLVLQHLRE----
                |||||||||||||||||||||||||||||||||||:|:| ||::|||:: || :|||
    g229        RQAVGGFRPASARKFNRFFGRSVVYSGLTKIRTRRRAAGSTDGTEPVRPVLGRLREPFPL
                       120       130       140       150       160       170

150       160
    m229.pep    -----SRSLFCSSAILCX
                    :|: |||||||||
    g229        SRGGATRTGFCSSAILC
                       180       190
```

The following partial DNA sequence was identified in *N. meningitidis* <SEQ ID 825>:

```
a229.seq (partial)
  1 ATGGCTGTCG TATCGGGCGG CGGTGCGGTC TTCCTGATAA CGCTTCCACA

51 TATTGCCCAC GTTCAGCGTC AGCCGCCA.. GTTCGCTCAA GCGTCGGGAG

101 AAATCGGCAT TGAAGCCGCC GACGAAATTG TATCGGCTGC CGCCTAAGAG

151 GTTTTGCTCG ATAAACGGCA CGATGCCGAA TGAGCGCGTT ACTGAACGGT

201 TTTTATAGCC GAGCGACAGG CGCAGGCTCT GTTCGCTGAA ATCTTTGTTA

251 TCCTAATAGT GCACGCCGCC GCCGCTGATG TCTCCGTAGA GGAAATGATG

301 CCCGCCCGCA TTGATTTCGC GCGACACGCC CAAGCCGTAG CGCAAACCGT

351 GTGCCTTTTG CGGCAGGCTG TCGGCGGTTT TCGTCCAGCT TCTGCCTGCA

401 AATTCAATCG TTTTTTCGGA CGAAGCGTTG TTTATAGCGG ATTAACAAAA

451 ATCAGGACAA GGCGACGAAG CGCAGACAGT ACAGATAGTA CGGAACCGAT

501 TCACTTGGTG CTTCAGCACC TTAGAGAATC GTCTCTTTGA GCTAAGGCGA

551 GGCAACGCCG TACTGGTTTT TGTTCATCCA CTATA
```

This corresponds to the amino acid sequence <SEQ ID 826; ORF 229.a>:

```
a229.pep (partial)
  1 MAVVSGGGAV FLITLPHIAH VQRQPPXFAQ ASGEIGIEAA DEIVSAAA*E

51 VLLDKRHDAE *ARY*TVFIA ERQAQALFAE IFVILIVHAA AADVSVEEMM

101 PARIDFARHA QAVAQTVCLL RQAVGGFRPA SACKFNRFFG RSVVYSGLTK

151 IRTRRRSADS TDSTEPIHLV LQHLRESSL* AKARQRRTGF CSSTI
``` m229/a229 85.6% identity in 167 aa overlap

```
                          10        20        30
m229.pep                  AQALCEICIEAADEIVSAAAXEVLLDKRHDAE
                          |||  |||||||||||||||||||||||||||
a229      MAVVSGGGAVFLITLPHIAHVQRQPPXFAQASGEIGIEAADEIVSAAAXEVLLDKRHDAE
                  10        20        30        40        50        60

40        50        60        70        80
m229.pep  RARYRTVFIAERQAQALFAEIFVIPIMHAAAADAAVEEMMPARIDFARHAXALAQTVCLL
          ||| ||||||||||||||||||||| :|||||::||||||||||||||||| :|||||
a229      XARYXTVFIAERQAQALFAEIFVILIVHAAAADVSVEEMMPARIDFARHAQAVAQTVCLL
                  70        80        90       100       110       120

100       110       120       130       140       149
m229.pep  RQAVGGFRPASARKFNRFFGRSVVYSGLTKIRTRQRSADSTNSTEPIHLVLQHLRES---
          |||||||||||| ||||||||||||||||||||| :|||||:|||||||||||||
a229      RQAVGGFRPASACKFNRFFGRSVVYSGLTKIRTRRRSADSTDSTEPIHLVLQHLRESSLX
                 130       140       150       160       170       180

150       160
m229.pep  ------RSLFCSSAILCX
                |: ||||:|
a229      AKARQRRTGFCSSTI
                 190
```

The following partial DNA sequence was identified in *N. gonorrhoeae* <SEQ ID 827>:

```
g230.seq
    1 atgttccatt ccatcgaaaa atacagaaca cccgcccaag tcttattagg 51 cctgattgca ttaactttg tcggcttcgg cgtcagcacg gtttcccatc 101 cgggcgccga ctacatcgtc caagtgggcg acgaaaaaat cagcgagcac 151 tcaatcaaca acgccatgca gaacgagcag gcggacggcg gcagcccttg 201 gcgcgacgcg gtgttccaat ccctgctgca acgcgcctac ctgaaacagg 251 gcgcgaagct gatgggcatt tcggtttctt ccgaacaaat caagcagatg 301 attgtggacg atcccaattt ccacgacgca aacggcaaat tcagtcacgc 351 gcttttgagt caatacctgt cgcaacgcca tatgtctgaa gaccagtttg 401 tcgaagaaat ccgcgatcag tttgccttgc agaatttggt aagcctcgtc 451 caaaacggcg tattggtcgg cgacgcgcag gcggaacagc tgatcaggct 501 gacgcaggtc aaccgcacca tccgttcgca cactttcaac cccgacgagt 551 tcatcgccca agtcaaagcg tctgaagccg atttgcagaa atttataat 601 gcgaacaaaa aagactatct gctgccgcag gcggtcaaat tggaatatgt 651 cgccttgaat ctgaaggatt ttgcagacaa gcagaccgtc agtgaaacgg 701 aagtgaaaaa tgcgtttgaa gagcgcgtgg cgcgtttgcc ggcacatgaa 751 gccaaaccct ctttcgagca ggaaaaagcc gccgtcgaaa acgaattgaa 801 aatgaaaaag gcggttgccg acttcaacaa ggcaaaagaa aagctgggcg 851 acgatgcgtt caatcatccc tcctcgcttg ccgaagccgc caaaaacagc 901 ggtttgaaag tggaaaccca agaaacttgg ctgagcaggc aggacgcaca 951 aatgtccggc atgcccgaaa acctaatcaa tgccgtattc agcgacgacg 1001 tattgaagaa aaaacacaat tccgaagtgc tgaccatcaa cagcgaaacc 1051 gcgtgggtcg tccgcgccaa agaagtccgc gaagaaaaaa acctactgtt 1101 tgaagaagcc aaagatgcgg tgcgtcaggc ctatatccgt accgaagccg 1151 ccaaactttt gaaaacaatg taa
```

This corresponds to the amino acid sequence <SEQ ID 828; ORF 230.ng>:

```
g230.pep
    1 MFHSIEKYRT PAQVLLGLIA LTFVGFGVST VSHPGADYIV QVGDEKISEH

51 SINNAMQNEQ ADGGSPWRDA VFQSLLQRAY LKQGAKLMGI SVSSEQIKQM

101 IVDDPNFHDA NGKFSHALLS QYLSQRHMSE DQFVEEIRDQ FALQNLVSLV

151 QNGVLVGDAQ AEQLIRLTQV NRTIRSHTFN PDEFIAQVKA SEADLQKFYN

201 ANKKDYLLPQ AVKLEYVALN LKDFADKQTV SETEVKNAFE ERVARLPAHE

251 AKPSFEQEKA AVENELKMKK AVADFNKAKE KLGDDAFNHP SSLAEAAKNS

301 GLKVETQETW LSRQDAQMSG MPENLINAVF SDDVLKKKHN SEVLTINSET

351 AWVVRAKEVR EEKNLLFEEA KDAVRQAYIR TEAAKLLKTM *
```

The following partial DNA sequence was identified in *N. meningitidis* <SEQ ID 829>:

```
m230.seq (partial)
    1 ATGTTCCATT CCATCGAAAA ATACAGAACG CCCGCCCAAG TCCTTTTGGG

51 CCTGATTGCA TTAACCTTCG TCGGCTTCGG GGTCAGCACG GTATCCCATC

101 CGGGTGCCGA CTACATCGTC CAAGTGGGCG ACGAAAAAaT CAGCGACCAC

151 TCCATCAACA ACGCCATACA GAACGAACAG GCGGACGGCG GCGGCCCTTC

201 GCc.GACGCG GTGTTCCAAT CCCTGCTGCA ACGCGCCTAC CTGAAACAGG

251 GCGCGAAGCT GATGGGCATT TCGGTTTCTT CCGAACAAAT CAAGCAAATT

301 ATCGTGGACG ATCCCAATTT CCACGACGCA AACGGCAAAT TCGACCACGC

351 GCTTTTAAAC CGCTACCTTT CCCAACGCCA TATGTCTGAA GACCAGTTTG

401 TCGAAGAAAT CCGCGATCAG TTTGCCTTGC AGAATTTGGT AAACCTCGTC

451 CAAAACGGCG TATTGGTCGG CGACGCGCAG GCGGAACAGC TGATCAGGCT

501 GACACAGGTC AACCGCACCA TCCGTTCGCA CACTTTCAAC CCCGACGAGT

551 TCATCGCCCA AGTCAAAGTG TCTGAAGCCG ATTTGCAGAA ATTTTATAAT

601 GCGAACAAAA AAGACTATCT GCTGCCGCAG gCGGTCAAAT TGGAATATGT

651 CGCCTTGAAT CTGAAGGATT TTGCAGACAA GCAGACCGTC AGTGAAACGg

701 AAGTGAAAAA TGCATTTGAA GAGCGCGTGG CGCGTTTGCC GGCAAATGAA

751 GCCAAACCTT CTTTCGAGCA GGAAAAAGCC GCCGTCGAAA ACGAATTGAA

801 AATGAAAAAG GCGGTTGCCG ACTTCAACAA GGCAAAAGAA AAATTGGGCG

851 ACGATGC.GT cAACCATCCT TCyTCGCTTG CCGAAGCCGC CAAAAACAGC

901 GGTTTGAAAG TCGAAACCCA AGAAACTTGG CTGAGTAGGC AGGACGCGCA

951 AATGTCCGGT ATGCCCGAAA ACCTGATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAGAAAA CCCTGCCGTT

1101 TGCCGAAGCC AAAGACGCGG TACGTCAGGC TTATATCCGT ACCGAAGCCG

1151 CCAAACTT.. ...
```

This corresponds to the amino acid sequence <SEQ ID 830; ORF 230>:

```
m230.pep (partial)
    1 MFHSIEKYRT PAQVLLGLIA LTFVGFGVST VSHPGADYIV QVGDEKISDH

51 SINNAIQNEQ ADGGGPSPDA VFQSLLQRAY LKQGAKLMGI SVSSEQIKQI

101 IVDDPNFHDA NGKFDHALLN RYLSQRHMSE DQFVEEIRDQ FALQNLVNLV

151 QNGVLVGDAQ AEQLIRLTQV NRTIRSHTFN PDEFIAQVKV SEADLQKFYN

201 ANKKDYLLPQ AVKLEYVALN LKDFADKQTV SETEVKNAFE ERVARLPANE

251 AKPSFEQEKA AVENELKMKK AVADFNKAKE KLGDDAVNHP SSLAEAAKNS

301 GLKVETQETW LSRQDAQMSG MPENLINAVF SDDVLKKKHN SEVLTINSET

351 AWVVRAKEVR EEKTLPFAEA KDAVRQAYIR TEAAKL....
```

Computer analysis of this amino acid sequence gave the following results:

Homology with a Predicted ORF from *N. gonorrhoeae*

ORF 230 shows 95.9% identity over a 386 aa overlap with a predicted ORF (ORF 230.ng) from *N. gonorrhoeae*:

```
   m230/g230
                       10         20         30         40         50         60
       m230.pep  MFHSIEKYRTPAQVLLGLIALTFVGFGVSTVSHPGADYIVQVGDEKISDHSINNAIQNEQ
                 |||||||||||||||||||||||||||||||||||||||||||||||:||||||:||||
       g230      MFHSIEKYRTPAQVLLGLIALTFVGFGVSTVSHPGADYIVQVGDEKISEHSINNAMQNEQ
                       10         20         30         40         50         60

70         80         90        100        110        120
       m230.pep  ADGGGPSPDAVFQSLLQRAYLKQGAKLMGISVSSEQIKQIIVDDPNFHDANGKFDHALLN
                 ||||:| |||||||||||||||||||||||||||||||:|||||||||||||||:||||:
       g230      ADGGSPWRDAVFQSLLQRAYLKQGAKLMGISVSSEQIKQMIVDDPNFHDANGKFSHALLS
                       70         80         90        100        110        120

130        140        150        160        170        180
       m230.pep  RYLSQRHMSEDQFVEEIRDQFALQNLVNLVQNGVLVGDAQAEQLIRLTQVNRTIRSHTFN
                 :|||||||||||||||||||||||||||:|||||||||||||||||||||||||||||||
       g230      QYLSQRHMSEDQFVEEIRDQFALQNLVSLVQNGVLVGDAQAEQLIRLTQVNRTIRSHTFN
                      130        140        150        160        170        180

190        200        210        220        230        240
       m230.pep  PDEFIAQVKVSEADLQKFYNANKKDYLLPQAVKLEYVALNLKDFADKQTVSETEVKNAFE
                 ||||||||:|||||||||||||||||||||||||||||||||||||||||||||||||||
       g230      PDEFIAQVKASEADLQKFYNANKKDYLLPQAVKLEYVALNLKDFADKQTVSETEVKNAFE
                      190        200        210        220        230        240

250        260        270        280        290        300
       m230.pep  ERVARLPANEAKPSFEQEKAAVENELKMKKAVADFNKAKEKLGDDAVNHPSSLAEAAKNS
                 ||||||||:||||||||||||||||||||||||||||||||||||| ||||||||||||
       g230      ERVARLPAHEAKPSFEQEKAAVENELKMKKAVADFNKAKEKLGDDAFNHPSSLAEAAKNS
                      250        260        270        280        290        300

310        320        330        340        350        360
       m230.pep  GLKVETQETWLSRQDAQMSGMPENLINAVFSDDVLKKKHNSEVLTINSETAWVVRAKEVR
                 ||||||||||||||||||||||||||||||||||||||||||||||||||||||||||||
       g230      GLKVETQETWLSRQDAQMSGMPENLINAVFSDDVLKKKHNSEVLTINSETAWVVRAKEVR
                      310        320        330        340        350        360

370        380
       m230.pep  EEKTLPFAEAKDAVRQAYIRTEAAKL
                 |||:| |||||||||||||||||||
       g230      EEKNLLFEEAKDAVRQAYIRTEAAKLLKTM
                      370        380        390
```

The following partial DNA sequence was identified in *N. meningitidis* <SEQ ID 831>:

```
a230.seq (partial)
    1 ATGTTCCATT CCATCGAAAA ATACAGAACG CCCGCCCAAG TCCTTTTGGG

51 CCTGATTGCA TTAACCTTCG TCGGCTTCGG GGTCAGCACG GTATCCCATC

101 CGGGTGCCGA CTACATCGTC CAAGTGGGCG ACGAAAAAAT CAGCGACCAC
```

```
-continued
 151 TCCATCAACA ACGCCATACA GAACGAACAG GCGGACGGCG GCGGCCCTTC

201 GCGCGACGCG GTGTTCCAAT CCCTGCTACA ACGCGCCTAC CTGAAACAGG

251 GCGCGAAGCT GATGGGCATT TCGGTTTCTT CCGAACAAAT CAAGCAGATT

301 ATCGTGGACG ATCCCAATTT CCACGACGCA AACGGCAAAT TCGACCACGC

351 GCTTTTAAAC CGCTACCTTT CCCAACGTCA TATGTCTGAA GACCAGTTTG

401 TCGAAGAAAT CCGCGATCAG TTTGCCTTGC AGAATTTGGT AAACCTCGTC

451 CAAAACGGCG TATTGGTCGG CGACGCGCAG GCGGAACAGC TGATCAGGCT

501 GACGCAGGTC AACCGCACCA TCCGTTCGCA CACTTTCAAC CCCGACGAAT

551 TCATCGCCCA AGTCAAAGTG TCTGAAGCCG ATTTGCAGAA GTTTTATAAC

601 GCAAACAAAA AAGACTACCT GCTTCCCAAA GCGGTCAAAT TGGAATATGT

651 CGCCTTGAAT CTGAAAGACT TTGCAGACAA ACAGACCGTC AGCGAAACAG

701 AAGTGAAAAA TGCGTTTGAA GAGCGCGTGG CGCGTTTGCC GGCAAATGAA

751 GCCAAACCTT CTTTCGAGCA GGAAAAAGCC GCCGTCGAAA ACGAATTGAA

801 AATGAAAAAG GCGGTTGCCG ACTTCAATAA GGCAAAAGAA AAGCTGGGCG

851 ATGACGCGTT CAACCATCCT TCCTCGCTTG CCGAAGCCGC CAAAAACAGC

901 GGTTTGAAAG TCGAAACCCA AGAAACTTGG CTGAGCAGGC AGGATGCGCA

951 AATGTCCGGT ATGCCCGAAA ACCTGATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAGAAAA CCCTGCCGTT

1101 TGCCGAAGCC AAAGACGCGG TACGTCAGGC TTATATCCGT ACCGAAGCCG

1151 CCAAACTT
                                                          35
```

This corresponds to the amino acid sequence <SEQ ID 832; ORF 230.a>:

```
a230.pep (partial)
   1 MFHSIEKYRT PAQVLLGLIA LTFVGFGVST VSHPGADYIV QVGDEKISDH

51 SINNAIQNEQ ADGGGPSRDA VFQSLLQRAY LKQGAKLMGI SVSSEQIKQI

101 IVDDPNFHDA NGKFDHALLN RYLSQRHMSE DQFVEEIRDQ FALQNLVNLV

151 QNGVLVGDAQ AEQLIRLTQV NRTIRSHTFN PDEFIAQVKV SEADLQKFYN

201 ANKKDYLLPK AVKLEYVALN LKDFADKQTV SETEVKNAFE ERVARLPANE

251 AKPSFEQEKA AVENELKMKK AVADFNKAKE KLGDDAFNHP SSLAEAAKNS

301 GLKVETQETW LSRQDAQMSG MPENLINAVF SDDVLKKKHN SEVLTINSET

351 AWVVRAKEVR EEKTLPFAEA KDAVRQAYIR TEAAKL
``` m230/a230 99.2% identity in 386 aa overlap

```
                  10         20         30         40         50         60
    m230.pep  MFHSIEKYRTPAQVLLGLIALTFVGFGVSTVSHPGADYIVQVGDEKISDHSINNAIQNEQ
              ||||||||||||||||||||||||||||||||||||||||||||||||||||||||||||
        A230  MFHSIEKYRTPAQVLLGLIALTFVGFGVSTVSHPGADYIVQVGDEKISDHSINNAIQNEQ
                  10         20         30         40         50         60

70         80         90        100        110        120
    m230.pep  ADGGGPSPDAVFQSLLQRAYLKQGAKLMGISVSSEQIKQIIVDDPNFHDANGKFDHALLN
              ||||||| ||||||||||||||||||||||||||||||||||||||||||||||||||||
        a230  ADGGGPSRDAVFQSLLQRAYLKQGAKLMGISVSSEQIKQIIVDDPNFHDANGKFDHALLN
                  70         80         90        100        110        120
```

```
                     130        140        150        160        170        180
m230.pep    RYLSQRHMSEDQFVEEIRDQFALQNLVNLVQNGVLVGDAQAEQLIRLTQVNRTIRSHTFN
            ||||||||||||||||||||||||||||||||||||||||||||||||||||||||||||
a230        RYLSQRHMSEDQFVEEIRDQFALQNLVNLVQNGVLVGDAQAEQLIRLTQVNRTIRSHTFN
                     130        140        150        160        170        180

190        200        210        220        230        240
m230.pep    PDEFIAQVKVSEADLQKFYNANKKDYLLPQAVKLEYVALNLKDFADKQTVSETEVKNAFE
            ||||||||||||||||||||||||||||||:|||||||||||||||||||||||||||||
a230        PDEFIAQVKVSEADLQKFYNANKKDYLLPKAVKLEYVALNLKDFADKQTVSETEVKNAFE
                     190        200        210        220        230        240

250        260        270        280        290        300
m230.pep    ERVARLPANEAKPSFEQEKAAVENELKMKKAVADFNKAKEKLGDDAVNHPSSLAEAAKNS
            |||||||||||||||||||||||||||||||||||||||||||||| |||||||||||||
a230        ERVARLPANEAKPSFEQEKAAVENELKMKKAVADFNKAKEKLGDDAFNHPSSLAEAAKNS
                     250        260        270        280        290        300

310        320        330        340        350        360
m230.pep    GLKVETQETWLSRQDAQMSGMPENLINAVFSDDVLKKKHNSEVLTINSETAWVVRAKEVR
            ||||||||||||||||||||||||||||||||||||||||||||||||||||||||||||
a230        GLKVETQETWLSRQDAQMSGMPENLINAVFSDDVLKKKHNSEVLTINSETAWVVRAKEVR
                     310        320        330        340        350        360

370        380
m230.pep    EEKTLPFAEAKDAVRQAYIRTEAAKL
            ||||||||||||||||||||||||||
a230        EEKTLPFAEAKDAVRQAYIRTEAAKL
                     370        380
```

The following partial DNA sequence was identified in *N. gonorrhoeae* <SEQ ID 833>:

```
g230-1.seq
   1 ATGTTCCATT CCATCGAAAA ATACAGAACA CCCGCCCAAG TCTTATTAGG

51 CCTGATTGCA TTAACTTTTG TCGGCTTCGG CGTCAGCACG GTTTCCCATC

101 CGGGCGCCGA CTACATCGTC CAAGTGGGCG ACGAAAAAAT CAGCGAGCAC

151 TCAATCAACA ACGCCATGCA GAACGAGCAG GCGGACGGCG GCAGCCCTTG

201 GCGCGACGCG GTGTTCCAAT CCCTGCTGCA ACGCGCCTAC CTGAAACAGG

251 GCGCGAAGCT GATGGGCATT TCGGTTTCTT CCGAACAAAT CAAGCAGATG

301 ATTGTGGACG ATCCCAATTT CCACGACGCA AACGGCAAAT TCAGTCACGC

351 GCTTTTGAGT CAATACCTGT CGCAACGCCA TATGTCTGAA GACCAGTTTG

401 TCGAAGAAAT CCGCGATCAG TTTGCCTTGC AGAATTTGGT AAGCCTCGTC

451 CAAAACGGCG TATTGGTCGG CGACGCGCAG GCGGAACAGC TGATCAGGCT

501 GACGCAGGTC AACCGCACCA TCCGTTCGCA CACTTTCAAC CCCGACGAGT

551 TCATCGCCCA GTCAAAGCG TCTGAAGCCG ATTTGCAGAA ATTTTATAAT

601 GCGAACAAAA AAGACTATCT GCTGCCGCAG GCGGTCAAAT TGGAATATGT

651 CGCCTTGAAT CTGAAGGATT TTGCAGACAA GCAGACCGTC AGTGAAACGG

701 AAGTGAAAAA TGCGTTTGAA GAGCGCGTGG CGCGTTTGCC GGCACATGAA

751 GCCAAACCTT CTTTCGAGCA GGAAAAAGCC GCCGTCGAAA ACGAATTGAA

801 AATGAAAAAG GCGGTTGCCG ACTTCAACAA GGCAAAGAA AAGCTGGGCG

851 ACGATGCGTT CAATCATCCC TCCTCGCTTG CCGAAGCCGC CAAAAACAGC

901 GGTTTGAAAG TGGAAACCCA AGAAACTTGG CTGAGCAGGC AGGACGCACA

951 AATGTCCGGC ATGCCCGAAA ACCTAATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAAAAAA ACCTACTGTT

1101 TGAAGAAGCC AAAGATGCGG TGCGTCAGGC CTATATCCGT ACCGAAGCCG

1151 CCAAACTTGC CGAAAACAAG GCAAAGAAG TGCTTACCCA ACTGAACGGC
```

-continued

```
1201 GGCAAGGCAG TTGACGTGAA ATGGTCGGAA GTGTCCGTTT TGGGCGCGCA

1251 GCAGGCAAGG CAGTCCATGC CGCCCGAGGC TTATGCGGAA CTGCTGAAAG

1301 CAAAACCGGC AAACGGCAAA CCCGCCTATG TCAGACTGAC CGGTCTGCCG

1351 GCACCCGTGA TTGTCGAGGC GCAGGCAGTC ACGCCTCCGG AGGATATTGC

1401 CGCACAGCTT CCTCCTGCGA ACAGGCTTT GGCGCAACAG CAGTCTGCCA

1451 ATACTTTCGA CCTGCTGATC CGCTATTTCA ACGGAAAAAT CAAACAGACT

1501 AAAGGAGCAC AATCGGTTGA CAACGGCGAT GGTCAGTAA
```

This corresponds to the amino acid sequence <SEQ ID 834; ORF 230-1.ng>:

```
g230-1.pep.
  1 MFHSIEKYRT PAQVLLGLIA LTFVGFGVST VSHPGADYIV QVGDEKISEH

51 SINNAMQNEQ ADGGSPWRDA VFQSLLQRAY LKQGAKLMGI SVSSEQIKQM

101 IVDDPNFHDA NGKFSHALLS QYLSQRHMSE DQFVEEIRDQ FALQNLVSLV

151 QNGVLVGDAQ AEQLIRLTQV NRTIRSHTFN PDEFIAQVKA SEADLQKFYN

201 ANKKDYLLPQ AVKLEYVALN LKDFADKQTV SETEVKNAFE ERVARLPAHE

251 AKPSFEQEKA AVENELKMKK AVADFNKAKE KLGDDAFNHP SSLAEAAKNS

301 GLKVETQETW LSRQDAQMSG MPENLINAVF SDDVLKKKHN SEVLTINSET

351 AWVVRAKEVR EEKNLLFEEA KDAVRQAYIR TEAAKLAENK AKEVLTQLNG

401 GKAVDVKWSE VSVLGAQQAR QSMPPEAYAE LLKAKPANGK PAYVRLTGLP

451 APVIVEAQAV TPPEDIAAQL PPAKQALAQQ QSANTFDLLI RYFNGKIKQT

501 KGAQSVDNGD GQ*
```

The following partial DNA sequence was identified in N. meningitidis <SEQ ID 835>:

```
m230-1.seq
  1 ATGTTCCATT CCATCGAAAA ATACAGAACG CCCGCCCAAG TCCTTTTGGG

51 CCTGATTGCA TTAACCTTCG TCGGCTTCGG GGTCAGCACG GTATCCCATC

101 CGGGTGCCGA CTACATCGTC CAAGTGGGCG ACGAAAAAAT CAGCGACCAC

151 TCCATCAACA ACGCCATACA GAACGAACAG GCGGACGGCG GCGGCCCTTC

201 GCGCGACGCG GTGTTCCAAT CCCTGCTGCA ACGCGCCTAC CTGAAACAGG

251 GCGCGAAGCT GATGGGCATT TCGGTTTCTT CCGAACAAAT CAAGCAAATT

301 ATCGTGGACG ATCCCAATTT CCACGACGCA AACGGCAAAT TCGACCACGC

351 GCTTTTAAAC CGCTACCTTT CCCAACGCCA TATGTCTGAA GACCAGTTTG

401 TCGAAGAAAT CCGCGATCAG TTTGCCTTGC AGAATTTGGT AAACCTCGTC

451 CAAAACGGCG TATTGGTCGG CGACGCGCAG GCGGAACAGC TGATCAGGCT

501 GACACAGGTC AACCGCACCA TCCGTTCGCA CACTTTCAAC CCCGACGAGT

551 TCATCGCCCA AGTCAAAGTG TCTGAAGCCG ATTTGCAGAA ATTTTATAAT

601 GCGAACAAAA AAGACTATCT GCTGCCGCAG GCGGTCAAAT TGGAATATGT

651 CGCCTTGAAT CTGAAGGATT TTGCAGACAA GCAGACCGTC AGTGAAACGG

701 AAGTGAAAAA TGCATTTGAA GAGCGCGTGG CGCGTTTGCC GGCAAATGAA

751 GCCAAACCTT CTTTCGAGCA GGAAAAAGCC GCCGTCGAAA ACGAATTGAA
```

```
 801 AATGAAAAAG GCGGTTGCCG ACTTCAACAA GGCAAAAGAA AAATTGGGCG

851 ACGATGCGTT CAACCATCCT TCCTCGCTTG CCGAAGCCGC CAAAAACAGC

901 GGTTTGAAAG TCGAAACCCA AGAAACTTGG CTGAGTAGGC AGGACGCGCA

951 AATGTCCGGT ATGCCCGAAA ACCTGATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAGAAAA CCCTGCCGTT

1101 TGCCGAAGCC AAAGACGCGG TACGTCAGGC TTATATCCGT ACCGAAGCCG

1151 CCAAACTTGC CGAAAACAAG GCAAAAGACG TGCTTACCCA ACTGAACGGC

1201 GGCAAGGCTG TTGACGTGAA ATGGTCGGAA GTGTCCGTTT TGGGCGCACA

1251 GCAGGCAAGG CAGTCCATGC CGCCCGAGGC TTATGCGGAA CTGCTGAAAG

1301 CAAAACCGGC AAACGGCAAA CCCGCCTACG TCAGGCTGAT CGGTCTGCCG

1351 GCACCCGTGA TTGTCGAAGT ACAGGCTGTA ACCCCGCCGG ATGATATCGC

1401 CGCACAGCTT CCGCTTGCAA AACAGGCTTT GGCGCAACAG CAGTCTGCCA

1451 ATACTTTCGA CTTGTTGATA CGTTATTTCA ACGGCAAAAT CAAACAGACC

1501 AAAGGAGCGC AATCGGTCGA CAACGGCGAC GGTCAGTAA
```

This corresponds to the amino acid sequence <SEQ ID 836; ORF 230-1>:

```
a230-1.pep
     1  MFHSIEKYRT PAQVLLGLIA LTFVGFGVST VSHPGADYIV QVGDEKISDH

51  SINNAIQNEQ ADGGGPSRDA VFQSLLQRAY LKQGAKLMGI SVSSEQIKQI

101  IVDDPNGHDA NGKFDHALLN RYLSQRHMSE DQGVEEIRDQ FALQNLVNLV

151  QNGVLVGDAQ AEQLIRLTQV NRTIRSHTFN PDEFIAQVKV SEADLQKFYN

201  ANKKDYLLPQ AVKLEYVALN LKDFADKQTV SETEVKNAFE ERVARLPANE

251  AKPSFEQEKA AVENELKMKK AVADFNKAKE KLGDDAFNHP SSLAEAAKNS

301  GLKVETQETW LSRQDAQMSG MPENLINAVF SDDVLKKKHN SEVLTINSET

351  AWVVRAKEVR EEKTLPFAEA KDAVRQAYIR TEAAKLAENK AKDVLTQLNG

401  GKAVDVKWSE VSVLGAQQAR QSMPPEAYAE LLKAKPANGK PAYVRLIGLP

451  APVIVEVQAV TPPDDIAAQL PLAKQALAQQ QSANTFDLLI RYFNGKIKQT

501  KGAQSVDNGD GQ* m230-1/g230-1  96.3% identity in 512 aa overlap 10         20         30         40         50         60
m230-1.pep  MFHSIEKYRTPAQVLLGLIALTFVGFGVSTVSHPGADYIVQVGDEKISDHSINNAIQNEQ
            |||||||||||||||||||||||||||||||||||||||||||||:|||||:||||
g230-1      MFHSIEKYRTPAQVLLGLIALTFVGFGVSTVSHPGADYIVQVGDEKISEHSINNAMQNEQ
                 10         20         30         40         50         60

70         80         90        100        110        120
m230-1.pep  ADGGGPSRDAVFQSLLQRAYLKQGAKLMGISVSSEQIKQIIVDDPNFHDANGKFDHALLN
            ||||:||||||||||||||||||||||||||||||:||||||||||||||||:|||:
g230-1      ADGGSPWRDAVFQSLLQRAYLKQGAKLMGISVSSEQIKQMIVDDPNFHDANGKFSHALLS
                 70         80         90        100        110        120

130        140        150        160        170        180
m230-1.pep  RYLSQRHMSEDQFVEEIRDQFALQNLVNLVQNGVLVGDAQAEQLIRLTQVNRTIRSHTFN
            :|||||||||||||||||||||||||||:|||||||||||||||||||||||||||
g230-1      QYLSQRHMSEDQFVEEIRDQFALQNLVSLVQNGVLVGDAQAEQLIRLTQVNRTIRSHTFN
                130        140        150        160        170        180

190        200        210        220        230        240
m230-1.pep  PDEFIAQVKVSEADLQKFYNANKKDYLLPQAVKLEYVALNLKDFADKQTVSETEVKNAFE
            ||||||||||:|||||||||||||||||||||||||||||||||||||||||||||||||
g230-1      PDEFIAQVKASEADLQKFYNANKKDYLLPQAVKLEYVALNLKDFADKQTVSETEVKNAFE
                190        200        210        220        230        240
```

-continued

```
                  250       260       270       280       290       300
m230-1.pep ERVARLPANEAKPSFEQEKAAVENELKMKKAVADFNKAKEKLGDDAFNHPSSLAEAAKNS
           ||||||||:|||||||||||||||||||||||||||||||||||||||||||||||||||
g230-1     ERVARLPAHEAKPSFEQEKAAVENELKMKKAVADFNKAKEKLGDDAFNHPSSLAEAAKNS
                  250       260       270       280       290       300

310       320       330       340       350       360
m230-1.pep GAKVETQETWLSRQDAQMSGMPENLINAVFSDDVLKKKHNSEVLTINSETAWVVRAKEVR
           ||||||||||||||||||||||||||||||||||||||||||||||||||||||||||||
g230-1     GAKVETQETWLSRQDAQMSGMPENLINAVFSDDVLKKKHNSEVLTINSETAWVVRAKEVR
                  310       320       330       340       350       360

370       380       390       400       410       420
m230-1.pep EEKTLPFAEAKDAVRQAYIRTEAAKLAENKAKDVLTQLNGGKAVDVKWSEVSVLGAQQAR
           |||:| | ||||||||||||||||||||||||:|||||||||||||||||||||||||||
g230-1     EEKNLLFEEAKDAVRQAYIRTEAAKLAENKAKEVLTQLNGGKAVDVKWSEVSVLGAQQAR
                  370       380       390       400       410       420

430       440       450       460       470       480
m230-1.pep QSMPPEAYAELLKAKPANGKPAYVRLIGLPAPVIVEVQAVTPPDDIAAQLPLAKQALAQQ
           |||||||||||||||||||||||||| |||||||||:|||||||:|||||| ||||||||
g230-1     QSMPPEAYAELLKAKPANGKPAYVRLTGLPAPVIVEAQAVTPPEDIAAQLPPAKQALAQQ
                  430       440       450       460       470       480

490       500       510
m230-1.pep QSANTFDLLIRYFNGKIKQTKGAQSVDNGDGQX
           |||||||||||||||||||||||||||||||||
g230-1     QSANTFDLLIRYFNGKIKQTKGAQSVDNGDGQX
                  490       500       510
```

The following partial DNA sequence was identified in *N. meningitidis* <SEQ ID 837>:

```
a230-1.seq
   1 ATGTTCCATT CCATCGAAAA ATACAGAACG CCCGCCCAAG TCCTTTTGGG

51 CCTGATTGCA TTAACCTTCG TCGGCTTCGG GGTCAGCACG GTATCCCATC

101 CGGGTGCCGA CTACATCGTC CAAGTGGGCG ACGAAAAAAT CAGCGACCAC

151 TCCATCAACA ACGCCATACA GAACGAACAG GCGGACGGCG GCGGCCCTTC

201 GCGCGACGCG GTGTTCCAAT CCCTGCTACA ACGCGCCTAC CTGAAACAGG

251 GCGCGAAGCT GATGGGCATT TCGGTTTCTT CCGAACAAAT CAAGCAGATT

301 ATCGTGGACG ATCCCAATTT CCACGACGCA AACGGCAAAT TCGACCACGC

351 GCTTTTAAAC CGCTACCTTT CCCAACGTCA TATGTCTGAA GACCAGTTTG

401 TCGAAGAAAT CCGCGATCAG TTTGCCTTGC AGAATTTGGT AAACCTCGTC

451 CAAAACGGCG TATTGGTCGG CGACGCGCAG GCGGAACAGC TGATCAGGCT

501 GACGCAGGTC AACCGCACCA TCCGTTCGCA CACTTTCAAC CCCGACGAAT

551 TCATCGCCCA AGTCAAAGTG TCTGAAGCCG ATTTGCAGAA GTTTTATAAC

601 GCAAACAAAA AAGACTACCT GCTTCCCAAA GCGGTCAAAT TGGAATATGT

651 CGCCTTGAAT CTGAAAGACT TTGCAGACAA ACAGACCGTC AGCGAAACAG

701 AAGTGAAAAA TGCGTTTGAA GAGCGCGTGG CGCGTTTGCC GGCAAATGAA

751 GCCAAACCTT CTTTCGAGCA GGAAAAAGCC GCCGTCGAAA ACGAATTGAA

801 AATGAAAAAG GCGGTTGCCG ACTTCAATAA GGCAAAAGAA AAGCTGGGCG

851 ATGACGCGTT CAACCATCCT TCCTCGCTTG CCGAAGCCGC CAAAAACAGC

901 GGTTTGAAAG TCGAAACCCA AGAAACTTGG CTGAGCAGGC AGGATGCGCA

951 AATGTCCGGT ATGCCCGAAA ACCTGATCAA TGCCGTATTC AGCGACGACG

1001 TATTGAAGAA AAAACACAAT TCCGAAGTGC TGACCATCAA CAGCGAAACC

1051 GCGTGGGTCG TCCGCGCCAA AGAAGTCCGC GAAGAGAAAA CCCTGCCGTT

1101 TGCCGAAGCC AAAGACGCGG TACGTCAGGC TTATATCCGT ACCGAAGCCG

1151 CCAAACTTGC CGAAAACAAG GCAAAAGACG TGCTTACCCA ACTGAACGGC
```

```
-continued
1201 GGCAAGGCTG TTGACGTGAA ATGGTCGGAA GTGTCCGTTT TGGGCGCACA

1251 GCAGGCAAGG CAGTCCATGC CGCCCGAGGC TTATGCGGAA CTGCTGAAAG

1301 CAAAACCGGC AAACGGCAAA CCCGCCTACG TCAGGCTGAT CGGTCTGCCG

1351 GCACCCGTGA TTGTCGAAGT ACAGGCTGTA ACCCCGCCGG ATGATATCGC

1401 CGCACAGCTT CCGCTTGCAA AACAGGCTTT GGCGCAACAG CAGTCTGCCA

1451 ATACTTTCGA CTTGTTGATA CGTTATTTCA ACGGCAAAAT CAAACAGACC

1501 AAAGGAGCGC AATCGGTCGA CAACGGCGAC GGTCAGTAA
```

This corresponds to the amino acid sequence <SEQ ID 838; ORF 230-1.a>:

```
a230-1.pep
       1  MFHSIEKYRT PAQVLLGLIA LTFVGFGVST VSHPGADYIV QVGDEKISDH

51  SINNAIQNEQ ADGGGPSRDA VFQSLLQRAY LKQGAKLMGI SVSSEQIKQI

101  IVDDPNGHDA NGKFDHALLN RYLSQRHMSE DQGVEEIRDQ FALQNLVNLV

151  QNGVLVGDAQ AEQLIRLTQV NRTIRSHTFN PDEFIAQVKV SEADLQKFYN

201  ANKKDYLLPQ AVKLEYVALN LKDFADKQTV SETEVKNAFE ERVARLPANE

251  AKPSFEQEKA AVENELKMKK AVADFNKAKE KLGDDAFNHP SSLAEAAKNS

301  GLKVETQETW LSRQDAQMSG MPENLINAVF SDDVLKKKHN SEVLTINSET

351  AWVVRAKEVR EEKTLPFAEA KDAVRQAYIR TEAAKLAENK AKDVLTQLNG

401  GKAVDVKWSE VSVLGAQQAR QSMPPEAYAE LLKAKPANGK PAYVRLIGLP

451  APVIVEVQAV TPPDDIAAQL PLAKQALAQQ QSANTFDLLI RYFNGKIKQT

501         KGAQSVDNGD GQ* a230-1/m230-1  99.8% identity in 512 aa overlap 10         20         30         40         50         60
a230-1.pep  MFHSIEKYRTPAQVLLGLIALTFVGFGVSTVSHPGADYIVQVGDEKISDHSINNAIQNEQ
            ||||||||||||||||||||||||||||||||||||||||||||||||||||:|||||||
m230-1      MFHSIEKYRTPAQVLLGLIALTFVGFGVSTVSHPGADYIVQVGDEKISDHSINNIMQNEQ
                    10         20         30         40         50         60

70         80         90        100        110        120
a230-1.pep  ADGGGPSRDAVFQSLLQRAYLKQGAKLMGISVSSEQIKQIIVDDPNFHDANGKFDHALLN
            ||||||||||||||||||||||||||||||||||||||||||||||||||||||||||||
m230-1      ADGGGPSRDAVFQSLLQRAYLKQGAKLMGISVSSEQIKQIIVDDPNFHDANGKFDHALLN
                    70         80         90        100        110        120

130        140        150        160        170        180
a230-1.pep  RYLSQRHMSEDQFVEEIRDQFALQNLVNLVQNGVLVGDAQAEQLIRLTQVNRTIRSHTFN
            ||||||||||||||||||||||||||||||||||||||||||||||||||||||||||||
m230-1      RYLSQRHMSEDQFVEEIRDQFALQNLVNLVQNGVLVGDAQAEQLIRLTQVNRTIRSHTFN
                   130        140        150        160        170        180

190        200        210        220        230        240
a230-1.pep  PDEFIAQVKVSEADLQKFYNANKKDYLLPKAVKLEYVALNLKDFADKQTVSETEVKNAFE
            ||||||||||||||||||||||||||||||||:|||||||||||||||||||||||||||
m230-1      PDEFIAQVKVSEADLQKFYNANKKDYLLPQAVKLEYVALNLKDFADKQTVSETEVKNAFE
                   190        200        210        220        230        240

250        260        270        280        290        300
a230-1.pep  ERVARLPANEAKPSFEQEKAAVENELKMKKAVADFNKAKEKLGDDAFNHPSSLAEAAKNS
            ||||||||||||||||||||||||||||||||||||||||||||||||||||||||||||
m230-1      ERVARLPANEAKPSFEQEKAAVENELKMKKAVADFNKAKEKLGDDAFNHPSSLAEAAKNS
                   250        260        270        280        290        300

310        320        330        340        350        360
a230-1.pep  GAKVETQETWLSRQDAQMSGMPENLINAVFSDDVLKKKHNSEVLTINSETAWVVRAKEVR
            ||||||||||||||||||||||||||||||||||||||||||||||||||||||||||||
m230-1      GAKVETQETWLSRQDAQMSGMPENLINAVFSDDVLKKKHNSEVLTINSETAWVVRAKEVR
                   310        320        330        340        350        360

370        380        390        400        410        420
a230-1.pep  EEKTLPFAEAKDAVRQAYIRTEAAKLAENKAKDVLTQLNGGKAVDVKWSEVSVLGAQQAR
            ||||||||||||||||||||||||||||||||||||||||||||||||||||||||||||
m230-1      EEKTLPFAEAKDAVRQAYIRTEAAKLAENKAKDVLTQLNGGKAVDVKWSEVSVLGAQQAR
                   370        380        390        400        410        420
```

```
                          430        440        450        460        470        480
a230-1.pep   QSMPPEAYAELLKAKPANGKPAYVRLIGLPAPVIVEVQAVTPPDDIAAQLPLAKQALAQQ
             ||||||||||||||||||||||||||||||||||||||||||||||||||||||||||||
m230-1       QSMPPEAYAELLKAKPANGKPAYVRLIGLPAPVIVEVQAVTPPDDIAAQLPLAKQALAQQ
                          430        440        450        460        470        480

490        500        510
a230-1.pep   QSANTFDLLIRYFNGKIKQTKGAQSVDNGDGQX
             ||||||||||||||||||||||||||||||||
m230-1       QSANTFDLLIRYFNGKIKQTKGAQSVDNGDGQX
                          490        500        510
```

The following partial DNA sequence was identified in *N. gonorrhoeae* <SEQ ID 839>:

```
g231.seq
    1 atgtcaaaac gaaaatccat aaaccgtccg tatcaaaaac cggcggaact
   51 gccgccgttg caaataatc cgccatttta ccgtaaaaac cgccgcctga
  101 actttttat cgcggcagac ggcggttgcg cgtctccgca aaaatgcagg
  151 gcgcgcggtt ttcagacggc atttgccgtt caaggccgtg cggtgtcttt
  201 accaaatgcc caaccattcg cccacggaat ccatccaatc cttattgccc
  251 ccgccgctcc tgcctgcccg gcggtacgcc cacggcgctt gcggattttt
  301 agctttccac aatcctttgc gttcccttc cgcctgaatt tgagcgtcgg
  351 catagtcggc aaaatccgcc ttatcctgct gttctttagc ataactttta
  401 taatgccacg ccgccccgtc ctgcacctgc atcaggttca aatcggtttt
  451 gccggcggat acctgcgcca cttcgcgctg atagcggtcg gtttcaaaca
  501 cacgtacact gactttccta ccctccgccg ccgcgcgcag gttgtcgcgc
  551 gaacgtgtac cgtaagcctg tttcatctcc ggtgcgtcga tatacgccat
  601 ccgaatttta tgtttcgcgc cgtcgccgtc gatgacgtga agggtatcgc
  651 cgtcatagac tttggacacc gtgcctgtgt agctgtggcc ggatttcgcc
  701 gatgcccgtc ggcgaacggg cgcgtcgaaa cccacgtccc tgcagtgcc
  751 gagtacgtcg agtacggcaa ccgccgtccg caccgcctca ctgtcatatc
  801 ccgtataacc caacgcgccc aaaagcgaca gggcgacggg aagccatttc
  851 atgatttttt taatctgcat atttttcaaa tgccgatgcc gtctgaacat
  901 ctctga
```

This corresponds to the amino acid sequence <SEQ ID 840; ORF 231.ng>:

```
g231.pep
    1 MSKRKSINRP YQKPAELPPL QNNPPFYRKN RRLNFFIAAD GGCASPQKCR

51 ARGFQTAFAV QGRAVSLPNA QPFAHGIHPI LIAPAAPACP AVRPRRLRIF

101 SFPQSFAFPF RLNLSVGIVG KIRLILLFFS ITFIMPRRPV LHLHQVQIGF

151 AGGYLRHFAL IAVGFKHTYT DFPTLRRRAQ VVARTCTVSL FHLRCVDIRH

201 PNFMFRAVAV DDVKGIAVID FGHRACVAVA GFRRCPSANG RVETHVPCSA

251 EYVEYGNRRP HRLTVISRIT QRAQKRQGDG KPFHDFFNLH IFQMPMPSEH

301 L*
```

The following partial DNA sequence was identified in *N. meningitidis* <SEQ ID 841>:

```
m231.seq (partial)
    1 ATGTCAAAAC GAAAATCCAT AAACCGTCCG TATCAAAAAC CGGCGGAACT

51 GCCGCCGTTG CAAAATAATC CGCCATTTTA CCGTAAAAAC CGCCGCCTGA

101 ACTTTTTTAT CGCGGCAGAC GGCGGTTGCG CGTCTCCGCA AAAATGCAGG

151 GCGCGCGGTT TTCAGACGGC ATTTGCCGTT CAAAGCCGTG CGGTGTCTTT

201 ACCAAATGCC CAACCATTCG GC.....
```

This corresponds to the amino acid sequence <SEQ ID 842; ORF 231>:

```
m231.pep (partial)
    1 MSKRKSINRP YQKPAELPPL QNNPPFYRKN RRLNFFIAAD GGCASPQKCR

51 ARGFQTAFAV QSRAVSLPNA QPFG.....
```

Computer analysis of this amino acid sequence gave the following results:
Homology with a Predicted ORF from *N. gonorrhoeae*
ORF 231 shows 98.6% identity over a 73 aa overlap with a predicted ORF (ORF 231.ng) from *N. gonorrhoeae*:

```
m231/g231

10         20         30         40         50         60
    m231.pep  MSKRKSINRPYQKPAELPPLQNNPPFYRKNRRLNFFIAADGGCASPQKCRARGFQTAFAV
              ||||||||||||||||||||||||||||||||||||||||||||||||||||||||||||
    g231      MSKRKSINRPYQKPAELPPLQNNPPFYRKNRRLNFFIAADGGCASPQKCRARGFQTAFAV
                  10         20         30         40         50         60
                  70
    m231.pep  QSRAVSLPNAQPFG
              |:||||||||||||:
    g231      QGRAVSLPNAQPFAHGIHPILIAPAAPACPAVRPRRLRIFSFPQSFAFPFRLNLSVGIVG
                  70         80         90        100        110        120
```

The following partial DNA sequence was identified in *N. meningitidis* <SEQ ID 843>:

```
a231.seq (partial)
    1 ATGTCAAAAC GAAAATCCAT AAACCGTCCG TATCAAAAAC CGGCGGAACT

51 GCCGCCGTTG CAAAATAATC CGCCATTTTA CCGTAAAAAC CGCCGCCTGA

101 ACTTTTTTAT CGNGGCAGAC GGCGGTTGCG CGTCTCCGCA AAAATGCAGG

151 GCGCGCGGTT TTCAGACGGC ATTTGCCGTT CAAAGCCGTG CGGTGTCTTT

201 ACCAAATGCC CAACCATTCG CCCACGGCAT CCATCCAATC CTTATTGCCC

251 CCGCCGCTCC TGCCTGCCCG GCGGTACGCC CACGGCGCTT GCGGATTTTT

301 AGCTTTCCAC AATCCTTTGC GTTCCCTTTC CGCCTGAATT TGAGCGTCGG

351 CATAATCGGC AAAATCCGCC TTATCCTGCT GTTCTTTAGC ATAACTTTTA

401 TAATGCCACG CCGCCCCGTC CTGCACCTGC ATCAGGTTCA AATCGGTTTT

451 GCCGACAGAA ACCTGCGCCA CTTCGCGCTG GTAGCGGTCG GTGTCGAACA

501 CGCGGACGCT GACTTTCCTG CCTTCCGCCG CCGCGCGCAG GTTGTCGCGC

551 GAACGCGTGC CGTAAGCCTG TTTCATCTCC GGCGCGTCGA TATACGCCAT

601 CCGGATTTTG TGTTTCGCGC CGTCGCCGTC GATAACGTGA AGGGTGTCGC

651 CGTCATAGAC TTTGGACACC GTGCCTGTGT AGCGGTGGCC GGATTTCGCC
```

-continued

```
701 GATGCTCGGC GGCGGGCGGG CGCGTCGGAA CCCGCGTCCC CTGCCGCGCC

751 GAGTACGTCG AGTACGGCAA CCGCCGTCCG CACCGCCTCG CTGCCGTACC

801 CCGTATAACC CAACGCACCC AAAAGCGACA AGGCGACGGG AAGCCATTTC

851 ATGATTTTTT TAATCTGCAT ATTTTTCAAA TGCCGATGCC GTCTGAACAT

901 ATC
```

This corresponds to the amino acid sequence <SEQ ID 844; ORF 217.a>:

```
a231.pep (partial)
   1 MSKRKSINRP YQKPAELPPL QNNPPFYRKN RRLNFFIXAD GGCASPQKCR

51 ARGFQTAFAV QSRAVSLPNA QPFAHGIHPI LIAPAAPACP AVRPRRLRIF

101 SFPQSFAFPF RLNLSVGIIG KIRLILLFFS ITFIMPRRPV LHLHQVQIGF

151 ADRNLRHFAL VAVGVEHADA DFPAFRRRAQ VVARTRAVSL FHLRRVDIRH

201 PDFVFRAVAV DNVKGVAVID FGHRACVAVA GFRRCSAAGG RVGTRVPCRA

251 EYVEYGNRRP HRLAAVPRIT QRTQKRQGDG KPFHDFFNLH IFQMPMPSEH

301 I
``` m231/a231 98.6% identity in 73 aa overlap

```
                    10        20        30        40        50        60
    m231.pep MSKRKSINRPYQKPAELPPLQNNPPFYRKNRRLNFFIAADGGCASPQKCRARGFQTAFAV
             |||||||||||||||||||||||||||||||||||||| |||||||||||||||||||||
        a231 MSKRKSINRPYQKPAELPPLQNNPPFYRKNRRLNFFIXADGGCASPQKCRARGFQTAFAV
                    10        20        30        40        50        60

70
    m231.pep QSRAVSLPNAQPFG
             ||||||||||||||:
        a231 QSRAVSLPNAQPFAHGIHPILIAPAAPACPAVRPRRLRIFSFPQSFAFPFRLNLSVGIIG
                    70        80        90       100       110       120
```

The following partial DNA sequence was identified in *N. gonorrhoeae* <SEQ ID 845>:

```
g231-1.seq
   1 ATGTCAAAAC GAAAATCCAT AAACCGTCCG TATCAAAAAC CGGCGGAACT

51 GCCGCCGTTG CAAAATAATC CGCCATTTTA CCGTAAAAAC CGCCGcCTGA

101 ACTTTTTTAT CGCGGCAGAC GGCGGTTGCG CGTCTCCGCA AAAATGCAGG

151 GCGCGCGGTT TTCAGACGGC ATTTGCCGTT CAAGGCCGTG CGGTGTCTTT

201 ACCAAATGCC CAACCATTCG CCCACGGAAT CCATCCAATC CTTATTGCCC

251 CCGCCGCTCC TGCCTGCCCG GCGGTACGCC CACGGCGCTT GCGGATTTTT

301 AGCTTTCCAC AATCCTTTGC GTTCCCTTTC CGCCTGAATT TGAGCGTCGG

351 CATAGTCGGC AAAATCCGCC TTATCCTGCT GTTCTTTAGC ATAACTTTTA

401 TAATGCCACG CCGCCCCGTC CTGCACCTGC ATCAGGTTCA AATCGGTTTT

451 GCCGGCGGAT ACCTGCGCCA CTTCGCGCTG ATAGCGGTCG GTTTCAAACa

501 CaCgTaCaat gagtttcgtA ccctccGCCG ccgcgcgCAG GTTGtcgcGC

551 GAACgTGTAC CGTAagcgtg TTtcatctcc GGTGCgtcGA TATACGCCaT 601 cCgAATTTta tGTttcgcgc cgtcgcCgtc gATGACGTGA AGGGtatcGC 651 CgtcATAGAC TTTGGACACC Gtgcctgcgt AGctGTGGCC GGATttcgc
```

This corresponds to the amino acid sequence <SEQ ID 846; ORF 231-1.ng>:

```
g231-1.pep
    1 MSKRKSINRP YQKPAELPPL QNNPPFYRKN RRLNFFIAAD GGCASPQKCR

51 ARGFQTAFAV QGRAVSLPNA QPFAHGIHPI LIAPAAPACP AVRPRRLRIF

101 SFPQSFAFPF RLNLSVGIVG KIRLILLFFS ITFIMPRRPV LHLHQVQIGF

151 AGGYLRHFAL IAVGFKHTYN EFRTLRRRAQ VVARTCTVSV FHLRCVDIRH

201 PNFMFRAVAV DDVKGIAVID FGHRACVAVA GFR
```

The following partial DNA sequence was identified in *N. meningitidis* <SEQ ID 847>:

```
m231-1.seq
    1 ATGTCAAAAC GAAAATCCAT AAACCGTCCG TATCAAAAAC CGGCGGAACT

51 GCCGCCGTTG CAAAATAATC CGCCATTTTA CCGTAAAAAC CGCCGCCTGA

101 ACTTTTTTAT CGCGGCAGAC GGCGGTTGCG CGTCTCCGCA AAAATGCAGG

151 GCGCGCGGTT TTCAGACGGC ATTTGCCGTT CAAAGCCGTG CGGTGTCTTT

201 ACCAAATGCC CAACCATTCG CCCACGGCAT CCATCCAATC CTTATTGCCC

251 CCGCCGCTCC TGCCTGCTCG GCGGTACGCC CACGGCGCTT GCGGATTTTT

301 AGCTTTCCAC AATCCTTTGC GTTCCCTTTC CGCCTGAATT TGAGCGTCGG

351 CATAATCGGC AAAATCCGCC TTATCCTGCT GTTCTTTAGC ATAACTTTTA

401 TAATGCCACG CCGCCCCGTC CTGCACCTGC ATCAGGTTCA AATCGGTTTT

451 GCCGACAGAA ACCTGCGCCA CTTCGCGCTG GTAGCGGTCG GTATCGAACA

501 CGCGCACGCT GACTTTCCTG CCTTCCGCCG CCGCGCGCAG GTTGTCGCGC

551 GAACGCGTGC CGTAAGCCTG TTTCATCTCC GGCGCGTCGA TATACGCCAT

601 CCGGATTTTG TGTTTCGCGC CGTCGCCGTC GATAACGTGA AGGGTGTCGC

651 CGTCATAGAC TTTGGACACC GTGCCTGTGT AGCGGTGGCC GGATTTCGCC

701 GATGCTCGGC GGCGGGCGGG CGCGTCGGAA CCCGCGTCCC CTGCCGCGCC

751 GAGTACGTCG AGTACGGCAA CCGCCGTCCG CACCGCCTCG CTGCCGTACC

801 CCGTATAACC CAACGCACCC AAAAGCGACA GGGCGACGGG AAGCCATTTC

851 ATGATTTTTT TAATCTGCAT ATTTTTCAAA TGCCGATGCC GTCTGAACAT

901 ATCGGAATCG GATTTCAGAC GGCATCTTAA
```

This corresponds to the amino acid sequence <SEQ ID 848; ORF 231-1>:

```
m231-1.pep
    1 MSKRKSINRP YQKPAELPPL QNNPPFYRKN RRLNFFIAAD GGCASPQKCR

51 ARGFQTAFAV QSRAVSLPNA QPFAHGIHPI LIAPAAPACS AVRPRRLRIF

101 SFPQSFAFPF RLNLSVGIIG KIRLILLFFS ITFIMPRRPV LHLHQVQIGF

151 ADRNLRHFAL VAVGIEHAHA DFPAFRRRAQ VVARTRAVSL FHLRRVDIRH

201 PDFVFRAVAV DNVKGVAVID FGHRACVAVA GFRRCSAAGG RVGTRVPCRA

251 EYVEYGNRRP HRLAAVPRIT QRTQKRQGDG KPFHDFFNLH IFQMPMPSEH

301 IGIGFQTAS* g231-1/m231-1 87.0% identity in 262 aa overlap
```

```
                    10         20         30         40         50         60
g231-1.pep  MSKRKSINRPYQKPAELPPLQNNPPFYRKNRRLNFFIAADGGCASPQKCRARGFQTAFAV
            ||||||||||||||||||||||||||||||||||||||||||||||||||||||||||||
m231-1      MSKRKSINRPYQKPAELPPLQNNPPFYRKNRRLNFFIAADGGCASPQKCRARGFQTAFAV
                    10         20         30         40         50         60

70         80         90        100        110        120
g231-1.pep  QGRAVSLPNAQPFAHGIHPILIAPAAPACPAVRPRRLRIFSFPQSFAFPPRLNLSVGIVG
            |:|||||||||||||||||||||||||| |||||||||||||||||||||||||||||:|
m231-1      QSRAVSLPNAQPFAHGIHPILIAPAAPACSAVRPRRLRIFSFPQSFAFPPRLNLSVGIIG
                    70         80         90        100        110        120

130        140        150        160        170        180
g231-1.pep  KIRLILLFFSITFIMPRRPVLHLHQVQIGFAGGYLRHFALIAVGFKHTYNEFRTLRRRAQ
            |||||||||||||||||||||||||||||| ||||||:|||::|:: :| ::||||
m231-1      KIRLILLFFSITFIMPRRPVLHLHQVQIGFADRNLRHFALVAVGIEHAHADFPAFRRRAQ
                   130        140        150        160        170        180

190        200        210        220        230        240
g231-1.pep  VVARTCTVSVFHLRCVDIRHPNFMFRAVAVDDVKGIAVIDFGHRACVAVAGFRXCPSANG
            ||||| :|||| |||||:|:||||||:|||||||||||||||||||||||||| |:|
m231-1      VVARTRAVSLFHLRRVDIRHPDFVFRAVAVDNVKGVAVIDFGHRACVAVAGFRRCSAANG
                   190        200        210        220        230        240

250        260
g231-1.pep  CVETHVPCSAEYVVXGNRRPHR
            | |:||| |||| |||||||||
m231-1      RVGTRVPCRAEYVEYGNRRPHRLAAVPRITQRTQKRQGDGKPFHDFFNLHIFQMPMPSEH
                   250        260        270        280        290        300
```

The following partial DNA sequence was identified in *N. meningitidis* <SEQ ID 849>:

```
a231-1.seq
    1 ATGTCAAAAC GAAAATCCAT AAACCGTCCG TATCAAAAAC CGGCGGAACT

51 GCCGCCGTTG CAAAATAATC CGCCATTTTA CCGTAAAAAC CGCCGCCTGA

101 ACTTTTTTAT GCGGCAGACG GCGGTTGCGC GTCTCCGCA AAAATGCAGG

151 GCGCGCGGTT TTCAGACGGC ATTTGCCGTT CAAAGCCGTG CGGTGTCTTT

201 ACCAAATGCC CAACCATTCG CCCACGGCAT CCATCCAATC CTTATTGCCC

251 CCGCCGCTCC TGCCTGCCCG GCGGTACGCC CACGGCGCTT GCGGATTTTT

301 AGCTTTCCAC AATCCTTTGC GTTCCCTTTC CGCCTGAATT TGAGCGTCGG

351 CATAATCGGC AAAATCCGCC TTATCCTGCT GTTCTTTAGC ATAACTTTTA

401 TAATGCCACG CCGCCCCGTC CTGCACCTGC ATCAGGTTCA AATCGGTTTT

451 GCCGACAGAA ACCTGCGCCA CTTCGCGCTG GTAGCGGTCG GTGTCGAACA

501 CGCGGACGCT GACTTTCCTG CCTTCCGCCG CCGCGCGCAG GTTGTCGCGC

551 GAACGCGTGC CGTAAGCCTG TTTCATCTCC GGCGCGTCGA TATACGCCAT

601 CCGGATTTTG TGTTTCGCGC CGTCGCCGTC GATAACGTGA AGGGTGTCGC

651 CGTCATAGAC TTTGGACACC GTGCCTGTGT AGCGGTGGCC GGATTTCGCC

701 GATGCTCGGC GGCGGGCGGG CGCGTCGGAA CCCGCGTCCC CTGCCGCGCC

751 GAGTACGTCG AGTACGGCAA CCGCCGTCCG CACCGCCTCG CTGCCGTACC

801 CCGTATAACC CAACGCACCC AAAAGCGACA AGGCGACGGG AAGCCATTTC

851 ATGATTTTTT TAATCTGCAT ATTTTTCAAA TGCCGATGCC GTCTGAACAT

901 ATCGGAATCG GATTTCAGAC GGCATCTTAA
```

This corresponds to the amino acid sequence <SEQ ID 850; ORF 231-1.a>:

```
a231-1.pep
    1 MSKRKSINRP YQKPAELPPL QNNPPFYRKN RRLNFFIAAD GGCASPQKCR

51 ARGFQTAFAV QSRAVSLPNA QPFAHGIHPI LIAPAAPACS AVRPRRLRIF
```

```
    101 SFPQSFAFPF RLNLSVGIIF KIRLILLFFS ITFIMPRRPV LHLHQVQIGF

151 ADRNLRHFAL VAVGIEHAHA DFPAFRRRAQ VVARTRAVSL FHLRRVDIRH

201 PDFVFRAVAV DNVKGVAVID FGHRACVAVA GFRRCSAAGG RVGTRVPCRA

251 EYVEYGNRRP HRLAAVPRIT QRTQKRQGDG KPFHDFFNLH IFQMPMPSEH

301 IGIGFQTAS* a231-1/m231-1  99.0% identity in 309 aa overlap 10         20         30         40         50         60
a231-1.pep  MSKRKSINRPYQKPAELPPLQNNPPFYRKNRRLNFFIAADGGCASPQKCRARGFQTAFAV
            ||||||||||||||||||||||||||||||||||||||||||||||||||||||||||||
m231-1      MSKRKSINRPYQKPAELPPLQNNPPFYRKNRRLNFFIAADGGCASPQKCRARGFQTAFAV
                     10         20         30         40         50         60

70         80         90        100        110        120
a231-1.pep  QSRAVSLPNAQPFAHGIHPILIAPAAPACPAVRPRRRLRIFSFPQSFAPPFRLNLSVIIG
            |||||||||||||||||||||||||||||| |||||||||||||||||||||||||||||
m231-1      QSRAVSLPNAQPFAHGIHPILIAPAAPACSAVRPRRRLRIFSFPQSFAPPFRLNLSVIIG
                     70         80         90        100        110        120

130        140        150        160        170        180
a231-1.pep  KIRLILLFFSITFIMPRRPVLHLHQVQIGFADRNLRHFALVAVGVEHADADFPAFRRRAQ
            |||||||||||||||||||||||||||||||||||||||||||||||:|||||||||||
m231-1      KIRLILLFFSITFIMPRRPVLHLHQVQIGFADRNLRHFALVAVGIEHAHADFPAFRRRAQ
                    130        140        150        160        170        180

190        200        210        220        230        240
a231-1.pep  VVARTRAVSLFHLRRVDIRHPDFVFRAVAVDNVKGVAVIDFGHRACVAVAGFRRCSAAGG
            ||||||||||||||||||||||||||||||||||||||||||||||||||||||||||||
m231-1      VVARTRAVSLFHLRRVDIRHPDFVFRAVAVDNVKGVAVIDFGHRACVAVAGFRRCSAAGG
                    190        200        210        220        230        240

250        260        270        280        290        300
a231-1.pep  RVGTRVPCRAEYVEYGNRRPHRLAAVPRITQRTQKRQGDGKPFHDFFNLHIFQMPMPSEH
            ||||||||||||||||||||||||||||||||||||||||||||||||||||||||||||
m231-1      RVGTRVPCRAEYVEYGNRRPHRLAAVPRITQRTQKRQGDGKPFHDFFNLHIFQMPMPSEH
                    250        260        270        280        290        300

310
a231-1.pep  IGIGFQTASX
            ||||||||||
m231-1      IGIGFQTASX
                    310
```

The following partial DNA sequence was identified in *N. gonorrhoeae* <SEQ ID 851>:

```
g232.seq
    1 atgatgggca acagcctgat tgaatccggt acgtttgtcg ccatcctgtt 51 tggtcagatt ttgggaacgg cggttgccgg cgcgccgcct tatattgtcg 101 ggatactggt tttgctggtc gccgtcggag gaacggccgg cagcctgttt 151 atgccgtccg tacccgccaa ggctgccgat acccaaatcg agtggaatat 201 tgtccgtggt acaaaatccc tgctgcgtga acggtgcgg cacaatcccg 251 ttttttaccgc cattatcggc atctcgtggt tttggtttgt cggcgcggtt 301 tataccacgc aactgccgac ctttacccaa atccatttgg gcggcaacga 351 taatgttttt aacctgatgc ttgctttgtt ttccatcggt attgccgccg 401 gttcggtact gtgtgccaag ttcggcaggg aacggctgat gttggcttgg 451 gtaacggttg gtgcgttggg ttcgacggtt tgcggcctgg ttttggtgtg 501 gctgacgcac ggacaccgtt ttgaagggct gaacggcatt ttttggtttt 551 tatcgcaagg atgggcatac cccgtgatgg cggtgatgac gctgatcggc 601 tttttcggcg gattttttctc cgttccgctc tataccctggc tgcaaaccgc 651 cagcagcgag actttccgcg cccgcgccgt tgccgccaac aatatcgtta 701 acggcatctt tatggtttcc gccgccgttt tgagcgcggt attgctgttt 751 ttgtttgaca gcatttccct gctgtatctg attgtcgcct tgggcaatat
```

-continued

```
801 tccgttggcg gtatttttga ttaagcgcga aaggcggttt ttaggcgcgg 851 cggcaatcag gaaaaaacct tga
```

This corresponds to the amino acid sequence <SEQ ID 852; ORF 232.ng>:

```
g232.pep
  1 MMGNSLIESG TFVAILFGQI LGTAVAGAPP YIVGILVLLV AVGGTAGSLF

51 MPSVPAKAAD TQIEWNIVRG TKSLLRETVR HNPVFTAIIG ISWFWFVGAV

101 YTTQLPTFTQ IHLGGNDNVF NLMLALFSIG IAAGSVLCAK FGRERLMLAW

151 VTVGALGSTV CGLVLVWLTH GHRFEGLNGI FWFLSQGWAY PVMAVMTLIG

201 FFGGFFSVPL YTWLQTASSE TFRARAVAAN NIVNGIFMVS AAVLSAVLLF

251 LFDSISLLYL IVALGNIPLA VFLIKRERRF LGAAAIRKKP *
```

The following partial DNA sequence was identified in *N. meningitidis* <SEQ ID 853>:

```
m232.seq
  1 ATGATGGGCA ACAGCCTGAT TGAATCGGGT ACGTTTGTCG CCATCCTGTT

51 CGGTCAGATT TTGGGAACGG CGGTGGCAGG TGTACCGCCT TATATTGTCG

101 GGATACTGGT TTTGCTGGTC GCCGTCGGAG GCACGGTCGG CAGCCTGTTT

151 ATGCCGTCCG TACCCGCCAA GGCTGCCGAT ACACAAATTG AGTGGAATAT

201 TGTCCGTGGC ACAAAATCCC TGCTGCGTGA AACGGTGCGG CACAAGCCCG

251 TTTTTACCGC CATTATCGGT ATTTCGTGGT TTTGGTTTGT CGGCGCGGTT

301 TATACCACGC AACTGCCGAC CTTTACCCAA ATCCATCTGG GCGGCAACGA

351 CAATGTTTTC AACCTGATGC TTGCTCTGTT TTCCATCGGT ATTGCCGCCG

401 GTTCGGTACT GTGTGCCAAG TTCAGCAkGG AACGCCTGAT GTTGGCTTGG

451 GTAACGGTTG GTGCGTTGGG TTTGACGGTT TGCGGCTTGG TTTTGGTGTG

501 GCTGACGCAC GGACACCGTT TGAAGGGCT GAACGGCATT TTTTrGTTTT

551 TATCGCAAGG ATGGGCATAT CCCGTGATGG CGGTGATGAC GCTGATCGGC

601 TTTTTCGGCG GATTTTTCTC CGTTCCGCTC TATACCt(g)TG CAAACCGCCa

651 TAGCGAGaTT TCCGCGCCCg GCCGTTGCCG CCAACAATAT CGTTAACGGT

701 ATTTTTATGG TTTCCGCTGC CGTTTTGAGC GCGGTGTTGC TGTTTTTGTT

751 TGACAGCATT TCCTTGTTGT ATCTGATTGT CGCTTTGGGC AATATTCCGT

801 TGTCGGTATT TTTGATTAAG CGCGAAAGGC GGTTTTTAGG CGCGGCGGCA

851 ATCAGGAAAA AACCTTGA
```

This corresponds to the amino acid sequence <SEQ ID 854; ORF 232>:

```
m232.pep
  1 MMGNSLIESG TFVAILFGQI LGTAVAGVPP YIVGILVLLV AVGGTVGSLF

51 MPSVPAKAAD TQIEWNIVRG TKSLLRETVR HKPVFTAIIG ISWFWFVGAV

101 YTTQLPTFTQ IHLGGNDNVF NLMLALFSIG IAAGSVLCAK FSXERLMLAW

151 VTVGALGLTV CGLVLVWLTH GHRFEGLNGI FXFLSQGWAY PVMAVMTLIG
```

-continued

```
201 FFGGFFSVPL YTVQTAIARF PRPAVAANNI VNGIFMVSAA VLSAVLLFLF

251 DSISLLYLIV ALGNIPLSVF LIKRERRFLG AAAIRKKP*
```

Computer analysis of this amino acid sequence gave the following results:
Homology with a Predicted ORF from *N. gonorrhoeae*
ORF 232 shows 94.1% identity over a 290 aa overlap with a predicted ORF (ORF 232.ng) from *N. gonorrhoeae*:

```
   m232/g232

10         20         30         40         50         60
       m232.pep  MMGNSLIESGTFVAILFGQILGTAVAGVPPYIVGILVLLVAVGGTVGSLFMPSVPAKAAD
                 ||||||||||||||||||||||||||||:|||||||||||||||||:|||||||||||||
           g232  MMGNSLIESGTFVAILFGQILGTAVAGAPPYIVGILVLLVAVGGTAGSLFMPSVPAKAAD
                     10         20         30         40         50         60

70         80         90        100        110        120
       m232.pep  TQIEWNIVRGTKSLLRETVRHKPVFTAIIGISWFWFVGAVYTTQLPTFTQIHLGGNDNVF
                 |||||||||||||||||||||||:||||||||||||||||||||||||||||||||||||
           g232  TQIEWNIVRGTKSLLRETVRHNPVFTAIIGISWFWFVGAVYTTQLPTFTQIHLGGNDNVF
                     70         80         90        100        110        120

130        140        150        160        170        180
       m232.pep  NLMLALFSIGIAAGSVLCAKFSXERLMLAWVTVGALGLTVCGLVLVWLTHGHRFEGLNGI
                 ||||||||||||||||||||||| :|||||||||||||||||:|||||||||||||||||
           g232  NLMLALFSIGIAAGSVLCAKFGRERLMLAWVTVGALGSTVCGLVLVWLTHGHRFEGLNGI
                    130        140        150        160        170        180

190        200        210        220        230
       m232.pep  FXFLSQGWAYPVMAVMTLIGFFGGFFSVPLYT-VQTAIARFPRP-AVAANNIVNGIFMVS
                 | |||||||||||||||||||||||||||||| :|||  ::  |  |||||||||||||
           g232  FWFLSQGWAYPVMAVMTLIGFFGGFFSVPLYTWLQTASSETFRARAVAANNIVNGIFMVS
                    190        200        210        220        230        240

240        200        210        220        230
       m232.pep  AAVLSAVLLFLFDSISLLYLIVALGNIPLSVFLIKRERRFLGAAAIRKKPX
                 |||||||||||||||||||||||||||||:|||||||||||||||||||||
           g232  AAVLSAVLLFLFDSISLLYLIVALGNIPLAVFLIKRERRFLGAAAIRKKP
                    250        260        280        280        290
```

The following partial DNA sequence was identified in *N. meningitidis* <SEQ ID 855>:

```
a232.seq
   1 ATGTACGCTA AAAAAGGCGG TTTGGGACTG GTTAAAAGCC GCCGTTTCGC

51 ACCTCTTTTC GCTACGCAGT TTCTCGGCGC GTTCAACGAC AATGTGTTCA

101 AAACCGCGCT GTTTGTGATG ATTGGGTTTT ACGGTTTGGG GCAAAACGGC

151 TTCCTGCCTG CCGGACAGAT GTTGAACTTG GGCGCGTTGC TGTTTATTTT

201 GCCGTATTTC CTGTTTTCCT CGCTGTCGGG GCAGTTGGGT AACAAATTCG

251 ACAAGGCCGT TTTGGCGCGT TGGGCCAAGG TGCTGGAAAT GATCATTATG

301 GCGGTGGCGG CATACGGGTT TTATATCCGG TCTGCCCCGC TGCTTTTGGC

351 GTGTCTGTTT TGCATGGGCG CGCAATCGAC GCTGTTCGGG CCGCTGAAAT

401 ACGCCATCCT GCCCGATTAT CTCGACGACA AAGAGTTGAT GATGGGCAAC

451 AGCCTGATTG AATCGGGTAC GTTTGTCGCC ATCCTGTTCG GTCAGATACT

501 GGGGACTGCG GTGGCAGGTG TACCGCCTTA TATTGTCGGG ATACTGGTTT

551 TGCTGGTCGC CGTAGGAGGC ACGGTCGGCA GCCTGTTTAT GCCGTCCGTA

601 CCCGCCAAGG CTGCCGATAC ACAAATTGAG TGGAATATTG TCCGGGGTAC

651 AAAATCCCTG CTGCGTGAAA CGGTGCGGCA CAAGCCCGTT TTTACCGCCA

701 TTATCGGTAT TTCGTGGTTT TGGTTTGTCG GCGCGGTTTA TACCACGCAA

751 CTGCCGACCT TTACCCAAAT CCATCTAGGC GGCAACGACA ATGTTTTCAA
```

-continued

```
 801 CCTGATGCTT GCCCTGTTTT CCATCGGTAT TGCCGCCGGT TCGGTACTGT

851 GTGCCAAGTT CAGCAGGGAA CGGCTGAGGT TGGCTTGGGT AACGGTTGGT

901 GCGTTGGGTT TGACGGTTTG CGGCTTGGTT TTGGTGTGGC TGACGCACGG

951 ACACCGTTTT GAAGGGCTGA ACGGCATTTT TTGGTTTTTA TCGCAAGGAT

1001 GGGCATATCC CGTGATGGCG GTGATGACGC TGATCGGCTT TTTCGGCGGA

1051 TTTTTCTCCG TTCCGCTCTA TACCTGGCTG CAAACCGCCA GTAGCGAGAC

1101 TTTCCGCGCC CGCGCCGTTG CCGCCAACAA TATCGTTAAC GGTATTTTTA

1151 TGGTTTCCGC TGCCGTTTTG AGCGCGGTGT TGCTGTTTTT GTTTGACAGC

1201 ATTTCCTTGT TGTATCTGAT TGTCGCTTTG GGCAATATTC CGTTGTCGGT

1251 ATTTTTGATT AAGCGCGAAA GGCGGTTTTT AGGCGCGGCG GCAATCAGGA

1301 AAAAACCTTG A
```

This corresponds to the amino acid sequence <SEQ ID 856; ORF 232.a>:

```
a232.pep
  1 MYAKKGGLGL VKSRRFAPLF ATQFLGAFND NVFKTALFVM IGFYGLGQNG

51 FLPAGQMLNL GALLFILPYF LFSSLSGQLG NKFDKAVLAR WAKVLEMIIM

101 AVAAYGFYIR SAPLLLACLF CMGAQSTLFG PLKYAILPDY LDDKELMMGN

151 SLIESGTFVA ILFGQILGTA VAGVPPYIVG ILVLLVAVGG TVGSLFMPSV

201 PAKAADTQIE WNIVRGTKSL LRETVRHKPV FTAIIGISWF WFVGAVYTTQ

251 LPTFTQIHLG GNDNVFNLML ALFSIGIAAG SVLCAKFSRE RLRLAWVTVG

301 ALGLTVCGLV LVWLTHGHRF EGLNGIFWFL SQGWAYPVMA VMTLIGFFGG

351 FFSVPLYTWL QTASSETFRA RAVAANNIVN GIFMVSAAVL SAVLLFLFDS

401 ISLLYLIVAL GNIPLSVFLI KRERRFLGAA AIRKKP*
``` m232/a232 95.9% identity in 290 aa overlap

```
                                      10        20        30
     m232.pep                    MMGNSLIESGTFVAILFGQILGTAVAGVPP
                                 ||||||||||||||||||||||||||||||
     a232     ACLFCMGAQSTLFGPLKYAILPDYLDDKELMMGNSLIESGTFVAILFGQILGTAVAGVPP
                    120       130       140       150       160       170

40        50        60        70        80        90
     m232.pep YIVGILVLLVAVGGTVGSLFMPSVPAKAADTQIEWNIVRGTKSLLRETVRHKPVFTAIIG
              ||||||||||||||||||||||||||||||||||||||||||||||||||||||||||||
     a232     YIVGILVLLVAVGGTVGSLFMPSVPAKAADTQIEWNIVRGTKSLLRETVRHKPVFTAIIG
                    180       190       200       210       220       230

100       110       120       130       140       150
     m232.pep ISWFWFVGAVYTTQLPTFTQIHLGGNDNVFNLMLALFSIGIAAGSVLCAKFSXERLMLAW
              |||||||||||||||||||||||||||||||||||||||||||||||||||   |||
     a232     ISWFWFVGAVYTTQLPTFTQIHLGGNDNVFNLMLALFSIGIAAGSVLCAKFSRERLRLAW
                    240       250       260       270       280       290

160       170       180       190       200       210
     m232.pep VTVGALGLTVCGLVLVWLTHGHRFEGLNGIFXGLSQGWAYPVMAVMTLIGFFGGFFSVPL
              ||||||||||||||||||||||||||||||||  ||||||||||||||||||||||||||
     a232     VTVGALGLTVCGLVLVWLTHGHRFEGLNGIFWGLSQGWAYPVMAVMTLIGFFGGFFSVPL
                    300       310       320       330       340       350

220       230       240       250       260
     m232.pep YY-VQTAIARFPRP-AVAANNIVNGIFMVSAAVLSAVLLFLFDSISLLYLIVALGNIPLS
              || :|||  ::  | ||||||||||||||||||||||||||||||||||||||||||||
     a232     YTWLQTASSETFRARAVAANNIVNGIFMVSAAVLSAVLLFLFDSISLLYLIVALGNIPLS
                    360       370       380       390       400       410
```

```
                    270        280       289
    m232.pep  VFLIKRERRFLGAAAIRKKPX
              |||||||||||||||||||||
         a232 VFLIKRERRFLGAAAIRKKPX
                    420        430
```

The following partial DNA sequence was identified in *N. gonorrhoeae* <SEQ ID 857>:

```
g233.seq
    1  atgaaacgca aaaatatcgc gctgattccc gccgccggca tcggggtgcg 51  tttcggtgcg gacaaaccca agcaatatgt cgaaatcgga agcaaaaccg 101  ttttagaaca tgtacttggg atttttgaac ggcatgaggc cgtcgatttg 151  accgtcgttg tcgtctcgcc cgaagacacg tttgccgata aggttcagac 201  ggcatttcca caggttcggg tgtggaaaaa cggtggacag acccgcgccg 251  aaactgtccg caacggtgtg gcaaaactgt tggaaaccgg tttggcggcg 301  gaaaccgaca atattctggt acacgatgcc gcccgctgct gcctgccgtc 351  tgaagctctg gcgcggttga tagaacaggc gggcaacgcc gccgaaggcg 401  ggattttggc agttcccgtt gccgatacgc tcaagcgcgc agaaagcgga 451  caaatcagtg caactgtcga ccgttcgggg ctttggcagg cgcaaacgcc 501  gcagcttttt caagcgggtt tgctgcaccg cgcattggct gcggaaaact 551  tgggcggcat taccgatgaa gcgtccgccg tggaaaaact gggtgtgcgt 601  ccgctactga tacagggcga cgcgcgcaat ttgaaactga cgcagccgca 651  ggacgcatac atcgtcaggc tgctgctcaa tgccgtctga
```

This corresponds to the amino acid sequence <SEQ ID 858; ORF 233.ng>:

```
g233.pep
    1  MKRKNIALIP AAGIGVRFGA DKPKQYVEIG SKTVLEHVLG IFERHEAVDL

51  TVVVVSPEDT FADKVQTAFP QVRVWKNGGQ TRAETVRNGV AKLLETGLAA

101  ETDNILVHDA ARCCLPSEAL ARLIEQAGNA AEGGILAVPV ADTLKRAESG

151  QISATVDRSG LWQAQTPQLF QAGLLHRALA AENLGGITDE ASAVEKLGVR

201  PLLIQGDARN LKLTQPQDAY IVRLLLNAV*
```

The following partial DNA sequence was identified in *N. meningitidis* <SEQ ID 859>:

```
m233.seq (partial)
    1  ATGAAGCGCA AAAATATCGC GCTGATTCCC GCCGCCGGCA TCGGGGCGCG

51  TTTCGGTGCG GACAAACCCA AGCAATATGT CGAAATCGGA AGCAAAACCG

101  TTTTAGAACA TACGATTGGG ATTTTTGAAC GGCATGAGGC CGTCGATTTG

151  ACCGTCGTTG TCGTCTCGCC CGAAGACACG TTTGCCGATA AGGTTCAGAC

201  GGCATTTCCA CAGGTTCGGG TGTGGAAAAA CGGCGGACAG ACCCGCGCCG

251  AAACCGTCCG CAACGGTGTG GCAAAACTGT TGGAAACCGG TTTGGCGGCG

301  GAAACCGACA ATATTCTGGT ACACGATGCC GCGCGTTGCT GCCTGCCGTC

351  TGAAGCTTTG ACGCGGTTGA TAGAACAGGC GGGCAACGCC GCCGAAGGCG
```

-continued
```
401 GGATTTTGGC AATTCCCATT GCCGATACGC TCAAGTGCGC GGACGGTGGG

451 AACATT....
```

This corresponds to the amino acid sequence <SEQ ID 860; ORF 233>:

```
m233.pep (partial)
  1 MKRKNIALIP AAGIGARFGA DKPKQYVEIG SKTVLEHTIG IFERHEAVDL

51 TVVVVSPEDT FADKVQTAFP QVRVWKNGGQ TRAETVRNGV AKLLETGLAA

101 ETDNILVHDA ARCCLPSEAL TRLIEQAGNA AEGGILAIPI ADTLKCADGG

151 NI....
```

Computer analysis of this amino acid sequence gave the following results:
Homology with a Predicted ORF from *N. gonorrhoeae* 20
ORF 233 shows 93.4% identity over a 152 aa overlap with a predicted ORF (ORF 233.ng) from *N. gonorrhoeae*:

```
   m233/g233
                        10        20        30        40        50        60
        m233.pep  MKRKNIALIPAAGIGARFGADKPKQYVEIGSKTVLEHTIGIFERHEAVDLTVVVVSPEDT
                  ||||||||||||:|||||||||||||||||||||::||||||||||||||||||||||||
            g233  MKRKNIALIPAAGIGVRFGADKPKQYVEIGSKTVLEHVLGIFERHEAVDLTVVVVSPEDT
                        10        20        30        40        50        60

70        80        90       100       110       120
        m233.pep  FADKVQTAFPQVRVWKNGGQTRAETVRNGVAKLLETGLAAETDNILVHDAARCCLPSEAL
                  ||||||||||||||||||||||||||||||||||||||||||||||||||||||||||||
            g233  FADKVQTAFPQVRVWKNGGQTRAETVRNGVAKLLETGLAAETDNILVHDAARCCLPSEAL
                        70        80        90       100       110       120

130       140       150
        m233.pep  TRLIEQAGNAAEGGILAIPIADTLKCADGGNI
                  :|||||||||||||||:|:|||||  |::|:|
            g233  ARLIEQAGNAAEGGILAVPVADTLKRAESGQISATVDRSGLWQAQTPQLFQAGLLHRALA
                       130       140       150       160       170       180
```

The following partial DNA sequence was identified in *N. meningitidis* <SEQ ID 861>: 40

```
a233.seq
  1 ATGAAGCGCA AAAATATCGC GCTGATTCCC GCCGCCGGCA TCGGGGCGCG

51 TTTCGGTGCG GACAAACCCA AGCAATATGT CGAAATCGGA AGCAAAACCG

101 TTTTAGAACA TACGATTGGG ATTTTTGAAC GGCATGAGGC CGTCGATTTG

151 ACCGTCGTTG TCGTCTCGCC CGAAGACACG TTTGCCGATA AGGTTCAGAC

201 GGCATTTCCA CAGGTTCGGG TGTGGAAAAA CGGCGGACAG ACCCGCGCCG

251 AAACTGTCCG CAACGGTGTG GCAAAATTGT TGGAAACCGG TTTGGCGGCG

301 GAAACCGACA ATATTCTGGT ACACGATGCC GCGCGTTGCT GCCTGCCGTC

351 TGAAGCTTTG ACGCGGTTGA TAGAACAGGC GGGCAACGCT GCCGAAGGTG

401 GGATTTTGGC AATTCCCGTT GCCGATACGC TCAAGTGCGC GGACGGTGGG

451 AACATTAGTG CAACCGTCGA GCGGACGAGC CTTTGGCAGG CGCAAACGCC

501 GCAGCTTTTC CGCGCCGGGC TGCTGCACCG CGCATTGGCT GCGGAAAACT

551 TGGACGGCAT TACCGATGAA GCGTCCGCCG TGGAAAAATT GGGCATCCGC

601 CCTTTGCTGG TGCAGGGCGA CGCGCGCAAT TTGAAACTGA CGCAGCCGCA

651 GGACGCATAC ATCGTCAGGC TGCTGCTCGA TGCCGTCTGA
```

This corresponds to the amino acid sequence <SEQ ID 862; ORF 233.a>:

```
a233.pep
    1 MKRKNIALIP AAGIGARFGA DKPKQYVEIG SKTVLEHTIG IFERHEAVDL

51 TVVVVSPEDT FADKVQTAFP QVRVWKNGGQ TRAETVRNGV AKLLETGLAA

101 ETDNILVHDA ARCCLPSEAL TRLIEQAGNA AEGGILAIPV ADTLKCADGG

151 NISATVERTS LWQAQTPQLF RAGLLHRALA AENLDGITDE ASAVEKLGIR

201 PLLVQGDARN LKLTQPQDAY IVRLLLDAV*
``` m233/a233 99.3% identity in 152 aa overlap

```
                 10         20         30         40         50         60
m233.pep MKRKNIALIPAAGIGARFGADKPKQYVEIGSKTVLEHTIGIFERHEAVDLTVVVVSPEDT
         ||||||||||||||||||||||||||||||||||||||||||||||||||||||||||||
a233     MKRKNIALIPAAGIGARFGADKPKQYVEIGSKTVLEHTIGIFERHEAVDLTVVVVSPEDT
                 10         20         30         40         50         60
                 70         80         90        100        110        120
m233.pep FADKVQTAFPQVRVWKNGGQTRAETVRNGVAKLLETGLAAETDNILVHDAARCCLPSEAL
         ||||||||||||||||||||||||||||||||||||||||||||||||||||||||||||
a233     FADKVQTAFPQVRVWKNGGQTRAETVRNGVAKLLETGLAAETDNILVHDAARCCLPSEAL
                 70         80         90        100        110        120
                130        140        150
m233.pep TRLIEQAGNAAEGGILAIPIADTLKCADGGNI
         |||||||||||||||||||:|||||||||||| 
a233     TRLIEQAGNAAEGGILAIPVADTLKCADGGNISATVERTSLWQAQTPQLGRAGLLHRALA
                130        140        150        160        170        180 a233     AENLDGITDEASAVEKLGIRPLLVQGDARNLKLTQPQDAYIVRLLLDAVX
                190        200        210        220        230
```

The following partial DNA sequence was identified in *N. gonorrhoeae* <SEQ ID 863>:

```
g234.seq
    1 atgaaaaccg tttccgccgc catcgctttt gccgccgctg ccgtttcact 51 gaccggctgt gcgaccgagt cctcacgcag cctcgaggtt gcaaaagtcg 101 cctcctgcaa tacgcaatat cacggtgttc gcaccccgat ttccgtcgga 151 acattcgaca accgctccag cttccaaaaa ggcattttct ccgacagtga 201 agaccgtctg ggcagccagg caaaaaccat cctggtaaca cacctgcaac 251 aaaccaaccg cttcaacgta ctgaaccgca ccaaccttag cgcattgaaa 301 caggaatccg gcatttccgg caaagcgcag aacctgaaag cgcagatta 351 tgtcgttacc ggcgatgtaa ccgaattcgg acgcagagat gtcggcgatc 401 atcagctctt cggcattttg ggtcgcggca atcgcaaat cgcctatgca 451 aaagtggctc tgaatatcgt caacgtcaat acttccgaaa tcgtctattc 501 cacacagggc gcgggcgaat acgcactttc caaccgcgaa atcatcggtt 551 tcggcggcac ttccggctac gatgcgactt tgaacggcaa agttttagac 601 ttggcaatcc gcgaagccgt cgacaacttg gttcaggctg tcgacaacgg 651 cgcatggcaa tccaaccgtt aa
```

This corresponds to the amino acid sequence <SEQ ID 864; ORF 234.ng>:

```
g234.pep
    1 MKTVSAAIAF AAAAVSLTGC ATESSRSLEV AKVASCNTQY HGVRTPISVG

51 TFDNRSSFQK GIFSDSEDRL GSQAKTILVT HLQQTNRFNV LNRTNLSALK

101 QESGISGKAQ NLKGADYVVT GDVTEFGRRD VGDHQLFGIL GRGKSQIAYA

151 KVALNIVNVN TSEIVYSTQG AGEYALSNRE IIGFGGTSGY DATLNGKVLD

201 LAIREAVDNL VQAVDNGAWQ SNR*
```

The following partial DNA sequence was identified in *N. meningitidis* <SEQ ID 865>:

```
m234.seq (partial)
    1 ...GGCGCGGGCG AATACGCACT TTCCAACCGt GAAATCATCG GTTTCGGCGG

51 CACTTCCGGC TACGATGCGA CTTTGAACGG CAAAGTTTTA GACTTGGCAA

101 TCCGCGAAGC .gTCAACAGC CTGGTTCAGG CTGTTGACAA CGGCGCATGG

151 CAACCCAACC GTTAA
```

This corresponds to the amino acid sequence <SEQ ID 866; ORF 234>:

```
m234.pep (partial)
    1 ..GAGEYALSNR EIIGFGGTSG YDATLNGKVL DLAIREAVNS LVQAVDNGAW

51 QPNR*
```

Computer analysis of this amino acid sequence gave the following results:
Homology with a Predicted ORF from *N. gonorrhoeae*
ORF 234 shows 94.4% identity over a 54 aa overlap with a predicted ORF (ORF 234.ng) from *N. gonorrhoeae*:

```
m234/g234

10         20         30
    m234.pep                                 GAGEYALSNREIIGFGGTSGYDATLNGKVL
                                             ||||||||||||||||||||||||||||||
    g234       LGRGKSQIAYAKVALNIVNVNTSEIVYSTQGAGEYALSNREIIGFGGTSGYDATLNGKVL
                   140       150       160       170       180       190
                      40         50
    m234.pep    DLAIREAVNSLVQAVDNGAWQPNRX
                ||||||||::|||||||||| |||
    g234        DLAIREAVDNLVQAVDNGAWQSNRX
                   200       210       220
```

The following partial DNA sequence was identified in *N. meningitidis* <SEQ ID 867>:

```
a234.seq (partial)
    1 AACCGCACCT ATTTGAACGC ATTAAAACAG GAATCCGGCA TTTCCGGCAA

51 AGCGCATAAC CTGAAAGGCG CAAATTATGT CGNNACCGGC GATGTAACCG

101 AATTCGGACG CANAGATGTC GGCGATCATC AGCTCTTCGG CATTTTGGGT

151 CGCGGCAAAT CGCAAATCGC CTATGCAAAA GTGGCTCTGA ATATCGTCAA

201 CGTCAATACT TCCGAAATCG TCTATTCCGC ACAGGGCGCG GGCGAATACG

251 CACTTTCCAA CCGTGAAATC ATCGGTTTCG GCGGCACTTC CGGCTACGAT
```

```
-continued
301 GCGACTTTGA ACGGCAAAGT TTTAGACTTG GCAATCCGCG AAGCCGTCAA

351 CAGCCTGGTT CAGGCTGTTG ACAACGGCGC ATGGCAACCC AACCGTTAA
```

This corresponds to the amino acid sequence <SEQ ID 868; ORF 234.a>:

```
a234.pep (partial)
  1 NRTYLNALKQ ESGISGKAHN LKGANYVXTG DVTEFGRXDV GDHQLFGILG

51 RGKSQIAYAK VALNIVNVNT SEIVYSAQGA GEYALSNREI IGFGGTSGYD

101 ATLNGKVLDL AIREAVNSLV QAVDNGAWQP NR*
``` m234/a234 100.0% identity in 54 aa overlap

```
                                        10        20        30
   m234.pep                        GAGEYALSNREIIGFGGTSGYDATLNGKVL
                                   ||||||||||||||||||||||||||||||
   a234     LGRGKSQIAYAKVALNIVNVNTSEIVYSAQGAGEYALSNREIIGFGGTSGYDATLNGKVL
                    50        60        70        80        90       100

40        50
   m234.pep     DLAIREAVNSLVQAVDNGAWQPNRX
                |||||||||||||||||||||||||
   a234         DLAIREAVNSLVQAVDNGAWQPNRX
                   110       120       130
```

The following partial DNA sequence was identified in *N. gonorrhoeae* <SEQ ID 869>:

```
g235.seq
  1 atgaaacctt tgattttagg gcttgccgcc gtgttggctc tgtctgcctg 51 ccaagttcga aaagctcccg acctcgacta cacgtcattc aaagaaagca 101 aaccggcttc aattttggtg gttccgccgc tgaacgagtc gcctgatgtc 151 aacggcactt gggggatgct ggcttcgacc gccgcgccga tttccgaagc 201 cggctattac gtctttcccg ccgcagtcgt ggaggaaacc ttcaaagaaa 251 acggcttgac caatgccgcc gatattcacg ccgtccggcc ggaaaaactg 301 catcaaattt tcggcaatga tgcggttttg tacattacgg ttaccgaata 351 cggcacttca tatcaaattt tagacagcgt gacgaccgta tccgccaaag 401 cacggctggt cgattccgc aacgggaaag agttgtggtc gggttcggcc 451 agcatccgcg aaggcagcaa caacagcaac agcggcctgt tggggctttt 501 ggtcggcgca gtggtcaatc agattgccaa cagcctgacc gaccgcggtt 551 atcaggtttc caaaaccgcc gcatacaacc tactgtcgcc ctattcccgc 601 aacggtatct tgaaaggtcc gagattcgtc gaagagcagc ccaaataa
```

This corresponds to the amino acid sequence <SEQ ID 870; ORF 235.ng>:

```
g235.pep
  1 MKPLILGLAA VLALSACQVR KAPDLDYTSF KESKPASILV VPPLNESPDV

51 NGTWGMLAST AAPISEAGYY VFPAAVVEET FKENGLTNAA DIHAVRPEKL

101 HQIFGNDAVL YITVTEYGTS YQILDSVTTV SAKARLVDSR NGKELWSGSA
```

```
151 SIREGSNNSN SGLLGALVGA VVNQIANSLT DRGYQVSKTA AYNLLSPYSR

201 NGILKGPRFV EEQPK*
```

The following partial DNA sequence was identified in *N. meningitidis* <SEQ ID 871>:

```
m235.seq
  1 ATGAAACCTT TGATTTTAGG GCTTGCCGCC GTGTTGGCGC TGTCTGCCTG

51 CCAAGTTCAA AAAGCGCCCG ATTTCGACTA CACGTCATTC AAGGAAAGCA

101 AACCGGCTTC AATTTTGGTG GTTCCGCCGC TGAACGAATC GCCCGATGTC

151 AACGGAACAT GGGGTGTACT GGCTTCGACC GCCGCGCCGC TTTCCGAAGC

201 CGGCTATTAC GTCTTCCCCG CCGCAGTCGT GGAGGAAACC TTCAAACAAA

251 ACGGCTTGAC CAATGCCGCC GATATTCACG CCGTCCGGCC GGAAAAACTG

301 CATCAGATTT TCGGCAATGA TGCGGTTTTG TACATTACGG TTACCGAATA

351 CGGCACTTCA TATCAAATTT TAGACAGCGT GACGACCGTA TCCGCCAAAG

401 CACGGCTGGT CGATTCCCGC AACGGAAAAG AGTTGTGGTC GGGTTCGGCC

451 AGCATCCGCG AAGGCAGCAA CAACAGCAAC AGCGGCCTGT TGGGGGCTTT

501 GGTCAGCGCA GTGGTCAATC AGATTGCCAA CAGCCTGACC GACCGCGGTT

551 ATCAGGTTTC CAAAACCGCC GCATACAACC TGCTGTCGCC CTATTCTCAC

601 AACGGCATCT TGAAAGGTCC GAGATTCGTT GAAGAGCAGC CCAAATAA
```

This corresponds to the amino acid sequence <SEQ ID 872; ORF 235>:

```
m235.pep
  1 MKPLILGLAA VLALSACQVQ KAPDFDYTSF KESKPASILV VPPLNESPDV

51 NGTWGVLAST AAPLSEAGYY VFPAAVVEET FKQNGLTNAA DIHAVRPEKL

101 HQIFGNDAVL YITVTEYGTS YQILDSVTTV SAKARLVDSR NGKELWSGSA

151 SIREGSNNSN SGLLGALVSA VVNQIANSLT DRGYQVSKTA AYNLLSPYSH

201 NGILKGPRFV EEQPK*
```

Computer analysis of this amino acid sequence gave the following results:
Homology with a Predicted ORF from *N. gonorrhoeae*
ORF 235 shows 96.7% identity over a 215 aa overlap with a predicted ORF (ORF 235.ng) from *N. gonorrhoeae*:

```
    m235/g235

10         20         30         40         50         60
       m235.pep   MKPLILGLAAVLALSACQVQKAPDFDYTSFKESKPASILVVPPLNESPDVNGTWGVLAST
                  ||||||||||||||||||||:||||:|||||||||||||||||||||||||||||:||||
       g235       MKPLILGLAAVLALSACQVRKAPDLDYTSFKESKPASILVVPPLNESPDVNGTWGMLAST
                      10         20         30         40         50         60

70         80         90        100        110        120
       m235.pep   AAPLSEAGYYVFPAAVVEETFKQNGLTNAADIHAVRPEKLHQIFGNDAVLYITVTEYGTS
                  |||:||||||||||||||||||:|||||||||||||||||||||||||||||||||||||
       g235       AAPISEAGYYVFPAAVVEETFKENGLTNAADIHAVRPEKLHQIFGNDAVLYITVTEYGTS
                      70         80         90        100        110        120

130        140        150        160        170        180
       m235.pep   YQILDSVTTVSAKARLVDSRNGKELWSGSASIREGSNNSNSGLLGALVSAVVNQIANSLT
                  ||||||||||||||||||||||||||||||||||||||||||||||||||:|||||||||
       g235       YQILDSVTTVSAKARLVDSRNGKELWSGSASIREGSNNSNSGLLGALVGAVVNQIANSLT
                     130        140        150        160        170        180
```

-continued

```
               190        200        210
m235.pep   DRGYQVSKTAAYNLLSPYSHNGILKGPRFVEEQPKX
           ||||||||||||||||||:||||||||||||||||
g235       DRGYQVSKTAAYNLLSPYSRNGILKGPRFVEEQPKX
               190        200        210
```

The following partial DNA sequence was identified in *N. meningitidis* <SEQ ID 873>:

```
a235.seq
   1 ATGAAACCTT TGATTTTAGG GCTTGCCGCC GTGTTGGCGC TGTCTGCCTG

51 CCAAGTTCAA AAAGCGCCCG ATTTCGACTA CACGTCATTC AAGGAAAGCA

101 AACCGGCTTC AATTTTGGTG GTTCCGCCGC TGAACGAATC GCCCGATGTC

151 AACGAACAT GGGGTGTACT GGCTTCGACC GCCGCGCCGC TTTCCGAAGC

201 CGGCTATTAC GTCTTCCCCG CCGCAGTCGT GGAGGAAACC TTCAAACAAA

251 ACGGCTTGAC CAATGCCGCC GATATTCACG CCGTCCGGCC GGAAAAACTG

301 CATCAGATTT TCGGCAATGA TGCGGTTTTG TACATTACGG TTACCGAATA

351 CGGCACTTCA TATCAAATTT TAGACAGCGT GACGACCGTA TCCGCCAAAG

401 CACGGCTGGT CGATTCCCGC AACGGAAAAG AGTTGTGGTC GGGTTCGGCC

451 AGCATCCGCG AAGGCAGCAA CAACAGCAAC AGCGGCCTGT TGGGGCTTT

501 GGTCAGCGCA GTGGTCAATC AGATTGCCAA CAGCCTGACC GACCGCGGTT

551 ATCAGGTTTC TAAAACCGCC GCATACAACC TGCTGTCGCC CTATTCTCAC

601 AACGGCATCT TGAAAGGTCC GAGATTCGTC GAAGAGCAGC CCAAATAA
```

This corresponds to the amino acid sequence <SEQ ID 874; ORF 235.a>:

```
a235.pep.
   1 MKPLILGLAA VLALSACQVQ KAPDFDYTSF KESKPASILV VPPLNESPDV

51 NGTWGVLAST AAPLSEAGYY VFPAAVVEET FKQNGLTNAA DIHAVRPEKL

101 HQIFGNDAVL YITVTEYGTS YQILDSVTTV SAKARLVDSR NGKELWSGSA

151 SIREGSNNSN SGLLGALVSA VVNQIANSLT DRGYQVSKTA AYNLLSPYSH

201 NGILKGPRFV EEQPK*
``` m235/a235 100.0% identity in 215 aa overlap

```
                    10         20         30         40         50         60
m235.pep  MKPLILGLAAVLALSACQVQKAPDFDYTSFKESKPASILVVPPLNESPDVNGTWGVLAST
          ||||||||||||||||||||||||||||||||||||||||||||||||||||||||||||
a235      MKPLILGLAAVLALSACQVQKAPDFDYTSFKESKPASILVVPPLNESPDVNGTWGVLAST
                    10         20         30         40         50         60

70         80         90        100        110        120
m235.pep  AAPLSEAGYYVFPAAVVEETFKQNGLTNAADIHAVRPEKLHQIFGNDAVLYITVTEYGTS
          ||||||||||||||||||||||||||||||||||||||||||||||||||||||||||||
a235      AAPLSEAGYYVFPAAVVEETFKQNGLTNAADIHAVRPEKLHQIFGNDAVLYITVTEYGTS
                    70         80         90        100        110        120

130        140        150        160        170        180
m235.pep  YQILDSVTTVSAKARLVDSRNGKELWSGSASIREGSNNSNSGLLGALVSAVVNQIANSLT
          ||||||||||||||||||||||||||||||||||||||||||||||||||||||||||||
a235      YQILDSVTTVSAKARLVDSRNGKELWSGSASIREGSNNSNSGLLGALVSAVVNQIANSLT
                   130        140        150        160        170        180

190        200        210
m235.pep  DRGYQVSKTAAYNLLSPYSHNGILKGPRFVEEQPKX
          |||||||||||||||||||||||||||||||||||
a235      DRGYQVSKTAAYNLLSPYSHNGILKGPRFVEEQPKX
                   190        200        210
```

The following partial DNA sequence was identified in *N. gonorrhoeae* <SEQ ID 875>:

```
g236.seq
    1 ATGGCGCGTT TCGCCTTCTC CGCCGACATT CTCCGCACAG CGTTTGCAGA

51 CGGTTTCATA ACCTGCAACC GCGCCCACAT CGCGGGTGTA ATGCCAGCAG

101 CGTTCGCATT TTTCGCCGTC GCTGGCTTTG GCGGCAACGG CAAGTTCATC

151 ACCGACTTTC ACTTCTGCTT TAGACACCAG CAGGGCAAAG CGCAATTCTT

201 CGCCCAAAGC ATTCAGATAG CCGGCCATTT CTTCCGGCGC GGTAATTTCG

251 GCTTCCGCCT GCAAggacga accgacagTT TTGTCggcGC GCAAAGGCTC

301 GAtagcggcg gTTACTGCTT CGCGCGCTTC GCGGATTGCC GTCCATTTTT

351 TCACCAGTTC GGCTTCGGCT TTTTCGTTGA TGGCCGGGAA CTCGTGCCAA

401 GTATGGAAGA GGACGCTGTC TTCTTCGCCG CCGCCGATGA TGTCCCACGC

451 TTCTTCGCCG GTGAAGCACA AAATCGGTGC AATCAAGAGA ACCAGGCTGC

501 GCGTGATGTG GTACAGGGCG GTTTGCGCGC TGCGGCGGGC GCGGCTGTCG

551 GCTTTGGTGG TGTAGAGGCG GTCTTTCAGG ATGTCGAGGT AGAACGCGCC

601 CAAGTCTTCC GAGCAGAAAG AAACAATGTC TTTCACGGCG AAGTGGAAGG

651 CATAGCGCGG ATAGTAACCG CCTGCCAAAC GCTCTTGCAG CCGCCGCGCC

701 AATACCAAGG CGTAGCGGTC GATTTCCACC ATATCCGCCT GTTGCACGGC

751 ATCTTCAATC GGATTAAAGT CGCTCAAATT GGCAAAcagG AAGCTCAAGG

801 TATTGCGGAT GCGGCGGTAG CTTTCGGTAA CGCGTTTGAG GATTTCTTTG

851 GAAatcgCCA ATtcgccgct gTAATCGGTG GATGCCGCCC ACAGGCGCAG

901 GATGTCCGCG CCGAATTCGT TATAGACTTC CTGCGGCGCG ACGACGTTGC

951 CGATGGATTT CGACATTTTG CGGCCGTTTT GGTCAACCAC GAAACCGTGG

1001 GTCAGCAGCT GTTTATACGG TGCGCGTCCC ATGGATGA
```

This corresponds to the amino acid sequence <SEQ ID 876; ORF 236.ng>:

```
g236.pep
    1 MARFAFSADI LRTAFADGFI TCNRAHIAGV MPAAFAFFAV AGFGGNGKFI

51 TDFHFCFRHQ QGKAQFFAQS IQIAGHFFRR GNFGFRLQGR TDSFVGAQRL

101 DSGGYCFARF ADCRPFFHQF GFGFFVDGRE LVPSMEEDAV FFAAADDVPR

151 FFAGEAQNRC NQENQAARDV VQGGLRAAAG AAVGFGGVEA VFQDVEVERA

201 QVFRAERNNV FHGEVEGIAR IVTACQTLLQ PPRQYQGVAV DFHHIRLLHG

251 IFNRIKVAQI GKQEAQGIAD AAVAFGNAFE DFFGNRQFAA VIGGCRPQAQ

301 DVRAEFVIDF LRRDDVADGF RHFAAVLVNH ETVGQQLFIR CASHG*
```

The following partial DNA sequence was identified in *N. meningitidis* <SEQ ID 877>:

```
m236.seq (partial)
    1 ..TTGCACGGAC GAACCGACGG TTTTGTCGGC GCGCAAAGGC TCGATGGCGG

51     CGGTTACCGC TTCGCGGGCT TCGCGGATTG CCGTCCATTT TTTCACCAGT

101     TCGGCTTCGG TTTTTTCGTT GATGGTCGGG AACTCGTGCC AAGTATGGAA

151     GAGGACGCTG TCKTCTTCGC CGCCGCCGwT GAyGTCCCAC GCTTCTTCGC
```

```
-continued
201  CGGTGAAGCA CAAAATCGGT GCAATCAAGA GAACCAAACT GCGTGTGATG

251  TGATACAGGG CAGTTTGTGC GCTGCGGCGT GCATGGCTGT CTGCTTTGGT

301  GGTGTAGAGG CGGTCTTTCA GGATGTCGAG GTAGAACGCA CCCAAGTCTT

351  CCGAGCAGAA AGAAACArTG TCTTTTACGG CAAAGTGGaA kGCATAACGC

401  GGATAGTAAT CGCCTGCCAG ACACTCTTGC AGCTGACGTG CCAATACCAC

451  GGCGTAGCGG TCGATTTCCA CCATATCCGC CTGTTGCACG GCATCTTCAA

501  TCGGATTAAA GTCGCTCAAG TTGGCAAACA AAAGCTCAA GGTATTGCGG

551  ATACGGCGGT AgCTTTCGGT TACGCGTTTG AGGATTTCTT TGGAAATCGC

601  CAATTCGCCG CTGTAATCGG TAGATGCCGC CCACAGGCGC AGGATGTCTG

651  CGCCGAATTC GTTATAAACC TCTTGCGGTG CAACGACGTT GCCGATGGAT

701  TTCGACATTT TTTTGCCTTC GCCGTCGACA ACGAAACCAT GGGTCAGCAG

751  CTGTTTATAC GGCGCGCGAC CCATTGA
```

This corresponds to the amino acid sequence <SEQ ID 878; ORF 236>:

```
m236.pep (partial)
  1  ..LHGRTDGFVG AQRLDGGGYR FAGFADCRPF FHQFGFGFFV DGRELVPSME

51  EDAVXFAAAX DVPRFFAGEA QNRCNQENQT ACDVIQGSLC AAACMAVCFG

101  GVEAVFQDVE VERTQVFRAE RNXVFYGKVE XITRIVIACQ TLLQLTCQYH

151  GVAVDFHHIR LLHGIFNRIK VAQVGKQKAQ GIADTAVAFG YAFEDFFGNR

201  QFAAVIGRCR PQAQDVCAEF VINLLRCNDV ADGFRHFFAF AVDNETMGQQ

251  LFIRRATH*
```

Computer analysis of this amino acid sequence gave the following results:
Homology with a Predicted ORF from *N. gonorrhoeae*
ORF 236 shows 82.9% identity over a 258 aa overlap with a predicted ORF (ORF 236.ng) from *N. gonorrhoeae*:

```
m236/g236

10        20        30
m236.pep                             LHGRTDGFVGAQRLDGGGYRFAGFADCRPF
                                     |:||||:||||||||:||| || ||||||||
g236     FRHQQGKAQFFAQSIQIAGHFFRRGNFGFRLQGRTDSFVGAQRLDSGGYCFARFADCRPF
         60        70        80        90       100       110

40        50        60        70        80        90
m236.pep  FHQFGFGFFVDGRELVPSMEEDAVXFAAAXDVPRFFAGEAQNRCNQENQTACDVIQGSLC
          ||||||||||||||||||||||||| ||||  |||||||||||||||||||||:| ||:||:|
g236      FHQFGFGFFVDGRELVPSMEEDAVFFAAADDVPRFFAGEAQNRCNQENQAARDVVQGGLR
          120       130       140       150       160       170

100       110       120       130       140       150
m236.pep  AAACMAVCFGGVEAVFQDVEVERTQVFRAERNXVFYGKVEXITRIVIACQTLLQLTCQYH
          ||| || ||||||||||||||:|||||||| ||:|:|| |:||| ||||||| ||:
g236      AAAGAAVGFGGVEAVFQDVEVERAQVFRAERNNVFHGEVEGIARIVTACQTLLQPPRQYQ
          180       190       200       210       220       230

160       170       180       190       200       210
m236.pep  GVAVDFHHIRLLHGIFNRIKVAQVGKQKAQGIADTAVAFGYAFEDFFGNRQFAAVIGRCR
          ||||||||||||||||||||||:|||:||||||:|||| |||||||||||| ||
g236      GVAVDFHHIRLLHGIFNRIKVAQIGKQEAQGIADAAVAFGNAFEDFFGNRQFAAVIGGCR
          240       250       260       270       280       290

220       230       240       250       259
m236.pep  PQAQDVCAEFVINLLRCNDVADGFRHFFAFAVDNETMGQQLFIRRATHX
          ||||||  ||||||::||  :|||||||||  |  |::|:||||||| |:|
g236      PQAQDVRAEFVIDFLRRDDVADGFRHFAAVLVNHETVGQQLFIRCASHG
          300       310       320       330       340
```

The following partial DNA sequence was identified in *N. meningitidis* <SEQ ID 879>:

```
a236.seq
   1 ATGGCGCGTT TCGCCTTCTC CGCCGACATT CTCTGCACAG CGTTTGCAGA
  51 CGGTTTCATG GCCTGCAACC GCGCCCACAT CGCGGGTGTA GTGCCAGCAG
 101 CGTTCGCATT TTTCACCATC ACTGGCTTTA GCGGCAACGG CAAGTTCGCT
 151 GCCTACTTTC ACTTCTGCTT TAGACACCAG CAAAGCAAAG CGCAATTCTT
 201 CGCCCAAAGC ATTCAGATAG CCGGCCATTT CTTCCGGCGC GGTAATTTCG
 251 GCTTCGGCTT GCAAGGACGA ACCGACGGTT TTGTCGGCGC GCAAAGGCTC
 301 GATGGCGGCG GTTACCGCTT CGCGGGCTTC GCGGATTGCC GTCCATTTTT
 351 TCACCAGTTC GGCTTCGGCT TTTTCGTTGA TGGTCGGGAA CTCGTGCCAA
 401 GTATGGAAAA GCACGCTGTC TTCTGCGCCG CCGCCGATGA TGTCCCACGC
 451 TTCTTCGCCG GTGAAGCACA AAATCGGTGC AATCAAGAGA ACCAGGCTGC
 501 GCGTGATGTG GTACAGGGCG GTTTGCGCGC TGCGGCGGGC GCGGCTGTCG
 551 GCTTTGGTGG TATAGAGGCG GTCTTTCAGG ATATCGAGGT AGAACGCGCC
 601 CAAGTCTTCC GAGCAGAAAG AAACCATTTC TTTCACGGCA AAGTGGAAGG
 651 CATAACGCGG ATAAAAATCA CCGGCAACGC GTTCTTGCAG CCGCCTTGCC
 701 AACACCAAGG CATAGCGGTC GATTTCCACC ATATCCGCCT GTTGCACGGC
 751 ATCTTCAATA GGATTGAAGT CGCTCAAGTT GGCAAACAAA AAGCTCAAGG
 801 TATTGCGGAT ACGGCGGTAG CTTTCGGTTA CGCGCTTGAG GATTTCTTTG
 851 GAAATCGCCA ATTCGCCGCT GTAATCGGTG GATGCCGCCC ACAGGCGCAG
 901 GATGTCCGCG CCGAACTCGT TATACACTTC TTGCGGCGCG ACGACGTTGC
 951 CGATGGATTT CGACATTTTG CGCCCGTTTT GATCCACCAC GAAACCATGG
1001 GTCAGCAGCT GTTTGTACGG CGCGCGACCC ATTGA
```

This corresponds to the amino acid sequence <SEQ ID 880; ORF 236.a>:

```
a236.pep
   1 MARFAFSADI LCTAFADGFM ACNRAHIAGV VPAAFAFFTI TGFSGNGKFA
  51 AYFHFCFRHQ QSKAQFFAQS IQIAGHFFRR GNFGFGLQGR TDGFVGAQRL
 101 DGGGYRFAGF ADCRPFFHQF GFGFFVDGRE LVPSMEKHAV FCAAADDVPR
 151 FFAGEAQNRC NQENQAARDV VQGGLRAAAG AAVGFGGIEA VFQDIEVERA
 201 QVFRAERNHF FHGKVEGITR IKITGNAFLQ PPCQHQGIAV DFHHIRLLHG
 251 IFNRIEVAQV GKQKAQGIAD TAVAFGYALE DFFGNRQFAA VIGGCRPQAQ
 301 DVRAELVIHF LRRDDVADGF RHFAPVLIHH ETMGQQLFVR RATH*
``` m236/a236 81.0% identity in 258 aa overlap

```
                                                    10        20        30
m236.pep                                    LHGRTDGFVGAQRLDGGGYRFAGFADCRPF
                                            |:||||||||||||||||||||||||||||
a236          FRHQQSKAQFFAQSIQIAGHFFRRGNFGFGLQGRTDGFVGAQRLDGGGYRFAGFADCRPF
                60        70        80        90       100       110

40        50        60        70        80        90
m236.pep      FHQFGFGFFVDGRELVPSMEEDAVXFAAAXDVPRFFAGEAQNRCNQENQTACDVIQGSLC
              ||||||||||||||||||||: ||  ||| |||||||||||||||||||:| ||:||:| 
a236          FHQFGFGFFVDGRELVPSMEKHAVFCAAADDVPRFFAGEAQNRCNQENQAARDVVQGGLR
                 120       130       140       150       160       170
```

-continued

```
                 100        110        120        130        140        150
m236.pep  AAACMAVCFGGVEAVFQDVEVERTQVFRAERNXVFYGKVEXITRIVIACQTLLQLTCQYH
          |||  ||  |||:|||||:||||:||||||||  |:|||| |||| |:  :::||   ||::
a236      AAAGAAVGFGGIEAVFQDIEVERAQVFRAERNHFFHGKVEGITRIKITGNAFLQPPCQHQ
                 180        190        200        210        220        230

160        170        180        190        200        210
m236.pep  GVAVDFHHIRLLHGIFNRIKVAQVGKQKAQGIADTAVAFGYAFEDFFGNRQFAAVIGRCR
          |:||||||||||||||||||:|||||||||||||||||||||||:||||||||||||  ||
a236      GIAVDFHHIRLLHGIFNRIEVAQVGKQKAQGIADTAVAFGYALEDFFGNRQFAAVIGGCR
                 240        250        260        270        280        290

220        230        240        250        259
m236.pep  PQAQDVCAEFVINLLRCNDVADGFRHFFAFAVDNETMGQQLFIRRATHX
          ||||||  ||:||::||  :||||||||||      :  :|||||||||:||||||
a236      PQAQDVRAELVIHFLRRDDVADGFRHFAPVLIHHETMGQQLFVRRATHX
                 300        310        320        330        340
```

15

The following partial DNA sequence was identified in *N. gonorrhoeae* <SEQ ID 881>:

```
g237.seq
   1 atgcgggaca aggttggcgg taatatcgca ctccccgccc cacgaatatt
  51 cgattctaac atcggcaagc tgcggaaaaa ctttaagcat atcttggcgg
 101 acaagctcgg tcatacgcgc aggattgtcg ataaattcgt tatccttacc
 151 gccgaaaagc agcctgccgt ccgcgctgag gcggtaataa tccaaaatat
 201 ggcggttgtc gcatactgcc atattgttgc ggataagccc ttttgtgcgc
 251 gcgcccaagg gttcggtggc aataataaag gtgctgacgg caatcgcctt
 301 gcgttccaaa ggccggaata tcgggttcaa accgacataa gtattgacgg
 351 catagaccac atttttacac tcgacgctgc cttcgggcgt gtaaaccagc
 401 caaccgtttt gatacggttc gatgcgcgtc atcgggatt gctcgaaaat
 451 ctgcgcgccg gcttcggcag cggcgctggc aacacccaac gtgtaattga
 501 gcggatgaag atgcccggac aagggatcga actgtgcgcc ttggtacata
 551 tcgctgtcaa gctgctgttt caactcggct ttatcccaaa gttgataatg
 601 actcgcaccg taatgccgtt gggcgtgttc atgccactgc tgcaactctt
 651 cccaatgctg cggacggacg gcaaccgtgg cataaccgcg ctgccaatcg
 701 caatcgatgg catgtttgcg gacgcgttcg tccaccagtt cgaccgcctg
 751 caaagactgt tgccaaaacc attgcgcctg ctccaagccg acctgttttt
 801 caatttcccc cataccgcag gcgtagtcgc tgataacctg cccgccactc
 851 ctgccggacg cgccgaagcc gatacgtgcg gcttccaaaa cgacggcttc
 901 atgtccgtgt tccgccagcg gcaatgcggt acacaaaccg ctcaaaccgc
 951 cgccgataat gcaggtttcg gctttcagac ggcattggag tttcggataa
1001 acagtatgcg gattaaccga actaaaataa taagaaggca gatattcttg
1051 aaaatcaggg cgaatcattg tgtttgcttt atcgggtata ttttcggacg
1101 gaatgataca gactgtcggg ccatatcgtc aaacagaaa atcggttga
```

This corresponds to the amino acid sequence <SEQ ID 882; ORF 237.ng>:

```
g237.pep
   1 MRDKVGGNIA LPAPRIFDSN IGKLRKNFKH ILADKLGHTR RIVDKFVILT
  51 AEKQPAVRAE AVIIQNMAVV AYCHIVADKP FCARAQGFGG NNKGADGNRL
 101 AFQRPEYRVQ TDISIDGIDH IFTLDAAFGR VNQPTVLIRF DARHRGLLEN
```

-continued

```
151 LRAGFGSGAG NTQRVIERMK MPGQGIELCA LVHIAVKLLF QLGFIPKLIM

201 TRTVMPLGVF MPLLQLFPML RTDGNRGITA LPIAIDGMFA DAFVHQFDRL

251 QRLLPKPLRL LQADLFFNFP HTAGVVADNL PATPAGRAEA DTCGFQNDGF

301 MSVFRQRQCG TQTAQTAADN AGFGFQTALE FRINSMRINR TKIIRRQIFL

351 KIRANHCVCF IGYIFGRNDT DCRAISSKQK IG*
```

The following partial DNA sequence was identified in *N. meningitidis* <SEQ ID 883>:

```
m237.seq
   1 ATGCGGGACA AGGTTGGCGG TAATGTCGCA CTCCCCGCCC CACGAATATT

51 CGATTTTGAC ATCGGCAAGC TGCGGAAAAA CTTTAAGCAT ATCTTGGCGG

101 ACAAGCTCGG TCATaCGCTC AGGATTGTCG ATAAACTCGT TATCCTTACC

151 GCCGAAAAGC AGTCTGCCGT CCGCGCTGAG GCGGTAATAA TCCAAAATAT

201 GGCGGTTGTC GCATACTGCC ATATTGTTAC GGATAAGCCC TTTTGCGCGC

251 GCCCCCAAGG GTTCGGTCGC AATAATAAAG GTGCTGACAG CAATCGCCTT

301 GCGTTCCAAA GGCCGGAATA TCGGGTTCAA ACCTGCATAA GTATTGACAG

351 CATAGACCAC ATTTTTGCAC TCGACGCTGC CTTCGGGCGT GTAAACCAGC

401 CAACCGTTTT GATGCGGTTC GATGCACGTC ATCGGGGATT GCTCGAAAAT

451 CTGCGCACCG GCTTCGGCAG CGGCACGAGC GATGCCCAAA GTGTAAGTGA

501 GCGGATGCAG GTGTCCGGAT AAGGGGTCGA ATTGTGCCCC TTGGTACATA

551 TCGCTGTCAA GCTGCTGTTT CAACTCGGCT TTATCCCAAA GTTGATAATG

601 ACTCGCACCG TAATGCCGTT GGGCGTGTTC ATGCCACTGC TGCAACTCTT

651 CCCAATGCTG CGGACGGACG GCAACCGTGG CATAACCGCG CTGCCAATCA

701 CAATCGACGG CATGTTTGCG GACGCGTTCG TCCACCAGTT CGACCGCCTG

751 CAAAGACTGT TGCCAAAACC ATTGCGCCTG CTCCAAGCCG ACCTGTTTTT

801 CAATTTCCCC CATACCGCAG nCGTAATCGC TGATAACCTG CCCGCCACTC

851 CGTCCCGACG CGCCGAAACC GATACGCGCG GCTTCCAACA CAACCGTTTC

901 ATGTCCCTGC TCCGCCAAGG GCAATGCAGT GCACAAACCA CCCAATCCGC

951 CGCCGATGAT ACAGGTATCG GTTTTCAGAC GGCATTGAAG TTtCGGATAA

1001 ACAGTATGAG GATTAACCGA ACTGAAATAA TAAGAAGGCA GATATTCTTG

1051 AAAATCAGGG CGAATCATTG TGTTTGCTTT ATCAGGTGTA TTTTCGGACG

1101 GAATGATACA GGCTGTCGGG CCATATCGTC CAwACAGAAA ATCGGTTGA
```

This corresponds to the amino acid sequence <SEQ ID 884; ORF 237>:

```
m237.pep
  1 MRDKVGGNVA LPAPRIFDFD IGKLRKNFKH ILADKLGHTL RIVDKLVILT

51 AEKQSAVRAE AVIIQNMAVV AYCHIVTDKP FCARPQGFGR NNKGADSNRL

101 AFQRPEYRVQ TCISIDSIDH IFALDAAFGR VNQPTVLMRF DARHRGLLEN

151 LRTGFGSGTS DAQSVSERMQ VSGXGVELCP LVHIAVKLLF QLGFIPKLIM

201 TRTVMPLGVF MPLLOLFPML RTDGNRGITA LPITIDGMFA DAFVHQFDRL

251 QRLLPKPLRL LQADLFFNFP HTAXVIADNL PATPSRRAET DTRGFQHNRF
```

-continued

```
301 MSLLRQGQCS AQTTQSAADD TGIGFQTALK FRINSMRINR TEIIRRQIFL

351 KIRANHCVCF IRCIFGRNDT GCRAISSXQK IG*
```

Computer analysis of this amino acid sequence gave the following results:
Homology with a Predicted ORF from *N. gonorrhoeae*
ORF 237 shows 86.1% identity over a 382 aa overlap with a predicted ORF (ORF 237.ng) from *N. gonorrhoeae*:

```
m237/g237
                  10         20         30         40         50         60
     m237.pep MRDKVGGNVALPAPRIFDFDIGKLRKNFKHILADKLGHTLRIVDKLVILTAEKQSAVRAE
             |||||||:|||||||| :|||||||||||||||||| |||||:||||||| |||||
     g237    MRDKVGGNIALPAPRIFDSNIGKLRKNFKHILADKLGHTRRIVDKFVILTAEKQPAVRAE
                  10         20         30         40         50         60

70         80         90        100        110        120
     m237.pep AVIIQNMAVVAYCHIVTDKPFCARPQGFGRNNKGADSNRLAFQRPEYRVQTCISIDSIDH
             |||||||||||||||| |||||||| |||| ||||||:|||||||||||||| ||||:|||
     g237    AVIIQNMAVVAYCHIVADKPFCARAQGFGGNNKGADGNRLAFQRPEYRVQTDISIDGIDH
                  70         80         90        100        110        120

130        140        150        160        170        180
     m237.pep IFALDAAFGRVNQPTVLMRFDARHRGLLENLRTGFGSGTSDAQSVSERMQVSGXGVELCP
             ||:|||||||||||||||:|||||||||||||:||||::::|  |  |||::  |  |:|||
     g237    IFTLDAAFGRVNQPTVLIRFDARHRGLLENLRAGFGSGAGNTQRVIERMKMPGQGIELCA
                 130        140        150        160        170        180

190        200        210        220        230        240
     m237.pep LVHIAVKLLFQLGFIPKLIMTRTVMPLGVFMPLLQLFPMLRTDGNRGITALPITIDGMFA
             |||||||||||||||||||||||||||||||||||||||||||||||||||||:|||||
     g237    LVHIAVKLLFQLGFIPKLIMTRTVMPLGVFMPLLQLFPMLRTDGNRGITALPIAIDGMFA
                 190        200        210        220        230        240

250        260        270        280        290        300
     m237.pep DAFVHQFDRLQRLLPKPLRLLQADLFFNFPHTAXVIADNLPATPSRRAETDTRGFQHNRF
             ||||||||||||||||||||||||||||||||| :|||||:  |||:  |||  ||:: |
     g237    DAFVHQFDRLQRLLPKPLRLLQADLFFNFPHTAGVVADNLPATPAGRAEADTCGFQNDGF
                 250        260        270        280        290        300

310        320        330        340        350        360
     m237.pep MSLLRQGQCSAQTTQSAADDTGIGFQTALKFRINSMRINRTEIIRRQIFLKIRANHCVCF
             ||::||   ||:: ||:|:|||::|:|||||:||||||||||||:||| |||||||||||||
     g237    MSVFRQRQCGTQTAQTAADNAGFGFQTALEFRINSMRINRTKIIRRQIFLKIRANHCVCF
                 310        320        330        340        350        360

370        380
     m237.pep IRCIFGRNDTGCRAISSXQKIGX
             | ||||||| |||| |||||
     g237    IGYIFGRNDTDCRAISSKQKIGX
                 370        380
```

The following partial DNA sequence was identified in *N. meningitidis* <SEQ ID 885>:

```
a237.seq
  1 ATGCGGGACA AGGTTGGCGG TAATGTCGCA CTCCCCGCCC CACGAATATT

51 CGATTTTGAC ATCGGCAAGC TGCGGAAAAA CTTTAAGCAT ATCTTGGCGG

101 ACAAGCTCGG TCATACGCGC GGGATTGTCG ATAAACTCGT TATCCTTACC

151 GCCGAAAAGC AGTCTGCCGT CCGCGCTGAG GCGGTAATAA TCCAAAATAT

201 GACGGTTGTC GCATACTGCC ATATTGTTGC GGATAAGCCC TTTTGCACGC

251 GCGCCCAAGG GTTCTGTGGC AATAATAAAG GTGCTGACAG CAATCGCCTT

301 GCGCTCCAAA GGCTTGAATA TCGGATTCAA ACCGGCATAA GTATTGACGG

351 CGTACACCAG ATTTTTGCAT TCGACGCTGC CTTCGGGGGT GTAAACCAGC

401 CAACCGTTTT GATAAGGTTC AATGCGTATC ATGGGAGAAT GCTCAAAAAT

451 CTTCGTACCA GCTTCGGCAG CGGCGCGGGC GATGCCCAAC GTGTAATTGA

501 GCGGATGGAG ATGCCCGGAC AAGGGATCGA ACTGTGCGCC TTGGTACATA
```

```
 551 TCGCTGTCAA GCTGCTGCTT CAGTTCAGTG TTATCCCAGA GTTGATAATG

601 AGTTGCACCG TAATATTTTT GGGCGTGCTC ATGCCATTGT TGCAATTCTT

651 CCCAATGCTG CGAACGGATG CAACCGTGG CATAACCGCG CTGCCAATCG

701 CAATCAATGG CATGTTTGCG GACGCGTTCG TCCACCAGTT CGACCGCCTG

751 CAAAGACTGT TGCCAAAACC ATTGCGCTTG CTCCAAACCG ACCTGTTTTT

801 CAATTTCCTC CATACCGCAG GCGTAATCGC TGATAACCTG CCCGCCACTC

851 CGTCCCGACG CGCCGAAACC GATACGCGCG GCTTCCAACA CAACCGTTTC

901 ATGTCCCTGC TCCGCCAAGG GCAATGCAGT GCACAAACCA CTCAATCCGC

951 CGCCGATGAT ACAGGTATCG GTTTTCAGAC GGCATTGAAG TTTCGGATAA

1001 ACAGTATGAG GATTAACCGA ACTGAAATAA TAAGAAGGCA GATATTCTTG

1051 AAAATCAGGG CGAATCATTG TGTTTGCTTT ATCGGGTATA TTTTCGGACG

1101 GAATGATACA GGCTGTCGAG CCATATCGTC CAAACAGAAA ATCGGTTGA
```

This corresponds to the amino acid sequence <SEQ ID 886; ORF 237.a>:

```
a237.pep
  1 MRDKVGGNVA LPAPRIFDFD IGKLRKNFKH ILADKLGHTR GIVDKLVILT

51 AEKQSAVRAE AVIIQNMTVV AYCHIVADKP FCTRAQGFCG NNKGADSNRL

101 ALQRLEYRIQ TGISIDGVHQ IFAFDAAFGG VNQPTVLIRF NAYHGRMLKN

151 LRTSFGSGAG DAQRVIERME MPGQGIELCA LVHIAVKLLL QFSVIPELIM

201 SCTVIFLGVL MPLLQFFPML RTDGNRGITA LPIAINGMFA DAFVHQFDRL

251 QRLLPKPLRL LQTDLFFNFL HTAGVIADNL PATPSRRAET DTRGFQHNRF

301 MSLLRQGQCS AQTTQSAADD TGIGFQTALK FRINSMRINR TEIIRRQIFL

351 KIRANHCVCF IGYIFGRNDT GCRAISSKQK IG*
``` m237/a237 85.6% identity in 382 aa overlap

```
                    10         20         30         40         50         60
  m237.pep  MRDKVGGNVALPAPRIFDFDIGKLRKNFKHILADKLGHTLRIVDKLVILTAEKQSAVRAE
            ||||||||||||||||||||||||||||||||||||||| |||||||||||||||||||
  a237      MRDKVGGNVALPAPRIFDFDIGKLRKNFKHILADKLGHTRGIVDKLVILTAEKQSAVRAE
                    10         20         30         40         50         60

70         80         90        100        110        120
  m237.pep  AVIIQNMAVVAYCHIVTDKPFCARPQGFGRNNKGADSNRLAFQRPEYRVQTCISIDSIDH
            |||||||:|||||||||:|||||:|||||:|| ||||||||||:||  |||:||||::  :
  a237      AVIIQNMTVVAYCHIVADKPFCTRAQGFCGNNKGADSNRLALQRLEYRIQTGISIDGVHQ
                    70         80         90        100        110        120

130        140        150        160        170        180
  m237.pep  IFALDAAFGRVNQPTVLMRFDARHRGLLENLRTGFGSGTSDAQSVSERMQVSGXGVELCP
            |||:|||| |||||||||:||:| |  :|:|||||||:||| | |||::  |  |:|||
  a237      IFAFDAAFGGVNQPTVLIRFNAYHGRMLKNLRTSFGSGAGDAQRVIERMEMPGQGIELCA
                   130        140        150        160        170        180

190        200        210        220        230        240
  m237.pep  LVHIAVKLLFQLGFIPKLIMTRTVMPLGVFMPLLQLFPMLRTDGNRGITALPITIDGMFA
            ||||||||||:|:: ||:|||: ||: ||||||||||:||||||||||||||:|:||||
  a237      LVHIAVKLLLQFSVIPELIMSCTVIFLGVLMPLLQFFPMLRTDGNRGITALPIAINGMFA
                   190        200        210        220        230        240

250        260        270        280        290        300
  m237.pep  DAFVHQFDRLQRLLPKPLRLLQADLFFNFPHTAXVIADNLPATPSRRAETDTRGFQHNRF
            ||||||||||||||||||||||:||||||  |||  |||||||||||||||||:|||||
  a237      DAFVHQFDRLQRLLPKPLRLLQTDLFFNFLHTACVIADNLPATPSRRAETDTRCFQHNRF
                   250        260        270        280        290        300
```

```
              310        320        330        340        350        360
m237.pep  MSLLRQGQCSAQTTQSAADDTGIGFQTALKFRINSMRINRTEIIRRQIFLKIRANHCVCF
          ||||||||||||||||||||||||||||||||||||||||||||||||||||||||||||
a237      MSLLRQGQCSAQTTQSAADDTGIGFQTALKFRINSMRINRTEIIRRQIFLKIRANHCVCF
              310        320        330        340        350        360
              370        380
m237.pep  IRCIFGRNDTGCRAISSXQKIGX
          |  ||||||||||||| |||||
a237      IGYIFGRNDTGCRAISSKQKIGX
              370        380
```

The following partial DNA sequence was identified in *N. gonorrhoeae* <SEQ ID 887>:

```
g238.seq
   1 atgaatttgc ctattcaaaa attcatgatg ctgttggcag cggcaatatc
  51 gatgctgcat atccccatta gtcatgcgaa cggtttggat gcccgtttgc
 101 gcgatgatat gcaggcaaaa cactacgaac cgggtggcaa ataccatctg
 151 tttggtaatg ctcgcggcag tgttaaaaat cgggtttgcg ccgtccaaac
 201 atttgatgca actgcggtcg gccccatact gcctattaca cacgaacgga
 251 caggatttga aggtgttatc ggctatgaaa cccattttc aggacacgga
 301 cacgaagtac acagtccgtt cgataatcat gattcaaaaa gcacttctga
 351 tttcagcggc ggcgtagacg gcggttttac cgtttaccaa cttcatcgga
 401 cagggtcgga aatacatccc gcagacggat atgacgggcc tcaaggcggc
 451 ggttatccgg aaccacaagg ggcaagggat atatacagct accatatcaa
 501 aggaacttca accaaaacaa agataaaacac tgttccgcaa gccccttttt
 551 cagaccgctg gctaaaagaa aatgccggtg ccgcttccgg tttctcagc
 601 cgtgcggatg aagcaggaaa actgatatgg gaaaacgacc ccgataaaaa
 651 ttggcgggct aaccgtatgg atgatattcg cggcatcgtc caaggtgcgg
 701 ttaatccttt tttaacgggt tttcaagggg tagggattgg ggcaattaca
 751 gacagtgcgg taagcccggt cacagataca gccgctcagc agactctaca
 801 aggtattaat gatttaggaa atttaagtcc ggaagcacaa cttgccgccg
 851 cgagcctatt acaggacagt gcctttgcgg taaaagacgg catcaattcc
 901 gccagacaat gggctgatgc ccatccgaat ataacagcaa cagcccaaac
 951 tgcccttgcc gtagcagagg ccgcaggtac ggtttggcgc ggtaaaaaag
1001 tagaacttaa cccgaccaaa tgggattggg ttaaaaatac cggctataaa
1051 aaacctgctg cccgccatat gcagactgta gatggggaga tggcagggg
1101 gaatagaccg cctaaatcta taacgtcgga aggaaaagct aatgctgcaa
1151 cctatcctaa gttggttaat cagctaaatg agcaaaactt aaataacatt
1201 gcggctcaag atccaagatt gagtctagct attcatgagg gtaaaaaaa
1251 ttttccaata ggaactgcaa cttatgaaga ggcagataga ctaggtaaaa
1301 tttgggttgg tgagggtgca agacaaacta gtggaggcgg atggttaagt
1351 agagatggca ctcgacaata tcggccacca acagaaaaaa aatcacaatt
1401 tgcaactaca ggtattcaag caaattttga aacttatact attgattcaa
1451 atgaaaaaag aaataaaatt aaaaatggac atttaaatat taggtaa
```

This corresponds to the amino acid sequence <SEQ ID 888; ORF 238.ng>:

```
g238.pep
   1  MNLPIQKFMM LLAAAISMLH IPISHANGLD ARLRDDMQAK HYEPGGKYHL

51  FGNARGSVKN RVCAVQTFDA TAVGPILPIT HERTGFEGVI GYETHFSGHG

101  HEVHSPFDNH DSKSTSDFSG GVDGGFTVYQ LHRTGSEIHP ADGYDGPQGG

151  GYPEPQGARD IYSYHIKGTS TKTKINTVPQ APFSDRWLKE NAGAASGFLS

201  RADEAGKLIW ENDPDKNWRA NRMDDIRGIV QGAVNPFLTG FQGVGIGAIT

251  DSAVSPVTDT AAQQTLQGIN DLGNLSPEAQ LAAASLLQDS AFAVKDGINS

301  ARQWADAHPN ITATAQTALA VAEAAGTVWR GKKVELNPTK WDWVKNTGYK

351  KPAARHMQTV DGEMAGGNRP PKSITSEGKA NAATYPKLVN QLNEQNLNNI

401  AAQDPRLSLA IHEGKKNFPI GTATYEEADR LGKIWVGEGA RQTSGGGWLS

451  RDGTRQYRPP TEKKSQFATT GIQANFETYT IDSNEKRNKI KNGHLNIR*
```

The following partial DNA sequence was identified in *N. meningitidis* <SEQ ID 889>:

```
m238.seq
    1 ATGAATTTGC CTATTCAAAA ATTCATGATG CTGTTTGCAG CAGCAATATC

51 GTTGCTGCAA ATCCCCATTA GTCATGCGAA CGGTTTGGAT GCCCGTTTGC

101 GCGATGATAT GCAGGCAAAA CAcTACGAAC CGGGTGGTAA ATACCATCTG

151 TTTGGTAATG CTCGCGGCAG TGTTAAAAAG CGGGTTTACG CCGTCCAGAC

201 ATTTGATGCA ACTGCGGTCA GTCCTGTACT GCCTATTACA CACGAACGGA

251 CAGGGTTTGA AGGTGTTATC GGTTATGAAA CCCATTTTTC AGGGCACGGA

301 CATGAAGTAC ACAGTCCGTT CGATCATCAT GATTCAAAAA GCACTTCTGA

351 TTTCAGCGGC GGTGTAGACG GCGGTTTTAC TGTTTACCAA CTTCATCGAA

401 CAGGGTCGGA AATCCATCCG GAGGATGGAT ATGACGGGCC GCAAGGCAGC

451 GATTATCCGC CCCCCGGAGG AGCAAGGGAT ATATACAGCT ATTATGTCAA

501 AGGAACTTCA ACAAAAACAA AGACTAATAT TGTCCCTCAA GCCCCATTTT

551 CAGACCGTTG GCTAAAAGAA AATGCCGGTG CCGCCTCTGG TTTTTTCAGC

601 CGTGCGGATG AAGCAGGAAA ACTGATATGG GAAAGCGACC CCAATAAAAA

651 TTGGTGGGCT AACCGTATGG ATGATGTTCG CGGCATCGTC CAAGGTGCGG

701 TTAATCCTTT TTTAATGGGT TTTCAAGGAG TAGGGATTGG GGCAATTACA

751 GACAGTGCAG TAAGCCCGGT CACAGATACA GCCGCGCAGC AGACTCTACA

801 AGGTATTAAT GATTTAGGAA AATTAAGTCC GGAAGCACAA CTTGCTGCCG

851 CGAGCCTATT ACAGGACAGT GCTTTTGCGG TAAAAGACGG TATCAACTCT

901 GCCAAACAAT GGGCTGATGC CCATCCAAAT ATAACAGCTA CTGCCCAAAC

951 TGCCCTTTCC GCAGCAGAGG CCGCAGGTAC GGTTTGGAGA GGTAAAAAAG

1001 TAGAACTTAA CCCGACTAAA TGGGATTGGG TTAAAAATAC CGGTTATAAA

1051 AAACCTGCTG CCCGCCATAT GCAGACTTTA GATGGGGAGA TGGCAGGTGG

1101 GAATAAACCT ATTAAATCTT TACCAAACAG TGCCGCTGAA AAAGAAAAC

1151 AAAATTTTGA GAAGTTTAAT AGTAACTGGA GTTCAGCAAG TTTTGATTCA

1201 GTGCACAAAA CACTAACTCC CAATGCACCT GGTATTTTAA GTCCTGATAA
```

```
-continued
1251 AGTTAAAACT CGATACACTA GTTTAGATGG AAAAATTACA ATTATAAAAG

1301 ATAACGAAAA CAACTATTTT AGAATCCATG ATAATTCACG AAAACAGTAT

1351 CTTGATTCAA ATGGTAATGC TGTGAAAACC GGTAATTTAC AAGGTAAGCA

1401 AGCAAAAGAT TATTTACAAC AACAAACTCA TATCAGGAAC TTAGACAAAT

1451 GA
```

This corresponds to the amino acid sequence <SEQ ID 10 890; ORF 238>:

```
m238.pep
  1 MNLPIQKFMM LFAAAISLLQ IPISHANGLD ARLRDDMQAK HYEPGGKYHL

51 FGNARGSVKK RVYAVQTFDA TAVSPVLPIT HERTGFEGVI GYETHFSGHG

101 HEVHSPFDHH DSKSTSDFSG GVDGGFTVYQ LHRTGSEIHP EDGYDGPQGS

151 DYPPPGGARD IYSYYVKGTS TKTKTNIVPQ APFSDRWLKE NAGAASGFFS

201 RADEAGKLIW ESDPNKNWWA NRMDDVRGIV QGAVNPFLMG FQGVGIGAIT

251 DSAVSPVTDT AAQQTLQGIN DLGKLSPEAQ LAAASLLQDS AFAVKDGINS

301 AKQWADAHPN ITATAQTALS AAEAAGTVWR GKKVELNPTK WDWVKNTGYK

351 KPAARHMQTL DGEMAGGNKP IKSLPNSAAE KRKQNFEKFN SNWSSASFDS

401 VHKTLTPNAP GILSPDKVKT RYTSLDGKIT IIKDNENNYF RIHDNSRKQY

451 LDSNGNAVKT GNLQGKQAKD YLQQQTHIRN LDK*
```

Computer analysis of this amino acid sequence gave the following results:
Homology with a Predicted ORF from *N. gonorrhoeae*
ORF 238 shows 86.0% identity over a 401 aa overlap with a predicted ORF (ORF 238.ng) from *N. gonorrhoeae*:

```
    m238/g238

10         20         30         40         50         60
      m238.pep  MNLPIQKFMMLFAAAISLLQIPISHANGLDARLRDDMQAKHYEPGGKYHLFGNARGSVKK
                ||||||||||:|||||:|:||||||||||||||||||||||||||||||||||||||:
          g238  MNLPIQKFMMLLAAAISMLHIPISHANGLDARLRDDMQAKHYEPGGKYHLFGNARGSVKN
                     10         20         30         40         50         60

70         80         90        100        110        120
      m238.pep  RVYAVQTFDATAVSPVLPITHERTGFEGVIGYETHFSGHGHEVHSPFDHHDSKSTSDFSG
                ||  |||||||||||:|:||||||||||||||||||||||||||||||:||||||||||
          g238  RVCAVQTFDATAVGPILPITHERTGFEGVIGYETHFSGHGHEVHSPFDNHDSKSTSDFSG
                     70         80         90        100        110        120

130        140        150        160        170        180
      m238.pep  GVDGGFTVYQLHRTGSEIHPEDGYDGPQGSDYPPPGGARDIYSYYVKGTSTKTKTNIVPQ
                ||||||||||||||||||||| |||||||:  || |||||||||::|||||||| | |||
          g238  GVDGGFTVYQLHRTGSEIHPADGYDGPQGGGYPEPQGARDIYSYHIKGTSTKTKINTVPQ
                    130        140        150        160        170        180

190        200        210        220        230        240
      m238.pep  APFSDRWLKENAGAASGFFSRADEAGKLIWESDPNKNWWANRMDDVRGIVQGAVNPFLMG
                ||||||||||||||||:||||||||||||||:||:|||  ||||||:||||||||||| |
          g238  APFSDRWLKENAGAASGFLSRADEAGKLIWENDPDKNWRANRMDDIRGIVQGAVNPFLTG
                    190        200        210       2200        230        240

250        260        270        280        290        300
      m238.pep  FQGVGIGAITDSAVSPVTDTAAQQTLQGINDLGKLSPEAQLAAASLLQDSAFAVKDGINS
                |||||||||||||||||||||||||||||||||:||||||||||||||||||||||||||
          g238  FQGVGIGAITDSAVSPVTDTAAQQTLQGINDLGNLSPEAQLAAASLLQDSAFAVKDGINS
                    250        260        270        280        290        300

310        320        330        340        350        360
      m238.pep  AKQWADAHPNITATAQTALSAAEAAGTVWRGKKVELNPTKWDWVKNTGYKKPAARHMQTL
                |:|||||||||||||||||::|||||||||||||||||||||||||||||||||||||:
          g238  ARQWADAHPNITATAQTALAVAEAAGTVWRGKKVELNPTKWDWVKNTGYKKPAARHMQTV
                    310        320        330        340        350        360
```

-continued

```
                 370       380       390       400       410       420
m238.pep  DGEMAGGNKPIKSLPNSAAEKRKQNFEKFNSNWSSASFDSVHKTLTPNAPGILSPDKVKT
          ||||||||:| ||: :| ||    :: |: ::  :  :::::
g238      DGEMAGGNRPPKSI-TSEGKANAATYPKLVNQLNEQNLNNIAAQDPRLSLAIHEGKKNFP
                 370        380       390       400       410

430       440       450       460       470       480
m238.pep    RYTSLDGKITIIKDNENNYFRIHDNSRKQYLDSNGNAVKTGNLQGKQAKDYLQQQTHIRN g238        IGTATYEEADRLGKIWVGEGARQTSGGGWLSRDGTRQYRPPTEKKSQFATTGIQANFETY
          420       430       440       450       460       470
```

The following partial DNA sequence was identified in *N. meningitidis* <SEQ ID 891>:

```
a238.seq (partial)
   1 ATGAATTTGC CTATTCAAAA ATTCATGATG CTGTTTGCAG CAGCAATATC

51 GTTGCTGCAA ATCCCCATTA GTCATGCGAA CGGTTTGGAT GCCCGTTTGC

101 GCGATGATAT GCAGGCAAAA CACTACGAAC CGGGTGGTAA ATACCATCTG

151 TTTGGTAATG CTCGCGGCAG TGTTAAAAAT CGGGTTTACG CCGTCCAAAC

201 ATTTGATGCA ACTGCGGTCG GCCCCATACT GCCTATTACA CACGAACGGA

251 CAGGATTTGA AGGCATTATC GGTTATGAAA CCCATTTTTC AGGACATGGA

301 CATGAAGTAC ACAGTCCGTT CGATAATCAT GATTCAAAAA GCACTTCTGA

351 TTTCAGCGGC GGCGTAGACG GTGGTTTTAC CGTTTACCAA CTTCATCGGA

401 CAGGGTCGGA AATCCATCCG GAGGATGGAT ATGACGGGCC GCAAGGCAGC

451 GATTATCCGC CCCCCGGAGG AGCAAGGGAT ATATACAGCT ACTATGTCAA

501 AGGAACTTCA ACAAAAACAA AGAGTAATAT TGTTCCCCGA GCCCCATTTT

551 CAGACCGCTG GCTAAAAGAA AATGCCGGTG CCGCCTCTGG TTTTTTCAGC

601 CGTGCTGATG AAGCAGGAAA ACTGATATGG GAAAGCGACC CCAATAAAAA

651 TTGGTGGGCT AACCGTATGG ATGATATTCG CGGCATCGTC CAAGGTGCGG

701 TTAATCCTTT TTTAATGGGT TTTCAAGGAG TAGGGATTGG GGCAATTACA

751 GACAGTGCAG TAAGCCCGGT CACAGATACA GCCGCGCAGC AGACTCTACA

801 AGGTATTAAT CATTTAGGAA ATTTAAGTCC CGAAGCACAA CTTGCGGCTG

851 CAACCGCATT ACAAGACAGT GCTTTTGCGG TAAAAGACGG TATCAATTCC

901 GCCAGACAAT GGGCTGATGC CCATCCGAAT ATAACTGCAA CAGCCCAAAC

951 TGCCCTTGCC GTAGCAGAGG CCGCAACTAC GGTTTGGGGC GGTAAAAAAG

1001 TAGAACTTAA CCCGACCAAA TGGGATTGGG TTAAAAATAC CGGCTATAAA

1051 ACACCTGCTG TTCGCACCAT GCATACTTTG GATGGGGAAA TGGCCGGTGG

1101 GAATAGACCG CCTAAATCTA TAACGTCCAA CAGCAAAGCA GATGCTTCCA

1151 CACAA
```

This corresponds to the amino acid sequence <SEQ ID 892; ORF 238.a>:

```
a238.pep (partial)
  1  MNLPIQKFMM LFAAAISLLQ IPISHANGLD ARLRDDMQAK HYEPGGKYHL

51  FGNARGSVKN RVYAVQTFDA TAVGPILPIT HERTGFEGII GYETHFSGHG

101  HEVHSPFDNH DSKSTSDFSG GVDGGFTVYQ LHRTGSEIHP EDGYDGPQGS

151  DYPPPGGARD IYSYYVKGTS TKTKSNIVPR APFSDRWLKE NAGAASGFFS
```

```
201 RADEAGKLIW ESDPNKNWWA NRMDDIRGIV QGAVNPFLMG FQGVGIGAIT

251 DSAVSPVTDT AAQQTLQGIN HLGNLSPEAQ LAAATALQDS AFAVKDGINS

301 ARQWADAHPN ITATAQTALA VAEAATTVWG GKKVELNPTK WDWVKNTGYK

351 TPAVRTMHTL DGEMAGGNRP PKSITSNSKA DASTQ
``` m238/a238 91.9% identity in 385 aa overlap

```
                 10         20         30         40         50         60
m238.pep MNLPIQKFMMLFAAAISLLQIPISHANGLDARLRDDMQAKHYEPGGKYHLFGNARGSVKK
         ||||||||||||||||||||||||||||||||||||||||||||||||||||||||||:
a238     MNLPIQKFMMLFAAAISLLQIPISHANGLDARLRDDMQAKHYEPGGKYHLFGNARGSVKN
                 10         20         30         40         50         60

70         80         90        100        110        120
m238.pep RVYAVQTFDATAVSPVLPITHERTGFEGVIGYETHFSGHGHEVHSPFDHHDSKSTSDFSG
         |||||||||||||:|:||||||||||||:|||||||||||||||||:|||||||||||
a238     RVYAVQTFDATAVGPILPITHERTGFEGIIGYETHFSGHGHEVHSPFDNHDSKSTSDFSG
                 70         80         90        100        110        120

130        140        150        160        170        180
m238.pep GVDGGFTVYQLHRTGSEIHPEDGYDGPQGSDYPPPGGARDIYSYYVKGTSTKTKTNIVPQ
         ||||||||||||||||||||||||||||||||||||||||||||||||||||:||||:
a238     GVDGGFTVYQLHRTGSEIHPEDGYDGPQGSDYPPPGGARDIYSYYVKGTSTKTKSNIVPR
                130        140        150        160        170        180

190        200        210        220        230        240
m238.pep APFSDRWLKENAGAASGFFSRADEAGKLIWESDPNYNWWANRMDDVRGIVQGAVNPFLMG
         |||||||||||||||||||||||||||||||||||||||||||||:|||||||||||||
a238     APFSDRWLKENAGAASGFFSRADEAGKLIWESDPNYNWWANRMDDIRGIVQGAVNPFLMG
                190        200        210        220        230        240

250        260        270        280        290        300
m238.pep GQGVGIGAITDSAVSPVTDTAAQQTLQGINDLGKLSPEAQLAAASLLQDSAFAVKDGINS
         |||||||||||||||||||||||||||||||:||||||||||||:|||||||||||||
a238     GQGVGIGAITDSAVSPVTDTAAQQTLQGINHLGNLSPEAQLAAATALQDSAFAVKDGINS
                250        260        270        280        290        300

310        320        330        340        350        360
m238.pep AKQWADAHPNITATAQTALSAAEEAAGTVWRGKKVELNPTKWDWVKNTGYKKPAARHMQTL
         |:|||||||||::|||| ||| |||  ||||||||||||||||||||||| |:|  : ||
a238     ARQWADAHPNITATAQTALAVAEAATTVWGGKKVELNPTKWDWVKNTGYKTPAVRTMHTL
                310        320        330        340        350        360

370        380        390        400        410        419
m238.pep DGEMAGGNKPIKSLP-NSAAEKRKQNFEKFNSNWSSASFDSVHKTLTPNAPGILSPDKVK
         ||||||||:|| |: || |: |
a238     DGEMAGGNRPPKSITSNSKADASTQ
```

The following partial DNA sequence was identified in *N. gonorrhoeae* <SEQ ID 893>:

```
g239.seq
  1 atgttccacc ataaaggtat tgcccgaaac cggcggatgg aggttttgtt
 51 tttctgccgc cgccctgatc gcttcgtgat tcgccaaacg cgcctgttgc
101 agcctcattt gcgcataatc ctgctccaag gcgatttcct gtttttcgc
151 cttgtccaaa gctgtgaagt tgagcctgta ctggttttgc tgcatcacaa
201 cggaaaaagc ggaaacgcac accgcaagca gcagaaagaa attcgatttg
251 ttcattgccg ttcagacgtt tttctctgtt attattccgg tatcggaccg
301 gcagtccgct ccgccacacg caaaactgcg ctcctcgccc tcgggttggc
351 ggcaattcc gcttcacccg gctttaatgc cctgcccacg attttcaggg
401 gcggatcggg caaatccgct tctctgaccg ccgcccagct cggcaggggc
451 tcgtgttgcg aatattttt gacaaactgc ttcacaatgc ggtcttccaa
501 cgaatggaaa gcaatgaccg ccaaacgccc gccctctttc agacggcaca
551 tgacctgcgg caataccgcc cctacttctt caagctcgcg gttaataaag
601 atgcggattg cctggaaggt gcgcgtcgca ggatcctgcc cccgctcgcg
```

```
651  agtacggacg ttttgtgcca cgatctgcgc cagcttgcgg gttgtatcga 701  ttggactttc cgcccgttgc gcgacaatgg cgcgcacaat ctggcggcta 751  aaccgctctt caccataa
```

This corresponds to the amino acid sequence <SEQ ID 894; ORF 239.ng>:

```
g239.pep
  1  MFHHKGIARN RRMEVLFFCR RPDRFVIRQT RLLQPHLRII LLQGDFLFFR

51  LVQSCEVEPV LVLLHHNGKS GNAHRKQQKE IRFVHCRSDV FLCYYSGIGP

101  AVRSATRKTA LLALGLAAIS ASPGFNALPT IFRGGSGKSA SLTAAQLGRG

151  SCCEYFLTNC FTMRSSNEWK AMTAKRPPSF RRHMTCGNTA PTSSSSRLIK

201  MRIAWKVRVA GSCPRSRVRT FCATICASLR VVSIGLSARC ATMARTIWRL

251  NRSSP*
```

The following partial DNA sequence was identified in *N. meningitidis* <SEQ ID 895>:

```
m239.seq
  1  ATGCTCCACC ATAAAGGTmy kGCCCGAAAC CGGCkGATGG AGGTTTTGTT

51  TTTCTGCCGC CGCCCTGATC GCTTCGTGGT TCGCCAAACG CGCCTGTTGC

101  AGCCTCATTT GCGCATAATC CTGCTCCAAG GCGATTTCCT GTTTTTTCGC

151  CTTATCCAAA GCTGTGAAAT TGAGCCTGTA CTGGTTTTGC TGCATCACAA

201  CGGAAAAAGC GGAAACGCAC ACCGCAAGCA GCAGAAGGAA ATTCAATTTG

251  TTCATTGCCA TTCAGACGTT TTTCTCTGTG ATTGTTCCGG TATCGGACCG

301  GCAGTCCGCT CCGCCACACG CAAAACCGCA CTTCTCGCCC TCGGATTGGC

351  GGCAATTTCC GCCTCACCCG GCTTTAATGC CCTGCCCACG ATTTTCAGGG

401  GCAGCTCGGG CAAATCCGCT TCCCTGaCCG CCGCCCAGCG CGGCAGGGGC

451  GCGTGTTGCG AATATTTTTT GACAAACTGC TTCACAATGC GATCTTCCAA

501  CGAATGGAAA GCAATGACCG CCAAACGTCC GCCCTCTTTC AGACGACACA

551  TGACCTGCGG CAATACTGCC CCTACTTCTT CAAGCTCGCG GTTAATAAAG

601  ATGCGGACCG CCTGGAAGGT GCGCGTCGCA GGATCCTGCC CAAGCTCGCG

651  AGTACGGACG TTTTGTGCCA CGATCTGCGC CAGCTTGCGG GTTGTATCGA

701  TTGGACTTTC CGCCTGTTGC GCAACAATGG CGCGCGCAAT cCGGCGGCTa

751  AACCGCTCTT cACCATAA
```

This corresponds to the amino acid sequence <SEQ ID 896; ORF 239>:

```
m239.pep
  1  MLHHKGXARN RXMEVLFFCR RPDRFVVRQT RLLQPHLRII LLQGDFLFFR

51  LIQSCEIEPV LVLLHHNGKS GNAHRKQQKE IQFVHCHSDV FLCDCSGIGP

101  AVRSATRKTA LLALGLAAIS ASPGFNALPT IFRGSSGKSA SLTAAQRGRG

151  ACCEYFLTNC FTMRSSNEWK AMTAKRPPSF RRHMTCGNTA PTSSSSRLIK

201  MRTAWKVRVA GSCPRSRVRT FCATICASLR VVSIGLSARC ATMARAIRRL

251  NRSSP*
```

Computer analysis of this amino acid sequence gave the following results:

Homology with a Predicted ORF from *N. gonorrhoeae*
ORF 239 shows 93.7% identity over a 255 aa overlap with a predicted ORF (ORF 239.ng) from *N. gonorrhoeae*:

```
m239/g239
                   10        20        30        40        50        60
    m239.pep MLHHKGXARNRXMEVLFFCRRPDRFVVRQTRLLQPHLRIILLQGDFLFFRLIQSCEIEPV
             |:||||  ||||  |||||||||||||||:|||||||||||||||||||||:||||:|||
    g239     MFHHKGIARNRRMEVLFFCRRPDRFVIRQTRLLQPHLRIILLQGDFLFFRLVQSCEVEPV
                   10        20        30        40        50        60

70        80        90       100       110       120
    m239.pep LVLLHHNGKSGNAHRKQQKEIQFVHCHSDVFLCDCSGIGPAVRSATRKTALLALGLAAIS
             ||||||||||||||||||||||:||||:||||||  ||||||||||||||||||||||||
    g239     LVLLHHNGKSGNAHRKQQKEIRFVHCRSDVFLCYYSGIGPAVRSATRKTALLALGLAAIS
                   70        80        90       100       110       120

130       140       150       160       170       180
    m239.pep ASPGFNALPTIFRGSSGKSASLTAAQRGRGACCEYFLTNCFTMRSSNEWKAMTAKRPPSF
             |||||||||||||||:||||||||||| |||:||||||||||||||||||||||||||||
    g239     ASPGFNALPTIFRGSGGKSASLTAAQLGRGSCCEYFLTNCFTMRSSNEWKAMTAKRPPSF
                  130       140       150       160       170       180

190       200       210       220       230       240
    m239.pep RRHMTCGNTAPTSSSSRLIKMRTAWKVRVAGSCPRSRVRTFCATICASLRVVSIGLSARC
             |||||||||||||||||||||||  ||||||||||||||||||||||||||||||||||
    g239     RRHMTCGNTAPTSSSSRLIKMRIAWKVRVAGSCPRSRVRTFCATICASLRVVSIGLSARC
                  190       200       210       220       230       240

250
    m239.pep ATMARAIRRLNRSSPX
             |||||:| |||||||||
    g239     ATMARTIWRLNRSSPX
                  250
```

The following partial DNA sequence was identified in *N. meningitidis* <SEQ ID 897>:

```
a239.seq
   1 ATGCTCCACC ATAAAGGTAT TGCCCGAAAC CGGCGGATGG AGGTTTTGTT

51 TTTCTGCCGC CGCCCTGATC GCTTCGTGGT TCGCCAAACG CGCCTGTTGC

101 AGCCTCATTT GCGCATAATC CTGCTCCAAG GCGATTTCCT GTTTTTTCGC

151 CTTATCCAAA GCTGTGAAGT TGAGCCTGTA CTGGTTTTGC TGCATCACAA

201 CGGAAAAAGC GGAAACGCAC ACCGCAAGCA GCAGAAGGAA ATTCAATTTG

251 TTCATTGCCA TTCAGACGTT TTTCTCTGTG ATTGTTCCGG TATCGGACCG

301 GCAGTCCGCT CCGCCACACG CAAAACCGCA CTTCTCGCCC TCGGATTGGC

351 GGCAATTTCC GCCTCACCCG GCTTTAATGC CCTGCCCGCG ATTTTCAGGG

401 GCGGCTCGGG CAAATCCGCT TCCCTGACCG CCGCCCAGCG CGGCAGGGGC

451 GCGTGTTGCG AATATTTTTT GACAAACTGC TTCACAATGC GGTCTTCCAA

501 CGAATGGAAA GCAATGACCG CCAAACGTCC GCCCTCTTTC AGACGACACA

551 TGACCTGCGG CAATACTGCC CCTACTTCTT CAAGCTCGCG GTTAATAAAG

601 ATGCGGATTG CCTGGAAGGT GCGCGTCGCA GGATCCTGCC CAAGCTCGCG

651 AGTACGGACG TTTTGTGCCA CGATCTGCGC CAGCTTGCGG GTTGTATCGA

701 TTGGACTTTC CGCCTGTTGC GCAACAATGG CGCGCGCAAT CTGGCGGCTA

751 AACCGCTCTT CACCATAA
```

This corresponds to the amino acid sequence <SEQ ID 898; ORF 239.a>:

```
a239.pep
  1 MLHHKGIARN RRMEVLFFCR RPDRFVVRQT RLLQPHLRII LLQGDFLFFR

51 LIQSCEVEPV LVLLHHNGKS GNAHRKQQKE IQFVHCHSDV FLCDCSGIGP

101 AVRSATRKTA LLALGLAAIS ASPGFNALPA IFRGGSGKSA SLTAAQRGRG

151 ACCEYFLTNC FTMRSSNEWK AMTAKRPPSF RRHMTCGNTA PTSSSSRLIK

201 MRIAWKVRVA GSCPRSRVRT FCATICASLR VVSIGLSARC ATMARAIWRL

251 NRSSP*
``` m239/a239 97.3% identity in 255 aa overlap

```
                   10         20         30         40         50         60
    m239.pep MLHHKGXARNRXMEVLFFCRRPDRFVVRQTRLLQPHLRIILLQGDFLFFRLIQSCEIEPV
             ||||||  ||||  |||||||||||||||||||||||||||||||||||||||||| |||
        a239 MLHHKGIARNRRMEVLFFCRRPDRFVVRQTRLLQPHLRIILLQGDFLFFRLIQSCEVEPV
                   10         20         30         40         50         60

70         80         90        100        110        120
    m239.pep LVLLHHNGKSGNAHRKQQKEIQFVHCHSDVFLCDCSGIGPAVRSATRKTALLALGLAAIS
             ||||||||||||||||||||||||||||||||||||||||||||||||||||||||||||
        a239 LVLLHHNGKSGNAHRKQQKEIQFVHCHSDVFLCDCSGIGPAVRSATRKTALLALGLAAIS
                   70         80         90        100        110        120

130        140        150        160        170        180
    m239.pep ASPGFNALPTIFRGSSGKSASLTAAQRGRGACCEYFLTNCFTMRSSNEWKAMTAKRPPSF
             ||||||||| :|||| :|||||||||||||||||||||||||||||||||||||||||||
        a239 ASPGFNALPAIFRGSGGKSASLTAAQRGRGACCEYFLTNCFTMRSSNEWKAMTAKRPPSF
                  130        140        150        160        170        180

190        200        210        220        230        240
    m239.pep RRHMTCGNTAPTSSSSRLIKMRTAWKVRVAGSCPRSRVRTFCATICASLRVVSIGLSARC
             ||||||||||||||||||||||| ||||||||||||||||||||||||||||||||||||
        a239 RRHMTCGNTAPTSSSSRLIKMRIAWKVRVAGSCPRSRVRTFCATICASLRVVSIGLSARC
                  190        200        210        220        230        240

250
    m239.pep ATMARAIRRLNRSSPX
             ||||||| ||||||||
        a239 ATMARAIWRLNRSSPX
                  250
```

The following partial DNA sequence was identified in *N. gonorrhoeae* <SEQ ID 899>:

```
g240.seq
  1 atgatagaag tcatacattt cttcggcgcc gaaacgcgca gacagtttgc 51 ttgtgccgac gttggacgat ttctgcataa tgccgcgcac atccaaagag 101 gggtaaacat gggtatcatc gcgcacggga acggtccga ttttataagg 151 ctgcgtattc agccgttcgt tcaaatcggt tttgcccgca tccaatgcct 201 tcgcaatcac gaacggtttg attgccgaac caggttcgat catatcggtt 251 acggcacggt tgcgccgctg ttcgctgtct gcccggccgg gtctgttggg 301 atcgtaggcg ggcgtattgg ccaaggcgag gatttcccc gtgcgggcat 351 ccaaaaccac caccgttccg gcttttgcct gatggtattc gaccgccttg 401 ttcaactctt cataggccaa ggtctgaatc ctctgatcga gggaaaggat 451 gatgtctttg ccgttttgcg gtgctttatt gcgcggggag tccaagctgt 501 ccacaatatt gccctgccgg tcccgcaaaa caacttccgc gccgtcttcg 551 ccatacaggc tgtcttcaag cgaaagttcc aaaccttcct gacctttgcc 601 gtcaatatcg gtaaatccga tgacgtgtgc aaacaggttg cccatcgggt 651 aatggcgttt taa
```

This corresponds to the amino acid sequence <SEQ ID 900; ORF 240.ng>:

```
g240.pep
  1 MIEVIHFFGA ETRRQFACAD VGRFLHNAAH IQRGVNMGII AHGRRSDFIR

51 LRIQPFVQIG FARIQCLRNH ERFDCRTRFD HIGYGTVAPL FAVCPAGSVG

101 IVGGRIGQGE DFPRAGIQNH HRSGFCLMVF DRLVQLFIGQ GLNPLIEGKD

151 DVFAVLRCFI ARGVQAVHNI ALPVPQNNFR AVFAIQAVFK RKFQTFLTFA

201 VNIGKSDDVC KQVAHRVMAF*
```

The following partial DNA sequence was identified in *N. meningitidis* <SEQ ID 901>:

```
m240.seq
  1 ATGATAGAAG TCATACATTT CTTCGGCACC GAAACGCGCA GACAGTTTGC

51 TTGTGCCGAC GTTGGACGAT TTCTGCATGA TGCCGCGCAC ATCCAAAGAG

101 GGGTAAACAT GGGTATCGCG CACGGGAGAC GGTCCGATTT TATAAGGCTG

151 CGTATTCAGC CGTTCGTTCA AATCGGTTTT GCCCGCATCC AATGCCTTCG

201 CAATCACAAA CGGTTTGATT GCCGAACCGG GTTCGATCAT ATCGGTTACG

251 GCACGGTTGC GCCGCTGTTC GCTGTCTGCC CGGCCGGGCC TGTTGGGATC

301 GTAGGCGGGC GTATTGGCCA AGGCGAGGAT TTCCCCCGTG CGGGCATCCA

351 ArACCACCAC CGTTCCGGCT TTTGCCTGAT GGTATTCGAC CGCCTTGTTC

401 AACTCTTCAT AGGCCAAGGT CTGAATCCTC TGATCGAGGG AAAGGATGAT

451 GTCTTTGCCG TTTTTCGGGG CTTTAkTGCG CGGGGAGTCC AAGCTGTCCA

501 CAATATTGCC CTGCCGGTCC CGCAAAACGA CTTCCGCGCC GTCTTCGCCA

551 TGCAAGCTGT CTTCAAGCGA AAGTTCCAAA CCTTCCTGAC CTTTGCCGTC

601 AATATCGGTA AATCCGATGA CGTGTGCAAA CAGGTTGCCC ATCGGGTAAT

651 GGCGTTTTAA
                                                    40
```

This corresponds to the amino acid sequence <SEQ ID 902; ORF 240>:

```
m240.pep
  1 MIEVIHFFGT ETRRQFACAD VGRFLHDAAH IQRGVNMGIA HGRRSDFIRL

51 RIQPFVQIGF ARIQCLRNHK RFDCRTGFDH IGYGTVAPLF AVCPAGPVGI

101 VGGRIGQGED FPRAGIQXHH RSGFCLMVFD RLVQLFIGQG LNPLIEGKDD

151 VFAVFRGFXA RGVQAVHNIA LPVPQNDFRA VFAMQAVFKR KFQTFLTFAV

201 NIGKSDDVCK QVAHRVMAF*
```

Computer analysis of this amino acid sequence gave the following results:
Homology with a Predicted ORF from *N. gonorrhoeae*
ORF 240 shows 94.5% identity over a 220 aa overlap with a predicted ORF (ORF 240.ng) from *N. gonorrhoeae*:

```
    m240/g240
                    10        20        30        40        50        59
        m240.pep    MIEVIHFFGTETRRQFACADVGRFLHDAAHIQRGVNMGI-AHGRRSDFIRLRIQPFVQIG
                    |||||||||:||||||||||||||||:|||||||||||| |||||||||||||||||||
            g240    MIEVIHFFGAETRRQFACADVGRFLHNAAHIQRGVNMGIIAHGRRSDFIRLRIQPFVQIG
                    10        20        30        40        50        60
```

-continued

```
                  60         70         80         90        100        110       119
    m240.pep   FARIQCLRNHKRFDCRTGFDHIGYGTVAPLFAVCPAGPVGIVGGRIGQGEDFPRAGIQXH
               ||||||||||:||||||||||||||||||||||||||||:|||||||||||||||||| |
    g240       FARIQCLRNHERGDCRTRFDHIGYGTVAPLFAVCPAGSVGIVGGRIGQGEDFPRAGIQNH
                         70         80         90        100        110        120
                 120        130        140        150        160        170       179
    m240.pep   HRSGFCLMVFDRLVQLFIGQGLNPLIEGKDDVFAVFRGFXARGVQAVHNIALPVPQNDFR
               |||||||||||||||||||||||||||||||||||: |  ||||||||||||||||||:||
    g240       HRSGFCLMVFDRLVQLFIGQGLNPLIEGKDDVFAVLRCFIARGVQAVHNIALPVPQNNFR
                         130        140        150        160        170        180
                 180        190        200        210        220
    m240.pep   AVFAMQAVFKRKFQTFLTFAVNIGKSDDVCKQVAHRVMAFX
               ||||:||||||||||||||||||||||||||||||||||||
    g240       AVFAIQAVFKRKFQTFLTFAVNIGKSDDVCKQVAHRVMAF
                         190        200        210        220
```

The following partial DNA sequence was identified in *N. meningitidis* <SEQ ID 903>:

```
a240.seq
   1  ATGATAGAAG TCATACATTT CTTCGGCACC GAAACGCGCA GACAGTTTGC

51  TTGTGCCGAC GTTGGACGAT TTCTGCATGA TGCCGCGCAC ATCCAAAGAG

101  GGGTAAACAT GGGTATCGCG CACGGAGAC GGTCCGATTT TATAAGGCTG

151  CGTATTCAGC CGTTCGTTCA ATCGGTTTT GCCCGCATCC AATGCCTTCG

201  CAATCACAAA CGGTTTGATT GCCGAACCGG GTTCGATCAT ATCGGTTACG

251  GCACGGTTGC GCCGCTGTTC GCTGTCTGCC CGGCCGGGCC TGTTGGGATC

301  GTAGGCGGGC GTATTGGCCA AGGCGAGGAT TTCCCCCGTG CGGGCATCCA

351  AAACCACCAC CGTTCCGGCT TTTGCCTGAT GGTATTCGAC CGCCTTGTTC

401  AACTCTTCAT AGGCCAAGGT CTGAATCCTC TGATCGAGGG AAAGGATGAT

451  GTCTTTGCCG TTTTTCGGGG CTTTATTGCG CGGGGAGTCC AAGCTGTCCA

501  CAATATTGCC CTGCCGGTCC CGCAAAACGA CTTCCGCGCC GTCTTCGCCA

551  TGCAGGCTGT CTTCAAGCGA AAGTTCCAAA CCTTCCTGAC CTTTGCCGTC

601  AATATCGGTA ATCCGATGA CGTGTGCAAA CAGGTTGCCC ATCGGGTAAT

651  GGCGTTTTAA
```

This corresponds to the amino acid sequence <SEQ ID 904; ORF 240.a>:

```
a240.pep
   1  MIEVIHFFGT ETRRQFACAD VGRFLHDAAH IQRGVNMGIA HGRRSDFIRL

51  RIQPFVQIGF ARIQCLRNHK RFDCRTGFDH IGYGTVAPLF AVCPAGPVGI

101  VGGRIGQGED FPRAGIQNHH RSGFCLMVFD RLVQLFIGQG LNPLIEGKDD

151  VFAVFRGFIA RGVQAVHNIA LPVPQNDFRA VFAMQAVFKR KFQTFLTFAV

201  NIGKSDDVCK QVAHRVMAF*
``` m240/a240 99.1% identity in 219 aa overlap

```
                  10         20         30         40         50         60
    m240.pep   MIEVIHFFGTETRRQFACADVGRFLHDAAHIQRGVNMGIAHGRRSDFIRLRIQPFVQIGF
               ||||||||||||||||||||||||||||||||||||||||||||||||||||||||||||
    a240       MIEVIHFFGTETRRQFACADVGRFLHDAAHIQRGVNMGIAHGRRSDFIRLRIQPFVQIGF
                         10         20         30         40         50         60
```

```
              70        80        90       100       110       120
m240.pep  ARIQCLRNHKRFDCRTGFDHIGYGTVAPLFAVCPAGPVGIVGGRIGQGEDFPRAGIQXHH
          ||||||||||||||||||||||||||||||||||||||||||||||||||||||||| ||
a240      ARIQCLRNHKRFDCRTGFDHIGYGTVAPLFAVCPAGPVGIVGGRIGQGEDFPRAGIQNHH
              70        80        90       100       110       120

130       140       150       160       170       180
m240.pep  RSGFCLMVFDRLVQLFIGQGLNPLIEGKDDVFAVFRGFXARGVQAVHNIALPVPQNDFRA
          |||||||||||||||||||||||||||||||||||||| |||||||||||||||||||||
a240      RSGFCLMVFDRLVQLFIGQGLNPLIEGKDDVFAVFRGFIARGVQAVHNIALPVPQNDFRA
             130       140       150       160       170       180

190       200       210       220
m240.pep  VFAMQAVFKRKFQTFLTFAVNIGKSDDVCKQVAHRVMAFX
          ||||||||||||||||||||||||||||||||||||||||
a240      VFAMQAVFKRKFQTFLTFAVNIGKSDDVCKQVAHRVMAFX
             190       200       210       220
```

The following partial DNA sequence was identified in *N. gonorrhoeae* <SEQ ID 905>:

```
g241.seq
   1 ATGATAGAAG TCATACATTT CTTCGGCACC GAAACGCGCA GACAGTTTGC

51 TTGTGCCGAC GTTGGACGAT TTCTGCATGA TGCCGCGCAC ATCCAAAGAG

101 GGGTAAACAT GGGTATCGCG CACGGGAGAC GGTCCGATTT TATAAGGCTG

151 CGTATTCAGC CGTTCGTTCA AATCGGTTTT GCCCGCATCC AATGCCTTCG

201 CAATCACAAA CGGTTTGATT GCCGAACCGG GTTCGATCAT ATCGGTTACG

251 GCACGGTTGC GCCGCTGTTC GCTGTCTGCC CGGCCGGGCC TGTTGGGATC

301 GTAGGCGGGC GTATTGGCCA AGGCGAGGAT TTCCCCCGTG CGGGCATCCA

351 ArACCACCAC CGTTCCGGCT TTTGCCTGAT GGTATTCGAC CGCCTTGTTC

401 AACTCTTCAT AGGCCAAGGT CTGAATCCTC TGATCGAGGG AAAGGATGAT

451 GTCTTTGCCG TTTTTCGGGG CTTTAkTGCG CGGGGAGTCC AAGCTGTCCA

501 CAATATTGCC CTGCCGGTCC CGCAAAACGA CTTCCGCGCC GTCTTCGCCA

551 TGCAAGCTGT CTTCAAGCGA AAGTTCCAAA CCTTCCTGAC CTTTGCCGTC

601 AATATCGGTA AATCCGATGA CGTGTGCAAA CAGGTTGCCC ATCGGGTAAT

651 GGCGTTTTAA
```

This corresponds to the amino acid sequence <SEQ ID 906; ORF 241.ng>:

```
g241.pep
   1 MPTRPTRAAN PPTPTTWLQT AYCPRPPYRP PSVQTHTPHE PASSTCAAKS

51 ANRRENSHNA QPTYLLHPSN KMPSETEQTL FRRHQIPPSC RQSVVVMTVR

101 TVDMTVCDFL IGCIAHAFNR SFKADFHACQ RMVAVHHRLA VGNIGYTIDD

151 NIAGFRIVRF KHHTDLDFNR ERARIFNTDQ LRIMLTERIV GRKRHFDRIA

201 GILTVQRLFH QRENAVVTAV QIRNRFFGFI QKLIVGIIHL IMQRNHGIFC

251 NSHICPFRNS RLITGAF*
```

The following partial DNA sequence was identified in *N. meningitidis* <SEQ ID 907>:

```
m241.seq (partial)
  1 ..CGGCAATCAG TGGTGGTGAT GACCGTGCGG GCCGTGGACA TGACCGTGTG

51   CGATTTCCTC ATCGGATGCA TCGCGCACGC TTTCAACTGT AGCCTTAAAG

101   CGGATTTTCA TGCCTGCCAA AGGATGGTTG CCGTCCACCA CCGCCTTGCC

151   GTCGGCAACA TCGGTTACAC GATAGACGAC AACATCGCCG GTTTCAGGAT

201   CGTCGGCTTC AAACATCATG CCGACTTCGA CTTCAACAGG GAACACGCCC

251   GCATCTTCGA TACGGACCAA CTCCGGATCC TGCTCGCCGA ACGCATCGTC

301   GGGCGACAGC GCCACATCGA CCGTATCGCC GGCATCCTTA CCGTGCAACG

351   CCTCTTCCAC CAAAGGGAAA ATGCCGTCGT AACCGCCGTG CAGATACGCA

401   ATCGGTTCTT CGGTTTTGTC CAAAAGCTGA TTGTTGGCAT CATACATCTC

451   ATAATGCAGC GAAACCACGG AATTTTTCAC GATAGCCATA TTTGTCCTTT

501   CAGGAACAGC AGATTAATTA CAGGCGCATT CTAA
```

This corresponds to the amino acid sequence <SEQ ID 908; ORF 241>:

```
m241.pep (partial)
  1 ..RQSVVVMTVR AVDMTVCDFL IGCIAHAFNC SLKADFHACQ RMVAVHHRLA

51   VGNIGYTIDD NIAGFRIVGF KHHADFDFNR EHARIFDTDQ LRILLAERIV

101   GRQRHIDRIA GILTVQRLFH QRENAVVTAV QIRNRFFGFV QKLIVGIIHL

151   IMQRNHGIFH DSHICPFRNS RLITGAF*
```

Computer analysis of this amino acid sequence gave the following results:

Homology with a Predicted ORF from *N. gonorrhoeae*

ORF 241 shows 91.5% identity over a 177 aa overlap with a predicted ORF (ORF 241.ng) from *N. gonorrhoeae*:

```
m241/g241

10        20        30
m241.pep                                 RQSVVVMTVRAVDMTVCDFLIGCIAHAFNC
                                         ||||||||||:|||||||||||||| ||| 
g241         QPTYLLHPSNKMPSETEQTLFRRHQIPPSCRQSVVVMTVRTVDMTVCDFLIGCIAGAFNR
                     70        80        90       100       110       120

40        50        60        70        80        90
m241.pep     SLKADFHACQRMVAVHHRLAVGNIGYTIDDNIAGFRIVGFKHHADFDFNREHARIFDTDQ
             |:|||||||||||||||||||||||||||||||||||| ||||:|:|||||:||||:|||
g241         SFKADFHACQRMVAVHHRLAVGNIGYTIDDNIAGFRIVRFKHHTDLDFNRERARIFNTDQ
                    130       140       150       160       170       180

100       110       120       130       140       150
m241.pep     LRILLAERIVGRQRHIDRIAGILTVQRLFHQRENAVVTAVQIRNRFFGFVQKLIVGIIHL
             |||:|:||||||:||:|||||||||||||||||||||||||||||||||:||||||||||
g241         LRIMLTERIVGRKRHFDRIAGILTVQRLFHQRENAVVTAVQIRNRFFGFIQKLIVGIIHL
                    190       200       210       220       230       240

160       170
m241.pep     IMQRNHGIFHDSHICPFRNSRLITGAFX
             ||||||||| :|||||||||||||||||
g241         IMQRNHGIFCNSHICPFRNSRLITGAFX
                    250       260
```

The following partial DNA sequence was identified in *N. meningitidis* <SEQ ID 909>:

```
a241.seq
   1 ATGCCAACAC GTCCAACTCG

```
                  160        170
   m241.pep  IMQRNHGIFHDSHICPFRNSRLITGAFX
             ||||||||:||||||||||||||||||||
       a241  IMQRNHGILHDSHICPFRNSRLITGAFX
                  250        260
```

The following partial DNA sequence was identified in *N. gonorrhoeae* <SEQ ID 911>:

```
g241-1.seq
   1 ATGATAGAAG TCATACATTT CTTCGGCACC GAAACGCGCA GACAGTTTGC

51 TTGTGCCGAC GTTGGACGAT TTCTGCATGA TGCCGCGCAC ATCCAAAGAG

101 GGGTAAACAT GGGTATCGCG CACGGGAGAC GGTCCGATTT TATAAGGCTG

151 CGTATTCAGC CGTTCGTTCA AATCGGTTTT GCCCGCATCC AATGCCTTCG

201 CAATCACAAA CGGTTTGATT GCCGAACCGG GTTCGATCAT ATCGGTTACG

251 GCACGGTTGC GCCGCTGTTC GCTGTCTGCC CGGCCGGGCC TGTTGGGATC

301 GTAGGCGGGC GTATTGGCCA AGGCGAGGAT TTCCCCCGTG CGGGCATCCA

351 ArACCACCAC CGTTCCGGCT TTTGCCTGAT GGTATTCGAC CGCCTTGTTC

401 AACTCTTCAT AGGCCAAGGT CTGAATCCTC TGATCGAGGG AAAGGATGAT

451 GTCTTTGCCG TTTTTCGGGG CTTTAkTGCG CGGGGAGTCC AAGCTGTCCA

501 CAATATTGCC CTGCCGGTCC CGCAAAACGA CTTCCGCGCC GTCTTCGCCA

551 TGCAAGCTGT CTTCAAGCGA AAGTTCCAAA CCTTCCTGAC CTTTGCCGTC

601 AATATCGGTA AATCCGATGA CGTGTGCAAA CAGGTTGCCC ATCGGGTAAT

651 GGCGTTTTAA
```

This corresponds to the amino acid sequence <SEQ ID 912; ORF 241-1.ng>:

```
g241-1.pep
   1 MPTRPTRAAN PPTPTTWLQT AYCPRPPYRP PSVQTHTPHE PASSTCAAKS

51 ANRRENSHNA QPTYLLHPSN KMPSETEQTL FRRHQIPPSC RQSVVVMTVR

101 TVDMTVCDFL IGCIAHAFNR SFKADFHACQ RMVAVHHRLA VGNIGYTIDD

151 NIAGFRIVRF KHHTDLDFNR ERARIFNTDQ LRIMLTERIV GRKRHFDRIA

201 GILTVQRLFH QRENAVVTAV QIRNRFFGFI QKLIVGIIHL IMQRNHGIFC

251 NSHICPFRNS RLITGAF*
```

The following partial DNA sequence was identified in *N. meningitidis* <SEQ ID 913>:

```
m241-1.seq
   1 ATGCCAACAC GTCCAACTCG CGCTGCAAAC CCTCCAACCC CGCCAACCTG

51 GCTTCAGACG GCATACTGCC CTCGTCCGCC ATATCGTCCG CCGTCCGTGC

101 AAACGCGTAC ACCGCGTGAA CCGGCTTCCT CAACCTGCGC GGCAAAATCA

151 GCGAACCGAC GGGAAAATTC TCATAATGCC CAACCGACAT ACCTTCTCCA

201 TCCATCAAAC AAAATGCCGT CTGAAACGGA ACAAACCCTT TTCAGACGGC

251 ATCAGATACC TCCAAGCTGC CGGCAATCAG TGGTGGTGAT GACCGTGCGG

301 GCCGTGGACA TGACCGTGTG CGATTTCCTC ATCGGATGCA TCGCGCACGC
```

-continued

```
351 TTTCAACTGT AGCCTTAAAG CGGATTTTCA TGCCTGCCAA AGGATGGTTG

401 CCGTCCACCA CCGCCTTGCC GTCGGCAACA TCGGTTACAC GATAGACGAC

451 AACATCGCCG GTTTCAGGAT CGTCGGCTTC AAACATCATG CCGACTTCGA

501 CTTCAACAGG GAACACGCCC GCATCTTCGA TACGGACCAA CTCCGGATCC

551 TGCTCGCCGA ACGCATCGTC GGGCGACAGC GCCACATCGA CCGTATCGCC

601 GGCATCCTTA CCGTGCAACG CCTCTTCCAC CAAAGGGAAA ATGCCGTCGT

651 AACCGCCGTG CAGATACGCA ATCGGTTCTT CGGTTTTGTC CAAAAGCTGA

701 TTGTTGGCAT CATACATCTC ATAATGCAGC GAAACCACGG AATTTTTCAC

751 GATAGCCATA TTTGTCCTTT CAGGAACAGC AGATTAATTA CAGGCGCATT

801 CTAA
```

This corresponds to the amino acid sequence <SEQ ID 914; ORF 241-1>:

```
m241-1.pep

1 MPTRPTRAAN PPTPPTWLQT AYCPRPPYRP PSVQTRTPRE PASSTCAAKS

51 ANRRENSHNA QPTYLLHPSN KMPSETEQTL FRRHQIPPSC RQSVVVMTVR

101 AVDMTVCDFL IGCIAHAFNC SLKADFHACQ RMVAVHHRLA VGNIGYTIDD

151 NIAGFRIVGF KHHADFDFNR EHARIFDTDQ LRILLAERIV GRQRHIDRIA

201 GILTVQRLFH QRENAVVTAV QIRNRFFGFV QKLIVGIIHL IMQRNHGIFH

251 DSHICPFRNS RLITGAF* m241-/g241-1    93.3% identity in 267 aa overlap 10         20         30         40         50         60
m241-1.pep    MPTRPTRAANPPTPPTWLQTAYCPRPPYRPPSVQTRTPREPASSTCAAKSANRRENSHNA
              |||||||||||||| |||||||||||||||||||||:||:||||||||||||||||||||
g241          MPTRPTRAANPPTPTTWLQTAYCPRPPYRPPSVQTHTPHEPASSTCAAKSANRRENSHNA
                  10         20         30         40         50         60

70         80         90        100        110        120
m241-1.pep    QPTYLLHPSNKMPSETEQTLFRRHQIPPSCRQSVVVMTVRAVDMTVCDFLIGCIAHAFNC
              ||||||||||||||||||||||||||||||||||||||||:|||||||||||||||||||
g241          QPTYLLHPSNKMPSETEQTLFRRHQIPPSCRQSVVVMTVRTVDMTVCDFLIGCIAHAFNR
                  70         80         90        100        110        120

130        140        150        160        170        180
m241-1.pep    SLKADFHACQRMVAVHHRLAVGNIGYTIDDNIAGFRIVGFKHHADFDFNREHARIFDTDQ
              |:|||||||||||||||||||||||||||||||||||| ||||:||||||:||||:|||
g241          SFKADFHACQRMVAVHHRLAVGNIGYTIDDNIAGFRIVRFKHHTDLDFNRERARIFNTDQ
                 130        140        150        160        170        180

190        200        210        220        230        240
m241-1.pep    LRILLAERIVGRQRHIDRIAGILTVQRLFHQRENAVVTAVQIRNRFFGFVQKLIVGIIHL
              |||:|:|||||:||:|||||||||||||||||||||||||||||||||||:|||||||||
g241          LRIMLTERIVGRKRHFDRIAGILTVQRLFHQRENAVVTAVQIRNRFFGFIQKLIVGIIHL
                 190        200        210        220        230        240

250        260
m241-1.pep    IMQRNHGIFHDSHICPFRNSRLITGAFX
              |||||||||| :||||||||||||||||
g241          IMQRNHGIFCNSHICPFRNSRLITGAFX
                 250        260
```

The following partial DNA sequence was identified in *N. meningitidis* <SEQ ID 915>:

```
a241-1.seq
    1 ATGCCAACAC GTCCAACTCG CGCCGCAAAG CATCCAACCC CGCCAACCTG

51 GCTTCAGACG GCATACTGCC CTCGTCCGCC ATATCGTCCG CCGTCCGTGC
```

```
101 AAACGCATAC ACCGCATGAA CCGGCTTCCT CAACCTGCGC GGCAAAATCA

151 GCGAACCGAC GGGAAAATTT TCATAATGCC CAACCGACAT ACCTTCTCCA

201 TCCATCAAAC AAAATGCCGT CTGAAATGGA ACAAACCCTT TTCAGACGGC

251 ATCAGATACC TCCAAGCTGC CGGCAATCAG TGGTGGTGAT GACCGTGCGG

301 ACCGTGGACA TGACCGTGTG CGATTCCTC ATCGGATGCA TCGCGCACAC

351 TTTCAACCGT AGCCTTAAAG CGGATTTTCA TGCCTGCCAA AGGATGGTTG

401 CCGTCCACCA CCGCCTTACC GTCGGCAACA TCGGTTACAC GATAGACGAC

451 AACATCGCCG GTTTCAGGAT CGTCGGCTTC AAACATCATG CCGACTTCGA

501 CTTCAACAGG GAACACGCCC GCATCTTCAA TACGGACCAA CTCCGGATCC

551 TGCTCGCCGA ACGCATCGTC GGGCGAAAGC GCCACATCGA CCGTATCGCC

601 GGCATCCTTA CCGTGCAACG CCTCTTCCAC CAAAGGGAAA ATGCCGTCGT

651 AACCGCCGTG CAGATACGCA ATCGGTTCTT CGGTTTTGTC CAAAAGCTGA

701 TTGTTGGCAT CATACATCTC ATAATGCAGC GAAACCACGG AATTCTTCAC

751 GATAGCCATA TTTGTCCTTT CAGGAACAGC AGATTAATTA CAGGCGCATT

801 CTAA
```

This corresponds to the amino acid sequence <SEQ ID 916; ORF 241-1.a>:

```
a244-1.pep

1 MPTRPTRAAK HPTPPTWLQT AYCPRPPYRP PSVQTHTPHE PASSTCAAKS

51 ANRRENFHNA QPTYLLHPSN KMPSEMEQTL FRRHQIPPSC RQSVVVMTVR

101 TVDMTVCDFL IGCIAHTFNR SLKADFHACQ RMVAVHHRLT VGNIGYTIDD

151 NIAGFRIVGF KHHADFDFNR EHARIFNTDQ LRILLAERIV GRKRHIDRIA

201 GILTVQRLFH QRENAVVTAV QIRNRFFGFV QKLIVGIIHL IMQRNHGILH

251 DSHICPFRNS RLITGAF* m241-1/a241-1  95.1% identity in 267 aa overlap 10        20        30        40        50        60
m241-1.pep  MPTRPTRAANPPTPPTWLQTAYCPRPPYRPPSVQTRTPREPASSTCAAKSANRRENSHNA
            ||||||||: ||||||||||||||||||||||||| ::|||||||||||||||| |||
a241        MPTRPTRAAKHPTPPTWLQTAYCPRPPYRPPSVQTHTPHEPASSTCAAKSANRRENFHNA
                    10        20        30        40        50        60

70        80        90       100       110       120
m241-1.pep  QPTYLLHPSNKMPSETEQTLFRRHQIPPSCRQSVVVMTVRAVDMTVCDFLIGCIAHAFNC
            |||||||||||||||| ||||||||||||||||||||||| :|||||||||||||:||
a241        QPTYLLHPSNKMPSEMEQTLFRRHQIPPSCRQSVVVMTVRTVDMTVCDFLIGCIAHTFNR
                    70        80        90       100       110       120

130       140       150       160       170       180
m241-1.pep  SLKADFHACQRMVAVHHRLAVGNIGYTIDDNIAGFRIVGFKHHADFDFNREHARIFDTDQ
            ||||||||||||||||||||:||||||||||||||||||||||||||||||||||:|||
a241        SLKADFHACQRMVAVHHRLTVGNIGYTIDDNIAGFRIVGFKHHADFDFNREHARIFNTDQ
                   130       140       150       160       170       180

190       200       210       220       230       239
m241-1.pep  LRILLAERIVGRQHIDRIAGILTVQRLFHQRENAVVTAVQIRNRFFGFVQKLIVGIIHL
            |||||||||||:||||||||||||||||||||||||||||||||||||||||||||||
a241        LRILLAERIVGRKRHIDRIAGILTVQRLFHQRENAVVTAVQIRNRFFGFVQKLIVGIIHL
                   190       200       210       220       230       240
```

```
                    250        260
m241-1.pep   IMQRNHGIFHDSHICPFRNSRLITGAFX
             ||||||||:|||||||||||||||||||
a241         IMQRNHGILHDSHICPFRNSRLITGAFX
                    250        260
```

The following partial DNA sequence was identified in *N. gonorrhoeae* <SEQ ID 917>:

```
g242.seq
   1 atgatcggcg aacttgttgt tttgttcgtg atcgagcact tcaagcaacg
  51 cgctggcggg atcgccccga aagtcgctgc ccaatttgtc gatttcgtcg
 101 agcaggaaca acgggtttct tacgcctgct tttgccatat tctgcaaaat
 151 cttgccgggc atagagccga tataggtacg gcggtgcccg cggatttcgc
 201 tttcgtcgcg cacgccgccc aaggccatac ggacatattt ccgccccgtt
 251 gctttggcga tggattcgcc caaagaggtt ttgcccacgc ccggagggcc
 301 gaccaaacac agaatcggac ctttgagctt gtccatacgt ttttggacgg
 351 cgaggtattc caaaatccgt tctttgactt tttccaggcc gtagtggtcg
 401 gcatccagca ccagtccggc tttggcgatg tctttgctga cgcgggatt
 451 tttcttccac ggcagtccga gcagggtgtc gatgtagttg cgtacgacgg
 501 tggattcggc agacatcggc ggcatcattt tgagtttttt cagttcggac
 551 aggcattttt cttccgcttc tttggtcata cccgcctttt tgatgcctgc
 601 ctccaaggca tccagttcgc cgttttcgtc ttcttcgccc aattctttgt
 651 gtatcgcttt aatctgttcg ttcagataat attcgcgttg ggattttcc
 701 atttggcgtt tgacgcgtcc gcgtatgcgt ttttcggcct gcataatgtc
 751 gagttcggat tccagctttg ccagcaggaa ttccatccgt ttgccgattt
 801 cgggaatctc caaaatctgt tggcgttgcg ccagtttcaa ctgcaaatgc
 851 gctgcgaccg tatcggttag
```

This corresponds to the amino acid sequence <SEQ ID 918; ORF 242.ng>:

```
g242.pep
   1 MIGELVVLFV IEHFKQRAGG IAPKVAAQFV DFVEQEQRVS YACFCHILQN
  51 LAGHRADIGT AVPADFAFVA HAAQGHTDIF PPRCFGDGFA QRGFAHARRA
 101 DQTQNRTFEL VHTFLDGEVF QNPFFDFFQA VVVGIQHQSG FGDVFADAGF
 151 FLPRQSEQGV DVVAYDGGFG RHRRHHFEFF QFGQAFFFRF FGHTRLFDAC
 201 LQGIQFAVFV FFAQFFVYRF NLFVQIIFAL GFFHLAFDAS AYAFFGLHNV
 251 EFGFQLCQQE FHPFADFGNL QNLLALRQFQ LQMRCDRIG*
```

The following partial DNA sequence was identified in *N. meningitidis* <SEQ ID 919>:

```
m242.seq
   1 ATGATCGGCA AACTTGTTGT TTTGTTCGGG ATCGAGCACT TCGAGCAACG
  51 CGCTGGCGGG ATCGCCTCGG AAGTCGTTAC CCAATTTGTC GATTTCGTCG
 101 AGCAGGAACA AGGGGTTTTT CACGCCGGCT TTGCCATAT TCTGCAAAAT
```

-continued

```
151 CTTACCGGGC ATAGAGCCGA TATAGGTGCG GCGGTGTCCC CTGATTTCGC

201 TTTCGTCGCG CACGCCGCCC AAAGCCATGC GGACATATTT CCGCCCCGTT

251 GCTTTGGCGA TGGATTCGCC CAAAGAGGTT TTGCCCACGC CCGGAGGGCC

301 GACCAGGCAC AGAATCGGGC CTTTGAGTTT GTCCATACGT TTTTGGACGG

351 CGAGGTATTC CAAAATCCGT TCTTTGACTT TTTCCAGGCC GTAGTGGTCG

401 GCATCCAGCA CCAGTCCGGC TTTGGCGATG TCTTTGCTGA CGCGGGATTT

451 TTTCTTCCAC GGCAGCTCGA GCAAAGTGTC GATGTAGTTG CGTACGACGG

501 TGGATTCCGC AGACATCGGT GGCATCATTT TGAGCTTTTT CAGTTCGGAC

551 AGGCATTTTT CTTCCGCTTC TTTGGTCATA CCCGCCTTTT TGATATCTGC

601 TTCCAAGGCA TCCAGTTCGC CGTTTTCGTC TTCTTCGCCC AGTTCTTTGT

651 GTATCGCTTT AATCTGTTCG TTCAGATAAT ATTCGCGCTG GGATTTTTCC

701 ATTTGGCGTT TGACGCGTCC GCGTATGCGT TTTTCGGCCT GCATAATGTC

751 GAGTTCGGAT TCCAGCTGTG CCAGCAGGAA TTCCATCCGT TTGCCGATTT

801 CGGGAATTTC CAAAATCTGT TGGCGTTGCG CCAGTTTCAA CTGCAAATGC

851 GCTGCGACCG TATCGGTTAG
```

This corresponds to the amino acid sequence <SEQ ID 920; ORF 242>:

```
m242.pep
  1 MIGKLVVLFG IEHFEQRAGG IASEVVTQFV DFVEQEQGVF HAGFCHILQN

51 LTGHRADIGA AVSPDFAFVA HAAQSHADIF PPRCFGDGFA QRGFAHARRA

101 DQAQNRAFEF VHTFLDGEVF QNPFFDFFQA VVVGIQHQSG FGDVFADAGF

151 FLPRQLEQSV DVVAYDGGFR RHRWHHFELF QFGQAFFFRF FGHTRLFDIC

201 FQGIQFAVFV FFAQFFVYRF NLFVQIIFAL GFFHLAFDAS AYAFFGLHNV

251 EFGFQLCQQE FHPFADFGNF QNLLALRQFQ LQMRCDRIG*
```

Computer analysis of this amino acid sequence gave the following results:

Homology with a Predicted ORF from *N. gonorrhoeae*
ORF 242 shows 90.3% identity over a 289 aa overlap with a predicted ORF (ORF 242.ng) from *N. gonorrhoeae*:

```
   m242/g24290.3% identity in 289 aa overlap
               10        20        30        40        50        60
   m242.pep    MIGKLVVLFGIEHFEQRAGGIASEVVTQFVDFVEQEQGVFHAGFCHILQNLTGHRADIGA
               |||:||||| ||||:|| |||| :|::||||||||||| | :| ||||||||:||||||||:
   g242        MIGELVVLFVIEHFKQRAGGIAPKVAAQFVDFVEQEQRVSYACFCHILQNLAGHRADIGT
               10        20        30        40        50        60

70        80        90       100       110       120
   m242.pep    AVSPDFAFVAHAAQSHADIFPPRCFGDGFAQRGFAHARRADQAQNRAFEFVHTFLDGEVF
               ||  ||||||||||:|:||||||||||||||||||||||||||||:|||:||:|||||||||
   g242        AVPADFAFVAHAAQGHTDIFPPRCFGDGFAQRGFAHARRADQTQNRTFELVHTFLDGEVE
               70        80        90       100       110       120

130       140       150       160       170       180
   m242.pep    QNPFFDFFQAVVVGIQHQSGFGDVFADAGFFLPRQLEQSVDVVAYDGGFRRHRWHHFELF
               ||||||||||||||||||||||||||||||||||||| ||:|||||||||| ||| ||||:|
   g242        QNPFFDFFQAVVVGIQHQSGFGDVFADAGFFLPRQSEQGVDVVAYDGGFGRHRRHHFEFF
              130       140       150       160       170       180
```

-continued

```
                  190       200       210       220       230       240
m242.pep   QFGQAFFFRFFGHTRLFDICFQGIQFAVFVFFAQFFVYRFNLFVQIIFALGFFHLAFDAS
           |||||||||||||||| |:|||||||||||||||||||||||||||||||||||||||||
g242       QFGQAFFFRFFGHTRLFDACLQGIQFAVFVFFAQFFVYRFNLFVQIIFALGFFHLAFDAS
                  190       200       210       220       230       240

250       260       270       280       290
m242.pep   AYAFFGLHNVEFGFQLCQQEFHPFADFGNFQNLLALRQFQLQMRCDRIGX
           ||||||||||||||||||||||||||||:|||||||||||||||||||||
g242       AYAFFGLHNVEFGFQLCQQEFHPFADFGNLQNLLALRQFQLQMRCDRIGX
                  250       260       270       280
```

The following partial DNA sequence was identified in *N. meningitidis* <SEQ ID 921>:

```
a242.seq
  1 ATGATCGGCG AACTTGTTGT TTTGCTCGGG ATCAAGCACT TCGAGCAACG

51 CGCTGGCGGG ATCGCCCCGG AAGTCGCTAN CCAATTTGTC GATTTCGTCG

101 AGCAGGAACA ATGGGTTTTT TACGCCGGCT TTTGCCATAT TCTGCAAAAT

151 CTTACCGGGC ATGGAGCCGA TATAGGTGCG GCGGTGTCCC CGGATTTCGC

201 TTTCGTCGCG CACGCCGCCC AAAGCCATGC GGACATATTT CCGCCCCGTT

251 GCTTTGGCGA TGGATTCGCC CAAAGAGGTT TTGCCCACGC CTGGAGGGCC

301 GACCAGGCAC AGAATCGGGC CTTTGAGTTT GTCCATACGT TTTTGGACGG

351 CGAGGTATTC CAAAATCCGT TCTTTGACTT TTTCCAGGCC GTAGTGGTCG

401 GTATCCAGCA CCAATCCGGC TTTGGCGATG TCTTTGCTGA CGCGGGATTT

451 TTTCTTCCAC GGCAGTTCGA GCAGGGTGTC GATGTAGTTG CGTACGACGG

501 TGGATTCGGC AGACATCGGC GGCATCATTT TGAGCTTTTT CAGTTCGGAC

551 AGGCATTTTT CTTCCGCTTC TTTGGTCATA CCCGCCTTTT TGATATCTGC

601 TTCCAAGGCA TCCAGTTCGC CGTTTTCGTC TTCTTCGCCC AGTTCTTTGT

651 GTATCGCTTT AATCTGTTCG TTCAGATAAT ATTCGCGCTG GGATTTTTCC

701 ATTTGGCGTT TGACGCGTCC GCGTATGCGT TTTTCGGCCT GCATAATGTC

751 GAGTTCGGAT TCCAGCTGTG CCAGCAGGAA TTCCATCCGT TTGCCGATTT

801 CGGGAATTTC CAAAATCTGT TGGCGTTGCG CCAGTTTCAA CTGCAAATGC

851 GCTGCGACCG TATCGGTTAG
```

This corresponds to the amino acid sequence <SEQ ID 922; ORF 242.a>:

```
a242.pep
  1 MIGELVVLLG IKHFEQRAGG IAPEVAXQFV DFVEQEQWVF YAGFCHILQN

51 LTGHGADIGA AVSPDFAFVA HAAQSHADIF PPRCFGDGFA QRGFAHAWRA

101 DQAQNRAFEF VHTFLDGEVF QNPFFDFFQA VVVGIQHQSG FGDVFADAGF

151 FLPRQFEQGV DVVAYDGGFG RHRRHHFELF QFGQAFFFRF FGHTRLFDIC

201 FQGIQFAVFV FFAQFFVYRF NLFVQIIFAL GFFHLAFDAS AYAFFGLHNV

251 EFGFQLCQQE FHPFADFGNF QNLLALRQFQ LQMRCDRIG*
``` m242/a242 95.2% identity in 289 aa overlap

```
                 10        20        30        40        50        60
    m242.pep  MIGKLVVLFGIEHFEQRAGGIASEVVTQFVDFVEQEQGVFHAGFCHILQNLTGHRADIGA
              |||:||||:||:||||||||||  ||::|||||||||||:|||||||||||||||||||
    a242      MIGELVVLLGIKHFEQRAGGIAPEVAXQFVDFVEQEQWVFYAGFCHILQNLTGHGADIGA
                 10        20        30        40        50        60

70        80        90       100       110       120
    m242.pep  AVSPDFAFVAHAAQSHADIFPPRCFGDGFAQRGFAHARRADQAQNRAFEFVHTFLDGEVF
              |||||||||||||||||||||||||||||||||||||| |||||||||||||||||||||
    a242      AVSPDFAFVAHAAQSHADIFPPRCFGDGFAQRGFAHAWRADQAQNRAFEFVHTFLDGEVE
                 70        80        90       100       110       120

130       140       150       160       170       180
    m242.pep  QNPFFDFFQAVVVGIQHQSGFGDVFADAGFFLPRQLEQSVDVVAYDGGFRRHRWHHFELF
              ||||||||||||||||||||||||||||||||||||:||:|||||||||||| |||||||
    a242      QNPFFDFFQAVVVGIQHQSGFGDVFADAGFFLPRQFEQGVDVVAYDGGFGRHRRHHFELF
                130       140       150       160       170       180

190       200       210       220       230       240
    m242.pep  QFGQAFFFRFFGHTRLFDICFQGIQFAVFVFFAQFFVYRFNLFVQIIFALGFFHLAFDAS
              ||||||||||||||||||||||||||||||||||||||||||||||||||||||||||||
    a242      QFGQAFFFRFFGHTRLFDICFQGIQFAVFVFFAQFFVYRFNLFVQIIFALGFFHLAFDAS
                190       200       210       220       230       240

250       260       270       280       290
    m242.pep  AYAFFGLHNVEFGFQLCQQEFHPFADFGNFQNLLALRQFQLQMRCDRIGX
              ||||||||||||||||||||||||||||||||||||||||||||||||||
    a242      AYAFFGLHNVEFGFQLCQQEFHPFADFGNFQNLLALRQFQLQMRCDRIGX
                250       260       270       280
```

The following partial DNA sequence was identified in *N. gonorrhoeae* <SEQ ID 923>:

```
g243.seq
   1  ATGGTaatcg tctGGTTGCc cgAGTTaccg CCGATGCCGG CGACGATGGG

51  CATCAGCGCG GCGAGTGCGA CGATTTTTTC gatactgcCT TCAAACGCGC

101  CGATGACGCG GCTGGCGAGG AAGGCGGTGC AGAGGTTGAC GGCGAGCCAC

151  ATCCAGCGGT TTTTGACGGA ATCCAAGACG GGGGCGAACA GGTCTTCCTC

201  TTCCTGCAAA CCTGCCATGT TCAACATATC CGCTTCGGAT TCTTCGCGGA

251  TCACGTCCAC CATCTCGTCG ATGGTAATCc tgCCGATGAG CTTTTTGTTT

301  TCATCAACGA CGGGCGCGGT AACCAAGTCG TAG
```

This corresponds to the amino acid sequence <SEQ ID 924; ORF 243.ng>:

```
g243.pep
   1  MVIVWLPELP PMPATMGISA ASATIFSILP SNAPMTRLAR KAVQRLTASH

51  IQRFLTESKT GANRSSSSCK PAMFNISASD SSRITSTISS MVILPMSFLF

101  SSTTGAVTKS *
```

The following partial DNA sequence was identified in *N. meningitidis* <SEQ ID 925>:

```
m243.seq
   1  ATGGTAATCG TCTGGTTGCC CGAGTTACCG CCTATGCCGG CGACGATGGG

51  CATCAGCGCG GyGAGTGCGA CGATTTTTTC GATGCTGCCT TCAAACGCGC

101  CGATAACACG GyTGGCGAGG AAGGCGGTGC AGAGGTTGAC GGCGAGCCAC

151  ATCCAGyGGT TTTTCACCGA ATCCCACACG GGGGCGAAyA GGTCTTCCTC

201  TTCCTGCAAA CCCGCCATAT TCAGCATATC CGCTTCCGAT TCTTCGCGGA
```

```
251 TCACGTCCAC CATCTCGTCG ATGGTAATCC TGCCGATGAG CTTTTTGTTT

301 TCATCGACGA CGGGCGCGGT AACCAAGTCG TAG
```

This corresponds to the amino acid sequence <SEQ ID 926; ORF 243>:

```
m243.pep
  1 MVIVWLPELP PMPATMGISA XSATIFSMLP SNAPITRLAR KAVQRLTASH

51 IQXFFTESHT GANRSSSSCK PAIFSISASD SSRITSTISS MVILPMSFLF

101 SSTTGAVTKS *
```

Computer analysis of this amino acid sequence gave the following results:
Homology with a Predicted ORF from *N. gonorrhoeae*
ORF 243 shows 92.7% identity over a 110 aa overlap with a predicted ORF (ORF 243.ng) from *N. gonorrhoeae*:

```
m243/g243
                      10        20        30        40        50        60
    m243.pep  MVIVWLPELPPMPATMGISAXSATIFSMLPSNAPITRLARKAVQRLTASHIQXFFTESHT
              ||||||||||||||||||| ||||||:||||||:||||||||||||||||| :|||:|
    g243      MVIVWLPELPPMPATMGISAASATIFSILPSNAPMTRLARKAVQRLTASHIQRFLTESKT
                      10        20        30        40        50        60

70        80        90       100       110
    m243.pep  GANRSSSSCKPAIFSISASDSSRITSTISSMVILPMSFLFSSTTGAVTKSX
              |||||||||||:|:||||||||||||||||||||||||||||||||||||
    g243      GANRSSSSCKPAMFNISASDSSRITSTISSMVILPMSFLFSSTTGAVTKSX
                      70        80        90       100       110
```

The following partial DNA sequence was identified in *N. meningitidis* <SEQ ID 927>:

```
a243.seq
  1 ATGGTAATCG TCTGGTTGCC CGAGTTACCG CCTATGCCGG CGACGATGGG

51 CATCAGCGCG GCGAGTGCGA CGATTTTTTC GATGCTGCCT TCAAACGCGC

101 CGATAACACG GCTGGCGAGG AAGGCGGTGC AGAGGTTGAC GGCGAGCCAC

151 ATCCAGCGGT TTTTGACGGA ATCCAAGACG GGGGCGAATA AGTCTTCCTC

201 TTCTTGCAAA CCCGCCATAT TCAACATATC CGCTTCGGAT TCTTCGCGGA

251 TCACGTCCAC CATTTCGTCA ACGGTCACCC TGCCGATGAG CTTTTTGTTT

301 TCATCGACGA CGGGCGCGGT AACCAAGTCA TAG
```

This corresponds to the amino acid sequence <SEQ ID 928; ORF 243.a>:

```
a243.pep
  1 MVIVWLPELP PMPATMGISA ASATIFSMLP SNAPITRLAR KAVQRLTASH

51 IQRFLTESKT GANKSSSSCK PAIFNISASD SSRITSTISS TVTLPMSFLF

101 SSTTGAVTKS *
``` m243/a243 92.7% identity in 110 aa overlap

```
                  10        20        30        40        50        60
    m243.pep  MVIVWLPELPPMPATMGISAXSATIFSMLPSNAPITRLARKAVQRLTASHIQXFFTESHT
              ||||||||||||||||||||  ||||||||||||||||||||||||||||| :||| :|
    a243      MVIVWLPELPPMPATMGISAASATIFSMLPSNAPITRLARKAVQRLTASHIQRFLTESKT
                  10        20        30        40        50        60

70        80        90       100       110
    m243.pep  GANRSSSSCKPAIFSISASDSSRITSTISSMVILPMSFLFSSTTGAVTKSX
              |||:||||||||||:||||||||||||||||| ||||||||||||||||||
    a243      GANKSSSSCKPAIFNISASDSSRITSTISSTVTLPMSFLFSSTTGAVTKSX
                  70        80        90       100       110
```

The following partial DNA sequence was identified in *N. gonorrhoeae* <SEQ ID 929>:

```
g244.seq
   1 atgccgcctg aagcccggcc ggcgggttca gacggcattg ccgctttact
  51 tcgatcggtt tatacgcaaa acgcgcttca ggaaataaat cagattattc
 101 cccagacgcc ttcaggcttc cttccgtgcc accgtaacca tagccgggcg
 151 caacacacgg tcggacaggg tataaccctt cttcatcaca ccaaccacgg
 201 tattgggttc ctgctcactg gccaccgcct gcatcgcctg atggatattc
 251 ggatcgagct tatcgcccgc tttaggattg atttccttga tttgcgtggc
 301 atcaaacgcc ttctgcaact cattcaaagt catctgcaca cccattttca
 351 gcgcatcgaa attaccgctc tgatccaaaa gcgccatttc cagataatcc
 401 ttgaccggca acatttccac ggcaaacttc tgtccggcga acttgtgcgt
 451 atcggcaatt cctgctggt ggcggcggcg caggttttgc tcgtttgcca
 501 aagcgcgcag ttgttcgtct ttcaactgcg cttccagctc ggcaatccgc
 551 gcctgcaaat cctcataagc cggctcggcg cagcctgtt cctgtacacc
 601 gtccgcattt cctactgtct cgacggtttc caccgcctcc acattttcaa
 651 ccgcttcttc actgttttgc tgctgtgtct gttcgctcat atcgtatccc
 701 tcaaaacaaa ttggaaatca aaatccggtt attacccgag caagataagg
 751 acattttcaa gaaacttcaa gcaaaggcag gaaatttcac atccgccgcc
 801 gaataccta ccgcaaaaac catataaacg gtaa
```

This corresponds to the amino acid sequence <SEQ ID 930; ORF 244.ng>:

```
g244.pep
   1 MPPEARPAGS DGIAALLRSV YTQNALQEIN QIIPQTPSGF LPCHRNHSRA

51 QHTVGQGITL LHHTNHGIGF LLTGHRLHRL MDIRIELIAR FRIDFLDLRG

101 IKRLLQLIQS HLHTHFQRIE ITALIQKRHF QIILDRQHFH GKLLSGELVR

151 IGNFLLVAAA QVLLVCQSAQ LFVFQLRFQL GNPRLQILIS RLGGSLFLYT

201 VRISYCLDGF HRLHIFNRFF TVLLLCLFAH IVSLKTNWKS KSGYYPSKIR

251 TFSRNFKQRQ EISHPPPNTL PQKPYKR*
```

The following partial DNA sequence was identified in *N. meningitidis* <SEQ ID 931>:

```
m244.seq
   1 ATGCCGTCTG AAGCCCGACA GGCGGGTTCA GACGGCATTG CCGCTTTACT

51 TCGATCGGTT TATACGCAAA ACGCGCTTCA GGAAATAAAT CAGATTATTC

101 CCCAGACGCC TTCAGGCTTC CTTCTGCGCC ACCGTAACCA TAGCCGGGCG

151 CAACACGCGG TCGGACAGCG TATAACCCTT CTTCATCACA CCCACCACGG

201 TATTCGGCTC CTGTTCGCTT GCCACCGCCT GCATCGCCTG ATGGATATTC

251 GGATCGAGCT TATCGCCCGC TTTAGGGTTG ATTTCCTTGA TTTGCGTAGC

301 ATCAAATGCT TTCTGCAACT CGTTCAAAGT CATCTGCACG CCCATTTTCA

351 GCGCATCGAA ATTGCCGCTC TGATCCAAAA GCGCCATTTC CAGATAATCC

401 TTGACCGGCA GCATTTCCAC GGCAAACTTC TGTCCGGCGA ACTTGTGCGT

451 ATCCGCAATT TyCTGCTGGT GGCGGCGGCG CAGGTTTTGC TCGTTTGCCA

501 AAGCGCGCTG CTCGTCTTTC AACTGCGTTT CCAGCTCGGC AATCCGCGCC

551 TGCAAATCCT CATAAGCCGG CTCTGCGGCA GCCTGTTCCT GCACACCGTC

601 CGCATTTCCT ACTGTTTCGA CGGTTTCCAC CGCCTCCACA TTTTCAACCG

651 CTTCTTCACT GTTTTGCTGC TGTGTCTGTT CGCTCATATC GTATCCCTTA

701 AAACAAATTG GAAATCAAAA TCCAGTTATT ACCCGCGCAA GATAAGGACA

751 TTTTCAAGAA ACTTCAAkCA AAAkCAGAGA ATTTCAAATT CATTTTCAAA

801 TCCCCTACCG AAAAAATAAT ATAGACGGTA A
```

This corresponds to the amino acid sequence <SEQ ID 932; ORF 244>:

```
m244.pep
   1 MPSEARQAGS DGIAALLRSV YTQNALQEIN QIIPQTPSGF LLRHRNHSRA

51 QHAVGQRITL LHHTHHGIRL LFACHRLHRL MDIRIELIAR FRVDFLDLRS

101 IKCFLQLVQS HLHAHFQRIE IAALIQKRHF QIILDRQHFH GKLLSGELVR

151 IRNFLLVAAA QVLLVCQSAL LVFQLRFQLG NPRLQILISR LCGSLFLHTV

201 RISYCFDGFH RLHIFNRFFT VLLLCLFAHI VSLKTNWKSK SSYYPRKIRT

251 FSRNFXQXQR ISNSFSNPLP KKXYRR*
```

Computer analysis of this amino acid sequence gave the following results:
Homology with a Predicted ORF from *N. gonorrhoeae*
ORF 244 shows 86.3% identity over a 277 aa overlap with a predicted ORF (ORF 244.ng) from *N. gonorrhoeae*:

```
M244/G244

10         20         30         40         50         60
       m244.pep  MPSEARQAGSDGIAALLRSVYTQNALQEINQIIPQTPSGFLLRHRNHSRAQHAVGQRITL
                 ||  ||| |||||||||||||||||||||||||||||||| |||||||||:||| |||
           g244  MPPEARPAGSDGIAALLRSVYTQNALQEINQIIPQTPSGFLPCHRNHSRAQHTVGQGITL
                     10         20         30         40         50         60

70         80         90        100        110        120
       m244.pep  LHHTHHGIRLLFACHRLHRLMDIRIELIARFRVDFLDLRSIKCFLQLVQSHLHAHFQRIE
                 ||||:|||  :|::  |||||||||||||||||||:||||| :|||:|||||:||||||
           g244  LHHTNHGIGFLLTGHRLHRLMDIRIELIARFRIDFLDLRGIKRLLQLIQSHLTHFQRIE
                     70         80         90        100        110        120
```

```
            130        140        150        160        170        180
m244.pep  IAALIQKRHFQI ILDRQHFHGKLLSGELVRIRNFLLVAAAQVLLVCQSAALLVFQLRFQL
          |:|||||||||| |||||||||||||||||||| |||||||||||||||||| :||||||||
g244      ITALIQKRHFQI ILDRQHFHGKLLSGELVRIGNFLLVAAAQVLLVCQSAQLFVFQLRFQL
            130        140        150        160        170        180

190        200        210        220        230        240
m244.pep  GNPRLQILISRLCGSLFLHTVRISYCFDGFHRLHIFNRFFTVLLLCLFAHIVSLKTNWKS
          |||||||||||| ||||| :||||||:||||||||||||||||||||||||||||||||
g244      GNPRLQILISRLGGSLFLYTVRISYCLDGFHRLHIFNRFFTVLLLCLFAHIVSLKTNWKS
            190        200        210        220        230        240

250        260        270
m244.pep  KSSYYPRKIRTFSRNFXQXQRISNSFSNPLPKKXYRRX
          ||:||| |||||||||| | |:||:    | ||:| |:||
g244      KSGYYPSKIRTFSRNFKQRQEISHPPPNTLPQKPYKRX
            250        260        270
```

The following partial DNA sequence was identified in *N. meningitidis* <SEQ ID 933>:

```
a244.seq
  1 ATGCCGTCTG AAGCCCGACA GG m244/a244 96.8% identity in 277 aa overlap

```
              10        20        30        40        50        60
m244.pep  MPSEARQAGSDGIAALLRSVYTQNALQEINQIIPQTPSGFLLRHRNHSRAQHAVGQRITL
          ||||||||||||||||||||||||||||||||||||||| ||||||||||||||||||||
a244      MPSEARQAGSDGIAALLRSVYTQNALQEINQIIPQTPSGFLLCHRNHSRAQHAVGQRITL
              10        20        30        40        50        60

70        80        90       100       110       120
m244.pep  LHHTHHGIRLLFACHRLHRLMDIRIELIARFRVDFLDLRSIKCFLQLVQSHLHAHFQRIE
          |||:||||  :|||||||||||||||||||||||:|||||||||||||||||||||||||
a244      LHHAHHGIGFLFACHRLHRLMDIRIELIARFRIDFLDLRSIKCFLQLVQSHLHAHFQRIE
              70        80        90       100       110       120

130       140       150       160       170       179
m244.pep  IAALIQKRHFQIILDRQHFHGKLLSGELVRIRNFLLVAAAQVLLVCQSA-LLVFQLRFQL
          |||||||||||||||||||||||||||||||||||||||||||||||| ||||||||||
a244      IAALIQKRHFQIILDRQHFHGKLLSGELVRIRNFLLVAAAQVLLVCQSAQLLVFQLRFQL
             130       140       150       160       170       180

180       190       200       210       220       230       239
m244.pep  GNPRLQILISRLCGSLFLHTVRISYCFDGFHRLHIFNRFFTVLLLCLFAHIVSLKTNWKS
          |||||||||||||||||||||||||||||:||||||||||||||||||||||||||||||
a244      GNPRLQILISRLCGSLFLHTVRISYCLDGFHRLHIFNRFFTVLLLCLFAHIVSLKTNWKS
             190       200       210       220       230       240

240       250       260       270
m244.pep  KSSYYPRKIRTFSRNFXQXQRISNSFSNPLPKKXYRRX
          ||||||||||||||||| | |||||||||||||||||
a244      KSSYYPRKIRTFSRNFKQRQRISNSFSNPLPKKXYRRX
             250       260       270
```

The following partial DNA sequence was identified in *N. gonorrhoeae* <SEQ ID 935>:

```
g244-1.seq
   1 atgccgcctg aagcccggcc ggcgggttca gacggcattg ccgctttact
  51 tcgatcggtt tatacgcaaa acgcgcttca ggaaataaat cagattattc
 101 cccagacgcc ttcaggcttc cttccgtgcc accgtaacca tagccgggcg
 151 caacacacgg tcggacaggg tataaccctt cttcatcaca ccaaccacgg
 201 tattgggttc ctgctcactg gccaccgcct gcatcgcctg atggatattc
 251 ggatcgagct tatcgcccgc tttaggattg atttccttga tttgcgtggc
 301 atcaaacgcc ttctgcaact cattcaaagt catctgcaca cccattttca
 351 gcgcatcgaa attaccgctc tgatccaaaa gcgccatttc agataatcc
 401 ttgaccggca catttccac ggcaaacttc tgtccggcga acttgtgcgt
 451 atcggcaatt tcctgctggt ggcggcggcg caggttttgc tcgtttgcca
 501 aagcgcgcag ttgttcgtct ttcaactgcg cttccagctc ggcaatccgc
 551 gcctgcaaat cctcataagc cggctcggcg cagcctgtt cctgtacacc
 601 gtccgcattt cctactgtct cgacggtttc caccgcctcc acattttcaa
 651 ccgcttcttc actgttttgc tgctgtgtct gttcgctcat atcgtatccc
 701 tcaaaacaaa ttggaaatca aatccggtt attacccgag caagataagg
 751 acattttcaa gaaacttcaa gcaaaggcag gaaatttcac atccgccgcc
 801 gaatacccta ccgcaaaaac catataaacg gtaa
```

This corresponds to the amino acid sequence <SEQ ID 936; ORF 244-1.ng>:

```
g244-1.pep
   1 MPPEARPAGS DGIAALLRSV YTQNALQEIN QIIPQTPSGF LPCHRNHSRA

51 QHTVGQGITL LHHTNHGIGF LLTGHRLHRL MDIRIELIAR FRIDFLDLRG

101 IKRLLQLIQS HLHTHFQRIE ITALIQKRHF QIILDRQHFH GKLLSGELVR

151 IGNFLLVAAA QVLLVCQSAQ LFVFQLRFQL GNPRLQILIS RLGGSLFLYT

201 VRISYCLDGF HRLHIFNRFF TVLLLCLFAH IVSLKTNWKS KSGYYPSKIR

251 TFSRNFKQRQ EISHPPPNTL PQKPYKR*
```

The following partial DNA sequence was identified in *N. meningitidis* <SEQ ID 937>:

```
m244-1.seq
   1 ATGCCGTCTG AAGCCCGACA GGCGGGTTCA GACGGCATTG CCGCTTTACT

51 TCGATCGGTT TATACGCAAA ACGCGCTTCA GGAAATAAAT CAGATTATTC

101 CCCAGACGCC TTCAGGCTTC CTTCTGCGCC ACCGTAACCA TAGCCGGGCG

151 CAACACGCGG TCGGACAGCG TATAACCCTT CTTCATCACA CCCACCACGG

201 TATTCGGCTC CTGTTCGCTT GCCACCGCCT GCATCGCCTG ATGGATATTC

251 GGATCGAGCT TATCGCCCGC TTTAGGGTTG ATTTCCTTGA TTTGCGTAGC

301 ATCAAATGCT TTCTGCAACT CGTTCAAAGT CATCTGCACG CCCATTTTCA

351 GCGCATCGAA ATTGCCGCTC TGATCCAAAA GCGCCATTTC CAGATAATCC

401 TTGACCGGCA GCATTTCCAC GGCAAACTTC TGTCCGGCGA ACTTGTGCGT

451 ATCCGCAATT TyCTGCTGGT GGCGGCGGCG CAGGTTTTGC TCGTTTGCCA

501 AAGCGCGCTG CTCGTCTTTC AACTGCGTTT CCAGCTCGGC AATCCGCGCC

551 TGCAAATCCT CATAAGCCGG CTCTGCGGCA GCCTGTTCCT GCACACCGTC

601 CGCATTTCCT ACTGTTTCGA CGGTTTCCAC CGCCTCCACA TTTTCAACCG

651 CTTCTTCACT GTTTTGCTGC TGTGTCTGTT CGCTCATATC GTATCCCTTA

701 AAACAAATTG GAAATCAAAA TCCAGTTATT ACCCGCGCAA GATAAGGACA

751 TTTTCAAGAA ACTTCAAkCA AAAkCAGAGA ATTTCAAATT CATTTTCAAA

801 TCCCCTACCG AAAAAATAA
```

This corresponds to the amino acid sequence <SEQ ID 938; ORF 244-1>:

```
m244-1.pep
   1 MPSEARQAGS DGIAALLRSV YTQNALQEIN QIIPQTPSGF LLRHRNHSRA

51 QHAVGQRITL LHHTHHGIRL LFACHRLHRL MDIRIELIAR FRVDFLDLRS

101 IKCFLQLVQS HLHAHFQRIE IAALIQKRHF QIILDRQHFH GKLLSGELVR

151 IRNFLLVAAA QVLLVCQSAL LVFQLRFQLG NPRLQILISR LCGSLFLHTV

201 RISYCFDGFH RLHIFNRFFT VLLLCLFAHI VSLKTNWKSK SSYYPRKIRT

251 FSRNFXQXQR ISNSFSNPLP KK* m244-1/G244-1  86.3% identity in 277 aa overlap
```

-continued

```
                        10        20        30        40        50        60
m244-1.pep      MPSEARQAGSDGIAALLRSVYTQNALQEINQIIPQTPSGFLLRHRNHSRAQHAVGQRITL
                || ||| ||||||||||||||||||||||||||||||||||  |||||||||:||| |||
g244-1          MPPEARPAGSDGIAALLRSVYTQNALQEINQIIPQTPSGFLPCHRNHSRAQHTVGQGITL
                        10        20        30        40        50        60

70        80        90       100       110       120
m244-1.pep      LHHTHHGIRLLFACHRLHRLMDIRIELIARFRVDFLDLRSIKCFLQLVQSHLHAHFQRIE
                ||||:||| :|:: ||||||||||||||||||:||||||:|| :|||:|||||:||||||
g244-1          LHHTNHGIGFLLTGHRLHRLMDIRIELIARFRIDFLDLRGIKRLLQLIQSHLHTHFQRIE
                        70        80        90       100       110       120

130       140       150       160       170       180
m244-1.pep      IAALIQKRHFQIILDRQHFHGKLLSGELVRIRNFLLVAAAQVLLVCQSAALLVFQLRFQL
                |:||||||||||||||||||||||||||||| ||||||||||||||||| |:||||||||
g244-1          ITALIQKRHFQIILDRQHFHGKLLSGELVRIGNFLLVAAAQVLLVCQSAQLFVFQLRFQL
                       130       140       150       160       170       180

190       200       210       220       230       240
m244-1.pep      GNPRLQILISRLCGSLFLHTVRISYCFDGFHRLHIFNRFFTVLLLCLFAHIVSLKTNWKS
                |||||||||||| |||||:|||||||:|||||||||||||||||||||||||||||||||
g244-1          GNPRLQILISRLGGSLFLYTVRISYCLDGFHRLHIFNRFFTVLLLCLFAHIVSLKTNWKS
                       190       200       210       220       230       240

250       260       270
m244-1.pep      KSSYYPRKIRTFSRNFXQXQRISNSFSNPLPKKX
                ||:||| ||||||||| | |:||:   | ||:|
g244-1          KSGYYPSKIRTFSRNFKQRQEISHPPPNTLPQKPYKRX
                       250       260       270
```

The following partial DNA sequence was identified in *N. meningitidis* <SEQ ID 939>:

```
a244-1.seq
   1 ATGCCGTCTG AAGCCCGACA GGCGGGTTCA GACGGCATTG CCGCTTTACT

51 TCGATCGGTT TATACGCAAA ACGCGCTTCA GGAAATAAAT CAGATTATTC

101 CCCAGACGCC TTCAGGCTTC CTTCTGTGCC ACCGTAACCA TAGCCGGGCG

151 CAACACGCGG TCGGACAGCG TATAACCCTT CTTCATCACG CCCACCACGG

201 TATTGGGTTC CTGTTCGCTT GCCACCGCCT GCATCGCCTG ATGGATATTC

251 GGATCGAGCT TATCGCCCGC TTTAGGATTG ATTTCCTTGA TTTGCGTAGC

301 ATCAAATGCT TTCTGCAACT CGTTCAAAGT CATCTGCACG CCCATTTTCA

351 GCGCATCGAA ATTGCCGCTC TGATCCAAAA GCGCCATTTC CAGATAATCC

401 TTGACCGGCA GCATTTCCAC GGCAAACTTC TGTCCGGCGA ACTTGTGCGT

451 ATCCGCAATT TCCTGCTGGT GGCGGCGGCG CAGGTTTTGC TCGTTTGCCA

501 AAGCGCGCAG CTGCTCGTCT TTCAACTGCG CTTCCAGCTC GGCAATCCGC

551 GCCTGCAAAT CCTCATAAGC CGGCTCTGCG GCAGCCTGTT CCTGCACACC

601 GTCCGCATTT CCTACTGTCT CGACGGTTTC CACCGCCTCC ACATTTTCAA

651 CCGCTTCTTC ACTGTTTTGC TGCTGTGTCT GTTCGCTCAT ATCGTATCCC

701 TTAAAACAAA TTGGAAATCA AAATCCAGTT ATTACCCGCG CAAGATAAGG

751 ACATTTTCAA GAAACTTCAA GCAAAGGCAG AGAATTTCAA ATTCATTTTC

801 AAATCCCCTA CCGAAAAAAT AA
```

This corresponds to the amino acid sequence <SEQ ID 940; ORF 244-1.a>:

```
a244-1.pep

1 MPSEARQAGS DGIAALLRSV YTQNALQEIN QIIPQTPSGF LLCHRNHSRA

51 QHAVGQRITL LHHAHHGIGF LFACHRLHRL MDIRIELIAR FRIDFLDLRS

101 IKCFLQLVQS HLHAHFQRIE IAALIQKRHF QIILDRQHFH GKLLSGELVR
```

```
    151 IRNFLLVAAA QVLLVCQSAQ LLVFQLRFQL GNPRLQILIS RLCGSLFLHT

201 VRISYCLDGF HRLHIFNRFF TVLLLCLFAH IVSLKTNWKS KSSYYPRKIR

251 TFSRNFKQRQ RISNSFSNPL PKK* m244-1/a244-1  96.8% identity in 274 aa overlap 10         20         30         40         50         60
  m244-1.pep  MPSEARQAGSDGIAALLRSVYTQNALQEINQIIPQTPSGFLLRHRNHSRAQHAVGQRITL
              |||||||||||||||||||||||||||||||||||||||| |||||||||||||||||||
  a244-1      MPSEARQAGSDGIAALLRSVYTQNALQEINQIIPQTPSGFLLCHRNHSRAQHAVGQRITL
                   10         20         30         40         50         60

70         80         90        100        110        120
  m244-1.pep  LHHTHHGIRLLFACHRLHRLMDIRIELIARFRVDFLDLRSIKCFLQLVQSHLHAHFQRIE
              |||:||||  :|||||||||||||||||||||||:|||||||||||||||||||||||||
  a244-1      LHHAHHGIGFLFACHRLHRLMDIRIELIARFRIDFLDLRSIKCFLQLVQSHLHAHFQRIE
                   70         80         90        100        110        120

130        140        150        160        170       179
  m244-1.pep  IAALIQKRHFQIILDRQHFHGKLLSGELVRIRNFLLVAAAQVLLVCQSA-LLVFQLRFQL
              ||||||||||||||||||||||||||||||||||||||||||||||||| ||||||||||
  a244-1      IAALIQKRHFQIILDRQHFHGKLLSGELVRIRNFLLVAAAQVLLVCQSAQLLVFQLRFQL
                   130        140        150        160        170       180

180       190        200        210        220        230       239
  m244-1.pep  GNPRLQILISRLCGSLFLHTVRISYCFDGFHRLHIFNRFFTVLLLCLFAHIVSLKTNWKS
              ||||||||||||||||||||||||||:|||||||||||||||||||||||||||||||||
  a244-1      GNPRLQILISRLCGSLFLHTVRISYCLDGFHRLHIFNRFFTVLLLCLFAHIVSLKTNWKS
                   190        200        210        220        230        240

240        250        260        270
  m244-1.pep  KSSYYPRKIRTFSRNFXQXQRISNSFSNPLPKKX
              |||||||||||||||| | ||||||||||||||||
  a244-1      KSSYYPRKIRTFSRNFKQRQRISNSFSNPLPKKX
                   250        260        270
```

35

The following partial DNA sequence was identified in *N. gonorrhoeae* <SEQ ID 941>:

```
g246.seq
  1 atgtacgggc ggaacggtag tactcaagcg gccgttgcct tcgttttcga 51 ccagacacag cgtgcccgtt tcggcaacgg cgaagtttac gccgctcaag 101 ccgacatcgg cagtgctgta aatatcgcgc agggctttgc gggcgaatcc 151 ggtcagttgg tccacgtcgt ctgtaagcgg tgtgccgagg ttttggtgga 201 acagttcgct gacctgttct ttggttttat ggattgcggg catcacgata 251 tgggtcggtt tttcgcctgc catttggacg ataaactcgc ccaagtcgct 301 ttccaccgcc ttaatgcctt ttgcttcaag ataatggttc agctcgattt 351 cttcgctgac catggatttg cctttgacca tcagcttgcc gttttttggct 401 gtgatgatgt cgtggataat ttggcaggct tcggcagggg tttccgccca 451 gtgtactttc acgcccaact tagtcaggtt ttcttccaac tgctccagca 501 gcgcgggtaa
```

This corresponds to the amino acid sequence <SEQ ID 942; ORF 246.ng>:

```
g246.pep
  1 MYGRNGSTQA AVAFVFDQTQ RARFGNGEVY AAQADIGSAV NIAQGFAGES

51 GQLVHVVCKR CAEVLVEQFA DLFFGFMDCG HHDMGRFFAC HLDDKLAQVA
```

```
101 FHRLNAFCFK IMVQLDFFAD HGFAFDHQLA VFGCDDVVDN LAGFGRGFRP

151 VYFHAQLSQV FFQLLQQRG*
```

The following partial DNA sequence was identified in *N. meningitidis* <SEQ ID 943>:

```
m246.seq (partial)
   1 ATGCACGGGC GGTACGGTGG TACTCAAGCG ACCGTTgCTT CGTTTTCCAC

51 CAGACACAGC GTACCTGTTT CAGCAACGGC AAAGTTTACG CCACTCAAAC

101 CGACATCGGC AGTGCTGTAA ATATCGCGCA GTGCTTTACG GGCGAAGCCG

151 GTCAGTTGGT CTACATCGTC TGTCAGCGGC GTACCGAGGT TTTGGTGGAA

201 CAGTTCGCTA ACCTGTTCTT TGGTTTTGTG GATAGCAGGC ATCACGATAT

251 GGGTCGGTTT TTCGCCTGCC ATTTGGACGA TGAACTCGCC CAAGTCGCTT

301 TCTACCGCTT TAATGCyTTT TGCTTCAAGA TAATGrTTCA GCTCGATTTC

351 CTCGCTGACC ATCGATTTGC CTTTGACCAT CAGCTTGCCG TTTTTGGCTG

401 TGATGATGTC GTGGATAATT TGGCAGGCTT CGGTCGGGGT TTCTGCCCG...
```

This corresponds to the amino acid sequence <SEQ ID 944; ORF 246>:

```
m246.pep (partial)
   1 MHGRYGGTQA TVAFVFHQTQ RTCFSNGKVY ATQTDIGSAV NIAQCFTGEA

51 GQLVYIVCQR RTEVLVEQFA NLFFGFVDSR HHDMGRFFAC HLDDELAQVA

101 FYRFNAFCFK IMXQLDFLAD HRFAFDHQLA VFGCDDVVDN LAGFGRGFCP...
```

Computer analysis of this amino acid sequence gave the following results:
Homology with a Predicted ORF from *N. gonorrhoeae*
ORF 246 shows 80.0% identity over a 150 aa overlap with a predicted ORF (ORF 246.ng) from *N. gonorrhoeae*:

```
m246/g246

10         20         30         40         50         60
m246.pep    MHGRYGGTQATVAFVFHQTQRTCFSNGKVYATQTDIGSAVNIAQCFTGEAGQLVYIVCQR
            |:||  :||| :|||||  ||||: |:||:|||:|:|||||||||| |:||:||||::||:|
g246        MYCRNGSTQAAVAFVFDQTQRARFGNGEVYAAQADIGSAVNIAQGFAGESGQLVHVVCKR
                  10         20         30         40         50         60

70         80         90        100        110        120
m246.pep    RTEVLVEQFANLFFGFVDSRHHDMGRFFACHLDDELAQVAFYRFNAFCFKIMXQLDFLAD
            :||||||||:||||:|   |||||||||||||:||||||:|:|||||||| ||||:||
g246        CAEVLVEQFADLFFGFMDCGHHDMGRFFACHLDDKLAQVAFHRLNAFCFKIMVQLDFFAD
                  70         80         90        100        110        120

130        140        150
m246.pep    HRFAFDHQLAVFGCDDVVDNLAGFGRGFCP
            | ||||||||||||||||||||||||||| |
g246        HGFAFDHQLAVFGCDDVVDNLAGFGRGFRPVYFHAQLSQVFFQLLQQRGX
                 130        140        150        160
```

The following partial DNA sequence was identified in *N. meningitidis* <SEQ ID 945>:

```
a246.seq (partial)
   1 ATGCACGGGC GGAACGGTGG TACTCAAGCG ACCGTTGCCT TCGTTTTCCA

51 CCAGACACAG CGTACCTGTT TCAGCAACGG CGAAGTTCAC GCCACTCAAA

101 CCGACATCGG CAGTGCTGTA AATATCGCGC AGTGCTTTAC GGGCGAAGCC
```

-continued

```
151 GGTCAGTTGG TCTACGTCGT CCGTTAACGG TGTGCCGAGG TTTTGGTGGA

201 ACAGTTCGCT AACCTGTTCT TTGGTTTTAT GGATTGCGGG CATCACGATA

251 TGGGTCGGTT TTTCACCTGC CATTTGGACG ATGAACTCGC CCAAGTCGCT

301 TTCCACCGCT TTAATGCCTT TTGCTTCAAG ATAATGGTTC AGCTCGATTT

351 CCTCGCTGAC CATCGATTTG CCTTTGACCA TCAGCTTGCC GTTTTTGGCT

401 GTGATGATGT CGTGGATGAT TTCGCAGGCT TCGGCCGGTG TTTCCGCCCA

451 GTGTACTTTT ACGCCCAACT TGGTCAGGTT TTCTTCCAGC TGCTCCAGCA

501 G
```

This corresponds to the amino acid sequence <SEQ ID 946; ORF 246.a>:

```
a246.pep (partial)
  1 MHGRNGGTQA TVAFVFHQTQ RTCFSNGEVH ATQTDIGSAV NIAQCFTGEA

51 GQLVYVVR*R CAEVLVEQFA NLFFGFMDCG HHDMGRFFTC HLDDELAQVA

101 FHRFNAFCFK IMVQLDFLAD HRFAFDHQLA VFGCDDVVDD FAGFGRCFRP

151 VYFYAQLGQV FFQLLQQ
``` m246/a246 88.0% identity in 150 aa overlap

```
                  10         20         30         40         50         60
    m246.pep MHGRYGGTQATVAFVFHQTQRTCFSNGKVYATQTDIGSAVNIAQCFTGEAGQLVYIVCQR
             ||||  |||||||||||||||||||||||:|:||||||||||||||||||||||||:| |
        a246 MHGRNGGTQATVAFVFHQTQRTCFSNGEVHATQTDIGSAVNIAQCFTGEAGQLVYVVRXR
                  10         20         30         40         50         60
                  70         80         90        100        110        120
    m246.pep RTEVLVEQFANLFFGFVDSRHHDMGRFFACHLDDELAQVAFYRFNAFCFKIMXQLDFLAD
             :|||||||||||||:|  ||||||||:|||||||||||||:|||||||||| |||||||
        a246 CAEVLVEQFANLFFGFMDCGHHDMGRFFTCHLDDELAQVAFHRFNAFCFKIMVQLDFLAD
                  70         80         90        100        110        120
                 130        140        150
    m246.pep HRFAFDHQLAVFGCDDVVDNLAGFGRGFCP
             ||||||||||||||||||||::|||| | |
        a246 HRFAFDHQLAVFGCDDVVDDFAGFGRCFRPVYFYAQLGQVFFQLLQQ
                 130        140        150        160
```

The following partial DNA sequence was identified in *N. gonorrhoeae* <SEQ ID 947>:

```
g247.seq
  1 atgaaacgta aaatgctaaa cgtaccaaag ggcggttatg atggtatgaa 51 gggttttacc attgttgaat ttctggttgc gggcctgctc agtataattg 101 tcctgatagc ggtcgtatcg agttacttta catcccggaa attaaatgat 151 gtggcaaacg agcgtcttgc cattcaacag gatttgcgga atgcggcaac 201 attaattgtc cgcgatgcaa gaatggcggg gagcttcggt tgtttcaata 251 tgtccgagca tactaaagac gatattgttg attcaagtaa tcaaactcaa 301 tctaaccttg caaacccggt gccaaacaa gaaaatcccc ttttttcctt 351 aaaaaggagc ggcatggata aacaactgat tcccgttgct gaatccatag 401 atattaaata tccgggtttt atccagcgcc ttaacgcatt ggttttccaa
```

```
451 tacggtatcg atgatcttga tgcgagtgct gagactgttg tagtcagcag 501 ctgttccaaa atagcaaaac cgggtaagaa aatatctacc ttgcaagaag 551 caaagagtgc attacagatt actaatgatg ataaacaaaa tggaaatatc 601 acccgtcaga aacatgtggt caatgcctat gcggtcggca ggtttggcaa 651 taatgaggaa agtttgttcc gcttccaatt ggatgataag ggcaagtggg 701 gtaatcctca gttgctcgtg aaaaaggtta aacgtatgga tgtgcggtat 751 atttatgttt ccggttgtcc tgaagatgaa gatgccggca agaggaaaa 801 attcagatat acgaataaat tcgacaaatc caaaaatgct gttacgcctg 851 ccggggtgga ggttttattg gatagcggcc ttaatgccaa gattgccgct 901 tcttcagaca atagtattta tgcttaccgt atcaatgcga caatacgcgg 951 gggaaatgta tgcgcaaaca gaacactttg a
```

This corresponds to the amino acid sequence <SEQ ID 948; ORF 247.ng>:

```
g247.pep
  1 MKRKMLNVPK GGYDGMKGFT IVEFLVAGLL SIIVLIAVVS SYFTSRKLND

51 VANERLAIQQ DLRNAATLIV RDARMAGSFG CFNMSEHTKD DIVDSSNQTQ

101 SNLAKPGAKQ ENPLFSLKRS GMDKQLIPVA ESIDIKYPGF IQRLNALVFQ

151 YGIDDLDASA ETVVVSSCSK IAKPGKKIST LQEAKSALQI TNDDKQNGNI

201 TRQKHVVNAY AVGRFGNNEE SLFRFQLDDK GKWGNPQLLV KKVKRMDVRY

251 IYVSGCPEDE DAGKEEKFRY TNKFDKSKNA VTPAGVEVLL DSGLNAKIAA

301 SSDNSIYAYR INATIRGGNV CANRTL*
```

The following partial DNA sequence was identified in *N. meningitidis* <SEQ ID 949>:

```
m247.seq (partial)
  1 ATsAGACGTA AAATGCTAAA CGTwsyArAA GGCAGTTATG ATGGTATGAA

51 AGGTTTTACC ATTATTGAAT TTTTGGTTGC GGGCCTGCTC AGTATGATTG

101 TCCTGATGGC GGTCGGATCG AGTTACTTCA CATCCCGGAA ATTAAATGAT

151 GCGGCAAACG AGCGTCTTGC CGCGCAACAG GATTTGCGGA ATGCGGCAAC

201 ATTGATTGTC CGCGATGCGA GAATGGCAGG CGGCTTCGGT TGTTTCAATA

251 TGTCCGAGCA TCCTGCAACT GATGTTATTC CCGATACGAC GCAACAAAAT

301 TCTCCTTTTT CCTTAAAAAG GAACGGTATA GATAAACTTA TTCCCATAGC

351 GGAATCTTCA AATATCAATT ATCAGAATTT TTTCCAGGTT GGTAGCGCAT

401 TGATTTTTCA ATACGGAATC GATGATGTTA ATGCAAGCAC CGCGACTACC

451 GTCGTCAGCA GCTGTGCCGC AATATCGAAA CCGGGCAAGC AAATCCCTAC

501 TTTAGAAGAT GCAAAAAAG AATTGAAGAT TCCGGATCAG GATAAGGAGC

551 AAAATGGCAA TATAGCGCGT CAAAGGCATG TGGTCAATGC CTATGCGGTC

601 GGCAGGATTG CCGATGAGGA AAGTTTGTTC CGCTTCCAAT TGGATGATAA

651 GGGCAAGTGG GGTAATCCTC AGTTGC...
```

This corresponds to the amino acid sequence <SEQ ID 950; ORF 247>:

```
m247.pep (partial)
   1 XRRKMLNVXX GSYDGMKGFT IIEFLVAGLL SMIVLMAVGS SYFTSRKLND

51 AANERLAAQQ DLRNAATLIV RDARMAGGFG CFNMSEHPAT DVIPDTTQQN

101 SPFSLKRNGI DKLIPIAESS NINYQNFFQV GSALIFQYGI DDVNASTATT

151 VVSSCAAISK PGKQIPTLED AKKELKIPDQ DKEQNGNIAR QRHVVNAYAV

201 GRIADEESLF RFQLDDKGKW GNPQL....
```

Computer analysis of this amino acid sequence gave the following results:
Homology with a Predicted ORF from *N. gonorrhoeae*
ORF 247 shows 69.3% identity over a 238 aa overlap with a predicted ORF (ORF 247.ng) from *N. gonorrhoeae*:

```
     m247/g247

10         20         30         40         50         60
        m247.pep  XRRKMLNVXXGSYDGMKGFTIIEFLVAGLLSMIVLMAVGSSYFTSRKLNDAANERLAAQQ
                  :||||||  |:||||||||||:||||||||:|||:|| |||||||||||:|||||| ||
        g247      MKRKMLNVPKGGYDGMKGFTIVEFLVAGLLSIIVLIAVVSSYFTSRKLNDVANERLAIQQ
                         10         20         30         40         50         60
                         70         80         90                   100
        m247.pep  DLRNAATLIVRDARMAGGFGCFNMSEHPATDVI------------PDTTQQNSPFSLKRN
                  |||||||||||||||||:|||||||||   |::          | :|:|  |||||:
        g247      DLRNAATLIVRDARMAGSFGCFNMSEHTKDDIVDSSNQTQSNLAKPGAKQENPLFSLKRS
                         70         80         90        100        110        120
                        110        120        130        140        150        160
        m247.pep  GIDK-LIPIAESSNINYQNFFQVGSALIFQYGIDDVNASTATTVVSSCAAISKPGKQIPT
                  |:||   |||:|||   :|:|   :|:|   :||:||||||::||: :|||||: |:||||:| |
        g247      GMDKQLIPVAESIDIKYPGFIQRLNALVFQYGIDDLDASAETVVVSSCSKIAKPGKKIST
                        130        140        150        160        170        180
                        170        180        190        200        210        220
        m247.pep  LEDAKKELKIPDQDKEQNGNIARQRHVVNAYAVGRIAD-EESLFRFQLDDKGKWGNPQL
                  |::||: |:|  ::||  |||||:|| :|||||||||::: ||||||||||||||||||
        g247      LQEAKSALQITNDDK-QNGNITRQKHVVNAYAVGRFGNNEESLFRFQLDDKGKWGNPQLL
                        190        200        210        220        230
        g247      VKKVKRMDVRYIYVSGCPEDEDAGKEEKFRYTNKFDKSKNAVTPAGVEVLLDSGLNAKIA
                        240        250        260        270        280        290
```

The following partial DNA sequence was identified in *N. meningitidis* <SEQ ID 951>:

```
a247.seq
   1 ATGAGACGTA AAATGCTAAA CGTACCAAAA GGCAATTATG ATGGTATGAA

51 GGGTTTTACC ATTATTGAAT TTTTGGTTGC GGGCATGCTC AGTATGATTG

101 TCCTGATGGC GGTCGGATCG AGTTACTTCA CATCCCGGAA ATTAAATGAT

151 GCGGCAAACG AGCGTCTTTC CGCGCAACAG GATTTGCGGA ATGCGGCAAC

201 ATTGATTGTC CGCGATGCAA GAATGGCAGG GGGCTTCGGT TGTTTCAATA

251 TGTCCGAGCA TACTAAAAAT GATATTATTG TTGATCCAAG TAAGCAAACT

301 CAACATGTCC CTGTAAAACC CGGTGCCAAA CAAGAAAATC CCCTTTTTTC

351 TTTAGAGTGG GCTAATACTA ATAATACTAA TAATAATACA GCTAAATTGA

401 TTCCTATTGC TGAATCCACA GATATTAAAT ATCCGGGTTT TGCCCAGGCT

451 CGTCCGGCAT TGATTTTCCA ATACGGCATC GATGATCTTG ATGCGAGTGC

501 TGAGACTGTT GTAGTCAGCA GCTGTTCCAA AATAGCAAAA CCGGGTAAGA

551 AAATATCTAC CTTGCAAGAA GCAAAGAGTG CATTACAGAT TACTAATGAT

601 GATAAACAAA ATGGAAATAT CACCCGTCAA AGGCATGTGG TCAATGCCTA
```

-continued

```
651 TGCGGTCGGC AGGATTGCCG GTGAGGAAGG TTTGTTCCGC TTCCAATTGG

701 ATGATAAGGG CAAGTGGGGT AATCCTCAGT TGCTCGTGAA AAAGATTAGA

751 CATATGAAAG TGCGGTATAT CTATGTTTCC GACTGTCCTG AAGATGACGA

801 TGCCGGCAAA GAGGAAAAAT TCAAATATAC GGGTACATTC GACAGCTCCA

851 CAAATGCTGT TACGCCCGCC GGGGTGGAGG TTTTATTGAG TANCGGTACT

901 GATACCAAGA TTGCCGCTTC TTCAGACAAT CATATTTATG CTTACCGTAT

951 CGATGCGACA ATACGCGGGG GAAATGTATG CGCAAACAGA ACACTTTGA
```

This corresponds to the amino acid sequence <SEQ ID 952; ORF 247.a>:

```
a247.pep
  1 MRRKMLNVPK GNYDGMKGFT IIEFLVAGML SMIVLMAVGS SYFTSRKLND

51 AANERLSAQQ DLRNAATLIV RDARMAGGFG CFNMSEHTKN DIIVDPSKQT

101 QHVPVKPGAK QENPLFSLEW ANTNNTNNNT AKLIPIAEST DIKYPGFAQA

151 RPALIFQYGI DDLDASAETV VVSSCSKIAK PGKKISTLQE AKSALQITND

201 DKQNGNITRQ RHVVNAYAVG RIAGEEGLFR FQLDDKGKWG NPQLLVKKIR

251 HMKVRYIYVS DCPEDDDAGK EEKFKYTGTF DSSTNAVTPA GVEVLLSXGT

301 DTKIAASSDN HIYAYRIDAT IRGGNVCANR TL*
``` m247/a247 70.9% identity in 244 aa overlap

```
                  10         20         30         40         50         60
   m247.pep  XRRKMLNVXXGSYDGMKGFTIIEFLVAGLLSMIVLMAVGSSYFTSRKLNDAANERLAAQQ
             ||||||  |:||||||||||||||||||:|||||||||||||||||||||||||||:|||
   a247      MRRKMLNVPKGNYDGMKGFTIIEFLVAGMLSMIVLMAVGSSYFTSRKLNDAANERLSAQQ
                  10         20         30         40         50         60

70         80         90                             100
   m247.pep  DLRNAATLIVRDARMAGGFGCFNMSEHPATDVI-------------PDTTQQNSPFSLK-
             ||||||||||||||||||||||||||||| :|:|             | : |:|  |||:
   a247      DLRNAATLIVRDARMAGGFGCFNMSEHTKNDIIVDPSKQTQHVPVKPGAKQENPLFSLEW
                  70         80         90        100       110        120

110        120        130        140        150        160
   m247.pep  ------RNGIDKLIPIAESSNINYQNFFQVGSALIFQYGIDDVNASTATTVVSSCAISK
             |:    ||||||||::|:| :|  |:   |||||||||||::|| |:||||: |:|
   a247      ANTNNTNNNTAKLIPIAESTDIKYPGFAQARPALIFQYGIDDLDASAETVVVSSCSKIAK
                     130        140        150        160        170        180

170        180        190        200        210        220
   m247.pep  PGKQIPTLEDAKKELKIPDQDKEQNGNIARQRHVVNAYAVGRIADEESLFRFQLDDKGKW
             |||:| ||::||:  |:|  ::||  ||||:||||||||||||| |:||||||||||||
   a247      PGKKISTLQEAKSALQITNDDK-QNGNITRQRHVVNAYAVGRIAGEEGLFRFQLDDKGKW
                     190        200        210        220        230 m247.pep  GNPQL
             |||||
   a247      GNPQQLLVKKIRHMKVRYIYVSDCPEDDDAGKEEKFKYTGTFDSSTNAVTPAGVEVLLSXG
                     240        250        260        270        280        290
```

The following partial DNA sequence was identified in *N. gonorrhoeae* <SEQ ID 953>:

```
g247-1.seq (partial) ..
  1 CCCGGTGCCA AACAAGAAAA TCCCCTTTTT TCCTTAAAAA GGAGCGGCAT

51 GGATAAACAA CTGATTCCCG TTGCTGAATC CATAGATATT AAATATCCGG

101 GTTTTATCCA GCGCCTTAAC GCATTGGTTT TCCAATACGG TATCGATGAT

151 CTTGATGCGA GTGCTGAGAC TGTTGTAGTC AGCAGCTGTT CCAAAATAGC
```

```
-continued
201 AAAACCGGGT AAGAAAATAT CTACCTTGCA AGAAGCAAAG AGTGCATTAC

251 AGATTACTAA TGATGATAAA CAAAATGGAA ATATCACCCG TCAGAAACAT

301 GTGGTCAATG CCTATGCGGT CGGCAGGTTT GGCAATAATG AGGAAAGTTT

351 GTTCCGCTTC CAATTGGATG ATAAGGGCAA GTGGGGTAAT CCTCAGTTGC

401 TCGTGAAAAA GGTTAAACGT ATGGATGTGC GGTATATTTA TGTTTCCGGT

451 TGTCCTGAAG ATGAAGATGC CGGCAAAGAG GAAAAATTCA GATATACGAA

501 TAAATTCGAC AAATCCAAAA ATGCTGTTAC GCCTGCCGGG GTGGAGGTTT

551 TATTGGATAG CGGCCTTAAT GCCAAGATTG CCGCTTCTTC AGACAATAGT

601 ATTTATGCTT ACCGTATCAA TGCGACAATA CGCGGGGGAA ATGTATGCGC

651 AAACAGAACA CTTTGA
```

This corresponds to the amino acid sequence <SEQ ID 954; ORF 247-1.ng>:

```
g247-1.pep (partial) ..
  1 PGAKQENPLF SLKRSGMDKQ LIPVAESIDI KYPGFIQRLN ALVFQYGIDD

51 LDASAETVVV SSCSKIAKPG KKISTLQEAK SALQITNDDK QNGNITRQKH

101 VVNAYAVGRF GNNEESLFRF QLDDKGKWGN PQLLVKKVKR MDVRYIYVSG

151 CPEDEDAGKE EKFRYTNKFD KSKNAVTPAG VEVLLDSGLN AKIAASSDNS

201 IYAYRINATI RGGNVCANRT L*
```

The following partial DNA sequence was identified in *N. meningitidis* <SEQ ID 955>:

```
m247-1.seq
  1 ATGAGACGTA AAATGCTAAA CGTACCAAAA GGCAGTTATG ATGGTATGAA

51 AGGTTTTACC ATTATTGAAT TTTTGGTTGC GGGCCTGCTC AGTATGATTG

101 TCCTGATGGC GGTCGGATCG AGTTACTTCA CATCCCGGAA ATTAAATGAT

151 GCGGCAAACG AGCGTCTTGC CGCGCAACAG GATTTGCGGA ATGCGGCAAC

201 ATTGATTGTC CGCGATGCGA GAATGGCAGG CGGCTTCGGT TGTTTCAATA

251 TGTCCGAGCA TCCTGCAACT GATGTTATTC CCGATACGAC GCAACAAAAT

301 TCTCCTTTTT CCTTAAAAAG GAACGGTATA GATAAACTTA TTCCCATAGC

351 GGAATCTTCA AATATCAATT ATCAGAATTT TTTCCAGGTT GGTAGCGCAT

401 TGATTTTTCA ATACGGAATC GATGATGTTA ATGCAAGCAC CGCGACTACC

451 GTCGTCAGCA GCTGTGCCGC AATATCGAAA CCGGGCAAGC AAATCCCTAC

501 TTTAGAAGAT GCAAAAAAAG AATTGAAGAT TCCGGATCAG GATAAGGAGC

551 AAAATGGCAA TATAGCGCGT CAAAGGCATG TGGTCAATGC CTATGCGGTC

601 GGCAGGATTG CCGATGAGGA AGGTTTGTTC CGCTTCCAAT TGGATGATAA

651 GGGCAAGTGG GGTAATCCTC AGTTGCTCGT GAAAAAGGTT AGACATATGA

701 AAGTGCGGTA TATCTATGTT TCCGGCTGTC CTGAAGATGA CGATGCCGGC

751 AAAGAGGAAA CATTCAAATA TACGGATAAA TTCGACAGCG CCCAAAATGC

801 TGTTACGCCC GCCGGGGTGG AGGTTTTATT GAGTAGCGGT ACTGATACCA

851 AGATTGCCGC TTCTTCAGAC AATCATATTT ATGCTTACCG TATCGATGCG

901 ACAATACGCG GGGAAATGT ATGCGCAAAC AGAACACTTT GA
```

This corresponds to the amino acid sequence <SEQ ID 956; ORF 247-1>:

```
m247-1.pep
      1  MRRKMLNVPK GSYDGMKGFT IIEFLVAGLL SMIVLMAVGS SYFTSRKLND
     51  AANERLAAQQ DLRNAATLIV RDARMAGGFG CFNMSEHPAT DVIPDTTQQN
    101  SPFSLKRNGI DKLIPIAESS NINYQNFFQV GSALIFQYGI DDVNASTATT
    151  VVSSCAAISK PGKQIPTLED AKKELKIPDQ DKEQNGNIAR QRHVVNAYAV
    201  GRIADEEGLF RFQLDDKGKW GNPQLLVKKV RHMKVRYIYV SGCPEDDDAG
    251  KEETFKYTDK FDSAQNAVTP AGVEVLLSSG TDTKIAASSD NHIYAYRIDA
    301  TIRGGNVCAN RTL* m247-1/g247-1  72.1% identity in 222 aa overlap 70        80        90       100       110       120
m247-1.pep     NAATLIVRDARMAGGFGCFNMSEHPATDVIPDTTQQNSPFSLKRNGIDK-LIPIAESSNI
                                                   | : |:|  |||||:|:|| |||:||| :|
g247-1                                             PGAKQENPLFSLKRSGMDKQLIPVAESIDI
                                                           10        20        30

130       140       150       160       170       180
m247-1.pep     NYQNFFQVGSALIFQYGIDDVNASTATTVVSSCAAISKPGKQIPTLEDAKKELKIPDQDK
               :| :|:|   :||:|||||||::||: |:|||||: |:||||:| ||::||: |:| ::||
g247-1         KYPGFIQRLNALVFQYGIDDLDASAETVVVSSCSKIAKPGKKISTLQEAKSALQITNDDK
                       40        50        60        70        80        90

190       200       210       220       230       240
m247-1.pep     EQNGNIARQRHVVNAYAVGRIAD-EEGLFRFQLDDKGKWGNPQLLVKKVRHMKVRYIYVS
                |||||:||:|||||||||:::  ||:||||||||||||||||||||||::| |||||||
g247-1         -QNGNITRQKHVVNAYAVGRFGNNEESLFRFQLDDKGKWGNPQLLVKKVKRMDVRYIYVS
                     100       110       120       130       140

250       260       270       280       290       300
m247-1.pep     GCPEDDDAGKEETFKYTDKFDSAQNAVTPAGVEVLLSSGTDTKIAASSDNHIYAYRIDAT
               |||||:|||||| |:||:|||:::||||||||||||:||  ::|||||||| ||||||:||
g247-1         GCPEDEDAGKEEKFRYTNKFDKSKNAVTPAGVEVLLDSGLNAKIAASSDNSIYAYRINAT
           150       160       170       180       190       200

310
m247-1.pep     IRGGNVCANRTLX
               |||||||||||||
g247-1         IRGGNVCANRTLX
           210       220
```

The following partial DNA sequence was identified in *N. meningitidis* <SEQ ID 957>:

```
a247-1.seq (partial)
   1 AATAATACAG CTAAATTGAT TCCTATTGCT GAATCCACAG ATATTAAATA

51 TCCGGGTTTT GCCCAGGCTC GTCCGGCATT GATTTTCCAA TACGGCATCG

101 ATGATCTTGA TGCGAGTGCT GAGACTGTTG TAGTCAGCAG CTGTTCCAAA

151 ATAGCAAAAC CGGGTAAGAA AATATCTACC TTGCAAGAAG CAAAGAGTGC

201 ATTACAGATT ACTAATGATG ATAAACAAAA TGGAAATATC ACCCGTCAAA

251 GGCATGTGGT CAATGCCTAT GCGGTCGGCA GGATTGCCGG TGAGGAAGGT

301 TTGTTCCGCT TCCAATTGGA TGATAAGGGC AAGTGGGGTA ATCCTCAGTT

351 GCTCGTGAAA AAGATTAGAC ATATGAAAGT GCGGTATATC TATGTTTCCG

401 ACTGTCCTGA AGATGACGAT GCCGGCAAAG AGGAAAAATT CAAATATACG

451 GGTACATTCG ACAGCTCCAC AAATGCTGTT ACGCCCGCCG GGGTGGAGGT

501 TTTATTGAGT AGCGGTACTG ATACCAAGAT TGCCGCTTCT TCAGACAATC

551 ATATTTATGC TTACCGTATC GATGCGACAA TACGCGGGGG AAATGTATGC

601 GCAAACAGAA CACTTTGA
```

This corresponds to the amino acid sequence <SEQ ID 958; ORF 247-1.a>:

```
a247-1.pep (partial)..

1  NNTAKLIPIA ESTDIKYPGF AQARPALIFQ YGIDDLDASA ETVVVSSCSK

51  IAKPGKKIST LQEAKSALQI TNDDKQNGNI TRQRHVVNAY AVGRIAGEEG

101  LFRFQLDDKG KWGNPQLLVK KIRHMKVRYI YVSDCPEDDD AGKEEKFKYT

151  GTFDSSTNAV TPAGVEVLLS SGTDTKIAAS SDNHIYAYRI DATIRGGNVC

201  ANRTL* m247-1/a247-1  80.6% identity in 206 aa overlap 10         20         30
a247-1.pep                       NNTAKLIPIAESTDIKYPGFAQARPALIFQ
                                 |:  ||||||||::|:|  :|  |:  |||||
m247-1       GFGCFNMSEHPATDVIPDTTQQNSPFSLKRNGIDKLIPIAESSNINYQNFFQVGSALIFQ
                80        90       100       110       120       130

40         50         60         70         80       89
a247-1.pep   YGIDDLDASAETVVVSSCSKIAKPGKKISTLQEAKSALQITNDDK-QNGNITRQRHVVNA
             |||||::||: :||||||: |:||||:|  ||::||: |:|  ::|| |||||:||||||
m247-1       YGIDDVNASTATTVVSSCAAISKPGKQIPTLEDAKKELKIPDQDKEQNGNIARQRHVVNA
                140       150       160       170       180       190

90        100       110       120       130       140       149
a247-1.pep   YAVGRIAGEEGLFRFQLDDKGKWGNPQLLVKKIRHMKVRYIYVSDCPEDDDAGKEEKFKY
             |||||| |||||||||||||||||||||||||:|||||||||||| ||||||||||| |||
m247-1       YAVGRIADEEGLFRFQLDDKGKWGNPQLLVKKVRHMKVRYIYVSGCPEDDDAGKEETFKY
                200       210       220       230       240       250

150       160       170       180       190       200
a247-1.pep   TGTFDSSTNAVTPAGVEVLLSSGTDTKIAASSDNHIYAYRIDATIRGGNVCANRTLX
             |  |||: |||||||||||||||||||||||||||||||||||||||||||||||||
m247-1       TDKFDSAQNAVTPAGVEVLLSSGTDTKIAASSDNHIYAYRIDATIRGGNVCANRTLX
                260       270       280       290       300       310
```

The following partial DNA sequence was identified in *N. gonorrhoeae* <SEQ ID 959>:

```
g248.seq
    1 atgcgcaaac agaacacttt gacaggaatc ccgacttctg acggacagag 51 ggggtccgca ctgtttatcg tgctgatggt gatgatagtc gtggcctttt 101 tggttgtaac tgccgcccag tcctacaata ccgaacagag gatcagtgcc 151 aacgaatcag acaggaaatt ggctttgtct ttagccgagg cggctttgcg 201 ggagggcgaa tttcaggttt tggatttgga atatgctgcg gacagtaagg 251 ttacgtttag cgaaaactgt gaaaaaggtc tgtgtaccgc agtgaatgtg 301 cggacaaata ataatggtag tgaagaggct tttggcaata tcgtggtgca 351 aggcaagccc gccgttgagg cggtgaaacg ttcttgccct gcaaagtctg 401 gcaaaaattc taccgacctg tgcattgaca ataaagggat ggaatataat 451 aaaggcgcgg caggcgtcag caaaatgccg cgctatatta tcgaatattt 501 aggcgtgaag aacggacaaa atgtttatcg ggttactgcc aaggcttggg 551 gtaagaatgc caataccgtg gtcgtccttc aatcttatgt aggcaataat 601 gatgagcaat aa
```

This corresponds to the amino acid sequence <SEQ ID 960; ORF 248.ng>:

```
g248.pep
    1 MRKQNTLTGI PTSDGQRGSA LFIVLMVMIV VAFLVVTAAQ SYNTEQRISA

51 NESDRKLALS LAEAALREGE FQVLDLEYAA DSKVTFSENC EKGLCTAVNV
```

```
101 RTNNNGSEEA FGNIVVQGKP AVEAVKRSCP AKSGKNSTDL CIDNKGMEYN

151 KGAAGVSKMP RYIIEYLGVK NGQNVYRVTA KAWGKNANTV VVLQSYVGNN

201 DEQ*
```

The following partial DNA sequence was identified in *N. meningitidis* <SEQ ID 961>:

```
m248.seq (partial)
  1  ..GGGTTTGCAC TGTTAATCGT GCTGATGGTG ATrATCGTCG TGGCT.TywT 51     gGwTGTAACT GCCGCGCAGT CTTACAATAC cGAGCAGCGk ATCAGTkCCA 101     ACGAATCAGA CAGGAAATTG GCTwTGTCTT TGGCCGAGkC GkCTwTGCGG

151     GAAGGCGAAC TTCAGGTTTT GGATTTGGAA TATGATACGG ACAGTAAGGT

201     TACATTTAGC GAAAACTGTG GAAAAGGTCT GTsTGCCGCA GTGAATGTGC

251     GGACAAATAA TGATAATGAA GAGGCTTTTG ACAATATCGT GGTGCAAGGC

301     AAGCCCACCG TTGAGGCGGT GAAGCGTTCT TGCCCTGCAA ATTCTACCGA

351     CCTGTGCATT GACAAGAAAG GGwTGGAATA TAAGAAAGGC ACGAGAAGCG

401     TCAc.AAAAT GCCACGTTAT ATTATCGAAT ATTTGGGCGT GwAGAACGGA

451     GAAAATGTTT ATCGGGTTAC TGCCAAGGCT TGGGGtAAGA ATGCCAATAC

501     CGTGGTCGTC CTTCAATCTT ATGTAAGCAA TAATGATGAG TAA
```

This corresponds to the amino acid sequence <SEQ ID 962; ORF 248>:

```
m248.pep (partial)
  1  ..GFALLIVLMV XIVVAFXXVT AAQSYNTEQR ISXNESDRKL AXSLAEXXXR

51     EGELQVLDLE YDTDSKVTFS ENCGKGLXAA VNVRTNNDNE EAFDNIVVQG

101     KPTVEAVKRS CPANSTDLCI DKKGXEYKKG TRSVTKMPRY IIEYLGVXNG

151     ENVYRVTAKA WGKNANTVVV LQSYVSNNDE *
```

Computer analysis of this amino acid sequence gave the following results:
Homology with a Predicted ORF from *N. gonorrhoeae*
ORF 248 shows 81.1% identity over a 185 aa overlap with a predicted ORF (ORF 248.ng) from *N. gonorrhoeae*:

```
    m248/g248

10         20         30         40
    m248.pep              GFALLIVLMVXIVVAFXXVTAAQSYNTEQRISXNESDRKLAXS
                          | ||:||||| ||||| |||||||||||||| ||||||||| |
    g248     MRKQNTLTGIPTSDGQRGSALFIVLMVMIVVAFLVVTAAQSYNTEQRISANESDRKLALS
                   10         20         30         40         50         60

50         60         70         80         90        100
    m248.pep  LAEXXXREGELQVLDLEYDTDSKVTFSENCGKGLXAAVNVRTNND-NEEAFDNIVVQGKP
              |||    ||||:|||||||:|||||||||| :|||||||: :|||| ||||||||
    g248      LAEAALREGEFQVLDLEYAADSKVTFSENCEKGLCTAVNVRTNNNGSEEAFGNIVVQGKP
                   70         80         90        100        110        120

110        120        130        140        150
    m248.pep  TVEAVKRSCPA----NSTDLCIDKKGXEYKKGTRSVTKMPRYIIEYLGVXNGENVYRVTA
              :|||||||||     ||||||||:|| ||:|:  :|:|||||||||| ||:||||||
    g248      AVEAVKRSCPAKSGKNSTDLCIDNKGMEYNKGAAGVSKMPRYIIEYLGVKNGQNVYRVTA
                   130        140        150        160        170        180

160        170        180
    m248.pep  KAWGKNANTVVVLQSYVSNNDEX
              ||||||||||||||||||:||||
    g248      KAWGKNANTVVVLQSYVGNNDEQX
                   190        200
```

The following partial DNA sequence was identified in *N. meningitidis* <SEQ ID 963>:

```
a248.seq
   1 ATGCGCAAAC AGAACACTTT GACGGGAATC CCGACTTCTG ACGGACAGAG

51 GGGGTTTGCA CTGTTTATCG TGCTGATGGT GATGATCGTC GTGGCTTTTT

101 TGGTTGTAAC TGCCGCGCAG TCTTACAATA CCGAGCAGCG GATCAGTGCC

151 AACGAATCAG ACAGGAAATT GGCTTTGTCT TTGGCCGAGG CGGCTTTGCG

201 GGAAGGCGAA CTTCAGGTTT TGGATTTGGA ATATGATACG GACAGTAAGG

251 TTACATTTAG CGAAAACTGT GGAAAAGGTC TGTGTACCGC AGTGAATGTG

301 CGGACAAATA ATGATAATGA AGAGGCTTTT GACAATATCG TGGTGCAAGG

351 CAAGCCCACC GTTGAGGCGG TGAAGCGTTC TTGCACTGCA AAATCTACAG

401 GCCTGTGCAT TGACAATAAA GGGATGGAAT ATAAGAAAGG CACGCAAAGC

451 GTCAGCAAAA TGCCACGTTA TATTATCGAA TATTTGGGCG TGAAGAACGG

501 AGAAAATGTT TATCGGGTTA CTGCCAAGGC TTGGGGTAAG AATGCCAATA

551 CCGTGGTCGT CCTTCAATCT TATGTAAGCA ATAATGATGA GTAA
```

This corresponds to the amino acid sequence <SEQ ID 964; ORF 248.a>:

```
a248.pep
   1 MRKQNTLTGI PTSDGQRGFA LFIVLMVMIV VAFLVVTAAQ SYNTEQRISA

51 NESDRKLALS LAEAALREGE LQVLDLEYDT DSKVTFSENC GKGLCTAVNV

101 RTNNDNEEAF DNIVVQGKPT VEAVKRSCTA KSTGLCIDNK GMEYKKGTQS

151 VSKMPRYIIE YLGVKNGENV YRVTAKAWGK NANTVVVLQS YVSNNDE*
``` m248/a248 89.4% identity in 180 aa overlap

```
                                            10        20        30        40
m248.pep                     GFALLIVLMVXIVVAFXXVTAAQSYNTEQRISXNESDRKLAXS
                             ||||:||||| |||||  |||||||||||||| |||||||| |
a248                MRKQNTLTGIPTSDGQRGFALFIVLMVMIVVAFLVVTAAQSYNTEQRISANESDRKLALS
                            10        20        30        40        50        60

50        60        70        80        90       100
m248.pep            LAEXXXREGELQVLDLEYDTDSKVTFSENCGKGLXAAVNVRTNNDNEEAFDNIVVQGKPT
                    |||   |||||||||||||||||||||||||||| :||||||||||||||||||||||||
a248                LAEAALREGELQVLKLEYDTDSKVTFSENCGKGLCTAVNVRTNNDNEEAFGNIVVQGKPT
                            70        80        90       100       110       120

110       120       130       140       150       160
m248.pep            VEAVKRSCPANSTDLCIDKKGXEYKKGTRSVTKMPRYIIEYLGVXNGENVYRVTAKAWGK
                    |||||||| |:|| ||||:|| ||||||:||:|||||||||||| |||||||||||||||
a248                VEAVKRSCTAKSTGLCIDNKGMEYKKGTQSVSKMPRYIIEYLGVKNGENVYRVTAKAWGK
                           130       140       150       160       170       180

170       180
m248.pep            NANTVVVLQSYVSNNDEX
                    ||||||||||||||||||
a248                NANTVVVLQSYVGNNDEX
                           190
```

The following partial DNA sequence was identified in *N. meningitidis* <SEQ ID 965>:

```
m248-1.seq
   1 ATGCGCAAAC AGAACACTTT GACGGGAATC CCGACTTCTG ACGGACAGAG

51 GGGGTTTGCA CTGTTTATCG TGCTGATGGT GATGATCGTC GTGGCTTTTT

101 TGGTTGTAAC TGCCGCGCAG TCTTACAATA CCGAGCAGCG GATCAGTGCC
```

-continued

```
151 AACGAATCAG ACAGGAAATT GGCTTTGTCT TTGGCCGAGG CGGCTTTGCG

201 GGAAGGCGAA CTTCAGGTTT TGGATTTGGA ATATGATACG GACAGTAAGG

251 TTACATTTAG CGAAAACTGT GGAAAAGGTC TGTGTGCCGC AGTGAATGTG

301 CGGACAAATA ATGATAATGA AGAGGCTTTT GACAATATCG TGGTGCAAGG

351 CAAGCCCACC GTTGAGGCGG TGAAGCGTTC TTGCCCTGCA AATTCTACCG

401 ACCTGTGCAT TGACAAGAAA GGGATGGAAT ATAAGAAAGG CACGAGAAGC

451 GTCAGCAAAA TGCCACGTTA TATTATCGAA TATTTGGGCG TGAAGAACGG

501 AGAAAATGTT TATCGGGTTA CTGCCAAGGC TTGGGGTAAG AATGCCAATA

551 CCGTGGTCGT CCTTCAATCT TATGTAAGCA ATAATGATGA GTAA
```

This corresponds to the amino acid sequence <SEQ ID 966; ORF 248-1>:

```
m248-1.pep

1 MRKQNTLTGI PTSDGQRGFA LFIVLMVMIV VAFLVVTAAQ SYNTEQRISA

51 NESDRKLALS LAEAALREGE LQVLDLEYDT DSKVTFSENC GKGLCAAVNV

101 RTNNDNEEAF DNIVVQGKPT VEAVKRSCPA NSTDLCIDKK GMEYKKGTRS

151 VSKMPRYIIE YLGVKNGENV YRVTAKAWGK NANTVVVLQS YVSNNDE* m248-1/g248 89.1% identity in 202 aa overlap 10         20         30         40         50         60
m248-1.pep  MRKQNTLTGIPTSDGQRGFALFIVLMVMIVVAFLVVTAAQSYNTEQRISANESDRKLALS
            ||||||||||||||||||| |||||||||||||||||||||||||||||||||||||||
g248        MRKQNTLTGIPTSDGQRGSALFIVLMVMIVVAFLVVTAAQSYNTEQRISANESDRKLALS
                 10         20         30         40         50         60

70         80         90        100        110       119
m248-1.pep  LAEAALREGELQVLDLEYDTDSKVTFSENCGKGLCAAVNVRTNND-NEEAFDNIVVQGKP
            ||||||||||:||||||||:||||||||||||:||||||||||||: ||||:|||||||
g248        LAEAALREGEFQVLDLEYAADSKVTFSENCEKGLCTAVNVRTNNNGSEEAFGNIVVQGKP
                 70         80         90        100        110        120

120        130        140        150        160        170
m248-1.pep  TVEAVKRSCPA----NSTDLCIDKKGMEYKKGTRSVSKMPRYIIEYLGVKNGENVYRVTA
            :|||||||||     ||||||||:|||||:||: :|||||||||||||||||:|||||
g248        AVEAVKRSCPAKSGKNSTDLCIDNKGMEYNKGAAGVSKMPRYIIEYLGVKNGQNVYRVTA
                     130        140        150        160        170        180

180        190
m248.1.pep  KAWGKNANTVVVLQSYVSNNDEX
            |||||||||||||||||:||||
g248        KAWGKNANTVVVLQSYVGNNDEQX
                    190        200 m248-1/a248 97.0% identity in 197 aa overlap 10         20         30         40         50         60
m248-1.pep  MRKQNTLTGIPTSDGQRGFALFIVLMVMIVVAFLVVTAAQSYNTEQRISANESDRKLALS
            ||||||||||||||||||||||||||||||||||||||||||||||||||||||||||||
a248        MRKQNTLTGIPTSDGQRGFALFIVLMVMIVVAFLVVTAAQSYNTEQRISANESDRKLALS
                 10         20         30         40         50         60

70         80         90        100        110        120
m248-1.pep  LAEAALREGELQVLDLEYDTDSKVTFSENCGKGLCAAVNVRTNNDNEEAFDNIVVQGKPT
            ||||||||||||||||||||||||||||||||||:|||||||||||||||||||||||
a248        LAEAALREGELQVLDLEYDTDSKVTFSENCGKGLCTAVNVRTNNDNEEAFDNIVVQGKPT
                 70         80         90        100        110        120
```

```
              130        140        150        160        170        180
m248-1.pep  VEAVKRSCPANSTDLCIDKKGMEYKKGTRSVSKMPRYIIEYLGVKNGENVYRVTAKAWGK
            ||||||||  : ||  |||| : |||||||||| : |||||||||||||||||||||||||
a248        VEAVKRSCTAKSTGLCIDNKGMEYKKGTQSVSKMPRYIIEYLGVKNGENVYRVTAKAWGK
              130        140        150        160        170        180
              190
m248.1.pep  NANTVVVLQSYVSNNDEX
            ||||||||||||||||||
a248        NANTVVVLQSYVSNNDEX
              190
```

The following partial DNA sequence was identified in *N. gonorrhoeae* <SEQ ID 967>:

```
g249.seq
   1 atgaagaata atgattgctt gcgcctgaaa atccccagt  ccggtatggc 51 gttgatagaa gtcttggtcg ctatgctcgt tctgaccatc ggtattttgg 101 cattgctgtc cgtacagttg cggacagtcg cttccgtcag ggaggcggaa 151 acgcaaacca tcgtcagcca aatcacgcaa aacctgatgg aaggaatgtt 201 gatgaatccg accattgatt tggacagcaa caagaaaaac tatagtcttt 251 acatgggaaa acagacacta tcagctgtgg atggtgagtt tatgcttgat 301 gccgagaaaa gtaaggcgca gttggcagag gaacaattga agagatttag 351 tcatgagctg aaaaatgcct tgccggatgc ggtagctatt cattacgccg 401 tctgcaagga ttcgtcgggt gacgcgccga cattgtccga cagcggtgct 451 ttttcttcaa attgcgacaa taaggcaaac ggggatactt tgattaaagt 501 attgtgggta aatgattcgg caggggattc ggatatttcc cgtacgaatc 551 ttgaagtgag cggcgacaat atcgtatata cctatcaggc aagggtcgga 601 ggtcgtgaat ga
```

This corresponds to the amino acid sequence <SEQ ID 968; ORF 249.ng>:

```
g249.pep
   1 MKNNDCLRLK NPQSGMALIE VLVAMLVLTI GILALLSVQL RTVASVREAE

51 TQTIVSQITQ NLMEGMLMNP TIDLDSNKKN YSLYMGKQTL SAVDGEFMLD

101 AEKSKAQLAE EQLKRFSHEL KNALPDAVAI HYAVCKDSSG DAPTLSDSGA

151 FSSNCDNKAN GDTLIKVLWV NDSAGDSDIS RTNLEVSGDN IVYTYQARVG

201 GRE*
```

The following partial DNA sequence was identified in *N. meningitidis* <SEQ ID 969>:

```
m249.seq
   1 ATGAAGAATA ATGATTGCTT CCGCCTGAAA GATTCCCAGT CCGGTATGGC

51 GCTGATAGAA GTCTTGGTTG CTATGCTCGT TCTGACCATC GGTATTTTGG

101 CACTATTGTC TGTACAGTTG CGGACAGTCN NNNNNNNNNN NNNNNNNNNN

151 NNNNNNNNNN NNNNNNNNNN NNNNNNNNNN NNNTTGATGG AGGGAATGTT

201 GATGAATCCG ACCATTGATT CGGACAGCAA CAAGAAAAAC TATAATCTTT

251 ACATGGGAAA CCATACACTA TCAGCTGTGG ATGGCGATTT TGCGATTGAT
```

-continued

```
301 GCCATGAAAA CTAAGGGCA ATTGGCAGAG GCACAATTGA AGAGATTTAG

351 TTATGAGCTG AAAAATGCCT TGCCGGATGC GGCAGCCATC CATTACGCCG

401 TCTGCAAGGA TTCGTCGGGT AACGCGCCGA CATTGTCCGG CAATGCTTTT

451 TCTTCAAATT GCGACAATAA GGCAAACGGG GATACTTTAA TTAAAGTATT

501 GTGGGTAAAT GATTCGGCAG GGGATTCGGA TATTTCCCGT ACGAATCTTG

551 AGGTGAGCGG CGACAATATC GTATATACTT ATCAGGCAAG GGTCGGAGGT

601 CGGGAATGA
```

This corresponds to the amino acid sequence <SEQ ID 970; ORF 249>:

```
m249.pep
  1 MKNNDCFRLK DSQSGMALIE VLVAMLVLTI GILALLSVQL RTVXXXXXXX

51 XXXXXXXXXX XLMEGMLMNP TIDSDSNKKN YNLYMGNHTL SAVDGDFAID

101 AMKTKGQLAE AQLKRFSYEL KNALPDAAAI HYAVCKDSSG NAPTLSGNAF

151 SSNCDNKANG DTLIKVLWVN DSAGDSDISR TNLEVSGDNI VYTYQARVGG

201 RE*
```

Computer analysis of this amino acid sequence gave the following results:
Homology with a Predicted ORF from *N. gonorrhoeae*
ORF 249 shows 81.3% identity over a 203 aa overlap with a predicted ORF (ORF 249.ng) from *N. gonorrhoeae*:

```
m249/g249

10         20         30         40         50         60
m249.pep  MKNNDCFRLKDSQSGMALIEVLVAMLVLTIGILALLSVQLRTVXXXXXXXXXXXXXXXXX
          ||||||:|||:|||||||||||||||||||||||||||||||  : :          :
g249      MKNNDCLRLKNPQSGMALIEVLVAMLVLTIGILALLSVQLRTVASVREAETQTIVSQITQ
                  10         20         30         40         50         60

70         80         90        100        110        120
m249.pep  XLMEGMLMNPTIDSDSNKKNYNLYMGNHTLSAVDGDFAIDAMKTKGQLAEAQLKRFSYEL
           ||||||||||| |||||||:||||::|||||||:| :|| |:|:|||| ||||||:||
g249      NLMEGMLMNPTIDLDSNKKNYSLYMGKQTLSAVDGEFMLDAEKSKAQLAEEQLKRFSHEL
                  70         80         90        100        110        120

130        140        150        160        170        179
m249.pep  KNALPDAAAIHYAVCKDSSGNAPTLSGN-AFSSNCDNKANGDTLIKVLWVNDSAGDSDIS
          ||||||||:|||||||||||:||||| :  ||||||||||||||||||||||||||||||
g249      KNALPDAVAIHYAVCKDSSGDAPTLSDSGAFSSNCDNKANGDTLIKVLWVNDSAGDSDIS
                  130        140        150        160        170        180

180        190        200
m249.pep  RTNLEVSGDNIVYTYQARVGGREX
          ||||||||||||||||||||||||
g249      RTNLEVSGDNIVYTYQARVGGREX
              190        200
```

The following partial DNA sequence was identified in *N. meningitidis* <SEQ ID 971>:

```
a249.seq
  1 ATGAAGAATA ATGATTGCTT CCGCCTGAAA AACCCCCAGT CCGGTATGGC

51 GCTGATAGAA GTCTTGGTCG CTATGCTCGT TCTGACCATC GGTATTTTGG

101 CACTATTGTC TGTTCAGTTG CGGACAGTCG CTTCCGTCAG GGAGGCAGAG

151 ACGCAAACCA TCGTCAGTCA AATCACGCAA AACCTGATGG AAGGAATGTT

201 GATGAATCCG ACCATTGATT CGGACAGCAA CAAGAAAAAC TATAATCTTT
```

-continued

```
251 ACATGGGAAA CCATCATGCA CTATCAGTTG TGGATGGCGA TTTTCAGGTT

301 GATGCCATAA AAACTAAGAC GCAGTTGGCA GAGGCACAAT TGAAGAGATT

351 TAGTTATGAG CTGAAAAATG CCTTGCCGGA TGCGGCAGCC ATCCATTACG

401 CCGTCTGCAA GGATTCGTCG GGTGTTGCGC CGACATTGTC CGCCGGCAGT

451 ACTTTTTCTT CAAATTGCGA TGGTAGTGCA AATGGGGATA CTTTGATTAA

501 AGTATTGTGG GTAAATGATT CGGCAGGGGA TTCGGATATC GCCCGTACGA

551 ATCTTGAGAC GAACGGCAAC AATATCGTAT ATACCTATCA GGCAAGGGTC

601 GGAGGTCGGG AATGA
```

This corresponds to the amino acid sequence <SEQ ID 972; ORF 249.a>:

```
a249.pep
   1 MKNNDCFRLK NPQSGMALIE VLVAMLVLTI GILALLSVQL RTVASVREAE

51 TQTIVSQITQ NLMEGMLMNP TIDSDSNKKN YNLYMGNHHA LSVVDGDFQV

101 DAIKTKTQLA EAQLKRFSYE LKNALPDAAA IHYAVCKDSS GVAPTLSAGS

151 TFSSNCDGSA NGDTLIKVLW VNDSAGDSDI ARTNLETNGN NIVYTYQARV

201 GGRE*
``` m249/a249 81.9% identity in 204 aa overlap

```
                    10        20        30        40        50        60
m249.pep  MKNNDCFRLKDSQSGMALIEVLVAMLVLTIGILALLSVQLRTVXXXXXXXXXXXXXXXXX
          ||||||||||: ||||||||||||||||||||||||||||||||       : :     :
a249      MKNNDCFRLKNPQSGMALIEVLVAMLVLTIGILALLSVQLRTVASVREAETQTIVSQITQ
                    10        20        30        40        50        60
                    70        80        90       100       110       119
m249.pep  XLMEGMLMNPTIDSDSNKKNYNLYMGNH-TLSAVDGDFAIDAMKTKGQLAEAQLKRFSYE
           |||||||||||||||||||||||||||| :||:||||| :||:||| ||||||||||||
a249      NLMEGMLMNPTIDSDSNKKNYNLYMGNHHALSVVDGDFQVDAIKTKTQLAEAQLKRFSYE
                    70        80        90       100       110       120
       120       130       140       150       160       170
m249.pep  LKNALPDAAAIHYAVCKDSSGNAPTLS-GNAFSSNCDNKANGDTLIKVLWVNDSAGDSDI
          |||||||||||||||||||| ||||| |::||||||::||||||||||||||||||||
a249      LKNALPDAAAIHYAVCKDSSGVAPTLSAGSTFSSNCDGSANGDTLIKVLWVNDSAGDSDI
                  130       140       150       160       170       180
        180       190       200
m249.pep  SRTNLEVSGDNIVYTYQARVGGREX
          :|||||::|:|||||||||||||||
a249      ARTNLETNGNNIVYTYQARVGGREX
                  190       200
```

The following partial DNA sequence was identified in *N. meningitidis* <SEQ ID 973>:

```
m249-1.seq
   1 ATGAAGAATA ATGATTGCTT CCGCCTGAAA GATTCCCAGT CCGGTATGGC

51 GCTGATAGAA GTCTTGGTTG CTATGCTCGT TCTGACCATC GGTATTTTGG

101 CACTATTGTC TGTACAGTTG CGGACAGTCG CTTCCGTCAG GGAGGCGGAG

151 ACACAAACCA TCGTCAGCCA AATCACGCAA AACCTGATGG AGGGAATGTT

201 GATGAATCCG ACCATTGATT CGGACAGCAA CAAGAAAAAC TATAATCTTT
```

-continued
```
251 ACATGGGAAA CCATACACTA TCAGCTGTGG ATGGCGATTT TGCGATTGAT

301 GCCATGAAAA CTAAGGGGCA ATTGGCAGAG GCACAATTGA AGAGATTTAG

351 TTATGAGCTG AAAAATGCCT TGCCGGATGC GGCAGCCATC CATTACGCCG

401 TCTGCAAGGA TTCGTCGGGT AACGCGCCGA CATTGTCCGG CAATGCTTTT

451 TCTTCAAATT GCGACAATAA GGCAAACGGG GATACTTTAA TTAAAGTATT

501 GTGGGTAAAT GATTCGGCAG GGGATTCGGA TATTTCCCGT ACGAATCTTG

551 AGGTGAGCGG CGACAATATC GTATATACTT ATCAGGCAAG GGTCGGAGGT

601 CGGGAATGA
```

This corresponds to the amino acid sequence <SEQ ID 974; ORF 249-1>:

```
m249-1.pep

1 MKNNDCKRLK DSQSGMALIE VLVAMLVLTI GILALLSVQL RTVASVREAE

51 TQTIVSQITQ NLMEGMLMNP TIDSDSNKKN YNLYMGNHTL SAVDGDFAID

101 AMKTKGQLAW AQLKRFSYEL KNALPDAAAI HYAVCKDSSG NAPTLSGNAF

151 SSNCDNKANG DTLIKVLWVN DSAGDSDISR TNLEVSGDNI VYTYQARVGG

201 RE* m249-1/g249    90.1% identity in 203 aa overlap 10         20         30         40         50         60
m249-1.pep  MKNNDCFRLKDSQSGMALIWVLVAMLVLTIGILALLSVQLRTVASVREAETQTIVSQITQ
            ||||||:|||:|||||||||||||||||||||||||||||||||||||||||||||||
g249        MKNNDCLRLKNPQSGMALIWVLVAMLVLTIGILALLSVQLRTVASVREAETQTIVSQITQ
                   10         20         30         40         50         60

70         80         90        100        110        120
m249-1.pep  NLMEGMLMNPTIDSDSNKKNYNLYMGNHTLSAVDGDFAIDAMKTKGQLAEAQLKRFSYEL
            ||||||||||||| |||||||:|||::||||||||:| :|| |:|:|||| ||||||:||
g249        NLMEGMLMNPTIDLDSNKKNYSLYMGKQTLSAVDGEFMLDAEKSKAQLAEEQLKRFSHEL
                   70         80         90        100        110        120

130        140        150        160        170        179
m249-1.pep  KNALPDAAAIHYAVCKDSSGNAPTLSGN-AFSSNCDNKANGDTLIKVLWVNDSAGDSDIS
            ||||||||:||||||||||:||||||| : ||||||||||||||||||||||||||||||
g249        KNALPDAVAIHYAVCKDSSDNAPTLSDSGAFSSNCDNKANGDTLIKVLWVNDSAGDSDIS
                  130        140        150        160        170        180

180        190        200
m249-1.pep  RTNLEVSGDNIVYTYQARVGGREX
            ||||||||||||||||||||||||
g249        RTNLEVSGDNIVYTYQARVGGREX
                  190        200 a249 (SEQ ID 972)/ L366117 (SEQ ID 4166)
gi|643582 (L36117) prepilin leader sequence requires cleavage to be active [Pseudomonas aeruginosa]
>gi|1161222 (L48934) involved in type 4 fimbrial biogenesis; contains pre-pilin like leader
sequence [Pseudomonas aeruginosa]
>gi|1246299 (L76605) reference L36117, L48934 [Pseudomonas aeruginosa] Length = 185
 Score = 50.4 bits (118), Expect = 9e-06
 Indentities - 45/183 (24%), Positives = 84/183 (45%), Gaps = 26/183 (14%)

Query:  13 QSGMALIEVLVAMLVLTIGILALLSVQLRTVASVREAETQTIVSQITQNLMEGMLMNPTI 72
           QSG ++IEVLVA+L+++IG+L ++++Q +T+   ++  +  + NL+E M  +P
Sbjct:  12 QSGFSMIEVLVALLLISIGVLVMIAMQGKTIQYTADSVERNKAAMLGSNLLESMRASPKA 71

Query:  73 DSDSNKKNYNLYMGNHHALSVVDGDFQVDAIKTKTQLAEA---QLKRFSYELKNALPDAA 129
            D  +    M    G   A  + T L +A   +L  ++KN LP A
Sbjct:  72 LYDVKDQ-----MATQSDFFKAKGSAFPTAPSSCTPLPDAIKDRLGCWAEQNKNELPGAG 126

Query: 130 AI---HYAVCKDSSGVAPTLSAGSTFSSNCDGSANGDTL-IKVLWVNDSAGDSDIARTNL 185
            +    Y +C+ S          +CDG  G  L I++ W      + A ++
Sbjct: 127 DLLKSDYYICRSSK-----------PGDCDG--KGSMLEIRLAWRGKQGACVNAADSSA 172

Query: 186 ETN 188
            +T+
Sbjct: 173 DTS 175 m249-1/a249    90.7% identity in 204 aa overlap
```

```
                  10         20         30         40         50         60
m249-1.pep   MKNNDCFRLKDSQSGMALIEVLVAMLVLTIGILALLSVQLRTVASVREAETQTIVSQITQ
             ||||||||||:|||||||||||||||||||||||||||||||||||||||||||||||||
a249         MKNNDCFRLKNPQSGMALIEVLVAMLVLTIGILALLSVQLRTVASVREAETQTIVSQITQ
                  10         20         30         40         50         60

70         80         90        100        110       119
m249-1.pep   NLMEGMLMNPTIDSDSNKKNYNLYMGNH-TLSAVDGDFAIDAMKTKGQLAEAQLKRFSYE
             ||||||||||||||||||||||||||||| :||:||||| :||:|||||||||||||||||
a249         NLMEGMLMNPTIDSDSNKKNYNLYMGNHHALSVVDGDFQVDAIKTKTQLAEAQLKRFSYE
                  70         80         90        100        110       120

120        130        140        150        160        170
m249-1.pep   LKNALPDAAAIHYAVCKDSSGNAPTLS-GNAFSSNCDNKANGDTLIKVLWVNDSAGDSDI
             |||||||:|||||||||||||:||||| |::||||::|||||||||||||||||||||||
a249         LKNALPDAVAIHYAVCKDSSDVAPTLSAGSTFSSNCDGSANGDTLIKVLWVNDSAGDSDI
                 130        140        150        160        170        180

180        190        200
m249-1.pep   SRTNLEVSGDNIVYTYQARVGGREX
             :||||::|:|||||||||||||||
a249         SRTNLETNGNNIVYTYQARVGGREX
                 190        200
```

The following partial DNA sequence was identified in *N. gonorrhoeae* <SEQ ID 975>:

```
g250.seq
   1 atgacgcaca cagcctctcc acgtgatgaa ttcatacgcg cataaaaga 51 aagttcgccc atgctgattg ggcttttgcc ttgggcattg atactcggta 101 tgcagggcgg gcaaaaaggt atgggccggc tggaaatgct gctgatgacg 151 gggatgaact ttgccggcgg ctccgaattt gccacggtca acctgtgggc 201 ggaacctctg ccgatactgc ttatcgccac cataaccttt atgattaatt 251 cgcggcatat cctgatgggg ggcggcgctt gccacgcaca tgaaagaaat 301 accgctgaaa aaagccgcgc ccgcgctgtt ttttatgtgt ga
```

This corresponds to the amino acid sequence <SEQ ID 976; ORF 250.ng>:

```
g250.pep
   1 MTHTASPRDE FIRGIKESSP MLIGLLPWAL ILGMQGGQKG MGRLEMLLMT

51 GMNFAGGSEF ATVNLWAEPL PILLIATITF MINSRHILMG GGACHAHERN

101 TAEKSRARAV FYV*
```

The following partial DNA sequence was identified in *N. meningitidis* <SEQ ID 977>:

```
m250.seq
   1 ATGCACACCT TCCCCGCATA ACGAATTTAT ACGCGGCATC AAAGAAAGTT

51 CGCCTATGCT GATTGGGCTG CTGCCTTGGG CATTAATACT CGGTATGCAG

101 GGCGGACAAA AAGGCATGAG CTGGCTGGAA ATGTTGTTGA TGACCAGTAT

151 GAACTTCGCC GGCGGCTCCG AGTTTGCCAC GGTCAACCTG TGGGCsGAAC

201 CTCTGCCGAT ACTGCTTATC GCCACCGTAA CCTTTATGAT TAATTCTCGG

251 CATATCCTGA T.GGGGGCGG CGCTTGCCCC GCACCTGAAA GGAaTACCGC

301 TGAAAAAAGC CGTGCCCGCA CTGTTTTTTA TGTGTGA
```

This corresponds to the amino acid sequence <SEQ ID 978; ORF 250>:

```
m250.pep
    1 MHTPSPHNEF IRGIKESSPM LIGLLPWALI LGMQGGQKGM SWLEMLLMTS

51 MNFAGGSEFA TVNLWAEPLP ILLIATVTFM INSRHILMGG GACPAPERNT

101 AEKSRARTVF YV*
```

Computer analysis of this amino acid sequence gave the following results:
Homology with a Predicted ORF from *N. gonorrhoeae*
ORF 250 shows 91.0% identity over a 111 aa overlap with a predicted ORF (ORF 250.ng) from *N. gonorrhoeae*:

```
    m250/g250

10        20        30        40        50        59
        m250.pep    MHTPSPHNEFIRGIKESSPMLIGLLPWALILGMQGGQKGMSWLEMLLMTSMNFAGGSEF
                    ||  ||::||||||||||||||||||||||||||||||: ||||||||:||||||||
        g250        MTHTASPRDEFIRGIKESSPMLIGLLPWALILGMQGGQKGMGRLEMLLMTGMNFAGGSEF
                    10        20        30        40        50        60

60        70        80        90       100       110
        m250.pep    ATVNLWAEPLPILLIATVTFMINSRHILMGGGACPAPERNTAEKSRARTVFYVX
                    |||||||||||||||||:|||||||||||||||| ||||||||||:||||
        g250        ATVNLWAEPLPILLIATITFMINSRHILMGGGACHAHERNTAEKSRARAVFYV
                    70        80        90       100       110
```

The following partial DNA sequence was identified in *N. meningitidis* <SEQ ID 979>:

```
a250.seq
    1 ATGACACACA TAAGCTCGCC CCGTAACGAA TTTATACGCG GCATCAAAGA

51 AAGTTCGCCC ATGCTGATCG GGCTTTTGCC TTGGGCATTA ATACTCGGTA

101 TGCAGGGTGG ACAAAAAGGC ATGAGCTGGC TGGAAATGTT GTTGATGACC

151 GGTATGAACT TCGCCGGCGG CTCCGAGTTT GCCACGGTCA ACCTGTGGGC

201 GGAACCTCTG CCGATACTGC TTATCGCCAC CGTAACCTTT ATGATTAATT

251 CTCGGCATAT CCTGATGGGG G.CGGCACTT GCCCCGCACC TGAAAGAAAT

301 ACCGCTGAAA AAAGCCGTGC CCGCACTGTT TTTTATGTGT GA
```

This corresponds to the amino acid sequence <SEQ ID 980; ORF 250.a>:

```
a250.pep
    1 MTHISSPRNE FIRGIKESSP MLIGLLPWAL ILGMQGGQKG MSWLEMLLMT

51 GMNFAGGSEF ATVNLWAEPL PILLIATVTF MINSRHILMG XGTCPAPERN

101 TAEKSRARTV FYV*
``` m250/a250 94.6% identity in 111 aa overlap

```
                    10        20        30        40        50        59
        m250.pep    MHTPSPHNEFIRGIKESSPMLIGLLPWALILGMQGGQKGMSWLEMLLMTSMNFAGGSEF
                    |  ||:||||||||||||||||||||||||||||||||||||||||||:||||||||
        a250        MTHISSPRNEFIRGIKESSPMLIGLLPWALILGMQGGQKGMSWLEMLLMTGMNFAGGSEF
                    10        20        30        40        50        60
```

```
              60         70         80         90        100        110
m250.pep    ATVNLWAEPLPILLIATVTFMINSRHILMGGGACPAPERNTAEKSRARTVFYVX
            |||||||||||||||||||||||||||||| |:|||||||||||||||||||||
a250        ATVNLWAEPLPILLIATVTFMINSRHILMGTGTCPAPERNTAEKSRARTVFYVX
              70         80         90        100        110
```

The following partial DNA sequence was identified in *N. gonorrhoeae* <SEQ ID 981>:

```
g251.seq
   1 atgcctgacc caatagggat tctttcgct gccgtcgggg ttgattttt
  51 tgccgttgtt ttgaggggc gttttcaacg aataggcgcg gttggcatgt
 101 tgataataat aatcctgatg gcggaggtcg aaccaaaac ggtcgtaacc
 151 gaggttgacg ctcaggttgt ggcggatttt ggcggtatcg aaggatttt
 201 tgaatgccgc ctgcaagagc ctgtggcttt ccccgtaaat cacgcggtcg
 251 gatttgtagt aggaagacgg cttgtcggca ctcgggcggc aatatttgtc
 301 cgaaccgtcg gcgaacagt gcgtctgctg aaaatgattg tccaaaccga
 351 tgccctgccg gtcgtaagag aggcgggcat aatccgccca agtgtcttta
 401 tcggcattgg tatagacata ttccaaaccg tagcggcttt tggtgtgcgt
 451 ctcgtcgtaa aacacgcccg taccgtattc cgcgcccacc tccgcaccgt
 501 tttcaccgtt ggtaatcagc ccgctgtatt tgcggccgcc cgcgtatttg
 551 ccgtagcctc ttatcgatcc gtatttttta ttttcatcaa aaaccgcctt
 601 ggtcaggaat gccggaaccg tcatatcgcg cgtgtcgaaa gtttgctgcg
 651 tgcgttcgag tatgccgccg atgtagtgcc gtttgttttc aaaacgaaaa
 701 cccgggcgga acagccacga ccggctttcg tatga
```

This corresponds to the amino acid sequence <SEQ ID 982; ORF 251.ng>:

```
g251.pep
   1 MPDPIGILFA AVGVDFFAVV LRGRFQRIGA VGMLIIIILM AEVGTKTVVT
  51 EVDAQVVADF GGIEGFFECR LQEPVAFPVN HAVGFVVGRR LVGTRAAIFV
 101 RTVGGTVRLL KMIVQTDALP VVREAGIIRP SVFIGIGIDI FQTVAAFGVR
 151 LVVKHARTVF RAHLRTVFTV GNQPAVFAAA RVFAVASYRS VFFIFIKNRL
 201 GQECRNRHIA RVESLLRAFE YAADVVPFVF KTKTRAEQPR PAFV*
```

The following partial DNA sequence was identified in *N. meningitidis* <SEQ ID 983>:

```
m251.seq
   1 ATGCGTGCTG CGGTAGTCGT AGCGCAAGCC CGCGCCGACA TCCGCCCACC
  51 TGCCCAAACG GACATTGTCC CGAACTGCCG CGTAATAGCT TTTACCGTTG
 101 ATGCTGCGCG GCGTGCAGTC CGTATAAGTA TTGTTGCCCA AGCGGCAGAT
 151 TTGCCCCGTA ACGACATTTC CCCTGCCTAT GGTGACCCAA TAGGGGCTGG
 201 TTTCACTGCC GTTGGGGCTG ATTTTTTTGC CGTTGTTTTG AGGGGCGTG
 251 TTCGACGAAT AGGCGCGGTT GGCATGTTGA TAATAATAAT CCTGATGGCG
 301 GAGATTAGAG CCAAAGCGGT CAAACCCGAG ATTCACGCTC AGGTTGTGGC
 351 GGATTTTGGC GGTATCGAAG GATTTTTTGA ATGCCGCCTG CAAGAGCCTG
```

```
401 TGGCTTTCCC CGTAAATCAC GCGATCGGAT TTGTAATAGG AAAACGGCTT

451 GTCGGCACTC GGGCGGCAAT ATTTGTCCGA ACCGTCGGCA GAACAGTGCG

501 TCTGCTGAAA ATGATTATCC AAACCGATGC CCTGCCGGTC GTAAGAGAGG

551 CGGGCATAAT CCGCCCAAGT GTCTTTATCG GCATTGGTAT AGACATATTC

601 CAAACCGTAG CGGCTTTTGG TGTGCGTCTC GTCGTAAAAC ACGCCCGTAC

651 CGTATTCCGC GCCCACCAGC GCACCGTTTT CGCCGTTGGT AAACAGTCCG

701 CCGTATTTGT GGTTGCCCGC GTATTTGCCG TTACCGGGCA AGAACCCGC

751 CTGTTTTTTA TTTGCATCAA AAACCGCCTT GGTCAGGAAT GCCGGAACCG

801 TCATATCGCG CGTGTCGAAA GTTTGTTGCG TGTGTTCGAG TATGCCGCCG

851 ATGTAGTGCC GCTTATTCTC AAAACGAAAA CCCGGGCGGA ACAGCCACGA

901 CCGGCTTTCG TATGA
```

This corresponds to the amino acid sequence <SEQ ID 984; ORF 251>:

```
m251.pep
  1 MRAAVVVAQA RADIRPPAQT DIVPNCRVIA FTVDAARRAV RISIVAQAAD

51 LPRNDISPAY GDPIGAGFTA VGADFFAVVL RGRVRRIGAV GMLIIIILMA

101 EIRAKAVKPE IHAQVVADFG GIEGFFECRL QEPVAFPVNH AIGFVIGKRL

151 VGTRAAIFVR TVGRTVRLLK MIIQTDALPV VREAGIIRPS VFIGIGIDIF

201 QTVAAFGVRL VVKHARTVFR AHQRTVFAVG KQSAVFVVAR VFAVTGQRTR

251 LFFICIKNRL GQECRNRHIA RVESLLRVFE YAADVVPLIL KTKTRAEQPR

301 PAFV*
```

Computer analysis of this amino acid sequence gave the following results:

Homology with a Predicted ORF from *N. gonorrhoeae*

ORF 251 shows 85.2% identity over a 243 aa overlap with a predicted ORF (ORF 251.ng) from *N. gonorrhoeae*:

```
m251/g251
                    40         50         60         70         80         90
      m251.pep   TVDAARRAVRISIVAQAADLPRNDISPAYGDPIGAGFTAVGADFFAVVLRGRVRRIGAVG
                 ||||  |:|||:||||||||||  :||||||
      g251                                   MPDPIGILFAAVGVDFFAVVLRGRFQRIGAVG
                                              10         20         30

100        110        120        130        140        150
      m251.pep   MLIIIILMAEIRAKAVKPEIHAQVVADFGGIEGFFECRLQEPVAFPVNHAIGFVIGKRLV
                 |||||||||:  :|:|  ||:  ||||||||||||||||||||||||||:|||:|:||
      g251       MLIIIILMAEVGTKTVVTEVDAQVVADFGGIEGFFECRLQEPVAFPVNHAVGFVVGRRLV
                    40         50         60         70         80         90

160        170        180        190        200        210
      m251.pep   GTRAAIFVRTVGRTVRLLKMIIQTDALPVVREAGIIRPSVFIGIGIDIFQTVAAFGVRLV
                 |||||||||||| ||||||||:||||||||||||||||||||||||||||||||||||
      g251       GTRAAIFVRTVGGTVRLLKMIVQTDALPVVREAGIIRPSVFIGIGIDIFQTVAAFGVRLV
                    100        110        120        130        140        150

220        230        240        250        260        270
      m251.pep   VKHARTVFRAHQRTVFAVGKQSAVFVVARVFAVTGQRTRLFFICIKNRLGQECRNRHIAR
                 ||||||||||| |||:||:| |||::||||::  |: :||| ||||||||||||||||
      g251       VKHARTVFRAHLRTVFTVGNQSAVFAAARVFAVASQRS-VFFIFIKNRLGQECRNRHIAR
                    160        170        180        190        200        210

280        290        300
      m251.pep   VESLLRVFEYAADVVPLILKTKTRAEQPRPAFVX
                 ||||||:|||||||:  :||||||||||||||||
      g251       VESLLRAFEYAADVVPFVFKTKTRAEQPRPAFVX
                    220        230        240
```

The following partial DNA sequence was identified in *N. meningitidis* <SEQ ID 985>:

```
a251.seq
   1 ATGCGTGCTG CGGTAGTCGT AGCGCAACCC CGCGCCGACA TCCGCCCACC

51 TGCCCAAACG GACATTGTCC CGAACTGCCG CGTAATAGCT TTTGCCGTTG

101 ATGCTGCGCG GCGTGCAGTC CGTATAAGTA TTGTTGCCCA AGCGGCAGAT

151 TTGCCCCGTA ACCACATTTC CCCTGCCTAT GCTGACCCAA TAGGGTTGGT

201 CCTTGCCGCC GTTGGGGTTG GCGGTTTTAG GGGGCGTTTT CGACGAATAG

251 GCGCGGTTGG CATGTTGATA ATAATAATCC TGATGGCGGA GATTAGAGTC

301 AAAGCGGTCA AAACCGAGAT TCACGCTCAG GTTGTGGCGG ATTTTGGCGG

351 TATCGAAGGA TTTTTTGAAT GCCGCCTGCA AGAGCCTGTG GCTTTCCCCG

401 TAAATCACGC GGTCGGATTT GTAGTAGGAA AACGGCTTGT CGGCACTCGG

451 GCGGCAATAT TTGTCCGAAC CGTCGGCAGA ACAGTGCGTC TGCTGAAAAT

501 GATTGTCCAA ACCGATGCCC TGCCGGTCGT AAGAGAGGCG GGCATAATCC

551 ACCCAAGTGT CTTTATCGGC ATTGGTATAG ACATATTCCA AACCGTAGCG

601 GCTTTTGGTG TGCGTCTCGT CGTAAAACAC GCCCGTACCG TATTCCGCGC

651 CCACCAGCGC ACCGTTTTCG CCGTTGGTAA ACAGACCGCC GTATTTGTGG

701 TCGCCCGCGT ATTTGCCGTT GCCTCTTATC GGTCCGTATT TTCTATTTTC

751 ATCAAAAACC GCCTTGGTCA GGAATGCCGG AACCGTCATA TCGCGCGTGT

801 CGAAAGTTTG TTGCGTGTGT TCGAGTATGC CGCCGATGTA GTGCCGTTTG

851 TTTTCAAAAC GAAAACCCGG GCGGAACAGC CACGATCGGC TTTCGTATGA
```

This corresponds to the amino acid sequence <SEQ ID 986; ORF 251.a>:

```
a251.pep
   1 MRAAVVVAQP RADIRPPAQT DIVPNCRVIA FAVDAARRAV RISIVAQAAD

51 LPRNHISPAY ADPIGLVLAA VGVGGFRGRF RRIGAVGMLI IIILMAEIRV

101 KAVKTEIHAQ VVADFGGIEG FFECRLQEPV AFPVNHAVGF VVGKRLVGTR

151 AAIFVRTVGR TVRLLKMIVQ TDALPVVREA GIIHPSVFIG IGIDIFQTVA

201 AFGVRLVVKH ARTVFRAHQR TVFAVGKQTA VFVVARVFAV ASYRSVFSIF

251 IKNRLGQECR NRHIARVESL LRVFEYAADV VPFVFKTKTR AEQPRSAFV*
``` m251/a251 88.5% identity in 304 aa overlap

```
                        10        20        30        40        50        60
m251.pep        MRAAVVVAQARADIRPPAQTDIVPNCRVIAFTVDAARRAVRISIVAQAADLPRNDISPAY
                ||||||||| |||||||||||||||||||||:|||||||||||||||||||||| |||||
a251            MRAAVVVAQPRADIRPPAQTDIVPNCRVIAFAVDAARRAVRISIVAQAADLPRNHISPAY
                        10        20        30        40        50        60

70        80        90       100       110       120
m251.pep        GDPIGAGFTAVGADFFAVVLRGRVRRIGAVGMLIIIILMAEIRAKAVKPEIHAQVVADFG
                :||||  ::|||:  |    ||| |||||||||||||||||||:|||| |||||||||||
a251            ADPIGLVLAAVGVGGF----RGRFRRIGAVGMLIIIILMAEIRVKAVKTEIHAQVVADFG
                        70            80        90       100       110

130       140       150       160       170       180
m251.pep        GIEGFFECRLQEPVAFPVNHAIGFVIGKRLVGTRAAIFVRTVGRTVRLLKMIIQTDALPV
                |||||||||||||||||||||:|||:||||||||||||||||||||||||||:|||||||
a251            GIEGFFECRLQEPVAFPVNHAVGFVVGKRLVGTRAAIFVRTVGRTVRLLKMIVQTDALPV
                 120       130       140       150       160       170
```

```
              190       200       210       220       230       240
m251.pep    VREAGIIRPSVFIGIGIDIFQTVAAFGVRLVVKHARTVFRAHQRTVFAVGKQSAVFVVAR
            ||||||| ||||||||||||||||||||||||||||||||||||||||||:||||||
a251        VREAGIIHPSVFIGIGIDIFQTVAAFGVRLVVKHARTVFRAHQRTVFAVGKQTAVFVVAR
              180       190       200       210       220       230

250       260       270       280       290       300
m251.pep    VFAVTGQRTRLFFICIKNRLGQECRNRHIARVESLLRVFEYAADVVPLILKTKTRAEQPR
            ||||:: |: :| | |||||||||||||||||||||||||||||||:::||||||||||
a251        VFAVASYRS-VFSIFIKNRLGQECRNRHIARVESLLRVFEYAADVVPFVFKTKTRAEQPR
              240       250       260       270       280       290 m251.pep    PAFVX
            ||||
a251        SAFVX
              300
```

The following partial DNA sequence was identified in *N. gonorrhoeae* <SEQ ID 987>:

```
g253.seq
    1 atgatcgaca gggaccgtat gttgcgggac acgttggaac gtgtgcgtgc 51 ggggtcgttc tggttatggg tggtggtggc atcgatgatg tttaccgccg 101 gattttcagg cacttatctt ctgatggaca atcaggggct gaatttcttt 151 ttagttttgg cgggagtgtt gggcatgaat acgctgatgc tggcagtatg 201 gttggcaacg ttgttcctgc gcgtgaaagt gggacggttt ttcagcagtc 251 cggcgacgtg gtttcggggc aaaggccctg taaatcaggc ggtgttgcgg 301 ctgtatgcgg accagtggcg gcaaccttcg gtacgatgga aaataggcgc 351 aacggcgcac agcttgtggc tctgcacgct gctcggaatg ctggtgtcgg 401 tattgctgct gcttttggtg cggcaatata cgttcaactg ggaaagcacg 451 ctgttgagca atgccgcttc ggtacgcgcg gtggaaatgt tggcatggct 501 gccgtcgaaa ctcggtttcc ctgtccccga tgcgcgggcg gtcatcgaag 551 gtcgtctgaa cggcaatatt gccgatgcgc gggcttggtc ggggctgctg 601 gtcggcagta tcgtctgcta cggcatcctg ccgcgcctct tggcttgggt 651 agtgtgtaaa atcctttga aaacaagcga aaacggattg gatttggaaa 701 aaacctatta tcaggcggtc atccgccgct ggcagaacaa aatcaccgat 751 gcggatacgc gtcgggaaac cgtgtccgcc gtttcgccga aaatcgtctt 801 gaacgatgcg ccgaaatggg cgctcatgct ggagaccgag tggcaggacg 851 gccaatggtt cgagggcagg ctggcgcagg aatggctgga taagggcgtt 901 gccgccaatc gggaacaggt tgccgcgctg gagacagagc tgaagcagaa 951 accggcgcaa ctgcttatcg gcgtacgcgc ccaaactgtg ccggaccggg 1001 gcgtgctgcg gcagattgtg cggctttcgg aagcggcgca gggcggcgcg 1051 gtggtgcagc tttggcgga acaggggctt tcagacgacc tttcggaaaa 1101 gctggaacat tggcgtaacg cgctgaccga atgcggcgcg gcgtggcttg 1151 agcctgacag ggtggcgcag gaaggccgtt tgaaagacca ataa
```

This corresponds to the amino acid sequence <SEQ ID 988; ORF 253.ng>:

```
g253.pep
    1 MIDRDRMLRD TLERVRAGSF WLWVVVASMM FTAGFSGTYL LMDNQGLNFF

51 LVLAGVLGMN TLMLAVWLAT LFLRVKVGRF FSSPATWFRG KGPVNQAVLR
```

-continued

```
101 LYADQWRQPS VRWKIGATAH SLWLCTLLGM LVSVLLLLLV RQYTFNWEST

151 LLSNAASVRA VEMLAWLPSK LGFPVPDARA VIEGRLNGNI ADARAWSGLL

201 VGSIVCYGIL PRLLAWVVCK ILLKTSENGL DLEKTYYQAV IRRWQNKITD

251 ADTRRETVSA VSPKIVLNDA PKWALMLETE WQDGQWFEGR LAQEWLDKGV

301 AANREQVAAL ETELKQKPAQ LLIGVRAQTV PDRGVLRQIV RLSEAAQGGA

351 VVQLLAEQGL SDDLSEKLEH WRNALTECGA AWLEPDRVAQ EGRLKDQ*
```

The following partial DNA sequence was identified in *N. meningitidis* <SEQ ID 989>:

```
m253.seq
   1 ATGATTGACA GGAACCGTAT GCTGCGGGAG ACGTTGGAAC GTGTGCGTGC

51 GGGGTCGTTC TGGTTGTGGG TGGTGGCGGC GACGTTTGCA TTTTTTACCG

101 GTTTTTCAGT CACTTATCTT CTAATGGACA ATCAGGGTCT GAATTTCTTT

151 TTGGTTTTGG CGGGCGTGTT GGGCATGAAT ACGCTGATGC TGGCAGTATG

201 GTTGGCAATG TTGTTCCTGC GTGTGAAAGT GGGGCGTTTT TTCAGCAGTC

251 CGGCGACGTG GTTTCGGGGC AAAGACCCTG TAAATCAGGC GGTGTTGCGG

301 CTGTATGCGG ACGAGTGGCG GCAACCTTCG GTACGTTGGA AAATAGGCGC

351 AACGTCGCAC AGCCTGTGGC TCTGCACGCT GCTCGGAATG CTGGTGTCGG

401 TATTGTTGCT GCTTTTGGTG CGGCAATATA CGTTCAACTG GGAAAGCACG

451 CTGTTGAGCA ATGCCGCTTC GGTACGCGCG GTGGAAATGT TGGCATGGCT

501 GCCGTCGAAA CTCGGTTTCC CTGTCCCCGA TGCGCGGGCG GTCATCGAAG

551 GCCGTCTGAA CGGCAATATT GCCGATGCGC GGGCTTGGTC GGGGCTGCTG

601 GTCGGCAGTA TCGCCTGCTA CGGCATCCTG CCGCGCCTGC TGGCTTGGGT

651 AGTGTGTAAA ATCCTTTTGA AAACAAGCGA AAACGGATTG GATTTGGAAA

701 AGCCCTATTA TCAGGCGGTC ATCCGCCGCT GGCAGAACAA AATCACCGAT

751 GCGGATACGC GTCGGGAAAC CGTGTCCGCC GTTTCACCGA AAATCATCTT

801 GAACGATGCG CCGAAATGGG CGGTCATGCT GGAGACCGAG TGGCAGGACG

851 GCGAATGGTT CGAGGGCAGG CTGGCGCAGG AATGGCTGGA TAAGGGCGTT

901 GCCACCAATC GGGAACAGGT TGCCGCGCTG GAGACAGAGC TGAAGCAGAA

951 ACCGGCGCAA CTGCTTATCG GCGTGCGCGC CCAAACTGTG CCGGACCGCG

1001 GCGTGTTGCG GCAGATTGTC CGACTCTCGG AAGCGGCGCA GGGCGGCGCG

1051 GTGGTGCAGC TTTTGGCGGA ACAGGGGCTT TCAGACGACC TTTCGGAAAA

1101 GCTGGAACAT TGGCGTAACG CGCTGGCCGA ATGCGGCGCG GCGTGGCTTG

1151 AGCCTGACAG GGCGGCGCAG GAAGGGCGTT TGAAAGACCA ATAA
```

This corresponds to the amino acid sequence <SEQ ID 990; ORF 253>:

```
m253.pep
  1 MIDRNRMLRE TLERVRAGSF WLWVVAATFA FFTGFSVTYL LMDNQGLNFF

51 LVLAGVLGMN TLMLAVWLAM LFLRVKVGRF FSSPATWFRG KDPVNQAVLR

101 LYADEWRQPS VRWKIGATSH SLWLCTLLGM LVSVLLLLLV RQYTFNWEST

151 LLSNAASVRA VEMLAWLPSK LGFPVPDARA VIEGRLNGNI ADARAWSGLL
```

```
201 VGSIACYGIL PRLLAWVVCK ILLKTSENGL DLEKPYYQAV IRRWQNKITD

251 ADTRRETVSA VSPKIILNDA PKWAVMLETE WQDGEWFEGR LAQEWLDKGV

301 ATNREQVAAL ETELKQKPAQ LLIGVRAQTV PDRGVLRQIV RLSEAAQGGA

351 VVQLLAEQGL SDDLSEKLEH WRNALAECGA AWLEPDRAAQ EGRLKDQ*
```

Computer analysis of this amino acid sequence gave the following results:

Homology with a Predicted ORF from *N. gonorrhoeae*

ORF 253 shows 94.7% identity over a 397 aa overlap with a predicted ORF (ORF 253.ng) from *N. gonorrhoeae*:

```
    m253/g253

10         20         30         40         50         60
    m253.pep   MIDRNRMLRETLERVRAGSFWLWVVAATFAFFTGFSVTYLLMDNQGLNFFLVLAGVLGMN
               ||||:||||:||||||||||||||||:|::  | :||| ||||||||||||||||||||
    g253       MIDRDRMLRDTLERVRAGSFWLWVVVASMMFTAGFSGTYLLMDNQGLNFFLVLAGVLGMN
                       10         20         30         40         50         60

70         80         90        100        110        120
    m253.pep   TLMLAVWLAMLFLRVKVGRFFSSPATWFRGKDPVNQAVLRLYADEWRQPSVRWKIGATSH
               |||||||| || ||||||||||||||||||| ||||||||||||:||||||||||||:|
    g253       TLMLAVWLATLFLRVKVGRFFSSPATWFRGKGPVNQAVLRLYADQWRQPSVRWKIGATAH
                       70         80         90        100        110        120

130        140        150        160        170        180
    m253.pep   SLWLCTLLGMLVSVLLLLLVRQYTFNWESTLLSNAASVRAVEMLAWLPSKLGFPVPDARA
               ||||||||||||||||||||||||||||||||||||||||||||||||||||||||||||
    g253       SLWLCTLLGMLVSVLLLLLVRQYTFNWESTLLSNAASVRAVEMLAWLPSKLGFPVPDARA
                      130        140        150        160        170        180

190        200        210        220        230        240
    m253.pep   VIEGRLNGNIADARAWSGLLVGSIACYGILPRLLAWVVCKILLKTSENGLDLEKPYYQAV
               |||||||||||||||||||||||||:|||||||||||||||||||||||||||| ||||
    g253       VIEGRLNGNIADARAWSGLLVGSIVCYGILPRLLAWVVCKILLKTSENGLDLEKTYYQAV
                      190        200        210        220        230        240

250        260        270        280        290        300
    m253.pep   IRRWQNKITDADTRRETVSAVSPKIILNDAPKWAVMLETEWQDGEWFEGRLAQEWLDKGV
               |||||||||||||||||||||||||:|||||||:|||||||:|||||||||||||||||
    g253       IRRWQNKITDADTRRETVSAVSPKIVLNDAPKWALMLETEWQDGQWFEGRLAQEWLDKGV
                      250        260        270        280        290        300

310        320        330        340        350        360
    m253.pep   ATNREQVAALETELKQKPAQLLIGVRAQTVPDRGVLRQIVRLSEAAQGGAVVQLLAEQGL
               |:||||||||||||||||||||||||||||||||||||||||||||||||||||||||||
    g253       AANREQVAALETELKQKPAQLLIGVRAQTVPDRGVLRQIVRLSEAAQGGAVVQLLAEQGL
                      310        320        330        340        350        360

370        380        390
    m253.pep   SDDLSEKLEHWRNALAECGAAWLEPDRAAQEGRLKDQX
               ||||||||||||||||:|||||||||:||||||||||
    g253       SDDLSEKLEHWRNALTECGAAWLEPDRVAQEGRLKDQX
                      370        380        390
```

The following partial DNA sequence was identified in *N. meningitidis* <SEQ ID 991>:

```
a253.seq
    1 ATGATCGACA GGAACCGTAT GCTGCGGGAG ACGTTGGAAC GTGTGCGTGC

51 GGGGTCGTTC TGGTTGTGGG TGGCGGCGGC GACGTTTGCG TTTTTTACCG

101 GTTTTTCAGT TACTTATCTT CTAATGGACA ATCAGGGTCT GAATTTCTTT

151 TTGGTTTTGG CGGGCGTGTT GGGCATGAAT ACGCTGATGC TGGCAGTATG

201 GTTGGCAATG TTGTTCCTGC GCGTGAAAGT GGGGCGTTTT TTCAGCAGTC

251 CGGCGACGTG GTTTCGGGGC AAAGACCCTG TCAATCAGGC GGTGTTGCGG

301 CTGTATGCGG ACGAGTGGCG GCAACCTTCG GTACGTTGGA AAATAGGCGC

351 AACGTCGCAC AGCCTGTGGC TCTGCACGCT GCTCGGAATG CTGGTGTCGG

401 TATTGTTGCT GCTTTTGGTG CGGCAATATA CGTTCAACTG GGAAAGCACG
```

-continued

```
 451 CTGTTGGGCG ATTCGTCTTC GGTACGGCTG GTGGAAATGT TGGCATGGCT
 501 GCCTGCGAAA CTGGGTTTTC CCGTGCCTGA TGCGCGGGCG GTCATCGAAG
 551 GTCGTCTGAA CGGCAATATT GCCGATGCGC GGGCTTGGTC GGGGCTGCTG
 601 GTCGGCAGTA TCGCCTGCTA CGGCATCCTG CCGCGCCTCT TGGCTTGGGC
 651 GGTATGCAAA ATCCTTTTGA AAACAAGCGA AAACGGCTTG GATTTGGAAA
 701 AGCCCTATTA TCAGGCGGTC ATCCGCCGCT GGCAGAACAA AATCACCGAT
 751 GCGGATACGC GTCGGGAAAC CGTGTCCGCC GTTTCGCCGA AAATCGTCTT
 801 GAACGATGCG CCGAAATGGG CGGTCATGCT GGAGACCGAA TGGCAGGACG
 851 GCGAATGGTT CGAGGGCAGG CTGGCGCAGG AATGGCTGGA TAAGGGCGTT
 901 GCCGCCAATC GGGAACAGGT TGCCGCGCTG GAGACAGAGC TGAAGCAGAA
 951 ACCGGCGCAA CTGCTTATCG GCGTGCGCGC CCAAACTGTG CCCGACCGCG
1001 GCGTGTTGCG GCAGATCGTC CGACTTTCGG AAGCGGCGCA GGGCGGCGCG
1051 GTGGTGCAGC TTTTGGCGGA ACAGGGGCTT TCAGACGACC TTTCGGAAAA
1101 GCTGGAACAT TGGCGTAACG CGCTGACCGA ATGCGGCGCG GCGTGGCTGG
1151 AACCCGACAG AGCGGCGCAG GAAGGCCGTC TGAAAACCAA CGACCGCACT
1201 TGA
```

This corresponds to the amino acid sequence <SEQ ID 992; ORF 253.a>:

```
a253.pep
  1 MIDRNRMLRE TLERVRAGSF WLWVAAATFA FFTGFSVTYL LMDNQGLNFF

51 LVLAGVLGMN TLMLAVWLAM LFLRVKVGRF FSSPATWFRG KDPVNQAVLR

101 LYADEWRQPS VRWKIGATSH SLWLCTLLGM LVSVLLLLLV RQYTFNWEST

151 LLGDSSSVRL VEMLAWLPAK LGFPVPDARA VIEGRLNGNI ADARAWSGLL

201 VGSIACYGIL PRLLAWAVCK ILLKTSENGL DLEKPYYQAV IRRWQNKITD

251 ADTRRETVSA VSPKIVLNDA PKWAVMLETE WQDGEWFEGR LAQEWLDKGV

301 AANREQVAAL ETELKQKPAQ LLIGVRAQTV PDRGVLRQIV RLSEAAQGGA

351 VVQLLAEQGL SDDLSEKLEH WRNALTECGA AWLEPDRAAQ EGRLKTNDRT

401 *
``` m253/a253 97.2% identity in 395 aa overlap

```
                10         20         30         40         50         60
m253.pep    MIDRNRMLRETLERVRAGSFWLWVVAATFAFFTGFSVTYLLMDNQGLNFFLVLAGVLGMN
            ||||||||||||||||||||||||:|||||||||||||||||||||||||||||||||||
a253        MIDRNRMLRETLERVRAGSFWLWVAAATFAFFTGFSVTYLLMDNQGLNFFLVLAGVLGMN
                10         20         30         40         50         60

70         80         90        100        110        120
m253.pep    TLMLAVWLAMLFLRVKVGRFFSSPATWFRGKDPVNQAVLRLYADEWRQPSVRWKIGATSH
            ||||||||||||||||||||||||||||||||||||||||||||||||||||||||||||
a253        TLMLAVWLAMLFLRVKVGRFFSSPATWFRGKDPVNQAVLRLYADEWRQPSVRWKIGATSH
                70         80         90        100        110        120

130        140        150        160        170        180
m253.pep    SLWLCTLLGMLVSVLLLLLVRQYTFNWESTLLSNAASVRAVEMLAWLPSKLGFPVPDARA
            |||||||||||||||||||||||||||||||::::|||  |||||||||:||||||||||
a253        SLWLCTLLGMLVSVLLLLLVRQYTFNWESTLLGDSSSVRLVEMLAWLPAKLGFPVPDARA
               130        140        150        160        170        180
```

```
                  190        200        210        220        230        240
m253.pep  VIEGRLNGNIADARAWSGLLVGSIACYGILPRLLAWVVCKILLKTSENGLDLEKPYYQAV
          ||||||||||||||||||||||||||||||||||||:|||||||||||||||||||||||
a253      VIEGRLNGNIADARAWSGLLVGSIACYGILPRLLAWAVCKILLKTSENGLDLEKPYYQAV
                  190        200        210        220        230        240

250        260        270        280        290        300
m253.pep  IRRWQNKITDADTRRETVSAVSPKIILNDAPKWAVMLETEWQDGEWFEGRLAQEWLDKGV
          ||||||||||||||||||||||||:|||||||||||||||||||||||||||||||||||
a253      IRRWQNKITDADTRRETVSAVSPKIVLNDAPKWAVMLETEWQDGEWFEGRLAQEWLDKGV
                  250        260        270        280        290        300

310        320        330        340        350        360
m253.pep  ATNREQVAALETELKQKPAQLLIGVRAQTVPDRGVLRQIVRLSEAAQGGAVVQLLAEQGL
          |:||||||||||||||||||||||||||||||||||||||||||||||||||||||||||
a253      AANREQVAALETELKQKPAQLLIGVRAQTVPDRGVLRQIVRLSEAAQGGAVVQLLAEQGL
                  310        320        330        340        350        360

370        380        390
m253.pep  SDDLSEKLEHWRNALAECGAAWLEPDRAAQEGRLKDQX
          |||||||||||||:|||||||||||||||||||||||
a253      SDDLSEKLEHWRNALTECGAAWLEPDRAAQEGRLKTNDRTX
                  370        380        390        400
```

The following partial DNA sequence was identified in *N. gonorrhoeae* <SEQ ID 993>:

```
g254.seq
  1 atgtatgcag gcgaacgctt caatacttac agccatttga gcggtttgat 51 tctggcggcg gcaggtttga tgctgatgct gctgaaaacc ataggacacg 101 gggacggata ccgtatcttc agcgtatcgg tttacggcat cagccttctt 151 ctgctctatt tgagttcctc gctgtaccac ggaattgcag ccggaaaact 201 gaaaagcatt ttgaaaaaaa ccgaccactg catgatttat gtgctgattg 251 ccggaagcta cacccgtttt gcactggttt ctttgagaaa cgggccgggc 301 tggacggtat tttcactgtc ctggctgctg gcggctgcag gaatcgcaca 351 agaactcacc atcggacgga aaagcgaaaa acgtctgctg tctattgcga 401 tttatatcgt aatgggctgg atggtcttgg cggtaatgaa atccctgaca 451 gcctcactcc cgccggcagg actggcttgg ctggcggcag gcggtatgct 501 gtacagcgtc ggcatttact ggtttgtaaa cgatgaaaaa atccgacacg 551 ggcacggaat ctggcatctg ttcgtattgg gcggcagcat aacccaattt 601 gtcagcgtgt acggttatgt aatctga
```

This corresponds to the amino acid sequence <SEQ ID 994; ORF 254.ng>:

```
g254.pep
  1 MYAGERFNTY SHLSGLILAA AGLMLMLLKT IGHGDGYRIF SVSVYGISLL

51 LLYLSSSLYH GIAAGKLKSI LKKTDHCMIY VLIAGSYTPF ALVSLRNGPG

101 WTVFSLSWLL AAAGIAQELT IGRKSEKRLL SIAIYIVMGW MVLAVMKSLT

151 ASLPPAGLAW LAAGGMLYSV GIYWFVNDEK IRHGHGIWHL FVLGGSITQF

201 VSVYGYVI*
```

The following partial DNA sequence was identified in *N. meningitidis* <SEQ ID 995>:

```
m254.seq (partial)
  1 ..GTATCGGTTT ACGGCATCAG CCTTCTTCTG CTCTATTTGA GTTCCTGGCT

51   GTACCACGGA ATTGCAGCCG GAAAACTGAA AAGCATTTTG AAAAAACCG
```

```
101   ACCACTGCAT GATTTATGTG CTGATTGCCG GAAGCTACAC ACCGTTTGCA

151   CTGGTTTCTT TGAGAAACGG GCCGGGCTGG ACGGTATTTT CACTGTCCTG

201   GCTGCTGGCG GCTGCAGGAA TCGCACAAGA ACTCACCATC GGACGGAAAA

251   GCGAAAAACG TCTGCTGTCT ATTGTGATTT ATGTCGTCAT GGGTTGGATG

301   GTCTTGGCGG TAATGAAATC CCTGACAGCC TCACTCCCGT CGGCAGGACT

351   GGCTTGGCTG GCGGCAGGCG GTATGCTGTA CAGTGTCGGC ATTTACTGGT

401   TTGTAAACGA TGAAAAAATC CGACACGGGC ACGGAATCTG GCATCTGTTC

451   GTATTGGGCG GCAGCATCAC CCAATTTGTC AGCGTGTACG GTTACGTAAT

501   CTGA
```

This corresponds to the amino acid sequence <SEQ ID 996; ORF 254>:

```
m254.pep (partial)
  1  ..VSVYGISLLL LYLSSWLYHG IAAGKLKSIL KKTDHCMIYV LIAGSYTPFA

51   LVSLRNGPGW TVFSLSWLLA AAGIAQELTI GRKSEKRLLS IVIYVVMGWM

101   VLAVMKSLTA SLPSAGLAWL AAGGMLYSVG IYWFVNDEKI RHGHGIWHLF

151   VLGGSITQFV SVYGYVI*
```

Computer analysis of this amino acid sequence gave the following results:
Homology with a Predicted ORF from *N. gonorrhoeae*
ORF 254 shows 97.6% identity over a 167 aa overlap with a predicted ORF (ORF 254.ng) from *N. gonorrhoeae*:

```
m254/g254

10         20         30
    m254.pep                        VSVYGISLLLLYLSSWLYHGIAAGKLKSIL
                                    |||||||||||||| |||||||||||||||
    g254    HLSGLILAAAGLMLMLLKTIGHGDGYRIFSVSVYGISLLLLYLSSSLYHGIAAGKLKSIL
                      20        30        40        50        60        70

40        50        60        70        80        90
    m254.pep  KKTDHCMIYVLIAGSYTPFALVSLRNGPGWTVFSLSWLLAAAGIAQELTIGRKSEKRLLS
              ||||||||||||||||||||||||||||||||||||||||||||||||||||||||||||
    g254      KKTDHCMIYVLIAGSYTPFALVSLRNGPGWTVFSLSWLLAAAGIAQELTIGRKSEKRLLS
                      80        90       100       110       120       130

100       110       120       130       140       150
    m254.pep  IVIYVVMGWMVLAVMKSLTASLPSAGLAWLAAGGMLYSVGIYWFVNDEKIRHGHGIWHLF
              |:||:|||||||||||||||||||||||||||||||||||||||||||||||||||||||
    g254      IAIYIVMGWMVLAVMKSLTASLPPAGLAWLAAGGMLYSVGIYWFVNDEKIRHGHGIWHLF
                     140       150       160       170       180       190

160
    m254.pep  VLGGSITQFVSVYGYVIX
              ||||||||||||||||||
    g254      VLGGSITQFVSVYGYVIX
                     200
```

The following partial DNA sequence was identified in *N. meningitidis* <SEQ ID 997>:

```
a254.seq
  1   ATGTATACAG GCGAACGCTT CAATACTTAC AGCCATTTGA GCGGTTTGAT

51   TCTGGCGGCG GCAGGTTTGG CGCTGATGCT GCTGAAAACC ATAGGACACG

101   GGGACGGCTA CCGTATCTTC AGCGTATCGG TTTACGGCAT CAGCCTTCTT

151   CTGCTCTATT TGAGTTCCTC GCTGTACCAC GGAATTGCAG CCGGAAAACT

201   GAAAAGCATT TTGAAAAAAA CCGACCACTG CATGATTTAT GTGCTGATTG
```

-continued

```
251 CCGGAAGCTA CACACCGTTT GCACTGGTTT CTTTGAGAAA CGGGCCGGGC

301 TGGACGGTAT TTTCACTGTC CTGGCTGCTG GCGGCTGCAG GAATCGCACA

351 AGAACTCACC ATTGGACGGA AAAGCGAAAA ACGACTGCTG TCTATTGCGA

401 TTTATATCGT AATGGGCTGG ATGGTCTTGG CGGTAATGAA ATCCCTGACA

451 GCCTCACTCC CGCCGGCAGG ACTGGCTTGG CTGGCGGCAG GCGGTATGCT

501 GTACAGCGTC GGCATTTACT GGTTTGTAAA CGATGAAAAA ATCCGACACG

551 GGCACGGAAT CTGGCATCTG TTCGTATTGG GCGGCAGCAT CACCCAATTT

601 GTCAGCGTGT ACGGTTACGT AATCTGA
```

This corresponds to the amino acid sequence <SEQ ID 998; ORF 254.a>:

```
a254.pep
  1 MYTGERFNTY SHLSGLILAA AGLALMLLKT IGHGDGYRIF SVSVYGISLL

51 LLYLSSSLYH GIAAGKLKSI LKKTDHCMIY VLIAGSYTPF ALVSLRNGPG

101 WTVFSLSWLL AAAGIAQELT IGRKSEKRLL SIAIYIVMGW MVLAVMKSLT

151 ASLPPAGLAW LAAGGMLYSV GIYWFVNDEK IRHGHGIWHL FVLGGSITQF

201 VSVYGYVI*
``` m254/a254 97.6% identity in 167 aa overlap

```
                                          10         20         30
    m254.pep                       VSVYGISLLLLYLSSWLYHGIAAGKLKSIL
                                   ||||||||||||| ||||| ||||||||||
    a254       HLSGLILAAAGLALMLLKTIGHGDGYRIFSVSVYGISLLLLYLSSSLYHGIAAGKLKSIL
                  20        30        40        50        60        70

40         50         60         70         80         90
    m254.pep   KKTDHCMIYVLIAGSYTPFALVSLRNGPGWTVFSLSWLLAAAGIAQELTIGRKSEKRLLS
               |||| |||||||||||||||||||||||||||||||||||||||||||||||||||||||
    a254       KKTDHCMIYVLIAGSYTPFALVSLRNGPGWTVFSLSWLLAAAGIAQELTIGRKSEKRLLS
                  80        90        100       110       120       130

100        110        120        130        140        150
    m254.pep   IVIYVVMGWMVLAVMKSLTASLPSAGLAWLAAGGMLYSVGIYWFVNDEKIRHGHGIWHLF
               | || ||||||||||||||||| |||||||||||||||||||||||||||||||||||||
    a254       IAIYIVMGWMVLAVMKSLTASLPPAGLAWLAAGGMLYSVGIYWFVNDEKIRHGHGIWHLF
                  140       150       160       170       180       190

160
    m254.pep   VLGGSITQFVSVYGYVIX
               |||| |||||||||||||
    a254       VLGGSITQFVSVYGYVIX
                  200
```

The following partial DNA sequence was identified in *N. gonorrhoeae* <SEQ ID 999>:

```
g255.seq
  1 atggttggac aggaagcctt gcggggtcag ttcgtcgccg tgttcgctgc 51 cgcgttgcgt tacgctgtca aaacctgcgc cgatttccac gcctttgacg 101 gcgttgatgc ccatcatcgc gtaggcgatt tcggcatcga ggcggtcgaa 151 aacgggttcg cccaaaccga cggggacgtt ggcggcttcg atatgcagtt 201 tcgcgccgac ggaatccaag gatttgcgca caccgtccat atagtgttcc 251 agttcggcga tttggctttg gttggcggca aaaaaggat tttgggaaat
```

-continued

```
301 gtgttcgctg ccttcaaacc ggattttttt ttcgccgact tgggtaacgt 351 aggcggtgat ttccgtgccg aattttcctt tcagccattt tttggcaacg 401 gctccggcgg caacgcgggc tgcggtttcg cgggcggaac tcctgccgcc 451 gccccggtag tcgcgcgtac cgtatttgtg ccaataggta tagtcggcgt 501 gtccggggcg gaaggcggtg gcgatgtcgc cgtagtcttc gctgcgctgg 551 tcggtgttgc ggattag
```

This corresponds to the amino acid sequence <SEQ ID 1000; ORF 255.ng>:

```
g255.pep
  1 MVGQEALRGQ FVAVFAAALR YAVKTCADFH AFDGVDAHHR VGDFGIEAVE

51 NGFAQTDGDV GGFDMQFRAD GIQGFAHTVH IVFQFGDLAL VGGKKRILGN

101 VFAAFKPDFF FADLGNVGGD FRAEFFFQPF FGNGSGGNAG CGFAGGTPAA

151 APVVARTVFV PIGIVGVSGA EGGGDVAVVF AALVGVAD*
```

The following partial DNA sequence was identified in *N. meningitidis* <SEQ ID 1001>:

```
m255.seq
  1 GTGGTTGGAC AGGAAGCCTT GCGGGGTCAG TTCGTCGCCG TGTTCGCTGC

51 CGCGTTGCGT TACGCTGTCA AAACCTGCGC CGATTTCCAC GCCTTTGACG

101 GCGTTGATGC CCATCATCGC GTAGGCGATT TCGGCATCGA GGCGGTCAAA

151 AACAGGTTCG CCCAAGCCGA CAGGGACATT GGCTGCTTCG ATATGCAGCT

201 TCGCGCCGAC GGAATCCAAG GATTTGCGCA CGCTGTCCAT ATAGTTTTCC

251 AGCTCGGCAA TTTGGCTATG GTTGGCGGCA AAAAAGGAT TTTGGGAAAT

301 GTGTTCGCAG CCTTCAAACC GGATTTCTTT TTCGCCGACT TGGGTAACGT

351 AGGCGGTGAT TTCCGTGCCG AATTTTTCTT TCAACCATTT TTTGGCAACG

401 GCTCCGGCAG CAACGCGGGC GGCGGTTTCA CGGGCGGAGC TCCTGCCGCC

451 GCCGCGGTAG TCGCGCGTGC CGTATTTGTG CCAATAGGTA TAGTCGGCGT

501 GGCCGGGGCG GAAGCTGGTG GCGATGTTGC CGTAGTCTTT GCTGCGCTGG

551 TCGGTATTGC GGATTAA
```

This corresponds to the amino acid sequence <SEQ ID 1002; ORF 255>:

```
m255.pep
  1 VVGQEALRGQ FVAVFAAALR YAVKTCADFH AFDGVDAHHR VGDFGIEAVK

51 NRFAQADRDI GCFDMQLRAD GIQGFAHAVH IVFQLGNLAM VGGKKRILGN

101 VFAAFKPDFF FADLGNVGGD FRAEFFFQPF FGNGSGSNAG GGFTGGAPAA

151 AAVVARAVFV PIGIVGVAGA EAGGDVAVVF AALVGIAD*
```

Computer analysis of this amino acid sequence gave the following results:

Homology with a Predicted ORF from *N. gonorrhoeae*

ORF 255 shows 88.8% identity over a 188 aa overlap with a predicted ORF (ORF 255.ng) from *N. gonorrhoeae*:

```
    m255/g255

10         20         30         40         50         60
        m255.pep   VVGQEALRGQFVAVFAAALRYAVKTCADFHAFDGVDAHHRVGDFGIEAVKNRFAQADRDI
                   :||||||||||||||||||||||||||||||||||||||||||||||:| |||:| |:
        g255       MVGQEALRGQFVAVFAAALRYAVKTCADFHAFDGVDAHHRVGDFGIEAVENGFAQTDGDV
                       10         20         30         40         50         60

70         80         90        100        110        120
        m255.pep   GCFDMQLRADGIQGFAHAVHIVFQLGNLAMVGGKKRILGNVFAAFKPDFFFADLGNVGGD
                   | |||:||||||||||||:||||||:|:||:||||||||||||||||||||||||||||
        g255       GGFDMQFRADGIQGFAHTVHIVFQFGDLALVGGKKRILGNVFAAFKPDFFFADLGNVGGD
                       70         80         90        100        110        120

130        140        150        160        170        180
        m255.pep   FRAEFFFQPFFGNGSGSNAGGGFTGGAPAAAAVVARAVFVPIGIVGVAGAEAGGDVAVVF
                   |||||||||||||||:||| ||:||:|||| ||||:|||||||||||:|||:||||||||
        g255       FRAEFFFQPFFGNGSGGNAGCGFAGGTPAAAPVVARTVFVPIGIVGVSGAEGGGDVAVVF
                      130        140        150        160        170        180

189
        m255.pep   AALVGIADX
                   |||||:|||
        g255       AALVGVADX
```

The following partial DNA sequence was identified in *N. meningitidis* <SEQ ID 1003>:

```
    a255.seq
      1 GTGGTTGGAC AGGAAGCCTT GCGGGGTGAG TTCGTCGCCG TGTTCGCTGC

51 CGCGTTGCGT TACGCTGTCA AAACCTGCGC CGATTTCCAC GCCTTTGACG

101 GCGTTGATGC CCATCATGGC GTAGGCGATT TCGGCATCGA GGCGGTCGAA

151 TACGGGTTCG CCCAAGCCGA CGGGGACGTT GGCGGCTTCA ATATGCAGCT

201 TCGCGCCGAC GGAATCCAAG GATTTGCGCA CGCTGTCCAT ATAGTTTTCC

251 AGCTCGGCAA TTTGGCTATG GTTGGCGGCA AAAAAGGAT TTTGGGAAAT

301 GTGTTCGCAG CCTTCAAACC GGATTTCTTT TTCGCCGACT TGGGTAACGT

351 AGGCGGTGAT TTCCGTGCCG AATTTTTCTT TCAACCATTT TTTGGCAACG

401 GCTCCGGCGG CAACGCGGGC GGCGGTTTCG CGGGCGGAAC TCCTGCCGCC

451 GCCCCGGTAG TCGCGCGTGC CGTATTTGTG CCAATAGGTA TAGTCGGCGT

501 GGCCGGGGCG GAAGCTGGTG GCGATGTTGC CGTAGTCTTT GCTGCGCTGG

551 TCGGTATTGC GGATTAA
```

This corresponds to the amino acid sequence <SEQ ID 1004; ORF 255.a>:

```
    a255.pep

1 VVGQEALRGE FVAVFAAALR YAVKTCADFH AFDGVDAHHG VGDFGIEAVE

51 YGFAQADGDV GGFNMQLRAD GIQGFAHAVH IVFQLGNLAM VGGKKRILGN

101 VFAAFKPDFF FADLGNVGGD FRAEFFFQPF FGNGSGGNAG GGFAGGTPAA

151 APVVARAVFV PIGIVGVAGA EAGGDVAVVF AALVGIAD*
``` m255/a255 93.1% identity in 188 aa overlap

```
                  10        20        30        40        50        60
    m255.pep  VVGQEALRGQFVAVFAAALRYAVKTCADFHAFDGVDAHHRVGDFGIEAVKNRFAQADRDI
              ||||||||||:|||||||||||||||||||||||||||| ||||||||:  ||||| |:
    a255      VVGQEALRGEFVAVFAAALRYAVKTCADFHAFDGVDAHHGVGDFGIEAVEYGFAQADGDV
                  10        20        30        40        50        60

70        80        90       100       110       120
    m255.pep  GCFDMQLRADGIQGFAHAVHIVFQLGNLAMVGGKKRILGNVFAAFKPDFFFADLGNVGGD
              | |:||||||||||||||||||||||||||||||||||||||||||||||||||||||||
    a255      GGFNMQLRADGIQGFAHAVHIVFQLGNLAMVGGKKRILGNVFAAFKPDFFFADLGNVGGD
                  70        80        90       100       110       120

130       140       150       160       170       180
    m255.pep  FRAEFFFQPFFGNGSGSNAGGGFTGGAPAAAAVVARAVFVPIGIVGVAGAEAGGDVAVVF
              ||||||||||||||||:||||| ::||||  ||||||||||||||||||||||||||||
    a255      FRAEFFFQPFFGNGSGGNAGGGFAGGTPAAAPVVARAVFVPIGIVGVAGAEAGGDVAVVF
                 130       140       150       160       170       180

189
    m255.pep  AALVGIADX
              |||||||||
    a255      AALVGIADX
```

The following partial DNA sequence was identified in *N. gonorrhoeae* <SEQ ID 1005>:

```
g256.seq
   1 atgctcgcgg tacgcaatcg gggttggcac ggcgcagtcg tccatttccg 51 cagctgcggc ggcgtagcga acaccgcccc ggtgttctac cacttgggtg 101 ataccgccga aatcgccttt gctttggaca cgctcaccgc gcgttaccgt 151 gaaatatacg ccgtcggcgt atcgctgggc ggcaacgcgc cggcaaaata 201 tttgggcgaa cagggcaaaa aggcattgcc gcacgcctcg gccgccgtat 251 ccgcccccgt tgatgcagag gcggcaggca gccgcttcga cagcggcatc 301 acgcggctgc tctacacgcg ctacttcctc cgcacactga tacccaaagc 351 acgttcgctc caaggttttc agacggcatt gccgcagggt gcaaaacac 401 tgggcgagtt tgacgaccgt ttcaccgcac cgctgcacgg ctttgccgac 451 cggcacgact actaccgcca aacttcctgc aaaccgctgc tcaaacacgt 501 tgccaaaccg ctgctcctgc tcaatgccgc caacgacccc ttcctgccgc 551 ccgaagccct gccccgtgca gacgaagcgt ccgaagccgt taccctgttc 601 caacctgcac acgcgggca cgccggcttt gtcagcagca ccggcggcag 651 gctgcacctg caatggctgc cgcagaccgt cctgtcctat tttgacagct 701 tccgcacaaa caggcgttaa
```

This corresponds to the amino acid sequence <SEQ ID 1006; ORF 256.ng>:

```
g256.pep
   1 MLAVRNRGWH GAVVHFRSCG GVANTAPVFY HLGDTAEIAF ALDTLTARYR

51 EIYAVGVSLG GNAPAKYLGE QGKKALPHAS AAVSAPVDAE AAGSRFDSGI

101 TRLLYTRYFL RTLIPKARSL QGFQTAFAAG CKTLGEFDDR FTAPLHGFAD

151 RHDYYRQTSC KPLLKHVAKP LLLLNAANDP FLPPEALPRA DEASEAVTLF

201 QPAHGGHAGF VSSTGGRLHL QWLPQTVLSY FDSFRTNRR*
```

The following partial DNA sequence was identified in *N. meningitidis* <SEQ ID 1007>:

```
m256.seq
   1 ATGCTTGCGG TACGCGATCG GGGTTGGCAC GGCGTAGTCG TCCATTTCCG

51 CAGCTGCGGC GGCATTGCCA ACACCGCTCC GGTGTTCTAC CA.CTtGGCG

101 ATACCGCCGA AATCGCCTTT ACTTTGGACA CGTTCGCCGC GCGTTACCGT

151 GAAAtATACG CCGTCGGCGT ATCGCTGGGC GGCAACGCGC TGGCAAAATA

201 TTTGGGCGAA CAGGGCAAAA AGGCATTGCC GCAAGCCGCT GCCGTCATCT

251 CCGCCCCCGT CGATGCAGAG GCGGCAGGCA GACGCTTCGA CAGCGGCATC

301 ACGCGGCTGC TCTACACGCG CTACTTCCTC CGCACCCTGA TACCCAAAGC

351 AAAATCGCTC CAAGGTTTTC AGACGGCATT TGCCGCAGGG TGCAAAACAC

401 TGGGCGAGTT TGACGACCGC TTCACCGCAC CGCTGCACGG CTTTGCCGAC

451 CGGCACGACT ACTACCGCCA AACTTCCTGC AAACCGCTGC TCAAACACGT

501 TGCCAAACCG CTGCTCCTGC TCAATGCCGT CAACGACCCC TTCCTGCCGC

551 CCGAAGCCGT GCCCCGCGCA GACGAAGTAT CCGAAGCCGT TACCCTGTTC

601 CAGCCGGCAT ATGGTGGTCA TGTCGGCTTT GTCAGCAGCA CCGGCGGCAG

651 GCTGCACCTG CAATGGCTGC CGCAGACCGT CCTGTCCTAT TTCGACAGCT

701 TCCGCACAAA CAGGCGTTAA
```

This corresponds to the amino acid sequence <SEQ ID 1008; ORF 256>:

```
m256.pep
   1 MLAVRDRGWH GVVVHFRSCG GIANTAPVFY XLGDTAEIAF TLDTFAARYR

51 EIYAVGVSLG GNALAKYLGE QGKKALPQAA AVISAPVDAE AAGRRFDSGI

101 TRLLYTRYFL RTLIPKAKSL QGFQTAFAAG CKTLGEFDDR FTAPLHGFAD

151 RHDYYRQTSC KPLLKHVAKP LLLLNAVNDP FLPPEALPRA DEVSEAVTLF

201 QPAYGGHVGF VSSTGGRLHL QWLPQTVLSY FDSFRTNRR*
```

Computer analysis of this amino acid sequence gave the following results:

Homology with a Predicted ORF from *N. gonorrhoeae*

ORF 256 shows 92.9% identity over a 239 aa overlap with a predicted ORF (ORF 256.ng) from *N. gonorrhoeae*:

```
m256/g256

10        20        30        40        50        60
m256.pep    MLAVRDRGWHGVVVHFRSCGGIANTAPVFYHLGDTAEIAFTLDTFAARYREIYAVGVSLG
            |||||:|||||:|||||||||:||||||||||||||||||:|||::||||||||||||||
g256        MLAVRNRGWHGAVVHFRSCGGVANTAPVFYHLGDTAEIAFALDTLTARYREIYAVGVSLG
                    10        20        30        40        50        60

70        80        90       100       110       120
m256.pep    GNALAKYLGEQGKKALPQAAAVISAPVDAEAAGRRFDSGITRLLYTRYFLRTLIPKAKSL
            ||| |||||||||||||:|:|::|||||||||| |||||||||||||||||||||||:||
g256        GNAPAKYLGEQGKKALPHASAAVSAPVDAEAAGSRFDSGITRLLYTRYFLRTLIPKARSL
                    70        80        90       100       110       120

130       140       150       160       170       180
m256.pep    QGFQTAFAAGCKTLGEFDDRFTAPLHGFADRHDYYRQTSCKPLLKHVAKPLLLLNAVNDP
            ||||||||||||||||||||||||||||||||||||||||||||||||||||||||:|||
g256        QGFQTAFAAGCKTLGEFDDRFTAPLHGFADRHDYYRQTSCKPLLKHVAKPLLLLNAANDP
                   130       140       150       160       170       180

190       200       210       220       230       240
m256.pep    FLPPEALPRADEVSEAVTLFQPAYGGHVGFVSSTGGRLHLQWLPQTVLSYFDSFRTNRRX
            ||||||||||||:||||||||||:|||:||||||||||||||||||||||||||||||||
g256        FLPPEALPRADEASEAVTLFQPAHGGHAGFVSSTGGRLHLQWLPQTVLSYFDSFRTNRRX
                   190       200       210       220       230
```

The following partial DNA sequence was identified in *N. meningitidis* <SEQ ID 1009>:

```
a256.seq
   1 ATGCTCGCGG TACGCGATCG GGGTTGGAAC GGCGTAGTCG TCCATTTCCG

51 CAGCTGCGGC GGCGTAGCGA ACACCGCCCC GGTGTTCTAC CACTTGGGCG

101 ATACCGCCGA AATTGCCTTT ACTTTGGACA CGCTCGCCGC GCGTTACCGT

151 GAAATATACG CCGTCGGCGT ATCGCTGGGC GGCAACGCGC TGGCAAAATA

201 TTTGGGCGAA CAGGGCGAAA ACGCGCTGCC GCAAGCCGCC GCCGTCATCT

251 CCGAAGCCGT CGATGCAGAG GCGGCAGGCA ACCGCTTCGA CAGCGGCATC

301 ACACGGCTGC TCTACACGCG CTACTTCCTC CGCACACTGA TACCCAAAGC

351 ACGGTCGCTC CAAGGTTTTC AGACGGCATT TGCCGCAGGG TGCAAAACAC

401 TGGGCGAGTT TGACGACCGT TTCACCGCAC CGCTGCACGG CTTTGCCGAT

451 CGGCACGACT ACTACCGCCA AACTTCCTGC AAACCGCTGC TCAAACACGT

501 TGCCAAACCG CTGCTCCTGC TCAATGCCGT CAACGACCCC TTCCTGCCGC

551 CCGAAGCGCT GCCCCGCGCA GACGAAGTGT CCGAAGCCGT TACCCTGTTC

601 CAGCCGACAC ACGGTGGTCA TGTCGGCTTT GTCGGCAGCA CCGGCGGCAG

651 GCTGCACCTG CAATGGTTGC CGCAGACCGT CCTGTCCTAT TTCGACAGCT

701 TCCGCACAAA CAGGCGTTAA
```

This corresponds to the amino acid sequence <SEQ ID 1010; ORF 256.a>:

```
a256.pep
   1 MLAVRDRGWN GVVVHFRSCG GVANTAPVFY HLGDTAEIAF TLDTLAARYR

51 EIYAVGVSLG GNALAKYLGE QGENALPQAA AVISAPVDAE AAGNRFDSGI

101 TRLLYTRYFL RTLIPKARSL QGFQTAFAAG CKTLGEFDDR FTAPLHGFAD

151 RHDYYRQTSC KPLLKHVAKP LLLLNAVNDP FLPPEALPRA DEVSEAVTLF

201 QPTHGGHVGF VGSTGGRLHL QWLPQTVLSY FDSFRTNRR*
``` m256/a256 95.4% identity in 239 aa overlap

```
                         10        20        30        40        50        60
m256.pep         MLAVRDRGWHGVVVHFRSCGGIANTAPVFYXLGDTAEIAFTLDTFAARYREIYAVGVSLG
                 |||||||||:|||||||||||:|||||||| |||||||||||||:|||||||||||||||
a256             MLAVRDRGWNGVVVHFRSCGGVANTAPVFYHLGDTAEIAFTLDTLAARYREIYAVGVSLG
                         10        20        30        40        50        60

70        80        90       100       110       120
m256.pep         GNALAKYLGEQGKKALPQAAAVISAPVDAEAAGRRFDSGITRLLYTRYFLRTLIPKAKSL
                 ||||||||||||::||||||||||||||||||| |||||||||||||||||||||||:||
a256             GNALAKYLGEQGENALPQAAAVISAPVDAEAAGNRFDSGITRLLYTRYFLRTLIPKARSL
                         70        80        90       100       110       120

130       140       150       160       170       180
m256.pep         QGFQTAFAAGCKTLGEFDDRFTAPLHGFADRHDYYRQTSCKPLLKHVAKPLLLLNAVNDP
                 ||||||||||||||||||||||||||||||||||||||||||||||||||||||||||||
a256             QGFQTAFAAGCKTLGEFDDRFTAPLHGFADRHDYYRQTSCKPLLKHVAKPLLLLNAVNDP
                        130       140       150       160       170       180

190       200       210       220       230       240
m256.pep         FLPPEALPRADEVSEAVTLFQPAYGGHVGFVSSTGGRLHLQWLPQTVLSYFDSFRTNRRX
                 ||||||||||||||||||||||::|||||||:||||||||||||||||||||||||||||
a256             FLPPEALPRADEVSEAVTLFQPTHGGHVGFVGSTGGRLHLQWLPQTVLSYFDSFRTNRRX
                        190       200       210       220       230       240
```

The following partial DNA sequence was identified in *N. gonorrhoeae* <SEQ ID 1011>:

```
g256-1.seq
   1 ATGATTTTGA CACCGCCGGA CACGCCCTTT TTCCTCCGCA ACGGCAATGC

51 CGACACGATT GCCGCCAAAT TCCTGCAACA CCCCGCACCC GCATACCGCC

101 GCGAGATGCT TCCCGACAGC ACGGGTAAAA CCAAAACCGC CTACGACTTT

151 TCAGCAGGCG GCATTTCGCC CGATGCGCCG CTGGTCGTGC TGTTTCACGG

201 TTTGGAAGGA AGCAGCCGCA GCCATTACGC GGTCGAACTG ATGCTCGCGG

251 TACGCAATCG GGGTTGGCAC GGCGCAGTCG TCCATTTCCG CAGCTGCGGC

301 GGCGTAGCGA ACACCGCCCC GGTGTTCTAC CACTTGGGTG ATACCGCCGA

351 AATCGCCTTT GCTTTGGACA CGCTCACCGC GCGTTACCGT GAAATATACG

401 CCGTCGGCGT ATCGCTGGGC GGCAACGCGC CGGCAAAATA TTTGGGCGAA

451 CAGGGCAAAA AGGCATTGCC GCACGCCTCG GCCGCCGTAT CCGCCCCCGT

501 TGATGCAGAG GCGGCAGGCA GCCGCTTCGA CAGCGGCATC ACGCGGCTGC

551 TCTACACGCG CTACTTCCTC CGCACACTGA TACCCAAAGC ACGTTCGCTC

601 CAAGGTTTTC AGACGGCATT TGCCGCAGGG TGCAAAACAC TGGGCGAGTT

651 TGACGACCGT TTCACCGCAC CGCTGCACGG CTTTGCCGAC CGGCACGACT

701 ACTACCGCCA AACTTCCTGC AAACCGCTGC TCAAACACGT TGCCAAACCG

751 CTGCTCCTGC TCAATGCCGC CAACGACCCC TTCCTGCCGC CCGAAGCCCT

801 GCCCCGTGCA GACGAAGCGT CCGAAGCCGT TACCCTGTTC CAACCTGCAC

851 ACGGCGGGCA CGCCGGCTTT GTCAGCAGCA CCGGCGGCAG GCTGCACCTG

901 CAATGGCTGC CGCAGACCGT CCTGTCCTAT TTTGACAGCT TCCGCACAAA

951 CAGGCGTTAA
```

This corresponds to the amino acid sequence <SEQ ID 1012; ORF 256-1.ng>:

```
g256-1.pep
   1 MILTPPDTPF FLRNGNADTI AAKFLQHPAP AYRREMLPDS TGKTKTAYDF

51 SAGGISPDAP LVVLFHGLEG SSRSHYAVEL MLAVRNRGWH GAVVHFRSCG

101 GVANTAPVFY HLGDTAEIAF ALDTLTARYR EIYAVGVSLG GNAPAKYLGE

151 QGKKALPHAS AAVSAPVDAE AAGSRFDSGI TRLLYTRYFL RTLIPKARSL

201 QGFQTAFAAG CKTLGEFDDR FTAPLHGFAD RHDYYRQTSC KPLLKHVAKP

251 LLLLNAANDP FLPPEALPRA DEASEAVTLF QPAHGGHAGF VSSTGGRLHL

301 QWLPQTVLSY FDSFRTNRR*
```

The following partial DNA sequence was identified in *N. meningitidis* <SEQ ID 1013>:

```
m256-1.seq
   1 ATGATTTTAA CACCGCCGGA CACGCCCTTT TTCCTCCGCA ACGGCAATGC

51 CGACACGATT GCCGCCAAAT TCCTGCAACG CCCCGCGCCC GCATACCGCC

101 GAGAGCTGCT TCCCGACAGC ACGGGTAAAA CCAAAGTCGC CTACGACTTT

151 TCAGACGGCA TTTCGCCCGA TGCGCCGCTG GTCGTGCTGT TCACGGTTT

201 GGAAGGAAGC AGCCGCAGCC ATTACGCGGT CGAACTGATG CTTGCGGTAC
```

```
-continued
251 GCGATCGGGG TTGGCACGGC GTAGTCGTCC ATTTCCGCAG CTGCGGCGGC

301 ATTGCCAACA CCGCTCCGGT GTTCTACCAC TTGGGCGATA CCGCCGAAAT

351 CGCCTTTACT TTGGACACGT TCGCCGCGCG TTACCGTGAA ATATACGCCG

401 TCGGCGTATC GCTGGGCGGC AACGCGCTGG CAAAATATTT GGGCGAACAG

451 GGCAAAAAGG CATTGCCGCA AGCCGCTGCC GTCATCTCCG CCCCCGTCGA

501 TGCAGAGGCG GCAGGCAGAC GCTTCGACAG CGGCATCACG CGGCTGCTCT

551 ACACGCGCTA CTTCCTCCGC ACCCTGATAC CCAAAGCAAA ATCGCTCCAA

601 GGTTTTCAGA CGGCATTTGC CGCAGGGTGC AAAACACTGG GCGAGTTTGA

651 CGACCGCTTC ACCGCACCGC TGCACGGCTT TGCCGACCGG CACGACTACT

701 ACCGCCAAAC TTCCTGCAAA CCGCTGCTCA AACACGTTGC CAAACCGCTG

751 CTCCTGCTCA ATGCCGTCAA CGACCCCTTC CTGCCGCCCG AAGCCCTGCC

801 CCGCGCAGAC GAAGTATCCG AAGCCGTTAC CCTGTTCCAG CCGGCATATG

851 GTGGTCATGT CGGCTTTGTC AGCAGCACCG GCGGCAGGCT GCACCTGCAA

901 TGGCTGCCGC AGACCGTCCT GTCCTATTTC GACAGCTTCC GCACAAACAG

951 GCGTTAA
```

This corresponds to the amino acid sequence <SEQ ID 1014; ORF 256-1>:

```
m256-1.pep

1 MILTPPDTPF FLRNGNADTI AAKFLQRPAP AYRRELLPDS TGKTKVAYDF

51 SDGISPDAPL VVLFHGLEGS SRSHYAVELM LAVRDRGWHG VVVHFRSCGG

101 IANTAPVFYH LGDTAEIAFT LDTFAARYRE IYAVGVSLGG NALAKYLGEQ

151 GKKALPQAAA VISAPVDAEA AGRRFDSGIT RLLYTRYFLR TLIPKAKSLQ

201 GFQTAFAAGC KTLGEFDDRF TAPLHGFADR HDYYRQTSCK PLLKHVAKPL

251 LLLNAVNDPF LPPEALPRAD EVSEAVTLFQ PAYGGHVGFV SSTGGRLHLQ

301 WLPQTVLSYF DSFRTNRR* m256-1/g256-1  93.1% identity in 319 aa overlap 10         20         30         40         50        59
m256-1.pep  MILTPPDTPFFLRNGNADTIAAKFLQRPAPAYRRELLPDSTGKTKVAYDFS-DGISPDAP
            ||||||||||||||||||||||||||||:|||||||||:|||||||| ||| |||||||
g256-1      MILTPPDTPFFLRNGNADTIAAKFLQHPAPAYRREMLPDSTGKTKTAYDFSAGGISPDAP
                   10         20         30         40         50        60

60         70         80         90        100        110        119
m256-1.pep  LVVLFHGLEGSSRSHYAVELMLAVRDRGWHGVVVHFRSCGGIANTAPVFYHLGDTAEIAF
            ||||||||||||||||||||||||||:|||||:|||||||||:|||||||||||||||||
g256-1      LVVLFHGLEGSSRSHYAVELMLAVRNRGWHGAVVHFRSCGGVANTAPVFYHLGDTAEIAF
                   70         80         90        100        110        120

120        130        140        150        160        170        179
m256-1.pep  TLDTFAARYREIYAVGVSLGGNALAKYLGEQGKKALPQAAAVISAPVDAEAAGRRFDSGI
            :|||::|||||||||||||||||:|||||||||||||:|::|||||||||||:|||||||
g256-1      ALDTLTARYREIYAVGVSLGGNAPAKYLGEQGKKALPHSAAVSAPVDAEAAGSRFDSGI
                  130        140        150        160        170        180

180        190        200        210        220        230        239
m256-1.pep  TRLLYTRYFLRTLIPKAKSLQGFQTAFAAGCKTLGEFDDRFTAPLHGFADRHDYYRQTSC
            |||||||||||||||||:|||||||||||||||||||||||||||||||||||||||||
g256-1      TRLLYTRYFLRTLIPKARSLQGFQTAFAAGCKTLGEFDDRFTAPLHGFADRHDYYRQTSC
                  190        200        210        220        230        240

240        250        260        270        280        290        299
m256-1.pep  KPLLKHVAKPLLLLNAVNDPFLPPEALPRADEVSEAVTLFQPAYGGHVGFVSSTGGRLHL
            ||||||||||||||||:||||||||||||||:||||||||||:|||:|||:||||||||
g256-1      KPLLKHVAKPLLLLNAANDPFLPPEALPRADEASEAVTLFQPAHGGHAGFVSSTGGRLHL
                  250        260        270        280        290        300
```

```
                          -continued
                  300        310       319
    m256-1.pep    QWLPQTVLSYFDSFRTNRRX
                  ||||||||||||||||||||
    g256-1        QWLPQTVLSYFDSFRTNRRX
                           310       320
```

The following partial DNA sequence was identified in *N. meningitidis* <SEQ ID 1015>:

```
a256-1.seq
   1 ATGATTTTGA CACCGCCGGA CACACCCTTT TTCCTCCGCA ACGGCAATGC

51 CGACACGATT GCCGCCAAAT TCCTGCAACG CTCCGCACCT GCATACCGCC

101 GCGAGCTGCT TCCCGACAGC ACGGGTAAAA CCAAAACCGC CTACGACTTT

151 TCAGACGGCA TTTCGCCCGA TGCGCCGCTG GTCGTGCTGT TTCACGGTTT

201 GGAGGGCGGC AGTGGCAGCC ATTACGCGGT CGAACTGATG CTCGCGGTAC

251 GCGATCGGGG TTGGAACGGC GTAGTCGTCC ATTTCCGCAG CTGCGGCGGC

301 GTAGCGAACA CCGCCCCGGT GTTCTACCAC TTGGGCGATA CCGCCGAAAT

351 TGCCTTTACT TTGGACACGC TCGCCGCGCG TTACCGTGAA ATATACGCCG

401 TCGGCGTATC GCTGGGCGGC AACGCGCTGG CAAAATATTT GGGCGAACAG

451 GGCGAAAACG CGCTGCCGCA AGCCGCCGCC GTCATCTCCG CACCCGTCGA

501 TGCAGAGGCG GCAGGCAACC GCTTCGACAG CGGCATCACA CGGCTGCTCT

551 ACACGCGCTA CTTCCTCCGC ACACTGATAC CCAAAGCACG GTCGCTCCAA

601 GGTTTTCAGA CGGCATTTGC CGCAGGGTGC AAAACACTGG GCGAGTTTGA

651 CGACCGTTTC ACCGCACCGC TGCACGGCTT TGCCGATCGG CACGACTACT

701 ACCGCCAAAC TTCCTGCAAA CCGCTGCTCA ACACGTTGC CAAACCGCTG

751 CTCCTGCTCA ATGCCGTCAA CGACCCCTTC CTGCCGCCCG AAGCGCTGCC

801 CCGCGCAGAC GAAGTGTCCG AAGCCGTTAC CCTGTTCCAG CCGACACACG

851 GTGGTCATGT CGGCTTTGTC GGCAGCACCG GCGGCAGGCT GCACCTGCAA

901 TGGTTGCCGC AGACCGTCCT GTCCTATTTC GACAGCTTCC GCACAAACAG

951 GCGTTAA
```

This corresponds to the amino acid sequence <SEQ ID 1016; ORF 256-1.a>:

```
a256-1.pep

1  MILTPPDTPF FLRNGNADTI AAKFLQRSAP AYRRELLPDS TGKTKTAYDF

51  SDGISPDAPL VVLFHGLEGG SGSHYAVELM LAVRDRGWNG VVVHFRSCGG

101  VANTAPVFYH LGDTAEIAFT LDTLAARYRE IYAVGVSLGG NALAKYLGEQ

151  GENALPQAAA VISAPVDAEA AGNRFDSGIT RLLYTRYFLR TLIPKARSLQ

201  GFQTAFAAGC KTLGEFDDRF TAPLHGFADR HDYYRQTSCK PLLKHVAKPL

251  LLLNAVNDPF LPPEALPRAD EVSEAVTLFQ PTHGGHVGFV GSTGGRLHLQ

301  WLPQTVLSYF DSFRTNRR* a256-1/m256-1 95.6% identity in 318 aa overlap 10         20         30         40         50         60
   a256-1.pep   MILTPPDTPFFLRNGNADTIAAKFLQRSAPAYRRELLPDSTGKTKTAYDFSDGISPDAPL
                ||||||||||||||||||||||||||| ||||||||||||||||:|||||||||||||||
   m256-1       MILTPPDTPFFLRNGNADTIAAKFLQRPAPAYRRELLPDSTGKAKTAYDFSDGISPDAPL
                    10         20         30         40         50         60
```

```
                   70         80         90        100        110        120
a256-1.pep  VVLFHGLEGGSGSHYAVELMLAVRDRGWNGVVVHFRSCGGVANTAPVFYHLGDTAEIAFT
            ||||||||||:| |||||||||||||||||:|||||||||||:||||||||||||||||
m256-1      VVLFHGLEGSSRSHYAVELMLAVRDRGWHGVVVHFRSCGGIANTAPVFYHLGDTAEIAFT
                   70         80         90        100        110        120

130        140        150        160        170        180
a256-1.pep  LDTLAARYREIYAVGVSLGGNALAKYLGEQGENALPQAAAVISAPVDAEAAGNRFDSGIT
            |||:||||||||||||||||||||||||||||::||||||||||||||||||| ||||||
m256-1      LDTFAARYREIYAVGVSLGGNALAKYLGEQGKKALPQAAAVISAPVDAEAAGRRFDSGIT
                  130        140        150        160        170        180

190        200        210        220        230        240
a256-1.pep  RLLYTRYFLRTLIPKARSLQGFQTAFAAGCKTLGEFDDRFTAPLHGFADRHDYYRQTSCK
            ||||||||||||||||:|||||||||||||||||||||||||||||||||||||||||||
m256-1      RLLYTRYFLRTLIPKAKSLQGFQTAFAAGCKTLGEFDDRFTAPLHGFADRHDYYRQTSCK
                  190        200        210        220        230        240

250        260        270        280        290        300
a256-1.pep  PLLKHVAKPLLLLNAVNDPFLPPEALPRADEVSEAVTLFQPTHGGHVGFVGSTGGRLHLQ
            |||||||||||||||||||||||||||||||||||||||||::||||||:||||||||||
m256-1      PLLKHVAKPLLLLNAVNDPFLPPEALPRADEVSEAVTLFQPAYGGHVGFVSSTGGRLHLQ
                  250        260        270        280        290        300

310        319
a256-1.pep  WLPQTVLSYFDSFRTNRRX
            |||||||||||||||||||
m256-1      WLPQTVLSYFDSFRTNRRX
                  310
```

The following partial DNA sequence was identified in *N. gonorrhoeae* <SEQ ID 1017>:

```
g257.seq
   1 atgggcaggc atttcgggcg cagacgtttt ctgacggctg ccgccgttgc 51 tgtggccggt gcggcggttt ctttttttgcc gaatcctttt gccgccggcg 101 gcgaaaaacg caacatggat aaaaaacgcg atgaaaatgt gttttctgg 151 aaaggtgtcg cgctgggttc cggcgcggag ctgcgcctgt tcggcgtgga 201 cgacagacag gcggcggatt tggtcaataa ggttttggcg aagtggcgc 251 gtttggaaaa aatgttcagc ctttaccgtg aagacagcct gatcagccgt 301 ctgaaccgcg acggttatct gacttcgcct ccggcggatt ttttggaact 351 gttgagcctg gccgcgatat tcacgcgctg a
```

This corresponds to the amino acid sequence <SEQ ID 1018; ORF 257.ng>:

```
g257.pep
   1 MGRHFGRRRF LTAAAVAVAG AAVSFLPNPF AAGGEKRNMD KKRDENVFFW

51 KGVALGSGAE LRLFGVDDRQ AADLVNKVLA EVARLEKMFS LYREDSLISR

101 LNRDGYLTSP PADFLELLSL AAIFTR*
```

The following partial DNA sequence was identified in *N. meningitidis* <SEQ ID 1019>:

```
m257.seq
   1 ATGGGCAGGC ATTTCGGGCG .CAGCGTTTT CTGACGGTTG CCGCCGTTGC

51 GGCGGGGaC. GCGGcGGTTT CTTTCCTGCC GAATCCTTTT GCCGCCGATG

101 ATGAAAAACG CAAcGGGGAT GAAAAACGCA ATGAAAATGT GTTTTTCTGG

151 AAAGGTGTCG CACTGGGTTC CGGTGCGGa. CTCCGTCTGT TCGGTGTGGA

201 CGACAGGCGT GCGGCGGATT TGGTCAACAA GGTTTTGGCG AAGTGGCGC

251 GTTTGGAAAA ATTGTTCAGC CTTTACCGTG AAGACAGCCT GATCAGCCGC
```

-continued

```
301 CTGAACAGGG ACGGTTATCT GACTTCGCCG TCGGCGGATT TTTTGGAACT

351 GkTGAGCCTG GCCGCGATAT TCACGCkCTG A
```

This corresponds to the amino acid sequence <SEQ ID 1020; ORF 257>:

```
m257.pep
  1 MGRHFGXQRF LTVAAVAAGX AAVSFLPNPF AADDEKRNGD EKRNENVFFW

51 KGVALGSGAX LRLFGVDDRR AADLVNKVLA EVARLEKLFS LYREDSLISR

101 LNRDGYLTSP SADFLELXSL AAIFTX*
```

Computer analysis of this amino acid sequence gave the following results:
Homology with a Predicted ORF from *N. gonorrhoeae*
ORF 257 shows 88.0% identity over a 125 aa overlap with a predicted ORF (ORF 257.ng) from *N. gonorrhoeae*:

```
    m257/g257
                      10         20         30         40         50         60
       m257.pep    MGRHFGRQRFLTVAAVAAGTAAVSFLPNPFAADDEKRNGDEKRNENVFFWKGVALGSGAD
                   ||||||||:||||:|||::  ||||||||||||  ||||  :||:||||||||||||||:
           g257    MGRHFGRRRFLTAAAVAVAGAAVSFLPNPFAAGGEKRNMDKKRDENVFFWKGVALGSGAE
                      10         20         30         40         50         60

70         80         90        100        110        120
       m257.pep    LRLFGVDDRRAADLVNKVLAEVARLEKLFSLYREDSLISRLNRDGYLTSPSADFLELXSL
                   |||||||||:||||||||||||||||||:|||||||||||||||||||| |||||| ||
           g257    LRLFGVDDRQAADLVNKVLAEVARLEKMFSLYREDSLISRLNRDGYLTSPPADFLELLSL
                      70         80         90        100        110        120 m257.pep    AAIFTXX
                   ||||| |
           g257    AAIFTRX
```

The following partial DNA sequence was identified in *N. meningitidis* <SEQ ID 1021>:

```
a257.seq
  1 ATGGGCAGGC ATTTCGGGCG CAGGCGTTTT TTGACAGTTG CCGCCGTTGC

51 GGCGGCGGGC GCGGCGGTTT CTTTCCTGCC GAATCCTTTT GCCGCCGATG

101 ATGAAAAACG CAATAAAGAT GAAAAACGCA ATGAAAATGT GTTTTTCTGG

151 AAAGGTGTCG CACTGGGTTC CGGTGCGGAG CTCCGTCTGT TCGGTGTGGA

201 CGACAGGCGT GCGGCGGATT TGGTCAACAA GGTTTTGGCG GAAGTGGCGC

251 GTTTGGAAAA AATGTTCAGC CTTTACCGTG AAGACAGCCT GATCAGCCGT

301 CTGAACCGTG ACGGTTATTT GACTTCGCCG CCGGCGGATT TTTTGGAACT

351 GTTGAGCCTG GCCGTGATAT TCACGCGCTG A
```

This corresponds to the amino acid sequence <SEQ ID 1022; ORF 257.a>:

```
a257.pep
  1 MGRHFGRRRF LTVAAVAAAG AAVSFLPNPF AADDEKRNKD EKRNENVFFW

51 KGVALGSGAE LRLFGVDDRR AADLVNKVLA EVARLEKMFS LYREDSLISR

101 LNRDGYLTSP PADFLELLSL AVIFTR*
``` m257/a257 92.0% identity in 125 aa overlap

```
              10        20        30        40        50        60
m257.pep  MGRHGGXQRFLTVAAVAAGXAAVSFLPNPFAADDEKRNGDEKRNENVFFWKGVALGSGAX
          ||||| :|||||||||||| ::||||||||||||||||| :|||||||||||||||||| 
a257      MGRHFGRRRFLTVAAVAAAGAAVSFLPNPFAADDEKRNKDEKRNENVFFWKGVALGSGAE
              10        20        30        40        50        60

70        80        90       100       110       120
m257.pep  LRLFGVDDRRAADLVNKVLAEVARLEKLFSLYREDSLISRLNRDGYLTSPSADFLELXSL
          |||||||||||||||||||||||||||:||||||||||||||||||||||  |||| || 
a257      LRLFGVDDRRAADLVNKVLAEVARLEKMFSLYREDSLISRLNRDGYLTSPPADFLELLSL
              70        80        90       100       110       120 m257.pep  AAIFTXX
          |:|||
a257      AVIFTRX
```

The following partial DNA sequence was identified in *N. gonorrhoeae* <SEQ ID 1023>:

```
g258.seq
    1 atgcgccgct tcctaccgat cgcagccata tgcgccgtcg tcctgctgta 51 cggattgacg gcggcgaccg gcagcaccag ttcgctggcg gattatttct 101 ggtggatagt ctcgttcagc gcaatgctgc tgctggtgtt gtccgccgtt 151 ttggcacgtt atgtcatatt gctgttgaaa gacaggcgca acggcgtgtt 201 cggttcgcag attgccaaac gcctttccgg gatgttcacg ctggtcgccg 251 tactgcccgg cttgttcctg ttcggcattt ccgcgcagtt tatcaacggc 301 acgattaatt cgtggttcgg caacgacacc cacgaagccc tcgaacgcag 351 ccttaatttg agcaagtccg cactggattt ggcggcagac aatgccgtca 401 gcaacgccgt tcccgtacag atagacctca tcggcaccgc ctccctgtcg 451 ggcaatatgg gcagtgtgct ggaacactac gccggcagcg gttttgccca 501 gcttgccctg tacaatgccg caagcgggaa atcgaaaaa agcatcaatc 551 cgcaccaatt cgaccagccg cttcccgaca agaacattg ggaacagatt 601 cagcagaccg gttcggttcg gagtttggaa agcataggcg gcgtattgta 651 cgcgcaggga tggttgtcgg caggtacgca caacgggcgc gattacgcgc 701 tgttcttccg ccagccgatt cccgaaaatg tggcacagga tgccgttctg 751 attgaaaagg cgcgggcgaa atatgccgaa ttgagttaca gcaaaaaagg 801 tttgcagacc ttttttctgg taaccctgct gattgcctcg ctgctgtcga 851 tttttcttgc gctggtaatg gcactgtatt tgcccgccg tttcgtcgaa 901 cccattctgt cgcttgccga gggcgcaaag gcggtggcgc agggtgattt 951 cagccagacg cgccccgtat tgcgcaacga cgagttcgga cgtttgacca 1001 agctgttcaa ccatatgacc gagcagcttt ccatcgccaa agaagcagac 1051 gaacgcaacc gccggcgcga ggaagccgcc cgtcactacc tcgagtgcgt 1101 gttggatggg ttgactaccg gtgtggtggt ctcntacccc ctctcttgtt 1151 gccgtaccgc ggtgttttcc acttgtcatt cctcccctct ttcttatttc 1201 taa
```

This corresponds to the amino acid sequence <SEQ ID 1024; ORF 258.ng>:

```
g258.pep
   1 MRRFLPIAAI CAVVLLYGLT AATGSTSSLA DYFWWIVSFS AMLLLVLSAV

51 LARYVILLLK DRRNGVFGSQ IAKRLSGMFT LVAVLPGLFL FGISAQFING

101 TINSWFGNDT HEALERSLNL SKSALDLAAD NAVSNAVPVQ IDLIGTASLS

151 GNMGSVLEHY AGSGFAQLAL YNAASGKIEK SINPHQFDQP LPDKEHWEQI

201 QQTGSVRSLE SIGGVLYAQG WLSAGTHNGR DYALFFRQPI PENVAQDAVL

251 IEKARAKYAE LSYSKKGLQT FFLVTLLIAS LLSIFLALVM ALYFARRFVE

301 PILSLAEGAK AVAQGDFSQT RPVLRNDEFG RLTKLFNHMT EQLSIAKEAD

351 ERNRRREEAA RHYLECVLDG LTTGVVVSYP LSCCRTAVFS TCHSSPLSYF*
```

The following partial DNA sequence was identified in *N. meningitidis* <SEQ ID 1025>:

```
m258.seq
   1 ATGCGCCGTT TTCTACCGAT CGCAGCCATA TGCGCCGTCG TCCTGTTGTA

51 CGGACTGACG GCGGCAACCG GCAGCACCAG TTCGCTGGCG GATTATTTCT

101 GGTGGATTGT TGCGTTCAGC GCAATGCTGC TGCTGGTGTT GTCCGCCGTT

151 TTGGCACGTT ATGTCATATT GCTGTTGAAA GACAGGCGCG ACGGCGTATT

201 CGGTTCGCAG ATTGCCAAAC GCCTTTCTGG GATGTTTACG CTGGTTGCCG

251 TACTGCCCGG CGTGTTTCTG TTCGGCGTTT CCGCACAGTT CATCAACGGC

301 ACGATTAATT CGTGGTTCGG CAACGATACC CACGAGGCGC TTGAACGCAG

351 CCTCAATTTG AGCAAGTCCG CATTGAATTT GGCGGCAGAC AACGCCCTCG

401 GCAACGCCGT CCCCGTGCAG ATAGACCTCA TCGGCGCGGC TTCCCTGCCC

451 GGGGATATGG GCAGGGTGCT GGAACATTAC GCCGGCAGCG GTTTTGCCCA

501 GCTTGCCCTG TACAATGCCG CAAGCGGCAA AATCGAAAAA AGCATCAACC

551 CGCACAAGCT CGATCAGCCG TTTCCAGGTA AGGCGCGTTG GGAAAAAATC

601 CAACGGGCGG GTTCGGTCAG GGATTTGGAA AGCATAGGCG GCGTATTGTA

651 CGCGCAGGGC TGGCTGTCGG CGGGTACGCA CAACGGGCGC GATTACGCCT

701 TGTTTTTCCG TCAGCCGGTT CCCAAAGGCG TGGCAGAGGA TGCCGTCTTA

751 ATCGAAAAGG CAAGGGCGAA ATATGCTGAG TTGAGTTACA GCAAAAAAGG

801 TTTGCAGACC TTTTTCCTGG CAACCCTGCT GATTGCCTCG CTGCTGTCGA

851 TTTTTCTTGC ACTGGTCATG GCACTGTATT TCGCCCGCCG TTTCGTCGAA

901 CCCGTCCTAT CGCTTGCCGA GGGGGCGAAG GCGGTGGCGC AAGGCGATTT

951 CAGCCAGACG CGCCCCGTGT TGCGCAACGA CGAGTTCGGA CGCTTGACCA

1001 AGTTGTTCAA CCACATGACC GAGCAGCTTT CCATCGCCAA AGAAGCAGAC

1051 GAGCGCAACC GCCGGCGCGA GGAAGCCGCC AGGCATTATC TTGAATGCGT

1101 GTTGGAGGGG CTGACCACGG CGTGGTGGT GTTTGACGAA CAAGGCTGTC

1151 TGAAAACsTT CAACAAAGCG GCGGAACAGA TTyTGGGGAT GCCGCTTACC

1201 CCCcTGTGGG GCAGCAGCCG GCACGGTTGG CACGGCGTTT CGGCGCAGCA

1251 GTCCCTGCTT GCCGAAGTGT TTGCCGCCAT CGGCGCGGCG GCAGGTACGG

1301 ACAAACCGGT CCATGTGAAA TATGCCGCGC CGGACGATGC CAAAATCCTG
```

```
-continued
1351 CTGGGCAAGG CAACCGTCCT GCCCGAAGAC AACGGCAACg GCGTGGTAAT

1401 GGTGATTGAC GACATCACCG TTTTGATACA CGCGCAAAAA GAAGCCGCGT

1451 GGGGCGAAgT GGCGaAgCGG CTGGCACACG AAATCCGCAA TCCGCTCACG

1501 CCCATCCAGC TTTCCGCCGA ACgGsTGGCG TkGAAATTGG GCGGGAAGCT

1551 GGATGAGCAG GATGCGCAAA TCCTGACGCG TTCGACCGAC ACCATCGTCA

1601 AACAGGTGGC GGCATTGAAG GAAATGGTCG AAGCATTCCG CAATTATGCG

1651 CGTTCCCCTT CGCTCAAATT GGAAAATCAG GATTTGAACG CCTTAATCGG

1701 CGATGTGTTG GCATTGTATG AAGCCGGTCC GTGCCGGTTT GCGGCGGACT

1751 TGCCGGCGAA CCGCTGA
```

This corresponds to the amino acid sequence <SEQ ID 1026; ORF 258>:

```
m258.pep
  1 MRRFLPIAAI CAVVLLYGLT AATGSTSSLA DYFWWIVAFS AMLLLVLSAV

51 LARYVILLLK DRRDGVFGSQ IAKRLSGMFT LVAVLPGVFL FGVSAQFING

101 TINSWFGNDT HEALERSLNL SKSALNLAAD NALGNAVPVQ IDLIGAASLP

151 GDMGRVLEHY AGSGFAQLAL YNAASGKIEK SINPHKLDQP FPGKARWEKI

201 QRAGSVRDLE SIGGVLYAQG WLSAGTHNGR DYALFFRQPV PKGVAEDAVL

251 IEKARAKYAE LSYSKKGLQT FFLATLLIAS LLSIFLALVM ALYFARRFVE

301 PVLSLAEGAK AVAQGDFSQT RPVLRNDEFG RLTKLFNHMT EQLSIAKEAD

351 ERNRRREEAA RHYLECVLEG LTTGVVVFDE QGCLKTFNKA AEQILGMPLT

401 PLWGSSRHGW HGVSAQQSLL AEVFAAIGAA AGTDKPVHVK YAAPDDAKIL

451 LGKATVLPED NGNGVVMVID DITVLIHAQK EAAWGEVAKR LAHEIRNPLT

501 PIQLSAERXA XKLGGKLDEQ DAQILTRSTD TIVKQVAALK EMVEAFRNYA

551 RSPSLKLENQ DLNALIGDVL ALYEAGPCRF AADLPANR*
                                                40
```

Computer analysis of this amino acid sequence gave the following results:

Homology with a Predicted ORF from *N. gonorrhoeae*

ORF 258 shows 90.9% identity over a 386 aa overlap with a predicted ORF (ORF 258.ng) from *N. gonorrhoeae*:

```
    m258/g258
                    10         20         30         40         50         60
    m258.pep   MRRFLPIAAICAVVLLYGLTAATGSTSSLADYFWWIVAFSAMLLLVLSAVLARYVILLLK
               ||||||||||||||||||||||||||||||||||||||:|||||||||||||||||||||
    g258       MRRFLPIAAICAVVLLYGLTAATGSTSSLADYFWWIVSFSAMLLLVLSAVLARYVILLLK
                    10         20         30         40         50         60

70         80         90        100        110        120
    m258.pep   DRRDGVFGSQIAKRLSGMFTLVAVLPGVFLFGVSAQFINGTINSWFGNDTHEALERSLNL
               |||:||||||||||||||||||||||||:||||:||||||||||||||||||||||||||
    g258       DRRRGVFGSQIAKRLSGMFTLVAVLPGLFLFGISAQFINGTINSWFGNDTHEALERSLNL
                    70         80         90        100        110        120

130        140        150        160        170        180
    m258.pep   SKSALNLAADNALGNAVPVQIDLIGAASLPGDMGRVLEHYAGSGFAQLALYNAASGKIEK
               |||||:||||::|||||||||||||:|||  |:||||||||||||||||||||||||||
    g258       SKSALDLAADNAVSNAVPVQIDLIGTASLSGNMGSVLEHYAGSGFAQLALYNAASGKIEK
                   130        140        150        160        170        180

190        200        210        220        230        240
    m258.pep   SINPHKLDQPFPGKARWEKIQRAGSVRDLESIGGVLYAQGWLSAGTHNGRDYALFFRQPV
               |||||::|||:|  :||:||::|||||:||||||||||||||||||||||||||||||:
    g258       SINPHQFDQPLPDKEHWEQIQQTGSVRSLESIGGVLYAQGWLSAGTHNGRDYALFFRQPI
                   190        200        210        220        230        240
```

-continued

```
                    250       260       270       280       290       300
m258.pep     PKGVAEDAVLIEKARAKYAELSYSKKGLQTFFLATLLIASLLSIGLALVMALYFARRFVE
             |::||:|||||||||||||||||||||||||||:||||||||||||||||||||||||||
g258         PENVAQDAVLIEKARAKYAELSYSKKGLQTFFLVTLLIASLLSIGLALVMALYFARRFVE
                    250       260       270       280       290       300

310       320       330       340       350       360
m258.pep     PVLSLAEGAKAVAQGDFSQTRPVLRNDEFGRLTKLFNHMTWQLSIAKEADERNRRREEAA
             |:||||||||||||||||||||||||||||||||||||||||||||||||||||||||||
g258         PILSLAEGAKAVAQGDFSQTRPVLRNDEFGRLTKLFNHMTWQLSIAKEADERNRRREEAA
                    310       320       330       340       350       360

370       380       390       400       410       420
m258.pep     RHYLECVLEGLTTGVVVFDEQGCLKTFNKAAEQILGMPLTPLWGSSRHGWHGVSAQQSLL
             ||||||||:||||||||     :| :|
g258         RHYLECVLDGLTTGVVVSYOKSCCRTAVFSTCHSSPLSYFX
                    370       380       390       400
```

The following partial DNA sequence was identified in *N. meningitidis* <SEQ ID 1027>:

```
a258.seq
   1 ATGCGCCGTT TTCTACCGAT CGCAGCCATA TGCGCCGTCG TCCTGTTGTA

51 CGGACTGACG GCGGCAACCG GCAGCACCAG TTCGCTGGCG GATTATTTCT

101 GGTGGATTGT TGCGTTCAGC GCAATGCTGC TGCTGGTGTT GTCCGCCGTT

151 TTGGCACGTT ATGTCATATT GCTGTTGAAA GACAGGCGCG ACGGCGTATT

201 CGGTTCGCAG ATTGCCAAAC GCCTTTCCGG GATGTTTACG CTGGTTGCCG

251 TACTGCCCGG CGTGTTTCTG TTCGGCGTTT CCGCACAGTT TATCAACGGC

301 ACGATTAATT CGTGGTTCGG CAACGATACC CACGAGGCGC TTGAACGCAG

351 CCTCAATTTG AGCAAGTCCG CATTGAATCT GGCGGCAGAC AACGCCCTTG

401 GCAACGCCAT CCCCGTGCAG ATAGACCTCA TCGGCGCGGC TTCCCTGCCC

451 GGGGATATGG GCAGGGTGCT GGAACATTAC GCCGGCAGCG GTTTTGCCCA

501 GCTTGCCCTG TACAATGCCG CAAGCGGCAA AATCGAAAAA AGCATCAACC

551 CGCACAAGCT CGATCAGCCG TTTCCAGGTA AGGCGCGTTG GGAAAAAATC

601 CAACAGGCGG GTTCGGTCAG GGATTTGGAA AGCATAGGCG GCGTATTGTA

651 CGCGCAGGGC TGGCTGTCGG CAGGTACGCA CAACGGGCGC GATTACGCCT

701 TGTTTTTCCG TCAGCCGGTT CCCAAAGGCG TGGCAGAGGA TGCCGTCTTA

751 ATCGAAAAGG CAAGGGCGAA ATATGCTGAG TTGAGTTACA GCAAAAAAGG

801 TTTGCAGACC TTTTTCCTGG CAACCCTGCT GATTGCCTCG CTGCTGTCGA

851 TTTTTCTTGC ACTGGTCATG GCACTGTATT TCGCCCGCCG TTTCGTCGAA

901 CCCGTCCTAT CGCTTGCCGA GGGGGCGAAG GCGGTGGCGC AAGGCGATTT

951 CAGCCAGACG CGCCCCGTGT TGCGCAACGA CGAGTTCGGA CGCTTGACCA

1001 AGTTGTTCAA CCACATGACC GAGCAGCTTT CCATCGCCAA AGAAGCAGAC

1051 GAGCGCAACC GCCGGCGCGA GGAAGCCGCC AGACATTATC TCGAATGCGT

1101 GTTGGAGGGG CTGACCACGG GCGTGGTGGT GTTTGACGAA CAAGGCTGTC

1151 TGAAAACCTT CAACAAAGCG GCGGAACAGA TTTTGGGGAT GCCGCTTACC

1201 CCCCTGTGGG GCAGCAGCCG GCACGGTTGG CACGGCGTTT CGGCGCAGCA

1251 GTCCCTGCTT GCCGAAGTGT TTGCCGCCAT CGGCGCGGCG GCAGGTACGG

1301 ACAAACCGGT CCATGTGAAA TATGCCGCGC CGGACGATGC CAAAATCCTG

1351 CTGGGCAAGG CAACCGTCCT GCCCGAAGAC AACGGCAACG GCGTGGTAAT

1401 GGTGATTGAC GACATCACCG TTTTGATACA CGCGCAAAAA GAAGCCGCGT
```

-continued

```
1451 GGGGCGAAGT GGCAAAACGG CTGGCACACG AAATCCGCAA TCCGCTCACG

1501 CCCATCCAGC TTTCTGCCGA ACGGCTGGCG TGGAAATTGG GCGGGAAGCT

1551 GGACGAGCAG GACGCGCAAA TCCTGACACG TTCGACCGAC ACCATCATCA

1601 AACAAGTGGC GGCATTAAAA GAAATGGTCG AGGCATTCCG CAATTACGCG

1651 CGTTCCCCTT CGCTCAAATT GGAAAATCAG GATTTGAACG CCTTAATCGG

1701 CGATGTGTTG GCATTGTACG AAGCTGGTCC GTGCCGGTTT GCGGCGGAAC

1751 TTGCCGGCGA ACCGCTGATG ATGGCGGCGG ATACGACCGC CATGCGGCAG

1801 GTGCTGCACA ATATTTTCAA AAATGCCGCC GAAGCGGCGG AAGAAGCCGA

1851 TGTGCCCGAA GTCAGGGTAA AATCGGAAGC GGGGCAGGAC GGACGGATTG

1901 TCCTGACAGT TTGCGACAAC GGCAAGGGGT TCGGCAGGGA AATGCTGCAC

1951 AATGCCTTCG AGCCGTATGT AACGGACAAA CCGGCTGGAA CGGGATTGGG

2001 ACTGCCCGTG GTGAAAAAAA TCATTGAAGA ACACGGCGGC CGCATCAGCC

2051 TGAGCAATCA GGATGCGGGC GGCGCGTGTG TCAGAATCAT CTTGCCAAAA

2101 ACGGTAGAAA CTTATGCGTA G
```

This corresponds to the amino acid sequence <SEQ ID 1028; ORF 258.a>:

```
a258.pep
  1 MRRFLPIAAI CAVVLLYGLT AATGSTSSLA DYFWWIVAFS AMLLLVLSAV

51 LARYVILLLK DRRDGVFGSQ IAKRLSGMFT LVAVLPGVFL FGVSAQFING

101 TINSWFGNDT HEALERSLNL SKSALNLAAD NALGNAIPVQ IDLIGAASLP

151 GDMGRVLEHY AGSGFAQLAL YNAASGKIEK SINPHKLDQP FPGKARWEKI

201 QQAGSVRDLE SIGGVLYAQG WLSAGTHNGR DYALFFRQPV PKGVAEDAVL

251 IEKARAKYAE LSYSKKGLQT FFLATLLIAS LLSIFLALVM ALYFARRFVE

301 PVLSLAEGAK AVAQGDFSQT RPVLRNDEFG RLTKLFNHMT EQLSIAKEAD

351 ERNRRREEAA RHYLECVLEG LTTGVVVFDE QGCLKTFNKA AEQILGMPLT

401 PLWGSSRHGW HGVSAQQSLL AEVFAAIGAA AGTDKPVHVK YAAPDDAKIL

451 LGKATVLPED NGNGVVMVID DITVLIHAQK EAAWGEVAKR LAHEIRNPLT

501 PIQLSAERLA WKLGGKLDEQ DAQILTRSTD TIIKQVAALK EMVEAFRNYA

551 RSPSLKLENQ DLNALIGDVL ALYEAGPCRF AAELAGEPLM MAADTTAMRQ

601 VLHNIFKNAA EAAEEADVPE VRVKSEAGQD GRIVLTVCDN GKGFGREMLH

651 NAFEPYVTDK PAGTGLGLPV VKKIIEEHGG RISLSNQDAG GACVRIILPK

701 TVETYA*
``` m258/a258 99.0% identity in 584 aa overlap

```
                    10         20         30         40         50         60
    m258.pep  MRRFLPIAAICAVVLLYGLTAATGSTSSLADYFWWIVAFSAMLLLVLSAVLARYVILLLK
              ||||||||||||||||||||||||||||||||||||||||||||||||||||||||||||
    a258      MRRFLPIAAICAVVLLYGLTAATGSTSSLADYFWWIVAFSAMLLLVLSAVLARYVILLLK
                    10         20         30         40         50         60

70         80         90        100        110        120
    m258.pep  DRRDGVFGSQIAKRLSGMFTLVAVLPGVFLFGVSAQFINGTINSWFGNDTHEALERSLNL
              ||||||||||||||||||||||||||||||||||||||||||||||||||||||||||||
    a258      DRRDGVFGSQIAKRLSGMFTLVAVLPGVFLFGVSAQFINGTINSWFGNDTHEALERSLNL
                    70         80         90        100        110        120
```

```
              130        140        150        160        170        180
m258.pep  SKSALNLAADNALGNAVPVQIDLIGAASLPGDMGRVLEHYAGSGFAQLALYNAASGKIEK
          ||||||||||||||||:|||||||||||||||||||||||||||||||||||||||||||
a258      SKSALNLAADNALGNAIPVQIDLIGAASLPGDMGRVLEHYAGSGFAQLALYNAASGKIEK
              130        140        150        160        170        180

190        200        210        220        230        240
m258.pep  SINPHKLDQPFPGKARWEKIQRAGSVRDLESIGGVLYAQGWLSAGTHNGRDYALFFRQPV
          |||||||||||||||||||||:||||||||||||||||||||||||||||||||||||||
a258      SINPHKLDQPFPGKARWEKIQQAGSVRDLESIGGVLYAQGWLSAGTHNGRDYALFFRQPV
              190        200        210        220        230        240

250        260        270        280        290        300
m258.pep  PKGVAEDAVLIEKARAKYAELSYSKKGLQTFFLATLLIASLLSIFLALVMALYFARRFVE
          ||||||||||||||||||||||||||||||||||||||||||||||||||||||||||||
a258      PKGVAEDAVLIEKARAKYAELSYSKKGLQTFFLATLLIASLLSIFLALVMALYFARRFVE
              250        260        270        280        290        300

310        320        330        340        350        360
m258.pep  PVLSLAEGAKAVAQGDFSQTRPVLRNDEFGRLTKLFNHMTEQLSIAKEADERNRRREEAA
          ||||||||||||||||||||||||||||||||||||||||||||||||||||||||||||
a258      PVLSLAEGAKAVAQGDFSQTRPVLRNDEFGRLTKLFNHMTEQLSIAKEADERNRRREEAA
              310        320        330        340        350        360

370        380        390        400        410        420
m258.pep  RHYLECVLEGLTTGVVVFDEQGCLKTFNKAAEQILGMPLTPLWGSSRHGWHGVSAQQSLL
          ||||||||||||||||||||||||||||||||||||||||||||||||||||||||||||
a258      RHYLECVLEGLTTGVVVFDEQGCLKTFNKAAEQILGMPLTPLWGSSRHGWHGVSAQQSLL
              370        380        390        400        410        420

430        440        450        460        470        480
m258.pep  AEVFAAIGAAAGTDKPVHVKYAAPDDAKILLGKATVLPEDNGNGVVMVIDDITVLIHAQK
          ||||||||||||||||||||||||||||||||||||||||||||||||||||||||||||
a258      AEVFAAIGAAAGTDKPVHVKYAAPDDAKILLGKATVLPEDNGNGVVMVIDDITVLIHAQK
              430        440        450        460        470        480

490        500        510        520        530        540
m258.pep  EAAWGEVAKRLAHEIRNPLTPIQLSAERXAXKLGGKLDEQDAQILTRSTDTIVKQVAALK
          ||||||||||||||||||||||||||||||| ||||||||||||||||||||:|||||||
a258      EAAWGEVAKRLAHEIRNPLTPIQLSAERLAWKLGGKLDEQDAQILTRSTDTIIKQVAALK
              490        500        510        520        530        540

550        560        570        580        589
m258.pep  EMVEAFRNYARSPSLKLENQDLNALIGDVLALYEAGPCRFAADLPANRX
          |||||||||||||||||||||||||||||||||||||||||:|
a258      EMVEAFRNYARSPSLKLENQDLNALIGDVLALYEAGPCRFAAELAGEPLMMAADTTAMRQ
              550        560        570        580        590        600
a258      VLHNIFKNAAEAAEEADVPEVRVKSEAGQDGRIVLTVCDNGKGFGREMLHNAFEPYVTDK
              610        620        630        640        650        660
```

The following partial DNA sequence was identified in *N. gonorrhoeae* <SEQ ID 1029>:

```
g259.seq
   1 atgatgatgc acgcttctgt ccaaagtcgt ttcgcaccga tactttatgt 51 tttgattttc tttgccggtt ttttgaccgc gcaaatctgg ttcaatcaga 101 aagcctatac tgaagagctg cctccgcttc tgtccgcatt gtccgccgtc 151 gcgctggtgt ggctggcgtg ggcgttcgtg tcggtgcgtt caaaggctaa 201 ggcagaaaag ttctaccgcg aaaaaatgat acagaacgaa agcatacacc 251 ccgtcctgca cgcttctttg caacacttgg aacacaagcc gcaaatgctc 301 gccctgctgg tcaaaaacca cggcaaaggc atggcggaac aggtcaggtt 351 caaggcggaa gtgctgcccg acgacgaaga cgcgcgcacg attgccgccg 401 agttggcaaa aatggatatg ttcgcattgg ggacggacgc ggtcgcctcg 451 ggcgaaacct atgggcgcgt gttcgccgat attttcgagt tgtcggcggc 501 tttggaaagg cgcgcgttca aagggatact gaaactgacg gcggaatata 551 aaaaacatct tcggcgatgc ctgccgttcg gaaacggcgt tggatttggg 601 cgcgctcaat caggcgttga gggaaatctc gaaaacgccg gaaaagccta 651 a
```

This corresponds to the amino acid sequence <SEQ ID 1030; ORF 259.ng>:

```
g259.pep
   1 MMMHASVQSR FAPILYVLIF FAGFLTAQIW FNQKAYTEEL PPLLSALSAV

51 ALVWLAWAFV SVRSKAKAEK FYREKMIQNE SIHPVLHASL QHLEHKPQML

101 ALLVKNHGKG MAEQVRFKAE VLPDDEDART IAAELAKMDM FALGTDAVAS

151 GETYGRVFAD IFELSAALER RAFKGILKLT AEYKKHLRRC LPFGNGVGFG

201 RAQSGVEGNL ENAGKA*
```

The following partial DNA sequence was identified in *N. meningitidis* <SEQ ID 1031>:

```
m259.seq (partial)
   1 ATGATGATGC ACGCTTCTGT CCAAAGCCGT TCGCACCGA TACTTTATGT

51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGCGCGTT CAAAGGCCAA

201 GGCGGAAAAG TTCTACCGCG AAAAAATGAT ACAGAACGAA AGCATACACC

251 CCGTCsTGCA CGCCTCTTTG CAACACTTGG AACACAAGCC GCAAATACTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTCGCATTGG GGACkGACGC GGTCGCCTCG

451 GGCGAAACCT ATGGACGCGT GTTCGCCGAT ATTTTCGAGT TGTCGGmGGC

501 TTTGGAAGGG CGCGCGTTCA AAGGAATGTT GAAACTGACG GCGGAATATA

551 AA.AACATCT TCGGmGATGC CTGCCGTTCG GAAACGGCGT TGGAGTTGGG

601 CGCACTCAAT CAGGCGTTGC AGGAGATTTC AAAAACATCC GG..
```

This corresponds to the amino acid sequence <SEQ ID 1032; ORF 259>:

```
m259.pep (partial)
   1 MMMHASVQSR FAPILYVLIF FAGFLTAQIW FNQKAYTEEL PPLLSALSAV

51 ALVWLAWAFV SARSKAKAEK FYREKMIQNE SIHPVXHASL QHLEHKPQIL

101 ALLVKNHGKG MAEQVRFKAE VLPDDEDART IAAELAKMDM FALGTDAVAS

151 GETYGRVFAD IFELSXALEG RAFKGMLKLT AEYKXHLRRC LPFGNGVGVG

201 RTQSGVAGDF KNIR..
```

Computer analysis of this amino acid sequence gave the following results:
Homology with a Predicted ORF from *N. gonorrhoeae*
ORF 259 shows 94.3% identity over a 212 aa overlap with a predicted ORF (ORF 259.ng) from *N. gonorrhoeae*:

```
   m259/g259

10         20         30         40         50         60
      m259.pep  MMMHASVQSRFAPILYVLIFFAGFLTAQIWFNQKAYTEELPPLLSALSAVALVWLAWAFV
                ||||||||||||||||||||||||||||||||||||||||||||||||||||||||||||
          g259  MMMHASVQSRFAPILYVLIFFAGFLTAQIWFNQKAYTEELPPLLSALSAVALVWLAWAFV
                       10         20         30         40         50         60
```

```
                  70         80         90        100        110        120
m259.pep  SARSKAKAEKFYREKMIQNESIHPVXHASLQHLEHKPQILALLVKNHGKGMAEQVRFKAE
          |:||||||||||||||||||||||| ||||||||||:|||||||||||||||||||||
g259      SVRSKAKAEKFYREKMIQNESIHPVLHASLQHLEHKPQMLALLVKNHGKGMAEQVRFKAE
                  70         80         90        100        110        120

130        140        150        160        170        180
m259.pep  VLPDDEDARTIAAELAKMDMFALGTDAVASGETYGRVFADIFELSXALEGRAFKGMLKLT
          |||||||||||||||||||||||||||||||||||||||||||| ||| ||||:||||
g259      VLPDDEDARTIAAELAKMDMFALGTDAVASGETYGRVFADIFELSAALERRAFKGILKLT
                 130        140        150        160        170        180

190        200        210
m259.pep  AEYKKHLRRCLPFGNGVGVGRTQSGVAGDFKNIR
          ||||||||||||||||||| :|||| |:::|
g259      AEYKKHLRRCLPFGNGVGFGRAQSGVEGNLENAGKAX
                 190        200        210
```

The following partial DNA sequence was identified in *N. meningitidis* <SEQ ID 1033>:

```
a259.seq (partial)
  1 ATGATGATGC ACGCTTCTGT CCAAAGCCGT TTCGCACCGA TACTTTATGT

51 TTTGATTTTC TTTGCCGGTT TTTTGACCGC GCAAATCTGG TTCAATCAGA

101 AAGCCTATAC T

```
                70        80        90        100       110       120
m259.pep    SARSKAKAEKFYREKMIQNESIHPVXHASLQHLEHKPQILALLVKNHGKGMAEQVRFKAE
            ||||||||||||||||||||||||||| |||||||||||:||||||||||||||||||||
a259        SARSKAKAEKFYREKMIQNESIHPVLHASLQHLEHKPQMLALLVKNHGKGMAEQVRFKAE
                70        80        90        100       110       120

130       140       150       160       170       180
m259.pep    VLPDDRDARTIAAELAKMDMFALGTDAVASGETYGRVFADIFELSXALEGRAFKGMLKLT
            |||||||||||||||||||||||||||||||||||||||||||| ||||||||||||||
a259        VLPDDRDARTIAAELAKMDMFALGTDAVASGETYGRVFADIFELSAALEGRAFKGMLKLT
                130       140       150       160       170       180

190       200       210
m259.pep    AEYKXHLRRCLPFGNGVGVGRTQSGVAGDFKNIR
            |||||||||||||||||||:|||||||||||
a259        AEYKXHLRRCLPFGNGVGVGRAQSGVAGDFKNIGKVQ
                190       200       210
```

The following partial DNA sequence was identified in *N. gonorrhoeae* <SEQ ID 1035>:

```
g259-1.seq
    1 ATGATGATGC ACGCTTCTGT CCAAAGTCGT TTCGCACCGA TACTTTATGT

51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GCGTTCGTG TCGGTGCGTT CAAAGGCTAA

201 GGCAGAAAAG TTCTACCGCG AAAAAATGAT ACAGAACGAA AGCATACACC

251 CCGTCCTGCA CGCTTCTTTG CAACACTTGG AACACAAGCC GCAAATGCTC

301 GCCCTGCTGG TCAAAAACCA CGGCAAAGGC ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTCGCATTGG GGACGGACGC GGTCGCCTCG

451 GGCGAAACCT ATGGGCGCGT GTTCGCCGAT ATTTTCGAGT TGTCGGCGGC

501 TTTGGAA
```

This corresponds to the amino acid sequence <SEQ ID 1036; ORF 259-1.ng>:

```
g259-1.pep
    1 MMMHASVQSR FAPILYVLIF FAGFLTAQIW FNQKAYTEEL PPLLSALSAV

51 ALVWLAWAFV SVRSKAKAEK FYREKMIQNE SIHPVLHASL QHLEHKPQML

101 ALLVKNHGKG MAEQVRFKAE VLPDDEDART IAAELAKMDM FALGTDAVAS

151 GETYGRVFAD IFELSAALE
```

The following partial DNA sequence was identified in *N. meningitidis* <SEQ ID 1037>:

```
m259-1.seq
    1 ATGATGATGC ACGCTTCTGT CCAAAGCCGT TTCGCACCGA TACTTTATGT

51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GCGTTCGTG TCGGCGCGTT CAAAGGCCAA

201 GGCGGAAAAG TTCTACCGCG AAAAAATGAT ACAGAACGAA AGCATACACC

251 CCGTCCTGCA CGCCTCTTTG CAACACTTGG AACACAAGCC GCAAATACTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG
```

-continued

```
401 AGTTGGCAAA AATGGATATG TTCGCATTGG GGACGGACGC GGTCGCCTCG

451 GGCGAAACCT ATGGACGCGT GTTCGCCGAT ATTTTCGAGT TGTCGGCGGC

501 TTTGGAAGGG CGCGCGTTCA AAGGAATGTT GAAACTGACG GCGGAATATA

551 AAAACATCTT CGGCGATGCC TGCCGTTCGG AAACGGCGTT GGAGTTGGGC

601 GCACTCAATC AGGCGTTGCA GGAGATTTCA AAAACATCGG AAAAGTCCAA

651 ACGGATATTT TATTGA
```

This corresponds to the amino acid sequence <SEQ ID 1038; ORF 259-1>:

```
m259-1.pep

1 MMMHASVQSR FAPILYVLIF FAGFLTAQIW FNQKAYTEEL PPLLSALSAV

51 ALVWLAWAFV SARSKAKAEK FYREKMIQNE SIHPVLHASL QHLEHKPQIL

101 ALLVKNHGKG MAEQVRFKAE VLPDDEDART IAAELAKMDM FALGTDAVAS

151 GETYGRVFAD IFELSAALEG RAFKGMLKLT AEYKNIFGDA CRSETALELG

201 ALNQALQEIS KTSEKSKRIF Y* g259-1/m259-1    98.8% indentity in 169 aa overlap 10        20        30        40        50        60
g259-1.pep   MMMHASVQSRFAPILYVLIFFAGFLTAQIWFNQKAYTEELPPLLSALSAVALVWLAWAFV
             ||||||||||||||||||||||||||||||||||||||||||||||||||||||||||||
m259-1       MMMHASVQSRFAPILYVLIFFAGFLTAQIWFNQKAYTEELPPLLSALSAVALVWLAWAFV
                    10        20        30        40        50        60

70        80        90       100       110       120
g259-1.pep   SVRSKAKAEKFYREKMIQNESIHPVLHASLQHLEHKPQMLALLVKNHGKGMAEQVRFKAE
             |:||||||||||||||||||||||||||||||||||||:|||||||||||||||||||||
m259-1       SARSKAKAEKFYREKMIQNESIHPVLHASLQHLEHKPQILALLVKNHGKGMAEQVRFKAE
                    70        80        90       100       110       120

130       140       150       160    169
g259-1.pep   VLPDDEDARTIAAELAKMDMFALGTDAVASGETYGRVFADIFELSAALE
             ||||||||||||||||||||||||||||||||||||||||||||||||
m259-1       VLPDDEDARTIAAELAKMDMFALGTDAVASGETYGRVFADIFELSAALEGRAFKGMLKLT
                   130       140       150       160       170       180
```

The following partial DNA sequence was identified in *N. meningitidis* <SEQ ID 1039>:

```
a259-1.seq
  1 ATGATGATGC ACGCTTCTGT CCAAAGCCGT TCGCACCGA TACTTTATGT

51 TTTGATTTTC TTTGCCGGTT TTTTGACCGC GCAAATCTGG TTCAATCAGA

101 AAGCCTATAC TGAAGAGCTG CCTCCGCTTC TGTCCGCATT GTCCGCCGTC

151 GCGCTGGTGT GGCTGGCGTG GGCGTTCGTG TCGGCGCGTT CAAAGGCTAA

201 GGCGGAAAAG TTCTACCGCG AAAAAATGAT ACAGAACGAA AGCATACACC

251 CCGTCCTGCA CGCTTCTTTG CAACACTTGG AACACAAGCC GCAAATGCTC

301 GCCCTGCTGG TCAAAAACCA CGGCAAAGGG ATGGCGGAAC AGGTCAGGTT

351 CAAGGCGGAA GTGCTGCCCG ACGACGAAGA CGCGCGCACG ATTGCCGCCG

401 AGTTGGCAAA AATGGATATG TTTGCATTGG GGACGGACGC GGTCGCCTCG

451 GGCGAAACCT ATGGACGCGT GTTCGCCGAT ATTTTCGAGT TGTCGGCGGC

501 TTTGGAAGGG CGCGCGTTCA AAGGAATGTT GAAACTGACG GCGGAATATA

551 AAAACATCTT CGGCGATGCC TGCCGTTCGG AAACGGCGTT GGAGTTGGGC
```

-continued

```
601 GCGCTCAATC AGGCGTTGCA GGAGATTTCA AAAACATCGG AAAAGTCCAA

651 ACGGATATTT TATTGA
```

This corresponds to the amino acid sequence <SEQ ID 1040; ORF 259-1.a>:

```
a259-1.pep

1 MMMHASVQSR FAPILYVLIF FAGFLTAQIW FNQKAYTEEL PPLLSALSAV

51 ALVWLAWAFV SARSKAKAEK FYREKMIQNE SIHPVLHASL QHLEHKPQML

101 ALLVKNHGKG MAEQVRFKAE VLPDDEDART IAAELAKMDM FALGTDAVAS

151 GETYGRVFAD IFELSAALEG RAFKGMLKLT AEYKNIFGDA CRSETALELG

201 ALNQALQEIS KTSEKSKRIF_Y* g259-1/m259-1    99.5% indentity in 221 aa overlap 10         20         30         40         50         60
    a259-1.pep   MMMHASVQSRFAPILYVLIFFAGFLTAQIWFNQKAYTEELPPLLSALSAVALVWLAWAFV
                 ||||||||||||||||||||||||||||||||||||||||||||||||||||||||||||
    m259-1       MMMHASVQSRFAPILYVLIFFAGFLTAQIWFNQKAYTEELPPLLSALSAVALVWLAWAFV
                    10         20         30         40         50         60

70         80         90        100        110        120
    a259-1.pep   SARSKAKAEKFYREKMIQNESIHPVLHASLQHLEHKPQMLALLVKNHGKGMAEQVRFKAE
                 |||||||||||||||||||||||||||||||||||||||:||||||||||||||||||||
    m259-1       SARSKAKAEKFYREKMIQNESIHPVLHASLQHLEHKPQILALLVKNHGKGMAEQVRFKAE
                    70         80         90        100        110        120

130        140        150        160        169        180
    a259-1.pep   VLPDDEDARTIAAELAKMDMFALGTDAVASGETYGRVFADIFELSAALEGRAFKGMLKLT
                 ||||||||||||||||||||||||||||||||||||||||||||||||||||||||||||
    m259-1       VLPDDEDARTIAAELAKMDMFALGTDAVASGETYGRVFADIFELSAALEGRAFKGMLKLT
                   130        140        150        160        170        180

190        200        210        220
    a259-1.pep   AEYKNIFGDACRSETALELGALNQALQEISKTSEKSKRIFYX
                 |||||||||||||||||||||||||||||||||||||||||
    m259-1       AEYKNIFGDACRSETALELGALNQALQEISKTSEKSKRIFYX
                   190        200        210        220
```

The following partial DNA sequence was identified in *N. gonorrhoeae* <SEQ ID 1041>:

```
g260.seq
  1 atgggtgcgg gtgtagtatt cgttgtcttt cagccgttct tcagcctgtt 51 tcgagcgttg ttcgagggcg gagtcggtat agtcgaggga gcgcacgatg 101 ccgctgaatg cgacttcttg tccgaggaat ttacccgtat ccggatcggt 151 gatgttttta ttgattcggt aggtcagata acggcccggt tctttcaggc 201 ctttggtgta aaccctggcg cctttggtgt acagcagcct gccttccggg 251 cccgagagca ggcgcggcgc ggcagcggtt tctttgcggg aaacgatttg 301 cgggtgctgc ataaagacgc ggtagaagtt gacatcgatg gcgggaatac 351 cgtatccgga cacttcctta tccggactga ttttgacgac ggggatgccg 401 tctgtctgtt ccaagccgag gcgcggttcg ccgccaacgt agcgcaacac 451 caatacctgg cccggataaa tcaggtcggg attgtggatt tgatcccggt 501 tcgcgcccca caggggggga ccattgccac gggctgtaca ggtatttgcc 551 cgaaataccc cacagggtgt cgccctgttt ga
```

This corresponds to the amino acid sequence <SEQ ID 1042; ORF 260.ng>:

```
g260.pep
    1 MGAGVVFVVF QPFFSLFRAL FEGGVGIVEG AHDAAECDFL SEEFTRIRIG

51 DVFIDSVGQI TARFFQAFGV NPGAFGVQQP AFRAREQARR GSGFFAGNDL

101 RVLHKDAVEV DIDGGNTVSG HFLIRTDFDD GDAVCLFQAE ARFAANVAQH

151 QYLARINQVG IVDLIPVRAP QGGTIATGCT GICPKYPTGC RPV*
```

The following partial DNA sequence was identified in *N. meningitidis* <SEQ ID 1043>:

```
m260.seq
    1 ATGGGTGCGG GTATGGTATT CGTTGTCTTT CGGCCGTTCT CCAGCCTGTT

51 TCGAGCGTTG TTCGAGGACA GAGTCGGTAT AGTCGAGGGA GCGCACGATG

101 CCGCTGAATG CGACTTCCTG CCCGAGGAAT TTACCCGTAT CCGGATCGGT

151 GATGTTTTTA TTGATTCGGT AGGTCAGGTA GCGGCCCGGC TCTTTCAGGC

201 CTTTGGTGTA AACCCTGGTG CCTTTGGTGT ACAGCAGCCT GCCTTCCGGG

251 CCCGAGwrCA sGCGCGGyGC GGCAGCGGTT TCTTTGCGGG AAACGATTTG

301 CGGATGCCGC ATAAAGATGC GGTAGAAGTT GACATCGATG GCGGGAATAC

351 CGTATCCGGA CACTTCCTTA TCCGGACTCA TTTTGACGAC GGGGATGCCG

401 TCTGTCTGTT CCAAGCCGAG GCGCGGTTCG CCGTCAACGT GGCGCAACAC

451 CAATACCTGG TCCGGATAAA TCAGGTCGGG ATTGTGGATT TGATCCCGGT

501 TCGCGTyCCA CAG
```

This corresponds to the amino acid sequence <SEQ ID 1044; ORF 260>:

```
m260.pep
    1 MGAGMVFVVF RPFSSLFRAL FEDRVGIVEG AHDAAECDFL PEEFTRIRIG

51 DVFIDSVGQV AARLFQAFGV NPGAFGVQQP AFRARXXARX GSGFFAGNDL

101 RMPHKDAVEV DIDGGNTVSG HFLIRTHFDD GDAVCLFQAE ARFAVNVAQH

151 QYLVRINQVG IVDLIPVRVP Q
```

Computer analysis of this amino acid sequence gave the following results:
Homology with a Predicted ORF from *N. gonorrhoeae*
ORF 260 shows 89.5% identity over a 171 aa overlap with a predicted ORF (ORF 260.ng) from *N. gonorrhoeae*:

```
    m260/g260
                      10         20         30         40         50         60
    m260.pep  MGAGMVFVVFRPFSSLFRALFEDRVGIVEGAHDAAECDFLPEEFTRIRIGDVFIDSVGQV
              ||||:||||||:|| ||||||||| ||||||||||||||||| |||||||||||||||||:
    g260      MGAGVVFVVFQPFFSLFRALFEGGVGIVEGAHDAAECDFLSEEFTRIRIGDVFIDSVGQI
                      10         20         30         40         50         60

70         80         90        100        110        120
    m260.pep  AARLFQAFGVNPGAFGVQQPAFRARXXARXGSGFFAGNDLRMPHKDAVEVDIDGGNTVSG
              :||:|||||||||||||||||||||   ||  ||||||||||||:||||||||||||||||
    g260      TARFFQAFGVNPGAFGVQQPAFRAREQARXGSGFFAGNDLRVLHKDAVEVDIDGGNTVSG
                      70         80         90        100        110        120

130        140        150        160        170
    m260.pep  HFLIRTHFDDGDAVCLFQAEARFAVNVAQHQYLVRINQVGIVDLIPVRVPQ
              ||||||  |||||||||||||||||:||||||||:||||||||||||||:||
    g260      HFLIRTDFDDGDAVCLFQAEARFAANVAQHQYLARINQVGIVDLIPVRAPQGGTIATGCT
                     130        140        150        160        170        180
```

```
g260         GICPKYPTGCRPV
                 190
```

The following partial DNA sequence was identified in *N. meningitidis* <SEQ ID 1045>:

```
a260.seq
   1 ATGGGTGCGG GTATGGTATT CGTTGTCTTT CGGCCGTTCT CCAGCCTGTT

51 TCGAGCGTTG TTCGAGGACA GAGTCGGTAT AGTCGAGGGA GCGCACGATG

101 CCGCTGAATG CGACTTCCTG CCCGAGGAAT TTACCCGTAT CCGGATCGGT

151 GATGTTTTTA TTGATTCGGT AGGTCAGGTA GCGGCCCGGC TCTTTCAGGC

201 CTTTGGTGTA AACCCTGGTG CCTTTGGTGT ACAGCAGCCT GCCTTCCGGG

251 CCCGAGAGCA GGCGCGGCGC GGCAGCGGTT TCTTTGCGGG AAACGATTTG

301 CGGGTGCCGC ATAAAGATGC GGTAGAAGTT GACATCGATG GCGGGAATAC

351 CGTATCCGGA CACTTCCTTA TCCGGACTCA TTTTGACGAC GGGGATGCCG

401 TCTGTCTGTT CCAAGCCGAG GCGCGGTTCG CCGTCAACGT GGCGCAACAC

451 CAATACCTGG TCCAGATAAA TCAGGTCGGG ATTGTGGATT TGATCCCGGT

501 TCGCGTCCCA CAGGCGGCC. CCATTGCCAC GGGCTGTACA GGTATTTGCC

551 CGAAATGCCC CACAGGGTGT CGCCCTGTTT GA
```

This corresponds to the amino acid sequence <SEQ ID 1046; ORF 260.a>:

```
a260.pep
   1 MGAGMVFVVF RPFSSLFRAL FEDRVGIVEG AHDAAECDFL PEEFTRIRIG

51 DVFIDSVGQV AARLFQAFGV NPGAFGVQQP AFRAREQARR GSGFFAGNDL

101 RVPHKDAVEV DIDGGNTVSG HFLIRTHFDD GDAVCLFQAE ARFAVNVAQH

151 QYLVQINQVG IVDLIPVRVP QAAXIATGCT GICPKCPTGC RPV*
``` m260/a260 97.1% identity in 171 aa overlap

```
                   10         20         30         40         50         60
    m260.pep  MGAGMVFVVFRPFSSLFRALFEDRVGIVEGAHDAAECDFLPEEFTRIRIGDVFIDSVGQV
              ||||||||||||||||||||||||||||||||||||||||||||||||||||||||||||
    a260      MGAGMVFVVFRPFSSLFRALFEDRVGIVEGAHDAAECDFLPEEFTRIRIGDVFIDSVGQV
                   10         20         30         40         50         60

70         80         90        100        110        120
    m260.pep  AARLFQAFGVNPGAFGVQQPAFRARXXARXGSGFFAGNDLRMPHKDAVEVDIDGGNTVSG
              ||||||||||||||||||||||||||   ||  |||||||||:|||||||||||||||||
    a260      AARLFQAFGVNPGAFGVQQPAFRAREQARRGSGFFAGNDLRVPHKDAVEVDIDGGNTVSG
                   70         80         90        100        110        120

130        140        150        160        170
    m260.pep  HFLIRTHFDDGDAVCLFQAEARFAVNVAQHQYLVRINQVGIVDLIPVRVPQ
              ||||||||||||||||||||||||||||||||||:|||||||||||||||
    a260      HFLIRTHFDDGDAVCLFQAEARFAVNVAQHQYLVQINQVGIVDLIPVRVPQAAXIATGCT
                  130        140        150        160        170        180 a260      GICPKCPTGCRPVX
                  190
```

The following partial DNA sequence was identified in *N. gonorrhoeae* <SEQ ID 1047>:

```
g261.seq
   1 atggagcttg ggcatatcgt attccttgtg ctttgcgcgc gttcagacgg 51 cctttttact ttccagacat tccgccagcc cgcgttcgcg caagatacag
```

```
101 ctcgggcatt cgcggcagcc gccgacgata cccttgtagc aggtgtgggt 151 ctgttcgcgg atgtagtcca acacgcccat ttcgtccgcc aacgcccacg 201 tttgcgcctt ggtcaggtac atcagcggcg tgtggatttg aaaatcgtag 251 tccatcgcca gattaagggt aacgttcatg gatttgacga acacgccgcg 301 gcagtcggga tagcccgaaa aatcggtttc gcacacgccc gcgatgatgt 351 gccggatacc ctgcccttgt gcaaaaatgg cggcgtaaag caggaaaagc 401 gcgttacgcc cgtccacaaa ggtattggga acgccgttgt cggcggtttc 451 gatggcggcg gtttcgatgg cggcggtttc gtccatcagg gcgttgtgcg 501 taatctgccg catcaggctc aaatcgagta cggtttgact gacacccaaa 551 tcctgcgcga tccactctgc gcgttccagc tcgacggcat ggcgttgccc 601 gtatcggaag gtgatggctt ggacgttttc gcgcccgtag gtttggattg 651 cctgaatcag gcaggtggtc gaatcctgac cgcccgagaa gatgaccaag 701 gcttttggt ttga
```

This corresponds to the amino acid sequence <SEQ ID 1048; ORF 261.ng>:

```
g261.pep
  1 MELGHIVFLV LCARSDGLFT FQTFRQPAFA QDTARAFAAA ADDTLVAGVG

51 LFADVVQHAH FVRQRPRLRL GQVHQRRVDL KIVVHRQIKG NVHGFDEHAA

101 AVGIARKIGF AHARDDVPDT LPFGKNGGVK QEKRVTPVHK GIGNAVVGGF

151 DGGGFDGGGF VHQGVVRNLP HQAQIEYGLT DTQILRDPLC AFQLDGMALP

201 VSEGDGLDVF APVGLDCLNQ AGGRILTARE DDQGFLV*
```

The following partial DNA sequence was identified in N. meningitidis <SEQ ID 1049>:

```
m261.seq
  1 ATGGAGCTTG GCATATCGT ATTCCTTATG GTTTGCGCGT GTTCAGACGG

51 CCTTTTTACT TTCCAGATAT TCCGCCAGCC cGcGTTCGCG CAAGATACAG

101 CTCGGGCATT CGCGgCAGCC GCCGACGATG CCGTTATAGC AGGTGTGGGT

151 TTGCTCGCGG ATATAGTCCA GCACGCCCAT TTCGTCCGCC AACGCCCACG

201 TTTGCGCCTT GGTCAGATAC ATCAGCGGCG TGTGGATTTG AAAATCATAG

251 TCCATCGCCA AATTAAGGGT AACGTTCATC GATTTGACAA ACACGTCGCG

301 GCAGTCGGGA TAGCCGGAGA AGTCGGTTTC GCACACGCCC GCGATGATGT

351 GCCGTATCCC CTGCCCTTTG GCGTAAATCG CGGCATAGAG CAGGAAAAGC 401 gCGTTGCGGC CGTCTACAAA GGTATTCGGA ACGCCGTTTT CGGCAGTTTC

451 GATGGCGGCG GTGTCGTCCA TCAGGGCATT GTGCGTAATC TGCCGCATCA

501 GgCTcAAGTC GAGTACGGTT TGTTTGACGC CCAAATCCTG CGCAATCCAG

551 CGGGCACGTT CCAGCTCGAC GGCATGGCGT TGCCCGTATT GGAAAGTAAT

601 GGCTTGGACG TTTTCGCGCC CGTAGGTTTG GATTGCCTGA ATCAGGCAGG

651 TGGTCGAATC CTGACCGCCC GAAAAGATGA CCAAGGCTTG TTGGTTTGA
```

This corresponds to the amino acid sequence <SEQ ID 1050; ORF 261>:

```
m261.pep
  1 MELGHIVFLM VCACSDGLFT FQIFRQPAFA QDTARAFAAA ADDAVIAGVG

51 LLADIVQHAH FVRQRPRLRL GQIHQRRVDL KIIVHRQIKG NVHRFDKHVA

101 AVGIAGEVGF AHARDDVPYP LPFGVNRGIE QEKRVAAVYK GIRNAVFGSF

151 DGGGVVHQGI VRNLPHQAQV EYGLFDAQIL RNPAGTFQLD GMALPVLESN

201 GLDVFAPVGL DCLNQAGGRI LTARKDDQGL LV*
```

Computer analysis of this amino acid sequence gave the following results:
Homology with a Predicted ORF from *N. gonorrhoeae*
ORF 261 shows 79.7% identity over a 237 aa overlap with a predicted ORF (ORF 261.ng) from *N. gonorrhoeae*:

```
m261/g261

10         20         30         40         50         60
    m261.pep  MELGHIVFLMVCACSDGLFTFQIFRQPAFAQDTARAFAAAADDAVIAGVGLLADIVQHAH
              ||||||||::|| |||||||| ||||||||||||||||||||:::||||:||:|||||
    g261      MELGHIVFLVLCARSDGLFTFQTFRQPAFAQDTARAFAAAADDTLVAGVGLFADVVQHAH
                 10         20         30         40         50         60

70         80         90        100        110        120
    m261.pep  FVRQRPRLRLGQIHQRRVDLKIIVHRQIKGNVHRFDKHVAAVGIAGEVGFAHARDDVPYP
              ||||||||||||:|||||||||:||||||||| ||:|:||||| ::|||||||||||||
    g261      FVRQRPRLRLGQVHQRRVDLKIVVHRQIKGNVHGFDEHAAAVGIARKIGFAHARDDVPDT
                 70         80         90        100        110        120

130        140        150        160        170
    m261.pep  LPFGVNRGIEQEKRVAAVYKGIRVAVFGSFDGGGV-----VHQGIVRNLPHQAQVEYGLF
              ||||  | |::||||| :|:|||  |||:|||||     ||||:|||||||||:|||
    g261      LPFGKNGGVKQEKRVTPVHKGIGNAVVGGFDGGGFDGGGFVHQGVVRNLPHQAQIEYGLT
                130        140        150        160        170        180

180        190        200        210        220        230
    m261.pep  DAQILRNPAGTFQLDGMALPVLESNGLDVFAPVGLDCLNQAGGRILTARKDDQGLLVX
              |:||||:   :|||||||||||:::|:||||||||||||||||||||||:||||:|||
    g261      DTQILRDPLCAFQLDGMALPVSEGDGLDVFAPVGLDCLNQAGGRILTAREDDQGFLVX
                190        200        210        220        230
```

The following partial DNA sequence was identified in *N. meningitidis* <SEQ ID 1051>:

```
a261.seq
  1 ATGGAGCTTG GGCATATCGT ATTCCTTATG GTTTGCGCGT GTTCAGACGG

51 CCTTTTTACT TTCCAGATAT TCCGCCAGCC CGCGTTCGCG CAAGATACAG

101 CTCGGGCATT CGCGGCAGCC GCCGACGATG CCGTTATAGC AGGTGTGGGT

151 TTGCTCGCGG ATATAGTCCA GCGCGCCCAT TTCGTCCGCC AACGCCCAAG

201 TTTGCGCCTT GGTCAGATAC ATCAGCGGCG TGTGGATTTG AAAATCATAG

251 TCCATCGCCA GATTAAGGGT AACGTTCATG GATTTGACAA ACACGTCACG

301 GCAGTCGGGA TAGCCGGAGA AGTCGGTTTC GCACACGCCC GCGATGATGT

351 GCCGTATCCC CTGCCCTTTG GCGTAAATCG GGCATAGAG CAGGAAAAGC

401 GCGTTGCGGC CGTCTACAAA GGTATTCGGA ACGCCGTTTT CGGCAGTTTC

451 GATGGCGGCG GTGTCGTCCA TCAGGGCATT GTGCGTAATC TGCCGCATCA

501 GGCTCAAGTC GAGTACGGTT TGTTTGACGC CCAAATCCTG CGCAATCCAG

551 CGGGCACGTT CCAGCTCGAC GGCATGGCGT TGCCCGTATT GGAAAGTAAT

601 GGCTTGGACG TTTTCGCGCC CGTAGGTTTG GATTGCCTGA ATCAGGCAGG

651 TGGTCGAATC CTGACCGCCC GAAAAGATGA CCAAGGCTTT TTGGTTTGA
```

This corresponds to the amino acid sequence <SEQ ID 1052; ORF 261.a>:

```
a261.pep
  1 MELGHIVFLM VCACSDGLFT FQIFRQPAFA QDTARAFAAA ADDAVIAGVG

51 LLADIVQRAH FVRQRPSLRL GQIHQRRVDL KIIVHRQIKG NVHGFDKHVT

101 AVGIAGEVGF AHARDDVPYP LPFGVNRGIE QEKRVAAVYK GIRNAVFGSF

151 DGGGVVHQGI VRNLPHQAQV EYGLFDAQIL RNPAGTFQLD GMALPVLESN

201 GLDVFAPVGL DCLNQAGGRI LTARKDDQGF LV*
``` m261/a261 97.8% identity in 232 aa overlap

```
                 10         20         30         40         50         60
    m261.pep  MELGHIVFLMVCACSDGLFTFQIFRQPAFAQDTARAFAAAADDAVIAGVGLLADIVQHAH
              |||||||||||||||||||||||||||||||||||||||||||||||||||||||||:||
        a261  MELGHIVFLMVCACSDGLFTFQIFRQPAFAQDTARAFAAAADDAVIAGVGLLADIVQRAH
                 10         20         30         40         50         60

70         80         90        100        110        120
    m261.pep  FVRQRPRLRLGQIHQRRVDLKIIVHRQIKGNVHRFDKHVAAVGIAGEVGFAHARDDVPYP
              ||||||  ||||||||||||||||||||||||||||| |||:||||||||||||||||||
        a261  FVRQRPSLRLGQIHQRRVDLKIIVHRQIKGNVHGFDKHVTAVGIAGEVGFAHARDDVPYP
                 70         80         90        100        110        120

130        140        150        160        170        180
    m261.pep  LPFGVNRGIEQEKRVAAVYKGIRNAVFGSFDGGGVVHQGIVRNLPHQAQVEYGLFDAQIL
              ||||||||||||||||||||||||||||||||||||||||||||||||||||||||||||
        a261  LPFGVNRGIEQEKRVAAVYKGIRNAVFGSFDGGGVVHQGIVRNLPHQAQVEYGLFDAQIL
                130        140        150        160        170        180

190        200        210        220        230
    m261.pep  RNPAGTFQLDGMALPVLESNGLDVFAPVGLDCLNQAGGRILTARKDDQGLLVX
              |||||||||||||||||||||||||||||||||||||||||||||||||:|||
        a261  RNPAGTFQLDGMALPVLESNGLDVFAPVGLDCLNQAGGRILTARKDDQGFLVX
                190        200        210        220        230
```

The following partial DNA sequence was identified in *N. gonorrhoeae* <SEQ ID 1053>:

```
g263.seq
  1 atggcacgtt taaccgtaca caccctcgaa accgccccg aagccgccaa 51 accgcgcgta gaggccgtac ccaaaaacaa cggctttatc cccaacctca 101 tcggcgtatt ggcaaacgcc cccgaagctt ggcgttttta ccaagaagtc 151 ggcaagctca acgccgccaa cagcctgacc gccggcgaag tcgaagtgat 201 ccggatcatc gccgtccgca ccaaccaatg cagcttctgc gtggcagggc 251 acaccaaact cgcaaccctg aaaaaactcc tgtccgagca atccctcaat 301 gccgcccgcg cttttggcgg caggtaaatct gacgatgcca aactcggcgc 351 gcttgccgcc ttcacccaag ccgtaatggc gaaaaaaggc gcagtatccg 401 acgacgaact caacgccttc ctcgaagcgg gctacaaccg gcagcaggca 451 gtcgaagtcg taatgggcgt agccttggca actttgtgca actacgccaa 501 caacctcgcc caaaccgaaa tcaaccccaa attgcaggca tacgcctaa
```

This corresponds to the amino acid sequence <SEQ ID 1054; ORF 263.ng>:

```
g263.pep
  1 MARLTVHTLE TAPEAAKPRV EAVPKNNGFI PNLIGVLANA PEALAFYQEV

51 GKLNAANSLT AGEVEVIRII AVRTNQCSFC VAGHTKLATL KKLLSEQSLN
```

```
101 AARALAAGKS DDAKLGALAA FTQAVMAKKG AVSDDELNAF LEAGYNRQQA

151 VEVVMGVALA TLCNYANNLA QTEINPKLQA YA*
```

The following partial DNA sequence was identified in *N. meningitidis* <SEQ ID 1055>:

```
m263.seq (partial)
    1 ..GCAGCAGGCG AATTTGACGA TGCCAAACTC GGCGCGCTCG CCGCCTTCAC

51   CCAAGCCGTA ATGGCGAAAA AAGGCGCGGT ATCCGACGAG GAACTCAAAG

101   CATTTTTCGA TGCGGGCTAC AACCAGCAGC AGGCAGTCGA AGTCGTGATG

151   GGCGT.AsyC TgGCAACCCT GTGCAACTAC GTCAACAACC TCGGACAAAC

201   CGAAATCAAC CCCGAATTGC AGGCTTACGC CTGA
```

This corresponds to the amino acid sequence <SEQ ID 1056; ORF 263>:

```
m263.pep (partial)
    1 ..GCAGCAGGCG AATTTGACGA TGCCAAACTC GGCGCGCTCG CCGCCTTCAC

51   CCAAGCCGTA ATGGCGAAAA AAGGCGCGGT ATCCGACGAG GAACTCAAAG

101   CATTTTTCGA TGCGGGCTAC AACCAGCAGC AGGCAGTCGA AGTCGTGATG

151   GGCGT.AsyC TgGCAACCCT GTGCAACTAC GTCAACAACC TCGGACAAAC

201   CGAAATCAAC CCCGAATTGC AGGCTTACGC CTGA
```

Computer analysis of this amino acid sequence gave the following results:
Homology with a Predicted ORF from *N. gonorrhoeae*
ORF 263 shows 85.7% identity over a 77 aa overlap with a predicted ORF (ORF 263.ng) from *N. gonorrhoeae*:

```
    m263/g263
                                                       10        20        30
        m263.pep                                AAGEFDDAKLGALAAFTQAVMAKKGAVSDE
                                                |||: ||||||||||||||||||||||||:
        g263    QCSFCVAGNTKLATLKKLLSEQSLNAARALAAGKSDDAKLGALAAFTQAVMAKKGAVSDD
                    80        90       100       110       120       130

40        50        60        70
        m263.pep  ELKAFFDAGYNQQQAVEVVMGVXLATLCNYVNNLGQTEINPELQAYAX
                  ||:||::||||:||||||||||| |||||||:|||:||||||:|||||
        g263     ELNAFLEAGYNRQQAVEVVMGVALATLCNYANNLAQTEINPKLQAYAX
                   140       150       160       170       180
```

The following partial DNA sequence was identified in *N. meningitidis* <SEQ ID 1057>:

```
a263.seq
    1 ATGGCACGTT TAACCGTACA CACCCTCGAA ACCGCCCCCG AAGCCGCCAA

51 AGCGCGCGTC GAGGCGGTAC TTCAAAACAA CGGCTTTATC CCCAACCTTA

101 TCGGCGTATT ATCAAACGCC CCCGAAGCCT TGGCGTTTTA CCAAGAAGTC

151 GGCAAGCTCA ACGCCGCCAA CAGCCTGACC GCCGGCGAAG TCGAAGTAAT

201 CCAGATTATT GCCGCCCGCA CCAACCAATG CGGCTTCTGC GTGGCAGGGC

251 ACACCAAACT CGCAACCCTG AAAAAACTCC TTTCCGAACA ATCCGTCAAA

301 GCCGCGCGCG CTTTGGCGGC AGGCGAATTT GACGATGCTA AACTCGGCGC
```

```
-continued
351 GCTCGCCGCC TTTACCCAAG CCGTAATGGC AAAAAAGGC GCGGTATCCG

401 ACGAGGAACT CAAAGCATTT TTTGATGCGG GCTACAACCA GCAGCAGGCA

451 GTCGAAGTCG TGATGGGCGT AGCCTTGGCA ACTTTGTGCA ACTACGTCAA

501 CAACCTCGGA CAAACCGAAA TCAACCCCGA ATTGCAGGCT TACGCCTGA
```

This corresponds to the amino acid sequence <SEQ ID 1058; ORF 263.a>:

```
a263.pep
  1 MARLTVHTLE TAPEAAKARV EAVLQNNGFI PNLIGVLSNA PEALAFYQEV

51 GKLNAANSLT AGEVEVIQII AARTNQCGFC VAGHTKLATL KKLLSEQSVK

101 AARALAAGEF DDAKLGALAA FTQAVMAKKG AVSDEELKAF FDAGYNQQQA

151 VEVVMGVALA TLCNYVNNLG QTEINPELQA YA*
``` m263/a263 97.4% identity in 77 aa overlap

```
                                    10        20        30
       m263.pep                  AAGEFDDAKLGALAAFTQAVMAKKGAVSDE
                                 ||||||||||||||||||||||||||||||
       a263     QCGFCVAGHTKLATLKKLLSEQSVKAARALAAGEFDDAKLGALAAFTQAVMAKKGAVSDE
                  80        90       100       110       120       130

40        50        60        70
       m263.pep  ELKAFFDAGYNQQQAVEVVMGXXLATLCNYVNNLGQTEINPELQAYAX
                 |||||||||||||||||||||||   |||||||||||||||||||||||
       a263      ELKAFFDAGYNQQQAVEVVMGVALATLCNYVNNLGQTEINPELQAYAX
                      140       150       160       170       180
```

The following partial DNA sequence was identified in *N. gonorrhoeae* <SEQ ID 1059>:

```
g264.seq
  1 ttgactttaa cccgaaaaac ccttttcctc ctcaccgccg cgttcggcac 51 acactccctt cagacggcat ccgccgacgc agtggtcaag ccggaaaaac 101 tgcacgcctc cgccaaccgc agctacaaag tcgccgaatt cacgcaaacc 151 ggcaacgcct cgtggtacgg cggcaggttt cacgggcgca aaacttccgg 201 cggagaccgc tacgatatga acgcctttac cgccgcccac aaaaccctgc 251 ccatccccag ccatgtgcgc gtaaccaaca ccaaaaacgg caaaagcgtc 301 atcgtccgcg tcaacgaccg cggcccctcc cacggcaacc gcatcatcga 351 cgtatccaaa gccgccgcgc aaaaattggg ctttgtcagc caagggacgg 401 cacacgtcaa aatcgaacaa atcgtcccgg gccaatccgc accggttgcc 451 gaaaacaaag acatctttat cgacttgaaa tctttcggta cggaacacga 501 agcacaagcc tatctgaacc aagccgccca aaatttcgcc gcttcgtcat 551 caagcccgaa cctctcggtt gaaaaacgcc gttacgaata cgttgtcaaa 601 atgggcccgt tgcctcgca ggaacgcgcc gccgaagccg aagcgcaggc 651 acgcggtatg gttcgggcgg tactgacctc cggttga
```

This corresponds to the amino acid sequence <SEQ ID 1060; ORF 264.ng>:

```
g264.pep
  1 LTLTRKTLFL LTAAFGTHSL QTASADAVVK PEKLHASANR SYKVAEFTQT

51 GNASWYGGRF HGRKTSGGDR YDMNAFTAAH KTLPIPSHVR VTNTKNGKSV
```

```
101 IVRVNDRGPF HGNRIIDVSK AAAQKLGFVS QGTAHVKIEQ IVPGQSAPVA

151 ENKDIFIDLK SFGTEHEAQA YLNQAAQNFA ASSSSPNLSV EKRRYEYVVK

201 MGPFASQERA AEAEAQARGM VRAVLTSG*
```

The following partial DNA sequence was identified in *N. meningitidis* <SEQ ID 1061>:

```
m264.seq
   1 TTGACTTTAA CCCGAAAAAC CCTTTTCCTT CTCACCGCCG CATTCGGCAC

51 ACACTCCCTT CAGACGGCAT CCGCCGACGC AGTGGTCAAG GCAGAAAAAC

101 TGCACGCCTC CGCCAACCGC AGCTACAAAG TCGCCGGAAA ACGCTACACG

151 CCGAAAAACC AAGTCGCCGA ATTCACGCAA ACCGGCAACG CCTCGTGGTA

201 CGGCGGCAGG TTTCACGGGC GCAAAACTTC CGGCGGAGAA CGATACGATA

251 TGAACGCCTT TACCGCCGCC CACAAAACCC TGCCCATCCC CAGCTATGTG

301 CGCGTAACCA ATACCAAAAA CGGCAAAAGC GTCATCGTCC GCGTCAACGA

351 CCGCGGCCCC TTCCACGGCA ACCGCATCAT CGACGTATCC AAAGCCGCCG

401 CGCAAAAATT GGGCTTTGTC AACCAAGGGA CGGCACACGT CAAAATCGAA

451 CAAATCGTCC CGGGCCAATC CGCACCGGTT GCCGAAAACA AAGACATCTT

501 TATCGACTTG AAATCTTTCG GTACGGAACA CGAAGCACAA GCCTATCTGA

551 ACCAAGCCGC CCAAAACTTC GCCGTTTCGT CATCGGGTAC GAACCTCTCG

601 GTTGAAAAAC GCCGTTACGA ATACGTCGTC AAAATGGGAC CGTTTACCTC

651 GCAGGAACGC GCCGCCGAAG CCGAAGCTCA GGCGCGCGGT ATGGTTCGGG

701 CGGTATTGAC CGCCGGCTGA
```

This corresponds to the amino acid sequence <SEQ ID 1062; ORF 264>:

```
m264.pep
   1 LTLTRKTLFL LTAAFGTHSL QTASADAVVK AEKLHASANR SYKVAGKRYT

51 PKNQVAEFTQ TGNASWYGGR FHGRKTSGGE RYDMNAFTAA HKTLPIPSYV

101 RVTNTKNGKS VIVRVNDRGP FHGNRIIDVS KAAAQKLGFV NQGTAHVKIE

151 QIVPGQSAPV AENKDIFIDL KSFGTEHEAQ AYLNQAAQNF AVSSSGTNLS

201 VEKRRYEYVV KMGPFTSQER AAEAEAQARG MVRAVLTAG*
```

Computer analysis of this amino acid sequence gave the following results:
Homology with a Predicted ORF from *N. gonorrhoeae*
  ORF 264 shows 91.6% identity over a 239 aa overlap with a predicted ORF (ORF 264.ng) from *N. gonorrhoeae*:

```
   m264/g264

10         20         30         40         50         60
       m264.pep    LTLTRKTLFLLTAAFGTHSLQTASADAVVKAEKLHASANRSYKVAGKRYTPKNQVAEFTQ
                   |||||||||||||||||||||||||||||||||||||||||||||           ||||
       g264        LTLTRKTLFLLTAAFGTHSLQTASADAVVKPEKLHASANRSYKVA-----------EFTQ
                       10         20         30         40

70         80         90        100        110        120
       m264.pep    TGNASWYGGRFHGRKTSGGERYDMNAFTAAHKTLPIPSYVRVTNTKNGKSVIVRVNDRGP
                   |||||||||||||||||||:||||||||||||||||||:|||||||||||||||||||||
       g264        TGNASWYGGRFHGRKTSGGDRYDMNAFTAAHKTLPIPSHVRVTNTKNGKSVIVRVNDRGP
                        50         60         70         80         90        100
```

-continued

```
                 130       140       150       160       170       180
m264.pep  FHGNRIIDVSKAAAQKLGFVNQGTAHVKIEQIVPGQSAPVAENKDIFIDLKSFGTEHEAQ
          ||||||||||||||||||||:|||||||||||||||||||||||||||||||||||||||
g264      FHGNRIIDVSKAAAQKLGFVSQGTAHVKIEQIVPGQSAPVAENKDIFIDLKSFGTEGEAQ
       110       120       130       140       150       160

190       200       210       220       230       240
m264.pep  AYLNQAAQNFAVSSSGTNLSVEKRRYEYVVKMGPFTSQERAAEAEAQARGMVRAVLTAGX
          |||||||||||:|||: ||||||||||||||||||:|||||||||||||||||||||:||
g264      AYLNQAAQNFAASSSSPNLSVEKRRYEYVVKMGPFASQERAAEAEAQARGMVRAVLTSGX
       170       180       190       200       210       220
```

The following partial DNA sequence was identified in *N. meningitidis* <SEQ ID 1063>:

```
a264.seq
   1 TTGACTTTAA CCCGAAAAAC CCTTTTCCTC CTCACCGCCG CATTCGGCAT

51 ACATTCCTTT CAGACGGCAT CCGCCGACGC AGTGGTCAGG GCAGAAAAAC

101 TGCACGCCTC CGCCAACCGC AGCTACAAAG TCGCCGGAAA ACGCTACACG

151 CCGAAAAACC AAGTCGCCGA ATTCACGCAA ACCGGCAACG CCTCGTGGTA

201 CGGCGGCAGG TTTCACGGGC GCAAAACTTC CGGCGGAGAA CGATACGATA

251 TGAACGCCTT TACCGCCGCC CACAAAACCC TGCCCATCCC CAGCTATGTG

301 CGCGTAACCA ATACCAAAAA CGGCAAAAGC GTCATCGTCC GCGTCAACGA

351 CCGCGGCCCC TTCCACGGCA ACCGCATCAT CGACGTATCC AAAGCCGCCG

401 CGCAAAAATT GGGCTTTGTC AACCAAGGGA CGGCGCACGT CAAAATCGAA

451 CAAATCGTCC CGGGCCAATC CGCACCGGTT GCCGAAAACA AAGACATCTT

501 CATCGACTTG AAATCTTTCG GTACGGAACA CGAAGCACAA GCCTATCTGA

551 ACCAAGCCGC CCAAAACCTG GCTTCATCGG CATCAAACCC GAACCTCTCG

601 GTTGAAAAAC GCCGTTACGA ATACGTCGTC AAAATGGGAC CGTTTGCCTC

651 GCAGGAACGC GCCGCCGAGG CCGAAGCTCA GGCGCGCGGT ATGGTTCGGG

701 CGGTATTAAC CGCCGGTTGA
```

This corresponds to the amino acid sequence <SEQ ID 1064; ORF 264.a>:

```
a264.pep
   1 LTLTRKTLFL LTAAFGIHSF QTASADAVVR AEKLHASANR SYKVAGKRYT

51 PKNQVAEFTQ TGNASWYGGR FHGRKTSGGE RYDMNAFTAA HKTLPIPSYV

101 RVTNTKNGKS VIVRVNDRGP FHGNRIIDVS KAAAQKLGFV NQGTAHVKIE

151 QIVPGQSAPV AENKDIFIDL KSFGTEHEAQ AYLNQAAQNL ASSASNPNLS

201 VEKRRYEYVV KMGPFASQER AAEAEAQARG MVRAVLTAG*
``` m264/a264 96.2% identity in 239 aa overlap

```
                   10        20        30        40        50        60
m264.pep  LTLTRKTLFLLTAAFGTHSLQTASADAVVKAEKLHASANRSYKVAGKRYTPKNQVAEFTQ
          |||||||||||||||| ||:|||||||||:||||||||||||||||||||||||||||||
a264      LTLTRKTLFLLTAAFGTHSFQTASADAVVRAEKLHASANRSYKVAGKRYTPKNQVAEFTQ
                  10        20        30        40        50        60

70        80        90       100       110       120
m264.pep  TGNASWYGGRFHGRKTSGGERYDMNAFTAAHKTLPIPSYVRVTNTKNGKSVIVRVNDRGP
          ||||||||||||||||||||||||||||||||||||||||||||||||||||||||||||
a264      TGNASWYGGRFHGRKTSGGERYDMNAFTAAHKTLPIPSYVRVTNTKNGKSVIVRVNDRGP
                  70        80        90       100       110       120
```

```
                130       140       150       160       170       180
m264.pep    FHGNRIIDVSKAAAQKLGFVNQGTAHVKIEQIVPGQSAPVAENKDIFIDLKSFGTEHEAQ
            ||||||||||||||||||||||||||||||||||||||||||||||||||||||||||
a264        FHGNRIIDVSKAAAQKLGFVNQGTAHVKIEQIVPGQSAPVAENKDIFIDLKSFGTEGEAQ
                130       140       150       160       170       180
                190       200       210       220       230       240
m264.pep    AYLNQAAQNFAVSSSGTNLSVEKRRYEYVVKMGPFTSQERAAEAEAQARGMVRAVLTAGX
            |||||||||:| |:|: |||||||||||||||||:|||||||||||||||||||||||
a264        AYLNQAAQNLASSASNPNLSVEKRRYEYVVKMGPFASQERAAEAEAQARGMVRAVLTAGX
                190       200       210       220       230       240
```

The following partial DNA sequence was identified in *N. meningitidis* <SEQ ID 1065>:

```
m265.seq
    1 ATGTCGGTGA TTTTGCCGCC GACACGCGCC AACGCTGCTT TTTCGGCTTG

51 GGCGCGGCTG ATGATTTTGT CTTGTTTGTT GTGTTGGTGT GCGGCGTGTC

101 CGTGGTCGTC ATCGCCGTGT CCGTCGTGGT GGGCGAGCGC GGGGGCGGAA

151 ATGCTCAGCA GTGCGGTTGC GGCGGAGGTC AAGAGAAGGT GTTTGATGTT

201 CATAT.TTTT GCCTTTGTAA ATCGTGGGTT GGAAAATGTG GATATTAATA

251 AGGTATCAAA TAACCGTCAG CCGGCGGTCA ATACCGCCCG AACCATACCG

301 CGCGCCTGAG CTTCGGCTTC GGCGGCGCGT TCCTGCGAGG TAAACGGTCC

351 CATTTTGACG ACGTATTCGT AA
```

This corresponds to the amino acid sequence <SEQ ID 1066; ORF 265>:

```
m265.pep
    1 MSVILPPTRA NAAFSAWARL MILSCLLCWC AACPWSSSPC PSWWASAGAE

51 MLSSAVAAEV KRRCLMFIXF AFVNRGLENV DINKVSNNRQ PAVNTARTIP

101 RAXASASAAR SCEVNGPILT TYS*
```

Computer analysis of this amino acid sequence gave the following results:

Homology with a Predicted ORF from *N. gonorrhoeae*

ORF 265 shows 88.6% identity over a 123 aa overlap with a predicted ORF (ORF 265.ng) from *N. gonorrhoeae*:

```
    m265/g265
                10        20        30        40        50        60
    m265.pep    MSVILPPTRANAAFSAWARLMILSCLLCWCAACPWSSSPCPSWWASAGAEMLSSAVAAEV
                |||||||||:|||||||||||||| |||||||||||||||||||||||| :||||| |
    g265        MSVILPPTRAQAAFSAWARLMILSCLPCWCAACPWSSSPCPSWWASAGAEMPNSAVAAV
                10        20        30        40        50        60
                70        80        90        100       110       120
    m265.pep    KRRCLMFIXFAFVNRGLENVDINKVSNNRQPAVNTARTIPRAXASASAARSCEVNGPILT
                |||||||| ||:||:||:| |||||||||||| :|||||||| ||||||||||:||||||
    g265        KRRCLMFI-FALVNQGLKNGDINKVSNNRQPEVSTARTIPRACASASAARSCEANGPILT
                70        80        90        100       110 m265.pep    TYSX
                ||||
    g265        TYSX
                120
```

The following partial DNA sequence was identified in *N. meningitidis* <SEQ ID 1067>:

```
a265.seq
    1 ATGTCGGTGA TTTTGCCGCC GACACGCGCC AACGCTGCTT TTTCGGCTTG

51 GGCGCGGCTG ATGATTTTGT CTTGTTTGCT GTGTTGGTGT GCGGCGTGTC
```

-continued

```
101 CGTGGTCGTC ATCGCCGTGT CCGTCGTGGT GGGCGAGTGC GGGGGCGGAA

151 ATGCCCATCA GTGCGGTTGC GGCGGCGGTC AAGAGAAGGC GTTTGAAGTT

201 CATTTTTGCT CCTGCGAAGT ATCTGGT... .....GGTGT TTGAAGGACG

251 TAAAGGCGGG ACATCAACCG GCGGTTAATA CCGCCCGAAC CATACCGCGC

301 GCCTGAGCTT CGGCCTCGGC GGCGCGTTCC TGCGAGGCAA ACGGTCCCAT

351 TTTGACGACG TATTCGTAA
```

This corresponds to the amino acid sequence <SEQ ID 1068; ORF 265.a>:

```
a265.pep
  1 MSVILPPTRA NAAFSAWARL MILSCLLCWC AACPWSSSPC PSWWASAGAE

51 MPISAVAAAV KRRRLKFIFA PAKYLX..XC LKDVKAGHQP AVNTARTIPR

101 A*ASASAARS CEANGPILTT YS*
``` m265/a265 79.7% identity in 123 aa overlap

```
                   10         20         30         40         50         60
   m265.pep  MSVILPPTRANAAFSAWARLMILSCLLCWCAACPWSSSPCPSWWASAGAEMLSSAVAAEV
             ||||||||||||||||||||||||||||||||||||||||||||||||| ||||| |
   a265      MSVILPPTRANAAFSAWARLMILSCLLCWCAACPWSSSPCPSWWASAGAEMPISAVAAAV
                   10         20         30         40         50         60

70         80         90        100        110        120
   m265.pep  KRRCLMFIXFAFVNRGLENVDINKVSNNRQPAVNTARTIPRAXASASAARSCEVNGPILT
             ||| | ||   |:       :: |:  ::||||||||||||||||||||||||:|||||
   a265      KRRRLKFI---FAPAKYLXXCLKDVKAGHQPAVNTARTIPRAXASASAARSCEANGPILT
                   70         80         90        100        110 m265.pep  TYSX
             ||||
   a265      TYSX
             120
```

The following partial DNA sequence was identified in *N. gonorrhoeae* <SEQ ID 1069>:

```
g266.seq
  1 agttcagacg gcatcgccgc cgacaatgcc caaacagaaa gcccatcatg 51 accgcatcca tgtacatcct tttggtcttg gcactcatct ttgccaacgc 101 ccccttcctc acgaccagac tgttcggcgt ggccgcgctc aagcgcaaac 151 atttcggaca ccacctgatc gagctggcgg caggtttcgc gctgaccgcc 201 tctcttgcct acatcctcga atcccgtgcg ggagcggtac acaatcaggg 251 ttgggagttt tacgccaccg tcgtctgcct gtacctcatt ttcgccttcc 301 cgtgtttcgt gcggcggtat ttttggcaca cgcgcaacag ggaataa
```

This corresponds to the amino acid sequence <SEQ ID 1070; ORF 266.ng>:

```
g266.pep
  1 MQFRRHRRRQ CPNRKPIMTA SMYILLVLAL IFANAPFLTT RLFGVAALKR

51 KHFGHHLIEL AAGFALTASL AYILESRAGA VHNQGWEFYA TVVCLYLIFA

101 FPCFVRRYFW HTRNRE*
```

The following partial DNA sequence was identified in *N. meningitidis* <SEQ ID 1071>:

```
m266.seq
    1 ATGCCGTTCC GCAACGCGtT cAGACGGCAT CGCCGCCGAC AACGCCTAAA

51 CAGAAAGCCC ACCATGACCG CATCCATGTA CATCCTTTTG GTCTTGGCAC

101 TCATCTTTGC CAACGCCCCC TTCCTCACGA CCAGACTGTT CGGCGTGGCC 151 rCACTCAAGC GCAAACATTT CGGACACCAC ATGATCGAGC TGGCGGCAGG

201 TTTCGCGCTG ACCGCCGTTC TTGCCTACAT CCTsGAATCC CGTGCAGGAT

251 CGGTACACGA TCAGGGTTGG GAGTTTTATG CCACAGTCGT CTGCCTGTAC

301 CTGATTTTTG CGTTTCCATG TTTTGTGTGG CGGTATTTTT GGCACACGCG

351 CAACAGGGAA TAG
```

This corresponds to the amino acid sequence <SEQ ID 1072; ORF 266>:

```
m266.pep
    1 MPFRNAFRRH RRRQRLNRKP TMTASMYILL VLALIFANAP FLTTRLFGVA

51 XLKRKHFGHH MIELAAGFAL TAVLAYILES RAGSVHDQGW EFYATVVCLY

101 LIFAFPCFVW RYFWHTRNRE *
```

Computer analysis of this amino acid sequence gave the following results:
Homology with a Predicted ORF from *N. gonorrhoeae*
ORF 266 shows 92.1% identity over a 114 aa overlap with a predicted ORF (ORF 266.ng) from *N. gonorrhoeae*:

```
m266/g266
                    10         20         30         40         50         60
      m266.pep  MPFRNAFRRHRRRQRLNRKPTMTASMYILLVLALIFANAPFLTTRLFGVAXLKRKHFGHH
                  ||||||||   ||||  |||||||||||||||||||||||||||||||  ||||||||
      g266              MQFRRHRRRQCPNRKPIMTASMYILLVLALIFANAPFLTTRLFGVAALKRKHFGHH
                            10         20         30         40         50
                    70         80         90        100        110        120
      m266.pep  MIELAAGFALTAVLAYILESRAGSVHDQGWEFYATVVCLYLIFAFPCFVWRYFWHTRNREX
                :|||||||||| |||||||||||:||:|||||||||||||||||||||||| ||||||||||
      g266      LIELAAGFALTASLAYILESRAGAVHNQGWEFYATVVCLYLIFAFPCFVRRYFWHTRNREX
                      60         70         80         90        100        110
```

The following partial DNA sequence was identified in *N. meningitidis* <SEQ ID 1073>:

```
a266.seq
    1 ATGCCGTTCC GCAATGCGTT CAGACGGCAT CGCCGCCGAC AATGCCCAAA

51 CAGAAAGCCC GCCATGACCG CATCCATGTA CATCCTTTTG CTGCTTGCCT

101 TGATTTTTGC CAACGCCCCC TTCCTCACGA CCAAGCTGTT CGGCATCGTA

151 CCGCTCAAGC GCAAACATTT CGGACACCAC CTGATCGAGC TGGCGGCAGG

201 TTTCGCGCTG ACCGCCGTTC TTGCCTACAT CCTCGAATCC CGTGCGGGAG

251 CGGTACACGA TCAGGGTTGG GAGTTTTACG CCACCGTCGT CTGCCTGTAC

301 CTGATTTTTG CGTTTCCCTG TTTCGTGTGG CGGTATTTTT GGCACACGCG

351 CAACAGGGAA TAG
```

This corresponds to the amino acid sequence <SEQ ID 1074; ORF 266.a>:

```
a266.pep
   1 MPFRNAFRRH RRRQCPNRKP AMTASMYILL LLALIFANAP FLTTKLFGIV

51 PLKRKHFGHH LIELAAGFAL TAVLAYILES RAGAVHDQGW EFYATVVCLY

101 LIFAFPCFVW RYFWHTRNRE *
``` m266/a266 91.7% identity in 120 aa overlap

```
                  10         20         30         40         50         60
     m266.pep MPFRNAFRRHRRRQRLNRKPTMTASMYILLVLALIFANAPFLTTRLFGVAXLKRKHFGHH
             ||||||||||||||    ||||:||||||||:||||||||||||||:|||::||||||||
        a266 MPFRNAFRRHRRRQCPNRKPAMTASMYILLLLALIFANAPFLTTKLFGIVPKLRKHFGHH
                  10         20         30         40         50         60

70         80         90        100        110        120
     m266.pep MIELAAGFALTAVLAYILESRAGSVHDQGWEFYATVVCLYLIFAFPCFVWRYFWHTRNRE
             :|||||||||||||||||||||:||||||||||||||||||||||||||||||||||||
        a266 LIELAAGFALTAVLAYILESRAGAVHDQGWEFYATVVCLYLIFAFPCFVWRYFWHTRNRE
                  70         80         90        100        110        120 m266.pep X
             |
        a266 X
```

The following partial DNA sequence was identified in *N. gonorrhoeae* <SEQ ID 1075>:

```
g267.seq
   1 atgcaagtcg cctttttct cgccgtggta ttcaaaaata tgggtttcca 51 caatcgcatc ggtcgggcag gcctcttcgc agaaaccgca gaagatgcac 101 ttggtcaggt cgatgtcgta acgcttggtg cggcgggtgc cgtcttcgcg 151 ttcttccgat tcgatgttga tcgccattgc cggacacacc gcctcgcaca 201 atttacacgc gatgcagcgt tcctctccgt tcggaaaacg gcgttgcgcg 251 tgcagaccgc ggaaacgcac ggattgcggc gttttctctt cgggaaaata 301 aattgtgtct ttgcgggcaa aaaagttttt gagcgttacg cccatgcctt 351 tgaccagttc gccaagcaga aaggttttta ctaa
```

This corresponds to the amino acid sequence <SEQ ID 1076; ORF 267.ng>:

```
g267.pep
   1 MQVAFFLAVV FKNMGFHNRI GRAGLFAETA EDALGQVDVV TLGAAGAVFA

51 FFRFDVDRHC RTHRLAQFTR DAAFLSVRKT ALRVQTAETH GLRRFLFGKI

101 NCVFAGKKVF ERYAHAFDQF AKQKGFY*
```

The following partial DNA sequence was identified in *N. meningitidis* <SEQ ID 1077>:

```
m267.seq
   1 GTGCAAGTCG CCTTTTTTCT CGCCGTGGTA TTCAAAAATA TGGGTTTCCA

51 CAATCGCATC AGTCGGGCAT GCCTCTTCGC AGAAACCGCA GAAGATGCAC

101 TTGGTCAGGT CGATGTCGTA ACGCTTGGTG CGGCGCGTAC CGTCTTCACG

151 TTCTTCCGAT TCGATGTTAA TCGCCATTGC CGGACACACT GCCTCACACA

201 ACTTACACGC GATACACCGC TCTTCGCCGT TCGGATACCG CcGCTGCGCG
```

```
251 TGCAGACCGC GGAAACGCAC GGATTGCGGC GTTTTCTCTT CGGGGAAATA

301 AATTGTGTCT TGCGGGCGA AAAAGTTTTT GAGCGTTACG CCCATACCTT

351 TTACCAATTC GCCAAGCAGA AAGGTTTTTA CTAA
```

This corresponds to the amino acid sequence <SEQ ID 1078; ORF 267>:

```
m267.pep
  1 VQVAFFLAVV FKNMGFHNRI SRACLFAETA EDALGQVDVV TLGAARTVFT

51 FFRFDVNRHC RTHCLTQLTR DTPLFAVRIP PLRVQTAETH GLRRFLFGEI

101 NCVFAGEKVF ERYAHTFYQF AKQKGFY*
```

Computer analysis of this amino acid sequence gave the following results:
Homology with a Predicted ORF from *N. gonorrhoeae* 20
ORF 267 shows 82.7% identity over a 127 aa overlap with a predicted ORF (ORF 267.ng) from *N. gonorrhoeae*:

```
m267/g267
                   10         20         30         40         50         60
   m267.pep  VQVAFFLAVVFKNMGFHNRISRACLFAETAEDALGQVDVVTLGAARTVFTFFRFDVNRHC
             :||||||||||||||||||:|| ||||||||||||||||||| :||:||||||:|||
       g267  MQVAFFLAVVFKNMGFHNRIGRAGLFAETAEDALGQVDVVTLGAAGAVPAFFRFDVDRHC
                   10         20         30         40         50         60
                   70         80         90        100        110        120
   m267.pep  RTHCLTQLTRDTPLFAVRIPPLRVQTAETHGLRRFLFGEINCVFAGEKVFERYAHTFYQF
             ||| |:|:|||: :::||  |||||||||||||||||:|||||||:||||||||:| ||
       g267  RTHRLAQFTRDAAFLSVRKTALRVQTAETHGLRRFLFGKINCVFAGKKVFERYAHAFDQF
                   70         80         90        100        110        120 m267.pep  AKQKGFYX
             ||||||||
       g267  AKQKGFYX
```

The following partial DNA sequence was identified in *N. meningitidis* <SEQ ID 1079>:

```
a267.seq
  1 GTGCAAGTCG CCTTTTTTCT CGCCGTGGTA TTCAAAAATA TGGGTTTCCA

51 CAATCGCATC GGTCGGGCAG GCTTCTTCGC AGAAACCGCA GAAGATGCAC

101 TTGGTCAGGT CGATGTCGTA ACGCTTGGTG CGGCGCGTGC CGTCTTCGCG

151 TTCTTCCGAT TCGATGTTGA TCGCCATTGC GGGGCAAACG GCTTCACACA

201 ATTTACACGC GATGCAGCGT TCCTCGCCGT TTGGATAACG GCGTTGCGCG

251 TGCAGACCGC GGAAACGCAC GGATTGCGGC GTTTTCTCTT CGGGAAAATA

301 AATCGTGTCT TGCGGGCAA AAAAGTTTTT GAGCGTTACG CCCATACCTT

351 TTACCAATTC GCCAAGCAGA AAGGTTTTTA CTAA
```

This corresponds to the amino acid sequence <SEQ ID 1080; ORF 267.a>:

```
a267.pep
  1 VQVAFFLAVV FKNMGFHNRI GRAGFFAETA EDALGQVDVV TLGAARAVFA

51 FFRFDVDRHC GANGFTQFTR DAAFLAVWIT ALRVQTAETH GLRRFLFGKI

101 NRVFAGKKVF ERYAHTFYQF AKQKGFY*
``` m267/a267 82.7% identity in 177 an overlap

```
                  10        20        30        40        50        60
    m267.pep   VQVAFFLAVVFKNMGFHNRISRACLFAETAEDALGQVDVVTLGAARTVFTFFRFDVNRHC
               ||||||||||||||||||||:||  :||||||||||||||||||||||:||:||||||:||
    a267       VQVAFFLAVVFKNMGFHNRIGRAGFFAETAEDALGQVDVVTLGAARAVFAFFRFDVDRHC
                  10        20        30        40        50        60

70        80        90       100       110       120
    m267.pep   RTHCLTQLTRDTPLFAVRIPPLRVQTAETHGLRRFLFGEINCVFAGEKVFERYAHTFYQF
               ::  :||:|||: ::|| |  ||||||||||||||||||:||  :||||||||||||||
    a267       GANGFTQFTRDAAFLAVWITALRVQTAETHGLRRFLFGKINRVFAGKKVFERYAHTFYQF
                  70        80        90       100       110       120 m267.pep   AKQKGFYX
               ||||||||
    a267       AKQKGFYX
```

The following partial DNA sequence was identified in *N. gonorrhoeae* <SEQ ID 1081>:

```
G268.seq
    1 atgaaaaaaa atttacccgc actggcattg caagtatgc tgattttgtc
   51 gggctgcgac cgtttgggaa taggcaaccc gttttccgga aaggaaattt
  101 cctgcggaag cgaagagact aaagagattt tggtcaaact ggtccgcgac
  151 aatgtcgaag gtgaaaccgt caaaactttt gacgacgacg cattcaaaga
  201 ccaagcattt gccgatatcg gcatatcgca tatccgcaga atggtcgaac
  251 gtttgggcat aaccgtcgat gaagtccgaa ctaccgagaa accgacacg
  301 tccagcaaac tcaaatgtga agccgcgtta aaactggacg tgcccgacga
  351 tgttgtcgat tatgccgtcg ccgccaacca atctataggc aacagccata
  401 agaaaacgcc cgactttttt gaaccctact accgcaaaga aggcgcgtat
  451 tatgtcaaaa ctatttctta cagcgtccag ccgacagacg acaaaagcaa
  501 aatctttgcc gaactcagtc aggcacacga tatcatccat ccgctcagcg
  551 agctggtgtc tatggcactg attaaagagc cgttggacaa agcgaaacaa
  601 aggaacgaaa aacttgaagc ggcagaagcc accgcgcagg aagcgaggga
  651 ggcagaagaa gcggcggcgc aggaggcatt gggtcgggag caggaagccg
  701 cccgcgtatc cgaatgggaa gaacgctaca gctgtcgcg cagcgagttc
  751 gagcagttt ggaaaggatt gcctcaaact gtacagaata agctgcaagc
  801 ctcgcagaaa acatggaaaa gcggtatgga caagatctgt gccaacaatg
  851 cgaaagccga aggtgaaacg ccaaacggca taaaagtcag tgagttggcg
  901 tgtaaaacgg cagaaaccga agcacgcttg gaagagctgc acaaccgtaa
  951 aaaagcccctt atcgacgaaa tggtcaggga gaggacaag aaagaactgc
 1001 caaagcggct ctga
```

This corresponds to the amino acid sequence <SEQ ID 1082; ORF 268.ng>:

```
m268.pep
    1 MKKNLPALAL ASMLILSGCD RLGIGNPFSG KEISCGSEET KEILVKLVRD

51 NVEGETVKTF DDDAFKDQAF ADIGISHIRR MVERLGITVD EVRTTEKTDT

101 SSKLKCEAAL KLDVPDDVVD YAVAANQSIG NSHKKTPDFF EPYYRKEGAY

151 YVKTISYSVQ PTDDKSKIFA ELSQAHDIIH PLSELVSMAL IKEPLDKAKQ

201 RNEKLEAAEA TAQEAREAEE AAAQEALGRE QEAARVSEWE ERYKLSRSEF
```

```
251 EQFWKGLPQT VQNKLQASQK TWKSGMDKIC ANNAKAEGET PNGIKVSELA

301 CKTAETEARL EELHNRKKAL IDEMVREEDK KELPKRL*
```

The following partial DNA sequence was identified in *N. meningitidis* <SEQ ID 1083>:

```
m268.seq (partial)
  1 ..ATGGCACTGA TTAAAGAGCC GTTGGACAAA GTGAAACAAA GGAACGAAGA

51   ACTTGAAGCG GCAGAAGAAG CGGCGGCGCA GGAGGCATTG GGTCGGGAGC

101   AGGAAGCCGC CCGCGTATCC GAATGGGAAG AACGCTACAA GCTGTCGCGC

151   AG.CAGTTCG AGCAGTTCTG GAAAGGATTG CCTCAAACCG TACAGAATAA

201   GCTGCAACCn TCACAGAAAA CATGGAAAAG CGGGATGGAT AAAATCTGTG

251   CCAACAATGC GAAAGCTGAA GGTAAAACGC CAAACGGCAT AAAATTCAGC

301   GAACTGGCAT GCAAAACGGC GAAAACCGAA GCACGCTTGG AAGAGCTGCA

351   CAACCGTAAA AAGCCCTTA TCGACGAAAT GGyCAGGGAA GCGGACAmGA

401   AAGAACTGTC AAAGCGGCTs TGA
```
                                                              25

This corresponds to the amino acid sequence <SEQ ID 1084; ORF 268>.

```
m268.pep (partial)
  1 ..MALIKEPLDK VKQRNEELEA AEEAAAQEAL GREQEAARVS EWEERYKLSR

51   XQFEQFWKGL PQTVQNKLQP SQKTWKSGMD KICANNAKAE GKTPNGIKFS

101   ELACKTAKTE ARLEELHNRK KALIDEMXRE ADXKELSKRL *
```
                                                              35

Computer analysis of this amino acid sequence gave the following results:
Homology with a Predicted ORF from *N. gonorrhoeae*
ORF 268 shows 86.0% identity over a 150 aa overlap with a predicted ORF (ORF 268.ng) from *N. gonorrhoeae*:

```
m268/g268

10        20
    m268.pep                          MALIKEPLDKVKQRNEELEAAE--------
                                      |||||||||||:|||:|||||
    g268     SVQPTDDKSKIFAELSQAHDIIHPLSELVSMALIKEPLDKAKQRNEKLEAAEATAQEARE
             160       170       180       190       200       210

30        40        50        60        70        80
    m268.pep --EAAAQEALGREQEAARVSEWEERYKLSRSQFEQFWKGLPQTVQNKLQPSQKTWKSGMD
             |||||||||||||||||||||||||||||:||||||||||||||||| ||||||||||
    g268     AEEAAAQEALGREQEAARVSEWEERYKLSRSEFEQFWKGLPQTVQNKLQASQKTWKSGMD
             220       230       240       250       260       270

90       100       110       120       130       140
    m268.pep KICANNAKAEGKTPNGIKFSELACKTAKTEARLEELHNRKKALIDEMXREADXKELSKRLX
             |||||||||||:||||||  ||||||||:||||||||||||||||||||| || | ||| ||||
    g268     KICANNAKAEGETPNGIKVSELACKTAETEARLEELHNRKKALIDEMVREEDKKELPKRLX
             280       290       300       310       320       330
```

The following partial DNA sequence was identified in *N. meningitidis* <SEQ ID 1085>:

```
a268.seq
  1 ATGGCACTGA TTAAAGAGCC GTTGGACAAA GCGAAACAAA GGAACGAAGA

51 ACTTGAAGCG GCAGAAGAAG CGGCGGCGCA GGAGGCATTG GGTCGGGAGC
```

```
-continued
101 AGGAAGTCGA CCGCGTATCC GAATGGGAAG AACGCTACAA GCTGTCGCGC

151 AGCGAGTTCG AGCAGTTCTG GAAAGGATTG CCTCAAACCG TACAGAATAA

201 GCTGCAAGCC TCACAGAAAA CATGGAAAAG CGGGATGGAT AAAATCTGTG

251 CCAACAATGC GAAAGCTGAA GGTGAAACGC CAAACGGCAT AAAATTCAGC

301 GAACTGGCAT GCAAAACGGC GGAAACCGAA GCACGCTTGG AAGAGCTGCA

351 CAACCGTAAA AAAGCCCTTC TCGACGAAAT GGCCAGGGAA GCGGACAAGA

401 AAGAACTGCC AAAGCGGCTC TGA
```

This corresponds to the amino acid sequence <SEQ ID 1086; ORF 268.a>:

```
a268.pep
   1 MALIKEPLDK AKQRNEELEA AEEAAAQEAL GREQEVDRVS EWEERYKLSR

51 SEFEQFWKGL PQTVQNKLQA SQKTWKSGMD KICANNAKAE GETPNGIKFS

101 ELACKTAETE ARLEELHNRK KALLDEMARE ADKKELPKRL *
``` m268/a268 91.4% identity in 140 aa overlap

```
                 10        20        30        40        50        60
  m268.pep  MALIKEPLDKVKQRNEELEAAEEAAAQEALGREQEAARVSEWEERYKLSRXQFEQFWKGL
            ||||||||||:|||||||||||||||||||||||||:||||||||||||||:||||||||
  a268      MALIKEPLDKAKQRNEELEAAEEAAAQEALGREQEVDRVSEWEERYKLSRSEFEQFWKGL
                 10        20        30        40        50        60

70        80        90       100       110       120
  m268.pep  PQTVQNKLQPSQKTWKSGMDKICANNAKAEGKTPNGIKFSELACKTAKTEARLEELHNRK
            ||||||||| ||||||||||||||||||||||:||||||||||||||:||||||||||||
  a268      PQTVQNKLQASQKTWKSGMDKICANNAKAEGETPNGIKFSELACKTAETEARLEELHNRK
                 70        80        90       100       110       120

130       140
  m268.pep  KALIDEMXREADXKELSKRLX
            |||:||| |||| ||| ||||
  a268      KALLDEMAREADKKELPKRLX
                130       140
```

40
The following partial DNA sequence was identified in *N. meningitidis* <SEQ ID 1087>:

```
m268-1.seq
   1 GTGCAATCCC GATATGATGG TTTGCATAAA TTTAAACATA TATGTTCCGC

51 AGCTATGGCA CTGATTAAAG AGCCGTTGGA CAAAGTGAAA CAAAGGAACG

101 AAGAACTTGA AGCGGCAGAA GAAGCGGCGG CGCAGGAGGC ATTGGGTCGG

151 GAGCAGGAAG CCGCCCGCGT ATCCGAATGG GAAGAACGCT ACAAGCTGTC

201 GCGCAGCGAG TTCGAGCAGT TCTGGAAAGG ATTGCCTCAA ACCGTACAGA

251 ATAAGCTGCA AGCCTCACAG AAAACATGGA AAGCGGGAT GGATAAAATC

301 TGTGCCAACA ATGCGAAAGC TGAAGGTAAA ACGCCAAACG GCATAAAATT

351 CAGCGAACTG GCATGCAAAA CGGCGAAAAC CGAAGCACGC TTGGAAGAGC

401 TGCACAACCG TAAAAAAGCC CTTATCGACG AAATGGCCAG GGAAGCGGAC

451 AAGAAAGAAC TGTCAAAGCG GCTCTGA
```

This corresponds to the amino acid sequence <SEQ ID 1088; ORF 268-1>:

```
m268-1.pep

1   VQSRYDGLHK FKHICSAAMA LIKEPLDKVK QRNEELEAAE EAAAQEALGR

51   EQEAARVSEW EERYKLSRSE FEQFWKGLPQ TVQNKLQASQ KTWKSGMDKI

101   CANNAKAEGK TPNGIKFSEL ACKTAKTEAR LEELHNRKKA LIDEMAREAD

151   KKELSKRL* m268-1/g268 82.3% identity in 164 aa overlap 10        20        30
    m268-1.pep               VQSRYDGLHKFKHICSAAMALIKEPLDKVKQRNE
                             :| :| :::: |  ||||||||||:|||||
    g268        KEGAYYVKTISYSVQPTDDKSKIFAELSQAHDIIHPLSELVS--MALIKEPLDKAKQRNE
                   150       160       170       180       190       200
                    40        50        60        70        80
    m268-1.pep  ELEAAE---------EAAAQEALGREQEAARVSEWEERYKLSRSEFEQFWKGLPQTVQN
                :|||||           |||||||||||||||||||||||||||||||||||||||||
    g268        KLEAAEATAQEAREAEEAAAQEALGREQEAARVSEWEERYKLSRSEFEQFWKGLPQTVQN
                   210       220       230       240       250       260
                    90       100       110       120       130       140
    m268-1.pep  KLQASQKTWKSGMDKICANNAKAEGKTPNGIKFSELACKTAKTEARLEELHNRKKALIDE
                ||||||||||||||||||||||||||:||||||||||||||:|||||||||||||||||
    g268        KLQASQKTWKSGMDKICANNAKAEGETPNGIKVSELACKTAETEARLEELHNRKKALIDE
                   270       280       290       300       310       320
                   150       159
    m268-1.pep  MAREADKKELSKRLX
                |:|| ||||| ||||
    g268        MVREEDKKELPKRLX
                   330
```

The following partial DNA sequence was identified in *N. meningitidis* <SEQ ID 1089>:

```
a268-1.seq
    1 GTGCAATCCC GATATGATGG TTTGCATAAA TTTAAACATA TATGTTCCGC

51 AGCTATGGCA CTGATTAAAG AGCCGTTGGA CAAAGCGAAA CAAAGGAACG

101 AAGAACTTGA AGCGGCAGAA GAAGCGGCGG CGCAGGAGGC ATTGGGTCGG

151 GAGCAGGAAG TCGACCGCGT ATCCGAATGG GAAGAACGCT ACAAGCTGTC

201 GCGCAGCGAG TTCGAGCAGT TCTGGAAAGG ATTGCCTCAA ACCGTACAGA

251 ATAAGCTGCA AGCCTCACAG AAAACATGGA AAGCGGGAT GGATAAAATC

301 TGTGCCAACA ATGCGAAAGC TGAAGGTGAA ACGCCAAACG GCATAAAATT

351 CAGCGAACTG GCATGCAAAA CGGCGGAAAC CGAAGCACGC TTGGAAGAGC

401 TGCACAACCG TAAAAAAGCC CTTCTCGACG AAATGGCCAG GGAAGCGGAC

451 AAGAAAGAAC TGCCAAAGCG GCTCTGA
```

This corresponds to the amino acid sequence <SEQ ID 1090; ORF 268-1.a>:

```
a268-1.pep

1   VQSRYDGLHK FKHICSAAMA LIKEPLDKAK QRNEELEAAE EAAAQEALGR

51   EQEVDRVSEW EERYKLSRSE FEQFWKGLPQ TVQNKLQASQ KTWKSGMDKI

101   CANNAKAEGE TPNGIKFSEL ACKTAETEAR LEELHNRKKA LLDEMAREAD

151   KKELPKRL*
```

-continued

```
a268-1/m268-1   95.6% identity in 158 aa overlap 10        20        30        40        50        60
a268-1.pep   VQSRYDGLHKFKHICSAAMALIKEPLDKAKQRNEELEAAEEAAAQEALGREQEVDRVSEW
             ||||||||||||||||||||||||||||:||||||||||||||||||||||||:|||||
m268-1       VQSRYDGLHKFKHICSAAMALIKEPLDKVKQRNEELEAAEEAAAQEALGREQEAARVSEW
                     10        20        30        40        50        60

70        80        90       100       110       120
a268-1.pep   EERYKLSRSEFEQFWKGLPQTVQNKLQASQKTWKSGMDKICANNAKAEGETPNGIKFSEL
             |||||||||||||||||||||||||||||||||||||||||||||||:||||||||||||
m268-1       EERYKLSRSEFEQFWKGLPQTVQNKLQASQKTWKSGMDKICANNAKAEGKTPNGIKFSEL
                     70        80        90       100       110       120

130       140       150   159
a268-1.pep   ACKTAETEARLEELHNRKKALLDEMAREADKKELPKRLX
             |||||:||||||||||||||||:||||||||||||| |||
m268-1       ACKTAKTEARLEELHNRKKALIDEMAREADKKELSKRLX
                    130       140       150
```

The following partial DNA sequence was identified in *N. gonorrhoeae* <SEQ ID 1091>:

```
g269.seq
   1 atggtttggc gtgtgaattg cgcggcaacg gcggcgctga ttttttcgtc 51 cagcccttgg atttgggcgg tggtgtgggt gtggtcgcgg tcggctttt 101 cctgcaaacc ttgcgccagc cttgacgcgt ccagtgcgcc ggcgttggcg 151 gtttcgccgt gggactttat ccggaacacg gcttcgccca aggtgtcggc 201 ggctttgatg cacagtttta aaaccagggc tttggggcgg ttttctgcgc 251 cgcccgttgc cattttgctg tccaatcgcg gggttaaaaa accgttgtcg 301 tttaagtcgc cgtccgtcca agtcgatacg agcgcgcttc tttgcctttc 351 attgcggtct tcgtaa
```
                                                               35

This corresponds to the amino acid sequence <SEQ ID 1092; ORF 269.ng>:

```
g269.pep
   1 MVWRVNCAAT AALIFSSSPW IWAVVWVWSR SAFSCKPCAS LDASSAPALA

51 VSPWDFIRNT ASPKVSAALM HSFKTRALGR FSAPPVAILL SNRGVKKPLS

101 FKSPSVQVDT SALLCLSLRS S*
```
                                                               45

The following partial DNA sequence was identified in *N. meningitidis* <SEQ ID 1093>:

```
m269.seq
   1 ATGGTTTGGC GTGTGAATTG CGCGGCAACG GCGGTGCTGA TTTTTTCGTC

51 CAGCCCTTGG ATTTGGGCGG CGGTGTGGGT GTGGTCTCGG TCGGCTTTGT

101 CTTGCAAACC TTGCGCCaCG TGCCCGCGTC CAGCGCCTGC GTTGATGGTT

151 TCGCCGTGGG ACTTTATCCA AAACACGGCT TCGCCCAAGG TGTCGGCGGC

201 TTTGATGCAC AGTTTTAAAA CCAGGGCTTT GGGGCGGTTT TCGTCGCCGC

251 CTGTCGCCAT TTTGCTGTCC GAGCGCGGGG TTAAAAAGCC GTTGTCGTTT

301 AAATTTTCGT CCGTCCAAGT CGATACGAGC GCGCTTCTCT GCCTTTCGTT

351 GCGGTCTTCG TAA
```

This corresponds to the amino acid sequence <SEQ ID 1094; ORF 269>:

```
m269.pep
  1 MVWRVNCAAT AVLIFSSSPW IWAAVWVWSR SALSCKPCAT CPRPAPALMV

51 SPWDFIQNTA SPKVSAALMH SFKTRALGRF SSPPVAILLS ERGVKKPLSF

101 KFSSVQVDTS ALLCLSLRSS *
```

Computer analysis of this amino acid sequence gave the following results:
Homology with a Predicted ORF from *N. gonorrhoeae*
ORF 269 shows 87.6% identity over a 121 aa overlap with a predicted ORF (ORF 269.ng) from *N. gonorrhoeae*:

```
     m269.pep  MVWRVNCAATAVLIFSSSPWIWAAVWVWSRSALSCKPCATCP-RPAPALMVSPWDFIQNT   59
               ||||||||||:|||||||||||||||||||:|||||||:||||||     ||||||||||:||
     g269      MVWRVNCAATAALIFSSSPWIWAVVWVWSRSAFSCKPCASLDASSAPALAVSPWDFIRNT   60
     m269.pep  ASPKVSAALMHSFKTRALGRFSSPPVAILLSERGVKKPLSFKFSSVQVDTSALLCLSLRS  119
               |||||||||||||||||||||:|||||||||:||||||||||||   ||||||||||||||
     g269      ASPKVSAALMHSFKTRALGRFSAPPVAILLSNRGVKKPLSFKSPSVQVDTSALLCLSLRS  120
     m269.pep  SX  121
               ||
     g269      SX  122
```

The following partial DNA sequence was identified in *N. meningitidis* <SEQ ID 1095>:

```
a269.seq
  1 ATGGTTTGGC GTGTGAATTG CGCGGCAACG GCGGTGCTGA TTTTTTCGTC

51 CAGCCCTTGG ATTTGGGCGG CGGTGTGGGT GTGGGCGCGG TCTGCTTTGT

101 CTTGGAGGTT TTGCGCCAGC GTGCCCGCGT CCAGCGCGCC GGCGTTGACG

151 GTTTCGCCGT GGGACTTTAT CCAGAACACG GCTTCGCCCA AGGTGTCGGC

201 GGCTTTGATG CACAGTTTTA AAACCAGGGC TTTGGGGCGG TTTTCGTCGC

251 CGCCTGTCGC CATTTTGCTG TCCGGGCGCG GGGTTAAAAA GCCGTTGTCG

301 TTTAAATTTT CGTCCGTCCA AGTCGATACG AGCGCGCTTC TCTGCCTTTC

351 GTTGTGGTCT TCGTAA
```

This corresponds to the amino acid sequence <SEQ ID 1096; ORF 269.a>:

```
a269.pep
  1 MVWRVNCAAT AVLIFSSSPW IWAAVWVWAR SALSWRFCAS VPASSAPALT

51 VSPWDFIQNT ASPKVSAALM HSFKTRALGR FSSPPVAILL SGRGVKKPLS

101 FKFSSVQVDT SALLCLSLWS S*
``` m269/a269 90.1% identity in 121 aa overlap

```
                       10         20         30         40         50         59
     m269.pep  MVWRVNCAATAVLIFSSSPWIWAAVWVWSRSALSCKPCATCP-RPAPALMVSPWDFIQNT
               |||||||||||||||||||||||||||||:|||||  :||:  |    ||||||||||||
     a269      MVWRVNCAATAVLIFSSSPWIWAAVWVWARSALSWRFCASVPASSAPALTVSPWDFIQNT
                       10         20         30         40         50         60
```

```
                 60         70         80         90        100        110       119
m269.pep    ASPKVSAALMHSFKTRALGRFSSPPVAILLSERGVKKPLSFKFSSVQVDTSALLCLSLRS
            ||||||||||||||||||||||||||| ||||||||||||| |||||||||||||||||| |
a269        ASPKVSAALMHSFKTRALGRFSAPPVAILLSGRGVKKPLSFKPSVQVDTSALLCLSLWS
                        70         80         90        100        110        120

120
m269.pep    SX
            ||
a269        SX
```

The following partial DNA sequence was identified in *N. gonorrhoeae* <SEQ ID 1097>:

```
g270.seq
   1 atgaataaaa accgcaaatt actgcttgcc gcactgctgc tgactgcctt
  51 tgccgccttc aagctcgttt tgttgcaatg gtggcaggcg cagcagccgc
 101 aagccgtggc ggcgcaatgc gatttgaccg agggttgcac gctgccggac
 151 ggaagccgtg tccgcgccgc cgccgtttca accaaaaaac cgtttgatat
 201 ttatatcgaa cacgcgcccg ccggcacgga acaggtcagc atcagcttca
 251 gtatgaaaaa tatggatatg ggtttcaacc gctatatgtt cgagcggcaa
 301 ccgtcgggga cttggcaggc agcacgcatc cgcctgcccg tctgtgtcga
 351 aggcaggcgc gattttacgg cggacattac aatcggcagc cggacatttc
 401 agacggcatt taccgccgaa taa
```

This corresponds to the amino acid sequence <SEQ ID 1098; ORF 270.ng>:

```
g270.pep
   1 MNKNRKLLLA ALLLTAFAAF KLVLLQWWQA QQPQAVAAQC DLTEGCTLPD
  51 GSRVRAAAVS TKKPFDIYIE HAPAGTEQVS ISFSMKNMDM GFNRYMFERQ
 101 PSGTWQAARI RLPVCVEGRR DFTADITIGS RTFQTAFTAE*
```

The following partial DNA sequence was identified in *N. meningitidis* <SEQ ID 1099>:

```
m270.seq
   1 ATGAATAAAA ACCGTAAATT ACTGCTTGCC GCACTGCTGC TGATTGCCTT
  51 TGCCGCCGTC AAGCTCGTTT TGTTGCAATG GTGGCAGGCG Ca.CAGCCGC
 101 AAGCTGTGGC GGCGCAATGC GATTTGACCG AGGGTTGCAC GCTGCCGGAC
 151 GGAAGCCGCG TCCGCGCCGC CGCcGTTTCA ACCAAAAAAC CGTTTGATAT
 201 TTATATCGAA CACGCGCCCG CCGGCACGGA ACAGGTCAGC ATCAGCTTCA
 251 GTATGAAAAA TATGGATATG GGTTTCaACC GCTATATGTT CGAGCGGCAA
 301 cCGTCGGGGA CTTGGCAGGC AGTACGCATC CGCCTGCCCA TCTGTGTCGA
 351 AGGCAGGCGC GATTTTACGG CGGACATTAC AATCGGCAGT CGGACATTTC
 401 AGACGGCATT TACCGCCGAA TAA
```

This corresponds to the amino acid sequence <SEQ ID 1100; ORF 270>:

```
m270.pep
    1 MNKNRKLLLA ALLLIAFAAV KLVLLQWWQA XQPQAVAAQC DLTEGCTLPD

51 GSRVRAAAVS TKKPFDIYIE HAPAGTEQVS ISFSMKNMDM GFNRYMFERQ

101 PSGTWQAVRI RLPICVEGRR DFTADITIGS RTFQTAFTAE *
```

Computer analysis of this amino acid sequence gave the following results:
Homology with a Predicted ORF from *N. gonorrhoeae*
ORF 270 shows 96.4% identity over a 140 aa overlap with a predicted ORF (ORF 270.ng) from *N. gonorrhoeae*:

```
    m270/g270

10         20         30         40         50         60
       m270.pep    MNKNRKLLLAALLLIAFAAVKLVLLQWWQAXQPQAVAAQCDLTEGCTLPDGSRVRAAAVS
                   ||||||||||||    ||||   |||||||||||| ||||||||||||||||||||||||
       g270        MNKNRKLLLAALLLTAFAAFKLVLLQWWQAQQPQAVAAQCDLTEGCTLPDGSRVRAAAVS
                       10         20         30         40         50         60

70         80         90        100        110        120
       m270.pep    TKKPFDIYIEHAPAGTEQVSISFSMKNMDMGFNRYMFERQPSGTWQAVRIRLPICVEGRR
                   |||||||||||||||||||||||||||||||||||||||||||||||:|||||:||||||
       g270        TKKPFDIYIEHAPAGTEQVSISFSMKNMDMGFNRYMFERQPSGTWQAARIRLPVCVEGRR
                       70         80         90        100        110        120

130        140
       m270.pep    DFTADITIGSRTFQTAFTAEX
                   |||||||||||||||||||||
       g270        DFTADITIGSRTFQTAFTAEX
                      130        140
```

The following partial DNA sequence was identified in *N. meningitidis* <SEQ ID 1101>:

```
a270.seq
    1 ATGAATAAAA ACCGTAAATT ACTGCTTGCC GCACTGCTGC TGATTGCCTT

51 TGCCGCCGTC AAGCTCGTTT TGTTGCAATG GTGGCAGGCG CAGCAGCCGC

101 AAGCTGTGGC GGCGCAATGC GATTTGACCG AGGGTTGCAC GCTGCCGGAC

151 GGAAGCCGCG TCCGCGCCGC CGCCGTTTCA ACCAAAAAAC CGTTTGATAT

201 TTATATCGAA CACGCGCCCG CCGGCACGGA ACAGGTCAGC ATCAGCTTCA

251 GTATGAAAAA TATGGATATG GGTTTCAACC GCTATATGTT CGAGCGGCAA

301 CCGTCGGGGA CTTGGCAGGC AGTACGCATC CGCCTGCCCA TCTGTGTCGA

351 AGGCAGGCGC GATTTTACGG CGGACATTAC AATCGGCAGC CGGACATTTC

401 AGACGGCATT TACCGCCGAA TAA
```

This corresponds to the amino acid sequence <SEQ ID 1102; ORF 270.a>:

```
a270.pep
    1 MNKNRKLLLA ALLLIAFAAV KLVLLQWWQA QQPQAVAAQC DLTEGCTLPD

51 GSRVRAAAVS TKKPFDIYIE HAPAGTEQVS ISFSMKNMDM GFNRYMFERQ

101 PSGTWQAVRI RLPICVEGRR DFTADITIGS RTFQTAFTAE *
``` m270/a270 99.3% identity in 140 aa overlap

```
               10        20        30        40        50        60
m270.pep  MNKNRKLLLAALLLIAFAAVKLVLLQWWQAXQPQAVAAQCDLTEGCTLPDGSRVRAAAVS
          ||||||||||||||||||||||||||||| ||||||||||||||||||||||||||||||
a270      MKKNRKLLAALLLLIAFAAVKLVLLQWWQAQQPQAVAAQCDLTEGCTLPDGSRVRAAAVS
               10        20        30        40        50        60

70        80        90       100       110       120
m270.pep  TKKPFDIYIEHAPAGTEQVSISFSMKNMDMGFNRYMFERQPSGTWQAVRIRLPICVEGRR
          ||||||||||||||||||||||||||||||||||||||||||||||||||||||||||||
a270      TKKPFDIYIEHAPAGTEQVSISFSMKNMDMGFNRYMFERQPSGTWQAVRIRLPICVEGRR
               70        80        90       100       110       120

130       140
m270.pep  DFTADITIGSRTFQTAFTAEX
          |||||||||||||||||||||
a270      DFTADITIGSRTFQTAFTAEX
              130       140
```

The following partial DNA sequence was identified in *N. gonorrhoeae* <SEQ ID 1103>:

```
g271.seq
  1 atgttcagtt cgcggatggc gaggatttgg gcgacggggg taacgttgtg 51 tatggtcagt ccgtgtccgg cgttgacgac caagcccaaa tcgccggcga 101 aatgcgcgcc gttttggatg cgctcgaact gcctgatttg ttcggcgtgg 151 ctttgtgcgt cggcatatgc gccggtgtgc agctcgacaa cgggcgcgcc 201 gacatcacgg gcggcttgga tttgcctgtc gtcggcatcg ataaacaagg 251 acacgcgtat gcccgcgtcg gtcaggattt tggcgaattc ggcgattttt 301 tcctgttgcg ccaatacgtc caaaccgcct tcggtcgtga tttcctgccg 351 tttttcaggc acgatgcaca cgtcttccgg catcacttta agcgcgtttt 401 cgagcatttc ttccgtcaac gccatttcaa ggttcaggcg cgtgcggatg 451 gcgttttga cggcaaatac atccgcgtct ttgatgtggc ggcggtcttc 501 gcgcaggtgc atggtaatca ggtctgcacc gtgcgtttcg caaccagtg 551 ccgcctccac ggggctggga taa
```

This corresponds to the amino acid sequence <SEQ ID 1104; ORF 271.ng>:

```
g271.pep
  1 MFSSRMARIW ATGVTLCMVS PCPALTTKPK SPAKCAPFWM RSNCLICSAW

51 LCASAYAPVC SSTTGAPTSR AAWICLSSAS INKDTRMPAS VRILANSAIF

101 SCCANTSKPP SVVISCRFSG TMHTSSGITL SAFSSISSVN AISRFRRVRM

151 AFLTANTSAS LMWRRSSRRC MVIRSAPCVS ATSAASTGLG*
```

The following partial DNA sequence was identified in *N. meningitidis* <SEQ ID 1105>:

```
m271.seq
  1 AwGTTCAGTT CGCGGATGGC GAGGATTTGG GCGATGGGGG TAACGTTGTG

51 TATGGTCAGT CCGTGTCCGG CGTTGACGAC CAAGCCCAAA TCGCCGGCGA

101 AATGCGCGCC GTTTTGGATG CGCTCGAACT GCCTGATTTG TTCGGCGTGG

151 CTGCGCGCGT CGGCATACGC GCCTGTGTGC AGCTCGACAA CGGGCGCGCC

201 GACATCACGG GCGGCTTGGA TTTGCCTGTC GTCGGCATCG ATAAACAAG
```

-continued

```
251 ACACGCGTAT GCCTGCGTCG GTCAGGATTT TGGTGAACCC GGCGATTTTT

301 TCCTGTTGCG CCAATACGTC CAAACCGCCT TCGGTCGTGA TTTCCTGACG

351 TTTTTCAGGC ACGATGCACA CGTCTTCCGG CATCACTTTC AAAGCGTTTT

401 CCAACATTTC TTCCGTCAAC GCCATTTCAA GGTTCAGGCG CGTGCGGATG

451 GCGTTTTTGA CGGCAAACAC GTCCGCGTCT TTGATGTGGC GGCGGTCTTC

501 GCGCAGGTGC ATGGTAATCA AATCCGCACC GTGCGTTTCG GCAACCAGTG

551 CCGCCTCCAC GGGGCTGGGA TAA
```

This corresponds to the amino acid sequence <SEQ ID 1106; ORF 271>:

```
m271.pep
  1 XFSSRMARIW AMGVTLCMVS PCPALTTKPK SPAKCAPFWM RSNCLICSAW

51 LRASAYAPVC SSTTGAPTSR AAWICLSSAS INKDTRMPAS VRILVNPAIF

101 SCCANTSKPP SVVISXRFSG TMHTSSGITF KAFSNISSVN AISRFRRVRM

151 AFLTANTSAS LMWRRSSRRC MVIKSAPCVS ATSAASTGLG *
                                                25
```

Computer analysis of this amino acid sequence gave the following results:
Homology with a Predicted ORF from *N. gonorrhoeae*
ORF 271 shows 95.2% identity over a 189 aa overlap with a predicted ORF (ORF 271.ng) from *N. gonorrhoeae*:

```
    m271/g271
                    10         20         30         40         50         60
    m271.pep  XFSSRMARIWAMGVTLCMVSPCPALTTKPKSPAKCAPFWMRSNCLICSAWLRASAYAPVC
              ||||||||| ||||||||||||||||||||||||||||||||||||||||| |||||||
    g271      MFSSRMARIWATGVTLCMVSPCPALTTKPKSPAKCAPFWMRSNCLICSAWLCASAYAPVC
                    10         20         30         40         50         60

70         80         90        100        110        120
    m271.pep  SSTTGAPTSRAAWICLSSASINKDTRMPASVRILVNPAIFSCCANTSKPPSVVISXRFSG
              |||||||||||||||||||||||||||||||||||| :| |||||||||||||||| |||
    g271      SSTTGAPTSRAAWICLSSASINKDTRMPASVRILANSAIFSCCANTSKPPSVVISCRFSG
                    70         80         90        100        110        120

130        140        150        160        170        180
    m271.pep  TMHTSSGITFKAFSNISSVNAISRFRRVRMAFLTANTSASLMWRRSSRRCMVIKSAPCVS
              ||||||||| ::|||:||||||||||||||||||||||||||||||||||||| |||||
    g271      TMHTSSGITLSAFSSISSVNAISRFRRVRMAFLTANTSASLMWRRSSRRCMVIRSAPCVS
                   130        140        150        160        170        180

190
    m271.pep  ATSAASTGLGX
              |||||||||||
    g271      ATSAASTGLGX
                   190
```

The following partial DNA sequence was identified in *N. meningitidis* <SEQ ID 1107>:

```
a271.seq
  1 ATGTTCAGTT CGCGGATGGC GAGGATTTGG GCGATGGGGG TAACGTTGTG

51 TATGGTCAGT CCGTGTCCGG CGTTGACGAC CAAGCCCAAA TCGCTGGCAA

101 AATGCGCGCC GTTTTGGATG CGCTCGAACT GCCTGATTTG TTCGGCGTGG

151 CTGCGCGCGT CGGCATACGC GCCTGTGTGC AGCTCGACAA CGGGCGCGCC

201 GACATCACGG GCGGCTTGGA TTTGCCTGTC GTCGGCATCG ATAAACAAGG
```

```
-continued
251 ACACGCGTAT GCCCGCGTCG GTCAGGATTT TGGTGAATTC GGCAATTTTG

301 TCTTGTTGCG CCAATACGTC CAAGCCGCCT TCGGTCGTGA TTTCCTGACG

351 TTTTTCCGGC ACGATGCACA CGTCTTCCGG CATCACTTTA AGCGCGTTTT

401 CGAGCATTTC TTCCGTCAAC GCCATTTCAA GGTTCAGGCG CGTGCGGATG

451 GCGTTTTTGA CAGCAAACAC GTCCGCGTCT TTGATGTGGC GGCGGTCTTC

501 GCGCAGGTGC ATGGTAATCA GGTCGGCACC GTGCGTTTCG GCAACCAGTG

551 CCGCCTCCAC GGGGCTGGGA TAA
```

This corresponds to the amino acid sequence <SEQ ID 1108; ORF 271.a>:

```
a271.pep
  1 MFSSRMARIW AMGVTLCMVS PCPALTTKPK SLAKCAPFWM RSNCLICSAW

51 LRASAYAPVC SSTTGAPTSR AAWICLSSAS INKDTRMPAS VRILVNSAIL

101 SCCANTSKPP SVVIS*RFSG TMHTSSGITL SAFSSISSVN AISRFRRVRM

151 AFLTANTSAS LMWRRSSRRC MVIRSAPCVS ATSAASTGLG *
``` m271/a271 96.3% identity in 189 aa overlap

```
                10         20         30         40         50         60
m271.pep XFSSRMARIWAMGVTLCMVSPCPALTTKPKSPAKCAPFWMRSNCLICSAWLRASAYAPVC
         ||||||||||||||||||||||||||||||| |||||||||||||||||| ||||||||
a271     MFSSRMARIWAMGVTLCMVSPCPALTTKPKSLAKCAPFWMRSNCLICSAWLCASAYAPVC
                10         20         30         40         50         60

70         80         90        100        110        120
m271.pep SSTTGAPTSRAAWICLSSASINKDTRMPASVRILVNPAIFSCCANTSKPPSVVISXRFSG
         |||||||||||||||||||||||||||||||||||:||||||||||||||||||||||||
a271     SSTTGAPTSRAAWICLSSASINKDTRMPASVRILANSAILSCCANTSKPPSVVISXRFSG
                70         80         90        100        110        120

130        140        150        160        170        180
m271.pep TMHTSSGITFKAFSNISSVNAISRFRRVRMAFLTANTSASLMWRRSSRRCMVIKSAPCVS
         ||||||||::|||:|||||||||||||||||||||||||||||||||||||||:|||||
a271     TMHTSSGITLSAFSSISSVNAISRFRRVRMAFLTANTSASLMWRRSSRRCMVIRSAPCVS
               130        140        150        160        170        180

190
m271.pep ATSAASTGLGX
         |||||||||||
a271     ATSAASTGLGX
               190
```

The following partial DNA sequence was identified in *N. gonorrhoeae* <SEQ ID 1109>:

```
g272.seq
  1 atgactgcaa aggaagaact gttcgcatgg ctgcgccata tgaacaaaaa 51 caaaggttcc gacctgtttg tgacgaccca tttcccgccc gctatgaagc 101 tggacggcaa aatcacccgc atcacggacg aaccgctgac ggcggaaaaa 151 tgtatggaaa tcgccttttc gattatgagt gcgaagcagg cggaagaatt 201 ttcatcgacc aacgagtgca atttcgccat cagcctgccg gacaccagcc 251 gcttccgcgt caatgcgatg atacagcgcg gtgcgacggc gttggtattc 301 cgcgcgatta ccagcaagat tcccaagttt gaaagcctga acctgccgcc 351 ggccttgaag gatgttgcgc tgaaaaaacg cgggctggtt attttttgtcg 401 gcggcaccgg ctcgggcaaa tcgacttcgc tcgcctcgct tatcgactac
```

-continued

```
 451 cgcaatgaaa attcgttcgg acacatcatc accatcgaag atccgatcga 501 gtttgtccac gaacacaaaa actgcatcat tacccagcgc gaggtcggcg 551 tggacacgga aaactggatg gcggcgttga aaaatacgct gcgtcaggcg 601 ccggatgtga tccttatcgg cgaaatccgc gaccgtgaaa caatggacta 651 cgccatcgcc tttgccgaaa cggggcattt gtgtatggcg acgctgcacg 701 ccaacagcac caatcaggcg ctcgaccgca tcatcaactt cttccccgag 751 gagcggcgcg aacaattgct gacggatttg tcgctcaacc ttcaggcgtt 801 tatttcgcaa cgcctcgttc cgcgagacgg cggcaagggc agggtggcgg 851 cagtcgaggt gctgctcaat tcgcccctga tttcggagtt gattcacaac 901 ggcaacatcc atgaaatcaa agaagtgatg aaaaaatcca ctaccctggg 951 tatgcagacc ttcgaccaac acctttacca attgtatgaa aaaggcgaga 1001 tttccttgca ggatgccttg aaaaatgccg attccgcaca tgatttgcgt 1051 ttggcggtac agttgcgcag ccgcagggca caaagttccg accccgattt 1101 ggaactgctc tga
```

This corresponds to the amino acid sequence <SEQ ID 1110; ORF 272.ng>:

```
g272.pep
   1 MTAKEELFAW LRHMNKNKGS DLFVTTHFPP AMKLDGKITR ITDEPLTAEK

51 CMEIAFSIMS AKQAEEFSST NECNFAISLP DTSRFRVNAM IQRGATALVF

101 RAITSKIPKF ESLNLPPALK DVALKKRGLV IFVGGTGSGK STSLASLIDY

151 RNENSFGHII TIEDPIEFVH EHKNCIITQR EVGVDTENWM AALKNTLRQA

201 PDVILIGEIR DRETMDYAIA FAETGHLCMA TLHANSTNQA LDRIINFFPE

251 ERREQLLTDL SLNLQAFISQ RLVPRDGGKG RVAAVEVLLN SPLISELIHN

301 GNIHEIKEVM KKSTTLGMQT FDQHLYQLYE KGEISLQDAL KNADSAHDLR

351 LAVQLRSRRA QSSDPDLELL*
```

The following partial DNA sequence was identified in *N. meningitidis* <SEQ ID 1111>:

```
m272.seq
   1 ATGACCGCAA AGGAAGAACT GTTCGCATGG CTGCGCCATA TGAwCCAAAA

51 CAAAGGTTCC GACCTGTTCG TGACAACCCA TTTCCCGCCC GCAATGAAGC

101 TGGACGGCAA AATCACCCGC ATCACGGACG AACCGCTGAC GGCGGAAAAA

151 TGTATGGAAA TCGCCTTTTC GATTATGAGT GCGAAGCAGG CGGAAGAATT

201 TTCATCGACC AACGAGTGCA ACTTCGCCAT CAGCCTGCCG GACACCAGCC

251 GCTTCCGCGT CAATGCGATG ATACAGCgCG GCGCGACGGC GTTGGTATTC

301 CGTACGATTA CCAGCAAGAT TCCCAAGTTT GAAAGCCTGA ACCTGCCGCC

351 AGTCTTGAAG GATGTCGCGC TGAAAAAACG CGGGCTGGTT ATTTTTGTCG

401 GCGGCACCGG CTCGGGTAAA TCGACTTCGC TTGCCTCGCT TATCGACTAC

451 CGCAATGAAA ATTCGTTCGG ACACATCATC ACCATCGAAG ACCCGATCGA

501 GTTTGTCCAC GAACACAAAA ACTGCATCAT CACCCAGCGC GAGGTCGGCG

551 TGGATACGGA AAACTGGATG GcGGCGTTGA AAACACGCT GCGTCAGGCG
```

-continued

```
 601 CCTGATGTCA TCCTTATCGG CGAAATCCGT GACCGCGAAA CAATGGACTA

651 CGCCATTGCC TTTGCCGAAA CGGGGCATTT GTGTATGGCG ACGCTGCACG

701 CCAACAGCAC CAATCAGGCA CTCGACCGCA TCATCAACTT TTTCCCCGAG

751 GAGCGGCGCG AACAATTGCT GACGGATTTG TCGCTCAACC TTCAGGCGTT

801 TATTTCGCAA CGCCTCGTTC CGCGAGACGG CGGCAAGGGC AGGGTGGCGG

851 CAGTCGAGGT GCTGCTCAAT TCGCCCCtGA TTTCGGAGTT GATTCACAAC

901 GGCAACATCC ATGAAATCAA AGAAGTGATG AAAAAATCCA CTACCCTGGG

951 TATGCAGACC TTCGATCAAC ACCTTTACCA ATTGTATGAA AAAGGCGATA

1001 TTTCCCTGCA AGAAGCATTG AAAAATGCCG ATTCCGCACA CGATTTGCGT

1051 TTGGCGGTAC AGTTGCGCAG CCGCCGCGCG CAaAGTTyCA GCCCCGATTT

1101 GGnACTGCTC TGA
```

This corresponds to the amino acid sequence <SEQ ID 1112; ORF 272>:

```
m272.pep
   1 MTAKEELFAW LRHMXQNKGS DLFVTTHFPP AMKLDGKITR ITDEPLTAEK

51 CMEIAFSIMS AKQAEEFSST NECNFAISLP DTSRFRVNAM IQRGATALVF

101 RTITSKIPKF ESLNLPPVLK DVALKKRGLV IFVGGTGSGK STSLASLIDY

151 RNENSFGHII TIEDPIEFVH EHKNCIITQR EVGVDTENWM AALKNTLRQA

201 PDVILIGEIR DRETMDYAIA FAETGHLCMA TLHANSTNQA LDRIINFFPE

251 ERREQLLTDL SLNLQAFISQ RLVPRDGGKG RVAAVEVLLN SPLISELIHN

301 GNIHEIKEVM KKSTTLGMQT FDQHLYQLYE KGDISLQEAL KNADSAHDLR

351 LAVQLRSRRA QSXSPDLXLL *
```

Computer analysis of this amino acid sequence gave the following results:

Homology with a Predicted ORF from *N. gonorrhoeae*

ORF 272 shows 97.6% identity over a 370 aa overlap with a predicted ORF (ORF 272.ng) from *N. gonorrhoeae*

```
    m272/g272

10         20         30         40         50         60
      m272.pep    MTAKEELFAWLRHMXQNKGSDLFVTTHFPPAMKLDGKITRITDEPLTAEKCMEIAFSIMS
                  ||||||||||||:|||||||||||||||||||||||||||||||||||||||||||||||
      g272        MTAKEELFAWLRHMNKNKGSDLFVTTHFPPAMKLDGKITRITDEPLTAEKCMEIAFSIMS
                   10         20         30         40         50         60

70         80         90        100        110        120
      m272.pep    AKQAEEFSSTNECNFAISLPDTSRFRVNAMIQRGATALVFRTITSKIPKFESLNLPPVLK
                  ||||||||||||||||||||||||||||||||||||||||:||||||||||||||||:||
      g272        AKQAEEFSSTNECNFAISLPDTSRFRVNAMIQRGATALVFRAITSKIPKFESLNLPPALK
                   70         80         90        100        110        120

130        140        150        160        170        180
      m272.pep    DVALKKRGLVIFVGGTGSGKSTSLASLIDYRNENSFGHIITIEDPIEFVHEHKNCIITQR
                  ||||||||||||||||||||||||||||||||||||||||||||||||||||||||||||
      g272        DVALKKRGLVIFVGGTGSGKSTSLASLIDYRNENSFGHIITIEDPIEFVHEHKNCIITQR
                  130        140        150        160        170        180

190        200        210        220        230        240
      m272.pep    EVGVDTENWMAALKNTLRQAPDVILIGEIRDRETMDYAIAFAETGHLCMATLHANSTNQA
                  ||||||||||||||||||||||||||||||||||||||||||||||||||||||||||||
      g272        EVGVDTENWMAALKNTLRQAPDVILIGEIRDRETMDYAIAFAETGHLCMATLHANSTNQA
                  190        200        210        220        230        240
```

-continued

```
                  250       260       270       280       290       300
m272.pep   LDRIINFFPPEERREQLLTDLSLNLQAFISQRLVPRDGGKGRVAAVEVLLNSPLISELIHN
           ||||||||||||||||||||||||||||||||||||||||||||||||||||||||||||
g272       LDRIINFFPPEERREQLLTDLSLNLQAFISQRLVPRDGGKGRVAAVEVLLNSPLISELIHN
                  250       260       270       280       290       300

310       320       330       340       350       360
m272.pep   GNIHEIKEVMKKSTTLGMQTFDQHLYQLYEKGDISLQEALKNADSAHDLRLAVQLRSRRA
           ||||||||||||||||||||||||||||||||:||||:||||||||||||||||||||||
g272       GNIHEIKEVMKKSTTLGMQTFDQHLYQLYEKGEISLQDALKNADSAHDLRLAVQLRSRRA
                  310       320       330       340       350       360

370
m272.pep   QSXSPDLXLLX
           || :||| |||
g272       QSSDPDLELLX
                  370
```

The following partial DNA sequence was identified in *N. meningitidis* <SEQ ID 1113>:

```
a272.seq
   1 ATGACCGCAA AGGAAGAACT GTTCGCATGG CTGCGCCATA TGAACAAAAA

51 CAAAGGTTCC GACCTGTTCG TGACGACCCA TTTCCCGCCC GCAATGAAGC

101 TGGACGGCAA AATCACCCGC ATCACGGACG AACCGCTGAC GGCGGAAAAA

151 TGTATGGAAA TCGCCTTTTC GATTATGAGT GCGAAGCAGG CGGAAGAATT

201 TTCATCGACC AACGAGTGCA ACTTCGCCAT CAGTCTGCCG GACACCAGCC

251 GCTTCCGCGT CAATGCGATG ATACAGCGCG GTGCGACGGC GTTGGTATTC

301 CGTGCGATTA CCAGCAAGAT TCCCAAGTTT GAAAGCCTGA ACCTGCCGCC

351 GGTCTTGAAG GATGTCGCGC TGAAAAAACG CGGGCTGGTT ATTTTTGTCG

401 GCGGCACCGG CTCGGGCAAA TCGACTTCGC TTGCCTCGCT TATCGACTAC

451 CGCAATGAAA ATTCGTTCGG ACACATCATC ACCATCGAAG ACCCGATCGA

501 GTTTGTCCAC GAACACAAAA ACTGCATCAT CACCCAGCGC GAGGTCGGCG

551 TGGATACGGA AAACTGGATG GCGGCGTTGA AAAACACGCT GCGTCAGGCA

601 CCGGATGTGA TTCTGATCGG CGAAATCCGC GACCGCGAAA CAATGGACTA

651 CGCCATTGCT TTTGCCGAAA CGGGGCATTT GTGTATGGCG ACGCTGCACG

701 CCAACAGCAC CAATCAGGCA CTCGACCGCA TCATCAACTT TTTCCCCGAG

751 GAGCGGCGCG AACAATTGCT GACGGATTTG TCGCTCAACC TTCAGGCATT

801 TATTTCGCAA CGCCTCGTTC CGCGAGACGG CGGCAAGGGC AGGGTGGCGG

851 CAGTCGAGGT GCTGCTCAAT TCGCCCCTGA TTTCGGAGTT GATTCACAAC

901 GGCAATATCC ATGAAATCAA AGAAGTGATG AAAAAATCCA CTACCCTGGG

951 TATGCAGACT TTCGACCAAC ACCTTTACCA ATTGTATGAA AAAGGCGAGA

1001 TTTCCTTGCA GGATGCCTTG AAAAATGCCG ATTCCGCACA CGATTTGCGT

1051 TTGGCGGTAC AGTTGCGCAG CCGCCAGGCG CAAAGTTCCG GTCCCGATTT

1101 GGAACTGCTC TGA
```

This corresponds to the amino acid sequence <SEQ ID 1114; ORF 272.a>:

```
a272.pep
   1 MTAKEELFAW LRHMNKNKGS DLFVTTHFPP AMKLDGKITR ITDEPLTAEK

51 CMEIAFSIMS AKQAEEFSST NECNFAISLP DTSRFRVNAM IQRGATALVF

101 RAITSKIPKF ESLNLPPVLK DVALKKRGLV IFVGGTGSGK STSLASLIDY
```

```
151 RNENSFGHII TIEDPIEFVH EHKNCIITQR EVGVDTENWM AALKNTLRQA

201 PDVILIGEIR DRETMDYAIA FAETGHLCMA TLHANSTNQA LDRIINFFPE

251 ERREQLLTDL SLNLQAFISQ RLVPRDGGKG RVAAVEVLLN SPLISELIHN

301 GNIHEIKEVM KKSTTLGMQT FDQHLYQLYE KGEISLQDAL KNADSAHDLR

351 LAVQLRSRQA QSSGPDLELL *
``` m272/a272 97.6% identity in 370 aa overlap

```
                    10         20         30         40         50         60
    m272.pep  MTAKEELFAWLRHMXQNKGSDLFVTTHFPPAMKLDGKITRITDEPLTAEKCMEIAFSIMS
              ||||||||||||||:|||||||||||||||||||||||||||||||||||||||||||:
    a272      MTAKEELFAWLRHMNKNKGSDLFVTTHFPPAMKLDGKITRITDEPLTAEKCMEIAFSMIS
                    10         20         30         40         50         60

70         80         90        100        110        120
    m272.pep  AKQAEEFSSTNECNFAISLPDTSRFRVNAMIQRGATALVFRTITSKIPKFESLNLPPVLK
              |||||||||||||||||||||||||||||||||||||||||:||||||||||||||||||
    a272      AKQAEEFSSTNECNFAISLPDTSRFRVNAMIQRGATALVFRAITSKIPKFESLNLPPVLK
                    70         80         90        100        110        120

130        140        150        160        170        180
    m272.pep  DVALKKRGLVIFVGGTGSGKSTSLASLIDYRNENSFGHIITIEDPIEFVHEHKNCIITQR
              ||||||||||||||||||||||||||||||||||||||||||||||||||||||||||||
    a272      DVALKKRGLVIFVGGTGSGKSTSLASLIDYRNENSFGHIITIEDPIEFVHEHKNCIITQR
                   130        140        150        160        170        180

190        200        210        220        230        240
    m272.pep  EVGVDTENWMAALKNTLRQAPDVILIGEIRDRETMDYAIAFAETGHLCMATLHANSTNQA
              ||||:||||||||:||||||||||||||||||||||||||||||||||||||||||||||
    a272      EVGVTENWMAALKKNTLRQAPDVILIGEIRDRETMDYAIAFAETGHLCMATLHANSTNQA
                   190        200        210        220        230        240

250        260        270        280        290        300
    m272.pep  LDRIINFFPEERREQLLTDLSLNLQAFISQRLVPRDGGKGRVAAVEVLLNSPLISELIHN
              ||||||||||||||||||||||||||||||||||||||||||||||||||||||||||||
    a272      LDRIINFFPEERREQLLTDLSLNLQAFISQRLVPRDGGKGRVAAVEVLLNSPLISELIHN
                   250        260        270        280        290        300

310        320        330        340        350        360
    m272.pep  GNIHEIKEVMKKSTTLGMQTFDQHLYQLYERGDISLQEALKNADSAHDLRLAVQLRSRRA
              |||||||||||||||||||||||||||||||||:||||:|||||||||||||||||||:|
    a272      GNIHEIKEVMKKSTTLGMQTFDQHLYQLYEKGEISLQDALKNADSAHDLRLAVQLRSRQA
                   310        320        330        340        350        360

370
    m272.pep  QSXSPDLXLLX
              ||:|||  |||
    a272      QSSGPDLELLX
                   370
```

The following partial DNA sequence was identified in *N. gonorrhoeae* <SEQ ID 1115>:

```
g273.seq
   1 atgagtcttc aggcggtatt tatataccccc ccaagccgta ccgcacaata 51 caacgaaaat caggaaaacg gcggtaaagc tcataaacag ggacaaagcg 101 gcaaacacac cgaccgccgt caggatatag gcgtattcga ggccggaact 151 ccattcaccg tttcctgcc gtttcttgtc gcttttgaaa taaggatga 201 tgccggcaag cagcgcggca gccgcgcccg acattggcat tgtgttcatt 251 gttgttcctt aacggttaaa aacccgcccg gccgtgcaac cgtttaagg 301 cgggaaattg caaatttgt ttgcgggcgc gtgccgctga aatcaaggcg 351 gtttgagaag tgtttccnac gcgcccgccc tatgtgccga aatattattt 401 gtcgctcacc tgcaaaatcg ccaagaacgc gctttgcgga atttccacgt
```

-continued

```
451 tgcccacttg tttcatacgg cgtttgcctg cttttttgttt ttcaagcagt 501 tttttcttac gcgtaa
```

This corresponds to the amino acid sequence <SEQ ID 1116; ORF 273.ng>:

```
g273.pep
  1 MSLQAVFIYP PSRTAQYNEN QENGGKAHKQ GQSGKHTDRR QDIGVFEAGT

51 PFTVFLPFLV AFEIKDDAGK QRGSRARHWH CVHCCSLTVK NPPGRATVLR

101 REIAKFVCGR VPLKSRRFEK CFXRARPMCR NIICRSPAKS PRTRFAEFPR

151 CPLVSYGVCL LFVFQAVFSY A*
```

The following partial DNA sequence was identified in *N. meningitidis* <SEQ ID 1117>:

```
m273.seq
  1 ATGAGTCTTC AGGCGGTATT TATATACCCm CCAAGCCGTA CCGCACAATA

51 CAACGAAAAT CAGGAAAACG GCGGTAAAGC TCAyAAACAG GGACAAAGCG

101 GCAAACACGC CGACCGCTGT CAGGATATAG GCGTATTCAA GGCCGGAACT

151 CCATTCCCCG TTTTCCTGCC GCTTCTTGTC GCTTTTGAAA TAAAGGATGA

201 TGCCGGCAAG CAGCGCGGCA GCCGCGCCCG ACATTAGCAT TGTGTTCATT

251 GTTGTTCCTT AATGCTTAAA AACCCGCCTG TCCGTGCAAC CGTTTTAAGG

301 CGGCAAATTG CAAAATTTGT TGCGGGCGC GTGCCCCTGA AATCAGGGCG

351 GTTTGAGGGG TGTTCCCGAC GCGCCGCCCT GTGTGCCGGA GTTATTTGTC

401 GCTCACCTGC AAAATCGCCA AGAACGCGCT TTGCGGAATT TCCACATTGC

451 CCACTTGTTT CATACGGCGT TTACCTGCCT TTTGTkTwTC AAGCAGTTTT

501 TTCTTACGCG TAA
```

This corresponds to the amino acid sequence <SEQ ID 1118; ORF 273>:

```
m273.pep
  1 MSLQAVFIYP PSRTAQYNEN QENGGKAHKQ GQSGKHADRC QDIGVFKAGT

51 PFPVFLPLLV AFEIKDDAGK QRGSRARH*H CVHCCSLMLK NPPVRATVLR

101 RQIAKFVCGR VPLKSGRFEG CSRRAALCAG VICRSPAKSP RTRFAEFPHC

151 PLVSYGVYLP FVXQAVFSYA *
```

Computer analysis of this amino acid sequence gave the following results:
Homology with a Predicted ORF from *N. gonorrhoeae*
ORF 273 shows 86.0% identity over a 171 aa overlap with a predicted ORF (ORF 273.ng) from *N. gonorrhoeae*:

```
m273/g273
                  10         20         30         40         50         60
    m273.pep MSLQAVFIYPPSRTAQYNENQENGGKAHKQGQSGKHADRCQDIGVFKAGTPFPVFLPLLV
             ||||||||||||||||||||||||||||||||||||:|| ||||||:||||| ||||:||
        g273 MSLQAVFIYPPSRTAQYNENQENGGKAHKQGQSGKHTDRRQDIGVFEAGTPFTVFLPFLV
                  10         20         30         40         50         60
```

-continued

```
                   70        80        90       100       110       120
m273.pep    AFEIKDDAGKQRGSRARHXHCVHCCSLMLKNPPVRATVLRRQIAKFVCGRVPLKSGRFEG
            |||||||||||||||||| |||||||| :|||| |||||||:||||||||||||| |||
g273        AFEIKDDAGKQRGSRARHWHCVHCCSLTVKNPPGRATVLRREIAKFVCGRVPLKSRRFEK
                   70        80        90       100       110       120

130       140       150       160       170
m273.pep    CSRRA-ALCAGVICRSPAKSPRTRFAEFPHCPLVSYGVYLPFVXQAVFSYAX
            |  ||  :|  ::|||||||||||||||||:|||||||| | || ||||||||
g273        CFXRARPMCRNIICRSPAKSPRTRFAEFPRCPLVSYGVCLLFVFQAVFSYAX
                 130       140       150       160       170
```

The following partial DNA sequence was identified in *N. meningitidis* <SEQ ID 1119>:

```
a273.seq
   1 ATGAGTCTTC AGGCGGTATT TGTATACCCC CCAAGCCGTA CCGCACAATA

51 CAACGAAAAT CAGGAAAACG GCGGTAAAGC TCATAAACAG GGACAAAGCG

101 GCAAACACGC CGACCGCCGT CAGGATATAG GCGTATTCCA GACCGGAACT

151 CCATTCACCG TTTTCCTGCC GCTTTTTGTC GCTTTTGAAA TAAAGGATGA

201 TGCCGGCAAG CAGCGCGGCA GCCGCGCCCG ACATTAGCAT AATGTTCATT

251 GTTGTTCCTT AACGGTTAAA AACCCGCCCG TCCGTGCAAC CGTTTTTAAG

301 AGGCGGTAAA TCACAAAGTT TGTTGGCGGA CGTGCTCTCT TACAATCAGG

351 GCGGTTTAAG GGGCATGATG CACTGCCCCG TGTGCCGGAT ATTATTTGTC

401 GCTCACCTGC AAAATTGCCA AGAACGCGCT TTGCGGGATT TCCACATTGC

451 CCACTTGTTT CATACGGCGT TTGCCTGCTT TTTGTTTTTC AAGCAGTTTT

501 TTCTTACGCG TAA
```

This corresponds to the amino acid sequence <SEQ ID 1120; ORF 273.a>:

```
a273.pep
  1  MSLQAVFVYP PSRTAQYNEN QENGGKAHKQ GQSGKHADRR QDIGVFQTGT

51  PFTVFLPLFV AFEIKDDAGK QRGSRARH*H NVHCCSLTVK NPPVRATVFK

101  RR*ITKFVGG RALLQSGRFK GHDALPRVPD IICRSPAKLP RTRFAGFPHC

151  PLVSYGVCLL FVFQAVFSYA *
``` m273/a273 80.1% identity in 171 aa overlap

```
                      10        20        30        40        50        60
m273.pep       MSLQAVFIYPPSRTAQYNENQENGGKAHKQGQSGKHADRCQDIGVFKAGTPFPVFLPLLV
               |||||||:||||||||||||||||||||||||||||||| ||||||::|||| |||||:|
a273           MSLQAVFVYPPSRTAQYNENQENGGKAHKQGQSGKHADRRQDIGVFQTGTPFTVFLPLFV
                      10        20        30        40        50        60

70        80        90       100       110        119
m273.pep       AFEIKDDAGKQRGSRARHXHCVHCCSLMLKNPPVRATVL-RRQIAKFVCGRVPLKSGRFE
               |||||||||||||||||||| |||||| :|||||||||: || |:||| ||: |:||||:
a273           AFEIKDDAGKQRGSRARHXHNVHCCSLTVKNPPVRATVFKRRXITKFVGGRALLQSGRFK
                      70        80        90       100       110       120

120       130       140       150       160       170
m273.pep       GCSRRAALCAGVICRSPAKSPRTRFAEFPHCPLVSYGVYLPFVXQAVFSYAX
               | :    :   :||||||| |||||| ||||||||||| | || ||||||||
a273           GHDALPRV-PDIICRSPAKLPRTRFAGFPHCPLVSYGVCLLFVFQAVFSYAX
                      130       140       150       160       170
```

The following partial DNA sequence was identified in *N. gonorrhoeae* <SEQ ID 1121>:

```
g274.seq
    1 ATGGCGGGGC CGATTTTTGT CGTCatCGCC AgcgTCGCTA TGTTTTTTGT

51 CGCGCAGCAG CACGCGACAG ATTTGGTTAC GGACGATTAT TATAAGGATG

101 GCAAGCATAT CGACATCCAG CTTCATCGGG ATGAAGAAGC CGTCAGACGG

151 CATATCGGGG TGCAGGTCCT CATTTCTCCC GATATGAATG CGGCAAAAGT

201 GTTTGTCGGc ggCgagtTTG ACGGCAAACA GCCTTTGAAC CTGCTGCTGA

251 TGCACCCGAC CCGCAAGGCG GACGATCAAA CCGTCGCCCT CAAGCCCGTC

301 GGCAGCGCGC AGAACGGCAG GGCGGAATAT GAGGCGGTgt tcaaAACCCT

351 TCCGCCGGCC AACCACTGGT ATGTGCGCGT GGAggacgCG GCAGGCGTGT

401 GGCGCGTCGA GAACAAATGG ATTACCAGCC AGGGCAATGC GGTCGATTTG

451 ACCCCGATGG ACAAACTTTT CAATAATGCA GGAAGCAAAT AA
```

This corresponds to the amino acid sequence <SEQ ID 1122; ORF 274.ng>:

```
g274.pep
    1 MAGPIFVVIA SVAMFFVAQQ HATDLVTDDY YKDGKHIDIQ LHRDEEAVRR

51 HIGVQVLISP DMNAAKVFVG GEFDKQPLN LLLMHPTRKA DDQTVALKPV

101 GSAQNGRAEY EAVFKTLPPA NHWYVRVEDA AGVWRVENKW ITSQGNAVDL

151 TPMDKLFNNA GSK*
```

The following partial DNA sequence was identified in *N. meningitidis* <SEQ ID 1123>:

```
m274.seq
    1 ATGGCGGGGC CGATTTTTGT CGTCATCGCC AGCGTCGCTA TGTTTTTTGT

51 CGCGCAGCAG CACGCGACAG ATTTGGTTAC GGACGATTAT TATAAAGACG

101 GCAAACATAT CGACATCCAG CTTCATCGGG ATGAAGAAGC CGTCAGACGG

151 CATATCGGGG TGCAGGTTCT CATTTCCCCC GATATGAATG CGGCAAAAGT

201 GTTTGTCGGC GGCGAGTTTG ACGGCAAACA GCCTTTGAAC CTGCTGCTGA

251 TGCACCCGAC CCGCAAGGCG GACGATCAAA CCGTCGCCCT CAAGCCCGTC

301 GGCAGCGCGC AGAACGGCAG GGCGGAATAT GAGGCGGTGT TCAAAACCCT

351 TTCGCCGACC AACCACTGGT ATGTGCGCGT GGAGGACGCG GCAGGCGTGT

401 GGCGCGTCGA GAACAAATGG ATTACCAGCC AAGGCAATGC GGTCGATTTG

451 ACCCCGATGG ACAAGCTTTT CAATAATACT GAAAGCAAAT AA
```

This corresponds to the amino acid sequence <SEQ ID 1124; ORF 274>:

```
m274.pep
    1 MAGPIFVVIA SVAMFFVAQQ HATDLVTDDY YKDGKHIDIQ LHRDEEAVRR

51 HIGVQVLISP DMNAAKVFVG GEFDKQPLN LLLMHPTRKA DDQTVALKPV

101 GSAQNGRAEY EAVFKTLSPT NHWYVRVEDA AGVWRVENKW ITSQGNAVDL

151 TPMDKLFNNT ESK*
```

Computer analysis of this amino acid sequence gave the following results:

Homology with a Predicted ORF from *N. gonorrhoeae*
ORF 274 shows 97.5% identity over a 163 aa overlap with a predicted ORF (ORF 274.ng) from *N. gonorrhoeae*:

```
    g274/m274
                      10        20        30        40        50        60
        g274.pep  MAGPIFVVIASVAMFFVAQQHATDLVTDDYYKDGKHIDIQLHRDEEAVRRHIGVQVLISP
                  ||||||||||||||||||||||||||||||||||||||||||||||||||||||||||||
            m274  MAGPIFVVIASVAMFFVAQQHATDLVTDDYYKDGKHIDIQLHRDEEAVRRHIGVQVLISP
                      10        20        30        40        50        60

70        80        90       100       110       120
        g274.pep  DMNAAKVFVGGEFDGKQPLNLLLMHPTRKADDQTVALKPVGSAQNGRAEYEAVFKTLPPA
                  |||||||||||||||||||||||||||||||||||||||||||||||||||||||||| :
            m274  DMNAAKVFVGGEFDGKQPLNLLLMHPTRKADDQTVALKPVGSAQNGRAEYEAVFKTLSPT
                      70        80        90       100       110       120

130       140       150       160
        g274.pep  NHWYVRVEDAAGVWRVENKWITSQGNAVDLTPMDKLFNNAGSKX
                  |||||||||||||||||||||||||||||||||||||||: |||
            m274  NHWYVRVEDAAGVWRVENKWITSQGNAVDLTPMDKLFNNTESKX
                     130       140       150       160
```

The following partial DNA sequence was identified in *N. meningitidis* <SEQ ID 1125>:

```
a274.seq
    1 ATGGCGGGGC CGATTTTTGT CGTCATCGCC AGCGTCGCTA TGTTTTTTGT

51 CGCGCAGCAG CACGCGACAG ATTTGGTTAC GGACGATTAT TATAAAGACG

101 GCAAGCATAT CGACATCCAG CTTCATCGGG ATGAAGAAGC CGTCAGACGG

151 CATATCGGGG TGCAGGTTCT CATTTCCCCC GATATGAATG CGGCAAAAGT

201 GTTTGTCGGC GGCGAGTTTG ACGGCAAACA GCCTTTGAAC CTGCTGCTGA

251 TGCACCCGAC CCGCAAGGCG GACGATCAAA CCGTCGCCCT CAAGCCCGTC

301 GGCAGCGCGC AGAACGGCAG GCGGAATAT GAGGCGGTGT TCAAAACCCT

351 TTCGCCGACC AACCACTGGT ATGTGCGCGT GGAGGACGCG GCAGGCGTGT

401 GGCGCGTCGA GAACAAATGG ATTACCAGCC AAGGCAATGC GGTCGATTTG

451 ACCCCGATGG ACAAACTTTT CAATAATACT GAAAGCAAAT AA
```

This corresponds to the amino acid sequence <SEQ ID 1126; ORF 274.a>:

```
a274.pep
    1 MAGPIFVVIA SVAMFFVAQQ HATDLVTDDY YKDGKHIDIQ LHRDEEAVRR

51 HIGVQVLISP DMNAAKVFVG GEFDGKQPLN LLLMHPTRKA DDQTVALKPV

101 GSAQNGRAEY EAVFKTLSPT NHWYVRVEDA AGVWRVENKW ITSQGNAVDL

151 TPMDKLFNNT ESK*
``` m274/a274 100.0% identity in 163 aa overlap

```
                      10        20        30        40        50        60
       m274.pep   MAGPIFVVIASVAMFFVAQQHATDLVTDDYYKDGKHIDIQLHRDEEAVRRHIGVQVLISP
                  ||||||||||||||||||||||||||||||||||||||||||||||||||||||||||||
            a274  MAGPIFVVIASVAMFFVAQQHATDLVTDDYYKDGKHIDIQLHRDEEAVRRHIGVQVLISP
                      10        20        30        40        50        60
```

```
                       70          80          90         100         110         120
   m274.pep    DMNAAKVFVGGEFDGKQPLNLLLMHPTRKADDQTVALKPVGSAQNGRAEYEAVFKTLSPT
                ||||||||||||||||||||||||||||||||||||||||||||||||||||||||||
   a274        DMNAAKVFVGGEFDGKQPLNLLLMHPTRKADDQTVALKPVGSAQNGRAEYEAVFKTLSPT
                       70          80          90         100         110         120

130         140         150         160
   m274.pep    NHWYVRVEDAAGVWRVENKWITSQGNAVDLTPMDKLFNNTESKX
                ||||||||||||||||||||||||||||||||||||||||||||
   a274        NHWYVRVEDAAGVWRVENKWITSQGNAVDLTPMDKLFNNTESKX
                      130         140         150         160
```

The following partial DNA sequence was identified in *N. gonorrhoeae* <SEQ ID 1127>:

```
g276.seq
    1    atgattttgc cgccatccat gacgatgatg cggtcggcgg attcgacggt 51    ggtcaggcgg tgggcgacga tgatgccggt gcggttttcc atcaggcgtt 101    cgagcgcttg ttggacgagg cgttcggatt cgttgtccaa tgcgctggtg 151    gcttcgtcca ataataatat cggcgcgtct ttcaaaatgg cgcgggcgat 201    ggcgacgcgt tgccgctgtc cgccggataa gttgctgccg ttcgatccga 251    tgggctggtg cagtccgagc ggggatgcgt cgatcaggct tgcaggttg 301    gcggcttgga gggcggacag gacttcggct tcgcccgcgt cgggacggct 351    gtatcggacg ttttcaaaca gggtgtcgtc aaacaggaat acgtcttggg 401    agacgaggc gaattgggcg cgcaggcagt cgagtttgat gtcggcgatg 451    tcgataccgt ctatgcagat gttgccggca gacggttcga caaagcgggg 501    cagaaggttg acgacggtgg atttgccgct gccggaacgt ccgaccaggg 551    cgacgcgttc gccttgtctg atgtcgaggt tgaagttgtc gagggctttg 601    atgccgtctg aacggtattc gacatcgacg ttgcggaagc tgatgcgccc 651    ttcgacacgc tgcggcgcga gcgtgccttt gtcctgttcg gcggggtgt 701    cgagaaatgc acatacgccg tcggcggcga ggaacatcgt ctgcataggg 751    atgctgatgt tggcaaggct tttgatgggg gcgtacattt gcagcatcgc 801    gacgatgaat gccataaatt cgccgatggt ggtgtag
```

This corresponds to the amino acid sequence <SEQ ID 1128; ORF 276.ng>:

```
g276.pep
    1  MILPPSMTMM RSADSTVVRR WATMMPVRFS IRRSSACWTR RSDSLSNALV

51  ASSNNNIGAS FKMARAMATR CRCPPDKLLP FDPMGWCSPS GDASIRLCRL

101  AAWRADRTSA SPASGRLYRT FSNRVSSNRN TSWETRANWA RRQSSLMSAM

151  SIPSMQMLPA DGSTKRGRRL TTVDLPLPER PTRATRSPCL MSRLKLSRAL

201  MPSERYSTST LRKLMRPSTR CGASVPLSCS GGVSRNAHTP SAARNIVCIG

251  MLMLARLLMG AYICSIATMN AINSPMVV*
```

The following partial DNA sequence was identified in *N. meningitidis* <SEQ ID 1129>:

```
m276.seq
    1    ATGATTTTGC CGTCGTCCAT CACGATGATG CGGTCGGCCC CTTCGATGGT

51    GGTCAGGCGG TGGGCGACGA TGATGCCGGT GCGGTTTTCC ATCAGGCGTT
```

```
101 CGAGCGCCTG TTGGACGAGG CGTTCGGATT CGTTGTCTAA TGCGCTGGTG

151 GCTTCGTCCA ATAATAATAT CGGCGCGTCT TTCAAAATGG CGCGGGCAAT

201 GGCGACGCGT TGCCGCTGTC CGCCGGATAA GTTGCTGCCG TTCGATCCGA

251 TGGGCTGGTG CAGTCCGAGC GGGGAGCTGT CAATCAGGCT TTGCAGGTTG

301 GCGGTTTGGA GGGCGAACAG GACTTCGGCT TCGCCCGCGT CGGGACGGCT

351 GTATCGGACG TTTTCAAACA GGGTGTCGTC AAACAGGAAT ACGTCTTGGG

401 AGACGAGGGC GAATTGGGCG CGCAGGCAGT CGAGTTTGAT GTCGGCGATG

451 TCGATACCGT CTATGCAGAT GTTGCCGGCA GACGGTTCGA CAAAGCGGGG

501 CAGCAGGTTG ACGACGGTGG ATTTGCCGCT GCCGGAACGT CCGACCAGGG

551 CGACGCGTTC GCCTTGTCTG ATGTCGAGGT TGAAGTTGTC GAGGGCTTTG

601 ATGCCGTCTG AACGGTATTC GACATCGACG TTGCGGAAGC TGATGCGCCC

651 TTCGACACGC TGCGGTGCGA GCGTGCCCTT GTCCTGTTCG GGCGGGGTGT

701 CGAGAAATGC ACATACACCG TCGGCGGCGA GGAACATCGT CTGCATAGGG

751 ATGCTGATGT TGGCAAGGCT TTTGATGGGG GCGTACATTT GCAGCATCGC

801 GACGATGAAT GCCATAAATT CGCCGATGGT GGTGTAG
```

This corresponds to the amino acid sequence <SEQ ID 1130; ORF 276>:

```
m276.pep
    1   MILPSSITMM RSAPSMVVRR WATMMPVRFS IRRSSACWTR RSDSLSNALV

51   ASSNNNIGAS FKMARAMATR CRCPPDKLLP FDPMGWCSPS GELSIRLCRL

101   AVWRANRTSA SPASGRLYRT FSNRVSSNRN TSWETRANWA RRQSSLMSAM

151   SIPSMQMLPA DGSTKRGSRL TTVDLPLPER PTRATRSPCL MSRLKLSRAL

201   MPSERYSTST LRKLMRPSTR CGASVPLSCS GGVSRNAHTP SAARNIVCIG

251   MLMLARLLMG AYICSIATMN AINSPMVV*
```

Computer analysis of this amino acid sequence gave the following results:
Homology with a Predicted ORF from *N. gonorrhoeae*
ORF 276 shows 96.8% identity over a 278 aa overlap with a predicted ORF (ORF 276.ng) from *N. gonorrhoeae*:

```
m276/g276

10         20         30         40         50         60
m276.pep    MILPSSITMMRSAPSMVVRRWATMMPVRFSIRRSSACWTRRSDSLSNALVASSNNNIGAS
            ||||  ||||||| | |||||||||||||||||||||||||||||||||||||||||||
g276        MILPPSMTMMRSADSTVVRRWATMMPVRFSIRRSSACWTRRSDSLSNALVASSNNNIGAS
                   10         20         30         40         50         60

70         80         90        100        110        120
m276.pep    FKMARAMATRCRCPPDKLLPFDPMGWCSPSGELSIRLCRLAVWRANRTSASPASGRLYRT
            |||||||||||||||||||||||||||||||  ||||||||  ||| |||||||||||||
g276        FKMARAMATRCRCPPDKLLPFDPMGWCSPSGDASIRLCRLAAWRADRTSASPASGRLYRT
                   70         80         90        100        110        120

130        140        150        160        170        180
m276.pep    FSNRVSSNRNTSWETRANWARRQSSLMSAMSIPSMQMLPADGSTKRGSRLTTVDLPLPER
            ||||||||||||||||||||||||||||||||||||||||||||||| ||||||||||||
g276        FSNRVSSNRNTSWETRANWARRQSSLMSAMSIPSMQMLPADGSTKRGRRLTTVDLPLPER
                  130        140        150        160        170        180

190        200        210        220        230        240
m276.pep    PTRATRSPCLMSRLKLSRALMPSERYSTSTLRKLMRPSTRCGASVPLSCSGGVSRNAHTP
            |||||||||||||| ||||||||||||||||||||||||||||||||||||||||||||
g276        PTRATRSPCLMSRLKPSRALMPSERYSTSTLRKLMRPSTRCGASVPLSCSGGVSRNAHTP
                  190        200        210        220        230        240
```

```
                       250        260        270    279
m276.pep   SAARNIVCIGMLMLARLLMGAYICSIATMNAINSPMVVX
           |||||||||||||||||||||||||||||||||||||||
g276       SAARNIVCIGMLMLARLLMGAYICSIATMNAINSPMVVX
                       250        260        270
```

The following partial DNA sequence was identified in *N. meningitidis* <SEQ ID 1131>:

```
a276.seq
    1  ATGATTTTGC CGTCGTCCAT TACGATGATG CGGTCGGCCC CTTCGATGGT

51  GGTCAGGCGG TGGGCGACGA TGATGCCGGT GCGGTTTTCC ATCAGGCGTT

101  CGAGCGCCTG TTGGACGAGG CGTTCGGATT CGTTGTCCAA TGCGCTGGTG

151  GCTTCGTCCA ATAATAATAT CGGCGCGTCT TTCAAAATGG CGCGGGCAAT

201  GGCAACGCGT TGCCGCTGTC CGCCGGATAA GTTGCTGCCG TTCGATCCGA

251  TGGGCTGGTG CAGTCCGAGC GGTGATGCGT CGATCAGGCT TTGCAGGTTA

301  GCGGCTTGGA GGGCGGATAG GACTTCGGCT TCGCCCGCGT CGGGACGGCT

351  ATATCGGACG TTTTCAAACA GGGTGTCGTC AAACAGGAAT ACGTCTTGGG

401  AGACGAGGGC AAATTGGGCG CGCAGGCAGT CGAGTTTGAT GTCGGCGATG

451  TCGATACCGT CTATGCAGAT GTTGCCGGCA GACGGTTCGA CAAAGCGGGG

501  CAGCAGGTTG ACGACGGTGG ATTTGCCGCT GCCGGAACGT CCGACCAGGG

551  CGACGCGTTC GCCTTGTCTG ATGTCGAGGT TGAAGCCGTC GAGGGCTTTG

601  ATGCCGTCCG AACGGTATTC GACATCGACG TTGCGGAAGC TGATGCGCCC

651  TTCGACACGC TGCGGTGCGA GCGTGCCTTT GTCCTGTTCG GGCGGGGTGT

701  CGAGAAATGC ACATACGCCG TCGGCGGCGA GGAACATCGT CTGCATAGGG

751  ATGCTAATGT TGGCAAGGCT TTTGATGGGG CGTACATTTT GCAGCATCGC

801  GACGATGAAT GCCATAAATT CGCCGATGGT GGTGTAG
```

This corresponds to the amino acid sequence <SEQ ID 1132; ORF 276.a>:

```
a276.pep
    1  MILPSSITMM RSAPSMVVRR WATMMPVRFS IRRSSACWTR RSDSLSNALV

51  ASSNNNIGAS FKMARAMATR CRCPPDKLLP FDPMGWCSPS GDASIRLCRL

101  AAWRADRTSA SPASGRLYRT FSNRVSSNRN TSWETRANWA RRQSSLMSAM

151  SIPSMQMLPA DGSTKRGSRL TTVDLPLPER PTRATRSPCL MSRLKPSRAL

201  MPSERYSTST LRKLMRPSTR CGASVPLSCS GGVSRNAHTP SAARNIVCIG

251  MLMLARLLMG AYICSIATMN AINSPMVV*
``` m276/a276 98.2% identity in 278 aa overlap

```
                   10         20         30         40         50         60
m276.pep   MILPSSITMMRSAPSMVVRRWATMMPVRFSIRRSSACWTRRSDSLSNALVASSNNNIGAS
           ||||||||||||||||||||||||||||||||||||||||||||||||||||||||||||
a276       MILPSSITMMRSAPSMVVRRWATMMPVRFSIRRSSACWTRRSDSLSNALVASSNNNIGAS
                   10         20         30         40         50         60

70         80         90        100        110        120
m276.pep   FKMARAMATRCRCPPDKLLPFDPMGWCSPSGELSIRLCRLAVWRANRTSASPASGRLYRT
           |||||||||||||||||||||||||||||||:  |||||||:|||:||||||||||||||
a276       FKMARAMATRCRCPPDKLLPFDPMGWCSPSGDASIRLCRLAAWRADRTSASPASGRLYRT
                   70         80         90        100        110        120
```

```
                 130       140       150       160       170       180
m276.pep    FSNRVSSNRNTSWETRANWARRQSSLMSAMSIPSMQMLPADGSTKRGSRLTTVDLPLPER
            ||||||||||||||||||||||||||||||||||||||||||||||||||||||||||||
a276        FSNRVSSNRNTSWETRANWARRQSSLMSAMSIPSMQMLPADGSTKRGSRLTTVDLPLPER
                 130       140       150       160       170       180

190       200       210       220       230       240
m276.pep    PTRATRSPCLMSRLKLSRALMPSERYSTSTLRKLMRPSTRCGASVPLSCSGGVSRNAHTP
            |||||||||||||||| |||||||||||||||||||||||||||||||||||||||||||
a276        PTRATRSPCLMSRLKPSRALMPSERYSTSTLRKLMRPSTRCGASVPLSCSGGVSRNAHTP
                 190       200       210       220       230       240

250       260       270   279
m276.pep    SAARNIVCIGMLMLARLLMGAYICSIATMNAINSPMVVX
            |||||||||||||||||||||||||||||||||||||||
a276        SAARNIVCIGMLMLARLLMGAYICSIATMNAINSPMVVX
                 250       260       270
```

The following partial DNA sequence was identified in *N. gonorrhoeae* <SEQ ID 1133>:

```
g277.seq (partial)
  1...    atggtacacg tcgccgtagc ttacggtatt gccgtccggc gttttgccc 51      aaacgaggtc atagacgttt ccacgccttt gcaggtacat cgccaagcgt 101      tcgatgccgt aggtaatttc gccgagtacg ggcgtgcaat cgataccgcc 151      gacttgttgg aaataggtaa actgggttac ttccatgccg ttgagccaga 201      cttcccagcc caaaccccac gcaccgaggg tggggttttc ccagtcgtct 251      tcgacaaagc ggatgtcgtg gactttggga tcgatgccca ttcgcgcag 301      ggagtcgaga tagaggtctt ggatattggc ggggcgggt ttgagggcga 351      cttggaattg gtaatagtgt tgcaggcggt tgggttgtc gccgtagcgg 401      ccgtctttgg ggcggcggct gggttggacg taggcggcaa accaaggctc 451      ggggccgagc gcgcgcaggc aggtggcggg atgggatgtg ccggcaccga 501      cttccatgtc gaagggttgg atgacggtgc agcctttgtc tgcccagaag 551      gtttgcagtt tgaagatgat tgttggaag gtaagcatgg cttattgttc 601      gataaaataa aggttttatt ttactgtttc catagccgct tgaatagatt 651      tatctcgaag acagcctga
```

This corresponds to the amino acid sequence <SEQ ID 1134; ORF 277.ng>:

```
g277.pep (partial)
  1...    MVHVAVAYGI AVRRFCPNEV IDVFHALQVH RQAFDAVGNF AEYGRAIDTA

51      DLLEIGKLGY FHAVEPDFPA QTPRTEGGVF PVVFDKADVV DFGIDAQFAQ

101      GVEIEVLDIG GGGFEGDLEL VIVLQAVGVV AVAAVFGAAA GLDVGGKPRL

151      GAERAQAGGG MGCAGTDFHV EGLDDGAAFV CPEGLQFEDD LLEGKHGLLF

201      DKIKVLFYCF HSRLNRFISK TA*
```

The following partial DNA sequence was identified in *N. meningitidis* <SEQ ID 1135>:

```
m277.seq
   1    ATGCCCCGCT TGAGGACAA GCTCGTAGGC AGGCAGGGCG AGGGCGGCGT

51    TTTCTTCGGC AAGCAGGCGT TTGGCTTGCG CTTCGTAGTC GTTGAACTGG

101    CGCAGCAGCC AGTCGGCATC GCTGTATTCG AAGTTGTAGG TGGATTGCTC
```

```
-continued
151  GACTTCGTTT TGGTGGTACA CGTCGCCGTA GGTGACGGTG TTGCCGTCGA

201  GCGTTTTTGC CCAAACGAGG TCGTAGACGT TTTCTACACC TTGCAAGTAC

251  ATCGCCAAGC GTTCGATGCC GTAGGTGATT TCGCCGAGTA CGGGCGTGCA

301  GTCGATGCCG CCGACTTGTT GGAAATAGGT AAACTGGGTT ACTTCCATGC

351  CGTTGAGCCA GACTTCCCAG CCCAAACCCC ACGCGCCGAG GGTGGGGTTT

401  TCCCAGTCGT CTTCGACAAA GCGGATGTCG TGGACTTTGG GATCGATGCC

451  CAATTCGCGC AGAGAGTCGA GATAGAGGTC TTGGATATTG GCGGGAGCGG

501  GCTTGAGGGC GACTTGGAAT TGGTAATAGT GTTGCAGGCG GTTGGGGTTG

551  TCGCCGTAGC GGCCGTCTTT GGGGCGGCGG CTGGGTTGGA CGTAGGCGGC

601  AAACCAAGGC TCGGGGCCGA GTGCGCGCAG GCAGGTGGCG GGATGGGATG

651  TGCCGGCACC GACTTCCATG TCGAAGGGTT GGATGACGGT GCAGCCTTTG

701  TCTGCCCAGA ATGTTTGCAG TTTGAAGATG ATTTGTTGGA AGGTAAGCAT

751  GGCTTATGA
```

This corresponds to the amino acid sequence <SEQ ID 1136; ORF 277>:

```
m277.pep
  1  MPRFEDKLVG RQGEGGVFFG KQAFGLRFVV VELAQQPVGI AVFEVVGGLL

51  DFVLVVHVAV GDGVAVERFC PNEVVDVFYT LQVHRQAFDA VGDFAEYGRA

101  VDAADLLEIG KLGYFHAVEP DFPAQTPRAE GGVFPVVFDK ADVVDFGIDA

151  QFAQRVEIEV LDIGGSGLEG DLELVIVLQA VGVVAVAAVF GAAAGLDVGG

201  KPRLGAECAQ AGGGMGCAGT DFHVEGLDDG AAFVCPECLQ FEDDLLEGKH

251  GL*
```

Computer analysis of this amino acid sequence gave the following results:
Homology with a Predicted ORF from *N. gonorrhoeae*     40
  ORF 277 shows 90.0% identity over a 221 aa overlap with a predicted ORF (ORF 277.ng) from *N. gonorrhoeae*:

```
g277/m277

10        20        30
     g277.pep                     MVHVAVAYGIAVRRFCPNEVIDVFHALQVH
                                  :||||: |:||:||||||||:|||::||||
     m277     GLRFVVVELAQQPVGIAVFEVVGGLLDFVLVVHVAVGDGVAVERFCPNEVVDVFYTLQVH
                  30        40        50        60        70        80

40        50        60        70        80        90
     g277.pep RQAFDAVGNFAEYGRAIDTADLLEIGKLGYFHAVEPDFPAQTPRTEGGVFPVVFDKADVV
              ||||||||:|||||||:|:|||||||||||||||||||||||||:||||||||||||||
     m277     RQAFDAVGDFAEYGRAVDAADLLEIGKLGYFHAVEPDFPAQTPRAEGGVFPVVFDKADVV
                  90       100       110       120       130       140

100       110       120       130       140       150
     g277.pep DFGIDAQFAQGVEIEVLDIGGGFEGDLELVIVLQAVGVVAVAAVFGAAAGLDVGGKPRL
              |||||||||| ||||||||||:|:||||||||||||||||||||||||||||||||||
     m277     DFGIDAQFAQRVEIEVLDIGGSGLEGDLELVIVLQAVGVVAVAAVFGAAAGLDVGGKPRL
                  150       160       170       180       190       200

160       170       180       190       200
     g277.pep GAERAQAGGGMGCAGTDFHVEGLDDGAAFVCPEGLQFEDDLLEGKHGLL
              ||| |||||||||||||||||||||||||||||| ||||||||||||||
     m277     GAECAQAGGGMGCAGTDFHVEGLDDGAAFVCPECLQFEDDLLEGKHGLX
                  210       220       230       240       250
```

The following partial DNA sequence was identified in *N. meningitidis* <SEQ ID 1137>:

```
a277.seq
   1  ATGCCCCGCT TTGAGGACAA GCTCGTAGGC AGGCAGGGCG AGGGCGGCGT

51  TTTCTTCGGC AAGCAGGCGT TTGGCTTGCG CTTCGTAGTC GTTGAACTGG

101  CGCAGCAGCC AATCGGCATC GCTGTATTCG AAGTTGTAGG TGGATTGTTC

151  GACTTCGTTT TGGTGGTACA CGTCGCCGTA AGTTACTGTA TTACCGTCCA

201  GCGTTTTTGC CCAAACGAGG TCATAGACGT TTTCCACGCC TTGCAGGTAC

251  ATCGCCAAGC GTTCGATGCC GTAGGTGATT TCGCCGAGTA CGGGGGTGCA

301  GTCGATGCCG CCGACTTGTT GGAAATAGGT GAACTGGGTT ACTTCCATAC

351  CGTTGAGCCA GACTTCCCAG CCCAAACCCC ACGCGCCGAG GGTGGGGTTT

401  TCCCAGTCGT CTTCGACAAA GCGGATGTCG TGCACTTTGG GGTCGATGCC

451  CAATTCGCGC AGGGAGTCGA GATAGAGGTC TTGGATATTG GCGGGAGCGG

501  GCTTGAGGGC GACTTGGAAT TGGTAATAGT GTTGCAGGCG GTTGGGGTTG

551  TCGCCGTAGC GACCGTCTTT GGGGCGGCGG CTGGGTTGGA CGTAGGCGGC

601  AAACCAAGGC TCGGGGCCGA GTGCGCGCAG ACAGGTGGCG GGATGGGATG

651  TGCCGGCACC GACTTCCATG TCGAAGGGTT GGATGACGGT GCAGCCTTTG

701  TCTGCCCAGA ATGTTTGCAG TTTGAAGATG ATTTGTTGGA AGGTAAGCAT

751  GGCTTATGA
```

This corresponds to the amino acid sequence <SEQ ID 1138; ORF 277.a>:

```
a277.pep
   1  MPRFEDKLVG RQGEGGVFFG KQAFGLRFVV VELAQQPIGI AVFEVVGGLF

51  DFVLVVHVAV SYCITVQRFC PNEVIDVFHA LQVHRQAFDA VGDFAEYGGA

101  VDAADLLEIG ELGYFHTVEP DFPAQTPRAE GGVFPVVFDK ADVVHFGVDA

151  QFAQGVEIEV LDIGGSGLEG DLELVIVLQA VGVVAVATVF GAAAGLDVGG

201  KPRLGAECAQ TGGGMGCAGT DFHVEGLDDG AAFVCPECLQ FEDDLLEGKH

251  GL*
``` m277/a277 92.5% identity in 252 aa overlap

```
                    10        20        30        40        50        60
m277.pep    MPRFEDKLVGRQGEGGVFFGKQAFGLRFVVVELAQQPVGIAVFEVVGGLLDFVLVVHAV
            |||||||||||||||||||||||||||||||||||||:||||||||||||:|||||||||
a277        MPRFEDKLVGRQGEGGVFFGKQAFGLRFVVVELAQQPIGIAVFEVVGGLFDFVLVVHAV
                    10        20        30        40        50        60

70        80        90       100       110       120
m277.pep    GDGVAVERFCPNEVVDVFYTLQVHRQAFDAVGDFAEYGRAVDAADDLLEIGHKLGYFHAVEP
            :  ::|:|||||||:|||::||||||||||||||||||| |||||||||||||:|||||:|||
a277        SYCITVQRFCPNEVIDVFHALQVHRQAFDAVGDFAEYGGAVDAADDLLEIGHELGYFHTVEP
                    70        80        90       100       110       120

130       140       150       160       170       180
m277.pep    DFPAQTPRAEGGVFPVVFDKADVVDFGIDAQFAQRVEIEVLDIGGSGLEGDLELVIVLQA
            |||||||||||||||||||||||| ||:|||||| |||||||||||||||||||||||||
a277        DFPAQTPRAEGGVFPVVFDKADVVHFGVDAQFAQGVEIEVLDIGGSGLEGDLELVIVLQA
                  130       140       150       160       170       180
```

```
              190        200        210        220        230        240
m277.pep  VGVVAVAAVFGAAAGLDVGGKPRLGAECAQAGGGMGCAGTDFHVEGLDDGAAFVCPECLQ
          |||||||:|||||||||||||||||||||||:||||||||||||||||||||||||||||
a277      VGVVAVATVFGAAAGLDVGGKPRLGAECAQTGGGMGCAGTDFHVEGLDDGAAFVCPECLQ
              190        200        210        220        230        240

250
m277.pep  FEDDLLEGKHGLX
          |||||||||||||
a277      FEDDLLEGKHGLX
              250
```

The following partial DNA sequence was identified in *N. gonorrhoeae* <SEQ ID 1139>:

```
g278.seq (partial)
   1  ttgcgtgcaa tcacgcccgg tgcgattttt tcgacagggg cggtcaaagt
  51  tgtattaatc ggacctttgc cgtcgatagg ccgacccaat gcatcgacga
 101  cgcgtccgac caattcgcgt ccgaccggca cttctaaaat acggccggta
 151  caggtaaccg tgtcgccttc tttaatatgt tcgtactcgc ccaacactac
 201  ggcaccgacg gagtcgcgct ccaggttcat cgccaagcct aaagtgttac
 251  ccgggaattc gagcatctca ccttgcattg catctgacaa accatggatg
 301  cgaacgatac cgtcagttac cgaaatcacc gtaccacggg tactcacttc
 351  ggcatttaca gacagatttt cgatcttggc tttaatcaga tcgctaattt
 401  cagcaggatt aagctgcatg aaaactctcc taattcgtca tagtcgtgta
 451  caaagcactc agtttgcctt gtacagacaa atccaaaacc tgatcaccca
 501  cttcaacttt ta . . .
```
                                                           35

This corresponds to the amino acid sequence <SEQ ID 1140; ORF 278.ng>:

```
g278.pep (partial)
   1  LRAITPGAIF STGAVKVVLI GPLPSIGRPN ASTTRPTNSR PTGTSKIRPV
  51  QVTVSPSLIC SYSPNTTAPT ESRSRFIAKP KVLPGNSSIS PCIASDKPWM
 101  RTIPSVTEIT VPRVLTSAFT DRFSILALIR SLISAGLSCM KTLLIRHSRV
 151  QSTQFALYRQ IQNLITHFNF . . .
```

The following partial DNA sequence was identified in *N. meningitidis* <SEQ ID 1141>:

```
m278.seq . . .
   1  TTGCGCGCAA TCACGCCCGG TGCGATTTTT TCGATAGGGG CGGTCAAAGT
  51  TGTATTAATC GGGCCTTTGC CGTCGATAGG CCGACCCAAT GCATCAACGA
 101  CGCGTCCGAC CAGTTCGCGT CCGACCGGCA CTTCCAAGAT ACGACCGGTA
 151  CAGGTAACCG TGTCGCCTTC TTTAATGTGT TCGTACTCGC CCAACACTAC
 201  GGCGCCGACG GAGTCGCGCT CCAGGTTCAT CGCCAAGCCG AAAGTGTTAC
 251  CCGGGAATTC GAGCATCTCA CCTTGCATTG CATCTGACAA ACCATGGATG
 301  CGAACGATAC CGTCAGTTAC CGAAATTACC GTACCACAGG TACGCACTTC
 351  GGCATTTACA GACAGATTTT CGATCTTGGC TTTAATCAAA TCGCTAATTT
 401  CAGCAGGATT AAGCTGCATG AAAACTCTCC TAATTCGTCA TAGTCGTGTA
```

```
-continued
451  CAAGGCACTC AATTTGCCTT GTACAGACAA ATCCAAAACC TGATCACCCA

501  CTTCAACTTT TATGCCGCCA ATCAGCTCCG GTTCGATTTC GACAGAGATT

551  TTCAGCTCGC TGTCGAAACG CTTATTCAGC ATTTGCACCA ACTCGCCGAC

601  CTGTTTGTCG GTCAACGGAT AGGCACTGTA AATGACGGCA GATTTGATAT

651  GGTTGAATGA
```

This corresponds to the amino acid sequence <SEQ ID 10 1142; ORF 278>:

```
m278.pep
    1  LRAITPGAIF SIGAVKVVLI GPLPSIGRPN ASTTRPTSSR PTGTSKIRPV

51  QVTVSPSLMC SYSPNTTAPT ESRSRFIAKP KVLPGNSSIS PCIASDKPWM

101  RTIPSVTEIT VPQVRTSAFT DRFSILALIK SLISAGLSCM KTLLIRHSRV

151  QGTQFALYRQ IQNLITHFNF YAANQLRFDF DRDFQLAVET LIQHLHQLAD

201  LFVGQRIGTV NDGRFDMVE*
```

Computer analysis of this amino acid sequence gave the following results:
Homology with a Predicted ORF from *N. gonorrhoeae* 25
ORF 278 shows 95.9% identity over a 170 aa overlap with a predicted ORF (ORF 278.ng) from *N. gonorrhoeae*:

```
    g278/m278
                   10         20         30         40         50         60
        g278.pep  LRAITPGAIFSTGAVKVVLIGPLPSIGRPNASTTRPTNSRPTGTSKIRPVQVTVSPSLIC
                  |||||||||||  ||||||||||||||||||||||||||:||||||||||||||||||||:|
        m278      LRAITPGAIFSIGAVKVVLIGPLPSIGRPNASTTRPTSSRPTGTSKIRPVQVTVSPSLMS
                   10         20         30         40         50         60

70         80         90        100        110        120
        g278.pep  SYSPNTTAPTESRSRFIAKPKVLPGNSSISPCIASDKPWMRTIPSVTEITVPRVLTSAFT
                  ||||||||||||||||||||||||||||||||||||||||||||||||||||:|||||
        m278      SYSPNITAPTESRSRFIAKPKVLPGNSSISPCIASDKPWMRTIPSVTEITVPQVRTSAFT
                   70         80         90        100        110        120

130        140        150        160        170
        g278.pep  DRFSILALIRSLISAGLSCMKTLLIRHSRVQSTQFALYRQIQNLITHFNF
                  |||||||||:|||||||||||||||||||:||||||||||||||||||||
        m278      DRFSILALIKSLISAGLSCMKTLLIRHSRVQGTQFALYRQIQNLITHFNFYAANQLRFDF
                  130        140        150        160        170        180 m278      DRDFQLAVETLIQHLHQLADLFVGQRIGTVNDGRFDMVE*
                  190        200        210
```

The following partial DNA sequence was identified in *N. meningitidis* <SEQ ID 1143>:

```
a278.seq
    1  TTGCGCGCAA TCACGCCCGG TGCGATTTTT TCGATAGGGG CGGTCAAAGT

51  TGTATTAATC GGGCCTTTGC CGTCGATAGG CCGACCCAAT GCATCAACGA

101  CGCGTCCGAC CAGTTCGCGT CCGACCGGCA CTTCCAAGAT ACGACCGGTA

151  CAGGTAACCG TGTCGCCTTC TTTAATATGT TCGTGCTCGC CAACACTAC

201  GGCGCCGACG GAGTCGCGCT CCAGGTTCAT CGCCAAGCCG AAAGTGTTAC

251  CCGGGAATTC GAGCATCTCA CCTTGCATTG CATCTGACAA ACCATGGATG

301  CGAACGATAC CGTCAGTTAC CGAAATCACC GTACCACGGG TACGCACTTC

351  GGCATTTACA GACAGATTTT CGATCTTGGC TTTAATCAAA TCGCTAATTT

401  CAGCAGGATT AAGCTGCATG AAAACTCTCC TAATTCGTCA TAGTCGTGTA
```

```
-continued
451  CAAGGCACTC AATTTGCCTT GTACAGACAA ATCCAAAACC TGATCACCCA

501  CTTCAACTTT TATGCCGCCA ATCAGCTCCG GTTCGATTTC GACAGAGATT

551  TTCAGCTCGC TGTCGAAACG CTTATTCAGC ATTTGCGCCA ACTCGCCGAC

601  CTGTTTGTCG GTCAACGGAT AGGCACTGTA AATGACGGCA GATTTGATAT

651  GGTTGAATGA
```

This corresponds to the amino acid sequence <SEQ ID 10 1144; ORF 278.a>:

```
a278.pep
    1 LRAITPGAIF SIGAVKVVLI GPLPSIGRPN ASTTRPTSSR PTGTSKIRPV

51 QVTVSPSLIC SCSPNTTAPT ESRSRFIAKP KVLPGNSSIS PCIASDKPWM

101 RTIPSVTEIT VPRVRTSAFT DRFSILALIK SLISAGLSCM KTLLIRHSRV

151 QGTQFALYRQ IQNLITHFNF YAANQLRFDF DRDFQLAVET LIQHLRQLAD

201 LFVGQRIGTV NDGRFDMVE*
``` m278/a278 98.2% identity in 219 aa overlap

```
                  10         20         30         40         50         60
   m278.pep  LRAITPGAIFSIGAVKVVLIGPLPSIGRPNASTTRPTSSRPTGTSKIRPVQVTVSPSLMC
             ||||||||||||||||||||||||||||||||||||||||||||||||||||||||||:|
   a278      LRAITPGAIFSIGAVKVVLIGPLPSIGRPNASTTRPTSSRPTGTSKIRPVQVTVSPSLIS
                  10         20         30         40         50         60

70         80         90        100        110        120
   m278.pep  SYSPNTTAPTESRSRFIAKPKVLPGNSSISPCIASDKPWMRTIPSVTEITVPQVRTSAFT
             | ||||||||||||||||||||||||||||||||||||||||||||||||||:|||||||
   a278      SCSPNTTAPTESRSRFIAKPKVLPGNSSISPCIASDKPWMRTIPSVTEITVPRVRTSAFT
                  70         80         90        100        110        120

130        140        150        160        170        180
   m278.pep  DRFSILALIKSLISAGLSCMKTLLIRHSRVQGTQFALYRQIQNLITHFNFYAANQLRFDF
             ||||||||||||||||||||||||||||||||||||||||||||||||||||||||||||
   a278      DRFSILALIKSLISAGLSCMKTLLIRHSRVQGTQFALYRQIQNLITHFNFYAANQLRFDF
                 130        140        150        160        170        180

190        200        210        220
   m278.pep  DRDFQLAVETLIQHLHQLADLFVGQRIGTVNDGRFDMVEX
             |||||||||||||||:||||||||||||||||||||||||
   a278      DRDFQLAVETLIQHLRQLADLFVGQRIGTVNDGRFDMVEX
                 190        200        210        220
```

The following partial DNA sequence was identified in *N. gonorrhoeae* <SEQ ID 1145>:

```
g279.seq
    1 atgacgcgga tttgcggctg cttgatttca acggttttga gtgtttcggc 51 aagtttgtcg gcggcgggtt tcatcaggct gcaatgggaa ggaacggata 101 ccggcagcgg cagggcgcgt ttggctccgg cttctttggc ggcagccatg 151 gtgcgtccga cggcggcggc gttgcctgca atcacgactt gtccgggcga 201 gttgaagttg acggcttcga ccacttcgcc ctgtgcggat tcggcacaaa 251 tctgcctgac ctgttcatct tccaaaccca aaatggccgc cattgcgcct 301 acgccttgcg gtacggcgga ctgcatcagt tcggcgcgca ggcggacgag 351 tttgacggca tcggcaaaat ccaatgcttc ggcggcgaca agcgcggtgt 401 attcgccgag gctgtgtccg gcaacggcgg caggcgtttt gccgcccact 451 tccaaatag
```

This corresponds to the amino acid sequence <SEQ ID 1146; ORF 279.ng>:

```
g279.pep
    1 MTRICGCLIS TVLSVSASLS AAGFIRLQWE GTDTGSGRAR LAPASLAAAM

51 VRPTAAALPA ITTCPGELKL TASTTSPCAD SAQICLTCSS SKPKMAAIAP

101 TPCGTADCIS SARRRTSLTA SAKSNASAAT SAVYSPRLCP ATAAGVLPPT

151 SK*
```

The following partial DNA sequence was identified in *N. meningitidis* <SEQ ID 1147>:

```
m279.seq
    1 ATAACGCGGA TTTGCGGCTG CTTGATTTCA ACGGTTTTCA GGGCTTCGGC

51 AAGTTTGTCG GCGGCGGGTT TCATCAGGCT GCAATGGGAA GGTACGGACA

101 CGGGCAGCGG CAGGGCGCGT TTGGCACCGG CTTCTTTGGC GGCAGCCATG

151 GCGCGTCCGA CGGCGGCGGC GTTGCCTGCA ATCACGATTT GTCCGGGTGA

201 GTTGAAGTTG ACGGCTTCGA CCACTTCGCT TTGGGCGGCT TCGGCACAAA

251 TGGCTTTAAC CTGCTCATCT TCCAAGCCGA GAATCGCCGC CATTGCGCCC

301 ACGCCTTGCG GTACGGCGGA CTGCATCAGT TCGGCGCGCA GGCGCACGAG

351 TTTGACCGCG TCGGCAAAAT TCAATGCGCC GGCGGCAACG AGTGCGGTGT

401 ATTCGCCGAG GCTGTGTCCG GCAACGGCGG CAGGCGTTTT GCCGCCCGCT

451 TCTAAATAG
```

This corresponds to the amino acid sequence <SEQ ID 1148; ORF 279>:

```
m279.pep
    1 ITRICGCLIS TVFRASASLS AAGFIRLQWE GTDTGSGRAR LAPASLAAAM

51 ARPTAAALPA ITICPGELKL TASTTSLWAA SAQMALTCSS SKPRIAAIAP

101 TPCGTADCIS SARRRTSLTA SAKFNAPAAT SAVYSPRLCP ATAAGVLPPA

151 SK*
```

Computer analysis of this amino acid sequence gave the following results:
Homology with a Predicted ORF from *N. gonorrhoeae*
ORF 279 shows 89.5% identity over a 152 aa overlap with a predicted ORF (ORF 279.ng) from *N. gonorrhoeae*:

```
                   10        20        30        40        50        60
   m279.pep ITRICGCLISTVFRASASLSAAGFIRLQWEGTDTGSGRARLAPASLAAAMARPTAAALPA
            :||||||||||: :||||||||||||||||||||||||||||||||||||:||||||||
   g279     MTRICGCLISTVLSVSASLSAAGFIRLQWEGTDTGSGRARLAPASLAAAMVRPTAAALPA
                   10        20        30        40        50        60

70        80        90       100       110       120
   m279.pep ITICPGELKLTASTTSLWAASAQMALTCSSSKPRIAAIAPTPCGTADCISSARRRTSLTA
            || ||||||||||||||  |||: ||||||||::||||||||||||||||||||||||||
   g279     ITTCPGELKLTASTTSPCADSAQICLTCSSSKPKMAAIAPTPCGTADCISSARRRTSLTA
                   70        80        90       100       110       120

130       140       150
   m279.pep SAKFNAPAATSAVYSPRLCPATAAGVLPPASKX
            ||| || ||||||||||||||||||||||:|||
   g279     SAKSNASAATSAVYSPRLCPATAAGVLPPTSKX
                  130       140       150
```

The following partial DNA sequence was identified in *N. meningitidis* <SEQ ID 1149>:

```
a279.seq
    1 ATGACNCNGA TTTGCGGCTG CTTGATTTCA ACGGTTTNNA GGGCTTCGGC

51 GAGTTTGTCG GCGGCGGGTT TCATGAGGCT GCAATGGGAA GGTACNGACA

101 CNGGCAGCGG CAGGGCGCGT TTGGCGCCGG CTTCTTTGGC GGCAAGCATA

151 GCGCGCTCGA CGGCGGCGGC ATTGCCTGCA ATCACGACTT GTCCGGGCGA

201 GTTGAAGTTG ACGGCTTCAA CCACTTCATC CTGTGCGGAT TCGGCGCAAA

251 TTTGTTTTAC CTGTTCATCT TCCAAGCCGA GAATCGCCGC CATTGCGCCC

301 ACGCCTTGCG GTACGGCGGA CTGCATCAGT TCGGCGCGCA NGCGCACGAG

351 TTTGACCGCG TCGGCAAAAT CCAATGCGCC GGCGGCAACN AGTGCGGTGT

401 ATTCGCCGAN GCTGTGTCCG GCAACGGCGG CAGGCGTTTT GCCGCCCGCT

451 TCCGAATAG
```

This corresponds to the amino acid sequence <SEQ ID 1150; ORF 279.a>:

```
a279.pep
    1 MTXICGCLIS TVXRASASLS AAGFMRLQWE GTDTGSGRAR LAPASLAASI

51 ARSTAAALPA ITTCPGELKL TASTTSSCAD SAQICFTCSS SKPRIAAIAP

101 TPCGTADCIS SARXRTSLTA SAKSNAPAAT SAVYSPXLCP ATAAGVLPPA

151 SE*
``` m279/a279 88.2% identity in 152 aa overlap

```
                     10        20        30        40        50        60
m279.pep     ITRICGCLISTVFRASASLSAAGFIRLQWEGTDTGSGRARLAPASLAAAMARPTAAALPA
             :| ||||||||| |||||||||||:|||||||||||||||||||||||::|| |||||||
a279         MTXICGCLISTVXRASASLSAAGFMRLQWEGTDTGSGRARLAPASLAASIARSTAAALPA
                     10        20        30        40        50        60

70        80        90       100       110       120
m279.pep     ITICPGELKLTASTTSLWAASAQMALTCSSSKPRIAAIAPTPCGTADCISSARRRTSLTA
             || ||||||||||||| | |||: :||||||||||||||||||||||||||| ||||||
a279         ITTCPGELKLTASTTSSCADSAQICFTCSSSKPRIAAIAPTPCGTADCISSARXRTSLTA
                     70        80        90       100       110       120

130       140       150
m279.pep     SAKFNAPAATSAVYSPRLCPATAAGVLPPASKX
             ||| |||||||||||| ||||||||||||||:|
a279         SAKSNAPAATSAVYSPXLCPATAAGVLPPASEX
                    130       140       150
```

Expression of ORF 279

The primer described in Table 1 for ORF 279 was used to locate and clone ORF 279. ORF 279 was cloned in pET and pGex vectors and expressed in *E. coli* as above-described. The products of protein expression and purification were analyzed by SDS-PAGE. FIG. 2A shows the results of affinity purification and FIG. 2B shows the expression in *E. coli*. Purified GST-fusion protein was used to immunize mice whose sera were used for ELISA (positive result), FACS analysis (FIG. 2C), western blot (FIG. 2D). These experiments confirm that 279 is a surface-exposed protein and that it is a useful immunogen. The hydrophilicity plots, antigenic index, and amphipatic regions of ORF 279 are provided in FIG. 6. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 279 and the amino acid sequence encoded thereby is provided herein.

The following partial DNA sequence was identified in *N. gonorrhoeae* <SEQ ID 1151>:

```
g280.seq
    1 atgaaacacc tcaaacttac ccttattgcc gcattgctgg ccaccgccgc 51 aactgccgca ccccttccgg ttgtaaccag tttcagcatt ttaggcgacg 101 tagccaaaca aatcggcggt gagcgcgtag ccgtacaaag cctcgtcgga 151 gccaaccaag atactcatgc ctatcacatg accagtggcg acattaaaaa 201 aatccgcagt gcaaaactcg tcctgctcaa cggcttggga cttgaagccg 251 ccgacatcca acgcgccgtc aaacagagca agtatcctat gccgaagcg 301 accaaaggca tccaacccct caaagccgaa gaagaaggcg gacaccatca 351 cgaccaccat cacgaccacg atcatgacca cgaaggacac caccacgacc 401 acggcgaata tgaccccac gtctggaacg accctgttct tatgtccgac 451 tatgcccaaa acgtcgctga accctgata aaggccgatc ccgaaggcaa 501 agtttattat caacaacgct tgggcaacta ccaaatgcag cttaaaaaac 551 tgcacagcga cgcacaagcc gcatttaatg ccgtccctgc cgccaaacgc 601 aaagtcctga ccgggcacga cgcattttcc tacatgggca accgctacaa 651 catcagcttc atcgccccgc aaggcgtgag cagcgaagcc gagccgtccg 701 ccaaacaagt cgccgccatc atccggcaaa tcaaacgcga aggcatcaaa 751 gccgtattta ccgaaaatat caaagacacc cgcatggttg accgcatcgc 801 caaagaaacc ggcgtcaacg tcagcggcaa actgtattcc gacgcactcg 851 gcaacgcgcc cgcagacacc tacatcggca tgtaccgcca caacgtcgaa 901 gccttgacca acgcgatgaa gcaataa
```

This corresponds to the amino acid sequence <SEQ ID 1152; ORF 280.ng>:

```
g280.pep
    1 MKHLKLTLIA ALLATAATAA PLPVVTSFSI LGDVAKQIGG ERVAVQSLVG

51 ANQDTHAYHM TSGDIKKIRS AKLVLLNGLG LEAADIQRAV KQSKVSYAEA

101 TKGIQPLKAE EEGGHHHDHH HDHDHDHEGH HHDHGEYDPH VWNDPVLMSD

151 YAQNVAETLI KADPEGKVYY QQRLGNYQMQ LKKLHSDAQA AFNAVPAAKR

201 KVLTGHDAFS YMGNRYNISF IAPQGVSSEA EPSAKQVAAI IRQIKREGIK

251 AVFTENIKDT RMVDRIAKET GVNVSGKLYS DALGNAPADT YIGMYRHNVE

301 ALTNAMKQ*
```

The following partial DNA sequence was identified in *N. meningitidis* <SEQ ID 1153>:

```
m280.seq
    1 ATGAAACACC TCAAACTCAC CCTTATTGCC GCATTGCTGA CCGCCTCCGC

51 AACTGCCGCC CCCCTGCCGG TTGTAACCAG CTTCAGCATT TTAGGCGACG

101 TAGCCAAACA AATCGGCGGA GAGCGCGTAT CCATACAAAG TTTGGTCGGA

151 GCCAACCAAG ATACGCACGC CTATCATATG ACCAGTGGCG ACATTAAAAA

201 AATCCGCAGT GCAAAACTCG TCCTGCTCAA CGGCTTAGGA CTTGAAGCTG

251 CCGATGTGCA ACGCGCCGTC AAACAAAGCA AGTATCCTA TACCGAAGCG
```

```
301 ACCAAAGGCA TCCAACCCCT CAAAGCCGAA GAAGAAGGCG GACACCATCA

351 CGACCACGAT CATGACCACG AAGGACACCA CCATGACCAC GGCGAATATG

401 ACCCGCACGT CTGGAACGAC CCCGTCCTTA TGTCCGCCTA TGCCCAAAAC

451 GTTGCCAAAG CCCTGATAAA GGCCGATCCC GAAGGCAAAG TTTATTATCA

501 ACAACGCTTG GGCAACTACC AAATGCAGCT CAAAAAACTG CACAGCGACG

551 CACAAGCCGC ATTTAATGCC GTCCCTGCTG CCAAACGCAA AGTCCTGACC

601 GGGCACGATG CCTTTTCCTA TATGGGCAAA CGTTACCATA TCGAATTCAT

651 CGCCCCGCAA GGCGTGAGCA GCGAAGCCGA GCCTTCGGCC AAACAAGTCG

701 CCGCCATCAT CCGACAAATC AAACGCGAAG GCATCAAAGC CGTCTTTACC

751 GAAAACATCA AGGACACCCG TATGGTTGAC CGTATCGCCA AAGAAACCGG

801 TGTCAACGTC AGCGGCAAAC TGTATTCCGA CGCACTCGGC AACGCGCCCG

851 CAGACACCTA CATCGGAATG TACCGCCACA ACATCAAAGC CTTGACCAAC

901 GCGATGAAGC AATAA
```

This corresponds to the amino acid sequence <SEQ ID 1154; ORF 280>:

```
m280.pep
  1 MKHLKLTLIA ALLTASATAA PLPVVTSFSI LGDVAKQIGG ERVSIQSLVG

51 ANQDTHAYHM TSGDIKKIRS AKLVLLNGLG LEAADVQRAV KQSKVSYTEA

101 TKGIQPLKAE EEGGHHHDHD HDHEGHHHDH GEYDPHVWND PVLMSAYAQN

151 VAKALIKADP EGKVYYQQRL GNYQMQLKKL HSDAQAAFNA VPAAKRKVLT

201 GHDAFSYMGK RYHIEFIAPQ GVSSEAEPSA KQVAAIIRQI KREGIKAVFT

251 ENIKDTRMVD RIAKETGVNV SGKLYSDALG NAPADTYIGM YRHNIKALTN

301 AMKQ*
```

Computer analysis of this amino acid sequence gave the following results:
Homology with a Predicted ORF from *N. gonorrhoeae*
ORF 280 shows 93.8% identity over a 308 aa overlap with a predicted ORF (ORF 280.ng) from *N. gonorrhoeae*:

```
   m280/g280
                   10         20         30         40         50         60
     m280.pep    MKHLKLTLIAALLTASATAAPLPVVTSFSILGDVAKQIGGERVSIQSLVGANQDTHAYHM
                 ||||||||||:::||||||||||||||||||||||||||||||::||||||||||||||
         g280   MKHLKLTLIAALLATAATAAPLPVVTSFSILGDVAKQIGGERVAVQSLVGANQDTHAYHM
                   10         20         30         40         50         60

70         80         90        100        110        119
     m280.pep    TSGDIKKIRSAKLVLLNGLGLEAADVQRAVKQSKVSYTEATKGIQPLKAEEEGGHHHDH-
                 ||||||||||||||||||||||||||:|||||||||||:|||||||||||||||||||
         g280   TSGDIKKIRSAKLVLLNGLGLEAADIQRAVKQSKVSYAEATKGIQPLKAEEEGGHHHDHH
                   70         80         90        100        110        120

120        130        140        150        160        170
     m280.pep    ---DHDHEGHHHDHGEYDPHVWNDPVLMSAYAQNVAKALIKADPEGKVYYQQRLGNYQMQ
                    |||||||||||||||||||||||||| ||||::||||||||||||||||||||||||
         g280   HDHDHDHEGHHHDHGEYDPHVWNDPVLMSDYAQNVAETLIKADPEGKVYYQQRLGNYQMQ
                  130        140        150        160        170        180

180        190        200        210        220        230
     m280.pep    LKKLHSDAQAAFNAVPAAKRKVLTGHDAFSYMGKRYHIEFIAPQGVSSEAEPSAKQVAAI
                 |||||||||||||||||||||||||||||||||::||:|||||||||||||||||||||
         g280   LKKLHSDAQAAFNAVPAAKRKVLTGHDAFSYMGNRYNISFIAPQGVSSEAEPSAKQVAAI
                  190        200        210        220        230        240
```

-continued

```
                240        250        260        270        280        290
m280.pep   IRQIKREGIKAVFTENIKDTRMVDRIAKETGVNVSGKLYSDALGNAPADTYIGMYRHNIK
           ||||||||||||||||||||||||||||||||||||||||||||||||||||||||||::
g280       IRQIKREGIKAVFTENIKDTRMVDRIAKETGVNVSGKLYSDALGNAPADTYIGMYRHNVE
                     250        260        270        280        290        300

300
m280.pep   ALTNAMKQX
           |||||||||
g280       ALTNAMKQX
```

The following partial DNA sequence was identified in *N. meningitidis* <SEQ ID 1155>:

```
a280.seq
   1 ATGAAACACC CCAAACTCAC CCTTATCGCC GCATTGCTGA CCACTGCCGC

51 AACTGCCGCC CCCCTGCCGG TTGTAACCAG CTTCAGCATT TTAGGCGACG

101 TAGCCAAACA AATCGGCGGA GAGCGCGTAT CCATACAAAG TTTGGTCGGA

151 GCCAACCAAG ATACGCACGC CTATCATATG ACCAGCGGCG ACATTAAAAA

201 AATCCGCAGT GCAAAACTCG TCCTGATTAA CGGCTTAGGA CTTGAAGCTG

251 CCGACATCCA ACGTGCCGTC AAACAGAGCA AAGTATCCTA TGCCGAAGCG

301 ACCAAAGGCA TCCAACCCCT CAAAGCCGAA GAAGAAGGCG GACACCATCA

351 CGACCACGAT CATGACCACG ACCATGACCA CGAAGGACAC CACCACGACC

401 ACGGCGAATA TGACCCCCAC GTCTGGAACG ACCCCGTCCT TATGTCCGCC

451 TATGCCCAAA ACGTCGCCGA AGCCCTGATA AAGGCCGACC CCGAAGGCAA

501 AGTTTATTAT CAACAACGCT TGGGCAACTA CCAAATGCAG CTCAAAAAAC

551 TGCACAGTGA CGCACAAGCC GCATTTAATG CCGTCCCTGC CGCCAAACGC

601 AAAGTCCTGA CCGGGCACGA TGCCTTTTCC TATATGGGCA AACGTTACCA

651 TATCGAATTC ATCGCCCCAC AAGGTGTGAG CAGCGAAGCC GAGCCTTCAG

701 CCAAACAAGT CGCCGCCATC ATCCGACAAA TCAAACGCGA AGGCATCAAA

751 GCCGTATTTA CCGAAAATAT CAAAGACACC CGCATGGTTG ACCGCATCGC

801 CAAAGAAACC GGTGTCAACG TCAGCGGCAA ACTGTATTCC GACGCACTCG

851 GCAACGCACC CGCAGACACC TACATCGGCA TGTACCGCCA CAACATCAAA

901 GCCTTAACCA ACGCGATGAA GCAATAA
```

This corresponds to the amino acid sequence <SEQ ID 1156; ORF 280.a>:

```
a280.pep
   1 MKHPKLTLIA ALLTTAATAA PLPVVTSFSI LGDVAKQIGG ERVSIQSLVG

51 ANQDTHAYHM TSGDIKKIRS AKLVLINGLG LEAADIQRAV KQSKVSYAEA

101 TKGIQPLKAE EEGGHHHDHD HDHDHDHEGH HHDHGEYDPH VWNDPVLMSA

151 YAQNVAEALI KADPEGKVYY QQRLGNYQMQ LKKLHSDAQA AFNAVPAAKR

201 KVLTGHDAFS YMGKRYHIEF IAPQGVSSEA EPSAKQVAAI IRQIKREGIK

251 AVFTENIKDT RMVDRIAKET GVNVSGKLYS DALGNAPADT YIGMYRHNIK

301 ALTNAMKQ*
``` m280/a280 96.4% identity in 308 aa overlap

```
              10         20         30         40         50         60
m280.pep  MKHLKLTLIAALLTASATAAPLPVVTSFSILGDVAKQIGGERVSIQSLVGANQDTHAYHM
          |||  ||||||||| |:||||||||||||||||||||||||||||:|||||||||||||
g280      MKHLKLTLIAALLATAATAAPLPVVTSFSILGDVAKQIGGERVAVQSLVGANQDTHAYHM
              10         20         30         40         50         60

70         80         90        100        110        120
m280.pep  TSGDIKKIRSAKLVLLNGLGLEAADVQRAVKQSKVSYTEATKGIQPLKAEEEGGHHHDHD
          ||||||||||||||||||||||||:||||||||||||||:|||||||||||||||||||
g280      TSGDIKKIRSAKLVLLNGLGLEAADIQRAVKQSKVSYAEATKGIQPLKAEEEGGHHHDHD
              70         80         90        100        110        120

130        140        150        160        170
m280.pep  HDH----EGHHHDHGEYDPHVWNDPVLMSAYAQNVAKALIKADPEGKVYYQQRLGNYQMQ
          |||    |||||||||||||||||||||||:|||||| |||||||||||||||||||||
g280      HDHDHDHEGHHHDHGEYDPHVWNDPVLMSDYAQNVAETLIKADPEGKVYYQQRLGNYQMQ
              130        140        150        160        170        180

180        190        200        210        220        230
m280.pep  LKKLHSDAQAAFNAVPAAKRKVLTGHDAFSYMGKRYHIEFIAPQGVSSEAEPSAKQVAAI
          ||||||||||||||||||||||||||||||||||||||||||||||||||||||||||||
g280      LKKLHSDAQAAFNAVPAAKRKVLTGHDAFSYMGKRYHIEFIAPQGVSSEAEPSAKQVAAI
              190        200        210        220        230        240

240        250        260        270        280        290
m280.pep  IRQIKREGIKAVFTENIKDTRMVDRIAKETGVNVSGKLYSDALGNAPADTYIGMYRHNIK
          ||||||||||||||||||||||||||||||||||||||||||||||||||||||||||||
g280      IRQIKREGIKAVFTENIKDTRMVDRIAKETGVNVSGKLYSDALGNAPADTYIGMYRHNIK
              250        260        270        280        290        300

300
m280.pep  ALTNAMKQX
          |||||||||
g280      ALTNAMKQX
```

The following partial DNA sequence was identified in *N. gonorrhoeae* <SEQ ID 1157>:

```
g281.seq
   1 atgcactacg ccctcgcatc cgtcttctgc ctgtccctca gcgccgcacc 51 cgtcggcgta ttcctcgtca tgcgccgtat gagcctgata ggcgacgcat 101 tgagccacgc cgtcctgccc ggtgccgccg tcggctacat gtttgccggc 151 ttgagcctgc ccgctatggg tgtgggcggg tttgccgccg gtatgctgat 201 ggcgctgctt gccggactcg tcagccgctt taccaccctg aaagaagatg 251 ccaactttgc cgccttttac ctgagcagcc tcgccatcgg cgtaatcctc 301 atcagcaaaa acggcagcag cgtcgattta ctccacctcc ttttcggatc 351 tgtgcttgcc gtcgatattc ccgcactgca actcatcgcc gccgtctccg 401 gcctcacgct cattacccct gccgtcatct accgcccccct ggtgctagaa 451 agcatagacc cccttttcct caagtccgtc aacggcaaag gcgggctttg 501 gcacgtcatt ttcctcatcc tcgtcgttat gaacctcgta tccggcttcc 551 aagctctcgg catcctgatg tcggtcggaa ttatgatgct gcccgccatt 601 accgcccgtt tatgggcaag aaatatgggg acgctcattc tgttgtccgt 651 cctcatcgcc ctttttgcg gtttgatcgg gctgctcatt tcctaccaca 701 tcgaaatccc ttccggcccc gccatcatcc tctgttgcag cgtcctttat 751 cttttttccg tcatactcgg caaagaaggc ggcatcttgc ccaaatggtt 801 caaaaaccac cgccaccaca ccacctga
```

This corresponds to the amino acid sequence <SEQ ID 1158; ORF 281.ng>:

```
g281.pep
    1 MHYALASVFC LSLSAAPVGV FLVMRRMSLI GDALSHAVLP GAAVGYMFAG

51 LSLPAMGVGG FAAGMLMALL AGLVSRFTTL KEDANFAAFY LSSLAIGVIL

101 ISKNGSSVDL LHLLFGSVLA VDIPALQLIA AVSGLTLITL AVIYRPLVLE

151 SIDPLFLKSV NGKGGLWHVI FLILVVMNLV SGFQALGILM SVGIMMLPAI

201 TARLWARNMG TLILLSVLIA LFCGLIGLLI SYHIEIPSGP AIILCCSVLY

251 LFSVILGKEG GILPKWFKNH RHHTT*
```

The following partial DNA sequence was identified in *N. meningitidis* <SEQ ID 1159>:

```
m281.seq (partial)
    1 ATGCGCTACG CCCTCGCATC CGTCTTCTGC CTGTCCCTCA GTGCCGCACC

51 CGTCGGCGTA TTCCTCGTCA TGCGCCGTAT GAGCCTGATA GGCGACGCAT

101 TGAGCCACGC CGTCCTGCCC GGTGCCGCCG TCGGCTACAT GTTTGCCGGC

151 TTGAGCCTGC CGCCATGGG TTTGGGCGGC GTAGCCGCAG GCATGCTGAT

201 GGCACTGCTT GCCGGACTCG TCAGCCGCTT CACCACCCTG AAAGAAGATG

251 CCAACTTTGC CGCCTTTTAT CTCAGCAGCC TCGCCATCGG CGTAGTCCTC

301 GTCAGCAAAA ACGGGAGCAG CGTCGATTTG CTCCACCTCC TTTTCGGCTC

351 TGTACTTGCC GTCGATATTC CTGCCCTGCA GCTCATCGCC GCCGTCTCCA

401 GCCTCACGCT CATTACCCTT GCCGTCATCT ACCGCCCGCT CGTACTCGAA

451 AGCATCGACC CCCTGTTTCT CAAATCCGTC GGCGGCAAAG GCGGGCTTTG

501 GCACGTCCTC TTTCTCGTCC TGGTCGTCAT GAACCTCGTA TCCGGCTTTC

551 AAGCCCTCGG CACACTCATG TCCGTCGGAC TCATGATGCT GCCAGCCATT

601 ACCGCCCGCC TGTGGGCGAA GCATATGGGC GCACTCATCC TCCTATCCGT

651 TCTGACAGCC CTGCTGTGCG GCTTGAGCGG ACTGCTCATT TCCTACCACA

701 TCGAAATTCC TTCCGGTCCC GCCATCATCC TCTGTTGCAG CGTCCTTTAT

751 CTCTTTTCCG TCATACTCGG CAAAGAAGGC GGCATTCTGA CC..
```

This corresponds to the amino acid sequence <SEQ ID 1160; ORF 281>:

```
m281.pep (partial)
    1 MRYALASVFC LSLSAAPVGV FLVMRRMSLI GDALSHAVLP GAAVGYMFAG

51 LSLPAMGLGG VAAGMLMALL AGLVSRFTTL KEDANFAAFY LSSLAIGVVL

101 VSKNGSSVDL LHLLFGSVLA VDIPALQLIA AVSSLTLITL AVIYRPLVLE

151 SIDPLFLKSV GGKGGLWHVL FLVLVVMNLV SGFCALGILM SVGLMMLPAI

201 TARLWAKHMG ALILLSVLTA LLCGLSGLLI SYHIEIPSGP AIILCCSVLY

251 LFSVILGKEG GILT . . .
```

Computer analysis of this amino acid sequence gave the following results:

Homology with a Predicted ORF from *N. gonorrhoeae*

ORF 281 shows 93.5% identity over a 263 aa overlap with a predicted ORF (ORF 281.ng) from *N. gonorrhoeae*:

```
m281/g281

10        20        30        40        50        60
     m281.pep  MRYALASVFCLSLSAAPVGVFLVMRRMSLIGDALSHAVLPGAAVGYMFAGLSLPAMGLGG
               |:||||||||||||||||||||||||||||||||||||||||||||||||||||||||:||
     g281      MHYALASVFCLSLSAAPVGVFLVMRRMSLIGDALSHAVLPGAAVGYMFAGLSLPAMGVGG
                      10        20        30        40        50        60

70        80        90       100       110       120
     m281.pep  VAAGMLMALLAGLVSRFTTLKEDANFAAFYLSSLAIGVVLVSKNGSSVDLLHLLFGSVLA
               |||||||||||||||||||||||||||||||||||||||||:|:||||||||||||||||
     g281      FAAGMLMALLAGLVSRFTTLKEDANFAAFYLSSLAIGVILISKNGSSVDLLHLLFGSVLA
                      70        80        90       100       110       120

130       140       150       160       170       180
     m281.pep  VDIPALQLIAAVSSLTLITLAVIYRPLVLESIDPLFLKSVGGKGGLWHVLFLVLVVMNLV
               ||||||||||||:|||||||||||||||||||||||||||:||||||:||:||||||||
     g281      VDIPALQLIAAVSGLTLITLAVIYRPLVLESIDPLFLKSVNGKGGLWHVIFLILVVMNLV
                     130       140       150       160       170       180

190       200       210       220       230       240
     m281.pep  SGFQALGTLMSVGLMMLPAITARLWAKHMGALILLSVLTALLCGLSGLLISYHIEIPSGP
               |||||||:|||||:||||||||||||:::||:||||||:|||:||||||||||||||||
     g281      SGFQALGILMSVGIMMLPAITARLWARNMGTLILLSVLIALFCGLIGLLISYHIEIPSGP
                     190       200       210       220       230       240

250       260
     m281.pep  AIILCCSVLYLFSVILGKEGGILT
               ||||||||||||||||||||||||
     g281      AIILCCSVLYLFSVILGKEGGILPKWFKNHRHHTTX
                     250       260       270
```

The following partial DNA sequence was identified in *N. meningitidis* <SEQ ID 1161>:

```
a281.seq
   1 ATGCGCTACG CCCTCGCATC CGTCTTCTGC CTGTCCCTCA GTGCCGCACC

51 CGTCGGCGTA TTCCTCGTCA TGCGCCGTAT GAGCCTGATA GGCGACGCAT

101 TGAGCCACGC CGTCCTGCCC GGTGCCGCCG TCGGCTACAT GTTTGCCGGC

151 TTAAGCCTGC CCGCCATGGG TTTGGGCGGC GTAGCCGCAG GTATGCTGAT

201 GGCACTGCTT GCCGGACTCG TCAGCCGCTT CACCACCCTG AAAGAAGATG

251 CCAACTTTGC CGCCTTTTAT CTCAGCAGCC TCGCCATCGG TGTAGTCCTC

301 GTCAGCAAAA ACGGCAGCAG CGTCGATTTG CTCCACCTCC TTTTCGGCTC

351 CGTACTTGCC GTCGATATTC CTGCCCTGCA ACTCATCGCC GCCGTATCCA

401 CCCTCACACT GCTTACCCTT GCCGTCATCT ACCGCCCGCT CGTACTCGAA

451 AGCATCGACC CCCTGTTTCT CAAATCTGTC GGCGGCAAAG GCGGGCTTTG

501 GCACGTCCTC TTTCTCGTCC TGGTCGTCAT GAACCTCGTA TCCGGCTTTC

551 AAGCCCTCGG CACACTCATG TCCGTCGGAC TTATGATGCT GCCAGCCATT

601 ACCGCCCGCC TATGGGCGAA GCACATGGGC GCACTCATCC TCCTATCCGT

651 TCTGACAGCC CTGCTGTGCG GCTTGAGCGG ACTGCTCATT TCCTACCACA

701 TCGAAATTCC TTCCGGTCCC GCCATCATCC TCTGTTGCAG CGTCCTTTAT

751 CTCTTTTCCG TCATACTCGG CAAAGAAGGC GGCATTCTGA CCAAATGGCT

801 CAAAAACCAC CGCCACCACA CCACCTGA
```

This corresponds to the amino acid sequence <SEQ ID 1162; ORF 281.a>:

```
a281.pep
    1 MRYALASVFC LSLSAAPVGV FLVMRRMSLI GDALSHAVLP GAAVGYMFAG

51 LSLPAMGLGG VAAGMLMALL AGLVSRFTTL KEDANFAAFY LSSLAIGVVL

101 VSKNGSSVDL LHLLFGSVLA VDIPALQLIA AVSTLTLLTL AVIYRPLVLE

151 SIDPLFLKSV GGKGGLWHVL FLVLVVMNLV SGFQALGTLM SVGLMMLPAI

201 TARLWAKHMG ALILLSVLTA LLCGLSGLLI SYHIEIPSGP AIILCCSVLY

251 LFSVILGKEG GILTKWLKNH RHHTT*
``` m281/a281 99.2% identity in 264 aa overlap

```
                   10        20        30        40        50        60
    m281.pep    MRYALASVFCLSLSAAPVGVFLVMRRMSLIGDALSHAVLPGAAVGYMFAGLSLPAMGLGG
                ||||||||||||||||||||||||||||||||||||||||||||||||||||||||:||
    a281        MRYALASVFCLSLSAAPVGVFLVMRRMSLIGDALSHAVLPGAAVGYMFAGLSLPAMGVGG
                   10        20        30        40        50        60

70        80        90       100       110       120
    m281.pep    VAAGMLMALLAGLVSRFTTLKEDANFAAFYLSSLAIGVVLVSKNGSSVDLLHLLFGSVLA
                ||||||||||||||||||||||||||||||||||||||||||||||||||||||||||||
    a281        VAAGMLMALLAGLVSRFTTLKEDANFAAFYLSSLAIGVVLVSKNGSSVDLLHLLFGSVLA
                   70        80        90       100       110       120

130       140       150       160       170       180
    m281.pep    VDIPALQLIAAVSSLTLITLAVIYRPLVLESIDPLFLKSVGGKGGLWHVLFLVLVVMNLV
                ||||||||||||:|||:|||||||||||||||||||||||||||||||||||||||||||
    a281        VDIPALQLIAAVSTLTLLTLAVIYRPLVLESIDPLFLKSVGGKGGLWHVLFLVLVVMNLV
                  130       140       150       160       170       180

190       200       210       220       230       240
    m281.pep    SGFQALGTLMSVGLMMLPAITARLWAKHMGALILLSVLTALLCGLSGLLISYHIEIPSGP
                ||||||||||||||||||||||||||||||||||||||||||||||||||||||||||||
    a281        SGFQALGTLMSVGLMMLPAITARLWAKHMGALILLSVLTALLCGLSGLLISYHIEIPSGP
                  190       200       210       220       230       240

250       260
    m281.pep    AIILCCSVLYLFSVILGKEGGILT
                ||||||||||||||||||||||||
    a281        AIILCCSVLYLFSVILGKEGGILTKWLKNHRHHTTX
                  250       260       270
```

The following partial DNA sequence was identified in *N. gonorrhoeae* <SEQ ID 1163>:

```
g282.seq
    1 atgggattgg gtatggaaat cggcaagctg attgtggctc ttttggtgct 51 gatcaatccg tttagcgcgt tgtcgcttta ccttgacctg accaacggac 101 acagcacgaa ggagcgcagg aaggtcgcgc ggacggccgc cgtcgccgtg 151 tttgccgtga ttgcggtatt tgcgctgatc ggcggtgcgc tattgaaggt 201 tttgggcatc agcgtcggtt cgtttcaggt cggcggcggg attttggtgc 251 tgctgatcgc catttcgatg atgaacggca acgacaatcc cgccaagcag 301 aatctcggcg cgcagccgga aacggggcaa gcgcgccccg cccgcaatgc 351 aggggcgatt gccgtcgtgc ccatcgccat accgatcacc atcggtccgg 401 gcggtatttc gactgtgatt atttatgctt cggcagccaa aacgtacagc 451 gatatcgcgc tgattatcgc ggccggtttg gtggtcagtg cgatttgtta 501 tgccattta atcgttgccg ggaaggtcag ccgcctgctg ggcgcgacgg 551 ggctgacgat tttaaaccgc attatgggta tgatgctggc ggcggtatcg 601 gtggagatta ttgtgtcggg actgaaaacg atattcccgc aactggcagg 651 ttga
```

This corresponds to the amino acid sequence <SEQ ID 1164; ORF 282.ng>:

```
g282.pep
    1 MGLGMEIGKL IVALLVLINP FSALSLYLDL TNGHSTKERR KVARTAAVAV

51 FAVIAVFALI GGALLKVLGI SVGSFQVGGG ILVLLIAISM MNGNDNPAKQ

101 NLGAQPETGQ ARPARNAGAI AVVPIAIPIT IGPGGISTVI IYASAAKTYS

151 DIALIIAAGL VVSAICYAIL IVAGKVSRLL GATGLTILNR IMGMMLAAVS

201 VEIIVSGLKT IFPQLAG*
```

The following partial DNA sequence was identified in *N. meningitidis* <SEQ ID 1165>:

```
m282.seq
    1 ATGGGATTGG GCATGGAAAT CGGCAAGCTG ATTGTGGCTT TTTTGGTGCT

51 GATTAATCCG TTTAGCGCGT TGTCGCTTTA CCTTGACCTG ACCAACGGGC

101 ACAGCACGAA GGAGCGCAGG AAGGTCGCGC GGACGGCCGC CGTTGCCGTG

151 TTTGCCGTGA TTGCGGTATT TGCGCTGATC GGCGGTACGC TGCTGAAGGT

201 TTTGGGCATC AGCGTCGGTT CGTTTCAGGT CGGCGGCGGG ATTTTGGTGC

251 TGCTGATCGC CATTTCGATG ATGAACGGCA ACGACAATCC CGCCAAGCAG

301 AATCTCGGCG CGCAGCCGGA AACGGGGCAG GCGCGCCCCG CCCGCAATGC

351 CGGAGCGATT GCCGTCGTGC CCATCGCCAT ACCGATCACC ATCGGCCCGG

401 GCGGTATTTC GACCGTGATT ATTTACGCTT CGGCGGCTAA ACATACGGC

451 GACATCGCGT TGATTATCGC GGCCGGTTTG GTGGTCAGTG CGATTTGTTA

501 TGCCATTTTA ATCGTTGCCG GGAAGGTCAG CCGCCTGCTG GGCGCGACGG

551 GGCTGACGAT TTTAAACCGC ATTATGGGTA TGATGCTGGC GGCGGTATCG

601 GTGGAGATTA TTGTGTCGGG ACTGAAAACG ATATTCCCGC AACTGGCAGG

651 TTGA
```
                                                                                          40

This corresponds to the amino acid sequence <SEQ ID 1166; ORF 282.ng>:

```
m282.pep
    1 MGLGMEIGKL IVAFLVLINP FSALSLYLDL TNGHSTKERR KVARTAAVAV

51 FAVIAVFALI GGTLLKVLGI SVGSFQVGGG ILVLLIAISM MNGNDNPAKQ

101 NLGAQPETGQ ARPARNAGAI AVVPIAIPIT IGPGGISTVI IYASAAKTYG

151 DIALIIAAGL VVSAICYAIL IVAGKVSRLL GATGLTILNR IMGMMLAAVS

201 VEIIVSGLKT IFPQLAG*
```

Computer analysis of this amino acid sequence gave the following results:
Homology with a Predicted ORF from *N. gonorrhoeae*
ORF 282 shows 98.6% identity over a 217 aa overlap with a predicted ORF (ORF 282.ng) from *N. gonorrhoeae*:

```
    m282/g282

10         20         30         40         50         60
    m282.pep   MGLGMEIGKLIVAFLVLINPFSALSLYLDLTNGHSTKERRKVARTAAVAVFAVIAVFALI
               ||||||||||||:|||||||||||||||||||||||||||||||||||||||||||||||
    g282       MGLGMEIGKLIVALLVLINPFSALSLYLDLTNGHSTKERRKVARTAAVAVFAVIAVFALI
                  10         20         30         40         50         60
```

-continued

```
                 70        80        90        100       110       120
m282.pep  GGTLLKVLGISVGSFQVGGGILVLLIAISMMNGNDNPAKQNLGAQPETGQARPARNAGAI
          ||:|||||||||||||||||||||||||||||||||||||||||||||||||||||||||
g282      GGALLKVLGISVGSFQVGGGILVLLIAISMMNGNDNPAKQNLGAQPETGQARPARNAGAI
                 70        80        90        100       110       120

130       140       150       160       170       180
m282.pep  AVVPIAIPITIGPGGISTVIIYASAAKTYGDIALIIAAGLVVSAICYAILIVAGKVSRLL
          |||||||||||||||||||||||||||||:||||||||||||||||||||||||||||||
g282      AVVPIAIPITIGPGGISTVIIYASAAKTYSDIALIIAAGLVVSAICYAILIVAGKVSRLL
                130       140       150       160       170       180

190       200       210
m282.pep  GATGLTILNRIMGMMLAAVSVEIIVSGLKTIFPQLAGX
          ||||||||||||||||||||||||||||||||||||||
g282      GATGLTILNRIMGMMLAAVSVEIIVSGLKTIFPQLAGX
                190       200       210
```

The following partial DNA sequence was identified in *N. meningitidis* <SEQ ID 1167>:

```
a282.seq
    1 ATGGGATTGG GCATGGAAAT CGGCAAGCTG ATTGTGGCTT TTTTGGTGCT

51 GATTAATCCG TTTAGCGCGT TGTCGCTTTA CCTTGACCTG ACCAACGGGC

101 ACAGCACGAA GGAGCGCAGG AAGGTCGCGC GGACGGCCGC CGTTGCCGTG

151 TTTGCCGTGA TTGCGGTATT TGCGCTGATC GGCGGTACGC TGCTGAAGGT

201 TTTGGGCATC AGCGTCGGTT CGTTTCAGGT CGGCGGCGGA ATTTTGGTGT

251 TGCTGATTGC CATTTCGATG ATGAACGGCA ACGACAATCC CGCCAAGCAG

301 AATCTCGGCG CGCAGCCGGA AACGGGGCAG GTGCGCCCCG CCCGCAATGC

351 CGGAGCGATT GCCGTCGTGC CCATCGCCAT ACCGATCACC ATCGGCCCGG

401 GCGGTATTTC GACCGTGATT ATTTACGCTT CGGCGGCTAA AACATACGGC

451 GACATCGCGT TGATTATCGC GGCCGGTTTG GTGGTCAGTG CGATTTGTTA

501 TGCCATTTTA ATCGTTGCCG GGAAGGTCAG CCGCCTGCTG GGTGCGACGG

551 GGCTGACGAT TTTAAACCGT ATCATGGGTA TGATGCTGGC GGCGGTATCG

601 GTGGAGATTA TTGTGTCGGG ACTGAAAATG ATATTCCCGC AACTGGCAGG

651 TTGA
```

This corresponds to the amino acid sequence <SEQ ID 1168; ORF 282.a>:

```
a282.pep
    1 MGLGMEIGKL IVAFLVLINP FSALSLYLDL TNGHSTKERR KVARTAAVAV

51 FAVIAVFALI GGTLLKVLGI SVGSFQVGGG ILVLLIAISM MNGNDNPAKQ

101 NLGAQPETGQ VRPARNAGAI AVVPIAIPIT IGPGGISTVI IYASAAKTYG

151 DIALIIAAGL VVSAICYAIL IVAGKVSRLL GATGLTILNR IMGMMLAAVS

201 VEIIVSGLKM IFPQLAG*
``` m282/a282 99.1% identity in 217 aa overlap

```
                 10        20        30        40        50        60
m282.pep  MGLGMEIGKLIVAFLVLINPFSALSLYLDLTNGHSTKERRKVARTAAVAVFAVIAVFALI
          ||||||||||||||||||||||||||||||||||||||||||||||||||||||||||||
a282      MGLGMEIGKLIVAFLVLINPFSALSLYLDLTNGHSTKERRKVARTAAVAVFAVIAVFALI
                 10        20        30        40        50        60
```

-continued

```
                 70         80         90        100        110        120
m282.pep  GGTLLKVLGISVGSFQVGGGILVLLIAISMMNGNDNPAKQNLGAQPETGQARPARNAGAI
          ||||||||||||||||||||||||||||||||||||||||||||||||||:||||||||
a282      GGTLLKVLGISVGSFQVGGGILVLLIAISMMNGNDNPAKQNLGAQPETGQVRPARNAGAI
                 70         80         90        100        110        120

130        140        150        160        170        180
m282.pep  AVVPIAIPITIGPGGISTVIIYASAAKTYGDIALIIAAGLVVSAICYAILIVAGKVSRLL
          ||||||||||||||||||||||||||||||||||||||||||||||||||||||||||||
a282      AVVPIAIPITIGPGGISTVIIYASAAKTYGDIALIIAAGLVVSAICYAILIVAGKVSRLL
                130        140        150        160        170        180

190        200        210
m282.pep  GATGLTILNRIMGMMLAAVSVEIIVSGLKTIFPQLAGX
          |||||||||||||||||||||||||||||| ||||||
a282      GATGLTILNRIMGMMLAAVSVEIIVSGLKMIFPQLAGX
                190        200        210
```

The following partial DNA sequence was identified in *N. gonorrhoeae* <SEQ ID 1169>:

```
g283.seq
    1 atgaactttg ctttatccgt catcacattt accctcgcct ctttcctgcc 51 cgtcccgcct gccggaaccg ccgtctttac ttggaaagac ggcggcggca 101 acagctattc ggatgtgccg aaacagcttc atcccgacca gagccaaatc 151 ctcaacctgc ggacgctcca aaccaaaccg gcggtcaagc ccaaacctgc 201 cgtcgatacg aatgcggaca gtgcgaagga aaacgaaaag gatatcgccg 251 agaaaaacgg gcagcttgag gaagaaaaga aaaaaattgc cgaaaccgaa 301 cggcagaaca agaagaaaa ctgccggatt tcaaaaatga acctgaaggc 351 ggtgggaaac tcaaatgcga aaacaagga tgatttgatc cgtaaataca 401 ataacgccgt aaacaaatac tgccgttaa
```

This corresponds to the amino acid sequence <SEQ ID 1170; ORF 283.ng>:

```
g283.pep
    1 MNFALSVITF TLASFLPVPP AGTAVFTWKD GGGNSYSDVP KQLHPDQSQI

51 LNLRTLQTKP AVKPKPAVDT NADSAKENEK DIAEKNGQLE EEKKKIAETE

101 RQNKEENCRI SKMNLKAVGN SNAKNKDDLI RKYNNAVNKY CR*
```

The following partial DNA sequence was identified in *N. meningitidis* <SEQ ID 1171>:

```
m283.seq
    1 ATGAACTTTG CTTTATCCGT CATTATGTTG ACCCTCGCCT CTTTCCTGCC

51 CGTCCCGCCT GCCGGAGCCG CCGTCTTTAC TTGGAAGGAC GGCGGCGGCA

101 ACAGCTATTC GGATGTACCG AAACAGCTTC ATCCCGACCA AAGCCAAATC

151 TTAAACCTGC GGACGCGCCA AACCAAACCG GCGGTCAAAC CCGCCCAAGC

201 CGACGCAGGG AAGCGCACAG ACGGCGCGGC ACAGGAAAAC AATCCCGACA

251 CTGCCGAGAA AAACCGGCAG CTTGAGGAAG AAAGAAAAG AATTGCCGAA

301 ACCGAACGGC AGAACAAAGA AGAAACTGC CGGATTTCAA AAATGAACCT

351 GAAGGCGGTG GGAAATTCAA ATGCAAAAAA CAAGGATGAT TTGATTCGGA

401 AATACAATAA CGCCGTAAAC AAATACTGCC GTTAA
```

This corresponds to the amino acid sequence <SEQ ID 1172; ORF 283>:

```
m283.pep
    1 MNFALSVIML TLASFLPVPP AGAAVFTWKD GGGNSYSDVP KQLHPDQSQI

51 LNLRTRQTKP AVKPAQADAG KRTDGAAQEN NPDTAEKNRQ LEEEKKRIAE

101 TERQNKEENC RISKMNLKAV GNSNAKNKDD LIRKYNNAVN KYCR*
```

Computer analysis of this amino acid sequence gave the following results:
Homology with a Predicted ORF from *N. gonorrhoeae*

```
    m283/g283  86.1% identity in 144 aa overlap 10         20         30         40         50         60
    m283.pep    MNFALSVIMLTLASFLPVPPAGAAVFTWKDGGGNSYSDVPKQLHPDQSQILNLRTRQTKP
                ||||||| :||||||||||||:||||||||||||||||||||||||||||||||| ||||
    g283        MNFALSVITFTLASFLPVPPAGTAVFTWKDGGGNSYSDVPKQLHPDQSQILNLRTLQTKP
                    10         20         30         40         50         60

70         80         90        100        110        120
    m283.pep    AVKPAQADAGKRTDGAAQENNPDTAEKNRQLEEEKKRIAETERQNKEENCRISKMNLKAV
                ||||   | :    :| :|:||: |  ||||  ||||||:||||||||||||||||||||
    g283        AVKPKPA-VDTNAD-SAKENEKDIAEKNGQLEEEKKKIAETERQNKEENCRISKMNLKAV
                    70         80         90        100        110

130        140
    m283.pep    GNSNAKNKDDLIRKYNNAVNKYCRX
                |||||||||||||||||||||||||
    g283        GNSNAKNKDDLIRKYNNAVNKYCRX
                   120        130        140
```

The following partial DNA sequence was identified in *N. meningitidis* <SEQ ID 1173>:

```
a283.seq
    1 ATGAACTTTG CTTTATCCGT CATTATGTTG ACCCTCGCCT CTTTCCTGCC

51 CGTCCCGCCT GCCGGAGCCG CCGTCTTTAC TTGGAAGGAC GGCGGCGGCA

101 ACAGCTATTC GGATGTACCG AAACAGCTTC ATCCCGACCA AAGCCAAATC

151 TTAAACCTGC GGACGCGCCA AACCAAACCG GCGGTCAAAC CCGCCCAAGC

201 CGACGCAGGG AAGCGCACAG ACGGCGCGGC ACAGGAAAAC AATCCCGACA

251 CTGCCGAGAA AAACCGGCAG CTTGAGGAAG AAAAGAAAAG AATTGCCGAA

301 ACCGAACGGC AGAACAAAGA AGAAAACTGC CGGATTTCAA AAATGAACCT

351 GAAAGCGGTG GGAAATTCAA ATGCAAAAAA CAAGGATGAT TTGATTCGGA

401 AATACAATAA CGCCGTAAAC AAATACTGCC GTTAA
```

This corresponds to the amino acid sequence <SEQ ID 1174; ORF 283.a>:

```
a283.pep
        1 MNFALSVIML TLASFLPVPP AGAAVFTWKD GGGNSYSDVP KQLHPDQSQI

51 LNLRTRQTKP AVKPAQADAG KRTDGAAQEN NPDTAEKNRQ LEEEKKRIAE

101 TERQNKEENC RISKMNLKAV GNSNAKNKDD LIRKYNNAVN KYCR* m283/a283   100.0% identity in 144 aa overlap 10         20         30         40         50         60
    m283.pep    MNFALSVIMLTLASFLPVPPAGAAVFTWKDGGGNSYSDVPKQLHPDQSQILNLRTRQTKP
                ||||||||||||||||||||||||||||||||||||||||||||||||||||||||||||
    a283        MNFALSVIMLTLASFLPVPPAGAAVFTWKDGGGNSYSDVPKQLHPDQSQILNLRTRQTKP
                    10         20         30         40         50         60
```

```
                70        80        90       100       110       120
m283.pep  AVKPAQADAGKRTDGAAQENNPDTAEKNRQLEEEKKRIAETERQNKEENCRISKMNLKAV
          ||||||||||||||||||||||||||||||||||||||||||||||||||||||||||||
a283      AVKPAQADAGKRTDGAAQENNPDTAEKNRQLEEEKKRIAETERQNKEENCRISKMNLKAV
                70        80        90       100       110       120

130       140
m283.pep  GNSNAKNKDDLIRKYNNAVNKYCRX
          |||||||||||||||||||||||||
a283      GNSNAKNKDDLIRKYNNAVNKYCRX
               130       140
```

The following partial DNA sequence was identified in *N. gonorrhoeae* <SEQ ID 1175>:

```
g284.seq.
   1 atgccgtctg aaactcgaaa tcggtttcag acggcattgg tttacgcggc
  51 aggttggggc ttagcggtct ttgtaacggc attcgctttt gcctgcaaaa
 101 gagtcgccgg ctttgcgttt gcctttgaag ccttcgccgg ttttttgaa
 151 actgtctttc ttaaagcctt ctttcttgaa accttcgccg cgcgttttgc
 201 cgccgaagcc ttctttgccc ggtttatgat cgccgcgccg gccgccggat
 251 ttcctatcgc cccagccgcc tttgcctttc ggcttgccgc ctgcggattt
 301 gcgtttgcgg gccggctcca tgccttcgat ggtcagttcg ggcagtttgc
 351 ggttaatgta tttttcgatt ttgtggactt tgacgtattc gttcacttcg
 401 gcaaacgtaa tcgcaatacc cgtgcggcct gcgcggccgg tgcgcccgat
 451 gcggtggacg tagtcttccg cctgtttcgg caggtcgtag tttatgacgt
 501 gggtaatggt cggtacgtca ataccgcgtg cggcaacgtc ggtggcaacc
 551 aaaattttgc agcggccttt acgcaaatcc gtcagcgtgc ggttgcgcca
 601 gccctgcggc atatcgccgt gcaggcagtt ggcggcgaaa ccttttttcgt
 651 acaattcatc cgcgatgact tcggtcatcg ctttggtgga cgtgaaaatc
 701 acacattggt cgatgttggc atcgcgcagg atgtggtcga gcaggcggtt
 751 tttgtggcgc atatcgtcgc agtacaacaa ctgctcttcg atttttgcctt
 801 ggccgtccac gcgttcgact tcgataattt cagagtctttt ggtcagtttg
 851 cgcgccagtt tgccgactgc gccgtcccaa gtggcggaga acaataa
```

This corresponds to the amino acid sequence <SEQ ID 1176; ORF 284.ng>:

```
g284.pep
   1 MPSETRNRFQ TALVYAAGWG LAVFVTAFAF ACKRVAGFAF AFEAFAGFFE

51 TVFLKAFFLE TFAARFAAEA FFARFMIAAP AAGFPIAPAA FAFRLAACGF

101 AFAGRLHAFD GQFGQFAVNV FFDFVDFDVF VHFGKRNRNT RAACAAGAPD

151 AVDVVFRLFR QVVVYDVGNG RYVNTACGNV GGNQNFAAAF TQIRQRAVAP

201 ALRHIAVQAV GGETFFVQFI RDDFGHRFGG RENHTLVDVG IAQDVVEQAV

251 FVAHIVAVQQ LLFDFALAVH AFDFDNFRVF GQFARQFADC AVPSGGEQ*
```

The following partial DNA sequence was identified in *N. meningitidis* <SEQ ID 1177>:

```
m284.seq..
    1 ATGCCGTCTG AAACTCGAAA TCGGTTTCAG ACGGCATTGG TTTATGCGGC

51 AGGTTGGGGC TTAGCGGTCT TTGTAACGGC GTTCGCCTTT GCCTGCAAAA

101 GAATCGCCGG CTTTGCGTTT GCCTTTGAAG CCTTCGCCGG TTTTTTTGAA

151 ACCGTCTCTC TTAAAGCCTT CTTTCTTGAA ACCTTCGCCG CGCGTTTTGC

201 CGCCGAAGCC TTCTTTGCTC GGTTTATGAT CGCCGCGCCA ACCGCCGGAT

251 TTACGATCGC CCCAGCCGCC TTTGCCTTTC GGCTTGCCGC CTGCGGATTT

301 GCGTTTGCGG GTCGGTTCCA TGCCTTCGAT GGTCAGTTCG GGCAGTTTTC

351 GGTTAATGTA TTTTTCGATT TTGTGGACTT TGACGTATTC GTTCACTTCG

401 GCAAACGTAA TCGCAATACC CGTGCGGCCT GCGCGGCCGG TGCGCCCGAT

451 GCGGTGGACG TAGTCTTCCG CCTGTTTCGG CAGGTCGTAG TTGATAACGT

501 GGGTAATGGT CGGTACGTCG ATACCGCGTG CGGCAACATC GGTGGCAACC

551 AAAATTTTGC AGCGGCCTTT ACGCAAATCC ATCAGCGTGC GGTTGCGCCA

601 GCCTTGCGGC ATATCGCCGT GCAGGCAGTT TGCGGCGAAA CCTTTTTCGT

651 ACAGTTCATC CGCAATGACT TCGGTCATGG CTTTGGTGGA CGTGAAAATC

701 ACGCATTGAT CGATATTGGC ATCGCGCAAG ATATGATCGA GCAGGCGGTT

751 TTTGTGGCGC ATATCGTCGC AGTACAGCAG TTGTTCTTCG ATTTTGCCTT

801 GATCGTCCAC GCGTTCGACT TCGATGATTT CAGGGTCTTT GGTCAGTTTG

851 CGCGCCAGTT TGCCGACCGC GCCGTCCCAA GTGGCGGAGA ACAACAAAGT

901 CTGACGGTCG CTCGGCGTTG CTTCCACGAT GGTTTCGATG TCGTCGATAA

951 AGCCCATATC CAACATACGG TCGGCTTCGT CCAAAATCAG CACTTCCAAA

1001 CGTTCAAAAT CAACTTTGCC GCTTTGCATC AGGTCCATCA GACGGCCCGG

1051 CGTGGCGACA ATCAGATCGA CCGGTTTGCT CAGGGCACGG GTTTGGTAGC

1101 CGAAAGACGC GCCGCCGACG ATGCTGACGG TGCGGAACCA ACGCATATTT

1151 TTGGCATACG CCAGCGCGTT TTTCTCGACT TGAGCCGCCA GTTCGCGGGT

1201 CGGGGTCAAC ACCAAAGCAC GCGGGCCTTT GCCCGGTTTT TCGCTGCGTT

1251 TGGTCAGTTT TTGCAAAGTC GGTAA
```

This corresponds to the amino acid sequence <SEQ ID 1178; ORF 284>:

```
m284.pep
    1 MPSETRNRFQ TALVYAAGWG LAVFVTAFAF ACKRIAGFAF AFEAFAGFFE

51 TVSLKAFFLE TFAARFAAEA FFARFMIAAP TAGFTIAPAA FAFRLAACGF

101 AFAGRFHAFD GQFGQFSVNV FFDFVDFDVF VHFGKRNRNT RAACAAGAPD

151 AVDVVFRLFR QVVVDNVGNG RYVDTACGNI GGNQNFAAAF TQIHQRAVAP

201 ALRHIAVQAV CGETFFVQFI RNDFGHGFGG RENHALIDIG IAQDMIEQAV

251 FVAHIVAVQQ LFFDFALIVH AFDFDDFRVF GQFARQFADR AVPSGGEQQS

301 LTVARRCFHD GFDVVDKAHI QHTVGFVQNQ HFQTFKINFA ALHQVHQTAR

351 RGDNQIDRFA QGTGLVAERR AADDADGAEP THIFGIRQRV FLDLSRQFAG

401 RGQHQSTRAF ARFFAAFGQF LQSR*
```

Computer analysis of this amino acid sequence gave the following results:

Homology with a Predicted ORF from *N. gonorrhoeae*

```
m284/g284 92.3% identity in 298 aa overlap 10         20         30         40         50         60
m284.pep  MPSETRNRFQTALVYAAGWGLAVFVTAFAFACKRIAGFAFAFEAFAGFFETVSLKAFFLE
          ||||||||||||||||||||||||||||||||:||||||||||||||||||| ||||||
g284      MPSETRNRFQTALVYAAGWGLAVFVTAFAFACKRVAGFAFAFEAFAGFFETVFLKAFFLE
                10         20         30         40         50         60

70         80         90        100        110        120
m284.pep  TFAARFAAEAFFARFMIAAPTAGFTIAPAAFAFRLAACGFAFAGRFHAFDGQFGQFSVNV
          ||||||||||||||||||||||:|||  ||||||||||||||||||:|||||||||:|||
g284      TFAARFAAEAFFARFMIAAPAAGFPIAPAAFAFRLAACGFAFAGRLHAFDGQFGQFAVNV
                70         80         90        100        110        120

130        140        150        160        170        180
m284.pep  FFDFVDFDVFVHFGKRNRNTRAACAAGAPDAVDVVFRLFRQVVVDNVGNGRYVDTACGNI
          ||||||||||||||||||||||||||||||||||||||||||||   ::||||||:|||||:
g284      FFDFVDFDVFVHFGKRNRNTRAACAAGAPDAVDVVFRLFRQVVVYDVGNGRYVNTACGNV
               130        140        150        160        170        180

190        200        210        220        230        240
m284.pep  GGNQNFAAAFTQIHQRAVAPALRHIAVQAVCGETFFVQFIRNDFGHGFGGRENHALIDIG
          ||||||||||||||:|||||||||||||||| ||||||||||:||||  ||||||:|:|:|
g284      GGNQNFAAAFTQIRQRAVAPALRHIAVQAVGGETFFVQFIRDDFGHRFGGRENHTLVDVG
               190        200        210        220        230        240

250        260        270        280        290        300
m284.pep  IAQDMIEQAVFVAHIVAVQQLFFDFALIVHAFDFDDFRVFGQFARQFADRAVPSGGEQQS
          |||||::||||||||||||:|||||||:||||||||:|||||||||||||| |||||||
g284      IAQDVVEQAVFVAHIVAVQQLLFDFALAVHAFDFDNFRVFGQFARQFADCAVPSGGEQX
               250        260        270        280        290

310        320        330        340        350        360
m284.pep  LTVARRCFHDGFDVVDKAHIQHTVGFVQNQHFQTFKINFAALHQVHQTARRGDNQIDRFA
```

30

The following partial DNA sequence was identified in *N. meningitidis* <SEQ ID 1179>:

```
a284.seq
   1 ATGCCGTCTG AAACTCGAAA TCGGTTTCAG ACGGCATTGG TTTATGCGGC

51 AGGTTGGGGC TTAGCGGTCT TTGTAACGGC GTTCGCCTTT GCCTGCAAAA

101 GAATCGCCGG CTTTGCGTTT GCCTTTGAAG CCTTCGCCGG TTTTTTTGAA

151 ACCGTCTCTC TTAAAGCCTT CTTTCTTGAA ACCTTCGCCG CGCGTTTTGC

201 CGCCGAAGCC TTCTTTGCTC GGTTTATGAT CGCCGCGCCA ACCGCCGGAT

251 TTACGATCGC CCCAGCCGCC TTTGCCTTTC GGCTTGCCGC CTGCGGATTT

301 GCGTTTGCGG GTCGGTTCCA TGCCTTCGAT GGTCAGTTCG GGCAGTTTTC

351 GGTTAATGTA TTTTTCGATT TTGTGGACTT TGACGTATTC GTTCACTTCG

401 GCAAACGTAA TCGCAATACC CGTGCGGCCT GCGCGGCCGG TGCGCCCGAT

451 GCGGTGGACG TAGTCTTCCG CCTGTTTCGG CAGGTCGTAG TTGATAACGT

501 GGGTAATGGT CGGTACGTCG ATACCGCGTG CGGCAACGTC GGTGGCAACC

551 AAAATTTTGC AGCGGCCTTT GCGCAAATCC ATCAGCGTGC GGTTGCGCCA

601 GCCTTGCGGC ATATCGCCGT GCAGGCAGTT GGCGGCGAAA CCTTTTTCGT

651 ACAATTCATC CGCGATGACT TCGGTCATGG CTTTGGTGGA CGTGAAAATC

701 ACGCATTGAT CGATGTCGGC ATCGCGCAAG ATATGATCGA GCAGGCGGTT

751 TTTGTGGCGC ATATCGTCGC AGTACAGCAG TTGTTCTTCG ATTTTGCCTT

801 GGTCGTCCAC GCGTTCGACT TCGATGATTT CAGGGTCTTT GGTCAGTTTG

851 CGCGCCAGTT TGCCGACCGC GCCGTCCCAA GTGGCGGAGA ACAACAAAGT

901 CTGACGGTCT TCCGGCGTGG CTTCGACGAT GGTTTCGATG TCGTCGATAA

951 AGCCCATATC CAACATACGG TCGGCTTCGT CCAAAATCAG CACTTCCAAG
```

```
-continued
1001 CGGGCGAAAT CGACTTTGCC GCTTTGCATC AAGTCCATCA GACGGCCCGG

1051 CGTGGCGACA ATCAGATCGA CCGGTTTGCT CAGGGCGCGG GTTTGGTAGC

1101 CGAACGATGC ACCACCGACG ATGCTGACGG TACGGAACCA ACGCATATTT

1151 TTGGCATACG CCAGCGCGTT TTTCTCGACT TGAGCCGCCA ATTCGCGGGT

1201 CGGCGTCAAC ACCAACGCGC GCGGGCCTTT GCCCGGTTTT TCGCTGCGTT

1251 TGGTCAGTCG CTGCAAAGTC GGTAA
```

This corresponds to the amino acid sequence <SEQ ID 1180; ORF 284.a>:

```
a284.pep

1 MPSETRNRFQ TALVYAAGWG LAVFVTAFAF ACKRIAGFAF AFEAFAGFFE

51 TVSLKAFFLE TFAARFAAEA FFARFMIAAP TAGFTIAPAA FAFRLAACGF

101 AFAGRFHAFD GQFGQFSVNV FFDFVDFDVF VHFGKRNRNT RAACAAGAPD

151 AVDVVFRLFR QVVVDNVGNG RYVDTACGNV GGNQNFAAAF AQIHQRAVAP

201 ALRHIAVQAV GGETFFVQFI RDDFGHGFGG RENHALIDVG IAQDMIEQAV

251 FVAHIVAVQQ LFFDFALVVH AFDFDDFRVF GQFARQFADR AVPSGGEQQS

301 LTVFRRGFDD GFDVVDKAHI QHTVGFVQNQ HFQAGEIDFA ALHQVHQTAR

351 RGDNQIDRFA QGAGLVAERC TTDDADGTEP THIFGIRQRV FLDLSRQFAG

401 RRQHQRARAF ARFFAAFGQS LQSR* m284/a284    94.8% identity in 424 aa overlap 10         20         30         40         50         60
m284.pep    MPSETRNRFQTALVYAAGWGLAVFVTAFAFACKRIAGFAFAFEAFAGFFETVSLKAFFLE
            ||||||||||||||||||||||||||||||||||||||||||||||||||||||||||||
a284        MPSETRNRFQTALVYAAGWGLAVFVTAFAFACKRIAGFAFAFEAFAGFFETVSLKAFFLE
                    10         20         30         40         50         60

70         80         90        100        110        120
m284.pep    TFAARFAAEAFFARFMIAAPTAGFTIAPAAFAFRLAACGFAFAGRFHAFDGQFGQFSVNV
            ||||||||||||||||||||||||||||||||||||||||||||||||||||||||||||
a284        TFAARFAAEAFFARFMIAAPTAGFTIAPAAFAFRLAACGFAFAGRFHAFDGQFGQFSVNV
                    70         80         90        100        110        120

130        140        150        160        170        180
m284.pep    FFDFVDFDVFVHFGKRNRNTRAACAAGAPDAVDVVFRLFRQVVVDNVGNGRYVDTACGNI
            |||||||||||||||||||||||||||||||||||||||||||||||||||||||||||:
a284        FFDFVDFDVFVHFGKRNRNTRAACAAGAPDAVDVVFRLFRQVVVDNVGNGRYVDTACGNV
                   130        140        150        160        170        180

190        200        210        220        230        240
m284.pep    GGNQNFAAAFTQIHQRAVAPALRHIAVQAVCGETFFVQFIRNDFGHGFGGRENHALIDIG
            ||||||||||:||||||||||||||||||| |||||||||||:|||||||||||||||:|
a284        GGNQNFAAAFAQIHQRAVAPALRHIAVQAVGGETFFVQFIRDDFGHGFGGRENHALIDVG
                   190        200        210        220        230        240

250        260        270        280        290        300
m284.pep    IAQDMIEQAVFVAHIVAVQQLFFDFALIVHAFDFDDFRVFGQFARQFADRAVPSGGEQQS
            ||||||||||||||||||||||||||||:|||||||||||||||||||||||||||||||
a284        IAQDMIEQAVFVAHIVAVQQLFFDFALVVHAFDFDDFRVFGQFARQFADRAVPSGGEQQS
                   250        260        270        280        290        300

310        320        330        340        350        360
m284.pep    LTVARRCFHDGFDVVDKAHIQHTVGFVQNQHFQTFKINFAALHQVHQTARRGDNQIDRFA
            ||| || |||||||||||||||||||||||||||: :|:|||||||||||||||||||||
a284        LTVFRRGFDDGFDVVDKAHIQHTVGFVQNQHFQAGEIDFAALHQVHQTARRGDNQIDRFA
                   310        320        330        340        350        360

370        380        390        400        410        420
m284.pep    QGTGLVAERRAADDADGAEPTHIFGIRQRVFLDLSRQFAGRGQHQSTRAFARFFAAFGQF
            ||:|||||| ::||||| ||||||||||||||||||||||||  ||  |||||||||||
a284        QGAGLVAERCTTDDADGTEPTHIFGIRQRVFLDLSRQFAGRRQHQRARAFARFFAAFGQS
                   370        380        390        400        410        420
```

```
m284.pep   LQSRX
           |||||
a284       LQSRX
```

The following partial DNA sequence was identified in *N. gonorrhoeae* <SEQ ID 1181>:

```
g285.seq
    1 atgaccgata ccacaccgac agataccgat ccgaccgaaa acggcacgcg
   51 caaaatgccg tctgaacacc gccccgcccc gccggcaaaa aaacgccgcc
  101 cgctgctgaa gctgtcggcg gcactgctgt ctgtcctgat tttggcagta
  151 tgtttcctcg gctggatcgc cggtacggaa gcaggtttgc gcttcgggct
  201 gtaccaaatc ccgtcctggt tcggcgtaaa catttcctcc caaaacctca
  251 aaggcacact gctcgacggc ttcgacggcg acaactggtc gatagaaacc
  301 gaggggcag accttaaaat cagccgcttc cgcttcgcgt ggaaaccgtc
  351 cgaactgatg cgccgcagcc tgcacatcac cgacatctcc gccggcgaca
  401 tcgccatcgt aaccaaaccg actccgccta agaagaacg cccgcctcaa
  451 ggcctgcccg acagcataga cctgcccgcc gctgtctatc tcgaccgctt
  501 cgagacgggc aaaatcagca tgggcaaaac ctttgacaaa caaaccgtct
  551 atctcgaacg cctcaacgcg gcataccgtt acgaccgtaa agggcaccgc
  601 ctcgacctga aggccgccga cacgccgtgg agcagttcgt cggggtcagc
  651 ctcggtcggc ttgaaaaaac cgtttgccct cgataccgcc atttacacca
  701 aaggcggatt cgaaggcgaa accatacaca gtacggcgcg gctgagcggc
  751 agcctgaagg atgtgcgcgc cgaactgacg atcgacggcg gcaatatccg
  801 cctctcggga aaatccgtca tccacccgtt tgccgaatca ttggataaaa
  851 cattggaaga agtactggtc aaaggattca acatcaatcc gtccgccttc
  901 gtgccttccc tgcccgatgc cgggctgaat ttcgacctga ccgccatccc
  951 gtcgttttca gacggcatcg cgctggaagg ctcgctcgat ttggaaaaca
 1001 ccaaagccgg ctttgccgac cgcaacggca tccccgtccg tcaggttttg
 1051 ggcggctttg tcatccggca ggacggcacg gtgcatatcg gcaatacgtc
 1101 cgccgccctg ctcggacggg gcggcatcag gctgtcgggc aaaatcgaca
 1151 ccgaaaaaga catccttgat ttaaatatag gcatcaactc cgtcggcgcg
 1201 gaagacgtgc tgcaaaccgc gttcaaaggc aggttggacg gcagcatcgg
 1251 catcggcggc acgaccgcct cgcccaaaat ctcttggcaa ctcggcaccg
 1301 gcacggcacg cacggacggc agcctccccca tcgcaagcga ccccgcaaac
 1351 gaacagcgga aactggtgtt cgacaccgtc aacatctccg ccggggaagg
 1401 cagcctgacc gcgcaaggct atctcgagct gttttaaagac cgcctgctca
 1451 agctggacat ccgttcccgc gcattcgacc cttcgcgcat cgatccgcaa
 1501 tttccggcag gcaatatcaa cggttcgatt catcttgccg gtgaactggc
 1551 aaaagagaaa tttacgggca aaatgcgttt tttgcccggt acgttcaacg
 1601 gcgtgccgat tgccggcagc gccgacattg tttacgagtc ccgccaccttt
 1651 ccgcgcgccg ccgtcgattt gcggttgggg cggaacatcg tcaaaacaga
 1701 cggcggcttc ggcaaaaaag gcgaccggct taacctcaat atcaccgcac
```

-continued

```
1751 ccgatttatc ccgtttcggt ttcggactcg cggggtcttt aaatgtacgc
1801 ggacaccttt ccggcgattt ggacggcggc atccgaacct ttgaaaccga
1851 cctttccggc acggcgcgca acttacacat cggcaaagcg gcagacatcc
1901 gttcgctcga ttttaccctc aaaggctcac ccggcacaag ccgcccgatg
1951 cgcgccgata tcaagggcgg ccgccttttcc ctgtcgggcg gcgcggcggt
2001 tgtcgatacc gccggcctga cgctggaagg tacgggcgcg cagcaccgca
2051 tccgcacaca cgccgccatg acgctggacg gcaaaccgtt caaactcgat
2101 ttggacgctt caggcggcat caacagggaa cttacccgat ggaaaggcag
2151 catcggcatc ctcgacatcg gcggcgcatt caacctcaag ctgcaaaacc
2201 gtatgacgct cgaagccggt gcggaacacg tggcggcaag tgcggcaaat
2251 tggcaggcaa tgggcggcag cctcaacctg caacactttt cttgggacag
2301 gaaaaccggc atatcggcaa aaggcggcgc acgcggcctg cacatcgccg
2351 agttgcacaa tttcttcaaa ccgcccttcg aacacaatct ggttttaaac
2401 ggcgactggg atgtcgccta cgggcacaac gcgcgcggct acctcaatat
2451 cagccggcaa agcggcgatg ccgtattgcc cggcgggcag gctttgggtt
2501 tgaacgcatt ttccctgaaa acgcgctttc aaaacgaccg catcggaatc
2551 ctgcttgacg gcggcgcgcg tttcggacgg attaacgccg atttgggcat
2601 cggcaacgcc ttcggcggca atatggcaaa tacaccgctc ggcggcagga
2651 ttacagcctc ccttcccgac ttgggcgcat gaagcccctt tctgcccgcc
2701 gccgcgcaaa acattaccgg cagcctgaat gcctccgcgc aaatcggcgg
2751 acgggtaggc tctccgtccg tcaatgccgc cgtcaacggt agcagcaact
2801 acgggaaaat caacggcaat atcaccgtcg ggcaaagccg ctccttcgat
2851 accgcacctt tgggcggcag gctcaacctg accgttgccg atgccgaagc
2901 attccgcaac ttcctaccgg tcggacaaac cgtcaaaggc agcctgaatg
2951 ccgccgtaac cctcggcggc agcatcgccg acccgcactt gggcggcagt
3001 atcaacggcg acaagctcta ttaccgcaac caaacccaag gcatcatctt
3051 ggacaacggc tcgctgcgtt cgcatattgc aggcaggaaa tgggtaatcg
3101 acagcctgaa attccggcac gaagggacgg cggaactctc cggcacggtc
3151 agcatggaaa acagcgtgcc cgatgtcgat atcggcgcgg tgttcgacaa
3201 ataccgcatc ctgtcccgcc ccaaccgccg cctgacggtt ccggcaaca
3251 cccgcctgcg ctattcgccg caaaaaggca tatccgttac cggtatgatt
3301 aaaactgatc aggggctgtt cggttcgcaa aaatcctcga tgccgtccgt
3351 cggcgacgat gtcgtcgtat gggcgaagt caagaaagag gcggcggcat
3401 cgctccccgt caatatgaac ctgactttag acctcaatga cggcatccgc
3451 ttctccggct acggcgcgga cgttaccata ggcggcaaac tgaccctgac
3501 cgcgcaaccg ggcggaaatg tgcgtggggt gggcacggtc cgcgtcatca
3551 aagggcgtta caaagcatac gggcaggatt tagacattac caaaggcaca
3601 gtctcctttg tcggcccgct caacgacccc aacctgaaca tccgcgccga
3651 acgccgcctt tccccgtcg gtgcgggcgt ggaatattg ggcagcctca
3701 acagcccgcg cattacgctg acggcaaacg aaccgatgag tgaaaaagac
```

-continued

```
3751 aagctctcct ggctcatcct caaccgtgcc ggcagcggca gcagcggcga
3801 caatgccgcc ctgtccgcag ccgcaggcgc gctgcttgcc gggcaaatca
3851 acgaccgcat cgggctggtg gatgatttgg gctttaccag caagcgcagc
3901 cgcaacgcgc aaaccggcga actcaacccc gccgaacagg tgctgaccgt
3951 cggcaaacaa ctgaccggca aactctacat cggctacgaa tacggcatct
4001 ccagcgcgga acagtccgtc aaactgattt accggctgac ccgcgccata
4051 caggcggttg cccgtatcgg cagccgttcg tcgggcggcg agctgacata
4101 caccatacgt ttcgaccgcc tcttcggttc ggacaaaaaa gactccgcag
4151 gaaacggcaa agggaaataa
```

This corresponds to the amino acid sequence <SEQ ID 1182; ORF 285.ng>:

```
g285.pep
   1 MTDTTPTDTD PTENGTRKMP SEHRPAPPAK KRRPLLKLSA ALLSVLILAV
  51 CFLGWIAGTE AGLRFGLYQI PSWFGVNISS QNLKGTLLDG FDGDNWSIET
 101 EGADLKISRF RFAWKPSELM RRSLHITDIS AGDIAIVTKP TPPKEERPPQ
 151 GLPDSIDLPA AVYLDRFETG KISMGKTFDK QTVYLERLNA AYRYDRKGHR
 201 LDLKAADTPW SSSSGSASVG LKKPFALDTA IYTKGGFEGE TIHSTARLSG
 251 SLKDVRAELT IDGGNIRLSG KSVIHPFAES LDKTLEEVLV KGFNINPSAF
 301 VPSLPDAGLN FDLTAIPSFS DGIALEGSLD LENTKAGFAD RNGIPVRQVL
 351 GGFVIRQDGT VHIGNTSAAL LGRGGIRLSG KIDTEKDILD LNIGINSVGA
 401 EDVLQTAFKG RLDGSIGIGG TTASPKISWQ LGTGTARTDG SLPIASDPAN
 451 EQRKLVFDTV NISAGEGSLT AQGYLELFKD RLLKLDIRSR AFDPSRIDPQ
 501 FPAGNINGSI HLAGELAKEK FTGKMRFLPG TFNGVPIAGS ADIVYESRHL
 551 PRAAVDLRLG RNIVKTDGGF GKKGDRLNLN ITAPDLSRFG FGLAGSLNVR
 601 GHLSGDLDGG IRTFETDLSG TARNLHIGKA ADIRSLDFTL KGSPGTSRPM
 651 RADIKGGRLS LSGGAAVVDT AGLTLEGTGA QHRIRTHAAM TLDGKPFKLD
 701 LDASGGINRE LTRWKGSIGI LDIGGAFNLK LQNRMTLEAG AEHVAASAAN
 751 WQAMGGSLNL QHFSWDRKTG ISAKGGARGL HIAELHNFFK PPFEHNLVLN
 801 GDWDVAYGHN ARGYLNISRQ SGDAVLPGGQ ALGLNAFSLK TRFQNDRIGI
 851 LLDGGARFGR INADLGIGNA FGGNMANTPL GGRITASLPD LGALKPFLPA
 901 AAQNITGSLN ASAQIGGRVG SPSVNAAVNG SSNYGKINGN ITVGQSRSFD
 951 TAPLGGRLNL TVADAEAFRN FLPVGQTVKG SLNAAVTLGG SIADPHLGGS
1001 INGDKLYYRN QTQGIILDNG SLRSHIAGRK WVIDSLKFRH EGTAELSGTV
1051 SMENSVPDVD IGAVFDKYRI LSRPNRRLTV SGNTRLRYSP QKGISVTGMI
1101 KTDQGLFGSQ KSSMPSVGDD VVVLGEVKKE AAASLPVNMN LTLDLNDGIR
1151 FSGYGADVTI GGKLTLTAQP GGNVRGVGTV RVIKGRYKAY GQDLDITKGT
1201 VSFVGPLNDP NLNIRAERRL SPVGAGVEIL GSLNSPRITL TANEPMSEKD
1251 KLSWLILNRA GSGSSGDNAA LSAAAGALLA GQINDRIGLV DDLGFTSKRS
1301 RNAQTGELNP AEQVLTVGKQ LTGKLYIGYE YGISSAEQSV KLIYRLTRAI
1351 QAVARIGSRS SGGELTYTIR FDRLFGSDKK DSAGNGKGK*
```

The following partial DNA sequence was identified in *N. meningitidis* <SEQ ID 1183>:

```
m285.seq
   1  ATGACCGATA CCGCACCGAC AGATACCGAT CCGACCGAAA ACGGCACGCG

51  CAAAATGCCG TCTGAACACC GCCCTACCCC GCCGGCAAAA AAACGCCGCC

101  CGTTGCTGAA GCTGTCGGCG GCACTGCTGT CTGTCCTGAT TTTGGCAGTA

151  TGTTTCCTCG GCTGGCTCGC CGGTACGGAA GCAGGTTTGC GCTTCGGGCT

201  GTACCAAATC CCGTCTTGGT TCGGCGTAAA CATTTCCTCC CAAAACCTCA

251  AAGGCACGCT GCTCGACGGC TTCGACGGCG ACAACTGGTC GATAGAAACC

301  GAGGGGGCAG ACCTTAAAAT CAGCCGCTTC CGCTTCGCGT GGAAACCGTC

351  CGAACTGATG CGCCGCAGCC TGCACATTAC CGAAATTTCC GCCGGCGACA

401  TCGCCATCGT TACCAAACCG ACTCCGCCTA AAGAAGAACG CCCGCCGCTC

451  AGCCTTCCCG ACAGCATAGA CCTGCCTGCC GCCGTCTATC TCGACCGCTT

501  CGAGACGGGC AAAATCAGCA TGGGCAAAGC CTTTGACAAA CAAACCGTCT

551  ATCTCGAACG GCTGGATGCT TCATACCGTT ACGACCGCAA AGGACACCGC

601  CTTGACCTGA AGGCCGCCGA CACGCCGTGG AGCAGTTCGT CGGGGGCGGC

651  CTCGGTCGGC TTGAAAAAAC CGTTTGCCCT CGATACCGCC ATTTACACCA

701  AAGGCGGACT CGAAGGCAAA ACCATACACA GTACGGCTCG GCTGAGCGGC

751  AGCCTGAAGG ATGTGCGCGC CGAACTGGCG ATCGACGGCG GCAATATCCG

801  CCTCTCGGGA AAATCCGTCA TCCACCCGTT TGCCGAATCA TTGGATAAAA

851  CATTGGAAGA AGTACTGGTC AAAGGGTTCA ACATCAATCC GGCCGCCTTC

901  GTGCCTTCCC TGCCCGATGC CGGACTGAAT TTCGACCTGA CCGCCATCCC

951  GTCGTTTTCA GACGGCATCG CGCTGGAAGG TTCGCTCGAT TTGGAAAACA

1001  CCAAAGCCGG CTTTGCCGAC CGCAACGGCA TCCCCGTCCG TCAGGTTTTA

1051  GGCGGCTTTG TCATCCGGCA GGACGGCACG GTGCATATCG GCAATACGTC

1101  CGCCGCCCTG CTCGGACGGG GCGGCATCAG GCTGTCGGGC AAAATCGACA

1151  CCGAAAAAGA CATCCTCGAT TTAAATATAG GCATCAACTC CGTCGGCGCG

1201  GAAGACGTAC TGCAAACCGC GTTCAAAGGC AGGTTGGACG GCAGCATCGG

1251  CATCGGTGGC ACGACCGCCT CGCCCAAAAT CTCTTGGCAA CTCGGCATCG

1301  GCACGGCGCG CACGGACGGC AGCCTCGCCA TTGCAAGCGA CCCAGCAAAC

1351  GGACAGCGGA AACTGGTGCT CGACACCGTC AACATCGCCG CCGGGCAAGG

1401  CAGCCTGACC GCGCAAGGCT ATCTCGAGCT GTTTAAAGAC CGCCTGCTCA

1451  AGCTGGACAT CCGTTCCCGC GCATTCGACC CTTCGCGCAT CGATCCGCAA

1501  CTTCCGGCAG GCAATATCAA CGGCTCAATA AACCTTGCCG GCGAACTGGC

1551  AAAAGAGAAA TTCACAGGCA AAATGCGGTT TTTACCCGGC ACGTTCAACG

1601  GCGTACCGAT TGCCGGCAGT GCCGACATTG TTTACGAGTC CCGCCACCTT

1651  CCGCGTGCCG CCGTCGATTT GCGGCTGGGG CGGAACATTA TTAAAACAGA

1701  CGGCGGCTTC GGCAAAAAAG GCGACCGGCT TAACCTCAAT ATCACCGCAC

1751  CCGATTTATC CCGTTTCGGT TTCGGACTCG CGGGGTCTTT AAATGTACGC

1801  GGACACCTTT CCGGTGATTT GGACGGCGGC ATCCGAACCT TTGAAACCGA

1851  CCTTTCCGGC GCGGCGCGCA ACCTGCACAT CGGCAAGGCG GCAGACATCC

1901  GTTCGCTCGA TTTCACGCTC AAAGGTTCGC CCGACACAAG CCGCCCGATA
```

-continued

```
1951 CGCGCCGACA TCAAAGGCAG CCGCCTTTCG CTGTCGGGCG GAGCGGCGGT
2001 TGTCGATACC GCCGACCTGA TGCTGGACGG CACGGGCGTG CAGCACCGCA
2051 TCCGCACACA CGCCGCCATG ACGCTGGATG CAAACCGTT CAAATTCGAT
2101 TTGGACGCTT CAGGCGGCAT CAACAGGGAA CTTACCCGAT GGAAAGGCAG
2151 CATCGGCATC CTCGACATCG GCGGCGCATT CAACCTCAAG CTGCAAAACC
2201 GTATGACGCT CGAAGCCGGT GCGGAACGCG TGGCGGCAAG TGCGGCAAAT
2251 TGGCAGGCAA TGGGCGGCAG CCTCAACCTG CAACACTTTT CTTGGGATAA
2301 AAAAACCGGC ATATCGGCAA AAGGCGGCGC ACACGGTCTG CATATCGCCG
2351 AGTTGCACAA TTTCTTCAAA CCGCCCTTCG AACACAATCT GGTTTTAAAC
2401 GGCGACTGGG ATGTCGCCTA CGGGCGCAAC GCGCGCGGCT ACCTCAATAT
2451 CAGCCGGCAA AGCGGCGATG CCGTATTGCC CGGCGGGCAG GCTTTGGGTT
2501 TGAACGCATT TTCCCTGAAA ACGCGCTTTC AAAACGACCG CATCGGAATC
2551 CTGCTTGACG GCGGCGCGCG TTTCGGGCGG ATTAACGCCG ATTTGGGCAT
2601 CGCCAACGCC TTCGGCGGCA ATATGGCAAA TGCACCGCTC GGCGGCAGGA
2651 TTACCGCCTC CCTTCCCGAC TTGGGCGCAT GAAGCCCTT TCTGCCCGCC
2701 GCCGCGCAAA ACATTACCGG CAGCCTGAAT GCCGCCGCGC AAATCGGCGG
2751 ACGGGTAGGC TCTCCGTCCG TCAATGCCGC CGTCAACGGC AGCAGCAACT
2801 ACGGGAAAAT CAACGGCAAC ATCACCGTCG GCAAAGCCG CTCTTTCGAT
2851 ACCGCGCCTT TGGGCGGCAG GCTCAACCTG ACCGTTGCCG ATGCCGAAGT
2901 ATTCGCAAC TTCCTACCGG TCGGACAAAC CGTCAAAGGC AGCCTGAATG
2951 CCGCCGTAAC CCTCGGCGGC AGCATCGCCG ATCCGCACTT GGGCGGCAGC
3001 ATCAACGGCG ACAAACTCTA TTACCGCAAC CAAACCCAAG GCATCATCTT
3051 GGACAACGGC TCGCTGCGTT CGCATATCGC GGGCAGGAAA TGGGTAATCG
3101 ACAGCCTGAA ATTCCGGCAC GAAGGGACGG CGGAACTCTC CGGTACGGTC
3151 GGTATGGAAA ACAGCGGACC CGATGTCGAT ATCGGCGCGG TGTTCGACAA
3201 ATACCGCATC CTGTCCCGCC CCAACCGCCG CCTGACGGTT TCCGGCAACA
3251 CCCGCCTGCG CTATTCGCCG CAAAAAGGCA TATCCGTTAC CGGGATGATT
3301 AAAACGGATC AGGGGCTGTT CGGTTCGCAA AAATCCTCGA TGCCGTCCGT
3351 CGGCGACGAT GTCGTCGTAT AGGCGAAGT CAAAAAAGAG GCGGCGGCAC
3401 CGCTCCCCGT CAATATGAAC CTGACTTTAG ACCTCAATGA CGGCATCCGC
3451 TTCGCCGGCT ACGGCGCGGA CGTTACCATA GGCGGCAAAC TGACCCTGAC
3501 CGCCCAATCG GGCGGAAGCG TACGGGCGT GGGCACGGTC CGCGTCATCA
3551 AAGGGCGTTA TAAGGCATAC GGGCAGGATT TGGACATTAC CAAAGGCACG
3601 GTCTCCTTTG TCGGCCCGCT CAACGATCCC AACCTCAACA TCCGCGCCGA
3651 ACGCCGCCTT TCCCCCGTCG GTGCGGGCGT GGAAATATTG GGCAGCCTCA
3701 ACAGCCCGCG CATTACGCTG ACGGCAAACG AACCGATGAG TGAAAAAGAC
3751 AAGCTCTCTT GGCTCATCCT CAACCGCGCC GGCAGCGGCA GCAGCGGCGA
3801 CAATGCCGCC CTGTCTGCAG CCGCAGGTGC GCTGCTTGCC GGGCAAATCA
3851 ACGACCGCAT CGGGCTGGTG GATGATTTGG GCTTTACCAG CAAGCGCAGC
3901 CGCAACGCGC AAACCGGCGA ACTCAACCCC GCCGAACAGG TGCTGACCGT
```

```
3951 CGGCAAACAA CTGACCGGCA AACTCTACAT CGGCTACGAA TACAGCATCT

4001 CCAGCGCGGA ACAGTCCGTC AAACTGATTT ACCGGCTGAC CCGCGCCATA

4051 CAGGCGGTTG CCCGTATCGG CAGCCGTTCG TCGGGCGGCG AGCTGACATA

4101 CACCATACGT TTCGACCGCT TCTCCGGTTC GGACAAAAAA GACTCCGCCG

4151 GAAACGGCAA AGGAAAATAA
```

This corresponds to the amino acid sequence <SEQ ID 10 1184; ORF 285>:

```
m285.pep
   1 MTDTAPTDTD PTENGTRKMP SEHRPTPPAK KRRPLLKLSA ALLSVLILAV

51 CFLGWLAGTE AGLRFGLYQI PSWFGVNISS QNLKGTLLDG FDGDNWSIET

101 EGADLKISRF RFAWKPSELM RRSLHITEIS AGDIAIVTKP TPPKEERPPL

151 SLPDSIDLPA AVYLDRFETG KISMGKAFDK QTVYLERLDA SYRYDRKGHR

201 LDLKAADTPW SSSSGAASVG LKKPFALDTA IYTKGGLEGK TIHSTARLSG

251 SLKDVRAELA IDGGNIRLSG KSVIHPFAES LDKTLEEVLV KGFNINPAAF

301 VPSLPDAGLN FDLTAIPSFS DGIALEGSLD LENTKAGFAD RNGIPVRQVL

351 GGFVIRQDGT VHIGNTSAAL LGRGGIRLSG KIDTEKDILD LNIGINSVGA

401 EDVLQTAFKG RLDGSIGIGG TTASPKISWQ LGIGTARTDG SLAIASDPAN

451 GQRKLVLDTV NIAAGQGSLT AQGYLELFKD RLLKLDIRSR AFDPSRIDPQ

501 LPAGNINGSI NLAGELAKEK FTGKMRFLPG TFNGVPIAGS ADIVYESRHL

551 PRAAVDLRLG RNIIKTDGGF GKKGDRLNLN ITAPDLSRFG FGLAGSLNVR

601 GHLSGDLDGG IRTFETDLSG AARNLHIGKA ADIRSLDFTL KGSPDTSRPI

651 RADIKGSRLS LSGGAAVVDT ADLMLDGTGV QHRIRTHAAM TLDGKPFKFD

701 LDASGGINRE LTRWKGSIGI LDIGGAFNLK LQNRMTLEAG AERVAASAAN

751 WQAMGGSLNL QHFSWDKKTG ISAKGGAHGL HIAELHNFFK PPFEHNLVLN

801 GDWDVAYGRN ARGYLNISRQ SGDAVLPGGQ ALGLNAFSLK TRFQNDRIGI

851 LLDGGARFGR INADLGIANA FGGNMANAPL GGRITASLPD LGALKPFLPA

901 AAQNITGSLN AAAQIGGRVG SPSVNAAVNG SSNYGKINGN ITVGQSRSFD

951 TAPLGGRLNL TVADAEVFRN FLPVGQTVKG SLNAAVTLGG SIADPHLGGS

1001 INGDKLYYRN QTQGIILDNG SLRSHIAGRK WVIDSLKFRH EGTAELSGTV

1051 GMENSGPDVD IGAVFDKYRI LSRPNRRLTV SGNTRLRYSP QKGISVTGMI

1101 KTDQGLFGSQ KSSMPSVGDD VVVLGEVKKE AAAPLPVNMN LTLDLNDGIR

1151 FAGYGADVTI GGKLTLTAQS GGSVRGVGTV RVIKGRYKAY GQDLDITKGT

1201 VSFVGPLNDP NLNIRAERRL SPVGAGVEIL GSLNSPRITL TANEPMSEKD

1251 KLSWLILNRA GSGSSGDNAA LSAAAGALLA GQINDRIGLV DDLGFTSKRS

1301 RNAQTGELNP AEQVLTVGKQ LTGKLYIGYE YSISSAEQSV KLIYRLTRAI

1351 QAVARIGSRS SGGELTYTIR FDRFSGSDKK DSAGNGKGK*
```

Computer analysis of this amino acid sequence gave the following results:
Homology with a Predicted ORF from *N. gonorrhoeae*

```
m285/g285  96.5% identity in 1389 aa overlap 10         20         30         40         50         60
m285.pep  MTDTAPTDTDPTENGTRKMPSEHRPTPPAKKRRPLLKLSAALLSVLLLAVCFLGWLAGTE
          ||||:||||||||||||||||||||:|||||||||||||||||||||||||||||:||||
g285      MTDTTPTDTDPTENGTRKMPSEHRPAPPAKKRRPLLKLSAALLSVLILAVCFLGWIAGTE
                  10         20         30         40         50         60

70         80         90        100        110        120
m285.pep  AGLRFGLYQIPSWFGVNISSQNLKGTLLDGFDGDNWSIETEGADLKISRFRFAWKPSELM
          ||||||||||||||||||||||||||||||||||||||||||||||||||||||||||||
g285      AGLRFGLYQIPSWFGVNISSQNLKGTLLDGFDGDNWSIETEGADLKISRFRFAWKPSELM
                  70         80         90        100        110        120

130        140        150        160        170        180
m285.pep  RRSLHITEISAGDIAIVTKPTPPKEERPPLSLPDSIDLPAAVYLDRFETGKISMGKAFDK
          |||||||:|||||||||||||||||||||:||||||||||||||||||||||||||:|||
g285      RRSLHITDISAGDIAIVTKPTPPKEERPPLSLPDSIDLPAAVYLDRFETGKISMGKAFDK
                 130        140        150        160        170        180

190        200        210        220        230        240
m285.pep  QTVYLERLDASYRYDRKGHRLDLKAADTPWSWSSGAASVGLKKPFALDTAIYTKGGLEGK
          ||||||||:|:||||||||||||||||||||:|||:|||||||||||||||||||:||:
g285      QTVYLERLNAAYRYDRKGHRLDLKAADTPWSSSSGSASVGLKKPFALDTAIYTKGGFEGE
                 190        200        210        220        230        240

250        260        270        280        290        300
m285.pep  TIHSTARLSGSLKDVRAELAIDGGNIRLSGKSVIHPFAESLDKTLEEVLVKGFNINPAAF
          ||||||||||||||||||||:|||||||||||||||||||||||||||||||||||:||
g285      TIHSTARLSGSLKDVRAELTIDGGNIRLSGKSVIHPFAESLDKTLEEVLVKGFNINPSAF
                 250        260        270        280        290        300

310        320        330        340        350        360
m285.pep  VPSLPDAGLNFDLTAIPSFSDGIALEGSLDLENTKAGFADRNGIPVRQVLGGFVIRQDGT
          ||||||||||||||||||||||||||||||||||||||||||||||||||||||||||||
g285      VPSLPDAGLNFDLTAIPSFSDGIALEGSLDLENTKAGFADRNGIPVRQVLGGFVIRQDGT
                 310        320        330        340        350        360

370        380        390        400        410        420
m285.pep  VHIGNTSAALLGRGGIRLSGKIDTEKDILDLNIGINSVGAEDVLQTAFKGRLDGSIGIGG
          ||||||||||||||||||||||||||||||||||||||||||||||||||||||||||||
g285      VHIGNTSAALLGRGGIRLSGKIDTEKDILDLNIGINSVGAEDVLQTAFKGRLDGSIGIGG
                 370        380        390        400        410        420

430        440        450        460        470        480
m285.pep  TTASPKISWQLGIGTARTDGSLAIASDPANGQRKLVLDTVNIAAGQGSLTAQGYLELFKD
          |||||||||||||:||||||||||||||||:|||:|:||||:|||:|||||||||||||
g285      TTASPKISWQLGTGTARTDGSLAIASDPANEQRKLVFDTVNIAAGEGSLTAQGYLELFKD
                 430        440        450        460        470        480

490        500        510        520        530        540
m285.pep  RLLKLDIRSRAFDPSRIDPQLPAGNINGSINLAGELAKEKFTGKMRPLPGTFNGVPIAGS
          |||||||||||||||||||||:||||||||:|||||||||||||||:||||||||||||
g285      RLLKLDIRSRAFDPSRIDPQFPAGNINGSIHLAGELAKEKFTGKMRFLPGTFNGVPIAGS
                 490        500        510        520        530        540

550        560        570        580        590        600
m285.pep  ADIVYESRHLPRAAVDLRLGRNIIKTDGGFGKKGDRLNLNITAPDLSRFGFGLAGSLNVR
          |||||||||||||||||||||||:||||||||||||||||||||||||||||||||||||
g285      ADIVYESRHLPRAAVDLRLGRNIVKTDGGFGKKGDRLNLNITAPDLSRFGFGLAGSLNVR
                 550        560        570        580        590        600

610        620        630        640        650        660
m285.pep  GHLSGDLDGGIRTFFTDLSGAARNLHIGKAADIRSLDFTLKGSPDTSRPIRADIKGSRLS
          ||||||||||||||||||||:|||||||||||||||||||||||:||||||:|||:|||
g285      GHLSGDLDGGIRTFFTDLSGTARNLHIGKAADIRSLDFTLKGSPGTSRPMRADIKGGRLS
                 610        620        630        640        650        660

670        680        690        700        710        720
m285.pep  LSGGAAVVDTADLMLDGTGVQHRIRTHAAMTLDGKPFKFDLDASGGINRELTRWKGSIGI
          ||||||||||| |:|||:|||||||||||||||||||:||||||||||||||||||||||
g285      LSGGAAVVDTAGLTLEGTGAQHRIRTHAAMTLDGKPFKLDLDASGGINRELTRWKGSIGI
                 670        680        690        700        710        720

730        740        750        760        770        780
m285.pep  LDIGGAFNLKLQNRMTLEAGAERVAASAANWQAMGGSLNLQHFSWDKKTGISAKGGAHGL
          ||||||||||||||||||||||:|||||||||||||||||||||||:|||||||||:||
g285      LDIGGAFNLKLQNRMTLEAGAEHVAASAANWQAMGGSLNLQHFSWDRKTGISAKGGARGL
                 730        740        750        760        770        780

790        800        810        820        830        840
m285.pep  HIAELHNFFKPPFEHNLVLNGDWDVAYGRNARGYLNISRQSGDAVLPGGQALGINAFSLK
          ||||||||||||||||||||||||||||:||||||||||||||||||||||||:||||||
g285      HIAELHNFFKPPFEHNLVLNGDWDVAYGHNARGYLNISRQSGDAVLPGGQALGLNAFSLK
                 790        800        810        820        830        840
```

-continued

```
              850        860        870        880        890        900
m285.pep  TRFQNDRIGILLDGGARFGRINADLGIANAFGGNMANAPLGGRITASLPDLGALKPFLPA
          |||||||||||||||||||||||| |:||||||||||||||||||||||||||||||||||
a285      TRFQNDRIGILLDGGARFGRINADLDIGNAFGGNMANAPLGGRITASLPDLGALKPFLPA
              850        860        870        880        890        900

910        920        930        940        950        960
m285.pep  AAQNITGSLNAAAQIGGRVGSPSVNAAVNGSSNYGKINGNITVGQSRSFDTAPLGGRLNL
          |||||||||:||||||||||||||||||||||||||||||||||||||||||||||||||
g285      AAQNITGSLNASAQIGGRVGSPSVNAAVNGSSNYGKINGNITVGQSRSFDTAPLGGRLNL
              910        920        930        940        950        960

970        980        990       1000       1010       1020
m285.pep  TVADAEVFRNFLPVGQTVKGSLNAAVTLGGSIADPHLGGSINGDKLYYRNQTQGIILDNG
          ||||||:|||||||||||||||||||||||||||||||||||||||||||||||||||||
g285      TVADAEAFRNFLPVGQTVKGSLNAAVTLGGSIADPHLGGSINGDKLYYRNQTQGIILDNG
              970        980        990       1000       1010       1020

1030       1040       1050       1060       1070       1080
m285.pep  SLRSHIAGRKWVIDSLKFRHEGTAELSGTVGMENSGPDVDIGAVFDKYRILSRPNRRLTV
          ||||||||||||||||||||||||||||||:|||||||||||||||||||||||||||||
g285      SLRSHIAGRKWVIDSLKFRHEGTAELSGTVSMENSGPDVDIGAVFDKYRILSRPNRRLTV
             1030       1040       1050       1060       1070       1080

1090       1100       1110       1120       1130       1140
m285.pep  SGNTRLRYSPQKGISVTGMIKTDQGLFGSQKSSMPSVGDDVVVLGEVKKEAAAPLPVNMN
          |||||||||||||||||||||||||||||||||||||||||||||||||||||| ||||||
g285      SGNTRLRYSPQKGISVTGMIKTDQGLFGSQKSSMPSVGDDVVVLGEVKKEAAASLPVNMN
             1090       1100       1110       1120       1130       1140

1150       1160       1170       1180       1190       1200
m285.pep  LTLDLNDGIRFAGYGADVTIGGKLTLTAQSGGSVRGVGTVRVIKGRYKAYGQDLDITKGT
          ||||||||||:|||||||||||||||||| ||:|||||||||||||||||||||||||||
g285      LTLDLNDGIRFAGYGADVTIGGKLTLTAQPGGNVRGVGTVRVIKGRYKAYGQDLDITKGT
             1150       1160       1170       1180       1190       1200

1210       1220       1230       1240       1250       1260
m285.pep  VSFVGPLNDPNLNIRAERRLSPVGAGVEILGSLNSPRITLTANEPMSEKDKLSWLILNRA
          ||||||||||||||||||||||||||||||||||||||||||||||||||||||||||||
g285      VSFVGPLNDPNLNIRAERRLSPVGAGVEILGSLNSPRITLTANEPMSEKDKLSWLILNRA
             1210       1220       1230       1240       1250       1260

1270       1280       1290       1300       1310       1320
m285.pep  GSGSSGDNAALSAAAGALLAGQINDRIGLVDDLGFTSKRSRNAQTGELNPAEQVLTVGKQ
          ||||||||||||||||||||||||||||||||||||||||||||||||||||||||||||
g285      GSGSSGDNAALSAAAGALLAGQINDRIGLVDDLGFTSKRSRNAQTGELNPAEQVLTVGKQ
             1270       1280       1290       1300       1310       1320

1330       1340       1350       1360       1370       1380
m285.pep  LTGKLYIGYEYSISSAEQSVKLIYRLTRAIQAVARIGSRSSGGELTYTIRFDRFSGSDKK
          |||||||||||:|||||||||||||||||||||||||||||||||||||||||: |||||
g285      LTGKLYIGYEYGISSAEQSVKLIYRLTRAIQAVARIGSRSSGGELTYTIRFDRLFGSDKK
             1330       1340       1350       1360       1370       1380

1390
m285.pep  DSAGNGKGKX
          ||||||||||
g285      DSAGNGKGKX
```

The following partial DNA sequence was identified in *N. meningitidis* <SEQ ID 1185>:

```
a285.seq
   1  ATGACCGATA CCGCACCGAC AGATACCGAT CCGACCGAAA ACGGCACGCG

51  CAAAATGCCG TCTGAACACC GCCCTACCCC GCCGGCAAAA AAACGCCGCC

101  CGCTGCTGAA GCTGTCGGCG GCACTGCTGT CTGTTCTGAT TTTGGCAGTA

151  TGTTTCCTCG GCTGGCTCGC CGGCACGGAA GCGGGTTTGC GCTTCGGGCT

201  GTACCAAATC CCGTCTTGGT TCGGCGTAAA CATTTCCTCC CAAAACCTCA

251  AAGGCACGCT GCTCGACGGC TTCGACGGCG ACAACTGGTC GATAGAAACC

301  GAGGGGGCAG ACCTTAAAAT CAGCCGCTTC CGCTTCGCGT GGAAACCGTC

351  CGAACTGATG CGCCGCAGCC TGCACATTAC CGAAATTTCC GCCGGCGACA

401  TCGCCATCGT TACCAAACCG ACTCCGCCTA AAGAAGAACG CCCGCCGCTC

451  AGCCTTCCCG ACAGCATAGA CCTGCCTGCC GCCGTCTATC TCGACCGCTT

501  CGAGACGGGC AAAATCAGCA TGGGCAAAGC CTTTGACAAA CAAACCGTCT

551  ATCTCGAACG GCTGGATGCT TCATACCGTT ACGACCGCAA AGGACACCGC
```

-continued

```
 601 CTCGACCTGA AGGCTGCCGA CACGCCGTGG AGCAGTTCGT CGGGGTCAGC
 651 CTCGGTCGGC TTGAAAAAAC CGTTTGCCCT CGATACCGCC ATTTACACCA
 701 AAGGCGGACT CGAAGGCAAA ACCATACACA GTACGGCTCG GCTGAGCGGC
 751 AGCCTGAAGG ATGTGCGCGC CGAACTGGCG ATCGACGGCG GCAATATCCG
 801 CCTCTCGGGA AAATCCGTCA TCCACCCGTT TGCCGAATCA TTGGATAAAA
 851 CATTGGAAGA AGTACTGGTC AAAGGGTTCA ACATCAATCC GTCCGCCTTC
 901 GTGCCTTCCC TGCCCGATGC CGGGCTGAAT TTCGACCTGA CCGCCATCCC
 951 GTCGTTTTCA GACGGCATCG CGCTGGAAGG CTCGCTCGAT TTGGAAAACA
1001 CCAAAGCCGG CTTTGCCGAC CGCAACGGCA TCCCCGTCCG TCAGGTTTTA
1051 GGCAGCTTTG TCATCCGGCA GGACGGCACG GTGCATATCG CAATACGTC
1101 CGTCGCCCTG CTCGGACGGG GCGGCATCAG GCTGTCGGGC AAAATCGACA
1151 CCGAAAAAGA CATCCTCGAT TTAAATATAG GCATCAACTC CGTCGGCGCG
1201 GAAGACGTAC TGCAAACCGC GTTCAAAGGC AGGTTGGACG GCAGCATCGG
1251 CATCGGTGGC ACGACCGCCT CGCCCAAAAT CTCTTGGCAA CTCGGCATCG
1301 GCACGGCGCG CACGGACGGC AGCCTCGCCA TTGCAAGCGA CCCCGCAAAC
1351 GGACAGCGGA AACTGGTGCT CGACACCGTC AACATCGCCG CCGGGCAAGG
1401 CAGCCTGACC GCGCAAGGCT ATCTCGAGCT GTTTAAAGAC CGCCTGCTCA
1451 AGCTGGACAT CCGTTCCCGC GCATTCGACC CTTCGCGCAT CGATCCGCAA
1501 CTTCCGGCAG GCAATATCAA CGGCTCAATA AACCTTGCCG GCGAACTGGC
1551 AAAAGAGAAA TTCACAGGCA AAATGCGGTT TTTACCCGGC ACGTTCAACG
1601 GCGTACCGAT TGCCGGCAGT GCCGACATTG TTTACGAGTC CCGCCACCTT
1651 CCGCGTGCCG CCGTCGATTT GCGGCTGGGG CGGAACATTA TTAAAACAGA
1701 CGGCGGCTTC GGCAAAAAAG GCGACCGGCT TAACCTCAAT ATCACCGCAC
1751 CCGATTTATC CCGTTTCGGT TTCGGACTCG CGGGGTCTTT AAATGTACGC
1801 GGACACCTTT CCGGCGATTT GGACGGTGGC ATCCGAACCT TTGAAACCGA
1851 CCTTTCCGGC GCGGCGCGCA ACCTGCACAT CGGCAAGGCG GCAGACATCC
1901 GTTCGCTCGA TTTCACGCTC AAAGGTTCGC CGACACAAG CCGCCCGATA
1951 CGCGCCGACA TCAAAGGCAG CCGCCTTTCG CTGTCGGGCG GAGCGGAGGT
2001 TGTCGATACC GCCGACCTGA TGCTGGACGG CACGGGCGTG CAGCACCGCA
2051 TCCGCACACA CGCCGCCATG ACGCTGGATG GCAAACCGTT CAAATTCGAT
2101 TTGGACGCTT CAGGCGGCAT CAACAGGGAA CTTACCCGAT GGAAAGGCAG
2151 CATCGGCATC CTCGACATCG GCGGCGCATT CAACCTCAAG CTGCAAAACC
2201 GTATGACGCT CGAAGCCGGT GCGGAACGCG TGGCGGCAAG TGCGGCAAAT
2251 TGGCAGGCAA TGGGCGGCAG CCTCAACCTG CAACACTTTT CTTGGGATAA
2301 AAAAACCGGC ATATCGGCAA AAGGCGGCGC ACACGGTCTG CATATCGCCG
2351 AGTTGCACAA TTTCTTCAAA CCGCCCTTCG AACACAATCT GGTTTTAAAC
2401 GGCGACTGGG ATGTCGCCTA CGGGCGAAAC GCGCGCGGCT ACCTCAATAT
2451 CAGCCGGCAA AGCGGCGATG CCGTATTGCC CGGCGGGCAG GCTTTGGGTT
2501 TGAACGCATT TTCCCTGAAA ACGCGCTTTC AAAACGACCG TATCGGAATC
2551 CTGCTTGACG GCGGCGCGCG TTTCGGGCGG ATTAACGCCG ATTTGGACAT
```

```
-continued
2601 CGGCAACGCC TTCGGCGGCA ATATGGCAAA TGCACCGCTC GGCGGCAGGA

2651 TTACCGCCTC CCTTCCCGAC TTGGGCACAT GAAGCCCTT TCTGCCCGCC

2701 GCCGCGCAAA ACATTACCGG CAGCCTGAAT GCCGCCGCGC AAATCGGCGG

2751 ACGGGTCGGC TCTCCGTCCG TCAATGCCGC CGTCAACGGC AGCAGCAACT

2801 ACGGGAAAAT CAACGGCAAC ATCACCGTCG GGCAAAGCCG CTCTTTCGAT

2851 ACCGCGCCTT TGGGCGGCAG GCTCAACCTG ACCGTTGCCG ATGCCGAAGT

2901 ATTCCGCAAC TTCCTACCGG TCGGACAAAC CGTCAAAGGC AGCCTGAATG

2951 CCGCCGTAAC CCTCGGCGGC AGCATCGCCG ATCCGCACTT GGGCGGCAGC

3001 ATCAACGGCG ACAAACTCTA TTACCGCAAC CAAACCCAAG GCATCATCTT

3051 GGACAACGGC TCGCTGCGTT CGCATATCGC GGGCAGGAAA TGGGTAATCG

3101 ACAGCCTGAA ATTCCGGCAC GAAGGGACGG CGGAACTCTC CGGTACGGTC

3151 GGTATGGAAA ACAGCGGACC CGATGTCGAT ATCGGCGCGG TGTTCGACAA

3201 ATACCGCATC CTGTCCCGCC CCAACCGCCG CCTGACGGTT TCCGGCAACA

3251 CCCGCCTGCG CTATTCGCCG CAAAAAGGCA TATCCGTTAC CGGGATGATT

3301 AAAACGGATC AGGGGCTGTT CGGTTCGCAA AAATCCTCGA TGCCGTCCGT

3351 CGGCGACGAT GTCGTCGTAT TAGGCGAAGT CAAAAAGAG GCGGCGGCAC

3401 CGCTCCCCGT CAATATGAAC CTGACTTTAG ACCTCAATGA CGGCATCCGC

3451 TTCGCCGGCT ACGGCGCGGA CGTTACCATA GGCGGCAAAC TGACCCTGAC

3501 CGCCCAATCG GGCGGAAGCG TGCGGGGCGT GGGCACGGTC CGCGTCATCA

3551 AAGGGCGTTA TAAGGCATAC GGGCAGGATT TGGACATTAC CAAAGGCACG

3601 GTCTCCTTTG TCGGCCCGCT CAACGACCCC AACCTCAACA TCCGCGCCGA

3651 ACGCCGCCTT TCCCCCGTCG GTGCGGGCGT GGAAATATTG GCAGCCTCA

3701 ACAGTCCGCG CATTACGCTG ACGGCAAACG AACCGATGAG TGAAAAAGAC

3751 AAGCTCTCCT GGCTCATCCT CAACCGCGCC GGCAGTGGCA GCAGCGGCGA

3801 CAATGCCGCC CTGTCCGCAG CCGCCGGCGC GCTGCTTGCC GGGCAAATCA

3851 ACGACCGCAT CGGGCTGGTG GATGATTTGG GCTTTACCAG CAAGCGCAGC

3901 CGCAACGCGC AAACCGGCGA ACTCAACCCC GCCGAACAGG TGCTGACCGT

3951 CGGCAAACAA CTGACCGGCA AACTCTACAT CGGCTACGAA TACAGCATCT

4001 CCAGCGCGGA ACAGTCCGTC AAACTGATTT ACCGGCTGAC CCGCGCCATA

4051 CAGGCGGTTG CCCGTATCGG CAGCCGTTCG TCGGGCGGCG AGCTGACATA

4101 CACCATACGT TTCGACCGCT TCTCCGGTTC GGACAAAAAA GACTCCGCCG

4151 GAAACAGCAA AGGAAAATAA
```

This corresponds to the amino acid sequence <SEQ ID 1186; ORF 285.a>:

```
a285.pep
        1   MTDTAPTDTD PTENGTRKMP SEHRPTPPAK KRRPLLKLSA ALLSVLILAV
       51   CFLGWLAGTE AGLRFGLYQI PSWFGVNISS QNLKGTLLDG FDGDNWSIET
      101   EGADLKISRF RFAWKPSELM RRSLHITEIS AGDIAIVTKP TPPKEERPPL
      151   SLPDSIDLPA AVYLDRFETG KISMGKAFDK QTVYLERLDA SYRYDRYGHR
      201   LDLKAADTPW SSSSGSASVG LKKPFALDTA IYTKGGLEGK TIHSTARLSG
```

```
 251  SLKDVRAELA IDGGNIRLSG KSVIHPFAES LDKTLEEVLV KGFNINPSAF

301  VPSLPDAGLN FDLTAIPSFS DGIALEGSLD LENTKAGFAD RNGIPVRQVL

351  GSFVIRQDGT VHIGNTSVAL LGRGGIRLSG KIDTEKDILD LNIGINSVGA

401  EDVLQTAFKG RLDGSIGIGG TTASPKISWQ LGIGTARTDG SLAIASDPAN

451  GQRKLVLDTV NIAAGQGSLT AQGYLELFKD RLLKLDIRSR AFDPSRIDPQ

501  LPAGNINGSI NLAGELAKEK FTGKMRFLPG TFNGVPIAGS ADIVYESRHL

551  PRAAVDLRLG RNIIKTDGGF GKKGDRLNLN ITAPDLSRFG FGLAGSLNVR

601  GHLSGDLDGG IRTFETDLSG AARNLHIGKA ADIRSLDFTL KGSPDTSRPI

651  RADIKGSRLS LSGGAEVVDT ADLMLDGTGV QHRIRTHAAM TLDGKPFKFD

701  LDASGGINRE LTRWKGSIGI LDIGGAFNLK LQNRMTLEAG AERVAASAAN

751  WQAMGGSLNL QHFSWDKKTG ISAKGGAHGL HIAELHNFFK PPFEHNLVLN

801  GDWDVAYGRN ARGYLNISRQ SGDAVLPGGQ ALGLNAFSLK TRFQNDRIGI

851  LLDGGARFGR INADLDIGNA FGGNMANAPL GGRITASLPD LGTLKPFLPA

901  AAQNITGSLN AAAQIGGRVG SPSVNAAVNG SSNYGKINGN ITVGQSRSFD

951  TAPLGGRLNL TVADAEVFRN FLPVGQTVKG SLNAAVTLGG SIADPHLGGS

1001  INGDKLYYRN QTQGIILDNG SLRSHIAGRK WVIDSLKFRH EGTAELSGTV

1051  GMENSGPDVD IGAVFDKYRI LSRPNRRLTV SGNTRLRYSP QKGISVTGMI

1101  KTDQGLFGSQ KSSMPSVGDD VVVLGEVKKE AAAPLPVNMN LTLDLNDGIR

1151  FAGYGADVTI GGKLTLTAQS GGSVRGVGTV RVIKGRYKAY GQDLDITKGT

1201  VSFVGPLNDP NLNIRAERRL SPVGAGVEIL GSLNSPRITL TANEPMSEKD

1251  KLSWLILNRA GSGSSGDNAA LSAAAGALLA GQINDRIGLV DDLGFTSKRS

1301  RNAQTGELNP AEQVLTVGKQ LTGKLYIGYE YSISSAEQSV KLIYRLTRAI

1351  QAVARIGSRS SGGELTYTIR FDRFSGSDKK DSAGNSKGK* m285/a285  99.4% identity in 1389 aa overlap 10         20         30         40         50         60
m285.pep  MTDTAPTDTDPTENGTRKMPSEHRPTPPAKKRRPLLKLSAALLSVLLLAVCFLGWLAGTE
          ||||||||||||||||||||||||||||||||||||||||||||||| |||||||||||
a285      MTDTAPTDTDPTENGTRKMPSEHRPTPPAKKRRPLLKLSAALLSVLILAVCFLGWLAGTE
                   10         20         30         40         50         60

70         80         90        100        110        120
m285.pep  AGLRFGLYQIPSWFGVNISSQNLKGTLLDGFDGDNWSIETEGADLKISRFRFAWKPSELM
          ||||||||||||||||||||||||||||||||||||||||||||||||||||||||||||
a285      AGLRFGLYQIPSWFGVNISSQNLKGTLLDGFDGDNWSIETEGADLKISRFRFAWKPSELM
                   70         80         90        100        110        120

130        140        150        160        170        180
m285.pep  RRSLHITEISAGDIAIVTKPTPPKEERPPLSLPDSIDLPAAVYLDRFETGKISMGKAFDK
          ||||||||||||||||||||||||||||||||||||||||||||||||||||||||||||
a285      RRSLHITEISAGDIAIVTKPTPPKEERPPLSLPDSIDLPAAVYLDRFETGKISMGKAFDK
                  130        140        150        160        170        180

190        200        210        220        230        240
m285.pep  QTVYLERLDASYRYDRKGHRLDLKAADTPWSWSSGAASVGLKKPFALDTAIYTKGGLEGK
          |||||||||||||||||||||||||||||||||||:||||||||||||||||||||||||
a285      QTVYLERLDASYRYDRKGHRLDLKAADTPWSSSSGSASVGLKKPFALDTAIYTKGGLEGK
                  190        200        210        220        230        240

250        260        270        280        290        300
m285.pep  TIHSTARLSGSLKDVRAELAIDGGNIRLSGKSVIHPFAESLDKTLEEVLVKGFNINPAAF
          |||||||||||||||||||||||||||||||||||||||||||||||||||||||||:||
a285      TIHSTARLSGSLKDVRAELAIDGGNIRLSGKSVIHPFAESLDKTLEEVLVKGFNINPSAF
                  250        260        270        280        290        300

310        320        330        340        350        360
m285.pep  VPSLPDAGLNFDLTAIPSFSDGIALEGSLDLENTKAGFADRNGIPVRQVLGGFVIRQDGT
          |||||||||||||||||||||||||||||||||||||||||||||||||||:||||||||
a285      VPSLPDAGLNFDLTAIPSFSDGIALEGSLDLENTKAGFADRNGIPVRQVLGSFVIRQDGT
                  310        320        330        340        350        360

370        380        390        400        410        420
m285.pep  VHIGNTSAALLGRGGIRLSGKIDTEKDILDLNIGINSVGAEDVLQTAFKGRLDGSIGIGG
          |||||||:||||||||||||||||||||||||||||||||||||||||||||||||||||
a285      VHIGNTSVALLGRGGIRLSGKIDTEKDILDLNIGINSVGAEDVLQTAFKGRLDGSIGIGG
                  370        380        390        400        410        420
```

```
                   430        440        450        460        470        480
m285.pep  TTASPKISWQLGIGTARTDGSLAIASDPANGQRKLVLDTVNIAAGQGSLTAQGYLELFKD
          ||||||||||||||||||||||||||||||||||||||||||||||||||||||||||||
a285      TTASPKISWQLGIGTARTDGSLAIASDPANGQRKLVLDTVNIAAGQGSLTAQGYLELFKD
                   430        440        450        460        470        480

490        500        510        520        530        540
m285.pep  RLLKLDIRSRAFDPSRIDPQLPAGNINGSINLAGELAKEKFTGKMRPLPGTFNGVPIAGS
          ||||||||||||||||||||||||||||||||||||||||||||||||||||||||||||
a285      RLLKLDIRSRAFDPSRIDPQLPAGNINGSINLAGELAKEKFTGKMRFLPGTFNGVPIAGS
                   490        500        510        520        530        540

550        560        570        580        590        600
m285.pep  ADIVYESRHLPRAAVDLRLGRNIIKTDGGFGKKGDRLNLNITAPDLSRFGFGLAGSLNVR
          ||||||||||||||||||||||||||||||||||||||||||||||||||||||||||||
a285      ADIVYESRHLPRAAVDLRLGRNIIKTDGGFGKKGDRLNLNITAPDLSRFGFGLAGSLNVR
                   550        560        570        580        590        600

610        620        630        640        650        660
m285.pep  GHLSGDLDGGIRTFFTDLSGAARNLHIGKAADIRSLDFTLKGSPDTSRPIRADIKGSRLS
          ||||||||||||||||||||||||||||||||||||||||||||||||||||||||||||
a285      GHLSGDLDGGIRTFFTDLSGAARNLHIGKAADIRSLDFTLKGSPDTSRPIRADIKGSRLS
                   610        620        630        640        650        660

670        680        690        700        710        720
m285.pep  LSGGAAVVDTADLMLDGTGVQHRIRTHAAMTLDGKPFKFDLDASGGINRELTRWKGSIGI
          |||| |||||||||||||||||||||||||||||||||||||||||||||||||||||||
a285      LSGGAEVVDTADLMLDGTGVQHRIRTHAAMTLDGKPFKFDLDASGGINRELTRWKGSIGI
                   670        680        690        700        710        720

730        740        750        760        770        780
m285.pep  LDIGGAFNLKLQNRMTLEAGAERVAASAANWQAMGGSLNLQHFSWDKKTGISAKGGAHGL
          ||||||||||||||||||||||||||||||||||||||||||||||||||||||||||||
a285      LDIGGAFNLKLQNRMTLEAGAERVAASAANWQAMGGSLNLQHFSWDKKTGISAKGGAHGL
                   730        740        750        760        770        780

790        800        810        820        830        840
m285.pep  HIAELHNFFKPPFEHNLVLNGDWDVAYGRNARGYLNISRQSGDAVLPGGQALGINAFSLK
          ||||||||||||||||||||||||||||||||||||||||||||||||||||||:|||||
a285      HIAELHNFFKPPFEHNLVLNGDWDVAYGRNARGYLNISRQSGDAVLPGGQALGLNAFSLK
                   790        800        810        820        830        840

850        860        870        880        890        900
m285.pep  TRFQNDRIGILLDGGARFGRINADLGIANAFGGNMANAPLGGRITASLPDLGALKPFLPA
          |||||||||||||||||||||||||||:||||||||||||||||||||||||:|||||||
a285      TRFQNDRIGILLDGGARFGRINADLDIGNAFGGNMANAPLGGRITASLPDLGTLKPFLPA
                   850        860        870        880        890        900

910        920        930        940        950        960
m285.pep  AAQNITGSLNAAAQIGGRVGSPSVNAAVNGSSNYGKINGNITVGQSRSFDTAPLGGRLNL
          ||||||||||||||||||||||||||||||||||||||||||||||||||||||||||||
a285      AAQNITGSLNAAAQIGGRVGSPSVNAAVNGSSNYGKINGNITVGQSRSFDTAPLGGRLNL
                   910        920        930        940        950        960

970        980        990       1000       1010       1020
m285.pep  TVADAEVFRNFLPVGQTVKGSLNAAVTLGGSIADPHLGGSINGDKLYYRNQTQGIILDNG
          ||||||||||||||||||||||||||||||||||||||||||||||||||||||||||||
a285      TVADAEVFRNFLPVGQTVKGSLNAAVTLGGSIADPHLGGSINGDKLYYRNQTQGIILDNG
                   970        980        990       1000       1010       1020

1030       1040       1050       1060       1070       1080
m285.pep  SLRSHIAGRKWVIDSLKFRHEGTAELSGTVGMENSGPDVDIGAVFDKYRILSRPNRRLTV
          ||||||||||||||||||||||||||||||||||||||||||||||||||||||||||||
a285      SLRSHIAGRKWVIDSLKFRHEGTAELSGTVGMENSGPDVDIGAVFDKYRILSRPNRRLTV
                  1030       1040       1050       1060       1070       1080

1090       1100       1110       1120       1130       1140
m285.pep  SGNTRLRYSPQKGISVTGMIKTDQGLFGSQKSSMPSVGDDVVVLGEVKKEAAAPLPVNMN
          ||||||||||||||||||||||||||||||||||||||||||||||||||||||||||||
a285      SGNTRLRYSPQKGISVTGMIKTDQGLFGSQKSSMPSVGDDVVVLGEVKKEAAAPLPVNMN
                  1090       1100       1110       1120       1130       1140

1150       1160       1170       1180       1190       1200
m285.pep  LTLDLNDGIRFAGYGADVTIGGKLTLTAQSGGSVRGVGTVRVIKGRYKAYGQDLDITKGT
          ||||||||||||||||||||||||||||||||||||||||||||||||||||||||||||
a285      LTLDLNDGIRFAGYGADVTIGGKLTLTAQSGGSVRGVGTVRVIKGRYKAYGQDLDITKGT
                  1150       1160       1170       1180       1190       1200

1210       1220       1230       1240       1250       1260
m285.pep  VSFVGPLNDPNLNIRAERRLSPVGAGVEILGSLNSPRITLTANEPMSEKDKLSWLILNRA
          ||||||||||||||||||||||||||||||||||||||||||||||||||||||||||||
a285      VSFVGPLNDPNLNIRAERRLSPVGAGVEILGSLNSPRITLTANEPMSEKDKLSWLILNRA
                  1210       1220       1230       1240       1250       1260

1270       1280       1290       1300       1310       1320
m285.pep  GSGSSGDNAALSAAAGALLAGQINDRIGLVDDLGFTSKRSRNAQTGELNPAEQVLTVGKQ
          ||||||||||||||||||||||||||||||||||||||||||||||||||||||||||||
a285      GSGSSGDNAALSAAAGALLAGQINDRIGLVDDLGFTSKRSRNAQTGELNPAEQVLTVGKQ
                  1270       1280       1290       1300       1310       1320

1330       1340       1350       1360       1370       1380
m285.pep  LTGKLYIGYEYSISSAEQSVKLIYRLTRAIQAVARIGSRSSGGELTYTIRFDRFSGSDKK
          ||||||||||||||||||||||||||||||||||||||||||||||||||||||||||||
a285      LTGKLYIGYEYSISSAEQSVKLIYRLTRAIQAVARIGSRSSGGELTYTIRFDRFSGSDKK
                  1330       1340       1350       1360       1370       1380
```

-continued

```
                  1390
m285.pep  DSAGNGKGKX
          |||||:||||
a285      DSAGNSKGKX
                  1390
```

The following partial DNA sequence was identified in *N. gonorrhoeae* <SEQ ID 1187>:

```
g285-1.seq
    1 CTGAAGCTGT CGGCGGCACT GCTGTCTGTC CTGATTTTGG CAGTATGTTT

51 CCTCGGCTGG ATCGCCGGTA CGGAAGCAGG TTTGCGCTTC GGGCTGTACC

101 AAATCCCGTC CTGGTTCGGC GTAAACATTT CCTCCCAAAA CCTCAAAGGC

151 ACACTGCTCG ACGGCTTCGA CGGCGACAAC TGGTCGATAG AAACCGAGGG

201 GGCAGACCTT AAAATCAGCC GCTTCCGCTT CGCGTGGAAA CCGTCCGAAC

251 TGATGCGCCG CAGCCTGCAC ATCACCGACA TCTCCGCCGG CGACATCGCC

301 ATCGTAACCA AACCGACTCC GCCTAAAGAA GAACGCCCGC CTCAAGGCCT

351 GCCCGACAGC ATAGACCTGC CCGCCGCCGT CTATCTCGAC CGCTTCGAGA

401 CGGGCAAAAT CAGCATGGGC AAAACCTTTG ACAAACAAAC CGTCTATCTC

451 GAACGCCTCA ACGCGGCATA CCGTTACGAC CGTAAAGGGC ACCGCCTCGA

501 CCTGAAGGCC GCCGACACGC CGTGGAGCAG TTCGTCGGGG TCAGCCTCGG

551 TCGGCTTGAA AAAACCGTTT GCCCTCGATA CCGCCATTTA CACCAAAGGC

601 GGATTCGAAG GCGAAACCAT ACACAGTACG GCGCGGCTGA GCGGCAGCCT

651 GAAGGATGTG CGCGCCGAAC TGACGATCGA CGGCGGCAAT ATCCGCCTCT

701 CGGGAAAATC CGTCATCCAC CCGTTTGCCG AATCATTGGA TAAAACATTG

751 GAAGAAGTAC TGGTCAAAGG ATTCAACATC AATCCGTCCG CCTTCGTGCC

801 TTCCCTGCCC GATGCCGGGC TGAATTTCGA CCTGACCGCC ATCCCGTCGT

851 TTTCAGACGG CATCGCGCTG GAAGGCTCGC TCGATTTGGA AAACACCAAA

901 GCCGGCTTTG CCGACCGCAA CGGCATCCCC GTCCGTCAGG TTTTGGGCGG

951 CTTTGTCATC CGGCAGGACG GCACGGTGCA TATCGGCAAT ACGTCCGCCG

1001 CCCTGCTCGG ACGGGGCGGC ATCAGGCTGT CGGGCAAAAT CGACACCGAA

1051 AAAGACATCC TTGATTTAAA TATAGGCATC AACTCCGTCG GCGCGGAAGA

1101 CGTGCTGCAA ACCGCGTTCA AAGGCAGGTT GGACGGCAGC ATCGGCATCG

1151 GCGGCACGAC CGCCTCGCCC AAAATCTCTT GGCAACTCGG CACCGGCACG

1201 GCACGCACGG ACGGCAGCCt cgcCATCGCA AGCGAcCCCG CAAACGAACA

1251 GCGGAAACTG GTGTTCGACA CCGTCAACAT CTCCGCCGGG GAAGGCAGCC

1301 TGACCGCGCA AGGCTATCTC GAGCTGTTTA AGACCGCCT GCTCAAGCTG

1351 GACATCCGTT CCCGCGCATT CGACCCTTCG CGCATCGATC CGCAATTTCC

1401 GGCAGGCgat atCAACGGTT CGATTCATCT TGCCGGTGAA CTGGCAAAAG

1451 AGAAATTTAC GGGCAAAATG CGTTTTTTGC CCGGTACGTT CAACGGCGTG

1501 CCGATTGCCG GCAGCGCCGA CATTGTTTAC GAGTCCCGCC ACCTTCCGCG

1551 CGCCGCCGTC GATTTGCGGT TGGGGCGGAA CATCGTCAAA ACAGACGGCG

1601 GCTTCGGCAA AAAAGGCGAC CGGCTTAACC TCAATATCAC CGCACCCGAT

1651 TTATCCCGTT TCGGTTTCGG ACTCGCGGGG TCTTTAAATG TACGCGGACA
```

```
1701 CCTTTCCGGC GATTTGGACG GCGGCATCCG AACCTTTGAA ACCGACCTTT
1751 CCGGCACGGC GCGCAACTTA CACATCGGCA AAGCGGCAGA CATCCGTTCG
1801 CTCGATTTTA CCCTCAAAGG CTCACCCGGC ACAAGCCGCC CGATGCGCGC
1851 CGATATCAAG GGCGGCCGCC TTTCCCTGTC GGGCGGCGCG GCGGTTGTCG
1901 ATACCGCCGG CCTGACGCTG GAAGGTACGG GCGCGCAGCA CCGCATCCGC
1951 ACACACGCCG CCATGACGCT GGACGGCAAA CCGTTCAAAC TCGATTTGGA
2001 CGCTTCAGGC GGCATCAACA GGGAACTTAC CCGATGGAAA GGCAGCATCG
2051 GCATCCTCGA CATCGGCGGC GCATTCAACC TCAAGCTGCA AAACCGTATG
2101 ACGCTCGAAG CCGGTGCGGA ACACGTGGCG GCAAGTGCGG CAAATTGGCA
2151 GGCAATGGGC GGCAGCCTCA ACCTGCAACA CTTTTCTTGG ACAGGAAAA
2201 CCGGCATATC GGCAAAAGGC GGCGCACGCG GCCTGCACAT CGCCGAGTTG
2251 CACAATTTCT TCAAACCGCC CTTCGAACAC AATCTGGTTT TAAACGGCGA
2301 CTGGGATGTC GCCTACGGGC ACAACGCGCG CGGCTACCTC AATATCAGCC
2351 GGCAAAGCGG CGATGCCGTA TTGCCCGGCG GCAGGCTTT GGGTTTGAAC
2401 GCATTTTCCC TGAAAACGCG CTTTCAAAAC GACCGCATCG GAATCCTGCT
2451 TGACGGCGGC GCGCGTTTCG GACGGATTAA CGCCGATTTG GCATCGGCA
2501 ACGCCTTCGG CGGCAATATG GCAAATACAC CGCTCGGCGG CAGGATTACA
2551 GCCTCCCTTC CCGACTTGGG CGCATTGAAG CCCTTTCTGC CCGCCGCCGC
2601 GCAAAACATT ACCGGCAGCC TGAATGCCTC CGCGCAAATC GGCGGACGGG
2651 TAGGCTCTCC GTCCGTCAAT GCCGCCGTCA ACGGTAGCAG CAACTACGGG
2701 AAAATCAACG GCAATATCAC CGTCGGGCAA AGCCGCTCCT TCGATACCGC
2751 ACCTTTGGGC GGCAGGCTCA ACCTGACCGT TGCCGATGCC GAAGCATTCC
2801 GCAACTTCCT ACCGGTCGGA CAAACCGTCA AAGGCAGCCT GAATGCCGCC
2851 GTAACCCTCG GCGGCAGCAT CGCCGACCCG CACTTGGGCG GCAGTATCAA
2901 CGGCGACAAG CTCTATTACC GCAACCAAAC CCAAGGCATC ATCTTGGACA
2951 ACGGCTCGCT GCGTTCGCAT ATTGCAGGCA GGAAATGGGT AATCGACAGC
3001 CTGAAATTCC GGCACGAAGG GACGGCGGAA CTCTCCGGCA CGGTCAGCAT
3051 GGAAAACAGC GTGCCCGATG TCGATATCGG CGCGGTGTTC GACAAATACC
3101 GCATCCTGTC CCGCCCCAAC CGCCGCCTGA CGGTTTCCGG CAACACCCGC
3151 CTGCGCTATT CGCCGCAAAA AGGCATATCC GTTACCGGTA TGATTAAAAC
3201 TGATCAGGGG CTGTTCGGTT CGCAAAAATC CTCGATGCCG TCCGTCGGCG
3251 ACGATGTCGT CGTATTGGGC GAAGTCAAGA AGAGGCGGC GGCATCGCTC
3301 CCCGTCAATA TGAACCTGAC TTTAGACCTC AATGACGGCA TCCGCTTCTC
3351 CGGCTACGGC GCGGACGTTA CCATAGGCGG CAAACTGACC CTGACCGCGC
3401 AACCGGCGG AAATGTGCGT GGGGTGGGCA CGGTCCGCGT CATCAAAGGG
3451 CGTTACAAAG CATACGGGCA GGATTTAGAC ATTACCAAAG GCACAGTCTC
3501 CTTTGTCGGC CCGCTCAACG ACCCCAACCT GAACATCCGC GCCGAACGCC
3551 GCCTTTCCCC CGTCGGTGCG GGCGTGGAAA TATTGGGCAG CCTCAACAGC
3601 CCGCGCATTA CGCTGACGGC AAACGAACCG ATGAGTGAAA AAGACAAGCT
3651 CTCCTGGCTC ATCCTCAACC GTGCCGGCAG CGGCAGCAGC GGCGACAATG
```

```
-continued
3701 CCGCCCTGTC CGCAGCCGCA GGCGCGCTGC TTGCCGGGCA AATCAACGAC

3751 CGCATCGGGC TGGTGGATGA TTTGGGCTTT ACCAGCAAGC GCAGCCGCAA

3801 CGCGCAAACC GGCGAACTCA ACCCCGCCGA ACAGGTGCTG ACCGTCGGCA

3851 AACAACTGAC CGGCAAACTC TACATCGGCT ACGAATACGG CATCTCCAGC

3901 GCGGAACAGT CCGTCAAACT GATTTACCGG CTGACCCGCG CCATACAGGC

3951 GGTTGCCCGT ATCGGCAGCC GTTCGTCGGG CGGCGAGCTG ACATACACCA

4001 TACGTTTCGA CCGCCTCTTC GGTTCGGACA AAAAGACTC CGCAGGAAAC

4051 GGCAAAGGGA AATAA
```

This corresponds to the amino acid sequence <SEQ ID 1188; ORF 285-1.ng>:

```
g285-1.pep
    1 LKLSAALLSV LILAVCFLGW IAGTEAGLRF GLYQIPSWFG VNISSQNLKG

51 TLLDGFDGDN WSIETEGADL KISRFRFAWK PSELMRRSLH ITDISAGDIA

101 IVTKPTPPKE ERPPQGLPDS IDLPAAVYLD RFETGKISMG KTFDKQTVYL

151 ERLNAAYRYD RKGHRLDLKA ADTPWSSSSG SASVGLKKPF ALDTAIYTKG

201 GFEGETIHST ARLSGSLKDV RAELTIDGGN IRLSGKSVIH PFAESLDKTL

251 EEVLVKGFNI NPSAFVPSLP DAGLNFDLTA IPSFSDGIAL EGSLDLENTK

301 AGFADRNGIP VRQVLGGFVI RQDGTVHIGN TSAALLGRGG IRLSGKIDTE

351 KDILDLNIGI NSVGAEDVLQ TAFKGRLDGS IGIGGTTASP KISWQLGTGT

401 ARTDGSLAIA SDPANEQRKL VFDTVNISAG EGSLTAQGYL ELFKDRLLKL

451 DIRSRAFDPS RIDPQFPAGD INGSIHLAGE LAKEKFTGKM RFLPGTFNGV

501 PIAGSADIVY ESRHLPRAAV DLRLGRNIVK TDGGFGKKGD RLNLNITAPD

551 LSRFGFGLAG SLNVRGHLSG DLDGGIRTFE TDLSGTARNL HIGKAADIRS

601 LDFTLKGSPG TSRPMRADIK GGRLSLSGGA AVVDTAGLTL EGTGAQHRIR

651 THAAMTLDGK PFKLDLDASG GINRELTRWK GSIGILDIGG AFNLKLQNRM

701 TLEAGAEHVA ASAANWQAMG GSLNLQHFSW DRKTGISAKG GARGLHIAEL

751 HNFFKPPFEH NLVLNGDWDV AYGHNARGYL NISRQSGDAV LPGGQALGLN

801 AFSLKTRFQN DRIGILLDGG ARFGRINADL GIGNAFGGNM ANTPLGGRIT

851 ASLPDLGALK PFLPAAAQNI TGSLNASAQI GGRVGSPSVN AAVNGSSNYG

901 KINGNITVGQ SRSFDTAPLG GRLNLTVADA EAFRNFLPVG QTVKGSLNAA

951 VTLGGSIADP HLGGSINGDK LYYRNQTQGI ILDNGSLRSH IAGRKWVIDS

1001 LKFRHEGTAE LSGTVSMENS VPDVDIGAVF DKYRILSRPN RRLTVSGNTR

1051 LRYSPQKGIS VTGMIKTDQG LFGSQKSSMP SVGDDVVVLG EVKKEAAASL

1101 PVNMNLTLDL NDGIRFSGYG ADVTIGGKLT LTAQPGGNVR GVGTVRVIKG

1151 RYKAYGQDLD ITKGTVSFVG PLNDPNLNIR AERRLSPVGA GVEILGSLNS

1201 PRITLTANEP MSEKDKLSWL ILNRAGSGSS GDNAALSAAA GALLAGQIND

1251 RIGLVDDLGF TSKRSRNAQT GELNPAEQVL TVGKQLTGKL YIGYEYGISS

1301 AEQSVKLIYR LTRAIQAVAR IGSRSSGGEL TYTIRFDRLF GSDKKDSAGN

1351 GKGK*
```

The following partial DNA sequence was identified in *N. meningitidis* <SEQ ID 1189>:

```
m285-1.seq
   1 CTGAAGCTGT CGGCGGCACT GCTGTCTGTC CTGATTTTGG CAGTATGTTT
  51 CCTCGGCTGG CTCGCCGGTA CGGAAGCAGG TTTGCGCTTC GGGCTGTACC
 101 AAATCCCGTC TTGGTTCGGC GTAAACATTT CCTCCCAAAA CCTCAAAGGC
 151 ACGCTGCTCG ACGGCTTCGA CGGCGACAAC TGGTCGATAG AAACCGAGGG
 201 GGCAGACCTT AAAATCAGCC GCTTCCGCTT CGCGTGGAAA CCGTCCGAAC
 251 TGATGCGCCG CAGCCTGCAC ATTACCGAAA TTTCCGCCGG CGACATCGCC
 301 ATCGTTACCA AACCGACTCC GCCTAAAGAA GAACGCCCGC CGCTCAGCCT
 351 TCCCGACAGC ATAGACCTGC CTGCCGCCGT CTATCTCGAC CGCTTCGAGA
 401 CGGGCAAAAT CAGCATGGGC AAAGCCTTTG ACAAACAAAC CGTCTATCTC
 451 GAACGGCTGG ATGCTTCATA CCGTTACGAC CGCAAAGGAC ACCGCCTTGA
 501 CCTGAAGGCC GCCGACACGC CGTGGAGCAG TTCGTCGGGG GCGGCCTCGG
 551 TCGGCTTGAA AAAACCGTTT GCCCTCGATA CCGCCATTTA CACCAAAGGC
 601 GGACTCGAAG GCAAAACCAT ACACAGTACG GCTCGGCTGA GCGGCAGCCT
 651 GAAGGATGTG CGCGCCGAAC TGGCGATCGA CGGCGGCAAT ATCCGCCTCT
 701 CGGGAAAATC CGTCATCCAC CCGTTTGCCG AATCATTGGA TAAAACATTG
 751 GAAGAAGTAC TGGTCAAAGG GTTCAACATC AATCCGGCCG CCTTCGTGCC
 801 TTCCCTGCCC GATGCCGGAC TGAATTTCGA CCTGACCGCC ATCCCGTCGT
 851 TTTCAGACGG CATCGCGCTG GAAGGTTCGC TCGATTTGGA AAACACCAAA
 901 GCCGGCTTTG CCGACCGCAA CGGCATCCCC GTCCGTCAGG TTTTAGGCGG
 951 CTTTGTCATC CGGCAGGACG GCACGGTGCA TATCGGCAAT ACGTCCGCCG
1001 CCCTGCTCGG ACGGGGCGGC ATCAGGCTGT CGGGCAAAAT CGACACCGAA
1051 AAAGACATCC TCGATTTAAA TATAGGCATC AACTCCGTCG GCGCGGAAGA
1101 CGTACTGCAA ACCGCGTTCA AAGGCAGGTT GGACGGCAGC ATCGGCATCG
1151 GTGGCACGAC CGCCTCGCCC AAAATCTCTT GGCAACTCGG CATCGGCACG
1201 GCGCGCACGG ACGGCAGCCT CGCCATTGCA AGCGACCCAG CAAACGGACA
1251 GCGGAAACTG GTGCTCGACA CCGTCAACAT CGCCGCCGGG CAAGGCAGCC
1301 TGACCGCGCA AGGCTATCTC GAGCTGTTTA AAGACCGCCT GCTCAAGCTG
1351 GACATCCGTT CCCGCGCATT CGACCCTTCG CGCATCGATC CGCAACTTCC
1401 GGCAGGCAAT ATCAACGGCT CAATAAACCT TGCCGGCGAA CTGGCAAAAG
1451 AGAAATTCAC AGGCAAAATG CGGTTTTTAC CCGGCACGTT CAACGGCGTA
1501 CCGATTGCCG GCAGTGCCGA CATTGTTTAC GAGTCCCGCC ACCTTCCGCG
1551 TGCCGCCGTC GATTTGCGGC TGGGGCGGAA CATTATTAAA ACAGACGGCG
1601 GCTTCGGCAA AAAAGGCGAC CGGCTTAACC TCAATATCAC CGCACCCGAT
1651 TTATCCCGTT TCGGTTTCGG ACTCGCGGGG TCTTTAAATG TACGCGGACA
1701 CCTTTCCGGT GATTTGGACG GCGGCATCCG AACCTTTGAA ACCGACCTTT
1751 CCGGCGCGGC GCGCAACCTG CACATCGGCA AGGCGGCAGA CATCCGTTCG
1801 CTCGATTTCA CGCTCAAAGG TTCGCCCGAC ACAAGCCGCC CGATACGCGC
1851 CGACATCAAA GGCAGCCGCC TTTCGCTGTC GGGCGGAGCG GCGGTTGTCG
1901 ATACCGCCGA CCTGATGCTG GACGGCACGG GCGTGCAGCA CCGCATCCGC
```

-continued

```
1951 ACACACGCCG CCATGACGCT GGATGGCAAA CCGTTCAAAT TCGATTTGGA
2001 CGCTTCAGGC GGCATCAACA GGGAACTTAC CCGATGGAAA GGCAGCATCG
2051 GCATCCTCGA CATCGGCGGC GCATTCAACC TCAAGCTGCA AAACCGTATG
2101 ACGCTCGAAG CCGGTGCGGA ACGCGTGGCG GCAAGTGCGG CAAATTGGCA
2151 GGCAATGGGC GGCAGCCTCA ACCTGCAACA CTTTTCTTGG GATAAAAAAA
2201 CCGGCATATC GGCAAAAGGC GGCGCACACG GTCTGCATAT CGCCGAGTTG
2251 CACAATTTCT TCAAACCGCC CTTCGAACAC AATCTGGTTT TAAACGGCGA
2301 CTGGGATGTC GCCTACGGGC GCAACGCGCG CGGCTACCTC AATATCAGCC
2351 GGCAAAGCGG CGATGCCGTA TTGCCCGGCG GCAGGCTTT GGGTTTGAAC
2401 GCATTTTCCC TGAAAACGCG CTTTCAAAAC GACCGCATCG GAATCCTGCT
2451 TGACGGCGGC GCGCGTTTCG GCGGATTAA CGCCGATTTG GCATCGCCA
2501 ACGCCTTCGG CGGCAATATG GCAAATGCAC CGTCGGCGG CAGGATTACC
2551 GCCTCCCTTC CCGACTTGGG CGCATTGAAG CCCTTTCTGC CCGCCGCCGC
2601 GCAAAACATT ACCGGCAGCC TGAATGCCGC CGCGCAAATC GGCGGACGGG
2651 TAGGCTCTCC GTCCGTCAAT GCCGCCGTCA ACGGCAGCAG CAACTACGGG
2701 AAAATCAACG GCAACATCAC CGTCGGGCAA AGCCGCTCTT TCGATACCGC
2751 GCCTTTGGGC GGCAGGCTCA ACCTGACCGT TGCCGATGCC GAAGTATTCC
2801 GCAACTTCCT ACCGGTCGGA CAAACCGTCA AAGGCAGCCT GAATGCCGCC
2851 GTAACCCTCG GCGGCAGCAT CGCCGATCCG CACTTGGGCG GCAGCATCAA
2901 CGGCGACAAA CTCTATTACC GCAACCAAAC CCAAGGCATC ATCTTGGACA
2951 ACGGCTCGCT GCGTTCGCAT ATCGCGGGCA GGAAATGGGT AATCGACAGC
3001 CTGAAATTCC GGCACGAAGG GACGGCGGAA CTCTCCGGTA CGGTCGGTAT
3051 GGAAAACAGC GGACCCGATG TCGATATCGG CGCGGTGTTC GACAAATACC
3101 GCATCCTGTC CCGCCCCAAC CGCCGCCTGA CGGTTTCCGG CAACACCCGC
3151 CTGCGCTATT CGCCGCAAAA AGGCATATCC GTTACCGGGA TGATTAAAAC
3201 GGATCAGGGG CTGTTCGGTT CGCAAAAATC CTCGATGCCG TCCGTCGGCG
3251 ACGATGTCGT CGTATTAGGC GAAGTCAAAA AGAGGCGGC GGCACCGCTC
3301 CCCGTCAATA TGAACCTGAC TTTAGACCTC AATGACGGCA TCCGCTTCGC
3351 CGGCTACGGC GCGGACGTTA CCATAGGCGG CAAACTGACC CTGACCGCCC
3401 AATCGGGCGG AAGCGTACGG GGCGTGGGCA CGGTCCGCGT CATCAAAGGG
3451 CGTTATAAGG CATACGGGCA GGATTTGGAC ATTACCAAAG CACGGTCTC
3501 CTTTGTCGGC CCGCTCAACG ATCCCAACCT CAACATCCGC GCCGAACGCC
3551 GCCTTTCCCC CGTCGGTGCG GGCGTGGAAA TATTGGGCAG CCTCAACAGC
3601 CCGCGCATTA CGCTGACGGC AAACGAACCG ATGAGTGAAA AGACAAGCT
3651 CTCTTGGCTC ATCCTCAACC GCGCCGGCAG CGGCAGCAGC GGCGACAATG
3701 CCGCCCTGTC TGCAGCCGCA GGTGCGCTGC TTGCCGGGCA AATCAACGAC
3751 CGCATCGGGC TGGTGGATGA TTTGGGCTTT ACCAGCAAGC GCAGCCGCAA
3801 CGCGCAAACC GGCGAACTCA ACCCCGCCGA ACAGGTGCTG ACCGTCGGCA
3851 AACAACTGAC CGGCAAACTC TACATCGGCT ACGAATACAG CATCTCCAGC
3901 GCGGAACAGT CCGTCAAACT GATTTACCGG CTGACCCGCG CCATACAGGC
```

-continued
```
3951 GGTTGCCCGT ATCGGCAGCC GTTCGTCGGG CGGCGAGCTG ACATACACCA

4001 TACGTTTCGA CCGCTTCTCC GGTTCGGACA AAAAAGACTC CGCCGGAAAC

4051 GGCAAAGGAA AATAA
```

This corresponds to the amino acid sequence <SEQ ID 1190; ORF 285-1>:

```
m285-1.pep

1    LKLSAALLSV LILAVCFLGW LAGTEAGLRF GLYQIPSWFG VNISSQNLKG

51    TLLDGFDGDN WSIETEGADL KISRFRFAWK PSELMRRSLH ITEISAGDIA

101    IVTKPTPPKE ERPPLSLPDS IDLPAAVYLD RFETGKISMG KAFDKQTVYL

151    ERLDASYRYD RYGHRLDLKA ADTPWSSSSG AASVGLKKPF ALDTAIYTKG

201    GLEGKTIHST ARLSGSLKDV RAELAIDGGN IRLSGKSVIH PFAESLDKTL

251    EEVLVKGFNI NPAAFVPSLP DAGLNFDLTA IPSFSDGIAL EGSLDLENTK

301    AGFADRNGIP VRQVLGSFVI RQDGTVHIGN TSAALLGRGG IRLSGKIDTE

351    KDILDLNIGI NSVGAEDVLQ TAFKGRLDGS IGIGGTTASP KISWQLGIGT

401    ARTDGSLAIA SDPANGQRKL VLDTVNIAAG QGSLTAQGYL ELFKDRLLKL

451    DIRSRAFDPS RIDPQLPAGN INGSINLAGE LAKEKFTGKM RFLPGTFNGV

501    PIAGSADIVY ESRHLPRAAV DLRLGRNIIK TDGGFGKKGD RLNLNITAPD

551    LSRFGFGLAG SLNVRGHLSG DLDGGIRTFE TDLSGAARNL HIGKAADIRS

601    LDFTLKGSPD TSRPIRADIK GSRLSLSGGA AVVDTADLML DGTGVQHRIR

651    THAAMTLDGK PFKFDLDASG GINRELTRWK GSIGILDIGG AFNLKLQNRM

701    TLEAGAERVA ASAANWQAMG GSLNLQHFSW DKKTGISAKG GAHGLHIAEL

751    HNFFKPPFEH NLVLNGDWDV AYGRNARGYL NISRQSGDAV LPGGQALGLN

801    AFSLKTRFQN DRIGILLDGG ARFGRINADL DIGNAFGGNM ANAPLGGRIT

851    ASLPDLGALK PFLPAAAQNI TGSLNAAAQI GGRVGSPSVN AAVNGSSNYG

901    KINGNITVGQ SRSFDTAPLG GRLNLTVADA EVFRNFLPVG QTVKGSLNAA

951    VTLGGSIADP HLGGSINGDK LYYRNQTQGI ILDNGSLRSH IAGRKWVIDS

1001    LKFRHEGTAE LSGTVGMENS GPDVDIGAVF DKYRILSRPN RRLTVSGNTR

1051    LRYSPQKGIS VTGMIKTDQG LFGSQKSSMP SVGDDVVVLG EVKKEAAAPL

1101    PVNMNLTLDL NDGIRFAGYG ADVTIGGKLT LTAQSGGSVR GVGTVRVIKG

1151    RYKAYGQDLD ITKGTVSFVG PLNDPNLNIR AERRLSPVGA GVEILGSLNS

1201    PRITLTANEP MSEKDKLSWL ILNRAGSGSS GDNAALSAAA GALLAGQIND

1251    RIGLVDDLGF TSKRSRNAQT GELNPAEQVL TVGKQLTGKL YIGYEYSISS

1301    AEQSVKLIYR LTRAIQAVAR IGSRSSGGEL TYTIRFDRFS GSDKKDSAGN

1351    GKGK* g285-1/m285-1  96.5% identity in 1354 aa overlap 10         20         30         40         50         60
g285-1.pep  LKLSAALLSVLLLAVCFLGWIAGTEAGLRFGLYQIPSWFGVNISSQNLKGTLLDGFDGDN
            ||||||||||:|||||||||:|||||||||||||||||||||||||||||||||||||||
m285-1      LKLSAALLSVLILAVCFLGWLAGTEAGLRFGLYQIPSWFGVNISSQNLKGTLLDGFDGDN
                     10         20         30         40         50         60

70         80         90        100        110        120
g285-1.pep  WSIETEGADLKISRFRFAWKPSELMRRSLHITDISAGDIAIVTKPTPPKEERPPQGLPDS
            |||||||||||||||||||||||||||||||:||||||||||||||||||||||:||||
m285-1      WSIETEGADLKISRFRFAWKPSELMRRSLHITEISAGDIAIVTKPTPPKEERPPLSLPDS
                     70         80         90        100        110        120
```

-continued

```
              130       140       150       160       170       180
g285-1.pep    IDLPAAVYLDRFETGKISMGKTFDKQTVYLERLNAAYRYDRKGHRLDLKAADTPWSSSSG
              ||||||||||||||||||||| :|||||||||||| : :|||||||||||||||||||||
m285-1        IDLPAAVYLDRFETGKISMGKAFDKQTVYLERLDASYRYDRKGHRLDLKAADTPWSSSSG
              130       140       150       160       170       180

190       200       210       220       230       240
g285-1.pep    SASVGLKKPFALDTAIYTKGGFEGETIHSTARLSGSLKDVRAELTIDGGNIRLSGKSVIH
              :|||||||||||||||||||||:||:|||||||||||||||||| :|||||||||||||
m285-1        AASVGLKKPFALDTAIYTKGGLEGKTIHSTARLSGSLKDVRAELAIDGGNIRLSGKSVIH
              190       200       210       220       230       240

250       260       270       280       290       300
g285-1.pep    PFAESLDKTLEEVLVKGFNINPSAFVPSLPDAGLNFDLTAIPSFSDGIALEGSLDLENTK
              ||||||||||||||||||||||:|||||||||||||||||||||||||||||||||||||
m285-1        PFAESLDKTLEEVLVKGFNINPAAFVPSLPDAGLNFDLTAIPSFSDGIALEGSLDLENTK
              250       260       270       280       290       300

310       320       330       340       350       360
g285-1.pep    AGFADRNGIPVRQVLGGFVIRQDGTVHIGNTSAALLGRGGIRLSGKIDTEKDILDLNIGI
              |||||||||||||||:||||||||||||||||||||||||||||||||||||||||||||
m285-1        AGFADRNGIPVRQVLGSFVIRQDGTVHIGNTSAALLGRGGIRLSGKIDTEKDILDLNIGI
              310       320       330       340       350       360

370       380       390       400       410       420
g285-1.pep    NSVGAEDVLQTAFKGRLDGSIGIGGTTASPKISWQLGIGTARTDGSLAIASDPANGQRKL
              ||||||||||||||||||||||||||||||||||||||||||||||||||||||||||||
m285-1        NSVGAEDVLQTAFKGRLDGSIGIGGTTASPKISWQLGIGTARTDGSLAIASDPANGQRKL
              370       380       390       400       410       420

430       440       450       460       470       480
g285-1.pep    VLDTVNIAAGQGSLTAQGYLELFKDRLLKLDIRSRAFDPSRIDPQFPAGDINGSIHLAGE
              ||||||||||||||||||||||||||||||||||||||||||||||:||||:||||||||
m285-1        VLDTVNIAAGQGSLTAQGYLELFKDRLLKLDIRSRAFDPSRIDPQLPAGNINGSINLAGE
              430       440       450       460       470       480

490       500       510       520       530       540
g285-1.pep    LAKEKFTGKMRPLPGTFNGVPIAGSADIVYESRHLPRAAVDLRLGRNIVKTDGGFGKKGD
              |||||||||||:||||||||||||||||||||||||||||||||||||:|||||||||||
m285-1        LAKEKFTGKMRFLPGTFNGVPIAGSADIVYESRHLPRAAVDLRLGRNIIKTDGGFGKKGD
              490       500       510       520       530       540

550       560       570       580       590       600
g285-1.pep    RLNLNITAPDLSRFGFGLAGSLNVRGHLSGDLDGGIRTFFTDLSGTARNLHIGKAADIRS
              |||||||||||||||||||||||||||||||||||||||||||:||||||||||||||||
m285-1        RLNLNITAPDLSRFGFGLAGSLNVRGHLSGDLDGGIRTFFTDLSGAARNLHIGKAADIRS
              550       560       570       580       590       600

610       620       630       640       650       660
g285-1.pep    LDFTLKGSPGTSRPMRADIKGGRLSLSGGAAVVDTAGLTLEGTGAQHRIRTHAAMTLDGK
              ||||||||| ||||:|||||:|||||||||||||||| |:|::|||:|||||||||||||
m285-1        LDFTLKGSPDTSRPIRADIKGSRLSLSGGAAVVDTADLMLDGTGVQHRIRTHAAMTLDGK
              610       620       630       640       650       660

670       680       690       700       710       720
g285-1.pep    PFKLDLDASGGINRELTRWKGSIGILDIGGAFNLKLQNRMTLEAGAEHVAASAANWQAMG
              |||:||||||||||||||||||||||||||||||||||||||||||:|||||||||||||
m285-1        PFKFDLDASGGINRELTRWKGSIGILDIGGAFNLKLQNRMTLEAGAERVAASAANWQAMG
              670       680       690       700       710       720

730       740       750       760       770       780
g285-1.pep    GSLNLQHFSWDRKTGISAKGGARGLHIAELHNFFKPPFEHNLVLNGDWDVAYGHNARGYL
              ||||||||||:||||||||||| |||||||||||||||||||||||||||||| ||||||
m285-1        GSLNLQHFSWDKKTGISAKGGAHGLHIAELHNFFKPPFEHNLVLNGDWDVAYGRNARGYL
              730       740       750       760       770       780

790       800       810       820       830       840
g285-1.pep    NISRQSGDAVLPGGQALGINAFSLKTRFQNDRIGILLDGGARFGRINADLGIGNAFGGNM
              ||||||||||||||||||:|||||||||||||||||||||||||||||||||| ||||||
m285-1        NISRQSGDAVLPGGQALGLNAFSLKTRFQNDRIGILLDGGARFGRINADLGIANAFGGNM
              790       800       810       820       830       840

850       860       870       880       890       900
g285-1.pep    ANTPLGGRITASLPDLGALKPFLPAAAQNITGSLNASAQIGGRVGSPSVNAAVNGSSNYG
              ||:|||||||||||||||||||||||||||||||| :|||||||||||||||||||||||
m285-1        ANAPLGGRITASLPDLGALKPFLPAAAQNITGSLNAAAQIGGRVGSPSVNAAVNGSSNYG
              850       860       870       880       890       900

910       920       930       940       950       960
g285-1.pep    KINGNITVGQSRSFDTAPLGGRLNLTVADAEAFRNFLPVGQTVKGSLNAAVTLGGSIADP
              |||||||||||||||||||||||||||||||:||||||||||||||||||||||||||||
m285-1        KINGNITVGQSRSFDTAPLGGRLNLTVADAEVFRNFLPVGQTVKGSLNAAVTLGGSIADP
              910       920       930       940       950       960

970       980       990       1000      1010      1020
g285-1.pep    HLGGSINGDKLYYRNQTQGIILDNGSLRSHIAGRKWVIDSLKFRHEGTAELSGTVSMENS
              ||||||||||||||||||||||||||||||||||||||||||||||||||||||||:|||
m285-1        HLGGSINGDKLYYRNQTQGIILDNGSLRSHIAGRKWVIDSLKFRHEGTAELSGTVGMENS
              970       980       990       1000      1010      1020

1030      1040      1050      1060      1070      1080
g285-1.pep    VPDVDIGAVFDKYRILSRPNRRLTVSGNTRLRYSPQKGISVTGMIKTDQGLFGSQKSSMP
              ||||||||||||||||||||||||||||||||||||||||||||||||||||||||||||
m285-1        GPDVDIGAVFDKYRILSRPNRRLTVSGNTRLRYSPQKGISVTGMIKTDQGLFGSQKSSMP
              1030      1040      1050      1060      1070      1080
```

-continued

```
                   1090      1100      1110      1120      1130      1140
g285-1.pep  SVGDDVVVLGEVKKEAAASLPVNMNLTLDLNDGIRFSGYGADVTIGGKLTLTAQPGGNVR
            |||||||||||||||||| |||||||||||||||||:||||||||||||||||| ||:||
m285-1      SVGDDVVVLGEVKKEAAAPLPVNMNLTLDLNDGIRFAGYGADVTIGGKLTLTAQSGGSVR
                   1090      1100      1110      1120      1130      1140

1150      1160      1170      1180      1190      1200
g285-1.pep  GVGTVRVIKGRYKAYGQDLDITKGTVSFVGPLNDPNLNIRAERRLSPVGAGVEILGSLNS
            ||||||||||||||||||||||||||||||||||||||||||||||||||||||||||||
m285-1      GVGTVRVIKGRYKAYGQDLDITKGTVSFVGPLNDPNLNIRAERRLSPVGAGVEILGSLNS
                   1150      1160      1170      1180      1190      1200

1210      1220      1230      1240      1250      1260
g285-1.pep  PRITLTANEPMSEKDKLSWLILNRAGSGSSGDNAALSAAAGALLAGQINDRIGLVDDLGF
            ||||||||||||||||||||||||||||||||||||||||||||||||||||||||||||
m285-1      PRITLTANEPMSEKDKLSWLILNRAGSGSSGDNAALSAAAGALLAGQINDRIGLVDDLGF
                   1210      1220      1230      1240      1250      1260

1270      1280      1290      1300      1310      1320
g285-1.pep  TSKRSRNAQTGELNPAEQVLTVGKQLTGKLYIGYEYGISSAEQSVKLIYRLTRAIQAVAR
            ||||||||||||||||||||||||||||||||||||:|||||||||||||||||||||||
m285-1      TSKRSRNAQTGELNPAEQVLTVGKQLTGKLYIGYEYSISSAEQSVKLIYRLTRAIQAVAR
                   1270      1280      1290      1300      1310      1320

1330      1340      1350
g285-1.pep  IGSRSSGGELTYTIRFDRLFGSDKKDSAGNGKGK
            ||||||||||||||||||: ||||||||||||||
m285-1      IGSRSSGGELTYTIRFDRFSGSDKKDSAGNGKGKX
                   1330      1340      1350
```

The following partial DNA sequence was identified in *N. meningitidis* <SEQ ID 1191>:

```
a285-1.seq
   1 CTGAAGCTGT CGGCGGCACT GCTGTCTGTT CTGATTTTGG CAGTATGTTT

51 CCTCGGCTGG CTCGCCGGCA CGGAAGCGGG TTTGCGCTTC GGGCTGTACC

101 AAATCCCGTC TTGGTTCGGC GTAAACATTT CCTCCCAAAA CCTCAAAGGC

151 ACGCTGCTCG ACGGCTTCGA CGGCGACAAC TGGTCGATAG AAACCGAGGG

201 GGCAGACCTT AAAATCAGCC GCTTCCGCTT CGCGTGGAAA CCGTCCGAAC

251 TGATGCGCCG CAGCCTGCAC ATTACCGAAA TTTCCGCCGG CGACATCGCC

301 ATCGTTACCA AACCGACTCC GCCTAAAGAA GAACGCCCGC CGCTCAGCCT

351 TCCCGACAGC ATAGACCTGC CTGCCGCCGT CTATCTCGAC CGCTTCGAGA

401 CGGGCAAAAT CAGCATGGGC AAAGCCTTTG ACAAACAAAC CGTCTATCTC

451 GAACGGCTGG ATGCTTCATA CCGTTACGAC CGCAAAGGAC ACCGCCTCGA

501 CCTGAAGGCT GCCGACACGC CGTGGAGCAG TTCGTCGGGG TCAGCCTCGG

551 TCGGCTTGAA AAAACCGTTT GCCCTCGATA CCGCCATTTA CACCAAAGGC

601 GGACTCGAAG GCAAAACCAT ACACAGTACG GCTCGGCTGA GCGGCAGCCT

651 GAAGGATGTG CGCGCCGAAC TGGCGATCGA CGGCGGCAAT ATCCGCCTCT

701 CGGGAAAATC CGTCATCCAC CCGTTTGCCG AATCATTGGA TAAAACATTG

751 GAAGAAGTAC TGGTCAAAGG GTTCAACATC AATCCGTCCG CCTTCGTGCC

801 TTCCCTGCCC GATGCCGGGC TGAATTTCGA CCTGACCGCC ATCCCGTCGT

851 TTTCAGACGG CATCGCGCTG GAAGGCTCGC TCGATTTGGA AAACACCAAA

901 GCCGGCTTTG CCGACCGCAA CGGCATCCCC GTCCGTCAGG TTTTAGGCAG

951 CTTTGTCATC CGGCAGGACG GCACGGTGCA TATCGGCAAT ACGTCCGTCG

1001 CCCTGCTCGG ACGGGGCGGC ATCAGGCTGT CGGGCAAAAT CGACACCGAA

1051 AAAGACATCC TCGATTTAAA TATAGGCATC AACTCCGTCG GCGCGGAAGA

1101 CGTACTGCAA ACCGCGTTCA AAGGCAGGTT GGACGGCAGC ATCGGCATCG

1151 GTGGCACGAC CGCCTCGCCC AAAATCTCTT GGCAACTCGG CATCGGCACG
```

-continued

```
1201 GCGCGCACGG ACGGCAGCCT CGCCATTGCA AGCGACCCCG CAAACGGACA
1251 GCGGAAACTG GTGCTCGACA CCGTCAACAT CGCCGCCGGG CAAGGCAGCC
1301 TGACCGCGCA AGGCTATCTC GAGCTGTTTA AAGACCGCCT GCTCAAGCTG
1351 GACATCCGTT CCCGCGCATT CGACCCTTCG CGCATCGATC CGCAACTTCC
1401 GGCAGGCAAT ATCAACGGCT CAATAAACCT TGCCGGCGAA CTGGCAAAAG
1451 AGAAATTCAC AGGCAAAATG CGGTTTTTAC CCGGCACGTT CAACGGCGTA
1501 CCGATTGCCG GCAGTGCCGA CATTGTTTAC GAGTCCCGCC ACCTTCCGCG
1551 TGCCGCCGTC GATTTGCGGC TGGGGCGGAA CATTATTAAA ACAGACGGCG
1601 GCTTCGGCAA AAAGGCGAC CGGCTTAACC TCAATATCAC CGCACCCGAT
1651 TTATCCCGTT TCGGTTTCGG ACTCGCGGGG TCTTTAAATG TACGCGGACA
1701 CCTTTCCGGC GATTTGGACG GTGGCATCCG AACCTTTGAA ACCGACCTTT
1751 CCGGCGCGGC GCGCAACCTG CACATCGGCA AGGCGGCAGA CATCCGTTCG
1801 CTCGATTTCA CGCTCAAAGG TTCGCCCGAC ACAAGCCGCC CGATACGCGC
1851 CGACATCAAA GGCAGCCGCC TTTCGCTGTC GGGCGGAGCG GAGGTTGTCG
1901 ATACCGCCGA CCTGATGCTG GACGGCACGG GCGTGCAGCA CCGCATCCGC
1951 ACACACGCCG CCATGACGCT GGATGGCAAA CCGTTCAAAT TCGATTTGGA
2001 CGCTTCAGGC GGCATCAACA GGGAACTTAC CCGATGGAAA GGCAGCATCG
2051 GCATCCTCGA CATCGGCGGC GCATTCAACC TCAAGCTGCA AAACCGTATG
2101 ACGCTCGAAG CCGGTGCGGA ACGCGTGGCG GCAAGTGCGG CAAATTGGCA
2151 GGCAATGGGC GGCAGCCTCA ACCTGCAACA CTTTTCTTGG GATAAAAAAA
2201 CCGGCATATC GGCAAAAGGC GGCGCACACG GTCTGCATAT CGCCGAGTTG
2251 CACAATTTCT TCAAACCGCC CTTCGAACAC AATCTGGTTT TAAACGGCGA
2301 CTGGGATGTC GCCTACGGGC GAAACGCGCG CGGCTACCTC AATATCAGCC
2351 GGCAAAGCGG CGATGCCGTA TTGCCCGGCG GCAGGCTTT GGGTTTGAAC
2401 GCATTTTCCC TGAAAACGCG CTTTCAAAAC GACCGTATCG GAATCCTGCT
2451 TGACGGCGGC GCGCGTTTCG GCGGATTAA CGCCGATTTG GACATCGGCA
2501 ACGCCTTCGG CGGCAATATG GCAAATGCAC CGCTCGGCGG CAGGATTACC
2551 GCCTCCCTTC CCGACTTGGG CACATTGAAG CCCTTTCTGC CGCCGCCGC
2601 GCAAAACATT ACCGGCAGCC TGAATGCCGC CGCGCAAATC GGCGGACGGG
2651 TCGGCTCTCC GTCCGTCAAT GCCGCCGTCA ACGGCAGCAG CAACTACGGG
2701 AAAATCAACG GCAACATCAC CGTCGGGCAA AGCCGCTCTT TCGATACCGC
2751 GCCTTTGGGC GGCAGGCTCA ACCTGACCGT TGCCGATGCC GAAGTATTCC
2801 GCAACTTCCT ACCGGTCGGA CAAACCGTCA AAGGCAGCCT GAATGCCGCC
2851 GTAACCCTCG GCGGCAGCAT CGCCGATCCG CACTTGGGCG GCAGCATCAA
2901 CGGCGACAAA CTCTATTACC GCAACCAAAC CCAAGGCATC ATCTTGGACA
2951 ACGGCTCGCT GCGTTCGCAT ATCGCGGGCA GGAAATGGGT AATCGACAGC
3001 CTGAAATTCC GGCACGAAGG GACGGCGGAA CTCTCCGGTA CGGTCGGTAT
3051 GGAAAACAGC GGACCCGATG TCGATATCGG CGCGGTGTTC GACAAATACC
3101 GCATCCTGTC CCGCCCCAAC CGCCGCCTGA CGGTTTCCGG CAACACCCGC
3151 CTGCGCTATT CGCCGCAAAA AGGCATATCC GTTACCGGGA TGATTAAAAC
```

```
-continued
3201 GGATCAGGGG CTGTTCGGTT CGCAAAAATC CTCGATGCCG TCCGTCGGCG

3251 ACGATGTCGT CGTATTAGGC GAAGTCAAAA AAGAGGCGGC GGCACCGCTC

3301 CCCGTCAATA TGAACCTGAC TTTAGACCTC AATGACGGCA TCCGCTTCGC

3351 CGGCTACGGC GCGGACGTTA CCATAGGCGG CAAACTGACC CTGACCGCCC

3401 AATCGGGCGG AAGCGTGCGG GGCGTGGGCA CGGTCCGCGT CATCAAAGGG

3451 CGTTATAAGG CATACGGGCA GGATTTGGAC ATTACCAAAG GCACGGTCTC

3501 CTTTGTCGGC CCGCTCAACG ACCCCAACCT CAACATCCGC GCCGAACGCC

3551 GCCTTTCCCC CGTCGGTGCG GGCGTGGAAA TATTGGGCAG CCTCAACAGT

3601 CCGCGCATTA CGCTGACGGC AAACGAACCG ATGAGTGAAA AAGACAAGCT

3651 CTCCTGGCTC ATCCTCAACC GCGCCGGCAG TGGCAGCAGC GGCGACAATG

3701 CCGCCCTGTC CGCAGCCGCC GGCGCGCTGC TTGCCGGGCA AATCAACGAC

3751 CGCATCGGGC TGGTGGATGA TTTGGGCTTT ACCAGCAAGC GCAGCCGCAA

3801 CGCGCAAACC GGCGAACTCA ACCCCGCCGA ACAGGTGCTG ACCGTCGGCA

3851 AACAACTGAC CGGCAAACTC TACATCGGCT ACGAATACAG CATCTCCAGC

3901 GCGGAACAGT CCGTCAAACT GATTTACCGG CTGACCCGCG CCATACAGGC

3951 GGTTGCCCGT ATCGGCAGCC GTTCGTCGGG CGGCGAGCTG ACATACACCA

4001 TACGTTTCGA CCGCTTCTCC GGTTCGGACA AAAAGACTC CGCCGGAAAC

4051 AGCAAAGGAA AATAA
```

This corresponds to the amino acid sequence <SEQ ID 1192; ORF 285-1.a>:

```
a285-1.pep

1 LKLSAALLSV LILAVCFLGW LAGTEAGLRF GLYQIPSWFG VNISSQNLKG

51 TLLDGFDGDN WSIETEGADL KISRFRFAWK PSELMRRSLH ITEISAGDIA

101 IVTKPTPPKE ERPPLSLPDS IDLPAAVYLD RFETGKISMG KAFDKQTVYL

151 ERLDASYRYD RYGHRLDLKA ADTPWSSSSG SASVGLKKPF ALDTAIYTKG

201 GLEGKTIHST ARLSGSLKDV RAELAIDGGN IRLSGKSVIH PFAESLDKTL

251 EEVLVKGFNI NPSAFVPSLP DAGLNFDLTA IPSFSDGIAL EGSLDLENTK

301 AGFADRNGIP VRQVLGSFVI RQDGTVHIGN TSVALLGRGG IRLSGKIDTE

351 KDILDLNIGI NSVGAEDVLQ TAFKGRLDGS IGIGGTTASP KISWQLGIGT

401 ARTDGSLAIA SDPANGQRKL VLDTVNIAAG QGSLTAQGYL ELFKDRLLKL

451 DIRSRAFDPS RIDPQLPAGN INGSINLAGE LAKEKFTGKM RFLPGTFNGV

501 PIAGSADIVY ESRHLPRAAV DLRLGRNIIK TDGGFGKKGD RLNLNITAPD

551 LSRFGFGLAG SLNVRGHLSG DLDGGIRTFE TDLSGAARNL HIGKAADIRS

601 LDFTLKGSPD TSRPIRADIK GSRLSLSGGA EVVDTADLML DGTGVQHRIR

651 THAAMTLDGK PFKFDLDASG GINRELTRWK GSIGILDIGG AFNLKLQNRM

701 TLEAGAERVA ASAANWQAMG GSLNLQHFSW DKKTGISAKG GAHGLHIAEL

751 HNFFKPPFEH NLVLNGDWDV AYGRNARGYL NISRQSGDAV LPGGQALGLN

801 AFSLKTRFQN DRIGILLDGG ARFGRINADL DIGNAFGGNM ANAPLGGRIT

851 ASLPDLGTLK PFLPAAAQNI TGSLNAAAQI GGRVGSPSVN AAVNGSSNYG

901 KINGNITVGQ SRSFDTAPLG GRLNLTVADA EVFRNFLPVG QTVKGSLNAA

951 VTLGGSIADP HLGGSINGDK LYYRNQTQGI ILDNGSLRSH IAGRKWVIDS
```

-continued

```
1001  LKFRHEGTAE LSGTVGMENS GPDVDIGAVF DKYRILSRPN RRLTVSGNTR

1051  LRYSPQKGIS VTGMIKTDQG LFGSQKSSMP SVGDDVVVLG EVKKEAAAPL

1101  PVNMNLTLDL NDGIRFAGYG ADVTIGGKLT LTAQSGGSVR GVGTVRVIKG

1151  RYKAYGQDLD ITKGTVSFVG PLNDPNLNIR AERRLSPVGA GVEILGSLNS

1201  PRITLTANEP MSEKDKLSWL ILNRAGSGSS GDNAALSAAA GALLAGQIND

1251  RIGLVDDLGF TSKRSRNAQT GELNPAEQVL TVGKQLTGKL YIGYEYSISS

1301  AEQSVKLIYR LTRAIQAVAR IGSRSSGGEL TYTIRFDRFS GSDKKDSAGN

1351  SKGK*
``` a285-1/m285-1  99.3% identity in 1354 aa overlap

```
                  10         20         30         40         50         60
a285-1.pep  LKLSAALLSVLLLAVCFLGWLAGTEAGLRFGLYQIPSWFGVNISSQNLKGTLLDGFDGDN
            ||||||||||| |||||||||||||||||||||||||||||||||||||||||||||||
m285-1      LKLSAALLSVLILAVCFLGWLAGTEAGLRFGLYQIPSWFGVNISSQNLKGTLLDGFDGDN
                  10         20         30         40         50         60

70         80         90        100        110        120
a285-1.pep  WSIETEGADLKISRFRFAWKPSELMRRSLHITEISAGDIAIVTKPTPPKEERPPLSLPDS
            ||||||||||||||||||||||||||||||||||||||||||||||||||||||||||||
m285-1      WSIETEGADLKISRFRFAWKPSELMRRSLHITEISAGDIAIVTKPTPPKEERPPLSLPDS
                  70         80         90        100        110        120

130        140        150        160        170        180
a285-1.pep  IDLPAAVYLDRFETGKISMGKAFDKQTVYLERLDASYRYDRKGHRLDLKAADTPWSWSSG
            ||||||||||||||||||||||||||||||||||||||||||||||||||||||||||||
m285-1      IDLPAAVYLDRFETGKISMGKAFDKQTVYLERLDASYRYDRKGHRLDLKAADTPWSWSSG
                 130        140        150        160        170        180

190        200        210        220        230        240
a285-1.pep  SASVGLKKPFALDTAIYTKGGLEGKTIHSTARLSGSLKDVRAELAIDGGNIRLSGKSVIH
            :|||||||||||||||||||||||||||||||||||||||||||||||||||||||||||
m285-1      AASVGLKKPFALDTAIYTKGGLEGKTIHSTARLSGSLKDVRAELAIDGGNIRLSGKSVIH
                 190        200        210        220        230        240

250        260        270        280        290        300
a285-1.pep  PFAESLDKTLEEVLVKGFNINPSAFVPSLPDAGLNFDLTAIPSFSDGIALEGSLDLENTK
            ||||||||||||||||||||||:|||||||||||||||||||||||||||||||||||||
m285-1      PFAESLDKTLEEVLVKGFNINPAAFVPSLPDAGLNFDLTAIPSFSDGIALEGSLDLENTK
                 250        260        270        280        290        300

310        320        330        340        350        360
a285-1.pep  AGFADRNGIPVRQVLGSFVIRQDGTVHIGNTSVALLGRGGIRLSGKIDTEKDILDLNIGI
            ||||||||||||||||:||||||||||||||||:||||||||||||||||||||||||||
m285-1      AGFADRNGIPVRQVLGGFVIRQDGTVHIGNTSAALLGRGGIRLSGKIDTEKDILDLNIGI
                 310        320        330        340        350        360

370        380        390        400        410        420
a285-1.pep  NSVGAEDVLQTAFKGRLDGSIGIGGTTASPKISWQLGIGTARTDGSLAIASDPANGQRKL
            ||||||||||||||||||||||||||||||||||||||||||||||||||||||||||||
m285-1      NSVGAEDVLQTAFKGRLDGSIGIGGTTASPKISWQLGIGTARTDGSLAIASDPANGQRKL
                 370        380        390        400        410        420

430        440        450        460        470        480
a285-1.pep  VLDTVNIAAGQGSLTAQGYLELFKDRLLKLDIRSRAFDPSRIDPQLPAGNINGSINLAGE
            ||||||||||||||||||||||||||||||||||||||||||||||||||||||||||||
m285-1      VLDTVNIAAGQGSLTAQGYLELFKDRLLKLDIRSRAFDPSRIDPQLPAGNINGSINLAGE
                 430        440        450        460        470        480

490        500        510        520        530        540
a285-1.pep  LAKEKFTGKMRPLPGTFNGVPIAGSADIVYESRHLPRAAVDLRLGRNIIKTDGGFGKKGD
            |||||||||||:||||||||||||||||||||||||||||||||||||||||||||||||
m285-1      LAKEKFTGKMRFLPGTFNGVPIAGSADIVYESRHLPRAAVDLRLGRNIIKTDGGFGKKGD
                 490        500        510        520        530        540

550        560        570        580        590        600
a285-1.pep  RLNLNITAPDLSRFGFGLAGSLNVRGHLSGDLDGGIRTFFTDLSGAARNLHIGKAADIRS
            ||||||||||||||||||||||||||||||||||||||||||||||||||||||||||||
m285-1      RLNLNITAPDLSRFGFGLAGSLNVRGHLSGDLDGGIRTFFTDLSGAARNLHIGKAADIRS
                 550        560        570        580        590        600

610        620        630        640        650        660
a285-1.pep  LDFTLKGSPDTSRPIRADIKGSRLSLSGGAEVVDTADLMLDGTGVQHRIRTHAAMTLDGK
            |||||||||||||||||||||||||||||||:||||||||||||||||||||||||||||
m285-1      LDFTLKGSPDTSRPIRADIKGSRLSLSGGAVVVDTADLMLDGTGVQHRIRTHAAMTLDGK
                 610        620        630        640        650        660

670        680        690        700        710        720
a285-1.pep  PFKFDLDASGGINRELTRWKGSIGILDIGGAFNLKLQNRMTLEAGAERVAASAANWQAMG
            ||||||||||||||||||||||||||||||||||||||||||||||||||||||||||||
m285-1      PFKFDLDASGGINRELTRWKGSIGILDIGGAFNLKLQNRMTLEAGAERVAASAANWQAMG
                 670        680        690        700        710        720
```

```
               730        740        750        760        770        780
a285-1.pep  GSLNLQHFSWDKKTGISAKGGAHGLHIAELHNFFKPPFEHNLVLNGDWDVAYGRNARGYL
            ||||||||||||||||||||||||||||||||||||||||||||||||||||||||||||
m285-1      GSLNLQHFSWDKKTGISAKGGAHGLHIAELHNFFKPPFEHNLVLNGDWDVAYGRNARGYL
               730        740        750        760        770        780

790        800        810        820        830        840
a285-1.pep  NISRQSGDAVLPGGQALGINAFSLKTRFQNDRIGILLDGGARFGRINADLDIGNAFGGNM
            |||||||||||||||||||||||||||||||||||||||||||||||||||:||||||||
m285-1      NISRQSGDAVLPGGQALGLNAFSLKTRFQNDRIGILLDGGARFGRINADLGIANAFGGNM
               790        800        810        820        830        840

850        860        870        880        890        900
a285-1.pep  ANAPLGGRITASLPDLGALKPFLPAAAQNITGSLNAAAQIGGRVGSPSVNAAVNGSSNYG
            ||||||||||||||||||||||||||||||||||||||||||||||||||||||||||||
m285-1      ANAPLGGRITASLPDLGTLKPFLPAAAQNITGSLNAAAQIGGRVGSPSVNAAVNGSSNYG
               850        860        870        880        890        900

910        920        930        940        950        960
a285-1.pep  KINGNITVGQSRSFDTAPLGGRLNLTVADAEVFRNFLPVGQTVKGSLNAAVTLGGSIADP
            ||||||||||||||||||||||||||||||||||||||||||||||||||||||||||||
m285-1      KINGNITVGQSRSFDTAPLGGRLNLTVADAEVFRNFLPVGQTVKGSLNAAVTLGGSIADP
               910        920        930        940        950        960

970        980        990       1000       1010       1020
a285-1.pep  HLGGSINGDKLYYRNQTQGIILDNGSLRSHIAGRKWVIDSLKFRHEGTAELSGTVGMENS
            ||||||||||||||||||||||||||||||||||||||||||||||||||||||||||||
m285-1      HLGGSINGDKLYYRNQTQGIILDNGSLRSHIAGRKWVIDSLKFRHEGTAELSGTVGMENS
               970        980        990       1000       1010       1020

1030       1040       1050       1060       1070       1080
a285-1.pep  GPDVDIGAVFDKYRILSRPNRRLTVSGNTRLRYSPQKGISVTGMIKTDQGLFGSQKSSMP
            ||||||||||||||||||||||||||||||||||||||||||||||||||||||||||||
m285-1      GPDVDIGAVFDKYRILSRPNRRLTVSGNTRLRYSPQKGISVTGMIKTDQGLFGSQKSSMP
              1030       1040       1050       1060       1070       1080

1090       1100       1110       1120       1130       1140
a285-1.pep  SVGDDVVVLGEVKKEAAAPLPVNMNLTLDLNDGIRFAGYGADVTIGGKLTLTAQSGGSVR
            ||||||||||||||||||||||||||||||||||||||||||||||||||||||||||||
m285-1      SVGDDVVVLGEVKKEAAAPLPVNMNLTLDLNDGIRFAGYGADVTIGGKLTLTAQSGGSVR
              1090       1100       1110       1120       1130       1140

1150       1160       1170       1180       1190       1200
a285-1.pep  GVGTVRVIKGRYKAYGQDLDITKGTVSFVGPLNDPNLNIRAERRLSPVGAGVEILGSLNS
            ||||||||||||||||||||||||||||||||||||||||||||||||||||||||||||
m285-1      GVGTVRVIKGRYKAYGQDLDITKGTVSFVGPLNDPNLNIRAERRLSPVGAGVEILGSLNS
              1150       1160       1170       1180       1190       1200

1210       1220       1230       1240       1250       1260
a285-1.pep  PRITLTANEPMSEKDKLSWLILNRAGSGSSGDNAALSAAAGALLAGQINDRIGLVDDLGF
            ||||||||||||||||||||||||||||||||||||||||||||||||||||||||||||
m285-1      PRITLTANEPMSEKDKLSWLILNRAGSGSSGDNAALSAAAGALLAGQINDRIGLVDDLGF
              1210       1220       1230       1240       1250       1260

1270       1280       1290       1300       1310       1320
a285-1.pep  TSKRSRNAQTGELNPAEQVLTVGKQLTGKLYIGYEYSISSAEQSVKLIYRLTRAIQAVAR
            ||||||||||||||||||||||||||||||||||||||||||||||||||||||||||||
m285-1      TSKRSRNAQTGELNPAEQVLTVGKQLTGKLYIGYEYSISSAEQSVKLIYRLTRAIQAVAR
              1270       1280       1290       1300       1310       1320

1330       1340       1350
a285-1.pep  IGSRSSGGELTYTIRFDRFSGSDKKDSAGNSKGKX
            |||||||||||||||||||||||||||||:||||
m285-1      IGSRSSGGELTYTIRFDRFSGSDKKDSAGNGKGKX
              1330       1340       1350
```

The following partial DNA sequence was identified in *N. gonorrhoeae* <SEQ ID 1193>:

```
g286.seq
  1  atgcagaaca ccggtaccat gatgatcaaa ccgaccgccc tgctcctgcc 51  ggctttattt ttctttccgc acgcatacgc gcctgccgcc gacctttccg 101  aaaacaaggc ggcgggtttc gcattgttca aaagcaaaag ccccgacacc 151  gaatcagtca aattaaaacc caaattcccc gtccgcatcg acacgcagga 201  cagtgaaatc aaagatatgg tcgaagaaca cctgccgctc atcacgcagc 251  agcaggaaga ggttttggat aaggaacaga cgggattcct tgccgaagaa 301  gcaccggaca acgttaaaac aatgctccgc agcaaaggct atttcagcag 351  caaggtcagc ctgacggaaa aagacggagc ttatacggtg cacatcacac 401  cgggcccgcg caccaaaatc gccaacgtcg gcgtcgccat cctcggcgac
```

```
 451 atcctttcag acggcaacct cgccgaatac taccgcaacg cgctggaaaa 501 ctggcagcag ccggtaggca gcgatttcga tcaggacagt tgggaaaaca 551 gcaaaacttc cgtcctcggc gcggtaacgc gcaaaggcta cccgcttgcc 601 aagctcggca cacccgggc ggccgtcaac cccgatacgc caccgccga 651 tttgaacgtc gtcgtggaca gcggccgccc cattgccttc ggcgactttg 701 aaatcaccgg cacacagcgt taccccgaac aaaccgtctc cggcctggcg 751 cgcttccaac cgggcacgcc ctacgacctc gacctgctgc tcgacttcca 801 acaggcgctc gaacaaaacg gcattattc cggcgcgtcc gtacaagccg 851 acttcgaccg cctcccaagg ggaccgcgtc cccgtcaaag tcagcgtaac 901 cgaggtcaaa cgccacaaac tcgaaaccgg catccgcctc gattcggaat 951 acggtttggg cggcaaaatc gcctacgact attacaacct cttcaacaaa 1001 ggctatatcg gctcggtcgt ctgggatatg acaaatacg aaaccacgct 1051 tgccgccggc atcagccagc cgcgcaacta tcggggcaac tactggacaa 1101 gcaacgtttc ctacaaccgt tcgaccaccc aaaacctcga aaaacgcgcc 1151 ttctccggcg gcatctggta tgtgcgcgac cgcgcgggca tcgatgccag 1201 gctgggggcg gaatttctcg cagaaggccg gaaaatcccc ggctcggatg 1251 tcgatttggg caacagccac gccacgatgc tgaccgcctc ttggaaacgc 1301 cagctgctca caacgtgct gcaccccgaa acggccatt acctcgacgg 1351 caaaatcggg acgactttgg gcacattcct gtcctccacc gcgctaatcc 1401 gcacctctgc ccgcgcaggt tatttcttca cgcccgaaaa caaaaaactc 1451 ggcacgttca tcatacgcgg acaagcgggt tacaccgttg cacgcgacaa 1501 tgccgatgtc ccctcggggc tgatgttccg cagcggcggc gcgtcttccg 1551 tgcgcggtta cgaacttga
```

This corresponds to the amino acid sequence <SEQ ID 40 1194; ORF 286.ng>:

```
g286.pep
  1 MQNTGTMMIK PTALLLPALF FFPHAYAPAA DLSENKAAGF ALFKSKSPDT

51 ESVKLKPKFP VRIDTQDSEI KDMVEEHLPL ITQQQEEVLD KEQTGFLAEE

101 APDNVKTMLR SKGYFSSKVS LTEKDGAYTV HITPGPRTKI ANVGVAILGD

151 ILSDGNLAEY YRNALENWQQ PVGSDFDQDS WENSKTSVLG AVTRKGYPLA

201 KLGNTRAAVN PDTATADLNV VVDSGRPIAF GDFEITGTQR YPEQTVSGLA

251 RFQPGTPYDL DLLLDFQQAL EQNGHYSGAS VQADFDRLPR GPRPRQSQRN

301 RGQTPQTRNR HPPRFGIRFG RQNRLRLLQP LQQRLYRLGR LGYGQIRNHA

351 CRRHQPAAQL SGQLLDKQRF LQPFDHPKPR KTRLLRRHLV CARPRGHRCQ

401 AGGGISRRRP ENPRLGCRFG QQPRHDADRL LETPAAQQRA APRKRPLPRR

451 QNRDDFGHIP VLHRANPHLC PRRLFLHARK QKTRHVHHTR TSGLHRCTRQ

501 CRCPLGADVP QRRRVFRARL RT*
```

The following partial DNA sequence was identified in *N. meningitidis* <SEQ ID 1195>:

```
m286.seq
   1 ATGCACGACA CCCGTACCAT GATGATCAAA CCGACCGCCC TGCTCCTGCC
  51 GGCTTTATTT TTCTTTCCGC ACGCATACGC GCCTGCCGCC GACCTTTCCG
 101 AAAACAAGGC GGCGGGTTTC GCATTGTTCA AAAACAAAAG CCCCGACACC
 151 GAATCAGTCA AATTAAAACC CAAATTCCCC GTCCTCATCG ACACGCAGGA
 201 CAGTGAAATC AAAGATATGG TCGAAGAACA CCTGCCGCTC ATCACGCAGC
 251 AGCAGGAAGA AGTATTGGAC AAGGAACAGA CGGGCTTCCT CGCCGAAGAA
 301 GCGCCGGACA ACGTTAAAAC GATGCTCCGC AGCAAAGGCT ATTTCAGCAG
 351 CAAAGTCAGC CTGACGGAAA AAGACGGAGC TTATACGGTA CACATCACAC
 401 CGGGCCCGCG CACCAAAATC GCCAACGTCG GCGTCGCCAT CCTCGGCGAC
 451 ATCCTTTCAG ACGGCAACCT CGCCGAATAC TACCGCAACG CGCTGGAAAA
 501 CTGGCAGCAG CCGGTAGGCA GCGATTTCGA TCAGGACAGT TGGGAAAACA
 551 GCAAAACTTC CGTCCTCGGC GCGGTAACGC GCAAAGCCTA CCCGCTTGCC
 601 AAGCTCGGCA ATACGCAGGC GGCCGTCAAC CCCGATACCG CCACCGCCGA
 651 TTTGAACGTC GTCGTGGACA GCGGCCGCCC CATCGCCTTC GGCGACTTTG
 701 AAATCACCGG CACACAGCGT TACCCCGAAC AAATCGTCTC CGGCCTTGCG
 751 CGTTTCCAGC CCGGTATGCC GTACGACCTC GACCTGCTGC TCGACTTCCA
 801 ACAGGCGCTC GAACAAAACG GGCATTATTC CGGCGCGTCC GTACAAGCCG
 851 ACTTCGACCG CCTCCAAGGC GACCGCGTCC CCGTCAAAGT CAGCGTAACC
 901 GAGGTCAAAC GCCACAAACT CGAAACCGGC ATCCGCCTCG ATTCGGAATA
 951 CGGTTTGGGC GGCAAAATCG CCTACGACTA TTACAACCTC TTCAACAAAG
1001 GCTATATCGG TTCGGTCGTC TGGGATATGG ACAAATACGA AACCACGCTT
1051 GCCGCCGGCA TCAGCCAGCC GCGCAACTAT CGGGGCAACT ACTGGACAAG
1101 CAACGTTTCC TACAACCGTT CGACCACCCA AAACCTCGAA AAACGCGCCT
1151 TCTCCGGCGG CGTCTGGTAT GTGCGCGACC GCGCGGGCAT CGATGCCAGG
1201 CTGGGGGCGG AATTTCTCGC AGAAGGCCGG AAAATCCCCG GCTCGGCTGT
1251 CGATTTGGGC AACAGCCACG CCACGATGCT GACCGCCTCT TGGAAACGCC
1301 AGCTGCTCAA CAACGTGCTG CATCCCGAAA ACGGCCATTA CCTCGACGGC
1351 AAAATCGGTA CGACTTTGGG CACATTCCTG TCCTCCACCG CGCTGATCCG
1401 CACCTCTGCC CGTGCAGGTT ATTTCTTCAC GCCCGAAAAC AAAAAACTCG
1451 GCACGTTCAT CATACGCGGA CAAGCGGGTT ACACCGTTGC CCGCGACAAT
1501 GCCGACGTTC CTTCAGGGCT GATGTTCCGC AGCGGCGGCG CGTCTTCCGT
1551 GCGCGGTTAC GAACTCGACA GCATCGGACT TGCCGGCCCG AACGGATCGG
1601 TCCTGCCCGA ACGCGCCCTC CTGGTGGGCA GCCTGGAATA CCAACTGCCG
1651 TTTACGCGCA CCCTTTCCGG CGCGGTGTTC CACGATATGG GCGATGCCGC
1701 CGCCAATTTC AAACGTATGA AGCTGAAACA CGGTTCGGGA CTGGGCGTGC
1751 GCTGGTTCAG CCCGCTTGCG CCGTTTTCCT TCGACATCGC CTACGGGCAC
1801 AGCGATAAGA AAATCCGCTG GCACATCAGC TTGGGAACGC GCTTCTAA
```

This corresponds to the amino acid sequence <SEQ ID 1196; ORF 286>:

```
m286.pep
  1 MHDTRTMMIK PTALLLPALF FFPHAYAPAA DLSENKAAGF ALFKNKSPDT

51 ESVKLKPKFP VLIDTQDSEI KDMVEEHLPL ITQQQEEVLD KEQTGFLAEE

101 APDNVKTMLR SKGYFSSKVS LTEKDGAYTV HITPGPRTKI ANVGVAILGD

151 ILSDGNLAEY YRNALENWQQ PVGSDFDQDS WENSKTSVLG AVTRKAYPLA

201 KLGNTQAAVN PDTATADLNV VVDSGRPIAF GDFEITGTQR YPEQIVSGLA

251 RFQPGMPYDL DLLLDFQQAL EQNGHYSGAS VQADFDRLQG DRVPVKVSVT

301 EVKRHKLETG IRLDSEYGLG GKIAYDYYNL FNKGYIGSVV WDMDKYETTL

351 AAGISQPRNY RGNYWTSNVS YNRSTTQNLE KRAFSGGVWY VRDRAGIDAR

401 LGAEFLAEGR KIPGSAVDLG NSHATMLTAS WKRQLLNNVL HPENGHYLDG

451 KIGTTLGTFL SSTALIRTSA RAGYFFTPEN KKLGTFIIRG QAGYTVARDN

501 ADVPSGLMFR SGGASSVRGY ELDSIGLAGP NGSVLPERAL LVGSLEYQLP

551 FTRTLSGAVF HDMGDAAANF KRMKLKHGSG LGVRWFSPLA PFSFDIAYGH

601 SDKKIRWHIS LGTRF*
```

Computer analysis of this amino acid sequence gave the following results:
Homology with a Predicted ORF from *N. gonorrhoeae*

```
m286/g286   95.9% identity in 293 aa overlap 10         20         30         40         50         60
m286.pep  MHDTRTMMIKPTALLLPALFFFPHAYAPAADLSENKAAGFALFKNKSPDTESVKLKPKFP
          |::| ||||||||||||||||||||||||||||||||||||||:||||||||||||||||
g286      MQNTGTMMIKPTALLLPALFFFPHAYAPAADLSENKAAGFALFKSKSPDTESVKLKPKFP
                  10         20         30         40         50         60

70         80         90        100        110        120
m286.pep  VLIDTQDSEIKDMVEEHLPLITQQQEEVLDKEQTGFLAEEAPDNVKTMLRSKGYFSSKVS
          | ||||||||||||||||||||||||||||||||||||||||||||||||||||||||||
g286      VRIDTQDSEIKDMVEEHLPLITQQQEEVLDKEQTGFLAEEAPDNVKTMLRSKGYFSSKVS
                  70         80         90        100        110        120

130        140        150        160        170        180
m286.pep  LTEKDGAYTVHITPGPRTKIANVGVAILGDILSDGNLAEYYRNALENWQQPVGSDFDQDS
          ||||||||||||||||||||||||||||||||||||||||||||||||||||||||||||
g286      LTEKDGAYTVHITPGPRTKIANVGVAILGDILSDGNLAEYYRNALENWQQPVGSDFDQDS
                 130        140        150        160        170        180

190        200        210        220        230        240
m286.pep  WENSKTSVLGAVTRKAYPLAKLGNTQAAVNPDTATADLNVVVDSGRPIAFGDFEITGTQR
          ||||||||||||||||:|||||||||:|||||||||||||||||||||||||||||||||
g286      WENSKTSVLGAVTRKGYPLAKLGNTRAAVNPDTATADLNVVVDSGRPIAFGDFEITGTQR
                 190        200        210        220        230        240

250        260        270        280        290      299
m286.pep  YPEQIVSGLARFQPGMPYDLDLLLDFQQALEQNGHYSGASVQADFDRL-QGDRVPVKVSV
          ||||  |||||||||| |||||||||||||||||||||||||||||| :| |
g286      YPEQTVSGLARFQPGTPYDLDLLLDFQQALEQNGHYSGASVQADFDRLPRGPRPRQSRN
                 250        260        270        280        290        300

300        310        320        330        340        350     359
m286.pep  TEVKRHKLETGIRLDSEYGLGGKIAYDYYNLFNKGYIGSVVWDMDKYETTLAAGISQPRN g286      RGQTPQTRNRHPPRFGIRFGRQNRLRLLQPLQQRLYRLGRLGYGQIRNHACRRHQPAAQL
                 310        320        330        340        350        360
```

The following partial DNA sequence was identified in *N. meningitidis* <SEQ ID 1197>:

```
a286.seq
   1 ATGCACGACA CCCGTACCAT GATGATTAAA CCGACCGCCC TGCTCCTGCC
  51 GGCTTTATTT TTCTTTCCGC ACGCATACGC GCCTGCCGCC GACCTTTCCG
 101 AAAACAAGGC GGCGGGTTTC GCATTGTTCA AAAACAAAAG CCCCGACACC
 151 GAATCAGTTA AATTAAAACC CAAATTCCCC GTCCGCATCG ACACGCAGGA
 201 TAGTGAAATC AAAGATATGG TCGAAGAACA CCTGCCGCTC ATCACGCAGC
 251 AGCAGGAAGA AGTATTGGAC AAGGAACAGA CGGGCTTCCT CGCCGAAGAA
 301 GCACCGGACA ACGTTAAAAC AATGCTCCGC AGCAAAGGCT ATTTCAGCAG
 351 CAAAGTCAGC CTGACGGAAA AAGACGGAGC TTATACGGTA CACATCACAC
 401 CGGGCCCGCG CACCAAAATC GCCAACGTCG GCGTCGCCAT CCTCGGCGAC
 451 ATCCTTTCAG ACGGCAACCT CGCCGAATAC TACCGCAACG CGCTGGAAAA
 501 CTGGCAGCAG CCGGTAGGCA GTGATTTCGA TCAGGACAGT TGGGAAAACA
 551 GCAAAACTTC CGTCCTCGGC GCGGTAACGC GCAAAGCCTA CCCGCTTGCC
 601 AAGCTCGGCA ACACCCGGGC GGCCGTCAAC CCCGATACCG CCACCGCCGA
 651 TTTGAACGTC GTCGTGGACA GCGGCCGCCC CATCGCCTTC GGCGACTTTG
 701 AAATTACCGG CACGCAGCGT TACCCCGAAC AAATCGTCTC CGGCTTGGCG
 751 CGCTTCCAAC CGGGCACGCC CTACGACCTC GACCTGCTGC TCGACTTCCA
 801 ACAGGCGCTC GAACAAAACG GGCATTATTC CGGCGCGTCC GTACAAGCCG
 851 ACTTCGACCG CCTCCAAGGC GACCGCGTCC CCGTCAAAGT CAGCGTAACC
 901 GAGGTCAAAC GCCACAAGCT CGAAACCGGC ATCCGCCTCG ATTCGGAATA
 951 CGGTTTGGGC GGCAAAATCG CCTACGACTA TTACAACCTC TTCAACAAAG
1001 GCTATATCGG TTCGGTCGTC TGGGATATGG ACAAATACGA AACCACGCTT
1051 GCCGCCGGCA TCAGCCAGCC GCGCAACTAT CGGGGCAACT ACTGGACAAG
1101 CAACGTTTCC TACAACCGTT CGACCACCCA AAACCTCGAA AAACGCGCCT
1151 TCTCCGGCGG CATCTGGTAT GTGCGCGACC GCGCGGGCAT CGATGCCAGG
1201 CTGGGGGCGG AGTTTCTCGC AGAAGGCCGG AAAATCCCCG GCTCGGATAT
1251 CGATTTGGGC AACAGCCACG CCACGATGCT GACCGCCTCT TGGAAACGCC
1301 AGCTGCTCAA CAACGTGCTG CATCCCGAAA ACGGCCATTA CCTCGACGGC
1351 AAAATCGGTA CGACTTTGGG CGCATTCCTG TCCTCCACCG CGCTGATCCG
1401 CACCTCTGCC CGCGCAGGTT ATTTCTTCAC GCCCGAAAAC AAAAAACTCG
1451 GCACGTTCAT CATACGCGGA CAAGCGGGTT ACACCGTTGC CCGCGACAAT
1501 GCCAACGTTC CTTCAGGGCT GATGTTCCGC AGCGGCGGCG CGTCTTCCGT
1551 GCGCGGTTAC GAACTCGACA GCATCGGGCT TGCCGGCCCG AACGGATCGG
1601 TCCTGCCCGA ACGCGCCCTC TTGGTGGGCA GCCTGGAATA CCAACTGCCG
1651 TTTACGCGCA CCCTTTCCGG CGCGGTGTTC CACGATATGG GCGACGCCGC
1701 CGCCAATTTC AAACGTATGA AGCTGAAACA CGGTTCGGGA CTGGGCGTGC
1751 GCTGGTTCAG CCCGCTCGCG CCGTTTTCCT TCGACATCGC CTACGGGCAC
1801 AGCGACAAGA AAATCCGCTG GCACATCAGC TTGGGAACGC GCTTCTAA
```

This corresponds to the amino acid sequence <SEQ ID 1198; ORF 286.a>:

```
a286.pep

1 MHDTRTMMIK PTALLLPALF FFPHAYAPAA DLSENKAAGF ALFKNKSPDT

51 ESVKLKPKFP VRIDTQDSEI KDMVEEHLPL ITQQQEEVLD KEQTGFLAEE

101 APDNVKTMLR SKGYFSSKVS LTEKDGAYTV HITPGPRTKI ANVGVAILGD

151 ILSDGNLAEY YRNALENWQQ PVGSDFDQDS WENSKTSVLG AVTRKAYPLA

201 KLGNTRAAVN PDTATADLNV VVDSGRPIAF GDFEITGTQR YPEQIVSGLA

251 RFQPGTPYDL DLLLDFQQAL EQNGHYSGAS VQADFDRLQG DRVPVKVSVT

301 EVKRHKLETG IRLDSEYGLG GKIAYDYYNL FNKGYIGSVV WDMDKYETTL

351 AAGISQPRNY RGNYWTSNVS YNRSTTQNLE KRAFSGGIWY VRDRAGIDAR

401 LGAEFLAEGR KIPGSDIDLG NSHATMLTAS WKRQLLNNVL HPENGHYLDG

451 KIGTTLGAFL SSTALIRTSA RAGYFFTPEN KKLGTFIIRG QAGYTVARDN

501 ANVPSGLMFR SGGASSVRGY ELDSIGLAGP NGSVLPERAL LVGSLEYQLP

551 FTRTLSGAVF HDMGDAAANF KRMKLKHGSG LGVRWFSPLA PFSFDIAYGH

601 SDKKIRWHIS LGTRF* m286/a286  98.7% identity in 615 aa overlap
                 10         20         30         40         50         60
m286.pep  MHDTRTMMIKPTALLLPALFFFPHAYAPAADLSENKAAGFALFKNKSPDTESVKLKPKFP
          ||||||||||||||||||||||||||||||||||||||||||||||||||||||||||||
a286      MHDTRTMMIKPTALLLPALFFFPHAYAPAADLSENKAAGFALFKNKSPDTESVKLKPKFP
                 10         20         30         40         50         60

70         80         90        100        110        120
m286.pep  VLIDTQDSEIKDMVEEHLPLITQQQEEVLDKEQTGFLAEEAPDNVKTMLRSKGYFSSKVS
          | |||||||||||||||||||||||||||||||||||||||||||||||||||||||||
a286      VRIDTQDSEIKDMVEEHLPLITQQQEEVLDKEQTGFLAEEAPDNVKTMLRSKGYFSSKVS
                 70         80         90        100        110        120

130        140        150        160        170        180
m286.pep  LTEKDGAYTVHITPGPRTKIANVGVAILGDILSDGNLAEYYRNALENWQQPVGSDFDQDS
          ||||||||||||||||||||||||||||||||||||||||||||||||||||||||||||
a286      LTEKDGAYTVHITPGPRTKIANVGVAILGDILSDGNLAEYYRNALENWQQPVGSDFDQDS
                130        140        150        160        170        180

190        200        210        220        230        240
m286.pep  WENSKTSVLGAVTRKAYPLAKLGNTRAAVNPDTATADLNVVVDSGRPIAFGDFEITGTQR
          ||||||||||||||||||||||||||||||||||||||||||||||||||||||||||||
a286      WENSKTSVLGAVTRKAYPLAKLGNTRAAVNPDTATADLNVVVDSGRPIAFGDFEITGTQR
                190        200        210        220        230        240

250        260        270        280        290        300
m286.pep  YPEQIVSGLARFQPGMPYDLDLLLDFQQALEQNGHYSGASVQADFDRLQGDRVPVKVSVT
          |||||||||||||||| |||||||||||||||||||||||||||||||||||||||||||
a286      YPEQIVSGLARFQPGTPYDLDLLLDFQQALEQNGHYSGASVQADFDRLQGDRVPVKVSVT
                250        260        270        280        290        300

310        320        330        340        350        360
m286.pep  EVKRHKLETGIRLDSEYGLGGKIAYDYYNLFNKGYIGSVVWDMDKYETTLAAGISQPRNY
          ||||||||||||||||||||||||||||||||||||||||||||||||||||||||||||
a286      EVKRHKLETGIRLDSEYGLGGKIAYDYYNLFNKGYIGSVVWDMDKYETTLAAGISQPRNY
                310        320        330        340        350        360

370        380        390        400        410        420
m286.pep  RGNYWTSNVSYNRSTTQNLEKRAFSGGVWYVRDRAGIDARLGAEFLAEGRKIPGSAVDLG
          |||||||||||||||||||||||||||:||||||||||||||||||||||||||:|||
a286      RGNYWTSNVSYNRSTTQNLEKRAFSGGIWYVRDRAGIDARLGAEFLAEGRKIPGSDIDLG
                370        380        390        400        410        420

430        440        450        460        470        480
m286.pep  NSHATMLTASWKRQLLNNVLHPENGHYLDGKIGTTLGTFLSSTALIRTSARAGYFFTPEN
          ||||||||||||||||||||||||||||||||||||:|||||||||||||||||||||||
a286      NSHATMLTASWKRQLLNNVLHPENGHYLDGKIGTTLGAFLSSTALIRTSARAGYFFTPEN
                430        440        450        460        470        480

490        500        510        520        530        540
m286.pep  KKLGTFIIRGQAGYTVARDNADVPSGLMFRSGGASSVRGYELDSIGLAGPNGSVLPERAL
          ||||||||||||||||||||||:|||||||||||||||||||||||||||||||||||||
a286      KKLGTFIIRGQAGYTVARDNANVPSGLMFRSGGASSVRGYELDSIGLAGPNGSVLPERAL
                490        500        510        520        530        540

550        560        570        580        590        600
m286.pep  LVGSLEYQLPFTRTLSGAVFHDMGDAAANFKRMKLKHGSGLGVRWFSPLAPFSFDIAYGH
          ||||||||||||||||||||||||||||||||||||||||||||||||||||||||||||
a286      LVGSLEYQLPFTRTLSGAVFHDMGDAAANFKRMKLKHGSGLGVRWFSPLAPFSFDIAYGH
                550        560        570        580        590        600
```

```
            610
m286.pep  SDKKIRWHISLGTRFX
          ||||||||||||||||
a286      SDKKIRWHISLGTRFX
            610
```

The following partial DNA sequence was identified in *N. gonorrhoeae* <SEQ ID 1199>:

```
g287.seq
    1 atgtttaaac gcagtgtgat tgcaatggct tgtattttc cctttcagc
   51 ctgtgggggc ggcggtggcg gatcgcccga tgtcaagtcg gcggacacgc
  101 cgtcaaaacc ggccgccccc gttgttgctg aaaatgccgg ggaaggggtg
  151 ctgccgaaag aaaagaaaga tgaggaggca gcgggcggtg cgccgcaagc
  201 cgatacgcag gacgcaaccg ccggagaagg cagccaagat atggcggcag
  251 tttcggcaga aaatacaggc aatggcggtg cggcaacaac ggacaacccc
  301 aaaaatgaag acgcgggggc gcaaaatgat atgccgcaaa atgccgccga
  351 atccgcaaat caaacaggga acaaccaacc cgccggttct tcagattccg
  401 cccccgcgtc aaaccctgcc cctgcgaatg gcggtagcga ttttggaagg
  451 acgaacgtgg gcaattctgt tgtgattgac ggaccgtcgc aaaatataac
  501 gttgacccac tgtaaaggcg attcttgtaa tggtgataat ttattggatg
  551 aagaagcacc gtcaaaatca gaatttgaaa aattaagtga tgaagaaaa
  601 attaagcgat ataaaaaaga cgagcaacgg gagaattttg tcggtttggt
  651 tgctgacagg gtaaaaaagg atggaactaa caaatatatc atcttctata
  701 cggacaaacc acctactcgt tctgcacggt cgaggaggtc gcttccggcc
  751 gagattccgc tgattcccgt caatcaggcc gatacgctga ttgtggatgg
  801 ggaagcggtc agcctgacgg ggcattccgg caatatcttc gcgcccgaag
  851 ggaattaccg gtatctgact tacgggcgg aaaaattgcc cggcggatcg
  901 tatgccctcc gtgtgcaagg cgaaccggca aaaggcgaaa tgcttgttgg
  951 cacggccgtg tacaacggcg aagtgctgca tttccatatg gaaaacggcc
 1001 gtccgtaccc gtccggaggc aggtttgccg caaaagtcga tttcggcagc
 1051 aaatctgtgg acggcattat cgacagcggc gatgatttgc atatgggtac
 1101 gcaaaaattc aaagccgcca tcgatggaaa cggctttaag gggacttgga
 1151 cggaaaatgg cggcggggat gtttccggaa ggttttacgg cccggccggc
 1201 gaggaagtgg cgggaaaata cagctatcgc ccgacagatg ctgaaaaggg
 1251 cggattcggc gtgtttgccg gcaaaaaaga tcgggattga
```

This corresponds to the amino acid sequence <SEQ ID 1200; ORF 287.ng>:

```
g287.pep
    1 MFKRSVIAMA CIFPLSACGG GGGGSPDVKS ADTPSKPAAP VVAENAGEGV
   51 LPKEKKDEEA AGGAPQADTQ DATAGEGSQD MAAVSAENTG NGGAATTDNP
  101 KNEDAGAQND MPQNAAESAN QTGNNQPAGS SDSAPASNPA PANGGSDFGR
  151 TNVGNSVVID GPSQNITLTH CKGDSCNGDN LLDEEAPSKS EFEKLSDEEK
  201 IKRYKKDEQR ENFVGLVADR VKKDGTNKYI IFYTDKPPTR SARSRRSLPA
```

-continued

```
251 EIPLIPVNQA DTLIVDGEAV SLTGHSGNIF APEGNYRYLT YGAEKLPGGS

301 YALRVQGEPA KGEMLVGTAV YNGEVLHFHM ENGRPYPSGG RFAAKVDFGS

351 KSVDGIIDSG DDLHMGTQKF KAAIDGNGFK GTWTENGGGD VSGRFYGPAG

401 EEVAGKYSYR PTDAEKGGFG VFAGKKDRD*
```

The following partial DNA sequence was identified in *N. meningitidis* <SEQ ID 1201>:

```
m287.seq.
   1 ATGTTTAAAC GCAGCGTAAT CGCAATGGCT TGTATTTTTG CCCTTTCAGC

51 CTGCGGGGGC GGCGGTGGCG GATCGCCCGA TGTCAAGTCG GCGGACACGC

101 TGTCAAAACC TGCCGCCCCT GTTGTTTCTG AAAAAGAGAC AGAGGCAAAG

151 GAAGATGCGC CACAGGCAGG TTCTCAAGGA CAGGGCGCGC CATCCGCACA

201 AGGCAGTCAA GATATGGCGG CGGTTTCGGA AGAAAATACA GGCAATGGCG

251 GTGCGGTAAC AGCGGATAAT CCCAAAAATG AAGACGAGGT GGCACAAAAT

301 GATATGCCGC AAAATGCCGC CGGTACAGAT AGTTCGACAC CGAATCACAC

351 CCCGGATCCG AATATGCTTG CCGGAAATAT GGAAAATCAA GCAACGGATG

401 CCGGGGAATC GTCTCAGCCG GCAAACCAAC CGGATATGGC AAATGCGGCG

451 GACGGAATGC AGGGGGACGA TCCGTCGGCA GGCGGGCAAA ATGCCGGCAA

501 TACGGCTGCC CAAGGTGCAA ATCAAGCCGG AAACAATCAA GCCGCCGGTT

551 CTTCAGATCC CATCCCCGCG TCAAACCCTG CACCTGCGAA TGGCGGTAGC

601 AATTTTGGAA GGGTTGATTT GGCTAATGGC GTTTTGATTG ACGGGCCGTC

651 GCAAAATATA ACGTTGACCC ACTGTAAAGG CGATTCTTGT AGTGGCAATA

701 ATTTCTTGGA TGAAGAAGTA CAGCTAAAAT CAGAATTTGA AAAATTAAGT

751 GATGCAGACA AAATAAGTAA TTACAAGAAA GATGGGAAGA ATGATAAATT

801 TGTCGGTTTG GTTGCCGATA GTGTGCAGAT GAAGGGAATC AATCAATATA

851 TTATCTTTTA TAAACCTAAA CCCACTTCAT TTGCGCGATT TAGGCGTTCT

901 GCACGGTCGA GGCGGTCGCT TCCGGCCGAG ATGCCGCTGA TTCCCGTCAA

951 TCAGGCGGAT ACGCTGATTG TCGATGGGGA AGCGGTCAGC CTGACGGGGC

1001 ATTCCGGCAA TATCTTCGCG CCCGAAGGGA ATTACCGGTA TCTGACTTAC

1051 GGGGCGGAAA AATTGCCCGG CGGATCGTAT GCCCTTCGTG TTCAAGGCGA

1101 ACCGGCAAAA GGCGAAATGC TTGCGGGCGC GGCCGTGTAC AACGGCGAAG

1151 TACTGCATTT CCATACGGAA AACGGCCGTC CGTACCCGAC CAGGGGCAGG

1201 TTTGCCGCAA AAGTCGATTT CGGCAGCAAA TCTGTGGACG GCATTATCGA

1251 CAGCGGCGAT GATTTGCATA TGGGTACGCA AAAATTCAAA GCCGCCATCG

1301 ATGGAAACGG CTTTAAGGGG ACTTGGACGG AAAATGGCAG CGGGGATGTT

1351 TCCGGAAAGT TTTACGGCCC GGCCGGCGAG GAAGTGGCGG GAAAATACAG

1401 CTATCGCCCG ACAGATGCGG AAAAGGGCGG ATTCGGCGTG TTTGCCGGCA

1451 AAAAAGAGCA GGATTGA
```

This corresponds to the amino acid sequence <SEQ ID 1202; ORF 287>:

```
m287.pep
  1 MFKRSVIAMA CIFALSACGG GGGGSPDVKS ADTLSKPAAP VVSEKETEAK

51 EDAPQAGSQG QGAPSAQGSQ DMAAVSEENT GNGGAVTADN PKNEDEVAQN

101 DMPQNAAGTD SSTPNHTPDP NMLAGNMENQ ATDAGESSQP ANQPDMANAA

151 DGMQGDDPSA GGQNAGNTAA QGANQAGNNQ AAGSSDPIPA SNPAPANGGS

201 NFGRVDLANG VLIDGPSQNI TLTHCKGDSC SGNNFLDEEV QLKSEFEKLS

251 DADKISNYKK DGKNDKFVGL VADSVQMKGI NQYIIFYKPK PTSFARFRRS

301 ARSRRSLPAE MPLIPVNQAD TLIVDGEAVS LTGHSGNIFA PEGNYRYLTY

351 GAEKLPGGSY ALRVQGEPAK GEMLAGAAVY NGEVLHFHTE NGRPYPTRGR

401 FAAKVDFGSK SVDGIIDSGD DLHMGTQKFK AAIDGNGFKG TWTENGSGDV

451 SGKFYGPAGE EVAGKYSYRP TDAEKGGFGV FAGKKEQD*
```

Computer analysis of this amino acid sequence gave the following results:
Homology with a Predicted ORF from *N. gonorrhoeae*

```
    m287/g287   70.1% identity in 499 aa overlap 10        20        30        40              49
    m287.pep    MFKRSVIAMACIFALSACGGGGGGSPDVKSADTLSKPAAPVVSE----------KETEA
                ||||||||||||  |||||||||||||||||||||||||| ||||||:|       |: ||
    g287        MFKRSVIAMACIFPLSACGGGGGGSPDVKSADTPSKPAAPVVAENAGEGVLPKEKKDEEA
                    10        20        30        40        50        60

50        60        70        80        90       100       109
    m287.pep    KEDAPQAGSQGQGAPSAQGSQDMAAVSEENTGNGGAVTADNPKNEDEVAQNDMPQNAAGT
                |||| :|    |  :::||||||||||  ||||||||:|:||||||||    ||||||||
    g287        AGGAPQADTQD--ATAGEGSQDMAAVSAENTGNGGAATTDNPKNEDAGAQNDMPQNAA--
                    70        80        90       100       110

110       120       130       140       150       160       169
    m287.pep    DSSTPNHTPDPNMLAGNMENQATDAGESSQPANQPDMANAADGMQGDDPSAGGQNAGNTA
    g287        ------------------------------------------------------------

170       180       190       200       210       220       229
    m287.pep    AQGANQAGNNQAAGSSDPIPASNPAPANGGSNFGRVDLANGVLIDGPSQNITLTHCKGDS
                ::|||:||||  ||||| ||||||||||||||:|||:::::|:|:|||||||||||||||
    g287        -ESANQTGNNQPAGSSDSAPASNPAPANGGSDFGRTNVGNSVVIDGPSQNITLTHCKGDS
                   120       130       140       150       160       170

230       240       250       260       270       280       289
    m287.pep    CSGNNFLDEEVQLKSEFEKLSDADKISNYKKDGKNDKFVGLVADSVQMKGINQYIIFYKP
                |:|:|:|||| : ||||||||| :||: ||||   : ::|||||||| |: | |:|||||
    g287        CNGDNLLDEEAPSKSEFEKLSDEEKIKRYKKDEQRENFVGLVADRVKKDGTNKYIIFYTD
                   180       190       200       210       220       230

290       300       310       320       330       340       349
    m287.pep    KPTSFARFRRSARSRRSLPAEMPLIPVNQADTLIVDGEAVSLTGHSGNIFAPEGNYRYLT
                || :     ||||||||||||:|||||||||||||||||||||||||||||||||||||
    g287        KPPT-----RSARSRRSLPAEIPLIPVNQADTLIVDGEAVSLTGHSGNIFAPEGNYRYLT
                             240       250       260       270       280       290

350       360       370       380       390       400       409
    m287.pep    YGAEKLPGGSYALRVQGEPAKGEMLAGAAVYNGEVLHFHTENGRPYPTRGRFAAKVDFGS
                ||||||||||||||||||||||||| |:|||||||||||:|||||| ||||||||||||
    g287        YGAEKLPGGSYALRVQGEPAKGEMLVGTAVYNGEVLHFHMENGRPYPSGGRFAAKVDFGS
                       300       310       320       330       340       350

410       420       430       440       450       460       469
    m287.pep    KSVDGIIDSGDDLHMGTQKFKAAIDGNGFKGTWTENGSGDVSGKFYGPAGEEVAGKYSYR
                |||||||||||||||||||||||||||||||||||||:|||||:||||||||||||||||
    g287        KSVDGIIDSGDDLHMGTQKFKAAIDGNGFKGTWTENGGGDVSGRFYGPAGEEVAGKYSYR
                       360       370       380       390       400       410
```

-continued

```
                470       480       489
m287.pep      PTDAEKGGFGVFAGKKEQDX
              ||||||||||||||||::||
g287          PTDAEKGGFGVFAGKKDRDX
                        420        430
```

The following partial DNA sequence was identified in *N. meningitidis* <SEQ ID 1203>:

```
a287.seq
   1 ATGTTTAAAC GCAGTGTGAT TGCAATGGCT TGTATTGTTG CCCTTTCAGC
  51 CTGTGGGGGC GGCGGTGGCG GATCGCCCGA TGTTAAGTCG GCGGACACGC
 101 TGTCAAAACC TGCCGCCCCT GTTGTTACTG AAGATGTCGG GGAAGAGGTG
 151 CTGCCGAAAG AAAAGAAAGA TGAGGAGGCG GTGAGTGGTG CGCCGCAAGC
 201 CGATACGCAG GACGCAACCG CCGGAAAAGG CGGTCAAGAT ATGGCGGCAG
 251 TTTCGGCAGA AAATACAGGC AATGGCGGTG CGGCAACAAC GGATAATCCC
 301 GAAAATAAAG ACGAGGGACC GCAAAATGAT ATGCCGCAAA ATGCCGCCGA
 351 TACAGATAGT TCGACACCGA ATCACACCCC TGCACCGAAT ATGCCAACCA
 401 GAGATATGGG AAACCAAGCA CCGGATGCCG GGGAATCGGC ACAACCGGCA
 451 AACCAACCGG ATATGGCAAA TGCGGCGGAC GGAATGCAGG GGGACGATCC
 501 GTCGGCAGGG GAAAATGCCG GCAATACGGC AGATCAAGCT GCAAATCAAG
 551 CTGAAAACAA TCAAGTCGGC GGCTCTCAAA ATCCTGCCTC TTCAACCAAT
 601 CCTAACGCCA CGAATGGCGG CAGCGATTTT GGAAGGATAA ATGTAGCTAA
 651 TGGCATCAAG CTTGACAGCG GTTCGGAAAA TGTAACGTTG ACACATTGTA
 701 AAGACAAAGT ATGCGATAGA GATTTCTTAG ATGAAGAAGC ACCACCAAAA
 751 TCAGAATTTG AAAAATTAAG TGATGAAGAA AAAATTAATA AATATAAAAA
 801 AGACGAGCAA CGAGAGAATT TTGTCGGTTT GGTTGCTGAC AGGGTAGAAA
 851 AGAATGGAAC TAACAAATAT GTCATCATTT ATAAAGACAA GTCCGCTTCA
 901 TCTTCATCTG CGCGATTCAG GCGTTCTGCA CGGTCGAGGC GGTCGCTTCC
 951 GGCCGAGATG CCGCTGATTC CCGTCAATCA GGCGGATACG CTGATTGTCG
1001 ATGGGGAAGC GGTCAGCCTG ACGGGGCATT CCGGCAATAT CTTCGCGCCC
1051 GAAGGGAATT ACCGGTATCT GACTTACGGG GCGGAAAAAT TGTCCGGCGG
1101 ATCGTATGCC CTCAGTGTGC AAGGCGAACC GGCAAAAGGC GAAATGCTTG
1151 CGGGCACGGC CGTGTACAAC GGCGAAGTGC TGCATTTCCA TATGGAAAAC
1201 GGCCGTCCGT CCCCGTCCGG AGGCAGGTTT GCCGCAAAAG TCGATTTCGG
1251 CAGCAAATCT GTGGACGGCA TTATCGACAG CGGCGATGAT TTGCATATGG
1301 GTACGCAAAA ATTCAAAGCC GTTATCGATG GAAACGGCTT TAAGGGGACT
1351 TGGACGGAAA ATGGCGGCGG GGATGTTTCC GGAAGGTTTT ACGGCCCGGC
1401 CGGCGAAGAA GTGGCGGGAA AATACAGCTA TCGCCCGACA GATGCGGAAA
1451 AGGGCGGATT CGGCGTGTTT GCCGGCAAAA AAGAGCAGGA TTGA
```

This corresponds to the amino acid sequence <SEQ ID 1204; ORF 287.a>:

```
a287.pep

1  MFKRSVIAMA CIVALSACGG GGGGSPDVKS ADTLSKPAAP VVTEDVGEEV
       51  LPKEKKDEEA VSGAPQADTQ DATAGKGGQD MAAVSAENTG NGGAATTDNP
      101  ENKDEGPQND MPQNAADTDS STPNHTPAPN MPTRDMGNQA PDAGESAQPA
      151  NQPDMANAAD GMQGDDPSAG ENAGNTADQA ANQAENNQVG GSQNPASSTN
      201  PNATNGGSDF GRINVANGIK LDSGSENVTL THCKDKVCDR DFLDEEAPPK
      251  SEFEKLSDEE KINKYKKDEQ RENFVGLVAD RVEKNGTNKY VIIYKDKSAS
      301  SSSARFRRSA RSRRSLPAEM PLIPVNQADT LIVDGEAVSL TGHSGNIFAP
      351  EGNYRYLTYG AEKLSGGSYA LSVQGEPAKG EMLAGTAVYN GEVLHFHMEN
      401  GRPSPSGGRF AAKVDFGSKS VDGIIDSGDD LHMGTQKFKA VIDGNGFKGT
      451  WTENGGGDVS GRFYGPAGEE VAGKYSYRPT DAEKGGFGVF AGKKEQD* m287/a287  77.2% identity in 501 aa overlap 10         20         30         40             49
m287.pep   MFKRSVIAMACIFALSACGGGGGGSPDVKSADTLSKPAAPVVSE----------KETEA
           ||||||||||| |||||||||||||||||||||||||||||||:|          |: ||
a287       MFKRSVIAMACIVALSACGGGGGGSPDVKSADTLSKPAAPVVTEDVGEEVLPKEKKDEEA
                    10         20         30         40         50         60

50         60         70         80         90        100       109
m287.pep   KEDAPQAGSQGQGAPSAQGSQDMAAVSEENTGNGGAVTADNPKNEDEVAQNDMPQNAAGT
           ||||  :|     |  : ::|:||||||| |||||||:|:|||:|:|  |||||||||| |
a287       VSGAPQADTQ--DATAGKGGQDMAAVSAENTGNGGAATTDNPENKDEGPQNDMPQNAADT
                    70         80         90        100        110

110        120        130        140        150        160       169
m287.pep   DSSTPNHTPDPNMLAGNMENQATDAGESSQPANQPDMANAADGMQGDDPSAGGQNAGNTA
           |||||||||  ||| : :| ||| |||||:|||||||||||||||||||||||| :|||||
a287       DSSTPNHTPAPNMPTRDMGNQAPDAGESAQPANQPDMANAADGMQGDDPSAG-ENAGNTA
                    120        130        140        150        160        170

170        180        190        200        210        220       229
m287.pep   AQGANQAGNNQAAGSSDPIPASNPAPANGGSNFGRVDLANGVLIDGPSQNITLTHCKGDS
            |:||||  |||::||::|   ::||   :||||:|||:::|||:   :|:   |:|:||||||
a287       DQAANQAENNQVGGSQNPASSTNPNATNGGSDFGRINVANGIKLDSGSENVTLTHCKDKV
                    180        190        200        210        220        230

230        240        250        260        270        280       289
m287.pep   CSGNNFLDEEVQLKSEFEKLSDADKISNYKKDGKNDKFVGLVADSVQMKGINQYIIFYKP
           |:   :|||||  ||||||||||:  ||::::| |:   : ::|||||||||||| :| |   :|:|
a287       CD-RDFLDEEAPPKSEFEKLSDEEKINKYKKDEQRENFVGLVADRVEKNGTNKYVIIYKD
                    240        250        260        270        280        290

290        300        310        320        330        340
m287.pep   KP--TSFARFRRSARSRRSLPAEMPLIPVNQADTLIVDGEAVSLTGHSGNIFAPEGNYRY
           ||   :|||||  ||||||||||||||||||||:|||||||||||| :||||||||||||| |:|:|:||
a287       KSASSSSARFRRSARSRRSLPAEMPLIPVNQADTLIVDGEAVSLTGHSGNIFAPEGNYRY
                    300        310        320        330        340        350

350        360        370        380        390        400
m287.pep   LTYGAEKLPGGSYALRVQGEPAKGEMLAGAAVYNGEVLHFHTENGRPYPTRGRFAAKVDF
           |||||||  ||||||  |||||||||||||||||: |||||||||||||  ||||| |:  |||||||||||
a287       LTYGAEKLSGGSYALSVQGEPAKGEMLAGTAVYNGEVLHFHMENGRPSPSGGRFAAKVDF
                    360        370        380        390        400        410

410        420        430        440        450        460
m287.pep   GSKSVDGIIDSGDDLHMGTQKFKAAIDGNGFKGTWTENGGDVSGKFYGPAGEEVAGKYS
           |||||||||||||||||||||||||:|||||||||||||||| :|||||: ||||||||||||||||
a287       GSKSVDGIIDSGDDLHMGTQKFKAVIDGNGFKGTWTENGGGDVSGRFYGPAGEEVAGKYS
                    420        430        440        450        460        470

470        480        489
m287.pep   YRPTDAEKGGFGVFAGKKEQDX
           ||||||||||||||||||||||
a287       YRPTDAEKGGFGVFAGKKEQDX
                    480        490
```

The following partial DNA sequence was identified in *N. gonorrhoeae* <SEQ ID 1205>:

```
g288.seq
    1 atgcacaccg gacaggcggt aagccgggtt ctgtctcgga cagtcattcc 51 tctaggcata ccgttgccgg tatgctcaag caacctaccc gaacgctcgg
```

-continued

```
101 cgggcagcgt cattgcgttc tgtttggtct tgctccgaat ggggtttggc 151 ctgccgcata ttgttaccaa atgcgcggtg cgcccttacc gcaccttttc 201 acccttgcct gtgctgccaa agcagccatc ggcggttttg ctttctgttc 251 cactttccgt cgcgttaccg cgcccggccg ttaaccggca ttctaccctg 301 cggagcccgg actttcctcc ccgtatgcct tacgcgatac gcggcgactg 351 tctgcccgtc ccgtgtgcgg cgcggattat aacacgaaac gcaaaaatgc 401 cgtctgaaac ggtacaggtt tcagacggca tacagcctaa actacacacc 451 ctgtttcagg ctggcttcga tgaagccgtc caagtcgccg tccaatacgg 501 ctttgtggtt gccgacttcg tagcctgtac gcaagtcttt gatgcgtga
```

This corresponds to the amino acid sequence <SEQ ID 1206; ORF 288.ng>:

```
g288.pep
  1 MHTGQAVSRV LSRTVIPLGI PLPVCSSNLP ERSAGSVIAF CLVLLRMGFG

51 LPHIVTKCAV RPYRTFSPLP VLPKQPSAVL LSVPLSVALP RPAVNRHSTL

101 RSPDFPPRMP YAIRGDCLPV PCAARIITRN AKMPSETVQV SDGIQPKLHT

151 LFQAGFDEAV QVAVQYGFVV ADFVACTQVF DA*
```

The following partial DNA sequence was identified in *N. meningitidis* <SEQ ID 1207>:

```
m288.seq
  1 ATGCACACCG GACAGGCGGT AAGCCGGGTT CTGTCTCGGA CAGTCATTCC

51 TCTAGGCATA CCGTTACCGG TATGCTCAAG CAACCTACCC GAACGCTCGG

101 CGGGCAGCGT CATTGCGTTC TGTTTGGTCT TGCTCCGAAT GGGGTTTGGC

151 CTGCCGCATA TTGTTACCAA ATGCGCGGTG CGCCCTTACC GCACCTTTTC

201 ACCCTTACCT GTGCTGCCAA AGCAGCCATC GGCGGTTTTG CTTTCTGTTC

251 CACTTTCCGT CGCGTTACCG CGCCCGGCCG TTAACCGGCA TTCTACCCTG

301 CGGAGCCCGG ACTTTCCTCC CCGTATGCCT TACGCGATAC GCGGCGACTG

351 TCTGCCCGTC CCGTGTGCGG CGCGGATTAT AACACGAAAC ACAAAAATGC

401 CGTCTGAAAC GGTACAGGTT TCAGACGGCA TACAGCCTAA ACTACACGCC

451 CTGTTTCAGG CTGGCTTCGA TGAAGCCGTC CAAGTCGCCA TCCAATACGG

501 CTTTGGTGTT GCCGACTTCG TAGCCTGTAC GCAAGTCTTT GATACGTGA
```

This corresponds to the amino acid sequence <SEQ ID 1208; ORF 288>:

```
m288.pep
  1 MHTGQAVSRV LSRTVIPLGI PLPVCSSNLP ERSAGSVIAF CLVLLRMGFG

51 LPHIVTKCAV RPYRTFSPLP VLPKQPSAVL LSVPLSVALP RPAVNRHSTL

101 RSPDFPPRMP YAIRGDCLPV PCAARIITRN TKMPSETVQV SDGIQPKLHA

151 LFQAGFDEAV QVAIQYGFGV ADFVACTQVF DT*
```

Computer analysis of this amino acid sequence gave the following results:
Homology with a Predicted ORF from *N. gonorrhoeae*

```
    m288/g288   97.8% identity in 181 aa overlap 10        20        30        40        50        60
    m288.pep   MHTGQAVSRVLSRTVIPLGIPLPVCSSNLPERSAGSVIAFCLVLLRMGFGLPHIVTKCAV
               ||||||||||||||||||||||||||||||||||||||||||||||||||||||||||||
    g288       MHTGQAVSRVLSRTVIPLGIPLPVCSSNLPERSAGSVIAFCLVLLRMGFGLPHIVTKCAV
                     10        20        30        40        50        60

70        80        90       100       110       120
    m288.pep   RPYRTFSPLPVLPKQPSAVLLSVPLSVALPRPAVNRHSTLRSPDFPPRMPYAIRGDCLPV
               ||||||||||||||||||||||||||||||||||||||||||||||||||||||||||||
    g288       RPYRTFSPLPVLPKQPSAVLLSVPLSVALPRPAVNRHSTLRSPDFPPRMPYAIRGDCLPV
                     70        80        90       100       110       120

130       140       150       160       170       180
    m288.pep   PCAARIITRNTKMPSETVQVSDGIQPKLHALFQAGFDEAVQVAIQYGFGVADFVACTQVF
               |||||||||:||||||||||||||||||:|||||||||||||:||| ||||||||||||
    g288       PCAARIITRNAKMPSETVQVSDGIQPKLHTLFQAGFDEAVQVAVQYGFVVADFVACTQVF
                    130       140       150       160       170       180 m288.pep   DTX
               |:|
    g288       DAX
                                                           25
```

The following partial DNA sequence was identified in *N. meningitidis* <SEQ ID 1209>:

```
a288.seq
    1 ATGCACACCG GACAGGCGGT AAGCCGGGTT CTGTCTCGGA CAGTCATTCC

51 TCTAGGCATA CCGTTGCCGG TATGCTCAAG CAACCTACCC GAACGCTCGG

101 CGGGCAGCGT CATTGCGTTC TGTTTGGTCT TGCTCCGAAT GGGGTTTGGC

151 CTGCCGCATA TTGTTACCAA ATGCGCGGTG CGCCCTTACC GCACCTTTTC

201 ACCCTTGCCT GTGCTGCCAA AGCAGCCATC GGCGGTTTTG CTTTCTGTTC

251 CACTTTCCGT CGCGTTACCG CGCCCGGCCG TTAACCGGCA TTCTACCCTG

301 CGGAGCCCGG ACTTTCCTCC CCGTATGCCT TACGCGATAC GCGGCGACTG

351 TCTGCCCGTC CCGTGTGCGG CGCGGATTAT AACACGAAAC GCAAAAATGC

401 CGTCTGAAAC GGTACAGGTT TCAGACGGCA TACAGCCTAA ACTACACGCC

451 CTGTTTCAGG CTGGCTTCGA TAAAGCCGTC CAAGTCGCCG TCCAATACGG

501 CTTTGGTGTT GCCGACTTCG TAGCCTGTGC GCAAGTCTTT AATGCGTGA
```

This corresponds to the amino acid sequence <SEQ ID 1210; ORF 288.a>:

```
a288.pep

1  MHTGQAVSRV LSRTVIPLGI PLPVCSSNLP ERSAGSVIAF CLVLLRMGFG

51  LPHIVTKCAV RPYRTFSPLP VLPKQPSAVL LSVPLSVALP RPAVNRHSTL

101  RSPDFPPRMP YAIRGDCLPV PCAARIITRN AKMPSETVQV SDGIQPKLHA

151  LFQAGFDKAV QVAVQYGFGV ADFVACAQVF NA* m288/a288   97.2% identity in 181 aa overlap 10        20        30        40        50        60
    m288.pep   MHTGQAVSRVLSRTVIPLGIPLPVCSSNLPERSAGSVIAFCLVLLRMGFGLPHIVTKCAV
               ||||||||||||||||||||||||||||||||||||||||||||||||||||||||||||
    a288       MHTGQAVSRVLSRTVIPLGIPLPVCSSNLPERSAGSVIAFCLVLLRMGFGLPHIVTKCAV
                     10        20        30        40        50        60
```

```
              70         80         90        100        110        120
m288.pep  RPYRTFSPLPVLPKQPSAVLLSVPLSVALPRPAVNRHSTLRSPDFPPRMPYAIRGDCLPV
          ||||||||||||||||||||||||||||||||||||||||||||||||||||||||||||
a288      RRYRTFSPLPVLPKQPSAVLLSVPLSVALPRPAVNRHSTLRSPDFPPRMPYAIRGDCLPV
              70         80         90        100        110        120

130        140        150        160        170        180
m288.pep  PCAARIITRNTKMPSETVQVSDGIQPKLHALFQAGFDEAVQVAIQYGFGVADFVACTQVF
          ||||||||||:|||||||||||||||||||||||||||:|||||:||||||||||||:|||
a288      PCAARIITRNAKMPSETVQVSDGIQPKLHALFQAGFDKAVQVAVQYGFGVADFVACAQVF
             130        140        150        160        170        180 m288.pep  DTX
          ::
a288      NAX
```

15

The following partial DNA sequence was identified in *N. gonorrhoeae* <SEQ ID 1211>:

```
g290.seq
    1 atggcaaaaa tgatgaaatg gcggctgtt gcggcggtcg cggcggcagc
   51 ggtttggggc ggatggtctt atctgaagcc cgaaccgcag gctgcttata
  101 ttacggaagc ggtcaggcgc ggcgatatca gccggacggt ttccgcgacg
  151 ggcgagattt cgccgtccaa cctggtatcg gtcggcgcgc aggcttcggg
  201 gcagattaaa aagctttatg tcaaactcgg gcaacaggtc aaaaagggcg
  251 atttgattgc ggaaatcaat tcgaccacgc agaccaacac gatcgatatg
  301 gaaaaatcca aattggaaac gtatcaggcg aagctggtgt ccgcacagat
  351 tgcattgggc agcgcggaaa aaaatataa gcgtcaggcg gcgttgtgga
  401 aggatgatgc gacctctaaa gaagatttgg aaagcgcgca ggatgcgctt
  451 gccgccgcca agccaatgt tgccgagttg aaggctttaa tcagacagag
  501 caaaatttcc atcaataccg ccgagtcgga tttgggctac acgcgcatta
  551 ccgcgacgat ggacggcacg gtggtggcga ttcccgtgga agaggggcag
  601 actgtgaacg cggcgcagtc tacgccgacg attgtccaat tggcgaatct
  651 ggatatgatg ttgaacaaaa tgcagattgc cgagggcgat attaccaagg
  701 tgaaggcggg gcaggatatt tcgtttacga ttttgtccga accggatacg
  751 ccgattaagg cgaagctcga cagcgtcgac cccgggctga ccacgatgtc
  801 gtcgggcggc tacaacagca gtacggatac ggcttccaat gcggtctatt
  851 attatgcccg ttcgtttgtg ccgaatccgg acggcaaact cgccacgggg
  901 atgacgacgc agaatacggt tgaaatcgac ggtgtgaaaa atgtgttgct
  951 tattccgtcg ctgaccgtga aaaatcgcgg cggcaaggcg ttcgtacgcg
 1001 tgttgggtgc ggacggcaag gcagtggaac gcgaaatccg gaccggtatg
 1051 aaagacagta tgaataccga agtgaaaagc gggttgaaag aggggggacaa
 1101 agtggtcatc tccgaaataa ccgccgccga gcagcaggaa agcggcgaac
 1151 gcgccctagg cggcccgccg cgccgataa
```

This corresponds to the amino acid sequence <SEQ ID 1212; ORF 290.ng>:

```
g290.pep
    1 MAKMMKWAAV AAVAAAAVWG GWSYLKPEPQ AAYITEAVRR GDISRTVSAT
   51 GEISPSNLVS VGAQASGQIK KLYVKLGQQV KKGDLIAEIN STTQTNTIDM
```

-continued

```
101 EKSKLETYQA KLVSAQIALG SAEKKYKRQA ALWKDDATSK EDLESAQDAL

151 AAAKANVAEL KALIRQSKIS INTAESDLGY TRITATMDGT VVAIPVEEGQ

201 TVNAAQSTPT IVQLANLDMM LNKMQIAEGD ITKVKAGQDI SFTILSEPDT

251 PIKAKLDSVD PGLTTMSSGG YNSSTDTASN AVYYYARSFV PNPDGKLATG

301 MTTQNTVEID GVKNVLLIPS LTVKNRGGKA FVRVLGADGK AVEREIRTGM

351 KDSMNTEVKS GLKEGDKVVI SEITAAEQQE SGERALGGPP RR*
```

The following partial DNA sequence was identified in *N. meningitidis* <SEQ ID 1213>:

```
m290.seq (partial)
   1 ..GTATCGGTCG GCGCGCAGGC ATCGGGGCAG ATTAAGATAC TTTATGTCAA

51   ACTCGGGCAA CAGGTTAAAA AGGGCGATTT GATTGCGGAA ATCAATTCGA

101   CCTCGCAGAC CAATACGCTC AATACGGAAA AATCCAAGTT GGAAACGTAT

151   CAGGCGAAGC TGGTGTCGGC ACAGATTGCA TTGGGCAGCG CGGAGAAGAA

201   ATATAAGCGT CAGGCGGCGT TATGGAAGGA AAACGCGACT TCCAAAGAGG

251   ATTTGGAAAG CGCGCAGGAT GCGTTTGCCG CCGCCAAAGC CAATGTTGCC

301   GAGCTGAAGG CTTTAATCAG ACAGAGCAAA ATTTCCATCA ATACCGCCGA

351   GTCGGAATTG GGCTACACGC GCATTACCGC AACGATGGAC GGCACGGTGG

401   TGGCGATTCT CGTGGAAGAG GGGCAGACTG TGAACGCGGC GCAGTCTACG

451   CCGACGATTG TCCAATTGGC GAATCTGGAT ATGATGTTGA ACAAAATGCA

501   GATTGCCGAG GGCGATATTA CCAAGGTGAA GGCGGGGCAG GATATTTCGT

551   TTACGATTTT GTCCGAACCG GATACGCCGA TTAAGGCGAA GCTCGACAGC

601   GTCGACCCCG GGCTGACCAC GATGTCGTCG GGCGGTTACA ACAGCAGTAC

651   GGATACGGCT TCCAATGCGG TCTACTATTA TGCCCGTTCG TTTGTGCCGA

701   ATCCGGACGG CAAACTCGCC ACGGGGATGA CGACGCAGAA TACGGTTGAA

751   ATCGACGGCG TGAAAAATGT GCTGATTATT CCGTCGCTGA CCGTGAAAAA

801   TCGCGGCGGC AAGGCGTTTG TGCGCGTGTT GGGTGCGGAC GGCAAGGCGG

851   CGGAACGCGA AATCCGGACC GGTATGAGAG ACAGTATGAA TACCGAAGTA

901   AAAAGCGGGT TGAAAGAGGG GGACAAAGTG GTCATCTCCG AAATAACCGC

951   CGCCGAGCAA CAGGAAAGCG GCGAACGCGC CCTAGGCGGC CCGCCGCGCC

1001   GATAA
```

This corresponds to the amino acid sequence <SEQ ID 1214; ORF 290>:

```
m290.pep (partial)
   1 ..VSVGAQASGQ IKILYVKLGQ QVKKGDLIAE INSTSQTNTL NTEKSKLETY

51   QAKLVSAQIA LGSAEKKYKR QAALWKENAT SKEDLESAQD AFAAAKANVA

101   ELKALIRQSK ISINTAESEL GYTRITATMD GTVVAILVEE GQTVNAAQST

151   PTIVQLANLD MMLNKMQIAE GDITKVKAGQ DISFTILSEP DTPIKAKLDS

201   VDPGLTTMSS GGYNSSTDTA SNAVYYYARS FVPNPDGKLA TGMTTQNTVE

251   IDGVKNVLII PSLTVKNRGG KAFVRVLGAD GKAAEREIRT GMRDSMNTEV

301   KSGLKEGDKV VISEITAAEQ QESGERALGG PPRR*
```

Computer analysis of this amino acid sequence gave the following results:
Homology with a Predicted ORF from *N. gonorrhoeae*

```
    m290/g290  96.1% identity in 334 aa overlap 10        20        30
    m290.pep                     VSVGAQASGQIKILYVKLGQQVKKGDLIAE
                                 ||||||||||| ||||||||||||||||||
    g290       PQAAYITEAVRRGDISRTVSATGEISPSNLVSVGAQASGQIKKLYVKLGQQVKKGDLIAE
                  30        40        50        60        70        80

40        50        60        70        80        90
    m290.pep   INSTSQTNTLNTEKSKLETYQAKLVSAQIALGSAEKKYKRQAALWKENATSKEDLESAQD
               ||||:||||::  ||||||||||||||||||||||||||||||||| ||| ||||||||
    g290       INSTTQTNTIDMEKSKLETYQAKLVSAQIALGSAEKKYKRQAALWKDDATSKEDLESAQD
                  90       100       110       120       130       140

100       110       120       130       140       150
    m290.pep   AFAAAKANVAELKALIRQSKISINTAESELGYTRITATMDGTVVAILVEEGQTVNAAQST
               |:||||||||||||||||||||||||||||:||||||||||||||| |||||||||||||
    g290       ALAAAKANVAELKALIRQSKISINTAESDLGYTRITATMDGTVVAIPVEEGQTVNAAQST
                 150       160       170       180       190       200

160       170       180       190       200       210
    m290.pep   PTIVQLANLDMMLNKMQIAEGDITKVKAGQDISFTILSEPDTPIKAKLDSVDPGLTTMSS
               ||||||||||||||||||||||||||||||||||||||||||||||||||||||||||||
    g290       PTIVQLANLDMMLNKMQIAEGDITKVKAGQDISFTILSEPDTPIKAKLDSVDPGLTTMSS
                 210       220       230       240       250       260

220       230       240       250       260       270
    m290.pep   GGYNSSTDTASNAVYYYARSFVPNPDGKLATGMTTQNTVEIDGVKNVLIIPSLTVKNRGG
               |||||||||||||||||||||||||||||||||||||||||||||||||:||||||||||
    g290       GGYNSSTDTASNAVYYYARSFVPNPDGKLATGMTTQNTVEIDGVKNVLLIPSLTVKNRGG
                 270       280       290       300       310       320

280       290       300       310       320       330
    m290.pep   KAFVRVLGADGKAAEREIRTGMRDSMNTEVKSGLKEGDKVVISEITAAEQQESGERALGG
               ||||||||||||||:||||:||||||||||||||||||||||||||||||||||||||||
    g290       KAFVRVLGADGKAVEREIRTGMKDSMNTEVKSGLKEGDKVVISEITAAEQQESGERALGG
                 330       340       350       360       370       380 m290.pep   PPRRX
               |||||
    g290       PPRRX
                 390
```

The following partial DNA sequence was identified in *N. meningitidis* <SEQ ID 1215>:

```
a290.seq
   1 ATGGCAAAAA TGATGAAATG GCGGCTGTT GCGGCGGTCG CGGCGGCAGC

51 GGTTTGGGGC GGATGGTCTT ATCTGAAGCC CGAGCCGCAG GCTGCTTATA

101 TTACGGAAAC GGTCAGGCGC GGCGACATCA GCCGGACGGT TTCTGCAACA

151 GGGGAGATTT CGCCGTCCAA CCTGGTATCG GTCGGCGCGC AGGCATCGGG

201 GCAGATTAAG AAACTTTATG TCAAACTCGG GCAACAGGTT AAAAAGGGCG

251 ATTTGATTGC GGAAATCAAT TCGACCTCGC AGACCAATAC GCTCAATACG

301 GAAAAATCCA AATTGGAAAC GTATCAGGCG AAGCTGGTGT CGGCACAGAT

351 TGCATTGGGC AGCGCGGAGA AGAAATATAA GCGTCAGGCG GCGTTGTGGA

401 AGGATGATGC GACCGCTAAA GAAGATTTGG AAAGCGCACA GGATGCGCTT

451 GCCGCCGCCA AAGCCAATGT TGCCGAGCTG AAGGCTCTAA TCAGACAGAG

501 CAAAATTTCC ATCAATACCG CCGAGTCGGA ATTGGGCTAC ACGCGCATTA

551 CCGCAACGAT GGACGGCACG GTGGTGGCGA TTCTCGTGGA AGAGGGGCAG

601 ACTGTGAACG CGGCGCAGTC TACGCCGACG ATTGTCCAAT TGGCGAATCT

651 GGATATGATG TTGAACAAAA TGCAGATTGC CGAGGGCGAT ATTACCAAGG

701 TGAAGGCGGG GCAGGATATT TCGTTTACGA TTTTGTCCGA ACCGGATACG

751 CCGATTAAGG CGAAGCTCGA CAGCGTCGAC CCCGGGCTGA CCACGATGTC
```

-continued

```
 801 GTCGGGCGGC TACAACAGCA GTACGGATAC GGCTTCCAAT GCGGTCTACT

851 ATTATGCCCG TTCGTTTGTG CCGAATCCGG ACGGCAAACT CGCCACGGGG

901 ATGACGACGC AGAATACGGT TGAAATCGAC GGTGTGAAAA ATGTGCTGAT

951 TATTCCGTCG CTGACCGTGA AAAATCGCGG CGGCAGGGCG TTTGTGCGCG

1001 TGTTGGGTGC AGACGGCAAG GCGGCGGAAC GCGAAATCC GACCGGTATG

1051 AGAGACAGTA TGAATACCGA AGTAAAAAGC GGGTTGAAAG AGGGGACAA

1101 AGTGGTCATC TCCGAAATAA CCGCCGCCGA GCAGCAGGAA AGCGGCGAAC

1151 GCGCCCTAGG CGGCCCGCCG CGCCGATAA
```

This corresponds to the amino acid sequence <SEQ ID 1216; ORF 290.a>:

```
a290.pep

1 MAKMMKWAAV AAVAAAAVWG GWSYLKPEPQ AAYITETVRR GDISRTVSAT

51 GEISPSNLVS VGAQASGQIK KLYVKLGQQV KKGDLIAEIN STSQTNTLNT

101 EKSKLETYQA KLVSAQIALG SAEKKYKRQA ALWKDDATAK EDLESAQDAL

151 AAAKANVAEL KALIRQSKIS INTAESELGY TRITATMDGT VVAILVEEGQ

201 TVNAAQSTPT IVQLANLDMM LNKMQIAEGD ITKVKAGQDI SFTILSEPDT

251 PIKAKLDSVD PGLTTMSSGG YNSSTDTASN AVYYYARSFV PNPDGKLATG

301 MTTQNTVEID GVKNVLIIPS LTVKNRGGRA FVRVLGADGK AAEREIRTGM

351 RDSMNTEVKS GLKEGDKVVI SEITAAEQQE SGERALGGPP RR*
``` m290/a290  98.2% identity in 334 aa overlap

```
                          10         20         30
m290.pep                  VSVGAQASGQIKILYVKLGQQVKKGDLIAE
                          |||||||||||| ||||||||||||||||
a290      PQAAYITETVRRGDISRTVSATGEISPSNLVSVGAQASGQIKKLYVKLGQQVKKGDLIAE
                 30        40        50        60        70        80

40        50        60        70        80        90
m290.pep  INSTSQTNTLNTEKSKLETYQAKLVSAQIALGSAEKKYKRQAALWKENATSKEDLESAQD
          ||||||||||||||||||||||||||||||||||||||||||||::||:|||||||||
a290      INSTSQTNTLNTEKSKLETYQAKLVSAQIALGSAEKKYKRQAALWKDDATAKEDLESAQD
                 90       100       110       120       130       140

100       110       120       130       140       150
m290.pep  AFAAAKANVAELKALIRQSKISINTAESELGYTRITATMDGTVVAILVEEGQTVNAAQST
          |:|||||||||||||||||||||||||||||||||||||||||||||||||||||||||
a290      ALAAAKANVAELKALIRQSKISINTAESELGYTRITATMDGTVVAILVEEGQTVNAAQST
                150       160       170       180       190       200

160       170       180       190       200       210
m290.pep  PTIVQLANLDMMLNKMQIAEGDITKVKAGQDISFTILSEPDTPIKAKLDSVDPGLTTMSS
          ||||||||||||||||||||||||||||||||||||||||||||||||||||||||||||
a290      PTIVQLANLDMMLNKMQIAEGDITKVKAGQDISFTILSEPDTPIKAKLDSVDPGLTTMSS
                210       220       230       240       250       260

220       230       240       250       260       270
m290.pep  GGYNSSTDTASNAVYYYARSFVPNPDGKLATGMTTQNTVEIDGVKNVLIIPSLTVKNRGG
          ||||||||||||||||||||||||||||||||||||||||||||||||||||||||||||
a290      GGYNSSTDTASNAVYYYARSFVPNPDGKLATGMTTQNTVEIDGVKNVLIIPSLTVKNRGG
                270       280       290       300       310       320

280       290       300       310       320       330
m290.pep  KAFVRVLGADGKAAEREIRTGMRDSMNTEVKSGLKEGDKVVISEITAAEQQESGERALGG
          :||||||||||||||||||||||||||||||||||||||||||||||||||||||||||
a290      RAFVRVLGADGKAAEREIRTGMKDSMNTEVKSGLKEGDKVVISEITAAEQQESGERALGG
                330       340       350       360       370       380 m290.pep  PPRRX
          |||||
a290      PPRRX
          390
```

The following partial DNA sequence was identified in *N. gonorrhoeae* <SEQ ID 1217>:

```
g292.seq
   1 atgaaaacca agttaatcaa aatcttgacc ccctttaccg tcctgccgct
  51 gctggcttgc gggcaaacgc ccgtttccaa tgccaacgcc gaatccgccg
 101 tcaaagccga atccgccggc aaatccgttg ccgcttcttt gaaagcgcgt
 151 ttggaaaaaa cctattccgc ccaagatttg aaagtgttga gcgtcagcga
 201 aacaccggtc aaaggcattt acgaagtcgt cgtcagcggc aggcagatta
 251 tctacaccga tgccgaaggc ggctatatgt tcgtcggcga actcatcaac
 301 atcgacacgc gcaaaaacct gaccgaagaa cgcgccgccg atttgaacaa
 351 aatcgacttc gcctccctgc ctttggacaa agccatcaaa gaagtacgcg
 401 gcaacggcaa gctgaaagtc gccgtcttct ccgaccccga ttgtccgttc
 451 tgcaaacgct tggaacatga gtttgaaaaa atgaccgacg tgacggttta
 501 cagctttatg atgccattg ccggcctgca cccagatgcc gcgcgcaagg
 551 cgcaaatctt atggtgtcag cccgaccgtg ccaaagcgtg gacggattgg
 601 atgcgtaaag gcaaattccc ggtcggcggc agcatctgcg acaatcccgt
 651 cgcggaaacc acttccttgg gcgaacagtt cggcttcaac ggcacgccga
 701 cccttcgtct tccccaacgg gcgcacccaa agcggttaca gcccgatgcc
 751 ccaactggag gaaatcatcc gcaaaaacca gcagtaaacc cgcaatga
```

This corresponds to the amino acid sequence <SEQ ID 1218; ORF 292.ng>:

```
g292.pep
   1 MKTKLIKILT PFTVLPLLAC GQTPVSNANA ESAVKAESAG KSVAASLKAR
  51 LEKTYSAQDL KVLSVSETPV KGIYEVVVSG RQIIYTDAEG GYMFVGELIN
 101 IDTRKNLTEE RAADLNKIDF ASLPLDKAIK EVRGNGKLKV AVFSDPDCPF
 151 CKRLEHEFEK MTDVTVYSFM MPIAGLHPDA ARKAQILWCQ PDRAKAWTDW
 201 MRKGKFPVGG SICDNPVAET TSLGEQFGFN GTPTLRLPQR AHPKRLQPDA
 251 PTGGNHPQKP AVNPQ*
                                                      45
```

The following partial DNA sequence was identified in *N. meningitidis* <SEQ ID 1219>:

```
m292.seq
   1 ATGAAAACCA AGTTAATCAA AATCTTGACC CCCTTTACCG TCCTCCCGCT
  51 GCTGGCTTGC GGGCAAACGC CCGTTTCCAA TGCCAACGCC GAACCCGCCG
 101 TCAAAGCCGA GTCCGCCGGC AAATCCGTTG CCGCCTCTTT GAAAGCGCGT
 151 TTGGAAAAAA CCTATTCCGC CCAAGATTTG AAAGTGTTGA GCGTCAGCGA
 201 AACACCGGTC AAAGGCATTT ACGAAGTCGT CGTCAGCGGC AGGCAGATTA
 251 TCTACACCGA TGCCGAAGGC GGCTATATGT TCGTCGGCGA ACTCATCAAC
 301 ATCGACACGC GCAAAAACCT GACCGAAGAA CGCGCCGCCG ATTTGAACAA
 351 AATCGACTTC GCCTCCCTGC CTTTGGACAA AGCCATCAAA GAAGTGCGCG
 401 GCAACGGCAA GCTGAAAGTC GCCGTCTTCT CCGACCCCGA TTGTCCGTTC
 451 TGCAAACGCT TGGAACACGA GTTTGAAAAA ATGACCGACG TGACGGTTTA
```

```
-continued
501 CAGCTTTATG ATGCCCATTG CCGGCCTGCA CCCCGATGCC GCGCGCAAGG

551 CGCAAATCTT ATGGTGTCAG CCCGACCGCG CCAAAGCGTG GACGGATTGG

601 ATGCGTAAAG GCAAATTCCC GGTCGGCGGC AGCATCTGCG ACAATCCCGT

651 CGCGGAAACC ACTTCCTTGG GCGAACAATT CGGCTTCAAC GGCACGCCGA

701 CCCTCGTCTT CCCCAACGGG CGCAGCCAAA GCGGCTACAG CCCGATGCCC

751 CAACTGGAGG AAATCATCCG CAAAAATCAA TAA
```

This corresponds to the amino acid sequence <SEQ ID 1220; ORF 292>:

```
m292.pep
  1 MKTKLIKILT PFTVLPLLAC GQTPVSNANA EPAVKAESAG KSVAASLKAR

51 LEKTYSAQDL KVLSVSETPV KGIYEVVVSG RQIIYTDAEG GYMFVGELIN

101 IDTRKNLTEE RAADLNKIDF ASLPLDKAIK EVRGNGKLKV AVFSDPDCPF

151 CKRLEHEFEK MTDVTVYSFM MPIAGLHPDA ARKAQILWCQ PDRAKAWTDW

201 MRKGKFPVGG SICDNPVAET TSLGEQFGFN GTPTLVFPNG RSQSGYSPMP

251 QLEEIIRKNQ *
```

Computer analysis of this amino acid sequence gave the following results:
Homology with a Predicted ORF from *N. gonorrhoeae*

```
    m292/g292  98.7% identity in 238 aa overlap
                   10         20         30         40         50         60
     m290.pep  MKTKLIKILTPFTVLPLLACGQTPVSNANAEPAVKAESAGKSVAASLKARLEKTYSAQDL
               ||||||||||||||||||||||||||||||  ||||||||||||||||||||||||||||
     g290      MKTKLIKILTPFTVLPLLACGQTPVSNANAESAVKAESAGKSVAASLKARLEKTYSAQDL
                   10         20         30         40         50         60

70         80         90        100        110        120
     m290.pep  KVLSVSETPVKGIYEVVVSGRQIIYTDAEGGYMFVGELINIDTRKNLTEERAADLNKIDF
               ||||||||||||||||||||||||||||||||||||||||||||||||||||||||||||
     g290      KVLSVSETPVKGIYEVVVSGRQIIYTDAEGGYMFVGELINIDTRKNLTEERAADLNKIDF
                   70         80         90        100        110        120

130        140        150        160        170        180
     m290.pep  ASLPLDKAIKEVRGNGKLKVAVFSDPDCPFCKRLEHEFEKMTDVTVYSFMMPIAGLHPDA
               ||||||||||||||||||||||||||||||||||||||||||||||||||||||||||||
     g290      ASLPLDKAIKEVRGNGKLKVAVFSDPDCPFCKRLEHEFEKMTDVTVYSFMMPIAGLHPDA
                  130        140        150        160        170        180

190        200        210        220        230        240
     m290.pep  ARKAQILWCQPDRAKAWTDWMRKGKFPVGGSICDNPVAETTSLGEQFGFNGTPTLVFPNG
               |||||||||||||||||||||||||||||||||||||||||||||||||||||| :|:
     g290      ARKAQILWCQPDRAKAWTDWMRKGKFPVGGSICDNPVAETTSLGEQFGFNGTPTLRLPQR
                  190        200        210        220        230        240

250        260
     m290.pep  RSQSGYSPMPQLEEIIRKNQX g290      AHPKRLQPDAPTGGNHPQKPAVNPQX
                  250        260
```

The following partial DNA sequence was identified in *N. meningitidis* <SEQ ID 1221>:

```
a292.seq
  1 ATGAAAACCA AGTTAATCAA AATCTTGACC CCCTTTACCG TCCTCCCGCT

51 GCTGGCTTGC GGGCAAACGC CCGTTTCCAA TGCCAACGCC GAACCCGCCG

101 TCAAAGCCGA GTCCGCCGGC AAATCCGTTG CCGCCTCTTT GAAAGCGCGT

151 TTGGAAAAAA CCTATTCCGC CCAAGATTTG AAAGTGTTGA GCGTCAGCGA

201 AACACCGGTC AAAGGCATTT ACGAAGTCGT CGTCAGCGGC AGGCAGATTA
```

```
-continued
251 TCTACACCGA TGCCGAAGGC GGCTATATGT TCGTCGGCGA ACTCATCAAC

301 ATCGACACGC GCAAAAACCT GACCGAAGAA CGCGCCGCCG ATTTGAACAA

351 AATCGACTTC GCCTCCCTGC CTTTGGACAA AGCCATCAAA GAAGTGCGCG

401 GCAACGGCAA GCTGAAAGTC GCCGTCTTCT CCGACCCCGA TTGTCCGTTC

451 TGCAAACGCT TGGAACACGA GTTTGAAAAA ATGACCGACG TGACGGTTTA

501 CAGCTTTATG ATGCCCATTG CCGGCCTGCA CCCCGATGCC GCGCGCAAGG

551 CGCAAATCTT ATGGTGTCAG CCCGACCGCG CCAAAGCGTG GACGGATTGG

601 ATGCGTAAAG GCAAATTCCC GGTCGGCGGC AGCATCTGCG ACAATCCCGT

651 CGCGGAAACC ACTTCCTTGG GCGAACAATT CGGCTTCAAC GGCACGCCGA

701 CCCTCGTCTT CCCCAACGGG CGCAGCCAAA GCGGCTACAG CCCGATGCCC

751 CAACTGGAGG AAATCATCCG CAAAAATCAA TAA
```

This corresponds to the amino acid sequence <SEQ ID 1222; ORF 292.a>:

```
a292.pep

1 MKTKLIKILT PFTVLPLLAC GQTPVSNANA EPAVKAESAG KSVAASLKAR

51 LEKTYSAQDL KVLSVSETPV KGIYEVVVSG RQIIYTDAEG GYMFVGELIN

101 IDTRKNLTEE RAADLNKIDF ASLPLDKAIK EVRGNGKLKV AVFSDPDCPF

151 CKRLEHEFEK MTDVTVYSFM MPIAGLHPDA ARKAQILWCQ PDRAKAWTDW

201 MRKGKFPVGG SICDNPVAET TSLGEQFGFN GTPTLVFPNG RSQSGYSPMP

251 QLEEIIRKNQ * m292/a292   100.0% identity in 260 aa overlap 10        20        30        40        50        60
m292.pep  MKTKLIKILTPFTVLPLLACGQTPVSNANAEPAVKAESAGKSVAASLKARLEKTYSAQDL
          ||||||||||||||||||||||||||||||| ||||||||||||||||||||||||||||
a292      MKTKLIKILTPFTVLPLLACGQTPVSNANAESAVKAESAGKSVAASLKARLEKTYSAQDL
                 10        20        30        40        50        60

70        80        90       100       110       120
m292.pep  KVLSVSETPVKGIYEVVVSGRQIIYTDAEGGYMFVGELINIDTRKNLTEERAADLNKIDF
          ||||||||||||||||||||||||||||||||||||||||||||||||||||||||||||
a292      KVLSVSETPVKGIYEVVVSGRQIIYTDAEGGYMFVGELINIDTRKNLTEERAADLNKIDF
                 70        80        90       100       110       120

130       140       150       160       170       180
m292.pep  ASLPLDKAIKEVRGNGKLKVAVFSDPDCPFCKRLEHEFEKMTDVTVYSFMMPIAGLHPDA
          ||||||||||||||||||||||||||||||||||||||||||||||||||||||||||||
a292      ASLPLDKAIKEVRGNGKLKVAVFSDPDCPFCKRLEHEFEKMTDVTVYSFMMPIAGLHPDA
                130       140       150       160       170       180

190       200       210       220       230       240
m292.pep  ARKAQILWCQPDRAKAWTDWMRKGKFPVGGSICDNPVAETTSLGEQFGFNGTPTLVFPNG
          ||||||||||||||||||||||||||||||||||||||||||||||||||||||||||||
a292      ARKAQILWCQPDRAKAWTDWMRKGKFPVGGSICDNPVAETTSLGEQFGFNGTPTLVFPNG
                190       200       210       220       230       240

250       260
m292.pep  RSQSGYSPMPQLEEIIRKNQX a292      RSQSGYSPMPQLEEIIRKNQX
                250       260
```

The following partial DNA sequence was identified in *N. gonorrhoeae* <SEQ ID 1223>:

```
g294.seq (partial)
   1 atgcgtatta cctgtgcgcc gatgtcgctt ttgtcggcgg cagtctggtc 51 ggttcgggct gtcagaacat catcgaaccg cttcctgcg gcgttacgac
```

-continued

```
101 gatattcggc tttcgacct acaatttttc cgaagcctgc cggcacgcct 151 tggcatcggg tgcggcggtt caagtcgaat cggcggacgc gtggcgtgaa 201 gccgttgaaa aaaccttatc tggcgagggg ggcggaatgc agatgcaggc 251 gcgcgtggac ggctttatcg cacaacatcg cggagcgggc gcagaatcg 301 ccgaggcggt gcgggaagcg gtatgcggac atcgggggcg atagtgatac 351 aatccgtatc cgagttttcc ggttggagca tcgtatgagt atttatgccg 401 tcgcgcacat catccacctg tattgcgcca ccgcctttgt cggcggcgtg 451 tttttgaag tgctggtttt gtccgtcctg catacgggac gggtgtcgcg 501 cgaggcgcgg cgcgaagtgg aaaaggcaat gtcttaccgc gccgtcaggg 551 tgatgccgtt tgcggtcgga ctgctgttcg ccaggggaac tctagagtcg 601 actgcagcag catgccctc...
```

This corresponds to the amino acid sequence <SEQ ID 1224; ORF 294.ng>:

```
g294.pep (partial)
  1 MRITCAPMSL LSAAVWSVRA VRTSSNRFPA ALRRYSAFRP TIFPKPAGTP

51 WHRVRRFKSN RRTRGVKPLK KPYLARGAEC RCRRAWTALS HNIAERARES

101 PRRCGKRYAD IGGDSDTIRI RVFRLEHRMS IYAVAHIIHL YCATAFVGGV

151 FFEVLVLSVL HTGRVSREAR REVEKAMSYR AVRVMPFAVG LLFARGTLES

201 TAAACP....
```

The following partial DNA sequence was identified in *N. meningitidis* <SEQ ID 1225>:

```
m294.seq
  1 ATGCGTATTA CCTGTGCGCC GATGTCGCTT TTGTCGGCGG CAGTCTGGTC

51 GATTCGGGTT GTCAGAACAT CATCGAACCG CTTTCCTGCG GCGTTCCGAC

101 GATATTCGGC TTTTCAACCT ACAATTTTTC CGAAGCCTGC CGACACGCCT

151 TGGCATCGGG TGCGGCGGTT CAAGTCGAAT CGGCGGATGC GTGGCGGGAA

201 GCCGTTGAAA AAACCTTATC GTCCGAGGGG GGGGGGATGC AGATGCAGGC

251 GCGCGTGGAC GGCTTTATCG CACAACATCG CGGAGCGGGC GCAGAGAATCG

301 CCGAGGCGGT GCGGGAAGCG GTATGCGGAT ATCGGGGGCG ATAGTGATAC

351 AATCCGTATC CGAGTTTTCC GTTTGGAGCA TCGTATGAGT ATTTATGCCG

401 TCGCGCACAT CGTTCATCTG TATTGCGCTA TTGCCTTTGT CGGCGGCGTG

451 TTTTTTGAAG TGCTGGTTTT GTCCGTCCTG CATACGGGAC GGGTGTCGCG

501 CGAGGCGCGG CGCGAAGTGG AAAAGGCAAT GTCTTACCGC GCCGTCAGGG

551 TGATGCCGTT TGTGGTCGGA CTGCTGTTCG CCAGCGGCAT CGTGATGGCG

601 GCAAACCGCT ATCTTTCTAT ATTGGGCGAA CCGTTTGCCA CTTCCTTCGG

651 TACGATGCTG ACGCTGAAAA TCCTGTTGGC GTTCAGCGTA TTGGCGCACT

701 TCGCCATCGC CGTCGTCAAA ATGGCGCGTT CCACACTGAC GGTCGGTTGG

751 TCGAAATACA TACACGCCGT CGTCTTTACC CATATGcTGC TGATTGTCTT

801 TTTGGCAAAA GCGATGTTTT ATATCAGCTG GTAA
```

This corresponds to the amino acid sequence <SEQ ID 1226; ORF 294>:

```
m294.pep

1  MRITCAPMSL LSAAVWSIRV VRTSSNRFPA AFRRYSAFQP TIFPKPADTP
   51  WHRVRRFKSN RRMRGGKPLK KPYRPRGGGC RCRRAWTALS HNIAERARES
  101  PRRCGKRYAD IGGDSDTIRI RVFRLEHRMS IYAVAHIVHL YCAIAFVGGV
  151  FFEVLVLSVL HTGRVSREAR REVEKAMSYR AVRVMPFVVG LLFASGIVMA
  201  ANRYLSILGE PFATSFGTML TIKILLAFSV LAHFAIAVVK MARSTLTVGW
  251  SKYIHAVVFT HMLLIVFLAK AMFYISW* g294/m294  92.3% identity in 196 aa overlap 10         20         30         40         50         60
g294.pep   MRITCAPMSLLSAAVWSVRAVRTSSNRFPAALRRYSAFRPTIFPKPAGTPWHRVRRFKSN
           ||||||||||||||||| :||||||||||||: ||||| :||||||||| ||||||||||
m294       MRITCAPMSLLSAAVWSIRVVRTSSNRFPAAFRRYSAFQPTIFPKPADTPWHRVRRFKSN
                 10         20         30         40         50         60

70         80         90        100        110        120
g294.pep   RRTRGVKPLKKPYLARGAECRCRRAWTALSHNIAERARESPRRCGKRYADIGGDSDTIRI
           ||  ||  |||||| ||:  |||||||||||||||||||||||||||||||||||||||
m294       RRMRGGKPLKKPYRPRGGGCRCRRAWTALSHNIAERARESPRRCGKRYADIGGDSDTIRI
                 70         80         90        100        110        120

130        140        150        160        170        180
g294.pep   RVFRLEHRMSIYAVAHIIHLYCATAFVGGVFFEVLVLSVLHTGRVSPEARREVEKAMSYR
           ||||||||||||||||: |||||:||||||||||||||||||||| ||||||||||||
m294       RVFRLEHRMSIYAVAHIVHLYCAIAFVGGVFFEVLVLSVLHTGRVSREARREVEKAMSYR
                130        140        150        160        170        180

190        200
g294.pep   AVRVMPFAVGLLFARGTLESTAAACP
           |||||||:|||||| |
m294       AVRVMPFVVGLLFASGIVMAANRYLSILGEPFATSFGTMLTLKILLAFSVLAHFAIAVVK
                190        200        210        220        230        240
```

The following partial DNA sequence was identified in *N. meningitidis* <SEQ ID 1227>:

```
a294.seq
   1  ATGCGTATTA CCTGTGCGCC GATGTCGCTT TTGTCGGCGG CAGTCTGGTC

51  GATTCGGGCT GTCAGAACAT CATCGAACCG CTTTCCTGCG GCGTTCCGAC

101  GATATTCGGC TTTTCGACCT ACAATTTTTC CGAAGCCTGC CGGCACGCCT

151  TGGCATCGGG TGCGGCGGTT CAAGTCGAAT CGGCGGACGC GTGGCGGGAA

201  GCCGTTGAAA AAACTTATC GTCCGAGGAG GGCGGAATGC AGATGCAGGC

251  GCGCGCGGAC GGCTTTATCG CACAACATCG CGGAGCGGGC GCGAGAATCG

301  CCGAGGCGGT ACGGGAAGCG GTATGCGGAC ATCGGGACG ATAGTGATAC

351  AATCCGTATC CGAGTTTTCC GGTTGGAGTA CCGTATGAGT ATTTATGCCG

401  TCGCGCACAT CGTCCACCTG TATTGCGCCA TCGCCTTTGT CGGCGGCGTG

451  TTTTTTGAAG TGCTGGTTTT GTCCGTCCTG CATACGGGAC GGGTGTCGTG

501  CGAGGCGCGG CGCGAAGTGG AAAAGGCAAT GTCTTACCGC GCCGTCAGGG

551  TGATGCCGTT TGTGGTCGGA CTGCTGTTCG CCAGCGGCAT CGTGATGGCG

601  GCAAACCGCT ATCTTTCTAT ATTGGGCGAA CCGTTTGCCA CTTCCTTCGG

651  TACGATGCTG ACGCTGAAAA TCCTGTTGGC GTTCAGCGTG TTGGCGCACT

701  TCGCCATCGC CGTCGTCAAA ATGGCGCGTT CCACACTGAC CGTCGGCTGG

751  TCGAAATACA TACACACCGT CGTCTTTACC CATATGCTGC TGATTGTCTT

801  TTTGGCAAAA GCGATGTTTT ATATCAGCTG GTAA
```

This corresponds to the amino acid sequence <SEQ ID 1228; ORF 294.a>:

```
a294.pep
   1 MRITCAPMSL LSAAVWSIRA VRTSSNRFPA AFRRYSAFRP TIFPKPAGTP

51 WHRVRRFKSN RRTRGGKPLK KTYRPRRAEC RCRRARTALS HNIAERARES

101 PRRYGKRYAD IGDDSDTIRI RVFRLEYRMS IYAVAHIVHL YCAIAFVGGV

151 FFEVLVLSVL HTGRVSCEAR REVEKAMSYR AVRVMPFVVG LLFASGIVMA

201 ANRYLSILGE PFATSFGTML TLKILLAFSV LAHFAIAVVK MARSTLTVGW

251 SKYIHTVVFT HMLLIVFLAK AMFYISW*
``` m294/a294 94.9% identity in 277 aa overlap

```
                   10         20         30         40         50         60
     m294.pep  MRITCAPMSLLSAAVWSIRVVRTSSNRFPAAFRRYSAFQPTIFPKPADTPWHRVRRFKSN
               ||||||||||||||||||| :|||||||||||||||||||:||||||||:||||||||||
         a294  MRITCAPMSLLSAAVWSIRAVRTSSNRFPAAFRRYSAFRPTIFPKPAGTPWHRVRRFKSN
                   10         20         30         40         50         60

70         80         90        100        110        120
     m294.pep  RRMRGGKPLKKPYRPRGGGCRCRRAWTALSHNIAERARESPRRCGKRYADIGGDSDTIRI
               || |||||||| |||| : ||||| |||||||||||||||||||  |||||||  |||||
         a294  RRTRGGKPLKKTYRPRRAECRCRRARTALSHNIAERARESPRRYGKRYADIGDDSDTIRI
                   70         80         90        100        110        120

130        140        150        160        170        180
     m294.pep  RVFRLEHRMSIYAVAHIVHLYCAIAFVGGVFFEVLVLSVLHTGRVSREARREVEKAMSYR
               |||||| :||||||||||||||||||||||||||||||||||||||  |||||||||||
         a294  RVFRLEYRMSIYAVAHIVHLYCAIAFVGGVFFEVLVLSVLHTGRVSCEARREVEKAMSYR
                  130        140        150        160        170        180

190        200        210        220        230        240
     m294.pep  AVRVMPFVVGLLFASGIVMAANRYLSILGEPFATSFGTMLTLKILLAFSVLAHFAIAVVK
               ||||||||||||||||||||||||||||||||||||||||||||||||||||||||||||
         a294  AVRVMPFVVGLLFASGIVMAANRYLSILGEPFATSFGTMLTLKILLAFSVLAHFAIAVVK
                  190        200        210        220        230        240

250        260        270
     m294.pep  MARSTLTVGWSKYIHAVVFTHMLLIVFLAKAMFYISWX
               |||||||||||||| :|||||||||||||||||||||
         a294  MARSTLTVGWSKYIHTVVFTHMLLIVFLAKAMFYISWX
                  250        260        270
```

The following partial DNA sequence was identified in *N. gonorrhoeae* <SEQ ID 1229>:

```
g295.seq
   1 atgctcggga tggcgcggca cgacggccag cagggcatcg ccgcgatatt 51 gttgccacgc cgccagcagt ttttccgcct cgtcttcgcc ccgataaacg 101 cgcgtgctgc cgcacacggc aaccggccgg cctccgatgc gttttcaaa 151 ctgccccgcc agcgttttca tgtcttcaga cggcatcagg tcgtatttgg 201 tattgccgca cacctgcacg gatgccgcgc ccaatttcgc caaccgcgcc 251 gcatccgcct ccgtctgcgc cagacagccc gtcagcgaag cggctgcggg 301 acggatcagg cggcggactt tcagataacc gttcagcgat ttttccgaca 351 gccgcgcatt cgccaaaaac agcggcacac ccgctcgccg gcattccttc 401 atcagattgg gccagatttc ggtttccatc aaaatgccga acatcgggcg 451 gtgttcgcgc aaaaactgcc gtacccacgt ttttttgtca tacggaagat 501 agcggcattg cgcatcggga aacagaactt gcgcggtttc ccgtcccgtc 551 ggggtcatct gcgtcatcag cagcggcgca tcgggaaaac gccgccgcaa 601 ctcgcgtatc aagggctggg cggcacgcgt ttctccgacc gaaacggcgt 651 gtatccaaac cgcgccggta acgggattcg gatgcggctt gccgaaacgc
```

-continued

```
701 tcgtccctat gcgcccggta tgccggggca cttccggagc gtttgtccaa 751 ataacgccgt atccatatcg gcgcaagcag ccacaataca tcataaagcc 801 attggaacat ctttctattt cctgcaaaac aaatgccgtc cgaacggttc 851 ggacggcatt tcggcaacgg aatcaaatat cgtag
```

This corresponds to the amino acid sequence <SEQ ID 1230; ORF 295.ng>:

```
g295.pep
  1 MLGMARHDGQ QGIAAILLPR RQQFFRLVFA PINARAAAHG NRPASDAFFK

51 LPRQRFHVFR RHQVVFGIAA HLHGCRAQFR QPRRIRLRLR QTARQRSGCG

101 TDQAADFQIT VQRFFRQPRI RQKQRHTRSP AFLHQIGPDF GFHQNAEHRA

151 VFAQKLPYPR FFVIRKIAAL RIGKQNLRGF PSRRGHLRHQ QRRIGKTPPQ

201 LAYQGLGGTR FSDRNGVYPN RAGNGIRMRL AETLVPMRPV CRGTSGAFVQ

251 ITPYPYRRKQ PQYIIKPLEH LSISCKTNAV RTVRTAFRQR NQIS*
```

The following partial DNA sequence was identified in *N. meningitidis* <SEQ ID 1231>:

```
m295.seq.
  1 ATGCTCGGGA TGGCGCGGCA CGACGACCAG CAGCGCATCG CCGCGATATT

51 GTTGCCACGC CGCCAGCAGT TTTTCCGCCT CGTCTTCACC CCGATAAACG

101 CGCGTGCTGC CGCACACGGC AACCGGCCGG CCTCCGATGC GTTTTTCAAA

151 CTGCCCCGCC AGCGTTTTCA TCTGTTCCGA CGGTATGATG TCGTATTTGG

201 TATTGCCGCA CACCTGCACG GATGCCGCGC CCAATTTCGC CAACCGCGCC

251 GCATCCGCCT CTGTCTGCGC CAGACACCCC GTCAGCGAAG CGGCGGCAGG

301 ACGGATCAGG CGGCGGACTT TCAGATAACC GTTCAACGAT TTTTCCGACA

351 GCCGCGCATT CGCCAAAAAC AGCGGCACAC CCGCGCGCCG GCATTCCCTC

401 ATCAGGTTGG GCCAGATTTC GGTTTCCATC AAAATGCCGA ACATCGGGCG

451 GTGTTCGCGC AAAAACTGCC GTACCCACGT TTTTTTGTCA TACGGAAGAT

501 AGCGGCATTG CGCATCGGGA AACAGAACTT GCGCGGTTTC CCGCCCCGTC

551 GGGGTCATCT GCGTCATCAG CAGCGGCGCA TCGGGAAAAC GCCGCCGCAA

601 CTCGCGTATC AAGGACTGGG CGGCACGCGT TTCTCCGACC GAAACGGCGT

651 GTATCCAAAC CGCGCCGGTA ACGGGATTCG GATACGGCTT GCCGAAACGC

701 TCGTCCCGAT GCGCCCGATA TGCCGGGGCA CTTCCGGAGC GTTTGTCCAA

751 ATAACGCCGT ATCCATATCG GCGCAAGCAG CCACAATACA TCATAAAGCC

801 ATTGGAACAT CTTTCTATTT CCTGCAAAAC AAATGCCGTC TGAACGGTTC

851 AGACGGCATT TCGGCAACGG AATCAAATAT CGTAG
```

This corresponds to the amino acid sequence <SEQ ID 1232; ORF 295>:

```
m295.pep
  1 MLGMARHDDQ QRIAAILLPR RQQFFRLVFT PINARAAAHG NRPASDAFFK

51 LPRQRFHLFR RYDVVFGIAA HLHGCRAQFR QPRRIRLCLR QTPRQRSGGR
```

-continued

```
101 TDQAADFQIT VQRFFRQPRI RQKQRHTRAP AFPHQVGPDF GFHQNAEHRA

151 VFAQKLPYPR FFVIRKIAAL RIGKQNLRGF PPRRGHLRHQ QRRIGKTPPQ

201 LAYQGLGGTR FSDRNGVYPN RAGNGIRIRL AETLVPMRPI CRGTSGAFVQ

251 ITPYPYRRKQ PQYIIKPLEH LSISCKTNAV XTVQTAFRQR NQIS*
```

```
m295/g295   93.9% identity in 294 aa overlap 10        20        30        40        50        60
m295.pep    MLGMARHDDQQRIAAILLPRRQQFFRLVFTPINARAAAHGNRPASDAFFKLPRQRFHLFR
            |||||||| || ||||||||||||||||:||||||||||||||||||||||||||:||
g295        MLGMARHDGQQGIAAILLPRRQQFFRLVFAPINARAAAHGNRPASDAFFKLPRQRFHVFR 10        20        30        40        50        60
                    70        80        90       100       110       120
m295.pep    RYDVVFGIAAHLHGCRAQFRQPRRIRLCLRQTPRQRSGGRTDQAADFQITVQRFFRQPRI
            |::|||||||||||||||||||||||| |||| |||||  |||||||||||||||||||
g295        RHQVVFGIAAHLHGCRAQFRQPRRIRLRLRQTARQRSGCGTDQAADFQITVQRFFRQPRI 70        80        90       100       110       120
                   130       140       150       160       170       180
m295.pep    RQKQRHTRAPAFPHQVGPDFGFHQNAEHRAVFAQKLPYPRFFVIRKIAALRIGKQNLRGF
            ||||||||:||| ||:||||||||||||||||||||||||||||||||||||||||||||
g295        RQKQRHTRSPAFLHQIGPDFGFHQNAEHRAVFAQKLPYPRFFVIRKIAALRIGKQNLRGF 130       140       150       160       170       180
                   190       200       210       220       230       240
m295.pep    PPRRGHLRHQQRRIGKTPPQLAYQGLGGTRFSDRNGVYPNRAGNGIRIRLAETLVPMRPI
            | |||||||||||||||||||||||||||||||||||||||||||||:|||||||||||:
g295        PSRRGHLRHQQRRIGKTPPQLAYQGLGGTRFSDRNGVYPNRAGNGIRMRLAETLVPMRPV 190       200       210       220       230       240
                   250       260       270       280       290
m295.pep    CRGTSGAFVQITPYPYRRKQPQYIIKPLEHLSISCKTNAVXTVQTAFRQRNQISX
            |||||||||||||||||||||||||||||||||||||||| ||:||||||||||
g295        CRGTSGAFVQITPYPYRRKQPQYIIKPLEHLSISCKTNAVRTVRTAFRQRNQIS 250       260       270       280       290
```

The following partial DNA sequence was identified in *N. meningitidis* <SEQ ID 1233>:

```
a295.seq.
  1 ATGCTCGGGA TGGCGCGGCA CGACGACCAG CAGGGCATCG CCGCGATATT

51 GTTGCCACGC CGCCAGCAGT TTTTCCGCCT CGTCTTCACC CCGATAAACG

101 CGCGTGCTGC CGCACACGGC AACCTGCCGG TCTCCGATGC GTTTTTCAAA

151 CTGCCCCGCC AGCGTTTTCA TCTGTTCCGA CGGCATCAGG TCGTATTTGG

201 TATTGCCGCA CACCTGCACG GATGCCGCGC CCAATTTCGC CAACCGCGCC

251 GCATCCGCCT CCGTCTGTGC CAGACAGCCC GTCAGCGAAG CGGCGGCAGG

301 ACGGATCAGG CTGCGGACTT TCAGATAACC GTTTAGCGAT TTTTCCGACA

351 GCCGCGCATT CGCCAAAAAC AGCGGCACAC CCGTGCGCCG GCATTCCTTC

401 ATCAGATTGG GCCAGATTTC GGTTTCCATC AAAATGCCGA ACATCGGGCG

451 GTGTTCGCGC AAAAACTGCC GTACCCACGT TTTTTTGTCA TACGGAAGAT

501 AGCGGCATTG TGCATCAGGA AACAGAACTT GCGCGGTTTC CCGTCCCGTC

551 GGGGTCATCT GCGTCATCAG CAGCGGCGCA TCGGGAAAAC GCTGCCGCAA

601 CTCGCGTATC AAAGGTTGGG CGGCACGCGT TTCCCCGACC GAAACGGCGT

651 GTATCCAAAC CGCGCCGGTA ACGGGATTCG GATACGGCTT GCCGAAACGC

701 TCGCCCCGAT GCGCCCGATA TGCAGGGGCA CTTCCGGAGC GTTTGTCCAA

751 ATAACGCCGT ATCCATATCG GCGCAAGCAG CCACAATACA TCATAAAGCC
```

```
             -continued
801 ATTGGAACAT CTTTCTATTT CCTGCAAAAC AAATGCCGTC CGAACGGTTC

851 GGACGGCATT TCGGCAACGG AATCAAATAT CGTAG
```

This corresponds to the amino acid sequence <SEQ ID 1234; ORF 295.a>:

```
a295.pep
  1 MLGMARHDDQ QGIAAILLPR RQQFFRLVFT PINARAAAHG NLPVSDAFFK

51 LPRQRFHLFR RHQVVFGIAA HLHGCRAQFR QPRRIRLRLC QTARQRSGGR

101 TDQAADFQIT V*RFFRQPRI RQKQRHTRAP AFLHQIGPDF GFHQNAEHRA

151 VFAQKLPYPR FFVIRKIAAL CIRKQNLRGF PSRRGHLRHQ QRRIGKTLPQ

201 LAYQRLGGTR FPDRNGVYPN RAGNGIRIRL AETLAPMRPI CRGTSGAFVQ

251 ITPYPYRRKQ PQYIIKPLEH LSISCKTNAV RTVRTAFRQR NQIS*
``` m295/a295 93.2% identity in 294 aa overlap

```
                  10        20        30        40        50        60
     m295.pep MLGMARHDDQQRIAAILLPRRQQFFRLVFTPINARAAAHGNRPASDAFFKLPRQRFHLFR
             |||||||||| ||||||||||||||||||||||||||||||  :|||||||||||||||
     a295    MLGMARHDDQQGIAAILLPRRQQFFRLVFTPINARAAAHGNLPVSDAFFKLPRQRFHLFR
                  10        20        30        40        50        60

70        80        90       100       110       120
     m295.pep RYDVVFGIAAHLHGCRAQFRQPRRIRLCLRQTPRQRSGGRTDQAADFQITVQRFFRQPRI
             |::|||||||||||||||||||||||||| | || |||||||||||||||| |||||||
     a295    RHQVVFGIAAHLHGCRAQFRQPRRIRLRLRQTARQRSGCGTDQAADFQITVQRFFRQPRI
                  70        80        90       100       110       120

130       140       150       160       170       180
     m295.pep RQKQRHTRAPAFPHQVGPDFGFHQNAEHRAVFAQKLPYPRFFVIRKIAALRIGKQNLRGF
             ||||||||| ||: |:|||||||||||||||||||||||||||||||||| |||||||
     a295    RQKQRHTRSPAFLHQIGPDFGFHQNAEHRAVFAQKLPYPRFFVIRKIAALRIGKQNLRGF
                 130       140       150       160       170       180

190       200       210       220       230       240
     m295.pep PPRRGHLRHQQRRIGKTPPQLAYQGLGGTRFSDRNGVYPNRAGNGIRIRLAETLVPMRPI
             | ||||||||||||||||||| |||||| |||||||||||||||||||:|||
     a295    PSRRGHLRHQQRRIGKTPPQLAYQGLGGTRFSDRNGVYPNRAGNGIRMRLAETLVPMRPI
                 190       200       210       220       230       240

250       260       270       280       290
     m295.pep CRGTSGAFVQITPYPYRRKQPQYIIKPLEHLSISCKTNAVXTVQTAFRQRNQISX
             |||||||||||||||||||||||||||||||||||||||| :||||||||||||
     a295    CRGTSGAFVQITPYPYRRKQPQYIIKPLEHLSISCKTNAVXTVQTAFRQRNQISX
                 250       260       270       280       290
```

The following partial DNA sequence was identified in *N. gonorrhoeae* <SEQ ID 1235>:

```
g297.seq.
  1 ATGGCTGTCT TCCCACTTTC GGCAAAACAT CGGAAATACG CGCTGCGCGC

51 GCTTGCCGTT TCGATTATTC TGGTGtcgGC GGCATACATT GCttcgacag 101 aggggaccga gcgcgtcaga ccgcAGCGCG TggaacaaAA ACTGCCGCCG 151 CTGTCtTGGg gcggcaacgg CGTtcagacg gcaTATTGGG TGCAGGAGGC 201 GGTGCagccg ggggactcgC TGGCGGACGT GCTGGCGCGT TCGGGTATGG 251 CGCGGGacga gattgCCcga ATcacGGAAA aataTggcgG CGAAGCCGAT 301 TTGCGgcatt tGCGTGCCGA CCAGTCGGTT CATGTTTTGG TCGGCGGCGA 351 CGGCAGTGCG CGCGAAGTGC AGTTTTttaC CGACGAAGAC GGCGAGCGCA 401 aTctGGTCGC TTTGGAAAAA AAAGGCGGCA TATGGCGGCG GTCGGCTTCT
```

-continued

```
 451 GATGCGGATA TGAAGGTTTT GCCGACACTG CGTTCGGTCG TGGTCAAAAC

501 GTCGGCGCGC GGTTCGCTGG CGCGGGCGGA AGTGCCCGTC GAAATCCGCG

551 AATCCTTAAG CGGGATTTTT GCCGGCCGCT TCAGCCTTGA CGGTTTGAAG

601 GAAGGCGATG CCGTGCGCCT GCTTTACGAC AGCCTGTATT TCCACGGGCA

651 GCAGGTGGCG GCGGGCGATA TTTTGGCGGC GGAAGTTGTC AAGGGCGGCA

701 CAACCCATCA GGCGTTCTAT TACCGTTCGG ACAAGGAAGG CGGAGGGGGC

751 GGCAATTATT ACGATGAAGA CGGCAGGGTG TTGCAGGAAA AAGGCGGCTT

801 CAACATCgaG CCGCTGGTCT ATACGCGCAT TTCTTCGCCG TTCGGCTACC

851 GTATGCACCC CATCCTGCAC ACATGGCGGC TGCACACGGG CATCGATTAT

901 GCCGCACCGC AGGGAACGCC GGTCAGGGCT TCCGCCGACG GCGTGATTAC

951 CTTTAAAGGC CGGAAGGGCG GATACGGCAA CGCGGTGATG ATACGCCACG

1001 CCAACGGTGT GGAAACGCTG TACGCGCACT TGAGCGCGTT TTCGCAGGCA

1051 CAAGGCAATG TGCGCGGCGG CGAGGTCATC GGTTTTGTCG GTTCGACAGG

1101 GCGTTCGACC GGGCCGCACC TGCATTACGA GGCGCGCATC AACGGGCAGC

1151 CCGTCAATCC TGTTTCGGTC GCATTGCCGA CACCCGAATT GACGCAGGCG

1201 GACAAGGCGG CGTTTGCCGC GCAGAAACAG AAGGCGGACG CGCTGCTTGC

1251 GCGCTTGCGC GGCATACCGG TTACCGTGTC GCAATCGGAT TGA
```

This corresponds to the amino acid sequence <SEQ ID 1236; ORF 297.ng>:

```
g297.pep
  1 MAVFPLSAKH RKYALRALAV SIILVSAAYI ASTEGTERVR PQRVEQKLPP

51 LSWGGNGVQT AYWVQEAVQP GDSLADVLAR SGMARDEIAR ITEKYGGEAD

101 LRHLRADQSV HVLVGGDGSA REVQFFTDED GERNLVALEK KGGIWRRSAS

151 DADMKVLPTL RSVVVKTSAR GSLARAEVPV EIRESLSGIF AGRFSLDGLK

201 EGDAVRLLYD SLYFHGQQVA AGDILAAEVV KGGTTHQAFY YRSDKEGGGG

251 GNYYDEDGRV LQEKGGFNIE PLVYTRISSP FGYRMHPILH TWRLHTGIDY

301 AAPQGTPVRA SADGVITFKG RKGGYGNAVM IRHANGVETL YAHLSAFSQA

351 QGNVRGGEVI GFVGSTGRST GPHLHYEARI NGQPVNPVSV ALPTPELTQA

401 DKAAFAAQKQ KADALLARLR GIPVTVSQSD *
```

The following partial DNA sequence was identified in *N. meningitidis* <SEQ ID 1237>:

```
m297.seq.
  1 ATGGCTGTCT TCCCACTTTC GGCAAAACAT CGGAAATACG CGCTGCGTGC

51 GCTTGCCGTT TCGATTATTT TGGTGTCGGC GGCATACATT GCTTCGACAG

101 AGAGGACGGA GCGCGTCAGA CCGCAGCGCG TGGAACAAAA TCTGCCGCCG

151 CTGTCTTGGG GCGGCAGCGG CGTTCAGACG GCATATTGGG TGCAGGAGGC

201 GGTGCAGCCG GGCGACTCGC TGGCGGACGT GCTGGCGCGT TCGGGTATGG

251 CGCGGGACGA GATTGCCCGA ATCACGGAAA AATATGGCGG CGAAGCCGAT

301 TTGCGGCATT TGCGTGCCGA CCAGTCGGTT CATGTTTTGG TCGGCGGCGA

351 CGGCGGCGCG CGCGAAGTGC AGTTTTTTAC CGACGAAGAC GGCGAGCGCA
```

-continued

```
 401  ATCTGGTCGC TTTGGAAAAG AAAGGCGGCA TATGGCGGCG GTCGGCTTCT

451  GAGGCGGATA TGAAGGTTTT GCCGACGCTG CGTTCGGTCG TGGTCAAAAC

501  GTCGGCGCGC GGTTCGCTGG CGCGGGCGGA AGTGCCCGTC GAAATCCGCG

551  AATCCTTAAG CGGGATTTTC GCCGGCCGCT TCAGCCTTGA CGGTTTGAAG

601  GAAGGCGATG CCGTGCGCCT GATGTACGAC AGCCTGTATT TCCACGGGCA

651  GCAGGTGGCG GCGGGCGATA TTTTGGCGGC TGAAGTCGTT AAGGGCGGCA

701  CAAGGCATCA GGCGTTCTAT TACCGTTCGG ACAAGGAAGG CGGAGGGGGC

751  GGCAATTATT ATGATGAAGA CGGCAAGGTG TTGCAGGAAA AAGGCGGCTT

801  CAACATCGAG CCGCTGGTCT ATACGCGCAT TTCTTCGCCG TTCGGCTACC

851  GTATGCACCC CATCCTGCAC ACATGGCGGC TGCACACGGG CATCGATTAT

901  GCCGCACCGC AGGGAACGCC GGTCAGGGCT TCCGCCGACG GCGTGATTAC

951  CTTTAAAGGC CGGAAGGGCG GATACGGCAA CGCGGTGATG ATACGCCACG

1001  CCAACGGTGT GGAAACGCTG TACGCGCACT TGAGCGCGTT TTCGCAGGCG

1051  GAAGGCAATG TGCGCGGCGG CGAGGTCATC GGTTTTGTCG GTTCGACCGG

1101  GCGTTCGACC GGGCCGCACC TGCATTACGA GGCGCGCATC AACGGGCAGC

1151  CCGTCAATCC TGTTTCGGTC GCATTGCCGA CACCGGAATT GACGCAGGCG

1201  GACAAGGCGG CGTTTGCCGC GCAGAAACAG AAGGCGGACG CGCTGCTTGC

1251  GCGCTTGCGC GGCATACCGG TTACCGTGTC GCAATCGGAT TGA
```

This corresponds to the amino acid sequence <SEQ ID 1238; ORF 297>:

```
m297.pep

1  MAVFPLSAKH RKYALRALAV SIILVSAAYI ASTERTERVR PQRVEQNLPP

51  LSWGGSGVQT AYWVQEAVQP GDSLADVLAR SGMARDEIAR ITEKYGGEAD

101  LRHLRADQSV HVLVGGDGGA REVQFFTDED GERNLVALEK KGGIWRRSAS

151  EADMKVLPTL RSVVVKTSAR GSLARAEVPV EIRESLSGIF AGRFSLDGLK

201  EGDAVRLMYD SLYFHGQQVA AGDILAAEVV KGGTRHQAFY YRSDKEGGGG

251  GNYYDEDGKV LQEKGGFNIE PLVYTRISSP FGYRMHPILH TWRLHTGIDY

301  AARQGTPVRA SADGVITFKG RKGGYGNAVM IRHANGVETL YAHLSAFSQA

351  EGNVRGGEVI GFVGSTGRST GPHLHYEARI NGQPVNPVSV ALPTPELTQA

401  DKAAFAAQKQ KADALLARLR GIPVTVSQSD * m297/g297  97.9% identity in 430 aa overlap 10         20         30         40         50         60
m297.pep  MAVFPLSAKHRKYALRALAVSIILVSAAYIASTERTERVRPQRVEQNLPPLSWGGSGVQT
          |||||||||||||||||||||||||||||||||||||| |||||||||||:|||||| |||
g297      MAVFPLSAKHRKYALRALAVSIILVSAAYIASTEGTERVRPQRVEQKLPPLSWGGNGVQT
                10         20         30         40         50         60

70         80         90        100        110        120
m297.pep  AYWVQEAVQPGDSLADVLARSGMARDEIARITEKYGGEADLRHLRADQSVHVLVGGDGGA
          |||||||||||||||||||||||||||||||||||||||||||||||||||||||||:|
g297      AYWVQEAVQPGDSLADVLARSGMARDEIARITEKYGGEADLRHLRADQSVHVLVGGDGSA
                70         80         90        100        110        120

130        140        150        160        170        180
m297.pep  REVQFFTDEDGERNLVALEKKGGIWRRSASEADMKVLPTLRSVVVKTSARGSLARAEVPV
          ||||||||||||||||||||||||||||||:|||||||||||||||||||||||||||||
g297      REVQFFTDEDGERNLVALEKKGGIWRRSASDADMKVLPTLRSVVVKTSARGSLARAEVPV
               130        140        150        160        170        180
```

```
                   190        200        210        220        230        240
m297.pep   EIRESLSGIFAGRFSLDGLKEGDAVRLMYDSLYFHGQQVAAGDILAAEVVKGGTRHQAFY
           ||||||||||||||||||||||||||:|||||||||||||||||||||||||| ||||
g297       EIRESLSGIFAGRFSLDGLKEGDAVRLLYDSLYFHGQQVAAGDILAAEVVKGGTTHQAFY
                   190        200        210        220        230        240

250        260        270        280        290        300
m297.pep   YRSDKEGGGGGNYYDEDGKVLQEKGGFNIEPLVYTRISSPFGYRMHPILHTWRLHTGIDY
           ||||||||||||||||||||:|||||||||||||||||||||||||||||||||||||||
g297       YRSDKEGGGGGNYYDEDGRVLQEKGGFNIEPLVYTRISSPFGYRMHPILHTWRLHTGIDY
                   250        260        270        280        290        300

310        320        330        340        350        360
m297.pep   AAPQGTPVRASADGVITFKGRKGGYGNAVMIRHANGVETLYAHLSAFSQAEGNVRGGEVI
           |||||||||||||||||||||||||||||||||||||||||||||||||:|||||||||
g297       AAPQGTPVRASADGVITFKGRKGGYGNAVMIRHANGVETLYAHLSAFSQAQGNVRGGEVI
                   310        320        330        340        350        360

370        380        390        400        410        420
m297.pep   GFVGSTGRSTGPHLHYEARINGQPVNPVSVALPTPELTQADKAAFAAQKQKADALLARLR
           ||||||||||||||||||||||||||||||||||||||||||||||||||||||||||||
g297       GFVGSTGRSTGPHLHYEARINGQPVNPVSVALPTPELTQADKAAFAAQKQKADALLARLR
                   370        380        390        400        410        420

430
m297.pep   GIPVTVSQSDX
           |||||||||||
g297       GIPVTVSQSDX
                   430
```

The following partial DNA sequence was identified in *N. meningitidis* <SEQ ID 1239>:

```
a297.seq.
    1 ATGGCTGTCT TCCCACTTTC GGCAAAACAT CGGAAATACG CGCTGCGCGC

51 GCTTGCCGTT TCGATTATTT TGGTGTCGGC GGCATACATT GCTTCGACAG

101 AGAGGACGGA GCGCGTCAGA CCGCAGCGCG TGGAACAAAA ACTGCCGCCG

151 CTGTCTTGGG GCGGCAGCGG TGTTCAGACG GCATATTGGG TGCAGGAGGC

201 GGTGCAGCCA GGCGACTCGC TGGCGGACGT GCTGGCGCGT TCGGGTATGG

251 CGCGGGACGA AATTGCCCGA ATAACGGAAA AATATGGCGG CGAAGCCGAT

301 TTGCGGCATT TGCGTGCCGA CCAGTCGGTT CATGTTTTGG TCGGCGGCGA

351 CGGCGGCGCG CGCGAAGTGC AGTTTTTTAC CGACGAAGAC GGCGAGCGCA

401 ATCTGGTCGC TTTGGAAAAA AAAGGCGGCA TATGGCGGCG GTCGGCTTCT

451 GAGGCGGATA TGAAGGTTTT GCCGACGCTG CGTTCGGTCG TGGTCAAAAC

501 GTCGGCGCGC GGTTCGCTGG CGCGGGCGGA AGTGCCCGTC GAAATTCGCG

551 AATCCTTAAG CGGGATTTTC GCCGGCCGCT TCAGCCTTGA TGGTTTGAAG

601 GAAGGCGATG CCGTGCGCCT GATTTACGAC AGCCTGTATT TCCACGGGCA

651 GCAGGTGGCG GCGGGCGATA TTCTGGCGGC GGAAGTCGTT AAGGGCGGCA

701 CAAGGCATCA GGCGTTCTAT TACCGTTCGG ACAAGGAAGG AGGAGGGGGC

751 GGCAATTATT ACGATGAAGA CGGCAGGGTG TTGCAGGAAA AAGGCGGCTT

801 CAACATCGAG CCACTGGTCT ATACGCGCAT TTCTTCGCCG TTCGGCTACC

851 GTATGCACCC CATCCTGCAC ACTTGGCGGC TGCACACGGG CATCGATTAT

901 GCCGCACCGC AGGGAACGCC GGTCAGGGCT TCCGCCGACG GCGTGATTAC

951 CTTTAAAGGC CGGAAGGGTG GCTACGGCAA CGCGGTGATG ATACGCCACG

1001 CCAACGGTGT GGAAACGCTG TATGCGCACT TGAGCGCGTT TTCTCAGGCA

1051 GAAGGCAATG TGCGCGGCGG CGAGGTCATC GGTTTTGTCG GTTCGACCGG

1101 GCGTTCGACG GGGCCGCACC TGCATTACGA GGCGCGCATC AATGGGCAGC

1151 CCGTCAATCC TGTTTCGGTC GCATTGCCGA CACCCGAATT GACGCAGGCG
```

-continued

```
1201 GACAAGGCGG CGTTTGCCGC GCAGAAACAG AAGGCGGACG CGCTGCTTGC

1251 GCGCTTGCGC GGCATACCGG TTACCGTGTC GCAATCGGAT TGA
```

This corresponds to the amino acid sequence <SEQ ID 1240; ORF 297.a>:

```
a297.pep
  1 MAVFPLSAKH RKYALRALAV SIILVSAAYI ASTERTERVR PQRVEQKLPP

51 LSWGGSGVQT AYWVQEAVQP GDSLADVLAR SGMARDEIAR ITEKYGGEAD

101 LRHLRADQSV HVLVGGDGGA REVQFFTDED GERNLVALEK KGGIWRRSAS

151 EADMKVLPTL RSVVVKTSAR GSLARAEVPV EIRESLSGIF AGRFSLDGLK

201 EGDAVRLIYD SLYFHGQQVA AGDILAAEVV KGGTRHQAFY YRSDKEGGGG

251 GNYYDEDGRV LQEKGGFNIE PLVYTRISSP FGYRMHPILH TWRLHTGIDY

301 AAPQGTPVRA SADGVITFKG RKGGYGNAVM IRHANGVETL YAHLSAFSQA

351 EGNVRGGEVI GFVGSTGRST GPHLHYEARI NGQPVNPVSV ALPTPELTQA

401 DKAAFAAQKQ KADALLARLR GIPVTVSQSD *
``` m297/a297 99.3% identity in 430 aa overlap

```
                  10         20         30         40         50         60
m297.pep  MAVFPLSAKHRKYALRALAVSIILVSAAYIASTERTERVRPQRVEQNLPPLSWGGSGVQT
          ||||||||||||||||||||||||||||||||||||||||||||||:|||||||||||||
a297      MAVFPLSAKHRKYALRALAVSIILVSAAYIASTERTERVRPQRVEQKLPPLSWGGSGVQT
                  10         20         30         40         50         60

70         80         90        100        110        120
m297.pep  AYWVQEAVQPGDSLADVLARSGMARDEIARITEKYGGEADLRHLRADQSVHVLVGGDGGA
          ||||||||||||||||||||||||||||||||||||||||||||||||||||||||||||
a297      AYWVQEAVQPGDSLADVLARSGMARDEIARITEKYGGEADLRHLRADQSVHVLVGGDGGA
                  70         80         90        100        110        120

130        140        150        160        170        180
m297.pep  REVQFFTDEDGERNLVALEKKGGIWRRSASEADMKVLPTLRSVVVKTSARGSLARAEVPV
          ||||||||||||||||||||||||||||||||||||||||||||||||||||||||||||
a297      REVQFFTDEDGERNLVALEKKGGIWRRSASEADMKVLPTLRSVVVKTSARGSLARAEVPV
                 130        140        150        160        170        180

190        200        210        220        230        240
m297.pep  EIRESLSGIFAGRFSLDGLKEGDAVRLMYDSLYFHGQQVAAGDILAAEVVKGGTRHQAFY
          |||||||||||||||||||||||||||:||||||||||||||||||||||||||||||||
a297      EIRESLSGIFAGRFSLDGLKEGDAVRLLYDSLYFHGQQVAAGDILAAEVVKGGTRHQAFY
                 190        200        210        220        230        240

250        260        270        280        290        300
m297.pep  YRSDKEGGGGGNYYDEDGKVLQEKGGFNIEPLVYTRISSPFGYRMHPILHTWRLHTGIDY
          ||||||||||||||||||:|||||||||||||||||||||||||||||||||||||||||
a297      YRSDKEGGGGGNYYDEDGRVLQEKGGFNIEPLVYTRISSPFGYRMHPILHTWRLHTGIDY
                 250        260        270        280        290        300

310        320        330        340        350        360
m297.pep  AAPQGTPVRASADGVITFKGRKGGYGNAVMIRHANGVETLYAHLSAFSQAEGNVRGGEVI
          ||||||||||||||||||||||||||||||||||||||||||||||||||||||||||||
a297      AAPQGTPVRASADGVITFKGRKGGYGNAVMIRHANGVETLYAHLSAFSQAEGNVRGGEVI
                 310        320        330        340        350        360

370        380        390        400        410        420
m297.pep  GFVGSTGRSTGPHLHYEARINGQPVNPVSVALPTPELTQADKAAFAAQKQKADALLARLR
          ||||||||||||||||||||||||||||||||||||||||||||||||||||||||||||
a297      GFVGSTGRSTGPHLHYEARINGQPVNPVSVALPTPELTQADKAAFAAQKQKADALLARLR
                 370        380        390        400        410        420

430
m297.pep  GIPVTVSQSDX
          |||||||||||
a297      GIPVTVSQSDX
                 430
```

The following partial DNA sequence was identified in *N. gonorrhoeae* <SEQ ID 1241>:

```
g298.seq.
    1 ATGAAAAACT TTCTTTCCCT TTTCGCCTCC ATACTGATGT CTGCCCTGAT

51 TGCCGTGTGG TTCAGCCAAA ACCCCATCAA CGCCTACTGG CAGCAGACCT

101 ACCACCGCAA CAGCCCGCTC GAACCGCTTG CCGCCTACGG ATGGTGGCGG

151 AGCGGAGCGG CGTTGCAAGA AAACGCCTAC GCCCTTTCAG ACGGCATCAA

201 AACCTTCCTG TCCGGCGAAA cgccccccac ggCTCAAGAC GGCGGTTCGG

251 CAGATATGCC GCCTGAAGCC GCCGCATCCG AAGCCGCCCC GCCGGCCGGC

301 GGAACAGAAT GGAAACAAGG CACCGAAGCC GCCGCCGTCC GCAGCGGCGA

351 CAAAGTCTTT TTCGCCGGAG ATTCGCTGAT GCAGGGCGTT GCGCCTTTCG

401 TGCAAAAAAG CCTGAAACAG CAATACGGCA TCGAATCCGC CAACCTCAGC

451 AAACAAAGCA CGGGGCTTTC CTATCCCTCA TTCTTCGACT GGCCGAAAAC

501 GATTGAAGAA ACCTTGAAAA AACATCCCGA AATCAGCGTA CTCGCCGTCT

551 TCCTCGGCCC GAACGACCCG TGGGATTTCC CCGTCGGCAA ACGCTACCTC

601 AAATTCGCTT CCGACGAATG GGCGCAAGAA TACCTGAAAC GCGTCGACCG

651 CATCCTTGAA GCCGCACACA CGCACCGCGT CCAAGTCGTC TGGCTCGGCA

701 TCCCCTACAT GAAAAAAGTC AAGCTCGACG GTCAGATGCG CTACCTCGAC

751 AAACTGCTTT CGGAACACTT GAAAGGCAAA ATCATCCTGA TTCCCACCGC

801 GCAAACACTG AGCGGCGGGA AAGgccGCTA CACCGATTCC GTCAACGTCA

851 ACGGCAAACC CGTCCGCTAC CGCAGTAAGG ACGGCATACA CTTTACCGCC

901 GAAGGACAAA AACTGCTGGC GGAAAAAATA ATGGAAAAAA TCGTTTTTGA

951 ACCGAGTACG CAACCATCAA GTACACAGCC ATGA
```

This corresponds to the amino acid sequence <SEQ ID 1242; ORF 298.ng>:

```
g298.pep
    1 MKNFLSLFAS ILMSALIAVW FSQNPINAYW QQTYHRNSPL EPLAAYGWWR

51 SGAALQENAY ALSDGIKTFL SGETPPTAQD GGSADMPPEA AASEAAPPAG

101 GTEWKQGTEA AAVRSGDKVF FAGDSLMQGV APFVQKSLKQ QYGIESANLS

151 KQSTGLSYPS FFDWPKTIEE TLKKHPEISV LAVFLGPNDP WDFPVGKRYL

201 KFASDEWAQE YLKRVDRILE AAHTHRVQVV WLGIPYMKKV KLDGQMRYLD

251 KLLSEHLKGK IILIPTAQTL SGGKGRYTDS VNVNGKPVRY RSKDGIHFTA

301 EGQKLLAEKI MEKIVFEPST QPSSTQP*
```

The following partial DNA sequence was identified in *N. meningitidis* <SEQ ID 1243>:

```
m298.seq.
    1 ATGAAAAACT TTCTTTCCCT TTTCTCCTCC ATACTGATGT CTGCCCTGAT

51 TGCCGTGTGG TTCAGCCAAA ACCCCATCAA CGCCTACTGG CAGCAGACCT

101 ACCACCGCAA CAGCCCGCTC GAACCGCTTG CCGCCTACGG ATGGTGGCGG

151 AGCGGTGCGG CGTTGCAAGA AAACGCCTAC GCCCTTTCAG ACGGCATCAA

201 AGCCTTCCTG TCCGGCGAAA CGCCGCCGAC GGCTCAAGAC GGCGGTTCGG
```

```
251 CAGATATGCC GTCTGAAGCC GCCGCATCCG AAGCCGTCCC TCAAACCGGT

301 GAAACAGAAT GGAAACAAGA CACCGAAGCC GCCGCCGTCC GCAGCGGCGA

351 CAAAGTCTTT TTTGTCGGCG ACTCGCTGAT GCAGGGCGTT GCCCCCTTCG

401 TGCAAAAAAG CCTGAAACAG CAATACGGCA TCGAATCCGT CAACCTCAGC

451 AAACAAAGCA CGGGGCTGTC CTACCCCTCA TTCTTCGACT GGCCGAAAAC

501 GATTGAAGAA ACCCTGCAAA AACATCCCGA AATCAGCGTA CTCGCCGTCT

551 TCCTCGGACC GAACGACCCG TGGGATTTCC CCGTCGGCAA ACTCTATCTC

601 AAATTCGCTT CCGACGAATG GGCGCAAGAA TACCTGAAAC GTGTCGACCG

651 CATCCTTGAA GCCGCACACA CGCACCGCGT CCAAGTCGTC TGGCTCGGCA

701 TCCCCTACAT GAAAAAAGCC AAGCTCGACG GACAGATGCG CTACCTAGAC

751 AAACTGCTTT CGGAACATTT GAAAGGCAAA ATCATCCTGA TTCCCACCAC

801 GCACACCCTG AGCGGCGGGA AAGACCGCTA CACCGACTCC GTCAACGTCA

851 ACGGCAAACC CGTCCGCTAC CGCAGCAAGG ACGGCATACA CTTTACCGCC

901 GAAGGACAAA AACTGCTGGC GGCAAAAATA ATGGAAAAAA TCGTTTTTGA

951 ACCAAGTACG CAACCATCAA GTACACAGCC ATGA
```

This corresponds to the amino acid sequence <SEQ ID 1244; ORF 298>:

```
m298.pep

1   MKNFLSLFSS ILMSALIAVW FSQNPINAYW QQTYHRNSPL EPLAAYGWWR

51   SGAALQENAY ALSDGIKAFL SGETPPTAQD GGSADMPSEA AASEAVPQTG

101   ETEWKQDTEA AAVRSGDKVF FVGDSLMQGV APFVQKSLKQ QYGIESVNLS

151   KQSTGLSYPS FFDWPKTIEE TLQKHPEISV LAVFLGPNDP WDFPVGKLYL

201   KFASDEWAQE YLKRVDRILE AAHTHRVQVV WLGIPYMKKA KLDGQMRYLD

251   KLLSEHLKGK IILIPTTHTL SGGKDRYTDS VNVNGKPVRY RSKDGIHFTA

301   EGQKLLAAKI MEKIVFEPST QPSSTQP* m298/g298  94.8% identify in 327 aa overlap 10         20         30         40         50         60
     m298.pep  MKNFLSLFSSILMSALIAVWFSQNPINAYWQQTYHRNSPLEPLAAYGWWRSGAALQENAY
               ||||||||:|||||||||||||||||||||||||||||||||||||||||||||||||||
         g298  MKNFLSLFASILMSALIAVWFSQNPINAYWQQTYHRNSPLEPLAAYGWWRSGAALQENAY
                      10         20         30         40         50         60

70         80         90        100        110        120
     m298.pep  ALSDGIKAFLSGETPPTAQDGGSADMPSEAAASEAVPQTGETEWKQDTEAAAVRSGDKVF
               |||||||:||||||||||||||||||||:|||||:| :||||||||||:|||||||||||
         g298  ALSDGIKTFLSGETPPTAQDGGSADMPPEAAASEAPPAGGTEWKQGTEAAAVRSGDKVF
                      70         80         90        100        110        120

130        140        150        160        170        180
     m298.pep  FVGDSLMQGVAPFVQKSLKQQYGIESVNLSKQSTGLSYPSFFDWPKTIEETLQKHPEISV
               |:||||||||||||||||||||||:|||||||||||||||||||||||||||:||||||
         g298  FAGDSLMQGVAPFVQKSLKQQYGIESANLSKQSTGLSYPSFFDWPKTIEETLKKHPEISV
                     130        140        150        160        170        180

190        200        210        220        230        240
     m298.pep  LAVFLGPNDPWDFPVGKLYLKFASDEWAQEYLKRVDRILEAAHTHRVQVVWLGIPYMKKA
               |||||||||||||||||:||||||||||||||||||||||||||||||||||||||||:
         g298  LAVFLGPNDPWDFPVGKRYLKFASDEWAQEYLKRVDRILEAAHTHRVQVVWLGIPYMKKV
                     190        200        210        220        230        240

250        260        270        280        290        300
     m298.pep  KLDGQMRYLDKLLSEHLKGKIILIPTTHTLSGGKDRYTDSVNVNGKPVRYRSKDGIHFTA
               |||||||||||||||||||||||||||::||||||| |||||||||||||||||||||||
         g298  KLDGQMRYLDKLLSEHLKGKIILIPTAQTLSGGKGRYTDSVNVNGKPVRYRSKDGIHFTA
                     250        260        270        280        290        300
```

```
                  310        320
m298.pep   EGQKLLAAKIMEKIVFEPSTQPSSTQPX
           ||||||||| ||||||||||||||||||
g298       EGQKLLAEKIMEKIVFEPSTQPSSTQPX
                  310        320
```

The following partial DNA sequence was identified in *N. meningitidis* <SEQ ID 1245>:

```
a298.seq.
    1 ATGAAAAACT TTCTTTCCCT TTTCGCCTCC ATACTGATGT CTGCCCTGAT

51 TGCCGTGTGG TTCAGCCAAA ACCCCATCAA CGCCTACTGG CAGCAGACCT

101 ACCACCGCAA CAGCCCGCTC GAACCGCTTG CCGCCTACGG ATGGTGGCGG

151 AGCGGTGCGG CATTGCAAGA AAACGCCTAC GCCCTTTCAG ACGGCATCAA

201 AGCCTTCCTG TCCGGCGAAA CGCCGCCGAC GGCTCAAGAC GGCGGTTCGG

251 CAGATATGCC GTCTGAAGCC GCCGCACCCG AAACCGCCCC TCAAACTGGC

301 GAAACAGAAT GGAAACAAAA CACCGAAGCC GCCGCCGTCC GAACAGGGGA

351 CAAAGTCTTT TTCGCCGGCG ACTCGCTGAT GCAGGGCGTT GCACCCTTCG

401 TGCAAAAAAG CCTGAAACAG CAATACGGCA TCGAATCCGT CAACCTCAGC

451 AAACAAAGCA CGGGGCTGTC CTACCCCTCA TTCTTCGACT GGCCGAAAAC

501 GATTGAAGAA ACCCTGAAAA AACATCCCGA AATCAGCGTG CTCGCCGTCT

551 TCCTCGGTCC GAACGACCCG TGGGATTTCC CCGTTGGCAA ACGCTACCTC

601 AAATTCGCTT CCGACGAATG GGCGCAAGAA TACCTGAAAC GCGTCGACCG

651 CATCCTTGAA GCCGCACACA CGCACTACGT CCAAGTCGTC TGGCTCGGCA

701 TCCCCTACAT GAAAAAAGCC AAGCTCGACG GACAGATGCG CTACCTAGAC

751 AAACTGCTTT CGGAATATTT GAAAGGCAAA ATCATCCTGA TTCCCACCGC

801 GCACACCCTG AGCGGCGGGA AGACCGCTA CACCGACTCC GTCAACGTCA

851 ACGGCAAACC CGTCCGCTAC CGCAGCAAGG ACGGCATACA CTTTACCGCC

901 GAAGGACAAA AACTGCTGGC GGCAAAAATA ATGGAAAAAA TCGTTTTTGA

951 ACCAAGTACG CAACCATCAA GTACACAGCC ATGA
```

This corresponds to the amino acid sequence <SEQ ID 1246; ORF 298.a>:

```
a298.pep
    1 MKNFLSLFAS ILMSALIAVW FSQNPINAYW QQTYHRNSPL EPLAAYGWWR

51 SGAALQENAY ALSDGIKAFL SGETPPTAQD GGSADMPSEA AAPETAPQTG

101 ETEWKQNTEA AAVRTGDKVF FAGDSLMQGV APFVQKSLKQ QYGIESVNLS

151 KQSTGLSYPS FFDWPKTIEE TLKKHPEISV LAVFLGPNDP WDFPVGKRYL

201 KFASDEWAQE YLKRVDRILE AAHTHYVQVV WLGIPYMKKA KLDGQMRYLD

251 KLLSEYLKGK IILIPTAHTL SGGKDRYTDS VNVNGKPVRY RSKDGIHFTA

301 EGQKLLAAKI MEKIVFEPST QPSSTQP*
``` m298/a298 96.3% identity in 327 aa overlap

```
              10         20         30         40         50         60
m298.pep  MKNFLSLFSSILMSALIAVWFSQNPINAYWQQTYHRNSPLEPLAAYGWWRSGAALQENAY
          ||||||||:|||||||||||||||||||||||||||||||:||||||||||||||||||
a298      MKNFLSLFASILMSALIAVWFSQNPINAWQQTYHRNSPKLEPLAAYGWWRSGAALQENAY
              10         20         30         40         50         60

70         80         90        100        110        120
m298.pep  ALSDGIKAFLSGETPPTAQDGGSADMPSEAAASEAVPQTGETEWKQDTEAAAVRSGDKVF
          |||||||||||||||||||||||||||||||||| ::|||||||||:||||||:||||
a298      ALSDGIKAFLSGETPPTAQDGGSADMPSEAAAPETAPQTGETEWKQNTEAAAVRTGDKVF
              70         80         90        100        110        120

130        140        150        160        170        180
m298.pep  FVGDSLMQGVAPFVQKSLKQQYGIESVNLSKQSTGLSYPSFFDWPKTIEETLQKHPEISV
          |:||||||||||||||||||||||||||||||||||||||||||||||||||:||||||
a298      FAGDSLMQGVAPFVQKSLKQQYGIESVNLSKQSTGLSYPSFFDWPKTIEETLKKHPEISV
             130        140        150        160        170        180

190        200        210        220        230        240
m298.pep  LAVFLGPNDPWDFPVGKLYLKFASDEWAQEYLKRVDRILEAAHTHRVQVVWLGIPYMKKA
          ||||||||||||||||| ||||||||||||||||||||||||||| |||||||||||||
a298      LAVFLGPNDPWDFPVGKRYLKFASDEWAQEYLKRVDRILEAAHTHYVQVVWLGIPYMKKA
             190        200        210        220        230        240

250        260        270        280        290        300
m298.pep  KLDGQMRYLDKLLSEHLKGKIILIPTTHTLSGGKDRYTDSVNVNGKPVRYRSKDGIHFTA
          |||||||||||||:|||||||||||:||||||||||||||||||||||||||||||||
a298      KLDGQMRYLDKLLSEYLKGKIILIPTAHTLSGGKDRYTDSVNVNGKPVRYRSKDGIHFTA
             250        260        270        280        290        300

310        320
m298.pep  EGQKLLAAKIMEKIVFEPSTQPSSTQPX
          ||||||||||||||||||||||||||||
a298      EGQKLLAAKIMEKIVFEPSTQPSSTQPX
             310        320
```

The following partial DNA sequence was identified in *N. gonorrhoeae* <SEQ ID 1247>:

```
g299.seq.
   1  ATGAACCCCA AACACTTCAT CGCATTTTCC GCCCTGTTCG CCGCCACGCA

51  GGCAGAAGCC CTGCCCGTCG CCTCCGTCAG CCCCGACACC GTTACCGTTT

101  CCCCGTCCGC CCCCTACACC GATACAAACG GGCTGCTGAC CGACTACGGC

151  AACGCCGCCG CCTCGCCTTG GATGAAAAAA CTCCGATCCG TCGCACAAGG

201  CAGCGGCGAG GCCTTCCGCA TCCTGCAAAT CGGCGACTCG CATACCGCCG

251  GCGACTTCTT TACCGACGCC CTGCGCAAAC GCCTGCAAAA AACATGGGC

301  GACGGCGGCA TAGGCTGGGT TTACCCCGCC AACGTCAAAG GCAGCGCAT

351  GGCGGCCGTC CGTCACAGCG GCAACTGGCA AAGCTTCACC AGCAGGAACA

401  ATACCGGAGA TTTCCCGCTC GGCGGCATCC TCGCCCAAAC CGGCAGCGGC

451  GGCGGCATGA CCCTGACCGC GTCTGACGGC AAAACCGGCA ACAGCGCGT

501  TTCCCTGTTT GCCAAACCGC TGCTCGCCGA CAAACCCTG ACCGTCAACG

551  GCAACACCGT CTCCGCCAAC GGCGGCGGCT GGCAGGTACT GGATACGGGC

601  GCGGCACTGC CCCTGGCCAT ACAGACCGAA ATGCCGTGGG ACATCGGCTT

651  CATCAACATC GAAAATCCCG CCGGCGGCAT TACCGTTTCC GCGATGGGCA

701  TCAACGGCGC ACAATTGACC CAGTGGTCGA ATGGCGTGC CGACCGTATG

751  AACGACCTTG CCCAAACCGG CGCCGATTTG GTTATCCTTT CCTACGGCAC

801  CAACGAAGCC TTCAACAACA ACATCGACAT TGCCGATACC GAACAAAAAT

851  GGCTGGATAC CGTCCGCCAA ATCCGCGACA GCCTGCCCGC CGCCGGCATC
```

-continued

```
 901 CTCATCATCG GCGCGCCCGA ATCCCTGAAA AACACGCTCG GCGTATGCGG

951 CACGCGCCCC GTCCTCCTGA CCGAAGTCCA ACAGATGCAG CGGCGCGTCG

1001 CCCGTCAGGG GCAGACGATG TTTTGGTCTT GGCAAAACGC AATGGGCGGC

1051 ATATGCAGCA TGAAAAACTG GCTCAACCAA GGATGGGCCG CCAAAGACGG

1101 CGTACACTTC TCCGCCCAAG GCTACCGGCG CGCGGCGGAA ATGCTTGCCG

1151 ACAGCCTCGA AGAACTCGTC CGCGCCGCCG CAATCAGGCA ATAA
```

This corresponds to the amino acid sequence <SEQ ID 1248; ORF 299.ng>:

```
g299.pep
  1 MNPKHFIAFS ALFAATQAEA LPVASVSPDT VTVSPSAPYT DTNGLLTDYG

51 NAAASPWMKK LRSVAQGSGE AFRILQIGDS HTAGDFFTDA LRKRLQKTWG

101 DGGIGWVYPA NVKGQRMAAV RHSGNWQSFT SRNNTGDFPL GGILAQTGSG

151 GGMTLTASDG KTGKQRVSLF AKPLLAEQTL TVNGNTVSAN GGGWQVLDTG

201 AALPLAIQTE MPWDIGFINI ENPAGGITVS AMGINGAQLT QWSKWRADRM

251 NDLAQTGADL VILSYGTNEA FNNNIDIADT EQKWLDTVRQ IRDSLPAAGI

301 LIIGAPESLK NTLGVCGTRP VLLTEVQQMQ RRVARQGQTM FWSWQNAMGG

351 ICSMKNWLNQ GWAAKDGVHF SAQGYRRAAE MLADSLEELV RAAAIRQ*
```

The following partial DNA sequence was identified in *N. meningitidis* <SEQ ID 1249>:

```
m299.seq
  1 ATGAACCCCA ACACCTCAT CGCATTTTCC GCCCTATTCG CCGCCACGCA

51 GGCAGAAGCC CTACCTGTCG CCTCCGTCAG CCTCGACACC GTTACCGTTT

101 CCCCGTCCGC CCCCTACACC GATACAAACG GGCTGCTGAC CGACTACGGC

151 AACGCCTCCG CCTCGCCTTG GATGAAAAAA CTCCAATCCG TCGCACAAGG

201 CAGCGGCGAG ACCTTCCGTA TCCTGCAAAT CGGCGACTCG CATACCGCCG

251 GCGACTTCTT TACCGACAGC CTGCGCAAAC GCCTGCAAAA AACTTGGGGC

301 GACGGCGGCA TAGGCTGGGT TTACCCCGCC AACGTCAAAG GGCAGCGCAT

351 GGCGGCCGTC CGGCACAACG GTAACTGGCA AAGCCTCACC AGCAGGAACA

401 ACACCGGAGA CTTCCCGCTC GGCGGCATCC TCGCCCACAC CGGCAGCGGC

451 GGCAGCATGA CCCTGACCGC ATCGGACGGC ATAGCAAGCA AGCAGCGCGT

501 TTCCCTGTTT GCCAAACCCC TGCTTGCCGA ACAAACCCTG ACCGTCAACG

551 GCAACACCGT CTCCGCCAAC GGCGGCGGCT GGCAGGTACT GGATACGGGC

601 GCGGCACTGC CCCTGACCAT ACACACCGAA ATGCCGTGGG ACATCGGCTT

651 CATCAACATC GAAAATCCCG CCGGCGGCAT TACCGTTTCC GCGATGGGCA

701 TCAACGGCGC ACAATTAACC CAGTGGTCGA AATGGCGTGC CGACCGTATG

751 AACGACCTCG CCCAAACCGG CGCCGATTTG GTTATCCTTT CCTACGGCAC

801 CAACGAAGCT TTCAACAACA ACATCGACAT TGCCGACACC GAACAAAAAT

851 GGCTGGATAC CGTCCGCCAA ATCCGCGACA GCCTGCCTGC CGCCGGCATC

901 CTCATCATCG GCGCACCCGA ATCCCTGAAA AACACGCTCG GCGTATGCGG

951 CACACGCCCC GTCCGCCTGA CCGAAGTCCA ACAGATGCAG CGGCGCGTCG
```

-continued

```
1001 CCCGTCAGGG GCAGACGATG TTCTGGTCTT GGCAAAACGC CATGGGCGGC

1051 ATATGCAGCA TGAAAAACTG GCTCAACCAA GGATGGGCCG CCAAAGACGG

1101 CGTACACTTC TCCGCCAAAG GCTACCGGCG CGCGGCGGAA ATGCTCGCCG

1151 ACAGCCTCGA AGAACTCGTC CGCTCCGCTG CAATCAGGCA ATAA
```

This corresponds to the amino acid sequence <SEQ ID 1250; ORF 299>:

```
m299.pep

1  MNPKHLIAFS ALFAATQAEA LPVASVSLDT VTVSPSAPYT DTNGLLTDYG

51  NASASPWMKK LQSVAQGSGE TFRILQIGDS HTAGDFFTDS LRKRLQKTWG

101  DGGIGWVYPA NVKGQRMAAV RHNGNWQSLT SRNNTGDFPL GGILAHTGSG

151  GSMTLTASDG IASKQRVSLF AKPLLAEQTL TVNGNTVSAN GGGWQVLDTG

201  AALPLTIHTE MPWDIGFINI ENPAGGITVS AMGINGAQLT QWSKWRADRM

251  NDLAQTGADL VILSYGTNEA FNNNIDIADT EQKWLDTVRQ IRDSLPAAGI

301  LIIGAPESLK NTLGVCGTRP VRLTEVQQMQ RRVARQGQTM FWSWQNAMGG

351  ICSMKNWLNQ GWAAKDGVHF SAKGYRRAAE MLADSLEELV RSAAIRQ* m299/g299  95.5% identity in 397 aa overlap 10         20         30         40         50         60
m299.pep  MNPKHLIAFSALFAATQAEALPVASVSLDTVTVSPSAPYTDTNGLLTDYGNASASPWMKK
          |||||:||||||||||||||||||||| |||||||||||||||||||||||||:||||||
g299      MNPKHFIAFSALFAATQAEALPVASVSPDTVTVSPSAPYTDTNGLLTDYGNAAASPWMKK
                  10         20         30         40         50         60

70         80         90        100        110        120
m299.pep  LQSVAQGSGETFRILQIGDSHTAGDFFTDSLRKRLQKTWGDGGIGWVYPANVKGQRMAAV
          |:||||||||:|||||||||||||||||||:|||||||||||||||||||||||||||||
g299      LRSVAQGSGEAFRILQIGDSHTAGDFFTDALRKRLQKTWGDGGIGWVYPANVKGQRMAAV
                  70         80         90        100        110        120

130        140        150        160        170        180
m299.pep  RHNGNWQSLTSRNNTGDFPLGGILAHTGSGGSMTLTASDGIASKQRVSLFAKPLLAEQTL
          ||:|||||:|||||||||||||||| |:||||:|||||||||  ::|||||||||||||||
g299      RHSGNWQSFTSRNNTGDFPLGGILAQTGSGGGMTLTASDGKTGKQRVSLFAKPLLAEQTL
                 130        140        150        160        170        180

190        200        210        220        230        240
m299.pep  TVNGNTVSANGGGWQVLDTGAALPLTIHTEMPWDIGFINIENPAGGITVSAMGINGAQLT
          |||||||||||||||||||||||||:|:||||||||||||||||||||||||||||||||
g299      TVNGNTVSANGGGWQVLDTGAALPLAIQTEMPWDIGFINIENPAGGITVSAMGINGAQLT
                 190        200        210        220        230        240

250        260        270        280        290        300
m299.pep  QWSKWRADRMNDLAQTGADLVILSYGTNEAFNNNIDIADTEQKWLDTVRQIRDSLPAAGI
          ||||||||||||||||||||||||||||||||||||||||||||||||||||||||||||
g299      QWSKWRADRMNDLAQTGADLVILSYGTNEAFNNNIDIADTEQKWLDTVRQIRDSLPAAGI
                 250        260        270        280        290        300

310        320        330        340        350        360
m299.pep  LIIGAPESLKNTLGVCGTRPVRLTEVQQMQRRVARQGQTMFWSWQNAMGGICSMKNWLNQ
          ||||||||||||||||||||||:|||||||||||||||||||||||||||||||||||||
g299      LIIGAPESLKNTLGVCGTRPVLLTEVQQMQRRVARQGQTMFWSWQNAMGGICSMKNWLNQ
                 310        320        330        340        350        360

370        380        390
m299.pep  GWAAKDGVHFSAKGYRRAAEMLADSLEELVRSAAIRQX
          ||||||||||||:|||||||||||||||||:|||||||
g299      GWAAKDGVHFSAQGYRRAAEMLADSLEELVRAAAIRQX
                 370        380        390
```

The following partial DNA sequence was identified in *N. meningitidis* <SEQ ID 1251>:

```
a299.seq
    1  ATGAACCCCA AACACCTCAT CGCATTTTCC GCCCTATTCG CCGCCACGCA

51  GGCAGAAGCC CTACCTGTCG CCTCAGTCAG CCTCGACACC GTTACCGTTT
```

```
-continued
101 CCCCGTCCGC CCCCTACACC GATACAAACG GGCTGCTGAC CGACTACGGC

151 AACGCCTCCG CCTCGCCTTG GATGAAAAAA CTCCAATCCG TCGCACAAGG

201 CAGCGGCGAG ACCTTCCGTA TCCTGCAAAT CGGCGACTCG CATACCGCCG

251 GCGACTTCTT TACCGACAGC CTGCGCAAAC GCCTACAAAA AACTTGGGGC

301 GACGGCGGCA TAGGCTGGGT TTACCCCGCC AACGTCAAAG GGCAGCGCAT

351 GGCGGCCGTC CGGCACAACG GTAACTGGCA AAGCCTCACC AGCAGGAACA

401 ACACCGGAGA CTTCCCGCTC GGCGGCATCC TCGCCCACAC CGGCAGCGGC

451 GGCAGCATGA CCCTGACCGC ATCGGACGGC ATAGCAAGCA AGCAGCGCGT

501 TTCCCTGTTT GCCAAACCCC TGCTTGCCGA ACAAACCCTG ACCGTCAACG

551 GCAACACCGT CTCCGCCAAC GGCGGCGGCT GGCAGGTACT GGATACGGGC

601 GCGGCACTGC CCCTGACCAT ACACACCGAA ATGCCGTGGG ACATCGGCTT

651 CATCAACATC GAAATCCCG CCGGCGGCAT TACCGTTTCC GCGATGGGCA

701 TCAACGGCGC ACAATTAACC CAGTGGTCGA AATGGCGTGC CGACCGTATG

751 AACGACCTTG CCCAAACCGG CGCCGATCTA GTCATCCTTG CCTACGGTAC

801 CAACGAAGCC TTCGGCGACA ACATCGACAT TGCCGATACC GAACAGAAAT

851 GGCTGGATAC CGTCCGCCAA ATCCGCGACA GCCTACCTGC CGCCGGCATC

901 CTCATCATCG GCGCGCCCGA ATCCCTGAAA AACACGCTCG GCGTATGCGG

951 CACACGCCCC GTCCGCCTGA CCGAAGTCCA ACAGATGCAG CGGCGCATCG

1001 CCCGTCAGGG GCAGACGATG TTCTGGTCTT GGCAAAACGC GATGGGCGGC

1051 GTTTGCAGCA TGAAAAACTG GCTCAACCAC GGATGGGCCG CCAAAGACGG

1101 CGTACACTTT TCCGCCAAAG CTACCAACG GTCGGCGGAA ATGCTCGCCG

1151 ACAGCCTCGA AGAACTCGTC CGCTCCGCTG CAATCAGGCA ATAA
```

This corresponds to the amino acid sequence <SEQ ID 1252; ORF 299.a>:

```
a299.pep
  1 MNPKHLIAFS ALFAATQAEA LPVASVSLDT VTVSPSAPYT DTNGLLTDYG

51 NASASPWMKK LQSVAQGSGE TFRILQIGDS HTAGDFFTDS LRKRLQKTWG

101 DGGIGWVYPA NVKGQRMAAV RHNGNWQSLT SRNNTGDFPL GGILAHTGSG

151 GSMTLTASDG IASKQRVSLF AKPLLAEQTL TVNGNTVSAN GGGWQVLDTG

201 AALPLTIHTE MPWDIGFINI ENPAGGITVS AMGINGAQLT QWSKWRADRM

251 NDLAQTGADL VILAYGTNEA FGDNIDIADT EQKWLDTVRQ IRDSLPAAGI

301 LIIGAPESLK NTLGVCGTRP VRLTEVQQMQ RRIARQGQTM FWSWQNAMGG

351 VCSMKNWLNH GWAAKDGVHF SAKGYQRSAE MLADSLEELV RSAAIRQ*
``` m299/a299 98.0% identity in 397 aa overlap

```
                  10         20         30         40         50         60
     m299.pep  MNPKHLIAFSALFAATQAEALPVASVSLDTVTVSPSAPYTDTNGLLTDYGNASASPWMKK
               ||||||||||||||||||||||||||||||||||||||||||||||||||||||||||||
         a299  MNPKHLIAFSALFAATQAEALPVASVSLDTVTVSPSAPYTDTNGLLTDYGNASASPWMKK
                  10         20         30         40         50         60
```

```
                     70         80         90        100        110        120
m299.pep    LQSVAQGSGETFRILQIGDSHTAGDFFTDSLRKRLQKTWGDGGIGWVYPANVKGQRMAAV
            ||||||||||||||||||||||||||||||||||||||||||||||||||||||||||||
a299        LQSVAQGSGETFRILQIGDSHTAGDFFTDSLRKRLQKTWGDGGIGWVYPANVKGQRMAAV
                     70         80         90        100        110        120

130        140        150        160        170        180
m299.pep    RHNGNWQSLTSRNNTGDFPLGGILAHTGSGGSMTLTASDGIASKQRVSLFAKPLLAEQTL
            ||||||||||||||||||||||||||||||||||||||||||||||||||||||||||||
a299        RHNGNWQSLTSRNNTGDFPLGGILAHTGSGGSMTLTASDGIASKQRVSLFAKPLLAEQTL
                    130        140        150        160        170        180

190        200        210        220        230        240
m299.pep    TVNGNTVSANGGGWQVLDTGAALPLTIHTEMPWDIGFINIENPAGGITVSAMGINGAQLT
            ||||||||||||||||||||||||||||||||||||||||||||||||||||||||||||
a299        TVNGNTVSANGGGWQVLDTGAALPLTIHTEMPWDIGFINIENPAGGITVSAMGINGAQLT
                    190        200        210        220        230        240

250        260        270        280        290        300
m299.pep    QWSKWRADRMNDLAQTGADLVILSYGTNEAFNNNIDIADTEQKWLDTVRQIRDSLPAAGI
            |||||||||||||||||||||||||:|||||||::|||||||||||||||||||||||||
a299        QWSKWRADRMNDLAQTGADLVILAYGTNEAFGDNIDIADTEQKWLDTVRQIRDSLPAAGI
                    250        260        270        280        290        300

310        320        330        340        350        360
m299.pep    LIIGAPESLKNTLGVCGTRPVRLTEVQQMQRRVARQGQTMFWSWQNAMGGICSMKNWLNQ
            |||||||||||||||||||||||||||||||||:||||||||||||||||:|||||||:
a299        LIIGAPESLKNTLGVCGTRPVRLTEVQQMQRRIARQGQTMFWSWQNAMGGVCSMKNWLNH
                    310        320        330        340        350        360

370        380        390
m299.pep    GWAAKDGVHFSAKGYRRAAEMLADSLEELVRSAAIRQX
            |||||||||||||:|:|||||||||||||||||||||
a299        GWAAKDGVHFSAKGYQRSAEMLADSLEELVRSAAIRQX
                    370        380        390
```

The following partial DNA sequence was identified in *N. gonorrhoeae* <SEQ ID 1253>:

```
g302.seq
    1 ATGCACTCAA TATATTTTTT TAAGGAGAAG CAGATGAGTC AAACCGACGC

51 GCGTCGTAGC GGACGATTTT TACGCACAGT CGAATGGCTG GCAATATGT

101 TGCCGCACCC GGTTACGCTT TTTATTATTT TCATTGTGTT ATTGCTGATT

151 GCCTCTGCCG TCGGTGCGTA TTTCGGACTA TCCGTCCCCG ATCCGCGTCC

201 TGTTGGGGCG AAAGGACGTG CCGATGACGG TTTGATTCAC GTTGTCAGCC

251 TGCTCGATGC CGACGGTTTG ATCAAAATCC TGACGCATAC CGTTAAAAAT

301 TTCACCGGTT TCGCGCCGTT GGGAACGGTG TTGGTTTCTT TATTGGGCGT

351 GGGGATTGCG GAAAAATCGG GCTTGATTTC CGCATTAATG CGCTTATTGC

401 TCACAAAATC CCCACGCAAA CTCACTACTT TTATGGTTGT TTTTACAGGG

451 ATTTTATCCA ATACGGCTTC TGAATTGGGC TATGTCGTCC TAATCCCTTT

501 GTCCGCCGTC ATCTTTCATT CGCTCGGCCG CCATCCGCTT GCCGGTTTGG

551 CTGCGGCTTT CGCCGGCGTT TCGGGCGGTT ATTCGGCCAA TCTGTTCTTA

601 GGCACAATCG ATCCGCTCTT GGCAGGCATC ACCCAACAGG CGGCGCAAAT

651 CATCCATCCC GACTACGTCG TAGGCCCTGA AGCCAACTGG TTTTTTATGG

701 CAGCCAGTAC GTTTGTGATT GCTTTGATTG GTTATTTTGT TACTGAAAAA

751 ATCGTCGAAC CGCAATTGGG CCCTTATCAA TCAGATTTGT CACAAGAAGA

801 AAAAGACATT CGGCATTCCA ATGAAATCAC GCCTTTGGAA TATAAAGGAT

851 TAATTTGGGC AGGCGTGGTG TTTGTTGCCT TATCCGCCCT ATTGGCTTGG

901 AGCATCGTCC CTGCCGACGG TATTTTGCGT CATCCTGAAA CAGGATTGGT
```

-continued

```
 951 TGCCGGTTCG CCGTTTTTAA AATCGATTGT TGTTTTTATT TTCTTGTTGT

1001 TTGCGCTGCC GGGCATTGTT TATGGCCGGA TAACCCGAAG TTTGCGCGGC

1051 GAACGGGAAG TCGTTAATGC GATGGCCGAA TCGATGAGTA CTTTGGGACT

1101 TTATTTGGTC ATCATCTTTT TTGCCGCACA GTTTGTCGCA TTTTTTAATT

1151 GGACGAATAT TGGGCAATAT ATTGCCGTTA AAGGGGCGGT GTTCTTAAAA

1201 GAAGTCGGCT TGGGCGGCAG TGTGTTGTTT ATCGGTTTTA TTTTAATTTG

1251 TGCTTTTATC AATCTGATGA TAGGCTCCGC CTCCGCGCAA TGGGCGGTAA

1301 CTGCGCCGAT TTTCGTCCCT ATGCTGATGT TGGCCGGCTA CGCGCCCCAA

1351 GTCATTCAAG CCGCTTACCG CATCGGTGAT TCCGTTACCA ATATTATTAC

1401 GCCGATGATG AGTTATTTCG GGCTGATTAT GGCGACGGTA ATCAAATACA

1451 AAAAAGATGC GGGCGTAGGC ACGCTGATTT CTATGATGTT GCCGTATTCC

1501 GCTTTCTTCT TAATTGCATG GATCGCCTTA TTCTGCATTT GGGTATTTGT

1551 TTTGGGTCTG CCCGTCGGTC CCGGCACACC CACATTCTAT CCGGTGCCTT

1601 AA
```

This corresponds to the amino acid sequence <SEQ ID 1254; ORF 302.ng>:

```
g302.pep
   1 MHSIYFFKEK QMSQTDARRS GRFLRTVEWL GNMLPHPVTL FIIFIVLLLI

51 ASAVGAYFGL SVPDPRPVGA KGRADDGLIH VVSLLDADGL IKILTHTVKN

101 FTGFAPLGTV LVSLLGVGIA EKSGLISALM RLLLTKSPRK LTTFMVVFTG

151 ILSNTASELG YVVLIPLSAV IFHSLGRHPL AGLAAAFAGV SGGYSANLFL

201 GTIDPLLAGI TQQAAQIIHP DYVVGPEANW FFMAASTFVI ALIGYFVTEK

251 IVEPQLGPYQ SDLSQEEKDI RHSNEITPLE YKGLIWAGVV FVALSALLAW

301 SIVPADGILR HPETGLVAGS PFLKSIVVFI FLLFALPGIV YGRITRSLRG

351 EREVVNAMAE SMSTLGLYLV IIFFAAQFVA FFNWTNIGQY IAVKGAVFLK

401 EVGLGGSVLF IGFILICAFI NLMIGSASAQ WAVTAPIFVP MLMLAGYAPQ

451 VIQAAYRIGD SVTNIITPMM SYFGLIMATV IKYKKDAGVG TLISMMLPYS

501 AFFLIAWIAL FCIWVFVLGL PVGPGTPTFY PVP*
```

The following partial DNA sequence was identified in *N. meningitidis* <SEQ ID 1255>:

```
m302.seq
   1 ATGCACTCAA TATATTTTTT TAAGGAGAAG CAGATGAGTC AAACCGATAC

51 GCAACGGGAC GGACGATTTT TACGCACAGT CGAATGGCTG GGCAATATGT

101 TGCCGCATCC GGTTACGCTT TTTATTATTT TCATTGTGTT ATTGCTGATT

151 GCCTCTGCCG TCGGTGCGTA TTTCGGACTA TCCGTCCCCG ATCCGCGCCC

201 TGTTGGTGCG AAAGGACGTG CCGATGACGG TTTGATTTAC ATTGTCAGCC

251 TGCTCAATGC CGACGGTTTT ATCAAAATCC TGACGCATAC CGTTAAAAAT

301 TTCACCGGTT TCGCGCCGTT GGGAACGGTG TTGGTTTCTT TATTGGGCGT

351 GGGGATTGCG GAAAAATCGG GCTTGATTTC CGCATTAATG CGCTTATTGC

401 TCACAAAATC GCCACGCAAA CTCACTACTT TTATGGTTGT TTTTACAGGG
```

-continued

```
 451 ATTTTATCTA ATACCGCTTC TGAATTGGGC TATGTCGTCC TAATCCCTTT

501 GTCCGCCATC ATCTTTCATT CCCTCGGCCG CCATCCGCTT GCCGGTCTGG

551 CTGCGGCTTT CGCCGGCGTT TCGGGCGGTT ATTCGGCCAA TCTGTTCTTA

601 AGCACAATCG ATCCGCTCTT GGCATGCATC ACCCATCAGG CGGCGGTCGT

651 AGGCCCTGAA GCCAACTGGT TTTTTATGGT AGCCAGTACG TTTGTGATTG

701 CTTTGATTGG TTATTTTGTT ACTGAAAAAA TCGTCGAACC GCAATTGGGC

751 CCTTATCAAT CAGATTTGTC ACAAGAAGAA AAAGACATTC GGCATTCCAA

801 TGAAATCACG CCTTTGGAAT ATAAAGGATT AATTTGGGCT GGCGTGGTGT

851 TTGTTGCCTT ATCCGCCCTA TTGGCTTGGA GCATCGTCCC TGCCGACGGT

901 ATTTTGCGTC ATCCTGAAAC AGGATTGGTT TCCGGTTCGC CGTTTTTAAA

951 ATCGATTGTT GTTTTTATTT TCTTGTTGTT TGCACTGyCG GGCmTTGTTT

1001 ATGGmCGGGT AACAGGAAGT TTGCGCGGCG AACAGGAAGT CGTTAATGCG

1051 ATGGCCGAAT CGATGAGTAC TCTGGsGCTT TmTTTGswCA kcATCTTTTT

1101 TGCCGCACAG TTTGTCGCAT TTTTTAATTG GACGAATATT GGGCAATATA

1151 TTGCCGTTAA AGGGGCGACG TTCTTAAAAG AAGTCGGCTT GGGCGGCAGC

1201 GTGTTGTTTA TCGGTTTTAT TTTAATTTGT GCTTTTATCA ATCTGATGAT

1251 AGGCTCCGCC TCCGCGCAAT GGGCGGTAAC TGCGCCGATT TTCGTCCCTA

1301 TGCTGATGTT GGCCGGCTAC GCGCCCGAAG TCATTCAAGC CGCTTACCGC

1351 ATCGGTGATT CCGTTACCAA TATTATTACG CCGATGATGA GTTATTTCGG

1401 GCTGATTATG GCGACGGTGA TCAAATACAA AAAAGATGCG GGCGTGGGTA

1451 CGCTGATTTC TATGATGTTG CCGTATTCCG CTTTCTTCTT GATTGCGTGG

1501 ATTGCCTTAT TCTGCATTTG GGTATTTGTT TTGGGCCTGC CCGTCGGTCC

1551 CGGCGCGCCC ACATTCTATC CCGCACCTTA A
```

This corresponds to the amino acid sequence <SEQ ID 1256; ORF 302>:

```
m302.pep
   1 MHSIYFFKEK QMSQTDTQRD GRFLRTVEWL GNMLPHPVTL FIIFIVLLLI

51 ASAVGAYFGL SVPDPRPVGA KGRADDGLIY IVSLLNADGF IKILTHTVKN

101 FTGFAPLGTV LVSLLGVGIA EKSGLISALM RLLLTKSPRK LTTFMVVFTG

151 ILSNTASELG YVVLIPLSAI IFHSLGRHPL AGLAAAFAGV SGGYSANLFL

201 STIDPLLACI THQAAVVGPE ANWFFMVAST FVIALIGYFV TEKIVEPQLG

251 PYQSDLSQEE KDIRHSNEIT PLEYKGLIWA GVVFVALSAL LAWSIVPADG

301 ILRHPETGLV SGSPFLKSIV VFIFLLFALX GXVYGRVTRS LRGEQEVVNA

351 MAESMSTLXL XLXXIFFAAQ FVAFFNWTNI GQYIAVKGAT FLKEVGLGGS

401 VLFIGFILIC AFINLMIGSA SAQWAVTAPI FVPMLMLAGY APEVIQAAYR

451 IGDSVTNIIT PMMSYFGLIM ATVIKYKKDA GVGTLISMML PYSAFFLIAW

501 IALFCIWVFV LGLPVGPGAP TFYPAP*
```

Computer analysis of this amino acid sequence gave the following results:

Homology with a Predicted ORF from *N. gonorrhoeae*
ORF 302 shows 94.0% identity over a 533 aa overlap with a predicted ORF (ORF 302.ng) from *N. gonorrhoeae*:

```
m302/g302

10        20        30        40        50        60
    m302.pep  MHSIYFEKEKQMSQTDTQRDGRFLRTVEWLGNMLPHPVTLFIIFIVLLLIASAVGAYFGL
              ||||||||||||||::|:||||||||||||||||||||||||||||||||||||||||||
        g302  MHSIYFFKEKQMSQTDARRSGRFLRTVEWLGNMLPHPVTLFIIFIVLLLIASAVGAYFGL
                   10        20        30        40        50        60

70        80        90       100       110       120
    m302.pep  SVPDPRPVGAKGRADDGLIYIVSLLNADGPIKILTHTVKNFTGFAPLGTVLVSLLGVGIA
              |||||||||||||||||||::||||:|||:||||||||||||||||||||||||||||||
        g302  SVPDPRPVGAKGRADDGLIHVVSLLDADGLIKILTHTVKNFTGFAPLGTVLVSLLGVGIA
                   70        80        90       100       110       120

130       140       150       160       170       180
    m302.pep  EKSGLISALMRLLLTKSPRKLTTFMVVFTGILSNTASELGYVVLIPLSAIIFHSLGRHPL
              |||||||||||||||||||||||||||||||||||||||||||||||:||||||||||||
        g302  EKSGLISALMRLLLTKSPRKLTTFMVVFTGILSNTASELGYVVLIPLSAVIFHSLGRHPL
                  130       140       150       160       170       180

190       200       210       220         230
    m302.pep  AGLAAAFAGVSGGYSANLFLSTIDPLLACITHQAA-------VVGPEANWFFMVASTFVI
              ||||||||||||||||||||:|||||| ||:|||        |||||||||||:||||||
        g302  AGLAAAFAGVSGGYSANLFLGTIDPLLAGITQQAAQIIHPDYVVGPEANWFFMAASTFVI
                  190       200       210       220       230       240

240       250       260       270       280       290
    m302.pep  ALIGYFVTEKIVEPQLGPYQSDLSQEEKDIRHSNEITPLEYKGLIWAGVVFVALSALLAW
              ||||||||||:|||||||||||||||||||||||||||||||||||||||||||||||||
        g302  ALIGYFVTECIVEPQLGPYQSDLSQEEKDIRHSNEITPLEYKGLIWAGVVFVALSALLAW
                  250       260       270       280       290       300

300       310       320       330       340       350
    m302.pep  SIVPADGILRHPETGLVSGSPFLKSIVVFIFLLFALXGXVYGRVTRSLRGEQEVVNAMAE
              ||||||||||||||||||:||||||||||||||||| ||||:||||||||:|||||||||
        g302  SIVPADGILRHPETGLVAGSPFLKSIVVFIFLLFALPGIVYGRITRSLRGEREVVNAMAE
                  310       320       330       340       350       360

360       370       380       390       400       410
    m302.pep  SMSTLXLXLXXIFFAAQFVAFFNWTNIGQYIAVKGATFLKEVGLGGSVLFIGFILICAFI
              |||||| | | |||||||||||||||||||||||||:|||||||||||||||||||||||
        g302  SMSTLGLYLVIIFFAAQFVAFFNWTNIGQYIAVKGAVFLKEVGLGGSVLFIGFILICAFI
                  370       380       390       400       410       420

420       430       440       450       460       470
    m302.pep  NLMIGSASAQWAVTAPIFVPMLMLAGYAPEVIQAAYRIGDSVTNIITPMMSYFGLIMATV
              ||||||||||||||||||||||||||||||:|||||||||||||||||||||||||||||
        g302  NLMIGSASAQWAVTAPIFVPMLMLAGYAPQVIQAAYRIGDSVTNIITPMMSYFGLIMATV
                  430       440       450       460       470       480

480       490       500       510       520
    m302.pep  IKYKKDAGVGTLISMMLPYSAFFLIAWIALFCIWVFVLGLPVGPGAPTFYPAPX
              ||||||||||||||||||||||||||||||||||||||||||||||:||||:||
        g302  IKYKKDAGVGTLISMMLPYSAFFLIAWIALFCIWVFVLGLPVGPGTPTFYPVPX
                  490       500       510       520       530
```

The following partial DNA sequence was identified in *N. meningitidis* <SEQ ID 1257>:

```
a302.seq
   1 ATGCACTCAA TATATTTTTT TAAGGAGAAG CAGATGAGTC AAACCGATAC

51 GCAACGGGAC GGACGATTTT TACGCACAGT CGAATGGCTG GCAATATGT

101 TGCCGCACCC GGTTACGCTT TTTATTATTT TCATTGTGTT ATTGCTGATT

151 GCCTCTGCCG CCGGTGCGTA TTTCGGACTA TCCGTCCCCG ATCCGCGCCC

201 TGTTGGTGCG AAAGGACGTG CCGATGACGG TTTGATTCAC GTTGTCAGCC

251 TGCTCGATGC TGACGGTTTG ATCAAAATCC TGACGCATAC CGTTAAAAAT

301 TTCACCGGTT TCGCGCCGTT GGGAACGGTG TTGGTTTCTT TATTGGGCGT

351 GGGGATTGCG GAAAAATCGG GCTTGATTTC CGCATTAATG CGCTTATTGC

401 TCACAAAATC TCCACGCAAA CTCACTACTT TTATGGTTGT TTTTACAGGG
```

```
-continued
 451 ATTTTATCTA ATACCGCTTC TGAATTGGGC TATGTCGTCC TAATCCCTTT

501 GTCCGCCATC ATCTTTCATT CCCTCGGCCG CCATCCGCTT GCCGGTCTGG

551 CTGCGGCTTT CGCCGGCGTT TCGGGCGGTT ATTCGGCCAA TCTGTTCTTA

601 GGCACAATCG ATCCGCTCTT GGCAGGCATC ACCCAACAGG CGGCGCAAAT

651 CATCCATCCC GACTACGTCG TAGGCCCTGA AGCCAACTGG TTTTTTATGG

701 TAGCCAGTAC GTTTGTGATT GCTTTGATTG GTTATTTTGT TACTGAAAAA

751 ATCGTCGAAC CGCAATTGGG CCCTTATCAA TCAGATTTGT CACAAGAAGA

801 AAAAGACATT CGACATTCCA ATGAAATCAC GCCTTTGGAA TATAAAGGAT

851 TAATTTGGGC TGGCGTGGTG TTTGTTGCCT TATCCGCCCT ATTGGCTTGG

901 AGCATCGTCC CTGCCGACGG TATTTTGCGT CATCCTGAAA CAGGATTGGT

951 TTCCGGTTCG CCGTTTTTAA AATCAATTGT TGTTTTTATT TTCTTGTTGT

1001 TTGCACTGCC GGGCATTGTT TATGGCCGGG TAACCCGAAG TTTGCGCGGC

1051 GAACAGGAAG TCGTTAATGC GATGGCCGAA TCGATGAGTA CTCTGGGGCT

1101 TTATTTGGTC ATCATCTTTT TTGCCGCACA GTTTGTCGCA TTTTTTAATT

1151 GGACGAATAT TGGGCAATAT ATTGCCGTTA AAGGGGCGAC GTTCTTAAAA

1201 GAAGTCGGCT TGGGCGGCAG CGTGTTGTTT ATCGGTTTTA TTTTAATTTG

1251 TGCTTTTATC AATCTGATGA TAGGCTCCGC CTCCGCGCAA TGGGCGGTAA

1301 CTGCGCCGAT TTTCGTCCCT ATGCTGATGT TGGCCGGCTA CGCGCCCGAA

1351 GTCATTCAAG CCGCTTACCG CATCGGTGAT TCCGTTACCA ATATTATTAC

1401 GCCGATGATG AGTTATTTCG GGCTGATTAT GGCGACGGTG ATCAAATACA

1451 AAAAGATGC GGGCGTGGGT ACGCTGATTT CTATGATGTT GCCGTATTCC

1501 GCTTTCTTCT TGATTGCGTG GATTGCCTTA TTCTGCATTT GGGTATTTGT

1551 TTTGGGCCTG CCCGTCGGTC CCGGCGCGCC CACATTCTAT CCCGCACCTT

1601 AA
```

This corresponds to the amino acid sequence <SEQ ID 1258; ORF 302.a>:

```
a302.pep
   1 MHSIYFFKEK QMSQTDTQRD GRFLRTVEWL GNMLPHPVTL FIIFIVLLLI

51 ASAAGAYFGL SVPDPRPVGA KGRADDGLIH VVSLLDADGL IKILTHTVKN

101 FTGFAPLGTV LVSLLGVGIA EKSGLISALM RLLLTKSPRK LTTFMVVFTG

151 ILSNTASELG YVVLIPLSAI IFHSLGRHPL AGLAAAFAGV SGGYSANLFL

201 GTIDPLLAGI TQQAAQIIHP DYVVGPEANW FFMVASTFVI ALIGYFVTEK

251 IVEPQLGPYQ SDLSQEEKDI RHSNEITPLE YKGLIWAGVV FVALSALLAW

301 SIVPADGILR HPETGLVSGS PFLKSIVVFI FLLFALPGIV YGRVTRSLRG

351 EQEVVNAMAE SMSTLGLYLV IIFFAAQFVA FFNWTNIGQY IAVKGATFLK

401 EVGLGGSVLF IGFILICAFI NLMIGSASAQ WAVTAPIFVP MLMLAGYAPE

451 VIQAAYRIGD SVTNIITPMM SYFGLIMATV IKYKKDAGVG TLISMMLPYS

501 AFFLIAWIAL FCIWVFVLGL PVGPGAPTFY PAP*
``` m302/a302 96.1% identity in 533 aa overlap

```
              10        20        30        40        50        60
m302.pep  MHSIYFEKEKQMSQTDTQRDGRFLRTVEWLGNMLPHPVTLFIIFIVLLLIASAVGAYFGL
          ||||||:|||||||||:|||||||||||||||||||||||||||||||||||:||||||
a302      MHSIYFFKEKQMSQTDQRRDGRFLRTVEWLGNMLPHPVTLFIIFIVLLLIASAAGAYFGL
              10        20        30        40        50        60

70        80        90       100       110       120
m302.pep  SVPDPRPVGAKGRADDGLIYIVSLLNADGFIKILTHTVKNFTGFAPLGTVLVSLLGVGIA
          |||||||||||||||||||::||||:|||:||||||||||||||||||||||||||||||
a302      SVPDPRPVGAKGRADDGLIHVVSLLDADGLIKILTHTVKNFTGFAPLGTVLVSLLGVGIA
              70        80        90       100       110       120

130       140       150       160       170       180
m302.pep  EKSGLISALMRLLLTKSPRKLTTFMVVFTGILSNTASELGYVVLIPLSAIIFHSLGRHPL
          ||||||||||||||||||||||||||||||||||||||||||||||||||||||||||||
a302      EKSGLISALMRLLLTKSPRKLTTFMVVFTGILSNTASELGYVVLIPLSAIIFHSLGRHPL
             130       140       150       160       170       180

190       200       210       220       230
m302.pep  AGLAAAFAGVSGGYSANLFLSTIDPLLACITHQAA-------VVGPEANWFFMVASTFVI
          ||||||||||||||||||||:|||||| ||:|||       ||||||||||||||||||
a302      AGLAAAFAGVSGGYSANLFLGTIDPLLAGITQQAAQIIHPDYVVGPEANWFFMVASTFVI
             190       200       210       220       230       240

240       250       260       270       280       290
m302.pep  ALIGYFVTEKIVEPQLGPYQSDLSQEEKDIRHSNEITPLEYKGLIWAGVVFVALSALLAW
          |||||||||:||||||||||||||||||||||||||||||||||||||||||||||||||
a302      ALIGYFVTECIVEPQLGPYQSDLSQEEKDIRHSNEITPLEYKGLIWAGVVFVALSALLAW
             250       260       270       280       290       300

300       310       320       330       340       350
m302.pep  SIVPADGILRHPETGLVSGSPFLKSIVVFIFLLFALXGXVYGRVTRSLRGEQEVVNAMAE
          ||||||||||||||||||||||||||||||||||||| |||:||||||||||||||||||
a302      SIVPADGILRHPETGLVSGSPFLKSIVVFIFLLFALPGIVYGRVTRSLRGEQEVVNAMAE
             310       320       330       340       350       360

360       370       380       390       400       410
m302.pep  SMSTLXLXLXXIFFAAQFVAFFNWTNIGQYIAVKGATFLKEVGLGGSVLFIGFILICAFI
          ||||| | |  ||||||||||||||||||||||||||||||||||||||||||||||||
a302      SMSTLGLYLVIIFFAAQFVAFFNWTNIGQYIAVKGATFLKEVGLGGSVLFIGFILICAFI
             370       380       390       400       410       420

420       430       440       450       460       470
m302.pep  NLMIGSASAQWAVTAPIFVPMLMLAGYAPEVIQAAYRIGDSVTNIITPMMSYFGLIMATV
          ||||||||||||||||||||||||||||||||||||||||||||||||||||||||||||
a302      NLMIGSASAQWAVTAPIFVPMLMLAGYAPEVIQAAYRIGDSVTNIITPMMSYFGLIMATV
             430       440       450       460       470       480

480       490       500       510       520
m302.pep  IKYKKDAGVGTLISMMLPYSAFFLIAWIALFCIWVFVLGLPVGPGAPTFYPAPX
          |||||||||||||||||||||||||||||||||||||||||||||| |||| |:
a302      IKYKKDAGVGTLISMMLPYSAFFLIAWIALFCIWVFVLGLPVGPGTPTFYPVPX
             490       500       510       520       530
```

The following partial DNA sequence was identified in *N. gonorrhoeae* <SEQ ID 1259>:

```
g305.seq
   1 ATGGATTTTT TGATTGTCCT GAAAGCCCTG ATGATGGGCT TGGTAGAAGG

51 TTTTACCGAA TTTTTACCGA TTTCCAGCAC CGGACATTTG ATTGTGTTCG

101 GCAATCTGAT TGGTTTTCAC AGCAATCACA AGGTTTTTGA AATTGCCATC

151 CAGCTCGGTG CGGTTTTGGC GGTAGTGTTT GAATACCGGC AGCGTTTCAG

201 CAATGTGTTG CATGGCGTGG GAAAAGACCG GAAAGCCAAC CGTTTCGTCC

251 TCAATCTTGC CATTGCTTTT ATACCTGCCG CCGTGATGGG GCTGTTGTTC

301 GACAAACAAA TCAAAGAGTA TCTGTTTAAC CCCTTGAGTG TTGCAGTCAT

351 GCTGGTTTTG GGCGGTTTTT TTATTTTGTG GGTGGAGAAA CGCCAAAGCC

401 GAGCAGAGCC TAAAATTGCC GATGTTGATG CATTGCGTCC GATTGATGCG

451 TTGATGATCG GTGTTGCCCA AGTGTTTGCA CTGGTTCCGG GTACGTCCCG

501 TTCGGGCAGT ACGGTTATGG GCGGGATGCT TTGGGGAATC GAGCGGAAAA

551 CGGCAACGGA GTTTTCATTT TTCTTGGCCG TTCCGATGAT GGTTGCAGCA

601 ACGGCTTATG ATGTCCTGAA ACATTACCGA TTTTTCACCC TGCATGATGT
```

-continued

```
651 CGGTTTGATT TTGATAGGCT TTATTGCCGC TTTTGTTTCC GGTTTGGTAG

701 CGGTTAAAGC ACTGCTGAAG TTTGTTTCCA AGAAAAACTA TATCCCGTTT

751 GCCTATTACC GCATTGTTTT CGGCATTGTC ATCATAATAT TGTGGTTGTC

801 GGGCTGGATA AGTTGGGAAT GA
```

This corresponds to the amino acid sequence <SEQ ID 1260; ORF 305.ng>:

```
g305.pep
  1 MDFLIVLKAL MMGLVEGFTE FLPISSTGHL IVFGNLIGFH SNHKVFEIAI

51 QLGAVLAVVF EYRQRFSNVL HGVGKDRKAN RFVLNLAIAF IPAAVMGLLF

101 DKQIKEYLFN PLSVAVMLVL GGFFILWVEK RQSRAEPKIA DVDALRPIDA

151 LMIGVAQVFA LVPGTSRSGS TVMGGMLWGI ERKTATEFSF FLAVPMMVAA

201 TAYDVLKHYR FFTLHDVGLI LIGFIAAFVS GLVAVKALLK FVSKKNYIPF

251 AYYRIVFGIV IIILWLSGWI SWE*
```

The following partial DNA sequence was identified in *N. meningitidis* <SEQ ID 1261>:

```
m305.seq (partial)
   1 AtGGATTTTC TGATTGTCCT GAAAGCCCTG ATGATGGGCT TGGTAGAAGG

51 TTTTACCGAA TTTTTACCGA TTTCCAGCAC CGGACATTTG ATTGTGTTCG

101 GCAATCTGAT TGGTTTTCAC AGCAATCACA AGGTTTTTGA AATTGCCATC

151 CAGCTCGGTG CAGTTTTGGC GGTAGTGTTT GAATACCGGC AACGTTTCAG

201 CAATGTGTTG CACGGCTTGG GAAAAGACCG GAAAGCCAAC CGCTTCGTCC

251 TTAATCTTGC CATTGCTTTT ATACCTGCCG CCGTGATGGG GCTGTTGTTC

301 GGCAwACAAA TCAAAGAGyA TCTGTTTAAC CCCTTGAGTG TTGCAGTCAT

351 GCTGGTTyTG GrCGGTTTTT yTATTTTGTG GGTGGAGAAA CGCCAAAGCC

401 GAGCAGAGCC TAAAATTGCC GATGTTGATG CATTGCGTCC GATTGATGCC

451 TTGATGATCG GCGTTGCCCA AGTGTTTGCA CTGGTTCCGG GTACGTCCCG

501 TTCGGGCAGT ACGATTATGG GCGGGATGCT TTGGGGCATC GAACGGAAAA

551 CTGCGACAGA ATTCTCGTTT TTCTTGGCTG TGCCGATGAT GGTTGCCGCA

601 ACGGCTTATG ATGTCCTGAA ACATTACCGA TTTTTCACCC TGCATGATGT

651 CGGTTTGATT CTGATAGGCT TTATTGCTGC CTTTGTTTCA GGCTTGGTAG

701 CGGTAAAAGC GTTGCTGAGG TTTGTTTCGG GTAC...
```

This corresponds to the amino acid sequence <SEQ ID 1262; ORF 305>:

```
m305.pep (partial)
  1 MDFLIVLKAL MMGLVEGFTE FLPISSTGHL IVFGNLIGFH SNHKVFEIAI

51 QLGAVLAVVF EYRQRFSNVL HGLGKDRKAN RFVLNLAIAF IPAAVMGLLF

101 GXQIKEXLFN PLSVAVMLVL XGFXILWVEK RQSRAEPKIA DVDALRPIDA

151 LMIGVAQVFA LVPGTSRSGS TIMGGMLWGI ERKTATEFSF FLAVPMMVAA

201 TAYDVLKHYR FFTLHDVGLI LIGFIAAFVS GLVAVKALLR FVSG...
```

Computer analysis of this amino acid sequence gave the following results:

Homology with a Predicted ORF from *N. gonorrhoeae*

ORF 305 shows 96.7% identity over a 243 aa overlap with a predicted ORF (ORF 305.ng) from *N. gonorrhoeae*:

```
    g305/m305

10         20         30         40         50         60
        g305.pep  MDFLIVLKALMMGLVEGFTEFLPISSTGHLIVFGNLIGFHSNHKVFEIAIQLGAVLAVVF
                  ||||||||||||||||||||||||||||||||||||||||||||||||||||||||||||
        m305      MDFLIVLKALMMGLVEGFTEFLPISSTGHLIVFGNLIGFHSNHKVFEIAIQLGAVLAVVF
                        10         20         30         40         50         60

70         80         90        100        110        120
        g305.pep  EYRQRFSNVLHGVGKDRKANRFVLNLAIAFIPAAVMGLLFDKQIKEYLFNPLSVAVMLVL
                  ||||||||||| ||||||||||||||||||||||||||||| |||| |||||||||||||
        m305      EYRQRFSNVLHGLGKDRKANRFVLNLAIAFIPAAVMGLLFGXQIKEXLFNPLSVAVMLVL
                        70         80         90        100        110        120

130        140        150        160        170        180
        g305.pep  GGFFILWVEKRQSRAEPKIADVDALRPIDALMIGVAQVFALVPGTSRSGSTVMGGMLWGI
                  ||  |||||||||||||||||||||||||||||||||||||||||||||||:|||||||
        m305      XGFXILWVEKRQSRAEPKIADVDALRPIDALMIGVAQVFALVPGTSRSGSTIMGGMLWGI
                       130        140        150        160        170        180

190        200        210        220        230        240
        g305.pep  ERKTATEFSFFLAVPMMVAATAYDVLKHYRFFTLHDVGLILIGFIAAFVSGLVAVKALLK
                  |||||||||||||||||||||||||||||||||||||||||||||||||||||||||||:
        m305      ERKTATEFSFFLAVPMMVAATAYDVLKHYRFFTLHDVGLILIGFIAAFVSGLVAVKALLR
                       190        200        210        220        230        240

250        260        270
        g305.pep  FVSKKNYIPFAYYRIVFGIVIIILWLSGWISWEX
                  |||
        m305      FVSG
```

The following partial DNA sequence was identified in *N. meningitidis* <SEQ ID 1263>:

```
a305.seq
  1 ATGGATTTTC TGATTGTCCT GAAAGCCCTG ATGATGGGCT TGGTAGAAGG

51 TTTTACCGAA TTTTTACCGA TTTCCAGCAC CGGACATTTG ATTGTGTTCG

101 GCAATCTGAT TGATTTTCAC AGCAATCACA AGGTTTTTGA AATTACCATC

151 CAGCTCGGTG CGGTTTTGGC GGTAGTGTTT GAATACCGGC AGCGTTTCAG

201 CAATGTGTTG CATGGCGTGG GAAAAGACCG GAAAGCCAAC CGTTTCGTCC

251 TTAATCTTGC CATTGCTTTT ATACCTGCCG CCGTGATGGG GCTGTTGTTC

301 GGCAAACAAA TCAAAGAGTA TCTGTTTAAC CCCTTGAGTG TTGCAGTCAT

351 GCTGGTTTTG GGCGGTTTTT TTATTTTGTG GGTGGAGAAA CGCCAAAGCC

401 GAGCAGAGCC TAAAATTGTC GATGTTGATG CATTGCGTCC GATTGATGCG

451 TTGATGATCG GCGTTGCCCA AGTGTTTGCA CTGGTTCCAG GTACGTCCCG

501 TTCGGGCAGT ACGATTATGG GCGGGATGCT TTGGGGAATC GAGCGGAAAA

551 CGGCAACGGA GTTTTCATTT TTCTTGGCCG TTCCGATGAT GGTTGCAGCA

601 ACGGCTTATG ATGTCCTGAA GCATTACCGG TTTTTCACCC TGCATGATGT

651 CGGTTTGATT TTGATTGGCT TTGTTGCTGC CTTTGTTTCA GGCTTGGTGG

701 CGGTCAAAGC GTTGCTGAGG TTTGTTTCCA AGAAAAATTA TATTCCTTTT

751 GCCTATTACC GCATTGTTTT TGGTATTGCC ATCATTATAT TGTGGCTGTC

801 AGGCTGGATA AGTTGGGAAT GA
```

This corresponds to the amino acid sequence <SEQ ID 1264; ORF 305.a>:

```
a305.pep
   1 MDFLIVLKAL MMGLVEGFTE FLPISSTGHL IVFGNLIDFH SNHKVFEITI

51 QLGAVLAVVF EYRQRFSNVL HGVGKDRKAN RFVLNLAIAF IPAAVMGLLF

101 GKQIKEYLFN PLSVAVMLVL GGFFILWVEK RQSRAEPKIV DVDALRPIDA

151 LMIGVAQVFA LVPGTSRSGS TIMGGMLWGI ERKTATEFSF FLAVPMMVAA

201 TAYDVLKHYR FFTLHDVGLI LIGFVAAFVS GLVAVKALLR FVSKKNYIPF

251 AYYRIVFGIA IIILWLSGWI SWE*
``` m305/a305 96.3% identity in 243 aa overlap

```
                   10         20         30         40         50         60
   m305.pep  MDFLIVLKALMMGLVEGFTEFLPISSTGHLIVFGNLIGFHSNHKVFEIAIQLGAVLAVVF
             |||||||||||||||||||||||||||||||||||| ||||||||||:||||||||||||
   a305      MDFLIVLKALMMGLVEGFTEFLPISSTGHLIVFGNLIDFHSNHKVFEITIQLGAVLAVVF
                   10         20         30         40         50         60

70         80         90        100        110        120
   m305.pep  EYRQRFSNVLHGLGKDRKANRFVLNLAIAFIPAAVMGLLFGXQIKEXLFNPLSVAVMLVL
             ||||||||||||:|||||||||||||||||||||||||||| |||| |||||||||||||
   a305      EYRQRFSNVLHGVGKDRKANRFVLNLAIAFIPAAVMGLLFGKQIKEYLFNPLSVAVMLVL
                   70         80         90        100        110        120

130        140        150        160        170        180
   m305.pep  XGFXILWVEKRQSRAEPKIADVDALRPIDALMIGVAQVFALVPGTSRSGSTIMGGMLWGI
             || ||||||||||||||||:||||||||||||||||||||||||||||||||||||||||
   a305      GGFFILWVEKRQSRAEPKIADVDALRPIDALMIGVAQVFALVPGTSRSGSTVMGGMLWGI
                  130        140        150        160        170        180

190        200        210        220        230        240
   m305.pep  ERKTATEFSFFLAVPMMVAATAYDVLKHYRFFTLHDVGLILIGFIAAFVSGLVAVKALLR
             |||||||||||||||||||||||||||||||||||||||||||:||||||||||||||||
   a305      ERKTATEFSFFLAVPMMVAATAYDVLKHYRFFTLHDVGLILIGFVAAFVSGLVAVKALLR
                  190        200        210        220        230        240 m305.pep  FVSG
             |||
   a305      FVSKKNYIPFAYYRIVFGIAIIILWLSGWISWEX
                  250        260        270
```

The following partial DNA sequence was identified in *N. gonorrhoeae* <SEQ ID 1265>:

```
g306.seq
   1 ATGTTTATGA ACAAATTTTC CCAATCCGGA AAAGGTCTGT CCGGTTTCTT

51 CTTCGGTTTG ATACTGGCAA CGGTCATTAT TGCCGGTATT TTGCTTTATC

101 TGAACCAGGG CGGTCAAAAT GCGTTCAAAA TCCCGGCTCC GTCGAAGCAG

151 CCTGCAGAAA CGGAAATCCT GAAACTGAAA AACCAGCCTA AGGAAGACAT

201 CCAACCTGAA CCGGCCGATC AAAACGCCTT GTCCGAACCG GATGTTGCGA

251 AAGAGGCAGA GCAGTCGGAT GCGGAAAAAG CTGCCGACAA GCAGCCCGTT

301 GCCGACAAAG CCGACGAGGT TGAAGAAAAG GCGGGCGAGC CGGAACGGGA

351 AGAGCCGGAC GGACAGGCAG TGCGCAAGAA AGCACTGACT GAAGAGCGTG

401 AACAAACCGT CAGGGAAAAA GCGCAGAAGA AGATGCCGA AACGGTTAAA

451 AAAAAGCGG TAAACCGTC TAAAGAAACA GAGAAAAAAG CTTCAAAAGA

501 AGAGAAAAAG GCGGCGAAAG AAAAAGTTGC ACCCAAACCG ACCCCGGAAC

551 AAATCCTCAA CAGCCGCAGT ATCGAAAAAG CGCGTAGTGC CGCTGCCAAA
```

-continued

```
601 GAAGTGCAGA AAATGAAAAA CTTTGGGCAA GGCGGAAGCC AACGCATTAT

651 CTGCAAATGG GCGCGTATGC CGAACCCCGG AGCGCGGAAG GGCAGCGTGC

701 CAAACTGGCA ATCTTGGGCA TATCTTCCGA AGTGGTCGGC TATCAGGCGG

751 GACATAAAAC GCTTTACCGC GTGCAAAGCG GCAATATGTC CGCCGATGCG

801 GTGA
```

This corresponds to the amino acid sequence <SEQ ID 1266; ORF 306.ng>:

```
g306.pep
  1 MFMNKFSQSG KGLSGFFFGL ILATVIIAGI LLYLNQGGQN AFKIPAPSKQ

51 PAETEILKLK NQPKEDIQPE PADQNALSEP DVAKEAEQSD AEKAADKQPV

101 ADKADEVEEK AGEPEREEPD GQAVRKKALT EEREQTVREK AQKKDAETVK

151 KKAVKPSKET EKKASKEEKK AAKEKVAPKP TPEQILNSRS IEKARSAAAK

201 EVQKMKNFGQ GGSQRIICKW ARMPNPGARK GSVPNWQSWA YLPKWSAIRR

251 DIKRFTACKA AICPPMR*
```

The following partial DNA sequence was identified in *N. meningitidis* <SEQ ID 1267>:

```
m306.seq (partial)
  1 ..GGTTTGTTCT TCGGTTTGAT ACTGGCGACG GTCATTATTG CCGGTATTTT

51    GTTTTATCTG AACCAGAGCG GTCAAAATGC GTTCAAAATC CCGGCTTCGT

101    CGAAGCAGCC TGCAGAAACG GAAATCCTGA AACCGmAwAA CCAGCyTAAG

151    GAAGACATCC AACCTGAwCC GGCCGATCAA AACGCCTTGT CCGAACCGGA

201    TGCTGCGACA GAGGCAGAGC AGTCGGATGC GGAAAAwGCT GCCGACAAGC

251    AGCCCGTTGC CGATAAAGCC GACGAGGTTG AAGAAAAGGC GGGCGAGCCG

301    GAACGGGAAG AGCCGGACGG ACAGGCAGTG CGTAAGAAAG CGCTGACGGA

351    AGAGCGTGAA CAAACCGTCA GGGAAAAAGC GCAGAAGAAA GATGCCGAAA

401    CGGTTAAAAw ACAAGCGGTA AAACCGTCTA AGAAACAGA GAAAAAAGCT

451    TCAAAAGAAG AGAAAAAGGC GGCGAAGGAA AAAGTTGCAC CAAAACCAAC

501    CCCGGAACAA ATCCTCAACA GCGGCAGCAT CGAAAAAGCC CGCAGTGCCG

551    CCGCCAAAGA AGTGCAGAAA ATGAAAACGC CGACAAGGCG GAAGCAACGC

601    ATTATCTGCA AATGGGCGCG TATGCCGACC GTCAGAGCGC GGAAGGGCAG

651    CGTGCCAAAC TGGCAATCTT GGGCATATCT TCCAAGGTGG TCGGTTATCA

701    GGCGGGACAT AAAACGCTTT ACCGGGTGCA AGCGGCAAT ATGTCTGCCG

751    ATGCGGTGA
```

This corresponds to the amino acid sequence <SEQ ID 1268; ORF 306>:

```
m306.pep (partial)
  1 ..GLFFGLILAT VIIAGILFYL NQSGQNAFKI PASSKQPAET EILKPXNQXK

51    EDIQPXPADQ NALSEPDAAT EAEQSDAEXA ADKQPVADKA DEVEEKAGEP

101    EREEPDGQAV RKKALTEERE QTVREKAQKK DAETVKXQAV KPSKETEKKA

151    SKEEKKAAKE KVAPKPTPEQ ILNSGSIEKA RSAAAKEVQK MKTPTRRKQR
```

```
201  IICKWARMPT VRARKGSVPN WQSWAYLPRW SVIRRDIKRF TGCKAAICLP

251  MR*
```

Computer analysis of this amino acid sequence gave the following results:

Homology with a Predicted ORF from *N. gonorrhoeae*

ORF 306 shows 88.9% identity over a 253 aa overlap with a predicted ORF (ORF 306.ng) from *N. gonorrhoeae*:

```
m306/g306

10         20         30         40
m306.pep             GLFFGLILATVIIAGILFYLNQSGQNAFKIPASSKQPAETEILKPX
                     |:||||||||||||||:||||:||||||||| ||||||||||
g306     MFMNKFSQSGKGLSGFFFGLILATVIIAGILLYLNQGGQNAFKIPAPSKQPAETEILKLK
                10         20         30         40         50         60

50         60         70         80         90        100
m306.pep  NQXKEDIQPXPADQNALSEPDAATEAEQSDAEXAADKQPVADKADEVEEKAGEPEREEPD
          || |||||| |||||||||||:| |||||||| ||||||||||||||||||||||||||
g306      NQPKEDIQPEPADQNALSEPDVAKEAEQSDAEKAADKQPVADKADEVEEKAGEPEREEPD
                70         80         90        100        110        120

110        120        130        140        150        160
m306.pep  GQAVRKKALTEEREQTVREKAQKKDAETVKXQAVKPSKETEKKASKEEKKAAKEKVAPKP
          ||||||||||||||||||||||||||||||| :||||||||||||||||||||||||||
g306      CQAVRKKALTEEREQTVREKAQKKDAETVKKKAVKPSKETEKKASKEEKKAAKEKVAPKP
                130        140        150        160        170        180

170        180        190        200        210        220
m306.pep  TPEQILNSGSIEKARSAAAKEVQKMKTPTRR-KQRIICKWARMPTVRARKGSVPNWQSWA
          ||||||||  ||||||||||||||||||:   : :||||||||||:  |||||||||||
g306      TPEQILNSRSIEKARSAAAKEVQKMKNFGQGGSQRIICKWARMPNPGARKGSVPNWQSWA
                190        200        210        220        230        240

230        240        250
m306.pep  YLPRWSVIRRDIKRFTGCKAAICLPMRX
          |||:||:|||||||||:||||||| |||
g306      YLPKWSAIRRDIKRFTACKAAICPPMRX
                250        260
```

The following partial DNA sequence was identified in *N. meningitidis* <SEQ ID 1269>:

```
a306.seq
   1 ATGTTTATGA ACAAATTTTC CCAATCCGGA AAAGGTCTGT CCGGTTTTTT

51 CTTCGGTTTG ATACTGGCGA CGGTCATTAT TGCCGGTATT TTGTTTTATC

101 TGAACCAGAG CGGTCAAAAT GCGTTCAAAA TCCCGGTTCC GTCGAAGCAG

151 CCTGCAGAAA CGGAAATCCT GAAACCGAAA AACCAGCCTA AGGAAGACAT

201 CCAACCTGAA CCGGCCGATC AAAACGCCTT GTCCGAACCG GATGCTGCGA

251 AAGAGGCAGA GCAGTCGGAT GCGGAAAAAG CTGCCGACAA GCAGCCCGTT

301 GCCGACAAAG CCGACGAGGT TGAGGAAAAG GCGGACGAGC CGGAGCGGGA

351 AAAGTCGGAC GGACAGGCAG TGCGCAAGAA AGCACTGACG GAAGAGCGTG

401 AACAAACCGT CGGGGAAAAA GCGCAGAAGA AGATGCCGA ACGGTTAAA

451 AAACAAGCGG TAAAACCATC TAAAGAAACA GAGAAAAAAG CTTCAAAAGA

501 AGAGAAAAAG GCGGAGAAGG AAAAAGTTGC ACCCAAACCG ACCCCGGAAC

551 AAATCCTCAA CAGCGGCAGC ATCGAAAAAG CGCGCAGTGC CGCTGCCAAA

601 GAAGTGCAGA AAATGAAAAC GCCGACAAGG CGGAAGCAAC GCATTATCTG

651 CAAATGGGCG CGTATGCCGA CCGCCGGAGC GCGGAAGGGC AGCGTGCCAA

701 ACTGGCAATC TTGGGCATAT CTTCCAAGGT GGTCGGTTAT CAGGCGGGAC

751 ATAAAACGCT TACCGGGTG CAAAGCGGCA ATATGTCTGC CGATGCGGTG

801 A
```

This corresponds to the amino acid sequence <SEQ ID 1270; ORF 306.a>:

```
a306.pep
   1 MFMNKFSQSG KGLSGFFFGL ILATVIIAGI LFYLNQSGQN AFKIPVPSKQ

51 PAETEILKPK NQPKEDIQPE PADQNALSEP DAAKEAEQSD AEKAADKQPV

101 ADKADEVEEK ADEPEREKSD GQAVRKKALT EEREQTVGEK AQKKDAETVK

151 KQAVKPSKET EKKASKEEKK AEKEKVAPKP TPEQILNSGS IEKARSAAAK

201 EVQKMKTPTR RKQRIICKWA RMPTAGARKG SVPNWQSWAY LPRWSVIRRD

251 IKRFTGCKAA ICLPMR*
``` m306/a306 93.7% identity in 252 aa overlap

```
                        10         20         30         40
   m306.pep             GLFFGLILATVIIAGILFYLNQSGQNAFKIPASSKQPAETEILKPX
                          :||||||||||||||||||||||||||||:  ||||||||||||
   a306      MFMNKFSQSGKGLSGFFFGLILATVIIAGILLYLNQSGQNAFKIPVPSKQPAETEILKPK
                        10        20        30        40        50        60

50         60         70         80         90        100
   m306.pep NQXKEDIQPXPADQNALSEPDAATEAEQSDAEXAADKQPVADKADEVEEKAGEPEREEPD
            || ||||||  ||||||||||||| |||||||| ||||||||||||||||||| :  |
   a306     NQPKEDIAPEPADQNALSEPDAAKEAEQSDAEKAADKQPVADKADEVEEKADEPEREKSD
                    70         80         90        100       110        120

110        120        130        140        150        160
   m306.pep GQAVRKKALTEEREQTVREKAQKKDAETVKXQAVKPSKETEKKASKEEKKAAKEKVAPKP
            ||||||||||||||||||| ||||||||||| |||||||||||||||||||| |||||||
   a306     CQAVRKKALTEEREQTVGEKAQKKDAETVKKQAVKPSKETEKKASKEEKKAEKEKVAPKP
                    130        140        150        160       170        180

170        180        190        200        210        220
   m306.pep TPEQILNSGSIEKARSAAAKEVQKMKTPTRRKQRIICKWARMPTVRATKGSVPNWQSWAY
            |||||||||||||||||||||||||||||||||||||||||||| : |||||||||||||
   a306     TPEQILNSGSIEKARSAAAKEVQKMKTPTRRKQRIICKWARMPTAGARKGSVPNWQSWAY
                    190        200        210        220       230        240

230        240        250
   m306.pep LPRWSVIRRDIKRFTGCKAAICLPMRX
            ||||||||||||||||||||||||||
   a306     LPRWSVIRRDIKRFTGCKAAICLPMRX
                    250        260
```

40

The following partial DNA sequence was identified in *N. gonorrhoeae* <SEQ ID 1271>:

```
g307.seq
   1 atgaaaacct tcttcaaaac cctttcgacc gcgtcactcg cgctcatcct 51 cgcagcctgc ggcggtcaaa aagacagcgc gcccgcagcc tctgccgccg 101 ccccttctgc cgataacggc gcggcgaaaa aagaaatcgt cttcggcacg 151 accgtgggcg acttcggcga tatggtcaaa gaacaaatcc aagccgagct 201 ggagaaaaaa ggctacaccg tcaaattggt cgaatttacc gactatgtgc 251 gcccgaatct ggcattggcg gagggcgagt tggacatcaa cgtcttccaa 301 cacaaaccct atcttgacga tttcaaaaaa gaacacaacc tggacatcac 351 cgaagccttc caagtgccga ccgcgccttt gggactgtat ccgggcaaac 401 tgaaatcgct ggaagaagtc aaagacggca gcaccgtatc cgcgcccaac 451 gacccgtcca acttcgcacg cgccttggtg atgctgaacg aactgggttg 501 gatcaaactc aaagacggca tcaatccgct gaccgcatcc aaagccgaca 551 tcgcggaaaa cctgaaaaac atcaaaatcg tcgagcttga agccgcacaa 601 ctgccgcgca gccgcgccga cgtggatttt gccgtcgtca acggcaacta
```

-continued
```
651 cgccataagc agcggcatga agctgaccga agccctgttc aagagccga 701 gctttgccta tgtcaactgg tctgccgtca aaaccgccga caaagacagc 751 caatggctta aagacgtaac cgaggcctat aactccgacg cgttcaaagc 801 ctacgcgcac aaacgcttcg agggctacaa atacccctgcc gcatggaatg 851 aaggcgcagc caaataa
```

This corresponds to the amino acid sequence <SEQ ID 1272; ORF 307.ng>:

```
g307.pep
  1 MKTFFKTLST ASLALILAAC GGQKDSAPAA SAAAPSADNG AAKKEIVFGT

51 TVGDFGDMVK EQIQAELEKK GYTVKLVEFT DYVRPNLALA EGELDINVFQ

101 HKPYLDDFKK EHNLDITEAF QVPTAPLGLY PGKLKSLEEV KDGSTVSAPN

151 DPSNFARALV MLNELGWIKL KDGINPLTAS KADIAENLKN IKIVELEAAQ

201 LPRSRADVDF AVVNGNYAIS SGMKLTEALF QEPSFAYVNW SAVKTADKDS

251 QWLKDVTEAY NSDAFKAYAH KRFEGYKYPA AWNEGAAK*
```

The following partial DNA sequence was identified in *N. meningitidis* <SEQ ID 1273>:

```
m307.seq(partial)
  1 ..CAATGGCTTA AAGACGTAAC CGAGGCCTAT AACTCCGACG CGTTCAAAGC

51    CTACGCGCAC AAACGCTTCG AGGGCTACAA ATCCCCTGCC GCATGGAATG

101    AAGGCGCAGC CAAATAA
```

This corresponds to the amino acid sequence <SEQ ID 1274; ORF 307>:

```
    m307.pep (partial)
      1 ..QWLKDVTEAY NSDAFKAYAH KRFEGYKSPA AWNEGAAK*
```

Computer analysis of this amino acid sequence gave the following results:
Homology with a Predicted ORF from *N. gonorrhoeae*

ORF 307 shows 97.4% identity over a 38 aa overlap with a predicted ORF (ORF 307.ng) from *N. gonorrhoeae*:

```
    m307/g307

10         20         30
        m307.pep                       QWLKDVTEAYNSDAFKAYAHKRFEGYKSPA
                                       ||||||||||||||||||||||||||| ||
        g307        SGMKLTEALFQEPSFAYVNWSAVKTADKDSQWLKDVTEAYNSDAFKAYAHKRFEGYKYPA
                        230        240        250        260        270        280
                       39
        m307.pep   AWNEGAAKX
                   |||||||||
        g307       AWNEGAAKX
```

The following partial DNA sequence was identified in *N. meningitidis* <SEQ ID 1275>:

```
a307.seq
  1 ATGAAAACCT TCTTCAAAAC CCTTTCCGCC GCCGCACTCG CGCTCATCCT

51 CGCCGCCTGC GGCGGTCAAA AAGATAGCGC GCCCGCCGCA TCCGCTTCTG
```

```
-continued
101 CCGCCGCCGA CAACGGCGCG GCGAAAAAAG NAATCGTCTT CGGCACGACC

151 GTCGGCGACT TCGGCGATAT GGTCAAAGAA CAAATCCAAC CCGAGCTGGA

201 GAAAAAGGC TACACCGTCA AACTGGTCGA GTTTACCGAC TATGTGCGCC

251 CGAATCTGGC ATTGGCTGAG GGCGAGTNGG ACATCAACGT CTTCCAACAC

301 AAACCCTATC TTGACGACTT CAAAAAAGAA CACAATCTGG ACATCACCGA

351 AGTCTTCCAA GTGCCGACCG CGCCTTTGGG ACTGTACCCG GGCAAGCTGA

401 AATCGCTGGA AGAAGTCAAA GACGGCAGCA CCGTATCCGC GCCCAACGAC

451 CCGTCCAACT TCGCCCGCGT CTTGGTGATG CTCGACGAAC TGGGTTGGAT

501 CAAACTCAAA GANGGCATCA ATCCGCTGAC CGCATCCAAA GCGGACATTG

551 CCGAAAACCT GAAAAACATC AAAATCGTCG AGCTTGAAGC CGCGCAACTG

601 CCGCGTAGCC GCGCCGACGT GGATTTTGNC GTCGTCAACG GCAANTACGC

651 CATAAGCAGC GGCATGAAGC TGACCGAAGC CCTGTTCCAA GAACCGAGCT

701 TTGCCTATGT CAACTGGTCT GCCGTCAAAA CCGCCGACAA AGACAGCCAA

751 TGGCTTAAAG ACGTAACCGA GGCCTATAAC TCCGACGCGT TCAAAGCCTA

801 CGCGCACAAA CGCTTCGAGG GCTACAAATC CCCTGCCGCA TGGAATGAAG

851 GCGCAGCCAA ATAA
```

This corresponds to the amino acid sequence <SEQ ID 1276; ORF 307.a>:

```
a307.pep
  1 MKTFFKTLSA AALALILAAC GGQKDSAPAA SASAAADNGA AKKXIVFGTT

51 VGDFGDMVKE QIQPELEKKG YTVKLVEFTD YVRPNLALAE GEXDINVFQH

101 KPYLDDFKKE HNLDITEVFQ VPTAPLGLYP GKLKSLEEVK DGSTVSAPND

151 PSNFARVLVM LDELGWIKLK XGINPLTASK ADIAENLKNI KIVELEAAQL

201 PRSRADVDFX VVNGXYAISS GMKLTEALFQ EPSFAYVNWS AVKTADKDSQ

251 WLKDVTEAYN SDAFKAYAHK RFEGYKSPAA WNEGAAK*
``` m307/a307 100.0% identity in 38 aa overlap

```
                                         10        20        30
      m307.pep             QWLKDVTEAYNSDAFKAYAHKRFEGYKSPA
                           ||||||||||||||||||||||||||||||
      a307     SGMKLTEALFQEPSFAYVNWSAVKTADKDSQWLKDVTEAYNSDAFKAYAHKRFEGYKSPA
                220       230       240       250       260       270

39
      m307.pep   AWNEGAAKX
                 |||||||||
      a307       AWNEGAAKX
                 280
```

The following partial DNA sequence was identified in *N. gonorrhoeae* <SEQ ID 1277>:

```
g308.seq
  1 ATGTTAAATC GGGTATTTTA TCGGATATTG GGTGTTGCCG ACAATTTGTA

51 TCCGTGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC
```

-continued

```
151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGCGCGG

251 AGATGGCGCG CGCTTCGGAA ACGGATTATA CGAAAGACGA AGTATATGCC

301 TTGGCTGATT TCGTCCATCC GATCGGCAAT ATCGGGCGT GCATTGCCAG

351 CGGTACGTTT AAAACGGACG GGATGCTGGT CGCACCCTGT TCGATGCGGA

401 CGCTTGCCTC TGTCGCGCAC GGCTTCGGCG ACAACCTCTT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GTAACGGAAA

551 TGGGCGGCGT GGTGTTTCCC CCTGTTCCTG CGATGTACCG CAAGCCGCAG

601 ACGGCGGACG ACATAGTGGC GCACAGTATC GCACACACGC TGTCGCTGTT

651 CGGAATCGAT ACGCCGGATT TGGCGGAATG GCAGGGAATG GCGGATTAA
```

This corresponds to the amino acid sequence <SEQ ID 1278; ORF 308.ng>:

```
g308.pep
  1 MLNRVFYRIL GVADNLYPCL SDFCFFTIIA GLPLQAVLWE RRMMVRRLII

51 GISGASGFQY GVKALELLRA QDVETHLVVS KGAEMARASE TDYTKDEVYA

101 LADFVHPIGN IGACIASGTF KTDGMLVAPC SMRTLASVAH GFGDNLLTRA

151 ADVVLKERRR LVLMVRETPL NLAHLDNMKR VTEMGGVVFP PVPAMYRKPQ

201 TADDIVAHSI AHTLSLFGID TPDLAEWQGM AD*
```

The following partial DNA sequence was identified in *N. meningitidis* <SEQ ID 1279>:

```
m308.seq (partial)
  1 ATGTTAAATC GGGTATTTTA TCGGATATTG GGTGTTGCCG ACAATTTGTA

51 TCCGCGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGTGCGG

251 AGATGGCGCG CGCTTCGGAA ACGGCTTATG CGAGAGACGA GGTATATGCC

301 TTGGCGGACT TCGTGCATCC GATCGGCAAT ATCGGGGCGT GCATTGCCAG

351 CGGTACGTTT AAAACGGATG GGATGCTGGT CGCCCCCTGT TCGATGCGGA

401 CGCTTGCCTC TGTCGCGCAC GGCTTCGGCG ACAATCTGcT GACGCGtGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GwAACGGAAA

551 TGGGCGGCGT GGTGTTTCCC CCTGTTCCTG CGATGTACCG CAAACCGCAG

601 ACGGCGGACG ACATAGTGGC GCACAGTGTT GCACACGCtT TGTCGCTGTT

651 CGGAATCGAT ACGCCGGATT CGGCGGAATG GCArGGAATG gcG . . .
```

This corresponds to the amino acid sequence <SEQ ID 1280; ORF 308>:

```
m308.pep (partial)
  1 MLNRVFYRIL GVADNLYPRL SDFCFFTIIA GLPLQAVLWE RRMMVRRLII

51 GISGASGFQY GVKALELLRA QDVETHLVVS KGAEMARASE TAYARDEVYA
```

-continued

```
101 LADFVHPIGN IGACIASGTF KTDGMLVAPC SMRTLASVAH GFGDNLLTRA

151 ADVVLKERRR LVLMVRETPL NLAHLDNMKR XTEMGGVVFP PVPAMYRKPQ

201 TADDIVAHSV AHALSLFGID TPDSAEWQGM A..
```

Computer analysis of this amino acid sequence gave the following results:
Homology with a Predicted ORF from *N. gonorrhoeae*
ORF 308 shows 96.5% identity over a 231 aa overlap with a predicted ORF (ORF 308.ng) from *N. gonorrhoeae*:

```
   m308/g308
                   10        20        30        40        50        60
   m308.pep MLNRVFYRILGVADNLYPRLSDFCFFTIIAGLPLQAVLWERRMMVRRLIIGISGASGFQY
            ||||||||||||||||||||||||||||||||||||||||||||||||||||||||||||
   g308     MLNRVFYRILGVADNLYPRLSDFCFFTIIAGLPLQAVLWERRMMVRRLIIGISGASGFQY
                   10        20        30        40        50        60

70        80        90       100       110       120
   m308.pep GVKALELLRAQDVETHLVVSKGAEMARASETAYARDEVYALADFVHPIGNIGACIASGTF
            |||||||||||||||||||||||||||||||||||::|||||||||||||||||||||||
   g308     GVKALELLRAQDVETHLVVSKGAEMARASETAYTKDEVYALADFVHPIGNIGACIASGTF
                   70        80        90       100       110       120

130       140       150       160       170       180
   m308.pep KTDGMLVAPCSMRTLASVAHGFGDNLLTRAADVVLKERRRLVLMVRETPLNLAHLDNMKR
            ||||||||||||||||||||||||||||||||||||||||||||||||||||||||||||
   g308     KTDGMLVAPCSMRTLASVAHGFGDNLLTRAADVVLKERRRLVLMVRETPLNLAHLDNMKR
                  130       140       150       160       170       180

190       200       210       220       230
   m308.pep XTEMGGVVFPPVPAMYRKPQTADDIVAHSVAHALSLFGIDTPDSAEWQGMA
            |||||||||||||||||||||||||||||||:||:|||||||||||||||||
   g308     XTEMGGVVFPPVPAMYRKPQTADDIVAHSIAHTLSLFGIDTPDSAEWQGMADX
                  190       200       210       220       230
```

The following partial DNA sequence was identified in *N. meningitidis* <SEQ ID 1281>:

```
a308.seq
  1 ATGTTAAATC GGATATTTTA TCGGATATTG GGTGTTGCCG ACAATTTGTA

51 TCCGTATTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGTG GGGCGAGCGG TTTCCAATAC GGCGTGAAGG CTTTGGANCT

201 TTTACGCGCG CAAGATATCG AAACGCACCT TGTGGTATCG AAAGGTGCGG

251 AGATGGCGCG CGCTTCGGAA ACGGNTTATG CGAGAGACGA NGTATATGCC

301 TTGGCGGACT TNGTGCATCC GATCGGCAAT ATCGGGGCGT GCATTGCCAG

351 CGGTACGTTT AAAACGGACG GGATGCTGGT CGCCCCCTGT TCGATGCGGA

401 CGCTTGCCTC GGTCGTGCAC GGCTTCGGCG ACAACCTCTT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAANCGG GTAACGGAAA

551 TGGGCGGCGT GGTGTTTCCC CCTGTTCCTG CGATGTACCG CAAACCGCAG

601 ACGGCGGACG ACATAGTGGC GCACAGTGTT GCACACGCTT TGTCGCTGTT

651 CGGAATCGAT ACGCCGGATT CGGCGGAATG GCAGGGAATG GCGGATTAA
```

This corresponds to the amino acid sequence <SEQ ID 1282; ORF 308.a>:

```
a308.pep
  1 MLNRIFYRIL GVADNLYPYL SDFCFFTIIA GLPLQAVLWE RRMMVRRLII

51 GISGASGFQY GVKALXLLRA QDIETHLVVS KGAEMARASE TXYARDXVYA

101 LADXVHPIGN IGACIASGTF KTDGMLVAPC SMRTLASVVH GFGDNLLTRA

151 ADVVLKERRR LVLMVRETPL NLAHLDNMXR VTEMGGVVFP PVPAMYRKPQ

201 TADDIVAHSV AHALSLFGID TPDSAEWQGM AD*
``` m308/a308 95.7% identity in 231 aa overlap

```
                 10         20         30         40         50         60
    m308.pep MLNRVFYRILGVADNLYPRLSDFCFFTIIAGLPLQAVLWERRMMVRRLIIGISGASGFQY
             ||||:||||||||||||| ||||||||||||||||||||||||||||||||||||||||
        a308 MLNRIFYRILGVADNLYPYLSDFCFFTIIAGLPLQAVLWERRMMVRRLIIGISGASGFQY
                 10         20         30         40         50         60
                 70         80         90        100        110        120
    m308.pep GVKALELLRAQDVETHLVVSKGAEMARASETAYARDEVYALADFVHPIGNIGACIASGTF
             ||||| ||||||:|||||||||||||||||| |||| |||||| |||||||||||||||
        a308 GVKALXLLRAQDIETHLVVSKGAEMARASETXYARDXVYALADXVHPIGNIGACIASGTF
                 70         80         90        100        110        120
                130        140        150        160        170        180
    m308.pep KTDGMLVAPCSMRTLASVAHGFGDNLLTRAADVVLKERRRLVLMVRETPLNLAHLDNMKR
             ||||||||||||||||||:|||||||||||||||||||||||||||||||||||||||| |
        a308 KTDGMLVAPCSMRTLASVVHGFGDNLLTRAADVVLKERRRLVLMVRETPLNLAHLDNMXR
                130        140        150        160        170        180
                190        200        210        220        230
    m308.pep XTEMGGVVFPPVPAMYRKPQTADDIVAHSVAHALSLFGIDTPDSAEWQGMA
             |||||||||||||||||||||||||||||||||||||||||||||||||||
        a308 VTEMGGVVFPPVPAMYRKPQTADDIVAHSVAHALSLFGIDTPDSAEWQGMADX
                190        200        210        220        230
```

The following partial DNA sequence was identified in *N. gonorrhoeae* <SEQ ID 1283>:

```
g308-1.seq
  1 ATGTTAAATC GGGTATTTTA TCGGATATTG GGTGTTGCCG ACAATTTGTA

51 TCCGTGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGCGCGG

251 AGATGGCGCG CGCTTCGGAA ACGGATTATA CGAAAGACGA AGTATATGCC

301 TTGGCTGATT TCGTCCATCC GATCGGCAAT ATCGGGGCGT GCATTGCCAG

351 CGGTACGTTT AAAACGGACG GGATGCTGGT CGCACCCTGT TCGATGCGGA

401 CGCTTGCCTC TGTCGCGCAC GGCTTCGGCG ACAACCTCTT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GTAACGGAAA

551 TGGGCGGCGT GGTGTTTCCC CCTGTTCCTG CGATGTACCG CAAGCCGCAG

601 ACGGCGGACG ACATAGTGGC GCACAGTATC GCACACACGC TGTCGCTGTT

651 CGGAATCGAT ACGCCGGATT TGGCGGAATG GCAGGGAATG GCGGATTAA
```

This corresponds to the amino acid sequence <SEQ ID 1284; ORF 308-1.ng>:

```
g308-1.pep
  1 MLNRVFYRIL GVADNLYPCL SDFCFFTIIA GLPLQAVLWE RRMMVRRLII

51 GISGASGFQY GVKALELLRA QDVETHLVVS KGAEMARASE TDYTKDEVYA

101 LADFVHPIGN IGACIASGTF KTDGMLVAPC SMRTLASVAH GFGDNLLTRA

151 ADVVLKERRR LVLMVRETPL NLAHLDNMKR VTEMGGVVFP PVPAMYRKPQ

201 TADDIVAHSI AHTLSLFGID TPDLAEWQGM AD*
```

The following partial DNA sequence was identified in *N. meningitidis* <SEQ ID 1285>:

```
m308-1.seq
  1 ATGTTAAATC GGGTATTTTA TCGGATATTG GGTGTTGCCG ACAATTTGTA

51 TCCGCGTTTA TCGGATTTCT GTTTTTTCAC TATAATAGCC GGTTTGCCGT

101 TGCAGGCGGT TTTATGGGAA AGGCGGATGA TGGTACGGCG TTTGATAATC

151 GGCATCAGCG GGGCGAGCGG TTTCCAATAC GGCGTGAAGG CTTTGGAACT

201 TTTGCGCGCG CAAGATGTCG AAACGCACCT TGTGGTATCG AAAGGTGCGG

251 AGATGGCGCG CGCTTCGGAA ACGGCTTATG CGAGAGACGA GGTATATGCC

301 TTGGCGGACT TCGTGCATCC GATCGGCAAT ATCGGGGCGT GCATTGCCAG

351 CGGTACGTTT AAAACGGATG GGATGCTGGT CGCCCCCTGT TCGATGCGGA

401 CGCTTGCCTC TGTCGCGCAC GGCTTCGGCG ACAATCTGCT GACGCGTGCG

451 GCGGATGTGG TTTTGAAGGA AAGGCGGCGG CTGGTGCTGA TGGTGCGCGA

501 AACGCCGCTG AACCTTGCCC ATTTGGACAA TATGAAGCGG GTAACGGAAA

551 TGGGCGGCGT GGTGTTTCCC CCTGTTCCTG CGATGTACCG CAAACCGCAG

601 ACGGCGGACG ACATAGTGGC GCACAGTGTT GCACACGCTT TGTCGCTGTT

651 CGGAATCGAT ACGCCGGATT CGGCGGAATG GCAGGGAATG GCGGATTAA
                                                      40
```

This corresponds to the amino acid sequence <SEQ ID 1286; ORF 308-1>:

```
m308-1.pep
  1 MLNRVFYRIL GVADNLYPRL SDFCFFTIIA GLPLQAVLWE RRMMVRRLII

51 GISGASGFQY GVKALELLRA QDVETHLVVS KGAEMARASE TAYARDEVYA

101 LADFVHPIGN IGACIASGTF KTDGMLVAPC SMRTLASVAH GFGDNLLTRA

151 ADVVLKERRR LVLMVRETPL NLAHLDNMKR VTEMGGVVFP PVPAMYRKPQ

201 TADDIVAHSV AHALSLFGID TPDSAEWQGM AD* m308-1/g308-1 97.0% identity in 232 aa overlap 10        20        30        40        50        60
m308-1.pep  MLNRVFYRILGVADNLYPRLSDFCFFTIIAGLPLQAVLWERRMMVRRLIIGISGASGFQY
            ||||||||||||||||||| |||||||||||||||||||||||||||||||||||||||
g308-1      MLNRVFYRILGVADNLYPCLSDFCFFTIIAGLPLQAVLWERRMMVRRLIIGISGASGFQY
                    10        20        30        40        50        60

70        80        90       100       110       120
m308-1.pep  GVKALELLRAQDVETHLVVSKGAEMARASETAYARDEVYALADFVHPIGNIGACIASGTF
            ||||| |||||||||||||||||||||||||::|||||||||||||||||||||||||||
g308-1      GVKALXLLRAQDVETHLVVSKGAEMARASETDYKRDEVYALADFVHPIGNIGACIASGTF
                    70        80        90       100       110       120
```

```
                  130        140        150        160        170        180
m308-1.pep KTDGMLVAPCSMRTLASVAHGFGDNLLTRAADVVLKERRRLVLMVRETPLNLAHLDNMKR
           ||||||||||||||||||||||||||||||||||||||||||||||||||||||||||||
g308-1     KTDGMLVAPCSMRTLASVAHGFGDNLLTRAADVVLKERRRLVLMVRETPLNLAHLDNMKR
                  130        140        150        160        170        180

190        200        210        220        230
m308.pep   VTEMGGVVFPPVPAMYRKPQTADDIVAHSVAHALSLFGIDTPDSAEWQGMADX
           ||||||||||||||||||||||||||||||||:||:||||||||| ||||||||
g308       VTEMGGVVFPPVPAMYRKPQTADDIVAHSIAHTLSLFGIDTPDLAEWQGMADX
                  190        200        210        220        230
```

The following partial DNA sequence was identified in *N. meningitidis* <SEQ ID 1287>:

```
a308-1.seq
  1 ATGTTAAATC GGATATTTTA

-continued

```
              190        200        210        220        230
a308-1 VTEMGGVVFPPVPAMYRKPQTADDIVAHSVAHALSLFGIDTPDSAEWQGMADX
       ||||||||||||||||||||||||||||||||||||||||||||||||||||
m308-1 VTEMGGVVFPPVPAMYRKPQTADDIVAHSVAHALSLFGIDTPDSAEWQGMADX
              190        200        210        220        230
```

The following partial DNA sequence was identified in *N. gonorrhoeae* <SEQ ID 1289>:

```
g311.seq
   1 atgttcagtt tcggctgggc gtttgaccgc ccgcagtatg agttgggttc
  51 gctgtcgcct gttgcggcac ttgcgtgccg gcgcgctttg gggtgtttgg
 101 gtttggaaac gcaaatcaag tggccaaacg atttggtcgt cggacgcgac
 151 aaattgggcg gcattctgat tgaaacagtc agggcgggcg gtaaaacggt
 201 tgccgtggtc ggtatcggca tcaatttcgt gctgcccaag gaagtggaaa
 251 acgccgcttc cgtgcagtcg ctgtttcaga cggcatcgcg gcggggcaat
 301 gccgatgccg ccgtattgct ggaaacattg cttgcgaaac tgggcgcggt
 351 gttggaacaa tatgcggaag aagggttcgc gccattttta aatgagtatg
 401 aaacggccaa ccgcgaccac ggcaaggcgg tattgctgtt gcgcgacggc
 451 gaaaccgtgt gcgaaggcac ggttaaaggc gtggacggac gaggcgttct
 501 gcacttggaa acggcagaag gcgaacagac ggtcgtcagc ggcgaaatca
 551 gcctgcggcc cgacaacagg tcggtttccg tgccgaagcg gccggattcg
 601 gaacgttttt tgctgttgga aggcgggaac agccggctca gtgggcgtg
 651 ggtggaaaac ggcacgttcg caaccgtggg cagcgcgccg taccgcgatt
 701 tgtcgccttt gggcgcggag tgggcggaaa aggcggatgg aaatgtccgc
 751 atcgtcggtt gcgccgtgtg cggagaatcc aaaaaggcac aagtgaagga
 801 acagctcgcc cgaaaaatcg agtggctgcc gtcttccgca caggctttgg
 851 gcatacgcaa ccactaccgc caccccgaag aacacggttc cgaccgttgg
 901 ttcaacgcct tgggcagccg ccgcttcagc cgcaacgcct gcgtcgtcgt
 951 cagttgcggc acggcggtaa cggttgacgc gctcaccgat gacggacatt
1001 atctcggcgg aaccatcatg cccggcttcc acctgatgaa agaatcgctc
1051 gccgtccgaa ccgccaacct caaccgcccc gccggcaaac gttaccctt
1101 cccgaccaca acgggcaacg ccgtcgcaag cggcatgatg gacgcggttt
1151 gcggctcgat aatgatgatg cacggccgtt tgaaagaaaa aaacggcgcg
1201 ggcaagcctg tcgatgtcat cattaccggc ggcggcgcgg cgaaagtcgc
1251 cgaagccctg ccgcctgcat ttttggcgga aataccgtg cgcgtggcgg
1301 acaacctcgt catccacggg ctgctgaacc tgattgccgc cgaaggcggg
1351 gaatcggaac acgcttaa
```

This corresponds to the amino acid sequence <SEQ ID 1290; ORF 311.ng>:

```
g311.pep
   1 MFSFGWAFDR PQYELGSLSP VAALACRRAL GCLGLETQIK WPNDLVVGRD
  51 KLGGILIETV RAGGKTVAVV GIGINFVLPK EVENAASVQS LFQTASRRGN
 101 ADAAVLLETL LAELGAVLEQ YAEEGFAPFL NEYETANRDH GKAVLLLRDG
```

-continued
```
151 ETVCEGTVKG VDGRGVLHLE TAEGEQTVVS GEISLRPDNR SVSVPKRPDS

201 ERFLLLEGGN SRLKWAWVEN GTFATVGSAP YRDLSPLGAE WAEKADGNVR

251 IVGCAVCGES KKAQVKEQLA RKIEWLPSSA QALGIRNHYR HPEEHGSDRW

301 FNALGSRRFS RNACVVVSCG TAVTVDALTD DGHYLGGTIM PGFHLMKESL

351 AVRTANLNRP AGKRYPFPTT TGNAVASGMM DAVCGSIMMM HGRLKEKNGA

401 GKPVDVIITG GGAAKVAEAL PPAFLAENTV RVADNLVIHG LLNLIAAEGG

451 ESEHA*
```

The following partial DNA sequence was identified in *N. meningitidis* <SEQ ID 1291>:

```
m311.seq (partial)
    1 ATGTTCAGTT TTGGCTGGGT GTTTGACCGG CCGCAGTATG AGTTGGGTTC

51 GCTGTCGCCT GTTGCGGCAG TGGCGTGTCG GCGCGCCTTG TCGCGTTTAG

101 GTTTGGATGT GCArATTAAG TGGCCCAATG ATTTGGTTGT CGGACGCGAC

151 AAATTGGGCG GCATTCTGAT TGAAACGGTC AGGACGGGCG GCAAAACGGT

201 TGCCGTGGTC GGTATCGGCA TCAATTTTGT CCTGCCCAAn GAAGTAGAAA

251 ATGCCGCTTC CGTGCAATCG CTGTTTCAGA CGGCATCGCG GCGGGGCAAT

301 GCCGATGCCG CCGTGCTGCT nnnnnnnnnn nnnnnnnnnn nnnnGGAAAT

351 CAGCCTGCGG TCCGACnACA GGCCGGTTTC CGTGnCGAAG CGGCGGGATT

401 CGGAACGTTT TCTGCTGTTG GACGGCGGCA ACAGCCGGCT CAAGTGGgCG

451 TGGGTGGAAA ACGGCACGTT CGCAACCGTC GGTAGCGCGC CGTACCgCGA

501 TTTGTCGCCT TTGGGCGCGG AGTGGGCGGA AAAGGCGGAT GGAAATGTCC

551 GCATCGTCGG TTGCGCTGTG TGCGGAGAAT TCAAAAAGGC ACAAGTGCAG

601 GAACAGCTCG CCCGAAAAAT CGAGTGGCTG CCGTCTTCCG CACAGGCTTT

651 GTTTGGCATA CGCAACCACT ACCGCCACCC CGAAGAACAC GGTTCCGACC

701 GCTGGTTCAA CGCCTTGGGC AGCCGCCGCT TCAGCCGCAA CGCyTGCGTC

751 GTCGTCAGTT GCGGCACGGC GGTAACGGTT GACGCGCTCA CCGATGACGG

801 ACATTATCTC GGrgGAACCA TCATGCCCGG TTTCCACCTG ATGAAAGAAT

851 CGCTCGCCGT CCGAACCGCC AACCTCAACC GGCACGCCGG TAAGCGTTAT

901 CCTTTCCCGA CCACAACGGG CAATGCCGTC GCCAGCGGCA TGATGGATGC

951 GGTTTGCGGC TCGGTTATGA TGATGCACGG GCGTTTGAAA GAAAAAACCG

1001 GGGCGGGCAA GCCTGTCGAT GTCATCATTA CCGGCGGCGG CGCGGCAAAA

1051 GTTGCCGAAG CCCTGCCGCC TGCATTTTTG GCGGAAAATA CCGTGCGCGT

1101 GGCGGACAAC CTCGTCATTT ACGGGTTGTT GAACATGATT GCCGCCGAAG

1151 GCAGGGAATA TGAACAT....
```

This corresponds to the amino acid sequence <SEQ ID 1292; ORF 311>:

```
m311.pep (partial)
    1 MFSFGWVFDR PQYELGSLSP VAAVACRRAL SRLGLDVQIK WPNDLVVGRD

51 KLGGILIETV RTGGKTVAVV GIGINFVLPX EVENAASVQS LFQTASRRGN

101 ADAAVLLXXX XXXXXEISLR SDXRPVSVXK RRDSERFLLL DGGNSRLKWA
```

-continued

```
151 WVENGTFATV GSAPYRDLSP LGAEWAEKAD GNVRIVGCAV CGEFKKAQVQ

201 EQLARKIEWL PSSAQALFGI RNHYRHPEEH GSDRWFNALG SRRFSRNACV

251 VVSCGTAVTV DALTDDGHYL GGTIMPGFHL MKESLAVRTA NLNRHAGKRY

301 PFPTTTGNAV ASGMMDAVCG SVMMMHGRLK EKTGAGKPVD VIITGGGAAK

351 VAEALPPAFL AENTVRVADN LVIYGLLNMI AAEGREYEH....
```

Computer analysis of this amino acid sequence gave the following results:
Homology with a Predicted ORF from *N. gonorrhoeae*
ORF 311 shows 78.5% identity over a 455 aa overlap with a predicted ORF (ORF 311.ng) from *N. gonorrhoeae*:

```
    m311/g311
                      10         20         30         40         50         60
        m311.pep  MFSFGWVFDRPQYELGSLSPVAAVACRRALSRLGLDVQIKWPNDLVVGRDKLGGILIETV
                  ||||||:||||||||||||||:||||||:|||::||||||||||||||||||||
        g311      MFSFGWAFDRPQYELGSLSPVAALACRRALGCLGLETQIKWPNDLVVGRDKLGGILIETV
                      10         20         30         40         50         60

70         80         90        100        110
        m311.pep  RTGGKTVAVVGIGINFVLPXEVENAASVQSLFQTASRRGNADAAVLLXXX----------
                  |:||||||||||||||||| ||||||||||||||||||||||||||| :
        g311      RAGGKTVAVVGIGINFVLPKEVENAASVQSLFQTASRRGNADAAVLLETLLAELGAVLEQ
                      70         80         90        100        110        120 m311.pep  ---------------------------------------------------------XXXX
                                                                              :
        g311      YAEEGFAPFLNEYETANRDHGKAVLLLRDGETVCEGTVKGVDGRGVLHLETAEGEQTVVS
                      130        140        150        160        170        180

120        130        140        150        160        170
        m311.pep  XEISLRSDXRPVSVXKRRDSERFLLLDGGNSRLKWAWVENGTFATVGSAPYRDLSPLGAE
                  ||||| | | ||| || |||||||||:|||||||||||||||||||||||||||||||||
        g311      GEISLRPDNRSVSVPKRPDSERFLLLEGGNSRLKWAWVEMGTFATVGSAPYRDLSPLGAE
                      190        200        210        220        230        240

180        190        200        210        220        230
        m311.pep  WAEKADGNVRIVGCAVCGEFKKAQVQEQLARKIEWLPSSAQALFGIRNHYRHPEEHGSDR
                  |||||||||||||||||||| |||||:||||||||||||||||| |||||||||||||||
        g311      WAEKADGNVRIVGCAVCGESKKAQVKEQLARKIEWLPSSAQAL-GIRNHYRHPEEHGSDR
                      250        260        270        280        290

240        250        260        270        280        290
        m311.pep  WFNALGSRRFSRNACVVVSCGTAVTVDALTDDGHYLGGTIMPGFHLMKESLAVRTANLNR
                  |||||||||||||||||||||||||||||||||||||||||||||||||||||||||||
        g311      WFNALGSRRFSRNACVVVSCGTAVTVDALTDDGHYLGGTIMPGFHLMKESLAVRTANLNR
                      300        310        320        330        340        350

300        310        320        330        340        350
        m311.pep  HAGKRYPFPTTTGNAVASGMMDAVCGSVMMMHGRLKEKTGAGKPVDVIITGGGAAKVAEA
                  ||||||||||||||||||||||||||:|||||||||||:||||||||||||||||||||
        g311      PAGKRYPFPTTTGNAVASGMMDAVCGSIMMMHGRLKEKNGAGKPVDVIITGGGAAKVAEA
                      360        370        380        390        400        410

360        370        380    389
        m311.pep  LPPAFLAENTVRVADNLVIYGLLNMIAAEGREYEH
                  ||||||||||||||||||||:||||:||||| | ||
        g311      LPPAFLAENTVRVADNLVIHGLLNLIAAEGGESEHAX
                      420        430        440        450
```

The following partial DNA sequence was identified in *N. meningitidis* <SEQ ID 1293>:

```
a311.seq
    1 ATGTTCAGTT TTGGCTGGGT GTTTGACCGG CCGCAGTATG AGTTGGGTTC

51 GCTGTCGCCT GTTGCGGCAG TGGCGTGCCG GCGCGCCTTG TCGCGTTTGG

101 GTTTGAAAAC GCAAATCAAG TGGCCAAACG ATTTGGTCGT CGGACGCGAC

151 AAATTGGGCG GCATTCTGAT TGAAACGGTC AGGACGGGCG GCAAAACGGT

201 TGCCGTGGTC GGTATCGGCA TCAATTTCGT GCTGCCCAAG GAAGTGGAAA
```

-continued

```
 251 ACGCCGCTTC CGTGCAATCG CTGTTTCAGA CGGCATCGCG GCGGGGAAAT

301 GCCGATGCCG CCGTGTTGCT GGAAACGCTG TTGGCGGAAC TTGATGCGGT

351 GTTGTTGCAA TATGCGCGGG ACGGATTTGC GCCTTTTGTG GCGGAATATC

401 AGGCTGCCAA CCGCGACCAC GGCAAGGCGG TATTGCTGTT GCGCGACGGC

451 GAAACCGTGT TCGAAGGCAC GGTTAAAGGC GTGGACGGAC AAGGCGTTCT

501 GCACTTGGAA ACGGCAGAGG GCAAACAGAC GGTCGTCAGC GGCGAAATCA

551 GCCTGCGGTC CGACGACAGG CCGGTTTCCG TGCCGAAGCG GCGGGATTCG

601 GAACGTTTTC TGCTGTTGGA CGGCGGCAAC AGCCGGCTCA AGTGGGCGTG

651 GGTGGAAAAC GGCACGTTCG CAACCGTCGG TAGCGCGCCG TACCGCGATT

701 TGTCGCCTTT GGGCGCGGAG TGGGCGGAAA AGGTGGATGG AAATGTCCGC

751 ATCGTCGGTT GCGCCGTGTG CGGAGAATTC AAAAAGGCAC AAGTGCAGGA

801 ACAGCTCGCC CGAAAAATCG AGTGGCTGCC GTCTTCCGCA CAGGCTTTGG

851 GCATACGCAA CCACTACCGC CACCCCGAAG AACACGGTTC CGACCGCTGG

901 TTCAACGCCT TGGGCAGCCG CCGCTTCAGC CGCAACGCCT GCGTCGTCGT

951 CAGTTGCGGC ACGGCGGTAA CGGTTGACGC GCTCACCGAT GACGGACATT

1001 ATCTCGGGGG AACCATCATG CCCGGTTTCC ACCTGATGAA AGAATCGCTC

1051 GCCGTCCGAA CCGCCAACCT CAACCGGCAC GCCGGTAAGC GTTATCCTTT

1101 CCCGACCACA ACGGGCAATG CCGTCGCCAG CGGCATGATG GATGCGGTTT

1151 GCGGCTCGGT TATGATGATG CACGGGCGTT TGAAAGAAAA AACCGGGGCG

1201 GGCAAGCCTG TCGATGTCAT CATTACCGGC GGCGGCGCGG CAAAAGTTGC

1251 CGAAGCCCTG CCGCCTGCAT TTTTGGCGGA AAATACCGTG CGCGTGGCGG

1301 ACAACCTCGT CATTCACGGG CTGCTGAACC TGATTGCCGC CGAAGGCGGG

1351 GAATCGGAAC ATACTTAA
```

This corresponds to the amino acid sequence <SEQ ID 1294; ORF 311.a>:

```
a311.pep
  1 MFSFGWVFDR PQYELGSLSP VAAVACRRAL SRLGLKTQIK WPNDLVVGRD

51 KLGGILIETV RTGGKTVAVV GIGINFVLPK EVENAASVQS LFQTASRRGN

101 ADAAVLLETL LAELDAVLLQ YARDGFAPFV AEYQAANRDH GKAVLLLRDG

151 ETVFEGTVKG VDGQGVLHLE TAEGKQTVVS GEISLRSDDR PVSVPKRRDS

201 ERFLLLDGGN SRLKWAWVEN GTFATVGSAP YRDLSPLGAE WAEKVDGNVR

251 IVGCAVCGEF KKAQVQEQLA RKIEWLPSSA QALGIRNHYR HPEEHGSDRW

301 FNALGSRRFS RNACVVVSCG TAVTVDALTD DGHYLGGTIM PGFHLMKESL

351 AVRTANLNRH AGKRYPFPTT TGNAVASGMM DAVCGSVMMM HGRLKEKTGA

401 GKPVDVIITG GGAAKVAEAL PPAFLAENTV RVADNLVIHG LLNLIAAEGG

451 ESEHT*
``` m311/a311 81.3% identity in 455 aa overlap

```
                10         20         30         40         50         60
m311.pep  MFSFGWVFDRPQYELGSLSPVAAVACRRALSRLGLDVQIKWPNDLVVGRDKLGGILIETV
          ||||||||||||||||||||||||||||||||||||  ||||||||||||||||||||||
a311      MFSFGWVFDRPQYELGSLSPVAAVACRRALSRLGLKTQIKWPNDLVVGRDKLGGILIETV
                10         20         30         40         50         60

70         80         90        100        110
m311.pep  RTGGKTVAVVGIGINFVLPXEVENAASVQSLFQTASRRGNADAAVLLXXXXXXXXX-----
          ||||||||||||||||||||  ||||||||||||||||||||||||||||            
a311      RTGGKTVAVVGIGINFVLPKEVENAASVQSLFQTASRRGNADAAVLLETLLAELDAVLLQ
                70         80         90        100        110        120 m311.pep  ------------------------------------------------------------ a311      YARDGFAPFVAEYQAANRDHGKAVLLLRDGETVFEGTVKGVDGQGVLHLETAEGKQTVVS
                130        140        150        160        170        180

120        130        140        150        160        170
m311.pep  -EISLRSDXRPVSVXKRRDSERFLLLDGGNSRLKWAWVENGTFATVGSAPYRDLSPLGAE
           ||||||| |||||  ||||||||||||||||||||||||||||||||||||||||||||
a311      GEISLRSDDRPVSVPKRRDSERFLLLDGGNSRLKWAWVENGTFATVGSAPYRDLSPLGAE
                190        200        210        220        230        240

180        190        200        210        220        230
m311.pep  WAEKADGNVRIVGCAVCGEFKKAQVQEQLARKIEWLPSSAQALFGIRNHYRHPEEHGSDR
          |||| ||||||||||||||||||||||||||||||||||||||| ||||||||||||||
a311      WAEKVDGNVRIVGCAVCGEFKKAQVQEQLARKIEWLPSSAQAL-GIRNHYRHPEEHGSDR
                250        260        270        280        290

240        250        260        270        280        290
m311.pep  WFNALGSRRFSRNACVVVSCGTAVTVDALTDDGHYLGGTIMPGFHLMKESLAVRTANLNR
          ||||||||||||||||||||||||||||||||||||||||||||||||||||||||||||
a311      WFNALGSRRFSRNACVVVSCGTAVTVDALTDDGHYLGGTIMPGFHLMKESLAVRTANLNR
                300        310        320        330        340        350

300        310        320        330        340        350
m311.pep  HAGKRYPFPTTTGNAVASGMMDAVCGSVMMMHGRLKEKTGAGKPVDVIITGGGAAKVAEA
          ||||||||||||||||||||||||||||||||||||||||||||||||||||||||||||
a311      HAGKRYPFPTTTGNAVASGMMDAVCGSVMMMHGRLKEKTGAGKPVDVIITGGGAAKVAEA
                360        370        380        390        400        410

360        370        380    389
m311.pep  LPPAFLAENTVRVADNLVIYGLLNMIAAEGREYEH
          ||||||||||||||||||| ||||:||||| | ||
a311      LPPAFLAENTVRVADNLVIHGLLNLIAAEGGESEHTX
                420        430        440        450
```

The following partial DNA sequence was identified in *N. gonorrhoeae* <SEQ ID 1295>:

```
g311-1.seq
   1  ATGACGGTTT TGAAGCCTTC GCATTGGCGG GTGTTGGCGG AGCTTGCCGA

51  CGGTTTGCCG CAACACGTAT CGCAATTGGC GCGTGAGGCG GACATGAAGC

101  CGCAGCAGCT CAACGGTTTT TGGCAGCAGA TGCCGGCGCA TATACGCGGG

151  CTGTTGCGCC AACACGACGG CTATTGGCGG CTGGTGCGCC CCTTGGCGGT

201  TTTCGATGCC GAAGGTTTGC GCGATCTGGG GGAAAGGTCG GGTTTTCAGA

251  CGGCATTGAA GCACGAGTGC GCGTCCAGCA ACGACGAGAT ACTGGAATTG

301  GCGCGGATTG CGCCGGACAA GGCGCACAAA ACCATATGCG TGACCCACCT

351  GCAAAGTAAG GGCAGGGGGC GGCAGGGGCG GAAGTGGTCG CACCGTTTGG

401  GCGAGTGCCT GATGTTCAGT TTCGGCTGGG CGTTTGACCG GCCGCAGTAT

451  GAGTTGGGTT CGCTGTCGCC TGTTGCGGCA CTTGCGTGCC GGCGCGCTTT

501  GGGGTGTTTG GGTTTGGAAA CGCAAATCAA GTGGCCAAAC GATTTGGTCG

551  TCGGACGCGA CAAATTGGGC GGCATTCTGA TTGAAACAGT CAGGGCGGGC

601  GGTAAAACGG TTGCCGTGGT CGGTATCGGC ATCAATTTCG TGCTGCCCAA
```

```
-continued
 651 GGAAGTGGAA AACGCCGCTT CCGTGCAGTC GCTGTTTCAG ACGGCATCGC

701 GGCGGGGCAA TGCCGATGCC GCCGTATTGC TGGAAACATT GCTTGCGGAA

751 CTGGGCGCGG TGTTGGAACA ATATGCGGAA GAAGGGTTCG CGCCATTTTT

801 AAATGAGTAT GAAACGGCCA ACCGCGACCA CGGCAAGGCG GTATTGCTGT

851 TGCGCGACGG CGAAACCGTG TGCGAAGGCA CGGTTAAAGG CGTGGACGGA

901 CGAGGCGTTC TGCACTTGGA AACGGCAGaa ggCGAACAGa cggtcGtcag 951 cggcGaaaTC AGccTGCGGc CCGacaacag gtcggtttcc GTgccgaagc 1001 gGccggatTC GgaacgttTT tTGCTgttgg aaggcgggaa cagccggctc 1051 aAGTGGgcgt gGGTggAAAA Cggcacgttc gcaaccgtgg gcAGCGCgCC 1101 gtaCCGCGAT TTGTCGCCTT TGGGCGCGGA GTGGGCGAAA AAGGCGGATG

1151 GAAATGTCCG CATCGTCGGT TGCGCCGTGT GCGGAGAATC CAAAAAGGCA

1201 CAAGTGAAGG AACAGCTCGC CCGAAAAATC GAGTGGCTGC CGTCTTCCGC

1251 ACAGGCTTTG GGCATACGCA ACCACTACCG CCACCCCGAA GAACACGGTT

1301 CCGACCGTTG GTTCAACGCC TTGGGCAGCC GCCGCTTCAG CCGCAACGCC

1351 TGCGTCGTCG TCAGTTGCGG CACGGCGGTA ACGGTTGACG CGCTCACCGA

1401 TGACGGACAT TATCTCGGCG AACCATCAT GCCCGGCTTC CACCTGATGA

1451 AAGAATCGCT CGCCGTCCGA ACCGCCAACC TCAACCGCCC CGCCGGCAAA

1501 CGTTACCCTT TCCCGACCAC AACGGGCAAC GCCGTCGCAA GCGGCATGAT

1551 GGACGCGGTT TGCGGCTCGA TAATGATGAT GCACGGCCGT TTGAAAGAAA

1601 AAAACGGCGC GGGCAAGCCT GTCGATGTCA TCATTACCGG CGGCGGCGCG

1651 GCGAAAGTCG CCGAAGCCCT GCCGCCTGCA TTTTTGGCGG AAAATACCGT

1701 GCGCGTGGCG GACAACCTCG TCATCCACGG GCTGCTGAAC CTGATTGCCG

1751 CCGAAGGCGG GGAATCGGAA CACGCTTAA
```

This corresponds to the amino acid sequence <SEQ ID 1296; ORF 311-1.ng>:

```
g311-1.pep
   1 MTVLKPSHWR VLAELADGLP QHVSQLAREA DMKPQQLNGF WQQMPAHIRG

51 LLRQHDGYWR LVRPLAVFDA EGLRDLGERS GFQTALKHEC ASSNDEILEL

101 ARIAPDKAHK TICVTHLQSK GRGRQGRKWS HRLGECLMFS FGWAFDRPQY

151 ELGSLSPVAA LACRRALGCL GLETQIKWPN DLVVGRDKLG GILIETVRAG

201 GKTVAVVGIG INFVLPKEVE NAASVQSLFQ TASRRGNADA AVLLETLLAE

251 LGAVLEQYAE EGFAPFLNEY ETANRDHGKA VLLLRDGETV CEGTVKGVDG

301 RGVLHLETAE GEQTVVSGEI SLRPDNRSVS VPKRPDSERF LLLEGGNSRL

351 KWAWVENGTF ATVGSAPYRD LSPLGAEWAE KADGNVRIVG CAVCGESKKA

401 QVKEQLARKI EWLPSSAQAL GIRNHYRHPE EHGSDRWFNA LGSRRFSRNA

451 CVVVSCGTAV TVDALTDDGH YLGGTIMPGF HLMKESLAVR TANLNRPAGK

501 RYPFPTTTGN AVASGMMDAV CGSIMMMHGR LKEKNGAGKP VDVIITGGGA

551 AKVAEALPPA FLAENTVRVA DNLVIHGLLN LIAAEGGESE HA*
```

The following partial DNA sequence was identified in *N. meningitidis* <SEQ ID 1297>:

```
m311-1.seq
   1 ATGACGGTTT TGAAGCTTTC GCACTGGCGG GTGTTGGCGG AGCTTGCCGA
  51 CGGTTTGCCG CAACACGTCT CGCAACTGGC GCGTATGGCG GATATGAAGC
 101 CGCAGCAGCT CAACGGTTTT TGGCAGCAGA TGCCGGCGCA CATACGCGGG
 151 CTGTTGCGCC AACACGACGG CTATTGGCGG CTGGTGCGCC CATTGGCGGT
 201 TTTCGATGCC GAAGGTTTGC GCGAGCTGGG GGAAAGGTCG GGTTTTCAGA
 251 CGGCATTGAA GCACGAGTGC GCGTCCAGCA ACGACGAGAT ACTGGAATTG
 301 GCGCGGATTG CGCCGGACAA GGCGCACAAA ACCATATGCG TGACCCACCT
 351 GCAAAGTAAG GGCAGGGGGC GGCAGGGGCG GAAGTGGTCG CACCGTTTGG
 401 GCGAGTGTCT GATGTTCAGT TTTGGCTGGG TGTTTGACCG GCCGCAGTAT
 451 GAGTTGGGTT CGCTGTCGCC TGTTGCGGCA GTGGCGTGTC GGCGCGCCTT
 501 GTCGCGTTTA GGTTTGGATG TGCAGATTAA GTGGCCCAAT GATTTGGTTG
 551 TCGGACGCGA CAAATTGGGC GGCATTCTGA TTGAAACGGT CAGGACGGGC
 601 GGCAAAACGG TTGCCGTGGT CGGTATCGGC ATCAATTTTG TCCTGCCCAA
 651 GGAAGTAGAA AATGCCGCTT CCGTGCAATC GCTGTTTCAG ACGGCATCGC
 701 GGCGGGGCAA TGCCGATGCC GCCGTGCTGC TGGAAACGCT GTTGGTGGAA
 751 CTGGACGCGG TGTTGTTGCA ATATGCGCGG GACGGATTTG CGCCTTTTGT
 801 GGCGGAATAT CAGGCTGCCA ACCGCGACCA CGGCAAGGCG GTATTGCTGT
 851 TGCGCGACGG CGAAACCGTG TTCGAAGGCA CGGTTAAAGG CGTGGACGGA
 901 CAAGGCGTTT TGCACTTGGA AACGGCAGAG GGCAAACAGA CGGTCGTCAG
 951 CGGCGAAATC AGCCTGCGGT CCGACGACAG GCCGGTTTCC GTGCCGAAGC
1001 GGCGGGATTC GGAACGTTTT CTGCTGTTGG ACGGCGGCAA CAGCCGGCTC
1051 AAGTGGGCGT GGGTGGAAAA CGGCACGTTC GCAACCGTCG GTAGCGCGCC
1101 GTACCGCGAT TTGTCGCCTT TGGGCGCGGA GTGGGCGGAA AAGGCGGATG
1151 GAAATGTCCG CATCGTCGGT TGCGCTGTGT GCGGAGAATT CAAAAAGGCA
1201 CAAGTGCAGG AACAGCTCGC CCGAAAAATC GAGTGGCTGC CGTCTTCCGC
1251 ACAGGCTTTG GGCATACGCA ACCACTACCG CCACCCCGAA GAACACGGTT
1301 CCGACCGCTG GTTCAACGCC TTGGGCAGCC GCCGCTTCAG CCGCAACGCC
1351 TGCGTCGTCG TCAGTTGCGG CACGGCGGTA ACGGTTGACG CGCTCACCGA
1401 TGACGGACAT TATCTCGGGG GAACCATCAT GCCCGGTTTC CACCTGATGA
1451 AAGAATCGCT CGCCGTCCGA ACCGCCAACC TCAACCGGCA CGCCGGTAAG
1501 CGTTATCCTT TCCCGACCAC AACGGGCAAT GCCGTCGCCA GCGGCATGAT
1551 GGATGCGGTT TGCGGCTCGG TTATGATGAT GCACGGGCGT TTGAAAGAAA
1601 AAACCGGGGC GGGCAAGCCT GTCGATGTCA TCATTACCGG CGGCGGCGCG
1651 GCAAAAGTTG CCGAAGCCCT GCCGCCTGCA TTTTTGGCGG AAAATACCGT
1701 GCGCGTGGCG GACAACCTCG TCATTTACGG GTTGTTGAAC ATGATTGCCG
1751 CCGAAGGCAG GGAATATGAA CATATTTAA
```

This corresponds to the amino acid sequence <SEQ ID 1298; ORF 311-1>:

```
m311-1.pep

1  MTVLKLSHWR  VLAELADGLP  QHVSQLARMA  DMKPQQLNGF  WQQMPAHIRG

51  LLRQHDGYWR  LVRPLAVFDA  EGLRELGERS  GRQTALKHEC  ASSNDEILEL

101  ARIAPDKAHK  TICVTHLQSK  GRGRQGRKWS  HRLGECLMFS  FGWVFDRPQY

151  ELGSLSPVAA  VACRRALSRL  GLDVQIKWPN  DLVVGRDKLG  GILIETVRTG

201  GKTVAVVGIG  INFVLPKEVE  NAASVQSLFQ  TASRRGNADA  AVLLETLLVE

251  LDAVLLQYAR  DGFAPFVAEY  QAANRDHGKA  VLLLRDGETV  FEGTVKGVDG

301  QGVLHLETAE  GKQTVVSGEI  SLRSDDRPVS  VPKRRDSERF  LLLDGGNSRL

351  KWAWVENGTF  ATVGSAPYRD  LSPLGAEWAE  KADGNVRIVG  CAVCGEFKKA

401  QVQEQLARKI  EWLPSSAQAL  GIRNHYRHPE  EHGSDRWFNA  LGSRRFSRNA

451  CVVVSCGTAV  TVDALTDDGH  YLGGTIMPGF  HLMKESLAVR  TANLNRHAGK

501  RYPFPTTTGN  AVASGMMDAV  CGSVMMMHGR  LKEKTGAGKP  VDVIITGGGA

551  AKVAEALPPA  FLAENTVRVA  DNLVIYGLLN  MIAAEGREYE  HI* m311-1/g311-1  93.9% identity in 591 aa overlap 10         20         30         40         50         60
m311-1.pep     MTVLKLSHWRVLAELADGLPQHVSQLARMADMKPQQLNGFWQQMPAHIRGLLRQHDGYWR
               ||||||||||||||||||||||||||||| ||||||||||||||||||||||||||||||
g311-1         MTVLKLSHWRVLAELADGLPQHVSQLAREADMKPQQLNGFWQQMPAHIRGLLRQHDGYWR
                       10         20         30         40         50         60

70         80         90        100        110        120
m311-1.pep     LVRPLAVFDAEGLRELGERSGFQTALKHECASSNDEILELARIAPDKAHKTICVTHLQSK
               ||||||||||||||:|||||||||||||||||||||||||||||||||||||||||||||
g311-1         LVRPLAVFDAEGLRDLGERSGFQTALKHECASSNDEILELARIAPDKAHKTICVTHLQSK
                       70         80         90        100        110        120

130        140        150        160        170        180
m311-1.pep     GRGRQGRKWSHRLGECLMFSFGWVFDRPQYELGSLSPVAAVACRRALSRLGLDVQIKWPN
               |||||||||||||||||||||||| :|||||||||||||||||:||||||: |||::|||||
g311-1         GRGRQGRKWSHRLGECLMFSFGWAFDRPQYELGSLSPVAALACRRALGCLGLETQIKWPN
                      130        140        150        160        170        180

190        200        210        220        230        240
m311-1.pep     DLVVGRDKLGGILIETVRTGGKTVAVVGIGINFVLPKEVENAASVQSLFQTASRRGNADA
               ||||||||||||||||||:|||||||||||||||||||||||||||||||||||||||||
g311-1         DLVVGRDKLGGILIETVRAGGKTVAVVGIGINFVLPKEVENAASVQSLFQTASRRGNADA
                      190        200        210        220        230        240

250        260        270        280        290        300
m311-1.pep     AVLLETLLVELDAVLLQYARDGFAPFVAEYQAANRDHGKAVLLLRDGETVFEGTVKGVDG
               ||||||||:|| ||| |||::|||||: ||::||||||||||||||||| ||||||||||
g311-1         AVLLETLLAELGAVLEQYAEEGFAPFLNEYETANRDHGKAVLLLRDGETVCEGTVKGVDG
                      250        260        270        280        290        300

310        320        330        340        350        360
m311-1.pep     QGVLHLETAEGKQTVVSGEISLRSDDRPVSVPKRRDSERFLLLDGGNSRLKWAWVENGTF
               :|||||||||:||||||||||| |:| |||||| |||:|||||:||||||||||||||||
g311-1         RGVLHLETAEGEQTVVSGEISLRPDNRSVSVPKRPDSERFLLLEGGNSRLKWAWVENGTF
                      310        320        330        340        350        360

370        380        390        400        410        420
m311-1.pep     ATVGSAPYRDLSPLGAEWAEKADGNVRIVGCAVCGEFKKAQVQEQLARKIEWLPSSAQAL
               ||||||||||||||||||||||||||||||||||||:|||||:|||||||||||||||||
g311-1         ATVGSAPYRDLSPLGAEWAEKADGNVRIVGCAVCGESKKAQVKEQLARKIEWLPSSAQAL
                      370        380        390        400        410        420

430        440        450        460        470        480
m311-1.pep     GIRNHYRHPEEHGSDRWFNALGSRRFSRNACVVVSCGTAVTVDALTDDGHYLGGTIMPGF
               |||||||||||||||||||||||||||||||||||||||:|||||:|||::|||||
g311-1         GIRNHYRHPEEHGSDRWFNALGSRRFSRNACVVVSCGTAVTVDALTDDGHYLGGTIMPGF
                      430        440        450        460        470        480
```

-continued

```
                    490       500       510       520       530       540
m311-1.pep    HLMKESLAVRTANLNRHAGKRYPFPTTTGNAVASGMMDAVCGSVMMMHGRLKEKTGAGKP
              ||||||||||||||| ||||||||||||||||||||||||||:||||||||||:|||||
g311-1        HLMKESLAVRTANLNRPAGKRYPFPTTTGNAVASGMMDAVCGSIMMMHGRLKEKNGAGKP
                    490       500       510       520       530       540

550       560       570       580       590
m311-1.pep    VDVIITGGGAAKVAEALPPAFLAENTVRVADNLVIYGLLNMIAAEGREYEHIX
              ||||||||||||||||||||||||||||||||||:||||:|||||  |  ||
g311-1        VDVIITGGGAAKVAEALPPAFLAENTVRVADNLVIHGLLNLIAAEGGESEHAX
                    550       560       570       580       590
```

The following partial DNA sequence was identified in *N. meningitidis* <SEQ ID 1299>:

```
a311-1.seq
   1  ATGACGGTTT TGAAGCCTTC GCACTGGCGG GTGTTGGCGG AGCTTGCCGA

51  CGGTTTGCCG CAACACGTCT CGCAACTGGC GCGTATGGCG GATATGAAGC

101  CGCAGCAGCT CAACGGTTTT TGGCAGCAGA TGCCGGCGCA CATACGCGGG

151  CTGTTGCGCC AACACGACGG CTATTGGCGG CTGGTGCGCC CATTGGCGGT

201  TTTCGATGCC GAAGGTTTGC GCGAGCTGGG GGAAAGGTCG GGTTTTCAGA

251  CGGCATTGAA GCACGAGTGC GCGTCCAGCA ACGACGAGAT ACTGGAATTG

301  GCGCGGATTG CGCCGGACAA GGCGCACAAA ACCATATGTG TGACCCACCT

351  GCAAAGTAAG GGCAGGGGGC GGCAGGGGCG GAAGTGGTCG CACCGTTTGG

401  GCGAGTGTCT GATGTTCAGT TTTGGCTGGG TGTTTGACCG GCCGCAGTAT

451  GAGTTGGGTT CGCTGTCGCC TGTTGCGGCA GTGGCGTGCC GGCGCGCCTT

501  GTCGCGTTTG GGTTTGAAAA CGCAAATCAA GTGGCCAAAC GATTTGGTCG

551  TCGGACGCGA CAAATTGGGC GGCATTCTGA TTGAAACGGT CAGGACGGGC

601  GGCAAAACGG TTGCCGTGGT CGGTATCGGC ATCAATTTCG TGCTGCCCAA

651  GGAAGTGGAA AACGCCGCTT CCGTGCAATC GCTGTTTCAG ACGGCATCGC

701  GGCGGGGAAA TGCCGATGCC GCCGTGTTGC TGGAAACGCT GTTGGCGGAA

751  CTTGATGCGG TGTTGTTGCA ATATGCGCGG GACGGATTTG CGCCTTTTGT

801  GGCGGAATAT CAGGCTGCCA ACCGCGACCA CGGCAAGGCG GTATTGCTGT

851  TGCGCGACGG CGAAACCGTG TTCGAAGGCA CGGTTAAAGG CGTGGACGGA

901  CAAGGCGTTC TGCACTTGGA AACGGCAGAG GGCAAACAGA CGGTCGTCAG

951  CGGCGAAATC AGCCTGCGGT CCGACGACAG GCCGGTTTCC GTGCCGAAGC

1001  GGCGGGATTC GGAACGTTTT CTGCTGTTGG ACGGCGGCAA CAGCCGGCTC

1051  AAGTGGGCGT GGGTGGAAAA CGGCACGTTC GCAACCGTCG GTAGCGCGCC

1101  GTACCGCGAT TTGTCGCCTT TGGGCGCGGA GTGGGCGGAA AAGGTGGATG

1151  GAAATGTCCG CATCGTCGGT TGCGCCGTGT GCGGAGAATT CAAAAAGGCA

1201  CAAGTGCAGG AACAGCTCGC CCGAAAAATC GAGTGGCTGC CGTCTTCCGC

1251  ACAGGCTTTG GGCATACGCA ACCACTACCG CCACCCCGAA GAACACGGTT

1301  CCGACCGCTG GTTCAACGCC TTGGGCAGCC GCCGCTTCAG CCGCAACGCC

1351  TGCGTCGTCG TCAGTTGCGG CACGGCGGTA ACGGTTGACG CGCTCACCGA

1401  TGACGGACAT TATCTCGGGG GAACCATCAT GCCCGGTTTC CACCTGATGA

1451  AAGAATCGCT CGCCGTCCGA ACCGCCAACC TCAACCGGCA CGCCGGTAAG
```

```
-continued
1501 CGTTATCCTT TCCCGACCAC AACGGGCAAT GCCGTCGCCA GCGGCATGAT

1551 GGATGCGGTT TGCGGCTCGG TTATGATGAT GCACGGGCGT TTGAAAGAAA

1601 AAACCGGGGC GGGCAAGCCT GTCGATGTCA TCATTACCGG CGGCGGCGCG

1651 GCAAAAGTTG CCGAAGCCCT GCCGCCTGCA TTTTGGCGG AAAATACCGT

1701 GCGCGTGGCG GACAACCTCG TCATTCACGG GCTGCTGAAC CTGATTGCCG

1751 CCGAAGGCGG GGAATCGGAA CATACTTAA
```

This corresponds to the amino acid sequence <SEQ ID 1300; ORF 311-1.a>:

```
a311-1.pep

1  MTVLKPSHWR  VLAELADGLP  QHVSQLARMA  DMKPQQLNGF  WQQMPAHIRG

51  LLRQHDGYWR  LVRPLAVFDA  EGLRELGERS  GFQTALKHEC  ASSNDEILEL

101  ARIAPDKAHK  TICVTHLQSK  GRGRQGRKWS  HRLGECLMFS  FGWVFDRPQY

151  ELGSLSPVAA  VACRRALSRL  GLKTQIKWPN  DLVVGRDKLG  GILIETVRTG

201  GKTVAVVGIG  INFVLPKEVE  NAASVQSLFQ  TASRRGNADA  AVLLETLLAE

251  LDAVLLQYAR  DGFAPFVAEY  QAANRDHGKA  VLLLRDGETV  FEGTVKGVDG

301  QCFLHLETAE  GKQTVVSGEI  SLRSDDRPVS  VPKRRDSERF  LLLDGGNSRL

351  KWAWVENGTF  ATVGSAPYRD  LSPLGAEWAE  KVDGNVRIVG  CAVCGEFKKA

401  QVQEQLARKI  EWLPSSAQAL  GIRNHYRHPE  EHGSDRWFNA  LGSRRFSRNA

451  CVVVSCGTAV  TVDALTDDGH  YLGGTIMPGF  HLMKESLAVR  TANLNRHAGK

501  RYPFPTTTGN  AVASGMMDAV  CGSVMMMHGR  LKEKTGAGKP  VDVIITGGGA

551  AKVAEALPPA  FLAENTVRVA  DNLVIHGLLN  LIAAEGGESE  HT* a311-1/m311-1  98.5% identity in 591 aa overlap 10        20        30        40        50        60
a311-1.pep   MTVLKPSHWRVLAELADGLPQHVSQLARMADMKPQQLNGFWQQMPAHIRGLLRQHDGYWR
             ||||| |||||||||||||||||||||||||||||||||||||||||||||||||||||
m311-1       MTVLKLSHWRVLAELADGLPQHVSQLARMADMKPQQLNGFWQQMPAHIRGLLRQHDGYWR
                     10        20        30        40        50        60

70        80        90       100       110       120
a311-1.pep   LVRPLAVFDAEGLRELGERSGFQTALKHECASSNDEILELARIAPDKAHKTICVTHLQSK
             ||||||||||||||||||||||||||||||||||||||||||||||||||||||||||||
m311-1       LVRPLAVFDAEGLRELGERSGFQTALKHECASSNDEILELARIAPDKAHKTICVTHLQSK
                     70        80        90       100       110       120

130       140       150       160       170       180
a311-1.pep   GRGRQGRKWSHRLGECLMFSFGWVFDRPQYELGSLSPVAAVACRRALSRLGLKTQIKWPN
             |||||||||||||||||||||||||||||||||||||||||||||||||||| :||||||
m311-1       GRGRQGRKWSHRLGECLMFSFGWVFDRPQYELGSLSPVAAVACRRALSRLGLDVQIKWPN
                    130       140       150       160       170       180

190       200       210       220       230       240
a311-1.pep   DLVVGRDKLGGILIETVRTGGKTVAVVGIGINFVLPKEVENAASVQSLFQTASRRGNADA
             ||||||||||||||||||||||||||||||||||||||||||||||||||||||||||||
m311-1       DLVVGRDKLGGILIETVRTGGKTVAVVGIGINFVLPKEVENAASVQSLFQTASRRGNADA
                    190       200       210       220       230       240

250       260       270       280       290       300
a311-1.pep   AVLLETLLAELDAVLLQYARDGFAPFVAEYQAANRDHGKAVLLLRDGETVFEGTVKGVDG
             |||||||| :||||||||||||||||||||||||||||||||||||||||||||||||||
m311-1       AVLLETLLVELDAVLLQYARDGFAPFVAEYQAANRDHGKAVLLLRDGETVFEGTVKGVDG
                    250       260       270       280       290       300

310       320       330       340       350       360
a311-1.pep   QGVLHLETAEGKQTVVSGEISLRSDDRPVSVPKRRDSERFLLLDGGNSRLKWAWVENGTF
             |||||||||||||||||||||||||||||||||| |||||||||||||||||||||||||
m311-1       QGVLHLETAEGKQTVVSGEISLRSDDRPVSVPKRPDSERFLLLDGGNSRLKWAWVENGTF
                    310       320       330       340       350       360
```

-continued

```
                 370        380        390        400        410        420
a311-1.pep  ATVGSAPYRDLSPLGAEWAEKVDGNVRIVGCAVCGEFKKAQVQEQLARKIEWLPSSAQAL
            ||||||||||||||||||||||:|||||||||||||||||||||||||||||||||||
m311-1      ATVGSAPYRDLSPLGAEWAEKADGNVRIVGCAVCGEFKKAQVQEQLARKIEWLPSSAQAL
                 370        380        390        400        410        420

430        440        450        460        470        480
a311-1.pep  GIRNHYRHPEEHGSDRWFNALGSRRFSRNACVVVSCGTAVTVDALTDDGHYLGGTIMPGF
            ||||||||||||||||||||||||||||||||||||||||||||||||||||||||||||
m311-1      GIRNHYRHPEEHGSDRWFNALGSRRFSRNACVVVSCGTAVTVDALTDDGHYLGGTIMPGF
                 430        440        450        460        470        480

490        500        510        520        530        540
a311-1.pep  HLMKESLAVRTANLNRHAGKRYPFPTTTGNAVASGMMDAVCGSVMMMHGRLKEKTGAGKP
            ||||||||||||||||||||||||||||||||||||||||||||| ||||| |||||||
m311-1      HLMKESLAVRTANLNRHAGKRYPFPTTTGNAVASGMMDAVCGSVMMMHGRLKEKTGAGKP
                 490        500        510        520        530        540

550        560        570        580        590
a311-1.pep  VDVIITGGGAAKVAEALPPAFLAENTVRVADNLVIHGLLNLIAAEGGESEHTX
            |||||||||||||||||||||||||||||||||||:||||:||||| | ||
m311-1      VDVIITGGGAAKVAEALPPAFLAENTVRVADNLVIYGLLNMIAAEGREYEHIX
                 550        560        570        580        590
```

The following partial DNA sequence was identified in *N. gonorrhoeae* <SEQ ID 1301>:

```
g312.seq
    1 atgaGtatCc aatCcGgcga AATTTtagaa accgtCAAAA TGGTTGCCGA
   51 ccggaATttt gAtgtccgCA CCATTAccat cggcaTTgaT ttgcacgact
  101 gcatcagcac cgacatcgac gtgttaAACC AAAACATtta caaCAaaaTc
  151 accacggtcg gcaaagactT GGTGGCAacg Gcgaaacacc tTTccgcCAA
  201 ATACGGCGTG CCGATTGTGA ATCAGCGCAT TTCCGTTACG CCGAttgccc
  251 AaatcGCGGC GGcgaccaAa gccgaCAGTT AtgtcAGCgt ggcgcAGact
  301 tTGGACAAGG CAGCCAAAGC CATCGGCGTG TCCTTTATCG GcggCTTTTC
  351 CGCGCTGGTG CAAAAAGGTA TGTCGCCTTC GGATGAGGTG TTGATCCGTT
  401 CCGTTCCCGA AGCGATGAAA ACTACCGATA TCGTGTGCAG CTCCATCAAT
  451 ATCGGCAGCA CGCGTGCCGG TATCAATATG GATGCGGTCA AGCTGGCAGG
  501 CGAAACCATC AAACGCACGG CTGAAATCAC ACCCGAAGGT TTCGGCTGCG
  551 CCAAAATCGT CGTGTTCTGC AACGCGGTGG AAGACAATCC GTTTATGGCG
  601 GGTGCGTTCC ACGGCTCGGG CGAAGCGGAT GCTGTGATTA ATGTCGGCGT
  651 ATCCGGTCCA GGCGTGGTCA AGCCGCGCT GGAAAATTCG GACGCGGTCA
  701 GCCTGACCGA GGTCGCCGAA GTCGTGAAGA AAACCGCTTT CAAAATCACC
  751 CGCGTGGGCG AACTCATCGG TCGCGAAGCC TCAAAAATGC TGAATATCCC
  801 GTTCGGCATT CTCGATTTGT CGCTGGCACC GACCGCCGTC GTCGGCGACT
  851 CGGTGGCGCG CATTCTTGAA GAAATGGGCT TGAGCGTCTG CGGTACGCAC
  901 GGCACAACAG CAGCTTTGGC ATTGCTGAAC GATGCCGTGA AAAAGGGCGG
  951 CATGATGGCT TCCAGCGCGG TCGGCGGTTT GAGCGGCGCG TTTATCCCCG
 1001 TTTCCGAAGA CGAAGGTATG ATTGCCGCCG CCGAGGCAGG CGTGTTGACG
 1051 CTGGACAAAC TCGAAGCCAT GACCGCCGTC TGCTCCGTTG GTTTGGACAT
 1101 GATTGCCGTT CCCGGCGACA CGCCCGCGCA CACCATTTCC GGCATCATCG
 1151 CCGACGAAGC CGCCATCGGC ATGATCAACA GCAAAACCAC CGCCGTGCGC
```

-continued

```
1201 ATTATTCCGG TAACGGGCAA AACCGTCGGC GACAGCGTCG AGTTCGGCGG

1251 TCTGTTGGGC TACGCGCCTG TAATGCCGGC AAAAGAAGGT TCGTGCGAAG

1301 TGTTCGTCAA CCGGGGCGGC AGGATTCCCG CACCGGTTCA ATCGATGAAA

1351 AACTGA
```

This corresponds to the amino acid sequence <SEQ ID 1302; ORF 312.ng>:

```
g312.pep
  1 MSIQSGEILE TVKMVADRNF DVRTITIGID LHDCISTDID VLNQNIYNKI

51 TTVGKDLVAT AKHLSAKYGV PIVNQRISVT PIAQIAAATK ADSYVSVAQT

101 LDKAAKAIGV SFIGGFSALV QKGMSPSDEV LIRSVPEAMK TTDIVCSSIN

151 IGSTRAGINM DAVKLAGETI KRTAEITPEG FGCAKIVVFC NAVEDNPFMA

201 GAFHGSGEAD AVINVGVSGP GVVKAALENS DAVSLTEVAE VVKKTAFKIT

251 RVGELIGREA SKMLNIPFGI LDLSLAPTPA VGDSVARILE EMGLSVCGTH

301 GTTAALALLN DAVKKGGMMA SSAVGGLSGA FIPVSEDEGM IAAAEAGVLT

351 LDKLEAMTAV CSVGLDMIAV PGDTPAHTIS GIIADEAAIG MINSKTTAVR

401 IIPVTGKTVG DSVEFGGLLG YAPVMPAKEG SCEVFVNRGG RIPAPVQSMK

451 N*
```

The following partial DNA sequence was identified in *N. meningitidis* <SEQ ID 1303>:

```
m312.seq
  1 ATGAGTATCC AATCCGGCGA AATTTTAGAA ACCGTCAAAA TGGTTGCCGA

51 CCAGAATTTT GATGTCCGCA CCATTACCAT CGGCATTGAT TTGCACGACT

101 GCATCAGCAG CGATATCAAT GTGTTGAACC AAAATATTTA CAATAAAATT

151 ACCACAGTCG GCAAAGACTT GGTCACTACG GCAAAATATC TGTCTGCCAA

201 ATACGGCGTA CCGATTGTGA ATCAGCGCAT TTCCGTTACG CCGATTGCCC

251 AAATCGCGGC GGCCACCCAT GCTGATTCTT ACGTCAGCGT GGCGCAAACT

301 TTGGATAAAG CTGCCAAAGC CATCGGTGTG TCTTTTATCG GCGGTTTTTC

351 CGCGTTGGTG CAAAAAGGGA TGTCGCcTTC GGATGAGGTG TTAATCCGCT

401 CCATTCCCGA AGCGATGAAG ACTACCGATA TTGTGTGCwG CTCCATCAAT

451 ATCGGCAGTA CGCGTGCCGG TATCAATATG GATGCGGTCA AGCTGGCGGG

501 CGAAACcGTc AAACGCACGG CGGAAATCAC GCCCGAAGGT TTCGGCTGCG

551 CTAAAATTGT CGTGTTCTGC AACGCGGTGG AAGACAACCC GTTTwTGGCG

601 GGCGCGTTTC ATGGTTCGGG CGATGCCGTT ATCAATGTCG GCGTATCCGG

651 CCCAGGTGTC GTAAAAGCCG CGTTGGAAAA TTCAGATGCA ACGACATTGA

701 CCGAAGTTGC GGAAGTAGTG AAGAAAACTG CTTTCAAAAT TACCCGCGTG

751 GGCGAACTCA TCGGCCGCGA AGCcTCAAAA ATGCTGAATA TCCCGTTTGG

801 TATTCTCGAC TTGTCGCCGA CCCCGCCCGT CGGCGACTCA GTGGCACGCA

851 TTCTTGAAGA AATGGGCTTG AGCGTCTGCG GTACGCACGG CACAACAGCA

901 GCTTTGGCAT TGCTGAACGA TGCCGTGAAA AAGGCGGCA TGATGGCTTC

951 CAGCGCGGTC GGGGGTTTGA GTGGCGCGTT TATCCCCGTT TCCGAAGACG
```

-continued

```
1001 AAGGTATGAT yGmCgCcGCC GAAGCAGGCG TGCTGACGCT GGACAAACTC

1051 GAAGCCATGA CCGCCGTTTG TTCGGTCGGC TTGGATATGA TTGCCGTTCC

1101 CGGCGACACG CCCGCGCACA CCATTTCCGG CATCATTGCC GACGAAGCCG

1151 CCATCGGCAt GATCAACAGC AAAACCACTG CCGTGCGCAT TATTCCGGTA

1201 ACCGGTAAAA CCGTCGGCGA CAcGGTCGAG TTCGGCGGCT TGTTGGgCTA

1251 CGCGCCTGTG ATGCCGGTCA AGAAGGTTC GTGCGAAGTA TTCGTCAACC

1301 GAGGCGGCAG AATTCCGGCT CCGGTTCAAT CGATGAAAAA CTGA
```

This corresponds to the amino acid sequence <SEQ ID 1304; ORF 312>:

```
m312.pep
  1 MSIQSGEILE TVKMVADQNF DVRTITIGID LHDCISSDIN VLNQNIYNKI

51 TTVGKDLVTT AKYLSAKYGV PIVNQRISVT PIAQIAAATH ADSYVSVAQT

101 LDKAAKAIGV SFIGGFSALV QKGMSPSDEV LIRSIPEAMK TTDIVCXSIN

151 IGSTRAGINM DAVKLAGETV KRTAEITPEG FGCAKIVVFC NAVEDNPFXA

201 GAFHGSGDAV INVGVSGPGV VKAALENSDA TTLTEVAEVV KKTAFKITRV

251 GELIGREASK MLNIPFGILD LSPTPPVGDS VARILEEMGL SVCGTHGTTA

301 ALALLNDAVK KGGMMASSAV GGLSGAFIPV SEDEGMIXAA EAGVLTLDKL

351 EAMTAVCSVG LDMIAVPGDT PAHTISGIIA DEAAIGMINS KTTAVRIIPV

401 TGKTVGDTVE FGGLLGYAPV MPVKEGSCEV FVNRGGRIPA PVQSMKN*
```

Computer analysis of this amino acid sequence gave the following results:
Homology with a Predicted ORF from *N. gonorrhoeae*
ORF 312 shows 95.6% identity over a 451 aa overlap with a predicted ORF (ORF 312.ng) from *N. gonorrhoeae*:

```
    m312/g312

10         20         30         40         50         60
    m312.pep     MSIQSGEILETVKMVADQNFDVRTITIGIDLHDCISSDINVLNQNIYNKITTVGKDLVTT
                 ||||||||||||||||:|||||||||||||||||:||:||||||||||||||||||||:|
    g312         MSIQSGEILETVKMVADRNFDVRTITIGIDLHDCISTDIDVLNQNIYNKITTVGKDLVAT
                 10         20         30         40         50         60

70         80         90        100        110        120
    m312.pep     AKYLSAKYGVPIVNQRISVTPIAQIAAATHADSYVSVAQTLDKAAKAIGVSFIGGFSALV
                 ||:|||||||||||||||||||||||||||:|||||||||||||||||||||||||||||
    g312         AKHLSAKYGVPIVNQRISVTPIAQIAAATKADSYVSVAQTLDKAAKAIGVSFIGGFSALV
                 70         80         90        100        110        120

130        140        150        160        170        180
    m312.pep    QKGMSPSDEVLIRSIPEAMKTTDIVCXSINIGSTRAGINMDAVKLAGETVKRTAEITPEG
                ||||||||||||||:|||||||||||||:|||||||||||||||||||||:|||||||||
    g312        QKGMSPSDEVLIRSVPEAMKTTDIVCSSINIGSTRAGINMDAVKLAGETIKRTAEITPEG
                130        140        150        160        170        180

190        200        210        220        230
    m312.pep    FGCAKIVVFCNAVEDNPFXAGAFHGSG--DAVINVGVSGPGVVKAALENSDATTLTEVAE
                ||||||||||||||||||| ||||||||  |||||||||||||||||||||:::||||
    g312        FGCAKIVVFCNAVEDNPFMAGAFHGSGEADAVINVGVSGPGVVKAALENSDAVSLTEVAE
                190        200        210        220        230        240

240        250        260        270        280        290
    m312.pep    VVKKTAFKITRVGELIGREASKMLNIPFGILDLS--PTPPVGDSVARILEEMGLSVCGTH
                ||||||||||||||||||||||||||||||||||   |||||||||||||||||||||||
    g312        VVKKTAFKITRVGELIGREASKMLNIPFGILDLSLAPTPAVGDSVARILEEMGLSVCGTH
                250        260        270        280        290        300
```

-continued

```
                300       310       320       330       340       350
m312.pep      GTTAALALLNDAVKKGGMMASSAVGGLSGAFIPVSEDEGMIXAAAEAGVLTLDKLEAMTAV
              ||||||||||||||||||||||||||||||||||||||||| ||||||||||||||||||
g312          GTTAALALLNDAVKKGGMMASSAVGGLSGAFIPVSEDEGMIAAAEAGVLTLDKLEAMTAV
                    310       320       330       340       350       360

360       370       380       390       400       410
m312.pep      CSVGLDMIAVPGDTPAHTISGIIADEAAIGMINSKTTAVRIIPVTGKTVGDTVEFGGLLG
              ||||||||||||||||||||||||||||||||||||||||||||||||||:||||||||
g312          CSVGLDMIAVPGDTPAHTISGIIADEAAIGMINSKTTAVRIIPVTGKTVGDSVEFGGLLG
                    370       380       390       400       410       420

420       430       440
m312.pep      YAPVMPVKEGSCEVFVNRGGRIPAPVQSMKNX
              ||||||:|||||||||||||||||||||||||
g312          YAPVMPAKEGSCEVFVNRGGRIPAPVQSMKNX
                    430       440       450
```

The following partial DNA sequence was identified in *N. meningitidis* <SEQ ID 1305>:

```
a312.seq
   1  ATGAGTATCC AATCCGGCGA AATTTTAGAA ACCGTCAAAA TGGTTGCCGA
  51  CCAGAATTTC GATGTCCGCA CCATTACCAT CGGCATTGAT TTGCACGACT
 101  GCATCAGCAC CGACATCGAC GTGTTGAACC AAAATATTTA CAACAAAATT
 151  ACCACGGTCG GCAAAGACTT GGTGGCGACA GCAAAATATC TGTCTGCCAA
 201  ATACGGCGTG CCGATTGTGA ATCAGCGCAT TTCTGTCACG CCGATTGCCC
 251  AAATCGCGGC GGCCACCCAT GCTGATTCTT ACGTCAGCGT GGCGCAAACT
 301  TTGGATAAGG CTGCCAAAGC CATCGGCGTG TCTTTTATTG GCGGCTTTTC
 351  CGCGCTGGTG CAAAAAGGTA TGTCGCCTTC TGACGAGGTG TTAATCCGTT
 401  CCATTCCCGA AGCGATGAAG ACTACTGATA TCGTGTGCAG CTCCATCAAT
 451  ATCGGCAGTA CGCGCGCCGG TATCAATATG GACGCGGTCA GACTGGCGGG
 501  CGAAACCATC AAACGCACGG CTGAAATCAC ACTAGAAGGT TTCGGCTGCG
 551  CCAAAATCGT CGTGTTCTGC AACGCGGTGG AAGACAACCC GTTTATGGCG
 601  GGCGCGTTTC ACGGCTCAGG CGAAGCGGAT GCTGTGATTA ATGTCGGCGT
 651  ATCCGGCCCG GGTGTCGTAA AAGCCGCGTT GGAAAATTCG GATGCAACGA
 701  CATTGACCGA AGTTGCCGAA GTTGTGAAGA AAACCGCCTT CAAAATTACC
 751  CGCGTGGGCG AACTCATCGG CCGCGAAGCC TCAAAAAATGC TGAATATCCC
 801  GTTTGGTATT CTCGACTTGT CGCTGGCACC GACCCCTGCC GTCGGCGACT
 851  CGGTGGCGCG CATTCTTGAA GAAATGGGTT TGAGCGTCTG CGGTACGCAC
 901  GGCACAACAG CAGCTTTGGC ATTGCTGAAC GATGCCGTGA AAAAGGGCGG
 951  CATGATGGCT TCGAGCGCGG TTGGCGGTTT GAGTGGCGCG TTTATCCCCG
1001  TTTCCGAAGA CGAAGGTATG ATTGCCGCCG CCGAAGCAGG CGTGCTGACG
1051  TTGGATAAAC TCGAAGCGAT GACCGCCGTT TGTTCGGTCG GCTTGGATAT
1101  GATTGCCGTT CCCGGCGACA CACCCGCGCA CACCATTTCC GGCATCATTG
1151  CCGACGAAGC CGCCATCGGC ATGATCAACA GCAAAACCAC TGCCGTGCGC
1201  ATTATTCCGG TAACCGGTAA AACCGTCGGC GACAGCGTCG AGTTCGGCGG
1251  CCTGTTGGGC TACGCGCCTG TAATGCCGGT AAAAGAAGGC TCATGCGAAG
1301  TGTTCGTCAA CCGGGGCGGC AGGATTCCCG CACCGGTTCA ATCGATGAAA
1351  AACTGA
```

This corresponds to the amino acid sequence <SEQ ID 1306; ORF 312.a>:

```
a312.pep
  1 MSIQSGEILE TVKMVADQNF DVRTITIGID LHDCISTDID VLNQNIYNKI

51 TTVGKDLVAT AKYLSAKYGV PIVNQRISVT PIAQIAAATH ADSYVSVAQT

101 LDKAAKAIGV SFIGGFSALV QKGMSPSDEV LIRSIPEAMK TTDIVCSSIN

151 IGSTRAGINM DAVRLAGETI KRTAEITLEG FGCAKIVVFC NAVEDNPFMA

201 GAFHGSGEAD AVINVGVSGP GVVKAALENS DATTLTEVAE VVKKTAFKIT

251 RVGELIGREA SKMLNIPFGI LDLSLAPTPA VGDSVARILE EMGLSVCGTH

301 GTTAALALLN DAVKKGGMMA SSAVGGLSGA FIPVSEDEGM IAAAEAGVLT

351 LDKLEAMTAV CSVGLDMIAV PGDTPAHTIS GIIADEAAIG MINSKTTAVR

401 IIPVTGKTVG DSVEFGGLLG YAPVMPVKEG SCEVFVNRGG RIPAPVQSMK

451 N*
``` m312/a312 96.7% identity in 451 aa overlap

```
                  10         20         30         40         50         60
    m312.pep  MSIQSGEILETVKMVADQNFDVRTITIGIDLHDCISSDINVLNQNIYNKITTVGKDLVTT
              ||||||||||||||||||||||||||||||||||||:||:||||||||||||||||||:|
        a312  MSIQSGEILETVKMVADRNFDVRTITIGIDLHDCISTDIDVLNQNIYNKITTVGKDLVAT
                      10         20         30         40         50         60

70         80         90        100        110        120
    m312.pep  AKYLSAKYGVPIVNQRISVTPIAQIAAATHADSYVSVAQTLDKAAKAIGVSFIGGFSALV
              ||||||||||||||||||||||||||||||||||||||||||||||||||||||||||||
        a312  AKYLSAKYGVPIVNQRISVTPIAQIAAATHADSYVSVAQTLDKAAKAIGVSFIGGFSALV
                      70         80         90        100        110        120

130        140        150        160        170        180
    m312.pep  QKGMSPSDEVLIRSIPEAMKTTDIVCXSINIGSTRAGINMDAVKLAGETVKRTAEITPEG
              ||||||||||||||||||||||||||| ||||||||||||||||:|||||:|||||| ||
        a312  QKGMSPSDEVLIRSIPEAMKTTDIVCSSINIGSTRAGINMDAVRLAGETIKRTAEITLEG
                     130        140        150        160        170        180

190        200        210        220        230
    m312.pep  FGCAKIVVFCNAVEDNPFXAGAFHGSG--DAVINVGVSGPGVVKAALENSDATTLTEVAE
              |||||||||||||||||||| |||||||  |||||||||||||||||||||| ||||||
        a312  FGCAKIVVFCNAVEDNPFMAGAFHGSGEADAVINVGVSGPGVVKAALENSDATTLTEVAE
                     190        200        210        220        230        240

240        250        260        270        280        290
    m312.pep  VVKKTAFKITRVGELIGREASKMLNIPFGILDLS--PTPPVGDSVARILEEMGLSVCGTH
              ||||||||||||||||||||||||||||||||||  |||||||||||||||||||||||
        a312  VVKKTAFKITRVGELIGREASKMLNIPFGILDLSLAPTPAVGDSVARILEEMGLSVCGTH
                     250        260        270        280        290        300

300        310        320        330        340        350
    m312.pep  GTTAALALLNDAVKKGGMMASSAVGGLSGAFIPVSEDEGMIXAAEAGVLTLDKLEAMTAV
              ||||||||||||||||||||||||||||||||||||||||| |||||||||||||||||
        a312  GTTAALALLNDAVKKGGMMASSAVGGLSGAFIPVSEDEGMIAAAEAGVLTLDKLEAMTAV
                     310        320        330        340        350        360

360        370        380        390        400        410
    m312.pep  CSVGLDMIAVPGDTPAHTISGIIADEAAIGMINSKTTAVRIIPVTGKTVGDTVEFGGLLG
              ||||||||||||||||||||||||||||||||||||||||||||||||||:||||||||
        a312  CSVGLDMIAVPGDTPAHTISGIIADEAAIGMINSKTTAVRIIPVTGKTVGDSVEFGGLLG
                     370        380        390        400        410        420

420        430        440
    m312.pep  YAPVMPVKEGSCEVFVNRGGRIPAPVQSMKNX
              ||||||||||||||||||||||||||||||||
        a312  YAPVMPVKEGSCEVFVNRGGRIPAPVQSMKNX
                     430        440        450
```

The following partial DNA sequence was identified in *N. gonorrhoeae* <SEQ ID 1307>:

```
g313.seq
    1 atggacgacc cgcgcaccta cggatcgggc aatcccggcg cgaccaatgt
   51 tttacgcagc ggcaaaaaaa aggcggccgc gctgacgctc ttgggcgatg
  101 ccgccaaagg tttggttgcc gttttgcttg cacgcgtgct tcaagaaccg
  151 ctcggtttat ccgacagcgc aatcgccgcc gtcgcactcg ccgcgctggt
  201 cgggcatatg tggccggtgt ttttcggatt taagggcggc aaaggcgtgg
  251 caacggcatt gggcgtgctt ctggcactct ctcctgcaac tgccttggtc
  301 tgcgcgttga tttggcttgt gatggcattc ggcttcaaag tatcctccct
  351 tgccgcgctg gtcgccacaa ccgccgcccc ccttgccgca ctgttttta
  401 tgccgcatac ttcttggatt ttcgcaaccc tcgcaatcgc catattggtg
  451 ttgctccgcc ataagagcaa catcctcaac ctgattaaag gcaaagaaag
  501 caaaatcggc gaaaaacgct ga
```

This corresponds to the amino acid sequence <SEQ ID 1308; ORF 313.ng>:

```
g313.pep
    1 MDDPRTYGSG NPGATNVLRS GKKKAAALTL LGDAAKGLVA VLLARVLQEP
   51 LGLSDSAIAA VALAALVGHM WPVFFGFKGG KGVATALGVL LALSPATALV
  101 CALIWLVMAF GFKVSSLAAL VATTAAPLAA LFFMPHTSWI FATLAIAILV
  151 LLRHKSNILN LIKGKESKIG EKR*
```

The following partial DNA sequence was identified in *N. meningitidis* <SEQ ID 1309>:

```
m313.seq
    1 ATGGACGACC CGCGCACCTA CGGATCGGGC AATCCGGGGG CAACCAATGT
   51 TTTACGCAGC GGCAAAAAAA AGGCGGCCGC GCTGACGCTC TTGGGCGATG
  101 CCGCCAAAGG TTTAGTTGCC GTTTTGCTTG CACGCGTGCT TCAAGAACCG
  151 CTCGGTTTAT CCGACAGCGC AATCGCGGCC GTCGCACTCG CCGCGCTGGT
  201 CGGGCATATG TGGCCGGTGT TTTTCGGATT TAAAGGCGGC AAAGGCGTGG
  251 CAACGGCATT GGGCGTGCTT CTGGCACTCT CTCCCGCAAC TGCCTTGGTC
  301 TGCGCGTTGA TTTGGCTTGT TATGGCATTC GGCTTCAAGG TGTCCTCCCT
  351 TGCCGCATTA ACCGCCACAA TCGCCGCACC GGTCGCCGCA TCCTTCTTTA
  401 TGCCGCACGT CTCGTGGGTT TGGGCGACCG TCGCCATTGC TTTGCTGGTG
  451 TTGTTCCGCC ACAAAAGTAA TATCGTCAAG CTGCTCGAAG GCAGAGAAAG
  501 CAAAATCGGC GGCAGCCGCT GA
```

This corresponds to the amino acid sequence <SEQ ID 1310; ORF 313>:

```
m313.pep
    1 MDDPRTYGSG NPGATNVLRS GKKKAAALTL LGDAAKGLVA VLLARVLQEP
   51 LGLSDSAIAA VALAALVGHM WPVFFGFKGG KGVATALGVL LALSPATALV
```

```
101 CALIWLVMAF GFKVSSLAAL TATIAAPVAA SFFMPHVSWV WATVAIALLV

151 LFRHKSNIVK LLEGRESKIG GSR*
```

Computer analysis of this amino acid sequence gave the following results:

Homology with a Predicted ORF from *N. gonorrhoeae*

ORF 313 shows 90.2% identity over a 173 aa overlap with a predicted ORF (ORF 313.ng) from *N. gonorrhoeae*:

```
m313/g313
                     10         20         30         40         50         60
      m313.pep MDDPRTYGSGNPGATNVLRSGKKKAAALTLLGDAAKGLVAVLLARVLQEPLGLSDSAIAA
               ||||||||||||||||||||||||||||||||||||||||||||||||||||||||||||
         g313  MDDPRTYGSGNPGATNVLRSGKKKAAALTLLGDAAKGLVAVLLARVLQEPLGLSDSAIAA
                     10         20         30         40         50         60

70         80         90        100        110        120
      m313.pep VALAALVGHMWPVFFGFKGGKGVATALGVLLALSPATALVCALIWLVMAFGFKVSSLAAL
               ||||||||||||||||||||||||||||||||||||||||||||||||||||||||||||
         g313  VALAALVGHMWPVFFGFKGGKGVATALGVLLALSPATALVCALIWLVMAFGFKVSSLAAL
                     70         80         90        100        110        120

130        140        150        160        170
      m313.pep TATIAAPVAASFFMPHVSWVWATVAIALLVLFRHKSNIVKLLEGRESKIGGSRX
               :|| |||:|| |||||:||::|||:||| ||||||::|::|:||||| :||
         g313  VATTAAPLAALFFMPHTSWIFATLAIAILVLLRHKSNILNLIKGKESKIGEKRX
                    130        140        150        160        170
```

The following partial DNA sequence was identified in *N. meningitidis* <SEQ ID 1311>:

```
a313.seq
   1 ATGGACGACC CGCGCACCTA CGGATCGGGC AATCCGGGGG CAACCAATGT

51 TTTACGCAGC GGCAAAAAAA AGGCGGCCGC GCTGACGCTC TTGGGCGATG

101 CCGCCAAAGG TTTGGTTGCC GTTTTGCTTG CACGCGTGCT TCAAGAACCG

151 CTCGGTTTAT CCGACAGCGC AATCGCGGCC GTCGCACTCG CCGCGCTGGT

201 CGGGCATATG TGGCCGGTGT TTTTCGGATT TAAAGGCGGC AAAGGCGTGG

251 CAACGGCATT GGGCGTGCTT CTGGCACTCT CTCCCACAAC TGCCTTGGTC

301 TGCGCGTTGA TTTGGCTTGT GATGGCATTC GGCTTCAAGG TGTCCTCCCT

351 TGCCGCATTA ACCGCCACAA TCGCCGCCCC CCTTGCCGCA CTGTTTTTTA

401 TGCCGCATAC TTCTTGGATT TTCGCAACCC TCGCAATCGC CATATTGGTG

451 TTGCTCCGCC ATAAGAGCAA CATCCTCAAC CTGATTAAAG GCAAAGAAAG

501 CAAAATCGGC GAAAACGCT GA
```

This corresponds to the amino acid sequence <SEQ ID 1312; ORF 313.a>:

```
a313.pep
   1 MDDPRTYGSG NPGATNVLRS GKKKAAALTL LGDAAKGLVA VLLARVLQEP

51 LGLSDSAIAA VALAALVGHM WPVFFGFKGG KGVATALGVL LALSPTTALV

101 CALIWLVMAF GFKVSSLAAL TATIAAPLAA LFFMPHTSWI FATLAIAILV

151 LLRHKSNILN LIKGKESKIG EKR*
``` m313/a313 90.8% identity in 173 aa overlap

```
                     10         20         30         40         50         60
      m313.pep MDDPRTYGSGNPGATNVLRSGKKKAAALTLLGDAAKGLVAVLLARVLQEPLGLGLSDSAIAA
               ||||||||||||||||||||||||||||||||||||||||:|||||||||||||||||||
         a313  MDDPRTYGSGNPGATNVLRSGKKKAAALTLLGDAAKGLVAVLLARVLQEPLGLGLSDSAIAA
                     10         20         30         40         50         60
```

```
              70         80         90        100        110        120
m313.pep  VALAALVGHMWPVFFGFKGGKGVATALGVLLALSPATALVCALIWLVMAFGFKVSSLAAL
          ||||||||||||||||||||||||||||||||||:|||||||||||||||||||||||
a313      VALAALVGHMWPVFFGFKGGKGVATALGVLLALSPTTALVCALIWLVMAFGFKVSSLAAL
              70         80         90        100        110        120

130        140        150        160        170
m313.pep  TATIAAPVAASFFMPHVSWVWATVAIALLVLFRHKSNIVKLLEGRESKIGGSRX
          ||||||||:||  |||||:||::||:|||:|||:||||||::|::|||||  :||
a313      TATIAAPLAALFFMPHTSWIFATLAIAILVLLRHKSNILNLIKGKESKIGEKRX
             130        140        150        160        170
```

The following partial DNA sequence was identified in *N. gonorrhoeae* <SEQ ID 1313>:

```
g401.seq
    1 atgaaattac aacaattggc tgaagaaaaa atcggcgttc tgattgtgtt
   51 cacgctgctt gtagtcagtg tcggtctgtt gattgaagtt gtgcccttgg
  101 cctttaccaa ggcggcaaca cagccggcgc cgggcgtgaa gccttacaat
  151 gccctgcagg ttgccggacg cgatatttac atccgtgagg gctgttacaa
  201 ctgccactct caaatgattc gtccgttccg tgcggaaacc gagcgttacg
  251 gtcattactc tgttgccgga gagtcggttt acgaccatcc gttccaatgg
  301 ggttccaaac gtaccggtcc tgatttggca cgtgtgggcg gccgctattc
  351 cgacgaatgg caccgcatcc acctgctgaa tccccgtgat gtcgtgcctg
  401 agtccaatat gccggcattc ccgtggcttg cacgcaataa agtcgatgtc
  451 gatgcaaccg ttgccaacat gaaggctttg cgtaaagtag gtactcctta
  501 cagtgatgag gaaattgcga aagcgcctga ggctttggca aacaaatccg
  551 agctggatgc tgtagtcgcc tatctgcaag gattgggtct ggctttgaaa
  601 aacgtaaggt aa
```

This corresponds to the amino acid sequence <SEQ ID 1314; ORF 401.ng>:

```
g401.pep
    1 MKLQQLAEEK IGVLIVFTLL VVSVGLLIEV VPLAFTKAAT QPAPGVKPYN
   51 ALQVAGRDIY IREGCYNCHS QMIRPFRAET ERYGHYSVAG ESVYDHPFQW
  101 GSKRTGPDLA RVGGRYSDEW HRIHLLNPRD VVPESNMPAF PWLARNKVDV
  151 DATVANMKAL RKVGTPYSDE EIAKAPEALA NKSELDAVVA YLQGLGLALK
  201 NVR*
```

The following partial DNA sequence was identified in *N. meningitidis* <SEQ ID 1315>:

```
m401.seq
    1 ATGAAATTAC AaCAATTGGC TGAAGAAAAA ATCGGCGTTC TGATTGTGTT
   51 CACGCTGCTT GTAGTCAGTG TCGGTCTGTT GATTGAAGTT GTGCCCTTGG
  101 CCTTTACCAA GGCGGCAACA CAGCCGGCGC CGGGCGTGAA GCCTTACAAT
  151 GCCCTGCAGG TTGCCGGACG CGATATTTAC ATCCGTGAGG GCTGTTACAA
  201 CTGCCACTCG CAAATGATTC GTCCGTTCCG TGCGGAAACC GAGCGTTACG
  251 GTCATTACTC TGTTGCCGGA GAGTCGGTTT ACGACCATCC GTTCCAATGG
```

-continued

```
301 GGTTCCAAAC GTACCGGTCC TGATTTGGCA CGTGTGGGCG GTCGCTATTC

351 CGACGAATGG CACCGTATCC ACCTGCTGAA TCCCCGTGAT GTCGTGCCTG

401 AGTCCAATAT GCCGGCATTC CCGTGGCTTG CACGCAATAA AGTCGATGTC

451 GATGCAACCG TTGCCAACAT GAAGGCTTTG CGTAAAGTAG GTACTCCTTA

501 CAGTGATGAG GAAATTGCGA AAGCACCTGA GGCTTTGGCA AACAAATCCG

551 AGCTGGATGC TGTAGTCGCC TATCTGCAAG GATTGGGTCT GGCTTTGAAA

601 AACGTAAGGT AA
```

This corresponds to the amino acid sequence <SEQ ID 1316; ORF 401>:

```
m401.pep
  1 MKLQQLAEEK IGVLIVFTLL VVSVGLLIEV VPLAFTKAAT QPAPGVKPYN

51 ALQVAGRDIY IREGCYNCHS QMIRPFRAET ERYGHYSVAG ESVYDHPFQW

101 GSKRTGPDLA RVGGRYSDEW HRIHLLNPRD VVPESNMPAF PWLARNKVDV

151 DATVANMKAL RKVGTPYSDE EIAKAPEALA NKSELDAVVA YLQGLGLALK

201 NVR*
```

Computer analysis of this amino acid sequence gave the following results:
Homology with a Predicted ORF from *N. gonorrhoeae*
ORF 401 shows 100.0% identity over a 203 aa overlap with a predicted ORF (ORF 401.ng) from *N. gonorrhoeae*:

```
m401/g401
                  10         20         30         40         50         60
    m401.pep  MKLQQLAEEKIGVLIVFTLLVVSVGLLIEVVPLAFTKAATQPAPGVKPYNALQVAGRDIY
              ||||||||||||||||||||||||||||||||||||||||||||||||||||||||||||
    g401      MKLQQLAEEKIGVLIVFTLLVVSVGLLIEVVPLAFTKAATQPAPGVKPYNALQVAGRDIY
                  10         20         30         40         50         60
                  70         80         90        100        110        120
    m401.pep  IREGCYNCHSQMIRPFRAETERYGHYSVAGESVYDHPFQWGSKRTGPDLARVGGRYSDEW
              ||||||||||||||||||||||||||||||||||||||||||||||||||||||||||||
    g401      IREGCYNCHSQMIRPFRAETERYGHYSVAGESVYDHPFQWGSKRTGPDLARVGGRYSDEW
                  70         80         90        100        110        120
                 130        140        150        160        170        180
    m401.pep  HRIHLLNPRDVVPESNMPAFPWLARNKVDVDATVANMKALRKVGTPYSDEEIAKAPEALA
              ||||||||||||||||||||||||||||||||||||||||||||||||||||||||||||
    g401      HRIHLLNPRDVVPESNMPAFPWLARNKVDVDATVANMKALRKVGTPYSDEEIAKAPEALA
                 130        140        150        160        170        180
                 190        200
    m401.pep  NKSELDAVVAYLQGLGLALKNVRX
              ||||||||||||||||||||||||
    g401      NKSELDAVVAYLQGLGLALKNVRX
                 190        200
```

The following partial DNA sequence was identified in *N. meningitidis* <SEQ ID 1317>:

```
a401.seq
  1 ATGAAATTAC AACAATTGGC TGAAGAAAAA ATCGGCGTTC TGATTGTGTT

51 CACGCTGCTT GTAGTCAGTG TCGGTCTGTT GATTGAAGTT GTGCCCTTGG

101 CCTTTACCAA GGCGGCAACA CAGCCGGCGT CGGGCGTGAA GCCTTACAAT

151 GCCCTGCAGG TTGCCGGACG CGATATTTAC ATCCGTGAGG GCTGTTACAA

201 CTGCCACTCG CAAATGATTC GTCCGTTCCG TGCGGAAACC GAGCGTTACG
```

-continued

```
251 GTCATTACTC TGTTGCCGGA GAGTCGGTTT ACGACCATCC GTTCCAATGG

301 GGTTCCAAAC GTACCGGTCC TGATTTGGCA CGTGTGGGCG GTCGCTATTC

351 CGACGAATGG CACCGTATCC ACCTGCTGAA TCCCCGTGAT GTCGTGCCTG

401 AGTCCAATAT GCCGGCATTC CCGTGGCTTG CACGCAATAA AGTCGATGTC

451 GATGCAACCG TTGCCAACAT GAAGGCTTTG CGTAAAGTAG GTACTCCTTA

501 CAGTGATGAG GAAATTGCGA AAGCGCCTGA GGCTTTGGCA AACAAATCCG

551 AGCTGGATGC TGTAGTCGCC TATCTGCAAG GATTGGGTCT GGCTTTGAAA

601 AACGTAAGGT AA
```

15

This corresponds to the amino acid sequence <SEQ ID 1318; ORF 401.a>:

```
a401.pep
  1 MKLQQLAEEK IGVLIVFTLL VVSVGLLIEV VPLAFTKAAT QPASGVKPYN

51 ALQVAGRDIY IREGCYNCHS QMIRPFRAET ERYGHYSVAG ESVYDHPFQW

101 GSKRTGPDLA RVGGRYSDEW HRIHLLNPRD VVPESNMPAF PWLARNKVDV

151 DATVANMKAL RKVGTPYSDE EIAKAPEALA NKSELDAVVA YLQGLGLALK

201 NVR*
``` m401/a401 99.5% identity in 203 aa overlap

```
                 10         20         30         40         50         60
    m401.pep   MKLQQLAEEKIGVLIVFTLLVVSVGLLIEVVPLAFTKAATQPAPGVKPYNALQVAGRDIY
               ||||||||||||||||||||||||||||||||||||||||||| ||||||||||||||||
        a401   MKLQQLAEEKIGVLIVFTLLVSVGLLIEVVPLAFTKAATQPASGVKPYNALQVAGRDIY
                 10         20         30         40         50         60

70         80         90        100        110        120
    m401.pep   IREGCYNCHSQMIRPFRAETERYGHYSVAGESVYDHPFQWGSKRTGPDLARVGGRYSDEW
               ||||||||||||||||||||||||||||||||||||||||||||||||||||||||||||
        a401   IREGCYNCHSQMIRPFRAETERYGHYSVAGESVYDHPFQWGSKRTGPDLARVGGRYSDEW
                 70         80         90        100        110        120

130        140        150        160        170        180
    m401.pep   HRIHLLNPRDVVPESNMPAFPWLARNKVDVDATVANMKALRKVGTPYSDEEIAKAPEALA
               ||||||||||||||||||||||||||||||||||||||||||||||||||||||||||||
        a401   HRIHLLNPRDVVPESNMPAFPWLARNKVDVDATVANMKALRKVGTPYSDEEIAKAPEALA
                130        140        150        160        170        180

190        200
    m401.pep   NKSELDAVVAYLQGLGLALKNVRX
               ||||||||||||||||||||||||
        a401   NKSELDAVVAYLQGLGLALKNVRX
                190        200
```

The following partial DNA sequence was identified in N. gonorrhoeae <SEQ ID 1319>:

```
g402.seq
  1 ATGGATATGG TGAACACTAA Accgaatact agtgtgatta atatgctttc 51 tttccttacc ggatTATTGA GCTTGGGTat agaagtCtTg tGGGTAAGGA 101 TGttttcgTT CGCagcAcag tccgtgcctc aggCATTTTC atttattctt 151 gcctGttttc tgACCGgtat cgccgtcggc gCgTATTTTG GCAAACGGAT 201 TTGCCGCAGC CGCTTTGTTG ATATTCCctT TATCGGGCAG TgcttcttgT 251 GGGCGGGTAT TgccgaTttt ttgatTTTGG GTGCTGCGTG GTTGTTGACG
```

```
-continued
 301 GGTTTTTccg gtttcGTCCA CCACGCCGGT AtttTCATTA CCCTgtctgc

351 CGtcGTCAGG GGGTTGATTT TCCCACTTGT ACACCATgtg GGTACGGATG

401 GCAACAAATC CGGACGACAG GTTTCCAATG TTTATTTCGC CAACGTTGCC

451 GGCAGTGCAT TGGGTCCGGT CCTTATCGGC TTTGTGATAC TTGATttgtt 501 gTCCACCCAA CAGATTtacc tgctcatCTG TTTGATTTCT GCTGCtgtcc 551 cTTTGTTTTg tacaCTGtTC CAAAAAAGTC TCCGACTGAA TGCAGTGTCG

601 GTAGCAGTTT CCCTAATGTT CGGCATCCTC ATGTTCCTAC TGCCGGATTC

651 TGTCTTTCAA AATATTGCTG GCCGTCCGGA TAGGTTGATT GAAAACAAAC

701 ACGGCATTGT TGCGGTTTAC CATAGAGATG GTGATAAGGT TGTTTATGGG

751 GCGAATGTAT ACGACGGCGC ATACAATACC GATATATTCA ATAGTGTCAA

801 CGGCATCGAA CGTGCCTATC TGCTACCCTC CCTGAAGTCC GGCATACGCC

851 GCATTTTCGT CGTTGGATTG AGTACAGGTT CGTGGGCGCG CGTCTTGTCT

901 GCCATTCCGG AAATGCAGTC GATGATCGTT GCGGAAATCA ATCCGGCATA

951 CCGTAGCCTT ATCGCGGAcg agccgcAAAT CGCACCGCTT TTGCAGGACA

1001 AACGTGTTGA AATTGTATTG GATGACGGTA GGAAATGGCT GCGTCGCCAT

1051 CCTGATGAAA AATTCGACCT GATTTTGATG AATTCGACTT GGTACTGGCG

1101 TGCCTATTCC ACTAACCTGT TGAGTGCGGA ATTTTTAAAA CAGGTGCAAA

1151 GCCACCTTAC CCCGGATGGT ATTGTAATGT TTAATACCAC GCACAGCCCG

1201 CATgctTTTG CTACCGCCGT ACACAGTATT CCCTATGCAT ACCGCTACGG

1251 GCATATGGTA GTCGGCTCGG CAACCCCGGT AGTTTTCcct AATAAAGAAC

1301 TGCTCaagca aCGCCTTTcc cgGTTGATTT GGCCGGAAAG CGGCAGgcac 1351 gtATTTGACA GCAGCACCGT GGATGCTGCA GCACAAAAGG TTGtctctCG 1401 TATGCTGATT CGGATGACGG AAcctTCGGC TGGGGCGGAA GTCATTACTG 1451 ACGATAATAT GATTGTAGAA TACAAATACG GCAGAGGGAT TTAA
                                                        40
```

This corresponds to the amino acid sequence <SEQ ID 1320; ORF 402.ng>:

```
g402.pep
  1 MDMVNTKPNT SVINMLSFLT GLLSLGIEVL WVRMFSFAAQ SVPQAFSFIL

51 ACFLTGIAVG AYFGKRICRS RFVDIPFIGQ CFLWAGIADF LILGAAWLLT

101 GFSGFVHHAG IFITLSAVVR GLIFPLVHHV GTDGNKSGRQ VSNVYFANVA

151 GSALGPVLIG FVILDLLSTQ QIYLLICLIS AAVPLFCTLF QKSLRLNAVS

201 VAVSLMFGIL MFLLPDSVFQ NIAGRPDRLI ENKHGIVAVY HRDGDKVVYG

251 ANVYDGAYNT DIFNSVNGIE RAYLLPSLKS GIRRIFVVGL STGSWARVLS

301 AIPEMQSMIV AEINPAYRSL IADEPQIAPL LQDKRVEIVL DDGRKWLRRH

351 PDEKFDLILM NSTWYWRAYS TNLLSAEFLK QVQSHLTPDG IVMFNTTHSP

401 HAFATAVHSI PYAYRYGHMV VGSATPVVFP NKELLKQRLS RLIWPESGRH

451 VFDSSTVDAA AQKVVSRMLI RMTEPSAGAE VITDDNMIVE YKYGRGI*
```

The following partial DNA sequence was identified in *N. meningitidis* <SEQ ID 1321>:

```
m402.seq
     1  ATGGATATAG TGAACACTAA ACCGAATACT AGTTTGATTT ATATGCnTTC
    51  TTTCCTTAGC GGCTTATTGA GCTTGGGTAT AGAAGTCTTG TGGGTGAGGA
   101  TGTTTTCGTT CGCAGCACAG TCCGTGCCTC AGGCATTTTC ATTTACCCTT
   151  GCCTGTTTTC TGACCGGTAT CGCCGTCGGC GCGTATTTTG GCAAACGGAT
   201  TTGCCGCAGC CGCTTTGTTG ATATTCCCTT TATCGGGCAG TGCTTCTTGT
   251  GGGCGGGTAT TGCCGACTTT TTGATTTTGG GTGCTGCGTG GTTGTTGACG
   301  GGTTTTTCCG GCTTCGTCCA CCACGCCGGT ATCTTCATTA CCCTGTCTGC
   351  CGTCGTCAsA sGGTTGATTT TCCCGCTCGT ACACCATGTG GGTACGGATG
   401  GCAACAAATC CGGACGACAG GTTTCCAATG TTTATTTCGC CAmCGTTGCC
   451  GGCAGTGCAT TGGGTCCGGT CCTTATCGGC TTTGTGATAC TTGATTTCTT
   501  GTCCACCCAA CAGATTTACC TGCTCATCTG TwTGATTTCT GCTGCTGTCC
   551  CTTTGTTTTG TACACTGTTC CAAAAAAGTC TCCGACTGAA TGCAGTGTCG
   601  GTAGCAGTTT CCCTAATGTT CGGCATCCTC ATGTTCyTAC TGCCGGATTC
   651  TGTCTTTCAA AATATTGCTG ACCGTCCGGA TAgGCTGATT GAAAACAAAC
   701  ACGGCATTGT TGCGGTTTAC CATAGAGATG GTGATAAGGT TGTTTATGGG
   751  GCGAATGTAT ACGACGGCGC ATACAATACC GATGTATTCA ATAGTGTCAA
   801  CGGCATCGAA CGTGCCTATC TGCTACCCTC CCTGAAGTCT GGCATACGCC
   851  GCATTTTCGT CGTTGGACTG AGTACAGGTT CGTGGGCGCG CGTCTTGTCT
   901  GCCATTCCGG AAATGCAGTC GATGATCGTT GCGGAAATCA ATCCGGCATA
   951  CCGTAGCCTT ATCGCGGACG AGCCGCAAAT CGCCCCGCTT TTGCAGGACA
  1001  AACGTGTTGA AATTGTATTG GATGACGGTA GGAAATGGCT GCGTCGCCAT
  1051  CCTGATGAAA AATTCGACCT GATTTTGATG AATACGACTT GGTACTGGCG
  1101  TGCCTATTCC ACCAACCTGT TGAGTGCGGA ATTTTTAAAA CAGGTGCAAA
  1151  GCCACCTTAC CCCGGATGGT ATTGTAATGT TTAATACCAC GCACAGCCCG
  1201  CATGCTTTTG CTACCGCCGT ACACAGTATT CCCTATGCAT ACCGCTATGG
  1251  GCATATGGTA GTCGGCTCGG CAACCCCGGT AGTTTTCCCT AATAAAGAAC
  1301  TGCTCAAGCA ACGTCTCTCC CGGTTGATTT GGCCGGAAAG CGGCAGGCAC
  1351  GTATTTGACA GCAGCACCGT GGATGCTGCA GCACAAAAGG TTGTCTCTCG
  1401  TATGCTGATT CAGATGACGG aAcCTTCGGC TGGGGCGGAA GTTATTACCG
  1451  ACGATAATAT GATTGTAGAA TACAAATACG GCAGAGGGAT TTAA
```

This corresponds to the amino acid sequence <SEQ ID 1322; ORF 402>:

```
m402.pep
     1  MDIVNTKPNT SLIYMXSFLS GLLSLGIEVL WVRMFSFAAQ SVPQAFSFTL
    51  ACFLTGIAVG AYFGKRICRS RFVDIPFIGQ CFLWAGIADF LILGAAWLLT
   101  GFSGFVHHAG IFITLSAVVX XLIFPLVHHV GTDGNKSGRQ VSNVYFAXVA
   151  GSALGPVLIG FVILDFLSTQ QIYLLICXIS AAVPLFCTLF QKSLRLNAVS
   201  VAVSLMFGIL MFLLPDSVFQ NIADRPDRLI ENKHGIVAVY HRDGDKVVYG
```

```
251 ANVYDGAYNT DVFNSVNGIE RAYLLPSLKS GIRRIFVVGL STGSWARVLS

301 AIPEMQSMIV AEINPAYRSL IADEPQIAPL LQDKRVEIVL DDGRKWLRRH

351 PDEKFDLILM NTTWYWRAYS TNLLSAEFLK QVQSHLTPDG IVMFNTTHSP

401 HAFATAVHSI PYAYRYGHMV VGSATPVVFP NKELLKQRLS RLIWPESGRH

451 VFDSSTVDAA AQKVVSRMLI QMTEPSAGAE VITDDNMIVE YKYGRGI*
```

Computer analysis of this amino acid sequence gave the following results:

Homology with a Predicted ORF from *N. gonorrhoeae*
 ORF 402 shows 97.0% identity over a 497 aa overlap with a predicted ORF (ORF 402.ng) from *N. gonorrhoeae*:

```
m402/g402

10        20        30        40        50        60
        m402.pep   MDIVNTKPNTSLIYMXSFLSGLLSLGIEVLWVRMFSFAAQSVPQAFSFTLACFLTGIAVG
                   ||:||||||||:| |  |||:||||||||||||||||||||||||| |||||||||||
        g402       MDMVNTKPNTSVINMLSFLTGLLSLGIEVLWVRMFSFAAQSVPQAFSILACFLTGIAVG
                      10        20        30        40        50        60

70        80        90       100       110       120
        m402.pep   AYFGKRICRSRFVDIPFIGQCFLWAGIADFLILGAAWLLTGFSGFVHHAGIFITLSAVVX
                   |||||||||||||||||||||||||||||||||||||||||||||||||||||||||||
        g402       AYFGKRICRSRFVDIPFIGQCFLWAGIADFLILGAAWLLTGFSGFVHHAGIFITLSAVVR
                      70        80        90       100       110       120

130       140       150       160       170       180
        m402.pep   XLIFPLVHHVGTDGNKSGRQVSNVYFAXVAGSALGPVLIGFVILDFLSTQQIYLLICXIS
                    |||||||||||||||||||||||||| |||||||||||||||||:||||||||||| ||
        g402       GLIFPLVHHVGTDGNKSGRQVSNVYFANVAGSALGPVLIGFVILDLLSTQQIYLLICLIS
                     130       140       150       160       170       180

190       200       210       220       230       240
        m402.pep   AAVPLFCTLFQKSLRLNAVSVAVSLMFGILMFLLPDSVFQNIADRPDRLIENKHGIVAVY
                   |||||||||||||||||||||||||||||||||||||||||| |||||||||||||||||
        g402       AAVPLFCTLFQKSLRLNAVSVAVSLMFGILMFLLPDSVFQNIAGRPDRLIENKHGIVAVY
                     190       200       210       220       230       240

250       260       270       280       290       300
        m402.pep   HRDGDKVVYGANVYDGAYNTDVFNSVNGIERAYLLPSLKSGIRRIFVVGLSTGSWARVLS
                   |||||||||||||||||||||:||||||||||||||||||||||||||||||||||||||
        g402       HRDGDKVVYGANVYDGAYNTDIFNSVNGIERAYLLPSLKSGIRRIFVVGLSTGSWARVLS
                     250       260       270       280       290       300

310       320       330       340       350       360
        m402.pep   AIPEMQSMIVAEINPAYRSLIADEPQIAPLLQDKRVEIVLDDGRKWLRRHPDEKFDLILM
                   |||||||||||||||||||||||||||||||||||||||||||||||||||||||||||
        g402       AIPEMQSMIVAEINPAYRSLIADEPQIAPLLQDKRVEIVLDDGRKWLRRHPDEKFDLILM
                     310       320       330       340       350       360

370       380       390       400       410       420
        m402.pep   NTTWYWRAYSTNLLSAEFLKQVQSHLTPDGIVMFNTTHSPHAFATAVHSIPYAYRYGHMV
                   |:|||||||||||||||||||||||||||||||||||||||||||||||||||||||||
        g402       NSTWYWRAYSTNLLSAEFLKQVQSHLTPDGIVMFNTTHSPHAFATAVHSIPYAYRYGHMV
                     370       380       390       400       410       420

430       440       450       460       470       480
        m402.pep   VGSATPVVFPNKELLKQRLSRLIWPESGRHVFDSSTVDAAAQKVVSRMLIQMTEPSAGAE
                   ||||||||||||||||||||||||||||||||||||||||||||||||||||:|||||||
        g402       VGSATPVVFPNKELLKQRLSRLIWPESGRHVFDSSTVDAAAQKVVSRMLIRMTEPSAGAE
                     430       440       450       460       470       480

490
        m402.pep   VITDDNMIVEYKYGRGIX
                   |||||||||||||||||
        g402       VITDDNMIVEYKYGRGI
                     490
```

The following partial DNA sequence was identified in *N. meningitidis* <SEQ ID 1323>:

```
a402.seq
    1  ATGGATATAG TGAACACTAA ACCGAATACT AGTTTGATTT ATATGCTTTC
   51  TTTCCTTAGC GGCTTATTGA GCTTGGGTAT AGAAGTCTTG TGGGTAAGGA
  101  TGTTTTCGTT CGCAGCACAG TCCGTGCCTC AGGCATTTTC ATTTACTCTT
  151  GCCTGTTTTC TGACCGGTAT CGCCGTCGGC GCGTATTTTG GCAAACGGAT
  201  TTGCCGCAGC CGCTTTGTTG ATATTCCCTT TATCGGGCAG TGCTTCTTGT
  251  GGGCGGGTAT TGCCGACTTT TTGATTTTGG GTGCTGCGTG GTTGTTGACG
  301  GGTTTTTCCG GCTTCGTCCA CCACGCCGGT ATCTTCATTA CCCTGTCTGC
  351  CGTCGTCAGA GGGTTGATTT TCCCGCTCGT ACACCATGTG GGTACGGATG
  401  GCAACAAATC CGGACGACAG GTTTCCAATG TTTATTTCGC CAACGTTGCC
  451  GGCAGTGCAT TGGGTCCGGT CCTTATCGGC TTTGTGATAC TTGATTTCTT
  501  GTCCACCCAA CAGATTTACC TGCTCATCTG TTTGATTTCT GCTGCTGTCC
  551  CTTTGTTTTG TACACTGTTC CAAAAAAGTC TCCGACTGAA TGCAGTGTCG
  601  GTAGCAGTTT CCCTAATGTT CGGCATCCTC ATGTTCCTAC TGCCGGATTC
  651  TGTCTTTCAA AATATTGCTG ACCGTCCGGA TAGGCTGATT GAAAACAAAC
  701  ACGGCATTGT TGCGGTTTAC CATAGAGATG GTGATAAGGT TGTTTATGGG
  751  GCGAATGTAT ACGACGGCGC ATACAATACC GATGTATTCA ATAGTGTCAA
  801  CGGCATCGAA CGTGCCTATC TGCTACCCTC CCTGAAGTCT GGCATACGCC
  851  GCATTTTCGT CGTTGGATTG AGTACAGGTT CGTGGGCGCG CGTCTTGTCT
  901  GCCATTCCGG AAATGCAGTC GATGATCGTT GCGGAAATCA ATCCGGCATA
  951  CCGTAGCCTT ATCGCGGACG AGCCGCAAAT CGCCCCGCTT TTGCAGGACA
 1001  AACGTGTTGA AATTGTATTG GATGACGGTA GGAAATGGCT GCGTCGCCAT
 1051  CCTGATGAAA AATTCGACCT GATTTTGATG AATACGACTT GGTACTGGCG
 1101  TGCCTATTCC ACCAACCTGT TGAGTGCGGA ATTTTTAAAA CAGGTGCAAA
 1151  GCCACCTTAC CCCGGATGGT ATTGTAATGT TTAATACCAC GCACAGCCCG
 1201  CATGCTTTTG CTACCGCCGT ACACAGTATT CCCTATGCAT ACCGCTATGG
 1251  GCATATGGTA GTCGGCTCGG CAACCCCGGT AGTTTTCCCT AATAAAGAAC
 1301  TGCTCAAGCA ACGTCTCTCC CGGTTGATTT GGCCGGAAAG CGGCAGGCAC
 1351  GTATTTGACA GCAGCACCGT GGATGCTGCA GCACAAAAGG TTGTCTCTCG
 1401  TATGCTGATT CAGATGACGG AACCTTCGGC TGGTGCGGAA GTCATTACCG
 1451  ACGATAATAT GATTGTAGAA TACAAATACG GCAGAGGGAT TTAA
```

This corresponds to the amino acid sequence <SEQ ID 1324; ORF 402.a>:

```
a402.pep
    1  MDIVNTKPNT SLIYMLSFLS GLLSLGIEVL WVRMFSFAAQ SVPQAFSFTL
   51  ACFLTGIAVG AYFGKRICRS RFVDIPFIGQ CFLWAGIADF LILGAAWLLT
  101  GFSGFVHHAG IFITLSAVVR GLIFPLVHHV GTDGNKSGRQ VSNVYFANVA
  151  GSALGPVLIG FVILDFLSTQ QIYLLICLIS AAVPLFCTLF QKSLRLNAVS
  201  VAVSLMFGIL MFLLPDSVFQ NIADRPDRLI ENKHGIVAVY HRDGDKVVYG
```

-continued

```
251 ANVYDGAYNT DVFNSVNGIE RAYLLPSLKS GIRRIFVVGL STGSWARVLS

301 AIPEMQSMIV AEINPAYRSL IADEPQIAPL LQDKRVEIVL DDGRKWLRRH

351 PDEKFDLILM NTTWYWRAYS TNLLSAEFLK QVQSHLTPDG IVMFNTTHSP

401 HAFATAVHSI PYAYRYGHMV VGSATPVVFP NKELLKQRLS RLIWPESGRH

451 VFDSSTVDAA AQKVVSRMLI QMTEPSAGAE VITDDNMIVE YKYGRGI*
``` m402/a402 99.0% identity in 497 aa overlap

```
                   10         20         30         40         50         60
m402.pep  MDIVNTKPNTSLIYMXSFLSGLLSLGIEVLWVRMFSFAAQSVPQAFSFTLACFLTGIAVG
          ||||||||||||| |||||||||||||||||||||||||||||||||||||||||||
a402      MDDPRTYGSGNPGATLVLRSGKKKAAALTLLGDAAKGLVAVLLARVLQEPLGLSDSAIAA
                   10         20         30         40         50         60

70         80         90        100        110        120
m402.pep  AYFGKRICRSRFVDIPFIGQCFLWAGIADFLILGAAWLLTGFSGFVHHAGIFITLSAVVX
          |||||||||||||||||||||||||||||||||||||||||||||||||||||||||
a402      AYFGKRICRSRFVDIPFIGQCFLWAGIADFLILGAAWLLTGFSGFVHHAGIFITLSAVVR
                   70         80         90        100        110        120

130        140        150        160        170        180
m402.pep  XLIFPLVHHVGTDGNKSGRQVSNVYFAXVAGSALGPVLIGFVILDFLSTQQIYLLICXIS
           ||||||||||||||||||||||||| ||||||||||||||||||||||||||||| ||
a402      GLIFPLVHHVGTDGNKSGRQVSNVYFANVAGSALGPVLIGFVILDFLSTQQIYLLICLIS
                  130        140        150        160        170        180

190        200        210        220        230        240
m402.pep  AAVPLFCTLFQKSLRLNAVSVAVSLMFGILMFLLPDSVFQNIADRPDRLIENKHGIVAVY
          ||||||||||||||||||||||||||||||||||||||||||||||||||||||||||||
a402      AAVPLFCTLFQKSLRLNAVSVAVSLMFGILMFLLPDSVFQNIADRPDRLIENKHGIVAVY
                  190        200        210        220        230        240

250        260        270        280        290        300
m402.pep  HRDGDKVVYGANVYDGAYNTDVFNSVNGIERAYLLPSLKSGIRRIFVVGLSTGSWARVLS
          ||||||||||||||||||||||||||||||||||||||||||||||||||||||||||||
a402      HRDGDKVVYGANVYDGAYNTDVFNSVNGIERAYLLPSLKSGIRRIFVVGLSTGSWARVLS
                  250        260        270        280        290        300

310        320        330        340        350        360
m402.pep  AIPEMQSMIVAEINPAYRSLIADEPQIAPLLQDKRVEIVLDDGRKWLRRHPDEKGDLILM
          ||||||||||||||||||||||||||||||||||||||||||||||||||||||||||||
a402      AIPEMQSMIVAEINPAYRSLIADEPQIAPLLQDKRVEIVLDDGRKWLRRHPDEKGDLILM
                  310        320        330        340        350        360

370        380        390        400        410        420
m402.pep  NTTWYWRAYSTNLLSAEFLKQVQSHLTPDGIVMFNTTHSPHAFATAVHSIPYAYRYGHMV
          ||||||||||||||||||||||||||||||||||||||||||||||||||||||||||||
a402      NTTWYWRAYSTNLLSAEFLKQVQSHLTPDGIVMFNTTHSPHAFATAVHSIPYAYRYGHMV
                  370        380        390        400        410        420

430        440        450        460        470        480
m402.pep  VGSATPVVFPNKELLKQRLSRLIWPESGRHVFDSSTVDAAAQKVVSRMLIQMTEPSAGAE
          ||||||||||||||||||||||||||||||||||||||||||||||||||||||||||||
a402      VGSATPVVFPNKELLKQRLSRLIWPESGRHVFDSSTVDAAAQKVVSRMLIQMTEPSAGAE
                  430        440        450        460        470        480

490
m402.pep  VITDDNMIVEYKYGRGIX
          |||||||||||||||||
a402      VITDDNMIVEYKYGRGIX
                  490
```

The following partial DNA sequence was identified in *N. gonorrhoeae* <SEQ ID 1325>:

```
g406.seq
  1 ATGCGGGCAC GGCTGCTGAT ACCTATTCTT TTTTCAGTTT TTATTTTATC

51 CGCCTGCGGG ACACTGACAG GTATTCCATC GCATGGCGGA GGCAAACGCT

101 TCGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 AACTATGGGC GACCAAGGTT CAGGCAGTTT GACAGGGGGT CGCTACTCCA

251 TTGATGCACT GATTCGCGGC GAATACATAA ACAGCCCTGC CGTCCGCACC

301 GATTACACCT ATCCGCGTTA CGAAACCACC GCTGAAACAA CATCAGGCGG
```

-continued

```
351 TTTGACGGGT TTAACCACTT CTTTATCTAC ACTTAATGCC CCTGCACTCT

401 CGCGCACCCA ATCAGACGGT AGCGGAAGTA GGAGCAGTCT GGGCTTAAAT

451 ATTGGCGGGA TGGGGGATTA TCGAAATGAA ACCTTGACGA CCAACCCGCG

501 CGACACTGCC TTTCTTTCCC ACTTGGTGCA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA

701 GAACCAATAA AAAATTGCTC ATCAAACCCA AAACCAATGC GTTTGAAGCT

751 GCCTATAAAG AAAATTACGC ATTGTGGATG GGGCCGTATA AAGTAAGCAA

801 AGGAATCAAA CCGACGGAAG GATTGATGGT CGATTTCTCC GATATCCAAC

851 CATACGGCAA TCATACGGGT AACTCCGCCC CATCCGTAGA GGCTGATAAC

901 AGTCATGAGG GGTATGGATA CAGCGATGAA GCAGTGCGAC AACATAGACA

951 AGGGCAACCT TGA
```

This corresponds to the amino acid sequence <SEQ ID 1326; ORF 406>:

```
g406.pep
  1 MRARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSRSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIQPYGNHTG NSAPSVEADN

301 SHEGYGYSDE AVRQHRQGQP *
```

The following partial DNA sequence was identified in *N. meningitidis* <SEQ ID 1327>:

```
m406.seq
  1 ATGCAAGCAC GGCTGCTGAT ACCTATTCTT TTTTCAGTTT TTATTTTATC

51 CGCCTGCGGG ACACTGACAG GTATTCCATC GCATGGCGGA GGTAAACGCT

101 TTGCGGTCGA ACAAGAACTT GTGGCCGCTT CTGCCAGAGC TGCCGTTAAA

151 GACATGGATT TACAGGCATT ACACGGACGA AAAGTTGCAT TGTACATTGC

201 CACTATGGGC GACCAAGGTT CAGGCAGTTT GACAGGGGGT CGCTACTCCA

251 TTGATGCACT GATTCGTGGC GAATACATAA ACAGCCCTGC CGTCCGTACC

301 GATTACACCT ATCCACGTTA CGAAACCACC GCTGAAACAA CATCAGGCGG

351 TTTGACAGGT TTAACCACTT CTTTATCTAC ACTTAATGCC CCTGCACTCT

401 CTCGCACCCA ATCAGACGGT AGCGGAAGTA AAAGCAGTCT GGGCTTAAAT

451 ATTGGCGGGA TGGGGGATTA TCGAAATGAA ACCTTGACGA CTAACCCGCG

501 CGACACTGCC TTTCTTTCCC ACTTGGTACA GACCGTATTT TTCCTGCGCG

551 GCATAGACGT TGTTTCTCCT GCCAATGCCG ATACAGATGT GTTTATTAAC

601 ATCGACGTAT TCGGAACGAT ACGCAACAGA ACCGAAATGC ACCTATACAA

651 TGCCGAAACA CTGAAAGCCC AAACAAAACT GGAATATTTC GCAGTAGACA
```

-continued

```
701 GAACCAATAA AAAATTGCTC ATCAAACCAA AAACCAATGC GTTTGAAGCT

751 GCCTATAAAG AAAATTACGC ATTGTGGATG GGGCCGTATA AAGTAAGCAA

801 AGGAATTAAA CCGACGGAAG GATTAATGGT CGATTTCTCC GATATCCGAC

851 CATACGGCAA TCATACGGGT AACTCCGCCC CATCCGTAGA GGCTGATAAC

901 AGTCATGAGG GGTATGGATA CAGCGATGAA GTAGTGCGAC AACATAGACA

951 AGGACAACCT TGA
```

This corresponds to the amino acid sequence <SEQ ID 1328; ORF 406>:

```
m406.pep
  1 MQARLLIPIL FSVFILSACG TLTGIPSHGG GKRFAVEQEL VAASARAAVK

51 DMDLQALHGR KVALYIATMG DQGSGSLTGG RYSIDALIRG EYINSPAVRT

101 DYTYPRYETT AETTSGGLTG LTTSLSTLNA PALSRTQSDG SGSKSSLGLN

151 IGGMGDYRNE TLTTNPRDTA FLSHLVQTVF FLRGIDVVSP ANADTDVFIN

201 IDVFGTIRNR TEMHLYNAET LKAQTKLEYF AVDRTNKKLL IKPKTNAFEA

251 AYKENYALWM GPYKVSKGIK PTEGLMVDFS DIRPYGNHTG NSAPSVEADN

301 SHEGYGYSDE VVRQHRQGQP *
```

Computer analysis of the amino acid sequences gave the following results:
Homology with a Predicted ORF from *N. meningitidis* menA with menB ORF 406 shows 98.8% identity over a 320 aa overlap with a predicted ORF (ORF406.a) from *N. gonorrhoeae*:

```
g406/m406

10         20         30         40         50         60
       g406.pep  MRARLLIPILFSVFILSACGTLTGIPSHGGGKRFAVEQELVAASARAAVKDMDLQALHGR
                 |:||||||||||||||||||||||||||||||||||||||||||||||||||||||||||
       m406      MQARLLIPILFSVFILSACGTLTGIPSHGGGKRFAVEQELVAASARAAVKDMDLQALHGR
                          10         20         30         40         50         60

70         80         90        100        110        120
       g406.pep  KVALYIATMGDQGSGSLTGGRYSIDALIRGEYINSPAVRTDYTYPRYETTAETTSGGLTG
                 ||||||||||||||||||||||||||||||||||||||||||||||||||||||||||||
       m406      KVALYIATMGDQGSGSLTGGRYSIDALIRGEYINSPAVRTDYTYPRYETTAETTSGGLTG
                          70         80         90        100        110        120

130        140        150        160        170        180
       g406.pep  LTTSLSTLNAPALSRTQSDGSGSRSSLGLNIGGMGDYRNETLTTNPRDTAFLSHLVQTVF
                 |||||||||||||||||||||||||:||||||||||||||||||||||||||||||||||
       m406      LTTSLSTLNAPALSRTQSDGSGSKSSLGLNIGGMGDYRNETLTTNPRDTAFLSHLVQTVF
                         130        140        150        160        170        180

190        200        210        220        230        240
       g406.pep  FLRGIDVVSPANADTDVFINIDVFGTIRNRTEMHLYNAETLKAQTKLEYFAVDRTNKKLL
                 ||||||||||||||||||||||||||||||||||||||||||||||||||||||||||||
       m406      FLRGIDVVSPANADTDVFINIDVFGTIRNRTEMHLYNAETLKAQTKLEYFAVDRTNKKLL
                         190        200        210        220        230        240

250        260        270        280        290        300
       g406.pep  IKPKTNAFEAAYKENYALWMGPYKVSKGIKPTEGLMVDFSDIQPYGNHTGNSAPSVEADN
                 |||||||||||||||||||||||||||||||||||||||:||||||||||||||||||||
       m406      IKPKTNAFEAAYKENYALWMGPYKVSKGIKPTEGLMVDFSDIRPYGNHTGNSAPSVEADN
                         250        260        270        280        290        300
```

```
             310        320
g406.pep  SHEGYGYSDEAVRQHRQGQPX
          ||||||||||:|||||||||||
m406      SHEGYGYSDEVVRQHRQGQPX
             310        320
```

The following partial DNA sequence was identified in *N. meningitidis* <SEQ ID 1329>:

```
a406.seq
  1 ATGCAAGCAC GGCTGCTGAT ACCTATTCTT TTTTCAGTTT TTATTTTATC
 51 CGCCTGCGGG ACACTGACAG GTATTCCATC GCATGGCGGA GGTAAACGCT
101 TCGCGGTCGA ACAAGAACTT GTGGCCGCTT CTGCCAGAGC TGCCGTTAAA
151 GACATGGATT TACAGGCATT ACACGGACGA AAAGTTGCAT TGTACATTGC
201 AACTATGGGC GACCAAGGTT CAGGCAGTTT GACAGGGGGT CGCTACTCCA
251 TTGATGCACT GATTCGTGGC GAATACATAA ACAGCCCTGC CGTCCGTACC
301 GATTACACCT ATCCACGTTA CGAAACCACC GCTGAAACAA CATCAGGCGG
351 TTTGACAGGT TTAACCACTT CTTTATCTAC ACTTAATGCC CCTGCACTCT
401 CGCGCACCCA ATCAGACGGT AGCGGAAGTA AAAGCAGTCT GGGCTTAAAT
451 ATTGGCGGGA TGGGGGATTA TCGAAATGAA ACCTTGACGA CTAACCCGCG
501 CGACACTGCC TTTCTTTCCC ACTTGGTACA GACCGTATTT TTCCTGCGCG
551 GCATAGACGT TGTTTCTCCT GCCAATGCCG ATACGGATGT GTTTATTAAC
601 ATCGACGTAT TCGGAACGAT ACGCAACAGA ACCGAAATGC ACCTATACAA
651 TGCCGAAACA CTGAAAGCCC AAACAAAACT GGAATATTTC GCAGTAGACA
701 GAACCAATAA AAAATTGCTC ATCAAACCAA AAACCAATGC GTTTGAAGCT
751 GCCTATAAAG AAAATTACGC ATTGTGGATG GGACCGTATA AAGTAAGCAA
801 AGGAATTAAA CCGACAGAAG GATTAATGGT CGATTTCTCC GATATCCAAC
851 CATACGGCAA TCATATGGGT AACTCTGCCC CATCCGTAGA GGCTGATAAC
901 AGTCATGAGG GGTATGGATA CAGCGATGAA GCAGTGCGAC GACATAGACA
951 AGGGCAACCT TGA
```

This corresponds to the amino acid sequence <SEQ ID 1330; ORF 406.a>:

```
a406.pep

1  MQARLLIPIL  FSVFILSACG  TLTGIPSHGG  GKRFAVEQEL  VAASARAAVK
 51  DMDLQALHGR  KVALYIATMG  DQGSGSLTGG  RYSIDALIRG  EYINSPAVRT
101  DYTYPRYETT  AETTSGGLTG  LTTSLSTLNA  PALSRTQSDG  SGSKSSLGLN
151  IGGMGDYRNE  TLTTNPRDTA  FLSHLVQTVF  FLRGIDVVSP  ANADTDVFIN
201  IDVFGTIRNR  TEMHLYNAET  LKAQTKLEYF  AVDRTNKKLL  IKPKTNAFEA
251  AYKENYALWM  GPYKVSKGIK  PTEGLMVDFS  DIQPYGNHMG  NSAPSVEADN
301  SHEGYGYSDE  AVRRHRQGQP  * m406/a406  98.8% identity in 320 aa overlap
```

```
              10         20         30         40         50         60
m406.pep  MQARLLIPILFSVFILSACGTLTGIPSHGGGKRFAVEQELVAASARAAVKDMDLQALHGR
          ||||||||||||||||||||||||||||||||||||||||||||||||||||||||||||
a406      MQARLLIPILFSVFILSACGTLTGIPSHGGGKRFAVEQELVAASARAAVKDMDLQALHGR
              10         20         30         40         50         60

70         80         90        100        110        120
m406.pep  KVALYIATMGDQGSGSLTGGRYSIDALIRGEYINSPAVRTDYTYPRYETTAETTSGGLTG
          ||||||||||||||||||||||||||||||||||||||||||||||||||||||||||||
a406      KVALYIATMGDQGSGSLTGGRYSIDALIRGEYINSPAVRTDYTYPRYETTAETTSGGLTG
              70         80         90        100        110        120

130        140        150        160        170        180
m406.pep  LTTSLSTLNAPALSRTQSDGSGSKSSLGLNIGGMGDYRNETLTTNPRDTAFLSHLVQTVF
          ||||||||||||||||||||||||||||||||||||||||||||||||||||||||||||
a406      LTTSLSTLNAPALSRTQSDGSGSKSSLGLNIGGMGDYRNETLTTNPRDTAFLSHLVQTVF
             130        140        150        160        170        180

190        200        210        220        230        240
m406.pep  FLRGIDVVSPANADTDVFINIDVFGTIRNRTEMHLYNAETLKAQTKLEYFAVDRTNKKLL
          ||||||||||||||||||||||||||||||||||||||||||||||||||||||||||||
a406      FLRGIDVVSPANADTDVFINIDVFGTIRNRTEMHLYNAETLKAQTKLEYFAVDRTNKKLL
             190        200        210        220        230        240

250        260        270        280        290        300
m406.pep  IKPKTNAFEAAYKENYALWMGPYKVSKGIKPTEGLMVDFSDIRPTGNHTGNSAPSVEADN
          |||||||||||||||||||||||||||||||||||||||||:|||| |||||||||||||
a406      IKPKTNAFEAAYKENYALWMGPYKVSKGIKPTEGLMVDFSDIQPYGNHMGNSAPSVEADN
             250        260        270        280        290        300

310        320
m406.pep  SHEGYGYSDEVVRQHRQGQPX
          ||||||||||:||:|||||||
a406      SHEGYGYSDEAVRRHRQGQPX
             310        320
```

The following partial DNA sequence was identified in *N. gonorrhoeae* <SEQ ID 1331>:

```
g501.seq
   1  atggtcggac ggaccttgac cgcagatacc gacatatttg ttctgcttgc,
  51  ggcaggcgga gatggcaaga tgcagcatca ctttgacggc agggttgcgt
 101  tcgtcaaacg attcggacac caagccgctg tctcggtcga ggccgagggt
 151  cagctgggtc atgtcgttcg agccgatgga gaagccgtcg aagtattgca
 201  ggaattgttc cgccaatacc gcgttgctcg gcagctcgca catcataatc
 251  aggcgcaggc cgttttttgcc gcgttccaag ccgttttctt tcaatgcctt
 301  aaccactgct tcggcttcgc ccaaagtgcg gacgaacgga atcatgattt
 351  cgacgttggt cagacccatt tcgtcacgaa cgcgtttcaa ggctttgcat
 401  tccaaggcga acagtctttg aagctctcg gcaacataac gcgccgcacc
 451  acggaagccc aacatcgggt tttcttcatg cggttcgtat acgctgccgc
 501  cgaccaggtt ggcgtattcg ttggatttga agtcggacat acggacgatg
 551  gttttacgcg gataaaccga tgcggcaagc gttgccacgc cttcggcgat
 601  tttatcgacg tagaagtcga caggggatgc gtaaccggcg atgcggcgga
 651  taatttccgc tttcagttcg tcgtcttgtt tgtcaaattc caacaaggct
 701  ttcgggtgga tgccgatttg gcggttgatg ataaattcca tacgcgccaa
 751  gccgatgcct tcgctgggca gattggcgaa gctgaatgcg agttcgggat
 801  tgccgacgtt catcatgact ttgacgggtg cttttggcat attgtccaag
 851  gcgacatcgg taatttgtac gtccagcagg ccggcataga taaagccggt
```

-continued

```
 901 atcgccttcg gcacaggata cggtaacttc ctgaccgttt tccaagagtt
 951 cggtcgcatt gccgcagccg acgacggcag gaatacccag ttcgcgcgcg
1001 atgatggcgg cgtggcaggt gcgtccgccg cggttggtca cgatggcgga
1051 agcacgtttc atcacgggtt cccaatccgg atcggtcatg tcggtaacca
1101 gtacgtcgcc ggcttcgacg gaatccatct cggaagcatc tttaatcagg
1151 cgcaccttgc cctgaccgac tttttgaccg atggcacgac cttcgcacaa
1201 gacggttttt tcgccgttga tggcgtagcg gcgcaggttg cggctgcctt
1251 cttcttggga tttgacggtt tcggggcggg cttgcaggat gtagagtttg
1301 ccgtccaggc cgtcgcgtcc ccattcgata tccatcgggc ggccgtagtg
1351 tttttcgatg gtcagcgcgt agtgtgccaa ctcggtgatt tcttcgtcgg
1401 taatggagaa gcggttgcgg tcttcttcgg ggacttcgac gttggttacc
1451 gatttgccgg cttcggcttt gtcggtgaaa atcattttga tgtgtttcga
1501 acccatggtc ttgcgcagga tggcgggttt gcctgctttg agcgtgggtt
1551 tgaacacata aaattcgtcc gggttgaccg cgccttgtac gacgttttcg
1601 cccagaccgt aagaggaggt aacaaagacg acttggttgt agccggattc
1651 ggtgtcgagg gtgaacatca cacctga
```

This corresponds to the amino acid sequence <SEQ ID 1332; ORF 501.ng>:

```
g501.pep
  1 MVGRTLTADT DIFVLLAAGG DGKMQHHFDG RVAFVKRFGH QAAVSVEAEG
 51 QLGHVVRADG EAVEVLQELF RQYRVARQLA HHNQAQAVFA AFQAVFFQCL
101 NHCFGFAQSA DERNHDFDVG QTHFVTNAFQ GFAFQGETVF EALGNITRRT

151 TEAQHRVFFM RFVYAAADQV GVFVGFEVGH TDDGFTRINR CGKRCHAFGD

201 FIDVEVDRGC VTGDAADNFR FQFVVLFVKF QQGFRVDADL AVDDKFHTRQ

251 ADAFAGQIGE AECEFGIADV HHDFDGCFWH IVQGDIGNLY VQQAGIDKAG

301 IAFGTGYGNF LTVFQEFGRI AAADDGRNTQ FARDDGGVAG ASAAVGHDGG

351 STFHHGFPIR IGHVGNQYVA GFDGIHLGSI FNQAHLALTD FLTDGTTFAQ

401 DGFFAVDGVA AQVAAAFFLG FDGFGAGLQD VEFAVQAVAS PFDIHRAAVV

451 FFDGQRVVCQ LGDFFVGNGE AVAVFFGDFD VGYRFAGFGF VGENHFDVFR

501 THGLAQDGGF ACFERGFEHI KFVRVDRALY DVFAQTVRGG NKDDLVVAGF

551 GVEGEHHT*
```

The following partial DNA sequence was identified in *N. meningitidis* <SEQ ID 1333>:

```
m501.seq
  1 atggtcggac sggccttgac cgcagatgcc gacatatttg ttctgcttgc
 51 ggcaggcgga gatggcaagg tgcagcatca ctttgacggc agggttgcgt
101 tcgtcaaacg attcggatac caagccgctg tcgcggtcga gaccgagggt
151 cagttgggtc atgtcgttcg agccgatgga gaagccgtcg aagtattgca
201 ggaattgttc cgccaatacc gcgttgctcg gcagctcgca catcataatc
251 aggcgcaggc cgtttttgcc gcgttccaag ccgttttctt tcagggcttt
```

-continued

```
 301 gacaacggmt tcggcttcgc ccaaagtgcg gacgaacgga atcatgattt 351 caacgttggy caacccatt tcatcgcgga cgcgtttcaa ggctttgcat 401 tccaaggcga aacagtcttt gaagttgtcg gcgacataac gcgccgcacc 451 acggaagccc aacatcgggt tttcttcatg cggttcgtat acgttgccgc 501 cgaccaggtt ggcgtattcg ttggatttga agtcggacat acggacgatg 551 gttttacgcg gataaaccga tgcggccaat gtcgccacgc cttcggcgat 601 tttatcgacg tagaagtcga caggggacgc gtaaccggcg atacggcggg 651 taatttccgc ttttaattcg tcgtcttgtt tgtcaaattc caacaargct 701 ttggggtgga taccgatttg gcggttgatg ataaattcca tacgcgccaa 751 gccgatgcct tcgctgggca ggttggcgaa gctgaatgcg agttcgggat 801 tgccgacgtt catcatgact tttacaggtg ctttaggcat attgtctaag 851 gcgacatcgg taatctgtac gtccaacaga ccggcataga taaagccggt 901 atcgccttcg gcacaggata cggtaacttc ttgaccgttt ttcagcaatt 951 cggttgcatt gccgcagccg acaacggcag gaatgcccaa ttcacgcgcg 1001 atgatggcgg cgtggcaggt acggccgccg cggttggtaa cgatggcaga 1051 agcacgtttc atcacgggtt cccaatccgg atcggtcatg tcggtaacga 1101 gtacgtcgcc ggcttcgacg gaatccatct cggaagcatc tttaatcagg 1151 cgcaccttgc cctgaccgac tttctgaccg atggcgcggc cttcgcataa 1201 tacgttttg tcgccgttga tggcgaagcg gcgcaggttg cggttgccct 1251 cttcttggga ttttacggtt tcgggacggg cttgcaggat gtagagtttg 1301 ccgtccaagc cgtcgcgtcc ccattcgata tccatcgggc ggccgtagtg 1351 tttttcgatg gtcagtgcgt aatgcgccaa ctcagtaatt tcttcgtcgg 1401 taatggagaa gcggttgcgg tcttcctcgg ggacatcgac gttggttacg 1451 gatttaccgg cttctgcttt gtcggtaaaa atcatttga tgtgttttga 1501 acccatggtt ttacgcagga tggcgggctt gcccgytttg agcgtgggtt 1551 tgaacacatr aaattcgtcc gggttgaccg caccttgtac gacgttttcg 1601 cccagaccgt aagaggaggt aacaaagacg acytgatcgt akccggattc 1651 ggtgtcgagg gtgaacatca cacctga
```

This corresponds to the amino acid sequence <SEQ ID 1334; ORF 501>:

```
m501.pep
  1 MVGXALTADA DIFVLLAAGG DGKVQHHFDG RVAFVKRFGY QAAVAVETEG

51 QLGHVVRADG EAVEVLQELF RQYRVARQLA HHNQAQAVFA AFQAVFFQGF

101 DNGFGFAQSA DERNHDFNVG QPHFIADAFQ GFAFQGETVF EVVGDITRRT

151 TEAQHRVFFM RFVYVAADQV GVFVGFEVGH TDDGFTRINR CGQCRHAFGD

201 FIDVEVDRGR VTGDTAGNFR FXFVVLFVKF QQXFGVDTDL AVDDKFHTRQ

251 ADAFAGQVGE AECEFGIADV HHDFYRCFRH IVXGDIGNLY VQQTGIDKAG

301 IAFGTGYGNF LTVFQQFGCI AAADNGRNAQ FTRDDGGVAG TAAAVGNDGR

351 STFHHGFPIR IGHVGNEYVA GFDGIHLGSI FNQAHLALTD FLTDGAAFAX

401 YGFVAVDGEA AQVAVALFLG FYGFGTGLQD VEFAVQAVAS PFDIHRAAVV
```

-continued

```
451 FFDGQCVMRQ LSNFFVGNGE AVAVFLGDID VGYGFTGFCF VGKNHFDVFX

501 THGFTQDGGL ARFERGFEHX KFVRVDRTLY DVFAQTVRGG NKDDLIVXGF

551 GVEGEHHT*
```

Computer analysis of this amino acid sequence gave the following results:
Homology with a Predicted ORF from *N. gonorrhoeae*
ORF 501 shows 86.2% identity over a 558 aa overlap with a predicted ORF (ORF 501.ng) from *N. gonorrhoeae*:

```
m501/g501

10         20         30         40         50         60
m501.pep  MVGXALTADADIFVLLAAGGDGKVQHHFDGRVAFVKRFGYQAAVAVETEGQLGHVVRADG
          ||| :||||:|||||||||||||:|||||||||||||:||||:||:|||||||||||||
g501      MVGRTLTADTDIFVLLAAGGDGKMQHHFDGRVAFVKRGFHQAAVSVEAEGQLGHVVRADG
                    10         20         30         40         50         60

70         80         90        100        110        120
m501.pep  EAVEVLQELFRQYRVARQLAHHNQAQAVFAAFQAVFFQGFDNGFGFAQSADERNHDFNVG
          |||||||||||||||||||||||||||||||||||||||  : : ||||||||||||:||
g501      EAVEVLQELFRQYRVARQLAHHNQAQAVFAAFQAVFFQCLNHCFGFAQSADERNHDFDVG
                    70         80         90        100        110        120

130        140        150        160        170        180
m501.pep  QPHFIADAFQGFAFQGETVFEVVGDITRRTTEAQHRVFFMRFVYVAADQVGVFVGFEVGH
          | ||:::|||||||||||||||::|:||||||||||||||||||:|||||||||||||||
g501      QTHFVTNAFQGFAFQGETVFEALGNITRRTTEAQHRVFFMRFVYAAADQVGVFVGFEVGH
                   130        140        150        160        170        180

190        200        210        220        230        240
m501.pep  TDDGFRTINRCGQCRHAFGDFIDVEVDRGRVTGDTAGNFRFXFVVLFVKFQQXFGVDTDL
          |||||||||||: |||||||||||||||| ||||:| |||| ||||||||| | ||:||
g501      TDDGFRTINRCGKRCHAFGDFIDVEVDRGCVTGDAADNFRFQFVVLFVKFQQGFRVDADL
                   190        200        210        220        230        240

250        260        270        280        290        300
m501.pep  AVDDKFHTRQADAFAGQVGEAECEFGIADVHHDFYRCFRHIVXGDIGNLYVQQTGIDKAG
          ||||||||||||||||:||||||||||||||||||  || ||| ||||||||||:|||||
g501      AVDDKFHTRQADAFAGQIGEAECEFGIADVHHDFDGCFWHIVQGDIGNLYVQQAGIDKAG
                   250        260        270        280        290        300

310        320        330        340        350        360
m501.pep  IAFGTGYGNFLTVFQQFGCIAAADNGRNAQFTRDDGGVAGTAAAVGNDGRSTFHHGFPIR
          |||||||||||||||:|| ||||||:|||:|:|||||||::|||:|| ||||||||||||
g501      IAFGTGYGNFLTVFQEFGRIAAADDGRNTQFARDDGGVAGASAAVGHDGGSTFHHGFPIR
                   310        320        330        340        350        360

370        380        390        400        410        420
m501.pep  IGHVGNEYVAGFDGIHLGSIFNQAHLALTDFLTDGAAFAXYGFVAVDGEAAQVAVALFLG
          ||||||:||||||||||||||||||||||||||||::|| || |||| ||||:|:|||
g501      IGHVGNQYVAGFDGIHLGSIFNQAHLALTDFLTDGTTFAQDGFFAVDGVAAQVAAAFFLG
                   370        380        390        400        410        420

430        440        450        460        470        480
m501.pep  FYGFGTGLQDVEFAVQAVASPFDIHRAAVVFFDGQCVMRQLSNFFVGNGEAVAVFLGDID
          | |||:|||||||||||||||||||||||||||| |: ||::||||||||||||||:|:|
g501      FDGFGAGLQDVEFAVQAVASPFDIHRAAVVFFDGQRVVCQLGDFFVGNGEAVAVFFGDFD
                   430        440        450        460        470        480

490        500        510        520        530        540
m501.pep  VGYGFTGFCFVGKNHFDVFXTHGFTQDGGLARFERGFEHXKFVRVDRTLYDVFAQTRVGG
          |||||:|| |||:|||||| |||::|||:| ||||||||:|||||||:|||||||||||
g501      VGYGFAGFGFVGENHFDVFRTHGLAQDGGFACFERGREHIKFVRVDRALYDVFAQTRVGG
                   490        500        510        520        530        540

550
m501.pep  NKDDLIVXGFGVEGEHHT
          |||||:| |||||||||||
g501      NKDDLVVAGFGVEGEHHT
                   550
```

550
The following partial DNA sequence was identified in *N. meningitidis* <SEQ ID 1335>:

```
a501.seq (partial)
    1 ATGGTCGGAC GGGCCTTGAC CGCAGATGCC GACATATTTG TTCTGCTTGC

51 GGCAGGCGGA GATGGCAAGG TGCAGCATCA CTTTGACGGC AGGGTTGCGT

101 TCGTCAAACG ATTCGGATAC CAAGCCGCTG TCGCGGTCGA GACCGAGGGT
```

```
 151 CAGTTGGGTC ATGTCGTTCG AGCCGATGGA GAAGCCGTCG AAGTATTGCA

201 GGAATTGTTC CGCCAATACC GCGTTGCTCG GCAGCTCGCA CATCATAATC

251 AGGCGCAGGC CGTTTTTGCC GCGTTCCAAG CCGTTTTCTT TCAGGGCTTT

301 GACAACGGCT TCGGCTTCGC CCAAAGTGCG GACGAACGGA ATCATGATTT

351 CAACGTTGGT CAACCCCATT TCATCGCGGA CGCGTTTCAA GGCTTTGCAT

401 TCCAAGGCGA AACAGTCTTT GAAGTTGTCG GCGACATAAC GCGCCGCACC

451 ACGGAAGCCC AACATCGGGT TTTCTTCATG CGGTTCGTAT ACGTTGCCGC

501 CGACCAGGTT GGCGTATTCG TTGGATTTGA AGTCGGACAT ACGGACGATG

551 GTTTTACGCG GATAAACCGA TGCGGCCAAT GTCGCCACGC CTTCGGCGAT

601 TTTATCGACG TAGAAGTCGA CAGGGGACGC GTAACCGGCG ATACGGCGGG

651 TAATTTCCGC TTTTAATTCG TCGTCTTGTT TGTCAAATTC CAACAAGGCT

701 TTGGGGTGGA TACCGATTTG GCGGTTGATG ATAAATTCCA TACGCGCCAA

751 GCCGATGCCT TCGCTGGGCA GGTTGGCGAA GCTGAATGCG AGTTCGGGAT

801 TGCCGACGTT CATCATGACT TTTACAGGTG CTTTAGGCAT GTTGTCCAAA

851 GCAACATCGG TAATTTGTAC GTCCAGCAGG CCGGAGTAGA TGAAGCCGGT

901 ATCGCCTTCG GCACAGGATA CGGTAACTTC TTGACCGTTT TTCAGCAATT

951 CGGTTGCATT GCCGCAGCCG ACAACGGCAG GAATACCCAG TTCGCGCGCG

1001 ATGATGGCGG CGTGGCAGGT ACGTCCGCCC CTGTTGGTCA CGATGGCGGA

1051 AGCGCGTTTC ATCACCGGTT CCCAATCTGG GTCGGTCATG TCGGTAACCA

1101 GTACGTCGCC GGCTTCGACG GAATCCATCT CGGAAGCATC TTTAATCAGG

1151 CGTACCTTGC CCTGACCGAC TTTCTGACCG ATGGCGCGGC CTTCGCACAA

1201 GACGGTTTTT TCGCCGTTGA TAGAAAAGCG GCGCAGGTTG CGGCTGCCTT

1251 CTTCCTGGGA TTTGACGGTT TCGGGACGGG CTTGCAGGAT GTAGAGTTTG

1301 CCGTCCAAGC CGTCGCGTCC CCATTCGATG TCCATCGGGC GGCCGTAGTG

1351 TTTTTCGATG GTCAGTGCGT AATGCGCCAA CTCGGTGATT TCTTCGTCGG

1401 TAATGGAGAA GCGGTTGCGG TCTTCTTCGG GGACATCGAC GTTGGTTACC

1451 GATTTGCCGG CTTCTGCTTT GTCGGTAAAA ATCATTTTGA TGTGTTTTGA

1501 GCCCATGGTT TTGCGCAGGA TGGCAGGTTT GCCTGCTTTC AGCGTGGGTT

1551 TGAACACATA GAATTCGTCG GGATTGACTG CGCCTTGTAC GACGTTTTCG

1601 CCCAGACCGT AGGATGAAGT GACAAAGACG ACTTGGTCGT AACCGGATTC

1651 GGTATCGAGG GTGAACATCA C
```

This corresponds to the amino acid sequence <SEQ ID 1336; ORF 501.a>:

```
a501.pep
   1 MVGRALTADA DIFVLLAAGG DGKVQHHFDG RVAFVKRFGY QAAVAVETEG

51 QLGHVVRADG EAVEVLQELF RQYRVARQLA HHNQAQAVFA AFQAVFFQGF

101 DNGFGFAQSA DERNHDFNVG QPHFIADAFQ GFAFQGETVF EVVGDITRRT

151 TEAQHRVFFM RFVYVAADQV GVFVGFEVGH TDDGFTRINR CGQCRHAFGD

201 FIDVEVDRGR VTGDTAGNFR F*FVVLFVKF QQGFGVDTDL AVDDKFHTRQ

251 ADAFAGQVGE AECEFGIADV HHDFYRCFRH VVQSNIGNLY VQQAGVDEAG
```

```
-continued
301 IAFGTGYGNF LTVFQQFGCI AAADNGRNTQ FARDDGGVAG TSAPVGHDGG

351 SAFHHRFPIW VGHVGNQYVA GFDGIHLGSI FNQAYLALTD FLTDGAAFAQ

401 DGFFAVDRKA AQVAAAFFLG FDGFGTGLQD VEFAVQAVAS PFDVHRAAVV

451 FFDGQCVMRQ LGDFFVGNGE AVAVFFGDID VGYRFAGFCF VGKNHFDVF*

501 AHGFAQDGRF ACFQRGFEHI EFVGIDCALY DVFAQTVG*S DKDDLVVTGF

551 GIEGEHH
``` m501/a501 90.3% identity in 557 aa overlap

```
                    10         20         30         40         50         60
      m501.pep   MVGXALTADADIFVLLAAGGDGKVQHHFDGRVAFVKRFGYQAAVAVETEGQLGHVVRADG
                 ||| ||||||||||||||||||||||||||||||||||||||||||||||||||||||||
      a501       MVGRALTADADIFVLLAAGGDGKVQHHFDGRVAFVKRFGYQAAVAVETEGQLGHVVRADG
                    10         20         30         40         50         60

70         80         90        100        110        120
      m501.pep   EAVEVLQELFRQYRVARQLAHHNQAQAVFAAFQAVFFQGFDNGFGFAQSADERNHDFNVG
                 ||||||||||||||||||||||||||||||||||||||||||||||||||||||||||||
      a501       EAVEVLQELFRQYRVARQLAHHNQAQAVFAAFQAVFFQGFDNGFGFAQSADERNHDFNVG
                    70         80         90        100        110        120

130        140        150        160        170        180
      m501.pep   QPHFIADAFQGFAFQGETVFEVVGDITRRTTEAQHRVFFMRFVYVAADQVGVFVGFEVGH
                 ||||||||||||||||||||||||||||||||||||||||||||||||||||||||||||
      a501       QPHFIADAFQGFAFQGETVFEVVGDITRRTTEAQHRVFFMRFVYVAADQVGVFVGFEVGH
                   130        140        150        160        170        180

190        200        210        220        230        240
      m501.pep   TDDGFTRINRCGQCRHAFGDFIDVEVDRGRVTGDTAGNFREXFVVLFVKFQQXFGVDTDL
                 |||||||||||||||||||||||||||||||||||||||||||||||||||| |||||||
      a501       TDDGFTRINRCGQCRHAFGDFIDVEVDRGRVTGDTAGNFREXFVVLFVKFQQGFGVDTDL
                   190        200        210        220        230        240

250        260        270        280        290        300
      m501.pep   AVDDKFHTRQADAFAGQVGEAECEFGIADVHHDFYRCFRHIVXGDIGNLYVQQTGIDKAG
                 ||||||||||||||||||||||||||||||||||||||||||:::||||||:|:|:||
      a501       AVDDKFHTRQADAFAGQVGEAECEFGIADVHHDFYRCFRHVVQSNIGNLYVQQAGVDEAG
                   250        260        270        280        290        300

310        320        330        340        350        360
      m501.pep   IAFGTGYGNFLTVFQQFGCIAAADNGRNAQFTRDDGGVAGTAAAVGNDGRSTFHHGFPIR
                 |||||||||||||||||||||||||||||:||:||||||||:|||:||  |:|||  |||
      a501       IAFGTGYGNFLTVFQQFGCIAAADNGRNTQFARDDGGVAGTSAPVGHDGGSAFHHRFPIW
                   310        320        330        340        350        360

370        380        390        400        410        420
      m501.pep   IGHVGNEYVAGFDGIHLGSIFNQAHLALTDFLTDGAAFAXYGFVAVDGEAAQVAVALFLG
                 :||||:|||||||||||||:|||||||||||||||||||  || ||| :|||||:|:|||
      a501       VGHVGNQYVAGFDGIHLGSIFNQAYLALTDFLTDGAAFAQDGFFAVDRKAAQVAAAFFLG
                   370        380        390        400        410        420

430        440        450        460        470        480
      m501.pep   FYGFGTGLQDVEFAVQAVASPFDIHRAAVVFFDGQCVMRQLSNFFVGNGEAVAVFLGDID
                 | ||||||||||||||||||||||:|||||||||||||||||:||||||||||||||||||
      a501       FDGFGTGLQDVEFAVQAVASPFDVHRAAVVFFDGQCVMRQLGDFFVGNGEAVAVFFGDID
                   430        440        450        460        470        480

490        500        510        520        530        540
      m501.pep   VGYGFTGFCFVGKNHFDVFXTHGFTQDGGLARFERGFEHXKFVRVDRTLYDVFAQTVRGG
                 |||  |:|||||||||||||:|||:|||  |:|:|||||  :||  |  :||||||||  :
      a501       VGYRFAGFCFVGKNHFDVFXAHGFAQDGRFACFQRGFEHIEFVGIDCALYDVFAQTVGXS
                   490        500        510        520        530        540

550       559
      m501.pep   NKDDLIVXGFGVEGEHHTX
                 :||||:|:|||:|||||
      a501       DKDDLVVTGFGIEGEHH
                   550
```

The following partial DNA sequence was identified in *N. gonorrhoeae* <SEQ ID 1337>:

```
g502.seq
   1 atgatgaaac cgcacaacct gttccaattc ctcgccgttt gctccctgac
  51 cgtcgccgtc gcttccgcac aggcgggcgc ggtggacgcg ctcaagcaat
 101 tcaacaacga tgccgacggt atcagcggca gcttcaccca aaccgtccaa
 151 agcaaaaaga aacccaaac cgcgcacggc acgttcaaaa tcctgcgccc
 201 gggcctcttc aaatgggaat acactttgcc ctacagacag actattgtcg
 251 gcgacggtca aaccgtttgg ctctacgatg ttgatttggc acaagtgacc
 301 aagtcgtccc aagaccaggc catcggcggc agccccgccg ccatcctgtc
 351 gaacaaaacc gccctcgaaa gcagttacac gctgaaagag gacggttcgt
 401 ccaacggcat cgattatgtg cggggcaacg cccaaacgca acaacgccgg
 451 ctaccaatac atccgcatcg gcttcaaagg cggcaacctc gccgccatgc
 501 agcttaa
```

This corresponds to the amino acid sequence <SEQ ID 1338; ORF 502.ng>:

```
g502.pep
   1 MMKPHNLFQF LAVCSLTVAV ASAQAGAVDA LKQFNNDADG ISGSFTQTVQ
  51 SKKKTQTAHG TFKILRPGLF KWEYTLPYRQ TIVGDGQTVW LYDVDLAQVT
 101 KSSQDQAIGG SPAAILSNKT ALESSYTLKE DGSSNGIDYV RGNAQTQQRR
 151 LPIHPHRLQR RQPRRHAA*
```

The following partial DNA sequence was identified in *N. meningitidis* <SEQ ID 1339>:

```
m502.seq
   1 atgatgaaac cgcacaacct gttccaattc ctcgccgttt gctccctgac
  51 cgtcgccgtc gcttccgcac aggcgggcgc ggtagacgcg cttaagcaat
 101 tcaacaacga tgccgacggt atcagcggca gcttcaccca amccgtccaa
 151 wgcaaaaaga aacccaaac cgcgcacggc acgttcaaaa tcctgcgacc
 201 gggcctttc aaatgggaat acaccaaact t.acaggcaa accatcgtcg
 251 gcgacggtca aacygtttgg ctmtacgatg tygatctggc acaagtgacc
 301 aagtcgtccc aagaccaggc cataggcgsc agccccgccg ccatcctgtc
 351 gaacaaarcc gccctcgaaa gcagctacac gctgaaagag gacggttcgt
 401 ccaacggcat cgattatgtg ggcaacgccc aaacgcaaca acgccggcta
 451 ccaatacatc cgcatcggct tcaaaggcgg caacctcgcc gccatgcagc
 501 tyaa
```

This corresponds to the amino acid sequence <SEQ ID 1340; ORF 502.ng>:

```
m502.pep
   1 MMKPHNLFQF LAVCSLTVAV ASAQAGAVDA LKQFNNDADG ISGSFTQXVQ
  51 XKKKTQTAHG TFKILRPGLF KWEYTKLYRQ TIVGDGQTVW LYDVDLAQVT
```

```
101 KSSQDQAIGX SPAAILSNKX ALESSYTLKE DGSSNGIDYV GNAQTQQRRL

151 PIHPHRLQRR QPRRHAAX
```

Computer analysis of this amino acid sequence gave the following results:

Homology with a Predicted ORF from *N. gonorrhoeae*

ORF 502 shows 95.8% identity over a 168 aa overlap with a predicted ORF (ORF 502.ng) from *N. gonorrhoeae*:

```
m502/g502
                 10         20         30         40         50         60
    m502.pep MMKPHNLFQFLAVCSLTVAVASAQAGAVDALKQFNNDADGISGSFTQXVQXKKKTQTAHG
             ||||||||||||| |||||||||||||||||||||||||||||||||:|| |||||||||
    g502     MMKPHNLFQFLAVCSLTVAVASAQAGAVDALKQFNNDADGISGSFTQTVQSKKKTQTAHG
                 10         20         30         40         50         60

70         80         90        100        110        120
    m502.pep TFKILRPGLFKWEYTKLYRQTIVGDGQTVWLYDVDLAQVTKSSQDQAIGXSPAAILSNKX
             ||||||||||||||||| ||||||||||||||||||||||||||||||||| ||||||||:
    g502     TFKILRPGLFKWEYTLPYRQTIVGDGQTVWLYDVDLAQVTKSSQDQAIGGSPAAILSNKT
                 70         80         90        100        110        120

130        140        150        160
    m502.pep ALESSYTLKEDGSSNGIDYV-GNAQTQQRRLPIHPHRLQRRQPRRHAA
             |||||||||||||||||||| |||||||||||||||||||||||||||
    g502     ALESSYTLKEDGSSNGIDYVRGNAQTQQRRLPIHPHRLQRRQPRRHAA
                130        140        150        160
```

The following partial DNA sequence was identified in *N. meningitidis* <SEQ ID 1341>:

```
a502.seq
  1 ATGATGAAAC CGCACAACCT GTTCCAATTC CTCGCCGTTT GCTCCCTGAC

51 CGTCTCCGTC GCTTCCGCAC AGGCGGGCGC GGTGGACGCG CTCAAGCAAT

101 TCAACAACGA TGCCGACGGT ATCAGCGGCA GCTTCACCCA AACCGTCCAA

151 AGCAAAAAGA AACCCAAAC CGCGCACGGC ACGTTCAAAA TCCTGCGCCC

201 GGGCCTCTTT AAATGGGAAT ACACTTCGCC TTACAAACAG ACTATTGTCG

251 GCGACGGTCA AACCGTTTGG CTCTACGATG TCGATTTGGC ACAAGTGACC

301 AAGTCGTCCC AAGACCAGGC CATAGGCGGC AGCCCCGCCG CCATCCTGTC

351 GAACAAAACC GCCCTCGAAA GCAGCTACAC GCTGAAAGAG GACGGTTCGT

401 CCAACGGCAT CGATTATGTG GGCAACGCCC AAACGCAACA ACGCCGGCTA

451 CCAATACATC CGCATCGGCT TCAAAGGCGG CAACCTCGCC GCCATGCAGC

501 TTAA
```

This corresponds to the amino acid sequence <SEQ ID 1342; 502 217.a>:

```
a502.pep
  1 MMKPHNLFQF LAVCSLTVSV ASAQAGAVDA LKQFNNDADG ISGSFTQTVQ

51 SKKKTQTAHG TFKILRPGLF KWEYTSPYKQ TIVGDGQTVW LYDVDLAQVT

101 KSSQDQAIGG SPAAILSNKT ALESSYTLKE DGSSNGIDYV GNAQTQQRRL

151 PIHPHRLQRR QPRRHAA*
``` m502/a502 95.2% identity in 167 aa overlap

```
                 10         20         30         40         50         60
    m502.pep MMKPHNLFQFLAVCSLTVAVASAQAGAVDALKQFNNDADGISGSFTQXVQXKKKTQTAHG
             |||||||||||||||||:||||||||||||||||||||||||||||:|| |||||||||
    a502     MMKPHNLFQFLAVCSLTVSVASAQAGAVDALKQFNNDADGISGSFTQTVQSKKKTQTAHG
                 10         20         30         40         50         60
```

-continued

```
              70         80         90        100        110        120
m502.pep  TFKILRPGLFKWEYTKLYRQTIVGDGQTVWLYDVDLAQVTKSSQDQAIGXSPAAILSNKX
          ||||||||||||:|:|||||||||||||||||||||||||||||| ||||||||||:
a502      TFKILRPGLFKWEYTSPYKQTIVGDGQTVWLYDVDLAQVTKSSQDQAIGGSPAAILSNKT
              70         80         90        100        110        120

130        140        150        160
m502.pep  ALESSYTLKEDGSSNGIDYVGNAQTQQRRLPIHPHRLQRRQPRRRHAAX
          ||||||||||||||||||||||||||||||||||||||||||||||||
a502      ALESSYTLKEDGSSNGIDYVGNAQTQQRRLPIHPHRLQRRQPRRRHAAX
             130        140        150        160
```

The following partial DNA sequence was identified in *N. gonorrhoeae* <SEQ ID 1343>:

```
g502-1.seq
    1 ATGatGAAAc cgcaCaacct gttccaaTTc CTCGCCGTTT GCTCCCTGAC

51 CGTCGCCGTC GCTTCCGCAC AGGCGGGCGC GGTGGACGCG CTCAAGCAAT

101 TCAACAACGA TGCCGACGGT ATCAGCGGCA GCTTCACCCA AACCGTCCAA

151 AGCAAAAAGA AACCCAAAC CGCGCACGGC ACGTTCAAAA TCCTGCGCCC

201 GGGCCTCTTC AAATGGGAAT ACACTTTGCC CTACAGACAG ACTATTGTCG

251 GCGACGGTCA AACCGTTTGG CTCTACGATG TTGATTTGGC ACAAGTGACC

301 AAGTCGTCCC AAGACCAGGC CATCGGCGGC AGCCCCGCCG CCATCCTGTC

351 GAACAAAACC GCCCTCGAAA GCAGTTACAC GCTGAAAGAG GACGGTTCGT

401 CCAACGGCAT CGATTATGTG CGGGCAACGC CCAAACGCAA CAACGCCGGC

451 TACCAATACA TCCGCATCGG CTTCAAAGGC GGCAACCTCG CCGCCATGCA

501 GCTTAAAGAC AGCTTCGGCA ACCAAACCTC CATCAGTTTC GGCGGTTTGA

551 ATACCAATCC CCAACTCTCG CGCGGCGCGT TCAAGTTTAC CCCGCCCAAA

601 GGCGTGGACG TGTTGAGCAA CTGA
```

This corresponds to the amino acid sequence <SEQ ID 1344; ORF 502-1.ng>:

```
g502-1.pep
    1 MMKPHNLFQF LAVCSLTVAV ASAQAGAVDA LKQFNNDADG ISGSFTQTVQ

51 SKKKTQTAHG TFKILRPGLF KWEYTLPYRQ TIVGDGQTVW LYDVDLAQVT

101 KSSQDQAIGG SPAAILSNKT ALESSYTLKE DGSSNGIDYV RATPKRNNAG

151 YQYIRIGFKG GNLAAMQLKD SFGNQTSISF GGLNTNPQLS RGAFKFTPPK

201 GVDVLSN*
```

The following partial DNA sequence was identified in *N. meningitidis* <SEQ ID 1345>:

```
m502-1.seq
    1 ATGATGAAAC CGCACAACCT GTTCCAATTC CTCGCCGTTT GCTCCCTGAC

51 CGTCGCCGTC GCTTCCGCAC AGGCGGGCGC GGTAGACGCG CTTAAGCAAT

101 TCAACAACGA TGCCGACGGT ATCAGCGGCA GCTTCACCCA AACCGTCCAA

151 AGCAAAAAGA AACCCAAAC CGCGCACGGC ACGTTCAAAA TCCTGCGACC

201 GGGCCTTTTC AAATGGGAAT ACACCAAACC TTACAGGCAA ACCATCGTCG

251 GCGACGGTCA AACCGTTTGG CTCTACGATG TTGATCTGGC ACAAGTGACC

301 AAGTCGTCCC AAGACCAGGC CATAGGCGGC AGCCCCGCCG CCATCCTGTC
```

```
351 GAACAAAACC GCCCTCGAAA GCAGCTACAC GCTGAAAGAG GACGGTTCGT

401 CCAACGGCAT CGATTATGTG CTGGCAACGC CCAAACGCAA CAACGCCGGC

451 TACCAATACA TCCGCATCGG CTTCAAAGGC GGCAACCTCG CCGCCATGCA

501 GCTTAAAGAC AGCTTCGGCA ACCAAACCTC CATCAGTTTC GGCGGTTTGA

551 ATACCAATCC CCAACTCTCG CGCGGCGCGT TCAAGTTTAC CCCGCCCAAA

601 GGCGTGGACG TGTTGAGCAA CTGA
```

This corresponds to the amino acid sequence <SEQ ID 1346; ORF 502-1>:

```
m502-1.pep

1 MMKPHNLFQF LAVCSLTVAV ASAQAGAVDA LKQFNNDADG ISGSFTQTVQ

51 SKKKTQTAHG TFKILRPGLF KWEYTKPYRQ TIVGDGQTVW LYDVDLAQVT

101 KSSQDQAIGG SPAAILSNKT ALESSYTLKE DGSSNGIDYV LATPKRNNAG

151 YQYIRIGFKG GNLAAMQLKD SFGNQTSISF GGLNTNPQLS RGAFKFTPPK

201 GVDVLSN* m502-1/g502-1  99.0% identity in 207 aa overlap 10         20         30         40         50         60
m502-1.pep  MMKPHNLFQFLAVCSLTVAVASAQAGAVDALKQFNNDADGISGSFTQTVQSKKKTQTAHG
            ||||||||||||||||||||||||||||||||||||||||||||||||||||||||||||
g502-1      MMKPHNLFQFLAVCSLTVAVASAQAGAVDALKQFNNDADGISGSFTQTVQSKKKTQTAHG
                10         20         30         40         50         60

70         80         90        100        110        120
m502-1.pep  TFKILRPGLFKWEYTKPYRQTIVGDGQTVWLYDVDLAQVTKSSQDQAIGGSPAAILSNKT
            ||||||||||||||| |||||||||||||||||||||||||||||||||||||||||||
g502-1      TFKILRPGLFKWEYTLPYRQTIVGDGQTVWLYDVDLAQVTKSSQDQAIGGSPAAILSNKT
                70         80         90        100        110        120

130        140        150        160        170        180
m502-1.pep  ALESSYTLKEDGSSNGIDYVLATPKRNNAGYQYIRIGFKGGNLAAMQLKDSFGNQTSISF
            ||||||||||||||||||||| ||||||||||||||||||||||||||||||||||||||
g502-1      ALESSYTLKEDGSSNGIDYVRATPKRNNAGYQYIRIGFKGGNLAAMQLKDSFGNQTSISF
               130        140        150        160        170        180

190        200
m502-1.pep  GGLNTNPQLSRGAFKFTPPKGVDVLSNX
            ||||||||||||||||||||||||||||
g502-1      GGLNTNPQLSRGAFKFTPPKGVDVLSNX
               190        200
```

The following partial DNA sequence was identified in *N. meningitidis* <SEQ ID 1347>:

```
a502-1.seq
    1 ATGATGAAAC CGCACAACCT GTTCCAATTC CTCGCCGTTT GCTCCCTGAC

51 CGTCTCCGTC GCTTCCGCAC AGGCGGGCGC GGTGGACGCG CTCAAGCAAT

101 TCAACAACGA TGCCGACGGT ATCAGCGGCA GCTTCACCCA AACCGTCCAA

151 AGCAAAAAGA AACCCAAAC CGCGCACGGC ACGTTCAAAA TCCTGCGCCC

201 GGGCCTCTTT AAATGGGAAT ACACTTCGCC TTACAAACAG ACTATTGTCG

251 GCGACGGTCA AACCGTTTGG CTCTACGATG TCGATTTGGC ACAAGTGACC

301 AAGTCGTCCC AAGACCAGGC CATAGGCGGC AGCCCCGCCG CCATCCTGTC

351 GAACAAAACC GCCCTCGAAA GCAGCTACAC GCTGAAAGAG GACGGTTCGT

401 CCAACGGCAT CGATTATGTG CTGGCAACGC CCAAACGCAA CAACGCCGGC

451 TACCAATACA TCCGCATCGG CTTCAAAGGC GGCAACCTCG CCGCCATGCA

501 GCTTAAAGAC AGCTTCGGCA ATCAAACCTC CATCAGTTTC GGCGGTTTGA
```

```
551 ATACCAATCC CCAACTCTCG CGCGGCGCGT TCAAGTTTAC CCCGCCCAAA

601 GGCGTGGACG TGTTGAGCAA CTGA
```

This corresponds to the amino acid sequence <SEQ ID 1348; ORF 502-1.a>:

```
a502-1.pep

1 MMKPHNLFQF  LAVCSLTVSV  ASAQAGAVDA  LKQFNNDADG  ISGSFTQTVQ

51 SKKKTQTAHG  TFKILRPGLF  KWEYTSPYKQ  TIVGDGQTVW  LYDVDLAQVT

101 KSSQDQAIGG  SPAAILSNKT  ALESSYTLKE  DGSSNGIDYV  LATPKRNNAG

151 YQYIRIGFKG  GNLAAMQLKD  SFGNQTSISF  GGLNTNPQLS  RGAFKFTPPK

201 GVDVLSN* a502-1/m502-1   98.6% identity in 207 aa overlap 10         20         30         40         50         60
a502-1.pep      MMKPHNLFQFLAVCSLTVSVASAQAGAVDALKQFNNDADGISGSFTQTVQSKKKTQTAHG
                ||||||||||||||||||| :|||||||||||||||||||||||||||||||||||||||
m502-1          MMKPHNLFQFLAVCSLTVAVASAQAGAVDALKQFNNDADGISGSFTQTVQSKKKTQTAHG
                  10         20         30         40         50         60

70         80         90        100        110        120
a502-1.pep      TFKILRPGLFKWEYTSPYKQTIVGDGQTVWLYDVDLAQVTKSSQDQAIGGSPAAILSNKT
                ||||||||||||||||::||:||||||||||||||||||||||||||||||||||||||
m502-1          TFKILRPGLFKWEYTKPYRQTIVGDGQTVWLYDVDLAQVTKSSQDQAIGGSPAAILSNKT
                  70         80         90        100        110        120

130        140        150        160        170        180
a502-1.pep      ALESSYTLKEDGSSNGIDYVLATPKRNNAGYQYIRIGFKGGNLAAMQLKDSFGNQTSISF
                ||||||||||||||||||||||||||||||||||||||||||||||||||||||||||||
m502-1          ALESSYTLKEDGSSNGIDYVLATPKRNNAGYQYIRIGFKGGNLAAMQLKDSFGNQTSISF
                 130        140        150        160        170        180

190        200
a502-1.pep      GGLNTNPQLSRGAFKFTPPKGVDVLSNX
                ||||||||||||||||||||||||||||
m502-1          GGLNTNPQLSRGAFKFTPPKGVDVLSNX
                 190        200
```

The following partial DNA sequence was identified in *N. gonorrhoeae* <SEQ ID 1349>:

```
g503.seq
  1 atgtccgcgc cgtcggcatc ggtaatcatt ttgttccatg ccgcttcgat 51 ttcggcatcg agctgttcgg ggaagggcgt gtccaaaatc cattggcgga 101 tttctttgcc gacgcgtgcc agttcggaaa cgtcttcgac atccaatttt 151 gccagagcgg cggaaatgcg ttcgttcaga ccgttgtgtg cgagaaatgc 201 gcggtag
```

This corresponds to the amino acid sequence <SEQ ID 1350; ORF 503.ng>:

```
g503.pep
  1 MSAPSASVII  LFHAASISAS  SCSGKGVSKI  HWRISLPTRA  SSETSSTSNF

51 ARAAEMRSFR  PLCARNAR*
```

The following partial DNA sequence was identified in *N. meningitidis* <SEQ ID 1351>:

```
m503.seq
   1 atgtccgcac cgccggcatc ggcaaccatt ttgttccatg ccgcttcgat 51 ttcggcatcg agctgttcgg ggaaaggcgt atccaaaatc cattggcgga 101 tttctttgcc gacgcgtgcc agttcggcaa cgtcttcgac atccaatttt 151 gccagtgcgg cggaaatgcg ttcgctcaga ccgttgtgtg cgaggaatgc 201 gcggtag
```

This corresponds to the amino acid sequence <SEQ ID 1352; ORF 503>:

```
m503.pep
   1 MSAPPASATI LFHAASISAS SCSGKGVSKI HWRISLPTRA SSATSSTSNF

51 ASAAEMRSLR PLCARNAR*
```

Computer analysis of this amino acid sequence gave the following results:
Homology with a Predicted ORF from *N. gonorrhoeae*
ORF 503 shows 91.2% identity over a 68 aa overlap with a predicted ORF (ORF 503.ng) from *N. gonorrhoeae*:

```
    m503/g503
                    10        20        30        40        50        60
        m503.pep MSAPPASATILFHAASISASSCSGKGVSKIHWRISLPTRASSATSSTSNFASAAEMRSLR
                 ||||  ||: ||||||||||||||||||||||||||||||||| |||||||| ||||||:|
        g503     MSAPSASVIILFHAASISASSCSGKGVSKIHWRISLPTRASSETSSTSNFARAAEMRSFR
                    10        20        30        40        50        60
                        69
        m503.pep PLCARNAR
                 ||||||||
        g503     PLCARNAR
```

The following partial DNA sequence was identified in *N. meningitidis* <SEQ ID 1353>:

```
a503.seq
   1 ATGTCCGCGC CGCCGGCATC GGCAACCATT TTGTTCCATG CCGCTTCGAT

51 TTCGGCATCG AGCTGTTCGG GGAAGGGCGT GTCCAAAATC CATTGGCGGA

101 TTTCTTTGCC GACGCGTGCC AGTTCGGCAA CGTCTTCGAC ATCTAATTTT

151 GCCAGTGCGG CGGAAATGCG TTCGCTCAGA CCGTTGTGTG CGAGGAATGC

201 GCGGTAG
```

This corresponds to the amino acid sequence <SEQ ID 1354; ORF 503.a>:

```
a503.pep
   1 MSAPPASATI LFHAASISAS SCSGKGVSKI HWRISLPTRA SSATSSTSNF

51 ASAAEMRSLR PLCARNAR*
``` m503/a503 100.0% identity in 68 aa overlap

```
                    10        20        30        40        50        60
        m503.pep MSAPPASATILFHAASISASSCSGKGVSKIHWRISLPTRASSATSSTSNFASAAEMRSLR
                 ||||||||||||||||||||||||||||||||||||||||||||||||||||||||||||
        a503     MSAPPASATILFHAASISASSCSGKGVSKIHWRISLPTRASSATSSTSNFASAAEMRSLR
                    10        20        30        40        50        60
```

```
                  69
m503.pep    PLCARNARX
            |||||||||
a503        PLCARNARX
```

The following partial DNA sequence was identified in *N. gonorrhoeae* <SEQ ID 1355>:

```
g503-1.seq
   1 ATGGCGCGGT CGTTGTACAG GGAGGCGAAA ACGTGGCGCA TCGCTTTTTT

51 AACGTTATCC AAGCCATTGA TATTCAGGAA GGTTTCCTGT TGGCCGGCAA

101 ATGATGCGTC GGGCAGGTCT TCGGCGGTTG CGGAAGAGCG TACGGCAACG

151 GAAATGTCCG CGCCGTCGGC ATCGGTAATC ATTTTGTTCC ATGCCGCTTC

201 GATTTCGGCA TCGAGCTGTT CGGGGAAGGG CGTGTCCAAA ATCCATTGGC

251 GGATTTCTTT GCCGACGCGT GCCAGTTCGG AAACGTCTTC GACATCCAAT

301 TTTGCCAGAG CGGCGGAAAT GCGTTCGTTC AGACCGTTGT GTGCGAGAAA

351 TGCGCGGTAG
```

This corresponds to the amino acid sequence <SEQ ID 1356; ORF 214.ng>:

```
g503-1.pep
   1 MARSLYREAK TWRIAFLTLS KPLIFRKVSC WPANDASGRS SAVAEERTAT

51 EMSAPSASVI ILFHAASISA SSCSGKGVSK IHWRISLPTR ASSETSSTSN

101 FARAAEMRSF RPLCARNAR*
```

The following partial DNA sequence was identified in *N. meningitidis* <SEQ ID 1357>:

```
m503-1.seq
   1 ATGGCACGGT CGTTATACAG GGAAGCGAAT ACATGGTGCA TCGCTTCTTT

51 AACGTTATCC AAGCCGTTGA TGTTCAAGAA GGTTTCCTGT TGTCCAGCGA

101 ATGATGCGTC CGGCAGGTCT TCGGCAGTTG CGGAAGAACG TACGGCAACG

151 GAAATGTCCG CACCGCCGGC ATCGGCAACC ATTTTGTTCC ATGCCGCTTC

201 GATTTCGGCA TCGAGCTGTT CGGGGAAAGG CGTATCCAAA ATCCATTGGC

251 GGATTTCTTT GCCGACGCGT GCCAGTTCGG CAACGTCTTC GACATCCAAT

301 TTTGCCAGTG CGGCGGAAAT GCGTTCGCTC AGACCGTTGT GTGCGAGGAA

351 TGCGCGGTAG
```

This corresponds to the amino acid sequence <SEQ ID 1358; ORF 503-1>:

```
m503-1.pep
         1 MARSLYREAN TWCIASLTLS KPLMFKKVSC CPANDASGRS SAVAEERTAT

51 EMSAPPASAT ILFHAASISA SSCSGKGVSK IHWRISLPTR ASSATSSTSN

101 FASAAEMRSL RPLCARNAR*
```

```
g503-1 / m503-1 89.9% identity in 119 aa overlap
                    10         20         30         40         50         60
   g503-1.pep  MARSLYREAKTWRIAFLTLSKPLIFRKVSCWPANDASGRSSAVAEERTATEMSAPSASVI
               |||||||||:|| || ||||||:|:|||| |||||||||||||||||||||||||| ||:
   m503-1      MARSLYREANTWCIASLTLSKPLMFKKVSCCPANDASGRSSAVAEERTATEMSAPPASAT
                    10         20         30         40         50         60

70         80         90        100        110        120
   g503-1.pep  ILFHAASISASSCSGKGVSKIHWRISLPTRASSETSSTSNFARAAEMRSFRPLCARNARX
               |||||||||||||||||||||||||||||||||| ||||||| ||||||:||||||||||
   m503-1      ILFHAASISASSCSGKGVSKIHWRISLPTRASSATSSTSNFASAAEMRSFRPLCARNARX
                    70         80         90        100        110        120
```

The following partial DNA sequence was identified in *N. meningitidis* <SEQ ID 1359>:

```
a503-1.seq
  1 ATGGCGCGGT CGTTGTACAG GGAGGCGAAT ACATGGCGCA TCGCTTCTTT

51 AACGTTTTCC AAGCCGTTGA TATTCAGGAA GGTTTCCTGT TGGCCGGCAA

101 ATGATGCGTC GGGCAGGTCT TCGGCGGTTG CGGAAGAGCG TACGGCAACG

151 GAAATGTCCG CGCCGCCGGC ATCGGCAACC ATTTTGTTCC ATGCCGCTTC

201 GATTTCGGCA TCGAGCTGTT CGGGGAAGGG CGTGTCCAAA ATCCATTGGC

251 GGATTTCTTT GCCGACGCGT GCCAGTTCGG CAACGTCTTC GACATCTAAT

301 TTTGCCAGTG CGGCGGAAAT GCGTTCGCTC AGACCGTTGT GTGCGAGGAA

351 TGCGCGGTAG
```

This corresponds to the amino acid sequence <SEQ ID 1360; ORF 503-1.a>:

```
a503-1.pep
    1  MARSLYREAN TWRIASLTFS KPLIFRKVSC WPANDASGRS SAVAEERTAT

51  EMSAPPASAT ILFHAASISA SSCSGKGVSK IHWRISLPTR ASSATSSTSN

101  FASAAEMRSL RPLCARNAR* a501-1/m503-1 95.8% identity in 119 aa overlap
                    10         20         30         40         50         60
   a503-1.pep  MARSLYREANTWRIASLTFSKPLIFRKVSCWPANDASGRSSAVAEERTATEMSAPPASAT
               |||||||||| |||||:||||:|:|||| ||||||||||||||||||||||||||||||||
   m503-1      MARSLYREANTWCIASLTLSKPLMFKKVSCCPANDASGRSSAVAEERTATEMSAPPASAT
                    10         20         30         40         50         60

70         80         90        100        110        120
   a503-1.pep  ILFHAASISASSCSGKGVSKIHWRISLPTRASSATSSTSNFASAAEMRSLRPLCARNARX
               ||||||||||||||||||||||||||||||||||||||||||||||||||||||||||||
   m503-1      ILFHAASISASSCSGKGVSKIHWRISLPTRASSATSSTSNFASAAEMRSLRPLCARNARX
                    70         80         90        100        110        120
```

The following partial DNA sequence was identified in *N. gonorrhoeae* <SEQ ID 1361>:

```
g504.seq
  1 atgttggttc aggacttgcc ttttgaagtc aaactgaaaa aattccatat 51 cgattttac aatacgggta tgccgcgcga ttttgccagc gatattgaag 101 taacggacaa ggcaaccggt gagaaactcg agcgcaccat ccgcgtgaac 151 catcctttga ccttgcacgg catcacgatt tatcaggcga gttttgccga 201 cggcggttcg gatttgacat tcaaggcgtg gaatttgagg gatgcttcgc 251 gcgaacctgt cgtgttgaag gcaacctcca tacaccagtt tccgttggaa
```

-continued

```
 301 atcggcaaac acaaatatcg tcttgagttc gatcagttca cttctatgaa
 351 tgtggaggac atgagcgagg gtgcggaacg ggaaaaaagc ctgaaatcca
 401 ctctgaacga tgtccgcgcc gttactcagg aaggtaaaaa atacaccaat
 451 atcggccctt ccatcgtgta ccgcatccgt gatgcggcag ggcaggcggt
 501 cgaatataaa aactatatgc tgccgatttt gcaggacaaa gattattttt
 551 ggctgaccgg cacgcgcagc ggcttgcagc agcaataccg ctggctgcgt
 601 atccccttgg acaagcagtt gaaagcggac acctttatgg cattgcgtga
 651 gttttttgaaa gatggggaag ggcgcaaacg tctggttgcc gacgcaacca
 701 aagacgcacc tgccgaaatc cgcgaacaat tcatgctggc tgcggaaaac
 751 acgctgaata tctttgcgca aaaaggctat ttgggattgg acgaatttat
 801 tacgtccaat atcccgaaag ggcagcagga taagatgcag ggctatttct
 851 acgaaatgct ttacggcgtg atgaacgctg cttttggatga aaccatacgc
 901 cggtacggct tgcccgaatg gcagcaggat gaagcgcgga accgtttcct
 951 gctgcacagt atggatgcct atacggggct gacggaatat cccgcgccta
1001 tgctgctcca gcttgacggg ttttccgagg tgcgttcctc aggtttgcag
1051 atgacccgtt cgccgggtgc gcttttggtc tatctcggct cggtattgtt
1101 ggttttgggt acagtattta tgttttatgt gcccaaaaaa cgggcgtggg
1151 tattgttttc aaacdgcaaa atccgttttg ctatgtcttc ggcccgcagc
1201 gaacgggatt tgcagaagga atttccaaaa cacgtcgaga gcctgcaacg
1251 gctcggcaag gacttgaatc atgactga
```

This corresponds to the amino acid sequence <SEQ ID 1362; ORF 504.ng>:

```
g504.pep
  1 MLVQDLPFEV KLKKFHIDFY NTGMPRDFAS DIEVTDKATG EKLERTIRVN
 51 HPLTLHGITI YQASFADGGS DLTFKAWNLR DASREPVVLK ATSIHQFPLE
101 IGKHKYRLEF DQFTSMNVED MSEGAEREKS LKSTLNDVRA VTQEGKKYTN
151 IGPSIVYRIR DAAGQAVEYK NYMLPILQDK DYFWLTGTRS GLQQQYRWLR
201 IPLDKQLKAD TFMALREFLK DGEGRKRLVA DATKDAPAEI REQFMLAAEN
251 TLNIFAQKGY LGLDEFITSN IPKGQQDKMQ GYFYEMLYGV MNAALDETIR
301 RYGLPEWQQD EARNRFLLHS MDAYTGLTEY PAPMLLQLDG FSEVRSSGLQ
351 MTRSPGALLV YLGSVLLVLG TVFMFYVPKK RAWVLFSNKI RFAMSSARSE
401 RDLQKEFPKH VESLQRLGKD LNHD*
```

The following partial DNA sequence was identified in N. meningitidis <SEQ ID 1363>:

```
m504.seq..
  1 atattggttc aggacttgcc ttttgaagtc aaactgaaaa aattccatat
 51 cgatttttac aatacgggta tgccgcgtga tttcgccagc gatattgaag
101 tgacggacaa ggcaaccggt gagaaactcg agcgcaccat ccgcgtgaac
151 catcctttga ccttgcacgg catcacgatt tatcaggcga gttttgccga
201 cggcggttcg gatttgacat tcaaggcgtg gaatttgggt gatgcttcgc
```

```
 251 gcgagcctgt cgtgttgaag gcaacatcca tacaccagtt tccgttggaa
 301 attggcaaac acaaatatcg tcttgagttc gatcagttca cttctatgaa
 351 tgtggaggac atgagcgagg gcgcggaacg ggaaaaaagc ctgaaatcca
 401 cgctgmmcga tgtccgcgcc gttactcagg aaggtaaaaa atacaccaat
 451 atcggccctt ccattgttta ccgtatccgt gatgcggcag ggcaggcggt
 501 cgaatataaa aactatatgc tgccggtttt gcaggaacag gattattttt
 551 ggattaccgg cacgcgcagc ggcttgcagc agcaataccg ctggctgcgt
 601 atccccttgg acaagcagtt gaaagcggac acctttatgg cattgcgtga
 651 gtttttgaaa gatggggaag ggcgcaaacg tctggttgcc gacgcaacca
 701 aaggcgcacc tgccgaaatc cgcgaacaat tcatgctggc tgcggaaaac
 751 acgctgaaca tctttgcaca aaaaggctat ttgggattgg acgaatttat
 801 tacgtccaat atcccgaaag agcagcagga taagatgcag ggctatttct
 851 acgaaatgct ttacggcgtg atgaacgctg ctttggatga aaccatacgc
 901 cggtacggct tgcccgaatg gcagcaggat gaagcgcgga atcgtttcct
 951 gctgcacagt atggatgcgt acacgggttt gaccgaatat cccgcgccta
1001 tgctgctgca acttgatggg ttttccgagg tgcgttcgtc gggtttgcag
1051 atgacccgtt ccccgggtgc gcttttggtc tatctcggct cggtgctgtt
1101 ggtattgggt acggtattga tgttttatgt gcgcgaaaaa cgggcgtggg
1151 tattgttttc agacggcaaa atccgttttg ccatgtcttc ggcccgcagc
1201 gaacgggatt tgcagaagga atttccaaaa cacgtcgaga gtctgcaacg
1251 gctcggcaag gacttgaatc atga
```

This corresponds to the amino acid sequence <SEQ ID 1364; ORF 504>:

```
m504.pep..
  1 ILVQDLPFEV KLKKFHIDFY NTGMPRDFAS DIEVTDKATG EKLERTIRVN

51 HPLTLHGITI YQASFADGGS DLTFKAWNLG DASREPVVLK ATSIHQFPLE

101 IGKHKYRLEF DQFTSMNVED MSEGAEREKS LKSTLXDVRA VTQEGKKYTN

151 IGPSIVYRIR DAAGQAVEYK NYMLPVLQEQ DYFWITGTRS GLQQQYRWLR

201 IPLDKQLKAD TFMALREFLK DGEGRKRLVA DATKGAPAEI REQFMLAAEN

251 TLNIFAQKGY LGLDEFITSN IPKEQQDKMQ GYFYEMLYGV MNAALDETIR

301 RYGLPEWQQD EARNRFLLHS MDAYTGLTEY PAPMLLQLDG FSEVRSSGLQ

351 MTRSPGALLV YLGSVLLVLG TVLMFYVREK RAWVLFSDGK IRFAMSSARS

401 ERDLQKEFPK HVESLQRLGK DLNHD*
```

Computer analysis of this amino acid sequence gave the following results:

Homology with a Predicted ORF from *N. gonorrhoeae*

ORF 504 shows 96.7% identity over a 425 aa overlap with a predicted ORF (ORF 504.ng) from *N. gonorrhoeae*:

```
m504/g504
                    10        20        30        40        50        60
    m504.pep    ILVQDLPFEVKLKKFHIDFYNTGMPRDFASDIEVTDKATGEKLERTIRVNHPLTLHGITI
                :|||||||||||||||||||||||||||||||||||||||||||||||||||||||||||
        g504    MLVQDLPFEVKLKKFHIDFYNTGMPRDFASDIEVTDKATGEKLERTIRVNHPLTLHGITI
                    10        20        30        40        50        60

70        80        90       100       110       120
    m504.pep    YQASFADGGSDLTFKAWNLGDASREPVVLKATSIHQFPLEIGKHKYRLEFDQFTSMNVED
                ||||||||||||||||||| ||||||||||||||||||||||||||||||||||||||||
        g504    YQASFADGGSDLTFKAWNLRDASREPVVLKATSIHQFPLEIGKHKYRLEFDQFTSMNVED
                    70        80        90       100       110       120

130       140       150       160       170       180
    m504.pep    MSEGAEREKSLKSTLXDVRAVTQEGKKYTNIGPSIVYRIRDAAGQAVEYKNYMLPVLQEQ
                ||||||||||||||| ||||||||||||||||||||||||||||||||||||||:||::
        g504    MSEGAEREKSLKSTLNDVRAVTQEGKKYTNIGPSIVYRIRDAAGQAVEYKNYMLPILQDK
                   130       140       150       160       170       180

190       200       210       220       230       240
    m504.pep    DYFWITGTRSGLQQQYRWLRIPLDKQLKADTFMALREFLKDGEGRKRLVADATKGAPAEI
                ||||:|||||||||||||||||||||||||||||||||||||||||||||||||| ||||
        g504    DYFWLTGTRSGLQQQYRWLRIPLDKQLKADTFMALREFLKDGEGRKRLVADATKDAPAEI
                   190       200       210       220       230       240

250       260       270       280       290       300
    m504.pep    REQFMLAAENTLNIFAQKGYLGLDEFITSNIPKEQQDKMQGYFYEMLYGVMNAALDETIR
                |||||||||||||||||||||||||||||||||| |||||||||||||||||||||||||
        g504    REQFMLAAENTLNIFAQKGYLGLDEFITSNIPKGQQDKMQGYFYEMLYGVMNAALDETIR
                   250       260       270       280       290       300

310       320       330       340       350       360
    m504.pep    RYGLPEWQQDEARNRFLLHSMDAYTGLTEYPAPMLLQLDGFSEVRSSGLQMTRSPGALLV
                ||||||||||||||||||||||||||||||||||||||||||||||||||||||||||||
        g504    RYGLPEWQQDEARNRFLLHSMDAYTGLTEYPAPMLLQLDGFSEVRSSGLQMTRSPGALLV
                   310       320       330       340       350       360

370       380       390       400       410       420
    m504.pep    YLGSVLLVLGTVLMFYVREKRAWVLFSDGKIRFAMSSARSERDLQKEFPKHVESLQRLGK
                |||||||||||:||||  :||||||||: |||||||||||||||||||||||||||||||
        g504    YLGSVLLVLGTVFMFYVPKKRAWVLFSN-KIRFAMSSARSERDLQKEFPKHVESLQRLGK
                   370       380       390       400       410 m504.pep    DLNHD
                |||||
        g504    DLNHD
                   420
```

The following partial DNA sequence was identified in *N. meningitidis* <SEQ ID 1365>:

```
a504.seq
   1  ATATTGGTTC AGGACTTGCC TTTTGAAGTC AAACTGAAAA AATTCCATAT

51  CGATTTTTAC AATACGGGTA TGCCGCGCGA TTTTGCCAGT GATATTGAAG

101  TAACGGATAA GGCAACCGGT GAGAAACTCG AGCGCACCAT CCGCGTGAAC

151  CATCCTTTGA CCTTGCACGG CATCACGATT TATCAGGCGA GTTTTGCCGA

201  CGGCGGTTCG GATTTGACAT TCAAGGCGTG GAATTTGGGT GATGCTTCGC

251  GCGAGCCTGT CGTGTTGAAG GCAACATCCA TACACCAGTT TCCGTTGGAA

301  ATTGGCAAAC ACAAATATCG TCTTGAGTTC GATCAGTTTA CTTCTATGAA

351  TGTGGAGGAC ATGAGCGAGG GCGCGGAACG GGAAAAAAGC CTGAAATCCA

401  CGCTGAACGA TGTCCGCGCC GTTACTCAGG AAGGTAAAAA ATACACCAAT

451  ATCGGCCCTT CCATTGTTTA CCGTATCCGT GATGCGGCAG GGCAGGCGGT
```

-continued

```
 501  CGAATATAAA AACTATATGC TGCCGGTTTT GCAGGAACAG GATTATTTTT

551  GGATTACCGG CACGCGCAGC GGCTTGCAGC AGCAATACCG CTGGCTGCGT

601  ATCCCCTTGG ACAAGCAGTT GAAAGCGGAC ACCTTTATGG CATTGCGTGA

651  GTTTTTGAAA GATGGGGAAG GGCGCAAACG TCTGGTTGCC GACGCAACCA

701  AAGGCGCACC TGCCGAAATC CGCGAACAAT TCATGCTGGC TGCGGAAAAC

751  ACGCTGAACA TCTTTGCACA AAAAGGCTAT TTGGGATTGG ACGAATTTAT

801  TACGTCCAAT ATCCCGAAAG AGCAGCAGGA TAAGATGCAG GGCTATTTCT

851  ACGAAATGCT TTACGGCGTG ATGAACGCTG CTTTGGATGA AACCATACGC

901  CGGTACGGCT TGCCCGAATG GCAGCAGGAT GAAGCGCGGA ATCGTTTCCT

951  GCTGCACAGT ATGGATGCGT ACACGGGTTT GACCGAATAT CCCGCGCCTA

1001  TGCTGCTGCA ACTTGATGGG TTTTCCGAGG TGCGTTCGTC GGGTTTGCAG

1051  ATGACCCGTT CCCCGGGTGC GCTTTTGGTC TATCTCGGCT CGGTGCTGTT

1101  GGTATTGGGT ACGGTATTGA TGTTTTATGT GCGCGAAAAA CGGGCGTGGG

1151  TATTGTTTTC AGACGGCAAA ATCCGTTTTG CCATGTCTTC GGCTTGCAGC

1201  GAACGGGATT TGCAGAAGGA ATTTCCAAAA CACGTCGAGA GTCTGCAACG

1251  GCTCGGCAAG GACTTGAATC ATGACTGA
```

This corresponds to the amino acid sequence <SEQ ID 1366; ORF 504.a>:

```
a504.pep
  1 ILVQDLPFEV KLKKFHIDFY NTGMPRDFAS DIEVTDKATG EKLERTIRVN

51 HPLTLHGITI YQASFADGGS DLTFKAWNLG DASREPVVLK ATSIHQFPLE

101 IGKHKYRLEF DQFTSMNVED MSEGAEREKS LKSTLNDVRA VTQEGKKYTN

151 IGPSIVYRIR DAAGQAVEYK NYMLPVLQEQ DYFWITGTRS GLQQQYRWLR

201 IPLDKQLKAD TFMALREFLK DGEGRKRLVA DATKGAPAEI REQFMLAAEN

251 TLNIFAQKGY LGLDEFITSN IPKEQQDKMQ GYFYEMLYGV MNAALDETIR

301 RYGLPEWQQD EARNRFLLHS MDAYTGLTEY PAPMLLQLDG FSEVRSSGLQ

351 MTRSPGALLV YLGSVLLVLG TVLMFYVREK RAWVLFSDGK IRFAMSSARS

401 ERDLQKEFPK HVESLQRLGK DLNHD*
```

50
m504/a504 99.8% identity in 425 aa overlap

```
                  10         20         30         40         50         60
    m504.pep  ILVQDLPFEVKLKKFHIDFYNTGMPRDFASDIEVTDKATGEKLERTIRVNHPLTLHGITI
              |||||||||||||||||||||||||||||||||||||||||||||||||||
    a504          ILVQDLPFEVKLKKFHIDFYNTGMPRDFASDIEVTDKATGEKLERTIRVNHPLTLHGITI
                      10         20         30         40         50         60

70         80         90        100        110        120
    m504.pep  YQASFADGGSDLTFKAWNLGDASREPVVLKATSIHQFPLEIGKHKYRLEFDQFTSMNVED
              ||||||||||||||||||||||||||||||||||||||||||||||||||||||||||||
    a504      YQASFADGGSDLTFKAWNLGDASREPVVLKATSIHQFPLEIGKHKYRLEFDQFTSMNVED
                  70         80         90        100        110        120

130        140        150        160        170        180
    m504.pep  MSEGAEREKSLKSTLXDVRAVTQEGKKYTNIGPSIVYRIRDAAGQAVEYKNYMLPVLQEQ
              |||||||||||||||| |||||||||||||||||||||||||||||||||||||||||||
    a504      MSEGAEREKSLKSTLNDVRAVTQEGKKYTNIGPSIVYRIRDAAGQAVEYKNYMLPVLQEQ
                 130        140        150        160        170        180
```

```
                  190        200        210        220        230        240
m504.pep  DYFWITGTRSGLQQQYRWLRIPLDKQLKADTFMALREFLKDGEGRKRLVADATKGAPAEI
          ||||||||||||||||||||||||||||||||||||||||||||||||||||||||||||
a504      DYFWITGTRSGLQQQYRWLRIPLDKQLKADTFMALREFLKDGEGRKRLVADATKGAPAEI
                  190        200        210        220        230        240

250        260        270        280        290        300
m504.pep  REQFMLAAENTLNIFAQKGYLGLDEFITSNIPKEQQDKMQGYFYEMLYGVMNAALDETIR
          ||||||||||||||||||||||||||||||||||||||||||||||||||||||||||||
a504      REQFMLAAENTLNIFAQKGYLGLDEFITSNIPKEQQDKMQGYFYEMLYGVMNAALDETIR
                  250        260        270        280        290        300

310        320        330        340        350        360
m504.pep  RYGLPEWQQDEARNRFLLHSMDAYTGLTEYPAPMLLQLDGFSEVRSSGLQMTRSPGALLV
          ||||||||||||||||||||||||||||||||||||||||||||||||||||||||||||
a504      RYGLPEWQQDEARNRFLLHSMDAYTGLTEYPAPMLLQLDGFSEVRSSGLQMTRSPGALLV
                  310        320        330        340        350        360

370        380        390        400        410        420
m504.pep  YLGSVLLVLGTVLMFYVREKRAWVLFSDGKIRFAMSSARSERDLQKEFPKHVESLQRLGK
          ||||||||||||||||||||||||||||||||||||||||||||||||||||||||||||
a504      YLGSVLLVLGTVLMFYVREKRAWVLFSDGKIRFAMSSARSERDLQKEFPKHVESLQRLGK
                  370        380        390        400        410        420 m504.pep  DLNHDX
          ||||||
a504      DLNHDX
```

The following partial DNA sequence was identified in *N. gonorrhoeae* <SEQ ID 1367>:

```
g505.seq
   1 atgtttcgtt tacaattcag gctgtttccc cctttgcgaa ccgccatgca 51 catcctgttg accgccctgc tcaaatgcct ctccctgctg tcgctttcct 101 gtctgcacac gctgggaaac cggctcggac atctggcgtt ttaccttta 151 aaggaagacc gcgcgcgcat cgtcgccaat atgcggcagg cgggtttgaa 201 ccccgacacg cagacggtca aagccgtttt tgcggaaacg gcaaaatgcg 251 gtttggaact tgcccccgcg tttttcaaaa accggaagaa catcgaaaca 301 atgttcaaag cggtacacgg ctgggaacac gtgcagcagg ctttggacaa 351 gggcgaaggg ctgctgttca tcacgccgca tcggcagc tacgatttgg 401 gcggacgcta tcagccag cagcttccgt tccacctgac cgccatgtac 451 aagccgccga aaatcaaagc gatagacaaa atcatgcagg cgggcagggt 501 gcgcggcaaa ggcaaaaccg cgcccaccgg catacaaggg gtcaaacaaa 551 tcatcaaggc cctgcgcgcg ggcgaggcaa ccatcatcct gcccgaccac 601 gtccttctc cgcaggaagg cggcggcgtg tgggcggatt ttttcggcaa 651 acctgcatac accatgacac tggcggcaaa attggcacac gtcaaaggcg 701 tgaaaaccct gttttctgc tgcgaacgcc tgcccgacgg acaaggcttc 751 gtgttgcaca tccgccccgt ccaaggggaa ttgaacggca acaaagccca 801 cgatgccgcc gtgttcaacc gcaataccga atattggata cgccgttttc 851 cgacgcagta tctgtttatg tacaaccgct ataaaacgcc gtaa
```

This corresponds to the amino acid sequence <SEQ ID 1368; ORF 505.ng>:

```
g505.pep
   1 MFRLQFRLFP PLRTAMHILL TALLKCLSLL SLSCLHTLGN RLGHLAFYLL

51 KEDRARIVAN MRQAGLNPDT QTVKAVFAET AKCGLELAPA FFKKPEDIET

101 MFKAVHGWEH VQQALDKGEG LLFITPHIGS YDLGGRYISQ QLPFHLTAMY

151 KPPKIKAIDK IMQAGRVRGK GKTAPTGIQG VKQIIKALRA GEATIILPDH
```

-continued
```
201 VPSPQEGGGV WADFFGKPAY TMTLAAKLAH VKGVKTLFFC CERLPDGQGF

251 VLHIRPVQGE LNGNKAHDAA VFNRNTEYWI RRFPTQYLFM YNRYKTP*
```

The following partial DNA sequence was identified in *N. meningitidis* <SEQ ID 1369>:

```
m505.seq (partial)
  1 GGCATGTTTC GTTTACAATT CAGGCTGTTT CCCCCTTTGC GAACCGCCAT

51 GCACATCCTG TTGACCGCCC TGCTCAAATG CCTCTCCCTG CTGCCGCTTT

101 CCTGTCTGCA CACGCTGGGA AACCGGCTCG GACATCTGGC GTTTTACCTT

151 TTAAAGGAAG ACCGCGCGCG CATCGTCGCC AATATGCGGC AGGCGGGTTT

201 GAACCCCGAC CCCAAAACGG TCAAAGCCGT TTTTGCGGAA ACGGCAAAAG

251 GCGGTTTGGA ACTTGCCCCC GCGTTTTTCA GAAAACCGGA AGACATAGAA

301 ACAATGTTCA AAGCGGTACA CGGCTGGGAA CATGTGCAGC AGGCTTTGGA

351 CAAACACGAA GGGCTGCTAT TCATCACGCC GCACATCGGC AGCTACGATT

401 TGGGCGGACG CTACATCAGC CAGCAGCTTC CGTTCCCGCT GACCGCCATG

451 TACAAACCGC CGAAAATCAA AGCGATAGAC AAAATCATGC AGGCGGGCAG

501 GGTTCGCGGC AAAGGAAAAA CCGCGCCTAC CAGCATACAA GGGGTCAAAC

551 AAATCATCAA AGCCCTGCGT TCGGGCGAgC AACCATCGTC CTGCCCGACC

601 ACGTCCCCTC CCCTCAAGAA GGCGGGGAAG GCGTATGGGT GGATTTCTTC

651 GGCAAACCTG CCTATACCAT GACGCTGGCG GCAArATTGG CACACGTCAA

701 AGGCGTGAAA ACCCTGTTTT TCTGCTGCGA ACGCCTGCCT GGCGGACAAG

751 GTTTCGATTT GCACATCCGC CCCGTCCAAG GGGAATTGAA CGGCGACAAA

801 GCCCATGATG CCGCCGTGTT CAACCGCAAT GCCGAATATT GGATACGCCG

851 TTTTCCGACG CAtATC....
```

This corresponds to the amino acid sequence <SEQ ID 1370; ORF 505>:

```
m505.pep (partial)
  1 MFRLQFRLFP PLRTAMHILL TALLKCLSLL PLSCLHTLGN RLGHLAFYLL

51 KEDRARIVAN MRQAGLNPDP KTVKAVFAET AKGGLELAPA FFRKPEDIET

101 MFKAVHGWEH VQQALDKHEG LLFITPHIGS YDLGGRYISQ QLPFPLTAMY

151 KPPKIKAIDK IMQAGRVRGK GKTAPTSIQG VKQIIKALRS GEATIVLPDH

201 VPSPQEGGEG VWVDFFGKPA YTMTLAAXLA HVKGVKTLFF CCERLPGGQG

251 FDLHIRPVQG ELNGDKAHDA AVFNRNAEYW IRRFPTHI...
```

Computer analysis of this amino acid sequence gave the following results:
Homology with a Predicted ORF from *N. gonorrhoeae*
ORF 505 shows 93.7% identity over a 287 aa overlap with a predicted ORF (ORF 505.ng) from *N. gonorrhoeae*:

```
m505/g505

10         20         30         40         50         60
         m505.pep    MFRLQFRLFPPLRTAMHILLTALLKCLSLLPLSCLHTLGNRLGHLAFYLLKEDRARIVAN
                     |||||||||||||||||||||||||||||| |||||||||||||||||||||||||||||
         g505        MFRLQFRLFPPLRTAMHILLTALLKCLSLLSLSCLHTLGNRLGHLAFYLLKEDRARIVAN
                          10         20         30         40         50         60
```

-continued

```
                70         80         90        100        110        120
   m505.pep  MRQAGLNPDPKTVKAVFAETAKGGLELAPAFFRKPEDIETMFKAVHGWEHVQQALDKHEG
              ||||||||:||||||||||| ||||||||||:|||||||||||||||||||||||||| ||
       g505  MRQAGLNPDTQTVKAVFAETAKCGLELAPAFFKKPEDIETMFKAVHGWEHVQQALDKGEG
                70         80         90        100        110        120

130        140        150        160        170        180
   m505.pep  LLFITPHIGSYDLGGRYISQQLPFPLTAMYKPPKIKAIDKIMQAGRVRGKGKTAPTSIQG
              ||||||||||||||||||||||||||| ||||||||||||||||||||||||||||:|||
       g505  LLFITPHIGSYDLGGRYISQQLPFHLTAMYKPPKIKAIDKIMQAGRVRGKGKTAPTGIQG
               130        140        150        160        170        180

190        200        210        220        230        240
   m505.pep  VKQIIKALRSGEATIVLPDHVPSPQEGGEGVWVDFFGKPAYTMTLAAXLAHVKGVKTLFF
              |||||||||:|||||:||||||||||||| |||:|||||||||||||||| |||||||||
       g505  VKQIIKALRAGEATIILPDHVPSPQEGG-GVWADFFGKPAYTMTLAAKLAHVKGVKTLFF
               190        200        210        220        230

250        260        270        280        289
   m505.pep  CCERLPGGQGFDLHIRPVQGELNGDKAHDAAVFNRNAEYWIRRFPTHI
              ||||||  ||||  |||||||||||||:|||||||||||:|||||||:
       g505  CCERLPDGQGFVLHIRPVQGELNGNKAHDAAVFNRNTEYWIRRFPTQYLFMYNRYKTP
               240        250        260        270        280        290
```

The following partial DNA sequence was identified in N. meningitidis <SEQ ID 1371>:

```
a505.seq
   1 ATGTTTCGTT TACAATTCAG GCTGTTTCCC CCTTTGCGAA CCGCCATGCA

51 CATCCTGTTG ACCGCCCTGC TCAAATGCCT CTCCCTGCTG CCGCTTTCCT

101 GTCTGCACAC GCTGGGAAAC CGGCTCGGAC ATCTGGCGTT TTACCTTTTA

151 AAGGAAGACC GCGCGCGCAT CGTCGCCAAT ATGCGTCAGG CAGGCATGAA

201 TCCCGACCCC AAAACGGTCA AGCCGTTTTT GCGGAAACG GCAAAAGGCG

251 GTTTGGAACT TGCCCCCGCG TTTTTCAGAA AACCGGAAGA CATAGAAACA

301 ATGTTCAAAG CGGTACACGG CTGGGAACAT GTGCAGCAGG CTTTGGACAA

351 ACACGAAGGG CTGCTATTCA TCACGCCGCA CATCGGCAGC TACGATTTGG

401 GCGGACGCTA CATCAGCCAG CAGCTTCCGT TCCCGCTGAC CGCCATGTAC

451 AAACCGCCGA AAATCAAAGC GATAGACAAA ATCATGCAGG CGGGCAGGGT

501 TCGCGGCAAA GGAAAAACCG CGCCTACCAG CATACAAGGG GTCAAACAAA

551 TCATCAAAGC CCTGCGTTCG GGCGAAGCAA CCATCGTCCT GCCCGACCAC

601 GTCCCCTCCC CTCAAGAAGG CGGGGAAGGC GTATGGGTGG ATTTCTTCGG

651 CAAACCTGCC TATACCATGA CGCTGGCGGC AAAATTGGCA CACGTCAAAG

701 GCGTGAAAAC CCTGTTTTTC TGCTGCGAAC GCCTGCCTGG CGGACAAGGT

751 TTCGATTTGC ACATCCGCCC CGTCCAAGGG GAATTGAACG GCGACAAAGC

801 CCATGATGCC GCCGTGTTCA ACCGCAATGC CGAATATTGG ATACGCCGTT

851 TTCCGACGCA GTATCTGTTT ATGTACAACC GCTACAAAAT GCCGTAA
```

This corresponds to the amino acid sequence <SEQ ID 1372; ORF 505.a>:

```
a505.pep
   1 MFRLQFRLFP PLRTAMHILL TALLKCLSLL PLSCLHTLGN RLGHLAFYLL

51 KEDRARIVAN MRQAGMNPDP KTVKAVFAET AKGGLELAPA FFRKPEDIET

101 MFKAVHGWEH VQQALDKHEG LLFITPHIGS YDLGGRYISQ QLPFPLTAMY

151 KPPKIKAIDK IMQAGRVRGK GKTAPTSIQG VKQIIKALRS GEATIVLPDH
```

-continued

```
801 CCATGATGCC GCCGTGTTCA ACCGCAATGC CGAATATTGG ATACGCCGTT

201 VPSPQEGGEG VWVDFFGKPA YTMTLAAKLA HVKGVKTLFF CCERLPGGQG

251 FDLHIRPVQG ELNGDKAHDA AVFNRNAEYW IRRFPTQYLF MYNRYKMP*
``` m505/a505 99.0% identity in 287 aa overlap

```
                      10        20        30        40        50        60
m505.pep      MFRLQFRLFPPLRTAMHILLTALLKCLSLLPLSCLHTLGNRLGHLAFYLLKEDRARIVAN
              ||||||||||||||||||||||||||||||||||||||||||||||||||||||||||||
a505          MFRLQFRLFPPLRTAMHILLTALLKCLSLLPLSCLHTLGNRLGHLAFYLLKEDRARIVAN
                      10        20        30        40        50        60

70        80        90       100       110       120
m505.pep      MRQAGLNPDPKTVKAVFAETAKGGLELAPAFFRKPEDIETMFKAVHGWEHVQQALDKHEG
              |||||:||||||||||||||||||||||||||||||||||||||||||||||||||||||
a505          MRQAGMNPDPKTVKAVFAETAKGGLELAPAFFRKPEDIETMFKAVHGWEHVQQALDKHEG
                      70        80        90       100       110       120

130       140       150       160       170       180
m505.pep      LLFITPHIGSYDLGGRYISQQLPFPLTAMYKPPKIKAIDKIMQAGRVRGKGKTAPTSIQG
              ||||||||||||||||||||||||||||||||||||||||||||||||||||||||||||
a505          LLFITPHIGSYDLGGRYISQQLPFPLTAMYKPPKIKAIDKIMQAGRVRGKGKTAPTSIQG
                     130       140       150       160       170       180

190       200       210       220       230       240
m505.pep      VKQIIKALRSGEATIVLPDHVPSPQEGGEGVWVDFFGKPAYTMTLAAXLAHVKGVKTLFF
              |||||||||||||||||||||||||||||||||||||||||||||| |||||||||||||
a505          VKQIIKALRSGEATIVLPDHVPSPQEGGEGVWVDFFGKPAYTMTLAAKLAHVKGVKTLFF
                     190       200       210       220       230       240

250       260       270       280
m505.pep      CCERLPGGQGFDLHIRPVQGELNGDKAHDAAVFNRNAEYWIRRFPTHI
              ||||||||||||||||||||||||||||||||||||||||||||||:
a505          CCERLPGGQGFDLHIRPVQGELNGDKAHDAAVFNRNAEYWIRRFPTQYLFMYNRYKMPX
                     250       260       270       280       290
```

The following partial DNA sequence was identified in *N. meningitidis* <SEQ ID 1373>:

```
m505-1.seq
  1 ATGTTTCGTT TACAATTCAG GCTGTTTCCC CCTTTGCGAA CCGCCATGCA

51 CATCCTGTTG ACCGCCCTGC TCAAATGCCT CTCCCTGCTG CCGCTTTCCT

101 GTCTGCACAC GCTGGGAAAC CGGCTCGGAC ATCTGGCGTT TTACCTTTTA

151 AAGGAAGACC GCGCGCGCAT CGTCGCCAAT ATGCGGCAGG CGGGTTTGAA

201 CCCCGACCCC AAAACGGTCA AAGCCGTTTT TGCGGAAACG GCAAAAGGCG

251 GTTTGGAACT TGCCCCCGCG TTTTTCAGAA AACCGGAAGA CATAGAAACA

301 ATGTTCAAAG CGGTACACGG CTGGGAACAT GTGCAGCAGG CTTTGGACAA

351 ACACGAAGGG CTGCTATTCA TCACGCCGCA CATCGGCAGC TACGATTTGG

401 GCGGACGCTA CATCAGCCAG CAGCTTCCGT TCCCGCTGAC CGCCATGTAC

451 AAACCGCCGA AAATCAAAGC GATAGACAAA ATCATGCAGG CGGGCAGGGT

501 TCGCGGCAAA GGAAAAACCG CGCCTACCAG CATACAAGGG GTCAAACAAA

551 TCATCAAAGC CCTGCGTTCG GGCGAAGCAA CCATCGTCCT GCCCGACCAC

601 GTCCCCTCCC CTCAAGAAGG CGGGGAAGGC GTATGGGTGG ATTTCTTCGG

651 CAAACCTGCC TATACCATGA CGCTGGCGGC AAAATTGGCA CACGTCAAAG

701 GCGTGAAAAC CCTGTTTTTC TGCTGCGAAC GCCTGCCTGG CGGACAAGGT
```

```
751 TTCGATTTGC ACATCCGCCC CGTCAAGGG GAATTGAACG GCGACAAAGC

851 TTCCGACGCA GTATCTGTTT ATGTACAACC GCTACAAAAT GCCGTAA
```

This corresponds to the amino acid sequence <SEQ ID
1374; ORF 505-1>:

```
m505-1.pep

1  MFRLQFRLFP PLRTAMHILL TALLKCLSLL PLSCLHTLGN RLGHLAFYLL

51  KEDRARIVAN MRQAGLNPDP KTVKAVFAET AKGGLELAPA FFRKPEDIET

101  MFKAVHGWEH VQQALDKHEG LLFITPHIGS YDLGGRYISQ QLPFPLTAMY

151  KPPKIKAIDK IMQAGRVRGK GKTAPTSIQG VKQIIKALRS GEATIVLPDH

201  VPSPQEGGEG VWVDFFGKPA YTMTLAAKLA HVKGVKTLFF CCERLPGGQG

251  FDLHIRPVQG ELNGDKAHDA AVFNRNAEYW IRRFPTQYLF MYNRYKMP* m505-1/g505    94.3% identity in 298 aa overlap 10         20         30         40         50         60
m505-1.pep   MFRLQFRLFPPLRTAMHILLTALLKCLSLLPLSCHTLGNRLGHLAFYLLKEDRARIVAN
             ||||||||||||||||||||||||||||||| ||||||||||||||||||||||||||
g505         MFRLQFRLFPPLRTAMHILLTALLKCLSLLSLSCHTLGNRLGHLAFYLLKEDRARIVAN
                    10         20         30         40         50         60

70         80         90        100        110        120
m505-1.pep   MRQAGLNPDPKTVKAVFAETAKGGLELAPAFFRKPEDIETMFKAVHGWEHVQQALDKHEG
             ||||||||| :||||||||||||| ||||||||:|||||||||||||||||||||| ||
g505         MRQAGLNPDTQTVKAVFAETAKCGLELAPAFFKKPEDIETMFKAVHGWEHVQQALDKGEG
                    70         80         90        100        110        120

130        140        150        160        170        180
m505-1.pep   LLFITPHIGSYDLGGRYISQQLPFPLTAMYKPPKIKAIDKIMQAGRVRGKGKTAPTSIQG
             |||||||||||||||||||||||| |||||||||||||||||||||||||||||||:|||
g505         LLFITPHIGSYDLGGRYISQQLPFHLTAMYKPPKIKAIDKIMQAGRVRGKGKTAPTGIQG
                   130        140        150        160        170        180

190        200        210        220        230        240
m505-1.pep   VKQIIKALRSGEATIVLPDHVPSPQEGGEGVWVDFFGKPAYTMTLAAKLAHVKGVKTLFF
             ||||||||| :||||:|||||||||||| ||| :||||||||||||||||||||||||
g505         VKQIIKALRAGEATIILPDHVPSPQEGG-GVWADFFGKPAYTMTLAAKLAHVKGVKTLFF
                   190        200        210        220        230

250        260        270        280        290    299
m505-1.pep   CCERLPGGQGFDLHIRPVQGELNGDKAHDAAVFNRNAEYWIRRFPTQYLFMYNRYKMPX
             |||||| |||| ||||||||||||| :||||||||||:||||||||||||||||| ||
g505         CCERLPDGQGFVLHIRPVQGELNGNKAHDAAVFNRNTEYWIRRFPTQYLFMYNRYKTPX
                  240        250        260        270        280        290 m505-1/a505    99.7% identity in 298 aa overlap 10         20         30         40         50         60
m505-1.pep   MFRLQFRLFPPLRTAMHILLTALLKCLSLLPLSCHTLGNRLGHLAFYLLKEDRARIVAN
             ||||||||||||||||||||||||||||||||||||||||||||||||||||||||||
a505         MFRLQFRLFPPLRTAMHILLTALLKCLSLLPLSCHTLGNRLGHLAFYLLKEDRARIVAN
                    10         20         30         40         50         60

70         80         90        100        110        120
m505-1.pep   MRQAGLNPDPKTVKAVFAETAKGGLELAPAFFRKPEDIETMFKAVHGWEHVQQALDKHEG
             |||||:|||||||||||||||||||||||||||||||||||||||||||||||||||||
a505         MRQAGMNPDPKTVKAVFAETAKGGLELAPAFFRKPEDIETMFKAVHGWEHVQQALDKHEG
                    70         80         90        100        110        120

130        140        150        160        170        180
m505-1.pep   LLFITPHIGSYDLGGRYISQQLPFPLTAMYKPPKIKAIDKIMQAGRVRGKGKTAPTSIQG
             ||||||||||||||||||||||||||||||||||||||||||||||||||||||||||
a505         LLFITPHIGSYDLGGRYISQQLPFPLTAMYKPPKIKAIDKIMQAGRVRGKGKTAPTSIQG
                   130        140        150        160        170        180

190        200        210        220        230        240
m505-1.pep   VKQIIKALRSGEATIVLPDHVPSPQEGGEGVWVDFFGKPAYTMTLAAXLAHVKGVKTLFF
             |||||||||||||||||||||||||||||||||||||||||||||| |||||||||||
a505         VKQIIKALRSGEATIVLPDHVPSPQEGGEGVWVDFFGKPAYTMTLAAKLAHVKGVKTLFF
                   190        200        210        220        230        240
```

```
                       -continued
                 250        260        270        280        290       299
m505-1.pep    CCERLPGGQGFDLHIRPVQGELNGDKAHDAAVFNRNAEYWIRRFPTQYLFMYNRYKMPX
              ||||||||||||||||||||||||||||||||||||||||||||||||||||||||||
a505          CCERLPGGQGFDLHIRPVQGELNGDKAHDAAVFNRNAEYWIRRFPTQYLFMYNRYKMPX
                 250        260        270        280        290
```

The following partial DNA sequence was identified in *N. gonorrhoeae* <SEQ ID 1375>:

```
g506.seq
    1 ATGGCGGTAT TTGATGAAGT CGGGCGCATC GCCCATGGCT GCGGCGGTGT

51 TGTCAAACAA AGCCTGTTTC TGCGCGTCGT TCATCAGGTT GAACAAGGCG

101 CGCGGTTGGC TGAAGTAGTC GTCATCGTCT TGGCGGTAGT CCCAGTGTGC

151 CGCGTCGCCG TTGATTTTCA AAGGCGGTTC GGCGAAGTCG GGTTGTTGCT

201 GCCATTGGCC GAAGCTGTTG GGTTCGTAGT GCGGCAGGCT GCCGTAGTTG

251 CCGTCGGCGC GGCCTTGTCC GTCGCGCTGG TTGCTGTGAA CAGGGCAACG

301 CGGACGATTG ACGGGGATTT GGCGGAAGTT CACACCCAAG CGGTAACGTT

351 GCGCGTCGGC GTAATTGAAC AAACGGGCTT GCAACATTTT ATCCGGGCTC

401 GCGCCGATAC CGGGAACGAG GTTGCTCGGT GCGAAGGCGG ATTGTTCCAC

451 ATCGGCGAAG AAGTTTTCGG GATTGCGGTT CAACTCGAAT TTGCCGACTT

501 CAATCAGCGG ATAGTCTTTT TTCGGCCAAA CTTTGGTCAA GTCAAACGGA

551 TGATAAGGCA CTTTTTCGGC ATCGGCTTCA GGCATGACTT GGATGTACAT

601 CGTCCATTTC GGGAACTCGC CGCGCTCGAT GGCTTCGTAC AGGTCGCGCT

651 GATGGCTTTC GCGGTCGTCG GCGATGATTT TGCAGCTTC TTCGTTGGTC

701 AGGTTTTTAA TCCCTTGCTG GCTGCGGAAA TGGAATTTCA CCCAAAAACG

751 TTCGCCCGCT TCGTTCCAGA AGCTGTAGGT ATGCGAACCG AAGCCGTGCA

801 TATGGCGGTA GCTGGCGGGA ATACCGCGGT CGCTCATCAC GATGGTAACT

851 TGGTGCAGGG CTTCGGGCAG CAGCGTCCAG AAGTCCCAGT TGTTTGTGGC

901 GGAACGCATA TTGGTGCGCG GATCGCGTTT GACGGCTTTG TTCAGGTCGG

951 GGAATTTGCG CGGGTCGCGC AGGAAGAACA CGGGCGTGTT GTTGCCGACC

1001 ACATCCCAGT TGCCTTCTTC GGTATAGAAT TTCAACGCAA AACCGCGGAT

1051 GTCGCGTTCC GCATCGGCTG CGCCGCGCTC GCCTGCCACG GTGGTGAAAC

1101 GGGCGAACAT CTCGGTTTTT TGCCGACTT CGCTGAAAAT TTTGGCGCGG

1151 GTGTATTTGG TGATGTCGTG TGTTACGGTA AACGTACCGA ACGCGCCCGA

1201 ACCTTTGGCG TGCATACGGC GTTCGGGGAT GACTTCGCGC ACGAAGTCGG

1251 CGAGTTTTTC ATTCAGCCAC AAATCTTGCG TCAGCAGGGG GCCGCGCGGG

1301 CCGGCGGTCA GGCTGTTTTG ATTGTCGGCA ACGGGCGCGC CGTTGTTCAT

1351 GGTCAGATGG GTTACGGGGC ATTTGGAGGT AGTCATCGCT CTTGTTCCTT

1401 TTCTCAGGTT GGTCAAATGG GGGCAAACG GCTTACAGTA CGATTTGGCG

1451 GAAAGCGTAT TCGTAACCGG TTTCTTGATT GTAATAAATT TCTTGAATCG

1501 ACATTTTATT TTCCTTTTGC AAAAACTATG GATGCGATTA TACGCCAAGA

1551 TTTTCGTTAT TAA
```

This corresponds to the amino acid sequence <SEQ ID 1376; ORF 506.ng>:

```
g506.pep
   1 MAVFDEVGRI AHGCGGVVKQ SLFLRVVHQV EQGARLAEVV VIVLAVVPVC
  51 RVAVDFQRRF GEVGLLLPLA EAVGFVVRQA AVVAVGAALS VALVAVNRAT
 101 RTIDGDLAEV HTQAVTLRVG VIEQTGLQHF IRARADTGNE VARCEGGLFH
 151 IGEEVFGIAV QLEFAHFNQR IVFFRPNFGQ VKRMIRHFFG IGFRHDLDVH
 201 RPFRELAALD GFVQVALMAF AVVGDDFCSF FVGQVFNPLL AAEMEFHPKT
 251 FARFVPEAVG MRTEAVHMAV AGGNTAVAHH DGNLVQGFGQ QRPEVPVVCG
 301 GTHIGARIAF DGFVQVGEFA RVAQEEHGRV VADHIPVAFF GIEFQRKTAD
 351 VAFRIGCAAL ACHGGETGEH LGFFADFAEN FGAGVFGDVV CYGKRTERAR
 401 TFGVHTAFGD DFAHEVGEFF IQPQILRQQG AARAGGQAVL IVGNGRAVVH
 451 GQMGYGAFGG SHRSCSFSQV GQMGGKRLTV RFGGKRIRNR FLDCNKFLES
 501 TFYFPFAKTM DAIIRQDFRY *
```

The following partial DNA sequence was identified in *N. meningitidis* <SEQ ID 1377>:

```
m506.seq
    1 ATGGCGGTAT TTGATGAAGT CGGGCGCGTC GCCCATTGCG GCGGCGGTGT
   51 TGCCGAACAA TGCCTGTTTC TGCGCGTCGT TCATCAGGTT GAACAGGGCG
  101 CGCGGTTGGC TGAAATAGTC GTCATCGTCT TGGCGGTAGT CCCAGTGTGC
  151 CGCGTCGCCG TTGATTTTCA AAGGCGGTTC GGCGAAtCGg GGTTGTTGCT
  201 GCCATTGGCC GAAGCTGTyG GGTTCGTAGT GCGGCAGGCT GCCGyAGTTG
  251 CCGTCGGCGC GGCCTTGCCC GTyGCGsTgr TTgCTGTgAA CAsGGCAACG
  301 CGGACGATTG ACGGGAATTT GGCGGAAGTT TACGCCCAAA CGGTAGCGTT
  351 GTGCGTCGGC GTAATTGAAC AAACGCGCTT GCAGCATTTT ATCTsGGCTG
  401 GCGCCGACAC CGGGAACGAG GTTGCTCGGT GCGAAGGCGG ATTGTTCCAC
  451 ATCGGCGAAG AAGTTTTCGG GATTGCGGTT CTCAAACGGA TGATAAGGTA
  501 CTTTTTCCGC GTCTGCTTCA GGCATGACTT GGATGTACAT CGTCCATTTC
  551 GGAAACTCGC CGCGTTCGAT GGCTTCsTAT AAGTCGCGCT GATGGCTTTC
  601 GCGGTCGTCG GCGATGATTT TGGCGGCTTC TTCGTTGGTC AGGTTTTTAA
  651 TGCCTTGTTG GGTGCGGAAA TGGAATTTCA CCCAAAAACG CTCGCCTGCT
  701 TCGTTCCAGA AGCTGTAGGT ATGCGAACCG AAGCCGTGCA TATGGCGGTA
  751 GCCGGCGGGG ATGCCGCGGT CGCTCATCAC GATGGTAACT TGGTGCAGTG
  801 CTTCGGGCAG CAGCGTCCAG AAGTCCCAGT TGTTTGTGGC AGAGCGCATA
  851 TTGGTGCGCG GGTCGCGTTT GACGGCTTTG TTCAGGTCGG GGAACTTACG
  901 CGGGTCGCGC AGGAAGAACA CGGGCGTGTT GTTGCCGACC ACATCCCAGT
  951 TGCCTTCTTC GGTATAAAAT TTCAAGGCAA AACCGCGGAT GTCGCGTTCT
 1001 GCATCGGCTG CGCCGCGTTC GCCTGCCACG GTGGTGAAAC GGGCGAACAT
 1051 CTCGGTTTTT TTGCCGACTT CGCTGAAGAT TCCTTTGGCG TGCATACGGC
 1101 GTTCGGGGAT GACTTCGCGC ACGAAGTCGG CGAGTTTTTC AGTCATCGCT
 1151 CTTGTTCCTT TTCTCAGGTT GGTCAAATGG GGGTAAACGG CTTACAGTAC
```

```
-continued
1201 GATTTGGCGG AAAGCGTATT CGTAACCGGT TTCTTGATTG CAATAAATTT

1251 CTTGAATCGA CATTTTATTT CCCTTTTGTA AAAACTATGG ATGCGACTAT

1301 ACGCCAAGAT TTTCGCTATT AA
```

This corresponds to the amino acid sequence <SEQ ID 1378; ORF 506>:

```
m506.pep
  1 MAVFDEVGRV AHCGGGVAEQ CLFLRVVHQV EQGARLAEIV VIVLAVVPVC

51 RVAVDFQRRF GESGLLLPLA EAVGFVVRQA AXVAVGAALP VAXXAVNXAT

101 RTIDGNLAEV YAQTVALCVG VIEQTRLQHF IXAGADTGNE VARCEGGLFH

151 IGEEVFGIAV QLEFAHFNQR IVFFRPNFGQ VKRMIRYFFR VCFRHDLDVH

201 RPFRKLAAFD GFXXVALMAF AVVGDDFGGF FVGQVFNALL GAEMEFHPKT

251 LACFVPEAVG MRTEAVHMAV AGGDAAVAHH DGNLVQCFGQ QRPEVPVVCG

301 RAHIGARVAF DGFVQVGELT RVAQEEHGRV VADHIPVAFF GIKFQGKTAD

351 VAFCIGCAAF ACHGGETGEH LGFFADFAED FGAGVFGDVV RYGKRTERAR

401 TFGVHTAFGD DFAHEVGEFF IQPQILRQQR AARTGGQAVL IVGNRRAVVH

451 GQMGYRAFGG SHRSCSFSQV GQMGGKRLTV RFGGKRIRNR FLDCNKFLES

501 TFYFPFVKTM DATIRQDFRY *
```

Computer analysis of this amino acid sequence gave the following results:

Homology with a Predicted ORF from *N. gonorrhoeae*

ORF 506 shows 89.2% identity over a 520 aa overlap with a predicted ORF (ORF 506.ng) from *N. gonorrhoeae*:

```
m506/g506
                         10         20         30         40         50         60
        m506.pep  MAVFDEVGRVAHCGGGVAEQCLFLRVVHQVEQGARLAEIVVIVLAVVPVCRVAVDFQRRF
                  ||||||||||:||   |||::| ||||||||||||||||||:||||||||||||||||||
        g506      MAVFDEVGRIAHGCGVAVKCSLFLRVVHQVEQGARLAEVVVIVLAVVPVCRVAVDFQRRF
                         10         20         30         40         50         60

70         80         90        100        110        120
        m506.pep  GESGLLLPLAEAVGFVVRQAAXVAVGAALPVAXXAVNXATRTIDGNLAEVYAQTVALCVG
                  || |||||||||||||||||| |||||||| ||| |||||||:||||::|:|:|  ||
        g506      GEVGLLLPLAEAVGFVVRQAAVVAVGAALSVALVAVNRATRTIDGDLAEVHTQAVTLRVG
                         70         80         90        100        110        120

130        140        150        160        170        180
        m506.pep  VIEQTRLQHFIXAGADTGNEVARCEGGLFHIGEEVFGIAVQLEFAHFNQRIVFFRPNFGQ
                  ||||| ||||| | ||||||||||||||||||||||||||||||||||||||||||||||
        g506      VIEQTGLQHFIRARADTGNEVARCEGGLFHIGEEVFGIAVQLEFAHFNQRIVFFRPNFGQ
                        130        140        150        160        170        180

190        200        210        220        230        240
        m506.pep  VKRMIRYFFRVCFRHDLDVHRPFRKLAAFDGFXXVALMAFAVVGDDFGGFFVGQVFNALL
                  ||||||:||  : ||||||||||||:|||:||   ||||||||||||  :||||||||||
        g506      VKRMIRHFFGIGFRHDLDVHRPFRELAALDGFVQVALMAFAVVGDDFCSFFVGQVFNALL
                        190        200        210        220        230        240

250        260        270        280        290        300
        m506.pep  GAEMEFHPKTLACFVPEAVGMRTEAVHMAVAGGDAAVAHHDGNLVQCFGQQRPEVPVVCG
                  :||||||||:| ||||||||||||||||||||||::||||||||||| ||||||||||||
        g506      AAEMEFHPKTFARFVPEAVGMRTEAVHMAVAGGNTAVAHHDGNLVQGFGQQRPEVPVVCG
                        250        260        270        280        290        300

310        320        330        340        350        360
        m506.pep  RAHIGARVAFDGFVQVGELTRVAQEEHGRVVADHIPVAFFGIKFQGKTADVAFCIGCAAF
                  :||||:|||||||||||::||||||||||||||||||||||:|| ||||||| ||||||:
        g506      GTHIGARIAFDGFVQVGEFARVAQEEHGRVVADHIPVAFFGIEFQRKTADVAFRIGCAA:
                        310        320        330        340        350        360
```

-continued

```
                      370       380       390       400       410       420
m506.pep       ACHGGETGEHLGFFADFAEDFGAGVFGDVVRYGKRTERARTFGVHTAFGDDFAHEVGEFF
               ||||||||||||||||||:|||||||||| ||||||||||||||||||||||||||||||
g506           ACHGGETGEHLGFFADFAENFGAGVFGDVVCYGKRTERARTFGVHTAFGDDFAHEVGEFF
                      370       380       390       400       410       420

430       440       450       460       470       480
m506.pep       IQPQILRQQRAARTGGQAVLIVGNRRAVVHGQMGYRAFGGSHRSCSFSQVGQMGGKRLTV
               ||||||||| |||:|||||||||| |||||||||| ||||||||||||||||||||||||
g506           IQPQILRQQGAARAGGQAVLIVGNGRAVVHGQMGYGAFGGSHRSCSFSQVGQMGGKRLTV
                      430       440       450       460       470       480

490       500       510       520
m506.pep       RFGGKRIRNRFLDCNKFLESTFYFPFVKTMDATIRQDFRY
               ||||||||||||||||||||||||||:||||| |||||||
g506           RFGGKRIRNRFLDCNKFLESTFYFPFAKTMDAIIRQDFRY
                      490       500       510       520
```

The following partial DNA sequence was identified in *N. meningitidis* <SEQ ID 1379>:

```
a506.seq
     1  ATGGCGGTAT TTGATGAAGT CGGGCGCGTC GCCCATTGCG GCGGCGGTGT
    51  TGCCGAACAA TGCCTGTTTC TGCGCGTCGT TCATCAGGTT GAACAGGGCG
   101  CGCGGTTGGC TGAAATAGTC GTCATCGTCT TGGCGGTAGT CCCAGTGCGC
   151  CGCGTCGCCG TTGATTTTCA AAGGCGGTTC GGCGAAGTCG GGCTGCTGCT
   201  GCCATTGGCC GAAGCTGTTG GGTTCGTAGT GCGGCAGGCT GCCGTAGTTG
   251  CCGTCGGCGC GTCCTTGTCC GTCGCGCTGG TTGCTGTGAA CAGGGCAACG
   301  CGGACGGTTG ACAGGGATTT GGCGGAAGTT CACGCCCAAG CGGTAGCGTT
   351  GCGCGTCGGC GTAATTGAAC AAACGCGCCT GCAACATTTT ATCTGGGCTG
   401  GCGCCGACAC CGGGAACGAG GTTGCTCGGT GCGAAGGCGG ATTGTTCCAC
   451  ATCGGCGAAG AAGTTTTCGG GATTGCGGTT CAACTCGAAT TCGCCCACTT
   501  CAATCAGCGG ATAGTCTTTT TTCGGCCAAA CTTTGGTCAA GTCAAACGGA
   551  TGATACGGCA CTTTTTCCGC ATCGGCTTCA GGCATGACTT GGATGTACAT
   601  CGTCCATTTC GGAAACTCGC CGCGCTCGAT GGCTTCGTAC AGGTCGCGCT
   651  GATGGCTTTC ACGGTCGTCG GCGATGATTT TGGCGGCTTC TTCGTTGGTC
   701  AGGTTTTTAA TGCCTTGTTG GGTGCGGAAA TGGAATTTCA CCCAAAAACG
   751  CTCGCCTGCT TCGTTCCAGA AGCTGTAGGT ATGCGAACCG AAGCCGTGCA
   801  TATGGCGGTA GCCGGCGGGG ATGCCGCGGT CGCTCATCAC GATGGTAACT
   851  TGGTGCAGTG CTTCGGGCAG CAGCGTCCAG AAGTCCCAGT TGTTTGTGGC
   901  AGAGCGCATA TTGGTGCGCG GGTCGCGTTT GACGGCTTTG TTCAGGTCGG
   951  GGAACTTACG CGGGTCGCGC AGGAAGAACA CGGGCGTGTT GTTGCCGACC
  1001  ACATCCCAGT TGCCTTCTTC GGTATAGAAC TTCAACGCAA AACCGCGGAT
  1051  GTCGCGTTCT GCATCGGCTG CGCCGCGTTC GCCTGCCACG GTGGTGAAAC
  1101  GGGCGAACAT CTCGGTTTTT TTGCCGACTT CGCTGAAGAT TTTGGCGCGG
  1151  GTGTATTTGG TGATGTCGTG CGTTACGGTA AACGTACCGA ACGCGCCCGA
  1201  ACCTTTGGCG TGCATACGGC GTTCGGGGAT GACTTCGCGC ACGAAGTCGG
  1251  CGAGTTTTTC ATTCAGCCAC AAATCCTGCG CCAGCAGAGG GCCGCGAGGA
  1301  CCGGCGGTCA GGCTGTTTTG ATTGTCGGCA ACAGGCGCGC CGTTGTTCAT
  1351  GGTCAGATGG GTTACAGGGC ATTTGGAGGT ANTCATCGCT CTTGTTCCTT
```

```
-continued
1401 TTCTCAGGTT GGTCAAAT.G GGGGTAAACG GCTTACAGTA CGATTTGGCG

1451 GAAAGCGTAT TCGTAACCGG TTTCTTGATT GCAATAAATT TCTTGAATCG

1501 ACATTTTATT TCCCTTTTGT AAAAACTATG GATGCGACTA TACGCCAAGA

1551 TTTTCGCTAT TAA
```

This corresponds to the amino acid sequence <SEQ ID 1380; ORF 506.a>:

```
a506.pep
  1 MAVFDEVGRV AHCGGGVAEQ CLFLRVVHQV EQGARLAEIV VIVLAVVPVR

51 RVAVDFQRRF GEVGLLLPLA EAVGFVVRQA AVVAVGASLS VALVAVNRAT

101 RTVDRDLAEV HAQAVALRVG VIEQTRLQHF IWAGADTGNE VARCEGGLFH

151 IGEEVFGIAV QLEFAHFNQR IVFFRPNFGQ VKRMIRHFFR IGFRHDLDVH

201 RPFRKLAALD GFVQVALMAF TVVGDDFGGF FVGQVFNALL GAEMEFHPKT

251 LACFVPEAVG MRTEAVHMAV AGGDAAVAHH DGNLVQCFGQ QRPEVPVVCG

301 RAHIGARVAF DGFVQVGELT RVAQEEHGRV VADHIPVAFF GIELQRKTAD

351 VAFCIGCAAF ACHGGETGEH LGFFADFAED FGAGVFGDVV RYGKRTERAR

401 TFGVHTAFGD DFAHEVGEFF IQPQILRQQR AARTGGQAVL IVGNRRAVVH

451 GQMGYRAFGG XHRSCSFSQV GQXGGKRLTV RFGGKRIRNR FLDCNKFLES

501 TFYFPFVKTM DATIRQDFRY *
``` m506/a506 94.8% identity in 520 aa overlap

```
                 10         20         30         40         50         60
m506.pep  MAVFDEVGRVAHCGGGVAEQCLFLRVVHQVEQGARLAEIVVIVLAVVPVCRVAVDFQRRF
          |||||||||||:||||:|:|||||||||||||||||||:|||||||||| ||||||||||
a506      MAVFDEVGRIAHGCGVAVKCSLFLRVVHQVEQGARLAEVVVIVLAVVPVRRVAVDFQRRF
                 10         20         30         40         50         60

70         80         90        100        110        120
m506.pep  GESGLLLPLAEAVGFVVRQAAXVAVGAALPVAXXAVNXATRTIDGNLAEVYAQTVALCVG
          || ||||||||||||||||| |||||| || |:|  |:|| :|| :|| ||:|| || ||
a506      GEVGLLLPLAEAVGFVVRQAAVVAVGASLSVALVAVNRATRTVDRDLAEVHAQAVALRVG
                 70         80         90        100        110        120

130        140        150        160        170        180
m506.pep  VIEQTRLQHFIXAGADTGNEVARCEGGLFHIGEEVFGIAVQLEFAHFNQRIVFFRPNFGQ
          ||||||||||| ||||||||||||||||||||||||||||||||||||||||||||||||
a506      VIEQTRLQHFIWAGADTGNEVARCEGGLFHIGEEVFGIAVQLEFAHFNQRIVFFRPNFGQ
                130        140        150        160        170        180

190        200        210        220        230        240
m506.pep  VKRMIRYFFRVCFRHDLDVHRPFRKLAAFDGFXXVALMAFAVVGDDFGGFFVGQVFNALL
          ||||||:|||: |||||||||||||||| |||  ||||||:|||||||||||||||||||
a506      VKRMIRHFFRIGFRHDLDVHRPFRKLAALDGFVQVALMAFTVVGDDFGGFFVGQVFNALL
                190        200        210        220        230        240

250        260        270        280        290        300
m506.pep  GAEMEFHPKTLACFVPEAVGMRTEAVHMAVAGGDAAVAHHDGNLVQCFGQQRPEVPVVCG
          ||||||||||||||||||||||||||||||||||||||||||||||||||||||||||||
a506      GAEMEFHPKTLACFVPEAVGMRTEAVHMAVAGGDAAVAHHDGNLVQCFGQQRPEVPVVCG
                250        260        270        280        290        300

310        320        330        340        350        360
m506.pep  RAHIGARVAFDGFVQVGELTRVAQEEHGRVVADHIPVAFFGIKFQGKTADVAFCIGCAAF
          ||||||||||||||||||||||||||||||||||||||||||::|||||||||||||||
a506      RAHIGARVAFDGFVQVGELTRVAQEEHGRVVADHIPVAFFGIELQRKTADVAFCIGCAAF
                310        320        330        340        350        360
```

```
                    370        380        390        400        410        420
m506.pep    ACHGGETGEHLGFFADFAEDFGAGVFGDVVRYGKRTERARTFGVHTAFGDDFAHEVGEFF
            ||||||||||||||||||||||||||||||||||||||||||||||||||||||||||||
a506        ACHGGETGEHLGFFADFAEDFGAGVFGDVVRYGKRTERARTFGVHTAFGDDFAHEVGEFF
                    370        380        390        400        410        420

430        440        450        460        470        480
m506.pep    IQPQILRQQRAARTGGQAVLIVGNRRAVVHGQMGYRAFGGSHRSCSFSQVGQMGGKRLTV
            |||||||||||||||||||||||||||||||||||||||| |||||||||| ||||||||
a506        IQPQILRQQRAARTGGQAVLIVGNRRAVVHGQMGYRAFGGXHRSCSFSQVGQXGGKRLTV
                    430        440        450        460        470        480

490        500        510        520
m506.pep    RFGGKRIRNRFLDCNKFLESTFYFPFVKTMDATIRQDFRYX
            ||||||||||||||||||||||||||||||||||||||||
a506        RFGGKRIRNRFLDCNKFLESTFYFPFVKTMDATIRQDFRYX
                    490        500        510        520
```

The following partial DNA sequence was identified in *N. gonorrhoeae* <SEQ ID 1381>:

```
g507.seq
    1 ATGCTCTTGC CGGCTTTGCA ACAAGGCGGC GGCTTCCTGA GCGGCGGCGG

51 TTTCGGCCTC GTCGGGCAGG TTCAGGGCTT GGTTTTCCTG CTTCAGACGG

101 CCTTTGCGCT CTTCGTGCTT GGCAACGGTT TGTTCGGCAT GGGCAAGCTG

151 CTGCTGCTTC AACGCCAGTT CGCGGCGGAT GCGGTTTGCC TCGTCCTGCT

201 GGGTTTGGAA GGCAGCGTTG AGCGTGGCTT GGACTTCTTC CAATTCGGGC

251 AGACGCTCTT CGTGTTCGGC AACCTGCATC GCCCATTCCG CCAATTCGGT

301 TTGCTTTTCT TCGACCTGCA ACTCGTTTTC CTCAAGCTGC ACGCGGATTT

351 GCTGCTGCTC CTGCCGGATG CGTTGCAACT GCGCCTGCGC TGCCTGCTTG

401 TCGCGTTCGA TGCGTTGGTG CAGGTTTTGC CGGTGGCGGA TTTGTTCTTC

451 CAAACGGGCA ATCTGCTCGC GCAACACGCC GCGTTTGTTG CTCAATTCGT

501 GTACTGCCTG CTGCTGCGAC TGTTCGGCAG TCTGCAAGGC GTGTACTTCG

551 TTATTTAA
```

This corresponds to the amino acid sequence <SEQ ID 1382; ORF 507.ng>:

```
g507.pep
    1 MLLPALQQGG GFLSGGGFGL VGQVQGLVFL LQTAFALFVL GNGLFGMGKL

51 LLLQRQFAAD AVCLVLLGLE GSVERGLDFF QFGQTLFVFG NLHRPFRQFG

101 LLFFDLQLVF LKLHADLLLL LPDALQLRLR CLLVAFDALV QVLPVADLFF

151 QTGNLLAQHA AFVACFVYCL LLRLFGSLQG VYFVI*
```

The following partial DNA sequence was identified in *N. meningitidis* <SEQ ID 1383>:

```
m507.seq
    1 ATGCTCTTGC TGACTTTGCA ACAAGGCGGC TGCTTCCTGC GCGGCGGCGG

51 TTTCGGCTTC GTCGGGCAGG TTTAAGGCTT GGTTTTCCTG TTTCAGACGA

101 CCTTTGCGCT CTTCGTGCTT GGCAATCGTT TGTTCGGCAT GGGCAAGCTG

151 CTGCTGCTTC AACGCCAGTT CGCGGCGGAT GCGGTTTGCC TCGTCCTGCT

201 GGGTTTGGAA GGCGGCGTTG AGCGTGGCTT GGGCTTCTTC CAATTCGGGC
```

```
-continued
251 AGACGCTCCT CGTGTTCGGC AACCTGCATC GCCCATTCCG CCAGCTCGGT

301 TTGTTTTTCT TCGACCTGCA ACTCGTTTTC TTCAAGCTGC ACGCGGATTT

351 GCTGCTGCTC TTGATGAATG CGTTGTAACT GCGCCTGCGC TGCCTGCTTG

401 TCGCGTTCGA TGCGTTGGTG CAGGTTTTGC TGATGGCGGA TTTGTTCTTC

451 CAAACGGGCA ATCTGCTCGC GCAACACGCC GCGCTTGTTG CTCAATTCAT

501 GCACTGCCTG CTGCTGCGAC TGTTCGGCAG TCTGCAAGGC GTGTACTTCG

551 TCGTTTAA
```

This corresponds to the amino acid sequence <SEQ ID 1384; ORF 507>:

```
m507.pep
   1 MLLLTLQQGG CFLRGGGFGF VGQVXGLVFL FQTTFALFVL GNRLFGMGKL

51 LLLQRQFAAD AVCLVLLGLE GGVERGLGFF QFGQTLLVFG NLHRPFRQLG

101 LFFFDLQLVF FKLHADLLLL LMNALXLRLR CLLVAFDALV QVLLMADLFF

151 QTGNLLAQHA ALVAQFMHCL LLRLFGSLQG VYFVV*
```

Computer analysis of this amino acid sequence gave the following results:
Homology with a Predicted ORF from *N. gonorrhoeae*
ORF 507 shows 87.0% identity over a 185 aa overlap with a predicted ORF (ORF 507.ng) from *N. gonorrhoeae*:

```
    m507/g507
                    10         20         30         40         50         60
    m507.pep  MLLLTLQQGGCFLRGGGFGFVGQVXGLVFLFQTTFALFVLGNRLFGMGKLLLLQRQFAAD
              ||| :||||| || |||||:|||| |||||:||:||||||||| ||||||||||||||||
    g507      MLLPALQQGGGFLSGGGFGLVGQVQGLVFLLQTAFALFVLGNGLFGMGKLLLLQRQFAAD
                    10         20         30         40         50         60

70         80         90        100        110        120
    m507.pep  AVCLVLLGLEGGVERGLGFFQGFQTLLVFGNLHRPFRQLGLFFFDLQLVFFKLHADLLLL
              ||||||||||:|||||| |||||||||:||||||||||||:||:||||||||:|||||||
    g507      AVCLVLLGLEGSVERGLDFFQGFQTLFVFGNLHRPFRQFGLLFFDLQLVFLKLHADLLLL
                    70         80         90        100        110        120

130        140        150        160        170        180
    m507.pep  LMNALXLRLRCLLVAFDALVQVLLMADLFFQTGNLLAQHAALVAQFMHCLLLRLFGSLQG
              | :||||||||||||||||||||| :|||||||||||||||||:||||::||||||||||
    g507      LPDALQLRLRCLLVAFDALVQVLPVADLFFQTGNLLAQHAAFVAQFVYCLLLRLFGSLQG
                   130        140        150        160        170        180 m507.pep  VYFVV
              ||||:
    g507      VYFVI
```

The following partial DNA sequence was identified in *N. meningitidis* <SEQ ID 1385>:

```
a507.seq
   1 ATGCTCTTGC TGGCTTTGCA ACAAGGCGGC AGCTTCCTGC GCGGCGGCGG

51 TTTCGGCTTC GTCAGGCAGA TTCAGGGCTT GGTTTTCCTG TTTCAGACGA

101 CCTTTGCGCT CTTCGTGCTT GGCAACGGTT TGTTCGGCAT GGGCAAGCTG

151 CTGCTGCTTC AACGCCAGTT CGCGGCGGAT GCGGTTTGCC TCGTCCTGCT

201 GGGTTTGGAA GGCGGCATTG AGTGTGGCTT GGGTTTCTTC CAATTCGGGC

251 AGACGCTCTT CGTGTTCGGC AACCTGCATC GCCCATTCCG CCAATTCGGT

301 TTGCTTTTCT TCCGCCTGCA ACTCGTTTTC TTCAAGCTGC ACGCGGATTT

351 GCTGCTGCTC CTGATGGATG CGCTGCATCT GCGCCTGCGC CGCCTGCTTG

401 TCGCGTTCGA TGCGTTGGTG CAGGTTTTGC TGATGGCGGA TTTGTTCTTC
```

```
451 CAAACGGGCA ATCTGTTCGC GCAACACGCC GCGTTTGTTG CCCAATTCGT

501 GCACCGCCTG CTGCTGCGAC TGTTCGGCAG TCTGCAAGGC GTGTACTTCG

551 TCGTTTAA
```

This corresponds to the amino acid sequence <SEQ ID 1386; ORF 507.a>:

```
a507.pep
  1 MLLLALQQGG SFLRGGGFGF VRQIQGLVFL FQTTFALFVL GNGLFGMGKL

51 LLLQRQFAAD AVCLVLLGLE GGIECGLGFF QFGQTLFVFG NLHRPFRQFG

101 LLFFRLQLVF FKLHADLLLL LMDALHLRLR RLLVAFDALV QVLLMADLFF

151 QTGNLFAQHA AFVAQFVHRL LLRLFGSLQG VYFVV*
``` m507/a507 89.7% identity in 185 aa overlap

```
                       10         20         30         40         50         60
      m507.pep   MLLLTLQQGGCFLRGGGFGFVGQVXGLVFLFQTTFALFVLGNRLFGMGKLLLLQRQFAAD
                 ||||:||||| ||||||||||| |: ||||||||||||||| |||||| |||||||||||
      a507       MLLLALQQGGSFLRGGGFGFVRQIQGLVFLFQTTFALFVLGNGLFGMGKLLLLQRQFAAD
                       10         20         30         40         50         60

70         80         90        100        110        120
      m507.pep   AVCLVLLGLEGGVERGLGFFQFGQTLLVFGNLHRPFRQLGLFFFDLQLVFFKLHADLLLL
                 ||||||||||||:| ||||||||||||:||||||||||||:||:|| |||||||||||||
      a507       AVCLVLLGLEGGIECGLGFFQFGQTLFVFGNLHRPFRQFGLLFFRLQLVFFKLHADLLLL
                       70         80         90        100        110        120

130        140        150        160        170        180
      m507.pep   LMNALXLRLRCLLVAFDALVQVLLMADLFFQTGNLLAQHAALVAQFMHCLLLRLFGSLQG
                 ||:|| |||| ||||||||||||||||||||||||:|||||:||||:||||:|||||||||
      a507       LMDALHLRLRRLLVAFDALVQVLLMADLFFQTGNLFAQHAAFVAQFVHRLLLRLFGSLQG
                      130        140        150        160        170        180 m507.pep   VYFVVX
                 ||||||
      a507       VYFVVX
```

The following partial DNA sequence was identified in *N. gonorrhoeae* <SEQ ID 1387>:

```
g508.seq
  1 ATGGTAGCGT TTGGCGTTGA TCAGGGCCTC CTGCTGCTGC AACAGGGCGG

51 TTTGGGTGGC GGCCTGAAGC TGCGGCAGCT TGGTTTGCAG GGTTTGTACG

101 CGGGCGTATT GCTCCCTGCC CTGTTCCTGA ATCTGCGCGA GTTTTTCCTG

151 CACGGCGATG TATTCTTCGT CCAGCGTGTG TACGGTTTCG GTCAACTCGT

201 CGAGCTTGAT GTGCTGCTCG TCGTTTTGGA ACTCGGTTTC ATAGGCGAGG

251 GCAAGCTCTT GCCGGCGTTC CTGCCAGTCC AGGGTTTGCT GTTCGAGCCG

301 GGCGATTTGC TGCCGGTAGT TTTGTTTTTG CGGGTTGAGT TTGTGGACGG

351 CGACTTCGGC AAGCCCGTAT GGCGGTTGG CTTCCAACAG GGCAAGCTGC

401 GCCTGTTTCA GACGGCCTTG CTGCTCTTGG CGGCTGTGCG CGGTGGTTTG

451 CTGCTGGTGT TCGAGTTCGG CGGCGGCTTC CTGCAAAGTA GCGATGTCGT

501 CTGA
```

This corresponds to the amino acid sequence <SEQ ID 1388; ORF 508.ng>:

```
g508.pep
    1 MVAFGVDQGL LLLQQGGLGG GLKLRQLGLQ GLYAGVLLPA LFLNLREFFL

51 HGDVFFVQRV YGFGQLVELD VLLVVLELGF IGEGKLLPAF LPVQGLLFEP

101 GDLLPVVLFL RVEFVDGDFG KPVLAVGFQQ GKLRLFQTAL LLLAAVRGGL

151 LLVFEFGGGF LQSSDVV
```

The following partial DNA sequence was identified in *N. meningitidis* <SEQ ID 1389>:

```
m508.seq
    1 ATGGTAGCGT TTGGCGTTGA TCAGGGCTTC CTGCTGCTGC AACAAGGCGG

51 TTTGGGTGGC GGCCTGAAGC TGCGGCAGCT TGGTTTGCAG GGTTTGCACT

101 TTAGCGTATT GCTCCCTGCC CTGTTCCTGA ATCTGCGCGA GTTTCTCTTG

151 CACAACAATA TATTCTTCGT CCAAGGTCTG TACGGCTTCG CTTAATTCTT

201 CAAGCTTGAT GTGCTGCTCG TCGTTTTGGA ACTCGGTTTC ATAGGCGAGG

251 GCAAGCTCTT GCTGGCGTTC CTGCCAGTCG AGGGTTTGCT GTTCAAGCTG

301 GGCGATTTGC TGCCGGTAGT TTTGTTTTTG CTGGTTGAGT TTGTGGACGG

351 CGACTTCGGC AAGCCCGTAT TGGCGGTTGG CTTCCAACAG GGCAAGCTGC

401 GCCTGTTTCA GACGGCCTTG CTGCTCTTGG CGGCTGTGCG CGGTGGTTTG

451 CTGCTGGTGT TCGAGTTCGG CGGCGGCTTC CTGCAAGGTA ACGATGTCGT

501 CTGA
```

This corresponds to the amino acid sequence <SEQ ID 1390; ORF 508.ng>:

```
m508.pep
    1 MVAFGVDQGF LLLQQGGLGG GLKLRQLGLQ GLHFSVLLPA LFLNLREFLL

51 HNNIFFVQGL YGFAXFFKLD VLLVVLELGF IGEGKLLLAF LPVEGLLFKL

101 GDLLPVVLFL LVEFVDGDFG KPVLAVGFQQ GKLRLFQTAL LLLAAVRGGL

151 LLVFEFGGGF LQGNDVV*
```

Computer analysis of this amino acid sequence gave the following results:
Homology with a Predicted ORF from *N. gonorrhoeae*
ORF 508 shows 86.8% identity over a 167 aa overlap with a predicted ORF (ORF 508.ng) from *N. gonorrhoeae*:

```
    m508/g508

10         20         30         40         50         60
       m508.pep  MVAFGVDQGFLLLQQGGLGGGLKLRQLGLQGLHFSVLLPALFLNLREFLLHNNIFFVQGL
                 ||||||||||:||||||||||||||||||||: :|||||||||||||||:||:::|||  :
           g508  MVAFGVDQGLLLLQQGGLGGGLKLRQLGLQGLYAGVLLPALFLNLREFFLHGDVFFVQRV
                    10         20         30         40         50         60

70         80         90        100        110        120
       m508.pep  YGFAXFFKLDVLLVVLELGFIGEGKLLLAFLPVEGLLFKLGDLLPVVLFLLVEFVDGDFG
                 |||: : :|||||||||||||||||| |||||:||||: |||||||||||| ||||||||
           g508  YGFGQLVELDVLLVVLELGFIGEGKLLPAFLPVQGLLFEPGDLLPVVLFLRVEFVDGDFG
                    70         80         90        100        110        120
```

```
                 130        140        150        160
    m508.pep  KPVLAVGFQQGKLRLFQTALLLLAAVRGGLLLVFEFGGGFLQGNDVV
              |||||||||||||||||||||||||||||||||||||||||::|||
    g508      KPVLAVGFQQGKLRLFQTALLLLAAVRGGLLLVFEFGGGFLQSSDVV
                 130        140        150        160
```

The following partial DNA sequence was identified in *N. meningitidis* <SEQ ID 1391>:

```
a508.seq
  1 ATGGTAGCGT TTGGCGTTGA TCAGGGCTTC CTGCTGCTGC AACAGGGCGG

51 TTTGGGTGGC GGCCTGAAGC TGCGGCAGCT TGGTTTGCAG GGTTTGTACG

101 CGGGCGTATT GTTCCCTACC CTGCTCCTGA ATCTGCGCGA GTTTCTCCTG

151 TACGACAATA TATTCTTCGT CCAAACTCTG TACGGCTTCG CTCAACTCTT

201 CGAGCTTGAT GTGCTGCTCG TCGTTTTGGA ACTCGGTTTC ATAGGCGAGG

251 GCAAGCTCTT GCTGGCGTTC CTGCCAATCG AAGGTTTGTT GTTCAAGCTG

301 GGCAATTTGC TGTTGGTAGT TTTGTTTTTG CTGGTTGAGC TTGTGGACGG

351 CGACTTCGGC AAGCCCGTAT TGGCGGTTGG CTTCCAACAG GGCAAGCTGC

401 GCCTGTTTCA GACGACCTTG CTGCTCTTGG CGGCTGTGCG CGGCGGTTTG

451 CTGCTGGTGT TCGAGTTCGG CGGCGGCTTC CTGCAAAATG GCGATGTCGT

501 CTGA
```

This corresponds to the amino acid sequence <SEQ ID 1392; ORF 508.a>:

```
a508.pep
  1 MVAFGVDQGF LLLQQGGLGG GLKLRQLGLQ GLYAGVLFPT LLLNLREFLL

51 YDNIFFVQTL YGFAQLFELD VLLVVLELGF IGEGKLLLAF LPIEGLLFKL

101 GNLLLVVLFL LVELVDGDFG KPVLAVGFQQ GKLRLFQTTL LLLAAVRGGL

151 LLVFEFGGGF LQNGDVV*
``` m508/a508 88.6% identity in 167 aa overlap

```
                 10         20         30         40         50         60
    m508.pep  MVAFGVDQGFLLLQQGGLGGGLKLRQLGLQGLHFSVLLPALFLNLREFLLHNNIFFVQGL
              ||||||||||||||||||||||||||||||||||: :|:|:|||||||||::||||| |
    a508      MVAFGVDQGFLLLQQGGLGGGLKLRQLGLQGLYAGVLFPTLLLNLREFLLYDNIFFVQTL
                 10         20         30         40         50         60

70         80         90        100        110        120
    m508.pep  YGFAXFFKLDVLLVVLELGFIGEGKLLLAFLPVEGLLFKLGDLLPVVLFLLVEFVDGDFG
              ||||  :|:||||||||||||||||||||||||:||||||:||  |||||||:||||||
    a508      YGFAQLFELDVLLVVLELGFIGEGKLLLAFLPIEGLLFKLGNLLLVVLFLLVELVDGDFG
                 70         80         90        100        110        120

130        140        150        160
    m508.pep  KPVLAVGFQQGKLRLFQTALLLLAAVRGGLLLVFEFGGGFLQGNDVVX
              |||||||||||||||||::||||||||||||||||||||||::||||
    a508      KPVLAVGFQQGKLRLFQTTLLLLAAVRGGLLLVFEFGGGFLQNGDVVX
                 130        140        150        160
```

The following partial DNA sequence was identified in *N. gonorrhoeae* <SEQ ID 1393>:

```
g509.seq
  1   atggtcgctg tatgtgatga acgggctgta cagcggacgt tggtggccca 51   attcgcgcaa caaggcggct tgttttgct cttcgttcag gctgttgtag
```

-continued

```
 101 tcttccaagc ctgcgtgttg gaaaagctcg gcaaccacat cggcgtgttt
 151 gcctgcgtgt tggcgcaggt cgagcggcat catgtggaag ccgaacacgg
 201 acacggaacg gatgaggtct gccaaacggc cttcggcaag caggcggctg
 251 ccgttgtcga taagggaacg ttgcaatttt ttcaaatcat cgagaaattt
 301 ttgggccgaa gcataaggct cgagaaagcc gaatttgcag cccatgccca
 351 aaccgagcga gcgcgctttg cccatagcgc gcgccataat gtaggcaatg
 401 gcgcggcggt aaggttcttc ggtgcgggcg atttcttcgt caggcgagag
 451 ggctgccagt gccattacgt cgtcgttgac tttgacgcgg cggatggaaa
 501 gcggcagttc gcggtaaagt ttgtcgagtt cgctgcggta aaaacggaac
 551 acggcatcgg cgtggcggcg aaggcaaag cgcagggttt cgccagaaac
 601 aaacggattg ccgtcgcggt cgccgccgat ccagccgccg attttaagga
 651 tattcggaac gcggacatcg ggataggccg tctgaaagtc gtgttccatc
 701 ttgcggtaga gtttgggcag ggcttcaaaa aagctcatcg ggaagatgga
 751 cacgccgttg ttgatttcgt cgttgacgct gagtttgtgg cggcgcgttt
 801 cgctggtctg ccacaagccc agaagcacgg tgtcgatttc gcggcgcagc
 851 cgtgccagcg cgtcggcatt ggtgcagcgt tcgcgttgcg cagcagcgc
 901 gcggatgcgg cggttgaaat tcaaacggt ttggcgttgc acttcggtcg
 951 ggtgcgcggt caaaacggcg gtaacggacg tattgtccaa ctgccgctgc
1001 accgatttgc cgtcggcttt ccccgctttg agcctgcgga cggtttccgt
1051 caggctgcct tctgctgcgt tgtggccggc atcttcgtgg atttggcggc
1101 ggcgttcgtg gtgcacgtct tcggcgatat tcagaatctg gcgaacagc
1151 ccgcaggcaa gcgtcagatc gtaggtctgc cgttcgtcca attgcggcaa
1201 tacttttca atcaatgccg cgctgtcgtc ggaagtggac aagagtttga
1251 ccgtttcgac aaccaacggc gaggcttctt cgtgcaggag gttgaacagg
1301 gactgtttca aaaattccgc gtccgccgcc aaagccgcgt ccttcggatt
1351 gttcaggata tgcagttgca tgatttttcct ctcattgccg taaatactgt
1401 aaatgtacct caaatgccgc atccgtgcca aaccgttcac actttaacca
1451 ctcatgtccc gaaatgccgt ctgaagttga acgccgcccg acggcggcgt
1501 tacaatcgcc cgcaactgtt tttttccgaa catcatcatg accgcgaccg
1551 aacacgacaa cgacgacgca ctcctgctgc ggtacagccg ccacatcctc
1601 ttggacgaaa tcggcatcga agggcagcag aagctttccg ccgcgcatat
1651 tttggtcgtc ggctgcggcg gattgggcgc cgccgcccct gccctatctc
1701 gccgcctcgg gggtcggcac gctga
                                                          55
```

This corresponds to the amino acid sequence <SEQ ID 1394; ORF 509.ng>:

```
g509.pep
  1 MVAVCDERAV QRTLVAQFAQ QGGLFLLFVQ AVVVFQACVL EKLGNHIGVF

51 ACVLAQVERH HVEAEHGHGT DEVCQTAFGK QAAVVDKGT LQFFQIIEKF

101 LGRSIRLEKA EFAAHAQTER ARFAHSARHN VGNGAAVRFF GAGDFFVRRE

151 GCQCHYVVVD FDAADGKRQF AVKFVEFAAV KTEHGIGVAA EGKAQGFARN
```

-continued

```
201 KRIAVAVAAD PAADFKDIRN ADIGIGRLKV VFHLAVEFGQ GFKKAHREDG

251 HAVVDFVVDA EFVAARFAGL PQAQKHGVDF AAQPCQRVGI GAAFALRQQR

301 ADAAVEIQNG LALHFGRVRG QNGGNGRIVQ LPLHRFAVGF PRFEPADGFR

351 QAAFCCVVAG IFVDLAAAFV VHVFGDIQNL GEQPAGKRQI VGLPFVQLRQ

401 YFFNQCRAVV GSGQEFDRFD NQRRGFFVQE VEQGLFQKFR VRRQSRVLRI

451 VQDMQLHDFP LIAVNTVNVP QMPHPCQTVH TLTTHVPKCR LKLNAARRRR

501 YNRPQLFFSE HHHDRDRTRQ RRRTPAAVQP PHPLGRNRHR RAAEAFRRAY

551 FGRRLRRIGR RRPCPISPPR GSAR*
```

The following partial DNA sequence was identified in *N. meningitidis* <SEQ ID 1395>:

```
m509.seq
   1 ATGGTCGCTG TATGTGATAA ACGGGCTGTA CAGAGGACGT TGATGGCTCA

51 ATTCGCGCAA CAGGGCGGTT TGTTTTTGCT CTTCGTTCAG GCGGTTGTAG

101 TCTTCCAAGC CTGCGTGTTG GAAAAGCTCG GCAACCACAT CGGCGTGTTT

151 GCCTGCGTGT TGGCGCAAGT CGAGCGGCAT CATGTGAAAG CCGAACACGG

201 ATACGGAACG GATGAGGTCT GCCAAACGGC CTTCGGCAAG CAGACGGCTG

251 CCGTTGTCGA TAAGGGAACG TTGCAATTTT TTCAAATCAT CCAGAAACTC

301 TTGTGCCGAA GCATAAGGCT CGAGAAAGCC GAATTTGCAG CCCATACCCA

351 AACCGAGCGC GCGCGCTTTG CCCATAGCGC GCGCCATAAT GTAGGCGATG

401 GCGCGGCGGT AGGGTTCTTC GGCGCGGGCG ATTTCTTCGT CGGGCGATTT

451 GTCGGACAAC GCCGTTACAT CGCCGTTGAC TTTGACGCGG CGGATGGAGA

501 GCGGCAGTTC GCGGTAGAGT TTGTCGAGTT CGCCGCGATA GAAGCGGAAC

551 ACGGCATCGG CGTGGCGGCG GAAGGCAAAG CGCAGGGTTT CGGCAGAAAC

601 AAACGGATTG CCGTCGCGGT CGCCGCCGAT CCAGCCGCCG ATTTTGAGGA

651 TGTCCGGAAC GCGGACGCCG GGATAGGCCG TCTGAAAGTC GTGTTCCATC

701 TTGCGGTAGA GCTTGGGCAG GGCTTCGAAA AAGCTCATCG GGAAGATGGA

751 CACGCCGTTG TTGATTTCGT CGTTGACGCT GAGTTTGTGG CGGCGCGTTT

801 CGCTGGTCTG CCACAAGCCC AGCAGGATAG TGTCGATTtC GCgGCGCAGC

851 CGTGCCAGCG CGTCGGCATT GGTGCAGCGT TCgCGTTGCG GCAACAGTGC

901 GCGGATGCGG CGGTTGAAGC TTAAGACGGT TTGGCGTTGC ACTTCGGTCG

951 GGTGCGCGGT CAAAACGGCG GTAACGGACG TATTGTCCAA CTGCCGCTGC

1001 ACCGATTTGC CGTCGGCTTT CCCCGCTTTG AGCCTGCGGA CGGTTTCCGT

1051 CAGGCTGCCT TCCGCGCCGC CGCGTCCGGC TTCTTCGTGG ATTTGGCGGC

1101 GGCGTTCGTG GTGCACGTCT TCGGCGATGT TCAAAATCTG GGCGAACAGG

1151 CCGCAGGCCA AGGTTAAATC GTGGGTTTGT TGTTCGTCCA ATTGCGGCAA

1201 TACTTTTTCA ATCAATGCCG CGCTGTCGTC GGAAGTGGAC AAGAGTTTGA

1251 CTGTTTCGAC AACCAACGGC GAGGCTTCTT CGTGCAGGAG GTTGAACAGG

1301 GATTGTTTCA GAAATTCCGC GTCCGCCGCC AAAGCCGCGT CCTTTGGATT

1351 GTTCAGAATA TGCAGTTGCA TGATTTTTCT CTCTCGTCTG CCGTAAATAT

1401 TGTAAATGTA CCCCAAATGC CGCATCCGTG CCAAACCGTT CACACTTTAA
```

-continued

```
1451 CCGCCCGTGT CCCGAAATGC CGTCTGAAGT TGAACGCCGC CCGACGGCAG

1501 CGTTACAATC GCCCGCAACT GTTTTtTTCC GAACATCATC ATGACCACGA

1551 CCGAACACGA CAACGACGAT GCATTCCTGC TGCGGTACAG CCGCCACATC

1601 CTCTTGGACG AAATCGGCAT CGAAGGGCAG CAGAAACTTT CCGCCGCGCA

1651 TATTTTGGTC GTCGGCTGCG GCGGTTTGGG TGCCGCCGCA CT.GCCCTAC

1701 CTTGCCGCTT CGGGTGTCGG CACGCTGA
```

This corresponds to the amino acid sequence <SEQ ID 1396; ORF 509>:

```
m509.pep
  1 MVAVCDKRAV QRTLMAQFAQ QGGLFLLFVQ AVVVFQACVL EKLGNHIGVF

51 ACVLAQVERH HVKAEHGYGT DEVCQTAFGK QTAAVVDKGT LQFFQIIQKL

101 LCRSIRLEKA EFAAHTQTER ARFAHSARHN VGDGAAVGFF GAGDFFVGRF

151 VGQRRYIAVD FDAADGERQF AVEFVEFAAI EAEHGIGVAA EGKAQGFGRN

201 KRIAVAVAAD PAADFEDVRN ADAGIGRLKV VFHLAVELGQ GFEKAHREDG

251 HAVVDFVVDA EFVAARFAGL PQAQQDSVDF AAQPCQRVGI GAAFALRQQC

301 ADAAVEAXDG LALHFGRVRG QNGGNGRIVQ LPLHRFAVGF PRFEPADGFR

351 QAAFRAAASG FFVDLAAAFV VHVFGDVQNL GEQAAGQGXI VGLLFVQLRQ

401 YFFNQCRAVV GSGQEFDCFD NQRRGFFVQE VEQGLFQKFR VRRQSRVLWI

451 VQNMQLHDFS LSSAVNIVNV PQMPHPCQTV HTLTARVPKC RLKLNAARRQ

501 RYNRPQLFFS EHHHDHDRTR QRRCIPAAVQ PPHPLGRNRH RRAAETFRRA

551 YFGRRLRRFG CRRTXPTLPL RVSAR*
```

Computer analysis of this amino acid sequence gave the following results:
Homology with a Predicted ORF from *N. gonorrhoeae*
ORF 509 shows 87.8% identity over a 575 aa overlap with a predicted ORF (ORF 509.ng) from *N. gonorrhoeae*:

```
m509/g509
                     10         20         30         40         50         60
       m509.pep   MVAVCDKRAVQRTLMAQFAQQGGLFLLFVQAVVVFQACVLEKLGNHIGVFACVLAQVERH
                  ||||||:|||||||:|||||||||||||||||||||||||||||||||||||||||||||
       g509       MVAVCDERAVQRTLVAQFAQQGGLFLLFVQAVVVFQACVLEKLGNHIGVFACVLAQVERH
                     10         20         30         40         50         60

70         80         90        100        110        120
       m509.pep   HVKAEHGYGTDEVCQTAFGKQTAAVVDKGTLQFFQIIQKLLCRSIRLEKAEFAAHTQTER
                  ||:||||:|||||||||||||:||||||||||||||||:|:|||||||||||||:||||
       g509       HVEAEHGHGTDEVCQTAFGKQAAAVVDKGTLQFFQIIEKFLGRSIRLEKAEFAAHAQTER
                     70         80         90        100        110        120

130        140        150        160        170        180
       m509.pep   ARFAHSARHNVGDGAAVGFFGAGDFFVGRFVGQRRYIAVDFDAADGERQFAVEFVEFAAI
                  ||||||||||||:||||  ||||||||||  |   |:|::|||||||||:||||:|||||:
       g509       ARFAHSARHNVGNGAAVRFFGAGDFFVRREGCQCHYVVVDFDAADGKRQFAVKFVEFAAV
                    130        140        150        160        170        180

190        200        210        220        230        240
       m509.pep   EAEHGIGVAAEGKAQGFGRNKRIAVAVAADPAADFEDVRNADAGIGRLKVVFHLAVELGQ
                  ::||||||||||||||:|||||||||||||||||:|||||:||||||||||||||||:||
       g509       KTEHGIGVAAEGKAQGFARNKRIAVAVAADPAADFKDIRNADIGIGRLKVVFHLAVEFGQ
                    190        200        210        220        230        240
```

```
                  250        260        270        280        290        300
m509.pep   GFEKAHREDGHAVVDFVVDAEFVAARFAGLPQAQQDSVDFAAQPCQRVGIGAAFALRQQC
           ||:||||||||||||||||||||||||||||||:||||||||||||||||||||||||
g509       GFKKAHREDGHAVVDFVVDAEFVAARFAGLPQAQKHGVDFAAQPCQRVGIGAAFALRQQR
                  250        260        270        280        290        300

310        320        330        340        350        360
m509.pep   ADAAVEAXDGLALHFGRVRGQNGGNGRIVQLPLHRFAVGFPRFEPADGFRQAAFRAAASG
           ||||||:|||||||||||||||||||||||||||||||||||||||||||||:::|
g509       ADAAVEIQNGLALHFGRVRGQNGGNGRIVQLPLHRFAVGFPRFEPADGFRQAAFCCVVAG
                  310        320        330        340        350        360

370        380        390        400        410        420
m509.pep   FFVDLAAAFVVHVFGDVQNLGEQAAGQGXIVGLLFVQLRQYFFNQCRAVVGSGQEFDCFD
           :|||||||||||||||:||||||||  ||:  ||||  ||||||||||||||||||||||||  ||
g509       IFVDLAAAFVVHVFGDIQNLGEQPAGKRQIVGLPFVQLRQYFFNQCRAVVGSGQEFDRFD
                  370        380        390        400        410        420

430        440        450        460        470        480
m509.pep   NQRRGFFVQEVEQGLFQKFRVRRQSRVLWIVQNMQLHDFSLSSAVNIVNVPQMPHPCQTV
           |||||||||||||||||||||||||||||:|||||||  |  |||  ||||||||||||
g509       NQRRGFFVQEVEQGLFQKFRVRRQSRVLRIVQDMQLHDFPLI-AVNTVNVPQMPHPCQTV
                  430        440        450        460        470

490        500        510        520        530        540
m509.pep   HTLTARVPKCRLKLNAARRQRYNRPQLFFSEHHHDHDRTRQRRCIPAAVQPPHPLGRNRH
           ||||::||||||||||||:|||||||||||||||:|||||||  ||||||||||||||
g509       HTLTTHVPKCRLKLNAARRRRYNRPQLFFSEHHHDRDRTRQRRRTPAAVQPPHPLGRNRH
              480        490        500        510        520        530

550        560        570
m509.pep   RRAAETFRRAYFGRRLRRFGCRRTCPTLPLRVSAR
           |||||:||||||||||||:|  ||  ||   |  |||
g509       RRAAEAFRRAYFGRRLRRIGRRRPCPISPPRGSAR
              540        550        560        570
```

The following partial DNA sequence was identified in *N. meningitidis* <SEQ ID 1397>:

```
a509.seq
   1  ATGGTCGCTG TATGTGATGA ACGGACTGTA CAGTGGACGT TGATGGCTCA

51  ATTCGCGCAA CAGGGCGGCT TGTTTTTGCT CTTCGTTGAG GCTGTTGTAG

101  TCTTCCAAGC CTGCGTGTTG GAAAAGCTCG GCAACCACAT CGGCGTGTTT

151  GCCTGCGTGT TGGCGCAGGT CGAGCGGCAT CATGTGGAAG CCGAACACGG

201  ATACGGAACG GATGAGGTCT GCCAAACGGC CTTCGGCAAG CAGGCGGCTG

251  CCGTTGTCGA TAAGGGAATG TTGCAATTTT TTCAAATCAT CGAGAAATTC

301  TTGTGCCGAA GCATAAGGCT CGAGAAAGCC GAATTTGCAG CCCATACCCA

351  AACCGAGCGC GCGCGCTTTG CCCATAGCGC GCGCCATAAT GTAGGCAATG

401  GCGCGACGGT AGGGTTCTTC GGCGCGGGCG GTTTCTTCGT CGGGCGATTT

451  GTCGGACAAC GCCATCACAT CGCCGTTGAC TTTGACGCGG CGGATGGAGA

501  GCGGCAGTTC GCGGTAGAGT TTGTCGAGTT CGCCACGGTA AAAACGGAAC

551  ACGGCATCGG CGTGGCGGCG GAAGGCAAAA CGCAAGGTTT CGGCAGAAAC

601  GAACGGATTG CCGTCGCGGT CGCCGCCGAT CCAGCCGCCG ATTTTGAGGA

651  TGTCCGGAAC GCGGACATCG GGATAGGCCG TCTGAAAGTC GTGTTCCATC

701  TTGCGGTAGA GCTTGGGCAG GGCTTCAAAA AAGCTCATCG GAAAGATGGA

751  CACGCCGTTG TTGATTTCGT CGTTGACGCT GAGTTTGTGG CGGCGCGTTT

801  CGCTGGTCTG CCACAAGCCC AGCAGGATAG TGTCGATTTC GCGGCGCAGC

851  CGTGCCAGCG CGTCGGCATT GGTACAGCGT TCGCGTTGCG GCAGCAGCGC

901  GCGGATGCGG CGGTTGAAAT TCAAGACGGT CTGGCGTTGC ACTTCGGTCG
```

-continued

```
 951 GGTGCGCGGT CAAAACGGCG GTAACGGACG TATTGTCCAA CTGCCGCTGC
1001 ACCGATTTGC CGTCGGCTTT CCCCGCTTTG AGCCTGCGGA CGGTTTCCGT
1051 CAGGCTGCCT TCCGCGCCGC CGCGTCCGGC TTCTTCGTGG ATTTGGCGGC
1101 GGCGTTCGTG GTGCACGTCT TCGGCGATGT TCAAAATCTG GGCGAACAGG
1151 CCGCAGGCCA AGGTTAAATC GTGGGTTTGT TGTTCGTCCA ATTGCGGCAA
1201 TACTTTTTCA ATCAATGCCG CGCTGTCGTC GGAAGTGGAC AAGAGTTTGA
1251 CCGTTTCGAC AACCAACGGC GAGGCTTCTT CGTGCAGGAG GTTGAACAGG
1301 GATTGTTTCA GAAATTCCGC GTCCGCCGCC AAAGCCGCGT CCTTTGGATT
1351 GTTCAGAATA TGCAGTTGCA TGATTTTTCT CTCATTGCCG TAAATACTGT
1401 AAATGTACCT CAAATGCCGC ATCCGTGCCA AACCGTTCAC ACTTTAACCG
1451 CCCGTGTCCC GAAATGCCGT CTGAAGTTGA ACGCCGCCCG ACGGCAGCGT
1501 TACAATCGCC CACAACTGTT TTT.TCCGAA CATCATCATG ACCACGACCG
1551 AACACGACAA CGACGATGCA TTCCTGCTGC GGTACAGCCG CCACATCCTC
1601 TTGGACGAAA TTGGCATCGA AGGGCAGCAG AAACTTTCCG CCGCGCATAT
1651 TTTGGTCGTC GGCTGCGGCG GTTTGGGTGC CGCCG.CCCT GCCCTATCTC
1701 GCCGCTTCCG GCATCGGCAC GCTGA
```

This corresponds to the amino acid sequence <SEQ ID 1398; ORF 509.a>:

```
a509.pep
  1 MVAVCDERTV QWTLMAQFAQ QGGLFLLLFVE AVVVFQACVL EKLGNHIGVF

51 ACVLAQVERH HVEAEHGYGT DEVCQTAFGK QAAAVVDKGM LQFFQIIEKF

101 LCRSIRLEKA EFAAHTQTER ARFAHSARHN VGNGATVGFF GAGGFFVGRF

151 VGQRHHIAVD FDAADGERQF AVEFVEFATV KTEHGIGVAA EGKTQGFGRN

201 ERIAVAVAAD PAADFEDVRN ADIGIGRLKV VFHLAVELGQ GFKKAHRKDG

251 HAVVDFVVDA EFVAARFAGL PQAQQDSVDF AAQPCQRVGI GTAFALRQQR

301 ADAAVEIQDG LALHFGRVRG QNGGNGRIVQ LPLHRFAVGF PRFEPADGFR

351 QAAFRAAASG FFVDLAAAFV VHVFGDVQNL GEQAAGQG*I VGLLFVQLRQ

401 YFFNQCRAVV GSGQEFDRFD NQRRGFFVQE VEQGLFQKFR VRRQSRVLWI

451 VQNMQLHDFS LIAVNTVNVP QMPHPCQTVH TLTARVPKCR LKLNAARRQR

501 YNRPQLFXSE HHHDHDRTRQ RRCIPAAVQP PHPLGRNWHR RAAETFRRAY

551 FGRRLRRFGC RXPCPISPLP ASAR*
``` m509/a509 93.0% identity in 575 aa overlap

```
                 10         20         30         40         50         60
m509.pep MVAVCDKRAVQRTLMAQFAQQGGLFLLFVQAVVVFQACVLEKLGNHIGVFACVLAQVERH
         ||||||:|:|| |||||||||||||||||:||||||||||||||||||||||||||||||
a509     MVAVCDERTVQWTLMAQFAQQGGLFLLFVEAVVVFQACVLEKLGNHIGVFACVLAQVERH
                 10         20         30         40         50         60

70         80         90        100        110        120
m509.pep HVKAEHGYGTDEVCQTAFGKQTAAVVDKGTLQFFQIIQKLLCRSIRLEKAEFAAHTQTER
         ||:|||||||||||||||||:|||||||: ||||||| |:||||||||||||||||||||
a509     HVEAEHGYGTDEVCQTAFGKQAAAVVDKGMLQFFQIIEKFLCRSIRLEKAEFAAHTQTER
                 70         80         90        100        110        120
```

-continued

```
              130        140        150        160        170        180
m509.pep  ARFAHSARHNVGDGAAVGFFGAGDFFVGRFVGQRRYIAVDFDAADGERQFAVEFVEFAAI
          ||||||||||||:|:||||||| ||||||||||||||::|||||||||||||||||||::
a509      ARFAHSARHNVGNGATVGFFGAGGFFVGRFVGQRHHIAVDFDAADGERQFAVEFVEFATV
              130        140        150        160        170        180

190        200        210        220        230        240
m509.pep  EAEHGIGVAAEGKAQGFGRNKRIAVAVAADPAADFEDVRNADAGIGRLKVVFHLAVELGQ
          ::||||||||||:||||||:|||||||||||||||||||||| |||||||||||||||||
a509      KTEHGIGVAAEGKTQGFGRNERIAVAVAADPAADFEDVRNADIGIGRLKVVFHLAVELGQ
              190        200        210        220        230        240

250        260        270        280        290        300
m509.pep  GFEKAHREDGHAVVDFVVDAEFVAARFAGLPQAQQDSVDFAAQPCQRVGIGAAFALRQQC
          ||:||||:|||||||||||||||||||||||||||||||||||||||||:|||||||
a509      GFKKAHRKDGHAVVDFVVDAEFVAARFAGLPQAQQDSVDFAAQPCQRVGIGTAFALRQQR
              250        260        270        280        290        300

310        320        330        340        350        360
m509.pep  ADAAVEAXDGLALHFGRVRGQNGGNGRIVQLPLHRFAVGFPRFEPADGFRQAAFRAAASG
          ||||||  ||||||||||||||||||||||||||||||||||||||||||||||||||
a509      ADAAVEIQDGLALHFGRVRGQNGGNGRIVQLPLHRFAVGFPRFEPADGFRQAAFRAAASG
              310        320        330        340        350        360

370        380        390        400        410        420
m509.pep  FFVDLAAAFVVHVFGDVQNLGEQAAGQGXIVGLLFVQLRQYFFNQCRAVVGSGQEFDCFD
          ||||||||||||||||||||||||||||||||||||||||||||||||||||||||  ||
a509      FFVDLAAAFVVHVFGDVQNLGEQAAGQGXIVGLLFVQLRQYFFNQCRAVVGSGQEFDRFD
              370        380        390        400        410        420

430        440        450        460        470        480
m509.pep  NQRRGFFVQEVEQGLFQKFRVRRQSRVLWIVQNMQLHDFSLSSAVNIVNVPQMPHPCQTV
          ||||||||||||||||||||||||||||||||||||||||| ||| ||||||||||||||
a509      NQRRGFFVQEVEQGLFQKFRVRRQSRVLWIVQNMQLHDFSLI-AVNTVNVPQMPHPCQTV
              430        440        450        460        470

490        500        510        520        530        540
m509.pep  HTLTARVPKCRLKLNAARRQRYNRPQLFFSEHHHDHDRTQRRCIPAAVQPPHPLGRNRH
          ||||||||||||||||||||||||||||| |||||||||||||||||||||||||||||  |
a509      HTLTARVPKCRLKLNAARRQRYNRPQLFXSEHHHDHDRTQRRCIPAAVQPPHPLGRNWH
          480       490        500        510        520        530

550        560        570
m509.pep  RRAAETFRRAYFGRRLRRFGCRRTXPTLPLRVSARX
          ||||||||||||||||||||||||   |  ||:||||
a509      RRAAETFRRAYFGRRLRRFGCRXPCPISPLPASARX
          540       550        560        570
```

The following partial DNA sequence was identified in *N. gonorrhoeae* <SEQ ID 1399>:

```
g510.seq
  1 atgccttcgc ggacaccgca gggaaaaagg ggttattcct gccccaagcg 51 ggatagtgcc ttttggcagg cgttgtccat atcggttatt ttacgcgcaa 101 aatcgccgat tgccaaatcg ccgccgttca gggaggtttt caataggtcg 151 tggacgacgt tgagcgcggc cataatgacg attttttcgc tgtccgcgac 201 gcggccgcct tcgcggatgg cttcggcttt gccgttgagc attccgactg 251 cctgcaacag tgtgtctttt tcttctgccg gcgtgttgac agtcagccgg 301 ggcgtgcatg acttcgatgt agacttgttc gatgttcatc ctttaatcct 351 tattgctgcg tttcctgccg ttggggagg cgcgctgcca gtgcgctga
```

This corresponds to the amino acid sequence <SEQ ID 1400; ORF 510.ng>:

```
g510.pep
  1 MPSRTPQGKR GYSCPKRDSA FWQALSISVI LRAKSPIAKS PPFREVFNRS

51 WTTLSAAIMT IFSLSATRPP SRMASALPLS IPTACNSVSF SSAGVLTVSR

101 GVHDFDVDLF DVHPLILIAA FPAVGGGALP VR*
```

The following partial DNA sequence was identified in *N. meningitidis* <SEQ ID 1401>:

```
m510.seq
   1 ATGCCTTCGC GGACACCGCA GGGnAAAAGG GGTTATTCCT GCGCCAAGCG

51 GGATAGTGCT TTTTGGCAGG CGTTGTCCAT ATCGGCTATT TTACGCGCAA

101 AATCGCCGAT TGCCAAATCG CCGCCGTTCA GGGAGGTTTT CAACAGGTCG

151 TGGACGACGT TGAGCGCGGC CATAATGACG ATTTTTTCGC TGTCCGCGAC

201 GCGTCCGCCT TCGCGGATGG CTTCGGCTTT GCCGTTGAGC ATTCCGACTG

251 CCTGCAACAG TGTGTCTTTT TCTTCTGCCG GCGTGTTGAC GGTCAGCCGG

301 GGCGTGCAwG ACTTCsAtGT GGACTTGTTC GATGTTCATC CTTTAATCCT

351 TATTGCTGCG TTTCCTGCCA TTGGGGGAGG CGCGCTGCCA GTGCGCTGA
```

This corresponds to the amino acid sequence <SEQ ID 1402; ORF 510>:

```
m510.pep
   1 MPSRTPQGKR GYSCAKRDSA FWQALSISAI LRAKSPIAKS PPFREVFNRS

51 WTTLSAAIMT IFSLSATRPP SRMASALPLS IPTACNSVSF SSAGVLTVSR

101 GVXDFXVDLF DVHPLILIAA FPAIGGGALP VR*
```

Computer analysis of this amino acid sequence gave the following results:

Homology with a Predicted ORF from *N. gonorrhoeae*

ORF 510 shows 96.2% identity over a 132 aa overlap with a predicted ORF (ORF 510.ng) from *N. gonorrhoeae*:

```
m510/g510
                    10        20        30        40        50        60
m510.pep    MPSRTPQGKRGYSCAKRDSAFWQALSISAILRAKSPIAKSPPFREVFNRSWTTLSAAIMT
            |||||||||||||| ||||||||||||:||||||||||||||||||||||||||||||||
g510        MPSRTPQGKRGYSCPKRDSAFWQALSISVILRAKSPIAKSPPFREVFNRSWTTLSAAIMT
                    10        20        30        40        50        60

70        80        90       100       110       120
m510.pep    IFSLSATRPPSRMASALPLSIPTACNSVSFSSAGVLTVSRGVXDFXVDLFDVHPLILIAA
            |||||||||||||||||||||||||||||||||||||||||| || ||||||||||||||
g510        IFSLSATRPPSRMASALPLSIPTACNSVSFSSAGVLTVSRGVHDFDVDLFDVHPLILIAA
                    70        80        90       100       110       120

130
m510.pep    FPAIGGGALPVRX
            |||:|||||||||
g510        FPAVGGGALPVRX
                   130
```

The following partial DNA sequence was identified in *N. meningitidis* <SEQ ID 1403>:

```
a510.seq
   1 ATGCCTTCGC GGACACCGCA GGGAAAAAGG GGTTATTCCT GCGCCAAGCG

51 GGATAGTGCT TTTTGGCAGG CGTTGTCCAT ATCGGCTATT TTACGCGCAA

101 AATCGCCGAT TGCCAAATCG CCGCCGTTCA GGGAGGTTTT CAACAGGTCG

151 TGGACGACGT TGAGCGCGGC CATAATGACG ATTTTTTCGC TGTCCGCGAC

201 GCGTCCGCCT TCGCGGATGG CTTCGGCTTT GCCGTTGAGC ATTCCGACTG

251 CCTGCAACAG TGTGTCTTTT TCTTCTGCCG GCGTGTTGAC GGTCAGCCGG

301 G.CGTGCATG ACTTCGATGT GGACTTGTTC GATGTTCATC CTTTAATCCT

351 TATTGCTGCG TTTCCTGCCG TTGGGGGAGG CGCGCTGCCA GTGCGCTGA
```

This corresponds to the amino acid sequence <SEQ ID 1404; ORF 510.a>:

```
a510.pep
   1 MPSRTPQGKR GYSCAKRDSA FWQALSISAI LRAKSPIAKS PPFREVFNRS

51 WTTLSAAIMT IFSLSATRPP SRMASALPLS IPTACNSVSF SSAGVLTVSR

101 XVHDFDVDLF DVHPLILIAA FPAVGGGALP VR*
``` m510/a510 97.0% identity in 132 aa overlap

```
                   10        20        30        40        50        60
    m510.pep  MPSRTPQGKRGYSCAKRDSAFWQALSISAILRAKSPIAKSPPFREVFNRSWTTLSAAIMT
              ||||||||||||||||||||||||||||||||||||||||||||||||||||||||||||
    a510      MPSRTPQGKRGYSCAKRDSAFWQALSISAILRAKSPIAKSPPFREVFNRSWTTLSAAIMT
                   10        20        30        40        50        60
                   70        80        90       100       110       120
    m510.pep  IFSLSATRPPSRMASALPLSIPTACNSVSFSSAGVLTVSRGVXDFXVDLFDVHPLILIAA
              |||||||||||||||||||||||||||||||||||||||  |  ||||||||||||||||
    a510      IFSLSATRPPSRMASALPLSIPTACNSVSFSSAGVLTVSRXVHDFDVDLFDVHPLILIAA
                   70        80        90       100       110       120
                  130
    m510.pep  FPAIGGGALPVRX
              |||:|||||||||
    a510      FPAVGGGALPVRX
                  130
```

The following partial DNA sequence was identified in *N. gonorrhoeae* <SEQ ID 1405>:

```
g512.seq
   1 atgaaagtgc ttgttttagg tgcgggtgtt gccggcgtat cctccgtgtg 51 gtatctggca gaggccggac atgaagtaac ggtcatcgac cgcaccgagg 101 gtgtggcgat ggaaaccagt tttgccaatg caggccagct ttcttacggc 151 tataccacgc cttgggctgc acccggtatt ccgaccaaag cactgaaacg 201 gctgtttaaa agccatccgc ctttactgtt ccgccctgac ggcggcctgt 251 atcaaatcga atggctgtgg cggatgctgc aaaactgcac ggcaacgcgc 301 tatcaaatca ataaagagcg catggtcagg atttccgaat acagccgtga 351 aatgttccgc cgttttgaag cgcaaaccga catgaatttt gagggacgca 401 aaaaagggac gttgcagatt ttccgccaaa ccgaagaagt cgaagcggca 451 aaacaagaca ttgccgtttt ggaacgctac ggcgtgccgt accgccgtct 501 gaagcccgaa gaatgcgcag aattcgagcc tgcgctggca cgcgttaccg 551 ccaaaattgt cggcggtctg cacctgcctg cggatgcgac cggcgactgc 601 cgcctcttca ccgaaaacct gtacaaattg tgtcaagaga aggggtacg 651 gttctacttc aaccaaacca tcagccgcat cgaccacaac gggctgcgca 701 tcaaagccgt tgaaacgaaa cagggcggtt tgaaacagat gccgttgtct 751 gcgcgctcgg ctgcttcagc aggactgtgt tggcgcagtt ggatctcaat 801 ctgcccattt atcccgtcaa aggctattcc ttga
```

This corresponds to the amino acid sequence <SEQ ID 1406; ORF 512.ng>:

```
g512.pep
   1 MKVLVLGAGV AGVSSVWYLA EAGHEVTVID RTEGVAMETS FANAGQLSYG

51 YTTPWAAPGI PTKALKRLFK SHPPLLFRPD GGLYQIEWLW RMLQNCTATR
```

```
101 YQINKERMVR ISEYSREMFR RFEAQTDMNF EGRKKGTLQI FRQTEEVEAA

151 KQDIAVLERY GVPYRRLKPE ECAEFEPALA RVTAKIVGGL HLPADATGDC

201 RLFTENLYKL CQEKGVRFYF NQTISRIDHN GLRIKAVETK QGGLKQMPLS

251 ARSAASAGLC WRSWISICPF IPSKAIP*
```

The following partial DNA sequence was identified in *N. meningitidis* <SEQ ID 1407>:

```
m512.seq (partial)
    1 ..GTTTTGGAAC GCTACGGCGT GCCGTACCGC CGTCTGAAAC CCGAAGAATG

51    TGCAGAATTT GAGCCTGCGC TGGCACGCGT TACCGCCAAA ATTGCCGGCG

101    GCCTGCACCT GCCTGCAGAT GCGACCGGCG ACTggCGCCT CTTCACTGAA

151    AACCTATACA AATTGTGTCA GGAAAAGGGC GTACGGTTTC ATTTCAACCA

201    AAACATCAGC CGCATCGACC ACAACGGGCT GCGCATCAAA ACCGTTGAAA

251    CCAAACAGGG CGGTTTGAAG CAGATGCCGT TGTCTGCGCG CTCGGTTGCT

301    TCAGCAGGAC GGTTTTGGCG CAGTTGGATC TCAATCTGCC CATTTATCCC

351    GTCAAAGGCT ATTCCTTGA
```

This corresponds to the amino acid sequence <SEQ ID 1408; ORF 512>:

```
m512.pep (partial)
    1 ..VLERYGVPYR RLKPEECAEF EPALARVTAK IAGGLHLPAD ATGDWRLFTE

51    NLYKLCQEKG VRFHFNQNIS RIDHNGLRIK TVETKQGGLK QMPLSARSVA

101    SAGRFWRSWI SICPFIPSKA IP*
```

Computer analysis of this amino acid sequence gave the following results:
Homology with a Predicted ORF from *N. gonorrhoeae*
ORF 512 shows 93.4% identity over a 122 aa overlap with a predicted ORF (ORF 512.ng) from *N. gonorrhoeae*:

```
m512/g512
                                                       10         20         30
    m512.pep                                  VLERYGVPYRRLKPEECAEFEPALARVTAK
                                              ||||||||||||||||||||||||||||||
       g512   TDMNFEGRKKGTLQIFRQTEEVEAAKQDIAVLERYGVPYRRLKPEECAEFEPALARVTAK
                  130        140        150        160        170        180

40         50         60         70         80         90
    m512.pep   IAGGLHLPADATGDWRLFTENLYKLCQEKGVRFHFNQNISRIDHNGLRIKTVETKQGGLK
               |:||||||||||| |||||||||||||||||:|||:||||||||||||:||||||||||
       g512    IVGGLHLPADATGDCRLFTENLYKLCQEKGVRFYFNQTISRIDHNGLRIKAVETKQGGLK
                  190        200        210        220        230        240

100        110        120
    m512.pep   QMPLSARSVASAGRFWRSWISICPFIPSKAIP
               ||||||||:||||  ||||||||||||||||
       g512    QMPLSARSAASAGLCWRSWISICPFIPSKAIP
                  250        260        270
```

The following partial DNA sequence was identified in *N. meningitidis* <SEQ ID 1409>:

```
a512.seq
    1 ATGAAAGTGC TTGTTTTAGG TGCTGGTGTT GCCGGCGTAT CTTCCGCGTG

51 GTATCTGGCA GAGGCAGGAC ATGAAGTAAC GGTCATCGAC CGCGCCGAGG

101 GCGTGGCGAT GGAAACCAGT TTTGCCAACG CAGGCCAGCT TTCTTACGGC
```

```
151 TATACCACGC CTTGGGCTGC ACCCGGTATT CCGACCAAAG CACTGAAATG

201 GCTGTTTAAA AGCCATCCGC CTTTGCTGTT TCGCCCCGAC GGCAGCCTGT

251 ATCAAATCGA ATGGCTGTGG CAGATGCTGC AACACTGCAC GGCAGCGCGC

301 TATCAAATCA ATAAAGAGCG CATGGTCAGG ATGTCCGAAT ACAGCCGTGA

351 AATGTTCCGC CGTTTTGAAG CGCAAACCGG CATGAATTTT GAGGGACGCA

401 AAAAAGGGAC GTTGCAGATT TTCCGCCAAA CCAAAGAAGT CGAAGCGGCA

451 AAACAAGACA TTGCCGTTTT GGAACGCTAC GGCGTGCCGT ACCGCCGTCT

501 GAAGCCCGAA GAATGCGCAG AATTCGAGCC TGCGCTGGCA CGCGTTACCG

551 CCAAAATTGC CGGCGGCCTG CACCTGCCCG CAGACGCGAC CGGCGACTGC

601 CGCCTCTTCA CTGAAAACCT GTACAAATTG TGTCAGGAAA AGGGCGTACG

651 GTTTCATTTC AACCAAACCA TCAGCCGCAT CGACCACAAC GGGCTGCGCA

701 TCAAAACCGT TGAAACGAAA CAGGGCGGTT TGAAGCAGAT GCCGTTGTCT

751 GCGCGCTCGG CTGCTTCAGC AGGACGGTTT TGGCGCAAGT GGATCTCAAT

801 CTGCCGATTT ATCCCGTCAA AGGCTATTCC TTGA
```

This corresponds to the amino acid sequence <SEQ ID 1410; ORF 512.a>:

```
a512.pep
  1 MKVLVLGAGV AGVSSAWYLA EAGHEVTVID RAEGVAMETS FANAGQLSYG

51 YTTPWAAPGI PTKALKWLFK SHPPLLFRPD GSLYQIEWLW QMLQHCTAAR

101 YQINKERMVR MSEYSREMFR RFEAQTGMNF EGRKKGTLQI FRQTKEVEAA

151 KQDIAVLERY GVPYRRLKPE ECAEFEPALA RVTAKIAGGL HLPADATGDC

201 RLFTENLYKL CQEKGVRFHF NQTISRIDHN GLRIKTVETK QGGLKQMPLS

251 ARSAASAGRF WRKWISICRF IPSKAIP*
``` m512/a512 95.9% identity in 122 aa overlap

```
                                          10        20        30
    m512.pep                      VLERYGVPYRRLKPEECAEFEPALARVTAK
                                  |||||||||||||||||||||||||||||
    a512     TGMNFEGRKKGTLQIFRQTEEVEAAKQDIAVLERYGVPYRRLKPEECAEFEPALARVTAK
                 130       140       150       160       170       180
                   40        50        60        70        80        90
    m512.pep IAGGLHLPADATGDWRLFTENLYKLCQEKGVRFHFNQNISRIDHNGLRIKTVETKQGGLK
            ||||||||||||||| |||||||||||||||||||||:||||||||||||||||||||||
    a512    IAGGLHLPADATGDCRLFTENLYKLCQEKGVRHHFNQTISRIDHNGLRIKTVETKQGGLK
                 190       200       210       220       230       240
                  100       110       120
    m512.pep QMPLSARSVASAGRFWRSWISICPFIPSKAIP
            ||||||||:|||||||||:|||| ||||||||
    a512    QMPLSARSAASAGRFWRKWISICRFIPSKAIP
                 250       260       270
```

The following partial DNA sequence was identified in *N. gonorrhoeae* <SEQ ID 1411>:

```
g513.seq
  1 ATGGGTTCCG CGCCGAACGC CGCCGCCGCC GCCGAAGTGA AACACCCTGT

51 TTCGCAAGGT ATGATTCAAA TGCTGGGCGT GTTTGTCGAT ACCATCATCG

101 TTTGTTCTTG CACCGCCTTC ATCATCTTGA TTTACCAACA GCCTTATGGC

151 GATTTGAGCG GTGCGGCGCT GAcgcAGGCG GCGATTGTCA GCCAAGTGGG
```

-continued

```
201 GCAATGGGGC GCGGGTTTCC TCGCCGTCAT CCTGTTTATG TTTGCCTTTT

251 CCACCGTTAT CGGCAACTAT GCCTATGCCG AGTCCAACGT CCAATTCATC

301 AAAAGCCATT GGCTGATTAC CGCCGTTTTC CGTATGCTGG TTTTGGCGTG

351 GGTCTATTTC GGCGCGGTTG CCAATGTGCC TTTGGTCTGG GATATGGCGG

401 ATATGGCGAT GGGCATCATG GCGTGGATCA ACCTCGTCGC CATCCTGCTG

451 CTCTCGCCat TGGCGTTTAT GCTGCTGCGC GATTACACCG CCAAGCTGAA

501 AATGGGCAAA GACCCCGAGT TCAAACTTTc cgAACATCCG GGCCTGAAAC

551 GCCGCATCAA ATCCGATGTT TGGTAA
```

This corresponds to the amino acid sequence <SEQ ID 1412; ORF 513.ng>:

```
g513.pep
  1 MGSAPNAAAA AEVKHPVSQG MIQMLGVFVD TIIVCSCTAF IILIYQQPYG

51 DLSGAALTQA AIVSQVGQWG AGFLAVILFM FAFSTVIGNY AYAESNVQFI

101 KSHWLITAVF RMLVLAWVYF GAVANVPLVW DMADMAMGIM AWINLVAILL

151 LSPLAFMLLR DYTAKLKMGK DPEFKLSEHP GLKRRIKSDV W*
```

The following partial DNA sequence was identified in N. meningitidis <SEQ ID 1413>:

```
m513.seq
  1 ATGGGTTCCG CGCCGAACGC CGCCGCCGCC GCCGAAGTGA AACACCCTGT

51 TTCGCAAGGT ATGATTCAAA TGCTGGGCGT GTTTGTCGAT ACCATCATCG

101 TTTGTTCTTG CACCGCCTTC ATCATCTTGA TTTACCAACA GCCTTATGGC

151 GATTTGAGCG GTGCGGCGCT GAcgcAGGCG GCGATTGTCA GCCAAGTGGG

201 GCAATGGGGC GCGGGTTTCC TCGCCGTCAT CCTGTTTATG TTTGCCTTTT

251 CCACCGTTAT CGGCAACTAT GCCTATGCCG AGTCCAACGT CCAATTCATC

301 AAAAGCCATT GGCTGATTAC CGCCGTTTTC CGTATGCTGG TTTTGGCGTG

351 GGTCTATTTC GGCGCGGTTG CCAATGTGCC TTTGGTCTGG GATATGGCGG

401 ATATGGCGAT GGGCATCATG GCGTGGATCA ACCTCGTCGC CATCCTGCTG

451 CTCTCGCCat TGGCGTTTAT GCTGCTGCGC GATTACACCG CCAAGCTGAA

501 AATGGGCAAA GACCCCGAGT TCAAACTTTc cgAACATCCG GGCCTGAAAC

551 GCCGCATCAA ATCCGATGTT TGGTAA
```

This corresponds to the amino acid sequence <SEQ ID 1414; ORF 513>:

```
m513.pep
  1 MGSAPNAAAA AEVKHPVSQG MIQMLGVFVD TIIVCSCTAF IILIYQQPYG

51 DLSGAALTQA AIVSQVGQWG AGFLAVILFM FAFSTVIGNY AYAESNVQFI

101 KSHWLITAVF RMLVLAWVYF GAVANVPLVW DMADMAMGIM AWINLVAILL

151 LSPLAFMLLR DYTAKLKMGK DPEFKLSEHP GLKRRIKSDV W*
```

Computer analysis of this amino acid sequence gave the following results:

Homology with a Predicted ORF from *N. gonorrhoeae*
ORF 513 shows 99.5% identity over a 191 aa overlap with a predicted ORF (ORF 513.ng) from *N. gonorrhoeae*:

```
m513/g513
                   10         20         30         40         50         60
  m513.pep  MGSAPNAAAAAEVKHPVSQGMIQMLGVFVDTIIVCSCTAFIILIYQQPYGDLSGAALTQA
            ||||||||||||||||||||||||||||||||||||||||||||||||||||||||||||
     g513   MGSAPNAAAAAEVKHPVSQGMIQMLGVFVDTIIVCSCTAFIILIYQQPYGDLSGAALTQA
                   10         20         30         40         50         60

70         80         90        100        110        120
  m513.pep  AIVSQVGQWGAGFLAVILFMFAFSTVIGNYAYAESNVQFIKSHWLITAVFRMLVLAWVYF
            ||||||||||||||||||||||||||||||||||||||||||||||||||||||||||||
     g513   AIVSQVGQWGAGFLAVILFMFAFSTVIGNYAYAESNVQFIKSHWLITAVFRMLVLAWVYF
                   70         80         90        100        110        120

130        140        150        160        170        180
  m513.pep  GAVANVPLVWDMADMAMGIMAWINLVAILLLSPLAFMXLRDYTAKLKMGKDPEFKLSEHP
            |||||||||||||||||||||||||||||||||||| |||||||||||||||||||||||
     g513   GAVANVPLVWDMADMAMGIMAWINLVAILLLSPLAFMLLRDYTAKLKMGKDPEFKLSEHP
                  130        140        150        160        170        180

190
  m513.pep  GLKRRIKSDVW
            |||||||||||
     g513   GLKRRIKSDVW
                  190
```

The following partial DNA sequence was identified in *N. meningitidis* <SEQ ID 1415>:

```
a513.seq
    1 ATGAACGAGA ACTTTACCGA ATGGCTGCAC GGCTGGGTCG GCGCCATCAA

51 CGATCCGATG TGGTCATACT TGGTTTATNT GCTTTTGGGT ACGGGGCTTT

101 TCTTCACCGT AACCACGGGC TTTGTCCAAT TCCGCCTGTT CGGGCGCAGC

151 ATCAAAGAAA TGCTCGGCGG CCGCAAACAG GGGGACGACC CTCACGGCAT

201 CACGCCGTTT CAGGCATTTG TAACCGGCCT TGCCAGCCGC GTGGGCGTGG

251 GCAATATCGC GGGCGTGGCC ATCGCCATCA AGTCGGCGG ACCGGGCGCG

301 GTGTTTTGGA TGTGGGTAAC CGCCTTAATC GGTATGAGTT CGGCGTTTGT

351 CGAATCTTCG CTGGCGCAGC TCTTTAAAGT CCGCGACTAC GACAACCACC

401 ATTTCCGGGG CGGCCCTGCC TACTACATCA CTCAAGGGCT GGGGCAGAAA

451 TGGCTGGGCG TGTTGTTCGC CCTGAGCCTG ATTTTCTGTT TCGGCTTTGT

501 GTTTGAAGCG GTTCAGACCA ATACCATTGC CGATACCGTC AAAGCGGCGT

551 GGGGTTGGGA GCCTCATTAT GTCGGCGTCG CCCTGGTGAT TTTAACCGCG

601 CCGATTATCT TCGGCGGCAT CAGGCGCATA TCTAAAGCGG CGGAAATCGT

651 CGTCCCCCTG ATGGCGGTTT TGTACCTCTT TATCGCGCTT TTCATCATTT

701 TGACCAATAT TCCGATGATT CCGGACGTGT TCGGTCAGAT TTTTTCGGGC

751 GCGTTCAAAT TCGACGCGGC AGCAGGCGGC TTACTCGGCG GTCTGATTTC

801 GCAAACGATG ATGATGGGCA TCAAACGCGG CCTGTATTCC AACGAGGCGG

851 GTATGGGTTC CGCGCCGAAC GCCGCCGCCG CCGCCGAAGT GAAACACCCT

901 GTTTCGCAAG GTATGATTCA AATGCTGGGC GTGTTTGTCG ATACCATCAT

951 CGTTTGTTCT TGCACCGCCT TCATCATCTT GATTTACCAA CAGCCTTACG

1001 GCGATTTGAG CGGTGCGGCG CTGACGCAGG CGGCGATTGT CAGCCAAGTG

1051 GGGCAATGGG GCGCGGGCTT CCTCGCCGTC ATCCTGTTTA TGTTTGCCTT
```

-continued

```
1101 TTCCACCGTT ATCGGCAACT ATGCCTATGC CGAGTCCAAC GTCCAATTCA

1151 TCAAAAGCCA TTGGCTGATT ACCGCCGTTT TCCGTATGCT GGTTTTGGCG

1201 TGGGTCTATT TCGGCGCGGT TGCCAATGTG CCTTTGGTCT GGGATATGGC

1251 GGATATGGCG ATGGGCATTA TGGCGTGGAT CAACCTTGTC GCCATCCTGC

1301 TGCTCTCGCC CTTGGCGTTT ATGCTGCTGC GCGATTACAC CGCCAAGCTG

1351 AAAATGGGCA AGACCCCGA GTTCAAACTT TCCGAACATC CGGGCCTGAA

1401 ACGCCGTATC AAATCCGACG TTTGGTAA
```

This corresponds to the amino acid sequence <SEQ ID 1416; ORF 513.a>:

```
a513.pep
  1 MNENFTEWLH GWVGAINDPM WSYLVYXLLG TGLFFTVTTG FVQFRLFGRS

51 IKEMLGGRKQ GDDPHGITPF QAFVTGLASR VGVGNIAGVA IAIKVGGPGA

101 VFWMWVTALI GMSSAFVESS LAQLFKVRDY DNHHFRGGPA YYITQGLGQK

151 WLGVLFALSL IFCFGFVFEA VQTNTIADTV KAAWGWEPHY VGVALVILTA

201 PIIFGGIRRI SKAAEIVVPL MAVLYLFIAL FIILTNIPMI PDVFGQIFSG

251 AFKFDAAAGG LLGGLISQTM MMGIKRGLYS NEAGMGSAPN AAAAAEVKHP

301 VSQGMIQMLG VFVDTIIVCS CTAFIILIYQ QPYGDLSGAA LTQAAIVSQV

351 GQWGAGFLAV ILFMFAFSTV IGNYAYAESN VQFIKSHWLI TAVFRMLVLA

401 WVYFGAVANV PLVWDMADMA MGIMAWINLV AILLLSPLAF MLLRDYTAKL

451 KMGKDPEFKL SEHPGLKRRI KSDVW*
``` m513/a513 100.0% identity in 191 aa overlap

```
                            10        20        30
  m513.pep                  MGSAPNAAAAAEVKHPVSQGMIQMLGVFVD
                            ||||||||||||||||||||||||||||||
  a513     DAAAGGLLGGLISQTMMMGIKRGLYSNEAGMGSAPNAAAAAEVKHPVSQGMIQMLGVFVD
              260       270       280       290       300       310

40        50        60        70        80        90
  m513.pep  TIIVCSCTAFIILIYQQPYGDLSGAALTQAAIVSQCGQWGAGFLAVILFMFAFSTVIGNY
             ||||||||||||||||||||||||||||||||||||||||||||||||||||||||||||
  a513      TIIVCSCTAFIILIYQQPYGDLSGAALTQAAIVSQCGQWGAGFLAVILFMFAFSTVIGNY
              320       330       340       350       360       370

100       110       120       130       140       150
  m513.pep  AYAESNVQFIKSHWLITAVFRMLVLAWVYFGAVANVPLVWDMADMAMGIMAWINLVAILL
             ||||||||||||||||||||||||||||||||||||||||||||||||||||||||||||
  a513      AYAESNVQFIKSHWLITAVFRMLVLAWVYFGAVANVPLVWDMADMAMGIMAWINLVAILL
              380       390       400       410       420       430

160       170       180       190
  m513.pep  LSPLAFMLLRDYTAKLKMGKDPEFKLSEHPGLKRRIKSDVWX
             ||||||||||||||||||||||||||||||||||||||||||
  a513      LSPLAFMLLRDYTAKLKMGKDPEFKLSEHPGLKRRIKSDVWX
              440       450       460       470
```

55

The following partial DNA sequence was identified in *N. gonorrhoeae* <SEQ ID 1417>:

```
g515.seq
  1 atggttcaaa tacaggttgt gcgcgccgcc ggcgttgccc gtggtctgca 51 ttccgagttt gcgcgcgctg taactgccga ggaaatagcc ttcgacaatg 101 ccgttttgaa tcacgaagcg cggcgcggtg gcaacacctt ccgcatcaaa 151 atagctgctg cggaaagagc gggggatgtg cggttcttcg cgcaggttga
```

-continued
```
 201 ggaaatcggg caggactttt tgccgatgc tgtcgatcag gaaactgctt 251 tggcggtaga gcgcgccgcc ggagagtgtg ccgacgaggt gtccgatcag 301 cccgcccgaa acggtggtat cgaagaggac ggggtagctg cctgtcggga 351 tgctgcggct gccgagtcgg cgcaaagtgc ggcgggcggc ggtttgaccg 401 atggtttcgg ggctgtccat atccggatgg cggcaggcgg aatcgtacca 451 gtagtcgcgc tgcattccgt tttcgtcggc ggcgacgacg ctgcaggaaa 501 tgctgtggtg cgtgctttgc cggtgtgcgg caaaaccgtg ggtgttgccg 551 taaacgtatt ggtactgtcc ggtttgcacc gccgcgcctt cggagttttc 601 gatgcggctg tccgtgtcca acgctgcctg ttcgcattgt tttgccaagc 651 cgacggcggc ttccgtatcc aaatcccatt cgtggtaaag gtcggggtcg 701 ccgatgtgtt gcgccatcaa ctcggggtcg gcaagtccgg cgcaaccgtc 751 ttcggcggtg tggcgggcga tgtcggcggc ggcgcggacg tgtcgcgca 801 gggcttgttc ggagaagtcg gcggtgccgg cgcggccttt gcgtttgccg 851 acgtaaacgg taatgtccag cgatttgtcc tgctggaact cgatttgttc 901 gatttcgccc aagcgcacgc tgacgctttg tccgagcgat tcgctgaagt 951 cggcttcggc ggcggtcgcg cccgctgctt ttgccaagtc gagcgtgcgg 1001 cggcagaggt cgaggagttc ggaagcggtg tggttgaaca gcataacaat 1051 ctttcttggt ggagcgttgt ggcattttaa
```

This corresponds to the amino acid sequence <SEQ ID 1418; ORF 515.ng>:

```
g515.pep
  1 MVQIQVVRAA GVARGLHSEF ARAVTAEEIA FDNAVLNHEA RRGGNTFRIK

51 IAAAERAGDV RFFAQVEEIG QDFFADAVDQ ETALAVERAA GECADEVSDQ

101 PARNGGIEED GVAACRDAAA AESAQSAAGG GLTDGFGAVH IRMAAGGIVP

151 VVALHSVFVG GDDAAGNAVV RALPVCGKTV GVAVNVLVLS GLHRRAFGVF

201 DAAVRVQRCL FALFCQADGG FRIQIPFVVK VGVADVLRHQ LGVGKSGATV

251 FGGVAGDVGG GADGVAQGLF GEVGGAGAAF AFADVNGNVQ RFVLLELDLF

301 DFAQAHADAL SERFAEVGFG GGRARCFCQV ERAAAEVEEF GSGVVEQHNN

351 LSWWSVVAF*
```

The following partial DNA sequence was identified in *N. meningitidis* <SEQ ID 1419>:

```
m515.seq (partial)
  1 ..GGAAAGAGCG GGGATGTGC GTTCTTCGCG CAGGTTGAGG AAATCGGGCA

51    GGACTTTTCT GCCGATGCTG TCGATCAGGA AACTGCTTTG GCGGTAGAGC

101    GCGCCGCCGG AGAGTGCGCC GACGAGGTGT CCGATAAGAC CGCCCGAAAC

151    GGTGGTATCG AAGAGGACGG GGTAGCTGCC TGTCGGGATG CTGCGGCTGC

201    CGAGTCGGCG CAAAGTGCGG CGGGCGGCGG TTTGACCGAT GGTTTCGGGG

251    CTGTCCATAT CCGGATGGCG GCAGGCGGAA TCGTACCAGT AGTCGCGCTG

301    CATGCCGTTT TCGTCGGCGG CAACGACGCT GCAGGAAATG CTGTGGTGCG

351    TGCCTTGCCG GTGTGCGGCA AAACCGTGGG TGTTGCCGTA AACGTATTGG
```

-continued

```
401   TAATGGCCGG TTTGCACCGC CGCGCCTTCG GAGTTTTCGA TGCGCTCATC
451   CTCGTTCAGG GCGGCTTGTT CGCATTGTTT TGCCAAGCCG ACGGCGGCTk
501   CCGTATCCAA ATCCCATTCG TGGTAAAGGT CGGGGTCGCC GATGTGTTTT
551   GCCATCAGAC AGGCATCGGC AAGTCCGGCG CAACCGTCTT CGGCGGTGTG
601   GCGGGCGATG TCGATGGCGG CTTTGACGGT GTCTTGCAGG GCTTTTTCGG
651   AGAAGTCGGC AGTACTGGCG CGGCCTTTGC GTTTGCCGAC GTAAACGGTA
701   ATGTCCAGCG ACTTGTCCTG CTGGAACTCG ATTTGTTsGA TTTsGCCCAG
751   CCGCACGCTG ACGCTTTGTC CCAATGATTC GCTGAAATCG GCTTCGGCGG
801   CGGTTGCGCC CGTCGCTTTT GCCAAGTCGA GCGTGCGGCG GCAGAGGTCG
851   AGGAGTTCGG AAGCGGTGTG GTTgAACAGC ATAGAAATCT TCTTGATGA
901   TGCTTTGCGG CATTTTAA
```

This corresponds to the amino acid sequence <SEQ ID 1420; ORF 515>:

```
m515.pep (partial)
  1  ..GKSGGCAFFA QVEEIGQDFS ADAVDQETAL AVERAAGECA DEVSDKTARN

51   GGIEEDGVAA CRDAAAAESA QSAAGGGLTD GFGAVHIRMA AGGIVPVVAL

101   HAVFVGGNDA AGNAVVRALP VCGKTVGVAV NVLVMAGLHR RAFGVFDALI

151   LVQGGLFALF CQADGGXRIQ IPFVVKVGVA DVFCHQTGIG KSGATVFGGV

201   AGDVDGGFDG VLQGFFGEVG STGAAFAFAD VNGNVQRLVL LELDLXDXAQ

251   PHADALSQXF AEIGFGGGCA RRFCQVERAA AEVEEFGSGV VEQHRNLSXX

301   CFAAF*
```

Computer analysis of this amino acid sequence gave the following results:
Homology with a Predicted ORF from *N. gonorrhoeae*
ORF 515 shows 85.9% identity over a 304 aa overlap with a predicted ORF (ORF 515.ng) from *N. gonorrhoeae*:

```
m515/g515
                                       10         20         30
      m515.pep                    GKSGGCAFFAQVEEIGQDFSADAVDQETALA
                                 ::|   ||||||||||| ||||||||||||
      g515     AEEIAFDNAVLNHEARRGGNTFRIKIAAAERAGDVRFFAQVEEIGQDFFADAVDQETALA
                30         40         50         60         70         80

40         50         60         70         80         90
      m515.pep  VERAAGECADEVSDKTARNGGIEEDGVAACRDAAAAESAQSAAGGGLTDGFGAVHIRMAA
                ||||||||||||||:  ||||||||||||||||||||||||||||||||||||||||||
      g515      VERAAGECADEVSDQPARNGGIEEDGVAACRDAAAAESAQSAAGGGLTDGFGAVHIRMAA
                         90        100        110        120        130        140

100        110        120        130        140        150
      m515.pep  GGIVPVVALHAVFVGGNDAAGNAVVRALPVCGKTVGVAVNVLVMAGLHRRAFGVFDALIL
                ||||||||||:|||||:|||||||||||||||||||||||||||::||||||||||  :
      g515      GGIVPVVALHSVFVGGDDAAGNAVVRALPVCGKTVGVAVNVLVLSGLHRRAFGVFDAAVR
                         150        160        170        180        190        200

160        170        180        190        200        210
      m515.pep  VQGGLFALFCQADGGXRIQIPFVVKVGVADVFCHQTGIGKSGATVFGGVAGDVDGGFDGV
                ||  |||||||||||  ||||||||||||||| ||  |:|||||||||||||  || |||
      g515      VQRCLFALFCQADGGFRIQIPFVVKVGVADVLRHQLGVGKSGATVFGGVAGDVGGGADGV
                         210        220        230        240        250        260
```

-continued

```
                        220       230       240       250       260       270
m515.pep        LQGFFGEVGSTGAAFAFADVNGNVQRLVLLELDLXDXAQPHADALSQXFAEIGFGGGCAR
                 ||:|||||::|||||||||||||||:||||||| | || ||||||: |||:||||| ||
g515            AQGLFGEVGGAGAAFAFADVNGNVQRFVLLELDLXDFAQAHADALSERFAEVGFGGGRAR
                  270       280       290       300       310       320

280       290       300
m515.pep        RFCQVERAAAEVEEFGSGVVEQHRNLSXXCFAAF
                 |||||||||||||||||||||| |||    :||
g515            CFCQVERAAAEVEEFGSGVVEQHNNLSWWSVVAF
                  330       340       350
```

The following partial DNA sequence was identified in *N. meningitidis* <SEQ ID 1421>:

```
a515.seq
     1  ATGGTTCAAA TAAAGGTTGT GCGCGCCGCC GGCGTTGCCC GTGGTCTGCA

51  TTCCGAGTTT GCGCGCGCTG TAACTGCTGA GGAAATAGCC TTCGACAATG

101  CCGTTTTGAA TCACGAAGCG CGGTGCGGTG GCAACGCCTT CCGCATCAAA

151  ATAGCTGCTG CGGAAAGAGC GGGGGATGTG CGGTTCTTCG CGCAGGTTGA

201  GGAAATCGGG CAGGACTTTT TTGCCGATGC TGTCGATCAG GAAACTGCTT

251  TGGCGGTAGA GCGCTCCGCC GGAGAGTGCG CCGACGAGGT GTCCGATAAG

301  ACCGCCCGAA ACGGTGGTAT CGAAGAGGAC GGGGTAGTTG CCTGTCGGGA

351  TGCTGCGGCT GCCGAGTCGG CGCAAAGTGC GGCGGGCGGC GGTTTGACCG

401  ATGGTTTCGG GGCTGTCCAT ATCCGGATGG CGGCAGGCGG AATCGTACCA

451  GTAGTCGCGC TGCATGCCGT TTTCGTCGGC GGCAACGACG CTGCAGGAAA

501  TGCTGTGGTG CGTGCTTTGC CGGTGTGCGG CAAAACCGTA GGTGTTGCCG

551  TAAACGTATT GGTAATGGCC GGTTTGCACC GCCGCGCCTT CGGAGTTTTC

601  GATGCGCTCA TCCTCGTTCA GGGCGGCTTG TTCGCATTGT TTTGCCAAGC

651  CGACGGCGGC TTCCGTATCC AAATCCCATT CGTGGTAAAG GTCGGGGTCG

701  CCGATGTGTT GCGCCATCAA CTCGGGGTCG GCAAGTCCGG CGCAACCGTC

751  TTCGGCGGTG TGGCGGGCGA TGTCNNNNGC GGCGCGGACG GTGTCGCGCA

801  GGGCTTGTTC GGAGAAATCG GCGGTGCCGG CGCGGCCTTT GCGTTTGCCG

851  ACGTAAACGG TAATGTCCAG CGACTTGTCC TGCTGAAACT CGATTTGTTC

901  GATTTCGCCC AGCCGCACGC TGACGCTTTG TCCCAATGAT TCGCTGAAAT

951  CGGCTTCGGC GGCGGTTGCG CCCGTCGCTT TTGCCAAGTC GAGCGTGCGG

1001  CGGCAGAGGT CGAGGAGTTC GGAAGCGGTG TGGTTGAACA GCATAGAAAT

1051  CTTTCTTGAT GATGCTTTGC GGCATTTTAA
```

This corresponds to the amino acid sequence <SEQ ID 1422; ORF 515.a>:

```
a515.pep
     1  MVQIKVVRAA GVARGLHSEF ARAVTAEEIA FDNAVLNHEA RCGGNAFRIK

51  IAAAERAGDV RFFAQVEEIG QDFFADAVDQ ETALAVERSA GECADEVSDK

101  TARNGGIEED GVVACRDAAA AESAQSAAGG GLTDGFGAVH IRMAAGGIVP

151  VVALHAVFVG GNDAAGNAVV RALPVCGKTV GVAVNVLVMA GLHRRAFGVF

201  DALILVQGGL FALFCQADGG FRIQIPFVVK VGVADVLRHQ LGVGKSGATV

251  FGGVAGDVXX GADGVAQGLF GEIGGAGAAF AFADVNGNVQ RLVLLKLDLF
```

-continued

```
301 DFAQPHADAL SQ*FAEIGFG GGCARRFCQV ERAAAEVEEF GSGVVEQHRN

351 LS**CFAAF*
``` m515/a515 92.1% identity in 304 aa overlap

```
                                            10        20        30
    m515.pep                        GKSGGCAFFAQVEEIGQDFSADAVDQETALA
                                    ::|  ||||||||||| |||||||||||||
         a515    AEEIAFDNAVLNHEARCGGNTFRIKIAAAERAGDVRFFAQVEEIGQDFFADAVDQETALA
                 30        40        50        60        70        80
                         40        50        60        70        80        90
    m515.pep    VERAAGECADEVSDKTARNGGIEEDGVAACRDAAAAESAQSAAGGGLTDGFGAVHIRMAA
                |||:||||||||||||||||||||||||||:|||||||||||||||||||||||||||||
         a515   VERSAGECADEVSDKTARNGGIEEDGVVACRDAAAAESAQSAAGGGLTDGFGAVHIRMAA
                90        100       110       120       130       140
                        100       110       120       130       140       150
    m515.pep    GGIVPVVALHAVFVGGNDAAGNAVVRALPVCGKTVGVAVNVLVMAGLHRRAFGVFDALIL
                ||||||||||||||||||||||||||||||||||||||||||||||||||||||||||||
         a515   GGIVPVVALHAVFVGGNDAAGNAVVRALPVCGKTVGVAVNVLVMAGLHRRAFGVFDALIL
                150       160       170       180       190       200
                        160       170       180       190       200       210
    m515.pep    VQGGLFALFCQADGGXRIQIPFVVKVGVADVFCHQTGIGKSGATVFGGVAGDVDGGFDGV
                ||||||||||||||| |||||||||||||||||: || |:|||||||||||| |  |||
         a515   VQGGLFALFCQADGGFRIQIPFVVKVGVADVLRHQLGVGKSGATVFGGVAGDVXXGADGV
                210       220       230       240       250       260
                        220       230       240       250       260       270
    m515.pep    LQGFFGEVGSTGAAFAFADVNGNVQRLVLLELDLXDXAQPHADALSQXFAEIGFGGGCAR
                ||:|||:|::||||||||||||||||||||||||:|| | ||||||||||||||||||||
         a515   AQGLFGEVGGAGAAFAFADVNGNVQRLVLLELDLFDFAQPHADALSQXFAEIGFGGGCAR
                270       280       290       300       310       320
                        280       290       300
    m515.pep    RFCQVERAAAEVEEFGSGVVEQHRNLSXXCFAAFX
                |||||||||||||||||||||||||||||||||||
         a515   RFCQVERAAAEVEEFGSGVVEQHRNLSXXCFAAFX
                330       340       350       350
```

The following partial DNA sequence was identified in N. gonorrhoeae <SEQ ID 1423>:

```
g515-1.seq
    1 ATGGTTCAAA TACAGGTTGT GCGCGCCGCC GGCGTTGCCC GTGGTCTGCA

51 TTCCGAGTTT GCGCGCGCTG TAACTGCCGA GGAAATAGCC TTCGACAATG

101 CCGTTTTGAA TCACGAAGCG CGGCGCGGTG GCAACACCTT CCGCATCAAA

151 ATAGCTGCTG CGGAAAGAGC GGGGGATGTG CGGTTCTTCG CGCAGGTTGA

201 GGAAATCGGG CAGGACTTTT TTGCCGATGC TGTCGATCAG GAAACTGCTT

251 TGGCGGTAGA GCGCGCCGCC GGAGAGTGTG CCGACGAGGT GTCCGATCAG

301 CCCGCCCGAA ACGGTGGTAT CGAAGAGGAC GGGGTAGCTG CCTGTCGGGA

351 TGCTGCGGCT GCCGAGTCGG CGCAAAGTGC GGCGGGCGGC GGTTTGACCG

401 ATGGTTTCGG GGCTGTCCAT ATCCGGATGG CGGCAGGCGG AATCGTACCA

451 GTAGTCGCGC TGCATTCCGT TTTCGTCGGC GGCAACGACG CTGCAGGAAA

501 TGCTGTGGTG CGTGCTTTGC CGGTGTGCGG CAAAACCGTG GGTGTTGCCG

551 TAAACGTATT GGTAGTGTCC GGTTTGCACC GCCGCGCCTT CGGAGTTTTC

601 GATGCGGCTG TCCGTGTCCA ACGCTGCCTG TTCGCATTGT TTTGCCAAGC

651 CGACGGCGGC TTCCGTATCC AAATCCCATT CGTGGTAAAG GTCGGGGTCG

701 CCGATGTGTT GCGCCATCAA CTCGGGGTCG GCAAGTCCGG CGCAACCGTC
```

-continued

```
 751 TTCGGCGGTG TGGCGGGCGA TGTCGGCGGC GGCGCGGACG GTGTCGCGCA

801 GGGCTTGTTC GGAGAAGTCG GCGGTGCCGG CGCGGCCTTT GCGTTTGCCG

851 ACGTAAACGG TAATGTCCAG CGATTTGTCC TGCTGGAACT CGATTTGTTC

901 GATTTCGCCC AAGCGCACGC TGACGCTTTG TCCGAGCGAT TCGCTGAAGT

951 CGGCTTCGGC GGCGGTCGCG CCCGCTGCTT TGCCAAGTC GAGCGTGCGG

1001 CGGCAGAGGT CGAGGAGTTC GGAAGCGGTG TGGTTGAACA GCATAACAAT

1051 CTTTCTTGGT GGAGCGTTGT GGCATTTTAA
```

This corresponds to the amino acid sequence <SEQ ID 1424; ORF 515-1.ng>:

```
g515-1.pep
   1 MVQIQVVRAA GVARGLHSEF ARAVTAEEIA FDNAVLNHEA RRGGNTFRIK

51 IAAAERAGDV RFFAQVEEIG QDFFADAVDQ ETALAVERAA GECADEVSDQ

101 PARNGGIEED GVAACRDAAA AESAQSAAGG GLTDGFGAVH IRMAAGGIVP

151 VVALHSVFVG GNDAAGNAVV RALPVCGKTV GVAVNVLVVS GLHRRAFGVF

201 DAAVRVQRCL FALFCQADGG FRIQIPFVVK VGVADVLRHQ LGVGKSGATV

251 FGGVAGDVGG GADGVAQGLF GEVGGAGAAF AFADVNGNVQ RFVLLELDLF

301 DFAQAHADAL SERFAEVGFG GGRARCFCQV ERAAAEVEEF GSGVVEQHNN

351 LSWWSVVAF*
```

The following partial DNA sequence was identified in *N. meningitidis* <SEQ ID 1425>:

```
m515-1.seq
   1 ATGGTTCAAA TACAGGTTGT GCGCGCCGCC GGCGTTGCCC GTGGTCTGCA

51 TACCGAGTTT GCGCGCGCTG TAACTGCTGA GGAAATAGCC TTCGACAATG

101 CCGTTTTGAA TCACGAAGCG CGGTGCGGTG GCAACGCCTT CCGCATCAAA

151 ATAGCTGCTG CGGAAAGAGC GGGGGATGTG CGGTTCTTCG CGCAGGTTGA

201 GGAAATCGGG CAGGACTTTT TTGCCGATGC TGTCGATCAG GAAACTGCTT

251 TGGCGGTAGA GCGCGCCGCC GGAGAGTGCG CCGACGAGGT GTCCGATAAG

301 ACCGCCCGAA ACGGTGGTAT CGAAGAGGAC GGGGTAGCTG CCTGTCGGGA

351 TGCTGCGGCT GCCGAGTCGG CGCAAAGTGC GGCGGGCGGC GGTTTGACCG

401 ATGGTTTCGG GGCTGTCCAT ATCCGGATGG CGGCAGGCGG AATCGTACCA

451 GTAGTCGCGC TGCATGCCGT TTTCGTCGGC GGCAACGACG CTGCAGGAAA

501 TGCTGTGGTG CGTGCCTTGC CGGTGTGCGG CAAAACCGTG GGTGTTGCCG

551 TAAACGTATT GGTAATGGCC GGTTTGCACC GCCGCGCCTT CGGAGTTTTC

601 GATGCGCTCA TCCTCGTTCA GGGCGGCTTG TTCGCATTGT TTTGCCAAGC

651 CGACGGCGGC TTCCGTATCC AAATCCCATT CGTGGTAAAG GTCGGGGTCG

701 CCGATGTGTT TTGCCATCAG ACAGGCATCG GCAAGTCCGG CGCAACCGTC

751 TTCGGCGGTG TGGCGGGCGA TGTCGATGGC GGCTTTGACG GTGTCTTGCA

801 GGGCTTTTTC GGAGAAGTCG GCAGTACTGG CGCGGCCTTT GCGTTTGCCG

851 ACGTAAACGG TAATGTCCAG CGACTTGTCC TGCTGGAACT CGATTTGTTC

901 GATTTCGCCC AGCCGCACGC TGACGCTTTG TCCCAATGA
```

This corresponds to the amino acid sequence <SEQ ID 1426; ORF 515-1>:

```
m515-1.pep

1  MVQIQVVRAA GCARGLHTEF ARAVTAEEIA FDNAVLNHEA RCGGNAFRIK

51  IAAAERAGDV RFFAQVEEIG QDFFADAVDQ ETALAVERAA GECADEVSDK

101  TARNGGIEED GVAACRDAAA AESAQSAAGG GLTDGFGAVH IRMAAGGIVP

151  VVALHAVFVG GNDAAGNAVV RALPVCGKTV GVAVNVLVMA GLHRRAFGVF

201  DALILVQGGL FALFCQADGG FRIQIPFVVK VGVADVFCHQ TGIGKSGATV

251  FGGVAGDVDG GFDGVLQGFF GEVGSTGAAF AFADVNGNVQ RLVLLELDLF

301  DFAQPHADAL SQ* m515-1/g515-1   91.7% identity in 312 aa overlap 10         20         30         40         50         60
g515-1.pep  MVQIQVVRAAGVARGLHSEFARACTAEEIAFDNAVLNHEARRGGNTFRIKIAAAERAGDV
            ||||||||||||||||||:||||||||||||||||||||||||  :||||||||||||||
m515-1      MVQIQVVRAAGVARGLHTEFARACTAEEIAFDNAVLNHEARCGGNAFRIKIAAAERAGDV
                    10         20         30         40         50         60

70         80         90        100        110        120
g515-1.pep  RFFAQVEEIGQDFFADAVDQETALAVERAAGECADEVSDQPARNGGIEEDGVAACRDAAA
            |||||||||||||||||||||||||||||||||||||||:|||||||||||||||||||
m515-1      RFFAQVEEIGQDFFADAVDQETALAVERAAGECADEVSDKTARNGGIEEDGVAACRDAAA
                    70         80         90        100        110        120

130        140        150        160        170        180
g515-1.pep  AESAQSAAGGGLTDGFGAVHIRMAAGGIVPVVALHSVFVGGNDAAGNAVVRALPVCGKTV
            |||||||||||||||||||||||||||||||||||:||||||||||||||||||||||||
m515-1      AESAQSAAGGGLTDGFGAVHIRMAAGGIVPVVALHAVFVGGNDAAGNAVVRALPVCGKTV
                   130        140        150        160        170        180

190        200        210        220        230        240
g515-1.pep  GVAVNVLVVSGLHRRAFGVFDAAVRVQRCLFALFCQADGGFRIQIPFVVKVGVADVLRHQ
            ||||||||::||||||||||| : ||  ||||||||||||||||||||||||||||||::||
m515-1      GVAVNVLVMAGLHRRAFGVFDALILVQGGLFALFCQADGGFRIQIPFVVKVGVADVFCHQ
                   190        200        210        220        230        240

250        260        270        280        290        300
g515-1.pep  LGVGKSGATVFGGVAGDVGGGADGVAQGLFGECGGAGAAFAFADVNGNVQRFVLLELDLF
            |:||||||||||||||||| ||  ||:|||::||||::||||||||||||:|||||||||
m515-1      TGIGKSGATVFGGVAGDVDGGFDGVLQGFFGECGSTGAAFAFADVNGNVQRLVLLELDLF
                   250        260        270        280        290        300

310        320        330        340        350        360
g515-1.pep  DFAQAHADALSERFAECGFGGGRARCFCQVERAAAEVEEFGSGVVEQHNNLSWWSVVAFX
            ||||  ||||||:
m515-1      DFAQPHADALSQX
                   310
```

The following partial DNA sequence was identified in *N. meningitidis* <SEQ ID 1427>:

```
a515-1.seq
   1  ATGGTTCAAA TAAAGGTTGT GCGCGCCGCC GGCGTTGCCC GTGGTCTGCA

51  TTCCGAGTTT GCGCGCGCTG TAACTGCTGA GGAAATAGCC TTCGACAATG

101  CCGTTTTGAA TCACGAAGCG CGGTGCGGTG GCAACGCCTT CCGCATCAAA

151  ATAGCTGCTG CGGAAAGAGC GGGGGATGTG CGGTTCTTCG CGCAGGTTGA

201  GGAAATCGGG CAGGACTTTT TTGCCGATGC TGTCGATCAG GAAACTGCTT

251  TGGCGGTAGA GCGCTCCGCC GGAGAGTGCG CCGACGAGGT GTCCGATAAG

301  ACCGCCCGAA ACGGTGGTAT CGAAGAGGAC GGGGTAGTTG CCTGTCGGGA

351  TGCTGCGGCT GCCGAGTCGG CGCAAAGTGC GGCGGGCGGC GGTTTGACCG

401  ATGGTTTCGG GGCTGTCCAT ATCCGGATGG CGGCAGGCGG AATCGTACCA

451  GTAGTCGCGC TGCATGCCGT TTTCGTCGGC GGCAACGACG CTGCAGGAAA

501  TGCTGTGGTG CGTGCTTTGC CGGTGTGCGG CAAAACCGTA GGTGTTGCCG
```

```
-continued
551 TAAACGTATT GGTAATGGCC GGTTTGCACC GCCGCGCCTT CGGAGTTTTC

601 GATGCGCTCA TCCTCGTTCA GGGCGGCTTG TTCGCATTGT TTTGCCAAGC

651 CGACGGCGGC TTCCGTATCC AAATCCCATT CGTGGTAAAG GTCGGGGTCG

701 CCGATGTGTT GCGCCATCAA CTCGGGGTCG GCAAGTCCGG CGCAACCGTC

751 TTCGGCGGTG TGGCGGGCGA TGTCGGCGGC GGCGCGGACG GTGTCGCGCA

801 GGGCTTGTTC GGAGAAATCG GCGGTGCCGG CGCGGCCTTT GCGTTTGCCG

851 ACGTAAACGG TAATGTCCAG CGACTTGTCC TGCTGAAACT CGATTTGTTC

901 GATTTCGCCC AGCCGCACGC TGACGCTTTG TCCCAATGA
```

This corresponds to the amino acid sequence <SEQ ID 1428; ORF 515-1.a>:

```
a515-1.pep

1 MVQIQVVRAA GCARGLHTEF ARAVTAEEIA FDNAVLNHEA RCGGNAFRIK
     51 IAAAERAGDV RFFAQVEEIG QDFFADAVDQ ETALAVERAA GECADEVSDK
    101 TARNGGIEED GVAACRDAAA AESAQSAAGG GLTDGFGAVH IRMAAGGIVP
    151 VVALHAVFVG GNDAAGNAVV RALPVCGKTV GVAVNVLVMA GLHRRAFGVF
    201 DALILVQGGL FALFCQADGG FRIQIPFVVK VGVADVFCHQ TGIKSGATV
    251 FGGVAGDVDG GFDGVLQGFF GEVGSTGAAF AFADVNGNVQ RLVLLELDLF
    301 DFAQPHADAL SQ* m515-1/a515-1  94.9% identity in 312 aa overlap
                    10         20         30         40         50         60
a515-1.pep  MVQIKVVRAAGVARGLHSEFARACTAEEIAFDNAVLNHEARRGGNTFRIKIAAAERAGDV
            ||||:|||||||||||||:|||||:|||||||||||||||||||||||||||||||||||
m515-1      MVQIQVVRAAGVARGLHTEFARACTAEEIAFDNAVLNHEARRGGNTFRIKIAAAERAGDV
                    10         20         30         40         50         60

70         80         90        100        110        120
a515-1.pep  RFFAQVEEIGQDFFADAVDQETALAVERSAGECADEVSDQPARNGGIEEDGVVACRDAAA
            ||||||||||||||||||||||||||||:|||||||||||||||||||||||:||||||
m515-1      RFFAQVEEIGQDFFADAVDQETALAVERAAGECADEVSDQPARNGGIEEDGVAACRDAAA
                    70         80         90        100        110        120

130        140        150        160        170        180
a515-1.pep  AESAQSAAGGGLTDGFGAVHIRMAAGGIVPVVALHAVFVGGNDAAGNAVVRALPVCGKTV
            ||||||||||||||||||||||||||||||||||||||||||||||||||||||||||||
m515-1      AESAQSAAGGGLTDGFGAVHIRMAAGGIVPVVALHAVFVGGNDAAGNAVVRALPVCGKTV
                   130        140        150        160        170        180

190        200        210        220        230        240
a515-1.pep  GVAVNVLVMAGLHRRAFGVFDALILVQGGLFALFCQADGGFRIQIPFVVKVGVADVLRHQ
            |||||||||||||||||||||||||||||||||||||||||||||||||||||||:||
m515-1      GVAVNVLVMAGLHRRAFGVFDALILVQGGLFALFCQADGGFRIQIPFVVKVGVADVFCHQ
                   190        200        210        220        230        240

250        260        270        280        290        300
a515-1.pep  LGVGKSGATVFGGVAGDVGGGADGVAQGLFGEIGGAGAAFAFADVNGNVQRLVLLKLDLF
            |:|||||||||||||||||  |||  ||:|||:|::|||||||||||||||||:||||
m515-1      TGIGKSGATVFGGVAGDVDGGFDGVLQGFFGEVGSTGAAFAFADVNGNVQRLVLLELDLF
                   250        260        270        280        290        300

310
a515-1.pep  DFAQPHADALSQX
            |||||||||||||
m515-1      DFAQPHADALSQX
                   310
```

The following partial DNA sequence was identified in *N. gonorrhoeae* <SEQ ID 1429>:

```
g516.seq
   1 atgttgttcc gtaaaacgac cgccgccgtt ttggcggcaa ccttgatact 51 gaacggctgt acgatgatgt tgcgggggat gaacaacccg gtcagccaaa
```

-continued
```
101 caatcacccg caaacacgtt gacaaagacc aaatccgcgc cttcggtgtg 151 gttgccgaag acaatgccca attggaaaag ggcagcctgg tgatgatggg 201 cgggaaatac tggttcgccg tcaatcccga agattcggcg aagctgacgg 251 gccttttgaa ggccggggttg gacaagccct tccaaatagt tgaggatacc 301 ccgagctatg cccgccacca agccctgccg gtcaaattcg aagcgcccgg 351 cagccagaat ttcagtaccg gaggtctttg cctgcgctat gataccggca 401 gacctgacga catcgccaag ctgaaacagc ttgagtttaa agcggtcaaa 451 ctcgacaatc ggaccattta cacgcgctgc gtatccgcca aaggcaaata 501 ctacgccacg ccgcaaaaac tgaacgccga ttatcatttt gagcaaagtg 551 tgcccgccga tatttattat acggttactg aaaaacatac cgacaaatcc 601 aagctgtttg gaaatatctt atatacgccc cccttgttga tattggatgc 651 ggcggccgcg gtgctggtct tgcctatggc tctgattgca gccgcgaatt 701 cctcagacaa atga
```

This corresponds to the amino acid sequence <SEQ ID 1430; ORF 516.ng>:

```
g516.pep
  1 MLFRKTTAAV LAATLILNGC TMMLRGMNNP VSQTITRKHV DKDQIRAFGV

51 VAEDNAQLEK GSLVMMGGKY WFAVNPEDSA KLTGLLKAGL DKPFQIVEDT

101 PSYARHQALP VKFEAPGSQN FSTGGLCLRY DTGRPDDIAK LKQLEFKAVK

151 LDNRTIYTRC VSAKGKYYAT PQKLNADYHF EQSVPADIYY TVTEKHTDKS

201 KLFGNILYTP PLLILDAAAA VLVLPMALIA AANSSDK*
```

The following partial DNA sequence was identified in *N. meningitidis* <SEQ ID 1431>:

```
m516.seq
  1 ATGTTGTTCC GTAAAACGAC CGCCGCCGTT TTGGCGGCAA CCTTGATGCT

51 GAACGGCTGT ACGTTGATGT TGTGGGGAAT GAACAACCCG GTCAGCGAAA

101 CAATCACCCG CAAACACGTT GACAAAGACC AAATCCGCGC CTTCGGTGTG

151 GTTGCCGAAG ACAATGCCCA ATTGGAAAAG GGCAGCCTGG TGATGATGGG

201 CGGAAAATAC TGGTTCGTCG TCAATCCCGA AGATTCGGCG AAGCTGACGG

251 GCATTTTGAA GGCAGGGCTG ACAAACCCT TCCAAATAGT TGAGGATACC

301 CCGAGCTATG CTCGCCACCA AGCCCTGCCG GTCAAACTCG AATCGCCTGG

351 CAGCCAGAAT TTCAGTACCG AAGGCCTTTG CCTGCGCTAC GATACCGACA

401 AGCCTGCCGA CATCGCCAAG CTGAAACAGC TCGGGTTTGA AGCGGTCAAA

451 CTCGACAATC GGACCATTTA CACGCGCTGC GTATCCGCCA AAGGCAAATA

501 CTACGCCACA CCGCAAAAAC TGAACGCCGA TTACCATTTT GAGCAAAGTG

551 TGCCTGCCGA TATTTATTAC ACGGTTACTG AAGAACATAC CGACAAATCC

601 AAGCTGTTTG CAAATATCTT ATATACGCCC CCCTTTTTGA TACTGGATGC

651 GGCGGGCGCG GTACTGGCCT TGCCTGCGGC GGCTCTGGGT GCGGTCGTGG

701 ATGCCGCCCG CAAATGA
```

This corresponds to the amino acid sequence <SEQ ID 1432; ORF 516>:

```
m516.pep
   1 MLFRKTTAAV LAATLMLNGC TLMLWGMNNP VSETITRKHV DKDQIRAFGV

51 VAEDNAQLEK GSLVMMGGKY WFVVNPEDSA KLTGILKAGL DKPFQIVEDT

101 PSYARHQALP VKLESPGSQN FSTEGLCLRY DTDKPADIAK LKQLGFEAVK

151 LDNRTIYTRC VSAKGKYYAT PQKLNADYHF EQSVPADIYY TVTEEHTDKS

201 KLFANILYTP PFLILDAAGA VLALPAAALG AVVDAARK*
```

Computer analysis of this amino acid sequence gave the following results:
Homology with a Predicted ORF from *N. gonorrhoeae*
ORF 516 shows 90.0% identity over a 231 aa overlap with a predicted ORF (ORF 516.ng) from *N. gonorrhoeae*:

```
m516/g516
                  10         20         30         40         50         60
   m516.pep  MLFRKTTAAVLAATLMLNGCTLMLWGMNNPVSETITRKHVDKDQIRAFGVVAEDNAQLEK
             ||||||||||||||:|||||:||:||||||||:||||||||||||||||||||||||||
       g516  MLFRKTTAAVLAATLILNGCTMMLRGMNNPVSQTITRKHVDKDQIRAFGVVAEDNAQLEK
                  10         20         30         40         50         60

70         80         90        100        110        120
   m516.pep  GSLVMMGGKYWFVVNPEDSADLTGILKAGLDKPFQIVEDTPSYARHQALPVKLESPGSQN
             ||||||||||||:||||||||||||:|||||||||||||||||||||||||:|:|||||
       g516  GSLVMMGGKYWFAVNPEDSADLTGLLKAGLDKPFQIVEDTPSYARHQALPVKKEAPGSQN
                  70         80         90        100        110        120

130        140        150        160        170        180
   m516.pep  FSTEGLCLRYDTDKPADIAKLKQLGFEAVKLDNRTIYTRCVSAKGKYYATPQKLNADYHF
             |||  ||||||||| :| |||||||| :|||||||||||||||||||||||||||||||
       g516  FSTGGLCLRYDTGRPDDIAKLKQLEFKAVKLDNRTIYTRCVSAKGKYYATPQKLNADYHF
                 130        140        150        160        170        180

190        200        210        220        230     239
   m516.pep  EQSVPADIYYTVTEEHTDKSKLFANILYTPPFLILDAAGAVLALPAAALGAVVDAARK
             ||||||||||||||:|||||||||:||||||:||||||:|||:||  |  ::|:
       g516  EQSVPADIYYTVTEKHTDKSKLFGNILYTPPLLILDAAAAVLVLPMALIAAANSSDK
                 190        200        210        220        230
```

The following partial DNA sequence was identified in *N. meningitidis* <SEQ ID 1433>:

```
a516.seq
   1 ATGTTGTTCC GTAAAACGAC CGCCGCCGTT TTGGCGGCAA CCTTGATGTT

51 GAACGGCTGT ACGGTAATGA TGTGGGGTAT GAACAGCCCG TTCAGCGAAA

101 CGACCGCCCG CAAACACGTT GACAAGGACC AAATCCGCGC CTTCGGTGTG

151 GTTGCCGAAG ACAATGCCCA ATTGGAAAAG GGCAGCCTGG TGATGATGGG

201 CGGGAAATAC TGGTTCGTCG TCAATCCTGA AGATTCGGCG AAGCTGACGG

251 GCATTTTGAA GGCCGGGTTG GACAAGCAGT TTCAAATGGT TGAGCCCAAC

301 CCGCGCTTTG CCTACCAAGC CCTGCCGGTC AAACTCGAAT CGCCCGCCAG

351 CCAGAATTTC AGTACCGAAG GCCTTTGCCT GCGCTACGAT ACCGACAGAC

401 CTGCCGACAT CGCCAAGCTG AAACAGCTTG AGTTTGAAGC GGTCGAACTC

451 GACAATCGGA CCATTTACAC GCGCTGCGTC TCCGCCAAAG GCAAATACTA

501 CGCCACACCG CAAAAACTGA ACGCCGATTA TCATTTTGAG CAAAGTGTGC

551 CTGCCGATAT TTATTACACG GTTACGAAAA AACATACCGA CAAATCCAAG

601 TTGTTTGAAA ATATTGCATA TACGCCCACC ACGTTGATAC TGGATGCGGT

651 GGGCGCGGTG CTGGCCTTGC CTGTCGCGGC GTTGATTGCA GCCACGAATT

701 CCTCAGACAA ATGA
```

This corresponds to the amino acid sequence <SEQ ID 1434; ORF 516.a>:

```
a516.pep
   1 MLFRKTTAAV LAATLMLNGC TVMMWGMNSP FSETTARKHV DKDQIRAFGV

51 VAEDNAQLEK GSLVMMGGKY WFVVNPEDSA KLTGILKAGL DKQFQMVEPN

101 PRFAYQALPV KLESPASQNF STEGLCLRYD TDRPADIAKL KQLEFEAVEL

151 DNRTIYTRCV SAKGKYYATP QKLNADYHFE QSVPADIYYT VTKKHTDKSK

201 LFENIAYTPT TLILDAVGAV LALPVAALIA ATNSSDK*
``` m516/a516 86.1% identity in 238 aa overlap

```
                  10         20         30         40         50         60
 m516.pep  MLFRKTTAAVLAATLMLNGCTLMLWGMNNPVSETITRKHVDKDQIRAFGVVAEDNAQLEK
           |||||||||||||||||||| : :||||:| ||| :||||||||||||||||||||||||
 a516      MLFRKTTAAVLAATLMLNGCTVMMWGMNSPFSETTARKHVDKDQIRAFGVVAEDNAQLEK
                  10         20         30         40         50         60
                  70         80         90        100        110        120
 m516.pep  GSLVMMGGKYWFVVNPEDSAKLTGILKAGLDKPFQIVEDTPSYARHQALPVKLESPGSQN
           ||||||||||||||||||||||||||||||||  ||:|  : :|  :||||||||||:|||
 a516      GSLVMMGGKYWFVVNPEDSAKLTGILKAGLDKQFQMVEPNPRFA-YQALPVKLESPASQN
                  70         80         90        100        110
                 130        140        150        160        170        180
 m516.pep  FSTEGLCLRYDTDKPADIAKLKQLGFEAVKLDNRTIYTRCVSAKGKYYATPQKLNADYHF
           ||||||||||||||:||||||||| ||||:||||||||||||||||||||||||||||||
 a516      FSTEGLCLRYDTDRPADIAKLKQLEFEAVELDNRTIYTRCVSAKGKYYATPQKLNADYHF
                 120        130        140        150        160        170
                 190        200        210        220        230       239
 m516.pep  EQSVPADIYYTVTEEHTDKSKLFANILYTPPFLILDAAGAVLALPAAALGAVVDAARKX
           ||||||||||||| :::|||||||||||:|| |||  |||||:||||||:||| |:::: ||
 a516      EQSVPADIYYTVTKKHTDKSKLFENIAYTPTTLILDAVGAVLALPVAALIAATNSSDKX
                 180        190        200        210        220        230
```

The following partial DNA sequence was identified in *N. gonorrhoeae* <SEQ ID 1435>:

```
g517.seq
   1 atgcatcggg tttcagacgg cattggagtg tcagtcgtgt tctgccgatt 51 cgtaggcttc gacgattttt tgcaccagag gatgccggac aacgtcttcg 101 ccggtgaagg tatggaaata cagtcctgcc acgccgtgca gtttctcacg 151 tgcgtctttc aatcccgatt tgatgttttt gggcaggtcg atttggctgg 201 tgtcgccggt aatgacggct tcgcgccga agccgatgcg ggtcaggaac 251 attttcattt gttcgggcgt ggtgttttgc gcttcgtcga ggatgatgta 301 tgcgccgttg agcgtcctgc cgcgcatata ggcgagcggg gcgatttcaa 351 tcaggccttt ttcaatcagc ttggttacac ggtcaaagcc catcaggtca 401 tagagggcat cataaagcgg acggaggtag gggtcgactt tttgggtcag 451 gtctccgggc aggaagccca gtttctcacc ggcttcgacg gcaggccgaa 501 ctaa
```

This corresponds to the amino acid sequence <SEQ ID 1436; ORF 517.ng>:

```
g517.pep
   1 MHRVSDGIGV SVVFCRFVGF DDFLHQRMPD NVFAGEGMEI QSCHAVQFLT

51 CVFQSRFDVF GQVDLAGVAG NDGFRAEADA GQEHFHLFGR GVLRFVEDDV
```

```
101 CAVERPAAHI GERGDFNQAF FNQLGYTVKA HQVIEGIIKR TEVGVDFLGQ

151 VSGQEAQFLT GFDGRPN*
```

The following partial DNA sequence was identified in *N. meningitidis* <SEQ ID 1437>:

```
m517.seq
  1 ATGCATCGGG TTTCAGACGG CATTGGAATG TCAGTCGTGT TCTGCCGATT

51 CGTAGGCTTC GACGATTTTT TGCACCAAAG GATGCCGGAC AACGTCTTCG

101 CCGGTAAAGG TGTGGAAATA CAGCCCTTCC ACGTTGTGCA GTTTCTCACG

151 CGCATCTTTT AATCCCGATT TGATGTTTTT GGGCAGGTCG ATTTGGCTGG

201 TGTCGCCGGT AATGACGGCT TTCGCGCCGA AGCCGATGCG GGTCAGGAAC

251 ATTTTCATTT GTTCGGGCGT GGTGTTTTGC GCTTCGTCGA GGATGATGTA

301 TGCGCCGTTG AGCGTCCTGC CGCGCATATA GGCGAGCGGG GCGATTTCAA

351 TCAGGCCTTT TTCAATCAGC TTGGTTACAC GGTCAAAGCC CATCAGGTCA

401 TAGAGGGCAT CATAAAGCGG ACGAAGGTAG GGATCGACTT TCTGGGTCAG

451 GTCTCCGGGC AGGAAGCCCA GTTTCTCGCC GGCTTCGACG GCTGgGCGCA

501 CTAA
```

This corresponds to the amino acid sequence <SEQ ID 1438; ORF 517>:

```
m517.pep
  1 MHRVSDGIGM SVVFCRFVGF DDFLHQRMPD NVFAGKGVEI QPFHVVQFLT

51 RIFXSRFDVF GQVDLAGVAG NDGFRAEADA GQEHFHLFGR GVLRFVEDDV

101 CAVERPAAHI GERGDFNQAF FNQLGYTVKA HQVIEGIIKR TKVGIDFLGQ

151 VSGQEAQFLA GFDGWAH*
```

Computer analysis of this amino acid sequence gave the following results:
Homology with a Predicted ORF from *N. gonorrhoeae*
ORF 517 shows 92.7% identity over a 164 aa overlap with a predicted ORF (ORF 517.ng) from *N. gonorrhoeae*:

```
m517/g517

10         20         30         40         50         60
    m517.pep  MHRVSDGIGMSVVFCRFVGFDDFLHQRMPDNVFAGKGVEIQPFHVVQFLTRIFXSRFDVF
              ||||||||| :||||||||||||||||||||||| :||| | :|||| : | |||||
    g517      MHRVSDGIGVSVVFCRFVGFDDFLHQRMPDNVFAGEGMEIQSCHAVQFLTCVFQSRFDVF
                    10         20         30         40         50         60

70         80         90        100        110        120
    m517.pep  GQVDLAGVAGNDGFRAEADAGQEHFHLFGRGVLRFVEDDVCAVERPAAHIGERGDFNQAF
              ||||||||||||||||||||||||||||||||||||||||||||||||||||||||||||
    g517      GQVDLAGVAGNDGFRAEADAGQEHFHLFGRGVLRFVEDDVCAVERPAAHIGERGDFNQAF
                    70         80         90        100        110        120

130        140        150        160
    m517.pep  FNQLGYTVKAHQVIEGIIKRTKVGIDFLGQVSGQEAQFLAGFDGWAH
              |||||||||||||||||||||:||:||||||||||||||| :||||
    g517      FNQLGYTVKAHQVIEGIIKRTEVGVDFLGQVSGQEAQFLTGFDGRPN
                   130        140        150        160
```

The following partial DNA sequence was identified in *N. meningitidis* <SEQ ID 1439>:

```
a517.seq
   1 ATGCATCGGG TTTCAGACGG CATTGGAATG TCAGTCGTGT TCTGCCGATT

51 CGTAGGCTTC GACGATTTTT TGCACCAAAG GATGCCGGAC AACGTCTTCG

101 CCGGTAAAGG TGTGGAAATA CAGCCCTTCC ACGCCGTGCA GTTTCTCACG

151 CGCATCTTTT AATCCCGATT TGATGTTTTT GGGCAGGTCG ATTTGGCTGG

201 TGTCGCCGGT AATGACGGCT TTCGCGCCGA AGCCGATGCG GGTCAGGAAC

251 ATTTTCATTT GTTCGGGCGT GGTGTTTTGC GCTTCGTCGA GGATGATGTA

301 TGCGCCGTTG AGCGTCCTGC CGCGCATATA GGCGAGCGGG GCAATCTCAA

351 TCAGACCTTT TTCAATCAGC TTGGTGACAC GGTCGAAGCC CATCAGGTCA

401 TAGAGGGCAT CATAAAGCGG ACGAAGGTAG GGATCGACTT TCTGGGTCAG

451 GTCACCGGGC AGAAAACCCA GTTTCTCGCC GGCTTCGACG GCAGGCCGCA

501 CTAA
```

This corresponds to the amino acid sequence <SEQ ID 1440; ORF 517.a>:

```
a517.pep
     1 MHRVSDGIGM SVVFCRFVGF DDFLHQRMPD NVFAGKGVEI QPFHAVQFLT

51 RAF*SRFDVF GQVDLAGVAG NDGFRAEADA GQEHFHLFGR GVLRFVEDDV

101 CAVERPAAHI GERGNLNQTF FNQLGDTVEA HQVIEGIIKR TKVGIDFLGQ

151 VTGQKTQFLA GFDGRPH* m517/a517    93.4% identity in 167 aa overlap
                  10         20         30         40         50         60
m517.pep  MHRVSDGIGMSVVFCRFVGFDDFLHQRMPDNVFAGKGVEIQPFHVVQFLTRIFXSRFDVF
          |||||||||||||||||||||||||||||||||||||||||:||||||||||||||||||
a517      MHRVSDGIGMSVVFCRFVGFDDFLHQRMPDNVFAGKGVEIQPFHAVQFLTRIFXSRFDVF
                  10         20         30         40         50         60

70         80         90        100        110        120
m517.pep  GQVDLAGVAGNDGFRAEADAGQEHFHLFGRGVLRFVEDDVCAVERPAAHIGERGDFNQAF
          ||||||||||||||||||||||||||||||||||||||||||||||||||||||::||:|
a517      GQVDLAGVAGNDGFRAEADAGQEHFHLFGRGVLRFVEDDVCAVERPAAHIGERGNLNQTF
                  70         80         90        100        110        120

130        140        150        160
m517.pep  FNQLGYTVKAHQVIEGIIKRTKVGIDFLGQVSGQEAQPLAGFDGWAHX
          |||||  ||:||||||||||||||||||||:||::|||||||  ||
a517      FNQLGDTVEAHQVIEGIIKRTKVGIDFLGQVTGQKTQFLAGFDGRPHX
                 130        140        150        160
```

The following partial DNA sequence was identified in *N. gonorrhoeae* <SEQ ID 1441>:

```
g518.seq
   1 atgacgtttt cggcggcaaa gctcaacatt tcggcactga tgttgtgtct 51 ttcggcagga atgaccgttt tactttccgc tttttactg ctccgaccgg 101 aaggcagcat cttattcaac cattttttca gcataaatat tctgacccga 151 agagcggcat ctccacgggc aaccgtgttc agactgcatc aggcggtacg 201 attccacaag atgccgaaaa ccataagcaa atgcgtagaa actacgccg 251 tccgaatcac gccgcctcct cgggcggcaa cgcttcatta taacagattg 301 cccttaaaa aatcagaccc tgcttttgtg gcggagtctg aaatttga
```

This corresponds to the amino acid sequence <SEQ ID 1442; ORF 518.ng>:

```
g518.pep
   1 MTFSAAKLNI SALMLCLSAG MTVLLSAFLL LRPEGSILFN HFFSINILTR

51 RAASPRATVF RLHQAVRFHK MPKTISKMRR NYAVRITPPP RAATLHYNRL

101 PLKKSDPAFV AESEI*
```

The following partial DNA sequence was identified in *N. meningitidis* <SEQ ID 1443>:

```
m518.seq
   1 ATGACGTTTT CGGCGGCAAA GCTCAACATT TCGGCACGGA TGTTGTGTCT

51 TTCGGCAGGA ATGACCGTTT TACTTTCCGC TTTTTTACTG CTCCGACCGG

101 AAGGCAGCAT CTTATTCAAC CATTTTTTCA GCATAAATAT TCTGACCCGA

151 AGAGCGGCAT CTCCACAGGC AACCGTGTTC AGACGGCATC AGGCGCGGTT

201 TGCAAGATGC CGTACCATAA ACAAAAGGCG TAGAAACTAC GCCGTCCGAA

251 TCACGCCGCC CTCGCG.GCG GCAACGCGTC ATTATAACAG ATTGCCCTCC

301 GCGGCAGGCT TAGTGCGGCG GGAGCGCCGC CGTTGCGCAG TAATATTGTC

351 TAACGGGAGG AAAAAATCAG ACCCTGCTTT TGTGGCAGAG TCTGAAATTT

401 GA
```

This corresponds to the amino acid sequence <SEQ ID 1444; ORF 518>:

```
m518.pep
   1 MTFSAAKLNI SARMLCLSAG MTVLLSAFLL LRPEGSILFN HFFSINILTR

51 RAASPQATVF RRHQARFARC RTINKRRRNY AVRITPPSXA ATRHYNRLPS

101 AAGLVRRERR RCAVILSNGR KKSDPAFVAE SEI*
```

Computer analysis of this amino acid sequence gave the following results:

Homology with a Predicted ORF from *N. gonorrhoeae*

ORF 518 shows 74.1% identity over a 135 aa overlap with a predicted ORF (ORF 518.ng) from *N. gonorrhoeae*:

```
m518/g518 m518.pep    MTFSAAKLNISARMLCLSAGMTVLLSAFLLLRPEGSILFNHFFSINILTRRAASPQATVF
            |||||||||||| |||||||||||||||||||||||||||||||||||||||:|||||
g518        MTFSAAKLNISALMLCLSAGMTVLLSAFLLLRPEGSILFNHFFSINILTRRAASPRATVF
                    10        20        30        40        50        60

70        80        90       100       110
m518.pep    RRHQA-RFARC-RTINKRRRNYAVRITPPSXAATRHYNRLPSAAGLVRRERRRCAVILSN
            | ||| || : :||:| || |||||||||| ||| ||||||
g518        RLHQAVRFHKMPKTISKMRRNYAVRITPPPRAATLHYNRLPL------------------
                    70        80        90       100

120       130
m518.pep       GRKKSDPAFVAESEI
               ||||||||||||||
g518           --KKSDPAFVAESEI
                      110
```

The following partial DNA sequence was identified in *N. meningitidis* <SEQ ID 1445>:

```
a518.seq
   1 ATGACGTTTT CGGCGGCAAA GCTCAACATT TCGGCACGGA TGTTGTGTCT

51 TTCGGCAGGA ATGACCGTTT TACTTTCCGC TTTTTTACTG CTCCGACCGG
```

-continued

```
101 AAGGCAGCAT CTTATTCAAC CATTTTTTCA GCATAAATAT TCTAACCCGA

151 AGAGCGGCAT CTCCACGGGC AACCGTGTTC AGACGGCATC AGGCGGTACG

201 ATTCCGCAAG ATGCCGACCA TAAACAAAAG GCGTAGAAAC TACGCCGTCC

251 GAATCACGCC GTCCTCG.CG GCGGCAACGC GTCATTATAA CAGATTGCCC

301 TCC....... .......... .......... .......... ..........

351 .......... ...AAAAAAT CAGACCCTGC TTTTGTGGCA GAGTCTGAAA

401 TTTGA
```

This corresponds to the amino acid sequence <SEQ ID 1446; ORF 518.a>:

```
a518.pep

1 MTFSAAKLNI SARMLCLSAG MTVLLSAFLL LRPEGSILFN HFFSINILTR

51 RAASPRATVF RRHQAVRFRK MPTINKRRRN YAVRITPSSX AATRHYNRLP

101 S......... .......... .KKSDPAFVA ESEI* m518/a518    79.9% identity in 134 aa overlap 10        20        30        40        50        60
m518.pep      MTFSAAKLNISARMLCLSAGMTVLLSAFLLLRPEGSILFNHFFSINILTRRAASPQATVF
              ||||||||||||||||||||||||||||||||||||||||||||||||||||:||||
a518          MTFSAAKLNISARMLCLSAGMTVLLSAFLLLRPEGSILFNHFFSINILTRRAASPRATVF
                      10        20        30        40        50        60

70        80        90       100               119
m518.pep      RRHQA-RFARCRTINKRRRNYAVRITPPSXAATRHYNRLPSAAGLVRRERRRCAVILSNG
              ||||| || :  ||||||||||||||||| |||||||||||
a518          RRHQAVRFRKMPTINKRRRNYAVRITPSSXAATRHYNRLPS-------------------
                      70        80        90       100

120       130
m518.pep        RKKSDPAFVAESEIX
                |||||||||||||||
a518           -KKSDPAFVAESEIX
                      110
```

The following partial DNA sequence was identified in *N. gonorrhoeae* <SEQ ID 1447>:

```
g519.seq
  1 atggaatttt tcattatctt gttggcagcc gtcgccgttt tcggcttcaa 51 atcctttgtc gtcatccccc agcaggaagt ccacgttgtc gaaaggctcg 101 ggcgtttcca tcgcgccctg acggccggtt tgaatatttt gattcccttt 151 atcgaccgcg tcgcctaccg ccattcgctg aaagaaatcc ctttagacgt 201 acccagccag gtctgcatca cgcgcgataa tacgcaattg actgttgacg 251 gcatcatcta tttccaagta accgatccca aactcgcctc atacggttcg 301 agcaactaca ttatggcaat tacccagctt gcccaaacga cgctgcgttc 351 cgttatcggg cgtatggagt tggacaaaac gtttgaagaa cgcgacgaaa 401 tcaacagtac cgtcgtctcc gccctcgatg aagccgccgg ggcttggggt 451 gtgaaagtcc tccgttacga aatcaaggat ttggttccgc cgcaagaaat 501 ccttcgcgca atgcaggcac aaattaccgc cgaacgcgaa aaacgcgccc 551 gtattgccga atccgaaggc cgtaaaatcg aacaaatcaa ccttgccagt 601 ggtcagcgtg aagccgaaat ccaacaatcc gaaggcgagg ctcaggctgc 651 ggtcaatgcg tccaatgccg agaaaatcgc ccgcatcaac cgcgccaaag
```

-continued

```
701 gcgaagcgga atccctgcgc cttgttgccg aagccaatgc cgaagccaac 751 cgtcaaattg ccgccgccct tcaaacccaa agcggggcgg atgcggtcaa 801 tctgaagatt gcgggacaat acgttaccgc gttcaaaaat cttgccaaag 851 aagacaatac gcggattaag cccgccaagg ttgccgaaat cgggaaccct 901 aattttcggc ggcatgaaaa attttcgcca gaagcaaaaa cggccaaata 951 a
```

This corresponds to the amino acid sequence <SEQ ID 1448; ORF 519.ng>:

```
g519.pep
  1 MEFFIILLAA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRA MQAQITAERE KRARIAESEG RKIEQINLAS

201 GQREAEIQQS EGEAQAAVNA SNAEKIARIN RAKGEAESLR LVAEANAEAN

251 RQIAAALQTQ SGADAVNLKI AGQYVTAFKN LAKEDNTRIK PAKVAEIGNP

301 NFRRHEKFSP EAKTAK*
```

The following partial DNA sequence was identified in *N. meningitidis* <SEQ ID 1449>:

```
m519.seq (partial)
  1 ..TCCGTTATCG GCGTATGGA GTTGGACAAA ACGTTTGAAG AACGCGACGA 51    AATCAACAGT ACTGTTGTTG CGGCTTTGGA CGAGGCGGCC GGGgCTTgGG

101    GTGTGAAGGT TTTGCGTTAT GAGATTAAAG ACTTGGTTCC GCCGCAAGAA

151    ATCCTTCGCT CAATGCAGGC GCAAATTACT GCCGAACGCG AAAAACGCGC

201    CCGTATCGCC GAATCCGAAG GTCGTAAAAT CGAACAAATC AACCTTGCCA

251    GTGGTCAGCG CGAAGCCGAA ATCCAACAAT CCGAAGGCGA GGCTCAGGCT

301    GCGGTCAATG CGTCAAATGC CGAGAAAATC GCCCGCATCA ACCGCGCCAA

351    AGGTGAAGCG GAATCCTTGC GCCTTGTTGC CGAAGCCAAT GCCGAAGCCA

401    TCCGTCAAAT TGCCGCCGCC CTTCAAACCC AAGGCGGTGC GGATGCGGTC

451    AATCTGAAGA TTGCGGAACA ATACGTCGCT GCGTTCAACA ATCTTGCCAA

501    AGAAAGCAAT ACGCTGATTA TGCCCGCCAA TGTTGCCGAC ATCGGCAGCC

551    TGATTTCTGC CGGTATGAAA ATTATCGACA GCAGCAAAAC CGCCAAaTAA
```

This corresponds to the amino acid sequence <SEQ ID 1450; ORF 519>:

```
m519.pep (partial)
  1 ..SVIGRMELDK TFEERDEINS TVVAALDEAA GAWGVKVLRY EIKDLVPPQE

51    ILRSMQAQIT AEREKRARIA ESEGRKIEQI NLASGQREAE IQQSEGEAQA

101    AVNASNAEKI ARINRAKGEA ESLRLVAEAN AEAIRQIAAA LQTQGGADAV

151    NLKIAEQYVA AFNNLAKESN TLIMPANVAD IGSLISAGMK IIDSSKTAK*
```

Computer analysis of this amino acid sequence gave the following results:

Homology with a Predicted ORF from *N. gonorrhoeae*
ORF 519 shows 87.5% identity over a 200 aa overlap with a predicted ORF (ORF 519.ng) from *N. gonorrhoeae*:

```
m519/g519

10        20        30
   m519.pep                   SVIGRMELDKTFEERDEINSTVVAALDEAA
                              ||||||||||||||||||||||||||||||
   g519      YFQVTDPKLASYGSSNYIMAITQLAQTTLRSVIGRMELDKTFEERDEINSTVVSALDEAA
                90       100       110       120       130       140

40        50        60        70        80        90
   m519.pep  GAWGVKVLRYEIKDLVPPQEILRSMQAQITAEREKRARIAESEGRKIEQINLASGQREAE
             |||||||||||||||||||||||:|||||||||||||||||||||||||||||||||||
   g519      GAWGVKVLRYEIKDLVPPQEILRAMQAQITAEREKRARIAESEGRKIEQINLASGQREAE
               150       160       170       180       190       200

100       110       120       130       140       150
   m519.pep  IQQSEGEAQAAVNASNAEKIARINRAKGEAESLRLVAEANAEAIRQIAAALQTQGGADAV
             ||||||||||||||||||||||||||||||||||||||||||| ||||||||||:|||||
   g519      IQQSEGEAQAAVNASNAEKIARINRAKGEAESLRLVAEANAEANRQIAAALQTQSGADAV
               210       220       230       240       250       260

160       170       180       190       200
   m519.pep  NLKIAEQYVAAFNNLAKESNTLIMPANVADIGSL-ISAGMKIIDSSKTAK
             ||||| |||:||:|||||:|| | ||:||:||:  :    |:   :||||
   g519      NLKIAGQYVTAFKNLAKEDNTRIKPAKVAEIGNPNFRRHEKFSPEAKTAK
               270       280       290       300       310
```

The following partial DNA sequence was identified in *N. meningitidis* <SEQ ID 1451>:

```
a519.seq
   1 ATGGAATTTT TCATTATCTT GCTGGCAGCC GTCGTTGTTT TCGGCTTCAA

51 ATCCTTTGTT GTCATCCCAC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GTATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA

401 TCAACAGCAC CGTCGTCTCC GCCCTCGATG AAGCCGCCGG AGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC TGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCCGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 1452; ORF 519.a>:

```
a519.pep

1 MEFFIILLAA VVVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQYYLRSVIG RMELDKTFEE RDEINSTVVS ALDEAAGAWG

151 VKVLRYEIKD LVPPQEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK* m519/a519   99.5% identity in 199 aa overlap 10        20        30
m519.pep                            SVIGRMELDKTFEERDEINSTVVAALDEAA
                                    ||||||||||||||||||||||||:|||||
a519        YFQVTDPKLASYGSSNYIMAITQLAQTTLRSVIGRMELDKTFEERDEINSTVVSAALDEA
                 90       100       110       120       130       140

40        50        60        70        80        90
m519.pep   GAWGVKVLRYEIKDLVPPQEILRSMQAQITAEREKRARIAESEGRKIEQINLASGQREAE
           ||||||||||||||||||||||||||||||||||||||||||||||||||||||||||||
a519       GAWGVKVLRYEIKDLVPPQEILRSMQAQITAEREKRARIAESEGRKIEQINLASGQREAE
                150       160       170       180       190       200

100       110       120       130       140       150
m519.pep   IQQSEGEAQAAVNASNAEKIARINRAKGEAESLRLVAEANAEAIRQIAAALQTQGGADAV
           ||||||||||||||||||||||||||||||||||||||||||||||||||||||||||||
a519       IQQSEGEAQAAVNASNAEKIARINRAKGEAESLRLVAEANAEAIRQIAAALQTQGGADAV
                210       220       230       240       250       260

160       170       180       190       200
m519.pep   NLKIAEQYVAAFNNLAKESNTLIMPANVADIGSLISAGMKIIDSSKTAKX
           ||||||||||||||||||||||||||||||||||||||||||||||||||
a519       NLKIAEQYVAAFNNLAKESNTLIMPANVADIGSLISAGMKIIDSSKTAKX
                270       280       290       300       310
```

The following partial DNA sequence was identified in *N. gonorrhoeae* <SEQ ID 1453>:

```
g519-1.seq
  1 ATGGAATTTT TCATTATCTT GTTGGCAGCC GTCGCCGTTT TCGGCTTCAA

51 ATCCTTTGTC GTCATCCCCC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGATAA TACGCAATTG ACTGTTGACG

251 GCATCATCTA TTTCCAAGTA ACCGATCCCA AACTCGCCTC ATACGGTTCG

301 AGCAACTACA TTATGGCAAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC CGTCGTCTCC GCCCTCGATG AAGCCGCCGG GGCTTGGGGT

451 GTGAAAGTCC TCCGTTACGA AATCAAGGAT TTGGTTCCGC CGCAAGAAAT

501 CCTTCGCGCA ATGCAGGCAC AAATTACCGC CGAACGCGAA AAACGCGCCC

551 GTATTGCCGA ATCCGAAGGC CGTAAAATCG AACAAATCAA CCTTGCCAGT

601 GGTCAGCGTG AAGCCGAAAT CCAACAATCC GAAGGCGAGG CTCAGGCTGC

651 GGTCAATGCG TCCAATGCCG AGAAAATCGC CGCATCAAC CGCGCCAAAG

701 GCGAAGCGGA ATCCCTGCGC CTTGTTGCCG AAGCCAATGC CGAAGCCATC

751 CGTCAAATTG CCGCCGCCCT TCAAACCCAA GGCGGGGCGG ATGCGGTCAA
```

```
 801 TCTGAAGATT GCGGAACAAT ACGTAGCCGC GTTCAACAAT CTTGCCAAAG

851 AAAGCAATAC GCTGATTATG CCCGCCAATG TTGCCGACAT CGGCAGCCTG

901 ATTTCTGCCG GCATGAAAAT TATCGACAGC AGCAAAACCG CCAAATAA
```

This corresponds to the amino acid sequence <SEQ ID 1454; ORF 519-1.ng>:

```
g519-1.pep
   1 MEFFIILLAA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINSTVVS ALDEAAGAWG

151 VKVLRYEIKD LVPPQEILRA MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK*
```

The following partial DNA sequence was identified in *N. meningitidis* <SEQ ID 1455>:

```
m519-1.seq
   1 ATGGAATTTT TCATTATCTT GTTGGTAGCC GTCGCCGTTT TCGGTTTCAA

51 ATCCTTTGTT GTCATCCCAC AACAGGAAGT CCACGTTGTC GAAAGGCTGG

101 GGCGTTTCCA TCGCGCCCTG ACGGcCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GCATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAGT TGGACAAAAC GTTTGAAGAA CGCGACGAAA

401 TCAACAGTAC TGTTGTTGCG GCTTTGGACG AGGCGGCCGG GGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC CGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC

751 CGTCAAATTG CCGCCGCCCT TCAAACCCAA GGCGGTGCGG ATGCGGTCAA

801 TCTGAAGATT GCGGAACAAT ACGTCGCTGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 1456; ORF 519-1>:

```
m519-1.

1 MEFFIILLVA VAVFGFKSFV VIPQQEVHVV ERLGRFHRAL TAGLNILIPF

51 IDRVAYRHSL KEIPLDVPSQ VCITRDNTQL TVDGIIYFQV TDPKLASYGS
```

-continued
```
101 SNYIMAITQL AQTTLRSVIG RMELDKTFEE RDEINETVVA ALDEAAGAWG

151 VKVLRYEIKD LVPPQEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQYVAAFNN LAKESNTLIM PANVADIGSL

301 ISAGMKIIDS SKTAK*
``` m519-1/g519-1 99.0% identity in 315 aa overlap

```
                    10        20        30        40        50        60
g519-1.pep   MEFFIILLAAVAVFGFKSFVVIPQQEVHVVERLGRFHRALTAGLNILIPFIDRVAYRHSL
             ||||||||:|||||||||||||||||||||||||||||||||||||||||||||||||||
m519-1       MEFFIILLVAVAVFGFKSFVVIPQQEVHVVERLGRFHRALTAGLNILIPFIDRVAYRHSL
                    10        20        30        40        50        60

70        80        90       100       110       120
g519-1.pep   KEIPLDVPSQVCITRDNTQLTVDGIIYFQVTDPKLASYGSSNYIMAITQLAQTTLRSVIG
             ||||||||||||||||||||||||||||||||||||||||||||||||||||||||||||
m519-1       KEIPLDVPSQVCITRDNTQLTVDGIIYFQVTDPKLASYGSSNYIMAITQLAQTTLRSVIG
                    70        80        90       100       110       120

130       140       150       160       170       180
g519-1.pep   RMELDKTFEERDEINSTVVSALDEAAGAWGVKVLRYEIKDLVPPQEILRAMQAQITAERE
             |||||||||||||||||||:|||||||||||||||||||||||||||||:||||||||||
m519-1       RMELDKTFEERDEINSTVVAALDEAAGAWGVKVLRYEIKDLVPPQEILRSMQAQITAERE
                   130       140       150       160       170       180

190       200       210       220       230       240
g519-1.pep   KRARIAESEGRKIEQINLASGQREAEIQQSEGEAQAAVNASNAEKIARINRAKGEAESLR
             ||||||||||||||||||||||||||||||||||||||||||||||||||||||||||||
m519-1       KRARIAESEGRKIEQINLASGQREAEIQQSEGEAQAAVNASNAEKIARINRAKGEAESLR
                   190       200       210       220       230       240

250       260       270       280       290       300
g519-1.pep   LVAEANAEAIRQIAAALQTQGGADAVNLKIAEQYVAAFNNLAKESNTLIMPANVADIGSL
             ||||||||||||||||||||||||||||||||||||||||||||||||||||||||||||
m519-1       LVAEANAEAIRQIAAALQTQGGADAVNLKIAEQYVAAFNNLAKESNTLIMPANVADIGSL
                   250       260       270       280       290       300

310
g519-1.pep   ISAGMKIIDSSKTAKX
             ||||||||||||||||
m519-1       ISAGMKIIDSSKTAKX
                   310
```

The following partial DNA sequence was identified in *N. meningitidis* <SEQ ID 1457>:

```
a519-1.seq
  1 ATGGAATTTT TCATTATCTT GCTGGCAGCC GTCGTTGTTT TCGGCTTCAA

51 ATCCTTTGTT GTCATCCCAC AGCAGGAAGT CCACGTTGTC GAAAGGCTCG

101 GGCGTTTCCA TCGCGCCCTG ACGGCCGGTT TGAATATTTT GATTCCCTTT

151 ATCGACCGCG TCGCCTACCG CCATTCGCTG AAAGAAATCC CTTTAGACGT

201 ACCCAGCCAG GTCTGCATCA CGCGCGACAA TACGCAGCTG ACTGTTGACG

251 GTATCATCTA TTTCCAAGTA ACCGACCCCA AACTCGCCTC ATACGGTTCG

301 AGCAACTACA TTATGGCGAT TACCCAGCTT GCCCAAACGA CGCTGCGTTC

351 CGTTATCGGG CGTATGGAAT TGGACAAAAC GTTTGAAGAA CGCGACGAAA

401 TCAACAGCAC CGTCGTCTCC GCCCTCGATG AAGCCGCCGG AGCTTGGGGT

451 GTGAAGGTTT TGCGTTATGA GATTAAAGAC TTGGTTCCGC CGCAAGAAAT

501 CCTTCGCTCA ATGCAGGCGC AAATTACTGC TGAACGCGAA AAACGCGCCC

551 GTATCGCCGA ATCCGAAGGT CGTAAAATCG AACAAATCAA CCTTGCCAGT

601 GGTCAGCGCG AAGCCGAAAT CCAACAATCC GAAGGCGAGG CTCAGGCTGC

651 GGTCAATGCG TCAAATGCCG AGAAAATCGC CCGCATCAAC CGCGCCAAAG

701 GTGAAGCGGA ATCCTTGCGC CTTGTTGCCG AAGCCAATGC CGAAGCCATC
```

```
751 CGTCAAATTG CCGCCGCCCT TCAAACCCAA GGCGGTGCGG ATGCGGTCAA

801 TCTGAAGATT GCGGAACAAT ACGTCGCCGC GTTCAACAAT CTTGCCAAAG

851 AAAGCAATAC GCTGATTATG CCCGCCAATG TTGCCGACAT CGGCAGCCTG

901 ATTTCTGCCG GTATGAAAAT TATCGACAGC AGCAAAACCG CCAAATAA
```

This corresponds to the amino acid sequence <SEQ ID 1458; ORF 519-1.a>:

```
m519-1.pep.

1 MEFFIILLVA VVVFGFKSFV VIPQQEVHVV ERLGRFHRAL TAGLNILIPF

51 IDRVAYRHSL KEIPLDVPSQ VCITRDNTQL TVDGIIYFQV TDPKLASYGS

101 SNYIMAITQL AQTTLRSVIG RMELDKTFEE RDEINETVVS ALDEAAGAWG

151 VKVLRYEIKD LVPPQEILRS MQAQITAERE KRARIAESEG RKIEQINLAS

201 GQREAEIQQS EGEAQAAVNA SNAEKIARIN RAKGEAESLR LVAEANAEAI

251 RQIAAALQTQ GGADAVNLKI AEQTVAAFNN LAKESNTLIM PANVADIGSL

301 ISAGMKIIDS SKTAK* m519-1/a519-1 99.0% identity in 315 aa overlap 10         20         30         40         50         60
a519-1.pep  MEFFIILLAAVVVFGFKSFVVIPQQEVHVVERLGRFHRALTAGLNILIPFIDRVAYRHSL
            ||||||||:||:||||||||||||||||||||||||||||||||||||||||||||||||
m519-1      MEFFIILLVAVAVFGFKSFVVIPQQEVHVVERLGRFHRALTAGLNILIPFIDRVAYRHSL
                   10         20         30         40         50         60

70         80         90        100        110        120
a519-1.pep  KEIPLDVPSQVCITRDNTQLTVDGIIYFQVTDPKLASYGSSNYIMAITQLAQTTLRSVIG
            ||||||||||||||||||||||||||||||||||||||||||||||||||||||||||||
m519-1      KEIPLDVPSQVCITRDNTQLTVDGIIYFQVTDPKLASYGSSNYIMAITQLAQTTLRSVIG
                   70         80         90        100        110        120

130        140        150        160        170        180
a519-1.pep  RMELDKTFEERDEINSTVVSALDEAAGAWGVKVLRYEIKDLVPPQEILRSMQAQITAERE
            |||||||||||||||||:||||||||||||||||||||||||||||||||||||||||||
m519-1      RMELDKTFEERDEINSTVVAALDEAAGAWGVKVLRYEIKDLVPPQEILRSMQAQITAERE
                  130        140        150        160        170        180

190        200        210        220        230        240
a519-1.pep  KRARIAESEGRKIEQINLASGQREAEIQQSEGEAQAAVNASNAEKIARINRAKGEAESLR
            ||||||||||||||||||||||||||||||||||||||||||||||||||||||||||||
m519-1      KRARIAESEGRKIEQINLASGQREAEIQQSEGEAQAAVNASNAEKIARINRAKGEAESLR
                  190        200        210        220        230        240

250        260        270        280        290        300
a519-1.pep  LVAEANAEAIRQIAAALQTQGGADAVNLKIAEQYVAAFNNLAKESNTLIMPANVADIGSL
            ||||||||||||||||||||||||||||||||||||||||||||||||||||||||||||
m519-1      LVAEANAEAIRQIAAALQTQGGADAVNLKIAEQYVAAFNNLAKESNTLIMPANVADIGSL
                  250        260        270        280        290        300

310
a519-1.pep  ISAGMKIIDSSKTAKX
            |||||||||||||||
m519-1      ISAGMKIIDSSKTAKX
                  310
```

Expression of ORF 519

Figure 8A:
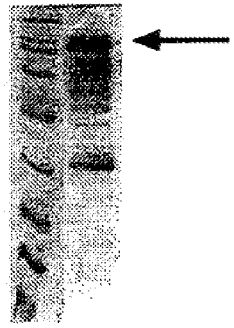
Figure 8B:
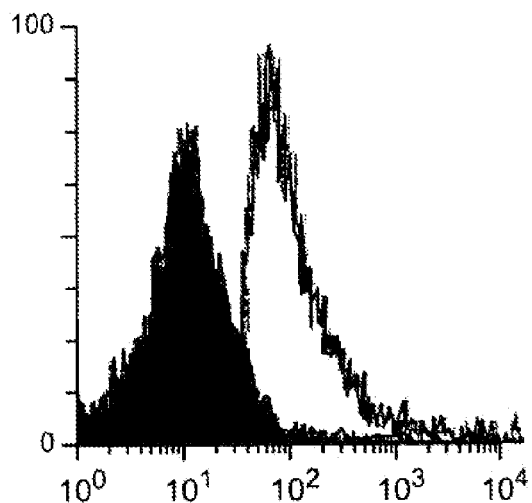
Figure 8C:
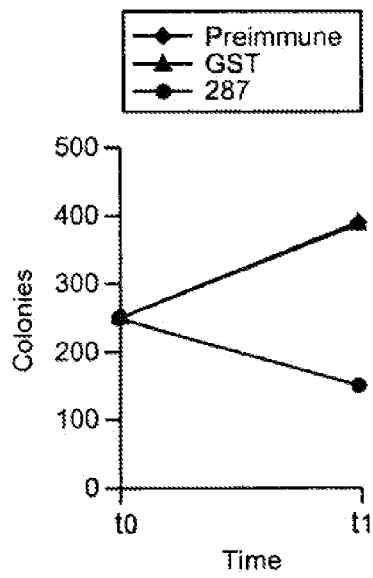
Figure 9A:
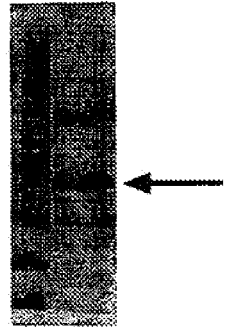
Figure 9B:
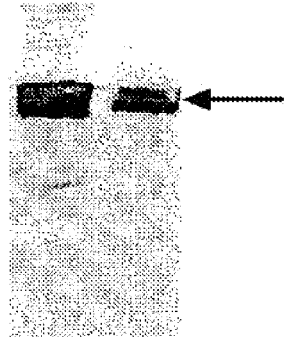
Figure 9C:
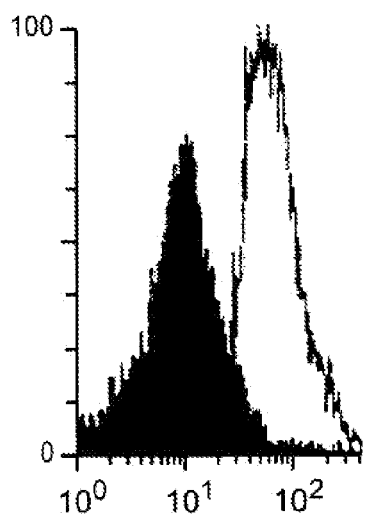
Figure 9D:
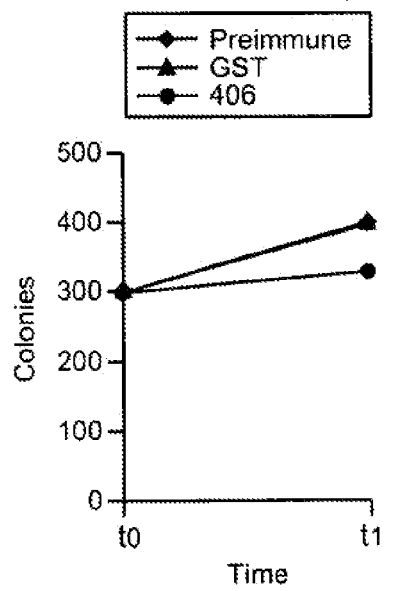

The primer described in Table 1 for ORF 519 was used to locate and clone ORF 519. ORF 519 was cloned in pET and pGex vectors and expressed in E. coli as above described. The products of protein expression and purification were analyzed by SDS-PAGE. FIG. 4A shows the results of affinity purification, and FIG. 4B shows the expression in E. coli. Purified Nis-fusion protein was used to immunize mice whose sera were used for ELISA (positive result), FACS analysis (FIG. 4C), western blot (FIG. 1E), and a bactericidal assay (FIG. 4D). These experiments confirm that 519 is a surface-exposed protein and that it is a useful immunogen. The hydrophilicity plots, antigenic index, and amphipatic regions of ORF 519 are provided in FIG. 8. The AMPHI program is used to predict putative T-cell epitopes (Gao et al 1989, *J. Immunol* 143: 3007; Roberts et al. 1996, *AIDS Res Human Retroviruses* 12:593; Quakyi et al. 1992, *Scand J Immunol Suppl* 11:9). The nucleic acid sequence of ORF 519 and the amino acid sequence encoded thereby as provided herein.

The following partial DNA sequence was identified in *N. gonorrhoeae* <SEQ ID 1459>:

```
g520.seq
   1 atgcctgcgc ttctttcaat acgtcgggca aacgcgctgc cttttcgcg 51 catttcggaa aggatgaagt tgctggtgcc gttaataatg ccggcgatgg 101 atttaatcct gtttgccgcc aaaccttcgc gcacggcttt gatgattggg 151 ataccgcccg ctactgccgc ttcaaattgg acgatgacgt tttgtttttc 201 cgccagcggg aagatttcgt tgccgtattc ggcgagcagt ttttgttgg 251 cggtaacgat gtgtttgccg ttttcaatgg ctttcaacac cgcttctttg 301 gcaatgcccg tgccgccgaa caattcgacc aagacatcga cgtctttacg 351 cgcgaacagt tcgaacggat cttttgacaa gggcgggcga cgggccgatt 401 ttggcgggct ttttcttcgc ttaagtcgca catggcagaa atacggattt 451 cgcgccccaa gcggcgggaa atttcctctg cgttgtcccg caacacggca 501 gccgcaccgc cgccgaccgt acctaagcct aaaagaccga tgtttactgg 551 cttcattgtg tctccttgta agccgactga aatgtaaata ttga
```

This corresponds to the amino acid sequence <SEQ ID 1460; ORF 520.ng>:

```
g520.pep
   1 MPALLSIRRA NALPFSRISE RMKLLVPLIM PAMDLILFAA KPSRTALMIG

51 IPPATAASNW TMTFCFSASG KISLPYSASS FLLAVTMCLP FSMAFNTASL

101 AMPVPPNNST KTSTSLRANS SNGSFDKGGR RADFGGLFLR LSRTWQKYGF

151 RAPSGGKFPL RCPATRQPHR RRPYLSLKDR CLLASLCLLV SRLKCKY*
```

The following partial DNA sequence was identified in *N. meningitidis* <SEQ ID 1461>:

```
m520.seq
   1 ATGCCTGCGC TTCTTTCAGT ACATCG.GCA AACGCGCTGC CTTTTTCGCG

51 CATTTCGGrk AGGATGAAGT TGCTGGTGCC GTTAATAATG CCGGCGATGG

101 ATTTAATCCT GTTTGCCGCC AAACCTTCGC GCAGGGCTTT GATGATTGGG

151 ATACCGCCCG CTACTGCCGC TTCAAATTGG ACGATGACGT TTTGTTTTTC

201 CGCCAGCGGG AAGATTTCGT TGCCGTATTC GGCGAGCAGT TTTTTGTTGG

251 CGGTAACGAT GTGTTTGCCG TTTTCAATGG CTTTCAACAC CGCATCTTTG

301 GCAATGCCGG TACCGCCGaA CAATTCGACG ACGACATCGA CGTCTTCACG

351 TGCGACCAGT TCGAACGGAT CTTTGACAAA GGCTGc.CGG ACGGGCAGGT

401 TTGTCGGGCT TTTTCTTCAC TCAAATCGCA CACGGCAGAA ATACGGATTT

451 CGCGCCCCAA GCGACGGGAA ATTTCCTCCG CGTTGTCsCG CAACACGGCA

501 GCCGTACCGC CGCCGACCGT ACCCAAACCT AAAAGACCGA TGTTTACTGG

551 CTTCATTGTG TCTCCTTGTA AGCCGACTGA AATGTAAATA TTGA
```

This corresponds to the amino acid sequence <SEQ ID 1462; ORF 520>:

```
m520.pep
   1 MPALLSVHXA NALPFSRISX RMKLLVPLIM PAMDLILFAA KPSRRALMIG

51 IPPATAASNW TMTFCFSASG KISLPYSASS FLLAVTMCLP FSMAFNTASL
```

-continued

```
101 AMPVPPNNST TTSTSSRATS SNGSLTKAXR TGRFVGLFLH SNRTRQKYGF

151 RAPSDGKFPP RCXATRQPYR RRPYPNLKDR CLLASLCLLV SRLKCKY*
```

Computer analysis of this amino acid sequence gave the following results:
Homology with a Predicted ORF from *N. gonorrhoeae*
ORF 520 shows 87.3% identity over a 197 aa overlap with a predicted ORF (ORF 520.ng) from *N. gonorrhoeae*:

```
    m520/g520
                     10         20         30         40         50         60
        m520.pep  MPALLSVHRANALPFSRISXRMKLLVPLIMPAMDLILFAAKPSRRALMIGIPPATAASNW
                  ||||||::||||||||||| ||||||||||||||||||||||:|||||||||||||||||
        g520      MPALLSIRRANALPFSRISERMKLLVPLIMPAMDLILFAAKPSRTALMIGIPPATAASNW
                     10         20         30         40         50         60
                     70         80         90        100        110        120
        m520.pep  TMTFCFSASGKISLPYSASSFLLAVTMCLPFSMAFNTASLAMPVPPNNSTTTSTSSRATS
                  |||||||||||||||||||||||||||||||||||||||||||||||||| |||| ||:|
        g520      TMTFCFSASGKISLPYSASSFLLAVTMCLPFSMAFNTASLAMPVPPNNSTKTSTSLRANS
                     70         80         90        100        110        120
                    130        140        150        160        170        180
        m520.pep  SNGSLTKAARTGRFVGLFLHSNRTRQKYGFRAPSDGKFPPRCXATRQPYRRRPYPNLKDR
                  ||||: |::| : | ||||: :|| ||||||||||| |||| || |||||:|||| :||||
        g520      SNGSFDKGGRRADFGGLFLRLSRTWQKYGFRAPSGGKFPLRCPATRQPHRRRPYLSLKDR
                    130        140        150        160        170        180
                    190
        m520.pep  CLLASLCLLVSRLKCKY
                  |||||||||||||||||
        g520      CLLASLCLLVSRLKCKY
                    190
```

The following partial DNA sequence was identified in *N. meningitidis* <SEQ ID 1463>:

```
a520.seq
   1 ATGCCTGCGC TTCTTTCAGT ACATCGG.CA AACGCGCTGC CTTTTTCGCG

51 CATTTCGGAG AGGATGAAGT TGCTGGTGCC GTTAATAATG CCGGCGATGG

101 ATTTAATCCT GTTTGCCGCC AAACCTTCGC GCAGGGCTTT GATGATTGGG

151 ATACCGCCCG CTACTGCCGC TTCAAATTGG ACGATGACGT TTTGTTTTTC

201 CGCCAGCGGG AAGATTTCGT TGCCGTATTC GGCGAGCAGT TTTTTGTTGG

251 CGGTAACGAT GTGTTTGCCG TTTTCAATGG CTTTCAACAC CGCATCTTTG

301 GCAATGCCGG TACCGCCGAA CAATTCGACG ACGACATCGA CGTCTTCACG

351 TGCGACCAGT TCGAACGGAT CTTTGACAAA GGCTG..CGG ACGGGCAGGT

401 TTGTCGGGCT TTTTCTTCAC TCAAATCGCA CACGGCAGAA ATACGGATTT

451 CGCGCCCCAA GCGACGGGAA ATTTCCTCCG CGTTGTCCCG CAACACGGCA

501 GCCGTACCGC CGCCGACCGT ACCCAAACCT AAAAGACCGA TGTTTACTGG

551 CTTCATTGTG TCTCCTTGTA AGCCGACTGA AATGTAAATA TTGA
```

This corresponds to the amino acid sequence <SEQ ID 1464; ORF 520.a>:

```
a520.pep
   1 MPALLSVHRX NALPFSRISE RMKLLVPLIM PAMDLILFAA KPSRRALMIG

51 IPPATAASNW TMTFCFSASG KISLPYSASS FLLAVTMCLP FSMAFNTASL

101 AMPVPPNNST TTSTSSRATS SNGSLTKAXR TGRFVGLFLH SNRTRQKYGF

151 RAPSDGKFPP RCPATRQPYR RRPYPNLKDR CLLASLCLLV SRLKCKY*
``` m520/a520 98.0% identity in 197 aa overlap

```
                  10        20        30        40        50        60
m520.pep  MPALLSVHXANALPFSRISXRMKLLVPLIMPAMDLILFAAKPSRRALMIGIPPATAASNW
          ||||||||| ||||||||| ||||||||||||||||||||||||||||||||||||||||
a520      MPALLSVHRXNALPFSRISERMKLLVPLIMPAMDLILFAAKPSRRALMIGIPPATAASNW
                  10        20        30        40        50        60

70        80        90       100       110       120
m520.pep  TMTFCFSASGKISLPYSASSFLLAVTMCLPFSMAFNTASLAMPVPPNNSTTTSTSSRATS
          ||||||||||||||||||||||||||||||||||||||||||||||||||||||||||||
a520      TMTFCFSASGKISLPYSASSFLLAVTMCLPFSMAFNTASLAMPVPPNNSTTTSTSSRATS
                  70        80        90       100       110       120

130       140       150       160       170       180
m520.pep  SNGSLTKAXRTGRFVGLFLHSNRTRQKYGFRAPSDGKFPPRCXATRQPYRRRPYPNLKDR
          |||||||||||||||||||||||||||||||||||||||||| |||||||||||||||||
a520      SNGSLTKAXRTGRFVGLFLHSNRTRQKYGFRAPSDGKFPPRCPATRQPYRRRPYPNLKDR
                 130       140       150       160       170       180

190
m520.pep  CLLASLCLLVSRLKCKYX
          ||||||||||||||||||
a520      CLLASLCLLVSRLKCKYX
                 190
```

The following partial DNA sequence was identified in *N. gonorrhoeae* <SEQ ID 1465>:

```
g520-1.seq
   1 ATGAAGTTGC TGGTGCCGTT AATAATGCCG GCGATGGATT TAATCCTGTT

51 TGCCGCCAAA CCTTCGCGCA GGGCTTTGAT GATTGGGATA CCGCCCGCTA

101 CTGCCGCTTC AAATTGGACG ATGACGTTTT GTTTTCCGC CAGCGGGAAG

151 ATTTCGTTGC CGTATTCGGC GAGCAGTTTT TTGTTGGCGG TAACGATGTG

201 TTTGCCGTTT TCAATGGCTT TCAACACCGC TTCTTTGGCA ATGCCCGTGC

251 CGccgAACAA TTCGACGACG ACATCGACGT CTTTACGCGC GACCAGTtCG

301 AACGGATCTT TGACAAAGGC GGCGGACGGG CAGATTTGGC GGGCTTTTTC

351 TTCGCTTAAG TCGCACATGG CAGAAATACG GATTTCGCGC CCCAAGCGGC

401 GGGAAATTTC CTCTGCGTTG TCCCGCAACA CGGCAGCCGC ACCGCCGCCG

451 ACCgTACCTA AGCCTAAAAG ACCGATGTTT ACTGGCTTCA TTGTGTCTCC

501 TTGTAAGCCG ACTGAAATGT AA
```

This corresponds to the amino acid sequence <SEQ ID 1466; ORF 520-1.ng>:

```
g520-1.pep
   1 MKLLVPLIMP AMDLILFAAK PSRRALMIGI PPATAASNWT MTFCFSASGK

51 ISLPYSASSF LLAVTMCLPF SMAFNTASLA MPVPPNNSTT TSTSLRATSS

101 NGSLTKAADG QIWRAFSSLK SHMAEIRISR PKRREISSAL SRNTAAAPPP

151 TVPKPKRPMF TGFIVSPCKP TEM*
```

The following partial DNA sequence was identified in *N. meningitidis* <SEQ ID 1467>:

```
m520-1.seq
   1 ATGAAGTTGC TGGTGCCGTT AATAATGCCG GCGATGGATT TAATCCTGTT

51 TGCCGCCAAA CCTTCGCGCA GGGCTTTGAT GATTGGGATA CCGCCCGCTA

101 CTGCCGCTTC AAATTGGACG ATGACGTTTT GTTTTCCGC CAGCGGGAAG

151 ATTTCGTTGC CGTATTCGGC GAGCAGTTTT TTGTTGGCGG TAACGATGTG
```

```
-continued
201 TTTGCCGTTT TCAATGGCTT TCAACACCGC ATCTTTGGCA ATGCCGGTAC

251 CGCCGAACAA TTCGACGACG ACATCGACGT CTTCACGTGC GACCAGTTCG

301 AACGGATCTT TGACAAAGGC TGCGGACGGG CAGGTTTGTC GGGCTTTTTC

351 TTCACTCAAA TCGCACACGG CAGAAATACG GATTTCGCGC CCCAAGCGAC

401 GGGAAATTTC CTCCGCGTTG TCCCGCAACA CGGCAGCCGT ACCGCCGCCG

451 ACCGTACCCA AACCTAAAAG ACCGATGTTT ACTGGCTTCA TTGTGTCTCC

501 TTGTAAGCCG ACTGAAATGT AA
```

This corresponds to the amino acid sequence <SEQ ID 1468; ORF 520-1>:

```
m520-1.pep

1 MKLLVPLIMP AMDLILFAAK PSRRALMIGI PPATAASNWT MTFCFSASGK

51 ISLPYSASSF LLAVTMCLPF SMAFNTASLA MPVPPNNSTT TSTSSRATSS

101 NGSLTKAADG QVCRAFSSLK SHTAEIRISR PKRREISSAL SRNTAAVPPP

151 TVPKPKRPMF TGFIVSPCKP TEM* g520-1/m520-1 97.1% identity in 173 aa overlap 10         20         30         40         50         60
g520-1.pep  MKLLVPLIMPAMDLILFAAKPSRRALMIGIPPATAASNWTMTFCFSASGKISLPYSASSF
            ||||||||||||||||||||||||||||||||||||||||||||||||||||||||||||
m520-1      MKLLVPLIMPAMDLILFAAKPSRRALMIGIPPATAASNWTMTFCFSASGKISLPYSASSF
                10         20         30         40         50         60
                70         80         90        100        110        120
g520-1.pep  LLAVTMCLPFSMAFNTASLAMPVPPNNSTTTSTSLRATSSNGSLTKAADGQIWRAFSSLK
            |||||||||||||||||||||||||||||||||||: ||||||||||||||||:||||||
m520-1      LLAVTMCLPFSMAFNTASLAMPVPPNNSTTTSTSSRATSSNGSLTKAADGQVCRAFSSLK
                70         80         90        100        110        120
              130        140        150        160        170
g520-1.pep  SHMAEIRISRPKRREISSALSRNTAAPPPTVPKPKRPMFTGFIVSPCKPTEMX
            || |||||||||||||||||||||||:|||||||||||||||||||||||||
m520-1      SHTAEIRISRPKRREISSALSRNTAAVPPPTVPKPKRPMFTGFIVSPCKPTEMX
              130        140        150        160        170
```

The following partial DNA sequence was identified in *N. meningitidis* <SEQ ID 1469>:

```
a520-1.seq
  1 ATGAAGTTGC TGGTGCCGTT AATAATGCCG GCGATGGATT TAATCCTGTT

51 TGCCGCCAAA CCTTCGCGCA GGGCTTTGAT GATTGGGATA CCGCCCGCTA

101 CTGCCGCTTC AAATTGGACG ATGACGTTTT GTTTTCCGC CAGCGGGAAG

151 ATTTCGTTGC CGTATTCGGC GAGCAGTTTT TTGTTGGCGG TAACGATGTG

201 TTTGCCGTTT TCAATGGCTT TCAACACCGC ATCTTTGGCA ATGCCGGTAC

251 CGCCGAACAA TTCGACGACG ACATCGACGT CTTCACGTGC GACCAGTTCG

301 AACGGATCTT TGACAAAGGC TGCGGACGGG CAGGTTTGTC GGGCTTTTTC

351 TTCACTCAAA TCGCACACGG CAGAAATACG GATTTCGCGC CCCAAGCGAC

401 GGGAAATTTC CTCCGCGTTG TCCCGCAACA CGGCAGCCGT ACCGCCGCCG

451 ACCGTACCCA AACCTAAAAG ACCGATGTTT ACTGGCTTCA TTGTGTCTCC

501 TTGTAAGCCG ACTGAAATGT AA
```

This corresponds to the amino acid sequence <SEQ ID 1470; ORF 520-1.a>:

```
a520-1.pep

1 MKLLVPLIMP AMDLILFAAK PSRRALMIGI PPATAASNWT MTFCFSASGK

51 ISLPYSASSF LLAVTMCLPF SMAFNTASLA MPVPPNNSTT TSTSSRATSS

101 NGSLTKAADG QVCRAFSSLK SHTAEIRISR PKRREISSAL SRNTAAVPPP

151 TVPKPKRPMF TGFIVSPCKP TEM* m520-1/a520-1 100.0% identity in 173 aa overlap 10         20         30         40         50         60
    a520-1.pep  MKLLVPLIMPAMDLILFAAKPSRRALMIGIPPATAASNWTMTFCFSASGKISLPYSASSF
                ||||||||||||||||||||||||||||||||||||||||||||||||||||||||||||
    m520-1      MKLLVPLIMPAMDLILFAAKPSRRALMIGIPPATAASNWTMTFCFSASGKISLPYSASSF
                       10         20         30         40         50         60
                       70         80         90        100        110        120
    a520-1.pep  LLAVTMCLPFSMAFNTASLAMPVPPNNSTTTSTSSRATSSNGSLTKAADGQVCRAFSSLK
                ||||||||||||||||||||||||||||||||||||||||||||||||||||||||||||
    m520-1      LLAVTMCLPFSMAFNTASLAMPVPPNNSTTTSTSSRATSSNGSLTKAADGQVCRAFSSLK
                       70         80         90        100        110        120
                      130        140        150        160        170
    a520-1.pep  SHTAEIRISRPKRREISSALSRNTAAVPPPTVPKPKRPMFTGFIVSPCKPTEMX
                |||||||||||||||||||||||||||||||||||||||||||||||||||||
    m520-1      SHTAEIRISRPKRREISSALSRNTAAVPPPTVPKPKRPMFTGFIVSPCKPTEMX
                      130        140        150        160        170
```

The following partial DNA sequence was identified in *N. gonorrhoeae* <SEQ ID 1471>:

```
g521.seq
    1 ATGAAATCAA AACTCCCCTT AATCCTAATC AACCTTTCCC TGATTTCAAG

51 CCCATTGGGT GCGAATGCGG CCAAAATCTA TACCTGCACA ATCAACGGAG

101 AAACCGTTTA CACCACCAAG CCGTCTAAAA GCTGCCACTC AACCGATTTG

151 CCCCCAATCG GCAACTACAG CAGCGAACGC TATATCCTGC CCCAAACTCC

201 CGAACCGGCA CCATCACCGT CAAACGGCGG ACAGGCTGTC AAATATAAAG

251 CCCCGGTCAA AACAGTATCC AAGCCGGCAA AATCCAATAC GCCGCCTCAA

301 CAAGCACCTG TAAATAACAG CAGACGCTCC ATTCTcgaag caGaattaag 351 cAatgaacgc aaagccctGa ctGaAGCCCA AAAAATGTTA TCACAagcac 401 gtCtGGCAAA AGGCGgcaAC AtcaaCCatc aaaAaatcaa cgcattgtaa 451 AGCAATGTTt tggacAGACA GCAAAATaTC Caagcactgc aaaGAgAATt

501 GGGACGTATG TAA
```

This corresponds to the amino acid sequence <SEQ ID 1472; ORF 521.ng>:

```
g521n.pep

1 MKSKLPLILI NLSLISSPLG ANAAKIYTCT INGETVYTTK PSKSCHSTDL

51 PPIGNYSSER YILPQTPEPA PSPSNGGQAV KYKAPVKTVS KPAKSNTPPQ

101 QAPVNNSRRS ILEAELSNER KALTEAQKML SQARLAKGGN INHQKINAL*

151 SNVLDRQQNI QALQRELGRM *
```

The following partial DNA sequence was identified in *N. meningitidis* <SEQ ID 1473>:

```
m521.seq
   1 ATGAAATCAA AACTCCTCTT AATCCTAATC AACTTTTCCC TGATTTCAAG

51 CCCATTGGGT GCGAATGCGG CCAAAATCTA sACCTGCACA ATCAACGGAG

101 AAACCGTTTA CACCAsCAAG CCGTCCAAAA GCTGCCACTC AACCGATTTG

151 CCCCCAATCG GCAACTACAG CAGCGAACGC TATATCCCGC CCCAAACGCC

201 CGAACCGGTA TCATCACCGT CAAACGGCGG ACwGGTTGTC AAATATAAAG

251 CCCCGGTCAA AACAGTATCC AAGCCGGCAA AATCCArTAC GCCGCCGCCG

301 CAACAAGCAC CCTCAAACAA CAGCAGACGC TCCATTCTCG AAACAGAATT

351 GAGCAACGAA CGCAAAGCAT TGGTTGAAGC CCAAAAAATG TTATCACAAG

401 CACGTCTGGC AAAGGGCGGC AACATCAACC ATCAAGAAAT AAATGCATTA

451 CAAAGCAATG TATTGGACAG GCAGCAAAAT ATTCAAGCCC TGCAAAGGGA

501 ACTGGGGCGT ATGTAA
```

This corresponds to the amino acid sequence <SEQ ID 1474; ORF 521>:

```
m521.pep
   1 MKSKLLLILI NFSLISSPLG ANAAKIXTCT INGETVYTXK PSKSCHSTDL

51 PPIGNYSSER YIPPQTPEPV SSPSNGGXVV KYKAPVKTVS KPAKSXTPPP

101 QQAPSNNSRR SILETELSNE RKALVEAQKM LSQARLAKGG NINHQEINAL

151 QSNVLDRQQN IQALQRELGR M*
```

Computer analysis of this amino acid sequence gave the following results:

Homology with a Predicted ORF from *N. gonorrhoeae*

ORF 521 shows 90.6% identity over a 171 aa overlap with a predicted ORF (ORF 521.ng) from *N. gonorrhoeae*:

```
m521/g521
                       10        20        30        40        50        60
m521.pep      MKSKLLLILINFSLISSPLGANAAKIXTCTINGETVYTXKPSKSCHSTDLPPIGNYSSER
              ||||| |||||:|||||||||||||| |||||||||||:|||||||||||||||||||||
g521          MKSKLPLILINLSLISSPLGANAAKIYTCTINGETVYTTKPSKSCHSTDLPPIGNYSSER
                       10        20        30        40        50        60

70        80        90       100       110       120
m521.pep      YIPPQTPEPVSSPSNGGXVVKYKAPVKTVSKPAKSXTPPPQQAPSNNSRRSILETELSNE
              || ||||||: |||||| :|||||||||||||||| ||| |||| |||||||||:|||||
g521          YILPQTPEPAPSPSNGGQAVKYKAPVKTVSKPAKSNTPP-QQAPVNNSRRSILEAELSNE
                       70        80        90       100       110       120

130       140       150       160       170
m521.pep      RKALVEAQKMLSQARLAKGGNINHQEINALQSNVLDRQQNIQALQRELGRMX
              ||||:||||||||||||||||||||:|||| |||||||||||||||||||||
g521          RKALTEAQKMLSQARLAKGGNINHQKINALXSNVLDRQQNIQALQRELGRMX
            120       130       140       150       160       170
```

The following partial DNA sequence was identified in *N. meningitidis* <SEQ ID 1475>:

```
a521.seq
   1 ATGAAATCAA AACTCCCCTT AATCCTAATC AACTTTTCCC TGATTTCAAG

51 CCCATTGGGT GCGAATGCGG CCAAAATCTA CACCTGCACA ATCAACGGAG

101 AAACCGTTTA CACCACCAAG CCGTCCAAAA GCTGCCTCTC AACCGATTTG

151 CCCCCAATCG GCAACTACAG CAGCGAACGC TATATCCCGC CCCAAACATC
```

-continued

```
201 CGAACCGACA CCATCACCGT CAAACGGCGG ACAGGCTGTC AAATATAAAG

251 CCCCGGTCAA AACAGTATCC AAGCCGGCAA AATCCAATAC GCCGCCGCCG

301 CAACAAGCAC CCTCAAACAA CAGCAGACGC TCCATTCTCG AAACAGAATT

351 GAGCAACGAA CGCAAAGCAT TGGTTGAAGC CCAAAAAATG TTATCACAAG

401 CACGTCTGGC AAAAGGCGGC AACATCAACC ATCAAGAAAT CAACGCATTG

451 CAAAGCAATG TATTGGACAG GCAGCAAAAT ATCCAAGCAC TGCAAAGAGA

501 ATTGGGACGT ATGTAA
```

This corresponds to the amino acid sequence <SEQ ID 1476; ORF 521.a>:

```
a521.pep
  1 MKSKLPLILI NFSLISSPLG ANAAKIYTCT INGETVYTTK PSKSCLSTDL

51 PPIGNYSSER YIPPQTSEPT PSPSNGGQAV KYKAPVKTVS KPAKSNTPPP

101 QQAPSNNSRR SILETELSNE RKALVEAQKM LSQARLAKGG NINHQEINAL

151 QSVLDRQQN IQALQRELGR M*
``` m521/a521 94.2% identity in 171 aa overlap

```
                10        20        30        40        50        60
    m521.pep    MKSKLLLILINFSLISSPLGANAAKIXTCTINGETVYTXKPSKSCHSTDLPPIGNYSSER
                |||||  |||||||||||||||||||| ||||||||||||:|||||| ||||||||||||
    a521        MKSKLPLILINFSLISSPLGANAAKIYTCTINGETVYTTKPSKSCLSTDLPPIGNYSSER
                10        20        30        40        50        60

70        80        90       100       110       120
    m521.pep    YIPPQTPEPVSSPSNGGXVVKYKAPVKTVSKPAKSXTPPPQQAPSNNSRRSILETELSNE
                ||||||  || :||||||  :|||||||||||||||| ||||||||| |||||| ||||
    a521        YIPPQTSEPTPSPSNGGQAVKYKAPVKTVSKPAKSNTPP-QQAPVNNSRRSILEAELSNE
                70        80        90       100       110       120

130       140       150       160       170
    m521.pep    RKALVEAQKMLSQARLAKGGNINHQEINALQSNVLDRQQNIQALQRELGRMX
                ||||||||||||||||||||||||||||||||||||||||||||||||||||
    a521        RKALVEAQKMLSQARLAKGGNINHQEINALQSNVLDRQQNIQALQRELGRMX
                130       140       150       160       170
```

The following partial DNA sequence was identified in *N. gonorrhoeae* <SEQ ID 1477>:

```
g522.seq
  1 atgactgagc cgaaacacga aacgccgacg gaagagcagg ttgccgcgcg 51 caaaaaagca aaagccaaaa tccgcaccat ccgcatttgg gcgtgggtca 101 ttttggcgtt gctcgcttca accgccctgc tctcccaatg cgcgatgtcc 151 aaaccgcagg caaaacagaa aattgtcgag tcttgcatga aaaatattcc 201 gtttgctgaa aaatggcaga acgatttgaa agcgcgcggc ttggatgcgg 251 acaatacccg tctcgccgtc gactactgca aatgtatgtg ggagcagcct 301 ttggacggat tgagcgagaa acagatcagc tccttcggca aactcggtgc 351 acaagaacag cttgacctgc tcggcggcgc aaacgcgttt gaaactcgag 401 acaaacaatg tgtcgcggat ttgaaagccg attga
```

This corresponds to the amino acid sequence <SEQ ID 1478; ORF 522.ng>:

```
g522.pep
  1 MTEPKHETPT EEQVAARKKA KAKIRTIRIW AWVILALLAS TALLSQCAMS

51 KPQAKQKIVE SCMKNIPFAE KWQNDLKARG LDADNTRLAV DYCKCMWEQP

101 LDGLSEKQIS SFGKLGAQEQ LDLLGGANAF ETRDKQCVAD LKAD*
```

The following partial DNA sequence was identified in *N. meningitidis* <SEQ ID 1479>:

```
m522.seq
  1 ATGACTGAGC CGAAACACGA AATGCTGACG AAAGAGCAGG TTGCCGCGCG

51 CAAAAAAGCA AAAGCCAAAA TCCGCACCAT CCGCATTTGG GCGTGGGTCA

101 TTTTGGCGTT GCTCGCTTTA ACCGCCCTGC TCTCCCAATG CGCGATGTCC

151 AAACCGCAGG CAAAACAGAA AATTGTCGAG TCTTGCGTGA AGAATATTCC

201 GTTTGCCGAA AAATGGCAAA ACGATTTGCG GGCCCGCGGT TTAGATTCAA

251 ACAATACCCG CCTCGCCGTC GACTACTGCA AATGTATGTG GGAGCAGCCT

301 TTGGACAGAT TGAGCGAGAA ACAGATTAGA TCCTTCGGCA AACTCGGCGC

351 ACAAGAACAG CTTGACCTGC TCGGCGGCGC AAATGCCTTT GAAGCACGTG

401 ACAAGCAGTG TGTTGCCGAT TTGAAATCAG AATAA
```

This corresponds to the amino acid sequence <SEQ ID 1480; ORF 522>:

```
m522.pep
  1 MTEPKHEMLT KEQVAARKKA KAKIRTIRIW AWVILALLAL TALLSQCAMS

51 KPQAKQKIVE SCVKNIPFAE KWQNDLRARG LDSNNTRLAV DYCKCMWEQP

101 LDRLSEKQIR SFGKLGAQEQ LDLLGGANAF EARDKQCVAD LKSE*
```

Computer analysis of this amino acid sequence gave the following results:
Homology with a Predicted ORF from *N. gonorrhoeae*
ORF 522 shows 91.0% identity over a 144 aa overlap with a predicted ORF (ORF 522.ng) from *N. gonorrhoeae*:

```
m522/g522

10        20        30        40        50        60
       m522.pep  MTEPKHEMLTKEQVAARKKAKAKIRTIRIWAWVILALLALTALLSQCAMSKPQAKQKIVE
                 |||||||  |:||||||||||||||||||||||||||||| |||||||||||||||||||
       g522      MTEPKHETPTEEQVAARKKAKAKIRTIRIWAWVILALLASTALLSQCAMSKPQAKQKIVE
                        10        20        30        40        50        60

70        80        90       100       110       120
       m522.pep  SCVKNIPFAEKWQNDLRARGLDSNNTRLAVDYCKCMWEQPLDRLSEKQIRSFGKLGAQEQ
                 ||:|||||||||||||:|||||::||||||||||||||||||| ||||| ||||||||||
       g522      SCMKNIPFAEKWQNDLKARGLDADNTRLAVDYCKCMWEQPLDGLSEKQISSFGKLGAQEQ
                        70        80        90       100       110       120

130       140
       m522.pep  LDLLGGANAFEARDKQCVADLKSEX
                 ||||||||||:|||||||||||::
       g522      LDLLGGANAFETRDKQCVADLKAD
                       130       140
```

The following partial DNA sequence was identified in *N. meningitidis* <SEQ ID 1481>:

```
a522.seq
   1 ATGACTGAGC CGAAACACGA AATGCCGACG GAAGAGCAGG TTGCCGCGCG

51 CAAAAAAGCA AAAGCCAAAA TCCGCACCAT CCGCATTTGG GCATGGGTCA

101 TTTTGGCGTT GCTCGCTTCA ACCGCCCTGC TCTCCCAATG CGCGATGTCC

151 AAACCGCAGG CAAAACAGAA AATTGTCGAG TCTTGCGTGA AGAATATTCC

201 GTTTGCCGAA AAATGGCAAA ACGATTTGCG GGCCCGCGGT TTAGATTCAA

251 ACAATACCCG CCTTACCGTC GACTACTGCA AATGTATGTG GGAGCAGCCT

301 TTGGACAGAT TGAGCGAGAA ACAGATTAGT TCCTTCGGCA AACTCGGCGC

351 ACAAGAACAG CTTGACCTGC TCGGCGGCGC AAATGCCTTT GAAACGCGAG

401 ACAAGCAGTG TGTTGCCGAT TTGAAATCAG AATAA
```

This corresponds to the amino acid sequence <SEQ ID 1482; ORF 522.a>:

```
a522.pep
   1 MTEPKHEMPT EEQVAARKKA KAKIRTIRIW AWVILALLAS TALLSQCAMS

51 KPQAKQKIVE SCVKNIPFAE KWQNDLRARG LDSNNTRLTV DYCKCMWEQP

101 LDRLSEKQIS SFGKLGAQEQ LDLLGGANAF ETRDKQCVAD LKSE*
``` m522/a522 95.8% identity in 144 aa overlap

```
                       10        20        30        40        50        60
m522.pep    MTEPKHEMLTKEQVAARKKAKAKIRTIRIWAWVILALLALTALLSQCAMSKPQAKQKIVE
            |||||||| |:||||||||||||||||||||||||| |||||||||||||||||||||||
a522        MTEPKHEMPTEEQVAARKKAKAKIRTIRIWAWVILASLASTALLSQCAMSKPQAKQKIVE
                       10        20        30        40        50        60

70        80        90       100       110       120
m522.pep    SCVKNIPFAEKWQNDLRARGLDSNNTRLAVDYCKCMWEQPLDRLSEKQIRSFGKLGAQEQ
            ||||||||||||||||||||||||||||:||||||||||||||||||||| ||||||||||
a522        SCVKNIPFAEKWQNDLRARGLDSNNTRLTVDYCKCMWEQPLDGLSEKQISSFGKLGAQEQ
                       70        80        90       100       110       120

130       140
m522.pep    LDLLGGANAFEARDKQCVADLKSEX
            |||||||||||:|||||||||||||
a522        LDLLGGANAFETRDKQCVADLKSEX
                      130       140
```

The following partial DNA sequence was identified in *N. gonorrhoeae* <SEQ ID 1483>:

```
g523.seq
   1 atgactgtat ggtttgttgc cgctgttgcc gtcttaatca tcgaattatt 51 gacgggaacg gtttatcttt tggttgtcag cgcggctttg gcgggttcgg 101 gcattgccta cgggctgact ggcagcacgc ctgccgccgt cttgaccgcc 151 gcactgcttt ccgcgctggg catttggttc gtacatgcca aaaccgccgt 201 gggaaaagtt gaaacggatt catatcagga tttggatacc ggaaaaatatg 251 ccgaaatcct ccgatacaca ggcggcaacc gttacgaagt tttttatcgc 301 ggtacgcact ggcaggcgca aaatacgggg caggaagtgt ttgaaccggg 351 aacgcgcgcc ctcatcgtcc gcaaagaagg taaccttctt atcatcgcaa 401 acccttaa
```

This corresponds to the amino acid sequence <SEQ ID 1484; ORF 523.ng>:

```
g523.pep
   1 MTVWFVAAVA VLIIELLTGT VYLLVVSAAL AGSGIAYGLT GSTPAAVLTA

51 ALLSALGIWF VHAKTAVGKV ETDSYQDLDT GKYAEILRYT GGNRYEVFYR

101 GTHWQAQNTG QEVFEPGTRA LIVRKEGNLL IIANP*
```

The following partial DNA sequence was identified in *N. meningitidis* <SEQ ID 1485>:

```
m523.seq (partial)
   1 ..GCCGTCTTAA TCATCGAATT ATTGACGGGA ACGGTTTATC TTTTGGTTGT 51    nAGCGCGGCT TTGGCGGGTT CGGGCATTGC TTACGGGCTG ACCGGCAGTA 101    CGCCTGCCGC CGTCTTGACC GnCGCTCTGC TTTCCGCGCT GGGTATTTnG

151    TTCGTACACG CCAAAACCGC CGTTAGAAAA GTTGAAACGG ATTCATATCA

201    GGATTTGGAT GCCGGACAAT ATGTCGAAAT CCTCCGACAC ACAGGCGGCA

251    ACCGTTACGA AGTTTTtTAT CGCGGTACGc ACTGGCAGGC TCAAAATACG

301    GGGCAAGAAG AGCTTGAACC AGGAACTCGC GCCCTCATTG TCCGCAAGGA

351    AGGCAACCTT CTTATTATCA CACACCCTTAA
```

This corresponds to the amino acid sequence <SEQ ID 1486; ORF 523>:

```
m523.pep (partial)
   1 ..AVLIIELLTG TVYLLVVSAA LAGSGIAYGL TGSTPAAVLT XALLSALGIX

51    FVHAKTAVRK VETDSYQDLD AGQYVEILRH TGGNRYEVFY RGTHWQAQNT

101    GQEELEPGTR ALIVRKEGNL LIITHP*
```

Computer analysis of this amino acid sequence gave the following results:
Homology with a Predicted ORF from *N. gonorrhoeae*
ORF523 shows 91.3% identity over a 126 aa overlap with a predicted ORF (ORF 523.ng) from *N. gonorrhoeae*:

```
    m523/g523

10         20         30         40         50
         m523.pep            AVLIIELLTGTVYLLVVSAALAGSGIAYGLTGSTPAAVLTXALLSALGIXF
                             ||||||||||||||||||||||||||||||||||||||| ||||||| |
         g523       MTVWFVAAVAVLIIELLTGTVYLLVVSAALAGSGIAYGLTGSTPAAVLTAALLSALGIWF
                    10        20        30        40        50        60

60         70         80         90        100        110
         m523.pep   VHAKTAVRKVETDSYQDLDAGQYVEILRHTGGNRYEVFYRGTHWQAQNTGQEELEPGTRA
                    |||||||  ||||||||||| : : :|||| :||||||||||||||||||||  ||||||
         g523       VHAKTAVGKVETDSYQDLDTGKYAEILRYTGGNRYEVFYRGTHWQAQNTGQEVFEPGTRA
                    70        80        90       100       110       120

120
         m523.pep   LIVRKEGNLLIITHP
                    |||||||||||| ::|
         g523       LIVRKEGNLLIIANPX
                          130
```

The following partial DNA sequence was identified in *N. meningitidis* <SEQ ID 1487>:

```
a523.seq
   1 ATGACTGTAT GGTTTGTTGC CGCTGTTGCC GTCTTAATCA TCGAATTATT

51 GACGGGAACG GTTTATCTTT TGGTTGTCAG CGCGGCTTTG GCGGGTTCGG
```

-continued
```
101 GCATTGCTTA CGGGCTGACC GGCAGCACGC CTGCCGCCGT CTTGACCGCC

151 GCTCTGCTTT CCGCGCTGGG TATTTGGTTC GTACACGCCA AAACCGCCGT

201 GGGAAAAGTT GAAACGGATT CATATCAGGA TTTGGATGCC GGGCAATATG

251 CCGAAATCCT CCGGCACGCA GGCGGCAACC GTTACGAAGT TTTTTATCGC

301 GGTACGCACT GGCAGGCTCA AAATACGGGG CAAGAAGAGC TTGAACCAGG

351 AACGCGCGCC CTAATCGTCC GCAAGGAAGG CAACCTTCTT ATCATCGCAA

401 AACCTTAA
```

This corresponds to the amino acid sequence <SEQ ID 1488; ORF 523.a>:

```
a523.pep
  1 MTVWFVAAVA VLIIELLTGT VYLLVVSAAL AGSGIAYGLT GSTPAAVLTA

51 ALLSALGIWF VHAKTAVGKV ETDSYQDLDA GQYAEILRHA GGNRYEVFYR

101 GTHWQAQNTG QEELEPGTRA LIVRKEGNLL IIAKP*
``` m523/a523 94.4% identity in 126 aa overlap

```
                       10          20         30         40         50
     m523.pep         AVLIIELLTGTVYLLVVSAALAGSGIAYGLTGSTPAAVLTXALLSALGIXF
                      |||||||||||||||||||||||||||||||||||||||| ||||||| |
        a523   MTVWFVAAVAVLIIELLTGTVYLLVVSAALAGSGIAYGLTGSTPAAVLTAALLSALGIWF
                10        20        30        40        50        60

60        70        80        90       100       110
     m523.pep  VHAKTAVRKVETDSYQDLDAGQYVEILRHTGGNRYEVFYRGTHWQAQNTGQEELEPGTRA
                |||||| ||||||||||||||| :||||| ||||||||||||||||||||||| |||||
        a523   VHAKTAVGKVETDSYQDLDAGQYAEILRHAGGNRYEVFYRGTHWQAQNTGQEVFEPGTRA
                70        80        90       100       110       120

120
     m523.pep  LIVRKEGNLLIITHPX
                |||||||||||::||
        a523   LIVRKEGNLLIIAKPX
                130
```

The following partial DNA sequence was identified in *N. gonorrhoeae* <SEQ ID 1489>:

```
g525.seq
  1 atgaagtacg tccggttatt tttcctcggc acggcactcg ccggcactca 51 agcggcggct gccgaaatgg ttcaaatcga aggcggcagc taccgccgc 101 tttatctgaa aaaagatacc ggcctgatta aagtcaaacc gttcaaactg 151 gataaatatc ccgttaccaa tgccgagttt gccgaatttg tcaacagcca 201 cccccaatgg caaaaaggca ggatcggttc caaacaggca gaacccgctt 251 acctgaagca ttggatgaaa aacggcagcc gcagctatgc gccgaaggcg 301 ggcgaattga aacagccggt taccaatatt tcctggtttg ccgccaacgc 351 ctattgcgcc gcacaaggca aacgcctgcc gaccatcgac gaatgggaat 401 ttgccggact tgcttccgcc acgcagaaaa aacggctcaa acgaacccgg 451 ctacaaccgc actattctcg attggtatgc cgacggcgga cggaaaggcc 501 tgcacgatgt cggcaaagca ccgcccgaac tactggggtg tttatgatat 551 gcacgggctg a
```

This corresponds to the amino acid sequence <SEQ ID 1490; ORF 525.ng>:

```
g525.pep
   1 MKYVRLFFLG TALAGTQAAA AEMVQIEGGS YRPLYLKKDT GLIKVKPFKL

51 DKYPVTNAEF AEFVNSHPQW QKGRIGSKQA EPAYLKHWMK NGSRSYAPKA

101 GELKQPVTNI SWFAANAYCA AQGKRLPTID EWEFAGLASA TQKKRLKRTR

151 LQPHYSRLVC RRRTERPARC RQSTARTTGV FMICTG *
```

The following partial DNA sequence was identified in N. meningitidis <SEQ ID 1491>:

```
m525.seq
   1 ATGAAGTATG TCCGGTTATT TTwCCTCGGC GCGGCACTCG cCrrCACTCA

51 ArCGGCGGCT GcCGAAATGG TTCAAATCGA AGGCGGCAgC TACCGCCCrC

101 TTTATCTGAA AAAAGATACC GGCCTGATTA AGTCAAACC GTTCAAACTG

151 GATAAATATC CCGTTACCAA TGCCGAGTTT GCCGAATTTG TCAACAGCCA

201 CCCCCAATGG CAAAAAGGCA GGATCGGTTC CAAACAGGCA GAACCCGCTT

251 ACCTGAAGCA TTGGATGAAA AACGGCAGCC GCAGCTATGc GCCGAAGgCG

301 GgCGAATTAA ACAACCGGT AACCAATGTT TCCTGGwTTG CCGCCAAcGC

351 CTAtTGCGCC GCACAAGGCA AACGCCTGCC GACCATTGAC GAATGGGAAT

401 TTGCCGGACT TGCTTCCGCC ACGCAGAAAA A.CGGCTCAA ACGAACCCGG

451 CTACAACCGC ACTATTCTCG ATTGGTATGC CGACGGCGGA CGGAAAGGCC

501 TGCACGATGT CGGCA.AAGG CCGCCCGAAC TACTGGGGCG TTTATGATAT

551 GCACGGGCTG A
```

This corresponds to the amino acid sequence <SEQ ID 1492; ORF 525>:

```
m525.pep
   1 MKYVRLFXLG AALAXTQXAA AEMVQIEGGS YRPLYLKKDT GLIKVKPFKL

51 DKYPVTNAEF AEFVNSHPQW QKGRIGSKQA EPAYLKHWMK NGSRSYAPKA

101 GELKQPVTNV SWXAANAYCA AQGKRLPTID EWEFAGLASA TQKXRLKRTR

151 LQPHYSRLVC RRRTERPARC RXKAARTTGA FMICTG*
```

Computer analysis of this amino acid sequence gave the following results:
Homology with a Predicted ORF from N. gonorrhoeae
ORF 525 shows 94.1% identity over a 186 aa overlap with a predicted ORF (ORF 525.ng) from N. gonorrhoeae:

```
m525/g525

10         20         30         40         50         60
     m525.pep    MKYVRLFXLGAALAXTQXAAAEMVQIEGGSYRPLYLKKDTGLIKVKPFKLDKYPVTNAEF
                 ||||||| ||:||| || |||||||||||||||||||||||||||||||||||||||||
     g525        MKYVRLFFLGTALAGTQAAAAEMVQIEGGSYRPLYLKKDTGLIKVKPFKLDKYPVTNAEF
                   10         20         30         40         50         60

70         80         90        100        110        120
     m525.pep    AEFVNSHPQWQKGRIGSKQAEPAYLKHWMKNGSRSYAPKAGELKQPVTNVSWXAANAYCA
                 |||||||||||||||||||||||||||||||||||||||||||||||||:|| ||||||
     g525        AEFVNSHPQWQKGRIGSKQAEPAYLKHWMKNGSRSYAPKAGELKQPVTNISWFAANAYCA
                   70         80         90        100        110        120
```

-continued

```
                    130       140       150       160       170       180
m525.pep    AQGKRLPTIDEWEFAGLASATQKXRLKRTRLQPHYSRLVCRRRTERPARCRXKAARTTGA
            |||||||||||||||||||||| ||||||||||||||||||||||||||||| ::|||||:
g525        AQGKRLPTIDEWEFAGLASATQKKRLKRTRLQPHYSRLVCRRRTERPARCRQSTARTTGV
                    130       140       150       160       170       180 m525.pep    FMICTGX
            |||||||
g525        FMICTGX
```

The following partial DNA sequence was identified in *N. meningitidis* <SEQ ID 1493>:

```
a525.seq
   1 ATGAAGTTTA CCCGGTTACT CTTTCTCTGT GCGGCACTCG CCGGCACTCA

51 AGCGGCAGCT GCCGAAATGG TTCAAATCGA AGGCGGCAGC TACCGCCCGC

101 TTTATCTGAA AAAAGATACC GGCCTGATTA AAGTCAAACC GTTCAAACTG

151 GATAAATATC CCGTTACCAA TGCCGAGTTT GCCGAATTTG TCAACAGCCA

201 CCCCCAATGG CAAAAAGGCA GGATCGGTTC CAAACAGGCA GAACCCGCTT

251 ACCTGAAGCA TTGGATGAAA AACGGCAGCC GCAGCTATGC GCCGAAGGCG

301 GGCGATTTAA AACAACCGGT AACCAATGTT TCCTGGTTCG CCGCCAACGC

351 CTATTGCGCC GCACAAGGCA AACGCCTGCC GACCATTGAC GAATGGGAAT

401 TTGCCGGACT TGCCTCCGCC ACGCAG.AAA AACGGCTCAA ACGAACCCGG

451 CTACAACCGC ACTATTCTCG ACTGGTATGC GGATGGCGAC CGGAAAGACC

501 TGCACGATGT CGGCAAAG.G TCGCCCGAAC TACTGGGGCG TTTATGATAT

551 GCACGGTCTG A
```

This corresponds to the amino acid sequence <SEQ ID 1494; ORF 525.a>:

```
a525.pep
   1 MKFTRLLFLC AALAGTQAAA AEMVQIEGGS YRPLYLKKDT GLIKVKPFKL

51 DKYPVTNAEF AEFVNSHPQW QKGRIGSKQA EPAYLKHWMK NGSRSYAPKA

101 GDLKQPVTNV SWFAANAYCA AQGKRLPTID EWEFAGLASA TQXKRLKRTR

151 LQPHYSRLVC GWRPERPARC RQXVARTTGA FMICTV*
```

(In the original, "MKFTRLLFLC AALAGTQAAA" is underlined.)

m525/a525 90.8% identity in 185 aa overlap

```
                    10        20        30        40        50        60
m525.pep    MKYVRLFXLGAALAXTQXAAAEMVQIEGGSYRPLYLKKDTGLIKVKPFKLDKYPVTNAEF
            ||::||: | |||| || |||||||||||||||||||||||||||||||||||||||||||
a525        MKFTRLLFLCAALAGTQAAAAEMVQIEGGSYRPLYLKKDTGLIKVKPFKLDKYPVTNAEF
                    10        20        30        40        50        60

70        80        90       100       110       120
m525.pep    AEFVNSHPQWQKGRIGSKQAEPAYLKHWMKNGSRSYAPKAGELKQPVTNVSWXAANAYCA
            ||||||||||||||||||||||||||||||||||||||||:|||||||||| ||||||
a525        AEFVNSHPQWQKGRIGSKQAEPAYLKHWMKNGSRSYAPKAGDLKQPVTNVSWFAANAYCA
                    70        80        90       100       110       120

130       140       150       160       170       180
m525.pep    AQGKRLPTIDEWEFAGLASATQKXRLKRTRLQPHYSRLVCRRRTERPARCRXKAARTTGA
            ||||||||||||||||||||||  ||||||||||||||||  | |||||||  :||||||
a525        AQGKRLPTIDEWEFAGLASATQXKRLKRTRLQPHYSRLVCGWRPERPARCRQXVARTTGA
                   130       140       150       160       170       180 m525.pep    FMICTGX
            |||||
a525        FMICTVX
```

The following partial DNA sequence was identified in *N. gonorrhoeae* <SEQ ID 1495>:

```
g525-1.seq
    1 ATGAAGTACG TCCGGTTATT TTTCCTCGGC ACGGCACTCG CCGGCACTCA

51 AGCGGCGGCT GCCGAAATGG TTCAAATCGA AGGCGGCAGC TACCGCCCGC

101 TTTATCTGAA AAAAGATACC GGCCTGATTA AAGTCAAACC GTTCAAACTG

151 GATAAATATC CCGTTACCAA TGCCGAGTTT GCCGAATTTG TCAACAGCCA

201 CCCCCAATGG CAAAAAGGCA GGATCGGTTC CAAACAGGCA GAACCCGCTT

251 ACCTGAAGCA TTGGATGAAA AACGGCAGCC GCAGCTATGC GCCGAAGGCG

301 GGCGAATTGA AACAGCCGGT TACCAATATT TCCTGGTTTG CCGCCAACGC

351 CTATTGCGCC GCACAAGGCA AACGCCTGCC GACCATCGAC GAATGGGAAT

401 TTGCCGGACT TGCTTCCGCC ACGCAGAAAA ACGGCTCAAA CGAACCCGGC

451 TACAACCGCA CTATTCTCGA TTGGTATGCC GACGGCGGAC GGAAAGGCCT

501 GCACGATGTC GGCAAAGACC GCCCGAACTA CTGGGGTGTT TATGATATGC

551 ACGGGCTGAT TTGGGAATGG ACGGAAGATT TCAACAGCAG CCTGCTTTCT

601 TCCGGCAATG CCAACGCGCA AATGTTTTGC AGCGGCGCAT CTGTCGGGGC

651 GAGCGACTCG TCCAACTATG CCGCCTTCCT CCGCTACGGC ATCCGCACCA

701 GCCTGCAATC CAAATACGTC CTGCACAACT TGGGCTTCCG CTGCGCAAGC

751 CGATAA
```

This corresponds to the amino acid sequence <SEQ ID 1496; ORF 525-1.ng>:

```
g525-1.pep
    1 MKYVRLFFLG TALAGTQAAA AEMVQIEGGS YRPLYLKKDT GLIKVKPFKL

51 DKYPVTNAEF AEFVNSHPQW QKGRIGSKQA EPAYLKHWMK NGSRSYAPKA

101 GELKQPVTNI SWFAANAYCA AQGKRLPTID EWEFAGLASA TQKNGSNEPG

151 YNRTILDWYA DGGRKGLHDV GKDRPNYWGV YDMHGLIWEW TEDFNSSLLS

201 SGNANAQMFC SGASVGASDS SNYAAFLRYG IRTSLQSKYV LHNLGFRCAS

251 R*
```

45

The following partial DNA sequence was identified in *N. meningitidis* <SEQ ID 1497>:

```
m525-1.seq
    1 ATGAAGTATG TCCGGTTATT TTTCCTCGGC GCGGCACTCG CCGGCACTCA

51 AGCGGCGGCT GCCGAAATGG TTCAAATCGA AGGCGGCAGC TACCGCCCGC

101 TTTATCTGAA AAAAGATACC GGCCTGATTA AAGTCAAACC GTTCAAACTG

151 GATAAATATC CCGTTACCAA TGCCGAGTTT GCCGAATTTG TCAACAGCCA

201 CCCCCAATGG CAAAAAGGCA GGATCGGTTC CAAACAGGCA GAACCCGCTT

251 ACCTGAAGCA TTGGATGAAA AACGGCAGCC GCAGCTATGC GCCGAAGGCG

301 GGCGAATTAA ACAACCGGT AACCAATGTT TCCTGGTTTG CCGCCAACGC

351 CTATTGCGCC GCACAAGGCA AACGCCTGCC GACCATTGAC GAATGGGAAT

401 TTGCCGGACT TGCTTCCGCC ACGCAGAAAA ACGGCTCAAA CGAACCCGGC

451 TACAACCGCA CTATTCTCGA TTGGTATGCC GACGGCGGAC GGAAAGGCCT
```

-continued
```
501 GCACGATGTC GGCAAAGGCC GCCCGAACTA CTGGGGCGTT TATGATATGC

551 ACGGGCTGAT TTGGGAATGG ACGGAAGATT TCAACAGCAG CCTGCTTTCT

601 TCCGGCAATG CCAACGCGCA AATGTTTTGC AGCGGCGCGT CTATCGGGTC

651 GAGCGACTCG TCCAACTATG CCGCCTTCCT CCGCTACGGC ATCCGTACCA

701 GCCTGCAATC CAAATATGTC TTGCACAACT TGGGCTTCCG TTGCACAAGC

751 CGATAA
```

This corresponds to the amino acid sequence <SEQ ID 1498; ORF 525-1>:

```
m525-1.pep

1 MKYVRLFFLG AALAGTQAAA AEMVQIEGGS YRPLYLKKDT GLIKVKPFKL

51 DKYPVTNAEF AEFVNSHPQW QKGRIGSKQA EPAYLKHWMK NGSRSYAPKA

101 GELKQPVTNV SWFAANAYCA AQGKRLPTID EWEFAGLASA TQKNGSNEPG

151 YNRTILDWYA DGGRKGLHDV GKGRPNYWGV TDMHGLIWEW TEDFNSSLLS

201 SGNANAQMFC SGASIGSSDS SNYAAFLRYG IRTSLQSKYV LHNLGFRCTS

251 R* m525-1/g525-1 97.6% identity in 251 aa overlap 10        20        30        40        50        60
m525-1.pep   MKYVRLFFLGAALAGTQAAAAEMVQIEGGSYRPLYLKKDTGLIKVKPFKLDKYPVTNAEF
             ||||||||||:|||||||||||||||||||||||||||||||||||||||||||||||
g525-1       MKYVRLFFLGTALAGTQAAAAEMVQIEGGSYRPLYLKKDTGLIKVKPFKLDKYPVTNAEF
                 10        20        30        40        50        60

70        80        90       100       110       120
m525-1.pep   AEFVNSHPQWQKGRIGSKQAEPAYLKHWMKNGSRSYAPKAGELKQPVTNVSWFAANAYCA
             ||||||||||||||||||||||||||||||||||||||||||||||||:|||||||||||
g525-1       AEFVNSHPQWQKGRIGSKQAEPAYLKHWMKNGSRSYAPKAGELKQPVTNISWFAANAYCA
                 70        80        90       100       110       120

130       140       150       160       170       180
m525-1.pep   AQGKRLPTIDEWEFAGLASATWKNGSNEPGYNRTILDWYADGGRKGLHDVGKGRPNYWGV
             |||||||||||||||||||||||||||||||||||||||||||||||||| |||||||
g525-1       AQGKRLPTIDEWEFAGLASATWKNGSNEPGYNRTILDWYADGGRKGLHDVGKDRPNYWGV
                130       140       150       160       170       180

190       200       210       220       230       240
m525-1.pep   YDMHGLIWEWTEDFNSSLLSSGNANAQMFCSGASIGSSDSSNYAAFLRYGIRTSLQSKYV
             |||||||||||||||||||||||||||||||||||:|:||||||||||||||||||||
g525-1       YDMHGLIWEWTEDFNSSLLSSGNANAQMFCSGASVGASDSSNYAAFLRYGIRTSLQSKYV
                190       200       210       220       230       240

250
m525-1.pep   LHNLGFRCTSRX
             |||||||||:|||
g525-1       LHNLGFRCASRX
                250
```

The following partial DNA sequence was identified in *N. meningitidis* <SEQ ID 1499>:

```
a525-1.seq
   1 ATGAAGTTTA CCCGGTTACT CTTTCTCTGT GCGGCACTCG CCGGCACTCA

51 AGCGGCAGCT GCCGAAATGG TTCAAATCGA AGGCGGCAGC TACCGCCCGC

101 TTTATCTGAA AAAAGATACC GGCCTGATTA AGTCAAACC GTTCAAACTG

151 GATAAATATC CCGTTACCAA TGCCGAGTTT GCCGAATTTG TCAACAGCCA

201 CCCCCAATGG CAAAAAGGCA GGATCGGTTC CAAACAGGCA GAACCCGCTT

251 ACCTGAAGCA TTGGATGAAA AACGGCAGCC GCAGCTATGC GCCGAAGGCG

301 GGCGATTTAA ACAACCGGT AACCAATGTT TCCTGGTTCG CCGCCAACGC

351 CTATTGCGCC GCACAAGGCA AACGCCTGCC GACCATTGAC GAATGGGAAT
```

-continued

```
401 TTGCCGGACT TGCCTCCGCC ACGCAGAAAA ACGGCTCAAA CGAACCCGGC

451 TACAACCGCA CTATTCTCGA CTGGTATGCG GATGGCGACC GGAAAGACCT

501 GCACGATGTC GGCAAAGGTC GCCCGAACTA CTGGGGCGTT TATGATATGC

551 ACGGTCTGAT TTGGGAATGG ACGGAAGATT TCAACAGCAG CCTGCTTTCT

601 TCCGGCAATG CCAACGCGCA AATGTTTTGC AGCGGCGCGT CTATCGGGTC

651 GAGCGACTCG TCCAACTATG CCGCCTTCCT CCGCTACGGC ATCCGCACCA

701 GCCTGCAATC CAAATATGTC TTGCACAACT TGGGCTTCCG TTGCACAAGC

751 CGATAA
```

This corresponds to the amino acid sequence <SEQ ID 1500; ORF 525-1.a>:

```
a525-1.pep

1 MKFTRLLFLC AALAGTQAAA AEMVQIEGGS YRPLYLKKDT GLIKVKPFKL

51 DKYPVTNAEF AEFVNSHPQW QKGRIGSKQA EPAYLKHWMK NGSRSYAPKA

101 GDLKQPVTNV SWFAANAYCA AQGKRLPTID EWEFAGLASA TQKNGSNEPG

151 YNRTILDWYA DGDRKDLHDV GKGRPNYWGV YDMHGLIWEW TEDFNSSLLS

201 SGNANAQMFC SGASIGSSDS SNYAAFLRYG IRTSLQSKYV LHNLGFRCTS

251 R* m525-1/a525-1 97.2% identity in 251 aa overlap 10         20         30         40         50         60
m525-1.pep  MKYVRLFFLGAALAGTQAAAAEMVQIEGGSYRPLYLKKDTGLIKVKPFKLDKYPVTNAEF
            ||:: ||:|| ||||||||||||||||||||||||||||||||||||||||||||||||
a525-1      MKFTRLLFLCTALAGTQAAAAEMVQIEGGSYRPLYLKKDTGLIKVKPFKLDKYPVTNAEF
                  10         20         30         40         50         60

70         80         90        100        110        120
m525-1.pep  AEFVNSHPQWQKGRIGSKQAEPAYLKHWMKNGSRSYAPKAGELKQPVTNVSWFAANAYCA
            |||||||||||||||||||||||||||||||||||||||:||||||||||||||||||||
a525-1      AEFVNSHPQWQKGRIGSKQAEPAYLKHWMKNGSRSYAPKAGDLKQPVTNVSWFAANAYCA
                  70         80         90        100        110        120

130        140        150        160        170        180
m525-1.pep  AQGKRLPTIDEWEFAGLASATQKNGSNEPGYNRTILDWYADGGRKGLHDVGKGRPNYWGV
            |||||||||||||||||||||||||||||||||||||||||| || ||||||||||||||
a525-1      AQGKRLPTIDEWEFAGLASATQKNGSNEPGYNRTILDWYADGDRKDLHDVGKDRPNYWGV
                 130        140        150        160        170        180

190        200        210        220        230        240
m525-1.pep  YDMHGLIWEWTEDFNSSLLSSGNANAQMFCSGASIGSSDSSNYAAFLRYGIRTSLQSKYV
            ||||||||||||||||||||||||||||||||||||||||||||||||||||||||||||
a525-1      YDMHGLIWEWTEDFNSSLLSSGNANAQMFCSGASIGSSDSSNYAAFLRYGIRTSLQSKYV
                 190        200        210        220        230        240

250
m525-1.pep  LHNLGFRCTSRX
            ||||||||||||
a525-1      LHNLGFRCTSRX
                 250
```

The following partial DNA sequence was identified in *N. gonorrhoeae* <SEQ ID 1501>:

```
g527.seq
   1 atggttttac cagtctcctt ttttcagcct gtccagttgg cggcggtcgc 51 gcttggtcgg tctgccgtcg ggatgggcgg aagtgatgcg gctgaattgg 101 tcgagctgtt tgcactcttc cctcaatgct gccgttttcg cgtcttcttc 151 atacagaagc cgcgcctcgg gtgccgggcg gcgttggtgg ttcaaacctt 201 taaccttgat tttatgggga agggaattga gcgtcaggtc gataatatcg
```

```
251 ccgatgtcta tggttttact gtttttgact ttcgagccgt ttacttgaac 301 cctacccagt tcgatatgct tttgcgcaag ggaacgggtc ttgaaaaaac 351 gtgccgccca aagccatttg tccagccgca tggcggaaga atcgtgcttg 401 tctttcatac gattttgttt gaaataattg aatttgtttc gagtttagca 451 taa
```

This corresponds to the amino acid sequence <SEQ ID 1502; ORF 527.ng>:

```
g527.pep
   1 MVLPVSFFQP VQLAAVALGR SAVGMGGSDA AELVELFALF PQCCRFRVFF

51 IQKPRLGCRA ALVVQTFNLD FMGKGIERQV DNIADVYGFT VFDFRAVYLN

101 PTQFDMLLRK GTGLEKTCRP KPFVQPHGGR IVLVFHTILF EIIEFVSSLA

151 *
```

The following partial DNA sequence was identified in *N. meningitidis* <SEQ ID 1503>:

```
m527.seq
   1 ATGGTTTTAC CAGTCTCCTT TTTTCAGCCT GTCCAGTTGG CGGCGGTCGC

51 GCTTGGTCGG TCTGCCGTCG GGATAGGCGG AAGTGATGCG GCTGAATTGG

101 TCGAGCTGTT TGCGCTCTTC CCTCAATGTT GCCGTTwTCG CGTCCTCTTC

151 ATACAGAAGC CGCGCyTCGG ATGCCGGGCG GCGTTGGTGG TTCAAACCTT

201 TAACCkTGAT TTTATAGGGA AGGG.AATTk AgCkTCaGTy GrTwATaTCG

251 CsGATGTmTA TGGTTTTACT GTTTTTGACC TTCGAGCCGT TTACTTGAAC

301 CCTACCCAGT TCGATGTGCT TTTGCGCAAG GGAACGGGTC TTGAAAAAAC

351 GTGCCGCCCA AAGCCATTTG TCCAGCCGCA TGGCGGAAGA ATCGTGCTTG

401 TCTTTCATAC GATTTGTTT GAAATAATTG AATTTGTTTC GAGTTTAGCA

451 TAA
```

This corresponds to the amino acid sequence <SEQ ID 1504; ORF 527>:

```
m527pep
   1 MVLPVSFFQP VQLAAVALGR SAVGIGGSDA AELVELFALF PQCCRXRVLF

51 IQKPRXGCRA ALVVQTFNXD FIGKXNXASV XXIADVYGFT VFDLRAVYLN

101 PTQFDVLLRK GTGLEKTCRP KPFVQPHGGR IVLVFHTILF EIIEFVSSLA

151 *
```

Computer analysis of this amino acid sequence gave the following results:
Homology with a Predicted ORF from *N. gonorrhoeae*
ORF 527 shows 90.0% identity over a 150 aa overlap with a predicted ORF (ORF 527.ng) from *N. gonorrhoeae*:

```
    m527/g527
                        10         20         30         40         50         60
        m527.pep   MVLPVSFFQPVQLAAVALGRSAVGIGGSDAAELVELFALFPQCCRXRVLFIQKPRXGCRA
                   ||||||||||||||||||||||||:|||||||||||||||||||||| :| |||| ||||
        g527       MVLPVSFFQPVQLAAVALGRSAVGMGGSDAAELVELFALFPQCCRFRVFFIQKPRLGCRA
                        10         20         30         40         50         60
```

```
                      70        80        90       100       110       120
    m527.pep  ALVVQTFNXDFIGKXNXASVXXIADVYGFTVFDLRAVYLNPTQFDVLLRKGTGLEKTCRP
              ||||||||| ||:||    :|  ||||||||||||:|||||||||||:|||||||||||||
    g527      ALVVQTFNLDFMGKGIERQVDNIADVYGFTVFDFRAVYLNPTQFDMLLRKGTGLEKTCRP
                      70        80        90       100       110       120

130       140       150
    m527.pep  KPFVQPHGGRIVLVFHTILFEIIEFVSSLA
              |||||||||||||||||||||||||||||
    g527      KPFVQPHGGRIVLVFHTILFEIIEFVSSLA
                     130       140       150
```

The following partial DNA sequence was identified in *N. meningitidis* <SEQ ID 1505>:

```
a527.seq
   1 ATGGTTTTAC CAGTCTCCTT TTTTCAGCCT GTCCAGTTGG CGGCGGTCGC

51 GCTTGGTCGG TCTGCCGTCG GGATAGGCGG AAGTGATGCG GCTGAATTGG

101 TCGAGCTGTT TGCGCTCTTC CCTCAATGTT GCCGTTTTCG CGTCCTCTTC

151 ATACAGAAGC CGCGCCTCGG ATGCCGGGCG GCGTTGGTGG TTCAAACCTT

201 TAACCTTGAT TTTATAGGGA AGGGAATTGA GCGTCAGGTC GATAATATCG

251 CCGATGTCTA TGGTTTTACT GTTTTTGACC TTCGAGCCGT TTACTTGAAC

301 CCTACCCAGT TCGATGTGCT TTTGCGCAAG GGAACGGGTC TTGAAAAAAC

351 GTGCCGCCCA AAGCCATTTG TCCAGCCGCA TGGCGGAAGA ATCGTGCTTG

401 TCTTTCATAC GATTTTGTTT GAAATAATTG AATTTGTTTC GAGTTTAGCA

451 TAA
```

This corresponds to the amino acid sequence <SEQ ID 1506; ORF 527.a>:

```
a527.pep
   1 MVLPVSFFQP VQLAAVALGR SAVGIGGSDA AELVELFALF PQCCRFRVLF

51 IQKPRLGCRA ALVVQTFNLD FIGKGIERQV DNIADVYGFT VFDLRAVYLN

101 PTQFDVLLRK GTGLEKTCRP KPFVQPHGGR IVLVFHTILF EIIEFVSSLA

151 *
``` m527/a527 93.3% identity in 150 aa overlap

```
                      10        20        30        40        50        60
    m527.pep  MVLPVSFFQPVQLAAVALGRSAVGIGGSDAAELVELFALFPQCCRXRVLFIQKPRXGCRA
              ||||||||||||||||||||||||||||||||||||||||||||||| |||||||| ||||
    a527      MVLPVSFFQPVQLAAVALGRSAVGIGGSDAAELVELFALFPQCCRFRVLFIQKPRLGCRA
                      10        20        30        40        50        60

70        80        90       100       110       120
    m527.pep  ALVVQTFNXDFIGKXNXASVXXIADVYGFTVFDLRAVYLNPTQFDVLLRKGTGLEKTCRP
              ||||||||| |||||    :|  |||||||||||||||||||||||||||||||||||||
    a527      ALVVQTFNLDFIGKGIERQVDNIADVYGFTVFDLRAVYLNPTQFDVLLRKGTGLEKTCRP
                      70        80        90       100       110       120

130       140       150
    m527.pep  KPFVQPHGGRIVLVFHTILFEIIEFVSSLAX
              |||||||||||||||||||||||||||||||
    a527      KPFVQPHGGRIVLVFHTILFEIIEFVSSLAX
                     130       140       150
```

The following partial DNA sequence was identified in *N. gonorrhoeae* <SEQ ID 1507>:

```
g528.seq
   1 atggaaattc gggtaataaa atatacggca acggctgcgt tgtttgcatt 51 tacggttgca ggctgccggc tggcggggtg gtatgagtgt ttgtccttgt 101 ccggctggtg taagccgaga aaacctgccg ccatcgattt ttgggatatt 151 ggcggcgaga gtccgctgtc tttagaggac tacgagatac cgctttcaga 201 cggcaatcgt tccgtcaggg caaacgaata tgaatccgcg caaaaatctt 251 acttttatag gaaaataggg aagtttgaag cctgcgggtt ggattggcgt 301 acgcgtgacg gcaaaccttt ggttgagagg ttcaaacagg aaggtttcga 351 ctgtttggaa aagcaggggt tgcggcgcaa cggcctgtcc gagcgcgtcc 401 gatggtaa
```

This corresponds to the amino acid sequence <SEQ ID 1508; ORF 528.ng>:

```
g528.pep
   1 MEIRVIKYTA TAALFAFTVA GCRLAGWYEC LSLSGWCKPR KPAAIDFWDI

51 GGESPLSLED YEIPLSDGNR SVRANEYESA QKSYFYRKIG KFEACGLDWR

101 TRDGKPLVER FKQEGFDCLE KQGLRRNGLS ERVRW*
```

The following partial DNA sequence was identified in *N. meningitidis* <SEQ ID 1509>:

```
m528.seq (partial)
   1 ATGGAAATTC GGGCAATAAA ATATACGGCA ATGGCTGCGT TGCTTGCATT

51 TACGGTTGCA GGCTGCCGGC TGGCGGGGTG GTATGAGTGT TCGTCCCTCA

101 CCGGCTGGTG TAAGCCGAGA AAACCGGCTG CCATCGATTT TTGGGATATT

151 GGCGGCGAGA GTCCGCCGTC TTTAGGGGAC TACGAGATAC CGCTTTCAGA

201 CGGCAATAGT TCCGTCAGGG CAAACGAATA TGAATCCGCA CAACAATCTT

251 ACTTTTACAG GAAAATAGGG AAGTTTGAAG C.TGCGGGCT GGATTGGCGT

301 ACGCGTGACG GCAAACCTTT GATTGAGACG TTCAAACAGG GAGGATTTGA

351 CTGCTTGGAA AAG....
```

This corresponds to the amino acid sequence <SEQ ID 1510; ORF 528>:

```
m528.pep (partial)
   1 MEIRAIKYTA MAALLAFTVA GCRLAGWYEC SSLTGWCKPR KPAAIDFWDI

51 GGESPPSLGD YEIPLSDGNS SVRANEYESA QQSYFYRKIG KFEXCGLDWR

101 TRDGKPLIET FKQGGFDCLE K....
```

Computer analysis of this amino acid sequence gave the following results:

Homology with a Predicted ORF from *N. gonorrhoeae*
ORF 528 shows 89.3% identity over a 121 aa overlap with a predicted ORF (ORF 528.ng) from *N. gonorrhoeae*:

```
    m528/g528

10         20         30         40         50         60
        m528.pep    MEIRAIKYTAMAALLAFTVAGCRLAGWYECSSLTGWCKPRKPAAIDFWDIGGESPPSLGD
                    ||||:|||||  |||:|||||||||||||||  ||:|||||||||||||||||||| ||
        g528        MEIRVIKYTATAALFAFTVAGCRLAGWYECLSLSGWCKPRKPAAIDFWDIGGESPLSLED
                        10         20         30         40         50         60

70         80         90        100        110        120
        m528.pep    YEIPLSDGNSSVRANEYESAQQSYFYRKIGKFEXCGLDWRTRDGKPLIETFKQGGFDCLE
                    |||||||||| |||||||||||:||||||||||| ||||||||||||||:| ||| |||||
        g528        YEIPLSDGNRSVRANEYESAQKSYFYRKIGKFEACGLDWRTRDGKPLVERFKQEGFDCLE
                        70         80         90        100        110        120 m528.pep    K
                    |
        g528        KQGLRRNGLSERVRW
```

The following partial DNA sequence was identified in *N. meningitidis* <SEQ ID 1511>:

```
a528.seq
  1 ATGGAAATTC GGGCAATAAA ATATACGGCA ATGGCTGCGT TGCTTGCATT

51 TACGGTTGCA GGCTGCCGGT TGGCAGGTTG GTATGAGTGT TCGTCCCTGT

101 CCGGCTGGTG TAAGCCGAGA AAACCTGCCG CCATCGATTT TTGGGATATT

151 GGCGGCGAGA GTCCTCCGTC TTTAGAGGAC TACGAGATAC CGCTTTCAGA

201 CGGCAATCGT TCCGTCAGGG CAAACGAATA TGAATCCGCA CAACAATCTT

251 ACTTTTACAG GAAAATAGGG AAGTTTGAAG CCTGCGGGTT GGATTGGCGT

301 ACGCGTGACG GCAAACCTTT GATTGAGACG TTCAAACAGG AAGGTTTTGA

351 TTGTTTGAAA AAGCAGGGGT TGCGGCGCAA CGGTCTGTCC GAGCGCGTCC

401 GATGGTAA
```

This corresponds to the amino acid sequence <SEQ ID 1512; ORF 528.a>:

```
a528.pep
  1 MEIRAIKYTA MAALLAFTVA GCRLAGWYEC SSLSGWCKPR KPAAIDFWDI

51 GGESPPSLED YEIPLSDGNR SVRANEYESA QQSYFYRKIG KFEACGLDWR

101 TRDGKPLIET FKQEGFDCLK KQGLRRNGLS ERVRW*
``` m528/a528 95.0% identity in 121 aa overlap

```
                        10         20         30         40         50         60
        m528.pep    MEIRAIKYTAMAALLAFTVAGCRLAGWYECSSLTGWCKPRKPAAIDFWDIGGESPPSLGD
                    ||||||||||||||||||||||||||||||:|||||||||||||||||||||||||||| |
        a528        MEIRAIKYTAMAALLAFTVAGCRLAGWYECSSLSGWCKPRKPAAIDFWDIGGESPPSLED
                        10         20         30         40         50         60

70         80         90        100        110        120
        m528.pep    YEIPLSDGNSSVRANEYESAQQSYFYRKIGKFEXCGLDWRTRDGKPLIETFKQGGFDCLE
                    |||||||| |||||||||||||||||||||| ||||||||||||||||||||||| |:
        a528        YEIPLSDGNRSVRANEYESAQQSYFYRKIGKFEACGLDWRTRDGKPLIETFKQEGFDCLK
                        70         80         90        100        110        120
```

```
m528.pep     K
             |
a528         KQGLRRNGLSERVRWX
                  130
```

The following partial DNA sequence was identified in *N. gonorrhoeae* <SEQ ID 1513>:

```
g528-1.seq
   1 ATGGAAATTC GGGTAATAAA ATATACGGCA ACGGCTGCGT TGTTTGCATT

51 TACGGTTGCA GGCTGCCGGC TGGCGGGGTG GTATGAGTGT TCGTCCTTGT

101 CCGGCTGGTG TAAGCCGAGA AAACCTGCCG CCATCGATTT TTGGGATATT

151 GGCGGCGAGA GTCCGCTGTC TTTAGAGGAC TACGAGATAC CGCTTTCAGA

201 CGGCAATCGT TCCGTCAGGG CAAACGAATA TGAATCCGCG CAAAAATCTT

251 ACTTTTATAG GAAAATAGGG AAGTTTGAAG CCTGCGGGTT GGATTGGCGT

301 ACGCGTGACG GCAAACCTTT GGTTGAGAGG TTCAAACAGG AAGGTTTCGA

351 CTGTTTGGAA AAGCAGGGGT TGCGGCGCAA CGGCCTGTCC GAGCGCGTCC

401 GATGGTAA
```

This corresponds to the amino acid sequence <SEQ ID 1514; ORF 528-1.ng>:

```
g528-1.pep
   1 MEIRVIKYTA TAALFAFTVA GCRLAGWYEC SSLSGWCKPR KPAAIDFWDI

51 GGESPLSLED YEIPLSDGNR SVRANEYESA QKSYFYRKIG KFEACGLDWR

101 TRDGKPLVER FKQEGFDCLE KQGLRRNGLS ERVRW*
```

The following partial DNA sequence was identified in *N. meningitidis* <SEQ ID 1515>:

```
m528-1.seq
   1 ATGGAAATTC GGGCAATAAA ATATACGGCA ATGGCTGCGT TGCTTGCATT

51 TACGGTTGCA GGCTGCCGGC TGGCGGGGTG GTATGAGTGT TCGTCCCTCA

101 CCGGCTGGTG TAAGCCGAGA AAACCGGCTG CCATCGATTT TTGGGATATT

151 GGCGGCGAGA GTCCGCCGTC TTTAGGGGAC TACGAGATAC CGCTTTCAGA

201 CGGCAATCGT TCCGTCAGGG CAAACGAATA TGAATCCGCA CAACAATCTT

251 ACTTTTACAG GAAAATAGGG AAGTTTGAAG CCTGCGGGCT GGATTGGCGT

301 ACGCGTGACG GCAAACCTTT GATTGAGACG TTCAAACAGG AGGATTTGA

351 CTGCTTGGAA AAGCAGGGGT TGCGGCGCAA CGGTCTGTCC GAGCGCGTCC

401 GATGGTAA
```

This corresponds to the amino acid sequence <SEQ ID 1516; ORF 528-1>:

```
  m528-1.pep..

1 MEIRAIKYTA MAALLAFTVA GCRLAGWYEC SSLTGWCKPR KPAAIDFWDI

51 GGESPPSLGD YEIPLSDGNR SVRANEYESA QQSYFYRKIG KFEACGLDWR
```

-continued
```
    101 TRDGKPLIET FKQGGFDCLE KQGLRRNGLS ERVRW* g528-1/m528-1  92.6% identity in 135 aa overlap 10         20         30         40         50         60
g528-1.pep   MEIRVIKYTATAALFAFTVAGCRLAGWYECSSLSGWCKPRKPAAIDFWDIGGESPLSLED
             ||||:||||| |||:|||||||||||||||||||:|||||||||||||||||||||| ||
m528-1       MEIRAIKYTAMAALLAFTVAGCRLAGWYECSSLTGWCKPRKPAAIDFWDIGGESPPSLGD
                      10         20         30         40         50         60

70         80         90        100        110        120
g528-1.pep   YEIPLSDGNRSVRANEYESAQKSYFYRKIGKFEACGLDWRTRDGKPLVERFKQEGFDCLE
             ||||||||||||||||||||||:|||||||||||||||||||||||:|  ||| ||||||
m528-1       YEIPLSDGNRSVRANEYESAQQSYFYRKIGKFEACGLDWRTRDGKPLIETFKQGGFDCLE
                      70         80         90        100        110        120

130
g528-1.pep   KQGLRRNGLSERVRWX
             ||||||||||||||||
m528-1       KQGLRRNGLSERVRWX
                     130
```

The following partial DNA sequence was identified in *N. meningitidis* <SEQ ID 1517>:

```
a528-1.seq
  1 ATGGAAATTC GGGCAATAAA ATATACGGCA ATGGCTGCGT TGCTTGCATT

51 TACGGTTGCA GGCTGCCGGT TGGCAGGTTG GTATGAGTGT TCGTCCCTGT

101 CCGGCTGGTG TAAGCCGAGA AAACCTGCCG CCATCGATTT TTGGGATATT

151 GGCGGCGAGA GTCCTCCGTC TTTAGAGGAC TACGAGATAC CGCTTTCAGA

201 CGGCAATCGT TCCGTCAGGG CAAACGAATA TGAATCCGCA CAACAATCTT

251 ACTTTTACAG GAAAATAGGG AAGTTTGAAG CCTGCGGGTT GGATTGGCGT

301 ACGCGTGACG GCAAACCTTT GATTGAGACG TTCAAACAGG AAGGTTTTGA

351 TTGTTTGAAA AAGCAGGGGT TGCGGCGCAA CGGTCTGTCC GAGCGCGTCC

401 GATGGTAA
```

This corresponds to the amino acid sequence <SEQ ID 1518; ORF 528-1.a>:

```
a528-1.pep

1 MEIRAIKYTA MAALLAFTVA GCRLAGWYEC SSLSGWCKPR KPAAIDFWDI

51 GGESPPSLED YEIPLSDGNR SVRANEYESA QQSYFYRKIG KFEACGLDWR

101 TRDGKPLIET FKQEGFDCLK KQGLRRNGLS ERVRW* a528-1/m528-1  97.0% identity in 135 aa overlap 10         20         30         40         50         60
a528-1.pep   MEIRAIKYTAMAALLAFTVAGCRLAGWYECSSLSGWCKPRKPAAIDFWDIGGESPPSLED
             ||||||||||||||||||||||||||||||||:|||||||||||||||||||||||||| |
m528-1       MEIRAIKYTAMAALLAFTVAGCRLAGWYECSSLTGWCKPRKPAAIDFWDIGGESPPSLGD
                      10         20         30         40         50         60

70         80         90        100        110        120
a528-1.pep   YEIPLSDGNRSVRANEYESAQQSYFYRKIGKFEACGLDWRTRDGKPLIETFKQEGFDCLK
             |||||||||||||||||||||||||||||||||||||||||||||||||||||| ||||:
m528-1       YEIPLSDGNRSVRANEYESAQQSYFYRKIGKFEACGLDWRTRDGKPLIETFKQGGFDCLE
                      70         80         90        100        110        120

130
a528-1.pep   KQGLRRNGLSERVRWX
             ||||||||||||||||
m528-1       KQGLRRNGLSERVRWX
                     130
```

The following partial DNA sequence was identified in *N. gonorrhoeae* <SEQ ID 1519>:

```
g529.seq (partial)
   1 atgacccata tcaaacccgt cattgccgcg ctcgcactca tcgggcttgc 51 cgcctgctcc ggcagcaaaa ccgaacagcc caagctcgac taccaaagcc 101 ggtcgcaccg cctgatcaaa ctcgaagtcc cgcctgattt gaacaacccc 151 gaccaaggca acctctaccg cctgcctgcc ggttcgggag ccgtccgcgc 201 cggggatttg gaaaaacgcc gcacacccgc cgtccaacag ccagcggatg 251 ccggaagtat tgaaaagcgt caaaggcgtc cgcttcgagc ggcgacggca 301 gccaacgcct ggcttgtcgt tgacggcaaa tccccgccg aaatctccgc 351 cgctttctg.
```

This corresponds to the amino acid sequence <SEQ ID 1520; ORF 529.ng>:

```
g529.pep (partial)
   1 MTHIKPVIAA LALIGLAACS GSKTEQPKLD YQSRSHRLIK LEVPPDLNNP

51 DQGNLYRLPA GSGAVRAGDL EKRRTPAVQQ PADAGSIEKR QRRPLRAATA

101 ANAWLVVDGK SPAEISAAF..
```

The following partial DNA sequence was identified in *N. meningitidis* <SEQ ID 1521>:

```
m529.seq
    1 ATGACCCATA TCAAACCCGT CATTGCCGCG CTCGCACTCA TCGGGCTTGC

51 CGCCTGCTCC GGCAGCAAAA CCGAACAGCC CAAGCTCGAC TACCAAAGCC

101 GGTCGCACCG CCTGATCAAA CTTGAAGTCC CACCTGATTT GAAAAACGCC

151 GACCAAGGCA ACCTCTACCG CCTGCCTGCC GGTTCGGGCG CCGTCCGCGC

201 CAGCGATTTG GAAAAACGCC GCACACCCGC CGTCCAACAG CCTGCCGATG

251 CCGAAGTATT GAAAAGCGTC AAAGGTGTCC GCCTCGAGCG CGACGGCAGC

301 CAACGCTGGC TCGTTGTCGA CGGCAAGTCT CCTGCCGAAA TCTGGCCGCT

351 CCTGAAAGCC TTTTGGCAGG AAAACGGCTT CGACATCAAA TCCGAAGAAC

401 CCGCCATCGG ACAAATGGAA ACCGAGTGGG CGGAAAACCG CGCCAAAATC

451 CCCCAAGACA GCTTGCGCCG CCTCTTCGAC AAAGTCGGCT TGGGCGGCAT

501 CTACTCCACC GGCGAGCGCG ACAAATTCAT CGTCCGTATC GAACAGGGCA

551 AAAACGGCGT TTCCGACATC TTCTTCGCCC ACAAAGCCAT GAAAGAAGTG

601 TACGGCGGCA AAGACAAAGA CACGACCGTA TGGCAGCCCT CCCCGTCCGA

651 TCCCAACCTC GAAGCCGCTT TCCTGACGCG CTTTATGCAA TATTTGGGCG

701 TTGACGGACA GCAGGCGGAA AACGCATCGG CAAAAAAACC TACCCTTCCC

751 GCCGCCAACG AAATGGCGCG TATCGAAGGC AAAAGCCTGA TTGTCTTTGG

801 CGACTACGGC AGAAACTGGC GGCGCACCGT GCTCGCCCTC GACCGCATCG

851 GGCTGACCGT CGTCGGTCAA ACACCGAAC GCCACGCCTT CCTGGTTCAA

901 AAAGCCCCGA ACGAAAGCAA TGCAGTTACC GAACAAAAAC CCGGCCTGTT

951 CAAACGCCTG CTGGGCAAAG GCAAAGCGGA GAAACCTGCC GAACAGCCGG

1001 AACTGATTGT CTATGCAGAA CCTGTCGCCA ACGGCTCGCG CATCGTCCTG
```

-continued
```
1051 CTCAACAAAG ACGGCAGCGC ATATGCCGGC AAAGACGCAT CCGCATTATT

1101 GGGCAAACTC CATTCCGAAC TGCGTTAA
```

This corresponds to the amino acid sequence <SEQ ID 1522; ORF 529>:

```
m529.pep
   1 MTHIKPVIAA LALIGLAACS GSKTEQPKLD YQSRSHRLIK LEVPPDLNNP

51 DQGNLYRLPA GSGAVRASDL EKRRTPAVQQ PADAEVLKSV KGVRLERDGS

101 QRWLVVDGKS PAEIWPLLKA FWQENGFDIK SEEPAIGQME TEWAENRAKI

151 PQDSLRRLFD KVGLGGIYST GERDKFIVRI EQGKNGVSDI FFAHKAMKEV

201 YGGKDKDTTV WQPSPSDPNL EAAFLTRFMQ YLGVDGQQAE NASAKKPTLP

251 AANEMARIEG KSLIVFGDYG RNWRRTVLAL DRIGLTVVGQ NTERHAFLVQ

301 KAPNESNAVT EQKPGLFKRL LGKGKAEKPA EQPELIVYAE PVANGSRIVL

351 LNKDGSAYAG KDASALLGKL HSELR*
```

Computer analysis of this amino acid sequence gave the following results:
Homology with a Predicted ORF from *N. gonorrhoeae*
  ORF 529 shows 83.5% identity over a 115 aa overlap with a predicted ORF (ORF 529.ng) from *N. gonorrhoeae*:

```
    g529/m529
                        10         20         30         40         50         60
        g529.pep   MTHIKPVIAALALIGLAACSGSKTEQPKLDYQSRSHRLIKLEVPPDLNNPDQGNLYRLPA
                   ||||||||||||||||||||||||||||||||||||||||||||||||||||||||||||
        m529       MTHIKPVIAALALIGLAACSGSKTEQPKLDYQSRSHRLIKLEVPPDLNNPDQGNLYRLPA
                        10         20         30         40         50         60

70         80         90        100        110        120
        g529.pep   GSGAVRAGDLEKRRTPAVQQPADAGSIEKRQRRPLRAATAANAWLVVDGKSPAEISAAFX
                   |||||||:|||||||||||||||||    ::: :    |:    ::: ||||||||||||
        m529       GSGAVRASDLEKRRTPAVQQPADAEVLKSVKGVRLER-DGSQRWLVVDGKSPAEIWPLLK
                        70         80         90        100        110 m529              AFWQENGFDIKSEEPAIGQMETEWAENRAKIPQDSLRRLFDKVGLGGIYSTGERDKFIVR
                              120        130        140        150        160        170
```

The following partial DNA sequence was identified in *N. meningitidis* <SEQ ID 1523>:

```
a529.seq
   1 ATGACCCATA TCAAACCCGT CATTGCCGCG CTCGCACTCA TCGGGCTTGC

51 CGCCTGCTCC GGCAGCAAAA CCGAACAGCC CAAGCTCGAC TACCAAAGCC

101 GGTCGCACCG CCTGATCAAA CTCGAAGTCC CACCTGATTT GAAAAACGCC

151 GACCAAGGCA ACCTCTACCG CCTGCCTGCC GGTTCGGGCG CCGTCCGCGC

201 CAGCGATTTG GAAAAACGCC GCACACCCGC CGTCCAACAG CCTGCCGATG

251 CCGAAGTATT GAAAAGCGTC AAAGGTGTCC GCCTCGAGCG CGACGGCAGC

301 CAACGCTGGC TCGTTGTCGA CGGCAAGTCT CATGCCGAAA TCTGGCCGCT

351 CCTGAAAGCC TTTTGGCAGG AAAACGGCTT CGACATCAAA TCCGAAGAAC

401 CCGCCATCGG ACAAATGGAA ACCGAGTGGG CGGAAAACCG TGCCAAAATC

451 CCCCAAGACA GCTTGCGCCG CCTATTCGAC ACAGTCGGTT TGGGCGGCAT
```

-continued

```
 501 CTACTCCACC GGCGAGCGCG ACAAATTCAT CGTCCGTATC GAACAGGGCA

551 AAAACGGCGT TCCGACATC TTCTTCGCCC ACAAAGCCAT GAAAGAAGTG

601 TACGGCGGCA AGACAAAGA CACGACCGTA TGGCAGCCCT CCCCGTCCGA

651 TCCCAACCTC GAAGCCGCTT TCCTGACGCG CTTTATGCAA TATTTGGGCG

701 TTGACGGACA GCAGGCGGAA AACGCATCGG CAAAAAAACC TACCCTTCCC

751 GCCGCCAACG AAATGGCGCG TATCGAAGGC AAAAGCCTGA TTGTCTTTGG

801 CGACTACGGC AGAAACTGGC GGCGCACCGC GCTCGCCCTC GACCGCATCG

851 GGCTGACCGT CGTCGGTCAA AACACCGAAC GCCACGCTTT CCTGGTTCAA

901 AAAGCCCCGA ACGAAAGCAA TGCAGTTACC GAACAAAAAC CCGGCCTGTT

951 CAAACGCCTG CTGGGCAAAG GCAAAGCGGA GAAACCTGCC GAACAGCCGG

1001 AACTGATTGT CTATGCCGAG CCTGTCGCCA ACGGCTCGCG CATCGTCCTG

1051 CTCAACAAAG ACGGCAGCGC ATATGCCGGC AAAGACGCAT CCGCATTATT

1101 GGGCAAACTC CATTCCGAAC TGCGTTAA
```

This corresponds to the amino acid sequence <SEQ ID 1524; ORF 529.a>:

```
a529.pep
  1 MTHIKPVIAA LALIGLAACS GSKTEQPKLD YQSRSHRLIK LEVPPDLNNP

51 DQGNLYRLPA GSGAVRASDL EKRRTPAVQQ PADAEVLKSV KGVRLERDGS

101 QRWLVVDGKS HAEIWPLLKA FWQENGFDIK SEEPAIGQME TEWAENRAKI

151 PQDSLRRLFD TVGLGGIYST GERDKFIVRI EQGKNGVSDI FFAHKAMKEV

201 YGGKDKDTTV WQPSPSDPNL EAAFLTRFMQ YLGVDGQQAE NASAKKPTLP

251 AANEMARIEG KSLIVFGDYG RNWRRTALAL DRIGLTVVGQ NTERHAFLVQ

301 KAPNESNAVT EQKPGLFKRL LGKGKAEKPA EQPELIVYAE PVANGSRIVL

351 LNKDGSAYAG KDASALLGKL HSELR*
``` m529/a529 99.2% identity in 375 aa overlap

```
                  10         20         30         40         50         60
    m529.pep  MTHIKPVIAALALIGLAACSGSKTEQPKLDYQSRSHRLIKLEVPPDLNNPDQGNLYRLPA
              ||||||||||||||||||||||||||||||||||||||||||||||||||||||||||||
        a529  MTHIKPVIAALALIGLAACSGSKTEQPKLDYQSRSHRLIKLEVPPDLNNPDQGNLYRLPA
                  10         20         30         40         50         60

70         80         90        100        110        120
    m529.pep  GSGAVRASDLEKRRTPAVQQPADAEVLKSVKGVRLERDGSQRWLVVDGKSPAEIWPLLKA
              |||||||||||||||||||||||||||||||||||||||||||||||||||| |||||||
        a529  GSGAVRASDLEKRRTPAVQQPADAEVLKSVKGVRLERDGSQRWLVVDGKSHAEIWPLLKA
                  70         80         90        100        110        120

130        140        150        160        170        180
    m529.pep  FWQENGFDIKSEEPAIGQMETEWAENRAKIPQDSLRRLFDKVGLGGIYSTGERDKFIVRI
              |||||||||||||||||||||||||||||||||||||||| |||||||||||||||||||
        a529  FWQENGFDIKSEEPAIGQMETEWAENRAKIPQDSLRRLFDTVGLGGIYSTGERDKFIVRI
                 130        140        150        160        170        180

190        200        210        220        230        240
    m529.pep  EQGKNGVSDIFFAHKAMKEVYGGKDKDTTVWQPSPSDPNLEAAFLTRFMQYLGVDGQQAE
              ||||||||||||||||||||||||||||||||||||||||||||||||||||||||||||
        a529  EQGKNGVSDIFFAHKAMKEVYGGKDKDTTVWQPSPSDPNLEAAFLTRFMQYLGVDGQQAE
                 190        200        210        220        230        240

250        260        270        280        290        300
    m529.pep  NASAKKPTLPAANEMARIEGKSLIVFGDYGRNWRRYVLALDRIGLTVVGQNTERHAFLVQ
              |||||||||||||||||||||||||||||||||||||| :||||||||||||||||||||
        a529  NASAKKPTLPAANEMARIEGKSLIVFGDYGRNWRRYALALDRIGLTVVGQNTERHAFLVQ
                 250        260        270        280        290        300
```

```
                 310        320        330        340        350        360
m529.pep   KAPNESNAVTEQKPGLFKRLLGKGKAEKPAEQPELIVYAEPVANGSRIVLLNKDGSAYAG
           ||||||||||||||||||||||||||||||||||||||||||||||||||||||||||
a529       KAPNESNAVTEQKPGLFKRLLGKGKAEKPAEQPELIVYAEPVANGSRIVLLNKDGSAYAG
                 310        320        330        340        350        360

370
m529.pep   KDASALLGKLHSELRX
           ||||||||||||||||
a529       KDASALLGKLHSELRX
                 370
```

The following partial DNA sequence was identified in *N. gonorrhoeae* <SEQ ID 1525>:

```
g530.seq
  1 atgagtgcga gcgcggcaat gacgggtttg atatgggtca tcgtgtcatc 51 ctgtgtgatg gatattaaag tgtttgtcat gttatgccgt ccgaacggtt 101 cagacggcat ggctatattt aaagttgtcc tgaggctttc agggcggcgc 151 ggacttttgc ctgtccgcct tccgtcagcg aacgagcgg caggcgcacg 201 tgcggtccgc atccgcccaa ggcggatacc gcccatttcg gtgcggcggg 251 actgggttcg cagaacatgg tgtcgtaaat cggaatcagc cggtcgttga
```

This corresponds to the amino acid sequence <SEQ ID 1526; ORF 530.ng>:

```
g530.pep
  1 MSASAAMTGL IWVIVSSCVM DIKVFVMLCR PNGSDGMAIF KVVLRLSGRR

51 GLLPVRLPSA ERAAGARAVR IRPRRIPPIS VRRDWVRRTW CRKSESAGR*
```

The following partial DNA sequence was identified in *N. meningitidis* <SEQ ID 1527>:

```
m530.seq
  1 wTGAGTGCGA GCGCGGCAAT GACGGGTyTG ATATGGGTCA TCGTGTCATC 51 sTGTGTGATG GATATTAAAG TGTyTGTTGC GwTATGCCGT CCGAACGGTT 101 CGGACGGCAT GGmTATATTT AAAGTTGTCC TGAGGCTTTC AGGGCGGCGC 151 GGACTkTTGC wTGTCCGTTT yCCGTCAGCG AACGAGCGG CAGGCGGACG 201 TGCGGTTCGC ATCTGCCCAg GCGGATACC GCCCATTTCG GTGCGGCGGG

251 GCTGGGTTCG CAGAACATGG TGTCGTAAAT CGGAATCAGT CGGTCGTTGA
```

This corresponds to the amino acid sequence <SEQ ID 1528; ORF 530>:

```
m530.pep
  1 XSASAAMTGL IWVIVSSCVM DIKVXVAXCR PNGSDGMXIF KVVLRLSGRR

51 GLLXVRFPSA ERAAGGRAVR ICPGRIPPIS VRRGWVRRTW CRKSESVGR*
```

Computer analysis of this amino acid sequence gave the following results:

Homology with a Predicted ORF from *N. gonorrhoeae*

ORF 530 shows 88.8% identity over a 98 aa overlap with a predicted ORF (ORF 530.ng) from *N. gonorrhoeae*:

```
m530/g530 m530.pep    XSASAAMTGLIWVIVSSCVMDIKVXVAXCRPNGSDGMXIFKVVLRLSGRRGLLXVRFPSA    60
                |||||||||||||||||||| |  ||||||||| |||||||||||||||| ||:|||
    g530        MSASAAMTGLIWVIVSSCVMDIKVFVMLCRPNGSDGMAIFKVVLRLSGRRGLLPVRLPSA    60
                       10        20        30        40        50        60 m530.pep    ERAAGGRAVRICPGRIPPISVRRGWVRRTWCRKSESVGR    99
                |||||:||||| | ||||||||| ||||||||||||:||
    g530        ERAAGARAVRIRPRRIPPISVRRDWVRRTWCRKSESAGR    99
```

The following partial DNA sequence was identified in *N. meningitidis* <SEQ ID 1529>:

```
a530.seq
  1 ATGAGTGCGA GCGCGGCAAT GACGGGTTTG ATATGGGTCA TCGTGTCATC

51 CTGTGTGATG GATATTAAAG TGTTTGTTGC GTTATGCCGT CCGAACGGTT

101 CGGACGGCAT GGCTATATTT AAAGTTGTCC TGAGGCTTTC AGGGCGGCGC

151 GGACTTTTGC CTGTCCGCCT TCCGTCAGCG GAACGAGCGG CAGGCGGACG

201 TGCGGTTCGC ATCTGCCCAG GGCGGATACC GCCCATTTCG GTGCGGCGGG

251 GCTGGGTTCG CAGAACATGG TGTCGTAAAT CGGAATCAGC CGGTCGTTGA
```

This corresponds to the amino acid sequence <SEQ ID 1530; ORF 530.a>:

```
a530.pep
  1 MSASAAMTGL IWVIVSSCVM DIKVFVALCR PNGSDGMAIF KVVLRLSGRR

51 GLLPVRLPSA ERAAGGRAVR ICPGRIPPIS VRRGWVRRTW CRKSESAGR*
``` m530/a530 93.9% identity in 98 aa overlap

```
                    10        20        30        40        50        60
    m530.pep    XSASAAMTGLIWVIVSSCVMDIKVXVAXCRPNGSDGMXIFKVVLRLSGRRGLLXVRFPSA
                ||||||||||||||||||||||||  || |||||||| ||||||||||||||| || |||
    a530        MSASAAMTGLIWVIVSSCVMDIKVFVALCRPNGSDGMAIFKVVLRLSGRRGLLPVRLPSA
                    10        20        30        40        50        60

70        80        90       100
    m530.pep    ERAAGGRAVRICPGRIPPISVRRGWVRRTWCRKSESVGRX
                ||||||||||||||||||||||||||||||||||||:|||
    a530        ERAAGGRAVRICPGRIPPISVRRGWVRRTWCRKSESAGRX
                    70        80        90       100
```

The following partial DNA sequence was identified in *N. gonorrhoeae* <SEQ ID 1531>:

```
g531.seq
  1 ATGACCGCCC TACTCGTCAT CCTCGCCCTC GCCCTGATAG CCGTCGGCAC

51 GGCAGGCATC GTCTATCCCG CCCTGCCCGG CTTGGCATTG ATGTTTGCCG

101 GAACATGGCT GCTTGCCTAT GCCGGCGGCT ATCAAATCTA CGGCGCAGGC

151 ATCTTGTGGA CGGTCGGACT CATCAGCCTT GGCGGCATAC TGGCGGACTA
```

```
-continued
201 TATGGCAGGC ATGTTGGGGG TAAAATACAC TGGGGCAGGC AAACTCGCCG

251 TCCGAGGTGC ATTGGCCGGC AGCATCATCG GCATATTTTT CTCCCTTCCC

301 GGACTAATAC TCGGCCCCTT TATCGGCGCG GCGGCAGGCG AACTGATCGA

351 TCGGCGCAAT ATGCTTCAGG CAGGTAAAGC GGGCTTGGGT ACGCTGTTGG

401 GGCTTGTCGT CGGCACGGCG TTCAAAATCG GCTGCGCCGT ATCCATCTTG

451 TTTATCCTGT TGGTGAAATA CATCGCATAC CTGTTTTAA
```

This corresponds to the amino acid sequence <SEQ ID 1532; ORF 531.ng>:

```
g531.pep
  1 MTALLVILAL ALIAVGTAGI VYPALPGLAL MFAGTWLLAY AGGYQIYGAG

51 ILWTVGLISL GGILADYMAG MLGVKYTGAG KLAVRGALAG SIIGIFFSLP

101 GLILGPFIGA AAGELIDRRN MLQAGKAGLG TLLGLVVGTA FKIGCAVSIL

151 FILLVKYIAY LF
```

The following partial DNA sequence was identified in *N. meningitidis* <SEQ ID 1533>:

```
m531.seq
  1 ATGACCGTAC TGACCGTCAT CCTCGCCCTC GCCCTGATAG CCGTCGGCAC

51 GGCGGGCATC GTTTaCCCCG CCCTGCCCGG ATTGGCATTG ATGTTTGCCG

101 GAACATGGCT GCTTGCCTAT GCCGGCGGCT ACCAAATCTA CGGCGCGGGC

151 GTTTTGTGGA CGGTCGGACT CATCAGCCTT GCCGGCATAC TGGCGGACTA

201 TGTGGCAGGC ATATGGGGA CAAAATATAC CGGAGCGGGC AAGCTCGCCG

251 TTCGCGGCGC ATTGGCCGGC AGCATCATCG GCATATTTTT CTCCCTTCCC

301 GGACTAATAC TCGGTCCCTT TATCGGCGCG GCGGCAGGCG AACTGATCGA

351 ACGGCGCAAT ATGCTTCAGG CAGGTAAAGC GGGCTTGGGT ACGCTGTTGG

401 GGCTTGTCGT CGGCACGGCG TTCAAAATCG GCTGCGCnGT ATCCATCTTG

451 TTTATCCTGT TGGTGAaATA CATCGCCTAC CTGTTTTAA
```

This corresponds to the amino acid sequence <SEQ ID 1534; ORF 531>:

```
m531.pep
  1 MTVLTVILAL ALIAVGTAGI VYPALPGLAL MFAGTWLLAY AGGYQIYGAG

51 VLWTVGLISL AGILADYVAG IWGTKYTGAG KLAVRGALAG SIIGIFFSLP

101 GLILGPFIGA AAGELIERRN MLQAGKAGLG TLLGLVVGTA FKIGCAVSIL

151 FILLVKYIAY LF*
```

Computer analysis of this amino acid sequence gave the following results:
Homology with a Predicted ORF from *N. gonorrhoeae*
ORF 531 shows 94.4% identity over a 162 aa overlap with a predicted ORF (ORF 531.ng) from *N. gonorrhoeae*:

```
m531/g531

10         20         30         40         50         60
      m531.pep    MTVLTVILALALIAVGTAGIVYPALPGLALMFAGTWLLAYAGGYQIYGAGVLWTVGLISL
                  ||:|||||||||||||||||||||||||||||||||||||||||||||||:||||||||
      g531        MTALLVILALALIAVGTAGIVYPALPGLALMFAGTWLLAYAGGYQIYGAGILWTVGLISL
                       10         20         30         40         50         60
```

```
                    70         80         90        100        110        120
   m531.pep  AGILADYVAGIWGTKYTGAGKLAVRGALAGSIIGIFFSLPGLILGPFIGAAAGELIERRN
             :||||||:||:  |:||||||||||||||||||||||||||||||||||||||||||:|||
   g531      GGILADYMAGMLGVKYTGAGKLAVRGALAGSIIGIFFSLPGLILGPFIGAAAGELIDRRN
                    70         80         90        100        110        120

130        140        150        160
   m531.pep  MLQAGKAGLGTLLGLVVGTAFKIGCAVSILFILLVKYIAYLF
             |||||||||||||||||||||||||||||||||||||||||
   g531      MLQAGKAGLGTLLGLVVGTAFKIGCAVSILFILLVKYIAYLF
                   130        140        150        160
```

The following partial DNA sequence was identified in *N. meningitidis* <SEQ ID 1535>:

```
a531.seq
   1 ATGACCGCCT TGCTCGTCAT CCTCGCCCTC GCCCTGATAG CCGCCGGTAC

51 GGCGGGCATC GTTTACCCCG CCCTGCCCGG ATTGGCATTG ATGTTTGCCG

101 GAACCTGGCT GCTCGCCTAC TCCGGCGGCT ACCAAATCTA CGGCGCGGGC

151 GTTTTGTGGA CGGTCGGACT CATCAGCCTT GCCGGCATAC TGGCGGACTA

201 TGTGGCAGGC ATATGGGGGA CAAAATATAC CGGAGCGGGC AAGCTCGCCG

251 TTCGCGGCGC ATTGGCCGGC AGCATCATCG GCATATTTTT CTCCCTTCCC

301 GGACTAATAC TCGGTCCCTT TATCGGCGCG GCGGCAGGCG AACTGATCGA

351 ACGGCGCAAT ATGCTTCAGG CAGGTAAAGC GGGCTTGGGT ACGCTGTTGG

401 GGCTTATCGT CGGTACGGCG TTCAAAATCG GCTGCGCCGT ATCCATCTTG

451 TTTATCCTGT TGGTGAAATA CATCGCCTAC CTGTTTTAA
```

This corresponds to the amino acid sequence <SEQ ID 1536; ORF 531.a>:

```
a531.pep
   1 MTALLVILAL ALIAAGTAGI VYPALPGLAL MFAGTWLLAY SGGYQIYGAG

51 VLWTVGLISL AGILADYVAG IWGTKYTGAG KLAVRGALAG SIIGIFFSLP

101 GLILGPFIGA AAGELIERRN MLQAGKAGLG TLLGLIVGTA FKIGCAVSIL

151 FILLVKYIAY LF*
``` m531/a531 96.9% identity in 162 aa overlap

```
                    10         20         30         40         50         60
   m531.pep  MTVLTVILALALIAVGTAGIVYPALPGLALMFAGTWLLAYAGGYQIYGAGVLWTVGLISL
             ||:| ||||||||:|||||||||||||||||||||||||||:||||||||||||||||||
   a531      MTALLVILALALIAAGTAGIVYPALPGLALMFAGTWLLAYSGGYQIYGAGVLWTVGLISL
                    10         20         30         40         50         60

70         80         90        100        110        120
   m531.pep  AGILADYVAGIWGTKYTGAGKLAVRGALAGSIIGIFFSLPGLILGPFIGAAAGELIERRN
             ||||||||||||||||||||||||||||||||||||||||||||||||||||||||||||
   a531      AGILADYVAGIWGTKYTGAGKLAVRGALAGSIIGIFFSLPGLILGPFIGAAAGELIERRN
                    70         80         90        100        110        120

130        140        150        160
   m531.pep  MLQAGKAGLGTLLGLVVGTAFKIGCAVSILFILLVKYIAYLFX
             ||||||||||||||:|||||||||||||||||||||||||||
   a531      MLQAGKAGLGTLLGLIVGTAFKIGCAVSILFILLVKYIAYLFX
                   130        140        150        160
```

The following partial DNA sequence was identified in *N. gonorrhoeae* <SEQ ID 1537>:

```
g532.seq (partial)
   1 atggctgaaa caatgaaaaa acaggcggat tcgcctgatt tggtgtacgg 51 tttggaagac aggccgccgt tcggtaatgc gctcttgagc gcggttaccc
```

-continued
```
101 atcttttggc gattttcgtg ccgatgatta cgcccgcgct gattgtgggc 151 ggcgcgctgg aattgccggt ggagatgacg gcgtatctgg tgtcgatggc 201 gatggttgcg tcgggtgtcg gcacttattt gcaggtcaac cgcttcgggt 251 cggtcggctc ggggatgctg tccatccagc gttaccgtca tgattgcgct 301 cggcgcgggg atgaaagagg gcggtttgag ...
```

This corresponds to the amino acid sequence <SEQ ID 1538; ORF 532.ng>:

```
g532.pep (partial)
   1 MAETMKKQAD SPDLVYGLED RPPFGNALLS AVTHLLAIFV PMITPALIVG

51 GALELPVEMT AYLVSMAMVA SGVGTYLQVN RFGSVGSGML SIQRYRHDCA

101 RRGDERGRFE ...
```

The following partial DNA sequence was identified in *N. meningitidis* <SEQ ID 1539>:

```
m532.seq
    1 ATGAGCGGTC AGTTGGGCAA AGGTGCGGAT GCGCCTGATT TGGTGTACGG

51 TTTGGAAGAC AGGCCGCCGT TCGGTAATGC GCTCTTGAGC GCGGTTACCC

101 ATCTTTTGGC GATTTTTGTG CCGATGATTA CGCCCGCGCT GATTGTGGGC

151 GGCGCGCTGG AATTGCCGGT GGAGATGACG GCGTATCTCG TGTCGATGGC

201 GATGGTTGCG TCGGGTGTCG GCACTTATTT GCAGGTCAAC CGCTTCGGGC

251 CGGTCGGTTC GGGGATGCTG TCCATCCAGT CGGTGAATTT TTCGTTCGTT

301 ACCGTGATGA TTGCGCTGGG CGCGGGGATG AAAGAGGGCG GTTTGACTAA

351 GGATGCGATG ATTTCGACGC TCTTGGGCGT ATCGTTTGTC GGCGCGTTTT

401 TGGTGTGTTT CTCGGCGTGG CTTCTGCCGT ATTTGAAAAA AGTGATTACG

451 CCGACGGTCA GCGGCGTGGT CGTGATGCTC ATTGGTTTGA GTTTGGTACA

501 CGTCGGCATT ACCGATTTCG GCGGCGGCTT CGGCGCGAAG GCGGACGGCA

551 CGTTCGGCTC GATGGAAAAC TTGGGGCTGG CATCGCTGGT GTTGCTGATT

601 GTGTTGGTGT TCAACTGCAT GAAAAACCCG CTGTTGCGCA TGAGCGGCAT

651 TGCGGTCGGG CTGATTGCCG GCTATATCGT CGCGCTGTTT TTGGGCAAGG

701 TGGATTTTTC CGCGCTGCAA AACCTGCCGC TGGTTACGCT GCCCGTACCG

751 TTTAAATACG GTTTTGCTTT CGACTGGCAC GCGTTTATTG TGGCGGGCGC

801 GATTTTCTTG TTGAGCGTGT TTGAGGCGGT CGGCGATTTA ACCGCGACGG

851 CAATGGTGTC CGACCAGCCG ATTGAAGGCG AGGAATACAC CAAACGCCTG

901 CGCGGCGGCG TGTTGGCTGA CGGCTTGGTG TCGGTGATTG CGACGGCTTT

951 GGGTTCGCTG CCGCTGACGA CGTTTGCGCA AACAACGGC GTGATTCAGA

1001 TGACCGGCGT GGCTTCGCGC CATGTGGGCA ATATATTGC CGTGATTTTG

1051 GTGCTGTTGG GTCTGTTCCC CGTTGTCGGT CGCGCGTTTA CGACGATTCC

1101 GAGTCCGGTG TTGGGCGGCG CGATGGTTTT GATGTTCGGC TTAATTGCGA

1151 TTGCGGGCGT GCGGATTTTG GTCAGTCACG GCATCCGCAG GCGCGAAGCG

1201 GTGATTGCGG CAACGTCGGT CGGTTTGGGC TTGGGTGTCG CGTTTGAGCC

1251 GGAAGTGTTT AAAAACCTGC CCGTCTTGTT CCAAAACTCT ATTTCCGCCG
```

-continued
```
1301 GCGGCATTAC GGCAGTCTTG CTGAATTTGG TCTTGCCCGA AGATAAAACC

1351 GAGGCGGCGG TCAAGTTTGA TACCGACCAC TTGGAACACT GA
```

This corresponds to the amino acid sequence <SEQ ID 1540; ORF 532>.

```
m532.pep
   1 MSGQLGKGAD APDLVYGLED RPPFGNALLS AVTHLLAIFV PMITPALIVG

51 GALELPVEMT AYLVSMAMVA SGVGTYLQVN RFGPVGSGML SIQSVNFSFV

101 TVMIALGAGM KEGGLTKDAM ISTLLGVSFV GAFLVCFSAW LLPYLKKVIT

151 PTVSGVVVML IGLSLVHVGI TDFGGGFGAK ADGTFGSMEN LGLASLVLLI

201 VLVFNCMKNP LLRMSGIAVG LIAGYIVALF LGKVDFSALQ NLPLVTLPVP

251 FKYGFAFDWH AFIVAGAIFL LSVFEAVGDL TATAMVSDQP IEGEEYTKRL

301 RGGVLADGLV SVIATALGSL PLTTFAQNNG VIQMTGVASR HVGKYIAVIL

351 VLLGLFPVVG RAFTTIPSPV LGGAMVLMFG LIAIAGVRIL VSHGIRRREA

401 VIAATSVGLG LGVAFEPEVF KNLPVLFQNS ISAGGITAVL LNLVLPEDKT

451 EAAVKFDTDH LEH*
```

Computer analysis of this amino acid sequence gave the following results:

Homology with a Predicted ORF from *N. gonorrhoeae*

ORF532 shows 91.4% identity over a 93 aa overlap with a predicted ORF (ORF 532.ng) from *N. gonorrhoeae*:

```
    g532/m532
                     10         20         30         40         50         60
    g532.pep   MAETMKKQADSPDLVYGLEDRPPFGNALLSAVTHLLAIFVPMITPALIVGGALELPVEMT
               |:  : ||:||||||||||||||||||||||||||||||||||||||||||||||||||
    m532       MSGQLGKGADAPDLVYGLEDRPPFGNALLSAVTHLLAIFVPMITPALIVGGALELPVEMT
                     10         20         30         40         50         60
                     70         80         90        100        110
    g532.pep   AYKVSMAMVASGVGTYLQVNRFGSVGSGMLSIQRYRHDCARRGDERGRFEX
               |||||||||||||||||||||||| ||||||||||
    m532       AYKVSMAMVASGVGTYLQVNRFGPVGSGMLSIQSVNFSFVTVMIALGAGMKEGGLTKDAM
                     70         80         90        100        110        120
```

The following partial DNA sequence was identified in *N. meningitidis* <SEQ ID 1541>:

```
a532.seq
   1 ATGAGCGGTC AGTTGGGCAA AGGTGCGGAT GCGCCTGATT TGGTGTACGG

51 TTTGGAGGAT AGGCCGCCGT TCGGTAATGC GCTCTTGAGC GCGGTTACCC

101 ATCTTTTGGC GATTTTTGTG CCGATGATTA CGCCCGCGCT GATTGTGGGC

151 GGCGCGCTGG AATTGCCGGT GGAGATGACG GCGTATCTCG TGTCGATGGC

201 GATGGTTGCG TCGGGTGTCG GCACTTATTT GCAGGTCAAC CGCTTCGGGC

251 CGGTCGGTTC GGGGATGCTG TCCATCCAGT CGGTGAATTT CTCGTTCGTT

301 ACCGTCATGA TTGCGCTCGG CGCGGGGATG AAAGAGGGCG GTTTGACTAA

351 GGATGCGATG ATTTCGACGC TCTTGGGCGT ATCGTTTGTC GGCGCGTTTT

401 TGGTGTGTTT TTCGGCGTGG CTTCTGCCGT ATTTGAAAAA AGTGATTACG

451 CCGACGGTCA GCGGTGTGGT GGTGATGCTG ATCGGCTTGA GTTTGGTACA

501 CGTCGGTATT ACCGATTTCG GCGGCGGCTT CGGCGCAAAG GCGGACGGCA

551 CGTTCGGCTC GATGGAAAAC TTGGGGCTGG CATCGCTGGT GCTGCTGATT
```

```
-continued
 601 GTGCTGGTGT TCAATTGCAT GAAAAACCCG CTGCTGCGGA TGAGCGGCAT

651 TGCGGTCGGT CTGATTGCCG GCTATATCGT CGCGCTGTTT TTGGGCAAGG

701 TGGATTTTTC GGCACTGCAA AACCTGCCGC TGGTTACGCT GCCCGTACCG

751 TTTAAATATG GTTTTGCTTT TGACTGGCAC GCATTTATTG TGGCGGGTGC

801 GATTTTCTTG TTGAGCGTGT TTGAGGCGGT CGGCGATTTG ACGGCGACGG

851 CAATGGTGTC CGACCAGCCG ATTGAAGGCG AGGAATACAC CAAACGCTTG

901 CGCGGCGGCG TGTTGGCGGA CGGCTTGGTG TCGGTGATTG CGACGGCTTT

951 GGGTTCGCTG CCGCTGACGA CGTTTGCACA AAACAACGGC GTGATTCAGA

1001 TGACCGGCGT GGCTTCGCGC CATGTGGGCA AATATATTGC CGTGATTTTG

1051 GTGCTGTTGG GTCTGTTCCC CGTTGTCGGA CGCGCGTTTA CGACGATTCC

1101 GAGTCCGGTG TTGGGCGGCG CGATGGTTTT GATGTTCGGC TTGATTGCGA

1151 TTGCGGGCGT GCGGATTTTG GTCAGCCACG GCATCCGCAG GCGCGAAGCG

1201 GTAATTGCGG CAACGTCGGT CGGTTTGGGC TTGGGTGTCG CGTTTGAGCC

1251 GGAAGTGTTT AAAAACCTGC CCGTCTTGTT CCAAAACTCT ATTTCCGCCG

1301 GCGGCATTAC GGCAGTCTTG CTGAATTTGG TCTTGCCCGA AGATAAAACC

1351 GAGGCGGCGG TCAAGTTTGA TACCGACCAC TTGGAACACT GA
```

This corresponds to the amino acid sequence <SEQ ID 1542; ORF 532.a>:

```
a532.pep
  1 MSGQLGKGAD APDLVYGLED RPPFGNALLS AVTHLLAIFV PMITPALIVG

51 GALELPVEMT AYLVSMAMVA SGVGTYLQVN RFGPVGSGML SIQSVNFSFV

101 TVMIALGAGM KEGGLTKDAM ISTLLGVSFV GAFLVCFSAW LLPYLKKVIT

151 PTVSGVVVML IGLSLVHVGI TDFGGGFGAK ADGTFGSMEN LGLASLVLLI

201 VLVFNCMKNP LLRMSGIAVG LIAGYIVALF LGKVDFSALQ NLPLVTLPVP

251 FKYGFAFDWH AFIVAGAIFL LSVFEAVGDL TATAMVSDQP IEGEEYTKRL

301 RGGVLADGLV SVIATALGSL PLTTFAQNNG VIQMTGVASR HVGKYIAVIL

351 VLLGLFPVVG RAFTTIPSPV LGGAMVLMFG LIAIAGVRIL VSHGIRRREA

401 VIAATSVGLG LGVAFEPEVF KNLPVLFQNS ISAGGITAVL LNLVLPEDKT

451 EAAVKFDTDH LEH*
``` m532/a532 100.0% identity in 463 aa overlap

```
                 10         20         30         40         50         60
m532.pep  MSGQLGKGADAPDLVYGLEDRPPFGNALLSAVTHLLAIFVPMITPALIVGGALELPVEMT
          ||||||||||||||||||||||||||||||||||||||||||||||||||||||||||||
a532      MSGQLGKGADAPDLVYGLEDRPPFGNALLSAVTHLLAIFVPMITPALIVGGALELPVEMT
                 10         20         30         40         50         60

70         80         90        100        110        120
m532.pep  AYLVSMAMVASGVGTYLQVNRFGPVGSGMLSIQSVNFSFVTVMIALGAGMKEGGLTKDAM
          ||||||||||||||||||||||||||||||||||||||||||||||||||||||||||||
a532      AYLVSMAMVASGVGTYLQVNRFGPVGSGMLSIQSVNFSFVTVMIALGAGMKEGGLTKDAM
                 70         80         90        100        110        120

130        140        150        160        170        180
m532.pep  ISTLLGVSFVGAFLVCFSAWLLPYLKKVITPTVSGVVVMLIGLSLVHVGITDFGGGFGAK
          ||||||||||||||||||||||||||||||||||||||||||||||||||||||||||||
a532      ISTLLGVSFVGAFLVCFSAWLLPYLKKVITPTVSGVVVMLIGLSLVHVGITDFGGGFGAK
                130        140        150        160        170        180
```

```
              190       200       210       220       230       240
m532.pep  ADGTFGSMENLGLASLVLLIVLVFNCMKNPLLRMSGIAVGLIAGYIVALFLGKVDFSALQ
          ||||||||||||||||||||||||||||||||||||||||||||||||||||||||||||
a532      ADGTFGSMENLGLASLVLLIVLVFNCMKNPLLRMSGIAVGLIAGYIVALFLGKVDFSALQ
              190       200       210       220       230       240

250       260       270       280       290       300
m532.pep  NLPLVTLPCPFKTGFAFDEHAFIVAGAIFLLSVFEAVGDLTATAMVSDQPIEGEEYRKRL
          ||||||||||||||||||||||||||||||||||||||||||||||||||||||||||||
a532      NLPLVTLPCPFKTGFAFDEHAFIVAGAIFLLSVFEAVGDLTATAMVSDQPIEGEEYRKRL
              250       260       270       280       290       300

310       320       330       340       350       360
m532.pep  RGGVLADGLVSVIATALGSLPLTTFAQNNGVIQMTGVASRHVGKYIAVILVLLGLFPVVG
          ||||||||||||||||||||||||||||||||||||||||||||||||||||||||||||
a532      RGGVLADGLVSVIATALGSLPLTTFAQNNGVIQMTGVASRHVGKYIAVILVLLGLFPVVG
              310       320       330       340       350       360

370       380       390       400       410       420
m532.pep  RAFTTIPSPVLGGAMVLMFGLIAIAGVRILVSHGIRRREAVIAATSVGLGLGVAFEPEVF
          ||||||||||||||||||||||||||||||||||||||||||||||||||||||||||||
a532      RAFTTIPSPVLGGAMVLMFGLIAIAGVRILVSHGIRRREAVIAATSVGLGLGVAFEPEVF
              370       380       390       400       410       420

430       440       450       460
m532.pep  KNLPVLFQNSISAGGITAVLLNLVLPEDKTEAAVKFDTDHLEHX
          ||||||||||||||||||||||||||||||||||||||||||||
a532      KNLPVLFQNSISAGGITAVLLNLVLPEDKTEAAVKFDTDHLEHX
              430       440       450       460
```

The following partial DNA sequence was identified in *N. gonorrhoeae* <SEQ ID 1543>:

```
g535.seq
    1 atgccctttc cgttttcag acaantattt gcttngtcct tgctacggtt 51 ttttgccgta ggtcggattc tcgaatccga catttccaac agcggttttt 101 cggaaacgat aaacgcgtca aatgttttt ttgtcggata cgaatatccg 151 gcctgcattt caaatttaca tcgcttccaa tttcgcaaac ttggtatcca 201 gttctttcac gccctgtttg ccgaagttga tggtcagtcg gcggattcg 251 cctttgtctg cggcatcgat aatcacgccg gtgccgaatt tggcgtgacg 301 gacgttttgt ccgatgcgga agcctgcgta ggtttgcggc tgtttgaagt 351 catcgatgat tttgtcccgt tgtacggtgg tttggcgcgt gttgccgtag 401 ctgtcgaagg cgggttttt gacggacagg tagtgcaata cttctggcgg 451 gatttcttcg acgaagcggg atgcgatgcc gaattgggtt tgtccgtgca 501 gcatgcgttg ctgtgccatg gtgatgtaga ggcgtttgcg ggcgcgggtg 551 atggcgacgt acatgaggcg gcgttcttct cgaggccgc cgcgctcggc 601 aaggctcatt tcgctgggga aacgcccctc ttccataccg gtgaggaaga 651 cggcgttgaa ttccaagcct ttggcggcgt ggacggtcat cagttggacg 701 gcttttcgc ctgcccctgc ttggttttcg ccggattcga gggcggcgtt 751 gctcaagaag gcgaggatgg ggaaggcggg atcgtctga
```

This corresponds to the amino acid sequence <SEQ ID 1544; ORF 535.ng>:

```
g535.pep
    1 MPFPVFRQXF AXSLLRFFAV GRILESDISN SGFSETINAS NVFFVGYEYP

51 ACISNLHRFQ FRKLGIQFFH ALFAEVDGQS GGFAFVCGID NHAGAEFGVT

101 DVLSDAEACV GLRLFEVIDD FVPLYGGLAR VAVAVEGGFF DGQVVQYFWR

151 DFFDEAGCDA ELGLSVQHAL LCHGDVEAFA GAGDGDVHEA AFFFEAAALG
```

```
-continued
201 KAHFAGETPL FHTGEEDGVE FQAFGGVDGH QLDGFFACPC LVFAGFEGGV

251 AQEGEDGEGG IV*
```

The following partial DNA sequence was identified in *N. meningitidis* <SEQ ID 1545>:

```
m535.seq
  1 aTGCCCTTtC CGTTTTCAG ACGGCCTTTT GCTTTGTCCT TACTtACGTT

51 TTTTGCCGTA AGTCAGATTC TTGTATCCGA CATTTCCAAC AGCGGTGTTT

101 CGGAAACAAT AGACGCGTCA AATGTTTTTG TCGGATACGA ATATCCGACC

151 TACATTTCAA ATTTACATCT CTTCCAATTT CGCAAACTTG GTGTCCAACT

201 CTTTCACGCC CTGTTTGCCG AAATTGATGG TCAGTCGGGC GGATTCGCCT

251 TTATCTGCGG CATCGATAAT CACGCCGGTG CCGAATTTGG CGTGGCGGAC

301 GTTTTGTCCG ATACGGAAAC CTGCGTAGGT TTGGGGCTGT TTGTAGTCGT

351 CGATGATTTT ATCTTTGGAT GCGGCGGTTT GGCGCGTGTT GCCGTAACTG

401 TCGTAGGCAG GCTTTTTGAC GGACAGGTAG TGCAATACTT CGGGTGGGAT

451 CTCTTCGACG AAGCGGGAGA CGATGCCGAA TTGGGTTTGT CCGTGCAGCA

501 TGCGTTGTTG CGCCATGGTG ATGTAGAGGC GTTTGCGGGC GCGGGTGATG

551 GCGACGTACA TGAGGCGGCG TTCTTCTTCG AGGCCGCCGC GTTCGGCAAG

601 GCTCATTTCG CTGGGGAAGC GGCCTTCTTC CATGCCGGTG AGGAAGACGG

651 CGTTAAATTC CAAGCCTTTG GCGGCGTGGA CGGTCATGAG TTGGACGGCC

701 TTTTCGCCTG CGCCTGCCTG GTTTTCACCG GATTCGAGGG CGGCATTGCT

751 TAGGAAGGCG AGAATGGGGA AGGCGGGGTC GTCTGA
```

This corresponds to the amino acid sequence <SEQ ID 1546; ORF 535>:

```
m535.pep
  1 MPFPVFRRPF ALSLLTFFAV SQILVSDISN SGVSETIDAS NVFVGYEYPT

51 YISNLHLFQF RKLGVQLFHA LFAEIDGQSG GFAFICGIDN HAGAEFGVAD

101 VLSDTETCVG LGLFVVVDDF IFGCGGLARV AVTVVGRLFD GQVVQYFGWD

151 LFDEAGDDAE LGLSVQHALL RHGDVEAFAG AGDGDVHEAA FFFEAAAFGK

201 AHFAGEAAFF HAGEEDGVKF QAFGGVDGHE LDGLFACACL VFTGFEGGIA

251 XEGENGEGGV V*
```

Computer analysis of this amino acid sequence gave the following results:
Homology with a Predicted ORF from *N. gonorrhoeae*
ORF 535 shows 80.9% identity over a 262 aa overlap with a predicted ORF (ORF 535.ng) from *N. gonorrhoeae*:

```
    m535/g535

10         20         30         40         50       59
        m535.pep   MPFPVFRRPFALSLLTFFAVSQILVSDISNSGVSETIDASNVF-VGYEYPTYISNLHLFQ
                   |||||||:  || ||| ||||::|| |||||||| ||||:|||||  ||||||: ||||| ||
        g535       MPFPVFRQXFAXSLLRFFAVGRILESDISNSGFSETINASNVFFVGYEYPACISNLHRFQ
                       10         20         30         40         50       60

60         70         80         90        100        110       119
        m535.pep   FRKLGVQLFHALFAEIDGQSGGFAFICGIDNHAGAEFGVADVLSDTETCVGLGLFVVVDD
                   |||||:|:||||||||:|||||||||||:|||||||||||||||||:||:|:|||| ||  |:||
        g535       FRKLGIQFFHALFAEVDGQSGGFAFVCGIDNHAGAEFGVTDVLSDAEACVGLRLFEVIDD
                       70         80         90        100        110        120
```

-continued

```
               120        130        140        150        160        170       179
m535.pep       FIFGCGGLARVAVTVVGRLFDGQVVQYFGWDLFDEAGDDAELGLSVQHALLRHGDVEAFA
               |:   ||||||||:| | :|||||||||  |:||||| ||||||||||||| ||||||||
g535           FVPLYGGLARVAVAVEGGFFDGQVVQYFWRDFFDEAGCDAELGLSVQHALLCHGDVEAFA
                       130        140        150        160        170        180

180        190        200        210        220        230       239
m535.pep       GAGDGDVHEAAFFFEAAAFGKAHFAGEAAFFHAGEEDGVKFQAFGGVDGHELDGLFACAC
               ||||||||||||||||||:||||||||: :||:||||||:||||||||||:|||:||| |
g535           GAGDGDVHEAAFFFEAAALGKAHFAGETPLFHTGEEDGVEFQAFGGVDGHQLDGFFACPC
                       190        200        210        220        230        240

240        250        260
m535.pep       LVFTGFEGGIAXEGENGEGGVV
               |||:|||||:| |||:||||:|
g535           LVFAGFEGGVAQEGEDGEGGIV
                       250        260
```

The following partial DNA sequence was identified in *N. meningitidis* <SEQ ID 1547>:

```
a535.seq (partial)
  1 TTCAGACGGC CTTTTGCCTT GTCCTTGCTA CAGTTTTTTG CCATAGGTCG

51 GATTCTCGAA TCCGACATTT CCAACAGCGG TTTTTCGGAA ACGATAGACG

101 CGTCAAATAT TTTTGTCGGA TACGAGTATC CAGCCTGCAT TTCAAATTTA

151 CATCGCTTCC AATTTCGCAA ACTTGGTGTC CAACTCTTTC ACGCCCTGTT

201 TGCCGAAATT GATGGTCAGT CGGGCGGATT CGCCTTTATC TGCGGCATCG

251 ATAATCACGC CGGTGCCGAA TTTGGCGTGG CGGACGTTTT GTCCGATACG

301 GAAACCTGCG TAGGTTTGGG GCTGTTTGTA GTCGTCGATG ATTTTGTCTT

351 TGGGCGCGGC GGTTTGGCGC GTGTTGCCAT AGCGGTCGTA GGCGGGTTTT

401 TTGACGGACA GGTAGTGCAA TACTTCGGGC GGGATTTCTT CGACGAAGCG

451 GGAGACGATG CCGAATTGGG TTTGTCCGTG CAGCATGCGT TGTTGCGCCA

501 TGGTGATGTA GAGGCGTTTG CGGGCGCGGG TGATGGCGAC GTACATCAGG

551 CGGCGTTCTT CTTCGAGGCC GCCGCGTTCG GCAAGGCTCA TTTCGCTGGG

601 GAAGCGGCCT TCTTCCATGC CGGTGAGGAA TACGGCGTTA AATTCCAAGC

651 CTTTGGCGGC GTGCACGGTC ATGAGTTGTA CGGCTTTTTC GCCCGCGCCT

701 GCTTGGTTTT CGCCGGATTC GAGAGCAGCA TTGCTTAGGA AAGCGAGGAT

751 GGGGAAGGCG GGGTCGTCTG A
```

This corresponds to the amino acid sequence <SEQ ID 1548; ORF 535.a>:

```
a535.pep (partial)
  1 FRRPFALSLL QFFAIGRILE SDISNSGFSE TIDASNIFVG YEYPACISNL

51 HRFQFRKLGV QLFHALFAEI DGQSGGFAFI CGIDNHAGAE FGVADVLSDT

101 ETCVGLGLFV VVDDFVFGRG GLARVAIAVV GGFFDGQVVQ YFGRDFFDEA

151 GDDAELGLSV QHALLRHGDV EAFAGAGDGD VHQAAFFFEA AAFGKAHFAG

201 EAAFFHAGEE YGVKFQAFGG VHGHELYGFF ARACLVFAGF ESSIA*ESED

251 GEGGVV*
``` m535/a535 88.7% identity in 256 aa overlap

```
                   10        20        30        40        50        60
    m535.pep  MPFPVFRRPFALSLLTFFAVSQILVSDISNSGVSETIDASNVFVGYEYPTYISNLHLFQF
              ||||||||||||| :::|| |||||| |||||||:||||||: ||||| |||
    a535          FRRPFALSLLQFFAIGRILESDISNSGFSETIDASNIFVGYEYPACISNLHRFQF
                       10        20        30        40        50

70        80        90       100       110       120
    m535.pep  RKLGVQLFHALFAEIDGQSGGFAFICGIDNHAGAEFGVADVLSDTETCVGLGLFVVVDDF
              ||||||||||||||||||||||||||||||||||||||||||||||||||||||||||||
    a535      RKLGVQLFHALFAEIDGQSGGFAFICGIDNHAGAEFGVADVLSDTETCVGLGLFVVVDDF
                       60        70        80        90       100       110

130       140       150       160       170       180
    m535.pep  IFGCGGLARVAVTVVGRLFDGQVVQYFGWDLFDEAGDDAELGLSVQHALLRHGDVEAFAG
              :|| |||||||| :::||| :||||||||| |:|||||||||||||||||||||||||||
    a535      VFGRGGLARVAIAVVGGFFDGQVVQYFGRDFFDEAGDDAELGLSVQHALLRHGDVEAFAG
                       120       130       140       150       160       170

190       200       210       220       230       240
    m535.pep  AGDGDVHEAAFFFEAAAFGKAHFAGEAAFFHAGEEDGVKFQAFGGVDGHELDGLFACACL
              ||||||| :|||||||||||||||||||||||||||| ||||||||| |||| |:|| |||
    a535      AGDGDVHQAAFFFEAAAFGKAHFAGEAAFFHAGEEYGVKFQAFGGVHGHELYGFFARACL
                       180       190       200       210       220       230

250       260
    m535.pep  VFTGFEGGIAXEGENGEGGVVX
              ||:|||::||||:|:||||||||
    a535      VFAGFESSIAXESEDGEGGVVX
                       240       250
```

The following partial DNA sequence was identified in *N. gonorrhoeae* <SEQ ID 1549>:

```
g537.seq
   1 atgaaatccc tttttatttg gctgcttcta ttgggctcgg cggcaggcgt 51 tttctaccat acccaaaacc aatccctgcc cgcgggcgaa cttgtctatc 101 cgtccgcacc gcaaatcagg gacggcggcg atgcgctgca ctacctcaac 151 cgcatccgca cacaaatcgg tttgcacgcg ctggcacacg cgccggtttt 201 ggaaaattcc gcccgcaggc acgcacgcta tctcacgctc aatcccgaag 251 acggacacgg cgaacaccat cccgacaatc cgcactacac cgcacaaaag 301 ctgaccgaac gcacacgcct tgccgggtat ctctacaacg gcgtgcatga 351 aaacatcagc acggaagagg aagccgccga atcgtccgac agcgacatcc 401 gcacgcagca acgccaagtg gacgctttga tgagcgcaat ctaccaccgc 451 cttttcgctgc ttgaccgcca taccgacgaa gcaggtgcgg catttgtgcg 501 cgaaaacggc aaaaccgtcc tcgtattcaa tcagggcaac ggcagcttcg 551 agcgcgcctg tgcaaaagga aggcggcagc cggaagcagg acggaaatat 601 taccgcaacg cttgccacaa cggtgcggcc gtttatgctg acgaagccat 651 gcccgtaacg gaattgcttt ataccgccta tccggttggc ggcggcgcgc 701 tgccttattt ttacggggaa cgtcccgacc ccgtgccgga atatgaaatc 751 acaggcaatc ctgccagcat tgattttcc gaggcggcag gcaaaattgc 801 gatgaaaagt ttcaagctgt atcagggtaa aaacgaaatc cgccccgtca 851 gggttttaac cgccggcaac gaccctaacg gcaggctgac cgcgcaccaa 901 ttcgccctt tcccgctcaa acctttggaa tacggcacgc tttatacggc 951 ggtattcgac tatgtccgca acggacggca cgcgcaggcg aaatggcagt 1001 ttagaacccg aaaacccgat taccctatt ttgaggtaaa cggcggcgag 1051 acacttgcgg ttagaaaagg cgaaaaatat ttcatccact ggcgcggacg 1101 ctggtgtctg gaagcgtgta cccgttatac ctaccggcgg cagttcggca
```

-continued

```
1151 acagcctgtc catactccgg cacgaagcgg gcggcattgt cttcagcgtc 1201 agcggaatgg cgggaagccg catcaggctt actccggaag acagcccgga 1251 acgcggtgta accctttatt tgcaggattg a
```

This corresponds to the amino acid sequence <SEQ ID 1550; ORF 537.ng>:

```
g537.pep
  1 MKSLFIWLLL LGSAAGVFYH TQNQSLPAGE LVYPSAPQIR DGGDALHYLN

51 RIRTQIGLHA LAHAPVLENS ARRHARYLTL NPEDGHGEHH PDNPHYTAQK

101 LTERTRLAGY LYNGVHENIS TEEEAAESSD SDIRTQQRQV DALMSAIYHR

151 LSLLDRHTDE AGAAFVRENG KTVLVFNQGN GSFERACAKG RRQPEAGRKY

201 YRNACHNGAA VYADEAMPVT ELLYTAYPVG GGALPYFYGE RPDPVPEYEI

251 TGNPASIDFS EAAGKIAMKS FKLYQGKNEI RPVRVLTAGN DPNGRLTAHQ

301 FALFPLKPLE YGTLYTAVFD YVRNGRHAQA KWQFRTRKPD YPYFEVNGGE

351 TLAVRKGEKY FIHWRGRWCL EACTRYTYRR QFGNSLSILR HEAGGIVFSV

401 SGMAGSRIRL TPEDSPERGV TLYLQD *
```

The following partial DNA sequence was identified in *N. meningitidis* <SEQ ID 1551>:

```
m537.seq (partial)
  1 ATGAAATCCC TTTTTATTCG GCTGCTCCTG TTGGGTTCGG CGGCAGGCGT 51 TTTCTACCAT ACCCAAAmCC AATCCCTGCC CGCGGGCGAA CTTGTCTATC

101 CGTCCGCACC GCAAATCAGG GACGGCGGCG ATGCGCTGCA CTACCTCAAC

151 CGCATCCGAG CCCAAATCGG TTTGCACAAG CTGGCACACG CGCCGGTTTT

201 GGAAAACTCC GCCCGCAgGC ACGCAAGCTA CCTCACGCTC AATCCCGAAG

251 ACGGACACGG CGAACACCAT CCCGACAATC CGCACTACAC CGCACAAAAG

301 CTGACCGAAC GCACACGCCT TGCCGGGTAT CTCTACAACG GCGTGCATGA

351 AAACATCAGC ACGGAAGAAG AAGCCGCCGA ATCGTCCGAC AGCGACATCC

401 GCACGCAGCA ACGCCAAGTG GACGGATTAA TGAGCGCAAT CTACCACCGC

451 CTTTCCCTAC TTGACCGCCA TACGGATGAG TCAGGAGCGG CATT...
```

This corresponds to the amino acid sequence <SEQ ID 1552; ORF 537>:

```
m537.pep (partial)
  1 MKSLFIRLLL LGSAAGVFYH TQXQSLPAGE LVYPSAPQIR DGGDALHYLN

51 RIRAQIGLHK LAHAPVLENS ARRHASYLTL NPEDGHGEHH PDNPHYTAQK

101 LTERTRLAGY LYNGVHENIS TEEEAAESSD SDIRTQQRQV DGLMSAIYHR

151 LSLLDRHTDE SGAA...
```

Computer analysis of this amino acid sequence gave the following results:

Homology with a Predicted ORF from *N. gonorrhoeae*

ORF 537 shows 95.7% identity over a 164 aa overlap with a predicted ORF (ORF 537.ng) from *N. gonorrhoeae*:

```
m537/g537

10        20        30        40        50        60
    m537.pep    MKSLFIRLLLLGSAAGVFYHTQXQSLPAGELVYPSAPQIRDGGDALHYLNRIRAQIGLHK
                ||||||  ||||||||||||||||  ||||||||||||||||||||||||||:|||||
    g537        MKSLFIWLLLLGSAAGVFYHTQNQSLPAGELVYPSAPQIRDGGDALHYLNRIRTQIGLHA
                    10        20        30        40        50        60

70        80        90       100       110       120
    m537.pep    LAHAPVLENSARRHASYLTLNPEDGHGEHHPDNPHYTAQKLTERTRLAGYLYNGVHENIS
                ||||||||||||||| ||||||||||||||||||||||||||||||||||||||||||||
    g537        LAHAPVLENSARRHARYLTLNPEDGHGEHHPDNPHYTAQKLTERTRLAGYLYNGVHENIS
                    70        80        90       100       110       120

130       140       150       160
    m537.pep    TEEEAAESSDSDIRTQQRQVDGLMSAIYHRLSLLDRHTDESGAA
                ||||||||||||||||||||||:|||||||||||||||||:|||
    g537        TEEEAAESSDSDIRTQQRQVDALMSAIYHRLSLLDRHTDEAGAAFVRENGKTVLVFNQGN
                   130       140       150       160       170       180 g537        GSFERACAKGRRQPEAGRKYYRNACHNGAAVYADEAMPVTELLYTAYPVGGGALPYFYGE
                   190       200       210       220       230       240
```

The following partial DNA sequence was identified in *N. meningitidis* <SEQ ID 1553>:

```
a537.seq
   1 ATGAAATCCC TTTTTATTCG GCTGCTCCTG TTGGGTTCGG CGGCCGGCGT

51 TTTCTATCAT ACCCAAAACC AATCCCTGCC CGCGGGCGAA CTTGTCTATC

101 CGTCCGCACC GCAAATCAGG GACGGCGGCG ATGCGCTGCA CTACCTCAAC

151 CGCATCCGCG CCCAAATCGG TTTGCACAAG CTGGCACACG CGCCGGTTTT

201 GGAAAATTCC GCCCGCAGGC ACGCACGCTA TCTCACGCTC AATCCCGAAG

251 ACGGACACGG CGAACACCAT CCCGACAATC CGCACTACAC CGCACAAAAG

301 CTGACCGAAC GCACACGCCT TGCCGGGTAT CTCTACAACG GCGTGCATGA

351 AAACATCAGC ACGGAAGAGG AAGCCGCCGA ATCGTCCGAC AGCGACATCC

401 GCACGCAGCA ACGCCAAGTG GACGGATTAA TGAGCGCAAT CTACCACCGC

451 CTTTCCCTAC TTGACCGCCA TACGGATGAG GCAGGAGCGG CATTTGTGCG

501 CGAAAACGGT AAAACCGTTC TCGTATTCAA TCAGGGCAAC GGCAGGTTTG

551 AGCGGCATTG CGCCCAAGGC AGAAATCAGC CGGAAGCAGG ACGGAAATAT

601 TACCGCAACG CCTGCCATAA CGGTGCGGTC GTGTACACCG ACGAAGCCAT

651 GCCCGCACAG GAGCTGCTCT ATACAGCCTA TCCCGTCGGC AACGGCGCAC

701 TGCCTTATTT CCACGGCGAG CGTCCAGACC CCGTGCCGGA ATATGAAATC

751 ACGGGCAATC CTGCCAGCAT TGATTTTTCC GAGGCGGCAG GCAAAATTAC

801 GATGAAAAGT TTCAAGCTGT ATCAGGGTAA AAACGAAATC CGCCCCGTCA

851 GGGTTTTAAC CGCCGGCAAC GACCCCAACG GCAGGCTGAC CGCGTACCAA

901 TTCGCGCTTT TCCCGCTCAA GCCTTTGGAA TACGGTACGC TTTATACGGC

951 GGTATTCGAC TATGTCCGCA ACGGACGGCG CGCGCAGGCG AAATGGCAGT

1001 TTAGAACCCG AAAACCCGAT TACCCTTATT TTGAGGTAAA CGGCGGCGAG

1051 ACACTTGCGG TTAGAAAAGG CGAAAAATAT TTCATCCACT GGCGCGGACG

1101 CTGGTGTTTG GAAGCGTGTA CCCGTTATAC CTACCGGCAG CGACCCGGCA
```

-continued

```
1151 GCCGCCTGTC CATAGGAAGG CACAAGGCGG GCGGCATCGT CTTCAGCGTT

1201 GACGGAATGG CGGGCAGCCG CATCACGCTT GCACCGGAAG GAGAAACGGA

1251 ACGAGGCGTA ACCCTTTATT TACAGGATTG A
```

This corresponds to the amino acid sequence <SEQ ID 1554; ORF 537.a>:

```
a537.pep
   1 MKSLFIRLLL LGSAAGVFYH TQNQSLPAGE LVYPSAPQIR DGGDALHYLN

51 RIRAQIGLHK LAHAPVLENS ARRHARYLTL NPEDGHGEHH PDNPHYTAQK

101 LTERTRLAGY LYNGVHENIS TEEEAAESSD SDIRTQQRQV DGLMSAIYHR

151 LSLLDRHTDE AGAAFVRENG KTVLVFNQGN GRFERHCAQG RNQPEAGRKY

201 YRNACHNGAV VYTDEAMPAQ ELLYTAYPVG NGALPYFHGE RPDPVPEYEI

251 TGNPASIDFS EAAGKITMKS FKLYQGKNEI RPVRVLTAGN DPNGRLTAYQ

301 FALFPLKPLE YGTLYTAVFD YVRNGRRAQA KWQFRTRKPD YPYFEVNGGE

351 TLAVRKGEKY FIHWRGRWCL EACTRYTYRQ RPGSRLSIGR HKAGGIVFSV

401 DGMAGSRITL APEGETERGV TLYLQD*
``` m537/a537 98.2% identity in 164 aa overlap

```
                   10         20         30         40         50         60
    m537.pep   MKSLFIRLLLLLGSAAGVFYHTQXQSLPAGELVYPSAPQIRDGGDALHYLNRIRAQIGLHK
               |||||||||||||||||||| |||||||||||||||||||||||||||||||||||||||
        a537   MKSLFIRLLLLGSAAGVFYHTQNQSLPAGELVYPSAPQIRDGGDALHYLNRIRAQIGLHA
                   10         20         30         40         50         60

70         80         90        100        110        120
    m537.pep   LAHAPVLENSARRHASYLTLNPEDGHGEHHPDNPHYTAQKLTERTRLAGYLYNGVHENIS
               |||||||||||||||| ||||||||||||||||||||||||||||||||||||||||||
        a537   LAHAPVLENSARRHARYLTLNPEDGHGEHHPDNPHYTAQKLTERTRLAGYLYNGVHENIS
                   70         80         90        100        110        120

130        140        150        160
    m537.pep   TEEEAAESSDSDIRTQQRQVDGLMSAIYHRLSLLDRHTDESGAA
               ||||||||||||||||||||||||||||||||||||||||:|||
        a537   TEEEAAESSDSDIRTQQRQVDGLMSAIYHRLSLLDRHTDEAGAAFVRENGKTVLVFNQGN
                  130        140        150        160        170        180 a537   GRFERACAQGRNQPEAGRKYYRNACHNGAVVYADEAMPAQELLTYAYPVGNGALPYFHGE
                  190        200        210        220        230        240
```

The following partial DNA sequence was identified in *N. gonorrhoeae* <SEQ ID 1555>:

```
g538.seq
   1 atgtcaggta gaacaggacg gaacagtgcc actcaggcgc aaccggaacg 51 cgtcatgctg gtgggcgtaa tgttggataa agatgatacg ggcagcaatg 101 ccgcccgtct gaacggtttt cagacggcat tggcggaagc cgtcgagctg 151 gtcaaagcgg cgggcggcga ttccgtacgc gtggagactg ccaaacgcga 201 ccgcccgcac actgcgctgt tgtcggcac gggcaaggcg gcggagctgt 251 cggaagcagt tgccgcagac ggcattgatt tggtcgtatt caaccacgaa 301 cttactccca cgcaggaacg caatttggaa aaaatcctcc aatgccgcgt 351 attggacaga gtggggctga ttctggcgat tttcgcccgc cgcgcccgca 401 cgcaggaagg caggctgcaa gtcgagttgg cgcaattgag ccatttggcg 451 ggacgcttga tacgcggtta cggacatttg caaagccagc gcggcggtat
```

```
-continued
 501 cggcatgaaa gggccgggcg aaaccaaact ggaaaccgac cgccgattaa 551 ccgcccatcg gatcaacgcc ttgaaaaaac agcttgccaa cctcaaaaaa 601 cagcgcgccc tgcgccgcaa gtcccgcgag tcgggcagaa tcaaaacgtt 651 tgcgctggtc ggctatacca atgtcggcaa atccagcctg ttcaaccggc 701 tgaccaagtc gggcatatat gcgaaagacc agcttttcgc cactctcgac 751 acgacggcgc ggcggctgta catcagtccc gcatgcagca ttatcctgac 801 cgataccgtc ggattcgtca gcgatctgcc gcacaaactg atttccgcct 851 tttccgccac cttggaagaa accgtgcaag ccgatgtgct gctgcacgtc 901 gtcgatgctg ccgcccggaa cagcgggcag cagattgaag acgtggaaaa 951 cgtactgcaa gaaatccatg cccacgatat tccgtgcatc aaggtgtaca 1001 acaaaaccga cctgctgccg tctgaagaac aaaacacggg catatggcgc 1051 gacgctgcgg gaaaaattgc cgccgtccgc atttccgttg ctgaaaatac
```

This corresponds to the amino acid sequence <SEQ ID 1556; ORF 538.ng>:

```
g538.pep
   1 MSGRTGRNSA TQAQPERVML VGVMLDKDDT GSNAARLNGF QTALAEAVEL

51 VKAAGGDSVR VETAKRDRPH TALFVGTGKA AELSEAVAAD GIDLVVFNHE

101 LTPTQERNLE KILQCRVLDR VGLILAIFAR RARTQEGRLQ VELAQLSHLA

151 GRLIRGYGHL QSQRGGIGMK GPGETKLETD RRLTAHRINA LKKQLANLKK

201 QRALRRKSRE SGRIKTFALV GYTNVGKSSL FNRLTKSGIY AKDQLFATLD

251 TTARRLYISP ACSIILTDTV GFVSDLPHKL ISAFSATLEE TVQADVLLHV

301 VDAAARNSGQ QIEDVENVLQ EIHAHDIPCI KVYNKTDLLP SEEQNTGIWR

351 DAAGKIAAVR ISVAENTGID ALREAIAEYC AAAPNTDETE MP*
```

The following partial DNA sequence was identified in *N. meningitidis* <SEQ ID 1557>:

```
m538.seq
   1 ATGACAGGCA GAACAGGCGG CAACGGCAGT ACCCAAGCGC AACCCGAACG

51 CGTCATGCTG GTGGGCGTAA TGTTGGACAA AGATGGTACG GGCAGTAGTG

101 CCGCCCGTCT GAACGGTTTT CAGACGGCAT TGGCGGAAGC TGTCGAGCTG

151 GTCAAAGCGG CGGGCGGCGA TTCCGTGCGC GTGGAGACTG CCAAACGCGA

201 CCGTCCGCAC ACCGCGCTGT TTGTCGGCAC GGGCAAGGCG GCGGAGCTGT

251 CAGAAGCAGT TGCCGCAGAC GGCATCGATT TGGTCGTATT CAACCACGAA

301 CTCACGCCCA CGCAGGAACG CAACCTTGAA AAAGAACTsA AATGCCGCGT

351 ATTGGACAGG GTAGGGCTGA TTCTGGCGAT TTTCGCTCGC CGCGCCCGCA

401 CGCAGGAAGG CAGGCTGCAA GTCGAGTTGG CGCAATTGAG CCATTTGGCG

451 GGACGCTTGA TACGCGGTTA CGGCCATCTG CAGAGCCAGC GCGGCGGTAT

501 CGGCATGAAA GGCCCCGGCG AAACCAAACT GGAAACCGAC CGCCGATTGA

551 TCGCCCATCG GATCAATGCC TTGATAAAAC AGCTTGCCAA CCTCAAAAAA

601 CAGCGCGCCC TGCGCCGCAA GTCnCGCGAA TCGGGCACAA TCAAAACGTT

651 TGCGCTGGTC GGCTATACAA ATGTCGGAAA ATCCAGCCTG TTCAACCGGC
```

```
-continued
 701 TGACAAAGTC GGGCATATAT GCAAAGGACA AGCTTAGTCC CGAATGCAGC

751 ATTATCCTGA CCGATACCGT CGGATTCGTn AGCGATCTGC CGCAcAAACT

801 GATTTCCGCC TTTTCgCC.A CGCTGGAAGA AACCGCGCAA GCCGATGTGC

851 TGCTGCACGT CGTCGATGCC GCCGCTCCGA ACAGCGGACA GCAGATTGAA

901 GACGTGGAAA ACGTACTGCA AGAAATCCAT GCCGGCGATA TTCCGTGCAT 951 cAAGGTGTAC AACAAAACCG ACCTGCTGCC GTCTGAAGAA CAAACACGG

1001 GCATATGGCG CGACGCTGCG GGAAAAATTG CCGCCGTCCG CATTTCCGTT

1051 GCTGAAAATA CCGGTATAGA CGCACTGCGC GAAGCcATTG CCGAGTCTTG

1101 TGCCGCCGCA CCAAACACAG ACGAAACCGA AATGCCATGA
```

This corresponds to the amino acid sequence <SEQ ID 1558; ORF 538>:

```
m538.pep
   1 MTGRTGGNGS TQAQPERVML VGVMLDKDGT GSSAARLNGF QTALAEAVEL

51 VKAAGGDSVR VETAKRDRPH TALFVGTGKA AELSEAVAAD GIDLVVFNHE

101 LTPTQERNLE KELKCRVLDR VGLILAIFAR RARTQEGRLQ VELAQLSHLA

151 GRLIRGYGHL QSQRGGIGMK GPGETKLETD RRLIAHRINA LIKQLANLKK

201 QRALRRKSRE SGTIKTFALV GYTNVGKSSL FNRLTKSGIY AKDKLSPECS

251 IILTDTVGFV SDLPHKLISA FSXTLEETAQ ADVLLHVVDA AAPNSGQQIE

301 DVENVLQEIH AGDIPCIKVY NKTDLLPSEE QNTGIWRDAA GKIAAVRISV

351 AENTGIDALR EAIAESCAAA PNTDETEMP*
```

Computer analysis of this amino acid sequence gave the following results:
Homology with a Predicted ORF from *N. gonorrhoeae*
    ORF 538 shows 92.1% identity over a 392 aa overlap with a predicted ORF (ORF 538.ng) from *N. gonorrhoeae*:

```
    m538/g538

10         20         30         40         50         60
      m538.pep   MTGRTGGNGSTQAQPERVMLVGVMLDKDGTGSSAARLNGFQTALAEAVELVKAAGGDSVR
                 |:||||  |::|||||||||||||||||   |||:|||||||||||||||||||||||||
      g538       MSGRTGRNSATQAQPERVMLVGVMLDKDDTGSNAARLNGFQTALAEAVELVKAAGGDSVR
                      10         20         30         40         50         60

70         80         90        100        110        120
      m538.pep   VETAKRDRPHTALFVGTGKAAELSEAVAADGIDLVVFNHELTPTQERNLEKELKCRVLDR
                 ||||||||||||||||||||||||||||||||||||||||||||||||||||| :|||||
      g538       VETAKRDRPHTALFVGTGKAAELSEAVAADGIDLVVFNHELTPTQERNLEKILQCRVLDR
                      70         80         90        100        110        120

130        140        150        160        170        180
      m538.pep   VGLILAIFARRARTQEGRLQVELAQLSHLAGRLIRGYGHLQSQRGGIGMKGPGETKLETD
                 ||||||||||||||||||||||||||||||||||||||||||||||||||||||||||||
      g538       VGLILAIFARRARTQEGRLQVELAQLSHLAGRLIRGYGHLQSQRGGIGMKGPGETKLETD
                     130        140        150        160        170        180

190        200        210        220        230        240
      m538.pep   RRLIAHRINALIKQLANLKKQRALRRKSRESGTIKTFALVGYTNVGKSSLFNRLTKSGIY
                 ||| ||||||| ||||||||||||||||||||| ||||||||||||||||||||||||||
      g538       RRLTAHRINALKKQLANLKKQRALRRKSRESGRIKTFALVGYTNVGKSSLFNRLTKSGIY
                     190        200        210        220        230        240

250        260        270        280
      m538.pep   AKDKL------------SPECSIILTDTVGFVSDLPHKLISAFSXTLEETAQADVLLHV
                 ||||:            || ||||||||||||||||||||||||| |||||:|||||||
      g538       AKDQLFATLDTTARRLYISPACSIILTDTVGFVSDLPHKLISAFSATLEETVQADVLLHV
                     250        260        270        280        290        300
```

-continued

```
              290       300       310       320       330       340
m538.pep      VDAAAPNSGQQIEDVENVLQEIHAGDIPCIKVYNKTDLLPSEEQNTGIWRDAAGKIAAVR
              ||||| |||||||||||||||||| |||||||||||||||||||||||||||||||||||
g538          VDAAARNSGQQIEDVENVLQEIHAHDIPCIKVYNKTDLLPSEEQNTGIWRDAAGKIAAVR
                     310       320       330       340       350       360

350       360       370       380
m538.pep      ISVAENTGIDALREAIAESCAAAPNTDETEMPX
              |||||||||||||||||| ||||||||||||||
g538          ISVAENTGIDALREAIAEYCAAAPNTDETEMPX
```

The following partial DNA sequence was identified in *N. meningitidis* <SEQ ID 1559>:

```
a538.seq
   1 ATGACAGGCA GAACAGGCCG CAACGGCAGT ACCCAAGCGC AACCCGAACG

51 CGTCATGCTG GTGGGCGTAA TGTTGGACAA AGATGGTACG GGCAGCAGTG

101 CCACCCGTCT GAACGGTTTT CAGACGGCAT TGGCGGAAGC TGTCGAGCTG

151 GTCAAAGCGG CGGGCGGCGA TTCCGTGCGC GTGGAGACTG CCAAACGCGA

201 CCGTCCGCAC ACCGCGCTGT TTGTCGGCAC GGGCAAGGCG GCGGAGCTGT

251 CGGAAGCAGT TGCCGCAGAC GGCATCGATT TGGTCGTATT CAACCACGAA

301 CTTACGCCCA CGCAGGAACG CAATTTGGAA AAAATCCTCC AATGCCGCGT

351 ATTGGACAGA GTGGGGCTGA TTCTGGCGAT TTTCGCCCGC CGCGCCCGCA

401 CGCAGGAAGG CAGGCTGCAA GTCGAGTTGG CACAATTGAG CCATTTGGCG

451 GGACGCTTGA TACGCGGTTA CGGCCATCTG CAGAGCCAGC GCGGCGGTAT

501 CGGCATGAAA GGCCCCGGCG AAACCAAACT GGAAACCGAC CGCCGATTGA

551 TCGCCCATCG GATCAATGCC TTGAAAAAAC AGCTTGCCAA CCTCAAAAAA

601 CAGCGCGCCC TGCGCCGCAA GTCCCGCGAA TCGGGCACAA TCAAAACGTT

651 TGCGCTGGTC GGCTATACCA ATGTCGGCAA ATCCAGTCTG TTCAACCGGC

701 TGACCAAGTC GGGCATATAT GCGAAAGACC AGCTTTTCGC CACACTCGAC

751 ACGACGGCGC GGCGGCTGTA CATCAGTCCC GAATGCAGCA TTATCCTGAC

801 CGATACCGTC GGATTCGTCA GCGATCTGCC GCACAAACTG ATTTCCGCCT

851 TTTCCGCCAC GCTGGAAGAA ACCGCGCAAG CCGATGTGCT GCTGCACGTC

901 GTCGATGCCG CCGCTCCGAA CAGCGGACAG CAGATTGAAG ACGTGGAAAA

951 CGTACTGCAA GAAATCCATG CCGGCGATAT TCCGTGCATC AAGGTGTACA

1001 ACAAAACCGA CCTGCTGCCG TCTGAAGAAC AAAACACGGG CATATGGCGC

1051 GACGCTGCGG GAAAAATTGC CGCCGTCCGC ATTTCCGTTG CTGAAAATAC

1101 CGGTATAGAC GCACTGCGCG AAGCCATTGC CGAGTATTGT GCCGCCGCAC

1151 CAAACACAGA CGAAACCGAA ATGCCATGA
```

This corresponds to the amino acid sequence <SEQ ID 1560; ORF 538.a>:

```
a538.pep
   1 MTGRTGRNGS TQAQPERVML VGVMLDKDGT GSSATRLNGF QTALAEAVEL

51 VKAAGGDSVR VETAKRDRPH TALFVGTGKA AELSEAVAAD GIDLVVFNHE

101 LTPTQERNLE KILQCRVLDR VGLILAIFAR RARTQEGRLQ VELAQLSHLA

151 GRLIRGYGHL QSQRGGIGMK GPGETKLETD RRLIAHRINA LKKQLANLKK

201 QRALRRKSRE SGTIKTFALV GYTNVGKSSL FNRLTKSGIY AKDQLFATLD
```

```
251 TTARRLYISP ECSIILTDTV GFVSDLPHKL ISAFSATLEE TAQADVLLHV

301 VDAAAPNSGQ QIEDVENVLQ EIHAGDIPCI KVYNKTDLLP SEEQNTGIWR

351 DAAGKIAAVR ISVAENTGID ALREAIAEYC AAAPNTDETE MP*
``` m538/a538 94.6% identity in 392 aa overlap

```
                   10         20         30         40         50         60
m538.pep   MTGRTGGNGSTQAQPERVMLVGVMLDKDGTGSSAARLNGFQTALAEAVELVKAAGGDSVR
           ||||||  ||||||||||||||||||||||||||  ||||||||||||||||||||||||
a538       MTGRTGRNGSTQAQPERVMLVGVMLDKDGTGSSATRLNGFQTALAEAVELVKAAGGDSVR
                   10         20         30         40         50         60

70         80         90        100        110        120
m538.pep   VETAKRDRPHTALFVGTGKAAELSEAVAADGIDLVVFNHELTPTQERNLEKELKCRVKDR
           ||||||||||||||||||||||||||||||||||||||||||||||||||| : ||||||
a538       VETAKRDRPHTALFVGTGKAAELSEAVAADGIDLVVFNHELTPTQERNLEKILQCRVKDR
                   70         80         90        100        110        120

130        140        150        160        170        180
m538.pep   VGLILAIFARRARTWEGRLQVELAQLSHLAGRLIRGYGHLQSQRGGIGMKGPGETKLETD
           ||||||||||||||||||||||||||||||||||||||||||||||||||||||||||||
a538       VGLILAIFARRARTWEGRLQVELAQLSHLAGRLIRGYGHLQSQRGGIGMKGPGETKLETD
                  130        140        150        160        170        180

190        200        210        220        230        240
m538.pep   RRLIAHRINALIKQLANLKKQRALRRKSRESGTIKTFALVGYTNVGKEELFNRLTKSGIY
           |||||||||||| |||||||||||||||||||||||||||||||||||||||||||||||
a538       RRLIAHRINALKKQLANLKKQRALRRKSRESGTIKTFALVGYTNVGKEELFNRLTKSGIY
                  190        200        210        220        230        240

250        260        270        280
m538.pep   AKDKL-------------SPECSIILTDTVGFVSDLPHKLISAFSXTLEETAQADVLLHV
           |||:|             |||||||||||||||||||||||||||| |||||||||||||
a538       AKDQLFATLDTTARRLYISPECSIILTDTVGFVSDLPHKLISAFSATLEETAQADVLLHV
                  250        260        270        280        290        300

290        300        310        320        330        340
m538.pep   VDAAAPNSGQQIEDVENVLQEIHAGDIPCIKVYNKTDLLPSEEQNTGIWRDAAGKIAAVR
           ||||||||||||||||||||||||||||||||||||||||||||||||||||||||||||
a538       VDAAAPNSGQQIEDVENVLQEIHAGDIPCIKVYNKTDLLPSEEQNTGIWRDAAGKIAAVR
                  310        320        330        340        350        360

350        360        370        380
m538.pep   ISVAENTGIDALREAIAESCAAAPNTDETEMPX
           |||||||||||||||||||  ||||||||||||
a538       ISVAENTGIDALREAIAEYCAAAPNTDETEMPX
                  370        380        390
```

The following partial DNA sequence was identified in *N. gonorrhoeae* <SEQ ID 1561>:

```
g539.seq
   1  atggaggatc tgcaggaaat cgggttcgat gtcgccgccg taaaggtagg 51  tcggcagcgc gaacatcatc gtctgcatca tacccagtcc ggcaacggca 101  aggcggacga tgtattgttt gcgttctttt tggttggcgg cttcgatttt 151  ttgcgcgtca tagggtgcgg cggtgtagcc tgtctgccgg attttcaaca 201  gaatgtcgga gaggcggatt ttgccgtcgt cccagacgac gcggcagcgg 251  tgcgtgctgt aattgaggtc gatgcggacg atgccgtctg tgcgcaaaag 301  ctgctgttcg atcagccaga cgcaggcggc gcaggtaatg ccgctgagca 351  tcagcactgc ttcgtgcgtg ccattatggg tttccacaaa gtcggattgg 401  acttcgggca ggtcgtacag gcggatttgg tcgaggattt cttgggcgg 451  cagttcggtt ttttcgcgt cggcggtgcg tcgtttgtaa taactgccca 501  agccggaatc gatgatgctt tgtgcgactg cctgacagcc gacgcagcag 551  gtttcgcggt cttcgccttc gtagcggacg gtcagatgca ggttttcggg 601  aacgtccagc ccgcagtgga aacaggtttt tttcatggca tttcggtttc
```

-continued
```
 651 gtctgtgttt ggtgcggcgg cacaatactc ggcaatggct tcgcgcagtg
 701 cgtctatacc ggtattttca gcaacggaaa tgcggacggc ggcaattttt
 751 cccgcagcgt cgcgccatat gcccgtgttt tgttcttcag acggcagcag
 801 gtcggttttg ttgtacacct tgatgcacgg aatatcgtgg gcatggattt
 851 cttgcagtac gttttccacg tcttcaatct gctgcccgct gttccgggcg
 901 gcagcatcga cgacgtgcag cagcacatcg gcttgcacgg tttcttccaa
 951 ggtggcggaa aaggcggaaa tcagtttgtg cggcagatcg ctgacgaatc
1001 cgacggtatc ggtcaggata atgctgcatg cgggactgat gtacagccgc
1051 cgcgccgtcg tgtcgagagt ggcgaaaagc tggtctttcg catatatgcc
1101 cgacttggtc agccggttga acaggctgga tttgccgaca ttggtatag
```

This corresponds to the amino acid sequence <SEQ ID 1562; ORF 539.ng>:

```
g539.pep
  1 MEDLQEIGFD VAAVKVGRQR EHHRLHHTQS GNGKADDVLF AFFLVGGFDF
 51 LRVIGCGGVA CLPDFQQNVG EADFAVVPDD AAAVRAVIEV DADDAVCAQK
101 LLFDQPDAGG AGNAAEHQHC FVRAIMGFHK VGLDFGQVVQ ADLVEDFLGR

151 QFGFFRVGGA SFVITAQAGI DDALCDCLTA DAAGFAVFAF VADGQMQVFG

201 NVQPAVETGF FHGISVSSVF GAAAQYSAMA SRSASIPVFS ATEMRTAAIF

251 PAASRHMPVF CSSDGSRSVL LYTLMHGISW AWISCSTFST SSICCPLFRA

301 AASTTCSSTS ACTVSSKVAE KAEISLCGRS LTNPTVSVRI MLHAGLMYSR

351 RAVVSRVAKS WSFAYMPDLV SRLNRLDLPT LV*
```

The following partial DNA sequence was identified in *N. meningitidis* <SEQ ID 1563>:

```
m539.seq (partial)
  1 ATGGAGGATT TGCAGGAAAT CGGGTTCGAT GTCGCCGCCG TAAAGGTAGG
 51 TCGGCAGCGC GAACATCATC GTCTGCATCA TCCCCAGCCC GGCAACGGCG
101 AGGCGGACGA TGTATTGTTT GCGTTCTTTT TGGTTGGCGG CTTCGATTTT
151 TTGCGCGTCA TAGGGTGCGG CGGTGTAGCC TATCTGCCTG ATTTTCAACA
201 GAATGTCGGA AAGGCGGATT TTGCCGTCGT CCCAGACGAc GCGGCaGCgG
251 TGCGTGCTGT AATTGAGGTC GATGCGGACG ATGCCGTCTG TACGCAAAAG
301 CTGCTGTTCG ATCAGCCAGA CGCAGGCGGC GCAGGTGATG CCGCCGAGCA
351 TTAAAACCGC CTCGCGCGTG CCGCCGTGGG TTTCCACAAA GTCGGACTGG
401 ACTTCGGGCA GGTCGTACAG GCGGATTTGG TCGAGGATTT CTTGGGGCGG
451 CAgCTCGGTT TTTTGCGCGT CGGCGGTGCG TTGTTTGTAA TAACTGCCCA
501 AGCCCGCGTC AATAATGCTT TGTGCGACCG CCTGACAGCC GGCGCaCAgG
551 GTTTCGCGGT CTTCGTTTTC GTAACGGACA GTCAGGTGGA GGTGTTCGGG
601 AACATCCAGA CCGCAGTGGA AACAGGTTTT TTTCATGGCA TTTCGGTTTC
651 GTCTGTGTTT GGTGCGGCGG CACAAGACTC GGCAATgGCT TCGCGCAGTG
701 CGTCTATACC GGTATTTTCA GCAACGGAAA TGCGGACGGC GGCAATTTTT
751 CCCGCAGCGT CGCGCCATAT GTCTGTGTTT TGTTCTTCAG ACGGCAGCAG
```

```
-continued
 801 GTCGGTTTTG TTGTACACCT TgATGCACGG AATATCGCCG GCATGGATTT

851 CTTGCAGTAC GTTTTCCACG TCTTCAATCT GCTGTCCGCT GTTCGGAGCG

901 GCGGCATCGA CGACGTGCAG CAGCACATCG GCTTGCGCGG TTTCTTCCAG

951 CGTGGcG.AA AAGGCGGAAA TCAGTTTgTG CGGCAGATCG CTnACGAATC

1001 CGACGGTATC GGTCAGGATA ATGCTGCATT CGGGAC...
```

This corresponds to the amino acid sequence <SEQ ID 1564; ORF 539>:

```
m539.pep (partial)
   1 MEDLQEIGFD VAAVKVGRQR EHHRLHHPQP GNGEADDVLF AFFLVGGFDF

51 LRVIGCGGVA YLPDFQQNVG KADFAVVPDD AAAVRAVIEV DADDAVCTQK

101 LLFDQPDAGG AGDAAEH*NR LARAAVGFHK VGLDFGQVVQ ADLVEDFLGR

151 QLGFLRVGGA LFVITAQARV NNALCDRLTA GAQGFAVFVF VTDSQVEVFG

201 NIQTAVETGF FHGISVSSVF GAAAQDSAMA SRSASIPVFS ATEMRTAAIF

251 PAASRHMPVF CSSDGSRSVL LYTLMHGISP AWISCSTFST SSICCPLFGA

301 AASTTCSSTS ACAVSSSVAX KAEISLCGRS LTNPTVSVRI MLHSG....
```

Computer analysis of this amino acid sequence gave the following results:
Homology with a Predicted ORF from *N. gonorrhoeae*
ORF 539 shows 89% identity over a 345 aa overlap with a predicted ORF (ORF 539.ng) from *N. gonorrhoeae*:

```
   m539/g539
                       10         20         30         40         50         60
        m539.pep  MEDLQEIGFDVAAVKVGRQREHHRLHHPQPGNGEADDVLFAFFLVGGFDFLRVIGCGGVA
                  |||||||||||||||||||||||||| |||:||||||||||||||||||||||||||||
        g539      MEDLQEIGFDVAAVKVGRQREHHRLHHTQSGNGKADDVLFAFFLVGGFDFLRVIGCGGVA
                       10         20         30         40         50         60

70         80         90        100        110        120
        m539.pep  YLPDFQQNVGKADFAVVPDDAAAVRAVIEVDADDAVCTQKLLFDQPDAGGAGDAAEHXNR
                   ||||||||:||||||||||||||||||||||||||:||||||||||||||||||:||| :
        g539      CLPDFQQNVGEADFAVVPDDAAAVRAVIEVDADDAVCAQKLLFDQPDAGGAGNAAEHQHC
                       70         80         90        100        110        120

130        140        150        160        170        180
        m539.pep  LARAAVGFHKVGLDFGQVVQADLVEDFLGRQLGFLRVGGALFVITAQARVNNALCDRLTA
                  ::|| :||||||||||||||||||||||||||:||:||||| |||||| :::|||| |||
        g539      FVRAIMGFHKVGLDFGQVVQADLVEDFLGRQFGFFRVGGASFVITAQAGIDDALCDCLTA
                      130        140        150        160        170        180

190        200        210        220        230        240
        m539.pep  GAQGFAVFVFVTDSQVEVFGNIQTAVETGFFHGISVSSVFGAAAQDSAMASRSASIPVFS
                  | |||||:|:|:|::||||:|||||||||||||||||||||||||:||||||||||||||
        g539      DAAGFAVFAFVADGQMQVFGNVQPAVETGFFHGISVSSVFGAAAQYSAMASRSASIPVFS
                      190        200        210        220        230        240

250        260        270        280        290        300
        m539.pep  ATEMRTAAIFPAASRHMPVFCSSDGSRSVLLYTLMHGISPAWISCSTFSTSSICCPLFGA
                  |||||||||||||||||||||||||||||||||||||||| ||||||||||||||||| |
        g539      ATEMRTAAIFPAASRHMPVFCSSDGSRSVLLYTLMHGISWAWISCSTFSTSSICCPLFRA
                      250        260        270        280        290        300

310        320        330        340
        m539.pep  AASTTCSSTSACAVSSSVAXKAEISLCGRSLTNPTVSVRIMLHSG
                  ||||||||||:|||:||||||||||||||||||||||||||||:|
        g539      AASTTCSSTSACTVSSKVAEKAEISLCGRSLTNPTVSVRIMLHAGLMYSRRAVVSRVAKS
                      310        320        330        340        350        360 g539      WSFAYMPDLVSRLNRLDLPTLV
                      370        380
```

The following partial DNA sequence was identified in *N. meningitidis* <SEQ ID 1565>:

```
a539.seq
   1 ATGGAGGATT TGCAGGAAAT CGGGTTCGAT GTCGCCGCCG TAAAGGTAGG
  51 TCGGCAGCGC GAACATCATC GTCTGCATCA TCCCCAGCCC GGCAACGGCG
 101 AGGCGGACGA TGTATTGTTT GCGTTCTTTT TGGTTGGCGG CTTCGATTTT
 151 TTGCGCGTCA TAGGGTGCGG CGGTGTAGCC TATCTGCCTG ATTTTCAACA
 201 GAATGTCGGA AAGGCGGATT TTGCCGTCGT CCCAGACGAC GCGGCAGCGG
 251 TGCGTGCTGT AATTGAGGTC GATGCGGACG ATGCCGTCTG TACGCAAAAG
 301 CTGCTGTTCG ATCAGCCAGA CGCAGGCGGC GCAGGTGATG CCGCCGAGCA
 351 TTAAAACCGC CTCGCGCGTG CCGCCGTGGG TTTCCACAAA GTCGGACTGG
 401 ACTTCGGGCA GGTCGTACAG GCGGATTTGG TCGAGGATTT CTTGGGGCGG
 451 CAGCTCGGTT TTTTGCGCGT CGGCGGTGCG TTGTTTGTAA TAACTGCCCA
 501 AGCCCGCGTC AATAATGCTT TGTGCGACTG CCTGACAACC GGCGCAGCAG
 551 GTTTCGCGGT CTTCGTTTTC GTAACGGACG GTCAGATGCA GGTTTTCGGG
 601 AACGTCCAGC CCGCAGTGGA AACAGGTTTT TTTCATGGCA TTTCGGTTTC
 651 GTCTGTGTTT GGTGCGGCGG CACAATACTC GGCAATGGCT TCGCGCAGTG
 701 CGTCTATACC GGTATTTTCA GCAACGGAAA TGCGGACGGC GGCAATTTTT
 751 CCCGCAGCGT CGCGCCATAT GCCCGTGTTT TGTTCTTCAG ACGGCAGCAG
 801 GTCGGTTTTG TTGTACACCT TGATGCACGG AATATCGCCG GCATGGATTT
 851 CTTGCAGTAC GTTTTCCACG TCTTCAATCT GCTGTCCGCT GTTCGGAGCG
 901 GCGGCATCGA CGACGTGCAG CAGCACATCG GCTTGCGCGG TTTCTTCCAG
 951 CGTGGCGGAA AAGGCGGAAA TCAGTTTGTG CGGCAGATCG CTGACGAATC
1001 CGACGGTATC GGTCAGGATA ATGCTGCATT CGGGACTGAT GTACAGCCGC
1051 CGCGCCGTCG TGTCGAGTGT GGCGAAAAGC TGGTCTTTCG CATATATGCC
1101 CGACTTGGTC AGCCGGTTGA ACAGACTGGA TTTGCCGACA TTGGTATAG
```

This corresponds to the amino acid sequence <SEQ ID 1566; ORF 539.a>:

```
a539.pep
  1 MEDLQEIGFD VAAVKVGRQR EHHRLHHPQP GNGEADDVLF AFFLVGGFDF
 51 LRVIGCGGVA YLPDFQQNVG KADFAVVPDD AAAVRAVIEV DADDAVCTQK
101 LLFDQPDAGG AGDAAEH*NR LARAAVGFHK VGLDFGQVVQ ADLVEDFLGR
151 QLGFLRVGGA LFVITAQARV NNALCDCLTT GAAGFAVFVF VTDGQMQVFG
201 NVQPAVETGF FHGISVSSVF GAAAQYSAMA SRSASIPVFS ATEMRTAAIF
251 PAASRHMPVF CSSDGSRSVL LYTLMHGISP AWISCSTFST SSICCPLFGA
301 AASTTCSSTS ACAVSSSVAE KAEISLCGRS LTNPTVSVRI MLHSGLMYSR
351 RAVVSSVAKS WSFAYMPDLV SRLNRLDLPT LV*
``` m539/a539 97.1% identity in 345 aa overlap

```
                    10        20        30        40        50        60
m539.pep    MEDLQEIGFDVAAVKVGRQREHHRLHHPQPGNGEADDVLFAFFLVGGFDFLRVIGCGGVA
            ||||||||||||||||||||||||||||||||||||||||||||||||||||||||||||
a539        MEDLQEIGFDVAAVKVGRQREHHRLHHPQPGNGEADDVLFAFFLVGGFDFLRVIGCGGVA
                    10        20        30        40        50        60
```

```
                  70          80         90        100        110        120
    m539.pep  YLPDFQQNVGKADFAVVPDDAAAVRAVIEVDADDAVCTQKLLFDQPDAGGAGDAAEHXNR
              ||||||||||||||||||||||||||||||||||||||||||||||||||||||||||||
    a539      YLPDFQQNVGKADFAVVPDDAAAVRAVIEVDADDAVCTQKLLFDQPDAGGAGDAAEHXNR
                  70          80         90        100        110        120

130         140        150        160        170        180
    m539.pep  LARAAVGFHKVGLDFGQVVQADLVEDFLGRQLGFLRVGGALFVITAQARVNNALCDRLTA
              ||||||||||||||||||||||||||||||||||||||||||||||||||||||||||||
    a539      LARAAVGFHKVGLDFGQVVQADLVEDFLGRQLGFLRVGGALFVITAQARVNNALCDRLTA
                 130         140        150        160        170        180

190         200        210        220        230        240
    m539.pep  GAQGFAVFVFVTDSQVEVFGNIQTAVETGFFHGISVSSVFGAAAQDSAMASRSASIPVFS
              ||  ||||||||||| :|: :||||: |  ||||||||||||||| ||||||||||||||
    a539      GAAGFAVFVFVTDGQMQVFGNVQPAVETGFFHGISVSSVFGAAAQYSAMASRSASIPVFS
                 190         200        210        220        230        240

250         260        270        280        290        300
    m539.pep  ATEMRTAAIFPAASRHMPVFCSSDGSRSVLLYTLMHGISPAWISCSTFSTSSICCPLFGA
              ||||||||||||||||||||||||||||||||||||||||||||||||||||||||||||
    a539      ATEMRTAAIFPAASRHMPVFCSSDGSRSVLLYTLMHGISPAWISCSTFSTSSICCPLFGA
                 250         260        270        280        290        300

310         320        330        340
    m539.pep  AASTTCSSTSACAVSSSVAXKAEISLCGRSLTNPTVSVRIMLHSG
              ||||||||||||||||||||  |||||||||||||||||||||||
    a539      AASTTCSSTSACAVSSSVAEKAEISLCGRSLTNPTVSVRIMLHSGLMYSRRAVVSSVAKS
                 310         320        330        340        350        360 a539      WSFAYMPDLVSRLNRLDLPTLVX
                 370         380
```

The following partial DNA sequence was identified in *N. gonorrhoeae* <SEQ ID 1567>:

```
g540.seq
   1 atgccgccct cccgacgcgg caacggggtg ttttatcaaa acggcaaact 51 tgccaatgcg gtttccgctt gccgattgcc aaaccggcaa acctttcccg 101 tgccggtgcc gaacccgatg ccgtctgaac cttcagacgg catcgggtgt 151 ttatttgtcc actcggacgg gtgcaggttc gtattgtgtc gattcgtcgc 201 cgtaatacag cacgccgagt ttgacgggga tgcgtccctg cgatttgcgg 251 tgggcgttgg aatcgcgcaa ggaatacgcg cagccgcagt attcctgctg 301 gtagaagttt tcgcgtttgc tgatttcaat catacgcgcg ccgccgccgc 351 ctttgcgcca gttgaagtcc caataggcca catcatcgta aggcgcggcg 401 gcacggtgtc cgcagtcgtt gatttgcgcc atatttttcc agcgtga
```

This corresponds to the amino acid sequence <SEQ ID 1568; ORF 540.ng>:

```
g540.pep
   1 MPPSRRGNGV FYQNGKLANA VSACRLPNRQ TFPVPVPNPM PSEPSDGIGC

51 LFVHSDGCRF VLCRFVAVIQ HAEFDGDASL RFAVGVGIAQ GIRAAAVFLL

101 VEVFAFADFN HTRAAAAFAP VEVPIGHIIV RRGGTVSAVV DLRHIFPA *
```

The following partial DNA sequence was identified in *N. meningitidis* <SEQ ID 1569>:

```
m540.seq (partial)
   1 ..CCGAACCCGA TGCCGTCTGA ACCTTCAGAC GGCATCGGGT GTTTATTTGT

51    CCACCCGGAT GGGGGCAGGT TCGTATTGTG TCGATTCGTC GCCGTAATAC

101    AGCACGCCGA GTTTGATGGG GATTCTGCCC TGTGATTTGC GGTGGGCATT

151    GGAATCCCTC AGGGAATAGG CACAACCGCA ATATTCCTGC TGGTAGAAGT
```

```
-continued
201  TTTCACGTTT GCTGATTTCA ATCATGCGCG CGCTGCCGCC GCCTTTGCGC

251  CAGTTGAAAT CCCAATACAC CACATCATCG TAAGGCGCGG CGGCGCGGTG

301  TCCGCAGTCG TTGATTTGCG CCATATTTTT CCAGCGTGA
```

This corresponds to the amino acid sequence <SEQ ID 1570; ORF 540>:

```
m540.pep (partial)
  1  ..PNPMPSEPSD GIGCLFVHPD GGRFVLCRFV AVIQHAEFDG DSAL*FAVGI

51  GIPQGIGTTA IFLLVEVFTF ADFNHARAAA AFAPVEIPIH HIIVRRGGAV

101  SAVVDLRHIF PA*
```

Computer analysis of this amino acid sequence gave the following results:
Homology with a Predicted ORF from N. gonorrhoeae
ORF 540 shows 85.7% identity over a 112 aa overlap with a predicted ORF (ORF 540.ng) from N. gonorrhoeae:

```
    m540/g540
                                               10         20         30
        m540.pep                      PNPMPSEPSDGIGCLFVHPDGGRFVLCRFV
                                      ||||||||||||||||||| || ||||||||
        g540     GNGVFYQNGKLANAVSACRLPNRQTFPVPVPNPMPSEPSDGIGCLFVHSDGCRFVLCRFV
                 10         20         30         40         50         60

40         50         60         70         80         90
        m540.pep AVIQHAEFDGDSALXFAVGIGIPQGIGTTAIFLLVEVFTFADFNHARAAAAFAPVEIPIH
                 ||||||||||||::| ||||:||  ||| ::|:||||||:||||||:|||||||||:||
        g540     AVIQHAEFDGDASLRFAVGVGIAQGIRAAAVFLLVEVFAFADFNHTRAAAAFAPVEVPIG
                 70         80         90         100        110        120

100        110
        m540.pep HIIVRRGGAVSAVVDLRHIFPAX
                 ||||||||:||||||||||||||
        g540     HIIVRRGGTVSAVVDLRHIFPAX
                 130        140
```
L' estremita' N-terminale di meningococco e' assente perche' interviene la fine del contig The following partial DNA sequence was identified in N. meningitidis <SEQ ID 1571>:

```
a540.seq
  1  ATGCCGTCCT CCCGACGCGG CAACGGGGTG TTTTATCAAA ACGGCAAACT

51  TGCCAATGCG GTTTCCGATT GCAGATTGCC AAACCGGCAA ACCTTTCCCG

101  TGCCGATGCC GAACCCGATG CCGTCTGAAC CTTCAGACGG CATCGGGTGT

151  TTATTTGTCC ACCCGGATGG GTGCAGGTTC GTATTGTGTC GATTCGTCGC

201  CGTAATACAG CACGCCGAGT TTGATGGGGA TTCTGCCCTG TGATTTGCGG

251  TGGGCGTTGG AATCCCTCAG GGAATAGGCA CAACCGCAAT ATTCCTGCTG

301  GTAGAAGTTT TCACGTTTGC TGATTTCAAT CATACGCGCG CTGCCGCCGC

351  CTTTGCGCCA GTTGAAATCC AATACACCA CATCATCGTA AGGCGCGGCG

401  GCGCGGCGGC CGCAGTCGTT AATCTGGTTC ATGTTTTTCC A
```

This corresponds to the amino acid sequence <SEQ ID 1572; ORF 540.a>:

```
a540.pep (partial)
  1  MPSSRRGNGV FYQNGKLANA VSDCRLPNRQ TFPVPMPNPM PSEPSDGIGC

51  LFVHPDGCRF VLCRFVAVIQ HAEFDGDSAL *FAVGVGIPQ GIGTTAIFLL

101  VEFTFADFN HTRAAAAFAP VEIPIHHIIV RRGGAAAAVV NLVHVFP
``` m540/a540 92.8% identity in 111 aa overlap

```
                                    10        20        30
    m540.pep                 PNPMPSEPSDGIGCLFVHPDGGRFVLCRFV
                             ||||||||||||||||||||| ||||||||
    a540     GNGVFYQNGKLANAVSDCRLPNRQTFPVPMPNPMPSEPSDGIGCLFVHPDGCRFVLCRFV
                 10        20        30        40        50        60

40        50        60        70        80        90
    m540.pep AVIQHAEFDGDSALXFAVGIGIPQGIGTTAIFLLVEVFTFADFNHARAAAAFAPVEIPIH
             ||||||||||||||||||||:||||||||||||||||||||||||||:||||||||||||
    a540     AVIQHAEFDGDSALXFAVGVGIPQGIGTTAIFLLVEVFTFADFNHTRAAAAFAPVEIPIH
                 70        80        90       100       110       120

100       110
    m540.pep HIIVRRGGAVSAVVDLRHIFPAX
             ||||||||::|||:| |:||
    a540     HIIVRRGGAAAAVVNLVHVFP
                130       140
```

The following partial DNA sequence was identified in *N. gonorrhoeae* <SEQ ID 1573>:

```
g542.seq
   1 atgccgaaat ggtcgcgcat acggcgttgc agcgtccttt cgctgatgtt 51 cagcgcggct gtcagccggt tgacttggtg tgcgccgccg tcgaacgcgg 101 cattcagggt gcggctgaag tcttcagacg gcatagcgtc tgcttccgcc 151 gtttgccccg ccgccggctc gatgccgtct gaaaccgtgt cccacaaatc 201 cgacagcagc cgcaacacgt ccgcctcgcg gcgcaatgtt tcgcccaaat 251 gccccttgg dacggtttgc aggcaggatg ccgccaagcc gcgcaggttt 301 gggggcaaat cccatatcct gaccggttcg cggtaa
```

This corresponds to the amino acid sequence <SEQ ID 1574; ORF 542.ng>:

```
g542.pep
   1 MPKWSRIRRC SVLSLMFSAA VSRLTWCAPP SNAAFRVRLK SSDGIASASA

51 VCPAAGSMPS ETVSHKSDSS RNTSASRRNV SPKCPFGTVC RQDAAKPRRF

101 GGKSHILTGS R*
```

The following partial DNA sequence was identified in *N. meningitidis* <SEQ ID 1575>:

```
m542.seq
   1 ATGCCGAAAT GGTCGCGCAT ACGGCGTTGC AGCGTCCTTT CACTGATGTT

51 CAGCGCGTCT GTCAGCCGGT TGACTTGGTG TGCGCCGTCG GCAAACGCGG

101 CATTTAGGGT GCGGCTGAAG TCTTCAGACG GCATAGCGTC TGCTTCCGCC

151 GTTTGCCCCG CCGCCGGCCC GATGCCGTCT GAAACCGTGT CCCACAAGTC

201 CGACAGCAGC CGCAACACGT CCGCCTCGCG .CGCAATGTT TCGCCCAAAT

251 GCCCCTTTGG DACGGCTTTC AGGCAGGATG CCGCCAAGCC GCGCAGGTTC

301 GGGGGCAAAT CCCATATCCT GACCGGTTCG CGGTAA
```

This corresponds to the amino acid sequence <SEQ ID 1576; ORF 542>:

```
m542.pep
   1 MPKWSRIRRC SVLSLMFSAS VSRLTWCAPS ANAAFRVRLK SSDGIASASA

51 VCPAAGPMPS ETVSHKSDSS RNTSASRAMF RPNAPLGRNV SPKCPFGTAF

101 RQDAAKPRRF GGKSHILTGS R*
```

Computer analysis of this amino acid sequence gave the following results:
Homology with a Predicted ORF from *N. gonorrhoeae*
ORF 542 shows 93.7% identity over a 111 aa overlap with a predicted ORF (ORF 542.ng) from *N. gonorrhoeae*:

```
m542/g542
                 10        20        30        40        50        60
    m542.pep MPKWSRIRRCSVLSLMFSASVSRLTWCAPSANAAFRVRLKSSDGIASASAVCPAAGPMPS
             ||||||||||||||||||:||||||||| :||||||||||||||||||||||||| |||
    g542     MPKWSRIRRCSVLSLMFSAAVSRLTWCAPPSNAAFRVRLKSSDGIASASAVCPAAGSMPS
                 10        20        30        40        50        60

70        80        90        100       110
    m542.pep ETVSHKSDSSRNTSASXRNVSPKCPFGTAFRQDAAKPRRFGGKSHILTGSRX
             ||||||||||||||||| ||||||||||||:|||||||||||||||||||||
    g542     ETVSHKSDSSRNTSASRRNVSPKCPFGTVCRQDAAKPRRFGGKSHILTGSRX
                 70        80        90        100       110
```

The following partial DNA sequence was identified in *N. meningitidis* <SEQ ID 1577>:

```
a542.seq
   1 ATGCCGAAAT GGTCGCGCAT ACGGCGTTGC AGCGTCCTTT CGCTGATGTT

51 CAGCGTGTCT GCCAGCCGGT TGACTTGATG TGCGCCGCCG GCAAACGCGG

101 CATTCAGGAT GCGGCTGAAG TCTTCAGACG GCATAGCGTC TGCTTCCGCC

151 GTTTGCCCCG CCGCCGGCCC GATGCCGTCT GAAACCGTGT CCCACAAGTC

201 CGACAGCAGC CGCAACACGT CCGCCTCGCG GCGCAATGTT TCGCCCAAAT

251 GCCCCTTTGG GACGGCTTTC AGGCAGGATG CCGCCAAGCC GCGCAGGTTC

301 GGGGGCAAAT CCCATATCCT GACCGGTTCG CGGTAA
```

This corresponds to the amino acid sequence <SEQ ID 1578; ORF 542.a>:

```
a542.pep
   1 MPKWSRIRRC SVLSLMFSVS ASRLT*CAPP ANAAFRMRLK SSDGIASASA

51 VCPAAGPMPS ETVSHKSDSS RNTSASRRNV SPKCPFGTAF RQDAAKPRRF

101 GGKSHILTGS R*
``` m542/a542 94.6% identity in 111 aa overlap

```
                 10        20        30        40        50        60
    m542.pep MPKWSRIRRCSVLSLMFSASVSRLTWCAPSANAAFRVRLKSSDGIASASAVCPAAGPMPS
             ||||||||||||||||||:|:|||| ||| ||||||:||||||||||||||||||||||
    a542     MPKWSRIRRCSVLSLMFSVSASRLTXCAPPANAAFRMRLKSSDGIASASAVCPAAGPMPS
                 10        20        30        40        50        60

70        80        90        100       110
    m542.pep ETVSHKSDSSRNTSASXRNVSPKCPFGTAFRQDAAKPRRFGGKSHILTGSRX
             ||||||||||||||||| ||||||||||||||||||||||||||||||||||
    a542     ETVSHKSDSSRNTSASRRNVSPKCPFGTAFRQDAAKPRRFGGKSHILTGSRX
                 70        80        90        100       110
```

The following partial DNA sequence was identified in *N. gonorrhoeae* <SEQ ID 1579>:

```
g543.seq
   1 atggtttgtc ggttatttgc cgccgttttt ggctttcaac tcggcaatca 51 gcccgtcgat gcctttggct ttgatgattt cgccgaattg gttgcggtac 101 acggtaacca ggctcgtgcc ttcgatggcg acgttgtagg tacggtattt
```

-continued

```
 151 gccgccgctt tggtaggtgg taaagtccat attgacgggc ttctgaccgg
 201 ggatgccgac ttcggcacgg acgacgattt ccttgccgcc cttattgacg
 251 atgggattgt ctttgacgtt gacggtcgcg tttttgaatt tcagcatcgt
 301 gccggaatag gtgcggatca gcagggtttg aaattctttg ccaacgctt
 351 gttttttgcgc gtcggacgcg gtacgccaag ggttgccgac cgccaatgcg
 401 gtcatacgtt ggaaatcgaa atagggaacc gcataggctt cggcttttgg
 451 gcgtgcagaa gccgcgtcgc cgcttttgag gatggtcaaa acctgtgtgg
 501 cgttttggcg gatttgtccc actgcgtcgg ccggggaggc aaatgccatg
 551 ccgatgctca aaataccgat gcccaatgcg ctgatgaagg aggattttt
 601 cacgatgtct ttcctgaaaa tggatgtgta tgtttattct gcggcttttt
 651 ccgcattgcc gccctcagcg ttttctcgg cgaagctggt catgaattta
 701 ccgatcaggt tttccagaac cattgcagaa ctggttacgg agatggtgtc
 751 gccggcagca aggttttccg tatcgccgcc ctgctgcagc ccgatgtact
 801 gttcgcccaa aagtcccgaa gtcaggattt gcgcggaaac gtcactgctg
 851 aactgatact tgccgtccaa atcaaggcgc accctcgcct gataggattt
 901 cgggtcaagc ccgatagcgc cgacgcgccc gaccaatacg cctgcggatt
 951 tgacgggggc attgaccttc aaaccgccga tgtcgccgaa atcggcataa
1001 acggcgtaag ttttgtccga accgccgaac gccgcgccgc ccgccacgcg
1051 gaaagcgaga aaggcaaccg ccgccgcgcc gatcaagacg aacagtccga
1101 cccaaaattc caatatgttc tttttcatta a
```

This corresponds to the amino acid sequence <SEQ ID 1580; ORF 543.ng>:

```
g543.pep
  1 MVCRLFAAVF GFQLGNQPVD AFGFDDFAEL VAVHGNQARA FDGDVVGTVF
 51 AAALVGGKVH IDGLLTGDAD FGTDDDFLAA LIDDGIVFDV DGRVFEFQHR
101 AGIGADQQGL KFFGQRLFLR VGRGTPRVAD RQCGHTLEIE IGNRIGFGFW
151 ACRSRVAAFE DGQNLCGVLA DLSHCVGRGG KCHADAQNTD AQCADEGGFF
201 HDVFPENGCV CLFCGFFRIA ALSVFLGEAG HEFTDQVFQN HCRTGYGDGV
251 AGSKVFRIAA LLQPDVLFAQ KSRSQDLRGN VTAELILAVQ IKAHPRLIGF
301 RVKPDSADAP DQYACGFDGG IDLQTADVAE IGINGVSFVR TAERRAARHA
351 ESEKGNRRRA DQDEQSDPKF QYVLFH*
```

The following partial DNA sequence was identified in *N. meningitidis* <SEQ ID 1581>:

```
m543.seq
   1 ATGGTTTGTC GGTTATTTGC CGCCGTTTTT GGCTTTCAAC TCGGCAATCA
  51 GTCCGTCCAC GCCTTTCGCT TGATAATTT CGCCGAATTG GTTGCGGTAC
 101 ACGGTAACCA GGCTCGCGCC TTCGATGGCG ACGTTGTAGG TACGGTATTT
 151 ACCGCCGCTT TGGTAGGTGG TGAAGTCCAT GTTGACGGGT TTTTGCCCGG
 201 GTACGCCGAC TTCGGCGCGG ACGATGATTT CTTTGCCGCC TTTATTGACG
 251 ATGGGATTGT CTTTGACGTT GACGTTGGCG TTTTTTAATT TCAGCATCGT
```

```
 301 GCCGGAATAG GTGCGGATCA GCAGGGTTTG AAATTCTTTG GCCAACGCTT

351 GTTTTTGCGC GTCGGACGCG GTGCGCCAAG GGTTGCCGAC CGCCAATGCG

401 GTCATACGTT GGAAATCGAA ATAGGGAATC GCATAGGCTT CGGCTTTTTG

451 GCGAGCGGTG TTGGCATCGC CGTTTTTTAA GATGCTCAAT ACTTGAGTGG

501 CGTTTTGACG GATTTGGCTT ACCGCGTCGG CAGGGCGGC AAATGCCATG

551 CCGATGCTCA AAATACCGAT GCCCAATGCG CTGATGAGGG AGGATTTTTT

601 CATGATTAAG TGTCCTAGTT TGAATATGAT GGCATACGTT TATTCGGCGG

651 CTTTTTCCGC ATTGCCGCCG TCGGCATTTT TCTCGGCAAA ACTCGTCATG

701 AATTTGCCGA TAAGGTTTTC CAGAACCATT GCAGAACTGG TTACGGAGAT

751 GGTGTCGCCG GCAGCAAGGT TTTCCGTGTC GCCGCCCTGC TGCAGCCCGA

801 TGTACTGCTC GCCCAAAAGT CCCGAAGTCA GGATTTGCGC GGAAACGTCG

851 CTGCTGAACT GATACTTGCC GTCCAAATCG AGGCGCACCC TCGCCTGATA

901 GGATTTCGGG TCAAGTCCGA TAGCGCCGAC GCGCCCGACC AATACGCCTG

951 CGGATTTGAC GGGGGCATTG ACCTTCAAAC CGCCGATGTC GCCGAAATCG

1001 GCATAAACGG CGTAAGTTTT GTCCGAACCG CCGAACGCCG CACCGCCGGC

1051 CACGCGGAAA GCGAGAAAGG CAACCGCCGC CGCGCCAATC AGGACGAACA

1101 GTCCGACCCA AAATTCCAAT ATGTTCTTCT TCATTAA
```

This corresponds to the amino acid sequence <SEQ ID 1582; ORF 543>:

```
m543.pep
   1 MVCRLFAAVF GFQLGNQSVH AFRFDNFAEL VAVHGNQARA FDGDVVGTVF

51 TAALVGGEVH VDGFLPGYAD FGADDDFFAA FIDDGIVFDV DVGVFXFQHR

101 AGIGADQQGL KFFGQRLFLR VGRGAPRVAD RQCGHTLEIE IGNRIGFGFL

151 ASGVGIAVFX DAQYLSGVLT DLAYRVGRGG KCHADAQNTD AQCADEGGFF

201 HDXVSXFEYD GIRLFGGFFR IAAVGIFLGK TRHEFADKVF QNHCRTGYGD

251 GVAGSKVFRV AALLQPDVLL AQKSRSQDLR GNVAAELILA VQIEAHPRLI

301 GFRVKSDSAD APDQYACGFD GGIDLQTADV AEIGINGVSF VRTAERRTAG

351 HAESEKGNRR RANQDEQSDP KFQYVLLH*
```

Computer analysis of this amino acid sequence gave the following results:
Homology with a Predicted ORF from *N. gonorrhoeae*
ORF 543 shows 84.2% identity over a 379 aa overlap with a predicted ORF (ORF 543.ng) from *N. gonorrhoeae*:

```
    m543/g543
                   10         20         30         40         50         60
    m543.pep   MVCRLFAAVFGFQLGNQSVHAFRFDNFAELVAVHGNQARAFDGDVVGTVFTAALVGGEVH
               ||||||||||||||||| || ||:||||||||||||||||||||||||||:||||||:||
    a543       MVCRLFAAVFGFQLGNQPVDAFGFDDFAELVAVHGNQARAFDGDVVGTVFAAALVGGKVH
                   10         20         30         40         50         60

70         80         90        100        110        120
    m543.pep   VDGFLPGYADFGADDDFFAAFIDDGIVFDVDVGVFXFQHRAGIGADQQGLKFFGQRLFLR
               :||:| |||||:||||:|:|||||||| || ||||||||||||||||||||||||||||
    a543       IDGLLTGDADFGTDDDFLAALIDDGIVFDVDGRVFEFQHRAGIGADQQGLKFFGQRLFLR
                   70         80         90        100        110        120
```

-continued

```
                130       140       150       160       170       180
m543.pep   VGRGAPRVADRQCGHTLEIEIGNRIGFGFLASGVGIAVFXDAQYLSGVLTDLAYRVGRGG
           ||||:|||||||||||||||||||||||| |     :|:| |:| | |||:||:: |||||
a543       VGRGTPRVADRQCGHTLEIEIGNRIGFGFWACRSRVAAFEDGQNLCGVLADLSHCVGRGG
                130       140       150       160       170       180

190       200       210       220       230       239
m543.pep   KCHADAQNTDAQCADEGGFFHDXVSXFEYDG-IRLFGGFFRIAAVGIFLGKTRHEFADKV
           |||||||||||||||||||||      | :| : || ||||||:::|||:: |||:|:|
a543       KCHADAQNTDAQCADEGGFFHDV---FPENGCVCLFCGFFRIAALSVFLGEAGHEFTDQV
                190       200       210       220       230

240       250       260       270       280       290       299
m543.pep     FQNHCRTGYGDGVAGSKVFRVAALLQPDVLLAQKSRSQDLRGNVAAELILAVQIEAHPRL
             ||||||||||||||||||||:|||||||||:|||||||||||||:|||||||||:|||||
a543         FQNHCRTGYGDGVAGSKVFRIAALLQPDVLFAQKSRSQDLRGNVTAELILAVQIKAHPRL
             240       250       260       270       280       290

300       310       320       330       340       350       359
m543.pep     IGFRVKSDSADAPDQYACGFDGGIDLQTADVAEIGINGVSFVRTAERRTAGHAESEKGNR
             |||||| |||||||||||||||||||||||||||||||||||||||||: ||||||||||
a543         IGFRVKPDSADAPDQYACGFDGGIDLQTADVAEIGINGVSFVRTAERRAARHAESEKGNR
             300       310       320       330       340       350

360 370 379
m543.pep     RRANQDEQSDPKFQYVLLHX
             |||:||||||||||||||:||
a543         RRADQDEQSDPKFQYVLFHX
             360       370
```

The following partial DNA sequence was identified in *N. meningitidis* <SEQ ID 1583>:

```
a543.seq
   1  ATGGCTTATG GATTACTTGC TGCCGTTTNT AGCCTTCAAC TCGNCAATCA

51  GTCCGTCCAC GCCTTTCGCT TTGATAATTT CGCCGAATTG GTTGCGGTAC

101  ACGGTAACCA GGCTCGCGCC TTCGATGGCG ACGTTGTAGG TACGGTATTT

151  ACCGCCGCTT TGGTAGGTGG TGAAGTCCAT GTTGACGGGT TTTTGCCCGG

201  NNACGCCGAC TTCGGCGCGG ACGATGATTT CTTTGCCGCC TTTATTGACG

251  ATNGGATTGT CTTTGACGTT GACGTTGGCG TTTTTTAATT TCAGCATCGT

301  GCCGGAATAG GTGCGGATCA GCAGGGTTTG AAATTCTTTG GCCAACGCTT

351  GTTTTTGCGC GTCGGACGCG GTGCGCCAAG GGTTGCCGAC CGCCAATGCG

401  GTCATACGTT GGAAATCGAA ATAGGGAATC GCATAGGCTT CGGCTTTTTG

451  GCGGGCGGTG TTGGCATCAC CGCTTTTTAA GATGCTCAAT ACTTGAGTGG

501  CGTTTTGACG GATTTGGTTT ACCGCGTCGG CAGGGGCGGC AAATGCCATG

551  CCGATGCTCA AAATACCGAT GCCCAATGCG CTGATGAAGG AGGATTTTTT

601  CATGATTAAG TGTCCTAGTT TGAATATGAT GGCATACGTT TATTCGGCGG

651  CTTTTTCCGC ATTGCCGCCG TCGGCATTTT TCTCGGCAAA ACTCGTCATG

701  AATTTGCCGA TAAGGTTTTC CAGAACCATT GCAGAACTGG TTACGGAGAT

751  GGTGTCGCCG GCAGCAAGGT TTTCCGTGTC GCCGCCCTGC TGCAGCCCGA

801  TGTACTGCTC GCCCAAAAGT CCCGAAGTCA GGATTTGCGC GGAAACGTCG

851  CTGCTGAACT GATACTTGCC GTCCAAATCG AGGCGCACCC TCGCCTGATA

901  GGATTTCGGG TCAAGTCCGA TAGCGCCGAC GCGCCCGACC AATACGCCTG

951  CGGATTTGAC GGGGGCATTG ACCTTCAAAC CGCCGATGTC GCCGAAATCG

1001  GCATAAACGG CGTAAGTTTT GTCCGAACCG CCGAACGCCG CACCGCCGGC

1051  CACGCGGAAA GCGAGAAAGG CAACCGCCGC CGCGCCAATC AGGACGAACA

1101  GTCCGACCCA AAATTCCAAT ATGTTCTTTT TCATTAA
```

This corresponds to the amino acid sequence <SEQ ID 1584; ORF 543.a>:

```
a543.pep
   1 MAYGLLAAVX SLQLXNQSVH AFRFDNFAEL VAVHGNQARA FDGDVVGTVF

51 TAALVGGEVH VDGFLPGXAD FGADDDFFAA FIDDXIVFDV DVGVF*FQHR

101 AGIGADQQGL KFFGQRLFLR VGRGAPRVAD RQCGHTLEIE IGNRIGFGFL

151 AGGVGITAF* DAQYLSGVLT DLVYRVGRGG KCHADAQNTD AQCADEGGFF

201 HD*VS*FEYD GIRLFGGFFR IAAVGIFLGK TRHEFADKVF QNHCRTGYGD

251 GVAGSKVFRV AALLQPDVLL AQKSRSQDLR GNVAAELILA VQIEAHPRLI

301 GFRVKSDSAD APDQYACGFD GGIDLQTADV AEIGINGVSF VRTAERRTAG

351 HAESEKGNRR RANQDEQSDP KFQYVLFH*
``` m543/a543 96.0% identity in 378 aa overlap

```
                 10        20        30        40        50        60
m543.pep MVCRLFAAVFGFQLGNQSVHAFRFDNFAELVAVHGNQARAFDGDVVGTVFTAALVGGEVH
         |:  |:|||  ::|| ||||||||||||||||||||||||||||||||||||||||||||
a543     MAYGLLAAVXSLQLXNQSVHAFRFDNFAELVAVHGNQARAFDGDVVGTVFTAALVGGEVH
                 10        20        30        40        50        60
                 70        80        90       100       110       120
m543.pep VDGFLPGYADFGADDDFFAAFIDDGIVFDVDVGVFXFQHRAGIGADQQGLKFFGQRLFLR
         ||||||| |||||||||||||||||| ||||||||||||||||||||||||||||||||
a543     VDGFLPGXADFGADDDFFAAFIDDXIVFDVDVGVFXFQHRAGIGADQQGLKFFGQRLFLR
                 70        80        90       100       110       120
                130       140       150       160       170       180
m543.pep VGRGAPRVADRQCGHTLEIEIGNRIGFGFLASGVGIAVFXDAQYLSGVLTDLAYRVGRGG
         ||||||||||||||||||||||||||||||||:||| ::|||||||||||||||:|||||
a543     VGRGAPRVADRQCGHTLEIEIGNRIGFGFLAGGVGITAFXDAQYLSGVLTDLVYRVGRGG
                130       140       150       160       170       180
                190       200       210       220       230       240
m543.pep KCHADAQNTDAQCADEGGFFHDXVSXFEYDGIRLFGGFFRIAAVGIFLGKTRHEFADKVF
         ||||||||||||||||||||||||||||||||||||||||||||||||||||||||||||
a543     KCHADAQNTDAQCADEGGFFHDXVSXFEYDGIRLFGGFFRIAAVGIFLGKTRHEFADKVF
                190       200       210       220       230       240
                250       260       270       280       290       300
m543.pep QNHCRTGYGDGVAGSKVFRVAALLQPDVLLAQKSRSQDLRGNVAAELILAVQIEAHPRLI
         ||||||||||||||||||||||||||||||||||||||||||||||||||||||||||||
a543     QNHCRTGYGDGVAGSKVFRVAALLQPDVLLAQKSRSQDLRGNVAAELILAVQIEAHPRLI
                250       260       270       280       290       300
                310       320       330       340       350       360
m543.pep GFRVKSDSADAPDQYACGFDGGIDLQTADVAEIGINGVSFVRTAERRTAGHAESEKGNRR
         ||||||||||||||||||||||||||||||||||||||||||||||||||||||||||||
a543     GFRVKSDSADAPDQYACGFDGGIDLQTADVAEIGINGVSFVRTAERRTAGHAESEKGNRR
                310       320       330       340       350       360
                370       379
m543.pep RANQDEQSDPKFQYVLLHX
         |||||||||||||||:||
a543     RANQDEQSDPKFQYVLFHX
                370
```

The following partial DNA sequence was identified in *N. gonorrhoeae* <SEQ ID 1585>:

```
g544.seq
   1 atgaaaaaaa tactcaccgc cgccgccgtc gcactgatcg gcatcctcct 51 cgccaccgtc ctcatccccg acagtaaaac cgcgcccgcc ttctccctgc 101 ccgacctgca cggaaaaacc gtttccaacg ccgacctgca aggcaaagtc 151 accctgatta atttttggtt tccctcctgt ccgggttgtg tgagcgaaat 201 gcccaaagtc accaaaacgg caaacgacta caaaaataaa gatttccaag 251 tcctcgccgt tgcccagccc atcgatccga tagaaagcgt ccgccaatac 301 gtcaaagact acggactgcc gtttaccgtc atttatgatg cggacaaagc
```

-continued

```
351 cgtcggacag gcattcggca cacaggttta tccgacttcc gtccttatcg 401 gcaaaaaagg cgaaatcctc aaaacttatg tcggcgaacc cgatttcggc 451 aaactctacc aagaaatcga taccgcgctg gcgcaatag
```

This corresponds to the amino acid sequence <SEQ ID 1586; ORF 544.ng>:

```
g544.pep
  1 MKKILTAAAV ALIGILLATV LIPDSKTAPA FSLPDLHGKT VSNADLQGKV

51 TLINFWFPSC PGCVSEMPKV TKTANDYKNK DFQVLAVAQP IDPIESVRQY

101 VKDYGLPFTV IYDADKAVGQ AFGTQVYPTS VLIGKKGEIL KTYVGEPDFG

151 KLYQEIDTAL AQ*
```

The following partial DNA sequence was identified in *N. meningitidis* <SEQ ID 1587>:

```
m544.seq
  1 ATGAwAAAAA TACTCACCGC CGCCGTCGTC GCACTGATCG GCATCCTCCT

51 TGCCATCGTC CTCmTCCCCG ACAGCAAAAC CGCGCCCGCC TTCTCCmTGC

101 CCGACCTGCA CGGAAAAACC GTTTCCAACG CCGACCTGCA AGGCAAAGTA

151 ACCCTGATTA ATTTTTGGTT TCCCTCCTGT CCGGGTTGTG TGAGCGAwAT

201 GCCCAAAATC ATTAAAACGG CAAATGACTA TAAAAwCAAA AACTTCCAAG

251 TACTTGCCGT CGCCCAGCCC ATCGATCCGA TAGAAAGCGT CCGCCAATAT

301 GTCAAAGACT ACGGTTTGCC GTTTACCGTC ATGTATGATG CGGACAAAGC

351 TGTCGGACAG GCGTTCGGCA CACAGGTTTA TCCGACTTCC GTCCTTATCG

401 GCAAATAAGG CGAAATCTTC AAAACCTACG TCGGCGAACC CGATTTCGGC

451 AAACTCTACC AAGAAATCGA TACGCGCGTG GCGCAATAG
```

This corresponds to the amino acid sequence <SEQ ID 1588; ORF 544>:

```
m544.pep
  1 MXKILTAAVV ALIGILLAIV LXPDSKTAPA FSXPDLHGKT VSNADLQGKV

51 TLINFWFPSC PGCVSXMPKI IKTANDYKXK NFQVLAVAQP IDPIESVRQY

101 VKDYGLPFTV MYDADKAVGQ AFGTQVYPTS VLIGK*GEIF KTYVGEPDFG

151 KLYQEIDTRV AQ*
```

Computer analysis of this amino acid sequence gave the following results:
Homology with a Predicted ORF from *N. gonorrhoeae*
ORF 544 shows 90.7% identity over a 162 aa overlap with a predicted ORF (ORF 544.ng) from *N. gonorrhoeae*:

```
m544/g544
                  10         20         30         40         50         60
    m544.pep  MXKILTAAVVALIGILLAIVLXPDSKTAPAFSXPDLHGKTVSNADLQGKVTLINFWFPSC
              | ||||||:||||||||| || ||||||||| |||||||||||||||||||||||||||||
    g544      MKKILTAAAVALIGILLATVLIPDSKTAPAFSLPDLHGKTVSNADLQGKVTLINFWFPSC
                  10         20         30         40         50         60
                  70         80         90        100        110        120
    m544.pep  PGCVSXMPKIIKTANDYKXKNFQVLAVAQPIDPIESVRQYVKDYGLPFTVMYDADKAVGQ
              ||||| |||: ||||||||  :||||||||||||||||||||||||||||||:|||||||
    g544      PGCVSEMPKVTKTANDYKNKDFQVLAVAQPIDPIESVRQYVKDYGLPFTVIYDADKAVGQ
                  70         80         90        100        110        120
```

```
               130        140        150        160
m544.pep AFGTQVYPTSVLIGKXGEIFKTYVGEPDFGKLYQEIDTRVAQX
         ||||||||||||||| |||:||||||||||||||||||| :|||
g544     AFGTQVYPTSVLIGKKGEILKTYVGEPDFGKLYQEIDTALAQX
               130        140        150        160
```

The following partial DNA sequence was identified in *N. meningitidis* <SEQ ID 1589>:

```
a544.seq
   1 ATGAAAAAAA TACTCACCGC CGCCGTCGTC GCACTGATCG GCATCCTCCT

51 TGCCATCGTC CTCATCCCCG ACAGCAAAAC CGCGCCCGCT TTCTCCCTGT

101 CCGANCTGCA CGGAAAAANC GTTTNCAACG CCGACCTGCA AGGCNAAGTT

151 ANCCTGATTA ANTTTTGGTT TCCCTCCTGT CCGGGTTGTG TGAGCGAAAT

201 GNCCANAATC ATTAAAACGG CAAATGACTA TAAAAACAAA AACTTCCAAG

251 TCCTTGCCGT CGCCCAGCCC ATCGATCCGA TAGAAAGCGT CCGCCAATAT

301 GTCAAAGACT ACGGTTTGCC GTTTACCGTC ATGTATGATG CGGACAAAGC

351 TGTCGGACAG GCGTTCGGCA CACAGGTTTA TCCGACTTCC GTCCTTATCG

401 GCAAAAAAGG CGAAATCCTC AAAACTTATG TCGGCGAACC CGATTTCGGC

451 AAACTCTACC AAGAAATCGA TACCGCGCTG GCACAATAG
```

This corresponds to the amino acid sequence <SEQ ID 1590; ORF 544.a>:

```
a544.pep
   1 MKKILTAAVV ALIGILLAIV LIPDSKTAPA FSLSXLHGKX VXNADLQGXV

51 XLIXFWFPSC PGCVSEMXXI IKTANDYKNK NFQVLAVAQP IDPIESVRQY

101 VKDYGLPFTV MYDADKAVGQ AFGTQVYPTS VLIGKKGEIL KTYVGEPDFG

151 KLYQEIDTAL AQ*
``` m544/a544 88.9% identity in 162 aa overlap

```
                 10         20         30         40         50         60
m544.pep MXKILTAAVVALIGILLAIVLXPDSKTAPAFSXPDLHGKTVSNADLQGKVTLINFWFPSC
         | ||||||||||||||||||| |||||||||  ||||:| |||||| ||||: ||||||||
a544     MKKILTAAVVALIGILLAIVLIPDSKTAPAFSLSXLHGKXVXNADLQGXVXLIXFWFPSC
                 10         20         30         40         50         60
                 70         80         90        100        110        120
m544.pep PGCVSXMPKIIKTANDYKXKNFQVLAVAQPIDPIESVRQYVKDYGLPFTVMYDADKAVGQ
         ||||| | |||||||||| ||||||||||||||||||||||||||||||||||||||||
a544     PGCVSEMXXIIKTANDYKNKNFQVLAVAQPIDPIESVRQYVKDYGLPFTVMYDADKAVGQ
                 70         80         90        100        110        120
                130        140        150        160
m544.pep AFGTQVYPTSVLIGKXGEIFKTYVGEPDFGKLYQEIDTRVAQX
         ||||||||||||||| |||:|||||||||||||||||| :|||
a544     AFGTQVYPTSVLIGKKGEILKTYVGEPDFGKLYQEIDTALAQX
                130        140        150        160
```

The following partial DNA sequence was identified in *N. gonorrhoeae* <SEQ ID 1591>:

```
g547.seq
   1 atgttcgtag ataacggatt taataaaacg gtagcgagtt ttgcccaaat 51 cgtcgaaact ttcgacgtat tctttcttag gaacgattgc gccttttta 101 cgcagatgaa acagcggtgc ggttgggtct gctcgttggt atatctcgtt
```

```
151 gatatattta caagatgcgg cttcgagatt ccgaaccgct cctttaaaga 201 gcttgggctt ttgatacaga taagtctgtc ggaacgtttt aggactaatg 251 ccgaagtcga gatggatgcc cattacttcc ccttactcag aaaatattta 301 aaatttataa tgttacatat agttacaaat attagagttt tttgtgtgtg 351 cgtcaaggaa ttgttgacaa ttttagttaa aaatttgtct ccaaacggaa 401 aaaagcggtt tgtttttgt tgttaa
```

This corresponds to the amino acid sequence <SEQ ID 1592; ORF 547.ng>:

```
g547.pep
  1 MFVDNGFNKT VASFAQIVET FDVFFFRNDC AFFTQMKQRC GWVCSLVYLV

51 DIFTRCGFEI PNRSFKELGL LIQISLSERF RTNAEVEMDA HYFPLLRKYL

101 KFIMLHIVTN IRVFCVCVKE LLTILVKNLS PNGKKRFVFC C*
```

The following partial DNA sequence was identified in *N. meningitidis* <SEQ ID 1593>:

```
m547.seq.
  1 ATGTTCGTAG ATAACGGATT TAATAAAACG GTAGCGAGTT TTGCCCAAAT

51 CGTCGAAACT TTCGACGTAT TCTTCTTTAG GAACGATTGC GCCTTTTTTA

101 CGCAGATGAA ACAGCGGTGC GGTTGGGTCT GCTCGTTGGT ATATCTCGTT

151 GATATCTTTC CAAGATGCGG ATTCGAGATT CCGAACCGCT CCTTTAAAGA

201 GCTTGGGCTT TTGATACAGA TAAGTCTGTC GGAACGTTTT AGGACTAATG

251 CCGAAGTCGA GATGGATGCT CATTACTTCC CCTTACTCAG AAAATATTTA

301 AAATTTATAA TGTTACATAT ATTTACAAAT ATTAAAGTTT TTTwTTGTGT

351 GTGCGTCAAG GAATTGTTGA CAATTTTAGT TAAAAATTTG TCTCCAAACG

401 GAAAAAAGCG GTTTGTTTTT TGTTGTTAA
```

This corresponds to the amino acid sequence <SEQ ID 1594; ORF 547>:

```
m547.pep
  1 MFVDNGFNKT VASFAQIVET FDVFFFRNDC AFFTQMKQRC GWVCSLVYLV

51 DIFPRCGFEI PNRSFKELGL LIQISLSERF RTNAEVEMDA HYFPLLRKYL

101 KFIMLHIFTN IKVFXCVCVK ELLTILVKNL SPNGKKRFVF CC*
```
50

Computer analysis of this amino acid sequence gave the following results:
Homology with a Predicted ORF from *N. gonorrhoeae*
ORF 547 shows 97.2% identity over a 142 aa overlap with a predicted ORF (ORF 547.ng) from *N. gonorrhoeae*:

```
m547/g547
                    10         20         30         40         50         60
     m547.pep   MFVDNGFNKTVASFAQIVETFDVFFFRNDCAFFTQMKQRCGWVCSLVYLVDIFPRCGFEI
                ||||||||||||||||||||||||||||||||||||||||||||||||||| ||||||
        g547   MFVDNGFNKTVASFAQIVETFDVFFFRNDCAFFTQMKQRCGWVCSLVYLVDIFTRCGFEI
                    10         20         30         40         50         60
```

-continued

```
                   70        80        90       100       110       120
m547.pep   PNRSFKELGLLIQISLSERFRTNAEVEMDAHYFPLLRKYLKFIMLHIFTNIKVFXCVCVK
           |||||||||||||||||||||||||||||||||||||||||||||||| |||:|| |||||
g547       PNRSFKELGLLIQISLSERFRTNAEVEMDAHYFPLLRKYLKFIMLHIVTNIRVF-CVCVK
                   70        80        90       100       110

130       140
m547.pep   ELLTILVKNLSPNGKKRFVFCCX
           |||||||||||||||||||||||
g547       ELLTILVKNLSPNGKKRFVFCCX
         120       130       140
```

The following partial DNA sequence was identified in *N. meningitidis* <SEQ ID 1595>:

```
a547.seq
   1 ATGTTCGTAG ATAACGGATT TAATAAAACG GTAGCGAGTT TTGCCCAAAT

51 CGTCGAAACT TTCGACGTAT TCTTCTTTAG GAACAATTGC ACCTTTTTTA

101 CGCAGATGAA ACAGCGGTGC GGTTGGGTCT GCTCGTTGGT ATATCTCGTT

151 GATATCTTTC CAAGATGCGG CTTCGAGATT CCGAACCGCT CCTTTAAAGA

201 GCTTGGGCTT TTGATACAGA TAAGTCTGTC GGAACGTTTT AGGACTAATG

251 CCGAAGTCGA GATAGATGCT CATTACTTCC CCTTACTCAG AAAATATTTA

301 AAATTTATAA TGTTACATAT ATTTACAAAT ATTAAAGTTT TTTT.TGTGT

351 GTGCGTCAAG GAATTGTTGA CAATTTTAGT T
```

This corresponds to the amino acid sequence <SEQ ID 1596; ORF 547.a>:

```
a547.pep
   1 MFVDNGFNKT VASFAQIVET FDVFFFRNNC TFFTQMKQRC GWVCSLVYLV

51 DIFPRCGFEI PNRSFKELGL LIQISLSERF RTNAEVEIDA HYFPLLRKYL

101 KFIMLHIFTN IKVFXCVCVK ELLTILV
``` m547/a547 97.6% identity in 127 aa overlap

```
                 10        20        30        40        50        60
m547.pep MFVDNGFNKTVASFAQIVETFDVFFFRNDCAFFTQMKQRCGWVCSLVYLVDIFPRCGFEI
         ||||||||||||||||||||||||||||:|:|||||||||||||||||||||||||||||
a547     MFVDNGFNKTVASFAQIVETFDVFFFRNNCTFFTQMKQRCGWVCSLVYLVDIFPRCGFEI
                 10        20        30        40        50        60

70        80        90       100       110       120
m547.pep PNRSFKELGLLIQISLSERFRTNAEVEMDAHYFPLLRKYLKFIMLHIFTNIKVFXCVCVK
         ||||||||||||||||||||||||||:|||||||||||||||||||||||||||||||||
a547     PNRSFKELGLLIQISLSERFRTNAEVEIDAHYFPLLRKYLKFIMLHIFTNIKVFXCVCVK
                 70        80        90       100       110       120

130       140
m547.pep ELLTILVKNLSPNGKKRFVFCCX
         |||||||
a547     ELLTILV
```

The following partial DNA sequence was identified in *N. gonorrhoeae* <SEQ ID 1597>:

```
g548.seq
   1 atgttttccg taccgcgttc ctttttgccg ggcgttttcg tacttgccgc 51 gcttgccgcc tgcaaacctc aagacaacag tgcggcgcaa gccgcttctt 101 caagtgcatc cgcgccggct gcggaaaatg cggcaaagcc gcaaacgcgc 151 ggtacggata tgcgtaagga agacatcggc ggcgatttca cactgaccga
```

-continued

```
201 cggcgaaggc aagcctttca gcctgagcga tttgaaaggc aaggtcgtga 251 ttctgtctttt cggctttacg cactgtcccg atgtctgccc gacagggctt 301 ttgacgtaca gcgacacttt gaagcagttg ggcgggcagg ctaaggacgt 351 gaaagtggtg ttcgtcagca tcgatccgga acgcgacacg cctgaaatca 401 tcggcaagta tgccaaacag ttcaatccgg actttatcgg tctgacggca 451 acgggcggcc aaaacctgcc ggtcatcaag cagcaatacc gcgtggtttc 501 tgccaaaatc aatcaaaaag acgacagcga aaactatttg gtcgaccact 551 cttccggtgc gtatcttatc gataaaaacg gtgaggttgc cattttctcg 601 ccttacggaa gcgagccgga aacgattgct gccgatgtaa ggaccctgct 651 ctga
```

This corresponds to the amino acid sequence <SEQ ID 1598; ORF 548.ng>:

```
g548.pep
  1 MFSVPRSFLP GVFVLAALAA CKPQDNSAAQ AASSSASAPA AENAAKPQTR

51 GTDMRKEDIG GDFTLTDGEG KPFSLSDLKG KVVILSFGFT HCPDVCPTGL

101 LTYSDTLKQL GGQAKDVKVV FVSIDPERDT PEIIGKYAKQ FNPDFIGLTA

151 TGGQNLPVIK QQYRVVSAKI NQKDDSENYL VDHSSGAYLI DKNGEVAIFS

201 PYGSEPETIA ADVRTLL*
```

The following partial DNA sequence was identified in *N. meningitidis* <SEQ ID 1599>:

```
m548.seq
  1 ATGTTTTCCG TACCGCGTTC CTTTTTGCCG GGCGTTTTCG TACTTGCCGC

51 GCTTGCCGCC TGCAAACCTC AAGACAACAG TGCGGCGCAA GTCGCTTCTT

101 CAAGTGCATC CGCGTCGGCT GCGGAAAATG CGGCAAAGCA AnACACGCGC

151 GGTACGGATA TGCGTAAGGA AGACATCGGC GGCGATTTCA CGCTGACCGA

201 CGGCGAAGGC AAGCCTTTCA ACCTGAGCGA TTTGAAAGGC AAGGTCGTGA

251 TTCTGTCTTT CGGCTTTACG CACTGTCCCG ATGTCTGCCC GACAGAGCTT

301 TTGACGTACA GCGACACGTT GAAGCAGTTG GGCGGGCAGG CTAAGGACGT

351 GAAAGTGGTG TTCGTCAGCA TCGATCCGGA ACGCGACACG CCTGAAATCA

401 TCGGCAAGTA TGCCAAACAG TTCAATCCGG ACTTTATCGs TCTGACGGCA

451 ACGGGCGGCC AAAACCTGCC GGTCATCAAG CAGCAATACc GCGTGGTTTC

501 TGCCAAAGTC AATCAAAmG ACGACAGCGA AAACTATTTG GTCGACCACT

551 CTTCCGGTGC GTATCTCATC GACAAAAACG GTGAGGTTGC CATTTTCTCG

601 CCTTACGGAA GCGAGCCGGA AACGATTGCT GCCGATGTAA GGACCCTGCT

651 CTGA
```

This corresponds to the amino acid sequence <SEQ ID 1600; ORF 548>.

```
m548.pep
  1 MFSVPRSFLP GVFVLAALAA CKPQDNSAAQ VASSSASASA AENAAKQXTR

51 GTDMRKEDIG GDFTLTDGEG KPFNLSDLKG KVVILSFGFT HCPDVCPTEL
```

```
101 LTYSDTLKQL GGQAKDVKVV FVSIDPERDT PEIIGKYAKQ FNPDFIXLTA

151 TGGQNLPVIK QQYRVVSAKV NQXDDSENYL VDHSSGAYLI DKNGEVAIFS

201 PYGSEPETIA ADVRTLL*
```

Computer analysis of this amino acid sequence gave the following results:
Homology with a Predicted ORF from *N. gonorrhoeae*
ORF 548 shows 95.9% identity over a 217 aa overlap with a predicted ORF (ORF 548.ng) from *N. gonorrhoeae*:

```
   m548/g548

10          20          30          40          50          60
      m548.pep  MFSVPRSFLPGVFVLAALAACKPQDNSAAQVASSSASASAAENAAKQXTRGTDMRKEDIG
                ||||||||||||||||||||||||||||||:||||||| |||||| ||||||||||||||
         g548  MFSVPRSFLPGVFVLAALAACKPQDNSAAQAASSSASAPAAENAAKPQTRGTDMRKEDIG
                    10          20          30          40          50          60

70          80          90         100         110         120
      m548.pep  GDFTLTDGEGKPFNLSDLKGKVVILSFGFTHCPDVCPTELLTYSDTLKQLGGQAKDVKVV
                ||||||||||||||:|||||||||||||||||||||||||||||||||||||||||||||
         g548  GDFTLTDGEGKPFSLSDLKGKVVILSFGFTHCPDVCPTGLLTYSDTLKQLGGQAKDVKVV
                    70          80          90         100         110         120

130         140         150         160         170         180
      m548.pep  FVSIDPERDTPEIIGKYAKQFNPDFIXLTATGGQNLPVIKQQYRVVSAKVNQXDDSENYL
                ||||||||||||||||||||||||||||:|||||||||||||||||||||:|||||||||
         g548  FVSIDPERDTPEIIGKYAKQFNPDFIGLTATGGQNLPVIKQQYRVVSAKINQKDDSENYL
                   130         140         150         160         170         180

190         200         210
      m548.pep  VDHSSGAYLIDKNGEVAIFSPYGSEPETIAADVRTLLX
                |||||||||||||||||||||||||||||||||||||
         g548  VDHSSGAYLIDKNGEVAIFSPYGSEPETIAADVRTLLX
                   190         200         210
```

The following partial DNA sequence was identified in *N. meningitidis* <SEQ ID 1601>:

```
a548.seq
    1 ATGTTTTCCG TACCGCGTTC CTTTTTGCCG GGCGTTTTCG TACTTGCCGC

51 GCTTGCCGCC TGCAAACCTC AAGACAACAG TGCGGCGCAA GTCGCTTCTT

101 CAAGTGCATC CGCGTCGGCT GCGGAAAATG CGGCAAAGCC GCAAACGCGC

151 GGTACGGATA TGCGTAAGGA AGACATCGGC GGCGATTTCA CGCTGACCGA

201 CGGCGAAGGC AAGCCTTTCA ACCTGAGCGA TTTGAAAGGC AAGGTCGTGA

251 TTCTGTCTTT CGGCTTTACG CACTGTCCCG ATGTCTGCCC GACAGAGCTT

301 TTGACGTACA GCGACACGTT GAAGCAGTTG GGCGGGCAGG CTAAGGACGT

351 GAAAGTGGTG TTCGTCAGCA TCGATCCGGA ACGCGACACG CCTGAAATCA

401 TCGGCAAGTA TGCCAAACAG TTCAATCCGG ACTTTATCGG TCTGACGGCA

451 ACGGGCGACC AAAACCTGCC GGTCATCAAG CAGCAATACC GCGTGGTTTC

501 TGCCAAAGTC AATCAAAAAG ACGACAGCGA AAACTATTTG GTCGACCACT

551 CTTCCGGTGC GTATCTCATC GACAAAAACG GTGAGGTTGC CATTTTCTCG

601 CCTTACGGAA GCGAGCCGGA AACGATTGCT GCCGATGTAA GGACCCTGCT

651 CTGA
```

This corresponds to the amino acid sequence <SEQ ID 1602; ORF 548.a>:

```
a548.pep
   1 MFSVPRSFLP GVFVLAALAA CKPQDNSAAQ VASSSASASA AENAAKPQTR

51 GTDMRKEDIG GDFTLTDGEG KPFNLSDLKG KVVILSFGFT HCPDVCPTEL

101 LTYSDTLKQL GGQAKDVKVV FVSIDPERDT PEIIGKYAKQ FNPDFIGLTA

151 TGDQNLPVIK QQYRVVSAKV NQKDDSENYL VDHSSGAYLI DKNGEVAIFS

201 PYGSEPETIA ADVRTLL*
``` m548/a548 97.7% identity in 217 aa overlap

```
                  10        20        30        40        50        60
    m548.pep MFSVPRSFLPGVFVLAALAACKPQDNSAAQVASSSASASAAENAAKQXTRGTDMRKEDIG
            ||||||||||||||||||||||||||||||||||||||||||||| ||||||||||||||
    a548    MFSVPRSFLPGVFVLAALAACKPQDNSAAQVASSSASASAAENAAKPQTRGTDMRKEDIG
                  10        20        30        40        50        60
                  70        80        90       100       110       120
    m548.pep GDFTLTDGEGKPFNLSDLKGKVVILSFGFTHCPDVCPTELLTYSDTLKQLGGQAKDVKVV
            ||||||||||||||||||||||||||||||||||||||||||||||||||||||||||||
    a548    GDFTLTDGEGKPFNLSDLKGKVVILSFGFTHCPDVCPTELLTYSDTLKQLGGQAKDVKVV
                  70        80        90       100       110       120
                 130       140       150       160       170       180
    m548.pep FVSIDPERDTPEIIGKYAKQFNPDFIXLTATGGQNLPVIKQQYRVVSAKVNQKDDSENYL
            |||||||||||||||||||||||||||||| ||||| |||||||||||||||||||||||
    a548    FVSIDPERDTPEIIGKYAKQFNPDFIGLTATGDQNLPVIKQQYRVVSAKVNQKDDSENYL
                 130       140       150       160       170       180
                 190       200       210
    m548.pep VDHSSGAYLIDKNGEVAIFSPYGSEPETIAADVRTLLX
            ||||||||||||||||||||||||||||||||||||||
    a548    VDHSSGAYLIDKNGEVAIFSPYGSEPETIAADVRTLLX
                 190       200       210
```

The following partial DNA sequence was identified in *N. gonorrhoeae* <SEQ ID 1603>:

```
g550.seq
   1 atgataacgg acaggtttca tctctttcat tttccagtat ctttcattta 51 tcaatctgac aacaaaatgc cgcctgaaaa cagttcagac ggcattttaa 101 ccacaaacgg cttacagctt ccattcgccc aacttggcag cgtaagcttc 151 caaatctgca atcggacggg ttgccacgcc gctttccatc gctgctttgg 201 cggcagccgt agcgacgcga ggcagcaggc gggaatcgaa cggagtagga 251 atcaggtatt ccgcgccgaa ttcgaatttc ttaccgtaag cggcaaccac 301 ttcttcggtt acttcttcca tcgccaaatc tgccaaagca tacacgcagg 351 cgcgtttcat ttcttcgttg atggtggttg cgccgacatc caacgcgccc 401 cggaagatga acgggaagca caatacgttg tcacttggt tcgggaagtc 451 ggagcggccg gtaccgataa ccacgtccgg acgggtttct ttcgccagcg 501 gcggcaggat ttccggattc gggttggcca tggcgaacac gatgggtttt 551 tcgttcatcg tgttcaacat ttcaggcgtc agcaggtttg cgccggagag 601 gcccaagaag atgtctttgc cttttaaccgc atcggcaagt acgcgccggc 651 cgttgtcttc aacggcgtag aatttttttgg attcgtccat gcggtctttg 701 tcttcgcggg tttggtaaat cacgcctttg gagttgcaaa cggttacgtt 751 ttcacgtttc aagcccaaat ccagcagttg gttcaggcag gcaatcgcgg 801 cggcacctgc gccggagcac accaaagtcg cttcttcgat tttacggccg
```

```
-continued
851 gtataacgca gggcgttcaa tacggcggcg gcggtaatga tggccgtgcc 901 gtgctggtca tcatgaaata cggggatttt gcagcgtttg cgtaa
```

This corresponds to the amino acid sequence <SEQ ID 1604; ORF 550.ng>:

```
g550.pep
   1 MITDRFHLFH FPVSFIYQSD NKMPPENSSD GILTTNGLQL PFAQLGSVSF

51 QICNRTGCHA AFHRCFGGSR SDARQQAGIE RSRNQVFRAE FEFLTVSGNH

101 FFGYFFHRQI CQSIHAGAFH FFVDGGCADI QRAPEDEREA QYVVHLVREV

151 GAAGTDNHVR TGFFRQRRQD FRIRVGHGEH DGFFVHRVQH FRRQQVCAGE

201 AQEDVFAFNR IGKYAPAVVF NGVEFFGFVH AVFVFAGLVN HAFGVANGYV

251 FTFQAQIQQL VQAGNRGGTC AGAHQSRFFD FTAGITQGVQ YGGGGNDGRA

301 VLVIMKYGDF AAFA*
```

The following partial DNA sequence was identified in *N. meningitidis* <SEQ ID 1605>:

```
m550.seq (partial)
   1 ..GACGGCATCG GCAAGCACGC GCTGGCCGTT GTCTTCAATG GCGTAGAACT

51    GTTTGGACTC GTCCATACGG TCTTTGTCTT CGCGGGTTTG GTAAATCACG

101    CCTTTGGAGT CGCAAACGGT CACGTTTTCG CGTTTCAAGC CCAAATCCAG

151    CAATTGGwTC AAGCAGGCAA TCGCGGCCGC ACCTGCGCCG GAACACACCA

201    AAGTCGCTTC TTCGATTTTA CGGCCGGTAA AACGCAkGGC GTTCAATACG

251    GCGGCGGCGG TAATGATGGC CGTGCCGTGC TGGTCGTCGT GGAATACGGG

301    GATTTTGCAG CGTTTGCGTA A
```

This corresponds to the amino acid sequence <SEQ ID 1606; ORF 550>:

```
m550.pep (partial)
   1 ..DGIGKHALAV VFNGVELFGL VHTVFVFAGL VNHAFGVANG HVFAFQAQIQ

51    QLXQAGNRGR TCAGTHQSRF FDFTAGKTXG VQYGGGGNDG RAVLVVVEYG

101    DFAAFA*
```

Computer analysis of this amino acid sequence gave the following results:
Homology with a Predicted ORF from *N. gonorrhoeae*
ORF 550 shows % identity over a aa overlap with a predicted ORF (ORF 550.ng) from *N. gonorrhoeae*:

```
    m550/g550
                                             10         20         30
        m550.pep                   DGIGKHALAVVFNGVELFGLVHTVFVFAGLVN
                                   |||:| |||||||||:||:||:|||||||||
           g550    DGFFVHRVQHFRRQQVCCAGEAQEDVFAFNRIGKYAPAVVFNGVEFFGFVHAVFVFAGLVN
                           190        200        210        220        230        240

40         50         60         70         80         90
        m550.pep HAFGVANGHVFAFQAQIQQLXQAGNRGRTCAGTHQSRFFDFTAGKTXGVQYGGGGNDGRA
                 ||||||||:||:||||||| |||||| ||||:|||||||||| | |||||||||||||||
           g550  HAFGVANGYVFTFQAQIQQLVQAGNRGGTCAGAHQSRFFDFTAGITQGVQYGGGGNDGRA
                        250        260        270        280        290        300
```

```
               100
m550.pep  VLVVVEYGDFAAFAX
          |||::|||||||||
g550      VLVIMKYGDFAAFAX
               310
```

The following partial DNA sequence was identified in *N. meningitidis* <SEQ ID 1607>:

```
a550.seq
   1    CTATATCAAT CTGACAGCAA AATGCCGCCT GAAAACAGTT CAGACGGCAT

51    TTTAACCGCA AACGGCTTAC AGCTTCCATT CGCTCAGCTT GGCAGCGTAA

101    GCTTCCAAAT CTGCAATCGG ACGGGTTGCC ACGCCGCTTT CCATCGCTGC

151    TTTGGCGGCA GCCGTAGCAA CGCGCGGCAG CAGGCGGGAA TCGAACGGAG

201    TCGGAATCAG GTATTCCGCG CCGAATTCAA ATTTCTTACC GTAAGCGGCA

251    ACCACTTCTT CGGTTACCTC TTCCATCGCC AAATCCGCCA AAGCATACAC

301    GCAGGCGCGT TTCATTTCTT CGTTGATGGT CGTCGCGCCG ACATCCAACG

351    CACCGCGGAA GATGAACGGG AAGCACAATA CATTGTTCAC TTGGTTCGGG

401    AAGTCGGAGC GGCCGGTACC GATAACCACG TCCGGACGGG TTTCTTTCGC

451    CAGCGGCGGC AGGATTTCCG GATTCGGGTT GGCCATAGCG AACACGATGG

501    GTTTTTCGTT CATGGTGTTC AGTATTTCAG GCGTCAGCAG GTTCGCGCCG

551    GAGAGGCCCA AGAAGATGTC TTTGCCTTTG ACGGCATCGG CAAGCACGCG

601    CTGGCCGTTG TCTTCAATGG CGTAGAACTG TTTGGACTCG TCCATACGGT

651    CTTTGTCTTC GCGGGTTTGG TAAATCACGC CTTTGGAGTC GCAAACGGTC

701    ACGTTTTCGC GTTTCAAGCC CAAATCCAGC AATTGGTTCA AGCAGGCAAT

751    CGCGGCCGCA CCTGCGCCGG AACACACCAA GTCGCTTCT TCGATTTTAC

801    GGCCGGTAAA ACGCAGGGCG TTCAATACGG CAGCGGCGGT AATGATGGCC

851    GTGCCGTGCT GGTCGTCGTG GAATACGGGG ATTTTGCAGC GTTTGCGTAA
```

This corresponds to the amino acid sequence <SEQ ID 1608; ORF 550.a>:

```
a550.pep
   1  LYQSDSKMPP ENSSDGILTA NGLQLPFAQL GSVSFQICNR TGCHAAFHRC

51  FGGSRSNARQ QAGIERSRNQ VFRAEFKFLT VSGNHFFGYL FHRQIRQSIH

101  AGAFHFFVDG RRADIQRTAE DEREAQYIVH LVREVGAAGT DNHVRTGFFR

151  QRRQDFRIRV GHSEHDGFFV HGVQYFRRQQ VRAGEAQEDV FAFDGIGKHA

201  LAVVFNGVEL FGLVHTVFVF AGLVNHAFGV ANGHVFAFQA QIQQLVQAGN

251  RGRTCAGTHQ SRFFDFTAGK TQGVQYGSGG NDGRAVLVVV EYGDFAAFA*
``` m550/a550 97.2% identity in 106 aa overlap

```
                            10         20         30
m550.pep                    DGIGKHALAVVFNGVELFGLVHTVFVFAGL
                            ||||||||||||||||||||||||||||||
a550      EHDGFFVHGVQYFRRQQVRAGEAQEDVFAFDGIGKHALAVVFNGVELFGLVHTVFVFAGL
                  170       180       190       200       210       220
```

```
                 40         50         60         70         80         90
m550.pep VNHAFGVANGHVFAFQAQIQQLXQAGNRGRTCAGTHQSRFFDFTAGKTXGVQYGGGNDG
         |||||||||||||||||||||| |||||||||||||||||||||||||||| :||||
a550     VNHAFGVANGHVFAFQAQIQQLVQAGNRGRTCAGTHQSRFFDFTAGKTQGVQYGSGGNDG
                230        240        250        260        270        280

100
m550.pep RAVLVVVEYGDFAAFAX
         |||||||||||||||||
a550     RAVLVVVEYGDFAAFAX
                290        300
```

The following partial DNA sequence was identified in *N. gonorrhoeae* <SEQ ID 1609>:

```
g552.seq
   1 atgaagctga aaaccttgtt attgcccttc gccgcactgg cattgtgtgc 51 caacgcattt gccgcccgc cggcgacgc gtcgttggca cgttggctgg 101 atacgcagaa tttcgaccgg gatatagaaa aaaatatgat tgaaggcttt 151 aatgccggat ttaaaccgta tgcggacaaa gcccttgccg aaatgccgga 201 agcgaaaaaa gatcaggcgg cagaagcctt taatcgttat cgtgagaatg 251 ttttgaaaga tttgattacg cccgaagtga acaggctgt ccgcaatacc 301 ttattgaaga atgcccgtga aatatacacg caagaagaaa ttgacggcat 351 gattgccttt tacggttcgc ctgtcggtca gtccgtcgtt gccaaaaatc 401 cgcgcttaat caagaaatcg atgagtgaaa tagcggtatc ttggactgca 451 ttgtcaggga aaatcgcgcg acatcatctg cccgagttta cggaagagtt 501 acggcgcatc atctgcggcg gtatagtgga ttaa
```

This corresponds to the amino acid sequence <SEQ ID 1610; ORF552.ng>:

```
g552.pep
   1 MKLKTLLLPF AALALCANAF AAPPGDASLA RWLDTQNFDR DIEKNMIEGF

51 NAGFKPYADK ALAEMPEAKK DQAAEAFNRY RENVLKDLIT PEVKQAVRNT

101 LLKNAREIYT QEEIDGMIAF YGSPVGQSVV AKNPRLIKKS MSEIAVSWTA

151 LSGKIARHHL PEFTEELRRI ICGGIVD*
```

The following partial DNA sequence was identified in *N. meningitidis* <SEQ ID 1611>:

```
m552.seq (partial)
   1 ..ATTAAACTGA AAACCTTGTT ATTGCCCTTC GCCACGCTGG CATTGTGCAC

51    CAATGCTTTT GCCGCCCCGC CCAGCGACGC GTCGTTGGCG CGTTGGCTGG

101    ATACGCAGAA TTTTGACCGG GATATAGAAA AAAATATGAT TGAGGGCTTT

151    AATGCCGGAT TTAAACCGTA TGCGGACAAA GCCCTTGCCG AAATGCCGGA

201    AGCGAAAAAA GATCAGGCGG CAGAAGCCTT TAACCGTTAT CGTGAGAATG

251    TTTTGAAAGA TTTGATTACG CCCGAAGTGA ACAGGCTGT CCGCAATACT

301    TTATTGAAGA ATGCCCGTGA GATATACACG CAAGAAGAAA TTGACGGCAT

351    GATTGCCTTT TACGGTTCGC CTGTCGGTCA GTCCGTCGTT GCCAAAAATC

401    CGCGCTTAAT CAAGAAATCG ATGAGTGAAA TAGCGGTATC TTGGACTGCA

451    TTGTCAGGGA AAATCGCGCA ACATCATCTG CCCGAGTTTA CGGAAGAGTT
```

```
-continued
501   GCGGCGCATC ATCTGCGGCG GTAAAAATCC CGATGCGGGC TGTAAACAAG

551   CCGGACAGGT TGGGAAAAGG CATCAGAAAT AA
```

This corresponds to the amino acid sequence <SEQ ID 1612; ORF 552>:

```
m552.pep (partial)
  1 ..IKLKTLLLPF ATLALCTNAF AAPPSDASLA RWLDTQNFDR DIEKNMIEGF

51   NAGFKPYADK ALAEMPEAKK DQAAEAFNRY RENVLKDLIT PEVKQAVRNT

101   LLKNAREIYT QEEIDGMIAF YGSPVGQSVV AKNPRLIKKS MSEIAVSWTA

151   LSGKIAQHHL PEFTEELRRI ICGGKNPDAG CKQAGQVGKR HQK*
```

Computer analysis of this amino acid sequence gave the following results:
Homology with a Predicted ORF from *N. gonorrhoeae*
ORF 552 shows 97.1% identity over a 174 aa overlap with a predicted ORF (ORF 552.ng) from *N. gonorrhoeae*:

```
    m552/g552
                      10         20         30         40         50         60
    m552.pep   IKLKTLLLPFATLALCTNAFAAPPSDASLARWLDTQNFDRDIEKNMIEGFNAGFKPYADK
               :||||||||||:||||:||||||:||||||||||||||||||||||||||||||||||||
    g552       MKLKTLLLPFAALALCANAFAAPPGDASLARWLDTQNFDRDIEKNMIEGFNAGFKPYADK
                      10         20         30         40         50         60

70         80         90        100        110        120
    m552.pep   ALAEMPEAKKDQAAEAFNRYRENVLKDLITPEVKQAVRNTLLKNAREIYTQEEIDGMIAF
               ||||||||||||||||||||||||||||||||||||||||||||||||||||||||||||
    g552       ALAEMPEAKKDQAAEAFNRYRENVLKDLITPEVKQAVRNTLLKNAREIYTQEEIDGMIAF
                      70         80         90        100        110        120

130        140        150        160        170        180
    m552.pep   YGSPVGQSVVAKNPRLIKKSMSEIAVSWTALSGKIAQHHLPEFTEELRRIICGGKNPDAG
               |||||||||||||||||||||||||||||||||||:||||||||||||||||||:|||||
    g552       YGSPVGQSVVAKNPRLIKKSMSEIAVSWTALSGKIARHHLPEFTEELRRIICGGIVDX
                     130        140        150        160        170

190
    m552.pep   CKQAGQVGKRHQKX
```

The following partial DNA sequence was identified in *N. meningitidis* <SEQ ID 1613>:

```
a552.seq
  1 ATTAAACTGA AAACCTTGTT ATTGCCCTTC GCCACGCTGG CATTGTGCAC

51 CAATGCTTTT GCCGCCCCGC CCAGCGACGC GTCGTTGGCG CGTTGGCTGG

101 ATACGCAGAA TTTTGACCGG GATATAGAAA AAAATATGAT TGAGGGCTTT

151 AATGCCGGAT TTAAACCGTA TGCGGACAAA GCCCTTGCCG AAATGCCGGA

201 AGCGAAAAAA GATCAGGCGG CAGAAGCCTT TAACCGTTAT CGTGAGAATG

251 TTTTGAAAGA TTTGATTACG CCCGAAGTGA AACAGGCTGT CCGCAATACT

301 TTATTGAAGA ATGCCCGTGA GATATACACG CAAGAAGAAA TTGACGGCAT

351 GATTGCCTTT TACGGTTCGC CTGTCGGTCA GTCCGTCGTT GCCAAAAATC

401 CGCGCTTAAT CAAGAAATCG ATGAGTGAAA TAGCGGTATC TTGGACTGCA

451 TTGTCAGGGA AAATCGCGCA ACATCATCTG CCCGAGTTTA CGGAAGAGTT

501 GCGGCGCATC ATCTGCGGCG GTAAAAATCC CGATGCGGGC TGTAAACAAG

551 CCGGACAGGT TGGGAAAAGG CATCAGAAAT AA
```

This corresponds to the amino acid sequence <SEQ ID 1614; ORF 552.a>:

```
a552.pep
  1 IKLKTLLLPF ATLALCTNAF AAPPSDASLA RWLDTQNFDR DIEKNMIEGF

51 NAGFKPYADK ALAEMPEAKK DQAAEAFNRY RENVLKDLIT PEVKQAVRNT

101 LLKNAREIYT QEEIDGMIAF YGSPVGQSVV AKNPRLIKKS MSEIAVSWTA

151 LSGKIAQHHL PEFTEELRRI ICGGKNPDAG CKQAGQVGKR HQK*
``` m552/a552 100.0% identity in 193 aa overlap

```
                  10        20        30        40        50        60
    m552.pep IKLKTLLLPFATLALCTNAFAAPPSDASLARWLDTQNFDRDIEKNMIEGFNAGFKPYADK
            ||||||||||||||||||||||||||||||||||||||||||||||||||||||||||||
        a552 IKLKTLLLPFATLALCTNAFAAPPSDASLARWLDTQNFDRDIEKNMIEGFNAGFKPYADK
                  10        20        30        40        50        60
                  70        80        90       100       110       120
    m552.pep ALAEMPEAKKDQAAEAFNRYRENVLKDLITPEVKQAVRNTLLKNAREIYTQEEIDGMIAF
            ||||||||||||||||||||||||||||||||||||||||||||||||||||||||||||
        a552 ALAEMPEAKKDQAAEAFNRYRENVLKDLITPEVKQAVRNTLLKNAREIYTQEEIDGMIAF
                  70        80        90       100       110       120
                 130       140       150       160       170       180
    m552.pep YGSPVGQSVVAKNPRLIKKSMSEIAVSWTALSGKIAQHHLPEFTEELRRIICGGKNPDAG
            ||||||||||||||||||||||||||||||||||||||||||||||||||||||||||||
        a552 YGSPVGQSVVAKNPRLIKKSMSEIAVSWTALSGKIAQHHLPEFTEELRRIICGGKNPDAG
                 130       140       150       160       170       180
                 190
    m552.pep CKQAGQVGKRHQKX
            ||||||||||||||
        a552 CKQAGQVGKRHQKX
                 190
```

The following partial DNA sequence was identified in *N. meningitidis* <SEQ ID 1615>:

```
m552-1.seq
  1 TTGAATATTA AACTGAAAAC CTTGTTATTG CCCTTCGCCA CGCTGGCATT

51 GTGCACCAAT GCTTTTGCCG CCCCGCCCAG CGACGCGTCG TTGGCGCGTT

101 GGCTGGATAC GCAGAATTTT GACCGGGATA TAGAAAAAAA TATGATTGAG

151 GGCTTTAATG CCGGATTTAA ACCGTATGCG GACAAAGCCC TTGCCGAAAT

201 GCCGGAAGCG AAAAAAGATC AGGCGGCAGA AGCCTTTAAC CGTTATCGTG

251 AGAATGTTTT GAAAGATTTG ATTACGCCCG AAGTGAAACA GGCTGTCCGC

301 AATACTTTAT TGAAGAATGC CCGTGAGATA TACACGCAAG AAGAAATTGA

351 CGGCATGATT GCCTTTTACG GTTCGCCTGT CGGTCAGTCC GTCGTTGCCA

401 AAAATCCGCG CTTAATCAAG AAATCGATGA GTGAAATAGC GGTATCTTGG

451 ACTGCATTGT CAGGGAAAAT CGCGCAACAT CATCTGCCCG AGTTTACGGA

501 AGAGTTGCGG CGCATCATCT GCGGCGGTAA AAATCCCGAT GCGGGCTGTA

551 AACAAGCCGG ACAGGTTGGG AAAAGGCATC AGAAATAA
```

This corresponds to the amino acid sequence <SEQ ID 1616; ORF 552-1>:

```
m552-1.pep
  1 LNIKLKTLLL PFATLALCTN AFAAPPSDAS LARWLDTQNF DRDIEKNMIE

51 GFNAGFKPYA DKALAEMPEA KKDQAAEAFN RYRENVLKDL ITPEVKQAVR
```

```
101 NTLLKNAREI YTQEEIDGMI AFYGSPVGQS VVAKNPRLIK KSMSEIAVSW

151 TALSGKIAQH HLPEFTEELR RIICGGKNPD AGCKQAGQVG KRHQK*
```

The following partial DNA sequence was identified in *N. meningitidis* <SEQ ID 1617>:

```
a552-1.seq
   1 TTGAATATTA AACTGAAAAC CTTGTTATTG CCCTTCGCCA CGCTGGCATT

51 GTGCACCAAT GCTTTTGCCG CCCCGCCCAG CGACGCGTCG TTGGCGCGTT

101 GGCTGGATAC GCAGAATTTT GACCGGGATA TAGAAAAAAA TATGATTGAG

151 GGCTTTAATG CCGGATTTAA ACCGTATGCG GACAAAGCCC TTGCCGAAAT

201 GCCGGAAGCG AAAAAAGATC AGGCGGCAGA AGCCTTTAAC CGTTATCGTG

251 AGAATGTTTT GAAAGATTTG ATTACGCCCG AAGTGAAACA GGCTGTCCGC

301 AATACTTTAT TGAAGAATGC CCGTGAGATA TACACGCAAG AAGAAATTGA

351 CGGCATGATT GCCTTTTACG GTTCGCCTGT CGGTCAGTCC GTCGTTGCCA

401 AAAATCCGCG CTTAATCAAG AAATCGATGA GTGAAATAGC GGTATCTTGG

451 ACTGCATTGT CAGGGAAAAT CGCGCAACAT CATCTGCCCG AGTTTACGGA

501 AGAGTTGCGG CGCATCATCT GCGGCGGTAA AAATCCCGAT GCGGGCTGTA

551 AACAAGCCGG ACAGGTTGGG AAAAGGCATC AGAAATAA
```

This corresponds to the amino acid sequence <SEQ ID 1618; ORF 552-1.a>:

```
a552-1.pep
    1 LNIKLKTLLL PFATLALCTN AFAAPPSDAS LARWLDTQNF DRDIEKNMIE

51 GFNAGFKPYA DKALAEMPEA KKDQAAEAFN RYRENVLKDL ITPEVKQAVR

101 NTLLKNAREI YTQEEIDGMI AFYGSPVGQS VVAKNPRLIK KSMSEIAVSW

151 TALSGKIAQH HLPEFTEELR RIICGGKNPD AGCKQAGQVG KRHQK* a552-1/m552-1 100.0% identity in 195 aa overlap 10         20         30         40         50         60
a552-1.pep LNIKLKTLLLPFATLALCTNAFAAPPSDASLARWLDTQNFDRDIEKNMIEGFNAGFKPYA
           ||||||||||||||||||||||||||||||||||||||||||||||||||||||||||||
   m552-1 LNIKLKTLLLPFATLALCTNAFAAPPSDASLARWLDTQNFDRDIEKNMIEGFNAGFKPYA
                 10         20         30         40         50         60

70         80         90        100        110        120
a552-1.pep DKALAEMPEAKKDQAAEAFNRYRENVLKDLITPEVKQAVRNTLLKNAREIYTQEEIDGMI
           ||||||||||||||||||||||||||||||||||||||||||||||||||||||||||||
   m552-1 DKALAEMPEAKKDQAAEAFNRYRENVLKDLITPEVKQAVRNTLLKNAREIYTQEEIDGMI
                 70         80         90        100        110        120

130        140        150        160        170        180
a552-1.pep AFYGSPVGQSVVAKNPRLIKKSMSEIAVSWTALSGKIAQHHLPEFTEELRRIICGGKNPD
           ||||||||||||||||||||||||||||||||||||||||||||||||||||||||||||
   m552-1 AFYGSPVGQSVVAKNPRLIKKSMSEIAVSWTALSGKIAQHHLPEFTEELRRIICGGKNPD
                130        140        150        160        170        180

190
a552-1.pep AGCKQAGQVGKRHQKX
           ||||||||||||||||
   m552-1 AGCKQAGQVGKRHQKX
                190
```

The following partial DNA sequence was identified in *N. gonorrhoeae* <SEQ ID 1619>:

```
g553.seq
   1 atggattatc tgcaaaacct gtctttgggc ttgacaaaaa agctgcccgt 51 tatactgcaa acagaagtag cggagtgtgg cttggcatgt ctagcggctg
```

-continued

```
101 tggccggatt ttatggtttc tatacggatt tgcgcgcact gcgttcaaaa 151 tactgtctgt cacttaaggg tgagaatttg gcagatattg ttcgttttgc 201 tgatgatatg gggctgacgg gacgggcgtt gaggctggat ttagacgaat 251 tgggcagttt gcgcctgccc tgtattctac attgggattt gaatcatttt 301 gtggtgctgg aatcggtatc ttcggacggg gctgccgtca tggatccggc 351 ttcgggacga cgcaaagtca agacggagga aatatcgcgc aagtttacgg 401 gaattgcttt ggaactgtgg ccaaacacgc gtttcgaggc aggggaagaa 451 aagcaggaaa tccgcatcct acccatgttg cgcgggattt ctgggctggg 501 gcggacattg tttcagcttt tggctttggc agcagcaatg gaagtgtttg 551 cttttttaca aaacgtcagc ttcaagatcg gacgtggtga atcgcttgcg 601 ttaatcggac gatcgggctg cggtaaatcg acacttttgg atattttaag 651 cggcaatcta cctcccgaat caggcaaagt catgataaat gggcacgaca 701 tttacagctt accgccacct tttattccgc aatttgagtg cgatggtcaa 751 ggcaggacga tgttttatag tggattaaat ttaaaccggt ag
```

This corresponds to the amino acid sequence <SEQ ID 1620; ORF 553.ng>:

```
g553.pep
  1 MDYLQNLSLG LTKKLPVILQ TEVAECGLAC LAAVAGFYGF YTDLRALRSK

51 YCLSLKGENL ADIVRFADDM GLTGRALRLD LDELGSLRLP CILHWDLNHF

101 VVLESVSSDG AAVMDPASGR RKVKTEEISR KFTGIALELW PNTRFEAGEE

151 KQEIRILPML RGISGLGRTL FQLLALAAAM EVFAFLQNVS FKIGRGESLA

201 LIGRSGCGKS TLLDILSGNL PPESGKVMIN GHDIYSLPPP FIPQFECDGQ

251 GRTMFYSGLN LNR*
```

The following partial DNA sequence was identified in *N. meningitidis* <SEQ ID 1621>:

```
m553.seq (partial)
  1 ATGGATTATT TATCAAGACT GTCCTTTGGA TTTAACAAAA AGCTACCTGT

51 CATTCTGCAA ACAGAAGTTG CTGAATGTGG TTTAGCATGC CTGACATCCA

101 TCTTGTCCTA TTATGGCTTT CACACTGATT TAAGAACGTT ACGCCAAAAA

151 TACACCCTGT CATTAAAGGG CGCAAATCTT GCAGACATCA TGAGATTTGG

201 CAATGAAATG AATTTAACGC CACGAGCTTT GCGTTTAGAG TTAGATGAGC

251 TGTCAAATTT ACAACTACCC TGCATTCTCC ATTGGAACTT AAACCATTTT

301 GTTGTACTTT GTTCCATTTC CAAAGACAGT ATCGTCATTA TGGACCCTGC

351 TGTCGGTATG CGAAAAATCA AAATGGACGA AGTTTCACAA AAATTCACAG

401 GGATTGCCCT AGAATTATTC CCCAATACCC ATTTTGAAGA GAAAAAAGAA

451 ACAAAGAAAA TCAAAATATT ATCTCTATTA AGGGGGGG.T CAGGCTTAAA

501 ACGCTCTTTA ATTCAAATGC TTATATTAGC TATTTCTTTG GAAGTCTTTG

551 CATTG...
```

This corresponds to the amino acid sequence <SEQ ID 1622; ORF 553>:

```
m553.pep (partial)
   1 MDYLSRLSFG FNKKLPVILQ TEVAECGLAC LTSILSYYGF HTDLRTLRQK

51 YTLSLKGANL ADIMRFGNEM NLTPRALRLE LDELSNLQLP CILHWNLNHF

101 VVLCSISKDS IVIMDPAVGM RKIKMDEVSQ KFTGIALELF PNTHFEEKKE

151 TKKIKILSLL RGXSGLKRSL IQMLILAISL EVFAL...
```

Computer analysis of this amino acid sequence gave the following results:
Homology with a Predicted ORF from *N. gonorrhoeae*
ORF 553 shows 65.5% identity over a 185 aa overlap with a predicted ORF (ORF 553.ng) from *N. gonorrhoeae*:

```
m553/g553

10         20         30         40         50         60
      g553.pep MDYLQNLSLGLTKKLPVILQTEVAECGLACLAAVAGFYGFYTDLRALRSKYCLSLKGENL
             ||||: ||:|::|||||||||||||||||||:::  :::|||:|||||:||  ||||| ||
         m553 MDYLSRLSFGFNKKLPVILQTEVAECGLACLTSILSYYGFHTDLRTLRQKYTLSLKGANL
                    10         20         30         40         50         60

70         80         90        100        110        120
      g553.pep ADIVRFADDMGLTGRALRLDLDELGSLRLPCILHWDLNHFVVLESVSSDGAAVMDPASGR
             |||:||::::|:|| |||||:||||::|:|||||||:|||||||| |:|:|:  ::||||  |
         m553 ADIMRFGNEMNLTPRALRLELDELSNLQLPCILHWNLNHFVVLCSISKDSIVIMDPAVGM
                    70         80         90        100        110        120

130        140        150        160        170        180
      g553.pep RKVKTEEISRKFTGIALELWPNTRFEAGEEKQEIRILPMLRGISGLGRTLFQLLALAAAM
             ||:| :|:|:|||||||||||:|||:||   :|  ::|:|| :||| ||| |:|:|:| || ::
         m553 RKIKMDEVSQKFTGIALELFPNRHFEEKKETKKIKILSLLRGXSGLKRSLIQMLILAISL
                   130        140        150        160        170        180

180        190        200        210        220        240
      g553.pep EVFAFLQNVSFKIGRGESLALIGRSGCGKSTLLDILSGNLPPESGKVMINGHDIYSLPPP
             ||||:
         m553 EVFAL
```

The following partial DNA sequence was identified in *N. meningitidis* <SEQ ID 1623>:

```
a553.seq
   1 ATGCCCCATC TGCAAAACCT GTCTTTGGGC TTAAAGAAAA AGCTGCCTGT

51 TATCCTGCAA ACAGAAATAT CAGAATGCGG CTTGGCATGT CTGGCGGCTG

101 TGGCGGGATT TCATGGTTTC CATACGAATT TACGCGCACT GCGTTCAAAA

151 TAC
```

This corresponds to the amino acid sequence <SEQ ID 1624; ORF 553.a>:

```
a553.pep
   1 MPHLQNLSLG LKKKLPVILQ TEISECGLAC LAAVAGFHGF HTNLRALRSK

51 Y
``` m553/a553 62.7% identity in 51 aa overlap

```
                    10         20         30         40         50         60
     m553.pep MDYLSRLSFGFNKKLPVILQTEVAECGLACLTSILSYYGFHTDLRTLRQKYTLSLKGANL
             | :|: ||:||::|||||||||||||::|||||||::: :::|||:||:|||
         a553 MPHLQNLSLGLKKKLPVILQTEISECGLACLAAVAGFHGFHTNLRALRSKY
                    10         20         30         40         50

70         80         90        100        110        120
     m553.pep ADIMRFGNEMNLTPRALRLELDELSNLQLPCILHWNLNHFVVLCSISKDSIVIMDPAVGM
```

The following partial DNA sequence was identified in N. gonorrhoeae <SEQ ID 1625>:

```
g554.seq..
    1 atgacagcac ataaaatcct gcccgtcctt cttcccatca tcttaggcgt
   51 ttctcacgca acggctgcat cgcccgcgcc caacagaccg acggtacacg
  101 ccgcccccac gctccaaaca cccgaaaccc tcacggcggc acacatcgtt
  151 atcgaccttc aaagcaggca gactttatcc gccaaaaaca ccaataccccc
  201 tgtcgaaccg gcggcactaa cccaactgat gaccgcatat ttggttttca
  251 aaaacatgaa atcgggaaat atccaatctg aagaaaactt aaaaatacccc
  301 gaatccgcat gggcttcaga aggaagcaga atgtttgtac gtcccggcga
  351 tacggtcagc accgacaaac tcttaaaagg catgattgcc ctatgcgcaa
  401 acgatgccgc cctaacccctt gccgaccggc tgggcaacgg ctcgattgaa
  451 aattttgtgc aacaaatgaa caagaagcc cgacgcttgg gcatgaagaa
  501 caccgtattc aaaaacccga caggcttggg tagagaagga caggtttcca
  551 ccgccaaaga cctctccctg ctgtctgaag cattgatgcg cgactttccg
  601 gaatattacc cgctgttttc catcaaatcg ttcaagtttg aaaacataga
  651 acaaaacaac cgcaatatcc ttttatatag ggacaacaat gtaaacggcc
  701 tgaaagccgg gcacacagaa agcggcggct acaaccttgc cgtgtcatac
  751 tccggcaacg gcaggcacat ccttgtcatc acactaggtt cggaatcggc
  801 ggaaacccgc gcatcggaca acagcaagct gctgaaccgg gcattgcagg
  851 ccttcgatac gcccaaaata tatccgaaag gcaaaaccgt tgcccaaatc
  901 caaatttccg gaggcagcaa aaaaaccgtc cgcgcaggct cctcaaaga
  951 agcctacatc actctgccac ataaagaagc gaaaatggca gaacagattt
 1001 tggaaaccat acagccgatt cccgccccgg taaaaaaagg gcagatttta
 1051 ggaaaaatca aaatcaggca aaacggacat accattgccg aaaagaaat
 1101 cgtcgcactg gaaaacgtag aaaaaagaag ccggtggcaa aggctttgga
 1151 cgcgtctgac agggcagtaa
```

This corresponds to the amino acid sequence <SEQ ID 1626; ORF 554.ng>:

```
g554.pep..
    1 MTAHKILPVL LPIILGVSHA TAASPAPNRP TVHAAPTLQT PETLTAAHIV

51 IDLQSRQTLS AKNTNTPVEP AALTQLMTAY LVFKNMKSGN IQSEENLKIP

101 ESAWASEGSR MFVRPGDTVS TDKLLKGMIA LCANDAALTL ADRLGNGSIE

151 NFVQQMNKEA RRLGMKNTVF KNPTGLGREG QVSTAKDLSL LSEALMRDFP

201 EYYPLFSIKS FKFENIEQNN RNILLYRDNN VNGLKAGHTE SGGYNLAVSY

251 SGNGRHILVI TLGSESAETR ASDNSKLLNR ALQAFDTPKI YPKGKTVAQI

301 QISGGSKKTV RAGFLKEAYI TLPHKEAKMA EQILETIQPI PAPVKKGQIL

351 GKIKIRQNGH TIAEKEIVAL ENVEKRSRWQ RLWTRLTGQ*
```

The following partial DNA sequence was identified in *N. meningitidis* <SEQ ID 1627>:

```
m554.seq..
     1 ATGACAGCAC ATAAAATCCT GCCCGTCCTG CTTTCCATCA TCTTAGGCGT
    51 TTCTCACGCA ACGGCTGCAT CGCCCGCGCC CAACAGACCG ACGGTACACG
   101 CCGCCCCCAC GTTCCAAACA CCCGAAACCC TCACAGCGGC ACACATCGTT
   151 ATCGACCTTC AAAGCAAACA GATTTTATCC GCCAAAAACA TCAATACCCC
   201 TGTTGAACCG GCGGCACTAA CCCAACTGAT GACCGCATAT CTGGTTTTCA
   251 AAAACATGAA ATCGGGCAAT ATCCAATCTG AAGAAAACTT AAAAATACCC
   301 GAATCCGCAT GGGCTTCAGA AGGAAGCAGA ATGTTTGTAC GTCCCGGCGA
   351 TACGGTCAGC ACCGACAAAC TCTTAAAAGG CATGATTGCA CTATCCGCAA
   401 ACGATGCCGC CCTAACCCTT GCCGGCCGGC TGGGCAACGG CTCGATTGAA
   451 AATTTTGTGC AACAAATGAA CAAAGAAGCC CGACGCTTGG GCATGAAGAA
   501 CACTGTATTC AAAAACCCGA CAGGCTTGAG TAGAGAAGGA CAGGTTTCCA
   551 CCGCCAAAGA CGTCGCACTG CTGTCTGAAG CATTGATGCG CGACTTTCCG
   601 GAATATTACC CGCTGTTTTC CATCAAATCT TTCAAATTCA AAAATATAGA
   651 ACAAAACAAC CGCAATATCC TTTTATATAG GGACAACAAT GTAAACGGTC
   701 TGAAAGCCGG ACACACAGAA AGCGGCGGCT ACAACCTTGC CGTGTCATAC
   751 TCCGGCAACG GCAGGCACAT CCTTGTCATC ACATTGGGTT CGGAATCGGC
   801 GGAAACACGC GCATCAGACA ACAGCAAGCT GCTGAACTGG GCATTGCAGG
   851 CCTTCGATAC GCCCAAAATA TATCCGAAAG GCAAAACCGT TGCCCAAATC
   901 CAAATTTCCG GAGGCAGCAA AAAAACCGTC CGCGCAGGCT TCCTCAAAGA
   951 AGCCTACATC ACTCTGCCAC ATAAGGAAGC GAAAATGGCA GAACAAATTC
  1001 TAGAAACCAT ACAGCCGATT CCCGCCCCAG TAAAAAAAGG GCAAATTTTA
  1051 GGAAAAATCA AATCAGACA AAACGGATAC ACCATTGCCG AAAAAGAAAT
  1101 CGTCGCACTG GAAAATGTAA AAAAAAGAAG CCGGTGGCAA AGGCTTTGGG
  1151 CGTGTCTGAC AGGGCAGTAA
```

This corresponds to the amino acid sequence <SEQ ID 1628; ORF 554>:

```
m554.pep..
    1 MTAHKILPVL LSIILGVSHA TAASPAPNRP TVHAAPTFQT PETLTAAHIV
   51 IDLQSKQILS AKNINTPVEP AALTQLMTAY LVFKNMKSGN IQSEENLKIP
  101 ESAWASEGSR MFVRPGDTVS TDKLLKGMIA LSANDAALTL AGRLGNGSIE
  151 NFVQQMNKEA RRLGMKNTVF KNPTGLSREG QVSTAKDLAL LSEALMRDFP
  201 EYYPLFSIKS FKFKNIEQNN RNILLYRDNN VNGLKAGHTE SGGYNLAVSY
  251 SGNGRHILVI TLGSESAETR ASDNSKLLNW ALQAFDTPKI YPKGKTVAQI
  301 QISGGSKKTV RAGFLKEAYI TLPHKEAKMA EQILETIQPI PAPVKKGQIL
  351 GKIKIRQNGY TIAEKEIVAL ENVKKRSRWQ RLWACLTGQ*
```

Computer analysis of this amino acid sequence gave the following results:

Homology with a Predicted ORF from *N. gonorrhoeae*

ORF 554 shows 96.1% identity over a 389 aa overlap with a predicted ORF (ORF 554.ng) from *N. gonorrhoeae*:

```
m554/g554

10         20         30         40         50         60
    m554.pep MTAHKILPVLLSIILGVSHATAASPAPNRPTVHAAPTFQTPETLTAAHIVIDLQSKQILS
             ||||||||||| |||||||||||||||||||||||:||||||||||||||||||:| ||
       g554 MTAHKILPVLLPIILGVSHATAASPAPNRPTVHAAPTLQTPETLTAAHIVIDLQSRQTLS
                    10         20         30         40         50         60

70         80         90        100        110        120
    m554.pep AKNINTPVEPAALTQLMTAYLVFKNMKSGNIQSEENLKIPESAWASEGSRMFVRPGDTVS
             ||| ||||||||||||||||||||||||||||||||||||||||||||||||||||||||
       g554 AKNTNTPVEPAALTQLMTAYLVFKNMKSGNIQSEENLKIPESAWASEGSRMFVRPGDTVS
                    70         80         90        100        110        120

130        140        150        160        170        180
    m554.pep TDKLLKGMIALSANDAALTLAGRLGNGSIENFVQQMNKEARRLGMKNTVFKNPTGLSREG
             ||||||||||| |||||||| |||||||||||||||||||||||||||||||||||:|||
       g554 TDKLLKGMIALCANDAALTLADRLGNGSIENFVQQMNKEARRLGMKNTVFKNPTGLGREG
                   130        140        150        160        170        180

190        200        210        220        230        240
    m554.pep QVSTAKDLALLSEALMRDFPEYYPLFSIKSFKFKNIEQNNRNILLYRDNNVNGLKAGHTE
             |||||||:||||||||||||||||||||||:|||||||||||||||||||||||||||||
       g554 QVSTAKDLSLLSEALMRDFPEYYPLFSIKSFKEKNIEQNNRNILLYRDNNVNGLKAGHTE
                   190        200        210        220        230        240

250        260        270        280        290        300
    m554.pep SGGYNLAVSYSGNGRHILVITLGSESAETRASDNSKLLNWALQAFDTPKIYPKGKTVAQI
             ||||||||||||||||||||||||||||||||||||||| ||||||||||||||||||||
       g554 SGGYNLAVSYSGNGRHILVITLGSESAETRASDNSKLLNRALQAFDTPKIYPKGKTVAQI
                   250        260        270        280        290        300

310        320        330        340        350        360
    m554.pep QISGGSKKTVRAGFLKEAYITLPHKEAKMAEQILETIQPIPAPVKKGQILGKIKIRQNGY
             ||||||||||||||||||||||||||||||||||||||||||||||||||||||||||:
       g554 QISGGSKKTVRAGFLKEAYITLPHKEAKMAEQILETIQPIPAPVKKGQILGKIKIRQNGH
                   310        320        330        340        350        360

370        380        390
    m554.pep TIAEKEIVALENVKKRSRWQRLWACLTGQX
             ||||||||||||:|||||||||:| ||||
       g554 TIAEKEIVALENEKKRSRWQRLWTRLTGQX
                   370        380        390
```

The following partial DNA sequence was identified in *N. meningitidis* <SEQ ID 1629>:

```
a554.seq
   1 ATGACAGCAC ATAAAATCCT GCCCGTCCTG CTTTCCATCA TCTTAGGCGT

51 TTCTCACGCA ACGGCTGCAT CGCCCGCGCC CAACAGACCG ACGGCACACG

101 CCGCCCCCAC GTTCCAAACA CCCGAAACCC TCACAGCGGC ACACATCGTT

151 ATCGACCTTC AAAGCAAACA GATTTTATCC GCCAAAAACA TCAATACCCC

201 TGTCGAACCG GCGGCACTAA CCCAACTGAT GACCGCATAT CTGGTTTTCA

251 AAAACATGAA ATCGGGAAAT ATCCGATCTG AAGAAAACTT AAAAATACCC

301 GAATCCGCAT GGGCTTCAGA AGGAAGCAGA ATGTTTGTAC GTCCCGGCGA

351 TACGGTCAGC ACCGACAAAC TCTTAAAAGG CATGATTGCA CTATCCGCAA

401 ACGATGCCGC CCTAACCCTT GCCGGCCGGC TGGGCAACGG CTCGATTGAA

451 AATTTTGTGC AACAAATGAA CAAAGAAGCC CGACGCTTGG GCATGAAGAA

501 CACTGTATTC AAAAATCCGA CAGGCTTGAG TAGAGAAGGA CAGGTTTCCA

551 CCGCCAAAGA CCTCGCCCAG CTGTCTGAAG CATTGATGCG CGACTTTCCG

601 GAATATTACC CGCTGTTTTC CATCAAATCT TTCAAATTCA AAAATATAGA

651 GCAAAACAAC CGCAATATCC TTTTATATAG GGACAACAAT GTAAACGGTC
```

-continued

```
 701 TGAAAGCCGG ACACACAGAA AGCGGCGGCT ACAACCTTGC CGTGTCATAC

751 TCCGGCAACG GCAGGCACAT CCTTGTCATC ACATTGGGTT CGGAATCGGC

801 GGAAACACGC GCATCAGACA ACAGCAAGCT GCTGAACTGG GCATTGCAAG

851 CCTTCGATAC GCCCAAAATA TATCCGAAAG GCAAAACCGT TGCCCAAATC

901 CAAATTTCCG GAGGCAGCAA AAAACCGTC CGCGCAGGCT TCCTCAAAGA

951 AGCCTACATC ACTCTGCCAC ATAAGGAAGC GAAAATGGCA GAACAAATTC

1001 TAGAAACCAT ACAGCCGATT CCCGCCCCAG TAAAAAAAGG GCAAATTTTA

1051 GGAAAAATCA AAATCAGACA AACGGATAC ACCATTGCCG AAAAAGAAAT

1101 CGTCGCACTG GAAAATGTAA AAAAAAGAAG CCGGTGGCAA AGGCTTTGGG

1151 CGTGTCTGAC AGGGCAGTAA
```

This corresponds to the amino acid sequence <SEQ ID 1630; ORF 554.a>:

```
a554.pep
  1 MTAHKILPVL LSIILGVSHA TAASPAPNRP TAHAAPTFQT PETLTAAHIV

51 IDLQSKQILS AKNINTPVEP AALTQLMTAY LVFKNMKSGN IRSEENLKIP

101 ESAWASEGSR MFVRPGDTVS TDKLLKGMIA LSANDAALTL AGRLGNGSIE

151 NFVQQMNKEA RRLGMKNTVF KNPTGLSREG QVSTAKDLAQ LSEALMRDFP

201 EYYPLFSIKS FKFKNIEQNN RNILLYRDNN VNGLKAGHTE SGGYNLAVSY

251 SGNGRHILVI TLGSESAETR ASDNSKLLNW ALQAFDTPKI YPKGKTVAQI

301 QISGGSKKTV RAGFLKEAYI TLPHKEAKMA EQILETIQPI PAPVKKGQIL

351 GKIKIRQNGY TIAEKEIVAL ENVKKRSRWQ RLWACLTGQ*
``` m554/a554 99.2% identity in 389 aa overlap

```
                 10         20         30         40         50         60
  m554.pep  MTAHKILPVLLSIILGVSHATAASPAPNRPTVHAAPTFQTPETLTAAHIVIDLQSKQILS
            ||||||||||||||||||||||||||||||:|||||||||||||||||||||||||||||
     a554   MTAHKILPVLLSIILGVSHATAASPAPNRPTAHAAPTFQTPETLTAAHIVIDLQSKQILS
                 10         20         30         40         50         60

70         80         90        100        110        120
  m554.pep  AKNINTPVEPAALTQLMTAYLVFKNMKSGNIQSEENLKIPESAWASEGSRMFVRPGDTVS
            |||||||||||||||||||||||||||||||:||||||||||||||||||||||||||||
     a554   AKNINTPVEPAALTQLMTAYLVFKNMKSGNIRSEENLKIPESAWASEGSRMFVRPGDTVS
                 70         80         90        100        110        120

130        140        150        160        170        180
  m554.pep  TDKLLKGMIALSANDAALTLAGRLGNGSIENFVQQMNKEARRLGMKNTVFKNPTGLSREG
            ||||||||||||||||||||||||||||||||||||||||||||||||||||||||||||
     a554   TDKLLKGMIALSANDAALTLAGRLGNGSIENFVQQMNKEARRLGMKNTVFKNPTGLSREG
                130        140        150        160        170        180

190        200        210        220        230        240
  m554.pep  QVSTAKDLALLSEALMRDFPEYYPLFSIKSFKFKNIEQNNRNILLYRDNNVNGLKAGHTE
            |||||||||| |||||||||||||||||||||||||||||||||||||||||||||||||
     a554   QVSTAKDLAQLSEALMRDFPEYYPLFSIKSFKFKNIEQNNRNILLYRDNNVNGLKAGHTE
                190        200        210        220        230        240

250        260        270        280        290        300
  m554.pep  SGGYNLAVSYSGNGRHILVITLGSESAETRASDNSKLLNWALQAFDTPKIYPKGKTVAQI
            ||||||||||||||||||||||||||||||||||||||||||||||||||||||||||||
     a554   SGGYNLAVSYSGNGRHILVITLGSESAETRASDNSKLLNWALQAFDTPKIYPKGKTVAQI
                250        260        270        280        290        300
```

-continued

```
                310        320        330        340        350        360
   m554.pep   QISGGSKKTVRAGFLKEAYITLPHKEAKMAEQILETIQPIPAPVKKGQILGKIKIRQNGY
              ||||||||||||||||||||||||||||||||||||||||||||||||||||||||||||
   a554       QISGGSKKTVRAGFLKEAYITLPHKEAKMAEQILETIQPIPAPVKKGQILGKIKIRQNGY
                310        320        330        340        350        360

370        380        390
   m554.pep   TIAEKEIVALENVKKRSRWQRLWACLTGQX
              |||||||||||||||||||||||||||||
   a554       TIAEKEIVALENVKKRSRWQRLWACLTGQX
                370        380        390
```

The following partial DNA sequence was identified in *N. gonorrhoeae* <SEQ ID 1631>:

```
g556.seq..
   1 atggacaata agaccaaact gcgcttgggc ggcctgattt tactgaccac 51 cgccgtttta agcctcatta tcgtattgat tgtcgattcc tggccgcttg 101 ccatcctgct tgccgccgtc atcgtcgccg ccgctgcggg cggctttgtt 151 tggacatccc gccgacagca acgccagttt atcgaacgtc tgaaaaaatt 201 cgacatcgat cccgaaaaag gcagaatcaa cgaggcaaac ctgcgccgta 251 tgtaccacag cggcggacaa caccagaaag atgcgattac cctgatctgc 301 ctgtcgcaaa aatgttcggt ggacgaggcg cacgctatgt tcaaaaaacg 351 cccgacacgt caggaaatca atcaaatggc ggcaaaacag tcgcgcggtc 401 agaaacgtcc gcaccgttaa
```

This corresponds to the amino acid sequence <SEQ ID 1632; ORF 556.ng>:

```
g556.pep..
   1 MDNKTKLRLG GLILLTTAVL SLIIVLIVDS WPLAILLAAV IVAAAAGGFV

51 WTSRRQQRQF IERLKKFDID PEKGRINEAN LRRMYHSGGQ HQKDAITLIC

101 LSQKCSVDEA HAMFKKRPTR QEINQMAAKQ SRGQKRPHR*
```

The following partial DNA sequence was identified in *N. meningitidis* <SEQ ID 1633>:

```
m556.seq..
   1 ATGGACAATA AGACCAAACT GCGCTTGGGC GGCCTGATTT TACTGACCAC

51 CGCCGTTTTA AGCCTCATTA TCGTATTGAT TGTCGATTCC TGGCCGCTTG

101 CCATCCTGCT TGCAGCCGTC ATTGTCGCTG CCGCTGCGGG CGGTTTTGTT

151 TGGACATCCC GCCGACAGCA ACGCCAGTTT ATCGAACGCC TGAAAAAATT

201 CGACATCGAT CCCGAAAAAG GCAGAATCAA CGAGGCAAAC CTGCGCCGTA

251 TGTACCACAG CGGCGGACAA CACCAGAAAG ATGCGATTAC CCTGATCTGC

301 CTGTCGCAAA AATGTTCGGT GGACGAGGCG CACGCTATGT TCAAAAAACG

351 CCCGACACGT CAGGAAATCA ATCAAATGGC GGCAAAACAG TCGCGCGGTC

401 AGAAACGTCC GCACCGTTAA
```

This corresponds to the amino acid sequence <SEQ ID 1634; ORF 556>:

```
m556.pep..
   1 MDNKTKLRLG GLILLTTAVL SLIIVLIVDS WPLAILLAAV IVAAAAGGFV

51 WTSRRQQRQF IERLKKFDID PEKGRINEAN LRRMYHSGGQ HQKDAITLIC

101 LSQKCSVDEA HAMFKKRPTR QEINQMAAKQ SRGQKRPHR*
```

Computer analysis of this amino acid sequence gave the following results:
Homology with a Predicted ORF from *N. gonorrhoeae*
ORF 556 shows 100.0% identity over a 139 aa overlap with a predicted ORF (ORF 556.ng) from *N. gonorrhoeae*:

```
   m556/g556

10        20        30        40        50        60
        m556.pep MDNKTKLRLGGLILLTTAVLSLIIVLIVDSWPLAILLAAVIVAAAAGGFVWTSRRQQRQF
                ||||||||||||||||||||||||||||||||||||||||||||||||||||||||||||
            g556 MDNKTKLRLGGLILLTTAVLSLIIVLIVDSWPLAILLAAVIVAAAAGGFVWTSRRQQRQF
                    10        20        30        40        50        60

70        80        90       100       110       120
        m556.pep IERLKKFDIDPEKGRINEANLRRMYHSGGQHQKDAITLICLSQKCSVDEAHAMFKKRPTR
                ||||||||||||||||||||||||||||||||||||||||||||||||||||||||||||
            g556 IERLKKFDIDPEKGRINEANLRRMYHSGGQHQKDAITLICLSQKCSVDEAHAMFKKRPTR
                    70        80        90       100       110       120

130       140
        m556.pep QEINQMAAKQSRGQKRPHRX
                ||||||||||||||||||||
            g556 QEINQMAAKQSRGQKRPHRX
                   130       140
```

The following partial DNA sequence was identified in *N. meningitidis* <SEQ ID 1635>:

```
a556.seq
   1 ATGGACAATA AGACCAAACT GCGCTTGGGC GGCCTGATTT TACTGACCAC

51 CGCCGTTTTA AGCCTCATTA TCGTATTGAT TGTCGATTCC TGGCCGCTTG

101 CCATCCTGCT TGCCGCCGTC ATCGTCGCCG CCGCTGCGGG CGGCTTTGTT

151 TGGACATCCC GCCGACAGCA ACGCCAGTTT ATCGAACGTC TGAAAAAATT

201 CGACATCGAT CCCGAAAAAG GCAGAATCAA CGAGGCAAAC CTGCGCCGTA

251 TGTACCACAG CGGCGGACAA CACCAAAAAG ATGCGATTAC CCTGATCTGC

301 CTGTCGCAAA AATGTTCGGT GGACGAGGCG CACGCTATGT TCAAAAAACG

351 CCCGACACGT CAGGAAATCA ATCAAATGGC GGCAAAACAG TCGCGCGGTC

401 AGAAACGTCC GCACCGTTAA
```

This corresponds to the amino acid sequence <SEQ ID 1636; ORF 556.a>:

```
a556.pep
   1 MDNKTKLRLG GLILLTTAVL SLIIVLIVDS WPLAILLAAV IVAAAAGGFV

51 WTSRRQQRQF IERLKKFDID PEKGRINEAN LRRMYHSGGQ HQKDAITLIC

101 LSQKCSVDEA HAMFKKRPTR QEINQMAAKQ SRGQKRPHR*
``` m556/a556 100.0% identity in 139 aa overlap

```
                  10         20         30         40         50         60
    m556.pep MDNKTKLRLGGLILLTTAVLSLIIVLIVDSWPLAILLAAVIVAAAAGGFVWTSRRQQRQF
             ||||||||||||||||||||||||||||||||||||||||||||||||||||||||||||
        a556 MDNKTKLRLGGLILLTTAVLSLIIVLIVDSWPLAILLAAVIVAAAAGGFVWTSRRQQRQF
                  10         20         30         40         50         60

70         80         90        100        110        120
    m556.pep IERLKKFDIDPEKGRINEANLRRMYHSGGQHQKDAITLICLSQKCSVDEAHAMFKKRPTR
             ||||||||||||||||||||||||||||||||||||||||||||||||||||||||||||
        a556 IERLKKFDIDPEKGRINEANLRRMYHSGGQHQKDAITLICLSQKCSVDEAHAMFKKRPTR
                  70         80         90        100        110        120

130        140
    m556.pep QEINQMAAKQSRGQKRPHRX
             ||||||||||||||||||||
        a556 QEINQMAAKQSRGQKRPHRX
                 130        140
```

The following partial DNA sequence was identified in *N. gonorrhoeae* <SEQ ID 1637>:

```
g557.seq
   1 atgaacaaaa tattccttac tgccgcagcc ttggtgctgg gcgcgtgcgg 51 tttccacctg aaaggtgcag acggcatttc tccgccgctg acctaccgga 101 gctggcacat cgaaggcgga caggcattgc aatttccttt ggaaaccgcg 151 ctgtatcagg cttcgggcag ggtggacgat gctgccggcg cgcagatgac 201 cctgcgtata gacagcgttt cccaaaacaa ggaaacctat accgttaccc 251 gtgcggcagt catcaacgaa tatcttttga tattgacggt tgaagcgcag 301 gtattgaaac gcggcgagcc ggtcggcaaa ccgatgaccg tgtccgtccg 351 ccgcattttg gattatgccg acaacgaaat tttgggcaaa caggaagaag 401 aagaaaccct gtgggcggaa atgcggcagg atgttgccga acagattgtc 451 cgccgcctga cctttctgaa ggcggaatga
```

This corresponds to the amino acid sequence <SEQ ID 1638; ORF 557.ng>:

```
g557.pep..
   1 MNKIFLTAAA LVLGACGFHL KGADGISPPL TYRSWHIEGG QALQFPLETA

51 LYQASGRVDD AAGAQMTLRI DSVSQNKETY TVTRAAVINE YLLILTVEAQ

101 VLKRGEPVGK PMTVSVRRIL DYADNEILGK QEEETLWAE MRQDVAEQIV

151 RRLTFLKAE*
```

The following partial DNA sequence was identified in *N. meningitidis* <SEQ ID 1639>:

```
m557.seq..
   1 ATGAACAAAC TGTTTCTTAC TGCCGCAGTG CTGATGCTGG GCGCGTGCGG

51 TTTCCACCTG AAAGGTGCAG ACGGCATTTC TCCGCCGCTG ACCTACCGGA

101 GCTGGCACAT CGAAGGCGGA CAGGCATTGC GGTTTCCTTT GGAAACCGCG

151 CTGTATCAGG CTTCGGGCAG GGTGGACGAT GCTGCCGGCG CGCAGATGAC

201 CCTGCGTATA GACAGCGTTT CCCAAAACAA GGAAACCTAC ACCGTTACCC

251 GTGCGGCAGT CATCAACGAA TATCTTTTGA TATTGACGGT TGAAGCGCAG

301 GTATTGAAAC GCGGCGAGCC GGTCGGTAAA CCGATGACCG TGTCCGTCCG

351 CCGCGTCCTT GCTTATGCCG ACAACGAGAT CTTGGGCAAA CAGGAAGAGG
```

-continued

```
401 AAGCGGCATT GTGGGCGGAA ATGCGGCAGG ATGCCGCCGA ACAGATTGTC

451 CGCCGCCTGA CCTTTCTGAA GGCGGAATGA
```

This corresponds to the amino acid sequence <SEQ ID 1640; ORF 557>:

```
m557.pep..
   1 MNKLFLTAAV LMLGACGFHL KGADGISPPL TYRSWHIEGG QALRFPLETA

51 LYQASGRVDD AAGAQMTLRI DSVSQNKETY TVTRAAVINE YLLILTVEAQ

101 VLKRGEPVGK PMTVSVRRVL AYADNEILGK QEEEAALWAE MRQDAAEQIV

151 RRLTFLKAE*
```

Computer analysis of this amino acid sequence gave the following results:
Homology with a Predicted ORF from *N. gonorrhoeae* 20
ORF 557 shows 94.3% identity over a 159 aa overlap with a predicted ORF (ORF 557.ng) from *N. gonorrhoeae*:

```
    m557/g557
                  10         20         30         40         50         60
    m557.pep MNKLFLTAAVLMLGACGFHLKGADGISPPLTYRSWHIEGGQALRFPLETALYQASGRVDD
             |||:|||||:|:||||||||||||||||||||||||||||:|||||||||||||||||
       g557 MNKIFLTAAALVLGACGFHLKGADGISPPLTYRSWHIEGGQALQFPLETALYQASGRVDD
                  10         20         30         40         50         60

70         80         90        100        110        120
    m557.pep AAGAQMTLRIDSVSQNKETYTVTRAAVINEYLLILTVEAQVLKRGEPVGKPMTVSVRRVL
             ||||||||||||||||||||||||||||||||||||||||||||||||||||||||||:|
       g557 AAGAQMTLRIDSVSQNKETYTVTRAAVINEYLLILTVEAQVLKRGEPVGKPMTVSVRRIL
                  70         80         90        100        110        120

130        140        150        160
    m557.pep AYADNEILGKQEEEAALWAEMRQDAAEQIVRRLTFLKAEX
             |||||||||||||||:|||||||||:||||||||||||||
       g557 DYADNEILGKQEEETLWAEMRQDVAEQIVRRLTFLKAEX
                 130        140        150        160
```

The following partial DNA sequence was identified in *N. meningitidis* <SEQ ID 1641>:

```
a557.seq
   1 ATGAACAAAC TGTTTCTTAC TGCCGCAGTG CTGATGCTGG GCGCGTGCGG

51 TTTCCACCTG AAAGGTGCAG ACGGCATTTC TCCGCCGCTG ACCTACCGGA

101 GCTGGCACAT CGAAGGCGGA CAGGCATTGC AGTTTCCTTT GGAAACCGCG

151 CTGTATCAGG CTTCGGGTAG GGTGGACGAT GCTGCCGGCG CGCAGATGAC

201 CCTGCGTATA GACAGCGTTT CCCAAAACAA GGAAACCTAC ACCGTTACCC

251 GTGCGGCAGT CATCAACGAA TATCTTTTGA TATTGACGGT TGAAGCGCAG

301 GTATTGAAAC GCGGCGAGCC GGTCGGCAAA CCGATGACCG TGTCCGTCCG

351 CCGCGTCCTT GCTTATGCCG ACAACGAGAT CTTGGGCAAA CAGGAAGAGG

401 AAGCGGCATT GTGGGCGGAA ATGCGGCAGG ATGCCGCCGA ACAGATTGTC

451 CGCCGCCTGA CCTTTCTGAA GGCGGAATGA
```

This corresponds to the amino acid sequence <SEQ ID 1642; ORF 557.a>: 60

```
a557.pep
   1 MNKLFLTAAV LMLGACGFHL KGADGISPPL TYRSWHIEGG QALQFPLETA

51 LYQASGRVDD AAGAQMTLRI DSVSQNKETY TVTRAAVINE YLLILTVEAQ
```

```
101 VLKRGEPVGK PMTVSVRRVL AYADNEILGK QEEEAALWAE MRQDAAEQIV

151 RRLTFLKAE*
``` m557/a557 99.4% identity in 159 aa overlap

```
                    10         20         30         40         50         60
   m557.pep  MNKLFLTAAVLMLGACGFHLKGADGISPPLTYRSWHIEGGQALRFPLETALYQASGRVDD
             ||||||||||||||||||||||||||||||||||||||||||:|||||||||||||||||
      a557   MNKLFLTAAVLMLGACGFHLKGADGISPPLTYRSWHIEGGQALQFPLETALYQASGRVDD
                    10         20         30         40         50         60

70         80         90        100        110        120
   m557.pep  AAGAQMTLRIDSVSQNKETYTVTRAAVINEYLLILTVEAQVLKRGEPVGKPMTVSVRRVL
             ||||||||||||||||||||||||||||||||||||||||||||||||||||||||||||
      a557   AAGAQMTLRIDSVSQNKETYTVTRAAVINEYLLILTVEAQVLKRGEPVGKPMTVSVRRVL
                    70         80         90        100        110        120

130        140        150        160
   m557.pep  AYADNEILGKQEEEAALWAEMRQDAAEQIVRRLTFLKAEX
             |||||||||||||||||||||||||||||||||||||||
      a557   AYADNEILGKQEEEAALWAEMRQDAAEQIVRRLTFLKAEX
                   130        140        150        160
```

The following partial DNA sequence was identified in *N. gonorrhoeae* <SEQ ID 1643>:

```
g558.seq..
   1 ATGGATGCTT GTTTTTTCGT CATTCCCGCA CAGGCGGGAA TTCGGAGATT

51 CGGGATTGTT TTCAAACGTT CGGGTCGGAT TCTTGCCGGT GCGGGAATGA

101 TGCCCTTATA TACTTTCTCC GAGCTTTATA TGCTTCAACA GGGGACGGCA

151 CATCAAGCAC CGCACTGCGT GTTGCCCGAA CGAGGCTGCC CTCCGATTAG

201 ATTCTATCGC TATAAACAGA CGGGTTTCAA CCGAAAAGGA ATGGGGATAA

251 AGTCCATTTC CGACACCTCT CGGGCGATGC CGTCTGAAAA CCAATCTCCA

301 CTTTCAGACG GCATTGTTTA G
```

This corresponds to the amino acid sequence <SEQ ID 1644; ORF 558.ng>:

```
g558.pep..
   1 MDACFFVIPA QAGIRRFGIV FKRSGRILAG AGMMPLYTFS ELYMLQQGTA

51 HQAPHCVLPE RGCPPIRFYR YKQTGFNRKG MGIKSISDTS RAMPSENQSP

101 LSDGIV*
```

The following partial DNA sequence was identified in *N. meningitidis* <SEQ ID 1645>:

```
m558.seq..
   1 ATGAATGCTT GTTTTTTCGT CATTCCCACA CAGGCGGGAA TTCGGAGATT

51 CGGGATTGTT TTCAAACGTT CGGGTCGGAT TCTTGCCGGT GCAGGAATGA

101 TGCCCTTATA TACTTTCTCC GAGCTTTATA TGTTTCAACA GGGGACGGCA

151 CATCAAGCAC CGCACTGCGT GTTGCCCGAA CGAGACTACC CTCCGATTAG

201 ATTCTATCGC CATAAACAGA CGGGTTTCAA CCGAAAAGGA ATGGGGATAA

251 AGTCCATTTC CGACATCTsT CGGGCGATGC CGTCTGAAAA CCAATCTCCA

301 CTTTCAGACG GCATTGTTTA G
```

This corresponds to the amino acid sequence <SEQ ID 1646; ORF 558>:

```
m558.pep..
  1 MNACFFVIPT QAGIRRFGIV FKRSGRILAG AGMMPLYTFS ELYMFQQGTA

51 HQAPHCVLPE RDYPPIRFYR HKQTGFNRKG MGIKSISDIX RAMPSENQSP

101 LSDGIV*
```

Computer analysis of this amino acid sequence gave the following results:
Homology with a Predicted ORF from *N. gonorrhoeae*
ORF 558 shows 92.5% identity over a 106 aa overlap with a predicted ORF (ORF 558.ng) from *N. gonorrhoeae*:

```
     m558/g558

10        20        30        40        50        60
    m558.pep MNACFFVIPTQAGIRRFGIVFKRSGRILAGAGMMPLYTFSELYMFQQGTAHQAPHCVLPE
             |:||||||:||||||||||||||||||||||||||||||||||||:||||||||||||
        g558 MDACFFVIPAQAGIRRFGIVFKRSGRILAGAGMMPLYTFSELYMLQQGRAHQAPHCVLPE
                  10        20        30        40        50        60

70        80        90       100
    m558.pep RDYPPIRFYRHKQTGFNRKGMGIKSISDIXRAMPSENQSPLSDGIVX
             | ||||||||:||||||||||||||||||  |||||||||||||||
        g558 RGCPPIRFYRYKQTGFNRKGMGIKSISDTSRAMPSENQSPLSDGIVX
                  70        80        90       100
```

The following partial DNA sequence was identified in *N. meningitidis* <SEQ ID 1647>:

```
a558.seq
  1 ATGAATGCTT GTTTTTTCGT CATTCCCACA CAGGCGGGAA TTCGGAGATT

51 CGGGATTGTT TTCAAACGTT CGGGTCGGAT TCTTGCCGGT GCGGGAATGA

101 TGCCCTTATA TATAGTGGAT TAAATTTAAA TCAGGACAAG GCGACGAAGC

151 CGCAGACAGT ACAAATAGTA CGGCAAGGCG AGGCAACGCC GTACTGGTTT

201 AAATTTAATC CACTATACTT TCTCCGAGCT TTATATGTTT CAACAGAGGA

251 CGGCACATCA AGCACCGCAC TGCGTGTTGC CCGAACGAGA CTGCCCTCCG

301 ATTAGATTCT ATCGCTATAA ACAGACGGGT TTCAACCGAA AAGGAATGGG

351 AATGAAGTCC GTTTCCGACA CCTCTCGGGC GATGCCGTCT GAAAACCAAT

401 CTCCACTTTC AGACGGCATT GTTTAG
```

This corresponds to the amino acid sequence <SEQ ID 1648; ORF 558.a>:

```
a558.pep
  1 MNACFFVIPT QAGIRRFGIV FKRSGRILAG AGMMPLYIVD *I*IRTRRRS

51 RRQYK*YGKA RQRRTGLNLI HYTFSELYMF QQRTAHQAPH CVLPERDCPP

101 IRFYRYKQTG FNRKGMGMKS VSDTSRAMPS ENQSPLSDGI V*
``` m558/a558 70.2% identity in 141 aa overlap

```
                  10        20        30
    m558.pep MNACFFVIPTQAGIRRFGIVFKRSGRILAGAGMMPLY----------------------
             ||||||||||||||||||||||||||||||||||||
        a558 MNACFFVIPTQAGIRRFGIVFKRSGRILAGAGMMPLYIVDXIXIRTRRRSRRQYKXYGKA
                  10        20        30        40        50        60
```

```
                        40         50         60         70         80
    m558.pep -----------TFSELYMFQQGTAHQAPHCVLPERDYPPIRFYRHKQTGFNRKGMGIKS
                        |||||||||| |||||||||||||| ||||||:||||||||||||:||
       a558 RQRRTGLNLIHYTFSELYMFQQRTAHQAPHCVLPERDCPPIRFYRYKQTGFNRKGMGMKS
                70        80        90       100       110       120

90        100
    m558.pep ISDIXRAMPSENQSPLSDGIVX
             :|| ||||||||||||||||||
       a558 VSDTSRAMPSENQSPLSDGIVX
                130       140
```

The following partial DNA sequence was identified in *N. gonorrhoeae* <SEQ ID 1649>:

```
g560.seq
   1 atgctcatca tccgcaacct gatttactgg ctgatactct gttccagcct
  51 gattttcctc tttcccttta tgctgctcgc ctcgcctttc cgggacgggg
 101 cgcacaagat ggcgcgggtc tgggtcggca tcctcaactg gtcgctcaaa
 151 cacatcgtcg ggctcaaata ccgcatcatc ggcgcggaac acattccgga
 201 ccgccctcc gtcatctgcg ccaaacacca aagcggctgg gaaacgctcg
 251 cgctccaaga gatttttccg ccgcaggttt acgttgccaa gcgcgagttg
 301 ttcaaaatcc ccttttcgg ctggggcttg aaactggtca aaccatagg
 351 catagaccgc aacaaccgcc gcgaagccaa cgaacagctc ataaaacagg
 401 gtttggcgcg caaaaacgaa ggttattgga ttaccatttt ccccgaaggc
 451 acgcgccttg cgcccggaaa acgcggcaaa tacaaactcg gcggcgcgcg
 501 catggcgaaa atgtttgaga tggacatcgt ccccgtcgcc ctcaacagcg
 551 gcgaattttg gccgaaaaat tcctttctga aatatccggg ggaaatcacc
 601 gtcatcatct gtccgaccat cccgcacgca agcggcagcg aagccgaatt
 651 gatggaaaaa tgcgaacacc tcattgaaac gcaacaaccg cttatttccg
 701 gcgcaggccc gtttgccgcc gaaatgccgt ctgaaaccgc atga
                                                     40
```

This corresponds to the amino acid sequence <SEQ ID 1650; ORF 560.ng>:

```
g560.pep..
   1 MLIIRNLIYW LILCSSLIFL FPFMLLASPF RDGAHKMARV WVGILNWSLK
  51 HIVGLKYRII GAEHIPDRPS VICAKHQSGW ETLALQEIFP PQVYVAKREL
 101 FKIPFFGWGL KLVKTIGIDR NNRREANEQL IKQGLARKNE GYWITIFPEG
 151 TRLAPGKRGK YKLGGARMAK MFEMDIVPVA LNSGEFWPKN SFLKYPGEIT
 201 VIICPTIPHA SGSEAELMEK CEHLIETQQP LISGAGPFAA EMPSET*
```

The following partial DNA sequence was identified in *N. meningitidis* <SEQ ID 1651>:

```
m560.seq
   1 ATGCTCATCA TCCGCAACCT GATTTACTGG CTGATACTCT GTTCCACCCT
  51 GATTTTCCTC TTTCCCTTTA TGCTGCTCGC CTCGCCTTTC CGGGACGGGG
 101 CGCACAAGAT GGCGCGGGTC TGGGTCGGCA TTCTCAACTG GTCGCTCAAA
 151 CACATCGTCG GGCTCAAATA CCGCATCATC GGCGCGGAAA ACATCCCCGA
 201 CCGCCCCGCC GTCATCTGCG CCAAACACCA AAGCGGCTGG GAAACGCTCG
```

-continued

```
251 CCCTTCAGGA CATTTTTCCG CCGCAGGTTT ACGTTGCCAA ACGCGAGTTG

301 TTCAAAATCC CCTTTTTCGG CTGGGGCTTG AAACTGGTCA AAACCATAGG

351 CATAGACCGC AACAACCGCC GCGAAGCCAA CGAGCAGCTC ATAAAACAGG

401 GGTTGGTGCG CAAAAACGAA GGCTATTGGA TTACCATTTT CCCCGAAGGC

451 ACGCGCCTTG CGCCCGGAAA ACGCGGCAAA TACAAACTCG GCGGCGCGCG

501 CATGGCGAAA ATGTTTGAGA TGGACATCGT CCCCGTCGCC CTCAACAGCG

551 GCGAATTTTG GCCGAAAAAC TCCTTTCTGA AATATCCGGG GGAAATCACC

601 GTCGTCATCT GTCCGACCAT CCCGCACGCA AGCGGCAGCG AAGCCGAATT

651 GATGGAAAAA TGCGAACATC TCATCGAAAC GCAACAACCG CTTATTTCCG

701 GCGCAGGCCC GTTTGCCGCC AAAATGCCGT CTGAAACCGC ATGA
```

This corresponds to the amino acid sequence <SEQ ID 1652; ORF 560>:

```
m560.pep
  1 MLIIRNLIYW LILCSTLIFL FPFMLLASPF RDGAHKMARV WVGILNWSLK

51 HIVGLKYRII GAENIPDRPA VICAKHQSGW ETLALQDIFP PQVYVAKREL

101 FKIPFFGWGL KLVKTIGIDR NNRREANEQL IKQGLVRKNE GYWITIFPEG

151 TRLAPGKRGK YKLGGARMAK MFEMDIVPVA LNSGEFWPKN SFLKYPGEIT

201 VVICPTIPHA SGSEAELMEK CEHLIETQQP LISGAGPFAA KMPSETA*
```

Computer analysis of this amino acid sequence gave the following results:
Homology with a Predicted ORF from *N. gonorrhoeae*
ORF 560 shows 97.2% identity over a 246 aa overlap with a predicted ORF (ORF 560.ng) from *N. gonorrhoeae*:

```
m560/g560

10         20         30         40         50         60
     m560.pep MLIIRNLIYWLILCSTLIFLFPFMLLASPFRDGAHKMARVWVGILNWSLKHIVGLKYRII
              ||||||||||||||:|||||||||||||||||||||||||||||||||||||||||||||
         g560 MLIIRNLIYWLILCSSLIFLFPFMLLASPFRDGAHKMARVWVGILNWSLKHIVGLKYRII
                  10         20         30         40         50         60

70         80         90        100        110        120
     m560.pep GAENIPDRPAVICAKHQSGWETLALQDIFPPQVYVAKRELFKIPFFGWGLKLVKTIGIDR
              |||:||||:||||||||||||||||||:||||||||||||||||||||||||||||||||
         g560 GAEHIPDRPSVICAKHQSGWETLALQEIFPPQVYVAKRELFKIPFFGWGLKLVKTIGIDR
                  70         80         90        100        110        120

130        140        150        160        170        180
     m560.pep NNRREANEQLIKQGLVRKNEGYWITIFPEGTRLAPGKRGKYKLGGARMAKMFEMDIVPVA
              |||||||||||||||:||||||||||||||||||||||||||||||||||||||||||||
         g560 NNRREANEQLIKQGLARKNEGYWITIFPEGTRLAPGKRGKYKLGGARMAKMFEMDIVPVA
                 130        140        150        160        170        180

190        200        210        220        230        240
     m560.pep LNSGEFWPKNSFLKYPGEITVVICPTIPHASGSEAELMEKCEHLIETQQPLISGAGPFAA
              |||||||||||||||||||||:||||||||||||||||||||||||||||||||||||||
         g560 LNSGEFWPKNSFLKYPGEITVIICPTIPHASGSEAELMEKCEHLIETQQPLISGAGPFAA
                 190        200        210        220        230        240 m560.pep KMPSETAX
              :|||||
         g560 EMPSETX
```

The following partial DNA sequence was identified in *N. meningitidis* <SEQ ID 1653>:

```
a560.seq
  1 ATGCTCATCA TCCGCAACCT GATTTACTGG CTGATACTCT GTTCCACCCT

51 GATTTTCCTC TTTCCCTTTA TGCTGCTCGC CTCGCCTTTC CGAGACGGGG
```

-continued

```
101 CGCACAAGAT GGCGCGGGTC TGGGTCAAAA TCCTCAACCT CTCGCTCAAA

151 CACATCGTCG GGCTCAAATA CCGCATCATC GGCGCGGAAA ACATCCCGA

201 CCGCCCCGCC GTCATCTGCG CCAAACACCA AAGCGGCTGG GAAACGCTCG

251 CCCTTCAGGA CATTTTTCCG CCGCAGGTTT ACGTTGCCAA ACGCGAGTTG

301 TTCAAAATCC CCTTTTTCGG CTGGGGCTTG AAACTGGTCA AAACCATAGG

351 CATAGACCGC AACAACCGCC GCGAAGCCAA CGAGCAGCTC ATAAAACAGG

401 GGTTGGCGCG CAAAAACGAA GGCTATTGGA TTACCATTTT CCCCGAAGGC

451 ACACGCCTTG CGCCCGGAAA ACGCGGCAAA TACAAACTCG GCGGCGCGCG

501 CATGGCGAAA ATGTTTGAGA TGGACATCGT CCCCGTCGCC CTCAACAGCG

551 GCGAATTTTG GCCGAAAAAC TCCTTTCTGA AATATCCGGG GGAAATCACC

601 GTCGTCATCT GTCCGACCAT CCCGCACGCA AGCGGCAGCG AAGCCGAATT

651 GATGGGAAAA TGCGAACACC TCATCGAAAC GCAGCAGCCG CTCATTTCCG

701 GCGCAGGCCC GTTTGCCGCC AAAATGCCGT CTGAAACCGC ATGA
```

This corresponds to the amino acid sequence <SEQ ID 1654; ORF 560.a>:

```
a560.pep
  1 MLIIRNLIYW LILCSTLIFL FPFMLLASPF RDGAHKMARV WVKILNLSLK

51 HIVGLKYRII GAENIPDRPA VICAKHQSGW ETLALQDIFP PQVYVAKREL

101 FKIPFFGWGL KLVKTIGIDR NNRREANEQL IKQGLARKNE GYWITIFPEG

151 TRLAPGKRGK YKLGGARMAK MFEMDIVPVA LNSGEFWPKN SFLKYPGEIT

201 VVICPTIPHA SGSEAELMGK CEHLIETQQP LISGAGPFAA KMPSETA*
``` m560/a560 98.4% identity in 247 aa overlap

```
                10         20         30         40         50         60
    m560.pep MLIIRNLIYWLILCSTLIFLFPFMLLASPFRDGAHKMARVWVGILNWSLKHIVGLKYRII
             ||||||||||||||||||||||||||||||||||||||||   |||||||||||||||
        a560 MLIIRNLIYWLILCSTLIFLFPFMLLASPFRDGAHKMARVWVKILNLSLKHIVGLKYRII
                10         20         30         40         50         60

70         80         90        100        110        120
    m560.pep GAENIPDRPAVICAKHQSGWETLALQDIFPPQVYVAKRELFKIPFFGWGLKLVKTIGIDR
             ||||||||||||||||||||||||||||||||||||||||||||||||||||||||||||
        a560 GAENIPDRPAVICAKHQSGWETLALQDIFPPQVYVAKRELFKIPFFGWGLKLVKTIGIDR
                70         80         90        100        110        120

130        140        150        160        170        180
    m560.pep NNRREANEQLIKQGLVRKNEGYWITIFPEGTRLAPGKRGKYKLGGARMAKMFEMDIVPVA
             |||||||||||||| :|||||||||||||||||||||||||||||||||||||||||||
        a560 NNRREANEQLIKQGLARKNEGYWITIFPEGTRLAPGKRGKYKLGGARMAKMFEMDIVPVA
               130        140        150        160        170        180

190        200        210        220        230        240
    m560.pep LNSGEFWPKNSFLKYPGEITVVICPTIPHASGSEAELMEKCEHLIETQQPLISGAGPFAA
             |||||||||||||||||||||||||||||||||||||| |||||||||||||||||||||
        a560 LNSGEFWPKNSFLKYPGEITVVICPTIPHASGSEAELMGKCEHLIETQQPLISGAGPFAA
               190        200        210        220        230        240 m560.pep KMPSETAX
             ||||||||
        a560 KMPSETAX
```

60

The following partial DNA sequence was identified in *N. meningitidis* <SEQ ID 1655>:

```
Nm561.seq.
   1 ATGATACTGC CAGCCCGTTT TTCAGACGGC ATCAGCCTTT CCCTGCGCCT

51 GAAACTCCTG ACCGGACTGT GGGTCGGGTT GGCGGCATTG TCTGTCGTTT
```

-continued

```
 101 TGACACTGCT GCTCTCTTTG CGTCTGGAAA ACGCGGCCTC CGTCATCGAA
 151 GAGGCGGGCA ACTTGAGAAT GCAGGCATAC CGTCTGGCAT ACATGGCGGG
 201 TGAAGGCTCG CCCCGTGCGC AAATTGACAA TCAGGTTGCC GAATTTGAAA
 251 AAAGTTTAAA ACGCATTGCC CAAAGCGATG CCATCCATCC GCTGATTCCT
 301 TCGGACACCC CTCTTGCTTA TGATTTGATA CAATCCATGC TGATTATAGA
 351 TTGGCAGGCA CACATCCTCC CCCCGCTCCA GTCCTACCGG CGACCGACTC
 401 AGGTCGATCT CTACCGCTTT GCCGGAAACA TCGAACTGTT TTTGCAGGCA
 451 TTGGAAAATG CCAACGAAAA AAACACATGG TGGCTCAGGC GTTTTCAATG
 501 GGCAATTATG TTGATGACGC TGGTGTCGTC TGTACTGATG CTGTTTTGGC
 551 ACCAGATTTG GGTTATCCGG CCGCTGCAGG CGTTAAGGGA AGGTGCGGAA
 601 CGCATCGGAC GGAGGTGTTT CGATATTCCG GTTCCCGAAG GCGGTACGCC
 651 GGAATTCAAA CAGGTCGGGC GTTGTTTCAA TCAAATGGGC GGCAGGTTGA
 701 AAATTTTATA TGATGATTTG GAAGGACAAG TCGCCGAGCA GACACGCAGT
 751 CTCGAAAAAC AAAATCAAAA CCTGACCCTG CTGTACCAAA CTACACGGGA
 801 CCTGCACCAA TCCTACATAC CGCAACAGGC TGCAGAACAT TTTCTAAACC
 851 GTATCCTGCC CGCCGTAGGA GCAGATTCCG GCAGAGTTTG TTTGGACGGC
 901 GGATCCGATG TTTATGTTTC CATTCATCAT GCGGATTGCG GCACAGCAGC
 951 TTCGGATTTG GGGAAGTACC ATGAGGAAAT CTTCCCCATT GAGTACCAGA
1001 ACGAAACATT GGGCAGGCTG TTGCTCAGCT TTCCAAACGG CATTTCTCTT
1051 GATGAAGACG ACCGCATCCT GCTTCAAACA CTAGGCAGGC AATTGGGCGT
1101 ATCGCTTGCC GGCGCAAAAC AGGAGGAAGA AAAACGCCTG CTTGCAGTAT
1151 TGCAGGAACG CAACCTGATT GCGCAAGGAT ACATGACAG CATCGCACAA
1201 GCATTAACGT TCCTAAACCT ACAGGTACAG ATGCTGGAAA CCGCCTTTGC
1251 CGAAAACAAA CGGGAGGAAG CCGCAGAAAA CATCAGCTTT ATCAAAACAG
1301 GCGTGCAGGA ATGTTATGAA GATGTCCGCG AACTGCTGCT CAACTTCCGT
1351 ACCAAAATCA GCAATAAAGA ATTTCCCGAA GCCGTTGCCG ACCTATTCGC
1401 CCGCTTTACG CAACAAACCG GGATAACGGT CGAAACCGCC TGGGAAAACG
1451 GTTCGTTCCT GCCGCCTCAG GAAGCGCAGC TCCAAATGAT TTTTATCCTG
1501 CAGGAAAGCC TGTCCAACAT CCGCAAACAC GCCCGCGCCA CCCATGTAAA
1551 ATTCACCCTT TCCGAACACG GCGGACGCTT TACCATGACC ATCCAAGACA
1601 ACGGACAAGG TTTCGACACG GAGAAAATAG GAGAACCCAC GGGCAGCCAT
1651 GTCGGACTGC ACATCATGCA GGAGCGTGCC AAACGCATCC ATGCCGTTTT
1701 AGAAATCCGT TCCCAAGCTC AACAGGGAAC CACCGTCTCA TTGACGGTTG
1751 CATCTGAAGA AAGCTTGAAA TGA
```

This corresponds to the amino acid sequence <SEQ ID 1656; ORF 561>:

m561.pep

```
 1 MILPARFSDG ISLSLRLKLL TGLWVGLAAL SVVLTLLLSL RLENAASVIE

51 EAGNLRMQAY RLAYMAGEGS PRAQIDNQVA EFEKSLKRIA QSDAIHPLIP
```

-continued

```
101 SDTPLAYDLI QSMLIIDWQA HILPPLQSYR RPTQVDLYRF AGNIELFLQA

151 LENANEKNTW WLRRFQWAIM LMTLVSSVLM LFWHQIWVIR PLQALREGAE

201 RIGRRCFDIP VPEGGTPEFK QVGRCFNQMG GRLKILYDDL EGQVAEQTRS

251 LEKQNQNLTL LYQTTRDLHQ SYIPQQAAEH FLNRILPAVG ADSGRVCLDG

301 GSDVYVSIHH ADCGTAASDL GKYHEEIFPI EYQNETLGRL LLSFPNGISL

351 DEDDRILLQT LGRQLGVSLA GAKQEEEKRL LAVLQERNLI AQGLHDSIAQ

401 ALTFLNLQVQ MLETAFAENK REEAAENISF IKTGVQECYE DVRELLLNFR

451 TKISNKEFPE AVADLFARFT QQTGITVETA WENGSFLPPQ EAQLQMIFIL

501 QESLSNIRKH ARATHVKFTL SEHGGRFTMT IQDNGQGFDT EKIGEPTGSH

551 VGLHIMQERA KRIHAVLEIR SQAQQGTTVS LTVASEESLK *
```

Computer analysis of this amino acid sequence gave the following results:
Homology with a Predicted ORF from *N. gonorrhoeae*

```
    m561/g561  89.7% identity in 223 aa overlap 10        20        30        40        50        60
    m561.pep  MILPARFSDGISLSLRLKLLTGLWVGLAALSVVLTLLLSLRLENAASVIEEAGNLRMQAY
              ||||:||||| ||||||||||||||||||||||||||||:||||||||||||||||:|||
    g561      MILPTRFSDGIPLSLRLKLLTGLWVGLAALSVVLTLLLSFRLENAASVIEEAGNLKMQAY
                  10        20        30        40        50        60

70        80        90       100       110       120
    m561.pep  RLAYMAGEGSPRAQIDNQVAEFEKSLKRIAQSDAIHPLIPSDTPLAYDLIQSMLIIDWQA
              |||||||||||||||||||:||||||||||:||||||||||:||||||||||||||||||
    g561      RLAYMAGEGSPRAQIDNQIAEFEKSLKRISQSDAIHPLIPSDNPLAYDLIQSMLIIDWQA
                  70        80        90       100       110       120

130       140       150       160       170       180
    m561.pep  HILPPLQSYRRPTQVDLYRFAGNIELFLQALENANEKNTWWLRRFQWAIMLMTLVSSVLM
              :||||||:||||||::||||||||||||||||||:||||||||||||:||||||||||||
    g561      NILPPLQAYRRPTQIELYRFAGNIELFLQALENAGEKNTWWLRRFQWVIMLMTLVSSVLM
                 130       140       150       160       170       180

190       200       210       220       230       240
    m561.pep  LFWHQIWVIRPLQALREGAERIGRRCFDIPVPEGGTPEFKQVGRCFNQMGGRLKILYDDL
              ||||||||||||||||||||||||:| |||||||   |: ::  |
    g561      LFWHQIWVIRPLQALREGAERIGQRHFDIPVPEDVRPNSNRSGGVSTKWRSGX
                 190       200       210       220       230

250       260       270       280       290       300
    m561.pep  EGQVAEQTRSLEKQNQNLTLLYQTTRDLHQSYIPQQAAEHFLNRILPAVGADSGRVCLDG
```

The following partial DNA sequence was identified in *N. meningitidis* <SEQ ID 1657>:

```
a561.seq
    1 ATGATACTGC CAGCCCGTTT TTCAGACGGC ATCAGCCTTT CCCTGCGCCT

51 GAAACTCCTG ACCGGACTGT GGGTCGGGTT GGCGGCATTG TCTGTCGTTT

101 TGACACTGCT GCTCTCTTTG CGTCTGGAAA ACGCGGCCTC CGTCATCGAA

151 GAGGCGGGCA ACTTGAGAAT GCAGGCATAC CGTCTGGCAT ACATGGCGGG

201 TGAAGGCTCG CCCCGTGCGC AAATTGACAA TCAGGTTGCC GAATTTGAAA

251 AAAGTTTAAA ACGCATTGCC CAAAGCGATG CCATCCATCC GCTGATTCCT

301 TCGGACACCC CTCTTGCTTA TGATTTGATA CAATCCATGC TGATTATAGA

351 TTGGCAGGCA CACATCCTCC CCCCGCTCCA GTCCTACCGG CGACCGACTC

401 AGGTCGATCT CTACCGCTTT GCCGGAAACA TCGAACTGTT TTTGCAGGCA
```

```
 451 TTGGAAAATG CCAACGAAAA AAACACATGG TGGCTCAGGC GTTTTCAATG

501 GGCAATTATG TTGATGACGC TGGTGTCGTC TGTACTGATG CTGTTTTGGC

551 ACCAGATTTG GGTTATCCGG CCGCTGCAGG CGTTAAGGGA AGGTGCGGAA

601 CGCATCGGAC GGAGGTGTTT CGATATTCCG GTTCCCGAAG GCGGTACGCC

651 GGAATTCAAA CAGGTCGGGC GTTGTTTCAA TCAAATGGGC GGCAGGTTGA

701 AAATTTTATA TGATGATTTG GAAGGACAAG TCGCCGAGCA GACACGCAGT

751 CTCGAAAAAC AAAATCAAAA CCTGACCCTG CTGTACCAAA CTACACGGGA

801 TCTGCACCAA TCCTACATAC CGCAACAGGC TGCAGAACAT TTTCTAAACC

851 GTATCCTGCC CGCCGTAGGA GCAGATTCCG GCAGAGTTTG TTTGGACGGC

901 GGATCCGATG TTTATGTTTC CATTCATCAT GCGGATTGCG GCACAGCAGC

951 TTCGGATTTG GGAAGTACC ATGAGGAAAT CTTCCCCATT GAGTACCAGA

1001 ACGAAACATT GGGCAGGCTG TTGCTCAGCT TTCCAAACGG CATTTCTCTT

1051 GATGAAGACG ACCGCATCCT GCTTCAAACA CTAGGCAGGC AATTGGGCGT

1101 ATCGCTTGCC GGCGCAAAAC AGGAGGAAGA AAAACGCCTG CTTGCAGTAT

1151 TGCAGGAACG CAACCTGATT GCGCAAGGAT ACATGCAGAC ATCGCACAA

1201 GCATTAACGT TCCTAAACCT ACAGGTACAG ATGCTGGAAA CCGCCTTTGC

1251 CGAAAACAAA CGGGAGGAAG CCGCAGAAAA CATCGGCTTC ATCAAAACAG

1301 GCGTGCAGGA ATGTTATGAA GATGTCCGCG AACTGCTGCT CAACTTCCGT

1351 ACCAAAATCA GTAATAAAGA ATTTCCCGAA GCCGTTGCCG ACCTATTCTC

1401 GCGCTTTACG CAACAGACCG GCACGACTGT CGAAACCGCT TGGGAAAACG

1451 GCACGCACCT GCCTACACAG GACGAGCAGC TCCAAATGAT TTTCATCCTG

1501 CAAGAAAGCT TGTCCAACAT CCGAAAACAT GCCCACGCCA CCCATATCAA

1551 ATTCAGACTG CTCAAACAGG ATGGAAGTTT TACAATGACC ATTCAAGACA

1601 ACGGACAGGG TTTTGACACG GAAAACATTG GAGAACCATC GGGCAGCCAT

1651 GTCGGACTGC ATATCATGCA GGAGCGTGCC AAACGCATCC ATGCCGTTTT

1701 AGAAATCCGT TCCCAAGCTC AACAGGGAAC CACCGTCTCA TTGACGGTTG

1751 CATCTGAAGA AAGCTTGAAA TGA
```

This corresponds to the amino acid sequence <SEQ ID 45 1658; ORF 561.a>:

```
a561.pep

1 MILPARFSDG ISLSLRLKLL TGLWVGLAAL SVVLTLLLSL RLENAASVIE

51 EAGNLRMQAY RLAYMAGEGS PRAQIDNQVA EFEKSLKRIA QSDAIHPLIP

101 SDTPLAYDLI QSMLIIDWQA HILPPLQSYR RPTQVDLYRF AGNIELFLQA

151 LENANEKNTW WLRRFQWAIM LMTLVSSVLM LFWHQIWVIR PLQALREGAE

201 RIGRRCFDIP VPEGGTPEFK QVGRCFNQMG GRLKILYDDL EGQVAEQTRS

251 LEKQNQNLTL LYQTTRDLHQ SYIPQQAAEH FLNRILPAVG ADSGRVCLDG

301 GSDVYVSIHH ADCGTAASDL GKYHEEIFPI EYQNETLGRL LLSFPNGISL

351 DEDDRILLQT LGRQLGVSLA GAKQEEEKRL LAVLQERNLI AQGLHDSIAQ

401 ALTFLNLQVQ MLETAFAENK REEAAENIGF IKTGVQECYE DVRELLLNFR

451 TKISNKEFPE AVADLFSRFT QQTGTTVETA WENGTHLPTQ DEQLQMIFIL
```

```
    501 QESLSNIRKH AHATHIKFRL LKQDGSFTMT IQDNGQGFDT ENIGEPSGSH

551 VGLHIMQERA KRIHAVLEIR SQAQQGTTVS LTVASEESLK * m561/a561  96.9% identity in 590 aa overlap 10         20         30         40         50         60
m561.pep  MILPARFSDGISLSLRLKLLTGLWVGLAALSVVLTLLLSLRLENAASVIEEAGNLRMQAY
          ||||||||||||||||||||||||||||||||||||||||||||||||||||||||||||
a561      MILPARFSDGISLSLRLKLLTGLWVGLAALSVVLTLLLSLRLENAASVIEEAGNLRMQAY
                  10         20         30         40         50         60

70         80         90        100        110        120
m561.pep  RLAYMAGEGSPRAQIDNQVAEFEKSLKRIAQSDAIHPLIPSDTPLAYDLIQSMLIIDWQA
          ||||||||||||||||||||||||||||||||||||||||||||||||||||||||||||
a561      RLAYMAGEGSPRAQIDNQVAEFEKSLKRIAQSDAIHPLIPSDTPLAYDLIQSMLIIDWQA
                  70         80         90        100        110        120

130        140        150        160        170        180
m561.pep  HILPPLQSYRRPTQVDLYRFAGNIELFLQALENANEKNTWWLRRFQWAIMLMTLVSSVLM
          ||||||||||||||||||||||||||||||||||||||||||||||||||||||||||||
a561      HILPPLQSYRRPTQVDLYRFAGNIELFLQALENANEKNTWWLRRFQWAIMLMTLVSSVLM
                 130        140        150        160        170        180

190        200        210        220        230        240
m561.pep  LFWHQIWVIRPLQALREGAERIGRRCFDIPVPEGGTPEFKQVGRCFNQMGGRLKILYDDL
          ||||||||||||||||||||||||||||||||||||||||||||||||||||||||||||
a561      LFWHQIWVIRPLQALREGAERIGRRCFDIPVPEGGTPEFKQVGRCFNQMGGRLKILYDDL
                 190        200        210        220        230        240

250        260        270        280        290        300
m561.pep  EGQVAEQTRSLEKQNQNLTLLYQTTRDLHQSYIPQQAAEHFLNRILPAVGADSGRVCLDG
          ||||||||||||||||||||||||||||||||||||||||||||||||||||||||||||
a561      EGQVAEQTRSLEKQNQNLTLLYQTTRDLHQSYIPQQAAEHFLNRILPAVGADSGRVCLDG
                 250        260        270        280        290        300

310        320        330        340        350        360
m561.pep  GSDVYVSIHHADCGTAASDLGKYHEEIFPIEYQNETLGRLLLSFPNGISLDEDDRILLQT
          ||||||||||||||||||||||||||||||||||||||||||||||||||||||||||||
a561      GSDVYVSIHHADCGTAASDLGKYHEEIFPIEYQNETLGRLLLSFPNGISLDEDDRILLQT
                 310        320        330        340        350        360

370        380        390        400        410        420
m561.pep  LGRQLGVSLAGAKQEEEKRLLAVLQERNLIAQGLHDSIAQALTFLNLQVQMLETAFAENK
          ||||||||||||||||||||||||||||||||||||||||||||||||||||||||||||
a561      LGRQLGVSLAGAKQEEEKRLLAVLQERNLIAQGLHDSIAQALTFLNLQVQMLETAFAENK
                 370        380        390        400        410        420

430        440        450        460        470        480
m561.pep  REEAAENISFIKTGVQECYEDVRELLLNFRTKISNKEFPEAVADLFARFTQQTGITVETA
          ||||||||:|||||||||||||||||||||||||||||||||||||:|||||  |||||
a561      REEAAENIGFIKTGVQECYEDVRELLLNFRTKISNKEFPEAVADLFSRFTQQTGTTVETA
                 430        440        450        460        470        480

490        500        510        520        530        540
m561.pep  WENGSFLPPQEAQLQMIFILQESLSNIRKHARATHVKFTLSEHGGRFTMTIQDNGQGFDT
          ||||: || |: ||||||||||||||||||:|||:|| |  ::  | |||||||||||||
a561      WENGTHLPTQDEQLQMIFILQESLSNIRKHAHATHIKFRLLKDGSFTMTIQDNGQGFDT
                 490        500        510        520        530        540

550        560        570        580        590
m561.pep  EKIGEPTGSHVGLHIMQERAKRIHAVLEIRSQAQQGTTVSLTVASEESLKX
          |:||||:|||||||||||||||||||||||||||||||||||||||||||
a561      ENIGEPSGSHVGLHIMQERAKRIHAVLEIRSQAQQGTTVSLTVASEESLKX
                 550        560        570        580        590
```

The following partial DNA sequence was identified in *N. gonorrhoeae* <SEQ ID 1659>:

```
g562.seq..
   1 atggcaagcc cgtcgagtct gcctttcaat tcgggcaaga ccaaaccgac 51 ggcttttgcc gcgccggttt tggtcggaat catgttttcc acgccgctgc 101 gggcgcggcg caggtctttg tggcgcacgt cggtaacggt ttggtcgttg 151 gtcagtgcgt ggatggtggt cattgcgcct ttgacgatgc cgacgctttc
```

-continued

```
201 gctcaacact ttggcaaccg gcgagaggca gttggtggtg caggaagcgt 251 tggaaacgac ggtcatgtcg gcggtcagga cgctgtcgtt cacgccgtac 301 acgacggttg catcgacatc gtcgccgccc ggtgcggaaa tgaggacttt 351 tttcgcgccg ctttcgaggt ggattttggc tttttctttg ctggtgaacg 401 cgccggtgca ttccatgacc aaatcgacac cgagttcttt ccacggcagt 451 tcggcagggt gcgggtcga gaagaagggg attttgtcgc cgttgacgat 501 gaggttgccg ccgtcgtggg atacgtcggc ttcaaagcgt ccgtgtacgg 551 tgtcgaattt ggtcagatgg gcgttggttt caaggctgcc gctggcgttg 601 acggcgacga tttggagttg gtcttga
```

This corresponds to the amino acid sequence <SEQ ID 1660; ORF 562.ng>:

```
g562.pep
  1 MASPSSLPFN SGKTKPTAFA APVLVGIMFS TPLRARRRSL WRTSVTVWSL

51 VSAWMVVIAP LTMPTLSLNT LATGERQLVV QEALETTVMS AVRTLSFTPY

101 TTVASTSSPP GAEMRTFFAP LSRWILAFSL LVNAPVHSMT KSTPSSFHGS

151 SAGLRVEKKG ILSPLTMRLP PSWDTSASKR PCTVSNLVRW ALVSRLPLAL

201 TATIWSWS*
```

The following partial DNA sequence was identified in *N. meningitidis* <SEQ ID 1661>:

```
m562.seq
  1 ATGGCAAGCC CGTCGAGCCT GCCTTTCAAT TCGGGCAGTA CCAAACCGAC

51 GGCTTTTGCC GCGCCGGTTT TGGTCGGAAT CATGTTTTCC ACGCCGCTGC

101 GGGCGCGGCG CAGGTCTTTG TGGCGCACGT CGGTAACGGT TTGGTCGTTG

151 GTCAGCGCGT GGATGGTGGT CATCGCGCCT TTGACGATGC CGACGCTTTC

201 GCTCAACACT TTGGCAACCG GCGAGAGGCA GTTGGTGGTG CAGGAAGCGT

251 TGGAAACGAC GGTCATGTCG GCGGTCAGGA CGCTGTCGTT CACGCCGTAC

301 ACGACGGTTG CATCGACATC GTCGCCGCCC GGTGCGGAAA TGAGGACTTT

351 TTTCGCGCCG CTTTCGAGGT GGATTTTGGC TTTTTCTTTG CTGGTGAACG

401 CGCCGGTGCA TTCCATGACC AAATCGACAC CGAGTTCTTT CCACGGCAGT

451 TCGGCAGGGT GCGGGTCGA GAAGAAGGGG ATTTTGTCGC CGTTGACGAT

501 GAGGTTGCCG CCGTCGTGGG ATACGTCGGC TTCAAAGCGT CCGTGCACGG

551 TGTCGAATTT GGTCAGATGG GCGTTGGTTT CAAGGCTGCC GCTGGCGTTG

601 ACGGCGACGA GTTGGAGTTG GTCTTGA
```

This corresponds to the amino acid sequence <SEQ ID 1662; ORF 562>:

```
m562.pep
  1 MASPSSLPFN SGSTKPTAFA APVLVGIMFS TPLRARRRSL WRTSVTVWSL

51 VSAWMVVIAP LTMPTLSLNT LATGERQLVV QEALETTVMS AVRTLSFTPY

101 TTVASTSSPP GAEMRTFFAP LSRWILAFSL LVNAPVHSMT KSTPSSFHGS
```

-continued

```
151 SAGLRVEKKG ILSPLTMRLP PSWDTSASKR PCTVSNLVRW ALVSRLPLAL

201 TATSWSWS*
```

Computer analysis of this amino acid sequence gave the following results:
Homology with a Predicted ORF from *N. gonorrhoeae*

```
    m562/g562  99.0% identity in 208 aa overlap 10         20         30         40         50         60
    m562.pep  MASPSSLPFNSGSTKPTAFAAPVLVGIMFSTPLRARRRSLWRTSVTVWSLVSAWMVVIAP
              ||||||||||||:|||||||||||||||||||||||||||||||||||||||||||||||
    g562      MASPSSLPFNSGKTKPTAFAAPVLVGIMFSTPLRARRRSLWRTSVTVWSLVSAWMVVIAP
                  10         20         30         40         50         60

70         80         90        100        110        120
    m562.pep  LTMPTLSLNTLATGERQLVVQEALETTVMSAVRTLSFTPYTTVASTSSPPGAEMRTFFAP
              ||||||||||||||||||||||||||||||||||||||||||||||||||||||||||||
    g562      LTMPTLSLNTLATGERQLVVQEALETTVMSAVRTLSFTPYTTVASTSSPPGAEMRTFFAP
                  70         80         90        100        110        120

130        140        150        160        170        180
    m562.pep  LSRWILAFSLLVNAPVHSMTKSTPSSFHGSSAGLRVEKKGILSPLTMRLPPSWDTSASKR
              ||||||||||||||||||||||||||||||||||||||||||||||||||||||||||||
    g562      LSRWILAFSLLVNAPVHSMTKSTPSSFHGSSAGLRVEKKGILSPLTMRLPPSWDTSASKR
                 130        140        150        160        170        180

190        200        210        220        230        240
    m562.pep  PCTVSNLVRWALVSRLPLALTATSWSWSX
              |||||||||||||||||||||||| |||||
    g562      PCTVSNLVRWALVSRLPLALTATIWSWSX
```

The following partial DNA sequence was identified in *N. meningitidis* <SEQ ID 1663>:

```
a562.seq
  1 ATGGCAAGCC CGTCGAGTTT GTCTTTCAAT TCGGGCAGTA CCAAACCGAC

51 GGCTTTTGCC GCGCCAGTTT TGGTCGGAAT CATGTTTTCC ACGCCGCTGC

101 GGGCGCGGCG CAGGTCTTTG TGGCGCACGT CGGTAACGGT TTGGTCGTTG

151 GTCAGCGCGT GGATGGTGGT CATCGCGCCT TTGACGATGC CGACGCTTTC

201 GCTCAACACT TTGGCAACCG GCGAGAGGCA GTTGGTGGTG CAGGAAGCGT

251 TGGAAACGAC GGTCATGTCG GCGGTCAGGA TGCTGTCGTT CACGCCGTAC

301 ACGACGGTTG CATCGACATC GTCGCCGCCC GGTGCGGAAA TGAGGACTTT

351 TTTCGCGCCG CTTTCCAGAT GAACTTTGGC TTTTTCTTTG CTGGTGAACG

401 CGCCGGTGCA TTCCATGACC AAATCGACAC CGAGTTCTTT CCACGGCAGT

451 TCGGCAGGGT TGCGGGTCNA GAAGAANGGG ATTTTGTCGC CGTTGACGAT

501 GAGGTTGCCG CCGTCGTGGG ATACGTCGGC TTCAAAGCGT CCGTGCACGG

551 TGTCGAATTT GGTGAGGTGG GCGTTGGTTT CAAGGCTGCC GCTGGCGTTG

601 ACGGCGACGA TTTGGAGTTG GTCTTGA
```

This corresponds to the amino acid sequence <SEQ ID 1664; ORF 562.a>:

```
a562.pep
      1 MASPSSLSFN SGSTKPTAFA APVLVGIMFS TPLRARRRSL WRTSVTVWSL

51 VSAWMVVIAP LTMPTLSLNT LATGERQLVV QEALETTVMS AVRMLSFTPY
```

```
    101 TTVASTSSPP GAEMRTFFAP LSR*TLAFSL LVNAPVHSMT KSTPSSFHGS

151 SAGLRVXKXG ILSPLTMRLP PSWDTSASKR PCTVSNLVRW ALVSRLPLAL

201 TATIWSWS*
```

```
m562/a562  96.6% identity in 208 aa overlap
                  10         20         30         40         50         60
m562.pep  MASPSSLPFNSGSTKPTAFAAPVLVGIMFSTPLRARRRSLWRTSVTVWSLVSAWMVVIAP
          ||||||| ||||||||||||||||||||||||||||||||||||||||||||||||||||
a562      MASPSSLSFNSGSTKPTAFAAPVLVGIMFSTPLRARRRSLWRTSVTVWSLVSAWMVVIAP
                  10         20         30         40         50         60

70         80         90        100        110        120
m562.pep  LTMPTLSLNTLATGERQLVVQEALETTVMSAVRTLSFTPYTTVASTSSPPGAEMRTFFAP
          |||||||||||||||||||||||||||||||||||| |||||||||||||||||||||||
a562      LTMPTLSLNTLATGERQLVVQEALETTVMSAVRMLSFTPYTTVASTSSPPGAEMRTFFAP
                  70         80         90        100        110        120

130        140        150        160        170        180
m562.pep  LSRWILAFSLLVNAPVHSMTKSTPSSFHGSSAGLRVEKKGILSPLTMRLPPSWDTSASKR
          |||   ||||||||||||||||||||||||||||||| | ||||||||||||||||||||
a562      LSRXTLAFSLLVNAPVHSMTKSTPSSFHGSSAGLRVXKXGILSPLTMRLPPSWDTSASKR
                 130        140        150        160        170        180

190        200      209
m562.pep  PCTVSNLVRWALVSRLPLALTATSWSWSX
          |||||||||||||||||||||||| ||||
a562      PCTVSNLVRWALVSRLPLALTATIWSWSX
                 190        200
```

The following partial DNA sequence was identified in *N. gonorrhoeae* <SEQ ID 1665>:

```
g563.seq
   1 ATGAACAAAA CCCTCTATCG TGTGATTTTC AACCGCAAAC GCGGTGCTGT

51 GGTAGCTGTT GCCGAAACCA CCAAGCGCGA AGGTAAAAGC TGTGCCGATA

101 GTGGTTCGGG CAGCGTTTAT GTGAAATCCG TTTCTTTCAT TCCTACTCAT

151 TCCAAAGCCT TTTGTTTTTC TGCATTAGGC TTTTCTTTAT GTTTGGCTTT

201 GGGTACGGTC AATATTGCTT TTGCTGACGG CATTATTACT GATAAAGCTG

251 CTCCTAAAAC CCAACAAGCC ACGATTCTGC AAACAGGTAA CGGCATACCG

301 CAAGTCAATA TTCAAACCcc tACTTCGGCa ggGGTTTCTG TTAATCAATA

351 TGCCCAGTTT GATGTGGGTA ATcgcGGGGC GATTTTAAAC AACAGTCGCA

401 GCAACACCCA AACACAGCTA GGCGGTTGGA TTCAAGGCAA TCCTTGGTTG

451 ACAAGGGGCG AAGCACGTGT GGTTGTAAAC CAAATCAACA GCAGCCATCC

501 TTCACAACTG AATGGCTATA TTGAAGTGGG TGGACGACGT GCAGAAGTCG

551 TTATTGCCAA TCCGGCAGGG ATTGCAGTCA ATGGTGGTGG TTTTATCAAT

601 GCTTCCCGTG CCACTTTGAC GACAGGCCAA CCGCAATATC AAGCAGGAGA

651 CTTTAGCGGC TTTAAGATAA GGCAAGGCAA TGCTGTAATC GCCGGACACG

701 GTTTGGATGC CCGTGATACC GATTTCACAC GTATTCTTTT GTATGCCAAC

751 AAAATCACCT TGATCAGTAC GGCCGAACAA GCAGGCATTC GTAATCAAGG

801 GCAGTTGTTT GCTTCTTCCG GTAATGTGGC GATTGATGCA AATGGCCGTT

851 TGGTCAATAG TGGCACGATG GCTGCCGCCA ATGTGCAAGA TATGAATAAT

901 ACAGCGGAAC ACAAAGTCAA TATCCGCAGT CAAGCCTTTG AAAACAGCGG

951 TACGGCGGTA TCGCAACAAG GCACTCAAAT TCACAGTCAA TCGATTCAAA

1001 ACACTGGCAA ATTATTGTCG GCAGGAACAG AGGATTTAGC CGTTTCAGGC
```

-continued

```
1051 AGCCTGAACA ATCAAAATGG CGAAATAGCG ACCAATCAAC AACTGATTAT
1101 TCACGATGGT CAGCAATCTA CCGTTGTCAT TGATAATACG AATGGCACGA
1151 TACAATCAGG CCGTGATGTT GCCATTCAGG CAAAATCGTT ATCCAACAAC
1201 GGCACACTTG CCGCTGATAA TAAACTGGAT ATTGCGTTAC AAGATGATTT
1251 TTATGTAGAA CGCAAGATCG TGGCGGGCAA TGAATTGTCG CTCAGTACAC
1301 GAGGCAGCCT GAAAAATTCA CATACCTTGC AAGCAGGAAA ACGCATTCGG
1351 ATTAAAGCAA ATAACCTTGA TAATGCAGTA CAAGGCAACA TTCAATCCGG
1401 CGGTACGACA GACATTGGCA CGCAGCACAA TTTAACCAAT AGAGGCTTGA
1451 TTGACGGACA ACAAACCAAA ATCCAAGCCG GCAAATGAA TAATATCGGT
1501 ACAGGTCGGA TTTATGGCGA CAATATCGCT ATTGCGGCTA CCCGCTTAGA
1551 CAATCAAGAT GAAAACGGTA CAGGTGCCGC CATTGCGGCA CGCGAAAACC
1601 TGAATTTAGG CATTGAACAA TTAAATAACC GTGAAAACAG TCTGATTTAC
1651 AGCGGTAACG ATATGGCGGT TGGCGGCGCA TTAGATACCA ATGACCAAGC
1701 CACAGGCAAA GCCCAAGGA TACACAATGC CGGCGCAATC ATTGAAGCTG
1751 CAGGCAAAAT GCGTTTAGGT GTAGAAAAGC TGCACAATAC CAATGAGCAT
1801 TTGAAAACGC AGTTGGTAGA ACAGGGCGC GAGCGTATTG TTGATTACGA
1851 AGCATTTGGA CGACACGAAT TATTGCGAGA AGGCACGCAA CATGAATTAG
1901 GCTGGTTTGT CTACAACAAT GAATCAGACC ACTTACGCAC CCCTGATGGA
1951 GTGGCGCATG AAAATTGGCA TAAATACGAT TATGAAAAAG TAACGCAAGA
2001 AACTCAAGTA ACCGGAACTG CGCCTGCTAA ATCATTGCA GGTAGCGATT
2051 TGATTATTGA TAGCAAAGCA GTCTTCAACA GCGACAGCCG AATCATTGCC
2101 GGCGGCCAAT TGCTTGTGCA AACAGAAAAA GACGGTTTGC ATAACGAGCA
2151 AACCTTTGGC GAGAAGAAAG TCTTCAGCGA AAATGGTAAG TTGCACAACT
2201 ACTGGCGTGC GCGTCGTAAA GGACATGATG AAACAGGGCA TCGTGAACAA
2251 AATTATACTT TGCCGGAGGA AATCACACGC GACATTTCAC TGGGTTCATT
2301 TGCCTATGAA TCGCATAGCA AAGCATTAAG CCGTCATGCG CCCAGCCAAG
2351 GCACTGAGTT GCCACAAAGT AACCGGGATA ATATCCGTAC TGCGAAAAGC
2401 AACGGTATTT CGCTACCCTA TACGCCCAAT TCTTTTACCC CATTACCCGG
2451 CAGCAGCTTA TACATTATCA ATCCTGCCAA TAAAGGCTAT CTTGTTGAAA
2501 CCGATCCACG CTTTGCCAAC TACCGTCAAT GGTTGGGTAG TGACTATATG
2551 CTGGGCAGCC TCAAACTAGA CCCAAACAAT TTACATAAAC GTTTGGGTGA
2601 TGGTTATTAC GAGCAACGTT AATCAATGA ACAAATCGCA GAGCTGACAG
2651 GGCATCGTCG TTTAGACGGT TATCAAAACG ACGAAGAACA ATTTAAAGCC
2701 TTAATGGATA ATGGCGCGAC TGCGGCACGT TCGATGAATC TCAGCGTTGG
2751 CATTGCATTA AGTGCCGAGC AAGCAGCGCA ACTGACCAGC GATATTGTTT
2801 GGTTGGTACA AAAAGAAGTT AAACTTCCTG ATGGCGGCAC ACAAACCGTA
2851 TTGATGCCAC AGGTTTATGT ACGCGTTAAA AATGGCGGCA TAGACGGTAA
2901 AGGTGCATTG TTGTCAGGCA GCAATACACA AATCAATGTT TCAGGCAGCC
2951 TGAAAAACTC AGGCACGATT GCAGGGCGCA ATGCGCTTAT TATCAATACC
3001 GATACGCTAG ACAATATCGG TGGGCGTATT CATGCGCAAA AATCAGCGGT
3051 TACGGCCACA CAAGACATCA ATAATATTGG CGGCATTCTT TCTGCCGAAC
```

-continued

```
3101 AGACATTATT GCTCAATGCG GGTAACAACA TCAACAACCA AAGCACGGCC

3151 AAGAGCAGTC AAAATGCACA AGGTAGCAGC ACCTACCTAG ACCGAATGGC

3201 AGGTATTTAT ATCACAGGCA AAGAAAAAGG TGTTTTAGCA GCGCAGGCAG

3251 GCAAAGACAT CAACATCATT GCCGGTCAAA TCAGCAATCA ATCAGATCAA

3301 GGGCAAACCC GGCTGCAGGC AGGACGCGAC ATTAACCTGG ATACGGTACA

3351 AACCGGCAAA TATCAAGAAA TCCATTTTGA TGCCGATAAC CATACCATCC

3401 GAGGTTCAAC GAACGAAGTC GGCAGCAGCA TTCAAACAAA GGCGATGTT

3451 ACCCtatTGT CAGGGAATAA TCTCAATGCC AAAGCTGCCG AAGTCGGCAG

3501 CGCAAAAGGC ACACTTGCCG TGTATGCTAA AAATGACATT ACTATCAGCT

3551 CAGGCATCCA TGCCGGCCAA GTTGATGATG CGTCCAAACA TACAGGCAGA

3601 AGCGGCGGCG GTAATAAATT AGTCATTACC GATAAAGCCC AAAGTCATCA

3651 CGAAACTGCT CAAAGCAGCA CCTTTGAAGG CAAGCAAGTT GTATTGCAGG

3701 CAGGAAACGA TGCCAACATC CTTGGCAGTA ATGTTATTTC CGATAATGGC

3751 ACCCGGATTC AAGCAGGCAA TCATGTTCGC ATTGGTACAA CCCAAACTCA

3801 AAGCCAAAGC GAAACCTATC ATCAAACCCA AAATCAGGA TTGATGAGTG

3851 CAGGTATCGG CTTCACTATT GGCAGCAAGA CAAACACACA AGAAAACCAA

3901 TCCCAAAGCA ACGAACATAC AGGCAGTACC GTAGGCAGCC TGAAAGGCGA

3951 TACCACCATT GTTGCAAGCA ACACTACGA ACAAACCGGC AGCAACGTTT

4001 CCAGCCCTGA GGGCAACAAC CTTATCAGCA CGCAAAGTAT GGATATTGGC

4051 GCAGCACAAA ACCAATTAAA CAGCAAAACC ACCCAAACCT ACGAACAAAA

4101 AGGCTTAACG GTGGGCATTC AGTTCGCCCG TTACCGATTT GGCACAACAA

4151 GCGATTGCCG TAGCACACAA AGCAGCAAAC AAGTCGGACA AAGCAAAAAC

4201 GACCGCGTTA ATGCCATGGC GGCTGCCAAT GCAGGTTGGC AGGCCTATCA

4251 AACAGGCAAA GGCGCACAAA ACTTAGCCAA TGGTACAACC AATGCCAAAC

4301 AAGTCAGCAT CTCCATAACC TACGGCGAAC AGCAAAACCG ACAAACCACC

4351 CAAGTTCAAG CCAATCAAGC CAAGCGAGT CAAATTCAAG CAGGCGGCAA

4401 AACTACCCTT TATTGCCGAA GGTGCGGCGA ACAATCCAAT ATCAACATCA

4451 CAGGCTCAGG TGTTTCAGGC AGAGCAGGAA CCGGCCTGAT TGCCGATAAG

4501 CAAATCCATC TGCAATCAGC CGAGCAAAGC AATACCGAAC GCAGCCAAAA

4551 CAAATCAGCA GGCTGGAACG CAGGTGCTGC CGTATCATTC GGACAAGGAG

4601 GCTGGTCATT AGGCGTTGCC GCAGGCGGCA ATGTCGGCAA AGGCTACGGC

4651 TATGGCGATA GCGTAACCCA CCGCCATAGC CATATTGGCG ACAAAGGCAG

4701 CCAAACCCTT ATCCAAAGTG GTGGCGATAC CATCATCAAA GGCGCGCAAG

4751 TACGCGGCAA AGGCGTACAA GTCAATGCCA AAAACCTAAG CATTCAAAGT

4801 GTACAAGATA GAGAAACTTA TCAAAGCAAA CAACAAAACG CCGGTGCACA

4851 AGTTACCGTA GGTTATGGCT TCAGTGCCAG TGGCGATTAC AGCCAAAGCA

4901 AAATCCGAGC CGACCATGCT TCGGTAACCG AGCAAAGCGG TATTTATGCC

4951 GGAGAAGACG GCTATCAAAT CAAGGTCGGA AACCATACAG GCCTCAAAGG

5001 CGGCATCATC ACCAGCAGCC AAAGCGCAAA AGACAAGGGT AAAAACCGAT

5051 TCAGCACAGG CACACTCGCC GGCAGTGATA TTCAAAATTA CAGCCAATAC
```

```
-continued
5101 GAAGGAAAAA GTTTTGGATT GGGTGCCAGC GTTGCCGTAA GCGGCAAAAC

5151 ACTGGGACAG GGCGCAAAAA ATAAACCTCA AGACAAACAC CTGACAAGCA

5201 TAGCCGATAA AAACGGCGCA AGTTCATCAG TAGGGTACGG CAGCGACAGC

5251 GACAGTCAAA GCAGCATCAC AAAAAGCGGC ATCAATACCC CCAAAAACAT

5301 TCAAATCACA GACGAAGCCG CACAAATCAG GCTGACAGGC AAAATAGCGG

5351 CACAAACCAA AGCCGATATT GATACAAACG TAACCACAGA CACCGCCGAA

5401 CGACATTCGG GCAGCCTGAA AAACATATTT GACAAAGATA GAGTGCAAAG

5451 TGAACTGGAT TTACAAAgaA CCGTCAGCCA AGATTTTAGT AAAAATGTTC

5501 AACAAACCAA TACCGAGATT AACCAACATT TAGACAAACT CAAAGCAGAC

5551 AAAGAAGCAG CCGAAACAGC AGCAGCCGAG GCATTAGCCA ATGGCGATAT

5601 GGAAACTGCC AAACGCAAAG CCCATGAAGC TCAAGATGCG GCAGCAAAAG

5651 CAGATAATTG GCAACAAGGC AAAGTCATTC TCAACATGTT AGCCTCAGGT

5701 TTAGCTGAGC CGACCCAAAG CGGAGCgggc ATCGCTGCGG CTACCGCATC

5751 GCCagaCGTA TCGTATGCGA TTGGACAGCA CTTTAAagaT TTAGCCGGTC

5801 AAAACGCGAA TGGCAAACTA ACCGCCAGTC AagaAACCGC TCACGTTCTT

5851 GCCCACGCGG TATTAGGAGC AGCGGTTGCC GCAGCATGAG GCAACAATGC

5901 CCCGGCAGGA GCATTGGGTG CGGGCGGGTc ggAagcggCC GCCCCAATCA

5951 TCGGCAAATG GCTGTACGGC AAAGGAGAcg gcggcagccT GAATgcggag 6001 gaaaAAGaga CCGTTTCGGC GATTACAAGG ATGCTGggta cGgctGCCGG 6051 AGCAGCTGAG GGAAACTCGT CCGCCGATGC TGTGTGGGGT TGTTTTcaaa 6101 cggctTCaga TTTCGCTTCC TCTTTTTCAT ATCCTATAAA CATGTGA
```

35

This corresponds to the amino acid sequence <SEQ ID 1666; ORF 563.ng>:

```
g563.pep..
  1 MNKTLYRVIF NRKRGAVVAV AETTKREGKS CADSGSGSVY VKSVSFIPTH

51 SKAFCFSALG FSLCLALGTV NIAFADGIIT DKAAPKTQQA TILQTGNGIP

101 QVNIQTPTSA GVSVNQYAQF DVGNRGAILN NSRSNTQTQL GGWIQGNPWL

151 TRGEARVVVN QINSSHPSQL NGYIEVGGRR AEVVIANPAG IAVNGGGFIN

201 ASRATLTTGQ PQYQAGDFSG FKIRQGNAVI AGHGLDARDT DFTRILLYAN

251 KITLISTAEQ AGIRNQGQLF ASSGNVAIDA NGRLVNSGTM AAANVQDMNN

301 TAEHKVNIRS QAFENSGTAV SQQGTQIHSQ SIQNTGKLLS AGTEDLAVSG

351 SLNNQNGEIA TNQQLIIHDG QQSTVVIDNT NGTIQSGRDV AIQAKSLSNN

401 GTLAADNKLD IALQDDFYVE RKIVAGNELS LSTRGSLKNS HTLQAGKRIR

451 IKANNLDNAV QGNIQSGGTT DIGTQHNLTN RGLIDGQQTK IQAGQMNNIG

501 TGRIYGDNIA IAATRLDNQD ENGTGAAIAA RENLNLGIEQ LNNRENSLIY

551 SGNDMAVGGA LDTNDQATGK AQRIHNAGAI IEAAGKMRLG VEKLHNTNEH

601 LKTQLVETGR ERIVDYEAFG RHELLREGTQ HELGWFVYNN ESDHLRTPDG

651 VAHENWHKYD YEKVTQETQV TGTAPAKIIA GSDLIIDSKA VFNSDSRIIA

701 GGQLLVQTEK DGLHNEQTFG EKKVFSENGK LHNYWRARRK GHDETGHREQ

751 NYTLPEEITR DISLGSFAYE SHSKALSRHA PSQGTELPQS NRDNIRTAKS
```

-continued

```
 801 NGISLPYTPN SFTPLPGSSL YIINPANKGY LVETDPRFAN YRQWLGSDYM
 851 LGSLKLDPNN LHKRLGDGYY EQRLINEQIA ELTGHRRLDG YQNDEEQFKA
 901 LMDNGATAAR SMNLSVGIAL SAEQAAQLTS DIVWLVQKEV KLPDGGTQTV
 951 LMPQVYVRVK NGGIDGKGAL LSGSNTQINV SGSLKNSGTI AGRNALIINT
1001 DTLDNIGGRI HAQKSAVTAT QDINNIGGIL SAEQTLLLNA GNNINNQSTA

1051 KSSQNAQGSS TYLDRMAGIY ITGKEKGVLA AQAGKDINII AGQISNQSDQ

1101 GQTRLQAGRD INLDTVQTGK YQEIHFDADN HTIRGSTNEV GSSIQTKGDV

1151 TLLSGNNLNA KAAEVGSAKG TLAVYAKNDI TISSGIHAGQ VDDASKHTGR

1201 SGGGNKLVIT DKAQSHHETA QSSTFEGKQV VLQAGNDANI LGSNVISDNG

1251 TRIQAGNHVR IGTTQTQSQS ETYHQTQKSG LMSAGIGFTI GSKTNTQENQ

1301 SQSNEHTGST VGSLKGDTTI VASKHYEQTG SNVSSPEGNN LISTQSMDIG

1351 AAQNQLNSKT TQTYEQKGLT VGIQFARYRF GTTSDCRSTQ SSKQVGQSKN

1401 DRVNAMAAAN AGWQAYQTGK GAQNLANGTT NAKQVSISIT YGEQQNRQTT

1451 QVQANQAQAS QIQAGGKTTL YCRRCGEQSN INITGSGVSG RAGTGLIADK

1501 QIHLQSAEQS NTERSQNKSA GWNAGAAVSF GQGGWSLGVA AGGNVGKGYG

1551 YGDSVTHRHS HIGDKGSQTL IQSGGDTIIK GAQVRGKGVQ VNAKNLSIQS

1601 VQDRETYQSK QQNAGAQVTV GYGFSASGDY SQSKIRADHA SVTEQSGIYA

1651 GEDGYQIKVG NHTGLKGGII TSSQSAKDKG KNRFSTGTLA GSDIQNYSQY

1701 EGKSFGLGAS VAVSGKTLGQ GAKNKPQDKH LTSIADKNGA SSSVGYGSDS

1751 DSQSSITKSG INTPKNIQIT DEAAQIRLTG KIAAQTKADI DTNVTTDTAE

1801 RHSGSLKNIF DKDRVQSELD LQRTVSQDFS KNVQQTNTEI NQHLDKLKAD

1851 KEAAETAAAE ALANGDMETA KRKAHEAQDA AAKADNWQQG KVILNMLASG

1901 LAEPTQSGAG IAAATASPDV SYAIGQHFKD LAGQNANGKL TASQETAHVL

1951 AHAVLGAAVA AAXGNNAPAG ALGAGGSEAA APIIGKWLYG KGDGGSLNAE

2001 EKETVSAITR MLGTAAGAAE GNSSADAVWG CFQTASDFAS SFSYPINM*
```

The following partial DNA sequence was identified in *N. meningitidis* <SEQ ID 1667>:

```
m563.seq..
   1 ATGAATAAAA CTCTCTATCG TGTAATTTTC AACCGCAAAC GTGGGGCTGT
  51 GGTAGCCGTT GCTGAAACTA CCAAGCGCGA AGGTAAAAGC TGTGCCGATA
 101 GTGATTCAGG CAGCGCTCAT GTGAAATCTG TTCCTTTTGG TACTACTCAT
 151 GCACCTGTTT GTCGTTCAAA TATCTTTTCT TTTTCTTTAT TGGGCTTTTC
 201 TTTATGTTTG GCTGTAGGTA CGGCCAATAT TGCTTTTGCT GATGGCATTA
 251 TTGCTGATAA AGCTGCTCCT AAAACTCAAC AAGCCACGAT TCTGCAAACA
 301 GGTAACGGCA TACCGCAAGT CAATATTCAA ACCCCTACTT CGGCAGGGGT
 351 TTCTGTTAAT CAATACGCCC AGTTTGATGT GGGTAATCGC GGGGCGATTT
 401 TAAACAACAG CCGCAGCAAC ACCCAAACAC AGCTAGGCGG TTGGATTCAA
 451 GGTAATCCTT GGTTGGCAAG GGGCGAAGCA CGTGTGGTTG TAAACCAAAT
 501 CAACAGCAGC CATTCTTCAC AAATGAATGG CTATATTGAA GTGGGCGGAC
 551 GACGTGCAGA AGTCGTTATT GCCAATCCGG CAGGGATTGC AGTCAATGGT
```

-continued
```
 601 GGTGGTTTTA TCAATGCTTC CCGTGCCACT TTGACGACAG GCCAACCGCA

651 ATATCAAGCA GGAGACCTTA GCGGCTTTAA GATAAGGCAA GGCAATGTTG

701 TAATCGCCGG ACACGGTTTG GATGCCCGTG ATACCGATTT CACACGTATT

751 CTCAGTTATC ATTCCAAAAT TGATGCACCC GTATGGGGAC AAGATGTTCG

801 TGTCGTCGCG GGACAAAACG ATGTGGTCGC AACAGGTAAT GCACATTCGC

851 CTATTCTCAA TAATGCTGCT GCCAATACGT CAAACAATAC AGCCAACAAC

901 GGCACACATA TCCCTTTATT TGCGATTGAT ACAGGCAAAT TAGGAGGTAT

951 GTATGCCAAC AAAATCACCT TGATCAGTAC GGCCGAGCAA GCAGGCATTC

1001 GTAATCAAGG GCAGTTGTTT GCTTCTTCCG GTAATGTGGC GATTGATGCA

1051 AATGGCCGTT TAGTCAATAG TGGCACGATG GCTGCCGCCA ATGCGAAAGA

1101 TACGGATAAT ACAGCGGAAC ACAAAGTCAA TATCCGCAGT CAGGGCGTTG

1151 AAAACAGCGG TACGGCGGTA TCGCAACAAG GCACTCAAAT TCACAGTCAG

1201 TCGATTCAAA ACACTGGCAC ATTATTGTCC TCAGGCGAAA TATTGATTCA

1251 CAATTCGGGC AGCCTGAAAA ATGAAACATC AGGCACCATT GAAGCCGCTC

1301 GTTTGGCTAT TGATACCGAC ACACTTAATA ATCAAGGCAA ACTCTCTCAA

1351 ACAGGTTCAC AAAAACTCCA TATTGATGCA CAAGGCAAAA TGGATAACCG

1401 TGGCCGCATG GGTTTACAAG ATACCGCACC AACCGCGTCA AATGGTTCAA

1451 GCAATCAAAC CGGCAATAGT TACAATGCAT CTTTCCATTC ATCCACTACC

1501 ACACCAACAA CGGCAACAGG TACGGGTACT GCAACCGTTT CTATATCAAA

1551 CATAACTGCG CCTACCTTTG CTGATGGGAC AATTCGCACT CATGGTGCAC

1601 TGGATAATTC AGGCAGTATT ATTGCCAATG GTCAAACAGA TGTTAGTGCG

1651 CAACAAGGTT TAAATAATGC AGGACAAATA GACATTCATC AGTTAAATGC

1701 AAAAGGTTCG GCGTTTGACA ATCACAATGG AACAATTATC AGTGATGCGG

1751 TCCACATTCA AGCCGGCAGC CTGAATAATC AAAATGGCAA CATCACAACA

1801 CGCCAACAGT TAGAGATTGA AACCGATCAA CTGGATAACG CTCATGGCAA

1851 GTTATTATCA GCAGAAATAG CGGATTTAGC CGTTTCAGGC AGCCTGAACA

1901 ATCAAAATGG CGAAATAGCG ACCAATCAAC AACTGATTAT TCACGATGGT

1951 CAGCAATCTA CCGCTGTCAT TGATAATACG AATGGCACGA TACAATCAGG

2001 CCGTGATGTT GCTATTCAGG CAAATCGTT ATCCAACAAC GGCACACTTG

2051 CCGCTGATAA TAAACTGGAT ATTGCGTTAC AAGATGATTT TTATGTAGAA

2101 CGCAATATCG TGGCGGGCAA TGAATTGTCG CTCAGTACAC GAGGCAGCCT

2151 GAAAAATTCA CATACTTTGC AAGCAGGAAA ACGCATTCGG ATTAAAGCAA

2201 ATAACCTTGA TAATGCAGCA CAAGGCAACA TTCAATCCGG CGGTACGACA

2251 GACATTGGCA CGCAGCACAA TTTAACCAAT AGAGGCTTGA TTGACGGACA

2301 ACAAACCAAA ATCCAAGCCG GCAAATGAA TAATATCGGT ACAGGTCGGA

2351 TTTATGGCGA CAATATCGCT ATTGCGGCTA CCCGCTTAGA CAATCAAGAT

2401 GAAAACGGTA CAGGTGCCGC CATTGCGGCA CGTGAAAACC TGAATTTAGG

2451 CATCGGACAA TTAAACAACC GTGAAAACAG TCTGATTTAC AGCGGTAACG

2501 ATATGGCGGT TGGCGGCGCA TTAGATACCA ATGGCCAAGC CACAGGCAAA

2551 GCCCAAAGGA TACACAATGC CGGCGCAACC ATTGAAGCTG CAGGCAAAAT

2601 GCGTTTAGGT GTAGAAAAGC TGCACAATAC CAATGAGCAT TTGAAAACGC
```

-continued

```
2651 AGTTGGTAGA AACAGGGCGC GAGCATATTG TTGATTACGA AGCATTTGGA

2701 CGACACGAAT TATTGCGAGA AGGCACGCAA CATGAATTAG GCTGGTCTGT

2751 CTATAACGAT GAATCAGACC ACTTACGCAC CCCTGATGGA GCGGCGCATG

2801 AAAATTGGCA TAAATACGAT TATGAAAAAG TCACCCAAAA AACCCAAGTT

2851 ACCCAAACTG CGCCAGCCAA AATCATTTCA GGTAATGATT TAACCATTGA

2901 TGGTAAAGAA GTATTTAATA CCGATAGCCA AATCATTGCT GGTGGCAATC

2951 TCATTGTACA AACAGAAAAA GACGGTTTGC ATAACGAGCA AACCTTTGGC

3001 GAAAAGAAAG TATTCAGTGA AAATGGCAAA TTACACAGCT ATTGGCGTGA

3051 GAAACATAAA GGACGAGACT CAACGGGACA TAGCGAACAA AATTACACTT

3101 TGCCGGAGGA AATCACACGC AACATTTCAC TGGGTTCATT TGCCTATGAA

3151 TCGCATCGCA AAGCATTAAG CCATCATGCG CCCAGCCAAG GCACTGAGTT

3201 GCCGCAAAGC AACGGTATTT CGCTACCCTA TACGTCCAAT TCTTTTACCC

3251 CATTACCCAG CAGCAGCTTA TACATTATCA ATCCTGTCAA TAAAGGCTAT

3301 CTTGTTGAAA CCGATCCACG CTTTGCCAAC TACCGTCAAT GGTTGGGTAG

3351 TGACTATATG CTGGACAGCC TCAAACTAGA CCCAAACAAT TTACATAAAC

3401 GTTTGGGTGA TGGTTATTAC GAGCAACGTT TAATCAATGA ACAAATCGCA

3451 GAGCTGACAG GGCATCGTCG TTTAGACGGT TATCAAAACG ACGAAGAACA

3501 ATTTAAAGCC TTAATGGATA ATGGCGCGAC TGCGGCACGT TCGATGAATC

3551 TCAGCGTTGG CATTGCATTA AGTGCCGAGC AAGTAGCGCA ACTGACCAGC

3601 GATATTGTTT GGTTGGTACA AAAAGAAGTT AAGCTTCCTG ATGGCGGCAC

3651 ACAAACCGTA TTGGTGCCAC AGGTTTATGT ACGCGTTAAA AATGGCGACA

3701 TAGACGGTAA AGGTGCATTG TTGTCAGGCA GCAATACACA AATCAATGTT

3751 TCAGGCAGCC TGAAAAACTC AGGCACGATT GCAGGGCGCA ATGCGCTTAT

3801 TATCAATACC GATACGCTAG ACAATATCGG TGGGCGTATT CATGCGCAAA

3851 AATCAGCGGT TACGGCCACA CAAGACATCA ATAATATTGG CGGCATGCTT

3901 TCTGCCGAAC AGACATTATT GCTCAACGCA GGCAACAACA TCAACAGCCA

3951 AAGCACCACC GCCAGCAGTC AAAATACACA AGGCAGCAGC ACCTACCTAG

4001 ACCGAATGGC AGGTATTTAT ATCACAGGCA AAGAAAAAGG TGTTTTAGCA

4051 GCGCAGGCAG GAAAAGACAT CAACATCATT GCCGGTCAAA TCAGCAATCA

4101 ATCAGAGCAA GGGCAAACCC GGCTGCAAGC AGGGCGCGAC ATTAACCTAG

4151 ATACGGTACA AACCAGCAAA CATCAAGCAA CCCATTTTGA TGCCGATAAC

4201 CATGTTATTC GCGGTTCAAC GAACGAAGTC GGCAGCAGCA TTCAAACAAA

4251 AGGCGATGTT ACCCTATTGT CAGGGAATAA CCTCAATGCC AAAGCTGCCG

4301 AAGTCAGCAG CGCAAACGGT ACACTCGCTG TGTCTGCCAA AAATGACATC

4351 AACATCAGCG CAGGCATCAA CACGACCCAT GTTGATGATG CGTCCAAACA

4401 CACAGGCAGA AGCGGTGGTG GCAATAAATT AGTCATTACC GATAAAGCCC

4451 AAAGTCATCA CGAAACCGCC CAAAGCAGCA CCTTTGAAGG CAAGCAAGTT

4501 GTATTGCAGG CAGGAAACGA TGCCAACATC CTTGGCAGCA ATGTTATTTC

4551 CGATAATGGC ACCCAGATTC AAGCAGGCAA TCATGTTCGC ATTGGTACAA

4601 CCCAAACTCA AAGCCAAAGC GAAACCTATC ATCAAACCCA GAAATCAGGA
```

-continued
```
4651 TTGATGAGTG CAGGTATCGG CTTCACTATT GGCAGCAAGA CAAACACACA

4701 AGAAAACCAA TCCCAAAGCA ACGAACATAC AGGCAGTACC GTAGGCAGCT

4751 TGAAAGGCGA TACCACCATT GTTGCAGGCA ACACTACGA ACAAATCGGC

4801 AGTACCGTTT CCAGCCCGGA AGGCAACAAT ACCATCTATG CCCAAAGCAT

4851 AGACATTCAA GCGGCACACA ACAAATTAAA CAGTAATACC ACCCAAACCT

4901 ATGAACAAAA AGGCCTAACG GTGGCATTCA GTTCGCCCGT TACCGATTTG

4951 GCACAACAAG CGATTGCCGT AGCACAAAGC AGCAAACAAG TCGGACAAAG

5001 CAAAAACGAC CGCGTTAATG CCATGGCGGC TGCCAATGCA GGCTGGCAAG

5051 CCTATCAAAC AGGTAAGAGT GCACAAAACT TAGCCAATGG TACAACCAAT

5101 GCCAAACAAG TCAGCATCTC CATAACCTAC GGCGAACAGC AAAACCGACA

5151 AACCACCCAA GTTCAAGCCA ATCAAGCCCA AGCGAGTCAA ATTCAAGCAG

5201 GTGGTAAAAC CACATTAATC GCCACAGGCG CAGCAGAACA ATCCAATATC

5251 AACATCGCAG GCTCAGATGT TGCCGGCAAA GCAGGCACAA TCCTGATTGC

5301 CGATAACGAC ATCACACTCC AATCAGCCGA GCAAAGCAAT ACCGAACGCG

5351 GCCAAAACAA ATCGGCAGGC TGGAACGCAG GTGCTGCCGT ATCATTCGGA

5401 CAAGGAGGCT GGTCATTAGG CGTTACCGCA GGCGGCAATG TCGGCAAAGG

5451 CTACGGCAAT GGCGACAGCA TCACCCACCG CCATAGCCAT ATCGGCGACA

5501 AAGGCAGCCA AACCCTTATC CAAAGCGGTG GCGACACTAC CATCAAAGGC

5551 GCGCAAGTAC GCGGCAAAGG CGTACAAGTC AATGCCAAAA ACCTAAGTAT

5601 TCAAAGCGTA CAAGATAGAG AAACCTATCA AGCAAACAA CAAAACGCCA

5651 GTGCACAAGT TACCGTAGGT TATGGCTTCA GTGCCGGTGG CGATTACAGC

5701 CAAAGCAAAA TCCGAGCCGA CCATGTTTCA GTAACCGAGC AAAGCGGTAT

5751 TTATGCCGGA GAAGACGGCT ATCAAATCAA GGTCGGAAAC CATACAGACC

5801 TCAAAGGCGG CATCATCACC AGTACCCAAA GCGCAGAAGA CAAGGGTAAA

5851 AACCGCTTTC AGACGGCCAC CCTCACCCAT AGCGACATCA AAAACCACAG

5901 CCAATACAAA GGCGAAAGTT TTGGATTGGG CGCAAGTGCG TCCATAAGCG

5951 GCAAAACACT GGGACAGGGC GCACAAAATA AACCTCAAAA CAAACACCTG

6001 ACAAGCGTAG CCGATAAAAA CAGCGCAAGT TCATCAGTGG GTTATGGCAG

6051 CGACAGCGAC AGTCAAAGCA GCATCACAAA AAGCGGCATC AACACCCGCA

6101 ACATTCAAAT CACCGACGAA GCCGCACAAA TCCGGCTGAC AGGCAAAACA

6151 GCGGCACAAA CCAAAGCCGA TATTGATACA AACGTAACCA CAGACACCGC

6201 CGAACGACAT TCGGGCAGCT TGAAGAACAC CTTCAACAAA GAAGCGGTGC

6251 AAAGTGAACT GGATTTACAA AGAACCGTCA GCCAAGATTT TAGTAAAAAT

6301 GTTCAACAAG CCAATACCGA GATTAACCAA CATTTAGACA AACTCAAAGC

6351 AGACAAAGAA GCAGCCGAAA CAGCAGCAGC CGAGGCATTA GCCAATGGCG

6401 ATATGGAAAC TGCCAAACGC AAAGCCCATG AAGCTCAAGA TGCGGCAGCA

6451 AAAGCAGATA ATTGGCAACA AGGCAAAGTC ATTCTCAACA TGTTAGCCTC

6501 AGGTTTAGCT GCGCCGACCC AAAGCGGAGC GGGCATCGCT GCGGCTACCG

6551 CATCGCCAGC CGTATCGTAT GCGATTGGAC AGCACTTTAA AGATTTAGCC

6601 GGTCAAAACG CGAATGGTAA ACTAACCGCC AGTCAAGAAA CCGCACACGT

6651 TCTTGCCCAC GCGGTATTAG GAGCAGCGGT TGCCGCAGTA GGAGACAACA
```

-continued

```
6701 ATGCTCTAGC AGGAGCATTG AGTGCGGGCG GGTCGGAAGC GGCTGCGCCT
6751 TACATCAGCA AATGGTTATA CGGCAAAGAA AAAGGAAGCG ACTTAACGGC
6801 GGAAGAGAAA GAGACTGTAA CAGCGATTAC AAATGTATTG GGTACGGCTA
6851 CGGGTGCGGC AGTCGGCAAC AGCGCAACAG ATGCAGCGCA AGGCAGCCTG
6901 AATGCGCAAA GTGCGGTGGA GAATAATGAT ACTGTAGAGC AAGTGAAATT
6951 TGCTCTTAGG CACCCTAGAA TTGCTATTGC AATTGGATCT GTACATAAAG
7001 ATCCTGGCTC TACATTAGAG CCTAATATTT CAACAATTGC TTCAACTTTT
7051 CAATTAAATT TATTTCCTAA TAGTGAATTT GGTGGTGAAG GTGGAGTTGG
7101 CAATGCATTC AGGCACGTTT TATGGCAAGC AACCATCACA CGAGAATTTG
7151 GCAAAGATAT TGCTGTTAAA GTAGGAAATA GTCATGAAAG TGGGGAAAAA
7201 ATTAATTATT CTATAAGACG TAATCTTTCA TTAGATAAAG CAGATGAAAT
7251 GATTGATCAA CTAAATAACG AAATAGGAAG AGAAATAGCA TTAAATACCA
7301 ATAGGTTAAA CACAAAAGAG TTAGTTGGAT TAATTCTGGA AACTTATAAA
7351 AATAATGGTT TTTATCAAGC AGAAAGAAAC AGTAATGGAA ATTATGATGT
7401 TGTAAGAAAA AGATTATCTG AAAAAGATTA CCAGAATACA AGCAATATAT
7451 TGATTCACTT AGATAATACT GGTGCCGGAT TTAAAATTCA GCAGAGGAGA
7501 AAACAAATCA GAGCACAAAT TCAGCCAGA CAATGGAGAA GATAA
```

This corresponds to the amino acid sequence <SEQ ID<sup>30</sup> 1668; ORF 561>:

```
m563.pep..
   1 MNKTLYRVIF NRKRGAVVAV AETTKREGKS CADSDSGSAH VKSVPFGTTH
  51 APVCRSNIFS FSLLGFSLCL AVGTANIAFA DGIIADKAAP KTQQATILQT
 101 GNGIPQVNIQ TPTSAGVSVN QYAQFDVGNR GAILNNSRSN TQTQLGGWIQ
 151 GNPWLARGEA RVVVNQINSS HSSQMNGYIE VGGRRAEVVI ANPAGIAVNG
 201 GGFINASRAT LTTGQPQYQA GDLSGFKIRQ GNVVIAGHGL DARDTDFTRI
 251 LSYHSKIDAP VWGQDVRVVA GQNDVVATGN AHSPILNNAA ANTSNNTANN
 301 GTHIPLFAID TGKLGGMYAN KITLISTAEQ AGIRNQGQLF ASSGNVAIDA
 351 NGRLVNSGTM AAANAKDTDN TAEHKVNIRS QGVENSGTAV SQQGTQIHSQ
 401 SIQNTGTLLS SGEILIHNSG SLKNETSGTI EAARLAIDTD TLNNQGKLSQ
 451 TGSQKLHIDA QGKMDNRGRM GLQDTAPTAS NGSSNQTGNS YNASFHSSTT
 501 TPTTATGTGT ATVSISNITA PTFADGTIRT HGALDNSGSI IANGQTDVSA
 551 QQGLNNAGQI DIHQLNAKGS AFDNHNGTII SDAVHIQAGS LNNQNGNITT
 601 RQQLEIETDQ LDNAHGKLLS AEIADLAVSG SLNNQNGEIA TNQQLIIHDG
 651 QQSTAVIDNT NGTIQSGRDV AIQAKSLSNN GTLAADNKLD IALQDDFYVE
 701 RNIVAGNELS LSTRGSLKNS HTLQAGKRIR IKANNLDNAA QGNIQSGGTT
 751 DIGTQHNLTN RGLIDGQQTK IQAGQMNNIG TGRIYGDNIA IAATRLDNQD
 801 ENGTGAAIAA RENLNLGIGQ LNNRENSLIY SGNDMAVGGA LDTNGQATGK
 851 AQRIHNAGAT IEAAGKMRLG VEKLHNTNEH LKTQLVETGR EHIVDYEAFG
 901 RHELLREGTQ HELGWSVYND ESDHLRTPDG AAHENWHKYD YEKVTQKTQV
 951 TQTAPAKIIS GNDLTIDGKE VFNTDSQIIA GGNLIVQTEK DGLHNEQTFG
```

-continued

```
1001  EKKVFSENGK LHSYWREKHK GRDSTGHSEQ NYTLPEEITR NISLGSFAYE

1051  SHRKALSHHA PSQGTELPQS NGISLPYTSN SFTPLPSSSL YIINPVNKGY

1101  LVETDPRFAN YRQWLGSDYM LDSLKLDPNN LHKRLGDGYY EQRLINEQIA

1151  ELTGHRRLDG YQNDEEQFKA LMDNGATAAR SMNLSVGIAL SAEQVAQLTS

1201  DIVWLVQKEV KLPDGGTQTV LVPQVYVRVK NGDIDGKGAL LSGSNTQINV

1251  SGSLKNSGTI AGRNALIINT DTLDNIGGRI HAQKSAVTAT QDINNIGGML

1301  SAEQTLLLNA GNNINSQSTT ASSQNTQGSS TYLDRMAGIY ITGKEKGVLA

1351  AQAGKDINII AGQISNQSEQ GQTRLQAGRD INLDTVQTSK HQATHFDADN

1401  HVIRGSTNEV GSSIQTKGDV TLLSGNNLNA KAAEVSSANG TLAVSAKNDI

1451  NISAGINTTH VDDASKHTGR SGGGNKLVIT DKAQSHHETA QSSTFEGKQV

1501  VLQAGNDANI LGSNVISDNG TQIQAGNHVR IGTTQTQSQS ETYHQTQKSG

1551  LMSAGIGFTI GSKTNTQENQ SQSNEHTGST VGSLKGDTTI VAGKHYEQIG

1601  STVSSPEGNN TIYAQSIDIQ AAHNKLNSNT TQTYEQKGLT VAFSSPVTDL

1651  AQQAIAVAQS SKQVGQSKND RVNAMAAANA GWQAYQTGKS AQNLANGTTN

1701  AKQVSISITY GEQQNRQTTQ VQANQAQASQ IQAGGKTTLI ATGAAEQSNI

1751  NIAGSDVAGK AGTILIADND ITLQSAEQSN TERGQNKSAG WNAGAAVSFG

1801  QGGWSLGVTA GGNVGKGYGN GDSITHRHSH IGDKGSQTLI QSGGDTTIKG

1851  AQVRGKGVQV NAKNLSIQSV QDRETYQSKQ QNASAQVTVG YGFSAGGDYS

1901  QSKIRADHVS VTEQSGIYAG EDGYQIKVGN HTDLKGGIIT STQSAEDKGK

1951  NRFQTATLTH SDIKNHSQYK GESFGLGASA SISGKTLGQG AQNKPQNKHL

2001  TSVADKNSAS SSVGYGSDSD SQSSITKSGI NTRNIQITDE AAQIRLTGKT

2051  AAQTKADIDT NVTTDTAERH SGSLKNTFNK EAVQSELDLQ RTVSQDFSKN

2101  VQQANTEINQ HLDKLKADKE AAETAAAEAL ANGDMETAKR KAHEAQDAAA

2151  KADNWQQGKV ILNMLASGLA APTQSGAGIA AATASPAVSY AIGQHFKDLA

2201  GQNANGKLTA SQETAHVLAH AVLGAAVAAV GDNNALAGAL SAGGSEAAAP

2251  YISKWLYGKE KGSDLTAEEK ETVTAITNVL GTATGAAVGN SATDAAQGSL

2301  NAQSAVENND TVEQVKFALR HPRIAIAIGS VHKDPGSTLE PNISTIASTF

2351  QLNLFPNSEF GGEGGVGNAF RHVLWQATIT REFGKDIAVK VGNSHESGEK

2401  INYSIRRNLS LDKADEMIDQ LNNEIGREIA LNTNRLNTKE LVGLILETYK

2451  NNGFYQAERN SNGNYDVVRK RLSEKDYQNT SNILIHLDNT GAGFKIQQRR

2501  KQIRAQISAR QWRR*
```

Computer analysis of this amino acid sequence gave the following results:

Homology with a Predicted ORF from *N. gonorrhoeae*

ORF 563 shows 79.1% identity over a 2316 aa overlap with a predicted ORF (ORF 563.ng) from *N. gonorrhoeae*:

```
m563/g563

10         20         30         40         50
     g563.pep  MNKTLYRVIFNRKRGAVVAVAETTKREGKSCADSGSGSVYVKSVSFIPTH-----SKAFC
               |||||||||||||||||||||||||||||||||||||||:|||| |  ||     |: |
     m563.pep  MNKTLYRVIFNRKRGAVVAVAETTKREGKSCADSDSGSAHVKSVPFGTTHAPVCRSNIFS
                       10         20         30         40         50         60
```

```
              60         70         80         90        100        110
g563.pep  FSALGFSLCLALGTVNIAFADGIITDKAAPKTQQATILQTGNGIPQVNIQTPTSAGVSVN
          ||  ||||||||:||:|||||||||||:|||||||||||||||||||||||||||||||
m563.pep  FSLLGFSLCLAVGTANIAFADGIIADKAAPKTQQATILQTGNGIPQVNIQTPTSAGVSVN
              70         80         90        100        110        120

120        130        140        150        160        170
g563.pep  QYAQFDVGNRGAILNNSRSNTQTQLGGWIQGNPWLTRGEARVVVQINSSHPSQLNGYIE
          ||||||||||||||||||||||||||||||||||||:||||||||||||||:||||||
m563.pep  QYAQFDVGNRGAILNNSRSNTQTQLGGWIQGNPWLARGEARVVVQINSSHSSQMNGYIE
             130        140        150        160        170        180

180        190        200        210        220        230
g563.pep  VGGRRAEVVIANPAGIAVNGGGFINASRATLTTGQPQYQAGDFSGFKIRQGNAVIAGHGL
          ||||||||||||||||||||||||||||||||||||||||||:||||||||:|||||||
m563.pep  VGGRRAEVVIANPAGIAVNGGGFINASRATLTTGQPQYQAGDLSGFKIRQGNVVIAGHGL
             190        200        210        220        230        240

240
g563.pep  DARDTDFTRIL-------------------------------------------------
          |||||||||||
m563.pep  DARDTDFTRILSYHSKIDAPVWGQDVRVVAGQNDVVATGNAHSPILNNAAANTSNNTANN
             250        260        270        280        290        300

250        260        270        280        290
g563.pep  ----------------LYANKITLISTAEQAGIRNQGQLFASSGNVAIDANGRLVNSGTM
                          :|||||||||||||||||||||||||||||||||||||||||||
m563.pep  GTHIPLFAIDTGKLGGMYANKITLISTAEQAGIRNQGQLFASSGNVAIDANGRLVNSGTM
             310        320        330        340        350        360

300        310        320        330        340
g563.pep  AAANVQDMNNTAEHKVNIRSQAFENSGTAVSQQGTQIHSQSIQNTGKLLSAGT-------
          ||||::|:|||||||||||||:|||||||||||||||||||||||||||:|
m563.pep  AAANAKDTDNTAEHKVNIRSQGVENSGTAVSQQGTQIHSQSIQNTGTLLSSGEILIHNSG
             370        380        390        400        410        420 g563.pep  ------------------------------------------------------------
m563.pep  SLKNETSGTIEAARLAIDTDTLNNQGKLSQTGSQKLHIDAQGKMDNRGRMGLQDTAPTAS
             430        440        450        460        470        480 g563.pep  ------------------------------------------------------------
m563.pep  NGSSNQTGNSYNASFHSSTTTPTTATGTGTATVSISNITAPTFADGTIRTHGALDNSGSI
             490        500        510        520        530        540 g563.pep  ------------------------------------------------------------
m563.pep  IANGQTDVSAQQGLNNAGQIDIHQLNAKGSAFDNHNGTIISDAVHIQAGSLNNQGNITT
             550        560        570        580        590        600

350        360        370        380
g563.pep  ----------------------EDLAVSGSLNNQNGEIATNQQLIIHDGQQSTVVIDNT
                                 ||||||||||||||||||||||||||||:||||||
m563.pep  RQQLEIETDQLDNAHGKLLSAEIADLAVSGSLNNQNGEIATNQQLIIHDGQQSTAVIDNT
             610        620        630        640        650        660

390        400        410        420        430        440
g563.pep  NGTIQSGRDVAIQAKSLSNNGTLAADNKLDIALQDDFYVERKIVAGNELSLSTRGSLKNS
          ||||||||||||||||||||||||||||||||||||||||:|||||||||||||||||
m563.pep  NGTIQSGRDVAIQAKSLSNNGTLAADNKLDIALQDDFYVERNIVAGNELSLSTRGSLKNS
             670        680        690        700        710        720

450        460        470        480        490        500
g563.pep  HTLQAGKRIRIKANNLDNAVQGNIQSGGTTDIGTQHNLTNRGLIDGQQTKIQAGQMNNIG
          |||||||||||||||||||:||||||||||||||||||||||||||||||||||||||
m563.pep  HTLQAGKRIRIKANNLDNAAQGNIQSGGTTDIGTQHNLTNRGLIDGQQTKIQAGQMNNIG
             730        740        750        760        770        780

510        520        530        540        550        560
g563.pep  TGRIYGDNIAIAATRLDNQDENGTGAAIAARENLNLGIEQLNNRENSLIYSGNDMAVGGA
          |||||||||||||||||||||||||||||||||||||| |||||||||||||||||||
m563.pep  TGRIYGDNIAIAATRLDNQDENGTGAAIAARENLNLGIGQLNNRENSLIYSGNDMAVGGA
             790        800        810        820        830        840

570        580        590        600        610        620
g563.pep  LDTNDQATGKAQRIHNAGAIIEAAGKMRLGVEKLHNTEHLKTQLVETGRERIVDYEAFG
          ||||:|||||||||||||||:|||||||||||||||||||||||||||||:|||||||
m563.pep  LDTNGQATGKAQRIHNAGATIEAAGKMRLGVEKLHNTEHLKTQLVETGREHIVDYEAFG
             850        860        870        880        890        900
```

-continued

```
               630        640        650        660        670        680
g563.pep  RHELLREGTQHELGWFVYNNESDHLRTPDGVAHENWHKYDYEKVTQETQVTGTAPAKIIA
          ||||||||||||||  |||:||||||||||:||||||||||||||:|||| ||||||:
m563.pep  RHELLREGTQHELGWSVYNDESDHLRTPDGAAHENWHKYDYEKVTQKTQVTQTAPAKIIS
               910        920        930        940        950        960

690        700        710        720        730        740
g563.pep  GSDLIIDSKAVFNSDSRIIAGGQLLVQTEKDGLHNEQTFGEKKVFSENGKLHNYWRARRK
          |:|| ||:| |||:||:|||||| ||||||||||||||||||||||||||:||| ::|
m563.pep  GNDLTIDGKEVFNTDSQIIAGGNLIVQTEKDGLHNEQTFGEKKVFSENGKLHSYWREKHK
               970        980        990       1000       1010       1020

750        760        770        780        790        800
g563.pep  GHDETGHREQNYTLPEEITRDISLGSFAYESHSKALSRHAPSQGTELPQSNRDNIRTAKS
          |:| ||| ||||||||||||:||||||||||:|||| |||||||||||||
m563.pep  GRDSTGHSEQNYTLPEEITRNISLGSFAYESHRKALSHHAPSQGTELPQSN---------
              1030       1040       1050       1060       1070

810        820        830        840        850        860
g563.pep  NGISLPYTPNSFTPLPGSSLYIINPANKGYLVETDPRFANYRQWLGSDYMLGSLKLDPNN
           ||||||| |||||||||:|||||||:||||||||||||||||||||||| ||||||||
m563.pep  -GISLPYTSNSFTPLPSSSLYIINPVNKGYLVETDPRFANYRQWLGSDYMLDSLKLDPNN
              1080       1090       1100       1110       1120       1130

870        880        890        900        910        920
g563.pep  LHKRLGDGYYEQRLINEQIAELTGHRRLDGYQNDEEQFKALMDNGATAARSMNLSVGIAL
          ||||||||||||||||||||||||||||||||||||||||||||||||||||||||||
m563.pep  LHKRLGDGYYEQRLINEQIAELTGHRRLDGYQNDEEQFKALMDNGATAARSMNLSVGIAL
              1140       1150       1160       1170       1180       1190

930        940        950        960        970        980
g563.pep  SAEQAAQLTSDIVWLVQKEVKLPDGGTQTVLMPQVYVRVKNGGIDGKGALLSGSNTQINV
          ||||:|||||||||||||||||||||||||:||||||||||||:|||||||||||||||
m563.pep  SAEQVAQLTSDIVWLVQKEVKLPDGGTQTVLVPQVYVRVKNGDIDGKGALLSGSNTQINV
              1200       1210       1220       1230       1240       1250

990       1000       1010       1020       1030       1040
g563.pep  SGSLKNSGTIAGRNALIINTDTLDNIGGRIHAQKSAVTATQDINNIGGILSAEQTLLLNA
          ||||||||||||||||||||||||||||||||||||||||||||||||:||||||||||
m563.pep  SGSLKNSGTIAGRNALIINTDTLDNIGGRIHAQKSAVTATQDINNIGGMLSAEQTLLLNA
              1260       1270       1280       1290       1300       1310

1050       1060       1070       1080       1090       1100
g563.pep  GNNINNQSTAKSSQNAQGSSTYLDRMAGIYITGKEKGVLAAQAGKDINIIAGQISNQSDQ
          ||||:|||: ||||:||||||||||||||||||||||||||||||||||||||||||:|
m563.pep  GNNINSQSTTASSQNTQGSSTYLDRMAGIYITGKEKGVLAAQAGKDINIIAGQISNQSEQ
              1320       1330       1340       1350       1360       1370

1110       1120       1130       1140       1150       1160
g563.pep  GQTRLQAGRDINLDTVQTGKYQEIHFDADNHTIRGSTNEVGSSIQTKGDVTLLSGNNLNA
          ||||||||||||||||||:|:|| ||||||||:|||||||||||||||||||||||||
m563.pep  GQTRLQAGRDINLDTVQTSKHQATHFDADNHVIRGSTNEVGSSIQTKGDVTLLSGNNLNA
              1380       1390       1400       1410       1420       1430

1170       1180       1190       1200       1210       1220
g563.pep  KAAEVGSAKGTLAVYAKNDITISSGIHAGQVDDASKHTGRSGGGNKLVITDKAQSHHETA
          |||||:||:||||| ||||:|| ||:: :|||||||||||||||||||||||||||||
m563.pep  KAAEVSSANGTLAVSAKNDINISAGINTTHVDDASKHTGRSGGGNKLVITDKAQSHHETA
              1440       1450       1460       1470       1480       1490

1230       1240       1250       1260       1270       1280
g563.pep  QSSTFEGKQVVLQAGNDANILGSNVISDNGTRIQAGNHVRIGTTQTQSQSETYHQTQKSG
          ||||||||||||||||||||||||||||||:||||||||||||||||||||||||||||
m563.pep  QSSTFEGKQVVLQAGNDANILGSNVISDNGTQIQAGNHVRIGTTQTQSQSETYHQTQKSG
              1500       1510       1520       1530       1540       1550

1290       1300       1310       1320       1330       1340
g563.pep  LMSAGIGFTIGSKTNTQENQSQSNEHTGSTVGSLKGDTTIVASKHYEQTGSNVSSPEGNN
          ||||||||||||||||||||||||||||||||||||||||:||||| ||:|:|||||||
m563.pep  LMSAGIGFTIGSKTNTQENQSQSNEHTGSTVGSLKGDTTIVAGKHYEQIGSTVSSPEGNN
              1560       1570       1580       1590       1600       1610

1350       1360       1370       1380       1390       1400
g563.pep  LISTQSMDIGAAQNQLNSKTTQTYEQKGLTVGIQFARYRFGTTSDCRSTQSSKQVGQSKN
          :|||| |:|:|:|::|||:|||||||||||| ::   ::     ||||||||||||||
m563.pep  TIYAQSIDIQAAHNKLNSTTQTYEQKGLTVAFSSPVTDLAQQA-IAVAQSSKQVGQSKN
              1620       1630       1640       1650       1660
```

```
                 1410       1420       1430       1440       1450       1460
g563.pep   DRVNAMAAANAGWQAYQTGKGAQNLANGTTNAKQVSISITYGEQQNRQTTQVQANQAQAS
           ||||||||||||||||||||||||:|||||||||||||||||||||||||||||||||||
m563.pep   DRVNAMAAANAGWQAYQTGKSAQNLANGTTNAKQVSISITYGEQQNRQTTQVQANQAQAS
                 1670       1680       1690       1700       1710       1720

1470       1480       1490       1500       1510       1520
g563.pep   QIQAGGKTTLYCRRCGEQSNINITGSGVSGRAGTGLIADKQIHLQSAEQSNTERSQNKSA
           ||||||||||| :|||||||:|| |:|:||| ||||::| |||||||||||||:|||||
m563.pep   QIQAGGKTTLIATGAAEQSNINIAGSDVAGKAGTILIADNDITLQSAEQSNTERGQNKSA
                 1730       1740       1750       1760       1770       1780

1530       1540       1550       1560       1570       1580
g563.pep   GWNAGAAVSFGQGGWSLGVAAGGNVGKGYGYGDSVTHRHSHIGDKGSQTLIQSGGDTIIK
           ||||||||||||||||||||:|||||||||| |||:|||||||||||||||||||| ||
m563.pep   GWNAGAAVSFGQGGWSLGVTAGGNVGKGYGNGDSITHRHSHIGDKGSQTLIQSGGDTTIK
                 1790       1800       1810       1820       1830       1840

1590       1600       1610       1620       1630       1640
g563.pep   GAQVRGKGVQVNAKNLSIQSVQDRETYQSKQQNAGAQVTVGYGFSASGDYSQSKIRADHA
           |||||||||||||||||||||||||||||||||:|||||||||||||:||||||||||:
m563.pep   GAQVRGKGVQVNAKNLSIQSVQDRETYQSKQQNASAQVTVGYGFSAGGDYSQSKIRADHV
                 1850       1860       1870       1880       1890       1900

1650       1660       1670       1680       1690       1700
g563.pep   SVTEQSGIYAGEDGYQIKVGNHTGLKGGIITSSQSAKDKGKNRFSTGTLAGSDIQNYSQY
           |||||||||||||||||||||||:||||||||:|||:|||||||:|:||  |||:|:||
m563.pep   SVTEQSGIYAGEDGYQIKVGNHTDLKGGIITSTQSAEDKGKNRFQTATLTHSDIKNHSQY
                 1910       1920       1930       1940       1950       1960

1710       1720       1730       1740       1750       1760
g563.pep   EGKSFGLGASVAVSGKTLGQGAKNKPQDKHLTSIADKNGASSSVGYGSDSDSQSSITKSG
           :|:||||||||:::|||||||||:||||:||||:|||:||||||||||||||||||||
m563.pep    KGESFGLGASASISGKTLGQGAQNKPQNKHLTSVADKNSASSSVGYGSDSDSQSSITKSG
                 1970       1980       1990       2000       2010       2020

1770       1780       1790       1800       1810       1820
g563.pep   INTPKNIQITDEAAQIRLTGKIAAQTKADIDTNVTTDTAERHSGSLKNIFDKDRVQSELD
           ||| :|||||||||||||||||:|||||||||||||||||||||||||| |:| ||||||
m563.pep   INT-RNIQITDEAAQIRLTGKTAAQTKADIDTNVTTDTAERHSGSLKNTFNKEAVQSELD
                 2030       2040       2050       2060       2070       2080

1830       1840       1850       1860       1870       1880
g563.pep   LQRTVSQDFSKNVQQTNTEINQHLDKLKADKEAAETAAAEALANGDMETAKRKAHEAQDA
           ||||||||||||||::|||||||||||||||||||||||||||||||||||||||||||
m563.pep   LQRTVSQDFSKNVQQANTEINQHLDKLKADKEAAETAAAEALANGDMETAKRKAHEAQDA
                 2090       2100       2110       2120       2130       2140

1890       1900       1910       1920       1930       1940
g563.pep   AAKADNWQQGKVILNMLASGLAEPTQSGAGIAAATASPDVSYAIGQHFKDLAGQNANGKL
           |||||||||||||||||||||||| ||||||||||||| |||||||||||||||||||
m563.pep   AAKADNWQQGKVILNMLASGLAAPTQSGAGIAAATASPAVSYAIGQHFKDLAGQNANGKL
                 2150       2160       2170       2180       2190       2200

1950       1960       1970       1980       1990       2000
g563.pep   TASQETAHVLAHAVLGAAVAAAXGNNAPAGALGAGGSEAAAPIIGKWLYGKGDGGSLNAE
           |||||||||||||||||||  |||||| ||:|||||||||| |:|||||||:|:|:||
m563.pep   TASQETAHVLAHAVLGAAVAAVGDNNALAGALSAGGSEAAAPYISKWLYGKEKGSDLTAE
                 2210       2220       2230       2240       2250       2260

2010       2020       2030       2040       2049
g563.pep   EKETVSAITRMLGTAAGAAEGNSSADAVWGCFQTASDFASSFSYPINMX
           |||||:||| :||||:||| |||::||: | |:::      |
m563.pep   EKETVTAITNVLGTATGAAVGNSATDAAQGSLNAQSAVENNDTVEQVKFALRHPRIAIAI
                 2270       2280       2290       2300       2310       2320 m563.pep   GSVHKDPGSTLEPNISTIASTFQLNLFPNSEFGGEGGVGNAFRHVLWQATITREFGKDIA
                 2330       2340       2350       2360       2370       2380
```

The following partial DNA sequence was identified in *N. meningitidis* <SEQ ID 1669>:

```
m564.seq
    1   ATGAACCGCA CCCTGTACAA AGTTGTATTT AACAAACATC G

-continued

```
 101 CCCAAGCTGT AGGTATTTTG CCAAATGATA TTGCGGGCTT TGCGGGTTTT

151 ATCCATTCTA TCTCTGTTAT CTCATTCTCC CTTTCATTAC TGCTCGGTTC

201 TGCCCTTATC CTGACTTCTT CTTCTGCTAC TGCCCAAGGT ATCGTTGCCG

251 ACAAATCCGC ACCTGCACAG CAACAGCCTA CCATCCTGCA AACAGGTAAC

301 GGCATACCGC AAGTCAATAT TCAAACCCCT ACTTCGGCAG GGGTTTCTGT

351 TAATCAATAC GCCCAGTTTG ATGTGGGTAA TCGCGGGGCG ATTTTAAACA

401 ACAGTCGCAG CAACACCCAA ACACAGCTAG GCGGTTGGAT TCAAGGCAAT

451 CCTTGGTTGG CAAGGGGCGA AGCACGTGTG GTTGTAAACC AAATCAACAG

501 CAGCCATTCT TCACAACTGA ATGGCTATAT TGAAGTGGGC GGACGACGTG

551 CAGAAGTCGT TATTGCCAAT CCGGCAGGGA TTGCAGTCAA TGGTGGTGGT

601 TTTATCAATG CTTCCCGTGC CACTTTGACG ACAGCCCAAC CGCAATATCA

651 AGCAGGAGAC CTTAGCGGCT TTAAGATAAG GCAAGGCAAT GTTGTAATCG

701 CCGGACACGG TTTGGATGCA CGTGATACCG ATTACACACG TATTCTCAGT

751 TATCATTCCA AAATTGATGC ACCCGTATGG GGACAAGATG TTCGTGTCGT

801 CGCGGGACAA AACGATGTGG CCGCAACAGG TGATGCACAT TCGCCTATTC

851 TCAATAATGC TGCTGCCAAT ACGTCAAACA ATACAGCCAA CAACGGCACA

901 CATATCCCTT TATTTGCGAT TGATACAGGC AAATTAGGAG GTATGTATGC

951 CAACAAAATC ACCTTGATCA GTACGGTCGA GCAAGCAGGC ATTCGTAATC

1001 AAGGGCAATG GTTTGCCTCA GCCGGCAATG TGGCAGTGAA TGCTGAGGGT

1051 AAACTGGTCA ACACGGGCAT GATTGCAGCG ACGGGAGAAA TCATGCGGT

1101 TTCACTTCAT GCCGGCAATG TTCATAATAG CGGTACGGTT GCCTCACAGG

1151 ATGATGCCAA TATTCACAGC CAGACGCTGG ACAATTCAGG TACGGTCTTA

1201 TCCTCAGGTC GATTGACTGT TCGTAATTTA GGCCGTCTGA AAAACCAAAA

1251 CAACGGTACG ATCCAGGCTG CCCGCTTAGA TATGTCAACA GGTGGTTTGG

1301 ATAACACAGG TAATATTACT CAAACAGGTT CACAAGCATT GGATTTGGTA

1351 TCTGCCGGCA AATTCGATAA CAGTGGCAAG ATTGGTGTAA GTGACGTTCC

1401 ACAGACCGGT TTGAATCCCA ATCCATCAGT CATACCACAG ATTCCGAGTA

1451 CTGCAACAGG TTCAGGCAGC AGCACTGTCT CGGTATCTAA GCCTGGTTCA

1501 AACAATCCCG TTTCACCTAC AGCACCTGCA AAAAACTACG CCGTAGGACG

1551 CATTCAAACA ACAGGAGCAT TTGACAATGC AGGATCAATT AATGCGGGTG

1601 GGCAAATTGA CATTGCCGCC AAAACGGTT TGGGAAATTC GGGTAGTCTG

1651 AATGCGGCTA AACTACGAGT ATCAGGCGAT TCATTTAACA ATACGGTAAA

1701 AGGCAAACTC CAGGCACACG ATCTGGCTGT TAACACTCAA ACTGCTAAAA

1751 ACAGCGGTCA CTTATTAACT CAAACCGGCA AGATTGATAA CCGTGAACTG

1801 CATAATGCCG GAGAAATTGC CGCCAACAAT CTGACACTCA TTCATTCGGG

1851 CCGCTTGAGC AATGATAAAA AAGGCAATAT TCGAGCTGCA CATTTACAGC

1901 TTGATACCGC CGGTTTACAT AATGCAGGTA ACATTCTTGC CGATAGTGGA

1951 ACCGTTACCA CCAAGAATAA TCTTCGCAAT ACAGGAAAAG TTTCTGTTGC

2001 ACGACTGAAT ACCGAAGGTC AGACTCTAGA TAATACGCGC GGACGTATAG

2051 AGGCTGAAAC GGTTAACATC CAAAGTCAGC AACTGACTAA CCAAAGCGGC

2101 CATATTACTG CTACCGAACA ACTGACTATC AATAGTCGAA ATGTAGACAA
```

-continued

```
2151 CCAAAACGGC AAACTCCTAT CTGCAAACCA AGCACAATTA GCTGTTTCAG

2201 ACGGCCTATA CAACCAACAT GGTGAAATTG CCACCAACCG GCAGTTGTCT

2251 ATTCACGATA AAAATCAAAA CACTTTGGCG TTAAACAATG CGGATGGCAC

2301 GATTCAATCT GCCGGTAATG TATCGCTACA AGCCAAATCA CTCGCCAACA

2351 ATGGCACATT AACAGCCGGT AACAAACTGG ATATTGCTTT GACGGACGAT

2401 TTCGTCGTAG AGCGCGACCT CACTGCAGGC AAACAATTAA ATCTAAGCAT

2451 AAAAGGCCGT CTGAAAAATA CCCATACCCT ACAAGCAGGC CATACGCTCA

2501 AACTCAATGC CGGCAATATA GATAACCAAG TTACAGGCAA AATTATTGGT

2551 GGAGAACAAA CGGACATCAC ATCCGAACAG CATGTTGACA ACAGGGGCTT

2601 GATCAACAGC GACGGTTTGA CCCACATCGG TGCAGGTCAA ACCCTGACCA

2651 ACACCGGGAC AGGCAAAATC TATGGCAACC ATATTGCCCT GGACGCGCAA

2701 ATACTGCTTA ACCGGGAAGA AACGACGGAA GGCAGTACCA AAGCGGGGGC

2751 AATAGCTGCA AGGAAACGTT TGGATATTGG AGCGAAAGAG ATTCATAACC

2801 AAGAAGGTGC CCTACTATCC AGCGAAGGTA TTTTTGCCGT AgGTAATCGA

2851 CTGGATGAAC AACATCATGC GGCAGGCATG GCCGATACCT TTGTTAATGG

2901 CAGTGCCGGT TTGGAAGTAC AAGGTGATGC ATTGATGTCC GTTCGGAATA

2951 TGCAGAATAT CAATAATCAC TTTAAAACAG AGACATACTT AGCCAAAGCG

3001 GAAAAGCAAG TCCGCGACTA CACCGTACTG GGGCAAAATA CCTACTATCA

3051 GGCGGGAAAA GACGGTTTAT TCGACAACTC GCAAGGACAA AAAGACCAAA

3101 CTACTGCTAC GTTCCATTTA AAAAATGGTT CTCGTATTGA GGCCAACCAA

3151 TGGCATGTCC GAGACTACCA CATCGAGACT TATAAAGAAC GCATCATCGA

3201 AAACCGGCCG GCACACATTA CTGTGGGCGG TGATTTGACT GCCTCAGGTC

3251 AAAATTGGCT GAACAAAGAC AGCCGGATTG TAGTAGGCGG GCGTATTATC

3301 ACTGATGATT TAAACCAGAA AGAAATTACC AATCAAAGTA CAACAGGCAA

3351 AGGTCGCACA GATGCTGTCG GCACACAGTG GGATTCAGTT ACAAAAAAAG

3401 GATGGTACAG CGGTAGAAAA AGACAACGCC GTACTGAAAG AAACCATACT

3451 CCTTACCATG ATACCCAACT ATTTACCCAC GACTTCGACA CGCCTGTATC

3501 CGTCATCCAA CAGAATGCCG CCTCCCCTTC CTTTCAACCC GCCGCATCTG

3551 CAATCAAACT GATTGACGGA GTATCCACGG CAGCCGTCAA TGGTCAGCGC

3601 ATCCATACCG GTAATGTGGT CTCGTTAAAT AACGCTACTG TTACTCTGCC

3651 TAACAGCAGC CTCTATACCA CCCATCCTGA CAATAAAGGC TGGTTGGTTG

3701 AAACCGATCC TCAATTTGCA GACTACCGCC GCTGGTTGGG CAGCGACTAC

3751 ATGTTGCAAC AACTGCAATT GGACACCAAT CATCTACACA AACGGCTTGG

3801 CGACGGCTAC TACGAACAAA AACTTGTTAA TGAACAAATC CATCAGTTAA

3851 CAGGCTACCG CCCGACTCGAC GGCTACAGGA GTGATGAAGA ACAATTCAAA

3901 GCTCTGATGG ACAACGGCCT TACTGCTGCC AAAACATTCG GTCTCACCCC

3951 AGGTATCGCC TTGAGTGCAG AGCAAGTTGC CCGCTTAACT TCAGATATCG

4001 TTTGGATGGA AAATCAAACC GTCACCCTGT CTGACGGTTC GACTCAAACC

4051 GTACTGGTTC CTAAAGTCTA TGCCCTGGCG CGCAAAGGTG ATCTCAATAC

4101 CTCCGGTGGC CTGATTAGTG CCGAACAAGT CTTACTTAAA CTGCAAAACG
```

-continued

```
4151 GCAACCTGAC TAACAGCGGT ACCATTGCGG GGCGACAGGC CGTACTCATC

4201 CAGGCACGGA ATATTAACAG CAACGGTAAC ATTCAAGCCG ACCAAATCGG

4251 CTTAAAAGCT GAAAAAGTA TCAATATCGA CGGCGGGCAG GTACAAGCAG

4301 GCAGACTGCT GACTGCCCAA GCGCAAAATA TCAACCTTAA CGGTACAACC

4351 CAAACTTCCG GTAATGAACG TAACGGCAAT ACCGCCATCG ATCGTATGGC

4401 CGGCATTAAC GTGGTCGGAA GCCATACTGA ACAAGTAGAT AACAGAACTT

4451 CAGACGGCAT CCTATCCCTG CATGCCAGCA ACGATATCAA CCTCAATGCG

4501 GCCACCGTCT CTAACCAAGT TAAAGACGGC ACTACCCAAA TTACCGCCGG

4551 CAATAATCTC AACCTCGGCA CCATCCGTAC CGAACATCGC GAAGCCTATG

4601 GTACATTAGA TGACGAGAAC CATCGCCATG TCCGCCAAAG TACCGAAGTC

4651 GGCAGCAGTA TCCGCACGCA AAACGGCGCA CTGCTTAGAG CCGGTAACGA

4701 CTTAAAAATC CGCCAAGGCG AACTGGAGGC CGAAGAAGGC AAAACCGTCC

4751 TTGCCGCAGG ACGTGATGTC ACTATCAGCG AAGGACGCCA AATAACCGAA

4801 CTGGATACCT CGGTAAGCGG AAAAAGCAAA GGCATCCTTT CCAGTACCAA

4851 AACACACGAC CGCTACCGCT TCAGTCATGA TGAAGCAGTC GGCAGCAACA

4901 TCGGCGGCGG CAAAATGATT GTTGCAGCCG GCAGGATAT CAATGTACGC

4951 GGCAGCAACC TTATTTCTGA TAAGGGCATT GTTTTAAAAG CAGGACACGA

5001 CATCGATATT TCTACTGCCC ATAATCGCTA TACCGGCAAT GAATACCACG

5051 AGAGCAAAAA ATCAGGCGTC ATGGGTACTG GCGGATTGGG CTTTACTATC

5101 GGTAACCGGA AAACTACCGA TGACACTGAT CGTACCAATA TTGTCCATAC

5151 AGGCAGCATT ATAGGCAGCC TGAATGGAGA CACCGTTACA GTTGCAGGAA

5201 ACCGCTACCG ACAAACCGGC AGTACCGTCT CCAGCCCCGA GGGGCGCAAT

5251 ACCGTCACAG CCAAAAGCAT AGATGTAGAG TTCGCAAACA ACCGGTATGC

5301 CACTGACTAC GCCCATACCC AGGAACAAAA AGGCCTTACC GTCGCCCTCA

5351 ATGTCCCGGT TGTCCAAGCT GCACAAAACT TCATACAAGC AGCCCAAAAT

5401 GTGGGCAAAA GTAAAAATAA ACGCGTTAAT GCCATGGCTG CAGCCAATGC

5451 TGCATGGCAG AGTTATCAAG CAAACAACA AATGCAACAA TTTGCTCCAA

5501 GCAGCAGTGC GGGACAAGGT CAAACAACA ATCAAAGCCC CAGTATCAGT

5551 GTGTCCATTA CCTACGGCGA ACAGAAAAGT CGTAACGAGC AAAAAAGACA

5601 TTACACCGAA GCGGCAGCAA GTCAAATTAT CGGCAAAGGG CAAACCACAC

5651 TTGCGGCAAC AGGAAGTGGG GAGCAGTCCA ATATCAATAT TACAGGTTCC

5701 GATGTCATCG GCCATGCAGG TACTGCCCTC ATTGCCGACA ACCATATCAG

5751 ACTCCAATCT GCCAAACAGG ACGGCAGCGA GCAAAGCAAA AACAAAAGCA

5801 GTGGTTGGAA TGCAGGCGTA GCCGTCAAAA TAGGCAACGG CATCAGGTTT

5851 GGAATTACCG CCGGAGGAAA TATCGGTAAA GGTAAAGAGC AAGGGGGAAG

5901 TACTACCCAC CGCCACACCC ATGTCGGCAG CACAACCGGC AAAACTACCA

5951 TCCGAAGCGG CGGGGATACC ACCCTCAAAG GTGTGCAGCT CATCGGCAAA

6001 GGCATACAGG CAGATACGCG CAACCTGCAT ATAGAAAGTG TTCAAGATAC

6051 TGAAACCTAT CAGAGCAAAC AGCAAAACGG CAATGTCCAA GTTACTGTCG

6101 GTTACGGATT CAGTGCAAGC GGCAGTTACC GCCAAAGCAA AGTCAAAGCA

6151 GACCATGCCT CCGTAACCGG GCAAAGCGGT ATTTATGCCG GAGAAGACGG
```

```
-continued
6201 CTATCAAATC AAAGTCAGAG ACAACACAGA CCTCAAGGGC GGTATCATCA
6251 CGTCTAGCCA AAGCGCAGAA GATAAGGGCA AAAACCTTTT TCAGACGGCC
6301 ACCCTTACTG CCAGCGACAT TCAAAACCAC AGCCGCTACG AAGGCAGAAG
6351 CTTCGGCATA GGCGGCAGTT TCGACCTGAA CGGCGGCTGG GACGGCACGG
6401 TTACCGACAA ACAAGGCAGG CCTACCGACA GGATAAGCCC GGCAGCCGGC
6451 TACGGCAGCG ACGGAGACAG CAAAAACAGC ACCACCCGCA GCGGCGTCAA
6501 CACCCACAAC ATACACATCA CCGACGAAGC GGGACAACTT GCCCGAACAG
6551 GCAGGACTGC AAAAGAAACC GAAGCGCGTA TCTACACCGG CATCGACACC
6601 GAAACTGCGG ATCAACACTC AGGCCATCTG AAAAACAGCT TCGACAAAGA
6651 CGCGGTCGCC AAAGAGATCA ACCTGCAAAG GAAGTAACG AAGGAGTTCG
6701 GCAGAAACGC CGCCCAAGCC GTAGCGGCCG TTGCCGACAA ACTCGGCAAT
6751 ACCCAAAGTT ACGAACGGTA TCAGGAAGCC CGAACCCTGC TGGAGGCCGA
6801 ACTGCAAAAC ACGGACAGCG AAGCCGAAAA AGCCGCCTTC CGCGCATCCC
6851 TCGGCCAAGT AAACGCCTAT CTTGCCGAAA ACCAAAGCCG CTACGACACC
6901 TGGAAAGAAG GCGGCATAGG CAGGAGCATA CTGCACGGGG CGGCAGGCGG
6951 ACTGACGACC GGCAGCCTCG GCGGCATACT GGCCGGCGGC GGCACTTCCC
7001 TTGCCGCACC GTATTTGGAC AAAGCGGCGG AAAACCTCGG TCCGGCGGGC
7051 AAAGCGGCGG TCAACGCACT GGGCGGTGCG GCCATCGGCT ATGCAACTGG
7101 TGGTAGTGGT GGTGCTGTGG TGGGTGCGAA TGTAGATTGG AACAATAGGC
7151 AGCTGCATCC GAAAGAAATG GCGTTGGCCG ACAAATATGC CGAAGCCCTC
7201 AAGCGCGAAG TTGAAAAACG CGAAGGCAGA AAAATCAGCA GCCAAGAAGC
7251 GGCAATGAGA ATCCGCAGGC AGATACTGCG TTGGGTGGAC AAAGGTTCCC
7301 AAGACGGCTA TACCGACCAA AGCGTCATAT CCCTTATCGG AATGAAAGGC
7351 GAAGACAAAG CCTTGGGTTA TACTTGGGAC TACCGCGACT ACGGCGCAAG
7401 AAATCCGCAA ACCTACAACG ATCCGAAGCT GTTTGAGGAA TACCGCCGAC
7451 AGGACAAACC CGAATACCGC AACCTGACCT GGCTGCACAG CGGGACGAAA
7501 GACACCAAAA TCAGGCAGGG AGAGCGGAAA AACGAAGAGT TTGCACTGAA
7551 CGTTGCCGAA GGACTGACGA GCCTTGTCAA CCCCAATCCG AGGATAAAAG
7601 TCCCGATTCT TGCAGGCATC CGCAACCTGA AAACATCAA GCCGACAGTT
7651 ACCGGCAGCG ATCCCTTATT GGCGGGTGCG GGGAATATCC GTATCCCTGC
7701 AAACGGCAAT GTTGCGAAGG GGGACAGGAT TCCGGATACG GCATTGGCTA
7751 GCAAGGGAAT CAAACATAAA GATCGTAAAG ATCAACTGGA GAAAAAATAA
```

This corresponds to the amino acid sequence <SEQ ID 1670; ORF 564>:

```
m564.pep
    1 MNRTLYKVVF NKHRNCMIAV AENAKREGKN TADTQAVGIL PNDIAGFAGF

51 IHSISVISFS LSLLLGSALI LTSSSATAQG IVADKSAPAQ QQPTILQTGN

101 GIPQVNIQTP TSAGVSVNQY AQFDVGNRGA ILNNSRSNTQ TQLGGWIQGN

151 PWLARGEARV VVNQINSSHS SQLNGYIEVG GRRAEVVIAN PAGIAVNGGG

201 FINASRATLT TAQPQYQAGD LSGFKIRQGN VVIAGHGLDA RDTDYTRILS
```

```
 251  YHSKIDAPVW  GQDVRVVAGQ  NDVAATGDAH  SPILNNAAAN  TSNNTANNGT
 301  HIPLFAIDTG  KLGGMYANKI  TLISTVEQAG  IRNQGWFAS   AGNVAVNAEG
 351  KLVNTGMIAA  TGENHAVSLH  ARNVHNSGTV  ASQDDANIHS  QTLDNSGTVL
 401  SSGRLTVRNL  GRLKNQNNGT  IQAARLDMST  GGLDNTGNIT  QTGSQALDLV
 451  SAGKFDNSGK  IGVSDVPQTG  LNPNPSVIPQ  IPSTATGSGS  STVSVSKPGS
 501  NNPVSPTAPA  KNYAVGRIQT  TGAFDNAGSI  NAGGQIDIAA  QNGLGNSGSL
 551  NAAKLRVSGD  SFNNTVKGKL  QAHDLAVNTQ  TAKNSGHLLT  QTGKIDNREL
 601  HNAGEIAANN  LTLIHSGRLS  NDKKGNIRAA  HLQLDTAGLH  NAGNILADSG
 651  TVTTKNNLRN  TGKVSVARLN  TEGQTLDNTR  GRIEAETVNI  QSQQLTNQSG
 701  HITATEQLTI  NSRNVDNQNG  KLLSANQAQL  AVSDGLYNQH  GEIATNRQLS
 751  IHDKNQNTLA  LNNADGTIQS  AGNVSLQAKS  LANNGTLTAG  NKLDIALTDD
 801  FVVERDLTAG  KQLNLSIKGR  LKNTHTLQAG  HTLKLNAGNI  DNQVTGKIIG
 851  GEQTDITSEQ  HVDNRGLINS  DGLTHIGAGQ  TLTNTGTGKI  YGNHIALDAQ
 901  ILLNREETTE  GSTKAGAIAA  RKRLDIGAKE  IHNQEGALLS  SEGIFAVGNR
 951  LDEQHHAAGM  ADTFVNGSAG  LEVQGDALMS  VRNMQNINNH  FKTETYLAKA
1001  EKQVRDYTVL  GQNTYYQAGK  DGLFDNSQGQ  KDQTTATFHL  KNGSRIEANQ
1051  WHVRDYHIET  YKERIIENRP  AHITVGGDLT  ASGQNWLNKD  SRIVVGGRII
1101  TDDLNQKEIT  NQSTTGKGRT  DAVGTQWDSV  TKKGWYSGRK  RQRRTERNHT
1151  PYHDTQLFTH  DFDTPVSVIQ  QNAASPSFQP  AASAIKLIDG  VSTAAVNGQR
1201  IHTGNVVSLN  NATVTLPNSS  LYTTHPDNKG  WLVETDPQFA  DYRRWLGSDY
1251  MLQQLQLDTN  HLHKRLGDGY  YEQKLVNEQI  HQLTGYRRLD  GYRSDEEQFK
1301  ALMDNGLTAA  KTFGLTPGIA  LSAEQVARLT  SDIVWMENQT  VTLSDGSTQT
1351  VLVPKVYALA  RKGDLNTSGG  LISAEQVLLK  LQNGNLTNSG  TIAGRQAVLI
1401  QARNINSNGN  IQADQIGLKA  EKSINIDGGQ  VQAGRLLTAQ  AQNINLNGTT
1451  QTSGNERNGN  TAIDRMAGIN  VVGSHTEQVD  NRTSDGILSL  HASNDINLNA
1501  ATVSNQVKDG  TTQITAGNNL  NLGTIRTEHR  EAYGTLDDEN  HRHVRQSTEV
1551  GSSIRTQNGA  LLRAGNDLKI  RQGELEAEEG  KTVLAAGRDV  TISEGRQITE
1601  LDTSVSGKSK  GILSSTKTHD  RYRFSHDEAV  GSNIGGGKMI  VAAGQDINVR
1651  GSNLISDKGI  VLKAGHDIDI  STAHNRYTGN  EYHESKKSGV  MGTGGLGFTI
1701  GNRKTTDDTD  RTNIVHTGSI  IGSLNGDTVT  VAGNRYRQTG  STVSSPEGRN
1751  TVTAKSIDVE  FANNRYATDY  AHTEQKGLT   VALNVPVVQA  AQNFIQAAQN
1801  VGKSKNKRVN  AMAAANAAWQ  SYQATQQMQQ  FAPSSSAGQG  QNNNQSPSIS
1851  VSITYGEQKS  RNEQKRHYTE  AAASQIIGKG  QTTLAATGSG  EQSNINITGS
1901  DVIGHAGTAL  IADNHIRLQS  AKQDGSEQSK  NKSSGWNAGV  AVKIGNGIRF
1951  GITAGGNIGK  GKEQGGSTTH  RHTHVGSTTG  KTTIRSGGDT  TLKGVQLIGK
2001  GIQADTRNLH  IESVQDTETY  QSKQQNGNVQ  VTVGYGFSAS  GSYRQSKVKA
2051  DHASVTGQSG  IYAGEDGYQI  KVRDNTDLKG  GIITSSQSAE  DKGKNLFQTA
2101  TLTASDIQNH  SRYEGRSFGI  GGSFDLNGGW  DGTVTDKQGR  PTDRISPAAG
2151  YGSDGDSKNS  TTRSGVNTHN  IHITDEAGQL  ARTGRTAKET  EARIYTGIDT
2201  ETADQHSGHL  KNSFDKDAVA  KEINLQREVT  KEFGRNAAQA  VAAVADKLGN
```

```
-continued
2251 TQSYERYQEA RTLLEAELQN TDSEAEKAAF RASLGQVNAY LAENQSRYDT

2301 WKEGGIGRSI LHGAAGGLTT GSLGGILAGG GTSLAAPYLD KAAENLGPAG

2351 KAAVNALGGA AIGYATGGSG GAVVGANVDW NNRQLHPKEM ALADKYAEAL

2401 KREVEKREGR KISSQEAAMR IRRQILRWVD KGSQDGYTDQ SVISLIGMKG

2451 EDKALGYTWD YRDYGARNPQ TYNDPKLFEE YRRQDKPEYR NLTWLHSGTK

2501 DTKIRQGERK NEEFALNVAE GLTSLVNPNP RIKVPILAGI RNLKNIKPTV

2551 TGSDPLLAGA GNIRIPANGN VAKGDRIPDT ALASKGIKHK DRKDQLEKK*
```

Computer analysis of this amino acid sequence gave the following results:
Homology with a Predicted ORF from *N. gonorrhoeae*

```
    m564/fha

ID         FHAB_BORPE STANDARD; PRT; 3591 AA.

AC         P12255;

DT         01-OCT-1989 (REL. 12, CREATED)

DT         01-FEB-1996 (REL. 33, LAST SEQUENCE UPDATE)

DT         01-FEB-1996 (REL. 33, LAST ANNOTATION UPDATE)

DE         FILAMENTOUS HEMAGGLUTININ...

SCORES     Init1: 190 Initn: 524 Opt: 594
    Smith-
    Waterman
    score:     866; 21.7% identity in 2427 aa overlap 10         20         30         40         50         60
    m564.pep   MNRTLYKVVFNKHRNCMIAVAENAKREGKNTADTQAVGILPNDIAGFAGFIHSISVISFS
               ||  :||::||::  |:  ::  |:|:      |  ||     ::  |      :|    :       |::   :::
    fhab_borpe MNTNLYRLVFSHVRGMLVPVSEHCTV-G-NTFCGRTRG---QARSGARATSLSVAPNALA
                        10         20         30            40         50

70         80         90        100        110       119
    m564.pep   LSLLLG-SALILTSSSATAQGIVADKSAPAQQQPTILQTGNGIPQVNIQTPTSAGVSVNQ
               :|:|:  ::|  |::      |||:|         |  |  |      :||  ||   ||     |:
    fhab_borpe WALMLACTGLPLVTH---AQGLV-----P-QGQTQVLQGGNKVPVVNIADPNSGGVSHNK
                        60         70                 80         90        100

120        130        140        150        160       179
    m564.pep   YAQFDVGNRGAILNNSRSNTQTQLGGWIQGNPWLARGEARVVVNQINSSHSSQLNGYIEV
               :  ||:|:|  |:::||  ::   :::||        ||   |:|   :|   |:::   :::::     |:|     |   :||
    fhab_borpe FQQFNVANPGVVFNNGLTDGVSRIGGALTKNPNLTR-QASAILAEVTDTSPSRLAGTLEV
                       110        120        130        140        150       160

180        190        200        210        220       239
    m564.pep   GGRRAEVVIANPAGIAVNGGGFINASRATLTTAQPQYQAGDLSGFKIRQGNVVIAGHGLD
               |:  |:::||||  ||:|||   :  :|||     ||||::|:   :::|   :  |:   ::||:|:|           |::
    fhab_borpe YGKGADLIIANPNGISVNGLSTLNASNLTLTTGRPSVNGGRI-GLDVQQGTVTIERGGVN
                       170        180        190        200        210       220

240        250        260        270        280       290
    m564.pep   ARDTDYTRILSYHSKIDAPV---WGQ---DVRVVAGQNDVAATGDAHSPILNNAAANTSN
               |    |   :::    |:::  |      |:      |:   ||||  |         :  :||         ||::  :
    fhab_borpe ATGLGYFDVVARLVKLQGAVSSKQGKPLADIAVVAGANRYDHATRRATPI----AAGARG
                       230        240        250        260        270       280

300        310        320        330        340       350
    m564.pep   NTANNGTHIPLFAIDTGKLGGMYANKITLISTVEQAGIRNQGQWFASAGNVAVNAEGKLV
               :|:         :|||    |:||:::|||:|:    |:|:||:|::|     |: |:||    |:::
    fhab_borpe AAAGA------YAIDGTAAGAMYGKHITLVSSDSGLGVRQLGS-LSSPSAITVSSQGEIA
                                  290        300        310         320        330
```

-continued

```
                360       370       380       390       400       410
m564.pep    NTGMIAATGENHAVSLHARNVHNSGTVASQDDANIHSQTLDNSGTVLSSGRLTVRNLGRL
              :  ||  :  :|||:: :|  ::  :||      ::  ::|:|  ::   ::|  |
fhab_borpe  ---LGDATVQRGPLSLKGAGVVSAGKLASGGGAV----NVAGGGAVKIA---SASSVGNL
                340       350       360       370       380

420       430       440       450       460       470
m564.pep    KNQNNGTIQAARLDMSTGGLDNTGNITQTGSQALDLVSAGKFDNSGKIGVSDVPQTGLNP
             |::|  |||:  |: :        |::  :| |||:|  :|::: ::|    : |:
fhab_borpe  AVQGGGKVQATLLNAG-------GTLLVSGRQAVQLGAASSRQALSVNAGGALKADKLSA
                390       400       410       420       430

480       490       500       510       520       530
m564.pep    NPSV-IPQIPSTATGSGSSTVSVSKPGSNNPVSPTAPAKNYAVGRIQTTGAFD-NAGSIN
             :  | :    ::| ||:||::   :|:     :|   |:|:|||:::    : ||:
fhab_borpe  TRRVDVDGKQAVALGSASSNALSVRAGGA-----LKAGKLSATGRLDVDGKQAVTLGSVA
                440       450       460       470       480       490

540       550       55        560       570       579
m564.pep    AGGQIDIAAQNGLGNSGSLNAAKLRVSG------DSFNNT------VKGKLQAHDLAVNT
             :  |  :::|  ||  :    :::|:|:|  |     |: :::    :  | ||  ::|
fhab_borpe  SDGALSVSAGGNLRANELVSSAQLEVRGQREVALDDASSARGMTVVAAGALAARNLQSKG
                500       510       520       530       540       550

580       590       600       610       620       630
m564.pep    QTAKNSGHLLTQTGKIDNRELH--NAGEIAANNLTLIHSGRLSNDKKGNIRAAHLQLDTA
              :  ::|  :: :: :: ||:  : |::   ::| :::  :|::  ||   |:  |  |:
fhab_borpe  AIGVQGGEAVSANANSDAELRVRGRGQVDLHDLSAARGADISGEGRVNIGRARSDSDVK
                560       570       580       590       600       610

640       650       660       670       680       690
m564.pep    GLHNAGNILADSGTVTTKNNLRNTGKVSVARLNTEGQTLDNTRGRIEAETVNIQSQQLTN
             |   :   ||  :  |||  |:    |:|| |  : ::     |   :|::   :
fhab_borpe  -VSAHGALSIDSMTALGAIGVQAGGSVSAKDMRSRGAVTVSGGG-----AVNLGDVQ---
                620       630       640       650       660

700       710       720       730       740       750
m564.pep    QSGHITATEQLTINSRNVDNQNGKLLSANQAQLAVSDGLYNQHGEIATNRQLSIHDKNQN
             ::::  ||   :::   |::    |    |:|::  |   |:| ::|::| :::: ::
fhab_borpe  SDGQVRATSAGAMTVRDV---------AAAADLALQAGDALQAGFLKSAGAMTVNGRDAV
                670       680       690       700       710

760       770       780       790       800       810
m564.pep    TLALNNADGTIQSAGNVSLQAKSLANNGTLTAGNKLDIALTDDFVVERDLTAGKQL-NLS
             |      ||: :::|::  :::  :    |  |:|| ::| ::|  :|    :|    :|
fhab_borpe  RL-----DGA-HAGGQLRVSSDGQAALGSLAAKGELTVSAARAATVA-EL---KSLDNIS
                720       730       740       750       760

820       830       840       850       860       870
m564.pep    IKGRLK-NTHTLQAGHTLKLNA-GNIDNQVTGKIIGGEQTDITSEQHVDNRGLINSDGLT
             :   |  :|  : ::::::|::  ::     :||  :|| ||:|    ::::|
fhab_borpe  VTGGERVSVQSVNSASRVAISAHGALD---VGKV--SAKSGIGLE----GWGAVGADSL-
                770       780       790       800       810

880       890       900       910       920       930
m564.pep    HIGAGQTLTNTGTGKIYGNHIALDAQILLNREETTEGSTKAGAIAARKRLDI-GAKEIHN
             |:  :::  :|   :   ::    |:| |:    :|||  ||: |  :|:  |::
fhab_borpe  --GSDGAISVSGRDAVRVDQARSLADISLG----AEGGATLGAVEAAGSIDVRGGSTV--
                820       830       840       850       860

940       950       960       970       980       990
m564.pep    QEGALLSSEGIFAVGNRLDEQHHAAGMADTFVNGSAGLEVQGDALMSVRNMQNINNHFKT
             ::| :::  : :|  |    | :|:     ::  |:| :::  |:::  |:    :::
fhab_borpe  AANSLHANRDVRVSGK--DAVRVTAATSGGGLHVSSGRQLDLGAVQA-RGALALDGGAGV
                870       880       890       900       910       920

1000      1010      1020      1030      1040      1050
m564.pep    ETYLAKAEK--QVRDYTVLGQNTYYQAGKDGLFDNSQGQKDQTTATFHLKNGSRIEANQ-
             |||     :|:    |  :|    :    ::|  | :|   |: ::|:
fhab_borpe  ALQSAKASGTLHVQGGEHLDLGTLAAVGAVDV----NGTGDVRVAKLVSDAGADLQAGRS
                930       940       950       960       970

1060      1070      1080      1090      1100
m564.pep    --WHVRDYHIETYKERIIENRPAHITVGGDLTASGQNWLNKDSRIVVGGRIITDDLNQKE
                ||     |::|   |:: |||:  |::|   |: |::|:|      :|
fhab_borpe  MTLGIVDTTGDLQARAQQKLELGSVKSDGGLQAAAGGALSLAAAEVAGALELS---GQGV
            980       990       1000      1010      1020      1030
```

-continued

```
              1110      1120      1130      1140      1150      1160
m564.pep    ITNQSTTGKGRTDAVGTQWDSVTKKGWY--SGRKRQRRTERNHTPYHDTQLFTHDFDTPV
            :::::::::|  |::   ::  | |   ::  |||:  |          :|| ||
fhab_borpe  TVDRASASRARIDSTGSVGIGALKAGAVEAASPRRARRALR-----------QDFFTPG
              1040      1050      1060      1070      1080

1170      1180      1190      1200      1210      1220
m564.pep    SVI---QQNAASPSFQPAASAIKLIDGVSTAAVNGQRIHTGNVVSLNNATVTLPNSSLYT
            ||:   |  |::   :|  :::    |  :   |  ::  :::|||   :|
fhab_borpe  SVVVRAQGNVTVGRGDPHQGVLAQGDIIMDA--KGGTLLLRNDALTENGTVTISADSAVL
              1090      1100      1110      1120      1130      1140

1230      1240      1250      1260      1270      1280
m564.pep    THPDNKGWLVETD-PQFADYRRWLGSDYMLQQLQLDTNHLHKRLGDGYYEQKLVNEQIHQ
            |    ::  ::     :|  :     |   :::||   |     :::|:  ::   ::||
fhab_borpe  EHSTIESKISQSVLAAKGDKGKPAVSVKVAKKLFL--NGTLRAVNDN--NETMSGRQIDV
              1150      1160      1170      1180      1190

1290      1300      1310      1320      1330      1340
m564.pep    LTGYRRLDGYRSDEEQFKALMDNGLTAAKTFGLTPG-IALSAEQVARLTSDIVWMENQTV
            :  |   ::     :|    :| |:::::  ::    |  ||::   |   ::    :|:
fhab_borpe  VDGRPQI----TDAVTGEARKDESVVSDAALVADGGPIVVEAGELVSHAGGIGNGRNK--
              1200      1210      1220      1230      1240      1250

1350      1360      1370      1380      1390      1400
m564.pep    TLSDGSTQTVLVPKVYALARKGDLNTSGGLISAEQVLLKLQNGNLTNSGTIAGRQAVLIQ
            :|:: ||   ||       ||  ::||    :|:: |  ::|:  |  |
fhab_borpe  --ENGASVTVRTT--------GNLVNKGYISAGKQGVLEV-GGALTNEFLVGSDGTQRIE
                1260      1270      1280      1290      1300

1410      1420      1430      1440      1450
m564.pep    ARNINSNGNIQ-------ADQIGLKAEKSINIDGGQVQAGRLLTAQ----AQNINLNGTT
            |:  |::  ::|        |    :  ||  ::||  ||  ::|        :  ::: :
fhab_borpe  AQRIENRGTFQSQAPAGTAGALVVKAAEAIVHDGVMATKGEMQIAGKGGGSPTVTAGAKA
              1310      1320      1330      1340      1350      1360

1460      1470      1480      1490      1500
m564.pep    QTSGNERNGNTAI-DRMAGINVV-GSHTEQVDNRTSD-GILSLHASNDINLNAATVSNQV
            ||:|: : ::|   |    :::::   |:       |   |   :: |  :::::  ::  ||
fhab_borpe  TTSANKLSVDVASWDNAGSLDIKKGGAQVTVAGRYAEHGEVSIQGDYTVSADAIALAAQV
              1370      1380      1390      1400      1410      1420

1510      1520      1530      1540      1550
m564.pep    --KDGTTQITAGNNLNLGT-IRTE---HREAYGTLDDENHRHVRQST---------EVGS
              : |::::|: ::  ::: ||      :|  |:  :::  :|       ||
fhab_borpe  TQRGGAANLTSRHDTRFSNKIRLMGPLQVNAGGPVSNTGNLKVREGVTVTAASFDNETGA
              1430      1440      1450      1460      1470      1480

1560      1570      1580      1590      1600
m564.pep    SIRTQNGALLRAGNDLKIRQGELEAEEGKTVLAAGRDV--TISEGRQITELDTS---VSG
            : ::::::|  :|    :  |::::|:  |::|||  :   |::   ||   :  :       |
fhab_borpe  EVMAKSATLTTSGAARN--AGKMQVKEAATIVAASVSNPGTFTAGKDITVTSRGGFDNEG
              1490      1500      1510      1520      1530

1610      1620      1630      1640      1650      1660
m564.pep    K---SKGILSSTKTHDRYRF---SHDEAV-GSNIGGGKMIVAAGQDINVRGSNLISDKGI
                 :| |: :|:  :    |    :||  :|  |: : ::   :  ||:|::|:::  :   |::
fhab_borpe  KMESNKDIVIKTEQFSNGRVLDAKHDLTVTASGQADNRGSLKAGHDFTVQAQRI--DNSG
              1540      1550      1560      1570      1580      1590

1670     16  1680      1690      1700      1710
m564.pep    VLKAGHDIDISTAHNRYTG-----NEYHESKKSGVMGTGGLGFTIGNRKTTDDTDRTNIV
            ::  ||||   :::  | |  ||       ::  |  :::  :||   |   : |  :|||
fhab_borpe  TMAAGHDATLKAPHLRNTGQVVAGHDIHIINSAKLENTGRV--DARNDIALDVADFTN--
              1600      1610      1620      1630      1640      1650

1720      1730      1    1740      1750      1760      1770
m564.pep    HTGSIIGSLNGDTVTVAGNRYRQT----GSTVSSPEGRNTVTAKSIDVEFANNRYATDYA
            |||:  ::   :|:|:|    |:              ||  ::   ::     ::    ::
fhab_borpe  -TGSLYAEHDA-TLTLAQGTQRDLVVDQDHILPVAEGTLRVKAKSLTTEIETGNPGSLIA
              1660      1670      1680      1690      1700      1710

1780      1790      1800      1810      1820      1830
m564.pep    HTQEQKGLTVALNVPVVQAAQNFIQAAQNVGKSKNKRVNAMAAANAA-WQSYQATQQMQQ
            ::||        |:  ||       |:  ||       :   |:: :  |||         |:
fhab_borpe  EVQE--------NIDNKQA----IVVGKDTLS-SAHGNVANEANALLWAAGELTVKAQN
                      1720      1730      1740      1750
```

```
             1840       1850       1860       1870       1880       1890
m564.pep   FAPSSSAGQGQNNNQSPSISVSITYGEQKSRNEQKRHYTEAAASQIIGKGQTTLAATGSG
           :: : :|     :: |    : :|::      :  |   :  |      | :|    ::|    :|
fhab_borpe ITNKRAALIEAGGNARLTAAVALLNKLGRIRAGEDMHLD---APRI----ENTAKLSGEV
             1760       1770       1780       1790       1800       1810

1900       1910       1920       1930       1940       1950
m564.pep   EQSNINITGSDVIGHAGTALIADNHIRLQSAKQDGSEQSKNKSSGWNAGVAVKIGNGIRF
           :::::: :|:     |:  :    ::   :|   ::|: |:          :: |  :|    :  : |:
fhab_borpe QRKGVQDVGGGEHGRWSGIGYVNYWLRAGNGKKAGT-----IAAPWYGGDLTAEQSLIEV
             1820       1830       1840       1850       1860

1960       1970       1980       1990       2000       2010
m564.pep   GITAGGNIGKGKEQGGSTTHRHTHVGSTTGKTTIRSGGDTTLKGVQLIGKGIQADTRNLH
           |    |   |  |::    |||         :: :|::||      :  |       ::|:|::
fhab_borpe GKDLYLNAGARKDE-----HRHL-----LNEGVIQAGGHGHIGG--------DVDNRSV-
             1870       1880       1890       1900

2020       2030       2040       2050       2060
m564.pep   IESVQDTETYQSKQQNGNVQVTVGYGFSASGSYRQSKVKA-----DHASVTGQSGIYAGE
           :::|:   |  :::      :  :      |:|   :       ||    :       |:        |:|
fhab_borpe VRTVSAMEYFKTPLPVSLTALDNRAGLSPATWNFQSTYELLDYLLDQNRYEYIWGLYPTY
             1910       1920       1930       1940       1950       1960

2070       2080       2090       2100       2110       2120
m564.pep   DGYQIKVRDNTDLKGGIITSSQSAEDKGKNLFQTATLTASDIQNHS--RYEGRSFGIGGS
           :::::    |  |||       :    |::: :|          |:::|    :|             |||:: :|
fhab_borpe TEWSVNTLKNLDL-GYQAKPAPTAPPMPKA-------PELDLRGHTLESAEGRKI-FGEY
             1970       1980       1990       2000       2010

2130       2140       2150       2160       2170
m564.pep   FDLNGGWDGT-----VTDKQGRPTDRISPAAGYGSDGDSKNSTTRSGVNTHNIHITDEAG
           |:|  :: :       :::     |: |  |:     |          ::  :   : :|:::::    ::
fhab_borpe KKLQGEYEKAKMAVQAVEAYGEATRRVHDQLG------QRYGKALGGMDAETKEVDGIIQ
             2020       2030       2040       2050       2060       2070

2180       2190       2200       2210       2220       2230
m564.pep   QLARTGRTAKETEARIYTGIDTETADQHSGHLKNSFDKDAVAKEINLQREVTKEFGRNAA
           ::|     ||:      :|       |    | ||:||   |: : :   |:::|          ||        ||:: :
fhab_borpe EFAADLRTVYAKQADQAT-IDAET-DKVAQRYKSQID--AVRLQAIQPGRVT--LAKALS
             2080       2090       2100       2110       2120

2240       2250       2260       2270       2280       2290
m564.pep   QAVAAVADKLGNTQSYERYQEARTLLE-AELQNTDSEAEKAAFRASLGQVNAYL------
           |::|        ||::|   ::|:::   ::     :   ||:           :|       |       |:|       |: :
fhab_borpe AALGADWRALGHSQLMQRWKDFKAGKRGAEIAFYPKEQTVLAAGAGLTLSNGAIHNGENA
             2130       2140       2150       2160       2170       2180

2300       2310       2320       2330       2340       2350
m564.pep   AENQSRYDTWKEGGIGRSILHGAAGGLTTGSLGGILAGGGTSLAAPYLDKAAENLGPAGK
           |:|::|  :       |    |:: :  :       |:      :|
fhab_borpe AQNRGRPEGLKIGAHSATSVSGSFDALRDVGLEKRLDIDDALAAVLVNPHIFTRIGAAQT
             2190       2200       2210       2220       2230       2240
```

The following partial DNA sequence was identified in *N. gonorrhoeae* <SEQ ID 1671>:

```
g565.seq
  1 atggacagca cattgtctaa aacgtgttgc gtttcgtgca tattgttgag 51 cgtaaccacc accattttcg cccgtcccag accggcggct tccaatactt 101 ccctgcgttt cgcatcgccg aacgacaccg gctcgcctgc acttctggct 151 acctgcacgc gtgcgatgtc caagtcgagc gcgaaatacg gaatatcctc 201 tttgggcgaa gacgcgtccg accgtctgcc cgccctgcc gaagccgaca 251 atcagcacat gatcagactt gctcatcgct tccaccaaca tgctgtgcag 301 atcgagcgac ttcatgtccc agcttga
```

This corresponds to the amino acid sequence <SEQ ID 1672; ORF 565.ng>:

```
g565.pep
   1 MDSTLSKTCC VSCILLSVTT TIFARPRPAA SNTSLRFASP NDTGSPALLA

51 TCTRAMSKSS AKYGISSLGE DASDRLPAPA EADNQHMIRL AHRFHQHAVQ

101 IERLHVPA*
```

The following partial DNA sequence was identified in *N. meningitidis* <SEQ ID 1673>:

```
m565.seq
   1 ATGGACAGCA CATTGTCTAA AACGTGTTGC GTTTCGTGCA TATTGTTGAG

51 CGTAACCACC ACCATTTTCG CCCGTCCCAG ACCGGCGGCT TCCAATACTT

101 CCCTGCGTTT CGCATCGCCG AACGACACCG GTTCGCCCGC ACTTCTGGCA

151 ACCTGCACCC GCGCAATGTC CAAGTCGAGC GCGAAATACG GAATATCCTC

201 TTGGGCAAGG ACGCGTCCGA CCGTCTGCCC GCCCCTGCCG AAGCCGACAA

251 TCAGCACATG GTCGGACTTG CTCATGGTTT CTACCAGCAT ACTGTGCAGA

301 TCGAGCGACT TCATGTCCCA GCTTGACTTG ACCAAACGCC CGACCAGCGC

351 ATCGCTGCCG CCCAAGAGGA AGGGCGCGAT AATCATCGAC AGCAGAACCG

401 CCGCCGTCGC CGCCTGTTCC CATTCTGGCG AAACCATATC AAGCTGCCCG

451 GCAATGGCCA GCATCACGAA GCCGAACTCG CCGCCCTGCG CGAGATACAA

501 AGCCGTTTTG AGGCTGTCGC CGACCGAATG TTTCATTTTG AAGGCAATGG

551 CAAACACAAC CAGTGCCTTC AACACCAGCA GCATTGCCAA CAGCATCAAT

601 ACCTGCCGCC AGCCGCCGAT CAATGCCTGA
```

This corresponds to the amino acid sequence <SEQ ID 1674; ORF 565>:

```
m565.pep
   1 MDSTLSKTCC VSCILLSVTT TIFARPRPAA SNTSLRFASP NDTGSPALLA

51 TCTRAMSKSS AKYGISSWAR TRPTVCPPLP KPTISTWSDL LMVSTSILCR

101 SSDFMSQLDL TKRPTSASLP PKRKGAIIID SRTAAVAACS HSGETISSCP

151 AMASITKPNS PPCARYKAVL RLSPTECFIL KAMANTTSAF NTSSIANSIN

201 TCRQPPINA*
```

Computer analysis of this amino acid sequence gave the following results:
Homology with a Predicted ORF from *N. gonorrhoeae*

```
    m565/g565 100.0% identity in 67 aa overlap 10        20        30        40        50        60
    m565.pep MDSTLSKTCCVSCILLSVTTTIFARPRPAASNTSLRFASPNDTGSPALLATCTRAMSKSS
             ||||||||||||||||||||||||||||||||||||||||||||||||||||||||||||
        g565 MDSTLSKTCCVSCILLSVTTTIFARPRPAASNTSLRFASPNDTGSPALLATCTRAMSKSS
                    10        20        30        40        50        60

70        80        90       100       110       120
    m565.pep AKYGISSWARTRPTVCPPLPKPTISTWSDLLMVSTSILCRSSDFMSQLDLTKRPRSASLP
             |||||||
        g565 AKYGISSLGEDASDRLPAPAEADNQHMIRLAHRFHQHAVQIERLHVPAX
```

The following partial DNA sequence was identified in *N. meningitidis* <SEQ ID 1675>:

```
a565.seq
   1 ATGGACAGCA CATTGTCTAA AACGTGTTGC GTTTCGTGCA TATTGTTGAG

51 CGTAACCACC ACCATTTTCG CCCGTCCCAG ACCGGCGGCT TCCAATACTT

101 CCCTGCGTTT CGCATCGCCG AACGACACCG GTTCGCCCGC ACTTCTGGCA

151 ACCTGCACCC GCGCAATGTC CAAGTCGAGC GCGAAATACG GAATATCCTC

201 TTGGGCAAGG ACGCGTCCGA CCGTCTGCCC GCCCCTGCCG AAGCCGACAA

251 TCAGCACATG GTCGGACTTG CTCATGGTTT CTACCAGCAT ACTGTGCAGA

301 TCGAGCGACT TCATGTCCCA GCTTGACTTG ACCAAACGCC CGACCAGTGC

351 ATCGCTGCCG CCCAAGAGGA AGGGCGCGAT AATCATCGAC AGCAGAACCG

401 CCGCCGTCGC CGCCTGTTCC CATTCTAGCG AAACCATATC AAGCTGCCCG

451 GCAATGGCCA GCATCACGAA GCCGAACTCG CCGCCCTGCG CGAGATACAA

501 AGCCGTTTTG AGGCTGTCGC CGACCGAATG TTTCATTTTG AAGGCAATGG

551 CAAACACAAC CAGTGCCTTC AACACCAGCA GCATTGCCAA CAGCATCAAT

601 ACCTGCCGCC AGCCGCCGAT TAATGCCTGA
```

This corresponds to the amino acid sequence <SEQ ID 1676; ORF 565.a>:

```
a565.pep

1  MDSTLSKTCC VSCILLSVTT TIFARPRPAA SNTSLRFASP NDTGSPALLA

51  TCTRAMSKSS AKYGISSWAR TRPTVCPPLP KPTISTWSDL LMVSTSILCR

101  SSDFMSQLDL TKRPTSASLP PKRKGAIIID SRTAAVAACS HSSETISSCP

151  AMASITKPNS PPCARYKAVL RLSPTECFIL KAMANTTSAF NTSSIANSIN

201  TCRQPPINA* m565/a565  99.5% identity in 209 aa overlap 10        20        30        40        50        60
m565.pep    MDSTLSKTCCVSCILLSVTTTIFARPRPAASNTSLRFASPNDTGSPALLATCTRAMSKSS
            ||||||||||||||||||||||||||||||||||||||||||||||||||||||||||||
a565        MDSTLSKTCCVSCILLSVTTTIFARPRPAASNTSLRFASPNDTGSPALLATCTRAMSKSS
                    10        20        30        40        50        60

70        80        90       100       110       120
m565.pep    AKYGISSWARTRPTVCPPLPKPTISTWSDLLMVSTSILCRSSDFMSQLDLTKRPTSASLP
            ||||||||||||||||||||||||||||||||||||||||||||||||||||||||||||
a565        AKYGISSWARTRPTVCPPLPKPTISTWSDLLMVSTSILCRSSDFMSQLDLTKRPTSASLP
                    70        80        90       100       110       120

130       140       150       160       170       180
m565.pep    PKRKGAIIIDSRTAAVAACSHSGETISSCPAMASITKPNSPPCARYKAVLRLSPTECFIL
            ||||||||||||||||||||||:|||||||||||||||||||||||||||||||||||||
a565        PKRKGAIIIDSRTAAVAACSHSSETISSCPAMASITKPNSPPCARYKAVLRLSPTECFIL
                   130       140       150       160       170       180

190       200       210
m565.pep    KAMANTTSAFNTSSIANSINTCRQPPINAX
            ||||||||||||||||||||||||||||||
a565        KAMANTTSAFNTSSIANSINTCRQPPINAX
                   190       200       210
```

The following partial DNA sequence was identified in *N. gonorrhoeae* <SEQ ID 1677>:

```
g566.seq..
   1 atgccgtctg aacaatatct tttcagacgg catttTgtat ggggGTTAAC 51 ggttgttcag cccgagtacg tcctgcatat cgtacaaacc cgttttgccg 101 tttacccaaa ctgcggcgcg gacggcaccg gcggcaaagg tcatgcggct 151 gccggctttg tgggtgattt ccacgcgttc gccgtcggtg gcgaagaggg 201 cggtgtggtc gccgactatg tcgcctgcgc ggacggtggc aaagccgatg 251 gtggaaggat cgcgcggacc agtgtggcct tcgcggccgt aaacggcgca 301 ttgtttgagg tcgcggccga gcgcgccggc gatgacttcg cccattcgta 351 a
```

This corresponds to the amino acid sequence <SEQ ID 1678; ORF 566.ng>:

```
g566.pep..
   1 MPSEQYLFRR HFVWGLTVVQ PEYVLHIVQT RFAVYPNCGA DGTGGKGHAA

51 AGFVGDFHAF AVGGEEGGVV ADYVACADGG KADGGRIART SVAFAAVNGA

101 LFEVAAERAG DDFAHS*
```

The following partial DNA sequence was identified in *N. meningitidis* <SEQ ID 1679>:

```
m566.seq..
   1 ATGCCGTCTG AACAATATCT TTTCAGACGG CATTTTGTAT GGGGGTTAAC

51 GGTTGTTCAG CCCGAGTACG TCCTGCATAT CGTACAAACC CGTTTTGCCG

101 TTGACCCAAA CTGCGGCGCG GACGGCACCG GCGGCAAAGG TCATGCGGCT

151 GCTGGCCTTG TGGGTGATTT CCACGCGCTC GCCGTCGGTG GCGAAGAGGG

201 CGGTGTGGTC GCCGACGATG TCGCCTGCGC GGACGGTGGC AAAGCCGATG

251 GTCGACGGAT CGCGCGGACC GGTGTGGCCT TCGCGGCCGT AAACGGCGCA

301 TTGTTTGAGG TCTCTGCCGA GCGCGCCGGC GATGACTTCG CCCATGCGTA

351 A
```

This corresponds to the amino acid sequence <SEQ ID 1680; ORF 566>:

```
m566.pep..
   1 MPSEQYLFRR HFVWGLTVVQ PEYVLHIVQT RFAVDPNCGA DGTGGKGHAA

51 AGLVGDFHAL AVGGEEGGVV ADDVACADGG KADGRRIART GVAFAAVNGA

101 LFEVSAERAG DDFAHA*
```

Computer analysis of this amino acid sequence gave the following results:
Homology with a Predicted ORF from *N. gonorrhoeae*

```
   m566/g566 93.1% identity in 116 aa overlap 10         20         30         40         50         60
   m566.pep MPSEQYLFRRHFVWGLTVVQPEYVLHIVQTRFAVDPNCGADGTGGKGHAAAGLVFDFHAL
            ||||||||||||||||||||||||||||||||||| |||||||||||||||:||||||:
       g566 MPSEQYLFRRHFVWGLTVVQPEYVLHIVQTRFAVYPNCGADGTGGKGHAAAGFVFDFHAF
                 10         20         30         40         50         60
```

-continued

```
                   70         80         90        100        110
     m566.pep AVGGEEGGVVADDVACADGGKADGRRIARTGVAFAAVNGALFEVSAERAGDDFAHAX
              |||||||||||| |||||||||||| |||||:|||||||||||||:|||||||||:|
         g566 AVGGEEGGVVADYVACADGGKADGGRIARTSVAFAAVNGALFEVAAERAGDDFAHSX
                   70         80         90        100        110
```

The following partial DNA sequence was identified in N. meningitidis <SEQ ID 1681>:

```
a566.seq
   1 ATGCCGTCTG AACAATATCT TTTCAGACGG CATTTTGTAT GGGGGTTAAC

51 GGTTGTTCAG CCCGAGTACG TCCTGCATAT CGTACAAACC CGTTTTACCG

101 TTTACCCAAA CTGCGGCGCG GACGGCGCCG GCGGCAAAGG TCATGCGGCT

151 GCTTGCCTTG TGGGTGATTT CCACGCGCTC GCCGTCGGTG GCGAAGAGGG

201 CGGTGTGGTC GCCGACGATG TCGCCCGCGC GGACGGTGGC AAAGCCGATG

251 GTGGACGGAT CGCGCGGGCC GGTGTGGCCT TCGCGGCCGT AAACGGCGCA

301 TTGTTTGAGG TCTCTGCCGA GCGCGCCGGC GATGACTTCG CCCATGCGTA

351 A
```

This corresponds to the amino acid sequence <SEQ ID 1682; ORF 566.a>:

```
a556.pep

1 MPSEQYLFRR HFVWGLTVVQ PEYVLHIVQT RFTVYPNCGA DGAGGKGHAA

51 ACLVGDFHAL AVGGEEGGVV ADDVARADGG KADGGRIARI GVAFAAVNGA

101 LFEVSAERAG DDFAHA* m566/a566 94.0% identity in 116 aa overlap 10         20         30         40         50         60
    m566.pep MPSEQYLFRRHFVWGLTVVQPEYVLHIVQTRFAVDPNCGADGTGGKGHAAAGLVGDFHAL
             ||||||||||||||||||||||||||||||:||||||:|||||||||||  ||||||||
        a566 MPSEQYLFRRHFVWGLTVVQPEYVLHIVQTRFTVDPNCGADGAGGKGHAAACLVGDFHAL
                  10         20         30         40         50         60

70         80         90        100        110
    m566.pep AVGGEEGGVVADDVACADGGKADGRRIARTGVAFAAVNGALFEVSAERAGDDRAGAX
             ||||||||||||| |||||||||| ||||:||||||||||||||||||||||||||
        a566 AVGGEEGGVVADDVARADGGKADGGRIARAGVAFAAVNGALFEVSAERAGDDRAGAX
                  70         80         90        100        110
```

The following partial DNA sequence was identified in N. gonorrhoeae <SEQ ID 1683>:

```
g567.seq..
   1 atgcgacgac gggcagcggc atcgacaagg cgggtttgca gtccggcgtt 51 tatcaggtct tattgggcga tgcggacgtg cagtcggcgg cggtacgcag 101 caaagagggc ggatacggcg tgttgggtgc gaacgcgcgc gcttgccggc 151 gcggaaatcg agctggtgca ggaaatcgcc cgggaagtgc gtttgaaaaa 201 cgcgctcaag gcagtggcgg aagattacga ctttatcctg atcgactgtc 251 cgccttcgct gacgctgttg acgcttaacg gcttggtggc ggcggcggc 301 gtgattgtgc cgatgttgtg cgaatattac gcgctggaag ggatttccga 351 tttgattgcg accgtgcgca aaatccgtca ggcggtcaat cccgatttgg 401 acatcacggg catcgtgcgt acgatgtacg acagccgcag caggctggtt
```

-continued
```
451 gccgaagtca gcgaacagtt gcgcagccat ttcggggatt tgcttttga 501 aaccgccatc ccgcgcaata tccgccttgc ggaagcgccg agccacggta 551 tgccggtgat ggcttacgac gcgcaggcaa agggtgccaa ggcgtatctt 601 gccttggcgg acgaactggc ggcgagggtg tcggggaaat ag
```

This corresponds to the amino acid sequence <SEQ ID 1684; ORF 567.ng>:

```
g567.pep
  1 MRRRAAASTR RVCSPAFIRS YWAMRTCSRR RYAAKRADTA CWVRTRALAG

51 AEIELVQEIA REVRLKNALK AVAEDYDFIL IDCPPSLTLL TLNGLVAAGG

101 VIVPMLCEYY ALEGISDLIA TVRKIRQAVN PDLDITGIVR TMYDSRSRLV

151 AEVSEQLRSH FGDLLFETAI PRNIRLAEAP SHGMPVMAYD AQAKGAKAYL

201 ALADELAARV SGK*
```

The following partial DNA sequence was identified in *N. meningitidis* <SEQ ID 1685>:

```
m567.seq..
  1 ATGAGTGCGA ACATCCTTGC CATCGCCAAT CAGAAGGGCG GTGTGGGCAA

51 AACGACGACG ACGGTAAATT TGGCGGCTTC GCTGGCATCG CGCGGCAAAC

101 GCGTGCTGGT GGTCGATTTG GATCCGCAGG GCAATGCGAC GACGGGCAGC

151 GGCATCGACA AGGCGGGTTT GCAGTCCGGC GTTTATCAGG TCTTATTGGG

201 CGATGCGGAC GTGCAGTCGG CGGCGGTACG CAGCAAAGAG GGCGGATACG

251 CTGTGTTGGG TGCGAACCGC GCGCTGGCCG GCGCGGAAAT CGAACTGGTG

301 CAGGAAATCG CCCGGGAAGT GCGTTTGAAA AACGCGCTCA AGGCAGTGGA

351 AGAAGATTAC GACTTTATCC TGATCGACTG CCCGCCTTCG CTGACGCTGT

401 TGACGCTTAA CGGGCTGGTG GCGGCGGGCG GCGTGATTGT GCCGATGTTG

451 TGCGAATATT ACGCGCTGGA AGGGATTTCC GATTTGATTG CGACCGTGCG

501 CAAAATCCGT CAGGCGGTCA ATCCCGATTT GGACATCACG GGCATCGTGC

551 GCACGATGTA CGACAGCCGC AGCAGGCTGG TTGCCGAAGT CAGCGAACAG

601 TTGCGCAGCC ATTTCGGGGA TTTGCTTTTT GAAACCGTCA TCCCGCGCAA

651 TATCCGCCTT GCGGAAGCGC CGAGCCACGG TATGCCGGTG ATGGCTTACG

701 ACGCGCAGGC AAAGGGTACC AAGGCGTATC TTGCCTTGGC GGACGAGCTG

751 GCGGCGAGGG TGTCGGGGAA ATAG
```

This corresponds to the amino acid sequence <SEQ ID 1686; ORF 567>:

```
m567.pep..
  1 MSANILAIAN QKGGVGKTTT TVNLAASLAS RGKRVLVVDL DPQGNATTGS

51 GIDKAGLQSG VYQVLLGDAD VQSAAVRSKE GGYAVLGANR ALAGAEIELV

101 QEIAREVRLK NALKAVEEDY DFILIDCPPS LTLLTLNGLV AAGGVIVPML

151 CEYYALEGIS DLIATVRKIR QAVNPDLDIT GIVRTMYDSR SRLVAEVSEQ

201 LRSHFGDLLF ETVIPRNIRL AEAPSHGMPV MAYDAQAKGT KAYLALADEL

251 AARVSGK*
```

Computer analysis of this amino acid sequence gave the following results:
Homology with a Predicted ORF from N. gonorrhoeae

```
    m567/g567  98.2% identity in 168 aa overlap 60         70         80         90        100        110       119
    m567.pep    GVYQVLLGDADVQSAAVRSKEGGYAVLGANRALAGAEIELVQEIAREVRLKNALKAVEED
                                                 ||||||||||||||||||||||||||||  ||
    g567        AFIRSYWAMRTCSRRRYAAKRADTACWVRTRALAGAEIELVQEIAREVRLKNALKAVAED
                         20         30         40         50         60        70

120        130        140        150        160        170       179
    m567.pep    YDFILIDCPPSLTLLTLNGLVAAGGVIVPMLCEYYALEGISDLIATVRKIRQAVNPDLDI
                ||||||||||||||||||||||||||||||||||||||||||||||||||||||||||||
    g567        YDFILIDCPPSLTLLTLNGLVAAGGVIVPMLCEYYALEGISDLIATVRKIRQAVNPDLDI
                         80         90        100        110        120        130

180        190        200        210        220        230       239
    m567.pep    TGIVRTMYDSRSRLVAEVSEQLRSHFGDLLFETVIPRNIRLAEAPSHGMPVMAYDAQAKG
                |||||||||||||||||||||||||||||||||||:||||||||||||||||||||||||
    g567        TGIVRTMYDSRSRLVAEVSEQLRSHFGDLLFETAIPRNIRLAEAPSHGMPVMAYDAQAKG
                        140        150        160        170        180        190

240        250
    m567.pep    TKAYLALADELAARVSGKX
                :||||||||||||||||||
    g567        AKAYLALADELAARVSGKX
                        200        210
```

The following partial DNA sequence was identified in *N. meningitidis* <SEQ ID 1687>:

```
a567.seq
  1 ATGAGTGCGA ACATCCTTGC CATCGCCAAT CAGAAGGGCG GTGTGGGCAA

51 AACGACGACG ACGGTAAATT TGGCGGCTTC GCTGGCATCG CGCGGCAAAC

101 GCGTGCTGGT GGTCGATTTG GATCCGCAGG GCAATGCGAC GACGGGCAGC

151 GGCATCGACA AGGCGAGTTT GCAGTCCGGC GTTTATCAGG TCTTATTGGG

201 CGATGCGGAC GTGAAATCGG CGGCGGTACG CAGCAAAGAG GGCGGATACG

251 GCGTGTTGGG TGCGAACCGC GCGCTGGCCG GCGCGGAAAT CGAGCTGGTG

301 CAGGAAATCG CCCGGGAAGT GCGTTTGAAA AACGCGCTCA AGGCAGTGGC

351 GGAAGATTAC GACTTTATCC TGATCGACTG CCCGCCTTCG CTGACGCTGT

401 TGACGCTTAA CGGCTTGGTG GCGGCAGGCG GCGTGATTGT GCCGATGTTG

451 TGCGAATATT ACGCGCTGGA AGGGATTTCC GATTTGATTG CGACCGTGCG

501 CAAAATCCGT CAGGCGGTCA ATCCCGATTT GGATATCACG GGCATCGTGC

551 GTACGATGTA CGACAGCCGC AGCAGGCTAG TTGCCGAAGT CAGCGAACAG

601 TTGCGCAGCC ATTTCGGGGA TTTGCTGTTT GAAACCGTCA TCCCGCGCAA

651 TATCCGCCTT GCGGAAGCGC CGAGCCACGG TATGCCGGTG ATGGCTTATG

701 ATGCGCAGGC AAAGGGTGCC AAGGCGTATC TTGCCTTGGC GGACGAGCTG

751 ATGGCGAGGG TGTCGGGGAA ATAG
```

This corresponds to the amino acid sequence <SEQ ID 1688; ORF 567.a>:

```
a567.pep
      1  MSANILAIAN QKGGVGKTTT TVNLAASLAS RGKRVLVVDL DPQGNATTGS

51  GIDKASLQSG VYQVLLGDAD VKSAAVRSKE GGYGVLGANR ALAGAEIELV

101  QEIAREVRLK NALKAVAEDY DFILIDCPPS LTLLTLNGLV AAGGVIVPML

151  CEYYALEGIS DLIATVRKIR QAVNPDLDIT GIVRTMYDSR SRLVAEVSEQ
```

```
    201  LRSHFGDLLF ETVIPRNIRL AEAPSHGMPV MAYDAQAKGA KAYLALADEL

251  MARVSGK* m567/a567  97.7% identity in 257 aa overlap 10         20         30         40         50         60
   m567.pep   MSANILAIANQKGGVGKTTTTVNLAASLASRGKRVLVVDLDPQGNATTGSGIDKAGLQSG
              ||||||||||||||||||||||||||||||||||||||||||||||||||||||:||||
   a567       MSANILAIANQKGGVGKTTTTVNLAASLASRGKRVLVVDLDPQGNATTGSGIDKASLQSG
                    10         20         30         40         50         60
                    70         80         90        100        110        120
   m567.pep   VYQVLLGDADVQSAAVRSKEGGYAVLGANRALAGAEIELVQEIAREVRLKNALKAVEEDY
              ||||||||||||:|||||||||||||:|||||||||||||||||||||||||||| |||
   a567       VYQVLLGDADVKSAAVRSKEGGYGVLGANRALAGAEIELVQEIAREVRLKNALKAVAEDY
                    70         80         90        100        110        120
                   130        140        150        160        170        180
   m567.pep   DFILIDCPPSLTLLTLNGLVAAGGVIVPMLCEYYALEGISDLIATVRKIRQAVNPDLDIT
              ||||||||||||||||||||||||||||||||||||||||||||||||||||||||||||
   a567       DFILIDCPPSLTLLTLNGLVAAGGVIVPMLCEYYALEGISDLIATVRKIRQAVNPDLDIT
                   130        140        150        160        170        180
                   190        200        210        220        230        240
   m567.pep   GIVRTMYDSRSRLVAEVSEQLRSHFGDLLFETVIPRNIRLAEAPSHGMPVMAYDAQAKGT
              |||||||||||||||||||||||||||||||||||||||||||||||||||||||||||:
   a567       GIVRTMYDSRSRLVAEVSEQLRSHFGDLLFETVIPRNIRLAEAPSHGMPVMAYDAQAKGA
                   190        200        210        220        230        240
                   250
   m567.pep   KAYLALADELAARVSGKX
              |||||||||| |||||||
   a567       KAYLALADELMARVSGKX
                   250
```

The following partial DNA sequence was identified in *N. gonorrhoeae* <SEQ ID 1689>:

```
g568.seq
    1 atgctcaggg tcagaccggt attatttgcc gtcaaggctt ccgcctcttc 51 gataccttgc agaatctgcc gattaaagcg ttcgcggctg cccaatattt 101 tcaggcgcat attgttttcg tgcaggcggc gtacctgttt ttgcaaagcc 151 tgtaaaaaca gccccatcag gaacgaaact tcgtcttcgg ggcgacgcca 201 gttttcggtt gaaaaggcaa acacggtcag atattgcacg cccagtttgg 251 cgcaatgctt caccatattt tccaacgcgt ccaagccgcg tttgtgtccc 301 attatacgcg ggagaaaacg ttttttcgcc caacggccgt tgccgtccat 351 aattacggcg atgtgcctcg ggatggcggt gtgttccaaa atggtctgcg 401 tgctgctctt catatctgcc tttcgcggtt cggcgttcaa atgccgtctg 451 aacgccgcgc cgtga
```

This corresponds to the amino acid sequence <SEQ ID 1690; ORF 568.ng>:

```
g568.pep
    1 MLRVRPVLFA VKASASSIPC RICRLKRSRL PNIFRRILFS CRRRTCFCKA

51 CKNSPIRNET SSSGRRQFSV EKANTVRYCT PSLAQCFTIF SNASKPRLCP

101 IIRGRKRFFA QRPLPSIITA MCLGMAVCSK MVCVLLFISA FRGSAFKCRL

151 NAAP*
```

The following partial DNA sequence was identified in *N. meningitidis* <SEQ ID 1691>:

```
m568.seq
   1 ATGCTCAGGG TCAGGCCGGT ATTGTTTGCC GTCAACGCTT CCGCCTCTTC

51 GATGCCTTGC AGAATCTGCC GGTTGAAGCG TTCGCGGCTG CCCAATATCT

101 TCAGGCGCAT ATTGTTTTCG TGCAGGCGGC GTACCTGTTT TTGCAAAGCC

151 TGTAAAAACA GCCCCATCAG GAACGAAACT TCGTCTTCGG GGCGGCGCCA

201 GTTTTCGGTT GAAAAGGCAA ACACGGTCAG ATATTGCACA CCCAGTTTGG

251 CGCAATGCTT CACCATATTT TCCAATGCGT CCAAACCGCG TTTGTGTCCC

301 ATTATGCGCG GGAGGAAACG TTTTTTCGCC CAACGGCCGT TGCCGTCCAT

351 AATCACGGCG ATATGCTTGG GAATGGCGGT GTGTTCCAAA ACGGCCTGCG

401 TGCTGCTTTT CATGTCTGCC TTTCGCGGTT CGGCATTCAA ATGCCGTCTG

451 AACGCCGAAC CGTGCAGGTT AAATTGCCAT CAAATCTTCT TCTTTGGCAG

501 TCAGGAGTTT GTCGGCTTCG GTAATGTATT TGTCGGTCAG TTTTTGAACC

551 GCTTCTTCGC CGCGACGTGC CTCGTCTTCG GAAATTTCTT TGTCTTTGAG

601 GAGTTTTTTG ATGTGGTCGT TGGCATCGCG GCGCACGTTG CGGATAGAGA

651 CGCGGCCTTC TTCCGCTTCG CCGCGTACGA CTTTAATCAG GTCTTTGCGG

701 CGTTCCTCGG TCAGCATGGG CATCGGCACG CGGATCAGGT CGCCGACAGC

751 TGCCGGGTTC AGTCCCAAGT TTGA
```

This corresponds to the amino acid sequence <SEQ ID 1692; ORF 568>:

```
m568.pep..
   1 MLRVRPVLFA VNASASSMPC RICRLKRSRL PNIFRRILFS CRRRTCFCKA

51 CKNSPIRNET SSSGRRQFSV EKANTVRYCT PSLAQCFTIF SNASKPRLCP

101 IMRGRKRFFA QRPLPSIITA ICLGMAVCSK TACVLLFMSA FRGSAFKCRL

151 NAEPCRLNCH QIFFGSQEF VGFGNVFVGQ FLNRFFAATC LVFGNFFVFE

201 EFFDVVVGIA AHVADRDAAF FRFAAYDFNQ VFAAFLGQHG HRHADQVADS

251 CRVQSQV*
```

Computer analysis of this amino acid sequence gave the following results:
Homology with a Predicted ORF from *N. gonorrhoeae*

```
m568/g568 94.8% identity in 154 aa overlap 10        20        30        40        50        60
m568.pep   MLRVRPVLFAVNASASSMPCRICRLKRSRLPNIFRRILFSCRRRTCFCKACKNSPIRNET
           |||||||||||:|||||:||||||||||||||||||||||||||||||||||||||||||
g568       MLRVRPVLFAVKASASSIPCRICRLKRSRLPNIFRRILFSCRRRTCFCKACKNSPIRNET
                   10        20        30        40        50        60

70        80        90       100       110       120
m568.pep   SSSGRRQFSVEKANTVRYCTPSLAQCFTIFSNASKPRLCPIMRGRKRFFAQRPLPSIITA
           ||||||||||||||||||||||||||||||||||||||||:|||||||||||||||||||
g568       SSSGRRQFSVEKANTVRYCTPSLAQCFTIFSNASKPRLCPIIRGRKRFFAQRPLPSIITA
                   70        80        90       100       110       120

130       140       150       160       170       180
m568.pep   ICLGMAVCSKTACVLLFMSAFRGSAFKCRLNAEPCRLNCHQIFFGSQEFVGFGNVFVGQ
           :|||||||||  :|||||:|||||||||||||  |
g568       MCLGMAVCSKMVCVLLFISAFRGSAFKCRLNAAPX
                  130       140       150

190       200       210       220       230       240
m568.pep   FLNRFFAATCLVFGNFFVFEEFFDVVVGIAAHVADRDAAFFRFAAYDFNQVFAAFLGQHG
```

The following partial DNA sequence was identified in *N. meningitidis* <SEQ ID 1693>:

```
a568.seq
   1 ATGCTCAGGG TCAGGCCGGT ATTGTTTGCC GTCAAGGCTT CCGCCTCTTC

51 GATGCCCTTC AGGATTTGAC GGTTGAAGCG TTCGCGGCTG CCCAGTATTT

101 TCAGGCGCAT ATTGTTTTCG TGCAGGCGGC GTACCTGTTT TTGCAAAGCC

151 TGTAAAAACA GCCCCATCAG GAACGAAACT TCGTCTTCGG GGCGGCGCCA

201 GTTTTCGGTT GAAAAGGCAA ACACGGTCAG ATATTGCACA CCCAGTTTGG

251 CGCAATGCTT CACCATATTT TCCAATGCGT CCAAACCGCG TTTGTGTCCC

301 ATTATGCGCG GGAGGAAACG TTTTTTCGCC CAACGGCCGT TGCCGTCCAT

351 AATCACGGCG ATATGCTTGG GAATGGCGGT GTGTTCCAAA ACGGCCTGCG

401 TGCTGCTTTT CATGTCTGCC TTTCGCGGTT CGGCATTCAA ATGCCGTCTG

451 AACGCCGAAC CGTGCAGGTT AAATTGCCAT CAAATCTTCT TCTTTGGCAG

501 TCAGGAGTTT GTCGGCTTCG GTAATGTATT TGTCGGTCAG TTTTTGAACC

551 GCTTCTTCGC CGCGACGTGC CTCGTCTTCG GAAATTTCTT TGTCTTTGAG

601 GAGTTTTTTG ATGTGGTCGT TGGCATCGCG GCGCACGTTG CGGATGGAGA

651 CGCGGCCTTC TTCCGCTTCG CCGCGTACGA CTTTAATCAG GTCTTTGCGG

701 CGTTCCTCGG TCAGCATGGG CATCGGCACG CGGATCAGGT CGCCGACAGC

751 TGCCGGGTTC AGTCCCAAGT TTGA
```

This corresponds to the amino acid sequence <SEQ ID 1694; ORF 568.a>:

```
a568.pep

1  MLRVRPVLFA VKASASSMPF RI*RLKRSRL PSIFRRILFS CRRRTCFCKA

51  CKNSPIRNET SSSGRRQFSV EKANTVRYCT PSLAQCFTIF SNASKPRLCP

101  IMRGRKRFFA QRPLPSIITA ICLGMAVCSK TACVLLFMSA FRGSAFKCRL

151  NAEPCRLNCH QIFFFGSQEF VGFGNVFVGQ FLNRFFAATC LVFGNFFVFE

201  EFFDVVVGIA AHVADGDAAF FRFAAYDFNQ VFAAFLGQHG HRHADQVADS

251  CRVQSQV* m568/a568  98.1% identity in 257 aa overlap 10        20        30        40        50        60
m568.pep      MLRVRPVLFAVNASASSMPCRICRLKRSRLPNIFRRILFSCRRRTCFCKACKNSPIRNET
              |||||||||||:||||||| || ||||||||:||||||||||||||||||||||||||||
a568          MLRVRPVLFAVKASASSMPFRIXRLKRSRLPSIFRRILFSCRRRTCFCKACKNSPIRNET
                      10        20        30        40        50        60

70        80        90       100       110       120
m568.pep      SSSGRRQFSVEKANTVRYCTPSLAQCFTIFSNASKPRLCPIMRGRKRFFAQRPLPSIITA
              ||||||||||||||||||||||||||||||||||||||||||||||||||||||||||||
a568          SSSGRRQFSVEKANTVRYCTPSLAQCFTIFSNASKPRLCPIMRGRKRFFAQRPLPSIITA
                      70        80        90       100       110       120

130       140       150       160       170       180
m568.pep      ICLGMAVCSKTACVLLFMSAFRGSAFKCRLNAEPCRLNCHQIFFFGSQEFVGFGNVFVGQ
              ||||||||||||||||||||||||||||||||||||||||||||||||||||||||||||
a568          ICLGMAVCSKTACVLLFMSAFRGSAFKCRLNAEPCRLNCHQIFFFGSQEFVGFGNVFVGQ
                     130       140       150       160       170       180

190       200       210       220       230       240
m568.pep      FLNRFFAATCLVFGNFFVFEEFFDVVVGIAAHVADRDAAFFRFAAYDFNQVFAAFLGQHG
              ||||||||||||||||||||||||||||||||||| ||||||||||||||||||||||||
a568          FLNRFFAATCLVFGNFFVFEEFFDVVVGIAAHVADGDAAFFRFAAYDFNQVFAAFLGQHG
                     190       200       210       220       230       240
```

```
                             250
    m568.pep  HRHADQVADSCRVQSQVX
              ||||||||||||||||||
    a568      HRHADQVADSCRVQSQVX
                             250
```

The following partial DNA sequence was identified in *N. gonorrhoeae* <SEQ ID 1695>:

```
g569.seq..
   1 atgctgaaac aacgggtaat aaccgctatg tggctgctgc cgctgatgct 51 gggcatgctg ttttacgcgc cgcaatggct gtgggctgca ttttgcgggc 101 tgattgccct gaccgccttg tgggagtatg cccgtatggc cggtttgtgc 151 aaaaccgaaa ccaaccatta cctcgccgca accttggttt tcggcgtagt 201 tgcctatgcg ggcggctgga tgctgcctaa tttggtttgg tatgttgttt 251 tggcattttg gctcgccgtt atgcctttgt ggttgagatt caaatggagg 301 ctcaacggcg gttggcaggt ttatgccgtc ggctggcttt tgctcatgcc 351 gttttggttc gcgctcgtat ccctggcgcc cgcatcccga tga
                                                    25
```

This corresponds to the amino acid sequence <SEQ ID 1696; ORF 569.ng>:

```
g569.pep
   1 MLKQRVITAM WLLPLMLGML FYAPQWLWAA FCGLIALTAL WEYARMAGLC

51 KTETNHYLAA TLVFGVVAYA GGWMLPNLVW YVVLAFWLAV MPLWLRFKWR

101 LNGGWQVYAV GWLLLMPFWF ALVSLAPASR *
                                                         35
```

The following partial DNA sequence was identified in *N. meningitidis* <SEQ ID 1697>:

```
m569.seq..
   1 ATGCTGAAAC AACGGGTAAT AACCGCCATG TGGCTGCTGC CGCTGATGCT

51 GGGCATGCTG TTTTACGCGC CGCAATGGTT GTGGGCTGCA TTTTGCGGAC

101 TGATTGCCCT GATTGCCTTG TGGGAATATG CCCGTATGGG CGGTTTGTGC

151 AAAATTAAAA CCAACCATTA CCTCGCCGCA ACCTTGGTTT TCGGCGTGGT

201 TGCCTATGCG GGCGGCTGGA TGCTGCCTAA TTTGGTTTGG TATGTTGTTT

251 TGGCATTTTG GCTCGCCGTT ATGCCTTTAT GGTTGAGATT CAAATGGAGG

301 CTCAACGGCG GTTGGCAGGT TTATGCCGTC GGCTGGCTTC TGGTCATGCC

351 GTTTTGGTTC GCGCTCGTAT CCCTGCGCCC GCATCCCGAT GATGCCCTGC

401 CGCTGCTCGC CGTGATGGGT TTGGTGTGGG TTGCCGATAT TTGCGCGTAT

451 TTCAGCGGCA AGGCGTTCGG CAAACACAAA ATCGCGCCGG CAATCAGCCC

501 CGGCAAAAGC TGGGAAGGTG CAATCGGCGG CGCGGTTTGC GTGGCAGTGT

551 ACATGACCGC CGTACGAAGT GCCGGCTGGC TGGCATTCGA TACAGGCTGG

601 TTCGATACCG TGTTAATCGG TTTGGTGCTG ACCGTTGTCA GCGTATGCGG

651 CGACCTTTTG GAAAGCTGGC TCAAGCGCGC GGCAGGCATC AAAGACAGCA

701 GCAAGCTGCT GCCCGGACAC GGCGGCGTGT TCGACCGTAC CGACAGCCTG

751 ATTGCCGTTA TCAGCGTCTA TGCAGCGATG ATGTCGGTTT TAAATTGA
```

This corresponds to the amino acid sequence <SEQ ID 1698; ORF 569>:

```
m569.pep..
     1  MLKQRVITAM WLLPLMLGML FYAPQWLWAA FCGLIALIAL WEYARMGGLC
    51  KIKTNHYLAA TLVFGVVAYA GGWMLPNLVW YVVLAFWLAV MPLWLRFKWR
   101  LNGGWQVYAV GWLLVMPFWF ALVSLRPHPD DALPLLAVMG LVWVADICAY
   151  FSGKAFGKHK IAPAISPGKS WEGAIGGAVC VAVYMTAVRS AGWLAFDTGW
   201  FDTVLIGLVL TVVSVCGDLL ESWLKRAAGI KDSSKLLPGH GGVFDRTDSL
   251  IAVISVYAAM MSVLN* m569/g569  95.3% identity in 127 aa overlap
                  10         20         30         40         50         60
m569.pep  MLKQRVITAMWLLPLMLGMLFYAPQWLWAAFCGLIALIALWEYARMGGLCKIKTNHYLAA
          ||||||||||||||||||||||||||||||||||||||:||||:||||||||
g569      MLKQRVITAMWLLPLMLGMLFYAPQWLWAAFCGLIALTALWEYARMAGLCKTETNHYLAA
                  10         20         30         40         50         60

70         80         90        100        110        120
m569.pep  TLVFGVVAYAGGWMLPNLVWYVVLAFWLAVMPLWLRFKWRLNGGWQVYAVGWLLVMPFWF
          ||||||||||||||||||||||||||||||||||||||||||||||||||:|||||
g569      TLVFGVVAYAGGWMLPNLVWYVVLAFWLAVMPLWLRFKWRLNGGWQVYAVGWLLLMPFWF
                  70         80         90        100        110        120

130        140        150        160        170        180
m569.pep  ALVSLRPHPDDALPLLAVMGLVWVADICAYFSGKAFGKHKIAPAISPGKSWEGAIGGAVC
          ||||| |
g569      ALVSLAPASRX
                 130
```

The following partial DNA sequence was identified in *N. meningitidis* <SEQ ID 1699>:

```
a569.seq
     1  ATGCTGAAAC AACGGGTGAT AACCGCCATG TGGCTGCTGC CGCTGATGCT

51  GGGCATGCTG TTTTACGCGC CGCAATGGTT GTGGGCTGCA TTTTGCGGAC

101  TGATTGCCCT GATTGCCTTG TGGGAATATG CCCGTATGGG CGGTTTGTGC

151  AAAATTAAAA CCAACCATTA CCTCGCCGCA ACCTTGGTTT TCGGCGTGGT

201  TGCCTATGCG GGCGGCTGGA TGCTGCCTAA TTTGGTTTGG TATGTTGTTT

251  TGGCATTTTG GCTCGCCGTT ATGCCTTTAT GGTTGAGATT CAAATGGAGG

301  CTCAACGGCG GTTGGCAGGT TTATGCCGTC GGCTGGCTTC TGGTCATGCC

351  GTTTTGGTTC GCGCTCGTAT CCCTGCGCCC GCATCCCGAT GATGCCCTGC

401  CGCTGCTCGC CGTGATGGGT TTGGTGTGGG TTGCCGATAT TTGCGCGTAT

451  TTCAGCGGCA AGGCGTTCGG CAAACACAAA ATCGCACCGG CAATCAGCCC

501  CGGCAAAAGC TGGGAAGGTG CAATCGGCGG CGCGGTTTGC GTGGCCGTGT

551  ACATGACCGC CGTACGAAGT GCCGGCTGGC TGGCATTCGA TACAGGCTGG

601  TTCGATACCG TGTTAATCGG TTTGGTGTTG ACCGTTGTCA GCGTATGCGG

651  CGACCTTTTG GAAAGCTGGC TCAAGCGCGC GGCAGGCATC AAAGACAGCA

701  GCAACCTGCT GCCCGGACAC GGCGGCGTGT TCGACCGCAC CGACAGCCTG

751  ATTGCCGTTA TCAGCGTCTA TGCAGCGATG ATGTCGGTTT TAAATTGA
```

This corresponds to the amino acid sequence <SEQ ID 1700; ORF 569.a>:

```
a569.pep

1  MLKQRVITAM WLLPLMLGML FYAPQWLWAA FCGLIALIAL WEYARMGGLC

51  KIKTNHYLAA TLVFGVVAYA GGWMLPNLVW YVVLAFWLAV MPLWLRFKWR

101  LNGGWQVYAV GWLLVMPFWF ALVSLRPHPD DALPLLAVMG LVWVADICAY

151  FSGKAFGKHK IAPAISPGKS WEGAIGGAVC VAVYMTAVRS AGWLAFDTGW

201  FDTVLIGLVL TVVSVCGDLL ESWLKRAAGI KDSSNLLPGH GGVFDRTDSL

251  IAVISVYAAM MSVLN* m569/a569  99.6% identity in 265 aa overlap
                  10         20         30         40         50         60
m569.pep   MLKQRVITAMWLLPLMLGMLFYAPQWLWAAFCGLIALIALWEYARMGGLCKIKTNHYLAA
           ||||||||||||||||||||||||||||||||||||||||||||||||||||||||||||
a569       MLKQRVITAMWLLPLMLGMLFYAPQWLWAAFCGLIALIALWEYARMGGLCKIKTNHYLAA
                  10         20         30         40         50         60

70         80         90        100        110        120
m569.pep   TLVFGVVAYAGGWMLPNLVWYVVLAFWLAVMPLWLRFKWRLNGGWQVYAVGWLLVMPFWF
           ||||||||||||||||||||||||||||||||||||||||||||||||||||||||||||
a569       TLVFGVVAYAGGWMLPNLVWYVVLAFWLAVMPLWLRFKWRLNGGWQVYAVGWLLVMPFWF
                  70         80         90        100        110        120

130        140        150        160        170        180
m569.pep   ALVSLRPHPDDALPLLAVMGLVWVADICAYFSGKAFGKHKIAPAISPGKSWEGAIGGAVC
           ||||||||||||||||||||||||||||||||||||||||||||||||||||||||||||
a569       ALVSLRPHPDDALPLLAVMGLVWVADICAYFSGKAFGKHKIAPAISPGKSWEGAIGGAVC
                 130        140        150        160        170        180

190        200        210        220        230        240
m569.pep   VAVYMTAVRSAGWLAFDTGWFDTVLIGLVLTVVSVCGDLLESWLKRAAGIKDSSKLLPGH
           |||||||||||||||||||||||||||||||||||||||||||||||||||||:||||
a569       VAVYMTAVRSAGWLAFDTGWFDTVLIGLVLTVVSVCGDLLESWLKRAAGIKDSSNLLPGH
                 190        200        210        220        230        240

250        260
m569.pep   GGVFDRTDSLIAVISVYAAMMSVLNX
           ||||||||||||||||||||||||||
a569       GGVFDRTDSLIAVISVYAAMMSVLNX
                 250        260
```

The following partial DNA sequence was identified in *N. gonorrhoeae* <SEQ ID 1701>:

```
g570.seq..
   1  atgatccgtt tgacccgcgc gtttgccgcc gccctgatcg gtttatgctg 51  caccacaggc gcgcacgccg acaccttcca aaaaatcggc tttatcaaca 101  ccgagcgcat ctacctcgaa tccaagcagg cgcgcaacat ccaaaaaacg 151  ctggacggcg aattttccgc ccgtcaggac gaattgcaaa aactgcaacg 201  cgaaggcttg gatttggaaa ggcagctcgc cggcggcaaa cttaaggacg 251  caaaaaggc gcaagccgaa gaaaaatggc gcgggctggt cgaagcgttc 301  cgcaaaaaac aggcgcagtt tgaagaagac tacaacctcc gccgcaacga 351  agagtttgcc tccctccagc aaaacgccaa ccgcgtcatc gtcaaaatcg 401  ccaaacagga aggttacgat gtcattttgc aggacgtgat ttacgtcaac 451  acccaatacg acgttaccga cagcgtcatt aaagaaatga acgcccgctg 501  a
```

This corresponds to the amino acid sequence <SEQ ID 1702; ORF 570.ng>:

```
g570.pep..
  1 MIRLTRAFAA ALIGLCCTTG AHADTFQKIG FINTERIYLE SKQARNIQKT

51 LDGEFSARQD ELQKLQREGL DLERQLAGGK LKDAKKAQAE EKWRGLVEAF

101 RKKQAQFEED YNLRRNEEFA SLQQNANRVI VKIAKQEGYD VILQDVIYVN

151 TQYDVTDSVI KEMNAR*
```

The following partial DNA sequence was identified in *N. meningitidis* <SEQ ID 1703>:

```
m570.seq..
  1 ATGACCCGTT TGACCCGCGC GTTTGCCGCG GCTCTGATCG GTTTGTGCTG

51 CACCGCAGGC GCGCACGCCG ACACCTTCCA AAAAATCGGC TTTATCAACA

101 CCGAGCGCAT CTACCTCGAA TCCAAGCAGG CGCGCAAGAT TCAAAAAACG

151 CTGGACAGCG AATTTTCCGC TCGTCAGGAC GAATTGCAAA AACTGCAACG

201 CGAAGGTCTG GATTTGGAAA GGCAGCTTGC CGAAGGCAAA CTCAGAAACG

251 CAAAAAAGGC GCAAGCCGAA GAAAAATGGC GCGGGCTGGT CGCAGCGTTC

301 CGCAAAAAAC AGGCGCAGTT TGAAGAAGAC TACAACCTCC GCCGCAACGA

351 AGAGTTTGCC TCCCTCCAGC AAAACGCCAA CCGCGTCATC GTCAAAATCG

401 CCAAACAGGA AGGTTACGAT GTCATTTTGC AGAACGTGAT TTACGTCAAC

451 ACCCAATACG ACGTTACCGA CAGCGTCATT AAAGAAATGA ACGCCCGCTG

501 A
```

This corresponds to the amino acid sequence <SEQ ID 1704; ORF 570>:

```
m570.pep

1    MTRLTRAFAA ALIGLCCTAG AHADTFQKIG FINTERIYLE SKQARKIQKT

51    LDSEFSARQD ELQKLQREGL DLERQLAEGK LRNAKKAQAE EKWRGLVAAF

101    RKKQAQFEED YNLRRNEEFA SLQQNANRVI VKIAKQEGYD VILQNVIYVN

151    TQYDVTDSVI KEMNAR* m570/g570   94.6% identity in 166 aa overlap 10         20         30         40         50         60
     m570.pep   MTRLTRAFAAALIGLCCTAGAHADTFQKIGFINTERIYLESKQARKIQKTLDSEFSARQD
                | |||||||||||||||:||||||||||||||||||||||||:||||:|||||||
     g570       MIRLTRAFAAALIGLCCTTGAHADTFQKIGFINTERIYLESKQARNIQKTLDGEFSARQD
                        10         20         30         40         50         60

70         80         90        100        110        120
     m570.pep   ELQKLQREGLDLERQLAEGKLRNAKKAQAEEKWRGLVAAFRKKQAQFEEDYNLRRNEEFA
                |||||||||||||||||||:::||||||||||||||||| ||||||||||||||||||||
     g570       ELQKLQREGLDLERQLAGGKLKDAKKAQAEEKWRGLVEAFRKKQAQFEEDYNLRRNEEFA
                        70         80         90        100        110        120

130        140        150        160
     m570.pep   SLQQNANRVIVKIAKQEGYDVILQNVIYVNTQYDVTDSVIKEMNARX
                |||||||||||||||||||||||||:|||||||||||||||||||||
     g570       SLQQNANRVIVKIAKQEGYDVILQDVIYVNTQYDVTDSVIKEMNARX
                       130        140        150        160
```

The following partial DNA sequence was identified in *N. meningitidis* <SEQ ID 1705>:

```
a570.seq
   1 ATGACCCGTT TGACCCGCGC GTTTGCCGCG GCTCTGATCG GTTTGTGCTG

51 CACCGCAGGC GCGCACGCCG ACACCTTCCA AAAAATCGGC TTTATCAACA

101 CCGAGCGCAT CTACCTCGAA TCCAAGCAGG CGCGCAAGAT TCAAAAAACG

151 CTGGACAGCG AATTTTCCGC CCGCCAGGAC GAATTGCAAA AACTGCAACG

201 CGAAGGTCTG GATTTGGAAA GGCAGCTTGC CGAAGGCAAA CTCAAAGACG

251 CAAAAAAGGC GCAAGCCGAA GAAAAATGGT GCGGGCTGGT CGCAGCGTTC

301 CGCAAAAAAC AGGCGCAGTT TGAAGAAGAC TACAACCTCC GCCGCAACGA

351 AGAGTTTGCC TCCCTCCAGC AAAACGCCAA CCGCGTCATC GTCAAAATCG

401 CCAAACAGGA AGGTTACGAT GTCATTTTGC AGGACGTGAT TTACGTCAAC

451 ACCCAATACG ACGTTACCGA CAGCGTCATT AAAGAAATGA ACGCCCGCTG

501 A
```

This corresponds to the amino acid sequence <SEQ ID 1706; ORF 570.a>:

```
a570.pep
      1   MTRLTRAFAA ALIGLCCTAG AHADTFQKIG FINTERIYLE SKQARKIQKT

51   LDSEFSARQD ELQKLQREGL DLERQLAEGK LKDAKKAQAE EKWCGLVAAF

101   RKKQAQFEED YNLRRNEEFA SLQQNANRVI VKIAKQEGYD VILQDVIYVN

151   TQYDVTDSVI KEMNAR* m570/a570 97.6% identity in 166 aa overlap 10        20        30        40        50        60
m570.pep  MTRLTRAFAAALIGLCCTAGAHADTFQKIGFINTERIYLESKQARKIQKTLDSEFSARQD
          ||||||||||||||||||||||||||||||||||||||||||||||||||||||||||||
a570      MTRLTRAFAAALIGLCCTAGAHADTFQKIGFINTERIYLESKQARKIQKTLDSEFSARQD
                   10        20        30        40        50        60

70        80        90       100       110       120
m570.pep  ELQKLQREGLDLERQLAEGKLRNAKKAQAEEKWRGLVAAFRKKQAQFEEDYNLRRNEEFA
          |||||||||||||||||||||::|||||||||| ||||||||||||||||||||||||||
a570      ELQKLQREGLDLERQLAEGKLKDAKKAQAEEKWCGLVAAFRKKQAQFEEDYNLRRNEEFA
                   70        80        90       100       110       120

130       140       150       160
m570.pep  SLQQNANRVIVKIAKQEGYDVILQNVIYVNTQYDVTDSVIKEMNARX
          ||||||||||||||||||||||||:||||||||||||||||||||||
a570      SLQQNANRVIVKIAKQEGYDVILQDVIYVNTQYDVTDSVIKEMNARX
                  130       140       150       160
```

The following partial DNA sequence was identified in *N. gonorrhoeae* <SEQ ID 1707>:

```
g571.seq (partial)
   1 atgcgcgttt tccgagtaaa ccgatttgtt gttaccgttt tcggcggcgg 51 tataggttct gccgtcccac acgctgcctg cgtcggcaaa caggctcagg 101 cggacggtgc gtgcgtcttt cgcaccgggc atcgggaaga gcagctcggc 151 ggagacgttg gctttttttgt tgccgccgta gctgattttt tcgccgtatt 201 cgtcatacac tttcgggccg agcgtgccgc tttcgtagcc gcgcaccgaa 251 cccaggccgc cgccgtagaa gttttcaaag aaggggattt ctttggttct 301 gccgtagccg cccgcaatgc cgacttcgcc gccgagcatc agcgtgaagg 351 ttttgct...
```

This corresponds to the amino acid sequence <SEQ ID 1708; ORF 571.ng>:

```
g571.pep (partial)
   1 MRVFRVNRFV VTVFGGGIGS AVPHAACVGK QAQADGACVF RTGHREEQLG

51 GDVGFFVAAV ADFFAVFVIH FRAERAAFVA AHRTQAAAVE VFKEGDFFGS

101 AVAARNADFA AEHQREGFA...
```

The following partial DNA sequence was identified in *N. meningitidis* <SEQ ID 1709>:

```
m571.seq
   1 ATGGGTATTG CCGGCGCCGT AAATGTTTTG AACCCTGCCG CCGGTCGCGG

51 AACTGCTGTT GTCGTCGTAG GTTTTGCCGT CCCACACGCT GCCTGCGTCG

101 GCAAACAGGC TCAGGCGGAC GGTGCGCGCG TCTTTCGCGC CGGGCATCGG

151 GAAGAGCAGC TCGGCGGAGA CGTTGGCTTT TTTGTTGCCG CCGTAGCTGA

201 TTTTTTCGCC GTATTCGTCA TAGACTTTCG GACCGAGCGT GCCGCTTTCG

251 TATCCGCGCA CCGAACCCAG GCCGCCGCCG TAGAAGTTTT CAAAGAAGGG

301 GATTTCTTTG GTTCTGCCGT AGCCGCCCGC AATGCCGACT TCGCCGCCGA

351 GCATCAGCGT GAAGGTTTTG CTCAGGGGGA AGAACCAGGT TTGGTTGTGG

401 GTGGCGGAGT AGTATTGCAG TTTGCTGCCA GGCAGGGCGA TTTCGGCGTT

451 CACGCCCGTC AGGTAGCCGC GCGTCGGCCA TAA
```

This corresponds to the amino acid sequence <SEQ ID 1710; ORF 571>:

```
  a571.pep

1    MGIAGAVNVL NPAAGRGTAV VVVGFAVPHA ACVGKQAQAD GARVFRAGHR

51    EEQLGGDVGF FVAAVADFFA VFVIDFRTER AAFVSAHRTQ AAAVEVFKEG

101    DFFGSAVAAR NADFAAEHQR EGFAQGEEPG LVVGGGVVLQ FAARQGDFGV

151    HARQVAARRP * m571/g571 93.1% identity in 102 aa overlap 10         20         30         40         50         60
   m571.pep  MGIAGAVNVLNPAAGRGTAVVVVGFAVPHAACVGKQAQADGARVFRAGHREEQLGGDVGF
                        :|  ||||||||||||||||| |||:||||||||||||
   g571              MRVFRVNRFVVTFGGGIGSAVPHAACVGKQAQADGACVFRTGHREEQLGGDVGF
                            10         20         30         40         50

70         80         90        100        110        120
   m571.pep  FVAAVADFFAVFVIDFRTERAAFVSAHRTQAAAVEVFKEGDFFGSAVAARNADFAAEHQR
             ||||||||||||||  ||:||||:||||||||||||||||||||||||||||||||||||
   g571      FVAAVADFFAVFVIHFRAERAAFVAAHRTQAAAVEVFKEGDFFGSAVAARNADFAAEHQR
                    60         70         80         90        100        110

130        140        150        160
   m571.pep  EGFAQGEEPGLVVGGGVVLQFAARQGDFGVHARQVAARRPX
             ||||
   g571      EGFA
                   119
```

The following partial DNA sequence was identified in *N. meningitidis* <SEQ ID 1711>:

```
a571.seq
   1 ATGGGTATTG CCGGCGCCGT AAATGTTTTG AACCCTGCCG CCGGTCGCGG

51 AACTGCTGTT GTCGTCGTAG GTTTTGCCGT CCCACACGCT GCCTGCGTCG
```

-continued

```
101 GCAAACAGGC TCAGGCGGAC GGTGCGCGCG TCTTTCGCGC CGGGCATCGG

151 GAAGAGCAGC TCGGCGGAGA CGTTGGCTTT TTTGTTGCCG CCGTAGCTGA

201 TTTTTTCGCC GTATTCGTCA TACACTTTCG GACCGAGCGT GCCGCTTTCG

251 TATCCGCGCA CCGAACCCAG GCCGCCGCCG TAGAAGTTTT CAAAGAAGGG

301 GATTTCTTTG GTTCTGCCGT AGCCGCCCGC AATGCCGACT TCGCCGCCGA

351 GCATCAGCGT GAAGGTTTTG CTTAAGGGGA AGAACCAGGT TTGGTTGTGG

401 GTGGCGGAGT AGTATTGCAG TTTGCTGCCG GGCAGGGCGA TTTCGGCGTT

451 CACGCCCGTC AGGTAGCCGC GCGTCGGCCA TAA
```

This corresponds to the amino acid sequence <SEQ ID 1712; ORF 571.a>:

```
a571.pep
       1  MGIAGAVNVL NPAAGRGTAV VVVGFAVPHA ACVGKQAQAD GARVFRAGHR

51  EEQLGGDVGF FVAAVADFFA VFVIHFRTER AAFVSAHRTQ AAAVEVFKEG

101  DFFGSAVAAR NADFAAEHQR EGFA*GEEPG LVVGGGVVLQ FAAGQGDFGV

151  HARQVAARRP * m571/a571  98.1% identity in 160 aa overlap 10         20         30         40         50         60
m571.pep  MGIAGAVNVLNPAAGRGTAVVVVGFAVPHAACVGKQAQADGARVFRAGHREEQLGGDVGF
          ||||||||||||||||||||||||||||||||||||||||||||||||||||||||||||
a571      MGIAGAVNVLNPAAGRGTAVVVVGFAVPHAACVGKQAQADGARVFRAGHREEQLGGDVGF
                  10         20         30         40         50         60

70         80         90        100        110        120
m571.pep  FVAAVADFFAVFVIDFRTERAAFVSAHRTQAAAVEVFKEGDFFGSAVAARNADFAAEHQR
          ||||||||||||| |||||||||||||||||||||||||||||||||||||||||||||
a571      FVAAVADFFAVFVIHFRTERAAFVSAHRTQAAAVEVFKEGDFFGSAVAARNADFAAEHQR
                  70         80         90        100        110        120

130        140        150        160
m571.pep  EGFAQGEEPGLVVGGGVVLQFAARQGDFGVHARQVAARRPX
          ||||  ||||||||||||||||||||| |||||||||||||
a571      EGFAXGEEPGLVVGGGVVLQFAAGQGDFGVHARQVAARRPX
                 130        140        150        160
```

The following partial DNA sequence was identified in *N. gonorrhoeae* <SEQ ID 1713>:

```
g572.seq..
   1 atgtgcgcca tcgtcggggc ggcggggctg ccttccgcgc tcgcagcggc 51 gcaaaaaggc aaaaccattt atctggcaaa caaagaaacg ctggtggttt 101 ccggcgcgtt gtttatggaa accgcccgcg caaacggcgc ggcagtgttg 151 cccgtcgaca gcgaacacaa cgccattttc caagttttgc cgcgcgatta 201 cacagaccgt ctgaacgaac acggcatcga ttcgattatc ctgaccgctt 251 ccggcggccc gtttttaaca accgatttaa gcacgttcga cagcattacg 301 cccgagcagg cggtcaaaca ccccaattgg cgtatggggc gcaaaatctc 351 cgtcgattca gccactatgg caaacaaggg cttggaactg attgaagcgc 401 attggctgtt caactgtccg cccgacaaac tcgaagtcgt catccatccc 451 caatccgtga tacacagtat ggtgcgctac cgcgacggct ccgtgctggc 501 gcaactgggc aatcccgata tgcgaacgcc catcgcctat tgtttgggct 551 tgcccgagcg catcgattcg ggtgtcggca aactcgattt cggcgcattg
```

```
-continued
601 tccgcgctga ccttccaaaa gcccgacttc ggccgcttcc cctgcctgaa 651 gttcgcctat gaaaccataa acgcaggcgg agccgcgccc tgcgtattga 701 acgccgccaa cgaaaccgcc gtcgccgcct ttttggacgg acagattaag 751 tttaccgaca ttgccaaaac cgtcgcccac tgtcttgcac aagacttttc 801 aaacggcatg ggcgatatag aaggactgtt ggcgcaagat gcccggacac 851 gcgcacaagc gcgggcattt atcggcacac tgcgctga
```

This corresponds to the amino acid sequence <SEQ ID 1714; ORF 572.ng>:

```
g572.pep..
  1 MCAIVGAAGL PSALAAAQKG KTIYLANKET LVVSGALFME TARANGAAVL

51 PVDSEHNAIF QVLPRDYTDR LNEHGIDSII LTASGGPFLT TDLSTFDSIT

101 PEQAVKHPNW RMGRKISVDS ATMANKGLEL IEAHWLFNCP PDKLEVVIHP

151 QSVIHSMVRY RDGSVLAQLG NPDMRTPIAY CLGLPERIDS GVGKLDFGAL

201 SALTFQKPDF GRFPCLKFAY ETINAGGAAP CVLNAANETA VAAFLDGQIK
```

The following partial DNA sequence was identified in *N. meningitidis* <SEQ ID 1715>:

```
m572.seq..
  1 ATGTGCGCCA TCGTCGGGGC GGTGGGGCTG CCTTCCGCGC TCGCAGCGGC

51 GCAAAAGGC AAAACCATTT ATCTGGCAAA CAAAGAAACG CTGGTGGTTT

101 CCGGCGCGTT GTTTATGGAA ACCGCCCGTG CAAACGGCGC GGCAGTGCTG

151 CCCGTCGACA GCGAACACAA CGCCGTTTTC CAAGTTTTGC CGCGCGATTA

201 CGCCGGCCGT CTGAACGAAC ACGGCATCGC TTCGATTATC CTGACCGCTT

251 CCGGCGGCCC GTTTCTGACC GCCGATTTAA ACACGTTCGA CCGCATTACG

301 CCCGCCCAAG CGGTCAAACA CCCCAATTGG CGTATGGGAC GCAAAATCTC

351 CGTCGATTCC GCCACCATGA TGAACAAAGG TTTGGAGCTG ATTGAAGCGC

401 ATTGGCTGTT CAACTGTCCG CCCGACAAAC TCGAAGTCGT CATCCATCCG

451 CAATCCGTGA TACACAGCAT GGTGCGCTAC CGCGACGGCT CCGTGCTGGC

501 GCAACTGGGC AATCCCGATA TGCGAACGCC CATCGCTTAT TGTTTGGGTT

551 TGCCCGAGCG CATCGATTCG GGTGTCGGCG ACCTGGATTT CGACGCATTG

601 TCCGCGCTGA CCTTCCAAAA GCCCGACTTT GACCGCTTCC CCTGCCTGAG

651 GCTCGCCTAT GAAGCCATGA ACGCAGGCGG AGCCGCGCCC TGCGTATTGA

701 ACGCCGCCAA CGAAGCCGCC GTCGCCGCCT TTTTGGACGG ACAGATTAAG

751 TTTACCGACA TTGCCAAAAC CGTCGCCCAC TGTCTTGCAC AAGACTTTTC

801 AGACGGCATA GGCGATATAG GGGGGCTCTT GGCGCAAGAT GCCCGGACAC

851 GCGCACAAGC GCGAGCATTT ATCGGCACAC TGCGCTGA
```

This corresponds to the amino acid sequence <SEQ ID 1716; ORF 572>:

```
m572.pep..
  1     MCAIVGAVGL PSALAAAQKG KTIYLANKET LVVSGALFME TARANGAAVL

51     PVDSEHNAVF QVLPRDYAGR LNEHGIASII LTASGGPFLT ADLNTFDRIT
```

-continued

```
101     PAQAVKHPNW RMGRKISVDS ATMMNKGLEL IEAHWLFNCP PDKLEVVIHP

151     QSVIHSMVRY RDGSVLAQLG NPDMRTPIAY CLGLPERIDS GVGDLDFDAL

201     SALTFQKPDF DRFPCLRLAY EAMNAGGAAP CVLNAANEAA VAAFLDGQIK

251     FTDIAKTVAH CLAQDFSDGI GDIGGLLAQD ARTRAQARAF IGTLR*
```

```
m572/g572   92.9% identity in 295 aa overlap 10        20        30        40        50        60
m572.pep    MCAIVGAVGLPSALAAAQKGKTIYLANKETLVVSGALFMETARANGAAVLPVDSEHNAVF
            |||||||:||||||||||||||||||||||||||||||||||||||||||||||||||:|
g572        MCAIVGAAGLPSALAAAQKGKTIYLANKETLVVSGALFMETARANGAAVLPVDSEHNAIF
                    10        20        30        40        50        60

70        80        90       100       110       120
m572.pep    QVLPRDYAGRLNEHGIASIILTASGGPFLTADLNTFDRITPAQAVKHPNWRMGRKISVDS
            |||||||: ||||||| |||||||||||||:||:||| ||| ||||||||||||||||||
g572        QVLPRDYTDRLNEHGIDSIILTASGGPFLTTDLSTFDSITPEQAVKHPNWRMGRKISVDS
                    70        80        90       100       110       120

130       140       150       160       170       180
m572.pep    ATMMNKGLELIEAHWLFNCPPDKLEVVIHPQSVIHSMVRYRDGSVLAQLGNPDMRTPIAY
            ||| ||||||||||||||||||||||||||||||||||||||||||||||||||||||||
g572        ATMANKGLELIEAHWLFNCPPDKLEVVIHPQSVIHSMVRYRDGSVLAQLGNPDMRTPIAY 130       140       150       160       170       180
                     190       200       210       220       230       240
m572.pep    CLGLPERIDSGVGDLDFDALSALTFQKPDFDRFPCLRLAYEAMNAGGAAPCVLNAANEAA
            ||||||||||||| ||| |||||||||||| |||||::|||::|||||||||||||||:|
g572        CLGLPERIDSGVGKLDFGALSALTFQKPDFGRFPCLKFAYETINAGGAAPCVLNAANETA 190       200       210       220       230       240
                     250       260       270       280       290
m572.pep    VAAFLDGQIKFTDIAKTVAHCLAQDFSDGIGDIGGLLAQDARTRAQARAFIGTLRX
            |||||||||||||||||||||||||||:|:||| |||||||||||||||||||||
g572        VAAFLDGQIKFTDIAKTVAHCLAQDFSNGMGDIEGLLAQDARTRAQARAFIGTLRX
                     250       260       270       280       290
```

The following partial DNA sequence was identified in *N. meningitidis* <SEQ ID 1717>:

```
a572.seq
   1 ATGTGCGCCA TCGTCGGGGC GGTGGGGCTG CCTTCCGCGC TCGCAGCGGC

51 GCAAAAAGGC AAAACCATTT ATCTGGCGAA CAAAGAGACG CTGGTGGTTT

101 CCGGCGCGTT GTTTATGGAA ACCGCCCGTG CAAACGGCGC GGCAGTGCTG

151 CCCGTCGACA GCGAACACAA CGCCGTTTTC CAAGTTTTGC CGCGCGATTA

201 CACAGGTCGC CTGAACGAAC ACGGCATCGC TTCGATTATC CTGACCGCTT

251 CCGGCGGCCC GTTTCTGACC GCCGATTTAA ACACGTTCGA CAGCATTACG

301 CCCGACCAAG CGGTCAAACA CCCCAATTGG CGTATGGGAC GCAAAATCTC

351 CGTCGATTCC GCCACCATGA TGAACAAAGG TTTGGAGCTG ATTGAAGCGC

401 ATTGGCTGTT CAACTGTCCG CCCGACAAAC TCGAAGTCGT CATCCATCCG

451 CAATCTGTGA TACACAGCAT GGTGCGCTAC CGCGACGGCT CCGTGTTGGC

501 GCAACTGGGC AATCCCGATA TGCGAACGCC TATCGCTTAT TGTTTGGGTT

551 TGCCCGAGCG CATCGATTCG GGTGTCGGCG ACCTGGATTT CGACGCATTG

601 TCCGCGCTGA CCTTCCAAAA GCCCGACTTT GACCGCTTCC CCTGCCTGAA

651 GCTCGCCTAT GAAGCCATGA ACGCAGGCGG AGCCGCGCCC TGCGTATTGA

701 ACGCCGCCAA CGAAGCCGCC GTCGCCGCCT TTTTGGACGG ACAGATTAAG

751 TTTACCGACA TTGCCAAAAC CGTCGCCCAT TGTCTTTCAC AAGACTTTTC

801 AGACGGCATA GGCGACATAG GGGGGCTCTT GGCGCAAGAT GCCCGGACAC

851 GCGCACAAGC GCGGGCATTT ATCGGCACAC TGCGCTGA
```

This corresponds to the amino acid sequence <SEQ ID 1718; ORF 572.a>:

```
a572.pep

1    MCAIVGAVGL PSALAAAQKG KTIYLANKET LVVSGALFME TARANGAAVL

51    PVDSEHNAVF QVLPRDYTGR LNEHGIASII LTASGGPFLT ADLNTFDSIT

101    PDQAVKHPNW RMGRKISVDS ATMMNKGLEL IEAHWLFNCP PDKLEVVIHP

151    QSVIHSMVRY RDGSVLAQLG NPDMRTPIAY CLGLPERIDS GVGDLDFDAL

201    SALTFQKPDF DRFPCLKLAY EAMNAGGAAP CVLNAANEAA VAAFLDGQIK

251    FTDIAKTVAH CLSQDFSDGI GDIGGLLAQD ARTRAQARAF IGTLR* m572/a572   98.3% identity in 295 aa overlap 10         20         30         40         50         60
m572.pep   MCAIVGAVGLPSALAAAQKGKTIYLANKETLVVSGALFMETARANGAAVLPVDSEHNAVF
           ||||||||||||||||||||||||||||||||||||||||||||||||||||||||||||
a572       MCAIVGAVGLPSALAAAQKGKTIYLANKETLVVSGALFMETARANGAAVLPVDSEHNAVF
                 10         20         30         40         50         60

70         80         90        100        110        120
m572.pep   QVLPRDYAGRLNEHGIASIILTASGGPFLTADLNTFDRITPAQAVKHPNWRMGRKISVDS
           ||||||||:|||||||||||||||||||||||||||||:|||||||||||||||||||||
a572       QVLPRDYTGRLNEHGIASIILTASGGPFLTADLNTFDSITPDQAVKHPNWRMGRKISVDS
                 70         80         90        100        110        120

130        140        150        160        170        180
m572.pep   ATMMNKGLELIEAHWLFNCPPDKLEVVIHPQSVIHSMVRYRDGSVLAQLGNPDMRTPIAY
           ||||||||||||||||||||||||||||||||||||||||||||||||||||||||||||
a572       ATMMNKGLELIEAHWLFNCPPDKLEVVIHPQSVIHSMVRYRDGSVLAQLGNPDMRTPIAY
                130        140        150        160        170        180

190        200        210        220        230        240
m572.pep   CLGLPERIDSGVGDLDFDALSALTFQKPDFDRFPCLRLAYEAMNAGGAAPCVLNAANEAA
           |||||||||||||||||||||||||||||||||||||:||||||||||||||||||||||
a572       CLGLPERIDSGVGDLDFDALSALTFQKPDFDRFPCLKLAYEAMNAGGAAPCVLNAANEAA
                190        200        210        220        230        240

250        260        270        280        290
m572.pep   VAAFLDGQIKFTDIAKTVAHCLAQDFSDGIGDIGGLLAQDARTRAQARAFIGTLRX
           ||||||||||||||||||||||:|||||||||||||||||||||||||||||||||
a572       VAAFLDGQIKFTDIAKTVAHCLSQDGSDGIGDIGGLLAQDARTRAQARAFIGTLRX
                250        260        270        280        290
```

The following partial DNA sequence was identified in *N. gonorrhoeae* <SEQ ID 1719>:

```
g573.seq..
    1  atgccctgtt tgtgccgcct taatcgcaat atcggcagtt tccaaatcac 51  gaatctcacc gaccataatg atgtccgggt cctgacgcag gaaagacttc 101  aaagcagcgg caaaagtcag accctgctta tcattgacgt taacctgatt 151  gatgcccggc aggttaatct cggcagggtc ttccgccgtt gcaatattta 201  ccgactccgt attcaaaata ttcaaacagg tatagagcga caccgtctta 251  cccgaacccg tcggaccggt taccagcacc atcccgtaag gacggtgaat 301  cgcttccaac aacattttt tctggaacgg ctcaaaaccg agctggtcga 351  tgttcaaaga cgcggcatcg gaattcaaaa tccgcatcac gacctttcg 401  ccaaacagcg tcggcaatgt gctgacacgg aaatcgacag gcttgccgcc 451  cttttgaaag gtcagctgca tcctaccgtc ctgcggtatc cgttttccgg 501  aaatgtccaa acgcgacatt accttaatcc gggaagcaag ctgcccccctt 551  accgcaatgg gcggctgaac cacctcgcgg agctgcccgt ccacacggaa 601  acggatacgc gcattgtgtt cgtaaaactc gaatggatg tcggatgccc 651  cgctacgcaa ggcatccgac aaagttttat ggataaacct cggaacaggg
```

-continued

```
 701 ccgtcttctg cctcctcgtc gtcgatatac agggtgtggc tttcctcttc 751 ctcttgcccc tccccaagct cctgaagcag cgatgtcgaa cgcgaaccca 801 cccaatcgag caaacccgcc aactggtcat cctcgacaat gaccaactca 851 accgcaatcc ctgcggcaga aaccgttttc tgaatttgcg gcatctgggt 901 cggatcggaa accgcaaaaa atactttgtc gcccccacgg aaaaccggca 951 cacagtggaa ctccaccatc tgctcctccg tcaacacccc catcagcacc 1001 ctgtggcgcg gataatgacg caaatcaaga atcgaataac tgaacaccct 1051 cgcaatcaat gccgcaagcg acttgggcga aatgacaccg tctga
```

This corresponds to the amino acid sequence <SEQ ID 1720; ORF 573.ng>:

```
g573.pep..
  1 MPCLCRLNRN IGSFQITNLT DHNDVRVLTQ ERLQSSGKSQ TLLIIDVNLI

51 DARQVNLGRV FRRCNIYRLR IQNIQTGIER HRLTRTRRTG YQHHPVRTVN

101 RFQQQFFLER LKTELVDVQR RGIGIQNPHH DLFAKQRRQC ADTEIDRLAA

151 LLKGQLHPTV LRYPFFGNVQ TRHYLNPGSK LPPYRNGRLN HLAELPVHTE

201 TDTRIVFVKL EMDVGCPATQ GIRQSFMDKP RNRAVFCLLV VDIQGVAFLF

251 LLPLPKLLKQ RCRTRTHPIE QTRQLVILDN DQLNRNPCGR NRFLNLRHLG

301 RIGNRKKYFV APTENRHTVE LHHLLLRQHP HQHPVARIMT QIKNRITEHP

351 RNQCRKRLGR NDTV*
```

The following partial DNA sequence was identified in *N. meningitidis* <SEQ ID 1721>:

```
m573.seq..
  1 ATGCCCTGTT TGTGCCGCCT TAATCGCAAT ATCGGCAGTT TCCAAATCAC

51 GAATCTCACC GACCATAATG ATGTCCGGGT CCTGACGCAG GAAAGACTTC

101 AAAGCAGCGG CAAAAGTCAG GCCCTGCTTA TCATTGACGT TAACCTGATT

151 GATGCCCGGC AGGTTAATCT CGGCAGGGTC TTCCGCCGTT GCAATATTTA

201 CCGACTCCGT ATTCAAAATA TTCAAACAGG TATAGAGCGA CACCGTCTTA

251 CCCGAACCCG TCGGACCGGT TACCAGCACC ATCCCGTAGG GACGGTGAAT

301 CGCTACCAAC aCaw.TTTTT TCTGAAACGG CTCAAAACCG AGCTGGTCGA

351 TGTTCAAAGA CGCGGCATCG GAATTCAAAA TCCGCATCAC GACCTTTTCG

401 CCAAACAGCG TCGGCAATGT GCTGACACGG AAATCGACAG GCTTGCCGCC

451 CTTTTGAAAG GTCAGCTGCA TCCTGCCGTC CTGCGGTATC CGTTTTTCGG

501 AAATGTCCAA ACGCGACATT ACCTTAATCC GTGAAGCAAG CTGCCCCCTT

551 ACCGCAATGG GCGGCTGAAC CACCTCGCGG AGCTGCCCGT CCACACGGAA

601 ACGGATACGG GCATTGTGTT CGTAAAACTC GAAATGGATG TCCGATGCCC

651 CGCTGCGCAA GGCATCCGAC AAAGTCTTAT GGATAAACCT CGGAACAGGG

701 CCGTCTTCTG CCTCCTCGTT GTCGATATAC AGGGTGTGGC TTTCCTCTTC

751 CTCCTGCCCC TCCCCAAGCT CCTGAAGCAG CGATGTCGAA CGCGAACCCA

801 CCCAATCGAG CAAACCCGCC AACTGGTCAT CCTCGACAAT GACCAACTCA

851 ACCTCAATCC CTGCGGCAGA AACGGTTTTC TGAATTTGCG GCATCTGTGT
```

```
 901  CGGATCGGAA ACCGCAAAAA ATACTTTGTC GCCCCGACGG AAAACCGGCA

951  CACAGTGGAA CTCCACCATC TGCTCCTCCG TCAACACCCC CATCAGCACC

1001  CTGTGGCGCG GATAATGACG CAAATCAAGA ATCGAATAAC TGAACACCCT

1051  CGCAATCAAT GCCGCAAGCG ACTTGGGCGA AATGACACCG TCTGA
```

This corresponds to the amino acid sequence <SEQ ID 1722; ORF 573>:

```
m573.pep..
      1     MPCLCRLNRN IGSFQITNLT DHNDVRVLTQ ERLQSSGKSQ ALLIIDVNLI

51     DARQVNLGRV FRRCNIYRLR IQNIQTGIER HRLTRTRRTG YQHHPVGTVN

101     RYQHXFFLKR LKTELVDVQR RGIGIQNPHH DLFAKQRRQC ADTEIDRLAA

151     LLKGQLHPAV LRYPFFGNVQ TRHYLNP*SK LPPYRNGRLN HLAELPVHTE

201     TDTGIVFVKL EMDVRCPAAQ GIRQSLMDKP RNRAVFCLLV VDIQGVAFLF

251     LLPLPKLLKQ RCRTRTHPIE QTRQLVILDN DQLNLNPCGR NGFLNLRHLC

301     RIGNRKKYFV APTENRHTVE LHHLLLRQHP HQHPVARIMT QIKNRITEHP

351     RNQCRKRLGR NDTV* m573/g573 95.9% identity in 364 aa overlap
                   10         20         30         40         50         60
m573.pep  MPCLCRLNRNIGSFQITNLTDHNDVRVLTQERLQSSGKSQALLIIDVNLIDARQVNLGRV
          |||||||||||||||||||||||||||||||||||||||:|||||||||||||||||||
g573      MPCLCRLNRNIGSFQITNLTDHNDVRVLTQERLQSSGKSQTLLIIDVNLIDARQVNLGRV
                   10         20         30         40         50         60
                   70         80         90        100        110        120
m573.pep  FRRCNIYRLRIQNIQTGIERHRLTRTRRTGYQHHPVGTVNRYQHXFFLKRLKTELVDVQR
          |||||||||||||||||||||||||||||||||||||:|: |||:|: |||:||||||||
g573      FRRCNIYRLRIQNIQTGIERHRLTRTRRTGYQHHPVRTVNRFQQQFFLERLKTELVDVQR
                   70         80         90        100        110        120
                  130        140        150        160        170        180
m573.pep  RGIGIQNPHHDLFAKQRRQCADTEIDRLAALLKGQLHPAVLRYPFFGNVQTRHYLNPXSK
          ||||||||||||||||||||||||||||||||||||||:|||||||||||||||||| ||
g573      RGIGIQNPHHDLFAKQRRQCADTEIDRLAALLKGQLHPTVLRYPFFGNVQTRHYLNPGSK
                  130        140        150        160        170        180
                  190        200        210        220        230        240
m573.pep  LPPYRNGRLNHLAELPVHTETDTGIVFVKLEMDVRCPAAQGIRQSLMDKPPNRAVFCLLV
          ||||||||||||||||||||||| ||||||||||:|||:|||||:||||||||||||||
g573      LPPYRNGRLNHLAELPVHTETDTRIVFVKLEMDVGCPATQGIRQSFMDKPPNRAVFCLLV
                  190        200        210        220        230        240
                  250        260        270        280        290        300
m573.pep  VDIQGVAFLFLLPLPKLLKQRCRTRTHPIEQTRQLVILDNDQLNLNPCGRNGFLNLRHLC
          |||||||||||||||||||||||||||||||||||||||||||| |||| ||||||||||
g573      VDIQGVAFLFLLPLPKLLKQRCRTRTHPIEQTRQLVILDNDQLNRNPCGRNRFLNLRHLC
                  250        260        270        280        290        300
                  310        320        330        340        350        360
m573.pep  RIGNRKKYFVAPTENRHTVELHHLLLRQHPHQHPVARIMTQIKNRITEHPRNQCRKRLGR
          ||||||||||||||||||||||||||||||||||||||||||||||||||||||||||
g573      RIGNRKKYFVAPTENRHTVELHHLLLRQHPHQHPVARIMTQIKNRITEHPRNQCRKRLGR
                  310        320        330        340        350        360
m573.pep  NDTVX
          |||||
g573      NDTVX
```

The following partial DNA sequence was identified in *N. meningitidis* <SEQ ID 1723>:

```
a573.seq
    1  ATGCCCTGTT TGTGCCGCCT TAATCGCAAT ATCGGCAGTT TCCAAATCAC

51  GAATCTCACC GACCATAATG ATGTCCGGGT CCTGACGCAG GAAAGACTTC

101  AAAGCAGCGG CAAAAGTCAG ACCCTGCTTA TCATTGACGT TAACCTGATT

151  GATGCCCGGC AGGTTAATCT CGGCAGGGTC TTCCGCCGTT GCAATATTTA
```

```
-continued
 201  CCGACTCCGT ATTCAAAATA TTCAAACAGG TATAGAGCGA CACCGTCTTA
 251  CCCGAACCCG TCGGACCGGT TACCAGCACC ATCCCGTAGG GACGGTGAAT
 301  CGCTTCCAAC AACAATTTTT TCTGAAACGG CTCAAAACCG AGCTGGTCGA
 351  TGTTCAAAGA CGCGGCATCG GAATTCAAAA TCCGCATCAC GACCTTTTCG
 401  CCAAACAGCG TCGGCAATGT GCTGACACGG AAATCGACAG GCTTGCCGCC
 451  CTTTTGAAAG GTCAGCTGCA TCCTGCCGTC CTGCGGTATC CGTTTTTCGG
 501  AAATGTCCAA ACGCGACATT ACCTTAATCC GGGAAGCAAG CTGCCCCCTT
 551  ACCGCAATGG GCGGCTGAAC CACCTCGCGG AGCTGCCCGT CCACACGGAA
 601  ACGGATACGG GCATTGTGTT CGTAAAACTC GAATGGATG TCCGATGCCC
 651  CGCTGCGCAA GGCATCCGAC AAAGTCTTAT GGATAAACCT CGGAACAGGG
 701  CCGTCTTCTG CCTCCTCGTT GTCGATATAC AGGGTGTGGC TTTCCTCTTC
 751  CTCCTGCCCC TCCCCAAGCT CCTGAAGCAG CGATGTCGAA CGCGAACCCA
 801  CCCAATCGAG CAAACCCGCC AACTGGTCAT CCTCGACAAT GACCAACTCA
 851  ACCTCAATCC CTGCGGCAGA AACGGTTTTC TGAATTTGCG GCATCTGTGT
 901  CGGATCGGAA ACCGCAAAAA ATACTTTGTC GCCCCGACGG AAAACCGGCA
 951  CACAGTGGAA CTCCACCATC TGCTCCTCCG TCAACACCCC CATCAGCACC
1001  CTGTGGCGCG GATAATGACG CAAATCAAGA ATCGAATAAC TGAACACCCT
1051  CGCAATCAAT GCCGCAAGCG ACTTGGGCGA AATGACACCG TCTGA
```

This corresponds to the amino acid sequence <SEQ ID 1724; ORF 573.a>:

```
a573.pep

1    MPCLCRLNRN IGSFQITNLT DHNDVRVLTQ ERLQSSGKSQ TLLIIDVNLI

51    DARQVNLGRV FRRCNIYRLR IQNIQTGIER HRLTRTRRTG YQHHPVGTVN

101    RFQQQFFLKR LKTELVDVQR RGIGIQNPHH DLFAKQRRQC ADTEIDRLAA

151    LLKGQLHPAV LRYPFFGNVQ TRHYLNPGSK LPPYRNGRLN HLAELPVHTE

201    TDTGIVFVKL EMDVRCPAAQ GIRQSLMDKP RNRAVFCLLV VDIQGVAFLF

251    LLPLPKLLKQ RCRTRTHPIE QTRQLVILDN DQLNLNPCGR NGFLNLRHLC

301    RIGNRKKYFV APTENRHTVE LHHLLLRQHP HQHPVARIMT QIKNRITEHP

351    RNQCRKRLGR NDTV* m573/a573    98.6% identity in 364 aa overlap 10         20         30         40         50         60
   m573.pep   MPCLCRLNRNIGSFQITNLTDHNDVRVLTQERLQSSGKSQALLIIDVNLIDARQVNLGRV
              |||||||||||||||||||||||||||||||||||||||:|||||||||||||||||||
   a573       MPCLCRLNRNIGSFQITNLTDHNDVRVLTQERLQSSGKSQTLLIIDVNLIDARQVNLGRV
                    10         20         30         40         50         60

70         80         90        100        110        120
   m573.pep   FRRCNIYRLRIQNIQTGIERHRLTRTRRTGYQHHPVGTVNRYQHXFLKRLKTELVDVQR
              ||||||||||||||||||||||||||||||||||||||||:|: |||||||||||||||
   a573       FRRCNIYRLRIQNIQTGIERHRLTRTRRTGYQHHPVGTVNRFQQQFFLKRLKTELVDVQR
                    70         80         90        100        110        120

130        140        150        160        170        180
   m573.pep   RGIGIQNPHHDLFAKQRRQCADTEIDRLAALLKGQLHPAVLRYPFFGNVQTRHYLNPXSK
              ||||||||||||||||||||||||||||||||||||||||||||||||||||||||| ||
   a573       RGIGIQNPHHDLFAKQRRQCADTEIDRLAALLKGQLHPAVLRYPFFGNVQTRHYLNPGSK
                   130        140        150        160        170        180
```

```
               190       200       210       220       230       240
m573.pep  LPPYRNGRLNHLAELPVHTETDTGIVFVKLEMDVRCPAAQGIRQSLMDKPRNRAVFCLLV
          ||||||||||||||||||||||||||||||||||||||||||||||||||||||||||||
a573      LPPYRNGRLNHLAELPVHTETDTGIVFVKLEMDVRCPAAQGIRQSLMDKPRNRAVFCLLV
               190       200       210       220       230       240

250       260       270       280       290       300
m573.pep  VDIQGVAFLFLLPLPKLLKQRCRTRTHPIEQTRQLVILDNDQLNLNPCGRNGFLNLRHLC
          ||||||||||||||||||||||||||||||||||||||||||||||||||||||||||||
a573      VDIQGVAFLFLLPLPKLLKQRCRTRTHPIEQTRQLVILDNDQLNLNPCGRNGFLNLRHLC
               250       260       270       280       290       300

310       320       330       340       350       360
m573.pep  RIGNRKKYFVAPTENRHTVELHHLLLRQHPHQHPVARIMTQIKNRITEHPRNQCRKRLGR
          ||||||||||||||||||||||||||||||||||||||||||||||||||||||||||||
a573      RIGNRKKYFVAPTENRHTVELHHLLLRQHPHQHPVARIMTQIKNRITEHPRNQCRKRLGR
               310       320       330       340       350       360 m573.pep  NDTVX
          |||||
a573      NDTVX
```

The following partial DNA sequence was identified in *N. gonorrhoeae* <SEQ ID 1725>:

```
g574.seq
    1 atgctgccga atctgccaaa cagccttaag aaagccgata tggacaacga 51 attgtggatt atcctgctgc cgattatcct tttgcccgtc ttcttcacga 101 tgggctggtt tgccgcccgc gtggatatga aaccgtatt gaagcaggca 151 aaaagcatcc cttcgggatt ttataaaagc ctggacgctt tggtcgaccg 201 caacagcggg cgcgcggcaa gggagttggc ggaagtcgtc gacggccggc 251 cgcaatcgta tgatttgaac cttaccctcg gcaaacttta ccgtcagcgc 301 ggcgaaaacg acaaagccat caacatacac cggacaatgc tcgattctcc 351 cgatacggtc ggcgaaaagc gcgcgcgcgt cctgtttgaa ttggcgcaaa 401 actaccaaag cgcgggtttg gtcgatcgtg ccgaacagat ttttttgggg 451 ctgcaagacg gtgaaatggc gcgtgaagcc agacagcacc tgctcaatat 501 ctaccagcag gacagggatt gggaaaaagc ggttgaaacc gcccaacttc 551 ttagtcacga cgaacagaca tatcagtttg agattgcaca gtttttattgc 601 gaacttgccc aagccgcgct gttcaagtcc aatttcgatg ccgcgcgttt 651 caatgtcggc aaggcactcg aagccaacaa aaaatgcacc gcgccaaca 701 tgattttggg cgacattgaa caccgacaag gcaatttccc tgccgccgtc 751 gaagcctatg ccgccatcga gcagcaaaac catgcatact tgagcatggt 801 cggcgagaag ctttacgaag cctatgccgc gcagggaaaa cctgaagaag 851 gcttgaaccg tctgacagga tatatgcaga cgtttcccga acttgacctg 901 atcaatgtcg tgtacgagaa atccctgctg cttaagggcg agaaagaagc 951 cgcgcaaacc gccgtcgagc ttgtccgccg caagcccgac cttaacggcg 1001 tgtaccgcct gctcggtttg aaactcagcg atttggatcc ggcttggaaa 1051 gccgatgccg acatgatgcg ttcggttatc ggacggcagc tccagcgcag 1101 cgtgatgtac cgttgccgca actgccactt caaatcccaa gtcttttttct 1151 ggcactgtcc cgcctgcaac aaatggcaga cgtttacgcc gaataaaatc 1201 gaagtttaa
```

This corresponds to the amino acid sequence <SEQ ID 1726; ORF 574.ng>:

```
g574.pep..
  1 MLPNLPNSLK KADMDNELWI ILLPIILLPV FFTMGWFAAR VDMKTVLKQA

51 KSIPSGFYKS LDALVDRNSG RAARELAEVV DGRPQSYDLN LTLGKLYRQR

101 GENDKAINIH RTMLDSPDTV GEKRARVLFE LAQNYQSAGL VDRAEQIFLG

151 LQDGEMAREA RQHLLNIYQQ DRDWEKAVET AQLLSHDEQT YQFEIAQFYC

201 ELAQAALFKS NFDAARFNVG KALEANKKCT RANMILGDIE HRQGNFPAAV

251 EAYAAIEQQN HAYLSMVGEK LYEAYAAQGK PEEGLNRLTG YMQTFPELDL

301 INVVYEKSLL LKGEKEAAQT AVELVRRKPD LNGVYRLLGL KLSDLDPAWK

351 ADADMMRSVI GRQLQRSVMY RCRNCHFKSQ VFFWHCPACN KWQTFTPNKI

401 EV*
```

The following partial DNA sequence was identified in *N. meningitidis* <SEQ ID 1727>:

```
m574.seq..
   1 ATGCGCCCGA ATCTACCAAA CAGCCTTAAG AAAGCCGATA TGGACAACGA

51 ATTGTGGATT ATCCTGCTGC CGATTATCCT TTTGCCCGTC TTCTTCGCGA

101 TGGGCTGGTT TGCCGCCCGC GTGGATATGA AAACCGTATT GAAGCAGGCA

151 AAAAGCATCC CTTCGGGATT TTATAAAAGC TTGGACGCTT TGGTCGACCG

201 CAACAGCGGG CGCGCGGCAA GGGAGTTGGC GGAAGTCGTC GACGGCCGGC

251 CGCAATCGTA TGATTTGAAC CTCACCCTCG GCAAACTTTA CCGCCAGCGT

301 GGCGAAAACG ACAAAGCCAT CAACATACAC CGGACAATGC TCGATTCTCC

351 CGATACGGTC GGCGAAAAGC GCGCGCGCGT CCTGTTTGAA TTGGCGCAAA

401 ACTACCAAAG TGCGGGGTTG GTCGATCGTG CCGAACAGAT TTTTTTGGGG

451 CTGCAAGACG GTAAAATGGC GCGTGAAGCC AGACAGCACC TGCTCAATAT

501 CTACCAACAG GACAGGGATT GGGAAAAAGC GGTTGAAACC GCCCGGCTGC

551 TCAGCCATGA CGATCAGACC TATCAGTTTG AAATCGCCCA GTTTTATTGC

601 GAACTTGCCC AAGCCGCGCT GTTCAAGTCC AATTTCGATG TCGCGCGTTT

651 CAATGTCGGC AAGGCACTCG AAGCCAACAA AAAATGCACC CGCGCCAACA

701 TGATTTTGGG CGACATCGAA CACCGACAAG GCAATTTCCC TGCCGCCGTC

751 GAAGCCTATG CCGCCATCGA GCAGCAAAAC CATGCATACT TGAGCATGGT

801 CGGCGAGAAG CTTTACGAAG CCTATGCCGC GCAGGGAAAA CCTGAAGAAG

851 GCTTGAACCG TCTGACAGGA TATATGCAGA CGTTTCCCGA ACTTGACCTG

901 ATCAATGTCG TGTACGAGAA ATCCCTGCTG CTTAAGTGCG AGAAAGAAGC

951 CGCGCAAACC GCCGTCGAGC TTGTCCGCCG CAAGCCCGAC CTTAACGGCG

1001 TGTACCGCCT GCTCGGTTTG AAACTCAGCG ATATGAATCC GGCTTGGAAA

1051 GCCGATGCCG ACATGATGCG TTCGGTTATC GGACGGCAGC TACAGCGCAG

1101 CGTGATGTAC CGTTGCCGCA ACTGCCACTT CAAATCCCAA GTCTTTTTCT

1151 GGCACTGCCC CGCCTGCAAC AAATGGCAGA CGTTTACCCC GAATAAAATC

1201 GAAGTTTAA
```

This corresponds to the amino acid sequence <SEQ ID 1728; ORF 574>:

```
m574.pep..

1    MRPNLPNSLK KADMDNELWI ILLPIILLPV FFAMGWFAAR VDMKTVLKQA

51    KSIPSGFYKS LDALVDRNSG RAARELAEVV DGRPQSYDLN LTLGKLYRQR

101    GENDKAINIH RTMLDSPDTV GEKRARVLFE LAQNYQSAGL VDRAEQIFLG

151    LQDGKMAREA RQHLLNIYQQ DRDWEKAVET ARLLSHDDQT YQFEIAQFYC

201    ELAQAALFKS NFDVARFNVG KALEANKKCT RANMILGDIE HRQGNFPAAV

251    EAYAAIEQQN HAYLSMVGEK LYEAYAAQGK PEEGLNRLTG YMQTFPELDL

301    INVVYEKSLL LKCEKEAAQT AVELVRRKPD LNGVYRLLGL KLSDMNPAWK

351    ADADMMRSVI GRQLQRSVMY RCRNCHFKSQ VFFWHCPACN KWQTFTPNKI

401    EV* m573/g573 97.8% identity in 402 aa overlap
                  10         20         30         40         50         60
m574.pep  MRPNLPNSLKKADMDNELWIILLPIILLPVFFAMGWFAARVDMKTVLKQAKSIPSGFYKS
          | |||||||||||||||||||||||||||||:||||||||||||||||||||||||||||
g574      MLPNLPNSLKKADMDNELWIILLPIILLPVFFTMGWFAARVDMKTVLKQAKSIPSGFYKS
                  10         20         30         40         50         60

70         80         90        100        110        120
m574.pep  LDALVDRNSGRAARELAEVVDGRPQSYDLNLTLGKLYRQRGENDKAINIHRTMLDSPDTV
          ||||||||||||||||||||||||||||||||||||||||||||||||||||||||||||
g574      LDALVDRNSGRAARELAEVVDGRPQSYDLNLTLGKLYRQRGENDKAINIHRTMLDSPDTV
                  70         80         90        100        110        120

130        140        150        160        170        180
m574.pep  GEKRARVLFELAQNYQSAGLVDRAEQIFLGLQDGKMAREARQHLLNIYQQDRDWEKAVET
          |||||||||||||||||||||||||||||||||||:||||||||||||||||||||||||
g574      GEKRARVLFELAQNYQSAGLVDRAEQIFLGLQDGEMAREARQHLLNIYQQDRDWEKAVET
                 130        140        150        160        170        180

190        200        210        220        230        240
m574.pep  ARLLSHDDQTYQFEIAQFYCELAQAALFKSNFDVARFNVGKALEANKKCTRANMILGDIE
          |:||||:||||||||||||||||||||||||||||:||||||||||||||||||||||||
g574      AQLLSHDEQTYQFEIAQFYCELAQAALFKSNFDAARFNVGKALEANKKCTRANMILGDIE
                 190        200        210        220        230        240

250        260        270        280        290        300
m574.pep  HRQGNFPAAVEAYAAIEQQNHAYLSMVGEKLYEAYAAQGKPEEGLNRLTGYMQTFPELDL
          ||||||||||||||||||||||||||||||||||||||||||||||||||||||||||||
g574      HRQGNFPAAVEAYAAIEQQNHAYLSMVGEKLYEAYAAQGKPEEGLNRLTGYMQTFPELDL
                 250        260        270        280        290        300

310        320        330        340        350        360
m574.pep  INVVYEKSLLLKCEKEAAQTAVELVRRKPDLNGVYRLLGLKLSDMNPAWKADADMMRSVI
          ||||||||||| ||||||||||||||||||||||||||||||::||||||||||||||||
g574      INVVYEKSLLLKGEKEAAQTAVELVRRKPDLNGVYRLLGLKLSDLDPAWKADADMMRSVI
                 310        320        330        340        350        360

370        380        390        400
m574.pep  GRQLQRSVMYRCRNCHFKSQVFFWHCPACNKWQTFTPNKIEVX
          ||||||||||||||||||||||||||||||||||||||||||
g574      GRQLQRSVMYRCRNCHFKSQVFFWHCPACNKWQTFTPNKIEVX
                 370        380        390        400
```

The following partial DNA sequence was identified in *N. meningitidis* <SEQ ID 1729>:

```
a574.seq
     1   ATGCGCCCGA ATCTGCCAAA CAGCCTTGAG AAAGCCGATA TGGACAATGA

51   ATTGTGGATT ATCCTGCTGC CGATTATCCT TTTGCCCGTT TTCTTCGCGA

101   TGGGCTGGTT TGCCGCCCGC GTGGATATGA AGACTGTATT AAAGCAGGCA

151   AAAAGCATAC CGTCGGGATT TTATAAAAGT CTGGATGCCT TGGTTGACCG

201   CAACAGCGGG CGCGCGGCAA GGGAGTTGGC GGAAGTCGTC GACGGCCGGC

251   CGCAATCGTA TGATTTGAAC CTCACCCTCG GCAAACTTTA CCGCCAGCGT

301   GGCGAAAACG ACAAAGCCAT CAATATGCAC CAAACATTGC TTGACTCTCC
```

-continued
```
 351 CGATACAACC GGAGCCAAGC GCGCGCGCGT CCTGTTTGAA TTGGCGCAAA

401 ACTACCAAAG TGCGGGGTTG GTCGATCGTG CCGAACAGAT TTTTTTGGGG

451 CTGCAAGACG GTGAAATGGC GCGTGAAGCC AGACAGCACC TGCTCAATAT

501 CTACCAACAG GACAGGGATT GGGAAAAAGC GGTTGAAACC GCCCGGCTGC

551 TCAGCCATGA CGATCAGACC TATCAGTTTG AAATCGCCCA GTTTTATTGC

601 GAACTTGCCC AAGCCGCGCT GTTCAAGTCC AATTTCGATG CCGCGCGTTT

651 CAATGTCGGC AAGGCACTCG AAGCCAACAA AAAATGCACC CGCGCCAACA

701 TGATTTTGGG CGACATCGAA CACCGACAAG GCAATTTCCC TGCCGCCGTC

751 GAAGCCTATG CCGCCATCGA GCAGCAAAAC CATGCATACT TGAGTATGGT

801 CGGCGAGAAG CTTTACGAAG CCTATGCCGC GCAGGGAAAA CCTGAAGAAG

851 GCTTGAACCG TCTGACAGGA TATATGCAGA CGTTTCCCGA ACTTGACCTG

901 ATCAATGTCG TGTACGAGAA ATCCCTGCTG CTTAAGTGCG AGAAAGAAGC

951 CGCGCAAACC GCCGTCGAGC TTGTCCGCCG CAAGCCCGAC CTCAACGGCG

1001 TGTACCGCCT GCTTGGTTTG AAACTCAGCG ATTTGGATCC GGCTTGGAAA

1051 GCCGATGCCG ATATGATGCG TTCGGTTATC GGACGGCAGC TACAGCGCAG

1101 CGTGATGTAC CGGTGCCGAA ACTGCCACTT CAAATCACAA GTCTTTTTCT

1151 GGCATTGTCC TGCCTGCAAC AAATGGCAGA CGTTTACGCC AAACAAAATC

1201 GAAGTTTAA
```

This corresponds to the amino acid sequence <SEQ ID 1730; ORF 574.a>:

```
a574.pep

1     MRPNLPNSLE KADMDNELWI ILLPIILLPV FFAMGWFAAR VDMKTVLKQA

51     KSIPSGFYKS LDALVDRNSG RAARELAEVV DGRPQSYDLN LTLGKLYRQR

101     GENDKAINMH QTLLDSPDTT GAKRARVLFE LAQNYQSAGL VDRAEQIFLG

151     LQDGEMAREA RQHLLNIYQQ DRDWEKAVET ARLLSHDDQT YQFEIAQFYC

201     ELAQAALFKS NFDAARFNVG KALEANKKCT RANMILGDIE HRQGNFPAAV

251     EAYAAIEQQN HAYLSMVGEK LYEAYAAQGK PEEGLNRLTG YMQTFPELDL

301     INVVYEKSLL LKCEKEAAQT AVELVRRKPD LNGVYRLLGL KLSDLDPAWK

351     ADADMMRSVI GRQLQRSVMY RCRNCHFKSQ VFFWHCPACN KWQTFTPNKI

401     EV* m574/a574   97.5% identity in 402 aa overlap 10         20         30         40         50         60
m574.pep   MRPNLPNSLKKADMDNELWIILLPIILLPVFFAMGWFAARVDMKTVLKQAKSIPSGFYKS
           |||||||||:||||||||||||||||||||||||||||||||||||||||||||||||||
a574       MRPNLPNSLEKADMDNELWIILLPIILLPVFFAMGWFAARVDMKTVLKQAKSIPSGFYKS
                   10         20         30         40         50         60

70         80         90        100        110        120
m574.pep   LDALVDRNSGRAARELAEVVDGRPQSYDLNLTLGKLYRQRGENDKAINIHRTMLDSPDTV
           ||||||||||||||||||||||||||||||||||||||||||||||||:|:|:||||||:
a574       LDALVDRNSGRAARELAEVVDGRPQSYDLNLTLGKLYRQRGENDKAINMHQTLLDSPDTT
                   70         80         90        100        110        120

130        140        150        160        170        180
m574.pep   GEKRARVLFELAQNYQSAGLVDRAEQIFLGLQDGKMAREARQHLLNIYQQDRDWEKAVET
           |:||||||||||||||||||||||||||||||||:|||||||||||||||||||||||||
a574       GAKRARVLFELAQNYQSAGLVDRAEQIFLGLQDGEMAREARQHLLNIYQQDRDWEKAVET
                  130        140        150        160        170        180
```

```
                     190       200       210       220       230       240
m574.pep    ARLLSHDDQTYQFEIAQFYCELAQAALFKSNFDVARFNVGKALEANKKCTRANMILGDIE
            ||||||||||||||||||||||||||||||:|||||||||||||||||||||||||||||
a574        ARLLSHDDQTYQFEIAQFYCELAQAALFKSNFDAARFNVGKALEANKKCTRANMILGDIE
                     190       200       210       220       230       240
                     250       260       270       280       290       300
m574.pep    HRQGNFPAAVEAYAAIEQQNHAYLSMVGEKLYEAYAAQGKPEEGLNRLTGYMQTFPELDL
            ||||||||||||||||||||||||||||||||||||||||||||||||||||||||||||
a574        HRQGNFPAAVEAYAAIEQQNHAYLSMVGEKLYEAYAAQGKPEEGLNRLTGYMQTFPELDL
                     250       260       270       280       290       300
                     310       320       330       340       350       360
m574.pep    INVVYEKSLLLKCEKEAAQTAVELVRRKPDLNGVYRLLGLKLSDMNPAWKADADMMRSVI
            |||||||||||||||||||||||||||||||||||||||||::|||||||||||||||||
a574        INVVYEKSLLLKCEKEAAQTAVELVRRKPDLNGVYRLLGLKLSDLDPAWKADADMMRSVI
                     310       320       330       340       350       360
                     370       380       390       400
m574.pep    GRQLQRSVMYRCRNCHFKSQVFFWHCPACNKWQTFTPNKIEVX
            ||||||||||||||||||||||||||||||||||||||||||
a574        GRQLQRSVMYRCRNCHFKSQVFFWHCPACNKWQTFTPNKIEVX
                     370       380       390       400
```

The following partial DNA sequence was identified in *N. gonorrhoeae* <SEQ ID 1731>:

```
g575.seq (partial)
    1 ..atgccgtgcc tccgccggca agcagcaagg tgtacgaacc gccgaacaga 51   ccgtcaaaca gtccgctttc ggtttcttct cggcagaaa  cctgttcgac 101   aggttcggca acgggttcgg cggcaacttc actggctgtt ccgcaacag 151   gttcggaaac ggtgttaccg gtttcgtcgg tcggcgtgtc gatggcagaa 201   gcggcggctt cttgggggggg cggattcggc agcggtttcc gatgcggcag 251   tatttgcagc gggtacaggt ccgggttggc gttctgtcgc cgaagccgga 301   gtttcggaca ctgcgggttt gggttcgggt cgaacggccg gttttccgc 351   ttttgcttcg ggcgcggcaa cttttgcttc aggttttca accggttttt 401   cgacaggttt ctctatcggt ttctccacag ttgcctgttt ggacggttca 451   gacggcatgg atgcagtttc ggctttgggt ttcgccgttt gcggtttggg 501   ttgttccgct ttgattttt tgggtgctgc cgctttgatc ctgttcagat 551   tcggaatgtg a*
```

This corresponds to the amino acid sequence <SEQ ID 1732; ORF 575.ng>:

```
g575.pep (partial)
    1 ..MPCLRRQAAR CTNRRTDRQT VRFRFLLRQK PVRQVRQRVR RQLHWLFPQQ

51   VRKRCYRFRR SACRWQKRRL LGGADSAAVS DAAVFAAGTG PGWRSVAEAG

101   VSDTAGLGSG RTAGFSAFAS GAATFASGFS TGFSTGFSIG FSTVACLDGS

151   DGMDAVSALG FAVCGLGCSA LIFLGAAALI LFRFGM*
```

The following partial DNA sequence was identified in *N. meningitidis* <SEQ ID 1733>:

```
m575.seq..
    1  ATGGTTTCGG GCGAGGAAGC CTTCAGGAAG CCTGCCAGTC CGGAGGGTGA

51  GGCAGGTTTT GCGGAAGCTG TTTCTTCTGT GCCGATATGG TTGTTTGAGG

101  GCAGGTTGTC GGAGAAATCG GTATCGACGG TTTCCGGTTT GTTTTCGGCA
```

-continued

```
 151 GTTTGGGCGA CAGATTCCGG TTCGGGCGTG TCGATGACGA TTTCGACAGG

201 GTTGTACGGG TTGAAGGTCT CGGGCTCGTA CACGCTGTCT GTGGATTCGA

251 TGGCGTTCCA ATCGGCATCC GCGCGTTTTT GGGTTTCTTC ATCCTGCGTA

301 AGTGCGCCGG ATAAAATGCC GTTTTGCGCG GCTGCCAGGC TGTCGAAATC

351 CAAGTCGATG CGGTTGGAAG GCGTATCGGT TTCGACATCG AACGTTTGTT

401 TTGCCGATAA CTCTTCTTCA GATTCCCCAT CTAAGGCAAG TGTGTCGTTT

451 ACATCGTTTT TCGGAGCGGG TTCGGGCGTT GCCGGAGTTT CGACTTCGGC

501 AAAGGTGATT TCTATGCCGT CGTCTGCCGC GTCGTCAAGG TCAGGCTCTT

551 CCTCAGGGAC GGATTCTTCG GTACGGCGCG CGCGTTTGGA TTGGGCAAGG

601 CGCAAAAGCA GCAGCAGGGC GATTAATGCC GCGCCTCCGC CGGCAAGCAG

651 CAAGGTGTAC GAACCGCCGA ACAGACCGTC AAACAGTCCG CTTTCGGTTT

701 CTTCTTCGGC AGAAACCTGT TCGACAGGTT CGGAAACGGC GTTACCGGTT

751 TCGTCGGTCG GCGTGTCGAT GGCAGAAGCG GCGGCTTCTT GGGGGGCGGA

801 TTCGGCAGCG GTTTCCGATG CGGCAGTATT TGCAGCGGGT ACAGGTTCGG

851 GTCGAACGGC CGGTTTTTCC GCTTTTGCTT CGGGCGCGGC AACTTTTGCT

901 TCAGGTTTTT CAACCGGTTT CTCTACCGTT GCCTGTTTGG ACGGTTCGGA

951 CGGCATGGAT GCGGTTTCGG CTTTGGGTTT CGCCGTTTGC GGTTTGGGTT

1001 GTTCCGCTTT GATCCTGTTC AGATTCGGAA TGTGA
```

This corresponds to the amino acid sequence <SEQ ID 1734; ORF 575>:

```
m575.pep

1    MVSGEEAFRK PASPEGEAGF AEAVSSVPIW LFEGRLSEKS VSTVSGLFSA

51    VWATDSGSGV SMTISTGLYG LKVSGSYTLS VDSMAFQSAS ARFWVSSSCV

101    SAPDKMPFCA AARLSKSKSM RLEGVSVSTS NVCFADNSSS DSPSKASVSF

151    TSFFGAGSGV AGVSTSAKVI SMPSSAASSR SGSSSGTDSS VRRARLDWAR

201    RKSSSRAINA APPPASSKVY EPPNRPSNSP LSVSSSAETC STGSETALPV

251    SSVGVSMAEA AASWGADSAA VSDAAVFAAG TGSGRTAGFS AFASGAATFA

301    SGFSTGFSTV ACLDGSDGMD AVSALGFAVC GLGCSALILF RFGM*
```

```
m575/g575    70.2% identity in 114 aa overlap 240        250        260        270        280
m575.pep    SSAETCSTGSETALPVSSVGVSMAEAAASWGADSAAVSDAAVFAAGTG------------
                                    ||||||||||||||||||
g575        LHWLFPQQVRKRCYRFRRSACRWQKRRLLGGADSAAVSDAAVFAAGTGPGWRSVAEAGVS
             50         60         70         80         90        100

290        300    309        310        320
m575.pep    ------SGRTAGFSAFASGAATFASGFSTGFST--------VACLDGSDGMDAVSALGFA
                  ||||||||||||||||||||||||||||||         ||||||||||||||||||
g575        DTAGLGSGRTAGFSAFASGAATFASGFSTGFSTGFSIGFSTVACLDGSDGMDAVSALGFA
                 110        120        130        140        150        160

330        340
m575.pep    VCGLGCSALI--------LFRFGMX
            ||||||||||        |||||||
g575        VCGLGCSALIFLGAAALILFRFGMX
                 170        180
```

The following partial DNA sequence was identified in *N. meningitidis* <SEQ ID 1735>:

```
a575.seq
   1 ATGGTTTCGG GCGAGGAAGC CTTCAGGAAG CCTGCCAGTC CGGAGGGTGA

51 GGCAGGTTTT GCGGAAGCTG TTTCTTCTGT GCCGATATGG TTGTTTGAGG

101 GCAGGTTGTC GGAGAAATCG GTATCGACGG TTTCCGGTTT GTTTTCGGCA

151 GTTTGGGCGA CAGATTCCGG TTCGGGCGTG TCGATGACGA TTTCGACAGG

201 GTTGTACGGG TTGAAGGTCT CGGGCTCGTA CACGCTGTCT GTGGATTCGA

251 TGGCGTTCCA ATCGGCATCC GCGCGTTTTT GGGTTTCTTC ATCCTGCGTA

301 AGTGCGCCGG ATAAAATGCC GTTTTGCGCG GCTGCCAGGC TGTCGAAATC

351 CAAGTCGATG CGGTTGGAAG GCGTATCGGT TTCGACATCG AACGTTTGTT

401 TTGCCGACAA CTCTTCTTCA GATTCCCCAT CTAAGGCAAG TGTGTCGTTT

451 ACATCGTTTT TCGGAGCGGG TTCGGGCGTT GCCGGAGTTT CGACTTCGGC

501 AAAGGTGATT TCTATGCCGT CGTCTGCCGC GTCGTCAAGG TCAGGCTCTT

551 CCTCAGGGAC GGATTCTTCG GTACGGCGCG CGCGTTTGGA TTGGGCAAGG

601 CGCAAAAGCA GCAGCAGGGC GATCAATGCC GCGCCTCCGC CGGCAAGCAG

651 CAAGGTGTAC GAACCGCCGA ACAGTCCGCT TTCGGTTTCT TCTTCGGCAG

701 AAACCTGTTC GACAGGTTCG GAAACGGCGT TACCGGTTTC GTCGGTCGGC

751 GTGTCGATGG CAGAAGCGGC GGCTTCTTGG GGGGCGGATT CGGCAGCGGT

801 TTCCGATGCG GCAGTATTTG CAGCGGGTAC AGGTTCGGGT CGAACGGCCG

851 GTTTTTCCGC TTTTGCTTCG GGCGCGGCAA CTTTTGCTTC AGGTTTTTCA

901 ACCGGTTTCT CTACCGTTGC CTGTTTGGAC GGTTCGGACG GCATGGATGC

951 GGTTTCGGCT TTGGGTTTCG CCGTTTGCGG TTTGGGTTGT TCCGCTTTGA

1001 TCCTGTTCAG ATTCGGAATG TGA
```

This corresponds to the amino acid sequence <SEQ ID 1736; ORF 575.a>:

```
a575.pep

1    MVSGEEAFRK PASPEGEAGF AEAVSSVPIW LFEGRLSEKS VSTVSGLFSA

51    VWATDSGSGV SMTISTGLYG LKVSGSYTLS VDSMAFQSAS ARFWVSSSCV

101    SAPDKMPFCA AARLSKSKSM RLEGVSVSTS NVCFADNSSS DSPSKASVSF

151    TSFFGAGSGV AGVSTSAKVI SMPSSAASSR SGSSSGTDSS VRRARLDWAR

201    RKSSSRAINA APPPASSKVY EPPNSPLSVS SSAETCSTGS ETALPVSSVG

251    VSMAEAAASW GADSAAVSDA AVFAAGTGSG RTAGFSAFAS GAATFASGFS

301    TFGSTVACLD GSDGMDAVSA LGFAVCGLGC SALILFRFGM * m575/a575  98.8% identity in 344 aa overlap 10        20        30        40        50        60
m575.pep   MVSGEEAFRKPASPEGEAGFAEAVSSVPIWLFEGRLSEKSVSTVSGLFSAVWATDSGSGV
           ||||||||||||||||||||||||||||||||||||||||||||||||||||||||||||
a575       MVSGEEAFRKPASPEGEAGFAEAVSSVPIWLFEGRLSEKSVSTVSGLFSAVWATDSGSGV
                   10        20        30        40        50        60

70        80        90       100       110       120
m575.pep   SMTISTGLYGLKVSGSYTLSVDSMAFQSASARFWVSSSCVSAPDKMPFCAAARLSKSKSM
           ||||||||||||||||||||||||||||||||||||||||||||||||||||||||||||
a575       SMTISTGLYGLKVSGSYTLSVDSMAFQSASARFWVSSSCVSAPDKMPFCAAARLSKSKSM
                   70        80        90       100       110       120
```

-continued

```
              130        140        150        160        170        180
m575.pep   RLEGVSVSTSNVCFADNSSSDSPSKASVSFTSFFGAGSGVAGVSTSAKVISMPSSAASSR
           ||||||||||||||||||||||||||||||||||||||||||||||||||||||||||||
a575       RLEGVSVSTSNVCFADNSSSDSPSKASVSFTSFFGAGSGVAGVSTSAKVISMPSSAASSR
              130        140        150        160        170        180

190        200        210        220        230        240
m575.pep   SGSSSGTDSSVRRARLDWARRKSSSRAINAAPPPASSKVYEPPNRPSNSPLSVSSSAETC
           |||||||||||||||||||||||||||||||||||||||||||||    ||||||||||||
a575       SGSSSGTDSSVRRARLDWARRKSSSRAINAAPPPASSKVYEPPN----SPLSVSSSAETC
              190        200        210        220            230

250        260        270        280        290        300
m575.pep   STGSETALPVSSVGVSMAEAAASWGADSAAVSDAAVFAAGTGSGRTAGFSAFASGAATFA
           ||||||||||||||||||||||||||||||||||||||||||||||||||||||||||||
a575       STGSETALPVSSVGVSMAEAAASWGADSAAVSDAAVFAAGTGSGRTAGFSAFASGAATFA
              240        250        260        270        280        290

310        320        330        340
m575.pep   SGFSTGFSTVACLDGSDGMDAVSALGFAVCGLGCSALILFRFGMX
           ||||||||||||||||||||||||||||||||||||||||||||
a575       SGFSTGFSTVACLDGSDGMDAVSALGFAVCGLGCSALILFRFGMX
              300        310        320        330        340
```

The following partial DNA sequence was identified in *N. gonorrhoeae* <SEQ ID 1737>:

```
g576.seq..(partial)
   1  ..atgggcgtgg acatcggacg ctccctgaaa caaatgaagg aacagggcgc
  51    ggaaatcgat ttgaaagtct ttaccgatgc catgcaggca gtgtatgacg
 101    gcaaagaaat caaaatgacc gaagagcagg cccaggaagt gatgatgaaa
 151    ttcctgcagg agcagcaggc taaagccgta gaaaaacaca aggcggatgc
 201    gaaggccaac aaagaaaaag gcgaagcctt cctgaaggaa aatgccgccg
 251    aagacggcgt gaagaccact gcttccggtc tgcagtacaa aatcaccaaa
 301    cagggtgaag gcaaacagcc gacaaaagac gacatcgtta ccgtggaata
 351    cgaaggccgc ctgattgacg gtaccgtatt cgacagcagc aaagccaacg
 401    gcggcccggc caccttccct ttgagccaag tgattccggg ttggaccgaa
 451    ggcgtacggc ttctgaaaga aggcggcgaa gccacgttct acatcccgtc
 501    caaccttgcc taccgcgaac agggtgcggg cgaaaaaatc ggtccgaacg
 551    ccactttggt atttgacgtg aaactggtca aaatcggcgc acccgaaaac
 601    gcgcccgcca agcagccgga tcaagtcgac atcaaaaaag taaattaa
```

This corresponds to the amino acid sequence <SEQ ID 1738; ORF 576.ng>:

```
g576.pep..(partial)
   1  ..MGVDIGRSLK QMKEQGAEID LKVFTDAMQA VYDGKEIKMT EEQAQEVMMK
  51    FLQEQQAKAV EKHKADAKAN KEKGEAFLKE NAAEDGVKTT ASGLQYKITK
 101    QGEGKQPTKD DIVTVEYEGR LIDGTVFDSS KANGGPATFP LSQVIPGWTE
 151    GVRLLKEGGE ATFYIPSNLA YREQGAGEKI GPNATLVFDV KLVKIGAPEN
 201    APAKQPDQVD IKKVN*
```

The following partial DNA sequence was identified in *N. meningitidis* <SEQ ID 1739>:

```
m576.seq.. (partial)
   1  ..ATGCAGCAGG CAAGCTATGC GATGGGCGTG GACATCGGAC GCTCCCTGAA
  51    GCAAATGAAG GAACAGGGCG CGGAAATCGA TTTGAAAGTC TTTACCGAAG
```

-continued

```
101    CCATGCAGGC AGTGTATGAC GGCAAAGAAA TCAAAATGAC CGAAGAGCAG

151    GCTCAGGAAG TCATGATGAA ATTCCTTCAG GAACAACAGG CTAAAGCCGT

201    AGAAAAACAC AAGGCGGACG CGAAGGCCAA TAAAGAAAAA GGCGAAGCCT

251    TTCTGAAAGA AAATGCCGCC AAAGACGGCG TGAAGACCAC TGCTTCCGGC

301    CTGCAATACA AAATCACCAA ACAGGGCGAA GGCAAACAGC CGACCAAAGA

351    CGACATCGTT ACCGTGGAAT ACGAAGGCCG CCTGATTGAC GGTACGGTAT

401    TCGACAGCAG CAAAGCCAAC GGCGGCCCGG TCACCTTCCC TTTGAGCCAA

451    GTGATTCCGG GTTGGACCGA AGgCGTACAG CTTCTGAAAG AAGGCGGCGA

501    AGCCACGTTC TACATCCCGT CCAACCTTGC CTACCGCGAA CAGGGTGCGG

551    GCGACAAAAT CGGTCCGAAC GCCACTTTGG TATTTGATGT GAAACTGGTC

601    AAAATCGGCG CACCCGAAAA CGCGCCCGCC AAGCAGCCGG CTCAAGTCGA

651    CATCAAAAAA GTAAATTAA
```

This corresponds to the amino acid sequence <SEQ ID 1740; ORF 576>:

```
m576.pep.. (partial)
  1  ..MQQASYAMGV DIGRSLKQMK EQGAEIDLKV FTEAMQAVYD GKEIKMTEEQ

51    AQEVMMKFLQ EQQAKAVEKH KADAKANKEK GEAFLKENAA KDGVKTTASG

101    LQYKITKQGE GKQPTKDDIV TVEYEGRLID GTVFDSSKAN GGPVTFPLSQ

151    VIPGWTEGVQ LLKEGGEATF YIPSNLAYRE QGAGDKIGPN ATLVFDVKLV

201    KIGAPENAPA KQPAQVDIKK VN*
```

Computer analysis of this amino acid sequence gave the following results:
Homology with a Predicted ORF from *N. gonorrhoeae*

```
   m576/g576 97.2% identity in 215 aa overlap 10         20         30         40         50         60
   m576.pep MQQASYAMGVDIGRSLKQMKEQGAEIDLKVFTEAMQAVYDGKEIKMTEEQAQEVMMKFLQ
                    |||||||||||||||||||||||||:|||||||||||||||||||||||||
   g576             MGVDIGRSLKQMKEQGAEIDLKVFTDAMQAVYDGKEIKMTEEQAQEVMMKFLQ
                            10         20         30         40         50

70         80         90        100        110        120
   m576.pep EQQAKAVEKHKADAKANKEKGEAFLKENAAKDGVKTTASGLQYKITKQGEGKQPTKDDIV
            ||||||||||||||||||||||||||||||:|||||||||||||||||||||||||||||
   g576     EQQAKAVEKHKADAKANKEKGEAFLKENAAEDGVKTTASGLQYKITKQGEGKQPTKDDIV
                60         70         80         90        100        110

130        140        150        160        170        180
   m576.pep TVEYEGRLIDGTVFDSSKANGGPVTFPLSQVIPGWTEGVQLLKEGGEATFYIPSNLAYRE
            |||||||||||||||||||||||:|||||||||||||||:||||||||||||||||||||
   g576     TVEYEGRLIDGTVFDSSKANGGPATFPLSQVIPGWTEGVRLLKEGGEATFYIPSNLAYRE
                120        130        140        150        160        170

190        200        210        220
   m576.pep QGAGDKIGPNATLVFDVKLVKIGAPENAPAKQPAQVDIKKVNX
            ||||:||||||||||||||||||||||||||||| |||||||||
   g576     QGAGEKIGPNATLVFDVKLVKIGAPENAPAKQPDQVDIKKVNX
                180        190        200        210
```

The following partial DNA sequence was identified in *N. meningitidis* <SEQ ID 1741>:

```
a576.seq
  1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC
```

```
-continued
101 CTGCCGCCGC TTCTTCCGCG CAGGGCGACA CCTCTTCGAT CGGCAGCACG

151 ATGCAGCAGG CAAGCTATGC GATGGGCGTG GACATCGGAC GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AAGGCGGACG CGAAGGCCAA TAAAGAAAAA GGCGAAGCCT

401 TTCTGAAAGA AAATGCCGCC AAAGACGGCG TGAAGACCAC TGCTTCCGGC

451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT

551 TCGACAGCAG CAAAGCCAAC GGCGGCCCGG TCACCTTCCC TTTGAGCCAA

601 GTGATTCTGG GTTGGACCGA AGGCGTACAG CTTCTGAAAG AAGGCGGCGA

651 AGCCACGTTC TACATCCCGT CCAACCTTGC CTACCGCGAA CAGGGTGCGG

701 GCGACAAAAT CGGCCCGAAC GCCACTTTGG TATTTGATGT GAAACTGGTC

751 AAAATCGGCG CACCCGAAAA CGCGCCCGCC AAGCAGCCGG CTCAAGTCGA

801 CATCAAAAAA GTAAATTAA
```

This corresponds to the amino acid sequence <SEQ ID 1742; ORF 576.a>:

```
a576.pep

1     MNTIFKISAL TLSAALALSA CGKKEAAPAS ASEPAAASSA QGDTSSIGST

51     MQQASYAMGV DIGRSLKQMK EQGAEIDLKV FTEAMQAVYD GKEIKMTEEQ

101     AQEVMMKFLQ EQQAKAVEKH KADAKANKEK GEAFLKENAA KDGVKTTASG

151     LQYKITKQGE GKQPTKDDIV TVEYEGRLID GTVFDSSKAN GGPVTFPLSQ

201     VILGWTEGVQ LLKEGGEATF YIPSNLAYRE QGAGDKIGPN ATLVFDVKLN

251     KIGAPENAPA KQPAQVDIKK VN* m576/a576    99.5% identity in 222 aa overlap 10         20         30
m576.pep                      MQQASYAMGVDIGRSLKQMKEQGAEIDLKV
                              ||||||||||||||||||||||||||||||
a576         CGKKEAAPASASEPAAASSAQGDTSSIGSTMQQASYAMGVDIGRSLKQMKEQGAEIDLKV
                  30         40         50         60         70         80

40         50         60         70         80         90
m576.pep     FTEAMQAVYDGKEIKMTEEQAQEVMMKFLQEQQAKAVEKHKADAKANKEKGEAFLKENAA
             ||||||||||||||||||||||||||||||||||||||||||||||||||||||||||||
a576         FTEAMQAVYDGKEIKMTEEQAQEVMMKFLQEQQAKAVEKHKADAKANKEKGEAFLKENAA
                  90        100        110        120        130        140

100        110        120        130        140        150
m576.pep     KDGVKTTASGLQYKITKQGEGKQPTKDDIVTVEYEGRLIDGTVFDSSKANGGPVTFPLSQ
             ||||||||||||||||||||||||||||||||||||||||||||||||||||||||||||
a576         KDGVKTTASGLQYKITKQGEGKQPTKDDIVTVEYEGRLIDGTVFDSSKANGGPVTFPLSQ
                 150        160        170        180        190        200

160        170        180        190        200        210
m576.pep     VIPGWTEGVQLLKEGGEATFYIPSNLAYREQGAGDKIGPNATLVFDVKLVKIGAPENAPA
             ||  ||||||||||||||||||||||||||||||||||||||||  ||||||||||||||
a576         VILGWTEGVQLLKEGGEATFYIPSNLAYREQGAGDKIGPNATLVGDVKLVKIGAPENAPA
                 210        220        230        240        250        260

220
m576.pep     KQPAQVDIKKVNX
             |||||||||||||
a576         KQPAQVDIKKVNX
                 270
```

The following partial DNA sequence was identified in *N. gonorrhoeae* <SEQ ID 1743>:

```
g576-1.seq
   1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC

101 CTGCCGCCGC TTCTGCCGCG CAGGGCGACA CCTCTTCAAT CGGCAGCACG

151 ATGCAGCAGG CAAGCTATGC AATGGGCGTG GACATCGGAC GCTCCCTGAA

201 ACAAATGAAG GAACAGGGCG CGGAAATCGA TTTGAAAGTC TTTACCGATG

251 CCATGCAGGC AGTGTATGAC GGCAAAGAAA TCAAAATGAC CGAAGAGCAG

301 GCCCAGGAAG TGATGATGAA ATTCCTGCAG GAGCAGCAGG CTAAAGCCGT

351 AGAAAAACAC AAGGCGGATG CGAAGGCCAA CAAAGAAAAA GGCGAAGCCT

401 TCCTGAAGGA AAATGCCGCC AAAGACGGCG TGAAGACCAC TGCTTCCGGT

451 CTGCAGTACA AAATCACCAA ACAGGGTGAA GGCAAACAGC CGACAAAAGA

501 CGACATCGTT ACCGTGGAAT ACGAAGGCCG CCTGATTGAC GGTACCGTAT

551 TCGACAGCAG CAAAGCCAAC GGCGGCCCGG CCACCTTCCC TTTGAGCCAA

601 GTGATTCCGG GTTGGACCGA AGGCGTACGG CTTCTGAAAG AAGGCGGCGA

651 AGCCACGTTC TACATCCCGT CCAACCTTGC CTACCGCGAA CAGGGTGCGG

701 GCGAAAAAAT CGGTCCGAAC GCCACTTTGG TATTTGACGT GAAACTGGTC

751 AAAATCGGCG CACCCGAAAA CGCGCCCGCC AAGCAGCCGG ATCAAGTCGA

801 CATCAAAAAA GTAAATTAA
```

This corresponds to the amino acid sequence <SEQ ID 1744; ORF 576-1.ng>:

```
g576-1.pep
   1 MNTIFKISAL TLSAALALSA CGKKEAAPAS ASEPAAASAA QGDTSSIGST

51 MQQASYAMGV DIGRSLKQMK EQGAEIDLKV FTDAMQAVYD GKEIKMTEEQ

101 AQEVMMKFLQ EQQAKAVEKH KADAKANKEK GEAFLKENAA KDGVKTTASG

151 LQYKITKQGE GKQPTKDDIV TVEYEGRLID GTVFDSSKAN GGPATFPLSQ

201 VIPGWTEGVR LLKEGGEATF YIPSNLAYRE QGAGEKIGPN ATLVFDVKLV

251 KIGAPENAPA KQPDQVDIKK VN*
```

The following partial DNA sequence was identified in *N. meningitidis* <SEQ ID 1745>:

```
m576-1.seq
   1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC

101 CTGCCGCCGC TTCTTCCGCG CAGGGCGACA CCTCTTCGAT CGGCAGCACG

151 ATGCAGCAGG CAAGCTATGC GATGGGCGTG GACATCGGAC GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG

301 GCTCAGGAAG TCATGATGAA ATTCCTTCAG GAACAACAGG CTAAAGCCGT

351 AGAAAAACAC AAGGCGGACG CGAAGGCCAA TAAAGAAAAA GGCGAAGCCT

401 TTCTGAAAGA AAATGCCGCC AAAGACGGCG TGAAGACCAC TGCTTCCGGC
```

```
-continued
451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT

551 TCGACAGCAG CAAAGCCAAC GGCGGCCCGG TCACCTTCCC TTTGAGCCAA

601 GTGATTCCGG GTTGGACCGA AGGCGTACAG CTTCTGAAAG AAGGCGGCGA

651 AGCCACGTTC TACATCCCGT CCAACCTTGC CTACCGCGAA CAGGGTGCGG

701 GCGACAAAAT CGGTCCGAAC GCCACTTTGG TATTTGATGT GAAACTGGTC

751 AAAATCGGCG CACCCGAAAA CGCGCCCGCC AAGCAGCCGG CTCAAGTCGA

801 CATCAAAAAA GTAAATTAA
```

This corresponds to the amino acid sequence <SEQ ID 1746; ORF 576-1>:

```
m576-1.pep

1   MNTIFKISAL TLSAALALSA CGKKEAAPAS ASEPAAASSA QGDTSSIGST

51   MQQASYAMGV DIGRSLKQMK EQGAEIDLKV FTEAMQAVYD GKEIKMTEEQ

101   AQEVMMKFLQ EQQAKAVEKH KADAKANKEK GEAFLKENAA KDGVKTTASG

151   LQYKITKQGE GKQPTKDDIV TVEYEGRLID GTVFDSSKAN GGPVTFPLSQ

201   VIPGWTEGVQ LLKEGGEATF YIPSNLAYRE QGAGDKIGPN ATLVFDVKLV

251   KIGAPENAPA KQPAQVDIKK VN* g576-1/m576-1 97.8% identity in 272 aa overlap
                 10         20         30         40         50         60
g576-1.pep MNTIFKISALTLSAALALSACGKKEAAPASASEPAAASAAQGDTSSIGSTMQQASYAMGV
           ||||||||||||||||||||||||||||||||||||||:|||||||||||||||||||||
m576-1     MNTIFKISALTLSAALALSACGKKEAAPASASEPAAASSAQGDTSSIGSTMQQASYAMGV
                 10         20         30         40         50         60

70         80         90        100        110        120
g576-1.pep DIGRSLKQMKEQGAEIDLKVFTDAMQAVYDGKEIKMTEEQAQEVMMKFLQEQQAKAVEKH
           ||||||||||||||||||||||:|||||||||||||||||||||||||||||||||||||
m576-1     DIGRSLKQMKEQGAEIDLKVFTEAMQAVYDGKEIKMTEEQAQEVMMKFLQEQQAKAVEKH
                 70         80         90        100        110        120

130        140        150        160        170        180
g576-1.pep KADAKANKEKGEAFLKENAAKDGVKTTASGLQYKITKQGEGKQPTKDDIVTVEYEGRLID
           ||||||||||||||||||||||||||||||||||||||||||||||||||||||||||||
m576-1     KADAKANKEKGEAFLKENAAKDGVKTTASGLQYKITKQGEGKQPTKDDIVTVEYEGRLID
                130        140        150        160        170        180

190        200        210        220        230        240
g576-1.pep GTVFDSSKANGGPATFPLSQVIPGWTEGVRLLKEGGEATFYIPSNLAYREQGAGEKIGPN
           ||||||||||||||:|||||||||||||||:|||||||||||||||||||||||||:|||
m576-1     GTVFDSSKANGGPVTFPLSQVIPGWTEGVQLLKEGGEATFYIPSNLAYREQGAGDKIGPN
                190        200        210        220        230        240

250        260        270
g576-1.pep ATLVFDVKLVKIGAPENAPAKQPDQVDIKKVNX
           |||||||||||||||||||||||| |||||||
m576-1     ATLVFDVKLVKIGAPENAPAKQPAQVDIKKVNX
                250        260        270
```

The following partial DNA sequence was identified in N. meningitidis <SEQ ID 1747>:

```
a576-1.seq
   1 ATGAACACCA TTTTCAAAAT CAGCGCACTG ACCCTTTCCG CCGCTTTGGC

51 ACTTTCCGCC TGCGGCAAAA AAGAAGCCGC CCCCGCATCT GCATCCGAAC

101 CTGCCGCCGC TTCTTCCGCG CAGGGCGACA CCTCTTCGAT CGGCAGCACG

151 ATGCAGCAGG CAAGCTATGC GATGGGCGTG GACATCGGAC GCTCCCTGAA

201 GCAAATGAAG GAACAGGGCG CGGAAATCGA TTTGAAAGTC TTTACCGAAG

251 CCATGCAGGC AGTGTATGAC GGCAAAGAAA TCAAAATGAC CGAAGAGCAG
```

-continued

```
301 GCTCAGGAAG TCATGATGAA ATTCCTTCAG GAACAACAGG CTAAAGCCGT

351 AGAAAAACAC AAGGCGGACG CGAAGGCCAA TAAAGAAAAA GGCGAAGCCT

401 TTCTGAAAGA AAATGCCGCC AAAGACGGCG TGAAGACCAC TGCTTCCGGC

451 CTGCAATACA AAATCACCAA ACAGGGCGAA GGCAAACAGC CGACCAAAGA

501 CGACATCGTT ACCGTGGAAT ACGAAGGCCG CCTGATTGAC GGTACGGTAT

551 TCGACAGCAG CAAAGCCAAC GGCGGCCCGG TCACCTTCCC TTTGAGCCAA

601 GTGATTCTGG GTTGGACCGA AGGCGTACAG CTTCTGAAAG AAGGCGGCGA

651 AGCCACGTTC TACATCCCGT CCAACCTTGC CTACCGCGAA CAGGGTGCGG

701 GCGACAAAAT CGGCCCGAAC GCCACTTTGG TATTTGATGT GAAACTGGTC

751 AAAATCGGCG CACCCGAAAA CGCGCCCGCC AAGCAGCCGG CTCAAGTCGA

801 CATCAAAAAA GTAAATTAA
```

This corresponds to the amino acid sequence <SEQ ID 1748; ORF 576-1.a>:

```
m576-1.pep

1    MNTIFKISAL TLSAALALSA CGKKEAAPAS ASEPAAASSA QGDTSSIGST

51    MQQASYAMGV DIGRSLKQMK EQGAEIDLKV FTEAMQAVYD GKEIKMTEEQ

101    AQEVMMKFLQ EQQAKAVEKH KADAKANKEK GEAFLKENAA KDGVKTTASG

151    LQYKITKQGE GKQPTKDDIV TVEYEGRLID GTVFDSSKAN GGPVTFPLSQ

201    VILGWTEGVQ LLKEGGEATF YIPSNLAYRE QGAGDKIGPN ATLVFDVKLV

251    KIGAPENAPA KQPAQVDIKK VN* a576-1/m576-1 99.6% identity in 272 aa overlap 10        20        30        40        50        60
a576-1.pep  MNTIFKISALTLSAALALSACGKKEAAPASASEPAAASSAQGDTSSIGSTMQQASYAMGV
            ||||||||||||||||||||||||||||||||||||||||||||||||||||||||||||
m576-1      MNTIFKISALTLSAALALSACGKKEAAPASASEPAAASSAQGDTSSIGSTMQQASYAMGV
                  10        20        30        40        50        60

70        80        90       100       110       120
a576-1.pep  DIGRSLKQMKEQGAEIDLKVFTEAMQAVYDGKEIKMTEEQAQEVMMKFLQEQQAKAVEKH
            ||||||||||||||||||||||||||||||||||||||||||||||||||||||||||||
m576-1      DIGRSLKQMKEQGAEIDLKVFTEAMQAVYDGKEIKMTEEQAQEVMMKFLQEQQAKAVEKH
                  70        80        90       100       110       120

130       140       150       160       170       180
a576-1.pep  KADAKANKEKGEAFLKENAAKDGVKTTASGLQYKITKQGEGKQPTKDDIVTVEYEGRLID
            ||||||||||||||||||||||||||||||||||||||||||||||||||||||||||||
m576-1      KADAKANKEKGEAFLKENAAKDGVKTTASGLQYKITKQGEGKQPTKDDIVTVEYEGRLID
                 130       140       150       160       170       180

190       200       210       220       230       240
a576-1.pep  GTVFDSSKANGGPVTFPLSQVILGWTEGVQLLKEGGEATFYIPSNLAYREQGAGDKIGPN
            |||||||||||||||||||| |||||||||||||||||||||||||||||||||||||||
m576-1      GTVFDSSKANGGPVTFPLSQVIPGWTEGVQLLKEGGEATFYIPSNLAYREQGAGDKIGPN
                 190       200       210       220       230       240

250       260       270
a576-1.pep  ATLVFDVKLVKIGAPENAPAKQPAQVDIKKVNX
            ||||||||||||||||||||||||||||||||
m576-1      ATLVFDVKLVKIGAPENAPAKQPAQVDIKKVNX
                 250       260       270
```

Expression of ORF 576

The primer described in Table 1 for ORF 576 was used to locate and clone ORF 576. ORF 576 was cloned in pET and pGex vectors and expressed in *E. coli* as above described. The products of protein expression and purification were analyzed by SDS-PAGE. FIG. 3A shows the results of affinity purification and FIG. 3B shows the expression in *E. coli*. Purified His-fusion protein was used to immunize mice, whose sera were used for ELISA (positive result), FACS analysis (FIG. 3C), western blot (FIG. 3D). These experiments confirm that ORF 576 is a surface-exposed protein and that it is a useful immunogen. The hydrophilicity plots, antigenic index, and amphipatic regions of ORF 576 are provided in FIG. 7. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 576 and the amino acid sequence encoded thereby is provided in Example 1.

The following partial DNA sequence was identified in *N. gonorrhoeae* <SEQ ID 1749>:

```
g577.seq..
   1 atggaaagga gcggtgtatt tggtaaaatt gtcggcaatc gcatactccg
  51 tatgccgtcc gaacacgctg ccgcattcta tccgaaaccg tgcaaatcgt
 101 ttaaactaac gcaatcttgg ttcagagtgc gaagctgtcc gtgcggcgtt
 151 tttatttacg gagcaaacat gaaacttatc tataccgtca tcaaaatcat
 201 tatcctgctg ctcttcctgc tgcttgccgt cattaatatg gatgccgtta
 251 ccttttccta tcttccgggg cagagtgtca atctgccgct gattgtcgta
 301 ttgttcggcg cgtttgtcgt cggcatcgtg ttcggaatgt ttgccctgtt
 351 cgggcggctg ctgtccttgc gcggcgaaaa cagccgcctg cgtgcggaag
 401 tgaagaaaag tgcgcgcttg agcggacaga aattgactgc accgccgata
 451 caaaatgctg ccgaatctgc caaacagcct taa
```

This corresponds to the amino acid sequence <SEQ ID 1750; ORF 577.ng>:

```
g577.pep
   1 MERSGVFGKI VGNRILRMPS EHAAAFYPKP CKSFKLTQSW FRVRSCPCGV
  51 FIYGANMKLI YTVIKIIILL LFLLLAVINM DAVTFSYLPG QSVNLPLIVV
 101 LFGAFVVGIV FGMFALFGRL LSLRGENSRL RAEVKKSARL SGQKLTAPPI
 151 QNAAESAKQP *
```

The following partial DNA sequence was identified in *N. meningitidis* <SEQ ID 1751>:

```
m577.seq..
   1 ATGGAAAGGA ACGGTGTATT TGGTAAAATT GTCGGCAATC GCATACTCCG
  51 TATGTCGTCC GAACACGCTG CCGCATCCTA TCCGAAACCG TGCAAATCGT
 101 TTAAACTAGC GCAATCTTGG TTCAGAGTGC GAAGCTGTCT GGGCGGCGTT
 151 TTTATTTACG GAGCAAACAT GAAACTTATC TATACCGTCA TCAAAATCAT
 201 TATCCTGCTG CTCTTCCTGC TGCTTGCCGT CATTAATACG GATGCCGTTA
 251 CCTTTTCCTA CCTGCCGGGG CAAAAATTCG ATTTGCCGCT GATTGTCGTA
 301 TTGTTCGGCG CATTTGTAGT CGGTATTATT TTTGGAATGT TTGCCTTGTT
 351 CGGACGGTTG TTGTCGTTAC GTGGCGAGAA CGGCAGGTTG CGTGCCGAAG
 401 TAAAGAAAAA TGCGCGTTTG ACGGGGAAGG AGCTGACCGC ACCACCGGCG
 451 CAAAATGCGC CGAATCTAC  CAAACAGCCT TAA
```

This corresponds to the amino acid sequence <SEQ ID 1752; ORF 577>:

```
m577.pep..
   1 MERNGVFGKI VGNRILRMSS EHAAASYPKP CKSFKLAQSW FRVRSCLGGV
  51 FIYGANMKLI YTVIKIIILL LFLLLAVINT DAVTFSYLPG QKFDLPLIVV
 101 LFGAFVVGII FGMFALFGRL LSLRGENGRL RAEVKKNARL TGKELTAPPA
 151 QNAPESTKQP *
```

Computer analysis of this amino acid sequence gave the following results:
Homology with a Predicted ORF from N. gonorrhoeae

```
    m577/g577   88.1% identity in 160 aa overlap 10         20         30         40         50         60
       m577.pep  MERNGVFGKIVGNRILRMSSEHAAASYPKPCKSFKLAQSWFRVRSCLGGVFIYGANMKLI
                 |||:||||||||||||| |||||||||||||||:|||||||||| |||||||||||||
       g577      MERSGVFGKIVGNRILRMPSEHAAAFYPKPCKSFKLTQSWFRVRSCPCGVFIYGANMKLI
                       10         20         30         40         50         60

70         80         90        100        110        120
       m577.pep  YTVIKIIILLLFLLLAVINTDAVTFSYLPGQKFDLPLIVVLFGAFVVGIIGFMFALFGRL
                 ||||||||||||||||||| ||||| |||||: :|||||||||||||||:||||||||||
       g577      YTVIKIIILLLFLLLAVINMDAVTFSYLPGQSVNLPLIVVLFGAFVVGIVFGMFALFGRL
                       70         80         90        100        110        120

130        140        150        160
       m577.pep  LSLRGENGRLRAEVKKNARLTGKELTAPPAQNAPESTKQPX
                 ||||||:|||||||:|||:|::|||| ||| ||:||||
       g577      LSLRGENSRLRAEVKKSARLSGQKLTAPPIQNAAESAKQPX
                      130        140        150        160
```

The following partial DNA sequence was identified in N. meningitidis <SEQ ID 1753>:

```
a577.seq
   1 ATGGAAAGGA ACGGTGTATT TGGTAAAATT GTCGGCAATC GCATACTCCG

51 TATGTCGTCC GAACACGCTG CCGCATCCTA TCCGAAACCG TGCAAATCGT

101 TTAAACTAGC GCAATCTTGG TTCAGAGTGC GAAGCTGTCC GGGCGGCGTT

151 TTTATTTACG GAGCAAACAT GAAACTTATC TATACCGTCA TCAAAATCAT

201 TATCCTGCTG CTCTTCCTGC TGCTTGCTGT CATTAATACG GATGCCGTTA

251 CCTTTTCCTA CCTGCCGGGG CAAAAATTCG ATTTGCCGCT GATTGTCGTA

301 TTGTTCGGCG CGTTTGTCGT CGGCATCGTG TTCGGAATGT TTGCCTTGTT

351 CGGACGGTTG TTGTCGTTAC GTGGCGAGAA CGGCAGGTTG CGTGCCGAAG

401 TAAAGAAAAA TGCGCGTTTG ACGGGGAAGG AGCTGACCGC ACCACCGGCG

451 CAAAATGCGC CGAATCTGC CAAACAGCCT TGA
```

This corresponds to the amino acid sequence <SEQ ID 1754; ORF 577.a>:

```
    a577.pep

1   MERNGVFGKI VGNRILRMSS EHAAASYPKP CKSFKLAQSW FRVRSCPGGV

51   FIYGANMKLI YTVIKIIILL LFLLLAVINT DAVTFSYLPG QKFDLPLIVV

101   LFGAFVVGIV FGMFALFGRL LSLRGENGRL RAEVKKNARL TGKELTAPPA

151   QNAPESAKQP * m577/a577  98.1% identity in 160 aa overlap 10         20         30         40         50         60
       m577.pep  MERNGVFGKIVGNRILRMSSEHAAASYPKPCKSFKLAQSWFRVRSCLGGVFIYGANMKLI
                 |||||||||||||||||||||||||||||||||||||||||||||| ||||||||||||
       a577      MERNGVFGKIVGNRILRMSSEHAAASYPKPCKSFKLAQSWFRVRSCPGGVFIYGANMKLI
                       10         20         30         40         50         60

70         80         90        100        110        120
       m577.pep  YTVIKIIILLLFLLLAVINTDAVTFSYLPGQKFDLPLIVVLFGAFVVGIIGFMFALFGRL
                 ||||||||||||||||||||||||||||||||||||||||||||||||:||||||||||
       a577      YTVIKIIILLLFLLLAVINTDAVTFSYLPGQKFDLPLIVVLFGAFVVGIVFGMFALFGRL
                       70         80         90        100        110        120
```

```
                       130        140        150        160
m577.pep   LSLRGENGRLRAEVKKNARLTGKELTAPPAQNAPESTKQPX
           |||||||||||||||||||||||||||||||||||||:|||
a577       LSLRGENGRLRAEVKKNARLTGKELTAPPAQNAPESAKQPX
                       130        140        150        160
```

The following partial DNA sequence was identified in *N. gonorrhoeae* <SEQ ID 1755>:

```
g578.seq..
   1 atgggaaagc tcgacatcgg gatattgttt gccgatttct tcaaagattt 51 cgcgccacag ttcggtggtt tccaaaacgt tggctttgcc tacggagcag 101 acttttttgc tgcgttttg ggcggattgg aaggccacgt gggcgatgcg 151 gcggatttcg ctttcgctgt atttcatggt gttgtagcct tcgtgttcgc 201 cgttttccaa aacacggatg ccgcgcggtt cgccgaaata aatatcgccg 251 gtaagttcgc gcacaatcaa aatatccaaa ccggcaacga tttcaggctt 301 gagcgtggag gcgttggcta a
```

This corresponds to the amino acid sequence <SEQ ID 1756; ORF 578.ng>:

```
g578.pep
   1 MGKLDIGILF ADFFKDFAPQ FGGFQNVGFA YGADFFAAFL GGLEGHVGDA

51 ADFAFAVFHG VVAFVFAVFQ NTDAARFAEI NIAGKFAHNQ NIQTGNDFRL

101 ERGGVG*
```

The following partial DNA sequence was identified in *N. meningitidis* <SEQ ID 1757>:

```
m578.seq..
   1 ATGGGAAAGC TCGACATCAG GGTACTCTTT GCCGATTTCT TCAAAGATTT

51 CGCGCCACAA TTCGGTGGTT TCCAAAACGT TGGCTTTGCC TACGGAACAG

101 ACTTTTTTGC TGCGTTTTTG GGCGGATTGG AAGGCAACAT GGGCAATACG

151 GCGGATTTCG CTTTCGCTGT ATTTCATGGT GTTGTAGCCT TCGCGTTCGC

201 CGTTTTCCAG AACGCGGATG CCGCGCGGTT CGCCGAAATA GATGTCGCCG

251 GTGAGTTCGC GCACAATCAA AATATCCAAA CCGGCAACGA TTTCAGGCTT
```

This corresponds to the amino acid sequence <SEQ ID 1758; ORF 578>:

```
m578.pep..
      1   MGKLDIRVLF ADFFKDFAPQ FGGFQNVGFA YGTDFFAAFL GGLEGNMGNT

51   ADFAFAVFHG VVAFAFAVFQ NADAARFAEI DVAGEFAHNQ NIQTGNDFRL

101   QRGGVG* m578/g578    87.7% identity in 106 aa overlap 10         20         30         40         50         60
m578.pep    MGKLDIRVLFADFFKDFAPQFGGFQNVGFAYGTDFFAAFLGGLEGNMGNTADFAFAVFHG
            ||||| :||||||||||||||||||||||||||:||||||||||||::|::|||||||||
g578        MGKLDIGILFADFFKDFAPQFGGFQNVGFAYGADFFAAFLGGLEGHVGDAADFAFAVFHG
                     10         20         30         40         50         60
```

```
             70         80         90        100
m578.pep   VVAFAFAVFQNADAARFAEIDVAGEFAHNQNIQTGNDFRLQRGGVGX
           ||||:||||||:||||||||::||:|||||||||||||||:||||||
g578       VVAFVFAVFQNTDAARFAEINIAGKFAHNQNIQTGNDFRLERGGVGX
             70         80         90        100
```

The following partial DNA sequence was identified in *N. meningitidis* <SEQ ID 1759>:

```
a578.seq
  1 ATGGGAAAGC TCGACATCAG GGTATTCTTT GCCGATTTCT TCAAAGATTT

51 CGCGCCACAA TTCGGTGGTT TCCAAAACGT TGGCTTTGCC TACGGAGCAG

101 ACTTTTTTGC TGCGTTTTTG GGCGGATTGG AAGGCGACGT GGGCAATACG

151 GCGGATTTCG CTTTCGCTGT ATTTCATGGT GTTGTAGCCT TCGCGTTCGC

201 CGTTTTCCAG AACACGGATG CCGCGCGGTT CGCCGAAATA AATATCGCCG

251 GTGAGTTCGC GCACAATCAA AATATCCAAA CCCGCAACGA TTTCAGACTT

301 GAGCGTGGAG GCGTTGGCTA G
```

This corresponds to the amino acid sequence <SEQ ID 1760; ORF 578.a>:

```
a578.pep

1   MGKLDIRVFF ADFFKDFAPQ FGGFQNVGFA YGADFFAAFL GGLEGDVGNT

51   ADFAFAVFHG VVAFAFAVFQ NTDAARFAEI NIAGEFAHNQ NIQTRNDFRL

101   ERGGVG* m578/a578   91.5% identity in 106 aa overlap 10         20         30         40         50         60
m578.pep   MGKLDIRVLFADFFKDFAPQFGGFQNVGFAYGTDFFAAFLGGLEGNMGNTADFAFAVFHG
           ||||||||:||||||||||||||||||||||:||||||||||||||::||||||||||||
a578       MGKLDIRVFFADFFKDFAPQFGGFQNVGFAYGADGGAAFLGGLEGDVGNTADFAFAVFHG
             10         20         30         40         50         60
             70         80         90        100
m578.pep   VVAFAFAVFQNADAARFAEIDVAGEFAHNQNIQTGNDFRLQRGGVGX
           ||||||||||:||||||||::|||||||||||| |||||:||||||
a578       VVAFAFAVFQNTDAARFAEINIAGEFAHNQNIQTRNDFRLERGGVGX
             70         80         90        100
```

The following partial DNA sequence was identified in *N. gonorrhoeae* <SEQ ID 1761>:

```
g579.seq..
  1 ATGAGGGCGG CGATGACGCG CGCGCAGGTC GATGCCACGC TGATTAGTTT

51 TTTGTGTAAT GTTGCCAATA TCGGCTTATT GATTTTGGTG ATTATTGCCG

101 CATTGGGACG GTTGGGCGTT TCCACAACAT CCGTAACCGC CTTAATCGGC

151 GGCGCGGGTT TGGCGGTGGC GTTGTCCTTA AAAGACCAGC TGTCCAATTT

201 TGCCGCCGGC GCGCTGATTA TCCTGTTCCG CCCGTTCAAA GTCGGCGACT

251 TTATCCGTGT CGGCGGTTTT GAAGGATATG TCCGGGAAAT CAAAATGGTG

301 CAGACTTCTT TGCGGACGAC CGACAACGAA GAAGTCGTGC TGCCCAACAG

351 CGTGGTGATG GGCAACAGCA TCGTCAACCG TTCCAGCCTG CCGCTTTGCC

401 GCGCCCAAGT GATAGTCGGC GTCGATTACA ACTGCGATTT GAAAGTGGCG

451 AAAGAGGCGG TGTTGAAAGC CGCCGCCGAA CACCCCTTGA GCGTTCAAAA
```

```
501 CGAAGAGCGG CAGCCCGCCG CCTACATCAC CGCCTTGGGC GACAATGCCA

551 TCGAAATCAC ATTATGGGCT TGGGCAAACG AAGCAGACCG CTGGACGCTG

601 CAATGCGACT TGAACGAACA AGTGGTCGAA AACCTCCGCA AAGTCAATAT

651 CAACATCCCG TTCCCGCAAC GCGACATACA CATCATCAAT TCTTAA
```

This corresponds to the amino acid sequence <SEQ ID 1762; ORF 579.ng>:

```
g579.pep..
  1 MRAAMTRAQV DATLISFLCN VANIGLLILV IIAALGRLGV STTSVTALIG

51 GAGLAVALSL KDQLSNFAAG ALIILFRPFK VGDFIRVGGF EGYVREIKMV

101 QTSLRTTDNE EVVLPNSVVM GNSIVNRSSL PLCRAQVIVG VDYNCDLKVA

151 KEAVLKAAAE HPLSVQNEER QPAAYITALG DNAIEITLWA WANEADRWTL

201 QCDLNEQVVE NLRKVNINIP FPQRDIHIIN S*
```

The following partial DNA sequence was identified in *N. meningitidis* <SEQ ID 1763>:

```
m579.seq..
  1 ATGAGGGCGG CGATGACGCG CGCGCAGGTC GATGCCACGC TGATTAGTTT

51 TTTGTGTAAT GTTGCCAATA TCGGCTTATT GATTTTGGTG ATTATTGCCG

101 CATTGGGCAG ATTGGGCGTT TCCACAACAT CCGTAACCGC CTTAATCGGC

151 GGCGCGGGTT TGGCGGTGGC GTTGTCCCTG AAAGACCAGC TGTCCAATTT

201 TGCCGCCGGC GCACTGATTA TCCTGTTCCG CCCGTTCAAA GTCGGCGATT

251 TTATCCGCGT CGGCGGTTTT GAAGGATATG TCCGAGAGAT TAAAATGGTG

301 CAGACTTCTT TGCGGACGAC CGACAACGAA GAAGTCGTGC TGCCCAACAG

351 CGTGGTGATG GGCAACAGCA TCGTCAACCG TTCCACACTG CCGCTGTGCC

401 GCGCCCAAGT GATAGTCGGC GTCGATTACA ACTGCGATTT GAAAGTGGCG

451 AAAGAGGCGG TGTTGAAAGC CGCCGTCGAA CACCCCTTGA GCGTTCAAAA

501 CGAAGAGCGG CAGGCTGCCG CCTACATCAC CGCCTTGGGC GACAATGCCA

551 TCGAAATCAC ATTATGGGCT TGGGCAAACG AAGCAGACCG CTGGACGCTG

601 CAATGCGACT TGAACGAACA AGTGGTCGAA AACCTCCGCA AAGTCAATAT

651 CAACATCCCG TTCCCGCAAC GCGACATACA CATCATCAAT TCTTAA
```

This corresponds to the amino acid sequence <SEQ ID 1764; ORF 579>:

```
m579.pep..
  1 MRAAMTRAQV DATLISFLCN VANIGLLILV IIAALGRLGV STTSVTALIG

51 GAGLAVALSL KDQLSNFAAG ALIILFRPFK VGDFIRVGGF EGYVREIKMV

101 QTSLRTTDNE EVVLPNSVVM GNSIVNRSTL PLCRAQVIVG VDYNCDLKVA

151 KEAVLKAAVE HPLSVQNEER QAAYITALG DNAIEITLWA WANEADRWTL

201 QCDLNEQVVE NLRKVNINIP FPQRDIHIIN S*
```

Computer analysis of this amino acid sequence gave the following results:

Homology with a Predicted ORF from *N. gonorrhoeae*

```
    m579/g576    98.7% identity in 231 aa overlap 10         20         30         40         50         60
       m579.pep    MRAAMTRAQVDATLISFLCNVANIGLLILVIIAALGRLGVSTTSVTALIGGAGLAVALSL
                   ||||||||||||||||||||||||||||||||||||||||||||||||||||||||||||
       g579        MRAAMTRAQVDATLISFLCNVANIGLLILVIIAALGRLGVSTTSVTALIGGAGLAVALSL
                       10         20         30         40         50         60

70         80         90        100        110        120
       m579.pep    KDQLSNFAAGALIILFRPFKVGDFIRVGGFEGYVREIKMVQTSLRTTDNEEVVLPNSVVM
                   ||||||||||||||||||||||||||||||||||||||||||||||||||||||||||||
       g579        KDQLSNFAAGALIILFRPFKVGDFIRVGGFEGYVREIMKVQTSLRTTDNEEVVLPNSVVM
                       70         80         90        100        110        120

130        140        150        160        170        180
       m579.pep    GNSIVNRSTLPLCRAQVIVGVDYNCDLKVAKEAVLKAAVEHPLSVQNEERQAAAYITALG
                   ||||||||:|||||||||||||||||||||||||||||||:|||||||||||| ||||||
       g579        GNSIVNRSSLPLCRAQVIVGVDYNCDLKVAKEAVLKAAAEHPLSVQNEERQPAAYITALG
                      130        140        150        160        170        180

190        200        210        220        230
       m579.pep    DNAIEITLWAWANEADRWTLQCDLNEQVVENLRKVNINIPFPQRDIHIINSX
                   ||||||||||||||||||||||||||||||||||||||||||||||||||||
       g579        DNAIEITLWAWANEADRWTLQCDLNEQVVENLRKVNINIPFPQRDIHIINSX
                      190        200        210        220        230
```

The following partial DNA sequence was identified in *N. meningitidis* <SEQ ID 1765>:

```
a579.seq
   1 ATGAGGGCGG CGATGACGCG CGCGCAGGTC GATGCCACGC TGATTAGTTT
  51 TTTGTGTAAT GTTGCCAATA TCGGCTTATT GATTTTGGTG ATTATTGCCG
 101 CATTGGGCAG ATTGGGCGTT TCCACAACAT CCGTAACCGC CTTAATCGGC
 151 GGCGCGGGTT TGGCGGTGGC GTTGTCCTTG AAAGACCAGC TGTCCAATTT
 201 TGCCGCCGGC GCGCTGATTA TCCTGTTCCG CCCGTTCAAA GTCGGCGATT
 251 TTATCCGCGT CGGCGGTTTT GAAGGATATG TCCGAGAGAT TAAAATGGTG
 301 CAGACTTCTT TGCGGACGAC CGACAACGAA GAAGTCGTGC TGCCCAACAG
 351 CGTGGTGATG GGCAACAGCA TCGTCAACCG TTCCACACTG CCGCTGTGCC
 401 GCGCCCAAGT GATAGTCGGC GTCGATTACA ACTGCGATTT GAAAGTGGCG
 451 AAAGAGGCGG TGTTGAAAGC CGCCGTCGAA CACCCCTTGA GCGTTCAAAA
 501 CGAAGAGCGG CAGGCCGCCG CCTACATCAC CGCCTTGGGC GACAATGCCA
 551 TCGAAATCAC ATTATGGGCT TGGGCAAACG AAGCAGACCG CTGGACGCTG
 601 CAATGCGACT TGAACGAACA AGTGGTCGAA AACCTCCGCA AAGTCAATAT
 651 CAACATCCCG TTCCCGCAAC GCGACATACA CATCATCAAT TCTTAA
```

This corresponds to the amino acid sequence <SEQ ID 1766; ORF 579.a>:

```
a579.pep

1    MRAAMTRAQV DATLISFLCN VANIGLLILV IIAALGRLGV STTSVTALIG

51    GAGLAVALSL KDQLSNFAAQ ALIILFRPKF VGDFIRVGGF EGYVREIKMV

101    QTSLRTTDNE EVVLPNSVVM GNSIVNRSTL PLCRAQVIVG VDYNCDLKVA

151    KEAVLKAAVE HPLSVQNEER QAAAYITALG DNAIEITLWA WANEADRWTL

201    QCDLNEQVVE NLRKVNINIP FPQRDIHIIN S*
```

-continued m579/a579 100.0% identity in 231 aa overlap

```
                  10        20        30        40        50        60
m579.pep   MRAAMTRAQVDATLISFLCNVANIGLLILVIIAALGRLGVSTTSVTALIGGAGLAVALSL
           ||||||||||||||||||||||||||||||||||||||||||||||||||||||||||||
a579       MRAAMTRAQVDATLISFLCNVANIGLLILVIIAALGRLGVSTTSVTALIGGAGLAVALSL
                  10        20        30        40        50        60

70        80        90       100       110       120
m579.pep   KDQLSNFAAGALIILFRPFKVGDFIRVGGFEGYVREIKMVQTSLRTTDNEEVVLPNSVVM
           ||||||||||||||||||||||||||||||||||||||||||||||||||||||||||||
a579       KDQLSNFAAGALIILFRPFKVGDFIRVGGFEGYVREIKMVQTSLRTTDNEEVVLPNSVVM
                  70        80        90       100       110       120

130       140       150       160       170       180
m579.pep   GNSIVNRSTLPLCRAQVIVGVDYNCDLKVAKEAVLKAAVEHPLSVQNEERQAAAYITALG
           ||||||||||||||||||||||||||||||||||||||||||||||||||||||||||||
a579       GNSIVNRSTLPLCRAQVIVGVDYNCDLKVAKEAVLKAAVEHPLSVQNEERQAAAYITALG
                 130       140       150       160       170       180

190       200       210       220       230
m579.pep   DNAIEITLWAWANEADRWTLQCDLNEQVVENLRKVNINIPFPQRDIHIINSX
           ||||||||||||||||||||||||||||||||||||||||||||||||||||
a579       DNAIEITLWAWANEADRWTLQCDLNEQVVENLRKVNINIPFPQRDIHIINSX
                 190       200       210       220       230
```

The following partial DNA sequence was identified in *N. gonorrhoeae* <SEQ ID 1767>:

```
g579-1.seq
   1 ATGGACTTCA AACAATTTGA TTTTTTACAC CTGATCAGTG TTTCCGGTTG

51 GGGGCATCTG GCTGAAAAGG CGTGGGCGTT CGGGCTGAAC CTTGCCGCCG

101 CGCTGCTTAT TTTCTTGGTC GGGAAATGGG CGGCGAAACG CATTGTCGCC

151 GTAATGAGGG CGGCGATGAC GCGCGCGCAG GTCGATGCCA CGCTGATTAG

201 TTTTTTGTGT AATGTTGCCA ATATCGGCTT ATTGATTTTG GTGATTATTG

251 CCGCATTGGG ACGGTTGGGC GTTTCCACAA CATCCGTAAC CGCCTTAATC

301 GGCGGCGCGG GTTTGGCGGT GGCGTTGTCC TTAAAAGACC AGCTGTCCAA

351 TTTTGCCGCC GGCGCGCTGA TTATCCTGTT CCGCCCGTTC AAAGTCGGCG

401 ACTTTATCCG TGTCGGCGGT TTTGAAGGAT ATGTCCGGGA AATCAAAATG

451 GTGCAGACTT CTTTGCGGAC GACCGACAAC GAAGAAGTCG TGCTGCCCAA

501 CAGCGTGGTG ATGGGCAACA GCATCGTCAA CCGTTCCAGC CTGCCGCTTT

551 GCCGCGCCCA AGTGATAGTC GGCGTCGATT ACAACTGCGA TTTGAAAGTG

601 GCGAAAGAGG CGGTGTTGAA AGCCGCCGCC GAACACCCCT TGAGCGTTCA

651 AAACGAAGAG CGGCAGCCCG CCGCCTACAT CACCGCCTTG GGCGACAATG

701 CCATCGAAAT CACATTATGG GCTTGGGCAA ACGAAGCAGA CCGCTGGACG

751 CTGCAATGCG ACTTGAACGA ACAAGTGGTC GAAAACCTCC GCAAAGTCAA

801 TATCAACATC CCGTTCCCGC AACGCGACAT ACACATCATC AATTCTTAA
```

This corresponds to the amino acid sequence <SEQ ID 1768; ORF 008.ng>:

```
g579-1.pep
   1 MDFKQFDFLH LISVSGWGHL AEKAWAFGLN LAAALLIFLV GKWAAKRIVA

51 VMRAAMTRAQ VDATLISFLC NVANIGLLIL VIIAALGRLG VSTTSVTALI

101 GGAGLAVALS LKDQLSNFAA GALIILFRPF KVGDFIRVGG FEGYVREIKM

151 VQTSLRTTDN EEVVLPNSVV MGNSIVNRSS LPLCRAQVIV GVDYNCDLKV
```

```
201 AKEAVLKAAA EHPLSVQNEE RQPAAYITAL GDNAIEITLW AWANEADRWT

251 LQCDLNEQVV ENLRKVNINI PFPQRDIHII NS*
```

The following partial DNA sequence was identified in *N. meningitidis* <SEQ ID 1769>:

```
m579-1.seq
  1 ATGGACTTCA AACAATTTGA TTTTTTACAC CTGATCAGTG TTTCCGGTTG

51 GGAGCATCTG GCTGAAAAGG CGTGGGCGTT CGGGCTGAAC CTTGCCGCCG

101 CGCTGCTTAT TTTTTTGGTC GGAAAATGGG CGGCGAAACG CATTGTCGCT

151 GTGATGAGGG CGGCGATGAC GCGCGCGCAG GTCGATGCCA CGCTGATTAG

201 TTTTTTGTGT AATGTTGCCA ATATCGGCTT ATTGATTTTG GTGATTATTG

251 CCGCATTGGG CAGATTGGGC GTTTCCACAA CATCCGTAAC CGCCTTAATC

301 GGCGGCGCGG GTTTGGCGGT GGCGTTGTCC CTGAAAGACC AGCTGTCCAA

351 TTTTGCCGCC GGCGCACTGA TTATCCTGTT CCGCCCGTTC AAAGTCGGCG

401 ATTTTATCCG CGTCGGCGGT TTTGAAGGAT ATGTCCGAGA GATTAAAATG

451 GTGCAGACTT CTTTGCGGAC GACCGACAAC GAAGAAGTCG TGCTGCCCAA

501 CAGCGTGGTG ATGGGCAACA GCATCGTCAA CCGTTCCACA CTGCCGCTGT

551 GCCGCGCCCA AGTGATAGTC GGCGTCGATT ACAACTGCGA TTTGAAAGTG

601 GCGAAAGAGG CGGTGTTGAA AGCCGCCGTC GAACACCCCT TGAGCGTTCA

651 AAACGAAGAG CGGCAGGCTG CCGCCTACAT CACCGCCTTG GGCGACAATG

701 CCATCGAAAT CACATTATGG GCTTGGGCAA ACGAAGCAGA CCGCTGGACG

751 CTGCAATGCG ACTTGAACGA ACAAGTGGTC GAAAACCTCC GCAAAGTCAA

801 TATCAACATC CCGTTCCCGC AACGCGACAT ACACATCATC AATTCTTAA
```

This corresponds to the amino acid sequence <SEQ ID 1770; ORF 579-1>:

```
a579-1.pep

1   MDFKQFDFLH LISVSGWEHL AEKAWAFGLN LAAALLIFLV GKWAAKRIVA

51   VMRAAMTRAQ VDATLISFLC NVANIGLLIL VIIAALGRLG VSTTSVTALI

101   GGAGLAVALS LKDQLSNFAA GALIILFRPF KVGDFIRVGG FEGYVREIKM

151   VQTSLRTTDN EEVVLPNSVV MGNSIVNRST LPLCRAQVIV GVDYNCDLKV

201   AKEAVLKAAV EHPLSVQNEE RQAAAYITAL GDNAIEITLW AWANEADRWT

251   LQCDLNEQVV ENLRKVNINI PFPQRDIHII NS* m579-1/g579-1  98.6% identity in 282 aa overlap 10         20         30         40         50         60
       m579-1.pep  MDFKQFDFLHLISVSGWEHLAEKAWAFGLNLAAALLIFLVGKWAAKRIVAVMRAAMTRAQ
                   |||||||||||||||||||| |||||||||||||||||||||||||||||||||||||||
       g579-1     MDFKQFDFLHLISVSGWGHLAEKAWAFGLNLAAALLIFLVGKWAAKRIVAVMRAAMTRAQ
                       10         20         30         40         50         60

70         80         90        100        110        120
       m579-1.pep  VDATLISFLCNVANIGLLILVIIAALGRLGVSTTSVTALIGGAGLAVALSLKDQLSNFAA
                   ||||||||||||||||||||||||||||||||||||||||||||||||||||||||||||
       g579-1     VDATLISFLCNVANIGLLILVIIAALGRLGVSTTSVTALIGGAGLAVALSLKDQLSNFAA
                       70         80         90        100        110        120

130        140        150        160        170        180
       m579-1.pep  GALIILFRPFKVGDFIRVGGFEGYVREIKMVQTSLRTTDNEEVVLPNSVVMGNSIVNRST
                   |||||||||||||||||||||||||||||||||||||||||||||||||||||||||||:
       g579-1     GALIILFRPFKVGDFIRVGGFEGYVREIKMVQTSLRTTDNEEVVLPNSVVMGNSIVNRSS
                      130        140        150        160        170        180
```

-continued

```
                   190       200       210       220       230       240
m579-1.pep    LPLCRAQVIVGVDYNCDLKVAKEAVLKAAVEHPLSVQNEERQAAAYITALGDNAIEITLW
              |||||||||||||||||||||||||||||:|||||||||||| |||||||||||||||||
g579-1        LPLCRAQVIVGVDYNCDLKVAKEAVLKAAAEHPLSVQNEERQPAAYITALGDNAIEITLW
                   190       200       210       220       230       240

250       260       270       280
m579-1.pep    AWANEADRWTLQCDLNEQVVENLRKVNINIPFPQRDIHIINSX
              ||||||||||||||||||||||||||||||||||||||||||
g579-1        AWANEADRWTLQCDLNEQVVENLRKVNINIPFPQRDIHIINSX
                    250       260       270       280
```

The following partial DNA sequence was identified in *N. meningitidis* <SEQ ID 1771>:

```
a579-1.seq
  1 ATGGACTTCA AACAATTTGA TTTTTTACAC CTGATAAGTG CTTCCGGCTG

51 GGAGCATCTG GCTGAAAAGG CGTGGGCGTT CGGGCTGAAC CTTGCCGCCG

101 CGCTGCTTAT TTTTTTGGTC GGAAAATGGG CGGCGAAACG CATTGTCGCC

151 GTGATGAGGG CGGCGATGAC GCGCGCGCAG GTCGATGCCA CGCTGATTAG

201 TTTTTTGTGT AATGTTGCCA ATATCGGCTT ATTGATTTTG GTGATTATTG

251 CCGCATTGGG CAGATTGGGC GTTTCCACAA CATCCGTAAC CGCCTTAATC

301 GGCGGCGCGG GTTTGGCGGT GGCGTTGTCC TTGAAAGACC AGCTGTCCAA

351 TTTTGCCGCC GGCGCGCTGA TTATCCTGTT CCGCCCGTTC AAAGTCGGCG

401 ATTTTATCCG CGTCGGCGGT TTTGAAGGAT ATGTCCGAGA GATTAAAATG

451 GTGCAGACTT CTTTGCGGAC GACCGACAAC GAAGAAGTCG TGCTGCCCAA

501 CAGCGTGGTG ATGGGCAACA GCATCGTCAA CCGTTCCACA CTGCCGCTGT

551 GCCGCGCCCA AGTGATAGTC GGCGTCGATT ACAACTGCGA TTTGAAAGTG

601 GCGAAAGAGG CGGTGTTGAA AGCCGCCGTC GAACACCCCT TGAGCGTTCA

651 AAACGAAGAG CGGCAGGCCG CCGCCTACAT CACCGCCTTG GGCGACAATG

701 CCATCGAAAT CACATTATGG GCTTGGGCAA ACGAAGCAGA CCGCTGGACG

751 CTGCAATGCG ACTTGAACGA ACAAGTGGTC GAAAACCTCC GCAAAGTCAA

801 TATCAACATC CCGTTCCCGC AACGCGACAT ACACATCATC AATTCTTAA
```

This corresponds to the amino acid sequence <SEQ ID 1772; ORF 579-1.a>:

```
a579-1.pep

1 MDFKQFDFLH LISASGWEHL AEKAWAFGLN LAAALLIFLV GKWAAKRIVA

51 VMRAAMTRAQ VDATLISFLC NVANIGLLIL VIIAALGRLG VSTTSVTALI

101 GGAGLAVALS LKDQLSNFAA GALIILFRPF KVGDFIRVGG FEGYVREIKM

151 VQTSLRTTDN EEVVLPNSVV MGNSIVNRST LPLCRAQVIV GVDYNCDLKV

201 AKEAVLKAAV EHPLSVQNEE RQAAAYITAL GDNAIEITLW AWANEADRWT

251 LQCDLNEQVV ENLRKVNINI PFPQRDIHII NS*
```

(In the printed a579-1.pep sequence, residues "AWAFGLN LAAALLIFLV", "IGLLIL VIIAALGRLG" and "SVTALI GGAGLAVALS L" are underlined.)

```
a579-1/m579-1 99.6% identity in 282 aa overlap 10        20        30        40        50        60
a579-1.pep MDFKQFDFLHLISASGWEHLAEKAWAFGLNLAAALLIFLVGKWAAKRIVAVMRAAMTRAQ
           |||||||||||||:||||||||||||||||||||||||||||||||||||||||||||||
m579-1     MDFKQFDFLHLISVSGWEHLAEKAWAFGLNLAAALLIFLVGKWAAKRIVAVMRAAMTRAQ
                        10        20        30        40        50        60
```

-continued

```
                      70         80         90        100        110        120
   a579-1.pep VDATLISFLCNVANIGLLILVIIAALGRLGVSTTSVTALIGGAGLAVALSLKDQLSNFAA
              ||||||||||||||||||||||||||||||||||||||||||||||||||||||||||||
   m579-1     VDATLISFLCNVANIGLLILVIIAALGRLGVSTTSVTALIGGAGLAVALSLKDQLSNFAA
                      70         80         90        100        110        120

130        140        150        160        170        180
   a579-1.pep GALIILFRPFKVGDFIRVGGFEGYVREIKMVQTSLRTTDNEEVVLPNSVVMGNSIVNRST
              ||||||||||||||||||||||||||||||||||||||||||||||||||||||||||||
   m579-1     GALIILFRPFKVGDFIRVGGFEGYVREIKMVQTSLRTTDNEEVVLPNSVVMGNSIVNRST
                     130        140        150        160        170        180

190        200        210        220        230        240
   a579-1.pep LPLCRAQVIVGVDYNCDLKVAKEAVLKAAVEHPLSVQNEERQAAAYITALGDNAIEITLW
              ||||||||||||||||||||||||||||||||||||||||||||||||||||||||||||
   m579-1     LPLCRAQVIVGVDYNCDLKVAKEAVLKAAVEHPLSVQNEERQAAAYITALGDNAIEITLW
                     190        200        210        220        230        240

250        260        270        280
   a579-1.pep AWANEADRWTLQCDLNEQVVENLRKVNINIPFPQRDIHIINSX
              ||||||||||||||||||||||||||||||||||||||||||
   m579-1     AWANEADRWTLQCDLNEQVVENLRKVNINIPFPQRDIHIINSX
                     250        260        270        280
```

The following partial DNA sequence was identified in *N. gonorrhoeae* <SEQ ID 1773>:

```
g580.seq
   1 atggattcgc caaggtcgg gtgcgggtgg atggttttgc cgatgtctgc 51 cgcgtcgcag cccatttcga tggcaaggca gacttcgccg atcatgtcgc 101 caccgttcgg accgacaatg ccgccgccga tgatgcggcc ggtttcggca 151 tcgaaaatca gcttggtaaa gccgttgtcg caaccgttgg caatcgcacg 201 accggaagcc gcccatggga agttggcttt ggtaattttg cggcctgatg 251 ctttggcaga caattcggtt tcaccgaccc atgccacttc ggggaagtg 301 tag
```

This corresponds to the amino acid sequence <SEQ ID 1774; ORF 580.ng>:

```
g580.pep..
   1 MDSPKVGCGW MVLPMSAASQ PISMARQTSP IMSPPFGPTM PPPMMRPVSA

51 SKISLVKPLS QPLAIARPEA AHGKLALVIL RPDALADNSV SPTHATSGEV

101 *
```

The following partial DNA sequence was identified in *N. meningitidis* <SEQ ID 1775>:

```
m580.seq..
   1 ATGGATTCGC CAAGGTCGG GTGCGGGTGG ATGGTTTTGC CGATGTCTGC

51 CGCGTCGCAG CCCATTTCGA TGGCAAGGCA GACTTCGCCG ATCATATCGC

101 CACCGTTCGG ACCGACAATG CCGCCGCCGA TGATGCGGCC GGTTTCGGCA

151 TCAAAAATCA GCTTGGTAAA GCCGTTGTCG CAACCGTTGG CAATCGCACG

201 GCCGGAAGCC GCCCACGGGA AGTTGGCTTT GGTGATTTTG CGGCCGGAGG

251 CTTTGGCGGA CAGTTCGGTT TCGCCCACCC ACGCCACTTC GGGGAAGTG

301 TAG
```

This corresponds to the amino acid sequence <SEQ ID 1776; ORF 580>:

```
m580.pep..

1  MDSPKVGCGW MVLPMSAASQ PISMARQTSP IISPPFGPTM PPPMMRPVSA

51  SKISLVKPLS QPLAIARPEA AHGKLALVIL RPEALADSSV SPTHATSGEV

101  * m580/g580   97.0% identity in 100 aa overlap 10         20         30         40         50         60
   m580.pep    MDSPKVGCGWMVLPMSAASQPISMARQTSPIISPPFGPTMPPPMMRPVSASKISLVKPLS
               ||||||||||||||||||||||||||||||:|||||||||||||||||||||||||||||
   g580        MDSPKVGCGWMVLPMSAASQPISMARQTSPIMSPPFGPTMPPPMMRPVSASKISLVKPLS
                   10         20         30         40         50         60

70         80         90        100
   m580.pep    QPLAIARPEAAHGKLALVILRPEALADSSVSPTHATSGEVX
               |||||||||||||||||||||||:||||:||||||||||||
   g580        QPLAIARPEAAHGKLALVILRPDALADNSVSPTHATSGEVX
                   70         80         90        100
```

The following partial DNA sequence was identified in *N. meningitidis* <SEQ ID 1777>:

```
a580.seq
   1  ATGGATTCGC CCAAGGTCGG GTGCGGGTGG ATGGTTTTGC CGATGTCTGC

51  CGCGTCGCAG CCCATTTCGA TGGCAAGGCA GACTTCGCCG ATCATGTCGC

101  CACCGTTCGG ACCGACAATG CCGCCGCCGA TGATGCGGCC GGTTTCAGCA

151  TCAAAAATCA GCTTGGTGAA ACCATTGTCG CAACCGTTGG CAATCGCACG

201  GCCGGAAGCA GCCCATGGGA AGTTGGCTTT GGTGATTTTG CGGCCGGAGG

251  CTTTGGCAGA CAATTCGGTT TCGCCCACCC ATGCCACTTC AGGAGAAGTG

301  TAA
```

This corresponds to the amino acid sequence <SEQ ID 1778; ORF 580.a>:

```
a580.pep

1  MDSPKVGCGW MVLPMSAASQ PISMARQTSP IMSPPFGPTM PPPMMRPVSA

51  SKISLVKPLS QPLAIARPEA AHGKLALVIL RPEALADNSV SPTHATSGEV

101  * m580/a580   98.0% identity in 100 aa overlap 10         20         30         40         50         60
   m580.pep    MDSPKVGCGWMVLPMSAASQPISMARQTSPIISPPFGPTMPPPMMRPVSASKISLVKPLS
               ||||||||||||||||||||||||||||||:|||||||||||||||||||||||||||||
   a580        MDSPKVGCGWMVLPMSAASQPISMARQTSPIMSPPFGPTMPPPMMRPVSASKISLVKPLS
                   10         20         30         40         50         60

70         80         90        100
   m580.pep    QPLAIARPEAAHGKLALVILRPEALADSSVSPTHATSGEVX
               ||||||||||||||||||||||||||||:||||||||||||
   a580        QPLAIARPEAAHGKLALVILRPEALADNSVSPTHATSGEVX
                   70         80         90        100
```

The following partial DNA sequence was identified in *N. gonorrhoeae* <SEQ ID 1779>:

```
g581.seq..
   1  atgcacttcg cccagcttgt gggtcaaacc ggtatagaac aaaatacgtt 51  ctgtcgtcgt ggttttaccc gcatcgatat gggcggaaat accgatgttg
```

-continued

```
101 cggtacaggc tgatcggggt cttacgagcc attttattag cctttcaaaa 151 ttagaaacgg aagtgagaga atgctttgtt ggcttcagcc atacggtgta 201 cttcttcacg tttttcaac gcaccgccac ggccttcgga cgcatcaatc 251 aactcgcctg ccaaacgcag atccatggat ttctcaccac gtttgcgggc 301 cgcgtcgcga acccaacgca ttgccaaagc cagacggcgt ga
```

This corresponds to the amino acid sequence <SEQ ID 1780; ORF 581.ng>:

```
g581.pep..
  1 MHFAQLVGQT GIEQNTFCRR GFTRIDMGGN TDVAVQADRG LTSHFISLSK

51 LETEVRECFV GFSHTVYFFT FFQRTATAFG RINQLACQTQ IHGFLTTFAG

101 RVANPTHCQS QTA*
```

The following partial DNA sequence was identified in N. meningitidis <SEQ ID 1781>:

```
m581.seq..
  1 ATGCACTTCG CCCAGCTTGT GGGTCAAACC GGTATAGAAC AAAATACGTT

51 CTGTCGTCGT GGTTTTACCC GCGTCAATAT GGGCGGAAAT ACCGATGTTA

101 CGGTACAGGC TGATCGGGGT CTTACGAGCC ATTTTATTAG CCTTTCAAAA

151 TTAGAAACGG AAGTGAGAGA ATGCTTTGTT GGCTTCAGCC ATACGGTGTA

201 CTTCTTCACG TTTTTTCAAC GCACCGCCAC GGCCTTCGGA CGCATCAATC

251 AATTCGCCTG CCAAACGCAG GTCCATGGAT TTCTCACCAC GTTTGCGGGC

301 CGCATCGCGA ACCCAGCGCA TTGCCAAAGC CAAACGGCGT GA
```

This corresponds to the amino acid sequence <SEQ ID 1782; ORF 581>:

```
m581.pep..
    1 MHFAQLVGQT GIEQNTFCRR GFTRVNMGGN TDVTVQADRG LTSHFISLSK

51 LETEVRECFV GFSHTVYFFT FFQRTATAFG RINQFACQTQ VHGFLTTFAG

101 RIANPAHCQS QTA* m581/g581    93.8% identity in 113 aa overlap 10        20        30        40        50        60
     m581.pep    MHFAQLVGQTGIEQNTFCRRGFTRVNMGGNTDVTVQADRGLTSHFISLSKLETEVRECFV
                 ||||||||||||||||||||||||||||::||||||:|||||||||||||||||||||||
     g581        MHFAQLVGQTGIEQNTFCRRGFTRIDMGGNTDVAVQADRGLTSHFISLSKLETEVRECFV
                       10        20        30        40        50        60

70        80        90       100       110
     m581.pep    GFSHTVYFFTFFQRTATAFGRINQFACQTQVHGFLTTFAGRIANPAHCQSQTAX
                 |||||||||||||||||||||||||:||||:||||||||||:|||:|||||||
     g581        GFSHTVYFFTFFQRTATAFGRINQLACQTQIHGFLTTFAGRVANPTHCQSQTAX
                       70        80        90       100       110
```

The following partial DNA sequence was identified in N. meningitidis <SEQ ID 1783>:

```
a581.seq
  1 ATGCACTTCG CCCAGCTTGT GGGTCAAACC GGTATAGAAC AAAATACGTT

51 CTGTCGTCGT GGTTTTACCC GCATCGATAT GGGCGGAAAT ACCGATGTTA
```

-continued
```
101 CGGTACAGGC TGATCGGGGT CTTACGAGCC ATTTTATTAG CCTTTCAAAA

151 TTAGAAACGG AAGTGAGAGA ATGCTTTGTT GGCTTCAGCC ATACGGTGTA

201 CTTCTTCACG TTTTTTCAAC GCACCGCCAC GGCCTTCGGA CGCATCAATC

251 AATTCGCCTG CCAAACGCAG GTCCATGGAT TTCTCACCAC GTTTGCGGGC

301 CGCATCGCGA ACCCAGCGCA TTGCCAAAGC CAAACGGCGT GA
```

This corresponds to the amino acid sequence <SEQ ID 1784; ORF 581.a>:

```
  a581.pep

1   MHFAQLVGQT GIEQNTFCRR GFTRIDMGGN TDVTVQADRG LTSHFISLSK

51   LETEVRECFV GFSHTVYFFT FFQRTATAFG RINQFACQTQ VHGFLTTFAG

101   RINPAHCQS QTA* m581/a581    98.2% identity in 113 aa overlap 10         20         30         40         50         60
  m581.pep    MHFAQLVGQTGIEQNTFCRRGFTRVNMGGNTDVTVQADRGLTSHFISLSKLETEVRECFV
              ||||||||||||||||||||||||::||||||||||||||||||||||||||||||||||
  a581        MHFAQLVGQTGIEQNTFCRRGFTRIDMGGNTDVTVQADRGLTSHFISLSKLETEVRECFV
                        10         20         30         40         50         60

70         80         90        100        110
  m581.pep    GFSHTVYFFTFFQRTATAFGRINQFACQTQVHGFLTTFAGRIANPAHCQSQTAX
              |||||||||||||||||||||||||||||||||||||||||||||||||||||
  a581        GFSHTVYFFTFFQRTATAFGRINQFACQTQVHGFLTTFAGRIANPAHCQSQTAX
                        70         80         90        100        110
```

The following partial DNA sequence was identified in *N. gonorrhoeae* <SEQ ID 1785>:

```
  g582.seq..
     1   atgcgctata ttcttttgac aggactgttg ccgacggcat ccgcttttgg 51   agagaccgcg ctgcaatgcg ccgctttgac ggacaatgtt acgcgtttgg 101   cgtgttacga caggattttt gcggcacagc ttccgtcttc ggcagggcag 151   gaagggcagg agtcgaaagc cgtactcaat ctgacggaaa ccgtccgcag 201   cagcttggat aagggcgagg cggtcattgt tgttgaaaaa ggcggggatg 251   cgcttcctgc cgacagtgcg ggcgaaaccg ccgatatcta tacgcctttg 301   agcctgatgt acgacttgga caaaaacgat ttgcgcgggc tgttgggcgt 351   acgcgaacac aatccgatgt accttatgcc gttttggtat aacaattcgc 401   ccaactatgc cccgagttcg ccgacgcgcg gtacgactgt acaggaaaaa 451   ttcggacagc agaaacgtgc ggaaaccaaa ttgcaggttt cgttcaaaag 501   caaaattgcc gaaaatttgt ttaaaacccg cgcggatctg tggttcggct 551   acacccaaag atccgattgg cagatttaca accaaggcag gaaatccgcg 601   ccgttccgca atacggatta caaacctgaa attttcctga cccagcctgt 651   gaaggcggat ttgccgttcg gcggcaggct gcgtatgctc ggtgcgggtt 701   ttgtccacca gtccaacgga cagagccgtc ccgaatcgcg ttcgtggaac 751   aggatttatg ccatggcagg catggaatgg ggcaaattga cggtgattcc 801   gcgcgtgtgg gtgcgtgcgt tcgatcagag cggcgataaa aacgacaatc 851   ccgatattgc cgactatatg gggtatggcg acgtgaagct gcagtaccgc 901   ctgaacgaca ggcagaatgt gtattccgta ttgcgctaca accccaaaac
```

```
-continued
 951 gggctacggc gcgattgaag ccgcctacac gtttccgatt aagggcaaac 1001 tcaaaggcgt ggtacgcgga ttccacggtt acggcgagag cctgatcgac 1051 tacaaccaca agcagaacgg tatcggtatc gggttgatgt tcaacgactg 1101 ggacggcatc tga
```

This corresponds to the amino acid sequence <SEQ ID 1786; ORF 582.ng>:

```
g582.pep ..
  1 MRYILLTGLL PTASAFGETA LQCAALTDNV TRLACYDRIF AAQLPSSAGQ

51 EGQESKAVLN LTETVRSSLD KGEAVIVVEK GGDALPADSA GETADIYTPL

101 SLMYDLDKND LRGLLGVREH NPMYLMPFWY NNSPNYAPSS PTRGTTVQEK

151 FGQQKRAETK LQVSFKSKIA ENLFKTRADL WFGYTQRSDW QIYNQGRKSA

201 PFRNTDYKPE IFLTQPVKAD LPFGGRLRML GAGFVHQSNG QSRPESRSWN

251 RIYAMAGMEW GKLTVIPRVW VRAFDQSGDK NDNPDIADYM GYGDVKLQYR

301 LNDRQNVYSV LRYNPKTGYG AIEAAYTFPI KGKLKGVVRG FHGYGESLID

351 YNHKQNGIGI GLMFNDWDGI *
```

The following partial DNA sequence was identified in *N. meningitidis* <SEQ ID 1787>:

```
m582.seq ..
    1 ATGCGCTATA TTCTTTTGAC AGGACTGTTG CCGATGGCAT CCGCTTTTGG

51 AGAGACCGCG CTGCAATGCG CCGCTTTGAC GGACAATGTT ACGCGTTTGG

101 CGTGTTACGA CAGGATTTTT GCGGCACAGC TTCCGTCTTC GGCAGGGCAG

151 GAAGGGCAGG AGTCGAAAGC CGTACTCAAT CTGACGGAAA CCGTCCGCAG

201 CAGCCTGGAT AAGGGCGAGG CGGTCATTGT TGTTGAAAAA GGCGGGGATG

251 CGCTTCCTGC CGACAGTGCG GGCGAAACCG CCGACATCTA TACGCCTTTG

301 AGCCTGATGT ACGACTTGGA CAAAAACGAT TTGCGCGGGC TGTTGGGCGT

351 ACGCGAACAC AATCCGATGT ACCTTATGCC GCTCTGGTAC AACAATTCGC

401 CCAACTATGC CCCGGGTTCG CCGACGCGCG GTACGACTGT ACAGGAAAAA

451 TTCGGACAGC AGAAACGTGC GGAAACCAAA TTGCAGGTTT CGTTCAAAAG

501 CAAAATTGCC GAAGATTTGT TTAAAACCCG CGCGGATCTG TGGTTCGGCT

551 ACACCCAAAG ATCCGATTGG CAGATTTACA ACCAAGGCAG GAAATCCGCG

601 CCGTTCCGCA ATACGGATTA CAAACCTGAA ATTTTCCTGA CCCAGCCTGT

651 GAAGGCGGAT TTGCCGTTCG GCGGCAGGCT GCGTATGCTC GGTGCGGGTT

701 TTGTCCACCA GTCCAACGGA CAGAGCCGTC CCGAATCGCG TTCGTGGAAC

751 AGGATTTACG CCATGGCAGG CATGGAATGG GGCAAATTGA CGGTGATTCC

801 GCGCGTGTGG GTGCGTGCGT TCGATCAGAG CGGCGATAAA AACGACAATC

851 CCGATATTGC CGACTATATG GGGTATGGCG ACGTGAAGCT GCAGTACCGC

901 CTGAACGACA GGCAGAATGT GTATTCCGTA TTGCGCTACA ACCCCAAAAC

951 GGGCTACGGC GCGATTGAAG CCGCCTACAC GTTTCCGATT AAGGGCAAAC

1001 TCAAAGGCGT GGTACGCGGA TTCCACGGTT ACGGCGAGAG CCTGATCGAC
```

```
1051 TACAACCACA AGCAGAACGG TATCGGTATC GGGTTGATGT TCAACGACTT

1101 GGACGGCATC TGA
```

This corresponds to the amino acid sequence <SEQ ID 1788; ORF 582>:

```
m582.pep

1   MRYILLTGLL PMASAFGETA LQCAALTDNV TRLACYDRIF AAQLPSSAGO

51   EGQESKAVLN LTETVRSSLD KGEAVIVVEK GGDALPADSA GETADIYTPL

101   SLMYDLDKND LRGLLGVREH NPMYLMPLWY NNSPNYAPGS PTRGTTVQEK

151   FGQQKRAETK LQVSFKSKIA EDLFKTRADL WFGYTQRSDW QIYNQGRKSA

201   PFRBTDTJOE UFKTQOVJAD KOFGGRKRNK GAGFVGQSBG QSROESRSWN

251   RIYANAGMEW GKLTVIPRVW VRAFDQSGDK NDNPDIADYM GYGDVKLQYR

301   LNDRQNVYSV LRYNPKTGYG AIEAAYTFPI KGKLKGVVRG FHGYGESLID

351   YNHKQNGIGI GLMFNDLDGI * m582/g582    98.6% identity in 370 aa overlap 10         20         30         40         50         60
     m582.pep   MRYILLTGLLPMASAFGETALQCAALTDNVTRLACYDRIFAAQLPSSAGQEGQESKAVLN
                ||||||||||| |||||||||||||||||||||||||||||||||| |||||||||||||
         g582   MRYILLTGLLPTASAFGETALQCAALTDNVTRLACYDRIFAAQLPSAAGQEGQESKAVLN
                    10         20         30         40         50         60

70         80         90        100        110        120
     m582.pep   LTETVRSSLDKGEAVIVVEKGGDALPADSAGETADIYTPLSLMYDLDKNDLRGLLGVREH
                ||||||||||||||||||||||||||||||||||||||||||||||||||||||||||||
         g582   LTETVRSSLDKGEAVIVVEKGGDALPADSAGETADIYTPLSLMYDLDKNDLRGLLGVREH
                    70         80         90        100        110        120

130        140        150        160        170        180
     m582.pep   NPMYLMPLWYNNSPNYAPGSPTRGTTVQEKFGQQKRAETKLQVSFKSKIAEDLFKTRADL
                ||||||| :||||||||||| :||||||||||||||||||||||||||||| :|||||||
         g582   NPMYLMPFWYNNSPNYAPSSPTRGTTVQEKFGQQKRAETKLQVSFKSKIAENLFKTRADL
                   130        140        150        160        170        180

190        200        210        220        230        240
     m582.pep   WFGYTQRSDWQIYNQGRKSAPFRNTDYKPEIFLTQPVKADLPFGGRLRMLGAGFVHQSNG
                ||||||||||||||||||||||||||||||||||||||||||||||||||||||||||||
         g582   WFGYTQRSDWQIYNQGRKSAPFRNTDYKPEIFLTQPVKADLPFGGRLRMLGAGFVHQSNG
                   190        200        210        220        230        240

250        260        270        280        290        300
     m582.pep   QSRPESRSWNRIYAMAGMEWGKLTVIPRVWVRAFDQSGDKNDNPDIADYMGYGDVKLQYR
                ||||||||||||||||||||||||||||||||||||||||||||||||||||||||||||
         g582   QSRPESRSWNRIYAMAGMEWGKLTVIPRVWVRAFDQSGDKNDNPDIADYMGYGDVKLQYR
                   250        260        270        280        290        300

310        320        330        340        350        360
     m582.pep   LNDRQNVYSVLRYNPKTGYGAIEAAYTFPIKGKLKGVVRGFHGYGESLIDYNHKQNGIGI
                ||||||||||||||||||||||||||||||||||||||||||||||||||||||||||||
         g582   LNDRQNVYSVLRYNPKTGYGAIEAAYTFPIKGKLKGVVRGFHGYGESLIDYNHKQNGIGI
                   310        320        330        340        350        360

370
     m582.pep   GLMFNDLDGIX
                |||||| ||||
         g582   GLMFNDWDGIX
                   370
```

The following partial DNA sequence was identified in *N. meningitidis* <SEQ ID 1789>:

```
a582.seq
    1   ATGCGCTATA TTCTTTTGAC AGGACTGTTG CCGATGGCAT CCGCTTTTGG

51   AGAGACCGCG CTGCAATGCG CCGCTTTGAC GGACAATGTT ACGCGTTTGG

101   CGTGTTACGA CAGGATTTTT GCGGCACAGC TTCCGTCTTC GGCAGGGCAG

151   GAAGGGCAGG AGTCGAAAGC CGTACTCAAT CTGACGGAAA CCGTCCGCAG

201   CAGCCTGGAT AAGGGCGAGG CGGTCATTGT TGTTGAAAAA GGCGGGGATG
```

```
 251 CGCTTCCTGC CGACAGTGCG GGCGAAACCG CCGACATCTA TACGCCTTTG

301 AGCCTGATGT ACGACTTGGA CAAAAACGAT TTGCGCGGGC TGTTGGGCGT

351 ACGCGAACAC AATCCGATGT ACCTTATGCC GCTCTGGTAC AACAATTCGC

401 CCAACTATGC CCCGGGTTCG CCGACGCGCG GTACGACTGT ACAGGAAAAA

451 TTCGGACAGC AGAAACGTGC GGAAACCAAA TTGCAGGTTT CGTTCAAAAG

501 CAAAATTGCC GAAGATTTGT TTAAAACCCG CGCGGATCTG TGGTTCGGCT

551 ACACCCAAAG ATCCGATTGG CAGATTTACA ACCAAGGCAG GAAATCCGCG

601 CCGTTCCGCA ATACGGATTA CAAACCTGAA ATTTTCCTGA CCCAGCCTGT

651 GAAGGCGGAT TTGCCGTTCG GCGGCAGGCT GCGTATGCTC GGTGCGGGTT

701 TTGTCCACCA GTCCAACGGA CAGAGCCGTC CCGAATCGCG TTCGTGGAAC

751 AGGATTTACG CCATGGCAGG CATGGAATGG GGCAAATTGA CGGTGATTCC

801 GCGCGTGTGG GTGCGTGCGT TCGATCAGAG CGGCGATAAA AACGACAATC

851 CCGATATTGC CGACTATATG GGGTATGGCG ACGTGAAGCT GCAGTACCGC

901 CTGAACGACA GGCAGAATGT GTATTCCGTA TTGCGCTACA ATCCCAAAAC

951 GGGCTACGGC GCGATTGAAG CCGCCTACAC GTTTCCGATT AAGGGCAAAC

1001 TCAAAGGCGT GGTACGCGGA TTCCACGGTT ACGGCGAGAG CCTGATCGAC

1051 TACAACCACA AGCAGAACGG TATCGGTATC GGGTTGATGT TCAACGACTT

1101 GGACGGCATC TGA
```

This corresponds to the amino acid sequence <SEQ ID 1790; ORF 582.a>:

```
a582.pep

1 MRYILLTGLL PMASAFGETA LQCAALTDNV TRLACYDRIF AAQLPSSAGQ

51 EGQESKAVLN LTETVRSSLD KGEAVIVVEK GGDALPADSA GETADIYTPL

101 SLMYDLDKND LRGLLGVREH NPMYLMPLWY NNSPNYAPGS PTRGTTVQEK

151 FGQQKRAETK LQVSFKSKIA EDLFKTRADL WFGYTQRSDW QIYNQGRKSA

201 PFRNTDYKPE IFLTQPVKAD LPFGGRLRML GAGFVHQSNG QSRPESRSWN

251 RIYAMAGMEW GKLTVIPRVW VRAFDQSGDK NDNPDIADYM GYGDVKLQYR

301 LNDRQNVYSV LRYNPKTGYG AIEAAYTFPI KGKLKGVVRG FHGYGESLID

351 YNHKQNGIGI GLMFNDLDGI * m582/a582 100.0% identity in 370 aa overlap
               10         20         30         40         50         60
m582.pep MRYILLTGLLPMASAFGETALQCAALTDNVTRLACYDRIFAAQLPSSAGQEGQESKAVLN
         ||||||||||||||||||||||||||||||||||||||||||||||||||||||||||||
a582     MRYILLTGLLPMASAFGETALQCAALTDNVTRLACYDRIFAAQLPSSAGQEGQESKAVLN
               10         20         30         40         50         60
               70         80         90        100        110        120
m582.pep LTETVRSSLDKGEAVIVVEKGGDALPADSAGETADIYTPLSLMYDLDKNDLRGLLGVREH
         ||||||||||||||||||||||||||||||||||||||||||||||||||||||||||||
a582     LTETVRSSLDKGEAVIVVEKGGDALPADSAGETADIYTPLSLMYDLDKNDLRGLLGVREH
               70         80         90        100        110        120
              130        140        150        160        170        180
m582.pep NPMYLMPLWYNNSPNYAPGSPTRGTTVQEKFGQQKRAETKLQVSFKSKIAEDLFKTRADL
         ||||||||||||||||||||||||||||||||||||||||||||||||||||||||||||
a582     NPMYLMPLWYNNSPNYAPGSPTRGTTVQEKFGQQKRAETKLQVSFKSKIAEDLFKTRADL
              130        140        150        160        170        180
              190        200        210        220        230        240
m582.pep WFGYTQRSDWQIYNQGRKSAPFRNTDYKPEIFLTQPVKADLPFGGRLRMLGAGFVHQSNG
         ||||||||||||||||||||||||||||||||||||||||||||||||||||||||||||
a582     WFGYTQRSDWQIYNQGRKSAPFRNTDYKPEIFLTQPVKADLPFGGRLRMLGAGFVHQSNG
              190        200        210        220        230        240
```

```
                  250        260        270        280        290        300
m582.pep QSRPESRSWNRIYAMAGMEWGKLTVIPRVWVRAFDQSGDKNDNPDIADYMGYGDVKLQYR
         ||||||||||||||||||||||||||||||||||||||||||||||||||||||||||||
a582     QSRPESRSWNRIYAMAGMEWGKLTVIPRVWVRAFDQSGDKNDNPDIADYMGYGDVKLQYR
                  250        260        270        280        290        300
                  310        320        330        340        350        360
m582.pep LNDRQNVYSVLRYNPKTGYGAIEAAYTFPIKGKLKGVVRGFHGYGESLIDYNHKQNGIGI
         ||||||||||||||||||||||||||||||||||||||||||||||||||||||||||||
a582     LNDRQNVYSVLRYNPKTGYGAIEAAYTFPIKGKLKGVVRGFHGYGESLIDYNHKQNGIGI
                  310        320        330        340        350        360
                  370
m582.pep GLMFNDLDGIX
         |||||||||||
a582     GLMFNDLDGIX
                  370
```

The following partial DNA sequence was identified in *N. gonorrhoeae* <SEQ ID 1791>:

```
g583.seq..
   1 atgataattg accaaagcca aatatttacc catcttgcct tctgtgcctt 51 ttgcgggatt ggagccgtaa ctgccggcaa tcgactgcat aatcggatgt 101 ataatgccgc cgccgcgcgc ggtattggaa ggggtaacgg gagccagcag 151 cagttcggaa agagcgagac tgtaaccgat gcccagcgtt tttcttccaa 201 aaacggcgat aaacaaatat ccgatacgca tccccagccc tgttttgagc 251 aaaccgcgcg aaatcataac tgcgatggca atcagccaaa tcaacggatt 301 ggcgaacgca ctcaacgcat cgctcatcgc cgcgcccggt ttgtcggcgg 351 ttacgccggt tactgcgacc aacccgacgg caataatcga cagcgcgccc 401 aacggcataa ccttgccgat aatggcggca atcacaccga caaacatagc 451 cagcagcgtc caagcctgag gcttgacccc gtcgggtacg ggcagtgcca 501 aaaccagggc gcacaatact gcggcaatgg cgaggggtat cggtttgaaa 551 cccaatttca tcatattgac ctccgtaaaa aagaccgtcc cgaaaaatcg 601 gaaaaataa
```

This corresponds to the amino acid sequence <SEQ ID 1792; ORF 583.ng>:

```
g583.pep..
   1 MIIDQSQIFT HLAFCAFCGI GAVTAGNRLH NRMYNAAAAR GIGRGNGSQQ

51 QFGKSETVTD AQRFSSKNGD KQISDTHPQP CFEQTARNHN CDGNQPNQRI

101 GERTQRIAHR RARFVGGYAG YCDQPDGNNR QRAQRHNLAD NGGNHTDKHS

151 QQRPSLRLDP VGYGQCQNQG AQYCGNGEGY RFETQFHHID LRKKDRPEKS

201 EK*
```

The following partial DNA sequence was identified in *N. meningitidis* <SEQ ID 1793>:

```
m583.seq..
   1 ATGATAGTTG ACCAAAGCCA AATATTTACC CATCTTGCCT TCTGTGCCTT

51 TTGCGGGATT GGAGCCGTAA CTGCCGGCAA TCGACTGCAT AATCGGATGT

101 ATAATGCCGC CGCCGCGCGC GGTATTGGAA GGGGTAACGG GAGCCAGCAG

151 CAGTTCGGAA AGAGCGAGAC TGTAACCGAT GCCCAGCGTT TTTCTTCCAA

201 AAACGGCGAT AAACAAATAT CCGATACGCA TCCCCAGCCC TGTTTTGAGC
```

```
251 AAACCGCGCG AAATCATAAC TGCGATGGCA ATCAGCCAAA TCAACGGATT

301 GGCGAACGCA CTCAACGCAT CGCTCATCGC CGCGCCCGGT TTGTCGGCGG

351 TTACGCCGGT TACTGCGACC AACCCGACGG CAATAATCGA CAGCGCGCCC

401 AACGGCATGG CCTTGCCGAT AATGGCGGCA ATCACACCGA CAAACATGGC

451 CAGCAGCGTC AAGCCTGAG GCTTGACCCC GTCGGGTACG GGCAGTGCCA

501 AAACCAGGGC GCACAATACT GCGGCAATGG CGAGGGGTAT CGGTTTGAAA

551 CCCAATTTCA TCATATTGAC CTCCGTAAAA AAGACCGTCC CGAAAAATCG

601 GAAAAATAA
```

This corresponds to the amino acid sequence <SEQ ID 1794; ORF 583>:

```
a583.pep..
    1  MIVDQSQIFT HLAFCAFCGI GAVTAGNRLH NRMYNAAAAR GIGRGNGSQQ

51  QFGKSETVTD AQRFSSKNGD KQISDTHPQP CFEQTARNHN CDGNQPNQRI

101  GERTQRIAHR RARFVGGYAG YCDQPDGNNR QRAQRHGLAD NGGNHTDKHG

151  QQRPSLRLDP VGYGQCQNQG AQYCGNGEGY RFETQFHHID LRKKDRPEKS

201  EK* m583/g583  98.5% identity in 202 aa overlap 10         20         30         40         50         60
m583.pep  MIVDQSQIFTHLAFCAFCGIGAVTAGNRLHNRMYNAAAARGIGRGNGSQQQFGKSETVTD
          ||:|||||||||||||||||||||||||||||||||||||||||||||||||||||||||
g583      MIIDQSQIFTHLAFCAFCGIGAVTAGNRLHNRMYNAAAARGIGRGNGSQQQFGKSETVTD
                 10         20         30         40         50         60
                 70         80         90        100        110        120
m583.pep  AQRFSSKNGDKQISDTHPQPCFEQTARNHNCDGNQPNQRIGERTQRIAHRRARFVGGYAG
          ||||||||||||||||||||||||||||||||||||||||||||||||||||||||||||
g583      AQRFSSKNGDKQISDTHPQPCFEQTARNHNCDGNQPNQRIGERTQRIAHRRARFVGGYAG
                 70         80         90        100        110        120
                130        140        150        160        170        180
m583.pep  YCDQPDGNNRQRAQRHGLADNGGNHTDKHGQQRPSLRLDPVGYGQCQNQGAQYCGNGEGY
          |||||||||||||||||:||||||||||||:|||||||||||||||||||||||||||||
g583      YCDQPDGNNRQRAQRHNLADNGGNHTDKHSQQRPSLRLDPVGYGQCQNQGAQYCGNGEGY
                130        140        150        160        170        180
                190        200
m583.pep  RFETQFHHIDLRKKDRPEKSEKX
          |||||||||||||||||||||||
a583      RFETQFHHIDLRKKDRPEKSEKX
                190        200
```

The following partial DNA sequence was identified in *N. meningitidis* <SEQ ID 1795>:

```
a583.seq
    1 ATGATAGTTG ACCAAAGCCA AATATTTACC CATCTTGCCT TCTGTGCCTT

51 TTGCGGGATT GGAGCCGTAA CTGCCGGCAA TCGACTGCAT AATCGGATGT

101 ATAATGCCGC CGCCGCGCGC GGTATTGGAA GGGGTAACGG GAGCCAGCAG

151 CAGTTCGGAA AGAGCGAGAC TGTAACCGAT GCCCAGCGTT TTTCTTCCAA

201 AAACGGCGAT AAACAAATAT CCGATACGCA TCCCCAGCCC TGTTTTGAGC

251 AAACCGCGCG AAATCATAAC TGCGATGGCA ATCAGCCAAA TCAACGGATT

301 GGCGAACGCA CTCAACGCAT CGCTCATCGC CGCACCCGGT TTGTCGGCGG

351 TTACGCCGGT TACTGCGACC AACCCGACGG CAATAATCGA CAGCGCACCC

401 AACGGCATGG CCTTGCCGAT AATGGCGGCA ATCACACCGA TAAACATGGC
```

```
451 CAGCAGCGTC CAAGCCTGAG GCTTGACCCC GTCGGGTACG GGCAGTGCCA

501 AAACCAAGGC GCACAATACT GCGGCAATGG CGAGGGGTAT CGGTTTGAAA

551 CCCAATTTCA TCATATTGAC CTCCGTAAAA AAGACCGTCC CGAAAAATCG

601 GAAAAATAA
```

This corresponds to the amino acid sequence <SEQ ID 1796; ORF 583.a>:

```
a583.pep

1  MIVDQSQIFT HLAFCAFCGI GAVTAGNRLH NRMYNAAAAR GIGRGNGSQQ

51  QFGKSETVTD AQRFSSKNGD KQISDTHPQP CFEQTARNHN CDGNQPNQRI

101  GERTQRIAHR RTRFVGGYAG YCDQPDGNNR QRTQRHGLAD NGGNHTDKHG

151  QQRPSLRLDP VGYGQCQNQG AQYCGNGEGY RFETQFHHID LRKKDRPEKS

201  EK* m583/a583 99.0% identity in 202 aa overlap 10        20        30        40        50        60
m583.pep  MIVDQSQIFTHLAFCAFCGIGAVTAGNRLHNRMYNAAAARGIGRGNGSQQQFGKSETVTD
          ||||||||||||||||||||||||||||||||||||||||||||||||||||||||||||
a583      MIVDQSQIFTHLAFCAFCGIGAVTAGNRLHNRMYNAAAARGIGRGNGSQQQFGKSETVTD
                  10        20        30        40        50        60
                  70        80        90       100       110       120
m583.pep  AQRFSSKNGDKQISDTHPQPCFEQTARNHNCDGNQPNQRIGERTQRIAHRRARFVGGYAG
          |||||||||||||||||||||||||||||||||||||||||||||||||:|||||||||
a583      AQRFSSKNGDKQISDTHPQPCFEQTARNHNCDGNQPNQRIGERTQRIAHRRTRFVGGYAG
                  70        80        90       100       110       120
                 130       140       150       160       170       180
m583.pep  YCDQPDGNNRQRAQRHGLADNGGNHTDKHGQQRPSLRLDPVGYGQCQNQGAQYCGNGEGY
          |||||||||||||:||||||||||||||||||||||||||||||||||||||||||||||
a583      YCDQPDGNNRQRTQRHGLADNGGNHTDKHGQQRPSLRLDPVGYGQCQNQGAQYCGNGEGY
                 130       140       150       160       170       180
                 190       200
m583.pep  RFETQFHHIDLRKKDRPEKSEKX
          |||||||||||||||||||||||
a583      RFETQFHHIDLRKKDRPEKSEKX
                 190       200
```

The following partial DNA sequence was identified in *N. gonorrhoeae* <SEQ ID 1797>:

```
g584.seq..
  1 atgctgcgtt ctattttggc ggcttccctg ctggcggtat cttttccggc 51 ggcggctgag gcattgaatt acaatattgt cgaattttcc gaatcggcgg 101 gtatcgaggt ggctcaggat acaatgtccg cgcgtttcca ggtggcggcg 151 gaaggacggg acaaaaatgc cgtcaatgcc gagtttgtta aaaaattcaa 201 caatttcacc agaaaatcga aaatggtag ctttaaaacc gaattggtat 251 cgcgcagtgc gatgccgcgc tatcaatata ccaacggcag acgcattcaa 301 acaggctggg aggagcgtgc ggaatttaag gcggagggca gggattttga 351 tgctttaaac cgttttattg ctgatgttca gacggatgct tcgcttgaag 401 ataccgattt cagcgtgtcg cgcgaacgcc gaaacgaggt catcgatcag 451 gtcagcaagg atgccgtttt gcgtttcaag gcgcgtgccg aaaaactggc 501 gggcgttctg ggtgcgtccg gttataaaat cgtcaaattg aattttgggc 551 aaatcggcag ccatattgcg ggcgatgggg ctgttcgggc aaaaatgctg 601 cgcgcgatgc cgatggcggc aagcgtcaat atgaagggta cggattcagc
```

-continued

```
651 cgcaccgggt gtggaggaaa tcagcatcag catcaatggg acggttcagt 701 tctaa
```

This corresponds to the amino acid sequence <SEQ ID 1798; ORF 584.ng>:

```
g584.pep Length: ..
   1 MLRSILAASL LAVSFPAAAE ALNYNIVEFS ESAGIEVAQD TMSARFQVAA

51 EGRDKNAVNA EFVKKFNNFT RKSKNGSFKT ELVSRSAMPR YQYTNGRRIQ

101 TGWEERAEFK AEGRDFDALN RFIADVQTDA SLEDTDFSVS RERRNEVIDQ

151 VSKDAVLRFK ARAEKLAGVL GASGYKIVKL NFGQIGSHIA GDGAVRAKML

201 RAMPMAASVN MKGTDSAAPG VEEISISING TVQF*
```

The following partial DNA sequence was identified in *N. meningitidis* <SEQ ID 1799>:

```
m584.seq..
   1 ATGTTGCGTC TTGTTTTGGC GGCTTCGCTG TCGGCGGTAT CTTTTCCGGC

51 AGCGGCTGAA GCATTGAATT ACAATATTGT CGAATTTTCC GAATCGGCGG

101 GTGTCGAGGT GGCTCAGGAT ACAATGTCCG CACGTTTCCA AGTGACGGCG

151 GAAGGACGGG ACAAAAATGC CGTCAATGCT GAGTTTGTTA AAAAATTCAA

201 CAAGTTCATC AGAAAATCGA AAAATGGTAG CTTTAAAACC GAATTGGTAT

251 CGCGCAGTGC GATGCCGCGC TATCAATATA CCAACGGCAG ACGCATTCAA

301 ACAGGCTGGG AGGAGCGTGC GGAATTTAAG GTCGAAGGTA GAGATTTTGA

351 TGAGTTAAAC CGTTTTATTG CCGATATTCA AGCAGATGCC GCGTTGGmAT

401 ATACGGATTT CCATGTGTCG CGCGAACGCC GCAACGAGGT CATCkATCAG

451 GTCAGCAAGG ATGCCGTTTT GCGTTTCAAG GCGCGTGCCG AAAAGTTGGC

501 GGGCGTTTTG GGTGCGTCCG GTTATAAAAT CGTCAAATTG AATTTGGGAC

551 ACATCGGCAG CCATATCGCG GGAGGGGGAG CTGCTCAGGC AAAAATGCTT

601 CGTGCCATGC CGATGGCGGC AAGCGTCAAT ATGGAGGGTG CGGATTCCGC

651 CGCGCCTGGT GTGGAGGAAA TCAGCATCAG CGTCAATGGG ACGGTTCAGT

701 TCTGA
```

This corresponds to the amino acid sequence <SEQ ID 1800; ORF 584>:

```
  a584.pep..
       1 MLRLVLAASL SAVSFPAAAE ALNYNIVEFS ESAGVEVAQD TMSARFQVTA

51 EGRDKNAVNA EFVKKFNKFI RKSKNGSFKT ELVSRSAMPR YQYTNGRRIQ

101 TGWEERAEFK VEGRDFDELN RFIADIQADA ALXYTDPHVS RERRNEVIXQ

151 VSKDAVLRFK ARAEKLAGVL GASGYKIVKL NLGHIGSHIA GGGAAQAKML

201 RAMPMAASVN MEGADSAAPG VEEISISVNG TVQF* m584/g584 89.7% identity in 234 aa overlap 10         20         30         40         50         60
      m584.pep MLRLVLAASLSAVSFPAAAEALNYNIVEFSESAGVEVAQDTMSARFQVTAEGRDKNAVNA
               ||| :|||||  ||||||||||||||||||||||:|||||||||||:||||||||||
         g584 MLRSILAASLLAVSFPAAAEALNYNIVEFSESAGIEVAQDTMSARFQVAAEGRDKNAVNA
                  10         20         30         40         50         60
```

-continued

```
                 70        80        90       100       110       120
m584.pep EFVKKFNKFIRKSKNGSFKTELVSRSAMPRYQYTNGRRIQTGWEERAEFKVEGRDFDELN
         ||||||:| |||||||||||||||||||||||||||||||||||||||:|||||| ||
g584     EFVKKFNNFTRKSKNGSFKTELVSRSAMPRYQYTNGRRIQTGWEERAEFKAEGRDFDALN
                 70        80        90       100       110       120

130       140       150       160       170       180
m584.pep RFIADIQADAALXYTDFHVSRERRNEVIXQVSKDAVLRFKARAEKLAGVLGASGYKIVKL
         |||||:|:||:|   ||| ||||||||| |||||||||||||||||||||||||||||||
g584     RFIADVQTDASLEDTDFSVSRERRNEVIDQVSKDAVLRFKARAEKLAGVLGASGYKIVKL
                130       140       150       160       170       180

190       200       210       220       230
m584.pep NLGHIGSHIAGGGAAQAKMLRAMPMAASVNMEGADSAAPGVEEISISVNGTVQFX
         |:|:||||||| ||::||||||||||||||:|:|||||||||||||:|||||||
g584     NFGQIGSHIAGDGAVRAKMLRAMPMAASVNMKGTDSAAPGVEEISISINGTVQFX
                190       200       210       220       230
```

The following partial DNA sequence was identified in *N. meningitidis* <SEQ ID 1801>:

```
a584.seq
  1 ATGTTGCGTT CTATTTTGGC GGCTTCCCTG CTG.......  ..........

51 .......... ..........  .....ATTGT CGAATTTTCT GAATCGGCGG

101 GTGTCGAGGC GGTTCAGGAT ACAATGTCCG CACGTTTCCA AGTGACGGCG

151 GAAGGACGGG ACAAAAATGC CGTCAATGCC GAGTTTGTTA AAAAATTCAA

201 CAATTTCACC AGAAAATCAA AAAATGGTAG CTTTAAAACC GAATTGGTAT

251 CGCGCAGTGC GATGCCGCGC TATCAATATA CCAACGGCAG ACGCATTCAA

301 ACAGGTTGGG AGGAGCGTGC GGAATTTAAG GTCGAGGGTA GGAATTTTGA

351 TGCGTTGAAC CGTTTTATTG CCGATGTTCA GGCAGATGCC GCGTTGGAAT

401 ATACGGATTT CCATGTGTCG CGCGAACGCC GCAACGAGGT CATCGATCAG

451 GTCAGCAAGG ATGCCGTTTT GCGTTTCAAG GCGCGTGCCG AAAAGTTGGC

501 GGGCGTTTTG GGTGCGTCCG GTTATAAAAT CGTCAAATTG AATTTGGGAC

551 ACATCGGCAG CCATATCGCG GGAGGGGGAG CTGCTCAGGC AAAAATGCTT

601 CGTGCCATGC CGATGGCGGC AAGCGTCAAT ATGGAGGGTG CGGATTCCGC

651 CGCGCCTGGT GTGGAGGAAA TCAGCATCAG CGTCAATGGG ACGGTTCAGT

701 TCTGA
```

This corresponds to the amino acid sequence <SEQ ID 1802; ORF 584.a>:

```
a584.pep

1 MLRSILAASL L.........  .....IVEFS ESAGVEAVQD TMSARFQVTA

51 EGRDKNAVNA EFVKKFNNFT RKSKNGSFKT ELVSRSAMPR YQYTNGRRIQ

101 TGWEERAEFK VEGRNFDALN RFIADVQADA ALEYTDFHVS RERRNEVIDQ

151 VSKDAVLRFK ARAEKLAGVL GASGYKIVKL NLGHIGSHIA GGGAAQAKML

201 RAMPMAASVN MEGADSAAPG VEEISISVNG TVQF* m584/a584 88.9% identity in 234 aa overlap 10        20        30        40        50        60
m584.pep MLRLVLAASLSAVSFPAAAEALNYNIVEFSESAGVEAVQDTMSARFQVTAEGRDKNAVNA
         |||  :|||||              ||||||||||||||||::|||||||||||||||||
a584     MLRSILAASLL--------------IVEFSESAGVEAVQDTMSARFQVTAEGRDKNAVNA
                 10                  20        30        40
```

-continued

```
                       70        80        90        100       110       120
m584.pep  EFVKKFNKFIRKSKNGSFKTELVSRSAMPRYQYTNGRRIQTGWEERAEFKVEGRDFDELN
          ||||||:| ||||||||||||||||||||||||||||||||||||||||||||:|| ||
a584      EFVKKFNNFTRKSKNGSFKTELVSRSAMPRYQYTNGRRIQTGWEERAEFKVEGRNFDALN
                    50        60        70        80        90        100

130       140       150       160       170       180
m584.pep  RFIADIQADAALXYTDFHVSRERRNEVIXQVSKDAVLRFKARAEKLAGVLGASGYKIVKL
          |||||:||||||  |||||||||||||||| |||||||||||||||||||||||||||||
a584      RFIADVQADAALEYTDFHVSRERRNEVIDQVSKDAVLRFKARAEKLAGVLGASGYKIVKL
              110       120       130       140       150       160

190       200       210       220       230
m584.pep  NLGHIGSHIAGGGAAQAKMLRAMPMAASVNMEGADSAAPGVEEISISVNGTVQFX
          ||||||||||||||||||||||||||||||||||||||||||||||||||||||
a584      NLGHIGSHIAGGGAAQAKMLRAMPMAASVNMEGADSAAPGVEEISISVNGTVQFX
              170       180       190       200       210       220
```

15

The following partial DNA sequence was identified in *N. gonorrhoeae* <SEQ ID 1803>:

```
g585.seq..
   1 atgaaactgt tccaacgcat tttcgccaca ttttgcgcgg ttatcgtctg 51 cgcaatcttt gtggcgagtt tttcttttg gctggtgcag aacacccttg 101 ccgaaaacca attcaaccaa cgccgcacca tcgaaccac attgatgggc 151 agcattattt ccgcattcaa gacacggggc gacaacggcg cgcgcgaaat 201 cctgaccgaa tggaaaaaca gccccgtctc atccgccgtt tacgtcatac 251 agggcgacga gaaaaaagac atcttaaacc gctatatcga caattacacc 301 atagaacgcg cccggctgtt tgccgccaac aaccccatt ccaaccttgt 351 ccgcatcgaa tacgaccgtt tcggcgaaga atacctgttc ttcattaaag 401 gctgggacaa ccaccaggca caacgcctgc ccagcccgct gtttatcccg 451 ggcctgccgc ttgccccgat ttggcacgaa ttcatcatcc tctccttcat 501 catcattgtc ggactgctga tggcatatat ccttgccggc aacattgcca 551 aacccatcag aatcttaggc aacggcatgg acagggtggc agaacgagaa 601 cttgaagacc gcgtttgcca acaggttcgc gaccgcgacg acgaattggc 651 cgatgttgcc atgcaattcg acacaatggt ggaaaaactg gaataa
```

This corresponds to the amino acid sequence <SEQ ID 1804; ORF 585.ng>:

```
g585.pep..
   1 MKLFQRIFAT FCAVIVCAIF VASFSFWLVQ NTLAENQFNQ RRTIETTLMG

51 SIISAFKTRG DNGAREILTE WKNSPVSSAV YVIQGDEKKD ILNRYIDNYT

101 IERARLFAAN NPHSNLVRIE YDRFGEEYLF FIKGWDNHQA QRLPSPLFIP

151 GLPLAPIWHE FIILSFIIIV GLLMAYILAG NIAKPIRILG NGMDRVAERE

201 LEDRVCQQVR DRDDELADVA MQFDTMVEKL E*
```

The following partial DNA sequence was identified in *N. meningitidis* <SEQ ID 1805>:

```
m585.seq..
    1 ATGAAACTGT TCCAACGCAT TTTCGCCACA TTTTGCGCGG TTATCGTCTG

51 TGCAATCTTT GTGGCGAGTT TTTCTTTCTG GCTGGTGCAG AACACCCTTG

101 CCGAAAACCA GTTCAACCAA CGCCGCACCA TCGAACCAC TTTGATGGGC

151 AGCATCATTT CCGCATTCCG GGCACGCGGG GACGCGGGTG CGCGCGAAAT
```

-continued

```
 201 CCTGACGGAA TGGAAAGACA GCCCCGTCTC ATCGGGCGTG TACGTTATAC
 251 AGGGCGACGA GAAAAAAGAT ATCCTGAACC GGTATATCGA CAGCTATACC
 301 ATCGAACGCG CCCGGCTTTT CGCCGCCGGA CACCCGCATT CCAACCTCGT
 351 CCATATCGAA TACGACCGCT TCGGCGAAGA ATACCTGTTC TTCACCAAAG
 401 ACTGGGACAA ACTCCAAGCC CGCCGCCTGC CCAGCCCCCT GTTGATCCCC
 451 GGCCTGCCGC TCGCCCCGAT TTGGCACGAA CTCATCATAT TGTCCTTCAT
 501 CATCATCGTC GGACTGCTGA TGGCATATAT CCTCGCCGGC AACATTGCCA
 551 AACCCATCAG AATCTTAGGC AACGGCATGG ACAGGGTGGC AAACGGAGAA
 601 CTTGAAACCC GTATCTCCCA ACAGGTCGAC GACCGCGACG ACGAATTGTC
 651 CCATCTTGCC ATCCAATTCG ACAAAATGGT GGAAAAACTC GAAAAACTCG
 701 TTGCCAAAGA ACGCCACCTG CTCCATCACG TCTCCCATGA AATGCGTTCT
 751 CCCCTTGCGC GCATGCAGGC AATTGTCGGA CTGATTCAGG CGCAGCCCCA
 801 AAAACAGGAG CAATATCTCA AACGGCTGGA AGGCGAACTG ACCCGCATGG
 851 ATACGCTGGC CGGGGAACTG TTAACCCTGT CCCGTCTCGA AACTTCCAAT
 901 ATGGCTTTGG AAAAGAAAG CCTGAAACTC CTGCCCTTCC TGGGCAACCT
 951 GGTAGAAGAC AATCAAAGCA TTGCCCAGAA AAACGGACAA ACGGTTACCC
1001 TGTCTGCCGA CGGAAAAATC CCCGAAAACA CAACCATCCT TGCCAACGAA
1051 AGCTACCTGT ACCGCGCCTT CGACAACGTC ATCCGCAACG CCGTCAACTA
1101 CAGTCCCGAA GGCAGCACCA TCCTGATCAA CATCGGACAA GACCACAAAC
1151 ACTGGATAAT CGACGTTACC GACAACGGCC CCGGCGTGGA CGAAATGCAG
1201 CTCCCGCACA TCTTCACCGC TTTCTACCGT GCAGACTCCA GTGCCAACAA
1251 ACCCGGAACA GGACTGGGGC TTGCATTGAC CCAACATATT ATTGAACAGC
1301 ACTGCGGCAA AATCATCGCC GAAAACATCA AACCGAACGG TCTGCGGATG
1351 CGCTTTATCC TGCCCAAGAA AAAACCGGT TCCAAAACAG AAAAAAGTGC
1401 GAACTGA
```

This corresponds to the amino acid sequence <SEQ ID 1806; ORF 585>:

```
m585.pep..

1 MKLFQRIFAT FCAVIVCAIF VASFSFWLVQ NTLAENQFNQ RRTIETTLMG
   51 SIISAFRARG DAGAREILTE WKDSPVSSGV YVIQGDEKKD ILNRYIDSYT
  101 IERARLFAAG HPHSNLVHIE YDRFGEEYLF FTKDWDKLQA RRLPSPLLIP
  151 GLPLAPIWHE LIILSFIIIV GLLMAYILAG NIAKPIRILG NGMDRVANGE
  201 LETRISQQVD DRDDELSHLA IQFDKMVEKL EKLVAKERHL LHHVSHEMRS
  251 PLARMQAIVG LIQAQPQKQE QYLKRLEGEL TRMDTLAGEL LTLSRLETSN
  301 MALEKESLKL LPFLGNLVED NQSIAQKNGQ TVTLSADGKI PENTTILANE
  351 SYLYRAFDNV IRNAVNYSPE GSTILINIGQ DHKHWIIDVT DNGPGVDEMQ
  401 LPHIFTAFYR ADSSANKPGT GLGLALTQHI IEQHCGKIIA ENIKPNGLRM
  451 RFILPKKKTG SKTEKSAN* m585/g585 88.3% identity in 231 aa overlap
```

-continued

```
                  10        20        30        40        50        60
m585.pep  MKLFQRIFATFCAVIVCAIFVASFSFWLVQNTLAENQFNQRRTIETTLMGSIISAFRARG
          ||||||||||||||||||||||||||||||||||||||||||||||||||||||||::||
g585      MKLFQRIFATFCAVIVCAIFVASFSFWLVQNTLAENQFNQRRTIETTLMGSIISAFKTRG
                  10        20        30        40        50        60

70        80        90       100       110       120
m585.pep  DAGAREILTEWKDSPVSSGVYVIQGDEKKDILNRYIDSYTIERARLFAAGHPHSNLVHIE
          | ||||||||||:|||||:||||||||||||||||||:|||||||||||::||||||:||
g585      DNGAREILTEWKNSPVSSAVYVIQGDEKKDILNRYIDNYTIERARLFAANNPHSNLVRIE
                  70        80        90       100       110       120

130       140       150       160       170       180
m585.pep  YDRFGEEYLFFTKDWDKLQARRLPSPLLIPGLPLAPIWHELIILSFIIIVGLLMAYILAG
          ||||||||||| | ||: ||:||||||:||||||||||||:|||||||||||||||||||
g585      YDRFGEEYLFFIKGWDNHQAQRLPSPLFIPGLPLAPIWHEFIILSFIIIVGLLMAYILAG
                 130       140       150       160       170       180

190       200       210       220       230       240
m585.pep  NIAKPIRILGNGMDRVANGELETRISQQVDDRDDELSHLAIQFDKMVEKLEKLVAKERHL
          |||||||||||||||||: ||| |: ||| ||||||: :|:||| ||||||
g585      NIAKPIRILGNGMDRVAERELEDRVCQQVRDRDDELADVAMQFDTMVEKLEX
                 190       200       210       220       230

250       260       270       280       290       300
m585.pep  LHHVSHEMRSPLARMQAIVGLIQAQPQKQEQYLKRLEGELTRMDTLAGELLTLSRLETSN
```

The following partial DNA sequence was identified in *N. meningitidis* <SEQ ID 1807>:

```
a585.seq
     1  ATGAAACTGT TCCAACGCAT CTTCGCCACA TTTTGCGCGG TTATCGTCTG
    51  TGCAATCTTT GTGGCGAGTT TTTCTTTCTG GCTGGTGCAG AACACCCTTG
   101  CCGAAAACCA GTTCAACCAA CGCCGCACCA TCGAAACCAC TTTGATGGGC
   151  AGCATCATTT CCGCATTCCG GGCACGCGGG GACGCGGGTG CGCGCGAAAT
   201  CCTGACGGAA TGGAAAGACA GCCCCGTCTC ATCGGGCGTG TACGTTATAC
   251  AGGGCGACGA GAAAAAAGAT ATCCTGCACC GGTATATCGA CAGCTACACC
   301  ATCGAACGCG CCCGGCTTTT CGCCGCCGGA CACCCGCATT CCAACCTCGT
   351  CCATATCGAA TACGACCGCT TCGGCGAAGA ATACCTGTTC TTCACCAAAG
   401  ACTGGGACAA ACTCCAAGCC CGCCGCCTGC CCAGCCCCCT GTTGATCCCC
   451  GGCCTGCCGC TCGCCCCGAT TTGGCACGAA CTCATCATAT TGTCCTTCAT
   501  CATCATCGTC GGACTGCTGA TGGCGTACAT CCTCGCCGGC AACATTGCCA
   551  AACCCATCAG AATCTTAGGC AACGGCATGG ACAGGGTGGC AAACGGAGAA
   601  CTTGAAACCC GTATCTCCCA ACAGGTCGAC GACCGCGACG ACGAATTGTC
   651  CCATCTTGCC ATCCAATTCG ACAAAATGGT GGAAAAACTC GAAAAACTCG
   701  TTGCCAAAGA ACGCCACCTG CTCCATCACG TCTCCCATGA AATGCGTTCT
   751  CCCCTTGCGC GCATGCAGGC AATTGTCGGA CTGATTCAGG CGCAGCCCCA
   801  AAAACAGGAG CAATATCTCA AACGGCTGGA AGGCGAACTG AACGGCATGG
   851  ATACGCTGGC CGGGGAACTG TTAACCCTGT CCCGTCTCGA AACTTCCAAT
   901  ATGGCTTTGG AAAAAGAAAG CCTGAAACTC CTGCCCTTCC TGGGCAACCT
   951  GGTAGAAGAC AATCAAAGCA TTGCCCAGAA AAACGGACAA ACGGTTACCC
  1001  TGTCTGCCGA CGGAAAAATC CCCGAAAACA CAACCATCCT TGCCAACGAA
  1051  AGCTACCTGT ACCGCGCCTT CGACAACGTC ATCCGCAACG CCGTCAACTA
  1101  CAGTCCCGAA GGCAGCACCA TCCTGATCAA CATCGGACAA GACCACAAAC
  1151  ACTGGATAAT CGACGTTACC GACAACGGCC CCGGCGTGGA CGAAATGCAG
  1201  CTCCCGCACA TCTTCACCGC TTTCTACCGT GCAGACTCCA GTGCCAACAA
```

```
-continued
1251 ACCCGGAACA GGACTGGGGC TTGCATTGAC CCAACATATT ATTGAACAGC

1301 ACTGCGGCAA AATCATCGCC GAAAACATCA AACCGAACGG TCTGCGGATG

1351 CGCTTTATCC TGCCCAAGAA AAAACCGGT TCCAAAACAG AAAAAAGTGC

1401 GAACTGA
```

This corresponds to the amino acid sequence <SEQ ID 1808; ORF 585.a>:

```
a585.pep

1 MKLFQRIFAT FCAVIVCAIF VASFSFWLVQ NTLAENQFNQ RRTIETTLMG

51 SIISAFRARG DAGAREILTE WKDSPVSSGV YVIQGDEKKD ILHRYIDSYT

101 IERARLFAAG HPHSNLVHIE YDRFGEEYLF FTKDWDKLQA RRLPSPLLIP

151 GLPLAPIWHE LIILSFIIIV GLLMAYILAG NIAKPIRILG NGMDRVANGE

201 LETRISQQVD DRDDELSHLA IQFDKMVEKL EKLVAKERHL LHHVSHEMRS

251 PLARMQAIVG LIQAQPQKQE QYLKRLEGEL TRMDTLAGEL LTLSRLETSN

301 MALEKESLKL LPFLGNLVED NQSIAQKNGQ TVTLSADGKI PENTTILANE

351 SYLYRAFDNV IRNAVNYSPE GSTILINIGQ DHKHWIIDVT DNGPGVDEMQ

401 LPHIFTAFYR ADSSANKPGT GLGLALTQHI IEQHCGKIIA ENIKPNGLRM

451 RFILPKKKTG SKTEKSAN* m585/a585 99.8% identity in 468 aa overlap 10         20         30         40         50         60
m585.pep   MKLFQRIFATFCAVIVCAIFVASFSFWLVQNTLAENQFNQRRTIETTLMGSIISAFRARG
           ||||||||||||||||||||||||||||||||||||||||||||||||||||||||||||
a585       MKLFQRIFATFCAVIVCAIFVASFSFWLVQNTLAENQFNQRRTIETTLMGSIISAFRARG
                   10         20         30         40         50         60

70         80         90        100        110        120
m585.pep   DAGAREILTEWKDSPVSSGVYVIQGDEKKDILNRYIDSYTIERARLFAAGHPHSNLVHIE
           |||||||||||||||||||||||||||||||:||||||||||||||||||||||||||||
a585       DAGAREILTEWKDSPVSSGVYVIQGDEKKDILHRYIDSYTIERARLFAAGHPHSNLVHIE
                   70         80         90        100        110        120

130        140        150        160        170        180
m585.pep   YDRFGEEYLFFTKDWDKLQARRLPSPLLIPGLPLAPIWHELIILSFIIIVGLLMAYILAG
           ||||||||||||||||||||||||||||||||||||||||||||||||||||||||||||
a585       YDRFGEEYLFFTKDWDKLQARRLPSPLLIPGLPLAPIWHELIILSFIIIVGLLMAYILAG
                  130        140        150        160        170        180

190        200        210        220        230        240
m585.pep   NIAKPIRILGNGMDRVANGELETRISQQVDDRDDELSHLAIQFDKMVEKLEKLVAKERHL
           ||||||||||||||||||||||||||||||||||||||||||||||||||||||||||||
a585       NIAKPIRILGNGMDRVANGELETRISQQVDDRDDELSHLAIQFDKMVEKLEKLVAKERHL
                  190        200        210        220        230        240

250        260        270        280        290        300
m585.pep   LHHVSHEMRSPLARMQAIVGLIQAQPQKQEQYLKRLEGELTRMDTLAGELLTLSRLETSN
           ||||||||||||||||||||||||||||||||||||||||||||||||||||||||||||
a585       LHHVSHEMRSPLARMQAIVGLIQAQPQKQEQYLKRLEGELTRMDTLAGELLTLSRLETSN
                  250        260        270        280        290        300

310        320        330        340        350        360
m585.pep   MALEKESLKLLPFLGNLVEDNQSIAQKNGQTVTLSADGKIPENTTILANESYLYRAFDNV
           ||||||||||||||||||||||||||||||||||||||||||||||||||||||||||||
a585       MALEKESLKLLPFLGNLVEDNQSIAQKNGQTVTLSADGKIPENTTILANESYLYRAFDNV
                  310        320        330        340        350        360

370        380        390        400        410        420
m585.pep   IRNAVNYSPEGSTILINIGQDHKHWIIDVTDNGPGVDEMQLPHIFTAFYRADSSANKPGT
           ||||||||||||||||||||||||||||||||||||||||||||||||||||||||||||
a585       IRNAVNYSPEGSTILINIGQDHKHWIIDVTDNGPGVDEMQLPHIFTAFYRADSSANKPGT
                  370        380        390        400        410        420

430        440        450        460     469
m585.pep   GLGLALTQHIIEQHCGKIIAENIKPNGLRMRFILPKKKTGSKTEKSANX
           ||||||||||||||||||||||||||||||||||||||||||||||||
a585       GLGLALTQHIIEQHCGKIIAENIKPNGLRMRFILPKKKTGSKTEKSANX
                  430        440        450        460
```

The following partial DNA sequence was identified in *N. gonorrhoeae* <SEQ ID 1809>:

```
g586.seq..
   1 atggcagccc atctcgaaga acaacaagag ttagacaact ttaaatattt 51 ttggaaaacc acgggcaaat ggctgtttgc cctgctgatt ttggcggcac 101 tcggctactt gggatacacg gtttaccaaa accgtgcggc ttcccaaaat 151 caggaagcgg cggcggtgct ggcaaacatc gtggaaaagg cgcaaaacaa 201 agccccgcaa agcgaaatca atgccgaact gtccaaactc caacaaagct 251 acccccattc catttccgcc gcccaagcca cgctgatggc ggcggcaacc 301 gaatttgacg cgcagcgtta cgatgttgcc gaaggtcatt tgaaatgggt 351 gttgtccaac caaaaagaca gcctgattca ggcgttggcg gcgcagcgtc 401 tgggcgttgt gttgttgcaa caaaaaaat acgatgccgc gcttgccgca 451 ctcgacacgc cggttgaggc ggacttcgcc ccctgctga tggaaactaa 501 aggcgatgtt tatgccgcac aggaaaaaag ccaggaagcc ttaaaaaact 551 acggacaggc tttggaaaaa atgcctcaag attctgtcgg tcgcgaattg 601 cttcaaatga aactcgattc gctgaaataa
```

This corresponds to the amino acid sequence <SEQ ID 1810; ORF 586.ng>:

```
g586.pep..
   1 MAAHLEEQQE LDNFKYFWKT TGKWLFALLI LAALGYLGYT VYQNRAASQN

51 QEAAAVLANI VEKAQNKAPQ SEINAELSKL QQSYPHSISA AQATLMAAAT

101 EFDAQRYDVA EGHLKWVLSN QKDSLIQALA AQRLGVVLLQ QKKYDAALAA

151 LDTPVEADFA PLLMETKGDV YAAQEKSQEA LKNYGQALEK MPQDSVGREL

201 LQMKLDSLK*
```

The following partial DNA sequence was identified in *N. meningitidis* <SEQ ID 1811>:

```
m586.seq
   1 ATGGCAGCCC ATCTCGAAGA ACAACAAGAG TTAGACAACT TTAAATATTT

51 TTGGAAAACC ACGGGCAAAT GGCTGTTTGC CTTGCTGATT TTGGCGGCAC

101 TCGGCTACTT GGGATACACG GTTTACCAAA ACCGTAAAGT TTCCCAAAAT

151 CAGGAAGCGG CGGCGGTGCT GGCAAACATC GTAGAAAAGG CGCAAAGCAA

201 AGCCCCGCAA AGCGAAATCA ATGCCGAATT GACCAAACTC CAACAAAGCT

251 ACCCGCATTC CATTTCCGCC GCCCAAGCCA CACTGATGGC GGCGGCAACC

301 GAATTTGACG CGCAGCGTTA CGATGTTGCC GAAGGCCATT TGAAATGGGT

351 GTTGTCCAAC CAAAAAGACA GCCTGATTCA AGCGTTGGCG GCGCAGCGTC

401 TGGGCGTTGT GTTGTTGCAA CAAAAAAAAT ACGATGCCGC GCTTGCCGCG

451 CTCGATACGC CGGTTGAAGC GGACTTCGCC CCCTGCTGA TGGAAACCAA

501 AGGCGATGTC TATGCCGCAC AGGGAAAAAG CCAGGAAGCC TTAAAAAACT

551 ACGGACAGGC TTTAGAAAAA ATGCCTCAAG ATTCTGTCGG TCGCGAATTG

601 GTTCAAATGA AACTTGATTC GCTGAAATAA
```

This corresponds to the amino acid sequence <SEQ ID 1812; ORF 586>:

```
m586.pep

1   MAAHLEEQQE LDNFKYFWKT TGKWLFALLI LAALGYLGYT VYQNRKVSQN

51   QEAAAVLANI VEKAQSKAPQ SEINAELTKL QQSYPHSISA AQATLMAAAT

101   EFDAQRYDVA EGHLKWVLSN QKDSLIQALA AQRLGVVLLQ QKKYDAALAA

151   LDTPVEADFA PLLMETKGDV YAAQGKSQEA LKNYGQALEK MPQDSVGREL

201   VQMKLDSLK* m586/g586    97.1% identity in 209 aa overlap
                  10         20         30         40         50         60
   m586.pep    MAAHLEEQQELDNFKYFWKTTGKWLFALLILAALGYLGYTVYQNRKVSQNQEAAAVLANI
               ||||||||||||||||||||||||||||||||||||||||:|||||||||||
   g586        MAAHLEEQQELDNFKYFWKTTGKWLFALLILAALGYLGYTVYQNRAASQNQEAAAVLANI
                  10         20         30         40         50         60

70         80         90        100        110        120
   m586.pep    VEKAQSKAPQSEINAELTKLQQSYPHSISAAQATLMAAATEFDAQRYDVAEGHLKWVLSN
               |||||:|||||||||||||:|||||||||||||||||||||||||||||||||||||||
   g586        VEKAQNKAPQSEINAELSKLQQSYPHSISAAQATLMAAATEFDAQRYDVAEGHLKWVLSN
                  70         80         90        100        110        120

130        140        150        160        170        180
   m586.pep    QKDSLIQALAAQRLGVVLLQQKKYDAALAALDTPVEADFAPLLMETKGDVYAAQGKSQEA
               |||||||||||||||||||||||||||||||||||||||||||||||||||| ||||||
   g586        QKDSLIQALAAQRLGVVLLQQKKYDAALAALDTPVEADFAPLLMETKGDVYAAQEKSQEA
                 130        140        150        160        170        180

190        200        210
   m586.pep    LKNYGQALEKMPQDSVGRELVQMKLDSLKX
               |||||||||||||||||||||:|||||||||
   g586        LKNYGQALEKMPQDSVGRELLQMKLDSLKX
                 190        200        210
```

The following partial DNA sequence was identified in *N. meningitidis* <SEQ ID 1813>:

```
a586.seq
   1 ATGGCAGCCC ATTTGGAAGA ACAACAAGAG TTGGACAACT TTAAATATTT

51 TTGGAAAACC ACGGGCAAAT GGCTGTTTGC CGTGCTGATT TTGGCGGCAC

101 TCGGCTACTT GGGATACACG GTTTACCAAA ACCGTGCGGC TTCCCAAAAT

151 CAGGAAGCGG CGGCGGTGCT GGCAAACATC GTGGAAAAGG CGCAAAACAA

201 AGCCCCGCAA AGCGAAATCA ATGCCGAATT GGCCAAGCTC CAACAAAGCT

251 ACCCCCATTC CATTTCCGCC GCCCAAGCCA CGCTGATGGC GGCAGCAACC

301 GAATTTGACG CGCAGCGTTA CGATGTTGCC GAAGGCCATT TGAAATGGGT

351 ATTGTCCAAC CAAAAAGACA GCCTGATCCA GGCGTTGGCG GCGCAGCGTC

401 TGGGCGTTGT GTTGTTGCAA CAAAAAAAAT ACGATGCCGC GCTTGCCGCA

451 CTCGACACGC CGGTTGAAGC GGACTTCGCC CCCCTGCTGA TGGAAACCAA

501 AGGCGATGTC TATGCCGCAC AGGGAAAAAG CCAGGAAGCC TTAAAAAACT

551 ACGGACAGGC TTTAGAAAAA ATGCCTCAAG ATTCTGTCGG TCGCGAATTG

601 GTTCAAATGA AACTTGATTC GCTGAAATAA
```

This corresponds to the amino acid sequence <SEQ ID 1814; ORF 586.a>:

```
a586.pep

1   MAAHLEEQQE LDNFKYFWKT TGKWLFAVLI LAALGYLGYT VYQNRAASQN

51   QEAAAVLANI VEKAQNKAPQ SEINAELAKL QQSYPHSISA AQATLMAAAT
```

-continued

```
101  EFDAQRYDVA EGHLKWVLSN QKDSLIQALA AQRLGVVLLQ QKKYDAALAA

151  LDTPVEADFA PLLMETKGDV YAAQGKSQEA LKNYGQALEK MPQDSVGREL

201  VQMKLDSLK* m586/a586    97.6% identity in 209 aa overlap 10         20         30         40         50         60
m586.pep   MAAHLEEQQELDNFKYFWKTTGKWLFALLILAALGYLGYTVYQNRKVSQNQEAAAVLANI
           ||||||||||||||||||||||||||||||:|||||||||||||||:|||||||||||||
a586       MAAHLEEQQELDNFKYFWKTTGKWLFAVLILAALGYLGYTVYQNRAASQNQEAAAVLANI
                  10         20         30         40         50         60

70         80         90        100        110        120
m586.pep   VEKAQSKAPQSEINAELTKLQQSYPHSISAAQATLMAAATEFDAQRYDVAEGHLKWVLSN
           |||||:|||||||||||||:||||||||||||||||||||||||||||||||||||||||
a586       VEKAQNKAPQSEINAELAKLQQSYPHSISAAQATLMAAATEFDAQRYDVAEGHLKWVLSN
                  70         80         90        100        110        120

130        140        150        160        170        180
m586.pep   QKDSLIQALAAQRLGVVLLQQKKYDAALAALDTPVEADFAPLLMETKGDVYAAQGKSQEA
           ||||||||||||||||||||||||||||||||||||||||||||||||||||||||||||
a586       QKDSLIQALAAQRLGVVLLQQKKYDAALAALDTPVEADFAPLLMETKGDVYAAQGKSQEA
                 130        140        150        160        170        180

190        200        210
m586.pep   LKNYGQALEKMPQDSVGRELVQMKLDSLKX
           |||||||||||||||||||||||||||||
a586       LKNYGQALEKMPQDSVGRELVQMKLDSLKX
                 190        200        210
```

The following partial DNA sequence was identified in *N. gonorrhoeae* <SEQ ID 1815>:

```
g587.seq..
  1atgaaacgta tcttttttgcc cgccttgccc gccatcctgc ctttatccgc

51ttatgccgac ctgcccttga cgattgaaga cataatgacc gacaagggaa

101aatggaaact ggaaacttcc cttacctatc tgaatagcga aaacagccgc

151gccgcacttg ccgcaccggt ttacattcaa accggcgcaa cctcgtttat

201ccccattccg accgaaattc aagaaaacgg cagcaatacc gatatgctcg

251ccggcacgct cggtttgcgc tacggactga ccggcaatac cgacatttac

301ggcagcggca gctatctgtg gcacgaagaa cgcaaactcg acggcaacgg

351caaaacccgc aacaaacgga tgtccgacat atccgccggc atcagccaca

401ccttccttaa agacggcaaa aaccccgccc taatcagctt tcttgaaagc

451acggtttacg aaaaatcgcg caacaaagcc tcgttaatca aaaaaagggg

501gctttgcccc ttttataact taaggataaa ttatgaatat taa
```

This corresponds to the amino acid sequence <SEQ ID 1816; ORF 587.ng>:

```
g587.pep..
  1 MKRIFLPALP AILPLSAYAD LPLTIEDIMT DKGKWKLETS LTYLNSENSR

51 AALAAPVYIQ TGATSFIPIP TEIQENGSNT DMLAGTLGLR YGLTGNTDIY

101 GSGSYLWHEE RKLDGNGKTR NKRMSDISAG ISHTFLKDGK NPALISFLES

151 TVYEKSRNKA SLIKKRGLCP FYNLRINYEY *
```

The following partial DNA sequence was identified in *N. meningitidis* <SEQ ID 1817>:

```
m587.seq..
  1 ATGAAGCGCA TCTTTTTGCC CGCCTTGCCC GCCATCCTGC CTTTATCCAC

51 TTATGCCGAC CTGCCCTTGA CGATTGAAGA CATAATGACC GACAAGGGAA
```

-continued

```
101 AATGGAAACT GGAAACTTCC CTTACCTACC TGAACAGCGA AAACAACCGC

151 GCCGAACTTG CCGCACCGGT TTACATTCAA ACCGGCGCAA CCTCGTTTAT

201 CCCCATTCCG ACCGAAATCC AAGAAAACGG CAGCAATACC GATATGCTCG

251 TCGGCACGCT CGGTTTGCGC TACGGACTGA CCGGGAATAC CGACATTTAC

301 GGCAGCGGCA GCTATCTGTG GCACGAAGAA CGCAAACTCG ACGGCAACAG

351 CAAAACCCGC AACAAACGGA TGTCCGACGT ATCCCTCGGC ATCAGCCACA

401 CTTTCCTTAA AGACGACAAA AACCCCGCCC TAATCAGCTT TCTTGAAAGC

451 ACGGTTTACG AAAAATCGCG CAACAAAGCC TCGTCGGGAA ATCCTGGCT

501 CATCGGCGCC ACCACCTACA AAGCCATAGA TCCGATTGTC CTTTCCTTCA

551 CCGCCGCCTA CCGCATCAAC GGCAGCAAAA CCCTTTCAGA CGGCATCCGC

601 TACAAATCGG GCAACTACCT GCTGCTCAAC CCCAACATCT CATTTGCTGC

651 CAACGACAGA ATCAGCCTGA CCGGAGGCAT CCAATGGCTG GGCAGGCAGC

701 CCGACCGGAC GGACGGCAAA CGGGAATCCT CCAGAAACAC ATCCACCTAC

751 GCCCATTTCG GCGCAGGTTT CGGTTTCACC AAAACCACGG CTTTAAACGC

801 ATCCGCACGT TTCAACGTTT CAGGGCAAAG CAGTTCCGAA CTGAAATTTG

851 GCGTACAGCA TACATTTTAA
```

This corresponds to the amino acid sequence <SEQ ID 1818; ORF 587>:

```
m587.pep..
  1 MKRIFLPALP AILPLSTYAD LPLTIEDIMT DKGKWKLETS LTYLNSENNR

51 AELAAPVYIQ TGATSFIPIP TEIQENGSNT DMLVGTLGLR YGLTGNTDIY

101 GSGSYLWHEE RKLDGNSKTR NKRMSDVSLG ISHTFLKDDK NPALISFLES

151 TVYEKSRNKA SSGKSWLIGA TTYKAIDPIV LSLTAAYRIN GSKTLSDGIR

201 YKSGNYLLLN PNISFAANDR ISLTGGIQWL GRQPDRTDGK RESSRNTSTY

251 AHFGAGFGFT KTTALNASAR FNVSGQSSSE LKFGVQHTF*
```

Computer analysis of this amino acid sequence gave the following results:
Homology with a Predicted ORF from *N. gonorrhoeae*

```
    m587/g587   95.0% identity in 161 aa overlap 10         20         30         40         50         60
    m587.pep    MKRIFLPALPAILPLSTYADLPLTIEDIMTDKGKWKLETSLTYLNSENNRAELAAPVYIQ
                ||||||||||||||||||:||||||||||||||||||||||||||||||:|| ||||||||
    g587        MKRIFLPALPAILPLSAYADLPLTIEDIMTDKGKWKLETSLTYLNSENSRAALAAPVYIQ
                    10         20         30         40         50         60

70         80         90        100        110        120
    m587.pep    TGATSFIPIPTEIQENGSNTDMLVGTLGLRYGLTGNTDIYGSGSYLWHEERKLDGNSKTR
                ||||||||||||||||||||||||:|||||||||||||||||||||||||||||||||:|||
    g587        TGATSFIPIPTEIQENGSNTDMLAGTLGLRYGLTGNTDIYGSGSYLWHEERKLDGNGKTR
                    70         80         90        100        110        120

130        140        150        160        170        180
    m587.pep    NKRMSDVSLGISHTFLKDDKNPALISFLESTVYEKSRNKASSGKSWLIGATTYKAIDPIV
                ||||||:| |||||||||| |||||||||||||||||||||
    g587        NKRMSDISAGISHTFLKDGKNPALISFLESTVYEKSRNKASLIKKRGLCPFYNLRINYEY
                   130        140        150        160        170        180

190        200        210        220        230        240
    m587.pep    LSLTAAYRINGSKTLSDGIRYKSGNYLLLNPNISFAANDRISLTGGIQWLGRQPDRTDGK g587        X
```

The following partial DNA sequence was identified in *N. meningitidis* <SEQ ID 1819>:

```
a587.seq
   1 ATGAAGCGCA TCTTTTTGCC CGCCTTGCCC GCCATCCTGC CTTTATCCGC

51 TTATGCCGAC CTGCCCTTGA CGATTGAAGA CATAATGACC GACAAGGGCA

101 AATGGAAACT GGAAACTTCC CTTACCTACC TGAACAGCGA AAACAACCGC

151 GCCGAACTTG CCGCACCGGT TTACATCCAA ACCGGCGCAA CCTCGTTTAT

201 CCCCATTCCG ACCGAAATCC AAGAAAACGG CAGCAATACC GATATGCTCG

251 TTGGCACGCT CGGTTTGCGC TACGGACTGA CCGGGAATAC CGACATTTAC

301 GGCAGCGGCA GCTATCTGTG GCACGAAGAA CGCAAACTCG ACGGCAACGG

351 CAAAACCCGA AACAAACGGA TGTCCGACGT ATCCCTCGGC ATCAGCCACA

401 CCTTCCTTAA AGACGACAAA AACCCCGCCC TAATCAGCTT TCTTGAAAGC

451 ACGGTTTACG AAAAATCGCG CAACAAAGCC TCGTCGGGAA AATCCTGGCT

501 CATCGGCGCC ACCACCTACA AAGCCATCGA CCCCGTCGTC CTCTCATTGA

551 CCGCTGCCTA CCGTATCAAC GGCAGCAAAA CCCTTTCAAG CAACACCAAA

601 TACAAAGCAG GCAATTACTG GATGCTGAAT CCCAATATAT CCTTCGCCGC

651 CAACGACAGA ATCAGCCTCA CGGGCGGCAT CCAATGGCTG GGCAAGCAGC

701 CCGACCGTCT GGACGGCAAA AAGAATCCG CAAGAAACAC ATCCACCTAT

751 GCCCATTTCG GCGCAGGTTT CGGTTTCACC AAAACCACGG CTTTAAACGC

801 ATCCGCACGT TTCAACGTTT CAGGGCAAAG CAGTTCCGAA CTGAAATTTG

851 GCGTACAGCA TACGTTTTAA
```

This corresponds to the amino acid sequence <SEQ ID 1820; ORF 587.a>:

```
a587.pep

1  MKRIFLPALP AILPLSAYAD LPLTIEDIMT DKGKWKLETS LTYLNSENNR

51  AELAAPVYIQ TGATSFIPIP TEIQENGSNT DMLVGTLGLR YGLTGNTDIY

101  GSGSYLWHEE RKLDGNGKTR NKRMSDVSLG ISHTLFKDDK NPALISFLES

151  TVYEKSRNKA SSGKSWLIGA TTYKAIDPVV LSLTAAYRIN GSKTLSSNTK

201  YKAGNYWMLN PNISFAANDR ISLTGGIQWL GKQPDRLDGK KESARNTSTY

251  AHFGAGFGFT KTTALNASAR FNVSGQSSSE LKFGVQHTF*
```

```
m587/a587    95.2% identity in 289 aa overlap 10        20        30        40        50        60
m587.pep    MKRIFLPALPAILPLSTYADLPLTIEDIMTDKGKWKLETSLTYLNSENNRAELAAPVYIQ
            ||||||||||||||||:|||||||||||||||||||||||||||||||||||||||||||
a587        MKRIFLPALPAILPLSAYADLPLTIEDIMTDKGKWKLETSLTYLNSENNRAELAAPVYIQ
                     10        20        30        40        50        60

70        80        90       100       110       120
m587.pep    TGATSFIPIPTEIQENGSNTDMLVGTLGLRYGLTGNTDIYGSGSYLWHEERKLDGNSKTR
            ||||||||||||||||||||||||||||||||||||||||||||||||||||||||:|||
a587        TGATSFIPIPTEIQENGSNTDMLVGTLGLRYGLTGNTDIYGSGSYLWHEERKLDGNGKTR
                     70        80        90       100       110       120

130       140       150       160       170       180
m587.pep    NKRMSDVSLGISHTFLKDDKNPALISFLESTVYEKSRNKASSGKSWLIGATTYKAIDPIV
            ||||||||||||||||||||||||||||||||||||||||||||||||||||||||||:|
a587        NKRMSDVSLGISHTFLKDDKNPALISFLESTVYEKSRNKASSGKSWLIGATTYKAIDPVV
                    130       140       150       160       170       180

190       200       210       220       230       240
m587.pep    LSLTAAYRINGSKTLSDGIRYKSGNYLLLNPNISFAANDRISLTGGIQWLGRQPDRTDGK
            ||||||||||||||||:: :||:||| :|||||||||||||||||||||||:|||| |||
a587        LSLTAAYRINGSKTLSSNTKYKAGNYWMLNPNISFAANDRISLTGGIQWLGKQPDRLDGK
                    190       200       210       220       230       240
```

```
                    250        260        270        280        290
m587.pep  RESSRNTSTYAHFGAGFGFTKTTALNASARFNVSGQSSSELKFGVQHTFX
          :||:||||||||||||||||||||||||||||||||||||||||||||||
a587      KESARNTSTYAHFGAGFGFTKTTALNASARFNVSGQSSSELKFGVQHTFX
                    250        260        270        280        290
```

The following partial DNA sequence was identified in *N. gonorrhoeae* <SEQ ID 1821>:

```
g588.seq
   1 atgcttaaac atctcgcatt cctactgccc gccatgatgt tcgccctccc 51 cgcccagacc gccgtcctaa gcccctatca ggaaaccggc tgcacctacg 101 aaggcgggat cggaaaagac gggcttcctt caggcaaagg catatggcgt 151 tgccgggatg ggcgcggtta taccggttca ttcaaaaacg gcaaattcga 201 cgggcaaggc gtttataccg ttgccgccgg ccgcgaagta tttctcgagc 251 cgttcaattc cgacagtacc aaattccgca atatggcatt gtcgggcacg 301 ttcaaacaag gcttggcaca cggcaggttc gccgcctcgc aaaacggcga 351 aaccctcttt tattatgaaa tgcgaacacg gcatgattaa
```

This corresponds to the amino acid sequence <SEQ ID 1822; ORF 588.ng>:

```
g588.pep..
   1 MLKHLAFLLP AMMFALPAQT AVLSPYQETG CTYEGGIGKD GLPSGKGIWR

51 CRDGRGYTGS FKNGKFDGQG VYTVAAGREV FLEPFNSDST KFRNMALSGT

101 FKQGLAHGRF AASQNGETLF YYEMRTRHD*
```

The following partial DNA sequence was identified in *N. meningitidis* <SEQ ID 1823>:

```
m588.seq..
   1 ATGCTTAAAC ATCTCGCATT CCTACTGCCC GCCATGATGT TCGCCCTCCC

51 CACTTCGGCC GCCGTCCTGA CTTCCTATCA AGAACCAGGC TGCACCTACG

101 ACGGCAATGT CGGCAAAGAC GGTAAACCCG CCGGCAAAGG CACATGGCGC

151 TGCCAAGACG GGCGCAACTA TACCGGTTCG TTTAAAAACG GCAAATTCGA

201 CGGGCAAGGC GTTTATACCG TTGCCGCCAA CCGCGAAATA TTTATCGAAC

251 CGTTCAATTC CGACAGTACC AAATTCCGCA ACATGGTACT CTCGGGCACG

301 TTCAAAAAAG GCTTGGCACA CGGCAGATTT ACCGTCTCGC AAAACGGCGA

351 AACCCTCTTC ATTATGAAAT GCGAAAACGG CATGATTAAA GAAGTGAAAC

401 TGCCCAAAAA CAAATAA
```

This corresponds to the amino acid sequence <SEQ ID 1824; ORF 588>:

```
m588.pep..
   1 MLKHLAFLLP AMMFALPTSA AVLTSYQEPG CTYDGNVGKD GKPAGKGTWR

51 CQDGRNYTGS FKNGKFDGQG VYTVAANREI FIEPFNSDST KFRNMVLSGT

101 FKKGLAHGRF TVSQNGETLF IMKCENGMIK EVKLPKNK*
```

Computer analysis of this amino acid sequence gave the following results:

Homology with a Predicted ORF from *N. gonorrhoeae*

```
   m588/g588    82.5% identity in 120 aa overlap 10         20         30         40         50         60
   m588.pep    MLKHLAFLLPAMMFALPTSAAVLTSYQEPGCTYDGNVGKDGKPAGKGTWRCQDGRNYTGS
               ||||||||||||||||:::|||:  |||  ||||:|::||||  |:|||  |||:|||:||||
   g588        MLKHLAFLLPAMMFALPAQTAVLSPYQETGCTYEGGIGKDGLPSGKGIWRCRDGRGYTGS
                     10         20         30         40         50         60

70         80         90        100        110        120
   m588.pep    FKNGKFDGQGVYTVAANREIFIEPFNSDSTKFRNMVLSGTFKKGLAHGRFTVSQNGETLF
               ||||||||||||||||:||:||||||||||||||||:|||||:|||||||:::|||||||
   g588        FKNGKFDGQGVYTVAAGREVFLEPFNSDSTKFRNMALSGTFKQGLAHGRFAASQNGETLF
                     70         80         90        100        110        120

130        139
   m588.pep    IMKCENGMIKEVKLPKNKX g588        YYEMRTRHDX
                    130
```

The following partial DNA sequence was identified in *N. meningitidis* <SEQ ID 1825>:

```
a588.seq
  1 ATGCTTAAAC ATCTCGCATT CCTACTGCCC GCCATGATGT TCGCCCTCCC

51 CGCCGCGTCC GCCGTTCTGA CTTCCTATCA AGAACCCGGC TGCACCTACG

101 AAGGCGATGT CGGCAAAGAC GGTAAACCCG CCGGCAAAGG CACATGGCGC

151 TGCCAAGACG GCGCAACTA TACCGGTTCG TTTAAAAATG GCAAATTCGA

201 CGGACAAGGC GTTTATACCG TTGCCGCCAA CCGCGAAATA TTTATCGAAC

251 CGTTCAATTC CGACAGTACC AAATTCCGCA ACATGGTACT CTCGGGCACA

301 TTCAAAAAAG GCTTGGCACA CGGCAGATTT ACCGTCTCGC AAAACGGCGA

351 AACCCTCTTC ATTATGAAAT GCGAAAACGG CATGATTAAA GAAGTGAAGC

401 TGCCCAAAAA CAAATAA
                                                      40
```

This corresponds to the amino acid sequence <SEQ ID 1826; ORF 588.a>:

```
a588.pep

1   MLKHLAFLLP AMMFALPAAS AVLTSYQEPG CTYEGDVGKD GKPAGKGTWR

51   CQDGRNYTGS FKNGKFDGQG VYTVAANREI FIEPFNSDST KFRNMVLSGT

101   FKKGLAHGRF TVSQNGETLF IMKCENGMIK EVKLPKNK* m588/a588    96.4% identity in 138 aa overlap 10         20         30         40         50         60
   m588.pep    MLKHLAFLLPAMMFALPTSAAVLTSYQEPGCTYDGNVGKDGKPAGKGTWRCQDGRNYTGS
               ||||||||||||||||:::||||||||||||||:|:||||||||||||||||||||||||
   a588        MLKHLAFLLPAMMFALPAASAVLTSYQEPGCTYEGDVGKDGKPAGKGTWRCQDGRNYTGS
                     10         20         30         40         50         60

70         80         90        100        110        120
   m588.pep    FKNGKFDGQGVYTVAANREIFIEPFNSDSTKFRNMVLSGTFKKGLAHGRFTVSQNGETLF
               ||||||||||||||||||||:|||||||||||||||||||||||||||||||||||||||
   a588        FKNGKFDGQGVYTVAANREIFLEPFNSDSTKFRNMVLSGTFKKGLAHGRFTVSQNGETLF
                     70         80         90        100        110        120

130        139
   m588.pep    IMKCENGMIKEVKLPKNKX
               ||||||||||||||||||
   a588        IMKCENGMIKEVKLPKNKX
                    130
```

The following partial DNA sequence was identified in *N. gonorrhoeae* <SEQ ID 1827>:

```
g589.seq..
    1 atgcaacaaa aaatccgttt ccaaatcgag gcgatgacct gtcaggcatg
   51 tgcttcgcgc attgaaaaag tgttgaacaa aaaagattt gtcgaatcgg
  101 cgggagtgaa ctttgccagt gaggaagcgc aggttacgtt tgacggcagc
  151 aaaacctcgg ttgccgacat tgccaaaatc attgagaaaa ccggttacgg
  201 cgcgaaggaa aaaacggaag atacattgcc gcaacctgaa gcagaacacc
  251 atatcggctg gcggttgtgg cttttgctga ccatcaatat cccgttcctt
  301 atcggtatgg tagggatgat gctaaaaggg ctgaattgga cacggcacga
  351 ttggatgatt ccgcctgtat ggcagtttgt actggcaagc atagtgcaac
  401 tttggctggc aatcccgttt tacaaaagcg cgtgggcaag cattaaaggc
  451 gggctggcga atatggacgt actcgttacc atcggcacgg tgtcgattta
  501 cctgtattcc gtttatatgc tgttttttcag ttcgcatgcg gcgcacggta
  551 tggcgcatgt gtattttgaa gcgggcgtga tggtgatcgg ttttgtgtcg
  601 ctgggtaagt ttttggaaca ccgcaccaaa aaatccagcc tgaacagctt
  651 gggcttactg ctaaaactca cgccgaccca agtcaacgtg caacgcaacg
  701 gcgaatggaa acaactgccc atcgaccaag tgcaaatcgg cgaccttatc
  751 cgcaccaacc acggcgaacg catcgctgcc gacggcatta tcgaaagcgg
  801 cagcggttgg gcggacgaaa gccaccttac cggcgaatcc aatcccgaag
  851 agaaaaaggc gggcggcaaa gtgttggcgg gcgcgctgat gaccgaaggc
  901 agcgtggtgt accgcgccgc gcagctcggc agccaaaccc tgctcggcga
  951 catgatgaac gcgctctctg aagcacaagg cagtaaagca ccgattgcgc
 1001 gcgtggccga taaagcggcg gcggtatttg tgccaactgt cgtgggcatc
 1051 gcgcttctga cttttatcgt tgcttggctg attaagggcg attggacggt
 1101 cgcactgatg cacgccgttg ccgttttggt gattgcctgc ccgtgcgcgc
 1151 tcggtctggc gacccctgcc gcgattatgg tcggcatggg caaagcggtg
 1201 aaacacggca tttggtttaa agacgcggcg gcaatggagg aagcagccca
 1251 cgtcgatgcc gtcgtattgg acaaaaccgg tacgctgacc gaaggcaggc
 1301 cgcaggttgc cgccgtttat tacgttcccg acagcggctt tgacgaagac
 1351 gctttgtacc gcatcgccgc cgccgtcgag caaaacgccg cccacccgct
 1401 cgcccgcgcc atcgtctccg ccgcacaagc gcgcggtttg gagattcccg
 1451 ctgcacaaaa tgcgcaaacc gttgtcggag caggcattac cgccgaagtg
 1501 gaaggcgtgg gtttggtgaa atcaggcaaa gccgaatttg ccgaactgac
 1551 cttgccgaag ttttcagacg gcgtttggga aatcgccagt gcggttaccg
 1601 tatctgtaaa cggcaaaccg atcggcgcat tcgcactctc cgacgcgttg
 1651 aaagccgata ccgccgaagc cataggccgt ctgaaaaaac acaatatcga
 1701 tgtctatatt atgagcggcg ataaccaaag tacggtcgaa tacgtcgcca
 1751 aacaactggg catcgcacac gccttcggta atatgagtcc gtgcgacaaa
 1801 gccgccgaag tgcagaaact caaagccgcc ggcaaaaccg tggcgatggt
 1851 cggcgacggc atcaacgacg cgcccgcgct tgccgccgcc aacgtcagct
 1901 tcgccatgaa aggcggtgcg gacgttgccg aacacaccgc ctccgccacg
```

-continued

```
1951 ctgatgcagc attcggtcaa tcagctcgcc gatgccctgc tgatatcgca
2001 ggcaacgttg gaaaacatca agcaaaacct atttttcgcc ttcttctaca
2051 atatattggg cattccgctc gccgcgctcg gctttttaaa tcccgtcata
2101 gcaggcgcgg caatggcggc aagctcggtt tcggtattgg gcaatgccct
2151 gcgcctgaaa tgggtaaaaa tcgattga
```

This corresponds to the amino acid sequence <SEQ ID 1828; ORF 589.ng>:

```
g589.pep..
  1 MQQKIRFQIE AMTCQACASR IEKVLNKKDF VESAGVNFAS EEAQVTFDGS
 51 KTSVADIAKI IEKTGYGAKE KTEDTLPQPE AEHHIGWRLW LLLTINIPFL
101 IGMVGMMLKG LNWTRHDWMI PPVWQFVLAS IVQLWLAIPF YKSAWASIKG

151 GLANMDVLVT IGTVSIYLYS VYMLFFSSHA AHGMAHVYFE AGVMVIGFVS

201 LGKFLEHRTK KSSLNSLGLL LKLTPTQVNV QRNGEWKQLP IDQVQIGDLI

251 RTNHGERIAA DGIIESGSGW ADESHLTGES NPEEKKAGGK VLAGALMTEG

301 SVVYRAAQLG SQTLLGDMMN ALSEAQGSKA PIARVADKAA AVFVPTVVGI

351 ALLTFIVAWL IKGDWTVALM HAVAVLVIAC PCALGLATPA AIMVGMGKAV

401 KHGIWFKDAA AMEEAAHVDA VVLDKTGTLT EGRPQVAAVY YVPDSGFDED

451 ALYRIAAAVE QNAAHPLARA IVSAAQARGL EIPAAQNAQT VVGAGITAEV

501 EGVGLVKSGK AEFAELTLPK FSDGVWEIAS AVTVSVNGKP IGAFALSDAL

551 KADTAEAIGR LKKHNIDVYI MSGDNQSTVE YVAKQLGIAH AFGNMSPCDK

601 AAEVQKLKAA GKTVAMVGDG INDAPALAAA NVSFAMKGGA DVAEHTASAT

651 LMQHSVNQLA DALLISQATL ENIKQNLFFA FFYNILGIPL AALGFLNPVI

701 AGAAMAASSV SVLGNALRLK WVKID*
```

The following partial DNA sequence was identified in *N. meningitidis* <SEQ ID 1829>:

```
m589.seq..
  1 ATGCAACAAA AAATCCGTTT CCAAATCGAA GGCATGACCT GCCAGGCCTG
 51 CGCTTCGCGC ATTGAAAAAG TGTTGAACAA AAAAGATTTT GTCGAATCGG
101 CGGGGGTAAA CTTCGCCAGC GAAGAGGCGC AGGTAGTGTT TGACGACAGC
151 AAAACCTCAG TAGCCGACAT TGCCAAAATC ATTGAGAAAA CCGGTTACGG
201 CGCGAAGGAA AAAACGGAAG ATACATTGCC GCAACCCGAA GCAGAACACC
251 ATATCGGCTG GCGGCTGTGG CTGCTGTTCA CCATCAACGT CCCGTTCCTT
301 ATCGGCATGG CGGGGATGAT GATCGGCAGA CACGATTGGA TGATTCCGCC
351 GTTGTGGCAG TTCGCATTGG CAAGCGTGGT GCAGCTTTGG CTGGCAATCC
401 CGTTTTACAA AAGCGCGTGG GCGAGCATTA AGGGCGGACT GGCGAATATG
451 GACGTGCTGG TTACCATCGG CACGGTCTCG ATTTACCTGT ATTCCGTCTA
501 TATGCTGTTT TTCAGCCCGC ACGCGGCGTA CGGTATGGCG CATGTGTATT
551 TTGAAGTGGG CGTGATGGTG ATCGGTTTTG TGTCACTGGG TAAATTTTTG
601 GAACACCGTA CCAAAAAATC CAGCCTCAAC AGCTTGGGCT TGCTGCTCAA
651 ACTTACACCA ACCCAAGTCA ACGTGCAACG CAACGGCGAA TGGAAACAGC
```

-continued

```
 701 TTCCCATCGA CCAAGTGCAA ATCGGCGACC TTATCCGCGC CAACCACGGC

751 GAACGCATTG CCGCAGACGG CATCATTGAA AGCGGCAGCG GTTGGGCGGA

801 CGAGAGCCAT CTTACCGGCG AATCCAATCC TGAAGAAAAA AAGGCGGGCG

851 GCAAAGTGTT GGCGGGCGCG TTAATGACCG AAGGCAGTGT GGTGTACCGC

901 GCCACGCAGC TCGGCAGCCA AACCCAGCTC GGCGACATGA TGAACGCGCT

951 CTCTGAAGCA CAAGGCAGTA AAGCACCGAT TGCGCGCGTA GCCGATAAAG

1001 CGGCTGCGGT ATTCGTGCCT GCCGTCGTGG GCATTGCGTT GTTGACTTTT

1051 ATTGTTACTT GGCTGATTAA GGGCGATTGG ACGGTTGCGC TGATGCACGC

1101 CGTCGCCGTT TTGGTGATTG CCTGCCCGTG CGCGCTGGGT CTGGCAACCC

1151 CTGCCGCGAT TATGGTCGGT ATGGGCAAAG CGGTTAAACA CGGTATTTGG

1201 TTTAAAGACG CGGCAGCAAT GGAGGAAGCC GCCCACGTCG ATGCCGTCGT

1251 GTTGGACAAA ACCGGTACGC TGACCGAAGG CAGCCCGCAG GTTGCCGCCG

1301 TTTATTGCGT TCCCGACAGC GGCTTTGACG AAGACGCTTT GTACCGCATC

1351 GCCGCCGCCG TCGAACAAAA CGCCGCCCAT CCGCTCGCCC GTGCCATCGT

1401 CTCCGCCGCC CAAGCGCGCG GTTTGGACAT TCCCGCCGCA CAAAACGCAC

1451 AAACCGTTGT CGGCGCAGGC ATTACCGCCG AAGTGGAAGG CGTGGGTTTG

1501 GTGAAAGCAG GCAAAGCCGA ATTTGCCGAA CTGGCCTTGC CGAAGTTTTT

1551 AGACGGCGTT TGGGATATTG CAAGCATTGT TGCGGTCTCA GTCGATAACA

1601 AACCCATCGG CGCATTCGCA CTTGCCGACG CGTTGAAAGC CGATACCGCC

1651 GAAGCCATAG GCCGTCTGAA AAAACACAAT ATCGATGTCT ATATTATGAG

1701 CGGCGACAAC CAAGGCACGG TCGAATACGT CGCCAAACAA CTGGGCATCG

1751 CACACGCCTT CGGCAACATG AGTCCGCGCG ATAAAGCTGC CGAAGTGCAA

1801 AAACTCAAAG CCGCCGGCAA AACCGTGGCG ATGGTCGGCG ACGGCATCAA

1851 CGACGCGCCC GCGCTTGCCG CCGCTAACGT CAGCTTCGCC ATGAAAGGCG

1901 GAGCGGACGT TGCCGAACAT ACCGCATCCG CCACGCTGAT GCAGCATTCG

1951 GTCAACCAAC TCGCCGATGC TCTGCTGGTG TCGCAAGCCA CTTTGAAAAA

2001 CATCAAGCAA AACCTGTTTT TCGCCTTCTT CTACAATATT TTGGGCATTC

2051 CTCTCGCCGC GCTTGGCTTT TTAAATCCCG TCATCGCTGG CGCGGCAATG

2101 GCGGCAAGCT CGGTTTCCGT GTTGAGCAAT GCCTTGCGCC TGAAACGGGT

2151 AAAAATCGAT TAG
```

This corresponds to the amino acid sequence <SEQ ID 1830; ORF 589>:

```
m589.pep..
  1 MQQKIRFQIE GMTCQACASR IEKVLNKKDF VESAGVNFAS EEAQVVFDDS

51 KTSVADIAKI IEKTGYGAKE KTEDTLPQPE AEHHIGWRLW LLFTINVPFL

101 IGMAGMMIGR HDWMIPPLWQ FALASVVQLW LAIPFYKSAW ASIKGGLANM

151 DVLVTIGTVS IYLYSVYMLF FSPHAAYGMA HVYFEVGVMV IGFVSLGKFL

201 EHRTKKSSLN SLGLLLKLTP TQVNVQRNGE WKQLPIDQVQ IGDLIRANHG

251 ERIAADGIIE SGSGWADESH LTGESNPEEK KAGGKVLAGA LMTEGSVVYR

301 ATQLGSQTQL GDMMNALSEA QGSKAPIARV ADKAAVFVP AVVGIALLTF
```

```
351 IVTWLIKGDW TVALMHAVAV LVIACPCALG LATPAAIMVG MGKAVKHGIW

401 FKDAAAMEEA AHVDAVVLDK TGTLTEGSPQ VAAVYCVPDS GFDEDALYRI

451 AAAVEQNAAH PLARAIVSAA QARGLDIPAA QNAQTVVGAG ITAEVEGVGL

501 VKAGKAEFAE LALPKFLDGV WDIASIVAVS VDNKPIGAFA LADALKADTA

551 EAIGRLKKHN IDVYIMSGDN QGTVEYVAKQ LGIAHAFGNM SPRDKAAEVQ

601 KLKAAGKTVA MVGDGINDAP ALAAANVSFA MKGGADVAEH TASATLMQHS

651 VNQLADALLV SQATLKNIKQ NLFFAFFYNI LGIPLAALGF LNPVIAGAAM

701 AASSVSVLSN ALRLKRVKID *
```

15

Computer analysis of this amino acid sequence gave the following results:
Homology with a Predicted ORF from *N. gonorrhoeae*

```
    m589/g589 94.2% identity in 725 aa overlap 10         20         30         40         50         60
    m589.pep  MQQKIRFQIEGMTCQACASRIEKVLNKKDFVESAGVNFASEEAQVVFDDSKTSVADIAKI
              ||||||||||:|||||||||||||||||||||||||||||||||:||  ||||||||||
    g589      MQQKIRFQIEAMTCQACASRIEKVLNKKDFVESAGVNFASEEAQVTFDGSKTSVADIAKI
                  10         20         30         40         50         60

70         80         90        100          1        110
    m589.pep  IEKTGYGAKEKTEDTLPQPEAEHHIGWRLWLLFTINVPFLIGMAGMMIG-----RHDWMI
              |||||||||||||||||||||||||||||||:|||:||||||:|||           ||||||
    g589      IEKTGYGAKEKTEDTLPQPEAEHHIGWRLWLLLTINIPFLIGMVGMMLKGLNWTRHDWMI
                  70         80         90        100        110        120

120        130        140        150        160        170
    m589.pep  PPLWQFALASVVQLWLAIPFYKSAWASIKGGLANMDVLVTIGTVSIYLYSVYMLFFSPHA
              ||:|||:|||:||||||||||||||||||||||||||||||||||||||||||||||| ||
    g589      PPVWQFVLASIVQLWLAIPFYKSAWASIKGGLANMDVLVTIGTVSIYLYSVYMLFFSSHA
                 130        140        150        160        170        180

180        190        200        210        220        230
    m589.pep  AYGMAHVYFEVGVMVIGFVSLGKFLEHRTKKSSLNSLGLLLKLTPTQVNVQRNGEWKQLP
              |:||||||||:|||||||||||||||||||||||||||||||||||||||||||||||||
    g589      AHGMAHVYFEAGVMVIGFVSLGKFLEHRTKKSSLNSLGLLLKLTPTQVNVQRNGEWKQLP
                 190        200        210        220        230        240

240        250        260        270        280        290
    m589.pep  IDQVQIGDLIRANHGERIAADGIIESGSGWADESHLTGESNPEEKKAGGKVLAGALMTEG
              |||||||||||:|||||||||||||||||||||||||||||||||||||||||||||||
    g589      IDQVQIGDLIRTNHGERIAADGIIESGSGWADESHLTGESNPEEKKAGGKVLAGALMTEG
                 250        260        270        280        290        300

300        310        320        330        340        350
    m589.pep  SVVYRATQLGSQTQLGDMMNALSEAQGSKAPIARVADKAAAVFVPAVVGIALLTFIVTWL
              ||||||:|||||||:|||||||||||||||||||||||||||||:|||||||||:||
    g589      SVVYRAAQLGSQTLLGDMMNALSEAQGSKAPIARVADKAAAVFVPTVVGIALLTFIVAWL
                 310        320        330        340        350        360

360        370        380        390        400        410
    m589.pep  IKGDWTVALMHAVAVLVIACPCALGLATPAAIMVGMGKAVKHGIWFKDAAAMEEAAHVDA
              ||||||||||||||||||||||||||||||||||||||||||||||||||||||||||||
    g589      IKGDWTVALMHAVAVLVIACPCALGLATPAAIMVGMGKAVKHGIWFKDAAAMEEAAHVDA
                 370        380        390        400        410        420

420        430        440        450        460        470
    m589.pep  VVLDKTGTLTEGSPQVAAVYCVPDSGFDEDALYRIAAAVEQNAAHPLARAIVSAAQARGL
              |||||||||||| |||||| ||||||||||||||||||||||||||||||||||||||||
    g589      VVLDKTGTLTEGRPQVAAVYYVPDSGFDEDALYRIAAAVEQNAAHPLARAIVSAAQARGL
                 430        440        450        460        470        480

480        490        500        510        520        530
    m589.pep  DIPAAQNAQTVVGAGITAEVEGVGLVKAGKAEFAELALPKFLDGVWDIASIVAVSVDNKP
              :|||||||||||||||||||||||||||:||||||||:||||:|||  |||:|||:::||
    g589      EIPAAQNAQTVVGAGITAEVEGVGLVKSGKAEFAELTLPKFSDGWEIASAVTVSVNGKP
                 490        500        510        520        530        540

540        550        560        570        580        590
    m589.pep  IGAFALADALKADTAEAIGRLKKHNIDVYIMSGDNQGTVEYVAKQLGIAHAFGNMSPRDK
              |||||||:||||||||||||||||||||||||||:|||||||||||||||||||||| ||
    g589      IGAFALSDALKADTAEAIGRLKKHNIDVYIMSGDNQSTVEYVAKQLGIAHAFGNMSPCDK
                 550        560        570        580        590        600

600        610        620        630        640        650
    m589.pep  AAEVQKLKAAGKTVAMVGDGINDAPALAAANVSFAMKGGADVAEHTASATLMQHSVNQLA
              ||||||||||||||||||||||||||||||||||||||||||||||||||||||||||||
    g589      AAEVQKLKAAGKTVAMVGDGINDAPALAAANVSFAMKGGADVAEHTASATLMQHSVNQLA
                 610        620        630        640        650        660
```

-continued

```
              660        670        680        690        700        710
m589.pep DALLVSQATLKNIKQNLFFAFFYNILGIPLAALGFLNPVIAGAAMAASSVSVLSNALRLK
         ||||:|||||:||||||||||||||||||||||||||||||||||||||||:||||||
g589     DALLISQATLENIKQNLFFAFFYNILGIPLAALGFLNPVIAGAAMAASSVSVLGNALRLK
                 670        680        690        700        710        720

720
m589.pep RVKIDX
          |||||
g589     WVKIDX
```

The following partial DNA sequence was identified in *N. meningitidis* <SEQ ID 1831>:

```
a589.seq
   1 ATGCAACAAA AAGTCCGTTT CCAAATCGAA GGCATGACCT GCCAGGCATG

51 TGCTTCGCGC ATTGAAAAAG TGTTGAACAA AAAAGATTTT GTCGAATCGG

101 CGGGGGTAAA CTTCGCCAGC GAAGAGGCTC AGGTAGTGTT TGACGACAGC

151 AAAACCTCAG TAGCCGACAT TGCCAAAATC ATTGAGAAAA CCGGTTACGG

201 CGCGAAGGAA AAAACGGAAG ATACATTGCC GCAACCCGAA GCAGAACACC

251 ATATCGGCTG GAGGTTGTGG CTTTTGCTGG CCATCAATAT CCCGTTCCTT

301 ATCGGTATGG TAGGGATGAT GCTAAAAGGG CTGAATTGGA CACGGCATGA

351 TTGGATGTTG TCGCCCTTGT TGCAGTTTGC ATTGGCGAGT GTGGTGCAGC

401 TTTGGCTGGC GGTGCCATTT TACAAAAGCG CGTGGGCGAG CATTAAAGGC

451 GGGCTGGCGA ATATGGACGT ACTCGTTACC ATCGGCACGG TCTCGATTTA

501 CCTGTATTCC GTCTATATGC TGTTTTTCAG CCCGCACGCG GCGTACGGTA

551 TGGCGCATGT GTATTTTGAA GTAGGCATAA TGGTGATTGG TTTTGTGTCA

601 CTGGGTAAAT TTTTGGAACA CCGCACCAAA AAATCCAGCC TGAACAGCTT

651 GGGCTTGCTG CTCAAACTCA CGCCAACCCA AGTCAACGTG CAACGCGATG

701 GCGAATGGCG GCAGCTACCC ATCGACCAAG TGCAAATCGG CGACCTAATC

751 CGCGCCAATC ACGGCGAACG CATTGCCGCC GACGGCATCA TAGAAAGCGG

801 CAGCGGCTGG GCGGACGAAA GCCATCTTAC CGGCGAATCC AATCCCGAAG

851 AGAAAAAGGC AGGCGGCAAA GTATTGGCGG GCGCGCTGAT GACTGAAGGC

901 AGCGTGGTGT ACCGCGCCGC GCAGCTCGGC AGCCAAACCC TGCTCGGCGA

951 CATGATGAAC GCGCTCTCCG AAGCGCAAGG CAGTAAAGCA CCGATTGCGC

1001 GTGTGGCGGA CAAGGCGGCG GCGGTATTCG TGCCTGCCGT TGTGGGCATC

1051 GCACTTTTGA CTTTTATCGC TACTTGGCTG ATTAAGGGCG ATTGGACGCT

1101 CGCATTGATG CACGCCGTCG CCGTTTTGGT GATTGCCTGC CCGTGTGCAC

1151 TCGGTTTGGC AACCCCTGCT GCGATTATGG TCGGTATGGG CAAAGCGGTT

1201 AAACACGGTA TTTGGTTTAA AGACGCGGCA GCAATGGAAG AAGCCGCCCA

1251 CGTTGATGCC GTCGTGCTGG ACAAAACCGG CACGCTGACC GAAGGCAAGC

1301 CGCAGGTTGC CGCCGTTTAT TGTGTTCCCG ACAGCGGCTT TGACGAAGAC

1351 GCTTTGTACC GCATCGCCGC CGCCGTCGAA CAAAACGCCG CCCATCCGCT

1401 CGCCCGTGCC ATCGTCTCCG CCGCCCAGGC GCGCGGTTTG GAGATTCCCA

1451 CCGCACAAAA TGCCCAAACC ATTGTCGGCG CGGGCATTAC CGCCGAAGTA

1501 AAAGGCGCGG GTTTGGTAAA AGCAGGCAAA GCCGAATTTG CCGAACTGAC

1551 CTTGCCGAAG TTTTCAGACG GCGTTTGGGA AATCGCCAGT GTGGTTGCCG
```

-continued

```
1601 TATCTGTAAA CGGCAAACCT ATCGGCGCAT TCGCACTCGC CGACGCGTTG

1651 AAAGCCGATA CCGCCGAAGC CATAGGCCGT CTGAAAAAAC ACAATATCGA

1701 TGTCTATATT ATGAGCGGCG ATAACCAAGG CACGGTCGAG TACGTCGCCA

1751 AACAACTGGG CATCGCACAC GCCTTCGGTA ATATGAGTCC GCGCGACAAA

1801 GCCGCCGAAG TGCAGAAACT CAAAGCCGCC GGCAAAACCG TGGCGATGGT

1851 CGGCGACGGC ATCAACGACG CGCCCGCGCT CGCCGCCGCC AACGTCAGCT

1901 TCGCCATGAA AGGCGGTGCA GACGTTGCCG AACACACCGC ATCCGCCACA

1951 CTGATGCAGC ATTCGGTCAA CCAGCTCGCC GATGCGCTAT CGGTATCGCG

2001 AGCGACGTTG AAAAACATCA AGCAAAACCT GTTTTTCGCC TTCTTCTACA

2051 ATATTTTGGG CATTCCGCTC GCCGCGCTCG GCTTTTTAAA CCCCGTCATC

2101 GCAGGCGCGG CAATGGCGGC AAGCTCGGTT CCGTGTTGA GCAACGCCTT

2151 GCGCCTGAAA CGGGTAAAAA TCGATTGA
```

This corresponds to the amino acid sequence <SEQ ID 1832; ORF 589.a>:

```
a589.pep

1 MQQKVRFQIE GMTCQACASR IEKVLNKKDF VESAGVNFAS EEAQVVFDDS

51 KTSVADIAKI IEKTGYGAKE KTEDTLPQPE AEHHIGWRLW LLLAINIPFL

101 IGMVGMMLKG LNWTRHDWML SPLLQFALAS VVQLWLAVPF YKSAWASIKG

151 GLANMDVLVT IGTVSIYLYS VYMLFFSPHA AYGMAHVYFE VGIMVIGFVS

201 LGKFLEHRTK KSSLNSLGLL LKLTPTQVNV QRDGEWRQLP IDQVQIGDLI

251 RANHGERIAA DGIIESGSGW ADESHLTGES NPEEKKAGGK VLAGALMTEG

301 SVVYRAAQLG SQTLLGDMMN ALSEAQGSKA PIARVADKAA AVFVPAVVGI

351 ALLTFIATWL IKGDWTLALM HAVAVLVIAC PCALGLATPA AIMVGMGKAV

401 KHGIWFKDAA AMEEAAHVDA VVLDKTGTLT EGKPQVAAVY CVPDSGFDED

451 ALYRIAAAVE QNAAHPLARA IVSAAQARGL EIPTAQNAQT IVGAGITAEV

501 KGAGLVKAGK AEFAELTLPK FSDGVWEIAS VVAVSVNGKP IGAFALADAL

551 KADTAEAIGR LKKHNIDVYI MSGDNQGTVE YVAKQLGIAH AFGNMSPRDK

601 AAEVQKLKAA GKTVAMVGDG INDAPALAAA NVSFAMKGGA DVAEHTASAT

651 LMQHSVNQLA DALSVSRATL KNIKQNLFFA FFYNILGIPL AALGFLNPVI

701 AGAAMAASSV SVLSNALRLK RVKID* m589/a589 94.9% identity in 725 aa overlap 10          20         30         40         50        60
 m589.pep  MQQKIRFQIEGMTCQACASRIEKVLNKKDFVESAGVNFASEEAQVVFDDSKTSVADIAKI
           ||||:|||||||||||||||||||||||||||||||||||||||||||||||||||||||
 a589      MQQKVRFQIEGMTCQACASRIEKVLNKKDFVESAGVNFASEEAQVVFDDSKTSVADIAKI
                10          20         30         40         50        60

70          80         90        100        1        110
 m589.pep  IEKTGYGAKEKTEDTLPQPEAEHHIGWRLWLLFTINVPFLIGMAGMMIG-----RHDWMI
           ||||||||||||||||||||||||||||||||::||:||||||:|||:       ||||:
 a589      IEKTGYGAKEKTEDTLPQPEAEHHIGWRLWLLLAINIPFLIGMVGMMLKGLNWTRHDWML
                70          80         90        100       110       120

120          130        140        150        160      170
 m589.pep  PPLWQFALASVVQLWLAIPFYKSAWASIKGGLANMDVLVTIGTVSIYLYSVYMLFFSPHA
           ||:|||||||||||||||:|||||||||||||||||||||||||||||||||||||||||
 a589      SPLLQFALASVVQLWLAVPFYKSAWASIKGGLANMDVLVTIGTVSIYLYSVYMLFFSPHA
               130          140        150        160        170      180
```

```
                180       190       200       210       220       230
m589.pep  AYGMAHVYFEVGVMVIGFVSLGKFLEHRTKKSSLNSLGLLLKLTPTQVNVQRNGEWKQLP
          ||||||||||||:|||||||||||||||||||||||||||||||||||||||:|||:|||
a589      AYGMAHVYFEVGIMVIGFVSLGKFLEHRTKKSSLNSLGLLLKLTPTQVNVQRDGEWRQLP
                190       200       210       220       230       240

240       250       260       270       280       290
m589.pep  IDQVQIGDLIRANHGERIAADGIIESGSGWADESHLTGESNPEEKKAGGKVLAGALMTEG
          ||||||||||||||||||||||||||||||||||||||||||||||||||||||||||||
a589      IDQVQIGDLIRANHGERIAADGIIESGSGWADESHLTGESNPEEKKAGGKVLAGALMTEG
                250       260       270       280       290       300

300       310       320       330       340       350
m589.pep  SVVYRATQLGSQTQLGDMMNALSEAQGSKAPIARVADKAAAVFVPAVVGIALLTFIVTWL
          ||||||:||||||:||||||||||||||||||||||||||||||||||||||||:|:|||
a589      SVVYRAAQLGSQTLLGDMMNALSEAQGSKAPIARVADKAAAVFVPAVVGIALLTFIATWL
                310       320       330       340       350       360

360       370       380       390       400       410
m589.pep  IKGDWTVALMHAVAVLVIACPCALGLATPAAIMVGMGKAVKHGIWFKDAAAMEEAAHVDA
          |||||:||||||||||||||||||||||||||||||||||||||||||||||||||||||
a589      IKGDWTLALMHAVAVLVIACPCALGLATPAAIMVGMGKAVKHGIWFKDAAAMEEAAHVDA
                370       380       390       400       410       420

420       430       440       450       460       470
m589.pep  VVLDKTGTLTEGSPQVAAVYCVPDSGFDEDALYRIAAAVEQNAAHPLARAIVSAAQARGL
          ||||||||||||:|||||||||||||||||||||||||||||||||||||||||||||||
a589      VVLDKTGTLTEGKPQVAAVYCVPDSGFDEDALYRIAAAVEQNAAHPLARAIVSAAQARGL
                430       440       450       460       470       480

480       490       500       510       520       530
m589.pep  DIPAAQNAQTVVGAGITAEVEGVGLVKAGKAEFAELALPKFLDGVWDIASIVAVSVDNKP
          :||:||||||:|||||||||:|||||||||||||||:||||||:|||:|||:|||::||
a589      EIPTAQNAQTIVGAGITAEVKGAGLVKAGKAEFAELTLPKFSDGVWEIASVVAVSVNGKP
                490       500       510       520       530       540

540       550       560       570       580       590
m589.pep  IGAFALADALKADTAEAIGRLKKHNIDVYIMSGDNQGTVEYVAKQLGIAHAFGNMSPRDK
          ||||||||||||||||||||||||||||||||||||||||||||||||||||||||||||
a589      IGAFALADALKADTAEAIGRLKKHNIDVYIMSGDNQGTVEYVAKQLGIAHAFGNMSPRDK
                550       560       570       580       590       600

600       610       620       630       640       650
m589.pep  AAEVQKLKAAGKTVAMVGDGINDAPALAAANVSFAMKGGADVAEHTASATLMQHSVNQLA
          ||||||||||||||||||||||||||||||||||||||||||||||||||||||||||||
a589      AAEVQKLKAAGKTVAMVGDGINDAPALAAANVSFAMKGGADVAEHTASATLMQHSVNQLA
                610       620       630       640       650       660

660       670       680       690       700       710
m589.pep  DALLVSQATLKNIKQNLFFAFFYNILGIPLAALGFLNPVIAGAAMAASSVSVLSNALRLK
          |||  ||:||||||||||||||||||||||||||||||||||||||||||||||||||||
a589      DALSVSRATLKNIKQNLFFAFFYNILGIPLAALGFLNPVIAGAAMAASSVSVLSNALRLK
                670       680       690       700       710       720

720
m589.pep  RVKIDX
          ||||||
a589      RVKIDX
```

The following partial DNA sequence was identified in *N. gonorrhoeae* <SEQ ID 1833>:

```
g590.seq..
    1  atgaaaaaac ctttgatttc agttgcggca gtattgctcg gcgttgcttt 51  gggtacacct tattatttgg gtgtcaaagc agaagaaagt ctgacgcagc 101  agcaaaaaat attgcagaaa acgggctttt tgaccgtcga atcgcaccag 151  tatgatcgag gctggtttac ctctacggaa acgacggtca tccgtctgaa 201  acccgagttg ctgcataatg cgcagaaata cctgccggat aacttgaaaa 251  tagtgttgga acagccggtt acgctggtaa accatatcac gcacggccct 301  ttcgccggcg gattcggcac gcaggcgcac attgaaaccg agttcaaata 351  cgcgcctgaa acggaaaaag ttttgaacg ctttttggg aaacaagttc 401  cggtttccct tgccaatacc gtttatttca acggcagcgg taaaatggaa 451  gtcagtgttc ccgctttcga ttatgaagaa ctgtcggca tcaggctgca 501  ctgggaaggc ctgacggggg aaacggttta tcaaaaaggt ttcaaaagct
```

-continued

```
551  accgcaacag ctatgatgcg cccttgttca aaatcaagct ggcagacaaa 601  ggcgatgccg cgtttgaaaa agcgcatttc gattcggaaa cttcagacgg 651  catcaatccg cttgctttgg gcagcagcaa tctgactttg gaaaaatttt 701  cgctcgaatg gaaagagggt gtcgattaca acgtcaaatt gaacgaactg 751  gtcaacctcg ttaccgattt gcagatcggc gcgtttatca atcccaacgg 801  cagcatcgca ccttccaaaa tcgaagtcgg caagctggct tttcaacca 851  agaccgggga atcgggcgcg tttatcgaca gcgaagggcg gttccgtttc 901  gatacgttgg tgtacggcga tgaaaaatac ggcccgctgg acatccatat 951  cgctgccgaa cacctcgatg cttctgcctt aaccgtattg aaacgcaagt 1001 ttgcacaaat ttctgccaaa aaaatgactg aggaacaaat ccgcaatgat 1051 ttgattgcgg cagtcaaagg cgatgcttcc ggattattta cccatgaccc 1101 ggtactaaat atcaaaattt tccgtttcac cctgcctcag ggaaaaattg 1151 atgtgggcgg aaaaatcatg tttaaaggca tgaagaagga agatttgaac 1201 caattgggac tgatgttaaa gaaaaccgag gcaaacatca gaatgagtat 1251 tcctcaaaaa atgttggaag atttggcggt aagtcaggct ggaaatattt 1301 tcagtgtaaa tgccgaagat gaggcggaag ccagagcaag cattgccgat 1351 attaatgaaa cattgcgcct gatggtggac agtacggtcc aaagtatggc 1401 aagggaaaaa tatcttactt tagacggtaa tcagattgat acggtcattt 1451 cccttaaaaa caacgccctg aagttaaacg ggaaaacgct gcaaaatgaa 1501 cccgatcctg attttgacga gggagatatg gtttccggcc agccgcatta 1551 a
```

This corresponds to the amino acid sequence <SEQ ID 1834; ORF 590.ng>:

```
g590.pep..
  1 MKKPLISVAA VLLGVALGTP YYLGVKAEES LTQQQKILQK TGFLTVESHQ

51 YDRGWFTSTE TTVIRLKPEL LHNAQKYLPD NLKIVLEQPV TLVNHITHGP

101 FAGGFGTQAH IETEFKYAPE TEKVLERFFG KQVPVSLANT VYFNGSGKME

151 VSVPAFDYEE LSGIRLHWEG LTGETVYQKG FKSYRNSYDA PLFKIKLADK

201 GDAAFEKAHF DSETSDGINP LALGSSNLTL EKFSLEWKEG VDYNVKLNEL

251 VNLVTDLQIG AFINPNGSIA PSKIEVGKLA FSTKTGESGA FIDSEGRFRF

301 DTLVYGDEKY GPLDIHIAAE HLDASALTVL KRKFAQISAK KMTEEQIRND

351 LIAAVKGDAS GLFTHDPVLN IKIFRFTLPQ GKIDVGGKIM FKGMKKEDLN

401 QLGLMLKKTE ANIRMSIPQK MLEDLAVSQA GNIFSVNAED EAEARASIAD

451 INETLRLMVD STVQSMAREK YLTLDGNQID TVISLKNNAL KLNGKTLQNE

501 PDPDFDEGDM VSGQPH*
```

The following partial DNA sequence was identified in *N. meningitidis* <SEQ ID 1835>:

```
m590.seq (partial) ..
 1  ..TGGTTTACCT CTATGGAAAC GACGGTCATC CGTCTGAAAC CCGAGTTGCT

51    GAATAATGCC CGAAAATACC TGCCGGATAA CCTGAAAACA GTGTTGGAAC
```

-continued

```
 101  AGCCGGTTAC GCTGGTTAAC CATATCACGC ACGGCCCTTT CGCCGGCGGA
 151  TTCGGCACGC AGGCGTACAT TGAAACCGAG TTCAAATACG CGCCTGAAAC
 201  GGAAAAAGTT CTGGAACGCT TTTTTGGAAA ACAAGTCCCG GCTTCCCTTG
 251  CCAATACCGT TTATTTTAAC GGCAGCGGTA AAATGGAAGT CAGTGTTCCC
 301  GCCTTCGATT ATGAAGAGCT GTCGGGCATc AG.CTGCACT GGGAAkGCCT
 351  GACGGGAGAA ACGGTTTATC AAAAAGGTTT CAAAAGCTAC CGGAACGGCT
 401  ATGATGCCCC CTTGTTTAAA ATCAAGCTGG CAGACAAAGG CGATGCCGCG
 451  TTTGAAAAAG TGCATTTCGA TTCGGAAACT TCAGACGGCA TCAATCCGCT
 501  TGCTTTGGGC AGCAGCAATC TGACCTTGGA AAAATTCTCC CTAGAATGGA
 551  AAGAGGGTGT CGATTACAAC GTCAAGTTAA CGAACTGGT CAATCTTGTT
 601  ACCGATTTGC AGATTGGCGC GTTTATCAAT CCCAACGGCA GCATCGCACC
 651  TTCCAAAATC GAAGTCGGCA AACTGGCTTT TTCAACCAAG ACCGGGGAAT
 701  CAGGCGCGTT TATCAACAGT GAAGGGCAGT TCCGTTTCGA TACACTGGTG
 751  TACGGCGATG AAAAATACGG CCCGCTGGAC ATCCATATCG CTGCCGAACA
 801  CCTCGATGCT TCTGCCTTAA CCGTATTGAA ACGCAAGTTT GCACAAATTT
 851  CCGCCAAAAA AATGACCGAG GAACAAATCC GCAATGATTT GATTGCCGCC
 901  GTCAAAGGAG AGGCTTCCGG ACTGTTCACC AACAATCCCG TATTGGACAT
 951  TAAAACTTTC CGATTCACGC TGCCATCGGG AAAAATCGAT GTGGGCGGAA
1001  AAATCATGTT TAAAGACATG AAGAAGGAAG ATTTGAATCA ATTGGGTTTG
1051  ATGCTGAAGA AAACCGAAGC CGACATCAGA ATGAGTATTC CCCAAAAAAT
1101  GCTGGAAGAC TTGGCGGTCA GTCAAGCAGG CAATATTTTC AGCGTCAATG
1151  CCGAAGATGA GGCGGAAGGC AGGGCAAGTC TTGACGACAT CAACGAGACC
1201  TTGCGCCTGA TGGTGGACAG TACGGTTCAG AGTATGGCAA GGGAAAAATA
1251  TCTGACTTTG AACGGCGACC AGATTGATAC TGCCATTTCT CTGAAAAACA
1301  ATCAGTTGAA ATTGAACGGT AAAACGTTGC AAAACGAACC GGAGCCGGAT
1351  TTTGATGAAG GCGGTATGGT TTCAGAGCCG CAGCAGTAA
```

This corresponds to the amino acid sequence <SEQ ID 1836; ORF 590>:

```
m590.pep..(partial)
    1  ..WFTSMETTVI RLKPELLNNA RKYLPDNLKT VLEQPVTLVN HITHGPFAGG
   51    FGTQAYIETE FKYAPETEKV LERFFGKQVP ASLANTVYFN GSGKMEVSVP
  101    AFDYEELSGI XLHWEXLTGE TVYQKGFKSY RNGYDAPLFK IKLADKGDAA
  151    FEKVHFDSET SDGINPLALG SSNLTLEKFS LEWKEGVDYN VKLNELVNLV
  201    TDLQIGAFIN PNGSIAPSKI EVGKLAFSTK TGESGAFINS EGQFRFDTLV
  251    YGDEKYGPLD IHIAAEHLDA SALTVLKRKF AQISAKKMTE EQIRNDLIAA
  301    VKGEASGLFT NNPVLDIKTF RFTLPSGKID VGGKIMFKDM KKEDLNQLGL
  351    MLKKTEADIR MISPQKMLED LAVSQAGNIF SVNAEDEAEG RASLDDINET
  401    LRLMVDSTVQ SMAREKYLTL NGDQIDTAIS LKNNQLKLNG KTLQNEPEPD
  451    FDEGGMVSEP QQ* m590/g590 93.1% identity in 462 aa overlap
```

-continued

```
                                               10        20        30
m590.pep                                 WFTSMETTVIRLKPELLNNARKYLPDNLKT
                                         |||| ||||||||||||:||:|||||||| 
g590     VKAEESLTQQQKILQKTGFLTVESHQYDRGWFTSTETTVIRLKPELLHNAQKYLPDNLKI
             30        40        50        60        70        80

40        50        60        70        80        90
m590.pep VLEQPVTLVNHITHGPFAGGFGTQAYIETEFKYAPETEKVLERFFGKQVPASLANTVYFN
         |||||||||||||||||||||||||:||||||||||||||||||||||||:|||||||||
g590     VLEQPVTLVNHITHGPFAGGFGTQAHIETEFKYAPETEKVLERFFGKQVPVSLANTVYFN
             90       100       110       120       130       140

100       110       120       130       140       150
m590.pep GSGKMEVSVPAFDYEELSGIXLHWEXLTGETVYQKGFKSYRNGYDAPLFKIKLADKGDAA
         |||||||||||||||||||| |||| ||||||||||||||||:|||||||||||||||||
g590     GSGKMEVSVPAFDYEELSGIRLHWEGLTGETVYQKGFKSYRNSYDAPLFKIKLADKGDAA
            150       160       170       180       190       200

160       170       180       190       200       210
m590.pep FEKVHFDSETSDGINPLALGSSNLTLEKFSLEWKEGVDYNVKLNELVNLVTDLQIGAFIN
         |||:||||||||||||||||||||||||||||||||||||||||||||||||||||||||
g590     FEKAHFDSETSDGINPLALGSSNLTLEKFSLEWKEGVDYNVKLNELVNLVTDLQIGAFIN
            210       220       230       240       250       260

220       230       240       250       260       270
m590.pep PNGSIAPSKIEVGKLAFSTKTGESGAFINSEGQFRFDTLVYGDEKYGPLDIHIAAEHLDA
         ||||||||||||||||||||||||||||:|||:|||||||||||||||||||||||||||
g590     PNGSIAPSKIEVGKLAFSTKTGESGAFIDSEGRFRFDTLVYGDEKYGPLDIHIAAEHLDA
            270       280       290       300       310       320

280       290       300       310       320       330
m590.pep SALTVLKRKFAQISAKKMTEEQIRNDLIAAVKGEASGLFTNNPVLDIKTFRFTLPSGKID
         ||||||||||||||||||||||||||||||||||:||||||::|||:|| |||||:||||
g590     SALTVLKRKFAQISAKKMTEEQIRNDLIAAVKGDASGLFTHDPVLNIKIFRFTLPQGKID
            330       340       350       360       370       380

340       350       360       370       380       390
m590.pep VGGKIMFKDMKKEDLNQLGLMLKKTEADIRMSIPQKMLEDLAVSQAGNIFSVNAEDEAEG
         |||||||| ||||||||||||||||||:|||||||||||||||||||||||||||||||:
g590     VGGKIMFKGMKKEDLNQLGLMLKKTEANIRMSIPQKMLEDLAVSQAGNIFSVNAEDEAEA
            390       400       410       420       430       440

400       410       420       430       440       450
m590.pep RASLDDINETLRLMVDSTVQSMAREKYLTLNGDQIDTAISLKNNQLKLNGKTLQNEPEPD
         |||: |||||||||||||||||||||||||:|:||||:|||||| ||||||||||||:||
g590     RASIADINETLRLMVDSTVQSMAREKYLTLDGNQIDTVISLKNNALKLNGKTLQNEPDPD
            450       460       470       480       490       500

460
m590.pep FDEGGMVS-EPQQX
         |||| ||| :|:
g590     FDEGDMVSGQPHX
            510
```

The following partial DNA sequence was identified in *N. meningitidis* <SEQ ID 1837>:

```
a590.seq
     1  ATGAAAAAAC CTTTGATTTC GGTTGCGGCA GCATTGCTCG GCGTTGCTTT
    51  GGGCACGCCT TATTATTTGG GTGTCAAAGC CGAAGAAAGC TTGACGCAGC
   101  AGCAAAAAAT ATTGCAGGAA GCGGGCTTCT TGACCGTCGA ATCGCACCAA
   151  TATGAGCGCG GCTGGTTTAC CTCTACGGAA ACGACGGTCA TCCGCTTGAA
   201  ACCCGAGTTG CTGCATAATG CGCAGAAATA CCTGCCGGAT AACCTGAAAA
   251  CAGTGTTGGA ACAGCCGGTT ACGCTGGTAA ACCATATCAC GCACGGTCCT
   301  TTTGCCGGCG GATTCGGCAC GCAGGCGTAC ATTGAAACCG AGTTCAAATA
   351  CGCGCCTGAA ACGGAAAAAG TTCTGGAACG CTTTTTTGGA AAACAAGTCC
   401  CGGTTTCCCT TGCCAATACC GTTTATTTTA ACGGCAGCGG TAAAATGGAA
   451  GTCAGTGTTC CCGCCTTCGA TTATGAAGAG CTGTCGGGCA TCAGGCTGCA
   501  CTGGGAAGGC CTGACGGGAG AAACGGTTTA TCAAAAAGGT TTCAAAAGCT
   551  ACCGGAACGG CTATGATGCC CCCTTGTTTA AAATCAAGCT GGCAGACAAA
   601  GGCGATGCCG CGTTTGAAAA AGTGCATTTC GATTCGGAAA CTTCAGACGG
   651  CATCAACCCG CTTGCTTTGG GCAGCAGCAA TCTGACCTTG GAAAAATTTT
```

-continued

```
 701 CCTTAGAATG GAAAGAGGGT GTCGATTACA ACGTCAAGTT AAACGAACTG
 751 GTCAATCTTG TTACCGATTT GCAGATTGGC GCGTTTATCA ATCCCAACGG
 801 CAGCATCGCA CCTTCCAAAA TCGAAGTCGG CAAGCTGGCT TTTTCAACCA
 851 AGACCGGGGA ATCGGGCGCG TTTATCGATA GCGAAGGGCA GTTCCGTTTT
 901 GGCACGCTGG TTTACGGCGA TGAAAAATAC GGCCCTCTGG ACATCCATAT
 951 CGCTGCCGAA CACCTCGATG CTTCTGCCTT AACCGTATTG AAACGCAAGT
1001 TTGCACGAAT TTCTGCCAAA AAAATGACTG AAGAACAAAT CCGCAATGAT
1051 TTGATTGCGG CAGTCAAAGG CGAGGCTTCC GGATTATTTA CCCATAACCC
1101 AGTATTGGAC ATTAAAACTT TCCGATTCAC GCTGCCATCG GGAAAAATCG
1151 ATGTGGGCGG AAAAATCATG TTTAAAGACA TGAAGAAGGA AGATTTGAAC
1201 CAATTGGGTT TGATGCTGAA GAAAACCGAA GCCGACATCA GAATGAGTAT
1251 TCCCCAAAAA ATGCTGGAAG ACTTGGCGGT CAGTCAAGCA GGCAATATTT
1301 TCAGCGTCAA TGCCGAAGAT GAGGCGGAAG GCAGGGCAAG TCTTGACGAC
1351 ATCAACGAGA CCTTGCGCCT GATGGTGGAC AGTACGGTTC AGAGTATGGC
1401 AAGGGAAAAA TATCTGACTT TGAACGGCGA CCAGATTGAT ACTGCCATTT
1451 CTCTGAAAAA CAATCAGTTG AAATTGAACG GTAAAACGTT GCAAAACGAA
1501 CCGGAGCCGG ATTTTGATGA AGGCGGTATG GTTTCAGAGC CGCAGCAGTA
1551 A
```

This corresponds to the amino acid sequence <SEQ ID 1838; ORF 590.a>:

```
a590.pep

1 MKKPLISVAA ALLGVALGTP YYLGVKAEES LTQQQKILQE AGFLTVESHQ

51 YERGWFTSTE TTVIRLKPEL LHNAQKYLPD NLKTVLEQPV TLVNHITHGP

101 FAGGFGTQAY IETEFKYAPE TEKVLERFFG KQVPVSLANT VYFNGSGKME

151 VSVPAFDYEE LSGIRLHWEG LTGETVYQKG FKSYRNGYDA PLFKIKLADK

201 GDAAFEKVHF DSETSDGINP LALGSSNLTL EKFSLEWKEG VDYNVKLNEL

251 VNLVTDLQIG AFINPNGSIA PSKIEVGKLA FSTKTGESGA FIDSEGQFRF

301 GTLVYGDEKY GPLDIHIAAE HLDASALTVL KRKFARISAK KMTEEQIRND

351 LIAAVKGEAS GLFTHNPVLD IKTFRFTLPS GKIDVGGKIM FKDMKKEDLN

401 QLGLMLKKTE ADIRMSIPQK MLEDLAVSQA GNIFSVNAED EAEGRASLDD

451 INETLRLMVD STVQSMAREK YLTLNGDQID TAISLKNNQL KLNGKTLQNE

501 PEPDFDEGGM VSEPQQ*
``` m590/a590 97.8% identity in 462 aa overlap

```
                             10        20        30
    m590.pep                WFTSMETTVIRLKPELLNNARKYLPDNLKT
                            ||||  |||||||||||||:||:|||||||
    a590    VKAEESLTQQQKILQEAGFLTVESHQYERGWFTSTETTVIRLKPELLHNAQKYLPDNLKT
                  30        40        50        60        70        80

40        50        60        70        80        90
    m590.pep VLEQPVTLVNHITHGPFAGGFGTQAYIETEFKYAPETEKVLERFFGKQVPASLANTVYFN
             ||||||||||||||||||||||||||||||||||||||||||||||||||:|||||||||
    a590    VLEQPVTLVNHITHGPFAGGFGTQAYIETEFKYAPETEKVLERFFGKQVPVSLANTVYFN
                  90       100       110       120       130       140
```

-continued

```
                100       110       120       130       140       150
m590.pep GSGKMEVSVPAFDYEELSGIXLHWEXLTGETVYQKGFKSYRNGYDAPLFKIKLADKGDAA
         |||||||||||||||||||| |||| |||||||||||||||||||||||||||||||||||
a590     GSGKMEVSVPAFDYEELSGIRLHWEGLTGETVYQKGFKSYRNGYDAPLFKIKLADKGDAA
             150       160       170       180       190       200

160       170       180       190       200       210
m590.pep FEKVHFDSETSDGINPLALGSSNLTLEKFSLEWKEGVDYNVKLNELVNLVTDLQIGAFIN
         ||||||||||||||||||||:||||:||||||||||||||||||||||||||||||||||
a590     FEKVHFDSETSDGINPLALGSSNLTLEKFSLEWKEGVDYNVKLNELVNLVTDLQIGAFIN
             210       220       230       240       250       260

220       230       240       250       260       270
m590.pep PNGSIAPSKIEVGKLAFSTKTGESGAFINSEGQFRFDTLVYGDEKYGPLDIHIAAEHLDA
         |||||||||||||||||||||||||||||:||||||| ||||||||||||||||||||||
a590     PNGSIAPSKIEVGKLAFSTKTGESGAFIDSEGQFRFGTLVYGDEKYGPLDIHIAAEHLDA
             270       280       290       300       310       320

280       290       300       310       320       330
m590.pep SALTVLKRKFAQISAKKMTEEQIRNDLIAAVKGEASGLFTNNPVLDIKTFRFTLPSGKID
         |||||||||||:|||||||||||||||||||||||||||||:||||||||||||||||||
a590     SALTVLKRKFARISAKKMTEEQIRNDLIAAVKGEASGLFTHNPVLDIKTFRFTLPSGKID
             330       340       350       360       370       380

340       350       360       370       380       390
m590.pep VGGKIMFKDMKKEDLNQLGLMLKKTEADIRMSIPQKMLEDLAVSQAGNIFSVNAEDEAEG
         ||||||||||||||||||||||||||||||||||||||||||||||||||||||||||||
a590     VGGKIMFKDMKKEDLNQLGLMLKKTEADIRMSIPQKMLEDLAVSQAGNIFSVNAEDEAEG
             390       400       410       420       430       440

400       410       420       430       440       450
m590.pep RASLDDINETLRLMVDSTVQSMAREKYLTLNGDQIDTAISLKNNQLKLNGKTLQNEPEPD
         ||||||||||||||||||||||||||||||||||||||||||||||||||||||||||||
a590     RASLDDINETLRLMVDSTVQSMAREKYLTLNGDQIDTAISLKNNQLKLNGKTLQNEPEPD
             450       460       470       480       490       500

460
m590.pep FDEGGMVSEPQQX
         |||||||||||||
g590     FDEGGMVSEPQQX
             510
```

The following partial DNA sequence was identified in *N. meningitidis* <SEQ ID 1839>:

```
m590-1.seq
   1  ATGAAAAAAC CTTTGATTTC GGTTGCGGCA GCATTGCTCG GCGTTGCTTT

51  GGGCACGCCT TATTATTTGG GTGTCAAAGC CGAAGAAAGC TTGACGCAGC

101  AGCAAAAAAT ATTGCAGGAA ACGGGCTTCT TGACCGTCGA ATCGCACCAA

151  TATGAGCGCG GCTGGTTTAC CTCTATGGAA ACGACGGTCA TCCGTCTGAA

201  ACCCGAGTTG CTGAATAATG CCCGAAAATA CCTGCCGGAT AACCTGAAAA

251  CAGTGTTGGA ACAGCCGGTT ACGCTGGTTA ACCATATCAC GCACGGCCCT

301  TTCGCCGGCG GATTCGGCAC GCAGGCGTAC ATTGAAACCG AGTTCAAATA

351  CGCGCCTGAA ACGGAAAAAG TTCTGGAACG CTTTTTTGGA AAACAAGTCC

401  CGGCTTCCCT TGCCAATACC GTTTATTTTA ACGGCAGCGG TAAAATGGAA

451  GTCAGTGTTC CCGCCTTCGA TTATGAAGAG CTGTCGGGCA TCAGGCTGCA

501  CTGGGAAGGC CTGACGGGAG AAACGGTTTA TCAAAAAGGT TTCAAAAGCT

551  ACCGGAACGG CTATGATGCC CCCTTGTTTA AAATCAAGCT GGCAGACAAA

601  GGCGATGCCG CGTTTGAAAA AGTGCATTTC GATTCGGAAA CTTCAGACGG

651  CATCAATCCG CTTGCTTTGG GCAGCAGCAA TCTGACCTTG GAAAAATTCT

701  CCCTAGAATG GAAAGAGGGT GTCGATTACA ACGTCAAGTT AAACGAACTG

751  GTCAATCTTG TTACCGATTT GCAGATTGGC GCGTTTATCA ATCCCAACGG

801  CAGCATCGCA CCTTCCAAAA TCGAAGTCGG CAAACTGGCT TTTTCAACCA

851  AGACCGGGGA ATCAGGCGCG TTTATCAACA GTGAAGGGCA GTTCCGTTTC

901  GATACACTGG TGTACGGCGA TGAAAAATAC GGCCCGCTGG ACATCCATAT
```

-continued

```
 951 CGCTGCCGAA CACCTCGATG CTTCTGCCTT AACCGTATTG AAACGCAAGT
1001 TTGCACAAAT TTCCGCCAAA AAAATGACCG AGGAACAAAT CCGCAATGAT
1051 TTGATTGCCG CCGTCAAAGG AGAGGCTTCC GGACTGTTCA CCAACAATCC
1101 CGTATTGGAC ATTAAAACTT TCCGATTCAC GCTGCCATCG GGAAAAATCG
1151 ATGTGGGCGG AAAAATCATG TTTAAAGACA TGAAGAAGGA AGATTTGAAT
1201 CAATTGGGTT TGATGCTGAA GAAAACCGAA GCCGACATCA GAATGAGTAT
1251 TCCCCAAAAA ATGCTGGAAG ACTTGGCGGT CAGTCAAGCA GGCAATATTT
1301 TCAGCGTCAA TGCCGAAGAT GAGGCGGAAG GCAGGGCAAG TCTTGACGAC
1351 ATCAACGAGA CCTTGCGCCT GATGGTGGAC AGTACGGTTC AGAGTATGGC
1401 AAGGGAAAAA TATCTGACTT TGAACGGCGA CCAGATTGAT ACTGCCATTT
1451 CTCTGAAAAA CAATCAGTTG AAATTGAACG GTAAAACGTT GCAAAACGAA
1501 CCGGAGCCGG ATTTTGATGA AGGCGGTATG GTTTCAGAGC CGCAGCAGTA
1551 A
```

This corresponds to the amino acid sequence <SEQ ID 1840; ORF 590-1>:

```
m590-1.pep

1 MKKPLISVAA ALLGVALGTP YYLGVKAEES LTQQQKILQE TGFLTVESHQ
 51 YERGWFTSME TTVIRLKPEL LNNARKYLPD NLKTVLEQPV TLVNHITHGP
101 FAGGFGTQAY IETEFKYAPE TEKVLERFFG KQVPASLANT VYFNGSGKME
151 VSVPAFDYEE LSGIRLHWEG LTGETVYQKG FKSYRNGYDA PLFKIKLADK
201 GDAAFEKVHF DSETSDGINP LALGSSNLTL EKFSLEWKEG VDYNVKLNEL
251 VNLVTDLQIG AFINPNGSIA PSKIEVGKLA FSTKTGESGA FINSEGQFRF
301 DTLVYGDEKY GPLDIHIAAE HLDASALTVL KRKFAQISAK KMTEEQIRND
351 LIAAVKGEAS GLFTNNPVLD IKTFRFTLPS GKIDVGGKIM FKDMKKEDLN
401 QLGLMLKKTE ADIRMSIPQK MLEDLAVSQA GNIFSVNAED EAEGRASLDD
451 INETLRLMVD STVQSMAREK YLTLNGDQID TAISLKNNQL KLNGKTLQNE
501 PEPDFDEGGM VSEPQQ*
``` m590-1/g590    93.6% identity in 516 aa overlap

```
                   10         20         30         40         50         60
m590-1.pep MKKPLISVAAALLGVALGTPYYLGVKAEESLTQQQKILQETGFLTVESHQYERGWFTSME
           ||||||||||:||||||||||||||||||||||||||:||||||||||||:||||| |
g590       MKKPLISVAAVLLGVALGTPYYLGVKAEESLTQQQKILQKTGFLTVESHQYDRGWFTSTE
                   10         20         30         40         50         60

70         80         90        100        110        120
m590-1.pep TTVIRLKPELLNNARKYLPDNLKTVLEQPVTLVNHITHGPFAGGFGTQAYIETEFKYAPE
           ||||||||||||:||:|||||||:||||||||||||||||||||||||||:||||||||
g590       TTVIRLKPELLHNAQKYLPDNLKIVLEQPVTLVNHITHGPFAGGFGTQAHIETEFKYAPE
                   70         80         90        100        110        120

130        140        150        160        170        180
m590-1.pep TEKVLERFFGKQVPASLANTVYFNGSGKMEVSVPAFDYEELSGIRLHWEGLTGETVYQKG
           ||||||||||||||:|||||||||||||||||||||||||||||||||||||||||||||
g590       TEKVLERFFGKQVPVSLANTVYFNGSGKMEVSVPAFDYEELSGIRLHWEGLTGETVYQKG
                  130        140        150        160        170        180

190        200        210        220        230        240
m590-1.pep FKSYRNGYDAPLFKIKLADKGDAAFEKVHFDSETSDGINPLALGSSNLTLEKFSLEWKEG
           ||||||:|||||||||||||||||||||:||||||||||||||||||||||||||||||
g590       FKSYRNSYDAPLFKIKLADKGDAAFEKAHFDSETSDGINPLALGSSNLTLEKFSLEWKEG
                  190        200        210        220        230        240
```

```
                 250        260        270        280        290        300
m590-1.pep  VDYNVKLNELVNLVTDLQIGAFINPNGSIAPSKIEVGKLAFSTKTGESGAFINSEGQRF
            ||||||||||||||||||||||||||||||||||||||||||||||||||:|||:|||
g590        VDYNVKLNELVNLVTDLQIGAFINPNGSIAPSKIEVGKLAFSTKTGESGAFIDSEGRRF
                 250        260        270        280        290        300

310        320        330        340        350        360
m590-1.pep  DTLVYGDEKYGPLDIHIAAEHLDASALTVLKRKFAQISAKKMTEEQIRNDLIAAVKGEAS
            |||||||||||||||||||||||||||||||||||||||||||||||||||||||:||
g590        DTLVYGDEKYGPLDIHIAAEHLDASALTVLKRKFAQISAKKMTEEQIRNDLIAAVKGDAS
                 310        320        330        340        350        360

370        380        390        400        410        420
m590-1.pep  GLFTNNPVLDIKTFRFTLPSGKIDVGGKIMFKDMKKEDLNQLGLMLKKTEADIRMSIPQK
            ||||::|||||:||  ||||||||||||||||||||||||||||||||||||||||||
g590        GLFTHDPVLNIKIFRFTLPQGKIDVGGKIMFKGMKKEDLNQLGLMLKKTEANIRMSIPQK
                 370        380        390        400        410        420

430        440        450        460        470        480
m590-1.pep  MLEDLAVSQAGNIFSVNAEDEAEGRASLDDINETLRLMVDSTVQSMAREKYLTLNGDQID
            |||||||||||||||||||||||||:||:|||||||||||||||||||||||||:||||
g590        MLEDLAVSQAGNIFSVNAEDEAEARASIADINETLRLMVDSTVQSMAREKYLTLDGNQID
                 430        440        450        460        470        480

490        500        510
m590-1.pep  TAISLKNNQLKLNGKTLQNEPEPDFDEGGMVS-EPQQX
            |:|||||| ||||||||||||:||||| ||| :|:
g590        TVISLKNNALKLNGKTLQNEPDPDFDEGDMVSGQPHX
                 490        500        510 a590/m590-1  98.3% identity in 516 aa overlap 10         20         30         40         50         60
a590.pep    MKKPLISVAAALLGVALGTPYYLGVKAEESLTQQQKILQEAGFLTVESHQYERGWFTSTE
            ||||||||||||||||||||||||||||||||||||||:|||||||||||||||||||:|
m590-1      MKKPLISVAAALLGVALGTPYYLGVKAEESLTQQQKILQETGFLTVESHQYERGWFTSME
                 10         20         30         40         50         60

70         80         90        100        110        120
a590.pep    TTVIRLKPELLHNAQKYLPDNLKTVLEQPVTLVNHITHGPFAGGFGTQAYIETEFKYAPE
            ||||||||||||:|::||||||||||||||||||||||||||||||||||||||||||
m590-1      TTVIRLKPELLNNARKYLPDNLKTVLEQPVTLVNHITHGPFAGGFGTQAYIETEFKYAPE
                 70         80         90        100        110        120

130        140        150        160        170        180
a590.pep    TEKVLERFFGKQVPVSLANTVYFNGSGKMEVSVPAFDYEELSGIRLHWEGLTGETVYQKG
            ||||||||||||||:|||||||||||||||||||||||||||||||||||||||||||
m590-1      TEKVLERFFGKQVPASLANTVYFNGSGKMEVSVPAFDYEELSGIRLHWEGLTGETVYQKG
                 130        140        150        160        170        180

190        200        210        220        230        240
a590.pep    FKSYRNGYDAPLFKIKLADKGDAAFEKVHFDSETSDGINPLALGSSNLTLEKFSLEWKEG
            ||||||||||||||||||||||||||||||||||||||||||||||||||||||||||
m590-1      FKSYRNGYDAPLFKIKLADKGDAAFEKVHFDSETSDGINPLALGSSNLTLEKFSLEWKEG
                 190        200        210        220        230        240

250        260        270        280        290        300
a590.pep    VDYNVKLNELVNLVTDLQIGAFINPNGSIAPSKIEVGKLAFSTKTGESGAFIDSEGQRF
            |||||||||||||||||||||||||||||||||||||||||||||||||||:||||||
m590-1      VDYNVKLNELVNLVTDLQIGAFINPNGSIAPSKIEVGKLAFSTKTGESGAFINSEGQRF
                 250        260        270        280        290        300

310        320        330        340        350        360
a590.pep    GTLVYGDEKYGPLDIHIAAEHLDASALTVLKRKFARISAKKMTEEQIRNDLIAAVKGEAS
            :|||||||||||||||||||||||||||||||||:|||||||||||||||||||||||
m590-1      DTLVYGDEKYGPLDIHIAAEHLDASALTVLKRKFAQISAKKMTEEQIRNDLIAAVKGEAS
                 310        320        330        340        350        360

370        380        390        400        410        420
a590.pep    GLFTHNPVLDIKTFRFTLPSGKIDVGGKIMFKDMKKEDLNQLGLMLKKTEADIRMSIPQK
            ||||:|||||||||||||||||||||||||||||||||||||||||||||||||||||
m590-1      GLFTNNPVLDIKTFRFTLPSGKIDVGGKIMFKDMKKEDLNQLGLMLKKTEADIRMSIPQK
                 370        380        390        400        410        420

430        440        450        460        470        480
a590.pep    MLEDLAVSQAGNIFSVNAEDEAEGRASLDDINETLRLMVDSTVQSMAREKYLTLNGDQID
            ||||||||||||||||||||||||||||||||||||||||||||||||||||||||||
m590-1      MLEDLAVSQAGNIFSVNAEDEAEGRASLDDINETLRLMVDSTVQSMAREKYLTLNGDQID
                 430        440        450        460        470        480

490        500        510
a590.pep    TAISLKNNQLKLNGKTLQNEPEPDFDEGGMVSEPQQX
            ||||||||||||||||||||||||||||||||||||
m590-1      TAISLKNNQLKLNGKTLQNEPEPDFDEGGMVSEPQQX
                 490        500        510
```

The following partial DNA sequence was identified in *N. gonorrhoeae* <SEQ ID 1841>:

```
g591.seq
    1 TTGCAAACCC TTCTAGCTTT TATCTTCGCC ATCCTGATTT TGGTCAGCCT
   51 GCACGAATTC GGACACTACA TCGTCGCCAG GTTGTGCGGC GTCAAGGTTG
  101 TGCGTTTTTC CGTCGGCTTC GGCAAACCGT TTTTCACCCG AAAGCGCGGC
  151 GACACCGAAT GGTGCCTCGC CCCGATTCCG TTGGGCGGCT ACGTCAAAAT
  201 GGTCGATACG CGCGAAGGCG AAGTATCAGA AGCCGATTTA CCCTACGCTT
  251 TTGACAAACA ACACCCCGCC AAGCGCATCG CCATCGTCGC CGCCGGTCCG
  301 CTGACCAACC TCGCActggc ggTTTTGCTG TACGGACTGa gctTttcctt
  351 cggcgtaaCC GAACTGCGGC CCtatgtcgg cacagtcgaA cccgacaccg
  401 ttgccgCCCG CACCGGCTTC caaagcggcg acaaAATACa atccgtcaac
  451 ggcgtTtccg tCCAAGACTG GAGCAGCGCG CAAACCGAAA TCGTcctcAA
  501 CCTCGAAGCC Ggcaaagtcg ccgtcggcgT TCAGACGGCA TCGGGCGCGC
  551 AAACCGTCCG CACCAtcgAT GCCGCAGGCA CGCCGGAAGC CGGTAAAATC
  601 GCAAAAAACC AAGGCTACAT CGGACTGATG CCCTTTAAAA TCACAACCGT
  651 TGCCGGCGGC GTGGAAAAAG GCAGCCCCGC CGAAAAAGCA GGCCTGAAAC
  701 CGGGCGACAG GCTGACTGCC GCCGACGGCA AACCCATCGc ctcaTGGCAG
  751 GAATGGgcaa acctgACccg cCAAAGCCCg ggcAAAAAAA Tcaccctgac
  801 ctacgAaCGC GCcggacaaa cccaTAccgc CGACATCCGC CccgATactg
  851 TCGAAcagcc cgACCACACC CTGATCgggc gcgTCGGCCT CCGtccgcaG
  901 CCGGACAGGG CGTGGGACGC GCAAATCCGC CGCAGCTACC GTCCGTCTGT
  951 TGTCCGCGCA TTCGGCATGG GCTGGGAAAA AACCGTTTCC CACTCGTGGA
 1001 CAACCCTCAA ATTTTTCGGC AAACTAATCA GCGGCAACGC CTCTGTCAGC
 1051 CATATTTCCG GGCCGCTGAC CATTGCCGAC ATTGCCGGAC AGTCCGCCGA
 1101 ACTCGGCTTG CAAAGTTATT TGGAATTTTT AGCGTTGGTC AGCATCAGCC
 1151 TCGGCGTGCT GAACCTGCTG CCCGTCCCCG TTTTGGACGG CGGGCACCTC
 1201 GTGTTTTATA CTGTCGAATG GATACGCGGC AAACCTTTGG GCGAACGTGT
 1251 CCAAAACATC GGTTTGCGCT TCGGGCTCGC CCTGATGATG CTGATGATGG
 1301 CGGCCGCCTT CTTCAACGAC GTTACCCGGC TGATCGGTTA G
```

This corresponds to the amino acid sequence <SEQ ID 1842; ORF 591.ng>:

```
g591.pep..
    1 LQTLLAFIFA ILILVSLHEF GHYIVARLCG VKVVRFSVGF GKPFFTRKRG

51 DTEWCLAPIP LGGYVKMVDT REGEVSEADL PYAFDKQHPA KRIAIVAAGP

101 LTNLALAVLL YGLSFSFGVT ELRPYVGTVE PDTVAARTGF QSGDKIQSVN

151 GVSVQDWSSA QTEIVLNLEA GKVAVGVQTA SGAQTVRTID AAGTPEAGKI

201 AKNQGYIGLM PFKITTVAGG VEKGSPAEKA GLKPGDRLTA ADGKPIASWQ

251 EWANLTRQSP GKKITLTYER AGQTHTADIR PDTVEQPDHT LIGRVGLRPQ

301 PDRAWDAQIR RSYRPSVVRA FGMGWEKTVS HSWTTLKFFG KLISGNASVS
```

-continued

```
351 HISGPLTIAD IAGQSAELGL QSYLEFLALV SISLGVLNLL PVPVLDGGHL

401 VFYTVEWIRG KPLGERVQNI GLRFGLALMM LMMAAAFFND VTRLIG*
```

The following partial DNA sequence was identified in *N. meningitidis* <SEQ ID 1843>:

m591.seq
```
   1 TTGCACACCC TTCTAGCTTT TATCTTCGCC ATCCTGATTT TGGTCAGCCT

51 GCACGAGTTC GGACACTACA TCGTTGCCAG ATTGTGCGGC GTCAAAGTCG

101 TACGCTTTTC CGTCGGCTTC GGCAAACCGT TTTTCACCCG AAAGCGCGGC

151 GACACCGAAT GGTGCC

```
251 EWANLTRQSP GKKITLNYER AGQTHTADIR PDTVEQSDHT LIGRVGLRPQ

301 PDRAWDAQIR RSYRPSVVRA FGMGWEKTVS HSWTTLKFFG KLISGNASVS

351 HISGPLTIAD IAGQSAELGL QSYLEFLALV SISLGVLNLL PVPVLDGGHL

401 VFYTAEWIRG KPLGERVQNI GLRFGLALMM LMMAVAFFND VTRLLG*
```

Computer analysis of this amino acid sequence gave the following results:

Homology with a Predicted ORF from *N. gonorrhoeae*

```
   m591/g591  97.3% identity in 446 aa overlap
                   10         20         30         40         50         60
      m591.pep  LHTLLAFIFAILILVSLHEFGHYIVARLCGVKVVRFSVGFGKPFFTRKRGDTEWCLAPIP
                |:||||||||||||||||||||||||||||||||||||||||||||||||||||||||||
         g591  LQTLLAFIFAILILVSLHEFGHYIVARLCGVKVVRFSVGFGKPFFTRKRGDTEWCLAPIP
                   10         20         30         40         50         60

70         80         90        100        110        120
      m591.pep  LGGYVKMVDTREGEVSEADLPYAFDKQHPAKRIAIVAAGPLTNLALAVLLYGLSFSFGVT
                ||||||||||||||||||||||||||||||||||||||||||||||||||||||||||||
         g591  LGGYVKMVDTREGEVSEADLPYAFDKQHPAKRIAIVAAGPLTNLALAVLLYGLSFSFGVT
                   70         80         90        100        110        120

130        140        150        160        170        180
      m591.pep  ELRPYVGTVEPDTIAARAGFQSGDKIQSVNGTPVADWGSAQTEIVLNLEAGKVAVGVQTA
                ||||||||||||| ||| :|||||||||||| : || :||||||||||||||||||||||
         g591  ELRPYVGTVEPDTVAARTGFQSGDKIQSVNGVSVQDWSSAQTEIVLNLEAGKVAVGVQTA
                  130        140        150        160        170        180

190        200        210        220        230        240
      m591.pep  SGAQTVRTIDAAGTPEAGKIAKNQGYIGLMPFKITTVAGGVEKGSPAEKAGLKPGDRLTA
                ||||||||||||||||||||||||||||||||||||||||||||||||||||||||||||
         g591  SGAQTVRTIDAAGTPEAGKIAKNQGYIGLMPFKITTVAGGVEKGSPAEKAGLKPGDRLTA
                  190        200        210        220        230        240

250        260        270        280        290        300
      m591.pep  ADGKPIASWQEWANLTRQSPGKKITLNYERAGQTHTADIRPDTVEQSDHTLIGRVGLRPQ
                ||||||||||||||||||||||||||||:||||||||||||||||||| |||||||||||
         g591  ADGKPIASWQEWANLTRQSPGKKITLTYERAGQTHTADIRPDTVEQPDHTLIGRVGLRPQ
                  250        260        270        280        290        300

310        320        330        340        350        360
      m591.pep  PDRAWDAQIRRSYRPSVVRAFGMGWEKTVSHSWTTLKFFGKLISGNASVSHISGPLTIAD
                ||||||||||||||||||||||||||||||||||||||||||||||||||||||||||||
         g591  PDRAWDAQIRRSYRPSVVRAFGMGWEKTVSHSWTTLKFFGKLISGNASVSHISGPLTIAD
                  310        320        330        340        350        360

370        380        390        400        410        420
      m591.pep  IAGQSAELGLQSYLEFLALVSISLGVLNLLPVPVLDGGHLVFYTAEWIRGKPLGERVQNI
                ||||||||||||||||||||||||||||||||||||||||||||:|||||||||||||||
         g591  IAGQSAELGLQSYLEFLALVSISLGVLNLLPVPVLDGGHLVFYTVEWIRGKPLGERVQNI
                  370        380        390        400        410        420

430        440
      m591.pep  GLRFGLALMMLMMAVAFFNDVTRLLGX
                |||||||||||:|||||||||:||
         g591  GLRFGLALMMLMMAAAFFNDVTRLIGX
                  430        440
```

The following partial DNA sequence was identified in *N. meningitidis* <SEQ ID 1845>:

```
a591.seq
   1 TTGCACACCC TTCTAGCTTT TATCTTCGCC ATCCTGATTT TGGTCAGCCT

51 GCACGAATTC GGACACTACA TCGTCGCCAG ATTGTGCGGC GTCAAGGTTG

101 TGCGTTTTTC CGTCGGCTTC GGCAAACCGT TTTTCACCCG AAAGCGCGGC

151 GACACCGAAT GGTGCCTCGC CCCGATTCCG TTGGGCGGTT ACGTCAAAAT

201 GGTCGACACG CGCGAAGGCG AAGTATCAGA AGCCGATTTA CCCTACGCTT

251 TTGACAAACA ACACCCCGCC AAGCGCATCG CCATCGTCGC CGCCGGCCCG

301 CTGACCAACC TCGCACTGGC GGTTTTGCTG TACGGACTGA GCTTTTCCTT

351 CGGCGTTACC GAACTGCGCC CCTATGTCGG CACAGTCGAA CCCGACACCA

401 TTGCCGCCCG CGCCGGCTTC CAAAGCGGCG ACAAAATACA ATCCGTCAAC
```

-continued

```
 451 GGCACACCCG TTGCAGATTG GGGCAGCGCG CAAACCGAAA TCGTCCTCAA

501 CCTCGAAGCC GGCAAAGTCG CCGTCGGCGT TCAGACGGCA TCGGGCGCGC

551 AAACCGTCCG CACCATCGAT GCCGCAGGCA CGCCGGAAGC CGGTAAAATC

601 GCAAAAAACC AAGGCTACAT CGGACTGATG CCCTTTAAAA TCACAACCGT

651 TGCCGGCGGC GTGGAAAAAG GCAGCCCCGC CGAAAAAGCA GGCCTGAAAC

701 CGGGCGACAG GCTGACTGCC GCCGACGGCA AACCCATCGC CTCATGGCAA

751 GAATGGGCAA ACCTGACCCG CCAAAGCCCC GGCAAAAAAA TCACCCTGAC

801 CTACGAACGC GCCGGACAAA CCCATACCGC CGACATCCGC CCCGATACTG

851 TCGAACAGCC CGACCACACC CTGATCGGGC GCGTCGGCCT CCGTCCGCAG

901 CCGGACAGGG CGTGGGACGC GCAAATCCGC CGCAGCTACC GTCCGTCTGT

951 TGTCCGCGCA TTCGGCATGG GCTGGGAAAA AACCGTTTCC CACTCGTGGA

1001 CAACCCTCAA ATTTTTCGGC AAACTAATCA GCGGCAACGC CTCCGTCAGC

1051 CATATTTCCG GTCCGCTGAC CATTGCCGAT ATTGCCGGAC AGTCCGCCGA

1101 ACTCGGCTTG CAAAGTTATT TGGAATTTTT GGCACTGGTC AGCATCAGCC

1151 TCGGCGTGCT GAACCTGCTG CCCGTCCCCG TTTTGGACGG CGGCCACCTC

1201 GTGTTTTATA CTGCCGAATG GATACGCGGC AAACCTTTGG GCGAACGCGT

1251 CCAAAACATC GGTTTGCGCT TCGGGCTTGC CCTCATGATG CTGATGATGG

1301 CGGTCGCCTT CTTCAACGAC GTTACCCGGC TGCTCGGTTA G
```

This corresponds to the amino acid sequence <SEQ ID 1846; ORF 591.a>:

```
a591.pep

1 LHTLLAFIFA ILILVSLHEF GHYIVARLCG VKVVRFSVGF GKPFFTRKRG

51 DTEWCLAPIP LGGYVKMVDT REGEVSEADL PYAFDKQHPA KRIAIVAAGP

101 LTNLALAVLL YGLSFSFGVT ELRPYVGTVE PDTIAARAGF QSGDKIQSVN

151 GTPVADWGSA QTEIVLNLEA GKVAVGVQTA SGAQTVRTID AAGTPEAGKI

201 AKNQGYIGLM PFKITTVAGG VEKGSPAEKA GLKPGDRLTA ADGKPIASWQ

251 EWANLTRQSP GKKITLTYER AGQTHTADIR PDTVEQPDHT LIGRVGLRPQ

301 PDRAWDAQIR RSYRPSVVRA FGMGWEKTVS HSWTTLKFFG KLISGNASVS

351 HISGPLTIAD IAGQSAELGL QSYLEFLALV SISLGVLNLL PVPVLDGGHL

401 VFYTAEWIRG KPLGERVQNI GLRFGLALMM LMMAVAFFND VTRLLG* m591/a591  99.6% identity in 446 aa overlap 10         20         30         40         50         60
m591.pep  LHTLLAFIFAILILVSLHEFGHYIVARLCGVKVVRFSVGFGKPFFTRKRGDTEWCLAPIP
          ||||||||||||||||||||||||||||||||||||||||||||||||||||||||||||
a591      LHTLLAFIFAILILVSLHEFGHYIVARLCGVKVVRFSVGFGKPFFTRKRGDTEWCLAPIP
                10         20         30         40         50         60

70         80         90        100        110        120
m591.pep  LGGYVKMVDTREGEVSEADLPYAFDKQHPAKRIAIVAAGPLTNLALAVLLYGLSFSFGVT
          ||||||||||||||||||||||||||||||||||||||||||||||||||||||||||||
a591      LGGYVKMVDTREGEVSEADLPYAFDKQHPAKRIAIVAAGPLTNLALAVLLYGLSFSFGVT
                70         80         90        100        110        120

130        140        150        160        170        180
m591.pep  ELRPYVGTVEPDTIAARAGFQSGDKIQSVNGTPVADWGSAQTEIVLNLEAGKVAVGVQTA
          ||||||||||||||||||||||||||||||||||||||||||||||||||||||||||||
a591      ELRPYVGTVEPDTIAARAGFQSGDKIQSVNGTPVADWGSAQTEIVLNLEAGKVAVGVQTA
               130        140        150        160        170        180
```

```
              190       200       210       220       230       240
m591.pep  SGAQTVRTIDAAGTPEAGKIAKNQGYIGLMPFKITTVAGGVEKGSPAEKAGLKPGDRLTA
          ||||||||||||||||||||||||||||||||||||||||||||||||||||||||||||
a591      SGAQTVRTIDAAGTPEAGKIAKNQGYIGLMPFKITTVAGGVEKGSPAEKAGLKPGDRLTA
              190       200       210       220       230       240

250       260       270       280       290       300
m591.pep  ADGKPIASWQEWANLTRQSPGKKITLNYERAGQTHTADIRPDTVEQSDHTLIGRVGLRPQ
          ||||||||||||||||||||||||||||:|||||||||||||||||| ||||||||||||
a591      ADGKPIASWQEWANLTRQSPGKKITLTYERAGQTHTADIRPDTVEQPDHTLIGRVGLRPQ
              250       260       270       280       290       300

310       320       330       340       350       360
m591.pep  PDRAWDAQIRRSYRPSVVRAFGMGWEKTVSHSWTTLKFFGKLISGNASVSHISGPLTIAD
          ||||||||||||||||||||||||||||||||||||||||||||||||||||||||||||
a591      PDRAWDAQIRRSYRPSVVRAFGMGWEKTVSHSWTTLKFFGKLISGNASVSHISGPLTIAD
              310       320       330       340       350       360

370       380       390       400       410       420
m591.pep  IAGQSAELGLQSYLEFLALVSISLGVLNLLPVPVLDGGHLVFYTAEWIRGKPLGERVQNI
          ||||||||||||||||||||||||||||||||||||||||||||||||||||||||||||
a591      IAGQSAELGLQSYLEFLALVSISLGVLNLLPVPVLDGGHLVFYTAEWIRGKPLGERVQNI
              370       380       390       400       410       420

430       440
m591.pep  GLRFGLALMMLMMAVAFFNDVTRLLGX
          |||||||||||||||||||||||||||
a591      GLRFGLALMMLMMAVAFFNDVTRLLGX
              430       440
```

The following partial DNA sequence was identified in *N. gonorrhoeae* <SEQ ID 1847>:

```
g592.seq..
   1 atgattccgg acgtgttcgg tcagattttt tcgggcgcgt tcaaattcga
  51 cgcggcagca ggcggcttac tcggcggtct gatttcgcaa acgatgatga
 101 tgggcatcaa acgcggcctg tattccaacg aggcgggtat gggttccgcg
 151 ccgaacgccg ccgccgccgc cgaagtgaaa caccctgttt cgcaaggtat
 201 gattcaaatg ctgggcgtgt tgtcgatac catcatcgtt tgttcttgca
 251 ccgccttcat catcttgatt taccaacagc cttatggcga tttgagcggt
 301 gcggcgctga cgcaggcggc gattgtcagc caagtggggc aatggggcgc
 351 gggtttcctc gccgtcatcc tgtttatgtt tgccttttcc accgttatcg
 401 gcaactatgc ctatgccgag tccaacgtcc aattcatcaa aagccattgg
 451 ctgattaccg ccgttttccg tatgctggtt ttggcgtggg tctatttcgg
 501 cgcggttgcc aatgtgcctt ggtctgggat atggcggat atggcgatgg
 551 gcatcatggc gtggatcaac ctcgtcgcca tcctgctgct ctcgccattg
 601 gcgtttatgc tgctgcgcga ttacaccgcc aagctgaaaa tgggcaaaga
 651 ccccgagttc aaactttccg aacatccggg cctgaaacgc cgcatcaaat
 701 ccgatgtttg gtaa
```

This corresponds to the amino acid sequence <SEQ ID 1848; ORF 592.ng>:

```
g592.pep ..
   1 MIPDVFGQIF SGAFKFDAAA GGLLGGLISQ TMMMGIKRGL YSNEAGMGSA

51 PNAAAAAEVK HPVSQGMIQM LGVFVDTIIV CSCTAFIILI YQQPYGDLSG

101 AALTQAAIVS QVGQWGAGFL AVILFMFAFS TVIGNYAYAE SNVQFIKSHW

151 LITAVFRMLV LAWVYFGAVA NVPLVWDMAD MAMGIMAWIN LVAILLLSPL

201 AFMLLRDYTA KLKMGKDPEF KLSEHPGLKR RIKSDVW*
```

The following partial DNA sequence was identified in *N. meningitidis* <SEQ ID 1849>:

```
m592.seq ..
   1 ATGATTCCGG

The following partial DNA sequence was identified in *N. meningitides* <SEQ ID 1851>:

```
a592.seq
   1 ATGAT

The following partial DNA sequence was identified in *N. gonorrhoeae* <SEQ ID 1853>:

```
g593.seq..
   1 atgcttgaac tgaacggact ctgcaaatgc ttcggcggca aaacggtcgc 51 cgacaacatc tgcctgactg tcgggcgcgg caaaatactc gccgtactgg 101 ggcggtcggg ctgcggcaaa tccaccctgc tgaatatgat tgcgggcatc 151 gtccggccgg acggcggcga aattcggctg aacggggaaa acattacctg 201 tatgccgccc gaaaaacgcc gtatctcgct gatgtttcaa gattacgcgc 251 tgtttcccca tatgagtgcg ctggaaaata cggcattcgg tttgaaaatg 301 caaaaaatgc cgaaagccga agccgaacgc ctcgccttgt cggcacttgc 351 cgaagtcggg ctggaaaacg aggcgcaccg caagcctgaa aaactttccg 401 gaggcgagaa gcaacggttg gcactggcgc gcgctttggt tgtccgccct 451 tccctgctgt tgctggatga atcgttttcc agtttggaca cgcatttgcg 501 cgaccggctg cgccgtatga ccgccgaacg catccgcaag ggcggcatcc 551 ctgccgtttt ggtaacgcat tcgcccgaag aggcctgcac ggcggcggac 601 gaaatcgccg tcatgcacga ggggaaaatc cttcaatgcg gtacgcccga 651 aaccttgatt caaacgcctg ccggcgtgca ggtcgcccgt ctgatggggc 701 tgcccaatac cgacgatgac cgccatattc cgcaaaatgc cgtgtgcttg 751 gacaatcatg gaacggaatg ccgtctgctg tccctcgtcc gcctgcccga 801 ctcgctccgg ctttccgccg tccatcccga acacggcgag ctgaccttaa 851 acctgactgt cggacaacat acggacggta tttccggaaa cggtacggtc 901 cgcatccgcg tcgatgaagg gcgtatcgtc cgtttccgat ga
                                                  35
```

This corresponds to the amino acid sequence <SEQ ID 1854; ORF 593.ng>:

```
g593.pep..
   1 MLELNGLCKC FGGKTVADNI CLTVGRGKIL AVLGRSGCGK STLLNMIAGI

51 VRPDGGEIRL NGENITCMPP EKRRISLMFQ DYALFPHMSA LENTAFGLKM

101 QKMPKAEAER LALSALAEVG LENEAHRKPE KLSGGEKQRL ALARALVVRP

151 SLLLLDESFS SLDTHLRDRL RRMTAERIRK GGIPAVLVTH SPEEACTAAD

201 EIAVMHEGKI LQCGTPETLI QTPAGVQVAR LMGLPNTDDD RHIPQNAVCL

251 DNHGTECRLL SLVRLPDSLR LSAVHPEHGE LTLNLTVGQH TDGISGNGTV

301 RIRVDEGRIV RFR*
```

The following partial DNA sequence was identified in *N. meningitidis* <SEQ ID 1855>:

```
m593.seq
   1 ATGCTTGAAC TGAACGGACT CTGCAAACGC TTCGGCAATA AAACCGTCGC

51 CGACAACATC TGCCTGACTG TCGGGCGCGG CAAAATACTC GCCGTTTTGG

101 GGCGGTCGGG CTGCGGAAAA TCCACCCTGC TGAATATAAT TGCGGGGATT

151 GTCCGGCCGG ACGGCGGGGA AATATGGCTG AACGGAGAAA ACATTACCCG

201 TATGCCGCCC GAAAAACGCC GTATCTCGCT GATGTTTCAA GATTACGCGC

251 TGTTTCCCCA TATGAGTGCG CTGGAAAATG CGGCATTCGG TTTGAAAATG
```

```
-continued
301 CAAAAAATGC CGAAAGCCGA AGCCGAACGC CTCGCCATGG CGGCACTTGC

351 CGAAGTCGGA CTGGAAAACG AGGCGCACCG CAAGCCTGAA AAACTTTCCG

401 GAGGCGAGAA GCAACGGCTG GCGTTGGCGC GCGCTTTGGT TGTCCGCCCT

451 TCCCTGCTGC TGTTGGACGA ATCGTTTTCC AGTTTGGACA CGCATTTGCG

501 CGGCACGCTG CGCCGTATGA CTGCCGAACG TATCCGAAAC GGCGGCATCC

551 CTGCCGTTTT GGTAACGCAT TCGCCCGAAG AAGCCTGTAC GACGGCAGAC

601 GAAATCGCCG TGATGCATAA AGGGAGGATT CTACAATACG GTACGCCCGA

651 AACATTGGTC AAAACACCAT CCTGCGTGCA GGTCGCCCGA CTGATGGGTT

701 TGCCCAATAC CGACGATAAC CGCCATATTC CGCAACATGC GGTGCGTTTC

751 GACCAAGACG GCATGGAGTG CCGCGTATTA TCCCGTACCT GTTTGCCCGA

801 ATCGTTCAGC CTGTCCGTCC TCCATCCGGA ACACGGCATC CTGTGGCTGA

851 ACCTCGATAT GCGGCACGCC GGGGCGGTAT CGGGCAAGGA TACGGTACGC

901 ATCCATATCG AAGAACGGGA AATCGTCCGC TTCCGCTGA
```

This corresponds to the amino acid sequence <SEQ ID 1856; ORF 593>:

```
m593.pep ..
   1 MLELNGLCKR FGNKTVADNI CLTVGRGKIL AVLGRSGCGK STLLNIIAGI

51 VRPDGGEIWL NGENITRMPP EKRRISLMFQ DYALFPHMSA LENAAFGLKM

101 QKMPKAEAER LAMAALAEVG LENEAHRKPE KLSGGEKQRL ALARALVVRP

151 SLLLLDESFS SLDTHLRGTL RRMTAERIRN GGIPAVLVTH SPEEACTTAD

201 EIAVMHKGRI LQYGTPETLV KTPSCVQVAR LMGLPNTDDN RHIPQHAVRF

251 DQDGMECRVL SRTCLPESFS LSVLHPEHGI LWLNLDMRHA GAVSGKDTVR

301 IHIEEREIVR FR*
```

Computer analysis of this amino acid sequence gave the following results:
Homology with a Predicted ORF from *N. gonorrhoeae*

```
   m593/g593    83.4% identity in 313 aa overlap 10         20         30         40         50         60
        m593.pep    MLELNGLCKRFGNKTVADNICLTVGRGKILAVLGRSGCGKSTLLNIIAGIVRPDGGEIWL
                    |||||||||| ||:||||||||||||||||||||||||||||||||:||||||||||| |
        g593        MLELNGLCKCFGGKTVADNICLTVGRGKILAVLGRSGCGKSTLLNMIAGIVRPDGGEIRL
                     10         20         30         40         50         60

70         80         90        100        110        120
        m593.pep    NGENITRMPPEKRRISLMFQDYALFPHMSALENAAFGLKMQKMPKAEAERLAMAALAEVG
                    |||||| |||||||||||||||||||||||||||:|||||||||||||||||::||||||
        g593        NGENITCMPPEKRRISLMFQDYALFPHMSALENTAFGLKMQKMPKAEAERLALSALAEVG
                     70         80         90        100        110        120

130        140        150        160        170        180
        m593.pep    LENEAHRKPEKLSGGEKQRLALARALVVRPSLLLLDESFSSLDTHLRGTLRRMTAERIRN
                    |||||||||||||||||||||||||||||||||||||||||||||| ||||||||||:
        g593        LENEAHRKPEKLSGGEKQRLALARALVVRPSLLLLDESFSSLDTHLRDRLRRMTAERIRK
                    130        140        150        160        170        180

190        200        210        220        230        240
        m593.pep    GGIPAVLVTHSPEEACTTADEIAVMHKGRILQYGTPETLVKTPSCVQVARLMGLPNTDDN
                    ||||||||||||||||:||||||||:|:|||||||:|::| ||||||||||||||||||:
        g593        GGIPAVLVTHSPEEACTAADEIAVMHEGKILQCGTPETLIQTPAGVQVARLMGLPNTDDD
                    190        200        210        220        230        240

250        260        270        280        290        299
        m593.pep    RHIPQHAVRFDQDGMECRVLSRTCLPESFSLSVLHPEHGILWLNLDM-RHAGAVSGKDTV
                    |||||:||  :|: |  |||:||  ||:|: ||::||||| |||  : :|:  ::||  ||
        g593        RHIPQNAVCLDNHGTECRLLSLVRLPDSLRLSAVHPEHGELTLNLTVGQHTDGISGNGTV
                    250        260        270        280        290        300
```

```
              300        310
m593.pep    RIHIEEREIVRFRX
            ||:::| :||||||
g593        RIRVDEGRIVRFRX
                       310
```

The following partial DNA sequence was identified in *N. meningitidis* <SEQ ID 1857>:

```
a593.seq
   1 ATGCTTGAAC TGAACGGACT CTGCAAACGC TTCGGCGGCA AAACGGTTGC

51 CGACGATATC TGCCTGACTG TCGGGCGCGG CAAAATACTC GCCGTTTTGG

101 GGCGGTCGGG CTGCGGCAAA TCCACCCTGC TGAATATGAT TGCGGGCATC

151 GTCCGGCCGG ACGGCGGGGA AATATGGCTG AATGGGGAAA ACATTACCCG

201 TATGCCGCCC GAAAAACGCC GTATTTCGCT GATGTTTCAA GATTACGCGC

251 TGTTTCCCCA TATGAGTGCA CTGGAAAATG CGGCATTCGG TTTGAAAATG

301 CAAAAAATGC CGAAAGCCGA AGCCGAAAGC CTCGCCATGG CGGCACTTGC

351 CGAAGTCGGA CTGGAAAACG AGGCGCACCG CAAGCCTGAN AAACTTTCCG

401 GAGGCGAAAA GCAACGGTTG GCACTGGCGC GCGCTTTGGT TGTCCGCCCT

451 TCCCTGCTGC TGTTGGACGA ATCGTTTTCC AGTTTGGACA CGCATTTGCG

501 CGACCGGCTG CGCCGCATGA CTGCCGAACG TATCCGCAAG GGCGGCATCC

551 CTGCCGTTTT GGTAACGCAT TCGCCCGAAG AGGCCTGCAC GGCGGCAGAC

601 GAAATCGCCG TCATGCACGA GGGGAAAATC CTTCAATGCG GTACGCCCGA

651 AACCTTGGTT CAAACGCCTG CCGGCGTGCA GGTCGCCCAT CTGATGGGGC

701 TGCCCAATAC CGACGATGAC CGCCATATTC CGCAACATGC GGTGCGTTTC

751 GACCAAGACG GCATGGAGTG CCGCGTATTA TCCCGTACCT GTTTGCCCGA

801 ATCGTTCAGC CTGTCCGTCC TCCATCCGGA ACACGGCATC CTGTGGCTGA

851 ACCTCGATAT GCCGCACGCC GGTGAAATAT CGGGAAACGA TACGGTACGC

901 ATCCATATCG AAGACAGGGA AATCGTCCGC TTCCGCTGA
```

This corresponds to the amino acid sequence <SEQ ID 1858; ORF 593.a>:

```
a593.pep

1 MLELNGLCKR FGGKTVADDI CLTVGRGKIL AVLGRSGCGK STLLNMIAGI

51 VRPDGGEIWL NGENITRMPP EKRRISLMFQ DYALFPHMSA LENAAFGLKM

101 QKMPKAEAES LAMAALAEVG LENEAHRKPX KLSGGEKQRL ALARALVVRP

151 SLLLLDESFS SLDTHLRDRL RRMTAERIRK GGIPAVLVTH SPEEACTAAD

201 EIAVMHEGKI LQCGTPETLV QTPAGVQVAH LMGLPNTDDD RHIPQHAVRF

251 DQDGMECRVL SRTCLPESFS LSVLHPEHGI LWLNLDMPHA GEISGNDTVR

301 IHIEDREIVR FR* m593/a593  92.9% identity in 312 aa overlap 10         20         30         40         50         60
m593.pep    MLELNGLCKRFGNKTVADNICLTVGRGKILAVLGRSGCGKSTLLNIIAGIVRPDGGEIWL
            ||||||||||:|||||||:||||||||||||||||||||||||||:||||||||||||||
a593        MLELNGLCKRFGGKTVADDICLTVGRGKILAVLGRSGCGKSTLLNMIAGIVRPDGGEIWL
                 10         20         30         40         50         60
```

```
                        70         80         90        100        110        120
m593.pep    NGENITRMPPEKRRISLMFQDYALFPHMSALENAAFGLKMQKMPKAEAERLAMAALAEVG
            ||||||||||||||||||||||||||||||||||||||||||||||| ||||||||||||
a593        NGENITRMPPEKRRISLMFQDYALFPHMSALENAAFGLKMQKMPKAEAESLAMAALAEVG
                        70         80         90        100        110        120

130        140        150        160        170        180
m593.pep    LENEAHRKPEKLSGGEKQRLALARALVVRPSLLLLDESFSSLDTHLRGTLRRMTAERIRN
            ||||||||||  ||||||||||||||||||||||||||||||||||| | ||||||||||:
a593        LENEAHRKPXKLSGGEKQRLALARALVVRPSLLLLDESFSSLDTHLRDRLRRMTAERIRK
                       130        140        150        160        170        180

190        200        210        220        230        240
m593.pep    GGIPAVLVTHSPEEACTTADEIAVMHKGRILQYGTPETLVKTPSCVQVARLMGLPNTDDN
            ||||||||||||||||:|||||||||:|:|||  ||||||||:|| |:: ||||||||||:
a593        GGIPAVLVTHSPEEACTAADEIAVMHEGKILQCGTPETLVQTPAGVQVAHLMGLPNTDDD
                       190        200        210        220        230        240

250        260        270        280        290        300
m593.pep    RHIPQHAVRFDQDGMECRVLSRTCLPESFSLSVLHPEHGILWLNLDMRHAGAVSGKDTVR
            ||||||||||||||||||||||||||||||||||||||||||||||||||   :: ||||
a593        RHIPQHAVRFDQDGMECRVLSRTCLPESFSLSVLHPEHGILWLNLDMPHAGEISGNDTVR
                       250        260        270        280        290        300

310
m593.pep    IHIEEREIVRFRX
            ||||:||||||||
a593        IHIEDREIVRFRX
                       310
```

The following partial DNA sequence was identified in *N. gonorrhoeae* <SEQ ID 1859>:

```
g594.seq..
   1 atgggtgcag ataccgatgg cgacaaggat gttcggctta atcgaacggg 51 tctcgttttt agcatactcc ggctgctgtt ccgcatcgga attgggatcg 101 gtaagttcgc cgttcaggcc tttcaggtct ttaagctgct gatctgtacg 151 gttgagcacc caaatcggtt tgccttgcca ctcggcggtc agcagctgac 201 ccgcttcgat tttactgaca tccacctcga cggcagcacc ggaggccttg 251 gcttttccg aagggaaaaa actggccaca aacggcgttg ccacacccaa 301 tgctgccact ccgcccgcgc cgcaggtcgc aagtgtcagg aaacggcggc 351 ggccgttgtt gatttcttga ttatccatta ttcagtcgtc ctaatatttt 401 gggaatgccg agccattaaa cattgcaatt ttacccagtt tgcagtgata 451 ctcaaagcat tatttaaaat aaggtaa
```

This corresponds to the amino acid sequence <SEQ ID 1860; ORF 594.ng>:

```
g594.pep
   1 MGADTDGDKD VRLNRTGLVF SILRLLFRIG IGIGKFAVQA FQVFKLLICT

51 VEHPNRFALP LGGQQLTRFD FTDIHLDGST GGLGFFRREK TGHKRRCHTQ

101 CCHSARAAGR KCQETAAAVV DFLIIHYSVV LIFWECRAIK HCNFTQFAVI

151 LKALFKIR*
```

The following partial DNA sequence was identified in *N. meningitidis* <SEQ ID 1861>:

```
m594.seq
   1 ATGGGTGCAG ATACCGATGG CGACAAGGAT GTTCGGCTTA ATCGAACGGG

51 TCTCGTTTTT AGCATACTCC GGCTGCTGTT CCGCATCGGA ATTGGGATCG

101 GTAAGTTCGC CGTTCAGGCC TTTCAGGTCT TTAAGCTGCT GATCTGTACG
```

```
151 GTTGAGCACC CAAATCGGTT TGCCTTGCCA CTCGGCGGTC AGCAGCTGAC

201 CCGCTTCGAT TTTACTGACA TCCACCTCGA CGGCAGCACC GGCGGCCTTG

251 GCTTTTTCCG AAGGGAAAAA ACTGGCCACA AACGGCGTTG CCACACCCAA

301 TGCTGCCACT CCGCCCGCGC CGCAGGTCGC GAGTGTCAGG AAACGGCGGC

351 GGCCGTTGTT GATTTCTTGA TTATCCATTA TTCAGTCGTC CTAATATTTT

401 GGGAATACCG AGCCATTAAA CGTTGCAATT TTACCCAGTT TGCAGTGATA

451 CTCAAAGCAT TATTTAAAAT AAGGTAA
```

This corresponds to the amino acid sequence <SEQ ID 1862; ORF 594>:

```
m594.pep
  1 MGADTDGDKD VRLNRTGLVF SILRLLFRIG IGIGKFAVQA FQVFKLLICT

51 VEHPNRFALP LGGQQLTRFD FTDIHLDGST GGLGFFRREK TGHKRRCHTQ

101 CCHSARAAGR ECQETAAAVV DFLIIHYSVV LIFWEYRAIK RCNFTQFAVI

151 LKALFKIR*
```

Computer analysis of this amino acid sequence gave the following results:
Homology with a Predicted ORF from *N. gonorrhoeae*

```
    m594/g594    98.1% identity in 158 aa overlap 10         20         30         40         50         60
    m594.pep    MGADTDGDKDVRLNRTGLVFSILRLLFRIGIGIGKFAVQAFQVFKLLICTVEHPNRFALP
                ||||||||||||||||||||||||||||||||||||||||||||||||||||||||||||
    g594        MGADTDGDKDVRLNRTGLVFSILRLLFRIGIGIGKFAVQAFQVFKLLICTVEHPNRFALP
                        10         20         30         40         50         60

70         80         90        100        110        120
    m594.pep    LGGQQLTRFDFTDIHLDGSTGGLGFFRREKTGHKRRCHTQCCHSARAAGRECQETAAAVV
                |||||||||||||||||||||||||||||||||||||||||||||||||||:||||||||
    g594        LGGQQLTRFDFTDIHLDGSTGGLGFFRREKTGHKRRCHTQCCHSARAAGRKCQETAAAVV
                        70         80         90        100        110        120

130        140        150    159
    m594.pep    DFLIIHYSVVLIFWEYRAIKRCNFTQFAVILKALFKIRX
                ||||||||||||||||| ||||:||||||||||||||||
    g594        DFLIIHYSVVLIFWECRAIKHCNFTQFAVILKALFKIRX
                       130        140        150
```

The following partial DNA sequence was identified in *N. meningitidis* <SEQ ID 1863>:

```
a594.seq
  1 ATGGGTGCAG ATACCGATGG CGACAAGGAT GTTCGGCTTA ATCGAACGGG

51 TCTCGTTTTT AGCATACTCC GGCTGCTGTT CCGCATCGGA ATTGGGATCG

101 GTAAGTTCGC CGTTCAGGCC TTTCAGGTCT TTAAGCTGCT GATCTGTACG

151 GTTGAGCACC CAAATCGGTT TGCCTTGCCA CTCGGCGGTC AGCAACTGAC

201 CCGCTTCGAT TTTACTGACA TCCACCTCGA CGGCAGCACC GGCGGCCTTG

251 GCTTTTTCCG AAGGGAAAAA ACTGGCCACA AACGGCGTTG CCACACCCAA

301 TGCTGCCACT CCGCCCGCGC CGCAGGTCGC GAGTGTCAGG AAACGGCGGC

351 GGCCGTTGTT GATTTCTTGA TTATCCATTA TTCAGTCGTC CTAATATTTT

401 GGGAATACCG AGCCATTAAA CGTTGCAATT TTACCCAGTT TGCAGTGATA

451 CTCAAAGCAT TATTTAAAAT AAGGTAA
```

This corresponds to the amino acid sequence <SEQ ID 1864; ORF 594.a>:

```
a594.pep

1 MGADTDGDKD VRLNRTGLVF SILRLLFRIG IGIGKFAVQA FQVFKLLICT

51 VEHPNRFALP LGGQQLTRFD FTDIHLDGST GGLGFFRREK TGHKRRCHTQ

101 CCHSARAAGR ECQETAAAVV DFLIIHYSVV LIFWEYRAIK RCNFTQFAVI

151 LKALFKIR* m594/a594  100.0% identity in 158 aa overlap 10         20         30         40         50         60
m594.pep   MGADTDGDKDVRLNRTGLVFSILRLLFRIGIGIGKFAVQAFQVFKLLICTVEHPNRFALP
           ||||||||||||||||||||||||||||||||||||||||||||||||||||||||||||
a594       MGADTDGDKDVRLNRTGLVFSILRLLFRIGIGIGKFAVQAFQVFKLLICTVEHPNRFALP
                 10         20         30         40         50         60

70         80         90        100        110        120
m594.pep   LGGQQLTRFDFTDIHLDGSTGGLGFFRREKTGHKRRCHTQCCHSARAAGRECQETAAAVV
           ||||||||||||||||||||||||||||||||||||||||||||||||||||||||||||
a594       LGGQQLTRFDFTDIHLDGSTGGLGFFRREKTGHKRRCHTQCCHSARAAGRECQETAAAVV
                 70         80         90        100        110        120

130        140        150       159
m594.pep   DFLIIHYSVVLIFWEYRAIKRCNFTQFAVILKALFKIRX
           |||||||||||||||||||||||||||||||||||||||
a594       DFLIIHYSVVLIFWEYRAIKRCNFTQFAVILKALFKIRX
                130        140        150
```

The following partial DNA sequence was identified in *N. gonorrhoeae* <SEQ ID 1865>:

```
g595.seq..
    1 atgagaaaat tcaatttgac cgcattgtcc gtgatgcttg ccttgggttt 51 gaccgcgtgc cagccgccgg aggcggagaa agccgcgccg ccgcgtccg 101 gtgagaccca atccgccaac gaaggcggtt cggtcggtat cgccgtcaac 151 gacaatgcct gcgaaccgat gaatctgacc gtgccgagcg acaggttgt 201 gttcaatatt aaaaacaaca gcggccgcaa gctcgaatgg gaaatcctga 251 agggcgtgat ggtggtggac gaacgcgaaa atatcgcccc ggggctttcc 301 gacaaaatga accgtaacct gctgccgggc gaatacgaaa tgacctgcgg 351 ccttttgacc aatccgcgcg gcaagctggt ggtagccgac agcggcttta 401 aagacaccgc caacgaagcg gatttggaaa aactgcccca accgctcgcc 451 gactataaag cctacgttca aggcgaggtt aaagagctgg cggcgaaaac 501 caaaaccttt accgaagccg tcaaagcagg cgacattgaa aaggcgaaat 551 ccctgtttgc cgccacccgc gtccattacg aacgcatcga accgattgcc 601 gagcttttca gcgaactcga ccccgtcatc gatgcgtgtg aagacgactt 651 caaagacggt gcgaaagatg ccgggtttac cggcttccac cgtatcgaac 701 acgcccttg ggtggaaaaa gacgtatccg gcgtgaagga aaccgcggcc 751 aaactgatga ccgatgtcga agccctgcaa aagaaatcg acgcattggc 801 gttccctccg ggcaaagtgg tcggcggcgc gtccgaactg attgaagaag 851 cggcgggcag taaaatcagc ggcgaagaag accgttacag ccacaccgat 901 ttgagcgact tccaagctaa tgcggacgga tctaaaaaaa tcgtcgattt 951 gttccgtccg ttgattgagg ccaaaaacaa agccttgttg gaaaaaaccg 1001 ataccaactt caaacaggtc aacgaaattc tggcgaaata ccgcaccaaa 1051 gacggtttg aaacctacga caagctgagc gaagccgacc gcaaagcatt
```

-continued

```
1101 acaggctcct attaacgcgc ttgccgaaga ccttgcccaa cttcgcggca 1151 tactcggctt gaaataa
```

This corresponds to the amino acid sequence <SEQ ID 1866; ORF 595.ng>:

```
g595.pep ..
   1 MRKFNLTALS VMLALGLTAC QPPEAEKAAP AASGETQSAN EGGSVGIAVN

51 DNACEPMNLT VPSGQVVFNI KNNSGRKLEW EILKGVMVVD ERENIAPGLS

101 DKMNRNLLPG EYEMTCGLLT NPRGKLVVAD SGFKDTANEA DLEKLPQPLA

151 DYKAYVQGEV KELAAKTKTF TEAVKAGDIE KAKSLFAATR VHYERIEPIA

201 ELFSELDPVI DACEDDFKDG AKDAGFTGFH RIEHALWVEK DVSGVKETAA

251 KLMTDVEALQ KEIDALAFPP GKVVGGASEL IEEAAGSKIS GEEDRYSHTD

301 LSDFQANADG SKKIVDLFRP LIEAKNKALL EKTDTNFKQV NEILAKYRTK

351 DGFETYDKLS EADRKALQAP INALAEDLAQ LRGILGLK*
```

The following partial DNA sequence was identified in *N. meningitidis* <SEQ ID 1867>:

```
m595.seq
    1 ATGAGAAAAT TCAATTTGAC CGCATTGTCC GTGATGCTTG CCTTAGGTTT

51 GACCGCGTGC CAGCCGCCGG AGGCGGAGAA AGCTGCGCCG GCAGCGTCCG

101 GTGAGGCGCA AACCGCCAAC GAGGGCGGTT CGGTCAGTAT CGCCGTCAAC

151 GACAATGCCT GCGAACCGAT GGAACTGACC GTGCCGAGCG GACAGGTTGT

201 GTTCAATATT AAAAACAACA GCGGCCGCAA GCTCGAATGG GAAATCCTGA

251 AAGGCGTGAT GGTGGTGGAC GAGCGCGAAA ACATCGCCCC CGGACTTTCC

301 GATAAAATGA CCGTCACCCT GTTGCCGGGC GAATACGAAA TGACTTGCGG

351 TCTTTTGACC AATCCGCGCG GCAAGCTGGT GGTAACCGAC AGCGGCTTTA

401 AAGACACCGC CAACGAAGCG GATTTGGAAA AACTGTCCCA ACCGCTCGCC

451 GACTATAAAG CCTACGTTCA AGGCGAGGTT AAAGAGCTGG TGGCGAAAAC

501 CAAAACTTTT ACCGAAGCCG TCAAAGCAGG CGACATTGAA AAGGCGAAAT

551 CCCTGTTTGC CGACACCCGC GTCCATTACG AACGCATCGA ACCGATTGCC

601 GAGCTTTTCA GCGAACTCGA CCCCGTCATC GATGCGCGTG AAGACGACTT

651 CAAAGACGGC GCGAAAGATG CCGGATTTAC CGGCTTTCAC CGTATCGAAT

701 ACGCCCTTTG GGTGGAAAAA GACGTGTCCG GCGTGAAGGA AATTGCAGCG

751 AAACTGATGA CCGATGTCGA AGCCCTGCAA AAAGAAATCG ACGCATTGGC

801 GTTTCCTCCG GGCAAGGTGG TCGGCGGCGC GTCCGAACTG ATTGAAGAAG

851 TGGCGGGCAG TAAAATCAGC GGCGAAGAAG ACCGGTACAG CCACACCGAT

901 TTGAGCGACT TCCAAGCCAA TGTGGACGGA TCTAAAAAAA TCGTCGATTT

951 GTTCCGTCCG CTGATCGAGG CCAAAAACAA AGCCTTGTTG GAAAAAACCG

1001 ATACCAACTT CAAACAGGTC AACGAAATTC TGGCGAAATA CCGGACTAAA

1051 GACGGTTTTG AAACCTACGA CAAGCTGGGC GAAGCCGACC GCAAAGCGTT

1101 ACAGGCCTCT ATTAACGCGC TTGCCGAAGA CCTTGCCCAA CTTCGCGGCA

1151 TACTCGGCTT GAAATAA
```

This corresponds to the amino acid sequence <SEQ ID 1868; ORF 595>:

```
m595.pep
   1 MRKFNLTALS VMLALGLTAC QPPEAEKAAP AASGEAQTAN EGGSVSIAVN

51 DNACEPMELT VPSGQVVFNI KNNSGRKLEW EILKGVMVVD ERENIAPGLS

101 DKMTVTLLPG EYEMTCGLLT NPRGKLVVTD SGFKDTANEA DLEKLSQPLA

151 DYKAYVQGEV KELVAKTKTF TEAVKAGDIE KAKSLFADTR VHYERIEPIA

201 ELFSELDPVI DAREDDFKDG AKDAGFTGFH RIEYALWVEK DVSGVKEIAA

251 KLMTDVEALQ KEIDALAFPP GKVVGGASEL IEEVAGSKIS GEEDRYSHTD

301 LSDFQANVDG SKKIVDLFRP LIEAKNKALL EKTDTNFKQV NEILAKYRTK

351 DGFETYDKLG EADRKALQAS INALAEDLAQ LRGILGLK*
```

Computer analysis of this amino acid sequence gave the following results:
Homology with a Predicted ORF from *N. gonorrhoeae*

```
    m595/g595  95.4% identity in 388 aa overlap
                    10         20         30         40         50         60
    m595.pep   MRKFNLTALSVMLALGLTACQPPEAEKAAPAASGEAQTANEGGSVSIAVNDNACEPMELT
               ||||||||||||||||||||||||||||||||:|:||||||:||||||||||||||||:||
    g595       MRKFNLTALSVMLALGLTACQPPEAEKAAPAASGETQSANEGGSVGIAVNDNACEPMNLT
                    10         20         30         40         50         60

70         80         90        100        110        120
    m595.pep   VPSGQVVFNIKNNSGRKLEWEILKGVMVVDERENIAPGLSDKMTVTLLPGEYEMTCGLLT
               |||||||||||||||||||||||||||||||||||||||||||:||:|||||||||||||
    g595       VPSGQVVFNIKNNSGRKLEWEILKGVMVVDERENIAPGLSDKMNRNLLPGEYEMTCGLLT
                    70         80         90        100        110        120

130        140        150        160        170        180
    m595.pep   NPRGKLVVTDSGFKDTANEADLEKLSQPLADYKAYVQGEVKELVAKTKTFTEAVKAGDIE
               ||||||||:|||||||||||||||:|||||||||||||||||:||||||||||||||||
    g595       NPRGKLVVADSGFKDTANEADLEKLPQPLADYKAYVQGEVKELAAKTKTFTEAVKAGDIE
                   130        140        150        160        170        180

190        200        210        220        230        240
    m595.pep   KAKSLFADTRVHYERIEPIAELFSELDPVIDAREDDFKDGAKDAGFTGFHRIEYALWVEK
               |||||||:|||||||||||||||||||||||||:||||||||||||||||||||:|||||
    g595       KAKSLFAATRVHYERIEPIAELFSELDPVIDACEDDFKDGAKDAGFTGFHRIEHALWVEK
                   190        200        210        220        230        240

250        260        270        280        290        300
    m595.pep   DVSGVKEIAAKLMTDVEALQKEIDALAFPPGKVVGGASELIEEVAGSKISGEEDRYSHTD
               |||||||:|||||||||||||||||||||||||||||||||||:||||||||||||||||
    g595       DVSGVKETAAKLMTDVEALQKEIDALAFPPGKVVGGASELIEEAAGSKISGEEDRYSHTD
                   250        260        270        280        290        300

310        320        330        340        350        360
    m595.pep   LSDFQANVDGSKKIVDLFRPLIEAKNKALLEKTDTNFKQVNEILAKYRTKDGFETYDKLG
               |||||||:|||||||||||||||||||||||||||||||||||||||||||||||||||:
    g595       LSDFQANADGSKKIVDLFRPLIEAKNKALLEKTDTNFKQVNEILAKYRTKDGFETYDKLS
                   310        320        330        340        350        360

370        380    389
    m595.pep   EADRKALQASINALAEDLAQLRGILGLKX
               |||||||||:|||||||||||||||||||
    g595       EADRKALQAPINALAEDLAQLRGILGLKX
                   370        380
```

The following partial DNA sequence was identified in *N. meningitidis* <SEQ ID 1869>:

```
a595.seq
   1 ATGAGAAAAT TCAATTTGAC CGCATTGTCC GTGATGCTTG CCTTAGGTTT

51 GACCGCGTGC CAGCCGCCGG AGGCGGAGAA AGCTGCGCCG GCAGCGTCCG

101 GTGAGGCGCA AACCGCCAAC GAGGGCGGTT CGGTCAGTAT CGCCGTCAAC

151 GACAATGCCT GCGAACCGAT GGAACTGACC GTGCCGAGCG GACAGGTTGT

201 GTTCAATATT AAAAACAACA GCGGCCGCAA GCTCGAATGG GAAATCCTGA
```

-continued

```
 251 AAGGCGTGAT GGTGGTGGAC GAGCGCGAAA ACATCGCCCC CGGACTTTCC

301 GATAAAATGA CCGTCACCCT GTTGCCGGGC GAATACGAAA TGACTTGCGG

351 TCTTTTGACC AATCCGCGCG GCAAGCTGGT GGTAACCGAC AGCGGCTTTA

401 AAGACACCGC CAACGAAGCG GATTTGGAAA AACTGTCCCA ACCGCTCGCC

451 GACTATAAAG CCTATGTTCA AGGCGAAGTC AAAGAGCTGG TGGCGAAAAC

501 CAAAACCTTT ACCGAAGCCG TCAAAGCAGG CGACATTGAA AAGGCGAAAT

551 CCCTGTTTGC CGACACCCGC GTCCATTACG AACGCATCGA ACCGATTGCC

601 GAGCTTTTCA GCGAACTCGA CCCCGTCATC GATGCGCGTG AAGACGACTT

651 CAAAGACGGC GCGAAAGATG CCGGATTTAC CGGCTTCCAC CGTATCGAAT

701 ACGCCCTTTG GGTGGAAAAA GACGTGTCCG GCGTGAAGGA AATTGCAGCG

751 AAACTGATGA CCGATGTCGA AGCCCTGCAA AAAGAAATCG ACGCATTGGC

801 GTTTCCTCCG GGCAAGGTGG TCGGCGGCGC GTCCGAACTG ATTGAAGAAG

851 TGGCGGGCAG TAAAATCAGC GGCGAAGAAG ACCGGTACAG CCACACCGAT

901 TTGAGCGACT TCCAAGCCAA TGTGGACGGA TCGAAAAAAA TCGTCGATTT

951 GTTCCGTCCG TTGATCGAGA CCAAAAACAA AGCCTTGTTG GAAAAAACCG

1001 ATACCAACTT CAAACAGGTC AACGAAATTC TGGCGAAATA CCGGACTAAA

1051 GACGGTTTTG AAACCTACGA CAAGCTGGGC GAAGCCGACC GCAAAGCGTT

1101 ACAGGCCTCT ATTAACGCGC TTGCCGAAGA CCTTGCCCAA CTTCGCGGCA

1151 TACTCGGCTT GAAATAA
```

This corresponds to the amino acid sequence <SEQ ID 1870; ORF 595.a>:

```
a595.pep

1   MRKFNLTALS VMLALGLTAC QPPEAEKAAP AASGEAQTAN EGGSVSIAVN

51   DNACEPMELT VPSGQVVFNI KNNSGRKLEW EILKGVMVVD ERENIAPGLS

101   DKMTVTLLPG EYEMTCGLLT NPRGKLVVTD SGFKDTANEA DLEKLSQPLA

151   DYKAYVQGEV KELVAKTKTF TEAVKAGDIE KAKSLFADTR VHYERIEPIA

201   ELFSELDPVI DAREDDFKDG AKDAGFTGFH RIEYALWVEK DVSGVKEIAA

251   KLMTDVEALQ KEIDALAFPP GKVVGGASEL IEEVAGSKIS GEEDRYSHTD

301   LSDFQANVDG SKKIVDLFRP LIETKNKALL EKTDTNFKQV NEILAKYRTK

351   DGFETYDKLG EADRKALQAS INALAEDLAQ LRGILGLK*
``` m595/a595 99.7% identity in 388 aa overlap

```
                  10         20         30         40         50         60
m595.pep  MRKFNLTALSVMLALGLTACQPPEAEKAAPAASGEAQTANEGGSVSIAVNDNACEPMELT
          ||||||||||||||||||||||||||||||||||||||||||||||||||||||||||||
a595      MRKFNLTALSVMLALGLTACQPPEAEKAAPAASGEAQTANEGGSVSIAVNDNACEPMELT
                  10         20         30         40         50         60

70         80         90        100        110        120
m595.pep  VPSGQVVFNIKNNSGRKLEWEILKGVMVVDERENIAPGLSDKMTVTLLPGEYEMTCGLLT
          ||||||||||||||||||||||||||||||||||||||||||||||||||||||||||||
a595      VPSGQVVFNIKNNSGRKLEWEILKGVMVVDERENIAPGLSDKMTVTLLPGEYEMTCGLLT
                  70         80         90        100        110        120

130        140        150        160        170        180
m595.pep  NPRGKLVVTDSGFKDTANEADLEKLSQPLADYKAYVQGEVKELVAKTKTFTEAVKAGDIE
          ||||||||||||||||||||||||||||||||||||||||||||||||||||||||||||
a595      NPRGKLVVTDSGFKDTANEADLEKLSQPLADYKAYVQGEVKELVAKTKTFTEAVKAGDIE
                 130        140        150        160        170        180
```

```
              190       200       210       220       230       240
m595.pep   KAKSLFADTRVHYERIEPIAELFSELDPVIDAREDDFKDGAKDAGFTGFHRIEYALWVEK
           ||||||||||||||||||||||||||||||||||||||||||||||||||||||||||||
a595       KAKSLFADTRVHYERIEPIAELFSELDPVIDAREDDFKDGAKDAGFTGFHRIEYALWVEK
              190       200       210       220       230       240

250       260       270       280       290       300
m595.pep   DVSGVKEIAAKLMTDVEALQKEIDALAFPPGKVVGGASELIEEVAGSKISGEEDRYSHTD
           ||||||||||||||||||||||||||||||||||||||||||||||||||||||||||||
a595       DVSGVKEIAAKLMTDVEALQKEIDALAFPPGKVVGGASELIEEVAGSKISGEEDRYSHTD
              250       260       270       280       290       300

310       320       330       340       350       360
m595.pep   LSDFQANVDGSKKIVDLFRPLIEAKNKALLEKTDTNFKQVNEILAKYRTKDGFETYDKLG
           |||||||||||||||||||||||||:||||||||||||||||||||||||||||||||||
a595       LSDFQANVDGSKKIVDLFRPLIETKNKALLEKTDTNFKQVNEILAKYRTKDGFETYDKLG
              310       320       330       340       350       360

370       380   389
m595.pep   EADRKALQASINALAEDLAQLRGILGLKX
           |||||||||||||||||||||||||||||
a595       EADRKALQASINALAEDLAQLRGILGLKX
              370       380
```

The following partial DNA sequence was identified in *N. gonorrhoeae* <SEQ ID 1871>:

```
g596.seq.(partial).
   1 ..atgctgctct tggacgagcc gaccaaccac ttggatgcgg aatcggtgga 51   atggctggag caattcctcg tgcgcttccc cggcacagtg gtcgcggtaa 101   cgcacgaccg ctacttcctc gacaacgccg ccgaatggat tttggaactc 151   gaccgcggac acggcattcc gtggaaaggc aattactcgt cttggctgga 201   gcagaaagaa aaacgcttgg aaaacgaggc gaaatccgaa gccgcgcgcg 251   tgaaggcgat gaagcaggaa ttggaatggg tgcgccaaaa tgccaaaggc 301   cgccaagcca agcccaaagc gcgtttggcg cgttttgaag aaatgagcaa 351   ctacgaatac caaaaacgca acgaaactca ggaaatcttt atccctgttg 401   ccgagcgttt gggtaacgaa gtgattgaat tgtgaatgt ttccaaatcg 451   ttcggcgata aagtgctgat tgacggtttg agcttcaaag tgccggcggg 501   cgcgattgtc ggcatcatcg gcccgaacgg cgcgggtaaa tcgacgctgt 551   tcaaaatgat tgcgggcaaa gagcagcccg attcgggcga agtgaaaatc 601   gggcaaaccg tgaaaatgag cttgattgac caaagccgcg aaggtttgca 651   aaacgacaaa accgtgttcg acaacattgc cgaaggtcgc gatattttgc 701   aggtcggaca gtttgaaatc cccgcccgcc aatatttggg acgcttcaac 751   tttaaaggca gcgaccaaag caaaatcgca aggcagcttt ccggcggcga 801   acgcggccgt ctgcacttgg caaaaacctt gttgggcggc ggcaatgtgt 851   tgctgctgga cgaaccgtcc aacgatctcg acgtggaaac cctgcgcgcg 901   ttggaagacg cattgttgga atttgccggc agcgtgatgg tgatttcgca 951   cgaccgctgg tttctcgacc gcatagccac gcatatcttg gcgtgtgaag 1001   gcgactccaa atgggtgttc ttcgacggca actatcaaga atacgaagcc 1051   gacaagaaac gccgactcgg caagaaggc gcgaaaccga aacgcatcaa 1101   atacaaaccg gtaacgcgtt aa
```

This corresponds to the amino acid sequence <SEQ ID 1872; ORF 596.ng>:

```
g596.pep (partial).
   1 ..MLLLDEPTNH LDAESVEWLE QFLVRFPGTV VAVTHDRYFL DNAAEWILEL

51   DRGHGIPWKG NYSSWLEQKE KRLENEAKSE AARVKAMKQE LEWVRQNAKG

101   RQAKPKARLA RFEEMSNYEY QKRNETQEIF IPVAERLGNE VIEFVNVSKS

151   FGDKVLIDGL SFKVPAGAIV GIIGPNGAGK STLFKMIAGK EQPDSGEVKI

201   GQTVKMSLID QSREGLQNDK TVFDNIAEGR DILQVGQFEI PARQYLGRFN

251   FKGSDQSKIA RQLSGGERGR LHLAKTLLGG GNVLLLDEPS NDLDVETLRA

301   LEDALLEFAG SVMVISHDRW FLDRIATHIL ACEGDSKWVF FDGNYQEYEA

351   DKKRRLGKEG AKPKRIKYKP VTR*
```

The following partial DNA sequence was identified in *N. meningitidis* <SEQ ID 1873>:

```
m596.seq..
    1 ATGTCCCAAC AATACGTCTA TTCTATGCTG CGCGTGAGCA AGGTTGTGCC

51 GCCGCAGAAA ACCATCATTA AAGATATTTC CCTTTCTTTC TTCCCCGGCG

101 CGAAAATCGG CCTGCTCGGT TTGAACGGCG CGGGCAAGTC CACCGTGCTG

151 CGGATTATGG CGGGCGTGGA TAAGGAATTT GAGGGCGAAG CCGTGCCGAT

201 GGGCGGCATC AAAATCGGCT ACCTGCCGCA AGAGCCTGAG CTTGATCCGG

251 AAAAAACCGT GCGCGAGGAA GTGGAAAGCG GTTTGGGCGA AGTGGCTGCC

301 GCGCAGAAAC GTTTGGAAGA AGTGTATGCC GAGTACGCCA ATCCTGATGC

351 GGATTTTGAC GCGTTGGCAG AAGAGCAGGG CCGCTTGGAA GCGATTATTG

401 CGGCAGGTTC GTCCACGGGC GGCGGTGCGG AACACGAATT GGAAATCGCC

451 GCCGACGCGC TGCGCCTGCC GGAATGGGAT GCCAAAATCG ATAATTTGTC

501 CGGCGGTGAA AAACGCCGCG TTGCCTTGTG CAAACTCTTG TTGAGCAAGC

551 CCGATATGCT TTTGCTGGAC GAGCCGACCA ACCACTTGGA TGCGGAATCG

601 GTCGAGTGGC TGGAGCAATT TCTCGTGCGC TTCCCCGGCA CAGTCGTTGC

651 GGTAACGCAC GACCGCTACT TCCTCGACAA CGCCGCCGAA TGGATTTTGG

701 AACTCGACCG CGGCCATGGT ATTCCGTGGA AAGGCAATTA CTCGTCTTGG

751 CTGGAGCAGA AAGAAAAACG CTTGGAAAAC GAGGCAAAAT CCGAAGCCGC

801 GCGCGTGAAG GCGATGAAGC AGGAATTGGA ATGGGTGCGC CAAAATGCCA

851 AAGGCCGCCA AGCCAAGTCC AAAGCGCGTT TGGCTCGTTT TGAAGAAATG

901 AGCAACTACG AATACCAAAA ACGCAATGAA ACGCAGGAAA TCTTTATTCC

951 CGTTGCCGAG CGTTTGGGTA ACGAAGTGAT TGAATTTGTA AATGTTTCCA

1001 AATCGTTCGG CGATAAAGTG CTGATTGACG ATTTGAGCTT CAAAGTGCCT

1051 GCGGGCGCGA TTGTCGGCAT CATCGGCCCG AACGGCGCGG GTAAATCTAC

1101 GCTGTTCAAA ATGATTTCGG GCAAAGAGCA GCCTGATTCC GGCGAGGTGA

1151 AAATCGGACA AACCGTGAAA ATGAGCTTGA TTGACCAAAG CCGCGAAGGT

1201 TTGCAAAACG ACAAAACCGT GTTCGACAAC ATTGCCGAAG CCGCGACAT

1251 TTTGCAGGTT GGTCAGTTTG AAATTCCCGC CGCCAATAT TTGGGGCGTT

1301 TCAACTTCAA AGGCAGCGAC CAAAGCAAAA TTGCAGGTCA ATTGTCTGGC
```

```
1351 GGCGAACGCG GTCGTCTGCA CTTGGCAAAA ACCTTGTTGA GCGGCGGCAA

1401 TGTATTGCTG CTGGATGAAC CGTCTAACGA CCTTGACGTG GAAACCCTGC

1451 GCGCGTTGGA AGACGCATTG TTGGAATTTG CCGGCAGCGT GATGGTGATT

1501 TCGCACGACC GTTGGTTCCT CGACCGCATC GCCACGCATA TCTTGGCGTG

1551 TGAAGGCGAC TCTAAATGGG TGTTCTTCGA CGGCAACTAT CAGGAATACG

1601 AAGCCGACAA GAAACGCCGT TTGGGCGAAG AAGGCGCGAA ACCGAAACGC

1651 ATCAAATACA AACCGGTAAC GCGTTAA
```

This corresponds to the amino acid sequence <SEQ ID 1874; ORF 596>:

```
m596.pep..
   1 MSQQYVYSML RVSKVVPPQK TIIKDISLSF FPGAKIGLLG LNGAGKSTVL

51 RIMAGVDKEF EGEAVPMGGI KIGYLPQEPE LDPEKTVREE VESGLGEVAA

101 AQKRLEEVYA EYANPDADFD ALAEEQGRLE AIIAAGSSTG GGAEHELEIA

151 ADALRLPEWD AKIDNLSGGE KRRVALCKLL LSKPDMLLLD EPTNHLDAES

201 VEWLEQFLVR FPGTVVAVTH DRYFLDNAAE WILELDRGHG IPWKGNYSSW

251 LEQKEKRLEN EAKSEAARVK AMKQELEWVR QNAKGRQAKS KARLARFEEM

301 SNYEYQKRNE TQEIFIPVAE RLGNEVIEFV NVSKSFGDKV LIDDLSFKVP

351 AGAIVGIIGP NGAGKSTLFK MISGKEQPDS GEVKIGQTVK MSLIDQSREG

401 LQNDKTVFDN IAEGRDILQV GQFEIPARQY LGRFNFKGSD QSKIAGQLSG

451 GERGRLHLAK TLLSGGNVLL LDEPSNDLDV ETLRALEDAL LEFAGSVMVI

501 SHDRWFLDRI ATHILACEGD SKWVFFDGNY QEYEADKKRR LGEEGAKPKR

551 IKYKPVTR*
```

Computer analysis of this amino acid sequence gave the following results:
Homology with a Predicted ORF from *N. gonorrhoeae*

```
    m596 g596   98.4% identity in 373 aa overlap 160        170        180        190        200        210
       m596.pep  LPEWDAKIDNLSGGEKRRVALCKLLLSKPDMLLLDEPTNHLDAESVEWLEQFLVRFPGTV
                                               ||||||||||||||||||||||||||||||
           g596                              MLLLDEPTNHLDAESVEWLEQFLVRFPGTV
                                                     10         20         30

220        230        240        250        260        270
       m596.pep  VAVTHDRYFLDNAAEWILELDRGHGIPWKGNYSSWLEQKEKRLENEAKSEAARVKAMKQE
                 ||||||||||||||||||||||||||||||||||||||||||||||||||||||||||||
           g596  VAVTHDRYFLDNAAEWILELDRGHGIPWKGNYSSWLEQKEKRLENEAKSEAARVKAMKQE
                         40         50         60         70         80         90

280        290        300        310        320        330
       m596.pep  LEWVRQNAKGRQAKSKARLARFEEMSNYEYQKRNETQEIFIPVAERLGNEVIEFVNVSKS
                 |||||||||||||||| |||||||||||||||||||||||||||||||||||||||||||
           g596  LEWVRQNAKGRQAKPKARLARFEEMSNYEYQKRNETQEIFIPVAERLGNEVIEFVNVSKS
                        100        110        120        130        140        150

340        350        360        370        380        390
       m596.pep  FGDKVLIDDLSFKVPAGAIVGIIGPNGAGKSTLFKMISGKEQPDSGEVKIGQTVKMSLID
                 ||||||||:|||||||||||||||||||||||||||||:|||||||||||||||||||||
           g596  FGDKVLIDGLSFKVPAGAIVGIIGPNGAGKSTLFKMIAGKEQPDSGEVKIGQTVKMSLID
                        160        170        180        190        200        210

400        410        420        430        440        450
       m596.pep  QSREGLQNDKTVFDNIAEGRDILQVGQFEIPARQYLGRFNFKGSDQSKIAGQLSGGERGR
                 |||||||||||||||||||||||||||||||||||||||||||||||||| |||||||||
           g596  QSREGLQNDKTVFDNIAEGRDILQVGQFEIPARQYLGRFNFKGSDQSKIARQLSGGERGR
                        220        230        240        250        260        270
```

```
            460        470        480        490        500        510
m596.pep  LHLAKTLLSGGNVLLLDEPSNDLDVETLRALEDALLEFAGSVMVISHDRWFLDRIATHIL
          |||||||||:||||||||||||||||||||||||||||||||||||||||||||||||
g596      LHLAKTLLGGGNVLLLDEPSNDLDVETLRALEDALLEFAGSVMVISHDRWFLDRIATHIL
            280        290        300        310        320        330

520        530        540        550    559
m596.pep  ACEGDSKWVFFDGNYQEYEADKKRRLGEEGAKPKRIKYKPVTRX
          ||||||||||||||||||||||||||||:||||||||||||||
g596      ACEGDSKWVFFDGNYQEYEADKKRRLGKEGAKPKRIKYKPVTRX
            340        350        360        370
```

The following partial DNA sequence was identified in *N. meningitidis* <SEQ ID 1875>:

```
a596.seq
   1  ATGTCCCAAC AATACGTCTA TTCTATGCTG CGCGTGAGCA AGGTTGTGCC
  51  GCCGCAGAAA ACCATCATTA AAGATATTTC CCTTTCTTTC TTCCCCGGCG
 101  CGAAAATCGG TTTGCTCGGT TTGAACGGCG CGGGCAAGTC CACCGTGCTG
 151  CGGATTATGG CGGGCGTGGA TAAAGAATTT GAGGGCGAAG CCGTGCCGAT
 201  GGGCGGTATT AAAATCGGCT ACCTGCCGCA AGAGCCTGAG CTTGATCCGG
 251  AAAAAACCGT GCGTGAGGAA GTGGAAAGCG GTTTGGGCGA AGTGGCTGCC
 301  GCGCAGAAAC GTTTGGAGGA AGTGTATGCC GAGTACGCCA ATCCCGATGC
 351  GGATTTTGAC GCGTTGGCGG AAGAGCAGGG GCGTTTGGAA GCGATTATTG
 401  CGGCGGGTTC GTCCACGGGC GGCGGTGCGG AACACGAATT GGAAATCGCT
 451  GCCGACGCGC TGCGCCTGCC GGAATGGGAT GCCAAAATCG ATAATTTGTC
 501  CGGCGGTGAA AAACGCCGCG TCGCTTTGTG CAAACTCTTG TTGAGCAAGC
 551  CCGATATGCT TTTGCTGGAC GAGCCGACCA ACCACTTGGA TGCGGAATCG
 601  GTCGAGTGGC TGGAGCAATT TCTCGTGCGC TTCCCCGGTA CAGTCGTTGC
 651  CGTAACACAC GACCGCTACT TCCTCGACAA CGCCGCCGAA TGGATTTTGG
 701  AACTCGACCG CGGGCACGGT ATTCCGTGGA AAGGAAATTA CTCGTCTTGG
 751  TTGGAGCAGA AAGAAAAACG TTTGGAAAAC GAGGCGAAAT CCGAAGCCGC
 801  GCGCGTGAAA GCGATGAAGC AGGAATTGGA ATGGGTGCGC CAAAATGCCA
 851  AAGGCCGTCA AGCCAAGTCC AAAGCGCGTT TGGCGCGTTT TGAAGAAATG
 901  AGCAACTATG AATACCAAAA ACGCAATGAA ACGCAGGAAA TCTTCATTCC
 951  CGTCGCCGAG CGTTTGGGTA ACGAAGTGAT TGAATTTGTG AATGTTTCCA
1001  AATCGTTCGG CGACAAAGTG CTGATTGACG ATTTGAGCTT CAAAGTGCCT
1051  GCGGGCGCGA TTGTCGGCAT CATCGGTCCG AACGGCGCGG GTAAATCGAC
1101  ACTGTTTAAA ATGATTGCGG GCAAAGAGCA GCCCGATTCC GGTGAAGTGA
1151  AAATCGGGCA AACCGTGAAA ATGAGCTTGA TTGACCAAAG CCGCGAAGGT
1201  TTGCAAAACG ACAAAACCGT GTTCGACAAC ATTGCCGAAG GTCGCGATAT
1251  TTTACAGGTC GGGCAGTTTG AAATCCCCGC CCGCCAATAT TTGGGACGCT
1301  TCAATTTCAA AGGCAGCGAC CAAAGCAAAA TCACGGGGCA GCTTTCCGGC
1351  GGCGAACGCG GACGTTTGCA CTTGGCAAAA ACCTTGTTGG GCGGTGGCAA
1401  TGTGTTGCTG CTGGACGAAC CGTCCAACGA CCTCGACGTG GAAACCCTGC
1451  GCGCGTTGGA AGACGCATTG CTGGAATTTG CCGGCAGCGT GATGGTGATT
1501  TCGCACGACC GCTGGTTCCT CGACCGTATT GCTACGCATA TCTTGGCTTG
```

-continued
```
1551 CGAAGGCGAC TCCAAATGGG TGTTCTTTGA CGGCAACTAT CAGGAATACG

1601 AAGCCGACAA GAAACGCCGA CTCGGCGAAG AAGGCACGAA ACCGAAACGC

1651 ATCAAATACA AACCGGTAAC GCGTTAA
```

This corresponds to the amino acid sequence <SEQ ID 1876; ORF 596.a>:

```
a596.pep

1  MSQQYVYSML RVSKVVPPQK TIIKDISLSF FPGAKIGLLG LNGAGKSTVL

51  RIMAGVDKEF EGEAVPMGGI KIGYLPQEPE LDPEKTVREE VESGLGEVAA

101  AQKRLEEVYA EYANPDADFD ALAEEQGRLE AIIAAGSSTG GGAEHELEIA

151  ADALRLPEWD AKIDNLSGGE KRRVALCKLL LSKPDMLLLD EPTNHLDAES

201  VEWLEQFLVR FPGTVVAVTH DRYFLDNAAE WILELDRGHG IPWKGNYSSW

251  LEQKEKRLEN EAKSEAARVK AMKQELEWVR QNAKGRQAKS KARLARFEEM

301  SNYEYQKRNE TQEIFIPVAE RLGNEVIEFV NVSKSFGDKV LIDDLSFKVP

351  AGAIVGIIGP NGAGKSTLFK MIAGKEQPDS GEVKIGQTVK MSLIDQSREG

401  LQNDKTVFDN IAEGRDILQV GQFEIPARQY LGRFNFKGSD QSKITGQLSG

451  GERGRLHLAK TLLGGGNVLL LDEPSNDLDV ETLRALEDAL LEFAGSVMVI

501  SHDRWFLDRI ATHILACEGD SKWVFFDGNY QEYEADKKRR LGEEGTKPKR

551  IKYKPVTR*
``` m596/a596  99.3% identity in 558 aa overlap

```
                10         20         30         40         50         60
m596.pep   MSQQYVYSMLRVSKVVPPQKTIIKDISLSFFPGAKIGLLGLNGAGKSTVLRIMAGVDKEF
           ||||||||||||||||||||||||||||||||||||||||||||||||||||||||||||
a596       MSQQYVYSMLRVSKVVPPQKTIIKDISLSFFPGAKIGLLGLNGAGKSTVLRIMAGVDKEF
                10         20         30         40         50         60

70         80         90        100        110        120
m596.pep   EGEAVPMGGIKIGYLPQEPELDPEKTVREEVESGLGEVAAAQKRLEEVYAEYANPDADFD
           ||||||||||||||||||||||||||||||||||||||||||||||||||||||||||||
a596       EGEAVPMGGIKIGYLPQEPELDPEKTVREEVESGLGEVAAAQKRLEEVYAEYANPDADFD
                70         80         90        100        110        120

130        140        150        160        170        180
m596.pep   ALAEEQGRLEAIIAAGSSTGGGAEHELEIAADALRLPEWDAKIDNLSGGEKRRVALCKLL
           ||||||||||||||||||||||||||||||||||||||||||||||||||||||||||||
a596       ALAEEQGRLEAIIAAGSSTGGGAEHELEIAADALRLPEWDAKIDNLSGGEKRRVALCKLL
               130        140        150        160        170        180

190        200        210        220        230        240
m596.pep   LSKPDMLLLDEPTNHLDAESVEWLEQFLVRFPGTVVAVTHDRYFLDNAAEWILELDRGHG
           ||||||||||||||||||||||||||||||||||||||||||||||||||||||||||||
a596       LSKPDMLLLDEPTNHLDAESVEWLEQFLVRFPGTVVAVTHDRYFLDNAAEWILELDRGHG
               190        200        210        220        230        240

250        260        270        280        290        300
m596.pep   IPWKGNYSSWLEQKEKRLENEAKSEAARVKAMKQELEWVRQNAKGRQAKSKARLARFEEM
           ||||||||||||||||||||||||||||||||||||||||||||||||||||||||||||
a596       IPWKGNYSSWLEQKEKRLENEAKSEAARVKAMKQELEWVRQNAKGRQAKSKARLARFEEM
               250        260        270        280        290        300

310        320        330        340        350        360
m596.pep   SNYEYQKRNETQEIFIPVAERLGNEVIEFVNVSKSFGDKVLIDDLSFKVPAGAIVGIIGP
           ||||||||||||||||||||||||||||||||||||||||||||||||||||||||||||
a596       SNYEYQKRNETQEIFIPVAERLGNEVIEFVNVSKSFGDKVLIDDLSFKVPAGAIVGIIGP
               310        320        330        340        350        360

370        380        390        400        410        420
m596.pep   NGAGKSTLFKMISGKEQPDSGEVKIGQTVKMSLIDQSREGLQNDKTVFDNIAEGRDILQV
           |||||||||||:||||||||||||||||||||||||||||||||||||||||||||||||
a596       NGAGKSTLFKMIAGKEQPDSGEVKIGQTVKMSLIDQSREGLQNDKTVFDNIAEGRDILQV
               370        380        390        400        410        420

430        440        450        460        470        480
m596.pep   GQFEIPARQYLGRFNFKGSDQSKIAGQLSGGERGRLHLAKTLLSGGNVLLLDEPSNDLDV
           |||||||||||||||||||||||:|||||||||||||||||:||||||||||||||||||
a596       GQFEIPARQYLGRFNFKGSDQSKITGQLSGGERGRLHLAKTLLGGGNVLLLDEPSNDLDV
               430        440        450        460        470        480
```

```
               490        500        510        520        530        540
m596.pep   ETLRALEDALLEFAGSVMVISHDRWFLDRIATHILACEGDSKWVFFDGNYQEYEADKKRR
           ||||||||||||||||||||||||||||||||||||||||||||||||||||||||||||
a596       ETLRALEDALLEFAGSVMVISHDRWFLDRIATHILACEGDSKWVFFDGNYQEYEADKKRR
               490        500        510        520        530        540

550       559
m596.pep   LGEEGAKPKRIKYKPVTRX
           |||||:|||||||||||||
a596       LGEEGTKPKRIKYKPVTRX
               550
```

The following partial DNA sequence was identified in *N. gonorrhoeae* <SEQ ID 1877>

```
g597.seq
    1 ATGCTGCTTC ATGTCAGCAA TTCCCTCAAA CAGCTTCAGG AAGAGCGTAT

51 CCGCCAAGAA CGTATCCGCC AAGAGCGTAT CCGTCAGGCG CGCGGCAACC

101 TTGCTTCCGT CAACCGCAAA CAGCGCGAGG CTTGGGACAA ATTCCAAAAA

151 CTCAATACCG AGCTGAACCG TTTGAAAACG GAAGTCGCCG CTACGAAAGC

201 GCAGATTTCC CGTTTCGTAT CGGGGAACTA TAAAAACAGC CGGCCGAATG

251 CGGTTGCCCT GTTCCTGAAA AACGCCGAAC CGGGTCAGAA AAACCGCTTT

301 TTGCGTTATA CGCGTTATGT AAACGCCTCC AATCGGGAAG TTGTCAAGGA

351 TTTGGAAAAA CAGCAGAAGG CTTTGGCGGT ACAAGAGCAG AAAATCAACA

401 ATGAGCTTGC CCGTTTGAAG AAAATTCAGG CAAACGTGCA ATCCCTGCTG

451 AAAAAACAGG GTGTAACCGA TGCGGCGGAA CAGACGGAAA GCCGCAGACA

501 GAATGCCAAA ATCTCCAAAG ATGCCCGAAA ACTGCTGGAA CAGAAAGGGA

551 ACGAGCAGCA GCTGAACAAG CTCTTGAGCA ATTTGgagaa aaAAAagcc 601 gaacaccgCA TTcaggAtgc ggAagcaaAA agaAAATTGG CTGAagcCaa 651 actGgcggca gccgAAAAAG CCAGAAAAGA AGCGGCGCAG CAGAAGGCTG

701 AAGCGCGACG TGCGGAAATG TCCAACCTGA CCGCCGAAGA CAGGAACATC

751 CAAGCGCCTT CGGTTATGGG TATCGGCAGT GCCGACGgTT TCAGCCGCAT

801 GCAGGGACGT TTGAAAAAAC CGGTTGACGG TGTGCCGACC GGGCTTTTCG

851 GGCAGAACCG GAGCGGcggC GATGTTTGGA AAGGCGTGTT CTATTCCACT

901 GCGCCTGCAA CGGTTGAAAG CATTGCGCcg gGAACggtaa GCTATGCGGA 951 cgaGTTGGAC GGCTACGGCA AGTGGTCGT GATCGATCAC GGCGAGAACT

1001 ACATCAGCAT CTATGCCGGT TTGAGCGAAA TTTCCGCCGG CAAGGGTTAT

1051 ACGGTCGCGG CAGGAAGCAA AATCGGCACG AGCGGGTCGC TGCCGGACGG

1101 GGAAGAGGGG CTTTACCTGC AAATACGTTA TCGAGGTCAG GTGTTGAACC

1151 CTTCGGGCTG GATACGTTGA
```

This corresponds to the amino acid sequence <SEQ ID 1878; ORF 597>:

```
g597.pep
    1 MLLHVSNSLK QLQEERIRQE RIRQERIRQA RGNLASVNRK QREAWDKFQK

51 LNTELNRLKT EVAATKAQIS RFVSGNYKNS RPNAVALFLK NAEPGQKNRF

101 LRYTRYVNAS NREVVKDLEK QQKALAVQEQ KINNELARLK KIQANVQSLL

151 KKQGVTDAAE QTESRRQNAK ISKDARKLLE QKGNEQQLNK LLSNLEKKKA
```

```
201 EHRIQDAEAK RKLAEAKLAA AEKARKEAAQ QKAEARRAEM SNLTAEDRNI

251 QAPSVMGIGS ADGFSRMQGR LKKPVDGVPT GLFGQNRSGG DVWKGVFYST

301 APATVESIAP GTVSYADELD GYGKVVVIDH GENYISIYAG LSEISAGKGY

351 TVAAGSKIGT SGSLPDGEEG LYLQIRYRGQ VLNPSGWIR*
```

The following partial DNA sequence was identified in *N. meningitidis* <SEQ ID 1879>:

```
m597.seq
   1 ATGCTGCTTC ATGTCAGCAA TTCCCTCAAA CAGCTTCAGG AAGAGCGTAT

51 CCGCCAAGAG CGTATCCGTC AGGCGCGCGG CAACCTTGCT TCCGTCAACC

101 GCAAACAGCG CGAGGCTTGG GACAAGTTCC AAAAACTCAA TACCGAGCTG

151 AACCGTTTGA AAACGGAAGT CGCCGCTACG AAAGCGCAGA TTTCCCGTTT

201 CGTATCGGGG AACTATAAAA ACAGCCAGCC GAATGCGGTT GCCCTGTTCC

251 TGAAAAACGC CGAACCGGGT CAGAAAAACC GCTTTTTGCG TTATACGCGT

301 TATGTAAACG CCTCCAATCG GGAAGTTGTC AAGGATTTGG AAAAACAGCA

351 GAAGGCTTTG GCGGTACAAG AGCAGAAAAT CAACAATGAG CTTGCCCGTT

401 TGAAGAAAAT TCAGGCAAAC GTGCAATCTC TGCTGAAAAA ACAGGGTGTA

451 ACCGATGCGG CGGAACAGAC GGAAAGCCGC AGACAGAATG CCAAAATCGC

501 CAAAGATGCC CGAAAACTGC TGGAACAGAA AGGGAACGAG CAGCAGCTGA

551 ACAAGCTCTT GAGCAATTTG GAGAAGAAAA AGGCCGAACA CCGCATTCAG

601 GATGCGGAAG CAAAAGAAA ATTGGCTGAA GCCAGACTGG CGGCAGCCGA

651 AAAAGCCAGA AAAGAAGCGG CGCAGCAGAA GGCTGAAGCA CGACGTGCGG

701 AAATGTCCAA CCTGACCGCC GAAGACAGGA ACATCCAAGC GCCTTCGGTT

751 ATGGGTATCG GCAGTGCCGA CGGTTTCAGC CGCATGCAAG GACGTTTGAA

801 AAAACCGGTT GACGGTGTGC CGACCGGACT TTTCGGGCAG AACCGGAGCG

851 GCGGCGATAT TTGGAAAGGC GTGTTCTATT CCACTGCACC GGCAACGGTT

901 GAAAGCATTG CGCCGGGAAC GGTAAGCTAT GCGGACGAGT TGGACGGCTA

951 CGGCAAAGTG GTCGTGGTCG ATCACGGCGA GAACTACATC AGCATCTATG

1001 CCGGTTTGAG CGAAATTTCC GTCGGCAAGG GTTATATGGT CGCGGCAGGA

1051 AGCAAAATCG GCTCGAGCGG GTCGCTGCCG GACGGGGAAG AGGGGCTTTA

1101 CCTGCAAATA CGTTATCAAG GTCAGGTATT GAACCCTTCG AGCTGGATAC

1151 GTTGA
```

This corresponds to the amino acid sequence <SEQ ID 1880; ORF 597>:

```
m597.pep
   1 MLLHVSNSLK QLQEERIRQE RIRQARGNLA SVNRKQREAW DKFQKLNTEL

51 NRLKTEVAAT KAQISRFVSG NYKNSQPNAV ALFLKNAEPG QKNRFLRYTR

101 YVNASNREVV KDLEKQQKAL AVQEQKINNE LARLKKIQAN VQSLLKKQGV

151 TDAAEQTESR RQNAKIAKDA RKLLEQKGNE QQLNKLLSNL EKKKAEHRIQ

201 DAEAKRKLAE ARLAAAEKAR KEAAQQKAEA RRAEMSNLTA EDRNIQAPSV

251 MGIGSADGFS RMQGRLKKPV DGVPTGLFGQ NRSGGDIWKG VFYSTAPATV
```

```
301 ESIAPGTVSY ADELDGYGKV VVVDHGENYI SIYAGLSEIS VGKGYMVAAG

351 SKIGSSGSLP DGEEGLYLQI RYQGQVLNPS SWIR*
```

Computer analysis of this amino acid sequence gave the following results:

Homology with a Predicted ORF from *N. gonorrhoeae*

ORF 597 shows 96.1% identity over a 389 aa overlap with a predicted ORF (ORF 597) from *N. gonorrhoeae*:

```
m597/g597  96.1% identity in 389 aa overlap 10        20        30        40        50        60
g597.pep  MLLHVSNSLKQLQEERIRQERIRQERIRQARGNLASVNRKQREAWDKFQKLNTELNRLKT
          ||||||||||||||||||||||||        ||||||||||||||||||||||||||||
m597      MLLHVSNSLKQLQEERIRQERIRQ-----ARGNLASVNRKQREAWDKFQKLNTELNRLKT
                  10        20             30        40        50

70        80        90       100       110       120
g597.pep  EVAATKAQISRFVSGNYKNSRPNAVALFLKNAEPGQKNRFLRYTRYVNASNREVVKDLEK
          |||||||||||||||||||||:||||||||||||||||||||||||||||||||||||||
m597      EVAATKAQISRFVSGNYKNSQPNAVALFLKNAEPGQKNRFLRYTRYVNASNREVVKDLEK
              60        70        80        90       100       110

130       140       150       160       170       180
g597.pep  QQKALAVQEQKINNELARLKKIQANVQSLLKKQGVTDAAEQTESRRQNAKISKDARKLLE
          |||||||||||||||||||||||||||||||||||||||||||||||||:||||||||
m597      QQKALAVQEQKINNELARLKKIQANVQSLLKKQGVTDAAEQTESRRQNAKIAKDARKLLE
              120       130       140       150       160       170

190       200       210       220       230       240
g597.pep  QKGNEQQLNKLLSNLEKKKAEHRIQDAEAKRKLAEAKLAAAEKARKEAAQQKAEARRAEM
          |||||||||||||||||||||||||||||||||||:||||||||||||||||||||||
m597      QKGNEQQLNKLLSNLEKKKAEHRIQDAEAKRKLAEARLAAAEKARKEAAQQKAEARRAEM
              180       190       200       210       220       230

250       260       270       280       290       300
g597.pep  SNLTAEDRNIQAPSVMGIGSADGFSRMQGRLKKPVDGVPTGLFGQNRSGGDVWKGVFYST
          ||||||||||||||||||||||||||||||||||||||||||||||||||:|||||||
m597      SNLTAEDRNIQAPSVMGIGSADGFSRMQGRLKKPVDGVPTGLFGQNRSGGDIWKGVFYST
              240       250       260       270       280       290

310       320       330       340       350       360
g597.pep  APATVESIAPGTVSYADELDGYGKVVVIDHGENYISIYAGLSEISAGKGYTVAAGSKIGT
          ||||||||||||||||||||||||||||:||||||||||||||||:|||| |||||||:
m597      APATVESIAPGTVSYADELDGYGKVVVVDHGENYISIYAGLSEISVGKGYMVAAGSKIGS
              300       310       320       330       340       350

370       380       390
g597.pep  SGSLPDGEEGLYLQIRYRGQVLNPSGWIRX
          ||||||||||||||||:|||||||:||||
m597      SGSLPDGEEGLYLQIRYQGQVLNPSSWIRX
              360       370       380
```

The following partial DNA sequence was identified in *N. meningitidis* <SEQ ID 1881>

```
a597.seq
    1 ATGCTGCTTC ATGTCAGCAA TTCCCTCAAG CAGCTTCAGG AAGAGCGTAT

51 CCGCCAAGAA CGTATCCGCC AAGAGCGTAT CCGTCAGGCG CGCGGCAACC

101 TTGCTTCCGT CAACCGCAAA CAGCGCGAGG CTTGGGACAA GTTCCAAAAA

151 CTCAATACCG AGCTGAACCG TTTGAAAACG GAAGTCGCCG CTACGAAAGC

201 GCAGATTTCC CGTTTCGTAT CGGGGAACTA TAAAAACAGC CAGCCGAATG

251 CGGTTGCCCT GTTCCTGAAA AACGCCGAAC CGGGTCAGAA AAACCGCTTT

301 TTGCGTTATA CGCGTTATGT AAACGCCTCC AATCGGGAAG TTGTCAAGGA

351 TTTGGAAAAA CAGCAGAAGG CTTTGGCGGT ACAAGAGCAG AAAATCAACA

401 ATGAGCTTGC CCGTTTGAAG AAAATTCAGG CAAACGTGCA ATCCCTGCTG

451 AAAAAACAGG GTGTAACCGA TGCGGCGGAA CAGACGGAAA GCCGCAGACA

501 GAATGCCAAA ATCGCCAAAG ATGCCCGAAA ACTGCTGGAA CAGAAAGGGA
```

-continued

```
 551 ACGAGCAGCA GCTGAACAAG CTCTTGAGCA ATTTGGAGAA GAAAAAGGCC

601 GAACACCGCA TTCAGGATGC GGAAGCAAAA AGAAAATTGG CTGAAGCCAG

651 ACTGGCGGCA GCCGAAAAAG CCAGAAAAGA AGCGGCGCAG CAGAAGGCTG

701 AAGCACGACG TGCGGAAATG TCCAACCTGA CCGCCGAAGA CAGGAACATC

751 CAAGCGCCTT CGGTTATGGG TATCGGCAGT GCCGACGGTT TCAGCCGCAT

801 GCAAGGACGT TTGAAAAAAC CGGTTGACGG TGTGCCGACC GGACTTTTCG

851 GGCAGAACCG GAGCGGCGGC GATGTTTGGA AGGCGTGTT CTATTCCACT

901 GCACCGGCAA CGGTTGAAAG CATTGCGCCG GAACGGTAA GCTATGCGGA

951 CGAGTTGGAC GGCTACGGCA AAGTGGTCGT GGTCGATCAC GGCGAGAACT

1001 ACATCAGCAT CTATGCCGGT TTGAGCGAAA TTTCCGTCGG CAAGGGTTAT

1051 ATGGTCGCGG CAGGAAGCAA AATCGGCTCG AGCGGGTCGC TGCCGGACGG

1101 GGAAGAGGGG CTTTACCTGC AAATACGTTA TCAAGGTCAG GTATTGAACC

1151 CTTCGAGCTG GATACGTTGA
```

This corresponds to the amino acid sequence <SEQ ID 1882; ORF 597.a>:

```
a597.pep
   1 MLLHVSNSLK QLQEERIRQE RIRQERIRQA RGNLASVNRK QREAWDKFQK

51 LNTELNRLKT EVAATKAQIS RFVSGNYKNS QPNAVALFLK NAEPGQKNRF

101 LRYTRYVNAS NREVVKDLEK QQKALAVQEQ KINNELARLK KIQANVQSLL

151 KKQGVTDAAE QTESRRQNAK IAKDARKLLE QKGNEQQLNK LLSNLEKKKA

201 EHRIQDAEAK RKLAEARLAA AEKARKEAAQ QKAEARRAEM SNLTAEDRNI

251 QAPSVMGIGS ADGFSRMQGR LKKPVDGVPT GLFGQNRSGG DVWKGVFYST

301 APATVESIAP GTVSYADELD GYGKVVVVDH GENYISIYAG LSEISVGKGY

351 MVAAGSKIGS SGSLPDGEEG LYLQIRYQGQ VLNPSSWIR*
```

Computer analysis of this amino acid sequence gave the following results:
Homology with a Predicted ORF from *N. meningitidis*
ORF 597 shows 98.5% identity over a 389 aa overlap with a predicted ORF (ORF 597) from *N. meningitidis*

```
    m597/a597   98.5% identity in 389 aa overlap 10         20         30         40         50         60
    a597.pep  MLLHVSNSLKQLQEERIRQERIRQERIRQARGNLASVNRKQREAWDKFQKLNTELNRLKT
              ||||||||||||||||||||||||||     |||||||||||||||||||||||||||||
    m597      MLLHVSNSLKQLQEERIRQERIRQ-----ARGNLASVNRKQREAWDKFQKLNTELNRLKT
                  10         20              30         40         50

70         80         90        100        110        120
    a597.pep  EVAATKAQISRFVSGNYKNSQPNAVALFLKNAEPGQKNRFLRYTRYVNASNREVVKDLEK
              ||||||||||||||||||||||||||||||||||||||||||||||||||||||||||||
    m597      EVAATKAQISRFVSGNYKNSQPNAVALFLKNAEPGQKNRFLRYTRYVNASNREVVKDLEK
                  60         70         80         90        100        110

130        140        150        160        170        180
    a597.pep  QQKALAVQEQKINNELARLKKIQANVQSLLKKQGVTDAAEQTESRRQNAKIAKDARKLLE
              ||||||||||||||||||||||||||||||||||||||||||||||||||||||||||||
    m597      QQKALAVQEQKINNELARLKKIQANVQSLLKKQGVTDAAEQTESRRQNAKIAKDARKLLE
                 120        130        140        150        160        170

190        200        210        220        230        240
    a597.pep  QKGNEQQLNKLLSNLEKKKAEHRIQDAEAKRKLAEARLAAAEKARKEAAQQKAEARRAEM
              ||||||||||||||||||||||||||||||||||||||||||||||||||||||||||||
    m597      QKGNEQQLNKLLSNLEKKKAEHRIQDAEAKRKLAEARLAAAEKARKEAAQQKAEARRAEM
                 180        190        200        210        220        230
```

```
               250        260        270        280        290        300
a597.pep   SNLTAEDRNIQAPSVMGIGSADGFSRMQGRLKKPVDGVPTGLFGQNRSGGDVWKGVFYST
           ||||||||||||||||||||||||||||||||||||||||||||||||||:||||||||
m597       SNLTAEDRNIQAPSVMGIGSADGFSRMQGRLKKPVDGVPTGLFGQNRSGGDIWKGVFYST
               240        250        260        270        280        290

310        320        330        340        350        360
a597.pep   APATVESIAPGTVSYADELDGYGKVVVVDHGENYISIYAGLSEISVGKGYMVAAGSKIGS
           ||||||||||||||||||||||||||||||||||||||||||||||||||||||||||||
m597       APATVESIAPGTVSYADELDGYGKVVVVDHGENYISIYAGLSEISVGKGYMVAAGSKIGS
               300        310        320        330        340        350

370        380        390
a597.pep   SGSLPDGEEGLYLQIRYQGQVLNPSSWIRX
           |||||||||||||||||||||||||||||
m597       SGSLPDGEEGLYLQIRYQGQVLNPSSWIRX
               360        370        380
```

The following partial DNA sequence was identified in *N. gonorrhoeae* <SEQ ID 1883>:

```
g601.seq
   1 ATGTTCCCAA CCGGCAATTT GGTCGACGAA ATTGATGTGC CGAATATAGG

51 TCGTCTGAAA GCCACGCTCA TCAACGCGGG CATTCCGACC GTTTTCCTGA

101 ACGCCGCCGA CTTGGGCTAC ACGGGCAAAG AGTTGCAGGA CGACATCAAC

151 AACGATGCCG CCGCGCTGGA AAAATTTGAA ACCATCCGCG CATATGGCGC

201 GCTGAAAATG GGTTTGATCA GCGACGTATC CGAAGCCGCC GCCCGCGCGC

251 GCACGCCGAA ACCCGCCTTC GTCGCGCCCG CCGCCGATTA CACCGCCTCC

301 AGCGGCAAAA CCGTAAACGC CGCCGACATC GATTTGCCGG TACGCGCCCT

351 GAGCATGGGC AAACTGCACC ACGCTATGAT GGGCATCGCC TCGGTCGCCA

401 TCGCCGCCGC CGTGCTCGGT ACGCTGGTCA ACCTTGCCGC AGGCGGCGGA

451 ACGCGTAAAG AAGTGCGCTT CGGGCATCCG TCAGGTACGC TGCGTGTCGG

501 TGCTGCCGCC GAATGTCAGG ACGGACAATG GACGGCCGCc aaagcggtca 551 tgaGCCGCAG CGCACgcgtg attatggaaa gttgGGTGCg cgttcccgat 601 gattGTTTTT GA
```

This corresponds to the amino acid sequence <SEQ ID 1884; ORF 601.ng>:

```
g601.pep
   1 MFPTGNLVDE IDVPNIGRLK ATLINAGIPT VFLNAADLGY TGKELQDDIN

51 NDAAALEKFE TIRAYGALKM GLISDVSEAA ARARTPKPAF VAPAADYTAS

101 SGKTVNAADI DLPVRALSMG KLHHAMMGIA SVAIAAAVLG TLVNLAAGGG

151 TRKEVRFGHP SGTLRVGAAA ECQDGQWTAA KAVMSRSARV IMESWVRVPD

201 DCF*
```

The following partial DNA sequence was identified in *N. meningitidis* <SEQ ID 1885>:

```
m601.seq
   1 ATGTTCCCAA CCGGCAATTT GGTCGATGAA ATTGATGTGC CGAATATAGG

51 CCGTTTGAAA GCCACGCTCA TCAACGCGGG CATTCCGACC GTTTTCTTGA

101 ATGCCGCCGA CTTGGGCTAC ACAGGCAAAG AGTTGCAAGA CGACATCAAC

151 AACGATGCCG CGGCTTTGGA AAAATTCGAG AAAATCCGCG CTTACGGTGC
```

```
-continued
201 GCTGAAAATG GGTCTGATCA GCGACGTATC CGAAGCTGCC GCTCGCGCGC

251 ACACGCCGAA AGTCGCCTTC GTCGCGCCCG CCGCCGATTA CACCGCCTCC

301 AGTGGCAAAA CCGTGAACGC CGCCGACATC GATTTGCTGG TACGCGCCCT

351 GAGCATGGGC AAACTGCACC ACGCGATGAT GGGTACCGCC TCTGTTGCCA

401 TTGCGACCGC CGCCGCCGTA CCCGGTACGC TGGTCAACCT TGCCGCAGGC

451 GGCGGAACFG GTAAAGAAGT GCGCTTCGGG CATCCTTCCG GCACATTGCG

501 CGTCGGTGCA GCCGCCGAAT GTCAGGACGG ACAATGGACG GCCACCAAAG

551 CGGTCATGAG CCGTAGCGCA CGCGTGATGA TGGAAGGTTG GGTCAGGGTG

601 CCTGAGGATT GTTTTTAA
```

This corresponds to the amino acid sequence <SEQ ID 1886; ORF 601>:

```
m601.pep
  1 MFPTGNLVDE IDVPNIGRLK ATLINAGIPT VFLNAADLGY TGKELQDDIN

51 NDAAALEKFE KIRAYGALKM GLISDVSEAA ARAHTPKVAF VAPAADYTAS

101 SGKTVNAADI DLLVRALSMG KLHHAMGTA SVAIATAAAV PGTLVNLAAG

151 GGTRKEVRFG HPSGTLRVGA AAECQDGQWT ATKAVMSRSA RVMMEGWVRV

201 PEDCF*
```

Computer analysis of this amino acid sequence gave the following results:

Homology with a Predicted ORF from N. gonorrhoeae

ORF 601 shows 94.1% identity over a 205 aa overlap with a predicted ORF (ORF 601.ng) from N. gonorrhoeae:

```
    m601/g601
                    10         20         30         40         50         60
       m601.pep   MFPTGNLVDEIDVPNIGRLKATLINAGIPTVFLNAADLGYTGKELQDDINNDAAALEKFE
                  ||||||||||||||||||||||||||||||||||||||||||||||||||||||||||||
           g601   MFPTGNLVDEIDVPNIGRLKATLINAGIPTVFLNAADLGYTGKELQDDINNDAAALEKFE
                    10         20         30         40         50         60

70         80         90        100        110        120
       m601.pep   KIRAYGALKMGLISDVSEAAARAHTPKVAFVAPAADYTASSGKTVNAADIDLLVRALSMG
                  ||||||||||||||||||||||||:|||||||:|||||||||||||||||||| ||||||
           g601   TIRAYGALKMGLISDVSEAAARARTPKPAFVAPAADYTASSGKTVNAADIDLPVRALSMG
                    70         80         90        100        110        120

130        140        150        160        170        180
       m601.pep   KLHHAMMGTASVAIATAAAVPGTLVNLAAGGGTRKEVRFGHPSGTLRVGAAAECQDGQWT
                  |||||||| |||||    ||||||||||||||||||||||||||||||||||||||||||
           g601   KLHHAMMGIASVAI--AAAVLGTLVNLAAGGGTRKEVRFGHPSGTLRVGAAAECQDGQWT
                   130        140        150        160        170

190        200
       m601.pep   ATKAVMSRSARVMMEGWVRVPEDCFX
                  |:||||||||||:||:|||||:||||
           g601   AAKAVMSRSARVIMESWVRVPDDCFX
                   180        190        200
```

The following partial DNA sequence was identified in N. meningitidis <SEQ ID 1887>:

```
a601.seq
  1 ATGTTCCCAA CCGGCAATTT GGTCGATGAA ATTGATGTGC CGAATATAGG

51 CCGTTTGAAA GCCACGCTCA TCAACGCGGG CATTCCGACC GTTTTCCTGA

101 ATGCCGCCGA CTTGGGCTAC ACGGGCAAAG AGTTGCAAGA CGACATCAAC

151 AACGATGCCG CAGCTTTGGA AAAATTCGAG AAAATCCGCG CTTACGGTGC
```

-continued

```
201 GCTGAAAATG GGTCTGATCA GCGACGTATC CGAAGCTGCC GCCCGCGCGC

251 ACACGCCGAA AGTCGCCTTC GTCGCGCCCG CCGCCGATTA CACCGCCTCC

301 AGTGGCAAAA CCGTGAATGC CGCCGACATC GATTTGCTGG TACGCGCCCT

351 GAGCATGGGC AAATTGCACC ACGCGATGAT GGGTACCGCC TCTGTTGCCA

401 TTGCGACCGC CGCCGCCGTG CCCGGTACGC TGGTCAACCT TGCCGCAGGC

451 GGCGGAACGC GTAAAGAAGT GCGCTTCGGG CATCCTTCCG GCACATTGCG

501 CGTCGGTGCA GCCGCCGAAT GTCAGGACGG ACAATGGACG GCCACCAAAG

551 CGGTTATGAG CCGCAGCGCA CGCGTGATGA TGGAAGGTTG GGTCAGGGTG

601 CCGGAAGATT GTTTTTAA
```

This corresponds to the amino acid sequence <SEQ ID 1888; ORF 601.a>:

```
a601.pep
  1 MFPTGNLVDE IDVPNIGRLK ATLINAGIPT VFLNAADLGY TGKELQDDIN

51 NDAAALEKFE KIRAYGALKM GLISDVSEAA ARAHTPKVAF VAPAADYTAS

101 SGKTVNAADI DLLVRALSMG KLHHAMMGTA SVAIATAAAV PGTLVNLAAG

151 GGTRKEVRFG HPSGTLRVGA AAECQDGQWT ATKAVMSRSA RVMMEGWVRV

201 PEDCF*
``` m601/a601 100.0% identity in 205 aa overlap

```
                10         20         30         40         50         60
    m601.pep    MFPTGNLVDEIDVPNIGRLKATLINAGIPTVFLNAADLGYTGKELQDDINNDAAALEKFE
                ||||||||||||||||||||||||||||||||||||||||||||||||||||||||||||
    a601        MFPTGNLVDEIDVPNIGRLKATLINAGIPTVFLNAADLGYTGKELQDDINNDAAALEKFE
                10         20         30         40         50         60

70         80         90        100        110        120
    m601.pep    KIRAYGALKMGLISDVSEAAARAHTPKVAFVAPAADYTASSGKTVNAADIDLLVRALSMG
                ||||||||||||||||||||||||||||||||||||||||||||||||||||||||||||
    a601        KIRAYGALKMGLISDVSEAAARAHTPKVAFVAPAADYTASSGKTVNAADIDLLVRALSMG
                70         80         90        100        110        120

130        140        150        160        170        180
    m601.pep    KLHHAMMGTASVAIATAAAVPGTLVNLAAGGGTRKEVRFGHPSGTLRVGAAAECQDGQWT
                ||||||||||||||||||||||||||||||||||||||||||||||||||||||||||||
    a601        KLHHAMMGTASVAIATAAAVPGTLVNLAAGGGTRKEVRFGHPSGTLRVGAAAECQDGQWT
               130        140        150        160        170        180

190        200
    m601.pep    ATKAVMSRSARVMMEGWVRVPEDCFX
                ||||||||||||||||||||||||||
    a601        ATKAVMSRSARVMMEGWVRVPEDCFX
               190        200
```

The following partial DNA sequence was identified in *N. gonorrhoeae* <SEQ ID 1889>:

```
g602.seq
  1 ATGTTGCTCC ATCAATGCGA CAAAGCGCGA CATATGCGTC CCTTTCTGCT

51 CGGCGGGCAG ATAAACCGTC ATCGTCAGGC GAGCAACCGT GGATTGTGTT

101 CCTTCGGCGG TTTTCAGGGT AATCGGGAAG CGCAGGTCTT TAATGCCGAC

151 CTGATTGATC GGCAGGTTGC GCAAATCTCT GCTGGATTGC ACGTCTGCAA

201 TGGCGTTCAT GCGTTGTTTG TCCTTAATAT TCAGATAATT ATTGAGATGT

251 GTGTATTGTA TGGCAGGcag atgccgtctg aAAAAacgct gtcggCCGCC

301 TGCCTGCAAA TgcgagattA TATCACTTGC TTTtggcgGC TGCATTGA
```

This corresponds to the amino acid sequence <SEQ ID 1890; ORF 602.ng>:

```
g602.pep
    1  MLLHQCDKAR HMRPFLLGGQ INRHRQASNR GLCSFGGFQG NREAQVFNAD

51  LIDRQVAQIS AGLHVCNGVH ALFVLNIQII IEMCVLYGRQ MPSEKTLSAA

101  CLQMRDYITC FWRLH*
```

The following partial DNA sequence was identified in *N. meningitidis* <SEQ ID 1891>:

```
m602.seq
    1  ATGTTGCTCC ATCAATGCGA CAAAACGCGA CATATGCGTC CCCTTCTGCT

51  CAGCAGGCAG GTAAACCGTC ATGGTCAGAC GGGCAATGGT GGACTGGATG

101  CCTTCTGCAG TTTGCAGGGT AATCGGAAAG CGCAGGTCTT TGATACCGAC

151  CTGATTGATC GGCAGATTGC GCAAATCTCG GCTGGATTGC ACGTCTGCAA

201  TAGTGTTCAT GAGTTGTTTT TCCTTAATAT TCATGTAATT GTTGAGATGT

251  GTGCATGGTA TGGCGTTTCC GCCGGGGAAT ATACCGTCAA TCTGCAAATG

301  CGAGATTATA TCACTCGCTT TTAGCAGCTG CATTGA
```

This corresponds to the amino acid sequence <SEQ ID 1892; ORF 602>:

```
m602.pep
        1   MLLHQCDKTR HMRPLLLSRQ VNRHGQTGNG GLDAFCSLQG NRKAQVFDTD

51   LIDRQIAQIS AGLHVCNSVH ELFFLNIHVI VEMCAWYGVS AGEYTVNLQM

101   RDYITRF*QL H* m595/a595  65.2% identity in 115 aa overlap 10         20         30         40         50         60
    m602.pep  MLLHQCDKTRHMRPLLLSRQVNRHGQTGNGGLDAFCSLQGNRKAQVFDTDLIDRQIAQIS
              ||||||||:||||||:||: :|||| |::|| :| ::||||:||||::||||||:||||
              MLLHQCDKARHMRPFLLGGQINRHRQASNRGLCSFGGFQGNREAQVFNADLIDRQVAQIS
                      10         20         30         40         50         60

70         80         90        100        110
    m602.pep  AGLHVCNSVHELFFLNIHVIVEMCAWYGVSA-GEYTVN---LQMRDYITRFXQLHX
              ||||||:|| || |||::|:||| || : :| |:: |||||||| | :|||
              AGLHVCNGVHALFVLNIQIIIEMCVLYGRQMPSEKTLSAACLQMRDYITCFWRLHX
                      70         80         90        100        110
```

The following partial DNA sequence was identified in *N. meningitidis* <SEQ ID 1893>:

```
a602.seq
    1  ATGTTGCTCC ATCAATGCGA CAAAGCGCGA CATATGCGTA CCCTTCTGCT

51  CGGCAGGCAG GTAAACCGTC ATGGTCAGAC GGGCAACTGT GGACTGGATG

101  CCTTCTGCAG TTTGCAGGGT AATCGGAAAG CGCAGGTCTT TGATACCGAC

151  CTGATTGATC GGCAGATTGC GCAAATCTCG GCTGGATTGC ACGTCTGCAA

201  TAGTGTTCAT GAGTTGTTTT TCCTTAATAT TCATGTAATT GTTGAGATGT

251  GTGCATGGTA TGGCGTTTCC ACCGGGGAAT ATACCGTCAA TCTGCAAATG

301  CGAGATTATA TCACTCGCTT TTAGCAGCTG CATTGA
```

This corresponds to the amino acid sequence <SEQ ID 1894; ORF 602.a>:

```
m602.pep

1    MLLHQCDKAR HMRTLLLGRQ VNRHGQTGNC GLDAFCSLQG NRKAQVFDTD

51    LIDRQIAQIS AGLHVCNSVH ELFFLNIHVI VEMCAWYGVS TGEYTVNLQM

101    RDYITRF*QL H* m602/a602  95.5% identity in 111 aa overlap 10         20         30         40         50         60
   m602.pep  MLLHQCDKTRHMRPLLLSRQVNRHGQTGNGGLDAFCSLQGNRKAQVFDTDLIDRQIAQIS
             ||||||||:||| |||:|||||||||||| ||||||||||||||||||||||||||||||
   a602      MLLHQCDKARHMRTLLLGRQVNRHGQTGNCGLDAFCSLQGNRKAQVFDTDLIDRQIAQIS
                  10         20         30         40         50         60

70         80         90        100        110
   m602.pep  AGLHVCNSVHELFFLNIHVIVEMCAWYGVSAGEYTVNLQMRDYITRFXQLHX
             |||||||||||||||||||||||||||||||:||||||||||||||||||||
   a602      AGLHVCNSVHELFFLNIHVIVEMCAWYGVSTGEYTVNLQMRDYITRFXQLHX
                  70         80         90        100        110
```

The following partial DNA sequence was identified in *N. gonorrhoeae* <SEQ ID 1895>:

```
g603.seq
    1 ATGGATTCCC GCCTGCGTGG GAATGACGCT AGGAAATACG GCATACGCTT

51 TGCCCAAAGA GGCCGTCTGA ACACACTCC GCCCAACGCC CATCCTTTTT

101 CAGACGGCCC CGCACCAAAA AAACAACCAC AAACTACAAG GAGAAACATC

151 ATGTCCGACC AACTCATTCT TGTCCTGAAC TGCGTCAGTT CATCGCTCAA

201 AGGCGCCGTT ATCGACCGCA AAAGCGGCAG CGTCGTCCTA AGCTGCCTCG

251 GGGAACGCCT GACTACGCCC GAAGCCGTCA TTACCTTCAA CAAAGACGGC

301 AACAAACGCC AAGTTCCCCT GAGCGGCCGC AACTGCCACG CCGGCGCGGT

351 GGGTATGCTG TTGAACGAAC TGGAAAAACA CGGACTGCAC GACCGCATCA

401 AAGCCATCGG CCGCCGCATC GCCCACGGCG GCGAAAAATA TCACGAGTCC

451 GTCCTCATCG ACCAAGACGT CCTTGACGAA CTGAAAGCCT GCATCCCGTT

501 CGCCCCGCTG CACAACCCCG CCAACATCAG CGGCATCCTC GCCGCGCAGG

551 AACACTTTCC CGGCCTGCCC AACGTCGGCG TGATGGACAC CTCGTTCCAC

601 CAAACCATGC CGGAGCGGGC CTACACTTAT GCCGTGCCGC GCGAATTGCG

651 CAAAAAATAC GCCTTCCGCC GCTACGGTTT CCACGGTACC GGTATGCGTT

701 ACGTCGCCCC TGAAGCCGCA CGCATCTTGG GCAAACCTct ggaaGACATC

751 CGCATGATTA TTGCCCACTT AGGCAACGGC GCATCTATTA CCGCCGTCAA

801 AAACGGCAAA TCCGTCGATA CCGGTATGGG TTTCACGCCG ATCGAAGGTT

851 TGGTAATGGG TACACGTTGC GGCGACACCG ATCCGGGCGT ATACAGCTAT

901 CCGACTTTCC ACGCAGGGAT GGATGTTGCC CAAGTTGATG AAATGCTGAA

951 CGAAAAATCA GGTTTCCCCG GTATTTCcgA actTCCCAAC GACTGCCGCA

1001 CCCTCGAAAT CGCCGCCGAC GAAGGCCGCG AAGGCGCGCG CCTCGCCCTc 1051 gaAGTCATGA CCTGCCGCCT CGCCAAATAC ATCGCTTCGA TGGCTGTGGC

1101 CTGCGGCAGT GTTGACGCAC TCGTGTTCAC CGGCGGTATC GGCGAAAACT

1151 CGCGTAATAT CCGTGCCAAA ACCGTTTCCT ATCTTGATTT CTTGGGTCTG

1201 CACATCGACA CCAAAGCCAA TATGGAAAAA CGCTACGGCA ATTCGGGCAT
```

-continued

```
1251 TATCAGCCCG ACCGATTCTT CTCCGGCTGT TTTGGTCGTC CCGACCAATG

1301 AAGAACTGAT GATTGCCTGC GACACTGCCG AACTTGCCGG CATCTTGTAG
```

This corresponds to the amino acid sequence <SEQ ID 1896; ORF 603.ng>:

```
g603.pep
   1 MDSRLRGNDA RKYGIRFAQR GRLKHTPPNA HPFSDGPAPK KQPQTTRRNI

51 MSDQLILVLN CVSSSLKGAV IDRKSGSVVL SCLGERLTTP EAVITFNKDG

101 NKRQVPLSGR NCHAGAVGML LNELEKHGLH DRIKAIGRRI AHGGEKYHES

151 VLIDQDVLDE LKACIPFAPL HNPANISGIL AAQEHFPGLP NVGVMDTSFH

201 QTMPERAYTY AVPRELRKKY AFRRYGFHGT GMRYVAPEAA RILGKPLEDI

251 RMIIAHLGNG ASITAVKNGK SVDTGMGFTP IEGLVMGTRC GDTDPGVYSY

301 PTFHAGMDVA QVDEMLNEKS GFPGISELPN DCRTLEIAAD EGREGARLAL

351 EVMTCRLAKY IASMAVACGS VDALVFTGGI GENSRNIRAK TVSYLDFLGL

401 HIDTKANMEK RYGNSGIISP TDSSPAVLVV PTNEELMIAC DTAELAGIL*
```

The following partial DNA sequence was identified in *N. meningitidis* <SEQ ID 1897>:

```
m603.seq
    1 CTGTCCTCGC GTAGGCGGGG ACGGAATAAC GATAGAAAAT GCGGCATACG

51 CTTTGCCCAA AGAGGCCGTC TGAAACACCT TGCGCCTGAT GTCTGC.CTT

101 TTTCAGACGA CCCCACACTA AAAAAACAAC CACAAACTAC AAGGAGAAAC

151 ATCATGTCCG ACCAACTCAT CCTCGTTCTG AACTGCGGCA GTTCATCGCT

201 CAAAGGCGCC GTTATCGACC GAmAAAGCGG CAGCGTCGTC CTAAGCTGCC

251 TCGGCGAACG cCtGACCACG CCCGAAGCCG TCATTACGTT CAACAAAGAC

301 GGCAACAAAC GCCAAGTTCC CCTGAGCGGC CGAAATTGCC ACGCCGGCGC

351 GGTGGGTATG CTTTTGAACG AACTGGAAAA ACACGGTCTG CACGACCGCA

401 TCAAAGCCAT CGGCCACCGC ATCGCCCACG GCGGCGAAAA ATACAGCGAG

451 TCTGTTTTGA TCGACCAGGC CGTAATGGAC GAACTCAATG CCTGCATTCC

501 GCTTGCGCCG CTGCACAACC CCGCCAACAT CAGCGGCATC CTTGCCGCAC

551 AGGAACATTT CCCCGGTCTG CCCAATGTCG GCGTGATGGA TACTTCGTTC

601 CACCAAACCA TGCCGGAGCG TGCCTACACT TATGCCGTGC CGCGCGAGTT

651 GCGTAAAAAA TACGCTTTCC GCCGCTACGG TTTCCACGGC ACCAGTATGC

701 GTTACGTTGC CCCTGAAGCC GCACGCATCT TGGGCAAACC TCTGGAAGAC

751 ATCCGCATGA TTATTGCCCA CTTAGGCAAC GGCGCATCCA TTACCGCCAT

801 CAAAAACGGC AAATCCGTCG ATACCAGTAT GGGTTTCACG CCGATCGAAG

851 GTTTGGTAAT GGGTACACGT TGCGGCGACA TCGATCCGGG CGTATACAGC

901 TATCTGACTT CCCACGCCGG GATGGATGTT GCCCAAGTGG ATGAAATGCT

951 GAACAAAAAA TCAGGTTTGC TCGGTATTTC CGAACTTTCC AACGACTGCC

1001 GCACCCTCGA AATCGCCGCC GACGAAGGCC ACGAAGGCGC GCGCCTCGCC

1051 CTCGAAGTCA TGACCTACCG CCTCGCCAAA TACATCGCTT CGATGGCTGT

1101 GGGCTGCGGC GGCGTTGACG CACTCGTGTT CACCGGCGGT ATCGGCGAAA
```

```
-continued
1151 ACTCGCGTAA TATCCGTGCC AAAACCGTTT CCTATCTTGA TTTCTTGGGT

1201 CTGCACATCG ACACCAAAGC CAATATGGAA AAACGCTACG GCAATTCGGG

1251 CATTATCAGC CCGACCGATT CTTCTCCGGC TGTTTTGGTT GTCCCGACCA

1301 ATGAAGAACT GATGATTGCC TGCGACACTG CCGAACTTGC CGGCATCTTG

1351 TAG
```

This corresponds to the amino acid sequence <SEQ ID 10 1898; ORF 603>:

```
m603.pep
  1 LSSRRRGRNN DRKCGIRFAQ RGRLKHLAPD VCXFSDDPTL KKQPQTTRRN

51 IMSDQLILVL NCGSSSLKGA VIDRXSGSVV LSCLGERLTT PEAVITFNKD

101 GNKRQVPLSG RNCHAGAVGM LLNELEKHGL HDRIKAIGHR IAHGGEKYSE

151 SVLIDQAVMD ELNACIPLAP LHNPANISGI LAAQEHFPGL PNVGVMDTSF

201 HQTMPERAYT YAVPRELRKK YAFRRYGFHG TSMRYVAPEA ARILGKPLED

251 IRMIIAHLGN GASITAIKNG KSVDTSMGFT PIEGLVMGTR CGDIDPGVYS

301 YLTSHAGMDV AQVDEMLNKK SGLLGISELS NDCRTLEIAA DEGHEGARLA

351 LEVMTYRLAK YIASMAVGCG GVDALVFTGG IGENSRNIRA KTVSYLDFLG

401 LHIDTKANME KRYGNSGIIS PTDSSPAVLV VPTNEELMIA CDTAELAGIL

451 *
```

Computer analysis of this amino acid sequence gave the following results:

Homology with a Predicted ORF from *N. gonorrhoeae*
ORF 603 shows 91.6% identity over a 450 aa overlap with a predicted ORF (ORF 603.ng) from *N. gonorrhoeae*:

```
    m603/g603
                      10         20         30         40         50         60
    m603.pep   LSSRRRGRNNDRKCGIRFAQRGRLKHLAPDVCXFSDDPTLKKQPQTTRRNIMSDQLILVL
               ::|| || |: || |||||||||||  |::  ||| |: ||||||||||||||||||||
    g603       MDSRLRG-NDARKYGIRFAQRGRLKHTPPNAHPFSDGPAPKKQPQTTRRNIMSDQLILVL
                         10         20         30         40         50

70         80         90        100        110        120
    m603.pep   NCGSSSLKGAVIDRXSGSVVLSCLGERLTTPEAVITFNKDGNKRQVPLSGRNCHAGAVGM
               || |||||||| |||:|||||||||||||||||||||||||||||||||||||||||||
    g603       NCVSSSLKGAVIDRKSGSVVLSCLGERLTTPEAVITFNKDGNKRQVPLSGRNCHAGAVGM
                      60         70         80         90        100        110

130        140        150        160        170        180
    m603.pep   LLNELEKHGLHDRIKAIGHRIAHGGEKYSESVLIDQAVMDELNACIPLAPLHNPANISGI
               |||||||||||||||||:||||||||||| ||||||:||||:||||||:||||||||||
    g603       LLNELEKHGLHDRIKAIGRRIAHGGEKYHESVLIDQDVLDELKACIPFAPLHNPANISGI
                  120        130        140        150        160        170

190        200        210        220        230        240
    m603.pep   LAAQEHFPGLPNVGVMDTSFHQTMPERAYTYAVPRELRKKYAFRRYGFHGTSMRYVAPEA
               |||||||||||||||||||||||||||||||||||||||||||||||||::||||||||
    g603       LAAQEHFPGLPNVGVMDTSFHQTMPERAYTYAVPRELRKKYAFRRYGFHGTGMRYVAPEA
                  180        190        200        210        220        230

250        260        270        280        290        300
    m603.pep   ARILGKPLEDIRMIIAHLGNGASITAIKNGKSVDTSMGFTPIEGLVMGTRCGDIDPGVYS
               ||||||||||||||||||||||||||:|||||||| ||||||||||||||||  ||||||
    g603       ARILGKPLEDIRMIIAHLGNGASITAVKNGKSVDTGMGFTPIEGLVMGTRCGDTDPGVYS
                      240        250        260        270        280        290

310        320        330        340        350        360
    m603.pep   YLTSHAGMDVAQVDEMLNKKSGLLGISELSNDCRTLEIAADEGHEGARLALEVMTYRLAK
               | | |||||||||||||||:|||:  ||||  |||||||||||:||||||||||||||||
    g603       YPTFHAGMDVAQVDEMLNEKSGFPGISELPNDCRTLEIAADEGREGARLALEVMTCRLAK
                      300        310        320        330        340        350
```

```
                 370        380        390        400        410        420
m603.pep    YIASMAVGCGGVDALVFTGGIGENSRNIRAKTVSYLDFLGLHIDTKANMEKRYGNSGIIS
            ||||||| :||:|||||||||||||||||||||||||||||||||||||||||||:|||
g603        YIASMAVACGSVDALVFTGGIGENSRNIRAKTVSYLDFLGLHIDTKANMEKRYGNSCIIS
                 360        370        380        390        400        410

430        440        450
m603.pep    PTDSSPAVLVVPTNEELMIACDTAELAGILX
            ||||||||||||||||||||||||||||||
g603        PTDSSPAVLVVPTNEELMIACDTAELAGILX
                 420        430        440        450
```

The following partial DNA sequence was identified in *N. meningitidis* <SEQ ID 1899>:

```
a603.seq
   1  CTGTCCTCGC GTAGGCGGGG ACGGAATAAC GATAGAAAAT GCGGCATACG

51  CTTTGCCCAA AGAGGCCGTC TGAAACACAC TCCGCCCAAC GCCCATCCTT

101  TTTCAGACGA CCCCACACC. AAAAAACAAC CACAAACTAC AAGGAGAAAC

151  ATCATGTCCG ACCAACTCAT TCTTGTTCTG AACTGCGGCA GTTCATCGCT

201  CAAAGGTGCC GTTATCGACC GCAAAAGCGG CAGCGTCGTC CTAAGCTGCC

251  TCGGCGAACG CCTGACCACG CCCGAAGCCG TCATTACGTT CAGCAAAGAC

301  GGCAACAAAC GCCAAGTTCC CCTGAGCGGC CGGAACTGCC ACGCCGGCGC

351  GGTGGGTATG CTGTTGAACG AACTGGAAAA ACACGAACTG CACGACCGCA

401  TTCAAGCCGT CGGCCACCGC ATCGCCCACG GCGGCGAAAA ATACAGCGAG

451  TCTGTTTTGA TCGACCAGGC CGTAATGGAC GAACTCAATG CCTGCATTCC

501  GCTTGCGCCG CTGCACAACC CCGCCAACAT CAGCGGCATC CTCGCCGCAC

551  AGGAACATTT CCCCGGTCTG CCCAATGTCG GCGTGATGGA TACTTCGTTC

601  CACCAAACCA TGCCGGAGCG TGCCTACACT TATGCCGTGC CGCGCGAGTT

651  GCGTAAAAAA TACGCTTTCC GCCGCTACGG TTTCCACGGC ACCAGTATGC

701  GTTACGTTGC CCCTGAAGCC GCATGCATCT TGGGCAAACC TCTGGAAGAC

751  ATCCGCATGA TTATTGCCCA CTTAGGCAAC GGCGCATCCA TTACCGCCAT

801  CAAAAACGGC AAATCCGTCG ATACCAGTAT GGGTTTCACG CCGATCGAAG

851  GTTTGGTAAT GGGTACGCGC TGCGGCGATA TCGACCCGGG CGTATACAGC

901  TATCTGACTT CACACGCCGG TTTGGATGTT GCACAAGTTG ATGAAATGCT

951  GAATAAAAAA TCAGGCTTGC TCGGTATTTC CGAACTCTCC AACGACTGCC

1001  GCACCCTCGA AATCGCCGCC GACGAAGGCC ACGAAGGCGC GCGCCTCGCC

1051  CTCGAAGTTA TGACCTACCG CCTCGCCAAA TACATCGCTT CGATGGCTGT

1101  GGGCTGCGGC GGCGTTGACG CACTCGTGTT CACCGGCGGT ATCGGCGAAA

1151  ACTCGCGTAA TATCCGTGCC AAAACCGTTT CCTATCTTGA TTTCTTGGGT

1201  CTGCACATCG ACACCAAAGC CAATATGGAA AAACGCTACG GCAATTCGGG

1251  TATTATCAGC CCGACCGATT CTTCTCCGGC TGTTTTGGTT GTCCCGACCA

1301  ATGAAGAACT GATGATTGCC TGCGACACTG CCGAACTTGT CGGCATCTTG

1351  TAG
```

This corresponds to the amino acid sequence <SEQ ID 1900; ORF 603.a>:

```
a603.pep
  1 LSSRRRGRNN DRKCGIRFAQ RGRLKHTPPN AHPFSDDPTX KKQPQTTRRN

51 IMSDQLILVL NCGSSSLKGA VIDRKSGSVV LSCLGERLTT PEAVITFSKD

101 GNKRQVPLSG RNCHAGAVGM LLNELEKHEL HDRIQAVGHR IAHGGEKYSE

151 SVLIDQAVMD ELNACIPLAP LHNPANISGI LAAQEHFPGL PNVGVMDTSF

201 HQTMPERAYT YAVPRELRKK YAFRRYGFHG TSMRYVAPEA ACILGKPLED

251 IRMIIAHLGN GASITAIKNG KSVDTSMGFT PIEGLVMGTR CGDIDPGVYS

301 YLTSHAGLDV AQVDEMLNKK SGLLGISELS NDCRTLEIAA DEGHEGARLA

351 LEVMTYRLAK YIASMAVGCG GVDALVFTGG IGENSRNIRA KTVSYLDFLG

401 LHIDTKANME KRYGNSGIIS PTDSSPAVLV VPTNEELMIA CDTAELVGIL

451 *
``` m603/a603 96.7% identity in 450 aa overlap

```
                 10         20         30         40         50         60
    m603.pep LSSRRRGRNNDRKCGIRFAQRGRLKHLAPDVCXFSDDPTLKKQPQTTRRNIMSDQLILVL
             ||||||||||||||||||||||||||||  :::     ||||||  ||||||||||||||
    a603     LSSRRRGRNNDRKCGIRFAQRGRLKHTPPNAHPCXFSDDXTLKKQPQTTRRNIMSDQLILVL
                 10         20         30         40         50         60

70         80         90        100        110        120
    m603.pep NCGSSSLKGAVIDRXSGSVVLSCLGERLTTPEAVITFNKDGNKRQVPLSGRNCHAGAVGM
             |||||||||||||| ||||||||||||||||||||||| :||||||||||||||||||||
    a603     NCGSSSLKGAVIDRKSGSVVLSCLGERLTTPEAVITFSKDGNKRQVPLSGRNCHAGAVGM
                 70         80         90        100        110        120

130        140        150        160        170        180
    m603.pep LLNELEKHGLHDRIKAIGHRIAHGGEKYSESVLIDQAVMDELNACIPLAPLHNPANISGI
             ||||||||||||||:|||||||||||||||||||||||||||||||||||||||||||||
    a603     LLNELEKHGLHDRIVAIGHRIAHGGEKYSESVLIDQAVMDELNACIPLAPLHNPANISGI
                130        140        150        160        170        180

190        200        210        220        230        240
    m603.pep LAAQEHFPGLPNVGVMDTSFHQTMPERAYTYAVPRELRKKYAFRRYGFHGTSMRYVAPEA
             ||||||||||||||||||||||||||||||||||||||||||||||||||||||||||||
    a603     LAAQEHFPGLPNVGVMDTSFHQTMPERAYTYAVPRELRKKYAFRRYGFHGTSMRYVAPEA
                190        200        210        220        230        240

250        260        270        280        290        300
    m603.pep ARILGKPLEDIRMIIAHLGNGASITAIKNGKSVDTSMGFTPIEGLVMGTRCGDIDPGVYS
             | ||||||||||||||||||||||||||||||||||||||||||||||||||||||||||
    a603     ACILGKPLEDIRMIIAHLGNGASITAIKNGKSVDTSMGFTPIEGLVMGTRCGDIDPGVYS
                250        260        270        280        290        300

310        320        330        340        350        360
    m603.pep YLTSHAGMDVAQVDEMLNKKSGLLGISELSNDCRTLEIAADEGHEGARLALEVMTYRLAK
             |||||||:||||||||||||||||||||||||||||||||||||||||||||||||||||
    a603     YLTSHAGLDVAQVDEMLNKKSGLLGISELSNDCRTLEIAADEGHEGARLALEVMTYRLAK
                310        320        330        340        350        360

370        380        390        400        410        420
    m603.pep YIASMAVGCGGVDALVFTGGIGENSRNIRAKTVSYLDFLGLHIDTKANMEKRYGNSGIIS
             ||||||||||||||||||||||||||||||||||||||||||||||||||||||||||||
    a603     YIASMAVGCGGVDALVFTGGIGENSRNIRAKTVSYLDFLGLHIDTKANMEKRYGNSGIIS
                370        380        390        400        410        420

430        440        450
    m603.pep PTDSSPAVLVVPTNEELMIACDTAELAGILX
             |||||||||||||||||||||||||:||||
    a603     PTDSSPAVLVVPTNEELMIACDTAELVGILX
                430        440        450
```

The following partial DNA sequence was identified in *N. gonorrhoeae* <SEQ ID 1901>:

```
g604.seq
  1 ATGCCCGAAG CGCACTTCTT TACGCGTTCC GCCGCCTGCG GCAAGGTTGA

51 CCAGCGTACC GAGCACGGCG GCGGCGATGG CGACCGAGGC GATGCCCATC

101 ATAGCGTGGT GCAGTTTGCC CATGCTCAGG GCGCGTACCG GCAAATCGAT
```

```
151 GTCGGCGGCG TTTACGGTTT TGCCGCTGGA GGCGGTGTAA TCGGCGGCGG

201 GCGCGACGAA GGCGGGTTTC GGCGTGCGCG CGCGGGCGGC GGCTTCGGAT

251 ACGTCGCTGA TCAAACCCAT TTTCAGCGCG CCATATGCGC GGATGGTTTC

301 AAATTTTTCC AGCGCGGCGG CATCGTTGTT GATGTCGTCC TGCAACTCTT

351 TGCCCGTGTA GCCCAAGTCG GCGGCGTTCA GGAAAACGGT CGGAATGCCC

401 GCGTTGATGA GCGTGGCTTT CAGACGACCT ATATTCGGCA CATCAATTTC

451 GTCGACCAAA TTGCCGGTTG GAACATACT GCCTTcgcCG TCGGCTGGAT

501 CTAA
```

This corresponds to the amino acid sequence <SEQ ID 1902; ORF 604.ng>:

```
g604.pep
  1 MPEAHFFTRS AACGKVDQRT EHGGGDGDRG DAHHSVVQFA HAQGAYRQID

51 VGGVYGFAAG GGVIGGGRDE GGFRRARAGG GFGYVADQTH FQRAICADGF

101 KFFQRGGIVV DVVLQLFARV AQVGGVQENG RNARVDERGF QTTYIRHINF

151 VDQIAGWEHT AFAVGWI*
```

The following partial DNA sequence was identified in *N. meningitidis* <SEQ ID 1903>:

```
m604.seq
  1 ATGCCCGAAG CGCACTTCTT TACGCGTTCC GCCGCCTGCG GCAAGGTTGA

51 CCAGCGTACC GGGTACGGCG GCGGCGGTCG CAATGGCAAC AGAGGCGGTA

101 CCCATCATCG CGTGGTGCAG TTTGCCCATG CTCAGGGCGC GTACCAGCAA

151 ATCGATGTCG GCGGCGTTCA CGGTTTTGCC ACTGGAGGCG GTGTAATCGG

201 CGGCGGGCGC GACGAAGGCG ACTTTCGGCG TGTGCGCGCG AGCGGCAGCT

251 TCGGATACGT CGCTGATCAG ACCCATTTTC AGCGCACCGT AAGCGCGGAT

301 TTTCTCGAAT TTTTCCAAAG CCGCGGCATC GTTGTTGATG TCGTCTTGCA

351 ACTCTTTGCC TGTGTAGCCC AAGTCGGCGG CATTCAAGAA AACGGTCGGA

401 ATGCCCGCGT TGATGAGCGT GGCTTTCAAA CGGCCTATAT TCGGCACATC

451 AATTTCATCG ACCAAATTGC CGGTTGGGAA CATACTGCCT TCGCCGTCGG

501 CTGGATC
```

This corresponds to the amino acid sequence <SEQ ID 1904; ORF 604>:

```
m604.pep
  1 MPEAHFFTRS AACGKVDQRT GYGGGGRNGN RGGTHHRVVQ FAHAQGAYQQ

51 IDVGGVHGFA TGGGVIGGGR DEGDFRRVRA SGSFGYVADQ THFQRTVSAD

101 FLEFFQSRGI VVDVVLQLFA CVAQVGGIQE NGRNARVDER GFQTAYIRHI

151 NFIDQIAGWE HTAFAVGWI
```

Computer analysis of this amino acid sequence gave the following results:

Homology with a Predicted ORF from *N. gonorrhoeae*

ORF 604 shows 83.4% identity over a 169 aa overlap with a predicted ORF (ORF 604.ng) from *N. gonorrhoeae*:

```
m604/g604
                 10        20         30        40         50        60
    m604.pep  MPEAHFFTRSAACGKVDQRTGYGGGGRNGNRGGTHHRVVQFAHAQGAYQQIDVGGVHGFA
              ||||||||||||||||||||:|||  :|:||:||||||||||||:||||||:|||
    g604      MPEAHFFTRSAACGKVDQRTGHGGG--DGDRGDAHHSVVQFAHAQGAYRQIDVGGVYGFA
                 10        20         30        40         50

70        80         90       100        110       120
    m604.pep  TGGGVIGGGRDEGDFRRVRASGSFGYVADQTHFQRTVSADFLEFFQSRGIVVDVVLQLFA
              :|||||||||||| |||:||:|:|||||||||||||:: || ::||| ||||||||||||
    g604      AGGGVIGGGRDEGGFRRARAGGGFGYVADQTHFQRAICADGFKFFQRGGIVVDVVLQLFA
                 60        70         80        90       100       110

130       140        150       160       169
    m604.pep  CVAQVGGIQENGRNARVDERGFQTAYIRHINFIDQIAGWEHTAFAVGWI
              ||||||:|||||||||||||||||:|||||||:|||||||||||||||
    g604      RVAQVGGVQENGRNARVDERGFQTTYIRHINFVDQIAGWEHTAFAVGWIX
                120       130        140       150       160
```

The following partial DNA sequence was identified in *N. meningitidis* <SEQ ID 1905>:

```
a604.seq
   1 ATGCCCGAAG CGCACTTCTT TACGCGTTCC GCCGCCTGCG GCAAGGTTGA
  51 CCAGCGTACC GGGCACGGCG GCGGCGGTCG CAATGGCAAC AGAGGCGGTA
 101 CCCATCATCG CGTGGTGCAA TTTGCCCATG CTCAGGGCGC GTACCAGCAA
 151 ATCGATGTCG GCGGCATTCA CGGTTTTGCC ACTGGAGGCG GTGTAATCGG
 201 CGGCGGGCGC GACGAAGGCG ACTTTCGGCG TGTGCGCGCG GGCGGCAGCT
 251 TCGGATACGT CGCTGATCAG ACCCATTTTC AGCGCACCGT AAGCGCGGAT
 301 TTTCTCGAAT TTTTCCAAAG CTGCGGCATC GTTGTTGATG TCGTCTTGCA
 351 ACTCTTTGCC CGTGTAGCCC AAGTCGGCGG CATTCAGGAA AACGGTCGGA
 401 ATGCCCGCGT TGATGAGCGT GGCTTTCAAA CGGCCTATAT TCGGCACATC
 451 AATTTCATCG ACCAAATTGC CGGTTGGGAA CATACTGCCT TCGCCGTCGG
 501 CTGGATCAAG AAATTCGATT TGTACTTCGG CTGCCGGGAA CGTTACGCCG
 551 TCGAGCTCAA AATCGCCTGT TTCCAAAACT GCGCCGTTTT GCATCGGTAC
 601 ATGGGCAATA ATGGTTTTGC CGATGTTTTT CTGCCAGATT TTGACTGTGC
 651 AGATGCCGTC TGA
```

This corresponds to the amino acid sequence <SEQ ID 1906; *ORF 604.a*>:

```
a604.pep
   1 MPEAHFFTRS AACGKVDQRT GHGGGGRNGN RGGTHHRVVQ FAHAQGAYQQ

51 IDVGGIHGFA TGGGVIGGGR DEGDFRRVRA GGSFGYVADQ THFQRTVSAD

101 FLEFFQSCGI VVDVVLQLFA RVAQVGGIQE NGRNARVDER GFQTAYIRHI

151 NFIDQIAGWE HTAFAVGWIK KFDLYFGCRE RYAVELKIAC FQNCAVLHRY

201 MGNNGFADVF LPDFDCADAV *
``` m604/a604 97.0% identity in 169 aa overlap

```
              10         20         30         40         50         60
m604.pep  MPEAHFFTRSAACGKVDQRTGYGGGGRNGNRGGTHHRVVQFAHAQGAYQQIDVGGVHGFA
          ||||||||||||||||||||||| ||||||||||||||||||||||||||||||:||||
          MPEAHFFTRSAACGKVDQRTGHGGGGRNGNRGGTHHRVVQFAHAQGAYQQIDVGGIHGFA
              10         20         30         40         50         60

70         80         90        100        110        120
m604.pep  TGGGVIGGGRDEGDFRRVRASGSFGYVADQTHFQRTVSADFLEFFQSRGIVVDVVLQLFA
          ||||||||||||||||||||:|||||||||||||||||||||||||||| ||||||||||
          TGGGVIGGGRDEGDFRRVRAGGSFGYVADQTHFQRTVSADFLEFFQSCGIVVDVVLQLFA
              70         80         80        100        110        120

130        140        150        160       169
m604.pep  CVAQVGGIQENGRNARVDERGFQTAYIRHINFIDQIAGWEHTAFAVGWI
           |||||||||||||||||||||||||||||||||||||||||||||||||
          RVAQVGGIQENGRNARVDERGFQTAYIRHINFIDQIAGWEHTAFAVGWIKKFDLYFGCRE
             130        140        150        160        170        180 a604      RYAVELKIACFQNCAVLHRYMGNNGFADVFLPDFDCADAVX
             190        200        210        220
```

The following partial DNA sequence was identified in *N. gonorrhoeae* <SEQ ID 1907>:

```
g605.seq
    1 ATGATGACCG AAATGCAACA ACGCGCCCAA CTGCACCGCC AAATTTGGAA
   51 AATCGCCGAC GAAGTACGCG GCGCGGTGGA TGGCTGGGAC TTTAAACAAT
  101 ACGTTCTCGG CACACTTTTC TACCGCTTTA TCAGCGAAAA CTTCACCGAC
  151 TATATGCAGG CCGGCGACAG CAGCATTGAT TACGCCGCta tGCCGGACAG
  201 CATCATCACG CCCGAAATCA AAGACGATgc cgtcaaagtc aaAGGCTATT
  251 TCATCtacCc cgGCCAGCTT TTTTgcaata ttgccgccga agcCCATCAA
  301 AACGAAGAGC TCAACACCAA GCTGAAAGAa atCTTTACCG CGATTGAAAG
  351 CTCCGCCTCC GGCTAcccgT CCGAACAAGG CATCAAAGGC TTGTTTGACG
  401 ACTTCgACAC CACCAGCAGC CGGCTCGGCA GCACCGTTGC CGACAAAAAC
  451 AAACGCCTTG CCGCCGTCCT TAAAGGCGTG GCGGAACTCG ATTTCGGCAA
  501 TTTTGAAGAC CACCGCATCG ACCTTTTCGG TGATGCCTAC GAATACCTGA
  551 TTTCCAACTA CGCcgcCAAC GCAGGCAAAT CCGGCGGCGA ATTTTTCACC
  601 CCGCAAAGCG TCTCCAAGCT GATTGCGCGG CTGGCGGTGC ACGGGCAGGA
  651 GAAAGTCAAC AAAATCTACG ACCCCGCCTG CGGCTCGGGC AGCCTGCTCT
  701 TGCAGGCGAA AAAACAGTTT GACGAACACA TCATCGAAGA AGGCTTCTTC
  751 GGGCAGGAAA TCAACCACAC CACCTACAAC CTCGCCCGCA TGAATATGTT
  801 TCTGCACAAC GTCAATTACA ACAAATTCCA CATCGAATTG GGCGACACGC
  851 TGACCAACCC CAAACTCAAA GACAGCAAAC CCTTTGATGC CGTCGTCTCC
  901 AATCCGCCCT ATTCCATCGA CTGGATAGGC AGCGACGACC CCACCTtgaT
  951 CAACGACGAC CGCTTTGCCC CCGCAGGCGT ACTCGCACCG AAATCCAAAG
 1001 CCGATTTTGC CTTCATCCTG CACGCACTGA ACTACCTTTC CGGCAGAGGC
 1051 CGCGCCGCTA TCGTCTCATT CCCCGGCATT TTCTATCGCG GCGGCGCAGA
 1101 GCAGAAAATc CGCCAATATC TGGTGGAGGG CAACTATGTG AAACCGTGA
 1151 TTGCCCTTGC GCCCAATCTC TTTTACGGCA CCTGCATCGC CGTCAATATC
 1201 CTGGTTTTGT CCAAACACAA AGACAATACC GACATCCAAT TCATCGACGC
 1251 AAGCGGCTTC TTTAAAAAAG AAACCAACAA CAACGTCTTA ACCGAAGAAC
 1301 ACATTGCCGA AATCGTCAAA CTCTTCGCCG ACAAAGCCGA TGTGCCGCAT
```

-continued

```
1351 ATCGCCCAAA ACGCCGCCCA GCAAACCGTC AAAGACAACG GCTACAACCT

1401 CGCCGTCAGC AGCTATGTCG AAGCCGAAGA CACCCGCGAG GTCATCGACA

1451 TCAGACAGCT CAACGCCGAA ATCAGCGAAA CCgtcgCcaa AATCGAACGG

1501 CTGCGGCGTG AAATTGACGA AGTGATTGCA GAGATTGAAA CCTAG
```

This corresponds to the amino acid sequence <SEQ ID 1908; ORF 605.ng>:

```
g605.pep
  1 MMTEMQQRAQ LHRQIWKIAD EVRGAVDGWD FKQYVLGTLF YRFISENFTD

51 YMQAGDSSID YAAMPDSIIT PEIKDDAVKV KGYFIYPGQL FCNIAAEAHQ

101 NEELNTKLKE IFTAIESSAS GYPSEQGIKG LFDDFDTTSS RLGSTVADKN

151 KRLAAVLKGV AELDFGNFED HRIDLFGDAY EYLISNYAAN AGKSGGEFFT

201 PQSVSKLIAR LAVHGQEKVN KIYDPACGSG SLLLQAKKQF DEHIIEEGFF

251 GQEINHTTYN LARMNMFLHN VNYNKFHIEL GDTLTNPKLK DSKPFDAVVS

301 NPPYSIDWIG SDDPTLINDD RFAPAGVLAP KSKADFAFIL HALNYLSGRG

351 RAAIVSFPGI FYRGGAEQKI RQYLVEGNYV ETVIALAPNL FYGTCIAVNI

401 LVLSKHKDNT DIQFIDASGF FKKETNNNVL TEEHIAEIVK LFADKADVPH

451 IAQNAAQQTV KDNGYNLAVS SYVEAEDTRE VIDIRQLNAE ISETVAKIER

501 LRREIDEVIA EIET*
```

The following partial DNA sequence was identified in N. meningitidis <SEQ ID 1909>:

```
m605.seq
    1 ATGATGACCG AAATGCAACA ACGCGCCCAA CTGCACCGCC AAATTTGGAA

51 AATTGCCGAC GAAGTACGCG GCGCGGTGGA TGGCTGGGAC TTTAAACAAT

101 ACGTTCTCGG CACACTTTTC TACCGCTTTA TCAGCGAAAA CTTCACCGAC

151 TATATGCAGG CAGGCGACAG CAGTATTGAT TACGCCGCTA TGCCGGACAG

201 CATCATCACG CCCGAAATCA AGACGATGC CGTCAAAGTT AAAGGCTATT

251 TCATCTACCC CGGCCAGCTT TTTTGCAATA TTGCCGCCGA AGCCCATCAA

301 AACGAAGAGC TCAACACCAA GCTGAAAGAA ATTTTTACCG CGATTGAAAG

351 CTCCGCCTCC GGCTATCCGT CCGAACAGGA CATCAAAGGC CTGTTTGACG

401 ACTTCGACAC CACCAGCAGC CGGCTCGGCA GCACTGTTGC CGACAAGAAC

451 AAACGCCTTG CCGCCGTCCT CAAAGGCGTG GCGGAACTCG ATTTCGGCAA

501 TTTTGAAAAC CACCACATCG ACCTTTTCGG CGATGCCTAC GAATACCTGA

551 TTTCCAACTA CGCTGCCAAC GCAGGCAAAT CCGGCGGCGA ATTTTTCACC

601 CCGCAAAGCG TATCCAAGCT GATTGCGCGG CTGGCGGTGC ACGGACAGGA

651 GAAAGTCAAC AAAATCTACG ACCCAGCTTG CGGCTCGGGC AGTCTGCTCT

701 TGCAGGCGAA AAAACAGTTT GACGAGCACA TCATCGAAGA AGGCTTCTTC

751 GGGCAGGAAA TCAACCACAC CACCTACAAC CTCGCCCGCA TGAACATGTT

801 CCTGCACAAC GTCAATTACA ACCAATTCCA CATCGAATTG GGCGACACAC

851 TGACCAACCC AAAGCTCAAA GACAGCAAAC CCTTTGATGC CATCGTTTCC

901 AATCCGCCTT ATTCCATCAA CTGGATAGGC AGCGACGACC CCACCTTAAT
```

```
 951 CAACGACGAC CGCTTTGCCC CCGCAGGCGT ACTTGCCCCG AAATCCAAAG

1001 CCGATTTTGC CTTCATCCTG CACGCACTGA ACTACCTTTC CGGCAGAGGC

1051 CGCGCCGCCA TCGTCTCATT CCCCGGCATT TTCTATCGCG GCGGCGCAGA

1101 ACAGAAAATC CGCCAATATC TGGTGGAGGG CAACTACGTG AAACCGTGA

1151 TTGCCCTTGC GCCCAATCTC TTTTACGGCA CCGGCATCGC CGTCAATATC

1201 CTGGTTTTGT CCAAACACAA AGACAATACC GACATCCAAT TCATCGACGC

1251 AAGCGGCTTC TTTAAAAAAG AAACCAACAA CAACGTCTTA ATCGAAGAAC

1301 ACATTGCTGA AATCGTCAAA CTCTTCGCCG ATAAAGCCGA TGTGCCGCAT

1351 ATCGCCCAAA ACGCTGCCCA GCAAACCGTC AAAGACAACG GCTACAACCT

1401 CGCCGTCAGC AGCTATGTCG AAGCCGAAGA CACACGCGAA ATTATCGACA

1451 TCAAACAGCT CAACGCCGAA ATCGGCGAAA CCGTCGCCAA AATCGAACGG

1501 CTGCGGCGTG AAATTGACGA AGTGATTGCA GAGATTGAAG CATGA
```

This corresponds to the amino acid sequence <SEQ ID 1910; ORF 605>:

```
m605.pep
  1 MMTEMQQRAQ LHRQIWKIAD EVRGAVDGWD FKQYVLGTLF YRFISENFTD

51 YMQAGDSSID YAAMPDSIIT PEIKDDAVKV KGYFIYPGQL FCNIAAEAHQ

101 NEELNTKLKE IFTAIESSAS GYPSEQDIKG LFDDFDTTSS RLGSTVADKN

151 KRLAAVLKGV AELDFGNFEN HHIDLFGDAY EYLISNYAAN AGKSGGEFFT

201 PQSVSKLIAR LAVHGQEKVN KIYDPACGSG SLLLQAKKQF DEHIIEEGFF

251 GQEINHTTYN LARMNMFLHN VNYNQFHIEL GDTLTNPKLK DSKPFDAIVS

301 NPPYSINWIG SDDPTLINDD RFAPAGVLAP KSKADFAFIL HALNYLSGRG

351 RAAIVSFPGI FYRGGAEQKI RQYLVEGNYV ETVIALAPNL FYGTGIAVNI

401 LVLSKHKDNT DIQFIDASGF FKKETNNNVL IEEHIAEIVK LFADKADVPH

451 IAQNAAQQTV KDNGYNLAVS SYVEAEDTRE IIDIKQLNAE IGETVAKIER

501 LRREIDEVIA EIEA*
```

Computer analysis of this amino acid sequence gave the following results:
Homology with a Predicted ORF from *N. gonorrhoeae*
ORF 605 shows 97.9% identity over a 513 aa overlap with a predicted ORF (ORF 605.ng) from *N. gonorrhoeae*:

```
    m605/g605
                  10         20         30         40         50         60
    m605.pep   MMTEMQQRAQLHRQIWKIADEVRGAVDGWDFKQYVLGTLFYRFISENFTDYMQAGDSSID
               ||||||||||||||||||||||||||||||||||||||||||||||||||||||||||||
    g605       MMTEMQQRAQLHRQIWKIADEVRGAVDGWDFKQYVLGTLFYRFISENFTDYMQAGDSSID
                  10         20         30         40         50         60

70         80         90        100        110        120
    m605.pep   YAAMPDSIITPEIKDDAVKVKGYFIYPGQLFCNIAAEAHQNEELNTKLKEIFTAIESSAS
               ||||||||||||||||||||||||||||||||||||||||||||||||||||||||||||
    g605       YAAMPDSIITPEIKDDAVKVKGYFIYPGQLFCNIAAEAHQNEELNTKLKEIFTAIESSAS
                  70         80         90        100        110        120

130        140        150        160        170        180
    m605.pep   GYPSEQDIKGLFDDFDTTSSRLGSTVADKNKRLAAVLKGVAELDFGNFENHHIDLFGDAY
               ||||||  ||||||||||||||||||||||||||||||||||||||||||| :|:|||||
    g605       GYPSEQGIKGLFDDFDTTSSRLGSTVADKNKRLAAVLKGVAELDFGNFEDHRIDLFGDAY
                 130        140        150        160        170        180
```

-continued

```
                  190       200       210       220       230       240
m605.pep   EYLISNYAANAGKSGGEFFTPQSVSKLIARLAVHGQEKVNKIYDPACGSGSLLLQAKKQF
           ||||||||||||||||||||||||||||||||||||||||||||||||||||||||||||
g605       EYLISNYAANAGKSGGEFFTPQSVSKLIARLAVHGQEKVNKIYDPACGSGSLLLQAKKQF
                  190       200       210       220       230       240

250       260       270       280       290       300
m605.pep   DEHIIEEGFFGQEINHTTYNLARMNMFLHNVNYNQFHIELGDTLTNPKLKDSKPFDAIVS
           ||||||||||||||||||||||||||||||||||:||||||||||||||||||||||:||
g605       DEHIIEEGFFGQEINHTTYNLARMNMFLHNVNYNKFHIELGDTLTNPKLKDSKPFDAVVS
                  250       260       270       280       290       300

310       320       330       340       350       360
m605.pep   NPPYSINWIGSDDPTLINDDRFAPAGVLAPKSKADFAFILHALNYLSGRGRAAIVSFPGI
           ||||||:|||||||||||||||||||||||||||||||||||||||||||||||||||||
g605       NPPYSIDWIGSDDPTLINDDRFAPAGVLAPKSKADFAFILHALNYLSGRGRAAIVSFPGI
                  310       320       330       340       350       360

370       380       390       400       410       420
m605.pep   FYRGGAEQKIRQYLVEGNYVETVIALAPNLFYGTGIAVNILVLSKHKDNTDIQFIDASGF
           |||||||||||||||||||||||||||||||||| |||||||||||||||||||||||||
g605       FYRGGAEQKIRQYLVEGNYVETVIALAPNLFYGTCIAVNILVLSKHKDNTDIQFIDASGF
                  370       380       390       400       410       420

430       440       450       460       470       480
m605.pep   FKKETNNNVLIEEHIAEIVKLFADKADVPHIAQNAAQQTVKDNGYNLAVSSYVEAEDTRE
           |||||||||| |||||||||||||||||||||||||||||||||||||||||||||||||
g605       FKKETNNNVLTEEHIAEIVKLFADKADVPHIAQNAAQQTVKDNGYNLAVSSYVEAEDTRE
                  430       440       450       460       470       480

490       500       510
m605.pep   IIDIKQLNAEIGETVAKIERLRREIDEVIAEIEAX
           :|||:||||||:|||||||||||||||||||||:
g605       VIDIRQLNAEISETVAKIERLRREIDEVIAEIETX
                  490       500       510
```

The following partial DNA sequence was identified in *N. meningitidis* <SEQ ID 1911>:

```
a605.seq
   1  ATGATGACCG AAATACAACA ACGCGCCCAA CTGCACCGCC AAATTTGGAA

51  AATTGCCGAC GAAGTACGCG GCGCGGTGGA TGGCTGGGAC TTCAAACAAT

101  ACGTTCTCGG CACACTTTTC TACCGCTTTA TCAGCGAAAA CTTTACCGAC

151  TATATGCAGG CAGGCGACAG CAGTATTGAT TACGCCGCTA TGCCGGACAG

201  CATCATCACG CCCGAAATCA AAGACGATGC CGTCAAAGTC AAAGGCTATT

251  TCATCTACCC CGGCCAGCTT TTTTGCAATA TTGCCGCCGA AGCCCATCAA

301  AACGAAGAGC TCAACACCAA GCTGAAAGAA ATTTTTACCG CGATTGAAAG

351  CTCCGCCTCC GGCTATCCGT CCGAACAAGA CATTAAAGGC CTGTTTGACG

401  ACTTCGACAC CACCAGCAGC CGGCTCGGCA GCACCGTTGC CGACAAGAAC

451  AAACGCCTTG CCGCCGTCCT AAAAGGCGTG GCGGAACTCG ATTTCGGCAG

501  TTTTGAAGAC CACCACATCG ACCTTTTCGG CGATGCCTAC GAATACCTGA

551  TTTCCAACTA CGCTGCCAAC GCAGGCAAAT CCGGCGGCGA ATTTTTCACC

601  CCGCAAAGCG TATCCAAGCT GATTGCGCGG CTGGCGGTGC ACGGGCAGGA

651  GAAAGTAAAC AAAATCTACG ACCCAGCTTG CGGCTCGGGC AGCCTGCTCT

701  TGCAGGCGAA AAAACAGTTT GACGAGCACA TCATCGAAGA AGGCTTCTTC

751  GGGCAGGAAA TCAACCACAC CACCTACAAC CTCGCCCGCA TGAATATGTT

801  TCTGCACAAC GTCAATTACA ACAAATTCCA CATCGAATTG GGCGACACAC

851  TGACCAATCC CAAACTCAAA GACAGCAAAC CCTTTGATGC CGTCGTTTCC

901  AATCCGCCCT ATTCCATCAA CTGGATAGGC AGCGGCGACC CCACCTTAAT

951  CAACGACGAC CGCTTTGCCC CTGCAGGCGT ACTCGCCCCG AAATCCAAAG

1001  CCGATTTTGC CTTCATTCTG CACGCACTGA ACTACCTTTC CGGCAGAGGC
```

```
-continued
1051 CGCGCCGCCA TCGTCTCATT CCCCGGCATT TTCTATCGCG GCGGCGCAGA

1101 GCAGAAAATC CGCCAATATC TGGTGGAGGG CAACTACGTG GAAACCGTCA

1151 TCGCCCTTGC GCCCAATCTC TTTTACGGCA CCGGCATCGC CGTCAATATA

1201 CTGGTTTTGT CCAAACACAA AGACAATACC GACATCCAAT TCATCGACGC

1251 AGGCGGCTTC TTTAAAAAAG AAACCAACAA CAACGTCTTA ACCGAAGAAC

1301 ACATTGCCGA AATCGTCAAA CTCTTCGCCG ATAAAGCCGA TGTGCCGCAT

1351 ATCGCCCAAA ACGCCGCCCA GCAAACCGTC AAAGACAACG GCTACAACCT

1401 CGCCGTCAGC AGCTATGTTG AACCCGAAGA CACCCGCGAA ATTATCGACA

1451 TCAAACAGCT TAACGCCGAA ATCAGCGAAA CCGTTGCCAA ATCGAACGG

1501 CTGCGGCGTG AAATTGACGA AGTGATTGCA GAGATTGAAG CATGA
```

This corresponds to the amino acid sequence <SEQ ID 1912; ORF 605.a>:

```
a605.pep
  1 MMTEIQQRAQ LHRQIWKIAD EVRGAVDGWD FKQYVLGTLF YRFISENFTD

51 YMQAGDSSID YAAMPDSIIT PEIKDDAVKV KGYFIYPGQL FCNIAAEAHQ

101 NEELNTKLKE IFTAIESSAS GYPSEQDIKG LFDDFDTTSS RLGSTVADKN

151 KRLAAVLKGV AELDFGSFED HHIDLFGDAY EYLISNYAAN AGKSGGEFFT

201 PQSVSKLIAR LAVHGQEKVN KIYDPACGSG SLLLQAKKQF DEHIIEEGFF

251 GQEINHTTYN LARMNMFLHN VNYNKFHIEL GDTLTNPKLK DSKPFDAVVS

301 NPPYSINWIG SGDPTLINDD RFAPAGVLAP KSKADFAFIL HALNYLSGRG

351 RAAIVSFPGI FYRGGAEQKI RQYLVEGNYV ETVIALAPNL FYGTGIAVNI

401 LVLSKHKDNT DIQFIDAGGF FKKETNNNVL TEEHIAEIVK LFADKADVPH

451 IAQNAAQQTV KDNGYNLAVS SYVEPEDTRE IIDIKQLNAE ISETVAKIER

501 LRREIDEVIA EIEA*
```
                                               40
m605/a605 98.1% identity in 514 aa overlap

```
                   10         20         30         40         50         60
   m605.pep   MMTEMQQRAQLHRQIWKIADEVRGAVDGWDFKQYVLGTLFYRFISENFTDYMQAGDSSID
              ||||:|||||||||||||||||||||||||||||||||||||||||||||||||||||||
   a605       MMTEIQQRAQLHRQIWKIADEVRGAVDGWDFKQYVLGTLFYRFISENFTDYMQAGDSSID
                   10         20         30         40         50         60

70         80         90        100        110        120
   m605.pep   YAAMPDSIITPEIKDDAVKVKGYFIYPGQLFCNIAAEAHQNEELNTKLKEIFTAIESSAS
              ||||||||||||||||||||||||||||||||||||||||||||||||||||||||||||
   a605       YAAMPDSIITPEIKDDAVKVKGYFIYPGQLFCNIAAEAHQNEELNTKLKEIFTAIESSAS
                   70         80         90        100        110        120

130        140        150        160        170        180
   m605.pep   GYPSEQDIKGLFDDFDTTSSRLGSTVADKNKRLAAVLKGVAELDFGNFENHHIDLFGDAY
              |||||||||||||||||||||||||||||||||||||||||||||||:||:|||||||||
   a605       GYPSEQDIKGLFDDFDTTSSRLGSTVADKNKRLAAVLKGVAELDFGSFEDHHIDLFGDAY
                  130        140        150        160        170        180

190        200        210        220        230        240
   m605.pep   EYLISNYAANAGKSGGEFFTPQSVSKLIARLAVHGQEKVNKIYDPACGSGSLLLQAKKQF
              ||||||||||||||||||||||||||||||||||||||||||||||||||||||||||||
   a605       EYLISNYAANAGKSGGEFFTPQSVSKLIARLAVHGQEKVNKIYDPACGSGSLLLQAKKQF
                  190        200        210        220        230        240

250        260        270        280        290        300
   m605.pep   DEHIIEEGFFGQEINHTTYNLARMNMFLHNVNYNQFHIELGDTLTNPKLKDSKPFDAIVS
              ||||||||||||||||||||||||||||||||||||:|||||||||||||||||||||:||
   a605       DEHIIEEGFFGQEINHTTYNLARMNMFLHNVNYNKFHIELGDTLTNPKLKDSKPFDAVVS
                  250        260        270        280        290        300
```

```
              310        320        330        340        350        360
m605.pep  NPPYSINWIGSDDPTLINDDRFAPAGVLAPKSKADFAFILHALNYLSGRGRAAIVSFPGI
          |||||||||| |||||||||||||||||||||||||||||||||||||||||||||||
a605      NPPYSINWIGSGDPTLINDDRFAPAGVLAPKSKADFAFILHALNYLSGRGRAAIVSFPGI
              310        320        330        340        350        360

370        380        390        400        410        420
m605.pep  FYRGGAEQKIRQYLVEGNYVETVIALAPNLFYGTGIAVNILVLSKHKDNTDIQFIDASGF
          ||||||||||||||||||||||||||||||||||||||||||||||||||||||||:||
a605      FYRGGAEQKIRQYLVEGNYVETVIALAPNLFYGTGIAVNILVLSKHKDNTDIQFIDAGGF
              370        380        390        400        410        420

430        440        450        460        470        480
m605.pep  FKKETNNNVLIEEHIAEIVKLFADKADVPHIAQNAAQQTVKDGYNLAVSSYVEAEDTRE
          |||||||||| ||||||||||||||||||||||||||||||||||||||||| |||||
a605      FKKETNNNVLTEEHIAEIVKLFADKADVPHIAQNAAQQTVKDNGYNLAVSSYVEPEDTRE
              430        440        450        460        470        480

490        500        510
m605.pep  IIDIKQLNAEIGETVAKIERLRREIDEVIAEIEAX
          ||||||||||:|||||||||||||||||||||||
a605      IIDIKQLNAEISETVAKIERLRREIDEVIAEIEAX
              490        500        510
```

The following partial DNA sequence was identified in *N. gonorrhoeae* <SEQ ID 1913>:

```
g606.seq
   1 ATGTCCAAAT TTATCGCCAA CAATCGGTC GGTGCGGAAG TCATCGACAC

51 GCCGcgCACC GAAGAAGAAG CCTGGCTTCT GAACACTGTC GAAGCCCAAg 101 cgcGGCAATG GAATCTGAAA ACGCCAGAAG TCGCCATCTA CCACTCCCCC

151 GAACCCAATG CCTTTGCCAC GGGCGCATCG AGAAACAGCT CCCTGATCGC

201 CGTCAGCacc ggtttgctcg accaTAtgaC GCGCGACgaa gtggaagccg 251 tgTTGGCGCA CGAAATGGCG CACGTCGGCA ACGGCGACAT GGTTACGCTG 301 ACGCTGAtTC AAGGCGTGGT CAATACCTTT GTCGTGTTCC TGTCGCGCAT

351 TATTGCCAAC CTGATTGCCC GAAACAACGA CGGCAGCCAG TCCCAGGGAA

401 CTTATTTCCT AGTCAGCATG GTATTCCAAA TCCTGTTCGG CTTCCTTGCC

451 AGCCTGATTG TCATGTGGTT CAGCCGCCAA CGCGAATACC GCGCCGAcgc 501 gggCGcggCA AAACTGGTCG GCGCACCGAA AATGATTTCC GCCCTGCAAA

551 GGCTTAAAGG CAACCCGGTC GATTTGCCCG AAGAAATGAA CGCAATGGGC

601 ATCGCCGGAG ATACGCGCGA CTCCCTGCTC AGCACCCACC CTTCGCTGGA

651 CAACCGAATC GCCCGCCTCA AATCGCTTTA A
```

This corresponds to the amino acid sequence <SEQ ID 1914; *ORF606.ng*>:

```
g606.pep
   1 MSKFIAKQSV GAEVIDTPRT EEEAWLLNTV EAQARQWNLK TPEVAIYHSP

51 EPNAFATGAS RNSSLIAVST GLLDHMTRDE VEAVLAHEMA HVGNGDMVTL

101 TLIQGVVNTF VVFLSRIIAN LIARNNDGSQ SQGTYFLVSM VFQILFGFLA

151 SLIVMWFSRQ REYRADAGAA KLVGAPKMIS ALQRLKGNPV DLPEEMNAMG

201 IAGDTRDSLL STHPSLDNRI ARLKSL*
```

The following partial DNA sequence was identified in *N. meningitidis* <SEQ ID 1915>:

```
m606.seq
   1 ATGTCCAAAT TTATCGCCAA ACAATCGGTC GGCGCGGAAG TTATCGACAC

51 GCCGCGCACC GAAGAAGAAG CCTGGCTTTT GAACACTGTC GAAGCCCAAG

101 CGCGGCAATG GAACCTGAAA ACGCCCGAAG TCGCCATCTA CCACTCCCCC

151 GAACCCAATG CCTTTGCCAC GGGCGCATCG AGAAACAGCT CCCTGATCGC

201 CGTCAGCACC GGTTTGCTCG ACCATATGAC GCGTGACGAA GTGGAAGCCG

251 TATTGGCGCA CGAAATGGCA CACGTCGGCA ACGGCGATAT GGTTACGCTG

301 ACGCTGATTC AAGGCGTGGT CAATACCTTT GTCGTGTTCC TGTCGCGCAT

351 TATTGCCAAC CTGATTGCCC GAAACAACGA CGGCAGCCAG TCCCAGGGAA

401 CTTATTTCCT GGTCAGCATG GTATTCCAAA TCCTGTTCGG CTTCCTTGCC

451 AGCTTAATTG TCATGTGGTT CAGCCGACAA CGCGAATACC GCGCCGATGC

501 GGGCGCGGCA AAACTGGTCG GCGCGCCGAA AATGATTTCC GCCCTGCAAA

551 GGCTCAAAGG CAACCCGGTC GATTTGCCCG AAGAAATGAA CGCAATGGGC

601 ATCGCCGGAG ATACGCGCGA CTCCCTGCTC AGCACCCACC CTTCGCTGGA

651 CAACCGTATC GCCCGCCTCA AATCGCTTTA A
```

This corresponds to the amino acid sequence <SEQ ID 1916; *ORF 606*>:

```
m606.pep
   1 MSKFIAKQSV GAEVIDTPRT EEEAWLLNTV EAQARQWNLK TPEVAIYHSP

51 EPNAFATGAS RNSSLIAVST GLLDHMTRDE VEAVLAHEMA HVGNGDMVTL

101 TLIQGVVNTF VVFLSRIIAN LIARNNDGSQ SQGTYFLVSM VFQILFGFLA

151 SLIVMWFSRQ REYRADAGAA KLVGAPKMIS ALQRLKGNPV DLPEEMNAMG

201 IAGDTRDSLL STHPSLDNRI ARLKSL*
```
                                                                40

Computer analysis of this amino acid sequence gave the following results:
Homology with a Predicted ORF from *N. gonorrhoeae*
ORF 606 shows 100.0% identity over a 225 aa overlap with a predicted ORF (ORF 606.ng) from *N. gonorrhoeae*:

```
    m606.g606
                        10         20         30         40         50         60
    m606.pep  MSKFIAKQSVGAEVIDTPRTEEEAWLLNTVEAQARQWNLKTPEVAIYHSPEPNAFATGAS
              ||||||||||||||||||||||||||||||||||||||||||||||||||||||||||||
    g606      MSKFIAKQSVGAEVIDTPRTEEEAWLLNTVEAQARQWNLKTPEVAIYHSPEPNAFATGAS
                        10         20         30         40         50         60
                        70         80         90        100        110        120
    m606.pep  RNSSLIAVSTGLLDHMTRDEVEAVLAHEMAHVGNGDMVTLTLIQGVVNTFVVFLSRIIAN
              ||||||||||||||||||||||||||||||||||||||||||||||||||||||||||||
    g606      RNSSLIAVSTGLLDHMTRDEVEAVLAHEMAHVGNGDMVTLTLIQGVVNTFVVFLSRIIAN
                        70         80         80        100        110        120
                       130        140        150        160        170        180
    m606.pep  LIARNNDGSQSQGTYFLVSMVFQILFGFLASLIVMWFSRQREYRADAGAAKLVGAPKMIS
              ||||||||||||||||||||||||||||||||||||||||||||||||||||||||||||
    g606      LIARNNDGSQSQGTYFLVSMVFQILFGFLASLIVMWFSRQREYRADAGAAKLVGAPKMIS
                       130        140        150        160        170        180
                       190        200        210        220
    m606.pep  ALQRLKGNPVDLPEEMNAMGIAGDTRDSLLSTHPSLDNRIARLKSLX
              |||||||||||||||||||||||||||||||||||||||||||||||
    g606      ALQRLKGNPVDLPEEMNAMGIAGDTRDSLLSTHPSLDNRIARLKSLX
                       190        200        210        220
```

The following partial DNA sequence was identified in *N. meningitidis* <SEQ ID 1917>:

```
a606.seq
   1 ATGTCCAAAT TCATCGCCAA ACAATCGGTC GGCGCGGAAG TTATCGACAC

51 GCCGCGCACC GAAGAAGAAG CCTGGCTTTT GAACACTGTC GAAGCCCAAG

101 CGCGGCAATG GAACCTGAAA ACGCCCGAAG TCGCCATCTA CCACTCCCCC

151 GAACCCAATG CCTTTGCCAC GGGCGCATCG AGAAACAGCT CCCTGATCGC

201 CGTCAGCACC GGTTTGCTCG ACCATATGAC GCGTGACGAA GTGGAAGCCG

251 TATTGGCGCA CGAAATGGCA CACGTCGGCA ACGGCGATAT GGTTACGCTG

301 ACGCTGATTC AAGGCGTGGT CAATACCTTT GTCGTGTTCC TGTCGCGCAT

351 TATTGCCAAC CTGATTGCCC GAAACAACGA CGGCAGCCAG TCCCAGGGAA

401 CTTATTTCCT GGTCAGCATG GTATTCCAAA TCCTGTTCGG CTTCCTTGCC

451 AGCTTAATTG TCATGTGGTT CAGCCGACAA CGCGAATACC GCGCCGACGC

501 GGGCGCGGCA AAACTGGTCG GCGCGCCGAA AATGATTTCC GCCCTGCAAA

551 GGCTTAAAGG CAACCCGGTC GATTTGCCCG AAGAAATGAA CGCAATGGGC

601 ATCGCCGGAG ATACGCGCGA CTCCCTGCTC AGCACCCACC CTTCGCTGGA

651 CAACCGAATC GCCCGCCTCA AATCGCTTTA A
```

This corresponds to the amino acid sequence <SEQ ID 1918; *ORF* 606.a>:

```
a606.pep
   1 MSKFIAKQSV GAEVIDTPRT EEEAWLLNTV EAQARQWNLK TPEVAIYHSP

51 EPNAFATGAS RNSSLIAVST GLLDHMTRDE VEAVLAHEMA HVGNGDMVTL

101 TLIQGVVNTF VVFLSRIIAN LIARNNDGSQ SQGTYFLVSM VFQILFGFLA

151 SLIVMWFSRQ REYRADAGAA KLVGAPKMIS ALQRLKGNPV DLPEEMNAMG

201 IAGDTRDSLL STHPSLDNRI ARLKSL*
``` m606/a606 100.0% identity in 226 aa overlap

```
                    10        20        30        40        50        60
m606.pep    MSKFIAKQSVGAEVIDTPRTEEEAWLLNTVEAQARQWNLKTPEVAIYHSPEPNAFATGAS
            ||||||||||||||||||||||||||||||||||||||||||||||||||||||||||||
a606        MSKFIAKQSVGAEVIDTPRTEEEAWLLNTVEAQARQWNLKTPEVAIYHSPEPNAFATGAS
                    10        20        30        40        50        60

70        80        90       100       110       120
m606.pep    RNSSLIAVSTGLLDHMTRDEVEAVLAHEMAHVGNGDMVTLTLIQGVVNTFVVFLSRIIAN
            ||||||||||||||||||||||||||||||||||||||||||||||||||||||||||||
a606        RNSSLIAVSTGLLDHMTRDEVEAVLAHEMAHVGNGDMVTLTLIQGVVNTFVVFLSRIIAN
                    70        80        90       100       110       120

130       140       150       160       170       180
m606.pep    LIARNNDGSQSQGTYFLVSMVFQILFGFLASLIVMWFSRQREYRADAGAAKLVGAPKMIS
            ||||||||||||||||||||||||||||||||||||||||||||||||||||||||||||
a606        LIARNNDGSQSQGTYFLVSMVFQILFGFLASLIVMWFSRQREYRADAGAAKLVGAPKMIS
                   130       140       150       160       170       180

190       200       210       220
m606.pep    ALQRLKGNPVDLPEEMNAMGIAGDTRDSLLSTHPSLDNRIARLKSLX
            |||||||||||||||||||||||||||||||||||||||||||||||
a606        ALQRLKGNPVDLPEEMNAMGIAGDTRDSLLSTHPSLDNRIARLKSLX
                   190       200       210       220
```

The following partial DNA sequence was identified in *N. gonorrhoeae* <SEQ ID 1919>:

```
g607.seq
    1 ATGCTGCTCG accTcgaCCG CTTTTCCTtt tccGTCTTCC TGAAAGAAAT
   51 CCGCCTGCTG ACCGCCCTTG CCCTGCCCAT GCTGTTGGCG CAGGTCGCGC
  101 AGGTGGGCAT CGGTTTCGTC GATACCGTGA TGGCGGGCGG TGCGGGCAAG
  151 GAAGATTTGG CGGCGGTGGC TTTGGGCAGC AGCGCGTTTG CCACGGTTTA
  201 TATTACCTTT ATGGGCATTA TGGCGGCGCT GAACCCGATG ATTGCCCAGC
  251 TTTACGGCGC GGGTAAAACC GgtgAAGCAG GCGAAACGGG GCGGCAGGGG
  301 ATTTGGTTCG GGCTGATTTT GGGGATTTTC GGCATGATTT TGATGTGGGC
  351 GGCGATTACG CCGTTCCGCA ACTGGCTGAC TTTGAGCGAT TATGTGGAAG
  401 gcacAAtggc gcAGTATATG CTGTTCACCA GCTTGGCGAT GCCGGCGGCA
  451 ATGGTACACC GCGCACTGCA CGCCTACGCT TCCAGCCTGA ACCGCCCGCG
  501 CCTGATTATG TTGGTCAGCT TTGCGGCGTT TGTGTTGAAC GTGCCGCTGA
  551 ACTATATTTT CGTTTACGGC AAATTCGGTA TGCCCGCTTT GGGTGGCGCA
  601 GGTTGCGGCG TGGCGACAAT GGCGGTGTTT TGGTTCAGCG CGCTGGCATT
  651 GTGGATTTAT ATCGCCAAGG AAAAATTCTT CCGCCCGTTC GGACTGACAG
  701 CGAAATTCGg caaACCGGat tGGgcGGTGT TCAAACAGAT TtGGAAAATC
  751 gGcgcgCCCA TCGGGCTGTC TTATTTTTTG GAAgccaGcg cGTTTTCGTT
  801 TATCGTGTTT TTGATTGCGC CTttcggCGA GGATTATGTG GCGGCGCAGC
  851 AGGTCGGCAT CAGTTTGTCG GGGATTCTCT ATATGATTCC GCAAAGCGTC
  901 GGCTCGGCAG GGACGGTGCG CATCGGCTTT TCGCTTGGGC GGCGCGAATT
  951 TTCGCGGGCG CGTTATATTT CAGGAGTGTC GCTGGTGTCG GGCTGGGTGC
 1001 TCGCCGTGAT TACCGTGCTT TCCTTGGTAT TATTCCGTTC GCCGCTGGCA
 1051 AGCATGTACA ACGATGaTCC GGCAGTTTTA AGCATCGCCT CCACCGTCCT
 1101 GCTGTTCGCC GGCCTGTtcc aACCGGCAGA CTTCACCCAA TGTATCGCGT
 1151 CCTATGCCCT GCGCGGCTAC AAAGTCACCA AGGTGCCGAT GTTCATCCAC
 1201 GCCGCCGCCT TCTGGGGCTG CGGCCTGCTG CCGGGCTATC TGCTCGCCTA
 1251 CCGTTTCGAT ATGGGCATTT ACGGCTTCTG GACGGCATTG ATTGCCTCGC
 1301 TCACCATCGC AGCCGTCGCC TTGGTGTGGT GCTTGGAAAA ATACAGTATG
 1351 GAGTTGGTCA AATCACACAA GGCCGTCTGA
```

This corresponds to the amino acid sequence <SEQ ID 1920; ORF 607.ng>:

```
g607.pep
    1 MLLDLDRFSF SVFLKEIRLL TALALPMLLA QVAQVGIGFV DTVMAGGAGK
   51 EDLAAVALGS SAFATVYITF MGIMAALNPM IAQLYGAGKT GEAGETGRQG
  101 IWFGLILGIF GMILMWAAIT PFRNWLTLSD YVEGTMAQYM LFTSLAMPAA
  151 MVHRALHAYA SSLNRPRLIM LVSFAAFVLN VPLNYIFVYG KFGMPALGGA
  201 GCGVATMAVF WFSALALWIY IAKEKFFRPF GLTAKFGKPD WAVFKQIWKI
  251 GAPIGLSYFL EASAFSFIVF LIAPFGEDYV AAQQVGISLS GILYMIPQSV
  301 GSAGTVRIGF SLGRREFSRA RYISGVSLVS GWVLAVITVL SLVLFRSPLA
```

```
351 SMYNDDPAVL SIASTVLLFA GLFQPADFTQ CIASYALRGY KVTKVPMFIH

401 AAAFWGCGLL PGYLLAYRFD MGIYGFWTAL IASLTIAAVA LVWCLEKYSM

451 ELVKSHKAV*
```

The following partial DNA sequence was identified in *N. meningitidis* <SEQ ID 1921>:

```
m607.seq
    1 ATGCTGCTCG ACCTCAACCG CTTTTCCTTT CCCGTCTTCC TGAAAGAAGT

51 CCGCCTGCTG ACCACTCTTG CCCTGCCCAT GCTGTTGGCG CAGGTCGCGC

101 AGGTGGGCAT CGGTTTTGTC GATACTGTGA TGGCGGGCGG TGCGGGCAAG

151 GAAGACTTGG CGGCGGTGGC TTTGGGCAGC AGCGCGTTTG CCACGGTTTA

201 TATTACCTTT ATGGGCATTA TGGCGGCGCT GAACCCGATG ATTGCCCAGC

251 TTTACGGCGC GGGTAAAACC GACGAAGTGG GCGAAACGGG GCGGCAGGGG

301 ATTTGGTTCG GGCTGTTTTT GGGCGTGTTC GGCATGGTCT TGATGTGGGC

351 GGCGATTACG CCGTTCCGCA ACTGGCTGAC CTTGAGCGAT TATGTGGAAG

401 GCACGATGGC GCAGTATATG TTGTTCACCA GCTTGGCGAT GCCGGCGGCA

451 ATGGTACACC GCGCGCTGCA CGCCTACACT TCCAGCCTGA ACCGCCCGCG

501 CCTGATTATG TTGGTCAGCT TTGCGGCGTT TGTGTTGAAC GTGCCGCTGA

551 ACTATATTTT CGTTTACGGC AAATTCGGTA TGCCCGCTTT GGGCGGCGCA

601 GGCTGCGGAC TGGCGACGAT GGCGGTGTTT TGGTTCAGCG CGCTGGCATT

651 GTGGATTTAT ATCGCCAAGG AAAATTTCTT CCGCCCATTC GGACTGACGG

701 CGAAATTCGG CAAACCGGAT TGGGCGGTGT TCAAACAGAT TTGGAAAATC

751 GGCGCACCCA TCGGGCTGTC TTATTTTTTG GAAGCCAGCG CGTTTTCGTT

801 TATCGTGTTT TTGATTGCGC CTTTCGGCGA GGATTATGTG GCGGCGCAGC

851 AGGTCGGCAT CAGTTTGTCG GGGATTCTCT ATATGATTCC GCAAAGCGTC

901 GGCTCGGCGG GGACGGTGCG CATCGGCTTT TCGCTTGGGC GGCGCGAATT

951 TTCGCGGGCG CGTTATATTT CGGGCGTGTC ACTGGTGTTA GGATGGATGC

1001 TCGCCGTGAT TACCGTGCTT TCCTTGGTAT TATTCCGTTC GCCGCTGGTA

1051 AGTATGTACA ACAATGATCC GGCGGTTTTA AGCATCGCCG CCACCGTCTT

1101 ACTGTTCGCC GGCTTGTTCC AACCGGCAGA CTTCACCCAA TGTATCGCCT

1151 CCTACGCCTT GCGCGGCTAC AAAGTTACAA AGGTGCCGAT GTTCATCCAC

1201 GCCGCCGCCT TTTGGGGCTG CGGCCTGCTG CCGGGCTATC TGCTCGCCTA

1251 CCGTTTCAAT ATGGGCATTT ACGGCTTCTG GACGGCATTG ATTGCCTCGC

1301 TCACCATCGC CGCCATCGCC TTGGTGTGGT GCTTGGAATT GTGCAGTAGG

1351 GAGATGGTCA GATCGCATAA GGCCGTCTGA
```

This corresponds to the amino acid sequence <SEQ ID 1922; *ORF 607*>:

```
m607.pep
    1 MLLDLNRFSF PVFLKEVRLL TTLALPMLLA QVAQVGIGFV DTVMAGGAGK

51 EDLAAVALGS SAFATVYITF MGIMAALNPM IAQLYGAGKT DEVGETGRQG

101 IWFGLFLGVF GMVLMWAAIT PFRNWLTLSD YVEGTMAQYM LFTSLAMPAA
```

```
151 MVHRALHAYT SSLNRPRLIM LVSFAAFVLN VPLNYIFVYG KFGMPALGGA

201 GCGLATMAVF WFSALALWIY IAKENFFRPF GLTAKFGKPD WAVFKQIWKI

251 GAPIGLSYFL EASAFSFIVF LIAPFGEDYV AAQQVGISLS GILYMIPQSV

301 GSAGTVRIGF SLGRREFSRA RYISGVSLVL GWMLAVITVL SLVLFRSPLV

351 SMYNNDPAVL SIAATVLLFA GLFQPADFTQ CIASYALRGY KVTKVPMFIH

401 AAAFWGCGLL PGYLLAYRFN MGIYGFWTAL IASLTIAAIA LVWCLELCSR

451 EMVRSHKAV*
```

Computer analysis of this amino acid sequence gave the following results:

Homology with a Predicted ORF from *N. gonorrhoeae*

ORF 607 shows 94.8% identity over a 459 aa overlap with a predicted ORF (ORF 607.ng) from *N. gonorrhoeae*:

```
m607/g607
                 10         20         30         40         50         60
    m607.pep  MLLDLNRFSFPVFLKEVRLLTTLALPMLLAQVAQVGIGFVDTVMAGGAGKEDLAAVALGS
              ||||||:|||| |||||:||||:||||||||||||||||||||||||||||||||||||
    g607      MLLDLDRFSFSVFLKEIRLLTALALPMLLAQVAQVGIGFVDTVMAGGAGKEDLAAVALGS
                 10         20         30         40         50         60

70         80         90        100        110        120
    m607.pep  SAFATVYITFMGIMAALNPMIAQLYGAGKTDEVGETGRQGIWFGLFLGVFGMVLMWAAIT
              ||||||||||||||||||||||||||||| :||||||||||||||:|||:|||:||||||
    g607      SAFATVYITFMGIMAALNPMIAQLYGAGKTGEAGETGRQGIWFGLILGIFGMILMWAAIT
                 70         80         90        100        110        120

130        140        150        160        170        180
    m607.pep  PFRNWLTLSDYVEGTMAQYMLFTSLAMPAAMVHRALHAYTSSLNRPRLIMLVSFAAFVLN
              |||||||||||||||||||||||||||||||||||||||:|||||||||||||||||||
    g607      PFRNWLTLSDYVEGTMAQYMLFTSLAMPAAMVHRALHAYASSLNRPRLIMLVSFAAFVLN
                130        140        150        160        170        180

190        200        210        220        230        240
    m607.pep  VPLNYIFVYGKFGMPALGGAGCGLATMAVFWFSALALWIYIAKENFFRPFGLTAKFGKPD
              |||||||||||||||||||||||:||||||||||||||||||||::||||||||||||
    g607      VPLNYIFVYGKFGMPALGGAGCGVATMAVFWFSALALWIYIAKEKFFRPFGLTAKFGKPD
                190        200        210        220        230        240

250        260        270        280        290        300
    m607.pep  WAVFKQIWKIGAPIGLSYFLEASAFSFIVFLIAPFGEDYVAAQQVGISLSGILYMIPQSV
              ||||||||||||||||||||||||||||||||||||||||||||||||||||||||||
    g607      WAVFKQIWKIGAPIGLSYFLEASAFSFIVFLIAPFGEDYVAAQQVGISLSGILYMIPQSV
                250        260        270        280        290        300

310        320        330        340        350        360
    m607.pep  GSAGTVRIGFSLGRREFSRARYISGVSLVLGWMLAVITVLSLVLFRSPLVSMYNNDPAVL
              |||||||||||||||||||||||||||||| :||||||||||||||||||:||||:||||
    g607      GSAGTVRIGFSLGRREFSRARYISGVSLVSGWVLAVITVLSLVLFRSPLASMYNDDPAVL
                310        320        330        340        350        360

370        380        390        400        410        420
    m607.pep  SIAATVLLFAGLFQPADFTQCIASYALRGYKVTKVPMFIHAAAFWGCGLLPGYLLAYRFN
              |||:||||||||||||||||||||||||||||||||||||||||||||||||||||||:
    g607      SIASTVLLFAGLFQPADFTQCIASYALRGYKVTKVPMFIHAAAFWGCGLLPGYLLAYRFD
                370        380        390        400        410        420

430        440        450        460
    m607.pep  MGIYGFWTALIASLTIAAIALVWCLELCSREMVRSHKAVX
              ||||||||||||||||:|||||||| | |:|:||||||
    g607      MGIYGFWTALIASLTIAAVALVWCLEKYSMELVKSHKAVX
                430        440        450        460
```

55

The following partial DNA sequence was identified in *N. meningitidis* <SEQ ID 1923>:

```
a607.seq
    1   ATGCTGCTCG ACCTCAACCG CTTTTCCTTT TCCGTCTTCC TGAAAGAAGT

51   CCGCCTGCTG ACCGCTCTTG CCCTGCCCAT GCTGTTGGCG CAGGTCGCGC
```

```
 101 AGGTGGGCAT CGGTTTTGTC GATACCGTGA TGGCGGGCGG TGCGGGCAAG

151 GAAGACTTGG CGGCGGTGGC TTTGGGCAGC AGCGCGTTTG CCACGGTTTA

201 TATTACCTTT ATGGGCATTA TGGCGGCGCT GAACCCGATG ATTGCCCAGC

251 TTTACGGCGC GGGTAAAACC GACGAAGTGG GCGAAACGGG ACGGCAGGGG

301 ATTTGGTTCG GGCTGTTTTT GGGCGTGTTC GGCATGGTCT TGATGTGGGC

351 GGCGATTACG CCGTTCCGCA ACTGGCTGAC CTTGAGCGAT TATGTGGAAG

401 GCACAATGGC GCAGTATATG CTGTTCACCA GCTTGGCGAT GCCGGCGGCA

451 ATGGTACACC GCGCACTGCA CGCCTACGCC TCCAGCCTGA ACCGCCCGCG

501 CCTGATTATG TTGGTCAGCT TTGCGGCGTT TGTGTTGAAC GTGCCGCTGA

551 ACTATATTTT CGTTTACGGC AAATTCGGTA TGCCCGCTTT GGGCGGCGCA

601 GGCTGCGGAC TGGCGACGAT GGCGGTGTTT TGGTTCAGCG CGCTGGCATT

651 GTGGATTTAT ATCGCCAAGG AAAATTTCTT CCGCCCATTC GGACTGACGG

701 CGAAATTCGG CAAACCGGAT TGGGCGGTGT TCAAACAGAT TTGGAAAATC

751 GGCGCACCCA TCGGGCTGTC TTATTTTTTG GAAGCCAGCG CGTTTTCGTT

801 TATCGTGTTT TTGATTGCGC CTTTCGGCGA GGATTATGTG GCGGCGCAGC

851 AGGTCGGCAT CAGTTTGTCG GGGATTCTCT ATATGATTCC GCAAAGCGTC

901 GGCTCGGCGG GGACGGTGCG CATCGGCTTT TCGCTTGGGC GGCGCGAATT

951 TTCGCGGGCG CGTTATATTT CGGGCGTGTC ACTGGTGTCA GGATGGATGC

1001 TCGCCGTGAT TACCGTGCTT TCCTTGGTAT TATTCCGTTC GCCGCTGGTA

1051 AGTATGTACA ACAATGATCC GGCGGTTTTA AGCATCGCCG CCACCGTCTT

1101 ACTGTTCGCC GGCTTGTTCC AACCGGCAGA CTTCACCCAA TGTATCGCCT

1151 CCTACGCCTT GCGCGGCTAC AAAGTTACAA AGGTGCCGAT GTTCATCCAC

1201 GCCGCCGCCT TTTGGGGCTG CGGTCTGCTG CCGGGCTACC TGCTCGCCTA

1251 CCGTTTCGAT ATGGGCATTT ACGGCTTCTG GACGGCATTG ATTGCCTCGC

1301 TCACCATCGC CGCCATCGCC TTGGTGTGGT GCTTGGAATT GTGCAGTAGG

1351 GAGATGGTCA GATCGCATAA GGCTGTCTGA
```

This corresponds to the amino acid sequence <SEQ ID 1924; ORF 607.a>:

```
a607.pep
   1 MLLDLNRFSF SVFLKEVRLL TALALPMLLA QVAQVGIGFV DTVMAGGAGK

51 EDLAAVALGS SAFATVYITF MGIMAALNPM IAQLYGAGKT DEVGETRQG

101 IWFGLFLGVF GMVLMWAAIT PFRNWLTLSD YVEGTMAQYM LFTSLAMPAA

151 MVHRALHAYA SSLNRPRLIM LVSFAAFVLN VPLNYIFVYG KFGMPALGGA

201 GCGLATMAVF WFSALALWIY IAKENFFRPF GLTAKFGKPD WAVFKQIWKI

251 GAPIGLSYFL EASAFSFIVF LIAPFGEDYV AAQQVGISLS GILYMIPQSV

301 GSAGTVRIGF SLGRREFSRA RYISGVSLVS GWMLAVITVL SLVLFRSPLV

351 SMYNNDPAVL SIAATVLLFA GLFQPADFTQ CIASYALRGY KVTKVPMFIH

401 AAAFWGCGLL PGYLLAYRFD MGIYGFWTAL IASLTIAAIA LVWCLELCSR

451 EMVRSHKAV*
``` m607/a607 98.9% identity in 459 aa overlap

```
              10        20        30        40        50        60
m607.pep  MLLDLNRFSFPVFLKEVRLLTTLALPMLLAQVAQVGIGFVDTVMAGGAGKEDLAAVALGS
          ||||||||||||:|||||||||||:||||||||||||||||||||||||||||||||||
a607      MLLDLNRFSFSVFLKEVRLLTALALPMLLAQVAQVGIGFVDTVMAGGAGKEDLAAVALGS
              10        20        30        40        50        60

70        80        90       100       110       120
m607.pep  SAFATVYITFMGIMAALNPMIAQLYGAGKTDEVGETGRQGIWFGLFLGVFGMVLMWAAIT
          ||||||||||||||||||||||||||||||||||||||||||||||||||||||||||||
a607      SAFATVYITFMGIMAALNPMIAQLYGAGKTDEVGETGRQGIWFGLFLGVFGMVLMWAAIT
              70        80        90       100       110       120

130       140       150       160       170       180
m607.pep  PFRNWLTLSDYVEGTMAQYMLFTSLAMPAAMVHRALHAYTSSLNRPRLIMLVSFAAFVLN
          ||||||||||||||||||||||||||||||||||||||||:|||||||||||||||||||
a607      PFRNWLTLSDYVEGTMAQYMLFTSLAMPAAMVHRALHAYASSLNRPRLIMLVSFAAFVLN
             130       140       150       160       170       180

190       200       210       220       230       240
m607.pep  VPLNYIFVYGKFGMPALGGAGCGLATMAVFWFSALALWIYIAKENFFRPFGLTAKFGKPD
          ||||||||||||||||||||||||||||||||||||||||||||||||||||||||||||
a607      VPLNYIFVYGKFGMPALGGAGCGLATMAVFWFSALALWIYIAKENFFRPFGLTAKFGKPD
             190       200       210       220       230       240

250       260       270       280       290       300
m607.pep  WAVFKQIWKIGAPIGLSYFLEASAFSFIVFLIAPFGEDYVAAQQVGISLSGILYMIPQSV
          ||||||||||||||||||||||||||||||||||||||||||||||||||||||||||||
a607      WAVFKQIWKIGAPIGLSYFLEASAFSFIVFLIAPFGEDYVAAQQVGISLSGILYMIPQSV
             250       260       270       280       290       300

310       320       330       340       350       360
m607.pep  GSAGTVRIGFSLGRREFSRARYISGVSLVLGWMLAVITVLSLVLFRSPLVSMYNNDPAVL
          |||||||||||||||||||||||||||||:||||||||||||||||||||||||||||||
a607      GSAGTVRIGFSLGRREFSRARYISGVSLVSGWMLAVITVLSLVLFRSPLVSMYNNDPAVL
             310       320       330       340       350       360

370       380       390       400       410       420
m607.pep  SIAATVLLFAGLFQPADFTQCIASYALRGYKVTKVPMFIHAAAFWGCGLLPGYLLAYRFN
          |||||||||||||||||||||||||||||||||||||||||||||||||||||||||||:
a607      SIAATVLLFAGLFQPADFTQCIASYALRGYKVTKVPMFIHAAAFWGCGLLPGYLLAYRFD
             370       380       390       400       410       420

430       440       450       460
m607.pep  MGIYGFWTALIASLTIAAIALVWCLELCSREMVRSHKAVX
          ||||||||||||||||||||||||||||||||||||||||
a607      MGIYGFWTALIASLTIAAIALVWCLELCSREMVRSHKAVX
             430       440       450       460
```

The following partial DNA sequence was identified in *N. gonorrhoeae* <SEQ ID 1925>:

```
g608.seq
  1 ATGTCCGCCC TCCTCCCCAT CATCAACCGC CTGATTCTGC AAAGCCCGGA

51 CAGCCGCTCG GAACTTACCT CCTTTGCAGG CAAAACACTG ACCCTGAACA

101 TTGCCGGGCT GAAACTGGCG GGACGCATCA CAGAAGACGG TTTGCTCTCG

151 GCGGGAAACG GCTTTGCAGA CACCGAAATT ACCTTCCGCA ACAGCGCGAT

201 ACGGAAAATC CTCCAAGGCG GCGAACCCGG GGCTGGCGAC ATCAGGCTCG

251 AAGGCGACCT CATCCTCGGC ATcGCGGTAC TGTCCCTGCT CGGCAGCCTG

301 CGTTCCCGCG CATCGGacgA ATTGGCACGG ATTTTCGGCA CGCAGGCAGg 351 catcggcagc CGTGCCACCG ACATCGGACA CGGCaTCaaa cAAATCGGCA 401 GGAACATCGC CGAACAAATC GGCGGATTTT CCCGCGAACC CGAGTCcgCa 451 aacaccggca acgaagccct tgccgactgc ctCGACGAAA TAAGCAGACT

501 GCGCGACGGC GTGGAACGCC TCAACGAACG CCTCGACAGG CTCGAACGCG

551 ACATTTGGAT AGACTAA
```

This corresponds to the amino acid sequence <SEQ ID 1926; ORF 608.ng>:

```
g608.pep
   1 MSALLPIINR LILQSPDSRS ELTSFAGKTL TLNIAGLKLA GRITEDGLLS

51 AGNGFADTEI TFRNSAIRKI LQGGEPGAGD IRLEGDLILG IAVLSLLGSL

101 RSRASDELAR IFGTQAGIGS RATDIGHGIK QIGRNIAEQI GGFSREPESA

151 NTGNEALADC LDEISRLRDG VERLNERLDR LERDIWID*
```

The following partial DNA sequence was identified in *N. meningitidis* <SEQ ID 1927>:

```
m608.seq
   1 ATGTCCGCCC TCCTCCCCAT CATCAACCGC CTGATTCTGC AAAGCCCGGA

51 CAGCCGCTCG GAACTTGCCG CCTTTGCAGG CAAAACACTG ACCCTGAACA

101 TTGCCGGGCT GAAACTGGCG GGACGCATCA CGGAAGACGG TTTGCTCTCG

151 GCGGGAAACG GCTTTGCAGA CACCGAAATT ACCTTCCGCA ACAGCGCGGT

201 ACAGAAAATC CTCCAAGGAG GCGAACCCGG GGCGGGCGAC ATCGGGCTCG

251 AAGGCGACCT CATCCTCGGC ATCGCGGTAC TGTCCCTGCT CGGCAGCCTG

301 CGTTCCCGCG CATCGGACGA ATTGGCACGG ATTTTCGGCA CGCAGGCAGA

351 CATCGGCAGC CGTGCCGCCG ACATCGGACA CGGCATCAAA CAAATCGGCA

401 GGAACATCGC CGAACAAATC GGCGGATTTT CCCGCGAATC CGAGTCCGCA

451 AACATCGGCA ACGAAGCCCT TGCCGACTGC CTCGACGAAA TAAGCAGACT

501 GCGCGACGGC GTGGAACGCC TCAACGAACG CCTCGACCGG CTCGAACGCG

551 ACATTTGGAT AGACTAA
```

This corresponds to the amino acid sequence <SEQ ID 1928; ORF 608>:

```
m608.pep
   1 MSALLPIINR LILQSPDSRS ELAAFAGKTL TLNIAGLKLA GRITEDGLLS

51 AGNGFADTEI TFRNSAVQKI LQGGEPGAGD IGLEGDLILG IAVLSLLGSL

101 RSRASDELAR IFGTQADIGS RAADIGHGIK QIGRNIAEQI GGFSRESESA

151 NIGNEALADC LDEISRLRDG VERLNERLDR LERDIWID*
```

Computer analysis of this amino acid sequence gave the following results:
Homology with a Predicted ORF from *N. gonorrhoeae*
ORF 608 shows 95.2% identity over a 188 aa overlap with a predicted ORF (ORF 608.ng) from *N. gonorrhoeae*:

```
m608/g608

10         20         30         40         50         60
    m608.pep  MSALLPIINRLILQSPDSRSELAAFAGKTLTLNIAGLKLAGRITEDGLLSAGNGFADTEI
              ||||||||||||||||||||||  :||||||||||||||||||||||||||||||||||
    g608      MSALLPIINRLILQSPDSRSELTSFAGKTLTLNIAGLKLAGRITEDGLLSAGNGFADTEI
                    10         20         30         40         50         60

70         80         90        100        110        120
    m608.pep  TFRNSAVQKILQGGEPGAGDIGLEGDLILGIAVLSLLGSLRSRASDELARIFGTQADIGS
              ||||||::||||||||||||| ||||||||||||||||||||||||||||||||||| ||
    g608      TFRNSAIRKILQGGEPGAGDIRLEGDLILGIAVLSLLGSLRSRASDELARIFGTQAGIGS
                    70         80         80        100        110        120
```

-continued

```
                     130       140       150       160       170       180
m608.pep      RAADIGHGIKQIGRNIAEQIGGFSRESESANIGNEALADCLDEISRLRDGVERLNERLDR
              ||:||||||||||||||||||||||| |||| ||||||||||||||||||||||||||||
g608          RATDIGHGIKQIGRNIAEQIGGFSREPESANTGNEALADCLDEISRLRDGVERLNERLDR
                     130       140       150       160       170       180

189
m608.pep      LERDIWIDX
              |||||||||
g608          LERDIWIDX
```

The following partial DNA sequence was identified in *N. meningitidis* <SEQ ID 1929>:

```
a608.seq
   1 ATGTCCGCCC TCCTCCCCAT CATCAACCGC CTGATTCTGC AAAGCCCGGA

51 CAGCCGCTCG GAACTTGCCG CCTTCGCAGG CAAAACACTG ACCCTGAACA

101 TTGCCGGGTT GAAACTGGCG GGACGCATCA CGGAAGACGG TTTGCTCTCG

151 GCGGGAAACG GCTTTGCAGA CACCGAAATC ACCTTCCGCA ACAGCGCGGT

201 ACAGAAAATC CTCCAAGGCG GCGAACCCGG GGCGGGCGAC ATCGGGCTCG

251 AAGGCGACCT CATCCTCGGC ATCGCGGTAC TGTCCCTGCT CGGCAGCCTG

301 CGTTCCCGCG CATCGGACGA ATTGGCACGG ATTTTCGGCA CGCAGGCAGA

351 CATCGGCAGC CGTGCCGCCG ACATCGGACA CGGCATCAAA CAAATCGGCA

401 GGAACATCGC CGAACAAATC GGCAGATTTT CCCGCGAACC CGAGTCCGCA

451 AACATCGGCA ACGAAGCCCT TGCCGACTGC CTCGACGAAA TAAGCAGACT

501 GCGCGACGGC GTGGAACGCC TCAACGAACG CCTCGACCGG CTCGAACGCG

551 ACATTTGGAT AGACTAA
```

This corresponds to the amino acid sequence <SEQ ID 1930; *ORF* 608.a>:

```
a608.pep
   1 MSALLPIINR LILQSPDSRS ELAAFAGKTL TLNIAGLKLA GRITEDGLLS

51 AGNGFADTEI TFRNSAVQKI LQGGEPGAGD IGLEGDLILG IAVLSLLGSL

101 RSRASDELAR IFGTQADIGS RAADIGHGIK QIGRNIAEQI GRFSREPESA

151 NIGNEALADC LDEISRLRDG VERLNERLDR LERDIWID*
``` m608/a608 98.9% identity in 188 aa overlap

```
                      10        20        30        40        50        60
m608.pep      MSALLPIINRLILQSPDSRSELAAFAGKTLTLNIAGLKLAGRITEDGLLSAGNGFADTEI
              ||||||||||||||||||||||||||||||||||||||||||||||||||||||||||||
a608          MSALLPIINRLILQSPDSRSELAAFAGKTLTLNIAGLKLAGRITEDGLLSAGNGFADTEI
                      10        20        30        40        50        60

70        80        90       100       110       120
m608.pep      TFRNSAVQKILQGGEPGAGDIGLEGDLILGIAVLSLLGSLRSRASDELARIFGTQADIGS
              ||||||||||||||||||||||||||||||||||||||||||||||||||||||||||||
a608          TFRNSAVQKILQGGEPGAGDIGLEGDLILGIAVLSLLGSLRSRASDELARIFGTQADIGS
                      70        80        80       100       110       120

130       140       150       160       170       180
m608.pep      RAADIGHGIKQIGRNIAEQIGGFSRESESANIGNEALADCLDEISRLRDGVERLNERLDR
              ||||||||||||||||||||| |||| |||||||||||||||||||||||||||||||||
a608          RAADIGHGIKQIGRNIAEQIGRFSREPESANIGNEALADCLDEISRLRDGVERLNERLDR
                     130       140       150       160       170       180

189
m608.pep      LERDIWIDX
              |||||||||
a608          LERDIWIDX
```

The following partial DNA sequence was identified in *N. gonorrhoeae* <SEQ ID 1931>:

```
g609.seq
   1 ATGGTTGTGG ATAGACTCGA AATTCTCGCT CTCGACGACG AAACTCTTGA

51 TGCGTTTGTC GGCAATCAGC GAAGTAGCGA CATCGCGCAC CATATCTTCC

101 ACGAATTTCG GGTTTTCGTA GGCCTTTTCG GTAACGTATT TTTCATCGGG

151 GCGTTTGAGC AGGCCGTAGA GTTGGCAGCT CGCCTGCGTT TCCACATAAT

201 CGATAACTTC CTCGATACCG ACTTCGGCAT CGGAAGTCAG GCTGACGGTA

251 ACGTGCGAAC GCTGATTATG CGCGCCATAT TGGGAAATTT CTTTGGAACA

301 CGGGCAAAGC GAGGTTACGG GAATCATGAC CTTCATACTG TGGCCGTATG

351 CCCCGTCTTT CATTTCACCC GTGAGGCTGA CATCATAATC CAGtaa
```

This corresponds to the amino acid sequence <SEQ ID 1932; *ORF* 609.ng>:

```
g609.pep
   1 MVVDRLEILA LDDETLDAFV GNQRSSDIAH HIFHEFRVFV GLFGNVFFIG

51 AFEQAVELAA RLRFHIIDNF LDTDFGIGSQ ADGNVRTLIM RAILGNFFGT

101 RAKRGYGNHD LHTVAVCPVF HFTREADIII Q*
```

The following partial DNA sequence was identified in *N. meningitidis* <SEQ ID 1933>:

```
m609.seq
   1 ATGGTTGTGG ATAGACTCGA AATTCTCGCT CTCGACGACG AAACTCTTGA

51 TGCGTTTGTC GGCAATCAGC GAAGTAGCGA CATCGCGCAC CATATCTTCC

101 ACGAATTTCG GGTTTTCGTA GGCTTTTTCG GTAACGTATT TTTCATCGGG

151 GCGTTTGAGC AGGCCGTAGA GTTGGCAGCT CGCCTGCGCC TCCACATAAT

201 CGATGACTTC CTCGATACCG ACTTCGGCAT CGGCAGTCAG GCTGACGGTA

251 ACGTGCGAAC GCTGGTTGTG CGCGCCGTAT TGGGAAATTT CTTTGGAACA

301 CGGGCAAAGC GAGGTTACGG GAATCATGAC CTTCATACTG TGGCCGTATG

351 CCCCGTCTTT GATTTCGCCC GTGAGACAGA CATCATAATC CAGTAA
                                                    45
```

This corresponds to the amino acid sequence <SEQ ID 1934; *ORF* 609>:

```
   m609.pep

1   MVVDRLEILA LDDETLDAFV GNQRSSDIAH HIFHEFRVFV GFFGNVFFIG

51   AFEQAVELAA RLRLHIIDDF LDTDFGIGSQ ADGNVRTLVV RAVLGNFFGT

101   RAKRGYGNHD LHTVAVCPVF DFARETDIII Q* m609/g609 93.1% identity in 131 aa overlap 10         20         30         40         50         60
    m609.pep  MVVDRLEILALDDETLDAFVGNQRSSDIAHHIFHEFRVFVGFFGNVFFIGAFEQAVELAA
              ||||||||||||||||||||||||||||||||||||||||:|||||||||||||||||||
    g609      MVVDRLEILALDDETLDAFVGNQRSSDIAHHIFHEFRVFVGLFGNVFFIGAFEQAVELAA
                    10         20         30         40         50         60

70         80         90        100        110        120
    m609.pep  RLRLHIIDDFLDTDFGIGSQADGNVRTLVVRAVLGNFFGTRAKRGYGNHDLHTVAVCPVF
              |||:||||:|||||||||||||||||||::||:|||||||||||||||||||||||||||
    g609      RLRFHIIDNFLDTDFGIGSQADGNVRTLIMRAILGNFFGTRAKRGYGNHDLHTVAVCPVF
                    70         80         90        100        110        120
```

```
                         130
   m609.pep    DFARETDIIIQX
               |:||:||||||
   g609        HFTREADIIIQX
                         130
```

The following partial DNA sequence was identified in *N. meningitidis* <SEQ ID 1935>:

```
a609.seq
    1 ATGGTTGTGG ATAGACTCGA AATTCTCGCT CTCGACGACG AAACTCTTGA

51 TGCGTTTGTC GGCAATCAGC GAAGTAGCGA CATCGCGCAC CATATCTTCC

101 ACGAATTTCG GGTTTTCGTA GGCTTTTTCG GTAACGTATT TTTCATCGGG

151 GCGTTTGAGC AGGCCGTAGA GTTGGCAGCT CGCCTGCGCC TCCACATAAT

201 CGATGACTTC CTCGATACCG ACTTCGGCAT CGGCAGTCAG GCTGACGGTA

251 ACGTGCGAAC GCTGGTTGTG CGCGCCATAT TGGGAAATTT CTTTGGAACA

301 CGGGCAAAGC GAGGTTACGG GAATCATGAC CTTCATACTG TGGCCGTATG

351 CACCGTCTTT CATTTCGCCC GTGAGGCTGA CATCATAATC CAGTAA
```

This corresponds to the amino acid sequence <SEQ ID 1936; *ORF 609.a*>:

```
m609.pep

1    MVVDRLEILA LDDETLDAFV GNQRSSDIAH HIFHEFRVFV GFFGNVFFIG

51    AFEQAVELAA RLRLHIIDDF LDTDFGIGSQ ADGNVRTLVV RAVLGNFFGT

101    RAKRGYGNHD LHTVAVCPVF DFARETDIII Q* m609/g609    93.1% identity in 131 aa overlap 10         20         30         40         50         60
   m609.pep    MVVDRLEILALDDETLDAFVGNQRSSDIAHHIFHEFRVFVGFFGNVFFIGAFEQAVELAA
               ||||||||||||||||||||||||||||||||||||||||:|||||||||||||||||||
   g609        MVVDRLEILALDDETLDAFVGNQRSSDIAHHIFHEFRVFVGLFGNVFFIGAFEQAVELAA
                        10         20         30         40         50         60

70         80         90        100        110        120
   m609.pep    RLRLHIIDDFLDTDFGIGSQADGNVRTLVVRAVLGNFFGTRAKRGYGNHDLHTVAVCPVF
               |||:||||:|||||||||||||||||||||::||:|||||||||||||||||||||| ||
   g609        RLRFHIIDNFLDTDFGIGSQADGNVRTLIMRAILGNFFGTRAKRGYGNHDLHTVAVCTVF
                        70         80         90        100        110        120

130
   m609.pep    DFARETDIIQX
               |:||:||||||
   g609        HFTREADIIQX
                         130
```

The following partial DNA sequence was identified in *N. gonorrhoeae* <SEQ ID 1937>:

```
g610.seq
    1 ATGATTGGAG GGCTTATGCA ATTTCCTTAC CGCAATGTTC CGGCTTCGCG

51 TATGCGCCGT ATGCGCAGGG ATGATTTTTC ACGCCGCCTG ATGCGCGAGC

101 ATATGCTGAC CGCCGATGAT TTGATTTATC CGGTGTTCGT ATTGGAGGGG

151 GCGGCGCGCG AGGAGGATGT GCCTTCTATG CCGGGCGTGA AGCGTCAGAG

201 TTTGGACAGG CTGCTGTTTA CGGCGGAAGA GGCGGTGAAG CTCGGTATTC

251 CGATGTTGGC ACTCTTTCCC GTGGTTACGG CAAACAAAAC CGGGCGTGCG

301 CAGGAGGCGT ACAATCCCGA AGGACTCGTG CCGTCAACTG tccgagccTT
```

-continued

```
 351  GCGCGAGAGG  TttcCcgaac  tggggattat  gacggatgtc  gcgctcgAtc 401  cttatacggt  gcacGGTCAG  GACGGACTGA  CGGACgaaaa  cggttaCGTG 451  ATGAatgATg  aaaCCGTAGA  AGTCTTGGTG  AAACAGGCTT  TATGTCATGC

501  AGAGGCGGGC  ACGCAGGTCG  TTGCTCCTTC  CGATATGATG  GACGGGCGTA

551  TCGGCGCCAT  CCGCGAGGCT  TTGGAGGATG  CCGGACATAT  CCATACGCGG

601  ATTATGGCAT  ATTCCGCCAA  ATATGCTTCT  GCATTCTACG  GCCCTTTCCG

651  TGATGCGGTA  GGCAGTTCGG  GCAATTTGGG  AAAGGCAGAT  AAAAAGACCT

701  ATCAGATGGA  TCCTGCAAAT  ACCGATGAGG  CGCTGCATGA  AGTGGCGCTC

751  GATATTCAGG  AAGGTGCGGA  TATGGTGATG  GTGAAGCCCG  GTTTGCCGTA

801  TTTGGACGTT  GTCCGCCGCG  TGAAGGACGA  GTTCGGCGTA  CCGACTTATG

851  CCTATCAGGT  TTCGGGCGAA  TATGCGATGT  TGCAGGCGGC  GGTTGCCAAC

901  GGCTGGCTGG  ACGGCGGCAA  AGTGGTTTTG  GAAAGCCTGC  TGGCATTCAA

951  ACGTGCGGGT  GCGGACGGGA  TTTTGACCTA  TTACGCCATT  GAGGCGGCAA

1001  AGATGCTGAA  GCGTTGA
```

This corresponds to the amino acid sequence <SEQ ID 1938; ORF 610.ng>:

```
g610.pep
   1  MIGGLMQFPY  RNVPASRMRR  MRRDDFSRRL  MREHMLTADD  LIYPVFVLEG

51  AAREEDVPSM  PGVKRQSLDR  LLFTAEEAVK  LGIPMLALFP  VVTANKTGRA

101  QEAYNPEGLV  PSTVRALRER  FPELGIMTDV  ALDPYTVHGQ  DGLTDENGYV

151  MNDETVEVLV  KQALCHAEAG  TQVVAPSDMM  DGRIGAIREA  LEDAGHIHTR

201  IMAYSAKYAS  AFYGPFRDAV  GSSGNLGKAD  KKTYQMDPAN  TDEALHEVAL

251  DIQEGADMVM  VKPGLPYLDV  VRRVKDEFGV  PTYAYQVSGE  YAMLQAAVAN

301  GWLDGGKVVL  ESLLAFKRAG  ADGILTYYAI  EAAKMLKR*
```

The following partial DNA sequence was identified in *N. meningitidis* <SEQ ID 1939>:

```
m610.seq
   1  ATGATTGGAG  GGCTTATGCA  GTTTCCTTAC  CGCAATGTTC  CGGCTTCGCG

51  TATGCGCCGT  ATGCGCAGGG  ACGATTTTTC  ACGCCGCCTG  ATGCGCGAAC

101  ACACGCTGAC  CGCCGATGAT  TTGATTTATC  CGGTGTTCGT  ATTGGAGGGG

151  TCGGCGCGCG  AGGAGGATGT  GCCTTCTATG  CCGGGTGTGA  AGCGTCAAAG

201  TTTGGACAGG  CTGCTGTTTA  CGGCGGAAGA  GGCGGTAAAG  CTCGGTATTC

251  CGATGTTGGC  ACTGTTCCCC  GTGGTTACGG  CAAACAAAAC  CGAGCGTGCG

301  CAGGAGGCGT  ACAATCCCGA  AGGACTCGTG  CCGTCAACTG  TCCGCGCCTT

351  GCGCGAGAGG  TTTCCCGAAC  TGGGCATTAT  GACGGATGTC  GCGCTCGATC

401  CTTATACGGT  TCACGGTCAG  GACGGGCTGA  CGGACGAAAA  CGGTTATGTG

451  ATGAACGATG  AAACCGTAGA  GGTTTTGGTC  AAGCAGGCTT  TGTGCCACGC

501  TGAAGCGGGC  GCGCAGGTGG  TTGCCCCTTC  CGATATGATG  GACGGGCGTA

551  TCGGTGCGAT  TCGCGAGGCG  TTGGAGGATG  CCGGGCATAT  CCATACGCGG

601  ATTATGGCGT  ATTCCGCCAA  ATATGCTTCT  GCATTTTACG  GCCCTTTCCG
```

-continued

```
 651 TGATGCGGTA GGCAGTTCGG GCAATTTGGG CAAGGCAGAT AAAAAGACCT

701 ACCAGATGGA TCCGGCAAAT ACCGATGAGG CGTTGCACGA AGTGGCGTTG

751 GACATTCAGG AAGGTGCGGA TATGGTAATG GTCAAGCCCG GTTTGCCGTA

801 TTTGGACGTT GTCCGCCGCG TAAAGGACGA GTTCGGTGTG CCGACTTATG

851 CCTATCAGGT TTCGGGAGAA TACGCGATGT TGCAGGCAGC GATTGCCAAC

901 GGCTGGCTGG ACGGCGGCAA AGTGGTTTTG GAAAGCCTGC TGGCATTCAA

951 ACGTGCGGGT GCGGACGGGA TTTTGACCTA TTACGCTATT GAGGCGGCAA

1001 AGATGTTGAA GCGTTGA
```

This corresponds to the amino acid sequence <SEQ ID 1940; ORF 610>:

```
m610.pep

1 MIGGLMQFPY RNVPASRMRR MRRDDFSRRL MREHTLTADD LIYPVFVLEG

51 SAREEDVPSM PGVKRQSLDR LLFTAEEAVK LGIPMLALFP VVTANKTERA

101 QEAYNPEGLV PSTVRALRER FPELGIMTDV ALDPYTVHGQ DGLTDENGYV

151 MNDETVEVLV KQALCHAEAG AQVVAPSDMM DGRIGAIREA LEDAGHIHTR

201 IMAYSAKYAS AFYGPFRDAV GSSGNLGKAD KKTYQMDPAN TDEALHEVAL

251 DIQEGADMVM VKPGLPYLDV VRRVKDEFGV PTYAYQVSGE YAMLQAAIAN

301 GWLDGGKVVL ESLLAFKRAG ADGILTYYAI EAAKMLKR* m610/g610 98.5% identity in 338 aa overlap
                 10         20         30         40         50         60
m610.pep  MIGGLMQFPYRNVPASRMRRMRRDDFSRRLMREHTLTADDLIYPVFVLEGSAREEDVPSM
          ||||||||||||||||||||||||||||||||||| :|||||||||||||: ||||||||
g610      MIGGLMQFPYRNVPASRMRRMRRDDFSRRLMREHMLTADDLIYPVFVLEGAAREEDVPSM
                 10         20         30         40         50         60
                 70         80         90        100        110        120
m610.pep  PGVKRQSLDRLLFTAEEAVKLGIPMLALFPVVTANKTERAQEAYNPEGLVPSTVRALRER
          |||||||||||||||||||||||||||||||||||||:|||||||||||||||||||||
g610      PGVKRQSLDRLLFTAEEAVKLGIPMLALFPVVTANKTGRAQEAYNPEGLVPSTVRALRER
                 70         80         90        100        110        120
                130        140        150        160        170        180
m610.pep  FPELGIMTDVALDPYTVHGQDGLTDENGYVMNDETVEVLVKQALCHAEAGAQVVAPSDMM
          |||||||||||||||||||||||||||||||||||||||||||||||||:||||||||
g610      FPELGIMTDVALDPYTVHGQDGLTDENGYVMNDETVEVLVKQALCHAEAGTQVVAPSDMM
                130        140        150        160        170        180
                190        200        210        220        230        240
m610.pep  DGRIGAIREALEDAGHIHTRIMAYSAKYASAFYGPFRDAVGSSGNLGKADKKTYQMDPAN
          ||||||||||||||||||||||||||||||||||||||||||||||||||||||||||||
g610      DGRIGAIREALEDAGHIHTRIMAYSAKYASAFYGPFRDAVGSSGNLGKADKKTYQMDPAN
                190        200        210        220        230        240
                250        260        270        280        290        300
m610.pep  TDEALHEVALDIQEGADMVMVKPGLPYLDVVRRVKDEFGVPTYAYQVSGEYAMLQAAIAN
          |||||||||||||||||||||||||||||||||||||||||||||||||||||||||:|
g610      TDEALHEVALDIQEGADMVMVKPGLPYLDVVRRVKDEFGVPTYAYQVSGEYAMLQAAVAN
                250        260        270        280        290        300
                310        320        330    339
m610.pep  GWLDGGKVVLESLLAFKRAGADGILTYYAIEAAKMLKRX
          |||||||||||||||||||||||||| |||||||||||
g610      GWLDGGKVVLESLLAFKRAGADGILTYYAIEAAKMLKRX
                310        320        330
```

The following partial DNA sequence was identified in N. meningitidis <SEQ ID 1941>:

```
a610.seq
    1 ATGATTGGAG GGCTTATGCA GTTTCCTTAC CGCAATGTTT CGGCTTCGCG

51 TATGCGCCGT ATGCGCAGGG ACGATTTTTC ACGCCGCCTG ATGCGCGAGC
```

```
-continued
101  ATACGCTGAC TGCCGATGAT TTGATTTATC CGGTGTTCGT ATTGGAGGGG

151  TCGGCGCGCG AGGAGGATGT GCCTTCTATG CCGGGCGTGA AGCGTCAGAG

201  TTTGGACAGG CTGCTGTTTA CGGCGGAAGA GGCGGTAAAG CTCGGTATTC

251  CGATGTTGGC ACTGTTCCCC GTGGTTACGG CAAACAAAAC CGAGCGTGCG

301  CAGGAGGCGT ACAATCCCGA AGGACTCGTG CCGTCAACTG TCCGCGCCTT

351  GCGCGAGAGG TTTCCCGAAC TGGGCATTAT GACGGATGTC GCGCTCGATC

401  CTTATACGGT GCACGGTCAG GACGGGCTGA CGGACGAAAA CGGTTATGTG

451  ATGAACGATG AAACCGTAGA GGTTTTGGTC AAGCAGGCTT TGTGTCATGC

501  AGAGGCAGGC GCACAGGTCG TTGCTCCTTC CGATATGATG GATGGGCGTA

551  TCGGTGCGAT TCGCGAGGCG TTGGAGGATG CCGGGCATAT CCATACGCGG

601  ATTATGGCGT ATTCCGCCAA ATATGCTTCT GCATTTTACG GCCCTTTCCG

651  TGATGCGGTA GGCAGTTCGG GCAATTTGGG CAAGGCAGAT AAAAAGACCT

701  ACCAGATGGA TCCGGCAAAT ACCGATGAGG CGTTGCACGA AGTGGCGTTG

751  GACATTCAGG AAGGTGCGGA TATGGTGATG GTCAAGCCCG GTTTGCCGTA

801  TTTGGACGTT GTCCGCCGCG TGAAGGACGA GTTCGGCGTG CCGACTTATG

851  CCTATCAGGT TTCGGGAGAA TACGCGATGC TGCAGGCGGC GGTTGCCAAC

901  GGCTGGCTGG ACGGCGGCAA AGTGGTTTTG GAAAGCCTGC TGGCATTCAA

951  ACGTGCGGGT GCGGATGGGA TTTTGACCTA TTACGCCATT GAGGCGGCAA

1001 AGATGCTGAA GCGTTGA
```

This corresponds to the amino acid sequence <SEQ ID 1942; ORF 610.a>:

```
a610.pep
      1    MIGGLMQFPY RNVSASRMRR MRRDDFSRRL MREHTLTADD LIYPVFVLEG

51    SAREEDVPSM PGVKRQSLDR LLFTAEEAVK LGIPMLALFP VVTANKTERA

101    QEAYNPEGLV PSTVRALRER FPELGIMTDV ALDPYTVHGQ DGLTDENGYV

151    MNDETVEVLV KQALCHAEAG AQVVAPSDMM DGRIGAIREA LEDAGHIHTR

201    IMAYSAKYAS AFYGPFRDAV GSSGNLGKAD KKTYQMDPAN TDEALHEVAL

251    DIQEGADMVM VKPGLPYLDV VRRVKDEFGV PTYAYQVSGE YAMLQAAVAN

301    GWLDGGKVVL ESLLAFKRAG ADGILTYYAI EAAKMLKR* m610/a610  99.4% identity in 388 aa overlap
                    10         20         30         40         50         60
m610.pep    MIGGLMQFPYRNVPASRMRRMRRDDFSRRLMREHTLTADDLIYPVFVLEGSAREEDVPSM
            ||||||||||||| ||||||||||||||||||||||||||||||||||||||||||||||
a610        MIGGLMQFPYRNVSASRMRRMRRDDFSRRLMREHTLTADDLIYPVFVLEGSAREEDVPSM
                    10         20         30         40         50         60

70         80         90        100        110        120
m610.pep    PGVKRQSLDRLLFTAEEAVKLGIPMLALFPVVTANKTERAQEAYNPEGLVPSTVRALRER
            ||||||||||||||||||||||||||||||||||||||||||||||||||||||||||||
a610        PGVKRQSLDRLLFTAEEAVKLGIPMLALFPVVTANKTERAQEAYNPEGLVPSTVRALRER
                    70         80         90        100        110        120

130        140        150        160        170        180
m610.pep    FPELGIMTDVALDPYTVHGQDGLTDENGYVMNDETVEVLVKQALCHAEAGAQVVAPSDMM
            ||||||||||||||||||||||||||||||||||||||||||||||||||||||||||||
a610        FPELGIMTDVALDPYTVHGQDGLTDENGYVMNDETVEVLVKQALCHAEAGAQVVAPSDMM
                   130        140        150        160        170        180

190        200        210        220        230        240
m610.pep    DGRIGAIREALEDAGHIHTRIMAYSAKYASAFYGPFRDAVGSSGNLGKADKKTYQMDPAN
            ||||||||||||||||||||||||||||||||||||||||||||||||||||||||||||
a610        DGRIGAIREALEDAGHIHTRIMAYSAKYASAFYGPFRDAVGSSGNLGKADKKTYQMDPAN
                   190        200        210        220        230        240
```

```
                    250        260        270        280        290        300
m610.pep   TDEALHEVALDIQEGADMVMVKPGLPYLDVVRRVKDEFGVPTYAYQVSGEYAMLQAAIAN
           ||||||||||||||||||||||||||||||||||||||||||||||||||||||||:||
a610       TDEALHEVALDIQEGADMVMVKPGLPYLDVVRRVKDEFGVPTYAYQVSGEYAMLQAAVAN
                    250        260        270        280        290        300

310        320        330   339
m610.pep   GWLDGGKVVLESLLAFKRAGADGILTYYAIEAAKMLKRX
           ||||||||||||||||||||||||||||||||||||||
a610       GWLDGGKVVLESLLAFKRAGADGILTYYAIEAAKMLKRX
                    310        320        330
```

The following partial DNA sequence was identified in *N. gonorrhoeae* <SEQ ID 1943>:

```
g611.seq
  1 ATGCCGTCTG AAAACGGGAT GGGAAAACGG CAGCTTGCGG GCTGCCGTTT

51 GTTCGGGAAG TTAAGCCTTG TTTTCAGGCT GCTGCCCGGA CTCTGTCGAG

101 GCGGTGTCTG CCGGGGCAGG TGCTTCGGTT TTTTCCCGAG TCGGAGCGTG

151 CGGCGCGTTA TCTTCCGCCG CGTCCGCATT CtcgcgcaggttgtGGCtgt 201 tatcctTGGG CGGGCTGggt tgtttgcccg ccataaTTtc cagtacctgA 251 TcgcgGTCta tggtttcCCa ttCcatcagg gctttgcaca TCGTTTCCAT 301 cttgTCGCGG TTTTcatcga ggaTTTTGTA ggcaacCTGA TACTgctcgt 351 ccaaaAtccg Gcggatttcc gcgtcgAtgt cctgctgggt tTTCTCGGAA 401 ATGTTTTGCG AACGGttac gctGCGCCCC AAGAAGACTT CGCCTTCGTT 451 TTCCGCATAA ACCATCACGC CCATTTTGtc gCTCAtgcCG TAGCGCGTTA

501 CCATTTCGCG TGCCATTTGG GTTGCGCGTT CAAAGTCGTT TGA
```

This corresponds to the amino acid sequence <SEQ ID 1944; *ORF* 611.ng>:

```
g611.pep
  1 MPSENGMGKR QLAGCRLFGK LSLVFRLLPG LCRGGVCRGR CFGFFPSRSV

51 RRVIFRRVRI LAQVVAVILG RAGLFARHNF QYLIAVYGFP FHQGFAHRFH

101 LVAVFIEDFV GNLILLVQNP ADFRVDVLLG FLGNVLRTGY AAPQEDFAFV

151 FRINHHAHFV AHAVARYHFA CHLGCAFKVV *
```

The following partial DNA sequence was identified in *N. meningitidis* <SEQ ID 1945>:

```
m611.seq
  1 ATGCCGTCTG AAAACGGGAT GGGAAAACGG CAGCTTGCGG GCTGCCGTTT

51 GTTCGGGAAG TTAAGCCTTG TTTTCAGGCT GCTGCTCGGA CTCTGTCGAA

101 GCGGTGTCTG CCGGGGCAGG TGCTTCGGTT TCTTCCCGAG TCGGAGCGTG

151 CGGCGCGTTA TCTTCCGCCG CGTCCGCATT CTCGCGCAGG TTGTGGCTGT

201 AATCTTTGGG CGGGCTGGGT TGTTTGCCCG CCATGATTTC CAGTACCTGA

251 TCGCGGTCGA TGGTTTCCCA TTCCATCAGG GCTTTGCACA TCGTTTCCAT

301 CTTGTCGCGG TTTTCATCGA GGATTTTGTA GGCAACCTGA TATTGCTCGT

351 CCAAAATCCG GCGGATTTCC GCGTCGATGT CCTGCTGGGT TTTCTCGGAA

401 ATGTTTTGCG AACGGGTTAC GCTGCGTCCC AAGAAGACTT CGCCTTCGTT
```

-continued
```
451 TTCCGCATAA ACCATCACGC CCATTTTGTC GCTCATGCCG TAGCGCGTTA

501 CCATTTCGCG CGCCATTTGG GTTGCGCGTT CAAAGTCGTT TGA
```

This corresponds to the amino acid sequence <SEQ ID 1946; ORF 611>:

```
m611.pep

1   MPSENGMGKR QLAGCRLFGK LSLVRFLLLG LCRSGVCRGR CFGRRPSRSV

51   RRVIFRRVRI LAQVVAVIFG RAGLFARHDF QYLIAVDGFP FHQGFAHRFH

101   LVAVFIEDFV GNLILLVQNP ADFRVDVLLG FLGNVLRTGY AASQEDFAFV

151   FRINHHAHFV AHAVARYHFA RHLGCAFKVV * m611/g611 96.1% identity in 180 aa overlap 10         20         30         40         50         60
m611.pep    MPSENGMGKRQLAGCRLFGKLSLVRFLLLGLCRSGVCRGRCFGFFPSRSVRRVIFRRVRI
            ||||||||||||||||||||| ||||:|||||||||||||||||||||||||||||||||
g611        MPSENGMGKRQLAGCRLFGKLSLVRFLLPGLCRGGVCRGRCFGFFPSRSVRRVIFRRVRI
                    10         20         30         40         50         60

70         80         90        100        110        120
m611.pep    LAQVVAVUFGRAGKFARGDFQYKIAVDGFPPHQGFAHRFHLVAVFIEDFVGNLILLVQNP
            ||||||||:||||||||||:||||||| ||||||||||||||||||||||||||||||||
g611        LAQVVAVULGRAGKFARGNFQYKIAVYGFPPHQGFAHRFHLVAVFIEDFVGNLILLVQNP
                    70         80         90        100        110        120

130        140        150        160        170        180
m611.pep    ADFRVDVLLGFLGNVLRTGYAASQEDFAFVFRINHHAHFVAHAVARYHFARHLGCAFKVV
            |||||||||||||||||||||| |||||||||||||||||||||||||||| ||||||||
g611        ADFRVDVLLGFLGNVLRTGYAAPQEDFAFVFRINHHAHFVAHAVARYHFACHLGCAFKVV
                   130        140        150        160        170        180 m611.pep    X
            |
g611        X
```

The following partial DNA sequence was identified in *N. meningitidis* <SEQ ID 1947>:

```
a611.seq
   1 ATGCCGTCTG AAAACAGGAT GGGAAAACGG CAGCTTGCGG GCTGCCGTTT

51 GTTCGGGAAG TTAAGCCTTG TTTTCAGGCT GCTGCTCGGA CTCTGTCGAA

101 GCGGTGTCTG CCGGGGCAGG TGCTTCGGTT TCTTCCCGAG TCGGAGCGTG

151 CGGCGCGTTA TCTTCCGCCG CGTCCGCATT CTCGCGCAGG TTGTGGCTGT

201 AATCTTTGGG CGGGCTGGGT TGTTTGCCCG CCATGATTTC CAGTACCTGA

251 TCGCGGTCGA TGGTTTCCCA TTCCATCAGG GCTTTGCACA TCGTTTCCAT

301 CTTGTCGCGG TTTTCATCGA GGATTTTGTA GGCAACCTGA TACTGCTCGT

351 CCAAAATCCG GCGGATTTCC GCATCGATGT CCTGCTGGGT TTTCTCGGAA

401 ATGTTTTGCG AACGGGTTAC GCTGCGTCCC AAGAAGACTT CGCCTTCGTT

451 TTCCGCATAA ACCATCACGC CCATTTTGTC GCTCATGCCG TAGCGCGTTA

501 CCATTTCGCG CGCCATTTGG GTTGCGCGTT CAAAGTCGTT TGA
```

This corresponds to the amino acid sequence <SEQ ID 1948; ORF 611.a>:

```
a611.pep

1   MPSENRMGKR GLAGCRLFGK LSLVFRLLLG LCRSGVCRGR CFGFFPSRSV

51   RRVIFRRVRI LAQVVAVIFG RAGLFARHDF QYLIAVDGFP FHQGFAHRFH
```

```
    101 LVAVFIEDFV GNLILLVQNP ADFRIDVLLG FLGNVLRTGY AASQEDFAFV

151 FRINHHAHFV AHAVARYHFA RHLGCAFKVV * m611/a611  98.9% identity in 180 aa overlap 10         20         30         40         50         60
m611.pep   MPSENGMGKRQLAGCRLFGKLSLVFRLLLGLCRSGVCRGRCFGFFPSRSVRRVIFRRVRI
           |||||  |||||||||||||||||||||||||||||||||||||||||||||||||||||
a611       MPSENRMGKRQLAGCRLFGKLSLVFRLLLGLCRSGVCRGRCFGFFPSRSVRRVIFRRVRI
                   10         20         30         40         50         60

70         80         90        100        110        120
m611.pep   LAQVVAVIFGRAGLFARHDFQYLIAVDGFPPFHQGFAHRFHLVAVFIEDFVGNLILLVQNP
           ||||||||||||||||||||||||||||||||||||||||||||||||||||||||||||
a611       LAQVVAVIFGRAGLFARHDFQYLIAVDGFPPFHQGFAHRFHLVAVFIEDFVGNLILLVQNP
                   70         80         90        100        110        120

130        140        150        160        170        180
m611.pep   ADFRVDVLLGFLGNVLRTGYAASQEDFAFVFRINHHAHFVAHAVARYHFARHLGCAFKVV
           ||||:|||||||||||||||||||||||||||||||||||||||||||||||||||||||
a611       ADFRIDVLLGFLGNVLRTGYAASQEDFAFVFRINHHAHFVAHAVARYHFARHLGCAFKVV
                  130        140        150        160        170        180 m611.pep   X
           |
a611       X
```

The following partial DNA sequence was identified in *N. gonorrhoeae* <SEQ ID 1949>:

```
g612.seq
   1 ATGGgcttcg gcggcaatat tgcAAAAAAG CTGGCcggGg taGATGAAAT

51 AGCCTttgac tttgacggcA TCGTCTTTGA TTTCGGGCGT GATGATGCTG

101 TCCGGCataG CGGCGTAATC AATGCTGCTG TCGCCGGCCT GCATATAGTC

151 GGTGAAGTTT TCGCTGATAA AGCGGTAGAA AAGTGTGCCG AGAACGTATT

201 GTTTAAAGTC CCAGCCATCC ACCGCGCCGC GTACTTCGTC GGCGATTTTC

251 CAAATTTGGC GGTGCAGTTG GGCGCGTTGT TGCATTTCGG TCATCATCGA

301 AATCCATATA TAAAGTTAAA CAAATCAAAA TCGCCTGATA TTTTCAGACG

351 ATTTTTTTAC GGGCATTCAA ATTAA
```

This corresponds to the amino acid sequence <SEQ ID 1950; ORF 612.ng>:

```
g612.pep
   1 MGFGGNIAKK LAGVDEIAFD FDGIVFDFGR DDAVRHSGVI NAAVAGLHIV

51 GEVFADKAVE KCAENVLFKV PAIHRAAYFV GDFPNLAVQL GALLHFGHHR

101 NPYIKLNKSK SPDIFRRFFY GHSN*
```

The following partial DNA sequence was identified in *N. meningitidis* <SEQ ID 1951>:

```
m612.seq
   1 ATGGGCTTCG GCGGCAATAT TGCAAAAAAG CTGGCCGGGG TAGATGAAAT

51 AGCCTTTAAC TTTGACGGCA TCGTCTTTGA TTTCGGGCGT GATGATGCTG

101 TCCGGCATAG CGGCGTAATC AATACTGCTG TCGCCTGCCT GCATATAGTC

151 GGTGAAGTTT TCGCTGATAA AGCGGTAGAA AAGTGTGCCG AGAACGTATT
```

```
201 GTTTAAAGTC CCAGCCATCC ACCGCGCCGC GTACTTCGTC GGCAATTTTC

251 CAAATTTGGC GGTGCAGTTG GGCGCGTTGT TGCATTTCGG TCATCATCGA

301 AATCCATATA .AAAGTTAAA CAAATCAAAA TCGCCTGATA TTTTCAGACG

351 ATTTTTTTAC GGGCATTCAA ATTAA
```

This corresponds to the amino acid sequence <SEQ ID 1952; ORF 612>:

```
   m612.pep

1 MGFGGNIAKK LAGVDEIAFN FDGIVFDFGR DDAVRHSGVI NTAVACLHIV

51 GEVFADKAVE KCAENVLFKV PAIHRAAYFV GNFPNLAVQL GALLHFGHHR

101 NPYXKLNKSK SPDIFRRFFY GHSN* m612/g612 96.0% identity in 124 aa overlap 10         20         30         40         50         60
   m612.pep    MGFGGNIAKKLAGVDEIAFNFDGIVFDFGRDDAVRHSGVINTAVACLHIVGEVFADKAVE
               ||||||||||||||||||||:||||||||||||||||||||:||| |||||||||||||
   g612        MGFGGNIAKKLAGVDEIAFDFDGIVFDFGRDDAVRHSGVINAAVAGLHIVGEVFADKAVE
                      10         20         30         40         50         60
                      70         80         90        100        110        120
   m612.pep    KCAENVLFKVPAIHRAAYFVGNFPNLAVQLGALLHFGHHRNPYXKLNKSKSPDIFRRFFY
               |||||||||||||||||||||:||||||||||||||||||| ||||||||||||||||||
   g612        KCAENVLFKVPAIHRAAYFVGDFPNLAVQLGALLHFGHHRNPYIKLNKSKSPDIFRRFFY
                      70         80         90        100        110        120 m612.pep    GHSNX
               |||||
   g612        GHSNX
```

The following partial DNA sequence was identified in *N. meningitidis* <SEQ ID 1953>:

```
a612.seq
    1 ATGGGCTTCG GCGGCAATAT TGCAAAAAAG CTGGCCGGGG TAGATGAAAT

51 AGCCTTTGAC TTTGACGGCA TCGTCTTTGA TTTCGGGCGT GATGATGCTG

101 TCCGGCATAG CGGCGTAATC AATACTGCTG TCGCCTGCCT GCATATAGTC

151 GGTAAAGTTT TCGCTGATAA AGCGGTAGAA AAGTGTGCCG AGAACGTATT

201 GTTTGAAGTC CCAGCCATCC ACCGCGCCGC GTACTTCGTC GGCAATTTTC

251 CAAATTTGGC GGTGCAGTTG GGCGCGTTGT TGTATTTCGG TCATCATCGA

301 AATCCATAT. AAAAGTTAAA CAAATCAAAA TCGCCTGATA TTTTCAGACG

351 ATTTTTT.AC GGGCATTCAA ATTAA
```

This corresponds to the amino acid sequence <SEQ ID 1954; ORF 612.a>:

```
   a612.pep

1 MGFGGNIAKK LAGVDEIAFD FDGIVFDFGR DDAVRHSGVI NTAVACLHIV

51 GKVFADKAVE KCAENVLFEV PAIHRAAYFV GNFPNLAVQL GALLYFGHHR

101 NPYXKLNKSK SPDIFRRFFX GHSN* m612/a612 96.0% identity in 124 aa overlap
```

```
                  10         20         30         40         50         60
m612.pep  MGFGGNIAKKLAGVDEIAFNFDGIVFDFGRDDAVRHSGVINTAVACLHIVGEVFADKAVE
          |||||||||||||||||||:||||||||||||||||||||||||||||||:||||||||
a612      MGFGGNIAKKLAGVDEIAFDFDGIVFDFGRDDAVRHSGVINTAVACLHIVGKVFADKAVE
                  10         20         30         40         50         60
                  70         80         90        100        110        120
m612.pep  KCAENVLFKVPAIHRAAYFVGNFPNLAVQLGALLHFGHHRNPYXKLNKSKSPDIFRRFFY
          ||||||||:|||||||||||||||||||||||||||:|||||||||||||||||||||||
a612      KCAENVLFEVPAIHRAAYFVGNFPNLAVQLGALLYFGHHRNPYXKLNKSKSPDIFRRFFY
                  70         80         90        100        110        120
m612.pep  GHSNX
          |||||
a612      GHSNX
```

The following partial DNA sequence was identified in *N. gonorrhoeae* <SEQ ID 1955>:

```
g613.seq
   1ATGTCGCGTT CGAGCCTGTC GAGGCGTTCG TTGAGGCGTT CCACGCCGTC

51GCGCAGTCTG CTTATTTCGT CGaggcagtc ggcaagggct tcgttgccgg

101tgtttGcgGA CTCGGGTTCG CGGGAAAATC CGCCGATTTG TTCGGCGATG

151TTCCTGCCGA TTTgtttGAt GCCGTGTCCG ATGTCGGTGG CACGgctgcc

201gatgcCTGCC TGCGTGCCGA AAATCCGTGC CAATTcgtCC GATGCGCGGG

251AACGCAGGCT GCCGAGCAGG GACAGTACCG CgATGCCGAG GATGAGGTCG

301CCTTCGAGCC TGATGTCGCC AGCCCCGGGT TCGCCGCCTT GGAGGATTTT

351CCGTATCGCG CTGTTGCGGA AGGTAATTTC GGTGTCTGCA AAGCCGTTTC

401CCGCCGAGAG CAAACCGTCT TCTGTGATGC GTCCCGCCAG TTTCAGCCCG

451GCAATGTTCA GGGTCAGTGT TTTGCCTGCA AAGGAGGTAA GTTCCGAGCG

501GCTGTCCGGG CTTTGCAGAA TCAGGCGGTT GATGATGGGG AGGAGGGCGG

551ACATATTTTC TGATTGGGGC GGAGAATGCC TGTTGTTGCT GTTGCCGCTT

601ATTTTACAGG CTTAA
```

This corresponds to the amino acid sequence <SEQ ID 1956; *ORF 613.ng*>:

```
g613.pep
   1 MSRSSLSRRS LRRSTPSRSL LISSRQSARA SLPVFADSGS RENPPICSAM

51 FLPICLMPCP MSVARLPMPA CVPKIRANSS DARERRLPSR DSTAMPRMRS

101 PSSLMSPAPG SPPWRIFRIA LLRKVISVSA KPFPAESKPS SVMRPASFSP

151 AMFRVSVLPA KEVSSERLSG LCRIRRLMMG RRADIFSDWG GECLLLLLPL

201 ILQA*
```

The following partial DNA sequence was identified in *N. meningitidis* <SEQ ID 1957>:

```
m613.seq
   1 ATGTCGCGTT CGAGCCGGTC GAGGCGTTCG TTGAGGCGTT CCACGCCGTC

51 GCGCAGTCTG CTTATTTCGT CGAGGCAGTC GGCAAGGGCT TCGTTGCCGA

101 TGTTTGCGGA CTCGGATTCG CGGGAAAATC CGCCGATTTG TTCGGCGATG
```

-continued
```
151 TTCCTGCCGA TTTGTTTGAT GCCGTGTCCG ATGTCGGCGG CACGGCTGCC

201 GATGTCTGCC TGCGTGCCGA AAATCCGTGC CAATTCGTCC GATGCGCGGG

251 AACGCAGGCT GCCGAGCAGG GACAGTACCG CGATGCCGAG GATGAGGTCG

301 CCTTCGAGCC CGATGTCGCC CGCCCCGGGT TCGCCTCCTT GGAGGATTTT

351 CTGTACCGCG CTGTTGCGGA AGGTAATTTC GGTGTCTGCA AAGCCGTTTC

401 CCGCCGAGAG CAAACCGTCT TCCGTGATGC GTCCCGCCAG TTTCAGCCCG

451 GCAATGTTCA GGGTCAGTGT TTTGCCTGCA AAGGCGGCAA GTTCCGAGCG

501 GCTGTCCGGG CTTTGCAGAA TCAGGCGGTT GATGATGGGG AGGAGGGCGG

551 ACATATTTTC TGATCGGGGC GGAGAATGCC TGTTGTTGCT GTTGCCGCTT

601 ATTTTACAGG CTTAA
```

This corresponds to the amino acid sequence <SEQ ID 1958; *ORF 613*>:

```
m613.pep
  1 MSRSSRSRRS LRRSTPSRSL LISSRQSARA SLPMFADSDS RENPPICSAM

51 FLPICLMPCP MSAARLPMSA CVPKIRANSS DARERRLPSR DSTAMPRMRS

101 PSSPMSPAPG SPPWRIFCTA LLRKVISVSA KPFPAESKPS SVMRPASFSP

151 AMFRVSVLPA KAASSERLSG LCRIRRLMMG RRADIFSDRG GECLLLLLPL

201 ILQA*
```

Computer analysis of this amino acid sequence gave the following results:
Homology with a Predicted ORF from *N. gonorrhoeae*

```
    m613/g613 94.6% identity in 204 aa overlap 10         20         30         40         50         60
    m613.pep  MSRSSRSRRSLRRSTPSRSLLISSRQSARASLPMFADSDSRENPPICSAMFLPICLMPCP
              ||||| ||||||||||||||||||||||||||||:||||||||||||||||||||||||
    g613      MSRSSLSRRSLRRSTPSRSLLISSRQSARASLPVFADSGSRENPPICSAMFLPICLMPCP
                   10         20         30         40         50         60

70         80         90        100        110        120
    m613.pep  MSAARLPMSACVPKIRANSSDARERRLPSRDSTAMPRMRSPSSPMSPAPGSPPWRIFCTA
              ||:|||| ||||||||||||||||||||||||||||||||| ||||||||||||||| |
    g613      MSVARLPMPACVPKIRANSSDARERRLPSRDSTAMPRMRSPSSLMSPAPGSPPWRIFRIA
                   70         80         90        100        110        120

130        140        150        160        170        180
    m613.pep  LLRKVISVSAKPFPAESKPSSVMRPASFSPAMFRVSVLPAKAASSERLSGLCRIRRLMMG
              ||||||||||||||||||||||||||||||||||||||||:|||||||||||||||||||
    g613      LLRKVISVSAKPFPAESKPSSVMRPASFSPAMFRVSVLPAKEVSSERLSGLCRIRRLMMG
                  130        140        150        160        170        180

190        200
    m613.pep  RRADIFSDRGGECLLLLLPLILQAX
              ||||||||| |||||||||||||||
    g613      RRADIFSDWGGECLLLLLPLILQAX
                  190        200
```

The following partial DNA sequence was identified in *N. meningitidis* <SEQ ID 1959>:

```
a613.seq
  1 ATGTCGCGTT CGAGCCGGTC GAGGCGTTCG TTGAGGCGTT CCACGCCGTC

51 GCGCAGTCTG CTTATTTCGT CGAGGCAGTC GGCAAGGGCT TCGTTGCCGA

101 TGTTTGCGGA CTCGGGTTCG CGGGAAAATC TGCCGATTTG TTCGGCGATG

151 TTCCTGCCGA TTTGTTTGAT GCCGTGTCCG ATGTCGGCGG CACGGCTGCC
```

```
201 GATGTCTGCC TGCGTGCCGA AAATCCGTGC CAATTCGTCC GATGCGCGGG

251 AACGCAGGCT GCCGAGCAGG GACAGTACCG CGATGCCGAG GATGAGGTCG

301 CCTTCGAGCC CGATGTCGCC CGCCCCGGGT TCGCCGCCTT GGAGGATTTT

351 CTGTACCGCG CTGTTGCGGA AGGTGATTTC GGTGTCTGCA AAGCCGTTTC

401 CCGCCGAGAG CAAACCGTCT TCCGTGATGC GTCCCGCCAG TTTCAACCCG

451 GCAATGTTCA GGGTCAGTGT TTTGCCTGCG AAGGCGGCAA GTTCCGAGCG

501 GCTGTCCGGG CTTTGCAGAA TCAGGCGGTT GATGATGGGG AGGAGGGCGG

551 ACATATTTTC TGATCGGGGC GGAGAATGCC TGTTGTTGCT GTTGACGCTT

601 ATTTTACAGG CTTAA
```

This corresponds to the amino acid sequence <SEQ ID 1960; ORF 613.a>:

```
a613.pep
    1 MSRSSRSRRS LRRSTPSRSL LISSRQSARA SLPMFADSGS RENLPICSAM

51 FLPICLMPCP MSAARLPMSA CVPKIRANSS DARERRLPSR DSTAMPRMRS

101 PSSPMSPAPG SPPWRIFCTA LLRKVISVSA KPFPAESKPS SVMPASFNP

151 AMFRVSVLPA KAASSERLSG LCRIRRLMMG RRADIFSDRG GECLLLLLTL

201 ILQA* m613/a613  98.0% identity in 204 aa overlap 10         20         30         40         50         60
m613.pep  MSRSSRSRRSLRRSTPSRSLLISSRQSARASLPMFADSDSRENPPICSAMFLPICLMPCP
          ||||||||||||||||||||||||||||||||||||||| |||| |||||||||||||||
a613      MSRSSRSRRSLRRSTPSRSLLISSRQSARASLPMFADSGSRENLPICSAMFLPICLMPCP
                  10         20         30         40         50         60

70         80         90        100        110        120
m613.pep  MSAARLPMSACVPKIRANSSDARERRLPSRDSTAMPRMRSPSSPMSPAPGSPPWRIFCTA
          ||||||||||||||||||||||||||||||||||||||||||||||||||||||||||||
a613      MSAARLPMSACVPKIRANSSDARERRLPSRDSTAMPRMRSPSSPMSPAPGSPPWRIFCTA
                  70         80         90        100        110        120

130        140        150        160        170        180
m613.pep  LLRKVISVSAKPFPAESKPSSVMRPASFSPAMFRVSVLPAKAASSERLSGLCRIRRLMMG
          ||||||||||||||||||||||||||||||:|||||||||||||||||||||||||||||
a613      LLRKVISVSAKPFPAESKPSSVMRPASFNPAMFRVSVLPAKAASSERLSGLCRIRRLMMG
                 130        140        150        160        170        180

190        200
m613.pep  RRADIFSDRGGECLLLLLPLILQAX
          ||||||||||||||||||| ||||||
a613      RRADIFSDRGGECLLLLLTLILQAX
                 190        200
```

The following partial DNA sequence was identified in *N. gonorrhoeae* <SEQ ID 1961>:

```
g614.seq
    1 AtggcTgcgt tcAacgcttt ggacggcaaa aaagaagaca acgggcaaat 51 cgaaTATTCT CAGTTCATCC GACAGGTCAA CAACGGCGAA GTATCCGGCG

101 TCAACATCGA AGGATCCGTC GTCAGCGGTT ACCTGATTAA AGGCGAGCGC

151 ACCGACAAAA GCACCTTCTT CACCAACGCG CCCTTGGATG ACAACCTGAT

201 TCAAACCCTT TTGAACAAAA ACGTCCGCGT AAAAGTAACG CCGGAAGAAA
```

-continued

```
 251 AACCGAGCGC GCTGACTGCC CTGTTTTACA GCCTGCTGCC CGTCCTGCTG

301 CTGATTGGCG CATGGTTCTA CTTTATGCGT ATGCAGGCGG GCGGCGGCGG

351 AAAAGGCGGC GCATTCTCCT TCGGCAAAAG CCGCGCCCGC CTGCTGGACA

401 AAGATGCCAA CAAAGTTACC TTTGCCGATG TCGCCGGCTG CGACGAAGCC

451 AAAGAAGAAG TGCAGGAAAT CGTCGATTAC CTCAAAGCAC CGAACCGCta 501 tcaAAGcctc ggcggccgtg ttcCGCGCGG CATCCtgCtg gcgGgcagcc 551 CGGGAaccgg taaAACACTC TTGGCGAAAG CCATTGCAGG CGAGGCCGGC

601 GTGCCGTTCT TCAGCATTTC CGGTTCCGAT TTTGTCGAAA TGTTCGTCGG

651 TGTCGGTGCA AGCCGCGTCC GCGATATGTT CGAGCAGGCA AAGAAAAACG

701 CCCCATGCAT TATCTTTATC GACGAGATTG ACGCGGTAGG CCGCCAACGC

751 GGCGCAGgTT TGGGCGGCGG CAATGATGAG CGCGAGCAAA CATTAAACCA

801 ATTATTGGTT GAAATGGACG GTTTTGAGAG CAATCAGACT GTAATTGTGA

851 TTGCGGCAAC CAACCGCCCC GACGTACTCG ATCCTGCGCT GCAACGCCCC

901 GGCCGCTTCG ACCGCCAAGT CGTCGTCCCC CTGCCGGACA TCCGGGGGCG

951 CGAACAGatn ttGAACGTCC ATTCtaaAAA AGTGCctttG gacgaATCTg 1001 tggaTTTATT GTCCCTCGCG CGCGGCACGC ccggttttTTc cggcgcggat 1051 tTggcgaaac tggtcaacga agccccctg tttgccggcc gccgcaacaa 1101 agtgaaagtc gatcaaagcg attTGAAGAC GCCAAAGACA AAATCTATAT

1151 GGGTCCGGAA CGCCGCAGTA TGGTGA
```

This corresponds to the amino acid sequence <SEQ ID 1962; ORF 614.ng>:

```
g614.pep
   1 MAAFNALDGK KEDNGQIEYS QFIRQVNNGE VSGVNIEGSV VSGYLIKGER

51 TDKSTFFTNA PLDDNLIQTL LNKNVRVKVT PEEKPSALTA LFYSLLPVLL

101 LIGAWFYFMR MQAGGGGKGG AFSFGKSRAR LLDKDANKVT FADVAGCDEA

151 KEEVQEIVDY LKAPNRYQSL GGRVPRGILL AGSPGTGKTL LAKAIAGEAG

201 VPFFSISGSD FVEMFVGVGA SRVRDMFEQA KKNAPCIIFI DEIDAVGRQR

251 GAGLGGGNDE REQTLNQLLV EMDGFESNQT VIVIAATNRP DVLDPALQRP

301 GRFDRQVVVP LPDIRGREQX LNVHSKKVPL DESVDLLSLA RGTPGFSGAD

351 LAKLVNEAPL FAGRRNKVKV DQSDLKTPKT KSIWVRNAAV W*
```

The following partial DNA sequence was identified in *N. meningitidis* <SEQ ID 1963>:

```
m614.seq
   1 ATGGCTGCGT TCAACGCTTT AGACGGTAAA AAAGAAGACA ACGGGCAAAT

51 CGAATACTCT CAGTTCATCC AACAGGTCAA CAACGGCGAA GTATCCGGCG

101 TCAACATCGA AGGATCCGTC GTCAGCGGCT ACCTGATTAA GGGCGAGCGC

151 ACCGACAAAA GCACTTTCTT CACCAACGCG CCTTTGGACG ACAACCTAAT

201 TAAAACACTG CTCGACAAAA ACGTCCGCGT AAAAGTAACG CCGGAAGAAA

251 AACCGAGCGC GCTGGCTGCC CTGTTTTACA GCCTGCTGCC CGTCCTGCTG

301 CTGATTGGCG CATGGTTCTA CTTCATGCGT ATGCAGACGG GCGGCGGCGG
```

```
 351 AAAAGGCGGC GCATTCTCAT TCGGTAAAAG CCGCGCCCGC CTGCTGGACA

401 AAGATGCCAA CAAAGTGACC TTTGCCGATG TCGCCGGCTG CGACGAAGCC

451 AAAGAAGAAG TACAGGAAAT CGTCGATTAC CTCAAAGCGC CGAACCGCTA

501 TCAAAGCCTG GCGGGCGCG TGCCGCGCGG CATCCTGCTG GCGGGCAGCC

551 CGGGTACGGG TAAGACGCTT TTGGCGAAAG CGATTGCAGG CGAAGCCGGC

601 GTGCCGTTCT TCAGCATTTC AGGTTCCGAC TTTGTCGAAA TGTTCGTCGG

651 TGTCGGTGCG AGCCGCGTCC GCGATATGTT CGAGCAGGCG AAGAAAAACG

701 CCCCCTGCAT CATCTTTATC GACGAGATTG ACGCAGTCGG CCGCCAACGC

751 GGCGCAGGTT TGGGCGGCGG CAATGATGAG CGCGAGCAAA CATTAAACCA

801 ATTGTTGGTT GAAATGGACG GTTTTGAGAG CAATCAGACT GTAATTGTGA

851 TTGCGGCAAC CAACCGCCCC GACGTACTCG ATCCTGCGCT GCAACGCCCC

901 GGCCGTTTCG ACCGCCAAGT GGTTGTCCCC CTGCCGGACA TCCGAGGGCG

951 CGAACAGATT TTGAACGTCC ATTCTAAAAA AGTGCCTTTG GACGAATCTG

1001 TGGATTTATT GTCCCTCGCG CGCGGCACGC CGGGTTTTTC CGGCGCGGAT

1051 TTGGCGAACT TGGTCAACGA AGCCGCCCTG TTTGCCGGCC GCCGCAATAA

1101 AGTCAAAGTC GATCAGAGCG ATTTGAAGAC GCCAAAGACA AAATCTATAT

1151 GGGTCCGGAA CGCCGCAGTA TGGTGA
```

This corresponds to the amino acid sequence <SEQ ID 1964; ORF 614>:

```
m614.pep
   1 MAAFNALDGK KEDNGQIEYS QFIQQVNNGE VSGVNIEGSV VSGYLIKGER

51 TDKSTFFTNA PLDDNLIKTL LDKNVRVKVT PEEKPSALAA LFYSLLPVLL

101 LIGAWFYFMR MQTGGGGKGG AFSFGKSRAR LLDKDANKVT FADVAGCDEA

151 KEEVQEIVDY LKAPNRYQSL GGRVPRGILL AGSPGTGKTL LAKAIAGEAG

201 VPFFSISGSD FVEMFVGVGA SRVRDMFEQA KKNAPCIIFI DEIDAVGRQR

251 GAGLGGGNDE REQTLNQLLV EMDGFESNQT VIVIAATNRP DVLDPALQRP

301 GRFDRQVVVP LPDIRGREQI LNVHSKKVPL DESVDLLSLA RGTPGFSGAD

351 LANLVNEAAL FAGRRNKVKV DQSDLKTPKT KSIWVRNAAV W*
```

Computer analysis of this amino acid sequence gave the following results:
Homology with a Predicted ORF from *N. gonorrhoeae*

```
    m614/g614  98.0% identity in 391 aa overlap 10        20        30        40        50        60
       m614.pep  MAAFNALDGKKEDNGQIEYSQFIQQVNNGEVSGVNIEGSVVSGYLIKGERTDKSTFFTNA
                 |||||  |||||||||||||||||:|||||||||||||||||||||||||||||||||||
       g614      MAAFNALDGKKEDNGQIEYSQFIRQVNNGEVSGVNIEGSVVSGYLIKGERTDKSTFFTNA
                  10        20        30        40        50        60

70        80        90       100       110       120
       m614.pep  PLDDNLIKTLLDKNVRVKVTPEEKPSALAALFYSLLPVLLLIGAWFYFMRMQTGGGGKGG
                 ||||||||:|||:||||||||||||||:||||||||||||||||||||||||||:||||||
       g614      PLDDNLIQTLLNKNVRVKVTPEEKPSALTALFYSLLPVLLLIGAWFYFMRMQAGGGGKGG
                  70        80        90       100       110       120
```

-continued

```
                 130       140       150       160       170       180
m614.pep  AFSFGKSRARLLDKDANKVTFADVAGCDEAKEEVQEIVDYLKAPNRYQSLGGRVPRGILL
          ||||||||||||||||||||||||||||||||||||||||||||||||||||||||||||
g614      AFSFGKSRARLLDKDANKVTFADVAGCDEAKEEVQEIVDYLKAPNRYQSLGGRVPRGILL
                 130       140       150       160       170       180
                 190       200       210       220       230       240
m614.pep  AGSPGTGKTLIAKAIAGEAGVPFFSISGSDFVEMFVGVGASRVRDMFEQAKKNAPCIIFI
          ||||||||||||||||||||||||||||||||||||||||||||||||||||||||||||
g614      AGSPGTGKTLIAKAIAGEAGVPFFSISGSDFVEMFVGVGASRVRDMFEQAKKNAPCIIFI
                 190       200       210       220       230       240
                 250       260       270       280       290       300
m614.pep  DEIDAVGRQRGAGLGGGNDEREQTLNQLLVEMDGFESNQTVIVIAATNRPDVLDPALQRP
          ||||||||||||||||||||||||||||||||||||||||||||||||||||||||||||
g614      DEIDAVGRQRGAGLGGGNDEREQTLNQLLVEMDGFESNQTVIVIAATNRPDVLDPALQRP
                 250       260       270       280       290       300
                 310       320       330       340       350       360
m614.pep  GRFDRQVVVPLPDIRGREQILNVHSKKVPLDESVDLLSLARGTPGFSGADLANLVNEAAL
          ||||||||||||||||||| ||||||||||||||||||||||||||||||||:||||| |
g614      GRFDRQVVVPLPDIRGREQXLNVHSKKVPLDESVDLLSLARGTPGFSGADLAKLVNEAPL
                 310       320       330       340       350       360
                 370       380       390
m614.pep  FAGRRNKVKVDQSDLKTPKTKSIWVRNAAVWX
          |||||||||||||||||||||||||||||||
g614      FAGRRNKVKVDQSDLKTPKTKSIWVRNAAVWX
                 370       380       390
```

The following partial DNA sequence was identified in *N. meningitidis* <SEQ ID 1965>:

```
a614.seq
     1  ATGGCTGCGT TCAACGCTTT AGACGGTAAA AAAGAAGACA ACGGGCAAAT
    51  CGAATATTCT CAGTTCATCC AACAGGTCAA CAACGGCGAA GTATCCGGCG
   101  TCAACATCGA AGGATCCGTC GTCAGCGGCT ACCTGATTAA GGGCGAGCGC
   151  ACCGACAAAA GCACCTTCTT CACCAACGCG CCTTTGGACG ACAACCTGAT
   201  TAAAACACTG CTCGACAAAA ACGTCCGTGT AAAAGTAACG CCGGAAGAAA
   251  AACCGAGCGC GCTGGCTGCC CTGTTTTACA GCCTGCTGCC CGTCCTGCTG
   301  CTGATTGGCG CGTGGTTCTA CTTTATGCGT ATGCAGACGG GCGGCGGCGG
   351  AAAAGGCGGC GCATTCTCAT TCGGCAAAAG CCGCGCCCGC CTACTGGACA
   401  AAGATGCCAA CAAAGTTACC TTTGCCGATG TCGCCGGCTG CGACGAAGCC
   451  AAAGAAGAAG TGCAGGAAAT CGTCGATTAC CTCAAAGCGC CGAACCGCTA
   501  TCAAAGCCTG GGCGGGCGCG TGCCGCGCGG CATCCTGCTG GCGGGCAGCC
   551  CGGGTACGGG TAAGACGCTT TTGGCGAAAG CGATTGCAGG CGAAGCCGGC
   601  GTGCCGTTCT TCAGCATTTC AGGTTCCGAC TTTGTCGAAA TGTTCGTCGG
   651  TGTCGGTGCA AGCCGCGTCC GCGATATGTT CGAGCAGGCG AAGAAAAACG
   701  CCCCCTGCAT CATCTTTATC GACGAGATTG ACGCAGTCGG CCGCCAACGC
   751  GGCGCAGGTT TGGGCGGCGG TAATGATGAG CGCGAGCAAA CATTAAACCA
   801  ATTGTTGGTT GAAATGGACG GTTTTGAGAG CAATCAGACT GTAATTGTGA
   851  TTGCGGCAAC CAACCGCCCC GACGTACTCG ATCCTGCGCT GCAACGCCCC
   901  GGCCGTTTCG ACCGCCAAGT GGTTGTCCCC CTGCCGGACA TCCGGGGGCG
   951  CGAACAGATT TTGAACGTCC ACTCTAAAAA AGTGCCTTTG GACAAATCTG
```

-continued

```
1001 TGGATTTATT GTCCCTCGCG CGCGGCACGC CGGGTTTTTC CGGCGCGGAT

1051 TTGGCGAACT TGGTCAACGA AGCCGCCCTG TTTGCCGGCC GCCGCAATAA

1101 AGTCAAAGTC GATCAGAGCG ATTTGAAGAC GCCAAAGACA AAATCTATAT

1151 GGGTCCGGAA CGCCGCAGTA TGGTGA
```

This corresponds to the amino acid sequence <SEQ ID 1966; ORF 614.a>:

```
a614.pep

1 MAAFNALDGK KEDNGQIEYS QFIQQVNNGE VSGVNIEGSV VSGYLIKGER

51 TDKSTFFTNA PLDDNLIKTL LDKNVRVKVT PEEKPSALAA LFYSLLPVLL

101 LIGAWFYFMR MQTGGGGKGG AFSFGKSRAR LLDKDANKVT FADVAGCDEA

151 KEEVQEIVDY LKAPNRYQSL GGRVPRGILL AGSPGTGKTL LAKAIAGEAG

201 VPFFSISGSD FVEMFVGVGA SRVRDMFEQA KKNAPCIIFI DEIDAVGRQR

251 GAGLGGGNDE REQTLNQLLV EMDGFESNQT VIVIAATNRP DVLDPALQRP

301 GRFDRQVVVP LPDIRGREQI LNVHSKKVPL DKSVDLLSLA RGTPGFSGAD

351 LANLVNEAAL FAGRRNKVKV DQSDLKTPKT KSIWVRNAAV W* m614/a614 99.7% identity in 391 aa overlap 10         20         30         40         50         60
m614.pep  MAAFNALDGKKEDNGQIEYSQFIQQVNNGEVSGVNIEGSVVSGYLIKGERTDKSTFFTNA
          ||||||||||||||||||||||||||||||||||||||||||||||||||||||||||||
a614      MAAFNALDGKKEDNGQIEYSQFIQQVNNGEVSGVNIEGSVVSGYLIKGERTDKSTFFTNA
                 10         20         30         40         50         60
                 70         80         90        100        110        120
m614.pep  PLDDNLIKTLLDKNVRVKVTPEEKPSALAALFYSLLPVLLLIGAWFYFMRMQTGGGGKGG
          ||||||||||||||||||||||||||||||||||||||||||||||||||||||||||||
a614      PLDDNLIKTLLDKNVRVKVTPEEKPSALAALFYSLLPVLLLIGAWFYFMRMQTGGGGKGG
                 70         80         90        100        110        120
                130        140        150        160        170        180
m614.pep  AFSFGKSRARLLDKDANKVTFADVAGCDEAKEEVQEIVDYLKAPNRYQSLGGRVPRGILL
          ||||||||||||||||||||||||||||||||||||||||||||||||||||||||||||
a614      AFSFGKSRARLLDKDANKVTFADVAGCDEAKEEVQEIVDYLKAPNRYQSLGGRVPRGILL
                130        140        150        160        170        180
                190        200        210        220        230        240
m614.pep  AGSPGTGKTLLAKAIAGEAGVPFFSISGSDFVEMFVGVGASRVRDMFEQAKKNAPCIIFI
          ||||||||||||||||||||||||||||||||||||||||||||||||||||||||||||
a614      AGSPGTGKTLLAKAIAGEAGVPFFSISGSDFVEMFVGVGASRVRDMFEQAKKNAPCIIFI
                190        200        210        220        230        240
                250        260        270        280        290        300
m614.pep  DEIDAVGRQRGAGLGGGNDEREQTLNQLLVEMDGFESNQTVIVIAATNRPDVLDPALQRP
          ||||||||||||||||||||||||||||||||||||||||||||||||||||||||||||
a614      DEIDAVGRQRGAGLGGGNDEREQTLNQLLVEMDGFESNQTVIVIAATNRPDVLDPALQRP
                250        260        270        280        290        300
                310        320        330        340        350        360
m614.pep  GRFDRQVVVPLPDIRGREQILNVHSKKVPLDESVDLLSLARGTPGFSGADLANLVNEAAL
          |||||||||||||||||||||||||||||||:||||||||||||||||||||||||||||
a614      GRFDRQVVVPLPDIRGREQILNVHSKKVPLDKSVDLLSLARGTPGFSGADLANLVNEAAL
                310        320        330        340        350        360
                370        380        390
m614.pep  FAGRRNKVKVDQSDLKTPKTKSIWVRNAAVWX
          |||||||||||||||||||||||||||||||
a614      FAGRRNKVKVDQSDLKTPKTKSIWVRNAAVWX
                370        380        390
```

The following partial DNA sequence was identified in *N. gonorrhoeae* <SEQ ID 1967>:

```
g615.seq
     1 ATGTGGAAAC GGCGGCGGCG CGGTGtcggC AGCTTtgaag agcagcGaAT 51 agatgCCGCC GGCAAACCAC AATGCGGAAa gcaggCtgaa gcGGTTgcgC
```

-continued

```
 101 GGCagcTTca tGCCGCCTCC TcGTCCaGCC ACGtttGgca gattttggac 151 aggcgcAGga ATTTGCcgCc gcgtgcggCA agtatgtcgc gcCAttgtgc 201 cacttcttcg gcggacggTG cttcgtcgaT gctgCATTCG TACagcagga 251 aatcgagggt ttcttcgatg acggGgatgg AttccgTTTG GataAgCTgc 301 ttgagttcgt tcatgactGt TCgGATAcgg aaatcgggaa aatgccgtct 351 gAaagggctt CAGACGGCat tggATTATTT GCTGTGCAGG AAgcgcgttg 401 cctcttccca tttgcCGGAA AtgATGTCGg gtacggcctg cAGGGATttg 451 gCGACGGcat cgtcgatttg ccgGcggtgc ttCcgcgctc ggtttGTTca 501 agacgtagcc gaCGACGagg ttgcggtcGC CGGGGtggcC GATGCCGAGG 551 CGCAGGCGGt aatagtctgC CGTGCCGAGT TTTGCctgAA TGTCTTTCAA 601 GCCGTTGTGT CcgcCGttgc cgcCGCCGAG TTTGAATTTg ATCCGTCCGC

651 AAGGGATGTC GAGTTCGTCG TGGACGACGA GGATTTCTTC GGGTTTGATT

701 TTGTAGAACT GTGCAAGCGC GGCAACCGCC TGTCCGGAAC GGTTCATGAA

751 CGTGGCCGGT TTGAGCAGCC AAACATCGCC GTCGGGCAGG GCGGCGCGGG

801 CAACTTCGCC GAAGAATTTT TTTTCTTCTT TAAACGAAGC CTTCCATTTC

851 CACGCCAGTT CGTCGAGGAA CCAAAAGCCC GCATTGTGGC GGGTCTGTTC

901 GTATTCTTTG CCCGGGTTGC CCAAGCCGAC AACCATTTTG ATTGTGttcg 951 acatgataTT TtccgtgTTT CTgTCGaatg cggtCtgaAG GCTTCAGacg 1001 gcatggTtaT TCTTCTTgaT TTtgaACgcg tgtgcggCGC GCTTCTTTGG

1051 GGTCGATCAA CAGCGGGCGG TACACTTCGA TGCGGTCGCC GTCGCGCAGC

1101 GGCGTGTCGT CTTTGA
```

35

This corresponds to the amino acid sequence <SEQ ID 1968; ORF 615.ng>:

```
g615.pep
   1 MWKRRRRGVG SFEEQRIDAA GKPQCGKQAE AVARQLHAAS SSSHVWQILD

51 RRRNLPPRAA SMSRHCATSS ADGASSMLHS YSRKSRVSSM TGMDSVWISC

101 LSSFMTVRIR KSGKCRLKGL QTALDYLLCR KRVASSHLPE MMSGTACRDL

151 ATASSICRRC FRARFVQDVA DDEVAVAGVA DAEAQAVIVC RAEFCLNVFQ

201 AVVSAVAAAE FEFDPSARDV EFVVDDEDFF GFDFVELCKR GNRLSGTVHE

251 RGRFEQPNIA VGQGGAGNFA EEFFFFFKRS LPFPRQFVEE PKARIVAGLF

301 VFFARVAQAD NHFDCVRHDI FRVSVECGLK ASDGMVILLD FERVCGALLW

351 GRSTAGGTLR CGRRRAAACR L*
```

The following partial DNA sequence was identified in *N. meningitidis* <SEQ ID 1969>:

```
m615.seq Length: 1116
   1 ATGCGGAAAA GGCGGTGGCG CGGTTTCGGC AGCTTTGAAA AGCAGTGAGT

51 AAATGCTGCC TGCAAACCAC AATGCCGAGA GCAGGATAAA GCGGTTGCGT

101 GGCAGATTCA TGCTTGTTCC TCTTCAAGCC ATGTCTGGCA TAGTTTGGAT

151 AGGCGCAGGA ATTTTCCGCC GCGTGCGGCC AGCATATCGC GCCAAACGGC

201 AATTTCTTCG GCGGAGGGGG CATCGTCTAT GCTGCATTCG TAGAGCAGGA
```

```
-continued
 251 AATCGAGGGT TTCTTCGATG ACGGGGATGG ATTCGGTTTG GATAAGCTGC

301 TTGAGTTCGG TCATGACTGT TCGGATATGG AAATCGGGAA CATGCCGTCT

351 GAAAGGGCTT CAGACGGCAT CGGGTCATTT GCTGTGCAGG AAGCGGGTTG

401 CTTCTTCCCA TTTGCCGGCA AGGATGTCGG GTATGGCTTG CAGGGATTTG

451 GCGACGGCAT CGTCAATCTG TCGGCGGTGT .TCCGTACTG GGTTTGTTCA

501 GGACATAGCC GACGACGAGG TTGCGGTCGC CCGGGTGGCC GATGCCGAGG

551 CGCAGGCGGT AATAGTCTGC CGTGCCGAGT TTTGCCTGAA TGTCTTTCAA

601 GCCGTTGTGT CCGCCGTTGC CGCCGCCGAG TTTGAATTTG ATCCGTCCGC

651 AGGGAATGTC GAGTTCGTCG TGGACGACGA GGATTTCTTC GGGTTTGATT

701 TTGTAGAACT GTGCAAGCGC GGCAACTGCC TGTCCGGAAC GGTTCATGAA

751 CGTGGCAGGT TTGAGCAGCC AAACGTCGCC GTCGGGCAGG GCGGCACGGG

801 CGACTTCGCC GAAGAATTTT TTTTCTTCTT TAAATGAAGC CTTCCATTTC

851 CACGCCAGTT CGTCGAGGAA CCAAAAACCC GCATTGTGGC GTGTCTGTTC

901 GTATTCTTTG CCCGGGTTGC CCAAGCCGAC AACCATTTTG ATTGTGTTTG

951 ACATGATATT TTCCGTGTTT CTGTCGAATG CTGTCTGAAG CTTCAGACG

1001 GCATGGTTAT TCTTCTTGAT TTTGAACGCG TTTGCGGCGC GCTTCTTTGG

1051 GGTCGATCAA CAGCGGGCGG TACACTTCGA TGCGGTCGCC GTCGCGCAGC

1101 GGCGTGTCGT CTTTGA
```

This corresponds to the amino acid sequence <SEQ ID 1970; *ORF* 615>:

```
m615.pep Length: 372
   1 MRKRRWRGFG SFEKQXVNAA CKPQCREQDK AVAWQIHACS SSSHVWHSLD

51 RRRNFPPRAA SISRQTAISS AEGASSMLHS XSRKSRVSSM TGMDSVWISC

101 LSSVMTVRIW KSGTCRLKGL QTASGHLLCR KRVASSHLPA RMSGMACRDL

151 ATASSICRRC XRTGFVQDIA DDEVAVARVA DAEAQAVIVC RAEFCLNVFQ

201 AVVSAVAAAE FEFDPSAGNV EFVVDDEDFF GFDFVELCKR GNCLSGTVHE

251 RGRFEQPNVA VGQGGTGDFA EEFFFFFKXS LPFPRQFVEE PKTRIVACLF

301 VFFARVAQAD NHFDCVXHDI FRVSVECCLK ASDGMVILLD FERVCGALLW

351 GRSTAGGTLR CGRRRAAACR L*
```

Computer analysis of this amino acid sequence gave the following results:
Homology with a Predicted ORF from *N. gonorrhoeae*

```
    m615/g615 86.8% identity in 371 aa overlap 10         20         30         40         50         60
    m615.pep MRKRRWRGFGSFEKQXVNAACKPQCREQDKAVAWQIHACSSSSHVWHSLDRRRNFPPRAA
            | ||| ||  ||||:|  ::||  ||| :|  :||| |:|| ||||||: ||||||:||||
    g615    MWKRRRRGVGSFEEQRIDAAGKPQCGKQAEAVARQLHAASSSHVWQILDRRRNLPPRAA
                 10         20         30         40         50         60

70         80         90        100        110        120
    m615.pep SISRQTAISSAEGASSMLHSXSRKSRVSSMTGMDSVWISCLSSVMTVRIWKSGTCRLXGL
            |:||: | |||:||||||||| ||||||||||||||||||||| ||||||:|||:||||
    g615    SMSRHCATSSADGASSMLHSYSRKSRVSSMTGMDSVWISCLSSFMTVRIRKSGKCRLKGL
                 70         80         90        100        110        120

130        140        150        160        170        180
    m615.pep QTASGHLLCRKRVASSHLPARMSGMACRDLATASSICRRCXRTGFVQDIADDEVAVARVA
            |||  :|||||||||||||| :|||:|||||||||||||||| :  ||||:||||||  ||
    g615    QTALDYLLCRKRVASSHLPEMMSGTACRDLATASSICRRCFRARFVQDVADDEVAVGVA
                130        140        150        160        170        180
```

-continued

```
                190        200        210        220        230        240
m615.pep   DAEAQAVIVCRAEFCLNVFQAVVSAVAAAEFEFDPSAGNVEFVVDDEDFFGFDFVELCKR
           |||||||||||||||||||||||||||||||||||| :|||||||||||||||||||||
g615       DAEAQAVIVCRAEFCLNVFQAVVSAVAAAEFEFDPSARDVEFVVDDEDFFGFDFVELCKR
                190        200        210        220        230        240

250        260        270        280        290        300
m615.pep   GNCLSGTVHERGRFEQPNVAVGQGGTGDFAEEFFFFFKXSLPFPRQFVEEPKTRIVACLF
           || |||||||||||||||:|||||:|:|||||||||| ||||||||||||:|||| ||
g615       GNRLSGTVHERGRFEQPNIAVGQGGAGNFAEEFFFFFKRSLPFPRQFVEEPKARIVAGLF
                250        260        270        280        290        300

310        320        330        340        350        360
m615.pep   VFFARVAQADNHFDCVXHDIFRVSVECCLKASDGMVILLDFERVCGALLWGRSTAGGTLR
           |||||||||||||||| |||||||||| ||||||||||||||||||||||||||||||||
g615       VFFARVAQADNHFDCVRHDIFRVSVECGLKASDGMVILLDFERVCGALLWGRSTAGGTLR
                310        320        330        340        350        360

370
m615.pep   CGRRRAAACRLX
           ||||||||||||
g615       CGRRRAAACRLX
                370
```

The following partial DNA sequence was identified in *N. meningitidis* <SEQ ID 1971>:

```
a615.seq
   1 ATGCGGAAAC GGCGGCGGCG CGGTGTCGGC AGCTTTGAAG AGCAGCGAAT

51 AGATGCCGCC GGCAAACCAC AATGCGGAAA GCAGGCTGAA GCGGTTGCGC

101 GGCAGCTTCA TGCCGCCTCC TCGTCCAGCC ACGTTTGGCA GATTTTGGAC

151 AGGCGCAGGA ATTTGCCGCC GCGTGCGGCA AGTATGTCGC GCCATTGTGC

201 CACTTCTTCG GCGGATGGTG CGTCGTCGAT GCTGCATTCG TACAGCAGGA

251 AATCGAGGGT TTCTTCGATG ACGGGGATGG ATTCGGTTTG GATAAGCTGC

301 TTGAGTTCGG TCATGACTGT TCGGATATGG AAATCGGGAA CATGCCGTCT

351 GAAAGGGCTT CAGACGGCAT CGGGTCATTT GCTGTGCAGG AAGCGGGTTG

401 CCTCTTCACA TTTGCCGGCA AGGATGTCGG GTATGGCTTG CAGGGATTTG

451 GCGACGGCAT CGTCAATCTG TCGGCGGTG. TTCCGTACTG GGTTTGTTCA

501 GGACATAGCC GACGACGAGG TTGCGGTCGC CCGGGTGGCC GATGCCGAGG

551 CGCAGGCGGT AATAGTCTGC CGTGCCGAGT TTTGCCTGAA TGTCTTTCAA

601 GCCGTTGTGT CCACCGTTGC CGCCGCCGAG TTTGAATTTG ATCCGTCCGC

651 AGGGAATGTC GAGTTCGTCG TGGACGACGA GGATTTCTTC GGGTTTGATT

701 TTATAAAACT GCGCAAGGGC GGCAACTGCC TGTCCGGAAC GGTTCATGAA

751 CGTGGTCGGC TTGAGCAGCC AGACATCGCC GTCGGGCAGG GTAGCACGGG

801 CGACTTCGCC GAAGAATTTT TTTTCTTCTT TAAATGAAGC CTTCCATTTC

851 CACGCCAGTT CGTCGAGGAA CCAAAAACCC GCATTGTGGC GTGTCTGTTC

901 GTATTCTTTG CCCGGGTTGC CCAAGCCGAC AACCATTTTG ATTGTGTTTG

951 ACATGATATT TTCCGTGTTT CTGCCGAATG CCGTCTGAAG GCTTCAGACG

1001 GCATGGTTAT TCTTCTTGAT TTTGAACGCG TTTGCGGCGC GCTTCTTTGG

1051 GGTCGATCAA CAGCGGGCGG TACACTTCGA TGCGGTCGCC GTCGCGCAGC

1101 GGCGTGTCGT CTTTGA
```

This corresponds to the amino acid sequence <SEQ ID 1972; ORF 615.a>:

```
a614.pep

1 MRKRRRRGVG SFEEQRIDAA GKPQCGKQAE AVARQLHAAS SSSHVWQILD

51 RRRNLPPRAA SMSRHCATSS ADGASSMLHS YSRKSRVSSM TGMDSVWIGC

101 LSSVMTVRIW KSGTCRLKGL QTASGHLLCR KRVASSHLPA RMSGMACRDL

151 ATAGGICRRX FRTGFVQDIA DDEVAVARVA DAEAQAVIVC RAEFCLNVFQ

201 AVVSTVAAAE FEFDPSAGNV EFVVDDEDFF GFDFIKLRKG GNCLSGTVHE

251 RGRLEQPDIA VGQGSTGDFA EEFFFFFK*S LPFPRQFVEE PKTRIVACLF

301 VFFARVAQAD NHFDCV*HDI FRVSAECRLK ASDGMVILLD FERVCGALLW

351 GRSTAGGTLR CGRRRAAACR L* m615/a615  90.3% identity in 371 aa overlap
                  10         20         30         40         50         60
m615.pep  MRKRRWRGFGSFEKQXVNAACKPQCREQDKAVAWQIHACSSSSHVWHSLDRRRNFPPRAA
          ||||| || ||||:| :::|| |||| :| :||| |:|| ||||||: |||||:|||||
a615      MRKRRRGVGSFEEQRIDAAGKPQCGKQAEAVARQLHAASSSSHVWQILDRRRNLPPRAA
                  10         20         30         40         50         60
                  70         80         90        100        110        120
m615.pep  SISRQTAISSAEGASSMLHSXSRKSRVSSMTGMDSVWISCLSSVMTVRIWKSGTCRLKGL
          |:||: |  |||:||||||| ||||||||||||||||| |||||||||||||||||||||
a615      SMSRHCATSSADGASSMLHSYSRKSRVSSMTGMDSVWISCLSSVMTVRIWKSGTCRLKGL
                  70         80         90        100        110        120
                 130        140        150        160        170        180
m615.pep  QTASGHLLCRKRVASSHLPARMSGMACRDLATASSICRRCXRTGFVQDIADDEVAVARVA
          ||||||||||||||||||||||||||||||||||||| |||||||||||||||||||||
a615      QTASGHLLCRKRVASSHLPARMSGMACRDLATASSICRRXFRTGFVQDIADDEVAVARVA
                 130        140        150        160        170        180
                 190        200        210        220        230        240
m615.pep  DAEAQAVIVCRAEFCLNVFQAVVSAVAAAEFEFDPSAGNVEFVVDDEDFFGFDFVELCKR
          ||||||||||||||||||||||||:|||||||||||||||||||||||||||||::| |
a615      DAEAQAVIVCRAEFCLNVFQAVVSTVAAAEFEFDPSAGNVEFVVDDEDFFGFDFIKLRKG
                 190        200        210        220        230        240
                 250        260        270        280        290        300
m615.pep  GNCLSGTVHERGRFEQPNVAVGQGGTGDFAEEFFFFFKXSLPFPRQFVEEPKTRIVACLF
          ||||||||||||:|||::|||||||||||||||||||||||||||||||||||||||||
a615      GNCLSGTVHERGRLEQPDIAVGQGSTGDFAEEFFFFFKXSLPFPRQFVEEPKTRIVACLF
                 250        260        270        280        290        300
                 310        320        330        340        350        360
m615.pep  VFFARVAQADNHFDCVXHDIFRVSVECCLKASDGMVILLDFERVCGALLWGRSTAGGTLR
          ||||||||||||||||||||||||:|||||||||||||||||||||||||||||||||||
a615      VFFARVAQADNHFDCVXHDIFRVSAECRLKASDGMVILLDFERVCGALLWGRSTAGGTLR
                 310        320        330        340        350        360
                 370
m615.pep  CGRRRAAACRLX
          ||||||||||||
a615      CGRRRAAACRLX
                 370
```

The following partial DNA sequence was identified in *N. gonorrhoeae* <SEQ ID 1973>:

```
g616.seq
    1 atgtcgaaCA CAATCAAAAT GGTTGTCGGC TTGGGCAACC CGGGCAAAGA

51 ATACGAACAG ACCCGCCACA ATGCGGGCTT TTGGTTCCTC GACGAACTGG

101 CGTGGAAATG GAAGGCTTCG TTTAAAGAAG AAAAAAAATT CTTCGGCGAA

151 GTTGCCCGCG CCGCCCTGCC CGACGGCGAT GTTTGGCTGC TCAAACCGGC

201 CACGTTCATG AACCGTTCCG GACAGGCGGT TGCCGCGCTT GCACAGTTCT

251 ACAAAATCAA ACCCGAAGAA ATCCTCGTCG TCCACGACGA ACTCGACATC

301 CCTTGCGGAC GGATcAAATT CAAACTCGGC GgcggcaaCG gcgGACACAA

351 CGGCTTGAAA GACATTcagG CAAAACTCGG CACGGcagac tattaCCGCC
```

-continued

```
 401 TGCGCCTCGG CATCGgccaC CCCGGCgacc gcaacctCGT CGtcggctac 451 gtcttgAACa aaccgagcgc gGaagcaccg Ccggcaaatc gacgatgCCG 501 TCGccaaATC CCTgcaggcc gtaccCGACA TcaTTTCCGg caaatgggaa 551 gaggcaacgc gcTTCCTGCA CAGCAAATAA TccaatGCCG TCTGaagccc 601 ttTcagacgg cattttcccg atttccgTAT CcGAaCagtc atgaacgaac 651 tcaagcAGcT tatCCAAAcg gaaTccatcC ccgtcatcga agaaaccctc 701 gatttcctgc tGTACGAATG cagcAtcgac gaagCAccgt ccgccgaaga 751 agtggcacaa TGgcgcgaca tactTGccgc acgcgGcgGC AAATtcCTgc 801 gcctgtccaa aatctgcCaa aCGTGGCtGG ACgAGGAGGC GGCatgAAgc 851 tGCCGcgcAA CCgcttcaGc ctgctTTCCG CATTGTGGTT TGCCGGCGGc 901 atctATtCgc tgctcttcaA AGCTGccgaC ACCGCGCCGC CGCCGTTTCC 951 ACATTtcgaC AAAGCAGCAC ACCTTGCCCT GTTTTTCGCA CAaatCTTgt 1001 tTctGGCCAA AGCATTCAAA ACCGGAAAAC TTCCCATCCC CTACCGCAGC

1051 CTGATTGCGT TCGCCTTCTG TTTTGCCGTC GGCAGCGAAT GCGCGCAGGC

1101 ATGGTTTACC GCAACGCGAA CCGGCAGTTT GGGCGATGTC CTTGCCgACC

1151 TGACGGGCGC AGCCCTTGCC CTCTTTGCCG CGCGTTCTGC CTGCCGcccg 1201 gactaa
```

This corresponds to the amino acid sequence <SEQ ID 1974; *ORF* 616.ng>:

```
g616.pep
  1 MSNTIKMVVG LGNPGKEYEQ TRHNAGFWFL DELAWKWKAS FKEEKKFFGE

51 VARAALPDGD VWLLKPATFM NRSGQAVAAL AQFYKIKPEE ILVVHDELDI

101 PCGRIKFKLG GGNGGHNGLK DIQAKLGTAD YYRLRLGIGH PGDRNLVVGY

151 VLNKPSAEAP PANRRCRRQI PAGRTRHHFR QMGRGNALPA QQIIQCRLKP

201 FQTAFSRFPY PNSHERTQAA YPNGIHPRHR RNPRFPAVRM QHRRSTVRRR

251 SGTMARHTCR TRRQIPAPVQ NLPNVAGRGG GMKLPRNRFS LLSALWFAGG

301 IYSLLFKAAD TAPPPFPHFD KAAHLALFFA QILFLAKAFK TGKLPIPYRS

351 LIAFAFCFAV GSECAQAWFT ATRTGSLGDV LADLTGAALA LFAARSACRP

401 D*
```

The following partial DNA sequence was identified in *N. meningitidis* <SEQ ID 1975>:

```
m616.seq
   1 ATGTCAAACA CAATCAAAAT GGTTGTCGGC TTGGGCAACC CGGGCAAAGA

51 ATACGAACAG ACACGCCACA ATGCGGGTTT TTGGTTCCTC GACGAACTGG

101 CGTGGAAATG GAAGGCTTCA TTTAAAGAAG AAAAAAAATT CTTCGGCGAA

151 GTCGCCCGTG CCGCCCTGCC CGACGGCGAC GTTTGGCTGC TCAAACCTGC

201 CACGTTCATG AACCGTTCCG GACAGGCAGT TGCCGCGCTT GCACAGTTCT

251 ACAAAATCAA ACCCGAAGAA ATCCTCGTCG TCCACGACGA ACTCGACATT

301 CCCTGCGGAC GGATCAAATT CAAACTCGGC GGCGGCAACG GCGGACACAA

351 CGGCTTGAAA GACATTCAGG CAAAACTCGG CACGGCAGAC TATTACCGCC
```

-continued

```
 401 TGCGCCTCGG CATCGGCCAC CCGGGCGACC GCAACCTCGT CGTCGGCTAT

451 GTCCTGAACA AACCCAGTAC GGAACA.CCG CCGACAGATT GACGATGCCG

501 TCGCCAAATC CCTGCAAGCC ATACCCGACA TCCTTGCCGG CAAATGGGAA

551 GAAGCAACCC GCTTCCTGCA CAGCAAATGA CCCGATGCCG TCTGAAGCCC

601 TTTCAGACGG CATGTTCCCG ATTTCCATAT CCGAACAGTC ATGACCGAAC

651 TCAAGCAGCT TATCCAAACC GAATCCATCC CCGTCATCGA AGAAACCCTC

701 GATTTCCTGC TCTACGAATG CAGCATAGAC GATGCCCCCT CCGCCGAAGA

751 AATTGCCGTT TGGCGCGATA TGCTGGCCGC ACGCGGCGGA AAATTCCTGC

801 GCCTATCCAA ACTATGCCAG ACATGGCTTG AAGAGGAACA AGCATGAATC

851 TGCCACGCAA CCGCTTTATC CTGCTCTCGG CATTGTGGTT TGCAGGCAGC

901 ATTTACTCAC TGCTTTTCAA AGCTGCCGAA ACCGCGCCAC CGCCTTTTCC

951 GCATTTTGAC AAAGTGGCGC ACCTCGCCCT GTTTTTCGCA CAAATCTGGC

1001 TTCTGACCAA AGCATTCAGA ACCGACAACC GCCCCATCCC CTATCGCAGC

1051 CTGATGGTCT TTGCCCTCTG TTTCGCCCTC TTCAGCGAAT GCGCGCAGGC

1101 ATGGTTTACC GCAACGAGAA CCGGCAGTTT GGGCGATGTC CTTGCCGACC

1151 TGACGGGCGC AGCCCTTGCC CTCTTTACCG CGCGAGCTGC CTGCCGCCCG

1201 GACTAA
```

This corresponds to the amino acid sequence <SEQ ID 1976; *ORF* 616>:

```
a616.pep

1 MSNTIKMVVG LGNPGKEYEQ TRHNAGFWFL DELAWKWKAS FKEEKKFFGE

51 VARAALPDGD VWLLKPATFM NRSGQAVAAL AQFYKIKPEE ILVVHDELDI

101 PCGRIKFKLG GGNGGHNGLK DIQAKLGTAD VYRLRLGIGH PGDRNLVVGY

151 VLNKPSTEXP PTDXRCRRQI PASHTRHPCR QMGRSNPLPA QQMTRCRLKP

201 FQTACSRFPY PNSHDRTQAA YPNRIHPRHR RNPRFPALRM QHRRCPLRRR

251 NCRLARYAGR TRRKIPAPIQ TMPDMAXRGT SMNLPRNRFI LLSALWFAGS

301 IYSLLFKAAE TAPPPFPHFD KVAHLALFFA QIWLLTKAFR TCNRPIPYRS

351 LMVFALCFAL FSECAQAWFT ATRTGGLGDV LACLTGAALA LFTARAACRP

401 D* m616/g616 86.0% identity in 401 aa overlap
                 10         20         30         40         50         60
m616.pep MSNTIKMVVGLGNPGKEYEQTRHNAGFWFLDELAWKWKASFKEEKKFFGEVARAALPDGD
         ||||||||||||||||||||||||||||||||||||||||||||||||||||||||||||
g616     MSNTIKMVVGLGNPGKEYEQTRHNAGFWFLDELAWKWKASFKEEKKFFGEVARAALPDGD
                 10         20         30         40         50         60
                 70         80         90        100        110        120
m616.pep VWLLKPATFMNRSGQAVAALAQFYKIKPEEILVVHDELDIPCGRIKFKLGGGNGGHNGLK
         ||||||||||||||||||||||||||||||||||||||||||||||||||||||||||||
g616     VWLLKPATFMNRSGQAVAALAQFYKIKPEEILVVHDELDIPCGRIKFKLGGGNGGHNGLK
                 70         80         90        100        110        120
                130        140        150        160        170        180
m616.pep DIQAKLGTADYYRLRLGIHPGDRNLVVGYVLNKPSTEXPPTDXRCRRQIPASHTRHPCR
         |||||||||||||||||||||||||||||||||||||:| ||::  |||||||||::||| |
g616     DIQAKLGTADYYRLRLGIHPGDRNLVVGYVLNKPSAEAPPANRRCRRQIPAGRTRHHFR
                130        140        150        160        170        180
                190        200        210        220        230        240
m616.pep QMGRSNPLPAQQMTRCRLKPFQTACSRFPYPNSHDRTQAAYPNRIHPRHRRNPRFPALRM
         ||||:| |||||: :|||||||||||||||||||:|||||||||| ||||||||||||:||
g616     QMGRGNALPAQQIIQCRLKPFQTAFSRFPYPNSHERTQAAYPNGIHPRHRRNPRFPAVRM
                190        200        210        220        230        240
```

-continued

```
              250        260        270        280        290        300
m616.pep  QHRRCPLRRRNCRLARYAGRTRRKIPAPIQTMPDMAXRGTSMNLPRNRFILLSALWFAGS
          ||||  :|||:  :||::  ||||:||||||:|::|::|  ||  :|:|||||  ||||||||||:
g616      QHRRSTVRRRSGTMARHTCRTRRQIPAPVQNLPNVAGRGGGMKLPRNRFSLLSALWFAGG
              250        260        270        280        290        300

310        320        330        340        350        360
m616.pep  IYSLLFKAAETAPPPPPHFDKVAHLALFFAQIWLLTKAFRTDNRPIPYRSLMVFALCFAL
          ||||||||||:||||||||||||||:||||||||||  :|:|||:|  :  ||||||::|:|||
g616      IYSLLFKAADTAPPPPPHFDKAAHLALFFAQILFLAKAFKTGKLPIPYRSLIAFAFCFAV
              310        320        330        340        350        360

370        380        390        400
m616.pep  FSECAQAWFTATRTGSLGDVLADLTGAALALFTARAACRPDX
          ||||||||||||||||||||||||||||||||:||:||||||
g616      GSECAQAWFTATRTGSLGDVLADLTGAALALFAARSACRPDX
              370        380        390        400
```

15

The following partial DNA sequence was identified in *N. meningitidis* <SEQ ID 1977>:

```
a616.seq
   1 ATGTCAAACA CAATCAAAAT GGTTGTCGGC TTGGGCAACC CGGGCAAAGA

51 ATACGAACAG ACACGCCACA ATGCGGGTTT TTGGTTCCTC GACGAACTGG

101 CGTGGAAATG GAAGGCTTCA TTTAAAGAAG AAAAAAAATT CTTCGGCGAA

151 GTCGCCCGTG CTACCCTGCC CGACGGCGAT GTCTGGCTGC TCAAGCCGAC

201 CACGTTCATG AACCGTTCCG GACAGGCAGT TGCCGCCCTT GCGCAGTTTT

251 ATAAAATCAA ACCCGAAGAA ATCCTCGTCG TCCACGACGA ACTCGACATT

301 CCCTGCGGAC GGATCAAATT CAAACTCGGC GGCGGCAACG GTGGACACAA

351 CGGCTTGAAA GACATTCAGG CAAAACTCGG CACGGCAGAC TATTACCGCC

401 TGCGCCTCGG CATCGGCCAC CCGGGCGACC GCAACCTCGT CGTCGGCTAT

451 GTCCTGAACA AACCCAGTAC GGAA.CACCG CCGACAGATT GACGATGCCG

501 TCGCCAAATC CCTGCAAGCC ATACCCGACA TCCTTGCCGG CAAATGTGAA

551 GAGGCAACCC GCTTCCTGCA CAGCAAATGA CCCGATGCCG TCTGAAGCCC

601 TTTCAGACGG CATGTTCCCG ATTTCCATAT CCGAACAGTC ATGACCGAAC

651 TCAAGCAGCT TATCCAAACC GAATCCATCC CCGTCATCGA AGAAACCCTC

701 GATTTCCTGC TGTACGAATG CAGCATCGAC GACGCACCAT CCGCCGAAGA

751 AGTGGCACAA TGGCGCGACA TACTTGCCGC ACGCGGCGGC AAATTCCTGC

801 GCCTGTCCAA AATCTGCCAA ACGTGGCTGG ACGAGGAGGC GGCATGAAGC

851 TGCCGCGCAA CCGCTTCAGC CTGCTTTCCG CATTGTGGTT TGCCGGCGGC

901 ATCTATTCGC TGCTCTTCAA AGCTGCCGAC ACCGCGCCGC CGCCGTTTCC

951 GCATTTCGAC AAAGCAGCAC ACCTTGCCCT GTTTTTCGCA CAAATCTGGC

1001 TTTTGACCAA AGCATTCAAA ACCGGAAAAC TTCCCATCCC CTACCGCAGC

1051 CTGATGGTCT TTGCCCTCTG TTTCGCCCTC TTCAGCGAAT GCGCGCAGGC

1101 ATGATTTACC GCAACGAGAA CCGGCAGTTT GGGCGATGTT CTTGCCGATA

1151 TGGCAGGTAC GGTTCTCGCA CTCTTTGCCG CCCGCGCCGC CGACCGCCCG

1201 GACTGA
```

This corresponds to the amino acid sequence <SEQ ID 1978; ORF 616.a>:

```
a616.pep

1 MSNTIKMVVG LGNPGKEYEQ TRHNAGFWFL DELAWKWKAS FKEEKKFFGE

51 VARATLPDGD VWLLKPTTFM NRSGQAVAAL AQFYKIKPEE ILVVHDELDI

101 PCGRIKFKLG GGNGGHNGLK DIQAKLGTAD YYRLRLGIFH PGDRNLVVGY

151 VLNKPSTEXP PTD*RCRRQI PASHTRHPCR QM*RGNPLPA QQMTRCRLKP

201 FQTACSRFPY PNSHDRTQAA YPNRIHPRHR RNPRFPAVRM QHRRRTIRRR

251 SGTMARHTCR TRRQIPAPVQ NLPNVAGRGG GMKLPNRNFS LLSALWFAGG

301 IYSLLFKAAD TAPPPFPHFD KAAHLALFFA QIWLLTKARK TGKLPIPYRS

351 LMVFALCFAL FSECAQA*FT ATRTGSLGDV LADMAGTVLA LFAARAADRP

401 D* m616/a616  90.0% identity in 401 aa overlap 10         20         30         40         50         60
m616.pep  MSNTIKMVVGLGNPGKEYEQTRHNAGFWFLDELAWKWKASFKEEKKFFGEVARAALPDGD
          ||||||||||||||||||||||||||||||||||||||||||||||||||:|||||
a616      MSNTIKMVVGLGNPGKEYEQTRHNAGFWFLDELAWKWKASFKEEKKFFGEVARATLPDGD
                  10         20         30         40         50         60

70         80         90        100        110        120
m616.pep  VWLLKPATFMNRSGQAVVALAQFYKIKPEEILVVHDELDIPCGRIKFKLGGGNGGHNGLK
          ||||||:|||||||||||:|||||||||||||||||||||||||||:|||||||||||
a616      VWLLKPTTFMNRSGQAVAALAQFYKIKPEEILVVHDELDIPCGRIKFDLGGGNGGHNGLK
                  70         80         90        100        110        120

130        140        150        160        170        180
m616.pep  DIQAKLGTADYYRLRLGIHPGDRNLVVGYVLNKPSTEXPPTDXRCRRQIPASHTRHPCR
          |||||||||||||||||||||||||||||||||||||||||||||||||||||||||||
a616      DIQAKLGTADYYRLRLGIHPGDRNLVVGYVLNKPSTEXPPTDXRCRRQIPASHTRHPCR
                 130        140        150        160        170        180

190        200        210        220        230        240
m616.pep  QMGRSNPLPAQQMTRCRLKPFQTACSRFPYPNSHDRTQAAYPNRIHPRHRRNPRFPALRM
          || :||||||||||||||||||||||||||||||||||||||||||||||||||||:||
a616      QMXRGNPLPAQQMTRCRLKPFQTACSRFPYPNSHDRTQAAYPNRIHPRHRRNPRFPAVRM
                 190        200        210        220        230        240

250        260        270        280        290        300
m616.pep  QHRRCPLRRRNCRLARYAGRTRRKIPAPIQTMPDMAXRGTSMNLPRNRFILLSALWFAGS
          ||||  :|||:  :||::  ||||:||||:|::|::|  || :|: ||||||  ||||||:
a616      QHRRRTIRRRSGTMARHTCRTRRQIPAPVQNLPNVAGRGGGMKLPRNRFSLLSALWFAGG
                 250        260        270        280        290        300

310        320        330        340        350        360
m616.pep  IYSLLFKAAETAPPPFPHFDKVAHLALFFAQIWLLTKAFRTDNRPIPYRSLMVFALCFAL
          |||||||||:|||||||||||:|||||||||||||||||:|  : ||||||||||||||
a616      IYSLLFKAADTAPPPFPHFDKAAHLALFFAQIWLLTKAFKTGKLPIPYRSLMVFALCFAL
                 310        320        330        340        350        360

370        380        390        400
m616.pep  FSECAQAWFTATRTGSLGDVLADLTGAALALFTARAACRPDX
          ||||||| |||||||||||||||:::|::||||:||||||||
a616      FSECAQAXFTATRTGSLGDVLADMAGTVLALFAARAADRPDX
                 370        380        390        400
```

The following partial DNA sequence was identified in N. gonorrhoeae <SEQ ID 1979>:

```
g619.seq
    1 ATGCCGTCTG AAAAAAATAT CGGTTTTATG GCAGGAAGCA GCCGTCCGTT

51 GCGGGTCGCC TTTGCGCTGT TGCTGGTTTC CTGCATCCTG TTTATGACGC

101 TCAACGTCAA AGGAGATTGG GACTTTGTCT TGCACCTGCG CCTGACCAAG

151 CTTGCCGCGC TGCTGATGGT CGCCTATGCG GTCGGCGTGT CCACTCAACT

201 CTTCCAAACG CTGACCAACA ACCCGATTCT GACCCCTTCG ATTTTGGGTT

251 TCGATTCGCT GTATGTGTTT TTGCAGACCT TGCTGgtGTT TACGTcGGC

301 GGCGTGGGCT ATAcatccct gccgttgacg gGCAAATTCG GCTTTGAACT
```

-continued

```
351 GGTTGTTATG ATGGGCGGCT CGCTGCTGCT GTTTTACACG CTCATCCGTC

401 AGGGCGGGCG CGATTTGCCG CACATGATTT TAATCGGCGT GATTTTCGGG

451 ATTTTGTTCC GCAGCCTTTC CTCGCTGCTT TCGCGCATGA TAGACCCCGA

501 AGAATTTACC GCCGCGCAGG CGAATATGTT TGCCGGATTC AATACCGTCC

551 GCAGCGAGCT TTTAGGCATA GGCGCGCTGG TCCTGCTCGT CAGCGCGGCG

601 GTCGTTTGGC ACGAACGCTA CCGCTCGGAC GTACACCTTT TGGGGCGCGA

651 CCAAGCCGTC AATTTGGGCA TCAGCTACAC GCGCAACACC TTATGGATAC

701 TGCTTTGGAT TGCCGCATTG GTGGCGACGG CGACCGCCGT TGTCGGCCCG

751 GTGAGCTTTT TCGGGCTTCT CGCCGCCTCG CTTGCCAACC ACTTTTCCCc 801 gtCCGTGCGC CATTCCGTCC GCCTGCCgat gacggtttGC gtcgGcggCA 851 TCCTCTTGgt cggCggacaA ACCGTATTCG AACACTTCTT GGGCATGAag 901 gCggTATTAA GCGTGGTGGt cgAATTTGCG ggcggactcG TTTTCCTCTA

951 TCTCGTTTTA AAACACAAAA AATGA
```

This corresponds to the amino acid sequence <SEQ ID 1980; ORF 619.a>:

```
g619.pep
  1 MPSEKNIGFM AGSSRPLRVA FALLLVSCIL FMTLNVKGDW DFVLHLRLTK

51 LAALLMVAYA VGVSTQLFQT LTNNPILTPS ILGFDSLYVF LQTLLVFTFG

101 GVGYTSLPLT GKFGFELVVM MGGSLLLFYT LIRQGGRDLP HMILIGVIFG

151 ILFRSLSSLL SRMIDPEEFT AAQANMFAGF NTVRSELLGI GALVLLVSAA

201 VVWHERYRSD VHLLGRDQAV NLGISYTRNT LWILLWIAAL VATATAVVGP

251 VSFFGLLAAS LANHFSPSVR HSVRLPMTVC VGGILLVGGQ TVFEHFLGMK

301 AVLSVVVEFA GGLVFLYLVL KHKK*
```

The following partial DNA sequence was identified in *N. meningitidis* <SEQ ID 1981>:

```
m619.seq
  1 ATGCCGTCTG AAAAAAATAT CGGTTTTATG GCAGGAAGCA GCCGCCCGTT

51 GTGGGTCGCC TTTGCGCTGT TGCTGGTTTC TGCGTCCTG TTTATGACGC

101 TCAACGTCAA AGGCGATTGG GATTTTGTTT TGCAACTGCG GCTGACCAAA

151 CTTGCCGCGC TGCTGATGGT CGCCTATGCG GTCGGCGTGT CCACGCAACT

201 CTTCCAAACG CTGACCAATA ATCCGATTCT GACCCCTTCA ATTTTGGGTT

251 TCGATTCGCT GTATGTGTTT TTGCAGACCT TGCTGGTGTT TACGTTCGGC

301 GGCGTGGGCT ATGCTTCCCT GCCGTTGACG GGCAAATTCG GCTTTGAACT

351 GGTCGTCATG ATGGGCGGCT CGCTGCTGCT GTTCTACACG CTCATCAAAC

401 AGGGCGGACG CGATTTGTCG CGCATGATTT TAATCGGCGT GATTTTCGGG

451 ATTTTGTTCC GCAGCCTGTC GTCGCTGCTT TCGCGCATGA TCGATCCCGA

501 AGAATTTACC GCCGCGCAGG CGAATATGTT TGCCGGATTC AATACCGTCC

551 ACAGCGAGCT TTTGGGCATA GGCGCGCTGA TTCTGCTCGT CAGCGCGGCG

601 GTCGTTTGGC GCGAACGCTA CCGCTTGGAC GTTTACCTTT TGGGGCGTGA

651 CCAAGCCGTC AATTTGGGCA TCAGCTACAC GCGCAACACC TTATGGATAC
```

```
-continued
701 TGCTTTGGAT TGCCGCATTG GTGGCGACGG CGACCGCCGT GGTCGGCCCC

751 GTAAGCTTTT TCGGGCTTCT CGCCGCCTCG CTTGCCAACC ACTTTTCCCC

801 GTCGGTCAAA CATTCCGTCC GCCTGCCGAT GACGGTTTGT ATCGGCGGCA

851 TCCTCTTGGT CGGCGGACAG ACCGTGTTCG AACACCTGCT CGGTATGCAG

901 GCAGTGTTGA GCGTAGTAGT AGAATTTGCC GGCGGACTCG TTTTCCTCTA

951 TCTCGTTTTA AAACACAAAA AATGA
```

This corresponds to the amino acid sequence <SEQ ID 1982; ORF 619>:

```
m619.pep

1 MPSEKNIGFM AGSSRPLWVA FALLLVSCVL FMTLNVKGDW DRVLQLRLTK

51 LAALLMVAYA VGVSTQLFQT LTNNPILTPS ILGRDSLYVF LQTLLVFTFG

101 GVGYASLPLT GKFGFELVVM MGGSLLLFYT LIKQGGRDLS RMILIGVIFG

151 ILFRSLSSLL SRMIDPEEFT AAQANMFAGF NTVHSELLGI GALILLVSAA

201 VVWRERYRLD VYLLGRDQAV NLGISYTRNT LWILLWIAAL VATATAVVGP

251 VSFFGLLAAS LANHFSPSVK HSVRLPMTVC IGGILLVGGQ TVFEHLLGMQ

301 AVLSVVVEFA GGLVFLYLVL KHKK* m619/g619  95.1% identity in 324 aa overlap
                   10         20         30         40         50         60
m619.pep   MPSEKNIGFMAGSSRPLWVAFALLLVSCVLFMTLNVKGDWDFVLQLRLTKLAALLMVAYA
           ||||||||||||||||||||| ||||||||:||||||||||||||:||||||||||||||
g619       MPSEKNIGFMAGSSRPLRVAFALLLVSCILFMTLNVKGDWDFVLHLRLTKLAALLMVAYA
                   10         20         30         40         50         60

70         80         90        100        110        120
m619.pep   VGVSTQLFQTLTNNPILTPSILGFDSLYVFLQTLLVFTFGGVGYASLPLTGKFGRELVVM
           |||||||||||||||||||||||||||||||||||||||||||||:|||||||||||||
g619       VGVSTQLFQTLTNNPILTPSILGRDSLYVFLQTLLVFTFGGVGYTSLPLTGKFGRELVVM
                   70         80         90        100        110        120

130        140        150        160        170        180
m619.pep   MGGSLLLFYTLIKQGGRDLSRMILIGVIFGILFRSLSSLLSRMIDPEEFTAAQANMFAGF
           ||||||||||||:||||||  :|||||||||||||||||||||||||||||||||||| 
g619       MGGSLLLFYTLIRQGGRDLPHMILIGVIFGILFRSLSSLLSRMIDPEEFTAAQANMFAGR
                  130        140        150        160        170        180

190        200        210        220        230        240
m619.pep   NTVHSELLGIGALILLVSAAVVWRERYRLDVYLLGRDQAVNLGISYTRNTLWILLWIAAL
           |||:|||||: |:|||||||||:||||:|:|||||||||||||||||||||||||||||
g619       NTVRSELLGIFALVLLVSAAVVWHERYRSDVHLLGRDQAVNLGISYTRNTLWILLWIAAL
                  190        200        210        220        230        240

250        260        270        280        290        300
m619.pep   VATATAVVGPVSFFGLLAASLANHFSPSVKHSVRLPMTVCIGGILLVGGQTVFEHLLGMQ
           |||||||||||||||||||||||||||||:||||||||||:|||||||||||||||:|:
g619       VATATAVVGPVSFFGLLAASLANHFSPSVRHSVRLPMTVCVGGILLVGGQTVFEHFLGMK
                  250        260        270        280        290        300

310        320
m619.pep   AVLSVVVEFAGGLVFLYLVLKHKKX
           |||||||||||||||||||||||||
g619       AVLSVVVEFAGGLVFLYLVLKHKKX
                  310        320
```

The following partial DNA sequence was identified in *N. meningitidis* <SEQ ID 1983>:

```
a619.seq
    1 ATGCCGTCTG AAAAAAATAT CGGTTTTATG GCAGGAAGCA GCCGTCCGTT

51 GTGGGTTGCC TTTGCGCTGT TGCTGGTTTC CTGCATCCTG TTTATGACGC

101 TCAACGTCAA AGGCGATTGG GATTTTGTTT TGCACCTGCG CCTGACCAAG

151 CTTGCCGCGC TGCTGATGGT CGCCTATGCG GTCGGCGTTT CGACCCAGCT
```

-continued

```
201 TTTTCAAACG CTGACCAACA ATCCGATTCT GACCCCTTCG ATTTTGGGTT

251 TCGATTCGCT GTATGTGTTT TTGCAGACCT TGCTGGTGTT TACGTTCGGC

301 GGCGTGGGCT ATGCTTCCCT GCCGTTGACG GGCAAATTCG GCTTTGAACT

351 GGTCGTTATG ATGGGCGGCT CGCTGCTGCT GTTTTACACG CTCATCAAAC

401 AGGGCGGGCG CGATTTGCCG CGTATGATTT TAATCGGCGT GATTTTCGGG

451 ATTTTGTTCC GCAGCCTGTC GTCGCTGCTT TCGCGCATGA TCGACCCCGA

501 AGAATTTACG GCGGCGCAGG CGAATATGTT TGCCGGATTC AATACCGTCC

551 ACAGCGAGCT TTTAGGCATA GGCGCGCTGA TTCTGCTCGT CAGCGCGGCG

601 GTCGTTTGGC GCGAACGCTA CCGCTTGGAC GTACACCTTT TGGGGCGCGA

651 CCAAGCCATA AATTTGGGCA TCAGCTACAC GCGCAACACC TTATGGATAC

701 TGCTTTGGAT TGCCGCGCTG GTGGCGACGG CGACCGCCGT TGTCGGCCCG

751 GTAAGCTTTT TCGGGCTTCT CGCCGCCTCG CTTGCCAACC ACTTTTCCCC

801 GTCGGTCAAA CATTCCGTCC GCCTGCCGAT GACGGTTTGT GTCGGCGGCA

851 TCCTCTTGGT CGGCGGACAG ACCGTATTCG AACACTTCTT GGGCATGAAG

901 GCGGTATTAA GCGTGGTGGT CGAATTTGCG GGCGGACTCG TTTTCCTCTA

951 TCTCGTTTTA AGACACAAAA AATGA
```

This corresponds to the amino acid sequence <SEQ ID 1984; ORF 619.a>:

```
a619.pep

1 MPSEKNIGFM AGSSRPLWVA FALLLVSCIL FMTLNVKGDW DFVLGLRLTK

51 LAALLMVAYA VGSVTQLFQT LTNNPILTPS ILGFDSLYVF LQTLLVFTFG

101 GVGYASLPLT GKFGFELVVM MGGSLLLFYT LIKQGGRDLP RMILIGVIFG

151 ILFRSLSSLL SRMIDPEEFT AAQANMFAGF NTVHSELLGI GALILLVSAA

201 VVWRERYRLD VHLLGRDQAI NLGISYTRNT LWILLWIAAL VATATAVVGP

251 VSFFGLLAAS LANHFSPSVK HSVRLPMTVC VGGILLVGGQ TVFEHFLGMK

301 AVLSVVVEFA GGLVFLYLVL RHKK*
``` m619/a619 97.2% identity in 324 aa overlap

```
                 10         20         30         40         50         60
m619.pep  MPSEKNIGFMAGSSRPLWVAFALLLVSCVLFMTLNVKGDWDFVLQLRLTKLAALLMVAYA
          ||||||||||||||||||||||||||||:||||||||||||||||:||||||||||||||
a619      MPSEKNIGFMAGSSRPLWVAFALLLVSCILFMTLNVKGDWDFVLHLRLTKLAALLMVAYA
                 10         20         30         40         50         60

70         80         90        100        110        120
m619.pep  VGVSTQLFQTLTNNPILTPSILGFDSLYVFLQTLLVFTFGGVGYASLPLTGKFGFELVVM
          |||||||||||||||||||||||:||||||||||||||||||||||||||||||||||||
a619      VGVSTQLFQTLTNNPILTPSILGRDSLYVFLQTLLVFTFGGVGYASLPLTGKFGFELVVM
                 70         80         90        100        110        120

130        140        150        160        170        180
m619.pep  MGGSLLLFYTLIKQGGRDLSRMILIGVIFGILFRSLSSLLSRMIDPEEFTAAQANMFAGF
          |||||||||||||||||||| |||||||||||||||||||||||||||||||||||||||
a619      MGGSLLLFYTLIKQGGRDLPRMILIGVIFGILFRSLSSLLSRMIDPEEFTAAQANMFAGF
                130        140        150        160        170        180

190        200        210        220        230        240
m619.pep  NTVHSELLGIGALILLVSAAVVWRERYRLDVYLLGRDQAVNLGISYTRNTLWILLWIAAL
          ||||||||||||||||||||||||||||||:|||||||:|||||||||||||||||||||
a619      NTVHSELLGIGALILLVSAAVVWRERYRLDVHLLGRDQAINLGISYTRNTLWILLWIAAL
                190        200        210        220        230        240

250        260        270        280        290        300
m619.pep  VATATAVVGPVSFFGLLAASLANHFSPSVKHSVRLPMTVCIGGILLVGGQTVFEHLGMQ
          ||||||||||||||||||||||||||||||||||||||||:|||||||||||||:|||:
a619      VATATAVVGPVSFFGLLAASLANHFSPSVKHSVRLPMTVCVGGILLVGGQTVFEHFLGMK
                250        260        270        280        290        300
```

```
             310        320
m619.pep  AVLSVVVEFAGGLVFLYLVLKHKKX
          ||||||||||||||||||||||:||||
    a619  AVLSVVVEFAGGLVFLYLVLRHKKX
             310        320
```

The following partial DNA sequence was identified in *N. gonorrhoeae* <SEQ ID 1985>:

```
g620.seq
   1 ATGAAGAAAA CCCTGTTGGc AATTGTTGCC gtTTTCGCCT TAAGTGCCTG

51 CCGGCaggcg gaAGaggcac cgccgCCTTT ACCCCGGCAG AtTAGCGacc 101 gttcggtcgg aCACTAttgC Agtatgaacc tgaccgaaca caacggcccc 151 aaagcccaga tttttttgaa cGGCAAACCC GATCAGCCCG TTTGGTTCTC 201 CACCGTcaag cagatgttcg GCTATACCAA GCTGCCCGAA GAGCCCAAAG

251 GCATCCGCGT GATTTACGTT ACCGATATGG GCAATGTTAC CGATTGGACG

301 AATCCTAATG CCGACACGGA GTGGATAGAT GCGAAAAAAG CCTTTTACGT

351 CATCGACAGC GGCTTTATCG GCGGTATGGG CGCGGAAGAC GCGCTGCCGT

401 TCGGCAACAA GGAGCAGGCT GAAAAATTTG CAAAGGATAA AGGCGGCAAG

451 GTCGTCGGTT TTGACGATAT GCCCGATGCT TACATTTTCA AGTAA
```

This corresponds to the amino acid sequence <SEQ ID 1986; *ORF* 620.ng>:

```
g620.pep
   1 MKKTLLAIVA VFALSACRQA EEAPPPLPRQ ISDRSVGHYC SMNLTEHNGP

51 KAQIFLNGKP DQPVWFSTVK QMFGYTKLPE EPKGIRVIYV TDMGNVTDWT

101 NPNADTEWID AKKAFYVIDS GFIGGMGAED ALPFGNKEQA EKFAKDKGGK

151 VVGFDDMPDA YIFK*
```

The following partial DNA sequence was identified in *N. meningitidis* <SEQ ID 1987>:

```
m620.seq
   1 ATGAAAAAAA CCCTGTTGGC AATTGTTGCC GTTTCCGCCT TAAGTGCCTG

51 CCGGCAGGCG GAAGAGGGAC CGCCGCCTTT ACCCCGGCAG ATTAGCGACC

101 GTTCGGTCGG ACACTATTGC AGTATGAACC TGACCGAACA CAACGGCCCC

151 AAAGCCCAGA TTTTCTTGAA CGGCAAACCC GATCAGCCCG TTTGGTTCTC

201 CACCATCAAG CAGATGTTCG GCTATACCAA GCTGCCCGAA GAGCCTAAAG

251 GCATCCGCGT GATTTACGTT ACCGATATGG GCAATGTTAC CGATTGGACG

301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA AATAA
```

This corresponds to the amino acid sequence <SEQ ID 1088; ORF 670>:

```
m620.pep

1 MKKTLLAIVA VSALSACRQA EEGPPPLPRQ ISDRSVGHYC SMNLTEHNGP

51 KAQIFLNGKP DQPVWFSTIK QMFGYTKLPE EPKGIRVIYV TDMGNVTDWT

101 NPNADTEWMD AKKAFYVIDS GFIGGMGAED ALPFGNKEQA EKFAKDKGGK

151 VVGFDDMPDT YIFK* m620/g620  97.0% identity in 164 aa overlap 10         20         30         40         50         60
m620.pep   MKKTLLAIVAVSALSACRQAEEGPPPLPRQISDRSVGHYCSMNLTEHNGPKAQIFLNGKP
           ||||||||||| ||||||||||:|||||||||||||||||||||||||||||||||||||
g620       MKKTLLAIVAVFALSACRQAEEAPPPLPRQISDRSVGHYCSMNLTEHNGPKAQIFLNGKP
                  10         20         30         40         50         60
                  70         80         90        100        110        120
m620.pep   DQPVWFSTIKQMFGYTKLPEEPKGIRVIYVTDMGNVTDWTNPNADTEWMDAKKAFYVIDS
           ||||||||:||||||||||||||||||||||||||||||||||||||||| |||||||||
g620       DQPVWFSTVKQMFGYTKLPEEPKGIRVIYVTDMGNVTDWTNPNADTEWIDAKKAFYVIDS
                  70         80         90        100        110        120
                 130        140        150        160
m620.pep   GRIFFMGAEDALPFGNKEQAEKFAKDKGGKVVGFDDMPDTYIFKX
           | |||||||||||||||||||||||||||||||||||||:||||
g620       GFIGGMGAEDALPFGNKEQAEKFAKDKGGKVVGFDDMPDAYIFKX
                 130        140        150        160
```

The following partial DNA sequence was identified in *N. meningitidis* <SEQ ID 1989>:

```
a620.seq
   1 ATGAAAAAAA CCCTGTTGGC AATTGTTGCC GTTTCCGCCT TAAGTGCCTG

51 CCGGCAGGCG GAAGAGGGAC CGCCGCCTTT ACCCCGGCAG ATTAGCGACC

101 GTTCGGTCGG ACACTATTGC AGTATGAACC TGACCGAACA CAACGGCCCC

151 AAAGCCCAGA TTTTCTTGAA CGGCAAACCC GATCAGCCCG TTTGGTTCTC

201 CACCATCAAG CAGATGTTCG GCTATACCAA GCTGCCCGAA GAGCCTAAAG

251 GCATCCGCGT GATTTACGTT ACCGATATGG GCAATGTTAC CGATTGGACG

301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA AATAA
```

This corresponds to the amino acid sequence <SEQ ID 1990; ORF 620.a>:

```
a620.pep

1 MKKTLLAIVA VSALSACRQA EEGPPPLPRQ ISDRSVGHYC SMNLTEHNGP

51 KAQIFLNGKP DQPVWFSTIK QMFGYTKLPE EPKGIRVIYV TDMGNVTDWT

101 NPNADTEWMD AKKAFYVIDS GFIGGMGAED ALPFGNKEQA EKFAKDKGGK

151 VVGFDDMPDT YIFK* m620/a620  100.0% identity in 164 aa overlap 10         20         30         40         50         60
m620.pep   MKKTLLAIVAVSALSACRQAEEGPPPLPRQISDRSVGHYCSMNLTEHNGPKAQIFLNGKP
           ||||||||||||||||||||||||||||||||||||||||||||||||||||||||||||
a620       MKKTLLAIVAVSALSACRQAEEGPPPLPRQISDRSVGHYCSMNLTEHNGPKAQIFLNGKP
                  10         20         30         40         50         60
```

```
                 70         80         90        100        110        120
m620.pep   DQPVWFSTIKQMFGYTKLPEEPKGIRVIYVTDMGNVTDWTNPNADTEWMDAKKAFYVIDS
           ||||||||||||||||||||||||||||||||||||||||||||||||||||||||||||
a620       DQPVWFSTIKQMFGYTKLPEEPKGIRVIYVTDMGNVTDWTNPNADTEWMDAKKAFYVIDS
                 70         80         90        100        110        120

130        140        150        160
m620.pep   GFIGGMGAEDALPFGNKEQAEKFAKDKGGKVVGFDDMPDTYIFKX
           ||||||||||||||||||||||||||||||||||||||||||||
a620       GFIGGMGAEDALPFGNKEQAEKFAKDKGGKVVGFDDMPDTYIFKX
                130        140        150        160
```

The following partial DNA sequence was identified in *N. gonorrhoeae* <SEQ ID 1991>:

```
g622.seq
   1 ATGCAactta ccgctgtcgg ACTCAATCAT CAAACCGCAC CTTTAAGCAT

51 ACGGGAAAag ctggCGTTTG CCGCCGCCGC CCTGCCAGAA gccgTccgCA

101 ATCTTGCCCG AAGCAATGCG GCAACGGAGG CGGTAATCCT TTCTACCTGC

151 AACCGCACCG AGCTTTACTG CGTCGGCGAT TCGGAAgaaa TCATCCGATG

201 GCTTGCCGAT TACCACAGTT TGCCGATTGA AGAAATCCGT CCGTATCTGT

251 ACACGCTGGA TATGCAGGAA ACCGTGCGCC ACGCCTTCCG CGTTGCCTGC

301 GGCTTGGATT CGATGGTTTT GGGCGAGCCG CAGATTTTGG GGCAGATTAA

351 AGATGCGGTG CGTGCGGCTC AAGAACAGGA AAGTATGGGG GCAAAACTCA

401 ATGCCCTGTT CCAAAAAACC TTTTCCGTTG CTAAAGAAGT CCGTACCGAT

451 ACCGCTGTCG GCGAAAATTC GGTTTCGATG GCTTCCGCGT CCGTCAAGTT

501 GGCGGAACAG ATTTTTCCCG ACATCGGCGA TTTGAACGTA TTGTTTATCG

551 GCGCAGGCGA AATGATTGAG CTGGTTGCCA CTTATTTTGC CGCCAAAAAT

601 CCCCGGCTGA TGACGGTTGC CAACCGGACG CTGGCGCGTG CACAGGAGTT

651 GTGCGACAAG CTCGGTGTTA ACGCCGAACC GTGCCTGCTG TCCGATCTGC

701 CTGCCATTCT GCACGATTAC GACGTGGTGG TTTCTTCAAC GGCGAGCCAG

751 CTTCCGATAG TCGGCAAAGG CATGGTCGAA CGCGCATTGA ACAGCGTCA

801 GAGTATGCCG TTGTTCATGC TTGACTTGGC CGTGCCGCGC GATATTGAAG

851 CGGAAGTCGG CGATTTGAAC GATGCGTATC TTTATACGGT GGACGATATG

901 GTCAACATCG TCCAAAGCGg caaggaggca aggcagaaag ccgccgcCgc 951 cgccgaaacg ctggTGTCCG AAAAGGTTGC CGAATTTGTC AGGCAGCAGC 1001 AGGGCAGGCA GagcgttcCG CTGATTAAGG CCTTGCGGGA CGAGGGCGAG

1051 AAAGCGCGCA AGCAGGTGTT GGAAAATGCG ATGAAACAGC TTGCCAAAGG

1101 CGcaaCGGCG GAAGaggttt TGgaacggct gtccgtcCAA CTGACCAACA

1151 AGCTGCTGCA TTCGCCAACT CAAACCTTGA ATAAGGCGGG GGAAGAAGAT

1201 AAAGatttGG TTCATGCCgt cGCGCAGATt tatcatttGG ACAAATAA
```

This corresponds to the amino acid sequence <SEQ ID 1992; *ORF 622.ng*>:

```
g622.pep
   1 MQLTAVGLNH QTAPLSIREK LAFAAAALPE AVRNLARSNA ATEAVILSTC

51 NRTELYCVGD SEEIIRWLAD YHSLPIEEIR PYLYTLDMQE TVRHAFRVAC
```

-continued

```
101 GLDSMVLGEP QILGQIKDAV RAAQEQESMG AKLNALFQKT FSVAKEVRTD

151 TAVGENSVSM ASASVKLAEQ IFPDIGDLNV LFIGAGEMIE LVATYFAAKN

201 PRLMTVANRT LARAQELCDK LGVNAEPCLL SDLPAILHDY DVVVSSTASQ

251 LPIVGKGMVE RALKQRQSMP LFMLDLAVPR DIEAEVGDLN DAYLYTVDDM

301 VNIVQSGKEA RQKAAAAAET LVSEKVAEFV RQQQGRQSVP LIKALRDEGE

351 KARKQVLENA MKQLAKGATA EEVLERLSVQ LTNKLLHSPT QTLNKAGEED

401 KDLVHAVAQI YHLDK*
```

The following partial DNA sequence was identified in *N. meningitidis* <SEQ ID 1993>:

```
m622.seq
   1 ATGCAACTTA CCGCTGTCGG ACTCAATCAT CAAACCGCAC CTTTAAGCAT
  51 ACGGGAAAAG CTGGCGTTTG CCGCCGCCGC CCTGCCTAAA GCCGTCCGCA
 101 ATCTTGCCCG AAGCAATGCG GCAACGGAGG CGGTAATCCT TTCTACCTGC
 151 AACCGCACCG AGCTTTACTG CGTCGGTGAT TCGGAAGAAA TCATCCGATG
 201 GCTTGCCGAT TACCACAGTT TGCCGATTGA AGAAATCCGT CCGTATCTGT
 251 ACGCGCTGGA TATGCAGGAG ACTGTGCGCC ATGCTTTCCG CGTCGCCTGC
 301 GGGCTGGATT CGATGGTGTT GGGCGAGCCG CAGATTTTAG GACAGATTAA
 351 GGATGCCGTT AGGGTTGCTC AAGAGCAGGA AAGTATGGGT AAGAAACTCA
 401 ATGCCCTGTT CCAAAAAACC TTTTCCGTTG CTAAAGAGGT CCGTACCGAT
 451 ACTGCCGTCG GCGAAAACTC GGTTTCCATG GCTTCCGCTT CCGTCAAATT
 501 GGCGGAACAG ATTTTTCCCG ACATCGGCGA TTTGAATGTC TTGTTTATCG
 551 GCGCAGGCGA AATGATTGAG CTGGTTGCCA CTTATTTTGC CGCCAAAAGT
 601 CCCCGGCTGA TGACGGTTGC CAACCGGACG CTGGCGCGTG CACAGGAGTT
 651 GTGCGACAAG CTCGGTGTCA ACGCCGAACC GTGCCTGCTG TCCGATCTGC
 701 CTGCCATTCT GCACGATTAC GACGTAGTGG TTTCTTCAAC GGCAAGCCAG
 751 TTGCCCATTG TCGGCAAAGG CATGGTGGAG CGTGCATTGA AACAAAGGCA
 801 GAGTATGCCG TTGTTCATGC TTGATTTGGC AGTGCCGCGT GACATTGAAG
 851 CGGAAGTCGG CGATTTGAAT GATGCCTATC TTTATACGGT GGACGATATG
 901 GTCAATATCG TCCAAAGCGG CAAGGAGGCA AGGCAGAAGG CCGCCGCCGC
 951 CGCCGAAACG CTGGTGTCCG AGAAAGTTGC CGAATTTGTC AGGCAGCAGC
1001 AGGGCAGGCA GAGTGTCCCC TTGATTAAGG CGTTGCGGGA CGAGGGCGAG
1051 AAAGCGCGCA AACAGGTGTT GGAAAATGCC ATGAAACAGC TTGCCAAAGG
1101 CGCAACGGCA GAAGAGGTTT TGGAACGGCT GTCCGTCCAA CTGACCAACA
1151 AGCTGCTGCA TTCGCCGACC CAAACCTTGA ATAAGGCGGG GGAAGAAGAT
1201 AAAGATTTGG TTCATGCCGT CGCGCAGATT TATCATTTGG ACAAATAA
```

This corresponds to the amino acid sequence <SEQ ID 1994; *ORF* 622>:

```
m622.pep
  1 MQLTAVGLNH QTAPLSIREK LAFAAAALPK AVRNLARSNA ATEAVILSTC
 51 NRTELYCVGD SEEIIRWLAD YHSLPIEEIR PYLYALDMQE TVRHAFRVAC
```

```
101 GLDSMVLGEP QILGQIKDAV RVAQEQESMG KKLNALFQKT FSVAKEVRTD

151 TAVGENSVSM ASASVKLAEQ IFPDIGDLNV LFIGAGEMIE LVATYFAAKS

201 PRLMTVANRT LARAQELCDK LGVNAEPCLL SDLPAILHDY DVVVSSTASQ

251 LPIVGKGMVE RALKQRQSMP LFMLDLAVPR DIEAEVGDLN DAYLYTVDDM

301 VNIVQSGKEA RQKAAAAAET LVSEKVAEFV RQQQGRQSVP LIKALRDEGE

351 KARKQVLENA MKQLAKGATA EEVLERLSVQ LTNKLLHSPT QTLNKAGEED

401 KDLVHAVAQI YHLDK*
``` m622/g622   98.8% identity in 415 aa overlap

```
                  10         20         30         40         50         60
m622.pep  MQLTAVGLNHQTAPLSIREKLAFAAAALPKAVRNLARSNAATEAVILSTCNRTELYCVGD
          ||||||||||||||||||||||||||||||:||||||||||||||||||||||||||||
g622      MQLTAVGLNHQTAPLSIREKLAFAAAALPEAVRNLARSNAATEAVILSTCNRTELYCVGD
                  10         20         30         40         50         60

70         80         90        100        110        120
m622.pep  SEEIIRWLADYHSLPIEEIRPYLYALDMQETVRHAFRVACGLDSMVLGEPQILGQIKDAV
          ||||||||||||||||||||||||||:|||||||||||||||||||||||||||||||||
g622      SEEIIRWLADYHSLPIEEIRPYLYTLDMQETVRHAFRVACGLDSMVLGEPQILGQIKDAV
                  70         80         90        100        110        120

130        140        150        160        170        180
m622.pep  RVAQEQESMGKKLNALFQKTFSVAKEVRTDTAVGENSVSMASASVKLAEQIFPDIGDLNV
          |:||||||||| ||||||||||||||||||||||||||||||||||||||||||||||
g622      RAAQEQESMGAKLNALFQKTFSVAKEVRTDTAVGENSVSMASASVKLAEQIFPDIGDLNV
                 130        140        150        160        170        180

190        200        210        220        230        240
m622.pep  LFIGAGEMIELVATYFAAKSPRLMTVANRTLARAQELCDKLGVNAEPCLLSDLPAILHDY
          ||||||||||||||||||||:|||||||||||||||||||||||||||||||||||||
g622      LFIGAGEMIELVATYFAAKNPRLMTVANRTLARAQELCDKLGVNAEPCLLSDLPAILHDY
                 190        200        210        220        230        240

250        260        270        280        290        300
m622.pep  DVVVSSTASQLPIVGKGMVERALKQRQSMPLFMLDLAVPRDIEAEVGDLNDAYLYTVDDM
          ||||||||||||||||||||||||||||||||||||||||||||||||||||||||||
g622      DVVVSSTASQLPIVGKGMVERALKQRQSMPLFMLDLAVPRDIEAEVGDLNDAYLYTVDDM
                 250        260        270        280        290        300

310        320        330        340        350        360
m622.pep  VNIVQSGKEARQKAAAAAETLVSEKVAEFVRQQQGRQSVPLIKALRDEGEKARKQVLENA
          ||||||||||||||||||||||||||||||||||||||||||||||||||||||||||
g622      VNIVQSGKEARQKAAAAAETLVSEKVAEFVRQQQGRQSVPLIKALRDEGEKARKQVLENA
                 310        320        330        340        350        360

370        380        390        400        410
m622.pep  MKQLAKGATAEEVLERLSVQLTNKLLHSPTQTLNKAGEEDKDLVHAVAQIYHLDKX
          |||||||||||||||||||||||||||||||||||||||||||||||||||||||
g622      MKQLAKGATAEEVLERLSVQLTNKLLHSPTQTLNKAGEEDKDLVHAVAQIYHLDKX
                 370        380        390        400        410
```

The following partial DNA sequence was identified in *N. meningitidis* <SEQ ID 1995>:

```
a622.seq
   1 ATGCAACTTA CCGCTGTCGG ACTCAATCAT CAAACCGCAC CTTTAAGCAT

51 ACGGGAAAAG CTGGCGTTTG CCGCGGCCTG CCTGCCCGAA GCCGTCCGCA

101 ATCTTGCCCG AAGCAATGCG GCAACGGAGG CGGTAATCCT TTCTACCTGC

151 AACCGTACCG AGCTTTACTG TGTAGGTGAT TCGGAAGAAA TCATCCGTTG

201 GCTCGCAGAC TATCACAGCC TTCCCATAGA AGAAATCAGC CCCTACCTTT

251 ATACTTTGGG GATGCAGGAG ACTGTGCGCC ATGCTTTCCG CGTCGCCTGC

301 GGCTTGGATT CGATGGTGTT GGGCGAGCCG CAGATTTTAG GACAGATTAA

351 GGATGCGGTC AGGGTTGCTC AAGAGCAGGA AAGTATGGGT AAGAAACTCA

401 ATGCCCTGTT CCAAAAAACC TTTTCTGTTG CTAAAGAGGT CCGTACCGAT

451 ACTGCCGTCG GCGAAAACTC GGTTTCCATG GCTTCCGCTT CCGTCAAGTT
```

-continued

```
 501 GGCAGAGCAG ATTTTCCCCG ACATCGGCGA TTTGAATGTC TTGTTTATCG

551 GTGCGGGTGA GATGATTGAG CTGGTTGCCA CTTATTTTGC CGCCAAAAGT

601 CCCCGGCTGA TGACGGTTGC CAACCGGACG CTGGCGCGTG CACAGGAGTT

651 GTGCGACAAG CTCGGTGTCA ACGCCGAACC GTGCCTGCTG TCCGATCTGC

701 CTGCCATTTT GCATGAGTAC GACGTGGTGG TTTCTTCAAC GGCAAGCCAG

751 TTGCCCATTG TCGGCAAAGG TATGGTGGAG CGCGCATTGA AACAAAGGCA

801 GAGTATGCCG TTGTTTATGC TTGACTTGGC CGTGCCGCGA GACATTGAGG

851 CGGAAGTCGG AGATTTGAAC GATGCCTATC TTTATACGGT GGACGATATG

901 GTCAATATCG TCCAAAGCGG CAAGGAGGCA AGGCAGAAGG CCGCCGCCGC

951 CGCCGAAACG CTGGTGTCCG AGAAGGTTGC CGAATTTGTC AGGCAGCAGC

1001 AGGGCAGGCA GAGTGTCCCG TTAATCAGGG CATTGAGGGA TGAGGGAGAG

1051 AAAGCGCGCA AACAGGTCTT GGAAAATGCG ATGAAACAGC TTGCCAAAGG

1101 CGCAACGGCA GAAGAGGTTT TGGAAAGGCT GTCGATCCAA CTGACCAACA

1151 AGCTGCTGCA TTCGCCGACC CAAACCTTGA ATAAGGCGGG GGAAGAAGAT

1201 AAAGATTTGG TTCACGCCGT CGCGCAGATT TATCATTTGG ACAAATAA
```

This corresponds to the amino acid sequence <SEQ ID 1996; ORF 622.a>:

```
a622.pep

1 MQLTAVGLNH QTAPLSIREK LAFAAACLPE AVRNLARSNA ATEAVILSTC

51 NRTELYCVGD SEEIIRWLAD YHSLPIEEIS PYLYTLGMQE TVRHAFRVAC

101 GLDSMVLGEP QILGQIKDAV RVAQEQESMG KKLNALFQKT FSVAKEVRTD

151 TAVGENSVSM ASASVKLAEQ IFPDIGDLNV LFIGAGEMIE LVATYFAAKS

201 PRLMTVANRT LARAQELCDK LGVNAEPCLL SDLPAILHEY DVVVSSTASQ

251 LPIVGKGMVE RALKQRQSMP LFMLDLAVPR DIEAEVGDLN DAYLYTVDDM

301 VNIVQSGKEA RQKAAAAAET LVSEKVAEFV RQQQGRQSVP LIRALRDEGE

351 KARKQVLENA MKQLAKGATA EEVLERLSIQ LTNKLLHSPT QTLNKAGEED

401 KDLVHAVAQI YHLDK* m622/a622  98.1% identity in 415 aa overlap
                10         20         30         40         50         60
m622.pep  MQLTAVGLNHQTAPLSIREKLAFAAAALPKAVRNLARSNAATEAVILSTCNRTELYCVGD
          ||||||||||||||||||||||||||| ||:||||||||||||||||||||||||||||
a622      MQLTAVGLNHQTAPLSIREKLAFAAACLPEAVRNLARSNAATEAVILSTCNRTELYCVGD
                10         20         30         40         50         60

70         80         90        100        110        120
m622.pep  SEEIIRWLADYHSLPIEEIRPYLYALDMQETVRHAFRVACGLDSMVLGEPQILGQIKDAV
          |||||||||||||||||||| ||||:||||||||||||||||||||||||||||||||||
a622      SEEIIRWLADYHSLPIEEISPYLYTLGMQETVRHAFRVACGLDSMVLGEPQILGQIKDAV
                70         80         90        100        110        120

130        140        150        160        170        180
m622.pep  RVAQEQESMGKKLNALFQKTFSVAKEVRTDTAVGENSVSMASASVKLAEQIFPDIGDLNV
          ||||||||||||||||||||||||||||||||||||||||||||||||||||||||||||
a622      RVAQEQESMGKKLNALFQKTFSVAKEVRTDTAVGENSVSMASASVKLAEQIFPDIGDLNV
               130        140        150        160        170        180

190        200        210        220        230        240
m622.pep  LFIGAGEMIELVATYFAAKSPRLMTVANRTLARAQELCDKLGVNAEPCLLSDLPAILHDY
          |||||||||||||||||||||||||||||||||||||||||||||||||||||||||:|
a622      LFIGAGEMIELVATYFAAKSPRLMTVANRTLARAQELCDKLGVNAEPCLLSDLPAILHEY
               190        200        210        220        230        240

250        260        270        280        290        300
m622.pep  DVVVSSTASQLPIVGKGMVERALKQRQSMPLFMLDLAVPRDIEAEVGDLNDAYLYTVDDM
          ||||||||||||||||||||||||||||||||||||||||||||||||||||||||||||
a622      DVVVSSTASQLPIVGKGMVERALKQRQSMPLFMLDLAVPRDIEAEVGDLNDAYLYTVDDM
               250        260        270        280        290        300
```

-continued

```
              310        320        330        340        350        360
m622.pep  VNIVQSGKEARQKAAAAAETLVSEKVAEFVRQQQGRQSVPLIKALRDEGEKARKQVLENA
          ||||||||||||||||||||||||||||||||||||||||:|||||||||||||||||||
a622      VNIVQSGKEARQKAAAAAETLVSEKVAEFVRQQQGRQSVPLIRALRDEGEKARKQVLENA
              310        320        330        340        350        360

370        380        390        400        410
m622.pep  MKQLAKGATAEEVLERLSVQLTNKLLHSPTQTLNKAGEEDKDLVHAVAQIYHLDKX
          ||||||||||||||||||||:|||||||||||||||||||||||||||||||||||
a622      MKQLAKGATAEEVLERLSIQLTNKLLHSPTQTLNKAGEEDKDLVHAVAQIYHLDKX
              370        380        390        400        410
```

The following partial DNA sequence was identified in *N. gonorrhoeae* <SEQ ID 1997>:

```
g624.seq
  1 ATGATCCGTT ATCTTTTAAT TGCCTGCGGC GGCATCTCCC TGCTGTTGGG

51 GATAATCGGC ATTTTTTTGC CGCTGTTGCC GACCACGCCG TTCGTACTAC

101 TCTCCGCCGC CTGCTGGGCA AAGGCAtccc cgcgcTTTCa ccgCTGGCTG

151 CACcgGCacc gCTATTTCGG CCCGATGGTT CATAACTGGG AACAAAACGG

201 CGCAGTGCCG CGCAAAGCCA AGATTTTCGC CATCAGCATG AtaaccgcAt 251 cctgcctcat gatctTTtgg CattTTCccc aacnctggtg ggtcGGGGCG 301 GTTTCATCGG TTTTTTGTTC CCTTGTcacC ATacggatgt gGcacAGacC 351 cgaatCTTGA
```

This corresponds to the amino acid sequence <SEQ ID 1998; ORF 624.ng>:

```
g624.pep
  1 MIRYLLIACG GISLLLGIIG IFLPLLPTTP FVLLSAACWA KASPRFHRWL

51 HRHRYFGPMV HNWEQNGAVP RKAKIFAISM ITASCLMIFW HFPQXWWVGA

101 VSSVFCSLVT IRMWHRPES*
```

The following partial DNA sequence was identified in *N. meningitidis* <SEQ ID 1999>:

```
m624.seq
  1 ATGATACGTT ATCTTTTAAT TGCCTGCGGC TGCATTTCCC TACTGTTGGG

51 TATCATCGGC ATTTTTTTGC CGCTGTTGCC GACCACGCCG TTCGTACTGC

101 TCTCCGCCGC CTGCTGGGCA AAGGCATCCC CGCGCTTTTA CCGCTGGCTG

151 CACCGGCACC GCTATTTCGG CCCGATGGTT CATAACTGGG AACAAAACGG

201 CGCAGTGCCG CGCAAAGCCA AAATATTCGC CATCAGTATG ATGACCGCAT

251 CCTGCCTGAT AATGTTTTGG CAGTTTCCCC AACGCTGGTG GGTCGGGGCG

301 GTTTCATCGG TTTTTTGTTC CCTTGTCGCC ATATGGATGT GGCGCAGGCC

351 CGAATCTTGA
```

This corresponds to the amino acid sequence <SEQ ID 2000; ORF 624>:

```
m624.pep
  1 MIRYLLIACG CISLLLGIIG IFLPLLPTTP FVLLSAACWA KASPRFYRWL

51 HRHRYFGPMV HNWEQNGAVP RKAKIFAISM MTASCLIMFW QFPQRWWVGA

101 VSSVFCSLVA IWMWRRPES*
```

```
m624/g624 91.6% identity in 119 aa overlap
                    10         20         30         40         50         60
    m624.pep   MIRYLLIACGCISLLLGIIGIFLPLLPTTPFVLLSAACWAKASPRFYRWLHRHRYFGPMV
               |||||||||| ||||||||||||||||||||||||||||||||||:|||||||||||||
    g624       MIRYLLIACGGISLLLGIIGIFLPLLPTTPFVLLSAACWAKASPRFHRWLHRHRYFGPMV
                    10         20         30         40         50         60

70         80         90        100        110        120
    m624.pep   HNWEQNGAVPRKAKIFAISMMTASCLIMFWQFPQRWWVGAVSSVFCSLVAIWMWRRPESX
               ||||||||||||||||||||||:|||||::||:||| |||||||||||||||:|| :|||||
    g624       HNWEQNGAVPRKAKIFAISMITASCLMIFWHFPQXWWVGAVSSVFCSLVTIRMWHRPESX
                    70         80         90        100        110        120
```

The following partial DNA sequence was identified in *N. meningitidis* <SEQ ID 2001>:

```
a624.seq
    1 ATGATACGTT ATCTTTTAAT TGCCTGCGGC TGCATTTCCC TGCTGTTGGG

51 TATCATCGGC ATTTTTTTGC CGCTGTTGCC GACCACGCCG TTCGTACTGC

101 TCTCCGCCGC CTGCTGGGCA AAGGCATCCC CGCGCTTTCA CCGCTGGCTG

151 CACCGGCACC GCTATTTCGG TCCGATGGTT CATAACTGGG AACAAAACGG

201 CGCAGTGCCG CGCAAAGCCA AAATATTCGC CATCAGTATG ATGACCGCAT

251 CCTGCCTGAT AATGTTTTGG CAGTTTCCCC AACGCTGGTG GGTCGGGGCG

301 GTTTCATCGG TTTTTTGTTC CCTTGTCGCC ATATGGATGT GGCGCAGGCC

351 CGAATCTTGA
```

This corresponds to the amino acid sequence <SEQ ID 2002; ORF 624.a>:

```
a624.pep

1 MIRYLLIACG CISLLLGIIG IFLPLLPTTP FVLLSAACWA KASPRFHRWL

51 HRHRYFGPMV HNWEQNGAVP RKAKIFAISM MTASCLIMFW QFPQRWWVGA

101 VSSVFCSLVA IWMWRRPES*
```

```
m624/a624 99.2% identity in 119 aa overlap
                    10         20         30         40         50         60
    m624.pep   MIRYLLIACGCISLLLGIIGIFLPLLPTTPFVLLSAACWAKASPRFYRWLHRHRYFGPMV
               |||||||||| |||||||||||||||||||||||||||||||||||:|||||||||||||
    a624       MIRYLLIACGCISLLLGIIGIFLPLLPTTPFVLLSAACWAKASPRFHRWLHRHRYFGPMV
                    10         20         30         40         50         60

70         80         90        100        110        120
    m624.pep   HNWEQNGAVPRKAKIFAISMMTASCLIMFWQFPQRWWVGAVSSVFCSLVAIWMWRRPESX
               ||||||||||||||||||||||||||||||||||||||||||||||||||||||||||||
    a624       HNWEQNGAVPRKAKIFAISMMTASCLIMFWQFPQRWWVGAVSSVFCSLVAIWMWRRPESX
                    70         80         90        100        110        120
```

The following partial DNA sequence was identified in *N. meningitidis* <SEQ ID 2003>:

```
a625.seq
    1 ATGTTTGCAA CCAGGAAAAT GAAGAAGATG ACGATGTGCA CGCGGCGGGT

51 ACGGTTTTGG TTGGCTTTCA GCAGCGGACG AATCATCAGC ATTGCTGCGC

101 CGGTCGTTCC CATGATAGAG GCAAGTGCCG TACCGACGGC AAGCAGGGCG

151 GTGTTGAGCT TGGGTGTGCC GTTCAAGTCG CCCCAAACCA AAATGCCGCC
```

-continued

```
201 TGAAATGGTG TACAGGGCAA GCAGCAGCAG GATGAAAGGG ATGTATTCTT

251 CAACGAGTGC GTGTGCGACG GTATGGATAC CGGCGGACGC GCCAAAAACC

301 AAACTGAACG GGATGAGGAA GAGCAATGTC CAAAAGGCGG TAATTTTGCC

351 GTAA
```

The following partial DNA sequence was identified in *N. gonorrhoeae* <SEQ ID 2004>:

```
g625.seq
  1 atGTTTGCAA CCAGGAAAAT GAAGAAGATG ACGATGTGCA CGCGGCGGGT

51 ACGGtcTTGG TTGGCTTTCA GCAGCGGACG AATCATCAGC AttgCCGCGC

101 CGGtcgttcC CATGATAGAG GCAAGTGCCG TACCGACGGC AAGCAGGGCG

151 GTGTTGAGCT TGGGTGTGCC GTTCAAGTCG CCCCAAACCA AAATGCCGCC

201 TGAAATGGTG TACAGGGCAA GCAGCAGCAG GATGAAGGGG ATATATTCTT

251 CAACGAGTGC GTGTGCGACG GTATGGATAC CGGCGGACGC GCCAAAAACC

301 AAACTGAACG GGATGAGGAA GAGCAATGTC CAAAAGGCGG TGATTTTGCc 351 gtAA
```

This corresponds to the amino acid sequence <SEQ ID 2005; ORF 625.ng>:

```
g625.pep
  1 MFATRKMKKM TMCTRRVRSW LAFSSGRIIS IAAPVVPMIE ASAVPTASRA

51 VLSLGVPFKS PQTKMPPEMV YRASSSRMKG IYSSTSACAT VWIPADAPKT

101 KLNGMRKSNV QKAVILP*
```

The following partial DNA sequence was identified in *N. meningitidis* <SEQ ID 2006>:

```
m625.seq
  1 ATGTTTGCAA CCAGGAAAAT GAAGAAGATG ACGATGTGCA CGCGGCGGGT

51 ACGGTTTTGG TTGGCTTTCA GCAGCGGACG AATCATCAGC ATTGCTGCGC

101 CGGTCGTTCC CATGATAGAG GCAAGTGCCG TACCGACGGC AAGCAGGGCG

151 GTGTTGAGCT TGGGTGTGCC GTTCAAGTCG CCCCAAACCA AAATGCCGCC

201 TGAAATGGTG TACAGGGCAA GCAGCAGCAG GATGAAAGGG ATGTATTCTT

251 CAACGAGTGC GTGTGCGACG GTATGGATAC CGGCGGACGC GCCAAAAACC

301 AAACTGAACG GGATGAGGAA GAGCAATGTC CAAAAGGCGG TAATTTTGCC

351 GTAA
```

This corresponds to the amino acid sequence <SEQ ID 2007; ORF 625>:

```
m625.pep
   1 MFATRKMKKM TMCTRRVRFW LAFSSGRIIS IAAPVVPMIE ASAVPTASRA

51 VLSLGVPFKS PQTKMPPEMV YRASSSRMKG MYSSTSACAT VWIPADAPKT

101 KLNGMRKSNV QKAVILP* m625/g625 98.3% identity in 117 aa overlap
```

```
                   10        20        30        40        50        60
m625.pep   MFATRKMKKMTMCTRRVRFWLAFSSGRIISIAAPVVPMIEASAVPTASRAVLSLGVPFKS
           ||||||||||||||||||| ||||||||||||||||||||||||||||||||||||||||
g625       MFATRKMKKMTMCTRRVRSWLAFSSGRIISIAAPVVPMIEASAVPTASRAVLSLGVPFKS
                   10        20        30        40        50        60

70        80        90       100       110
m625.pep   PQTKMPPEMVYRASSSRMKGMYSSTSACATVWIPADAPKTKLNGMRKSNVQKAVILPX
           |||||||||||||||||||||||||:|||||||||||||||||||||||||||||||
g625       PQTKMPPEMVYRASSSRMKGIYSSTSACATVWIPADAPKTKLNGMRKSNVQKAVILPX
                   70        80        90       100       110
```

This corresponds to the amino acid sequence <SEQ ID 2008; ORF 625.a>:

```
a625.pep
     1  MFATRKMKKM TMCTRRVRFW LAFSSGRIIS IAAPVVPMIE ASAVPTASRA
    51  VLSLGVPFKS PQTKMPPEMV YRASSSRMKG MYSSTSACAT VWIPADAPKT
   101  KLNGMRKSNV QKAVILP*
m625/a625  100.0% identity in 117 aa overlap 10        20        30        40        50        60
m625.pep   MFATRKMKKMTMCTRRVRFWLAFSSGRIISIAAPVVPMIEASAVPTASRAVLSLGVPFKS
           ||||||||||||||||||||||||||||||||||||||||||||||||||||||||||||
a625       MFATRKMKKMTMCTRRVRFWLAFSSGRIISIAAPVVPMIEASAVPTASRAVLSLGVPFKS
                   10        20        30        40        50        60

70        80        90       100       110
m625.pep   PQTKMPPEMVYRASSSRMKGMYSSTSACATVWIPADAPKTKLNGMRKSNVQKAVILPX
           |||||||||||||||||||||||||||||||||||||||||||||||||||||||||
a625       PQTKMPPEMVYRASSSRMKGMYSSTSACATVWIPADAPKTKLNGMRKSNVQKAVILPX
                   70        80        90       100       110
```

The following partial DNA sequence was identified in *N. gonorrhoeae* <SEQ ID 2009>:

```
g627.seq
    1  ATGTCCGGCC TTTGGAAACC CGAACACCCG GGATTTGAAA TCCTCGGCAG

51  CCGTTACGCC CTGCAAAACC TTGTCCGCGA TGTCATCCTG ATTACATTGA

101  CCGCCGTATC TATGGCAATC ACGCCCAAAC AAGTCCGCGC AGGCAACGAA

151  TTCAACTTTG AACCCATCGC CGAAGTGGGC AAACTCTTCC TCGGCATCTT

201  CATCACCATC TTCCCCGTCC TGAGCATTCT GAAAGCAGGC GAGGCAGGCG

251  CGCTGGGCGG GGTGGTATCG CTGGTTCACG ATACGGCAGG TCATCCGATT

301  AATACGATGT ATTTCTGGAT GAGCGGCATA TTGTCGGCAT TCTTGGATAA

351  CGCGCCCACT TATCTCGTGT TTTTCAATAT GGCGGGCGGC GATGCCCAAG

401  CCTTAATGAC GGGTCCCCTG TTTCATTcgc TGCTGGCGGT TTCTAtgggT 451  tCGGTATTCA TGGGCGCACT GaccTACATc gGCAAcgcac cgaactTCAT 501  GGTcaaggcc aTTGCCGaaC agcgcgGCgt accgaTGCcg actTTCTTcc 551  ggtaTAtgat gtggtcggtc gcCTTCCTGa caCCCGTCTT CAtcgTACAT 601  ACCCTcgtCT TTTTcgTTtt cAAACTACTg taa
```

This corresponds to the amino acid sequence <SEQ ID 2010; ORF 627.ng>:

```
g627.pep
  1 MSGLWKPEHP GFEILGSRYA LQNLVRDVIL ITLTAVSMAI TPKQVRAGNE

51 FNFEPIAEVG KLFLGIFITI FPVLSILKAG EAGALGGVVS LVHDTAGHPI

101 NTMYFWMSGI LSAFLDNAPT YLVFFNMAGG DAQALMTGPL FHSLLAVSMG

151 SVFMGALTYI GNAPNFMVKA IAEQRGVPMP TFFRYMMWSV AFLTPVFIVH

201 TLVFFVFKLL *
```

The following partial DNA sequence was identified in N. meningitidis <SEQ ID 2011>:

```
m627.seq
  1 ATGTCCGGCC TTTGGAAACC CGAACACCCG GGATTTGAAA TCCTCGGCAG

51 CCGTTACGCC CTGCAAAACC TCGTCCGCGA TGTCATCCTG ATTGCATTGA

101 CCGCCGTATC TATGGCAATC ACGCCCAAAC AAGTCCGCGC AGGCAACGAA

151 TTCAACTTTG AACCCATCGC CGAAGTGGGC AAACTCTTCC TCGGCATCTT

201 CATCACCATC TTTCCCGTCC TGAGCATTCT GAAAGCAGGC GAGGCAGGCG

251 CGCTGGGCGG GGTGGTATCG CTGGTTCACG ATACGGCAGG TCATCCGATT

301 AATGTGATGT ATTTTTGGAT GAGCGGCATA TTGTCGGCAT TCTTGGATAA

351 CGCGCCCACT TATCTCGTTT TTTTCAATAT GGCGGGCGGC GATGCCCAAG

401 CCTTGATGAC GGGTACCCTG TTTCATTCGC TGCTGGCGGT TTCTATGGGT

451 TCGGTATTCA TGGGCGCACT GACCTACATC GGCAACGCAC CGAACTTCAT

501 GGTCAAGGCC ATTGCCGAAC AGCGCGGCGT ACCGATGCCG ACTTTCTTCG

551 GCTATATGAT GTGGTCGGTC GCCTTCCTGA CACCCGTCTT CATCGTACAT

601 ACCCTTATCT TTTTCGTTTT CAAACTGCTG TAA
```

This corresponds to the amino acid sequence <SEQ ID 2012; ORF 627>:

```
m627.pep
  1 MSGLWKPEHP GFEILGSRYA LQNLVRDVIL IALTAVSMAI TPKQVRAGNE

51 FNFEPIAEVG KLFLGIFITI FPVLSILKAG EAGALGGVVS LVHDTAGHPI

101 NVMYFWMSGI LSAFLDNAPT YLVFFNMAGG DAQALMTGTL FHSLLAVSMG

151 SVFMGALTYI GNAPNFMVKA IAEQRGVPMP TFFGYMMWSV AFLTPVFIVH

201 TLIFFVFKLL *
```

Computer analysis of this amino acid sequence gave the following results:
Homology with a Predicted ORF from N. gonorrhoeae

```
    m627/g627  97.6% identity in 210 aa overlap 10         20         30         40         50         60
    m627.pep  MSGLWKPEHPGFEILGSRYALQNLVRDVILIALTAVSMAITPKQVRAGNEFNEEPIAEVG
              ||||||||||||||||||||||||||||||:||||||||||||||||||||:||||||||
    g627      MSGLWKPEHPGFEILGSRYALQNLVRDVILITLTAVSMAITPKQVRAGNEFNFEPIAEVG
                  10         20         30         40         50         60

70         80         90        100        110        120
    m627.pep  KLFLGIFITIFPVLSILKAGEAGALGGVVSLVHDTAGHPINVMYFWMSGILSAFLDNAPT
              |||||||||||||||||||||||||||||||||||||||||:||||||||||||||||||
    g627      KLFLGIFITIFPVLSILKAGEAGALGGVVSLVHDTAGHPINTMYFWMSGILSAFLDNAPT
                  70         80         90        100        110        120
```

-continued

```
                 130       140       150       160       170       180
m627.pep    YLVFFNMAGGDAQALMTGTLFHSLLAVSMGSVFMGALTYIGNAPNFMVKAIAEQRGVPMP
            |||||||||||||||| |||||||||||||||||||||||||||||||||||||||||||
g627        YLVFFNMAGGDAQALMTGPLFHSLLAVSMGSVFMGALTYIGNAPNFMVKAIAEQRGVPMP
                 130       140       150       160       170       180

190       200       210
m627.pep    TFFGYMMWSVAFLTPVFIVHTLIFFVFKLLX
            ||| |||||||||||||||||||:||||||||
g627        TFFRYMMWSVAFLTPVFIVHTLVFFVFKLLX
                 190       200       210
```

The following partial DNA sequence was identified in *N. meningitidis* <SEQ ID 2013>:

```
a627.seq
   1 ATGTCCGGCC TTTGGAAACC CGAACACCCG GGATTTGAAA TCCTCGGCAG

51 CCGTTACGCC CTGCAAAACC TCGTCCGCGA TGTCATCCTG ATTGCATTGA

101 CCGCCGTATC TATGGCAATC ACGCCCAAAC AAGTCCGCGC AGGCAACGAA

151 TTCAACTTTG AACCCATCGC CGAAGTGGGC AAACTCTTCC TCGGCATCTT

201 CATCACCATC TTTCCCGTCC TGAGCATTCT GAAAGCAGGC GAGGCAGGCG

251 CGCTGGGCGG GGTGGTATCG CTGGTTCACG ATACGGCAGG TCATCCGATT

301 AATGTGATGT ATTTTTGGAT GAGCGGCATA TTGTCGGCAT TCTTGGATAA

351 CGCGCCCACT TATCTCGTTT TTTTCAATAT GGCGGGCGGC GATGCCCAAG

401 CCTTGATGAC GGGTTCCCTG TTTCATTCGC TGCTGGCGGT TTCTATGGGT

451 TCGGTATTCA TGGGCGCACT GACCTACATC GGCAACGCAC CGAACTTCAT

501 GGTCAAGGCC ATTGCCGAAC AGCGCGGCGT ACCGATGCCG ACTTTCTTCG

551 GCTATATGAT GTGGTCGGTC GCCTTCCTGA CACCCGTCTT CATCGTACAT

601 ACCCTTATCT TTTTCGTTTT CAAACTGCTG TAA
```

This corresponds to the amino acid sequence <SEQ ID 2014; *ORF* 627.a>:

```
a627.pep

1 MSGLWKPEHP GFEILGSRYA LQNLVRDVIL IALTAVSMAI TPKQVRAGNE

51 FNFEPIAEVG KLFLGIFITI RPVLSILKAG EAGALGGVVS LVHDTAGHPI

101 NVMYFWMSGI LSAFLDNAPT YLVFFNMAGG DAQALMTGSL FHSLLAVSMG

151 SVFMGALTYI GNAPNFMVKA IAEQRGVPMP TFFGYMMWSV AFLTPVFIVH

201 TLIFFVFKLL * m627/a627  99.5% identity in 210 aa overlap 10        20        30        40        50        60
m627.pep    MSGLWKPEHPGFEILGSRYALQNLVRDVILIALTAVSMAITPKQVRAGNEFNFEPIAEVG
            ||||||||||||||||||||||||||||||||||||||||||||||||||||||||||||
a627        MSGLWKPEHPGFEILGSRYALQNLVRDVILIALTAVSMAITPKQVRAGNEFNFEPIAEVG
                  10        20        30        40        50        60

70        80        90       100       110       120
m627.pep    KLFLGIFITIFPVLSILKAGEAGALGGVVSLVHDTAGHPINVMYFWMSGILSAFLDNAPT
            ||||||||||||||||||||||||||||||||||||||||||||||||||||||||||||
a627        KLFLGIFITIFPVLSILKAGEAGALGGVVSLVHDTAGHPINVMYFWMSGILSAFLDNAPT
                  70        80        90       100       110       120

130       140       150       160       170       180
m627.pep    YLVFFNMAGGDAQALMTGTLFHSLLAVSMGSVFMGALTYIGNAPNFMVKAIAEQRGVPMP
            ||||||||||||||||||:|||||||||||||||||||||||||||||||||||||||||
a627        YLVFFNMAGGDAQALMTGSLFHSLLAVSMGSVFMGALTYIGNAPNFMVKAIAEQRGVPMP
                 130       140       150       160       170       180
```

-continued
```
              190         200         210
m627.pep  TFFGYMMWSVAFLTPVFIVHTLIFFVFKLLX
          ||||||||||||||||||||||||||||||
a627      TFFGYMMWSVAFLTPVFIVHTLIFFVFKLLX
              190         200         210
```

The following partial DNA sequence was identified in *N. gonorrhoeae* <SEQ ID 2015>:

```
g628.seq
  1 ATGTGCGTGC CACTCAAGCC GGCAGGATGC GGGCCGCCAA ATTCATGTGT
 51 TTCGATATTG GCAGCATTTT CAGACGGCAC GTCTGCGCCT GCTGCTTTAC
101 ACACATGGAT TTTACGTTCG GTCAGGCGGC TCAATACCAA CAGGCCGCGT
151 TTGAAGTCTT CGGCGGCTTC TTTGATGATG ACCGTAGGGT CGGCAGCCAG
201 CGGATTGGTG TCCATCGCAT TGACGAAGAT GGCGAACGGC TCGGCATCTA
251 CGGCAGGGAT TTTGCTGAAC GGACGGGTGC GAAGCGCAGT CCATAAGCCT
301 GATTGAATCA GGTTGCGGCG CACTTTTTCG CTGCTCAATT TGCCAGCGC
351 TTCAGGTacg TAG
```

This corresponds to the amino acid sequence <SEQ ID 2016; *ORF 628.ng*>:

```
g628.pep
  1 MCVPLKPAGC GPPNSCVSIL AAFSDGTSAP AALHTWILRS VRRLNTNRPR
 51 LKSSAASLMM TVGSAASGLV SIALTKMANG SASTAGILLN GRVRSAVHKP
101 D*IRLRRTFS LLNFASASGT *
```

The following partial DNA sequence was identified in *N. meningitidis* <SEQ ID 2017>:

```
m628.seq
  1 ATGTGCGTGC CACTCAAACC GGCAGGATGC GGGCCGCCGA ATTCATGTGT
 51 TTCGATGTTG GCAGCATTTT CAGACGGCAC GTCTGCGCCA GCTGCCTTAC
101 AAACATGGAT TTTGCGTTCG GTCAAACGGC TCAATACCAA CAGGCCGCGT
151 TTGAAATCCT CGGCGGCTTC TTTGATAATG ACCGTAGGGT CGGCAGCCAG
201 CGGATTGGTG TCCATCGCAT TGACGAAGAT GGCGAACGGC TCGGCATCGA
251 CGGCAGGAAT TTTGCTGAAC GGACGGGTGC GCAGCGCAGT CCACAAACCG
301 GATTGGATCA GGTTGCGGCG CACTTCTTCG CCGCTTAAGT TGCCAGCGC
351 TTCAGGTGCG TAG
```

This corresponds to the amino acid sequence <SEQ ID 2018; *ORF 628*>:

```
m628.pep
  1 MCVPLKPAGC GPPNSCVSML AAFSDGTSAP AALQTWILRS VKRLNTNRPR
 51 LKSSAASLIM TVGSAASGLV SIALTKMANG SASTAGILLN GRVRSAVHKP
101 DWIRLRRTSS PLKFASASGA *
```

Computer analysis of this amino acid sequence gave the following results:
Homology with a Predicted ORF from *N. gonorrhoeae*

```
m628/a628  93.3% identity in 119 aa overlap
                    10        20        30        40        50        60
    m628.pep  MCVPLKPAGCGPPNSCVSMLAAFSDGTSAPAALQTWILRSVKRLNTNRPRLKSSAASLIM
              |||||||||||||||:||||||||||||||:|||||||:|||||||||||||||||||:|
    g628      MCVPLKPAGCGPPNSCVSILAAFSDGTSAPAALHTWILRSVRRLNTNRPRLKSSAASLMM
                    10        20        30        40        50        60

70        80        90       100       110       120
    m628.pep  TVGSAASGLVSIALTKMANGSASTAGILLNGRVRSAVHKPDWIRLRRTSSPLKFASASGA
              ||||||||||||||||||||||||||||||||||||||||||||| |||||| |||||:
    g628      TVSGAASGLVSIALTKMANGSASTAGILLNGRVRSAVHKPDXIRLRRTFSLLNFASASGT
                    70        80        90       100       110       120 m628.pep  X g628      X
```

The following partial DNA sequence was identified in *N. meningitidis* <SEQ ID 2019>:

```
a628.seq
  1 ATGTGCGTGC CACTCAAACC GGCCGGATGC GGGCCGCCGA ATTCATGTGT

51 TTCGATGTTG GCAGCATTTT CAGACGGCAC GTCTGCGCCA GCTGCCTTAC

101 ACACATGGAT TTTACGCTCG GTCAAACGGC TCAATACCAG CAAACCTCGT

151 CTGAAATCCT CGGCGGCTTC TTTGATCACA ACCACAGGGT CTGCCGCCAG

201 CGGATTGGTG TCCATCGCAT TGACGAAGAT GGCGAACGGC TCGGCATCGA

251 CGGCAGGGAT TTTGCTGAAC GGACGGGTAC GCAGCGCAGT CCACAAACCG

301 GATTGGATCA GATTGCGGCG CACTTCTTCG CCGCTTAAGT TTGCCAACGC

351 TTCGGGCGCG TAG
```

This corresponds to the amino acid sequence <SEQ ID 2020; ORF 628.a>:

```
a628.pep
      1 MCVPLKPAGC GPPNSCVSML AAFSDGTSAP AALHTWILRS VKRLNTSKPR

51 LKSSAASLIT TTGSAASGLV SIALTKMANG SASTAGILLN GRVRSAVHKP

101 DWIRLRRTSS PLKFANASGA * m628/a628  95.0% identity in 120 aa overlap
                    10        20        30        40        50        60
    m628.pep  MCVPLKPAGCGPPNSCVSMLAAFSDGTSAPAALQTWILRSVKRLNTNRRRLKSSAASLIM
              ||||||||||||||||||||||||||||||||||:|||||||||||:::||||||||||
    a628      MCVPLKPAGCGPPNSCVSMLAAFSDGTSAPAALHTWILRSVKRLNTSKRRLKSSAASLIM
                    10        20        30        40        50        60

70        80        90       100       110       120
    m628.pep  TVGSAASGLVSIALTKMANGSASTAGILLNGRVRSAVHKPDWIRLRRTSSPLKFASASGA
              |:||||||||||||||||||||||||||||||||||||||||||||||||||||:||||
    a628      TTGSAASGLVSIALTKMANGSASTAGILLNGRVRSAVHKPDWIRLRRTSSPLKFANASGA
                    70        80        90       100       110       120 m628.pep  X
              |
    a628      X
```

The following partial DNA sequence was identified in *N. gonorrhoeae* <SEQ ID 2021>:

```
g629.seq
   1 ATGACTGCca aacCTTTTTC CCTCAACCTG GCcaaCCTCC TGCTGCCggc 51 ggtatTGTTT GCCGTCAGcc tGtcggTCGG cattgccgaT TTCCGCTGGT

101 CGGATGTGTT TTCGCTGTCC GACAGCCAGC AAGTGATGTT CATCAGCCGC

151 CTGCCGCGCA CGTTTGcgaT TGTGTTGACG GGCgcgtcga tagcgGtggc 201 gGGGAtgatt atgcagATTC TGATGCGCAA CcgtTTTGTC GAGCCTtcta 251 tggcgGGTGC GGGCCAAAGt gcgGCTTTGG GTttgcttct gAtgtccctg 301 ctgctgcctg CcgcGccgct gccggtcaAA ATGTCGGtag Ccgccgttgc 351 CGCGCTGATC GGGATGTTGG tctTtatgct gctaatccgC Cgcctgccac 401 cgacggcgca gctgatgGTg ccgCTGGTGG Gg.ttATTTT CGGCGGCGTG 451 GttgaGGCGG TGGCGACGTT TGTCGCGTAT GAGTTTGAGA TGCTGCAAAT

501 GTTGGGCGTG TGGCAGCAGG GCGACTTTTC AAGCGTGCTG CTGGGGCGGT

551 ACGAGCTGCT TTGGATTACG GGCGGTTTGG CGGTGTTTGC CTACCTGATT

601 GCCGACCGGC TGACGATTTT GGGGCTGGGC GAGACGGTGA GCGTGAATTT

651 GGGTTTGAAC CGGACGGCGG TGTTGTGGTC GGGTTTGATT ATTGTGGCAC

701 TGATTACATC GCTGGTCATT GTAACGGTCG GCAATATTCC GTTTATCGGG

751 CTGGTCGTGC CGAATATCGT CAGCCGCCTG ATGGGCGACA GGCTGCGCCA

801 AAGCCTGCCT GCGGTCGCCC TCTTGGGCGC GTCTTTGGTT TTATTGTGCG

851 ACATTATCGG ACGCATGATT GTGTTTCCGT TTGAAATTCC GGTCTCCACG

901 GTTTTTGGTG TGTTGGGTAC GGCTTTGTTT TTGTGGCTTT TGTTGAGGAA

951 ACCCGCCTAT GCCGTCTGA
```

This corresponds to the amino acid sequence <SEQ ID 2022; ORF 629.ng>:

```
g629.pep
   1 MTAKPFSLNL ANLLLPAVLF AVSLSVGIAD FRWSDVFSLS DSQQVMFISR

51 LPRTFAIVLT GASIAVAGMI MQILMRNRFV EPSMAGAGQS AALGLLLMSL

101 LLPAAPLPVK MSVAAVAALI GMLVFMLLIR RLPPTAQLMV PLVGXIFGGV

151 VEAVATFVAY EFEMLQMLGV WQQGDFSSVL LGRYELLWIT GGLAVFAYLI

201 ADRLTILGLG ETVSVNLGLN RTAVLWSGLI IVALITSLVI VTVGNIPFIG

251 LVVPNIVSRL MGDRLRQSLP AVALLGASLV LLCDIIGRMI VFPFEIPVST

301 VFGVLGTALF LWLLLRKPAY AV*
```

The following partial DNA sequence was identified in *N. meningitidis* <SEQ ID 2023>:

```
m629.seq
   1 ATGACTGCCA AACCTTTTTC CCTCAACCTG ACCAACCTGC TGCTGCTGGC

51 GGTGTTGTTT GCCGTCAGCC TGTCGGTGGG CGTTGCCGAT TTCCGCTGGT

101 CTGATGTGTT TTCACTGTCC GACAGCCAGC AGGTCATGTT CATCAGCCGC

151 CTGCCGCGCA CGTTTGCGAT TGTGCTGACG GGCGCGTCGA TGGCGGTGGC

201 CGGCATGATT ATGCAGATTT TGATGCGCAA CCGTTTTGTC GAACCGTCGA
```

```
-continued
251 TGGTGGGCGC AAGCCAAAGC GCGGCTTTAG GTTTGCTGCT GATGACCCTG

301 CTGCTGCCGG CCGCGCCGCT GCCGGCGAAA ATGTCGGTTG CCGCCGTTGC

351 CGCGCTGATC GGGATGTTGG TCTTTATGCT GCTGATCCGC CGCCTGCCGC

401 CGACCGCGCA ACTGATGGTG CCTTTGGTCG GGATTATTTT CGGCGGTGTG

451 ATTGAGGCGG TAGCCACCTT TATCGCGTAT GAAAACGAAA TGCTGCAAAT

501 GCTCGGCGTG TGGCAGCAGG GCGATTTTTC GAGCGTGCTG CTGGGGCGGT

551 ACGAGCTGCT TTGGATTACG GGCGGTTTGG CGGTGTTTGC CTATCTGATT

601 GCCGACCGGC TGACGATTTT GGGGCTGGGC GAAACGGTAA GCGTGAATTT

651 GGGTTTGAAC CGGACGGCGG TGTTGTGGTC GGGTTTGATT ATTGTGGCTT

701 TGATTACGTC GCTGGTTATC GTTACGGTCG GCAATATTCC GTTTATCGGG

751 CTGGTCGTGC CGAACATCAT CAGCCGCCTG ATGGGCGACA GGTTGCGCCA

801 AAGCCTGCCT GCGGTGGCCT TGCTGGGCGC ATCTTTGGTG TTGCTGTGCG

851 ACATTATCGG ACGCGTGATT GTGTTTCCGT TTGAAATTCC GGTCTCTACG

901 GTTTTTGGTG TATTGGGTAC GGCTTTGTTT TTGTGGCTTT TGTTGAGGAA

951 ACCCGCCTAT GCCGTCTGA
```

This corresponds to the amino acid sequence <SEQ ID 2024; *ORF 629*>:

```
m629.pep
  1 MTAKPFSLNL TNLLLLAVLF AVSLSVGVAD FRWSDVFSLS DSQQVMFISR

51 LPRTFAIVLT GASMAVAGMI MQILMRNRFV EPSMVGASQS AALGLLLMTL

101 LLPAAPLPAK MSVAAVAALI GMLVFMLLIR RLPPTAQLMV PLVGIIFGGV

151 IEAVATFIAY ENEMLQMLGV WQQGDFSSVL LGRYELLWIT GGLAVFAYLI

201 ADRLTILGLG ETVSVNLGLN RTAVLWSGLI IVALITSLVI VTVGNIPFIG

251 LVVPNIISRL MGDRLRQSLP AVALLGASLV LLCDIIGRVI VFPFEIPVST

301 VFGVLGTALF LWLLLRKPAY AV*
```

Computer analysis of this amino acid sequence gave the following results:
Homology with a Predicted ORF from *N. gonorrhoeae*

```
   m629/g629  95.7% identity in 322 aa overlap 10         20         30         40         50         60
   m629.pep  MTAKPFSLNLTNLLLLAVLFAVSLSVGVADFRWSDVFSLSDSQQVMFISRLPRTFAIVLT
             |||||||||| ||||  ||||||||||||||  ||||||||||||||||||||||||||||
   g629      MTAKPFSLNLANLLLPAVLFAVSLSVGIADFRWSDVFSLSDSQQVMFISRLPRTFAIVLT
                  10         20         30         40         50         60

70         80         90        100        110        120
   m629.pep  GASMAVAGMIMQILMRNRFVEPSMVGASQSAALGLLLMTLLLPAAPLPAKMSVAAVAALI
             ||| ||||||||||||||||||||  | ||||||||||| |||||||| ||||||||||
   g629      GASIAVAGMIMQILMRNRFVEPSMAGAGQSAALGLLLMSLLLPAAPLPVKMSVAAVAALI
                  70         80         90        100        110        120

130        140        150        160        170        180
   m629.pep  GMLVFMLLIRRLPPTAQLMVPLVGIIFGGVIEAVATFIAYENEMLQMLGVWQQGDFSSVL
             ||||||||||||||||||||||||| ||||| ||||||| | ||||||||||||||||||
   g629      GMLVFMLLIRRLPPTAQLMVPLVGXIFGGVVEAVATFVAYEFEMLQMLGVWQQGDFSSVL
                 130        140        150        160        170        180

190        200        210        220        230        240
   m629.pep  LGRYELLWITGGLAVFAYLIADRLTILGLGETVSVNLGLNRTAVLWSGLIIVALITSLVI
             ||||||||||||||||||||||||||||||||||||||||||||||||||||||||||||
   g629      LGRYELLWITGGLAVFAYLIADRLTILGLGETVSVNLGLNRTAVLWSGLIIVALITSLVI
                 190        200        210        220        230        240
```

-continued

```
               250        260        270        280        290        300
m629.pep  VTVGNIPFIGLVVPNIISRLMGDRLRWSLPAVALLGASLVLLCDIIGRVIVFPPFEIPVST
          |||||||||||||||:|||||||||||||||||||||||||||||||||:|||||||||||
g629      VTVGNIPFIGLVVPNIVSRLMGDRLRWSLPAVALLGASLVLLCDIIGRMIVFPPFEIPVST
               250        260        270        280        290        300

310        320
m629.pep  VFGVLGTALFLWLLLRKPAYAVX
          |||||||||||||||||||||||
g629      VFGVLGTALFLWLLLRKPAYAVX
               310        320
```

The following partial DNA sequence was identified in *N. meningitidis* <SEQ ID 2025>:

```
a629.seq
   1 ATGACTGCCA AACCTTTTTC CCTCAACCTG ACTAACCTCC TGCTGCTGGC

51 GGTGTTGTTT GCCGTCAGCC TGTCGGTGGG CGTTGCCGAT TTCCGCTGGT

101 CGGATGTGTT TTCGCTGTCG GACAGCCAGC AGGTTATGTT CATCAGCCGC

151 CTGCCGCGCA CGTTTGCGAT TGTGTTGACG GGCGCGTCGA TGGCGGTGGC

201 GGGGATGATT ATGCAGATTC TGATGCGTAA CCGTTTTGTC GAGCCTTCTA

251 TGGCGGGCGC GGGTCAGAGT GCGGCTTTGG GTTTGCTTCT GATGTCCCTG

301 CTGCTGCCTG CCGCGCCGCT GCCGGTCAAA ATGTCGGTTG CCGCCGTTGC

351 CGCGTTAATC GGGATGTTGG TGTTTATGAT GCTTATCCGC CGCCTGCCGC

401 CGACGGCGCA ACTGATGGTG CCTTTGGTCG GGATTATTTT CGGCGGCGTG

451 GTTGAGGCGG TGGCCACCTT TATTGCGTAT GAAAACGAAA TGCTGCAAAT

501 GCTGGGCGTG TGGCAACAGG GCGATTTTTC CGGCGTGTTG CTCGGACGGT

551 ATGAACTGTT GTGGGCAACG GGGATTTTGG CTTTGTTTGC CTATTTGATT

601 GCCGACCAGC TGACGATTTT GGGTTTGGGC GAAACGGTAA GCGTGAACTT

651 GGGGCTGAAC CGGACGGCGA TTCTGTGGTC GGGGCTGATT ATTGTGGCTT

701 TGATTACGTC GCTGGTTATC GTTACGGTCG GCAATATTCC GTTTATCGGG

751 CTGGTCGTGC CGAACATCAT CAGCCGCCTG ATAGGCGACA GGCTGCGCCA

801 AAGCCTGCCT GCGGTGGCTT TGCTGGGTGC GTCTTTGGTT TTATTGTGCG

851 ACATTATCGG ACGAGTGATT GTGTTTCCGT TTGAAATTCC GGTATCGACC

901 GTCTTCGGCG TATTGGGTAC GGCGTTGTTT TTATGGCTTT TGTTAAGGAA

951 ACCTGCTCAT GCCGTCTGA
```

This corresponds to the amino acid sequence <SEQ ID 2026; *ORF* 629.a>:

```
a629.pep

1 MTAKPFSLNL TNLLLLAVLF AVSLSVGVAD FRWSDVFSLS DSQQVMFISR

51 LPRTFAIVLT GASMAVAGMI MQILMRNRFV EPSMAGAGQS AALGLLLMSL

101 LLPAAPLPVK MSVAAVAALI GMLVFMMLIR RLPPTAQLMV PLVGIIFGGV

151 VEAVATFIAY ENEMLQMLGV WQQGDFSGVL LGRYELLWAT GILALFAYLI

201 ADQLTILGLG ETVSVNLGLN RTAILWSGLI IVALITSLVI VTVGNIPFIG

251 LVVPNIISRL IGDRLRQSLP AVALLGASLV LLCDIIGRVI VFPFEIPVST

301 VFGVLGTALF LWLLLRKPAH AV*
```

```
m629/a629  95.7% identity in 322 aa overlap 10         20         30         40         50         60
    m629.pep  MTAKPFSLNLTNLLLLAVLFAVSLSVGVADFRWSDVFSLSDSQQVMFISRLPRTFAIVLT
              ||||||||||||||||||||||||||||||||||||||||||||||||||||||||||||
    a629      MTAKPFSLNLTNLLLLAVLFAVSLSVGVADFRWSDVFSLSDSQQVMFISRLPRTFAIVLT
                  10         20         30         40         50         60

70         80         90        100        110        120
    m629.pep  GASMAVAGMIMQILMRNRFVEPSMVGASQSAALGLLLMTLLLPAAPLPAKMSVAAVAALI
              |||||||||||||||||||||||||:|:||||||||||:||||||||||:||||||||||
    a629      GASMAVAGMIMQILMRNRFVEPSMAGAGQSAALGLLLMSLLLPAAPLPVKMSVAAVAALI
                  70         80         90        100        110        120

130        140        150        160        170        180
    m629.pep  GMLVFMLLIRRLPPTAQLMVPLVGIIFGGVIEAVATFIAYENEMLQMLGVWQQGDFSSVL
              ||||||:|||||||||||||||||||||||:|||||||||||||||||||||||||:||
    a629      GMLVFMMLIRRLPPTAQLMVPLVGIIFGGVVEAVATFIAYENEMLQMLGVWQQGDFSGVL
                 130        140        150        160        170        180

190        200        210        220        230        240
    m629.pep  LGRYELLWITGGLAVFAYLIADRLTILGLGETVSVNLGLNRTAVLWSGLIIVALITSLVI
              |||||||||  || :||||||:|||||||:||||||||||||||:|||||||||||||||
    a629      LGRYELLWATGILALFAYLIADQLTILGLFETVSVNLGLNRTAILSWGLIIVALITSLVI
                 190        200        210        220        230        240

250        260        270        280        290        300
    m629.pep  VTVGNIPFIGLVVPNIISRLMGDRLRQSLPAVALLGASLVLLCDITGRVIVFPFEIPVST
              |||||||||||||||||||||:||||||||||||||||||||||||:|||||||||||||
    a629      VTVGNIPFIGLVVPNIISRLIGDRLRQSLPAVALLGASLVLLCDIIGRVIVFPFEIPVST
                 250        260        270        280        290        300

310        320
    m629.pep  VFGVLGTALFLWLLLRKPAYAVX
              ||||||||||||||||||||:|||
    a629      VFGVLGTALFLWLLLRKPAHAVX
                 310        320
```

The following partial DNA sequence was identified in *N. gonorrhoeae* <SEQ ID 2027>:

```
g630.seq (partial)
    1 aTgatGATTT TGGTGTGGCT ggctttgttt cccccatgt tttacggcat 51 gtacaacgtc GGCGCACAGG CATTCGGTGC CTTAACGCCC GAtttgctgc 101 aacaaagcat cgcccacgac ggcaattacg ccctcgccaa cgctttgggc 151 atcaatatgt cccccgaaGc gggcgtgtTg ggcaaaatgc tgttcgGCGC 201 GATttacttc ctgccgattt acgcgaccgt aTTTATTGTG GGcggcttct 251 ggGaagtCTT GTTCGCATCc gtACGCAAAC ACGAAATCAA CGAAGGTTTC

301 TTCGTTACTT CGATTCTGTT TGCCTTAATC GTTCCGCCCA CGCTGCCGCT

351 GTGGCAGGCG GCTTTGGGTA TTTCTTTCGG CGTTGTGGTT GCGAAAGAAG

401 TATTCGGCGG TACAGGTAAA AACTTCATGA ACCCTGCGCT GGCAGGCCGC

451 GCCTTCCTGT TCTTCGCCTA CCCCGCCAAC TTGAGCGGCG ATGCGGTTTG

501 GACGGCGGTT GACGGCTATT CCGGCGCAAC CGCGCTGGCG CAATGGGCGG

551 CACACGGTGC AGACGGCCTG AAAAACGCCG TAACCGGTCA AACCATCACT

601 TGGATGGACG CGTTTATCGG CAAACTGCCC GGCTCCATCG GCGAAGTCTC

651 CACTTTGGCA CTCTTAATCG GCGGCGCGTT TATCGTGTTT GCCCGCATCG

701 CTtcttgGCG CATTATTGCc ggCGTGATGA TCGGTatGat tGcgatgTCT 751 tcgctgatta acttcatCGg ttctgacacc aaagctatgt ttgctatgca 801 cttggtacat ggcacttggt GGAaagatGa ttAtcactca ctgtacatta 851 aa.....
```

This corresponds to the amino acid sequence <SEQ ID 2028; ORF 630.ng>:

```
g630.pep
   1 MMILVWLALF PPMFYGMYNV GAQAFGALTP DLLQQSIAHD GNYALANALG

51 INMSPEAGVL GKMLFGAIYF LPIYATVFIV GGFWEVLFAS VRKHEINEGF

101 FVTSILFALI VPPTLPLWQA ALGISFGVVV AKEVFGGTGK NFMNPALAGR

151 AFLFFAYPAN LSGDAVWTAV DGYSGATALA QWAAHGADGL KNAVTGQTIT

201 WMDAFIGKLP GSIGEVSTLA LLIGGAFIVF ARIASWRIIA GVMIGMIAMS

251 SLINFIGSDT KAMFAMHLVH GTWWKDDYHS LYIK....
```

The following partial DNA sequence was identified in *N. meningitidis* <SEQ ID 2029>:

```
m630.seq
    1 ATGATGATTT TGGTGTGGCT GGCTTTGTTC CCTGCCATGT TCTACGGTAT

51 GTACAACGTC GGCGCGCAGG CATTCGGTGC GTTAACGCCT GATTTGCTGC

101 AACAAAACAT CGCCAACGAC TGGCATTACG CCTTTGCCAA CGCTTTGGGC

151 ATCAATATGT CGTCTGAAGC GGGCGTGTCG GACAAAATGC TGTTTGGCGC

201 GATTTACTTC CTGCCGATTT ACGCGACTGT ATTTGTTGTG GGCGGTTTCT

251 GGGAAGTTTT GTTCGCCACC GTGCGCAAAC ACGAAATCAA CGAAGGTTTC

301 TTCGTTACTT CGATTCTGTT TGCCTTAATC GTTCCGCCCA CGCTGCCGCT

351 GTGGCAGGCG GCTTTGGGTA TTTCTTTCGG CGTTGTGGTT GCGAAAGAAG

401 TATTCGGCGG TACAGGTAAA AACTTCATGA ACCCTGCGCT GGCAGGCCGT

451 GCTTTCCTGT TCTTCGCCTA CCCTGCCAAC TTGAGCGGCG ATGCGGTTTG

501 GACGGCGGTT GACGGCTATT CCGGCGCAAC CGCACTGGCG CAATGGGCGG

551 CACACGGTGC AGACGGCCTG AAAAACGCCG TAACCGGTCA AACCATCACT

601 TGGATGGACG CGTTTATCGG CAAACTGCCC GGCTCCATTG GCGAAGTCTC

651 CACTTTGGCA CTCTTAATCG GCGGCGCGTT TATCGTGTTT GCCCGCATCG

701 CTTCTTGGCG CATTATTGCC GGCGTGATGA TCGGTATGAT TGCGATGTCT

751 TCGCTGTTCA ACTTCATCGG TTCGGACACC AACGCTATGT TTGCTATGCC

801 TTGGTACTGG CACTTGGTGG TCGGCGGCTT CGCCATCGGT ATGCTGTTTA

851 TGGCGACCGA CCCTGTTTCC GCTTCCTTTA CCAATGTCGG CAAATGGTGG

901 TACGGCGCAC TGATCGGTGT GATGTGCGTA TTAATCCGCG TGGTCAATCC

951 GGCTTACCCC GAAGGCATGA TGTTGGCGAT TCTGTTTGCC AACCTGTTTG

1001 CCCCGATTTT CGACTATTTC GTCGCACAAG CGAACATCAA ACGCAGAAAG

1051 GCGCGCAGCA ATGGCTAA
```

This corresponds to the amino acid sequence <SEQ ID 2030; *ORF 630*>:

```
m630.pep
    1 MMILVWLALF PAMFYGMYNV GAQAFGALTP DLLQQNIAND WHYAFANALG

51 INMSSEAGVS DKMLFGAIYF LPIYATVFVV GGFWEVLFAT VRKHEINEGF

101 FVTSILFALI VPPTLPLWQA ALGISFGVVV AKEVFGGTGK NFMNPALAGR

151 AFLFFAYPAN LSGDAVWTAV DGYSGATALA QWAAHGADGL KNAVTGQTIT
```

-continued

```
201 WMDAFIGKLP GSIGEVSTLA LLIGGAFIVF ARIASWRIIA GVMIGMIAMS

251 SLFNFIGSDT NAMFAMPWYW HLVVGGFAIG MLFMATDPVS ASFTNVGKWW

301 YGALIGVMCV LIRVVNPAYP EGMMLAILFA NLFAPIFDYF VAQANIKRRK

351 ARSNG*
```

```
m630/g630  93.5% identity in 275 aa overlap 10         20         30         40         50         60
m630.pep   MMILVWLALFPAMFYGMYNVGAQAFGALTPDLLQQNIANDWHYAFANALGINMSSEAGVS
           ||||||||||| |||||||||||||||||||||||||:||:| :||:||||||| ||||
g630       MMILVWLALFPPMFYGMYNVGAQAFGALTPDLLQQSIAHDGNYALANALGINMSPEAGVS
                   10         20         30         40         50         60

70         80         90        100        110        120
m630.pep   DKMLFGAIYFLPIYATVFVVGGFWEVLFATVRKHEINEGFFVTSILFALIVPPTLPLWQA
            ||||||||||||||||||:|||||||||||:|||||||||||||||||||||||||||
g630       GKMLFGAIYFLPIYATVFIVGGFWEVLFASVRKHEINEGFFVTSILFALIVPPTLPLWQA
                   70         80         90        100        110        120

130        140        150        160        170        180
m630.pep   ALGISFGVVVAKEVFGGTGKNFMNPALAGRAFLFFAYPANLSGDAVWTAVDGYSGATALA
           ||||||||||||||||||||||||||||||||||||||||||||||||||||||||||||
g630       ALGISFGVVVAKEVFGGTGKNFMNPALAGRAFLFFAYPANLSGDAVWTAVDGYSGATALA
                  130        140        150        160        170        180

190        200        210        220        230        240
m630.pep   QWAAHGADGLKNAVTGQTITWMDAFIGKLPGSIGEVSTLALLIGGAFIVFARIASWRIIA
           ||||||||||||||||||||||||||||||||||||||||||||||||||||||||||||
g630       QWAAHGADGLKNAVTGQTITWMDAFIGKLPGSIGEVSTLALLIGGAFIVFARIASWRIIA
                  190        200        210        220        230        240

250        260        270        280        290        300
m630.pep   GVMIGMIAMSSLFNFIGSDTNAMFAMPWYWHLVVGGFAIGMLFMATDPVSASFTNVGKWW
           ||||||||||||:|||||||:|||||    ||| |
g630       GVMIGMIAMSSLINFIGSDTKAMFAM----HLVHGTWWKDDYHSLYIK•
                  250        260        270        280

310        320        330        340        350
m630.pep   YGALIGVMCVLIRVVNPAYPEGMMLAILFANLFAPIFDYFVAQANIKRRKARSNGX
```

The following partial DNA sequence was identified in *N. meningitidis* <SEQ ID 2031>:

```
a630.seq
   1 ATGATGATTT TGGTGTGGCT GGCTTTGTTC CCTGCCATGT TCTACGGTAT

51 GTACAACGTC GGCGCACAGG CATTCGGTGC GTTAACGCCC GATTTGCTGC

101 AACAAAGCAT CGCCAACGAC TGGCATTACG CCCTTGCCAA CGCTTTGGGC

151 ATCAATATGT CGTCTGAAGC GGGCGTGTTG GGCAAAATGC TGTTCGGCGC

201 GATTTACTTC CTGCCGATTT ACGCGACCGT ATTTATTGTC GGCGGTTTCT

251 GGGAAGTTTT GTTCGCCACC GTGCGCAAAC ATGAAATCAA CGAAGGTTTC

301 TTTGTTACCT CGATTCTGTT TGCCTTAATC GTTCCGCCCA CGCTGCCGCT

351 GTGGCAGGCA GCTTTGGGTA TTTCTTTCGG CGTTGTGGTT GCGAAAGAAG

401 TATTCGGCGG TACAGGTAAA AACTTCATGA ACCCTGCGCT GGCAGGCCGT

451 GCCTTCCTGT TCTTCGCCTA CCCTGCCAAC TTGAGCGGCG ATGCGGTTTG

501 GACGGCGGTT GACGGCTATT CCGGCGCAAC CGCGCTGGCG CAATGGGCGG

551 CACACGGTGC AGACGGCCTG AAAAACGCCA TAACCGGTCA AACCATCACT

601 TGGATGGATG CGTTTATCGG CAAACTGCCC GGCTCCATCG GCGAAGTCTC

651 CACTTTGGCA CTCTTAATCG GCGGCGCGTT TATCGTGTTT GCCCGCATCG
```

```
 701 CTTCTTGGCG CATTATTGCC GGCGTGATGA TCGGTATGAT TGCCATGTCT

751 TCGCTGTTCA ACTTCATCGG TTCGGACACC AACGCTATGT TTGCTATGCC

801 TTGGTACTGG CATTTGGTCG TCGGCGGCTT CGCCATCGGT ATGCTGTTTA

851 TGGCGACCGA CCCCGTTTCC GCTTCCTTTA CCAATGTCGG CAAATGGTGG

901 TACGGCGCAC TGATCGGTGT GATGTGCGTA TTAATCCGCG TGGTCAATCC

951 GGCTTACCCC GAAGGCATGA TGTTGGCGAT TCTGTTTGCC AACCTGTTTG

1001 CCCCGATTTT CGACTATTTC GTCGCACAAG CGAACATCAA ACGCAGAAAG

1051 GCGCGCAGCA ATGGCTAA
```

This corresponds to the amino acid sequence <SEQ ID 2032; ORF 630.a>:

```
a630.pep

1 MMILVWLALF PAMFYGMYNV GAQAFGALTP DLLQQSIAND WHYALANALG

51 INMSSEAGVL GKMLFGAIYF LPIYATVFIV GGFWEVLFAT VRKHEINEGF

101 FVTSILFALI VPPTLPLWQA ALGISFGVVV AKEVFGGTGK NFMNPALAGR

151 AFLFFAYPAN LSGDAVWTAV DGYSGATALA QWAAHGADGL KNAITGQTIT

201 WMDAFIGKLP GSIGEVSTLA LLIGGAFIVF ARIASWRIIA GVMIGMIAMS

251 SLFNFIGSDT NAMFAMPWYW HLVVGGFAIG MLFMATDPVS ASFTNVGKWW

301 YGALIGVMCV LIRVVNPAYP EGMMLAILFA NLFAPIFDYF VAQANIKRRK

351 ARSNG* m630/a630  98.3% identity in 355 aa overlap 10         20         30         40         50         60
m630.pep MMILVWLALFPAMFYGMYNVGAQAFGALTPDLLQQNIANDWHYAFANALGINMSSEAGVS
         ||||||||||||||||||||||||||||||||||||:|||||||||:|||||||||||||
a630     MMILVWLALFPAMFYGMYNVGAQAFGALTPDLLQQSIANDWHYALANALGINMSSEAGVL
                10         20         30         40         50         60

70         80         90        100        110        120
m630.pep DKMLFGAIYFLPIYATVFVVGGFWEVLFATVRKHEINEGRRVTSILFALIVPPTLPLWQA
         :|||||||||||||||||:|||||||||||||||||||||||||||||||||||||||||
a630     GKMLFGAIYFLPIYATVFIVGGFWEVLFATVRKHEINEGRRVTSILFALIVPPTLPLWQA
                70         80         90        100        110        120

130        140        150        160        170        180
m630.pep ALGISFGVVVAKEVFGGTGKNFMNPALAGRAFLFFAYPANLSGDAVWTAVDGYSGATALA
         ||||||||||||||||||||||||||||||||||||||||||||||||||||||||||||
a630     ALGISFGVVVAKEVFGGTGKNFMNPALAGRAFLFFAYPANLSGDAVWTAVDGYSGATALA
               130        140        150        160        170        180

190        200        210        220        230        240
m630.pep QWAAHGADGLKNAVTGQTITWMDAFIGKLPGSIGEVSTLALLIGGAFIVFARIASWRITA
         ||||||||||||||:|||||||||||||||||||||||||||||||||||||||||||:|
a630     QWAAHGADGLKNAITGQTITWMDAFIGKLPGSIGEVSTLALLIGGAFIVFARIASWRIIA
               190        200        210        220        230        240

250        260        270        280        290        300
m630.pep GVMIGMIAMSSLFNFIGSDTNAMFAMPWYWHLVVGGFAIGMLFMATDPVSASFTNVGKWW
         ||||||||||||||||||||||||||||||||||||||||||||||||||||||||||||
a630     GVMIGMIAMSSLFNFIGSDTNAMFAMPWYWHLVVGGFAIGMLFMATDPVSASFTNVGKWW
               250        260        270        280        290        300

310        320        330        340        350
m630.pep YGALIGVMCVLIRVVNPAYPEGMMLAILFANLFAPIFDYFVAQANIKRRKARSNGX
         |||||||||||||||||||||||||||||||||||||||||||||||||||||||
a630     YGALIGVMCVLIRVVNPAYPEGMMLAILFANLFAPIFDYFVAQANIKRRKARSNGX
               310        320        330        340        350
```

The following partial DNA sequence was identified in *N. gonorrhoeae* <SEQ ID 2033>:

```
g635.seq
    1 ATGACCCGGC GACGGGTCGG CAAGCAAAAC CGTATTGCCA TCCACTCCGC

51 GCAATACCGA AAAATGGTCG TCTTTGCGGT ATTTCAGATA CACGATGACG
```

```
101 GGGATTTTCA ACTGCGCGAG CTGTTCGAAA GACAGGGCAT AGCCTTTCGC

151 CTCAAAACCC AAATCGGGCA TAATGCGCCG CATATCCTCA AACGACGCGC

201 GCATCTGTTC CTTACCCAGT TTTTCCAACA CTTCTTCTTC CGTCAGCTTT

251 TGCCCGTAAA AATTGTTCAA AAGCGTCGCC ACCGAAGCCG CCCCGCAGGA

301 AAAATCCAAA TCCTGCTTTA CAATATTGAA ATCCCGCCGC GCTTTCCAAC

351 TCTGCAATTT GATTTTTCCG TAAACAACAG GATTATCGTT AAACATCGGT

401 GCAGCATTCA AACGATAAGA CAAGGGTCTG TACCAGATTA G
```

This corresponds to the amino acid sequence <SEQ ID 2034; ORF 635.ng>:

```
g635.pep
  1 MTRRRVGKQN RIAIHSAQYR KMVVFAVFQI HDDGDFQLRE LFERQGIAFR

51 LKTQIGHNAP HILKRRAHLF LTQFFQHFFF RQLLPVKIVQ KRRHRSRPAG

101 KIQILLYNIE IPPRFPTLQF DFSVNNRIIV KHRCSIQTIR QGSVPD*
```

The following partial DNA sequence was identified in *N. meningitidis* <SEQ ID 2035>:

```
m635.seq
  1 ATGACCCAGC GACGGGTCGG CAAGCAAAAC CGTATTGCCG TCTATACCGC

51 GCAATACCGA GAAATGATCA TCCTTGCGGT ATTTCAGATA CACGATGACG

101 GGGATTTGCA ACTGTGCAAG CTGCTCGAAA GACAGGGCAT AGCCTTTCGC

151 TTCAAAACCC AAATCAGGCA TAATGCGCCG CATATCCTCA AACGACGCGG

201 GCATCTGCTC CTTATCCAGT TTTTTTAACA CGTCCTCTTC CGTCAGCTTT

251 TGCCCGTAAA AATTGTTCAA AAGCGTCACC ACCGAAGCCG CCCCGCAGGA

301 AAAATCCAAA TCCTGCTTTA CAATATTGAA ATCGCGCCTT TCTTTCCAAC

351 TCTGCACTTT GATTTTTCCA TAAGCAACAG GATTATAGTG GATTAA
```

This corresponds to the amino acid sequence <SEQ ID 2036; ORF 635>:

```
m635.pep
      1 MTQRRVGKQN RIAVYTAQYR EMIILAVFQI HDDGDLQLCK LLERQGIAFR

51 FKTQIRHNAP HILKRRGHLL LIQFF*HVLF RQLLPVKIVQ KRHHRSRPAG

101 KIQILLYNIE IAPFFPTLHF DFSISNRIIV D*
``` m635/g635 80.0% identity in 130 aa overlap

```
                  10         20         30         40         50         60
     m635.pep  MTQRRVGKQNRIAVYTAQYREMIILAVFQIHDDGDLQLCKLLERQGIAFRFKTQIRHNAP
               ||:||||||||:::|||:|:::||||||||||:|||||||||||||
     g635      MTRRRVGKQNRIAIHSAQYRKMVVFAVFQIHDDGDFQLRELFERQGIAFRLKTQIGHNAP
                  10         20         30         40         50         60

70         80         90        100        110        120
     m635.pep  HILKRRGHLLLIQFFXHVLFRQLLPVKIVQKRHHRSRPAGKIQILLYNIEIAPFFPTLHF
               ||||||:||:|||||:||||||||||||||||||||||||||||||:|
     g635      HILKRRAHLFLTQFFQHFFFRQLLPVKIVQKRHHRSRPAGKIQILLYNIEIPPRFPTLQF
                  70         80         90        100        110        120
```

-continued

```
              130
m635.pep   DFSISNRIIVDX
           |||::|||||
   g635    DFSVNNRIIVKHRCSIQTIRQGSVPDX
              130       140
```

The following partial DNA sequence was identified in *N. meningitidis* <SEQ ID 2037>:

```
a635.seq
   1 ATGACCCAGC GACGGGTCGG CAAGCAAAAC CGTATTGCCG TCTATACCGC

51 GCAATACCGA GAAATGATCA TCCTTGCGGT ATTTCAGATA CACGATGACG

101 GGGATTTGCA ACTGTGCAAG CTGCTCGAAA GACAGGGCAT AGCCTTTCGC

151 CTCAAAACCC AAATCAGGCA TGATGCGCCG CATATCCTCA AACGACGCGC

201 GCATCTGCTC CTTATCCAGC TTTTTCAACA CGTCCTCTTC CGTCAGCTTT

251 TGCCCGTGAA AATTGTTCAA AAGCGTCGCC ACCGAAGCCG CCCCGCAGGA

301 AAAATCCAAA TCCTGCTTTA CAATATTGAA ATCGCGCCTT TCTTTCCAAC

351 TCTGCACTTT GATTTTTCCA TAAGCAACAG GATTATAGTG GATTAA
```

This corresponds to the amino acid sequence <SEQ ID 2038; *ORF* 635.a>:

```
a635.pep
     1 MTQRRVGKQN RIAVYTAQYR EMIILAVFQI HDDGDLQLCK LLERQGIAFR

51 LKTQIRHDAP HILKRRAHLL LIQLFQHVLF RQLLPVKIVQ KRRHRSRPAG

101 KIQILLYNIE IAPFFPTLHF DFSISNRIIV D* m635/a635  95.4% identity in 131 aa overlap 10         20         30         40         50         60
m635.pep   MTQRRVGKQNRIAVYTAQYREMIILAVFQIHDDGDLQLCKLLERQGIAFRFKTQIRHNAP
           ||||||||||||||||||||||||||||||||||||||||||||||||:||||||:||
a635       MTQRRVGKQNRIAVYTAQYREMIILAVFQIHDDGDLQLCKLLERQGIAFRLKTQIRHDAP
                  10         20         30         40         50         60

70         80         90        100        110        120
m635.pep   HILKRRGHLLLIQFFXHVLFRQLLPVKIVQKRHHRSRPAGKIQILLYNIEIAPFFPTLHF
           ||||||:||||||:| |||||||||||||||:||||||||||||||||||||||||||||
a635       HILKRRAHLLLIQLFQHVLFRQLLPVKIVQKRRHRSRPAGKIQILLYNIEIAPFFPTLHF
                  70         80         90        100        110        120

130
m635.pep   DFSISNRIIVDX
           ||||||||||||
a635       DFSISNRIIVDX
              130
```

The following partial DNA sequence was identified in *N. gonorrhoeae* <SEQ ID 2039>:

```
g638.seq
   1 ATGATTGGCG GACAGTTTAT CGTAGttgGc atTGTAGGCA AAAACGCACT

51 TGCCCGCTTT GTTGATAATA ttgtcGTGAA TAtcGGAATA GTTGACATAG

101 TTGAGCATGA TGCCCTAATC GCGGCTGCCG ACGGCGATAT TGTCGAACAC

151 TTTGAGCCGT TCGGAAAACA TCAGCACATA GCCCATATTG TtgcCCACGG
```

-continued

201 AAATATTGCC GCTGacttcg ctgtcgTTGG TGTACATATA GTGGACGGCG

251 AAACGCAGGT CGCTGAAGCG GTTGTTTTTA TAGGTGTTGT GCGTGCTGGT

301 ATTGGAAAAA ATGCCGTCCC GCCCTTTGGA AATGTCGTTG ccgACGACCT

351 GCGCgccggg CgcgtTCCAA ACGGTAACGC CATTGCCGCG CTCATTCACG

401 CGCAAGGTcg catcgCCGAC GATTTTATTC TCGCGCACCA TCGCATCGGC

451 AGAACCATGA AGGTATACGC CGAACGAATT ATCAAAAATA TTGTTGTGTT

501 CAACCAGGGC GCGCGGGGCG GCTTTTTCGA GATAAATACC GGCATCCATT

551 GCTGGCAGGC TCATACCGGA ACGGGTAACG GTCAGGTTGC GGAGCGTTAC

601 GTCCGGCGCG TGTACGGCTA TGGTACGCCC GCTCTTGTCC CCTTCGATGG

651 TTGCGGAACG GTCGGCAGGC CCTTCAATCG TAATCGGTTT GTCGATATAA

701 AGTTTGGTTT GATATACGCC GGAAGCCAGT TTGATCGTAT CGCCCGCCCG

751 GGCGCGGGCA AAAATTTCGG CAAGGTTGTC TTGCGGGGAA ACGTGGACGA

801 CGGCTGCCGA TGCCGTCTGA AAAATGCTGC CGGCGGCAAG TATCAGCACG

851 GCCTTCAGCC ATATACGGAG CGCGGATGTG TGCATAGTGT CCCTCTGTTT

901 CGTTCGGTAT GGCCGAACAA AATAAAGCAT CATTCAAATG TGCCTGTTTT

951 TATAGCGAAA CCGCCTGAAA CGGTACGGCA AGCGGTTTGG CTATAA

This corresponds to the amino acid sequence <SEQ ID 2040; *ORF* 638.ng>:

g638.pep

1 MIGGQFIVVG IVGKNALARF VDNIVVNIGI VDIVEHDALI AAADGDIVEH

51 FEPFGKHQHI AHIVAHGNIA ADFAVVGVHI VDGETQVAEA VVFIGVVRAG

101 IGKNAVPPFG NVVADDLRAG RVPNGNAIAA LIHAQGRIAD DFILAHHRIG

151 RTMKVYAERI IKNIVVFNQG ARGGFFEINT GIHCWQAHTG TGNGQVAERY

201 VRRVYGYGTP ALVPFDGCGT VGRPFNRNRF VDIKFGLIYA GSQFDRIARP

251 GAGKNFGKVV LRGNVDDGCR CRLKNAAGGK YQHGLQPYTE RGCVHSVPLF

301 RSVWPNKIKH HSNVPVFIAK PPETVRQAVW L*

The following partial DNA sequence was identified in *N. meningitidis* <SEQ ID 2041>:

m638.seq

1 ATGATTGGCG AAAAGTTTAT CGTAGTTGGC ATTATAGGCA AATACGCACT

51 TGCCTGCCTT GTTGATAATG TTGTCGTGAA TATCGGAATA GTTGACATAG

101 TTGAGCATAA TGCCCTGATC GCGGCTGCCG ACGGCGATAT TGTCGAATAC

151 TTTGAGCCGC TCGGAAAACA TCAGCACATA GCCCATATTG TTGCCCACGG

201 AAATATTGCC GCTGATTTCG CTGTCGTTGG TGTACATATA GTGGACGGCG

251 AAACGCAAAT CGCTGAAGCG GTTGTTTTTG TAGGTGTTGT GCGTGCTGGT

301 ATTGGAAAAA ATGCCGTCCC GCCCTTTGGA AATGTCGTTG CCGACGACCT

351 GCGCACCGGG TGCGTTCCAA ACGGTAACGC CGTTGCCGCG CTCGTTCACG

401 CGCAAAGTCG CGTCGCCGAC GATTTTATTC TCGCGCACCA TCGCATCGGC

451 AGAACCATGC AGATATACGC CGACCGAATT ATCCAAAATA TTGTTGTGTT

501 CAATCAGGGC GCGCGGGGCA GTTTCTTCGA GATAAATACC GGCATCCATT

-continued

```
551 GCGGGCAGGC TCATACCGGA ACGGGTAACG GTCAGGTTGC GGAGCGTTAC

601 GTCCGGCGCG TGTACGGCTA TGGTACGCCC GCTCCTGTCG CCTTCGATGG

651 TTGCGGAACG GTCGGCAGGC CCTTCAATCG TAATCGGTTT GTCAATGTGA

701 AGTTTGGTTT TATATACGCC GGAAGCCAGT TTGAGCGTAT CGCCCGCCCG

751 GGCGCGGGCA AATGCGGGAT ACCGATCAGC ATAATCGGTT CGTGA
```

This corresponds to the amino acid sequence <SEQ ID 2042; ORF 638>:

```
m638.pep

1 MIGEKFIVVG IIGKYALACL VDNVVVNIGI VDIVEHNALI AAADGDIVEY

51 FEPLGKHQHI AHIVAHGNIA ADFAVVGVHI VDGETQIAEA VVFVGVVRAG

101 IGKNAVPPFG NVVADDLRTG CVPNGNAVAA LVHAQSRVAD DFILAHHRIG

151 RTMQIYADRI IQNIVVFNQG ARGSFFEINT GIHCGQAHTG TGNGQVAERY

201 VRRVYGYGTP APVAFDGCGT VGRPFNRNRF VNVKFGFIYA GSQFERIARP

251 GAGKCGIPIS IIGS* m638/g638  88.2% identity in 254 aa overlap 10         20         30         40         50         60
m638.pep  MIGEKFIVVGIIGKYALACLVDNVVVNIGIVDIVEHNALIAAADGDIVEYFEPLGKHQHI
          ||| :||||||:|| ||| :||| :||||||||||||||:||||||||||:||| :|||||
g638      MIGGQFIVVGIVGKNALARFVDNIVVNIGIVDIVEHDALIAAADGDIVEHFEPFGKHQHI
                  10         20         30         40         50         60

70         80         90        100        110        120
m638.pep  AHIVAHGNIAADFAVVGVHIVDGETQIAEAVVFVGVVRAGIGKNAVPPFGNVVADDLRTG
          ||||||||||||||||||||||||||:||||| ||||||||||||||||||||||||||:|
g638      AHIVAHGNIAADFAVVGVHIVDGETQVAEAVVFIGVVRAGIGKNAVPPFGNVVADDLRAG
                  70         80         90        100        110        120

130        140        150        160        170        180
m638.pep  CVPNGNAVAALVHAQSRVADDFILAHHRIGRTMQIYADRIIQNIVVFNQGARGSFFEINT
          ||||||:|||:|||:|:||||||||||||||||::|||:||:||||||||||:|||||||
g638      RVPNGNAIAALIHAQGRIADDFILAHHRIGRTMKVYAERIIKNIVVFNQGARGGFFEINT
                 130        140        150        160        170        180

190        200        210        220        230        240
m638.pep  GIHCGQAHTGTGNGQVAERYVRRVYGYGTPAPVAFDGCGTVGRPFNRNRFVNVKFGFIYA
          |||| |||||||||||||||||||||||||| | |||||||||||||||||||::|||:|||
g638      GIHCWQAHTGTGNGQVAERYVRRVYGYGTPALVPFDGCGTVGRPFNRNRFVDIKFGLIYA
                 190        200        210        220        230        240

250        260
m638.pep  GSQFERIARPGAGKCGIPISIIGSX
          ||||:||||||||||||||
g638      GSQFDRIARPGAGKNFGKVVLRGNVDDGCRCRLKNAAGGKYQHGLQPYTERGCVHSVPLF
                 250        260        270        280        290        300
```

The following partial DNA sequence was identified in *N. meningitidis* <SEQ ID 2043>:

```
a638.seq
    1 ATGATTGGCG GACAGTTTAT CGTAGTTGGC ATTGTAGGCA AAAACGCACT

51 TGCCCGCTTT GTTGATAATG TTGTCGTGAA TATCGGAATA GTTGACATAG

101 TTGAGCATGA TGCCTTGGTC GCGGCTGCCG ACGGCGATAT TGTCAAACAC

151 TTTGAGCCGC TCGGAAAACA TCAGCACATA GCCCATATTG TTGCCCACGG
```

```
-continued
201 AAATATTGCC GCTGATTTCG CTGTCGTTGG TGTACATATA GTGGACGGCG

251 AAACGCAAAT CGCTGAAGCG GTTGTTTTTA TAGGTGTTGT GCGTGCTGGT

301 ATTGGAAAAA ATGCCGTCCC GCCCTTTGGA AATATCGTTG CCGACGACCT

351 GCGCGCCGGG CGCGTTCCAA ACGGTAACGC CATTGCCGCG CTCGTTCACG

401 CGCAAAGTCG CGTCGCCGAC GATTTTATTC TCCCGCACCA TCGCATCGGC

451 AGAACCATGC AGATAGACGC CGACCGAATT ATCCAAAATA TTATTGTGTT

501 CAATCAGGGC GCGCGGGGCA GTTTCTTCGA GATAAATACC GGCATCCATT

551 GCGGGCAGGC TCATACCGGA ACGGGTAACG GTCAGGTTGC GGAGCGTTAC

601 GTCCGGCGCG TGTACGGCTA TGGTACGCCC GCTCCTGTCT CCTTCGATGG

651 TTGCAGAACG GTCGGCAGGC CCTTCAATCG TAATCGGTTT GTCGATGTGA

701 AGTTTGGTTT GATATACGCC GGAAGCCAGT TTGAGCGTAT CGCCCGCCCG

751 GGCGCGGGCA AATGCGGGAT ACCGATCAGC ATAATCGACT CATGGTGA
```

This corresponds to the amino acid sequence <SEQ ID 2044; ORF 638.a>:

```
m638.pep

1 MIGGQFIVVG IVGKNALARF VDNVVVNIGI VDIVEHDALV AAADGDIVKH

51 FEPLGKHQHI AHIVAHGNIA ADFAVVGVHI VDGETQIAEA VVFIGVVRAG

101 IGKNAVPPFG NIVADDLRAG RVPNGNAIAA LVHAQSRVAD DFILPHHRIG

151 RTMQIDADRI IQNIIVFNQG ARGSFFEINT GIHCGQAHTG TGNGQVAERY

201 VRRVYGYGTP APVSFDGCRT VGRPFNRNRF VDVKFGLIYA GSQFERIARP

251 GAGKCGIPIS IIDSW* m638/a638  91.3%% identity in 264 aa overlap 10         20         30         40         50         60
     m638.pep  MIGEKFIVVGIIGKYALACLVDNVVVNIGIVDIVEHNALIAAADGDIVEYFEPLGKHQHI
               ||| :|||||:|| ||| :||||||||||||||||:|| :||||||::||||||||||
     a638      MIGGQFIVVGIVGKNALARFVDNVVVNIGIVDIVEHDALVAAADGDIVKHFEPLGKHQHI
                  10         20         30         40         50         60

70         80         90        100        110        120
     m638.pep  AHIVAHGNIAADFAVVGVHIVDGETQIAEAVVFVGVVRAGIGKNAVPPFGNVVADDLRTG
               ||||||||||||||||||||||||||||||||||:||||||||||||||||:||||||:|
     a638      AHIVAHGNIAADFAVVGVHIVDGETQIAEAVVFIGVVRAGIGKNAVPPFGNIVADDLRAG
                  70         80         90        100        110        120

130        140        150        160        170        180
     m638.pep  CVPNGNAVAALVHAQSRVADDFILAHHRIGRTMQIYADRIIQNIVVFNQGARGSFFEINT
               ||||||:|||||||||||||| |||||||||| |||||||||:||||||||||||||||
     a638      RVPNGNAIAALVHAQSRVADDFILPHHRIGRTMQIDADRIIQNIIVFNQGARGSFFEINT
                 130        140        150        160        170        180

190        200        210        220        230        240
     m638.pep  GIHCGQAHTGTGNGQVAERYVRRVYGYGTPAPVAFDGCGTVGRPFNRNRFVNVKFGFIYA
               |||||||||||||||||||||||||||||||||:|||| ||||||||||||:|||||:|||
     a638      GIHCGQAHTGTGNGQVAERYVRRVYGYGTPAPVSFDGCRTVGRPFNRNRFVDVKFGLIYA
                 190        200        210        220        230        240

250        260
     m638.pep  GSQFERIARPGAGKCGIPISIIGSX
               |||||||||||||||||||||||| |
     a638      GSQFERIARPGAGKCGIPISIIDSWX
                 250        260
```

The following partial DNA sequence was identified in N. gonorrhoeae <SEQ ID 2045>:

```
g639-1.seq
    1 ATGAGCCTGC CAGCAATGGA TGCCGGTATT TATCTCGAAA AAGCCGCCCC

51 GCGCGCCCTG GTTGAACACA ACAATATTTT TGATAATTCG TTCGGCGTAT

101 ACCTTCATGG TTCTGCCGAT GCGATGGTGC GCGAGAATAA AATCGTCGGC

151 GATGCGACCT TGCGCGTGAA TGAGCGCGGC AATGGCGTTA CCGTTTGGAA

201 CGCGCCCGGC GCGCAGGTCG TCGGCAACGA CATTTCCAAA GGGCGGGACG

251 GCATTTTTTC CAATACCAGC ACGCACAACA CCTATAAAAA CAACCGCTTC

301 AGCGACCTGC GTTTCGCCGT CCACTATATG TACACCAACG ACAGCGAAGT

351 CAGCGGCAAT ATTTCCGTGG GCAACAATAT GGGCTATGTG CTGATGTTTT

401 CCGAACGGCT CAAAGTGTTC GACAATATCG CCGTCGGCAG CCGCGATTAG

451 GGCATCATGC TCAACTATGT CAACTATTCC GATATTCACG ACAATATTAT

501 CAACAAAGCG GGCAAGTGCG TTTTTGCCTA CAATGCCAAC TACGATAAAC

551 TGTCCGCCAA TCATTTTGAA AACTGCCAAA TCGGCATGCA CTTTACCGCC

601 GCCATCGAAG GCACGTCCCT GCACGACAAT TCCTTTATCA ACAACGGAAG

651 CCAGGTCAAA TATGTCAGTA CGCGCTTTCT CGACTGGAGC GAGGGCGGAC

701 ACGGCAACTA CTGGAGCGAC AACAGCCCGT TCGATTTGAA CGGCGACGGC

751 TTCGGAGACA GCGCGTACCG TCCCGACGGC ATCATCGACC AAATCATCTG

801 GCGCGCGCCC GTATCGCGCC TCTTGATGAA CAGTCCCGCA ATCAGCATCG

851 TCAAATGGGC GCAGGCGCAG TTTCCCGCCG TTCTGCCCGG CGGCGTGGTG

901 GACAGCAAAC CGCTGATGAA GCCTTATGCC CCCAAAATTC AAACCCGTTA

951 TCAGGCGATG AAGGACGAGT TGCTCAAAGA AGCCGAAACG CGGCAGTCGG

1001 AACGGGCAG GGCGGAAAAC GGTTCTTTGA ACTAG
```

This corresponds to the amino acid sequence <SEQ ID 2046; ORF 639-1.ng>:

```
g639-1.pep
    1 MSLPAMDAGI YLEKAAPRAL VEHNNIFDNS FGVYLHGSAD AMVRENKIVG

51 DATLRVNERG NGVTVWNAPG AQVVGNDISK GRDGIFSNTS THNTYKNNRF

101 SDLRFAVHYM YTNDSEVSGN ISVGNNMGYV LMFSERLKVF DNIAVGSRD*

151 GIMLNYVNYS DIHDNIINKA GKCVFAYNAN YDKLSANHFE NCQIGMHFTA

201 AIEGTSLHDN SFINNGSQVK YVSTRFLDWS EGGHGNYWSD NSPFDLNGDG

251 FGDSAYRPDG IIDQIIWRAP VSRLLMNSPA ISIVKWAQAQ FPAVLPGGVV

301 DSKPLMKPYA PKIQTRYQAM KDELLKEAET RQSERGRAEN GSLN*
```

The following partial DNA sequence was identified in N. meningitidis <SEQ ID 2047>:

```
m639-1.seq
    1 ATGAGCCTGC CCGCAATGGA TGCCGGTATT TATCTCGAAG AAACTGCCCC

51 GCGCGCCCTG ATTGAACACA ACAATATTTT GGATAATTCG GTCGGCGTAT

101 ATCTGCATGG TTCTGCCGAT GCGATGGTGC GCGAGAATAA AATCGTCGGC

151 GACGCGACTT TGCGCGTGAA CGAGCGCGGC AACGGCGTTA CCGTTTGGAA
```

```
-continued
201 CGCACCCGGT GCGCAGGTCG TCGGCAACGA CATTTCCAAA GGGCGGGACG

251 GCATTTTTTC CAATACCAGC ACGCACAACA CCTACAAAAA CAACCGCTTC

301 AGCGATTTGC GTTTCGCCGT CCACTATATG TACACCAACG ACAGCGAAAT

351 CAGCGGCAAT ATTTCCGTGG GCAACAATAT GGGCTATGTG CTGATGTTTT

401 CCGAGCGGCT CAAAGTATTC GACAATATCG CCGTCGGCAG CCGCGATCAG

451 GGCATTATGC TCAACTATGT CAACTATTCC GATATTCACG ACAACATTAT

501 CAACAAGGCA GGCAAGTGCG TATTTGCCTA TAATGCCAAC TACGATAAAC

551 TTTTCGCCAA TCATTTTGAA AACTGTCAAA TCGGCATACA CTTTACCGCC

601 GCCATCGAAG GCACGTCCTT GCATGACAAT TCCTTTATCA ACAACGAAAG

651 CCAGGTCAAA TACGTCAGCA CGCGCTTTCT CGATTGGAGC GAGGGCGGAC

701 ACGGCAACTA TTGGAGCGAC AACAGCGCGT TCGATTTGAA CGGCGACGGC

751 TTCGGAGACA GCGCGTACCG CCCCAACGGC ATCATCGACC AAATCATCTG

801 GCGCGCGCCC GTATCGCGCC TTTTGATGAA CAGTCCCGCA ATCAGCATCG

851 TCAAATGGGC GCAGGCGCAG TTTCCCGCCG TTCTGCCTGG CGGCGTGGTG

901 GACAGCAAAC CGCTGATGAA GCCTTATGCC CCCAAAATTC AAACCCGTTA

951 TCAGGCGATG AAGGACGAGC TACTCAAAGA AGTCGAAACG CGGCAGTCGG

1001 AATGGGGCAG GGCGGAAAAC GGTTCTTTGA ACTAG
```

This corresponds to the amino acid sequence <SEQ ID 2048; ORF 639-1>:

```
m639-1.pep

1 MSLPAMDAGI YLEETAPRAL IEHNNILDNS VGVYLHGSAD AMVRENKIVG

51 DATLRVNERG NGVTVWNAPG AQVVGNDISK GRDGIFSNTS THNTYKNNRF

101 SDLRFAVHYM YTNDSEISGN ISVGNNMGYV LMFSERLKVF DNIAVGSRDQ

151 GIMLNYVNYS DIHDNIINKA GKCVFAYNAN YDKLFANHFE NCQIGIFHTA

201 AIEGTSLHDN SFINNESQVK YVSTRFLDWS EGGHGNYWSD NSAFDLNGDG

251 FGDSAYRPNG IIDQIIWRAP VSRLLMNSPA ISIVKWAQAQ FPAVLPGGVV

301 DSKPLMKPYA PKIQTRYQAM KDELLKEVET RQSEWGRAEN GSLN* g639-1/m639-1 95.9% identity in 344 aa overlap 10         20         30         40         50         60
       g639-1.pep  MSLPAMDAGIYLEKAAPRALVEHNNIFDNSFGVYLHGSADAMVRENKIVGDATLRVNERG
                   ||||||||||||::||||:|||||:|||  |||||||||||||||||||||||||||||
       m639-1      MSLPAMDAGIYLEETAPRALIEHNNILDNSVGVYLHGSADAMVRENKIVGDATLRVNERG
                   10         20         30         40         50         60
                   70         80         90        100        110        120
       g639-1.pep  NGVTVWNAPGAQVVGNDISKGRDGIFSNTSTHNTYKNNRFSDLRFAVHYMYTNDSEVSGN
                   ||||||||||||||||||||||||||||||||||||||||||||||||||||||||:|||
       m639-1      NGVTVWNAPGAQVVGNDISKGRDGIFSNTSTHNTYKNNRFSDLRFAVHYMYTNDSEISGN
                   70         80         90        100        110        120
                  130        140        150        160        170        180
       g639-1.pep  ISVGNNMGYVLMFSERLKVFDNIAVGSRDXGIMLNYVNYSDIHDNIINKAGKCVFAYNAN
                   |||||||||||||||||||||||||||||| |||||||||||||||||||||||||||||
       m639-1      ISVGNNMGYVLMFSERLKVFDNIAVGSRDQGIMLNYVNYSDIHDNIINKAGKCVFAYNAN
                  130        140        150        160        170        180
                  190        200        210        220        230        240
       g639-1.pep  YDKLSANHFENCQIGMHFTAAIEGTSLHDNSFINNGSQVKYVSTRFLDWSEGGHGNYWSD
                   ||||  |||||||||| ||||||||||||||||||:|||||||||||||||||||||||
       m639-1      YDKLFANHFENCQIGIHFTAAIEGTSLHDNSFINNESQVKYVSTRFLDWSEGGHGNYWSD
                  190        200        210        220        230        240
                  250        260        270        280        290        300
       g639-1.pep  NSPFDLNGDGFGDSAYRPDGIIDQIIWRAPVSRLLMNSPAISIVKWAQAQFPAVLPGGVV
                   || |||||||||||||||:|||||||||||||||||||||||||||||||||||||||||
       m639-1      NSAFDLNGDGFGDSAYRPNGIIDQIIWRAPVSRLLMNSPAISIVKWAQAQFPAVLPGGVV
                  250        260        270        280        290        300
```

```
                       310        320        330        340
    g639-1.pep  DSKPLMKPYAPKIQTRYQAMKDELLKEAETRQSERGRAENGSLNX
                ||||||||||||||||||||||||||||:||||||||||||||||
    m639-1      DSKPLMKPYAPKIQTRYQAMKDELLKEVETRQSEWGRAENGSLNX
                       310        320        330        340
```

The following partial DNA sequence was identified in *N. meningitidis* <SEQ ID 2049>:

```
a639-1.seq
    1 ATGAGCCTGC CCGCAATGGA TGCCGGTATT TATCTCGAAG AAACTGCCCC

51 GCGCGCCCTG ATTGAACACA ATAATATTTT GGATAATTCG GTCGGCGTCT

101 ATCTGCATGG TTCTGCCGAT GCGATGGTGC GGGAGAATAA AATCGTCGGC

151 GACGCGACTT TGCGCGTGAA CGAGCGCGGC AATGGCGTTA CCGTTTGGAA

201 CGCGCCCGGC GCGCAGGTCG TCGGCAACGA TATTTCCAAA GGGCGGGACG

251 GCATTTTTTC CAATACCAGC ACGCACAACA CCTATAAAAA CAACCGCTTC

301 AGCGATTTGC GTTTCGCCGT CCACTATATG TACACCAACG ACAGCGAAAT

351 CAGCGGCAAT ATTTCCGTGG GCAACAATAT GGGCTATGTG CTGATGTTTT

401 CCGAGCGGCT CAAAGTGTTT GACAATATCG CCGTCGGCAG CCGCGACCAA

451 GGCATCATGC TCAACTATGT CAACTATTCC GATATTCACG ACAACATTAT

501 CAACAAAGCG GGCAAGTGCG TTTTTGCCTA CAATGCCAAC TACGATAAAC

551 TGTCCGCCAA TCATTTTGAA ACTGCCAAA TCGGCATACA CTTTACCGCC

601 GCCATCGAAG GCACGTCCCT GCACGACAAT TCCTTTATCA ACAACGAAAG

651 CCAGGTCAAA TACGTCAGCA CGCGCTTTCT CGACTGGAGC GAGGGCGGAC

701 ACGGCAACTA TTGGAGCGAC AACAGCGCGT TCGATTTGAA CGGCGACGGC

751 TTCGGAGACA GCGCGTACCG TCCCAACGGC ATCATCGACC AAATCATCTG

801 GCGCGCACCC GTATCGCGCC TCTTGATGAA CAGTCCCGCA ATCAGCATCG

851 TCAAATGGGC GCAGGCGCAA TTTCCCGCCG TTTTGCCTGG CGGCGTGGTG

901 GACAGCAAAC CGCTGATGAA GCCTTATGCC CCAAAATTC AAACCCGTTA

951 TCAGGCGATG AAGGACGGGC TGCTCAAAAA AGTCGAAACG CGGCAGTTGG

1001 AATGGGGCAG GGCGGAAAAC GGTTCTTTGA ACTAG
```

This corresponds to the amino acid sequence <SEQ ID 2050; *ORF* 639-1.a>:

```
a639-1.pep

1 MSLPAMDAGI YLEETAPRAL IEHNNILDNS VGVYLHGSAD AMVRENKIVG

51 DATLRVNERG NGVTVWNAPG AQVVGNDISK GRDGIFSNTS THNTYKNNRF

101 SDLRFAVHYM YTNDSEISGN ISVGNNMGYV LMFSERLKVF DNIAVGSRDQ

151 GIMLNYVNYS DIHDNIINKA GKCVFAYNAN YDKLSANHFE NCQIGIHFTA

201 AIEGTSLHDN SFINNESQVK YVSTRFLDWS EGGHGNYWSD NSAFDLNGDG

251 FGDSAYRPNG IIDQIIWRAP VSRLLMNSPA ISIVKWAQAQ FPAVLPGGVV

301 DSKPLMKPYA PKIQTRYQAM KDGLLKKVET RQLEWGRAEN GSLN*
```

-continued a639-1/m639-1 98.8% identity in 344 aa overlap

```
                    10        20        30        40        50        60
a639-1.pep  MSLPAMDAGIYLEETAPRALIEHNNILDNSVGVYLHGSADAMVRENKIVGDATLRVNERG
            ||||||||||||||||||||||||||||||||||||||||||||||||||||||||||||
m639-1      MSLPAMDAGIYLEETAPRALIEHNNILDNSVGVYLHGSADAMVRENKIVGDATLRVNERG
                    10        20        30        40        50        60

70        80        90       100       110       120
a639-1.pep  NGVTVWNAPGAQVVGNDISKGRDGIFSNTSTHNTYKNNRFSDLRFAVHYMYTNDSEISGN
            ||||||||||||||||||||||||||||||||||||||||||||||||||||||||||||
m639-1      NGVTVWNAPGAQVVGNDISKGRDGIFSNTSTHNTYKNNRFSDLRFAVHYMYTNDSEISGN
                    70        80        90       100       110       120

130       140       150       160       170       180
a639-1.pep  ISVGNNMGYVLMFSERLKVFDNIAVGSRDQGIMLNYVNYSDIHDNIINKAGKCVFAYNAN
            ||||||||||||||||||||||||||||||||||||||||||||||||||||||||||||
m639-1      ISVGNNMGYVLMFSERLKVFDNIAVGSRDQGIMLNYVNYSDIHDNIINKAGKCVFAYNAN
                   130       140       150       160       170       180

190       200       210       220       230       240
a639-1.pep  YDKLSANHFENCQIGIHFTAAIEGTSLHDNSFINNESQVKYVSTRFLDWSEGGHGNYWSD
            ||||||||||||||||||||||||||||||||||||||||||||||||||||||||||||
m639-1      YDKLSANHFENCQIGIHFTAAIEGTSLHDNSFINNESQVKYVSTRFLDWSEGGHGNYWSD
                   190       200       210       220       230       240

250       260       270       280       290       300
a639-1.pep  NSAFDLNGDGFGDSAYRPNGIIDQIIWRAPVSRLLMNSPAISIVKWAQAQFPPAVLPGGVV
            ||||||||||||||||||||||||||||||||||||||||||||||||||||||||||||
m639-1      NSAFDLNGDGFGDSAYRPNGIIDQIIWRAPVSRLLMNSPAISIVKWAQAQFPPAVLPGGVV
                   250       260       270       280       290       300

310       320       330       340
a639-1.pep  DSKPLMKPYAPKIQTRYQAMKDGLLKKVETRQLEWGRAENGSLNX
            |||||||||||||||||||||||||||||||||||||||||||||
m639-1      DSKPLMKPYAPKIQTRYQAMKDGLLKKVETRQLEWGRAENGSLNX
                   310       320       330       340
```

The following partial DNA sequence was identified in *N. gonorrhoeae* <SEQ ID 2051>:

```
g640.seq
   1 ATGATTCATA TAATATCAAT ATTAAAGAGT ATCGGTATAT CGGGGATAGC

51 TATGTCCTGT TTTTCAATCC GGCGTATGTC TGCGTTTCGG GCGCGGATAA

101 CGGCGTTTTT TACCGCCTTT GTCTTTTTGA CGGcggcACT GCCCGCTTAT

151 GcggAgcgTc tgcctGATTT TCTGgcgAAA ATacAgcctT CGGAAATTTT

201 TCCGGGTGCG GATCGTTACG GCAAGCCGGA aggcAAGCCT AtggtTGCCC

251 GCgtttACAA AGgcgATGAG CAGCTCGGTT TGGTTTATAT CACGACCGAT

301 GCGGTCAATA CGCGCGGTTA TTCGAGCAAA CCGATCGATA CGCTGATGGC

351 TTTGGCAAAC GACGGCACGA TAGCCGGGGC GAAACTGGTC GATCATCACG

401 AACCGATTAT GCTGATCGGT ATCCCGCAAT CGCGTGTCGA TAAGTTCATC

451 GACAAATATA TCGGTCTGAA TTTTATTAAA AATCCGCCGA CCCCGAGCGT

501 GGCGCCGGGC GACATCATCA GcggtGCGAC TgttaCACTG ATGGTGGTTA

551 ACGACAGCAT CCAGCGTTCG TACAAGGTCA TTGCCAACCA ATACCGTCTG

601 GGTTCGGACA AGGCCCTTCA GACGGCATCC GCTTCCGATG TTCGGGAAGC

651 CGCGCCTGCG TCAGAAACCC GTCCGCGCCG TATGGCAAAT CCCGACAAGC

701 AGGATATTTT GTCTTGGGAC GAACTTTTGA ACAAAAGGC CGTCGGCCAT

751 CTGCATATCA CGCTCGATCA AATCAACAAA CTGTTTGAGA AAGGCGGCAA

801 GGCCGGCGTG GCCGATCACG CCGAACAGGG CGATCCTGAC GATACCTTTA

851 TTGATTTGTA TGTTGCCTTG GTCAGCCAGC CTTCCATCGG TAAAAGCCTG

901 CTGGGTGAGG ACGGCTGGGC GCATCTGCAA AAACGGCTGA AACCCGGGCA

951 GCAGGCGGTT TTGGTTGCCG GAGAGGGCCG TTATTCTTGG AAAGGTTCGG
```

-continued

```
1001 GCTATGTGCG CGGCGGTATT TTCGACCGTA TCGAGATGAT TCAGGGGGAG

1051 AACAGCTTCC GTTTTACCGA TGCCCAACAC GAACGCGTCG TCGAGCTGTC

1101 TGCCGCCGAT GCGCCGCGTT TTAAAGAAGT TTCTTGGTTT ACCATCCCTG

1151 AAGGCGTAGC GTTTGACGGT GCGGAGCCGT GGCGGCTGTA A
```

This corresponds to the amino acid sequence <SEQ ID 2052; ORF 640.ng>:

```
g640.pep
   1 MIHIISILKS IGISGIAMSC FSIRRMSAFR ARITAFFTAF VFLTAALPAY

51 AERLPDFLAK IQPSEIFPGA DRYGKPEGKP MVARVYKGDE QLGLVYITTD

101 AVNTRGYSSK PIDTLMALAN DGTIAGAKLV DHHEPIMLIG IPQSRVDKFI

151 DKYIGLNFIK NPPTPSVAPG DIISGATVTL MVVNDSIQRS YKVIANQYRL

201 GSDKALQTAS ASDVREAAPA SETRPRRMAN PDKQDILSWD ELLKQKAVGH

251 LHITLDQINK LFEKGGKAGV ADHAEQGDPD DTFIDLYVAL VSQPSIGKSL

301 LGEDGWAHLQ KRLKPGQQAV LVAGEGRYSW KGSGYVRGGI FDRIEMIQGE

351 NSFRFTDAQH ERVVELSAAD APRFKEVSWF TIPEGVAFDG AEPWRL*
```

The following partial DNA sequence was identified in *N. meningitidis* <SEQ ID 2053>:

```
m640.seq (partial)
   1 ATGATTCATA TAATATCAAT ATTAAAGAGT ATCGGTATAT CGGGGATAGT

51 CATGTCCTGT TTTTCAATCA AACGTATGTC CGCGTTTCGG GCGCGGATAA

101 CGGCGTTTTT TGCCGCCTTT GTCTTTTTGA CGGCGGCACT GCCCGCTTAT

151 GCGGAGCGTC TGCCTGATTT TCTGGCGAAA ATACAGCCTT CGGAAATTTT

201 TCCGGGTGCG GACCGTTACG GCAAGCCGGA AGGTAAGCCT ATGGTTGCCC

251 GCGTTTACAA AGGCGATGAG CAGTTGGGCT TGGTCTATAT CACGACCGAT

301 GCGGTCAATA CGCGCGGTTA TTCGAGCAAA CCGATTGATA CGCTGATGGT

351 GTTGGCAAAC GACGGCACGA TAGCCGGGGC GAAACTGGTC GACCATCACG

401 AACCGATTAT GCTGATCGGT ATCCCGCAT...
```

This corresponds to the amino acid sequence <SEQ ID 2054; ORF 640>:

```
m640.pep (partial)
   1 MIHIISILKS IGISGIVMSC FSIKRMSAFR ARITAFFAAF VFLTAALPAY

51 AERLPDFLAK IQPSEIFPGA DRYGKPEGKP MVARVYKGDE QLGLVYITTD

101 AVNTRGYSSK PIDTLMVLAN DGTIAGAKLV DHHEPIMLIG IPH...
``` m640/g640 96.5% identity in 143 aa overlap

```
                  10        20        30        40        50        60
     m640.pep    MIHIISILKSIGISGIVMSCFSIKRMSAFRARITAFFAAFVFLTAALPAYAERLPDFLAK
                 ||||||||||||||||:||||||:|||||||||||||:|||||||||||||||||||||
         g640    MIHIISILKSIGISGIAMSCFSIRRMSAFRARITAFFTAFVFLTAALPAYAERLPDFLAK
                  10        20        30        40        50        60
```

-continued

```
                 70         80         90        100        110        120
m640.pep    IQPSEIFPGADRYGKPEGKPMVARVYKGDEQLGLVYITTDAVNTRGYSSKPIDTLMVLAN
            ||||||||||||||||||||||||||||||||||||||||||||||||||||||||:|||
g640        IQPSEIFPGADRYGKPEGKPMVARVYKGDEQLGLVYITTDAVNTRGYSSKPIDTLMALAN
                 70         80         90        100        110        120

130        140
m640.pep    DGTIAGAKLVDHHEPIMLIGIPH
            |||||||||||||||||||||:
g640        DGTIAGAKLVDHHEPIMLIGIPQSRVDKFIDKYIGLNFIKNPPTPSVAPGDIISGATVTL
                130        140        150        160        170        180
```

The following partial DNA sequence was identified in *N. meningitidis* <SEQ ID 2055>:

```
a640.seq (partial)
   1 ATGATTCATA TAATATCAAT ATTAAAGAGT ATCGGTATAT CGGGGATAGT

51 CATGTCCTGT TTTTCAATCA AACGTATGTC CGCGTTTCGG GCGCGGATAA

101 CGGCGTTTTT TGCCGCCTTT GTCTTTTTGA CGGCGGCACT GCCCGCTTAT

151 GCGGAGCGTC TGCCTGATTT TCTGGCGAAA ATACAGCCTT CGGAAATTGT

201 TCCGGGTGCG GACCGTTACA GCAAGCCGGA AGGTAAGCCT ATGGTTGCCC

251 GCGTTTACAA AGGCGATGAG CAGTTGGGCT TGGTCTATAT CACGACCGAT

301 GCGGTCAATA CGCGCGGTTA TTCGAGCAAA CCGATTGATA CGCTGATGGC

351 GTTGGCTAAA GACGGTACGA TAGCCGGAGC GAAATTGGTT GATCACCATG

401 AGTCGATTAT GCTGATCGGT ATCCCGCAT...
```

This corresponds to the amino acid sequence <SEQ ID 2056; *ORF* 640.a>:

```
a640.pep (partial) Length: 143
   1 MIHIISILKS IGISGIVMSC FSIKRMSAFR ARITAFFAAF VFLTAALPAY

51 AERLPDFLAK IQPSEIVPGA DRYSKPEGKP MVARVYKGDE QLGLVYITTD

101 AVNTRGYSSK PIDTLMALAK DGTIAGAKLV DHHESIMLIG IPH...
``` m640/a640 96.5% identity in 143 aa overlap

```
                 10         20         30         40         50         60
m640.pep    MIHIISILKSIGISGIVMSCFSIKRMSAFRARITAFFAAFVFLTAALPAYAERLPDFLAK
            ||||||||||||||||||||||||||||||||||||||||||||||||||||||||||||
a640        MIHIISILKSIGISGIVMSCFSIKRMSAFRARITAFFAAFVFLTAALPAYAERLPDFLAK
                 10         20         30         40         50         60

70         80         90        100        110        120
m640.pep    IQPSEIFPGADRYGKPEGKPMVARVYKGDEQLGLVYITTDAVNTRGYSSKPIDTLMVLAN
            |||||| ||||||:||||||||||||||||||||||||||||||||||||||||||:||:
a640        IQPSEIVPGADRYSKPEGKPMVARVYKGDEQLGLVYITTDAVNTRGYSSKPIDTLMALAK
                 70         80         90        100        110        120

130        140
m640.pep    DGTIAGAKLVDHHEPIMLIGIPH
            |||||||||||||| ||||||||
a640        DGTIAGAKLVDHHESIMLIGIPH
                130        140
```

The following partial DNA sequence was identified in *N. gonorrhoeae* <SEQ ID 2057>:

```
g642.seq
   1   ATGCGGTATC CGCCGCAATC GGCGGTTTTG CAGAATGCCG CGCGTTGCCT

51   TTTGCGCCGC CCGAAATCTG CCTGCCGCCG TATTTGCCCG CTATCCGCAA
```

-continued

```
 101 TATCGGCAGT CCAATATATC TTTGCGGATG TCGTTCAGCA GGAAGGCTGT
 151 GGTGTCTTCG TGTTCCTCCT GTACGAAGAC AAAAAGTCGG GCGATGATTT
 201 TGCCGATGAA GACTTTTTGC AGGGCGCAGG CGTCGGTCAG GGTGTGTTCC
 251 TGCAGGAAGC TGCGGATGTC TTCGGGCAAA GCGTAgtCgc gGGCAACGGC
 301 GGcaaagcgG ACatcggtTT Gcacggcgtc gagCAGGGtt tggtTTTTGT
 351 CCAACTTAAT GCCTGCTTCT TTTTCTTCGG CGGTGGCGCG GACGAACTGG
 401 TCGTAAATTT CGGCATAAAG CATATCGTTC GGGCCTTCAA AAATCGTGAA
 451 GGGGCGGATA TCGATGGCGA TATTGCCGGC TGGGTGTCCG CGTTCAAAAC
 501 CCTTCGCGCC CAAGAGTTTT TGCAACATTT GCGCGGCGgc gTAAGTGTAT
 551 TCCGTGGCGa ggGTTTTGAc gatgTTCGCC TCCATCAATT GATGGGCGAc
 601 ggGCGcgacg ggCGAAACGG AATGGCAGAC GTAGCGGTAA AGGATTTCGG
 651 AAACCTGATG GCGGCGTTGG ATTTCGCGGC GTTCGTAATC GACGAATCTG
 701 ATATCGTTGC GGACATATCG GTTCAGGTTG TCAAGGATGT ATTCCATAAT
 751 GCCGTGCGTC ATGCCGATCA GTTGCAGGCG GCTGCGGATA AGATGTTTT
 801 GGAACGCGCG CAAACCGGCA GCGTCGCCCC GGGAGAGTTT CATCACGGCG
 851 GTTGCAGGCA TTTCGGCATC GATGCGGTTG ACGGCGTAAC GGACGGCGCG
 901 CAGGCCTTCG GATGCGAGGG TTTCGCAGCG GATGTATGTT TTGGGGACGA
 951 GCAGCAGGTC GATGactttg gcgagtttgC Cgtttttgcg ctctttggcg
1001 gcaacgaggA GGAAGTCGCT TTGCGAATTG CCCTGCCAGT ATTTCGCGGC
1051 GttgACGTAA ATGGTTtgtt cgtcggtata ttcgtagcag gactgcaTTT
1101 CGCGTGCAAt cgCcgcgccg gaggtTtcgg gttcggtaAc gcccaaacgg
1151 cggctttcgc ctTTGAAAAT CATGTCCAAA CCTTGTGCGA CTTGCgcttc
1201 gccgccgaac tCTTGCAGAG GCTGCAACAC CAGCGCGCCT TCGATGCCGG
1251 TACGCAGCGT AACGGGCACG CCGTAATGCC CCGCAATCCT TAG
```

This corresponds to the amino acid sequence <SEQ ID 2058; ORF 642.ng>:

```
g642.pep
  1 MRYPPQSAVL QNAARCLLRR PKSACRRICP LSAISAVQYI FADVVQQEGC
 51 GVFVFLLYED KKSGDDFADE DFLQGAGVGQ GVFLQEAADV FGQSVVAGNG
101 GKADIGLHGV EQGLVFVQLN ACFFFFGGGA DELVVNFGIK HIVRAFKNRE
151 GADIDGDIAG WVSAFKTLRA QEFLQHLRGG VSVFRGEGFD DVRLHQLMGD
201 GRDGRNGMAD VAVKDFGNLM AALDFAAFVI DESDIVADIS VQVVKDVFHN
251 AVRHADQLQA AADKDVLERA QTGSVAPGEF HHGGCRHFGI DAVDGVTDGA
301 QAFGCEGFAA DVCFGDEQQV DDFGEFAVFA LFGGNEEEVA LRIALPVFRG
351 VDVNGLFVGI FVAGLHFACN RRAGGFGFGN AQTAAFAFEN HVQTLCDLRF
401 AAELLQRLQH QRAFDAGTQR NGHAVMPRNP *
```

The following partial DNA sequence was identified in *N. meningitidis* <SEQ ID 2059>:

```
m642.seq (partial)
  1    GCCTGCCGCC GTATTTGCCC GCTACCCGCA ATATCGGCAG TCCAATATAT
```

-continued

```
  51 CTTTGCGGAT GTCGTTCAGC AGGAAGGCTG CGGTGTCTTC GTGTTTCGCC
 101 TGTACGAAGA CAAAGAGTCG GGCGATGATT TTGCCGATAA AGACTTTTTG
 151 CAGGGCGCAG GCATCGGTCA GGGTGTGTTC CTGCAGGAAG CTGCGGATGT
 201 CTTCAGGCAA AGTGTAGTCG CGGGCGACGG CGGCAAAGCG GGCATCGGTT
 251 TGCAGGCGGT CGAGCAGGGT TTGGTTTTTG TCCAACTTCA TGCCTGCTTC
 301 TTTTTCTTCG GCGGTGGCGC GGACAAACTG GTCGTAAATT TCGGCATAAA
 351 GCATATCGTT CGGGCCTTCA AAAATCGTGA AGGGGCGGAT GTCGATAGCG
 401 ATATTGCCGG CGGTGTGTCC GCGTTCAAAA CCCTTCGCAC CCAAGAGTTT
 451 TTGCAACATT TGCGCGGCGG CGTAAGTGTA TTCCGTGGCG AGGGTTTTGA
 501 CGATGTTCGC CTCCATCAGC TGATGGGCGA CGGGGGCAAC AGGCGAAACG
 551 GAATGGCAGA CGTAGCGGTA AGAATCTCG GAAACCTGAT GGCGGCGCCG
 601 GATTTCGCGG CGTTCGTAAT CGACGAATTT GATGTCGTTG CGGACGTATC
 651 GTTCCAGATT TTCAAGGATG TATTCCATAA TGCCGTGCGT CATGCCGATC
 701 AGTTGCAGGC GGCTGCGGAT AAAGATGTTT TGGAACGCGC GCAAACCGGC
 751 AGCGTCGCTC TGGGAGAGTT TCATCACGGC GGTTGCAGGC ATTTCGGCAT
 801 CGATGCGGTT GACGGCGTAA CGGACGGCGC GCAAGCCTTC GGATGCGAGG
 851 GTTTCGCAGC GGATGTATGT TTTGGGGACG AGCAGCAGGT CGATGACTTT
 901 GGCGAGTTTG CCGTTTTTGC GCTCTTTGGC GGCAACGAGG AGGAAGTCGC
 951 TTTGCGAGTT GCCCTGCCAG TATTTCGCGG CGTTGACGTA AATGGTTTGT
1001 CCGTCGATAT ATTCGTAGTA GGACTGCATT TCGCGTGCAA TCGCCGCGCC
1051 GGAGGTTTCG GGTTCGGTAA CACCCAAACC GCCGCCCTCG CCTTTGAAAA
1101 TCATCTCCAA ACCTTGCGCG ACTTGCGCTT CATCGCCGAA CTCTTGCAGT
1151 GGCTGCAACA CCAGCGCGCC TTCGATGCCG GTACGCAGCG TAACGGGCAC
1201 GCCGTAATGC CCCGCAATCC G
```

This corresponds to the amino acid sequence <SEQ ID 2060; ORF 642>:

```
m642.pep (partial)
   1 ACRRICPLPA ISAVQYIFAD VVQQEGCGVF VFRLYEDKES GDDFADKDFL
  51 QGAGIGQGVF LQEAADVFRQ SVVAGDGGKA GIGLQAVEQG LVFVQLHACF
 101 FFFGGGADKL VVNFGIKHIV RAFKNREGAD VDSDIAGGVS AFKTLRTQEF
 151 LQHLRGGVSV FRGEGFDDVR LHQLMGDGGN RRNGMADVAV KNLGNLMAAP
 201 DFAAFVIDEF DVVADVSFQI FKDVFHNAVR HADQLQAAAD KDVLERAQTG
 251 SVALGEFHHG GCRHFGIDAV DGVTDGAQAF GCEGFAADVC FGDEQQVDDF
 301 GEFAVFALFG GNEEEVALRV ALPVFRGVDV NGLSVDIFVV GLHFACNRRA
 351 GGFGFGNTQT AALAFENHLQ TLRDLRFIAE LLQWLQHQRA FDAGTQRNGH
 401 AVMPRNP
``` m642/g642 90.4% identity in 407 aa overlap

```
                      10        20        30
m642.pep              ACRRICPLPAISAVQYIFADVVQQEGCGVFVFRLYED
                      |||||||| ||||||||||||||||||||||||| |||
g642     MRYPPQSAVLQNAARCLLRRPKSACRRICPLSAISAVQYIFADVVQQEGCGVFVFLLYED
                  10        20        30        40        50        60
```

-continued

```
                40         50         60         70         80         90
m642.pep   KESGDDFADKDFLQGAGIGQGVFLQEAADVFRQSVVAGDGGKAGIGLQAVEQGLVFVQLH
           |:|||||||:|||||||:||||||||||||| ||||||:|||| |||::||||||||||:
g642       KKSGDDFADEDFLQGAGVGQGVFLQEAADVFGQSVVAGNGGKADIGLHGVEQGLVFVQLN
                    70        80        90       100       110       120

100       110       120       130       140       150
m642.pep   ACFFFFGGGADKLVVNFGIKHIVRAFKNREGADVDSDIAGGVSAFKTLRTQEFLQHLRGG
           |||||||||||:|||||||||||||||||||||:|:|||| ||||||||:||||||||||
g642       ACFFFFGGGADELVVNFGIKHIVRAFKNREGADIDGDIAGWVSAFKTLRAQEFLQHLRGG
                   130       140       150       160       170       180

160       170       180       190       200       210
m642.pep   VSVFRGEGFDDVRLHQLMGDGGNRRNGMADVAVKNLGNLMAAPDFAAFVIDEFDVVADVS
           ||||||||||||||||||||| : ||||||||||::|||||| ||||||||| |:|||:|
g642       VSVFRGEGFDDVRLHQLMGDGRDGRNGMADVAVKDFGNLMAALDFAAFVIDESDIVADIS
                   190       200       210       220       230       240

220       230       240       250       260       270
m642.pep   FQIFKDVFHNAVRHADQLQAAADKDVLERAQTGSVALGEFHHGGCRHFGIDAVDGVTDGA
            |: ||||||||||||||||||||||||||||||||| ||||||||||||||||||||||
g642       VQVVKDVFHNAVRHADQLQAAADKDVLERAQTGSVAPGEFHHGGCRHFGIDAVDGVTDGA
                   250       260       270       280       290       300

280       290       300       310       320       330
m642.pep   QAFGCEGFAADVCFGDEQQVDDFGEFAVFALFGGNEEEVALRVALPVFRGVDVNGLSVDI
           ||||||||||||||||||||||||||||||||||||||||||:||||||||||||| | |
g642       QAFGCEGFAADVCFGDEQQVDDFGEFAVFALFGGNEEEVALRIALPVFRGVDVNGLFVGI
                   310       320       330       340       350       360

340       350       360       370       380       390
m642.pep   FVVGLHFACNRRAGGFGFGNTQTAALAFENHLQTLRDLRFIAELLQWLQHQRAFDAGTQR
           ||:|||||||||||||||||:||||:|||||:||| |||| ||||| |||||||||||||
g642       FVAGLHFACNRRAGGFGFGNAQTAAFAFENHVQTLCDLRFAAELLQRLQHQRAFDAGTQR
                   370       380       390       400       410       420

400
m642.pep   NGHAVMPRNP
           ||||||||||
g642       NGHAVMPRNPX
                   430
```

The following partial DNA sequence was identified in *N. meningitidis* <SEQ ID 2061>:

```
a642.seq (partial)
   1  GCCTGCCGCC GTATTTGCCC GCTATCCGCA ATATCGGCAG TCCAATATGT

51  CTTTGCGGAT GTCGTTCAGC AGGAAGGCTG CGGTGTCTTC GTGTTCCGCC

101  TGTACGAAGA CAAAGAGTCG GGCGATGATT TTGCCGATAA AGACTTTTTG

151  CAGGGCGCAG GCATCGGTCA GGGTGTGTTC CTGCAGGAAG CTGCGGATGT

201  CTTCGGGCAA AGTGTAGTCG CGGGCGACGG CGGCAAAGCG GGCATCGGTT

251  TGCAGGCGGT CGAGCAGGGT TTGGTTTTTG TCCAACTTCA TGCCTGCTTC

301  TTTTTCTTCG GCGGTGGCGC GGACAAACTG GTCGTAAATT TCGGCATAAA

351  GCATATCGTT CGGGCCTTCA AAAATCGTGA AGGGGCGGAT GTCGATAGCG

401  ATATTGCCGG CGGTGTGTCC GCGTTCAAAA CCCTTCGCGC CCAAGAGTTT

451  TTGCAACATT TGCGCGGCGG CGTAAGTGTA TTCCGTGGCG AGGGTTTTGA

501  CGATGTTCGC CTCCATCAGT TGATGGGCGA CGGGTGCAAC GGGCGAAACG

551  GAATGGCAGA CGTAGCGGTA AAGAATCTCG GAAACCTGAT GGCGGCGCCG

601  GATTTCGCGG CGTTCGTAAT CGACGAATCT GATGTCGTTG CGGACGTATC

651  GTTCCAGGTT TTCAAGGGTG TATTCCATAA TGCCGTGCGT CATGCCGATC

701  AGTTGCAGGC GGCTGCGGAT AAAGATGTTT TGGAACGCGC GCAAACCGGC

751  AGCGTCGCTC TGGGAGAGTT TCATCACGGC GGTTGCAGGC ATTTCGGCAT

801  CGATGCGGTT GACGGCGTAA CGGACGGCGC GCAAGCCTTC GGATGCGAGG

851  GTTTCGCAGC GGATGTATGT TTTGGGGACG AGCAGCAGGT CGATGACTTT

901  GGCGAGTTTG CCGTTTTTGC GCTCTTTGGC GGCAACGAGG AGGAAGTCGC
```

-continued

```
 951 TTTGCGAGTT GCCCTGCCAG TATTTCGCGG CGTTGACGTA AATGGTTTGT

1001 CCGTCGGTAT ATTCGTAGTA AGACTGCATT TCTCGGGCAA TCGCCGCGCC

1051 GGAGGTTTCG GGTTCGGTAA CGCCTAAACC GCCGCCCTCG CCTTTGAAAA

1101 CCATGTCCAA ACCCTGTGCG ATTTGCGCTT CATCGCCGAA CTCTTGCAGT

1151 GGCTGCAACA CCAGCGCGCC TTCGATGCCG GTACGCAGCG TAACGGGCAC

1201 GCCGTAATGC CCCGCAATCC G
```

This corresponds to the amino acid sequence <SEQ ID 2062; ORF 642.a>:

```
a642.pep Length: 407
  1 ACRRICPLSA ISAVQYVFAD VVQQEGCGVF VFRLYEDKES GDDFADKDFL

51 QGAGIGQGVF LQEAADVFGQ SVVAGDGGKA GIGLQAVEQG LVFVQLHACF

101 FFFGGGADKL VVNFGIKHIV RAFKNREGAD VDSDIAGGVS AFKTLRAQEF

151 LQHLRGGVSV FRGEGFDDVR LHQLMGDGCN GRNGMADVAV KNLGNLMAAP

201 DFAAFVIDES DVVADVSFQV FKGVFHNAVR HADQLQAAAD KDVLERAQTG

251 SVALGEFHHG GCRHFGIDAV DGVTDGAQAF GCEGFAADVC FGDEQQVDDF

301 GEFAVFALFG GNEEEVALRV ALPVFRGVDV NGLSVGIFVV RLHFSGNRRA

351 GGFGFGNA*T AALAFENHVQ TLCDLRFIAE LLQWLQHQRA FDAGTQRNGH

401 AVMPRNP
``` m642/a642 95.8% identity in 407 aa overlap

```
                  10         20         30         40         50         60
m642.pep  ACRRICPLPAISAVQYIFADVVQQEGCGVFVFRLYEDKESGDDFADKDFLQGAGIGQGVF
          ||||||||  ||||||| :||||||||||||||||||||||||||||||| ||||||||
a642      ACRRICPLSAISAVQYVFADVVQQEGCGVFVFRLYEDKESGDDFADKDFLQCAGIGQGVF
                  10         20         30         40         50         60

70         80         90        100        110        120
m642.pep  LQEAADVFRQSVVAGDGGKAGIGLQAVEQGLVFVQLHACFFFGGGADKLVVNFGIKHIV
          ||||||||  |||||||||||||||||||||||||||||||||||||||||||||||||
a642      LQEAADVFGQSVVAGDGGKAGIGLQAVEQGLVFVQLHACFFFGGGADKLVVNFGIKHIV
                  70         80         90        100        110        120

130        140        150        160        170        180
m642.pep  RAFKNREGADVDSDIAGGVSAFKTLRTQEFLQHLRGGVSVFRGEGFDDVRLHQLMGDGGN
          ||||||||||||||||||||||||||:|||||||||||||||||||||||||||||| |
a642      RAFKNREGADVDSDIAGGVSAFKTLRAQEFLQHLRGGVSVFRGEGFDDVRLHQLMGDGCN
                 130        140        150        160        170        180

190        200        210        220        230        240
m642.pep  RRNGMADVAVKNLGNLMAAPDFAAFVIDEFDVVADVSFQIFKDVFHNAVRHADQLQAAAD
           |||||||||||||||||||||||||||| :||||||| ||||||||||||||||||||
a642      GRNGMADVAVKNLGNLMAAPDFAAFVIDESDVVADVSGQVFKGVFHNAVRHADQLQAAAD
                 190        200        210        220        230        240

250        260        270        280        290        300
m642.pep  RRNGMADVAVKNLGNLMAAPDFAAFVIDEFDVVADVSFQIFKDVFHNAVRHADQLQAAAD
           ||||||||||||||||||||||||||| :||||||| ||| |||||||||||||||||
a642      GRNGMADVAVKNLGNLMAAPDFAAFVIDESDVVADVSGQVFKGVFHNAVRHADQLQAAAD
                 250        260        270        280        290        300

310        320        330        340        350        360
m642.pep  GEFAVFALFGGNEEEVALRVALPVFRGVDVNGLSVDIFVVGLHFACNRRAGGFGFGNTQT
          ||||||||||||||||||||||||||||||||||||  |||  |||:||||||||||: |
a642      GEFAVFALFGGNEEEVALRVALPVFRGVDVNGLSVGIFVVRLHFSGNRRAGGFGFGNAXT
                 310        320        330        340        350        360

370        380        390        400
m642.pep  AALAFENHLQTLRDLRFIAELLQWLQHQRAFDAGTQRNGHAVMPRNP
          ||||||||:|||  ||||||||| ||||||||||||||||||||||
a642      AALAFENHVQTLCDLRFIAELLQELQHQRAFDAGTQRNGHAVMPRNP
                 370        380        330        400
```

The following partial DNA sequence was identified in *N. gonorrhoeae* <SEQ ID 2063>:

```
g643.seq
   1 ATGGTGTTGC CTTTGATGTT GTTGGCGACA ATCAGgTcgg CTACGCTGAc 51 gttgtancGt TTGGcaATGt tGaaCAgggt gtcgccTTCT ACAACGCGGT 101 GGATGCTGGC ATGGagcGGG GAGGTTTCGG CTTCGCCGTC GGCAGCTTTG 151 GCTACGCGCG TTTCCAAACG TGCCCGGCGT TtgCCGTCGG CGGCAACGGT

201 ATGTTGCGGA GATGAGGAAA TGTTGTGTTC GGCAACTGTG TCAGGCGTGC

251 CGATGACGGC GGagaTGGTT TCTTCAGCCT GCCGGCGCag gTTGTTTCGG

301 GCAACAAGCT GCATGAGTTC GTCTGCCGCC TGCATGTCGT TTGGGGGAt

351 GACCTGCGCg aGTGtTGCGG TTTGGGTTTC agacgGCATG GCAGTCTGTT

401 TTTcggTTTG a
```

This corresponds to the amino acid sequence <SEQ ID 2064; ORF 643>:

```
g643.pep
   1 MVLPLMLLAT IRSATLTLXR LAMLNRVSPS TTRWMLAWSG EVSASPSAAL

51 ATRVSKRARR LPSAATVCCG DEEMLCSATV SGVPMTAEMV SSACRRRLFR

101 ATSCMSSSAA CMSFGGMTCA SVAVWVSDGM AVCFSV*
```

The following partial DNA sequence was identified in *N. meningitidis* <SEQ ID 2065>:

```
m643.seq
   1 ATGGTGTTGC CTTTGATGTT GTTGGCGACA ATCAGGTCGG CTACACTGAC

51 GTTGTAGCGT TTGGCAATGT TGAACAGGGT GTCGCCTTCT ACAACGCGGT

101 GGATGCTGGC ATGGAGCGGG GAGATTTCGG CTTCGCCGTC GGCAGCTTTG

151 GCTACGCGCG TTTCCAAACG TACCCGGCGT TTGCCGTCGG CGGCAGCGGT

201 ATGTTGCGGA GATGCGGAAA TTTTGTGTTC GGCAACTGTG TCAGGCGTGC

251 CGATGACGGC GGAGATGGTT TCTTCAGCCT GTCGGCGCAG GTTGTTTCGG

301 GCAACAAGCT GCATGAGTTC GTCTGCCGCC TGCATGTCGT TTTGGGGGAT

351 GATCTGCGCG AGTGTTGCGG TTTGGGTTTC AGACGGCATG GCGGTCTGTT

401 TTTCGGTTTG A
```

This corresponds to the amino acid sequence <SEQ ID 2066; ORF 643>:

```
m643.pep
   1 MVLPLMLLAT IRSATLTL*R LAMLNRVSPS TTRWMLAWSG EISASPSAAL

51 ATRVSKRTRR LPSAAAVCCG DAEILCSATV SGVPMTAEMV SSACRRRLFR

101 ATSCMSSSAA CMSFWGMICA SVAVWVSDGM AVCFSV*
```

Computer analysis of the amino acid sequences gave the following results:

Homology with a Predicted ORF from *N. meningitidis* menA with menB ORF 643 shows 94.9% identity over a 136 aa overlap with a predicted ORF (ORF643.a) from *N. gonorrhoeae*:

```
    m643/g643

10         20         30         40         50         60
    m643.pep    MVLPLMLLATIRSATLTLZRLAMLNRVSPSTTRWMLAWSGEISASPSAALATRVSKRTRR
                |||||||||||||||||||| |||||||||||||||||||||| ||||||||||||||:||
    g643        MVLPLMLLATIRSATLTLXRLAMLNRVSPSTTRWMLAWSGEVSASPSAALATRVSKRARR
                     10         20         30         40         50         60

70         80         90        100        110        120
    m643.pep    LPSAAAVCCGDAEILCSATVSGVPMTAEMVSSACRRRLFRATSCMSSSAACMSFWGMICA
                |||||:|||||  |:||||||||||||||||||||||||||||||||||||||| || ||
    g643        LPSAATVCCGDEEMLCSATVSGVPMTAEMVSSACRRRLFRATSCMSSSAACMSFGGMTCA
                     70         80         90        100        110        120

130
    m643.pep    SVAVWVSDGMAVCFSVX
                |||||||||||||||||
    g643        SVAVWVSDGMAVCFSVX
                    130
```

The following partial DNA sequence was identified in *N. meningitidis* <SEQ ID 2067>:

```
a643.seq
   1 ATGGTGTTGC CTTTGATGTT GTTGGCGACA ATCAGGTCGG CTACACTGAC

51 GTTGTAGCGT TTGGCAATGT TGAACAGGGT GTCGCCTTCT ACAACGCGGT

101 GGATGCTGGC ATGGAGCGGG GAGATTTCGG CTTCGCCGTC GGCAGCTTTG

151 GCTACGCGCG TTTCCAAACG TACCCGGCGT TTGCCGTCGG CGGCAACGGT

201 ATGTTGCGGA GATGAGGAAA TGTTGTGTTC GGCAACTGTG TCAGGCGTGC

251 CGATGACGGC AGAGATGGTT TCTTCAGCCT GTCGGCGCAG GTTGTTTCGG

301 GCAACAAGCT GCATGAGTTC GTCTGCCGCC TGCATGTCGT TTTGGGGGAC

351 GATCTGCGCG AGTGTTGCGG TTTGGGTTTC AGACGGCATG GCGGTCTGTT

401 TTTCGGTTTG A
```

This corresponds to the amino acid sequence <SEQ ID 2068; *ORF 643.a*>:

```
    a643.pep

1    MVLPLMLLAT IRSATLTL*R LAMLNRVSPS TTRWMLAWSG EISASPSAAL

51    ATRVSKRTRR LPSAATVCCG DEEMLCSATV SGVPMTAEMV SSACRRRLFR

101    ATSCMSSSAA CMSFWGTICA SVAVWVSDGM AVCFSV* m643/a643    97.1% identity in 136 aa overlap 10         20         30         40         50         60
    m643.pep    MVLPLMLLATIRSATLTLZRLAMLNRVSPSTTRWMLAWSGEISASPSAALATRVSKRTRR
                |||||||||||||||||| ||||||||||||||||||||| |||||||||||||||||||
    a643        MVLPLMLLATIRSATLTLXRLAMLNRVSPSTTRWMLAWSGEVSASPSAALATRVSKRTRR
                     10         20         30         40         50         60

70         80         90        100        110        120
    m643.pep    LPSAAAVCCGDAEILCSATVSGVPMTAEMVSSACRRRLFRATSCMSSSAACMSFWGMICA
                |||||:|||||  |:|||||||||||||||||||||||||||||||||||||||| |||||
    a643        LPSAATVCCGDEEMLCSATVSGVPMTAEMVSSACRRRLFRATSCMSSSAACMSFWGTICA
                     70         80         90        100        110        120
```

-continued

```
                     130
m643.pep    SVAVWVSDGMAVCFSVX
            |||||||||||||||||
a643        SVAVWVSDGMAVCFSVX
                     130
```

The following partial DNA sequence was identified in *N. gonorrhoeae* <SEQ ID 2069>:

```
g644.seq
    1 ATGCCGTCTG AAAGGccgGC GGATTGTTGC CCGGTGCACT TTGTGGTAAA

51 GTTTAGAAAA TTAACTCTAA ACTGTGGCAG GCGGTTTGAC CGGCCGCCGA

101 TTAATGGGAA CCGACAGAGG AAGCCGATGA TACACACCGA ACCGAGCGCG

151 CAGCCGTCAA CCATGGACAC GGCTGCTTTT TTAAagcaca tcgaatCCGC

201 ATTcCCCCGC ATTTTTTCAG ACGGCATCGA CCTGATGCGA TACCTGCCCG

251 AAGACAAATG GCTTGCCTTG AAGCAGGCGG GTTTGCTGTT GCCCTTCCTC

301 GACAAAAAAC ACGGCGGGCG CAAGGGCAGT CAGTTTGAAA TCCAAGAAGT

351 CCTAAGGATT GCGGGGCATT ACGGCGTGCC CGTTACGCTG CGTACCGGCA

401 TCGAAGGCGC GCTGGTGTTG CAGCCTCTGC AAGagttcgg cggcgaagcG

451 CAAGTCGCAC AAGGTTTGGA CATGATTTTC AAaggcgaaa gccgccgttt 501 gggcgTtacc gaacccgaAa cctccggcgc gGcgaTTGCA CGCGAAAtgc 551 agtcctgcta cgaatatacc gacgaacaAA CCATTTACGT caaCGCCGCG 601 AAATACTGGC AGGGCAATTC GCAAAGCGAC TTCCTcctcg ttgccgccaa 651 agagcgcaaa aacGGcaaac tcgccaaagt CATCGACCTG CTGCTCGTCC

701 CCAAAACATA CATCCGCTGC GAAACCCTCG CATCCGAAGG CCTGCGCGCC

751 GTCCGTTACG CCGTCAACCG CATCGATGCC GAAATGCCTG CAACCGCCGT

801 GATGAAACTC TCCCGGGGCG ACGCTGCCGG TTTGCGCGCG TTCCAAAACA

851 TCTTTATCCG CAGCCGCCTG CAACTGATCG GCATGACGCA CGGCATTATG

901 GAATACATCC TTGACAACCT GAACCGATAT GTCCGCAACG ATATCAGATT

951 CGTCGATTAC GAACGCCGCG AAATCCAACG CCGCCATCAG GTTTCCGAAA

1001 TCCTTTACCG CTACGTCTGC CATTCCGTTT CGcccgtcgC GCccgTCGCC

1051 CATCAATTGA TGGAGGCGAA catcgTCAAA ACcctCGCCA CGGAATACAC

1101 TTAcgcCGCC GCGCAAATGT TGCAAAAACT CTTGGGCGCG AAGGGTTTTG

1151 AACGCGGACA CCCAGCCGGC AATATCGCCA TCGATATCCG CCCCTTCACG

1201 ATTTTTGAAG CCCGAACGA TATGCTTTAT GCCGAAATTT ACGACCAGTT

1251 CGTCCGCGCC ACCGCCGAAG AAAAAGAAGC AGGCATTAAG TTGGACAAAA 1301 accaaaCCCT GctcgacgCC gtgCAAaccg atGTCcgctt tgCCGCCGTT 1351 GCCcgcGacT ACGCTTTGCC CGAAGACATC CGCAGCTTCC TGCAGGAACA

1401 CACCCTGACC GACGCCTGCG CCCTGCAAAA AGTCTTCATC GGCAAAATCA

1451 TCGCCCGACT TTTTGTCTTC GTACAGGAGG AACACGAAGA CACCACAGCC

1501 TTCCTGCTGA ACGACATCCG CAAAGATATA TTGGACTGCC GATATTGCGG

1551 ATAG
```

This corresponds to the amino acid sequence <SEQ ID 2070; ORF 644.ng>:

```
g644.pep
   1 MPSERPADCC PVHFVVKFRK LTLNCGRRFD RPPINGNRQR KPMIHTEPSA

51 QPSTMDTAAF LKHIESAFPR IFSDGIDLMR YLPEDKWLAL KQAGLLLPFL

101 DKKHGGRKGS QFEIQEVLRI AGHYGVPVTL RTGIEGALVL QPLQEFGGEA

151 QVAQGLDMIF KGESRRLGVT EPETSGAAIA REMQSCYEYT DEQTIYVNAA

201 KYWQGNSQSD FLLVAAKERK NGKLAKVIDL LLVPKTYIRC ETLASEGLRA

251 VRYAVNRIDA EMPATAVMKL SRGDAAGLRA FQNIFIRSRL QLIGMTHGIM

301 EYILDNLNRY VRNDIRFVDY ERREIQRRHQ VSEILYRYVC HSVSPVAPVA

351 HQLMEANIVK TLATEYTYAA AQMLQKLLGA KGFERGHPAG NIAIDIRPFT

401 IFEGPNDMLY AEIYDQFVRA TAEEKEAGIK LDKNQTLLDA VQTDVRFAAV

451 ARDYALPEDI RSFLQEHTLT DACALQKVFI GKIIARLFVF VQEEHEDTTA

501 FLLNDIRKDI LDCRYCG*
```

The following partial DNA sequence was identified in *N. meningitidis* <SEQ ID 2071>:

```
m644.seq
    1 ATGCCGTCTG AAAGGTCGGC GGATTGTTGC CCGGCGCACT TTGTGGTAAA

51 GTTTAGAAAA TCAACTCTAA ACTGTGGCAG GCGGTTTGAC CGGCCGCCGA

101 TTAATGGGAA CCGACAGAGG AAGCCGATGA TACACACCGA ACCGAGCGCG

151 CAGCCGTCAA CTATGGACAC GGCTGCTTTT TTAAAGCACA TCGAATCCGC

201 ATTCCGCCGC ATTTTTTCAG ACGGTATCGA CCTGATGCGA TACCTGCCCG

251 AAGACAAATG GCTTGCCTTG AAGCAGGCGG GTTTGCTGTT GCCCTTCCTC

301 GACAAAAAAT ACGGCGGGCG CAAGGGCAGC CAGTTTGAAA TCCAAGAAGT

351 CcTGCGGATT GCGGGGCATT ACGGCGTGCC CGTTACGCTG CGTACCGGCA

401 TCGAAGGCGC GCTGGTGTTG CAGCCACTGC AAGAGTTCGG CGATGAAGCG

451 CAAGTCGCGC AAGGTTTGGA GATGATTTTC AAAGGCGAGG GCGGCGGTTT

501 GGGTGTTACC GAACCCGAAA CCTCCGGCGC GGCGATTGCA CGCGAAATGC

551 AGTCCTACTA CGAATATATC GACGGACAAA CCATTTACGT CAACGCCGCG

601 AAATACTGGC AGGGCAACTC GCAAAGCGAC TTCCTCCTCG TTGCCGCCAA

651 AGAGCGCAAA AACGGCAAAC TCGCCAAAGT CATCGACCTG CTGCTCGTCC

701 CCAAAACATA CATCCGCTGC GAAACCCTCG CATCCGAAGG CTTGCGCGCC

751 GTCCGTTACG CCGTCAACCG CATCGATGCC GAAATGCCTG CAACCGCCGT

801 GATGAAACTC TCCCAGAGCG ACGCTGCCGG TTTGCGCGCG TTCCAAAACA

851 TCTTTATCCG CAGCCGCCTG CAACTGATCG GCATGACGCA CGGCATTATG

901 GAATACATCC TTGAAAATCT GGAACGATAC GTCCGCAACG ACATCAAATT

951 CGTCGATTAC GAACGCCGCG AAATCGGCG CCGCCATCAG GTTTCCGAGA

1001 TTCTTTACCG CTACGTCTGC CATTCCGTTT CGCCTGTTGC CCCCGTCGCC

1051 CATCAGCTGA TGGAGGCGAA CATCGTCAAA ACCCTCGCCA CGGAATACAC

1101 TTACGCCGCC GCGCAAATGT TGCAAAAACT CTTGGGTGCG AAGGGTTTTG

1151 AACGCGGACA CACCGCCGGC AATATCGCTA TCGACATCCG CCCCTTCACG
```

```
1201 ATTTTTGAAG GCCCGAACGA TATGCTTTAT GCCGAAATTT ACGACCAGTT

1251 TGTCCGCGCC ACCGCCGAAG AAAAAGAAGC AGGCATGAAG TTGGACAAAA

1301 ACCAAACCCT GCTCGACCGC CTGCAAACCG ATGCCCGCTT TGCCGCCGTC

1351 GCCCGCGACT ACACTTTGCC TGAAGACATC CGCAGCTTCC TGCAGGAACA

1401 CACCCTGACC GATGCCTGCG CCCTGCAAAA AGTCTTTATC GGCAAAATCA

1451 TCGCCCGACT CTTTGTCTTC GTACAGGCGA ACACGAAGA CACCGCAGCC

1501 TTCCTGCTGA ACGACATCCG CAAAGATATA TTGGACTGCC GATATTGCGG

1551 GTAG
```

This corresponds to the amino acid sequence <SEQ ID 2072; ORF 644>:

```
m644.pep

1 MPSERSADCC PAHFVVKFRK STLNCGRRFD RPPINGNRQR KPMIHTEPSA

51 QPSTMDTAAF LKHIESAFRR IFSDGIDLMR YLPEDKWLAL KQAGLLLPFL

101 DKKYGGRKGS QFEIQEVLRI AGHYGVPVTL RTGIEGALVL QPLQEFGDEA

151 QVAQGLEMIF KGEGGGLGVT EPETSGAAIA REMQSYYEYI DGQTIYVNAA

201 KYWQGNSQSD FLLVAAKERK NGKLAKVIDL LLVPKTYIRC ETLASEGLRA

251 VRYAVNRIDA EMPATAVMKL SQSDAAGLRA FQNIFIRSRL QLIGMTHGIM

301 EYILENLERY VRNDIKFVDY ERREIRRRHQ VSEILYRYVC HSVSPVAPVA

351 HQLMEANIVK TLATEYTYAA AQMLQKLLGA KGFERGHTAG NIAIDIRPFT

401 IFEGPNDMLY AEIYDQFVRA TAEKKEAGMK LDKNQTLLDR LQTDARFAAV

451 ARDYTLPEDI RSFLQEHTLT DACALQKVFI GKIIARLFVF VQAKHEDTAA

501 FLLNDIRKDI LDCRYCG* m644/g644 94.6% identity in 517 aa overlap 10         20         30         40         50         60
m644.pep  MPSERSADCCPAHFVVKFRKSTLNCGRRFDRPPINGNRQRKPMIHTEPSAQPSTMDTAAF
          ||||| |||||:||||||||| ||||||||||||||||||||||||||||||||||||||
g644      MPSERPADCCPVHFVVKFRKLTLNCGRRFDRPPINGNRQRKPMIHTEPSAQPSTMDTAAF
                 10         20         30         40         50         60

70         80         90        100        110        120
m644.pep  LKHIESAFRRIFSDGIDLMRYLPEDKWLALKQAGLLLPFLDKKYGGRKGSQFEIQEVLRI
          |||||||| |||||||||||||||||||||||||||||||||||:|||||||||||||||
g644      LKHIESAFPRIFSDGIDLMRYLPEDKWLALKQAGLLLPFLDKKHGGRKGSQFEIQEVLRI
                 70         80         90        100        110        120

130        140        150        160        170        180
m644.pep  AGHYGVPVTLRTGIEGALVLQPLQEFGDEAQVAQGLEMIFKGEGGGLGVTEPETSGAAIA
          |||||||||||||||||||||||||||| |||||||:|||||:  |||||||||||||||
g644      AGHYGVPVTLRTGIEGALVLQPLQEFGGEAQVAQGLDMIFKGESRRLGVTEPETSGAAIA
                130        140        150        160        170        180

190        200        210        220        230        240
m644.pep  REMQSYYEYIDGQTIYVNAAKYWQGNSQSDFLLVAAKERKNGKLAKVIDLLLVPKTYIRC
          ||||| || | |||||||||||||||||||||||||||||||||||||||||||||||||
g644      REMQSCYEYTDEQTIYVNAAKYWQGNSQSDFLLVAAKERKNGKLAKVIDLLLVPKTYIRC
                190        200        210        220        230        240

250        260        270        280        290        300
m644.pep  ETLASEGLRAVRYAVNRIDAEMPATAVMKLSQSDAAGLRAFQNIFIRSRLQLIGMTHGIM
          ||||||||||||||||||||||||||||||::||||||||||||||||||||||||||||
g644      ETLASEGLRAVRYAVNRIDAEMPATAVMKLSRGDAAGLRAFQNIFIRSRLQLIGMTHGIM
                250        260        270        280        290        300

310        320        330        340        350        360
m644.pep  EYILENLERYVRNDIKFVDYERREIRRRHQVSEILYRYVCHSVSPVAPVAHQLMEANIVK
          ||||:||:|||||||:||||||||| |:|||||||||||||||||||||||||||||||
g644      EYILDNLNRYVRNDIRFVDYERREIQRRHQVSEILYRYVCHSVSPVAPVAHQLMEANIVK
                310        320        330        340        350        360
```

-continued

```
              370        380        390        400        410        420
m644.pep  TLATEYTYAAAQMLQKLLGAKGFERGHTAGNIAIDIRPFTIFEGPNDMLYAEIYDQFVRA
          ||||||||||||||||||||||||||||| ||||||||||||||||||||||||||||||
g644      TLATEYTYAAAQMLQKLLGAKGFERGHPAGNIAIDIRPFTIFEGPNDMLYAEIYDQFVRA
              370        380        390        400        410        420

430        440        450        460        470        480
m644.pep  TAEEKEAGMKLDKNQTLLDRLQTDARFAAVARDYTLPEDIRSFLQEHTLTDACALQKVFI
          |||||||||:|||||||||| :|||:||||||||||:|||||||||||||||||||||||
g644      TAEEKEAGIKLDKNQTLLDAVQTDVRFAAVARDYALPEDIRSFLQEHTLTDACALQKVFI
              430        440        450        460        470        480

490        500        510
m644.pep  GKIIARLFVFVQAKHEDTAAFLLNDIRKDILDCRYCGX
          |||||||||||| :||||:|||||||||||||||||||
g644      GKIIARLFVFVQEEHEDTTAFLLNDIRKDILDCRYCGX
              490        500        510
```

The following partial DNA sequence was identified in *N. meningitidis* <SEQ ID 2073>:

```
a644.seq
    1 ATGCCGTCTG AAAGGTCGGC GGATTGTTGC CCGGCGCACT TTGTGGTAAA

51 GTTTAGAAAA TCAACTCTAA ACTGTGGCAG GCGGTTTGAC CGGCCGCCGA

101 TTAATGGGAA CCGACAGAGG AAGCCGATGA TACACACCGA ACCGAGCGCG

151 CAGCCGTCAA CTATGGACAC GGCTGCTTTT TTAAAGCACA TCGAATCCGC

201 ATTCCGCCGC ATTTTTGCAG ACGGTATCGA CCTGATGCGA TACCTGCCCG

251 AAGACAAATG GCTTGCCTTG AAGCAGGCGG GTTTGCTGTT GCCCTTCCTC

301 GACAAAAAAT ACGGCGGGCG CAAGGGCAGC CAGTTTGAAA TTCAGGAAGT

351 CTTGCGGATT GCGGGGCATT ACGGCGTGCC CGTTANNNNN NNNNNNNNNN

401 NNGAAGGCGC GCTGGTGTTG CAGCCACTGC AAGAGTTCGG CGATGAAGCG

451 CAAATCGCAC AGGGTTTGGA CATGGTTTTC AAAGGCGAGG GCGGCGGTTT

501 AGGCGTTACC GAACCCGAAA CCTCCGGCGC GGCGATTGCC CGAGAAATGC

551 AGTCTTACTA CGAATATACC GACGGACAAA CCATTTACGT CAACGCCGCG

601 AAATACTGGC AGGGCAACTC GCAAAGCGAC TTCCTCCTCG TTGCCGCCAA

651 AGAGCGCAAA AACGGCAAAC TCGCCAAAGT CATCGACCTG CTGCTCGTCC

701 CCAAAACATA CATCCGCTGC GAAACCCTCG CATCCGAAGG CTTGCGCGCC

751 GTCCGTTACG CCGTCAACCG CATCGATGCC GAAATGCCTG CAACCGCCGT

801 GATGAAACTC TCCCAGAGCG ACGCTGCCGG TTTGCGCGCG TTCCAAAACA

851 TCTTTATCCG CAGCCGCCTG CAACTGATCG GCATGACGCA CGGCATTATG

901 GAATACACCC TTGAAAACCT GGAACGATAC GTCCGCAACG ACATCAGATT

951 CGTCGATTAC GAACGCCGCG AAATCCGGCG CCGCCATCAG GTTTCCGAGA

1001 TTCTTTACCG CTACGTCTGC CATTCCGTTT CGCCCGTTGC ACCCGTCGCC

1051 CATCAACTGA TGGAGGCGAA CATCGTCAAA CCCTCGCCA CGGAATACAC

1101 TTACGCCGCC GCGCAAATGT TGCAAAAACT CTTGGGCGCG AAGGGTTTTG

1151 AACGCGGACA CACCGCCGGC AATATCGCTA TCGACATCCG CCCCTTCACG

1201 ATTTTTGAAG CCCGAACGA TATGCTTTAT GCCGAAATTT ACGACCAGTT

1251 TGTCCGCGCC ACCGCCGAAG AAAAAGAAGC AGGCATGAAG TTGGACAAAA

1301 ACCAAACCCT GCTCGACCGC CTGCAAACCG ATGCCCGCTT TGCCGCCGTC

1351 GCCCGCGACT ACACTTTGCC CGAAGACATC CGCAGCTTCC TGCAGGAACA

1401 CACCCTGACC GATGCCTGCG CCCTGCAAAA AGTCTTTATC GGCAAAATCA
```

```
1451 TCGCCCGACT CTTTGTCTTC GTACAGGCGG AACACGAAGA CACCGCAGCC

1501 TTCCTGCTGA ACGACATCCG CAAAGACATA TTGGACTGCC GATATTGCGG

1551 ATAG
```

This corresponds to the amino acid sequence <SEQ ID 2074; ORF 644.a>:

```
a644.pep

1 MPSERSADCC PAHFVVKFRK STLNCGRRFD RPPINGNRQR KPMIHTEPSA

51 QPSTMDTAAF LKHIESAFRR IFADGIDLMR YLPEDKWLAL KQAGLLLPFL

101 DKKYGGRKGS QFEIQEVLRI AGHYGVPVXX XXXXEGALVL QPLQEFGDEA

151 QIAQGLDMVF KGEGGGLGVT EPETSGAAIA REMQSYYEYT DGQTIYVNAA

201 KYWQGNSQSD FLLVAAKERK NGKLAKVIDL LLVPKTYIRC ETLASEGLRA

251 VRYAVNRIDA EMPATAVMKL SQSDAAGLRA FQNIFIRSRL QLIGMTHGIM

301 EYTLENLERY VRNDIRFVDY ERREIRRRHQ VSEILYRYVC HSVSPVAPVA

351 HQLMEANIVK TLATEYTYAA AQMLQKLLGA KGFERGHTAG NIAIDIRPFT

401 IFEGPNDMLY AEIYDQFVRA TAEEKEAGMK LDKNQTLLDR LQTDARFAAV

451 ARDYTLPEDI RSFLQEHTLT DACALQKVFI GKIIARLFVF VQAEHEDTAA

501 FLLNDIRKDI LDCRYCG* m644/a644 97.3% identity in 517 aa overlap 10         20         30         40         50         60
m644.pep   MPSERSADCCPAHFVVKFRKSTLNCGRRFDRPPINGNRQRKPMIHTEPSAQPSTMDTAAF
           ||||||||||||||||||||||||||||||||||||||||||||||||||||||||||||
a644       MPSERSADCCPAHFVVKFRKSTLNCGRRFDRPPINGNRQRKPMIHTEPSAQPSTMDTAAF
                    10         20         30         40         50         60

70         80         90        100        110        120
m644.pep   LKHIESAFRRIFSDGIDLMRYLPEDKWLALKQAGLLLPFLDKKYGGRKGSQFEIQEVLRI
           ||||||||||:|||||||||||||||||||||||||||||||||||:||||||||||||
a644       LKHIESAFPRIFADGIDLMRYLPEDKWLALKQAGLLLPFLDKKHGGRKGSQFEIQEVLRI
                    70         80         90        100        110        120

130        140        150        160        170        180
m644.pep   AGHYGVPVTLRTGIEGALVLQPLQEFGDEAQVAQGLEMIFKGEGGGLGVTEPETSGAAIA
           ||||||||:  :  ||||||||||||||||||:||||:|||:|||||||||||||||||
a644       AGHYGVPVXXXXXXEGALVLQPLQEFGDEAQIAQGLDMVFKGEGGGLGVTEPETSGAAIA
                   130        140        150        160        170        180

190        200        210        220        230        240
m644.pep   REMQSYYEYIDGQTIYVNAAKYWQGNSQSDFLLVAAKERKNGKLAKVIDLLLVPKTYIRC
           |||||||||  ||||||||||||||||||||||||||||||||||||||||||||||||
a644       REMQSYYEYTDGQTIYVNAAKYWQGNSQSDFLLVAAKERKNGKLAKVIDLLLVPKTYIRC
                   190        200        210        220        230        240

250        260        270        280        290        300
m644.pep   ETLASEGLRAVRYAVNRIDAEMPATAVMKLSQSDAAGLRAFQNIFIRSRLQLIGMTHGIM
           ||||||||||||||||||||||||||||||||||||||||||||||||||||||||||||
a644       ETLASEGLRAVRYAVNRIDAEMPATAVMKLSQSDAAGLRAFQNIFIRSRLQLIGMTHGIM
                   250        260        270        280        290        300

310        320        330        340        350        360
m644.pep   EYILENLERYVRNDIKFVDYERREIRRRHQVSEILYRYVCHSVSPVAPVAHQLMEANIVK
           || ||||||||||||:||||||||||||||||||||||||||||||||||||||||||||
a644       EYTLENLERYVRNDIRFVDYERREIRRRHQVSEILYRYVCHSVSPVAPVAHQLMEANIVK
                   310        320        330        340        350        360

370        380        390        400        410        420
m644.pep   TLATEYTYAAAQMLQKLLGAKGFERGHTAGNIAIDIRPFTIFEGPNDMLYAEIYDQFVRA
           ||||||||||||||||||||||||||||||||||||||||||||||||||||||||||||
a644       TLATEYTYAAAQMLQKLLGAKGFERGHTAGNIAIDIRPFTIFEGPNDMLYAEIYDQFVRA
                   370        380        390        400        410        420

430        440        450        460        470        480
m644.pep   TAEEKEAGMKLDKNQTLLDRLQTDARFAAVARDYTLPEDIRSFLQEHTLTDACALQKVFI
           ||||||||||||||||||||||||||||||||||||||||||||||||||||||||||||
a644       TAEEKEAGMKLDKNQTLLDRLQTDARFAAVARDYTLPEDIRSFLQEHTLTDACALQKVFI
                   430        440        450        460        470        480
```

-continued

```
                490        500        510
m644.pep   GKIIARLFVFVQAKHEDTAAFLLNDIRKDILDCRYCGX
           |||||||||||||:||||||||||||||||||||||||
a644       GKIIARLFVFVQAEHEDTAAFLLNDIRKDILDCRYCGX
                490        500        510
```

The following partial DNA sequence was identified in *N. gonorrhoeae* <SEQ ID 2075>:

```
g645.seq
   1 ATGATGATGG TGTTGGCGTT GGGGATGTCG ATGCCGGTTT CGATGATGGT

51 GGAACAGAGC AACACATTGA ATCTTTGCTG CAAAAAGTCG CGCATGACTT

101 GTTCCAGCTC GCGCTCACGC AGTTGTCCGT GCGCCACGCC GATACGGGCT

151 TCGGGCAGCA GGGTTTCCAG CCGCTCGCGC ATATTCTCAA TCGTATCTAC

201 TTCATTGTGC AGGAAAAata cCTGTCCTCC GCGTTTGAGT TCGCGCAACA

251 CGGCTTCGCG CACGCTGCCT TCGCTGAACG GTTTGACAAA GGTTTTCACG

301 GCGAGGCGGC GGCTCGGTGC AGTGGTAATC AGCGAGAAGT CGCGCAGACC

351 TTCGAGCGCC ATGCTGAGGG TGCGCGGAAT CGGCGTGGCG GTCATGGTTA

401 GGATGTCGAC ATTGGCGCGC AGGCGTTTGA GCTGCTCTTT CTGTCGCACG

451 CCGAAGCGGT GTTCTTCATC GATAATCAAT AAACCTAAGT TTTTGAATTT

501 TATGTCGTCC TGCACCAATT TGTGCGTACC GATAACGATA TCGACAGTAC

551 CGTCCGCCAT GCCTTCGAGC GTGGCTTTGG TGGCTTTGCT GTTGTTGAAA

601 CGCGAAAGGC TGGCGACTTT CACGGGGAAA TCGGCGAAAC GGTCGGCGAA

651 GTTTTGCGCG TGCTGCTCGA CCAGAAGCGT GGTCGGGGCG AGTACGGCGA

701 CCTGTTTGCC GCCCATCACC GCCACAAACG CGGCGCGAAG GGCGACTTCG

751 GTTTTGCCGA AACCGACATC GCCGCACACA AGTCGGTCCA TCGGCTTCGC

801 CTGCGTCAAA TCTTTAATCA CGGcggcgat ggcggcggcC TGGTCTTCGG

851 TTTCCTCGTA G
```

This corresponds to the amino acid sequence <SEQ ID 2076; ORF 645.ng>:

```
g645.pep
   1 MMMVLALGMS MPVSMMVEQS NTLNLCCKKS RMTCSSSRSR SCPCATPIRA

51 SGSRVSSRSR IFSIVSTSLC RKNTCPPRLS SRNTASRTLP SLNGLTKVFT

101 ARRRLGAVVI SEKSRRPSSA MLRVRGIGVA VMVRMSTLAR RRLSCSFCRT

151 PKRCSSSIIN KPKFLNFMSS CTNLCVPITI STVPSAMPSS VALVALLLLK

201 RERLATFTGK SAKRSAKFCA CCSTRSVVGA STATCLPPIT ATNAARRATS

251 VLPKPTSPHT SRSIGFACVK SLITAAMAAA WSSVSS*
```

The following partial DNA sequence was identified in *N. meningitidis* <SEQ ID 2077>:

```
m645.seq
   1 ATGATGATGG TGTTGGCGTT GGGGATATCG ATACCGGTTT CGATGATGGT

51 GGAACAGAGC AACACGTTAA ATCGTTGCTG CAAAAAGTCG CGCATGACTT

101 GTTCCAGCTC GCGCTCGCGC AGTTGTCCGT GCGCCACGCC GATGCGGGCT

151 TCGGGCAGCA GGGTTTCCAG CCGCTCGCGC ATATTTTCAA TCGTATCTAC
```

-continued

```
201 TTCATTGTGC AGGAAAAATA CCTGTCCTCC GCGTTTGAGT TCGCGCAACA
251 CGGCTTCGCG CACGCTGCCT TCGCTAAAGG GTTTGACAAA GGTTTTGACG
301 GCGAGGCGGC GGCTGGGCGC GGTGGTAATC AGCGAGAAGT CGCGCAGTCC
351 TTCCAACGCC ATACTTAAAG TACGCGGAAT CGGCGTGGCG GTCATGGTAA
401 GGATATCAAC ATTGGCGCGC AGGCGTTTGA GCTGCTCTTT CTGACGCACG
451 CCGAAGCGGT GTTCTTCGTC GATAATCACT AAACCTAAGT TTTTGAATTT
501 GATGTCGTCC TGCACCAGTT TGTGCGTACC GATAACAATA TCGACCGTGC
551 CGTCTGCCAT GCCTTCCAGC GCGGCTTTGG TGGCTTTGCT GTTGTTGAAA
601 CGCGAAAGGC TGGCGACTTT CACGGGGAAA TCGGCGAAAC GGTCGGCGAA
651 GTTTTGCGCG TGCTGCTCGA CCAAAAGCGT GGTCGGAGCA AGTACGGCGA
701 CCTGTTTGCC GCCCATCACC GCCACAAACG CGGCGCGCAG GGCGACTTCG
751 GTTTTGCCGA AGCCGACATC GCCGCACACA AGGCGATCCA TCGGCTTCGC
801 TTGCGTCAAA TCTTTAATCA CGGCGGCGAT GGCGGCGGCC TGGTCTTCGG
851 TTTCCTCGTA G
```

This corresponds to the amino acid sequence <SEQ ID 2078; ORF 645>:

```
m645.pep
        1    MMMVLALGIS IPVSMMVEQS NTLNRCCKKS RMTCSSSRSR SCPCATPMRA
       51    SGSRVSSRSR IFSIVSTSLC RKNTCPPRLS SRNTASRTLP SLKGLTKVLT
      101    ARRRLGAVVI SEKSRSPSNA ILKVRGIGVA VMVRISTLAR RRLSCSF*RT
      151    PKRCSSSIIT KPKFLNLMSS CTSLCVPITI STVPSAMPSS AALVALLLLK
      201    RERLATFTGK SAKRSAKFCA CCSTKSVVGA STATCLPPIT ATNAARRATS
      251    VLPKPTSPHT RRSIGFACVK SLITAAMAAA WSSVSS* m645/g645    93.7% identity in 286 aa overlap 10         20         30         40         50         60
m645.pep      MMMVLALGISIPVSMMVEQSNTLNRCCKKSRMTCSSSRSRSCPCATPMRASGSRVSSRSR
              ||||||||:|:||||||||||||||:||||||||||||||||||||||:||||||||||
g645          MMMVLALGMSMPVSMMVEQSNTLNLCCKKSRMTCSSSRSRSCPCATPIRASGSRVSSRSR
                      10         20         30         40         50         60

70         80         90        100        110        120
m645.pep      IFSIVSTSLCRKNTCPPRLSSRNTASRTLPSLKGLTKVLTARRRLGAVVISEKSRSPSNA
              |||||||||||||||||||||||||||||||||:|||||:|||||||||||||||||:|
g645          IFSIVSTSLCRKNTCPPRLSSRNTASRTLPSLNGLTKVFTARRRLGAVVISEKSRRPSSA
                      70         80         90        100        110        120

130        140        150        160        170        180
m645.pep      ILKVRGIGVAVMVRISTLARRRLSCSFXRTPKRCSSSIITKPKFLNLMSSCTSLCVPITI
              :|:||||||||||:|||||||||||||| |||||||||:||||||||:|||||:|||||
g645          MLRVRGIGVAVMVRMSTLARRRLSCSFCRTPKRCSSSIINKPKFLNFMSSCTNLCVPITI
                     130        140        150        160        170        180

190        200        210        220        230        240
m645.pep      STVPSAMPSSAALVALLLLKRERLATFTGKSAKRSAKFCACCSTKSVVGASTATCLPPIT
              |||||||||:|||||||||||||||||||||||||||||||||:||||||||||||||||
g645          STVPSAMPSSVALVALLLLKRERLATFTGKSAKRSAKFCACCSTRSVVGASTATCLPPIT
                     190        200        210        220        230        240

250        260        270        280
m645.pep      ATNAARRATSVLPKPTSPHTRRSIGFACVKSLITAAMAAAWSSVSSX
              |||||||||||||||||||||:|||||||||||||||||||||||||
g645          ATNAARRATSVLPKPTSPHTSRSIGFACVKSLITAAMAAAWSSVSSX
                     250        260        270        280
```

The following partial DNA sequence was identified in *N. meningitidis* <SEQ ID 2079>:

```
a645.seq
   1 ATGATGATGG TGTTGGCGTT GGGAATGTCG ATACCGGTTT CGATGATGGT

51 GGAACAGAGC AACACGTTAA ATCGTTGCTG CAAAAAGTCG CGCATGACTT

101 GTTCCAGCTC GCGCTCGCGC AGTTGTCCGT GCGCCACGCC GATGCGGGCT

151 TCGGGCAGCA GGGTTTCCAG CCGCTCACGC ATGTTTTCGA TGGTATCCAC

201 TTCATTGTGC AGGAAAAATA CTTGCCCGCC GCGTTTGAGT TCGCGCAATA

251 CGGCTTCGCG CACGCTGCCT TCGCTGAACG GTTTGACAAA GGTTTTGACG

301 GCGAGGCGGC GGCTGGGCGC AGTGGTAATC AGCGAGAAGT CGCGCAGTCC

351 TTCCAGCGCC ATACTTAAAG TACGCGGAAT CGGCGTAGCG GTCATGGTAA

401 GGATGTCGAC ATTGGCGCGC AGGCGTTTGA GCTGCTCTTT CTGACGCACG

451 CCGAAGCGGT GTTCTTCGTC GATAATCACT AAACCTACGT TTTTGAATTT

501 TATGTCGTCC TGCACCAGTT TGTGCGTACC GATAACAATA TCGACCGTGC

551 CGTCCGCCAT GCCTTCCAGC GCGGCTTTGG TGGCTTTGCT GTTGTTGAAA

601 CGCGAAAGGC TGGCGACTTT CACGGGGAAA TCGGCGAAGC GGTCGGCAAA

651 ATTTGCGCGG TGCTGCTCGA CCAGAAGCGT GGTCGGTGCG AGTACGGCAA

701 CTTGTTTGCC ACCCATTACC GCCACAAACG CGGCGCGCAG GGCGACTTCG

751 GTTTTGCCGA AACCGACATC GCCGCACACG AGGCGGTCCA TCGGCTTCGC

801 CTGCGTCAAA TCTTTAATCA CGGCGGCGAT GGCGGCTGCC TGGTCTTCGG

851 TTTCTTCGTA G
```

This corresponds to the amino acid sequence <SEQ ID 2080; *ORF* 645.a>:

```
m645.pep

1     MMMVLALGMS IPVSMMVEQS NTLNRCCKKS RMTCSSSRSR SCPCATPMRA

51     SGSRVSSRSR MFSMVSTSLC RKNTCPPRLS SRNTASRTLP SLNGLTKVLT

101     ARRRLGAVVI SEKSRSPSSA ILKVRGIGVA VMVRMSTLAR RRLSCSF*RT

151     PKRCSSSIIT KPTFLNFMSS CTSLCVPITI STVPSAMPSS AALVALLLLK

201     RERLATFTGK SAKRSAKFCA CCSTRSVVGA STATCLPPIT ATNAARRATS

251     VLPKPTSPHT RRSIGFACVK SLITAAMAAA WSSVSS* m645/a645   96.9% identity in 286 aa overlap 10        20        30        40        50        60
m645.pep    MMMVLALGISIPVSMMVEQSNTLNRCCKKSRMTCSSSRSRSCPCATPMRASGSRVSSRSR
            ||||||||:|||||||||||||||||||||||||||||||||||||||||||||||||||
a645        MMMVLALGMSMPVSMMVEQSNTLNLCCKKSRMTCSSSRSRSCPCATPIRASGSRVSSRSR
                    10        20        30        40        50        60

70        80        90       100       110       120
m645.pep    IFSIVSTSLCRKNTCPPRLSSRNTASRTLPSLKGLTKVLTARRRLGAVVISEKSRSPSNA
            :||:|||||||||||||||||||||||||||||:||||||||||||||||||||||||:|
a645        MFSMVSTSLCRKNTCPPRLSSRNTASRTLPSLNGLTKVLTARRRLGAVVISEKSRSPSSA
                    70        80        90       100       110       120

130       140       150       160       170       180
m645.pep    ILKVRGIGVAVMVRISTLARRRLSCSFXRTPKRCSSSIITKPKFLNLMSSCTSLCVPITI
            ||||||||||||||:||||||||||||||||||||||||||| |||:|||||||||||||
a645        ILKVRGIGVAVMVRMSTLARRRLSCSFXRTPKRCSSSIITKPTFLNFMSSCTSLCVPITI
                   130       140       150       160       170       180

190       200       210       220       230       240
m645.pep    STVPSAMPSSAALVALLLLKRERLATFTGKSAKRSAKFCACCSTKSVVGASTATCLPPIT
            ||||||||||||||||||||||||||||||||||||||||||||:|||||||||||||||
a645        STVPSAMPSSAALVALLLLKRERLATFTGKSAKRSAKFCACCSTRSVVGASTATCLPPIT
                   190       200       210       220       230       240
```

```
                        -continued
              250         260         270        280
m645.pep   ATNAARRATSVLPKPTSPHTRRSIGFACVKSLITAAMAAAWSSVSSX
           |||||||||||||||||||||||||||||||||||||||||||||||
a645       ATNAARRATSVLPKPTSPHTRRSIGFACVKSLITAAMAAAWSSVSSX
              250         260         270        280
```

The following partial DNA sequence was identified in *N. gonorrhoeae* <SEQ ID 2081>:

```
g647.seq
   1 ATGCAAAGGC TCGCCGCAGA CGGCATCCAA ATCTTTTTTG TAGGTGTCGA

51 TGGGCAGTTT GCCTTGCGAA TAAACGGTTT GGTTAAAGAG CGTGCACGCT

101 CCGTATTCTT TGGCAAGGTT TGCCGATGCT TTGAGCAGGT AATACTGTAT

151 GGCTTCAAAG GTACGGTGGG TCAGACCGAG CGCGGAACCG TCGCTGTAGC

201 GGACACCGTT TTTCGCCAGA TAGTAGGCGT AGTTGATGAC ACCGATGCCG

251 AGCGAACGGC GGTCCATAGT AGAGGTACGC GCGGCTTCTA CCGGATATCC

301 CTGATAATCT AA
```

This corresponds to the amino acid sequence <SEQ ID 2082; ORF 647.ng>:

```
g647.pep
   1 MQRLAADGIQ IFFVGVDGQF ALRINGLVKE RARSVFFGKV CRCFEQVILY

51 GFKGTVGQTE RGTVAVADTV FRQIVGVVDD TDAERTAVHS RGTRGFYRIS

101 LII*
```

The following partial DNA sequence was identified in *N. meningitidis* <SEQ ID 2083>:

```
m647.seq
   1 ATGCAAAGGC TCGCCGCAGA CGGCATCCAA ATCTTTTTTG TAAGTGTCGA

51 TGGGCAGTTT GCCTTGCGAA TAAACGGTTT GGTTAAAGAG CGTGCACGCA

101 CCGTATTCTT TGGCAAGGTT TGCCGATGCT TTGAGCAGGT AATACTGTAT

151 GGCTTCAAAG GTACGGTGGG TCAGACCGAG CGCGGAACCG TCGCTGTAGC

201 GGACACCGTT TTTCGCCAGA TAATAAGCAT AGTTAATCAC GCCGATGCCG

251 AGCGAACGGC GGCCCATAGT AGAGGTACGC GCGGCTTCTA CCGGATATCC

301 CTGATAATCT AA
```

This corresponds to the amino acid sequence <SEQ ID 2084; *ORF 647*>:

```
m647.pep
         1    MQRLAADGIQ IFFVSVDGQF ALRINGLVKE RARTVFFGKV CRCFEQVILY

51    GFKGTVGQTE RGTVAVADTV FRQIISIVNH ADAERTAAHS RGTRGFYRIS

101    LII* m647/g647    91.3% identity in 103 aa overlap 10         20         30         40         50         60
m647.pep   MQRLAADGIQIFFVSVDGQFALRINGLVKERARTVFFGKVCRCFEQVILYGFKGTVGQTE
           ||||||||||||:|||||||||||||||||||:|||||||||||||||||||||||||||
g647       MQRLAADGIQIFFVGVDGQFALRINGLVKERARSVFFGKVCRCFEQVILYGFKGTVGQTE
                   10         20         30         40         50         60
```

```
                        -continued
                  70         80         90        100
m647.pep    RGTVAVADTVFRQIISIVNHADAERTAAHSRGTRGFYRISLIIX
            ||||||||||||||:::|: :||||||:|||||||||||||||
g647        RGTVAVADTVFRQIVGVVDDTDAERTAVHSRGTRGFYRISLIIX
                  70         80         90        100
```

The following partial DNA sequence was identified in *N. meningitidis* <SEQ ID 2085>:

```
a647.seq
  1 GTGCAAAGGC TCGTTACACA CAGCGTCCAA GTCTTTTTTG TAGGTGTCGA

51 TGGGCAGTTT GCCTTGCGAA TAAACGGTTT GGTTAAAGAG CGTGCACGCA

101 CCGTATTCTT TGGCAAGGTT TGCCGATGCT TTGAGCAGGT AATACTGTAT

151 GGCTTCAAAG GTACGGTGGG TCAGACCGAG CGCGGAGCCG TCGCTGTAGC

201 GGACACCGTT TTTCGCCAAA TAATACGCAT AGTTGATCAC GCCGATACCG

251 AGCGAACGGC GGCCCATAGT GGAGGTACGC GCGGCTTCTA CCGGATATCC

301 CTGATAATCT AA
```

This corresponds to the amino acid sequence <SEQ ID 2086; ORF 647.a>:

```
m647.pep

1   VQRLVTHSVQ VFFVGVDGQF ALRINGLVKE RARTVFFGKV CRCFEQVILY

51   GFKGTVGQTE RGAVAVADTV FRQIIRIVDH ADTERTAAHS GGTRGFYRIS

101   LII* m647/a647    87.4% identity in 103 aa overlap 10         20         30         40         50         60
m647.pep    MQRLAADGIQIFFVSVDGQFALRINGLVKERARTVFFGKVCRCFEQVILYGFKGTVGQTE
            :|||:: :::|:|||:||||||||||||||||||||||||||||||||||||||||||||
a647        VQRLVTHSVQVFFVGVDGQFALRINGLVKERARTVFFGKVCRCFEQVILYGFKGTVGQTE
                    10         20         30         40         50         60
                    70         80         90        100
m647.pep    RGTVAVADTVFRQIISIVNHADAERTAAHSRGTRGFYRISLIIX
            ||:||||||||||| ||:|||:||||||| |||||||||||||
a647        RGAVAVADTVFRQIIRIVDHADTERTAAHSGGTRGFYRISLIIX
                    70         80         90        100
```

The following partial DNA sequence was identified in *N. gonorrhoeae* <SEQ ID 2087>:

```
g648.seq
  1 ATGAACAGGC GCAACGCGCG GATCGAACGG GCTGTGCGTA TTGCAGTGAT

51 CGACGTTTTG AATGTAGATG CGCCCGGTCC CGGCACGCTC CTGCATCAGC

101 GTGGAAAACA GGTCGGCAGC CGGAATGATA CGCTTGCGTA TGTTCGGGTC

151 TTGCTCGTAT TTCGTATAGA GCCGCTCAAA TTCGTCTTGG TCGGCAAAAA

201 ACGCTTCGTA CAACCCCGAA ACCTCGTTGG GCGAAAACAG CGTAATGTTG

251 CCGCCCTTAA TCAGGCGGGT GTACAGCAGG CGGTTGATTT GCACGCCATA

301 ATCAAGCTGG CGGATACGGT TGTCTTCCAC GCCCCGGTTG TTTTTCAACA

351 CCAGCAGGCT TTCGGCTTCA ATATGCCACA AGGGGTAGAA CAAGGTTGCC

401 GCGCCGCCGC GCACGCCACC TTGCGAACAA GATTTGACCG CCGCCTGAAA

451 CATCTTAAAG AAGGGAATGC AGCCGGTATG CCGGGCTTCA CCGCCCCGGA
```

```
501 TTTCGCTGTC CAGCCCGCGG ATACGTCCGG CATTGATGCC GATGCCCGCG

551 CGTTGGGAAA CGTATTTCAC AATCGCGCTG GTAGTGGCAT TGATGGAATC

601 CAAACTATCG TCGCATTCAA TCAGCACACA GCTTGA
```

This corresponds to the amino acid sequence <SEQ ID 2088; ORF 648.ng>:

```
g648.pep
  1 MNRRNARIER AVRIAVIDVL NVDAPGPGTL LHQRGKQVGS RNDTLAYVRV

51 LLVFRIEPLK FVLVGKKRFV QPRNLVGRKQ RNVAALNQAG VQQAVDLHAI

101 IKLADTVVFH APVVFQHQQA FGFNMPQGVE QGCRAAAHAT LRTRFDRRLK

151 HLKEGNAAGM PGFTAPDFAV QPADTSGIDA DARALGNVFH NRAGSGIDGI

201 QTIVAFNQHT A*
                                                         20
```

The following partial DNA sequence was identified in *N. meningitidis* <SEQ ID 2089>:

```
m648.seq
  1 ATGAACAGGC GCGACGCGCG GATCGAACGG GCTGTGCGTA TTGCAGTGAT

51 CGACGTTTTG AATGTAGATG CGCCCGGTTC CGGCACGCTC CTGCATCAGC

101 GTGGAAAACA GGTCGGCAGC CGGAATGATG CGCTTGCGGA TATCAGGGTC

151 TTGCTCGTAT TTCGTATAGA GCCGCTCAAA TTCGTCTTGG TCGGCAAAAA

201 ACGCTTCGTA CAATCCCGGA ACCTCGTTGG GCGAAAACAG CGTAATGTTG

251 CCGCCCTTAA TCAGGCGGGT GTACAGCAGG CGGTTGATTT GCACGCCGTA

301 ATCAAGCTGA CGGATACGGT TGTCTTCCAC ACCGCGGTTG TTTTTCAACA

351 CCAGCAGGCT TTCGGCTTCG ATATGCCACA AGGGGTAGAA CAAGGTTGCC

401 GCGCCGCCGC GCACGCCGCC TTGCGAACAG GATTTGACCG CCGCCTGAAA

451 CATTTTAAAG AAGGGAATGC AGCCGGTATG CCGCGCTTCG CCGCCCCGGA

501 TTTCGCTGTC CAAACCGCGG ATACGTCCGG CATTGATGCC GATGCCCGCA

551 CGCTGGGAAA CGTATTTCAC AATCGCGCTG GTAGTGGCAT TGATGGAATC

601 CAAACTATCG TCGCATTCAA TCAGCACACA GCTTGA
```

This corresponds to the amino acid sequence <SEQ ID 2090; ORF 648>:

```
m648.pep

1    MNRRDARIER AVRIAVIDVL NVDAPGSGTL LHQRGKQVGS RNDALADIRV

51    LLVFRIEPLK FVLVGKKRFV QSRNLVGRKQ RNVAALNQAG VQQAVDLHAV

101    IKLTDTVVFH TAVVFQHQQA FGFDMPQGVE QGCRAAAHAA LRTGFDRRLK

151    HFKEGNAAGM PRFAAPDFAV QTADTSGIDA DARTLGNVFH NRAGSGIDGI

201    QTIVAFNQHT A* m648/g648    91.5% identity in 211 aa overlap 10         20         30         40         50         60
    m648.pep  MNRRDARIERAVRIAVIDVLNVDAPGSGTLLHQRGKQVGSRNDALADIRVLLVFRIEPLK
              ||||:|||||||||||||||||||||| |||||||||||||||:|| :||||||||||||
        g648  MNRRNARIERAVRIAVIDVLNVDAPGPGTLLHQRGKQVGSRNDTLAYVRVLLVFRIEPLK
                      10         20         30         40         50         60
```

```
                        70        80        90       100       110       120
   m648.pep   FVLVGKKRFVQSRNLVGRKQRNVAALNQAGVQQAVDLHAVIKLTDTVVFHTAVVFQHQQA
              |||||||||| |||||||||||||||||||||||||||||:|||:||||||:||||||||
      g648   FVLVGKKRFVQPRNLVGRKQRNVAALNQAGVQQAVDLHAIIKLADTVVFHAPVVGQHQQA
                        70        80        90       100       110       120

130       140       150       160       170       180
   m648.pep   FGFDMPQGVEQGCRAAAHAALRTGFDRRLKHFKEGNAAGMPRFAAPDFAVQTADTSGIDA
              |||:||||||||||||||:|||||||||||:|||||||||||:|||||| ||||||||||
      g648   FGFNMPQGVEQGCRAAAHATLRTRFDRRLKHLKEGNAAGMPGFTAPDFAVQPADTSGIDA
                       130       140       150       160       170       180

190       200       210
   m648.pep   DARTLGNVFHNRAGSGIDGIQTIVAFNQHTAX
              |||:||||||||||||||||||||||||||||
      g648   DARALGNVFHNRAGSGIDGIQTIVAFNQHTAX
                       190       200       210
```

The following partial DNA sequence was identified in *N. meningitidis* <SEQ ID 2091>:

```
a648.seq
   1 ATGAACAGGC GCAACGCGCG GATCGAACGG GCTGTGCGTA TTGCAGTGAT

51 CGACGTTTTG AATGTAGATG CGCCCGGTTC CGGCACGCTC CTGCATCAGC

101 GTGGAAAACA GGTCGGCAGC CGGAATGATG CGCTTGCGGA TATCAGGGTC

151 TTGCTCGTAT TCGTATAGA GCCGCTCAAA TTCGTCTTGG TCGGCAAAAA

201 ACGCTTCGTA CAATCCCGGA ACCTCGTTGG GCGAAAACAG CGTAATGTTG

251 CCGCCCTTAA TCAGGCGGGT GTACAGCAGG CGGTTGATTT GCACGCCGTA

301 ATCAAGCTGA CGGATACGGT TGTCTTCCAC GCCCCGGTTG TTTTTCAACA

351 CCAGCAGGCT TTCGGCTTCG ATATGCCACA AGGGGTAGAA CAAGGTTGCC

401 GCGCCGCCGC GCACGCCACC TTGCGAACAG GATTTGACTG CCGCCTGAAA

451 CATTTTAAAG AAGGGAATGC AGCCGGTATG CCGTGCTTCG CCGCCCCGGA

501 TTTCGCTGTC CAGTCCGCGG ATACGTCCGG CATTGATGCC GATGCCCGCA

551 CGCTGGGAAA CGTATTTCAC AATCGCGCTG GTAGTGGCGT TGATGGAATC

601 CAGGCTGTCG TCGCATTCGA TCAATACGCA GCTTGA
```

This corresponds to the amino acid sequence <SEQ ID 2092; *ORF* 648.a>:

```
a648.pep

1    MNRRDARIER AVRIAVIDVL NVDAPGSGTL LHQRGKQVGS RNDALADIRV

51    LLVFRIEPLK FVLVGKKRFV QSRNLVGRKQ RNVAALNQAG VQQAVDLHAV

101    IKLTDTVVFH APVVGQHQQA FGFDMPQGVE QGCRAAAHAT LRTGFDCRLK

151    HFKEGNAAGM PCFAAPDFAV QSADTSGIDA DARTLGNVFH NRAGSGVDGI

201    QAVVAFDQYA A* m648/a648    93.8% identity in 211 aa overlap 10        20        30        40        50        60
   m648.pep   MNRRDARIERAVRIAVIDVLNVDAPGSGTLLHQRGKQVGSRNDALADIRVLLVFRIEPLK
              ||||:|||||||||||||||||||||||:||||||||||||||||||||||||||||||
      a648   MNRRNARIERAVRIAVIDVLNVDAPGPGTLLHQRGKQVGSRNDALADIRVLLVFRIEPLK
                       10        20        30        40        50        60

70        80        90       100       110       120
   m648.pep   FVLVGKKRFVQSRNLVGRKQRNVAALNQAGVQQAVDLHAVIKLTDTVVFHTAVVFQHQQA
              |||||||||||||||||||||||||||||||||||||||||||||||||||:||||||||
      a648   FVLVGKKRFVQSRNLVGRKQRNVAALNQAGVQQAVDLHAVIKLTDTVVFHAPVVFQHQQA
                       70        80        90       100       110       120
```

```
              130        140        150        160        170        180
m648.pep   FGFDMPQGVEQGCRAAAHAALRTGFDRRLKHFKEGNAAGMPRFAAPDFAVQTADTSGIDA
           ||||||||||||||||||:|||||  ||||||||||||| |||||||:||||||||
a648       FGFNMPQGVEQGCRAAAHATLRTRFDCRLKHLKEGNAAGMPCFTAPDFAVQSADTSGIDA
              130        140        150        160        170        180

190        200        210
m648.pep   DARTLGNVFHNRAGSIDGIQTIVAFNQHTAX
           ||||||||||||||||:|||::|||:|::||
a648       DARTLGNVFHNRAGSVDGIQAVVAFDQYAAX
              190        200        210
```

The following partial DNA sequence was identified in N. gonorrhoeae <SEQ ID 2093>:

```
g649.seq
  1 ATGCTTGCCA TACTGTTGTC TGCAATACTG GGACTGGTAT CAACAACTGC

51 CGCTGCCGGT ACGTCAGAAC CCGCCCACCG ACATACCAAA CATATCAGCA

101 AGGCAAACAA GCAGATGCTG CACCCCGAAT GCAGGAAATA TTTGGAACGC

151 CGTGCCGCGT GGTACCGATC GCAAGGCAAC GTGCAGGAAT TGCGCGAAAA

201 CAAAAAGGCG CGCAAAGCAT TCCGCACCCT GCCTTATGCG GAACAGAAAA

251 TCCAATGCCG GGCGGCTTAT GAGGCTTTCG ATGATTTCGA CGGCGGCAGG

301 TTCCGCCGTT AA
```

This corresponds to the amino acid sequence <SEQ ID 2094; ORF 649.ng>:

```
g649.pep
  1 MLAILLSAIL GLVSTTAAAG TSEPAHRHTK HISKANKQML HPECRKYLER

51 RAAWYRSQGN VQELRENKKA RKAFRTLPYA EQKIQCRAAY EAFDDFDGGR

101 FRR*
```

The following partial DNA sequence was identified in N. meningitidis <SEQ ID 2095>:

```
m649.seq
  1 ATGCTTGCCA TACTGTTGTC TGCAATATTG GGACTGGTAT CGACAACTGC

51 CGCTGCCGGT ACGTCAGAAC CCGCCCACCG CGATACCAAA CATATCCGCA

101 AGGCAAACAA GCAGATGCTG CACCCCGAAT GCAGGAAATA TTTGGAACGC

151 CGTGCCGCGT GGTACCGATC GCAAGGCAAC GTGCAGGAAT TGCGCGAAAA

201 CAAAAAGGCG CGCAAAGCAT TCCGCTCCCT GCCTTATGCG GAACAGAAAA

251 TCCAATGCCG GGCGGCTTAT GAGGCTTTCG ATGATTTCGA CGGCGGCAGT

301 TTCCGCCGTT AA
```

This corresponds to the amino acid sequence <SEQ ID 2096; ORF 649>:

```
m649.pep
        1   MLAILLSAIL GLVSTTAAAG TSEPAHRDTK HIRKANKQML HPECRKYLER

51   RAAWYRSQGN VQELRENKKA RKAFRSLPYA EQKIQCRAAY EAFDDFDGGS

101   FRR* m649/g649   96.1% identity in 103 aa overlap
```

```
                  10         20         30         40         50         60
m649.pep   MLAILLSAILGLVSTTAAAGTSEPAHRDTKHIRKANKQMLHPECRKYLERRAAWYRSQGN
           ||||||||||||||||||||||||||| |||| |||||||||||||||||||||||||||
g649       MLAILLSAILGLVSTTAAAGTSEPAHRHTKHISKANKQMLHPECRKYLERRAAWYRSQGN
                  10         20         30         40         50         60

70         80         90        100
m649.pep   VQELRENKKARKAFRSLPYAEQKIQCRAAYEAFDDFDGGSFRRX
           |||||||||||||||:|||||||||||||||||||||| ||||
g649       VQELRENKKARKAFRTLPYAEQKIQCRAAYEAFDDFDGGRFRRX
                  70         80         90        100
```

The following partial DNA sequence was identified in *N. meningitidis* <SEQ ID 2097>:

```
a649.seq
   1 ATGCTTGCCA TACTGTTGTC TGCAATATTG GGACTGGTAT CGACAACTGC

51 CGCTGCCGGT ACGTCAGAAC CCGCCCACCG CGATACCAAA CATATCCGCA

101 AGGCAAACAA GCAGATGCTG CACCCCGAAT GCAGGAAATA TTTGGAACGC

151 CGTGCCGCGT GGTACCGATC GCAAGGCAAC GTGCAGGAAT TGCGCGAAAA

201 CAAAAAGGCG CGCAAAGCAT TCCGCTCCCT GCCTTATAAG GAACAGAAAA

251 CCCAATGCCG GGCGGCTTAT GAGGCTTTCG ATGATTTCGA CGGCAGCAGG

301 TTCCGCCGTT AA
```

This corresponds to the amino acid sequence <SEQ ID 2098; ORF 649.a>:

```
a649.pep

1  MLAILLSAIL GLVSTTAAAG TSEPAHRDTK HIRKANKQML HPECRKYLER

51  RAAWYRSQGN VQELRENKKA RKAFRSLPYK EQKTQCRAAY EAFDDFDGSR

101  FRR* m649/a649  96.1% identity in 103 aa overlap 10         20         30         40         50         60
m649.pep   MLAILLSAILGLVSTTAAAGTSEPAHRDTKHIRKANKQMLHPECRKYLERRAAWYRSQGN
           ||||||||||||||||||||||||||||||||||||||||||||||||||||||||||||
a649       MLAILLSAILGLVSTTAAAGTSEPAHRDTKHIRKANKQMLHPECRKYLERRAAWYRSQGN
                  10         20         30         40         50         60

70         80         90        100
m649.pep   VQELRENKKARKAFRSLPYAEQKIQCRAAYEAFDDFDGGSFRRX
           ||||||||||||||||||| ||| ||||||||||||||:||||
a649       VQELRENKKARKAFRSLPYKEQKEQCRAAYEAFDDFDGSRFRRX
                  70         80         90        100
```

The following partial DNA sequence was identified in *N. gonorrhoeae* <SEQ ID 2099>:

```
g650.seq
   1 ATGTCCAAAC TCAAAACCAT CGCCCTGACC GCATCAGGTC TGTCCGTTTG

51 TCCGGGTTTC CTATATGCCC AAAACACCTC ATCACACCAA GTCGGTTTAG

101 CGATTATGCG GTTAAACTCT TCAATACTCG ACCTGCCACC GACAAAACAA

151 TATTTCCAAT CCGGCAGCCT GTGGGACGAG CTGCGCCAAG GCTTCCGGAT

201 GGGCGAAGTC AATCCCGAAC TGGTACGCCG CCACGAAAGC AAATTCATCG

251 CAAGCCGCAG CTATTTCGAC AGGGTCGTCA ACCGGAGCCG ACCCTATATG

301 TACCATATCG CCAACGAAGT CAAAAAACGC AATATGCCCG CCGAAGCCGC
```

```
 351 CCTGCTTCCC TTCATCGAAA GCGCGTTCGT CACCAAAGCC AAATCACACG

401 TCGGCGCATC GGGCCTGTGG CAGTTCATGC CCGCTACCGG CAGGCATTAC

451 GGCTTGGAAA AAACaccgGT TTACGacggc aggcacGacg TTtacgcaGc 501 taccgatgcc gcacTCAACT AtctGcAATA TCTCTAtggA CTGTTCGGCG

551 ACTGGCCGCT CGCCTTTGCC GCCTACAACT GGGGTGAAGG CAACGTCGGA

601 CGCGCCGTCA ACCGCGCCCG CGACCAAGGG CTCGAACCGA CCTACGAAAA

651 CCTGCGTATG CCCAACGAAA CGCGCAACTA TGTCCCCAAG CTGCTCGCCG

701 TGCGCAACAT TATTGCCACC CCCCAATCTT TCGGCATGAA TATCAGCGAC

751 ATAGACAACA AACCCTATTT TCAGGCAGTC GAACCGGGCC GTCCGCTCGA 801 caacGAagcC ATCGCCCGGC TTGCCGGCAT CACGCAAAGC GAGCTGCTCG 851 CCCTGAATCC TGCATTCAAC GTCCCCGCgt tcatCCCCAA AAAcaaacgc 901 aaacTGCTGC TTCCTGTCGC GTCCGTCCAA ACCTTccaaa gcaACTACCT

951 CAACGCCGCA CCCGACAGCC TGTTTTCATG GGAAGTCTAT ACGCCTGCCG

1001 CCAAAACCAG CCTGTCCGAC ATCTCGACGG CAACCGGCAT GAGCATTGCC

1051 GACATCAAAC GCCTCAACAA CCTGAACGGC AACCTTGTCA ACGCAGGACG

1101 CAGCATCCTT GTCGCCAAGA ACGGCAAGAC CCTTCATACG GCATCGGAat 1151 ccGTCGTTTC CATCGACATC GACAATACGC CcgacacCTa ccgttccaaT 1201 ATGCcggcag gcaCGGTGAA CGTCAGCATt gccCgaatcc aacCCgccgc 1251 cgcaCAGACA gcggacatta ccgtcgcacc tttgccgcaa gaaaccgtcc 1301 gtacgggaac ccgatcccct tgtccgcaTt accgaacccg ccctTGCGAC 1351 AGCCGCAGCg CaacctCAAA ccgAAAAACA GACTGCCATG CcgtctGA
                                                        35
```

This corresponds to the amino acid sequence <SEQ ID 2100; ORF 650.ng>:

```
g650.pep
   1 MSKLKTIALT ASGLSVCPGF LYAQNTSSHQ VGLAIMRLNS SILDLPPTKQ

51 YFQSGSLWDE LRQGFRMGEV NPELVRRHES KFIASRSYFD RVVNRSRPYM

101 YHIANEVKKR NMPAEAALLP FIESAFVTKA KSHVGASGLW QFMPATGRHY

151 GLEKTPVYDG RHDVYAATDA ALNYLQYLYG LFGDWPLAFA AYNWGEGNVG

201 RAVNRARDQG LEPTYENLRM PNETRNYVPK LLAVRNIIAT PQSFGMNISD

251 IDNKPYFQAV EPGRPLDNEA IARLAGITQS ELLALNPAFN VPAFIPKNKR

301 KLLLPVASVQ TFQSNYLNAA PDSLFSWEVY TPAAKTSLSD ISTATGMSIA

351 DIKRLNNLNG NLVNAGRSIL VAKNGKTLHT ASESVVSIDI DNTPDTYRSN

401 MPAGTVNVSI ARIQPAAAQT ADITVAPLPQ ETVRTGTRSP CPHYRTRPCD

451 SRSATSNRKT DCHAV*
```

The following partial DNA sequence was identified in *N. meningitidis* <SEQ ID 2101>:

```
m650.seq
   1 ATGTCCAAAC TCAAAACCAT CGCTCTGACC GCATCAGGTC TGTCCGTTTG

51 TCCGGGTTTC CTATACGCCC AAAACACCTC ATCACACCAA ATCGGTTTGG

101 CGATTATGCG CTTAAACTCT TCAATACTCG ACCTGCCCCC GACAAAACAA
```

-continued

```
 151 TATTTCCAAT CCGGCAGCCT GTGGGGCGAG CTGCGCCAAG GCTTCCGGAT

201 GGGCGAAGTC AATCCCGAAC TGGTACGCCG CCACGAAAGC AAATTCATCG

251 CAAGCCACAG CTATTTCAAC AGGGTCATCA ACCGGAGTAG ACCCTATATG

301 TACCATATCG CCAACGAAGT CAAAAAACGC AATATGCCCG CCGAAGCCGC

351 CCTGCTTCCC TTCATCGAAA GCGCGTTCGT CACCAAAGCC AAATCACACG

401 TCGGCGCATC AGGATTATGG CAGTTTATGC CCGCTACCGG CAGGCATTAC

451 GGCCTGGAAA AAACACCGGT TTACGACGGC AGGCACGACG TTTACGCCGC

501 CACCGATGCC GCACTCAACT ATCTGCAATA CCTCTATGGA CTGTTCGGCG

551 ACTGGCCGCT TGCCTTTGCC GCCTACAACT GGGGTGAAGG CAACGTCGGA

601 CGCGCCATCA ACCGCGCCCG CGCCCAAGGG CTCGAACCGA CCTACGAAAA

651 CCTGCGTATG CCCAACGAAA CGCGCAACTA TGTCCCCAAG CTGCTCGCCG

701 TGCGCAACAT TATTGCCACT CCCCAATCTT TCGGCATGAA TATCAGCGAC

751 ATAGACAACA AACCCTATTT CAGGCAGTC GAACCGGATC GTCCGCTCGA

801 CAACGAAGCC ATCGCCCGGC TTGCCGGCAT CACGCAAAGC GAGCTGCTCG

851 CCCTAAACCC CGCATTCAAC GTCCCCGCGT TTATCCCCAA AAGCAAACGC

901 AAACTGCTGC TTCCTGTCGC GTCCGTACAA ACCTTCCAAA GCAACTACCT

951 CAACGCCGCA CCCGACAGCC TGTTTTCATG GGAAGTCTAT ACGCCTGCCG

1001 CCAAAACCAG CCTGTCCGAC ATCTCGACGG CAACCGGCAT GAGCATTGCC

1051 GACATCAAAC GCCTCAACAA CCTGAACGGC AACCTTGTCA ACGCAGGACG

1101 CAGCATCCTT GTCGCCAAGA ACGGCAAAAC CCTTCAGACG GCATCGGAAT

1151 CCGTCGTTTC CATCGACATC GACAATACGC CGACACCTA CCGTTCCAAT

1201 ATGCCGGCAG GCACGGTGAA CGTCGGCATT GCCCGAATCC GACCCGCCGC

1251 CGCACAGACA GCGGACATTA CCGTCGCACC TTTGCCGCAG AAAACCGTCC

1301 GTACGG.AAC CCGATCCCCT TGTCCGTATT GCCGAACCTG CCCTTGCGAC

1351 AGCCGCAGCG CAACCTCAAA CCGAAAAACA GACCGCCATG CCGTCTGA
```

This corresponds to the amino acid sequence <SEQ ID 2102; ORF 650>:

```
m650.pep

1 MSKLKTIALT ASGLSVCPGF LYAQNTSSHQ IGLAIMRLNS SILDLPPTKQ

51 YFQSGSLWGE LRQGFRMGEV NPELVRRHES KFIASHSYFN RVINRSRPYM

101 YHIANEVKKR NMPAEAALLP FIESAFVTKA KSHVGASGLW QFMPATGRHY

151 GLEKTPVYDG RHDVYAATDA ALNYLQYLYG LFGDWPLAFA AYNWGEGNVG

201 RAINRARAQG LEPTYENLRM PNETRNYVPK LLAVRNIIAT PQSFGMNISD

251 IDNKPYFQAV EPDRPLDNEA IARLAGITQS ELLALNPAFN VPAFIPKSKR

301 KLLLPVASVQ TFQSNYLNAA PDSLFSWEVY TPAAKTSLSD ISTATGMSIA

351 DIKRLNNLNG NLVNAGRSIL VAKNGKTLQT ASESVVSIDI DNTPDTYRSN

401 MPAGTVNVGI ARIRPAAAQT ADITVAPLPQ KTVRTXTRSP CPYCRTCPCD

451 SRSATSNRKT DRHAV*
```

-continued

```
m650/g650 96.1% identity in 465 aa overlap 10        20        30        40        50        60
m650.pep    MSKLKTIALTASGLSVCPGFLYAQNTSSHQIGLAIMRLNSSILDLPPTKQYFQSGSLWGE
            ||||||||||||||||||||||||||||||:||||||||||||||||||||||||||| |
g650        MSKLKTIALTASGLSVCPGFLYAQNTSSHQVGLAIMRLNSSILDLPPTKQYFQSGSLWDE
                    10        20        30        40        50        60

70        80        90       100       110       120
m650.pep    LRQGFRMGEVNPELVRRHESKFIASHSYFNRVINRSRPYMYHIANEVKKRNMPAEAALLP
            |||||||||||||||||||||||||:|||:||:|||||||||||||||||||||||||||
g650        LRQGFRMGEVNPELVRRHESKFIASRSYFDRVVNRSRPYMYHIANEVKKRNMPAEAALLP
                    70        80        90       100       110       120

130       140       150       160       170       180
m650.pep    FIESAFVTKAKSHVGASGLWQFMPATGRHYGLEKTPVYDGRHDVYAATDAALNYLQYLYG
            ||||||||||||||||||||||||||||||||||||||||||||||||||||||||||||
g650        FIESAFVTKAKSHVGASGLWQFMPATGRHYGLEKTPVYDGRHDVYAATDAALNYLQYLYG
                   130       140       150       160       170       180

190       200       210       220       230       240
m650.pep    LFGDWPLAFAAYNWGEGNVGRAINRARAQGLEPTYENLRMPNETRNYVPKLLAVRNIIAT
            ||||||||||||||||||||||:|||| ||||||||||||||||||||||||||||||||
g650        LFGDWPLAFAAYNWGEGNVGRAVNRARDQGLEPTYENLRMPNETRNYVPKLLAVRNIIAT
                   190       200       210       220       230       240

250       260       270       280       290       300
m650.pep    PQSFGMNISDIDNKPYFQAVEPDRPLDNEAIARLAGITQSELLALNPAFNVPAFIPKSKR
            |||||||||||||||||||||| ||||||||||||||||||||||||||||||||||:||
g650        PQSFGMNISDIDNKPYFQAVEPGRPLDNEAIARLAGITQSELLALNPAFNVPAFIPKNKR
                   250       260       270       280       290       300

310       320       330       340       350       360
m650.pep    KLLLPVASVQTFQSNYLNAAPDSLFSWEVYTPAAKTSLSDISTATGMSIADIKRLNNLNG
            ||||||||||||||||||||||||||||||||||||||||||||||||||||||||||||
g650        KLLLPVASVQTFQSNYLNAAPDSLFSWEVYTPAAKTSLSDISTATGMSIADIKRLNNLNG
                   310       320       330       340       350       360

370       380       390       400       410       420
m650.pep    NLVNAGRSILVAKNGKTLQTASESVVSIDIDNTPDTYRSNMPAGTVNVGIARIRPAAAQT
            ||||||||||||||||||:|||||||||||||||||||||||||||||:||||:||||||
g650        NLVNAGRSILVAKNGKTLHTASESVVSIDIDNTPDTYRSNMPAGTVNVSIARIQPAAAQT
                   370       380       390       400       410       420

430       440       450       460
m650.pep    ADITVAPLPQKTVRTXTRSPCPYCRTCPCDSRSATSNRKTDRHAVX
            ||||||||||:|||| ||||||: || |||||||||||||| ||||
g650        ADITVAPLPQETVRTGTRSPCPHYRTRPCDSRSATSNRKTDCHAVX
                   430       440       450       460
```

The following partial DNA sequence was identified in *N. meningitidis* <SEQ ID 2103>:

```
a650.seq
     1  ATGTCCAAAC TCAAAACCAT CGCCCTGACC GCGTCAGGTC TGTCCGTTTG

51  TCCGGGTTTC CTATACGCCC AAAACACCTC ATCACACCAA ATCGGTTTGG

101  CGATTATGCG CTTAAACTCT TCAATACTCG ACCTGCCACC GACAAAACAA

151  TATTTCCAAT CCGGCAGCCT GTGGAGCGAG CTGCGCCAAG GCTTCCGGAT

201  GGGCGAAGTC AATCCCGAAC TGGTACGCCG CCACGAAAGC AAATTCATCG

251  CAAGCCACAG CTATTTCAAC AGGGTCATCA ACCGGAGTAG ACCCTATATG

301  TACCATATCG CCAACGAAGT CAAAAAACGC AATATGCCCG CCGAAGCCGC

351  CCTGCTTCCC TTCATCGAAA GCGCGTTCGT CACCAAAGCC AAATCACACG

401  TCGGCGCATC GGGCCTGTGG CAGTTCATGC CCGCTACCGG CAGGCATTAC

451  GGCCTGGAAA AAACACCGGT TTACGACGGC AGGCACGACA TTTACGCCGC

501  CACCGATGCC GCACTCAACT ATCTGCAATA CCTCTATGGA CTGTTCGGCG

551  ACTGGCCGCT CGCCTTTGCC GCCTACAACT GGGGTGAAGG CAACGTCGGA

601  CGCGCCATCA ACCGCGCCCG CGCCCAAGGG CTCGAACCGA CCTACGAAAA

651  CCTGCGTATG CCCAACGAAA CGCGCAACTA TGTTCCCAAG CTGCTCGCCG

701  TGCGCAACAT CATTGCCGCC CCCCAATCTT TCGGCATGAA TATCAGCGAC
```

```
 751 ATAGACAACA AACCGTATTT TCAGGCAGTC GAACCGGACC GTCCGCTCGA

801 CAACGAAGCC ATCGCCCGGC TTGCCGGCAT CACGCAAAGC GAGCTGCTCG

851 CCCTAAACCC CGCATTCAAC GTCCCCGCGT TCATCCCCAA AAGCAAACGC

901 AAACTGCTGC TTCCTGTCGC GTCCGTACAA ACCTTCCAAA GCAACTACCT

951 CAACGCCGCA CCCGACAGCC TGTTTTCATG GGAAGTCTAT ACGCCTGCCG

1001 CCAAAACCAG CTTGTCCGAC ATCTCGACGG CAACCGGCAT GAGCATTGCC

1051 GACATCAAAC GCCTCAACAA CCTGAACGGC AACCTTGTCA ACGCAGGACG

1101 CAGCATCCTT GTCGCCAAGA ACGGCAAAAC CCTTCAGACG GCATCGGAAT

1151 CCGTCGTTTC CATCGACATC GACAATACGC CCAACACCTA CCGTTCCAAT

1201 ATGCCGGCAG GCACGGTGAA CGTCGGCATT GCCCGAATCC GACCCGCCGC

1251 CGCACAGACA GCGGACATTA CCGTCGCACC TTTGCCGCAG AAAACCGTCC

1301 GTACGG.AAC CCGATCCCCT TGTCCGTATT GCCGAACCTG CCCTTGCGAC

1351 AGCCGCAGCG CAACCTCAAA CCGAAAAACA GACCGCCATG CCGTCTGA
```

This corresponds to the amino acid sequence <SEQ ID 2104; ORF 650.a>:

```
a650.pep

1 MSKLKTIALT ASGLSVCPGF LYAQNTSSHQ IGLAIMRLNS SILDLPPTKQ

51 YFQSGSLWSE LRQGFRMGEV NPELVRRHES KFIASHSYFN RVINRSRPYM

101 YHIANEVKKR NMPAEAALLP FIESAFVTKA KSHVGASGLW QFMPATGRHY

151 GLEKTPVYDG RHDIYAATDA ALNYLQYLYG LFGDWPLAFA AYNWGEGNVG

201 RAINRARAQG LEPTYENLRM PNETRNYVPK LLAVRNIIAA PQSFGMNISD

251 IDNKPYFQAV EPDRPLDNEA IARLAGITQS ELLALNPAFN VPAFIPKSKR

301 KLLLPVASVQ TFQSNYLNAA PDSLFSWEVY TPAAKTSLSD ISTATGMSIA

351 DIKRLNNLNG NLVNAGFSIL VAKNGKTLQT ASESVVSIDI DNTPNTYRSN

401 MPAGTVNVGI ARIRPAAAQT ADITVAPLPQ KTVRTXTRSP CPYCRTCPCD

451 SRSATSNRKT DRHAV* m650/a650  99.1% identity in 465 aa overlap 10         20         30         40         50         60
m650.pep  MSKLKTIALTASGLSVCPGFLYAQNTSSHQIGLAIMRLNSSILDLPPTKQYFQSGSLWGE
          ||||||||||||||||||||||||||||||||||||||||||||||||||||||||||:|
a650      MSKLKTIALTASGLSVCPGFLYAQNTSSHQIGLAIMRLNSSILDLPPTKQYFQSGSLWSE
                10         20         30         40         50         60

70         80         90        100        110        120
m650.pep  LRQGFRMGEVNPELVRRHESKFIASHSYFNRVINRSRPYMYHIANEVKKRNMPAEAALLP
          ||||||||||||||||||||||||||||||||||||||||||||||||||||||||||||
a650      LRQGFRMGEVNPELVRRHESKFIASHSYFNRVINRSRPYMYHIANEVKKRNMPAEAALLP
                70         80         90        100        110        120

130        140        150        160        170        180
m650.pep  FIESAFVTKAKSHVGASGLWQFMPATGRHYGLEKTPVYDGRHDVYAATDAALNYLQYLYG
          |||||||||||||||||||||||||||||||||||||||||||:||||||||||||||||
a650      FIESAFVTKAKSHVGASGLWQFMPATGRHYGLEKTPVYDGRHDIYAATDAALNYLQYLYG
               130        140        150        160        170        180

190        200        210        220        230        240
m650.pep  LFGDWPLAFAAYNWGEGNVGRAINRARAQGLEPTYENLRMPNETRNYVPKLLAVRNIIAT
          |||||||||||||||||||||||||||||||||||||||||||||||||||||||||||:
a650      LFGDWPLAFAAYNWGEGNVGRAINRARAQGLEPTYENLRMPNETRNYVPKLLAVRNIIAA
               190        200        210        220        230        240

250        260        270        280        290        300
m650.pep  PQSFGMNISDIDNKPYFQAVEPDRPLDNEAIARLAGITQSELLALNPAFNVPAFIPKSKR
          ||||||||||||||||||||||||||||||||||||||||||||||||||||||||||||
a650      PQSFGMNISDIDNKPYFQAVEPDRPLDNEAIARLAGITQSELLALNPAFNVPAFIPKSKR
               250        260        270        280        290        300
```

```
                310         320        330        340        350        360
m650.pep   KLLLPVASVQTFQSNYLNAAPDSLFSWEVYTPAAKTSLSDISTATGMSIADIKRLNNLNG
           ||||||||||||||||||||||||||||||||||||||||||||||||||||||||||||
a650       KLLLPVASVQTFQSNYLNAAPDSLFSWEVYTPAAKTSLSDISTATGMSIADIKRLNNLNG
                310         320        330        340        350        360

370         380        390        400        410        420
m650.pep   NLVNAGRSILVAKNGKTLQTASESVVSIDIDNTPDTYRSNMPAGTVNVGIARIRPAAAQT
           |||||||||||||||||||||||||||||||||||:||||||||||||||||||||||||
a650       NLVNAGRSILVAKNGKTLQTASESVVSIDIDNTPNTYRSNMPAGTVNVGIARIRPAAAQT
                370         380        390        400        410        420

430         440        450        460
m650.pep   ADITVAPLPQKTVRTXTRSPCPYCRTCPCDSRSATSNRKTDRHAVX
           |||||||||||||||||||||||||||||||||||||||||||||
a650       ADITVAPLPQKTVRTXTRSPCPYCRTCPCDSRSATSNRKTDRHAVX
                430         440        450        460
```

The following partial DNA sequence was identified in *N. gonorrhoeae* <SEQ ID 2105>:

```
g652.seq
    1 ATGATCGAAT TGGACGGTAC TGAAAACAAA GGCAATTTGG GTGCGAATGC

51 GACTTTGGCG GTCTCTATGG CGGTTGCACG CGCCGCTGCC GAAGACTCAG

101 GCCTGCCGCT TTACCGCTAC TTGGGGGGCG CAGGTCCGAT GTCCCTGCCC

151 GTACCGATGA TGAACGTCAT CAACGGCGGC GAACACGCCA ACAACAGCCT

201 GAACATCCAA GAGTTTATGA TTATGCCCGT CGGCGCAAAA TCTTTCCGCG

251 AAGCGTTGCG CTGCGGTGCG GAAATTTTCC ACGCCTTGAA AAAACTGTGC

301 GACAGTAAAG GCTTCCCGAC CACAGTCGGC GACGAAGGCG GTTTCGCCCC

351 CAACCTGAAC AGCCACAAAG AAGCCCTGCA ACTGATGGTC GAAGCGGCCG

401 AAGCCGCCGG CTACAAGGCG GGCGAAGACG TATTATTCGC ATTGGACTGC

451 GCGTCCAGCG AGTTCTACAA AGACGGCAAA TACCACTTGG AAGCCGAAGG

501 CCGCTCCTAC ACCAACGCGG AATTTGCCGA ATACTTGGAA GGCTTGGTTA

551 ACGAATTCCC GATTATTTCC ATTGAAGACG GGATGGACGA AAACGACTGG

601 GAAGGCTGGA AACTGCTGAC CGAAAAATTG GGCAAAAAAG TTCAATTGGT

651 CGGCGACGAC TTGTTCGTAA CCAATCCGAA AATTCTTGCC GAAGGCATCG

701 AAAAAGGCGT AGCAAACGCA TTGCTGGTCA AAGTCAACCA AATCGGTACT

751 TTAAGCGAAA CCCTGAAAGc cgtcgatctg gCAAAATGCA accgctacGc 801 cagCGTGATG AGCCAccgct ccggCGAAAC CGAAGACAGT Accattgccg 851 ACTTGGCAGT CGCCACCAAC TGTATGCAGA TTAAAAccgG TTCTTTGAGc 901 cgTTCCGACC GCATGGCGAA ATACAACCAa ctGCTGCGTA TCGAGGAAGA 951 ATTGGCGGAA GCcgcctACT ACCCCGGCAA AGCCGCATTC TACCAACTGG

1001 GCAAATAA
```

This corresponds to the amino acid sequence <SEQ ID 2106; ORF 652.ng>:

```
g652.pep
    1 MIELDGTENK GNLGANATLA VSMAVARAAA EDSGLPLYRY LGGAGPMSLP

51 VPMMNVINGG EHANNSLNIQ EFMIMPVGAK SFREALRCGA EIFHALKKLC

101 DSKGFPTTVG DEGGFAPNLN SHKEALQLMV EAAEAAGYKA GEDVLFALDC

151 ASSEFYKDGK YHLEAEGRSY TNAEFAEYLE GLVNEFPIIS IEDGMDENDW

201 EGWKLLTEKL GKKVQLVGDD LFVTNPKILA EGIEKGVANA LLVKVNQIGT
```

```
251 LSETLKAVDL AKCNRYASVM SHRSGETEDS TIADLAVATN CMQIKTGSLS

301 RSDRMAKYNQ LLRIEEELAE AAYYPGKAAF YQLGK*
```

The following partial DNA sequence was identified in *N. meningitidis* <SEQ ID 2107>:

```
m652.seq
   1 ATGATCGAAT TGGACGGTAC TGAAAACAAA GGCAATTTGG GTGCGAATGC

51 GACTTTGGCG GTTTCTATGG CGGTTGCACG CGCCGCTGCC GAAGACTCAG

101 GCCTGCCGCT TTACCGCTAC TTGGGCGGCG CAGGCCCGAT GTCCCTGCCC

151 GTACCGATGA TGAACGTCAT CAACGGCGGC GAACACGCCA ACAACAGCCT

201 GAACATCCAA GAGTTTATGA TTATGCCCGT CGGCGCAAAA TCTTTCCGCG

251 AAGCGTTGCG CTGCGGTGCG GAAATTTTCC ACGCCTTGAA AAAACTGTGC

301 GACAGCAAAG GCTTCCCGAC CACAGTCGGC GACGAAGGCG GTTTCGCCCC

351 CAACCTGAAC AGCCACAAAG AAGCCCTGCA ACTGATGGTC GAGGCGACCG

401 AAGCCGCCGG CTACAAAGCG GGCGAAGACG TATTATTCGC ATTGGACTGC

451 GCCTCCAGCG AGTTCTACAA AGACGGCAAA TACCACTTGG AAGCCGAAGG

501 CCGCTCCTAC ACCAACGCGG AATTTGCCGA ATATCTGGAA GGCCTGGTCA

551 ACGAGTTCCC CATCATCTCC ATCGAAGACG GCATGGATGA AAACGACTGG

601 GAAGGCTGGA AACTGCTGAC CGAAAAACTG GGCGGTAGAG TTCAATTGGT

651 TGGCGACGAC TTGTTCGTAA CCAATCCAAA AATCTTGGCC GAAGGCATCG

701 AAAAAGGCGT AGCAAACGCA TTGCTGGTCA AAGTCAATCA AATCGGTACT

751 TTGAGCGAGA CCCTGAAAGC CGTCGACTTA GCCAAACGCA ACCGCTACGC

801 CAGCGTAATG AGCCACCGCT CCGGCGAAAC CGAAGACAGC ACCATTGCCG

851 ACTTGGCAGT CGCCACCAAC TGTATGCAGA TCAAAACCGG TTCTTTGAGC

901 CGTTCCGACC GCATGGCGAA ATACAACCAA CTGCTGCGTA TCGAGGAAGA

951 ATTGGCGGAA GCCGCCGACT ACCCCAGCAA AGCCGCATTC TACCAACTGG

1001 GCAAATAA
```

This corresponds to the amino acid sequence <SEQ ID 2108; ORF 652>:

```
m652.pep
   1 MIELDGTENK GNLGANATLA VSMAVARAAA EDSGLPLYRY LGGAGPMSLP

51 VPMMNVINGG EHANNSLNIQ EFMIMPVGAK SFREALRCGA EIFHALKKLC

101 DSKGFPTTVG DEGGFAPNLN SHKEALQLMV EATEAAGYKA GEDVLFALDC

151 ASSEFYKDGK YHLEAEGRSY TNAEFAEYLE GLVNEFPIIS IEDGMDENDW

201 EGWKLLTEKL GGRVQLVGDD LFVTNPKILA EGIEKGVANA LLVKVNQIGT

251 LSETLKAVDL AKRNRYASVM SHRSGETEDS TIADLAVATN CMQIKTGSLS

301 RSDRMAKYNQ LLRIEEELAE AADYPSKAAF YQLGK* m652/g652 98.2% identity in 335 aa overlap 10         20         30         40         50         60
   m652.pep  MIELDGTENKGNLGANATLAVSMAVARAAAEDSGLPLYRYLGGAGPMSLPVPMMNVINGG
             ||||||||||||||||||||||||||||||||||||||||||||||||||||||||||||
       g652  MIELDGTENKGNLGANATLAVSMAVARAAAEDSGLPLYRYLGGAGPMSLPVPMMNVINGG
                 10         20         30         40         50         60
```

-continued

```
                70        80        90       100       110       120
m652.pep   EHANNSLNIQEFMIMPVGAKSFREALRCGAEIFHALKKLCDSKGFPTTVGDEGGFAPNLN
           ||||||||||||||||||||||||||||||||||||||||||||||||||||||||||||
g652       EHANNSLNIQEFMIMPVGAKSFREALRCGAEIFHALKKLCDSKGFPTTVGDEGGFAPNLN
                70        80        90       100       110       120

130       140       150       160       170       180
m652.pep   SHKEALQLMVEATEAAGYKAGEDVLFALDCASSEFYKDGKYHLEAEGRSYTNAEFAEYLE
           |||||||||||:||||||||||||||||||||||||||||||||:||||||||||||||||
g652       SHKEALQLMVEAAEAAGYKAGEDVLFALDCASSEFYKDGKYHLEAEGRSYTNAEFAEYLE
               130       140       150       160       170       180

190       200       210       220       230       240
m652.pep   GLVNEFPIISIEDGMDENDWEGWKLLTEKLGGRVQLVGDDLFVTNPKILAEGIEKGVANA
           |||||||||||||||||||||||||||||||| :||||||||||||||||||||||||||
g652       GLVNEFPIISIEDGMDENDWEGWKLLTEKLGKKVQLVGDDLFVTNPKILAEGIEKGVANA
               190       200       210       220       230       240

250       260       270       280       290       300
m652.pep   LLVKVNQIGTLSETLKAVDLAKRNRYASVMSHRSGETEDSTIADLAVATNCMQIKTGSLS
           |||||||||||||||||||||| |||||||||||||||||||||||||||||||||||||
g652       LLVKVNQIGTLSETLKAVDLAKCNRYASVMSHRSGETEDSTIADLAVATNCMQIKTGSLS
               250       260       270       280       290       300

310       320       330
m652.pep   RSDRMAKYNQLLRIEEELAEAADYPSKAAFYQLGKX
           ||||||||||||||||||||||||||||||||||||
g652       RSDRMAKYNQLLRIEEELAEAADYPSKAAFYQLGKX
               310       320       330
```

The following partial DNA sequence was identified in *N. meningitidis* <SEQ ID 2109>:

```
a652.seq
   1  ATGATCGAAT TGGACGGTAC TGAAAACAAA GGCAATTTGG GTGCGAATGC

51  GACTTTGGCG GTTTCTATGG CGGTTGCACG CGCCGCTGCC GAAGACTCAG

101  GCCTGCCGCT TTACCGCTAC TTGGGCGGCG CAGGCCCGAT GTCCCTGCCC

151  GTACCGATGA TGAACGTCAT CAACGGCGGC GAACACGCCA ACAACAGCCT

201  GAACATCCAA GAGTTTATGA TTATGCCCGT CGGCGCAAAA TCTTTCCGCG

251  AAGCGTTGCG CTGCGGTGCG GAAATTTTCC ACGCCTTGAA AAAACTGTGC

301  GACAGCAAAG GCTTCCCGAC CACAGTCGGC GACGAAGGCG GTTTCGCCCC

351  CAACCTGAAC AGCCACAAAG AAGCCCTGCA ACTGATGGTC GAGGCGACCG

401  AAGCCGCCGG CTACAAAGCG GGCGAAGACG TATTATTCGC ATTGGACTGC

451  GCGTCCAGCG AGTTCTACAA AGACGGCAAA TACCACTTGG AAGCCGAAGG

501  CCGCTCCTAC ACCAACGCGG AATTTGCCGA ATATCTGGAA GGCCTGGTCA

551  ACGAGTTCCC CATCATCTCC ATCGAAGACG GGATGGATGA AAACGACTGG

601  GAAGGCTGGA AACTGCTGAC CGAAAAACTG GGCGGCAAAG TCCAACTCGT

651  TGGCGACGAC CTCTTCGTTA CCAACCCGAA AATCCTTGCC GAAGGCATTG

701  AAAAAGGCGT GGCAAACGCA CTATTGGTCA AAGTCAACCA AATCGGTACT

751  TTGAGTGAAA CCCTGAAAGC CGTCGACTTA GCCAAACGCA ACCGCTACGC

801  CAGCGTAATG AGCCACCGCT CCGGCGAAAC CGAAGACAGC ACCATTGCCG

851  ACTTGGCAGT CGCCACCAAC TGTATGCAGA TCAAAACCGG TTCTTTGAGC

901  CGTTCCGACC GCATGGCGAA ATACAACCAA CTGCTGCGTA TCGAGGAAGA

951  ATTGGCGGAA GCCGCCGACT ACCCCAGCAA AGCCGCATTC TACCAACTGG

1001  GCAAATAA
```

This corresponds to the amino acid sequence <SEQ ID 2110; ORF 652.a>:

```
a652.pep

1 MIELDGTENK GNLGANATLA VSMAVARAAA EDSGLPLYRY LGGAGPMSLP

51 VPMMNVINGG EHANNSLNIQ EFMIMPVGAK SFREALRCGA EIFHALKKLC

101 DSKGFPTTVG DEGGFAPNLN SHKEALQLMV EATEAAGYKA GEDVLFALDC

151 ASSEFYKDGK YHLEAEGRSY TNAEFAEYLE GLVNEFPIIS IEDGMDENDW

201 EGWKLLTEKL GGKVQLVGDD LFVTNPKILA EGIEKGVANA LLVKVNQIGT

251 LSETLKAVDL AKRNRYASVM SHRSGETEDS TIADLAVATN CMQIKTGSLS

301 RSDRMAKYNQ LLRIEEELAE AADYPSKAAF YQLGK* m652/a652 99.7% identity in 335 aa overlap 10         20         30         40         50         60
m652.pep   MIELDGTENKGNLGANATLAVSMAVARAAAEDSGLPLYRYLGGAGPMSLPVPMMNVINGG
           ||||||||||||||||||||||||||||||||||||||||||||||||||||||||||||
a652       MIELDGTENKGNLGANATLAVSMAVARAAAEDSGLPLYRYLGGAGPMSLPVPMMNVINGG
                  10         20         30         40         50         60

70         80         90        100        110        120
m652.pep   EHANNSLNIQEFMIMPVGAKSFREALRCGAEIFHALKKLCDSKGFPTTVGDEGGFAPNLN
           ||||||||||||||||||||||||||||||||||||||||||||||||||||||||||||
a652       EHANNSLNIQEFMIMPVGAKSFREALRCGAEIFHALKKLCDSKGFPTTVGDEGGFAPNLN
                  70         80         90        100        110        120

130        140        150        160        170        180
m652.pep   SHKEALQLMVEATEAAGYKAGEDVLFALDCASSEFYKDGKYHLEAEGRSYTNAEFAEYLE
           ||||||||||||||||||||||||||||||||||||||||||||||||||||||||||||
a652       SHKEALQLMVEATEAAGYKAGEDVLFALDCASSEFYKDGKYHLEAEGRSYTNAEFAEYLE
                 130        140        150        160        170        180

190        200        210        220        230        240
m652.pep   GLVNEFPIISIEDGMDENDWEGWKLLTEKLGGRVQLVGDDLFVTNPKILAEGIEKGVANA
           |||||||||||||||||||||||||||||||||:|||||||||||||||||||||||||
a652       GLVNEFPIISIEDGMDENDWEGWKLLTEKLGGKVQLVGDDLFVTNPKILAEGIEKGVANA
                 190        200        210        220        230        240

250        260        270        280        290        300
m652.pep   LLVKVNQIGTLSETLKAVDLAKRNRYASVMSHRSGETEDSTIADLAVATNCMQIKTGSLS
           |||||||||||||||||||||||:||||||||||||||||||||||||||||||||||||
a652       LLVKVNQIGTLSETLKAVDLAKCNRYASVMSHRSGETEDSTIADLAVATNCMQIKTGSLS
                 250        260        270        280        290        300

310        320        330
m652.pep   RSDRMAKYNQLLRIEEELAEAADYPSKAAFYQLGKX
           |||||||||||||||||||||||||||||||||||
a652       RSDRMAKYNQLLRIEEELAEAADYPSKAAFYQLGKX
                 310        320        330
```

The following partial DNA sequence was identified in *N. gonorrhoeae* <SEQ ID 2111>:

```
g652-1.seq
   1 ATGAGCGCAA TCGTTGATAT TTTCGCCCGC GAAATTTTGG ACTCACGCGG

51 CAACCCCACA GTCGAGTGTG ATGTATTGCT CGAATCCGGC GTAATGGGAC

101 GTGCGGCCGT ACCGAGCGGC GCATCCACCG GTCAGAAAGA AGCTTTGGAA

151 CTTCGCGACG GCGACAAATC CCGCTATTCC GGCAAAGGCG TATTGAAGGC

201 CGTCGAACAC GTCAACAACC AAATCGCCCA AGCCCTCATC GGTATCGATG

251 CCAACGAGCA ATCTTATATC GACCAAATCA TGATCGAATT GGACGGTACT

301 GAAAACAAAG GCAATTTGGG TGCGAATGCG ACTTTGGCGG TCTCTATGGC

351 GGTTGCACGC GCCGCTGCCG AAGACTCAGG CCTGCCGCTT ACCGCTACT

401 TGGGGGGCGC AGGTCCGATG TCCCTGCCCG TACCGATGAT GAACGTCATC

451 AACGGCGGCG AACACGCCAA CAGCCTGAAC ATCCAAGAGT TTATGAT

501 TATGCCCGTC GGCGCAAAAT CTTTCCGCGA AGCGTTGCGC TGCGGTGCGG
```

```
-continued
551 AAATTTTCCA CGCCTTGAAA AAACTGTGCG ACAGTAAAGG CTTCCCGACC

601 ACAGTCGGCG ACGAAGGCGG TTTCGCCCCC AACCTGAACA GCCACAAAGA

651 AGCCCTGCAA CTGATGGTCG AAGCGGCCGA AGCCGCCGGC TACAAGGCGG

701 GCGAAGACGT ATTATTCGCA TTGGACTGCG CGTCCAGCGA GTTCTACAAA

751 GACGGCAAAT ACCACTTGGA AGCCGAAGGC CGCTCCTACA CCAACGCGGA

801 ATTTGCCGAA TACTTGGAAG GCTTGGTTAA CGAATTCCCG ATTATTTCCA

851 TTGAAGACGG GATGGACGAA AACGACTGGG AAGGCTGGAA ACTGCTGACC

901 GAAAAATTGG GCAAAAAGT TCAATTGGTC GGCGACGACT TGTTCGTAAC

951 CAATCCGAAA ATTCTTGCCG AAGGCATCGA AAAAGGCGTA GCAAACGCAT

1001 TGCTGGTCAA AGTCAACCAA ATCGGTACTT TAAGCGAAAC CCTGAAAGCC

1051 GTCGATCTGG CAAAATGCAA CCGCTACGCC AGCGTGATGA GCCACCGCTC

1101 CGGCGAAACC GAAGACAGTA CCATTGCCGA CTTGGCAGTC GCCACCAACT

1151 GTATGCAGAT TAAAACCGGT TCTTTGAGCC GTTCCGACCG CATGGCGAAA

1201 TACAACCAAC TGCTGCGTAT CGAGGAAGAA TTGGCGGAAG CCGCCTACTA

1251 CCCCGGCAAA GCCGCATTCT ACCAACTGGG CAAATAA
```

This corresponds to the amino acid sequence <SEQ ID 2112; ORF 652-1.ng>:

```
g652-1.pep
  1 MSAIVDIFAR EILDSRGNPT VECDVLLESG VMGRAAVPSG ASTGQKEALE

51 LRDGDKSRYS GKGVLKAVEH VNNQIAQALI GIDANEQSYI DQIMIELDGT

101 ENKGNLGANA TLAVSMAVAR AAAEDSGLPL YRYLGGAGPM SLPVPMMNVI

151 NGGEHANNSL NIQEFMIMPV GAKSFREALR CGAEIFHALK KLCDSKGFPT

201 TVGDEGGFAP NLNSHKEALQ LMVEAAEAAG YKAGEDVLFA LDCASSEFYK

251 DGKYHLEAEG RSYTNAEFAE YLEGLVNEFP IISIEDGMDE NDWEGWKLLT

301 EKLGKKVQLV GDDLFVTNPK ILAEGIEKGV ANALLVKVNQ IGTLSETLKA

351 VDLAKCNRYA SVMSHRSGET EDSTIADLAV ATNCMQIKTG SLSRSDRMAK

401 YNQLLRIEEE LAEAAYYPGK AAFYQLGK*
```

45

The following partial DNA sequence was identified in *N. meningitidis* <SEQ ID 2113>:

```
m652-1.seq
  1 ATGAGCGCAA TCGTTGATAT TTTCGCCCGC GAAATTTTGG ACTCACGCGG

51 CAACCCCACA GTCGAGTGTG ATGTATTGCT CGAATCCGGC GTAATGGGAC

101 GCGCAGCCGT ACCGAGCGGC GCGTCCACCG GTCAAAAAGA GGCTTTGGAA

151 CTTCGCGACG GCGACAAATC CCGTTATTCG GGCAAGGGCG TATTGAAGGC

201 GGTCGAACAC GTCAACAACC AAATCGCCCA AGCCCTCATT GGTATCGATG

251 CCAACGAGCA ATCTTATATC GACCAAATCA TGATCGAATT GGACGGTACT

301 GAAAACAAAG GCAATTTGGG TGCGAATGCG ACTTTGGCGG TTTCTATGGC

351 GGTTGCACGC GCCGCTGCCG AAGACTCAGG CCTGCCGCTT TACCGCTACT

401 TGGGCGGCGC AGGCCCGATG TCCCTGCCCG TACCGATGAT GAACGTCATC

451 AACGGCGGCG AACACGCCAA CAACAGCCTG AACATCCAAG AGTTTATGAT
```

```
-continued
 501 TATGCCCGTC GGCGCAAAAT CTTTCCGCGA AGCGTTGCGC TGCGGTGCGG

551 AAATTTTCCA CGCCTTGAAA AAACTGTGCG ACAGCAAAGG CTTCCCGACC

601 ACAGTCGGCG ACGAAGGCGG TTTCGCCCCC AACCTGAACA GCCACAAAGA

651 AGCCCTGCAA CTGATGGTCG AGGCGACCGA AGCCGCCGGC TACAAAGCGG

701 GCGAAGACGT ATTATTCGCA TTGGACTGCG CCTCCAGCGA GTTCTACAAA

751 GACGGCAAAT ACCACTTGGA AGCCGAAGGC CGCTCCTACA CCAACGCGGA

801 ATTTGCCGAA TATCTGGAAG GCCTGGTCAA CGAGTTCCCC ATCATCTCCA

851 TCGAAGACGG CATGGATGAA AACGACTGGG AAGGCTGGAA ACTGCTGACC

901 GAAAAACTGG GCGGTAGAGT TCAATTGGTT GGCGACGACT TGTTCGTAAC

951 CAATCCAAAA ATCTTGGCCG AAGGCATCGA AAAGGCGTA GCAAACGCAT

1001 TGCTGGTCAA AGTCAATCAA ATCGGTACTT TGAGCGAGAC CCTGAAAGCC

1051 GTCGACTTAG CCAAACGCAA CCGCTACGCC AGCGTAATGA GCCACCGCTC

1101 CGGCGAAACC GAAGACAGCA CCATTGCCGA CTTGGCAGTC GCCACCAACT

1151 GTATGCAGAT CAAAACCGGT TCTTTGAGCC GTTCCGACCG CATGGCGAAA

1201 TACAACCAAC TGCTGCGTAT CGAGGAAGAA TTGGCGGAAG CCGCCGACTA

1251 CCCCAGCAAA GCCGCATTCT ACCAACTGGG CAAATAA
```

This corresponds to the amino acid sequence <SEQ ID 2114; ORF 652-1>:

```
m652-1.pep

1    MSAIVDIFAR EILDSRGNPT VECDVLLESG VMGRAAVPSG ASTGOKEALE

51    LRDGDKSRYS GKGVLKAVEH VNNQIAQALI GIDANEQSYI DQIMIELDGT

101    ENKGNLGANA TLAVSMAVAR AAAEDSGLPL YRYLGGAGPM SLPVPMMNVI

151    NGGEHANNSL NIQEFMIMPV GAKSFREALR CGAEIFHALK KLCDSKGFPT

201    TVGDEGGFAP NLNSHKEALQ LMVEATEAAG YKAGEDVLFA LDCASSEFYK

251    DGKYHLEAEG RSYTNAEFAE YLEGLVNEFP IISIEDGMDE NDWEGWKLLT

301    EKLGGRVQLV GDDLFVTNPK ILAEGIEKGV ANALLVKVNQ IGTLSETLKA

351    VDLAKRNRYA SVMSHRSGET EDSTIADLAV ATNCMQIKTG SLSRSDRMAK

401    YNQLLRIEEE LAEAADYPSK AAFYQLGK* m652-1/g652-1  98.6% identity in 428 aa overlap
                10         20         30         40         50         60
m652-1   MSAIVDIFAREILDSRGNPTVECDVLLESGVMGRAAVPSGASTGQKEALELRDGDKSRYS
         ||||||||||||||||||||||||||||||||||||||||||||||||||||||||||||
g652-1   MSAIVDIFAREILDSRGNPTVECDVLLESGVMGRAAVPSGASTGQKEALELRDGDKSRYS
                10         20         30         40         50         60

70         80         90        100        110        120
m652-1   GKGVLKAVEHVNNQIAQALIGIDANEQSYIDQIMIELDGTENKGNLGANATLAVSMAVAR
         ||||||||||||||||||||||||||||||||||||||||||||||||||||||||||||
g652-1   GKGVLKAVEHVNNQIAQALIGIDANEQSYIDQIMIELDGTENKGNLGANATLAVSMAVAR
                70         80         90        100        110        120

130        140        150        160        170        180
m652-1   AAAEDSGLPLYRYLGGAGPMSLPVPMMNVINGGEHANNSLNIQEFMIMPVGAKSFREALR
         ||||||||||||||||||||||||||||||||||||||||||||||||||||||||||||
g652-1   AAAEDSGLPLYRYLGGAGPMSLPVPMMNVINGGEHANNSLNIQEFMIMPVGAKSFREALR
               130        140        150        160        170        180

190        200        210        220        230        240
m652-1   CGAEIFHALKKLCDSKGFPTTVGDEGGFAPNLNSHKEALQLMVEATEAAGYKAGEDVLFA
         |||||||||||||||||||||||||||||||||||||||||:||||||||||||||||||
g652-1   CGAEIFHALKKLCDSKGFPTTVGDEGGFAPNLNSHKEALQLMVEAAEAAGYKAGEDVLFA
               190        200        210        220        230        240
```

```
                   250        260        270        280        290        300
m652-1   LDCASSEFYKDGKYHLEAEGRSYTNAEFAEYLEGLVNEFPIISIEDGMDENDWEGWKLLT
         ||||||||||||||||||||||||||||||||||||||||||||||||||||||||||||
g652-1   LDCASSEFYKDGKYHLEAEGRSYTNAEFAEYLEGLVNEFPIISIEDGMDENDWEGWKLLT
                   250        260        270        280        290        300
                   310        320        330        340        350        360
m652-1   EKLGGRVQLVGDDLFVTNPKILAEGIEKGVANALLVKVNQIGTLSETLKAVDLAKRNRYA
         |||| :||||||||||||||||||||||||||||||||||||||||||||||||| ||||
g652-1   EKLGKKVQLVGDDLFVTNPKILAEGIEKGVANALLVKVNQIGTLSETLKAVDLAKCNRYA
                   310        320        330        340        350        360
                   370        380        390        400        410        420
m652-1   SVMSHRSGETEDSTIADLAVATNCMQIKTGSLSRSDRMAKYNQLLRIEEELAEAADYPSK
         |||||||||||||||||||||||||||||||||||||||||||||||||||||||| :|
g652-1   SVMSHRSGETEDSTIADLAVATNCMQIKTGSLSRSDRMAKYNQLLRIEEELAEAAYYPGK
                   370        380        390        400        410        420
                 429
m652-1   AAFYQLGKX
         |||||||||
g652-1   AAFYQLGKX
```

The following partial DNA sequence was identified in *N. meningitidis* <SEQ ID 2115>:

```
a652-1.seq
    1 ATGAGCGCAA TCGTTGATAT TTTCGCCCGC GAAATTTTGG ACTCACGCGG

51 CAACCCCACA GTCGAGTGTG ATGTATTGCT CGAATCCGGC GTAATGGGAC

101 GCGCAGCCGT ACCGAGCGGC GCGTCCACCG GTCAAAAAGA GGCTTTGGAA

151 CTTCGCGACG GCGACAAATC CCGTTATTCG GGCAAGGGCG TATTGAAGGC

201 GGTCGAACAC GTCAACAACC AAATCGCCCA AGCCCTCATT GGTATCGATG

251 CCAACGAGCA ATCTTATATC GACCAAATCA TGATCGAATT GGACGGTACT

301 GAAAACAAAG GCAATTTGGG TGCGAATGCG ACTTTGGCGG TTTCTATGGC

351 GGTTGCACGC GCCGCTGCCG AAGACTCAGG CCTGCCGCTT TACCGCTACT

401 TGGGCGGCGC AGGCCCGATG TCCCTGCCCG TACCGATGAT GAACGTCATC

451 AACGGCGGCG AACACGCCAA CAACAGCCTG AACATCCAAG AGTTTATGAT

501 TATGCCCGTC GGCGCAAAAT CTTTCCGCGA AGCGTTGCGC TGCGGTGCGG

551 AAATTTTCCA CGCCTTGAAA AAACTGTGCG ACAGCAAAGG CTTCCCGACC

601 ACAGTCGGCG ACGAAGGCGG TTTCGCCCCC AACCTGAACA GCCACAAAGA

651 AGCCCTGCAA CTGATGGTCG AGGCGACCGA AGCCGCCGGC TACAAAGCGG

701 GCGAAGACGT ATTATTCGCA TTGGACTGCG CGTCCAGCGA GTTCTACAAA

751 GACGGCAAAT ACCACTTGGA AGCCGAAGGC CGCTCCTACA CCAACGCGGA

801 ATTTGCCGAA TATCTGGAAG GCCTGGTCAA CGAGTTCCCC ATCATCTCCA

851 TCGAAGACGG GATGGATGAA AACGACTGGG AAGGCTGGAA ACTGCTGACC

901 GAAAAACTGG GCGGCAAAGT CCAACTCGTT GGCGACGACC TCTTCGTTAC

951 CAACCCGAAA ATCCTTGCCG AAGGCATTGA AAAGGCGTG GCAAACGCAC

1001 TATTGGTCAA AGTCAACCAA ATCGGTACTT TGAGTGAAAC CCTGAAAGCC

1051 GTCGACTTAG CCAAACGCAA CCGCTACGCC AGCGTAATGA GCCACCGCTC

1101 CGGCGAAACC GAAGACAGCA CCATTGCCGA CTTGGCAGTC GCCACCAACT

1151 GTATGCAGAT CAAAACCGGT TCTTTGAGCC GTTCCGACCG CATGGCGAAA

1201 TACAACCAAC TGCTGCGTAT CGAGGAAGAA TTGGCGGAAG CCGCCGACTA

1251 CCCCAGCAAA GCCGCATTCT ACCAACTGGG CAAATAA
```

This corresponds to the amino acid sequence <SEQ ID 2116; ORF 652-1.a>:

```
a652-1.pep

1 MSAIVDIFAR EILDSRGNPT VECDVLLESG VMGRAAVPSG ASTGQKEALE

51 LRDGDKSRYS GKGVLKAVEH VNNQIAQALI GIDANEQSYI DQIMIELDGT

101 ENKGNLGANA TLAVSMAVAR AAAEDSGLPL YRYLGGAGPM SLPVPMMNVI

151 NGGEHANNSL NIQEFMIMPV GAKSFREALR CGAEIFHALK KLCDSKGFPT

201 TVGDEGGFAP NLNSHKEALQ LMVEATEAAG YKAGEDVLFA LDCASSEFYK

251 DGKYHLEAEG RSYTNAEFAE YLEGLVNEFP IISIEDGMDE NDWEGWKLLT

301 EKLGGKVQLV GDDLFVTNPK ILAEGIEKGV ANALLVKVNQ IGTLSETLKA

351 VDLAKRNRYA SVMSHRSGET EDSTIADLAV ATNCMQIKTG SLSRSDRMAK

401 YNQLLRIEEE LAEAADYPSK AAFYQLGK* m652-1/a652-1 99.8% identity in 428 aa overlap 10         20         30         40         50         60
m652-1   MSAIVDIFAREILDSRGNPTVECDVLLESGVMGRAAVPSGASTGQKEALELRDGDKSRYS
         ||||||||||||||||||||||||||||||||||||||||||||||||||||||||||||
a652-1   MSAIVDIFAREILDSRGNPTVECDVLLESGVMGRAAVPSGASTGQKEALELRDGDKSRYS
                 10         20         30         40         50         60

70         80         90        100        110        120
m652-1   GKGVLKAVEHVNNQIAQALIGIDANEQSYIDQIMIELDGTENKGNLGANATLAVSMAVAR
         ||||||||||||||||||||||||||||||||||||||||||||||||||||||||||||
a652-1   GKGVLKAVEHVNNQIAQALIGIDANEQSYIDQIMIELDGTENKGNLGANATLAVSMAVAR
                 70         80         90        100        110        120

130        140        150        160        170        180
m652-1   AAAEDSGLPLYRYLGGAGPMSLPVPMMNVINGGEHANNSLNIQEFMIMPVGAKSFREALR
         ||||||||||||||||||||||||||||||||||||||||||||||||||||||||||||
a652-1   AAAEDSGLPLYRYLGGAGPMSLPVPMMNVINGGEHANNSLNIQEFMIMPVGAKSFREALR
                130        140        150        160        170        180

190        200        210        220        230        240
m652-1   CGAEIFHALKKLCDSKGFPTTVGDEGGFAPNLNSHKEALQLMVEATEAAGYKAGEDVLFA
         ||||||||||||||||||||||||||||||||||||||||||||||||||||||||||||
a652-1   CGAEIFHALKKLCDSKGFPTTVGDEGGFAPNLNSHKEALQLMVEATEAAGYKAGEDVLFA
                190        200        210        220        230        240

250        260        270        280        290        300
m652-1   LDCASSEFYKDGKYHLEAEGRSYTNAEFAEYLEGLVNEFPIISIEDGMDENDWEGWKLLT
         ||||||||||||||||||||| ||||||||||||||||||||||||||||||||||||||
a652-1   LDCASSEFYKDGKYHLEAEGRSYTNAEFAEYLEGLVNEFPIISIEDGMDENDWEGWKLLT
                250        260        270        280        290        300

310        320        330        340        350        360
m652-1   EKLGGRVQLVGDDLFVTNPKILAEGIEKGVANALLVKVNQIGTLSETLKAVDLAKRNRYA
         |||||:||||||||||||||||||||||||||||||||||||||||||||||||||||||
a652-1   EKLGGKVQLVGDDLFVTNPKILAEGIEKGVANALLVKVNQIGTLSETLKAVDLAKRNRYA
                310        320        330        340        350        360

370        380        390        400        410        420
m652-1   SVMSHRSGETEDSTIADLAVATNCMQIKTGSLSRSDRMAKYNQLLRIEEELAEAADYPSK
         ||||||||||||||||||||||||||||||||||||||||||||||||||||||||||||
a652-1   SVMSHRSGETEDSTIADLAVATNCMQIKTGSLSRSDRMAKYNQLLRIEEELAEAADYPSK
                370        380        390        400        410        420

429
m652-1   AAFYQLGKX
         |||||||||
a652-1   AAFYQLGKX
```

The following partial DNA sequence was identified in *N. gonorrhoeae* <SEQ ID 2117>:

```
g653.seq
   1 ATGGCGGcgg aaccgatgcg gAtgccggag gtaAcgtaCG GTTTTTCCGG

51 ATCGTTCGGG ATGGCGTTTT TGTtgacggT GATGTGCGCt ttgcccaAAG

101 CGGCTtcggc ggctttgcCg gtgaTTTTCA TCGGTTGCAG GtcgacgaGG

151 AAaacgTGGC TTTCGGTGCG GCCGGAAacg atgcgCaaac cgCGTttaac 201 caactcttcc gcCATGACGG CAGCATTGAT TTTCACTTGT TTTGCGTATT
```

-continued

```
251 GTTTGAactC GGGTTGcaac gcttctTTAA acgctACGGC TttgGCGGCG

301 ATAACGTgca tcaACGGAcc gCCTTGCAGG CTTGGGAAGA TGGAAGAGTT

351 CAGCGCTTTT TCGTGGGTAT TGTCACGGCA CAAAATCACA CCGCCGCGAG

401 GGCCGCGTAG GGTTTTGTGG GTGGTAGTGg ttACgaaGTc GCAGAatggc

451 ACGGGgttag gatattcgcc gccGGCAACC AgtccgGCAT Ag
```

This corresponds to the amino acid sequence <SEQ ID 2118; ORF 653.ng>:

```
g653.pep
  1 MAAEPMRMPE VTYGFSGSFG MAFLLTVMCA LPKAASAALP VIFIGCRSTR

51 KTWLSVRPET MRKPRLTNSS AMTAALIFTC FAYCLNSGCN ASLNATALAA

101 ITCINGPPCR LGKMEEFSAF SWVLSRHKIT PPRGPRRVLW VVVVTKSQNG

151 TGLGYSPPAT SPA*
```

The following partial DNA sequence was identified in *N. meningitidis* <SEQ ID 2119>:

```
m653.seq
  1 ATGGCAGCGG AGCCGATGCG GATGCCGGAG GTAACGAAGG GTTTTTCCGG

51 ATCGTTCGGA ATGGCGTTTT TGTTGACGGT GATGTGCGCT TTGCCCAAAG

101 CGGCTTCGGC GGCTTTGCCG GTAATTTTCA TCGGTTGCAG GTCAACGAGG

151 AAAACGTGGC TTTCGGTGCG GCCGGAAACG ATGCGCAAAC CGCGTTTAAC

201 CAACTCTTCC GCCATGGCGG CTGCATTGAT TTTCACTTGT TTTGCGTATT

251 GTTTGAACTC GGGTTGCAAT GCTTCTTTAA ACGCCACGGC TTTGGCGGCG

301 ATAACGTGCA TCAGCGGACC GCCTTGCAGG CTTGGGAAGA TGGAAGAGTT

351 CAACGCTTTT TCGTGGGTAT TGTCGCGGCA CAAAATTACG CCGCCGCGAG

401 GACCGCGCAG GGTTTTGTGG GTGGTGGTGG TCACGAAGTC GCAGAACGGC

451 ACCGGGTTGG GATATTCGCC GCCGGCAACC AGACCGGCAT AG
```

This corresponds to the amino acid sequence <SEQ ID 2120; ORF 653>:

```
m653.pep
    1 MAAEPMRMPE VTKGFSGSFG MAFLLTVMCA LPKAASAALP VIFIGCRSTR

51 KTWLSVRPET MRKPRLTNSS AMAAALIFTC FAYCLNSGCN ASLNATALAA

101 ITCISGPPCR LGKMEEFNAF SWVLSRHKIT PPRGPRRVLW VVVVTKSQNG

151 TGLGYSPPAT RPA*
``` m653/g653 96.9% identity in 163 aa overlap

```
                   10         20         30         40         50         60
    m653.pep  MAAEPMRMPEVTKGFSGSFGMAFLLTVMCALPKAASAALPVIFIGCRSTRKTWLSVRPET
              ||||||||||||||||||||||||||||||||||||||||||||||||||||||||||||
    g653      MAAEPMRMPEVTKGFSGSFGMAFLLTVMCALPKAASAALPVIFIGCRSTRKTWLSVRPET
                   10         20         30         40         50         60

70         80         90        100        110        120
    m653.pep  MRKPRLTNSSAMAAALIFTCFAYCLNSGCNASLNATALAAITCISGPPCRLGKMEEFNAF
              ||||||||||:|||||||||||||||||||||||||||||||:|||||||||||||:||
    g653      MRKPRLTNSSAMTAALIFTCFAYCLNSGCNASLNATALAAITCINGPPCRLGKMEEFSAF
                   70         80         90        100        110        120
```

```
                       130       140       150       160
    m653.pep  SWVLSRHKITPPRGPRRVLWVVVVTKSQNGTGLGYSPPATRPAX
              ||||||||||||||||||||||||||||||||||||||||| ||
    g653      SWVLSRHKITPPRGPRRVLWVVVVTKSQNGTGLGYSPPATSPAX
                       130       140       150       160
```

The following partial DNA sequence was identified in *N. meningitidis* <SEQ ID 2121>:

```
a653.seq
   1 ATGGCGGCGG AACCGATGCG GATGCCGGAG GTAACGAAGG GTTTTTCCGG

51 ATCATTCGGG ATGGCGTTTT TGTTGACAGT GATGTGCGCT TTGCCCAAAG

101 CAGCTTCGGC GGCTTTGCCG GTAATTTTCA TCGGTTGCAG GTCAACGAGG

151 AAAACGTGGC TTTCGGTGCG GCCGGAAACG ATGCGCAAAC CGCGTTTAAC

201 CAACTCTTCC GCCATGGCGG CTGCATTGAT TTTCACTTGT TTTGCGTATT

251 GTTTGAACTC GGGTTGCAAT GCTTCTTTAA ACGCCACGGC TTTGGCGGCG

301 ATAACGTGCA TCAGCGGGCC ACCTTGCAGG CTTGGGAAGA TGGAAGAGTT

351 CAACGCTTTT TCGTGGGTAT TGTCGCGGCA CAAAATTACG CCGCCGCGAG

401 GACCGCGCAG GGTTTTGTGG GTGGTGGTGG TAACGAAGTC GCAGAACGGC

451 ACGGGATTGG GATATTCGCC GCCGGCAACC AGACCGGCAT AG
```

This corresponds to the amino acid sequence <SEQ ID 2122; ORF 653.a>:

```
    a653.pep

1    MAAEPMRMPE VTKGFSGSFG MAFLLTVMCA LPKAASAALP VIFIGCRSTR

51    KTWLSVRPET MRKPRLTNSS AMAAALIFTC FAYCLNSGCN ASLNATALAA

101    ITCISGPPCR LGKMEEFNAF SWVLSRHKIT PPRGPRRVLW VVVVTKSQNG

151    TGLGYSPPAT RPA* m653/a653    100.0% identity in 163 aa overlap 10        20        30        40        50        60
    m653.pep   MAAEPMRMPEVTKGFSGSFGMAFLLTVMCALPKAASAALPVIFIGCRSTRKTWLSVRPET
               ||||||||||||||||||||||||||||||||||||||||||||||||||||||||||||
    a653       MAAEPMRMPEVTKGFSGSFGMAFLLTVMCALPKAASAALPVIFIGCRSTRKTWLSVRPET
                        10        20        30        40        50        60

70        80        90       100       110       120
    m653.pep   MRKPRLTNSSAMAAALIFTCFAYCLNSGCNASLNATALAAITCISGPPCRLGKMEEFNAF
               ||||||||||||||||||||||||||||||||||||||||||||||||||||||||||||
    a653       MRKPRLTNSSAMAAALIFTCFAYCLNSGCNASLNATALAAITCISGPPCRLGKMEEFNAF
                        70        80        90       100       110       120

130       140       150       160
    m653.pep   SWVLSRHKITPPRGPRRVLWVVVVTKSQNGTGLGYSPPATRPAX
               ||||||||||||||||||||||||||||||||||||||||||||
    a653       SWVLSRHKITPPRGPRRVLWVVVVTKSQNGTGLGYSPPATRPAX
                       130       140       150       160
```

The following partial DNA sequence was identified in *N. gonorrhoeae* <SEQ ID 2123>:

```
g656.seq
   1 ATGCCGCGTT TCTCCGGTTC GATTTCTTCG ATGATTTCCA TCGCGCGGAC

51 TTTtggcGCG CCGGAGAGTG TGCcggcagg gAAGGTGGCG GCGAGGATGT

101 CCATATTGGT AACGCCCTCT TTCAAACAGc ctTCGACGTT GGAAACGATG

151 TGCATCACAT GGGAGTATTT TTCAATCACC ATTTTGTCGG TGACTTTGAC
```

-continued

```
201 TTCGCCTGTT TTGCTGATGC GTCCGACATC GTTGCGCCCC AAATCGATAA

251 GCATAACGTG TTCGGCgatt TCTTTGGCGT CGCTTAACAA ATCTTGTTCG

301 TTGGCAAGGT CTTCGGCGGG GGTTTTGCCG CGCAGGCGCG TGCCGGCGAT

351 GGGGCGGACG ATGACGTcat CGCGTTCGCG GCGGACGAGG ATTTCGGGCG

401 AGGAACCGAC GATGTGGAAA TCGCCGAAAT CGTAG
```

This corresponds to the amino acid sequence <SEQ ID 2124; ORF 656.ng>:

```
g656.pep
  1 MPRFSGSISS MISIARTFGA PESVPAGKVA ARMSILVTPS FKQPSTLETM

51 CITWEYFSIT ILSVTLTSPV LLMRPTSLRP KSISITCSAI SLASLNKSCS

101 LARSSAGVLP RRRVPAMGRT MTSSRSRRTR ISGEEPTMWK SPKS*
```

The following partial DNA sequence was identified in *N. meningitidis* <SEQ ID 2125>:

```
m656.seq
  1 ATGCCGCGTT TGCTCGGTTC GACTTCTTCG ATGATTTCCA TGGCGCGGAC

51 TTTGGGTGCG CCGGAGAGTG TGCCGGCAGG GAAGGTAGCG GCGAGGATGT

101 CCATGTTGGT CATGCCGTCT TTCAGACGGC CTTCGACGTT GGAAACGATG

151 TGCATTACAT GGGAGTATTT TTCAATCACC ATTTTGTCGG TAACTTTGAC

201 TTCGCCGGTT TTACTGATGC GGCCGACGTC GTTGCGTCCT AAGTCAATCA

251 ACATGACGTG TTCGGCGATT TCTTTGGCAT CGCTTAACAA ATCTTGTTCG

301 TTGGCAAGGT CTTCGGCGGG GGTTTTGCCG CGCAGGCGCG TGCCGGCGAT

351 GGGGCGGACG ATAACGTCGT TGCGTTCGCG TCGGACGAGG ATTTCGGGCG

401 AGGAGCCGAC GATGTGGAAA TCGCCGAAAT CGTAG
```

This corresponds to the amino acid sequence <SEQ ID 2126; ORF 656>:

```
m656.pep
  1 MPRLLGSTSS MISMARTLGA PESVPAGKVA ARMSMLVMPS FRRPSTLETM

51 CITWEYFSIT ILSVTLTSPV LLMRPTSLRP KSINMTCSAI SLASLNKSCS

101 LARSSAGVLP RRRVPAMGRT ITSLRSRRTR ISGEEPTMWK SPKS*
```

Computer analysis of this amino acid sequence gave the following results:
Homology with a Predicted ORF from *N. gonorrhoeae*

```
    m656/g656    91.0% identity in 144 aa overlap 10         20         30         40         50         60
    m656.pep    MPRLLGSTSSMISMARTLGAPESVPAGKVAARMSMLVMPSFRRPSTLETMCITWEYFSIT
                ||| : || |||||:|||:||||||||||||||||:|| |||::|||||||||||||||
    g656        MPRFSGSISSMISIARTFGAPESVPAGKVAARMSILVTPSFKQPSTLETMCITWEYFSIT
                    10         20         30         40         50         60

70         80         90        100        110        120
    m656.pep    ILSVTLTSPVLLMRPTSLRPKSINMTCSAISLASLNKSCSLARSSAGVLPRRRVPAMGRT
                ||||||||||||||||||||||||::|||||||||||||||||||||||||||||||||
    g656        ILSVTLTSPVLLMRPTSLRPKSISITCSAISLASLNKSCSLARSSAGVLPRRRVPAMGRT
                    70         80         90        100        110        120
```

-continued

```
                  130        140
m656.pep    ITSLRSRRTRISGEEPTMWKSPKSX
            :|| ||||||||||||||||||||
g656        MTSSRSRRTRISGEEPTMWKSPKSX
                  130        140
```

The following partial DNA sequence was identified in *N. meningitidis* <SEQ ID 2127>:

```
a656.seq
  1 ATGCCGCGTT TGCTCGGTTC GACTTCTTCG ATGATTTCCA TGGCGCGGAC

51 TTTGGGTGCG CCGGAGAGTG TGCCGGCAGG GAAGGTAGCG GCGAGGATGT

101 CCATGTTGGT CATGCCGTCT TTCAGACGGC CTTCGACGTT GGAAACGATG

151 TGCATTACAT GGGAGTATTT TTCAATCACC ATTTTGTCGG TAACTTTGAC

201 TTCGCCGGTT TTACTGATGC GGCCGACGTC GTTGCGTCCT AAGTCAATCA

251 ACATGACGTG TTCGGCGATT CTTTGGCAT CGCTTAACAA ATCTTGTTCG

301 TTGGCAAGGT CTTCGGCGGG GGTTTTGCCG CGCAGGCGCG TGCCGGCGAT

351 GGGGCGGACG ATGACATCGT CGCGTTCGCG GCGGACGAGG ATTTCGGGCG

401 AGGAGCCGAC GATGTGGAAA TCGCCGAAAT CGTAG
```

This corresponds to the amino acid sequence <SEQ ID 2128; ORF 656.a>:

```
a656.pep
      1 MPRLLGSTSS MISMARTLGA PESVPAGKVA ARMSMLVMPS FRRPSTLETM

51 CITWEYFSIT ILSVTLTSPV LLMRPTSLRP KSINMTCSAI SLASLNKSCS

101 LARSSAGVLP RRRVPAMGRT MTSSRSRRTR ISGEEPTMWK SPKS*
``` m656/a656 98.6% identity in 144 aa overlap

```
                  10         20         30         40         50         60
m656.pep    MPRLLGSTSSMISMARTLGAPESVPAGKVAARMSMLVMPSFRRPSTLETMCITWEYFSIT
            ||||||||||||||||||||||||||||||||||||||||||||||||||||||||||||
a656        MPRLLGSTSSMISMARTLGAPESVPAGKVAARMSMLVMPSFRRPSTLETMCITWEYFSIT
                  10         20         30         40         50         60
                  70         80         90        100        110        120
m656.pep    ILSVTLTSPVLLMRPTSLRPKSINMTCSAISLASLNKSCSLARSSAGVLPRRRVPAMGRT
            ||||||||||||||||||||||||||||||||||||||||||||||||||||||||||||
a656        ILSVTLTSPVLLMRPTSLRPKSINMTCSAISLASLNKSCSLARSSAGVLPRRRVPAMGRT
                  70         80         90        100        110        120
                  130        140
m656.pep    ITSLRSRRTRISGEEPTMWKSPKSX
            :|| ||||||||||||||||||||
a656        MTSSRSRRTRISGEEPTMWKSPKSX
                  130        140
```

The following partial DNA sequence was identified in *N. gonorrhoeae* <SEQ ID 2129>:

```
g657.seq
  1 ATGAACACAC CCCCCATCCT TCCTCCCGCC ATGCTCGGCA TCCTCGGCGG

51 CGGACAATTa ggcagAATGT TTGCCGTTGC CGCTAAAACC ATGGGCTACA

101 AAGTAACCGT TCTCGATCCC GACCCGAATG CGCCGGCGGC GGAATTTGCC

151 GACCGCCATT TGTGCGCGCC GTTTGACGAC CGGGCCGCGT TGGACGAATT

201 GGCAAAATGC GCGGCGGTta cgACCGAATT TGAAAacgtc aaTGCCGACG
```

```
251 CGATGCGCTC TCTGGCAAAG CATACCAACG TTTCCCCCAG CGGCGACTGC

301 GTGTCCATTG CACAAAACCG CATTCAGGAA AAAGCGTGGA TACGCAAAGC

351 AGGCTTGCAA ACCGCGCCGT ATCAGGCGGT TTGCAAGGCC GAAGACATTA

401 CTGAAGCAAG CGCGCAATTT TTGCCCGGCA TCCTGAAAAC GGCTACGTTG

451 GGCTACGACG GCAAAGGTCA AATCCGCGTC AAAACGTTGG ACGAACTCAA

501 AGCCGCGTTT GCCGAACACG GCGGCGTGGA TTGCGTTTTG GAAAAAATGG

551 TGGACTTGCG CGGCGAGATT TCCGTGATCG TATGCCGTCT GAACGATGAA

601 AACGTGCAAA CCTTCGACCC CGCCGAAAAC ATCCACGAAA ACGGCATCTT

651 GGCTTattcC ATCGTCcccg CGCGGCTGAG TGCCGACGTG CAGCAACAGG

701 CGCGGCAGAC GGCGCAACgc tTGGCGGACG AATTGGATTA TGTCGGCgta

751 TTGGCGGTAG AAATGTTTGT TGTCGGCGAC ACACATGAAT TGCTCGTCAA

801 TGAAACCGCC CCGCGCACGC ACAATTCCGG CCACCATACG ATAGATGCCT

851 GCGCCGCAGA CCAGTTCCAA CAGCAGGTAC GCATTATGTG CAAcctGCCG 901 cccGccgACA CCAAATTATT aTCCCCttgC TGTATGGCGA ATATTTTGGg

951 CGACGTTTGG CAGGAAGATG GCGGCGAACC GGATTGGCTG CCGTTGCAAA

1001 GCCGGCCGAA TGCACACCTG CACCTATACG GAAAAAAAAC CGCACAGAAA

1051 GGTCGGAAAA TGGGACACTT TaccgTTTTG ACCACCGATT CGGACaccgC

1101 ATTTCAAGAA GCAAAAAAAC TGCATCAGTC CCTATAA
```

This corresponds to the amino acid sequence <SEQ ID 2130; ORF 657.ng>:

```
g657.pep
  1 MNTPPILPPA MLGILGGGQL GRMFAVAAKT MGYKVTVLDP DPNAPAAEFA

51 DRHLCAPFDD RAALDELAKC AAVTTEFENV NADAMRSLAK HTNVSPSGDC

101 VSIAQNRIQE KAWIRKAGLQ TAPYQAVCKA EDITEASAQF LPGILKTATL

151 GYDGKGQIRV KTLDELKAAF AEHGGVDCVL EKMVDLRGEI SVIVCRLNDE

201 NVQTFDPAEN IHENGILAYS IVPARLSADV QQQARQTAQR LADELDYVGV

251 LAVEMFVVGD THELLVNETA PRTHNSGHHT IDACAADQFQ QQVRIMCNLP

301 PADTKLLSPC CMANILGDVW QEDGGEPDWL PLQSRPNAHL HLYGKKTAQK

351 GRKMGHFTVL TTDSDTAFQE AKKLHQSL*
```

The following partial DNA sequence was identified in *N. meningitidis* <SEQ ID 2131>:

```
m657.seq
  1 ATGAAAAACA TATCTCTTTC TCCGCCCGCC ATGCTTGGCA TCCTCGGCGG
 51 CGGACAATTA GGCAGAATGT TTACCGTTGC CGCCAAAACC ATGGGCTACA
101 AAGTAACCGT TCTCGACCCC GATCCGGACG CGCCGGCAGC AGAATTTGCC
151 GACCGCCATT TGTGCGCGCC GTTTAACGAC CAAGCTGCTT TGGACGAATT
201 GGCAAAATGC GCGGCGGTGA CCACTGAATT TGAAAACGTC AATGCCGATG
251 CGATGCGCTT TTTGGCAAAA CATACCAATG TTTCCCCTAG CGGCGATTGT
301 GTGGCGATTG CACAAAACCG CATTCAGGAA AAGGCATGGA TACGCAAAGC
351 GGGATTGCAA ACCGCGCCGT ATCAAGTGGT TTGTAAGGCT GAAGACATCA
```

```
 401 CTGAAGCAAG CGCGCAATTT TTGCCCGGCA TCCTGAAAAC GGCTACGTTG

451 GGCTACGACG GCAAAGGTCA AATCCGCGTA AAAACATTGG ATGAACTCAA

501 AGCCGCGTTT GCCGAACACG GCGGCGTGGA TTGCGTTTTG GAAAAAATGG

551 TGGATTTGCG CAGTGAAATT TCCGTAATCG TATGCCGTTT GAACAATGAC

601 AACGTGCAAA CTTTCGACCC TGCCGAAAAC ATCCACGAAA ACGGCATCTT

651 GGCTTATTCC ATCGTCCCCG CGCGACTGAG TGCCGACGTG CAGCAACAGG

701 CGCGGCAGAT GGCGCAACGC TTGGCGGACG AATTGGATTA TGTCGGCGTA

751 TTGGCGGTAG AAATGTTTGT TGTCGGTGAC ACGCATGAAT TGGTCGTCAA

801 CGAAATCGCC CCGCGCCCGC ACAATTCCGG ACACCATACG ATAGATGCCT

851 GCGCAGCAGA CCAGTTCCAG CAGCAGGTAC GCATTATGTG CAACCTGCCG

901 CCTGCCGATA CCAAATTACT GAGTTCTTGC TGTATGGCAA ATATTTTGGG

951 CGACGTTTGG CAGGAAGACG GCGGCGAACC GGATTGGCTG CCCTTGCAAA

1001 GCCATCCGAA TGCACACCTG CACCTTTACG GCAAAAAAAC CGCGCACAAA

1051 GGGCGGAAAA TGGGACACTT TACCGTTTTA ACCACCGATT CGGACACCGC

1101 ATTTCAAGAA GCAAAAAAAC TGCATCAGTC CCTATAA
```

This corresponds to the amino acid sequence <SEQ ID 2132; ORF 657>:

```
m657.pep
  1 MKNISLSPPA MLGILGGGQL GRMFTVAAKT MGYKVTVLDP DPDAPAAEFA

51 DRHLCAPFND QAALDELAKC AAVTTEFENV NADAMRFLAK HTNVSPSGDC

101 VAIAQNRIQE KAWIRKAGLQ TAPYQVVCKA EDITEASAQF LPGILKTATL

151 GYDGKGQIRV KTLDELKAAF AEHGGVDCVL EKMVDLRSEI SVIVCRLNND

201 NVQTFDPAEN IHENGILAYS IVPARLSADV QQQARQMAQR LADELDYVGV

251 LAVEMFVVGD THELVVNEIA PRPHNSGHHT IDACAADQFQ QQVRIMCNLP

301 PADTKLLSSC CMANILGDVW QEDGGEPDWL PLQSHPNAHL HLYGKKTAHK

351 GRKMGHFTVL TTDSDTAFQE AKKLHQSL*
```

Computer analysis of this amino acid sequence gave the following results:
Homology with a Predicted ORF from *N. gonorrhoeae*

```
    m657/g657 93.9% identity in 378 aa overlap 10        20        30        40        50        60
    m657.pep  MKNISLSPPAMLGILGGGQLGRMFTVAAKTMGYKVTVLDPDPDAPAAEFADRHLCAPFND
              |::  : ||||||||||||||||:|||||||||||||||||:|||||||||||||||:|
    g657      MNTPPILPPAMLGILGGGQLGRMFAVAAKTMGYKVTVLDPDPNAPAAEFADRHLCAPFDD
                    10        20        30        40        50        60

70        80        90       100       110       120
    m657.pep  QAALDELAKCAAVTTEFENVNADAMRFLAKHTNVSPSGDCVAIAQNRIQEKAWIRKAGLQ
              :|||||||||||||||||||||||||:||||||||||||||:||||||||||||||||||
    g657      RAALDELAKCAAVTTEFENVNADAMRSLAKHTNVSPSGDCVSIAQNRIQEKAWIRKAGLQ
                    70        80        90       100       110       120

130       140       150       160       170       180
    m657.pep  TAPYQVVCKAEDITEASAQFLPGILKTATLGYDGKGQIRVKTLDELKAAFAEHGGVDCVL
              |||||:||||||||||||||||||||||||||||||||||||||||||||||||||||||
    g657      TAPYQAVCKAEDITEASAQFLPGILKTATLGYDGKGQIRVKTLDELKAAFAEHGGVDCVL
                   130       140       150       160       170       180
```

-continued

```
                       190       200       210       220       230       240
m657.pep        EKMVDLRSEISVIVCRLNNDNVQTFDPAENIHENGILAYSIVPARLSADVQQQARQMAQR
                |||||||:||||||||||::|||||||||||||||||||||||||||||||||||| |||
g657            EKMVDLRGEISVIVCRLNDENVQTFDPAENIHENGILAYSIVPARLSADVQQQARQTAQR
                       190       200       210       220       230       240

250       260       270       280       290       300
m657.pep        LADELDYVGVLAVEMFVVGDTHELVVNEIAPRPHNSGHHTIDACAADQFQQQVRIMCNLP
                ||||||||||||||||||||||||:||| ||| |||||||||||||||||||||||||||
g657            LADELDYVGVLAVEMFVVGDTHELLVNETAPRTHNSGHHTIDACAADQFQQQVRIMCNLP
                       250       260       270       280       290       300

310       320       330       340       350       360
m657.pep        PADTKLLSSCCMANILGDVWQEDGGEPDWLPLQSHPNAHLHLYGKKTAHKGRKMHGFTVL
                |||||||| |||||||||||||||||||||||||:|||||||||||||:|||||||||||
g657            PADTKLLSPCCMANILGDVWQEDGGEPDWLPLQSRPNAHLHLYGKKTAQKGRKMHGFTVL
                       310       320       330       340       350       360

370      379
m657.pep        TTDSDTAFQEAKKLHQSLX
                ||||||||||||||||||
g657            TTDSDTAFQEAKKLHQSLX
                       370
```

The following partial DNA sequence was identified in *N. meningitidis* <SEQ ID 2133>:

```
a657.seq
   1 ATGAAAAACA TATCTCTTTC TCCGCCCGCC ATGCTCGGCA TTCTTGGCGG

51 CGGACAATTA GGCAGAATGT TTACTGTTGC TGCCAAAACC ATGGGCTACA

101 AAGTAACCGT ACTCGATCCC AACCCGAATG CGCCGGCAGC GGAATTTGCC

151 GACCGCCATT TGTGTGCGCC GTTTGACAAC CAAACCGCTT TGGAAGAATT

201 GGCAAAATGT GCGGCTGTTA CGACCGAGTT CGAAAACGTC AATGCCGATG

251 CGATGCGTTT TCTCGCCAAA CATACCAATG TTTCCCCCAG CGGCGACTGC

301 GTTGCCATCG CGCAAAACCG CATTCAGGAA AAGGCATGGA TACGCAAAGC

351 AGGCCTGCAA ACCGCGCCGT ATCAAGCAAT TTGCAAAGCC GAAGACATCA

401 CTGAAGAAAG CATACAATTT CTGCCCGGCA TCCTGAAAAC CGCTACATTG

451 GGCTATGACG GCAAAGGCCA AATCCGCGTC AAAACGGTGG ATGAACTCAA

501 AGCCGCGTTT GCCGAACACC GCGGCGTGGA TTGCGTTTTG GAAAAAATGG

551 TGGACTTGCG CGGCGAAATT TCCGTTATCG TATGCCGTCT GAACAATGAC

601 AACGTGCAAA CTTTCGATCC TGCCGAAAAC ATTCACGAAA ACGGTATCCT

651 CGCCTACTCC ATCGTCCCAG CCCGACTGAG TGCCGACATT CAGCAACAGG

701 CGCGACAAAT GGCGCAGCGT TTGGCCGATG AATTGAACTA CGTCGGCGTA

751 TTGGCGGTAG AAATGTTTGT TGTCGGCGAC ACGCATGAAT TGGTCGTCAA

801 CGAAATCGCG CCGCGTCCGC ACAATTCCGG CCACCATACC GTCGACGCCT

851 GCGCGGCAGA CCAATTCCAG CAACAGGTCC GCCTGATGTG CAACCTGCCA

901 CCTGCTGACA CCAAATTGCT GAGTTCTTGC TGTATGGCGA ATATTTTGGG

951 CGACGTTTGG CAGGAAGACG GCGGCGAACC GGATTGGTTT CCCCTGCAAA

1001 GCCGGCCGGA CGCGCACCTG CACCTTTACG GCAAAAAAAC CGCGCACAAA

1051 GGGCGGAAAA TGGGACACTT TACCATTTTA AGCACCGATT CGGACACCGC

1101 ATTTCAAGAA GCAAAAAAAC TGCATCAGTC CCTATAA
```

This corresponds to the amino acid sequence <SEQ ID 2134; ORF 657.a>:

```
a657.pep

1 MKNISLSPPA MLGILGGGQL GRMFTVAAKT MGYKVTVLDP NPNAPAAEFA

51 DRHLCAPFDN QTALEELAKC AAVTTEFENV NADAMRFLAK HTNVSPSGDC

101 VAIAQNRIQE KAWIRKAGLQ TAPYQAICKA EDITEESIQF LPGILKTATL

151 GYDGKGQIRV KTVDELKAAF AEHRGVDCVL EKMVDLRGEI SVIVCRLNND

201 NVQTFDPAEN IHENGILAYS IVPARLSADI QQQARQMAQR LADELNYVGV

251 LAVEMFVVGD THELVVNEIA PRPHNSGHHT VDACAADQFQ QQVRLMCNLP

301 PADTKLLSSC CMANILGDVW QEDGGEPDWF PLQSRPDAHL HLYGKKTAHK

351 GRKMGHFTIL STDSDTAFQE AKKLHQSL* m657/a657 94.2% identity in 378 aa overlap
                   10         20         30         40         50         60
m657.pep   MKNISLSPPAMLGILGGGQLGRMFTVAAKTMGYKVTVLDPDPDAPAAEFADRHLCAPFND
           ||||||||||||||||||||||||||||||||||||||| : |:|||||||||||||::
a657       MKNISLSPPAMLGILGGGQLGRMFTVAAKTMGYKVTVLDPNPNAPAAEFADRHLCAPFDN
                   10         20         30         40         50         60

70         80         90        100        110        120
m657.pep   QAALDELAKCAAVTTEFENVNADAMRFLAKHTNVSPSGDCVAIAQNRIQEKAWIRKAGLQ
           |:||:|||||||||||||||||||||||||||||||||||||||||||||||||||||||
a657       QTALEELAKCAAVTTEFENVNADAMRFLAKHTNVSPSGDCVAIAQNRIQEKAWIRKAGLQ
                   70         80         90        100        110        120

130        140        150        160        170        180
m657.pep   TAPYQVVCKAEDITEASAQFLPGILKTATLGYDGKGQIRVKTLDELKAAFAEHGGVDCVL
           |||||::||||||||| |||||||||||||||||||||||||:|||||||||||  |||||
a657       TAPYQAICKAEDITEESIQFLPGILKTATLGYDGKGQIRVKTVDELKAAFAEHRGVDCVL
                  130        140        150        160        170        180

190        200        210        220        230        240
m657.pep   EKMVDLRSEISVIVCRLNNDNVQTFDPAENIHENGILAYSIVPARLSADVQQQARQMAQR
           |||||||:|||||||||||||||||||||||||||||||||||||||||:||||||||||
a657       EKMVDLRGEISVIVCRLNNDNVQTFDPAENIHENGILAYSIVPARLSADIQQQARQMAQR
                  190        200        210        220        230        240

250        260        270        280        290        300
m657.pep   LADELDYVGVLAVEMFVVGDTHELVVNEIAPRPHNSGHHTIDACAADQFQQQVRIMCNLP
           |||||:||||||||||||||||||||||||||||||||||:|||||||||||||:|||||
a657       LADELNYVGVLAVEMFVVGDTHELVVNEIAPRPHNSGHHTVDACAADQFQQQVRLMCNLP
                  250        260        270        280        290        300

310        320        330        340        350        360
m657.pep   PADTKLLSSCCMANILGDVWQEDGGEPDWLPLQSHPNAHLHLYGKKTAHKGRKMGHFTVL
           ||||||||||||||||||||||||||||||:|||||:|:|||||||||||||||||||:|
a657       PADTKLLSSCCMANILGDVWQEDGGEPDWFPLQSRPDAHLHLYGKKTAHKGRKMGHFTIL
                  310        320        330        340        350        360

370      379
m657.pep   TTDSDTAFQEAKKLHQSLX
           :||||||||||||||||||
a657       STDSDTAFQEAKKLHQSLX
                  370
```

The following partial DNA sequence was identified in *N. gonorrhoeae* <SEQ ID 2135>:

```
g658.seq
    1 ATGGTGGCCG GAATTGTGCG TGCGCGGGGC GGTTTCATTG ACGAGCAATT

51 CATGTGTGTC GCCGACAACA AACATTTCTA CCGCCAAtac GCCGACATAA

101 TCCAATTCGT CCGCCAagcG TTGCGCCGTC TGCCGCGCCT GTTGCTGCAC

151 GTCGGCACTC AGCCGCGcgg gGACGATGga atAAGCCAAG ATGCCGTTTT

201 CGTGGATGTT TTCGGCGGGG TCGAAGGTTT GCACGTTTTC ATCGTTCAGA

251 CGGCATACGA TCACGGAAAT CTCGCCGCGC AAGTCCACCA TTTTTTCCAA

301 AACGCAATCC ACGCCGCCGT GTTCGGCAAA CGCGGCTTTG AGTTCGTCCA

351 ACGTTTTGAC GCGGATTTGA CCTTTGCCGT CGTAGCCCAA CGTAGCCGTT
```

-continued

```
401 TTCAGGATGC CGGGCAAAAA TTGCGCGCTT GCTTCAGTAA TGTCTTCGGC

451 CTTGCAAACC GCCTGATACG GCGCGGTTTG CAAGCCTGCT TTGCGTATCC

501 ACGCTTTTTC CTGAATGCGG TTTTGTGCAA TGGACACGCA GTCGCCGCTG

551 GGGGAAACGT TGGTATGCTT TGCCAGAGAG CGCATCGCGT CGGCAttgac 601 gtTTTCAAAT TCGGTcgtaA CCGCCGCGCA TTTTGCCAAT TCGTCCAACG

651 CGGCCCGGTC GTCAAACGGC GCGCACAAAT GGCGGTCGGC AAATTCCGCC

701 GCCGGCGCAT TCGGGTCGGG ATCGAGAACG GTTACTTTGT AGCCCATGGT

751 TTTAGCGGCA ACGGCAAACA TTctgcctAA
```

This corresponds to the amino acid sequence <SEQ ID 2136; ORF 658.ng>:

```
g658.pep
   1 MVAGIVRARG GFIDEQFMCV ADNKHFYRQY ADIIQFVRQA LRRLPRLLLH

51 VGTQPRGDDG ISQDAVFVDV FGGVEGLHVF IVQTAYDHGN LAAQVHHFFQ

101 NAIHAAVFGK RGFEFVQRFD ADLTFAVVAQ RSRFQDAGQK LRACFSNVFG

151 LANRLIRRGL QACFAYPRFF LNAVLCNGHA VAAGGNVGML CQRAHRVGID

201 VFKFGRNRRA FCQFVQRGPV VKRRAQMAVG KFRRRRIRVG IENGYFVAHG

251 FSGNGKHSA*
```

The following partial DNA sequence was identified in N. meningitidis <SEQ ID 2137>:

```
m658.seq
   1 ATGGTGTCCG GAATTGTGCG GGCGCGGGGC GATTTCGTTG ACGACCAATT

51 CATGCGTGTC ACCGACAACA AACATTTCTA CCGCCAATAC GCCGACATAA

101 TCCAATTCGT CCGCCAAGCG TTGCGCCATC TGCCGCGCCT GTTGCTGCAC

151 GTCGGCACTC AGTCGCGCGG GGACGATGGA ATAAGCCAAG ATGCCGTTTT

201 CGTGGATGTT TTCGGCAGGG TCGAAAGTTT GCACGTTGTC ATTGTTCAAA

251 CGGCATACGA TTACGGAAAT TTCACTGCGC AAATCCACCA TTTTTTCCAA

301 AACGCAATCC ACGCCGCCGT GTTCGGCAAA CGCGGCTTTG AGTTCATCCA

351 ATGTTTTTAC GCGGATTTGA CCTTTGCCGT CGTAGCCCAA CGTAGCCGTT

401 TTCAGGATGC CGGGCAAAAA TTGCGCGCTT GCTTCAGTGA TGTCTTCAGC

451 CTTACAAACC ACTTGATACG GCGCGGTTTG CAATCCCGCT TTGCGTATCC

501 ATGCCTTTTC CTGAATGCGG TTTTGTGCAA TCGCCACACA ATCGCCGCTA

551 GGGGAAACAT TGGTATGTTT TGCCAAAAAG CGCATCGCAT CGGCATTGAC

601 GTTTTCAAAT TCAGTGGTCA CCGCCGCGCA TTTTGCCAAT TCGTCCAAAG

651 CAGCTTGGTC GTTAAACGGC GCGCACAAAT GGCGGTCGGC AAATTCTGCT

701 GCCGGCGCGT CCGGATCGGG GTCGAGAACG GTTACTTTGT AGCCCATGGT

751 TTTGGCGGCA ACGGTAAACA TTCTGCCTAA
```

This corresponds to the amino acid sequence <SEQ ID 2138; ORF 658>:

```
m658.pep
   1 MVSGIVRARG DFVDDQFMRV TDNKHFYRQY ADIIQFVRQA LRHLPRLLLH

51 VGTQSRGDDG ISQDAVFVDV FGRVESLHVV IVQTAYDYGN FTAQIHHFFQ

101 NAIHAAVFGK RGFEFIQCFY ADLTFAVVAQ RSRFQDAGQK LRACFSDVFS

151 LTNHLIRRGL QSRFAYPCLF LNAVLCNRHT IAARGNIGMF CQKAHRIGID

201 VFKFSGHRRA FCQFVQSSLV VKRRAQMAVG KFCCRRVRIG VENGYFVAHG

251 FGGNGKHSA*
```

Computer analysis of this amino acid sequence gave the following results:

Homology with a Predicted ORF from *N. gonorrhoeae*

```
    m658/g658 82.2% identity in 259 aa overlap 10         20         30         40         50         60
   m658.pep MVSGIVRARGDFVDDQFMRVTDNKHFYRQYADIIQFVRQALRHLPRLLLHVGTQSRGDDG
            ||:|||||| |:|:||| |:|||||||||||||||||||:|||||||||||||:|||||
       g658 MVAGIVRAGGFIDEQFMCVADNKHFYRQYADIIQFVRQALRRLPRLLLHVGTQPRGDDG
                  10         20         30         40         50         60

70         80         90        100        110        120
   m658.pep ISQDAVFVDVFGRVESLHVVIVQTAYDYGNFTAQIHHFFQNAIHAAVFGKRGFEFIQCFY
            ||||||||||| ||:||||| ||||||:|| ::||||||||||||||||||||||:| |
       g658 ISQDAVFVDVFGGVEGLHVFIVQTAYDHGNLAAQVHHFFQNAIHAAVFGKRGFEFVQRFD
                  70         80         90        100        110        120

130        140        150        160        170        180
   m658.pep ADLTFAVVAQRSRFQDAGQKLRACFSDVFSLTNHLIRRGLQSRFAYPCLFLNAVLCNRHT
            |||||||||||||||||||||||||:||:|:|||||||: |||  :||||||||||| :
       g658 ADLTFAVVAQRSRFQDAGQKLRACFSNVFGLANRLIRRGLQACFAYPRFFLNAVLCNGHA
                 130        140        150        160        170        180

190        200        210        220        230        240
   m658.pep IAARGNIGMFCQKAHRIGIDVFKFSGHRRAFCQFVQSSLVVKRRAQMAVGKFCCRRVRIG
            :|| ||:||:|||:|||||||||||:  :||||||| : |||||||||||| ||:|:|
       g658 VAAGGNVGMLCQRAHRVGIDVFKFGRNRRAFCQFVQRGPVVKRRAQMAVGKFRRRRIRVG
                 190        200        210        220        230        240

250        260
   m658.pep VENGYFVAHGFGGNGKHSAX
            :|||||||||:|||||||||
       g658 IENGYFVAHGFSGNGKHSAX
                 250        260
```

The following partial DNA sequence was identified in *N. meningitidis* <SEQ ID 2139>:

```
a658.seq
   1 ATGGTGGCCG GAATTGTGCG GACGCGGCGC GATTTCGTTG ACGACCAATT

51 CATGCGTGTC GCCGACAACA AACATTTCTA CCGCCAATAC GCCGACGTAG

101 TTCAATTCAT CGGCCAAACG CTGCGCCATT TGTCGCGCCT GTTGCTGAAT

151 GTCGGCACTC AGTCGGGCTG GGACGATGGA GTAGGCGAGG ATACCGTTTT

201 CGTGAATGTT TTCGGCAGGA TCGAAAGTTT GCACGTTGTC ATTGTTCAGA

251 CGGCATACGA TAACGGAAAT TCGCCGCGC AAGTCCACCA TTTTTTCCAA

301 AACGCAATCC ACGCCGCGGT GTTCGGCAAA CGCGGCTTTG AGTTCATCCA

351 CCGTTTTGAC GCGGATTTGG CCTTTGCCGT CATAGCCCAA TGTAGCGGTT

401 TTCAGGATGC CGGGCAGAAA TTGTATGCTT TCTTCAGTGA TGTCTTCGGC

451 TTTGCAAATT GCTTGATACG GCGCGGTTTG CAGGCCTGCT TTGCGTATCC

501 ATGCCTTTTC CTGAATGCGG TTTTGCGCGA TGGCAACGCA GTCGCCGCTG

551 GGGGAAACAT TGGTATGTTT GGCGAGAAAA CGCATCGCAT CGGCATTGAC
```

-continued

```
601 GTTTTCGAAC TCGGTCGTAA CAGCCGCACA TTTTGCCAAT TCTTCCAAAG

651 CGGTTTGGTT GTCAAACGGC GCACACAAAT GGCGGTCGGC AAATTCCGCT

701 GCCGGCGCAT TCGGGTTGGG ATCGAGTACG GTTACTTTGT AGCCCATGGT

751 TTTGGCAGCA ACAGTAAACA TTCTGCCTAA
```

This corresponds to the amino acid sequence <SEQ ID 2140; ORF 658.a>:

```
a658.pep

1 MVAGIVRTRR DFVDDQFMRV ADNKHFYRQY ADVVQFIGQT LRHLSRLLLN

51 VGTQSGWDDG VGEDTVFVNV FGRIESLHVV IVQTAYDNGN FAAQVHHFFQ

101 NAIHAAVFGK RGFEFIHRFD ADLAFAVIAQ CSGFQDAGQK LYAFFSDVFG

151 FANCLIRRGL QACFAYPCLF LNAVLRDGNA VAAGGNIGMF GEKTHRIGID

201 VFELGRNSRT FCQFFQSGLV VKRRTQMAVG KFRCRRIRVG IEYGYFVAHG

251 FGSNSKHSA* m658/a658 75.3% identity in 259 aa overlap 10         20         30         40         50         60
m658.pep  MVSGIVRARGDFVDDQFMRVTDNKHFYRQYADIIQFVRQALRHLPRLLLHVGTQSRGDDG
          ||:||||:| ||||||||||:||||||||||::||: :|:|||| ||||:|||| |||
a658      MVAGIVRTRRDFVDDQFMRVADNKHFYRQYADVVQFIGQTLRHLSRLLLNVGTQSGWDDG
                  10         20         30         40         50         60
                  70         80         90        100        110        120
m658.pep  ISQDAVFVDVFGRVESLHVVIVQTAYDYGNFTAQIHHFFQNAIHAAVFGKRGFEFIQCFY
          :::|:|||:|||| :||||||||||||||| |||:|:||||||||||||||||||||: |
a658      VGEDTVFVNVFGRIESLHVVIVQTAYDNGNFAAQVHHFFQNAIHAAVFGKRGFEFIHRFD
                  70         80         90        100        110        120
                 130        140        150        160        170        180
m658.pep  ADLTFAVVAQRSRFQDAGQKLRACFSDVFSLTNHLIRRGLQSRFAYPCLFLNAVLCNRHT
          |||:|||:|| | ||||||||| | ||||||:::| |||||||: |||||||||||  : ::
a658      ADLAFAVIAQCSGFQDAGQKLYAFFSDVFGFANCLIRRGLQACFAYPCLFLNAVLRDGNA
                 130        140        150        160        170        180
                 190        200        210        220        230        240
m658.pep  IAARGNIGMFCQKAHRIGIDVFKFSGHRRAFCQFVQSSLVVKRRAQMAVGKFCCRRVRIG
          :|| |||||| :|:|||||||||::: : |:|||| ||:|||||:|||||||| ||:|:|
a658      VAAGGNIGMFGEKTHRIGIDVFELGRNSRTFCQFFQSGLVVKRRTQMAVGKFRCRRIRVG
                 190        200        210        220        230        240
                 250        260
m658.pep  VENGYFVAHGFGGNGKHSAX
          :| |||||||||:|:|||||
a658      IEYGYFVAHGFGSNSKHSAX
                 250        260
```

The following partial DNA sequence was identified in *N. gonorrhoeae* <SEQ ID 2141>:

```
g661.seq
  1 ATGCACATCG GCGGTTATTT TATCGACAAC CCCATCGCAC TTGCGCCGAT

51 GGCGGGCATT GCCGACAAAC CCTTCCGCCG CCTCTGTCGG GCGTTTGGCG

101 CAGGTTGGGC GGTGTGCGAA ATGCTGGCCA GCGATCCGAC GCTCAGGAAT

151 ACCGGAAAAA CCCtgcaccg cagtgaTTTt gccgatgaag gCGGCATCGT

201 TGCCGTGCAG ATTGCCGGCA GCGACCccga acaGATGGCG Gatgcggcgc 251 gttacAACGT CGGACTCGGG GCGCAGGTCA TCGACATcaa TATGGGCTGC 301 cccgccaaGA AAGTGTGCAA CGTCCAAGCC GGTAGCGCgc tGATGCAGGA 351 CGAGccgctg gttgcCgcca tTTtggaggc ggtggtcAAG GCGGCGGgcg 401 TACCCGTTAC cctCAAAACc cgtTtgggtt ggcacgacga cgatcaaaac
```

```
-continued
451 ctgcCcgccg tcgccaaaat cgccgaagat tgcggcattg ccgccCttgc 501 cgttccacgg gcgCGCgcgC ACGCAAATGT ACAAAGGCGA GGCgCGTTAC 551 Gaactcatcg CCGAGACCAA AAGccgTCTG AACATCCCGG cctGggtCAA 601 CGGCGACATC actTCgccgc AAAAAGCCGC CGccgTCCTC AAACAAACCG

651 CCGCCGACGG CATCATGATA GGGCGCGGCG CGCAAGGCAG GCCGTGGTTT

701 TTCCGCGATT TGAAGCATTA TGCCGAACAC GGCGTTTTAC CGCCTGCCTT

751 GAGTTTGGCA GAATGCAGAG CCGCCATTTT GAACCACATC CGCGCCATGC

801 ACGCGTTTTA TGGTGAGACC GTCGGTGTGC GCATCGCACG CAAACACATA

851 GGCTGGTACA TCGGCGAAAT GCCCGACGGC GAACAGGCGC GGCGTGA
```

This corresponds to the amino acid sequence <SEQ ID 2142; ORF 661.ng>:

```
g661.pep
  1 MHIGGYFIDN PIALAPMAGI ADKPFRRLCR AFGAGWAVCE MLASDPTLRN

51 TGKTLHRSDF ADEGGIVAVQ IAGSDPEQMA DAARYNVGLG AQVIDINMGC

101 PAKKVCNVQA GSALMQDEPL VAAILEAVVK AAGVPVTLKT RLGWHDDDQN

151 LPAVAKIAED CGIAALAVPR ARAHANVQRR GALRTHRRDQ KPSEHPGLGQ

201 RRHHFAAKSR RRPQTNRRRR HHDRARRARQ AVVFPRFEAL CRTRRFTACL

251 EFGRMQSRHF EPHPRHARVL WXDRRCAHRT QTHRLVHRRN ARRRTGAA*
```

The following partial DNA sequence was identified in *N. meningitidis* <SEQ ID 2143>:

```
m661.seq
  1 ATGCACATCG GCGGCTATTT TATCGACAAC CCCATCGCAC TTGCGCCGAT

51 GGCGGGCATT ACCGACAAAC CGTTCCGCCG ACTTTGCCGA GATTTTGGCG

101 CAGGTTGGGC GGTGTGCGAA ATGCTGACCA GCGACCCGAC GCTCAGAAAT

151 ACTAGAAAAA CCTTGCACCG CAGCGATTTT GCCGATGAAG GCGGCATTGT

201 TGCCGTGCAG ATTGCCGGAA GCGATCCGCA GCAGATGGCG GATGCCGCGC

251 GTTACAACGT CAGCCTTGGG GCGCAGCTTA TCGACATCAA CATGGGCTGT

301 CCCGCTAAAA AAGTCTGCAA TGTCCAAGCC GGTAGCGCGC TGATGCAGAA

351 CGAGCCGCTG GTTGCCGCCA TTTTGGAAGC CGTCGTCCGT GCGGCAGGCG

401 TACCCGTTAC CCTCAAAACC CGTTTGGGTT GGCACGACGA CCATCAAAAC

451 CTGCCCGTCA TCGCCAAAAT CGCCGAAGAT TGCGGCATCG CCGCCCTTGC

501 CGTCC.ACGG ACGCACGCGT ACGCAAATGT ACAAAGGCGA AGCGCGTTAC

551 GAACTCATCG CCGAAACCAA ATGCCGTCTG AACATCCCGG TCTGGGTCAA

601 CGGCGACATT ACTTCGCCGC AAAAAGCCCA AGCCGTCCTC AAACAAACCG

651 CCGCCGACGG CATTATGATA GGGCGCGGCG CGCAAGGCAG GCCGTGGTTC

701 TTCCGCGATT TGAAACATTA TGCCGAACAC GGTGTTTTGC CGCCTGCCTT

751 GAGTTTGGCA GAATGCGCCG CCGCTATTTT GAACCACATC CGCGCCATAC

801 ACGCGTTTTA CGGCGACACC GCCGGTGTGC GCATCGCACG CAAACACATA

851 GGCTGGTACA TCGACGAAAT GCCCGACGGC GAACAGACAC GTCGTGA
```

This corresponds to the amino acid sequence <SEQ ID 2144; ORF 661>:

```
m661.pep
   1 MHIGGYFIDN PIALAPMAGI TDKPFRRLCR DFGAGWAVCE MLTSDPTLRN

51 TRKTLHRSDF ADEGGIVAVQ IAGSDPQQMA DAARYNVSLG AQLIDINMGC

101 PAKKVCNVQA GSALMQNEPL VAAILEAVVR AAGVPVTLKT RLGWHDDHQN

151 LPVIAKIAED CGIAALAVXR THAYANVQRR SALRTHRRNQ MPSEHPGLGQ

201 RRHYFAAKSP SRPQTNRRRR HYDRARRARQ AVVLPRFETL CRTRCFAACL

251 EFGRMRRRYF EPHPRHTRVL RRHRRCAHRT QTHRLVHRRN ARRRTDTS*
```

Computer analysis of this amino acid sequence gave the following results:
Homology with a Predicted ORF from *N. gonorrhoeae*

```
   m661/g661   88.5% identity in 295 aa overlap
                    10         20         30         40         50         60
     m661.pep  MHIGGYFIDNPIALAPMAGITDKPFRRLCRDFGAGWAVCEMLTSDPTLRNTRKTLHRSDF
               ||||||||||||||||||||||:|||||||| ||||||||||||:|||||||| ||||||
         g661  MHIGGYFIDNPIALAPMAGIADKPFRRLCRAFGAGWAVCEMLASDPTLRNTGKTLHRSDF
                    10         20         30         40         50         60
                    70         80         90        100        110        120
     m661.pep  ADEGGIVAVQIAGSDPQQMADAARYNVSLGAQLIDINMGCPAKKVCNVQAGSALMQNEPL
               |||||||||||||||||:|||||||||:||||:||||||||||||||||||||||:|||
         g661  ADEGGIVAVQIAGSDPEQMADAARYNVGLGAQVIDINMGCPAKKVCNVQAGSALMQDEPL
                    70         80         90        100        110        120
                   130        140        150        160        170        180
     m661.pep  VAAILEAVVRAAGVPVTLKTRLGWHDDHQNLPVIAKIAEDCGIAALAVXRTHAYANVQRR
               |||||||||:||||||||||||||||| |||::||||||||||||||| |::|:|||||
         g661  VAAILEAVVKAAGVPVTLKTRLGWHDDDQNLPAVAKIAEDCGIAALAVPRARAHANVQRR
                   130        140        150        160        170        180
                   190        200        210        220        230        240
     m661.pep  SALRTHRRNQMPSEHPGLGQRRHYFAAKSPSRPQTNRRRRHYDRARRARQAVVLPRFETL
               :|||||||:| |||||||||||:|||||:||||  ||||||:||||||||||:|||:|:|
         g661  GALRTHRRDQKPSEHPGLGQRRHHFAAKSRRRPQTNRRRRHHDRARRARQAVVFPRFEAL
                   190        200        210        220        230        240
                   250        260        270        280        290        299
     m661.pep  CRTRCFAACLEFGRMRRRYFEPHPRHTRVLRRHRRCAHRTQTHRLVHRRNARRRTDTSX
               ||||  |:||||||||:  |:||||||:|||   ||||||||||||||||||||| ||
         g661  CRTRRFTACLEFGRMQSRHGEPHPRHARVLWXDRRCAHRTQTHRLVHRRNARRRTGAAX
                   250        260        270        280        290
```

The following partial DNA sequence was identified in *N. meningitidis* <SEQ ID 2145>:

```
a661.seq
   1 ATGCACATCG GCGGCTATTT TATCGACAAC CCCATCGCAC TTGCGCCGAT

51 GGCGGGCATT ACCGACAAAC CGTTCCGCCG ACTTTGCCGA GATTTTGGCG

101 CAGGTTGGGC GGTGTGCGAA ATGCTGACCA GCGACCCGAC GCTCAGAAAT

151 ACTAGAAAAA CCTTGCACCG CAGCGATTTT GCCGATGAAG GCGGCATTGT

201 TGCCGTGCAG ATTGCCGGAA GCGATCCGCA GCAGATGGCG GATGCCGCGC

251 GTTACAACGT CAGCCTTGGG GCGCAGCTTA TCGACATCAA CATGGGCTGT

301 CCCGCTAAAA AAGTCTGCAA TGTCCAAGCC GGTAGCGCGC TGATGCAGAA

351 CGAGCCGCTG GTTGCCGCCA TTTTGGAGGC GGTGGTCAAA GCGGCGGGCG

401 TACCCGTTAC CCTCAAAACC CGTTTGGGTT GGCACGACGA CCATCAAAAC

451 CTGCCCGTCA TCGCCAAAAT CGCCGAAGAT TGCGGCATTG CCGCCCTTGC

501 CG.TCCACGG ACGCACGCGC ACGCAAATGT ACAAAGGCGA AGCGGCTTAC

551 GACCTGATTG CCGAAACCAA ATGCCGTCTG AACATCCCGG TCTGGGTCAA
```

```
-continued
601 CGGCGACATT ACCTCGCCGC AAAAGCCCA AGCCGTCCTC AAACAAACCG

651 CCGCAGACGG CATTATGATA GGGCGCGGCG CGCAAGGCAG ACCGTGGTTC

701 TTCCGCGATT TGAAACATTA CGCCGAACAC GGTGTTTTAC CGCCTGCCTT

751 GAGTTTGGCA GAATGTACCG CCACTATTTT GAACCACATC CGAGCCATGC

801 ACGCGTTTTA CGGCGACACC GCCGGTGTGC GCATCGCACG CAAACACATA

851 GGCTGGTACA TCGACGAAAT GCCCGACGGC GAACAGACAC GTCGTGA
```

This corresponds to the amino acid sequence <SEQ ID 2146; ORF 661.a>:

```
a661.pep

1 MHIGGYFIDN PIALAPMAGI TDKPFRRLCR DFGAGWAVCE MLTSDPTLRN

51 TRKTLHRSDF ADEGGIVAVQ IAGSDPQQMA DAARYNVSLG AQLIDINMGC

101 PAKKVCNVQA GSALMQNEPL VAAILEAVVK AAGVPVTLKT RLGWHDDHQN

151 LPVIAKIAED CGIAALAXPR THAHANVQRR SGLRPDCRNQ MPSEHPGLGQ

201 RRHYLAAKSP SRPQTNRRRR HYDRARRARQ TVVLPRFETL RRTRCFTACL

251 EFGRMYRHYF EPHPSHARVL RRHRRCAHRT QTHRLVHRRN ARRRTDTS* m661/a661  94.6% identity in 298 aa overlap
                   10         20         30         40         50         60
m661.pep   MHIGGYFIDNPIALAPMAGITDKPFRRLCRDFGAGWAVCEMLTSDPTLRNTRKTLHRSDF
           ||||||||||||||||||||||||||||| ||||||||||||||||||||||||||||||
a661       MHIGGYFIDNPIALAPMAGITDKPFRRLCRAFGAGWAVCEMLTSDPTLRNTRKTLHRSDF
                   10         20         30         40         50         60

70         80         90        100        110        120
m661.pep   ADEGGIVAVQIAGSDPQQMADAARYNVSLGAQLIDINMGCPAKKVCNVQAGSALMQNEPL
           ||||||||||||||||||||||||||||||||||||||||||||||||||||||||||||
a661       ADEGGIVAVQIAGSDPQQMADAARYNVSLGAQLIDINMGCPAKKVCNVQAGSALMQNEPL
                   70         80         90        100        110        120

130        140        150        160        170        180
m661.pep   VAAILEAVVRAAGVPVTLKTRLGWHDDHQNLPVIAKIAEDCGIAALAVXRTHAYANVQRR
           |||||||||:|||||||||||||||||||||||||||||||||||| ||||:|||||||
a661       VAAILEAVVKAAGVPVTLKTRLGWHDDHQNLPVIAKIAEDCGIAALAXPRTHAHANVQRR
                  130        140        150        160        170        180

190        200        210        220        230        240
m661.pep   SALRTHRRNQMPSEHPGLGQRRHYFAAKSPSRPQTNRRRRHYDRARRARQAVVLPRFETL
           |:||   ||||||||||||||||||:||||||||||||||||||||||||:||||||||
a661       SGLRPDCRNQMPSEHPGLGQRRHYLAAKSPSRPQTNRRRRHYDRARRARQTVVLPRFETL
                  190        200        210        220        230        240

250        260        270        280        290        299
m661.pep   CRTRCFAACLEFGRMRRRYFEPHPRHTRVLRRHRRCAHRTQTHRLVHRRNARRRTDTSX
           |||||:|||||||||:|||||| |:|||||||||||||||||||||||||||||||||
a661       RRTRCFTACLEFGRMYRHYFEPHPSHARVLRRHRRCAHRTQTHRLVHRRNARRRTDTSX
                  250        260        270        280        290
```

The following partial DNA sequence was identified in *N. gonorrhoeae* <SEQ ID 2147>:

```
g663.seq
    1 ATGTGTACCG AGATGAAATT TATATTTTTT GTACTGTATG TTTTGCAGTT

51 TCTGCCGTTT GCGCTGCTGC ACAAGATTGC CGGCCTGATC GGTTCGCTTG

101 CCTACCTTCT GGTCAAACCG CGCCGCCGTA TCGGCGAAAT CAATTTGGCA

151 AAATGTTTTC CCGAATGGGA CGAAGAAAAG CGTAAAACCG TGTTGAAACA

201 GCATTTCAAA CACATGGCAA AACTGATGCT CGAATACGGC TTATATTGGT

251 ACGCGtctGC CAAATGCCTG AAATCGCTGG TGCGCTACCG CAATAAGCAT

301 TATTTGGACG ACGCGCTGGC GGCGGGGGAA AAAGTCATCA TCCTGTACCC

351 GCACTTTACC GCGTTCGAGA TGGCGGTGTA CGCGCTTAAT CAGGATGTCC
```

-continued

```
401 CGCTGATCAG TATGTATTCC CACCAAAAAA ACAAGATATT GGACGAACAG
451 ATTTTGAAAg gccgcaACCG CTATCACAAC GTCTTCCTTA TCGGGCGCAC
501 CGAagggctg cgCGCCCtcg TCAAACAGTT CCGCAAAAGC AGTGCGCCGT
551 TCCTGTATCT GCCCGATCAG GATTTCGGAC GCAACAATTG GGTTTTTGTG
601 GATTTTTTCG GCATtcagaC GGCAACGATT ACCGGCTTGA GCCGCATTGC
651 CGCGCTTGCA AATGCAAAAG TGATACCCGC CATTCCCGTC CGCGAGGCGG
701 ACAATACGGT TACATTGCAA TTCTATCCCG CTTGGAAATC CTTTCCGAGT
751 GAAGACGCGC AAGCCGACGC GCAACGTATG AACCGCTTTA TCGAAGAACG
801 CGTGCGCGAA CACCCGGAAC AATATTTCTG GCTGCACAAG CGTTTCAAAA
851 CCCGTCCGGA AGGCAGCCCC GATTTTTACT GA
```

This corresponds to the amino acid sequence <SEQ ID 2148; ORF 663.ng>:

```
g663.pep
  1 MCTEMKFIFF VLYVLQFLPF ALLHKIAGLI GSLAYLLVKP RRRIGEINLA
 51 KCFPEWDEEK RKTVLKQHFK HMAKLMLEYG LYWYASAKCL KSLVRYRNKH
101 YLDDALAAGE KVIILYPHFT AFEMAVYALN QDVPLISMYS HQKNKILDEQ
151 ILKGRNRYHN VFLIGRTEGL RALVKQFRKS SAPFLYLPDQ DFGRNNSVFV
201 DFFGIQTATI TGLSRIAALA NAKVIPAIPV READNTVTLQ FYPAWKSFPS
251 EDAQADAQRM NRFIEERVRE HPEQYFWLHK RFKTRPEGSP DFY*
```

The following partial DNA sequence was identified in N. meningitidis <SEQ ID 2149>:

```
m663.seq
  1 ATGTGTATCG AGATGAAATT TATATTTTTT GTACTGTATG TTTTGCAGTT
 51 TCTGCCGTTT GCGCTGCTGC ACAAGATTGC CGACCTGACG GGTTTGCTTG
101 CCTACCTTCT GGTCAAACCG CGCCGCCGTA TCGGCGAAAT CAATTTGGCA
151 AAATGTTTTT CCGAATGGAG TGAGGAAAAG CGTAAAACCG TGTTGAAACA
201 GCATTTCAAA CACATGGCGA AACTGATGTT GGAATACGGT TTATATTGGT
251 ACGCGCCTGC CGGACGTTTG AAATCGCTGG TGCGCTACCG CAATAAGCAT
301 TATTTGGACG ACGCGCTGGC GGCGGGGGAA AAAGTCATCA TCCTGTATCC
351 GCACTTCACC GCGTTCGAGA TGGCGGTGTA CGCGCTTAAT CAGGATATCC
401 CGCTGATCAG TATGTATTCC CATCAAAAAA ACAAGATATT GGACGAACAG
451 ATTTTGAAAG GCCGCAACCG CTATCACAAC GTCTTCCTTA TCGGGCGCAC
501 CGAAGGGCTG CGCGCCCTCG TCAAACAGTT CCGCAAAAGC AGCGCGCCGT
551 TTCTGTATCT GCCCGATCAG GATTTCGGAC GCAACGATTG GGTTTTTGTG
601 GATTTTTTCG GTATTCAGAC GGCAACGATT ACCGGATTGA GCCGCATTGC
651 CGCGCTTGCA AATGCAAAAG TGATACCCGC CATTCCCGTC CGCGAGGCAG
701 ACAATACGGT TACATTGCAT TTCTACCCTG CTTGGAAATC CTTTCCGGGT
751 GAAGACGCGA AAGCCGACGC GCAGCGCATG AACCGTTTTA TCGAAGACAG
801 GGTGCGCGAA CATCCGGAAC AATATTTTTG GCTGCACAAG CGTTTTAAAA
851 CCCGTCCGGA AGGCAGCCCC GATTTTTACT GA
```

This corresponds to the amino acid sequence <SEQ ID 2150; ORF 663>:

```
m663.pep
  1 MCIEMKFIFF VLYVLQFLPF ALLHKIADLT GLLAYLLVKP RRRIGEINLA

51 KCFSEWSEEK RKTVLKQHFK HMAKLMLEYG LYWYAPAGRL KSLVRYRNKH

101 YLDDALAAGE KVIILYPHFT AFEMAVYALN QDIPLISMYS HQKNKILDEQ

151 ILKGRNRYHN VFLIGRTEGL RALVKQFRKS SAPFLYLPDQ DFGRNDSVFV

201 DFFGIQTATI TGLSRIAALA NAKVIPAIPV READNTVTLH FYPAWKSFPG

251 EDAKADAQRM NRFIEDRVRE HPEQYFWLHK RFKTRPEGSP DFY*
```

Computer analysis of this amino acid sequence gave the following results:
Homology with a Predicted ORF from *N. gonorrhoeae*

```
    m663/g663 94.9% identity in 293 aa overlap 10         20         30         40         50         60
    m663.pep MCIEMKFIFFVLYVLQFLPFALLHKIADLTGLLAYLLVKPRRRIGEINLAKCFSEWSEEK
             ||  ||||||||||||||||||||||||| | | |||||||||||||||||||| |:|||
    g663     MCTEMKFIFFVLYVLQFLPFALLHKIAGLIGSLAYLLVKPRRRIGEINLAKCFPEWDEEK
                10         20         30         40         50         60

70         80         90        100        110        120
    m663.pep RKTVLKQHFKHMAKLMLEYGLYWYAPAGRLKSLVRYRNKHYLDDALAAGEKVIILYPHFT
             |||||||||||||||||||||||||| |  |||||||||||||||||||||||||||||
    g663     RKTVLKQHFKHMAKLMLEYGLYWYASAKCLKSLVRYRNKHYLDDALAAGEKVIILYPHFT
                70         80         90        100        110        120

130        140        150        160        170        180
    m663.pep AFEMAVYALNQDIPLISMYSHQKNKILDEQILKGRNRYHNVFLIGRTEGLRALVKQFRKS
             ||||||||||||:|||||||||||||||||||||||||||||||||||||||||||||||
    g663     AFEMAVYALNQDVPLISMYSHQKNKILDEQILKGRNRYHNVFLIGRTEGLRALVKQFRKS
               130        140        150        160        170        180

190        200        210        220        230        240
    m663.pep SAPFLYLPDQDFGRNDSVFVDFFGIQTATITGLSRIAALANAKVIPAIPVREADNTVTLH
             ||||||||||||||||:|||||||||||||||||||||||||||||||||||||||||:
    g663     SAPFLYLPDQDFGRNNSVFVDFFGIQTATITGLSRIAALANAKVIPAIPVREADNTVTLQ
               190        200        210        220        230        240

250        260        270        280        290
    m663.pep FYPAWKSFPGEDAKADAQRMNRFIEDRVREHPEQYFWLHKRFKTRPEGSPDFYX
             ||||||||||:|||:||||||||||:|||||||||||||||||||||||||||
    g663     FYPAWKSFPSEDAQADAQRMNRFIEERVREHPEQYFWLHKRFKTRPEGSPDFYX
               250        260        270        280        290
```

The following partial DNA sequence was identified in *N. meningitidis* <SEQ ID 2151>:

```
a663.seq
  1 ATGTGTATCG AGATGAAATT TATATTTTTT GTACTGTATG TTTTGCAGTT

51 TCTGCCGTTT GCGCTGCTGC ACAAACTTGC TGATCTGACA GGCTTGCTCG

101 CCTACCTTTT GGTCAAACCC CGCCGCCGTA TCGGCGAAAT CAATTTGGCA

151 AAATGCTTTC CCGAGTGGGA CGGAAAAAAG CGTAAAACCG TGTTGAAACA

201 GCATTTCAAA CATATGGCGA AACTGATGTT GGAATACGGT TTATATTGGT

251 ACGCGCCCGC CGGGCGTTTG AAATCACTGG TGCGCTACCG CAACAAACAT

301 TATTTGGACG ACGCTCTGGC GGCAGGGGAA AAAGTCATCA TCCTGTATCC

351 GCACTTCACC GCGTTCGAGA TGGCGGTGTA CGCGCTCAAT CAGGATGTTC

401 CGCTGATCAG TATGTATTCC CACCAAAAAA ACAAGATATT GGACGAACAG

451 ATTTTGAAAG CCGCAACCG CTATCACAAC GTTTTCCTTA TCGGGCGCAC

501 CGAAGGGCTG CGCGCCCTCG TCAAACAGTT CCGCAAAAGC AGCGCGCCGT

551 TTCTGTATCT GCCCGATCAG GATTTCGGAC GCAACGATTC GGTTTTTGTC
```

-continued
```
601 GATTTCTTCG GTATTCGGAC GGCAACGATT ACCGGCTTGA GCCGCATTGC

651 CGCGCTTGCA AATGCAAAAG TGATACCCGC CATCCCTGTC CGCGAGGCGG

701 ACAATACGGT TACATTGCAT TTCTACCCTG CTTGGGAATC CTTTCCGAGT

751 GAAGATGCGC AGGCCGACGC GCAGCGCATG AACCGTTTTA TCGAGGAACG

801 CGTGCGCGAA CATCCCGAGC AGTATTTTTG GCTGCACAAG CGTTTCAAAA

851 CCCGTCCGGA AGGCAGCCCC GATTTTTACT GA
```

This corresponds to the amino acid sequence <SEQ ID 2152; ORF 663.a>:

```
a663.pep

1 MCIEMKFIFF VLYVLQFLPF ALLHKLADLT GLLAYLLVKP RRRIGEINLA

51 KCFPEWDGKK RKTVLKQHFK HMAKLMLEYG LYWYAPAGRL KSLVRYRNKH

101 YLDDALAAGE KVIILYPHFT AFEMAVYALN QDVPLISMYS HQKNKILDEQ

151 ILKGRNRYHN VFLIGRTEGL RALVKQFRKS SAPFLYLPDQ DFGRNDSVFV

201 DFFGIRTATI TGLSRIAALA NAKVIPAIPV READNTVTLH FYPAWESFPS

251 EDAQADAQRM NRFIEERVRE HPEQYFWLHK RFKTRPEGSP DFY* m663/a663 96.2% identity in 293 aa overlap 10         20         30         40         50         60
m663.pep    MCIEMKFIFFVLYVLQFLPFALLHKIADLTGLLAYLLVKPRRRIGEINLAKCFSEWSEEK
            ||||||||||||||||||||||||:||||||||||||||||||||||||||||  : :|
a663        MCIEMKFIFFVLYVLQFLPFALLHKLADLTGLLAYLLVKPRRRIGEINLAKCFPEWDGKK
                    10         20         30         40         50         60

70         80         90        100        110        120
m663.pep    RKTVLKQHFKHMAKLMLEYGLYWYAPAGRLKSLVRYRNKHYLDDALAAGEKVIILYPHFT
            ||||||||||||||||||||||||||||||||||||||||||||||||||||||||||||
a663        RKTVLKQHFKHMAKLMLEYGLYWYAPAGRLKSLVRYRNKHYLDDALAAGEKVIILYPHFT
                    70         80         90        100        110        120

130        140        150        160        170        180
m663.pep    AFEMAVYALNQDIPLISMYSHQKNKILDEQILKGRNRYHNVFLIGRTEGLRALVKQFRKS
            ||||||||||||:|||||||||||||||||||||||||||||||||||||||||||||||
a663        AFEMAVYALNQDVPLISMYSHQKNKILDEQILKGRNRYHNVFLIGRTEGLRALVKQFRKS
                   130        140        150        160        170        180

190        200        210        220        230        240
m663.pep    SAPFLYLPDQDFGRNDSVFVDFFGIQTATITGLSRIAALANAKVIPAIPVREADNTVTLH
            ||||||||||||||||||||||||||:|||||||||||||||||||||||||||||||||
a663        SAPFLYLPDQDFGRNDSVFVDFFGIRTATITGLSRIAALANAKVIPAIPVREADNTVTLH
                   190        200        210        220        230        240

250        260        270        280        290
m663.pep    FYPAWKSFPGEDAKADAQRMNRFIEDRVREHPEQYFWLHKRFKTRPEGSPDFYX
            |||||:|||:|||:|||||||||||:||||||||||||||||||||||||||||
a663        FYPAWESFPSEDAQADAQRMNRFIEERVREHPEQYFWLHKRFKTRPEGSPDFYX
                   250        260        270        280        290
```

The following partial DNA sequence was identified in *N. gonorrhoeae* <SEQ ID 2153>:

```
g664.seq
    1 ATGATACATC CGCACCACTT CCGCGCCTTT TTCATAAACG GTCATGGTGT

51 AGAAATTGTT CATCTCCTCA TAGCTGAcgg gGCGCACCGG ATGGGCGGTC

101 GGGCCTGCGT CTTCGGGGAA CTGGTTCTGG CGCAGCAGGC GGATGTTCTC

151 GATGCGGCGC ACGGCGCGGC CGGCGCGGTC GCCGGAAAAC TCTTGGTCGC

201 GGAACACGGT CAGCCCTTCC TTCAGCGAAA GCTGGAACCA GTCGCGGCAG

251 GTTACGCGGT TGCCCGTCCA GTTGTGGAAA TATTCGTGTC CGACCACGGA

301 TTCAATGCCT TCGAAATCGG TATCGGTGGC GGTGCGGCTG TCGGCGAGGA

351 CGAACTTGGT GTTAAAAATG TTCAAACCCT TGTTTTCCAT CGCGCCCATA
```

-continued

```
401 TTGAAATCGC CTACGGCGAC GACCATGAaa atatccaagt cataTTCcaa 451 cCcgaagcgc gtttcgtcCc acttcatcgC gtTTTTTCAA cgaTTCCACG

501 GCAAAGCCGA CCTTGGGTTT GTCCGCTTCG GTGGTGTAAA ACTCGATTTT

551 GA
```

This corresponds to the amino acid sequence <SEQ ID 2154; ORF 664.ng>:

```
g664.pep
  1 MIHPHHFRAF FINGHGVEIV HLLIADGAHR MGGRACVFGE LVLAQQADVL

51 DAAHGAAGAV AGKLLVAEHG QPFLQRKLEP VAAGYAVARP VVEIFVSDHG

101 FNAFEIGIGG GAAVGEDELG VKNVQTLVFH RAHIEIAYGD DHENIQVIFQ

151 PEARFVPLHR VFSTIPRQSR PWVCPLRWCK TRF*
```

The following partial DNA sequence was identified in N. meningitidis <SEQ ID 2155>:

```
m664.seq
  1 GTGATACATC CGCACTACTT CCGCGCCTTT TTCATAAACG GTCATGGTGT

51 AGAAATTGTT CATCTCCTCA TAGCTGGCGG GGCGCACCGG ATGGGCGGTC

101 GGGCCTGCGT CTTCGGGGAA CTGGTGCTGG CGCAGCAGGC GGATGTTTTC

151 GATGCGGCGC ACGGCGCGGC TGGCGCGGTC GCCGGAAAAT TCTTGGTCGC

201 GGAACACGGT CAGCCCTTCC TTCAGCGAAA GCTGGAACCA GTCGCGGCAG

251 GTTACGCGGT TGCCCGTCCA GTTGTGGAAA TACTCGTGTC CGACCACGGA

301 TTCGATGCCT TCGAAATCGG TATCGGTGGC GGTGCGGCTG TCGGCAAGGA

351 CGAACTTGGT GTTAAAGATG TTCAAACCCT TGTTTTCCAT CGCGCCCATA

401 TTGAAATCGC CCACGGCGAC GACCATGAAA ATATCCAAGT CGTATTCCAA

451 ACCGAAGCGC GTTTCGTCCC ATTTCATCGC GTTTTT.CAA CGATTCCACG

501 GCAAAGCCGA CCTTGGGCTT GTCCGCTTCG GTGGTGTAAA ACTCGATTTT

551 GA
```

This corresponds to the amino acid sequence <SEQ ID 2156; ORF 664>:

```
m664.pep
  1 VIHPHYFRAF FINGHGVEIV HLLIAGGAHR MGGRACVFGE LVLAQQADVF

51 DAAHGAAGAV AGKFLVAEHG QPFLQRKLEP VAAGYAVARP VVEILVSDHG

101 FDAFEIGIGG GAAVGKDELG VKDVQTLVFH RAHIEIAHGD DHENIQVVFQ

151 TEARFVPFHR VFXTIPRQSR PWACPLRWCK TRF*
```

Computer analysis of this amino acid sequence gave the following results:
Homology with a Predicted ORF from N. gonorrhoeae

```
    m664/g664 91.8% identity in 183 aa overlap 10         20         30         40         50         60
    m664.pep VIHPHYFRAFFINGHGVEIVHLLIAGGAHRMGGRACVFGELVLAQQADVFDAAHGAAGAV
             :||||:||||||||||||||||||| |||||||||||||||||||||||||:|||||||||
    g664     MIHPHHFRAFFINGHGVEIVHLLIADGAHRMGGRACVFGELVLAQQADVLDAAHGAAGAV
                10         20         30         40         50         60
```

-continued

```
                 70         80         90        100        110        120
m664.pep AGKFLVAEHGQPFLQRKLEPVAAGYAVARPVVEILVSDHGFDAFEIGIGGGAAVGKDELG
         |||:||||||||||||||||||||||||||||:||||||:||||||||||||:||||
g664     AGKLLVAEHGQPFLQRKLEPVAAGYAVARPVVEIFVSDHGFNAFEIGIGGGAAVGEDELG
                 70         80         90        100        110        120

130        140        150        160        170        180
m664.pep VKDVQTLVFHRAHIEIAHGDDHENIQVVFQTEARFVPFHRVFXTIPRQSRPWACPLRWCK
         ||:|||||||||||:|||||||||:|| ||||||:|||| |||||||||:|||||||
g664     VKNVQTLVFHRAHIEIAYGDDHENIQVIFQPEARFVPLHRVFSRIPRQSRPWVCPLRWCK
                130        140        150        160        170        180 m664.pep TRFX
         ||||
g664     TRFX
```

The following partial DNA sequence was identified in *N. meningitidis* <SEQ ID 2157>:

```
a664.seq
   1 GTGATACATC CGCACCACTT CCGCGCCTTT TTCATAAACG GTCATGGTGT

51 AGAAATTGTT CATCTCCTCA TATCGGGCGG GGCGCACCGG ATGTGCGGTC

101 GGACCTGCGT CTTCGGGGAA CTGGTGCTGG CGCAGCAGGC GGATGTTTTC

151 GATACGGCGC ACGGCGCGGC TGGCGCGGTC GCCGGAAAAT TCTTGGTCGC

201 GGAACACGGT CAACCCTTCC TTCAGCGAAA GCTGGAACCA GTCGCGGCAG

251 GTCACGCGGT TGCCCGTCCA GTTGTGGAAA TATTCGTGTC CGACCACGGA

301 TTCGATGCCT TCAAAATCGG TATCGGTGGC GGTACGGCTG TCGGCAAGGA

351 CGAACTTGGT GTTAAAGATG TTCAAACCCT TGTTTTCCAT CGCACCCATA

401 TTGAAATCGC CCACGGCGAC GACCATGAAA ATATCCAAGT CGTATTCCAA

451 ACCGAAGCGC GTTTCGTCCC ACTTCATTGC GTTTTT.CAG CGATTCCACG

501 GCAAAGCCGA CCTTGGGCTT GTCCGCTTCG GTGGTGTAAA ACTCGATTTT

551 GA
```

This corresponds to the amino acid sequence <SEQ ID 2158; ORF 664.a>:

```
a664.pep

1 VIHPHHFRAF FINGHGVEIV HLLISGGAHR MCGRTCVFGE LVLAQQADVF

51 DTAHGAAGAV AGKFLVAEHG QPFLQRKLEP VAAGHAVARP VVEIFVSDHG

101 FDAFKIGIGG GTAVGKDELG VKDVQTLVFH RTHIEIAHGD DHENIQVVFQ

151 TEARFVPLHC VFXAIPRQSR PWACPLRWCK TRF*
``` m664/a664 92.9% identity in 183 aa overlap

```
                 10         20         30         40         50         60
m664.pep VIHPHYFRAFFINGHGVEIVHLLIAGGAHRMGGRACVFGELVLAQQADVFDAAHGAAGAV
         |||||:||||||||||||||||||:||||||  ||:||||||||||||||||:||||||
a664     VIHPHHFRAFFINGHGVEIVHLLISGGAHRMCGRTCVFGELVLAQQADVFDTAHGAAGAV
                 10         20         30         40         50         60

70         80         90        100        110        120
m664.pep AGKFLVAEHGQPFLQRKLEPVAAGYAVARPVVEILVSDHGFDAFEIGIGGGAAVGKDELG
         |||||||||||||||||||||||:||||||||||:|||||||||:|||||:||||||||
a664     AGKFLVAEHGQPFLQRKLEPVAAGHAVARPVVEIFVSDHGFDAFKIGIGGGTAVGKDELG
                 70         80         90        100        110        120

130        140        150        160        170        180
m664.pep VKDVQTLVFHRAHIEIAHGDDHENIQVVFQTEARFVPFHRVFXTIPRQSRPWACPLRWCK
         ||||||||||:||||||||||||||||||||||||||:|  |||:|||||||||||||||
a664     VKDVQTLVFHRTHIEIAHGDDHENIQVVFQTEARFVPLHCVFXAIPRQSRPWACPLRWCK
                130        140        150        160        170        180
```

```
m664.pep  TRFX
          ||||
a664      TRFX
```

The following partial DNA sequence was identified in *N. gonorrhoeae* <SEQ ID 2159>:

```
g665.seq
    1 atgaagtgGg acgaaacgcg cttcgGgttg GAAtatgact tggatatttT
   51 CATGGTCGTC GCCGTAGGCG ATTTCAATAT GGGCGCGATG GAAAACAAGG
  101 GTTTGAACAT TTTTAACACC AAGTTCGTCC TCGCCGACAG CCGCACCGCC
  151 ACCGATACCG ATTTCGAAGG CATTGAATCC GTGGTCGGAC ACGAATATTT
  201 CCACAACTGG ACGGGCAACC GCGTAACCTG CCGCGACTGG TTCCAGCTTT
  251 CGCTGAAGGA AGGGCTGACC GTGTTCCGCG ACCAAGAGTT TTCCGGCGAC
  301 CGCGCCGGCC GCGCCGTGCG CCGCATCGAG AACATCCGCC TGCTGCGCCA
  351 GAACCAGTTC CCCGAAGACG CAGGCCCGAC CGCCCATCCG GTGCGCcccg
  401 TCAGCTATGA GGAGATGAAC AATTTCTACA CCATGACCGT TTATGAAAAA
  451 GGCGCGGAAG TGGTGCGGAT GTATCATACC CTGCTCGGCG AAGAGGGCTT
  501 CCAAAAAGGC ATGAAGCTAT ATTTCcaacg CCACGACGGA CAGGCAGTGA
  551 CCTGCGACGA TTTCCGCGCG GCGatggcgg ATGCGAACGG CATCAATCTC
  601 GACCAGTTCG CCTTGTGGTA CAGCCAGGCG GGCACGCCCG TTTTGGAAGC
  651 CGAAGGCCGT CTGAAAAACA ATGTTTTCGA GTTAACCATT AAACAAACCG
  701 TGCCGCCCAC GCCCGATATG GCGGACAAAC AGCCGATGAT GATTCCCGTC
  751 AAAGTCGGGC TTCTGAACCG CAACGGCGAA GCGGTGGCAT TCGATTATCA
  801 GGGCAAACGC GCAACCGAAG CCGTGTTGCT GATGACCGAA GCCGAACagg
  851 CCTTCCCGCT CGAAGGTGTA ACCGAAGCCG TCGTTCCCTC GCTGCTGCGC
  901 GGGTTCAGCG CGCCAGTGTA TCTGAACTAT CCGTACAGCG ACGACGACCT
  951 GCTGCTCCTG CTCGCCCACG ACAGCGACGC TTTCACGTGC TGGGAAGCCG
 1001 CCCAAACGCT CTACCGTCGC GCCGTCGCCG CCAACCTTGC CGCGCTTTCA
 1051 GACGGCATCG GGTTGCCGAA ACACGAAAAA CTGCTTGCCG CCGTCGAAAA
 1101 AGTCATTTCA GACGACCTCT TGGACAACGC CTTCAAAGCC CTGCTTTTGG
 1151 GCGTGCCGTC CGAAGCCGAa ctGTGGGACG GCACGGAAAA CATcgaCCCG
 1201 CTGCGCTACC ATCAGGCGCG CGAAGCCTTG TTGGATACGC TTGCCGtcCG
 1251 CttcctgcCG AAATGGCACG AATTGGaccg tcaggcggcg aagCAggaaa
 1301 accaaagtTA CGAATACAGC CCCGAAACCG CCGACTGGCG CACGCTGCGC
 1351 AACGTCTGCC GCGCCTtcgt cctGCGCGCC GACCCCGCGC acatcgAAAC
 1401 TGTTGCCGAA Aaatacggcg AAATGGCGCA AAACATGACC CACGAATGGG
 1451 GCATCCTGTC CGCCGTCAAC GGCAACGAAA GCGATACGCG CAACTGCCTG
 1501 CTGGCGCAGT TTGCCGAcaa gTttTcAGAC GACGCGCTGG TGATGGACAA
 1551 ATATTTCGCC CTTATCGGCT CAAGccgccg cagCGACACC CTGCAACAGG
 1601 TTCAAACCGC CTTGCAGCAT CCGAAATTCA GTCTCGAAAA CCCCAACAAA
 1651 GCCCGTTCGC TCATCGGCAG CTTCAGCCGC AACGTCCCGC ATTTTCACGC
 1701 ACAAGACGGC AGCGGCTACC GCTTCATCGC CGACAAAGTC ATCGAAATCG
```

-continued

```
1751  ACCGCTTCAA cCCGCAggtc gccGCCCGCC TGGTGCAGGC GTTCAACCTC

1801  TGCAACAAGC TCGAGCCGCA CCGCAAAAAC TTgGTGAAAC AAGAATTGCA

1851  GTGCATTCGG GCGCAGGAAG GATTGTCGAA AGacGTGGGC GAaatcgtCG

1901  GCAAGATTTT GGGTTGA
```

This corresponds to the amino acid sequence <SEQ ID 2160; ORF 665.ng>:

```
g665.pep
  1  MKWDETRFGL EYDLDIFMVV AVGDFNMGAM ENKGLNIFNT KFVLADSRTA

51  TDTDFEGIES VVGHEYFHNW TGNRVTCRDW FQLSLKEGLT VFRDQEFSGD

101  RAGRAVRRIE NIRLLRQNQF PEDAGPTAHP VRPVSYEEMN NFYTMTVYEK

151  GAEVVRMYHT LLGEEGFQKG MKLYFQRHDG QAVTCDDFRA AMADANGINL

201  DQFALWYSQA GTPVLEAEGR LKNNVFELTI KQTVPPTPDM ADKQPMMIPV

251  KVGLLNRNGE AVAFDYQGKR ATEAVLLMTE AEQAFPLEGV TEAVVPSLLR

301  GFSAPVYLNY PYSDDDLLLL LAHDSDAFTC WEAAQTLYRR AVAANLAALS

351  DGIGLPKHEK LLAAVEKVIS DDLLDNAFKA LLLGVPSEAE LWDGTENIDP

401  LRYHQAREAL LDTLAVRFLP KWHELDRQAA KQENQSYEYS PETADWRTLR

451  NVCRAFVLRA DPAHIETVAE KYGEMAQNMT HEWGILSAVN GNESDTRNCL

501  LAQFADKFSD DALVMDKYFA LIGSSRRSDT LQQVQTALQH PKFSLENPNK

551  ARSLIGSFSR NVPHFHAQDG SGYRFIADKV IEIDRFNPQV AARLVQAFNL

601  CNKLEPHRKN LVKQELQCIR AQEGLSKDVG EIVGKILG*
```

The following partial DNA sequence was identified in *N. meningitidis* <SEQ ID 2161>:

```
m665.seq
  1  ATGAAATGGG ACGAAACGCG CTTCGGTTTG GAATACGACT TGGATATTTT

51  CATGGTCGTC GCCGTGGGCG ATTTCAATAT GGGCGCGATG GAAAACAAGG

101  GTTTGAACAT CTTTAACACC AAGTTCGTCC TTGCCGACAG CCGCACCGCC

151  ACCGATACCG ATTTCGAAGG CATCGAATCC GTGGTCGGAC ACGAGTATTT

201  CCACAACTGG ACGGGCAACC GCGTAACCTG CCGCGACTGG TTCCAGCTTT

251  CGCTGAAGGA AGGGCTGACC GTGTTCCGCG ACCAAGAATT TTCCGGCGAC

301  CGCGCCAGCC GCGCCGTGCG CCGCATCGAA AACATCCGCC TGCTGCGCCA

351  GCACCAGTTC CCCGAAGACG CAGGCCCGAC CGCCCATCCG GTGCGCCCCG

401  CCAGCTATGA GGAGATGAAC AATTTCTACA CCATGACCGT TTATGAAAAA

451  GGCGCGGAAG TAGTGCGGAT GTATCACACC CTGCTCGGCG AAGAGGGCTT

501  CCAGAAAGGC ATGAAGCTCT ATTTCCAACG CCACGACGGA CAGGCCGTTA

551  CCTGCGACGA TTTCCGCGCG GCGATGGCGG ACGCGAACGG CATCAATCTC

601  GACCAGTTCG CCTTGTGGTA CAGCCAGGCG GGCACGCCCG TTTTGGAAGC

651  GGAAGGTCGT CTGAAAAACA ATATTTTCGA GTTGACCGTC AAACAAACCG

701  TGCCGCCCAC GCCCGATATG ACGGATAAAC AGCCGATGAT GATTCCCGTC

751  AAGGTCGGGC TGCTGAACCG CAACGGCGAA GCGGTGGCAT TCGACTATCA

801  GGGCAAACGC GCGACCGAAG CCGTGTTGCT GCTGACCGAA GCCGAACAGA
```

-continued

```
 851 CCTTCCTGCT CGAAGGCGTA ACCGAAGCCG TCGTTCCCTC GCTGCTGCGC

901 GGGTTCAGCG CGCCGGTGCA TCTGAACTAT CCGTACAGCG ACGACGACCT

951 GCTGCTCCTG CTCGCCCATG ACAGCGACGC CTTCACGCGC TGGGAAGCCG

1001 CCCAAACGCT CTACCGCCGC GCCGTCGCCG CCAACCTTGC CACGCTTTCA

1051 GACGGCGTTG AGCTGCCGAA ACACGAAAAA CTGCTTGCCG CCGTCGAAAA

1101 AGTCATTTCA GACGACCTCT TAGACAACGC CTTCAAAGCC CTGCTTTTGG

1151 GCGTGCCATC CGAAGCCGAG CTGTGGGACG GCGCAGAAAA CATCGACCCG

1201 CTGCGCTACC ATCAGGCGCG CGAAGCCTTG TTGGATACGC TTGCCGTCCA

1251 CTTCCTGCCG AAATGGCACG AATTGAACCG TCAGGCGGCG AAGCAGGAAA

1301 ACCAAAGCTA CGAATACAGC CCCGAAGCCG CCGGCTGGCG CACGCTGCGC

1351 AACGTCTGCC GCGCCTTTGT CCTGCGCGCC GACCCCGCGC ACATCGAAAC

1401 CGTTGCCGAA AAATACGGCG AAATGGCGCA AAACATGACC CACGAATGGG

1451 GCATCCTGTC CGCCGTCAAC GGCAACGAAA GCGATACGCG CAACCGCCTG

1501 CTGGCGCAGT TTGCCGACAA GTTTTCAGAC GACGCGCTGG TGATGGACAA

1551 ATATTTTGCC CTCGTCGGCT CAAGCCGCCG CAGCGACACC CTGCAACAGG

1601 TTCGAACCGC CTTGCAGCAT CCGAAATTCA GCCTCGAAAA CCCCAACAAA

1651 GCCCGTTCGC TCATCGGCAG CTTCAGCCGC AACGTCCCGC ATTTCCACGC

1701 AGAAGACGGC AGCGGCTACC GCTTCATCGC CGACAAAGTC ATCGAAATCG

1751 ACCGCTTCAA CCCGCAGGTC GCCGCCCGCT TAGTGCAGGC GTTCAACCTC

1801 TGCAACAAGC TCGAGCCGCA CCGCAAAAAC TTGGTGAAAC AAGCATTGCA

1851 GCGCATTCGG GCGCAGGAAG GATTGTCGAA AGACGTGGGC GAAATCGTCG

1901 GCAAAATTTT GGATTGA
```

This corresponds to the amino acid sequence <SEQ ID 2162; ORF 665>:

```
m665.pep
  1 MKWDETRFGL EYDLDIFMVV AVGDFNMGAM ENKGLNIFNT KFVLADSRTA

51 TDTDFEGIES VVGHEYFHNW TGNRVTCRDW FQLSLKEGLT VFRDQEFSGD

101 RASRAVRRIE NIRLLRQHQF PEDAGPTAHP VRPASYEEMN NFYTMTVYEK

151 GAEVVRMYHT LLGEEGFQKG MKLYFQRHDG QAVTCDDFRA AMADANGINL

201 DQFALWYSQA GTPVLEAEGR LKNNIFELTV KQTVPPTPDM TDKQPMMIPV

251 KVGLLNRNGE AVAFDYQGKR ATEAVLLLTE AEQTFLLEGV TEAVVPSLLR

301 GFSAPVHLNY PYSDDDLLLL LAHDSDAFTR WEAAQTLYRR AVAANLATLS

351 DGVELPKHEK LLAAVEKVIS DDLLDNAFKA LLLGVPSEAE LWDGAENIDP

401 LRYHQAREAL LDTLAVHFLP KWHELNRQAA KQENQSYEYS PEAAGWRTLR

451 NVCRAFVLRA DPAHIETVAE KYGEMAQNMT HEWGILSAVN GNESDTRNRL

501 LAQFADKFSD DALVMDKYFA LVGSSRRSDT LQQVRTALQH PKFSLENPNK

551 ARSLIGSFSR NVPHFHAEDG SGYRFIADKV IEIDRFNPQV AARLVQAFNL

601 CNKLEPHRKN LVKQALQRIR AQEGLSKDVG EIVGKILD*
```

Computer analysis of this amino acid sequence gave the following results:

Homology with a Predicted ORF from *N. gonorrhoeae*

```
m665/g665 96.1% identity in 637 aa overlap 10         20         30         40         50         60
m665.pep   MKWDETRFGLEYDLDIFMVVAVGDFNMGAMENKGLNIFNTKFVLADSRTATDTDFEGIES
           ||||||||||||||||||||||||||||||||||||||||||||||||||||||||||||
g665       MKWDETRFGLEYDLDIFMVVAVGDFNMGAMENKGLNIFNTKFVLADSRTATDTDFEGIES
                    10         20         30         40         50         60

70         80         90        100        110        120
m665.pep   VVGHEYFHNWTGNRVTCRDWFQLSLKEGLTVFRDQEFSGDRASRAVRRIENIRLLRQHQF
           |||||||||||||||||||||||||||||||||||||||:||||||||||||||||:||
g665       VVGHEYFHNWTGNRVTCRDWFQLSLKEGLTVFRDQEFSGDRAGRAVRRIENIRLLRQNQF
                    70         80         90        100        110        120

130        140        150        160        170        180
m665.pep   PEDAGPTAHPVRPASYEEMNNFYTMTVYEKGAEVVRMYHTLLGEEGFQKGMKLYFQRHDG
           ||||||||||||||:|||||||||||||||||||||||||||||||||||||||||||||
g665       PEDAGPTAHPVRPVSYEEMNNFYTMTVYEKGAEVVRMYHTLLGEEGFQKGMKLYFQRHDG
                   130        140        150        160        170        180

190        200        210        220        230        240
m665.pep   QAVTCDDFRAAMADANGINLDQFALWYSQAGTPVLEAEGRLKNNIFELTVKQTVPPTPDM
           ||||||||||||||||||||||||||||||||||||||||||||:||||:|||||||||
g665       QAVTCDDFRAAMADANGINLDQFALWYSQAGTPVLEAEGRLKNNVFELTIKQTVPPTPDM
                   190        200        210        220        230        240

250        260        270        280        290        300
m665.pep   TDKQPMMIPVKVGLLNRNGEAVAFDYQGKRATEAVLLLTEAEQTFLLEGVTEAVVPSLLR
           :|||||||||||||||||||||||||||||||||||:||||:|||||||||||||||||
g665       ADKQPMMIPVKVGLLNRNGEAVAFDYQGKRATEAVLLMTEAEQAFPLEGVTEAVVPSLLR
                   250        260        270        280        290        300

310        320        330        340        350        360
m665.pep   GFSAPVHLNYPYSDDDLLLLLAHDSDAFTRWEAAQTLYRRAVAANLATLSDGVELPKHEK
           ||||||:|||||||||||||||||||||||  ||||||||||||||||:|||: ||||||
g665       GFSAPVYLNYPYSDDDLLLLLAHDSDAFTCWEAAQTLYRRAVAANLAALSDGIGLPKHEK
                   310        320        330        340        350        360

370        380        390        400        410        420
m665.pep   LLAAVEKVISDDLLDNAFKALLLGVPSEAELWDGAENIDPLRYHQAREALLDTLAVHFLP
           |||||||||||||||||||||||||||||||||:||||||||||||||||||||||:|||
g665       LLAAVEKVISDDLLDNAFKALLLGVPSEAELWDGTENIDPLRYHQAREALLDTLAVRFLP
                   370        380        390        400        410        420

430        440        450        460        470        480
m665.pep   KWHELNRQAAKQENQSYEYSPEAAGWRTLRNVCRAFVLRADPAHIETVAEKYGEMAQNMT
           |||||:|||||||||||||||||:|||||||||||||||||||||||||||||||||||
g665       KWHELDRQAAKQENQSYEYSPETADWRTLRNVCRAFVLRADPAHIETVAEKYGEMAQNMT
                   430        440        450        460        470        480

490        500        510        520        530        540
m665.pep   HEWGILSAVNGNESDTRNRLLAQFADKFSDDALVMDKYFALVGSSRRSDTLQQVRTALQH
           ||||||||||||||||||:|||||||||||||||||||||:|||||||||||||:||||
g665       HEWGILSAVNGNESDTRNCLLAQFADKFSDDALVMDKYFALIGSSRRSDTLQQVQTALQH
                   490        500        510        520        530        540

550        560        570        580        590        600
m665.pep   PKFSLENPNKARSLIGSFSRNVPHFHAEDGSGYRFIADKVIEIDRFNPQVAARLVQAFNL
           |||||||||||||||||||||||||||:||||||||||||||||||||||||||||||||
g665       PKFSLENPNKARSLIGSFSRNVPHFHAQDGSGYRFIADKVIEIDRFNPQVAARLVQAFNL
                   550        560        570        580        590        600

610        620        630   639
m665.pep   CNKLEPHRKNLVKQALQRIRAQEGLSKDVGEIVGKILDX
           ||||||||||||| || |||||||||||||||||||
g665       CNKLEPHRKNLVKQELQCIRAQEGLSKDVGEIVGKILGX
                   610        620        630
```

The following partial DNA sequence was identified in *N. meningitidis* <SEQ ID 2163>:

```
a665.seq
    1   ATGAAGTGGG ACGAAACGCG CTTCGGTTTG GAATACGACT TGGATATTTT

51   CATGGTCGTC GCCGTGGGCG ATTTCAATAT GGGTGCGATG GAAAACAAGG

101   GTTTGAACAT CTTTAACACC AAGTTCGTCC TTGCCGACAG CCGTACCGCC

151   ACCGATACCG ATTTTGAAGG CATCGAATCC GTGGTCGGAC ACGAATATTT

201   CCACAACTGG ACGGGCAACC GCGTGACCTG CCGCGACTGG TTCCAGCTTT

251   CGCTGAAGGA AGGGTTGACC GTGTTCCGCG ACCAAGAATT TTCCGGCGAC
```

```
-continued
 301 CGCGCCAGCC GCGCCGTGCG CCGTATCGAA AACATCCGCC TGCTGCGCCA
 351 GCACCAGTTC CCCGAAGACG CAGGTCCGAC CGCACATCCG GTGCGCCCCG
 401 CCCGATATGA GGAGATGAAC AATTTCTACA CCATGACCGT TTATGAAAAA
 451 GGCGCGGAAG TGGTGCGGAT GTATCACACC TTGCTCGGCG AAGAGGGCTT
 501 CCAAAAAGGT ATGAAGCTCT ATTTCCAACG CCACGACGGA CAGGCTGTTA
 551 CCTGCGACGA TTTCCGCGCG GCGATGGTGG ACGCGAACGG CATCAACCTC
 601 GACCAATTCG CCTTGTGGTA CAGCCAAGCA GGTACGCCGG TTTTAGATGC
 651 TCAAGGGCGT CTGAAAAACA ATGTGTTCGA GTTAACCATC AAACAAACCG
 701 TGCCGCCCAC GCCCGATATG GCGGACAAAC AGCCGATGAT GATTCCCGTC
 751 AAAATCGGGC TGCTGAACTG CAACGGCGAA GCGGTGGCAT TTGATTATCA
 801 GGGCAAACGC GCGACCGAAG CCGTGTTGCT GCTGACCGAA GCCGAACAGA
 851 CCTTCCAGTT CGAAAGCGTA ACCGAAGCCG TCGTTCCCTC GCTGCTGCGC
 901 GGGTTCAGCG CGCCGGTGCA TCTGAACTAT CCGTACAGCG ACGACGACCT
 951 GCTGCTTCTG CTCGCCCATG ACAGCGACGC CTTCACGCGC TGGGAAGCCG
1001 CACAAACGCT CTACCGCCGT GCCGTCGCCG CCAACCTTGC CGCGCTTTCA
1051 GACGGCGTCG AGTTGCCGAA ACACGAAAAA CTGCTTGCCG CCGTCGAAAA
1101 AGTCATTTCA GACGACCTCT TAGACAACGC TTTCAAAGCC CTGCTTTTGG
1151 GTGTGCCGTC TGAAGCCGAG CTGTGGGACG CGCGGAAAA CATCGACCCG
1201 CTGCGCTACC ATCAGGCGCG CGAAGCCTTG TTGGATATAC TTGCCGTCCG
1251 CTTTCTGCCG AAATGGCACG AATTGAACCG TCAGGCGGCG AAGCAGGAAA
1301 ACCAAAGCTA CGAGTACAGC CCCGAAGCCG CCGGTTGGCG CACGCTGCGC
1351 AATGTCTGCC GCGCCTTCGT CCTGCGCGCC GATCCCGCGC ACATCGAAAC
1401 CGTTGCCGAG AAATACGCCG AAATGGCGCA AAACATGACC CACGAATGGG
1451 GCATCCTGTC CGCCGTCAAC GGCAACGAAA GCGATACGCG CAACCGCCTG
1501 CTGGCGCAGT TTGCCGACAA GTTTTCAGAC GACGCGCTGG TGATGGACAA
1551 ATATTTCGCC CTCGTCGGCT CAAGCCGCCG CAGCGACACC CTGCAACAGG
1601 TTCAAACCGC CTTGCAGCAT CCGAAGTTCA GCCTCGAAAA TCCCAACAAA
1651 GCCCGCTCGC TCATCGGCAG CTTCAGCCGC AACGTCCCGC ATTTCCACGC
1701 AGAAGACGGC AGCGGCTACC GCTTCATCGC CGACAAAGTC ATCGAAATCG
1751 ACCGCTTTAA CCCGCAGGTC GCCGCCCGCC TGGTGCAGGC GTTCAACCTC
1801 TGCAACAAGC TCGAGCCGCA CCGCAAAAAC TTGGTGAAAC AAGCATTGCA
1851 GCGCATTCGG GCGCAGGAAG GATTGTCGAA AGACGTGGGC GAAATCGTCG
1901 GCAAAATTTT GGATTGA
```

This corresponds to the amino acid sequence <SEQ ID 2164; ORF 665.a>:

```
a665.pep

1 MKWDETRFGL EYDLDIFMVV AVGDFNMGAM ENKGLNIFNT KFVLADSRTA

51 TDTDFEGIES VVGHEYFHNW TGNRVTCRDW FQLSLKEGLT VFRDQEFSGD

101 RASRAVRRIE NIRLLRQHQF PEDAGPTAHP VRPARYEEMN NFYTMTVYEK
```

-continued

```
151 GAEVVRMYHT LLGEEGFQKG MKLYFQRHDG QAVTCDDFRA AMVDANGINL

201 DQFALWYSQA GTPVLDAQGR LKNNVFELTI KQTVPPTPDM ADKQPMMIPV

251 KIGLLNCNGE AVAFDYQGKR ATEAVLLLTE AEQTFQFESV TEAVVPSLLR

301 GFSAPVHLNY PYSDDDLLLL LAHDSDAFTR WEAAQTLYRR AVAANLAALS

351 DGVELPKHEK LLAAVEKVIS DDLLDNAFKA LLLGVPSEAE LWDGAENIDP

401 LRYHQAREAL LDILAVRFLP KWHELNRQAA KQENQSYEYS PEAAGWRTLR

451 NVCRAFVLRA DPAHIETVAE KYAEMAQNMT HEWGILSAVN GNESDTRNRL

501 LAQFADKFSD DALVMDKYFA LVGSSRRSDT LQQVQTALQH PKFSLENPNK

551 ARSLIGSFSR NVPHFHAEDG SGYRFIADKV IEIDRFNPQV AARLVQAFNL

601 CNKLEPHRKN LVKQALQRIR AQEGLSKDVG EIVGKILD*
``` m665/a665 97.3% identity in 638 aa overlap

```
                  10         20         30         40         50         60
m665.pep  MKWDETRFGLEYDLDIFMVVAVGDFNMGAMENKGLNIFNTKFVLADSRTATDTDFEGIES
          ||||||||||||||||||||||||||||||||||||||||||||||||||||||||||||
a665      MKWDETRFGLEYDLDIFMVVAVGDFNMGAMENKGLNIFNTKFVLADSRTATDTDFEGIES
                  10         20         30         40         50         60

70         80         90        100        110        120
m665.pep  VVGHEYFHNWTGNRVTCRDWFQLSLKEGLTVFRDQEFSGDRASRAVRRIENIRLLRQHQF
          ||||||||||||||||||||||||||||||||||||||||||||||||||||||||||||
a665      VVGHEYFHNWTGNRVTCRDWFQLSLKEGLTVFRDQEFSGDRASRAVRRIENIRLLRQHQF
                  70         80         90        100        110        120

130        140        150        160        170        180
m665.pep  PEDAGPTAHPVRPASYEEMNNFYTMTVYEKGAEVVRMYHTLLGEEGFQKGMKLYFQRHDG
          ||||||||||||||| ||||||||||||||||||||||||||||||||||||||||||||
a665      PEDAGPTAHPVRPARYEEMNNFYTMTVYEKGAEVVRMYHTLLGEEGFQKGMKLYFQRHDG
                 130        140        150        160        170        180

190        200        210        220        230        240
m665.pep  QAVTCDDFRAAMADANGINLDQFALWYSQAGTPVLEAEGRLKNNIFELTVKQTVPPTPDM
          |||||||||||:||||||||||||||||||||||| :||||||:||||:|||:|||||||
a665      QAVTCDDFRAAMVDANGINLDQFALWYSQAGTPVLDAQGRLKNNVFELTIKQTVPPTPDM
                 190        200        210        220        230        240

250        260        270        280        290        300
m665.pep  TDKQPMMIPVKVGLLNRNGEAVAFDYQGKRATEAVLLLTEAEQTFLLEGVTEAVVPSLLR
          :||||||||||:||||  |||||||||||||||||||||||||||  :|:||||||||||
a665      ADKQPMMIPVKIGLLNCNGEAVAFDYQGKRATEAVLLLTEAEQTFQFESVTEAVVPSLLR
                 250        260        270        280        290        300

310        320        330        340        350        360
m665.pep  GFSAPVHLNYPYSDDDLLLLLAHDSDAFTRWEAAQTLYRRAVAANLATLSDGVELPKHEK
          ||||||||||||||||||||||||||||||||||||||||||||||||  :|||||||||
a665      GFSAPVHLNYPYSDDDLLLLLAHDSDAFTRWEAAQTLYRRAVAANLAALSDGVELPKHEK
                 310        320        330        340        350        360

370        380        390        400        410        420
m665.pep  LLAAVEKVISDDLLDNAFKALLLGVPSEAELWDGAENIDPLRYHQAREALLDTLAVHFLP
          |||||||||||||||||||||||||||||||||||||||||||||||||||:|||:|||
a665      LLAAVEKVISDDLLDNAFKALLLGVPSEAELWDGAENIDPLRYHQAREALLDILAVRFLP
                 370        380        390        400        410        420

430        440        450        460        470        480
m665.pep  KWHELNRQAAKQENQSYEYSPEAAGWRTLRNVCRAFVLRADPAHIETVAEKYGEMAQNMT
          ||||||||||||||||||||||||||||||||||||||||||||||||||||:|||||||
a665      KWHELNRQAAKQENQSYEYSPEAAGWRTLRNVCRAFVLRADPAHIETVAEKYAEMAQNMT
                 430        440        450        460        470        480

490        500        510        520        530        540
m665.pep  HEWGILSAVNGNESDTRNRLLAQFADKFSDDALVMDKYFALVGSSRRSDTLQQVRTALQH
          |||||||||||||||||||||||||||||||||||||||||||||||||||||||:|||
a665      HEWGILSAVNGNESDTRNRLLAQFADKFSDDALVMDKYFALVGSSRRSDTLQQVQTALQH
                 490        500        510        520        530        540

550        560        570        580        590        600
m665.pep  PKFSLENPNKARSLIGSFSRNVPHFHAEDGSGYRFIADKVIEIDRFNPQVAARLVQAFNL
          ||||||||||||||||||||||||||||||||||||||||||||||||||||||||||||
a665      PKFSLENPNKARSLIGSFSRNVPHFHAEDGSGYRFIADKVIEIDRFNPQVAARLVQAFNL
                 550        560        570        580        590        600

610        620        630    639
m665.pep  CNKLEPHRKNLVKQALQRIRAQEGLSKDVGEIVGKILDX
          ||||||||||||||||||||||||||||||||||||||
a665      CNKLEPHRKNLVKQALQRIRAQEGLSKDVGEIVGKILDX
                 610        620        630
```

The following partial DNA sequence was identified in *N. gonorrhoeae* <SEQ ID 2165>:

```
g665-1.seq
    1 ATGAGCAAAA CCGTCCGTTA TCTGAAAGAT TACCAAACGC CTGCCTACCG
   51 CATTCTTGAA ACCGAACTGC ATTTCGACAT TGCCGAACCG CAAACCGTCG
  101 TGAAGTCGCG TTTGACGGTC GAGCCGCAGA GGGCGGGCGA GCCGCTGGTG
  151 TTGGACGGTT CGGCAAAACT CTTGTCCGTC AAAATCAACG GCGCGGCGGC
  201 GGATTATGTG TTGGAAGGCG AGACGCTGAC GATTGCAGAC GTACCGTCCG
  251 AACGCTTCAC CGTCGAAGTG GAAACCGAAA TCCTGCCGGC GGAAAACAAA
  301 TCGCTGATGG GGCTGTATGC TTCCGGCGGC AATCTGTTTA CCCAGTGCGA
  351 GCCGGAGGGC TTCCGCAAAA TCACGTTCTA CATCGACCGT CCGGATGTGA
  401 TGTCCAAGTT CACGACCACC ATCGTCGCGG ACAAAAAACG CTATCCCGTT
  451 TTGCTTTCCA ACGGCAACAA AATCGACGGC GGCGAGTTTT CAGACGGCCG
  501 CCATTGGGTG AAATGGGAAG ACCCGTTTGC CAAACCGAGT TATCTGTTTG
  551 CTTTGGTCGC GGGCGATTTG GCGGTAACGG AAGACCGTTT CACCACCATG
  601 AGCGGCAGAA ACGTCAAAAT CGAGTTTTAC ACCACCGAAG CGGACAAACC
  651 CAAGGTCGGC TTTGCCGTGG AATCGTTGAA AAACGCGATG AAGTGGGACG
  701 AAACGCGCTT CGGGTTGGAA TATGACTTGG ATATTTTCAT GGTCGTCGCC
  751 GTAGGCGATT TCAATATGGG CGCGATGGAA ACAAGGGTT TGAACATTTT
  801 TAACACCAAG TTCGTCCTCG CCGACAGCCG CACCGCCACC GATACCGATT
  851 TCGAAGGCAT TGAATCCGTG GTCGGACACG AATATTTCCA CAACTGGACG
  901 GGCAACCGCG TAACCTGCCG CGACTGGTTC CAGCTTTCGC TGAAGGAAGG
  951 GCTGACCGTG TTCCGCGACC AAGAGTTTTC CGGCGACCGC GCCGGCCGCG
 1001 CCGTGCGCCG CATCGAGAAC ATCCGCCTGC TGCGCCAGAA CCAGTTCCCC
 1051 GAAGACGCAG GCCCGACCGC CCATCCGGTG CGCCCCGTCA GCTATGAGGA
 1101 GATGAACAAT TTCTACACCA TGACCGTTTA TGAAAAAGGC GCGGAAGTGG
 1151 TGCGGATGTA TCATACCCTG CTCGGCGAAG AGGGCTTCCA AAAAGGCATG
 1201 AAGCTATATT TCCAACGCCA CGACGGACAG GCAGTGACCT GCGACGATTT
 1251 CCGCGCGGCG ATGGCGGATG CGAACGGCAT CAATCTCGAC CAGTTCGCCT
 1301 TGTGGTACAG CCAGGCGGGC ACGCCCGTTT TGGAAGCCGA AGGCCGTCTG
 1351 AAAAACAATG TTTTCGAGTT AACCATTAAA CAAACCGTGC CGCCCACGCC
 1401 CGATATGGCG GACAAACAGC CGATGATGAT TCCCGTCAAA GTCGGGCTTC
 1451 TGAACCGCAA CGGCGAAGCG GTGGCATTCG ATTATCAGGG CAAACGCGCA
 1501 ACCGAAGCCG TGTTGCTGAT GACCGAAGCC GAACAGGCCT TCCCGCTCGA
 1551 AGGTGTAACC GAAGCCGTCG TTCCCTCGCT GCTGCGCGGG TTCAGCGCGC
 1601 CAGTGTATCT GAACTATCCG TACAGCGACG ACGACCTGCT GCTCCTGCTC
 1651 GCCCACGACA GCGACGCTTT CACGTGCTGG GAAGCCGCCC AAACGCTCTA
 1701 CCGTCGCGCC GTCGCCGCCA ACCTTGCCGC GCTTTCAGAC GGCATCGGGT
 1751 TGCCGAAACA CGAAAAACTG CTTGCCGCCG TCGAAAAAGT CATTTCAGAC
 1801 GACCTCTTGG ACAACGCCTT CAAAGCCCTG CTTTTGGGCG TGCCGTCCGA
 1851 AGCCGAACTG TGGGACGGCA CGGAAAACAT CGACCCGCTG CGCTACCATC
 1901 AGGCGCGCGA AGCCTTGTTG GATACGCTTG CCGTCCGCTT CCTGCCGAAA
```

```
-continued
1951  TGGCACGAAT TGGACCGTCA GGCGGCGAAG CAGGAAAACC AAAGTTACGA

2001  ATACAGCCCC GAAACCGCCG ACTGGCGCAC GCTGCGCAAC GTCTGCCGCG

2051  CCTTCGTCCT GCGCGCCGAC CCCGCGCACA TCGAAACTGT TGCCGAAAAA

2101  TACGGCGAAA TGGCGCAAAA CATGACCCAC GAATGGGGCA TCCTGTCCGC

2151  CGTCAACGGC AACGAAAGCG ATACGCGCAA CTGCCTGCTG GCGCAGTTTG

2201  CCGACAAGTT TTCAGACGAC GCGCTGGTGA TGGACAAATA TTTCGCCCTT

2251  ATCGGCTCAA GCCGCCGCAG CGACACCCTG CAACAGGTTC AAACCGCCTT

2301  GCAGCATCCG AAATTCAGTC TCGAAAACCC CAACAAAGCC CGTTCGCTCA

2351  TCGGCAGCTT CAGCCGCAAC GTCCCGCATT TCACGCACA AGACGGCAGC

2401  GGCTACCGCT TCATCGCCGA CAAAGTCATC GAAATCGACC GCTTCAACCC

2451  GCAGGTCGCC GCCCGCCTGG TGCAGGCGTT CAACCTCTGC AACAAGCTCG

2501  AGCCGCACCG CAAAAACTTG GTGAAACAAG AATTGCAGTG CATTCGGGCG

2551  CAGGAAGGAT TGTCGAAAGA CGTGGGCGAA ATCGTCGGCA AGATTTTGGG

2601  TTGA
```

This corresponds to the amino acid sequence <SEQ ID 2166; ORF 665-1.ng>:

```
g665-1.pep
  1 MSKTVRYLKD YQTPAYRILE TELHFDIAEP QTVVKSRLTV EPQRAGEPLV

51 LDGSAKLLSV KINGAAADYV LEGETLTIAD VPSERFTVEV ETEILPAENK

101 SLMGLYASGG NLFTQCEPEG FRKITFYIDR PDVMSKFTTT IVADKKRYPV

151 LLSNGNKIDG GEFSDGRHWV KWEDPFAKPS YLFALVAGDL AVTEDRFTTM

201 SGRNVKIEFY TTEADKPKVG FAVESLKNAM KWDETRFGLE YDLDIFMVVA

251 VGDFNMGAME NKGLNIFNTK FVLADSRTAT DTDFEGIESV VGHEYFHNWT

301 GNRVTCRDWF QLSLKEGLTV FRDQEFSGDR AGRAVRRIEN IRLLRQNQFP

351 EDAGPTAHPV RPVSYEEMNN FYTMTVYEKG AEVVRMYHTL LGEEGFQKGM

401 KLYFQRHDGQ AVTCDDFRAA MADANGINLD QFALWYSQAG TPVLEAEGRL

451 KNNVFELTIK QTVPPTPDMA DKQPMMIPVK VGLLNRNGEA VAFDYQGKRA

501 TEAVLLMTEA EQAFPLEGVT EAVVPSLLRG FSAPVYLNYP YSDDDLLLLL

551 AHDSDAFTCW EAAQTLYRRA VAANLAALSD GIGLPKHEKL LAAVEKVISD

601 DLLDNAFKAL LLGVPSEAEL WDGTENIDPL RYHQAREALL DTLAVRFLPK

651 WHELDRQAAK QENQSYEYSP ETADWRTLRN VCRAFVLRAD PAHIETVAEK

701 YGEMAQNMTH EWGILSAVNG NESDTRNCLL AQFADKFSDD ALVMDKYFAL

751 IGSSRRSDTL QQVQTALQHP KFSLENPNKA RSLIGSFSRN VPHFHAQDGS

801 GYRFIADKVI EIDRFNPQVA ARLVQAFNLC NKLEPHRKNL VKQELQCIRA

851 QEGLSKDVGE IVGKILG*
```

The following partial DNA sequence was identified in *N. meningitidis* <SEQ ID 2167>:

```
m665-1.seq
  1  ATGAGCAAAA CCGTGCATTA TCTCAAAGAC TATCAAACGC CCGCCTACCA

51  TATTCTCAAA ACCGATTTAC ATTTTGATAT TAATGAACCG CAAACCGTCG
```

-continued

```
 101 TGAAGTCGCG TTTGACGGTT GAGCCGCAGA GGGTAGGGGA GCCGCTGGTG
 151 TTGGACGGTT CGGCGAAACT CTTGTCCGTC AAAATCAACG GGGCGGCGGC
 201 GGATTATGTG TTGGAAGGAG AGACGCTGAC GATTGCGGGC GTGCCGTCCG
 251 AACGCTTCAC CGTCGAAGTG GAAACCGAAA TCCTGCCGGC GGAAAACAAA
 301 TCGCTGATGG GGCTGTATGC TTCCGGCGGC AATTTGTTTA CCCAGTGCGA
 351 GCCGGAGGGC TTCCGCAAAA TCACATTTTA CATCGACCGT CCGGATGTGA
 401 TGTCCAAGTT CACCACCACC ATCGTCGCCG ACAAAAAACG CTATCCCGTT
 451 TTGCTTTCCA ACGGCAACAA ATCGACGGC GGCGAGTTTT CAGACGGCCG
 501 CCATTGGGTG AAATGGGAAG ACCCGTTTTC CAAACCGAGC TATCTGTTTG
 551 CTTTGGTCGC GGGCGATTTG GCGGTAACGG AAGACTATTT CACCACCATG
 601 AGCGGCAGAA ACGTCAAAAT CGAGTTTTAC ACCACCGAAG CGGACAAGCC
 651 CAAGGTCGGC TTTGCCGTGG AATCGTTGAA AAACGCGATG AAATGGGACG
 701 AAACGCGCTT CGGTTTGGAA TACGACTTGG ATATTTTCAT GGTCGTCGCC
 751 GTGGGCGATT TCAATATGGG CGCGATGGAA ACAAGGGTT TGAACATCTT
 801 TAACACCAAG TTCGTCCTTG CCGACAGCCG CACCGCCACC GATACCGATT
 851 TCGAAGGCAT CGAATCCGTG GTCGGACACG AGTATTTCCA CAACTGGACG
 901 GGCAACCGCG TAACCTGCCG CGACTGGTTC CAGCTTTCGC TGAAGGAAGG
 951 GCTGACCGTG TTCCGCGACC AAGAATTTTC CGGCGACCGC GCCAGCCGCG
1001 CCGTGCGCCG CATCGAAAAC ATCCGCCTGC TGCGCCAGCA CCAGTTCCCC
1051 GAAGACGCAG GCCCGACCGC CCATCCGGTG CGCCCCGCCA GCTATGAGGA
1101 GATGAACAAT TTCTACACCA TGACCGTTTA TGAAAAAGGC GCGGAAGTAG
1151 TGCGGATGTA TCACACCCTG CTCGGCGAAG AGGGCTTCCA GAAAGGCATG
1201 AAGCTCTATT TCCAACGCCA CGACGGACAG GCCGTTACCT GCGACGATTT
1251 CCGCGCGGCG ATGGCGGACG CGAACGGCAT CAATCTCGAC CAGTTCGCCT
1301 TGTGGTACAG CCAGGCGGGC ACGCCCGTTT TGGAAGCGGA AGGTCGTCTG
1351 AAAAACAATA TTTTCGAGTT GACCGTCAAA CAAACCGTGC CGCCCACGCC
1401 CGATATGACG GATAAACAGC CGATGATGAT TCCCGTCAAG GTCGGGCTGC
1451 TGAACCGCAA CGGCGAAGCG GTGGCATTCG ACTATCAGGG CAAACGCGCG
1501 ACCGAAGCCG TGTTGCTGCT GACCGAAGCC GAACAGACCT TCCTGCTCGA
1551 AGGCGTAACC GAAGCCGTCG TTCCCTCGCT GCTGCGCGGG TTCAGCGCGC
1601 CGGTGCATCT GAACTATCCG TACAGCGACG ACGACCTGCT GCTCCTGCTC
1651 GCCCATGACA GCGACGCCTT CACGCGCTGG GAAGCCGCCC AAACGCTCTA
1701 CCGCCGCGCC GTCGCCGCCA ACCTTGCCAC GCTTTCAGAC GGCGTTGAGC
1751 TGCCGAAACA CGAAAAACTG CTTGCCGCCG TCGAAAAAGT CATTTCAGAC
1801 GACCTCTTAG ACAACGCCTT CAAAGCCCTG CTTTTGGGCG TGCCATCCGA
1851 AGCCGAGCTG TGGGACGGCG CAGAAAACAT CGACCCGCTG CGCTACCATC
1901 AGGCGCGCGA AGCCTTGTTG GATACGCTTG CCGTCCACTT CCTGCCGAAA
1951 TGGCACGAAT TGAACCGTCA GGCGGCGAAG CAGGAAAACC AAAGCTACGA
2001 ATACAGCCCC GAAGCCGCCG GCTGGCGCAC GCTGCGCAAC GTCTGCCGCG
2051 CCTTTGTCCT GCGCGCCGAC CCCGCGCACA TCGAAACCGT TGCCGAAAAA
```

```
-continued
2101 TACGGCGAAA TGGCGCAAAA CATGACCCAC GAATGGGGCA TCCTGTCCGC

2151 CGTCAACGGC AACGAAAGCG ATACGCGCAA CCGCCTGCTG GCGCAGTTTG

2201 CCGACAAGTT TTCAGACGAC GCGCTGGTGA TGGACAAATA TTTTGCCCTC

2251 GTCGGCTCAA GCCGCCGCAG CGACACCCTG CAACAGGTTC GAACCGCCTT

2301 GCAGCATCCG AAATTCAGCC TCGAAAACCC CAACAAAGCC CGTTCGCTCA

2351 TCGGCAGCTT CAGCCGCAAC GTCCCGCATT TCCACGCAGA AGACGGCAGC

2401 GGCTACCGCT TCATCGCCGA CAAAGTCATC GAAATCGACC GCTTCAACCC

2451 GCAGGTCGCC GCCCGCTTAG TGCAGGCGTT CAACCTCTGC AACAAGCTCG

2501 AGCCGCACCG CAAAAACTTG GTGAAACAAG CATTGCAGCG CATTCGGGCG

2551 CAGGAAGGAT TGTCGAAAGA CGTGGGCGAA ATCGTCGGCA AAATTTTGGA

2601 TTGA
```

This corresponds to the amino acid sequence <SEQ ID 20 2168; ORF 665-1>:

```
m665-1.pep

1 MSKTVHYLKD YQTPAYHILK TDLHFDINEP QTVVKSRLTV EPQRVGEPLV
 51 LDGSAKLLSV KINGAAADYV LEGETLTIAG VPSERFTVEV ETEILPAENK
101 SLMGLYASGG NLFTQCEPEG FRKITFYIDR PDVMSKETTT IVADKKRYPV
151 LLSNGNKIDG GEFSDGRHWV KWEDPFSKPS YLFALVAGDL AVTEDYFTTM
201 SGRNVKIEFY TTEADKPKVG FAVESLKNAM KWDETRFGLE YDLDIFMVVA
251 VGDFNMGAME NKGLNIFNTK FVLADSRTAT DTDFEGIESV VGHEYFHNWT
301 GNRVTCRDWF QLSLKEGLTV FRDQEFSGDR ASRAVRRIEN IRLLRQHQFP
351 EDAGPTAHPV RPASYEEMNN FYTMTVYEKG AEVVRMYHTL LGEEGFQKGM
401 KLYFQRHDGQ AVTCDDFRAA MADANGINLD QFALWYSQAG TPVLEAEGRL
451 KNNIFELTVK QTVPPTPDMT DKQPMMIPVK VGLLNRNGEA VAFDYQGKRA
501 TEAVLLLTEA EQTFLLEGVT EAVVPSLLRG FSAPVHLNYP YSDDDLLLLL
551 AHDSDAFTRW EAAQTLYRRA VAANLATLSD GVELPKHEKL LAAVEKVISD
601 DLLDNAFKAL LLGVPSEAEL WDGAENIDPL RYHQEREALL DTLAVHFLPK
651 WHELNRQAAK QENQSYEYSP EAAGWRTLRN VCRAFVLRAD PAHIETVAEK
701 YGEMAQNMTH EWGILSAVNG NESDTRNRLL AQFADKFSDD ALVMDKYFAL
751 VGSSRRSDTL QQVRTALQHP KFSLENPNKA RSLIGSFSRN VPHFHAEDGS
801 GYRFIADKVI EIDRFNPQVA ARLVQAFNLC NKLEPHRKNL VKQALQRIRA
851 QEGLSKDVGE IVGKILD* m665-1/g665-1 96.1% identity in 866 aa overlap 10         20         30         40         50         60
m665-1.pep  MSKTVHYLKDYQTPAYHILKTDLHFDINEPQTVVKSRLTVEPQRVGEPLVLDGSAKLLSV
            |||||:||||||||||:||:|:||||  ||||||||||||||:||||||||||||||||
g665-1      MSKTVRYLKDYQTPAYRILETELHFDIAEPQTVVKSRLTVEPQRAGEPLVLDGSAKLLSV
                10         20         30         40         50         60

70         80         90        100        110        120
m665-1.pep  KINGAAADYVLEGETLTIAGVPSERFTVEVETEILPAENKSLMGLYASGGNLFTQCEPEG
            |||||||||||||||||||| |||||||||||||||||||||||||||||||||||||||
g665-1      KINGAAADYVLEGETLTIADVPSERFTVEVETEILPAENKSLMGLYASGGNLFTQCEPEG
                70         80         90        100        110        120

130        140        150        160        170        180
m665-1.pep  FRKITFYIDRPDVMSKFTTTIVADKKRYPVLLSNGNKIDGGEFSDGRHWVKWEDPFSKPS
            |||||||||||||||||||||||||||||||||||||||||||||||||||||||:|||
g665-1      FRKITFYIDRPDVMSKFTTTIVADKKRYPVLLSNGNKIDGGEFSDGRHWVKWEDPFAKPS
                130        140        150        160        170        180
```

-continued

```
                   190       200       210       220       230       240
m665-1.pep  YLFALVAGDLAVTEDYFTTMSGRNVKIEFYTTEADKPKVGFAVESLKNAMKWDETRFGLE
            ||||||||||||||| ||||||||||||||||||||||||||||||||||||||||||||
g665-1      YLFALVAGDLAVTEDRFTTMSGRNVKIEFYTTEADKPKVGFAVESLKNAMKWDETRFGLE
                   190       200       210       220       230       240

250       260       270       280       290       300
m665-1.pep  YDLDIFMVVAVGDFNMGAMENKGLNIFNTKFVLADSRTATDTDFEGIESVVGHEYFHNWT
            ||||||||||||||||||||||||||||||||||||||||||||||||||||||||||||
g665-1      YDLDIFMVVAVGDFNMGAMENKGLNIFNTKFVLADSRTATDTDFEGIESVVGHEYFHNWT
                   250       260       270       280       290       300

310       320       330       340       350       360
m665-1.pep  GNRVTCRDWFQLSLKEGLTVFRDQEFSGDRASRAVRRIENIRLLRQHQFPEDAGPTAHPV
            |||||||||||||||||||||||||||||||:||||||||||||||:|||||||||||||
g665-1      GNRVTCRDWFQLSLKEGLTVFRDQEFSGDRAGRAVRRIENIRLLRQNQFPEDAGPTAHPV
                   310       320       330       340       350       360

370       380       390       400       410       420
m665-1.pep  RPASYEEMNNFYTMTVYEKGAEVVRMYHTLLGEEGFQKGMKLYFQRHDGQAVTCDDFRAA
            ||:|||||||||||||||||||||||||||||||||||||||||||||||||||||||||
g665-1      RPVSYEEMNNFYTMTVYEKGAEVVRMYHTLLGEEGFQKGMKLYFQRHDGQAVTCDDFRAA
                   370       380       390       400       410       420

430       440       450       460       470       480
m665-1.pep  MADANGINLDQFALWYSQAGTPVLEAEGRLKNNIFELTVKQTVPPTPDMTDKQPMMIPVK
            |||||||||||||||||||||||||||||||||:||||:||||||||||:||||||||||
g665-1      MADANGINLDQFALWYSQAGTPVLEAEGRLKNNVFELTIKQTVPPTPDMADKQPMMIPVK
                   430       440       450       460       470       480

490       500       510       520       530       540
m665-1.pep  VGLLNRNGEAVAFDYQGKRATEAVLLLTEAEQTFLLEGVTEAVVPSLLRGFSAPVHLNYP
            ||||||||||||||||||||||||||:|||||:| ||||||||||||||||||||:||||
g665-1      VGLLNRNGEAVAFDYQGKRATEAVLLMTEAEQAFPLEGVTEAVVPSLLRGFSAPVYLNYP
                   490       500       510       520       530       540

550       560       570       580       590       600
m665-1.pep  YSDDDLLLLLAHDSDAFTRWEAAQTLYRRAVAANLATLSDGVELPKHEKLLAAVEKVISD
            |||||||||||||||||| |||||||||||||||||:||||: |||||||||||||||||
g665-1      YSDDDLLLLLAHDSDAFTCWEAAQTLYRRAVAANLAALSDGIGLPKHEKLLAAVEKVISD
                   550       560       570       580       590       600

610       620       630       640       650       660
m665-1.pep  DLLDNAFKALLLGVPSEAELWDGAENIDPLRYHQAREALLDTLAVHFLPKWHELNRQAAK
            |||||||||||||||||||||||:|||||||||||||||||||||:||||||||:|||||
g665-1      DLLDNAFKALLLGVPSEAELWDGTENIDPLRYHQAREALLDTLAVRFLPKWHELDRQAAK
                   610       620       630       640       650       660

670       680       690       700       710       720
m665-1.pep  QENQSYEYSPEAAGWRTLRNVCRAFVLRADPAHIETVAEKYGEMAQNMTHEWGILSAVNG
            |||||||||||:| ||||||||||||||||||||||||||||||||||||||||||||||
g665-1      QENQSYEYSPETADWRTLRNVCRAFVLRADPAHIETVAEKYGEMAQNMTHEWGILSAVNG
                   670       680       690       700       710       720

730       740       750       760       770       780
m665-1.pep  NESDTRNRLLAQFADKFSDDALVMDKYFALVGSSRRSDTLQQVRTALQHPKFSLENPNKA
            ||||||| ||||||||||||||||||||||:||||||||||||:||||||||||||||||
g665-1      NESDTRNCLLAQFADKFSDDALVMDKYFALIGSSRRSDTLQQVQTALQHPKFSLENPNKA
                   730       740       750       760       770       780

790       800       810       820       830       840
m665-1.pep  RSLIGSFSRNVPHFHAEDGSGYRFIADKVIEIDRFNPQVAARLVQAFNLCNKLEPHRKNL
            ||||||||||||||||:|||||||||||||||||||||||||||||||||||||||||||
g665-1      RSLIGSFSRNVPHFHAQDGSGYRFIADKVIEIDRFNPQVAARLVQAFNLCNKLEPHRKNL
                   790       800       810       820       830       840

850       860
m665-1.pep  VKQALQRIRAQEGLSKDVGEIVGKILDX
            ||| || |||||||||||||||||||
g665-1      VKQELQCIRAQEGLSKDVGEIVGKILGX
                   850       860
```

The following partial DNA sequence was identified in *N. meningitidis* <SEQ ID 2169>:

```
a665-1.seq
   1  ATGAGCAAAA CCGTGCATTA TCTCAAAGAC TATCAAACGC CCGCCTACCA

51  TATTCTCAAA ACCGATTTAC ATTTTGATAT TAACGAACCG CAAACCATTG

101  TGAAGTCGCG TTTGACGGTC GAGCCGAAGA GGGTGGGAGA GCCGCTGGTG

151  TTGGACGGTT CGGCGAAACT CTTGTCCGTC AAAATCAACG GCGTGGCGGC

201  GGATTATGTG TTGGAAGGCG AGACGCTGAC GATTGCGGAC GTGCCGTCCG

251  AACGCTTCAC CGTCGAAGTG GAAACCGAAA TCCTGCCGGC GGAAAACAAA
```

```
 301 TCGCTGATGG GGCTGTATGC GTCCGCCGGT AACCTGTTTA CCCAGTGCGA
 351 GCCGGAGGGC TTCCGCAAAA TCACGTTCTA TATCGACCGT CCGGATGTCA
 401 TGTCCAAGTT CACGACCACC ATCGTCGCGG ACAAAAAACG CTATCCCGTT
 451 TTGCTCTCCA ACGGCAACAA AATCGACGGC GGCGAGTATT CAGACGGCCG
 501 CCATTGGGTG AAATGGGAAG ACCCGTTTGC CAAACCGAGT TATCTGTTTG
 551 CTTTGGTCGC GGGCGATTTG GCGGTCACGG AAGACTATTT CACCACCATG
 601 AGCGGCAGAA ACGTCAAAAT CGAGTTTTAC ACCACCGAAG CGGACAAGCC
 651 CAAGGTCGGC TTTGCCGTGG AATCGCTGAA AAACGCAATG AAGTGGGACG
 701 AAACGCGCTT CGGTTTGGAA TACGACTTGG ATATTTTCAT GGTCGTCGCC
 751 GTGGGCGATT TCAATATGGG TGCGATGGAA ACAAGGGTT TGAACATCTT
 801 TAACACCAAG TTCGTCCTTG CCGACAGCCG TACCGCCACC GATACCGATT
 851 TTGAAGGCAT CGAATCCGTG GTCGGACACG AATATTTCCA CAACTGGACG
 901 GGCAACCGCG TGACCTGCCG CGACTGGTTC CAGCTTTCGC TGAAGGAAGG
 951 GTTGACCGTG TTCCGCGACC AAGAATTTTC CGGCGACCGC GCCAGCCGCG
1001 CCGTGCGCCG TATCGAAAAC ATCCGCCTGC TGCGCCAGCA CCAGTTCCCC
1051 GAAGACGCAG GTCCGACCGC ACATCCGGTG CGCCCCGCCC GATATGAGGA
1101 GATGAACAAT TTCTACACCA TGACCGTTTA TGAAAAAGGC GCGGAAGTGG
1151 TGCGGATGTA TCACACCTTG CTCGGCGAAG AGGGCTTCCA AAAAGGTATG
1201 AAGCTCTATT TCCAACGCCA CGACGGACAG GCTGTTACCT GCGACGATTT
1251 CCGCGCGGCG ATGGTGGACG CGAACGGCAT CAACCTCGAC CAATTCGCCT
1301 TGTGGTACAG CCAAGCAGGT ACGCCGGTTT TAGATGCTCA AGGGCGTCTG
1351 AAAAACAATG TGTTCGAGTT AACCATCAAA CAAACCGTGC CGCCCACGCC
1401 CGATATGGCG GACAAACAGC CGATGATGAT TCCCGTCAAA ATCGGGCTGC
1451 TGAACTGCAA CGGCGAAGCG GTGGCATTTG ATTATCAGGG CAAACGCGCG
1501 ACCGAAGCCG TGTTGCTGCT GACCGAAGCC GAACAGACCT TCCAGTTCGA
1551 AAGCGTAACC GAAGCCGTCG TTCCCTCGCT GCTGCGCGGG TTCAGCGCGC
1601 CGGTGCATCT GAACTATCCG TACAGCGACG ACGACCTGCT GCTTCTGCTC
1651 GCCCATGACA GCGACGCCTT CACGCGCTGG GAAGCCGCAC AAACGCTCTA
1701 CCGCCGTGCC GTCGCCGCCA ACCTTGCCGC GCTTTCAGAC GGCGTCGAGT
1751 TGCCGAAACA CGAAAAACTG CTTGCCGCCG TCGAAAAAGT CATTTCAGAC
1801 GACCTCTTAG ACAACGCTTT CAAAGCCCTG CTTTTGGGTG TGCCGTCTGA
1851 AGCCGAGCTG TGGGACGGCG CGGAAAACAT CGACCCGCTG CGCTACCATC
1901 AGGCGCGCGA AGCCTTGTTG GATATACTTG CCGTCCGCTT TCTGCCGAAA
1951 TGGCACGAAT TGAACCGTCA GGCGGCGAAG CAGGAAAACC AAAGCTACGA
2001 GTACAGCCCC GAAGCCGCCG GTTGGCGCAC GCTGCGCAAT GTCTGCCGCG
2051 CCTTCGTCCT GCGCGCCGAT CCCGCGCACA TCGAAACCGT TGCCGAGAAA
2101 TACGCCGAAA TGGCGCAAAA CATGACCCAC GAATGGGCA TCCTGTCCGC
2151 CGTCAACGGC AACGAAAGCG ATACGCGCAA CCGCCTGCTG GCGCAGTTTG
2201 CCGACAAGTT TTCAGACGAC GCGCTGGTGA TGGACAAATA TTTCGCCCTC
2251 GTCGGCTCAA GCCGCCGCAG CGACACCCTG CAACAGGTTC AAACCGCCTT
```

-continued
```
2301 GCAGCATCCG AAGTTCAGCC TCGAAAATCC CAACAAAGCC CGCTCGCTCA

2351 TCGGCAGCTT CAGCCGCAAC GTCCCGCATT TCCACGCAGA AGACGGCAGC

2401 GGCTACCGCT TCATCGCCGA CAAAGTCATC GAAATCGACC GCTTTAACCC

2451 GCAGGTCGCC GCCCGCCTGG TGCAGGCGTT CAACCTCTGC AACAAGCTCG

2501 AGCCGCACCG CAAAAACTTG GTGAAACAAG CATTGCAGCG CATTCGGGCG

2551 CAGGAAGGAT TGTCGAAAGA CGTGGGCGAA ATCGTCGGCA AAATTTTGGA

2601 TTGA
```

This corresponds to the amino acid sequence <SEQ ID 2170; ORF 665-1.a>:

```
a665-1.pep

1 MSKTVHYLKD YQTPAYHILK TDLHFDINEP QTIVKSRLTV EPKRVGEPLV

51 LDGSAKLLSV KINGVAADYV LEGETLTIAD VPSERFTVEV ETEILPAENK

101 SLMGLYASAG NLFTQCEPEG FRKITFYIDR PDVMSKFTTT IVADKKRYPV

151 LLSNGNKIDG GEYSDGRHWV KWEDPFAKPS YLFALVAGDL AVTEDYFTTM

201 SGRNVKIEFY TTEADKPKVG FAVESLKNAM KWDETRFGLE YDLDIFMVVA

251 VGDFNMGAME NKGLNIFNTK FVLADSRTAT DTDFEGIESV VGHEYFHNWT

301 GNRVTCRDWF QLSLKEGLTV FRDQEFSGDR ASRAVRRIEN IRLLRQHQFP

351 EDAGPTAHPV RPARYEEMNN FYTMTVYEKG AEVVPMYHTL LGEEGFQKGM

401 KLYFQRHDGQ AVTCDDFRAA MADANGINLD QFALWYSQAG TPVLDAQGRL

451 KNNVFELTIK QTVPPTPDMA DKQPMMIPVK IGLLNCNGEA VAFDYQGKRA

501 TEAVLLLTEA EQTFQFESVT EAVVPSLLRG FSAPVHLNYP YSDDDLLLLL

551 AHDSDAFTRW EAAQTLYRRA VAANLAALSD GVELPKHEKL LAAVEKVISD

601 DLLDNAFKAL LLGVPSEAEL WDGAENIDPL RYHQAREALL DILAVRFLPK

651 WHELNRQAAK QENQSYEYSP EAAGWRTLRN VCRAFVLRAD PAHIETVAEK

701 YAEMAQNMTH EWGILSAVNG NESDTRNRLL AQFADKFSDD ALVMDKYFAL

751 VGSSRRSDTL QQVQTALQHP KFSLENPNKA RSLIGSFSRN VPHFHAEDGS

801 GYRFIADKVI EIDRFNPQVA ARLVQAFNLC NKLEPHRKNL VKQALQRIRA

851 QEGLSKDVGE IVGKILD*
a665-1/m665-1 97.2% identity in 867 aa overlap 10         20         30         40         50         60
a665-1.pep MSKTVHYLKDYQTPAYHILKTDLHFDINEPQTIVKSRLTVEPKRVGEPLVLDGSAKLLSV
           ||||||||||||||||||||||||||||||||:|||||||||:||||||||||||||||
m665-1     MSKTVHYLKDYQTPAYHILKTDLHFDINEPQTVVKSRLTVEPQRVGEPLVLDGSAKLLSV
                  10         20         30         40         50         60

70         80         90        100        110        120
a665-1.pep KINGVAADYVLEGETLTIADVPSERFTVEVETEILPAENKSLMGLYASAGNLFTQCEPEG
           ||||:||||||||||||||| |||||||||||||||||||||||||||:|||||||||
m665-1     KINGAAADYVLEGETLTIAGVPSERFTVEVETEILPAENKSLMGLYASGGNLFTQCEPEG
                  70         80         90        100        110        120

130        140        150        160        170        180
a665-1.pep FRKITFYIDRPDVMSKFTTTIVADKKRYPVLLSNGNKIDGGEYSDGRHWVKWEDPFAKPS
           ||||||||||||||||||||||||||||||||||||||||:||||||||||||:|||
m665-1     FRKITFYIDRPDVMSKFTTTIVADKKRYPVLLSNGNKIDGGEFSDGRHWVKWEDPFSKPS
                  130        140        150        160        170        180

190        200        210        220        230        240
a665-1.pep YLFALVAGDLAVTEDYFTTMSGRNVKIEFYTTEADKPKVGFAVESLKNAMKWDETRFGLE
           ||||||||||||||||||||||||||||||||||||||||||||||||||||||||||||
m665-1     YLFALVAGDLAVTEDYFTTMSGRNVKIEFYTTEADKPKVGFAVESLKNAMKWDETRFGLE
                  190        200        210        220        230        240
```

```
                  250        260        270        280        290        300
a665-1.pep  YDLDIFMVVAVGDFNMGAMENKGLNIFNTKFVLADSRTATDTDFEGIESVVGHEYFHNWT
            ||||||||||||||||||||||||||||||||||||||||||||||||||||||||||||
m665-1      YDLDIFMVVAVGDFNMGAMENKGLNIFNTKFVLADSRTATDTDFEGIESVVGHEYFHNWT
                  250        260        270        280        290        300

310        320        330        340        350        360
a665-1.pep  GNRVTCRDWFQLSLKEGLTVFRDQEFSGDRASRAVRRIENIRLLRQHQFPEDAGPTAHPV
            ||||||||||||||||||||||||||||||||||||||||||||||||||||||||||||
m665-1      GNRVTCRDWFQLSLKEGLTVFRDQEFSGDRASRAVRRIENIRLLRQHQFPEDAGPTAHPV
                  310        320        330        340        350        360

370        380        390        400        410        420
a665-1.pep  RPARYEEMNNFYTMTVYEKGAEVVRMYHTLLGEEGFQKGMKLYFQRHDGQAVTCDDFRAA
            |||  |||||||||||||||||||||||||||||||||||||||||||||||||||||||
m665-1      RPASYEEMNNFYTMTVYEKGAEVVRMYHTLLGEEGFQKGMKLYFQRHDGQAVTCDDFRAA
                  370        380        390        400        410        420

430        440        450        460        470        480
a665-1.pep  MVDANGINLDQFALWYSQAGTPVLDAQGRLKNNVFELTIKQTVPPTPDMADKQPMMIPVK
            |:||||||||||||||||||||||||:|:||||||:|||||:|||||||||:||||||||
m665-1      MADANGINLDQFALWYSQAGTPVLEAEGRLKNNIFELTVKQTVPPTPDMTDKQPMMIPVK
                  430        440        450        460        470        480

490        500        510        520        530        540
a665-1.pep  IGLLNCNGEAVAFDYQGKRATEAVLLLTEAEQTFQFESVTEAVVPSLLRGFSAPVHLNYP
            :||||  ||||||||||||||||||||||||||  :|:||||||||||||||||||||||
m665-1      VGLLNRNGEAVAFDYQGKRATEAVLLLTEAEQTFLLEGVTEAVVPSLLRGFSAPVHLNYP
                  490        500        510        520        530        540

550        560        570        580        590        600
a665-1.pep  YSDDDLLLLLAHDSDAFTRWEAAQTLYRRAVAANLAALSDGVELPKHEKLLAAVEKVISD
            ||||||||||||||||||||||||||||||||||||:|||||||||||||||||||||||
m665-1      YSDDDLLLLLAHDSDAFTRWEAAQTLYRRAVAANLATLSDGVELPKHEKLLAAVEKVISD
                  550        560        570        580        590        600

610        620        630        640        650        660
a665-1.pep  DLLDNAFKALLLGVPSEAELWDGAENIDPLRYHQAREALLDILAVRFLPKWHELNRQAAK
            |||||||||||||||||||||||||||||||||||||||||:|||:||||||||||||||
m665-1      DLLDNAFKALLLGVPSEAELWDGAENIDPLRYHQAREALLDTLAVHFLPKWHELNRQAAK
                  610        620        630        640        650        660

670        680        690        700        710        720
a665-1.pep  QENQSYEYSPEAAGWRTLRNVCRAFVLRADPAHIETVAEKYAEMAQNMTHEWGILSAVNG
            ||||||||||||||||||||||||||||||||||||||||||:|||||||||||||||||
m665-1      QENQSYEYSPEAAGWRTLRNVCRAFVLRADPAHIETVAEKYGEMAQNMTHEWGILSAVNG
                  670        680        690        700        710        720

730        740        750        760        770        780
a665-1.pep  NESDTRNRLLAQFADKFSDDALVMDKYFALVGSSRRSDTLQQVQTALQHPKFSLENPNKA
            |||||||||||||||||||||||||||||||||||||||||||:||||||||||||||||
m665-1      NESDTRNRLLAQFADKFSDDALVMDKYFALVGSSRRSDTLQQVRTALQHPKFSLENPNKA
                  730        740        750        760        770        780

790        800        810        820        830        840
a665-1.pep  RSLIGSFSRNVPHFHAEDGSGYRFIADKVIEIDRFNPQVAARLVQAFNLCNKLEPHRKNL
            ||||||||||||||||||||||||||||||||||||||||||||||||||||||||||||
m665-1      RSLIGSFSRNVPHFHAEDGSGYRFIADKVIEIDRFNPQVAARLVQAFNLCNKLEPHRKNL
                  790        800        810        820        830        840

850        860
a665-1.pep  VKQALQRIRAQEGLSKDVGEIVGKILDX
            ||||||||||||||||||||||||||||
m665-1      VKQALQRIRAQEGLSKDVGEIVGKILDX
                  850        860
```

The following partial DNA sequence was identified in *N. gonorrhoeae* <SEQ ID 2171>:

```
g666.seq
   1 ATGCTTTGTA TGAATTATCA ATCAAACTCA GGCGAAGGAG TGCTTGTAGC

51 TAAAACATAT TTATTGACTG CATTGATAAT GTCTATGGTA ATCTCCGGAT

101 GTCAAGTCAT CCATGCCAAT CAAGGTAAGG TTAATACTAA TTCTGCTGTC

151 ATCGCAGGTG CAGACGCTCA CACGCCTGAA CATGTAACGG GACTGACCGA

201 ACAAAAGCAG GTGATTGCAA GTGATTTTAT AGTAGCGTCA GCCAATCCAT

251 TAGCAACACA AGCTGGCTAT GATATCTTAA AGCAAGGCGG TAGCGCTGCA

301 GATGCGATGG TGGCGGTGCA GACGACACTA AGCTTGGTAG AGCCACAGTC

351 GTCAGGCTTG GGCGGTGGTG CATTTGTGTT GTATTGGGAC AATACCGCCA
```

```
401 AAACATTGAC CACATTTGAT GGGCGTGAGA CGGCACCGAT GCGTGCGACG

451 CCAGAATTAT TTTTGGATAA AGATGGTTAA CCATTGAAAT TTATGGAAGC

501 GGTGGTCGCT CGGTAGGTAC GCCTGCTATC CCTAAACTGA
```

This corresponds to the amino acid sequence <SEQ ID 2172; ORF 666.ng>:

```
g666.pep
  1 MLCMNYQSNS GEGVLVAKTY LLTALIMSMV ISGCQVIHAN QGKVNTNSAV

51 IAGADAHTPE HVTGLTEQKQ VIASDFIVAS ANPLATQAGY DILKQGGSAA

101 DAMVAVQTTL SLVEPQSSGL GGGAFVLYWD NTAKTLTTFD GRETAPMRAT

151 PELFLDKDGX PLKFMEAVVA RXVRLLSLN*
```

The following partial DNA sequence was identified in *N. meningitidis* <SEQ ID 2173>:

```
m666.seq
  1 ATGCCTTGTA TGAATCATCA ATCAAACTCA GGCGAAGGAG TGCTTGTGGC

51 TAAAACATAT TTATTGACTG CATTGATAAT GTCTATGACA ATCTCTGGAT

101 GTCAAGTCAT CCATGCCAAT CAAGGTAAGG TTAATACTCA TTCTGCTGTC

151 ATCACAGGTG CAGACGCTCA CACGCCTGAA CATGCAACGG GACTGACCGA

201 ACAAAAGCAG GTGATTGCAA GTGATTTTAT GGTAGCGTCA GCCAATCCAT

251 TAGCAACACA AGCTGGCTAT GATATCTTAA AGCAAGGCGG TAGCGCTGCA

301 GATGCGATGG TGGCGGTGCA GACGACACTA AGCTTGGTAG AGCCACAGTC

351 GTCAGGCTTG GCGGTGGTG CATTTGTGTT GTATTGGGAT AATACCGCCA

401 AAACATTGAC CACATTTGAT GGGCGTGAGA CGGCACCGAT GCGTGCGACG

451 CCGGAATTAT TTTTGGATAA AGATGGTCAA CCATTGAAAT TTATGGAAGC

501 GGTGGTCGTG GTCGCTCGGT GGGTACGCCT GCTATCCCTA AACTGA
```

This corresponds to the amino acid sequence <SEQ ID 2174; ORF 666>:

```
m666.pep
  1 MPCMNHQSNS GEGVLVAKTY LLTALIMSMT ISGCQVIHAN QGKVNTHSAV

51 ITGADAHTPE HATGLTEQKQ VIASDFMVAS ANPLATQAGY DILKQGGSAA

101 DAMVAVQTTL SLVEPQSSGL GGGAFVLYWD NTAKTLTTFD GRETAPMRAT

151 PELFLDKDGQ PLKFMEAVVV VARWVRLLSL N*
```

Computer analysis of this amino acid sequence gave the following results:
Homology with a Predicted ORF from *N. gonorrhoeae*

```
    m666/g666 93.9% identity in 181 aa overlap 10         20         30         40         50         60
    m666.pep  MPCMNHQSNSGEGVLVAKTYLLTALIMSMTISGCQVIHANQGKVNTHSAVITGADAHTPE
              | |||:||||||||||||||||||||||||:||||||||||||||||:||||:|||||||
    g666      MLCMNYQSNSGEGVLVAKTYLLTALIMSMVISGCQVIHANQGKVNTNSAVIAGADAHTPE
               10         20         30         40         50         60
```

```
              70         80         90        100        110        120
m666.pep  HATGLTEQKQVIASDFMVASANPLATQAGYDILKQGGSAADAMVAVQTTLSLVEPQSSGL
          |:||||||||||||:|||||||||||||||||||||||||||||||||||||||||||
g666      HVTGLTEQKQVIASDFIVASANPLATQAGYDILKQGGSAADAMVAVQTTLSLVEPQSSGL
              70         80         90        100        110        120

130        140        150        160        170        180
m666.pep  GGGAFVLYWDNTAKTLTTFDGRETAPMRATPELFLDKDGQPLKFMEAVVVVARWVRLLSL
          ||||||||||||||||||||||||||||||||||||||||| |||||||| || ||||||
g666      GGGAFVLYWDNTAKTLTTFDGRETAPMRATPELFLDKDGXPLKFMEAVV--ARXVRLLSL
             130        140        150        160        170 m666.pep  NX
          ||
g666      NX
          180
```

The following partial DNA sequence was identified in *N. meningitidis* <SEQ ID 2175>:

```
a

The following partial DNA sequence was identified in *N. gonorrhoeae* <SEQ ID 2177>:

```
g667.seq
   1 atgcggtttg tcttctgttt gggcgGAGAG ATAGtttctg atccgtgtga 51 tttccAtttg gtattcgtcc gcgtcgaatc tgccgctgAc CAGAcagaaa 101 cgCAGataca tCaaatacgt attcacggca tcggtttcgc aatAAttgcg 151 GAtttccttc agcgtgcccg cgtgGAacgc ttcccacact ttgctgccgt 201 ccataCCCAg ctTGCCCGGA AAGCCGCACA GTTTcgcCat atcgtccagC 251 GGCACATTcg ccctcggctG GTAAAGCGCG AGCAAATCCA TCAAATCGCA 301 GTGGCGTTGG TGATAACGGC TGATGTAGTT GTTCCActtg AAATCGCGGC 351 tgtcgccgAA ATCGccgTCG CCCGTATCCC AATAGCGCGC GGCGTTGATG

401 CCGTATATCA GGGAGCGGTA ATGCAGTACG GGCAGGTCGA AACCGCCGCC

451 GTTCCAGCTG ACCAGTTGCG GCGTATGTTT TTCAACCAAT TCGAAAAACT

501 TGGCAATCAC GACTTCTTCG CCATCGTCCA TCTCGCCGAT GGTGCCGACA

551 TGAACCTTGT CCTGCCCCCA GCGCATACAG CAGGAAACCG CCACAACCTG

601 ATGGAGGTGG TGCTGCATAA AATCGCCGCC GGTCTGTGCG CGGCGTTTCT

651 GCTGCGCGAA CAGCACCACT TCGTCATCCG GCAGGGAAGA CGGCAAGTCA

701 TACAACGTAC GGATACCCTG CACATCGGGT ACGGTTTCAA TATCGAAAGC

751 CAAAATCGTA TTCATGGCAg tACCTTGCAT tcaAAAACAG ACtTGCGCCT

801 ATTgTgtcaT TAA
```

This corresponds to the amino acid sequence <SEQ ID 2178; ORF 667.ng>:

```
g667.pep
   1 MRFVFCLGGE IVSDPCDFHL VFVRVESAAD QTETQIHQIR IHGIGFAIIA

51 DFLQRARVER FPHFAAVHTQ LARKAAQFRH IVQRHIRPRL VKREQIHQIA

101 VALVITADVV VPLEIAAVAE IAVARIPIAR GVDAVYQGAV MQYGQVETAA

151 VPADQLRRMF FNQFEKLGNH DFFAIVHLAD GADMNLVLPP AHTAGNRHNL

201 MEVVLHKIAA GLCAAFLLRE QHHFVIRQGR RQVIQRTDTL HIGYGFNIES

251 QNRIHGSTLH SKTDLRLLCH *
```

The following partial DNA sequence was identified in *N. meningitidis* <SEQ ID 2179>:

```
m667.seq (PARTIAL)
   1 ATGCGGCTTT TCCCCGGCTT GTGCGGACAG GTAATTCCGC ATCCGTTTGA

51 TTTCCATTTC GTATTCGTCC GCATCCAGCC TGCCGCTGAC CAGACAGAAA

101 CGCAGGTACA TCAGATAAGT GTTTGCCGCG TCGGTTTCGC AATAATTGCG

151 GATTTCCTTC AGCCTGCCCG TATGGAATGC CTCCCAAACC TTGCTGCCGT

201 CCATACCCAG CTTGCCCGGA AAACCGCACA GTTTCGCCAT ATCGTCCAGC

251 GGCACGTTTG CCCTCGGCTG GTAAAGCGCG AGCAAATCCA TCAAATCGCA

301 GTGGCGTTGG TGATAACGGC TGATGTAGTT GTTCCACTTG AAATCGCGGC

351 TGTCGCCGAA ATCGCCGTCG CCCATATCCC AATAGCGCGC GGCGTTGATG

401 CCGTATATCA GGGAGCGGTA ATGCAGTACG GGCAGATCGA AACCGCCGCC
```

```
-continued
451 GTTCCAACTG ACCAGTTGCG GCGTATGTTT TTCAATCAAT TCGAAAAATT

501 TAGCAATGAC CACTTCCTCG CCGTCATCCA TCTCGCCGAT GGTGCCGACA

551 TGTACTTTAT CCTGCCCCCA ACGCATGCAG CACGAAATCG CCACAACCTG

601 ATGAAGATGA TGCTGCATAA AATCGCCGCC CGTCTGAGCA CGGCGTTTGT

651 GCTGGGCAAT CAGCACCACT TG...
```

This corresponds to the amino acid sequence <SEQ ID 2180; ORF 667>:

```
m667.pep (partial)
  1 MRLFPGLCGQ VIPHPFDFHF VFVRIQPAAD QTETQVHQIS VCRVGFAIIA

51 DFLQPARMEC LPNLAAVHTQ LARKTAQFRH IVQRHVCPRL VKREQIHQIA

101 VALVITADVV VPLEIAAVAE IAVAHIPIAR GVDAVYQGAV MQYGQIETAA

151 VPTDQLRRMF FNQFEKFSND HFLAVIHLAD GADMYFILPP THAARNRHNL

201 MKMMLHKIAA RLSTAFVLGN QHHL...
```

Computer analysis of this amino acid sequence gave the following results:
Homology with a Predicted ORF from *N. gonorrhoeae*

```
    m667/g667 75.0% identity in 224 aa overlap 10         20         30         40         50         60
    m667.pep MRLFPGLCGQVIPHPFDFHFVFVRIQPAADQTETQVHQISVCRVGFAIIADFLQPARMEC
             ||:    |  |::: |   |||:||||::  ||||||||:|||  :  :||||||||| ||:|
    g667     MRFVFCLGGEIVSDPCDFHLVFVRVESAADQTETQIHQIRIHGIGFAIIADFLQRARVER
              10         20         30         40         50         60

70         80         90        100        110        120
    m667.pep LPNLAAVHTQLARKTAQFRHIVQRHVCPRLVKREQIHQIAVALVITADVVVPLEIAAVAE
             :|:: ||||||||||:|||||||||||:  ||||||||||||||||||||||||||||||
    g667     FPHFAAVHTQLARKAAQFRHIVQRHIRPRLVKREQIHQIAVALVITADVVVPLEIAAVAE
              70         80         90        100        110        120

130        140        150        160        170        180
    m667.pep IAVAHIPIARGVDAVYQGAVMQYGQIETAAVPTDQLRRMFFNQFEKFSNDHFLAVIHLAD
             ||||:|||||||||||||||||||||||:||||||:|||||||||||||::|  |:::||||
    g667     IAVARIPIARGVDAVYQGAVMQYGQVETAAVPADQLRRMFFNQFEKLGNHDFFAIVHLAD
             130        140        150        160        170        180

190        200        210        220
    m667.pep GADMYFILPPTHAARNRHNLMKMMLHKIAARLSTAFVLGNQHHL
             ||||  ::|||:|:| |||||||:::||||||  |  :||:|  :|||:
    g667     GADMNLVLPPAHTAGNRHNLMEVVLHKIAAGLCAAFLLREQHHFVIRQGRRQVIQRTDTL
             190        200        210        220        230        240 g667     HIGYGFNIESQNRIHGSTLHSKTDLRLLCHX
             250        260        270
```

The following partial DNA sequence was identified in *N. meningitidis* <SEQ ID 2181>:

```
a667.seq
  1 ATGCGGTTTG TCTTCTGTTT GGGCGGAGAG ATAGTTTCTG ATCCGCTTGA

51 TTTCCATTTC GTATTCGTCT GCGTCGAATC TGCCGCTGAC CAGACAGAAA

101 CGCAGATACA TCAGATAGGT ATTTACCGCA TCGGTTTCGC AATAATTGCG

151 GATTTCCTTC AGCCTGCCCG CGTGGAACGC CTCCCACACC TTGCTGCCGT

201 CCATACCCAG CTTGCCCGGA AAACCGCACA GTTTCGCCAT ATCGTCCAAC

251 GGCACATTCG CCCTCGGCTG GTAAAGCGCG AGCAAATCCA TCAAATCGCA

301 ATGACGTTGG TGGTAGCGGC TGATGTAGTT GTTCCACTTG AAATCGCGGC
```

-continued

```
351 TGTCGCCGAA ATCGCCGTCG CCCATATCCC AATAGCGCGC GGCGTTGATG

401 CCGTGTAGCA GCGAACGGTA ATGCAGAACC GGCAGGTCGA AACCGCCGCC

451 GTTCCAACTG ACCAGTTGCG GCGTATGTTT TTCAATCAAC TCGAAAAATT

501 TGGCGATAAC CACTTCCTCG CCGTCATCCA TCTCGCCGAT TGTACCGACA

551 TGGACTTTAT CCTGCCCCCA ACGCATGCAG CACGAAATCG CCACAATCTG

601 ATGAAGATGA TGCTGCATAA AATCCCCACC CGTCTGAGCA CGGCGTTTTT

651 GCTGGGCAAA CAGCACCACT TCATCGTCGG GCAGCGAGGA CGGCAAGTCA

701 TACAGCGTAC GGATACACTG CACATCGGGT ACGGTTTCAA TATCGAAAGC

751 CAAAATCGTG GTCATGACAG CACCTTGTAT TTAAAA.CAG ACTTGCGCCT

801 ATTGTGTCAT TAA
```

This corresponds to the amino acid sequence <SEQ ID 2182; ORF 667.a>:

```
a667.pep
        1 MRFVFCLGGE IVSDPLDFHF VFVCVESAAD QTETQIHQIG IYRIGFAIIA

51 DFLQPARVER LPHLAAVHTQ LARKTAQFRH IVQRHIRPRL VKREQIHQIA

101 MTLVVAADVV VPLEIAAVAE IAVAHIPIAR GVDAV*QRTV MQNRQVETAA

151 VPTDQLRRMF FNQLEKFGDN HFLAVIHLAD CTDMDFILPP THAARNRHNL

201 MKMMLHKIPT RLSTAFLLGK QHHFIVGQRG RQVIQRTDTL HIGYGFNIES

251 QNRGHDSTLY LKXDLRLLCH * m667/a667 79.0% identity in 224 aa overlap 10         20         30         40         50         60
m667.pep MRLFPGLCGQVIPHPFDFHFVFVRIQPAADQTETQVHQISVCRVGFAIIADFLQPARMEC
         ||:    |  |:::   |:||||||  ::  ||||||||:|||  :: |:||||||||||:|
a667     MRFVFCLGGEIVSDPLDFHFVFVCVESAADQTETQIHQIGIYRIGFAIIADFLQPARVER
                    10         20         30         40         50         60

70         80         90        100        110        120
m667.pep LPNLAAVHTQLARKTAQFRHIVQRHVCPRLVKREQIHQIAVALVITADVVVPLEIAAVAE
         ||:||||||||||||||||||||||:  ||||||||||||||::||::|||||||||||||
a667     LPHLAAVHTQLARKTAQFRHIVQRHIRPRLVKREQIHQIAMTLVVAADVVVPLEIAAVAE
                    70         80         90        100        110        120

130        140        150        160        170        180
m667.pep IAVAHIPIARGVDAVYQGAVMQYGQIETAAVPTDQLRRMFFNQFEKFSNDHFLAVIHLAD
         |||||||||||||||  :|||    |:|||||||||||||||||||:|||:::||||||||||
a667     IAVAHIPIARGVDAVXQRTVMQNRQVETAAVPTDQLRRMFFNQLEKFGDNHFLAVIHLAD
                   130        140        150        160        170        180

190       2000        210        220
m667.pep GADMYFILPPTHAARNRHNLMKMMLHKIAARLSTAFVLGNQHHL
         :||  |||||||||||||||||||||||||  :||||||:||:|||:
a667     CTDMDFILPPTHAARNRHNLMKMMLHKIPTRLSTAFLLGKQHHFIVGQRGRQVIQRTDTL
                   190        200        210        220        230        240 a667     HIGYGFNIESQNRGHDSTLYLKXDLRLLCHX
                   250        260        270
```

The following partial DNA sequence was identified in *N. gonorrhoeae* <SEQ ID 2183>:

```
g669.seq
    1 ATGCGCCGCA TCGTTAAAAA ACACCAGCCC GTAAACGCGC CACATATCGT

51 TTTGGAAATT CGGATAATGA AACTGCATCG CGCGTTTGTC TTCCTTGGGC

101 GGAAACGTCC CCATCATCAT GACCGCAGCC TTCGGCGGCA ACACGGGATC

151 GAAGGGATGG GTTTCGATTT CAAGCAGATT TTCAGACACG TTCAATCCTC
```

```
201 CAACAGGCAA AGCGGCAGAC AGCCGGTTTG CACCAAACCG CCAAACACGG

251 CAAGCCTTCA AACAGCATTA TCACGCCCTG CCGTTTTCGG TTACAATGCC

301 GACATCAAAC GGATACTGTA A
```

This corresponds to the amino acid sequence <SEQ ID 2184; ORF 669.ng>:

```
g669.pep
  1 MRRIVKKHQP VNAPHIVLEI RIMKLHRAFV FLGRKRPHHH DRSLRRQHGI

51 EGMGFDFKQI FRHVQSSNRQ SGRQPVCTKP PNTASLQTAL SRPAVFGYNA

101 DIKRIL*
```

The following partial DNA sequence was identified in *N. meningitidis* <SEQ ID 2185>:

```
m669.seq
  1 ATGCGCCGCA TCATTAAAAA ACACCAGCCC ATAAACGCGC CACATATCGT

51 TTTGGAAATT CGGATAATGA AACTGCATCG CGCGTTTGTC TTCCTTGGGC

101 GGAAACGTCC CCATCATCAT GACAGCAGCC TTCGGCGGCA ACACGGGATC

151 GAAGGGATGG GTTTCGATTT CAAGCAGATT TTCAGACACG TTCAATCCTC

201 CAACAGGCAA AACGGCAGAC AGCCGGTTTG CACCAAACCG CCAAACACGG

251 CAAGCCTTCA AACAGCATTA TCACGCCCTG CCGTTTTCGG TTACAATGCC

301 GACATCAAAC GGATACTGTA A
```

This corresponds to the amino acid sequence <SEQ ID 2186; ORF 669>:

```
m669.pep
  1 MRRIIKKHQP INAPHIVLEI RIMKLHRAFV FLGRKRPHHH DSSLRRQHGI

51 EGMGFDFKQI FRHVQSSNRQ NGRQPVCTKP PNTASLQTAL SRPAVFGYNA

101 DIKRIL*
```

Computer analysis of this amino acid sequence gave the following results:
Homology with a Predicted ORF from *N. gonorrhoeae*

```
    m669/g669  96.2% identity in 106 aa overlap 10        20        30        40        50        60
        m669.pep  MRRIIKKHQPINAPHIVLEIRIMKLGRAFVFLGRKRPHHHDSSLRRQHGIEGMGFDFKQI
                  ||||:|||||:|||||||||||||| ||||||||||||| |||||||||||||||||||
        g669      MRRIVKKHQPVNAPHIVLEIRIMKLHRAFVFLGRKRPHHHDRSLRRQHGIEGMGFDFKQI
                       10        20        30        40        50        60

70        80        90       100
        m669.pep  FRHVQSSNRQNGRQPVCTKPPNTASLQTALSRPAVFGYNADIKRILX
                  ||||||||||:||||||||||||||||||||||||||||||||||||
        g669      FRHVQSSNRQSGRQPVCTKPPNTASLQTALSRPAVFGYNADIKRILX
                       70        80        90       100
```

The following partial DNA sequence was identified in *N. meningitidis* <SEQ ID 2187>:

```
a669.seq
   1 ATGCGCCGCA TCATTAAAAA ACACCAGCCC GTAAACGCGC CACATATCGT

51 TTTGGAAATT CGGATAATGA AACTGCATCG CGCGTTTGTC TTCCTTGGGC

101 GGAAACGTCC CCATCATCAT GACCGCAGCC TTCGGCGGCA ACACGGAATC

151 GAAGGGATGG GTTTCGATTT CAAGCAGATT TTCAGACACG TTCAATCCTC

201 CAACAGGCAA AACGGCAGAC AGCCGGTTTG CACCAAACCG CCAAACACGG

251 CAAGCCTTCA AACAGCATTA TCACGCCCTG CCGTTTTCGG TTACAATGCC

301 GACATCAAAC GGATACTGTA A
```

This corresponds to the amino acid sequence <SEQ ID 2188; ORF 669.a>:

```
a669.pep

1  MRRIIKKHQP VNAPHIVLEI RIMKLHRAFV FLGRKRPHHH DRSLRRQHGI

51  EGMGFDFKQI FRHVQSSNRQ NGRQPVCTKP PNTASLQTAL SRPAVFGYNA

101  DIKRIL* m669/a669  98.1% identity in 106 aa overlap
                   10        20        30        40        50        60
m669.pep   MRRIIKKHQPINAPHIVLEIRIMKLHRAFVFLGRKRPHHHDSSLRRQHGIEGMGFDFKQI
           ||||||||||:||||||||||||||||||||||||||||||| |||||||||||||||||
a669       MRRIIKKHQPVNAPHIVLEIRIMKLHRAFVFLGRKRPHHHDRSLRRQHGIEGMGFDFKQI
                   10        20        30        40        50        60

70        80        90       100
m669.pep   FRHVQSSNRQNGRQPVCTKPPNTASLQTALSRPAVFGYNADIKRILX
           |||||||||||||||||||||||||||||||||||||||||||||||
a669       FRHVQSSNRQNGRQPVCTKPPNTASLQTALSRPAVFGYNADIKRILX
                   70        80        90       100
```

The following partial DNA sequence was identified in *N. gonorrhoeae* <SEQ ID 2189>:

```
g670.seq
   1 ATGACTTGTT GCAGGAACTG CTTGGCGCGT TCGTGTTTCG GGTTGGTGAA

51 AAACGCTTCC GGCGTTTCGT CTTCAAGGAT TTGCCCTTTA TCGACGAAAA

101 TCACGCGGTC GGCAACTTCG CGGGCAAACC CCATTTCGTG GGTTACGCAC

151 ATCATCGTCA TGCCGCTTTC CGCCAAGTCT TTCATCACTT TCAACACTTC

201 GCCGACCATT TCGGGGTCGA GTGCGGAAGT CGGCTCGTCA AACAGCATCA

251 CGCGCGGCTC CATCGCCAGC CCGCGCGCAA TCGCCACGCG TTGCTGCTGG

301 CCGCCGGAAA GTTGGGAAGG GAAGGCGTCT TTTTTGTGTG CCAGTCCGAC

351 GCGTTCCAAA AGCTCCATTG CCTTTTTCTC CGCCTGTTCC GCATTTTGCC

401 CCTTAACCTT CATCGGTGCG AGGGTGATGT TGTCCAACAC GGTCAGGTGC

451 GGGTAG
```

This corresponds to the amino acid sequence <SEQ ID 2190; ORF 670.ng>:

```
g670.pep
  1 MTCCRNCLAR SCFGLVKNAS GVSSSRICPL STKITRSATS RANPISWVTH

51 IIVMPLSAKS FITFNTSPTI SGSSAEVGSS NSITRGSIAS PRAIATRCCW
```

```
101 PPESWEGKAS FLCASPTRSK SSIAFFSACS AFCPLTFIGA RVMLSNTVRC

151 G*
```

The following partial DNA sequence was identified in *N. meningitidis* <SEQ ID 2191>:

```
m670.seq
   1 ATGACCTGTT GCAGGAACTG CTTGGCGCGT TCGTGTTTCG GGTTGGTAAA

51 AAACGCTTCG GGCGTTTCGT CTTCGAGGAT TTGCCCTTTA TCGACGAAAA

101 TCACGCGGTC GGCAACTTCG CGGGCAAACC CCATTTCGTG GGTTACGCAC

151 ATCATCGTCA TGCCGCTTTC TGCCAAGTCT TTCATCACTT TCAACACTTC

201 GCCGACCATT TCGGGGTCGA GTGCGGAGGT CGGTTCGTCA AACAACATTA

251 CGCGCGGTTC CATCGCCAAA CCGCGTGCAA TCGCCACGCG TTGCTGCTGG

301 CCGCCGGAAA GTTGGGAAGG GAAGGCGTCT TTTTTGTGTG CCAGTCCGAC

351 GCGTTCCAAA AGCTCCATTG CCTTTTTCTC CGCCTGTTCC GCATTTTGCC

401 CCTTAACCTT CATCGGTGCG AGGGTAATGT TTTCCAACAC GGTCAGGTGC

451 GGGTAG
```

This corresponds to the amino acid sequence <SEQ ID 2192; ORF 670>:

```
m670.pep
   1 MTCCRNCLAR SCFGLVKNAS GVSSSRICPL STKITRSATS RANPISWVTH

51 IIVMPLSAKS FITFNTSPTI SGSSAEVGSS NNITRGSIAK PRAIATRCCW

101 PPESWEGKAS FLCASPTRSK SSIAFFSACS AFCPLTFIGA RVMFSNTVRC

151 G*
```

Computer analysis of this amino acid sequence gave the following results:
Homology with a Predicted ORF from *N. gonorrhoeae*

```
m670/g670  98.0% identity in 151 aa overlap
                  10        20        30        40        50        60
    m670.pep  MTCCRNCLARSCFGLVKNASGVSSSRICPLSTKITRSATSRANPISWVTHIIVMPLSAKS
              ||||||||||||||||||||||||||||||||||||||||||||||||||||||||||||
    g670      MTCCRNCLARSCFGLVKNASGVSSSRICPLSTKITRSATSRANPISWVTHIIVMPLSAKS
                  10        20        30        40        50        60

70        80        90       100       110       120
    m670.pep  FITFNTSPTISGSSAEVGSSNNITRGSIAKPRAIATRCCWPPESEWGKASFLCASPTRSK
              ||||||||||||||||||||:|||||||:|||||||||||||||||||||||||||||||
    g670      FITFNTSPTISGSSAEVGSSNSITRGSIASPRAIATRCCWPPESWGKASFLCASPTRSK
                  70        80        90       100       110       120

130       140       150
    m670.pep  SSIAFFSACSAFCPLTFIGARVMFSNTVRCGX
              |||||||||||||||||||||||:||||||||
    g670      SSIAFFSACSAFCPLTFIGARVMLSNTVRCGX
                 130       140       150
```

The following partial DNA sequence was identified in *N. meningitidis* <SEQ ID 2193>:

```
a670.seq
   1 ATGACCTGTT GCAGGAACTG CTTGGCGCGT TCGTGTTTCG GGTTGGTAAA

51 AAACGCTTCC GGCGTTTCGT CTTCGAGGAT TTGCCCTTTA TCGACGAAAA

101 TCACGCGGTC GGCAACTTCG CGGGCAAACC CCATTTCGTG GGTTACGCAC
```

-continued

```
151 ATCATGGTCA TACCGCTTTC CGCCAAGTCT TTCATCACTT TCAACACTTC

201 GCCGACCATT TCGGGGTCGA GTGCGGAGGT CGGTTCGTCA AACAACATTA

251 CGCGCGGTTC CATCGCCAAA CCGCGTGCAA TCGCCACGCG TTGCTGCTGG

301 CCGCCGGAAA GTTGGGAAGG GAAGGCGTCT TTTTTGTGTG CCAGTCCGAC

351 GCGTTCCAAA AGTTCCATCG CTTTTTTCTC TGCCTGTTCC GCATTTTGAC

401 CTTTAACCTT CATCGGTGCG AGGGTAATGT TTTCCAACAC GGTCAGGTGC

451 GGGTAG
```

This corresponds to the amino acid sequence <SEQ ID 2194; ORF 670.a>:

```
a670.pep

1  MTCCRNCLAR SCFGLVKNAS GVSSSRICPL STKITRSATS RANPISWVTH

51  IMVIPLSAKS FITFNTSPTI SGSSAEVGSS NNITRGSIAK PRAIATRCCW

101  PPESWEGKAS FLCASPTRSK SSIAFFSACS AF*PLTFIGA RVMFSNTVRC

151  G* m670/a670  98.0% identity in 151 aa overlap
                   10         20         30         40         50         60
m670.pep   MTCCRNCLARSCFGLVKNASGVSSSRICPLSTKITRSATSRANPISWVTHIIVMPLSAKS
           ||||||||||||||||||||||||||||||||||||||||||||||||||:|:||||||
a670       MTCCRNCLARSCFGLVKNASGVSSSRICPLSTKITRSATSRANPISWVTHIMVIPLSAKS
                   10         20         30         40         50         60

70         80         90        100        110        120
m670.pep   FITFNTSPTISGSSAEVGSSNNITRGSIAKPRAIATRCCWPPESWEGKASFLCASPTRSK
           ||||||||||||||||||||||||||||||||||||||||||||||||||||||||||||
a670       FITFNTSPTISGSSAEVGSSNNITRGSIAKPRAIATRCCWPPESWEGKASFLCASPTRSK
                   70         80         90        100        110        120

130        140        150
m670.pep   SSIAFFSACSAFCPLTFIGARVMFSNTVRCGX
           |||||||||||| |||||||||||||||||||
a670       SSIAFFSACSAFXPLTFIGARVMFSNTVRCGX
                  130        140        150
```

The following partial DNA sequence was identified in *N. gonorrhoeae* <SEQ ID 2195>:

```
g671.seq

1 ATGATCAGCA GGGTAACAAT CAAAACGCCT TCAATGCAC CGAATACACC

51 GCCCAAAATG CGGTTGGCAA AGCCCAGACC GACCGCCGAA ACTGCGCCGG

101 TCAGCAGCGA ACGGAGCATT TTCTGGATCA GACAGGCAAT GACGAACAGG

151 GAAATGAATG ACAGagccaa TGCAAACAgg cggggTTGGA ACGaggCAAA

201 GGCGAGGTCg gcgaaggGTG CGGCaaAGAG TTTggcaaAA AAGAaggAAA 251 ccaccCATGC cACCATCgaa ccTGCTTCCG CAATCACGCC GCGCATCGTG 301 GAAATGACGA TGCAGGCGGC GATGACGGcg gAGGCGAGGA GGTCGGCAAT

351 GGGGAGGCTA TTCATTCGTT ACCTGGCCGG CGATGCCGTG CACGCGCAGT

401 TTGTTCAAAT CGCGTTCGGC ATCCCTTGCG TTTTTATAGT TGCTTGA
```

This corresponds to the amino acid sequence <SEQ ID 2196; ORF 671.ng>:

```
g671.pep
   1 MISRVTIKTP FNAPNTPPKM RLAKPRPTAE TAPVSSERSI FWIRQAMTNR

51 EMNDRANANR RGWNEAKARS AKGAAKSLAK KKETTHATIE PASAITPRIV

101 EMTMQAAMTA EARRSAMGRL FIRYLAGDAV HAQFVQIAFG IPCVFIVA*
```

The following partial DNA sequence was identified in *N. meningitidis* <SEQ ID 2197>:

```
m671.seq
   1 ATGACCAGCA GGGTAACAAT CAAAACGCCT TTCAATGCAC CGAATACGCC

51 GCCCAAAATG CGGTTGGCAA AGCCCAAACC GACCGCCGAA ACTGCGCTGG

101 TCAGCAGCGA ACGGAGCATT TTCTGGATCA GACAGGCAAT GACGAACAGG

151 GAAATGAACG ACAGAGCCAA TGCAAACAGG CGGGGTTGGA ACGAGGCAAA

201 GGCGAGGTCG GCGAAGGAGG CGGCAAAGAG TTTGGCGAAA AGAAGGAAA

251 CCACCCATGC CGCCATTGAG CCTGCCTCCG CAATCACGCC GCGCATCGCG

301 GATAGCACGA TGCAGGCGGC GATGACGGCG GAGACGAGGA GGTCGGCAAT

351 GGGGAGGCTA TTCATTCGTT ACCTGACCGG CGATACCGTG TACGCGCAAT

401 TTGTTCAAAT CGCGTTCGGC ATCCCTTGCG TTTTTATAGT TGCTTGA
```

This corresponds to the amino acid sequence <SEQ ID 2198; ORF 671>:

```
m671.pep
   1 MTSRVTIKTP FNAPNTPPKM RLAKPKPTAE TALVSSERSI FWIRQAMTNR

51 EMNDRANANR RGWNEAKARS AKEAAKSLAK KKETTHAAIE PASAITPRIA

101 DSTMQAAMTA ETRRSAMGRL FIRYLTGDTV YAQFVQIAFG IPCVFIVA*
```

Computer analysis of this amino acid sequence gave the following results:
Homology with a Predicted ORF from *N. gonorrhoeae*

```
   m671/g671  91.9% identity in 148 aa overlap
                    10         20         30         40         50         60
     m671.pep  MTSRVTIKTPFNAPNTPPKMRLAKPKPTAETALVSSERSIFWIRQAMTNREMNDRANANR
               | ||||||||||||||||||||||| :|||||  |||||||||||||||||||||||||||
     g671      MISRVTIKTPFNAPNTPPKMRLAKPRPTAETAPVSSERSIFWIRQAMTNREMNDRANANR
                    10         20         30         40         50         60

70         80         90        100        110        120
     m671.pep  RGWNEAKARSAKEAAKSLAKKKETTHAAIEPASAITPRIADSTMQAAMTAETRRSAMGRL
               ||||||||||| |||||||||||||||: ||||||||||:: |||||||||:||||||||
     g671      RGWNEAKARSAKGAAKSLAKKKETTHATIEPASAITPRIVEMTMQAAMTAEARRSAMGRL
                    70         80         90        100        110        120

130        140     149
     m671.pep  FIRYLTGDTVYAQFVQIAFGIPCVFIVAX
               |||||:||:|:|||||||||||||||||
     g671      FIRYLAGDAVHAQFVQIAFGIPCVFIVAX
                   130        140
```

The following partial DNA sequence was identified in *N. meningitidis* <SEQ ID 2199>:

```
a671.seq
   1 ATGACCAGCA GGGTAATAAT CAAAATGCCT TCAATGCAC CGAATACGCC

51 GCCCAAAATG CGGTTGGCAA AGCCCAAACC GACCGCCGAA ACTGCCCCGG
```

-continued
```
101 TCAGCAGCGA GCGGAGTATT TTCTGGATCA GACAGGCAAT GACGAATAGG

151 GAAATGAACG ACAGAGCCAA TGCAAACAGG CGGGGTTGGA ACGATGCAAA

201 GGCGATGTCG GCGAAGGGTG CGGCAAAGAG TTTGGCGAAA AAAAAGGCAA

251 CCACCCATGC CGCCATTGAG CCAGCCTCCG CAATCACGCC GCGCATCGCG

301 GATAGCACGA TGCAGGCGGC GATGATGGCG GAGACGAGGA GGTCGGCAAC

351 GGGGAGGTTA TTCATTCGTT ACCTGACCGG CGATACCGTG TACGCGCAAT

401 TTGTTCAAAT CGCGTTCGGC ATCCCTTGCG TTTTTATAGT TGCTTGA
```

This corresponds to the amino acid sequence <SEQ ID 2200; ORF 671.a>:

```
a671.pep
        1 MTSRVIIKMP FNAPNTPPKM RLAKPKPTAE TAPVSSERSI FWIRQAMTNR

51 EMNDRANANR RGWNDAKAMS AKGAAKSLAK KKATTHAAIE PASAITPRIA

101 DSTMQAAMMA ETRRSATGRL FIRYLTGDTV YAQFVQIAFG IPCVFIVA* m671/a671 93.9% identity in 148 aa overlap 10        20        30        40        50        60
   m671.pep MTSRVTIKTPFNAPNTPPKMRLAKPKPTAETALVSSERSIFWIRQAMTNREMNDRANANR
            ||||| || |||||||||||||||||||||| |||||||||||||||||||||||||||
   a671     MTSRVIIKMPFNAPNTPPKMRLAKPKPTAETAPVSSERSIFWIRQAMTNREMNDRANANR
                   10        20        30        40        50        60

70        80        90       100       110       120
   m671.pep RGWNEAKARSAKEAAKSLAKKKETTHAAIEPASAITPRIADSTMQAAMTAETRRSAMGRL
            ||||:||| ||| ||||||||||| |||||||||||||||||||||||| |||||| ||
   a671     RGWNDAKAMSAKGAAKSLAKKKATTHAAIEPASAITPRIADSTMQAAMMAETRRSATGRL
                   70        80        90       100       110       120

130       140       149
   m671.pep FIRYLTGDTVYAQFVQIAFGIPCVFIVAX
            ||||||||||||||||||||||||||||
   a671     FIRYLTGDTVYAQFVQIAFGIPCVFIVAX
                  130       140
```

The following partial DNA sequence was identified in *N. gonorrhoeae* <SEQ ID 2201>:

```
g672.seq
    1 ATGAGGAAAA TCCGCACCAA AATCTGCGGC ATCACCACAC CGGAAGACGC

51 ACTGTATGCC GCCCACGCCG GCGCAGACGC ATTGGGACTG GTTTTTTACC

101 CCCAAAGCCC CCGCGCTATC GACATCATTA AGCACAAAA AATCGCCGCC

151 GCACTGCCGC CGTTTGTCAG CGTTGTCGCC CTTTTCGTCA ACGAAAGCGC

201 GCAAAACATC CGCCGCATCC TTGCCGAAGT GCCGATACAC ATCATCCAAT

251 TCCACGGCGA CGAAGACGAT GCATTCTGCC GGCAGTTCGA CCGCCCCTAT

301 ATTAAAGCCA TTCGTGTTCA GACGGCATCA GACATCCGAA ACGCCGCCAC

351 GCGCTTCCCC AACGCTCAGG CACTGCTGTT CGATGCCTAT CACCCTTCGG

401 AATACGGCGG CACCGGACAC CGCTTCGact GGacgctgtt ggcggAATAT

451 TCGGGCAAGC CGTGGGTGCT TGCCGGCGGG CTGACCCCTG AAAACGTCGG

501 CGAAGCCGTC CGCATCACCG GAGCGGAAGC GGTCGACGTA TCCGGCGGCG

551 TGGAAGCGTC TAAAGGCAAA AAAGACCCCG CCAAAGTCGC CGCCTTTATC

601 GCAACCGCCA ACCGCCTATC CCGTTAA
```

This corresponds to the amino acid sequence <SEQ ID 2202; ORF 672.ng>:

```
g672.pep
  1 MRKIRTKICG ITTPEDALYA AHAGADALGL VFYPQSPRAI DIIKAQKIAA

51 ALPPFVSVVA LFVNESAQNI RRILAEVPIH IIQFHGDEDD AFCRQFDRPY

101 IKAIRVQTAS DIRNAATRFP NAQALLFDAY HPSEYGGTGH RFDWTLLAEY

151 SGKPWVLAGG LTPENVGEAV RITGAEAVDV SGGVEASKGK KDPAKVAAFI

201 ATANRLSR*
```

The following partial DNA sequence was identified in *N. meningitidis* <SEQ ID 2203>:

```
m672.seq
  1 ATGAGGAAAA TCCGCACCAA AATCTGCGGC ATCACCACAC CGGAAGACGC

51 AGCTGCCGCC GCAGCGGCAG GTGCGGATGC CGTCGGGCTG GTCTTTTTCC

101 AAGGCAGCAG CCGGGCCGTC GATATTGCCC GCGCCAAAAA AATCACCGCC

151 GCACTGCCGC CGTTTGTCAG CGTTGTCGCC CTTTTCGTCA ACGAAAGCGC

201 GCAAAACATC CGCCGCATCC TTGCCGAAGT GCCGATACAC ATCATCCAAT

251 TCCACGGCGA CGAAGACGAC GCATTCTGCC GCCAGTTCCA CCGCCCCTAT

301 ATCAAAGCCA TTCGTGTTCA GACGGCATCA GACATCCGAA ACGCCGCCAC

351 GCGCTTCCCC GACGCTCAGG CACTGCTGTT CGATGCCTAC CATCCTTCGG

401 AATACGGCGG CACCGGAAAC CGCTTCGACT GGACGCTGCT GGCGGAATAT

451 TCGGGCAAAC CGTGGGTGCT TGCCGGCGGG CTGACCCCTG AAAACGTCGG

501 CGAAGCCGTC CGCATCACCG GAGCGGAATC GGTCGATGTA TCCGGCGGTG

551 TGGAAGCGTC TAAAGGCAAA AAAGATGCCG CCAAAGTCGC CGCCTTTATC

601 GCAACCGCCA ACCGCCTATC CCGTTAA
```

This corresponds to the amino acid sequence <SEQ ID 2204; ORF 672>:

```
m672.pep
  1 MRKIRTKICG ITTPEDAAAA AAAGADAVGL VFFQGSSRAV DIARAKKITA

51 ALPPFVSVVA LFVNESAQNI RRILAEVPIH IIQFHGDEDD AFCRQFHRPY

101 IKAIRVQTAS DIRNAATRFP DAQALLFDAY HPSEYGGTGN RFDWTLLAEY

151 SGKPWVLAGG LTPENVGEAV RITGAESVDV SGGVEASKGK KDAAKVAAFI

201 ATANRLSR*
```

Computer analysis of this amino acid sequence gave the following results:
Homology with a Predicted ORF from *N. gonorrhoeae*

```
   m672/g672 91.3% identity in 208 aa overlap 10         20         30         40         50         60
      m672.pep MRKIRTKICGITTPEDAAAAAAAGADAVGLVFFQGSSRAVDIARAKKITAALPPFVSVVA
              ||||||||||||||||  ||  |||||:||||:  |  ||:||  :|:||:|||||||||
         g672 MRKIRTKICGITTPEDALYAAHAGADALGLVFYPQSPRAIDIIKAQKIAAALPPFVSVVA
                10         20         30         40         50         60

70         80         90        100        110        120
      m672.pep LFVNESAQNIRRILAEVPIHIIQFHGDEDDAFCRQFHRPYIKAIRVQTASDIRNAATRFP
              ||||||||||||||||||||||||||||||||||||||:|||||||||||||||||||||
         g672 LFVNESAQNIRRILAEVPIHIIQFHGDEDDAFCRQFDRPYIKAIRVQTASDIRNAATRFP
                70         80         90        100        110        120
```

```
                 130       140       150       160       170       180
m672.pep DAQALLFDAYHPSEYGGTGNRFDWTLLAEYSGKPWVLAGGLTPENVGEAVRITGAESVDV
         :||||||||||||||||:|||||||||||||||||||||||||||||||||||:|||
g672     NAQALLFDAYHPSEYGGTGHRFDWTLLAEYSGKPWVLAGGLTPENVGEAVRITGAEAVDV
                 130       140       150       160       170       180

190       200   209
m672.pep SGGVEASKGKKDAAKVAAFIATANRLSRX
         ||||||||||| ||||||||||||||||
g672     SGGVEASKGKKDPAKVAAFIATANRLSRX
                 190       200
```

The following partial DNA sequence was identified in *N. meningitidis* <SEQ ID 2205>:

```
a672.seq
  1 ATGAGGAAAA TCCGCACCAA AATCTGCGGC ATCACCACAC CGGAAGACGC

51 ACTGTATGCC GCCCACGCCG GCGCAGACGC ATTGGGACTG GTTTTTTACC

101 CCCAAAGCCC CCGCGCTGTC GACATCATTA AAGCACAAAA AATCACCGCC

151 GCACTGCCGC CGTTTGTCAG CGTTGTCGCC CTTTTCGTCA ACGAAAGCGC

201 GCAAAACATC CGCCGCATCC TTGCCGAAGT ACCGATACAC ATCATCCAAT

251 TCCACGGCGA CGAAGACGAC GCATTCTGCC GCCAGTTCCA CCGCCCCTAT

301 ATCAAGGCCA TTCGTGTTCA GACGGCATCA GACATCCGAA ACGCCGCCGA

351 CCGCTTCCCC GACGCTCAGG CACTGCTGTT CGATGCCTAC CATCCTTCGG

401 AATACGGCGG CACCGGACAC CGCTTCGACT GGACGCTGTT GGCGGAATAT

451 TCGGGCAAAC CGTGGGTGCT TGCCGGCGGG CTGACCCCTG AAAACGTCGA

501 CGAAGCCATC CGCATCACCG GAGCGGAAGC GGTCGATGTA TCCGGCGGCG

551 TGGAAGCGTC TAAAGGCAAA AAAGACCCAG CCAAAGTTGC CGCCTTTATC

601 GCAACCGCCA ACCGCCTATC CGTTAA
```

This corresponds to the amino acid sequence <SEQ ID 2206; ORF 672.a>:

```
a672.pep

1 MRKIRTKICG ITTPEDALYA AHAGADALGL VFYPQSPRAV DIIKAQKITA

51 ALPPFVSVVA LFVNESAQNI RRILAEVPIH IIQFHGDEDD AFCRQFHRPY

101 IKAIRVQTAS DIRNAADRFP DAQALLFDAY HPSEYGGTGH RFDWTLLAEY

151 SGKPWVLAGG LTPENVDEAI RITGAEAVDV SGGVEASKGK KDPAKVAAFI

201 ATANRLSR* m672/a672 91.8% identity in 208 aa overlap 10        20        30        40        50        60
m672.pep MRKIRTKICGITTPEDAAAAAAGADAVGLVFFQGSSRAVDIARAKKITAALPPFVSVVA
         ||||||||||||||||||  || ||||:|||:  | ||||   :|:||||||||||||
a672     MRKIRTKICGITTPEDALYAAHAGADALGLVFYPQSPRAVDIIKAQKITAALPPFVSVVA
                 10        20        30        40        50        60

70        80        90       100       110       120
m672.pep LFVNESAQNIRRILAEVPIHIIQFHGDEDDAFCRQFHRPYIKAIRVQTASDIRNAATRFP
         |||||||||||||||||||||||||||||||||||||||||||||||||||||| |||
a672     LFVNESAQNIRRILAEVPIHIIQFHGDEDDAFCRQFHRPYIKAIRVQTASDIRNAADRFP
                 70        80        90       100       110       120

130       140       150       160       170       180
m672.pep DAQALLFDAYHPSEYGGTGNRFDWTLLAEYSGKPWVLAGGLTPENVGEAVRITGAESVDV
         ||||||||||||||||||:|||||||||||||||||||||||||||||| |:||||:|||
a672     DAQALLFDAYHPSEYGGTGHRFDWTLLAEYSGKPWVLAGGLTPENVDEAIRITGAEAVDV
                 130       140       150       160       170       180
```

```
                       190       200      209
m672.pep  SGGVEASKGKKDAAKVAAFIATANRLSRX
          |||||||||||| ||||||||||||||||
    a672  SGGVEASKGKKDPAKVAAFIATANRLSRX
                       190       200
```

The following partial DNA sequence was identified in *N. gonorrhoeae* <SEQ ID 2207>:

```
g673.seq
    1 ATGGATATTG AAACCTTCCT TGCAGGGGAA CGCGCCGCCG GCGGATACCG

51 TTGCGGCTTC GTGGCGATTG TCGGTCGTCC GAACGTGGGC AAATCAACGC

101 TGATGAACCA TCTCATCGGT CAGAAAATCA GTATTACCAG CAAAAAGGCG

151 CAGACGACGC GCAACCGCGT AACGGGGATT TATACCGACG ATACCGCGCA

201 GTTCGTGTTT GTCGATACGC CGGGCTTTCA AACCGACCAC CGCAACGCGC

251 TCAACGACAG GCTGAATCAA AATGTTACCG AGGCGCTCGG CGGTGTGGAT

301 GTGGTGGTTT TCGTCGTGGA GGCGATGCGC CTTACCGATG CCGACCGCGT

351 CGTGTTGAAA CAACTGCCCA AGCACACGCC GGTCATTTTA GTGATCAACA

401 AAATCGACAA GGACAAGGCG AAAGACCGTT ACGCGCTGGA GGCGTTTGTT

451 GCCCAAGTGC GCGCCGAATT TGAATTTGCG GCGGCGGAGG CGGTCAGTGC

501 GAAACACGGT TTGCGGATTG CCAACCTGTT GGAGCTGCTC AAGCCGTATC

551 TGCCCGAAAG CGTACCGATG TATCCCGAAG ACATGGTTAC GGACAAATCG

601 GCGCGTTTTT TGGCGATGGA AATCGTGCGT GAAAAACTCT TCCGCTATTT

651 GGGCGAGGAG CTGCCTTATG CGATGAACGT CGAAGTGGAG CAGTTTGAAG

701 AGGGAGACGG TTTGAACCGC ATCTACatcg cCGTTTTGGT CGACAAAGAA

751 AGCCAAAAGG CGATTTTGAT CGGTAAAGGC GGGGAGCGTT TGAAAAAAAT

801 TTCCACCGAA GCGCGGCTGG ATATGGAAAA ACTGTTTGAT AACAAAGTAT

851 TTTTGAAGGT CTGGGTCAAA GTCAAATCCG GTTGGGCAGA CGACATTCGC

901 TTCCTGCGCG AGCTGGGTTT GTAG
```

This corresponds to the amino acid sequence <SEQ ID 2208; ORF 673.ng>:

```
g673.pep
    1 MDIETFLAGE RAAGGYRCGF VAIVGRPNVG KSTLMNHLIG QKISITSKKA

51 QTTRNRVTGI YTDDTAQFVF VDTPGFQTDH RNALNDRLNQ NVTEALGGVD

101 VVVFVVEAMR LTDADRVVLK QLPKHTPVIL VINKIDKDKA KDRYALEAFV

151 AQVRAEFEFA AAEAVSAKHG LRIANLLELL KPYLPESVPM YPEDMVTDKS

201 ARFLAMEIVR EKLFRYLGEE LPYAMNVEVE QFEEGDGLNR IYIAVLVDKE

251 SQKAILIGKG GERLKKISTE ARLDMEKLFD NKVFLKVWVK VKSGWADDIR

301 FLRELGL*
```

The following partial DNA sequence was identified in *N. meningitidis* <SEQ ID 2209>:

```
m673.seq
   1 ATGGATATTG AAACCTTCCT TGCAGGGGAA CGCGCCGCCG GCGGATACCG

51 TTGCGGCTTC GTAGCGATTG TCGGCCGTCC GAACGTGGGC AAATCAACGC

101 TGATGAACCA TCTCATCGGT CAGAAAATCA GTATTACCAG CAAAAAGGCG

151 CAGACGACGC GCAACCGCGT AACGGGGATT TATACCGACG ATACCGCGCA

201 GTTCGTGTTT GTCGATACGC CCGGCTTT

```
                 130        140        150        160        170        180
m673.pep  QLPKHTPVILVVNKIDKDKAKDRYALEAFVAQVRAEFEFAAAEAVSAKHGLRIANLLELI
          ||||||||||||:||||||||||||||||||||||||||||||||||||||||||||||:
g673      QLPKHTPVILVINKIDKDKAKDRYALEAFVAQVRAEFEFAAAEAVSAKHGLRIANLLELL
                 130        140        150        160        170        180

190        200        210        220        230        240
m673.pep  KPYLPESVPMYPEDMVTDKSARFLAMEIVREKLFRYLGEELPYAMNVEVEQFEEEDGLNR
          ||||||||||||||||||:|||||||||||||||||||||||||||||||||||| |||||
g673      KPYLPESVPMYPEDMVTKDSARFLAMEIVREKLFRYLGEELPYAMNVEVEQFEEGDLNR
                 190        200        210        220        230        240

250        260        270        280        290        300
m673.pep  IYIAVLVDKESQKAILIGKGGERLKKISTEARLDMEKLFDTKVFLKVWVKVKSGWADDIR
          |||||||||||||||||||||||||||||||||||||||||:||||||||||||||||||
g673      IYIAVLVDKESQKAILIGKGGERLKKISTEARLDMEKLFDNKVFLKVWVKVKSGWADDIR
                 250        260        270        280        290        300 m673.pep  FLRELGLX
          ||||||||
g673      FLRELGLX
```

The following partial DNA sequence was identified in *N. meningitidis* <SEQ ID 2211>:

```
673.seq
  1 ATGGATATTG AAACCTTCCT TGCAGGGGAA CGCGCCGCCG ACGGATACCG

51 TTGCGGCTTC GTAGCGATTG TCGGCCGTCC GAACGTGGGC AAATCAACGC

101 TGATGAATCA TCTCATCGGT CAGAAAATCA GTATTACCAG CAAAAAGG

```
201 ARFLAMEIVR EKLFRYLGEE LPYAMNVEVE QFEEEDGLNR IYIAVLVDKE

251 SQKAILIGKG GERLKKISTE ARLDMEKLFD TKVFLKVWVK VKSGWADDIR

301 FLREIGL* m673/a673  99.7% identity in 307 aa overlap
                  10        20        30        40        50        60
m673.pep  MDIETFLAGERAAGGYRCGFVAIVGRPNVGKSTLMNHLIGQKISITSKKAQTTRNRVTGI
          ||||||||||| ||||||||||||||||||||||||||||||||||||||||||||||||
a673      MDIETFLAGERAADGYRCGFVAIVGRPNVGKSTLMNHLIGQKISITSKKAQTTRNRVTGI
                  10        20        30        40        50        60

70        80        90       100       110       120
m673.pep  YTDDTAQFVFVDTPGFQTDHRNALNDRLNQNVTEALGGVDVVVFVVEAMRFTDADRVVLK
          ||||||||||||||||||||||||||||||||||||||||||||||||||||||||||||
a673      YTDDTAQFVFVDTPGFQTDHRNALNDRLNQNVTEALGGVDVVVFVVEAMRFTDADRVVLK
                  70        80        90       100       110       120

130       140       150       160       170       180
m673.pep  QLPKHTPVILVVNKIDKDKAKDRYALEAFVAQVRAEFEFAAAEAVSAKHGLRIANLLELI
          ||||||||||||||||||||||||||||||||||||||||||||||||||||||||||||
a673      QLPKHTPVILVVNKIDKDKAKDRYALEAFVAQVRAEFEFAAAEAVSAKHGLRIANLLELI
                 130       140       150       160       170       180

190       200       210       220       230       240
m673.pep  KPYLPESVPMYPEDMVTDKSARFLAMEIVREKLFRYLGEELPYAMNVEVEQFEEEDGLNR
          ||||||||||||||||||||||||||||||||||||||||||||||||||||||||||||
a673      KPYLPESVPMYPEDMVTDKSARFLAMEIVREKLFRYLGEELPYAMNVEVEQFEEEDGLNR
                 190       200       210       220       230       240

250       260       270       280       290       300
m673.pep  IYIAVLVDKESQKAILIGKGGERLKKISTEARLDMEKLFDTKVFLKVWVKVKSGWADDIR
          ||||||||||||||||||||||||||||||||||||||||||||||||||||||||||||
a673      IYIAVLVDKESQKAILIGKGGERLKKISTEARLDMEKLFDTKVFLKVWVKVKSGWADDIR
                 250       260       270       280       290       300 m673.pep  FLRELGLX
          ||||||||
a673      FLRELGLX
```

The following partial DNA sequence was identified in *N. gonorrhoeae* <SEQ ID 2213>:

```
g674.seq
  1 ATGAAAACAG CCCGCCGCCG TTCCCGCGAG CTTGCCGTAC AAGCCGTTTA

51 CCAATCCCTT ATCAACCGCA CCGCCGCGCC CGAAATTGCT AAAAACATCC

101 GCGAAATGTC CGACTTTGCC AAAGCGGACG AAGAATTGTT CAACAAACTC

151 TTCTTCGGCA CACAAACCAA TGCAGCGGAC TACATCCAAA AAATCCGCCC

201 GCTGCTCGAC AGGGACGAAA AAGACCTCAA CCCCATCGAA CGCGCCGTTT

251 TGCTGACCGC CTGCCACGAG CTTTCCGCTA TGCCCGAAAC GCCCTACCCC

301 GTCATTATCA ACGAAGCCAT CGAAGTTACC AAAACCTTCG GCGGCACGGA

351 CGGGCACAAA TTCGTCAACG GCATCCTCGA CAAACTCGCC GCCCAAATCC

401 GCCCAGACGA GCCCAAACGC CGTTGA
```

This corresponds to the amino acid sequence <SEQ ID 2214; ORF 674.ng>:

```
g674.pep
  1 MKTARRRSRE LAVQAVYQSL INRTAAPEIA KNIREMSDFA KADEELFNKL

51 FFGTQTNAAD YIQKIRPLLD RDEKDLNPIE RAVLLTACHE LSAMPETPYP

101 VIINEAIEVT KTFGGTDGHK FVNGILDKLA AQIRPDEPKR R*
```

The following partial DNA sequence was identified in *N. meningitidis* <SEQ ID 2215>:

```
m674.seq
    1 ATGAAAACAG CCCGCCGCCG TTCCCGCGAG CTTGCCGTAC AAGCCGTTTA

51 CCAATCCCTT ATCAACCGCA CCGCCGCGCC CGAAATTGCT AAAAACATCC

101 GCGAAATGTC CGACTTTGCC AAGGCAGACG AAGAATTGTT CAACAAACTT

151 TTCTTCGGCA CGCAAACCAA TGCGGCAGAG TATATCCGAC AAATCCGCCC

201 GCTACTTGAC AGGGACGAAA AAGACCTCAA CCCCATCGAA CGCGCCGTTT

251 TGCTGACCGC CTGCCACGAG CTGTCCGCCA TGCCCGAAAC GCCCTACCCC

301 GTCATTATCA ACGAAGCCAT CGAAGTTACC AAAACCTTCG GCGGCACGGA

351 CGGGCACAAA TTCGTCAACG GCATCCTCGA CAAACTCGCC GCCCAAATCC

401 GCCCCGACGA GCCCAAACGC CGTTGA
```

This corresponds to the amino acid sequence <SEQ ID 2216; ORF 674>:

```
m674.pep
    1 MKTARRRSRE LAVQAVYQSL INRTAAPEIA KNIREMSDFA KADEELFNKL

51 FFGTQTNAAE YIRQIRPLLD RDEKDLNPIE RAVLLTACHE LSAMPETPYP

101 VIINEAIEVT KTFGGTDGHK FVNGILDKLA AQIRPDEPKR R*
```

Computer analysis of this amino acid sequence gave the following results:
Homology with a Predicted ORF from *N. gonorrhoeae*

```
    m674/g674   97.9% identity in 141 aa overlap
                        10         20         30         40         50         60
        m674.pep    MKTARRRSRELAVQAVYQSLINRTAAPEIAKNIREMSDFAKADEELFNKLFFGTQTNAAE
                    |||||||||||||||||||||||||||||||||||||||||||||||||||||||||||:
        g674        MKTARRRSRELAVQAVYQSLINRTAAPEIAKNIREMSDFAKADEELFNKLFFGTQTNAAD
                        10         20         30         40         50         60

70         80         90        100        110        120
        m674.pep    YIRQIRPLLDRDEKDLNPIERAVLLTACHELSAMPETPYPVIINEAIEVTKTFGGTDGHK
                    ||::||||||||||||||||||||||||||||||||||||||||||||||||||||||||
        g674        YIQKIRPLLDRDEKDLNPIERAVLLTACHELSAMPETPYPVIINEAIEVTKTFGGTDGHK
                        70         80         90        100        110        120

130        140
        m674.pep    FVNGILDKLAAQIRPDEPKRRX
                    ||||||||||||||||||||||
        g674        FVNGILDKLAAQIRPDEPKRRX
                       130        140
```

The following partial DNA sequence was identified in *N. meningitidis* <SEQ ID 2217>:

```
a674.seq
    1 ATGAAAACAG CCCGCCGCCG TTCCCGCGAG CTTGCCGTAC AAGCCGTTTA

51 CCAATCCCTT ATCAACCGCA CCGCCGCGCC CGAGATTGCT AAAAACATCC

101 GCGAAATGCC CGACTTTGCC AAGGCAGACG AAGAATTGTT CAACAAACTT

151 TTCTTCGGCA CGCAAACCAA TGCGGCAGAG TACATCCGAC AAATCCGCCC

201 CCTGCTCGAC CGCGACGAAA AAGACCTCAA CCCCATCGAA CGCGCCGTCC

251 TGCTGACCGC CTGCCACGAG CTGTCCGCCA TGCCCGAAAC GCCCTACCCC

301 GTCATCATCA ACGAAGCCAT CGAAGTAACC AAAACCTTCG GCGGCACGGA
```

```
-continued
351 CGGGCACAAA TTCGTCAACG GCATCCTCGA CAAACTCGCC GCCCAAATCC

401 GTCCCGACGA GCCCAAACGC CGTTGA
```

This corresponds to the amino acid sequence <SEQ ID 2218; ORF 674.a>:

```
a674.pep
     1  MKTARRRSRE LAVQAVYQSL INRTAAPEIA KNIREMPDFA KADEELFNKL

51  FFGTQTNAAE YIRQIRPLLD RDEKDLNPIE RAVLLTACHE LSAMPETPYP

101  VIINEAIEVT KTFGGTDGHK FVNGILDKLA AQIRPDEPKR R* m674/a674  99.3% identity in 141 aa overlap
                    10         20         30         40         50         60
m674.pep    MKTARRRSRELAVQAVYQSLINRTAAPEIAKNIREMSDFAKADEELFNKLFFGTQTNAAE
            ||||||||||||||||||||||||||||||||||| |||||||||||||||||||||||
a674        MKTARRRSRELAVQAVYQSLINRTAAPEIAKNIREMPDFAKADEELFNKLFFGTQTNAAE
                    10         20         30         40         50         60

70         80         90        100        110        120
m674.pep    YIRQIRPLLDRDEKDLNPIERAVLLTACHELSAMPETPYPVIINEAIEVTKTFGGTDGHK
            ||||||||||||||||||||||||||||||||||||||||||||||||||||||||||||
a674        YIRQIRPLLDRDEKDLNPIERAVLLTACHELSAMPETPYPVIINEAIEVTKTFGGTDGHK
                    70         80         90        100        110        120

130        140
m674.pep    FVNGILDKLAAQIRPDEPKRRX
            ||||||||||||||||||||||
a674        FVNGILDKLAAQIRPDEPKRRX
                    130        140
```

The following partial DNA sequence was identified in *N. gonorrhoeae* <SEQ ID 2219>:

```
g675.seq
    1  ATGAACACCA TCGCCCCcaa cctcgacgGC AAACACCTCC GCATCGGCAT

51  CGTACAGGCA CGCTTCACCA ACGAAATCGG CAGCCAAATG CTCAAAGTCT

101  GCTGCCGCAC CCTCCAAGAA TTGGGCGTAG CAGACGAAAa catcaccgtc 151  gCCACCGTAC CCGGCGCGCT TGAAATCCCC ATCGCGCTGA TGAACTTTGC

201  CTCTTCCGAA AAATTTGACG CACTGATTGC CATCGGCGTC GTCATCCGTG

251  GCGAAACCTA CCATTTCGAG CTGGTTGCCA ACGAATCCGG CGCAGGGATC

301  GGCCGCGTCG CACTCGACTA CAACATCCCG ATTGCCAACG CCGTCCTGAC

351  CACCGAAAAC GACGCGCAGG CAATTGAACG GATTGGAGAA AAAGCCTCGG

401  ATGCCGCCAA AGTCGCCGTA GAATGCGCCA ACCTCGTCAA CCTTCTGCTC

451  GAAGAACAGT TTGAAGACGA AGAATAA
```

This corresponds to the amino acid sequence <SEQ ID 2220; ORF 675.ng>:

```
g675.pep
    1  MNTIAPNLDG KHLRIGIVQA RFTNEIGSQM LKVCCRTLQE LGVADENITV

51  ATVPGALEIP IALMNFASSE KFDALIAIGV VIRGETYHFE LVANESGAGI

101  GRVALDYNIP IANAVLTTEN DAQAIERIGE KASDAAKVAV ECANLVNLLL

151  EEQFEDEE*
```

The following partial DNA sequence was identified in *N. meningitidis* <SEQ ID 2221>:

```
m675.seq
   1 ATGAACACCA TCGCCCCCAA CCTCGACGGC AAACACCTCC GCATCGGCAT

51 CGTACAGGCA CGCTTCACCA ACGAAATCGG CAGCGAAATG CTCAAAGTCT

101 GCTGCCGCAC CCTCCAAGAA TTGGGCGTGG CAGACGAAAA CATTACCGTC

151 GCCACCGTAC CCGGCGCGCT TGAAATCCCC ATCGCGCTGA TGAACTTTGC

201 CTCTTCCGAA AAGTTTGACG CACTGATTGC CATCGGCGTC GTCATCCGTG

251 GCGAAACCTA CCATTTCGAG CTGGTTTCCA ACGAATCCGG AGCAGGCGTC

301 AGCCGCGTCG CACTCGACTA CAATATCCCG ATTGCCAATG CCGTCCTAAC

351 CACCGAAAAC GACGCGCAGG CAATCGAACG GATTGAAGAA AAAGCCTCGG

401 ATGCCGCCAA AGTCGCCGTC GAATGCGCCA ACCTCGTCAA CCTGCTGCTC

451 GAAGAACAGT TTGAAGACGA AGAATAA
```

This corresponds to the amino acid sequence <SEQ ID 2222; ORF 675>:

```
m675.pep
   1 MNTIAPNLDG KHLRIGIVQA RFTNEIGSEM LKVCCRTLQE LGVADENITV

51 ATVPGALEIP IALMNFASSE KFDALIAIGV VIRGETYHFE LVSNESGAGV

101 SRVALDYNIP IANAVLTTEN DAQAIERIEE KASDAAKVAV ECANLVNLLL

151 EEQFEDEE*
```

Computer analysis of this amino acid sequence gave the following results:
Homology with a Predicted ORF from *N. gonorrhoeae*

```
    m675/g675  96.8% identity in 158 aa overlap
                       10         20         30         40         50         60
        m675.pep   MNTIAPNLDGKHLRIGIVQARFTNEIGSEMLKVCCRTLQELGVADENITVATVPGALEIP
                   ||||||||||||||||||||||||||||||:||||||||||||||||||||||||||||
        g675       MNTIAPNLDGKHLRIGIVQARFTNEIGSQMLKVCCRTLQELGVADENITVATVPGALEIP
                       10         20         30         40         50         60

70         80         90        100        110        120
        m675.pep   IALMNFASSEKFDALIAIGVVIRGETYHFELVSNESGAGVSRVADKYNIPIANAVLTTEN
                   |||||||||||||||||||||||||||||||||:||||::||||||||||||||||||
        g675       IALMNFASSEKFDALIAIGVVIRGETYHFELVANESGAGIGRVALDYNIPIANAVLTTEN
                       70         80         90        100        110        120

130        140        150    159
        m675.pep   DAQAIERIEEKASDAAKVAVECANLVNLLLEEQFEDEEX
                   |||||||| ||||||||||||||||||||||||||||||
        g675       DAQAIERIGEKASDAAKVAVECANLVNLLLEEQFEDEEX
                      130        140       150
```

The following partial DNA sequence was identified in *N. meningitidis* <SEQ ID 2223>:

```
a675.seq
   1 ATGAACACCA TCGCCCCCAA CCTCGACGGC AAACACCTCC GCATCGGCAT

51 CGTACAGGCA CGCTTCACCA ACGAAATCGG CAGCGAAATG CTCAAAGTCT

101 GCTGCCGCAC CCTCCAAGAA TTGGGCGTGG CAGACGAAAA CATTACCGTC

151 GCCACCGTAC CCGGCGCGCT TGAAATCCCC ATCGCGCTGA TGAACTTTGC

201 CTCTTCTGAA AAATTTGACG CACTGATTGC CATCGGCGTC GTTATCCGTG
```

```
-continued
251 GCGAAACCTA CCATTTCGAG CTGGTTTCCA ACGAATCCGG AGCAGGGGTC

301 AGCCGCGTCG CACTCGACTA CAACATCCCG ATTGCCAATG CCGTCCTGAC

351 CACGGAAAAC GACGCACAGG CAATCGAACG GATTGAAGAA AAAGCCTCGG

401 ATGCCGCCAA AGTCGCCGTA GAATGCGCCA ACCTCGTCAA CCTCCTGCTC

451 GAAGAACAGT TTGAAGACGA AGAATAA
```

This corresponds to the amino acid sequence <SEQ ID 2224; ORF 675.a>:

```
a675.pep
      1  MNTIAPNLDQ KHLRIGIVQA RFTNEIGSEM LKVCCRTLQE LGVADENITV

51  ATVPGALEIP IALMNFASSE KFDALIAIGV VIRGETYHFE LVSNESGAGV

101  SRVALDYNIP IANAVLTTEN DAQAIERIEE KASDAAKVAV ECANLVNLLL

151  EEQFEDDEE* m675/a675  100.0% identity in 158 aa overlap
                   10          20        30        40        50        60
m675.pep  MNTIAPNLDGKHLRIGIVQARFTNEIGSEMLKVCCRTLQELGVADENITVATVPGALEIP
          ||||||||||||||||||||||||||||||||||||||||||||||||||||||||||||
a675      MNTIAPNLDGKHLRIGIVQARFTNEIGSEMLKVCCRTLQELGVADENITVATVPGALEIP
                   10        20        30        40        50        60

70        80        90       100       110       120
m675.pep  IALMNFASSEKFDALIAIGVVIRGETYHFELVSNESGAGVSRVALDYNIPIANAVLTTEN
          ||||||||||||||||||||||||||||||||||||||||||||||||||||||||||||
a675      IALMNFASSEKFDALIAIGVVIRGETYHFELVSNESGAGVSRVALDYNIPIANAVLTTEN
                   70        80        90       100       110       120

130       140       150     159
m675.pep  DAQAIERIEEKASDAAKVAVECANLVNLLLEEQFEDEEX
          |||||||||||||||||||||||||||||||||||||||
a675      DAQAIERIEEKASDAAKVAVECANLVNLLLEEQFEDEEX
                  130       140      150
```

The following partial DNA sequence was identified in *N. gonorrhoeae* <SEQ ID 2225>:

```
g677.seq
   1 ATGCCGCAGA TTTTGGTGCG GATTTTCCTC ATTCGGTATT CCTTTATTtg 51 ggAAACGGTG CGCTTGTGCC GTTTCAGACG GCATTCCCGA TCAGTCGATT

101 TTGATGTATT CGACAGAAAG GATTTCAATT TCCTCACGGC CTTCCGGCGT

151 GTTCAAAACC ACTTCGTCGC CTTCGCGCGC TTTAATCAGG CAACGCGCCA

201 ACGGCGAAAT CCAAGAAATT TGTTTTGCG CGGTATCGAT TTCATCGACG

251 CCGACGATTT TGACGGTTTG CTCGCGCCCG TCGCCGCGCA ACAGACCGAC

301 GGTCGCGCCG AAAAATACTT GGTCGGTCGC TTCGCGCAAT TCGGGATCGA

351 CGACGACGGC AGCCTCCAAA CGTTTGGTCA GGAAACGGAT GCGGCGGTCG

401 ATTTCGCGCA TACGGCGTTT GCCGTAAAGA TAGTCGCCGT TTTCGCTGCG

451 GTCGCCGTTG CCTGCCGCCC AGTTGACGAT TTGGACGATT TCGGGCGTT

501 CTTTATTGAC CAGTTGATAA AGCTCGTCTT TCAATGCCTG CCATCCGGCG

551 GGCGTAATGT AGTTTTTGGT TTCGGTACTC ATATTGTGTG CGGATGA
```

This corresponds to the amino acid sequence <SEQ ID 2226; ORF 677.ng>:

```
g677.pep
   1 MPQILVRIFL IRYSFIWETV RLCRFRRHSR SVDFDVFDRK DFNFLTAFRR

51 VQNHFVAFAR FNQATRQRRN PRNFVLRGID FIDADDFDGL LAPVAAQQTD

101 GRAEKYLVGR FAQFGIDDDG SLQTFGQETD AAVDFAHTAF AVKIVAVFAA

151 VAVACRPVDD LDDFGAFFID QLIKLVFQCL PSGGRNVVFG FGTHIVCG*
```

The following partial DNA sequence was identified in *N. meningitidis* <SEQ ID 2227>:

```
m677.seq
   1 ATGCCGCAGA TTTTGGTGCG GATTTTCCTC ATTCGGTATT CCTTTATTTG

51 GGAAACGGCG CGCTTTTGCC GTTTCAGACG GCATTCCCGA TCAGTCGATT

101 TTGATGTATT CGACAGAAAG GATTTCAATT TCCTCACGCC CTTCCGGCGT

151 GTTCAAAACC ACTTCGTCGC CTTCGCGCGC TTTAATCAGA CAACGAGCCA

201 GCGGCGAAAT CCAAGAAATT TGTTTTGCG CGGTATCGAT TTCATCGATG

251 CCGACGATTT TGACGGTTTG CTCGCGCCCG TCGTCGCGCA ACAGTCCGAC

301 CGTCGCGCCG AAAAACACTT GGTCGGTCGC TTCGCGCAAT TCGGGATCGA

351 CGACGACGGC AGCCTCCAAA CGTTTGGTCA GGAAACGGAT GCGGCGGTCG

401 ATTTCGCGCA TACGGCGTTT GCCGTAAAGA TAGTCGCCGT TTTCGCTGCG

451 GTCGCCGTTG CCTGCCGCCC AGTTGACGAT TTGGACGATT TCGGGGCGTT

501 CTTTGTTGAC CAGTTGATAA AGCTCGTCTT TCAATGCCTG CCATCCGGCG

551 GGCGTAATGT AGTTTTTGGT TTCGGTACTC ATATTGTGTG CGGATGA
```

This corresponds to the amino acid sequence <SEQ ID 2228; ORF 677>:

```
m677.pep
   1 MPQILVRIFL IRYSFIWETA RFCRFRRHSR SVDFDVFDRK DFNFLTPFRR

51 VQNHFVAFAR FNQTTSQRRN PRNFVLRGID FIDADDFDGL LAPVVAQQSD

101 RRAEKHLVGR FAQFGIDDDG SLQTFGQETD AAVDFAHTAF AVKIVAVFAA

151 VAVACRPVDD LDDFGAFFVD QLIKLVFQCL PSGGRNVVFG FGTHIVCG*
```

Computer analysis of this amino acid sequence gave the following results:
Homology with a Predicted ORF from *N. gonorrhoeae*

```
   m677/g677  94.9% identity in 198 aa overlap
                     10         20         30         40         50         60
        m677.pep  MPQILVRIFLIRYSFIWETARFCRFRRHSRSVDFDVFDRKDFNFLTPFRRVQNHFVAFAR
                  ||||||||||||||||||||:|:||||||||||||||||||||||||| ||||||||||
            g677  MPQILVRIFLIRYSFIWETVRLCRFRRHSRSVDFDVFDRKDFNFLTAFRRVQNHFVAFAR
                     10         20         30         40         50         60

70         80         90        100        110        120
        m677.pep  FNQTTSQRRNPRNFVLRGIDFIDADDFDGLLAPVVAQQSDRRAEKHLVGRFAQFGIDDDG
                  |||:| |||||||||||||||||||||||||||||:|||:| ||||:|||||||||||||
            g677  FNQATRQRRNPRNFVLRGIDFIDADDFDGLLAPVAAQQTDGRAEKYLVGRFAQFGIDDDG
                     70         80         90        100        110        120

130        140        150        160        170        180
        m677.pep  SLQTFGQETDAAVDFAHTAFAVKIVAVFAAVAVACRPVDDLDDFGAFFVDQLIKLVFQCL
                  ||||||||||||||||||||||||||||||||||||||||||||||||:|||||||||||
            g677  SLQTFGQETDAAVDFAHTAFAVKIVAVFAAVAVACRPVDDLDDFGAFFIDQLIKLVFQCL
                    130        140        150        160        170        180
```

```
            190       199
m677.pep   PSGGRNVVFGFGTHIVCGX
           |||||||||||||||||||
g677       PSGGRNVVFGFGTHIVCGX
            190
```

The following partial DNA sequence was identified in *N. meningitidis* <SEQ ID 2229>:

```
a677.seq
  1 ATGCCGCAGA TTTTGGTGCG GATTTTCCTC ATTCGGTATT CCTTTATTTG

51 GGAAACGGCG CGTTTGTGCC GTTTCAGACG GCATTCCCGA TCAGTCGATT

101 TTGATGTATT CGACAGAAAG GATTTCAATT TCCTCACGCC CTTCCGGCGT

151 GTTTAAAACC ACTTCGTCGC CTTCACGCGC TTTAATCAGA CAACGAGCCA

201 GCGGCGAAAT CCAAGAAATT TTGTTTTGCG CGGTATCGAT TTCATCGATG

251 CCGACGATTT TGACGGTTTG CTCGCGCCCG TCGCCGCGCA ACAGACCGAC

301 GGTCGCGCCG AAAAACACTT GGTCGGTCGC TTCGCGCAAT TCGGGATCAA

351 CGACGACGGC GGCTTCCAAA CGCTTGGTCA GGAAACGGAT GCGGCGGTCG

401 ATTTCGCGCA TACGGCGTTT GCCGTAAAGG TAGTCGCCGT TTTCGCTGCG

451 GTCGCCGTTG CCTGCCGCCC AGTTGACGAT TTGGACGATT TCGGGCGTT

501 CTTTATTAAC CAGTTGATAA AGCTCGTCTT TCAATGCCTG CCATCCGGCG

551 GGCGTAATGT AGTTTTTGGT TTCGGTACTC ATATTGTGTG CGGATGA
```

This corresponds to the amino acid sequence <SEQ ID 2230; ORF 677.a>:

```
a677.pep

1 MPQILVRIFL IRYSFIWETA RLCRFRRHSR SVDFDVFDRK DFNFLTPFRR

51 V*NHFVAFTR FNQTTSQRRN PRNFVLRGID FIDADDFDGL LAPVAAQQTD

101 GRAEKHLVGR FAQFGINDDG GFQTLGQETD AAVDFAHTAF AVKVVAVFAA

151 VAVACRPVDD LDDFGAFFIN QLIKLVFQCL PSGGRNVVFG FGTHIVCG*
``` m677/a677 93.4% identity in 198 aa overlap

```
                10         20         30         40         50         60
m677.pep   MPQILVRIFLIRYSFIWETARFCRFRRHSRSVDFDVFDRKDFNFLTPFRRVQNHFVAFAR
           ||||||||||||||||||||| ||||||||||||||||||||||||||||| ||||||:|
a677       MPQILVRIFLIRYSFIWETARLCRFRRHSRSVDFDVFDRKDFNFLTPFRRVXNHFVAFTR
                10         20         30         40         50         60

70         80         90        100        110        120
m677.pep   FNQTTSQRRNPRNFVLRGIDFIDADDFDGLLAPVVAQQSDRRAEKHLVGRFAQFGIDDDG
           |||||||||||||||||||||||||||||||||||:|||:||||||||||||||||||||
a677       FNQTTSQRRNPRNFVLRGIDFIDADDFDGLLAPVAAQQTDGRAEKHLVGRFAQFGINDDG
                70         80         90        100        110        120

130        140        150        160        170        180
m677.pep   SLQTFGQETDAAVDFAHTAFAVKIVAVFAAVAVACRPVDDLDDFGAFFVDQLIKLVFQCL
           ::||:|||||||||||||||||:|||||||||||||||||||||||||::||||||||||
a677       GFQTLGQETDAAVDFAHTAFAVKVVAVFAAVAVACRPVDDLDDFGAFFINQLIKLVFQCL
               130        140        150        160        170        180

190       199
m677.pep   PSGGRNVVFGFGTHIVCGX
           |||||||||||||||||||
a677       PSGGRNVVFGFGTHIVCGX
               190
```

The following partial DNA sequence was identified in *N. gonorrhoeae* <SEQ ID 2231>:

```
g678.seq
    1 ATGAATAGCC TCCCCATTGC CGACCTCCTC GCCTccgCCG TCATCGCCGC

51 CTGCATCGTC ATTTCCACGA TGCGCGGCGT GATTGCGGAA GCAggttcGA

101 TGGTgGCATG ggtggTTTcc tTCTTTTttg ccAAACTCTt tGCCGCACcc 151 ttcgccgACC TCGCCTTTGc ctCGTTCCAA ccccgccTGT TTGCAttggc 201 tCTGTCATTC ATTTCCCTGT TCGTCATTGC CTGTCTGATC CAGAAAATGC

251 TCCGTTCGCT GCTGACCGGC GCAGTTTCGG CGGTCGGTCT GGGCTTTGCC

301 AACCGCATTT GGGCGGTGT ATTCGGTGCA TTGAAAGGCG TTTTGATTGT

351 TACCCTGCTG ATCATGCTTG CTTCAAAAAC CGACCTGCCC GATACCGAAG

401 AATGGCAACA GTCCTATACC GTACCGTTTT TCGTATCGCT TTCCGAAGCG

451 GTGTTAAACC atacggaCAA CGCacccgaa tCCCtcgacg acgactaa
```

This corresponds to the amino acid sequence <SEQ ID 2232; ORF 678.ng>:

```
g678.pep
    1 MNSLPIADLL ASAVIAACIV ISTMRGVIAE AGSMVAWVVS FFFAKLFAAP

51 FADLAFASFQ PRLFALALSF ISLFVIACLI QKMLRSLLTG AVSAVGLGFA

101 NRILGGVFGA LKGVLIVTLL IMLASKTDLP DTEEWQQSYT VPFFVSLSEA

151 VLNHTDNAPE SLDDD*
```

The following partial DNA sequence was identified in *N. meningitidis* <SEQ ID 2233>:

```
m678.seq
    1 ATGAATAGCC TCCCCATTGC CGACCTCCTC GTCTCCGCCG TCATCGCCGC

51 CTGCATCGTG CTATCCGCGA TGCGCGGCGT GATTGCGGAG GCAGGCTCAA

101 TGGCGGCATG GGTGGTTTCC TTCTTTTTCG CCAAACTCTT TGCCGCCTCC

151 TTCGCCGACC TCGCCTTTGC CTCGTTCCAA CCCCGCCTGT TTGCATTGGC

201 TCTGTCGTTC ATTTCCCTGT TCGTCATTGC CTGTCTGATC CAGAAAATGC

251 TCCGTTCGCT GCTGACCAGC GCAGTTTCGG CGGTCGGTTT GGGCTTTGCC

301 AACCGCATTT GGGCGGCGT ATTCGGTGCA TTGAAAGGCG TTTTGATTGT

351 TACCCTGCTG GTCATGCTTG CTTCAAAAAC CGACCTGCCC GATACCGAAG

401 AATGGCGGCA ATCTTACACA CTGCCGTTTT TCGTATCGCT TTCCGAAGCC

451 GTGTTGAACC ATAGCGGCGG CACGGCGGAA ACTCCGGAAG ACGATTGA
```

This corresponds to the amino acid sequence <SEQ ID 2234; ORF 678>:

```
m678.pep
    1 MNSLPIADLL VSAVIAACIV LSAMRGVIAE AGSMAAWVVS FFFAKLFAAS

51 FADLAFASFQ PRLFALALSF ISLFVIACLI QKMLRSLLTS AVSAVGLGFA

101 NRILGGVFGA LKGVLIVTLL VMLASKTDLP DTEEWRQSYT LPFFVSLSEA

151 VLNHSGGTAE TPEDD*
```

Computer analysis of this amino acid sequence gave the following results:
Homology with a Predicted ORF from *N. gonorrhoeae*

```
m678/g678  89.7% identity in 165 aa overlap 10         20         30         40         50         60
    m678.pep  MNSLPIADLLVSAVIAACIVLSAMRGVIAEAGSMAAWVVSFFFAKLFAASFADLAFASFQ
              ||||||||||:|||||||||:|:|||||||||||:||||||||||||| |||||||||||
    g678      MNSLPIADLLASAVIAACIVISTMRGVIAEAGSMVAWVVSFFFAKLFAAPFADLAFASFQ
                   10         20         30         40         50         60

70         80         90        100        110        120
    m678.pep  PRLFALALSFISLFVIACLIQKMLRSLLTSAVSAVGLGFANRILGGVFGALKGVLIVTLL
              ||||||||||||||||||||||||||||||:|||||||||||||||||||||||||||||
    g678      PRLFALALSFISLFVIACLIQKMLRSLLTGAVSAVGLGFANRILGGVFGALKGVLIVTLL
                   70         80         90        100        110        120

130        140        150        160
    m678.pep  VMLASKTDLPDTEEWRQSYTLPFFVSLSEAVLNHSGGTAETPEDDX
              :|||||||||||||:||||:|||||||||||:  |: |: :|||
    g678      IMLASKTDLPDTEEWQQSYTVPFFVSLSEAVLNHTDNAPESLDDDX
                  130        140        150        160
```

The following partial DNA sequence was identified in *N. meningitidis* <SEQ ID 2235>:

```
a678.seq
  1 ATGAATAACC TCCCCGTTGC CGACCTCCTC GTCTCCGCCA TCATCGCCGC

51 CTGCATCGTG CTATCCGCGA TGCGCGGCGT GATTGCGGAG GCTGGCTCAA

101 TGGCGGCATG GGTGGTTGCC TTTTTTTTCG CCAAACTCTT TGCCGCACCC

151 TTCGCCGACA TCGCCTTTGC ATCGTTCCAA CCCCGCCTGT TTGCATTGGC

201 TCTGTCGTTC ATTTCCCTAT TCGTCATTGC CTGTCTGATC CAGAAAATAC

251 TCCGCTCGCT GCTGACCGGG GCAGTTTCGG CGGTCGGTTT GGGCTTTGCC

301 AACCGCATTT TGGGCGGCGT ATTCGGTGCA TTGAAAGGCA TTTTGATTAT

351 TACCCTGCTG GTCATGCTCG CTTCAAAAAC CGACCTGCCC GATACCGAAG

401 AATGGCGGCA ATCTTACACA CTGCCGTTTT TCGTATCGCT TTCCGAAGCC

451 GTGTTGAACC ATAGCGGCGG CACGGCGGAA ACTCCGGAAG ACGATTGA
```

This corresponds to the amino acid sequence <SEQ ID 2236; ORF 678.a>:

```
a678.pep

1  MNNLPVADLL VSAIIAACIV LSAMRGVIAE AGSMAAWVVA FFFAKLFAAP

51  FADIAFASFQ PRLFALALSF ISLFVIACLI QKILRSLLTG AVSAVGLGFA

101  NRILGGVFGA LKGILIITLL VMLASKTDLP DTEEWRQSYT LPFFVSLSEA

151  VLNHSGGTAE TPEDD* m678/a678  93.9% identity in 165 aa overlap 10         20         30         40         50         60
    m678.pep  MNSLPIADLLVSAVIAACIVLSAMRGVIAEAGSMAAWVVSFFFAKLFAASFADLAFASFQ
              ||:||:||||||:|||||||||||||||||||||||||||:||||||||||||:||||||
    a678      MNNLPVADLLVSAIIAACIVLSAMRGVIAEAGSMAAWVVAFFFAKLFAAPFADIAFASFQ
                   10         20         30         40         50         60

70         80         90        100        110        120
    m678.pep  PRLFALALSFISLFVIACLIQKMLRSLLTSAVSAVGLGFANRILGGVFGALKGVLIVTLL
              ||||||||||||||||||||||||:||||||:||||||||||||||||||||||||:||:|||
    a678      PRLFALALSFISLFVIACLIQKILRSLLTGAVSAVGLGFANRILGGVFGALKGILIITLL
                   70         80         90        100        110        120
```

```
                    130        140        150        160
m678.pep    VMLASKTDLPDTEEWRQSYTLPFFVSLSEAVLNHSGGTAETPEDDX
            ||||||||||||||||||||||||||||||||||||||||||||||
a678        VMLASKTDLPDTEEWRQSYTLPFFVSLSEAVLNHSGGTAETPEDDX
                    130        140        150        160
```

The following partial DNA sequence was identified in *N. gonorrhoeae* <SEQ ID 2237>:

```
g680.seq
   1 ATGACGAAGG GCAGTTCGGC GATGTCCAGC CCACGCGCGG CGATATCGGT

51 GGCGACGAGG ACGCGCAGGC TGCCGTCTTT GAAGGCGTTG AGTGTTTCGA

101 GCCTGCTTTG TTGGGAACGG TCGCCGTGTA TCGCCTGTGC GGACAGGTTG

151 CGGCGCACCA GTTCGCGCGT TACGCGGTCG ACGCTTTGTT TGGTtttgCA

201 AAAGACGATA ACTTGGTTCA TATGCAGATC GACAATCAGC CGTTCGAGCA

251 GGTTGCGCTT TTGGAAGGTA TCGACGGCGA TGATGTgttg ttcGACGTTG

301 GCGTTGGTGG TGTTTTGGGC GGCAACCTCG ACGGTTTCGG GCGCGTTCAT

351 GAAGTCTTGC GCCAGTTTGC GTATCGGTGC GGAGAAGGTG GCGGAAAAGA

401 GCAGGGTTTG GCGTTGGCGG GGCAGCATCT GCATGATTTT GCGGATGTCG

451 TCGATAAACC CCATATCCAA CATGCGGTCT GCTTCGTCCA GAACGACGAT

501 TTCGGCTTTG TTTAAACTGA TGTTTTTCTG TTTCACATGG TCGAGCAGCC

551 GTCCGACGGT GGCGACGACT ATTTCGCAGC CGGCACGCAG GTCGGCGGTT

601 TGTTTGTCCA TGTTGACACC GCCGAAGAGG ACGGTATGCC GCAGCGGCAG

651 GTTTTTAATg tag
```
                                                         35

This corresponds to the amino acid sequence <SEQ ID 2238; ORF 680.ng>:

```
g680.pep
   1 MTKGSSAMSS PRAAISVATR TRRLPSLKAL SVSSLLCWER SPCIACADRL

51 RRTSSRVTRS TLCLVLQKTI TWFICRSTIS RSSRLRFWKV STAMMCCSTL

101 ALVVFWAATS TVSGAFMKSC ASLRIGAEKV AEKSRVWRWR GSICMILRMS

151 SINPISNMRS ASSRTTISAL FKLMFFCFTW SSSRPTVATT ISQPARRSAV

201 CLSMLTPPKR TVCRSGRFLM *
```

The following partial DNA sequence was identified in *N. meningitidis* <SEQ ID 2239>:

```
m680.seq
   1 ATGACGAAGG GCAGTTCGGC AATGTCCAGC CCGCGCGCGG CGATGTCGGT

51 GGCGACGAGG ACGCGCAGGT TGCCGTCTTT GAAGGCGTTG AGTGTTTCGA

101 GCCGGCTTTG TTGGGAACGG TCGCCGTGTA TCGCCTGTGC GGACAGGTTG

151 CGGCGCACCA GTTCGCGCGT TACGCGGTCG ACGCTTTGTT TGGTTTTGCA

201 GAACACGATG ACCTGGTTCA TATGCAAATC GACAATCAGC CGTTCGAGCA

251 GGTTGCGCTT CTGAATGGTA TCGACGGCGA TGATGTGCTG CTCGACGTTG

301 GCGTTGGTGG TGTTTTGCGC GGCGACTTCG ACGGTTTCGG GCGCGTTCAT

351 GAAGTCTTGC GCCAGTTTGC GTATCGGGGC GGAGAAGGTG GCGGAAAAGA
```

-continued
```
401 GCAGGGTTTG GCGTTGGCGG GGCAGCATCT GCATGATTTT GCGGATGTCG

451 TCGATAAAAC CCATATCCAG CATACGGTCG GCTTCGTCCA AAACGACGAT

501 TTCGACTTTG TTCAAATGGA TGTTTTTCTG TTTCACGTGG TCGAGCAGCC

551 GTCCGACGGT GGCGACGACG ATTTCGCAGC CGGCACGCAG GTCGGCGGTC

601 TGTTTGTCCA TATTCATACC GCCGAACAAG ACGGTGTGGC GCAGCGGCAG

651 GTTTTTGATG TAG
```

This corresponds to the amino acid sequence <SEQ ID 2240; ORF 680>:

```
m680.pep
   1 MTKGSSAMSS PRAAMSVATR TRRLPSLKAL SVSSRLCWER SPCIACADRL

51 RRTSSRVTRS TLCLVLQNTM TWFICKSTIS RSSRLRF*MV STAMMCCSTL

101 ALVVFCAATS TVSGAFMKSC ASLRIGAEKV AEKSRVWRWR GSICMILRMS

151 SIKPISSIRS ASSKTTISTL FKWMFFCFTW SSSRPTVATT ISQPARRSAV

201 CLSIFIPPNK TVWRSGRFLM *
```

Computer analysis of this amino acid sequence gave the following results:
Homology with a Predicted ORF from *N. gonorrhoeae*

```
   m680/g680 90.9% identity in 220 aa overlap 10         20         30         40         50         60
      m680.pep  MTKGSSAMSSPRAAMSVATRIRRLPSLKALSVSSRLCWERSPCIACADRLRRTSSRVTRS
                ||||||||||||:||||||||||||||||||||| |||||||||||||||||||||||||
      g680      MTKGSSAMSSPRAAISVATRIRRLPSLKALSVSSLLCWERSPCIACADRLRRTSSRVTRS
                  10         20         30         40         50         60

70         80         90        100        110        120
      m680.pep  TLCLVLQNTMTWFICKSTISRSSRLRFXMVSTAMMCCSTLALVVFCAATSTVSGAFMKSC
                ||||||:|:||||:|||||||||||||| |||||||||||||||| ||||||||||||||
      g680      TLCLVLQKTITWFICRSTISRSSRLRFWKVSTAMMCCSTLALVVFWAATSTVSGAFMKSC
                  70         80         90        100        110        120

130        140        150        160        170        180
      m680.pep  ASLRIGAEKVAEKSRVWRWRGSICMILRMSSIKPISSIRSASSKTTISTLFKWMFFCFTW
                |||||||||||||||||||||||||||||||:|||::|||:||||:|||:|||||||||
      g680      ASLRIGAEKVAEKSRVWRWRGSICMILRMSSINPISNMRSASSRTTISALFKLMFFCFTW
                 130        140        150        160        170        180

190        200        210        220
      m680.pep  SSSRPTVATTISQPARRSAVCLSIFIPPNKTVWRSGRFLMX
                |||||||||||||||||||||||:: ||::|| ||||||||
      g680      SSSRPTVATTISQPARRSAVCLSMLTPPKRTVCRSGRFLMX
                 190        200        210        220
```

The following partial DNA sequence was identified in *N. meningitidis* <SEQ ID 2241>:

```
a680.seq
   1 ATGACGAAGG GCAGTTCGGC AATATCCAGC CCCCGCGCGG CGATATCGGT

51 GGCGACGAGG ACGCGCAGGT TGCCGTCTTT GAAGGCGTTG AGTGTTTCGA

101 GCCGGCTTTG TTGGGAACGG TCGCCGTGTA TCGCCTGTGC GGACAGGTTG

151 CGGCGCACCA GTTCGCGCGT TACGCGGTCG ACGCTTTGTT TGGTTTTGCA

201 GAACACGATG ACCTGGTTCA TATGCAAATC GACAATCAGC CGTTCGAGCA

251 GGTTGCGCTT CTGAATGGTA TCGACGGCGA TGATGTGCTG CTCGACGTTG

301 GCGTTGGTGG TGTCTTGCGC GGCGACTTCG ACGGTTTCGG GCGCGTTCAT
```

```
-continued
351 GAAGTCTTGC GCCAGTTTGC GTATCGGGGC GGAGAAGGTG GCGGAAAAGA

401 GCAGGGTTTG GCGTTGGCGG GGCAGCATCT GCATGATTTT GCGGATGTCG

451 TCGATAAAAC CCATATCCAG CATACGGTCG GCTTCGTCCA AAACGACGAT

501 TTCGACTTTG TTCAAATGGA TGTTTTTCTG TTTCACGTGG TCGAGCAGCC

551 GTCCGACGGT GGCGACGACG ATTTCGCAGC CGGCACGCAG GTCGGCGGTC

601 TGTTTGTCCA TATTCATACC GCCGAACAAG ACGGTGTGGC GCAGCGGCAG

651 GTTTTTGATG TAG
```

This corresponds to the amino acid sequence <SEQ ID 2242; ORF 680.a>:

```
a680.pep
     1 MTKGSSAISS PRAAISVATR TRRLPSLKAL SVSSRLCWER SPCIACADRL

51 RRTSSRVTRS TLCLVLQNTM TWFICKSTIS RSSRLRF*MV STAMMCCSTL

101 ALVVSCAATS TVSGAFMKSC ASLRIGAEKV AEKSRVWRWR GSICMILRMS

151 SIKPISSIRS ASSKTTISTL FKWMFFCFTW SSSRPTVATT ISQPARRSAV

201 CLSIFIPPNK TVWRSGRFLM * m680/a680 98.6% identity in 220 aa overlap 10         20         30         40         50         60
m680.pep MTKGSSAMSSPRAAMSVATRTRRLPSLKALSVSSRLCWERSPCIACADRLRRTSSRVTRS
         |||||||:||||||:|||||||||||||||||||||||||||||||||||||||||||
a672     MTKGSSAISSPRAAISVATRTRRLPSLKALSVSSRLCWERSPCIACADRLRRTSSRVTRS
                10         20         30         40         50         60

70         80         90        100        110        120
m680.pep TLCLVLQNTMTWFICKSTISRSSRLRFXMVSTAMMCCSTLALVVFCAATSTVSGAFMKSC
         |||||||||||||||||||||||||||||||||||||||||||| |||||||||||||||
a680     TLCLVLQNTMTWFICKSTISRSSRLRFXMVSTAMMCCSTLALVVSCAATSTVSGAFMKSC
                70         80         90        100        110        120

130        140        150        160        170        180
m680.pep ASLRIGAEKVAEKSRVWRWRGSICMILRMSSIKPISSIRSASSKTTISTLFKWMFFCFTW
         ||||||||||||||||||||||||||||||||||||||||||||||||||||||||||||
a680     ASLRIGAEKVAEKSRVWRWRGSICMILRMSSIKPISSIRSASSKTTISTLFKWMFFCFTW
               130        140        150        160        170        180

190        200        210        220
m680.pep SSSRPTVATTISQPARRSAVCLSIFIPPNKTVWRSGRFLMX
         ||||||||||||||||||||||||||||||||||||||||
a680     SSSRPTVATTISQPARRSAVCLSIFIPPNKTVWRSGRFLMX
               190        200        210        220
```

The following partial DNA sequence was identified in N. gonorrhoeae <SEQ ID 2243>:

```
g681.seq
   1 ATGACGACGC CGATGGCAAT CAGTGCGTCA AATTTTTCGG AAGAGGCAAA

51 GTTCATCAGC GCGATGGGGA TTTCAAGCGC GCCGGGTACG GTGGcgacgg 101 tgatgtTTTC GTCTGCTACG CCCAATTCTT GGAGGGTGCG GCAGCAGACT

151 TTGAGCATTT GGCTGCCGAT TCGTTGGTG AAGCGTGCCT GTACGATGCC

201 GATGCGGAGG TGTTTGCcgt cgaggttgGG GGCGATGGTG TTCATTGGGT

251 GTCCTTTGGT ATTCGGGGTT TCGGAATGCC GTCTGAAGGT TTCAGTCTTG

301 CGGCTGCCAG TCGGCAACGG TTTGGAATGT GCCGTCTTCG GCAAGCTCCC

351 ACGCGCTGCC TTCGGGTTGG GAAAGCAGTG CGGCGGTTTC AGGGTTGGTT

401 TTGGTGATGT CGGCGAGGCT GACGATGCTG AAGTTGTCGG GGTCGTCGGT
```

-continued
```
451 GTATTCGTCG GTTTCGTCGC CGCTGAAGAA ACGCCAGCCG CTGTCGTTTT

501 CAAAAACGGG GGCTTCGCGG TAAAGGAAGC CGACGGGCCG GTTTTGTTTG

551 GCGACGGTGT TGGTGGCGAT GCAGCGGTCG AGTGCCGAGG AAAGTGCTTG

601 TGCAAATGCG TTCATTGCGG GAATACGTTG GGGGGGGGGA AACTTGCGGA

651 TTTTACCACG ATTCCCGCGT TGTCGGCAGA CGGCGGCGGT TTGGTGGTAC

701 AATGTGCGCC GTTTGCAGCC TTAAGGTGTT TCTGTATTTT TGGAGTATGG

751 AAACGCATTC GGGCTGTTTT TTGCGGAAGA CGGTAA
```

This corresponds to the amino acid sequence <SEQ ID 2244; ORF 681>:

```
g681.pep
  1 MTTPMAISAS NFSEEAKFIS AMGISSAPGT VATVMFSSAT PNSWRVRQQT

51 LSIWLPISLV KRACTMPMRR CLPSRLGAMV FIGCPLVFGV SECRLKVSVL

101 RLPVGNGLEC AVFGKLPRAA FGLGKQCGGF RVGFGDVGEA DDAEVVGVVG

151 VFVGFVAAEE TPAAVVFKNG GFAVKEADGP VLFGDGVGGD AAVECRGKCL

201 CKCVHCGNTL GGGKLADFTT IPALSADGGG LVVQCAPFAA LRCFCIFGVW

251 KRIRAVFCGR R*
```

The following partial DNA sequence was identified in *N. meningitidis* <SEQ ID 2245>:

```
m681.seq
  1 ATGACGACGC CGATGGCAAT CAGTGCGTCA AACTTTTCGG AAGAGGCAAA

51 GTTCATCAGC GCGATGGGGA TTTCAAGCGC GCCGGGTACG GTGGCGACGG

101 TAATGTTTTC GTCTGCCACG CCCAATTCTT GGAGGGTGCG GCAGCAGACT

151 TTGAGCATTT CGCTGCCGAT TCGTTGGTG AAGCGTGCCT GTACGATGCC

201 GATGCGGAGG TGTTTGCCGT CGAGGTTGGG GGCGATGGTG TTCATTGGGT

251 GTCCTTTGGT ATTCGGAGTT TCGGAATGCC GTCTGAAGGT TTCAGTCTTG

301 CGGCTGCCAG TCGGCGACGG TTTGGAATGT GCCGTCTTCG GCAAGCTCCC

351 ATGCGCTGCC TTCGGGTTGG GAGAGCAGTG CGGCGGTTTC AGGGTTGGTT

401 TTGGCGATGT CGGCGAGGCT GACGATGCTG AAGTTGTCCG GATCGTCGGT

451 GTATTCGTCG GTCTCGTCGC CGCTGAAGAA ACGCCAGCCG CTGTCGTTTT

501 CAAAAACGGG GGCTTCGCGG TAGAGGAAGC CGACGGGCCG GTTTTGTTTG

551 GCGACGGTGT TGGTGGCGAT ACAGCGGTCG AGTGCCGAGG AAAGTGCTTG

601 TGCAAATGCG TTCATTACGG GAATACGTTG GGGG.AAAAC TTACGGATTT

651 TACCACGATT CGTGCGTTGT CGGCAGACGG CGGCGGTTTG GTGGTACAAT

701 GTGCGCCGTT TGCAGCCTTA AGGTGTTTCT GTATTTTTGG AGTATGGAAA

751 CGCATTCGGG CTGTTTTTTG CGGAAGACGG TAA
```

This corresponds to the amino acid sequence <SEQ ID 2246; ORF 681>:

```
m681.pep
  1 MTTPMAISAS NFSEEAKFIS AMGISSAPGT VATVMFSSAT PNSWRVRQQT

51 LSISLPISLV KRACTMPMRR CLPSRLGAMV FIGCPLVFGV SECRLKVSVL
```

-continued
```
101 RLPVGDGLEC AVFGKLPCAA FGLGEQCGGF RVGFGDVGEA DDAEVVRIVG

151 VFVGLVAAEE TPAAVVFKNG GFAVEEADGP VLFGDVGGD TAVECRGKCL

201 CKCVHYGNTL GXKLTDFTTI RALSADGGGL VVQCAPFAAL RCFCIFGVWK

251 RIRAVFCGRR *
```

Computer analysis of the amino acid sequences gave the following results:

Homology with a Predicted ORF from *N. meningitidis* menA with menB ORF 681 shows 94.6% identity over a 261 aa overlap with a predicted ORF (ORF681.a) from *N. gonorrhoeae*:

```
m681/g681

10         20         30         40         50         60
m681.pep  MTTPMAISASNFSEEAKFISAMGISSAPGTVATVMFSSATPNSWRVRQQTLSISLPISLV
          ||||||||||||||||||||||||||||||||||||||||||||||||||| |||||||
g681      MTTPMAISASNFSEEAKFISAMGISSAPGTVATVMFSSATPNSWRVRQQTLWISLPISLV
                  10         20         30         40         50         60

70         80         90        100        110        120
m681.pep  KRACTMPMRRCLPSRLGAMVFIGCPLVFGVSECRLKVSVLRLPVGDGLECAVFGKLPCAA
          |||||||||||||||||||||||||||||||||||||||||||||:||||||||||| ||
g681      KRACTMPMRRCLPSRLGAMVFIGCPLVFGVSECRLKVSVLRLPVGNGLECAVFGKLPRAA
                  70         80         90        100        110        120

130        140        150        160        170        180
m681.pep  FGLGEQCGGFRVGFGDVGEADDAEVVRIVGVFVGLVAAEETPAAVVFKNGGFAVEEADGP
          ||||:|||||||||||||||||||||| ||||||||:|||||||||||||||||:||||
g681      FGLGKQCGGFRVGFGDVGEADDAEVVGVVGVFVGFVAAEETPAAVVFKNGGFAVKEADGP
                 130        140        150        160        170        180

190        200        210        220        230        239
m681.pep  VLFGDGVGGDTAVECRGKCLCKCVHYGNTLGX-KLTDFTTIRALSADGGGLVVQCAPFAA
          |||||||||:||||||||||||||||:|||||  ||:||||| ||||||||||||||||
g681      VLFGDGVGGDAAVECRGKCLCKCVHCGNTLGGGKLADFTTIPALSADGGGLVVQCAPFAA
                 190        200        210        220        230        240

240        250        260
m681.pep  LRCFCIFGVWKRIRAVFCGRRX
          ||||||||||||||||||||||
g681      LRCFCIFGVWKRIRAVFCGRRX
                 250        260
```

The following partial DNA sequence was identified in *N. meningitidis* <SEQ ID 2247>:

```
a681.seq
  1 ATAACGACGC CGATGGCAAT CAGTGCGTCA AATTTTTCAG AAGAGGCAAA

51 GTTCATCAGC GCGATGGGGA TTTCAAGCGC GCCGGGTACG GTGGCGACGG

101 TAATGTTTTC GTCTGCCACG CCCAATTCTT GGAGGGTGCG GCAGCAGACT

151 TTGAGCATTT CGCTGCCGAT TTCGTTGGTG AAGCGTGCCT GTACGATGCC

201 GATGCGGAGG TGTTTGCCGT CGAGGTTGGG GGCGATGGTG TTCATTGAGT

251 GTCCTTTGGT ATTCGGAGGT TCGGAATGC CGTCTGAAGG GTCAGTCCTT

301 AGGTTGCCAG TCGGCGACGG TTTGGAATGT GCCGTCTTCT GCCAATTCCC

351 ACGCGCTGCC TTCAGGTTGG GAGAGCAGTG CGGCGGTTTC AGGGTTGGTT

401 TTGGTGATAT CGGCGAGGCT GACGATGCTG AAGTTGTCCG GGTCGTCGGT

451 GTATTCGTCG GTCTCGTCGC CGCTGAAGAA ACGCCAGCCG CTGTCGTTTT

501 CAAAAACGGG GGCTTCGCGG TAGAGGAAGC CGACGGGCTG GTTTTGTTTG

551 GCGACGGTGT TGGTGGCGAT GCAGCGGTCG AGTGCCGAGG AAAGTGCTTG

601 TGCAAATGCG TTCATTGCGG GAATACGTT. GGGGGAAAAC TTGCGGATTT
```

-continued

```
651 TACCACGATT CTTGCGTTGT CGGCAGACGG CGGCGGTTTG GTGGTACAAT

701 GTGCGCCGTT TGCAGCCTTA AGGTGTTTCT GTATTTTTGG AGTATGGAAA

751 CGCATTCGGG CTGTTTTTTG CGGAAGACGG TAA
```

This corresponds to the amino acid sequence <SEQ ID 2248; ORF 681.a>:

```
a681.pep

1  ITTPMAISAS NFSEEAKFIS AMGISSAPGT VATVMFSSAT PNSWRVRQQT

51  LSISLPISLV KRACTMPMRR CLPSRLGAMV FIECPLVFGG FGMPSEGSVL

101  RLPVGDGLEC AVFCQFPRAA FRLGEQCGGF RVGFGDIGEA DDAEVVRVVG

151  VFVGLVAAEE TPAAVVFKNG GFAVEEADGL VLFGDGVGGD AAVECRGKCL

201  CKCVHCGNTX GGKLADFTTI LALSADGGGL VVQCAPFAAL RCFCIFGVWK

251  RIRAVFCGRR * m681/a681  90.8% identity in 260 aa overlap 10         20         30         40         50         60
  m681.pep  MTTPMAISASNFSEEAKFISAMGISSAPGTVATVMFSSATPNSWRVRQQTLSISLPISLV
            :|||||||||||||||||||||||||||||||||||||||||||||||||||||||||||
  a681      ITTPMAISASNFSEEAKFISAMGISSAPGTVATVMFSSATPNSWRVRQQTLSISLPISLV
                    10         20         30         40         50         60

70         80         90        100        110        120
  m681.pep  KRACTMPMRRCLPSRLGAMVFIGCPLVFGVSECRLKVSVLRLPVGDGLECAVFGKLPCAA
            ||||||||||||||||||||||| ||||||    : |||||||||||||||||| ::| ||
  a681      KRACTMPMRRCLPSRLGAMVFIECPLVFGGFGMPSEGSVLRLPVGDGLECAVFCQFPRAA
                    70         80         90        100        110        120

130        140        150        160        170        180
  m681.pep  FGLGEQCGGFRVGFGDVGEADDAEVVRIVGVFVGLVAAEETPAAVVFKNGGFAVEEADGP
            | |||||||||||||||:||||||||||:|||||||||||||||||||||||||||||||
  a681      FRLGEQCGGFRVGFGDIGEADDAEVVRVVGVFVGLVAAEETPAAVVFKNGGFAVEEADGL
                   130        140        150        160        170        180

190        200        210        220        230        240
  m681.pep  VLFGDGVGGDTAVECRGKCLCKCVHYGNTLGXKLTDFTTIRALSADGGGLVVQCAPFAAL
            ||||||||||:||||||||||||||| ||| | ||:||||| |||||||||||||||||
  a681      VLFGDGVGGDAAVECRGKCLCKCVHCGNTXGGKLADFTTILALSADGGGLVVQCAPFAAL
                   190        200        210        220        230        240

250        260
  m681.pep  RCFCIFGVWKRIRAVFCGRRX
            |||||||||||||||||||||
  a681      RCFCIFGVWKRIRAVFCGRRX
                   250        260
```

The following partial DNA sequence was identified in *N. gonorrhoeae* <SEQ ID 2249>:

```
g682.seq
  1 ATGCGCGATT TCGCCGTATG GGTGCCTTAC GGGGAACGGC GGAAAAATTG

51 GGACATAAGG TATTGCCTCC CGCACCTTAT TCGCCTGAGC CCAACCCGAT

101 TGAGAAAGTG TGGGCGAATA TTAAGCGGTA TCTGCGAACC GTTTTGTCTG

151 ATTACGCCCG ATTTGACGAT GCACTACTGT CCTATTTTGA TTTTAATTGA

201 CTATATTTGT GTGAATGATG AAATAAAAAT GCCGTCTGAA CCCGATTGGA

251 TTCAGACGGC ATTTTGTATG CAGGATTTA TTCGCTTTCC AACTGACCGA

301 CCTATTTTGA CAAGGCAGTC AGGCGTTGTT CGGATTCGC CACGAACGGG

351 TTTTCGGTAT CCCACGCGTA GCCTGCCAAA ATCGAAGAAA GCATACGGCT

401 GA
```

This corresponds to the amino acid sequence <SEQ ID 2250; ORF 682>:

```
g682.pep
  1 MRDFAVWVPY GERRKNWDIR YCLPHLIRLS PTRLRKCGRI LSGICEPFCL

51 ITPDLTMHYC PILILIDYIC VNDEIKMPSE PDWIQTAFCM AGFIRFPTDR

101 PILTRQSGVV RISPRTGFRY PTRSLPKSKK AYG*
```

The following partial DNA sequence was identified in *N. meningitidis* <SEQ ID 2251>:

```
m682.seq
  1 ATGCGTGATT TCACCGTATG GGTGTCTTAC GGGAAATGGC GGAAAAATTG

51 GGACATAAGG TATTGCCTCT TGCACCTTAT TCACCTGAGC TCAACCCGAT

101 TGAGAAAGTG TGGGCGAATA TTAAGCGGTA TCTGCGAACC GTTTTGTCTG

151 ATTACGCCCG ATTTGACGAT GCACTACTGT CCTATTTTGA TTTTAATTGA

201 CTAT...... ......GAAA TGGCAATGCC GTCTGAACCC GATTGGATTC

251 AGACGGCATT TTGTATGGCG TACGGATTTA TTCGGTTTCC AACTGACCGA

301 CCCATTCGGA CAAGGCAGTC AGGCGTTGTT CGGATTTCGC CACGAACGGG

351 TTTTCGGTAT CCCACGCGTA GCCTGCCAAA ATCGAAGAAA GCATACGGCT

401 GA
```

This corresponds to the amino acid sequence <SEQ ID 2252; ORF 682>:

```
m682.pep
  1 MRDFTVWVSY GKWRKNWDIR YCLLHLIHLS STRLRKCGRI LSGICEPFCL

51 ITPDLTMHYC PILILIDY.. ..EMAMPSEP DWIQTAFCMA YGFIRFPTDR

101 PIRTRQSGVV RISPRTGFRY PTRSLPKSKK AYG*
```

Computer analysis of the amino acid sequences gave the following results:
Homology with a Predicted ORF from *N. meningitidis* menA with menB ORF 682 shows 88.1% identity over a 134 aa overlap with a predicted ORF (ORF682.a) from *N. gonorrhoeae*:

```
m682/g682
                    10         20         30         40         50         60
    m682.pep  MRDFTVWVSYGKWRKNWDIRYCLLHLIHLSSTRLRKCGRILSGICEPFCLITPDLTMHYC
              ||||:||| ||: ||||||||||| |||:|| ||||||||||||||||||||||||||||
    g682      MRDFAVWVPYGERRKNWDIRYCLPHPIRLSPTRLRKCGRILSGICEPFCLITPDLTMHYC
                    10         20         30         40         50         60

70         80         90        100        110
    m682.pep  PILILIDY-----EMAMPSEPDWIQTAFCMAYGFIRFPTDRPIRTRQSGVVRISPRTGFER
              ||||||||     |: ||||||||||||||| |||||||||| |||||||||||||||||
    g682      PILILIDYICVNDEIKMPSEPDWIQTAFCMA-GFIRFPTDRPILTRQSGVVRISPRTGFER
                         70         80         90        100        110

120        130
    m682.pep  YPTRSLPKSKKAYGX
              |||||||||||||||
    g682      YPTRSLPKSKKAYGX
                   120        130
```

The following partial DNA sequence was identified in *N. meningitidis* <SEQ ID 2253>:

```
a682.seq
   1 ATGCGCGATT TTACCGTATG GGTGTCTTAC GGGAAATGGC GGAAAAATTG

51 GGACATAAGG TATTGCCTCT TGCACCTTAT TCACCTGAGC TCAACCCGAT

101 TGAGAAAGTG TGGGCGAATA TTAAGCGGTA TCTGCGAACC GTTTTGTCTG

151 ATTACGCCCG ATTTGACGAT GCACTACTGT CCTATTTTGA TTTTAATTGA

201 ATAT...... .......... .......... .......... ..........

251 .......... .......... ......TATA TTCGGTTTCC AACTGACCGA

301 CCCATTCTGA CAAGGCCGAC AGGCGTTGTT CGGATTTCGC CACGAACGGG

351 TTTTCGGTAT CCCACGCGTA GCCTGCCAAA ATCGAAGAAA GCATACGGCT

401 GA
```

This corresponds to the amino acid sequence <SEQ ID 2254; ORF 682.a>:

```
a682.pep
      1 MRDFTVWVSY GKWRKNWDIR YCLLHLIHLS STRLRKCGRI LSGICEPFCL

51 ITPDLTMHYC PILILIEY.. .......... .......... ..YIRFPTDR

101 PILTRPTGVV RISPRTGFRY PTRSLPKSKK AYG* m682/a682 80.6% identity in 129 aa overlap 10         20         30         40         50         60
m682.pep MRDFTVWVSYGKWRKNWDIRYCLLHLIHLSSTRLRKCGRILSGICEPFCLITPDLTMHYC
         ||||||||||||||||||||||||||||||||||||||||||||||||||||||||||||
a682     MRDFTVWVSYGKWRKNWDIRYCLLHLIHLSSTRLRKCGRILSGICEPFCLITPDLTMHYC
                  10         20         30         40         50         60

70         80         90        100        110        120
m682.pep PILILIDYEMAMPSEPDWIQTAFCMAYGFIRFPTDRPIRTRQSGVVRISPRTGFRYPTRS
         ||||||:|                    :|||||||||  ||  :|||||||||||||||
a682     PILILIEY--------------------YIRFPTDRPILTRPTGVVRISPRTGFRYPTRS
                                             70         80         90        100

130
m682.pep LPKSKKAYGX
         ||||||||||
a682     LPKSKKAYGX
                 110
```

The following partial DNA sequence was identified in *N. gonorrhoeae* <SEQ ID 2255>

```
g683.seq
   1 ATGATTAAGG AAACCCTAAT GCGCCCAATC TTCCTATCTT TCGTTTTACT

51 CCCTATTTTG ATAACCGCCT GCAGCACACC GGACAAGTCT GCCCGATGGG

101 AAAATATCGG CACAATCTCA AACGGCAATA TTCATACATA TATTAATAAA

151 GACAGTGTGA GAAAAAACGG AAATCTGATG ATTTTCCAAG ATAAAAAAGT

201 TGTTACCAAT CTGAAACAAG AACGTTTTGC CAACACCCCC GCATACAAGA

251 CTGCCATTGC CGAGTGGGAA ATCCACTGCA ACAACAAAAC ATACCGCTTA

301 AGTTCGCTAC AGTTATTTGA TACAAAAAAC ACGGAAATTT CCACACAAAA

351 CTACACAGCC TCTTCCCTCC GCCCGATGAG CATCCTGTCC GGGACATTAA

401 CTGAAAAACA ATATGAAACC GTATGCGGGA AAAAACTCTG A
```

This corresponds to the amino acid sequence <SEQ ID 2256; ORF 683>:

```
g683.pep
   1 MIKETLMRPI FLSFVLLPIL ITACSTPDKS ARWENIGTIS NGNIHTYINK

51 DSVRKNGNLM IFQDKKVVTN LKQERFANTP AYKTAIAEWE IHCNNKTYRL

101 SSLQLFDTKN TEISTQNYTA SSLRPMSILS GTLTEKQYET VCGKKL*
```

The following partial DNA sequence was identified in *N. meningitidis* <SEQ ID 2257>:

```
m683.seq..
   1 ATGATTAAGG AAACCCTAAT GCGCCCAATC TTCCTATCTT TCGTTTTATT

51 CCCTATTTTG ATAACCGCCT GCAGCACACC GGACAAGTCT GCCCGATGGG

101 AAAATATCGG CACAATCTCA AACGGCAATA TTCATACATA TATCAATAAA

151 GACAGCGTGA GAAAAAACGG AAATCTGATG ATTTTCCAAG ATAAAAAAGT

201 TGTTACCAAT CTAAAACAAG AACGTTTTGC CAACACCCCC GCATACAAGA

251 CTGCCATTGC CGAGTGGGAA ATCCACTGCA ACAACAAAAC ATACCGCTTA

301 AGTTCGCTAC AGTTGTTTGA TACAAAAAAC ACGGAAATTT CCACACAAAA

351 CTACACAGCC TCTTCCCTCC GCCCGATGAG CATCCTGTCC GGGACATTAA

401 CCGAAAAACA ATATGAAACC GTATGCGGAA AAAAACTCTG A
```

This corresponds to the amino acid sequence <SEQ ID 2258; ORF 683>:

```
m683.pep..
   1 MIKETLMRPI FLSFVLFPIL ITACSTPDKS ARWENIGTIS NGNIHTYINK

51 DSVRKNGNLM IFQDKKVVTN LKQERFANTP AYKTAIAEWE IHCNNKTYRL

101 SSLQLFDTKN TEISTQNYTA SSLRPMSILS GTLTEKQYET VCGKKL*
```

Computer analysis of this amino acid sequence gave the following results:

Homology with a Predicted ORF from *N. gonorrhoeae*

ORF 683 shows 99.3% identity over a 146 aa overlap with a predicted ORF (ORF 683) from *N. gonorrhoeae*:

```
m683/g683  99.3% identity in 146 aa overlap 10        20        30        40        50        60
m683.pep   MIKETLMRPIFLSFVLFPILITACSTPDKSARWENIGTISNGNIHTYINKDSVRKNGNLM
           ||||||||||||||||:|||||||||||||||||||||||||||||||||||||||||||
g683       MIKETLMRPIFLSFVLLPILITACSTPDKSARWENIGTISNGNIHTYINKDSVRKNGNLM
                   10        20        30        40        50        60

70        80        90       100       110       120
m683.pep   IFQDKKVVTNLKQERFANTPAYKTAIAEWEIHCNNKTYRLSSLQLFDTKNTEISTQNYTA
           ||||||||||||||||||||||||||||||||||||||||||||||||||||||||||||
g683       IFQDKKVVTNLKQERFANTPAYKTAIAEWEIHCNNKTYRLSSLQLFDTKNTEISTQNYTA
                   70        80        90       100       110       120

130       140
m683.pep   SSLRPMSILSGTLTEKQYETVCGKKLX
           ||||||||||||||||||||||||||
g683       SSLRPMSILSGTLTEKQYETVCGKKLX
                  130       140
```

The following partial DNA sequence was identified in *N. meningitidis* <SEQ ID 2259>

```
a683.seq
  1 ATGATTAAGG AAACCCTAAT GCGCCCAATC TTCCTATCTT TCGTTTTATT

51 CCCTATTTTG ATAACCGCCT GCAGCACACC GGACAAGTCT GCCCGATGGG

101 AAAATATCGG CACAATCTCA AACGGCAATA TTCATACATA TATCAATAAA

151 GACAGCGTGA GAAAAAACGG AAATCTGATG ATTTTCCNAG ATAAAAAAGT

201 TGTTACCAAT CTAAAACAAG AACGTTTTGC CNACACCCCC GCATACAAGA

251 CTGCCATTGC CGAGTGGGAA ATCCACTGCA ACAACAAAAC ATACCGCTTA

301 AGTTCGCTAC AATTGTTTGA TACAAAAAAC ACGGAAATTT CCACACAAAA

351 NTACACAGCC TCTTCCCTCC GCCCGATGAG CATCCTGTCC GGGACATTAA

401 CCGAAAAACA ATATGAAACC GTATGCGGAA AAAAACTCTG A
```

This corresponds to the amino acid sequence <SEQ ID 2260; ORF 683.a>:

```
a683.pep
  1 MIKETLMRPI FLSFVLFPIL ITACSTPDKS ARWENIGTIS NGNIHTYINK

51 DSVRKNGNLM IFXDKKVVTN LKQERFAXTP AYKTAIAEWE IHCNNKTYRL

101 SSLQLFDTKN TEISTQXYTA SSLRPMSILS GTLTEKQYET VCGKKL*
```

Computer analysis of this amino acid sequence gave the following results:

Homology with a Predicted ORF from *N. meningitidis*

ORF 683 shows 97.9% identity over a 146 aa overlap with a predicted ORF (ORF 683) from *N. meningitidis*:

```
m683/a683 97.9% identity in 146 aa overlap 10        20        30        40        50        60
m683.pep MIKETLMRPIFLSFVLFPILITACSTPDKSARWENIGTISNGNIHTYINKDSVRKNGNLM
         ||||||||||||||||||||||||||||||||||||||||||||||||||||||||||||
a683     MIKETLMRPIFLSFVLFPILITACSTPDKSARWENIGTISNGNIHTYINKDSVRKNGNLM
                 10        20        30        40        50        60

70        80        90       100       110       120
m683.pep IFQDKKVVTNLKQERFANTPAYKTAIAEWEIHCNNKTYRLSSLQLFDTKNTEISTQNYTA
         || |||||||||||||| ||||||||||||||||||||||||||||||||||||| |||
a683     IFXDKKVVTNLKQERFAXTPAYKTAIAEWEIHCNNKTYRLSSLQLFDTKNTEISTQXYTA
                 70        80        90       100       110       120

130       140
m683.pep SSLRPMSILSGTLTEKQYETVCGKKLX
         ||||||||||||||||||||||||||
a683     SSLRPMSILSGTLTEKQYETVCGKKLX
                130       140
```

The following partial DNA sequence was identified in *N. gonorrhoeae* <SEQ ID 2261>

```
g684.seq
  1 ATGCGCCTTT TCCCCATCGC CGCCGCCCTG ACGCTTGCCG CCTGCGGTAC

51 TGTGCAAAGC ACACAATATT TCGTGTTGCC CGACAGCCGC TACATCCGTC

101 CTGCAACGCA AGGCGGCGAA ACCGCCGTCG AAGTCCGTCT TGCCGAACCG

151 CTCAAACGCG GCGGACTGGT CTATCAAACC GACCCCTACC GCATCAACAC

201 CGCACAAAAC CATGTTTGGG CAGACACCTT GGACGATATG CTCGAAGCGG

251 CGTTGAGCAA TGCATTCAAC CGTTTGGACA GCACACGCAC CTTTGTTCCT
```

-continued

```
301 GCCTCACGCA GCGGCAGTAC CGACAAATGG ACGGTCTATA TCGACGCATT

351 CCAAGGCAGC TACACGGGCA AAACCCTCAT CAGCGGCTAC GCCGTCCTAC

401 CCGACGGTAC GAACAGACCC TTCCATATCG AAACCGAACA GCAGGGTGAC

451 GGCTACGCCG CCATGACCGC CGCACTCGAA CAGGGACTGA ACAGGCGGC

501 GCAACAGATG GTCGAGTAA
```

This corresponds to the amino acid sequence <SEQ ID 2262; ORF 684>:

```
g684.pep
  1 MRLFPIAAAL TLAACGTVQS TQYFVLPDSR YIRPATQGGE TAVEVRLAEP

51 LKRGGLVYQT DPYRLNTAQN HVWADTLDDM LEAALSNAFN RLDSTRIFVP

101 ASRSGSTDKW TVYIDAFQGS YTGKTLISGY AVLPDGTNRP FHIETEQQGD

151 GYAAMTAALE QGLKQAAQQM VE*
```

The following partial DNA sequence was identified in *N. meningitidis* <SEQ ID 2263>:

```
m684.seq
  1 ATGCGCCTTT TCCCGATTGC CGCCGCCCTG TCGCTTGCCG CCTGCGGTAC

51 TGTGCAAAGC ACACAATATT TCGTGTTGCC CGACAGCCGC TACATCCGTC

101 CTGCAACGCA AGGCGGCGAA ACTGCCGTCG AAGTCCGTCT TGCCGAACCG

151 CTCAAACGCG GCGGACTGGT CTATCAAACC GACCCCTACC GCCTCAACAC

201 CGCACAAAAC CACGTCTGGG CAGACACCTT GGACGATATG CTCGAAGCGG

251 CGTTGAGCAA TGCATTCAAC CGTTTGGACA GCACACGCAT CTTTGTTCCT

301 GCCTCACGCA GCGGCAGTAC CGAAAAATGG ACGGTCTATA TCGACGCATT

351 CCAAGGCAGC TACACGGGCA AAACCCTCAT CAGCGGCTAC GCCGTCCTAC

401 CCGACGGTAC GAACAGACCC TTCCATATCG AAACCGAACA GCAGGGTGAC

451 GGCTACGCCG CGATGACCGC CGCACTCGAA CAGGGACTGA ACAGGCGGC

501 GCAACAGATG GTCGAGTAA
```

This corresponds to the amino acid sequence <SEQ ID 2264; ORF 684>:

```
m684.pep
  1 MRLFPIAAAL SLAACGTVQS TQYFVLPDSR YIRPATQGGE TAVEVRLAEP

51 LKRGGLVYQT DPYRLNTAQN HVWADTLDDM LEAALSNAFN RLDSTRIFVP

101 ASRSGSTEKW TVYIDAFQGS YTGKTLISGY AVLPDGTNRP FHIETEQQGD

151 GYAAMTAALE QGLKQAAQQM VE*
```

Computer analysis of this amino acid sequence gave the following results:

Homology with a Predicted ORF from *N. gonorrhoeae*

ORF 684 shows 97.7% identity over a 172 aa overlap with a predicted ORF (ORF 684) from *N. gonorrhoeae*:

```
m684/g684 97.7% identity in 172 aa overlap 10        20        30        40        50        60
m684.pep  MRLFPIAAALSLAACGTVQSTQYFVLPDSRYIRPATQGGETAVEVRLAEPLKRGGLVYQT
          ||||||||||:|||||||||||||||||||||||||||||||||||||||||||||||
g684      MRLFPIAAALTLAACGTVQSTQYFVLPDSRYIRPATQGGETAVEVRLAEPLKRGGLVYQT
                 10        20        30        40        50        60

70        80        90       100       110       120
m684.pep  DPYRLNTAQNHVWADTLDDMLEAALSNAFNRLDSTRIFVPASRSGSTEKWTVYIDAFQGS
          ||||:||||||||||||||||||||||||||||||||| ||||||||||:||||||||||
g684      DPYRINTAQNHVWADTLDDMLEAALSNAFNRLDSTRTFVPASRSGSTDKWTVYIDAFQGS
                 70        80        90       100       110       120

130       140       150       160       170
m684.pep  YTGKTLISGYAVLPDGTNRPFHIETEQQGDGYAAMTAALEQGLKQAAQQMVEX
          |||||||||||||||||||||||||||||||||||||||||||||||||||
g684      YTGKTLISGYAVLPDGTNRPFHIETEQQGDGYAAMTAALEQGLKQAAQQMVEX
                130       140       150       160       170
```

The following partial DNA sequence was identified in *N. meningitidis* <SEQ ID 2265>

```
a684.seq
   1 ATGCGCCTCT TCCCGATTGC CGCCGCCCTG ACGCTTGCCG CCTGCGGTAC

51 TGTGCAAAGC ACACAATATT TCGTGTTGCC CGACAGCCGC TACATCCGTC

101 CTGCAACGCA AGGCGGCGAA ACTGCCGTCG AAGTCCGTCT TGCCGAACCG

151 CTCAAACGCG GCGGACTGGT CTATCAAACC GACCCCTACC GCCTCAACAC

201 CGCACAAAAC CACGTCTGGG CAGACACCTT GGACGATATG CTCGAAGCGG

251 CGTTGAGCAA TGCATTCAAC CGTTTGGACA GCACACGCAT CTTTGTTCCT

301 GCCTCACGCA GCGGCAGTAC CGAAAAATGG ACGGTCTATA TCGACGCATT

351 CCAAGGCAGC TACACGGGCA AAACCCTCAT CAGCGGCTAC GCCGTCCTAC

401 CCGACGGTAC GAACAGACCC TTCCATATCG AAACCGAACA GCAGGGTGAC

451 GGCTACGCCG CCATGACCGC CGCACTCGAA CAGGGACTGA AACAGGCGGC

501 GCAACAGATG GTCGAGTAA
```

This corresponds to the amino acid sequence <SEQ ID 2266; ORF 684.a>:

```
a684.pep
   1 MRLFPIAAAL TLAACGTVQS TQYFVLPDSR YIRPATQGGE TAVEVRLAEP

51 LKRGGLVYQT DPYRLNTAQN HVWADTLDDM LEAALSNAFN RLDSTRIFVP

101 ASRSGSTEKW TVYIDAFQGS YTGKTLISGY AVLPDGTNRP FHIETEQQGD

151 GYAAMTAALE QGLKQAAQQM VE*
```

Computer analysis of this amino acid sequence gave the following results:

Homology with a Predicted ORF from *N. meningitidis*
ORF 684 shows 99.4% identity over a 172 aa overlap with a predicted ORF (ORF 684) from *N. meningitidis*

```
m684/a684   99.4% identity in 172 aa overlap 10        20        30        40        50        60
    m684.pep  MRLFPIAAALSLAACGTVQSTQYFVLPDSRYIRPATQGGETAVEVRLAEPLKRGGLVYQT
              ||||||||||:|||||||||||||||||||||||||||||||||||||||||||||||||
    a684      MRLFPIAAALTLAACGTVQSTQYFVLPDSRYIRPATQGGETAVEVRLAEPLKRGGLVYQT
                 10        20        30        40        50        60

70        80        90       100       110       120
    m684.pep  DPYRLNTAQNHVWADTLDDMLEAALSNAFNRLDSTRIFVPASRSGSTEKWTVYIDAFQGS
              ||||||||||||||||||||||||||||||||||||||||||||||||||||||||||||
    a684      DPYRLNTAQNHVWADTLDDMLEAALSNAFNRLDSTRIFVPASRSGSTEKWTVYIDAFQGS
                 70        80        90       100       110       120

130       140       150       160       170
    m684.pep  YTGKTLISGYAVLPDGTNRPFHIETEQQGDGYAAMTAALEQGLKQAAQQMVEX
              |||||||||||||||||||||||||||||||||||||||||||||||||||||
    a684      YTGKTLISGYAVLPDGTNRPFHIETEQQGDGYAAMTAALEQGLKQAAQQMVEX
                130       140       150       160       170
```

The following partial DNA sequence was identified in *N. gonorrhoeae* <SEQ ID 2267>

```
g685.seq
    1 TTGTTTTGCC GTATCGGGAA TTTTGCGTTT TGCGGCGTGG TTTCTGCAGG

51 TTGTTTGCTT AATAATAAAC ATTCTTATTC GTATGCAAAG GAACCGCACA

101 CCGTGAAACC GCGTTTTTAT TGGGCAGcct GCGCCGTCCT GCCGGCCGCC

151 TGTTCGCCCG AACCTGCCGC CGAAAAAACT GTATccgCCG CATCCCAAGC

201 CGCATCCACA CCTGTCGCCA CGCTGACCGT GCCGACCGCG CGGGGCGATG

251 CCGTTGTGCC GAAGAATCCC GAACgcgtcg ccgtgtAcga CtggGCGGCG

301 TtggaTACGC TGACCGAGCC GGGCGTGAAT GTGGGCGCAA CCACCGCGCC

351 GGTGCGCGTG GACTATTTGC AGCCTGCATT TGACAAGGCG GCAACGGTGG

401 GGACGCTGTT TGAGCCCGAT GCGAATCCC TGCACCGCCA CAATCCGCAG

451 TTTGTCATTA CCGGCGGGCC GGGTGCGGAA GCGTATGAAC AGTTGGCGAA

501 AAACGCGACC ACCATAGATT TGACGGTGGA CAACGGCAAT ATCCGCACCA

551 GCGGCGAGAA GCAGATGGAG ACCCTGTCGC GGATTTTCGG TAAGGAAGCG

601 CGCGTGGCGG AATTGAATGC GCAGATTGAC GCGCTGTTCG CCCAAAAGCG

651 CGAAGCCGCC AAAGGCAAAG GACGCGGGCT GGTGCTGTCG GTTACAGGCA

701 ACAAGGTGTC CGCCTTCGGC ACGCAATCGC GGTTGGCAAG TTGGATACAC

751 GGCGACATCG GCCTGCCGCC CGTGGACGAA TCTTTACGCA ACGAAGGGCA

801 CGGGCAGCCC GTTTCCTTCG AATACATCAA AGAGAAAAAC CCCGGCTGGA

851 TTTTCATCAT CGACCGCACC GCCGCCATCG GGCAGGAAGG GCCGGCTGCC

901 GTGGAAGTGT TGGATAACGC GCTGGTATGC GGCACGAACG CTTGGAAGCG

951 CAAGCAAATC ATCGTCATGC CTGCCGCGAA CTACATTGTC GCGGGCGGCG

1001 CGCGGCAGTT GATACAGGCG GCGGAACAGT TGAAGGCGGC GTTTGAAAAG

1051 GCAGAACCCG TTGCGGCGCA GTAG
```

This corresponds to the amino acid sequence <SEQ ID 2268; ORF 685>:

```
g685.pep
   1 LFCRIGNFAF CGVVSAGCLL NNKHSYSYAK EPHTVKPRFY WAACAVLPAA

51 CSPEPAAEKT VSAASQAAST PVATLTVPTA RGDAVVPKNP ERVAVYDWAA

101 LDTLTEPGVN VGATTAPVRV DYLQPAFDKA ATVGTLFEPD CESLHRHNPQ

151 FVITGGPGAE AYEQLAKNAT TIDLTVDNGN IRTSGEKQME TLSRIFGKEA

201 RVAELNAQID ALFAQKREAA KGKGRGLVLS VTGNKVSAFG TQSRLASWIH

251 GDIGLPPVDE SLRNEGHGQP VSFEYIKEKN PGWIFIIDRT AAIGQEGPAA

301 VEVLDNALVC GTNAWKRKQI IVMPAANYIV AGGARQLIQA AEQLKAAFEK

351 AEPVAAQ*
```

The following partial DNA sequence was identified in *N. meningitidis* <SEQ ID 2269>:

```
m685.seq
   1 TTGTTTTGCC GTATCGGGAA TTTTGCGTTT TGCGGCGTGG TTTCTGCAGG

51 TTGTTTGCTT AATAATAAAC ATTCTTATTC GTATGCAAAG GAACCGCACA

101 CCGTGAAACC GCGTTTTTAT TGGGCAGCCT GCGCCGTCCT GCTGACCGCC

151 TGTTCGCCCG AACCTGCCGC CGAAAAAACT GTATCCGCCG CATCCGCATC

201 TGCCGCCACG CTGACCGTGC CGACCGCGCG GGGCGATGCC GTTGTGCCGA

251 AGAATCCCGA ACGCGTCGCC GTGTACGACT GGGCGGCGTT GGATACGCTG

301 ACCGAATTGG GCGTGAATGT GGGCGCAACC ACCGCGCCGG TGCGCGTGGA

351 TTATTTGCAG CCTGCATTTG ACAAGGCGGC AACGGTGGGG ACGCTGTTCG

401 AGCCCGATTA CGAAGCCCTG CACCGCTACA ATCCTCAGCT TGTCATTACC

451 GGCGGGCCGG GCGCGGAAGC GTATGAACAG TTAGCGAAAA ACGCGACCAC

501 CATAGATCTG ACGGTGGACA ACGGCAATAT CCGCACCAGC GGCGAAAAGC

551 AGATGGAGAC CTTGGCGCGG ATTTTCGGCA AGGAAGCGCG CGCGGCGGAA

601 TTGAAGGCGC AGATTGACGC GCTGTTCGCC CAAACGCGCG AAGCCGCCAA

651 AGGCAAAGGA CGCGGGCTGG TGCTGTCGGT TACGGGCAAC AAGGTGTCCG

701 CCTTCGGCAC GCAGTCGCGG TTGGCAAGTT GGATACACGG CGACATCGGC

751 CTACCGCCTG TAGACGAATC TTTACGCAAC GAGGGGCACG GGCAGCCTGT

801 TTCCTTCGAA TACATCAAAG AGAAAAACCC CGATTGGATT TTCATCATCG

851 ACCGTACCGC CGCCATCGGG CAGGAAGGGC CGGCGGCTGT CGAAGTATTG

901 GATAACGCGC TGGTACGCGG CACGAACGCT TGGAAGCGCA AGCAAATCAT

951 CGTCATGCCT GCCGCGAACT ACATTGTCGC GGGCGGCGCG CGGCAGTTGA

1001 TTCAGGCGGC GGAGCAGTTG AAGGCGGCGT TTAAAAAGGC AGAACCCGTT

1051 GCGGCGGGGA AAAAGTAG
```

This corresponds to the amino acid sequence <SEQ ID 2270; ORF 685>:

```
m685.pep
   1 LFCRIGNFAF CGVVSAGCLL NNKHSYSYAK EPHTVKPRFY WAACAVLLTA

51 CSPEPAAEKT VSAASASAAT LTVPTARGDA VVPKNPERVA VYDWAALDTL
```

```
-continued
101 TELGVNVGAT TAPVRVDYLQ PAFDKAATVG TLFEPDYEAL HRYNPQLVIT

151 GGPGAEAYEQ LAKNATTIDL TVDNGNIRTS GEKQMETLAR IFGKEARAAE

201 LKAQIDALFA QTREAAKGKG RGLVLSVTGN KVSAFGTQSR LASWIHGDIG

251 LPPVDESLRN EGHGQPVSFE YIKEKNPDWI FIIDRTAAIG QEGPAAVEVL

301 DNALVRGTNA WKRKQIIVMP AANYIVAGGA RQLIQAAEQL KAAFKKAEPV

351 AAGKK*
```

Computer analysis of this amino acid sequence gave the following results:
Homology with a Predicted ORF from *N. gonorrhoeae*
ORF 685 shows 94.4% identity over a 356 aa overlap with a predicted ORF (ORF 685) from *N. gonorrhoeae*:

```
   m685/g685 94.4% identity in 356 aa overlap 10         20         30         40         50         60
   m685.pep LFCRIGNFAFCGVVSAGCLLNNKHSYSYAKEPHTVKPRFYWAACAVLLTACSPEPAAEKT
            ||||||||||||||||||||||||||||||||||||||||||||:|||||||||||||||
   g685     LFCRIGNFAFCGVVSAGCLLNNKHSYSYAKEPHTVKPRFYWAACACLPAACSPEPAAEKT
                10         20         30         40         50         60

70         80         90        100        110
   m685.pep VSAASASA----ATLTVPTARGDAVVPKNPERVAVYDWAALDTLTELGVNVGATTAPVRV
            |||||:|     ||||||||||||||||||||||||||||||||||| ||||||||||||
   g685     VSAASQAASTPVATLTVPTARGDAVVPKNPERVAVYDWAALDTLTEPGVNVGATTAPVRV
                70         80         90        100        110        120

120        130        140        150        160        170
   m685.pep DYLQPAFDKAATVGTLFEPDYEALHRYNPQLVITGGPGAEAYEQLAKNATTIDLTVDNGN
            ||||||||||||||||||||||:|||:|||:|||||||||||||||||||||||||||||
   g685     DYLQPAFDKAATVGTLFEPDCESLHRHNPQFVITGGPGAEAYEQLAKNATTIDLTVDNGN
               130        140        150        160        170        180

180        190        200        210        220        230
   m685.pep IRTSGEKQMETLARIFGKEARAAELKAQIDALFAQTREAAKGKGRGLVLSVTGNKVSAFG
            ||||||||||||||:|||||||:|||:|||||||||||||||||||||||||||||||||
   g685     IRTSGEKQMETLSRIFGKEARVAELNAQIDALFAQKREAAKGKGRGLVLSVTGNKVSAFG
               190        200        210        220        230        240

240        250        260        270        280        290
   m685.pep TQSRLASWIHGDIGLPPVDESLRNEGHGQPVSFEYIKEKNPDWIFIIDRTAAIGQEGPAA
            |||||||||||||||||||||||||||||||||||||||||||| |||||||||||||||
   g685     TQSRLASWIHGDIGLPPVDESLRNEGHGQPVSFEYIKEKNPGWIFIIDRTAAIGQEGPAA
               250        260        270        280        290        300

300        310        320        330        340        350
   m685.pep VEVLDNALVRGTNAWKRKQIIVMPAANYIVAGGARQLIQAAEQLKAAFKKAEPVAAGKKX
            ||||||||| |||||||||||||||||||||||||||||||||||||||:|||||| |||
   g685     VEVLDNALVCGTNAWKRKQIIVMPAANYIVAGGARQLIQAAEQLKAAFEKAEPVAAQX
               310        320        330        340        350
```

The following partial DNA sequence was identified in *N. meningitidis* <SEQ ID 2271>

```
a685.seq
    1 TTGTTTTGCC GTATCGGGAA TTTTGCGTTT TGCGGCGTGG TTTCTGCAGG

51 TTGTTTGCTT AATAATAAAC ATTCTTATTC GTATGCAAAG GAACCGCACA

101 CCGTGAAACC GCGTTTTTAT TGGGCAGCCT GCGCCGTCCT GCTGACCGCC

151 TGTTCGCCCG AACCTGCCGC CGAAAAAACT GTATCCGCCG CATCCGCATC

201 TGCCGCCACA CTGACCGTGC CGACCGCGCG GGGCGATGCC GTTGTGCCGA

251 AGAATCCCGA ACGCGTCGCC GTGTACGACT GGGCGGCGTT GGATACGCTG

301 ACCGAATTGG GTGTGAATGT GGGCGCAACC ACCGCGCCGG TGCGCGTGGA

351 TTATTTGCAG CCTGCATTTG ACAAGGCGGC AACGGTGGGG ACGCTGTTCG
```

```
401 AGCCCGATTA CGAAGCCCTG CACCGCTACA ATCCTCAGCT TGTCATTACC

451 GGCGGGCCGG GCGCGGAAGC GTATGAACAG TTGGCGAAAA ACGCGACCAC

501 CATAGATCTG ACGGTGGACA ACGGCAATAT CCGCACCAGC GGCGAAAAGC

551 AGATGGAGAC CTTGGCGCGG ATTTTCGGCA AGGAAGCGCG CGCGGCGGAA

601 TTGAAGGCGC AGATTGACGC GCTGTTCGCC CAAACGCGCG AAGCCGCCAA

651 AGGCAAAGGA CGCGGGCTGG TGCTGTCGGT TACGGGCAAC AAGGTGTCCG

701 CCTTCGGCAC GCAGTCGCGG TTGGCAAGTT GGATACACGG CGACATCGGC

751 CTACCGCCTG TAGACGAATC TTTACGCAAC GAGGGGCACG GGCAGCCTGT

801 TTCCTTCGAA TACATCAAAG AGAAAAACCC CGATTGGATT TTCATCATCG

851 ACCGTACCGC CGCCATCGGG CAGGAAGGGC CGGCGGCTGT CGAAGTATTG

901 GATAACGCGC TGGTACGCGG CACGAACGCT TGGAAGCGCA AGCAAATCAT

951 CGTCATGCCT GCCGCGAACT ACATTGTCGC GGGCGGCTCG CGGCAGTTGA

1001 TTCAGGCGGC GGAGCAGTTG AAGGAGGCGT TTGAAAAGGC AGAACCCGTT

1051 GCGGCGGGGA AAGAGTAG
```

This corresponds to the amino acid sequence <SEQ ID 2272; ORF 685.a>:

```
a685.pep
  1 LFCRIGNFAF CGVVSAGCLL NNKHSYSYAK EPHTVKPRFY WAACAVLLTA

51 CSPEPAAEKT VSAASASAAT LTVPTARGDA VVPKNPERVA VYDWAALDTL

101 TELGVNVGAT TAPVRVDYLQ PAFDKAATVG TLFEPDYEAL HRYNPQLVIT

151 GGPGAEAYEQ LAKNATTIDL TVDNGNIRTS GEKQMETLAR IFGKEARAAE

201 LKAQIDALFA QTREAAKGKG RGLVLSVTGN KVSAFGTQSR LASWIHGDIG

251 LPPVDESLRN EGHGQPVSFE YIKEKNPDWI FIIDRTAAIG QEGPAAVEVL

301 DNALVRGTNA WKRKQIIVMP AANYIVAGGS RQLIQAAEQL KEAFEKAEPV

351 AAGKE*
```

Computer analysis of this amino acid sequence gave the following results:

Homology with a Predicted ORF from *N. meningitidis*

ORF 685 shows 98.9% identity over a 355 aa overlap with a predicted ORF (ORF 685) from *N. meningitidis*:

```
  m685/a685  98.9% identity in 355 aa overlap 10        20        30        40        50        60
   m685.pep  LFCRIGNFAFCGVVSAGCLLNNKHSYSYAKEPHTVKPRFYWAACAVLLTACSPEPAAEKT
             ||||||||||||||||||||||||||||||||||||||||||||||||||||||||||||
   a685      LFCRIGNFAFCGVVSAGCLLNNKHSYSYAKEPHTVKPRFYWAACAVLLTACSPEPAAEKT
                 10        20        30        40        50        60

70        80        90       100       110       120
   m685.pep  VSAASASAATLTVPTARGDAVVPKNPERVAVYDWAALDTLTELGVNVGATTAPVRVDYLQ
             ||||||||||||||||||||||||||||||||||||||||||||||||||||||||||||
   a685      VSAASASAATLTVPTARGDAVVPKNPERVAVYDWAALDTLTELGVNVGATTAPVRVDYLQ
                 70        80        90       100       110       120

130       140       150       160       170       180
   m685.pep  PAFDKAATVGTLFEPDYEALHRYNPQLVITGGPGAEAYEQLAKNATTIDLTVDNGNIRTS
             ||||||||||||||||||||||||||||||||||||||||||||||||||||||||||||
   a685      PAFDKAATVGTLFEPDYEALHRYNPQLVITGGPGAEAYEQLAKNATTIDLTVDNGNIRTS
                130       140       150       160       170       180
```

```
                     190         200        210        220        230        240
m685.pep     GEKQMETLARIFGKEARAAELKAQIDALFAQTREAAKGKGRGLVLSVTGNKVSAFGTQSR
             ||||||||||||||||||||||||||||||||||||||||||||||||||||||||||||
a685         GEKQMETLARIFGKEARAAELKAQIDALFAQTREAAKGKGRGLVLSVTGNKVSAFGTQSR
                     190         200        210        220        230        240

250         260        270        280        290        300
m685.pep     LASWIHGDIGLPPVDESLRNEGHGQPVSFEYIKEKNPDWIFIIDRTAAIGQEGPAAVEVL
             ||||||||||||||||||||||||||||||||||||||||||||||||||||||||||||
a685         LASWIHGDIGLPPVDESLRNEGHGQPVSFEYIKEKNPDWIFIIDRTAAIGQEGPAAVEVL
                     250         260        270        280        290        300

310         320        330        340        350
m685.pep     DNALVRGTNAWKRKQIIVMPAANYIVAGGARQLIQAAEQLKAAFKKAEPVAAGKKX
             |||||||||||||||||||||||||||||||:|||||||||||  ||:|||||||:|
a685         DNALVRGTNAWKRKQIIVMPAANYIVAGGSRQLIQAAEQLKEAFEKAEPVAAGKEX
                     310         320        330        340        350
```

The following partial DNA sequence was identified in *N. gonorrhoeae* <SEQ ID 2273>

```
g686.seq (partial)
   1 ..AATTTCTCCT GCCGCGCCGA TGATGTTTTT GACGATATCT GCAGTGCCGT 51   TGAAGGCTTC ggcgGCATTG CCCGATCTGT CCAGCTCGGG GCTGTATCGG

101   GTGGCGCGTT TGAATCCGTC GCCTACTCCT TGCGTCAGCA TAGCGCCGGC

151   ATTGTGGAAA CGGTCGGCAA GCCGTTGTCC GGTGCTGCGG TTGTCGGTCA

201   GGTTGAGGCG GATATTTTGG GCAACGCCTT TTATGTCGTA GCTGTATATA

251   TCCCTCGCGC CTTTGGGAGC GGGATAGCCG CCGCCCTGTG GCCCGTCATA

301   GCCGTCGGCG GGATGGTGTT CGTATCCGTC CCAATGGATG CGGTAAAGGC

351   TGAATCCGTC AACGGGACTA CCGGCTTCGT CAGAATCGGA ATGTGA
```

This corresponds to the amino acid sequence <SEQ ID 2274; ORF 686>:

```
g686.pep (partial)
   1 ..NFSCRADDVF DDICSAVEGF GGIARSVQLG AVSGGAFESV AYSLRQHSAG

51   IVETVGKPLS GAAVVGQVEA DILGNAFYVV AVYIPRAFGS GIAAALWPVI

101   AVGGMVFVSV PMDAVKAESV NGTTGFVRIG M*
```

The following partial DNA sequence was identified in *N. meningitidis* <SEQ ID 2275>:

```
m686.seq..
   1 ATGATGTTGA AAAAATTCGT ACTCGGCGGT ATTGCCGCAT TGGTTTTGGC

51 GGCCTGCGGC GGTTCGGAAG GCGGCAGCGG AGCGNNNNNN NNNNNNAATT

101 TCTCCTGCAG CGCCGATGAT GTTTTTAACG ATATCTGCAG TGCCGTTGAA

151 GGCTTCGGCG GCATTGCCCG ATCTGTCCAG CTCGGGCTG TATCGGGTGG

201 CGCGTTTGAA TCCGTCGCCT ACTCCTTGCG TCAGCATACT ACCGGCATTG

251 TGGAAACGGT CGGCAAGCCG TTGTCCGGTG CTGCGGTTGT CGGTCAGGTT

301 GAGGCGGATA TTTTGGGCAA CGCCTTTTAT GTCGTAGCTG TATATATCCC

351 TCGCGCCTTT GGGAGCGGGA TAGCCGCCGC CCTGTGGCCC GTCATAGCCG

401 TCGGCGGGAT GGTGTTCGTA TCCGTCCCAA TGGATGCGGT AAAGGCTAAA

451 TCCGTCAACG GGACTACCGG CTTCATCAGA ATCGGAATGT GA
```

This corresponds to the amino acid sequence <SEQ ID 2276; ORF 686>:

```
m686.pep
  1 MMLKKFVLGG IAALVLAACG GSEGGSGAXX XXNFSCSADD VFNDICSAVE

51 GFGGIARSVQ LGAVSGGAFE SVAYSLRQHT TGIVETVGKP LSGAAVVGQV

101 EADILGNAFY VVAVYIPRAF GSGIAAALWP VIAVGGMVFV SVPMDAVKAK

151 SVNGTTGFIR IGM*
```

Computer analysis of this amino acid sequence gave the following results:
Homology with a Predicted ORF from *N. gonorrhoeae*
ORF 686 shows 95.4% identity over a 131 aa overlap with a predicted ORF (ORF 686) from *N. gonorrhoeae*

```
    g686/m686   95.4% identity in 131 aa overlap 10        20        30
       g686.pep               NFSCRADDVFDDICSAVEGFGGIARSVQLG
                              ||||  |||||:||||||||||||||||||
          m686   LKKFVLGGIAALVLAACGGSEGGSGAXXXXNFSCSADDVFNDICSAVEGFGGIARSVQLG
                    10        20        30        40        50        60

40        50        60        70        80        90
       g686.pep  AVSGGAFESVAYSLRQHSAGIVETVGKPLSGAAVVGQVEADILGNAFYVVAVYIPRAFGS
                 |||||||||||||||||::|||||||||||||||||||||||||||||||||||||||||
          m686  AVSGGAFESVAYSLRQHTTGIVETVGKPLSGAAVVGQVEADILGNAFYVVAVYIPRAFGS
                    70        80        90       100       110       120

100       110       120       130
       g686.pep  GIAAALWPVIAVGGMVFVSVPMDAVKAESVNGTTGFVRIGMX
                 ||||||||||||||||||||||||||||:||||||||:||||
          m686  GIAAALWPVIAVGGMVFVSVPMDAVKAKSVNGTTGFIRIGMX
                   130       140       150       160
```

The following partial DNA sequence was identified in *N. meningitidis* <SEQ ID 2277>

```
a686.seq (partial)
  1 ..AATTTCTCCT GCCGCGCCGA TGATGTTTTT GACGATATCT GCAGTGCCGT

51   TGAAAGCTTC GGCGGCATTG CCCGATCTGT CCAGCTCGGG GCTGTATCGG

101   GTGGCGCGTT TGAATCCGTC GCCTACTCCT TGCGTCAGCA TACTACCGGT

151   ATTGTGGAAA CGGTCGACAA GCCGTTGTCC GGTGCTGCGG TTGTCGGTCA

201   GGTTGAGGCG GATATTTTGG GCAACGCCTT TTATGTCGTA GCTGTATATA

251   TCCCTCGCGC CTTTGGGAGC GGGATAGCCG CCGCCCTGTG GCCCGTCATA

301   GCCGTCGGCG GGATGGTGTT CGTATCCGTC CCAATGGATG CGGTAAAGGC

351   TGAATCCGTC AACGGGACTA CCGGCTTCAT CAGAATCGGA ATGTGA
```

This corresponds to the amino acid sequence <SEQ ID 2278; ORF 686.a>:

```
a686.pep (partial)
  1 ..NFSCRADDVF DDICSAVESF GGIARSVQLG AVSGGAFESV AYSLRQHTTG

51   IVETVDKPLS GAAVVGQVEA DILGNAFYVV AVYIPRAFGS GIAAALWPVI

101   AVGGMVFVSV PMDAVKAESV NGTTGFIRIG M*
```

Computer analysis of this amino acid sequence gave the following results:
Homology with a Predicted ORF from *N. meningitidis*
ORF 686 shows 96.2% identity over a 131 aa overlap with a predicted ORF (ORF 686) from *N. meningitidis*:

```
m686/a686  96.2%  identity in 131 aa overlap 10        20        30        40        50        60
M686.pep   LKKFVLGGIAALVLAACGGSEGGSGAXXXXXNFSCSADDVFNDICSAVEGFGGIARSVQLG
                               |||| ||||||:|||||||:||||||||||||
a686                           NFSCRADDVFDDICSAVESFGGIARSVQLG
                                          10        20        30

70        80        90       100       110       120
m686.pep   AVSGGAFESVAYSLRQHTTGIVETVGKPLSGAAVVGQVEADILGNAFYVVAVYIPRAFGS
           |||||||||||||||||||||||||||| |||||||||||||||||||||||||||||||
a686       AVSGGAFESVAYSLRQHTTGIVETVDKPLSGAAVVGQVEADILGNAFYVVAVYIPRAFGS
                    40        50        60        70        80        90

130       140       150       160
m686.pep   GIAAALWPVIAVGGMVFVSVPMDAVKAKSVNGTTGFIRIGMX
           |||||||||||||||||||||||||||:|||||||||||||
a686       GIAAALWPVIAVGGMVFVSVPMDAVKAESVNGTTGFIRIGMX
                   100       110       120       130
```

The following partial DNA sequence was identified in *N. gonorrhoeae* <SEQ ID 2279>

```
g687.seq
   1 ATGAAATCCA GACACCTCGC CCTCGCCCTC GGCGTTGCCG CCCTGTTCGC

51 CCTTGCCGCG TGCGACAGCA AAGTCCAAAC CAGCGTCCCC GCCGACAGCG

101 CGCCTGCCGC TTCGGCAGCC GCCGCCCCGG CAGGACTGGT CGAAGGGCAA

151 AACTACACCG TCCTTGCCAA CCCGATTCCC CAACAGCAGG CAGGCAAGGT

201 TGAAGTGCTT GAGTTTTTCG GCTATTTTTG TCCGCACTGC GCCCGCCTCg

251 AACCTGTTTT GAGCAAACAC GCCAAGTCTT TTAAAGACGA TATGTACCTG

301 CGTACCGAAC ACGTCGTCTG GCAGAAAGAA ATGCTGCCGC TGGCACGCct 351 cGCCGCCGCC GTCGATATGG CTGCCGCCGA AGCAAAGAT GTGGCGAACA

401 GCCATATTTT CGATGCGATG GTCAACCAAA AAATCAAGCT GCAAGAGCCG

451 GAAGTCCTCA AAAATGGCT GGGCGAACAa ACcgcctTTG ACGGCAAAAA

501 AGTCCTTGCC GCCTACGAAT CCCCCGAAAG TCAGGCGCGC GCcggcAAAA

551 TGCAGGAGCT GACCGAAACC TTCCAAATCG ACGGTACGCC CACGGTTATC

601 GTCGGCGGCA AATATAAAGT CGAATTTGCC GACTGGGAGT CCGGTATGAA

651 CACCATCGAC CTTTTGGCGG ACAAAGTACG TGAAGAACAA AAAGCCGCGC

701 AGTAG
```

This corresponds to the amino acid sequence <2280 ID 724; ORF 687>:

```
g687.pep
   1 MKSRHLALAL GVAALFALAA CDSKVQTSVP ADSAPAASAA AAPAGLVEGQ

51 NYTVLANPIP QQQAGKVEVL EFFGYFCPHC ARLEPVLSKH AKSFKDDMYL

101 RTEHVVWQKE MLPLARLAAA VDMAAAESKD VANSHIFDAM VNQKIKLQEP

151 EVLKKWLGEQ TAFDGKKVLA AYESPESQAR AGKMQELTET FQIDGTPTVI

201 VGGKYKVEFA DWESGMNTID LLADKVREEQ KAAQ*
```

The following partial DNA sequence was identified in *N. meningitidis* <SEQ ID 2281>:

```
m687.seq
   1 ATGAAATCCA GACACCTTGC CCTCgGCGTT GCCGCCCTGT TCGCCCTTGC
  51 CGCGTGCGAC AGCAAAGTCC AAACCAGCGT CCCCGCCGAC AGCGCGCCTG
 101 CCGCTTCGGC AGCCGCCGCC CCGGCAGGGC TGGTCGAAGG GCAAAACTAT
 151 ACCGTCCTTG CCAACCCGAT TCCCCAACAG CAGGCAGGCA AAGTCGAAGT
 201 CCTTGAGTTT TTCGGCTATT TCTGTCCGCA CTGCGCCCAC CTCGAACCTG
 251 TTTTAAGCAA ACACGCCAAG TCTTTTAAAG ACGATATGTA CCTGCGTACC
 301 GAACACGTCG TCTGGCAGAA AGAAATGCTG ACGCTGGCAC GCCTCGCCGC
 351 CGCCGTCGAT ATGGCTGCCG CCGACAGCAA AGATGTGGCG AACAGCCATA
 401 TTTTCGATGC GATGGTCAAC CAAAAAATCA AGCTGCAAAA TCCGGAAGTC
 451 CTCAAAAAAT GGCTGGGCGA ACAAACCGCC TTTGACGGCA AAAAAGTCCT
 501 TGCCGCCTAC GAGTCCCCCG AAAGCCAGGC GCGCGCCGAC AAAATGCAGG
 551 AGCTGACCGA AACCTTCCAA ATCGACGGTA CGCCCACGGT TATCGTCGGC
 601 GGTAAATATA AAGTTGAATT TGCCGACTGG GAGTCCGGTA TGAACACCAT
 651 CGACCTTTTG GCGGACAAAG TACGCGAAGA ACAAAAAGCC GCGCAGTAA
```

This corresponds to the amino acid sequence <SEQ ID 2282; ORF 687>:

```
m687.pep
   1 MKSRHLALGV AALFALAACD SKVQTSVPAD SAPAASAAAA PAGLVEGQNY
  51 TVLANPIPQQ QAGKVEVLEF FGYFCPHCAH LEPVLSKHAK SFKDDMYLRT
 101 EHVVWQKEML TLARLAAAVD MAAADSKDVA NSHIFDAMVN QKIKLQNPEV
 151 LKKWLGEQTA FDGKKVLAAY ESPESQARAD KMQELTETFQ IDGTPTVIVG
 201 GKYKVEFADW ESGMNTIDLL ADKVREEQKA AQ*
```

Computer analysis of this amino acid sequence gave the following results:

Homology with a Predicted ORF from *N. gonorrhoeae*

ORF 687 shows 97.0% identity over a 234 aa overlap with a predicted ORF (ORF 687) from *N. gonorrhoeae*:

```
m687/g687  97.0%  identity in 234 aa overlap 10        20        30        40        50
m687.pep  MKSRHLAL--GVAALFALAACDSKVQTSVPADSAPAASAAAAPAGLVEGQNYTVLANPIP
          ||||||||  ||||||||||||||||||||||||||||||||||||||||||||||||||
g687      MKSRHLALALGVAALFALAACDSKVQTSVPADSAPAASAAAAPAGLVEGQNYTVLANPIP
                  10        20        30        40        50        60

60        70        80        90       100       110
m687.pep  QQQAGKVEVLEFFGYFCPHCAHLEPVLSKHAKSFKDDMYLRTEHVVWQKEMLTLARLAAA
          ||||||||||||||||||||:|||||||||||||||||||||||||||||||| ||||||
g687      QQQAGKVEVLEFFGYFCPHCARLEPVLSKHAKSFKDDMYLRTEHVVWQKEMLPLARLAAA
                  70        80        90       100       110       120

120       130       140       150       160       170
m687.pep  VDMAAADSKDVANSHIFDAMVNQKIKLQNPEVLKKWLGEQTAFDGKKVLAAYESPESQAR
          ||||||:|||||||||||||||||||||:|||||||||||||||||||||||||||||||
g687      VDMAAAESKDVANSHIFDAMVNQKIKLQEPEVLKKWLGEQTAFDGKKVLAAYESPESQAR
                130       140       150       160       170       180

180       190       200       210       220       230
m687.pep  ADKMQELTETFQIDGTPTVIVGGKYKVEFADWESGMNTIDLLADKVREEQKAAQX
          | |||||||||||||||||||||||||||||||||||||||||||||||||||||
g687      AGKMQELTETFQIDGTPTVIVGGKYKVEFADWESGMNTIDLLADKVREEQKAAQX
                190       200       210       220       230
```

The following partial DNA sequence was identified in *N. meningitidis* <SEQ ID 2283>

```
a687.seq
   1 ATGAAATCCA AACACCTCGC CCTCGGCGTT GCCGCCCTGT TCGCACTTGC

51 CGCGTGCGAC AGCAAAGTCC AAACCAGCGT CCCCGCCGAC AGCGCGCCTG

101 CCGCTTCGGC AGCCGCCGCC CCGGCAGGGC TGGTCGAAGG GCAAAACTAT

151 ACTGTCCTTG CCAACCCGAT TCCCCAACAG CAGGCAGGCA AAGTCGAAGT

201 CCTTGAGTTT TTCGGCTATT TCTGTCCGCA CTGCGCCCAC CTCGAACCTG

251 TTTTAAGCAA ACACGCCAAG TCTTTTAAAG ACGATATGTA CCTGCGTACC

301 GAACACGTCG TCTGGCAGAA AGAAATGCTG ACGCTCGCAC GCCTCGCCGC

351 CGCCGTCGAT ATGGCTGCCG CCGACAGCAA AGATGTGGCG AACAGCCATA

401 TTTTCGATGC GATGGTCAAC CAAAAAATCA AGCTGCAAGA GCCGGAAGTC

451 CTCAAAAAAT GGCTGGGCGA ACAAACCGCC TTTGACGGCA AAAAAGTCCT

501 TGCCGCTTAC GAATCTCCCG AAAGCCAGGC GCGCGCCGAC AAAATGCAGG

551 AGCTGACCGA AACCTTCCAA ATCGACGGTA CGCCCACGGT TATCGTCGGC

601 GGCAAATATA AAGTCGAATT TGCCGACTGG GAGTCCGGTA TGAACACCAT

651 CGACCTTTTG GCGGACAAAG TACGCGAAGA ACAAAAAGCC GCGCACTAA
```

This corresponds to the amino acid sequence <SEQ ID 2284; ORF 687.a>:

```
a687.pep
   1 MKSKHLALGV AALFALAACD SKVQTSVPAD SAPAASAAAA PAGLVEGQNY

51 TVLANPIPQQ QAGKVEVLEF FGYFCPHCAH LEPVLSKHAK SFKDDMYLRT

101 EHVVWQKEML TLARLAAAVD MAAADSKDVA NSHIFDAMVN QKIKLQEPEV

151 LKKWLGEQTA FDGKKVLAAY ESPESQARAD KMQELTETFQ IDGTPTVIVG

201 GKYKVEFADW ESGMNTIDLL ADKVREEQKA AH*
```

Computer analysis of this amino acid sequence gave the following results:

Homology with a Predicted ORF from *N. meningitidis*

ORF 687 shows 98.7% identity over a 232 aa overlap with a predicted ORF (ORF 687) from *N. meningitidis*:

```
m687/a687  98.7%  identity in 232 aa overlap 10        20        30        40        50        60
m687.pep   MKSRHLALGVAALFALAACDSKVQTSVPADSAPAASAAAAPAGLVEGQNYTVLANPIPQQ
           |||:||||||||||||||||||||||||||||||||||||||||||||||||||||||||
a687       MKSKHLALGVAALFALAACDSKVQTSVPADSAPAASAAAAPAGLVEGQNYTVLANPIPQQ
                    10        20        30        40        50        60

70        80        90       100       110       120
m687.pep   QAGKVEVLEFFGYFCPHCAHLEPVLSKHAKSFKDDMYLRTEHVVWQKEMLTLARLAAAVD
           ||||||||||||||||||||||||||||||||||||||||||||||||||||||||||||
a687       QAGKVEVLEFFGYFCPHCAHLEPVLSKHAKSFKDDMYLRTEHVVWQKEMLTLARLAAAVD
                    70        80        90       100       110       120

130       140       150       160       170       180
m687.pep   MAAADSKDVANSHIFDAMVNQKIKLQNPEVLKKWLGEQTAFDGKKVLAAYESPESQARAD
           ||||||||||||||||||||||||||:|||||||||||||||||||||||||||||||||
a687       MAAADSKDVANSHIFDAMVNQKIKLQEPEVLKKWLGEQTAFDGKKVLAAYESPESQARAD
                   130       140       150       160       170       180

190       200       210       220       230
m687.pep   KMQELTETFQIDGTPTVIVGGKYKVEFADWESGMNTIDLLADKVREEQKAAQX
           ||||||||||||||||||||||||||||||||||||||||||||||||||||:|
a687       KMQELTETFQIDGTPTVIVGGKYKVEFADWESGMNTIDLLADKVREEQKAAHX
                   190       200       210       220       230
```

The following partial DNA sequence was identified in *N. gonorrhoeae* <SEQ ID 2285>

```
g688.seq
    1 GTGCTACACT AGACATCCCG ATTTGCACAG AAAGGTTCTC CCGTGAACAA

51 AACCCTCATC CTCGCCCTTT CCGCCCTGTT CAGCCTGACC GCGTGCAGCG

101 TCGAACGCGT CTCGCTGTTT CCCTCCTACA AACTCAAAAT CATCCAAGGC

151 AACGAACTCG AACCGCGCGC CGTTGCCGCC CTGCGCCCCG GCATGACCAA

201 AGACCAAGTC CTGCTCCTGC TCGGCAGCCC CATACTGCGC GACGCTTTCC

251 ATACCGACCG CTGGGACTAT ACCTTCAACA CCTCCCGCAA CGGCATCATC

301 AAAGAACGCA GCAACCTGAC CGTCTATTTT GAAAACGGCG TACTCGTCCG

351 CACCGAAGGC GACGCCCTCC AAAATGCCGC CGAAGCCCTC CGCGCGAAAC

401 AAAACGCAGA CAAACAATAA
```

This corresponds to the amino acid sequence <SEQ ID 2286; ORF 688>:

```
g688.pep
    1 VLH*TSRFAQ KGSPVNKTLI LALSALFSLT ACSVERVSLF PSYKLKIIQG

51 NELEPRAVAA LRPGMTKDQV LLLLGSPILR DAFHTDRWDY TFNTSRNGII

101 KERSNLTVYF ENGVLVRTEG DALQNAAEAL RAKQNADKQ*
```

The following partial DNA sequence was identified in *N. meningitidis* <SEQ ID 2287>:

```
m688.seq
    1 GTGTTACACT ACCCATCCCG ATTTGCACAG AAAGGCATTT CCGTGAACAA

51 AACCCTCATC CTCGCCCTTT CCGCCCTCCT CGGCCTTGCC GCGTGCAGTG

101 CCGAACGCGT TTCACTGTTC CCCTCGTACA AACTCAAAAT CATACAGGGC

151 AACGAACTCG AACCGCGCGC CGTTGCCGCC CTCCGCCCCG GCATGACCAA

201 AGACCAAGTC CTGCTCCTGC TCGGCAGCCC CATACTGCGC GACGCATTCC

251 ATACCGACCG CTGGGACTAT ACCTTCAACA CCTCCCGCAA CGGCATCATC

301 AAAGAACGCA GCAATCTGAC CGTCTATTTT GAAAACGGCG TACTCGTCCG

351 CACCGAAGGC GACGTCCTGC AAAACGCTGC CGAAGCCCTC AAAGACCGCC

401 AAAACACAGA CAAACCATAA
```

This corresponds to the amino acid sequence <SEQ ID 2288; ORF 688>:

```
m688.pep
    1 VLHYPSRFAQ KGISVNKTLI LALSALLGLA ACSAERVSLF PSYKLKIIQG

51 NELEPRAVAA LRPGMTKDQV LLLLGSPILR DAFHTDRWDY TFNTSRNGII

101 KERSNLTVYF ENGVLVRTEG DVLQNAAEAL KDRQNTDKP*
```

Computer analysis of this amino acid sequence gave the following results:
Homology with a Predicted ORF from *N. gonorrhoeae*
ORF 688 shows 90.6% identity over a 138 aa overlap with a predicted ORF (ORF 688) from *N. gonorrhoeae*:

```
    m688/g688   90.6%  identity in 138 aa overlap 10        20        30        40        50        60
        m688.pep  VLHYPSRFAQKGISVNKTLILALSALLGLAACSAERVSLFPSYKLKIIQGNELEPRAVAA
                  |||  |||||||  |||||||||||||::|:|||:|||||||||||||||||||||||||
        g688      VLHXYSRFAQKGSPVNKTLILALSALFSLTACSVERVSLFPSYKLKIIQGNELEPRAVAA
                    10        20        30        40        50        60

70        80        90       100       110       120
        m688.pep  LRPGMTKDQVLLLLGSPILRDAFHTDRWDYTFNTSRNGIIKERSNLTVYFENGVLVRTEG
                  ||||||||||||||||||||||||||||||||||||||||||||||||||||||||||||
        g688      LRPGMTKDQVLLLLGSPILRDAFHTDRWDYTFNTSRNGIIKERSNLTVYFENGVLVRTEG
                    70        80        90       100       110       120

130       140
        m688.pep  DVLQNAAEALKDRQNTDKPX
                  |:|||||||| :  ||:||
        g688      DALQNAAEALRAKQNADKQX
                   130       140
```

The following partial DNA sequence was identified in *N. meningitidis* <SEQ ID 2289>

```
a688.seq
  1 GTGTTACACT ACCCATCCCG ATTTGCACAG AAAGGCATTT CCGTGAACAA

51 AACCCTCATC CTCGCCCTTT CCGCCCTCCT CGGCCTTGCC GCGTGCAGCG

101 TCGAACGCGT TTCACTGTTC CCCTCGTACA AACTCAAAAT CATACAGGGC

151 AACGAACTCG AACCTCGCGC CGTCGCCTCC CTCCGCCCCG GTATGACCAA

201 AGACCAAGTC CTGCTCCTGC TCGGCAGCCC CATACTGCGC GACGCATTCC

251 ATACCGACCG CTGGGACTAT ACCTTCAACA CCTCCCGCAA CGGCATCATC

301 AAAGACCGAA GCAATCTGAC CGTCTATTTT GAAAACGGCG TGCTCGTCCG

351 CACCGAAGGC AACGCCCTGC AAAATGCCGC CGAAGCCCTC CGCGTAAAAC

401 AAAACGCAGA CAAACAATAA
```

This corresponds to the amino acid sequence <SEQ ID 2290; ORF 688.a>:

```
a688.pep
  1 VLHYPSRFAQ KGISVNKTLI LALSALLGLA ACSVERVSLF PSYKLKIIQG

51 NELEPRAVAS LRPGMTKDQV LLLLGSPILR DAFHTDRWDY TFNTSRNGII

101 KDRSNLTVYF ENGVLVRTEG NALQNAAEAL RVKQNADKQ*
```

Computer analysis of this amino acid sequence gave the following results:
Homology with a Predicted ORF from *N. meningitidis*
ORF 688 shows 93.5% identity over a 138 aa overlap with a predicted ORF (ORF 688) from *N. meningitidis*

```
    m688/g688   93.5%  identity in 138 aa overlap 10        20        30        40        50        60
        m688.pep  VLHYPSRFAQKGISVNKTLILALSALLGLAACSAERVSLFPSYKLKIIQGNELEPRAVAA
                  |||||||||||||||||||||||||||||||||:||||||||||||||||||||||||:
        a688      VLHYPSRFAQKGISVNKTLILALSALLGLAACSVERVSLFPSYKLKIIQGNELEPRAVAS
                    10        20        30        40        50        60
```

```
                        70        80        90       100       110       120
m688.pep   LRPGMTKDQVLLLLGSPILRDAFHTDRWDYTFNTSRNGIIKERSNLTVYFENGVLVRTEG
           ||||||||||||||||||||||||||||||||||||||:|||||||||||||||||||||
a688       LRPGMTKDQVLLLLGSPILRDAFHTDRWDYTFNTSRNGIIKDRSNLTVYFENGVLVRTEG
                        70        80        90       100       110       120

130       140
m688.pep   DVLQNAAEALKDRQNTDKPX
           ::|||||||||:  :||:||
a688       NALQNAAEALRVKQNADKQX
                       130       140
```

The following partial DNA sequence was identified in *N. gonorrhoeae* <SEQ ID 2291>

```
g689.seq (partial)
     1  ..TCTCCGCCCC TTCCTCCGAT GAGCGGAAAA CTGATGGCGG TTTTGATGGC

51    GGTACTGGTC GCGCTGATGC CGTTTTCCAT CGATGCCTAC CTGCCCGCGA

101    TTCCCGAAAT GGCGCAGCCG CTGAACGCGG ATATCCACCG TATCGAATAG

151    AGTCTGAGTT TGTTTATGTT CGGCACGGCG TTCGGGCAAG TGGCCGGCGG

201    CGCGGTGTCC GACATCAAAG GCGCAAACC CGTCGCCCTG ACCGGTTTGA

251    TTGTATATTG CCTTGCCGTT GCCGCCATCG TATTTGCTTC GAGTACCGAA

301    CAGCTCCTTA ACCTGCGTGC GGTACAGGCG TTCGGCGCAG GCATGGCTGT

351    AGTCATCGTc ggtgcgatgg tgcgcgatTA TTATTCCGGA CGCAAAGCCG 401    cgcAGATGTT TGCCCTTATC GGCATCATTC TGATGGTTGT GCCGCTGGCC

451    GCACCCATGG TCGGCGCATT GTTGCAGGGA TTGGGCGGAT GGCGGGCGAT

501    TTTCGTTTTC ttggcGgcgT ATTCGCCGGT GCTGCCCGGT TTGGTACAGT

551    ATTTCCTGCC CAATCCCGCC GTCGGCGGCA AAATCGGCAG GGATGTGTTC

601    GGGCTGGTGG CGGGGCGGTT CAAGCGCGTA TTGAAAACCC GTGCCGCGAT

651    GGGTtatCTG TTTTTTCAGG CATTCAGCTT CGGTTCGATG TTCGCCTTTC

701    TGACCGAATC TTCCTTCGTG TACCGGCAGC TCTACCACGT TACGCCGCAC

751    CGGTACGCAT GGGTGTTTGC ACTCAACATC ATCACGATGA TGTTTTTCAG

801    CCGCGTTACC GCGTGGCGGC TTAAAACCGG CGCGCATCCG CAAAGCATCC

851    TGCTGCGGGG GATTGTCGTC CAATTTGCCG CCAACCCGTC CCAACTCGCC

901    GCCGTGCTGT TTTTCGGGTT GCCCCCGTTT TGGCTGCCGG TCGCGTGCGT

951    GATGTTTTCC GTCGGTACGC AGGGCCTGGT CGGTGCGGAC ACGCAGGCAT

1001    GCTTTATGTC TTATTTCAAA GAAGAGGGCG GCAGCGCGAA CGCCGTGTCG

1051    GGTGTATTCC GGTCCTTAAT CGGCGCGGGC GTGGTCATGG CGGCAACCGT

1101    GATGGCGGCA ACCATGACCG CGTCCGCCTC TTGCGGCATT GCGCTTTTGT

1151    GGCTCTGCTC GCACAAGGCG TGGAAGGAAA ACGAAAAAAA GCGAATACTT
```

This corresponds to the amino acid sequence <SEQ ID 2292; ORF 689>:

```
g689.pep (partial)
     1  ..SPPLPPMSGK LMAVLMAVLV ALMPFSIDAY LPAIPEMAQP LNADIHRIE*

51    SLSLFMFGTA FGQVAGGAVS DIKGRKPVAL TGLIVYCLAV AAIVFASSTE

101    QLLNLRAVQA FGAGMAVVIV GAMVRDYYSG RKAAQMFALI GIILMVVPLA

151    APMVGALLQG LGGWRAIFVF LAAYSPVLPG LVQYFLPNPA VGGKIGRDVF
```

-continued

```
201   GLVAGRFKRV LKTRAAMGYL FFQAFSFGSM FAFLTESSFV YRQLYHVTPH

251   RYAWVFALNI ITMMFFSRVT AWRLKTGAHP QSILLRGIVV QFAANPSQLA

301   AVLFFGLPPF WLPVACVMFS VGTQGLVGAD TQACFMSYFK EEGGSANAVS

351   GVFRSLIGAG VVMAATVMAA TMTASASCGI ALLWLCSHKA WKENEKKRIL
```

The following partial DNA sequence was identified in *N. meningitidis* <SEQ ID 2293>:

```
m689.seq
   1 TTGTTAATCC ACTATATCGT TCCGGTTCGT CCGGTTTTGC CGGGGCTTTT

51 GTTGCCGCCT GTTTGTGCCG GTGTGTTAAA ATTTTCCGTT TCCGCGTATT

101 GTGTTTTCCG CCGCCGGGCG GTTTGTTTGC GAATCGGACG AGAATTTATG

151 CCTTCTGCCC ATTATCCTGA AATGAGCGAA AAACTGATGG CGGTTTTGAT

201 GGCGATGCTG GTTACGCTGA TGCCGTTTTC CATCGATGCC TACCTGCCCG

251 CGATTCCCGA AATGGCGCAA TCGCTGAACG CGGATGTTCA CCGCATCGAA

301 CAGAGTTTGA GTTTGTTTAT GTTCGGCACG GCGTTCGGAC AGGTGGTCGG

351 CGGTTCGGTG TCCGACATCA AAGGGCGCAA ACCCGTCGCC CTGACCGGTT

401 TGATTGTATA TTGCCTTGCC GTTGCCGCCA TCGTATTTGT TTCGAGTGCC

451 GAACAGCTCC TCAACCTGCG CGTCGTGCAG GCATTCGGTG CGGGCATGAC

501 TGTGGTCATC GTCGGCGCAA TGGTGCGCGA TTATTATTCC GGACGCAAAG

551 CCGCCCAGAT GTTTGCCCTT ATCGGCATCA TTTTGATGGT TGTGCCGCTG

601 GTCGCACCCA TGGTCGGCGC ATTGTTGCAG GGCTTGGGTG GCTGGCAGGC

651 GATTTTTGTT TTTCTGGCGG CGTATTCGCT GGTGCTGCTC GGTTTGGTAC

701 AGTATTTCCT GCCCAAGCCC GCCGTCGGCG GCAAAATCGG ACGGGACGTG

751 TTCGGGCTGG TGGCGGGGCG GTTCAAGCGC GTATTGAAAA CCCGTGCTGC

801 GATGGGTTAT CTGTTTTTTC AGGCATTCAG CTTCGGTTCG ATGTTCGCCT

851 TTCTGACCGA ATCTTCCTTC GTGTACCAGC AGCTCTACCG TGTTACGCCT

901 CATCAATACG CTTGGGCGTT TGCACTCAAC ATCATCACGA TGATGTTTTT

951 CAACCGCGTT ACCGCGTGGC GGCTCAAAAC CGGCGTGCAT CCGCAAAGCA

1001 TCCTGCTGTG GGGGATTGTC GTCCAGTTTG CCGCCAACCT GTCCCAACTC

1051 GCCGCCGTGC TGTTTTTCGG GTTGCCCCCG TTTTGGCTGC TGGTCGCGTG

1101 CGTGATGTTT TCCGTCGGTA CGCAGGGCTT GGTCGGTGCA AACACGCAGG

1151 CGTGTTTTAT GTCCTATTTC AAAGAAGAGG GCGGCAGCGC AAACGCCGTA

1201 TTGGGTGTAT TCCAATCTTT AATCGGCGCG GGGGTGGGTA TGGCGGCGAC

1251 CTTCTTGCAC GACGGTTCGG CAACCGTGAT GGCGGCAACG ATGACCGCGT

1301 CCACCTCTTG CGGCATTGCG CTTCTGTGGC TCTGCTCGCA TCGTGCGTGG

1351 AAAGAAAACG GGCAAAGCGA ATACCTTTAA
```

This corresponds to the amino acid sequence <SEQ ID 2294; ORF 689>:

```
m689.pep
  1 LLIHYIVPVR PVLPGLLLPP VCAGVLKFSV SAYCVFRRRA VCLRIGREFM

51 PSAHYPEMSE KLMAVLMAML VTLMPFSIDA YLPAIPEMAQ SLNADVHRIE
```

```
101 QSLSLFMFGT AFGQVVGGSV SDIKGRKPVA LTGLIVYCLA VAAIVFVSSA

151 EQLLNLRVVQ AFGAGMTVVI VGAMVRDYYS GRKAAQMFAL IGIILMVVPL

201 VAPMVGALLQ GLGGWQAIFV FLAAYSLVLL GLVQYFLPKP AVGGKIGRDV

251 FGLVAGRFKR VLKTRAAMGY LFFQAFSFGS MFAFLTESSF VYQQLYRVTP

301 HQYAWAFALN IITMMFFNRV TAWRLKTGVH PQSILLWGIV VQFAANLSQL

351 AAVLFFGLPP FWLLVACVMF SVGTQGLVGA NTQACFMSYF KEEGGSANAV

401 LGVFQSLIGA GVGMAATFLH DGSATVMAAT MTASTSCGIA LLWLCSHRAW

451 KENGQSEYL*
```

Computer analysis of this amino acid sequence gave the following results:

Homology with a Predicted ORF from N. gonorrhoeae

ORF 689 shows 88.0% identity over a 408 aa overlap with a predicted ORF (ORF 689) from N. gonorrhoeae:

```
    m689/a689  88.0% identity in 408 aa overlap 30        40        50        60        70        80
    m689.pep  CAGVLKFSVSAYCVFRRRAVCLRIGREFMPSAHYPEMSEKLMAVLMAMLVTLMPFSIDAY
                                             |  |  ||  ||||||||||:|:||||||||||
    g689                                     SPPLPPMSGKLMAVLMAVLVALMPFSIDAY
                                                      10        20        30

90       100       110       120       130       140
    m689.pep  LPAIPEMAQSLNADVHRIEQSLSLFMFGTAFGQVVGGSVSDIKGRKPVALTGLIVYCLAV
              ||||||||| ||||:|||| ||||||||||||||:||:|||||||||||||||||||||
    g689      LPAIPEMAQPLNADIHRIEXSLSLFMFGTAFGQVAGGAVSDIKGRKPVALTGLIVYCLAV
                    40        50        60        70        80        90

150       160       170       180       190       200
    m689.pep  AAIVFVSSAEQLLNLRVVQAFGAGMTVVIVGAMVRDYYSGRKAAQMFALIGIILMVVPLV
              |||||:||:|||||||:||||||||||||||||||||||||||||||||||||||||||:
    g689      AAIVFASSTEQLLNLRAVQAFGAGMAVVIVGAMVRDYYSGRKAAQMFALIGIILMVVPLA
                   100       110       120       130       140       150

210       220       230       240       250       260
    m689.pep  APMVGALLQGLGGWQAIFVFLAAYSLVLLGLVQYFLPKPAVGGKIGRDVFGLVAGRFKRV
              ||||||||||||||:|||||||||| |||:||||||||| :|||||||||||||||||||
    g689      APMVGALLQGLGGWRAIFVFLAAYSPVLPGLVQYFLPNPAVGGKIGRDVFGLVAGRFKRV
                   160       170       180       190       200       210

270       280       290       300       310       320
    m689.pep  LKTRAAMGYLFFQAFSFGSMFAFLTESSFVYQQLYRVTPHQYAWAFALNIITMMFFNRVT
              |||||||||||||||||||||||||||||||:|||:||||:|||| ||||||||||:|||
    g689      LKTRAAMGYLFFQAFSFGSMFAFLTESSFVYRQLYHVTPHRYAWVFALNIITMMFFSRVT
                   220       230       240       250       260       270

330       340       350       360       370       380
    m689.pep  AWRLKTGVHPQSILLWGIVVQFAANLSQLAAVLFFGLPPFWLLVACVMFSVGTQGLVGAN
              |||||||:||||||| |||||||||:||||||||||||||| |||||||||||||||| :
    g689      AWRLKTGAHPQSILLRGIVVQFAANPSQLAAVLFFGLPPFWLPVACVMFSVGTQGLVGAD
                   280       290       300       310       320       330

390       400       410       420       430       440
    m689.pep  TQACFMSYFKEEGGSANAVLGVFQSLIGAGVGMAATFLHDGSATVMAATMTASTSCGIAL
              |||||||||||||||||||:|||:|||||||:||||    ||||||||||||||:|||||
    g689      TQACFMSYFKEEGGSANAVSGVFRSLIGAGVVMAAT--------VMAATMTASASCGIAL
                   340       350       360               370       380

450       460
    m689.pep  LWLCSHRAWKENGQSEYLX
              ||||||:|||| :::  |
    g689      LWLCSHKAWKENEKKRIL
                   390       400
```

The following partial DNA sequence was identified in N. meningitidis <SEQ ID 2295>

```
    a689.seq
       1  TTGTTAATCC ACTATATCGT TCCGGTTCGT CCGGTTTTGC CGGGGCTTTT

51  GTTGCCGCCT GTTTGTGCCG GTGTGTTAAA ATTTTCCGTT TCCGCGTATT

101  GTGTTTTCCG CCGCCGGGCG GTTTGTTTGC GAATCGGACG AGAATTTATG
```

```
 151 CCTTCTGCCC ATTATCCTGA AATGAGCGAA AAACTGATGG CGGTTTTGAT

201 GGCGATGCTG GTTACGCTGA TGCCGTTTTC CATCGATGCC TACCTGCCCG

251 CGATTCCCGA AATGGCGCAG TCGCTGAACG CGGATGTCCA CCGCATCGAA

301 CAGAGCCTGA GTTTGTTTAT GTTCGGCACG GCGTTCGGAC AGGTGGTCGG

351 CGGTTCGGTG TCCGACATCA AGGGCGCAA ACCCGTCGCG CTGACCGGAC

401 TGGCCGTCTA CTGCCTTGCC GTTGCCGCCA TCGTATTTGC TTCGAGTGCC

451 GAACAGCTCC TCAACCTGCG CGTCGTGCAG GCATTCGGTG CGGGCATGAC

501 TGTGGTCATC GTCGGCGCAA TGGTGCGCGA TTATTATTCC GGACGCAAAG

551 CCGCCCAGAT GTTTGCCCTT ATCGGCATCA TTTTGATGGT TGTGCCGCTG

601 GTCGCACCCA TGGTCGGCGC ATTGTTGCAG GGCTTGGGTG GCTGGCAGGC

651 GATTTTTGTT TTTCTGGCGG CGTATTCGCT GGTGCTGCTC GGTTTGGTAC

701 AGTATTTCCT GCCCAAGCCC GCCGTCGGCG GCAAAATCGG CAGGGATGTG

751 TTCGGGCTGG TGGCTGGGCG GTTCAAACGC GTATTGAAAA CCCGTGCCGC

801 GATGGGTTAT CTGTTTTTTC AGGCATTCAG CTTCGGTTCG ATGTTCGCCT

851 TTCTGACCGA ATCTTCCTTC GTGTACCAGC AGCTCTACCA CGTTACGCCG

901 CACCAGTACG CTTGGGCGTT TGCACTCAAC ATCATCACGA TGATGTTTTT

951 CAACCGTATT ACCGCGTGGC GGCTCAAAAC CGGCGTGCAT CCGCAAAGCA

1001 TCCTGCTGTG GGGGATTGTC GTCCAGTTTG CCGCCAACCT GTCCCAACTC

1051 GCCGCCGTGC TGTTTTTCGG GTTGCCCCCG TTTTGGCTGC TGGTCGCGTG

1101 CGTGATGTTT TCCGTCGGTA CGCAGGGCTT GGTCGGTGCA ACACGCAGG

1151 CGTGTTTTAT GTCCTATTTC AAAGAAGAGG GCGGCAGCGC AAACGCCGTA

1201 TTGGGTGTAT TCCAATCTTT AATCGGCGCG GGGGTGGGTA TGGCGGCGAC

1251 CTTCTTGCAC GACGGTTCGG CAACCGTGAT GGCGGCAACC ATGACCGCGT

1301 CTACCTCTTG CGGCATTGCG CTTTTGTGGC TCTGCTCGCA TCGTGCGTGG

1351 AAAGAAAACG GGCAAAGCGA ATACCTTTAA
```

This corresponds to the amino acid sequence <SEQ ID 2296; ORF 689.a>:

```
a689.pep
  1 LLIHYIVPVR PVLPGLLLPP VCAGVLKFSV SAYCVFRRRA VCLRIGREFM

51 PSAHYPEMSE KLMAVLMAML VTLMPFSIDA YLPAIPEMAQ SLNADVHRIE

101 QSLSLFMFGT AFGQVVGGSV SDIKGRKPVA LTGLAVYCLA VAAIVFASSA

151 EQLLNLRVVQ AFGAGMTVVI VGAMVRDYYS GRKAAQMFAL IGIILMVVPL

201 VAPMVGALLQ GLGGWQAIFV FLAAYSLVLL GLVQYFLPKP AVGGKIGRDV

251 FGLVAGRFKR VLKTRAAMGY LFFQAFSFGS MFAFLTESSF VYQQLYHVTP

301 HQYAWAFALN IITMMFFNRI TAWRLKTGVH PQSILLWGIV VQFAANLSQL

351 AAVLFFGLPP FWLLVACVMF SVGTQGLVGA NTQACFMSYF KEEGGSANAV

401 LGVFQSLIGA GVGMAATFLH DGSATVMAAT MTASTSCGIA LLWLCSHRAW

451 KENGQSEYL*
```

Computer analysis of this amino acid sequence gave the following results:

Homology with a Predicted ORF from *N. meningitidis*

ORF 689 shows 99.1% identity over a 459 aa overlap with a predicted ORF (ORF 689) from *N. meningitidis*:

```
m689/a689  99.1% identity in 459 aa overlap 10        20        30        40        50        60
   m689.pep  LLIHYIVPVRPVLPGLLLPPVCAGVLKFSVSAYCVFRRRAVCLRIGREFMPSAHYPEMSE
             ||||||||||||||||||||||||||||||||||||||||||||||||||||||||||||
       a689  LLIHYIVPVRPVLPGLLLPPVCAGVLKFSVSAYCVFRRRAVCLRIGREFMPSAHYPEMSE
                    10        20        30        40        50        60

70        80        90       100       110       120
   m689.pep  KLMAVLMAMLVTLMPFSIDAYLPAIPEMAQSLNADVHRIEQSLSLFMFGTAFGQVVGGSV
             ||||||||||||||||||||||||||||||||||||||||||||||||||||||||||||
       a689  KLMAVLMAMLVTLMPFSIDAYLPAIPEMAQSLNADVHRIEQSLSLFMFGTAFGQVVGGSV
                    70        80        90       100       110       120

130       140       150       160       170       180
   m689.pep  SDIKGRKPVALTGLIVYCLAVAAIVFVSSAEQLLNLRVVQAFGAGMTVVIVGAMVRDYYS
             ||||||||||||| ||||||||||||||:|||||||||||||||||||||||||||||||
       a689  SDIKGRKPVALTGLAVYCLAVAAIVFASSAEQLLNLRVVQAFGAGMTVVIVGAMVRDYYS
                   130       140       150       160       170       180

190       200       210       220       230       240
   m689.pep  GRKAAQMFALIGIILMVVPLVAPMVGALLQGLGGWQAIFVFLAAYSLVLLGLVQYFLPKP
             ||||||||||||||||||||||||||||||||||||||||||||||||||||||||||||
       a689  GRKAAQMFALIGIILMVVPLVAPMVGALLQGLGGWQAIFVFLAAYSLVLLGLVQYFLPKP
                   190       200       210       220       230       240

250       260       270       280       290       300
   m689.pep  AVGGKIGRDVFGLVAGRFKRVLKTRAAMGYLFFQAFSFGSMFAFLTESSFVYQQLYRVTP
             |||||||||||||||||||||||||||||||||||||||||||||||||||||||:|||
       a689  AVGGKIGRDVFGLVAGRFKRVLKTRAAMGYLFFQAFSFGSMFAFLTESSFVYQQLYHVTP
                   250       260       270       280       290       300

310       320       330       340       350       360
   m689.pep  HQYAWAFALNIITMMFFNRVTAWRLKTGVHPQSILLWGIVVQFAANLSQLAAVLFFGLPP
             ||||||||||||||||||||:|||||||||||||||||||||||||||||||||||||||
       a689  HQYAWAFALNIITMMFFNRITAWRLKTGVHPQSILLWGIVVQFAANLSQLAAVLFFGLPP
                   310       320       330       340       350       360

370       380       390       400       410       420
   m689.pep  FWLLVACVMFSVGTQGLVGANTQACFMSYFKEEGGSANAVLGVFQSLIGAGVGMAATFLH
             ||||||||||||||||||||||||||||||||||||||||||||||||||||||||||||
       a689  FWLLVACVMFSVGTQGLVGANTQACFMSYFKEEGGSANAVLGVFQSLIGAGVGMAATFLH
                   370       380       390       400       410       420

430       440       450       460
   m689.pep  DGSATVMAATMTASTSCGIALLWLCSHRAWKENGQSEYLX
             ||||||||||||||||||||||||||||||||||||||||
       a689  DGSATVMAATMTASTSCGIALLWLCSHRAWKENGQSEYLX
                   430       440       450       460
```

The following partial DNA sequence was identified in *N. gonorrhoeae* <SEQ ID 2297>

```
g690.seq (partial)
  1 ATGAAAAACA AAACGTCATC ACTTCCCTTA TGGCTTGCCG CAATCATGCT

51 GGCCGCGCGT TCCCCGAGCA AGAAGATAAA ACGAAAGAA AACGGCGCAT

101 CCGCCGCTTC GTCTTCCGCG TCATCGGCTT CTTCCCAAAC CGATTTGCAA

151 CCGGCCGCAT CCGCCCCTGA TAACGTCAAG CAGGCAGAAA GCGCGCCACT

201 GTGAAATTGC ACCGGCCTGC ACCCCGCCGC CGGCATTGGC GATCTCATAC

251 AGCAAATCGC CGAACACATC GACTCGGACT GTCTGTTTGC CCTTTCCCAT

301 AACGAACTGG AAACCCGTTT CGGCTTACCC GGCGGCGGCT ATGACAACAT

351 ACAGCGGctG CTgttCCCG ACATCCGCCC TGAAGATCCC GACTACCATC

401 AGAAAATCAT GCTGGCAATC GAAGACTTGC GTTACGGAAC GCGCACCATC

451 AGccgGCAGG CACAAGATGC CATAATGGAA CAGGAACGCC gcctccGaGa 501 agCGACGCTG ATGCTGACAC AGGGCAGTCA AAAACCCGC GGaCAAGGCG 551 AGGAACCGAA ACGCGCACGT TATTTTGAAG TTTCGGCAAC ATCtgCCtaT
```

-continued

```
601 TTgaaccggC ACAAcaacGG ACTTggcgGC AATTTCCAAT ACATCGGCCA

651 ATTGCCCGGC TATCTGAAAA TGCACGGAGA AATGCTTGAA AACCAATCAC

701 TCTTCCGGCT GTCCAACCGT GAACGCAATC CCGACAAACC GTTTTTAGAC

751 ATCCATTTTG ACGAAAATGG CAAAATCACG CGTATTGTCG TTTACGAAAA

801 AAATATCTAT...
```

This corresponds to the amino acid sequence <SEQ ID 2298; ORF 690>:

```
g690.pep (partial)
  1 MKNKTSSLPL WLAAIMLAAR SPSKEDKTKE NGASAASSSA SSASSQTDLQ

51 PAASAPDNVK QAESAPL*NC TGLHPAAGIG DLIQQIAEHI DSDCLFALSH

101 NELETRFGLP GGGYDNIQRL LFPDIRPEDP DYHQKIMLAI EDLRYGTRTI

151 SRQAQDAIME QERRLREATL MLTQGSQKTR GQGEEPKRAR YFEVSATSAY

201 LNRHNNGLGG NFQYIGQLPG YLKMHGEMLE NQSLFRLSNR ERNPDKPFLD

251 IHFDENGKIT RIVVYEKNIY ...
```

The following partial DNA sequence was identified in *N. meningitidis* <SEQ ID 2299>:

```
m690.seq..
  1 ATGAAAAACA AAACCTCATC ACTTCTCTTA TGGCTTACCG CAATCATGCT

51 GACCGCGTGT TCTCCGAGCA AAGACGATAA AACCAAAGAA GTCGGTGCAT

101 CCGCTGCTTC GTCCTCCGCG TCATCAGCTC CTTCCCAAAC CGATTTGCAA

151 CCGACCGCAT CCGCCCCTGA TAACGTCAAG CAGGCAGAAA GCGCGCCGCC

201 GTCAAATTGC ACCAGCCTGC ACCCCGCCAC CGGCATTGAC GATCTCATGC

251 AGCAAATCGC CGAACACATT GACTCGGACT GTCTGTTTGC CCTTTCCCAT

301 CACGAACTGG AAACCCGTTT CGGCTTACCC GACGGTGGCT ATGACAACAT

351 ACAGCGGCTG CTGTTTCCCG ACATCCGCCC TGAAGATCCC GACTACCATC

401 AGAAAATCAT ACTGGCAATT GAAGACTTGC GTTACGGAAA GCGCACGATC

451 AGCCGGCAGG CACAAAATGC CTTGATGGAA CAGGAACGCC GCCTCCGAGA

501 AGCGACGCTG TTGCTGATAC AGGGCAGTCA AGAAACCCGC GGACAAGGCG

551 AGGAGCCGAA ACGCACGCGT TATTTTGAAG TTTCGGCAAC CCCTGCCTAT

601 TCGAGCCGGC ACAACAACGG ACTTGGCGGC AATTTCCAAT ACATCAGCCA

651 ATTGCCCGGC TATCTGAAAA TACACGGAGA AATGCTTGAA AACCAATCAC

701 TCTTCCGGCT GTCCAACCGT GAACGCAATC CCGACAAACC GTTTTTAGAC

751 ATCCATTTTG ACGAAAATGG CAAAATCACG CGTATTGTCG TTTACGAAAA

801 AAACATCTAC TTCAATCCAA ACACGGGGCG AATATAA
```

This corresponds to the amino acid sequence <SEQ ID 2300; ORF 690>:

```
m690.pep
  1 MKNKTSSLLL WLTAIMLTAC SPSKDDKTKE VGASAASSSA SSAPSQTDLQ

51 PTASAPDNVK QAESAPPSNC TSLHPATGID DLMQQIAEHI DSDCLFALSH

101 HELETRFGLP DGGYDNIQRL LFPDIRPEDP DYHQKIILAI EDLRYGKRTI
```

```
151 SRQAQNALME QERRLREATL LLIQGSQETR GQGEEPKRTR YFEVSATPAY

201 SSRHNNGLGG NFQYISQLPG YLKIHGEMLE NQSLFRLSNR ERNPDKPFLD

251 IHFDENGKIT RIVVYEKNIY FNPNTGRI*
```

Computer analysis of this amino acid sequence gave the following results:
Homology with a Predicted ORF from *N. gonorrhoeae*
ORF 690 shows 89.3% identity over a 408 aa overlap with a predicted ORF (ORF 690) from *N. gonorrhoeae*:

```
m690/g690 89.3% identity in 408 aa overlap 10         20         30         40         50         60
  m690.pep  MKNKTSSLLLWLTAIMLTACSPSKDDKTKEVGASAASSSASSAPSQTDLQPTASAPDNVK
            ||||||||   |:||||:  ||||:||||  ||||||||||||||||  ||||||||||
  g690      MKNKTSSLPLWLAAIMLAARSPSKEDKTKENGASAASSSASSASSQTDLQPAASAPDNVK
                    10         20         30         40         50         60

70         80         90        100        110        120
  m690.pep  QAESAPPSNCTSLHPATGIDDLMQQIAEHIDSDCLFALSHHELETRFGLPDGGYDNIQRL
            ||||||   |||:||||:||  ||:||||||||||||||||:|||||||||  ||||||
  g690      QAESAPLXNCTGLHPAAGIGDLIQQIAEHIDSDCLFALSHNELETRFGLPGGGYDNIQRL
                    70         80         90        100        110        120

130        140        150        160        170        180
  m690.pep  LFPDIRPEDPDYHQKIILAIEDLRYGKRTISRQAQNALMEQERRLREATLLLIQGSQETR
            ||||||||||||||||:|||||||||  ||||||||:|:|||||||||||:| ||||:||
  g690      LFPDIRPEDPDYHQKIMLAIEDLRYGTRTISRQAQDAIMEQERRLREATLMLTQGSQKTR
                   130        140        150        160        170        180

190        200        210        220        230        240
  m690.pep  GQGEEPKRTRYFEVSATPAYSSRHNNGLGGNFQYISQLPGYLKIHGEMLENQSLFRLSNR
            ||||||||:|||||||| :|::||||||||||||||:||||||:|||||||||||||||||
  g690      GQGEEPKRARYFEVSATSAYLNRHNNGLGGNFQYIGQLPGYLKMHGEMLENQSLFRLSNR
                   190        200        210        220        230        240

250        260        270        279
  m690.pep  ERNPDKPFLDIHFDENGKITRIVVYEKNIYFNPNTGRIX
            ||||||||||||||||||||||||||||||
  g690      ERNPDKPFLDIHFDENGKITRIVVYEKNIY
                   250        260        270
```

The following partial DNA sequence was identified in *N. meningitidis* <SEQ ID 2301>

```
a690.seq
   1 ATGAAAAACA AAACCTCATC ACTTCTCTTA TGGCTTGCCG CAATGATGCT

51 GACCGCGTGT TCCCCGAGCA AGAAGATAA AACGAAAGAA AACGGCGCAT

101 CCGCCGCCTC GTCCACGGCA TCCGCCGCTT CGTCTTCCGC GCCCCAAACC

151 GATTTGCAAC CGGCCGCATC CGCCCCTGAT AACGTCAAGC AGGCAGAAAG

201 CGTGCCGCCG TCAAATTGCA CCGACCTGCA CCCCGCCACC GGCATTGACG

251 ATCTCATGCA GCAAATCGCC GAACACATTG ACTCGGACTG TCTGTTTGCC

301 CTTTCCCATC ACGAACTGGA AACCCGTTTC GGCTTACCCG GCGGCGGCTA

351 TGACAACATA CAGCGGCTGC TGTTTCCCGA CATCCGCCCT GAAGATCCCG

401 ACTACCATCA GAAAATCATA CTGGCAATTG AAGACTTGCG TTACGGAAAG

451 CGCACGATCA GCCGGCAGGC ACAAGATGCC TTGATGGAAC AGGAACGCCG

501 CCTCCGAGAA GCGACGCTGT TGCTGATACA GGGCAGTCAA GAAACCCGCG

551 GACAAGGCGA GGAGCCGAAA CGCACGCGTT ATTTTGAAGT TTCGGCAACC

601 CCTGCCTATT CGAGCCGGCA CAACAACGGA CTTGGCGGCA ATTTCCAATA

651 CATCGGCCAA TTGCCCGGCT ATCTGAAAAT ACACGGAGAA ATGCTTGAAA

701 ACCAATCACT CTTCCGGCTG TCCAACCGTG AACGCAATCC CGACAAACCG
```

-continued

```
751 TTTTTAGACA TCCATTTTGA CGAAAATGGC AAAATCACGC GTATTGTCGT

801 TTACGAAAAA AACATCTACT TCAATCCAAA CTTGGGGCGA AGATAA
```

This corresponds to the amino acid sequence <SEQ ID 2302; ORF 690.a>:

```
a690.pep
   1 MKNKTSSLLL WLAAMMLTAC SPSKEDKTKE NGASAASSTA SAASSSAPQT

51 DLQPAASAPD NVKQAESVPP SNCTDLHPAT GIDDLMQQIA EHIDSDCLFA

101 LSHHELETRF GLPGGGYDNI QRLLFPDIRP EDPDYHQKII LAIEDLRYGK

151 RTISRQAQDA LMEQERRLRE ATLLLIQGSQ ETRGQGEEPK RTRYFEVSAT

201 PAYSSRHNNG LGGNFQYIGQ LPGYLKIHGE MLENQSLFRL SNRERNPDKP

251 FLDIHFDENG KITRIVVYEK NIYFNPNLGR R*
```

Computer analysis of this amino acid sequence gave the following results:
Homology with a Predicted ORF from *N. meningitidis*
ORF 690 shows 93.9% identity over a 280 aa overlap with a predicted ORF (ORF 690) from *N. meningitidis*:

```
    m690/a690  93.9% identity in 280 aa overlap 10         20         30         40         50
    m690.pep  MKNKTSSLLLWLTAIMLTACSPSKDDKTKEVGASAASSSASSAPS---QTDLQPTASAPD
              ||||||||   |||:|:||||||||||:||||| ||||||||:||:|      ||||||:|||||
    a690      MKNKTSSLPLWLAAMMLTACSPSKEDKTKENGASAASSTASAASSSAPQTDLQRAASAPD
                     10         20         30         40         50         60

60         70         80         90        100        110
    m690.pep  NVKQAESAPPSNCTSLHPATGIDDLMQQIAEHIDSDCLFALSHHELETRFGLPDGGYDNI
              ||||||||:|||||:|||||||||||||||||||||||||||||||||||||| ||||||
    a690      NVKQAESVPPSNCTDLHPATGIDDLMQQIAEHIDSDCLFALSHHELETRFGLPGGGYDNI
                     70         80         90        100        110        120

120        130        140        150        160        170
    m690.pep  QRLLFPDIRPEDPDYHQKIILAIEDLRYGKRTISRQAQNALMEQERRLREATLLLIQGSQ
              |||||||||||||||||||||||||||||||||||||:|||||||||||||||||||||
    a690      QRLLFPDIRPEDPDYHQKIILAIEDLRYGKRTISRQAQDALMEQERRLREATLLLIQGSQ
                    130        140        150        160        170        180

180        190        200        210        220        230
    m690.pep  ETRGQGEEPKRTRYFEVSATPAYSSRHNNGLGGNFQYISQLPGYLKIHGEMLENQSLFRL
              ||||||||||||||||||||||||||||||||||||||:|||||||||||||||||||||
    a690      ETRGQGEEPKRTRYFEVSATPAYSSRHNNGLGGNFQYIGQLPGYLKIHGEMLENQSLFRL
                    190        200        210        220        230        240

240        250        260        270        279
    m690.pep  SNRERNPDKPFLDIHFDENGKITRIVVYEKNIYFNPNTGRIX
              |||||||||||||||||||||||||||||||||||||| ||
    a690      SNRERNPDKPFLDIHFDENGKITRIVVYEKNIYFNPNLGRRX
                    250        260        270        280
```

The following partial DNA sequence was identified in *N. gonorrhoeae* <SEQ ID 2303>

```
g691.seq
   1 GTGCCGCTGC CTGCTCCCTG CCGTTTTGCC AAACCTGCCG CCTCTTTTTT

51 AAGTATGGCT TTGCTTTCCT GCCAGCTTTC CCACGCCGCC ACGGCTTATA

101 TCCCCCCGAA CGATTTTCAA CCGAACTGCG ACATACGCCG GCTCGGGCTG

151 ACACAGGGTC AGCACAATGA GCTGCGTAAA ATCCGCGCCG CCTTCAAAAT

201 GGCGGGCGAC AGGGCGCGTT TGAAGGTTAT GCATTCCGAA CACAGCCGCC

251 GCCGCTCTGT CGTCGAAATC ATTTCTTCGG ATGTTTTTAA TCGGAACGAG

301 GCGCGCGATT ATGTCGAAAG CCGCTACCAC TCCAGCATGG ATTTTGCGGT
```

```
351 GGACGAATTG GAAATCCAAC ACCGCTTCTT CCATATTCTC ACACCGCAAC

401 AGCAGCAAAT GTGGCTTTCT TCCTGCCTCA AATAA
```

This corresponds to the amino acid sequence <SEQ ID 2304; ORF 691>:

```
g691.pep
  1 VPLPAPCRFA KPAASFLSMA LLSCQLSHAA TAYIPPNDFQ PNCDIRRLGL

51 TQGQHNELRK IRAAFKMAGD RARLKVMHSE HSRRRSVVEI ISSDVFNRNE

101 ARDYVESRYH SSMDFAVDEL EIQHRFFHIL TPQQQQMWLS SCLK*
```

The following partial DNA sequence was identified in *N. meningitidis* <SEQ ID 2305>:

```
m691.seq
  1 GTGCCACTGC CTGCTCCCTG CCGTTTTGCC AAACCTGCCG CCTCTTTTTT

51 AAGTATGGCT TTGCTTTCCT GTCAGCTTTC CCACGCCGCC ACGGCTTATA

101 TCCCCCCGAA CGATTTTCAA CCGAACTGCG ACATACGCCG ACTCGGGCTG

151 ACCCAAAGTC AGCACAATGA GCTGCGTAAA ATCCGCACCG CCTTCAAAAT

201 GGCGGGCGAC AGGGCGCGTT TGAAGGTTAT GCATTCCGAA CACAGCCGCC

251 GCCGGTCTGT CGTCGAAATC ATTTCCTCGG ATGTTTTTAA TCGGAACGAG

301 GCGCGCGATT ATGTCGAAAG CCGCTATTTG TCCGGTATGG ATTTTGCGGT

351 GGACGAATTG GAAATCCAAC ACCGGTTCTT CCATATCCTC ACACCGCAAC

401 AGCAGCAAAT GTGGCTTTCT TCCTGCCTCA AATAA
```

This corresponds to the amino acid sequence <SEQ ID 2306; ORF 691>:

```
m691.pep
  1 VPLPAPCRFA KPAASFLSMA LLSCQLSHAA TAYIPPNDFQ PNCDIRRLGL

51 TQSQHNELRK IRTAFKMAGD RARLKVMHSE HSRRRSVVEI ISSDVFNRNE

101 ARDYVESRYL SGMDFAVDEL EIQHRFFHIL TPQQQQMWLS SCLK*
```

Computer analysis of this amino acid sequence gave the following results:
Homology with a Predicted ORF from *N. gonorrhoeae*
ORF 691 shows 97.2% identity over a 144 aa overlap with a predicted ORF (ORF 691) from *N. gonorrhoeae*:

```
  m691/g691 97.2% identity in 144 aa overlap 10         20         30         40         50         60
  m691.pep  VPLPAPCRFAKPAASFLSMALLSCQLSHAATAYIPPNDFQPNCDIRRLGLTQSQHNELRK
            |||||||||||||||||||||||||||||||||||||||||||||||||:|||||||
  g691      VPLPAPCRFAKPAASFLSMALLSCQLSHAATAYIPPNDFQPNCDIRRLGLTQGQHNELRK
                  10         20         30         40         50         60

70         80         90        100        110        120
  m691.pep  IRTAFKMAGDRARLKVMHSEHSRRRSVVEIISSDVFNRNEARDYVESRYLSGMDFAVDEL
            ||:|||||||||||||||||||||||||||||||||||||||||||||:|||||||
  g691      IRAAFKMAGDRARLKVMHSEHSRRRSVVEIISSDVFNRNEARDYVESRYHSSMDFAVDEL
                  70         80         90        100        110        120

130        140
  m691.pep  EIQHRFFHILTPQQQQMWLSSCLKX
            |||||||||||||||||||||||||
  g691      EIQHRFFHILTPQQQQMWLSSCLKX
                 130        140
```

The following partial DNA sequence was identified in *N. meningitidis* <SEQ ID 2307>

```
a691.seq
    1 GTGCCACTGC NTGCTCCCTG CCGTTTTGCC AAACCTGCCG CCTCTTTTTT

51 AAGTATGGCT TGCTTTCCT GCCAGCTTTC CCACGCCGCC ACGGCTTATA

101 TCCCCCTGAA CGATTTTCAA CCGAACTGCG ACATACGCCG GCTCGGACTG

151 ACACAGGGTC AGCACAATGA ACTGCGTAAA ATCCGCGCCG CCTTCAAAAT

201 GGCGGGCGAC AGGGCGCGTT TGAAGGTTAT GCATTCCGAA CACAGCCGCC

251 GTCGGTCTGT CGTCGAAATC ATTTCCTCGG ATGTTTTTAA TCGGAACGAG

301 GCGCGCGATT ATGTCGAAAG CCGCTATTTG TCCGGTATGG ATTTTGCGGT

351 GGACGAATTG GAAATCCAAC ACCGGTTCTT CCATATCCTC ACACCGCAAC

401 AGCAGCAAAT GTGGCTTTCT TCCTGCCTCA AATAA
```

This corresponds to the amino acid sequence <SEQ ID 2308; ORF 691.a>:

```
a691.pep
    1 VPLXAPCRFA KPAASFLSMA LLSCQLSHAA TAYIPLNDFQ PNCDIRRLGL

51 TQGQHNELRK IRAAFKMAGD RARLKVMHSE HSRRRSVVEI ISSDVFNRNE

101 ARDYVESRYL SGMDFAVDEL EIQHRFFHIL TPQQQQMWLS SCLK*
```

Computer analysis of this amino acid sequence gave the following results:
Homology with a Predicted ORF from *N. meningitidis*
ORF 691 shows 97.2% identity over a 144 aa overlap with a predicted ORF (ORF 691) from *N. meningitidis*:

```
    m691/a691  97.2%  identity in 144 aa overlap 10        20        30        40        50        60
         m691.pep  VPLPAPCRFAKPAASFLSMALLSCQLSHAATAYIPPNDFQPNCDIRRLGLTQSQHNELRK
                   ||| ||||||||||||||||||||||||||||||| |||||||||||||||:||||||
         a691      VPLXAPCRFAKPAASFLSMALLSCQLSHAATAYIPLNDFQPNCDIRRLGLTQGQHNELRK
                       10        20        30        40        50        60

70        80        90       100       110       120
         m691.pep  IRTAFKMAGDRARLKVMHSEHSRRRSVVEIISSDVFNRNEARDYVESRYLSGMDFAVDEL
                   ||:|||||||||||||||||||||||||||||||||||||||||||||||||||||||||
         a691      IRAAFKMAGDRARLKVMHSEHSRRRSVVEIISSDVFNRNEARDYVESRYLSGMDFAVDEL
                       70        80        90       100       110       120

130       140
         m691.pep  EIQHRFFHILTPQQQQMWLSSCLKX
                   |||||||||||||||||||||||||
         a691      EIQHRFFHILTPQQQQMWLSSCLKX
                      130       140
```

The following partial DNA sequence was identified in *N. gonorrhoeae* <SEQ ID 2309>

```
g692.seq
    1 GTATCGCACA CACGCTGTCG CTGTTCGGAA TCGAtacGCC GGATTTGGCG

51 GAATGGCAGG GAATGGCGGA TTAAAGGACA AAAATGCCGT CTGAACACGG

101 ATGCGGTTCA GACGGCATCA TTTTATACGA CTGCCTTATT TGGCTGCGCC

151 TTCATTCCAT GCGGCAGGGT ATTTGTAGCC CTCGAAGCGT TTGTGCGCGT

201 AGGCTTTGAA CGCGTCGGAG TTATAGGCCT CGGTTACGTC TTTAAGCCAT

251 TGGCTGTCTT TGTCGGCGGT TTTgacGGCA GACCAGTTGA CATAGGCAAA
```

-continued

```
 301 GCTCGGCTCT TGGAACAGGG CTTCGGTCAG CTTCATGCCG CTGCTTATGG

351 CGTAGTTGCC GTTGACGACG GCAAAATCCA CGTCGGCGCG GCTGCGCGGC

401 AGTTGTGCGG CTTCAAGCTC GACGATTTTG ATGTTTTTCA GGTTTTCCGC

451 GATGTCGGCT TTGGATGCGG TCAGCGGATT GATGCCGTCT TTGAGTTTGA

501 TCCAACCCAG TTCGTTCAGC ATCACCAAGG CGCGTGCGAA GTTGGAcggG

551 TcgtTGGGCG CGGATACGGT GCTGCCGTCT TTGACTTCTT CCAGCGATTT

601 CAGTTTGCCC GGATACAGTC CCAAAGGCGC GGTCGGCACT TGGAAGGCTT

651 CGGTGATGTC CAGGTTGTGT TCTTTTTTGA AATCGTCAAG ATAGGGTTTG

701 TGTTGGAAGA CGTTGATGTC CAACTCGCCC TCCGCCAATG CCAGATTCGG

751 GCGCACATAG TCggTAAATT cgaccaatTT gacgGTGTag cCTTTTTTCT

801 CCAGCTCGgc tTGGATTTGT TCTTTGACCA TATcgccgaa gtcgcccacg 851 gTCGTGCCGA agacgaTTTC TTTTTTCGCc GcgcCGTTAT CGGCAGAAGG 901 GGCGGCGgca gaggctgcGG GCGCGCTGTC TTTTtgaccG ccgCAGGCTG 951 CGAGGATGAG CGCGAGtgcg gcggcggaaa ggGTTTTGAA GAAGGTTTTc 1001 atATTTTCTc ctga
```

This corresponds to the amino acid sequence <SEQ ID 2310; ORF 692>:

```
g692.pep
  1 VSHTRCRCSE SIRRIWRNGR EWRIKGQKCR LNTDAVQTAS FYTTALFGCA

51 FIPCGRVFVA LEAFVRVGFE RVGVIGLGYV FKPLAVFVGG FDGRPVDIGK

101 ARLLEQGFGQ LHAAAYGVVA VDDGKIHVGA AARQLCGFKL DDFDVFQVFR

151 DVGFGCGQRI DAVFEFDPTQ FVQHHQGACE VGRVVGRGYG AAVFDFFQRF

201 QFARIQSQRR GRHLEGFGDV QVVFFFEIVK IGFVLEDVDV QLALRQCQIR

251 AHIVGKFDQF DGVAFFLQLG LDLFFDHIAE VAHGRAEDDF FFRRAVIGRR

301 GGGRGCGRAV FLTAAGCEDE RECGGGKGFE EGFHIFS*
```

The following partial DNA sequence was identified in *N. meningitidis* <SEQ ID 2311>:

```
m692.seq
  1 GTGTTGCACA CGCTTTGTCG CTGTTCGGAA TCGATACGCC GGATTCGGCG

51 GAATGGCAGG GAATGGCGGA TTAAAGGACA AAAATGCCGT CTGAACACGG

101 ATACAGTTCA GACGGCATCA TTTTATACGA CTGCCTTATT GGCTGCGCC

151 TTCATTCCAT GCGGCAGGGG ATTTGTAGCC CTCGAAGCGT TTGTGCGCGT

201 AGGCTTTGAA CGCGTCGGAG TTATAGGCCT CGGTTACGTC TTTAAGCCAT

251 TGGCTGTCTT TGTCGGCGGT TTTGACGGCA GACCAGTTGA CATAGGCAAA

301 GCTCGGTTCT TGGAACAGGG CTTCGGTCAG CTTCATGCCG CTGCTTATGG

351 CGTAGTTGCC GTTGACGACG GCAAAATCCA CGTCGGCGCG GCTACGCGGC

401 AGTTGCGCGG CTTCAAGCTC GACGATTTTG ATGTTTTTCA GGTTCTCGGC

451 GATGTCCGCT TTGGATGCGG TCAACGGATT GATGCCGTCT TTGAGTTTGA

501 TCCAACCCAG TTCGTCGAGC ATCACCAAGA CGCGGGCGAA GTTGGACGGG

551 TCGTTGGGCG CGGATACGGT GCTGCCGTCT TTGACTTCTT CCAGCGATTT
```

-continued

```
 601 CAGCTTGCCC GGGTACAGTC CCAAAGGCGC GGTCGGCACT TGGAAGACTT

651 CGGTGATGTC CAGATTGTGT TCTTTTTTGA AGTCGTCAAG ATAGGGTTTG

701 TGTTGGAAGA CGTTGATGTC CAACTCGCCC TCAGCCAATG CCAGATTCGG

751 GCGTACATAG TCGGTAAACT CGACCAGTTT GACGGTGTAG CCTTTTTTCT

801 CCAGCTCGGC TTGGATTTGT TCTTTGACCA TATCGCCGAA GTCGCCGACG

851 GTCGTGCCGA AGACGATTTC TTTTTTCGCC GCGCCGTTGT CGGCGGCGGC

901 AGAAGCGGAT GCGGCGGGCG CGCTGTCTTT TTGACCGCCG CAGGCGGCGA

951 GGATGAGCGC GAGTGCGGCG GCGGAAAGGG TTTTGAAGAA GGTTTTCATA

1001 TTTTCTCCTG A
```

This corresponds to the amino acid sequence <SEQ ID 2312; ORF 692>:

```
m692.pep
  1 VLHTLCRCSE SIRRIRRNGR EWRIKGQKCR LNTDTVQTAS FYTTALFGCA

51 FIPCGRGFVA LEAFVRVGFE RVGVIGLGYV FKPLAVFVGG FDGRPVDIGK

101 ARFLEQGFGQ LHAAAYGVVA VDDGKIHVGA ATRQLRGFKL DDFDVFQVLG

151 DVRFGCGQRI DAVFEFDPTQ FVEHHQDAGE VGRVVGRGYG AAVFDFFQRF

201 QLARVQSQRR GRHLEDFGDV QIVFFFEVVK IGFVLEDVDV QLALSQCQIR

251 AYIVGKLDQF DGVAFFLQLG LDLFFDHIAE VADGRAEDDF FFRRAVVGGG

301 RSGCGGRAVF LTAAGGEDER ECGGGKGFEE GFHIFS*
```

Computer analysis of this amino acid sequence gave the following results:

Homology with a Predicted ORF from *N. gonorrhoeae*

ORF 692 shows 91.1% identity over a 338 aa overlap with a predicted ORF (ORF 692) from *N. gonorrhoeae*:

```
    m692/g692 91.1% identity in 338 aa overlap 10         20         30         40         50         60
    m692.pep  VLHTLCRCSESIRRIRRNGREWRIKGQKCRLNTDTVQTASFYTTALFGCAFIPCGRGFVA
              | || |||||||||| ||||||||||||||||||:|||||||||||||||||||||| |||
    g692      VSHTRCRCSESIRRIWRNGREWRIKGQKCRLNTDAVQTASFYTTALFGCAFIPCGRVFVA
                    10         20         30         40         50         60

70         80         90        100        110        120
    m692.pep  LEAFVRVGFERVGVIGLGYVFKPLAVFVGGFDGRPVDIGKARFLEQGFGQLHAAAYGVVA
              ||||||||||||||||||||||||||||||||||||||||||:|||||||||||||||||
    g692      LEAFVRVGFERVGVIGLGYVFKPLAVFVGGFDGRPVDIGKARLLEQGFGQLHAAAYGVVA
                    70         80         90        100        110        120

130        140        150        160        170        180
    m692.pep  VDDGKIHVGAATRQLRGFKLDDFDVFQVLGDVRFGCGQRIDAVFEFDPTQFVEHHQDAGE
              ||||||||||:|||  ||||||||||||||:  ||  |||||||||||||||:|||  | |
    g692      VDDGKIHVGAAARQLCGFKLDDFDVFQVFRDVGFGCGQRIDAVFEFDPTQFVQHHQGACE
                   130        140        150        160        170        180

190        200        210        220        230        240
    m692.pep  VGRVVGRGYGAAVFDFFQRFQLARVQSQRRGRHLEDFGDVQIVFFFEVVKIGFVLEDVDV
              |||||||||||||||||||||:|::|||||||||| ||||| |||| :|||||||||||||
    a692      VGRVVGRGYGAAVFDFFQRFQFARIQSQRRGRHLEGFGDVQVVFFFEIVKIGFVLEDVDV
                   190        200        210        220        230        240

250        260        270        280        290
    m692.pep  QLALSQCQIRAYIVGKLDQFDGVAFFLQLGLDLFFDHIAEVADGRAEDDFFFRRAVVG--
              ||||  |||| ||||| ||:||||||||||||||||||||||| ||||||||||||||  :|
    g692      QLALRQCQIRAHIVGKFDQFDGVAFFLQLGLDLFFDHIAEVAHGRAEDDFFFRRAVVGRR
                   250        260        270        280        290        300

300        310        320        330
    m692.pep  GGRSGCGGRAVFLTAAGGEDERECGGGKGFEEGFHIFSX
              || ||| ||||||||||| ||||||||||||||||||||||
    g692      GGGRGCG-RAVFLTAAGCEDERECGGGKGFEEGFHIFSX
                         310        320        330
```

The following partial DNA sequence was identified in *N. meningitidis* <SEQ ID 2313>

```
a692.seq
     1  GTGTTGCACA CGCTTTGTCG CTGTTCGGAA TCGATACGCC GGATTCGGCG

51  GAATGGCAGG GAATGGCGGA TTAAAGGACA AAAATGCCGT CTGAACACGG

101  ATACGGTTCA GACGGCATCA TTTTATACGA CTGCCTTATT TGGCTGCGCC

151  TTCATTCCAT GCGGCAGGGG ATTTGTAGCC CTCGAAGCGT TTGTGCGCGT

201  AGGCTTTGAA CGCGTCGGAG TTATAGGCCT CGGTTACGTC TTTAAGCCAT

251  TGGCTGTCTT TGTCGGCGGT TTTGACGGCA GACCAGTTGA CATAGGCAAA

301  GCTCGGTTCT TGGAACAGGG CTTCGGTCAG CTTCATGCCG CTGCTTATGG

351  CGTAGTTGCC GTTGACGACG GCAAAATCCA CGTCGGCGCG GCTACGCGGC

401  AGTTGCGCGG CTTCAAGCTC GACGATTTTG ATGTTTTTCA GGTTTTCGGC

451  AATGTCCGCT TTGGATGCGG TCAGCGGATT GATGCCGTCT TTGAGTTTGA

501  TCCAACCCAG TTCGTCGAGC ATCACCAAGA CGCGGGCGAA GTTGGACGGG

551  TCGTTGGGCG CGGATACGGT GCTGCCGTCT TTGACTTCTT CCAGCGATTT

601  CAGCTTGCCC GGGTACAGTC CCAAAGGCGC GGTCGGCACT TGGAAGACTT

651  CGGTGATGTC CAGATTGTGT TCTTTTTTGA AGTCGTCAAG ATAGGGTTTG

701  TGTTGGAAGA CGTTGATGTC CAACTCGCCC TCAGCCAATG CCAGATTCGG

751  GCGCACATAG TCGGTAAACT CGACCAGTTT GACGGTGTAG CCTTTTTTCT

801  CCAGCTCGGG TTGGATTTGT TCTTTGACCA TATCGCCGAA GTCGCCGACG

851  GTCGTGCCGA AGACGATTTC TTTTTTCGCC GCGCCGTTGT CGGCGGCGGC

901  AGAAGCGGAT GCGGCGGGCG CGCTATCTTT TTGACCGCCG CAGGCGGCGA

951  GGATGAGCGC GAGTGCGGCG GCGGAAAGGG TTTTGAAGAA GGTTTTCATA

1001  TTTTCTCCTG A
```

This corresponds to the amino acid sequence <SEQ ID 2314; ORF 692.a>:

```
a692.pep
    1 VLHTLCRCSE SIRRIRRNGR EWRIKGQKCR LNTDTVQTAS FYTTALFGCA

51 FIPCGRGFVA LEAFVRVGFE RVGVIGLGYV FKPLAVFVGG FDGRPVDIGK

101 ARFLEQGFGQ LHAAAYGVVA VDDGKIHVGA ATRQLRGFKL DDFDVFQVFG

151 NVRFGCGQRI DAVFEFDPTQ FVEHHQDAGE VGRVVGRGYG AAVFDFFQRF

201 QLARVQSQRR GRHLEDFGDV QIVFFFEVVK IGFVLEDVDV QLALSQCQIR

251 AHIVGKLDQF DGVAFFLQLG LDLFFDHIAE VADGRAEDDF FFRRAVVGGG

301 RSGCGGRAIF LTAAGGEDER ECGGGKGFEE GFHIFS*
```

Computer analysis of this amino acid sequence gave the following results:

Homology with a Predicted ORF from *N. meningitidis*

ORF 692 shows 98.8% identity over a 336 aa overlap with a predicted ORF (ORF 692) from *N. meningitidis*:

```
m692/a692 98.8% identity in 336 aa overlap 10        20        30        40        50        60
m692.pep    VLHTLCRCSESIRRIRRNGREWRIKGQKCRLNTDTVQTASFYTTALFGCAFIPCGRGFVA
            ||||||||||||||||||||||||||||||||||||||||||||||||||||||||||||
a692        VLHTLCRCSESIRRIRRNGREWRIKGQKCRLNTDTVQTASFYTTALFGCAFIPCGRGFVA
                    10        20        30        40        50        60
```

```
                  70         80         90        100        110        120
m692.pep  LEAFVRVGFERVGVIGLGYVFKPLAVFVGGFDGRPVDIGKARFLEQGFGQLHAAAYGVVA
          ||||||||||||||||||||||||||||||||||||||||||||||||||||||||||||
a692      LEAFVRVGFERVGVIGLGYVFKPLAVFVGGFDGRPVDIGKARFLEQGFGQLHAAAYGVVA
                  70         80         90        100        110        120

130        140        150        160        170        180
m692.pep  VDDGKIHVGAATRQLRGFKLDDFDVFQVLGDVRFGCGQRIDAVFEFDPTQFVEHHQDAGE
          |||||||||||||||||||||||||||||||:|:||||||||||||||||||||||||||
a692      VDDGKIHVGAATRQLRGFKLDDFDVFQVFGNVRFGCGQRIDAVFEFDPTQFVEHHQDAGE
                 130        140        150        160        170        180

190        200        210        220        230        240
m692.pep  VGRVVGRGYGAAVFDFFQRFQLARVQSQRRGRHLEDFGDVQIVFFFEVVKIGFVLEDVDV
          ||||||||||||||||||||||||||||||||||||||||||||||||||||||||||||
a692      VGRVVGRGYGAAVFDFFQRFQLARVQSQRRGRHLEDFGDVQIVFFFEVVKIGFVLEDVDV
                 190        200        210        220        230        240

250        260        270        280        290        300
m692.pep  QLALSQCQIRAYIVGKLDQFDGVAFFLQLGLDLFFDHIAEVADGRAEDDFFFRRAVVGGG
          |||||||||||:||||||||||||||||||||||||||||||||||||||||||||||||
a692      QLALSQCQIRAHIVGKLDQFDGVAFFLQLGLDLFFDHIAEVADGRAEDDFFFRRAVVGGG
                 250        260        270        280        290        300

310        320        330
m692.pep  RSGCGGRAVFLTAAGGEDERECGGGKGFEEGFHIFSX
          ||||||||:|:||||||||||||||||||||||||||
a692      RSGCGGRAIGLTAAGGEDERECGGGKGFEEGFHIFSX
                 310        320        330
```

The following partial DNA sequence was identified in *N. gonorrhoeae* <SEQ ID 2315>:

```
g694.seq
    1  TCGGCATTTG TGTTGCCCAA ACATCCGATG CCTGCGTTAA CGCCTGCGTC

51  AACGTTTGCA CAAATCGGGT TTGGTTTCGC CCTCGCGGCG CAGCTCCTTG

101  GGCAGGACGA ACACGATGCT TCTTCCGCG CCCCCCCCTT CGCGCACGGT

151  TTCATGCCCC CATCCGCGTA TGGTTGCCAA TACTTCCCGC ACCAACACTT

201  CGGGCGCGGA CGCGCCTGCC GTTACGCCGA CTTTGCTTTT GCCTTCAAAC

251  CACGTGCGTT GCaggTAGGA CGCGTTGTCC ACCATATACG CATCGATTCC

301  GCGCGATGCC GCCACTTCGC GCAGGCGGTT GCTGTTGGAC GAATTGGGCG

351  AACCGACCAC AATCACGATG TCGCACTGTT CCGCCAGCTC TTTGACGGCG

401  GTTTGCCGGT TGGTCGTCGC ATAGCAGATG TCTTCCTTGT GCGGATTGCG

451  GATATTGGGG AAACGCGCGT TCAGCGCGGC GATGATGTCT TTGGTTTCAT

501  CGACCGAGAG CGTGGTTTGG CTGACATAGG CGAGTTTGTC GGGGTTTCTG

551  ACTTCGAGTT TTGCCACATC TCCGACCGTT TCGACCAAAA GCATTTTGCC

601  CGGTGCAAGC TGCCCCATCG TGCCTTCGAC CTCGGCGTGC CCCTTATGCC

651  CGATCATGAT GATTTCACAG TCTTGGGCAT CCAGTCGGGC GACTTCCTTA

701  TGCACTTTCG TCACCAGCGG GCAAGTCGCA TCAAATACCC GGAAACCGCG

751  CTCCGCCGCT TCCTGCTGCA CCGCCTTCGA TACGCCGTGT GCCGAATAAA

801  CCAGTGTCGC GCCCGGCGGC ACTTCCGCCA AGTCTTCGAT AAACACCGCG

851  CCTTTTTCGC GCAGGTTGTC CACGACGAAT TGTTGTGGA CGACTTCGTG

901  GCGCACATAA ACCGGCGCGC CGAATTCTTC CAAAGCACGT TCGACAATAC

951  TGATTGCCCG ATCCACACCG GCGCAGAAGC CGCGCGGATT GGCAAGGATG

1001  ATGGTTTTTC CGTTCATAAG TTTTGCATTC CGTGTTCAGA CGGCATTCAC

1051  GTTTTTTTGC TNNATCTTTG CGATGGACGA TATTGTCAAG CACCGCCAAC

1101  ACCGCACCGA CGCAGATAA
```

This corresponds to the amino acid sequence <SEQ ID 2316; ORF 694>:

```
g694.pep (partial)
   1 SAFVLPKHPM PALTPASTFA QIGFGFALAA QLLGQDEHDA FFRAPPFAHG

51 FMPPSAYGCQ YFPHQHFGRG RACRYADFAF AFKPRALQVG RVVHHIRIDS

101 ARCRHFAQAV AVGRIGRTDH NHDVALFRQL FDGGLPVGRR IADVFLVRIA

151 DIGETRVQRG DDVFGFIDRE RGLADIGEFV GVSDFEFCHI SDRFDQKHFA

201 RCKLPHRAFD LGVPLMPDHD DFTVLGIQSG DFLMHFRHQR ASRIKYPETA

251 LRRFLLHRLR YAVCRINQCR ARRHFRQVFD KHRAFFAQVV HDEFVVDDFV

301 AHINRRAEFF QSTFDNTDCP IHTGAEAARI GKDDGFSVHK FCIPCSDGIH

351 VFLLXLCDGR YCQAPPTPHR RR*
```

The following partial DNA sequence was identified in *N. meningitidis* <SEQ ID 2317>:

```
m694.seq
   1 TTGGTTTCCG CATCCGGCAC ACGGCAAAAA TGCCGTCTGA AGCCTGTTCA

51 GACGGCATTT GTGTTGCCCA AACATTCAAC GCCTGCGTCA ACGTTTGCAC

101 AAATCGGGTT TGGTTTCGCC CTCGCGGCGC AACTCTTTGG GCAGGACGAA

151 CACAATGCTT TCTTCCGCAC CCTCGCCTTC GCGTACGGTT TCGTGCCCCC

201 ATCCGCGTAT GGTTGCCAGT ACTTCCCGCA CCAACACTTC GGGCGCGGAC

251 GCGCCTGCCG TTACGCCGAC TTTGTTTTTG CCCTCAAACC ATGCGCGTTG

301 CAGGTAGCCT GCATTATCCA CCATATACGC ATCGATTCCG CGCGATGCCG

351 CCACTTCGCG CAAGCGGTTG CTGTTGGACG AATTGGGCGA ACCGACCACA

401 ATCACGATGT CGCACTGTTC TGCCAACTCT TTGACGGCGG TTTGCCGGTT

451 GGTCGTCGCA TAGCAGATAT CTTCCTTGTG CGGATTGCGG ATATTGGGGA

501 AACGCGCGTT CAGCGCGGCG ATGATGTCTT TGGTTTCATC GACCGAGAGC

551 GTGGTTTGGC TGACATAGGC GAGTTTGTCG GGGTTTCTGA CTTCGAGTTT

601 TGCCACATCT CCGACCGTTT CGACCAAAAG CATTTTGCCC GGCGCAAGCT

651 GCCCCATCGT TCCTTCGACC TCGACGTGCC CCTTATGCCC GATCATGATG

701 ATTTCACAGT CTTGGGCATC CAGTCGGGCG ACTTCCTTAT GCACTTTCGT

751 CACCAGCGGG CAAGTCGCAT CAAACACGCG GAAACCGCgC TCCGCCGCTT

801 CTTGCCGCAC CGCCTTCGAT ACGCCGTGTG CCGAATAAAC CAGTGTCGCG

851 CCCGGCGGCA CTTCCGCCAA GTCTTCAATA AACACCGCAC CTTTTTCACG

901 CAGGTTGTCC ACGACGAATT TGTTGTGAAC GACTTCGTGG CGCACATAAA

951 TCGGCGCGCC GAACTCTTCC AAAGCACGTT CGACAATACT GATT GCCCGA

1001 TCCACACCAG CGCAGAAGCC GCGCGGATTG GCAAGGATGA TGGTTTTCTC

1051 GTTCATAAGC CCGGTATTTC GTTTTCAGAC GGCATCAATA TTTTTCTTCT

1101 TGGGTTTTAC GGTGGACGAT GTTGTCCAAC ACCGCCAACA CCGCACCGAC

1151 GCAGATAA
```

This corresponds to the amino acid sequence <SEQ ID 2318; ORF 694>:

```
m694.pep
   1 LVSASGTRQK CRLKPVQTAF VLPKHSTPAS TFAQIGFGFA LAAQLFGQDE

51 HNAFFRTLAF AYGFVPPSAY GCQYFPHQHF GRGRACRYAD FVFALKPCAL

101 QVACIIHHIR IDSARCRHFA QAVAVGRIGR TDHNHDVALF CQLFDGGLPV

151 GRRIADIFLV RIADIGETRV QRGDDVFGFI DRERGLADIG EFVGVSDFEF

201 CHISDRFDQK HFARRKLPHR SFDLDVPLMP DHDDFTVLGI QSGDFLMHFR

251 HQRASRIKHA ETALRRFLPH RLRYAVCRIN QCRARRHFRQ VFNKHRTFFT

301 QVVHDEFVVN DFVAHINRRA ELFQSTFDNT DCPIHTSAEA ARIGKDDGFL

351 VHKPGISFSD GINIFLLGFY GGRCCPTPPT PHRRR*
```

Computer analysis of this amino acid sequence gave the following results:

Homology with a Predicted ORF from *N. gonorrhoeae*

ORF 694 shows 86.8% identity over a 372 aa overlap with a predicted ORF (ORF 694) from *N. gonorrhoeae*:

```
m694/g694 86.8% identity in 372 aa overlap 10        20        30        40        50
m694.pep  LVSASGTRQKCRLKPVQTAFVLPKHS----TPASTFAQIGFGFALAAQLFGQDEHNAFFR
                :|||||||     |||||||||||||||||||||:||||:||||
g694                      SAFVLPKHPMPALTPASTFAQIGFGFALAAQLLGQDEHDAFFR
                                10        20        30        40

60        70        80        90       100       110
m694.pep  TLAFAYGFVPPSAYGCQYFPHQHFGRGRACRYADFVFALKPCALQVACIIHHIRIDSARC
              :  ||:||:||||||||||||||||||||||||||:||:| ||||:  ::||||||||
g694      APPFAHGFMPPSAYGCQYFPHQHFGRGRACRYADFAFAFKPRALQVGRVVHHIRIDSARC
              50        60        70        80        90       100

120       130       140       150       160       170
m694.pep  RHFAQAVAVGRIGRTDHNHDVALFCQLFDGGLPVGRRIADIFLVRIADIGETRVQRGDDV
          |||||||||||||||||||||||| |||||||||||||||:|||||||||||||||||||
g694      RHFAQAVAVGRIGRTDHNHDVALFRQLFDGGLPVGRRIADVFLVRIADIGETRVQRGDDV
             110       120       130       140       150       160

180       190       200       210       220       230
m694.pep  FGFIDRERGLADIGEFVGVSDFEFCHISDRFDQKHFARRKLPHRSFDLDVPLMPDHDDFT
          |||||||||||||||||||||||||||||||||||||| ||||| :|||:||||||||||
g694      FGFIDRERGLADIGEFVGVSDFEFCHISDRFDQKHFARCKLPHRAFDLGVPLMPDHDDFT
             170       180       190       200       210       220

240       250       260       270       280       290
m694.pep  VLGIQSGDFLMHFRHQRASRIKHAETALRRFLPHRLRYAVCRINQCRARRHFRQVFNKHR
          |||||||||||||||||||||||:|||||||| |||||||||||||||||||||||:|||
g694      VLGIQSGDFLMHFRHQRASRIKYPETALRRFLLHRLRYAVCRINQCRARRHFRQVFDKHR
             230       240       250       260       270       280

300       310       320       330       340       350
m694.pep  TFFTQVVHDEFVVNDFVAHINRRAELFQSTFDNTDCPIHTSAEAARIGKDDGFLVHKPGI
           :||:|||||||||:|||||||||||:|||||||||||||:|||||||||||| |||  |
g694      AFFAQVVHDEFVVDDFVAHINRRAEFFQSTFDNTDCPIHTGAEAARIGKDDGFSVHKFCI
             290       300       310       320       330       340

360       370       380
m694.pep  SFSDGINIFLLGFYGGRCCPTPPTPHRRRX
          ||||::||  :  || |  :|||||||||X
g694      PCSDGIHVFLXXLCDGRYCQAPPTPHRRRX
             350       360       370
```

The following partial DNA sequence was identified in *N. meningitidis* <SEQ ID 2319>:

```
a694.seq
   1 TTGGTTTCCG CATCCGGCAC ACGGCAAAAA TGCCGTCTGA AGCCTGTTCA

51 GACGGCATTT GTGTTGCCCA AACATTCAAC GCCTGCGTCA ACGTTTGCAC

101 AAATCGGGTT TGGTTTCGCC CTCGCGGCGC AACTCTTTGG GCAGGACGAA
```

-continued

```
 151 CACAATGCTT TCTTCCGCAC CCTCGCCTTC GCGTACGGTT TCGTGCCCCC

201 ATCCGCGTAT GGTTGCCAGT ACTTCCCGCA CCAACACTTC GGGCGCGGAC

251 GCGCCTGCCG TTACGCCGAC TTTGTTTTTG CCCTCAAACC ATGCGCGTTG

301 CAGGTAGCCT GCATTATCCA CCATATACGC ATCGATTCCG CGCGATGCCG

351 CCACTTCGCG CAAGCGGTTG CTGTTGGACG AATTGGGCGA ACCGACCACA

401 ATCACGATGT CGCACTGTTC TGCCAACTCT TTGACGGCGG TTTGCCGGTT

451 GGTCGTCGCA TAGCAGATAT CTTCCTTGTG CGGATTGCGG ATATTGGGGA

501 AACGCGCGTT CAGCGCGGCG ATGATGTCTT TGGTTTCATC GACCGAGAGC

551 GTGGTTTGGC TGACATAGGC GAGTTTGTCG GGGTTTCTGA CTTCGAGTTT

601 TGCCACATCT CCGACCGTTT CGACCAAAAG CATTTTGCCC GGCGCAAGCT

651 GCCCCATCGT TCCTTCGACC TCGACGTGCC CCTTATGCCC GATCATGATG

701 ATTTCACAGT CTTGGGCATC CAGTCGGGCG ACTTCCTTAT GCACTTTCGT

751 CACCAGCGGG CAAGTCGCAT CAAACACGCG GAAACCGCGC TCCGCCGCTT

801 CTTGCCGCAC CGCCTTCGAT ACGCCGTGTG CCGAATAAAC CAGTGTCGCG

851 CCCGGCGGCA CTTCCGCCAA GTCTTCAATA ACACCGCAC CTTTTTCACG

901 CAGGTTGTCC ACGACGAATT TGTTGTGAAC GACTTCGTGG CGCACATAAA

951 TCGGCGCGCC GAACTCTTCC AAAGCACGTT CGACAATACT GATTGCCCGA

1001 TCCACACCAG CGCAGAAGCC GCGCGGATTG GCAAGGATGA TGGTTTTCTC

1051 GTTCATAAGC CCGGTATTTC GTTTTCAGAC GGCATCAATA TTTTTCTTCT

1101 TGGGTTTTAC GGTGGACGAT GTTGTCCAAC ACCGCCAACA CCGCACCGAC

1151 GCAGATAA
```

This corresponds to the amino acid sequence <SEQ ID 2320; ORF 694.a>:

```
a694.pep
  1 LVSASGTRQK CRLKPVQTAF VLPKHSTPAS TFAQIGFGFA LAAQLFGQDE

51 HNAFFRTLAF AYGFVPPSAY GCQYFPHQHF GRGRACRYAD FVFALKPCAL

101 QVACIIHHIR IDSARCRHFA QAVAVGRIGR TDHNHDVALF CQLFDGGLPV

151 GRRIADIFLV RIADIGETRV QRGDDVFGFI DRERGLADIG EFVGVSDFEF

201 CHISDRFDQK HFARRKLPHR SFDLDVPLMP DHDDFTVLGI QSGDFLMHFR

251 HQRASRIKHA ETALRRFLPH RLRYAVCRIN QCRARRHFRQ VFNKHRTFFT

301 QVVHDEFVVN DFVAHINRRA ELFQSTFDNT DCPIHTSAEA ARIGKDDGFL

351 VHKPGISFSD GINIFLLGFY GGRCCPTPPT PHRRR*
```

Computer analysis of this amino acid sequence gave the following results:
Homology with a Predicted ORF from *N. meningitidis*
ORF 694 shows 100% identity over a 385 aa overlap with a predicted ORF (ORF 694) from *N. meningitidis*:

```
   m694/a694  100.0% identity in 385 aa overlap 10         20         30         40         50         60
   m694.pep  LVSASGTRQKCRLKPVQTAFVLPKHSTPASTFAQIGFGFALAAQLFGQDEHNAFFRTLAF
             ||||||||||||||||||||||||||||||||||||||||||||||||||||||||||||
   a694      LVSASGTRQKCRLKPVQTAFVLPKHSTPASTFAQIGFGFALAAQLFGQDEHNAFFRTLAF
                     10         20         30         40         50         60
```

```
            70         80         90        100        110        120
m694.pep  AYGFVPPSAYGCQYFPHQHFGRGRACRYADFVFALKPCALQVACIIHHIRIDSARCRHFA
          ||||||||||||||||||||||| |||||||||||||||||||||||||||||||||||
a694      AYGFVPPSAYGCQYFPHQHFGFGFACRYADFVFALKPCALQVACIIHHIRIDSARCRHFA
            70         80         90        100        110        120

130        140        150        160        170        180
m694.pep  QAVAVGRIGRTDHNHDVALFCQLFDGGLPVGRRIADIFLVRIADIGETRVQRGDDVFGFI
          ||||||||||||||||||||||||||||||||||||||||||||||||||||||||||||
a694      QAVAVGRIGRTDHNHDVALFCQLFDGGLPVGRRIADIFLVRIADIGETRVQRGDDVFGFI
           130        140        150        160        170        180

190        200        210        220        230        240
m694.pep  DRERGLADIGEFVGVSDFEFCHISDRFDQKHFARRKLPHRSFDLDVPLMPDHDDFTVLGI
          ||||||||||||||||||||||||||||||||||||||||||||||||||||||||||||
a694      DRERGLADIGEFVGVSDFEFCHISDRFDQKHFARRKLPHRSFDLDVPLMPDHDDFTVLGI
           190        200        210        220        230        240

250        260        270        280        290        300
m694.pep  QSGDFLMHFRHQRASRIKHAETALRRFLPHRLRYAVCRINQCRARRHFRQVFNKHRTFFT
          ||||||||||||||||||||||||||||||||||||||||||||||||||||||||||||
a694      QSGDFLMHFRHQRASRIKHAETALRRFLPHRLRYAVCRINQCRARRHFRQVFNKHRTFFT
           250        260        270        280        290        300

310        320        330        340        350        360
m694.pep  QVVHDEFVVNDFVAHINRRAELFQSTFDNTDCPIHTSAEAARIGKDDGFLVHKPGISFSD
          ||||||||||||||||||||||||||||||||||||||||||||||||||||||||||||
a694      QVVHDEFVVNDFVAHINRRAELFQSTFDNTDCPIHTSAEAARIGKDDGFLVHKPGISFSD
           310        320        330        340        350        360

370        380
m694.pep  GINIFLLGFYGGRCCPTPPTPHRRRX
          ||||||||||||||||||||||||||
a694      GINIFLLGFYGGRCCPTPPTPHRRRX
           370        380
```

The following partial DNA sequence was identified in *N. gonorrhoeae* <SEQ ID 2321>:

```
g695.seq
   1 TTGCCTCAAA CTCGTCCGGC AAGGCGGCAT CATCGCCATC GACAATATTT

51 TGTTGAACGG AAGGGTGATG CGCGAAGCGG CTTTTGATGC GCCGCCCAGT

101 GTCAAAATTC TCAAAGATTT CAATCAAAAC CTGCCGAACG ATACGCGGAT

151 TGTCCCCATC ACCCTGCCCG TCGGCGACGG TTTGACCCTG CTTCTGAAAA

201 AATAATGAAG ACCAAATTAC CGCTTTTTAT CATTTGGCTG TCTGTGTCTG

251 CCTCCTGTGC TTCCGTTTTA CCCGTTCCGG AGGGCAGCCG AACCGAAATG

301 CCGACACAGG AAAATGCTTC AGACGGCATT CCCTATCCCG TTCCCACTCT

351 GCAAGACCGT TTGGACTATC TGGAAGGCAA AATCGTCCGG CTGTCGAACG

401 AAGTGGAAAT GTTAAACGGG AAAGTCAAAG CATTGGAGCA TACGAAAATA

451 CACCCTTCCG GCAGGACATA CGTCCAAAAA CTCGACGACC GCAAATTGAA

501 AGAGCATTAC CTCAATACCG AAGGCGGCAG CGCATCCGCA CATACCGTCG

551 AAACCGCACA AAACCTCTAC AATCAGGCAC TCAAACACTA TCAAAACGGC

601 AGGTTTTCTG CCGCAGCCGC CTTGTTGAAG GGGCGGACG GCGGAGACGG

651 CGGCAGCATC GCGCAACGCA GTATGTACCT GTTGCTGCAA AGCAGGGCGC

701 GTATGGGGAA CTGTGAATCT GTCATCGAAA TCGGAGGGCG TTACGCCAAC

751 CGTTTCAAAG ACAGCCCAAC CGCGCCCGAA GTCATATTCA AAATCGGCGA

801 ATGCCAATAC AGGCTTCAGC AAAAAGACAT TGCAAGGGCG ACTTGGCGCA

851 GCCTGATACA GACCTATCCC GGCAGCCCGG CGGCAAAACG CGCCGCCGCA

901 GCCGTACGCA AACGATAG
```

This corresponds to the amino acid sequence <SEQ ID 2322; ORF 695>:

```
g695.pep
   1 LPQTRPARRH HRHRQYFVER KGDARSGF*C AAQCQNSQRF QSKPAERYAD

51 CPHHPARRRR FDPASEKIMK TKLPLFIIWL SVSASCASVL PVPEGSRTEM

101 PTQENASDGI PYPVPTLQDR LDYLEGKIVR LSNEVEMLNG KVKALEHTKI

151 HPSGRTYVQK LDDRKLKEHY LNTEGGSASA HTVETAQNLY NQALKHYQNG

201 RFSAAAALLK GADGGDGGSI AQRSMYLLLQ SRARMGNCES VIEIGGRYAN

251 RFKDSPTAPE VIFKIGECQY RLQQKDIARA TWRSLIQTYP GSPAAKRAAA

301 AVRKR*
```

The following partial DNA sequence was identified in *N. meningitidis* <SEQ ID 2323>:

```
m695.seq
   1 TTGCCTCAAA CTCGTCCGTC AAGGCGGCAT CATCGCCATC GACAATATTT

51 TGCTGAACGG AAGGGTGATG CGCGAAGCGG CTTCCGATGC GCCGCCCAGC

101 GTCGGCATCC TCAAAGATTT CAATCAAAAC CTGCCGAACG ACCCGCGCAT

151 CGTCCCCATC ACCCTGCCCG TCGGCGACGG CTTGACCCTG CTTCTGAAAA

201 AATAATGAAG ATCAAATTAC CGCTTTTTAT CATTTGGCTG TCTGTGTCCG

251 CCTCCTGTGC TTCCGTTTCA CCCGTTCCGG CAGGCAGCCA AACCGAAATG

301 TCGACACGGG AAAATGCTTC AGACGGCATT CCCTATCCCG TTCCGACCTT

351 GCAAGACCGT TTGGACTATC TGGAAGGCAA AATCGTCCGG CTGTCGAACG

401 AAGTGGAAAC CTTAAACGGC AAAGTCAAAG CACTGGAACA CGCAAAAACA

451 CATTCTTCCG GCAGGGCATA CGTCCAAAAA CTCGACGACC GCAAGTTGAA

501 AGAGCATTAC CTCAATACCG AAGGCGGCAG CGCATCCGCA CATACTGTCG

551 AAACCGCACA AAACCTCTAC AATCAGGCAC TCAAACACTA TAAAAGCGGC

601 AAGTTTTCTG CCGCTGCCTC CCTGTTGAAA GGCGCGGACG GAGGCGACGG

651 CGGCAGCATC GCGCAACGCA GTATGTACCT GTTGCTGCAA AGCAGGGCGC

701 GTATGGGCAA CTGCGAATCC GTCATCGAAA TCGGAGGGCG TTACGCCAAC

751 CGTTTCAAAG ACAGCCCAAC CGCGCCTGAA GCCATGTTCA AAATCGGCGA

801 ATGCCAATAC AGGCTTCAGC AAAAAGACAT TGCAAGGGCG ACTTGGCGCA

851 GCCTGATACA GACCTATCCC GGCAGCCCGG CGGCAAAACG CGCCGCCGCA

901 GCCGTGCGCA AACGATAG
```

This corresponds to the amino acid sequence <SEQ ID 2324; ORF 695>:

```
m695.pep
   1 LPQTRPSRRH HRHRQYFAER KGDARSGFRC AAQRRHPQRF QSKPAERPAH

51 RPHHPARRRR LDPASEKIMK IKLPLFIIWL SVSASCASVS PVPAGSQTEM

101 STRENASDGI PYPVPTLQDR LDYLEGKIVR LSNEVETLNG KVKALEHAKT

151 HSSGRAYVQK LDDRKLKEHY LNTEGGSASA HTVETAQNLY NQALKHYKSG

201 KFSAAASLLK GADGGDGGSI AQRSMYLLLQ SRARMGNCES VIEIGGRYAN
```

```
251 RFKDSPTAPE AMFKIGECQY RLQQKDIARA TWRSLIQTYP GSPAAKRAAA

301 AVRKR*
```

Computer analysis of this amino acid sequence gave the following results:
Homology with a Predicted ORF from *N. gonorrhoeae*
ORF 694 shows 90.8% identity over a 305 aa overlap with a predicted ORF (ORF 695) from *N. gonorrhoeae*:

```
m695/g695  90.8% identity in 305 aa overlap 10        20        30        40        50        60
    m695.pep  LPQTRPSRRHHRHRQYFAERKGDARSGFRCAAQRRHPQRFQSKPAERPAHRPHHRARRRR
              |||||:|||||||||||:||||||||||||    ::  |||||||||| |  ||||||||
       g695   LPQTRPARRHHRHRQYFVERKGDARSGFXCAAQCQNSQRFQSKPAERYADCPHHRARRRR
                    10        20        30        40        50        60

70        80        90       100       110       120
    m695.pep  LDPASEKIMKIKLPLFIIWLSVSASCASVSPVPAGSQTEMSTRENASDGIPYPVPTLQDR
              :||||||||| |||||||||||||||||||| ||  |||  |:||||||||||||||||
       g695   FDPASEKIMKTKLPLFIIWLSVSASCASVLPVPEGSRTEMPTQENASDGIPYPVPTLQDR
                    70        80        90       100       110       120

130       140       150       160       170       180
    m695.pep  LDYLEGKIVRLSNEVETLNGKVKALEHAKTHSSGRAYVQKLDDRKLKEHYLNTEGGSASA
              ||||||||||||||||:|  |||:|||||||||||||||||||||||||||||||||||
       g695   LDYLEGKIVRLSNEVEMLNGKVKALEHTKIHPSGRTYVQKLDDRKLKEHYLNTEGGSASA
                   130       140       150       160       170       180

190       200       210       220       230       240
    m695.pep  HTVETAQNLYNQALKHYKSGKFSAAASLLKGADGGDGGSIAQRSMYLLLQSRARMGNCES
              ||||||||||||||||::||||||:||||||||||||||||||||||||||||||||||
       g694   HTVETAQNLYNQALKHYQNGRFSAAAALLKGADGGDGGSIAQRSMYLLLQSRARMGNCES
                   190       200       210       220       230       240

250       260       270       280       290       300
    m695.pep  VIEIGGRYANRFKDSPTAPEAMFKIGECQYRLQQKDIARATWRSLIQTYPGSPAAKRAAA
              |||||||||||||||||||||::||||||||||||||||||||||||||||||||||||
       g695   VIEIGGRYANRFKDSPTAPEVIFKIGECQYRLQQKDIARATWRSLIQTYPGSPAAKRAAA
                   250       260       270       280       290       300 m695.pep  AVRKRX
              ||||||
       g695   AVRKRX
```

The following partial DNA sequence was identified in *N. meningitidis* <SEQ ID 2325>:

```
a695.seq
   1 TTGCCTCAAG CTTGTCCGGC AAGGCGGCAT CATTGCCATC GACAATATTT

51 TGTTGAACGG AAGGGTGATG CGCGAAGCGG CTTCCGATGC GCCGCCCAGC

101 GTCGGCATCC TCAAAGATTT TAATCAAAAC CTGCCGAACG ATACGCGGAT

151 TGTCCCCATC ACCCTGCCCG TCGGCGACGG TTTGACCCTG CTTCTGAAAA

201 AATAATGAAG ACCAAATTAC CGCTTTTTAT CATTTGGCTG TCCGTATCCG

251 CCGCCTGTTC TTCCCCTGTT TCCCGCAATA TTCAGGATAT GCGGCTCGAA

301 CCGCAGGCAG AGGCAGGTAG TTCGGACGCT ATTCCCTATC CCGTTCCCAC

351 TCTGCAAGAC CGTTTGGATT ATCTGGAAGG CACACTCGTC CGCCTGTCGA

401 ACGAAGTGGA AACCTTAAAC GGCAAAGTCA AGCACTGGA GCATGCGAAA

451 ACACACCCTT CCAGCAGGGC ATACGTCCAA AAACTCGACG ACCGCAAGTT

501 GAAAGAGCAT TACCTCAATA CCGAAGGCGG CAGCGCATCC GCACATACCG

551 TCGAAACCGC ACAAAACCTC TACAATCAGG CACTCAAACA CTATAAAGC

601 GGCAGGTTTT CTGCCGCTGC CTCCCTGTTG AAAGGCGCGG ACGGAGGCGA

651 CGGCGGCAGC ATCGCGCAAC GCAGTATGTA CCTGTTGCTG CAAAGCAGGG
```

-continued

```
701 CGCGTATGGG CAACTGCGAA TCCGTCATCG AAATCGGAGG GCGTTACGCC

751 AACCGTTTCA AGACAGCCC AACCGCGCCT GAAGCCATGT TCAAAATCGG

801 CGAATGCCAA TACAGGCTTC AGCAAAAAGA CATTGCAAGG GCGACTTGGC

851 GCAGCCTGAT ACAGACCTAT CCCGGCAGCC CGGCGGCAAA ACGCGCCGCC

901 GCAGCCGTGC GCAAACGATA G
```

This corresponds to the amino acid sequence <SEQ ID 2326; ORF 695.a>:

```
a695.pep
  1 LPQACPARRH HCHRQYFVER KGDARSGFRC AAQRRHPQRF *SKPAERYAD

51 CPHHPARRRR FDPASEKIMK TKLPLFIIWL SVSAACSSPV SRNIQDMRLE

101 PQAEAGSSDA IPYPVPTLQD RLDYLEGTLV RLSNEVETLN GKVKALEHAK

151 THPSSRAYVQ KLDDRKLKEH YLNTEGGSAS AHTVETAQNL YNQALKHYKS

201 GRFSAAASLL KGADGGDGGS IAQRSMYLLL QSRARMGNCE SVIEIGGRYA

251 NRFKDSPTAP EAMFKIGECQ YRLQQKDIAR ATWRSLIQTY PGSPAAKRAA

301 AAVRKR*
```

Computer analysis of this amino acid sequence gave the following results:
Homology with a Predicted ORF from *N. meningitidis*
ORF 695 shows 88.3% identity over a 308 aa overlap with a predicted ORF (ORF 695) from *N. meningitidis*:

```
   m695/a695 88.3.8% identity in 308 aa overlap 10         20         30         40         50         60
   m695.pep  LPQTRPSRRHHRHRQYFAERKGDARSGFRCAAQRRHPQRFQSKPAERPAHRPHHRARRRR
             |||: |:|||| |||||:|||||||||||||||||||||| |||||| |  ||||||||||
   a695      LPQACPARRHHCHRQYFVERKGDARSGFRCAAQRRHPQRFXSKPAERYADCPHHPARRRR
                10         20         30         40         50         60

70         80         90        100        110
   m695.pep  LDPASEKIMKIKLPLFIIWLSVSASCASVSPVPAGSQT---EMSTRENASDGIPYPVPTL
             :||||||||| |||||||||||||:|:| ||  : |     | ::: ::||:||||||||
   a695      FDPASEKIMKTKLPLFIIWLSVSAACSS--PVSRNIQDMRLEPQAEAGSSDAIPYPVPTL
                70         80         90        100        110

120        130        140        150        160        170
   m695.pep  QDRLDYLEGKIVRLSNEVETLNGKVKALEHAKTHSSGRAYVQKLDDRKLKEHYLNTEGGS
             |||||||||   :|||||||||||||||||||||| |:||||||||||||||||||||||
   a695      QDRLDYLEGTLVRLSNEVETLNGKVKALEHAKTHPSSRAYVQKLDDRKLKEHYLNTEGGS
               120        130        140        150        160        170

180        190        200        210        220        230
   m695.pep  ASAHTVETAQNLYNQALKHYKSGKFSAAASLLKGADGGDGGSIAQRSMYLLLQSRARMGN
             |||||||||||||||||||||||| :||||| |||||||||||||||||||||||||||||
   a694      ASAHTVETAQNLYNQALKHYKSGRFSAAAALLKGADGGDGGSIAQRSMYLLLQSRARMGN
               180        190        200        210        220        230

240        250        260        270        280        290
   m695.pep  CESVIEIGGRYANRFKDSPTAPEAMFKIGECQYRLQQKDIARATWRSLIQTYPGSPAAKR
             ||||||||||||||||||||||||||||||||||||||||||||||||||||||||||||
   a695      CESVIEIGGRYANRFKDSPTAPEAMFKIGECQYRLQQKDIARATWRSLIQTYPGSPAAKR
               240        250        260        270        280        290

300
   m695.pep  AAAAVRKRX
             |||||||||
   a695      AAAAVRKRX
               300
```

The following partial DNA sequence was identified in *N. gonorrhoeae*
g696.seq: not found
This corresponds to the amino acid sequence <ORF 696.ng>:
g696.pep: not found
The following partial DNA sequence was identified in *N. meningitidis* <SEQ ID 2327>:

```
m696.seq
    1 TTGGGTTGCC GGCAGGCGGC ATCCCATCAT TTTTGCCAAG GCAACAAATT

51 ATTTGGCGGC ATCTTTCATT TTGTCTGCCG CTTCCTGAGT CGCGTCGGCA

101 GCTTTGTTCA AAGTATCTTT AGCTGCTTCA GTTACAGCTT CTTTGGCTTC

151 AGTTACAGCT TCCTCGGCAC TTGCCTTTGC ATCAGCCGCA GCATCTTTGA

201 CTTGGTCTTT CGCTTCTTCG ACGGCAGAAG CGGCAGACTC GGCGGCAGAA

251 GCCGCAGTGT CTTTAACATC GGACTCAACG GCTTGAACCG CTTCCTTAAC

301 CTCCTGTTTG GCTTCTTGCG AACAAGCTGC CAAGGCAGCC GCCATCATTG

351 CGGCAATCAA TAA
```

This corresponds to the amino acid sequence <SEQ ID 2328; ORF 696>:

```
m696.pep
    1 LGCRQAASHH FCQGNKLFGG IFHFVCRFLS RVGSFVQSIF SCFSYSFFGF

51 SYSFLGTCLC ISRSIFDLVF RFFDGRSGRL GGRSRSVFNI GLNGLNRFLN

101 LLFGFLRTSC QGSRHHCGNQ *
```

The following partial DNA sequence was identified in *N. meningitidis* <SEQ ID 2329>:

```
a696.seq
    1 TTGGGTTGCC GGCAGGCGGC ATCCCATCAT TTTTGCCAAG GCAACAAATT

51 ATTTGGCGGC ATCTTTCATT TTGTCTGCCG CTTCCTGAGT CGCGTCGGCA

101 GCTTTGTTCA AAGTATCTTT AGCTGCTTCA GTTACAGCTT CTTTGGCTTC

151 AGTTACAGCT TCCTCGGCAC TTGCCTTTGC ATCAGCCGCA GCATCTTTGA

201 CTTGGTCTTT CGCTTCTTCG ACGGCAGAAG CGGCAGACTC GGCGGCAGAA

251 GCCGCAGTGT CTTTAACATC GGACTCAACG GCTTGAACCG CTTCCTTAAC

301 CTCCTGTTTG GCTTCTTGCG AACAAGCTGC CAAGGCAGCC GCCATCATTG

351 CGGCAATCAA TAA
```

This corresponds to the amino acid sequence <SEQ ID 2330; ORF 696.a>:

```
a696.pep
    1 LGCRQAASHH FCQGNKLFGG IFHFVCRFLS RVGSFVQSIF SCFSYSFFGF

51 SYSFLGTCLC ISRSIFDLVF RFFDGRSGRL GGRSRSVFNI GLNGLNRFLN

101 LLFGFLRTSC QGSRHHCGNQ *
```

Computer analysis of this amino acid sequence gave the following results:
Homology with a Predicted ORF from *N. meningitidis* ORF 696 shows 100.0% identity over a 120 aa overlap with a predicted ORF (ORF 696) from *N. meningitidis*:

```
    m696/a696   100.0% identity in 120 aa overlap 10        20        30        40        50        60
      m696.pep   LGCRQAASHHFCQGNKLFGGIFHFVCRFLSRVGSFVQSIFSCFSYSFFGFSYSFLGTCLC
                 ||||||||||||||||||||||||||||||||||||||||||||||||||||||||||||
      a696       LGCRQAASHHFCQGNKLFGGIFHFVCRFLSRVGSFVQSIFSCFSYSFFGFSYSFLGTCLC
                       10        20        30        40        50        60

70        80        90       100       110       120
      m696.pep   ISRSIFDLVFRFFDGRSGRLGGRSRSVFNIGLNGLNRFLNLLFGFLRTSCQGSRHHCGNQ
                 ||||||||||||||||||||||||||||||||||||||||||||||||||||||||||||
      a696       ISRSIFDLVFRFFDGRSGRLGGRSRSVFNIGLNGLNRFLNLLFGFLRTSCQGSRHHCGNQ
                       70        80        90       100       110       120 m696.pep   X
                 |
      a696       x
```

The following partial DNA sequence was identified in *N. gonorrhoeae* <SEQ ID 2331>:

```
g700.seq
    1 ATGAGCAGCC TGATGACGTT GTTTTCGGTA TTGGTACCGA TGTTTGCCGG

51 ATTTTTTATC CGTGTTCCCA AGCCTTACCT GCCCGCTTCG GACAAGGTGC

101 TGTCGGTTTT GGTGTATGCC GTGCTGCTGC TGATCGGCGT ATCGTTGTCG

151 CGCGTGGAGG ATTTGGGTTC GCGGTTGGGC GATATGGCGT TGACGGTTCT

201 GTGGCTGTTT GTTTGTACGG TAGGGGCGAA CCTGCTTGCC TTGGCAGTGT

251 TGGGAAAGTT GTCCCCGTGG CGGATAGGGG GAAAAGGGAA GGGCGTTTCG

301 GTCGGCGTGT CGGGCAGTGT GAGGCAGCTC GGATGCGTAC TGCTCGGTTT

351 TGTGTCCGGC AAAATTGATG TGCGATATTTG GATGCCGTCT GAAAACGCGG

401 GTATGTACTG CCTGATGCTG CTGGTGTTCC TCATCGGCGT ACAGCTCAAA

451 AGTAGCGGCG TATCGTTGCG GCAGGTTTTG CTTAACCGGC GGGGCATCCG

501 GCTGTCGGTT TGGTTTATAT TGTCATCTCT TTCAGGCGGG CTGCTGTTTG

551 CCGCATCGGC AGATGGTGTG TCGTGGACGA AAGGTTTGGC GATGGCTTCC

601 GGCTTCGGTT GGTATTCCCT CTCGGGTTTG GTAATGACCG AGGCTTACGG

651 GGCGGTATGG GGCAGCATCA TGCTGCTGAA CGATTTGGCA CGAGAGCTGT

701 TTGCACTGGC ATTTATTCCG CTGCTGATGA AGCGTTTTCC GGATGCGGCG

751 GTGGGGGTCG GCGGCGCGAC CAGTATGGAT TTCACATTGC CCGTAATTCA

801 GGGTGCGGGC GGTTTGGAAG TCGTGCCGGT AGCGGTCAGC TTCGGCGTGG

851 TGGTCAATAT CGCCGCCCCG TTTCTGATGG TGGTGTTTTC CACGCTGGGC

901 TGA
```

This corresponds to the amino acid sequence <SEQ ID 2332; ORF 700>:

```
g700.pep
    1 MSSLMTLFSV LVPMFAGFFI RVPKPYLPAS DKVLSVLVYA VLLLIGVSLS

51 RVEDLGSRLG DMALTVLWLF VCTVGANLLA LAVLGKLSPW RIGGKGKGVS

101 VGVSGSVRQL GCVLLGFVSG KLMCDIWMPS ENAGMYCLML LVFLIGVQLK
```

```
151 SSGVSLRQVL LNRRGIRLSV WFILSSLSGG LLFAASADGV SWTKGLAMAS

201 GFGWYSLSGL VMTEAYGAVW GSIMLLNDLA RELFALAFIP LLMKRFPDAA

251 VGVGGATSMD FTLPVIQGAG GLEVVPVAVS FGVVVNIAAP FLMVVFSTLG

301 *
```

The following partial DNA sequence was identified in *N. meningitidis* <SEQ ID 2333>:

```
m700.seq
  1 ATGGACAGCC TGATGACGTT GCTTTCGGTA TTGATACCGA TGTTTGCCGG

51 ATTTTTTATC CGTGTGCCCA AGCCTTACCT GCCCGCTTTG GATAAGGTGC

101 TATCGGTCTT GGTGTATGCT GTGCTGCTGC TGATCGGCGT CTCGTTGTCG

151 CGCGTGGAGG ATTTGGGTTC GCGGTTGGAC GATATGGCGT TGACGGTTCT

201 GTGGCTGTTT GTTTGTACGG TCGGGGCGAA CCTGCTTGCT TTGGCAGTGT

251 TGGGAAAGTT ATTCCCGTGG CGGATAAAGG GGAAAGGGAA GGGCGTTTCG

301 GTCGGCGTGT CGGGCAGTGT GGGGCAGCTC GGATGCGTGC TGCTCGGATT

351 TGCATTCGGC AAACTGATGC GCGATATTTG GATGCCGTCT GAAAGCGCGG

401 GCATGTATTG TCTGATGCTG CTGGTGTTCC TCATCGGCGT ACAGCTCAAA

451 AGCAGCGGCG TATCGTTGCG GCAGGTTTTG GTCAACCGCA GGGGTATTCG

501 GTTGTCGGTC TGGTTTATGC TTTCATCTCT TTCGGGCGGG CTGCTGTTTG

551 CCGCATCGAC AGACGGTGTG TCGTGGACGA AAGGTTTGGC GATGGCTTCC

601 GGCTTCGGTT GGTATTCCCT CTCGGGTTTG GTCATGACCG AGGCTTACGG

651 CGCGGTATGG GGCAGCATCA TGCTGCTGAA CGATTTGGCA CGAGAGCTGT

701 TTGCACTGGC ATTTATCCCG CTGCTGATGA AGCGTTTTCC AGATGCGGCG

751 GTGGGGGTTG GCGGTGCGAC CAGTATGGAT TTTACATTGC CCGTGATTCA

801 GGGTGCGGGC GGTTTGGAAG TCGTGCCGGT AGCGGTCAGC TTCGGCGTGG

851 TGGTCAATAT CGCCGCCCCG TTTCTGATGG TGGTGTTTTC CGCTTTGGGT

901 TGA
```

This corresponds to the amino acid sequence <SEQ ID 2334; ORF 700>:

```
m700.pep
  1 MDSLMTLLSV LIPMFAGFFI RVPKPYLPAL DKVLSVLVYA VLLLIGVSLS

51 RVEDLGSRLD DMALTVLWLF VCTVGANLLA LAVLGKLFPW RIKGKGKGVS

101 VGVSGSVGQL GCVLLGFAFG KLMRDIWMPS ESAGMYCLML LVFLIGVQLK

151 SSGVSLRQVL VNRRGIRLSV WFMLSSLSGG LLFAASTDGV SWTKGLAMAS

201 GFGWYSLSGL VMTEAYGAVW GSIMLLNDLA RELFALAFIP LLMKRFPDAA

251 VGVGGATSMD FTLPVIQGAG GLEVVPVAVS FGVVVNIAAP FLMVVFSALG

301 *
```

Computer analysis of the amino acid sequences gave the following results:
Homology with a Predicted ORF from *N. meningitidis* menA with menB ORF 700 shows 94.7% identity over a 300 aa overlap with a predicted ORF (ORF700.ng) from *N. gonorrhoeae*:
m700/g700

```
                    10         20         30         40         50         60
m700.pep    MDSLMTLLSVLIPMFAGFFIRVPKPYLPALDKVLSVLVYAVLLLIGVSLSRVEDLGSRLD
            |:||||:|||:||||||||||||||||| |||||||||||||||||||||||||||||||
g700        MSSLMTLFSVLVPMFAGFFIRVPKPYLPASDKVLSVLVYAVLLLIGVSLSRVEDLGSRLG
                    10         20         30         40         50         60

70         80         90        100        110        120
m700.pep    DMALTVLWLFVCTVGANLLALAVLGKLFPWRIKGKGKGVSVGVSGSVGQLGCVLLGFAFG
            |||||||||||||||||||||||||||| |||| ||||||||||||||:|||||||:|
g700        DMALTVLWLFVCTVGANLLALAVLGKISPWRIGGKGKGVSVGVSGSVRQLGCVLLGFVSG
                    70         80         90        100        110        120

130        140        150        160        170        180
m700.pep    KLMRDIWMPSESAGMYCLMLLVFLIGVQLKSSGVSLRQVLVNRRGIRLSVWFMLSSLSGG
            |||  ||||||:||||||||||||||| ||||||||||||||:|||||||||||:||||||
g700        KLMCDIWMPSENAGMYCLMLLVFLIQGQLKSSGVSLRQVLLNRRGIRLSVWFILSSLSGG
                   130        140        150        160        170        180

190        200        210        220        230        240
m700.pep    LLFAASTDGVSWTKGLAMASGFGWYSLSGLVMTEAYGAVWGSIMLLNDLARELFALAFIP
            ||||||:|||||||||||||||||||||||||||||||||||||||||||||||||||||
g700        LLFAASADGVSWTKGLAMASGFGWYSLSGLVMTEAYGAVWGSIMLLNDLARELFALAFIP
                   190        200        210        220        230        240

250        260        270        280        290        300
m700.pep    LLMKRFPDAAVGVGGATSMDFTLPVIQGAGGLEVVPVAVSFGVVVNIAAPPFLMVVFSALG
            ||||||||||||||||||||||||||||||||||||||||||||||||||||||||:||
g700        LLMKRFPDAAVGVGGATSMDFTLPVIQGAGGLEVVPVAVSFGVVVNIAAPPFLMVVFSTLG
                   250        260        270        280        290        300 m700.pep    X
            |
g700        X
```

The following partial DNA sequence was identified in *N. meningitidis* <SEQ ID 2335>:

```
a700.seq
   1 ATGGACAGCC TGATGACGTT GCTTTCGGTA TTGATACCGA TGTTTGCCGG

51 ATTTTTTATC CGTGTGCCCA AGCCTTACCT GCCCGCTTTG GATAAGGTGC

101 TATCGGTCTT GGTGTATGCT GTGCTGCTGC TGATCGGCGT CTCGTTGTCG

151 CGCGTGGAGG ATTTGGGTTC GCGGTTGGAC GATATGGCGT TGACGGTTCT

201 GTGGCTGTTT GTTTGTACGG TCGGGGCGAA CCTGCTTGCT TTGGCAGTGT

251 TGGGAAAGTT ATTCCCGTGG CGGATAAAGG GGAAAGGGAA GGGCGTTTCG

301 GTCGGTGTGT CGGGCAGTGT GGGGCAGCTC GGATGCGTGC TGCTCGGATT

351 TGCATCCGGC AAACTGATGC GCGATATTTG GATGCCGTCT GAAAACGCGG

401 GTATGTATTG TCTGATGCTG CTGGTGCTCN TCATCGGCGT ACAGCTCAAA

451 AGCAGCGGCG TATCGTTGCG GCAGGTTTTG GTCAACCGCA GGGGTATTCG

501 GTTGTCGGTC TGGTTTATGC TTTCATCTCT TCAGGCGGG CTGCTGTTTG

551 CCGCATCGGC AGACGGTGTG TCGTGGGTGA AAGGTTTGGC GATGGCTTCC

601 GGCTTCGGTT GGTATTCCCT CTCGGGTTTG GTGATGACCG AGGCTTACGG

651 CGCGGTATGG GGCAGTATCG CGCTTTTGAA CGATTTGGCA CGAGAGCTGT

701 TCGCGCTGGC ATTTATTCCG CTGCTGATGA AGCGTTTTCC CGATGCGGCA

751 GTGGGGGTCG GCGGCGCGAC CAGTATGGAT TTCACATTGC CCGTGATTCG

801 GGGTGCGGGC GGCTTGGAAG CCGTACCGGT AGCGGTCAGC TTCGGCGTGG
```

```
851 TGGTCAATAT CGCCGCTCCG TTTCTGATGG TGGTGTTTTC CGCTTTGGGC

901 TGA
```

This corresponds to the amino acid sequence <SEQ ID 2336; ORF 700.a>:

```
a700.pep

1   MDSLMTLLSV LIPMFAGFFI RVPKPYLPAL DKVLSVLVYA VLLLIGVSLS

51   RVEDLGSRLD DMALTVLWLF VCTVGANLLA LAVLGKLFPW RIKGKGKGVS

101   VGVSGSVGQL GCVLLGFASG KLMRDIWMPS ENAGMYCLML LVLXIGVQLK

151   SSGVSLRQVL VNRRGIRLSV WFMLSSLSGG LLFAASADGV SWVKGLAMAS

201   GFGWYSLSGL VMTEAYGAVW GSIALLNDLA RELFALAFIP LLMKRFPDAA

251   VGVGGATSMD FTLPVIRGAG GLEAVPVAVS FGVVVNIAAP FLMVVFSALG

301   * m700/a700 97.0% identity in 300 aa overlap
                    10         20         30         40         50         60
     m700.pep  MDSLMTLLSVLIPMFAGFFIRVPKPYLPALDKVLSVLVYAVLLLIGVSLSRVEDLGSRLD
               ||||||||||||||||||||||||||||||||||||||||||||||||||||||||||||
     a700      MDSLMTLLSVLIPMFAGFFIRVPKPYLPALDKVLSVLVYAVLLLIGVSLSRVEDLGSRLD
                    10         20         30         40         50         60

70         80         90        100        110        120
     m700.pep  DMALTVLWLFVCTVGANLLALAVLGKLFPWRIKGKGKGVSVGVSGSVGQLGCVLLGFAFG
               ||||||||||||||||||||||||||||||||||||||||||||||||||||||||||| |
     a700      DMALTVLWLFVCTVGANLLALAVLGKLFPWRIKGKGKGVSVGVSGSVGQLGCVLLGFASG
                    70         80         90        100        110        120

130        140        150        160        170        180
     m700.pep  KLMRDIWMPSESAGMYCLMLLVFLIGVQLKSSGVSLRQVLVNRRGIRLSVWFMLSSLSGG
               ||||||||||||:|||||||||:|||||||||||||||||||||||||||||||||||||
     a700      KLMRDIWMPSENAGMYCLMLLVLXIGVQLKSSGVSLRQVLVNRRGIRLSVWFMLSSLSGG
                   130        140        150        160        170        180

190        200        210        220        230        240
     m700.pep  LLFAASTDGVSWTKGLAMASGFGWYSLSGLVMTEAYGAVWGSIMLLNDLARELFALAFIP
               ||||||:|||||:|||||||||||||||||||||||||||||||| ||||||||||||||
     a700      LLFAASADGVSWVKGLAMASGFGWYSLSGLVMTEAYGAVWGSIALLNDLARELFALAFIP
                   190        200        210        220        230        240

250        260        270        280        290        300
     m700.pep  LLMKRFPDAAVGVGGATSMDFTLPVIQGAGGLEVVPVAVSFGVVVNIAAPFLMVVFSALG
               ||||||||||||||||||||||||||||:||||||:||||||||||||||||||||||||
     a700      LLMKRFPDAAVGVGGATSMDFTLPVIRGAGGLEAVPVAVSFGVVVNIAAPFLMVVFSALG
                   250        260        270        280        290        300 m700.pep  X
               |
     a700      X
```

The following partial DNA sequence was identified in *N. gonorrhoeae* <SEQ ID 2337>:

```
g701.seq
    1 ATGTCTTGGC ACATATTCCA AGTTGCAGGG ATACCGACCG CTTCGATGGC

51 ACAATCTACG CCGTCTTCGC CGACGATGGC GAAAACTTGT TTGGAGACGT

101 CGCCGGAAGC GGGGCTGATG GTATGGGTCG CGCCCAACTC TTTCGCCGGT

151 TTCAAACGGT TTTCGTCCAT ATCGCACACG ATAATGGCGG CAGGGCTATA

201 CAGTTGGGCG GTCAACAAGG CGGACATACC GACAGGGCCG GCACCTGCGA

251 TGAATACGGT ATCGCCGGGT TTCACATCGC CGTATTGCAC GCCGATTTCG

301 TGGGCGGTCG GTAAAGCGTC GCTCAACAGC AGGGCGATTT CTTCGTTGAC

351 GTTGTCGTGC GGCGGCACGA GGCTGTTGTC GGCATAA
```

This corresponds to the amino acid sequence <SEQ ID 2338; ORF 701>:

```
g701.pep
   1 MSWHIFQVAG IPTASMAQST PSSPTMAKTC LETSPEAGLM VWVAPNSFAG

51 FKRFSSISHT IMAAGLYSWA VNKADIPTGP APAMNTVSPG FTSPYCTPIS

101 WAVGKASLNS RAISSLTLSC GGTRLLSA*
```

The following partial DNA sequence was identified in *N. meningitidis* <SEQ ID 2339>:

```
m701.seq
   1 ATGTCTTGGC ACATATTCCA TGTAGCAGGG ATACCGACGG CTTCGATGGC

51 GCAATCCACG CCGTCTTCGC CGACGATGGC AAAGACTTGT TTGGATACTT

101 CGCCGGAAGC AGGGTTAATG GTATGGGTCG CACCCAATTC TTTCGCCAGT

151 TTCAAACGGT TTTCGTCCAT ATCGCAAACG ATGATGGCGG CGGGACTGTA

201 CAGTTGGGCG GTCAACAGGG CGGACATACC GACAGGGCCT GCCCCAGCGA

251 TGAATACGGT GTCGCCGGGT TTGACATCGC CGTATTGCAC GCCGATTTCG

301 TGGGCGGTCG GCAAAGCGTC GCTCAACAAC AGGGCGATTT CTTCGTTGAC

351 ATTATCGGGC AGCGGAACGA GGCTGTTGTC GGCATAA
```

This corresponds to the amino acid sequence <SEQ ID 2340; ORF 701>:

```
m701.pep
   1 MSWHIFHVAG IPTASMAQST PSSPTMAKTC LDTSPEAGLM VWVAPNSFAS

51 FKRFSSISQT MMAAGLYSWA VNRADIPTGP APAMNTVSPG LTSPYCTPIS

101 WAVGKASLNN RAISSLTLSG SGTRLLSA*
```

Computer analysis of the amino acid sequences gave the following results:
Homology with a Predicted ORF from *N. meningitidis* menA with menB ORF 701 shows 92.2% identity over a 128 aa overlap with a predicted ORF (ORF701.a) from *N. gonorrhoeae*:

```
m701/g701

10        20        30        40        50        60
    m701.pep MSWHIFHVAGIPTASMAQSTPSSPTMAKTCLDTSPEAGLMVWVAPNSFASFKRFSSISQT
             ||||||:||||||||||||||||||||||:|||||||||||||||||||:||||||||:|
        g701 MSWHIFQVAGIPTASMAQSTPSSPTMAKTCLETSPEAGLMVWVAPNSFAGFKRFSSISHT
                    10        20        30        40        50        60

70        80        90       100       110       120
    m701.pep MMAAGLYSWAVNRADIPTGPAPAMNTVSPGLTSPYCTPISWAVGKASLNNRAISSLTLSG
             :||||||||||:|||||||||||||||||||:|||||||||||||||||||:||||||||
        g701 IMAAGLYSWAVNKADIPTGPAPAMNTVSPGFTSPYCTPISWAVGKASLNSRAISSLTLSC
                    70        80        90       100       110       120

129
    m701.pep SGTRLLSAX
             :||||||||
        g701 GGTRLLSAX
```

The following partial DNA sequence was identified in *N. meningitidis* <SEQ ID 2341>:

```
a701.seq
   1 ATGTCTTGGC ACATATTCCA AGTTGCAGGG ATACCGACGG CTTCGATCGC

51 GCAGTCCACG CCGTCTTCGC CGACGATAGC GGCAACTTGC TTGCTTACAT
```

```
101 CGCCGGAAGC AGGGTTAATG GTATGGGTTG CGCCCAACTC TTTCGCCAGT

151 TTCAAACGGT TTTCGTCCAT ATCGCAAACA ATGATGGCGG CGGGGCTGTA

201 CAGTTGGGCG GTCGGCAAGG CGGACATACC GACAGGAGCG GCACCTGCGA

251 TGAATACGGT GTCGCCGGGT TTGACATCGC CGTATTGCAC GCCGATTTCG

301 TGTGCGGTCG GCAAAGCGTC GCTCAACAAC AGGGCGACTT CTTCGTTGAC

351 GTTGTCGGGC AGCGGCACGA GGCTGTTGTC GGCATAA
```

This corresponds to the amino acid sequence <SEQ ID 2342; ORF 701.a>:

```
a701.pep
    1 MSWHIFQVAG IPTASIAQST PSSPTIAATC LLTSPEAGLM VWVAPNSFAS

51 FKRFSSISQT MMAAGLYSWA VGKADIPTGA APAMNTVSPG LTSPYCTPIS

101 CAVGKASLNN RATSSLTLSG SGTRLLSA* m701/a701  92.2% identity in 128 aa overlap
                  10         20         30         40         50         60
m701.pep  MSWHITFHVAGIPTASMAQSTPSSPTMAKTCLDTSPEAGLMVWVAPNSFASFKRFSSISQT
          ||||||:||||||||:||||||||:| |||||||||||||||||||||||||||||||||
a701      MSWHITFQVAGIPTASIAQSTPSSPTIAATCLLTSPEAGLMVWVAPNSFASFKRFSSISQT
                  10         20         30         40         50         60
                  70         80         90        100        110        120
m701.pep  MMAAGLYSWAVNRADIPTGPAPAMNTVSPGLTSPYCTPISWAVGKASLNNRAISSLTLSG
          ||||||||||::|||||||| |||||||||||||||||||| |||||||||| |||||||
a701      MMAAGLYSWAVGKADIPTGAAPAMNTVSPGLTSPYCTPISCAVGKASLNNRATSSLTLSG
                  70         80         90        100        110        120
                 129
m701.pep  SGTRLLSAX
          |||||||||
a701      SGTRLLSAX
```

The following partial DNA sequence was identified in *N. gonorrhoeae* <SEQ ID 2343>:

```
g702.seq
    1 ATGCCGTGTt ccaAAGCCAG TTGGACTTCG CCCGGAGtgg cAACGCCGGG

51 AATCAGGGGA ATGCCGCTGT TGCGGCCGGC TCTGGCGAGG GATTCGTGCA

101 AACCCGGGCT GATGGCGAAA ACCGCGCCTG CGTCTTCGAC GGCTTTGAGC

151 TGTTCGGGAT TGGTTACCGT ACCTGCGCCG ATGATGGCGT TGGGCATTTC

201 TTTGGCAATC AGGCGGATGG CCTCGAGTCC GACGGGGGTG CGCAAGGTAA

251 TTTCGAGGGT GGGGATGCCG CCTTCGACAA GGGCGCGGGA CAAATCGACG

301 GCGGTGCTTA AGTCGTCAAt cgCCATCACA GGCACAACTG CGCCGGCGGT

351 CAGGATTTCG cgggggtca gttga
```

This corresponds to the amino acid sequence <SEQ ID 2344; ORF 702>:

```
g702.pep
    1 MPCSKASWTS PGVATPGIRG MPLLRPALAR DSCKPGLMAK TAPASSTALS

51 CSGLVTVPAP MMALGISLAI RRMASSPTGV RKVISRVGMP PSTRARDKST

101 AVLKSSIAIT GTTAPAVRIS RGVS*
```

The following partial DNA sequence was identified in *N. meningitidis* <SEQ ID 2345>:

```
m702.seq
   1 ATGCCGTGTT CCAAAGCCAG TTGGATTTCG CCCGGGGTGG CAACACCGGG

51 AATCAGGGGG ATGCCGCTGT TGTGGCCGGC TTTGGCGAGG GATTCATGCA

101 GCCCCGGGCT GATGGCGAAA ACCGCGCCTG CGTCTTCGAC GGCTTTGAGC

151 TGTTCGGGAT TGGTTACCGT ACCTGCGCCG ACGATGGCGT TGGGCACTTC

201 TTTGGCAATC AGGCGGATGG CATCGAGGCC GACAGGGGTG CGCAGGGTGA

251 TTTCGAGGGT AGGGATGCCG CCTTCGACAA GGGCGTGGGA CAAATCGATG

301 GCGGTGCTTA AGTCGTCAAT CGCCATTACC GGCACAACTG CGCCGGCGGT

351 CAAAATTTCG CGGGGGGTCA GTTTGGACAT TTCGGTTCTC CGGGTGGAAT

401 GGGGTATTTT ATTAAGATGG GACAGGTTGT AG
```

This corresponds to the amino acid sequence <SEQ ID 2346; ORF 702>:

```
m702.pep
   1 MPCSKASWIS PGVATPGIRG MPLLWPALAR DSCSPGLMAK TAPASSTALS

51 CSGLVTVPAP TMALGTSLAI RRMASRPTGV RRVISRVGMP PSTRAWDKSM

101 AVLKSSIAIT GTTAPAVKIS RGVSLDISVL RVEWGILLRW DRL*
```

Computer analysis of the amino acid sequences gave the following results:
Homology with a Predicted ORF from *N. meningitidis* menA with menB ORF 702 shows 91.9% identity over a 124 aa overlap with a predicted ORF (ORF702.a) from *N. gonorrhoeae*:

```
m702/g702
                   10        20        30        40        50        60
m702.pep  MPCSKASWISPGVATPGIRGMPLLWPALARDSCSPGLMAKTAPASSTALSCSGLVTVPAP
          |||||||| |||||||||||||| ||||||||:|||||||||||||||||||||||||||
g702      MPCSKASWTSPGVATPGIRGMPLLRPALARDSCKPGLMAKTAPASSTALSCSGLVTVPAP
                   10        20        30        40        50        60

70        80        90       100       110       120
m702.pep  TMALGTSLAIRRMASRPTGVRRVISRVGMPPSTRAWDKSMAVLKSSIAITGTTAPAVKIS
          ||||| ||||||||| |||||:||||||||||||| ||| ||||||||||||||||:||
g702      MMALGISLAIRRMASSPTGVRKVISRVGMPPSTRARDKSTAVLKSSIAITGTTAPAVRIS
                   70        80        90       100       110       120

130       140
m702.pep  RGVSLDISVLRVEWGILLRWDRLX
          ||||
g702      RGVSX
```

The following partial DNA sequence was identified in *N. meningitidis* <SEQ ID 2347>:

```
a702.seq
   1 ATGCCGTGTT CCAAAGCCAG TTGGATTTCG CCCGGGGTGG CAACACCGGG

51 AATCAGGGGG ATGCCGCTGT TGTGGCCGGC TTTGGCGAGG GATTCATGCA

101 GCCCCGGGCT GATGGCGAAA ACCGCGCCTG CGTCTTCGAC GGCTTTGAGC

151 TGTTCGGGAT TGGTTACCGT ACCTGCGCCG ACGATGGCGT TGGGCACTTC

201 TTTGGCAATC AGGCGGATGG CATCGAGGCC GACAGGGGTG CGCAGGGTGA
```

```
-continued
251 TTTCGAGGGT AGGGATGCCG CCTTCGACAA GGGCGTGGGA CAAATCGATG

301 GCGGTGCTTA AGTCGTCAAT CGCCATTACC GGCACAACTG CGCCGGCGGT

351 CAAAATTTCG CGGGGGGTCA GTTTGGACAT TTCGGTTCTC CGGGTGGAAT

401 GGGGTATTTT ATTAAGATGG GACAGGTTGT AG
```

This corresponds to the amino acid sequence <SEQ ID 2348; ORF 702.a>:

```
a702.pep

1  MPCSKASWIS PGVATPGIRG MPLLWPALAR DSCSPGLMAK TAPASSTALS

51  CSGLVTVPAP TMALGTSLAI RRMASRPTGV RRVISRVGMP PSTRAWDKSM

101  AVLKSSIAIT GTTAPAVKIS RGVSLDISVL RVEWGILLRW DRL* m702/a702  100.0% identity in 143 aa overlap 10         20         30         40         50         60
m702.pep   MPCSKASWISPGVATPGIRGMPLLWPALARDSCSPGLMAKTAPASSTALSCSGLVTVPAP
           ||||||||||||||||||||||||||||||||||||||||||||||||||||||||||||
a702       MPCSKASWISPGVATPGIRGMPLLWPALARDSCSPGLMAKTAPASSTALSCSGLVTVPAP
                10         20         30         40         50         60

70         80         90        100        110        120
m702.pep   TMALGTSLAIRRMASRPTGVRRVISRVGMPPSTRAWDKSMAVLKSSIAITGTTAPAVKIS
           ||||||||||||||||||||||||||||||||||||||||||||||||||||||||||||
a702       TMALGTSLAIRRMASRPTGVRRVISRVGMPPSTRAWDKSMAVLKSSIAITGTTAPAVKIS
                70         80         90        100        110        120

130        140
m702.pep   RGVSLDISVLRVEWGILLRWDRLX
           ||||||||||||||||||||||||
a702       RGVSLDISVLRVEWGILLRWDRLX
               130        140
```

The following partial DNA sequence was identified in *N. gonorrhoeae* <SEQ ID 2349>:

```
g703.seq
   1 ATGAAAGCAA AAATCCTGAC TTCCGTTGCG CTGCTTGCCT GTTCCGGCAG

51 CCTGTTTGCC CAAACGCTGG CAACCGTTAA CGGTCAGAAA ATCGACAGTT

101 CCGTCATCGA TGCGCAGGTT GCCGCATTCC GTGCGGAAAA CAGCCGTGCC

151 GAAGACACGC CGCAACTGCG CCAATCCCTG CTGGAAAACG AAGTGGTCAA

201 CACCGTGGTC GCACAGGAAG TGAAACGCCT GAAACTCGAC CGGTCGGCAG

251 AGTTTAAAGA TGCGCTTGCC AAATTGCGTG CCGAAGCGAA AAAGTCGGGC

301 GACGACAAGA AACCGTCCTT CAAAACCGTT TGGCAGGCGG TAAAATATGG

351 CTTGAACGGC GAGGCATACG CACTGCATAT CGCCAAAACC CAACCGGTTT

401 CCGAGCAGGA AGTAAAAGCC GTTTACGACA ATATCAGCGG TTTTTATAAA

451 GGCACGCAGG AAGTCCAGTT GGGCGAAATC CTGACCGACA AGGAAGAAAA

501 TGCGAAAAAA GCGGTTGCCG ATTTGAAGGC GAAAAAAGGT TTTGATGCCG

551 TTTTGAAACA ATACTCGCTC AACGACCGCA CCAAACGGAC CGGCGCGCCG

601 GACGGATATG TGCCGCTGAA AGATTTGGAA CAGGGTGTTC CGCCGCTTTA

651 TCAGGCAATT AAGGACTTGA AAAAGGCGA ATTTACGGCA ACGCCGCTGA

701 AAAACGGCGA TTTCTACGGC GTTTATTATG TCAACGACAG CCGcgaggTG

751 AAAGTGCCTT CTTTTGACGA AATGAAAGGA CAGATTGCCG GCAACCTTCA
```

```
801 GGCGGAACGG ATTGACCGTG CCGTctgTGc gcTGTTgggt aaggCAAACA

851 TCAAACCTGC AAAATAA
```

This corresponds to the amino acid sequence <SEQ ID 2350; ORF 703>:

```
g703.pep
  1 MKAKILTSVA LLACSGSLFA QTLATVNGQK IDSSVIDAQV AAFRAENSRA

51 EDTPQLRQSL LENEVVNTVV AQEVKRLKLD RSAEFKDALA KLRAEAKKSG

101 DDKKPSFKTV WQAVKYGLNG EAYALHIAKT QPVSEQEVKA VYDNISGFYK

151 GTQEVQLGEI LTDKEENAKK AVADLKAKKG FDAVLKQYSL NDRTKRTGAP

201 DGYVPLKDLE QGVPPLYQAI KDLKKGEFTA TPLKNGDFYG VYYVNDSREV

251 KVPSFDEMKG QIAGNLQAER IDRAVCALLG KANIKPAK*
```

The following partial DNA sequence was identified in *N. meningitidis* <SEQ ID 2351>:

```
m703.seq
  1 ATGAAAGCAA AAATCCTGAC TTCCGTTGCA CTGCTTGCCT GTTCCGGCAG

51 CCTGTTTGCC CAAACGCTGG CAACCGTCAA CGGTCAGAAA ATCGACAGTT

101 CCGTCATCGA TGCGCAGGTT GCCGCATTCC GTGCGGAAAA CAGCCGTGCC

151 GAAGACACGC CGCAACTGCG CCAATCCCTG CTGGAAAACG AAGTGGTCAA

201 TACCGTGGTC GCACAGGAAG TGAAACGCCT GAAACTCGAC CGGTCGGCAG

251 AGTTTAAAAA TGCGCTTGCC AAATTGCGTG CCGAAGCGAA AAAGTCGGGC

301 GACGACAAGA AACCGTCCTT CAAAACCGTT TGGCAGGCGG TAAAATATGG

351 CTTGAACGGC GAGGCATACG CATTGCATAT CGCCAAAACC CAACCGGTTT

401 CCGAGCAGGA AGTAAAAGCC GCATATGACA ATATCAGCGG TTTTTACAAA

451 GGTACGCAGG AAGTCCAGTT GGGCGAAATC CTGACCGACA AGGAAGAAAA

501 TGCAAAAAAA GCGGTTGCCG ACTTGAAGGC GAAAAAGGT TTCGATGCCG

551 TCTTGAAACA ATATTCCCTC AACGACCGTA CCAAACAGAC CGGTGCGCCG

601 GTCGGATATG TGCCGCTGAA AGATTTGGAA CAGGGTGTTC CGCCGCTTTA

651 TCAGGCAATT AAGGACTTGA AAAAGGCGA ATTTACGGCA ACGCCGCTGA

701 AAAACGGCGA TTTCTACGGC GTTTATTATG TCAACGACAG CCGCGAGGTA

751 AAAGTGCCTT CTTTTGATGA AATGAAAGGA CAGATTGCGG GCAACCTTCA

801 GGCGGAACGG ATTGACCGTG CCGTCGGTGC ACTGTTGGGC AAGGCAAACA

851 TCAAACCTGC AAAATAA
```

This corresponds to the amino acid sequence <SEQ ID 2352; ORF 703>:

```
m703.pep
  1 MKAKILTSVA LLACSGSLFA QTLATVNGQK IDSSVIDAQV AAFRAENSRA

51 EDTPQLRQSL LENEVVNTVV AQEVKRLKLD RSAEFKNALA KLRAEAKKSG

101 DDKKPSFKTV WQAVKYGLNG EAYALHIAKT QPVSEQEVKA AYDNISGFYK

151 GTQEVQLGEI LTDKEENAKK AVADLKAKKG FDAVLKQYSL NDRTKQTGAP
```

-continued

```
201 VGYVPLKDLE QGVPPLYQAI KDLKKGEFTA TPLKNGDFYG VYYVNDSREV

251 KVPSFDEMKG QIAGNLQAER IDRAVGALLG KANIKPAK*
```

Computer analysis of the amino acid sequences gave the following results:
Homology with a Predicted ORF from *N. meningitidis* menA with menB ORF 703 shows 98.3% identity over a 288 aa overlap with a predicted ORF (ORF703.a) from *N. gonorrhoeae*:

```
m703/g703

10         20         30         40         50         60
m703.pep   MKAKILTSVALLACSGSLFAQTLATVNGQKIDSSVIDAQVAAFRAENSRAEDTPQLRQSL
           ||||||||||||||||||||||||||||||||||||||||||||||||||||||||||||
g703       MKAKILTSVALLACSGSLFAQTLATVNGQKIDSSVIDAQVAAFRAENSRAEDTPQLRQSL
                    10         20         30         40         50         60

70         80         90        100        110        120
m703.pep   LENEVVNTVVAQEVKRLKLDRSAEFKNALAKLRAEAKKSGDDKKPSFKTVWQAVKYGLNG
           |||||||||||||||||||||||||||||:||||||||||||||||||||||||||||||
g703       LENEVVNTVVAQEVKRLKLDRSAEFKDALAKLRAEAKKSGDDKKPSFKTVWQAVKYGLNG
                    70         80         90        100        110        120

130        140        150        160        170        180
m703.pep   EAYALHIAKTQPVSEQEVKAAYDNISGFYKGTQEVQLGEILTDKEENAKKAVADLKAKKG
           ||||||||||||||||||||||:|||||||||||||||||||||||||||||||||||||
g703       EAYALHIAKTQPVSEQEVKAVYDNISGFYKGTQEVQLGEILTDKEENAKKAVADLKAKKG
                   130        140        150        160        170        180

190        200        210        220        230        240
m703.pep   FDAVLKQYSLNDRTKQTGAPVGYVPLKDLEQGVPPLYQAIKDLKKGEFTATPLKNGDFYG
           ||||||||||||||:||| |||||||||||||||||||||||||||||||||||||||||
g703       FDAVLKQYSLNDRTKRTGAPDGYVPLKDLEQGVPPLYQAIKDLKKGEFTATPLKNGDFYG
                   190        200        210        220        230        240

250        260        270        280       289
m703.pep   VYYVNDSREVKVPSFDEMKGQIAGNLQAERIDRAVGALLGKANIKPAKX
           |||||||||||||||||||||||||||||||||| |||||||||||||
g703       VYYVNDSREVKVPSFDEMKGQIAGNLQAERIDRAVCALLGKANIKPAKX
                   250        260        270        280
```

The following partial DNA sequence was identified in *N. meningitidis* <SEQ ID 2353>:

```
a703.seq
   1 ATGAAAGCAA AAATCCTGAC TTCCGTTGCA CTGCTTGCCT GTTCCGGCAG

51 CCTGTTTGCC CAAACGCTGG CAACCGTCAA CGGTCAGAAA ATCGACAGTT

101 CCGTCATTGA TGCGCAGGTT GCCGCATTCC GTGCGGAAAA CAGCCGTGCC

151 GAAGACACGC CGCAACTGCG CCAATCCCTG CTGGAAAACG AAGTGGTCAA

201 CACCGTGGTC GCACAGGAAG TGAAACGCCT GAAACTCGAC CGGTCGGCAG

251 AGTTTAAAAA TGCGCTTGCC AAATTGCGTG CCGAAGCGAA AAAGTCGGGC

301 GACGACAAGA AACCGTCCTT CAAAACCGTT TGGCAGGCGG TAAAATATGG

351 CTTGAACGGC GAGGCATACG CGCTGCATAT CGCCAAAACC CAACCGGTTT

401 CCGAGCAGGA AGTAAAAGCC GCATATGACA ATATCAGCGG TTTTTACAAA

451 GGTACGCAGG AAGTCCAGTT GGGCGAAATC CTGACCGACA AGGAAGAAAA

501 TGCAAAAAAA GCGGTTGCCG ACTTGAAGGC GAAAAAGGT TTCGATGCCG

551 TCTTGAAACA ATATTCCCTC AACGACCGTA CCAAACAGAC CGGTGCGCCG

601 GTCGGATATG TGCCGCTGAA AGATTTGGAA CAGGGTGTTC CGCCGCTTTA

651 TCAGGCAATT AAGGACTTGA AAAAGGCGA ATTTACGGCA ACGCCGCTGA

701 AAAACGGCGA TTTCTACGGC GTTTATTATG TCAACGACAG CCGCGAGGTA
```

```
-continued
751 AAAGTGCCTT CTTTTGATGA AATGAAAGGA CAGATTGCGG GCAACCTTCA

801 GGCGGAACGG ATTGACCGTG CCGTCGGTGC ACTGTTGGGC AAGGCAAACA

851 TCAAACCTGC AAAATAA
```

This corresponds to the amino acid sequence <SEQ ID 2354; ORF 703.a>:

```
a703.pep

1   MKAKILTSVA LLACSGSLFA QTLATVNGQK IDSSVIDAQV AAFRAENSRA

51   EDTPQLRQSL LENEVVNTVV AQEVKRLKLD RSAEFKNALA KLRAEAKKSG

101   DDKKPSFKTV WQAVKYGLNG EAYALHIAKT QPVSEQEVKA AYDNISGFYK

151   GTQEVQLGEI LTDKEENAKK AVADLKAKKG FDAVLKQYSL NDRTKQTGAP

201   VGYVPLKDLY QGVPPLYQAI KDLKKGEFTA TPLKNGDFYG VYYVNDSREV

251   KVPSFDEMKG QIAGNLQAER IDRAVGALLG KNIKPAK* m703/a703   100.0% identity in 288 aa overlap
                    10        20        30        40        50        60
m703.pep    MKAKILTSVALLACSGSLFAQTLATVNGQKIDSSVIDAQVAAFRAENSRAEDTPQLRQSL
            ||||||||||||||||||||||||||||||||||||||||||||||||||||||||||||
a703        MKAKILTSVALLACSGSLFAQTLATVNGQKIDSSVIDAQVAAFRAENSRAEDTPQLRQSL
                    10        20        30        40        50        60
                    70        80        90       100       110       120
m703.pep    LENEVVNTVVAQEVKRLKLDRSAEFKNALAKLRAEAKKSGDDKKPSFKTVWQAVKYGLNG
            |||||||||||||||||||||||||||||| |||||||||||||||||||||||||||||
a703        LENEVVNTVVAQEVKRLKLDRSAEFKDALAKLRAEAKKSGDDKKPSFKTVWQAVKYGLNG
                    70        80        90       100       110       120
                   130       140       150       160       170       180
m703.pep    EAYALHIAKTQPVSEQEVKAAYDNISGFYKGTQEVQLGEILTDKEENAKKAVADLKAKKG
            |||||||||||||||||||||||||||||||||||||||||||||||||||||||||||| 
a703        EAYALHIAKTQPVSEQEVKAVYDNISGFYKGTQEVQLGEILTDKEENAKKAVADLKAKKG
                   130       140       150       160       170       180
                   190       200       210       220       230       240
m703.pep    FDAVLKQYSLNDRTKQTGAPVGYVPLKDLEQGVPPLYQAIKDLKKGEFTATPLKNGDFYG
            |||||||||||||||| ||||  ||||||||||||||||||||||||||||||||||||
a703        FDAVLKQYSLNDRTKRTGAPDGYVPLKDLEQGVPPLYQAIKDLKKGEFTATPLKNGDFYG
                   190       200       210       220       230       240
                   250       260       270       280    289
m703.pep    VYYVNDSREVKVPSFDEMKGQIAGNLQAERIDRAVGALLGKANIKPAKX
            ||||||||||||||||||||||||||||||||||||  ||||||||||
a703        VYYVNDSREVKVPSFDEMKGQIAGNLQAERIDRAVCALLGKANIKPAKX
                   250       260       270       280
```

The following partial DNA sequence was identified in *N. meningitidis* <SEQ ID 2355>:

```
a704.seq
    1   ATGAAAAAAA CCTGTTTCCA CTGCGGGCTG GACGTTCCCG AAAACCTGCA

51   TCTGACCGTC CGTTACGAAA ACGAAGACCG CGAAACCTGC TGCGCCGGTT

101   GTCAGGCAGT CGCACAAAGC ATTATTGACG CGGGCTTGGG CAGTTATTAC

151   AAACAACGCA CCGCCGACGC GCAAAAAACC GAGCTGCCGC CCCAAGAAAT

201   CCTCGACCAA ATCCGCCTGT ACGACCTGCC CGAAGTCCAG TCCGACTTTG

251   TGGAAACCCA CGGCGGCACG CGCGAGGCGG TTTTAATGCT CGGCGGCATC

301   ACCTGCGCCG CCTGCGTCTG GCTGATCGAA CAGCAGCTTT TGCGTACAGA

351   CGGCATCGTC CGCATCGACC TCAATTACAG CACGCACCGC TGCCGCGTCG

401   TCTGGGACGA CGGCAAAATC CGCCTTTCCG ACATTCTGTT GAAAATCAGG

451   CAGATAGGCT ACACCGCCGC ACCCTATGAC GCGCAAAAAA TCGAAGCCGC

501   CAACCAAAAA GAACGCAAAC AATACATCGT CCGCCTCGCC GTTGCCGGGC
```

```
 551 TGGGGATGAT GCAGACGATG ATGTTCGCGC TGCCGACCTA CCTTTACGGC

601 GGCGACATCG AACCCGATTT CCTGCAAATC CTCCATTGGG GCGGCTTTTT

651 AATGGTGCTG CCCGTCGTAT TCTATTGCGC CGTCCCGTTT TATCAAGGCG

701 CGCTGCGCGA CTTGAAAAAC CGCCGCGTCG GCATGGATAC GCCGATTACC

751 GTCGCCATCA TCATGACCTT TATCGCCGGC GTTTACAGCC TTGCGACAAA

801 TGCGGGGCAG GGGATGTATT TCGAATCCAT CGCGATGCTG CTGTTTTTCC

851 TGCTGGGCGG ACGCTTTATG AACACATTG CCCGCCGTAA GGCAGGCGAT

901 GCCGCCGAGA GGCTGGTGAA GCTGATTCCT GCGTTTTGCC ATCATATGCC

951 CGATTACCCC GATACGCAGG AAACCTGCGA GGCAGCTGTC GTCAAATTGA

1001 AGGCGGGCGA TATCGTGCTG GTCAAACCGG GCGAAACCAT CCCCGTTGAC

1051 GGCACGGTGC TGGAAGGAAG CAGTGCCGTC AACGAATCTA TGCTGACCGG

1101 CGAGAGCCTG CCCGTCGCCA AAATGCCGTC TGAAAAGTA ACCGCCGGCA

1151 CACTCAACAC GCAAAGCCCC CTGATTATAC GCACCGACCG CACCGGCGGC

1201 GGCACGCGAC TGTCGCACAT CGTCCGCCTG CTCGACCGCG CCTTAGCGCA

1251 AAAACCGCGC ACTGCCGAGT TGGCGGAACA ATACGCCTCG TCTTTCATAT

1301 TCGGCGAACT CCTGCTTGCC GTCCCCGTCT TCATCGGCTG GACGCTGTAC

1351 GCCGACGCGC ACACCGCATT GTGGATTACC GTCGCCCTGC TGGTCATTAC

1401 CTGCCCCTGC GCCTTATCGC TTGCCACGCC GACCGCGCTG GCAGCTTCTA

1451 CCGGTACGCT GGCGCGCGAA GGTATTTTAA TCGGCGGAAA GCAGGCAATC

1501 GAAACCCTCG CCCAAACCAC CGACATCATC TTCGACAAAA CCGGCACGCT

1551 GACCCAAGGC AAACCCGCCG TCCGCCGTAT CTCATTGTTG AGAGGCACAG

1601 ACGAAGCCTT TGTTCTCGCG GTGGCGCAGG CTTTAGAACA ACAGTCCGAA

1651 CATCCCCTTG CCCGCGCCAT CCTCAACTGC CGCATTTCAG ACGGCAGCGT

1701 CCCCGACATC GCTATTAAAC AACGCCTCAA CCGCATCGGC GAAGGCGTGG

1751 GCGCGCAACT GACCGTCAAC GGCGAAACAC AGGTTTGGGC ATTGGGCAGG

1801 GCATCCTATG TCGCCGAAAT TTCAGGTAAA GAACCGCAAA CAGAAGGCGG

1851 CGGCAGCGCG GTTTACCTCG GCAGTCAAAG CGGTTTCCAA GCCGTGTTCT

1901 ACCTGCAAGA CCCGCTCAAA GACAGCGCGG CGGAGGCGGT GCGGCAGTTG

1951 GCAGGCAAAA ACCTGACGCT GCACATTCTC AGCGGCGACC GTGAAACCGC

2001 CGTTGCCGAA ACCGCACGCG CCCTGGGTGT CGCGCACTAC CGCGCCCAAG

2051 CCATGCCCGA GGACAAACTG GAATACGTCA AGCCTTGCA AAAAGAAGGG

2101 AAAAAAGTGC TGATGATAGG CGACGGCATC AACGACGCGC CCGTTTTGGC

2151 GCAGGCAGAC GTATCCGCCG CCGCAGCGGG CGGGACGGAT ATTGCGAGGG

2201 ACGGCGCGGA CATTGTGTTA TTGAACGAAG ATTTGCGTAC CGTCGCCCAC

2251 CTGCTCGATC AGGCGCGGCG CACCCGCCAT ATTATCCGGC AAAACCTGAT

2301 ATGGGCGGGC GCGTACAATA TCATTGCCGT ACCGCTTGCC GTTTTGGGCT

2351 ATGTCCAACC GTGGATAGCC GCACTGGGTA TGAGCTTCAG TTCGCTGGCG

2401 GTTTTGGGCA ACGCCCTGCG CCTTCACAAA CGGGGGAAAA TGCAGTCTGA

2451 AAAAATGCCG TCCGAACAAT GA
```

This corresponds to the amino acid sequence <SEQ ID 2356; ORF 703>:

```
a704.pep

1  MKKTCFHCGL DVPENLHLTV RYENEDRETC CAGCQAVAQS IIDAGLGSYY
    51  KQRTADAQKT ELPPQEILDQ IRLYDLPEVQ SDFVETHGGT REAVLMLGGI
   101  TCAACVWLIE QQLLRTDGIV RIDLNYSTHR CRVVWDDGKI RLSDILLKIR
   151  QIGYTAAPYD AQKIEAANQK ERKQYIVRLA VAGLGMMQTM MFALPTYLYG
   201  GDIEPDFLQI LHWGGFLMVL PVVFYCAVPF YQGALRDLKN RRVGMDTPIT
   251  VAIIMTFIAG VYSLATNAGQ GMYFESIAML LFFLLGGRFM EHIARRKAGD
   301  AAERLVKLIP AFCHHMPDYP DTQETCEAAV VKLKAGDIVL VKPGETIPVD
   351  GTVLEGSSAV NESMLTGESL PVAKMPSEKV TAGTLNTQSP LIIRTDRTGG
   401  GTRLSHIVRL LDRALAQKPR TAELAEQYAS SFIFGELLLA VPVFIGWTLY
   451  ADAHTALWIT VALLVITCPC ALSLATPTAL AASTGTLARE GILIGGKQAI
   501  ETLAQTTDII FDKTGTLTQG KPAVRRISLL RGTDEAFVLA VAQALEQQSE
   551  HPLARAILNC RISDGSVPDI AIKQRLNRIG EGVGAQLTVN GETQVWALGR
   601  ASYVAEISGK EPQTEGGGSA VYLGSQSGFQ AVFYLQDPLK DSAAEAVRQL
   651  AGKNLTLHIL SGDRETAVAE TARALGVAHY RAQAMPEDKL EYVKALQKEG
   701  KKVLMIGDGI NDAPVLAQAD VSAAAAGGTD IARDGADIVL LNEDLRTVAH
   751  LLDQARRTRH IIRQNLIWAG AYNIIAVPLA VLGYVQPWIA ALGMSFSSLA
   801  VLGNALRLHK RGKMQSEKMP SEQ* m704/a704  99.8%  identity in 823 aa overlap 10         20         30         40         50         60
m704.pep   MKKTCFHCGLDVPEHLHLTVRYENEDRETCCAGCQAVAQSIIDAGLGSYYKQRTADAQKT
           ||||||||||||||:|||||||||||||||||||||||||||||||||||||||||||||
a704       MKKTCFHCGLDVPENLHLTVRYENEDRETCCAGCQAVAQSIIDAGLGSYYKQRTADAQKT
                    10         20         30         40         50         60

70         80         90        100        110        120
m704.pep   ELPPQEILDQIRLYDLPEVQSDFVETHGGTREAVLMLGGITCAACVWLIEQQLLRTDGIV
           ||||||||||||||||||||||||||||||||||||||||||||||||||||||||||||
a704       ELPPQEILDQIRLYDLPEVQSDFVETHGGTREAVLMLGGITCAACVWLIEQQLLRTDGIV
                    70         80         90        100        110        120

130        140        150        160        170        180
m704.pep   RIDLNYSTHRCRVVWDDGKIRLSDILLKIRQIGYTAAPYDAQKIEAANQKERKQYIVRLA
           ||||||||||||||||||||||||||||||||||||||||||||||||||||||||||||
a704       RIDLNYSTHRCRVVWDDGKIRLSDILLKIRQIGYTAAPYDAQKIEAANQKERKQYIVRLA
                   130        140        150        160        170        180

190        200        210        220        230        240
m704.pep   VAGLGMMQTMMFALPTYLYGGDIEPDFLQILHWGGFLMVLPVVFYCAVPFYQGALRDLKN
           ||||||||||||||||||||||||||||||||||||||||||||||||||||||||||||
a704       VAGLGMMQTMMFALPTYLYGGDIEPDFLQILHWGGFLMVLPVVFYCAVPFYQGALRDLKN
                   190        200        210        220        230        240

250        260        270        280        290        300
m704.pep   RRVGMDTPITVAIIMTFIAGVYSLATNAGQGMYFESIAMLLFFLLGGRFMEHIARRKAGD
           ||||||||||||||||||||||||||||||||||||||||||||||||||||||||||||
a704       RRVGMDTPITVAIIMTFIAGVYSLATNAGQGMYFESIAMLLFFLLGGRFMEHIARRKAGD
                   250        260        270        280        290        300

310        320        330        340        350        360
m704.pep   AAERLVKLIPAFCHHMPDYPDTQETCEAAVVKLKAGDIVLVKPGETIPVDGTVLEGSSAV
           ||||||||||||||||||||||||||||||||||||||||||||||||||||||||||||
a704       AAERLVKLIPAFCHHMPDYPDTQETCEAAVVKLKAGDIVLVKPGETIPVDGTVLEGSSAV
                   310        320        330        340        350        360

370        380        390        400        410        420
m704.pep   NESMLTGESLPVAKMPSEKVTAGTLNTQSPLIIRTDRTGGGTRLSHIVRLLDRALAQKPR
           ||||||||||||||||||||||||||||||||||||||||||||||||||||||||||||
a704       NESMLTGESLPVAKMPSEKVTAGTLNTQSPLIIRTDRTGGGTRLSHIVRLLDRALAQKPR
                   370        380        390        400        410        420

430        440        450        460        470        480
m704.pep   TAELAEQYASSFIFGELLLAVPVFIGWTLYADAHTALWITVALLVITCPCALSLATPTAL
           ||||||||||||||||||||||||||||||||||||||||||||||||||||||||||||
a704       TAELAEQYASSFIFGELLLAVPVFIGWTLYADAHTALWITVALLVITCPCALSLATPTAL
                   430        440        450        460        470        480
```

-continued

```
                490        500        510        520        530        540
   m704.pep   AASTGTLAREGILIGGKQAIETLAQTTDIIFDKTGTLTQGKPAVRRISLLRGTDEAFVLA
               ||||||||||||||||||||||||||||||||||||||||||||||||||||||||||||
   a704       AASTGTLAREGILIGGKQAIETLAQTTDIIFDKTGTLTQGKPAVRRISLLRGTDEAFVLA
                490        500        510        520        530        540

550        560        570        580        590        600
   m704.pep   VAQALEQQSEHPLARAILNCRISDGSVPDIAIKQRLNRIGEGVGAQLTVNGETQVWALGR
               ||||||||||||||||||||||||||||||||||||||||||||||||||||||||||||
   a704       VAQALEQQSEHPLARAILNCRISDGSVPDIAIKQRLNRIGEGVGAQLTVNGETQVWALGR
                550        560        570        580        590        600

610        620        630        640        650        660
   m704.pep   ASYVAEISGKEPQTEGGGSAVYLGSQSGFQAVFYLTDPLKDSAAEAVRQLAGKNLTLHIL
               |||||||||||||||||||||||||||||||||||| |||||||||||||||||||||||
   a704       ASYVAEISGKEPQTEGGGSAVYLGSQSGFQAVFYLQDPLKDSAAEAVRQLAGKNLTLHIL
                610        620        630        640        650        660

670        680        690        700        710        720
   m704.pep   SGDRETAVAETARALGVAHYRAQAMPEDKLEYVKALQKEGKKVLMIGDGINDAPVLAQAD
               ||||||||||||||||||||||||||||||||||||||||||||||||||||||||||||
   a704       SGDRETAVAETARALGVAHYRAQAMPEDKLEYVKALQKEGKKVLMIGDGINDAPVLAQAD
                670        680        690        700        710        720

730        740        750        760        770        780
   m704.pep   VSAAAAGGTDIARDGADIVLLNEDLRTVAHLLDQARRTRHIIRQNLIWAGAYNIIAVPLA
               ||||||||||||||||||||||||||||||||||||||||||||||||||||||||||||
   a704       VSAAAAGGTDIARDGADIVLLNEDLRTVAHLLDQARRTRHIIRQNLIWAGAYNIIAVPLA
                730        740        750        760        770        780

790        800        810        820
   m704.pep   VLGYVQPWIAALGMSFSSLAVLGNALRLHKRGKMQSEKMPSEQX
               ||||||||||||||||||||||||||||||||||||||||||||
   a704       VLGYVQPWIAALGMSFSSLAVLGNALRLHKRGKMQSEKMPSEQX
                790        800        810        820
```

The following partial DNA sequence was identified in *N. gonorrhoeae* <SEQ ID 2357>:

```
g705.seq
  1 GTGTTCAATA ATTTCCttgC CTCTCTGCCG TTTATGACGG AAACACGCGC

51 TGATATGCTC ATCAGCGCGT TTTGGCCCAT GGTTAAAGCC GGCTTTACAG

101 TGTCTTtgcC TTTGGCGATC GCTTCTTTCG TTATCGGCAT GATTATTGCC

151 GTAGCCGTTG CTTTGGTAAG AATCATGCCT TCCGGCGGTA TTTTCCAAAA

201 ATGCTTGTTG AAGCTGGTGG AATTTTATAT TTCCGTCGTT CGCGGTACGC

251 CGCTGTTGGT TCAGCTTGTG ATTGTGTTTT ACGGGCTGCC GTCCGTCGGC

301 ATCTATATCA ATCCGATTCC CGCCGCCATC ATCGGCTTTT CGCTCAATGT

351 CGGCGCATAC GCTTCCGAAA CCATACGCGC GGCGATTTTG TCCGTGCCGA

401 AAGGGCAGTG GGAAGCAGGT TTCTCCATCG GTATGACCTA TATGCAGACG

451 TTCCGCCGCA TCGTCGCACC GCAGGCATTC CGCGTCGCCG TTCCGCCGTT

501 GAGCAACGAG TTTATCGGCT TGTTCAAAAA CACCTCGCTT GCCGCCGTGG

551 TAACGGTAAC GGAGCTTTTC CGTGTCGCAC AGGAAACGGC AAACCGCACT

601 TATGACTTTT TGCCTGTCTA TATCGAAGCT GCATTGGTTT ATTGGTGTTT

651 CTGTAAAGTG CTGTTTTTGA TTCAGGCGCG TTTGGAAAAA CGTTTCGACC

701 GTTATGTCGC CAAATAA
```

This corresponds to the amino acid sequence <SEQ ID 2358; ORF 705>:

```
g705.pep
  1 VFNNFLASLP FMTETRADML ISAFWPMVKA GFTVSLPLAI ASFVIGMIIA

51 VAVALVRIMP SGGIFQKCLL KLVEFYISVV RGTPLLVQLV IVFYGLPSVG
```

-continued
```
101 IYINPIPAAI IGFSLNVGAY ASETIRAAIL SVPKGQWEAG FSIGMTYMQT

151 FRRIVAPQAF RVAVPPLSNE FIGLFKNTSL AAVVTVTELF RVAQETANRT

201 YDFLPVYIEA ALVYWCFCKV LFLIQARLEK RFDRYVAK*
```

The following partial DNA sequence wag identified in *N. meningitidis* <SEQ ID 2359>:

```
m705.seq
   1 GTGTTCAATA ATTTCCTTGC TTCGCTGCCG TTTATGACGG AAACACGCGC

51 CGATATGATT GTCAGCGCGT TTTTGCCTAT GGTCAAAGCC GGCTTCGCGG

101 TCTCTCTGCC TTTGGCGGCA GCTTCTTTCG TTATCGGTAT GATGATTGCG

151 GTAGCCGTGG CTTTGGTGCG GATTATGCCC GCCGGCGGCA TCGTGCGGAA

201 AATCCTGCTG AAATTGGTGG AATTTTATAT TTCCGTCATT CGCGGTACGC

251 CGCTGTTGGT TCAGCTTGTG ATTGTGTTTT ACGGGCTGCC TTCCGTCGGC

301 ATCTATATCG ACCCGATTCC TGCCGCCATC ATCGGCTTTT CGCTCAATGT

351 CGGCGCATAC GCTTCCGAAA CCATACGCGC GGCAATTTTG TCCGTACCTA

401 AAGGCCAATG GGAAGCAGGT TTCTCCATCG GCATGACCTA TATGCAGACG

451 TTCCGCCGCA TTGTCGCGCC GCAGGCATTC CGCGTTGCCG TGCCGCCTTT

501 GAGCAACGAG TTTATCGGTT TGTTTAAAAA CACCTCGCTC GCGGCAGTCG

551 TGACGGTAAC GGAATTATTC CGCGTCGCGC AGGAAACGGC AAACCGCACT

601 TATGACTTTT TGCCCGTCTA TATCGAAGCC GCTTTGGTTT ACTGGTGTTT

651 TTGTAAAGTG CTGTTCCTGA TTCAGGCGCG TTTGGAAAAA CGTTTCGACC

701 GCTACGTCGC CAAATAA
```

This corresponds to the amino acid sequence <SEQ ID 2360; ORF 705>:

```
m705.pep
   1 VFNNFLASLP FMTETRADMI VSAFLPMVKA GFAVSLPLAA ASFVIGMMIA

51 VAVALVRIMP AGGIVRKILL KLVEFYISVI RGTPLLVQLV IVFYGLPSVG

101 IYIDPIPAAI IGFSLNVGAY ASETIRAAIL SVPKGQWEAG FSIGMTYMQT

151 FRRIVAPQAF RVAVPPLSNE FIGLFKNTSL AAVVTVTELF RVAQETANRT

201 YDFLPVYIEA ALVYWCFCKV LFLIQARLEK RFDRYVAK*
```

Computer analysis of this amino acid sequence gave the following results:
Homology with a Predicted ORF from *N. gonorrhoeae*
ORF 705 shows 95.0% identity over a 238 aa overlap with a predicted ORF (ORF 705) from *N. gonorrhoeae*:

```
    m705/g705   95.0% identity in 238 aa overlap 10        20        30        40        50        60
      m705.pep   VFNNFLASLPFMTETRADMIVSAFLPMVKAGFAVSLPLAAASFVIGMMIAVAVALVRIMP
                 ||||||||||||||||||||::|||||||||||||||:|||||||:|||||||||||||
      g705       VFNNFLASLPFMTETRADMLISAFWPMVKAGFTVSLPLAIASFVIGMIIAVAVALVRIMP
                       10        20        30        40        50        60

70        80        90       100       110       120
      m705.pep   AGGIVRKILLKLVEFYISVIRGTPLLVQLVIVFYGLPSVGIYIDPIPAAIIGFSLNVGAY
                 :|||  :|||||||||||::|||||||||||||||||||||||:||||||||||||||
      g705       SGGIFQKCLLKLVEFYISVVRGTPLLVQLVIVFYGLPSVGIYINPIPAAIIGFSLVNGAY
                       70        80        90       100       110       120
```

-continued

```
            130        140        150        160        170        180
m705.pep    ASETIRAAILSVPKGQWEAGFSIGMTYMQTFRRIVAPQAFRVAVPPLSNEFIGLFKNTSL
            ||||||||||||||||||||||||||||||||||||||||||||||||||||||||||||
g705        ASETIRAAILSVPKGQWEAGFSIGMTYMQTFRRIVAPQAFRVAVPPLSNEFIGLFKNTSL
            130        140        150        160        170        180

190        200        210        220        230       239
m705.pep    AAVVTVTELFRVAQETANRTYDFLPVYIEAALVYWCFCKVLFLIQARLEKRFDRYVAKX
            |||||||||||||||||||||||||||||||||||||||||||||||||||||||||||
g705        AAVVTVTELFRVAQETANRTYDFLPVYIEAALVYWCFCKVLFLIQARLEKRFDRYVAKX
            190        200        210        220        230
```

The following partial DNA sequence was identified in *N. meningitidis* <SEQ ID 2361>:

```
a705.seq
  1 GTGTTCAATA ATTTCCTTGC TTCGCTGCCG TTTATGACGG AAACACGCGC
 51 CGATATGATT GTCAGCGCGT TTTTGCCTAT GGTCAAAGCC GGCTTCGCGG
101 TCTCTCTGCC TTTGGCGGCA GCTTCTTTCG TTATCGGTAT GATGATTGCG
151 GTAGCCGTGG CTTTGGTGCG GATTATGCCC GCCGGCGGCA TCGTGCGGAA
201 AATCCTGCTG AAATTGGTGG AATTTTATAT TTCCGTCATT CGCGGTACGC
251 CGCTGTTGGT TCAGCTTGTG ATTGTGTTTT ACGGGCTGCC TTCCGTCGGC
301 ATCTATATCG ACCCGATTCC TGCCGCCATC ATCGGCTTTT CGCTCAATGT
351 CGGCGCATAT GCTTCCGAAA CCATACGCGC GGCAATTTTG TCCGTACCGA
401 AAGGCCAATG GGAAGCAGGT TTCTCCATCG GCATGACCTA TATGCAGACG
451 TTCCGCCGCA TCGTCGCGCC GCAGGCATTT CGCGTTGCCG TGCCGCCTTT
501 GAGCAACGAG TTTATCGGTT TGTTTAAAAA CACCTCGCTC GCGGCAGTCG
551 TGACGGTAAC GGAATTATTC CGCGTCGCGC AGGAAACGGC AAACCGCACT
601 TATGACTTTT TGCCCGTCTA TATCGAAGCC GCTTTGGTTT ACTGGTGTTT
651 TTGTAAAGTG CTGTTCCTGA TTCAGGCGCG TTTGGAAAAA CGTTTCGACC
701 GCTACGTCGC CAAATAA
```

This corresponds to the amino acid sequence <SEQ ID 2362; ORF 705.a>:

```
a705.pep
  1 VFNNFLASLP FMTETRADMI VSAFLPMVKA GFAVSLPLAA ASFVIGMMIA
 51 VAVALVRIMP AGGIVRKILL KLVEFYISVI RGTPLLVQLV IVFYGLPSVG
101 IYIDPIPAAI IGFSLNVGAY ASETIRAAIL SVPKGQWEAG FSIGMTYMQT
151 FRRIVAPQAF RVAVPPLSNE FIGLFKNTSL AAVVTVTELF RVAQETANRT
201 YDFLPVYIEA ALVYWCFCKV LFLIQARLEK RFDRYVAK*
```

Computer analysis of this amino acid sequence gave the following results:
Homology with a Predicted ORF from *N. meningitidis* ORF 705 shows 100.0% identity over a 238 aa overlap with a predicted ORF (ORF 705) from *N. meningitidis*:

```
a705/m705  100.0%  identity in 238 aa overlap 10        20        30        40        50        60
a705.pep    VFNNFLASLPFMTETRADMIVSAFLPMVKAGFAVSLPLAAASFVIGMMIAVAVALVRIMP
            ||||||||||||||||||||||||||||||||||||||||||||||||||||||||||||
m705        VFNNFLASLPFMTETRADMIVSAFLPMVKAGFAVSLPLAAASFVIGMMIAVAVALVRIMP
                    10        20        30        40        50        60
```

```
                70         80         90        100        110        120
a705.pep  AGGIVRKILLKLVEFYISVIRGTPLLVQLVIVFYGLPSVGIYIDPIPAAIIGFSLNVGAY
          ||||||||||||||||||||||||||||||||||||||||||||||||||||||||||||
m705      AGGIVRKILLKLVEFYISVIRGTPLLVQLVIVFYGLPSVGIYIDPIPAAIIGFSLNVGAY
                70         80         90        100        110        120

130        140        150        160        170        180
a705.pep  ASETIRAAILSVPKGQWEAGFSIGMTYMQTFRRIVAPQAFRVAVPPLSNEFIGLFKNTSL
          ||||||||||||||||||||||||||||||||||||||||||||||||||||||||||||
m705      ASETIRAAILSVPKGQWEAGFSIGMTYMQTFRRIVAPQAFRVAVPPLSNEFIGLFKNTSL
               130        140        150        160        170        180

190        200        210        220        230       239
a705.pep  AAVVTVTELFRVAQETANRTYDFLPVYIEAALVYWCFCKVLFLIQARLEKRFDRYVAKX
          |||||||||||||||||||||||||||||||||||||||||||||||||||||||||||
m705      AAVVTVTELFRVAQETANRTYDFLPVYIEAALVYWCFCKVLFLIQARLEKRFDRYVAKX
               190        200        210        220        230       239
```

The following partial DNA sequence was identified in *N. gonorrhoeae* <SEQ ID 2363>:

```
g706.seq
    1 ATGAACTCCT CGCAACGCAA ACGCCTTTCC GgccGCTGGC TCAACTCCTA

51 CGAACGCTac cGCCaccGCC GCCTCATACA TGCCGTGCGG CTCGGCggaa 101 ccgtCCTGTT CGCCACCGCA CTCGCCCGgc tACTCCACCT CCAacacggc 151 gAATGGATAG GGAtgaCCGT CTTCGTCGTC CTCGGCATGC TCCAGTTCCA 201 AGGCgcgatt tActccaacg cggtgGAacg taTGctcggt acggtcatcg 251 ggctgGGCGC GGGTTTGGgc gTTTTATGGC TGAACCAGCA TTAtttccac 301 ggcaacCTcc tcttctacct gaccatcggc acggcaagcg cactggccgg 351 ctGGGCGGCG GTCGGCAAAA acggctacgt ccctatgctg GCGGGGctgA 401 CGATGTGCAT gctcatcggc gACAACGGCA GCGAATGGCT CGACAGCGGC

451 CTGATGCGCG CGATGAACGT CCTCATCGGC GCCGCCATCG CCATTGCCGC

501 CGCCAAACTG CTGCCGCTGA AATCCACACT GATGTGGCGT TTCATGCTTG

551 CCGACAACCT GGCCGACTGC AGCAAAATGA TTGCCGAAAT CAGCAACGGC

601 AGGCGTATGA CGCGCGAACG TTTGGAGCAG AATATGGTCA AAATGCGCCA

651 AATCAACGCA CGCATGGTCA AAAGCCGCAG CCACCTCGCC GCCACATCGG

701 GCGAAAGCCG CATCAGCCCC TCCATGATGG AAGCCATGCA GCACGCCCAC

751 CGCAAAATCG TCAACACCAC CGAGCTGCTC CTGACCACCG CCGCCAAGCT

801 GCAATCTCCC AAACTCAACG GCAGCGAAAT CCGGCTGCTC GACCGCCACT

851 TCACACTGCT CCAAACCGAC CTGCAACAAA CCGCCGCCCT CATCAACGGC

901 AGACACGCCC GCCGCATCCG CATCGACACC GCCATCAACC CCGAACTGGA

951 AGCCCTCGCC GAACACCTCC ACTACCAATG GCAGGGCTTC CTCTGGCTCA

1001 GCACCAATAT GCGTCAGGAA ATTTCCGCCC TCGTCATCCT GCTGCAACGC

1051 ACCCGCCGCA AATGGCTGGA TGCCCACGAA CGCCAACACC TGCGCCAAAG

1101 CCTGCTTGAA ACACGGGAAC ACGGCTGA
```

This corresponds to the amino acid sequence <SEQ ID 2364; ORF 706.ng>:

```
g706.pep
    1 MNSSQRKRLS GRWLNSYERY RHRRLIHAVR LGGTVLFATA LARLLHLQHG

51 EWIGMTVFVV LGMLQFQGAI YSNAVERMLG TVIGLGAGLG VLWLNQHYFH
```

-continued
```
101 GNLLFYLTIG TASALAGWAA VGKNGYVPML AGLTMCMLIG DNGSEWLDSG

151 LMRAMNVLIG AAIAIAAAKL LPLKSTLMWR FMLADNLADC SKMIAEISNG

201 RRMTRERLEQ NMVKMRQINA RMVKSRSHLA ATSGESRISP SMMEAMQHAH

251 RKIVNTTELL LTTAAKLQSP KLNGSEIRLL DRHFTLLQTD LQQTAALING

301 RHARRIRIDT AINPELEALA EHLHYQWQGF LWLSTNMRQE ISALVILLQR

351 TRRKWLDAHE RQHLRQSLLE TREHG*
```

The following partial DNA sequence was identified in *N. meningitidis* <SEQ ID 2365>:

```
m706.seq
   1 ATGAACACCT CGCAACGCA

-continued

```
251  RKIVNTTELL LTTAAKLQSP KLNGSEIRLL DRHFTLLQTD LQQTVALING

301  RHARRIRIDT AINPELEALA EHLHYQWQGF LWLSTNMRQE ISALVILLQR

351  TRRKWLDAHE RQHLRQSLLE TREHG*
``` m706/g706 96.5% identity in 375 aa overlap

```
                   10        20        30        40        50        60
m706.pep   MNTSQRNRLVSRWLNSYERYRYRRLIHAVRLGGAVLFATASARLLHLQHGEWIGMTVFVV
           ||:|||:||  :|||||||||:||||||||||:|||||| ||||||||||||||||||||
g706       MNSSQRKRLSGRWLNSYERYRHRRLIHAVRLGGTVLFATALARLLHLQHGEWIGMTVFVV
                   10        20        30        40        50        60

70        80        90       100       110       120
m706.pep   LGMLQFQGAIYSKAVERMLGTVIGLGAGLGVLWLNQHYFHGNLLFYLTVGTASALAGWAA
           |||||||||||:||||||||||||||||||||||||||||||||||||:|||||||||||
g706       LGMLQFQGAIYSNAVERMLGTVIGLGAGLGVLWLNQHYFHGNLLFYLTIGTASALAGWAA
                   70        80        90       100       110       120

130       140       150       160       170       180
m706.pep   VGKNGYVPMLAGLTMCMLIGDNGSEWLDSGLMRAMNVLIGAAIAIAAAKLLPLKSTLMWR
           ||||||||||||||||||||||||||||||||||||||||||||||||||||||||||||
g706       VGKNGYVPMLAGLTMCMLIGDNGSEWLDSGLMRAMNVLIGAAIAIAAAKLLPLKSTLMWR
                  130       140       150       160       170       180

190       200       210       220       230       240
m706.pep   FMLADNLADCSKMIAEISNGRRMTRERLEENMAKMRQINARMVKSRSHLAATSGESRISP
           ||||||||||||||||||||||||||||:||:||||||||||||||||||||||||||||
g706       FMLADNLADCSKMIAEISNGRRMTRERLEQNMVKMRQINARMVKSRSHLAATSGESRISP
                  190       200       210       220       230       240

250       260       270       280       290       300
m706.pep   AMMEAMQHAHRKIVNTTELLLTTAAKLQSPKLNGSEIRLLDRHFTLLQTDLQQTVALING
           :|||||||||||||||||||||||||||||||||||||||||||||||||||||:|||||
g706       SMMEAMQHAHRKIVNTTELLLTTAAKLQSPKLNGSEIRLLDRHFTLLQTDLQQTAALING
                  250       260       270       280       290       300

310       320       330       340       350       360
m706.pep   RHARRIRIDTAINPELEALAEHLHYQWQGFLWLSTNMRQEISALVILLQRTRRKWLDAHE
           ||||||||||||||||||||||||||||||||||||||||||||||||||||||||||||
g706       RHARRIRIDTAINPELEALAEHLHYQWQGFLWLSTNMRQEISALVILLQRTRRKWLDAHE
                  310       320       330       340       350       360

370
m706.pep   RQHLRQSLLETREHGX
           |||||||||||||||
g706       RQHLRQSLLETREHGX
                  370
```

The following partial DNA sequence was identified in *N. meningitidis* <SEQ ID 2367>:

```
a706.seq
   1  ATGAACACCT CGCAACGCAA CCGCCTCGTC AGCCGCTGGC TCAACTCCTA

51  CGAACGCTAC CGCTACCGCC GCCTCATCCA CGCCGTCCGG CTCGGCGGGG

101  CCGTCCTGTT CGCCACCGCC TCCGCCCGGC TGCTCCACCT CCAACACGGC

151  GAGTGGATAG GGATGACCGT CTTCGTCGTC CTCGGCATGC TCCAGTTTCA

201  AGGGGCGATT TACTCCAAGG CGGTGGAACG TATGCTCGGC ACGGTCATCG

251  GGCTGGGCGC GGGTTTGGGC GTTTTATGGC TGAACCAGCA TTATTTCCAC

301  GGCAACCTCC TCTTCTACCT CACCGTCGGC ACGGCAAGCG CACTGGCCGG

351  CTGGGCGGCG GTCGGCAAAA ACGGCTACGT CCCTATGCTG GCGGGGCTGA

401  CGATGTGCAT GCTCATCGGC GACAACGGCA GCGAATGGTT CGACAGCGGC

451  CTGATGCGCG CGATGAACGT CCTCATCGGC GCGGCCATCG CCATCGCCGC

501  CGCCAAACTG CTGCCGCTGA AATCCACACT GATGTGGCGT TTCATGCTTG

551  CCGACAACCT GACCGACTGC AGCAAAATGA TTGCCGAAAT CAGCAACGGC

601  AGGCGCATGA CCCGCGAACG CCTCGAAGAG AACATGGCGA AAATGCGCCA

651  AATCAACGCA CGCATGGTCA AAAGCCGCAG CCACCTCGCC GCCACATCGG
```

-continued

```
 701 GCGAAAGCCG CATCAGCCCC GCCATGATGG AAGCCATGCA GCACGCCCAC

751 CGTAAAATTG TCAACACCAC CGAGCTGCTC CTGACCACCG CCGCCAAGCT

801 GCAATCTCCC AAACTCAACG GCAGCGAAAT CCGGCTGCTT GACCGCCACT

851 TCACACTGCT CCAAACCGAC CTGCAACAAA CCGTCGCCCT TATCAACGGC

901 AGACACGCCC GCCGCATCCG CATCGACACC GCCATCAACC CGAACTGGA

951 AGCCCTCGCC GAACACCTCC ACTACCAATG GCAGGGCTTC CTCTGGCTCA

1001 GCACCAATAT GCGTCAGGAA ATTTCCGCCC TCGTCATCCT GCTGCAACGC

1051 ACCCGCCGCA AATGGCTGGA TGCCCACGAA CGCCAACACC TGCGCCAAAG

1101 CCTGCTTGAA ACACGGGAAC ACAGTTGA
```

This corresponds to the amino acid sequence <SEQ ID 2368; ORF 706.a>:

```
a706.pep
   1 MNTSQRNRLV SRWLNSYERY RYRRLIHAVR LGGAVLFATA SARLLHLQHG

51 EWIGMTVFVV LGMLQFQGAI YSKAVERMLG TVIGLGAGLG VLWLNQHYFH

101 GNLLFYLTVG TASALAGWAA VGKNGYVPML AGLTMCMLIG DNGSEWFDSG

151 LMRAMNVLIG AAIAIAAAKL LPLKSTLMWR FMLADNLTDC SKMIAEISNG

201 RRMTRERLEE NMAKMRQINA RMVKSRSHLA ATSGESRISP AMMEAMQHAH

251 RKIVNTTELL LTTAAKLQSP KLNGSEIRLL DRHFTLLQTD LQQTVALING

301 RHARRIRIDT AINPELEALA EHLHYQWQGF LWLSTNMRQE ISALVILLQR

351 TRRKWLDAHE RQHLRQSLLE TREHS*
``` a706/m706 99.5% identity in 374 aa overlap

```
                  10         20         30         40         50         60
     a706.pep  MNTSQRNRLVSRWLNSYERYRYRRLIHAVRLGGAVLFATASARLLHLQHGEWIGMTVFVV
               ||||||||||||||||||||||||||||||||||||||||||||||||||||||||||||
         m706  MNTSQRNRLVSRWLNSYERYRYRRLIHAVRLGGAVLFATASARLLHLQHGEWIGMTVFVV
                  10         20         30         40         50         60

70         80         90        100        110        120
     a706.pep  LGMLQFQGAIYSKAVERMLGTVIGLGAGLGVLWLNQHYFHGNLLFYLTVGTASALAGWAA
               ||||||||||||||||||||||||||||||||||||||||||||||||||||||||||||
         m706  LGMLQFQGAIYSKAVERMLGTVIGLGAGLGVLWLNQHYFHGNLLFYLTVGTASALAGWAA
                  70         80         90        100        110        120

130        140        150        160        170        180
     a706.pep  VGKNGYVPMLAGLTMCMLIGDNGSEWFDSGLMRAMNVLIGAAIAIAAAKLLPLKSTLMWR
               ||||||||||||||||||||||||||||||:|||||||||||||||||||||||||||||
         m706  VGKNGYVPMLAGLTMCMLIGDNGSEWLDSGLMRAMNVLIGAAIAIAAAKLLPLKSTLMWR
                 130        140        150        160        170        180

190        200        210        220        230        240
     a706.pep  FMLADNLTDCSKMIAEISNGRRMTRERLEENMAKMRQINARMVKSRSHLAATSGESRISP
               ||||||:|||||||||||||||||||||||||||||||||||||||||||||||||||||
         m706  FMLADNLADCSKMIAEISNGRRMTRERLEENMAKMRQINARMVKSRSHLAATSGESRISP
                 190        200        210        220        230        240

250        260        270        280        290        300
     a706.pep  AMMEAMQHAHRKIVNTTELLLTTAAKLQSPKLNGSEIRLLDRHFTLLQTDLQQTVALING
               ||||||||||||||||||||||||||||||||||||||||||||||||||||||||||||
         m706  AMMEAMQHAHRKIVNTTELLLTTAAKLQSPKLNGSEIRLLDRHFTLLQTDLQQTVALING
                 250        260        270        280        290        300

310        320        330        340        350        360
     a706.pep  RHARRIRIDTAINPELEALAEHLHYQWQGFLWLSTNMRQEISALVILLQRTRRKWLDAHE
               ||||||||||||||||||||||||||||||||||||||||||||||||||||||||||||
         m706  RHARRIRIDTAINPELEALAEHLHYQWQGFLWLSTNMRQEISALVILLQRTRRKWLDAHE
                 310        320        330        340        350        360
```

-continued

```
                      370
a706.pep    RQHLRQSLLETREHSX
            ||||||||||||||:
m706        RQHLRQSLLETREHGX
                      370 g704.seq    not found g707.pep    not found
```

10

The following partial DNA sequence was identified in *N. meningitidis* <SEQ ID 2369>:

```
m707.seq
     1  ATGGAAATTA TTAACGATGC AGAACTTATC CGTTCCATGC AGCGTCAGCA

51  GCACATAGAT GCTGAATTGT TAACTGATGC AAATGTCCGT TTCGAGCAAC

101  CATTGGAGAA GAACAATTAT GTCCTGAGTG AAGATGAAAC ACCGTGTACT

151  CGGGTAAATT ACATTAGTTT AGATGATAAG ACGGTGCGCA AATTTTCTTT

201  TCTTCCTTCT GTGCTCATGA AAGAAACAGC TTTTAAAACT GGGATGTGTT

251  TAGGTTCCAA TAATTTGAGC AGGCTACAAA AAGCCGCGCA ACAGATACTG

301  ATCGTGCGTG GCTACCTCAC TTCCCAAGCT ATTATCCAAC CACAGAATAT

351  GGATTCGGGA ATTCTGAAAT TACGGGTATC AGCAGGCGAA ATAGGGGATA

401  TCCGCTATGA AGAAAAACGG GATGGGAAGT CTGCCGAGGG CAGTATTAGT

451  GCATTCAATA ACAAATTTCC CTTATATAGG AACAAAATTC TCAATCTTCG

501  CGATGTAGAG CAGGGCTTGG AAAACCTGCG TCGTTTGCCG AGTGTTAAAA

551  CAGATATTCA GATTATACCG TCCGAAGAAG AAGGCAAAAG CGATTTACAG

601  ATCAAATGGC AGCAGAATAA ACCCATACGG TTCAGTATCG GTATAGATGA

651  TGCGGGCGGC AAAACGACCG GCAAATATCA AGGAAATGTC GCTTTATCGT

701  TCGATAACCC TTTGGGCTTA AGCGATTTGT TTTATGTTTC ATATGGACGC

751  GGTTTGGCGC ACAAAACGGA CTTGACTGAT GCCACCGGTA CGGAAACTGA

801  AAGCGGATCC AGAAGTTACA GCGTGCATTA TTCGGTGCCC GTAAAAAAAT

851  GGCTGTTTTC TTTTAATCAC AATGGACATC GTTACCACGA AGCAACCGAA

901  GGCTATTCCG TCAATTACGA TTACAACGGC AAACAATATC AGAGCAGCCT

951  GGCCGCCGAG CGCATGCTTT GGCGTAACAG ACTTCATAAA ACTTCAGTCG

1001  GAATGAAATT ATGGACACGC CAAACCTATA AATACATCGA CGATGCCGAA

1051  ATCGAAGTAC AACGCCGCCG CTCTGCAGGC TGGGAAGCCG AATTGCGCCA

1101  CCGTGCTTAC CTCAACCGTT GGCAGCTTGA CGGCAAGTTG TCTTACAAAC

1151  GCGGGACCGG CATGCGCCAA AGTATGCCTG CACCGGAAGA AAACGGCGGC

1201  GATATTCTTC CAGGTACATC TCGTATGAAA ATCATTACTG CCAGTTTGGA

1251  CGCAGCCGCC CCATTTATTT TAGGCAAACA GCAGTTTTTC TACGCAACCG

1301  CCATTCAAGC TCAATGGAAC AAAACGCCGT TGGTTGCCCA AGATAAATTG

1351  TCAATCGGCA GCCGCTACAC CGTTCGCGGA TTTGATGGGG AGCAGAGTCT

1401  TTTCGGAGAG CGAGGTTTCT ACTGGCAGAA TACTTTAACT TGGTATTTTC

1451  ATCCGAACCA TCAGTTCTAT CTCGGTGCGG ACTATGGCCG CGTATCTGGC

1501  GAAAGTGCAC AATATGTATC GGGCAAGCAG CTGATGGGTG CAGTGGTCGG

1551  CTTCAGAGGA GGGCATAAAG TAGGCGGTAT GTTTGCTTAT GATCTGTTTG
```

-continued
```
1601 CCGGCAAGCC GCTTCATAAA CCCAAAGGCT TTCAGACGAC CAACACCGTT

1651 TACGGCTTCA ACTTGAATTA CAGTTTCTAA
```

This corresponds to the amino acid sequence <SEQ ID 2370; ORF 707>:

```
m707.pep
   1 MEIINDAELI RSMQRQQHID AELLTDANVR FEQPLEKNNY VLSEDETPCT

51 RVNYISLDDK TVRKFSFLPS VLMKETAFKT GMCLGSNNLS RLQKAAQQIL

101 IVRGYLTSQA IIQPQNMDSG ILKLRVSAGE IGDIRYEEKR DGKSAEGSIS

151 AFNNKFPLYR NKILNLRDVE QGLENLRRLP SVKTDIQIIP SEEEGKSDLQ

201 IKWQQNKPIR FSIGIDDAGG KTTGKYQGNV ALSFDNPLGL SDLFYVSYGR

251 GLAHKTDLTD ATGTETESGS RSYSVHYSVP VKKWLFSFNH NGHRYHEATE

301 GYSVNYDYNG KQYQSSLAAE RMLWRNRLHK TSVGMKLWTR QTYKYIDDAE

351 IEVQRRRSAG WEAELRHRAY LNRWQLDGKL SYKRGTGMRQ SMPAPEENGG

401 DILPGTSRMK IITASLDAAA PFILGKQQFF YATAIQAQWN KTPLVAQDKL

451 SIGSRYTVRG FDGEQSLFGE RGFYWQNTLT WYFHPNHQFY LGADYGRVSG

501 ESAQYVSGKQ LMGAVVGFRG GHKVGGMFAY DLFAGKPLHK PKGFQTTNTV

551 YGFNLNYSF*
```

The following partial DNA sequence was identified in *N. meningitidis* <SEQ ID 2371>:

```
a707.seq
   1 NTGAAAGAAA CAGCTTTTAA AACTGGGATG TGTTTAGGTT CCAATAATTT

51 GAGCAGGCTA CAAAAAGCCG CGCAACAGAT ACTGATTGTG CGTGGCTACC

101 TCACTTCCCA AGCTATTATC CAACCACAGA ATATGGATTC GGGAATTCTG

151 AAATTACGGG TATCAGCAGG CGAAATAGGN GATATCCGCT ATGAAGAAAA

201 ACGGGATGNG AAGTCTGCCG AGGGCAGTAT TAGTGCATTC AATAACAAAN

251 TTCCCTTATA TAGGAACAAA ATTCTCAATC TTCGCGATGT AGAGCAGGGC

301 TTGGAAAACC TGCGTCGTTT GCCGAGTGTT AAAACAGATA TTCAGATTAT

351 ACCGTCCGAA GAAGAAGGCA AAAGCGATTT ACAGATCAAA TGGCAGCAGA

401 ATAAACCCAT ACGGTTCAGT ATCGGTATAG ATGATGCGGG CGGCAAAACG

451 ACCGGCAAAT ATCAAGGAAA TGTCGCTTTA TCGTNCGATA ACCCTTTGGG

501 NTTAAGCGAT TNGTTTTATG TTTCATATGG ACGCGGTTTG GTGCACAAAA

551 CGGACTTGAC TGNTGCCACC GGTACGGAAA CTGAAAGCGG ATCCAGAAGT

601 TACAGCGTGC ATTATTCGGT GNNCGTAAAA AAATGGCTGT TTTCTTTTAA

651 TCACAATGGA CATCGTTACC ACGAAGCAAC CGAAGGCTAT TCCGTCAATT

701 ACGATTACAA CGGCAAACAA TATCAGAGCA GCCTGGCCGC CGAGCGCATG

751 CTTTGGNNNN NNAGNTTTCN TNAAACTTCA GTCNGAATGA AATTATGGAC

801 ACGCCAAACC TATAAATACA TCGACGATGC CGAAATCGAA GTGCAACGCC

851 GCCGCTCTGC AGGCTGGGAA GCCGAATTGC GCCACCGTGC TTACCTCNAC

901 CGTTGGCAGC TTGACGGCAA GTTGTCTTAC AAACGCGGGA CCGGCATGCG

951 CCAAAGTATG CCCGCACCTG AAGAAACGG CGGCGGTACT ATTCCAGNCA
```

-continued

```
1001 NATCCCGTAT GAAAATCATA ACCGCCGGAT TGGATGCAGC GGCCCCGTNT

1051 ATGTTGGGCA AACAGCAGTT TTTCTACGCA ACCGCCATTC AAGCTCAATG

1101 GAACAAAACG CCTTTGGTTG CCCAAGACAA GTTGTCTATC GGCAGCCGCT

1151 ACACCGTTCG CGGATTTGAT GGGGAGCAGA GTCTTTTCGG AGAGCGAGGT

1201 TTCTACTGGC AGAATACTTT AACTTGGTAT TTTCATCCGA ACCATCAGTT

1251 CTATCTCGGT GCGGACTATG GCCGCGTATC TGGCGAAAGT GCACAATATG

1301 TATCGGGCAA GCAGCTGATG GGTGCAGTGG TCGGCTTCAG AGGAGGGCAT

1351 AAAGTAGGCG GTATGTTTGC TTATGATCTG TTTGCCGGCA AGCCGCTTCA

1401 TAAACCCAAA GGCTTTCAGA CGACCAACAC CGTTTACGGC TTCAACTTGA

1451 ATTACAGTTT CTAA
```

This corresponds to the amino acid sequence <SEQ ID 2372; ORF 707.a>:

```
a707.pep
   1 XKETAFKTGM CLGSNNLSRL QKAAQQILIV RGYLTSQAII QPQNMDSGIL

51 KLRVSAGEIG DIRYEEKRDX KSAEGSISAF NNKXPLYRNK ILNLRDVEQG

101 LENLRRLPSV KTDIQIIPSE EEGKSDLQIK WQQNKPIRFS IGIDDAGGKT

151 TGKYQGNVAL SXDNPLGLSD XFYVSYGRGL VHKTDLTXAT GTETESGSRS

201 YSVHYSVXVK KWLFSFNHNG HRYHEATEGY SVNYDYNGKQ YQSSLAAERM

251 LWXXXFXXTS VXMKLWTRQT YKYIDDAEIE VQRRRSAGWE AELRHRAYLX

301 RWQLDGKLSY KRGTGMRQSM PAPEENGGGT IPXXSRMKII TAGLDAAAPX

351 MLGKQQFFYA TAIQAQWNKT PLVAQDKLSI GSRYTVRGFD GEQSLFGERG

401 FYWQNTLTWY FHPNHQFYLG ADYGRVSGES AQYVSGKQLM GAVVGFRGGH

451 KVGGMFAYDL FAGKPLHKPK GFQTTNTVYG FNLNYSF*
``` a707/m707 95.3% identity in 486 aa overlap

```
                                 10        20        30
        a707.pep                 XKETAFKTGMCLGSNNLSRLQKAAQQILIVR
                                 ||||||||||||||||||||||||||||||
        m707     EDETPCTRVNYISLDDKTVRKFSFLPSVLMKETAFKTGMCLGSNNLSRLQKAAQQILIVR
                         50        60        70        80        90       100

40        50        60        70        80        90
        a707.pep GYLTSQAIIQPQNMDSGILKLRVSAGEIGDIRYEEKRDXKSAEGSISAFNNKXPLYRNKI
                 |||||||||||||||||||||||||||||||||||||||| ||||||||||| |||||||
        m707     GYLTSQAIIQPQNMDSGILKLRVSAGEIGDIRYEEKRDGKSAEGSISAFNNKFPLYRNKI
                        110       120       130       140       150       160

100       110       120       130       140       150
        a707.pep LNLRDVEQGLENLRRLPSVKTDIQIIPSEEEGKSDLQIKWQQNKPIRFSIGIDDAGGKTT
                 ||||||||||||||||||||||||||||||||||||||||||||||||||||||||||||
        m707     LNLRDVEQGLENLRRLPSVKTDIQIIPSEEEGKSDLQIKWQQNKPIRFSIGIDDAGGKTT
                        170       180       190       200       210       220

160       170       180       190       200       210
        a707.pep GKYQGNVALSXDNPLGLSDXFYVSYGRGLVHKTDLTXATGTETESGSRSYSVHYSVXVKK
                 ||||||||||| |||||||| ||||||||| ||||| |||||||||||||||||| |||
        m707     GKYQGNVALSFDNPLGLSDLFYVSYGRGLAHKTDLTDATGTETESGSRSYSVHYSVPVKK
                        230       240       250       260       270       280

220       230       240       250       260       270
        A707.pep WLFSFNHNGHRYHEATEGYSVNYDYNGKQYQSSLAAERMLWXXXFXXTSVXMKLWTRQTY
                 ||||||||||||||||||||||||||||||||||||||||||   :   ||||||||||
        m707     WLFSFNHNGHRYHEATEGYSVNYDYNGKQYQSSLAAERMLWRNRLHKTSVGMKLWTRQTY
                        290       300       310       320       330       340
```

-continued

```
                280        290        300        310        320        330
a707.pep   KYIDDAEIEVQRRRSAGWEAELRHRAYLXRWQLDGKLSYKRGTGMRQSMPAPEENGGGTI
           ||||||||||||||||||||||||||||||| |||||||||||||||||||||||||||| :
m707       KYIDDAEIEVQRRRSAGWEAELRHRAYLNRWQLDGKLSYKRGTGMRQSMPAPEENGGDIL
                350        360        370        380        390        400

340        350        360        370        380        390
a707.pep   PXXSRMKIITAGLDAAAPXMLGKQQFFYATAIQAQWNKTPLVAQDKLSIGSRYTVRGFDG
           | :||||||||:|||||| :||||||||||||||||||||||||||||||||||||||||
m707       PGTSRMKIITASLDAAAPPILGKQQFFYATAIQAQWNKTPLVAQDKLSIGSRYTVRGFDG
                410        420        430        440        450        460

400        410        420        430        440        450
a707.pep   EQSLFGERGFYWQNTLTWYFHPNHQFYLGADYGRVSGESAQYVSGKQLMGAVVGFRGGHK
           ||||||||||||||||||||||||||||||||||||||||||||||||||||||||||||
m707       EQSLFGERGFYWQNTLTWYFHPNHQFYLGADYGRVSGESAQYVSGKQLMGAVVGFRGGHK
                470        480        490        500        510        520

460        470        480
a707.pep   VGGMFAYDLFAGKPLHKPKGFQTTNTVYGFNLNYSFX
           ||||||||||||||||||||||||||||||||||||
m707       VGGMFAYDLFAGKPLHKPKGFQTTNTVYGFNLNYSFX
                530        540        550        560
```

20

The following partial DNA sequence was identified in *N. gonorrhoeae* <SEQ ID 2373>:

```
g708.seq
   1 ATGCCTTTTA AGCCATCCAA ACGAATCTCT TTATTACTTG TTCTTGCCTT

51 GGGCGCGTGC AGCACTTCCT ACCGCCCCTC GCGGGCAGAA AAAGCCAATC

101 AGGTTTCCAA TATCAAAACC CAGTTGGCGA TGGAATATAT GCGCGGTCAG

151 GACTACCGTC AGGCAACGGC AAGTATTGAA GATGCCTTGA AATCGAACCC

201 TAAAAACGAA CTTGCCTGGC TGGTCCGTGC CGAAATCTAT CAATACCTGA

251 AAGTTAACGA CAAGGCGCAG GAAAGTTTCC GGCAAGCCCT CTCCATCAAA

301 CCCGACAGTG CCGAAATCAA CAACAACTAC GGCTGGTTCC TGTGCGGCAG

351 GCTCAACCGC CCTGCCGAAT CTATGGCATA TTTCGACAAA GCCCTGGCCG

401 ACCCCACCTA CCCGACCCCT TATATTGCCA ACCTGAATAA AGGTATATGC

451 AGCGCAAAAC AGGGGCAATT CGGATTGGCG GAAGCCTATT TGAAACGTTC

501 CCTCGCCGCC CAGCCGCAGT TCCCACCCGC ATTTAAAGAA CTGGCGCGCA

551 CCAAAATGCT GGCCGGGCAG TTGGGCGATG CCGATTACTA CTTTAAAAAA

601 TACCAAAGCA GGGTAGAAGT CCTTCAGGCC GATGATTTGC TGCTAGGCTG

651 GAAAATTGCC AAAGCCCTCG GCAACGTGCA GGCGGCATAC GAATATGAAG

701 CACAATTGCA GGCAAATTTC CCCTACTCGG AAGAATTGCA AACCGTCCTC

751 ACCGGTCAAT AA
```

This corresponds to the amino acid sequence <SEQ ID 2374; ORF 708.ng>:

```
g708.pep
   1 MPFKPSKRIS LLLVLALGAC STSYRPSRAE KANQVSNIKT QLAMEYMRGQ

51 DYRQATASIE DALKSNPKNE LAWLVRAEIY QYLKVNDKAQ ESFRQALSIK

101 PDSAEINNNY GWFLCGRLNR PAESMAYFDK ALADPTYPTP YIANLNKGIC

151 SAKQGQFGLA EAYLKRSLAA QPQFPPAFKE LARTKMLAGQ LGDADYYFKK

201 YQSRVEVLQA DDLLLGWKIA KALGNVQAAY EYEAQLQANF PYSEELQTVL

251 TGQ*
```

The following partial DNA sequence was identified in *N. meningitidis* <SEQ ID 2375>:

```
m708.seq
  1 ATGCCTTTTA AGCCATCCAA ACGAATCTCT TTATTACTCG TTCTTGCCTT

51 GGGCGCGTGC AGCACTTCCT ACCGCCCCTC GCGGGCAGAA AAAGCCAATC

101 AGGTTTCCAA TATCAAAACC CAGTTGGCAA TGGAATATAT GCGCGGTCAG

151 G

```
                    250
m708.pep   PYSEELQTVLTGQX
           ||||||||||||||
g708       PYSEELQTVLTGQX
                    250
```

The following partial DNA sequence was identified in *N. meningitidis* <SEQ ID 2377>:

```
a708.seq
   1 ATGCCTTTTA AGCCATCCAA ACGAATCTCT TTATTACTTG TCCTTGCCTT

51 GGGCGCGTGC AGCACTTCCT ACCGCCCCTC GCGGGCAGAA AAAGCCAATC

101 AGGTTTCCAA TATCAAAACC CAGTTGGCAA TGGAATATAT GCGCGGTCAG

151 GACTACCGTC AGGNGACGGC AAGTATTGAA GACGCCTTGA AATCAGACCC

201 TAAAAACGAG CTTGCCTGGC TGGTCCGTGC CGAAATCTAT CAATACCTGA

251 AAGTTAACGA CAAGGCGCAG GAAAGTTTCC GGCAAGNCCT CTCCATCAAA

301 CCCGACAGTG CCGAAATCAA CAACAACTAC NGCTGGTTCC TGTGCGGCAG

351 GCTCAACCGC CCTGCCGAAT CTATGGCATA TTTCGACAAA GCCCTGGCCG

401 ACCCCACNTA CCCGANCCCT TATATTGCCA ACCTGAATAA AGGCATATGC

451 AGCGCAAAAC AGGGGCAATT CGGATTGGCG GAAGCCTATT TGAAACGTTC

501 CCTCGCCGCC CAGCCGCAGT TCCCACCCGC ATTTAAAGAA CTGGCGCGCA

551 CCAAAATGCT GGCCGGGCAG TTGGGCGATG CCGATTACTA CTTTAAAAAA

601 TACCAAAGCA GGGTAGAAGT CCTTCAGGCC GATGATTTGC TGCTAGGCTG

651 GAAAATTGCC AAAGCCCTCG GCAACGCACA GGCGGCATAC GAATATGAAG

701 CACAATTGCA GGCGAATTTC CCCTACTCGG AAGAATTGCA AACCGTCCTC

751 ATCGGTCAAT AA
```

This corresponds to the amino acid sequence <SEQ ID 2378; ORF 708.a>:

```
a708.pep
   1 MPFKPSKRIS LLLVLALGAC STSYRPSRAE KANQVSNIKT QLAMEYMRGQ

51 DYRQXTASIE DALKSDPKNE LAWLVRAEIY QYLKVNDKAQ ESFRQXLSIK

101 PDSAEINNNY XWFLCGRLNR PAESMAYFDK ALADPTYPXP YIANLNKGIC

151 SAKQGQFGLA EAYLKRSLAA QPQFPPAFKE LARTKMLAGQ LGDADYYFKK

201 YQSRVEVLQA DDLLLGWKIA KALGNAQAAY EYEAQLQANF PYSEELQTVL

251 IGQ*
``` a708/m708 98.0% identity in 253 aa overlap

```
                   10         20         30         40         50         60
a708.pep   MPFKPSKRISLLLVLALGACSTSYRPSRAEKANQVSNIKTQLAMEYMRGQDYRQXTASIE
           |||||||||||||||||||||||||||||||||||||||||||||||||||||| ||||
m708       MPFKPSKRISLLLVLALGACSTSYRPSRAEKANQVSNIKTQLAMEYMRGQDYRQATASIE
                   10         20         30         40         50         60

70         80         90        100        110        120
a708.pep   DALKSDPKNELAWLVRAEIYQYLKVNDKAQESFRQXLSIKPDSAEINNNYXWFLCGRLNR
           |||||||||||||||||||||||||||||||||||| ||||||||||||| |||||||||
m708       DALKSDPKNELAWLVRAEIYQYLKVNDKAQESFRQALSIKPDSAEINNNYGWFLCGRLNR
                   70         80         90        100        110        120
```

```
                      130        140        150        160        170        180
a708.pep    PAESMAYFDKALADPTYPXPYIANLNKGICSAKQGQFGLAEAYLKRSLAAQPQFPPAFKE
            ||||||||||||||||||:|||||||||||||||||||||||||||||||||||||||||
m708        PAESMAYFDKALADPTYPTPYIANLNKGICSAKQGQFGLAEAYLKRSLAAQPQFPPAFKE
                      130        140        150        160        170        180

190        200        210        220        230        240
a708.pep    LARTKMLAGQLGDADYYFKKYQSRVEVLQADDLLLGWKIAKALGNAQAAYEYEAQLQANF
            ||||||||||||||||||||||||||||||||||||||||||||||||||||||||||||
m708        LARTKMLAGQLGDADYYFKKYQSRVEVLQADDLLLGWKIAKALGNAQAAYEYEAQLQANF
                      190        200        210        220        230        240

250
a708.pep    PYSEELQTVLIGQX
            |||||||||| |||
m708        PYSEELQTVLTGQX
                      250
```

The following partial DNA sequence was identified in *N. gonorrhoeae* <SEQ ID 2379>:

```
g709.seq
    1 ATGTTTGCTT TCAAATCCTT ACTCGATATG CCGCGCGGTG AGGCACTTGC

51 CGTCGTCGTC GCTCTGATTG CCGCAATGGG CTATACCATC ATTTCATTGG

101 AGTGGCTGCC GCATATGTCC ATTATTGCCG CCATCGTCGT GCTGATTTTG

151 TACGGCTTGG CGCGCGGTTT GAAATACAAC GATATGCAGG CAGGGATGAT

201 AGGCGCGTTG AATCAGGGTA TGGGCGCGGT TTACCTGTTT TTCTTCATCG

251 GGCTGATGGT CAGCGCGCTG ATGATGAGCG GCGCGATTCC GACGCTGATG

301 TATTACGGTT TCGGGCTGAT TTCCCCGACT TATTTTTATT TTTCCGCCTT

351 CGCGCTGTGT TCCGTCATCG GCGTGTCCAT CGGCAGCAGC CTGACCGCCT

401 GCGCCACTGT CGGCGTTGCC TTTATGGGGA TGGCGGCGGC GTTTCAGGCC

451 GATATGGCGA TGACGgcggg cgcgattgTT tccggTGTGT TTTTCGGCGA

501 TAAAATGTCC CCGCTTTCCG ACACCACGGG CATTTCCGCG TCCATCGTCG

551 GTATCGACCT GTTTGAACAC ATCAAAAACA TGATGTACAC CACCATCCCT

601 GCGTGGCTTA TCAGCGCGGC ACTGATGCTT TGGCTTCTTC CCAGCGTCGC

651 CGCGCAGGAT TTGAACAGCG TCGAATCCTT CCGCAGCCAG CTTGAAGCCA

701 CGGGATTGGT GCACGGCTAT TCGCTGATTC CGTTTGCACT GTTGGTCGTT

751 TTGGCATTGA TGCGCGTCAA TGCCGTGGTC GCCATGCTCT TTACCGTCAT

801 TGCCGCCGTT GCCGTAACGT ATCTGCACAG CACGCCCGAT CTGCGTCAGC

851 TCGGCGCGTG GTTTTATGGC GGCTACAAAC TCGAAGGCGA AGCGTTTAAA

901 GACATTGCCA AACTGATTTC GCGCGGCGGC TTGGAGAGTA TGTTCTTTAC

951 GCAGACCATC GTTATCCTCG GTATGAGTTT GGGCGGGCTG CTGTTTGCGC

1001 TCGGTGTGAT TCCTTCCTTG CTGGAGGCCG TCCGTACCTT CTTGACGAAT

1051 GCCGGACGCG CGACGTTCAG CGTTGCCATG ACTTCGGTCG GGGTCAATTT

1101 CCTGATTGGA GAGCAATATT TGAGCATCCT GCTTTCGGGA GAAACGTTCA

1151 AACCCGTTTA CGACAAACTC GGCCTGCATT CGTGCAACCT GTCGCGGACT

1201 CTGGAAGATG CGGGGACGGT GATTAACCCG CTCGTGCCGT GGAGCGTGTG

1251 CGGCGTATTT ATCAGCCACG CCCTTGGCGT ACCCGTTTGG GAATATCTGC

1301 CTTATGCCTT TTTCTGCTAT TTGAGTTTGG CTTTAACCCT GTTATTCGGC

1351 TGGACGGGGC TGACTTTGAG CAAAAAATAA
```

This corresponds to the amino acid sequence <SEQ ID 2380; ORF 709.ng>:

```
g709.pep
   1 MFAFKSLLDM PRGEALAVVV ALIAAMGYTI ISLEWLPHMS IIAAIVVLIL

51 YGLARGLKYN DMQAGMIGAL NQGMGAVYLF FFIGLMVSAL MMSGAIPTLM

101 YYGFGLISPT YFYFSAFALC SVIGVSIGSS LTACATVGVA FMGMAAAFQA

151 DMAMTAGAIV SGVFFGDKMS PLSDTTGISA SIVGIDLFEH IKNMMYTTIP

201 AWLISAALML WLLPSVAAQD LNSVESFRSQ LEATGLVHGY SLIPFALLVV

251 LALMRVNAVV AMLFTVIAAV AVTYLHSTPD LRQLGAWFYG GYKLEGEAFK

301 DIAKLISRGG LESMFFTQTI VILGMSLGGL LFALGVIPSL LEAVRTFLTN

351 AGRATFSVAM TSVGVNFLIG EQYLSILLSG ETFKPVYDKL GLHSCNLSRT

401 LEDAGTVINP LVPWSVCGVF ISHALGVPVW EYLPYAFFCY LSLALTLLFG

451 WTGLTLSKK*
```

The following partial DNA sequence was identified in *N. meningitidis* <SEQ ID 2381>:

```
m709.seq
     1 ATGTTCGCTT TCAAATCCTT ACTCGATATG CCGCGCGGTG AGGCACTTGC

51 CGTCGTCGTC GCTCTGATTG CCGCGATGGG CTATACCATC ATTTCATTGG

101 AGTGGTTGCC GCATATGTCC ATTATTGCCG CCATCGTCGT GCTGATTTTG

151 TACGGCTTGG CGCGCGGTTT GAAATACAAC GATATGCAGC AGGGCATGAT

201 AGGCGCGTTG AATCAGGGTA TGGGCGCGAT TTACCTGTTT TTCTTCATCG

251 GGCTGATGGT CAGCGCGCTG ATGATGAGCG GCGCGATTCC GACGCTGATG

301 TATTACGGTT TCGGACTGAT TTCCCCGACT TATTTTTATT TTTCCTCCTT

351 CGCGCTGTGT TCCGTCATCG GCGTGTCCAT CGGCAGCAGC CTGACCACCT

401 GCGCCACTGT CGGCGTTGCC TTTATGGGGA TGGCGGCGGC GTTTCAGGCC

451 GATATGGCGA TGACGGCGGG CGCGATTGTT TCGGGCGCAT TTTTTGGCGA

501 CAAAATGTCC CCGCTTTCGG ATACGACGGG TATTTCCGCG TCCATCGTCG

551 GCATCGACTT GTTTGAGCAC ATCAAAAATA TGATGTACAC CACCATCCCC

601 GCGTGGCTCA TTAGTGCGGC ACTGATGCTT TGGCTTTTGC CGAATGTCGC

651 CGCGCAGGAT TTGAACAGCG TCGAATCCTT CCGCAGCCAG CTTGAAGCCA

701 CGGGATTGGT GCACGGCTAT TCGCTGATTC CGTTTGCGCT GTTGGTCATT

751 TTGGCATTGA TGCGCATCAA CGCCGTCGTC GCCATGCTCT TTACCGTCAT

801 GGTTGCCGTT GCTGTAACGT ATCTGCACAG CACGCCCGAT CTGCGTCAGC

851 TCGGTGCGTG GTTTTACGGC GGCTACAAAC TCGAAGGCGA AGCGTTTAAA

901 GATGTTGTCA AACTGATTTC GCGCGGCGGT TTGGAAAGTA TGTTTTTCAC

951 GCAAACCATC GTGATTCTCG GGATGAGTTT GGGCGGACTG TTGTTTGCGC

1001 TCGGTGTGAT TCCTTCCCTG TTGGAGGCCA TCCGTACCTT CTTGACGAAT

1051 GCCGGACGCG CGACGTTCAG CGTTGCCATG ACTTCGGTCG GGGTTAATTT

1101 CCTGATCGGC GAGCAATATT TGAGTATTTT GTTGTCGGGT GAAACGTTCA

1151 AACCCGTTTA CGATAAGCTC GGTCTGCATT CGCGCAATCT GTCGCGGACG

1201 CTGGAAGATG CGGGGACGGT GATTAACCCG CTCGTACCGT GGAGCGTATG
```

```
1251  CGGCGTGTTC ATCAGCCACG CGCTGGGCGT GCCGGTTTGG GAATATCTGC

1301  CGTATGCCTT TTTCTGCTAT TTGAGTTTGG CTTTGACCCT GTTATTCGGT

1351  TGGACGGGGC TGACTTTGAG CAAAAAATAA
```

This corresponds to the amino acid sequence <SEQ ID 2382; ORF 709>:

```
m709.pep

1   MFAFKSLLDM PRGEALAVVV ALIAAMGYTI ISLEWLPHMS IIAAIVVLIL

51   YGLARGLKYN DMQQGMIGAL NQGMGAIYLF FFIGLMVSAL MMSGAIPTLM

101   YYGFGLISPT YFYFSSFALC SVIGVSIGSS LTTCATVGVA FMGMAAAFQA

151   DMAMTAGAIV SGAFFGDKMS PLSDTTGISA SIVGIDLFEH IKNMMYTTIP

201   AWLISAALML WLLPNVAAQD LNSVESFRSQ LEATGLVHGY SLIPFALLVI

251   LALMRINAVV AMLFTVMVAV AVTYLHSTPD LRQLGAWFYG GYKLEGEAFK

301   DVVKLISRGG LESMFFTQTI VILGMSLGGL LFALGVIPSL LEAIRTFLTN

351   AGRATFSVAM TSVGVNFLIG EQYLSILLSG ETFKPVYDKL GLHSRNLSRT

401   LEDAGTVINP LVPWSVCGVF ISHALGVPVW EYLPYAFFCY LSLALTLLFG

451   WTGLTLSKK* m709/g709  96.9% identity in 459 aa overlap 10         20         30         40         50         60
m709.pep  MFAFKSLLDMPRGEALAVVVALIAAMGYTIISLEWLPHMSIIAAIVVLILYGLARGLKYN
          ||||||||||||||||||||||||||||||||||||||||||||||||||||||||||||
g709      MFAFKSLLDMPRGEALAVVVALIAAMGYTIISLEWLPHMSIIAAIVVLILYGLARGLKYN
                 10         20         30         40         50         60

70         80         90        100        110        120
m709.pep  DMQQGMIGALNQGMGAIYLFFFIGLMVSALMMSGAIPTLMYYGFGLISPTYFYFSSFALC
          |||  ||||||||||||||:||||||||||||||||||||||||||||||||||||:|||
g709      DMQAGMIGALNQGMGAVYLFFFIGLMVSALMMSGAIPTLMYYGFGLISPTYFYFSAFALC
                 70         80         90        100        110        120

130        140        150        160        170        180
m709.pep  SVIGVSIGSSLTTCATVGVAFMGMAAAFQADMAMTAGAIVSGAFFGDKMSPLSDTTGISA
          ||||||||||||:|||||||||||||||||||||||||||||||:|||||||||||||||
g709      SVIGVSIGSSLTACATVGVAFMGMAAAFQADMAMTAGAIVSGVFFGDKMSPLSDTTGISA
                130        140        150        160        170        180

190        200        210        220        230        240
m709.pep  SIVGIDLFEHIKNMMYTTIPAWLISAALMLWLLPNVAAQDLNSVESFRSQLEATGLVHGY
          ||||||||||||||||||||||||||||||||||||:|||||||||||||||||||||||
g709      SIVGIDLFEHIKNMMYTTIPAWLISAALMLWLLPSVAAQDLNSVESFRSQLEATGLVHGY
                190        200        210        220        230        240

250        260        270        280        290        300
m709.pep  SLIPFALLVILALMRINAVVAMLFTVMVAVAVTYLHSTPDLRQLGAWFYGGYKLEGEAFK
          ||||||||||:|||||:||||||||||::|||||||||||||||||||||||||||||||
g709      SLIPFALLVVLALMRVNAVVAMLFTVIAAVAVTYLHSTPDLRQLGAWFYGGYKLEGEAFK
                250        260        270        280        290        300

310        320        330        340        350        360
m709.pep  DVVKLISRGGLESMFFTQTIVILGMSLGGLLFALGVIPSLLEAIRTFLTNAGRATFSVAM
          |::|||||||||||||||||||||||||||||||||||||||||:|||||||||||||||
g709      DIAKLISRGGLESMFFTQTIVILGMSLGGLLFALGVIPSLLEAVRTFLTNAGRATFSVAM
                310        320        330        340        350        360

370        380        390        400        410        420
m709.pep  TSVGVNFLIGEQYLSILLSGETFKPVYDKLGLHSRNLSRTLEDAGTVINPLVPWSVCGVF
          |||||||||||||||||||||||||||||||||| |||||||||||||||||||||||||
g709      TSVGVNFLIGEQYLSILLSGETFKPVYDKLGLHSCNLSRTLEDAGTVINPLVPWSVCGVF
                370        380        390        400        410        420

430        440        450        460
m709.pep  ISHALGVPVWEYLPYAFFCYLSLALTLLFGWTGLTLSKKX
          ||||||||||||||||||||||||||||||||||||||||
g709      ISHALGVPVWEYLPYAFFCYLSLALTLLFGWTGLTLSKKX
                430        440        450        460
```

The following partial DNA sequence was identified in *N. meningitidis* <SEQ ID 2383>:

```
a709.seq
   1  ATGTTCGCTT TCNAATCCTT ACTCGATATG CCGCGCGGTG AGGCNCTTGC
  51  CGTCGTCGTC GCTCTGATTG CCGCGATGGG CTATACCATC ATTTNNTTGG
 101  AGTGGCTGCC GCATATGTCC ATTATTGCCG CCATCGTNGT GCTGATTTTG
 151  TACGGCTTGG CGCGCGGTTT GAAATACAAC GATATGCAGC AGGGCATGAT
 201  AGGCGCGTTG AATCAGGGTA TGGGCGCGAT TTACCTNTTT TTCTTCATCG
 251  GGCTGATGGT CAGCGCGCTG ATGATGAGCG GCGCGATTCC GACGCTGATG
 301  TATTACGGTT TCGGACTGAT TTCCCCGACT TATTTTTATT TTTCCGCCTT
 351  CGCGCTGTGT TCCGTCATCG GCGTGTCCAT CGGCAGCAGC CTGACCACCT
 401  GCGCCACTGT CGGCGTTGCC TTNATGGGTA TNNNGNCGGC GTTTCNGGCC
 451  NANATGGNGN NGNNGNNGGN CNNGATTGTN NNGGNCGCAT TNTTNGGCGN
 501  CAAAATGTCN CCGCTTTCCG ATACGNCGGG CATNTCCGCG TCCATTGTCG
 551  GTATCGACCT GTTTGAACAC ATCAAAAATA TGATGTACAC NACCATTCCC
 601  GCGTGGCTCA TCAGTGNNNC ACTGATGCTG TNGCTTCTTC CCAGCGTCGC
 651  CGCGCAGGAT TTGAACAGCG TCGAATCCTT CCGCAGCCAG CTTGAAGCCA
 701  CGGGATTGGT GCACTGCTAT TCGCTGATTC CGTTTGCGCT GTTGGTCGTT
 751  TTGGCATTGA TGCGCGTCAA TGCCGTGGTC GCTATGCTCT TTACCGTCAT
 801  TGCCGCCGTT GCCGTAACGT ATCTGCACAG CACGCCCGAT CTGCGTCAGC
 851  TCGGCGCGTG GTTTTACGGC GGCTACAAAC TCGAAGGCGA AGCGTNTANA
 901  GACATTGCCA AACTCATTTC TCGCGGCGGT TTGGAAAGTA TGTTTTTCAC
 951  GCAGACCATC GTGATTCTTG GGATGAGCCT TGGCGGGCTG CTGTTTGCAC
1001  TGGGCGCGAT TCCTTCCCTG CTGGATGCCG TCCGCAGCTT TTTGACGAAT
1051  GCCGGGCGTN CCACATTCAG CGTTGCCATG ACTTCGGTCG GGGTTAATTT
1101  CCTGATCGGC GAGCAATATT TGAGTATTTT GTTGTCNGGT GAAACGTTCA
1151  AACCTGTTTA CGATAAGCTC GGTCTGCATT CGCGCAATCT GTCGCGGACG
1201  CTGGAAGATG CGGGGACGGT CATCAACCCG CTCGTACCGT GGAGCGTATG
1251  CGGCGTGTTC ATCANCCACG CGCTGGGCGT GCCGGTTTGG GAATATCTGC
1301  CGTATGCCTT TTTCTGCTAT TTGAGTTTGG CTTTGACCCT GTTATTCGGT
1351  TGGACGGGGC TGACTTTGAG CAAAAAATAA
```

This corresponds to the amino acid sequence <SEQ ID 2384; ORF 709.a>:

```
a709.pep
   1  MFAFXSLLDM PRGEALAVVV ALIAAMGYTI IXLEWLPHMS IIAAIVVLIL
  51  YGLARGLKYN DMQQGMIGAL NQGMGAIYLF FFIGLMVSAL MMSGAIPTLM
 101  YYGFGLISPT YFYFSAFALC SVIGVSIGSS LTTCATVGVA XMGXXXAFXA
 151  XMXXXXXXIV XXAXXGXKMS PLSDTXGXSA SIVGIDLFEH IKNMMYTTIP
 201  AWLISXXLML XLLPSVAAQD LNSVESFRSQ LEATGLVHCY SLIPFALLVV
 251  LALMRVNAVV AMLFTVIAAV AVTYLHSTPD LRQLGAWFYG GYKLEGEAXX
 301  DIAKLISRGG LESMFFTQTI VILGMSLGGL LFALGAIPSL LDAVRSFLTN
```

```
-continued
351 AGRXTFSVAM TSVGVNFLIG EQYLSILLSG ETFKPVYDKL GLHSRNLSRT

401 LEDAGTVINP LVPWSVCGVF IXHALGVPVW EYLPYAFFCY LSLALTLLFG

451 WTGLTLSKK*
``` a709/m709 91.1% identity in 459 aa overlap

```
                    10         20         30         40         50         60
a709.pep    MFAFXSLLDMPRGEALAVVVALIAAMGYTIIXLEWLPHMSIIAAIVVLILYGLARGLKYN
            ||||  ||||||||||||||||||||||||| ||||||||||||||||||||||||||||
m709        MFAFKSLLDMPRGEALAVVVALIAAMGYTIISLEWLPHMSIIAAIVVLILYGLARGLKYN
                    10         20         30         40         50         60

70         80         90        100        110        120
a709.pep    DMQQGMIGALNQGMGAIYLFFFIGLMVSALMMSGAIPTLMYYGFGLISPTYFYFSAFALC
            ||||||||||||||||||||||||||||||||||||||||||||||||||||||||:|||
m709        DMQQGMIGALNQGMGAIYLFFFIGLMVSALMMSGAIPTLMYYGFGLISPTYFYFSSFALC
                    70         80         90        100        110        120

130        140        150        160        170        180
a709.pep    SVIGVSIGSSLTTCATVGVAXMGXXXAFXAXMXXXXXXIVXXAXXGXKMSPLSDTXGXSA
            |||||||||||||||||||| ||   ||| | |  :  || |  |  |||||||| | ||
m709        SVIGVSIGSSLTTCATVGVAFMGMAAAFQADMAMTAGAIVSGAFFGDKMSPLSDTTGISA
                   130        140        150        160        170        180

190        200        210        220        230        240
a709.pep    SIVGIDLFEHIKNMMYTTIPAWLISXXLMLXLLPSVAAQDLNSVESFRSQLEATGLVHCY
            ||||||||||||||||||||||||||   ||| |||:|||||||||||||||||||||| |
m709        SIVGIDLFEHIKNMMYTTIPAWLISAALMLWLLPNVAAQDLNSVESFRSQLEATGLVHGY
                   190        200        210        220        230        240

250        260        270        280        290        300
a709.pep    SLIPFALLVVLALMRVNAVVAMLFTVIAAVAVTYLHSTPDLRQLGAWFYGGYKLEGEAXX
            ||||||||::||||:|||||||||||::|||||||||||||||||||||||||||||||
m709        SLIPFALLVILALMRINAVVAMLFTVMVAVAVTYLHSTPDLRQLGAWFYGGYKLEGEAFK
                   250        260        270        280        290        300

310        320        330        340        350        360
a709.pep    DIAKLISRGGLESMFFTQTIVILGMSLGGLLFALGAIPSLLDAVRSFLTNAGRXTFSVAM
            |::|||||||||||||||||||||||||||||||||:||||:|:|:|||||||| |||||
m709        DVVKLISRGGLESMFFTQTIVILGMSLGGLLFALGVIPSLLEAIRTFLTNAGRATFSVAM
                   310        320        330        340        350        360

370        380        390        400        410        420
a709.pep    TSVGVNFLIGEQYLSILLSGETFKPVYDKLGLHSRNLSRTLEDAGTVINPLVPWSVCGVF
            ||||||||||||||||||||||||||||||||||||||||||||||||||||||||||||
m709        TSVGVNFLIGEQYLSILLSGETFKPVYDKLGLHSRNLSRTLEDAGTVINPLVPWSVCGVF
                   370        380        390        400        410        420

430        440        450        460
a709.pep    IXHALGVPVWEYLPYAFFCYLSLALTLLFGWTGLTLSKKX
            | ||||||||||||||||||||||||||||||||||||||
m709        ISHALGVPVWEYLPYAFFCYLSLALTLLFGWTGLTLSKKX
                   430        440        450        460 g710.seq    not found g710.pep    not found
```

The following partial DNA sequence was identified in *N. meningitidis* <SEQ ID 2385>:

```
m710.seq
   1 ATGGAAACCC ACGAAAAAAT CCGCCTGATG CGCGAATTGA ATAAATGGTC

51 CCAGGAGGAT ATGGCGGAAA AGCTGGCGAT GTCGGCAGGC GGGTATGCCA

101 AAATCGAACG GGGCGAAACG CAGTTAAATA TCCCGCGTTT GGAGCAGTTG

151 GCTCAGATTT TCAAAATCGA TATGTGGGAC TTGCTCAAAT CGGGCGGTGG

201 TGGGATGGTG TTTCAGATTA ATGAAGGTGA TAGTGGTGGC GATATTGCGT

251 TGTATGCGTC GGGTGATGTT TCGATGAAAA TAGAATTTTT AAAAATGGAG

301 TTGAAACACT GCAAAGAAAT GTTGGAACAA AAAGACAAAG AAATCGAGCT

351 GCTCCGCAAG CTGACCGAAA CCGTTTAA
```

This corresponds to the amino acid sequence <SEQ ID 2386; ORF 710>:

```
m710.pep
    1 METHEKIRLM RELNKWSQED MAEKLAMSAG GYAKIERGET QLNIPRLEQL

51 AQIFKIDMWD LLKSGGGGMV FQINEGDSGG DIALYASGDV SMKIEFLKME

101 LKHCKEMLEQ KDKEIELLRK LTETV*
```

The following partial DNA sequence was identified in *N. meningitidis* <SEQ ID 2387>:

```
a710.seq
    1 ATGGAAACCC ACGAAAAAAT CCGCCTGATG CGCGAATTGA ATAAATGGTC

51 CCAGGAGGAT ATGGCGGAAA AGCTGGCGAT GTCGGCAGGC GGGTATGCCA

101 AAATCGAACG AGGCGAAACG CAGTTGAATA TCCCGCGTTT GGAGCAGTTG

151 GCGCAGATTT TCAAAATTGA TATGTGGGAC TTGCTCAAAT CGGGCGGCGG

201 CGGGATGGTG TTGCAGATTA ACGATGTGGA TACCAACAGC GGGGAATTTG

251 CAATCTATAC CGCTCAGGAT GCATCNGGTA AAGCTGGATT TGTTAAAATG

301 GAATTAAAAC ACTGTAAAGA AATGTTGGAA CACAAAGACA AAGAAATCGA

351 GCTGCTCCGC AAGCTGACCG AAACCGTTTA A
```

This corresponds to the amino acid sequence <SEQ ID 2388; ORF 710.a>:

```
a710.pep
    1 METHEKIRLM RELNKWSQED MAEKLAMSAG GYAKIERGET QLNIPRLEQL

51 AQIFKIDMWD LLKSGGGGMV LQINDVDTNS GEFAIYTAQD ASGKAGFVKM

101 ELKHCKEMLE HKDKEIELLR KLTETV*
``` a710/m710 85.7% identity in 126 aa overlap

```
                    10        20        30        40        50        60
    a710.pep  METHEKIRLMRELNKWSQEDMAEKLAMSAGGYAKIERGETQLNIPRLEQLAQIFKIDMWD
              ||||||||||||||||||||||||||||||||||||||||||||||||||||||||||||
    m710      METHEKIRLMRELNKWSQEDMAEKLAMSAGGYAKIERGETQLNIPRELQLAQIFKIDMWD
                    10        20        30        40        50        60

70        80        90       100       110       120
    a710.pep  LLKSGGGGMVLQINDVDTNSGEFAIYTAQDASGKAGFVKMELKHCKEMLEHKDKEIELLR
              |||||||||||:|||: |:: |::|:|:: |:|  |:||:||||||||||:|||||||||
    m710      LLKSGGGGMVFQINEGDSG-GDIALYASGDVSMKIEFLKMELKHCKEMLEQKDKEIELLR
                    70        80        90       100       110 a710.pep  KLTETVX
              |||||||
    m710      KLTETVX
                120
    g711.seq not found g711.pep not found
```

The following partial DNA sequence was identified in *N. meningitidis* <SEQ ID 2389>:

```
m711.seq
    1 ATGCCCGCGC CTGATTTGGG ATTTGCCTTA AGTCTGCCGC CAAAAAAGGC

51 AATCGAGTGG CTGGAAAGTA AAAAGGTTAC GGCGGAGAGC TACCGCAATC

101 TGACAGCCTC CGAAATTGCC AAAGTCTATA CGATTGCCCG CATGACCGAC
```

-continued

```
 151 TTGGATATGC TCAACGACAT CAAAACTTCG ATGGTTGAAT CGGCAAAAAG

201 TGGACAGTCG TTTGACGATT GGCGAAAAGG TATCTTGAAT CTGCTCAGCA

251 ACAAGGGCTG GCTGCATCCG AACGGGCATA ACGGTAAGGA TATCATCGAC

301 CCAGCCACCG GCGAGGTATT CGGTTCGCCG CGGAGGTTGG AGACGATTTA

351 CCGTACCAAT ATGCAAACTG CCTACAACGC CGGTCAATAT CAAGGATATA

401 TGGCAAATAT TGATGCACGA CCTTATTGGA TGTATGACGC GGTAGGCGAC

451 AGCCGCACCC GTCCGGCGCA TTCGGCAATA GACGGGCTGG TGTACCGCTA

501 CGACGACCCG TTTTGGGCAA CGTTTTACCC GCCCAACGGC TACAACTGCC

551 GCTGCTCGGT CATCGCGCTG TCGGAGCGGG ATGTGGAACG CCAGGGCGG

601 ATTGTTGGGC AAAGCACGGC GGACAATCTG GTCGAGACCC ATAAAATCTA

651 CAACAAAAAA GGCGATACTT ATCTGACCCT TGCCTATAAA GCACCGGATG

701 GCAGTCTGTA CACGACCGAT CGAGGATTTG ATTACAACGC CGGACGAATG

751 AACTACCGCC CCGATTTAGA CAAGTACGAC CGTGCGTTGG CGCATCAATT

801 TGCCAAAGCG GAAATGGGTG GTGCGGATTT TAAAACCAGC TTTAAACAGC

851 TTGAAAAAGA GTTTTATGAA GTCAAGCAAC GTTTGGATAT TGATGGCAAG

901 CCCGATAAAG AGCAGAAAAT CAAATCCGA AATGCGCTAT CAAGACAGCT

951 TAAATTTGCT GCGGGTGTAT TGAGCAAGGA AACGCAAGAA TTGGCAGGTA

1001 TGACACGAGC GACGGTGTGG CTGTCTGATG ATACGTTGGT TAAACAGGTA

1051 GACAGCCGTG AGGGGCAGAA TTTCGATGAC TCCTACTATG CTTTTTTGCC

1101 GGATATGCTG CAAAACCCTG AACATGTCAT CCGCGACAAT CGTGAATTGA

1151 TTTTCACAGC TCGCTATAAA GGCTCGGCAT TGTGGGCAGT TTTAAAATAT

1201 ATTAAGGAGG TGGATGAGAT TTATCTACAG TCGTACCGAA TCAGTAACGA

1251 CAAAGAGATT GCCAAATTTA TGGCGAAGAA GAAAGTATTG AAATAG
```

This corresponds to the amino acid sequence <SEQ ID 2390; ORF 711>:

```
m711.pep
   1 MPAPDLGFAL SLPPKKAIEW LESKKVTAES YRNLTASEIA KVYTIARMTD

51 LDMLNDIKTS MVESAKSGQS FDDWRKGILN LLSNKGWLHP NGHNGKDIID

101 PATGEVFGSP RRLETIYRTN MQTAYNAGQY QGYMANIDAR PYWMYDAVGD

151 SRTRPAHSAI DGLVYRYDDP FWATFYPPNG YNCRCSVIAL SERDVERQGR

201 IVGQSTADNL VETHKIYNKK GDTYLTLAYK APDGSLYTTD RGFDYNAGRM

251 NYRPDLDKYD RALAHQFAKA EMGGADFKTS FKQLEKEFYE VKQRLDIDGK

301 PDKEQKIKIR NALSRQLKFA AGVLSKETQE LAGMTRATVW LSDDTLVKQV

351 DSREGQNFDD SYYAFLPDML QNPEHVIRDN RELIFTARYK GSALWAVLKY

401 IKEVDEIYLQ SYRISNDKEI AKFMAKKKVL K*
```

The following partial DNA sequence was identified in N. meningitidis <SEQ ID 2391>:

```
a711.seq
   1 ATGCCCGCGC CTGATTTGGG ATTTGCCTTA AGTCTGCCGC CAAAAAAGGC

51 AATCGAGTGG CTGGAAAGTA AAAAGGTTAC GGCGGAGAGC TACCGCAATC
```

-continued

```
 101 TGACAGCCTC CGAAATTGCC AAAGTCTATA CGATTGCCCG CATGACCGAC

151 TTGGATATGC TCAACGACAT CAAAACTTCG ATGGTTGAAT CGGCAAAAAG

201 TGGACAGTCG TTTGACGATT GGCGAAAAGG TATCTTGAAT CTGCTCAGCA

251 ACAAGGGCTG GCTGCATCCG AACGGGCATA ACGGTAAGGA TATCATCGAC

301 CCAGCCACCG GCGAGGTATT CGGTTCGCCG CGGAGGTTGG AGACGATTTA

351 CCGTACCAAC ATGCAAACTG CCTACAACGC CGGTCAATAT CAAGGATATA

401 TGGCAAATAT TGATGCACGA CCTTATTGGA TGTATGACGC GGTAGGCGAC

451 AGCCGCACCC GTCCGGCGCA TTCGGCAATA GACGGGCTGG TGTACCGCTA

501 CGACGACCCG TTTTGGGCAA CGTTTTACCC GCCCAACGGC TACAACTGCC

551 GTTGCTCGGT CATCGCGCTG TCGGAGCGGG ATGTGGAACG CCAGGGGCGG

601 ATTGTCGGGC AAAGCACGTC GGACAATCTT GTTGAGACCC ATAAAATCTA

651 CAACAAAAAA GGCGATACTT ATCTGACCCT TGCCTATAAA GCACCGGATG

701 GCAGTCTGTA CACGACCGAT CGAGGATTTG ATTACAACGC CGGACGAATG

751 AACTACCGCC CCGATTTAGA CAAGTACGAC CGTGCGTTGG CGCATCAATT

801 TGCCAAAGCG GAAATGGGTG GTGCGGATTT TAAAACCAGC TTTAAACAGC

851 TTGAAAAAGA GTTTTATGAA GTCAAGCAAC GTTTGGATAT TGATGGCAAG

901 CCCGATAAAG AGCAGAAAAT CAAAATCCGA ATGCGCTAT CAAGACAGCT

951 TAAATTTGCT GCGGGTGTAT TGAGCAAGGA AACGCAAGAA TTGGCAGGTA

1001 TGACACGAGC GACGGTGTGG CTGTCTGATG ATACGTTGGT TAAACAGGTA

1051 GACAGCCGTG AAGGGCAGAA TTTCGATGAC TCCTACTATG CTTTTTTGCC

1101 GGATATGCTG CAAAACCCTG AACATGTCAT CCGCGACAAT CGTGAATTGA

1151 TTTTCACAGC TCGCTATAAA GGCTCGGCAT TGTGGGCAGT TTTAAAATAT

1201 ATTAAGGAGG TGGATGAGAT TTATCTACAG TCGTACCGAA TCAGTAACGA

1251 CAAAGAGATT GCCAAATTTA TGGCGAAGAA GAAAGTATTG AAATAG
```

This corresponds to the amino acid sequence <SEQ ID 2392; ORF 711.a>:

```
a711.pep
  1 MPAPDLGFAL SLPPKKAIEW LESKKVTAES YRNLTASEIA KVYTIARMTD

51 LDMLNDIKTS MVESAKSGQS FDDWRKGILN LLSNKGWLHP NGHNGKDIID

101 PATGEVFGSP RRLETIYRTN MQTAYNAGQY QGYMANIDAR PYWMYDAVGD

151 SRTRPAHSAI DGLVYRYDDP FWATFYPPNG YNCRCSVIAL SERDVERQGR

201 IVGQSTSDNL VETHKIYNKK GDTYLTLAYK APDGSLYTTD RGFDYNAGRM

251 NYRPDLDKYD RALAHQFAKA EMGGADFKTS FKQLEKEFYE VKQRLDIDGK

301 PDKEQKIKIR NALSRQLKFA AGVLSKETQE LAGMTRATVW LSDDTLVKQV

351 DSREGQNFDD SYYAFLPDML QNPEHVIRDN RELIFTARYK GSALWAVLKY

401 IKEVDEIYLQ SYRISNDKEI AKFMAKKKVL K*
``` a711/m711 99.8% identity in 431 aa overlap

```
                 10        20        30        40        50        60
a711.pep  MPAPDLGFALSLPPKKAIEWLESKKVTAESYRNLTASEIAKVYTIARMTDLDMLNDIKTS
          ||||||||||||||||||||||||||||||||||||||||||||||||||||||||||||
m711      MPAPDLGFALSLPPKKAIEWLESKKVTAESYRNLTASEIAKVYTIARMTDLDMLNDIKTS
                 10        20        30        40        50        60

70        80        90       100       110       120
a711.pep  MVESAKSGQSFDDWRKGILNLLSNKGWLHPNGHNGKDIIDPATGEVFGSPRRLETIYRTN
          ||||||||||||||||||||||||||||||||||||||||||||||||||||||||||||
m711      MVESAKSGQSFDDWRKGILNLLSNKGWLHPNGHNGKDIIDPATGEVFGSPRRLETIYRTN
                 70        80        90       100       110       120

130       140       150       160       170       180
a711.pep  MQTAYNAGQYQGYMANIDARPYWMYDAVGDSRTRPAHSAIDGLVYRYDDPFWATFYPPNG
          ||||||||||||||||||||||||||||||||||||||||||||||||||||||||||||
m711      MQTAYNAGQYQGYMANIDARPYWMYDAVGDSRTRPAHSAIDGLVYRYDDPFWATFYPPNG
                130       140       150       160       170       180

190       200       210       220       230       240
a711.pep  YNCRCSVIALSERDVERQGRIVGQSTSDNLVETHKIYNKKGDTYLTLAYKAPDGSLYTTD
          |||||||||||||||||||||||||:||||||||||||||||||||||||||||||||||
m711      YNCRCSVIALSERDVERQGRIVGQSTADNLVETHKIYNKKGDTYLTLAYKAPDGSLYTTD
                190       200       210       220       230       240

250       260       270       280       290       300
a711.pep  RGFDYNAGRMNYRPDLDKYDRALAHQFAKAEMGGADFKTSFKQLEKEFYEVKQRLDIDGK
          ||||||||||||||||||||||||||||||||||||||||||||||||||||||||||||
m711      RGFDYNAGRMNYRPDLDKYDRALAHQFAKAEMGGADFKTSFKQLEKEFYEVKQRLDIDGK
                250       260       270       280       290       300

310       320       330       340       350       360
a711.pep  PDKEQKIKIRNALSRQLKFAAGVLSKETQELAGMTRATVWLSDDTLVKQVDSREGQNFDD
          ||||||||||||||||||||||||||||||||||||||||||||||||||||||||||||
m711      PDKEQKIKIRNALSRQLKFAAGVLSKETQELAGMTRATVWLSDDTLVKQVDSREGQNFDD
                310       320       330       340       350       360

370       380       390       400       410       420
a711.pep  SYYAFLPDMLQNPEHVIRDNRELIFTARYKGSALWAVLKYIKEVDEIYLQSYRISNDKEI
          ||||||||||||||||||||||||||||||||||||||||||||||||||||||||||||
m711      SYYAFLPDMLQNPEHVIRDNRELIFTARYKGSALWAVLKYIKEVDEIYLQSYRISNDKEI
                370       380       390       400       410       420

430
a711.pep  AKFMAKKKVLKX
          ||||||||||||
m711      AKFMAKKKVLKX
                430 g712.seq  not found yet g712.pep  not found yet
```

The following partial DNA sequence was identified in *N. meningitidis* <SEQ ID 2393>:

```
m712.seq
    1  ATGATGCCCC ATATTGATTT TGACACGATT CCGGGCAGCA TCCGCGTGCC
   51  CGGGCAGTAT ATTGAATTTA ACACCCGCAA TGCCGTACAA GGTTTGCCGC
  101  AAAATCCGCA AAAGGTATTG ATGGTTGCAC CCATGCTGAC CGCGGGCATA
  151  CAGACCGTCT TAGAGCCGGT GCAACTATTT AGCGATGCCG AGGCGGCCGA
  201  TTTGTTCGGA CAAGGCTCGC TGGCGCATTT GATGGTGCGC CAAGCATTTG
  251  CCAACAACCC TTATTTGGAT TTGACCGTTA TCGGTATTGC CGACCACAGC
  301  GCAGGCGTGC AGGCAACCGC AACCGTTACC CTTTCCGGCA CGGCCACCGC
  351  GCCGGGCGTG GTGGAAATCA CGATTGGCGG CAAGCAGGTA AGCACGGCCG
  401  TTAACACCGG CGAGACCGCC GCCACAGTGG CAGACCGTCT GAAAACCGCC
  451  ATCACTGCCG CCGATGTAAC CGTTACCGCA TCCGGCAGCG GCGCAGCCGT
  501  TACGCTGACG GCCAAACACA AAGGCGAGAT CGGCAACGAG AGCGGCTTAA
  551  CCGTGAGCAC CGGCAATACC GGCCTAACTT ATCAAGCCAA TGCCTTTACC
```

```
 601 GGCGGTGCCA AAAATGCGGA CATTGCCACG GCCTTGTCCA AAGTGGCGGG

651 CAAGCATTAT CACATTATTT GCAGCCCGTT TAGCGATGAC GCCAACGCCA

701 AAGCCTTGAG CAACCATATT ACCAACGTAT CCAACGCCAT CGAGCAGCGC

751 GGCTGTATCG GCGTATTGGG TATGAGTGCG GCCTTGAGCA CGGCCACCAC

801 CGCTACCGGC GAAATCAACG ACGGCCGCAT GACCTGTGCT TGGTACAAAG

851 GTGCGGTAGA GCCAAACGGC ATCATCGCCG CAGGTTATGC GGCGGTGTTG

901 GCCTTTGAAG AAGACCCTGC CAAGCCGCTG AACACGCTGG AAATCAAAGG

951 GCTGGCCGTT ACACCTGATG CGCAATGGCC GCTGTTTGCA GAATGCAACA

1001 ATGCGCTGTA CAACGGCTTG ACCCCGCTCA CAGTGGTCAA CAACCGCGTG

1051 CAGATTATGC GTGCCGTATC CACCTATACC AAGTCGGCCA ACAACACCGA

1101 CGACCCGGCA CTACTCGACA TTACCACCAT CCGCACGCTG GATTATGTGC

1151 GCCGCAGCGT TAAAGAGCGC ATTGCCCTGC GTTTTCCGCG CGACAAATTG

1201 AGCGACCGCC TGCTGCCCAA GGTTAAGAGC GAGATTTTGG ACGTGCTGAT

1251 TAAGCTCGAC CAAGCCGAAA TCATCGAAAA CGCCGAGGCC AACAAAGGCA

1301 AGCTGGTGGT GGCGCGTGCG CAAAACGACC CCAACCGTGT TAATGCCATT

1351 ATCACTGCCG ATGTGGTCAA CGGCCTGCAC GTCTTTGCCG GGCGCATTGA

1401 TTTGATTTTG TAA
```

This corresponds to the amino acid sequence <SEQ ID 2394; ORF 712>:

```
m712.pep
   1 MMPHIDFDTI PGSIRVPGQY IEFNTRNAVQ GLPQNPQKVL MVAPMLTAGI

51 QPALEPVQLF SDAEAADLFG QGSLAHLMVR QAFANNPYLD LTVIGIADHS

101 AGVQATATVT LSGTATAPGV VEITIGGKQV STAVNTGETA ATVADRLKTA

151 ITAADVTVTA SGSGAAVTLT AKHKGEIGNE SGLTVSTGNT GLTYQANAFT

201 GGAKNADIAT ALSKVAGKHY HIICSPFSDD ANAKALSNHI TNVSNAIEQR

251 GCIGVLGMSA ALSTATTATG EINDGRMTCA WYKGAVEPNG IIAAGYAAVL

301 AFEEDPAKPL NTLEIKGLAV TPDAQWPLFA ECNNALYNGL TPLTVVNNRV

351 QIMRAVSTYT KSANNTDDPA LLDITTIRTL DYVRRSVKER IALRFPRDKL

401 SDRLLPKVKS EILDVLIKLD QAEIIENAEA NKGKLVVARA QNDPNRVNAI

451 IPADVVNGLH VFAGRIDLIL *
a712.seq not found yet a712.pep not found yet g713.seq not found yet g713.pep not found yet
```

The following partial DNA sequence was identified in *N. meningitidis* <SEQ ID 2395>:

```
m713.seq
   1 ATGCAAAATA ATTCATACGG CTATGCCGTG TCGGTGCGCG TGGGCGGTAA

51 AGAGCACCGC CACTGGGAGC GCTACGACAT CGACAGCGAC TTTTTAATCC

101 CTGCCGACAG CTTCGATTTT GTCATCGGCA GGTTGGGACC GGAGGCGGCC
```

-continued

```
 151 ATACCCGATT TAAGCGGAGA GAGCTGCGAG GTAGTGATAG ACGGGCAAAT

201 CGTGATGACG GGCATCATCG GCAGCCAGCG CCACGGCAAA AGCAAGGGCA

251 GCCGCGAGTT GAGCTTGAGC GGGCGTGATT TGGCCGGTTT TTTGGTGGAT

301 TGCTCCGCGC CGCAGCTCAA TGTAAAGGGC ATGACGGTAT TGGATGCAGC

351 CAAAAAGCTG GCCGCGCCGT GGCCGCAGAT TAAAGCGGTG GTGCTTAAGG

401 CCGAAAACAA CCCCGCTTTG GGCAAAATCG ACATCGAGCC GGGCGAAACC

451 GTATGGCAGG CATTAACCCA TATTGCCAAC TCGGTCGGGC TGCATCCGTG

501 GCTGGAGCCG GACGGCACGT TGGTGGTGGG CGGTGCGGAT TACAGCAGCC

551 CGCCGGTGGC GACATTGTGT TGGAGCCGCA CCGACAGCCG CTGCAATATC

601 GAGCGCATGG ACATTGAGTG GGATACCGAC AACCGCTTTT CCGAGGTTAC

651 TTTTTTGGCG CAATCGCACG GCCGCAGCGG CGACAGCGCC AAACACGATT

701 TAAAGTGGGT GTACAAAGAC CCGACGATGA CGCTGCACCG CCCTAAAACG

751 GTGGTGGTGT CCGATGCCGA CAATTTGGCC GCATTGCAAA AGCAGGCTAA

801 AAAGCAGCTG GCCGACTGGC GGCTGGAGGG ATTTACACTC ACGATAACCG

851 TGGGCGGCCA TAAAACCCGC GACGGCGTAT TGTGGCAACC TGGCCTGCGT

901 GTGCATGTGA TCGACGACGA GCACGGTATC GATGCGGTGT TTTTTCTGAT

951 GGGGCGGCGG TTTATGCTAT CCCGCATGGA TGGTACGCAA ACCGAGCTGC

1001 GGCTCAAAGA GGACGGTATT TGGACACCCG ACGCTTACCC CAAAAAGGCC

1051 GAGGCGGCGC GCAAGCGCAA AGGCAAACGC AAAGGCGTGA GCCATAAGGG

1101 CAAAAAAGGC GGCAAAAAAC AAGCAGAAAC GGCGGTGTTT GAATGA
```

This corresponds to the amino acid sequence <SEQ ID 2396; ORF 713>:

```
m713.pep
  1 MQNNSYGYAV SVRVGGKEHR HWERYDIDSD FLIPADSFDF VIGRLGPEAA

51 IPDLSGESCE VVIDGQIVMT GIIGSQRHGK SKGSRELSLS GRDLAGFLVD

101 CSAPQLNVKG MTVLDAAKKL AAPWPQIKAV VLKAENNPAL GKIDIEPGET

151 VWQALTHIAN SVGLHPWLEP DGTLVVGGAD YSSPPVATLC WSRTDSRCNI

201 ERMDIEWDTD NRFSEVTFLA QSHGRSGDSA KHDLKWVYKD PTMTLHRPKT

251 VVVSDADNLA ALQKQAKKQL ADWRLEGFTL TITVGGHKTR DGVLWQPGLR

301 VHVIDDEHGI DAVFFLMGRR FMLSRMDGTQ TELRLKEDGI WTPDAYPKKA

351 EAARKRKGKR KGVSHKGKKG GKKQAETAVF E*
```

The following partial DNA sequence was identified in *N. meningitidis* <SEQ ID 2397>:

```
a713.seq
   1 ATGCAAAATA ATTCATACGG CTATGCCGTG TCGGTGCGCG TGGGCGGTAA

51 AGAGCACCGC CACTGGGAGC GCTACGACAT CGACAGCGAC TTTTTAATCC

101 CTGCCGACAG CTTCGATTTT GTCATCGGCA GGTTGGGGCC GGAGGCGGCC

151 ATACCCGATT TAAGCGGAGA GAGCTGCGAG GTAGTGATAG ACGGGCAAAT

201 CGTGATGACG GGCATCATCG GCAGCCAGCG CCACGGCAAA AGCAAGGGCG

251 GCCGCGAGTT GAGCTTGAGC GGGCGTGATT TGGCCGGTTT TTTGGTGGAT
```

-continued

```
 301 TGCTCCGCGC CGCAGCTCAA TGTAAAGGGC ATGACGGTAT TGGATGCAGC

351 CAAAAAGCTG GCCGCGCCGT GGCCGCAGAT TAAAGCGGTG GTGCTTAAGG

401 TCGAAAACAA CCCCGCTTTG GACAAAATCG ACATCGAGCC GGGCGAAACC

451 GTATGGCAGG CATTAACCCA TATTGCCAAC TCGGTCGGGC TGCATCCGTG

501 GCTGGAGCCG GACGGCACGT TGGTGGTGGG CGGTGTGGAT TACAGCAGCC

551 CGCCGGTGGC GACATTGTGT TGGAGCCGCA CCGACAGCCG CCGCAATATC

601 GAGCGCATGG ACATTGAGTG GGATACCGAC AACCGCTTTT CTGAGGTTAC

651 TTTTTTGGCG CAATCGCACG GCCGCAGCGG CGACAGCGCC AAACACGATT

701 TAAAGTGGGT GTACAAAGAC CCGACGATGA CGCTGCACCG CCCTAAAACG

751 GTGGTGGTGT CCGATGCCGA CAATTTGGCC GCATTGCAAA AGCAGGCTAA

801 AAAGCAGCTG GCCGACTGGC GGCTGGAGGG ATTTACACTC ACGATAACCG

851 TGGGCGGCCA TAAAACCCGC GACGGCGTAT TGTGGCAACC TGGCCAGCGT

901 GTGCATGTGA TCGACGACGA GCACGGTATC GATGCGGTGT TTTTTCTGAT

951 GGGGCGGCGG TTTATGCTAT CTCGCATGGA TGGCACGCAA ACCGAGCTGC

1001 GGCTCAAAGA GGACGGTATT TGGACACCCG ACGCTTACCC CAAAAAGGCC

1051 GAGGCGGCGC GCAAGCGCAA AGGCAAACGC AAAGGCGTGA GCCATAAGGG

1101 CAAAAAGGC GGCAAAAAAC AAGCAGAAAC GGCGGTGTTT GAATGA
```

This corresponds to the amino acid sequence <SEQ ID 2398; ORF 713.a>:

```
a713.pep
  1 MQNNSYGYAV SVRVGGKEHR HWERYDIDSD FLIPADSFDF VIGRLGPEAA

51 IPDLSGESCE VVIDGQIVMT GIIGSQRHGK SKGGRELSLS GRDLAGFLVD

101 CSAPQLNVKG MTVLDAAKKL AAPWPQIKAV VLKVENNPAL DKIDIEPGET

151 VWQALTHIAN SVGLHPWLEP DGTLVVGGVD YSSPPVATLC WSRTDSRRNI

201 ERMDIEWDTD NRFSEVTFLA QSHGRSGDSA KHDLKWVYKD PTMTLHRPKT

251 VVVSDADNLA ALQKQAKKQL ADWRLEGFTL TITVGGHKTR DGVLWQPGQR

301 VHVIDDEHGI DAVFFLMGRR FMLSRMDGTQ TELRLKEDGI WTPDAYPKKA

351 EAARKRKGKR KGVSHKGKKG GKKQAETAVF E*
``` a713/m713 98.4% identity in 381 aa overlap

```
                10         20         30         40         50         60
   a731.pep  MQNNSYGYAVSVRVGGKEHRHWERYDIDSDFLIPADSFDFVIGRLGPEAAIPDLSGESCE
             ||||||||||||||||||||||||||||||||||||||||||||||||||||||||||||
   m713      MQNNSYGYAVSVRVGGKEHRHWERYDIDSDFLIPADSFDFVIGRLGPEAAIPDLSGESCE
                10         20         30         40         50         60

70         80         90        100        110        120
   a713.pep  VVIDGQIVMTGIIGSQRHGKSKGGRELSLSGRDLAGFLVDCSAPQLNVKGMTVLDAAKKL
             |||||||||||||||||||||:||||||||||||||||||||||||||||||||:|||||
   m713      VVIDGQIVMTGIIGSQRHGKSKGSRELSLSGRDLAGFLVDCSAPQLNVKGMTVLKAAKKL
                70         80         90        100        110        120

130        140        150        160        170        180
   a713.pep  AAPWPQIKAVVLKVENNPALDKIDIEPGETVWQALTHIANSVGLHPWLEPDGTLVVGGVD
             ||||||||||||:|||||||||||||||||||||||||||||||||||||||||||||:|
   m713      AAPWPQIKAVVLKAENNPALGKIDIEPGETVWQALTHIANSVGLHPWLEPDGTLVVGGAD
               130        140        150        160        170        180

190        200        210        220        230        240
   a713.pep  YSSPPVATLCWSRTDSRRNIERMDIEWDTDNRFSEVTFLAQSHGRSGDSAKHDLKWVYKD
             |||||||||||||||||| |||||||||||||||||||||||||||||||||||||||||
   m713      YSSPPVATLCWSRTDSRCNIERMDIEWDTDNRFSEVTFLAQSHGRSGDSAKHDLKWVYKD
               190        200        210        220        230        240
```

```
                250       260       270       280       290       300
a713.pep PTMTLHRPKTVVVSDADNLAALQKAKKQLADWRLEGFTLTITVGGHKTRDGVLWQPGQR
         |||||||||||||||||||||||||||||||||||||||||||||||||||||||||| |
m713     PTMTLHRPKTVVVSDADNLAALQKAKKQLADWRLEGFTLTITVGGHKTRDGVLWQPGLR
                250       260       270       280       290       300

310       320       330       340       350       360
a713.pep VHVIDDEHGIDAVFFLMGRRFMLSRMDGTQTELRLKEDGIWTPDAYPKKAEAARKRKGKR
         ||||||||||||||||||||||||||||||||||||||||||||||||||||||||||||
m713     VHVIDDEHGIDAVFFLMGRRFMLSRMDGTQTELRLKEDGIWTPDAYPKKAEAARKRKGKR
                310       320       330       340       350       360

370       380
a713.pep KGVSHKGKKGGKKQAETAVFEX
         ||||||||||||||||||||||
m713     KGVSHKGKKGGKKQAETAVFEX
                370       380 g714.seq not found yet g714.pep not found yet
```

The following partial DNA sequence was identified in *N. meningitidis* <SEQ ID 2399>:

```
m714.seq
   1 ATGAGCTATC AAGACATCTT GCGGGGCCTG TTGCCCCCCG TGTCGTATGC

51 CCGCAATGCC CCGCGTGTGC GGGCGCAGGC AGAAATAGAC GGCGCAGCGC

101 TGGATGCGGT GGCGGAATCG GCTCAAAGCG TTGCCGATGC CGTCGACCCG

151 CGCAGCGCCG GCCAAATGCT GGCCGATTGG GAGCGCGTAT TAGGTTTGGA

201 CGGTACGGGC AAAAACCGCC AGCACCGTGT GTTGGCCGTC ATGGCCAAGC

251 TAAACGAAAC AGGCGGCTTG AGTATTCCTT ATTTTGTGCG TTTGGCCGAG

301 GCGGCGGGCT ATCAAATCCA AATCGACGAA CCGCAGCCGT TCCGCGCCGG

351 TGTAAACCGC GCCGGCGACC GTCTTGCGCC GCAGGAAATC ATGTGGGTGT

401 GGCACGTTAA CGTGCGCGGC GGCAACAACC GCATTACCCG ATTCCGCGCC

451 GGTATCTCGG CGGCGGGCGA CAGGCTGACC GATTACAGCG ATGCCGTGAT

501 CGAGAGCCTG TTCAACCGCC TCAAGCCCGC CCACACCGCT ATCCGATTTA

551 CCTACCGCTA A
```

This corresponds to the amino acid sequence <SEQ ID 2400; ORF 714>:

```
m714.pep
   1 MSYQDILRGL LPPVSYARNA PRVRAQAEID GAALDAVAES AQSVADAVDP

51 RSAGQMLADW ERVLGLDGTG KNRQHRVLAV MAKLNETGGL SIPYFVRLAE

101 AAGYQIQIDE PQPFRAGVNR AGDRLAPQEI MWVWHVNVRG GNNRITRFRA

151 GISAAGDRLT DYSDAVIESL FNRLKPAHTA IRFTYR*
```

The following partial DNA sequence was identified in *N. meningitidis* <SEQ ID 2401>:

```
a714.seq
   1 ATGAGCTATC AAGACATCTT GCGGGGTCTG TTGCCCCCCG TGTCGTATGC

51 CCGCAATGCC CCGCGTGTGC GGGCGCAGGC AGAAATAGAC GGCGCAGCGC

101 TGGATGCGGT GGCGGAATCG GCTCAAAGCG TTGCCGATGC CGTCGACCCG

151 AGCAGCGCCG GCCAAATGCT GGCCGATTGG GAGCGCGTAT TAGGTTTGGA

201 CGGTACGGGC AAAAACCGCC AGCGCCGTGT GTTGGCCGTC ATGGCCAAGC
```

-continued

```
251 TAAACGAAAC AGGCGGCTTG AGTATTCCTT ATTTTGTGCG TTTGGCCGAG

301 GCGGCGGGCT ATCAAATCCA AATCGACGAA CCGCAGCCGT TCCGCGCCGG

351 TGTAAACCGC GCCGGCGACC GTCTTGCGCC GCAGGAAATC ATGTGGGTGT

401 GGCACGTTAA CGTGCGCGGC GGCAACAACC GCATTACCCG ATTCCGCGCC

451 GGTATCTCGG CGGCGGGCGA CAGGCTGACC GATTACAGCG ATGCCGTGAT

501 CGAGAGCCTG TTCAACCGCC TCAAGCCCGC CCACACCGCT ATCCGATTTA

551 CCTACCGATA A
```

This corresponds to the amino acid sequence <SEQ ID 2402; ORF 714.a>:

```
a714.pep
  1 MSYQDILRGL LPPVSYARNA PRVRAQAEID GAALDAVAES AQSVADAVDP

51 SSAGQMLADW ERVLGLDGTG KNRQRRVLAV MAKLNETGGL SIPYFVRLAE

101 AAGYQIQIDE PQPFRAGVNR AGDRLAPQEI MWVWHVNVRG GNNRITRFRA

151 GISAAGDRLT DYSDAVIESL FNRLKPAHTA IRFTYR*
``` a714/m714 98.9% identity in 186 aa overlap

```
                  10        20        30        40        50        60
     a714.pep   MSYQDILRGLLPPVSYARNAPRVRAQAEIDGAALDAVAESAQSVADAVDPSSAGQMLADW
                ||||||||||||||||||||||||||||||||||||||||||||||||| ||||||||||
     m714       MSYQDILRGLLPPVSYARNAPRVRAQAEIDGAALDAVAESAQSVADAVDPRSAGQMLADW
                  10        20        30        40        50        60
                  70        80        90       100       110       120
     a714.pep   ERVLGLDGTGKNRQRRVLAVMAKLNETGGLSIPYFVRLAEAAGYQIQIDEPQPFRAGVNR
                ||||||||||||||:|||||||||||||||||||||||||||||||||||||||||||||
     m714       ERVLGLDGTGKNRQHRVLAVMAKLNETGGLSIPYFVRLAEAAGYQIQIDEPQPFRAGVNR
                  70        80        90       100       110       120
                 130       140       150       160       170       180
     a714.pep   AGDRLAPQEIMWVWHVNVRGGNNRITRFRAGISAAGDRLTDYSDAVIESLFNRLKPAHTA
                ||||||||||||||||||||||||||||||||||||||||||||||||||||||||||||
     m714       AGDRLAPQEIMWVWHVNVRGGNNRITRFRAGISAAGDRLTDYSDAVIESLFNRLKPAHTA
                 130       140       150       160       170       180
     a714.pep   IRFTYRX
                |||||||
     m714       IRFTYRX
     g715.seq   not found yet
     g715.pep   not found yet
```

The following partial DNA sequence was identified in *N. meningitidis* <SEQ ID 2403>:

```
m715.seq
  1 ATGATTGATG TCAAAATAGA CAATATCTTT GTCGTCCTAA ACCAAATCGA

51 GCGGCTTGGC AACGGGATCG AAAACCGCTA CCTGCTGATG CGCCGACTGT

101 CCGAAACCAT GCACACGGCG GTCAAGCTCA ATTTCCGCTA CGCAGGCCGT

151 CCGAAATGGG TTGGGCTAAA ATACCGCGAC GGCAAGCCGC TTTCGGATTC

201 GGGTCGTCTG AAAGACAGTT TTTCCACACT GTCAGACAAC GATACAGCCC

251 TTGTCGGTAC GAATATCGTC TATGCCGCCA TCCACAACTT CGGCGGTATG

301 GCGGGGCGCA ACCGCAAAGT TCGGATTCCG CAACGGGAAT TTTTGACGCT

351 GACGGACGAC GACAAACAGG CTTTGATGGA CGATGTGCAG GATTATTTTT

401 CGGGTCTGAT ACCGTGA
```

This corresponds to the amino acid sequence <SEQ ID 2404; ORF 715>:

```
m715.pep
    1 MIDVKIDNIF VVLNQIERLG NGIENRYLLM RRLSETMHTA VKLNFRYAGR

51 PKWVGLKYRD GKPLSDSGRL KDSFSTLSDN DTALVGTNIV YAAIHNFGGM

101 AGRNRKVRIP QREFLTLTDD DKQALMDDVQ DYFSGLIP*
```
:

The following partial DNA sequence was identified in *N. meningitidis* <SEQ ID 2405>:

```
a715.seq
    1 ATGATTGATG TCAAAATAGA CAATATCTTT GTCGTCCTAA ACCAAATCGA

51 GCGGCTTGGC AACGGGATCG AAAACCGCTA CCTGCTGATG CGCCGACTGT

101 CCGAAACCAT GCACACGGCG GTCAAGCTCA ATTTCCGCTA CGCAGGCCGT

151 CCGAAATGGT TGGGGCTAAA ATACCGCGAC GGCAAGCCGC TTTCGGATTC

201 GGGTCGTCTG AAAGACAGTT TTTCCACACT GTCAGACAAC GATACAGCCC

251 TTGTCGGTAC GAATATCGTC TATGCCGCCA TCCACAACTT CGGCGGTATG

301 GCGGGGCGCA ACCGCAAAGT TCGGATTCCG CAACGGGAAT TTTTGACGCT

351 GACGGACGAC GACAAACAGG CTTTGATGGA CGATGTGCAG GATTATTTTT

451 CGGGTCTGAT ACCGTGA
```

This corresponds to the amino acid sequence <SEQ ID 2406; ORF 715.a>

```
a715.pep
    1 MIDVKIDNIF VVLNQIERLG NGIENRYLLM RRLSETMHTA VKLNFRYAGR

51 PKWLGLKYRD GKPLSDSGRL KDSFSTLSDN DTALVGTNIV YAAIHNFGGM

101 AGRNRKVRIP QREFLTLTDD DKQALMDDVQ DYFSGLIP*
```

The following partial DNA sequence was identified in *N. gonorrhoeae* <SEQ ID 2407>:

```
g716.seq
    1 ATGAACAAAA ATATTGCTGC CGCACTCGCC GGTGCTTTAT CCCTGTCTCT

51 GGCCGCCGGC GCCGTTGCCG CCCACAAACC GGCAAGCAAC GCAACAGGCG

101 TTCAAAAATC CGCCCAAGGC TCTTGCGGCA CATCCAAATC TGCCGAAGGT

151 TCGTGCGGCG CATCCAAATC TGCCGAAGGT TCGTGCGGCG CGGCTGCTTC

201 TAAAGCAGGC GAAGGCAAAT GCGGCGAGGG CAAATGCGGT GCAACTGTAA

251 AAAAAGCCCA CAAACACACC AAAGCATCTA AGCCAAAGC CAAATCTGCC

301 GAAGGCAAAT GCGGCGAAGG CAAATGCGGT TCTAAATAA
```

This corresponds to the amino acid sequence <SEQ ID 2408; ORF 716.ng>:

```
g716.pep
    1 MNKNIAAALA GALSLSLAAG AVAAHKPASN ATGVQKSAQG SCGASKSAEG

51 SCGASKSAEG SCGAAASKAG EGKCGEGKCG ATVKKAHKHT KASKAKAKSA

101 EGKCGEGKCG SK*
```

The following partial DNA sequence was identified in *N. meningitidis* <SEQ ID 2409>:

```
m716.seq
    1 ATGAACAAAA ACATTGCTGC CGCTCTCGCC GGTGCTTTAT CCCTGTCTTT

51 GGCCGCCGGT GCAGTTGCTG CCAACAAACC GGCAAGCAAC GCAACAGGCG

101 TTCATAAATC CGCCCATGGC TCTTGCGGCG CGTCCAAATC TGCCGAAGGT

151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

This corresponds to the amino acid sequence <SEQ ID 2410; ORF 716>:

```
    m716.pep
         1    MNKNIAAALA GALSLSLAAG AVAANKPASN ATGVHKSAHG SCGASKSAEG

51    SCGAAGSKAG EGKCGEGKCG ATVKKTHKHT KASKAKAKSA EGKCGEGKCG

101    SK* m716/g716  86.6% identity in 112 aa overlap
                       10         20         30         40         50
    m716.pep   MNKNIAAALAGALSLSLAAGAVAANKPASNATGVHKSAHGSCGASKSAEGSCGA------
               |||||||||||||||||||||||||||||:||||||||:|||:|||||||||||
    g716       MNKNIAAALAGALSLSLAAGAVAAHKPASNATGVQKSAQGSCGASKSAEGSCGASKSAEG
                       10         20         30         40         50         60
                       60         70         80         90        100
    m716.pep   ----AGSKAGEGKCGEGKCGATVKKTHKHTKASKAKAKSAEGKCGEGKCGSKX
                   |:|||||||||||||||||||:||||||||||||||||||||||||||||
    g716       SCGAAASKAGEGKCGEGKCGATVKKAHKHTKASKAKAKSAEGKCGECKCGSKX
                       70         80         90        100        110
```

The following partial DNA sequence was identified in *N. meningitidis* <SEQ ID 2411>:

```
a716.seq
    1 ATGAACAAAA ACATTGCTGC CGCACTCGCC GGTGCTTTAT CCCTGTCTTT

51 GGCCGCCGGT GCAGTTGCTG CCAACAAACC GGCAAGCAAC GCAACAGGCG

101 TTCATAAATC CGCCCATGGC TCTTGCGGCG CGTCCAAATC TGCCGAAGGT

151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

The following partial DNA sequence was identified in *N. meningitidis* <SEQ ID 2412.a>:

```
a716.pep
    1 MNKNIAAALA GALSLSLAAG AVAANKPASN ATGVHKSAHG SCGASKSAEG

51 SCGAAGSKAG EGKCGEGKCG ATVKKTHKHT KASKAKAKSA EGKCGEGKCG

101 SK*
``` a716/m716 100.0% identity in 102 aa overlap

```
                 10         20         30         40         50         60
   a716.pep   MNKNIAAALAGALSLSLAAGAVAANKPASNATGVHKSAHGSCGASKSAEGSCGAAGSKAG
              ||||||||||||||||||||||||||||||||||||||||||||||||||||||||||||
   m716       MNKNIAAALAGALSLSLAAGAVAANKPASNATGVHKSAHGSCGASKSAEGSCGAAGSKAG
                 10         20         30         40         50         60

70         80         90        100
   a716.pep   EGKCGEGKCGATVKKTHKHTKASKAKAKSAEGKCGEGKCGSKX
              ||||||||||||||||||||||||||||||||||||||||||
   m716       EGKCGEGKCGATVKKTHKHTKASKAKAKSAEGKCGEGKCGSKX
                 70         80         90        100
```

The following partial DNA sequence was identified in *N. gonorrhoeae* <SEQ ID 2413>:

```
g717.seq
    1 ATGGACACAA AAGAAATCCT CGGCTACGCG GCAGGCTCGA TCGGCAGCGC

51 GGTTTTAGCC GTCATCATCC TGCCGCTGCT GTCGTGGTAT TTCcccgCCG

101 ACGACATCGG GCGCATCGTG CTGATGCAGA CGGCGGCGGG ACTGACGGTG

151 TCGGTATTGT GCCTCGGGCT GGATCAGGCA TACGTCCGCG AATACTATGC

201 CGCCGCCGAC AAAGACACTT TGTTCAAAAC CCTGTTCCTG CCGCCGCTGC

251 TGTTTTCCGC CGCGATAGCC GCCCTGCTGC TTTCCCGCCC GTCCCTGCCG

301 TCTGAAATCC TGTTTTCGCT CGACGATGCC GCCGCCGGCA TCGGGCTGGT

351 GCTGTTTGAA CTGAGCTTCC TGCCCATCCG CTTTCTCTTA CTGGTTTTGC

401 GTATGGAAGG GCGCGCCCTT GCCTTTTCGT CCGCGCAACT CGTGCCCAAA

451 CTCGCCATTC TGCTGCTGTT GCCGCTGACG GTCGGGCTGC TGCACTTTCC

501 GGCGAACACC TCCGTCCTGA CCGCCGTTTA CGCGCTGGCA AACCTTGCCG

551 CCGCCGCCTT TTTGCTGTTT CAAAACCGAT GCCGTCTGAA GGCCGTCCGG

601 CGCGCGCCGT TTTCGCCCGC CGTCCTGCAC CGGGGGCTGC GCTACGGCAT

651 ACCGCTCGCA CTGAGCAGCC TTGCCTATTG GGGGCTGGCA TCCGCCGACC

701 GTTTGTTCCT GAAAAAATAT GCGGGCCTGG AACAGCTCGG CGTTTATTCG

751 ATGGGTATTT CGTTCGGCGG GGCGGCATTA TTGCTCCAAA GCATCTTTTC

801 AACGGTCTGG ACACCGTATA TTTTCCGTGC AATCGAAGAA AACGCCACGC

851 CCGCCCGCCT CTCGGCAACG GCAGAATCCG CCGCCGCCCT GCTTGCCTCC

901 GCCCTCTGCC TGACCGGAAT TTTCTCGCCC CTCGCCTCCC TCCTGCTGCC

951 GGAAAACTAC GCCGCCGTCC GGTTTACCGT CGTATCGTGT ATGCTGccgc 1001 cgctGTTTTA CACGCTGACC GAAATCAGCG GCATCGGTTT GAACGTCGTC

1051 CGCAAAACGC GTCCGATCGC GCTTGCCACC TTGGGCGCGC TGGCGGCAAA

1101 CCTGCTGCTG CTGGGGCTTG CCGTACCGTC CGGCGGCACG CGCGGCGCGG

1151 CGGTTGCCTG TGCCGCCTCA TTCTGGTTGT TTTTTGTTTT CAAGACAGAA

1201 AGCTCCTGCC GCCTGTGGCA GCCGCTCAAA CGCCTGCCGC TTTATATGCA

1251 CACATTGTTC TGCCTgGCCT CCTCGGCGGC CTACACCTGC TTCGGCACAC

1301 CGGCAAACTA CCCcctgttt gccggcgtAT GGGCGGCATA TCTGGCAGGC

1351 TGCATCCTGC GCCACCGGAA AAATTTGCAC AAACTGTTTC ATTATTTGAA

1401 AAAACAAGGT TTCCCATTAT GA
```

This corresponds to the amino acid sequence <SEQ ID 2414; ORF 717.ng>:

```
g717.pep
   1 MDTKEILGYA AGSIGSAVLA VIILPLLSWY FPADDIGRIV LMQTAAGLTV

51 SVLCLGLDQA YVREYYAAAD KDTLFKTLFL PPLLFSAAIA ALLLSRPSLP

101 SEILFSLDDA AAGIGLVLFE LSFLPIRFLL LVLRMEGRAL AFSSAQLVPK

151 LAILLLLPLT VGLLHFPANT SVLTAVYALA NLAAAAFLLF QNRCRLKAVR

201 RAPFSPAVLH RGLRYGIPLA LSSLAYWGLA SADRLFLKKY AGLEQLGVYS

251 MGISFGGAAL LLQSIFSTVW TPYIFRAIEE NATPARLSAT AESAAALLAS

301 ALCLTGIFSP LASLLLPENY AAVRFTVVSC MLPPLFYTLT EISGIGLNVV

351 RKTRPIALAT LGALAANLLL LGLAVPSGGT RGAAVACAAS FWLFFVFKTE

401 SSCRLWQPLK RLPLYMHTLF CLASSAAYTC FGTPANYPLF AGVWAAYLAG

451 CILRHRKNLH KLFHYLKKQG FPL*
```

The following partial DNA sequence was identified in *N. meningitidis* <SEQ ID 2415>:

```
m717.seq
    1 ATGGACACAA AAGAAATCCT CGGCTACGCG GCAGGCTCGA TCGGCAGCGC

51 GGTTTTAGCC GTCATCATCC TGCCGCTGCT GTCGTGGTAT TTCCCCGCCG

101 ACGACATCGG GCGCATCGTG CTGATGCAGA CGGCGGCGGG GCTGACGGTG

151 TCGGTGTTGT GCCTCGGGCT GGATCAGGCA TACGTCCGCG AATACTATGC

201 CACCGCCGAC AAAGACACCT TGTTCAAAAC CCTGTTCCTG CCGCCGCTGC

251 TGTCTGCCGC CGCGATAGCC GCCCTGCTGC TTTCCCGCCC GTCCCTGCCG

301 TCTGAAATCC TGTTTTCACT CGACGATGCC GCCGCCGGCA TCGGGCTGGT

351 GCTGTTTGAA CTGAGCTTCC TGCCCATCCG CTTTCTCTTA CTGGTTTTGC

401 GTATGGAAGG ACGCGCCCTT GCCTTTTCGT CCGCGCAACT CGTGCCCAAG

451 CTCGCCATCC TGCTGCTGCT GCCGCTGACG GTCGGGCTGC TGCACTTTCC

501 AGCGAACACC GCCGTCCTGA CCGCCGTTTA CGCGCTGGCA AACCTTGCCG

551 CCGCCGCCTT TTTGCTGTTT CAAAACCGAT GCCGTCTGAA GGCCGTCCGG

601 CACGCACCGT TTTCGCCCGC CGTCCTGCAC CGGGGGCTGC GCTACGGCAT

651 ACCGATCGCA CTGAGCAGCA TCGCCTATTG GGGGCTGGCA TCCGCCGACC

701 GTTTGTTCCT GAAAAAATAT GCCGGCCTGG AACAGCTCGG CGTTTATTCG

751 ATGGGTATTT CGTTCGGCGG GGCGGCATTA TTGTTCCAAA GCATCTTTTC

801 AACGGTCTGG ACACCGTATA TTTTCCGCGC AATCGAAGAA AACGCCCCGC

851 CCGCCCGCCT CTCGGCAACG GCAGAATCCG CCGCCGCCCT GCTTGCCTCC

901 GCCCTCTGCC TGACCGGCAT TTTCTCGCCC CTTGCCTCCC TCCTGCTGCC

951 GGAAAACTAC GCCGCCGTCC GGTTTATCGT CGTATCGTGT ATGCTGCCGC

1001 CGCTGTTTTG CACGCTGGCG GAAATCAGCG GCATCGGTTT GAACGTCGTC

1051 CGCAAAACGC GCCCGATCGC GCTCGCCACC TTGGGCGCGC TGGCGGCAAA

1101 CCTGCTGCTG CTGGGGCTTG CCGTGCCGTC CGGCGGCGCG CGCGGCGCGG

1151 CGGTTGCCTG TGCCGCCTCA TTCTGGCTGT TTTTTGCCTT CAAGACCGAA

1201 AGCTCCTGCC GCCTGTGGCA GCCGCTCAAA CGCCTGCCGC TTTATCTGCA
```

```
1251 CACATTGTTC TGCCTGACCT CCTCGGCGGC CTACACCTGC TTCGGCACGC

1301 CGGCAAACTA TCCCCTGTTT GCCGGCGTAT GGGCGGCATA TCTGGCAGGC

1351 TGCATCCTGC GCCACCGGAA AGATTTGCAC AAACTGTTTC ATTATTTGAA

1401 AAAACAAGGT TTCCCATTAT GA
```

This corresponds to the amino acid sequence <SEQ ID 2416; ORF 717>:

```
m717.pep

1   MDRKEILGYA AGSIGSAVLA VIILPLLSWY FPADDIGRIV LMQTAAGLTV

51   SVLCLGLDQA YVREYYATAD KDTLFKTLFL PPLLSAAAIA ALLLSRPSLP

101   SEILFSLDDA AAGIGLVLFE LSFLPORFLL LVLRMEGRAL AFSSAQLVPK

151   LAILLLLPLT VGLLHFPANT AVLTAVYALA NLAAAAFLLF QNRCRLKAVR

201   HAPFSPAVLH RGLRYGIPIA LSSIAYWGLA SADRLFLKKY AGLEQLGVYS

251   MGISFGGAAL LFQSIFSTVW TPYIFRAIEE NAPPARLSAT AESAAALLAS

301   ALCLTGIFSP LASLLLPENY AAVRFIVVSC MLPPLFCTLA EISGIGLNVV

351   RKTRPIALAT LGALAANLLL LGLAVPSGGA RGAAVACAAS FWLFFAFKTE

401   SSCRLWQPLK RLPLYLHTLE CLTSSAAYTC FGTPANYPLF AGVWAAYLAG

451   CILRHRKDLH KLFHYLKKQG FPL* m717/g717   96.4% identity in 473 aa overlap 10         20         30         40         50         60
m717.pep   MDTKEILGYAAGSIGSAVLAVIILPLLSWYFPADDIGRIVLMQTAAGLTVSVLCLGLDQA
           ||||||||||||||||||||||||||||||||||||||||||||||||||  ||||||||
g717       MDTKEILGYAAGSIGSAVLAVIILPLLSWYFPADDIGRIVLMQTAAGLTVSVLCLGLDQA
                   10         20         30         40         50         60

70         80         90        100        110        120
m717.pep   YVREYYATADKDTLFKTLFLPPLLSAAAIAALLLSRPSLPSEILFSLDDAAAGIGLVLFE
           ||||||| ||||||||||||||||| ||||||||||||||||||||||||||||||||||
g717       YVREYYAAADKDTLFKTLFLPPLLFSAAIAALLLSRPSLPSEILFSLDDAAAGIGLVLFE
                   70         80         90        100        110        120

130        140        150        160        170        180
m717.pep   LSFLPIRFLLLVLRMEGRALAFSSAQLVPKLAILLLLPLTVGLLHFPANTAVLTAVYALA
           ||||||||||||||||||||||||||||||||||||||||||||||||||| ||||||||
g717       LSFLPIRFLLLVLRMEGRALAFSSAQLVPKLAILLLLPLTVGLLHFPANTSVLTAVYALA
                  130        140        150        160        170        180

190        200        210        220        230        240
m717.pep   NLAAAAFLLFQNRCRLKAVRHAPFSPAVLHRGLRYGIPIALSSIAYWGLASADRLFLKKY
           ||||||||||||||||||| ||||||||||||||||||||||| ||||||||||||||||
g717       NLAAAAFLLFQNRCRLKAVRRAPFSPAVLHRGLRYGIPIALSSLAYWGLASADRLFLKKY
                  190        200        210        220        230        240

250        260        270        280        290        300
m717.pep   AGLEQLGVYSMGISFGGAALLFQSIFSTVWTPYIFRAIEENAPPARLSATAESAAALLAS
           |||||||||||||||||||| |||||||||||||||||||| ||||||||||||||||||
g717       AGLEQLGVYSMGISFGGAALLLQSIFSTVWTPYIFRAIEENATPARLSATAESAAALLAS
                  250        260        270        280        290        300

310        320        330        340        350        360
m717.pep   ALCLTGIFSPLASLLLPENYAAVRFIVVSCMLPPLFCTLAEISGIGLNVVRKTRPIALAT
           |||||||||||||||||||||||| |||||||||||| || |||||||||||||||||||
g717       ALCLTGIFSPLASLLLPENYAAVRFTVVSCMLPPLFYTLTEISGIGLNVVRKTRPIALAT
                  310        320        330        340        350        360

370        380        390        400        410        420
m717.pep   LGALAANLLLLGLAVPSGGARGAAVACAASFWLFFAFKTESSCRLWQPLKRLPLYLHTLF
           |||||||||||||||||||| |||||||||||||| |||||||||||||||||| ||||
g717       LGALAANLLLLGLAVPSGGTRGAAVACAASFWLFFVFKTESSCRLWQPLKRLPLYMHTLF
                  370        380        390        400        410        420

430        440        450        460        470
m717.pep   CLTSSAAYTCFGTPANYPLFAGVWAAYLAGCILRHRKDLHKLFHYLKKQGFPLX
           || ||||||||||||||||||||||||||||||||||| |||||||||||||||
g717       CLASSAAYTCFGTPANYPLFAGVWAAYLAGCILRHRKNLHKLFHYLKKQGFPLX
                  430        440        450        460        470
```

The following partial DNA sequence was identified in *N. meningitidis* <SEQ ID 2417>:

```
a717.seq
   1  ATGGACACAA AAGAAATCCT CGGCTACGCG GCAGGCTCGA TCGGCAGCGC

51  GGTTTTAGCC GTCATCATCC TGCCGCTGCT GTCGTGGTAT TTCCCTGCCG

101  ACGACATCGG ACGCATCGTG CTGATGCAGA CGGCGGCGGG GCTGACGGTG

151  TCGGTGTTGT GCCTCGGGCT GGATCAGGCA TACGTCCGCG AATACTATGC

201  CGCCGCCGAC AAAGACACTT TGTTCAAAAC CCTGTTCCTG CCGCCGCTGC

251  TGTCTGCCGC CGCGATAGCC GCCCTGCTGC TTTTCCGCGC ATCCCTGCCG

301  TCTGAAATCC TGTTTTCGCT CGACGATGCC GCCGCCGGCA TCGGGCTGGT

351  GCTGTTTGAA CTGAGCTTCC TGCCCATCCG CTTTCTCTTA CTGGTTTTGC

401  GTATGGAAGG ACGCGCCCTT GCCTTTTCGT CCGCGCAACT CGTGTCCAAG

451  CTCGCCATCC TGCTGCTGCT GCCGCTGACG GTCGGGCTGC TGCACTTTCC

501  GGCGAACACC GCCGTCCTGA CCGCCGTTTA CGCGCTGGCA AACCTTGCCG

551  CCGCCGCCTT TTTGCTGTTT CAAAACCGAT GCCGTCTGAA GGCCGTCCGG

601  CGCGCACCGT TTTCATCCGC CGTCCTGCAT CGCGGCCTGC GCTACGGCAT

651  ACCGATCGCA CTAAGCAGCA TCGCCTATTG GGGGCTGGCA TCCGCCGACC

701  GTTTGTTCCT GAAAAAATAT GCCGGCCTAG AACAGCTCGG CGTTTATTCG

751  ATGGGTATTT CGTTCGGCGG AGCGGCATTA TTGTTCCAAA GCATCTTTTC

801  AACGGTCTGG ACACCGTATA TTTTCCGCGC AATCGAAGCA AACGCCCCGC

851  CCGCCCGCCT CTCGGCAACG GCAGAATCCG CCGCCGCCTT GCTTGCCTCC

901  GCCCTCTGCC TGACCGGCAT TTTCTCGCCC CTCGCCTCCC TCCTGCTGCC

951  GGAAAACTAC GCCGCCGTCC GGTTTATCGT CGTATCGTGT ATGCTGCCTC

1001  CGCTGTTTTG CACGCTGGTA GAAATCAGCG GCATCGGTTT GAACGTCGTC

1051  CGAAAAACAC GCCCGATCGC GCTCGCCACC TTGGGCGCGC TGGCGGCAAA

1101  CCTGCTGCTG CTGGGGCTTG CCGTACCGTC CGGCGGCGCG CGCGGCGCGG

1151  CGGTTGCCTG TGCCGCCTCA TTTTGGCTGT TTTTTGTTTT CAAGACCGAA

1201  AGCTCCTGCC GCCTGTGGCA GCCGCTCAAA CGCCTGCCGC TTTATATGCA

1251  CACATTGTTC TGCCTGGCCT CCTCGGCGGC CTACACCTGC TTCGGCACTC

1301  CGGCAAACTA CCCCCTGTTT GCCGGCGTAT GGGCGGTATA TCTGGCAGGC

1351  TGCATCCTGC GCCACCGGAA AGATTTGCAC AAACTGTTTC ATTATTTGAA

1401  AAAACAAGGT TTCCCATTAT GA
```

This corresponds to the amino acid sequence <SEQ ID 2418; ORF 717.a>:

```
a717.pep
   1  MDTKEILGYA AGSIGSAVLA VIILPLLSWY FPADDIGRIV LMQTAAGLTV

51  SVLCLGLDQA YVREYYAAAD KDTLFKTLFL PPLLSAAAIA ALLLSRPSLP

101  SEILFSLDDA AAGIGLVLFE LSFLPIRFLL LVLRMEGRAL AFSSAQLVSK

151  LAILLLLPLT VGLLHFPANT AVLTAVYALA NLAAAAFLLF QNRCRLKAVR

201  RAPFSSAVLH RGLRYGIPIA LSSIAYWGLA SADRLFLKKY AGLEQLGVYS

251  MGISFGGAAL LFQSIFSTVW TPYIFRAIEA NAPPARLSAT AESAAALLAS
```

-continued
```
301 ALCLTGIFSP LASLLLPENY AAVRFIVVSC MLPPLFCTLV EISGIGLNVV

351 RKTRPIALAT LGALAANLLL LGLAVPSGGA RGAAVACAAS FWLFFVFKTE

401 SSCRLWQPLK RLPLYMHTLF CLASSAAYTC FGTPANYPLF AGVWAVYLAG

451 CILRHRKDLH KLFHYLKKQG FPL*
``` a717/m717 97.9% identity in 473 aa overlap

```
                   10         20         30         40         50         60
    a717.pep  MDTKEILGYAAGSIGSAVLAVIILPLLSWYFPADDIGRIVLMQTAAGLTVSVLCLGLDQA
              ||||||||||||||||||||||||||||||||||||||||||||||||||||||||||||
       m717  MDTKEILGYAAGSIGSAVLAVIILPLLSWYFPADDIGRIVLMQTAAGLTVSVLCLGLDQA
                   10         20         30         40         50         60

70         80         90        100        110        120
    a717.pep  YVREYYAAADKDTLFKTLFLPPLLSAAAIAALLLSRPSLPSEILFSLDDAAAGIGLVLFE
              |||||||:||||||||||||||||||||||||||||||||||||||||||||||||||||
       m717  YVREYYATADKDTLFKTLFLPPLLSAAAIAALLLSRPSLPSEILFSLDDAAAGIGLVLFE
                   70         80         90        100        110        120

130        140        150        160        170        180
    a717.pep  LSFLPIRFLLLVLRMEGRALAFSSAQLVSKLAILLLLPLTVGLLHFPANTAVLTAVYALA
              ||||||||||||||||||||||||||||||| ||||||||||||||||||||||||||||
       m717  LSFLPIRFLLLVLRMEGRALAFSSAQLVPKLAILLLLPLTVGLLHFPANTAVLTAVYALA
                  130        140        150        160        170        180

190        200        210        220        230        240
    a717.pep  NLAAAAFLLFQNRCRLKAVRRAPFSSAVLHRGLRYGIPIALSSIAYWGLASADRLFLKKY
              |||||||||||||||||||||:||| ||||||||||||||||||||||||||||||||||
       m717  NLAAAAFLLFQNRCRLKAVRHAPFSPAVLHRGLRYGIPIALSSIAYWGLASADRLFLKKY
                  190        200        210        220        230        240

250        260        270        280        290        300
    a717.pep  AGLEQLGVYSMGISFGGAALLFQSIFSTVWTPYIFRAIEANAPPARLSATAESAAALLAS
              |||||||||||||||||||||||||||||||||||||||| |||||||||||||||||||
       m717  AGLEQLGVYSMGISFGGAALLFQSIFSTVWTPYIFRAIEENAPPARLSATAESAAALLAS
                  250        260        270        280        290        300

310        320        330        340        350        360
    a717.pep  ALCLTGIFSPLASLLLPENYAAVRFIVVSCMLPPLFCTLVEISGIGLNVVRKTRPIALAT
              |||||||||||||||||||||||||||||||||||||||:||||||||||||||||||||
       m717  ALCLTGIFSPLASLLLPENYAAVRFIVVSCMLPPLFCTLAEISGIGLNVVRKTRPIALAT
                  310        320        330        340        350        360

370        380        390        400        410        420
    a717.pep  LGALAANLLLLGLAVPSGGARGAAVACAASFWLFFVFKTESSCRLWQPLKRLPLYMHTLF
              |||||||||||||||||||||||||||||||||||:||||||||||||||||||||:|||
       m717  LGALAANLLLLGLAVPSGGARGAAVACAASFWLFFAFKTESSCRLWQPLKRLPLYLHTLF
                  370        380        390        400        410        420

430        440        450        460        470
    a717.pep  CLASSAAYTCFGTPANYPLFAGVWAVYLAGCILRHRKDLHKLFHYLKKQGFPLX
              ||:||||||||||||||||||||||:|||||||||||||||||||||||||||
       m717  CLTSSAAYTCFGTPANYPLFAGVWAAYLAGCILRHRKDLHKLFHYLKKQGFPLX
                  430        440        450        460        470 g718.seq not found yet g718.sep not found yet
```

The following partial DNA sequence was identified in *N. meningitidis* <SEQ ID 2419>:

```
m718.seq
     1  TCAGACGGCC TTTACGTACC CCGAAACTTT ATCCACCGCC CGCAAAGCTG

51  GTTCAAATGG GACAAAGACA ACGGGCTGCT GCTGCGTACC CGCGAAAATC

101  CGGAAGGCGA AGCGTTGTGG CCGCTGGGCT GGGTCGTTCA TACCCAAAAA

151  TCGCGCAGCG TCCAGCAGGC GCGCAACGGG CTTTTCCGCA CGCTTTCCTG

201  GCTGTATATG TTCAAACACT ACGCCGTCCA CGATTTTGCC GAGTTTTTGG

251  AGCTGTACGG CATGCCCATC CGTATCGGCA ATACGGCGC GGGCGCAACC

301  AAAGAGGAAA AAACACCCCT GCTTCGAGCG GTGGCGGAAA TCGGTCACAA

351  CGCGGCAGGC ATCATGCCAG AAGGTATGGA AATAGAGCTC CACAACGCGG
```

-continued
```
 401 CAAACGGTAC GACGGCAACC AGCAATCCGT TTTTGCAGAT GGCCGACTGG

451 TGCGAAAAAT CGGCGGCGCG GCTGATTTTG GGGCAAACGC TGACCAGCGG

501 TGCGGACGGA AAATCCAGCA CCAACGCGCT GGGCAATATC CACAACGAGG

551 TACGCCGCGA TTTGCTGGTG TCGGACGCAA AACAGGTGGC GCAAACCATC

601 ACAAGCCAAA TCATCGGACC GTTCCTGCAA ATCAACTATC CCCATGCCGA

651 CCCAAACCGC GTGCCGAAAT TTGAATTTGA CACGCGCGAG CCGAAAGACA

701 TCGCGGTCTT TGCCGACGCT ATCCCGAAAC TGGTGGATGT CGGCGTACAA

751 ATCCCCGAAA GCTGGGTGCG CGACAAACTG GTCATTCCAG ATGTGCAGGA

801 GGGTGAGGCT GTGTTGGTGC GGCAGGTACC GGACAATCCG GTAAACAGAA

851 CTGCATTGGC GGCTTTATCC GCCCACACCG TACCATCTAA GGCTACGGGC

901 AGGCATCAGG AAATATTGGA CGGCGCGTTG GATGACGCGC TGGTTGAGCC

951 CGATTTCAAT TCTCAGCTCA ACCCGATGGT GCGTCAGGCG GTTGCCGCAC

1001 TTAATGCTTG CAACAGCTAC GAGGAGGCAG ATGCCGCACT GAATGCGCTT

1051 TATCCGAATT TGGACAACGC GAAACTGCGT ACCTATATGC AGCAGGCCTT

1101 GTTTATCAGC GATATTTTGG GACAAGACCA TGCCCGCGCC TGA
```

This corresponds to the amino acid sequence <SEQ ID 2420; ORF 718>:

```
m718.pep
   1 SDGLYVPRNF IHRPQSWFKW DKDNGLLLRT RENPEGEALW PLGWVVHTQK

51 SRSVQQARNG LFRTLSWLYM FKHYAVHDFA EFLELYGMPI RIGKYGAGAT

101 KEEKNTLLRA VAEIGHNAAG IMPEGMEIEL HNAANGTTAT SNPFLQMADW

151 CEKSAARLIL GQTLTSGADG KSSTNALGNI HNEVRRDLLV SDAKQVAQTI

201 TSQIIGPFLQ INYPHADPNR VPKFEFDTRE PKDIAVFADA IPKLVDVGVQ

251 IPESWVRDKL VIPDVQEGEA VLVRQVPDNP VNRTALAALS AHTVPSKATG

301 RHQEILDGAL DDALVEPDFN SQLNPMVRQA VAALNACNSY EEADAALNAL

351 YPNLDNAKLR TYMQQALFIS DILGQDHARA *
```

The following partial DNA sequence was identified in *N. meningitidis* <SEQ ID 2421>:

```
a718.seq
   1 ATGGAGCCGA TAATGGCAAA AAAGAACAAT AAAACTAAAA TCCAAAAGCC

51 CGAAGCTGCA TTGCAGACGG ACGTGGCTCA AATTACAGCG ACCGGTCGAG

101 TTATCGCCGA GCATCCATCC AATTTTATTA CGCCGCAAAA GATGCGCGCC

151 CTCTTCGAGG ACGCAGAAAG CGGTGACATC CGCGCCCAAC ACGAGCTTTT

201 CGCGGACATT GAGGAGCGCG ACAGCGACAT CGCGGCAAAT ATGGGGACGC

251 GCAAACGCGC GCTGCTGACG CTCAACTGGC GCGTCGCCCC GCCGCGAAAT

301 GCGACGCCCG AAGAAGAAAA GCTGTCCGAC CAAGCCTACG AAATGATGGA

351 CAGCCTGCCT ACCCTCGAAG ACCTGATTAT GGATTTGATG ACGCGGTAG

401 GGCACGGATT TTCTGCGTTG GAGGTCGAGT GGGTATTTTC AGACGGCCTT

451 TACCTACCCC GAAACTTTAT CCACCGCCCG CAAAGCTGGT TCAAATGGGA

501 CAAAGACAAC GGGCTGCTGC TGCGTACCCG CGAAAATCCG GAAGGCGAAG
```

```
 551 CGTTGTGGCC GCTGGGCTGG GTCGTTCATA CCCAAAAATC GCGCAGCGTC

601 CAGCAGGCGC GCAACGGGCT TTTCCGCACG CTTTCCTGGC TGTATATGTT

651 CAAACACTAC GCCGTCCACG ATTTTGCCGA GTTTTTGGAG CTGTACGGCA

701 TGCCCATCCG TATCGGCAAA TACGGCGCGG GCGCAACCAA AGAGGAAAAA

751 AACACCCTGC TTCGAGCGGT GGCGGAAATC GGTCACAACG CGGCAGGCAT

801 CATGCCAGAA GGTATGGAAA TCGAGCTGCA CAACGCGGCA AACGGCATGA

851 CTTCCGCCGG CAATCCGTTT TTGCAGATGG CCGACTGGTG CGAAAAATCG

901 GCGGCGCGGC TGATTTTGGG GCAAACGCTA ACCAGCGGTG CGGACGGAAA

951 ATCCAGCACC AACGCGCTGG GCAATATCCA CAACGAGATA CGCCGCGATT

1001 TGCTGGTGTC GGACGCAAAA CAGGTGGCGC AAACCATCAC AAGCCAAATC

1051 ATCGGACCGT TCCTGCAAAT CAACTATCCC CATGCCGACC CAAACCGCGT

1101 GCCGAAATTT GAATTTGACA CGCGCGAGCC GAAAGACATC GCGGTCTTTG

1151 CCGACGCTAT CCCGAAACTG GTGGATGTCG GCGTACAAAT CCCCGAAAGC

1201 TGGGTGCGCG ACAAACTGGT CATTCCAGAT GTGCAGGAGG GTGAGGCTGT

1251 GTTGGTGCGG CAGGTACCGG ACAATCCGGT AAACAGAACT GCATTGGCGG

1301 CTTTATCCGC CCACACCGTA CCATCTAAGG CTACGGGCAG GCATCAGGAA

1351 ATATTGGACG GCGCGTTGGA TGACGCGCTG GTTGAGCCCG ATTTCAATTC

1401 TCAGCTCAAC CCGATGGTGC GTCAGGCGGT TGCCGCACTT AATGCTTGCA

1451 ACAGCTACGA GGAGGCAGAT GCCGCACTGA ATGCGCTTTA TCCGAATTTG

1501 GACAACGCGA AACTGCGTAC CTATATGCAG CAGGCCTTGT TTATCAGCGA

1551 TATTTTGGGA CAAGACCATG CCCGCGCCTG A
```

This corresponds to the amino acid sequence <SEQ ID 2422; ORF 718.a>:

```
a718.pep
  1 MEPIMAKKNN KTKIQKPEAA LQTDVAQITA TGRVIAEHPS NFITPQKMRA

51 LFEDAESGDI RAQHELFADI EERDSDIAAN MGTRKRALLT LNWRVAPPRN

101 ATPEEEKLSD QAYEMMDSLP TLEDLIMDLM DAVGHGFSAL EVEWVFSDGL

151 YLPRNFIHRP QSWFKWDKDN GLLLRTRENP EGEALWPLGW VVHTQKSRSV

201 QQARNGLFRT LSWLYMFKHY AVHDFAEFLE LYGMPIRIGK YGAGATKEEK

251 NTLLRAVAEI GHNAAGIMPE GMEIELHNAA NGMTSAGNPF LQMADWCEKS

301 AARLILGQTL TSGADGKSST NALGNIHNEI RRDLLVSDAK QVAQTITSQI

351 IGPFLQINYP HADPNRVPKF EFDTREPKDI AVFADAIPKL VDVGVQIPES

401 WVRDKLVIPD VQEGEAVLVR QVPDNPVNRT ALAALSAHTV PSKATGRHQE

451 ILDGALDDAL VEPDFNSQLN PMVRQAVAAL NACNSYEEAD AALNALYPNL

501 DNAKLRTYMQ QALFISDILG QDHARA*
``` a718/m718 98.4% identity in 380 aa overlap

```
                  120        130        140        150        160        170
     a718.pep     DSLPTLEDLIMDLMDAVGHGFSALEVEWVFSDGLYLPRNFIHRPQSWFKWDKDNGLLLRT
                                            |||||:||||||||||||||||||||||||
         m718                               SDGLYVPRNFIHRPQSWFKWDKDNGLLLRT
                                                    10         20         30
```

-continued

```
              180       190       200       210       220       230
a718.pep      RENPEGEALWPLGWVVHTQKSRSVQQARNGLFRTLSWLYMFKHYAVHDFAEFLELYGMPI
              ||||||||||||||||||||||||||||||||||||||||||||||||||||||||||||
m718          RENPEGEALWPLGWVVHTQKSRSVQQARNGLFRTLSWLYMFKHYAVHDFAEFLELYGMPI
                      40        50        60        70        80        90

240       250       260       270       280       290
a718.pep      RIGKYGAGATKEEKNTLLRAVAEIGHNAAGIMPEGMEIELHNAANGMTSAGNPFLQMADW
              |||||||||||||||||||||||||||||||||||||||||||||| |:::|||||||||
m718          RIGKYGAGATKEEKNTLLRAVAEIGHNAAGIMPEGMEIELHNAANGTTATSNPFLQMADW
                     100       110       120       130       140       150

300       310       320       330       340       350
a718.pep      CEKSAARLILGQTLTSGADGKSSTNALGNIHNEIRRDLLVSDAKQVAQTITSQIIGPFLQ
              |||||||||||||||||||||||||||||||||:||||||||||||||||||||||| ||
m718          CEKSAARLILGQTLTSGADGKSSTNALGNIHNEVRRDLLVSDAKQVAQTITSQIIGPGLQ
                     160       170       180       190       200       210

360       370       380       390       400       410
a718.pep      INYPHADPNRVPKFEFDTREPKDIAVFADAIPKLVDVGVQIPESWVRDKLVIPDVQEGEA
              ||||||||||||||||||||||||||||||||||||||||||||||||||||||||||||
m718          INYPHADPNRVPKFEFDTREPKDIAVFADAIPKLVDVGVQIPESWVRDKLVIPDVQEGEA
                     220       230       240       250       260       270

420       430       440       450       460       470
a718.pep      VLVRQVPDNPVNRTALAALSAHTVPSKATGRHQEILDGALDDALVEPDFNSQLNPMVRQA
              ||||||||||||||||||||||||||||||||||||||||||||||||||||||||||||
m718          VLVRQVPDNPVNRTALAALSAHTVPSKATGRHQEILDGALDDALVEPDFNSQLNPMVRQA
                     280       290       300       310       320       330

480       490       500       510       520
a718.pep      VAALNACNSYEEADAALNALYPNLDNAKLRTYMQQALFISDILGQDHARAX
              ||||||||||||||||||||||||||||||||||||||||||||||||||
m718          VAALNACNSYEEADAALNALYPNLDNAKLRTYMQQALFISDILGQDHARAX
                     340       350       360       370       380
```

The following partial DNA sequence was identified in *N. meningitidis* <SEQ ID 2423>:

```
m718-1.seq
   1 ATGGAGCCGA TAATGGCAAA AAAGAACAAT AAAACTAAAA TCCAAAAGCC

51 CGAAGCTGCA TTGCAGACGG ACGTGGCTCA AATTACGGCG ACCGGTCGGG

101 TTATCGCCGA GCATCCGTCC AATTTTATTA CGCCGCAAAA GATGCGGGCC

151 CTCTTCGAGG ACGCAGAAAG CGGCGACATC CGCGCCCAAC ACGAGCTTTT

201 CGCGGACATT GAGGAGCGCG ACAGCGACAT CGCGGCAAAT ATGGGGACGC

251 GCAAACGCGC GCTGCTGACG CTCAACTGGC GCGTCGCCCC GCCGCGAAAT

301 GCGACGCCCG AAGAAGAAAA GCTGTCCGAC CAAGCCTACG AAATGATGGA

351 CAGCCTGCCT ACCCTCGAAG ACCTGATTAT GGATTTGATG GACGCGGTAG

401 GGCACGGATT TTCTGCGTTG GAGGTCGAGT GGGTATTTTC AGACGGCCTT

451 TACCTACCCC GAAACTTTAT CCACCGCCCG CAAAGCTGGT TCAAATGGGA

501 CAAAGACAAC GGGCTGCTGC TGCGTACCCG CGAAAATCCG GAAGGCGAAG

551 CGTTGTGGCC GCTGGGCTGG GTCGTTCATA CCCAAAAATC GCGCAGCGTC

601 CAGCAGGCGC GCAACGGGCT TTTCCGCACG CTTTCCTGGC TGTATATGTT

651 CAAACACTAC GCCGTCCACG ATTTTGCCGA GTTTTTGGAG CTGTACGGCA

701 TGCCCATCCG TATCGGCAAA TACGGCGCGG GCGCAACCAA AGAGGAAAAA

751 AACACCCTGC TTCGAGCGGT GGCGGAAATC GGTCACAACG CGGCAGGCAT

801 CATGCCAGAA GGTATGGAAA TAGAGCTCCA CAACGCGGCA AACGGTACGA

851 CGGCAACCAG CAATCCGTTT TTGCAGATGG CCGACTGGTG CGAAAAAATCG

901 GCGGCGCGGC TGATTTTGGG GCAAACGCTG ACCAGCGGTG CGGACGGAAA

951 ATCCAGCACC AACGCGCTGG GCAATATCCA CAACGAGGTA CGCCGCGATT

1001 TGCTGGTGTC GGACGCAAAA CAGGTGGCGC AAACCATCAC AAGCCAAATC

1051 ATCGGACCGT TCCTGCAAAT CAACTATCCC CATGCCGACC CAAACCGCGT
```

-continued

```
1101 GCCGAAATTT GAATTTGACA CGCGCGAGCC GAAAGACATC GCGGTCTTTG

1151 CCGACGCTAT CCCGAAACTG GTGGATGTCG GCGTACAAAT CCCCGAAAGC

1201 TGGGTGCGCG ACAAACTGGT CATTCCAGAT GTGCAGGAGG GTGAGGCTGT

1251 GTTGGTGCGG CAGGTACCGG ACAATCCGGT AAACAGAACT GCATTGGCGG

1301 CTTTATCCGC CCACACCGTA CCATCTAAGG CTACGGGCAG GCATCAGGAA

1351 ATATTGGACG GCGCGTTGGA TGACGCGCTG GTTGAGCCCG ATTTCAATTC

1401 TCAGCTCAAC CCGATGGTGC GTCAGGCGGT TGCCGCACTT AATGCTTGCA

1451 ACAGCTACGA GGAGGCAGAT GCCGCACTGA ATGCGCTTTA TCCGAATTTG

1501 GACAACGCGA AACTGCGTAC CTATATGCAG CAGGCCTTGT TTATCAGCGA

1551 TATTTTGGGA CAAGACCATG CCCGCGCCTG A
```

This corresponds to the amino acid sequence <SEQ ID 2424; ORF 718-1>:

```
m718-1.pep.
  1 MEPIMAKKNN KTKIQKPEAA LQTDVAQITA TGRVIAEHPS NFITPQKMRA

51 LFEDAESGDI RAQHELFADI EERDSDIAAN MGTRKRALLT LNWRVAPPRN

101 ATPEEEKLSD QAYEMMDSLP TLEDLIMDLM DAVGHGFSAL EVEWVFSDGL

151 YLPRNFIHRP QSWFKWDKDN GLLLRTRENP EGEALWPLGW VVHTQKSRSV

201 QQARNGLFRT LSWLYMFKHY AVHDFAEFLE LYGMPIRIGK YGAGATKEEK

251 NTLLRAVAEI GHNAAGIMPE GMEIELHNAA NGTTATSNPF LQMADWCEKS

301 AARLILGQTL TSGADGKSST NALGNIHNEV RRDLLVSDAK QVAQTITSQI

351 IGPFLQINYP HADPNRVPKF EFDTREPKDI AVFADAIPKL VDVGVQIPES

401 WVRDKLVIPD VQEGEAVLVR QVPDNPVNRT ALAALSAHTV PSKATGRHQE

451 ILDGALDDAL VEPDFNSQLN PMVRQAVAAL NACNSYEEAD AALNALYPNL

501 DNAKLRTYMQ QALFISDILG QDHARA*
```

The following partial DNA sequence was identified in N. meningitidis <SEQ ID 2425>:

```
a718.seq
   1 ATGGAGCCGA TAATGGCAAA AAAGAACAAT AAAACTAAAA TCCAAAAGCC

51 CGAAGCTGCA TTGCAGACGG ACGTGGCTCA AATTACAGCG ACCGGTCGAG

101 TTATCGCCGA GCATCCATCC AATTTTATTA CGCCGCAAAA GATGCGCGCC

151 CTCTTCGAGG ACGCAGAAAG CGGTGACATC CGCGCCCAAC ACGAGCTTTT

201 CGCGGACATT GAGGAGCGCG ACAGCGACAT CGCGGCAAAT ATGGGGACGC

251 GCAAACGCGC GCTGCTGACG CTCAACTGGC GCGTCGCCCC GCCGCGAAAT

301 GCGACGCCCG AAGAAGAAAA GCTGTCCGAC CAAGCCTACG AAATGATGGA

351 CAGCCTGCCT ACCCTCGAAG ACCTGATTAT GGATTTGATG GACGCGGTAG

401 GGCACGGATT TTCTGCGTTG GAGGTCGAGT GGGTATTTTC AGACGGCCTT

451 TACCTACCCC GAAACTTTAT CCACCGCCCG CAAAGCTGGT TCAAATGGGA

501 CAAAGACAAC GGGCTGCTGC TGCGTACCCG CGAAAATCCG GAAGGCGAAG

551 CGTTGTGGCC GCTGGGCTGG GTCGTTCATA CCCAAAAATC GCGCAGCGTC

601 CAGCAGGCGC GCAACGGGCT TTTCCGCACG CTTTCCTGGC TGTATATGTT
```

-continued

```
 651 CAAACACTAC GCCGTCCACG ATTTTGCCGA GTTTTTGGAG CTGTACGGCA

701 TGCCCATCCG TATCGGCAAA TACGGCGCGG GCGCAACCAA AGAGGAAAAA

751 AACACCCTGC TTCGAGCGGT GGCGGAAATC GGTCACAACG CGGCAGGCAT

801 CATGCCAGAA GGTATGGAAA TCGAGCTGCA CAACGCGGCA AACGGCATGA

851 CTTCCGCCGG CAATCCGTTT TTGCAGATGG CCGACTGGTG CGAAAAATCG

901 GCGGCGCGGC TGATTTTGGG GCAAACGCTA ACCAGCGGTG CGGACGGAAA

951 ATCCAGCACC AACGCGCTGG GCAATATCCA CAACGAGATA CGCCGCGATT

1001 TGCTGGTGTC GGACGCAAAA CAGGTGGCGC AAACCATCAC AAGCCAAATC

1051 ATCGGACCGT TCCTGCAAAT CAACTATCCC CATGCCGACC CAAACCGCGT

1101 GCCGAAATTT GAATTTGACA CGCGCGAGCC GAAAGACATC GCGGTCTTTG

1151 CCGACGCTAT CCCGAAACTG GTGGATGTCG GCGTACAAAT CCCCGAAAGC

1201 TGGGTGCGCG ACAAACTGGT CATTCCAGAT GTGCAGGAGG GTGAGGCTGT

1251 GTTGGTGCGG CAGGTACCGG ACAATCCGGT AAACAGAACT GCATTGGCGG

1301 CTTTATCCGC CCACACCGTA CCATCTAAGG CTACGGGCAG CATCAGGAA

1351 ATATTGGACG GCGCGTTGGA TGACGCGCTG GTTGAGCCCG ATTTCAATTC

1401 TCAGCTCAAC CCGATGGTGC GTCAGGCGGT TGCCGCACTT AATGCTTGCA

1451 ACAGCTACGA GGAGGCAGAT GCCGCACTGA ATGCGCTTTA TCCGAATTTG

1501 GACAACGCGA AACTGCGTAC CTATATGCAG CAGGCCTTGT TTATCAGCGA

1551 TATTTTGGGA CAAGACCATG CCCGCGCCTG A
```

This corresponds to the amino acid sequence <SEQ ID 2426; ORF 718-1.a>:

```
a718.pep

1 MEPIMAKKNN KTKIQKPEAA LQTDVAQITA TGRVIAEHPS NFITPQKMRA

51 LFEDAESGDI RAQHELFADI EERDSDIAAN MGTRKRALLT LNWRVAPPRN

101 ATPEEEKLSD QAYEMMDSLP TLEDLIMDLM DAVGHGFSAL EVEWVFSDGL

151 YLPRNFIHRP QSWFKWDKDN GLLLRTRENP EGEALWPLGW VVHTQKSRSV

201 QQARNGLFRT LSWLYMFKHY AVHDFAEFLE LYGMPIRIGK YGAGATKEEK

251 NTLLRAVAEI GHNAAGIMPE GMEIELHNAA NGMTSAGNPF LQMADWCEKS

301 AARLILGQTL TSGADGKSST NALGNIHNET RRDLLVSDAK QVAQTITSQI

351 IGPFLQINYP HADPNRVPKF EFDTREPKDI AVFADAIPKL VDVGVQIPES

401 WVRDKLVIPD VQEGEAVLVR QVPDNPVNRT ALAALSAHTV PSKATGRHQE

451 ILDGALDDAL VEPDFNSQLN PMVRQAVAAL NACNSYEEAD AALNALYPNL

501 DNAKLRTYMQ QALFISDILG QDHARA* a718/m718-1 99.0% identity in526 aa overlap 10         20         30         40         50         60
    a718.pep  MEPIMAKKNNKTKIQKPEAALQTDVAQITATGRVIAEHPSNFITPQKMRALFEDAESGDI
              ||||||||||||||||||||||||||||||||||||||||||||||||||||||||||||
     m718-1  MEPIMAKKNNKTKIQKPEAALQTDVAQITATGRVIAEHPSNFITPQKMRALFEDAESGDI
                  10         20         30         40         50         60

70         80         90        100        110        120
    a718.pep  RAQHELFADIEERDSDIAANMGTRKRALLTLNWRVAPPRNATPEEEKLSDQAYEMMDSLP
              ||||||||||||||||||||||||||||||||||||||||||||||||||||||||||||
     m718-1  RAQHELFADIEERDSDIAANMGTRKRALLTLNWRVAPPRNATPEEEKLSDQAYEMMDSLP
                  70         80         90        100        110        120
```

-continued

```
                   130       140       150       160       170       180
a718.pep    TLEDLIMDLMDAVGHGFSALEVEWVFSDGLYLPRNFIHRPQSWFKWDKDNGLLLRTRENP
            ||||||||||||||||||||||||||||||||||||||||||||||||||||||||||||
m718-1      TLEDLIMDLMDAVGHGFSALEVEWVFSDGLYLPRNFIHRPQSWFKWDKDNGLLLRTRENP
                   130       140       150       160       170       180

190       200       210       220       230       240
a718.pep    EGEALWPLGWVVHTQKSRSVQQARNGLFRTLSWLYMFKHYAVHDFAEFLELYGMPIRIGK
            ||||||||||||||||||||||||||||||||||||||||||||||||||||||||||||
m718-1      EGEALWPLGWVVHTQKSRSVQQARNGLFRTLSWLYMFKHYAVHDFAEFLELYGMPIRIGK
                   190       200       210       220       230       240

250       260       270       280       290       300
a718.pep    YGAGATKEEKNTLLRAVAEIGHNAAGIMPEGMEIELHNAANGMTSAGNPFLQMADWCEKS
            |||||||||||||||||||||||||||||||||||||||||| |:::|||||||||||||
m718-1      YGAGATKEEKNTLLRAVAEIGHNAAGIMPEGMEIELHNAANGTTATSNPFLQMADWCEKS
                   250       260       270       280       290       300

310       320       330       340       350       360
a718.pep    AARLILGQTLTSGADGKSSTNALGNIHNEIRRDLLVSDAKQVAQTITSQIIGPFLQINYP
            |||||||||||||||||||||||||||||:||||||||||||||||||||||||||||||
m718-1      AARLILGQTLTSGADGKSSTNALGNIHNEVRRDLLVSDAKQVAQTITSQIIGPFLQINYP
                   310       320       330       340       350       360

370       380       390       400       410       420
a718.pep    HADPNRVPKFEFDTREPKDIAVFADAIPKLVDVGVQIPESWVRDKLVIPDVQEGEAVLVR
            ||||||||||||||||||||||||||||||||||||||||||||||||||||||||||||
m718-1      HADPNRVPKFEFDTREPKDIAVFADAIPKLVDVGVQIPESWVRDKLVIPDVQEGEAVLVR
                   370       380       390       400       410       420

430       440       450       460       470       480
a718.pep    QVPDNPVNRTALAALSAHTVPSKATGRHQEILDGALDDALVEPDFNSQLNPMVRQAVAAL
            ||||||||||||||||||||||||||||||||||||||||||||||||||||||||||||
m718-1      QVPDNPVNRTALAALSAHTVPSKATGRHQEILDGALDDALVEPDFNSQLNPMVRQAVAAL
                   430       440       450       460       470       480

490       500       510       520
a718.pep    NACNSYEEADAALNALYPNLDNAKLRTYMQQALFISDILGQDHARAX
            |||||||||||||||||||||||||||||||||||||||||||||||
m718-1      NACNSYEEADAALNALYPNLDNAKLRTYMQQALFISDILGQDHARAX
                   490       500       510       520
``` g719.seq not found yet g719.seq not found yet

The following partial DNA sequence was identified in *N. meningitidis* <SEQ ID 2427>:

```
m719.seq
    1  ATGGCAAACG GGAACATGAA ACTGTCGTTG GTGTTAACCG CCCGAGATGA
   51  CGGAGCGAGA CGGCTACTGG CTGATACTCA ACGACAATTA GATCGTACCG
  101  CGAAATCGCG GGCGCAACTT GAACGGCAAA GCCATACTTA TGCGTTGACC
  151  GGCATCCGCT CAGAAAAACA GATTCAACGC GAAATCATGC TGACACAGGC
  201  TGCGTTTAAC CGTTTGGCGC GCAGCGGCAA GGCATCACAA AATGATTTGG
  251  CACGGGCGGC GGTCGCTACG CGTAACCGAA TTCGCGAGCT GAACGCGGAA
  301  CTGAAACAGG GCACGGGATT TGCGGACAAG ATGGGAAAAA TCGGAAGATT
  351  CGGTGCAGCT GCGGTGGCTG GTGGCGCGGC AGCGTATACG GTGCTTAAGC
  401  CTGCTATGGA CAACAGAAAG CAGCTTGATG AGAACATCAA CCGCGTGTCC
  451  AGACAGGCAT TTATTGAGGA TAACAGTAAA TCGGCAGCGT GGATTGCAAC
  501  TGAAGGTGCG CAACAGATCA AGGATTTGGC ACTTGAACTT GTCGAGAAAA
  551  ATGGCGGGAC CCACGATAAG GCTTTGGATT TAATCAGCGG CATGATGACC
  601  ACCGGTCTGA ATTTTGCCCA AACCAAGAAT GAAGCGCAGG CGGCATATGC
  651  TTTTGCACTT GCCTCAGAAG GCAGTGGCGA GGATACGGCA AAACTGATTA
  701  AAACCCTGAA AGATGGCGGC ATGAGCGGTA AAGACCTGCA ACTCGGGCTT
  751  GAGCACGTCT TGCAATCGGG TTTAGACGGC ACTTTCGAGG TGCGGGATAT
```

-continued

```
 801 GGTTCGGGAG CTGCCGAGCC TGCTCTCTGC CGCGCAACAG GCAGGGATGA

851 ATGGTGTCGG CGGTTTGGAC TACCTGCTCT CACTCTTACA ATCTGCGGCG

901 AATAAATCGG GCAGTCCTGC CGAAGCGGCG ACTAATGTGC AAAATCTTTT

951 GAGTAAAACT CTGTCGCCTG ACACGATAGG TCGTCTGAAG AAGATGGCAA

1001 ATCCGAATGA CCCGAAGAAA GGTGTCGATT GGATAGGCTC GGTTGTGCAA

1051 GGCAAGCAAA ACGGCGAAAA CGCAGTGCAG GTGTTGTCCC GTCTTGCCGA

1101 TGCCATGCTA GTAAAGGATA AGCAATACCA AGATTATAAG AAACGCGCGG

1151 CTGCAGGCGA TAAGACGGCG GCGGAGCAGG CAAATATGCT TAAGGGCGCG

1201 CTTTTGGCGC AACTGCTGCC TGATTTGCAG GCAAAACAAG GTTTGCTGGC

1251 TGCAACGGAT ATGACGCAAA TCCGTGAATA TATGGCTTCG TTGGCTGGCG

1301 TAACGTTGGA TAACGGAAAA ATTGCTAAGA ACAACGAGGC GCGAATGTTG

1351 TCGGCAGCGG CGCAACAAGA GCAACAGGAA TCGCTGGCAA TGTTGCGGGA

1401 AAGTCTGACG GGAACATTGG TGGATATGGA AACCTCGTTT AAAAAGCTGG

1451 CAGCGGAATA CCCTAATGCC ACTCTAGCCC TGCAAGCATT GACGACGGCG

1501 GCAACAGCGG CGTCTGCCGC AATGTTATTA CCGCCGGTG GCGGTAAAGG

1551 TGCAGGCTTT CTGAAAGATG TAGGTAGTAA AGCGTTGGGA TGGGGTAAGG

1601 CTTCCGCAGG CGGCGTGGCA GCAGGTGCCA CAGCGGCAGG CGGTAAGTTG

1651 CTGTCATGGG GAAAATCTGC CGGTAGCGGG CTCATGAATA ATCCAGCGTT

1701 AGTTAAACGG GCGGGTTTGT TAGGTATGTT GCTGTATTCC GAGTCTTTGG

1751 GTGACGGCAC ATTGCCAAAG GGTTTGCGTG GTACCAAGAC AACTCCTGAA

1801 ATGATTAATC GTCTGAAAAA CAACGGTATC CGATTTGAAC CTGCGCCGAA

1851 GCGGGAACAG GCGCGGGGTG GTGTCCCTCA GTATTTGGCT GCTCCGTCAG

1901 CGCAGCCTAC CGATAAGATG TTGTCTCCGT TGTTTTCAAC TCAGACGGCG

1951 GCGTATCAGG CAGCCATTCA GCAGCAGACG GCGGCGTATC AGGCAGCATT

2001 GGCGCAGGAT ACGGCTGCAG TTACAACAGG TTTGGCACAA GTGCAAAGTG

2051 CGATGGCGTC GGCAAGTCAG ACCATCAATA CCAATGTGAG CCTGAATATC

2101 GACGGACGTG TTATCGCGAA TGAGGTATCG CGGTATCAAG TGGCCATGTT

2151 CGGCCGTGGA GCGGGTCAAT AA
```

This corresponds to the amino acid sequence <SEQ ID 2428; ORF 719>:

```
m719.pep
  1 MANGNMKLSL VLTARDDGAR RLLADTQRQL DRTAKSRAQL ERQSHTYALT

51 GIRSEKQIQR EIMLTQAAFN RLARSGKASQ NDLARAAVAT RNRIRELNAE

101 LKQGTGFADK MGKIGRFGAA AVAGGAAAYT VLKPAMDNRK QLDENINRVS

151 RQAFIEDNSK SAAWIATEGA QQIKDLALEL VEKNGGTHDK ALDLISGMMT

201 TGLNFAQTKN EAQAAYAFAL ASEGSGEDTA KLIKTLKDGG MSGKDLQLGL

251 EHVLQSGLDG TFEVRDMVRE LPSLLSAAQQ AGMNGVGGLD YLLSLLQSAA

301 NKSGSPAEAA TNVQNLLSKT LSPDTIGRLK KMANPNDPKK GVDWIGSVVQ

351 GKQNGENAVQ VLSRLADAML VKDKQYQDYK KRAAAGDKTA AEQANMLKGA

401 LLAQLLPDLQ AKQGLLAATD MTQIREYMAS LAGVTLDNGK IAKNNEARML
```

-continued

```
451 SAAAQQEQQE SLAMLRESLT GTLVDMETSF KKLAAEYPNA TLALQALTTA

501 ATAASAAMLL TAGGGKGAGF LKDVGSKALG WGKASAGGVA AGATAAGGKL

551 LSWGKSAGSG LMNNPALVKR AGLLGMLLYS ESLGDGTLPK GLRGTKTTPE

601 MINRLKNNGI RFEPAPKREQ ARGGVPQYLA APSAQPTDKM LSPLFSTQTA

651 AYQAAIQQQT AAYQAALAQD TAAVTTGLAQ VQSAMASASQ TINTNVSLNI

701 DGRVIANEVS RYQVAMFGRG AGQ*
``` a719.seq not found yet
a719.pep not found yet
g720.seq not found yet
g720.pep not found yet

15

The following partial DNA sequence was identified in *N. meningitidis* <SEQ ID 2429>:

```
m720.seq
    1 ATGAGCGGAT GGCATACCTT ATTGCAGGAC GCATCTTACA AGGGCGTCGG

51 CTTTGATATT GAGGTGGTGG ACGAGAGCAA CGGCAAGGCA TTGGCCGAGC

101 ATGCGCGGCC GTTTGTGCAG GGTATCGACC TTGAAGACAT GGGCATGACC

151 GGGCGGCAGG TGCAGATTAA TGCGGTGTTT TGGGGCAAGG GCTATGCAGG

201 CCGTCTGAAA AAGCTGCTGG ATGCGCTGGA GCAGCCGGGC GGCGGCGTGC

251 TGGTGCACCC TGTTTGGGGG CGGATGCACA ACATGATTGC GGCATCATGG

301 AGTTACCGAC ATGAGGCCGA TTATGTGGAT TATGCGGGCA TCGATATTAC

351 TTTCCGCGAG GCGGCCGAAG CGCAGGAAAT CTTTGTTTTT GAAAACGCCT

401 TTTTGGTCGA GCTTGAGGCG TTGATTGCTA ATATCGACAC CTACCGCGAG

451 GCGGCTATCG GCTTTGTTGA TGCGGTGTTG GCGGTGGATG CGGGCGTATC

501 AGCTTTATGG GGCAGCGCGC TGGGCATTTG GAGTGCGGCA TCGGGTACGT

551 TTGGCGCGGT GCGCCGTTTG TTTGATTTGG ACAAAATTGC CTTTCCCGAT

601 CGGGGCGGAT ACAGTGCAGC GGCGTTTAAA AACGGCTCGG CCAAGCTGTT

651 TGCGGATATA TCGGTCATGG TAGATACTGG CATACGCCGT GAGGCGGGTT

701 TGGCCGATAA TGCCATGCAC CATGCCGGTT GGTCGCCGCG ACAGCGGTTT

751 GACGGGGCTG CGGCTGTTGC CGACCGCGCC GCCGCTATCC CTGATAATTT

801 GCTGACCGGC CGCTTTTCAG ACGGCCTGCA AAACCGCCTG AACCGGTTAA

851 CCGCCAAACA GGTGCAGCCG GTAGCGCAGG CGGTGCGCCT GTTATCCACG

901 TCATCGCTGT TGTCGGTGGC AACGGCATTA ATCGAGGCGC ATGGCGAAGA

951 GATGACCGCG CCCGATTTGA TTGAGGTTAA CCGCGCCATG CGCCGCCGTA

1001 TGCAGGCCGA GATTGCCGCC TTGCGGGCGG TGCAGACGGC TGCTGCCGAG

1051 TCTGGTGGGC TGACGGCCAA CGCCGTGTAT ACCGAGGCTT ACCAAACGGC

1101 AGAATCCCTG CGCGCGGCGG CAGGCCGTCT GAATGCGTTG GTTGCGGCGG

1151 TCATCAACCA AAAGCCGCCG CTGATTGTGC GCCAAGCCCC AATCGACGGT

1201 ACGATACACC AAATCGCCCA CGAGTTTTAC GGCGATATAG CCCGCGCAGC

1251 AGAGCTGGTG CGGCTCAATC CCCATATCCA CCACCCCGCG TTTATCAAGC

1301 GCGGCACTTT GGTCAACAGC TATGCAAAAT AA
```

This corresponds to the amino acid sequence <SEQ ID 2430; ORF 720>:

```
m720.pep
    1 MSGWHTLLQD ASYKGVGFDI EVVDESNGKA LAEHARPFVQ GIDLEDMGMT

51 GRQVQINAVF WGKGYAGRLK KLLDALEQPG GGVLVHPVWG RMHNMIAASW

101 SYRHEADYVD YAGIDITFRE AAEAQEIFVF ENAFLVELEA LIANIDTYRE

151 AAIGFVDAVL AVDAGVSALW GSALGIWSAA SGTFGAVRRL FDLDKIAFPD

201 RGGYSAAAFK NGSAKLFADI SVMVDTGIRR EAGLADNAMH HAGWSPRQRF

251 DGAAAVADRA AAIPDNLLTG RFSDGLQNRL NRLTAKQVQP VAQAVRLLST

301 SSLLSVATAL IEAHGEEMTA PDLIEVNRAM RRRMQAEIAA LRAVQTAAAE

351 SGGLTANAVY TEAYQTAESL RAAAGRLNAL VAAVINQKPP LIVRQAPIDG

401 TIHQIAHEFY GDIARAAELV RLNPHIHHPA FIKRGTLVNS YAK*
```

The following partial DNA sequence was identified in *N. meningitidis* <SEQ ID 2431>:

```
a720.seq (partial)
    1 GGCCTGCAAA ACCGCCTGAA CCGGTTAACC GCCAAACAGG TGCAGCCGGT

51 AGCGCAGGCG GTGCGCCTGT TATCCACGTC ATCGCTGTTG TCGGTGGCAA

101 CGGCATTAAT CGAGGCGCAT GGCGAAGAGA TGACCGCGCC CGATTTGATT

151 GAGGTTAACC GCGCCATGCG CCGCCGTATG CAGGCCGAGA TTGCCGCCTT

201 ACGGGCGGTG CAGACGGCTG CTGCCGAGTC TGGTGGGCTG ACGGCCAACG

251 CCGTGTATAC CGAGGCTTAC CAAACGGCAG AATCCCTGCG CGCGGCGGCA

301 GGCCGTCTGA ATGCGTTGGT TGCGGCGGTC ATCAACCAAA AGCCGCCGCT

351 GATTGTGCGC CAAGCCCCAA TCGACGGTAC GATACACCAA ATCGCCCACG

401 AGTTTTACGG CGATATAGCC CGCGCAGCAG AGCTGGTGCG GCTCAATCCC

451 CATATCCACC ACCCCGCGTT TATCAAGCGC GGCACTTTGG TCAACAGCTA

501 TGCAAAATAA
```

This corresponds to the amino acid sequence <SEQ ID 2432; ORF 720.a>:

```
a720.pep (partial)
    1 GLQNRLNRLT AKQVQPVAQA VRLLSTSSLL SVATALIEAH GEEMTAPDLI

51 EVNRAMRRRM QAEIAALRAV QTAAAESGGL TANAVYTEAY QTAESLRAAA

101 GRLNALVAAV INQKPPLIVR QAPIDGTIHQ IAHEFYGDIA RAAELVRLNP

151 HIHHPAFIKR GTLVNSYAK*
``` m720/a720 100.0% identity in 169 aa overlap

```
                   250        260        270        280        290        300
       m720.pep    SPRQRFDGAAAVADRAAAIPDNLLTGRFSDGLQNRLNRLTAKQVQPVAQAVRLLSTSSLL
                                                  ||||||||||||||||||||||||||||||
           a720                                   GLQNRLNRLTAKQVQPVAQAVRLLSTSSLL
                                                           10        20        30

310        320        330        340        350        360
       m720.pep    SVATALIEAHGEEMTAPDLIEVNRAMRRRMQAEIAALRAVQTAAAESGGLTANAVYTEAY
                   ||||||||||||||||||||||||||||||||||||||||||||||||||||||||||||
           a720    SVATALIEAHGEEMTAPDLIEVNRAMRRRMQAEIAALRAVQTAAAESGGLTANAVYTEAY
                           40        50        60        70        80        90
```

-continued

```
                370       380       390       400       410       420
m720.pep    QTAESLRAAAGRLNALVAAVINQKPPLIVRQAPIDGTIHQIAHEFYGDIARAAELVRLNP
            ||||||||||||||||||||||||||||||||||||||||||||||||||||||||||||
a720        QTAESLRAAAGRLNALVAAVINQKPPLIVRQAPIDGTIHQIAHEFYGDIARAAELVRLNP
                   100       110       120       130       140       150

430       440
m720.pep    HIHHPAFIKRGTLVNSYAKX
            ||||||||||||||||||||
a720        HIHHPAFIKRGTLVNSYAKX
                   160       170 g721.seq not found
g721.pep not found
```

The following partial DNA sequence was identified in *N. meningitidis* <SEQ ID 2433>:

```
m721.seq
   1 ATGTCCAAAA ATGCACAAAA AACCCTACTT GCCGTGTGCA GTTTCGAGGT

51 GCAGCCAAAA GACGGGCGAA TCCAACTGCT GCCATATGGC GAATTTCGCG

101 CAGTAGACGG TCGTCCGACT GATGTCCCTG CGTGGTATCT GACCGAAGAA

151 AACGGTCATG ATGTCGCGTT GTTGGCCAAC AGCTCGCGCA ATCAGTTGGT

201 TGTCGATTAT GAACACCAGA CGCTCTACAA AGAGAAAAAC GGACAACCTG

251 CACCTGCCGC CGGTTGGATG CGTTGGCTGG AGTTCACGCC TAAAGGCATG

301 TTTGCCGAAG TGGAGTGGAC GGACAAGGCG GCTGCGGCAA TTGCCGCAAA

351 AGAGTATCGC TACATCTCTG CTGTGTTTTC CTATGACACA AAGGGATATG

401 TAAGCAAAAT TTTTCACGCC GCGCTGACAA ATTTCCCCGC GTTGGACGGT

451 ATGGACGAGG TGCTGGCGGC AGCGTCGGCG CAAATTTTAA AACCGGAAAC

501 GGAGCAAAAC CCTATGAAAG AGTTGTTACA GCAACTGTTC GACCTGCCTG

551 ATGCGGGCGA AGAAGAACTG AAGGCGGCAT TGTCCGCGCT CGTGGAAGCC

601 AAGCCGAAAG ACGTGGCATT GTCTGCCGAC GTGTTCGCGC AGCTGGCGGA

651 AAAAGACAGC CGCATCGCGG CATTGACGGC GCAAACCGCC AAGCCTGATT

701 TGACTAAATA CGCGCCTATC TCAGTGGTTC AAGAGCTGCA AAGCAAAGTC

751 GCCGCGCTGA CTGCCAAGCA GGAAGCAGAC AAAGGCAACG AATTGATTAC

801 CGCCGCGCTG ACTTCAGGCA AATTGCTGCC TGCTCAGAAG GAGTGGGCAA

851 AAGGCGTATT GAAACAGCCG GGCGGCTTGG CATTTTTGAC CGGCTTTATT

901 GAAAACGCCC AGCCGGTCGC TGCACTGGCA GGCTCGCAAA CGGGCGGCAA

951 AGCACCCGAC GAACGCGTCG CCGCACTGAC TGCGGAAGAG GCAGCCGCAG

1001 CAAAAATGCT GGGCATGTCC GGCGAAGAAT TTGTAAAAAT CAAAGAAAGC

1051 GAAGGTAAGT AA
```

This corresponds to the amino acid sequence <SEQ ID 2434; ORF 721>:

```
m721.pep
  1 MSKNAQKTLL AVCSFEVQPK DGRIQLLPYG EFRAVDGRPT DVPAWYLTEE

51 NGHDVALLAN SSRNQLVVDY EHQTLYKEKN GQPAPAAGWM RWLEFTPKGM

101 FAEVEWTDKA AAIAAKEYR YISAVFSYDT KGYVSKIFHA ALTNFPALDG

151 MDEVLAAASA QILKPETEQN PMKELLQQLF DLPDAGEEEL KAALSALVEA

201 KPKDVALSAD VFAQLAEKDS RIAALTAQTA KPDLTKYAPI SVVQELQSKV
```

-continued
```
251 AALTAKQEAD KGNELITAAL TSGKLLPAQK EWAKGVLKQP GGLAFLTGFI

301 ENAQPVAALA GSQTGGKAPD ERVAALTAEE AAAAKMLGMS GEEFVKIKES

351 EGK*
```

The following partial DNA sequence was identified in *N. meningitidis* <SEQ ID 2435>:

```
a721.seq
    1 ATGTCCAAAA ATGCACAAAA AACCCTACTT GCCGTGTGCA GTTTCGAGGT

51 GCAGCCAAAA GACGGGCGAA TCCAACTGCT GCCATATGGC GAATTTCGCG

101 CAGTAGACGG TCGTCCGACT GATGTCCCTG CGTGGTATCT GACCGAAGAA

151 AACGGTCATG ATGTCGCGTT GTTGGCCAAC AGCTCGCGCA ATCAGTTGGT

201 TGTCGATTAT GAACACTAGA CGCTCTACAA AGAGAAAAAC GGACAACCTG

251 CACCTGCCGC CGGTTGGATG CGTTGGCTGG AGTTCACGCC TAAAGGCATG

301 TTTGCCGAAG TGGAGTGGAC GGACAAGGCG GCTGCGGCAA TTGCCGCAAA

351 AGAGTATCGC TACATCTCTG CTGTGTTTTC CTATGACACA AAGGGATATG

401 TAAGCAAAAT TTTTCACGCC GCGCTGACAA ATTTCCCCGC GTTGGACGGT

451 ATGGACGAGG TGCTGGCGGC AGCGTCGGCG CAAATTTTAA ACCGGAAAC

501 GGAGCAAAAC CCTATGAAAG AGTTGTTACA GCAACTGTTC GGTCTGCCTG

551 ATGCGGGCGA AGAAGAACTG AAGGCGGCAT TGTCCGCGCT CGTGGAAGCC

601 AAGCCGAAAG ACGTGGCATT GTCTGCCGAC GTGTTCGCGC AGCTGGCGGA

651 AAAAGACAGC CGCATCGCGG CATTGACGGC GCAAACCGCC AAGCCTGATT

701 TGACTAAATA CGCGCCTATC TCAGTGGTTC AAGAGCTGCA AAGCAAAGTC

751 GCCGCGCTGA CTGCCAAGCA GGAAGCAGAC AAAGGCAACG AATTGATTAC

801 CGCCGCGCTG ACTTCAGGCA AATTGCTGCC TGCTCAGAAG GAGTGGGCAG

851 AAGGCGTATT GAAACAGCCG GCGGCTTGG CATTTTTGAC CGGCTTTATT

901 GAAAACGCCC AGCCGGTCGC TGCACTGGCA GGCTCGCAAA CGGGCGGTAA

951 AGCACCCGAC GAACGCGTCG CCGCACTGAC TGCGGAAGAG GCAGCCGCAG

1001 CAAAAATGCT GGGCATGTCC GGCGAAGAAT TTGTAAAAAT CAAAGAAAGC

1051 GAAGGTAAGT AA
```

This corresponds to the amino acid sequence <SEQ ID 2436; ORF 721.a>:

```
a721.pep
    1 MSKNAQKTLL AVCSFEVQPK DGRIQLLPYG EFRAVDGRPT DVPAWYLTEE

51 NGHDVALLAN SSRNQLVVDY EH*TLYKEKN GQPAPAAGWM RWLEFTPKGM

101 FAEVEWTDKA AAAIAAKEYR YISAVFSYDT KGYVSKIFHA ALTNFPALDG

151 MDEVLAAASA QILKPETEQN PMKELLQQLF GLPDAGEEEL KAALSALVEA

201 KPKDVALSAD VFAQLAEKDS RIAALTAQTA KPDLTKYAPI SVVQELQSKV

251 AALTAKQEAD KGNELITAAL TSGKLLPAQK EWAEGVLKQP GGLAFLTGFI

301 ENAQPVAALA GSQTGGKAPD ERVAALTAEE AAAAKMLGMS GEEFVKIKES

351 EGK*
``` a721/m721 99.2% identity in 353 aa overlap

```
               10         20         30         40         50         60
a721.pep  MSKNAQKTLLAVCSFEVQPKDGRIQLLPYGEFRAVDGRPTDVPAWYLTEENGHDVALLAN
          ||||||||||||||||||||||||||||||||||||||||||||||||||||||||||||
m721      MSKNAQKTLLAVCSFEVQPKDGRIQLLPYGEFRAVDGRPTDVPAWYLTEENGHDVALLAN
               10         20         30         40         50         60

70         80         90        100        110        120
a721.pep  SSRNQLVVDYEHXTLYKEKNGQPAPAAGWMRWLEFTPKGMFAEVEWTDKAAAAIAAKEYR
          |||||||||||| |||||||||||||||||||||||||||||||||||||||||||||||
m721      SSRNQLVVDYEHQTLYKEKNGQPAPAAGWMRWLEFTPKGMFAEVEWTDKAAAAIAAKEYR
               70         80         90        100        110        120

130        140        150        160        170        180
a721.pep  YISAVFSYDTKGYVSKIFHAALTNFPALDGMDEVLAAASAQILKPETEQNPMKELLQQLF
          ||||||||||||||||||||||||||||||||||||||||||||||||||||||||||||
m721      YISAVFSYDTKGYVSKIFHAALTNFPALDGMDEVLAAASAQILKPETEQNPMKELLQQLF
              130        140        150        160        170        180

190        200        210        220        230        240
a721.pep  GLPDAGEEELKAALSALVEAKPKDVALSADVFAQLAEKDSRIAALTAQTAKPDLTKYAPI
           |||||||||||||||||||||||||||||||||||||||||||||||||||||||||||
m721      DLPDAGEEELKAALSALVEAKPKDVALSADVFAQLAEKDSRIAALTAQTAKPDLTKYAPI
              190        200        210        220        230        240

250        260        270        280        290        300
a721.pep  SVVQELQSKVAALTAKQEADKGNELITAALTSGKLLPAQKEWAEGVLKQPGGLAFLTGFI
          |||||||||||||||||||||||||||||||||||||||||||| :|||||||||||||
m721      SVVQELQSKVAALTAKQEADKGNELITAALTSGKLLPAQKEWAKGVLKQPGGLAFLTGFI
              250        260        270        280        290        300

310        320        330        340        350
a721.pep  ENAQPVAALAGSQTGGKAPDERVAALTAEEAAAAKMLGMSGEEFVKIKESEGKX
          |||||||||||||||||||||||||||||||||||||||||||||||||||||
m721      ENAQPVAALAGSQTGGKAPDERVAALTAEEAAAAKMLGMSGEEFVKIKESEGKX
              310        320        330        340        350 g722.seq  not found yet g722.pep  not found yet
```

The following partial DNA sequence was identified in *N. meningitidis* <SEQ ID 2437>:

```
m722.seq
   1  GTGTTTGAAA CGCCGACATT TGAGCAAATC CGCGAGCGTA TCCTGCGCGA

51  TACCAAAAGC CTGTGGCCGG ATGCCGATAT CAGCCCCGAC AGCGACCATT

101  ATGTGCACGC CAGCCGTTTG GCCAGCTGCG CCGAAGGGCA ATATGCGCAT

151  CAAAGCTGGA TTGTGCGGCA GATTTTCCCT GATACCGCCG ACCGCGAGTA

201  TTTGGAGCGG CATGCCTCCA TGCGCGGCTT GAGCCGCCGC AATCCTACCA

251  CGGCCAGCGG CACGCTGACC GTAAGCGGTA TTGCGCAATC CATGCTTTCA

301  GACGACCTGC AAGTGCGTAT CGGCCAGCGT TTTTACCGCA CTACCGCCCG

351  CGCCGTTATC GGCAGCGGCG GCACGGCGGA ATACCGGCA ATCGCCGACG

401  AGCCGGGCGC GGCCGCCAAT GTGGGCGACG GCGAGGCGCA ACTGATGGCC

451  GCCCCCGCCG GTGTGGCCAC CGAATGCCGC CTTACCGTAC AAGGCGGCAC

501  CGACCGAGAA AGCGATGCCT CACTGCTGGC GCGTCTGTTG GAAATCATCC

551  GCCGACCGCC CGCAGGCGGC AACCGTTACG ACTATAAAAA CTGGGCGTTG

601  AGTGTTGACG GCGTAACCAG CGCATATGTT TATCCGCTGC GCCGCGGCTT

651  GGGTACGGTG GATATTGCCA TTACCTCCGC CGACGGTGTG TCGTCGGAAG

701  AAACTGTGCG CCGCGTACAG GCTTATATCG ACGAGATGCG CCCGGTAACG

751  GCAAAAAATG CGCTGGTACT CAAGCCAACC GTAACGGCGG TGCCTGTTAC

801  CGTGCAAGTC AAGCTCGACG GTATCGACTT GGACGAGGCC AAGCGCCGCA

851  TACGGACGGC CCTAAAAGAA TATTTCGACA CCCTGATCCC CGGCGACGGC
```

-continued

```
 901 CTGACTGTGT CGCAAATCGA GGCTGCTATC AGCAATGTGG ATGGTGTGAT

951 CGACCGCCGT CTGACTGCGC CGACGGCCAA CCGTGCCGCC GATACGGTTA

1001 ACCGCATCGA GTGGTTTAAA GCGGGCGCGA TTAATGTAAC GGAGATGCCG

1051 TCATGA
```

This corresponds to the amino acid sequence <SEQ ID 2438; ORF 722>:

```
m722.pep
   1 VFETPTFEQI RERILRDTKS LWPDADISPD SDHYVHASRL ASCAEGQYAH

51 QSWIVRQIFP DTADREYLER HASMRGLSRR NPTTASGTLT VSGIAQSMLS

101 DDLQVRIGQR FYRTTARAVI GSGGTAEIPA IADEPGAAAN VGDGEAQLMA

151 APAGVATECR LTVQGGTDRE SDASLLARLL EIIRRPPAGG NRYDYKNWAL

201 SVDGVTSAYV YPLRRGLGTV DIAITSADGV SSEETVRRVQ AYIDEMRPVT

251 AKNALVLKPT VTAVPVTVQV KLDGIDLDEA KRRIRTALKE YFDTLIPGDG

301 LTVSQIEAAI SNVDGVIDRR LTAPTANRAA DTVNRIEWFK AGAINVTEMP

351 S*
```

The following partial DNA sequence was identified in *N. meningitidis* <SEQ ID 2439>:

```
a722.seq
   1 GTGTTTGAAA CGCCGACATT TGAGCAAATC CGCGAGCGTA TCCTGCGCGA

51 TACCAAAAGC CTGTGGCCGG ATGCCGATAT CAGCCCCGAC AGCGACCATT

101 ATGTGCACGC CAGCCGTTTG GCCAGCTGCG CCGAAGGGCA ATATGCGCAT

151 CAAAGCTGGA TTGTGCGGCA GATTTTCCCT GATACCGCCG ACCGCGAGTA

201 TTTGGAGCGG CATGCCTCCA TGCGCGGCTT GCGCCGCCGC AATCCTACCA

251 CGGCCAGCGG CACGCTGACC GTAAGCGGTA TTGCGCAATC CATGCTTTCA

301 GACGGCCTGC AAGTGCGTAT CGGCCAGCGT TTTTACCGCA CTACCGCCCG

351 CGCCGTTATC GGCAGCGGCG GCACGGCGGA AATACCGGCA ATCGCCGACG

401 AGCCGGGCGC GGCCGCCAAT GTGCGCGACG GCGAGGCGCA ACTGATGGCC

451 GCCCCCGCCG GTGTGTCCAC CGAATGCCGC CTTACCGTAC AAGGCGGCAC

501 CGACCGAGAA AGCGATGCCT CACTGCTGGC GCGTCTGTTG GAAATCATCC

551 GCCGACCGCC CGCAGGCGGC AACCGTTACG ACTATAAAAA CTGGGCGTTG

601 AGTGTTGACG GCGTAACCAG CGCATATGTT TATCCGCTGC GCCGCGGCTT

651 GGGTACGGTG GATATTGCCA TTACCTCCGC CGACGGTGTG CCATCGGAAG

701 AAACTGTGCG CCGCGTACAG GCTTATATCG ACGAGATGCG CCCGGTAACG

751 GCAAAAAATG CGCTGGTACT CAAGCCAACC GTAACGGCGG TGCCTGTTAC

801 CGTGCAAGTC AAGCTCGACG GCATCGACTT GGACGAGGCC AAGCGCCGCA

851 TACGGACGGC CCTAAAAGAA TATTTCGACA CCCTGATCCC CGGCGACGGC

901 CTGACTGTGT CGCAAATCGA GGCGGCTATC AGCAATGTGG ATGGTGTGAT

951 CGACCTCCGT CTGACTGCGC CGACGGCCAA CCGTGCCGCC GATACGGTTA

1001 ACCGCATCGA GTGGTTTAAA GCGGGCGCGA TTAATGTAAC GGAGATGCCG

1051 TCATGA
```

This corresponds to the amino acid sequence <SEQ ID 2440; ORF 722.a>:

```
a722.pep
   1 VFETPTFEQI RERILRDTKS LWPDADISPD SDHYVHASRL ASCAEGQYAH

51 QSWIVRQIFP DTADREYLER HASMRGLRRR NPTTASGTLT VSGIAQSMLS

101 DGLQVRIGQR FYRTTARAVI GSGGTAEIPA IADEPGAAAN VRDGEAQLMA

151 APAGVSTECR LTVQGGTDRE SDASLLARLL EIIRRPPAGG NRYDYKNWAL

201 SVDGVTSAYV YPLRRGLGTV DIAITSADGV PSEETVRRVQ AYIDEMRPVT

251 AKNALVLKPT VTAVPVTVQV KLDGIDLDEA KRRIRTALKE YFDTLIPGDG

301 LTVSQIEAAI SNVDGVIDLR LTAPTANRAA DTVNRIEWFK AGAINVTEMP

351 S* g723.seq not found yet
g723.pep not found yet
```

The following partial DNA sequence was identified in *N. meningitidis* <SEQ ID 2441>:

```
m723.seq
   1 ATGCGACCCA AGCCCCGTTT CAGACGGTCT GTTATCGCTT GCTCAATATC

51 AGTGATCACG CCCGAACACC TTATTTTTAC CGTTTACAAA CACAATACCG

101 TCTTCGCCCG CGGCCACTTC TTCGCCGCTA TCATCCACGC CCAGCTGCAC

151 TTCGCCTTTG GCCATAGCAC GCAGCAGGTC GAGCACGTCG ATTTTGTAGC

201 GGTTGCGGAT TTCGTCGGTA ATCAACACGC CCTGAGCCGC CGTCAGACGG

251 TAGCGGGCAA TGTCGCAGCA AAGGCGCACC AAGATGGGCG GCAGATCCTC

301 AAAAGGTCGT CTGAACCGCC CCAGATACGC GTCGATTTCG GCAGTGGCGT

351 CCACCAGCGC GGTTTGTGCG ACCTCGCGGT CAATCAGCCC CTCGTTGTTG

401 CGGTCGGTGA GCTGCAAGAC TTCCAGCTCA CCGAAACGCG CAACCATATC

451 CTCAACCGTC GCGTATGCCA TTACTCGACC GCCTTGCGTT GCAGCATAGG

501 CTCGGCGCAG ATTGCCTTCC ACACCGCTTC GCCGACTTCG GCGCGCTTCA

551 CTTCGCGCCA GCCGCCGTCA AACAGCAGGC CGCCGCGCCA AAATTCTTTG

601 CCGTCTGCGC CGGTACTGAC GAGCATCACA TCGCGGCTGT CCGCCAAAGC

651 GTCGGCGGCA CGTTGCGTAT GCTGCACTTT GAGTTCGGCA AGTTCGGCGG

701 ACAGTGCCTT TTTGTCGTCT TCGGCTTTTT CCAAGGCTGT GGTCAGCATT

751 TCGACATCGT TTCGGGCGGC GGCAAGCTCT GCCTGCACGG CGTCCAATTC

801 GGCTTTGATG TCTTCAAACG ACGGGGCGGC GGTTTCGGCG GTTTCTGGTT

851 TGTTGTTGGT TTTTGCCATG ATGACTCCTT GTTTCAGACG GCGGCGGATT

901 CGCATTTGA
```

This corresponds to the amino acid sequence <SEQ ID 2442; ORF 723>:

```
m723.pep
   1 MRPKPRFRRS VIACSISVIT PEHLIFTVYK HNTVFARGHF FAAIIHAQLH

51 FAFGHSTQQV EHVDFVAVAD FVGNQHALSR RQTVAGNVAA KAHQDGRQIL

101 KRSSEPPQIR VDFGSGVHQR GLCDLAVNQP LVVAVGELQD FQLTETRNHI

151 LNRRVCHYST ALRCSIGSAQ IAFHTASPTS ARFTSRQPPS NSRPPRQNSL
```

-continued

```
201 PSAPVLTSIT SRLSAKASAA RCVCCTLSSA SSADSAFLSS SAFSKAVVSI

251 STSFRAAASS ACTASNSALM SSNDGAAVSA VSGLLLVFAM MTPCFRRRRI

301 RI*
``` a723.seq not found yet
a723.pep not found yet g724.seq not found yet
g724.pep not found yet The following partial DNA sequence, shown with its encoded amino acid sequence, was identified in *N. meningitidis* <SEQ ID 2443>:

```
m724.map
    ATGAGTTTGAGTAAATTGGCGAAAAAAACGGCACAAACTGCTAAAAATATCGGCGAAACC
  1 ---------+---------+---------+---------+---------+---------+  60
    TACTCAAACTCATTTAACCGCTTTTTTTGCCGTGTTTGACGATTTTATAGCCGCTTTGG
a   M  S  L  S  K  L  A  K  K  T  A  Q  T  A  K  N  I  G  E  T      -

CTGCGCGCGGCCTTTCGGGGAAAAATCACGCTGGTGGTGTCGTCCGAGCCGATACAGCGC
 61 ---------+---------+---------+---------+---------+---------+ 120
    GACGCGCGCCGGAAAGCCCCTTTTTAGTGCGACCACCACAGCAGGCTCGGCTATGTCGCG
a   L  R  A  A  F  R  G  K  I  T  L  V  V  S  S  E  P  I  Q  R      -

GTGCAGTTGAGCGGCTTGGCCGACGAAACCCTGCAAGACCTTGAACATTTGCAGGAATAC
121 ---------+---------+---------+---------+---------+---------+ 180
    CACGTCAACTCGCCGAACCGGCTGCTTTGGGACGTTCTGGAACTTGTAAACGTCCTTATG
a   V  Q  L  S  G  L  A  D  E  T  L  Q  D  L  E  H  L  Q  E  Y      -

GGCTTTGCCAGCCATCCGCCCGACGGCAGCGAAGCGGTAGTGATACCGCTGGGCGGCAAT
181 ---------+---------+---------+---------+---------+---------+ 240
    CCGAAACGGTCGGTAGGCGGGCTGCCGTCGCTTCGCCATCACTATGGCGACCCGCCGTTA
a   G  F  A  S  H  P  P  D  G  S  E  A  V  V  I  P  L  G  G  N      -

ACTTCGCACGGTGTGATTGTGTGCAGCCAGCACGGCAGCTACCGCATCAAAAACCTTAAG
241 ---------+---------+---------+---------+---------+---------+ 300
    TGAAGCGTGCCACACTAACACACGTCGGTCGTGCCGTCGATGGCGTAGTTTTTGGAATTC
a   T  S  H  G  V  I  V  C  S  Q  H  G  S  Y  R  I  K  N  L  K      -

CCCGGCGAGACGGCGATTTTTAATCATGAGGGTGCAAAAATCGTGATTAAGCAAGGCAAA
301 ---------+---------+---------+---------+---------+---------+ 360
    GGGCCGCTCTGCCGCTAAAAATTAGTACTCCCACGTTTTTAGCACTAATTCGTTCCGTTT
a   P  G  E  T  A  I  F  N  H  E  G  A  K  I  V  I  K  Q  G  K      -

ATCATTGAGGCCGATTGCGACGTGTACCGGGTTAACTGCAAACAATACGAGGTTAATGCG
361 ---------+---------+---------+---------+---------+---------+ 420
    TAGTAACTCCGGCTAACGCTGCACATGGCCCAATTGACGTTTGTTATGCTCCAATTACGC
a   I  I  E  A  D  C  D  V  Y  R  V  N  C  K  Q  Y  E  V  N  A      -

GCCACGGATGCCAAATTTAACGCTCCGTTGGTGGAGACCAGTGCAGTGTTGACGGCGCAA
421 ---------+---------+---------+---------+---------+---------+ 480
    CGGTGCCTACGGTTTAAATTGCGAGGCAACCACCTCTGGTCACGTCACAACTGCCGCGTT
a   A  T  D  A  K  F  N  A  P  L  V  E  T  S  A  V  L  T  A  Q      -

GGCCAAATCAACGGCAACGGCGGCATGGCCGTCGAGGGCGGCGACGGAGCCACCTTTAGC
481 ---------+---------+---------+---------+---------+---------+ 540
    CCGGTTTAGTTGCCGTTGCCGCCGTACCGGCAGCTCCCGCCGCTGCCTCGGTGGAAATCG
a   G  Q  I  N  G  N  G  G  M  A  V  E  G  G  D  G  A  T  F  S      -

GGCGATGTTAACCAAACGGGCGGCAGCTTTAACACCGACGGCGACGTGGTGGCCGGCAAT
541 ---------+---------+---------+---------+---------+---------+ 600
    CCGCTACAATTGGTTTGCCCGCCGTCGAAATTGTGGCTGCCGCTGCACCACCGGCCGTTA
a   G  D  V  N  Q  T  G  G  S  F  N  T  D  G  D  V  V  A  G  N      -

ATATCGTTGCGCCAGCACCCGCATACCGACAGCATCGGCGGCAAAACCTTACCGGCGGAA
601 ---------+---------+---------+---------+---------+---------+ 660
    TATAGCAACGCGGTCGTGGGCGTATGGCTGTCGTAGCCGCCGTTTTGGAATGGCCGCCTT
a   I  S  L  R  Q  H  P  H  T  D  S  I  G  G  K  T  L  P  A  E      -

CCGGCATAG
661 ---------                                                     669
    GGCCGTATC
a   P  A  *                                                         -
```

-continued

```
Enzymes that do cut: NONE
Enzymes that do not cut: BamHI BglII EcoRI HindIII KpnI NdeI NheI
PstI SacI SalI SmaI SphI XbaI XhoI
```

This corresponds to the amino acid sequence <SEQ ID 2444; ORF 724>:

```
m724.pep
    1 MSLSKLAKKT AQTAKNIGET LRAAFRGKIT LVVSSEPIQR VQLSGLADET

51 LQDLEHLQEY GFASHPPDGS EAVVIPLGGN TSHGVIVCSQ HGSYRIKNLK

101 PGETAIFNHE GAKIVIKQGK IIEADCDVYR VNCKQYEVNA ATDAKFNAPL

151 VETSAVLTAQ GQINGNGGMA VEGGDGATFS GDVNQTGGSF NTDGDVVAGN

201 ISLRQHPHTD SIGGKTLPAE PA*
```

The following partial DNA sequence was identified in *N. meningitidis* <SEQ ID 2445>:

```
a724.seq
    1 ATGAGTTTGA GTAAATTGGC GAAAAAAACG GCACAAACTG CTAAAAATAT

51 CGGCGAAACC CTGCGCGCGG CCTTTCGGGG AAAAATCACG CTGGTGGTGT

101 CGTCCGAGCC GATACAGCGC GTGCAGTTGA GCGGCTTGGC CGACGAAACC

151 CTGCAAGACC TTGAACATTT GCAGGAATAC GGCTTTGCCA GCCATCCGCC

201 CGACGGCAGC GAAGCGGTAG TGATACCGCT GGGCGGCAAT ACTTCGCACG

251 GTGTGATTGT GTGCAGCCAG CACGGCAGCT ACCGCATCAA AAACCTTAAG

301 CCCGGCGAGA CGGCGATTTT TAATCATGAG GGTGCAAAAA TCGTGATTAA

351 GCAAGGCAAA ATCATTGAGG CCGATTGCGA CGTGTACCGG GTTAACTGCA

401 AACAATACGA GGTTAATGCG GCCACGGATG CCAAATTTAA CGCTCCGTTG

451 GTGGAGACCA GTGCAGTGTT GACGGCGCAA GGCCAAATCA ACGGCAACGG

501 CGGCATGGCC GTCGAGGGCG GCGACGGAGC CACCTTTAGC GGCGATGTTA

551 ACCAAACGGG CGGCAGCTTT AACACCGACG GCGACGTGGT GGCCGGCAAT

601 ATATCGTTGC GCCAGCACCC GCATACCGAC AGCATCGGCG GCAAAACCTT

651 ACCGGCGGAA CCGGCATAG
```

This corresponds to the amino acid sequence <SEQ ID 2446; ORF 724.a>:

```
a724.pep
    1 MSLSKLAKKT AQTAKNIGET LRAAFRGKIT LVVSSEPIQR VQLSGLADET

51 LQDLEHLQEY GFASHPPDGS EAVVIPLGGN TSHGVIVCSQ HGSYRIKNLK

101 PGETAIFNHE GAKIVIKQGK IIEADCDVYR VNCKQYEVNA ATDAKFNAPL

151 VETSAVLTAQ GQINGNGGMA VEGGDGATFS GDVNQTGGSF NTDGDVVAGN

201 ISLRQHPHTD SIGGKTLPAE PA*
``` a724/m724 100.0% identity in 222 aa overlap

```
                      10         20         30         40         50         60
       a724.pep   MSLSKLAKKTAQTAKNIGETLRAAFRGKITLVVSSEPIQRVQLSGLADETLQDLEHLQEY
                  ||||||||||||||||||||||||||||||||||||||||||||||||||||||||||||
           m724   MSLSKLAKKTAQTAKNIGETLRAAFRGKITLVVSSEPIQRVQLSGLADETLQDLEHLQEY
                      10         20         30         40         50         60
```

```
                          70        80        90       100       110       120
a724.pep       GFASHPPDGSEAVVIPLGGNTSHGVIVCSQHGSYRIKNLKPGETAIFNHEGAKIVIKQGK
               ||||||||||||||||||||||||||||||||||||||||||||||||||||||||||||
m724           GFASHPPDGSEAVVIPLGGNTSHGVIVCSQHGSYRIKNLKPGETAIFNHEGAKIVIKQGK
                          70        80        90       100       110       120

130       140       150       160       170       180
a724.pep       IIEADCDVYRVNCKQYEVNAATDAKFNAPLVETSAVLTAQGQINGNGGMAVEGGDGATFS
               ||||||||||||||||||||||||||||||||||||||||||||||||||||||||||||
m724           IIEADCDVYRVNCKQYEVNAATDAKFNAPLVETSAVLTAQGQINGNGGMAVEGGDGATFS
                         130       140       150       160       170       180

190       200       210       220
a724.pep       GDVNQTGGSFNTGDGVVAGNISLRQHPHTDSIGGKTLPAEPAX
               ||||||||||||||||||||||||||||||||||||||||||
m724           GDVNQTGGSFNTGDVVAGNISLRQHPHTDSIGGKTLPAEPAX
                         190       200       210       220 g725.seq not found yet
g725.pep not found yet
```

The following partial DNA sequence was identified in *N. meningitidis* <SEQ ID 2447>:

```
m725.seq
   1 ATGGTGCGCA CGGTTAAAAG CTACAACGGC GAGGCCGACG ATTTGGCGGG

51 GCAAATCCAT ACGCTGCCTG CGGTTTGGGT AACGTATGGC GGCAGCAAAG

101 TTGAGCCTGC CAGCACCGGC GGCGTATGCG GACGTTATCA GGATACCGCC

151 GAATTTGTGG TGATGGTGGC GGCCCGCAAT CTGCGCAACG AGCAGGCGCA

201 GCGGCAAGGC GGCATCGACA GCCGCGAAAT CGGCAGCAAC GATTTAATCC

251 GCGCTGTTCG CCGCCTGCTT GACGGCCAGC GGCTCGGTTT TGCCGATAGC

301 CGCGGCTTGG TGCCCAAAGC GGTGCGCGCG ATTGCCAATC ATGTGCTGGT

351 GCAAAACGCC GCAGTAAGCA TATATGCGGT TGAGTATGCC ATCCGCTTTA

401 ACACCTGCGG GTTGGAAAAT GACCGCTACC CCGAACGCAC CGACAATCCC

451 GACGACCCCA ACCATATCTT TACCAAGTAT CAGGGTACAT TGAGCGAGCC

501 GTGGCCTGAT TTCGAGGGGT TGGACGGCAA AATTTACGAC CCGCAATCCG

551 CCGATGAAAT ACCTGTAAAC CTAACCCTTA AGGATAAGCA ATGA
```

This corresponds to the amino acid sequence <SEQ ID 2448; ORF 725>:

```
m725.pep
   1 MVRTVKSYNG EADDLAGQIH TLPAVWVTYG GSKVEPASTG GVCGRYQDTA

51 EFVVMVAARN LRNEQAQRQG GIDSREIGSN DLIRAVRRLL DGQRLGFADS

101 RGLVPKAVRA IANHVLVQNA AVSIYAVEYA IRFNTCGLEN DRYPERTDNP

151 DDPNHIFTKY QGTLSEPWPD FEGLDGKIYD PQSADEIPVN LTLKDKQ* a725.seq not found yet a725.pep not found yet g726.seq not found yet g726.pep not found yet
```

The following partial DNA sequence was identified in *N. meningitidis* <SEQ ID 2449>:

```
m726.seq
   1 ATGACCATCT ATTTCAAAAA CGGCTTTTAC GACGACACAT TGGGCGGCAT

51 CCCCGAAGGC GCGGTTGCCG TCCGCGCCGA AGAATACGCC GCCCTTTTGG
```

-continued

```
101 CAGGACAGGC GCAGGGCGGG CAGATTGCCG CAGATTCCGA CGGCCGCCCC

151 GTTTTAACCC CGCCGCGCCC GTCCGATTAC CACGAATGGG ACGGCAAAAA

201 ATGGAAAATC AGCAAAGCCG CCGCCGCCGC CCGTTTCGCC AAACAAAAAA

251 CCGCCTTGGC ATTCCGCCTC GCGGAAAAGG CGGACGAACT CAAAAACAGC

301 CTCTTGGCGG GCTATCCCCA AGTGGAAATC GACAGCTTTT ACAGGCAGGA

351 AAAAGAAGCC CTCGCGCGGC AGGCGGACAA CAACGCCCCG ACCCCGATGC

401 TGGCGCAAAT CGCCGCCGCA AGGGGCGTGG AATTGGACGT TTTGATTGAA

451 AAAGTTATCG AAAAATCCGC CGCCTGGCT GTTGCCGCCG GCGCGATTAT

501 CGGAAAGCGT CAGCAGCTCG AAGACAAATT GAACACCATC GAAACCGCGC

551 CCGGATTGGA CGCGCTGGAA AAGGAAATCG AAGAATGGAC GCTAAACATC

601 GGCTGA
```

This corresponds to the amino acid sequence <SEQ ID 2450; ORF 726>:

```
m726.pep
  1 MTIYFKNGFY DDTLGGIPEG AVAVRAEEYA ALLAGQAQGG QIAADSDGRP

51 VLTPPRPSDY HEWDGKKWKI SKAAAAARFA KQKTALAFRL AEKADELKNS

101 LLAGYPQVEI DSFYRQEKEA LARQADNNAP TPMLAQIAAA RGVELDVLIE

151 KVIEKSARLA VAAGAIIGKR QQLEDKLNTI ETAPGLDALE KEIEEWTLNI

201 G*
```

The following partial DNA sequence was identified in *N. meningitidis* <SEQ ID 2451>:

```
a726.seq
  1 ATGACCATCT ATTTCAAAAA CGGCTTTTAC GACGACACCT TGGGCAGCAT

51 CCCCGAAGGC GCGGTTGCCG TCCGCGCCGA AGAATACGCC GCCCTTTTGG

101 CAGGACAGGC GCAGGGCGGG CAGATTGCCG CAGATTCCGA CGGCCGCCCC

151 GTTTTAACCC CGCCGCGCCC GTCCGAATAC CACGAATGGG ACGGCAAGAA

201 ATGGGAAATC GGCGAAGCCG CTGCCGCCGC CCGTTTCGCC GAACAAAAAA

251 CCGCCACGGC ATTCCGCCTC GCGGCAAAGG CGGACGAACT CAAAAACAGC

301 CTCTTGGCGG GCTATCCCCA AGTGGAAATC GACAGCTTTT ACAGGCAGGA

351 AAAAGAAGCC CTCGCGCGGC AGGCGGACAA CAACGCCCCG ACCCCGATGC

401 TGGCGCAAAT CGCCGCCGCA AGGGGCGTGG AATTGGACGT TTTGATTGAA

451 AAAGTTGTCG AAAAATCCGC CGCCTGGCC GTTGCCGCCG GCGCGATTAT

501 CGGAAAGCGG CAGCAGCTCG AAGACAAATT GAACACCATC GAAACCGCGC

551 CAGGATTGGA CGCGCTGGAA AAGGAAATCG AAGAATGGAC GCTAAACATC

601 GGCTGA
```

This corresponds to the amino acid sequence <SEQ ID 2452; ORF 726.a>:

```
a726.pep
  1 MTIYFKNGFY DDTLGSIPEG AVAVRAEEYA ALLAGQAQGG QIAADSDGRP

51 VLTPPRPSEY HEWDGKKWEI GEAAAARFA EQKTATAFRL AAKADELKNS
```

```
101 LLAGYPQVEI DSFYRQEKEA LARQADNNAP TPMLAQIAAA RGVELDVLIE

151 KVVEKSARLA VAAGAIIGKR QQLEDKLNTI ETAPGLDALE KEIEEWTLNI

201 G*
``` a726/m726 95.5% identity in 201 aa overlap

```
                   10         20         30         40         50         60
     a726.pep  MTIYFKNGFYDDTLGSIPEGAVAVRAEEYAALLAGQAQGGQIAADSDGRPVLTPPRPSEY
               ||||||||||||||:||||||||||||||||||||||||||||||||||||||||||:|
     m726      MTIYFKNGFYDDTLGGIPEGAVAVRAEEYAALLAGQAQGGQIAADSDGRPVLTPPRPSDY
                   10         20         30         40         50         60

70         80         90        100        110        120
     a726.pep  HEWDGKKWEIGEAAAAARFAEQKTATAFRLAAKADELKNSLLAGYPQVEIDSFYRQEKEA
               ||||||||:|::||||||:||| |||||:|||||||||||||||||||||||||||||||
     m726      HEWDGKKWKISKAAAAARFAKQKTALAFRLAEKADELKNSLLAGYPQVEIDSFYRQEKEA
                   70         80         90        100        110        120

130        140        150        160        170        180
     a726.pep  LARQADNNAPTPMLAQIAAARGVELDVLIEKVVEKSARLAVAAGAIIGKRQQLEDKLNTI
               |||||||||||||||||||||||||||||||:||||||||||||||||||||||||||||
     m726      LARQADNNAPTPMLAQIAAARGVELDVLIEKVIEKSARLAVAAGAIIGKRQQLEDKLNTI
                  130        140        150        160        170        180

190        200
     a726.pep  ETAPGLDALEKEIEEWTLNIGX
               ||||||||||||||||||||||
     m726      ETAPGLDALEKEIEEWTLNIGX
                  190        200 g727.seq not found yet g727.pep not found yet
```

The following partial DNA sequence was identified in *N. meningitidis* <SEQ ID 2453>:

```
m727.seq
   1 ATGAATCTCG TGAAACTGCT GGCGAATAAC TGGCAACCGA TTGCCATTAT

51 CGCGCTTGTC GGCACGGGCT TGGCTGTGTC GCACCATCAA GGCTACAAGT

101 CGGCATTTGC GAAGCAGCAG GCGGTCATCG ACAAGATGGA GCGCGACAAG

151 GCGCAAGCCC TGCTGTTGTC GGCTCAAAAC TATGCGCGCG AACTGGAACT

201 GGCACGCGCG GAAGCTAAAA AATATGAAGT CAAGGCGCAC GCTGTCGGCA

251 TGGCTTTGGC GAAAAAACAG GCGGAAGTCA GCCGTCTGAA AACGGAAAGA

301 GACCTTTGCA AAATTCCTTT CCCTCCCGAC AGCCGAAACC CAAACACAGG

351 TTTTCGGCTG TTTTCGCCCC AAATACCGCC TAATTTTACC CAAATACCCC

401 CTTAA
```

This corresponds to the amino acid sequence <SEQ ID 2454; ORF 727>:

```
m727.pep
   1 MNLVKLLANN WQPIAIIALV GTGLAVSHHQ GYKSAFAKQQ AVIDKMERDK

51 AQALLLSAQN YARELELARA EAKKYEVKAH AVGMALAKKQ AEVSRLKTER

101 DLCKIPFPPD SRNPNTGFRL FSPQIPPNFT QIPP*
```

The following partial DNA sequence was identified in *N. meningitidis* <SEQ ID 2455>:

```
a727.seq
   1 ATGAATCTCG TGAAACTGCT GGCGAATAAC TGGCAACCGA TTGCCATCAT

51 CGCGCTTGTC GGCACGGGTT TGGCGGTGTC GCACCATCAA GGCTACAAGT

101 CGGCTTTTGC GAAGCAGCAG GCGGTCATTG AGAAAATGAA GCGCGACAAG

151 GCGCAAGCCC TGCTGTTGTC GGCTCAAAAC TACGCCCGCG AACTGGAACA

201 GGCGCGTGCG GAAGCTAAAA AATATGAAGT CAAGGCGCAC GCCGTCGGCA

251 TGGCTTTGGC GAAAAAACAG GCGGAAGTCA GCCGTCTGAA AACGGAAAAT

301 AAAAAGGAAA TCGAAAATGT CCTTACTCAA GACCGTAAAA ATGCAGGCGG

351 CGGTTGTATT GACGGCTTTG GCCATCACGG CTTGCAGCTC TACAAGCGCG

401 CCCTCGGCTA CGGAAATTAA
```

This corresponds to the amino acid sequence <SEQ ID 2456; ORF 727.a>:

```
a727.pep
   1 MNLVKLLANN WQPIAIIALV GTGLAVSHHQ GYKSAFAKQQ AVIEKMKRDK

51 AQALLLSAQN YARELEQARA EAKKYEVKAH AVGMALAKKQ AEVSRLKTEN

101 KKEIENVLTQ DRKNAGGGCI DGFGHHGLQL YKRALGYGN*
``` a727/m727 83.2% identity in 119 aa overlap

```
                  10         20         30         40         50         60
     a727.pep  MNLVKLLANNWQPIAIIALVGTGLAVSHHQGYKSAFAKQQAVIEKMKRDKAQALLLSAQN
               ||||||||||||||||||||||||||||||||||||||||||:|||||||||||||||
         m727  MNLVKLLANNWQPIAIIALVGTGLAVSHHQGYKSAFAKQQAVIDKMERDKAQALLLSAQN
                  10         20         30         40         50         60

70         80         90        100        110        119
     m717.pep  YARELEQARAEAKKYEVKAHAVGMALAKKQAEVSRLKTENKKEIENV-LTQDRKNAGGGC
               ||||| ||||||||||||||||||||||||||||||||| ::  ::  :  | :| : |
         g717  YARELELARAEAKKYEVKAHAVGMALAKKQAEVSRLKTE--RDLCKIPFPPDSRNPNTGF
                         70         80         90        100        110

120        130        140
     m717.pep    IDGFGHHGLQLYKRALGYGNX
         g717    RLFSPQIPPNFTQIPPX
                 120        130
```

The following partial DNA sequence was identified in *N. gonorrhoeae* <SEQ ID 2457>:

```
g728.seq
   1 ATGTTTAAAA AATTCAAACC GGTACTGTTG TCATTTTTTG CACTTGTATT

51 TGCCTTTTGG CTGGGAACAG GTATTGCCTA TGAGATTAAT CCGCGTTGGT

101 TTTTGAGCGA TACGGCAACT GAAGTACCTG AAAATCCGAA TGCTTTTGTG

151 GCGAAACTTG CCCGCCTGTT CCGAAATGCC GACAGGGCGG TTGTCATCGT

201 GAAGGAATCG ATGAGGACGG AGGAAAGCCT TGCCGGAGCT GTGGATGACG

251 GTCCGTTGCA GTCGGAGAAG GATTATCTCG CGCTCGCTAT CCGGCTCAGT

301 CGTTTGAAAG AAAAGGCGAA ATGGTTTCAC GTAACGGAGC AGGAACATGG

351 GGAAGAGGTT TGGCTGGATT ACTATATCGG CGAGGGCGGT TTGGTTGCGG

401 TTTCGCTTTC GCAACGCTCG CCGGAAGCGT TTGTTAATGC CGAATATCTG

451 TATCGGAACG ATCGTCCGTT TTCTGTAAAT GTGTACGGCG GAACGGCTCA
```

-continued

```
 501 CGGGGAAAAT TATGAAACGA CAGGAGAATA TCGGGTTGTT TGGCAACCGG

551 ACGGTTCGGT ATTTGATGCG GCGGGCGCG  GGAAAATCGG GGAAGATGTT

601 TATGAGCATT GCCTCGGGTG TTATCAGATG GCCCAGGTAT ATTTGGCGAA

651 ATACCGGGAT GTCGCGAATG ACGAGCAGAA GGTTTGGGAC TTCCGCGAAG

701 AGAGCAACCG GATTGCATCG GACTCGCGCG ATTATGTGTT TTATCAGAAT

751 ATGCGGGAAT TGATGCCCCG GGGGATGAAG GCGAACAGTC TTGTGGTCGG

801 CTATGATGCG GACGGTCTGC CGCAAAAAGT CTATTGGAGT TTCGACAATG

851 GAAAAAAACG CCAGAGTTTC GAATATTATT TGAAAAACGG AAATCTTTTT

901 ATTGCACAAT CTTCGACGGT AGCATTGAAA GCGGATGGCG TAACGGCGGA

951 TATGCAGACC TATCATGCGC AACAGACGTG GTATTTGGAT GGCGGGCGGA

1001 TTATCCGCGA AGAGAAACAG GGAGACAGAC TGCCTGATTT TCCTTTGAAC

1051 TTGGAAGATT TGGAAAAAGA GGTGAGCCGT TATGCAGAGG CTGCGGCGAG

1101 ACGTTCGGGC GGCAGGCGCG GCCTTTCTCA CTGA
```

This corresponds to the amino acid sequence <SEQ ID 2458; ORF 728>:

```
g728.pep
   1 MFKKFKPVLL SFFALVFAFW LGTGIAYEIN PRWFLSDTAT EVPENPNAFV

51 AKLARLFRNA DRAVVIVKES MRTEESLAGA VDDGPLQSEK DYLALAIRLS

101 RLKEKAKWFH VTEQEHGEEV WLDYYIGEGG LVAVSLSQRS PEAFVNAEYL

151 YRNDRPFSVN VYGGTAHGEN YETTGEYRVV WQPDGSVFDA AGRGKIGEDV

201 YEHCLGCYQM AQVYLAKYRD VANDEQKVWD FREESNRIAS DSRDYVFYQN

251 MRELMPRGMK ANSLVVGYDA DGLPQKVYWS FDNGKKRQSF EYYLKNGNLF

301 IAQSSTVALK ADGVTADMQT YHAQQTWYLD GGRIIREEKQ GDRLPDFPLN

351 LEDLEKEVSR YAEAAARRSG GRRGLSH*
```

The following partial DNA sequence was identified in *N. meningitidis* <SEQ ID 2459>:

```
m728.seq
   1 ATGTTTAAAA AATTCAAACC GGTACTGTTG TCATTTTTTG CACTTGTATT

51 TGCCTTTTGG CTGGGAACGG GTATTGCCTA TGAGATTAAT CCGCGTTGGT

101 TTTTGAGCGA TACGGCAACT GAAGTACCTA AAAATCCGAA TGCTTTTGTG

151 GCGAAACTTG CCCGCCTGTT CCGAAATGCC GACAGGGCGG TTGTCATCGT

201 GAAGGAATCG ATAAGGACGG AGGAAAATCT TGCCGGAACT GTGGATGACG

251 GTCCGTTGCA GTCGGAGAAG GATTATCTCG CGCTCGCTAT CCGGCTCAGT

301 CGTTTGAAAG AAAAGGCGAA ATGGTTTCAC GTAACGGAGC AGGAACATGG

351 GAAAGAGGTT TGGCTGGATT ACCATATCGG CGAGGGCGGT TTGGTTGCGG

401 TTTCGCTTTC GCAACGCTCG CCGGAAGCAT TGTTAATGC  CGAATATCTG

451 TATCGGAACG ATCGTCCGTT TTCTGTAAAT GTGTACGGCG GAACGGTTCA

501 CGGGGAAAAT TATGAAACGA CAGGAGAATA TCGGGTTGTT TGGCAACCAG

551 ACGGTTCGGT ATTTGATGCG GCGGGCGCG  GGAAAATCGG GGAAGATGTT

601 TATGAGCATT GCCTCGGGTG TTATCAGATG GCCCAGGTAT ATTTGGCGAA
```

```
 651 ATACCGGGAT GTCGCGAATG ACGAGCAGAA GGTTTGGGAC TTCCGCAAAG

701 AGAGCAACCG AATTGCGTCG GACTCGCGCA ATTCTGTGTT TTATCAGAAT

751 ATGCGGGAAT TGATGCCCCG AGGGATGAAG GCGAACAGTC TTGTGGTCGG

801 CTATGATGCG GACGGTCTGC CGCAAAAAGT CTATTGGAGT TTCGACAATG

851 GAAAAAAACG CCAGAGTTTC GAATATTATT TGAAAAACGG AAATCTTTTT

901 ATTGCACAAT CTTCGACGGT AGCATTGAAA GCGGATGGCG TAACGGCGGA

951 TATGCAGACC TATCATGCGC AACAGACGTG GTATTTGGAT GGCGGGCGGA

1001 TTGTCCGCGA AGAGAAACAG GGAGACAGAC TGCCTGATTT TCCTTTGAAC

1051 TTGGAAAATT TGGAAAAGA GGTGCGCCGT TATGCAGAGG CTGCGGCGAG

1101 ACGTTCGGGC GGCAGGCGCG ACCTTTCTCA CTGA
```

This corresponds to the amino acid sequence <SEQ ID 2460; ORF 728>:

```
m728.pep
  1 MFKKFKPVLL SFFALVFAFW LGTGIAYEIN PRWFLSDTAT EVPKNPNAFV

51 AKLARLFRNA DRAVVIVKES IRTEENLAGT VDDGPLQSEK DYLALAIRLS

101 RLKEKAKWFH VTEQEHGKEV WLDYHIGEGG LVAVSLSQRS PEAFVNAEYL

151 YRNDRPFSVN VYGGTVHGEN YETTGEYRVV WQPDGSVFDA AGRGKIGEDV

201 YEHCLGCYQM AQVYLAKYRD VANDEQKVWD FRKESNRIAS DSRNSVFYQN

251 MRELMPRGMK ANSLVVGYDA DGLPQKVYWS FDNGKKRQSF EYYLKNGNLF

301 IAQSSTVALK ADGVTADMQT YHAQQTWYLD GGRIVREEKQ GDRLPDFPLN

351 LENLEKEVRR YAEAAARRSG GRRDLSH*
```

Computer analysis of the amino acid sequences gave the following results:
Homology with a Predicted ORF from *N. meningitidis* menA with menB ORF 728 shows 96.3% identity over a 377 aa overlap with a predicted ORF (ORF728.a) from *N. gonorrhoeae*:

```
m728/g728

10         20         30         40         50         60
    m728.pep  MFKKFKPVLLSFFALVFAFWLGTGIAYEINPRWFLSDTATEVPKNPNAFVAKLARLFRNA
              ||||||||||||||||||||||||||||||||||||||||||:|||||||||||||||||
    g728      MFKKFKPVLLSFFALVFAFWLGTGIAYEINPRWFLSDTATEVPENPNAFVAKLARLFRNA
                   10         20         30         40         50         60

70         80         90        100        110        120
    m728.pep  DRAVVIVKESIRTEENLAGTVDDGPLQSEKDYLALAIRLSRLKEKAKWFHVTEQEHGKEV
              |||||||||:||||:|||:|||||||||||||||||||||||||||||||||||||||:||
    g728      DRAVVIVKESMRTEESLAGAVDDGPLQSEKDYLALAIRLSRLKEKAKWFHVTEQEHGEEV
                   70         80         90        100        110        120

130        140        150        160        170        180
    m728.pep  WLDYHIGEGGLVAVSLSQRSPEAFVNAEYLYRNDRPFSVNVYGGTVHGENYETTGEYRVV
              ||||:|||||||||||||||||||||||||||||||||||||||||:|||||||||||||
    g728      WLDYYIGEGGLVAVSLSQRSPEAFVNAEYLYRNDRPFSVNVYGGTAHGENYETTGEYRVV
                  130        140        150        160        170        180

190        200        210        220        230        240
    m728.pep  WQPDGSVFDAAGRGKIGEDVYEHCLGCYQMAQVYLAKYRDVANDEQKVWDFRKESNRIAS
              |||||||||||||||||||||||||||||||||||||||||||||||||||:||||||
    g728      WQPDGSVFDAAGRGKIGEDVYEHCLGCYQMAQVYLAKYRDVANDEQKVWDFREESNRIAS
                  190        200        210        220        230        240
```

```
                    250        260        270        280        290        300
m728.pep   DSRNSVFYQNMRELMPRGMKANSLVVGYDADGLPQKVYWSFDNGKKRQSFEYYLKNGNLF
           |||:||||||||||||||||||||||||||||||||||||||||||||||||||||||
g728       DSRDYVFYQNMRELMPRGMKANSLVVGYDADGLPQKVYWSFDNGKKRQSFEYYLKNGNLF
                    250        260        270        280        290        300

310        320        330        340        350        360
m728.pep   IAQSSTVALKADGVTADMQTYHAQQTWYLDGGRIVREEKQGDRLPDFPLNLENLEKEVRR
           |||||||||||||||||||||||||||||||||:|||||||||||||||||:||||| |
g728       IAQSSTVALKADGVTADMQTYHAQQTWYLDGGRIIREEKQGDRLPDFPLNLEDLEKEVSR
                    310        320        330        340        350        360

370
m728.pep   YAEAAARRSGGRRDLSHX
           ||||||||||||| ||||
g728       YAEAAARRSGGRRGLSHX
                    370
```

The following partial DNA sequence was identified in *N. meningitidis* <SEQ ID 2461>:

```
a728.seq
    1 ATGTTTAAAA AATTCAAACC GGTACTGTTG TCATTTTTTG CACTTGTATT

51 TGCCTTTTGG CTGGGAACGG GTATTGCCTA TGAGATTAAT CCGCGTTGGT

101 TTTTGAGCGA TACGGCAACT GAAAATCCGA ATGCTTTTGT GGCGAAACTT

151 GCCCGCCTGT TCCGAAATGC CGACAGGGCG GTTGTCATCG TGAAGGAATC

201 GATGAGGACG GAGGAAAGTC TTGCCGGAGC TGTGGATGAC GGTCCGTTGC

251 AGTCGGAGAA GGATTATCTT GCACTCGCTG TCCGGCTCAG TCGTTTGAAA

301 GAAAAGGCGA ATGGTTTCA CGTAACGGAG CAGGAACATG GGAAGAGGT

351 TTGGCTGGAT TACTATATCG GCGAGGGCGG TTTGGTTGCG GTTTCGCTTT

401 CGCAACGCTC GCCGGAAGCG TTTGTTAATG CCGAATATCT GTATCGGAAC

451 GATCGTCCGT TTTCTGTAAA TGTGTACGGC GGAACGGTTC ACGGGGAAAA

501 TTATGAAACG ACAGGAGAAT ATCGGGTTGT TTGGCAACCG GACGGTTCGG

551 TATTTGATGC GTCGGGCGC GGGAAAATCG GGGAAGATGT TTATGAGCAT

601 TGCCTCGGGT GTTATCAGAT GGCCCAGGTA TATTTGGCGA AATATCGGGA

651 TGTCGCGAAT GATGAGCAGA AGGTTTGGGA CTTCCGCGAA GAGAGTAACC

701 GGATTGCGTC GGACTCGCGC GATTCTGTGT TTTATCAGAA TATGCGGGAA

751 TTGATGCCCC GAGGGATGAA GGCAAACAGT CTTGTGGTCG GCTATGATGC

801 GGACGGTCTG CCGCAGAAAG TCTATTGGAG TTTCGACAAT GGGAAAAAAC

851 GCCAGAGTTT CGAATATTAT TTGAAAAACG GAAATCTTTT TATTGCACAA

901 TCTTCGACGG TAGCATTGAA AGCGGATGGC GTAACGGCGG ATATGCAGAC

951 CTATCATGCG CAACAGACGT GGTATTTAGA TGGCGGGCGG ATTGTCCGCG

1001 AAGAGAAACA GGGGGACAGA CTGCCTGATT TTCCTTTGAA CTTGGAAGAT

1051 TTGGAAAAAG AGGTGAGCCG TTATGCAGAG GCTGCGGCGA GACGTTCGGG

1101 CGGCAGGCGC GACCTTTCTC ACTGA
```

This corresponds to the amino acid sequence <SEQ ID 2462; ORF 728.a>:

```
a728.pep
     1 MFKKFKPVLL SFFALVFAFW LGTGIAYEIN PRWFLSDTAT ENPNAFVAKL

51 ARLFRNADRA VVIVKESMRT EESLAGAVDD GPLQSEKDYL ALAVRLSRLK
```

-continued

```
101 EKAKWFHVTE QEHGEEVWLD YYIGEGGLVA VSLSQRSPEA FVNAEYLYRN

151 DRPFSVNVYG GTVHGENYET TGEYRVVWQP DGSVFDASGR GKIGEDVYEH

201 CLGCYQMAQV YLAKYRDVAN DEQKVWDFRE ESNRIASDSR DSVFYQNMRE

251 LMPRGMKANS LVVGYDADGL PQKVYWSFDN GKKRQSFEYY LKNGNLFIAQ

301 SSTVALKADG VTADMQTYHA QQTWYLDGGR IVREEKQGDR LPDFPLNLED

351 LEKEVSRYAE AAARRSGGRR DLSH*
``` a728/m728 96.3% identity in 377 aa overlap

```
                  10        20        30        40        50
a728.pep   MFKKFKPVLLSFFALVFAFWLGTGIAYEINPRWFLSDTATE---NPNAFVAKLARLFRNA
           |||||||||||||||||||||||||||||||||||||||||   ||||||||||||||||
m728       MFKKFKPVLLSFFALVFAFWLGTGIAYEINPRWFLSDTATEVPKNPNAFVAKLARLFRNA
                  10        20        30        40        50        60

60        70        80        90       100       110
a728.pep   DRAVVIVKESMRTEESLAGAVDDGPLQSEKDYLALAVRLSRLKEKAKWFHVTEQEHGEEV
           ||||||||||:||||:|||:||||||||||||||||||:|||||||||||||||||||:|
m728       DRAVVIVKESIRTEENLAGTVDDGPLQSEKDYLALAIRLSRLKEKAKWFHVTEQEHGKEV
                  70        80        90       100       110       120

120       130       140       150       160       170
a728.pep   WLDYYIGEGGLVAVSLSQRSPEAFVNAEYLYRNDRPFSVNVYGGTVHGENYETTGEYRVV
           ||||:|||||||||||||||||||||||||||||||||||||||||||||||||||||||
m728       WLDYHIGEGGLVAVSLSQRSPEAFVNAEYLYRNDRPFSVNVYGGTVHGENYETTGEYRVV
                  130       140       150       160       170       180

180       190       200       210       220       230
a728.pep   WQPDGSVFDASGRGKIGEDVYEHCLGCYQMAQVYLAKYRDVANDEQKVWDFREESNRIAS
           ||||||||||:|||||||||||||||||||||||||||||||||||||||||:|||||||
m728       WQPDGSVFDAAGRGKIGEDVYEHCLGCYQMAQVYLAKYRDVANDEQKVWDFRKESNRIAS
                  190       200       210       220       230       240

240       250       260       270       280       290
a728.pep   DSRDSVFYQNMRELMPRGMKANSLVVGYDADGLPQKVYWSFDNGKKRQSFEYYLKNGNLF
           |||:||||||||||||||||||||||||||||||||||||||||||||||||||||||||
m728       DSRNSVFYQNMRELMPRGMKANSLVVGYDADGLPQKVYWSFDNGKKRQSFEYYLKNGNLF
                  250       260       270       280       290       300

300       310       320       330       340       350
a728.pep   IAQSSTVALKADGVTADMQTYHAQQTWYLDGGRIVREEKQGDRLPDFPLNLEDLEKEVSR
           |||||||||||||||||||||||||||||||||||||||||||||||||||:|||| |
m728       IAQSSTVALKADGVTADMQTYHAQQTWYLDGGRIVREEKQGDRLPDFPLNLENLEKEVRR
                  310       320       330       340       350       360

360       370
a728.pep   YAEAAARRSGGRRDLSHX
           ||||||||||||||||||
m728       YAEAAARRSGGRRDLSHX
                  370
```

The following partial DNA sequence was identified in *N. gonorrhoeae* <SEQ ID 2463>:

```
g729.seq
    1 ATGAATACTA CATTGAAAAC TACCTTGACC TCTGTTGCAG CAGCCTTTGC

51 ATTGTCTGCC TGCACCATGA TTCCTCAATA CGAGCAGCCC AAAGTCGAAG

101 TTGCGGAAAC CTTCCAAAAC GACACATCGG TTTCTTCCAT CCGCGCGGTT

151 GATTTGGGTT GGCATGACTA TTTTGCCGAC CCGCGCCTGC AAAAGCTGAT

201 CGACATCGCA CTCGAGCGCA ATACCAGTTT GCGTACAGCC GTATTGAACA

251 GCGAAATCTA CCGCAAACAA TACATGATCG AGCGCAACAA CCTCCTGCCC

301 ACGCTTGCCG CCAATGCGAA CGGCTCGCGC CAAGGCAGCT TGAGCGGCgg 351 caaTGTCAGC AGCAGCTACA ATGTCGGACT GGGTGcGGca tCTTACGAAC 401 TCGATCTGTT CgGGCGCGTG CGCagcaacA GcgaagcAGC ACTGcaggGC 451 tATTTTGCCA GCGTTGCCAA CcgcGATGCG GCACATTTGa ttCtGATTGC 501 CACCGTTGCC AAAGCCTATT TCAAcgaGcG TTATGCCGAA AAAGcgatgT
```

-continued

```
 551 CTTTGGCGCa gcGTGTCTTG AAAACGCGCG AGGAAACCTA CAAGCTGTCC

601 GAATTGCGGT ACAAGGCAGG CGTGATTTCC GCCGTCGCCC TGCGCCAGCA

651 GGAAGCCTTG ATTGAATCTG CCAAAGCCGA TTATGCCCAT GCCGCGCGCa 701 gcCGCGAACA GGCGCGCAAT GCCTTGGCAA CCTTGATTAA ccGTCCGATA

751 CCCGAagaCC TGCCCGCCGG TTTGCCGTTG GACAagcAGT TTTTTGTTGA

801 AAAACTGCCT GCCGGTTTGA GTTCCGAAGT ATTGCTCGAC CGTCCCGACA

851 TCCGCGCCGC CGAACACGCG CTCAAACAGG CAAACGCCAA TATCGGTGCG 901 gcgCGCGCCg ccTTTTTCCC GTCCATCCGC CTGACCGGAA GCGTCGGTAC

951 GGGTTCTGTC GAATTGGGCG GGCTGTTCAA AAGCGGCACG GGCGTTTGGG

1001 CGTTCGCTCC GTCTATTACC CTGCCGATTT TTACTTGGGG AACGAACAAG

1051 GCGAACCTTG ATGTGGCAAA ACTGCGCCAA CAGGCACAAA TTGTTGCCTA

1101 TGAATCCGCC GTCCAATCCG CCTTTCAAGA CGTGGCAAAC GCATTGGCGG

1151 CGCGCGAGCA GCTGGATAAA GCCTATGACG CTTTAAGCAA ACAAAGCCGC

1201 GCCTCTAAAG AAGCGTTGCG CTTGGTCGGA CTGCGTTACA AACACGGCGT

1251 ATCCGGCGCG CTCGATTTGC TCGATGCGGA ACGCATCAGC TATTCGGCGG

1301 AAGGTGCGGC TTTGTCGGCA CAACTGACCC GCGCCGAAAA CCTTGCCGAT

1351 TTGTACAAGG CGCTCgacGG CGGATTGAAA CGGGATACCC AAACCGGCAA

1401 ATAA
```

This corresponds to the amino acid sequence <SEQ ID 2464; ORF 729>:

```
g729.pep
  1 MNTTLKTTLT SVAAAFALSA CTMIPQYEQP KVEVAETFQN DTSVSSIRAV

51 DLGWHDYFAD PRLQKLIDIA LERNTSLRTA VLNSEIYRKQ YMIERNNLLP

101 TLAANANGSR QGSLSGGNVS SSYNVGLGAA SYELDLFGRV RSNSEAALQG

151 YFASVANRDA AHLILIATVA KAYFNERYAE KAMSLAQRVL KTREETYKLS

201 ELRYKAGVIS AVALRQQEAL IESAKADYAH AARSREQARN ALATLINRPI

251 PEDLPAGLPL DKQFFVEKLP AGLSSEVLLD RPDIRAAEHA LKQANANIGA

301 ARAAFFPSIR LTGSVGTGSV ELGGLFKSGT GVWAFAPSIT LPIFTWGTNK

351 ANLDVAKLRQ QAQIVAYESA VQSAFQDVAN ALAAREQLDK AYDALSKQSR

401 ASKEALRLVG LRYKHGVSGA LDLLDAERIS YSAEGAALSA QLTRAENLAD

451 LYKALDGGLK RDTQTGK*
```

The following partial DNA sequence was identified in *N. meningitidis* <SEQ ID 2465>:

```
m729.seq
   1 ATGGATACTA CATTGAAAAC CACCTTGACT TCTGTTGCAG CAGCCTTTGC

51 ATTGTCTGCC TGCACCATGA TTCCCCAATA CGAGCAGCCC AAAGTCGAAG

101 TTGCCGAAAC GTTCAAAAAC GATACCGCCG ACAGCGGCAT CCGCGCCGTC

151 GATTTAGGTT GGCATGACTA TTTTGCCGAC CCGCGCCTGC AAAAGCTGAT

201 CGACATCGCA CTCGAGCGCA ATACCAGTTT GCGTACCGCC GTATTGAACA
```

-continued

```
 251 GCGAAATCTA CCGCAAACAA TACATGATTG AGCGCAACAA CCTCCTGCCC

301 ACGCTTGCCG CCAATGCGAA CGACTCGCGC CAAGGCAGCT TGAGCGGCGG

351 CAATGTAAGC AGCAGCTACA AAGTCGGACT GGGTGCGGCA TCTTACGAAC

401 TCGATCTGTT CGGGCGTGTA CGCAGCAGCA GCGAGGCGGC ACTGCAAGGC

451 TATTTCGCCA GCACCGCCAA CCGCGATGCG GCACATTTGA GCCTGATTGC

501 CACCGTTGCC AAAGCCTATT TCAACGAACG TTACGCCGAA GAAGCGATGT

551 CTTTGGCGCA ACGTGTTTTG AAAACGCGCG AGGAAACCTA CAAGCTGTCC

601 GAATTACGTT ACAAGGCAGG CGTGATTTCC GCCGTCGCCC TACGTCAGCA

651 GGAAGCCCTG ATCGAATCTG CCAAAGCCGA TTATGCCCAT GCCGCGCGCA

701 GCCGCGAACA GGCGCGCAAT GCCTTGGCAA CCTTGATTAA CCAACCGATA

751 CCCGAAGACC TGCCTGCCGG TTTGCCGCTG ACAAGCAGT TTTTTGTTGA

801 AAAACTGCCG GCCGGTTTGA GTTCCGAAGT ATTGCTCGAC CGTCCCGATA

851 TCCGTGCTGC CGAACACGCG CTCAAACAGG CAAACGCCAA TATCGGTGCG

901 GCACGCGCCG CCTTTTTCCC ATCCATCCGC CTGACCGGAA CCGTCGGTAC

951 GGGTTCTGCC GAATTGGGTG GGTTGTTCAA AAGCGGCACG GGCGTTTGGT

1001 CGTTCGCGCC GTCTATTACC CTGCCGATTT TTACCTGGGG TACGAACAAG

1051 GCGAACCTTG ATGTAGCCAA GCTGCGCCAA CAGGTACAAA TCGTTGCCTA

1101 TGAATCCGCC GTCCAATCCG CATTTCAAGA CGTGGCAAAC GCATTGGCGG

1151 CGCGCGAGCA GCTGGATAAA GCCTATGACG CTTTAAGCAA ACAAAGCCGC

1201 GCCTCTAAAG AAGCGTTGCG CTTGGTCGGC CTGCGTTACA AGCACGGCGT

1251 ATCCGGCGCG CTCGACTTGC TCGATGCGGA ACGCAGCAGC TATGCGGCGG

1301 AGGGTGCGGC TTTGTCGGCA CAACTGACCC GCGCCGAAAA CCTTGCCGAT

1351 TTGTACAAGG CACTCGGCGG CGGATTGAAA CGGGATACCC AAACCGACAA

1401 ATAA
```

This corresponds to the amino acid sequence <SEQ ID 2466; ORF 729>:

```
m729.pep
   1 MDTTLKTTLT SVAAAFALSA CTMIPQYEQP KVEVAETFKN DTADSGIRAV

51 DLGWHDYFAD PRLQKLIDIA LERNTSLRTA VLNSEIYRKQ YMIERNNLLP

101 TLAANANDSR QGSLSGGNVS SSYKVGLGAA SYELDLFGRV RSSSEAALQG

151 YFASTANRDA AHLSLIATVA KAYFNERYAE EAMSLAQRVL KTREETYKLS

201 ELRYKAGVIS AVALRQQEAL IESAKADYAH AARSREQARN ALATLINQPI

251 PEDLPAGLPL DKQFFVEKLP AGLSSEVLLD RPDIRAAEHA LKQANANIGA

301 ARAAFFPSIR LTGTVGTGSA ELGGLFKSGT GVWSFAPSIT LPIFTWGTNK

351 ANLDVAKLRQ QVQIVAYESA VQSAFQDVAN ALAAREQLDK AYDALSKQSR

401 ASKEALRLVG LRYKHGVSGA LDLLDAERSS YAAEGAALSA QLTRAENLAD

451 LYKALGGGLK RDTQTDK*
```

Computer analysis of the amino acid sequences gave the following results:

Homology with a Predicted ORF from *N. meningitidis* menA with menB ORF 729 shows 95.7% identity over a 467 aa overlap with a predicted ORF (ORF729.a) from *N. gonorrhoeae*:

```
m729/g729  95.7% identity in 467 aa overlap 10        20        30        40        50        60
   m729.pep  MDTTLKTTLTSVAAAFALSACTMIPQYEQPKVEVAETFKNDTADSGIRAVDLGWHDYFAD
             ||:||||||||||||||||||||||||||||||:|||:|:||||||||||||||||||||
       g729  MNTTLKTTLTSVAAAFALSACTMIPQYEQPKVEVAETFQNDTSVSSIRAVDLGWHDYFAD
                  10        20        30        40        50        60

70        80        90       100       110       120
   m729.pep  PRLQKLIDIALERNTSLRTAVLNSEIYRKQYMIERNNLLPTLAANANDSRQGSLSGGNVS
             ||||||||||||||||||||||||||||||||||||||||||||||| ||||||||||||
       g729  PRLQKLIDIALERNTSLRTAVLNSEIYRKQYMIERNNLLPTLAANANGSRQGSLSGGNVS
                  70        80        90       100       110       120

130       140       150       160       170       180
   m729.pep  SSYKVGLGAASYELDLFGRVRSSSEAALQGYFASTANRDAAHLSLIATVAKAYFNERYAE
             |||:|||||||||||||||||||:||||||||||:||||||||||:||||||||||||||
       g729  SSYNVGLGAASYELDLFGRVRSNSEAALQGYFASVANRDAAHLILIATVAKAYFNERYAE
                 130       140       150       160       170       180

190       200       210       220       230       240
   m729.pep  EAMSLAQRVLKTREETYKLSELRYKAGVISAVALRQQEALIESAKADYAHAARSREQARN
             :|||||||||||||||||||||||||||||||||||||||||||||||||||||||||||
       g729  KAMSLAQRVLKTREETYKLSELRYKAGVISAVALRQQEALIESAKADYAHAARSREQARN
                 190       200       210       220       230       240

250       260       270       280       290       300
   m729.pep  ALATLINQPIPEDLPAGLPLDKQFFVEKLPAGLSSEVLLDRPDIRAAEHALKQANANIGA
             |||||||:||||||||||||||||||||||||||||||||||||||||||||||||||||
       g729  ALATLINRPIPEDLPAGLPLDKQFFVEKLPAGLSSEVLLDRPDIRAAEHALKQANANIGA
                 250       260       270       280       290       300

310       320       330       340       350       360
   m729.pep  ARAAFFPSIRLTGTVGTGSAELGGLFKSGTGVWSFAPSITLPIFTWGTNKANLDVAKLRQ
             ||||||||||||:|||||:|||||||||||||||:|||||||||||||||||||||||||
       g729  ARAAFFPSIRLTGSVGTGSVELGGLFKSGTGVWAFAPSITLPIFTWGTNKANLDVAKLRQ
                 310       320       330       340       350       360

370       380       390       400       410       420
   m729.pep  QVQIVAYESAVQSAFQDVANALAAREQLDKAYDALSKQSRASKEALRLVGLRYKHGVSGA
             |:||||||||||||||||||||||||||||||||||||||||||||||||||||||||||
       g729  QAQIVAYESAVQSAFQDVANALAAREQLDKAYDALSKQSRASKEALRLVGLRYKHGVSGA
                 370       380       390       400       410       420

430       440       450       460
   m729.pep  LDLLDAERSSYAAEGAALSAQLTRAENLADLYKALGGGLKRDTQTDKX
             ||||||||| ||:|||||||||||||||||||||||| |||||||:||
       g729  LDLLDAERISYSAEGAALSAQLTRAENLADLYKALDGGLKRDTQTGKX
                 430       440       450       460
```

The following partial DNA sequence was identified in *N. meningitidis* <SEQ ID 2467>:

```
a729.seq
    1  ATGGATACTA CATTGAAAAC CACCTTGACT TCTGTTGCAG CAGCCTTCGC

51  ATTATCCGCC TGCACCATGA TTCCCCAATA CGAGCAGCCC AAAGTCGAAG

101  TTGCCGAAAC GTTCAAAAAC GATACCGCCG ACAGCGGCAT CCGTGCGGTC

151  GATTTGGGTT GGCATGACTA TTTTGCCGAC CCGCGCCTGC AAAAGCTGAT

201  CGACATCGCA CTCGAGCGCA ATACCAGTTT GCGTACCGCC GTATTGAACA

251  GCGAAATCTA CCGCAAACAA TACATGATTG AGCGCAACAA CCTCCTGCCC

301  ACGCTTGCCG CCAATGCGAA CGACTCGCGC CAAGGCAGCT TGAGCGGCGG

351  CAATGTAAGC AGCAGCTACA AGTCGGACT GGGTGCGGCA TCTTACGAAC

401  TCGATCTGTT CGGGCGTGTA CGCAGCAGCA GCGAGGCGGC ACTGCAAGGC

451  TATTTCGCCA GCACCGCCAA CCGCGATGCG GCACATTTGA GCCTGATTGC

501  CACCGTTGCC AAAGCCTATT TCAACGAACG TTATGCCGAA GAAGCGATGT
```

```
 551 CTTTGGCGCA ACGTGTTTTG AAAACGCGCG AGGAAACCTA CAAGCTGTCC

601 GAATTACGTT ACAAGGCAGG CGTGATTTCC GCCGTCGCCC TACGTCAGCA

651 GGAAGCCCTA ATCGAATCTG CCAAAGCCGA TTATGCCCAT GCCGCGCGCA

701 GCCGCGAACA GGCGCGCAAT GCCTTGGCAA CCCTGATTAA CCAACCGATA

751 CCCGACGACC TGCCCGCCGG TTTGCCGTTG ACAAGCAGT TTTTTGTTGA

801 GAAGCTGCCG GCCGGTTTGA GTTCCGAAGT ATTGCTCGAC CGTCCCGATA

851 TCCGTGCTGC CGAACACGCG CTCAAACAGG CAAACGCCAA TATCGGTGCG

901 GCACGCGCCG CCTTTTTCCC ATCCATCCGC CTGACCGGAA GCGTCGATAC

951 GCATTCTGCC GAATTGGGCG GGCTGTTCAA AAGCGGCACC GGCGTTTGGT

1001 TGTTCGCACC TTCCATTACC CTGCCGATTT TTACCTGGGG TACGAACAAG

1051 GCGAACCTCG ATGTAGCCAA GCTGCGCCAA CAGGCACAAA TCGTTGCCTA

1101 TGAAGCCGCC GTCCAATCCG CATTTCAAGA CGTGGCAAAC GCATTGACCG

1151 CGCGCGAGCA GTTGGATAAA GCCTATGACG CTTTAAGCAA ACAAAGCCGC

1201 GCCTCTAAAG AAGCGTTGCG TTTGGTCGGT CTGCGTTACA ACACGGCGT

1251 ATCCGGCGCG CTCGACTTGC TCGATGCGGA ACGCAGCAGC TATTCGGCGG

1301 AAGGTGCGGC TTTGTCGGCA CAACTGACCC GCGCCGAAAA CCTTGCCGAT

1351 TTGTACAAGG CACTCGGCGG CGGATTGAAA CGGGATACCC AAACCGACAA

1401 ATAA
```

This corresponds to the amino acid sequence <SEQ ID 2468; ORF 729.a>:

```
a729.pep

1 MDTTLKTTLT SVAAAFALSA CTMIPQYEQP KVEVAETFKN DTADSGIRAV

51 DLGWHDYFAD PRLQKLIDIA LERNTSLRTA VLNSEIYRKQ YMIERNNLLP

101 TLAANANDSR QGSLSGGNVS SSYKVGLGAA SYELDLFGRV RSSSEAALQG

151 YFASTANRDA AHLSLIATVA KAYFNERYAE EAMSLAQRVL KTREETYKLS

201 ELRYKAGVIS AVALRQQEAL IESAKADYAH AARSREQARN ALATLINQPI

251 PDDLPAGLPL DKQFFVEKLP AGLSSEVLLD RPDIRAAEHA LKQANANIGA

301 ARAAFFPSIR LTGSVDTHSA ELGGLFKSGT GVWLFAPSIT LPIFTWGTNK

351 ANLDVAKLRQ QAQIVAYEAA VQSAFQDVAN ALTAREQLDK AYDALSKQSR

401 ASKEALRLVG LRYKHGVSGA LDLLDAERSS YSAEGAALSA QLTRAENLAD

451 LYKALGGGLK RDTQTDK*
``` a729/m729 98.1% identity in 467 aa overlap

```
                10         20         30         40         50         60
a729.pep  MDTTLKTTLTSVAAAFALSACTMIPQYEQPKVEVAETFKNDTADSGIRAVDLGWHDYFAD
          ||||||||||||||||||||||||||||||||||||||||||||||||||||||||||||
m729      MDTTLKTTLTSVAAAFALSACTMIPQYEQPKVEVAETFKNDTADSGIRAVDLGWHDYFAD
                10         20         30         40         50         60

70         80         90        100        110        120
a729.pep  PRLQKLIDIALERNTSLRTAVLNSEIYRKQYMIERNNLLPTLAANANDSRQGSLSGGNVS
          ||||||||||||||||||||||||||||||||||||||||||||||||||||||||||||
m729      PRLQKLIDIALERNTSLRTAVLNSEIYRKQYMIERNNLLPTLAANANDSRQGSLSGGNVS
                70         80         90        100        110        120

130        140        150        160        170        180
a729.pep  SSYKVGLGAASYELDLFGRVRSSSEAALQGYFASTANRDAAHLSLIATVAKAYFNERYAE
          ||||||||||||||||||||||||||||||||||||||||||||||||||||||||||||
m729      SSYKVGLGAASYELDLFGRVRSSSEAALQGYFASTANRDAAHLSLIATVAKAYFNERYAE
               130        140        150        160        170        180
```

```
                  190        200        210        220        230        240
a729.pep  EAMSLAQRVLKTREETYKLSELRYKAGVISAVALRQQEALIESAKADYAHAARSREQARN
          ||||||||||||||||||||||||||||||||||||||||||||||||||||||||||||
m729      EAMSLAQRVLKTREETYKLSELRYKAGVISAVALRQQEALIESAKADYAHAARSREQARN
                  190        200        210        220        230        240

250        260        270        280        290        300
a729.pep  ALATLINQPIPDDLPAGLPLDKQFFVEKLPAGLSSEVLLDRPDIRAAEHALKQANANIGA
          ||||||||||:|||||||||||||||||||||||||||||||||||||||||||||||||
m729      ALATLINQPIPEDLPAGLPLDKQFFVEKLPAGLSSEVLLDRPDIRAAEHALKQANANIGA
                  250        260        270        280        290        300

310        320        330        340        350        360
a729.pep  ARAAFFPSIRLTGSVDTHSAELGGLFKSGTGVWLFAPSITLPIFTWGTNKANLDVAKLRQ
          ||||||||||||:|  ||||||||||||||||| ||||||||||||||||||||||||||
m729      ARAAFFPSIRLTGTVGTGSAELGGLFKSGTGVWSFAPSITLPIFTWGTNKANLDVAKLRQ
                  310        320        330        340        350        360

370        380        390        400        410        420
a729.pep  QAQIVAYEAAVQSAFQDVANALTAREQLDKAYDALSKQSRASKEALRLVGLRYKHGVSGA
          |:||||||:|||||||||||||:|||||||||||||||||||||||||||||||||||||
m729      QVQIVAYESAVQSAFQDVANALAAREQLDKAYDALSKQSRASKEALRLVGLRYKHGVSGA
                  370        380        390        400        410        420

430        440        450        460
a729.pep  LDLLDAERSSYSAEGAALSAQLTRAENLADLYKALGGGLKRDTQTDKX
          ||||||||||:|||||||||||||||||||||||||||||||||||||
m729      LDLLDAERSSYAAEGAALSAQLTRAENLADLYKALGGGLKRDTQTDKX
                  430        440        450        460
```

The following partial DNA sequence was identified in *N. gonorrhoeae* <SEQ ID 2469>:

```
g730.seq
    1  GTGAAACCGC TGCGCAGACT GACAAACCTC CTTGCCGCCT GCGCCGTAGC
   51  GGCGGTCGCA CTCATACAGC CCGCCCTCGC GGCGGACTTG GCGCAAGACC
  101  CGTTCATTAC CGATAACACC CAACGGCAGC ACTACGAACC CGGCGGCAAA
  151  TACCACCTCT TCGGcgaCCC GCGCGGCAGC GTTTCCGACC GCACCGGCAA
  201  AATCAACGTC ATCCAAGACT ATACCCACCA GATGGGCAAC CTGCTCATCC
  251  AACAGGCGGC AATCCAAGGC AATCTTGGTT ACACCGTCCG CTTTTCCGGA
  301  CACGGACACG AAGAACACGC CCCCTTCGAC AACCACGCCG CCGACAGCGC
  351  AAGCGAAGAA AAAGGCAACG TTGACGACGG CTTTACCGTG TACCGGCTCA
  401  ACTGGGAAGG ACACGAACAT CATCCCGCCG ATGCCTACGA CGGCCCGAAG
  451  GGCGGCAATT ACCCCAAACC TACGGGCGCA CGAGACGAAT ACACCTATCA
  501  CGTCAACGGC ACAGCCCGCA GTATCAAACT CAATCCGACC GACACCCGCA
  551  GCATCCGGCA ACGCATATTC GACAACTACA ACAACCTCGG CAGCAATTTC
  601  TCCGACCGCG CCGATGAAGC CAACAGAAAA ATGTTCGAGC ACAATGCCAA
  651  GCTCGACCGC TGGGGCAACA GCATGGAGTT TGTCAACGGC GTCGCCGCCG
  701  GCGCGCTCAA CCCCTTTATC AGCGCGGGCG AAGCCTTGGG CATAGGCGAC
  751  ATACTGTACG GAACGCGCTA TGCCATAGAC AAAGCCGCGA TGCGCAACAT
  801  CGCCCCCTTA CCCGCCGAGG GCAAATTCGC CGCCATCGGC GGCTTGGGCA
  851  GCGCGGCGGG CTTTGAAAAA AATACGCGCG AAGCCGTTGA CCGGTGGATA
  901  CAGGAAAACC CCAATGCCGC CGAAACCGTC GAAGCCCTGG TCAACGTCCT
  951  GCCGTTTGCC AAAGTCAAAA ACCTGACAAA GGCGGCAAAA CCGGGGAAGG
 1001  CTGCGGTTAG TGGGGATTTT TCTAAATCCT ACACCTGCTC CTTCCACGGC
 1051  AGCACCTTGG TCAAAACGGC AGACGGCTAC AAAGCCATTG CCCATATTCA
 1101  AGCCGGAGAC CGCGTCCTTT CCAAGGACGA GGCAAGCGGA GAAACGGGAT
 1151  ACAAACCCGT TACCGCCCGA TACGGCAATC CGTATCAAGA AACCGTTTAC
```

-continued

```
1201 ATTGAAGTTT CAGACGGCAT CGGCAACAGC CAAACCCTGA TTTCCAACCG
1251 CATCCACCCG TTTTATTCGG ACGGCAAATG GATTAAGGCG GAAGATTTAA
1301 AAGCGGGAAG CCGGCTGTTA TCCGAAAGCG GCAAAACCCA AACCGTCCGC
1351 AACATCGTTG TCAAACCAAA ACCGCTCAAA GCCTACAATC TGACCGTTGC
1401 CGATTGGCAT ACCTACTTCG TCAAGGGTAA TCAGGCGGAA ACGGAAGGGG
1451 TTTGGGTTCA TAATGATTGT CCGCCTAAAC CAAACCAAC CAATCATGCC
1501 CAACAAAGAA AAGAAGAAGC TAAAAACGAT TCTCATCGAA GTGTGGGAGA
1551 TTCCAATCGT GTCGTTCGCG AAGGAAAGCA ATATTTAGAT TCCGACACAG
1601 GAAACCATGT TTATGTAAAA GGAGATAAAG TGGTTATTCT AACTCCTGAT
1651 GGAAGACAGG TAACTCAATT TAAGAACTCG AAAGCCAATA CGTCAAAAAG
1701 GGTAAAAAAT GGGAAATGGA CACCAAAATA A
```

This corresponds to the amino acid sequence <SEQ ID 2470; ORF 730.ng>:

```
g730.pep
  1 VKPLRRLTNL LAACAVAAVA LIQPALAADL AQDPFITDNT QRQHYEPGGK
 51 YHLFGDPRGS VSDRTGKINV IQDYTHQMGN LLIQQAAIQG NLGYTVRFSG
101 HGHEEHAPFD NHAADSASEE KGNVDDGFTV YRLNWEGHEH HPADAYDGPK
151 GGNYPKPTGA RDEYTYHVNG TARSIKLNPT DTRSIRQRIF DNYNNLGSNF
201 SDRADEANRK MFEHNAKLDR WGNSMEFVNG VAAGALNPFI SAGEALGIGD
251 ILYGTRYAID KAAMRNIAPL PAEGKFAAIG GLGSAAGFEK NTREAVDRWI
301 QENPNAAETV EALVNVLPFA KVKNLTKAAK PGKAAVSGDF SKSYTCSFHG
351 STLVKTADGY KAIAHIQAGD RVLSKDEASG ETGYKPVTAR YGNPYQETVY
401 IEVSDGIGNS QTLISNRIHP FYSDGKWIKA EDLKAGSRLL SESGKTQTVR
451 NIVVKPKPLK AYNLTVADWH TYFVKGNQAE TEGVWVHNDC PPKPKPTNHA
501 QQRKEEAKND SHRSVGDSNR VVREGKQYLD SDTGNHVYVK GDKVVILTPD
551 GRQVTQFKNS KANTSKRVKN GKWTPK*
```

The following partial DNA sequence was identified in *N. meningitidis* <SEQ ID 2471>:

```
m730.seq
   1 GTGAAACCGC TGCGCAGACT GACAAACCTC CTTGCCGCCT GCGCCGTAGC
  51 GGCGGCCGCA CTCATACAGC CCGCCCTCGC GGCGGACTTG GCGCAAGACC
 101 CGTTCATTAC CGATAACGCC CAACGGCAGC ACTACGAACC CGGCGGCAAA
 151 TACCACCTCT TCGGCGACCC GCGCGGCAGC GTTTCCGACC GCACCGGCAA
 201 AATCAACGTC ATCCAAGACT ATACCCACCA GATGGGCAAC CTGCTCATCC
 251 AACAGGCAAA CATCAACGGC ACAATCGGCT ACCACACCCG CTTTTCCGGA
 301 CACGGACACG AAGAACACGC CCCCTTCGAC AACCACGCCG CCGACAGCGC
 351 GAGCGAAGAA AAAGGCAACG TTGACGAAGG CTTTACCGTA TACCGGCTCA
 401 ACTGGGAAGG ACACGAACAT CATCCCGCCG ATGCCTACGA CGGCCCGAAG
 451 GGCGGCAATT ACCCCAAACC TACGGGCGCA CGAGACGAAT ACACCTATCA
 501 CGTCAACGGC ACAGCCCGCA GTATCAAACT CAATCCGACC GACACCCGCA
```

-continued

```
 551 GCATCCGGCA ACGCATATCC GACAATTACA GCAACCTCGG CAGCAATTTC

601 TCCGACCGCG CCGATGAAGC CAACAGAAAA ATGTTCGAGC ACAATGCCAA

651 GCTCGACCGC TGGGGCAACA GCATGGAGTT TATCAACGGC GTCGCCGCCG

701 GCGCGCTCAA CCCCTTTATC AGCGCGGGCG AAGCCTTGGG CATAGGCGAC

751 ATACTGTACG GAACGCGCTA TGCCATAGAC AAAGCCGCAA TGCGCAACAT

801 CGCCCCCTTG CCCGCCGAGG GCAAATTCGC CGTCATCGGC GGCTTGGGCA

851 GCGTGGCGGG CTTTGAAAAG AATACGCGCG AAGCCGTTGA CCGGTGGATA

901 CAGGAAAATC CCAATGCCGC CGAAACCGTC GAAGCCGTCT TCAACGTTGC

951 CGCAGCAGCC AAAGTCGCGA AGTTGGCAAA GGCGGCAAAA CCAGGGAAGG

1001 CTGCCGGTTAG CGGGGATTTT GCTGATTCTT ATAAAAAGAA ATTGGCTTTG

1051 TCTGATAGTG CGAGACAGTT ATATCAAAAT GCAAAGTATA GAGAAGCTCT

1101 AGATATACAT TATGAAGATT TAATTAGAAG AAAAACTGAT GGTTCATCAA

1151 AATTTATTAA CGGCAGAGAA ATTGACGCTG TTACGAATGA TGCTTTAATA

1201 CAAGCCAAAA GAACAATTTC AGCAATAGAT AAACCTAAAA ATTTCTTAAA

1251 TCAAAAAAAT AGAAAGCAAA TTAAAGCAAC CATCGAAGCA GCAAACCAAC

1301 AGGGAAAACG TGCAGAATTT TGGTTTAAAT ACGGTGTTCA TTCACAAGTT

1351 AAGTCATATA TTGAATCAAA AGGCGGCATT GTTAAAACAG GTTTAGGAGA

1401 TTAA
```

This corresponds to the amino acid sequence <SEQ ID 2472; ORF 730>:

```
m730.pep
  1 VKPLRRLTNL LAACAVAAAA LIQPALAADL AQDPFITDNA QRQHYEPGGK

51 YHLFGDPRGS VSDRTGKINV IQDYTHQMGN LLIQQANING TIGYHTRFSG

101 HGHEEHAPFD NHAADSASEE KGNVDEGFTV YRLNWEGHEH HPADAYDGPK

151 GGNYPKPTGA RDEYTYHVNG TARSIKLNPT DTRSIRQRIS DNYSNLGSNF

201 SDRADEANRK MFEHNAKLDR WGNSMEFING VAAGALNPFI SAGEALGIGD

251 ILYGTRYAID KAAMRNIAPL PAEGKFAVIG GLGSVAGFEK NTREAVDRWI

301 QENPNAAETV EAVFNVAAAA KVAKLAKAAK PGKAAVSGDF ADSYKKKLAL

351 SDSARQLYQN AKYREALDIH YEDLIRRKTD GSSKFINGRE IDAVTNDALI

401 QAKRTISAID KPKNFLNQKN RKQIKATIEA ANQQGKRAEF WFKYGVHSQV

451 KSYIESKGGI VKTGLGD*
``` g730/m730 93.0% identity in 344 aa overlap

```
                  10         20         30         40         50         60
       g730.pep   VKPLRRLTNLLAACAVAAVALIQPALAADLAQDPFITDNTQRQHYEPGGKYHLFGDPRGS
                  ||||||||||||||||||:||||||||||||||||||||:|||||||||||||||||||
       m730       VKPLRRLTNLLAACAVAAAALIQPALAADLAQDPFITDNAQRQHYEPGGKYHLFGDPRGS
                  10         20         30         40         50         60

70         80         90        100        110        120
       g730.pep   VSDRTGKINVIQDYTHQMGNLLIQQAAIQGNLGYTVRFSGHGHEEHAPFDNHAADSASEE
                  ||||||||||||||||||||||||||:|::||  :|||||||||||||||||||||||||
       m730       VSDRTGKINVIQDYTHQMGNLLIQQANINGTIGYHTRFSGHGHEEHAPFDNHAADSASEE
                  70         80         90        100        110        120
```

-continued

```
                130       140       150       160       170       180
g730.pep  KGNVDDGFTVYRLNWEGHEHHPADAYDGPKGGNYPKPTGARDEYTYHVNGTARSIKLNPT
          |||||:||||||||||||||||||||||||||||||||||||||||||||||||||||||
m730      KGNVDEGFTVYRLNWEGHEHHPADAYDGPKGGNYPKPTGARDEYTYHVNGTARSIKLNPT
                130       140       150       160       170       180

190       200       210       220       230       240
g730.pep  DTRSIRQRIFDNYNNLGSNFSDRADEANRKMFEHNAKLDRWGNSMEFVNGVAAGALNPFI
          ||||||||| |||:||||||||||||||||||||||||||||||||||:|||||||||||
m730      DTRSIRQRISDNYSNLGSNFSDRADEANRKMFEHNAKLDRWGNSMEFINGVAAGALNPFI
                190       200       210       220       230       240

250       260       270       280       290       300
g730.pep  SAGEALGIGDILYGTRYAIDKAAMRNIAPLPAEGKFAAIGGLGSAAGFEKNTREAVDRWI
          ||||||||||||||||||||||||||||||||||||:||||||:||||||||||||||||
m730      SAGEALGIGDILYGTRYAIDKAAMRNIAPLPAEGKFAVIGGLGSVAGFEKNTREAVDRWI
                250       260       270       280       290       300

310       320       330       340       350       360
g730.pep  QENPNAAETVEALVNVLPFAKVKNLTKAAKPGKAAVSGDFSKSYTCSFHGSTLVKTADGY
          |||||||||||: ||    ||| :|:|||||||||||||: ||
m730      QENPNAAETVEAVFNVAAAAKVAKLAKAAKPGKAAVSGDFADSYKKKLALSDSARQLYQN
                310       320       330       340       350       360

370       380       390       400       410       420
g730.pep  KAIAHIQAGDRVLSKDEASGETGYKPVTARYGNPYQETVYIEVSDGIGNSQTLISNRIHP m730      AKYREALDIHYEDLIRRKTDGSSKFINGREIDAVTNDALIQAKRTISAIDKPKNFLNQKN
                370       380       390       400       410       420
```

The following partial DNA sequence was identified in *N. meningitidis* <SEQ ID 2473>:

```
a730.seq
   1 GTGAAACCGC TGCGAAGACT CATCAAGCTC CTTGCCGCCT GTGCCGTAGC
  51 GGCGGCCGCA CTCATACAGC CCGCCCTCGC GGCGGACTTG GCGCAAGACC
 101 CGTTCATTAC CGATAACGCC CAACGGCAGC ACTACGAACC CGGAGGCAAA
 151 TACCACCTCT TCGGCGACCC GCGCGGCAGC GTCTCCGACC GCACCGGTCA
 201 AATCAACGTC ATCCAAGACT ATACCCACCG GATGGGCAAC CTGCTCATCC
 251 AGCAGGCAAA CATCAACGGC ACAATCGGCT ACCACACCCG CTTTTCCGGA
 301 CACGGATACG AAGAACACGC CCCCTTCGAC AACCACGCCG CCGACAGCGC
 351 GAGCGAAGAA AAAGGCAACG TTGACGAAGG CTTTACCGTA TACCGGCTCA
 401 ACTGGGAAGG ACACGAACAT CATCCCGCCG ATGCCTACGA CGGCCCGAAG
 451 GGCGGCAATT ACCCCAAACC TACGGGTGCA CGCGACGAAT ACACCTATCA
 501 CGTCAACGGC ACAGCACGCA GCATCAAACT CAATCCGACC GACACCCGCA
 551 GCATCCGGCA ACGCATATCC GACAATTACA GCAACCTCGG CAGCAATTTC
 601 TCCGACCGCG CCGATGAAGC CAACAGAAAA ATGTTCGAGC ACAATGCCAA
 651 GCTCGACCGC TGGGGCAACA GCATGGAGTT TATCAACGGC GTCGCCGCCG
 701 GCGCGCTCAA CCCCTTTATC AGCGCGGGCG AAGCCTTGGG CATAGGCGAC
 751 ATACTGTACG GAACGCGCTA TGCCATAGAC AAAGCCGCAA TGCGCAACAT
 801 CGCCCCCTTG CCCGCCGAGG GCAAATTCGC CGTCATCGGC GGCTTGGGCA
 851 GCGTGGCGGG CTTTGAAAAA AATACGCGCG AAGCCGTTGA CCGGTGGATA
 901 CAGGAAAACC CCAATGCCGC CGAAACCGTC GAAGCCCTGG TCAACGTCCT
 951 GCCGTTTGCC AAAGTCAAAA ACCTGACAAA GGCGGCAAAA CCGGGGAAGG
1001 CTGCGGTTAG CGGGGATTTT TCTGCTGCAT ACAATACAAG AACAACTAGA
1051 AAAGTTACTA CAGAAACAGA GGGGTTAAAT AGAATCAGAC AGAACCAGAA
1101 AAATAGTAAT ATACATGAGA AAAATTATGG AAGAGATAAT CCTAATCATA
1151 TTAATGTTTT ATCTGGAAAT TCTATACAAC ATATACTGTA TGGAGATGAA
```

-continued

```
1201 GCAGGAGGTG GGCATCTTTT TCCTGGCAAA CCTGGTAAGA CAACATTCCC

1251 CCAACATTGG TCAGCCAGTA AAATAACTCA TGAAATTAGT GATATCGTTA

1301 CATCCCCAAA AACGCAATGG TATGCACAGA CTGGAACAGG CGGCAAATAT

1351 ATTGCTAAAG GAAGACCAGC TAGGTGGGTA TCATATGAAA CGAGAGATGG

1401 AATTCGTATC AGAACAGTTT ATGAACCTGC AACAGGAAAA GTGGTAACTG

1451 CATTCCCCGA TAGAACCTCT AATCCCAAAT ATAACCCTGT AAAATAA
```

This corresponds to the amino acid sequence <SEQ ID 2474; ORF 730.a>:

```
a730.pep
  1 VKPLRRLIKL LAACAVAAAA LIQPALAADL AQDPFITDNA QRQHYEPGGK

51 YHLFGDPRGS VSDRTGQINV IQDYTHRMGN LLIQQANING TIGYHTRFSG

101 HGYEEHAPFD NHAADSASEE KGNVDEGFTV YRLNWEGHEH HPADAYDGPK

151 GGNYPKPTGA RDEYTYHVNG TARSIKLNPT DTRSIRQRIS DNYSNLGSNF

201 SDRADEANRK MFEHNAKLDR WGNSMEFING VAAGALNPFI SAGEALGIGD

251 ILYGTRYAID KAAMRNIAPL PAEGKFAVIG GLGSVAGFEK NTREAVDRWI

301 QENPNAAETV EALVNVLPFA KVKNLTKAAK PGKAAVSGDF SAAYNTRTTR

351 KVTTETEGLN RIRQNQKNSN IHEKNYGRDN PNHINVLSGN SIQHILYGDE

401 AGGGHLFPGK PGKTTFPQHW SASKITHEIS DIVTSPKTQW YAQTGTGGKY

451 IAKGRPARWV SYETRDGIRI RTVYEPATGK VVTAFPDRTS NPKYNPVK*
``` a730/m730 88.6% identity in 376 aa overlap

```
                  10        20        30        40        50        60
      a730.pep  VKPLRRLIKLLAACAVAAAALIQPALAADLAQDPFITDNAQRQHYEPGGKYHLFGDPRGS
                ||||||:|||||||||||||||||||||||||||||||||||||||||||||||||||||
          m730  VKPLRRLTNLLAACAVAAAALIQPALAADLAQDPFITDNAQRQHYEPGGKYHLFGDPRGS
                  10        20        30        40        50        60

70        80        90       100       110       120
      a730.pep  VSDRTGQINVIQDYTHRMGNLLIQQANINGTIGYHTRFSGHGYEEHAPFDNHAADSASEE
                ||||||:||||||||||:||||||||||||||||||||:|| ||||||||||||||||||
          m730  VSDRTGKINVIQDYTHQMGNLLIQQANINGTIGYHTRFSCHCHEEHAPFDNHAADSASEE
                  70        80        90       100       110       120

130       140       150       160       170       180
      a730.pep  KGNVDEGFTVYRLNWEGHEHHPADAYDGPKGGNYPKPTGARDEYTYHVNGTARSIKLNPT
                ||||||||||||||||||||||||||||||||||||||||||||||||||||||||||||
          m730  KGNVDEGFTVYRLNWEGHEHHPADAYDGPKGGNYPKPTGARDEYTYHVNGTARSIKLNPT
                 130       140       150       160       170       180

190       200       210       220       230       240
      a730.pep  DTRSIRQRISDNYSNLGSNFSDRADEANRKMFEHNAKLDRWGNSMEFINGVAAGALNPFI
                ||||||||||||||||||||||||||||||||||||||||||||||||||||||||||||
          m730  DTRSIRQRISDNYSNLGSNFSDRADEANRKMFEHNAKLDRWGNSMEFINGVAAGALNPFI
                 190       200       210       220       230       240

250       260       270       280       290       300
      a730.pep  SAGEALGIGDILYGTRYAIDKAAMRNIAPLPAEGKFAVIGGLGSVAGFEKNTREAVDRWI
                ||||||||||||||||||||||||||||||||||||||||||||||||||||||||||||
          m730  SAGEALGIGDILYGTRYAIDKAAMRNIAPLPAEGKFAVIGGLGSVAGFEKNTREAVDRWI
                 250       260       270       280       290       300

310       320       330       340       350       360
      a730.pep  QENPNAAETVEALVNVLPFAKVKNLTKAAKPGKAAVSGDFSAAYNTRTTRKVTTETEGLN
                |||||||||||: ||   |::||||||||||||||||||: :|      :|  : :::
          m730  QENPNAAETVEAVFNVAAAAKVAKLAKAAKPGKAAVSGDFADSY-----KKKLALSDSAR
                 310       320       330       340            350

370       380       390       400       410       420
      a730.pep  RIRQNQKNSNIHEKNYGRDNPNHINVLSGNSIQHILYGDEAGGGHLFPGKPGKTTFPQHW
                ::  ||  |   :    : |
          m730  QLYQNAKYREALDIHYEDLIRRKTDGSSKFINGREIDAVTNDALIQAKRTISAIDKPKNF
                 360       370       380       390       400       410
```

The following partial DNA sequence was identified in *N. gonorrhoeae* <SEQ ID 2475>:

```
g731.seq
   1 gattttcgag cgttttcatG CGAGAACGGT TTGTCTGTGC GCGTCCGCAA

51 TTTGGACGGC GGCAAAATCG CGTTGCGGCT GGACGGCAGG CGTGCCGTCC

101 TCTCTTCCGA CGTTGCCGCA TCCGGCGAAC GCTATACCGC CGAACACGGT

151 TTGTTCGGAA ACGGAACCGA GTGGCACCAG AAAGGCGGCG AAGCCTTTTT

201 CGGCTTTACC GATGCCTACG GCAATTCGGT CGAAACTTCC TGCCGCGCCC

251 GTTAA
```

This corresponds to the amino acid sequence <SEQ ID 2476; ORF 731.ng>:

```
g731.pep
   1 DFRAFSCENG LSVRVRNLDG GKIALRLDGR RAVLSSDVAA SGERYTAEHG

51 LFGNGTEWHQ KGGEAFFGFT DAYGNSVETS CRAR*
```

The following partial DNA sequence was identified in *N. meningitidis* <SEQ ID 2477>:

```
m731.seq
   1 ATGAATATCA GGTTTTTCGC GCTGACCGTA CCGGTTTTGT CTTTGGCGGC

51 CTGTGCCGTG CCGGAGGCGT ATGATGACGG CGGACGCGGG CATATGCCGC

101 CCGTTCAAAA CCAAGCCGGC ACGGACGATT TTCGGGCGTT TTCCTGCGAG

151 AACGGTTTGT CTGTGCGCGT CCGCCATTTG GACAGCGGCA AAGTCGCGTT

201 GCGGCTGGAC GGCAGGCGTG CCGTCCTCTC TTCCGACGTT GCCGCATCCG

251 GCGAACGCTA TACCGCCGAA CACGGTTTGT TCGGAAACGC AACCGAGTGG

301 CACCAGAAAG GCGGCGAAGC CTTTTTCGGC TTTACCGATG CCTACGGCAA

351 TTCGGTCGAA ACTTCCTGCC GCGCCCGTTA A
```

This corresponds to the amino acid sequence <SEQ ID 2478; ORF 731>:

```
m731.pep
   1 MNIRFFALTV PVLSLAACAV PEAYDDGGRG HMPPVQNQAG TDDFRAFSCE

51 NGLSVRVRHL DSGKVALRLD GRRAVLSSDV AASGERYTAE HGLFGNATEW

101 HQKGGEAFFG FTDAYGNSVE TSCRAR*
``` g731/m731 95.2% identity in 84 aa overlap

```
                                 10        20         30
       g731.pep                  DFRAFSCENGLSVRVRNLDGGKIALRLDGR
                                 |||||||||||||||:||:||:|||||||
           m731 LSLAACAVPEAYDDGGRGHMPPVQNQAGTDDFRAFSCENGLSVRVRHLDSGKVALRLDGR
                      20        30        40        50        60        70

40        50        60        70        80
       g731.pep RAVLSSDVAASGERYTAEHGLFGNGTEWHQKGGEAFFGFTDAYGNSVETSCRARX
                ||||||||||||||||||||||||:|||||||||||||||||||||||||||||
           m731 RAVLSSDVAASGERYTAEHGLFGNATEWHQKGGEAFFGFTDAYGNSVETSCRARX
                       80        90       100       110       120
```

The following partial DNA sequence was identified in *N. meningitidis* <SEQ ID 2479>:

```
a731.seq
   1 ATGAATATCA GGTTTTTCGC GCTGACCGTA CCGGTTTTGT CTTTGGCGGC

51 CTGTGCCGTG CCGGAGGCGT ATGATGACGG CGGACGAGGG CATATGCCGC

101 CCGTTCAAAA CCAAGCCGGC ACGGCAGATT TTCGGGCATT TTCCTGCGAG

151 AACGGTTTGT CTGTGCACGT CCGCCGTTTG GACGGCGGCA GAATCGCGTT

201 GCGGTTGGAC GGCAGGCGTG CCGTCCTCTC TTCCGACGTT GCCGCATCCG

251 GCGAACGCTA TACCGCCGAA CACGGTTTGT TCGGAAACGG AACCGAGTGG

301 CATCAGAAAG GCGGCGAAGC CTTTTTCGGC TTTACCGATG CCTACGGCAA

351 TTCGGTCGAA ACCTCCTGCC GCGAACGCTA A
```

This corresponds to the amino acid sequence <SEQ ID 2480; ORF 731.a>:

```
a731.pep

1 MNIRFFALTV PVLSLAACAV PEAYDDGGRG HMPPVQNQAG TADFRAFSCE

51 NGLSVHVRRL DGGRIALRLD GRRAVLSSDV AASGERYTAE HGLFGNGTEW

101 HQKGGEAFFG FTDAYGNSVE TSCRAR*
```

```
a731.pep  94.4% identity in 126 aa overlap 10        20        30        40        50        60
a731.pep   MNIRFFALTVPVLSLAACAVPEAYDDGGRGHMPPVQNQAGTADFRAFSCENGLSVHVRRL
           |||||||||||||||||||||||||||||||||||||||| ||||||||||||:||:|
m731       MNIRFFALTVPVLSLAACAVPEAYDDGGRGHMPPVQNQAGTDDFRAFSCENGLSVRVRHL
                   10        20        30        40        50        60

70        80        90       100       110       120
a731.pep   DGGRIALRLDGRRAVLSSDVAASGERYTAEHGLFGNGTEWHQKGGEAFFGFTDAYGNSVE
           |:|::|||||||||||||||||||||||||||||:|||||||||||||||||||||||||
m731       DSGKVALRLDGRRAVLSSDVAASGERYTAEHGLFGNATEWHQKGGEAFFGFTDAYGNSVE
                   70        80        90       100       110       120 a731.pep   TSCRARX
           |||||||
m731       TSCRARX
```

The following partial DNA sequence was identified in *N. gonorrhoeae* <SEQ ID 2481>:

```
g732.seq
    1  ATGTCGAAAC CTGTTTTTAA GAAAATCGCA CTTTATACTT TGGGTGCAAT

51  CAGCGGCGTG GCCGTAAGTC TGGCGGTGCA GGGTTTTGCC GCCGagaagg

101  ACGGgcgGGA TAACGAagtC CTGCCGGTGC AATCCATCCG TACGATGGCG

151  GAGGTTTACG GTCAGATTAA GGCAAACTAC TATCATGACA AACCCGATGC

201  CGATTTGTTT GAAGGTGCGA TGAAGGGTAT GGTGGCCGGT TTGGATCCGC

251  ATTCCGAATA TATGGATAAA AAAGGTTATG CCGAGATAAA GGAGTCCACC

301  AGCGGCGAAT TTGGCGGCTT GGGGATGGAA ATCGGGCAGG AAGACGGTTT

351  TGTCAAAGTG GTTTCGCCGA TTGAGGACAC GCCTGCCGAA CGGGCGGAGG

401  TGAAAAGCGG CGATTTCATT GTGAAAATCG ATAATGTTTC GACGCGCGGT

451  ATGACGGTCA GCGAAGCGGT GAAAAAAATG CGGGGCAAGC CGGGTACGAA

501  GATTACTTTG ACGTTGTCGC GCAAAAATGC CGACAAGCCG ATAGTCGTCA

551  ACCTGACCCG TGCCATTATT AAAGTGAAAA GCGTCCGCCA TCACCTGATC
```
-continued

```
 601 GAACCCGATT ACGGCTATAT CCGCGTGTCG CAGTTCCAAG AGCGGACGGT

651 CGAAAGCGTC AATACCGCCG CAAAAGAGCT GGTAAAGGAA AATAAAGGAA

701 AACCGCTCAA GGGGCTGGTG TTGGATTTGC GCGACGACCC CGGCGGGCTT

751 TTGACCGGCG CGGTCGGCGT GTCGGCGGCG TTTCTGCCGT CTGAAGCGGT

801 CGTCGTCAGC ACCAAGGGAC GCGACGGCAA AGACGGCATG GTACTGAAAG

851 CCGTTCCCGA GGATTATGTG TACGGTATGG GCGGCGACCC TTTGGCGGGT

901 ATTCCTGCCG AGTTGAAAAC GATTCCGATG ACGgtaTTGG TcaaTTCCGG

951 TTCggcttCC GCGTCGGAGA TTGtcgCCGG CGCATTGCAG GACCACAAAC

1001 GCGCGGTCAT CGTCGGTACG CAGAGCTTCG GTAAAGGTTC GGTTCAGACT

1051 TTGATTCCTT TGTCCAACGG CAGCGCGGTC AAGTTGACGA CCGCCCTGTA

1101 TTACACGCCG AACGACCGTT CCATTCAGGC ACAGGGGATT GTTCCCGATG

1151 TCgaaGTAAA AGATAAGGAA CGTACTTTTG AAAGCCGCGA GGCGGACCTG

1201 GTCGGACACA TCGGCAATCC CTTgggcGGC GAGGATGTGA ACAGTGAAAC

1251 CCttgcCGTA CCGCTTGAAA AAGATGCGGA TAAGCCCGCT GCAAAAGAAA

1301 AAGGTAAAAA GAAAAAGGAC GAGGATTTGT CTTCAAGGCG GATTCCGAAC

1351 CCTGCGAAAG ACGATCAGTT GCGTAAGGCT TTGGATTTGG TCAAGTCGCC

1401 CGAGCAGTGG CAGAAGTCTT TGGGGCTGGC GGCGAAAAAA CCGGTTTCAA

1451 ATAAAGATAA AAAAGATAAG AAGTAG
```

This corresponds to the amino acid sequence <SEQ ID 2482; ORF 732>:

```
g732.pep
  1MSKPVFKKIA LYTLGAISGV AVSLAVQGFA AEKDGRDNEV LPVQSIRTMA

51EVYGQIKANY YHDKPDADLF EGAMKGMVAG LDPHSEYMDK KGYAEIKEST

101SGEFGGLGME IGQEDGFVKV VSPIEDTPAE RAEVKSGDFI VKIDNVSTRG

151MTVSEAVKKM RGKPGTKITL TLSRKNADKP IVVNLTRAII KVKSVRHHLI

201EPDYGYIRVS QFQERTVESV NTAAKELVKE NKGKPLKGLV LDLRDDPGGL

251LTGAVGVSAA FLPSEAVVVS TKGRDGKDGM VLKAVPEDYV YGMGGDPLAG

301IPAELKTIPM TVLVNSGSAS ASEIVAGALQ DHKRAVIVGT QSFGKGSVQT

351LIPLSNGSAV KLTTALYYTP NDRSIQAQGI VPDVEVKDKE RTFESREADL

401VGHIGNPLGG EDVNSETLAV PLEKDADKPA AKEKGKKKKD EDLSSRRIPN

451PAKDDQLRKA LDLVKSPEQW QKSLGLAAKK PVSNKDKKDK K*
```

The following partial DNA sequence was identified in *N. meningitidis* <SEQ ID 2483>:

```
m732.seq
  1 ATGTCGAAAC CTGTTTTTAA GAAAATCGCA CTTTATACTT TGGGTGCAAT

51 CAGCGGCGTG GCCGTCAGTC TGGCGGTGCA GGGTTTTGCC GCCGAGAAGG

101 ACAGGCGGGA TAACGAAGTC CTGCCGGTGC AATCCATCCG CACAATGGCG

151 GAGGTTTACG GTCAAATCAA GGCAAACTAC TATCAGGACA AACCCGATGC

201 CGATTTGTTT GAAGGTGCGA TGAAGGGTAT GGTGGCCGGT TTGGATCCGC

251 ATTCCGAATA TATGGATAAA AAAGGTTATG CCGAGATAAA GGAGTCCACC
```

```
 301 AGCGGCGAAT TTGGCGGCTT GGGGATGGAA ATCGGGCAGG AAGACGGATT
 351 TGTCAAAGTG GTTTCGCCGA TTGAGGACAC GCCTGCGGAA CGGGCGGGGG
 401 TGAAAAGCGG CGATTTCATT GTGAAAATCG ATAATGTTTC GACACGCGGC
 451 ATGACGGTCA GCGAAGCGGT GAAGAAAATG CGGGGCAAGC CGGGTACGAA
 501 GATTACTTTG ACGCTGTCGC GCAAAAATGC CGACAAGCCG ATAGTCGTCA
 551 ACCTGACCCG TGCCATTATT AAAGTGAAAA GCGTCCGCCA TCACCTGATC
 601 GAACCCGATT ACGGCTATAT CCGCGTGTCG CAGTTCCAAG AGCGGACGGT
 651 CGAAAGCGTC AATACCGCCG CAAAGAGCT GGTAAAGGAA AATAAAGGAA
 701 AACCGCTCAA GGGGCTGGTG TTGGATTTGC GCGACGACCC CGGCGGGCTT
 751 TTGACTGGCG CGGTCGGCGT GTCGGCGGCA TTTCTGCCGT CTGAAGCAGT
 801 CGTCGTCAGC ACCAAGGGAC GCGACGGCAA AGACCGCATG GTACTGAAAG
 851 CCATTCCTGA AGATTATGTG TACGGGATGG GCGGCGATTC GTTGGCGGGC
 901 ATTCCTGCCG AGTTGAAAAC CATACCGATG ACGGTATTGG TCAATTCCGG
 951 TTCGGCTTCC GCGTCGGAGA TTGTCGCAGG TGCATTGCAG GATCATAAAC
1001 GCGCGGTCAT CGTCGGTACG CAGAGCTTCG GCAAAGGTTC GGTTCAGACT
1051 TTGATTCCTT TGTCCAACGG CAGCGCGGTC AAGCTGACAA CGGCACTGTA
1101 TTATACGCCG AACGACCGTT CTATTCAGGC GCAGGGGATT GTTCCCGATG
1151 TCGAAGTAAA AGATAAGGAA CGCATTTTTG AAAGCCGCGA GGCGGATTTG
1201 GTCGGACACA TCGGCAATCC CTTGGGCGGC GAGGATGTGA ACGGTGAAAC
1251 CCTTGCCGTG CCGCTTGAAA AGATGCGGA TAAGCCCGCT GTAAAAGAAA
1301 AAGGTAAAAA GAAAAAGGAC GAGGATTTGT CTTCAAGGCG GATTCCCAAC
1351 CCTGCCAAAG ACGACCAGTT GCGGAAAGCT TTGGATTTAG TCAAGTCGCC
1401 CGAGCAGTGG CAGAAGTCTT TGGGGCTGGC GGCGAAAAAG CCGGTTTCAA
1451 ATAAAGATAA GAAAGATAAA AAGATAAGA AGTAG
```

This corresponds to the amino acid sequence <SEQ ID 2484; ORF 732>.

```
m732.pep
  1 MSKPVFKKIA LYTLGAISGV AVSLAVQGFA AEKDRRDNEV LPVQSIRTMA

51 EVYGQIKANY YQDKPDADLF EGAMKGMVAG LDPHSEYMDK KGYAEIKEST

101 SGEFGGLGME IGQEDGFVKV VSPIEDTPAE RAGVKSGDFI VKIDNVSTRG

151 MTVSEAVKKM RGKPGTKITL TLSRKNADKP IVVNLTRAII KVKSVRHHLI

201 EPDYGYIRVS QFQERTVESV NTAAKELVKE NKGKPLKGLV LDLRDDPGGL

251 LTGAVGVSAA FLPSEAVVVS TKGRDGKDRM VLKAIPEDYV YGMGGDSLAG

301 IPAELKTIPM TVLVNSGSAS ASEIVAGALQ DHKRAVIVGT QSFGKGSVQT

351 LIPLSNGSAV KLTTALYYTP NDRSIQAQGI VPDVEVKDKE RIFESREADL

401 VGHIGNPLGG EDVNGETLAV PLEKDADKPA VKEKGKKKKD EDLSSRRIPN

451 PAKDDQLRKA LDLVKSPEQW QKSLGLAAKK PVSNKDKKDK KDKK*
```

Computer analysis of the amino acid sequences gave the following results:

Homology with a Predicted ORF from *N. meningitidis* menA with menB ORF 732 shows 98.2% identity over a 491 aa overlap with a predicted ORF (ORF732.a) from *N. gonorrhoeae*:

```
    m732/g732      98.2% identity in 491 aa overlap 10        20        30        40        50        60
         m732.pep   MSKPVFKKIALYTLGAISGVAVSLAVQGFAAEKDRRDNEVLPVQSIRTMAEVYGQIKANY
                    ||||||||||||||||||||||||||||||||| ||||||||||||||||||||||||||
             g732   MSKPVFKKIALYTLGAISGVAVSLAVQGFAAEKDGRDNEVLPVQSIRTMAEVYGQIKANY
                        10        20        30        40        50        60

70        80        90       100       110       120
         m732.pep   YQDKPDADLFEGAMKGMVAGLDPHSEYMDKKGYAEIKESTSGEFGGLGMEIGQEDGFVKV
                    | :|||||||||||||||||||||||||||||||||||||||||||||||||||||||||
             g732   YHDKPDADLFEGAMKGMVAGLDPHSEYMDKKGYAEIKESTSGEFGGLGMEIGQEDGFVKV
                        70        80        90       100       110       120

130       140       150       160       170       180
         m732.pep   VSPIEDTPAERAGVKSGDFIVKIDNVSTRGMTVSEAVKKMRGKPGTKITLTLSRKNADKP
                    ||||||||||||  |||||||||||||||||||||||||||||||||||||||||||||
             g732   VSPIEDTPAERAEVKSGDFIVKIDNVSTRGMTVSEAVKKMRGKPGTKITLTLSRKNADKP
                       130       140       150       160       170       180

190       200       210       220       230       240
         m732.pep   IVVNLTRAIIKVKSVRHHLIEPDYGYIRVSQFQERTVESVNTAAKELVKENKGKPLKGLV
                    ||||||||||||||||||||||||||||||||||||||||||||||||||||||||||||
             g732   IVVNLTRAIIKVKSVRHHLIEPDYGYIRVSQFQERTVESVNTAAKELVKENKGKPLKGLV
                       190       200       210       220       230       240

250       260       270       280       290       300
         m732.pep   LDLRDDPGGLLTGAVGVSAAFLPSEAVVVSTKGRDGKDRMVLKAIPEDYVYGMGGDSLAG
                    ||||||||||||||||||||||||||||||||||||||| :|||||||||||||||| ||
             g732   LDLRDDPGGLLTGAVGVSAAFLPSEAVVVSTKGRDGKDGMVLKAVPEDYVYGMGGDPLAG
                       250       260       270       280       290       300

310       320       330       340       350       360
         m732.pep   IPAELKTIPMTVLVNSGSASASEIVAGALQDHKRAVIVGTQSFGKGSVQTLIPLSNGSAV
                    ||||||||||||||||||||||||||||||||||||||||||||||||||||||||||||
             g732   IPAELKTIPMTVLVNSGSASASEIVAGALQDHKRAVIVGTQSFGKGSVQTLIPLSNGSAV
                       310       320       330       340       350       360

370       380       390       400       410       420
         m732.pep   KLTTALYYTPNDRSIQAQGIVPDVEVKDKERIFESREADLVGHIGNPLGGEDVNGETLAV
                    ||||||||||||||||||||||||||||||||| ||||||||||||||||||||| :|||
             g732   KLTTALYYTPNDRSIQAQGIVPDVEVKDKERTFESREADLVGHIGNPLGGEDVNSETLAV
                       370       380       390       400       410       420

430       440       450       460       470       480
         m732.pep   PLEKDADKPAVKEKGKKKKDEDLSSRRIPNPAKDDQLRKALDLVKSPEQWQKSLGLAAKK
                    ||||||||||:|||||||||||||||||||||||||||||||||||||||||||||||||
             g732   PLEKDADKPAAKEKGKKKKDEDLSSRRIPNPAKDDQLRKALDLVKSPEQWQKSLGLAAKK
                       430       440       450       460       470       480

490
         m732.pep   PVSNKDKKDKKDKKX
                    |||||||||||
             g732   PVSNKDKKDKKX
                       490
```

The following partial DNA sequence was identified in *N. meningitidis* <SEQ ID 2485>:

```
a732.seq
    1   ATGTCGAAAC CTGTTTTTAA GAAAATCGCA CTTTATACTT TGGGTGCAAT

51   CAGCGGCGTG GCCGTCAGTC TGGCGGTGCA GGGTTTTGCC GCCGAGAAGG

101   ACAGGCGGGA TAACGAAGTC CTGCCGGTGC AATCCATCCG CACAATGGCG

151   GAGGTTTACG GTCAAATCAA GGCAAACTAC TATCAGGACA AACCCGATGC

201   CGATTTGTTT GAAGGTGCGA TGAAGGGTAT GGTGGCCGGT TTGGATCCGC

251   ATTCCGAATA TATGGATAAA AAAGGTTATG CCGAGATAAA GGAGTCCACC

301   AGCGGCGAAT TTGGCGGCTT GGGGATGGAA ATCGGGCAGG AAGACGGATT

351   TGTCAAAGTG GTTTCGCCGA TTGAGGACAC GCCTGCGGAA CGGGCGGGGG

401   TGAAAAGCGG CGATTTCATT GTGAAAATCG ATAATGTTTC GACACGCGGC
```

```
-continued
 451 ATGACGGTCA GCGAAGCGGT GAAGAAAATG CGGGGCAAGC CGGGTACGAA
 501 GATTACTTTG ACGCTGTCGC GCAAAAATGC CGACAAGCCG ATAGTCGTCA
 551 ACCTGACCCG TGCCATTATT AAAGTGAAAA GCGTCCGCCA TCACCTGATC
 601 GAACCCGATT ACGGCTATAT CCGCGTGTCG CAGTTCCAAG AGCGGACGGT
 651 CGAAAGCGTC AATACCGCCG CAAAAGAGCT GGTAAAGGAA AATAAAGGAA
 701 AACCGCTCAA GGGGCTGGTG TTGGATTTGC GCGACGACCC CGGCGGGCTT
 751 TTGACTGGCG CGGTCGGCGT GTCGGCGGCA TTTCTGCCGT CTGAAGCAGT
 801 CGTCGTCAGC ACCAAGGGAC GCGACGGCAA AGACCGCATG GTACTGAAAG
 851 CCGTTCCTGA AGATTATGTG TACGGGATGG GCGGCGATTC GTTGGCGGGC
 901 ATTCCTGCCG AGTTGAAAAC CATACCGATG ACGGTATTGG TCAATTCCGG
 951 TTCGGCTTCC GCGTCGGAGA TTGTCGCAGG TGCATTGCAG GATCATAAAC
1001 GCGCGGTCAT CGTCGGTACG CAGAGCTTCG GCAAAGGTTC GGTTCAGACT
1051 TTGATTCCTT TGTCCAACGG CAGCGCGGTC AAGCTGACAA CGGCACTGTA
1101 TTATACGCCG AACGACCGTT CTATTCAGGC GCAGGGGATT GTTCCCGATG
1151 TCGAAGTAAA AGATAAGGAA CGCATTTTTG AAAGCCGCGA GGCGGATTTG
1201 GTCGGACACA TCGGCAATCC TTTGGGCGGC GAGGATGTGA ACAGTGAAAC
1251 CCTTGCCGTG CCGCTTGAAA AGATGCGGA TAAGCCCGCT GTAAAAGAAA
1301 AAGGTAAAAA GAAAAAGGAC GAGGATTTGT CTTCAAGGCG GATTCCCAAC
1351 CCTGCCAAAG ACGACCAGTT GCGGAAAGCT TTGGATTTAG TCAAGTCGCC
1401 CGAGCAGTGG CAGAAGTCTT TGGGGCTGGC GGCGAAAAAG CCGGTTTCAA
1451 ATAAAGATAA GAAAGATAAA AAAGATAAGA AGTAG
```

This corresponds to the amino acid sequence <SEQ ID 2486; ORF 732.a>:

```
a732.pep

1 MSKPVFKKIA LYTLGAISGV AVSLAVQGFA AEKDRRDNEV LPVQSIRTMA
 51 EVYGQIKANY YQDKPDADLF EGAMKGMVAG LDPHSEYMDK KGYAEIKEST
101 SGEFGGLGME IGQEDGFVKV VSPIEDTPAE RAGVKSGDFI VKIDNVSTRG
151 MTVSEAVKKM RGKPGTKITL TLSRKNADKP IVVNLTRAII KVKSVRHHLI
201 EPDYGYIRVS QFQERTVESV NTAAKELVKE NKGKPLKGLV LDLRDDPGGL
251 LTGAVGVSAA FLPSEAVVVS TKGRDGKDRM VLKAVPEDYV YGMGGDSLAG
301 IPAELKTIPM TVLVNSGSAS ASEIVAGALQ DHKRAVIVGT QSFGKGSVQT
351 LIPLSNGSAV KLTTALYYTP NDRSIQAQGI VPDVEVKDKE RIFESREADL
401 VGHIGNPLGG EDVNSETLAV PLEKDADKPA VKEKGKKKKD EDLSSRRIPN
451 PAKDDQLRKA LDLVKSPEQW QKSLGLAAKK PVSNKDKKDK KDKK* a732/m732    99.6% identity in 494 aa overlap 10        20        30        40        50        60
a732.pep   MSKPVFKKIALYTLGAISGVAVSLAVQGFAAEKDRRDNEVLPVQSIRTMAEVYGQIKANY
           ||||||||||||||||||||||||||||||||||||||||||||||||||||||||||||
m732       MSKPVFKKIALYTLGAISGVAVSLAVQGFAAEKDRRDNEVLPVQSIRTMAEVYGQIKANY
                     10        20        30        40        50        60

70        80        90       100       110       120
a732.pep   YQDKPDADLFEGAMKGMVAGLDPHSEYMDKKGYAEIKESTSGEFGGLGMEIGQEDGFVKV
           ||||||||||||||||||||||||||||||||||||||||||||||||||||||||||||
m732       YQDKPDADLFEGAMKGMVAGLDPHSEYMDKKGYAEIKESTSGEFGGLGMEIGQEDGFVKV
                     70        80        90       100       110       120
```

-continued

```
                130       140       150       160       170       180
a732.pep   VSPIEDTPAERAGVKSGDFIVKIDNVSTRGMTVSEAVKKMRGKPGTKITLTLSRKNADKP
           ||||||||||||||||||||||||||||||||||||||||||||||||||||||||||||
m732       VSPIEDTPAERAGVKSGDFIVKIDNVSTRGMTVSEAVKKMRGKPGTKITLTLSRKNADKP
                130       140       150       160       170       180

190       200       210       220       230       240
a732.pep   IVVNLTRAIIKVKSVRHHLIEPDYGYIRVSQFQERTVESVNTAAKELVKENKGKPLKGLV
           ||||||||||||||||||||||||||||||||||||||||||||||||||||||||||||
m732       IVVNLTRAIIKVKSVRHHLIEPDYGYIRVSQFQERTVESVNTAAKELVKENKGKPLKGLV
                190       200       210       220       230       240

250       260       270       280       290       300
a732.pep   LDLRDDPGGLLTGAVGVSAAFLPSEAVVVSTKGRDGKDRMVLKAVPEDYVYGMGGDSLAG
           |||||||||||||||||||||||||||||||||||||||||||:||||||||||||||||
m732       LDLRDDPGGLLTGAVGVSAAFLPSEAVVVSTKGRDGKDRMVLKAIPEDYVYGMGGDSLAG
                250       260       270       280       290       300

310       320       330       340       350       360
a732.pep   IPAELKTIPMTVLVNSGSASASEIVAGALQDHKRAVIVGTQSFGKGSVQTLIPLSNGSAV
           ||||||||||||||||||||||||||||||||||||||||||||||||||||||||||||
m732       IPAELKTIPMTVLVNSGSASASEIVAGALQDHKRAVIVGTQSFGKGSVQTLIPLSNGSAV
                310       320       330       340       350       360

370       380       390       400       410       420
a732.pep   KLTTALYYTPNDRSIQAQGIVPDVEVKDKERIFESREADLVGHIGNPLGGEDVNSETLAV
           |||||||||||||||||||||||||||||||||||||||||||||||||||||:||||
m732       KLTTALYYTPNDRSIQAQGIVPDVEVKDKERIFESREADLVGHIGNPLGGEDVNGETLAV
                370       380       390       400       410       420

430       440       450       460       470       480
a732.pep   PLEKDADKPAVKEKGKKKKDEDLSSRRIPNPAKDDQLRKALDLVKSPEQWQKSLGLAAKK
           ||||||||||||||||||||||||||||||||||||||||||||||||||||||||||||
m732       PLEKDADKPAVKEKGKKKKDEDLSSRRIPNPAKDDQLRKALDLVKSPEQWQKSLGLAAKK
                430       440       450       460       470       480

490
a732.pep   PVSNKDKKDKKDKKX
           |||||||||||||||
m732       PVSNKDKKDKKDKKX
                490
```

The following partial DNA sequence was identified in *N. gonorrhoeae* <SEQ ID 2487>:

```
g733.seq
   1 ATGATGAATC CGAAAACCTT GGGCCGTTTG TCGCTGTGTG CGGCGGTCTT

51 GGCTCTGACC GCCTGCGCCG GCGGCGGGCA TAAAAACCTG TATTATTACG

101 GCGGTTATCC CGATACCGTC TATGAAGGTT TGAAAAACGa cgACACTTCG

151 TTGGGCAAGC AGACCGAAAA GATGGAAAAA TACTTTGCGG AAGCCGCCAA

201 CAAAAAAATG AATGCCGCCC CGGGTGCGCA CGCCCATTTG GGACTGCTGC

251 TTTCCCGTTC GGGAGACAAA GAGGGCGCGT TCCGCCAATT TGAAGAAGAG

301 AAAAGGCTGT TTCCCGAATC GGGCGTATTT ATGGACTTCC TGATGAAAAC

351 CGGtaaAGGA GGCAAGCGAT GA
```

This corresponds to the amino acid sequence <SEQ ID 2488; ORF 733>:

```
g733.pep
   1 MMNPKTLGRL SLCAAVLALT ACAGGGHKNL YYYGGYPDTV YEGLKNDDTS

51 LGKQTEKMEK YFAEAANKKM NAAPGAHAHL GLLLSRSGDK EGAFRQFEEE

101 KRLFPESGVF MDFLMKTGKG GKR*
```

The following partial DNA sequence was identified in *N. meningitidis* <SEQ ID 2489>:

```
m733.seq
   1 ATGATGAATC CGAAAACCTT GAGCCGTTTG TCGCTGTGTG CGGCGGTCTT

51 GGCTCTGACC GCCTGCGGCG GCAACGGGCA AAAATCCCTG TATTATTACG
```

```
101 GCGGCTATCC CGATACCGTC TATGAAGGTT TGAAAAACGA CGACACTTCG

151 TTGGGCAAGC AGACCGAAAA GATGGAAAAA TACTTTGTGG AAGCCGGCAA

201 CAAAAAAATG AATGCCGCCC CGGGTGCGCA CGCCCATCTG GGACTGCTGC

251 TTTCCCGTTC GGGAGACAAA GAGGGCGCGT TCCGCCAGTT TGAAGAAGAG

301 AAAAGGCTGT TTCCCGAATC GGGCGTATTT ATGGACTTCC TGATGAAAAC

351 CGGTAAAGGA GGCAAGCGAT GA
```

This corresponds to the amino acid sequence <SEQ ID 2490; ORF 733>:

```
m733.pep
  1 MMNPKTLSRL SLCAAVLALT ACGGNGQKSL YYYGGYPDTV YEGLKNDDTS

51 LGKQTEKMEK YFVEAGNKKM NAAPGAHAHL GLLLSRSGDK EGAFRQFEEE

101 KRLFPESGVF MDFLMKTGKG GKR*
```

Computer analysis of the amino acid sequences gave the following results:
Homology with a Predicted ORF from *N. meningitidis* menA with menB ORF 733 shows 94.3% identity over a 123 aa overlap with a predicted ORF (ORF733.a) from *N. gonorrhoeae*:

```
    m733/g733
                       10         20         30         40         50         60
          m733.pep   MMNPKTLSRLSLCAAVLALTACGGNGQKSLYYYGGYPDTVYEGLKNDDTSLGKQTEKMEK
                     |||||||:||||||||||||||:|:|:|||||||||||||||||||||||||||||||||
          g733       MMNPKTLGRLSLCAACLALTACAGGGHKNLYYYGGYPDTVYEGLKNDDTSLGKQTEKMEK
                       10         20         30         40         50         60
                       70         80         90        100        110        120
          m733.pep   YFVEAGNKKMNAAPGAHAHLGLLLSRSGDKEGAFRQFEEEKRLFPESGVFMDFLMKTGKG
                     ||:||:|||||||||||||||||||||||||||||||||||||||||||||||||||||
          g733       YFAEAANKKMNAAPGAHAHLGLLLSRSGDKEGAFRQFEEEKRLFPESGVFMDFLMKTGKG
                       70         80         90        100        110        120
          m733.pep   GKRX
                     ||||
          g733       GKRX
```

The following partial DNA sequence was identified in *N. meningitidis* <SEQ ID 2491>:

```
a733.seq
  1 ATGATGAATC CGAAAACCTT GAGCCGTTTG TCGCTGTGTG CGGCGGTCTT

51 GGCTCTGACC GCCTGCGGCG GCAACGGGCA AAAATCCCTG TATTATTACG

101 GCGGCTATCC CGATACCGTC TATGAAGGTT TGAAAAACGA CGACACTTCG

151 TTGGGCAAGC AGACCGAAAA GATGGAAAAA TACTTTGTGG AAGCCGGCAA

201 CAAAAAAATG AATGCCGCCC CGGGTGCGCA CGCCCATCTG GGACTGCTGC

251 TTTCCCGTTC GGGAGACAAA GAGGGCGCGT TCCGCCAGTT TGAAGAAGAG

301 AAAAGGCTGT TTCCCGAATC GGGCGTATTT ATGGACTTCC TGATGAAAAC

351 CGGTAAAGGA GGCAAGCGAT GA
```

This corresponds to the amino acid sequence <SEQ ID 2492; ORF 733.a>:

```
a733.pep
        1   MKNPKTLSRL SLCAAVLALT ACGGNGQKSL YYYGGYPDTV YEGLKNDDTS

51   LGKQTEKMEK YFVEAGNKKM NAAPGAHAHL GLLLSRSGDK EGAFRQFEEE

101   KRLFPESGVF MDFLMKTGKG GKR* a733/m733 100.0% identity in 123 aa overlap 10         20         30         40         50         60
   m733.pep  MMNPKTLSRLSLCAAVLALTACGGNGQKSLYYYGGYPDTVYEGLKNDDTSLGKQTEKMEK
             ||||||||| |||||| ||||| ||| || ||||||||||||||||||||||||||||||
   m733      MMNPKTLGRLSLCAACLALTACAGGGHKNLYYYGGYPDTVYEGLKNDDTSLGKQTEKMEK
                 10         20         30         40         50         60

70         80         90        100        110        120
   m733.pep  YFVEAGNKKMNAAPGAHAHLGLLLSRSGDKEGAFRQFEEEKRLFPESGVFMDFLMKTGKG
             |||| | ||||||||||||||||||||||||||||||||||||||||||||||||||||
   m733      YFAEAANKKMNAAPGAHAHLGLLLSRSGDKEGAFRQFEEEKRLFPESGVFMDFLMKTGKG
                 70         80         90        100        110        120 m733.pep  GKRX
             ||||
   m733      GKRX
```

The following partial DNA sequence was identified in *N. gonorrhoeae* <SEQ ID 2493>:

```
g734.seq
    1 ATGATGAAAA AGATACTGGC AGTATCGGCA CTATGCCTGA TGACTGCGGC

51 GGCACAGGCT GCCGATACTT ACGGCTATCT CGCCGTTTGG CAGAATCCGC

101 AGGATGCAAA CGATGTTTTG CAGGTTAAAA CCACAAAAGA AGATTCGGCG

151 AAAAGCGAAG CGTTTGCCGA GTTGGAAGCC TTTTGCAAAG GTCAGGACAC

201 GCTTGCGGGC ATTGCCGAAG ACGAGCCGAC CGGATGCCGG TCGGTCGTGT

251 CGCTGAACAA TACCTGTGTC TCGCTGGCAT ACCCGAAAGC CTTGGGCGCG

301 ATGCGCGTTG AAAACGCCGT CGTGATTACT TCTCCGCGTT TTACGAGCGT

351 TCATCAGGTC GCACTCAACC AGTGCATAAA AAAATACGGC GCACAGGGAC

401 AATGCGGCTT GGAAACAGTG TATTGCACGT CATCTTCTTA TTACGGCGGG

451 GCTGTTCGCT CCTTAATCCA ACACCTGAAA TAA
```

This corresponds to the amino acid sequence <SEQ ID 2494; ORF 734.ng>:

```
g734.pep
    1 MMKKILAVSA LCLMTAAAQA ADTYGYLAVW QNPQDANDVL QVKTTKEDSA

51 KSEAFAELEA FCKGQDTLAG IAEDEPTGCR SVVSLNNTCV SLAYPKALGA

101 MRVENAVVIT SPRFTSVHQV ALNQCIKKYG AQGQCGLETV YCTSSSYYGG

151 AVRSLIQHLK *
```

The following partial DNA sequence was identified in *N. meningitidis* <SEQ ID 2495>:

```
m734.seq (partial)
    1 TCGGGCATTG CTGAAGACGA GCCGACCGGA TGCCGGTCGG TCGTGTCGCT

51 GAACAATACC TGTGTCGCGC TGGCATACCC GAAAGCCTTG GGCGCGCTGC
```

-continued

```
101 GTGTCGACAA CGCCGTCGTG ATTACTTCTC CGCGTTTTAC GAGCGTTCAT

151 CAGGTCGCAC TCAACCAGTG CATCAAAAAA TACGGCGTAC AGGGACAATG

201 CGGCTTGGAA ACAGTGTATT GCACATCTTC TTCTTATTAC GGCGGAACTG

251 TGCGCTCTTT GATTCAAAAT CTCAAATAA
```

This corresponds to the amino acid sequence <SEQ ID 2496; ORF 734>:

```
m734.pep (partial)
  1 SGIAEDEPTG CRSVVSLNNT CVALAYPKAL GALRVDNAVV ITSPRFTSVH

51 QVALNQCIKK YGVQGQCGLE TVYCTSSSYY GGTVRSLIQN LK*
``` m734/g734 92.4% identity in 92 aa overlap

```
                                        10         20         30
   m734.pep                     SGIAEDEPTGCRSVVSLNNTCVALAYPKAL
                                :||||||||||||||||||| :||||||||
       g734   VLQVKTTKEDSAKSEAFAELEAFCKGQDTLAGIAEDEPTGCRSVVSLNNTCVSLAYPKAL
                40         50         60         70         80         90
                      40         50         60         70         80         90
   m734.pep   GALRVDNAVVITSPRFTSVHQVALNQCIKKYGVQGQCGLETVYCTSSSYYGGTVRSLIQN
              || :|:||||||||||||||||||||||||||||:||||||||||||||||||:||||||:
       g734   GAMRVENAVVITSPRFTSVHQVALNQCIKKYGAQGQCGLETVYCTSSSYYGGAVRSLIQH
               100        110        120        130        140        150
   m734.pep   LKX
              |||
       g734   LKX
              160
```

The following partial DNA sequence was identified in *N. meningitidis* <SEQ ID 2497>:

```
a734.seq
  1 ATGATGAAAA AGATACTGGC CGTATCGGCA CTATGCCTGA TGACTGCGGC

51 GGCACGGGCT GCCGATACTT ACGGCTATCT CGCCGTTTGG CAGAATCCGC

101 AGAATGCAAA CGATGTTTTG CAGGTTAAAA CCACAAAAGA AGATTCGACG

151 AAAAGCGAAG CGTTTGCCGA GTTGGAAGCT TTCTGCAAAG GTCAGGACAC

201 GCTTGCGGGC ATTGCCGAAG ACGAGCCGAC CGGATGCCGG TCGGTCGTGT

251 CGCTGAACAA TACCTGTGTC GCGCTGGCAT ACCCGAAAGC CTTGGGCGCG

301 ATGCGCGTTG AAAACGCCGT TGTGATTACT TCTCCGCGTT TTACGAGCGT

351 TTATCAGGTC GCACTCAACC AGTGCATCAA AAAATACGGC GCACAGGGAC

401 AATGCGGCTT GGAAACAGTG TATTGCACGT CTTCTTCTTA TTACGGGGGA

451 ACTGTGCGCT CTTTGATTCA AAATCTCAAA TAA
```

This corresponds to the amino acid sequence <SEQ ID 2498; ORF 734.a>:

```
a734.pep
  1 MMKKILAVSA LCLMTAAARA ADTYGYLAVW QNPQNANDVL QVKTTKEDST

51 KSEAFAELEA FCKGQDTLAG IAEDEPTGCR SVVSLNNTCV ALAYPKALGA

101 MRVENAVVIT SPRFTSVYQV ALNQCIKKYG AQGQCGLETV YCTSSSYYGG

151 TVRSLIQNLK *
``` a734/g734 95.6% identity in 160 aa overlap

```
                 10        20        30        40        50        60
     a734.pep  MMKKILAVSALCLMTAAARAADTYGYLAVWQNPQNANDVLQVKTTKEDSTKSEAFAELEA
               ||||||||||||||||:|||||||||||||:||||||||||||||||:||||||||||
     g734      MMKKILAVSALCLMTAAAQAADTYGYLAVWQNPQDANDVLQVKTTKEDSAKSEAFAELEA
                 10        20        30        40        50        60

70        80        90       100       110       120
     a734.pep  FCKGQDTLAGIAEDEPTGCRSVVSLNNTCVALAYPKALGAMRVENAVVITSPRFTSVYQV
               ||||||||||||||||||||||||||||||:||||||||||||||||||||||||:||
     g734      FCKGQDTLAGIAEDEPTGCRSVVSLNNTCVSLAYPKALGAMRVENAVVITSPRFTSVHQV
                 70        80        90       100       110       120

130       140       150       160
     a734.pep  ALNQCIKKYGAQGQCGLETVYCTSSSYYGGTVRSLIQNLKX
               ||||||||||||||||||||||||||||||:||||||:|||
     g734      ALNQCIKKYGAQGQCGLETVYCTSSSYYGGAVRSLIQHLKX
                130       140       150       160
``` g735.seq  not found yet g735.pep  not found yet

The following partial DNA sequence was identified in *N. meningitidis* <SEQ ID 2499>:

```
m735.seq
   1 ATGAATCTCG TGAAACTGCT GGCGAATAAC TGGCAACCGA TTGCCATTAT

51 CGCGCTTGTC GGCACGGGCT TGGCTGTGTC GCACCATCAA GGCTACAAGT

101 CGGCATTTGC GAAGCAGCAG GCGGTCATCG ACAAGATGGA GCGCGACAAG

151 GCGCAAGCCC TGCTGTTGTC GGCTCAAAAC TATGCGCGCG AACTGGAACT

201 GGCACGCGCG GAAGCTAAAA AATATGAAGT CAAGGCGCAC GCTGTCGGCA

251 TGGCTTTGGC GAAAAAACAG GCGGAAGTCA GCCGTCTGAA AACGGAAAAT

301 AAAAAGGAAA TCGAAAATGT CCTTACTCAA GACCGTAAAA ATGCAAGCGG

351 CGGTTGCATT GACGGCTTTG GCTCTCACGG CCTGCAGCTC TACAACCGCG

401 CCCTCGGCTA CGGAAATTAA
```

This corresponds to the amino acid sequence <SEQ ID 2500; ORF 735>:

```
m735.pep
   1 MNLVKLLANN WQPIAIIALV GTGLAVSHHQ GYKSAFAKQQ AVIDKMERDK

51 AQALLLSAQN YARELELARA EAKKYEVKAH AVGMALAKKQ AEVSRLKTEN

101 KKEIENVLTQ DRKNASGGCI DGFGSHGLQL YNRALGYGN*
```

The following partial DNA sequence was identified in *N. meningitidis* <SEQ ID 2501>:

```
a735.seq
   1 ATGAATCTCG TGAAACTGCT GGCGAATAAC TGGCAACCGA TTGCCATCAT

51 CGCGCTTGTC GGCACGGGTT TGGCGGTGTC GCACCATCAA GGCTACAAGT

101 CGGCTTTTGC GAAGCAGCAG GCGGTCATTG AGAAAATGAA GCGCGACAAG

151 GCGCAAGCCC TGCTGTTGTC GGCTCAAAAC TACGCCCGCG AACTGGAACA

201 GGCGCGTGCG GAAGCTAAAA AATATGAAGT CAAGGCGCAC GCCGTCGGCA

251 TGGCTTTGGC GAAAAAACAG GCGGAAGTCA GCCGTCTGAA AACGGAAAAT

301 AAAAAGGAAA TCGAAAATGT CCTTACTCAA GACCGTAAAA ATGCAGGCGG

351 CGGTTGTATT GACGGCTTTG GCCATCACGG CTTGCAGCTC TACAAGCGCG

401 CCCTCGGCTA CGGAAATTAA
```

This corresponds to the amino acid sequence <SEQ ID 2502; ORF 735.a>:

```
a735.pep

1  MNLVKLLANN WQPIAIIALV GTGLAVSHHQ GYKSAFAKQQ AVIEKMKRDK

51  AQALLLSAQN YARELEQARA EAKKYEVKAH AVGMALAKKQ AEVSRLKTEN

101  KKEIENVLTQ DRKNAGGGCI DGFGHHGLQL YKRALGYGN* a735/m735  95% identity in 139 aa overlap 10         20         30         40         50         60
    a735.pep  MNLVKLLANNWQPIAIIALVGTGLAVSHHQGYKSAFAKQQAVIEKMKRDKAQALLLSAQN
              ||||||||||||||||||||||||||||||||||||||||:||:|||||||||||||||
    m735      MNLVKLLANNWQPIAIIALVGTGLAVSHHQGYKSAFAKQQAVIDKMERDKAQALLLSAQN
                    10         20         30         40         50         60

70         80         90        100        110        120
    a735.pep  YARELEQARAEAKKYEVKAHAVGMALAKKQAEVSRLKTENKKEIENVLTQDRKNAGGGCI
              ||||||:|||||||||||||||||||||||||||||||||||||||||||||||:||||
    m735      YARELELARAEAKKYEVKAHAVGMALAKKQAEVSRLKTENKKEIENVLTQDRKNASGGCI
                    70         80         90        100        110        120

130        140
    a735.pep  DGFGHHGLQLYKRALGYGNX
              ||||  ||||||:||||||||
    m735      DGFGSHGLQLYNRALGYGNX
                   130        140
```

The following partial DNA sequence was identified in *N. gonorrhoeae* <SEQ ID 2503>:

```
g736.seq
  1 ATGAATTTTA TCCGTTCCGT CGGGGCGAAA ACCCTCGGCC TTATTCAATC

51 CTTCGGCAGT ATCACGCTGT TTCTGCTGAA CATTTTGGCG AAATCCGGCA

101 CGGCTTTCGC CCGTCCGCGC CTGAGCGTGC GCCAAGTGTA TTTTGCCGGC

151 GTGCTGTCGG TGCTGATTGT TGCCGTTTCG GGGCTGTTCG TCGGTATGGT

201 TTTGGGTTTG CAGGGCTATA CGCAGTTGTC GAAATTCAAA TCCGCCGATA

251 TTTTGGGCTA TATGGTCGCG GCTTCTCTGT TGCGCGAACT GGGTCCCGTG

301 TTGGCGGCGA TTCTGTTTGC CAGCAGCGCG GGCGGTGCGA TGACCAGCGA

351 AATCGGTTTG ATGAAAACGA CCGGACAGCT CGAAGCGATG AACGTGATGG

401 CGGTCAACCC CGTCGCCCGC GTGGTTGCCC CGCGTTTTTG GGCGGGCGTG

451 TTTTCTATGC CGCTTTTGGC TTCGATTTTC AACGTCGCGG GCATTTTCGG

501 CGCGTATTTG GTCGGCGTGA GCTGGCTGGG TTTGGACAGC GGTATTTTCT

551 GGCCGCAGAT GCAGAACAAC ATTACGATAC ATTACGATGT AATCAACGGT

601 TTGATCAAAT CCGCCGCGTT CGGCGTGGCG GTAACGCTGA TTGCCGTGCA

651 TCAGGGCTTC CACTGCATCC CGACTTCGGA AGGCATTTTG CGCGCCAGCA

701 CGCGCACGGT GGTTTCGTCC GCCCTGACGA TTTTGGCGGT CGATTTTATA

751 TTGACCGCGT GGATGTTTAC AGATTGA
```

This corresponds to the amino acid sequence <SEQ ID 2504; ORF 736>:

```
g736.pep
  1 MNFIRSVGAK TLGLIQSFGS ITLFLLNILA KSGTAFARPR LSVRQVYFAG

51 VLSVLIVAVS GLFVGMVLGL QGYTQLSKFK SADILGYMVA ASLLRELGPV

101 LAAILFASSA GGAMTSEIGL MKTTGQLEAM NVMAVNPVAR VVAPRFWAGV

151 FSMPLLASIF NVAGIFGAYL VGVSWLGLDS GIFWPQMQNN ITIHYDVING
```

```
201 LIKSAAFGVA VTLIAVHQGF HCIPTSEGIL RASTRTVVSS ALTILAVDFI

251 LTAWMFTD*
```

The following partial DNA sequence was identified in *N. meningitidis* <SEQ ID 2505>:

```
m736.seq
  1 ATGAATTTTA TCCGTTCCGT CGGGGCGAAA ACCCTCGGCC TTATTCAATC

51 CTTCGGCAGT ATCACGCTGT TTCTGCTGAA CATTTTGGCG AAATCCGGCA

101 CGGCTTTCGC CCGTCCGCGC CTGAGCGTGC GCCAAGTGTA TTTTGCCGGC

151 GTGCTGTCGG TGCTGATTGT TGCCGTTTCG GGGCTGTTCG TCGGTATGGT

201 TTTGGGTTTG CAGGGCTATA CGCAGTTGTC GAAATTCAAA TCCGCCGATA

251 TTTTGGGCTA TATGGTCGCG GCTTCTCTGT TGCGCGAACT GGGTCCCGTG

301 TTGGCGGCGA TTCTGTTTGC CAGCAGCGCG GGCGGTGCGA TGACCAGCGA

351 AATCGGTTTG ATGAAAACGA CCGGACAGCT CGAAGCGATG AACGTGATGG

401 CGGTCAACCC CGTCGCCCGC GTGGTTGCCC CGCGTTTTTG GGCGGGCGTG

451 TTTTCTATGC CGCTTTTGGC TTCGATTTTC AACGTCGCGG GCATTTTCGG

501 CGCGTATTTG GTCGGCGTGA GCTGGCTGGG TTTGGACAGC GGTATTTTCT

551 GGCCGCAGAT GCAGAACAAC ATTACGATAC ATTACGATGT AATCAACGGT

601 TTGATCAAAT CCGCCGCGTT CGGCGTGGCG GTAACGCTGA TTGCCGTGCA

651 TCAGGGCTTC CACTGCATCC CGACTTCGGA AGGCATTTTG CGCGCCAGCA

701 CGCGCACGGT GGTTTCGTCC GCCCTGACGA TTTTGGCGGT CGATTTTATA

751 TTGACCGCGT GGATGTTTAC AGATTGA
```

This corresponds to the amino acid sequence <SEQ ID 2506; ORF 736>:

```
m736.pep
  1 MNFIRSVGAK TLGLIQSLGS ITLFLLNILA KSGTAFVRPR LSVRQVYFAG

51 VLSVLIVAVS GLFVGMVLGL QGYTQLSKFK SADILGYMVA ASLLRELGPV

101 LAAILFASSA GGAMTSEIGL MKTTEQLEAM NVMAVNPVAR VVAPRFWAGV

151 FSMPLLASIF NVAGIFGAYL VGVTWLGLDS GIFWSQMQNN ITIHYDVING

201 LIKSAAFGVA VTLIAVHQGF HCVPTSEGIL RASTRTVVSS ALTILAVDFI

251 LTAWMFTD*
```

Computer analysis of the amino acid sequences gave the following results:
Homology with a Predicted ORF from *N. meningitidis* menA with menB ORF 736 shows 97.7% identity over a 258 aa overlap with a predicted ORF (ORF736.ng) from *N. gonorrhoeae*:

```
m736/g736

10         20         30         40         50         60
    m736.pep MNFIRSVGAKTLGLIQSLGSITLFLNILAKSGTAFVRPRLSVRQVYFAGVLSVLIVAVS
             ||||||||||||||||||:|||||||||||||||||||:|||||||||||||||||||||
        g736 MNFIRSVGAKTLGLIQSFGSITLFLLNILAKSGTAFARPRLSVRQVYFAGVLSVLIVAVS
                    10         20         30         40         50         60
```

```
                  70         80         90        100        110        120
m736.pep  GLFVGMVLGLQGYTQLSKFKSADILGYMVAASLLRELGPVLAAILFASSAGGAMTSEIGL
          ||||||||||||||||||||||||||||||||||||||||||||||||||||||||||||
g736      GLFVGMVLGLQGYTQLSKFKSADILGYMVAASLLRELGPVLAAILFASSAGGAMTSEIGL
                  70         80         90        100        110        120

130        140        150        160        170        180
m736.pep  MKTTEQLEAMNVMAVNPVARVVAPRFWAGVFSMPLLASIFNVAGIFGAYLVGVTWLGLDS
          |||| |||||||||||||||||||||||||||||||||||||||||||||||:||||||
g736      MKTTGQLEAMNVMAVNPVARVVAPRFWAGVFSMPLLASIFNVAGIFGAYLVGVSWLGLDS
                 130        140        150        160        170        180

190        200        210        220        230        240
m736.pep  GIFWSQMQNNITIHYDVINGLIKSAAFGVAVTLIAVHQGFHCVPTSEGILRASTRTVVSS
          |||| |||||||||||||||||||||||||||||||||||||:|||||||||||||||||
g736      GIFWPQMQNNITIHYDVINGLIKSAAFGVAVTLIAVHQGFHCIPTSEGILRASTRTVVSS
                 190        200        210        220        230        240

250       259
m736.pep  ALTILAVDFILTAWMFTDX
          |||||||||||||||||||
g736      ALTILAVDFILTAWMFTDX
                 250
```

The following partial DNA sequence was identified in *N. meningitidis* <SEQ ID 2507>:

```
a736.seq
  1 ATGAATTTTA TCCGTTCCGT CGGGGCGAAA ACCCTCGGCC TTATTCAATC

51 TCTCGGCAGT ATCACGCTGT TTCTGCTGAA TATTCTGGCG AAATCCGGTA

101 CGGCTTTCGT CCGTCCGCGC CTGAGCGTGC GCCAAGTGTA TTTTGCCGGC

151 GTGCTGTCGG TGTTGATTGT TGCCGTTTCA GGGCTGTTTG TCGGCATGGT

201 CTTGGGTTTG CAGGGCTATA CGCAGTTGTC GAAATTCAAA TCCGCCGATA

251 TTTTGGGCTA TATGGTCGCG GCTTCGCTGT TGCGCGAACT GGGTCCGGTG

301 TTGGCGGCGA TTCTGTTTGC CAGCAGCGCG GGCGGTGCGA TGACCAGCGA

351 AATCGGTTTG ATGAAAACGA CCGAACAGCT CGAAGCGATG AACGTGATGG

401 CGGTAAACCC CGTCGCCCGA GTGGTTGCGC CGCGCTTTTG GGCGGGCGTG

451 TTTTCCATGC CGCTTTTGGC TTCGATTTTC AACGTGGCGG GTATTTTCGG

501 CGCGTATTTG GTCGGTGTAA CCTGGCTGGG CTTGGACAGC GGTATTTTCT

551 GGTCGCAAAT GCAGAACAAC ATCACGTATC ATTACGATGT AATCAACGGT

601 CTGATCAAAT CCGCCGCGTT CGGCGTGGCG GTAACGCTGA TTGCCGTGCA

651 TCAGGGCTTC CACTGCGTCC CGACCTCGGA AGGCATTTTG CGCGCCAGCA

701 CGCGCACGGT GGTTTCGTCC GCCCTGACGA TTTTGGCGGT CGATTTTATA

751 TTGACCGCGT GGATGTTTAC AGATTGA
```

This corresponds to the amino acid sequence <SEQ ID 2508; ORF 736.a>:

```
a736.pep

1  MNFIRSVGAK TLGLIQSLGS ITLFLLNILA KSGTAFVRPR LSVRQVYFAG

51  VLSVLIVAVS GLFVGMVLGL QGYTQLSKFK SADILGYMVA ASLLRELGPV

101  LAAILFASSA GGAMTSEIGL MKTTEQLEAM NVMAVNPVAR VVAPRFWAGV

151  FSMPLLASIF NVAGIFGAYL VGVTWLGLDS GIFWSQMQNN ITIHYDVING

201  LIKSAAFGVA VTLIAVHQGF HCVPTSEGIL RASTRTVVSS ALTILAVDFI

251  LTAWMFTD* a736/m736  100.0% identity in 258 aa overlap
```

```
              10         20         30         40         50         60
a736.pep  MNFIRSVGAKTLGLIQSLGSITLFLINILAKSGTAFVRPRLSVRQVYFAGVLSVLIVAVS
          ||||||||||||||||||||||||||||| ||||||||||||||||||||||||||||||
m736      MNFIRSVGAKTLGLIQSLGSITLFLLNILAKSGTAFVRPRLSVRQVYFAGVLSVLIVAVS
              10         20         30         40         50         60

70         80         90        100        110        120
a736.pep  GLFVGMVLGLQGYTQLSKFKSADILGYMVAASLLRELGPVLAAILFASSAGGAMTSEIGL
          ||||||||||||||||||||||||||||||||||||||||||||||||||||||||||||
m736      GLFVGMVLGLQGYTQLSKFKSADILGYMVAASLLRELGPVLAAILFASSAGGAMTSEIGL
              70         80         90        100        110        120

130        140        150        160        170        180
a736.pep  MKTTEQLEAMNVMAVNPVARVVAPRFWAGVFSMPLLASIFNVAGIFGAYLVGVTWLGLDS
          ||||||||||||||||||||||||||||||||||||||||||||||||||||||||||||
m736      MKTTEQLEAMNVMAVNPVARVVAPRFWAGVFSMPLLASIFNVAGIFGAYLVGVTWLGLDS
             130        140        150        160        170        180

190        200        210        220        230        240
a736.pep  GIFWSQMQNNITIHYDVINGLIKSAAFGVAVTLIAVHQGFHCVPTSEGILRASTRTVVSS
          ||||||||||||||||||||||||||||||||||||||||||||||||||||||||||||
m736      GIFWSQMQNNITIHYDVINGLIKSAAFGVAVTLIAVHQGFHCVPTSEGILRASTRTVVSS
             190        200        210        220        230        240

250        259
a736.pep  ALTILAVDFILTAWMFTDX
          |||||||||||||||||||
m736      ALTILAVDFILTAWMFTDX
             250
```

The following partial DNA sequence was identified in *N. gonorrhoeae* <SEQ ID 2509>:

```
g737.seq
   1 atgaACATCA AACACCTTCT CTTGACCGCC GCCGCAACCG CACTGTTGGG

51 CATTTCCGCC CCCGCACTCG CCCACCACGA CGGACACGGC GATGACGACC

101 ACGGACACGC CGCACACCAA CACGGCAAAC AAGACAAAAT CATCAGCCGC

151 GCCCAAGCCG AAAAAGCGGC TTGGGCGCGT GTCGGCGGCA AAATCACCGA

201 CATCGATCTC GAACACGACG ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2510; ORF 737>:

```
g737.pep
   1 MNIKHLLLTA AATALLGISA PALAHHDGHG DDDHGHAAHQ HGKQDKIISR

51 AQAEKAAWAR VGGKITDIDL EHDDGRPHYD VEIVKNGQEY KVVVDARTGR

101 VISSRRDD*
```

The following partial DNA sequence was identified in *N. meningitidis* <SEQ ID 2511>:

```
m737.seq..
   1 ATGAACATCA AACACCTTCT CTTGACCTCC GCCGCAACCG CACTGCTGAG

51 CATTTCCGCC CCCGCGCTCG CCCACCACGA CGGACACGGC GATGACGACC

101 ACGGACACGC CGCACACCAA CACAACAAAC AAGACAAAAT CATCAGCCGC

151 GCCCAAGCCG AAAAAGCAGC GTTGGCGCGT GTCGGCGGCA AAATCACCGA

201 CATCGATCTC GAACACGACA ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2512; ORF 737>:

```
m737.pep
  1 MNIKHLLLTS AATALLSISA PALAHHDGHG DDDHGHAAHQ HNKQDKIISR

51 AQAEKAALAR VGGKITDIDL EHDNGRPHYD VEIVKNGQEY KVVVDARTGR

101 VISSRRDD*
```

Computer analysis of the amino acid sequences gave the following results:
Homology with a Predicted ORF from *N. meningitidis* menA with menB ORF 737 shows 95.4% identity over a 108 aa overlap with a predicted ORF (ORF737.a) from *N. gonorrhoeae*:

```
m737/g737
                      10        20        30        40        50        60
    m737.pep  MNIKHLLLTSAATALLSISAPALAHHDGHGDDDHGHAAHQHNKQDKIISRAQAEKAALAR
              ||||||||| :||||| :|||||||||||||||||||||| :|||||||||||||| ||
    g737      MNIKHLLLTAAATALLGISAPALAHHDGHGDDDHGHAAHQHGKQDKIISRAQAEKAAWAR
                      10        20        30        40        50        60

70        80        90       100       109
    m737.pep  VGGKITDIDLEHDNGRPHYDVEIVKNGQEYKVVVDARTGRVISSRRDDX
              ||||||||||||:||||||||||||||||||||||||||||||||||||
    g737      VGGKITDIDLEHDDGRPHYDVEIVKNGQEYKVVVDARTGRVISSRRDDX
                      70        80        90       100
```

The following partial DNA sequence was identified in *N. meningitidis* <SEQ ID 2513>:

```
a737.seq
  1 ATGAACTTCA AACGCCTTCT CTTGACCGCC GCCGCAACCG CACTGATGGG

51 CATTTCCGCC CCCGCACTCG CCCACCACGA CGGACACGGC GATGACGACC

101 ACGGACACGC CGCACACCAA CACAGCAAAC AAGACAAAAT CATCAGCCGC

151 GCCCAAGCCG AAAAAGCAGC GTTGGCGCGT GTCGGCGGCA AAATCACCGA

201 CATCGATCTC GAACACGACA ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2514; ORF 737.a>:

```
a737.pep
          1 MNFKRLLLTA AATALMGISA PALAHHDGHG DDDHGHAAHQ HSKQDKIISR

51 AQAEKAALAR VGGKITDIDL EHDNGRPHYD VEIVKNGQEY KVVVDARTGR

101 VISSRRDD* a737/m737  94.4% identity in 108 aa overlap 10        20        30        40        50        60
    a737.pep  MNFKHLLLTAAATALMGISAPALAHHDGHGDDDHGHAAHQHSKQDKIISRAQAEKAALAR
              ||:|||||: |||| ::|||||||||||||||||||||||:|||||||||||||||| ||
    m737      MNIKHLLLTSAATALLSISAPALAHHDGHGDDDHGHAAHQHNKQDKIISRAQAEKAAWAR
                      10        20        30        40        50        60

70        80        90       100       109
    a737.pep  VGGKITDIDLEHDNGRPHYDVEIVKNGQEYKVVVDARTGRVISSRRDDX
              |||||||||||||||||||||||||||||||||||||||||||||||||
    m737      VGGKITDIDLEHDNGRPHYDVEIVKNGQEYKVVVDARTGRVISSRRDDX
                      70        80        90       100
```

The following partial DNA sequence was identified in *N. gonorrhoeae* <SEQ ID 2515>:

```
g738.seq
    1 ATGTCCGCTG AAACGACCGT ATCCGGCGCG CGCCCCGCCG CCAAACTGCC

51 GATTTACATC CTGCCCTGCT TCCTTTGGAT AGGCATCATC CCCTTTACCT

101 TCGCACTCAG GCTGAAACCG TCGCCCGACT TTTACCACGA TGCCGCCGCC

151 GCGGCCGGCC TGATTGTCCT GTTGTTCCTC ACGGCAGGAA AAAAGCTGTT

201 TGATGTCAAA ATCCCCGCCA TCAGCTTCCT CCTGTTTGCA ATGGCGGCAT

251 TTTGGTGGCT TCAGGCACGC CTGATGAACC TGATTTATCC CGGAATGAAC

301 GACATCGCCT CTTGGGTTTT CATCTTGCTC GCCGTCAGCG CGTGGGCCTG

351 CAAGAGTTTG GTCGCACACT ACGGACAAGA ACGCAtcgtT ACCCTGTTTG

401 CCTGGTCGCT GCTTATCGGC TCCCTGCTTC AATCCTGCAT CGTcgtCATC

451 CAGTTTGCCG GCTGGGAAAA CACCCCCCTG CTTCAAAACA TCATCGTTCA

501 CAGAGGGCAA GGCGTAATCG GACACATCGG GCAGCGCAAC AACCTCGGAC

551 ACTACCTCAT GTGGGGCATA CTCGCCTCCG CCTACCTCAA CGGACAACGA

601 AAAATCCCCG CAGCCCTCGG CGCAATCGC CTGATTATGC AGACCGCCGT

651 TTTAGGTTTG GTCAATTCGC GCACCATCTT GACCTACATA GCCGCCATCG

701 CCCTCATCCT TCCCTTCTGG TATTTCCGTT CGGACAAATC CAACAGACGG

751 ACGATGCTCG GCATAGCCGC AGCCGTATTC CTTACCGCGC TGTTCCAATT

801 TTCCATGAAC GCCATTCTGG AAACCTTTAC AGGCATCCGC TACGAAACTG

851 CCGTCGAACG CGTCGCCAAC GGCGGTTTCA CAGACTTGCC GCGCCAAAGC

901 GAATGGAATA AAGCCCTTGC CGCCTTCCAG TCCGCCCCGA TATTCGGGCA

951 CGGCTGGAAC AGTTTTGCCC AACAAACCTT CCTGATCAAT GCCGAACAGC

1001 ACACCATACA CGACAACTTC CTCAGCACCT TGTTCACCCA TTCCCACAAC

1051 ATCATCCTCC AACTCCTTGC AGAAATGGGG ATCAGCGGCA CGCTTCTGGT

1101 TGCCGCAACC CTGCTGACGG GCATTGCCGG GCTGCTGAAA CGCTCCCTGA

1151 CCCCCGCATC ACTTTTCCTG CTGTGCGCGC TTGCCGTCAG TATGTGCCAC

1201 AGTATGCTCG AATATCCTTT GTGGTATGTC TATTTCCTCA TCCCCTTCGG

1251 ACTGATGCTC TTTCTGTCCC CCGCAGAGGC TTCAGACGGC ATCGCCTTCA

1301 AAAAAGCCGC CAATCTCGGC ATACTGACCG CCTCCGCCGC CATATTCGCA

1351 GGATTGCTGC ACTTGGACTG GACATACACC CGGCTGGTTA ACTCCTTTTC

1401 CCCCGCCGCT GACGACAGTG CCAAAACCCT CAACCGGAAA ATCAACGAAC

1451 TGCGCTATAT TTCCGCAAAC AGCCCGATGC TGTCCTTTTA TGCCGACTTC

1501 TCCCTCGTAA ACTTCGCCCT GCCGGAATAC CCCGAAACCC AGACTTGGGC

1551 GGAAGAAGCA ACCCTCAAAG CACTAAAATA CCGCCCCTAC TCCGCCACCT

1601 ACCGCATCGC CCTCTACTTG ATGCGGCAAG GCAAAGTTGC AGAAGCAAAA

1651 CAATGGATGC GGGCAACACA GTCCTATTAC CCCTACCTGA TGCCCCGATA

1701 CGCCGACGAA ATCCGCAAAC TGCCCGTATG GGCACCGCTG CTGCCCGAAC

1751 TGCTCAAAGA CTGCAAAGCC TTCGCCGCCG CTCCCGGCCA TCCGGAAACA

1801 AAACCCTGCA AATGA
```

This corresponds to the amino acid sequence <SEQ ID 2516; ORF 738>:

```
g738.pep
   1 MSAETTVSGA RPAAKLPIYI LPCFLWIGII PFTFALRLKP SPDFYHDAAA

51 AAGLIVLLFL TAGKKLFDVK IPAISFLLFA MAAFWWLQAR LMNLIYPGMN

101 DIASWVFILL AVSAWACKSL VAHYGQERIV TLFAWSLLIG SLLQSCIVVI

151 QFAGWENTPL LQNIIVHRGQ GVIGHIGQRN NLGHYLMWGI LASAYLNGQR

201 KIPAALGAIC LIMQTAVLGL VNSRTILTYI AAIALILPFW YFRSDKSNRR

251 TMLGIAAAVF LTALFQFSMN AILETFTGIR YETAVERVAN GGFTDLPRQS

301 EWNKALAAFQ SAPIFGHGWN SFAQQTFLIN AEQHTIHDNF LSTLFTHSHN

351 IILQLLAEMG ISGTLLVAAT LLTGIAGLLK RSLTPASLFL LCALAVSMCH

401 SMLEYPLWYV YFLIPFGLML FLSPAEASDG IAFKKAANLG ILTASAAIFA

451 GLLHLDWTYT RLVNSFSPAA DDSAKTLNRK INELRYISAN SPMLSFYADF

501 SLVNFALPEY PETQTWAEEA TLKALKYRPY SATYRIALYL MRQGKVAEAK

551 QWMRATQSYY PYLMPRYADE IRKLPVWAPL LPELLKDCKA FAAAPGHPET

601 KPCK*
```

The following partial DNA sequence was identified in *N. meningitidis* <SEQ ID 2517>:

```
m738.seq
    1 ATGCCCGCTG AAACGACCGT ATCCGGCGCG CACCCCGCCG CCAAACTGCC

51 GATTTACATC CTGCCCTGCT TCCTTTGGAT AGGCATCGTC CCCTTTACCT

101 TCGCGCTCAA ACTGAAACCG TCGCCCGACT TTTACCACGA TGCCGCCGCC

151 GCAGCCGGCC TGATTGTCCT GTTGTTCCTC ACGGCAGGAA AAAAACTGTT

201 TGATGTCAAA ATCCCCGCCA TCAGCTTCCT TCTGTTTGCA ATGGCGGCGT

251 TTTGGTATCT TCAGGCACGC CTGATGAACC TGATTTACCC CGGTATGAAC

301 GACATCGTCT CTTGGATTTT CATCTTGCTC GCCGTCAGCG CGTGGGCCTG

351 CCGGAGCTTG GTCGCACACT TCGGACAAGA ACGCATCGTG ACCCTGTTTG

401 CCTGGTCGCT GCTTATCGGC TCCCTGCTTC AATCCTGCAT CGTCGTCATC

451 CAGTTTGCCG GCTGGGAAGA CACCCCTCTG TTTCAAAACA TCATCGTTTA

501 CAGCGGGCAA GGCGTAATCG GACACATCGG GCAGCGCAAC AACCTCGGAC

551 ACTACCTCAT GTGGGGCATA CTCGCCGCCG CCTACCTCAA CGGACAACGA

601 AAAATCCCCG CCGCCCTCGG CGTAATCTGC CTGATTATGC AGACCGCCGT

651 TTTAGGTTTG GTCAACTCGC GCACCATCTT GACCTACATA GCCGCCATCG

701 CCCTCATCCT TCCCTTCTGG TATTTCCGTT CGGACAAATC CAACAGGCGG

751 ACGATGCTCG GCATAGCCGC AGCCGTATTC CTTACCGCGC TGTTCCAATT

801 TTCCATGAAC ACCATTCTGG AAACCTTTAC TGGCATCCGC TACGAAACTG

851 CCGTCGAACG CGTCGCCAAC GGCGGTTTCA CAGACTTGCC GCGCCAAATC

901 GAATGGAATA AAGCCCTTGC CGCCTTCCAG TCCGCCCCGA TATTCGGGCA

951 CGGCTGGAAC AGTTTTGCCC AACAAACCTT CCTCATCAAT GCCGAACAGC

1001 ACAACATATA CGACAACCTC CTCAGCAACT TGTTCACCCA TTCCCACAAC

1051 ATCGTCCTCC AACTCCTTGC AGAGATGGGA ATCAGCGGCA CGCTTCTGGT
```

```
-continued
1101 TGCCGCAACC CTGCTGACGG GCATTGCCGG GCTGCTTAAA CGCCCCCTGA

1151 CCCCCGCATC GCTTTTCCTA ATCTGCACGC TTGCCGTCAG TATGTGCCAC

1201 AGTATGCTCG AATATCCTTT GTGGTATGTC TATTTCCTCA TCCCTTTCGG

1251 ACTGATGCTC TTCCTGTCCC CCGCAGAGGC TTCAGACGGC ATCGCCTTCA

1301 AAAAGCCGC CAATCTCGGC ATACTGACCG CCTCCGCCGC CATATTCGCA

1351 GGATTGCTGC ACTTGGACTG GACATACACC CGGCTGGTTA ACGCCTTTTC

1401 CCCCGCCACT GACGACAGTG CCAAAACCCT CAACCGGAAA ATCAACGAGT

1451 TGCGCTATAT TTCCGCAAAC AGTCCGATGC TGTCCTTTTA TGCCGACTTC

1501 TCCCTCGTAA ACTTCGCCCT GCCGGAATAC CCCGAAACCC AGACTTGGGC

1551 GGAAGAAGCA ACCCTCAAAT CACTAAAATA CCGCCCCCAC TCCGCCACCT

1601 ACCGCATCGC CCTCTACCTG ATGCGGCAAG GCAAAGTTGC AGAAGCAAAA

1651 CAATGGATGC GGGCGACACA GTCCTATTAC CCgTACCTGA TGCCCCGATA

1701 CGCCGACGAA ATCCGCAAAC TGCCCGTATG GGCGCCGCTG CTACCCGAAC

1751 TGCTCAAAGA CTGCAAAGCC TTCGCCGCCG CGCCCGGTCA TCCGGAAGCA

1801 AAACCCTGCA AATGA
```

This corresponds to the amino acid sequence <SEQ ID 2518; ORF 738>:

```
m738.pep
  1 MPAETTVSGA HPAAKLPIYI LPCFLWIGIV PFTFALKLKP SPDFYHDAAA

51 AAGLIVLLFL TAGKKLFDVK IPAISFLLFA MAAFWYLQAR LMNLIYPGMN

101 DIVSWIFILL AVSAWACRSL VAHFGQERIV TLFAWSLLIG SLLQSCIVVI

151 QFAGWEDTPL FQNIIVYSGQ GVIGHIGQRN NLGHYLMWGI LAAAYLNGQR

201 KIPAALGVIC LIMQTAVLGL VNSRTILTYI AAIALILPFW YFRSDKSNRR

251 TMLGIAAAVF LTALFQFSMN TILETFTGIR YETAVERVAN GGFTDLPRQI

301 EWNKALAAFQ SAPIFGHGWN SFAQQTFLIN AEQHNIYDNL LSNLFTHSHN

351 IVLQLLAEMG ISGTLLVAAT LLTGIAGLLK RPLTPASLFL ICTLAVSMCH

401 SMLEYPLWYV YFLIPFGLML FLSPAEASDG IAFKKAANLG ILTASAAIFA

451 GLLHLDWTYT RLVNAFSPAT DDSAKTLNRK INELRYISAN SPMLSFYADF

501 SLVNFALPEY PETQTWAEEA TLKSLKYRPH SATYRIALYL MRQGKVAEAK

551 QWMRATQSYY PYLMPRYADE IRKLPVWAPL LPELLKDCKA FAAAPGHPEA

601 KPCK*
```

Computer analysis of the amino acid sequences gave the following results:
Homology with a Predicted ORF from *N. meningitidis* menA with menB ORF 738 shows 95.0% identity over a 604 aa overlap with a predicted ORF (ORF738.a) from *N. gonorrhoeae*:

```
m738/g738

10         20         30         40         50         60
   m738.pep   MPAETTVSGAHPAAKLPIYILPCFLWIGIVPFTFALKLKPSPDFYHDAAAAAGLIVLLFL
              ||||||||:||||||||||||||||||:||||||:||||||||||||||||||||||
       g738   MSAETTVSGARPAAKLPIYILPCFLWIGIIPFTFALRLKPSPDFYHDAAAAAGLIVLLFL
                  10         20         30         40         50         60
```

```
                  70        80        90       100       110       120
m738.pep  TAGKKLFDVKIPAISFLLFAMAAFWYLQARLMNLIYPGMNDIVSWIFILLAVSAWACRSL
          |||||||||||||||||||||||||||:||||||||||||||:||:|||||||||||:||
g738      TAGKKLFDVKIPAISFLLFAMAAFWWLQARLMNLIYPGMNDIASWVFILLAVSAWACKSL
                  70        80        90       100       110       120

130       140       150       160       170       180
m738.pep  VAHFGQERIVTLFAWSLLIGSLLQSCIVVIQFAGWEDTPLFQNIIVYSGQGVIGHIGQRN
          |||:||||||||||||||||||||||||||||||||||:|||||||:|||||||||||||
g738      VAHYGQERIVTLFAWSLLIGSLLQSCIVVIQFAGWENTPLLQNIIVHRGQGVIGHIGQRN
                 130       140       150       160       170       180

190       200       210       220       230       240
m738.pep  NLGHYLMWGILAAAYLNGQRKIPAALGVICLIMQTAVLGLVNSRTILTYIAAIALILPFW
          ||||||||||||:||||||||||||||||:||||||||||||||||||||||||||||||
g738      NLGHYLMWGILASAYLNGQRKIPAALGAICLIMQTAVLGLVNSRTILTYIAAIALILPFW
                 190       200       210       220       230       240

250       260       270       280       290       300
m738.pep  YFRSDKSNRRTMLGIAAAVFLTALFQFSMNTILETFTGIRYETAVERVANGGFTDLPRQI
          |||||||||||||||||||||||||||||:||||||||||||||||||||||||||||:
g738      YFRSDKSNRRTMLGIAAAVFLTALFQFSMNAILETFTGIRYETAVERVANGGFTDLPRQS
                 250       260       270       280       290       300

310       320       330       340       350       360
m738.pep  EWNKALAAFQSAPIFGHGWNSFAQQTFLINAEQHNIYDNLLSNLFTHSHNIVLQLLAEMG
          |||||||||||||||||||||||||||||||||:|:||:||:|||||||||:||||||||
g738      EWNKALAAFQSAPIFGHGWNSFAQQTFLINAEQHTIHDNFLSTLFTHSHNIILQLLAEMG
                 310       320       330       340       350       360

370       380       390       400       410       420
m738.pep  ISGTLLVAATLLTGIAGLLKRPLTPASLFLICTLAVSMCHSMLEYPLWYVYFLIPFGLML
          ||||||||||||||||||||||:||||||||:|:|||||||||||||||||||||||||
g738      ISGTLLVAATLLTGIAGLLKRSLTPASLFLLCALAVSMCHSMLEYPLWYVYFLIPFGLML
                 370       380       390       400       410       420

430       440       450       460       470       480
m738.pep  FLSPAEASDGIAFKKAANLGILTASAAIFAGLLHLDWTYTRLVNAFSPATDDSAKTLNRK
          ||||||||||||||||||||||||||||||||||||||||||||:||||:||||||||||
g738      FLSPAEASDGIAFKKAANLGILTASAAIFAGLLHLDWTYTRLVNSFSPAADDSAKTLNRK
                 430       440       450       460       470       480

490       500       510       520       530       540
m738.pep  INELRYISANSPMLSFYADFSLVNFALPEYPETQTWAEEEATLKSLKYRPHSATYRIALYL
          ||||||||||||||||||||||||||||||||||||||||||||:||||:|||||||||||
g738      INELRYISANSPMLSFYADFSLVNFALPEYPETQTWAEEEATLKALKYRPYSATYRIALYL
                 490       500       510       520       530       540

550       560       570       580       590       600
m738.pep  MRQGKVAEAKQWMRATQSYYPYLMPRYADEIRKLPVWAPLLPELLKDCKAFAAAPGHPEA
          ||||||||||||||||||||||||||||||||||||||||||||||||||||||||||:
g738      MRQGKVAEAKQWMRATQSYYPYLMPRYADEIRKLPVWAPLLPELLKDCKAFAAAPGHPET
                 550       560       570       580       590       600 m738.pep  KPCKX
          |||||
g738      KPCKX
```

The following partial DNA sequence was identified in *N. meningitidis* <SEQ ID 2519>:

```
a738.seq
   1  ATGCCCGCTG AAACGACCGT ATCCGGCGCG CACCCCGCCG CCAAACTGCC

51  GATTTACATC CTGCCCTGCT TCCTTTGGAT AGGCATCGTC CCCTTTACCT

101  TTGCGCTCAG GCTGCAACCG TCGCCCGACT TTTACCACGA TGCCGCCGCC

151  GCAGCCGGCC TGATTGTCCT GTTGTTCCTC ACGGCAGGAA AAAAGCTGTT

201  TGATGTCAAA ATCCCACCTA TCAGCTTCCT TCTGTTTGCA ATGGCGGCGT

251  TTTGGTATCT TCAGGCACGC CTGATGAACC TGATTTACCC CGGTATGAAC

301  GACATCGTCT CTTGGATTTT CATCTTACTC GCCGTCAGCG CGTGGGCCTG

351  CCGGAGCTTG GTCGCACACT ACGGACAAGA ACGCATCGTT ACCCTGTTTG

401  CCTGGTCGCT GCTTATCGGC TCCCTGCTTC AATCCTGCAT CGTCGTCATC

451  CAGTTTGCCG GCTGGGAAGA CACCCCTCTG TTTCAAAACA TCATTGTTTA

501  CAGCGGGCAA GGCGTAATCG GACACATCGG ACAGCGCAAC AACCTCGGAC

551  ACTACCTCAT GTGGGGCATA CTCGCCGCCG CCTACCTCAA CGGACAACGA
```

-continued

```
 601 AAAATCCCGC CCGCCTTGGG TGCAATCTGC CTGATTATGC AGACCGCCGT

651 TTTAGGTTTG GTCAATTCGC GCACCATCTT GACCTACATA GCCGCCATCG

701 CCCTCATCCT TCCCTTCTGG TATTTCCGTT CGGACAAATC AACAGGCGG

751 ACGATACTCG GCATAGCCGC AGCCGTATTC CTTACCGCGC TGTTCCAATT

801 TTCCATGAAC ACCATTCTGG AAACCTTTAC CGGCATCCGC TACGAAACCG

851 CCGTCGAACG CGTCGCCAAC GGCGGTTTCA CAGACCTGCC GCGCCAAATC

901 GAATGGCGCA AAGCCCTCGC CGCCTTCCAG TCCGCCCCGA TATTCGGGCA

951 CGGCTGGAAC AGTTTTGCCC AACAAACCTT CCTCATCAAT GCCGAACAGC

1001 ACAACATACA CGACAACCTC CTCAGCAACT TGTTCACCCA TTCCCACAAC

1051 ATCGTTCTCC AACTCCTTGC AGAGATGGGG ATCAGCGGCA CGCTTCTGGT

1101 TGCCGCAACC CTGCTGACGG GCATTGCCGG GCTGCTGAAA CGCCCCCTGA

1151 CCCCCGCATC GCTTTTCCTG ATCTGCACAC TTGCCGTCAG TATGTGCCAC

1201 AGTATGCTCG AATATCCTTT GTGGTATGTC TATTTCCTCA TCCCCTTCGG

1251 ACTGATGCTC TTTCTGTCCC CCGCAGAGGC TTCAGACGGC ATCGCCTTCA

1301 AAAAAGCCGC CAATCTCGGC ATACTAACCG CCTCCGCCGC CATATTCGCA

1351 GGATTGCTGC ACTTGGACTG GACATACACC CGGATGGTTA ACGCCTTTTC

1401 CCCCGCCACT GACGACAGTG CCAAAACCCT CAACCGGAAA ATCAACGAGT

1451 TGCGCTATAT TTCCGCAAAC AGTCCGATGC TGTCCTTTTA TGCCGACTTC

1501 TCCCTCGTAA ACTTCGCCCT GCCGGAATAC CCCGAAACCC AGACTTGGGC

1551 GGAAGAAGCA ACCCTCAAAT CACTAAAATA CCGCCCCCAC TCCGCCACCT

1601 ACCGCATCGC CCTCTACCTG ATGCGGCAAG GCAAAGTTGC AGAAGCAAAA

1651 CAATGGATGC GGGCGACACA GTCCTATTAC CCCTACCTGA TGCCCCGATA

1701 CGCCGACGAA ATCCGCAAAC TGCCCGTATG GGCGCCGCTG CTACCCGAAC

1751 TGCTCAAAGA CTGCAAAGCC TTCGCCGCCG CGCCCGGTCA TCCGGAAGCA

1801 AAACCCTGCA AATGA
```

This corresponds to the amino acid sequence <SEQ ID 2520; ORF 738.a>:

```
a738.pep

1 MPAETTVSGA HPAAKLPIYI LPCFLWIGIV PFTFALRLQP SPDFYHDAAA

51 AAGLIVLLFL TAGKKLFDVK IPPISFLLFA MAAFWYLQAR LMNLIYPGMN

101 DIVSWIFILL AVSAWACRSL VAHYGQERIV TLFAWSLLIG SLLQSCIVVI

151 QFAGWEDTPL FQNIIVYSGQ GVIGHIGQRN NLGHYLMWGI LAAAYLNGQR

201 KIPPALGAIC LIMQTAVLGL VNSRTILTYI AAIALILPFW YFRSDKSNRR

251 TILGIAAAVF LTALFQFSMN TILETFTGIR YETAVERVAN GGFTDLPRQI

301 EWRKALAAFQ SAPIFGHGWN SFAQQTFLIN AEQHNIHDNL LSNLFTHSHN

351 IVLQLLAEMG ISGTLLVAAT LLTGIAGLLK RPLTPASLFL ICTLAVSMCH

401 SMLEYPLWYV YFLIPFGLML FLSPAEASDG IAFKKAANLG ILTASAAIFA

451 GLLHLDWTYT RMVNAFSPAT DDSAKTLNRK INELRYISAN SPMLSFYADF

501 SLVNFALPEY PETQTWAEEA TLKSLKYRPH SATYRIALYL MRQGKVAEAK

551 QWMRATQSYY PYLMPRYADE IRKLPVWAPL LPELLKDCKA FAAAPGHPEA
```

-continued

```
601 KPCK* a738/m738    98.3% identity in 604 aa overlap 10        20        30        40        50        60
a738.pep   MPAETTVSGAHPAAKLPIYILPCFLWIGIVPFTFALRLQPSPDFYHDAAAAAGLIVLLFL
           ||||||||||||||||||||||||||||||||||||:|:|||||||||||||||||||||
m738       MPAETTVSGAHPAAKLPIYILPCFLWIGIVPFTFALKLKPSPDFYHDAAAAAGLIVLLFL
                   10        20        30        40        50        60

70        80        90       100       110       120
a738.pep   TAGKKLFDVKIPPISFLLFAMAAFWYLQARLMNLIYPGMNDIVSWIFILLAVSAWACRSL
           |||||||||||||:|||||||||||||||||||||||||||||||||||||||||||||
m738       TAGKKLFDVKIPAISFLLFAMAAFWYLQARLMNLIYPGMNDIVSWIFILLAVSAWACRSL
                   70        80        90       100       110       120

130       140       150       160       170       180
a738.pep   VAHYGQERIVTLFAWSLLIGSLLQSCIVVIQFAGWEDTPLFQNIIVYSGQGVIGHIGQRN
           |||:||||||||||||||||||||||||||||||||||||||||||||||||||||||||
m738       VAHFGQERIVTLFAWSLLIGSLLQSCIVVIQFAGWEDTPLFQNIIVYSGQGVIGHIGQRN
                  130       140       150       160       170       180

190       200       210       220       230       240
a738.pep   NLGHYLMWGILAAAYLNGQRKIPPALGAICLIMQTAVLGLVNSRTILTYIAAIALILPFW
           ||||||||||||||||||||||||||:|||||||||||||||||||||||||||||||||
m738       NLGHYLMWGILAAAYLNGQRKIPAALGVICLIMQTAVLGLVNSRTILTYIAAIALILPFW
                  190       200       210       220       230       240

250       260       270       280       290       300
a738.pep   YFRSDKSNRRTILGIAAAVFLTALFQFSMNTILETFTGIRYETAVERVANGGFTDLPRQI
           |||||||||||:|||||||||||||||||||||||||||||||||||||||||||||||
m738       YFRSDKSNRRTMLGIAAAVFLTALFQFSMNTILETFTGIRYETAVERVANGGFTDLPRQI
                  250       260       270       280       290       300

310       320       330       340       350       360
a738.pep   EWRKALAAFQSAPIFGHGWNSFAQQTFLINAEQHNIHDNLLSNLFTHSHNIVLQLLAEMG
           ||:|||||||||||||||||||||||||||||||||:||||||||||||||||||||||
m738       EWNKALAAFQSAPIFGHGWNSFAQQTFLINAEQHNIYDNLLSNLFTHSHNIVLQLLAEMG
                  310       320       330       340       350       360

370       380       390       400       410       420
a738.pep   ISGTLLVAATLLTGIAGLLKRPLTPASLFLICTLAVSMCHSMLEYPLWYVYFLIPFGLML
           ||||||||||||||||||||||||||||||||||||||||||||||||||||||||||||
m738       ISGTLLVAATLLTGIAGLLKRPLTPASLFLICTLAVSMCHSMLEYPLWYVYFLIPFGLML
                  370       380       390       400       410       420

430       440       450       460       470       480
a738.pep   FLSPAEASDGIAFKKAANLGILTASAAIFAGLLHLDWTYTRMVNAFSPATDDSAKTLNRK
           ||||||||||||||||||||||||||||||||||||||||||:|||||||||||||||||
m738       FLSPAEASDGIAFKKAANLGILTASAAIFAGLLHLDWTYTRLVNAFSPATDDSAKTLNRK
                  430       440       450       460       470       480

490       500       510       520       530       540
a738.pep   INELRYISANSPMLSFYADFSLVNFALPEYPETQTWAEEEATLKSLKYRPHSATYRIALYL
           ||||||||||||||||||||||||||||||||||||||||||||||||||||||||||||
m738       INELRYISANSPMLSFYADFSLVNFALPEYPETQTWAEEEATLKSLKYRPHSATYRIALYL
                  490       500       510       520       530       540

550       560       570       580       590       600
a738.pep   MRQGKVAEAKQWMRATQSYYPYLMPRYADEIRKLPVWAPLLPELLKDCKAFAAAPGHPEA
           |||||||||||||||||||||||||||||||||||||||||||||:|||||||||||||
m738       MRQGKVAEAKQWMRATQSYYPYLMPRYADEIRKLPVWAPLLPELLHDCKAFAAAPGHPEA
                  550       560       570       580       590       600 a738.pep   KPCKX
           |||||
m738       KPCKX
```

The following partial DNA sequence was identified in *N. gonorrhoeae* <SEQ ID 2521>:

```
g739.seq
  1 ATGGCAAAAA AACCGAACAA ACCCTTCAGG CTGACCCCCA AACTCCTGAT

51 ACGCGCCGTA TTGCTCATCT GTATCACCGC CATCGGCGCA TTGGCAGTAG

101 GCATCGTCAG CACATTCAAC CCGAACGGCG ACAAAACCCT CCAAACCGAA

151 CCGCAACACA CCGACAGCCC CCGCGAAACC GAATTCTGGC TGCCAAACGG

201 CGCCGTCGGA CAAGATGCCG CCCAACCCGA ACACCACCAC GCCGCCTCAT

251 CCGAACCCGC ACAGCCGGAC GGCACAGAAG AAAGCGGCAG CGGACTGCCG

301 TCCCCTGCCG CACCCAAGAA AAACCGGGTc AAACCGCGCC CTTCGGATGC
```

```
351 GGCCCGGGCA GCCGATTCGT TAACCGGCAC CGGAACACAA GCTGAAAACA

401 CACTCAAAGA AACCCCCGTA CTGCCCACAA ACGCCCCCCA TCCCGAACCC

451 CGAAAAGAAA CACCCGAAAA ACAGGCGCAG CCCAAAGAAA CACCCAAAGA

501 AAAAGAAACG CCCAAAGAAA ACCATACCAA ACCGGACACC CCGAAAAACA

551 CGCCGGCCAA ACCCCATAAA GAGATTCTCG ACAACCTCTT TTGA
```

This corresponds to the amino acid sequence <SEQ ID 2522; ORF 739>:

```
g739.pep
   1 MAKKPNKPFR LTPKLLIRAV LLICITAIGA LAVGIVSTFN PNGDKTLQTE

51 PQHTDSPRET EFWLPNGAVG QDAAQPEHHH AASSEPAQPD GTEESGSGLP

101 SPAAPKKNRV KPRPSDAARA ADSLTGTGTQ AENTLKETPV LPTNAPHPEP

151 RKETPEKQAQ PKETPKEKET PKENHTKPDT PKNTPAKPHK EILDNLF*
```

The following partial DNA sequence was identified in *N. meningitidis* <SEQ ID 2523>:

```
m739.seq
   1 ATGGCAAAAA AACCGAACAA ACCCTTCAGG CTGACCCCCA AACTCCTGAT

51 ACGCGCCGTA TTGCTCATCT GTATCGCCGC CATCGGCGCA TTGGCAATAG

101 GCATCGTCAG CACATTCAAC CCGAACGGCG ACAAAACCCT TCAAGCCGAA

151 CCGCAACACA CCGACAGCCC CCGCGAAACC GAATTCTGGC TGCCAAACGG

201 CGTAGTCGGA CAAGATGCCG CCCAACCCGA ACACCACCAC GCCGCCTCAT

251 CCGAACCCGC ACAGCCGGAC GGCACAGACG AAAGCGGCAG CGGACTGCCG

301 TCCCCTGCCG CACCCAAGAA AAACCGGGTC AAACCGCAAC CTGCCGACAC

351 AGCTCAAACC GACAGGCAGC CGGACGACGC CGGAACACAA GCTGAAAACA

401 CACTCAAAGA AACCCCCGTA CTGCCCACAA ACGTCCCCCG TCCCGAACCC

451 CGAAAAGAAA CACCCGAAAA ACAGGCGCAG CCCAAAGAAA CGCCCAAAGA

501 AAACCATACC AAACCGGACA CCCCGAAAAA CACGCCGCCC AAACCCCATA

551 AAGAAATTCT CGACAAACTC TTC
```

This corresponds to the amino acid sequence <SEQ ID 2524; ORF 739>:

```
m739.pep
   1 MAKKPNKPFR LTPKLLIRAV LLICIAAIGA LAIGIVSTFN PNGDKTLQAE

51 PQHTDSPRET EFWLPNGVVG QDAAQPEHHH AASSEPAQPD GTDESGSGLP

101 SPAAPKKNRV KPQPADTAQT DRQPDDAGTQ AENTLKETPV LPTNVPRPEP

151 RKETPEKQAQ PKETPKENHT KPDTPKNTPP KPHKEILDKL F
```

Computer analysis of the amino acid sequences gave the following results:
Homology with a Predicted ORF from *N. meningitidis* menA with menB ORF 739 shows 86.3% identity over a 197 aa overlap with a predicted ORF (ORF739.a) from *N. gonorrhoeae*:

```
m739/g739

10        20        30        40        50        60
    m739.pep  MAKKPNKPFRLTPKLLIRAVLLICIAAIGALAIGIVSTFNPNGDKTLQAEPQHTDSPRET
              ||||||||||||||||||||||:||||||:||||||||||||||||||:|||||||||||
    g739      MAKKPNKPFRLTPKLLIRAVLLICITAIGALAVGIVSTFNPNGDKTLQTEPQHTDSPRET
                   10        20        30        40        50        60

70        80        90       100       110       120
    m739.pep  EFWLPNGVVGQDAAQPEHHHAASSEPAQPDGTDESGSGLPSPAAPKKNRVKPQPADTAQT
              |||||||:|||||||||||||||||||||||||:|||||||||||||||||||:|:|:::
    g739      EFWLPNGAVGQDAAQPEHHHAASSEPAQPDGTEESGSGLPSPAAPKKNRVKPRPSDAARA
                   70        80        90       100       110       120

130       140       150       160            170
    m739.pep  DRQPDDAGTQAENTLKETPVLPTNVPRPEPRKETPEKQAQPKETPKE------NHTKPDT
              :   :|||||||||||||||||||:|:|||||||||||||||||||||      ||||||
    g739      ADSLTGTGTQAENTLKETPVLPTNAPHPEPRKETPEKQAQPKETPKEKETPKENHTKPDT
                  130       140       150       160       170       180

180       190
    m739.pep  PKNTPPKPHKEILDKLF
              |||||  ||||||||:||
    g739      PKNTPAKPHKEILDNLFX
                            190
```

The following partial DNA sequence was identified in *N. meningitidis* <SEQ ID 2525>:

```
a739.seq
   1 ATGGCAAAAA AACCGAACAA ACCCTTCAGG CTGACCCCCA AACTCCTGAT

51 ACGCGCCGTA TTGCTCATCT GTATCACCGC CATCGGCGCA TTGGCAATAG

101 GCATCGTCAG CACATTCAAC CCGAACGGCG ACAAAACCCT CCAAACCGAA

151 CCGCAACACA CCGACAGCCC CCGCGAAACC GAATTCTGGC TGCCAAACGG

201 CGTAGTCGGA CAAGATGCCG CCCAACCCGA ACACCACCAC GCCTCCTCAT

251 CCGCACCCGC ACAGCCGGAC GGCACAGACG AAAGCGGCAG CGGACTGCCG

301 TCCCCTGCCG CACCCAAGAA AAACCGGGTC AAACCGCAAC CTGCCGACAC

351 AGCTCAAACC GACAGGCAGC CGGACGACGC CGGAGCACAA GCTGAAAACA

401 CACTCAAAGA AACCCCCGTA CTGCCCACAA ACGTCCCCCG TCCCGAACCC

451 CGAAAAGAAA CACCCGAAAA ACAGGCACAG CCCAAAGAAA CACCCAAAGA

501 AAAAGAAACG CCCAAAGAAA ACCATACCAA ACCGGACACC CCGAAAAACA

551 CGCCGCCTAA ACCCCATAAA GAAATTCTCG ACAACCTCTT CTGA
```

This corresponds to the amino acid sequence <SEQ ID 2526; ORF 739.a>:

```
a739.pep

1  MAKKPNKPFR LTPKLLIRAV LLICITAIGA LAIGIVSTFN PNGDKTLQTE

51  PQHTDSPRET EFWLPNGVVG QDAAQPEHHH ASSSAPAQPD GTDESGSGLP

101  SPAAPKKNRV KPQPADTAQT DRQPDDAGAQ AENTLKETPV LPTNVPRPEP

151  RKETPEKQAQ PKETPKEKET PKENHTKPDT PKNTPPKPHK EILDNLF* a739/m739   93.9% identity in 197 aa overlap
```

```
                    10         20         30         40         50         60
a739.pep   MAKKPNKPFRLTPKLLIRAVLLICITAIGALAIGIVSTFNPNGDKTLQTEPQHTDSPRET
           ||||||||||||||||||||||||||:|||||||||||||||||||||:|||||||||||
m739       MAKKPNKPFRLTPKLLIRAVLLICIAAIGALAIGIVSTFNPNGDKTLQAEPQHTDSPRET
                    10         20         30         40         50         60

70         80         90        100        110        120
a739.pep   EFWLPNGVVGQDAAQPEHHHASSSAPAQPDGTDESGSGLPSPAAPKKNRVKPQPADTAQT
           |||||||||||||||||||||||:||  ||||||||||||||||||||||||||||||||
m739       EFWLPNGVVGQDAAQPEHHHAASSEPAQPDGTDESGSGLPSPAAPKKNRVKPQPADTAQT
                    70         80         90        100        110        120

130        140        150        160        170        180
a739.pep   DRQPDDAGAQAENTLKETPVLPTNVPRPEPRKETPEKQAQPKETPKEKETPKENHTKPDT
           ||||||||:|||||||||||||||||||||||||||||||||||||      |||||||
m739       DRQPDDAGTQAENTLKETPVLPTNVPRPEPRKETPEKQAQPKETPK------ENHTKPDT
                   130        140        150        160        170

130
a739.pep   PKNTPPKPHKEILDNLFX
           ||||||||||||||:||
m739       PKNTPPKPHKEILDKLF
               180        190
```

The following partial DNA sequence was identified in *N. gonorrhoeae* <SEQ ID 2527>:

```
g740.seq
  1 ATGTCCCGAA ACCTGCTTGT CCGCTGGCTC GCCGTCTGCC TCATCCCCTT

51 GgcgACGCTT GCCGTTTTCG CCGCCAATcc gcCCGAAGAC AAACCCCAGC

101 ATCTGATCAA CGGCATCATC CTTGCCTGCG AAGCGACGTT TTTGTTTAAa 151 ttcgtgctCT TTGAAACCAT CAAGCATCAT CTTAaacaag gGTTTGATTT 201 GAAACgtcaa ACCATGTTTC TGTTTATTCC GATTGTTTTG CTGGTTGTGT 251 ATTTGTTCCA CTATTTCGGC GCGTTTTag
```

This corresponds to the amino acid sequence <SEQ ID 2528; ORF 740.ng>:

```
g740.pep
  1 MSRNLLVRWL AVCLIPLATL AVFAANPPED KPQHLINGII LACEATFLFK

51 FVLFETIKHH LKQGFDLKRQ TMFLFIPIVL LVVYLFHYFG AF*
```

The following partial DNA sequence was identified in *N. meningitidis* <SEQ ID 2529>:

```
m740.seq
  1 ATGTCCCGAA ACCTGCTTGT CCGCTGGCTT GCCGTCTGCC TCATCCCGTT

51 GGCGACGCTT GCCGTTTTCG CCGCCAATCC GCCCGAAGAC AAACTCCAGC

101 ATCTGATCAA CGGCATCATC CTTGCCTGCG AAGCGACGTT TTTGTTTAAA

151 TTCGTCCTTT TCGACACCAT CAAGCATCAT TTGAAACAAG AGTTTGATTT

201 GAAACGTCAA ACTATGTTGC TGTTTATTCC GATTATTTTG CTGATTGTGT

251 ATTTGTTCCA CTATTTTGGC GCGTTTTAG
```

This corresponds to the amino acid sequence <SEQ ID 2530; ORF 740>:

```
m740.pep
  1 MSRNLLVRWL AVCLIPLATL AVFAANPPED KLQHLINGII LACEATFLEK

51 FVLFDTIKHH LKQEEDLKRQ TMLLFIPIIL LIVYLFHYFG AF*
```

-continued m740/g740 93.5% identity in 92 aa overlap

```
              10         20         30         40         50         60
m740.pep  MSRNLLVRWLAVCLIPLATLAVFAANPPEDKLQHLINGIILACEATFLFKFVLFDTIKHH
          ||||||||||||||||||||||||||||||:|||||||||||||||||||||||:|||||
g740      MSRNLLVRWLAVCLIPLATLAVFAANPPEDKPQHLINGIILACEATFLFKFVLFETIKHH
              10         20         30         40         50         60

70         80         90
m740.pep  LKQEFDLKRQTMLLFIPIILLIVYLFHYFGAFX
          |||:||||||||:||||:||:|||||||||||
g740      LKQGFDLKRQTMFLFIPIVLLVVYLFHYFGAFX
              70         80         90
```

The following partial DNA sequence was identified in *N. meningitidis* <SEQ ID 2531>:

```
a740.seq
  1 ATGTCCCGAA ACCTGCTTGT CCGCTGGCTT GTCGTCTGCC TGATACCCTT

51 GGCGACGCTT GCCGTTTTCG CCGCCAATCC GCCCGAAGAC AAACCCCAGC

101 ATCTGATTAA CGGCATCATC CTTGCCTGCG AAGCGACGTT TTTGTTCAAA

151 TTCGTCCTTT TCGACACCAT CAAGCATCAT TTGAAACAAG AGTTTGATTT

201 GAAACGTCAA ACTATGTTGC TGTTTATTCC GATTATTTTG CTGATTGTGT

251 ATTTGTTCCA CTATTTTGGC GCGTTTTAG
```

This corresponds to the amino acid sequence <SEQ ID 2532; ORF 740.a>:

```
a740.pep
  1 MSRNLLVRWL VVCLIPLATL AVFAANPPED KPQHLINGII LACEATFLFK

51 FVLFDTIKHH LKQEFDLKRQ TMLLFIPIIL LIVYLFHYFG AF*
``` a740/m740 97.8% identity in 92 aa overlap

```
              10         20         30         40         50         60
a740.pep  MSRNLLVRWLVVCLIPLATLAVFAANPPEDKPQHLINGIILACEATFLFKFVLFDTIKHH
          ||||||||||:|||||||||||||||||||| ||||||||||||||||||||||||||||
m740      MSRNLLVRWLAVCLIPLATLAVFAANPPEDKLQHLINGIILACEATFLFKFVLFDTIKHH
              10         20         30         40         50         60

70         80         90
a740.pep  LKQEFDLKRQTMLLFIPIILLIVYLFHYFGAFX
          ||||||||||||||||||||||||||||||||
m740      LKQEFDLKRQTMLLFIPIILLIVYLFHYFGAFX
              70         80         90
```

The following partial DNA sequence was identified in *N. gonorrhoeae* <SEQ ID 2533>:

```
g741.seq
  1 GTGAACCGAA CTACCTTCTG CTGCCTTTCT TTGACCGCCG GCCCTGATTC

51 TGACCGCCTG CAGCAGCGGA GGGGCGGAGG CGGTGGTGTC GCCGCCGACA

101 TCGGCACGGG GCTTGCCGAT GCATTAACCG CGCCGCTCGA CCATAAAGAC

151 AAAGGTTTGA ATCCCTAAC ATTGGAAGCC TCCATTCCCC AAAACGGAAC

201 ACTGACCCTG TCGGCACAAG GTGCGGAAAA AACTTTCAAA GCCGGCGGCA

251 AAGACAACAG CCTCAACACG GGCAAACTGA AGAACGACAA AATCAGCCGC

301 TTCGACTTCG TGCAAAAAAT CGAAGTGGAC GGACAAACCA TCACACTGGC

351 AAGCGGCGAA TTTCAAATAT ACAAACAGGA TCACTCCGcc gtcgtTgcCC
```

-continued
```
401 TacgGATTGA AAAAATCAAC AACCCCGACA AAATCGACAG CCTGATAAAC

451 CAACGCTCCT TCCTTGTCAG CGATTTGGGC GGAGAACATA CCGCCTTCAA

501 CCAACTGCCT GACGGCAAAG CCGAGTATCA CGGCAAAGCA TTCAGCTCCG

551 ACGATGCCGA CGGAAAACTG ACCTATACCA TAGATTTCGC CGCCAAACAG

601 GGACACGGCA AAATCGAACA CCTGAAAACA CCCGAGCAGA ATGTTGAGCT

651 TGCCTCCGCC GAACTCAAAG CAGATGAAAA ATCACACGCC GTCATTTTGG

701 GCGACACGCG CTACGGCGGC GAAGAGAAAG GCACTTACCG CCTCGCCCTT

751 TTCGGCGACC GCGCCCAAGA AATCGCTGGC TCGGCAACCG TGAAGATAGG

801 GGAAAAGGTT CACGAAATCG GCATCGCCGA CAAACAGTAG
```

This corresponds to the amino acid sequence <SEQ ID 2534; ORF 741.ng>:

```
g741.pep
  1 VNRTTFCCLS LTAGPDSDRL QQRRGGGGGV AADIGTGLAD ALTAPLDHKD

51 KGLKSLTLEA SIPQNGTLTL SAQGAEKTFK AGGKDNSLNT GKLKNDKISR

101 FDFVQKIEVD GQTITLASGE FQIYKQDHSA VVALRIEKIN NPDKIDSLIN

151 QRSFLVSDLG GEHTAFNQLP DGKAEYHGKA FSSDDADGKL TYTIDFAAKQ

201 GHGKIEHLKT PEQNVELASA ELKADEKSHA VILGDTRYGG EEKGTYRLAL

251 FGDRAQEIAG SATVKIGEKV HEIGIADKQ*
```

The following partial DNA sequence was identified in N. meningitidis <SEQ ID 2535>:

```
m741.seq
  1 GTGAATCGAA CTGCCTTCTG CTGCCTTTCT CTGACCACTG CCCTGATTCT

51 GACCGCCTGC AGCAGCGGAG GGGGTGGTGT CGCCGCCGAC ATCGGTGCGG

101 GGCTTGCCGA TGCACTAACC GCACCGCTCG ACCATAAAGA CAAAGGTTTG

151 CAGTCTTTGA CGCTGGATCA GTCCGTCAGG AAAAACGAGA AACTGAAGCT

201 GGCGGCACAA GGTGCGGAAA AAACTTATGG AAACGGTGAC AGCCTCAATA

251 CGGGCAAATT GAAGAACGAC AAGGTCAGCC GTTTCGACTT TATCCGCCAA

301 ATCGAAGTGG ACGGGCAGCT CATTACCTTG GAGAGTGGAG AGTTCCAAGT

351 ATACAAACAA AGCCATTCCG CCTTAACCGC CTTTCAGACC GAGCAAATAC

401 AAGATTCGGA GCATTCCGGG AAGATGGTTG CGAAACGCCA GTTCAGAATC

451 GGCGACATAG CGGGCGAACA TACATCTTTT GACAAGCTTC CCGAAGGCGG

501 CAGGGCGACA TATGCGGGA CGGCGTTCGG TTCAGACGAT GCCGGCGGAA

551 AACTGACCTA CACCATAGAT TTCGCCGCCA AGCAGGGAAA CGGCAAAATC

601 GAACATTTGA ATCGCCAGA ACTCAATGTC GACCTGGCCG CCGCCGATAT

651 CAAGCCGGAT GGAAAACGCC ATGCCGTCAT CAGCGGTTCC GTCCTTTACA

701 ACCAAGCCGA GAAAGGCAGT TACTCCCTCG GTATCTTTGG CGGAAAAGCC

751 CAGGAAGTTG CCGGCAGCGC GGAAGTGAAA ACCGTAAACG GCATACGCCA

801 TATCGGCCTT GCCGCCAAGC AATAA
```

This corresponds to the amino acid sequence <SEQ ID 2536; ORF 741>:

```
m741.pep
   1 VNRTAFCCLS LTTALILTAC SSGGGGVAAD IGAGLADALT APLDHKDKGL

51 QSLTLDQSVR KNEKLKLAAQ GAEKTYGNGD SLNTGKLKND KVSRFDFIRQ

101 IEVDGQLITL ESGEFQVYKQ SHSALTAFQT EQIQDSEHSG KMVAKRQFRI

151 GDIAGEHTSF DKLPEGGRAT YRGTAFGSDD AGGKLTYTID FAAKQGNGKI

201 EHLKSPELNV DLAAADIKPD GKRHAVISGS VLYNQAEKGS YSLGIFGGKA

251 QEVAGSAEVK TVNGIRHIGL AAKQ*
``` m741/2741 61.4% identity in 280 aa overlap

```
                   10         20            30         40         50
    m741.pep   VNRTAFCCLSLTT---ALILTACSSGGGGVAADIGAGLADALTAPLDHKDKGLQSLTLDQ
               ||||:|||||||:     :|          :||||||||||||||||||||||||:||||:
    g741       VNRTTFCCLSLTAGPDSDRLQQRRGGGGVAADIGTGLADALTAPLDHKDKGLKSLTLEA
                   10         20         30         40         50         60

60         70         80         90        100        110
    m741.pep   SVRKNEKLKLAAQGAEKTY---GNGDSLNTGKLKNDKVSRFDFIRQIEVDGQLITLESGE
               |::|   |  |:||||||:     |: :||||||||||||:|||||||:|||||:||| |||
    g741       SIPQNGTLTLSAQGAEKTFKAGGKDNSLNTGKLKNDKISRFDFVQKIEVDGQTITLASGE
                   70         80         90        100        110        120

120        130        140        150        160        170
    m741.pep   FQVYKQSHSALTAFQTEQIQDSEHSGKMVAKRQFRIGDIAGEHTSFDKLPEGGRATYRGT
               ||:|||:|||::|::   |:|::  ::   :|:|   ::|::||||||:|::||:|   :|   |:|
    g741       FQIYKQDHSAVVALRIEKINNPDKIDSLINQRSFLVSDLGGEHTAFNQLPDG-KAEYHGK
                  130        140        150        160        170

180        190        200        210        220        230
    m741.pep   AFGSDDAGGKLTYTIDFAAKQGNGKIEHLKSPELNVDLAAADIKPDGKRHAVISGSVLYN
               ||:|||| |||||||||||||||||:||||||||:|| ||:||:|::|  |  |  ||||  |::  |:
    g741       AFSSDDADGKLTYTIDFAAKQGHGKIEHLKTPEQNVELASAELKADEKSHAVILGDTRYG
                  180        190        200        210        220        230

240        250        260        270
    m741.pep   QAEKGSYSLGIFGGKAQEVAGSAEVKTVNGIRHIGLAAKQX
               |||:| |::||  :|||:||||  ||    :  :::||:|  |||
    g741       GEEKGTYRLALFGDRAQEIAGSATVKIGEKVHEIGIADKQX
                  240        250        260        270        280
```

The following partial DNA sequence was identified in *N. meningitidis* <SEQ ID 2537>:

```
a741.seq
   1 GTGAACCGAA CTGCCTTCTG CTGCCTTTCT TTGACCGCCG CCCTGATTCT

51 GACCGCCTGC AGCAGCGGAG GCGGCGGTGT CGCCGCCGAC ATCGGCGCGG

101 TGCTTGCCGA TGCACTAACC GCACCGCTCG ACCATAAAGA CAAAGTTTG

151 CAGTCTTTGA CGCTGGATCA GTCCGTCAGG AAAAACGAGA AACTGAAGCT

201 GGCGGCACAA GGTGCGGAAA AAACTTATGG AAACGGCGAC AGCCTCAATA

251 CGGGCAAATT GAAGAACGAC AAGGTCAGCC GCTTCGACTT TATCCGTCAA

301 ATCGAAGTGG ACGGGCAGCT CATTACCTTG GAGAGCGGAG AGTTCCAAGT

351 GTACAAACAA AGCCATTCCG CCTTAACCGC CCTTCAGACC GAGCAAGTAC

401 AAGATTCGGA GCATTCAGGG AAGATGGTTG CGAAACGCCA GTTCAGAATC

451 GGCGATATAG CGGGTGAACA TACATCTTTT GACAAGCTTC CCGAAGGCGG

501 CAGGGCGACA TATCGCGGGA CGGCATTCGG TTCAGACGAT GCCAGTGGAA

551 AACTGACCTA CACCATAGAT TTCGCCGCCA AGCAGGGACA CGGCAAAATC

601 GAACATTTGA AATCGCCAGA ACTCAATGTT GACCTGGCCG CCTCCGATAT

651 CAAGCCGGAT AAAAAACGCC ATGCCGTCAT CAGCGGTTCC GTCCTTTACA
```

-continued

```
701 ACCAAGCCGA GAAAGGCAGT TACTCTCTAG GCATCTTTGG CGGGCAAGCC

751 CAGGAAGTTG CCGGCAGCGC AGAAGTGGAA ACCGCAAACG GCATACGCCA

801 TATCGGTCTT GCCGCCAAGC AGTAA
```

This corresponds to the amino acid sequence <SEQ ID 2538; ORF 741.a>:

```
a741.pep
  1 VNRTAFCCLS LTAALILTAC SSGGGGVAAD IGAVLADALT APLDHKDKSL

51 QSLTLDQSVR KNEKLKLAAQ GAEKTYGNGD SLNTGKLKND KVSRFDFIRQ

101 IEVDGQLITL ESGEFQVYKQ SHSALTALQT EQVQDSEHSG KMVAKRQFRI

151 GDIAGEHTSF DKLPEGGRAT YRGTAFGSDD ASGKLTYTID FAAKQGHGKI

201 EHLKSPELNV DLAASDIKPD KKRHAVISGS VLYNQAEKGS YSLGIFGGQA

251 QEVAGSAEVE TANGIRHIGL AAKQ*
``` a741/m741 95.6% identity in 274 aa overlap

```
                  10         20         30         40         50         60
   a741.pep  VNRTAFCCLSLTAALILTACSSGGGGVAADIGAVLADALTAPLDHKDKSLQSLTLDQSVR
             ||||||||||:|||||||||||||||||||||:|||||||||||||||:|||||||||||
       m741  VNRTAFCCLSLTTALILTACSSGGGGVAADIGAGLADALTAPLDHKDKGLQSLTLDQSVR
                  10         20         30         40         50         60

70         80         90        100        110        120
   a741.pep  KNEKLKLAAQGAEKTYGNGDSLNTGKLKNDKVSRFDFIRQIEVDGQLITLESGEFQVYKQ
             ||||||||||||||||||||||||||||||||||||||||||||||||||||||||||||
       m741  KNEKLKLAAQGAEKTYGNGDSLNTGKLKNDKVSRFDFIRQIEVDGQLITLESGEFQVYKQ
                  70         80         90        100        110        120

130        140        150        160        170        180
   a741.pep  SHSALTALQTEQVQDSEHSGKMVAKRQFRIGDIAGEHTSFDKLPEGGRATYRGTAFGSDD
             ||||||:||||:|||||||||||||||||||||||||||||||||||||||||||||||
       m741  SHSALTAFQTEQIQDSEHSGKMVAKRQFRIGDIAGEHTSFDKLPEGGRATYRGTAFGSDD
                 130        140        150        160        170        180

190        200        210        220        230        240
   a741.pep  ASGKLTYTIDFAAKQGHGKIEHLKSPELNVDLAASDIKPDKKRHAVISGSVLYNQAEKGS
             |:|||||||||||||:||||||||||||||||||:|||||:||||||||||||||||||
       m741  AGGKLTYTIDFAAKQGNGKIEHLKSPELNVDLAAADIKPDGKRHAVISGSVLYNQAEKGS
                 190        200        210        220        230        240

250        260        270
   a741.pep  YSLGIFGGQAQEVAGSAEVETANGIRHIGLAAKQX
             ||||||||:|||||||||||:|:|||||||||||
       m741  YSLGIFGGKAQEVAGSAEVKTVNGIRHIGLAAKQX
                 250        260        270
   g742.seq  not found yet
   g742.pep  not found yet
```

The following partial DNA sequence was identified in *N. meningitidis* <SEQ ID 2539>:

```
m742.seq
  1 ATGGTTTACG GCATTGCCGA AGCCGATGCG GGCGACAGCA GTGTGCTTAC

51 TTTGGGCGGC ATGTATCAGA AGAGTAGGGA GGTTCCTGAT TTTTCGGGCA

101 TTATTTTGCC CTGTGAAAAT CAGAAAACTG CCCCGTTCAG TTCAACGCCT

151 GCCTGCAACC GGCCTTTGCA ACTGCCGCGC AACACTTATT TGGGGGAGGA

201 TTGGTCGCGG TTAAGTGCCG ACAAATACAA CCTTTTCTCA GGATTCAAAC

251 ATGTGTTTGA CAACGGTTGG CAGCTCAATG CCGAAGTGTC TTATACCAAG

301 AATGAATCCG ATGCGAAGGT GGGGCAGTTT TTTCTGAAAA ACGAATATGC

351 GGCGGGTTTG TCGGGTGAGG ATGCGGTAGG CTTTTTGACT GAAAAAAACG
```

-continued

```
 401 AAGTCATCCC GTTCGAGCCG AAAGATAAGG CATTGGAGAA ACTGAAAGCA
 451 TATCGTGATG AAACCGCCAA GGAATACCGG GAGCGCAAAG ACGATTTTGT
 501 TAAAAACCGT TTCGATAATA CTGCTTTCGA ACAGTATCGC AGCCGCCGTG
 551 CCGCAGAACG CAAAGCCGGT TTTGACAAGT GTATGAGTGA CCCTTTCGCG
 601 CTGGACTTTA TCTGTCAAGG TTCTTGGGGG ATCCGGGCG TTGATGCCGA
 651 CAAGGCGGAA TTTGTCGATA AGCCCTTGC GAAGGAGGGC ATCTTTAATA
 701 ATGCGGCACA ACGTTTTCCA AACAGCCTGT ATGACTCTTC CTTTAATCGG
 751 AAGGCTACCG CCAACCGACA ATACAGTTAT ATGCCGTTGC GGCATACCAA
 801 AGACGACCGC CAATGGGGAA TTAAACTTGA CCTGACCGGC ACATATGGGC
 851 TGTTCGGGCG GGAGCATGAT TTCTTTGTCG GCTATGCCTA CGGTGATGAA
 901 AGATACGTT CGGAATATCT AGAAATCTAC GAACGCCGCT ACAGAGTACG
 951 TCCGAATACG GGGGCAACGC ACGGCGTGTA TGCGGGAAGT TGTCAGGAGG
1001 AGCCGGACGG CGATTTGTCG TCTCCTTTGG TCAGGGGCA TAAAGAACCC
1051 GATTGGCAGG CGTACGATGA AAAAGGCAAC CGTACCGTTT ATGCCGAAGA
1101 ATGCAGGAAC GCCAAGAAAA TAAAACCGA GCCCAAGCTC GATGCCGAAG
1151 GCAAGCAGGT GTATTACTAT GACGAATACA GCGGCAGCCG GACACCGGTA
1201 TATGTCGATG TATATGAGCT GGACGAAAAA GGCAACAAGA TTCAGGAGAC
1251 CAATCCCGAC GGCACGCCTG CCTTTACCGG TTTTTCCGGT ACGGTGCCGG
1301 TTTGGAAAAC CGTCAAAGTG GCAGACGACC ATGTTCCTGC GCTGTATAAC
1351 TACGCCAAAT ACCTCAACAC CAACAAAACC CATTCGCTGA CTGCCAGCAC
1401 GCGTTTCAAC GTAACCGGCC GACTGCACCT TTTGGGCGGG CTGCACTACA
1451 CGCGCTATGA GACTTCGCAA ACCAAAGATA TGCCTGTCCG CTATGGGCAG
1501 CCGGCAAGCG ATTTTCAGAC GGCATCGAGC ATTAGGGCGG ATCAGGACCA
1551 TTACACGGCC AAGATGCAAG GTCATAAATT GACGCCCTAT GCAGGCATTA
1601 CCTATGACTT GACACCGCAA CAGAGTATTT ACGGAAGTTA TACCAAAATC
1651 TTCAAACAGC AGGATAATGT CGATGTCAGT GCCAAAACCG TTTTACCGCC
1701 TTTGGTCGGC ACAAACTATG AGGTAGGCTG GAAAGGCGCG TTCTTGCAAG
1751 GACGGCTGAA TGCTTCGTTC GCATTGTTTT ACCTCGAACA GAAAAACCGC
1801 ACGGTCGTCG ATTTCGGCTA TGTTCCCGGA GCAGGCGGCA AGCAGGGGTC
1851 GTTCCAAACC GTTGCCAAAC CGATAGGCAA AGTGGTCAGC AGGGGTGCGG
1901 AATTCGAGTT GTCGGGTGAG TTGAACGAAG ATTGGAAAGT CTTTGCGGGT
1951 TACACCTACA ACAAGAGCCG CTACAAAAAC GCCGCCGAAG TCAACGCCGA
2001 ACGCCTTGCC AAAAATTCCA GTGCAGACCC GTACAACTTC AGCAATTTCA
2051 CACCCGTGCA CATATTCCGT TTCGGAACGA GCTTCCATAT ACCGAATACG
2101 GGGCTGACCG TCGGCGGCGG CGTGTCCGCA CAAAGCGGCA CAAGCAGTCT
2151 GTATAACATC AGGCAGGGCG GCTACGGGCT GATAGACGGT TTCGTCCGTT
2201 ACGAATTGGG CAAACACGCC AAATTGAGCC TCATCGGTAC GAACTTAAAC
2251 GGACGCACTT ATTTTGAGAA CAACTACAAC CGTACGCGCG GCGCAAACAA
2301 CTTCTACGGA GAGCCGCGCA CTGTCAGCAT GAAACTGGAT TGGCAGTTTT
2351 AA
```

This corresponds to the amino acid sequence <SEQ ID 2540; ORF 742>:

```
m742.pep
    1 MVYGIAEADA GDSSVLTLGG MYQKSREVPD FSGIILPCEN QKTAPFSSTP

51 ACNRPLQLPR NTYLGEDWSR LSADKYNLFS GFKHVFDNGW QLNAEVSYTK

101 NESDAKVGQF FLKNEYAAGL SGEDAVGFLT EKNEVIPFEP KDKALEKLKA

151 YRDETAKEYR ERKDDFVKNR FDNTAFEQYR SRRAAERKAG FDKCMSDPFA

201 LDFICQGSWG DPGVDADKAE FVDKALAKEG IFNNAAQRFP NSLYDSSFNR

251 KATANRRYSY MPLRHTKDDR QWGIKLDLTG TYGLFGREHD FFVGYAYGDE

301 KIRSEYLEIY ERRYRVRPNT GATHGVYAGS CQEEPDGDLS SPLVRGHKEP

351 DWQAYDEKGN RTVYAEECRN AKKIKTEPKL DAEGKQVYYY DEYSGSRTPV

401 YVDVYELDEK GNKIQETNPD GTPAFTGFSG TVPVWKTVKV ADDHVPALYN

451 YAKYLNTNKT HSLTASTRFN VTGRLHLLGG LHYTRYETSQ TKDMPVRYGQ

501 PASDFQTASS IRADQDHYTA KMQGHKLTPY AGITYDLTPQ QSIYGSYTKI

551 FKQQDNVDVS AKTVLPPLVG TNYEVGWKGA FLQGRLNASF ALFYLEQKNR

601 TVVDFGYVPG AGGKQGSFQT VAKPIGKVVS RGAEFELSGE LNEDWKVFAG

651 YTYNKSRYKN AAEVNAERLA KNSSADPYNF SNFTPVHIFR FGTSFHIPNT

701 GLTVGGGVSA QSGTSSLYNI RQGGYGLIDG FVRYELGKHA KLSLIGTNLN

751 GRTYFENNYN RTRGANNFYG EPRTVSMKLD WQF*
```

The following partial DNA sequence was identified in *N. meningitidis* <SEQ ID 2541>:

```
a742.seq
    1 ATGGTTTACG GCATTGCCGA AGCCGATGCG GGCGACAGCA GTGTGCTTAC

51 TTTGGGCGGC ATGTATCAGA AGAGTAGGGA GGTTCCTGAT TTTTCGGGCA

101 TTATTTTGTC CTGTGAAAAT CAGAAAACTG CCCCGTTCAG TTCAACGCCT

151 GCCTGCAACC GGCCTTTGCA ACTGCCGCGC AACACTTATT TGGGGGAGGA

201 TTGGTCGCGG TTGAGTGCTG ACAAATACAA CCTTTTCTCA GGTTTCAAAC

251 ATGTGTTTGA CAACGGTTGG CAGCTCAATG CCGAAGTGTC TTATACCAAG

301 AATGAATCCG ATGCGAAGGT GGGGCAGTTT TTTCTGAAAA ACGAACATGC

351 GGCGGGTTTG TCAGATGAGG ATGCGGTAGG CTTTTTGACC GAAAAAAACG

401 AAGTCATCCC GTTCGAGCCG AAAGATAAGG CATTGGAGAA ACTGAAAGCA

451 TATCGTGACG AAACCGCCAA GGAATACCGT GAGCGCAAAG ACGATTTTGT

501 TAAAAACCGT TTCGATAATA CTGCTTTCGA GCAGTACCGC AGCCGCCGTG

551 CCGCAGAACG CAAAGCCGGT TTTGACGAGT GTATGAGTGC CCCTTTTGCG

601 CTGGACTTTA TCTGTCAAGG TTCTTGGGGG GATCCGGGTG TTGATGCCGA

651 CAAGTCGGAA TTTGTCGATA AAGCCCTTGC GAAGGAAGGC ATCTTTAATA

701 ATGCGGCACA ACGTTTTCCA AACAGCCTGT ATGACTCTTC CTTTAATCGG

751 AAGGCTACCG CCAACCGACG ATACAGTTAT ATGCCGTTGC GGCATACCAA

801 AGACGACCGC CAATGGGGAA TTAAACTTGA CCTGACCGGC ACATATGGGC

851 TGTTCGGGCG GGAGCATGAT TTCTTTGTCG GCTATGCCTA CGGCGATGAA

901 AAGATACGTT CCGAATATCT GGAAATCTAC GAACGCCGCC ACAGAGTACG
```

-continued

```
 951 TCCGAATACA GGGGCAACGC ACGGCGTGTA TGCGGGAAGT TGTCAGGGGG

1001 AGCCGGACGG TGATTTGTCT TCTCCTTTGG TCAGGGGCA TAAAGAACCC

1051 GATTGGCAGG CGTACGATGA AAAAGGCAAC CGTACCGTTT ATGCCGAAGA

1101 ATGCAGGAAT GCCAAGAAAA TAAAAACCGA GCCCAAGCTC GATGCCGAAG

1151 GCAAGCAGGT GTATTACTAT GACGAATACA GCGGCAGCCG GACGCCAGTA

1201 TATGTCGATG TATATGAACT GGATGAAAAA GGCAATAAGA TTCAGGAGAC

1251 CAATCCCGAC GGCACGCCTG CCTTTACCGG TTTTTCCGGT ACGGTGCCGG

1301 TTTGGAAAAC CGTCAAAGTG GCCGACGACC ATGTTCCTGC GCTGTATAAC

1351 TACGCCAAAT ACCTCAACAC CAACAAAACC CATTCGCTGA CTGCCGGCAC

1401 GCGTTTCAAC GTAACCGGCC GACTGCATCT TTTGGGCGGG CTGCACTACA

1451 CGCGCTATGA AACCTCGCAA ACCAAAGATA TGCCTGTCCG CTATGGGCAG

1501 CCGGCAAGCG ATTTTCAGAC GGCATCGAGC ATTAAGGCGG ATCAGGACCA

1551 TTATACGGCC AAGATGCAAG GTCATAAATT GACGCCCTAT GCAGGCATTA

1601 CCTATGATTT GACACCGCAA CAGAGTATTT ACGGAAGTTA TACCAAAATC

1651 TTCAAACAGC AGGATAATGT CGATGTCAGT GCCAAAACCG TTTTACCGCC

1701 TTTGGTCGGC ACAAACTATG AGGTAGGCTG GAAAGGCGCG TTCTTGCAAG

1751 GACGGCTGAA TGCTTCGTTC GCATTGTTTT ACCTCGAACA GAAAAACCGC

1801 ACGGTCGTCG ATTTTGGCTA TGTTCCCGGA GCAGGCGGCA AGCAGGGGTC

1851 GTTCCAAACC GTTGCCAAAC CGATAGGCAA AGTGGTCAGC AGGGGTGCGG

1901 AATTCGAGTT GTCGGGTGAG TTGAACGAAG ATTGGAAAGT CTTTGCGGGT

1951 TACACCTACA ACAAGAGCCG CTACAAAAAC GCCGCCGAAG TCAACGCCGA

2001 ACGCCTCGCC AAAAACACAG GCGCAGACCC GTACAACTTC AGCAATTTCA

2051 CACCCGTGCA CATATTCCGT TTCGGAACGA GCTTCCATAT ACCGAATACG

2101 GGGCTGACCG TCGGCGGCGG CGTGTCCGCA CAAAGCGGCA CAAGCAGTCT

2151 GTATAACATC AGGCAGGGCG GCTACGGGCT GATAGACGGT TTCGTCCGTT

2201 ACGAATTGGG CAAACACGCT AAATTGAGCC TCATCGGTAC GAACTTAAAC

2251 GGACGCACTT ATTTTGAGAA CAACTACAAC CGTACGCGCG GCGCAAACAA

2301 CTTCTATGGA GAGCCGCGCA CTGTCAGCAT GAAACTGGAT TGGCAGTTTT

2351 AA
```

This corresponds to the amino acid sequence <SEQ ID 2542; ORF 742.a>:

```
a742.pep
  1 MVYGIAEADA GDSSVLTLGG MYQKSREVPD FSGIILSCEN QKTAPFSSTP

51 ACNRPLQLPR NTYLGEDWSR LSADKYNLFS GFKHVFDNGW QLNAEVSYTK

101 NESDAKVGQF FLKNEHAAGL SDEDAVGFLT EKNEVIPFEP KDKALEKLKA

151 YRDETAKEYR ERKDDFVKNR FDNTAFEQYR SRRAAERKAG FDECMSAPFA

201 LDFICQGSWG DPGVDADKSE FVDKALAKEG IFNNAAQRFP NSLYDSSFNR

251 KATANRRYSY MPLRHTKDDR QWGIKLDLTG TYGLFGREHD FFVGYAYGDE

301 KIRSEYLEIY ERRHRVRPNT GATHGVYAGS CQGEPDGDLS SPLVRGHKEP

351 DWQAYDEKGN RTVYAEECRN AKKIKTEPKL DAEGKQVYYY DEYSGSRTPV
```

```
401 YVDVYELDEK GNKIQETNPD GTPAFTGFSG TVPVWKTVKV ADDHVPALYN

451 YAKYLNTNKT HSLTAGTRFN VTGRLHLLGG LHYTRYETSQ TKDMPVRYGQ

501 PASDFQTASS IKADQDHYTA KMQGHKLTPY AGITYDLTPQ QSIYGSYTKI

551 FKQQDNVDVS AKTVLPPLVG TNYEVGWKGA FLQGRLNASF ALFYLEQKNR

601 TVVDFGYVPG AGGKQGSFQT VAKPIGKVVS RGAEFELSGE LNEDWKVFAG

651 YTYNKSRYKN AAEVNAERLA KNTGADPYNF SNFTPVHIFR FGTSFHIPNT

701 GLTVGGGVSA QSGTSSLYNI RQGGYGLIDG FVRYELGKHA KLSLIGTNLN

751 GRTYFENNYN RTRGANNFYG EPRTVSMKLD WQF*
``` a742/m742 98.5% identity in 783 aa overlap

```
                    10         20         30         40         50         60
a742.pep    MVYGIAEADAGDSSVLTLGGMYQKSREVPDFSGIILSCENQKTAPFSSTPACNRPLQLPR
            ||||||||||||||||||||||||||||||||||| ||||||||||||||||||||||||
m742        MVYGIAEADAGDSSVLTLGGMYQKSREVPDFSGIILPCENQKTAPFSSTPACNRPLQLPR
                    10         20         30         40         50         60

70         80         90        100        110        120
a742.pep    NTYLGEDWSRLSADKYNLFSGFKHVFDNGWQLNAEVSYTKNESDAKVGQFFLKNEHAAGL
            |||||||||||||||||||||||||||||||||||||||||||||||||||||||:|||
m742        NTYLGEDWSRLSADKYNLFSGFKHVFDNGWQLNAEVSYTKNESDAKVGQFFLKNEYAAGL
                    70         80         90        100        110        120

130        140        150        160        170        180
a742.pep    SDEDAVGFLTEKNEVIPFEPKDKALEKLKAYRDETAKEYRERKDDFVKNRFDNTAFEQYR
            | ||||||||||||||||||||||||||||||||||||||||||||||||||||||||
m742        SGEDAVGFLTEKNEVIPFEPKDKALEKLKAYRDETAKEYRERKDDFVKNRFDNTAFEQYR
                   130        140        150        160        170        180

190        200        210        220        230        240
a742.pep    SRRAAERKAGFDECMSAPFALDFICQGSWGDPGVDADKSEFVDKALAKEGIFNNAAQRFP
            |||||||||||||:||| ||||||||||||||||||||:|||||||||||||||||||||
m742        SRRAAERKAGFDKCMSDPFALDFICQGSWGDPGVDADKAEFVDKALAKEGIFNNAAQRFP
                   190        200        210        220        230        240

250        260        270        280        290        300
a742.pep    NSLYDSSFNRKATANRRYSYMPLRHTKDDRQWGIKLDLTGTYGLFGREHDFFVGYAYGDE
            ||||||||||||||||||||||||||||||||||||||||||||||||||||||||||||
m742        NSLYDSSFNRKATANRRYSYMPLRHTKDDRQWGIKLDLTGTYGLFGREHDFFVGYAYGDE
                   250        260        270        280        290        300

310        320        330        340        350        360
a742.pep    KIRSEYLEIYERRHRVRPNTGATHGVYAGSCQGEPDGDLSSPLVRGHKEPDWQAYDEKGN
            |||||||||||||:|||||||||||||||||| |||||||||||||||||||||||||||
m742        KIRSEYLEIYERRYRVRPNTGATHGVYAGSCQEEPDGDLSSPLVRGHKEPDWQAYDEKGN
                   310        320        330        340        350        360

370        380        390        400        410        420
a742.pep    RTVYAEECRNAKKIKTEPKLDAEGKQVYYYDEYSGSRTPVYVDVYELDEKGNKIQETNPD
            ||||||||||||||||||||||||||||||||||||||||||||||||||||||||||||
m742        RTVYAEECRNAKKIKTEPKLDAEGKQVYYYDEYSGSRTPVYVDVYELDEKGNKIQETNPD
                   370        380        390        400        410        420

430        440        450        460        470        480
a742.pep    GTPAFTGFSGTVPVWKTVKVADDHVPALYNYAKYLNTNKTHSLTAGTRFNVTGRLHLLGG
            |||||||||||||||||||||||||||||||||||||||||||||:||||||||||||||
m742        GTPAFTGFSGTVPVWKTVKVADDHVPALYNYAKYLNTNKTHSLTASTRFNVTGRLHLLGG
                   430        440        450        460        470        480

490        500        510        520        530        540
a742.pep    LHYTRYETSQTKDMPVRYGQPASDFQTASSIKADQDHYTAKMQGHKLTPYAGITYDLTPQ
            |||||||||||||||||||||||||||||||:||||||||||||||||||||||||||||
m742        LHYTRYETSQTKDMPVRYGQPASDFQTASSIRADQDHYTAKMQGHKLTPYAGITYDLTPQ
                   490        500        510        520        530        540

550        560        570        580        590        600
a742.pep    QSIYGSYTKIFKQQDNVDVSAKTVLPPLVGTNYEVGWKGAFLQGRLNASFALFYLEQKNR
            ||||||||||||||||||||||||||||||||||||||||||||||||||||||||||||
m742        QSIYGSYTKIFKQQDNVDVSAKTVLPPLVGTNYEVGWKGAFLQGRLNASFALFYLEQKNR
                   550        560        570        580        590        600

610        620        630        640        650        660
a742.pep    TVVDFGYVPGAGGKQGSFQTVAKPIGKVVSRGAEFELSGELNEDWKVFAGYTYNKSRYKN
            ||||||||||||||||||||||||||||||||||||||||||||||||||||||||||||
m742        TVVDFGYVPGAGGKQGSFQTVAKPIGKVVSRGAEFELSGELNEDWKVFAGYTYNKSRYKN
                   610        620        630        640        650        660

670        680        690        700        710        720
a742.pep    AAEVNAERLAKNTGADPYNFSNFTPVHIFRFGTSFHIPNTGLTVGGGVSAQSGTSSLYNI
            ||||||||||||::||||||||||||||||||||||||||||||||||||||||||||||
m742        AAEVNAERLAKNSSADPYNFSNFTPVHIFRFGTSFHIPNTGLTVGGGVSAQSGTSSLYNI
                   670        680        690        700        710        720
```

```
          730        740        750        760        770        780
a742.pep  RQGGYGLIDGFVRYELGKHAKLSLIGTNLNGRTYFENNYNRTRGANNFYGEPRTVSMKLD
          ||||||||||||||||||||||||||||||||||||||||||||||||||||||||||||
m742      RQGGYGLIDGFVRYELGKHAKLSLIGTNLNGRTYFENNYNRTRGANNFYGEPRTVSMKLD
          730        740        750        760        770        780 a742.pep  WQFX
          ||||
m742      WQFX a742 (SEQ ID 2542)/p25184 (SEQ ID 4167)
 sp|P25184|PUPA_PSEPU FERRIC-PSEUDOBACTIN 358 RECEPTOR PRECURSOR
>gi|94923|pir||S15169
ferric-pseudobactin receptor precursor-Pseudomonas putida >gi|45723 (x56605)
pseudobactin uptake protein [pseudomonas putida]Length = 819
  Score = 152 bits (381), Expect = 6e-36
  Identities = 110/356 (30%), Positives = 170/356 (46%), Gaps = 55/356 (15%)

Query: 436 KTVKVADDHV-PALYNYAKYLNTNKTHSLTAGTRFNVTGRLHLLGGLHYTRYETSQTKDM 494
           +T K  DD + P +     +Y +N+        +RFN+T  LHL+ G    + Y
Sbjct: 511 QTPKPGDDEIIPGI----QYNISNRQSGYFVASRFNLTDDLHLILGARASNYRFDYAL-- 564
Query: 495 PVRYGQPASDFQTASSIKADQDHYTAKMQGHKLTPYAGITYDLTPQQSIYGSYTKIFKQQ 554
             R G   + ++               ++   +TPYAGI YDLT +QS+Y SYT +FK Q
Sbjct: 565 -WRIGNEPAPYKM--------------VERGVVTPYAGIVYDLTNEQSVYASYTDIFKPQ 609
Query: 555 DNVDVSAKTVLPPLVGTNYEVGWKGAFLQGRLNASFALFYLEQKNRTVVDFGYVPGAGGK 614
           +NVD++  K  L P VG NYE+GWKG FL+GRLNA+ AL+ +++  N      VP +GG
Sbjct: 610 NNVDITGKP-LDPEVGKNYELGWKGEFLEGRLNANIALYMVKRDNLAESTNEVVPDSGGL 668
Query: 615 QGSFQTVAKPIGKVVSRGAEFELSGELNEDWKVFAGYTYNKSRYKNAAEVNAERLAKNTG 674
             S       + +  ++G + ELSGE+   W VF GY++ ++
Sbjct: 669 IAS-----RAVDGAETKGVDVELSGEVLPGWNVFTGYSHTRTE----------------D 707
Query: 675 ADPYNFSNFTPVHIFRFGTSFHIPN--TGLTVGGGVSAQSGTS---SLYN--IRQGGYGL 727
           AD     +  P+  FRF  ++ +P        LT+GGGV+  S ++   + YN  + Q   Y +
Sbjct: 708 ADGKRLTPQLPMDTFRFWNTYRLPGEWEKLTLGGGVNWNSKSTLNFARYNSHVTQDDTFV 767
Query: 728 IDGFVRYELGKHAKLSLIGTNLNGRTYFENNYNRTRGANNFYGEPRTVSMKLDWQF 783
                RY + +   +L  N+ + Y     Y      G+   YG PR ++ L + F
Sbjct: 768 TSLMARYRINESLAATLNVNNIFDKKY----YAGMAGSYGHYGAPRNATVTLRYDF 819
g743.seq not found yet g743.pep not found yet
```

The following partial DNA sequence was identified in *N. meningitidis* <SEQ ID 2543>:

```
m743.seq
   1 ATGAATCAAA ATCATTTTTC ACTTAAAATT CTGACCGTTA TGCTGTTATC

51 GGCTTACGGT GGTTCTTTTG CAGACGGTGT TGTGCCTGTT TCAGACGGCA

101 ATACCGTCAG TCTGGATACG GTCAATGTAC GCGGCTCTCA TGCTTTGTTG

151 GGCAAGACCG AAAAGACCCG TTCTTATACG ATAGATCGGA TGTCCACCGC

201 CACAGGTATG AGGATTGCGG GCAAGGATAC GCCGCAGTCG GTCAGCGTCA

251 TCACGCGCAG CCGCCTTGAC GATAAGGCGG TGCATACGCT TGAAGAGGCA

301 ATGAAAAACA CGACGGGTGT CAACGTTGTG CGCGATTCAG GCTTGCAGAC

351 GCGGTTTTTG TCACGCGGTT TCTATATTGA TCAGATTGGT GAAGACGGTA

401 TGACCGTCAA TGTTGCAGGC CGTTCGGGAT ATACGGCGAA AATCGACGTG

451 TCTCCGAGTA CCGATTTGGC GGTTTATGAC CATATTGAAG TTGTACGGGG

501 TGCAACGGGG TTGACCCAAT CCAATTCAGA GCCGGGAGGA ACCGTCAATT

551 TGATCCGTAA GTGA
```

This corresponds to the amino acid sequence <SEQ ID 2544; ORF 743>:

```
m743.pep
   1 MNQNHFSLKI LTVMLLSAYG GSFADGVVPV SDGNTVSLDT VNVRGSHALL

51 GKTEKTRSYT IDRMSTATGM RIAGKDTPQS VSVITRSRLD DKAVHTLEEA
```

```
-continued
101 MKNTTGVNVV RDSGLQTRFL SRGFYIDQIG EDGMTVNVAG RSGYTAKIDV

151 SPSTDLAVYD HIEVVRGATG LTQSNSEPGG TVNLIRK*
```

The following partial DNA sequence was identified in *N. meningitidis* <SEQ ID 2545>:

```
a743.seq
   1 ATGAATCAAA ATCATTTTTC ACTTAAAATT CTGACCGTTA TGCTGTTATC

51 GGCTTACGGT GGTTCTTTTG CAGACGGTGT TGTGCCTGTT TCAGACGGCA

101 ATACCGTCAG TTTGGATACG GTCAATGTAC GCGGCTCTCA TGCTCTGTCG

151 GGCAAGACCG AGAAGACCCG TTCTTATACG ATAGATCGGA TGTCCACCGC

201 CACAGGTATG AGGATTGCGG GCAAGGATAC GCCGCAGTCG GTCAGCGTCA

251 TCACGCGCAG CCGCCTTGAC GATAAGGCGG TGCATACGCT TGAAGAGGCA

301 ATGAAAAACA CGACGGGTGT CAACGTTGTG CGCGATTCAG GCTTGCAGAC

351 GCGGTTTTTG TCACGCGGTT TCTATATTGA TCAGATTGGT GAAGACGGTA

401 TTACCGTCAA TGTTGCAGGC CGTTCGGGAT ATACGGCGAA AATCGACGTG

451 TCTCCGAGTA CCGATTTGGC GGTTTATGAC CATATTGAAG TTGTACGGGG

501 TGCAACGGGG TTGACCCAAT CCAATTCAGA GCCGGGTGGA ACCGTCAATT

551 TGATCCGTAA GCGA
```

This corresponds to the amino acid sequence <SEQ ID 2546; ORF 743.a>:

```
a743.pep
   1 MNQNHFSLKI LTVMLLSAYG GSFADGVVPV SDGNTVSLDT VNVRGSHALS

51 GKTEKTRSYT IDRMSTATGM RIAGKDTPQS VSVITRSRLD DKAVHTLEEA

101 MKNTTGVNVV RDSGLQTRFL SRGFYIDQIG EDGITVNVAG RSGYTAKIDV

151 SPSTDLAVYD HIEVVRGATG LTQSNSEPGG TVNLIRKR
``` a743/m743 98.9% identity in 187 aa overlap

```
                    10         20         30         40         50         60
    a743.pep    MNQNHFSLKILTVMLLSAYGGSFADGVVPVSDGNTVSLDTVNVRGSHALSGKTEKTRSYT
                |||||||||||||||||||||||||||||||||||||||||||||||| |||||||||||
    m743        MNQNHFSLKILTVMLLSAYGGSFADGVVPVSDGNTVSLDTVNVRGSHALLGKTEKTRSYT
                    10         20         30         40         50         60

70         80         90        100        110        120
    a743.pep    IDRMSTATGMRIAGKDTPQSVSVITRSRLDDKAVHTLEEAMKNTTGVNVVRDSGLQTRFL
                ||||||||||||||||||||||||||||||||||||||||||||||||||||||||||||
    m743        IDRMSTATGMRIAGKDTPQSVSVITRSRLDDKAVHTLEEAMKNTTGVNVVRDSGLQTRFL
                    70         80         90        100        110        120

130        140        150        160        170        180
    a743.pep    SRGFYIDQIGEDGITVNVAGRSGYTAKIDVSPSTDLAVYDHIEVVRGATGLTQSNSEPGG
                |||||||||||:||||||||||||||||||||||||||||||||||||||||||||||||
    m743        SRGFYIDQIGEDGMTVNVAGRSGYTAKIDVSPSTDLAVYDHIEVVRGATGLTQSNSEPGG
                   130        140        150        160        170        180 a743.pep    TVNLIRKR
                |||||||
    m743        TVNLIRKX g744 .seq not found yet
    g744 .pep not found yet
```

The following partial DNA sequence was identified in *N. meningitidis* <SEQ ID 2547>:

```
m744.seq
   1  ATGAAACCGT TAAAAACATT AGAATTTGGA TTTGTGGATG CTGCAAACTA
  51  CAGAAGAAGA GAAAATAAAG ATTTATTTAA CCGAATATTT GTAAAAGGAG
 101  AATATTTGGA TGAATTATGT GAACCAAATA TTTCGTTTTT AATCGGAGAA
 151  AAGGGAACTG GAAAGACAGC ATATGCTGTT TATTTAACTA ATAACTTCTA
 201  TAAAAACATA CATGCCACTA CTAAGTTTGT TCGTGAAACC GATTATTCAA
 251  AATTTATTCA GCTAAAGAAA GCAAGACACT TAACTGTTTC AGATTTTACA
 301  AGTATTTGGA AAGTCATTTT ATATCTGTTG ATATCAAATC AAATCAAATG
 351  TAAAGAAAAC GGAATATTAT CTTCAATATT TAATAAATTT AAAGCCTTAG
 401  ATGAGGCTAT AAATGAATAT TATTATGGCG CTTTTGATCC GGAAATTGTA
 451  CAAGCAATAA CTTTAATAGA AAATTCAAAA GAAGCTGCGG AAATGATTTT
 501  TGGAAAATTT GTTAAACTAG GTGAAGAGGA ATCCCAACAA ATAACTTTTA
 551  CAGAAAGTAA ATTCCAAGCA AATTTAGGTT TTATTGAAAG AAAATTTAAA
 601  GATGCTTTAT CTCAGTTAAA GCTAAAAGAT AATCATATTT TGTTTATTGA
 651  TGGGATAGAT ATTAGACCAT CACAGATTCC ATTTGATGAA TATCATGAGT
 701  GTGTAAAAGG TCTTGCTAAC GCCATATGGA TGTTAAATAA TGATATCTTC
 751  CCTTCCATTA AAGATAGTAA GGGAAGGATG AGAGTTGTGT TATTGATTAG
 801  ACCTGATATC TTTGATTCAT TAGGTTTACA AAATCAAAAT ACCAAACTTC
 851  AAGATAATTC AGTATTTTTA GACTGGAGGA CGGATTATAA ATCTTATAGA
 901  AGTTCAAAGA TTTTTGGCGT TTTTGATCAT CTTTTGAGAA CCCAGCAAGA
 951  AAAACAAGAT AGTTTAGAAA AAGGCAACTC ATGGGATTAT TATTTTCCAT
1001  GGAATGCTCC TAATTTACAT GATGAGTATA AAAATTTAAC TTCATTTATT
1051  AGCTTCCTAA GAAAATCGTA TTATCGACCT CGCGATATTC TTCAGATGCT
1101  TACTTTGCTA CAAAAAAATA AGAAAAGTAA GGAAGATTAT GTCGTAGCAG
1151  AAGATTTTGA TAATACTTCT TTTCAAAGAG AATACTCGAT ATATTTACTT
1201  GGTGAAATCA AAGATCATCT TTTGTTTTAT TATAGTCAAA GTGATTATCA
1251  AAATTTCCTG AAATTTTTTG AATTTTTAAA CGGGAAAGAT AGATTTAAAT
1301  ATAGTGATTT TTTAAAAGCA TTTGAACGTT TGAAAAAGCA CTTACAAACA
1351  ACATCAGTGG AAATACCTAA ATTTATGAGT ACTGCTAATG AGTTTTTGCA
1401  ATTTTTATTT GACTTGAATG TTATTGCTTA TTTAGATAAC CCAGAAGATG
1451  AAACGAAACC ATATATCCAT TGGTGCTTTA AAGATAGAAA TTATGCAAAT
1501  ATTTCTCCTA AAATAAAAAC TGAAACTGAA TATTTAATAT TTTCAGGATT
1551  ATCAAAAGCC CTTGATGTTG GTACTCCATT TAAGAACAAA CAGTAA
```

This corresponds to the amino acid sequence <SEQ ID 2548; ORF 744>:

```
m744.pep
  1 MKPLKTLEFG FVDAANYRRR ENKDLFNRIF VKGEYLDELC EPNISFLIGE
 51 KGTGKTAYAV YLTNNFYKNI HATTKFVRET DYSKFIQLKK ARHLTVSDFT
101 SIWKVILYLL ISNQIKCKEN GILSSIFNKF KALDEAINEY YYGAFDPEIV
```

```
151 QAITLIENSK EAAEMIFGKF VKLGEEESQQ ITFTESKFQA NLGFIERKFK

201 DALSQLKLKD NHILFIDGID IRPSQIPFDE YHECVKGLAN AIWMLNNDIF

251 PSIKDSKGRM RVVLLIRPDI FDSLGLQNQN TKLQDNSVFL DWRTDYKSYR

301 SSKIFGVFDH LLRTQQEKQD SLEKGNSWDY YFPWNAPNLH DEYKNLTSFI

351 SFLRKSYYRP RDILQMLTLL QKNKKSKEDY VVAEDFDNTS FQREYSIYLL

401 GEIKDHLLFY YSQSDYQNFL KFFEFLNGKD RFKYSDFLKA FERLKKHLQT

451 TSVEIPKFMS TANEFLQFLF DLNVIAYLDN PEDETKPYIH WCFKDRNYAN

501 ISPKIKTETE YLIFSGLSKA LDVGTPFKNK Q* g745.seq not found yet
g745.pep not found yet
```

The following partial DNA sequence was identified in *N. meningitidis* <SEQ ID 2549>:

```
m745.seq
  1 ATGTTTTGGC AACTGACCGT TGTTTCAGTA ACCGCCGTCA TTGCACTGGG

51 GACAATATTC ATCAATAAGA AAACTTCAAA GCAAAAGGCG ACATTAGATG

101 TTATTTTGAA TGATTACCAA GATGCACAAT TTGTAGAAGC CGACAATCAT

151 ATTTCGCCTT ATATTCGCGG CACGGCAGTT GACGACAACA ACGCGCGGAT

201 CGACCTGTAT GAAATTTATC AAAATAAGGG CGGACAATGG GAAAAGAGA

251 GAGGGCATTT ACTTACCGTA ATCAATCGGC ACGAGTTTTA TGCGTGCGCA

301 ATCAACTCGG GAGTATTGGA TGAGGATTTG TTTAAACGGC TGCATTGCAC

351 CAACTTCATA AAATTGTGGA ATGCAGTTTC GCCTCTTGTT ATGAAAATAC

401 GCGAAGAAGA ACGCAAAGAC ACAATATTTA GAGAGTTGGA AATTTTGGTT

451 GCATTATGGA AAGCAAACCC CCTAAAGGCA TCTGATTTGT GA
```

This corresponds to the amino acid sequence <SEQ ID 2550; ORF 745>:

```
m745.pep
  1 MFWQLTVVSV TAVIALGTIF INKKTSKQKA TLDVILNDYQ DAQFVEADNH

51 ISPYIRGTAV DDNNARIDLY EIYQNKGGQW EKERGHLLTV INRHEFYACA

101 INSGVLDEDL FKRLHCTNFI KLWNAVSPLV MKIREEERKD TIFRELEILV

151 ALWKANPLKA SDL* a745.seq not found yet
a745.pep not found yet
```

The following partial DNA sequence was identified in *N. gonorrhoeae* <SEQ ID 2551>:

```
g746.seq
  1 ATGTCCGAAA ACAAACAAAA CGAAGTCCTG ACCGGTTACG AACAGCTGAA

51 ACGGCGCAAC CGCCGCCGCC TCGTAACGGC AAGCTCCCTG GTTGCCGCCT

101 CCTGCATCCT GCTGGCAGCC GCACTCAGTT CCGATCCTGC CGACAGCAAT

151 CCCGCACCGC AGGCCGGCGA AACCGGCGCA ACGGAAAGCC AAACGGCAAA

201 CACGGCACAA ACCCCTGCCT TGAAATCCGC CGCCGAAAAC GGGGAAACCG

251 CCGCCGACAA ACCGCAGGAC TTGGCAGGCG AAGACAAGCC TTCTGCCGCC
```

-continued

```
 301 GACAGCGAAA TCAGCGAGCC TGAAAACGTA GGCGCGCCGC TGGTGCTGAT

351 TAACGACCGG CTCGAAGACA GCAACATCAA AGGTTTGGAA GAATCCGAGA

401 AACTGCAACA GGCAGAAACC GCCAAAACCG AACCGAAGCA GGCAAAACAA

451 CGCGCTGCCG AAAAAGTGTC GGCAACTGCC GACAGTACGG ATACGGTAGC

501 GGTTGAAAAA CCGAAACGCA CTGCCGAACC CAAACCGCAA AAGCGGAAC

551 GCACTGCCGA AGCCAAGCCC AAAGCCAAAG AAACCAAAAC CGCCGAAAAA

601 GTTGCCGACA AACCGAAAAC TGCTGCCGAA AAAACCAAAC CGGATACGGC

651 AAAATCCGAC AGCGCGGTAA AAGAAGCGAA AAAAGCCGAC AAGGCTGAAG

701 GCAAAAAGAC AGCCGAAAAA GACCGTTCGG ACGGCAAAAA ACACGAAACG

751 GCGCAAAAAA CCGACAAAGC GGACAAAACC AAAACCGCCG AGAAGGAAAA

801 ATCCGGCAAG GCGGGCAAAA AAGCCGCCAT TCAGGCAGGT TATGCCGAAA

851 AAGAACGCGC CTTGAGCCTC CAGCGCAAAA TGAAGGCGGC GGGTATCGAT

901 TCGACCATCA CCGAAATCAT GACCGACAAC GGCAAAGTTT ACCGCGTCAA

951 ATCAAGCAAC TATAAAAACG CAAGGGATGC CGAACGCGAT TTGAACAAAC

1001 TGCGCGTGCA CGGCATCGCC GGCCAGGTAA CGAATGAATA G
```

This corresponds to the amino acid sequence <SEQ ID 2552; ORF 746.ng>:

```
g746.pep
   1 MSENKQNEVL TGYEQLKRRN RRRLVTASSL VAASCILLAA ALSSDPADSN

51 PAPQAGETGA TESQTANTAQ TPALKSAAEN GETAADKPQD LAGEDKPSAA

101 DSEISEPENV GAPLVLINDR LEDSNIKGLE ESEKLQQAET AKTEPKQAKQ

151 RAAEKVSATA DSTDTVAVEK PKRTAEPKPQ KAERTAEAKP KAKETKTAEK

201 VADKPKTAAE KTKPDTAKSD SAVKEAKKAD KAEGKKTAEK DRSDGKKHET

251 AQKTDKADKT KTAEKEKSGK AGKKAAIQAG YAEKERALSL QRKMKAAGID

301 STITEIMTDN GKVYRVKSSN YKNARDAERD LNKLRVHGIA GQVTNE*
```

The following partial DNA sequence was identified in *N. meningitidis* <SEQ ID 2553>:

```
m746.seq
   1 ATGTCCGAAA ACAAACAAAA CGAAGTCCTG AGCGGTTACG AACAACTCAA

51 ACGGCGCAAC CGCCGCCGCC TCGTAACGGC AAGTTGCCTG GTTGCCGCCT

101 CCTGCATCCT GCTGGCAGCC GCCCTCAGTT CCGGCCCTGC CGAACAGACT

151 GCCGGCGAAA CAAGCGGCGT AGAAAACAAA GCGGCAGGTG CGGCACAAAC

201 CCCTGCCTTG AAATCCGCCG CCGACAAACC GCAGGACTTG GCAGGCGAAG

251 ACAAGCCTTC TGCCGCCGAC AGCGAAATCA GCGAGCCTGA AAACGTAGGC

301 GCGCCGCTGG TGCTGATTAA CGAGCGCCTC GAAGACAGCA ACATCAAAGG

351 TTTGGAAGCA TCCGAGAAAC TGCAACAGGC AGAAACCGCC AAAACCGCAC

401 CGAAGCAGGC AAAACAACGC GCTGCCGAAA AAGTGCCGGC AACTGCCGAC

451 AGTACGGATA CGGTAGCGGT TGAAAAACCG AAACGCACTG CCGAAACAAA

501 ACCGCAAAAA GCGGAACGCA CTGCCAAAGC CAAGCCCAAA GCCAAAGAAA

551 CCAAAACCGC CGAAAAAGTT GCCGACAAAC CGAAAACTGC CGCCGAAAAA
```

```
-continued
601 ACCAAACCGG ATACGGCAAA ATCCGACAGC GCGGTAAAAG AAGCGAAAAA

651 AGCCGACAAG GCTGAAAGCA AAAAAACAGC CGAAAAAGAC CGTTCGGACG

701 GCAAAAAACA CGAAACGGCA CAAAAAACCG ACAAAGCGGA CAAGACCAAA

751 ACCGCCGAGA AGGAAAAATC CGGTAAAAAA GCCGCCATTC AGGCAGGTTA

801 TGCCGAAAAA GAACGCGCCT TAAGCCTCCA GCGCAAAATG AAGGCGGCGG

851 GTATCGATTC GACCATCACC GAAATTATGA CCGACAACGG CAAAGTTTAC

901 CGCGTCAAAT CAAGCAACTA TAAAAACGCA AGGGATGCCG AACGCGATTT

951 GAACAAATTG CGCGTACACG GTATCGCCGG TCAGGTAACG AATGAATAG
```

This corresponds to the amino acid sequence <SEQ ID 2554; ORF 746>:

```
m746.pep
  1 MSENKQNEVL SGYEQLKRRN RRRLVTASCL VAASCILLAA ALSSGPAEQT

51 AGETSGVENK AAGAAQTPAL KSAADKPQDL AGEDKPSAAD SEISEPENVG

101 APLVLINERL EDSNIKGLEA SEKLQQAETA KTAPKQAKQR AAEKVPATAD

151 STDTVAVEKP KRTAETKPQK AERTAKAKPK AKETKTAEKV ADKPKTAAEK

201 TKPDTAKSDS AVKEAKKADK AESKKTAEKD RSDGKKHETA QKTDKADKTK

251 TAEKEKSGKK AAIQAGYAEK ERALSLQRKM KAAGIDSTIT EIMTDNGKVY

301 RVKSSNYKNA RDAERDLNKL RVHGIAGQVT NE*
```

Computer analysis of this amino acid sequence gave the following results:
Homology with a Predicted ORF from *N. gonorrhoeae*
ORF 746 shows 89.9% identity over a 346 aa overlap with a predicted ORF (ORF 746) from *N. gonorrhoeae*:

```
   m746/g746  89.9% identity in 346 aa overlap 10         20         30         40         50
   m746.pep  MSENKQNEVLSGYEQLKRRNRRRLVTASCLVAASCILLAAALSSGPAEQT----AGETSG
             ||||||||||:|||||||||||||||||| ||||||||||||||| |:::    ||||::
   g746      MSENKQNEVLTGYEQLKRRNRRRLVTASSLVAASCILLAAALSSDPADSNPAPQAGETGA
                    10         20         30         40         50         60

60         70         80         90        100       109
   m746.pep  VENKAAGAAQTPALKSAA-------DKPQDLAGEDKPSAADSEISEPENVGAPLVLINER
             :|::::|::|||||||||       |||||||||||||||||||||||||||||||||:|
   g746      TESQTANTAQTPALKSAAENGETAADKPQDLAGEDKPSAADSEISEPENVGAPLVLINDR
                    70         80         90        100       110       120

110        120        130        140        150       169
   m746.pep  LEDSNIKGLEASEKLQQAETAKTAPKQAKQRAAEKVPATADSTDTVAVEKPKRTAETKPQ
             ||||||||||| |||||||||||| |||||||||||| ||||||||||||||||||| ||
   g746      LEDSNIKGLEESEKLQQAETAKTEPKQAKQRAAEKVSATADSTDTVAVEKPKRTAEPKPQ
                   130        140        150        160        170        180

170        180        190        200        210       229
   m746.pep  KAERTAKAKPKAKETKTAEKVADKPKTAAEKTKPDTAKSDSAVKEAKKADKAESKKTAEK
             ||||||:||||||||||||||||||||||||||||||||||||||||||||||:||||||
   g746      KAERTAEAKPKAKETKTAEKVADKPKTAAEKTKPDTAKSDSAVKEAKKADKAEGKKTAEK
                   190        200        210        220        230        240

230        240        250        260        270       280
   m746.pep  DRSDGKKHETAQKTDKADKTKTAEKEKSGK---KAAIQAGYAEKERALSLQRKMKAAGID
             ||||||||||||||||||||||||||||||   |||||||||||||||||||||||||||
   g746      DRSDGKKHETAQKTDKADKTKTAEKEKSGKAGKKAAIQAGYAEKERALSLQRKMKAAGID
                   250        260        270        280        290        300

290        300        310        320        330
   m746.pep  STITEIMTDNGKVYRVKSSNYKNARDAERDLNKLRVHGIAGQVTNEX
             |||||||||||||||||||||||||||||||||||||||||||||||
   g746      STITEIMTDNGKVYRVKSSNYKNARDAERDLNKLRVHGIAGQVTNEX
                   310        320        330        340
```

The following partial DNA sequence was identified in *N. meningitidis* <SEQ ID 2555>:

```
a746.seq
   1 ATGTCCGAAA ACAAACAAAA CGAAGTCCTG AGCGGTTACG AACAACTCAA

51 ACGGCGCAAC CGCCGCCGCC TCGTAACGGC AAGTTGCCTG GTTGCCGCCT

101 CCTGCATCCT GCTGGCAGCC GCCCTCAGTT CCGGCCCTGC CGAACAGACT

151 GCCGGCGAAA CAAGCGGCGT AGAAAACAAA GCGGCAGGTG CGGCACAAAC

201 CCCTGCCTTG AAATCCGCCG CCGACAAACC GCAGGACTTG GCAGGCGAAG

251 ACAAGCCTTC TGCCGCCGAC AGCGAAATCA GCGAGCCTGA AAACGTAGGC

301 GCGCCGCTGG TGCTGATTAA CGACCGCCTC GAAGACAGCA ACATCAAAGG

351 TTTGGAAGCA TCCGAGAAAC TGCAACAGGC AGAAACCGCC AAAACCGCAC

401 CGAAGCAGGC AAAACAACGC GCTGCCGAAA AAGTGCCGGC AACTGCCGAC

451 AGTACGGATA CGGTAGCGGT TGAAAAACCG AAACGCACTG CCGAAACAAA

501 ACCGCAAAAA GCGGAACGCA CTGCCAAAGC CAAGCCCAAA GCCAAAGAAA

551 CCAAAACCGC CGAAAAAGTT GCCGACAAAC CGAAAACTGC CGCCGAAAAA

601 ACCAAACCGG ATACGGCAAA ATCCGACAGC GCGGTAAAAG AAGCGAAAAA

651 AGCCGACAAG GCTGAAAGCA AAAAAACAGC CGAAAAAGAC CGTTCGGACG

701 GCAAAAAACA CGAAACGGCA CAAAAAACCG ACAAAGCGGA CAAGACCAAA

751 ACCGCCGAGA AGGAAAAATC CGGTAAAAAA GCCGCCATTC AGGCAGGTTA

801 TGCCGAAAAA GAACGCGCCT TAAGCCTCCA GCGCAAAATG AAGGCGGCGG

851 GTATCGATTC GACCATCACC GAAATTATGA CCGACAACGG CAAAGTTTAC

901 CGCGTCAAAT CAAGCAACTA TAAAAACGCA AGGGATGCCG AACGCGATTT

951 GAACAAATTG CGCGTACACG GTATCGCCGG TCAGGTAACG AATGAATAA
```

This corresponds to the amino acid sequence <SEQ ID 2556; ORF 746.a>:

```
a746.pep
   1 MSENKQNEVL SGYEQLKRRN RRRLVTASCL VAASCILLAA ALSSGPAEQT

51 AGETSGVENK AAGAAQTPAL KSAADKPQDL AGEDKPSAAD SEISEPENVG

101 APLVLINDRL EDSNIKGLEA SEKLQQAETA KTAPKQAKQR AAEKVPATAD

151 STDTVAVEKP KRTAETKPQK AERTAKAKPK AKETKTAEKV ADKPKTAAEK

201 TKPDTAKSDS AVKEAKKADK AESKKTAEKD RSDGKKHETA QKTDKADKTK

251 TAEKEKSGKK AAIQAGYAEK ERALSLQRKM KAAGIDSTIT EIMTDNGKVY

301 RVKSSNYKNA RDAERDLNKL RVHGIAGQVT NE*
```

Computer analysis of this amino acid sequence gave the following results:

Homology with a Predicted ORF from *N. meningitidis*

ORF 746 shows 99.7% identity over a 332 aa overlap with a predicted ORF (ORF 746) from *N. meningitidis*:

```
a746/m746;  99.7% identity in 332 aa overlap 10        20        30        40        50        60
a746.pep     MSENKQNEVLSGYEQLKRRNRRRLVTASCLVAASCILLAAALSSGPAEQTAGETSGVENK
             ||||||||||||||||||||||||||||||||||||||||||||||||||||||||||||
m746         MSENKQNEVLSGYEQLKRRNRRRLVTASCLVAASCILLAAALSSGPAEQTAGETSGVENK
                    10        20        30        40        50        60
```

-continued

```
                      70        80        90       100       110       120
a746.pep      AAGAAQTPALKSADKPQDLAGEDKPSAADSEISEPENVGAPLVLINDRLEDSNIKGLEA
              ||||||||||||||||||||||||||||||||||||||||||||||||:|||||||||||
m746          AAGAAQTPALKSADKPQDLAGEDKPSAADSEISEPENVGAPLVLINERLEDSNIKGLEA
                      70        80        90       100       110       120

130       140       150       160       170       180
a746.pep      SEKLQQAETAKTAPKQAKQRAAEKVPATADSTDTVAVEKPKRTAETKPQKAERTAKAKPK
              ||||||||||||||||||||||||||||||||||||||||||||||||||||||||||||
m746          SEKLQQAETAKTAPKQAKQRAAEKVPATADSTDTVAVEKPKRTAETKPQKAERTAKAKPK
                     130       140       150       160       170       180

190       200       210       220       230       240
a746.pep      AKETKTAEKVADKPKTAAEKTKPDTAKSDSAVKEAKKADKAESKKTAEKDRSDGKKHETA
              ||||||||||||||||||||||||||||||||||||||||||||||||||||||||||||
m746          AKETKTAEKVADKPKTAAEKTKPDTAKSDSAVKEAKKADKAESKKTAEKDRSDGKKHETA
                     190       200       210       220       230       240

250       260       270       280       290       300
a746.pep      QKTDKADKTKTAEKEKSGKKAAIQAGYAEKERALSLQRKMKAAGIDSTITEIMTDNGKVY
              ||||||||||||||||||||||||||||||||||||||||||||||||||||||||||||
m746          QKTDKADKTKTAEKEKSGKKAAIQAGYAEKERALSLQRKMKAAGIDSTITEIMTDNGKVY
                     250       260       270       280       290       300

310       320       330
a746.pep      RVKSSNYKNARDAERDLNKLRVHGIAGQVTNEX
              |||||||||||||||||||||||||||||||||
m746          RVKSSNYKNARDAERDLNKLRVHGIAGQVTNEX
                     310       320       330
``` g747.seq not found yet g747.pep not found yet

The following partial DNA sequence was identified in *N. meningitidis* <SEQ ID 2557>:

```
m747.seq
  1 CTGACCCCTT GGGCGGATGC ATATGCAGAT TTGCGCGGCA AAACCAAAGT

51 GATGACGACC CAGATGGGTG CTTCCCGCGA TGTCAGCAAA AGCGCCAAAG

101 GTTGGAGTGT CGGTATCGGT CTGAATGTAG GCAAACAGTT GACCGACAGC

151 GTCGGTCTCG AGTTTGATCC ATACTACCGT CACAAAACAA TCTACAAACC

201 CCGTGAGATT GTCTTGGACG GTGACAAAAC CAAAATGGGC CGCTCCAAAT

251 CCAACGAGTA CGGCTTCCGC GTAGCCGCAA CGTTCTATAG TCAATTAAAA

301 TCAAAATAG
```

This corresponds to the amino acid sequence <SEQ ID 2558; ORF 747>:

```
m747.pep
  1 LTPWADAYAD LRGKTKVMTT QMGASRDVSK SAKGWSVGIG LNVGKQLTDS

51 VGLEFDPYYR HKTIYKPREI VLDGDKTKMG RSKSNEYGFR VAATFYSQLK

101 SK*
```

The following partial DNA sequence was identified in *N. meningitidis* <SEQ ID 2559>:

```
a747.seq
  1 CTAACCCCTT GGGCGGATGC ATATGCAGAT TTGCGCGGCA AAACCAAAGT

51 GATGACGACC CAGATGTGTG CTTCCCGCGA TGTCAGCAAA AGCGCCAAAG

101 GTTGGAGTGT CGGTATCGGT CTGAATGTAG GCAAACAGTT GACCGACAGC

151 GTCGGTCTCG AGTTTGATCC ATACTACCGT CACAAAACAA TCTGCAAACC

201 CCGTGAGATT GTTTTGGACG GCGACAAAAC CAAAATGGGC CGCTCCAAAT
```

-continued

```
251 CCAACGAGTA CGGCTTCCGC GTAACCGCAA CGTTCTATAG TCAATTAAAA

301 TCAAAGTAG
```

This corresponds to the amino acid sequence <SEQ ID 2560; ORF 747.a>:

```
a747.pep
   1 LTPWADAYAD LRGKTKVMTT QMCASRDVSK SAKGWSVGIG LNVGKQLTDS

51 VGLEFDPYYR HKTICKPREI VLDGDKTKMG RSKSNEYGFR VTATFYSQLK

101 SK*
```

Computer analysis of this amino acid sequence gave the following results:
Homology with a Predicted ORF from N. meningitidis
ORF 747 shows 97.1% identity over a 102 aa overlap with a predicted ORF (ORF 746) from N. meningitidis:

```
      a747/m747      97.1% identity in 102 aa overlap 10         20         30         40         50         60
      a747.pep    LTPWADAYADLRGKTKVMTTQMCASRDVSKSAKGWSVGIGLNVGKQLTDSVGLEFDPYYR
                  |||||||||||||||||||||| |||||||||||||||||||||||||||||||||||||
      m747        LTPWADAYADLRGKTKVMTTQMGASRDVSKSAKGWSVGIGLNVGKQLTDSVGLEFDPYYR
                       10         20         30         40         50         60

70         80         90        100
      a747.pep    HKTICKPREIVLDGDKTKMGRSKSNEYGFRVTATFYSQLKSKX
                  |||| |||||||||||||||||||||||||||:|||||||||||
      m747        HKTIYKPREIVLDGDKTKMGRSKSNEYGFRVAATFYSQLKSKX
                       70         80         90        100
      a747 (SEQ ID 2560)/m80195 (SEQ ID 4168)
      gi|150271 (M80195) outer membrane protein [Neisseria meningitidis] Length = 272
       Score = 59.3 bits (141), Expect = 6e-09
       Identities = 29/99 (29%), Positives = 51/99 (51%), Gaps = 4/99 (4%)
      Query: 1    LTPWADAYADLRGKTKVMTTQMCASRDVSKSAKGWSVGIGLNVGKQLTDSVGLEFDPYYR 60
                  + PW++    DL + K+ T      +D+++   GW  G+G N+GK+L +S  +E P+Y+
      Sbjct: 174  INPWSEVKFDLNSRYKLNTGVTNLKKDINQKTNGWGFGLGANIGKKLGESASIEAGPFYK 233

Query: 61   HKTICKPREIVL---DGD-KTKMGRSKSNEYGFRVTATF 95
                  +T  + E +    GD   + ++   EYG RV   F
      Sbjct: 234  QRTYKESGEFSVTTKSGDVSLTIPKTSIREYGLRVGIKF 272
```

The following partial DNA sequence was identified in N. gonorrhoeae <SEQ ID 2561>:

```
g748.seq
   1 ATGAGTCAAA ACCAACCCGC ACAACCGACC AAACGCAATC TGTTCAAAAC

51 CGCCCTTGCC GTCGGCGCAA TCGGCGCAAT CGGAGGTTAT TTCGGCGGCA

101 AAAAACAGGG CGAAACCGCC GAACGCACCG CCGAAAGCCA ACACTCGCCC

151 CAAGCCTATC CCTGCTACGG CGAACATCAG GCAGGTATCG TTACGCCGCG

201 GCAGGCGTTT TCCATTATGT GCGCCTTCGA CGTAACCGCG CAAAGTGCCA

251 AGCAGCTGGA AAACCTGTTC CGCACACTGA CCGCCCGCAT CGAGTTTCTC

301 ACCCAAGGCG GAGAATACCA AGACGGCGAC GACAAACTCC CGTCAGCCGG

351 CAGCGGCATT TTGGGTAAAG CCTTCAACCC CGACGGATTG ACCGTTACCG

401 TGGGGGTGGG CAGCAGCCTG TTTGACGGCC GGTTCGGACT CAAAGACAAA

451 AAAACGGTTC ATTTGCAGGA AATGCGCGAC TTCCCCAACG ATAAGCTGCA

501 AAAAAGCTGG TGCGACGGCG ATTTGAGCCT GCAAATCTGC GCCTTCACCC

551 CCGAAACCTG CCAAACCGCC CTGCGCGACA TCATCAAACA CACCGCCCAA
```

-continued

```
 601 ACCGCCGTCA TCCGCTGGAG TATCGACGGG TGGCAGCCTA AATCCGAACC

651 CGGCGCGATG GCGGCGCGCA ACCTGTTGGG CTTCCGAGAC GGCACGGGCA

701 ACCCCAAGGT TTCCGATCCC AAAACCGCCG ACGAGGTTTT ATGGACGGGC

751 GTGGCCGCCA ACAGCCTCGA CGAACCGGAG TGGGCGAAAA ACGGCAGCTA

801 TCAGGCAGTC CGCCTTATCC GCCGCTTTGT CGAGTTTTGG GACAGGACGC

851 CGCTTCAAGA GCAAACCGAC ATTTTCGGGC GGCGAAAATA CAGCGGGGCG

901 CCGATGGACG GCAAAAAAGA AGCCGACCAA CCGGATTTCG CCAAAGACCC

951 CGAGGGTGAT ATCACGCCCA AAGACAGCCA TATGCGCCTG GCGAATCCGC

1001 GCGATCCCGA ATTCCTCAAA AAACACTGCC TCTTCCGCCG CGCCTACAGC

1051 TATTCTCGCG GACCCGCCTC AAGCGGACAG CTTGATGTCG GGCTGGTGTT

1101 CGTCTGCTAT CAGGCAAATC TTGCCGACGG TTTCATCTTC GTGCAAAACC

1151 TCCTCAACGG CGAACCGCTG GAAGAATACA TCAGCCCCTT CGGCGGCGGC

1201 TATTTCTTCG TCTTGCCCGG CGTGGGAAAA GGCGGATTCT TGGGACAAGG

1251 GCTGCCGGGC GTATAA
```

This corresponds to the amino acid sequence <SEQ ID 2562; ORF 748.ng>:

```
g748.pep
  1 MSQNQPAQPT KRNLFKTALA VGAIGAIGGY FGGKKQGETA ERTAESQHSP

51 QAYPCYGEHQ AGIVTPRQAF SIMCAFDVTA QSAKQLENLF RTLTARIEFL

101 TQGGEYQDGD DKLPSAGSGI LGKAFNPDGL TVTVGVGSSL FDGRFGLKDK

151 KTVHLQEMRD FPNDKLQKSW CDGDLSLQIC AFTPETCQTA LRDIIKHTAQ

201 TAVIRWSIDG WQPKSEPGAM AARNLLGFRD GTGNPKVSDP KTADEVLWTG

251 VAANSLDEPE WAKNGSYQAV RLIRRFVEFW DRTPLQEQTD IFGRRKYSGA

301 PMDGKKEADQ PDFAKDPEGD ITPKDSHMRL ANPRDPEFLK KHCLFRRAYS

351 YSRGPASSGQ LDVGLVFVCY QANLADGFIF VQNLLNGEPL EEYISPFGGG

401 YFFVLPGVGK GGFLGQGLPG V*
```

The following partial DNA sequence was identified in N. meningitidis <SEQ ID 2563>:

```
m748.seq
  1 ATGAGCAAAA AACAACCCGC ACAACCGACC AGGCGCACTC TTTTTAAAAC

51 CGCGATCGCA GCCGGAGCAG TCGGCGCAAT CGGAGGTTAT CTCGGCGGCA

101 AAAAACAGGG CGAAACCGCC GAACGCACCG CCGAAAGCCA ACACTCGCCC

151 CAAGCCTATC CCTGCTACGG CGAACATCAG GCAGGCATCG TTACGCCGCA

201 GCAGGCGTTT TCGATTATGT GCGCCTTCGA CGTAACCGCG CAAAGTGCCA

251 AGCAGCTGGA AAACCTGTTC CGCACGCTGA CCGCCCGCAT CGAGTTTCTC

301 ACCCAAGGCG GCGAATACCA AGACGGCGAC GACAAACTTC CGCCAGCCGG

351 CAGCGGCATT TTGGGCAAAG CCTTCAACCC CGACGGGTTG ACCGTTACCG

401 TGGGGGTGGG CAGCAGCCTG TTTGACGGCC GGTTCGGACT CAAAGACAAA

451 AAACCGATTC ATTTGCAGGA AATGCGCGAC TTCTCCAACG ATAAGCTGCA

501 AAAAGCTGG TGCGACGGCG ATTTGAGCCT GCAAATCTGT GCCTTCACCC
```

-continued

```
 551 CCGAAACCTG CCAAGCCGCC CTGCGCGACA TCATCAAACA CACCGTCCAA

601 ACCGCCGTTA TCCGTTGGAG TATCGACGGG TGGCAGCCCA AATCCGAACC

651 CGGCGCGATG GCGGCGCGCA ACCTGTTGGG CTTCAGGGAC GGCACGGGCA

701 ACCCCAAAGT TTCCGATCCC AAAACTGCCG ACGAGGTTTT GTGGACGGGG

751 GTGGCCGCCA ACAGCCTCGA CGAACCGGAG TGGGCGAAAA ACGGCAGCTA

801 TCAGGCAGTC CGCCTTATCC GCCACTTTGT CGAGTTTTGG GACAGGACGC

851 CGCTTCAAGA GCAAACCGAC ATTTTCGGGC GGCGCAAATA CAGCGGTGCG

901 CCGATGGACG GCAAAAAAGA AGCCGACCAA CCGGATTTTG CCAAAGACCC

951 CGAGGGTGAT ATCACGCCCA AGACAGCCA TATACGCCTG GCGAATCCGC

1001 GCGATCCCGA ATTCCTCAAA AAACACCGCC TCTTCCGCCG CGCCTACAGC

1051 TATTCGCGCG GACTCGCCTC AAGCGGACAG CTTGATGTCG GGCTGGTGTT

1101 CGTCTGCTAT CAGGCAAACC TTGCCGACGG ATTCATCTTC GTGCAAAACC

1151 TCCTCAACGG CGAACCGCTG GAAGAATACA TCAGCCCCTT CGGCGGCGGC

1201 TATTTCTTCG TCTTGCCCGG CGTGGAAAAA GGCGGCTTTT TGGGGCAAGG

1251 GCTGCTGGGC GTATAA
```

This corresponds to the amino acid sequence <SEQ ID 2564; ORF 748>:

```
m748.pep
  1 MSKKQPAQPT RRTLFKTAIA AGAVGAIGGY LGGKKQGETA ERTAESQHSP

51 QAYPCYGEHQ AGIVTPQQAF SIMCAFDVTA QSAKQLENLF RTLTARIEFL

101 TQGGEYQDGD DKLPPAGSGI LGKAFNPDGL TVTVGVGSSL FDGRFGLKDK

151 KPIHLQEMRD FSNDKLQKSW CDGDLSLQIC AFTPETCQAA LRDIIKHTVQ

201 TAVIRWSIDG WQPKSEPGAM AARNLLGFRD GTGNPKVSDP KTADEVLWTG

251 VAANSLDEPE WAKNGSYQAV RLIRHFVEFW DRTPLQEQTD IFGRRKYSGA

301 PMDGKKEADQ PDFAKDPEGD ITPKDSHIRL ANPRDPEFLK KHRLFRRAYS

351 YSRGLASSGQ LDVGLVFVCY QANLADGFIF VQNLLNGEPL EEYISPFGGG

401 YFFVLPGVEK GGFLGQGLLG V*
```

Computer analysis of this amino acid sequence gave the following results:
Homology with a Predicted ORF from *N. gonorrhoeae*
ORF 748 shows 95.0% identity over a 421 aa overlap with a predicted ORF (ORF 748) from *N. gonorrhoeae*

```
    m748/g748    95.0% identity in 421 aa overlap 10         20         30         40         50         60
        m748.pep   MSKKQPAQPTRRTLFKTAIAAGAVGAIGGYLGGKKQGETAERTAESQHSPQAYPCYGEHQ
                   ||::||||||:|:||||||:|:||:||||||:||||||||||||||||||||||||||||
        g748       MSQNQPAQPTKRNLFKTALAVGAIGAIGGYFGGKKQGETAERTAESQHSPQAYPCYGEHQ
                    10         20         30         40         50         60

70         80         90        100        110        120
        m748.pep   AGIVTPQQAFSIMCAFDVTAQSAKQLENLFRTLTARIEFLTQGGEYQDGDDKLPPAGSGI
                   ||||||:||||||||||||||||||||||||||||||||||||||||||||||| ||||
        g748       AGIVTPRQAFSIMCAFDVTAQSAKQLENLFRTLTARIEFLTQGGEYQDGDDKLPSAGSGI
                    70         80         90        100        110        120

130        140        150        160        170        180
        m748.pep   LGKAFNPDGLTVTVGVGSSLFDGRFGLKDKKPIHLQEMRDFSNDKLQKSWCDGDLSLQIC
                   ||||||||||||||||||||||||||||||:||||||||:|||||||||||||||||||
        g748       LGKAFNPDGLTVTVGVGSSLFDGRFGLKDKKTVHLQEMRDFPNDKLQKSWCDGDLSLQIC
                   130        140        150        160        170        180
```

-continued

```
                   190       200       210       220       230       240
m748.pep    AFTPETCQAALRDIIKHTVQTAVIRWSIDGWQPKSEPGAMAARNLLGFRDGTGNPKVSDP
            |||||||:|||||||||:||||||||||||||||||||||||||||||||||||||||||
g748        AFTPETCQTALRDIIKHTAQTAVIRWSIDGWQPKSEPGAMAARNLLGFRDGTGNPKVSDP
                   190       200       210       220       230       240

250       260       270       280       290       300
m748.pep    KTADEVLWTGVAANSLDEPEWAKNGSYQAVRLIRHFVEFWDRTPLQEQTDIFGRRKYSGA
            ||||||||||||||||||||||||||||||||||:|||||||||||||||||||||||||
g748        KTADEVLWTGVAANSLDEPEWAKNGSYQAVRLIRRFVEFWDRTPLQEQTDIFGRRKYSGA
                   250       260       270       280       290       300

310       320       330       340       350       360
m748.pep    PMDGKKEADQPDFAKDPEGDITPKDSHIRLANPRDPEFLKKHRLFRRAYSYSRGLASSGQ
            ||||||||||||||||||||||||||||:||||||||||||||| |||||||||| |||||
g748        PMDGKKEADQPDFAKDPEGDITPKDSHMRLANPRDPEFLKKHCLFRRAYSYSRGPASSGQ
                   310       320       330       340       350       360

370       380       390       400       410       420
m748.pep    LDVGLVFVSYQANLADGFIFVQNLLNGEPLEEYISPFGGGYFFVLPGVEKGGFLGQGLLG
            ||||||||||||||||||||||||||||||||||||||||||| ||||| ||||||||| |
g748        LDVGLVFVCYQANLADGFIFVQNLLNGEPLEEYISPFGGGTFFVLPGVGKGGFLGQGLPG
                   370       380       390       400       410       420 m748.pep    VX
            ||
g748        VX
```

The following partial DNA sequence was identified in *N. meningitidis* <SEQ ID 2565>:

```
a748.seq
   1 ATGAGCAAAA ACCAACCCGC ACAACCGACC AGGCGCACTC TTTTTAAAAC
  51 CGCGATCGCA GCTGGAGCAG TCGGCGCAAT CGGAGGTTAT CTCGGCGGCA
 101 AAAAACGGGG CGAAACCGCC GAACGCACCG CCGAAAGCCA ACACTCGCCC
 151 CAAGCCTATC CCTGCTACGG CGAACATCAG GCAGGCATCG TTACGCCGCA
 201 GCAGGCGTTT TCGATTATGT GCGCCTTCGA CGTAACCGCG CAAAGTGCCA
 251 AGCAGCTGGA AAACCTGTTC CGCACGCTGA CCGCCCGCAT CGAGTTTCTC
 301 ACCCAAGGCG GCGAATACCA AGACGGCGAC GACAAACTTC CGCCAGCCGG
 351 CAGCGGCATT TTGGGCAAAG CCTTCAACCC CGACGGGTTG ACCGTTACCG
 401 TGGGGGTGGG CAGCAGCCTG TTTGACGGCC GGTTCGGACT CAAAGACAAA
 451 AAACCGATTC ATTTGCAGGA AATGCGCGAC TTCTCCAACG ATAAGCTGCA
 501 AAAAAGCTGG TGCGACGGCG ATTTGAGCCT GCAAATCTGT GCCTTCACCC
 551 CCGAAACCTG CCAAGCCGCC CTGCGCGACA TCATCAAACA CACCGTCCAA
 601 ACCGCCGTTA TCCGCTGGAG TATCGACGGG TGGCAGCCTA AATCCGAACC
 651 CGGCGCGATG GCGGCGCGCA ACCTGTTGGG CTTCCGCGAC GGCACGGGCA
 701 ACCCCAAAGT TTCCGACCCC AAAACTGCCG ACGAGGTTTT GTGGACGGGG
 751 GTGGCCGCCA ACAGCCTCGA CGAACCGGAG TGGGCGAAAA ACGGCAGCTA
 801 TCAGGCAGTC CGCCTTATCC GCCACTTTGT TGAGTTTTGG GACAGGACGC
 851 CGCTTCAAGA GCAAACCGAC ATTTTCGGGC GGCGCAAATA CAGCGGCGCG
 901 CCGATGGACG GCAAAAAAGA AGCCGACCAA CCGGATTTTG CCAAAGACCC
 951 CGAGGGGAAT ACCACGCCCA AAGACAGCCA TATACGCCTG GCGAATCCGC
1001 GCGATCCCGA GTTCCTTAAA AAACACCGCC TCTTCCGCCG CGCCTACAGC
1051 TATTCGCGCG GACTCGCCTC AAGCGGACAG CTTGATGTCG GGCTGGTGTT
1101 CGTCTGCTAT CAGGCAAACC TTGCCGACGG ATTCATCTTC GTGCAAAACC
1151 TCCTCAACGG CGAACCGCTG GAAGAATACA TCAGCCCCTT CGGCGGCGGC
```

```
1201 TATTTCTTCG TCTTGCCCGG CGTGGAAAAA GGCGGCTTTT TGGGGCAAGG

1251 GCTGCTGGGC GTATAA
```

This corresponds to the amino acid sequence <SEQ ID 2566; ORF 748.a>:

```
a748.pep
  1 MSKNQPAQPT RRTLFKTAIA AGAVGAIGGY LGGKKRGETA ERTAESQHSP

51 QAYPCYGEHQ AGIVTPQQAF SIMCAFDVTA QSAKQLENLF RTLTARIEFL

101 TQGGEYQDGD DKLPPAGSGI LGKAFNPDGL TVTVGVGSSL FDGRFGLKDK

151 KPIHLQEMRD FSNDKLQKSW CDGDLSLQIC AFTPETCQAA LRDIIKHTVQ

201 TAVIRWSIDG WQPKSEPGAM AARNLLGFRD GTGNPKVSDP KTADEVLWTG

251 VAANSLDEPE WAKNGSYQAV RLIRHFVEFW DRTPLQEQTD IFGRRKYSGA

301 PMDGKKEADQ PDFAKDPEGN TTPKDSHIRL ANPRDPEFLK KHRLFRRAYS

351 YSRGLASSGQ LDVGLVFVCY QANLADGFIF VQNLLNGEPL EEYISPFGGG

401 YFFVLPGVEK GGFLGQGLLG V*
```

Computer analysis of this amino acid sequence gave the following results:
Homology with a Predicted ORF from *N. meningitidis* ORF 748 shows 99.0% identity over a 421 aa overlap with a predicted ORF (ORF 748) from *N. meningitidis*:

```
    a748/m748      99.0% identity in 421 aa overlap 10         20         30         40         50         60
        a748.pep  MSKNQPAQPTRRTLFKTAIAAGAVGAIGGYLGGKKRGETAERTAESQHSPQAYPCYGEHQ
                  |||:||||||||||||||||||||||||||||||||:|||||||||||||||||||||||
        m748      MSKKQPAQPTRRTLFKTAIAAGAVGAIGGYLGGKKQGETAERTAESQHSPQAYPCYGEHQ
                      10         20         30         40         50         60

70         80         90        100        110        120
        a748.pep  AGIVTPQQAFSIMCAFDVTAQSAKQLENLFRTLTARIEFLTQGGEYQDGDDKLPPAGSGI
                  ||||||||||||||||||||||||||||||||||||||||||||||||||||||||||||
        m748      AGIVTPQQAFSIMCAFDVTAQSAKQLENLFRTLTARIEFLTQGGEYQDGDDKLPPAGSGI
                      70         80         90        100        110        120

130        140        150        160        170        180
        a748.pep  LGKAFNPDGLTVTVGVGSSLFDGRFGLKDKKPIHLQEMEDFSNDKLQKSWCDGDLSLQIC
                  ||||||||||||||||||||||||||||||||||||||:|||||||||||||||||||||
        m748      LGKAFNPDGLTVTVGVGSSLFDGRFGLKDKKPIHLQEMRDFSNDKLQKSWCDGDLSLQIC
                     130        140        150        160        170        180

190        200        210        220        230        240
        a748.pep  AFTPETCQAALRDIIKHTVQTAVIRWSIDGWQPKSEPGAMAARNLLGFRDGTGNPKVSDP
                  ||||||||||||||||||||||||||||||||||||||||||||||||||||||||||||
        m748      AFTPETCQAALRDIIKHTVQTAVIRWSIDGWQPKSEPGAMAARNLLGFRDGTGNPKVSDP
                     190        200        210        220        230        240

250        260        270        280        290        300
        a748.pep  KTADEVLWTGVAANSLDEPEWAKNGSYQAVRLIRHFVEFWDRTPLQEQTDIFGRRKYSGA
                  ||||||||||||||||||||||||||||||||||||||||||||||||||||||||||||
        m748      KTADEVLWTGVAANSLDEPEWAKNGSYQAVRLIRHFVEFWDRTPLQEQTDIFGRRKYSGA
                     250        260        270        280        290        300

310        320        330        340        350        360
        a748.pep  PMDGKKEADQPDFAKDPEGNTTPKDSHIRLANPRDPEFLKKHRLFRRAYSYSRGLASSGQ
                  |||||||||||||||||||:||||||||||||||||||||||||||||||||||||||||
        m748      PMDGKKEADQPDFAKDPEGDITPKDSHIRLANPRDPEFLKKHRLFRRAYSYSRGLASSGQ
                     310        320        330        340        350        360

370        380        390        400        410        420
        a748.pep  LDVGLVFVCYQANLADGFIFVQNLLNGEPLEEYISPFGGGYFFVLPGVEKGGFLGQGLLG
                  ||||||||||||||||||||||||||||||||||||||||||||||||||||||||||||
        m748      LDVGLVFVCYQANLADGFIFVQNLLNGEPLEEYISPFGGGYFFVLPGVEKGGFLGQGLLG
                     370        380        390        400        410        420 a748.pep  VX
                  ||
        m748      VX
```

The following partial DNA sequence was identified in *N. gonorrhoeae* <SEQ ID 2567>:

```
g749.seq
    1 ATGAGAAAAT TCAATTTGAC CGCATTGTCC GTGATGCTTG CCTTGGGTTT

51 GACCGCGTGC CAGCCGCCGG AGGCGGAGAA AGCCGCGCCG GCCGCGTCCG

101 GTGAGACCCA ATCCGCCAAC GAAGGCGGTT CGGTCGGTAT CGCCGTCAAC

151 GACAATGCCT GCGAACCGAT GAATCTGACC GTGCCGAGCG GACAGGTTGT

201 GTTCAATATT AAAAACAACA GCGGCCGCAA GCTCGAATGG GAAATCCTGA

251 AGGGCGTGAT GGTGGTGGAC GAACGCGAAA ATATCGCCCC GGGGCTTTCC

301 GACAAAATGA CCGTAAccct GCTGCCGGGC GAATACGAAA TGACCTGCGG

351 CCTTTTGACC AATCCGCGCG GCAAGCTGGT GGTAGCCGAC AGCGGCTTTA

401 AAGACACCGC CAACGAAGCG GATTTGGAAA AACTGCCCCA ACCGCTCGCC

451 GACTATAAAG CCTACGTTCA AGGCGAGGTT AAAGAGCTGG CGGCGAAAAC

501 CAAAACCTTT ACCGAAGCCG TCAAAGCAGG CGACATTGAA AAGGCGAAAT

551 CCCTGTTTGC CGCCACCCGC GTCCATTACG AACGCATCGA ACCGATTGCC

601 GAGCTTTTCA GCGAACTCGA CCCCGTCATC GATGCGTGTG AAGACGACTT

651 CAAAGACGGT GCGAAAGATG CCGGGTTTAC CGGCTTCCAC CGTATCGAAC

701 ACGCCCTTTG GGTGGAAAAA GACGTATCCG GCGTGAAGGA AACCGCGGCC

751 AAACTGATGA CCGATGTCGA AGCCCTGCAA AAAGAAATCG ACGCATTGGC

801 GttccctCCG GCAAAGTGG TCGGCGGCGC GTCCGAACTG ATTGAAGAAG

851 CGGCGGGCAG TAAAATCAGC GGCGAAGAAG ACCgttaCAG CCACACCGAT

901 TTGAGCGACT TCCAAGCTAA TGCGGACGGA TCTAAAAAAA TCGTCGATTT

951 GTTCCGTCCG TTGATTGAGG CCAAAAACAA AGCCTTGTTG GAAAAAACCG

1001 ATACCAACTT CAAACAGGTC AACGAAATTC TGGCGAAATA CCGCACCAAA

1051 GACGGTTTTG AAACCTACGA CAAGCTGAGC GAAGCCGACC GCAAAGCATT

1101 ACAGGCTCCT ATTAACGCGC TTGCCGAAGA CCTTGCCCAA CTTCGCGGCA

1151 TACTCGGCTT GAAATAA
```

This corresponds to the amino acid sequence <SEQ ID 2568; ORF 749.ng>:

```
g749.pep
    1 MRKFNLTALS VMLALGLTAC QPPEAEKAAP AASGETQSAN EGGSVGIAVN

51 DNACEPMNLT VPSGQVVFNI KNNSGRKLEW EILKGVMVVD ERENIAPGLS

101 DKMTVTLLPG EYEMTCGLLT NPRGKLVVAD SGFKDTANEA DLEKLPQPLA

151 DYKAYVQGEV KELAAKTKTF TEAVKAGDIE KAKSLFAATR VHYERIEPIA

201 ELFSELDPVI DACEDDFKDG AKDAGFTGFH RIEHALWVEK DVSGVKETAA

251 KLMTDVEALQ KEIDALAFPP GKVVGGASEL IEEAAGSKIS GEEDRYSHTD

301 LSDFQANADG SKKIVDLFRP LIEAKNKALL EKTDTNFKQV NEILAKYRTK

351 DGFETYDKLS EADRKALQAP INALAEDLAQ LRGILGLK*
```

The following partial DNA sequence was identified in *N. meningitidis* <SEQ ID 2569>:

```
m749.seq
    1 ATGAGAAAAT T

Computer analysis of this amino acid sequence gave the following results:

Homology with a Predicted ORF from *N. gonorrhoeae*
ORF 749 shows 96.1% identity over a 388 aa overlap with a predicted ORF (ORF 749) from *N. gonorrhoeae*

```
m749/g749    96.1% identity in 388 aa overlap 10        20        30        40        50        60
    m749.pep  MRKFNLTALSVMLALGLTACQPPEAEKAAPAASGEAQTANEGGSVSIAVNDNACEPMELT
              ||||||||||||||||||||||||||||||||:|:||||||:||||||||||||||:||
    g749      MRKFNLTALSVMLALGLTACQPPEAEKAAPAASGETQSANEGGSVGIAVNDNACEPMNLT
                    10        20        30        40        50        60

70        80        90       100       110       120
    m749.pep  VPSGQVVFNIKNNSGRKLEWEILKGVMVVDERENIAPGLSDKMTVTLLPGEYEMTCGLLT
              ||||||||||||||||||||||||||||||||||||||||||||||||||||||||||||
    g749      VPSGQVVFNIKNNSGRKLEWEILKGVMVVDERENIAPGLSDKMTVTLLPGEYEMTCGLLT
                    70        80        90       100       110       120

130       140       150       160       170       180
    m749.pep  NPRGKLVVTDSGFKDTANEADLEKLSQPLADYKAYVQGEVKELVAKTKTFTEAVKAGDIE
              ||||||||:||||||||||||||||| |||||||||||||||:|||||||||||||||||
    g749      NPRGKLVVADSGFKDTANEADLEKLPQPLADYKAYVQGEVKELAAKTKTFTEAVKAGDIE
                   130       140       150       160       170       180

190       200       210       220       230       240
    m749.pep  KAKSLFADTRVHYERIEPIAELFSELDPVIDAREDDFKDGAKDAGFTGFHRIEYALWVEK
              |||||||  ||||||||||||||||||||||||  ||||||||||||||||||:||||||
    g749      KAKSLFAATRVHYERIEPIAELFSELDPVIDACEDDFKDGAKDAGFTGFHRIEHALWVEK
                   190       200       210       220       230       240

250       260       270       280       290       300
    m749.pep  DVSGVKEIAAKLMTDVEALQKEIDALAFPPGKVVGGASELIEEVAGSKISGEEDRYSHTD
              |||||||:||||||||||||||||||||||||||||||||||||:|||||||||||||||
    g749      DVSGVKETAAKLMTDVEALQKEIDALAFPPGKVVGGASELIEEAAGSKISGEEDRYSHTD
                   250       260       270       280       290       300

310       320       330       340       350       360
    m749.pep  LSDFQANVDGSKKIVDLFRPLIEAKNKALLEKTDTNFKQVNEILAKYRTKDGFETYDKLG
              ||||||||:|||||||||||||||||||||||||||||||||||||||||||||||||||:
    g749      LSDFQANADGSKKIVDLFRPLIEAKNKALLEKTDTNFKQVNEILAKYRTKDGFETYDKLS
                   310       320       330       340       350       360

370       380       389
    m749.pep  EADRKALQASINALAEDLAQLRGILGLKX
              |||||||||| |||||||||||||||||||
    g749      EADRKALQAPINALAEDLAQLRGILGLKX
                   370       380
```

The following partial DNA sequence was identified in *N. meningitidis* <SEQ ID 2571>:

```
a749.seq
    1 ATGAGAAAAT TCAATTTGAC CGCATTGTCC GTGATGCTTG CCTTAGGTTT

51 GACCGCGTGC CAGCCGCCGG AGGCGGAGAA AGCTGCGCCG GCAGCGTCCG

101 GTGAGGCGCA AACCGCCAAC GAGGGCGGTT CGGTCAGTAT CGCCGTCAAC

151 GACAATGCCT GCGAACCGAT GGAACTGACC GTGCCGAGCG GACAGGTTGT

201 GTTCAATATT AAAAACAACA GCGGCCGCAA GCTCGAATGG GAAATCCTGA

251 AAGGCGTGAT GGTGGTGGAC GAGCGCGAAA ACATCGCCCC CGGACTTTCC

301 GATAAAATGA CCGTCACCCT GTTGCCGGGC GAATACGAAA TGACTTGCGG

351 TCTTTTGACC AATCCGCGCG GCAAGCTGGT GGTAACCGAC AGCGGCTTTA

401 AAGACACCGC CAACGAAGCG GATTTGGAAA AACTGTCCCA ACCGCTCGCC

451 GACTATAAAG CCTATGTTCA AGGCGAAGTC AAAGAGCTGG TGGCGAAAAC

501 CAAAACCTTT ACCGAAGCCG TCAAAGCAGG CGACATTGAA AAGGCGAAAT

551 CCCTGTTTGC CGACACCCGC GTCCATTACG AACGCATCGA ACCGATTGCC

601 GAGCTTTTCA GCGAACTCGA CCCCGTCATC GATGCGCGTG AAGACGACTT

651 CAAAGACGGC GCGAAAGATG CCGGATTTAC CGGCTTCCAC CGTATCGAAT
```

```
 701 ACGCCCTTTG GGTGGAAAAA GACGTGTCCG GCGTGAAGGA AATTGCAGCG

751 AAACTGATGA CCGATGTCGA AGCCCTGCAA AAAGAAATCG ACGCATTGGC

801 GTTTCCTCCG GGCAAGGTGG TCGGCGGCGC GTCCGAACTG ATTGAAGAAG

851 TGGCGGGCAG TAAAATCAGC GGCGAAGAAG ACCGGTACAG CCACACCGAT

901 TTGAGCGACT TCCAAGCCAA TGTGGACGGA TCGAAAAAAA TCGTCGATTT

951 GTTCCGTCCG TTGATCGAGA CCAAAAACAA AGCCTTGTTG GAAAAAACCG

1001 ATACCAACTT CAAACAGGTC AACGAAATTC TGGCGAAATA CCGGACTAAA

1051 GACGGTTTTG AAACCTACGA CAAGCTGGGC GAAGCCGACC GCAAAGCGTT

1101 ACAGGCCTCT ATTAACGCGC TTGCCGAAGA CCTTGCCCAA CTTCGCGGCA

1151 TACTCGGCTT GAAATAA
```

This corresponds to the amino acid sequence <SEQ ID 2572; ORF 749.a>:

```
a749.pep
  1 MRKFNLTALS VMLALGLTAC QPPEAEKAAP AASGEAQTAN EGGSVSIAVN

51 DNACEPMELT VPSGQVVFNI KNNSGRKLEW EILKGVMVVD ERENIAPGLS

101 DKMTVTLLPG EYEMTCGLLT NPRGKLVVTD SGFKDTANEA DLEKLSQPLA

151 DYKAYVQGEV KELVAKTKTF TEAVKAGDIE KAKSLFADTR VHYERIEPIA

201 ELFSELDPVI DAREDDFKDG AKDAGFTGFH RIEYALWVEK DVSGVKEIAA

251 KLMTDVEALQ KEIDALAFPP GKVVGGASEL IEEVAGSKIS GEEDRYSHTD

301 LSDFQANVDG SKKIVDLFRP LIETKNKALL EKTDTNFKQV NEILAKYRTK

351 DGFETYDKLG EADRKALQAS INALAEDLAQ LRGILGLK*
```

Computer analysis of this amino acid sequence gave the following results:
Homology with a Predicted ORF from *N. meningitidis* ORF 749 shows 99.7% identity over a 388 aa overlap with a predicted ORF (ORF 749) from *N. meningitidis*:

```
   a749/m749  99.7% identity in 388 aa overlap 10         20         30         40         50         60
   a749.pep  MRKFNLTALSVMLALGLTACQPPEAEKAAPAASGEAQTANEGGSVSIAVNDNACEPMELT
             ||||||||||||||||||||||||||||||||||||||||||||||||||||||||||||
   m749      MRKFNLTALSVMLALGLTACQPPEAEKAAPAASGEAQTANEGGSVSIAVNDNACEPMELT
                    10         20         30         40         50         60

70         80         90        100        110        120
   a749.pep  VPSGQVVFNIKNNSGRKLEWEILKGVMVVDERENIAPGLSDKMTVTLLPGEYEMTCGLLT
             ||||||||||||||||||||||||||||||||||||||||||||||||||||||||||||
   m749      VPSGQVVFNIKNNSGRKLEWEILKGVMVVDERENIAPGLSDKMTVTLLPGEYEMTCGLLT
                    70         80         90        100        110        120

130        140        150        160        170        180
   a749.pep  NPRGKLVVTDSGFKDTANEADLEKLSQPLADYKAYVQGEVKELVAKTKTFTEAVKAGDIE
             |||||||||||||||||||||||||||||||||| |||||||||||||||||||||||||
   m749      NPRGKLVVTDSGFKDTANEADLEKLSQPLADYDAYVQGEVKELVAKTKTFTEAVKAGDIE
                   130        140        150        160        170        180

190        200        210        220        230        240
   a749.pep  KAKSLFADTRVHYERIEPIAELFSELDPVIDAREDDFKDGAKDAGFTGFHRIEYALWVEK
             ||||||||||||||||||||||||||||||||||||||||||||||||||||||||||||
   m749      KAKSLFADTRVHYERIEPIAELFSELDPVIDAREDDFKDGAKDAGFTGFHRIEYALWVEK
                   190        200        210        220        230        240

250        260        270        280        290        300
   a749.pep  DVSGVKEIAAKLMTDVEALQKEIDALAFPPGKVVGGASELIEEVAGSKISGEEDRYSHTD
             ||||||||||||||||||||||||||||||||||||||||||||||||||||||||||||
   m749      DVSGVKEIAAKLMTDVEALQKEIDALAFPPGKVVGGASELIEEVAGSKISGEEDRYSHTD
                   250        260        270        280        290        300
```

```
                  310        320        330        340        350        360
a749.pep    LSDFQANVDGSKKIVDLFRPLIETKNKALLEKTDTNFKQVNEILAKYRTKDGFETYDKLG
            ||||||||||||||||||||||||:|||||||||||||||||||||||||||||||||||
m749        LSDFQANVDGSKKIVDLFRPLIEAKNKALLEKTDTNFKQVNEILAKYRTKDGFETYDKLG
                  310        320        330        340        350        360

370        380    389
a749.pep    EADRKALQASINALAEDLAQLRGILGLKX
            |||||||||||||||||||||||||||||
m749        EADRKALQASINALAEDLAQLRGILGLKX
                  370        380
```

The following partial DNA sequence was identified in *N. gonorrhoeae* <SEQ ID 2573>:

```
g750.seq
   1 GTGAAACCGC GTTTTTATTG GGCAGcctGC GCCGTCCTGC CGGCCGCCTG

51 TTCGCCCGAA CCTGCCGCCG AAAAAACTGT ATccgCCGCA TCCCAAGCCG

101 CATCCACACC TGTCGCCACG CTGACCGTGC CGACCGCGCG GGGCGATGCC

151 GTTGTGCCGA AGAATCCCGA ACgcgtcgcc gtgtAcgaCt ggGCGGCGTt 201 ggaTACGCTG ACCGAGCCGG GCGTGAATGT GGGCGCAACC ACCGCGCCGG

251 TGCGCGTGGA CTATTTGCAG CCTGCATTTG ACAAGGCGGC AACGGTGGGG

301 ACGCTGTTTG AGCCCGATTG CGAATCCCTG CACCGCCACA ATCCGCAGTT

351 TGTCATTACC GGCGGGCCGG GTGCGGAAGC GTATGAACAG TTGGCGAAAA

401 ACGCGACCAC CATAGATTTG ACGGTGGACA ACGGCAATAT CCGCACCAGC

451 GGCGAGAAGC AGATGGAGAC CCTGTCGCGG ATTTTCGGTA AGGAAGCGCG

501 CGTGGCGGAA TTGAATGCGC AGATTGACGC GCTGTTCGCC CAAAAGCGCG

551 AAGCCGCCAA AGGCAAAGGA CGCGGGCTGG TGCTGTCGGT TACAGGCAAC

601 AAGGTGTCCG CCTTCGGCAC GCAATCGCGG TTGGCAAGTT GGATACACGG

651 CGACATCGGC CTGCCGCCCG TGGACGAATC TTTACGCAAC GAAGGGCACG

701 GGCAGCCCGT TTCCTTCGAA TACATCAAAG AGAAAAACCC CGGCTGGATT

751 TTCATCATCG ACCGCACCGC CGCCATCGGG CAGGAAGGGC CGGCTGCCGT

801 GGAAGTGTTG GATAACGCGC TGGTATGCGG CACGAACGCT TGGAAGCGCA

851 AGCAAATCAT CGTCATGCCT GCCGCGAACT ACATTGTCGC GGGCGGCGCG

901 CGGCAGTTGA TACAGGCGGC GGAACAGTTG AAGGCGGCGT TTGAAAAGGC

951 AGAACCCGTT GCGGCGCAGT AG
```

This corresponds to the amino acid sequence <SEQ ID 2574; ORF 750.ng>:

```
g750.pep
   1 VKPRFYWAAC AVLPAACSPE PAAEKTVSAA SQAASTPVAT LTVPTARGDA

51 VVPKNPERVA VYDWAALDTL TEPGVNVGAT TAPVRVDYLQ PAFDKAATVG

101 TLFEPDCESL HRHNPQFVIT GGPGAEAYEQ LAKNATTIDL TVDNGNIRTS

151 GEKQMETLSR IFGKEARVAE LNAQIDALFA QKREAAKGKG RGLVLSVTGN

201 KVSAFGTQSR LASWIHGDIG LPPVDESLRN EGHGQPVSFE YIKEKNPGWI

251 FIIDRTAAIG QEGPAAVEVL DNALVCGTNA WKRKQIIVMP AANYIVAGGA

301 RQLIQAAEQL KAAFEKAEPV AAQ*
```

The following partial DNA sequence was identified in *N. meningitidis* <SEQ ID 2575>:

```
m750.seq
    1 GTGAAACCGC GTTTTTATTG GGCAGCCTGC GCCGTCCTGC TGACCGCCTG

51 TTCGCCCGAA CCTGCCGCCG AAAAAACTGT ATCCGCCGCA TCCGCATCTG

101 CCGCCACGCT GACCGTGCCG ACCGCGCGGG GCGATGCCGT TGTGCCGAAG

151 AATCCCGAAC GCGTCGCCGT GTACGACTGG GCGGCGTTGG ATACGCTGAC

201 CGAATTGGGC GTGAATGTGG GCGCAACCAC CGCGCCGGTG CGCGTGGATT

251 ATTTGCAGCC TGCATTTGAC AAGGCGGCAA CGGTGGGGAC GCTGTTCGAG

301 CCCGATTACG AAGCCCTGCA CCGCTACAAT CCTCAGCTTG TCATTACCGG

351 CGGGCCGGGC GCGGAAGCGT ATGAACAGTT AGCGAAAAAC GCGACCACCA

401 TAGATCTGAC GGTGGACAAC GGCAATATCC GCACCAGCGG CGAAAAGCAG

451 ATGGAGACCT TGGCGCGGAT TTTCGGCAAG AAGCGCGCG CGGCGGAATT

501 GAAGGCGCAG ATTGACGCGC TGTTCGCCCA AACGCGCGAA GCCGCCAAAG

551 GCAAAGGACG CGGGCTGGTG CTGTCGGTTA CGGGCAACAA GGTGTCCGCC

601 TTCGGCACGC AGTCGCGGTT GGCAAGTTGG ATACACGGCG ACATCGGCCT

651 ACCGCCTGTA GACGAATCTT TACGCAACGA GGGGCACGGG CAGCCTGTTT

701 CCTTCGAATA CATCAAAGAG AAAAACCCCG ATTGGATTTT CATCATCGAC

751 CGTACCGCCG CCATCGGGCA GGAAGGGCCG GCGGCTGTCG AAGTATTGGA

801 TAACGCGCTG GTACGCGGCA CGAACGCTTG GAAGCGCAAG CAAATCATCG

851 TCATGCCTGC CGCGAACTAC ATTGTCGCGG GCGGCGCGCG GCAGTTGATT

901 CAGGCGGCGG AGCAGTTGAA GGCGGCGTTT AAAAAGGCAG AACCCGTTGC

951 GGCGGGGAAA AAGTAG
```

This corresponds to the amino acid sequence <SEQ ID 2576; ORF 750>:

```
m750.pep
    1 VKPRFYWAAC AVLLTACSPE PAAEKTVSAA SASAATLTVP TARGDAVVPK

51 NPERVAVYDW AALDTLTELG VNVGATTAPV RVDYLQPAFD KAATVGTLFE

101 PDYEALHRYN PQLVITGGPG AEAYEQLAKN ATTIDLTVDN GNIRTSGEKQ

151 METLARIFGK EARAAELKAQ IDALFAQTRE AAKGKGRGLV LSVTGNKVSA

201 FGTQSRLASW IHGDIGLPPV DESLRNEGHG QPVSFEYIKE KNPDWIFIID

251 RTAAIGQEGP AAVEVLDNAL VRGTNAWKRK QIIVMPAANY IVAGGARQLI

301 QAAEQLKAAF KKAEPVAAGK K*
```

Computer analysis of this amino acid sequence gave the following results:
Homology with a Predicted ORF from *N. gonorrhoeae*
ORF 750 shows 93.8% identity over a 322 aa overlap with a predicted ORF (ORF 750) from *N. gonorrhoeae*

```
    m750/g750   93.8% identity in 322 aa overlap 10        20        30        40        50
       m750.pep     VKPRFYWAACAVLLTACSPEPAAEKTVSAASASA----ATLTVPTARGDAVVPKNPERVA
                    ||||||||||:||||||||||||||||||:|    ||||||||||||||||||||
       g750         VKPRFYWAACAVLPAACSPEPAAEKTVSAASQAASTPVATLTVPTARGDAVVPKNPERVA
                        10        20        30        40        50        60
```

-continued

```
                 60         70         80         90        100        110
m750.pep   VYDWAALDTLTELGVNVGATTAPVRVDYLQPAFDKAATVGTLFEPDYEALHRYNPQLVIT
           ||||||||||||| |||||||||||||||||||||||||||||| :|| :|||:|||
g750       VYDWAALDTLTEPGVNVGATTAPVRVDYLQPAFDKAATVGTLFEPDCESLHRHNPQFVIT
                 70         80         90        100        110        120

120        130        140        150        160        170
m750.pep   GGPGAEAYEQLAKNATTIDLTVDNGNIRTSGEKQMETLARIFGKEARAAELKAQIDALFA
           ||||||||||||||||||||||||||||||||||||||:||||||| :|||:||||||||
g750       GGPGAEAYEQLAKNATTIDLTVDNGNIRTSGEKQMETLSRIFGKEARVAELNAQIDALFA
                130        140        150        160        170        180

180        190        200        210        220        230
m750.pep   QTREAAKGKGRGLVLSVTGNKVSAFGTQSRLASWIHGDIGLPPVDESLRNEGHGQPVSFE
           | |||||||||||||||||||||||||||||||||||||||||||||||||||||||||
g750       QKREAAKGKGRGLVLSVTGNKVSAFGTQSRLASWIHGDIGLPPVDESLRNEGHGQPVSFE
                190        200        210        220        230        240

240        250        260        270        280        290
m750.pep   YIKEKNPDWIFIIDRTAAIGQEGPAAVEVLDNALVRGTNAWKRKQIIVMPAANYIVAGGA
           ||||||| |||||||||||||||||||||||||||| ||||||||||||||||||||||
g750       YIKEKNPGWIFIIDRTAAIGQEGPAAVEVLDNALVCGTNAWKRKQIIVMPAANYIVAGGA
                250        260        270        280        290        300

300        310        320
m750.pep   RQLIQAAEQLKAAFKKAEPVAAGKKX
           ||||||||||||||||| |||||| |
g750       RQLIQAAEQLKAAFEKAEPVAAQX
                310        320
```

The following partial DNA sequence was identified in *N. meningitidis* <SEQ ID 2577>:

```
a750.seq
   1 GTGAAACCGC GTTTTTATTG GGCAGCCTGC GCCGTCCTGC TGACCGCCTG

51 TTCGCCCGAA CCTGCCGCCG AAAAAACTGT ATCCGCCGCA TCCGCATCTG

101 CCGCCACACT GACCGTGCCG ACCGCGCGGG GCGATGCCGT TGTGCCGAAG

151 AATCCCGAAC GCGTCGCCGT GTACGACTGG GCGGCGTTGG ATACGCTGAC

201 CGAATTGGGT GTGAATGTGG GCGCAACCAC CGCGCCGGTG CGCGTGGATT

251 ATTTGCAGCC TGCATTTGAC AAGGCGGCAA CGGTGGGGAC GCTGTTCGAG

301 CCCGATTACG AAGCCCTGCA CCGCTACAAT CCTCAGCTTG TCATTACCGG

351 CGGGCCGGGC GCGGAAGCGT ATGAACAGTT GGCGAAAAAC GCGACCACCA

401 TAGATCTGAC GGTGGACAAC GGCAATATCC GCACCAGCGG CGAAAAGCAG

451 ATGGAGACCT TGGCGCGGAT TTTCGGCAAG GAAGCGCGCG CGGCGGAATT

501 GAAGGCGCAG ATTGACGCGC TGTTCGCCCA AACGCGCGAA GCCGCCAAAG

551 GCAAAGGACG CGGGCTGGTG CTGTCGGTTA CGGGCAACAA GGTGTCCGCC

601 TTCGGCACGC AGTCGCGGTT GGCAAGTTGG ATACACGGCG ACATCGGCCT

651 ACCGCCTGTA GACGAATCTT TACGCAACGA GGGGCACGGG CAGCCTGTTT

701 CCTTCGAATA CATCAAAGAG AAAAACCCCG ATTGGATTTT CATCATCGAC

751 CGTACCGCCG CCATCGGGCA GGAAGGGCCG GCGGCTGTCG AAGTATTGGA

801 TAACGCGCTG GTACGCGGCA CGAACGCTTG GAAGCGCAAG CAAATCATCG

851 TCATGCCTGC CGCGAACTAC ATTGTCGCGG CGGCTCGCG GCAGTTGATT

901 CAGGCGGCGG AGCAGTTGAA GGAGGCGTTT GAAAAGGCAG AACCCGTTGC

951 GGCGGGGAAA GAGTAG
```

This corresponds to the amino acid sequence <SEQ ID 2578; ORF 750.a>:

```
a750.pep
   1 VKPRFYWAAC AVLLTACSPE PAAEKTVSAA SASAATLTVP TARGDAVVPK

51 NPERVAVYDW AALDTLTELG VNVGATTAPV RVDYLQPAFD KAATVGTLFE
```

-continued

```
101 PDYEALHRYN PQLVITGGPG AEAYEQLAKN ATTIDLTVDN GNIRTSGEKQ

151 METLARIFGK EARAAELKAQ IDALFAQTRE AAKGKGRGLV LSVTGNKVSA

201 FGTQSRLASW IHGDIGLPPV DESLRNEGHG QPVSFEYIKE KNPDWIFIID

251 RTAAIGQEGP AAVEVLDNAL VRGTNAWKRK QIIVMPAANY IVAGGSRQLI

301 QAAEQLKEAF EKAEPVAAGK E*
```

Computer analysis of this amino acid sequence gave the following results:
Homology with a Predicted ORF from N. meningitidis
ORF 750 shows 98.8% identity over a 321 aa overlap with a predicted ORF (ORF 750) from N. meningitidis:

```
    a750/m750   93.8% identity in 321 aa overlap 10        20        30        40        50        60
        a750.pep   VKPRFYWAACAVLLTACSPEPAAEKTVSAASASAATLTVPTARGDAVVPKNPERVAVYDW
                   ||||||||||||||||||||||||||||||||||||||||||||||||||||||||||||
        m750       VKPRFYWAACAVLLTACSPEPAAEKTVSAASASAATLTVPTARGDAVVPKNPERVAVYDW
                       10        20        30        40        50        60

70        80        90       100       110       120
        a750.pep   AALDTLTELGVNVGATTAPVRVDYLQPAFDKAATVGTLFEPDYEALHRYNPQLVITGGPG
                   ||||||||||||||||||||||||||||||||||||||||||||||||||||||||||||
        m750       AALDTLTELGVNVGATTAPVRVDYLQPAFDKAATVGTLFEPDYEALHRYNPQLVITGGPG
                       70        80        90       100       110       120

130       140       150       160       170       180
        a750.pep   AEAYEQLAKNATTIDLTVDNGNIRTSGEKQMETLARIFGKEARAAELKAQIDALFAQTRE
                   ||||||||||||||||||||||||||||||||||||||||||||||||||||||||||||
        m750       AEAYEQLAKNATTIDLTVDNGNIRTSGEKQMETLARIFGKEARAAELKAQIDALFAQTRE
                      130       140       150       160       170       180

190       200       210       220       230       240
        a750.pep   AAKGKGRGLVLSVTGNKVSAFGTQSRLASWIHGDIGLPPVDESLRNEGHGQPVSFEYIKE
                   ||||||||||||||||||||||||||||||||||||||||||||||||||||||||||||
        m750       AAKGKGRGLVLSVTGNKVSAFGTQSRLASWIHGDIGLPPVDESLRNEGHGQPVSFEYIKE
                      190       200       210       220       230       240

240       250       260       270       280       290       300
        a750.pep   KNPDWIFIIDRTAAIGQEGPAAVEVLDNALVRGTNAWKRKQIIVMPAANYIVAGGSRQLI
                   |||||||||||||||||||||||||||||||||||||||||||||||||||||||:||||
        m750       KNPDWIFIIDRTAAIGQEGPAAVEVLDNALVRGTNAWKRKQIIVMPAANYIVAGGARQLI
                      250       260       270       280       290       300

310       320
        a750.pep   QAAEQLKEAFEKAEPVAAGKEX
                   ||||||||:|||||||||||:|
        m750       QAAEQLKAAFKKAEPVAAGKKX
                      310       320 g751.seq   not found yet g751.pep   not found yet
```

The following partial DNA sequence was identified in N. meningitidis <SEQ ID 2579>:

```
m751.seq..
    1 ATGGCTTGGA GTATGTTTGC CACAACCCAA GCCGATAGAG CGGTAAGGTC

51 TGCAACTGCA CCTAAAGAAA TGTGGTTCCA TAAGAAGATA ATAGATGAAA

101 AAACAGGTAA AGTATCCTTT GATACCAGAC AAATTTGGTC ATTGAATGAT

151 TTAAGCAAGG AAGAACTGGC AAGCATTCAA GACACAAATG GCAAAGTTAT

201 TACTGTGTCT AATCCTGGTA TTTTCAATAA TCGAGAAGAT TCATTAAGCA

251 ACGCAGCAAA ACAAAATCGT AATAGTACAA ACGGTAGTGG TGTTATTGCA

301 GTCATGAATC CTCCAACAGG GAAATATAAA TCTGATTCTA ATAACAAAAT

351 AAAAGATTTT TTATGGCTCG GTTCAAGTCT TGTTTCTGAA CTGATGTATG

401 TCGGTTACGA CCAATTAAAT AATAAAGTGT TCCAAGGCTA TTTACCCAAA
```

-continued

```
 451 ACCAATTCAG AAAAACTGAA TCAAGATATT TATCGAGAGG TTCAAAAAAT

501 GGGTAACGGC TGGTCGGTTG ATACCAGTAA TCACAGTCGT GGGGGAATTA

551 CAGCAAGCGT TTCCTTAAAA GATTGGGTAA ACAATCAAAA ACAAAATGGC

601 ATTGCCCCAA TCAGAAAAGC ACGTTTCTAT GGTACAGCCA CAAATGTGCA

651 GAATGATTAC GCCGATGTTT TACAGAAAAA CGGCTATACC TATACGGGTG

701 CAGACGGCAA AACTTATAAC AGCGGATCCT ACTCAATCGT GCATGATAAA

751 GATTTTGTGG GGAACAAATG GATACCTTTC TTGCTAGGAA CCAATGACAC

801 CACACAAGGT ACATGTAAGG GGTTGTGCTA TTCGCATAGC AGTTATTTTG

851 CGGAGGTGCC AAAAGCAGGT ACAAAAGAAT TTGATGACTA TGTAAAAATA

901 TGGGGTGAAG TTGAATATGA CGCTCAAGGT AAGCCAATTA ACAAATCTAA

951 ACCCATACTG GTAGAACCAA ACAAAACAAA AGATAATGAA AAATATGAAA

1001 AAGAAGCTTT CTAA
```

This corresponds to the amino acid sequence <SEQ ID 2580; ORF 751>:

```
m751.pep..
   1 MAWSMFATTQ ADRAVRSATA PKEMWFHKKI IDEKTGKVSF DTRQIWSLND

51 LSKEELASIQ DTNGKVITVS NPGIFNNRED SLSNAAKQNR NSTNGSGVIA

101 VMNPPTGKYK SDSNNKIKDF LWLGSSLVSE LMYVGYDQLN NKVFQGYLPK

151 TNSEKLNQDI YREVQKMGNG WSVDTSNHSR GGITASVSLK DWVNNQKQNG

201 IAPIRKARFY GTATNVQNDY ADVLQKNGYT YTGADGKTYN SGSYSIVHDK

251 DFVGNKWIPF LLGTNDTTQG TCKGLCYSHS SYFAEVPKAG TKEFDDYVKI

301 WGEVEYDAQG KPINKSKPIL VEPNKTKDNE KYEKEAF* a751.seq not found yet
a751.pep not found yet g752.seq not found yet
g752.pep not found yet
```

The following partial DNA sequence was identified in *N. meningitidis* <SEQ ID 2581>:

```
m752.seq..
   1 ATGAAAATTT CCAGACCTCC GGAATTTACC CTGTTGCAAC AGGAATATAT

51 GCAGCATCTC ACTGAAAGAA TGACGCAAAT TGCCAAGCTG CTGAATTCTT

101 CCGCAAACAA TCCTGATATA GACATTCCCG ATTTTCTTAC TGAAATCAAA

151 GATTATTCAG AATTTTCCGT GACAGATGAA AATGGAACCT ACCTGCATTG

201 GGACAAATTC CGCCGGATTC ACACGGAAGA TACGCGGATG AAATGGCGCG

251 CCGTTAAGGA AAGCCGCAAA AAAATCCAAA AACCAATTGA TTTCCCGTTT

301 GAACATCAGT TTTGGTTCTG CATTCCCGAC TCTTTGCAGG CACGGCTTCA

351 TTTGATTGAC AAAAGCTGCG GCAGTTCTAT CGGCACGTCT AGCTTGGGTG

401 GCTTCGGCAG AAGCGAGCAA AACAGATTCT TGCTCAAGTC TCTGATTATG

451 GAAGAAGCGA TTACATCCGC CCAACTGGAA GGTGCGGCTA CCACGCGTAA

501 AGTGGCCAAG GATATGCTCA AATCGCAGCG TAAACCCAAA ACAAAAGACG

551 AAATCATGAT AGTGAACAAC TATCACTTGA TGAAAAAAGC GGTAGAATTG
```

```
 601 AAAAATACGC CGTTAAGTGT TGAAATGATT TTGGATTTGC ACCGCATTGC

651 TACCAGTAAC GCTATTGAAA ACAAGGCCGA GCCCGGACAA TTCAGGCAGG

701 ATGACGAAAT CTTTATCGCC GATATCAATG GTAACAGCCT GTATCAACCA

751 CCGCCGCACG GACAGGTTCA TACGCTGATG GAAGAGGTGT GTGCGTTTGC

801 CAATAATACC TATGACGGCG TGGAAAATCC GTTTATCCAT CCGGTTGTCC

851 AAGCTATTAT CTTGCATTTC CTCATCGGCT ACATCCACCC ATTTGGTGAT

901 GGCAACGGGC GGACAGCGCG GGCTTTGTTC TATTGGTTTA TGCTCAAAAA

951 CGGCTACTGG CTATTTGAAT ACATATCCAT CAGCCGTCTT CTGAAAAACG

1001 CTCCTGCCCA ATACGCCAAA TCCTATTTGT ATGCGGAAAC TGACGATTTA

1051 GATTTAACCT ATTTCATCTA TTACCAATGC GATATTATCA AGCGGGCGGT

1101 TGCCGATTTG GAGCACTACA TTTCCGACAA ACAAAAACAC CAACAGGAAT

1151 TCAAAGCAGC GATTGCCCAA TATACTGAAA AGATAGGAAA GTTGAACCAA

1201 CGGCAAATTG GTATCCTGCA AAAAGCAGTG GAAGAAAGCG GAAAAATCTT

1251 TACTGCACAA GAAATTGCCA ACCAATACGG CATCTCCCTG AATACTGCCC

1301 GTAGCGATTT GAGTAAACTG GGAGAATATA GATTCCTAGT GCCGTTCAAA

1351 TCAGGAAATG CTTTAGAGTA TGTTGCTCCT CAGGATTTAT TGGAAAGGTT

1401 AGAAAAAAAA TAG
```

This corresponds to the amino acid sequence <SEQ ID 2582; ORF 752>:

```
m752.pep
  1 MKISRPPEFT LLQQEYMQHL TERMTQIAKL LNSSANNPDI DIPDFLTEIK

51 DYSEFSVTDE NGTYLHWDKF RRIHTEDTRM KWRAVKESRK KIQKPIDFPF

101 EHQFWFCIPD SLQARLHLID KSCGSSIGTS SLGGFGRSEQ NRFLLKSLIM

151 EEAITSAQLE GAATTRKVAK DMLKSQRKPK TKDEIMIVNN YHLMKKAVEL

201 KNTPLSVEMI LDLHRIATSN AIENKAEPGQ FRQDDEIFIA DINGNSLYQP

251 PPHGQVHTLM EEVCAFANNT YDGVENPFIH PVVQAIILHF LIGYIHPFGD

301 GNGRTARALF YWFMLKNGYW LFEYISISRL LKNAPAQYAK SYLYAETDDL

351 DLTYFIYYQC DIIKRAVADL EHYISDKQKH QQEFKAAIAQ YTEKIGKLNQ

401 RQIGILQKAV EESGKIFTAQ EIANQYGISL NTARSDLSKL GEYRFLVPFK

451 SGNALEYVAP QDLLERLEKK *
```

The following partial DNA sequence was identified in *N. meningitidis* <SEQ ID 2583>:

```
m752-1.seq
    1 ATGAAAATTT CCAGACCTCC GGAATTTACC CTGTTGCAAC AGGAATATAT

51 GCAGCATCTC ACTGAAAGAA TGACGCAAAT TGCCAAGCTG CTGAATTCTT

101 CCGCAAACAA TCCTGATATA GACATTCCCG ATTTTCTTAC TGAAATCAAA

151 GATTATTCAG AATTTTCCGT GACAGATGAA AATGGAACCT ACCTGCATTG

201 GGACAAATTC CGCCGGATTC ACACGGAAGA TACGCGGATG AAATGGCGCG

251 CCGTTAAGGA AAGCCGCAAA AAAATCCAAA AACCAATTGA TTTCCCGTTT

301 GAACATCAGT TTTGGTTCTG CATTCCCGAC TCTTTGCAGG CACGGCTTCA
```

-continued

```
 351 TTTGATTGAC AAAAGCTGCG GCAGTTCTAT CGGCACGTCT AGCTTGGGTG

401 GCTTCGGCAG AAGCGAGCAA AACAGATTCT TGCTCAAGTC TCTGATTATG

451 GAAGAAGCGA TTACATCCGC CCAACTGGAA GGTGCGGCTA CCACGCGTAA

501 AGTGGCCAAG GATATGCTCA AATCGCAGCG TAAACCCAAA ACAAAAGACG

551 AAATCATGAT AGTGAACAAC TATCACTTGA TGAAAAAAGC GGTAGAATTG

601 AAAAATACGC CGTTAAGTGT TGAAATGATT TTGGATTTGC ACCGCATTGC

651 TACCAGTAAC GCTATTGAAA ACAAGGCCGA GCCCGGACAA TTCAGGCAGG

701 ATGACGAAAT CTTTATCGCC GATATCAATG GTAACAGCCT GTATCAACCA

751 CCGCCGCACG GACAGGTTCA TACGCTGATG AAGAGGTGT GTGCGTTTGC

801 CAATAATACC TATGACGGCG TGGAAAATCC GTTTATCCAT CCGGTTGTCC

851 AAGCTATTAT CTTGCATTTC CTCATCGGCT ACATCCACCC ATTTGGTGAT

901 GGCAACGGGC GGACAGCGCG GGCTTTGTTC TATTGGTTTA TGCTCAAAAA

951 CGGCTACTGG CTATTTGAAT ACATATCCAT CAGCCGTCTT CTGAAAAACG

1001 CTCCTGCCCA ATACGCCAAA TCCTATTTGT ATGCGGAAAC TGACGATTTA

1051 GATTTAACCT ATTTCATCTA TTACCAATGC GATATTATCA AGCGGGCGGT

1101 TGCCGATTTG GAGCACTACA TTTCCGACAA ACAAAAACAC CAACAGGAAT

1151 TCAAAGCAGC GATTGCCCAA TATACTGAAA AGATAGGAAA GTTGAACCAA

1201 CGGCAAATTG GTATCCTGCA AAAAGCAGTG GAAGAAAGCG GAAAAATCTT

1251 TACTGCACAA GAAATTGCCA ACCAATACGG CATCTCCCTG AATACTGCCC

1301 GTAGCGATTT GAGTAAACTG GGAGAATATA GATTCCTAGT GCCGTTCAAA

1351 TCAGGAAATG CTTTAGAGTA TGTTGCTCCT CAGGATTTAT TGGAAAGGTT

1401 AGAAAAAAAA TAG
```

This corresponds to the amino acid sequence <SEQ ID 2584; ORF 752-1>:

```
m752-1.pep
   1 MKISRPPEFT LLQQEYMQHL TERMTQIAKL LNSSANNPDI DIPDFLTEIK

51 DYSEFSVTDE NGTYLHWDKF RRIHTEDTRM KWRAVKESRK KIQKPIDFPF

101 EHQFWFCIPD SLQARLHLID KSCGSSIGTS SLGGFGRSEQ NRFLLKSLIM

151 EEAITSAQLE GAATTRKVAK DMLKSQRKPK TKDEIMIVNN YHLMKKAVEL

201 KNTPLSVEMI LDLHRIATSN AIENKAEPGQ FRQDDEIFIA DINGNSLYQP

251 PPHGQVHTLM EEVCAFANNT YDGVENPFIH PVVQAIILHF LIGYIHPFGD

301 GNGRTARALF YWFMLKNGYW LFEYISISRL LKNAPAQYAK SYLYAETDDL

351 DLTYFIYYQC DIIKRAVADL EHYISDKQKH QQEFKAAIAQ YTEKIGKLNQ

401 RQIGILQKAV EESGKIFTAQ EIANQYGISL NTARSDLSKL GEYRFLVPFK

451 SGNALEYVAP QDLLERLEKK * a752.seq not found yet
a752.pep not found yet g753.seq not found yet
g753.pep not found yet
```

The following partial DNA sequence was identified in *N. meningitidis* <SEQ ID 2585>:

```
m753.seq
   1 ATGCCCATCA CTCCACCCTT AAACATCATC TCTCCTAAAC TCTACCCCAA

51 TGAACAATGG AACGAAAGCG AAGCACTCGG TGCCATCACT TGGCTATGGT

101 ATCAGTCGCC TACGCATCGC CAAGTACCTA TTGTGGAGAT GATGACGTAT

151 ATATTGCCTG TGTTAAAAAA CGGGCAGTTC GCTTTGTTTT GCAAGGGTAC

201 CCAACCAATC GGTTATATCT CATGGGCTTA TTTTGATGAA GTGGCGCAGG

251 CGCATTATTT AGAATCTGAC CGCCATTTGC GTGACAACAG CGATTGGAAC

301 TGTGGCGACA ATATTTGGCT GATTCAATGG TTTGCGCCAT TGGGACACAG

351 TCATCAAATG CGCTCAGCTG TGCGCCAGTT ATTTCCTAGT ACGACAGTAC

401 GCGCCTTGTA TCATAAAGGG AGCGATAAGG GTTTGAGAAT TTTAACTTTT

451 AAAACTTGA
```

This corresponds to the amino acid sequence <SEQ ID 2586; ORF 753>:

```
m753.pep
   1 MPITPPLNII SPKLYPNEQW NESEALGAIT WLWYQSPTHR QVPIVEMMTY

51 ILPVLKNGQF ALFCKGTQPI GYISWAYFDE VAQAHYLESD RHLRDNSDWN

101 CGDNIWLIQW FAPLGHSHQM RSAVRQLFPS TTVRALYHKG SDKGLRILTF

151 KT* a753.seq not found yet
a753.pep not found yet g754.seq not found yet
g754.pep not found yet
```

The following partial DNA sequence was identified in *N. meningitidis* <SEQ ID 2587>:

```
m754.seq
    1  ATGATGAAGT CTATCCTCAC CGTATCCGGA AATCGTATGC GTAAACCCAG

51  AATCACCTAT TTGGATGTTT GGGCAAACGA TGAAAGAATC GGTACTTTGG

101  AAAAGGGGGC CATGTATCGG TTCGCATACG ACAATCCCAA TTCTTCGTTG

151  CTGGGCCTGC ATTATCAAGA CAGAAGCAAG GTATATATCA GCAACAATAT

201  GCCGCATATC TTTGCACAGT ATTTTCCGGA AGGCTTTTTG GATGCACACA

251  TCACAAGCAA ATATGCTTTT CATGATGCGC CTTTTGAAGA CAATGAGATG

301  CTGCGCTTGG CAATTCTGTG CAGAGAGACT TTGGGTCGGA TACATGTGCG

351  CTGTAATGAC CCGCTTTTTA ATGAATGGAT TGACGGGTTG GAGATGAAAA

401  ATCCAAGAAT ATTGACTGAA CGGGATTTGC TGGGCATAAA TGCCCGACAG

451  GTTTTTCAGC AATATATGGC AGAAATCTTC CATCACGGCC GTTTCGTCAG

501  TGTATCCGGG ATACAGCAGA AGATGTCCTT AGATGCCATC CGCAGAAATA

551  CCAAGCAAAC TGCCTCATAT ATTGCCAAAG GTTTTGATGC ATCCGAATAT

601  CCTTGCTTGG CTGCCAATGA ATTTTTATGC ATGCAGACCA TCAAACAAGC

651  CGGCATTGCC GTTGCACAGA CCAGCCTGTC GGAAGATTCA TCAGTCTTAT

701  TGGTACGTCG GTTTGATGTC AGTGAACAGG GTTATTTTTT AGGGATGGAA
```

-continued

```
 751 GACTTTACCA GTCTGCGCCA GTATTCGGTA GAAGATAAAT ATAAAGGCAG

801 TTATGCGGCT ATTGCACAGA TTATCCGACA GATATCCGGC AGACCAGATG

851 AAGATTTAAT CCATTTCTTT AATCAGCTTG CTGCCAGTTG CATATTGAAA

901 AACGGCGATG CACACCTCAA AAATTTTTCA GTACTCTATC ATGACGAATA

951 CGATGTTCGT CTTGCACCTG TCTATGATGT ATTGGATACA TCAATATACA

1001 GGGTTGGAAC ACAAGGAATT TTTGATGCTT ATGACGATAC GCTGGCATTA

1051 AACCTGACTA ACCACGGTAA GAAAACATAT CCTTCCAAGA ATACATTGTT

1101 GGATTTTGCT GAGAAATATT GCGATTTGGG AAGAGAAGAT GCATCCTTTA

1151 TGATAGATAC AATCGTTCAA GCTAAAGAAC AGGTTCTTGT TAAATACTCG

1201 GATGTATTGC GTGAGAATGA ATGGTTGGCG CAGAAGTGGC ATTTTATCCC

1251 GGATGAAAAT GAAGAAGGTC TACCGTTTAC ATTCCGGTAG
```

This corresponds to the amino acid sequence <SEQ ID 2588; ORF 754>:

```
m754.pep
   1 MMKSILTVSG NRMRKPRITY LDVWANDERI GTLEKGAMYR FAYDNPNSSL

51 LGLHYQDRSK VYISNNMPHI FAQYFPEGFL DAHITSKYAF HDAPFEDNEM

101 LRLAILCRET LGRIHVRCND PLFNEWIDGL EMKNPRILTE RDLLGINARQ

151 VFQQYMAEIF HHGRFVSVSG IQQKMSLDAI RRNTKQTASY IAKGFDASEY

201 PCLAANEFLC MQTIKQAGIA VAQTSLSEDS SVLLVRRFDV SEQGYFLGME

251 DFTSLRQYSV EDKYKGSYAA IAQIIRQISG RPDEDLIHFF NQLAASCILK

301 NGDAHLKNFS VLYHDEYDVR LAPVYDVLDT SIYRVGTQGI FDAYDDTLAL

351 NLTNHGKKTY PSKNTLLDFA EKYCDLGRED ASFMIDTIVQ AKEQVLVKYS

401 DVLRENEWLA QKWHFIPDEN EEGLPFTFR* a754.seq not found yet
a754.pep not found yet g755.seq not found yet
g755.pep not found yet
```

The following partial DNA sequence was identified in *N. meningitidis* <SEQ ID 2589>:

```
m755.seq..
   1 ATGAGCCGTT ACCTGATTAC CTTTGATATG GATACCAACT GCCTGAAAGA

51 CAATTACCAC GGAAATAACT ATACCAATGC CTACTCCGAT ATTAAAACCA

101 TCTTGGCTAG ACATGGATTT GAGAACATTC AGGGCAGTGT TTATCTAGGC

151 CGTGAAGGCA TCAGTGAAGC ACACGGAACA ATAGCCATTC AGGAACTGAC

201 CGCTCGGTTT GATTGGTTTT ACTCCTGTAT TTCAAACATT AAGTTTTACC

251 GCCTTGAAAG TGATTTGAAC GCACAATTTA TCGCTGATGG TGTGTATCAA

301 GCCAAACAGG CTTTCCTTCA ACGTGTTGAA CAACTTCGTA TATCCCTAAC

351 AGAAGCTGGA TTGTCTGATG AGCAAATCAA TCAGGTTCTG GAAAAACAGA

401 AATTTGAATT GGAAAGTCCT AACCTGAAAT TAAATTAA
```

This corresponds to the amino acid sequence <SEQ ID 2590; ORF 755>:

```
m755.pep..
   1 MSRYLITFDM DTNCLKDNYH GNNYTNAYSD IKTILARHGF ENIQGSVYLG

51 REGISEAHGT IAIQELTARF DWFYSCISNI KFYRLESDLN AQFIADGVYQ

101 AKQAFLQRVE QLRISLTEAG LSDEQINQVL EKQKFELESP NLKLN* a755.seq not found yet
a755.pep not found yet g756.seq not found yet
g756.pep not found yet
```

The following partial DNA sequence was identified in *N. meningitidis* <SEQ ID 2591>:

```
m756.seq
   1 ATGACCGCCA ACTTTGCACA GACGCTGGTC GAAATACAGG ACAGTCTGTA

51 CAGGGTTGTG TCAACCGTCC AATACGGGGA TGACAACCTC AAGCGGTTGA

101 CAGCGGACAA ACGGAAGCAG TATGAGTTGA ACTTCAAGAT TTCCGAGGGT

151 TCTACGCGTG TAGAGTCCGA CTTTAAAGAG ACTTTGGTTC GGTTCGGTAG

201 AGATATGCTT CAAGATATGC CCCCTAAAAT CCGTTCGGCA ACGCTGGTAG

251 CGTTGACGAC CCTGCTTGTC GGAGGGGCGT TGGGTTACGG TTATTTGGAA

301 TACCTGAAGC AGGTTGCTTC GGAAGGGTAT CAGACCGAGC GTCTGTATAA

351 TGCCGTCGAC CGTCTTGCAG AATCCCAAGA ACGGATAACG TCCGCCATCC

401 TGAAGGGTGC TAGAGGTGCC GATTTCGTGC AAATCGGCAG ACGTTCCTAC

451 AGTAGGGAGG ATATATCGGA GGCAAATAGA CGTGCAGAGC GTGTCCCGTA

501 TGGCGCAGAG TTGGTTTCAG ACGGCAATTT TACCGCTGTT TTATCTGATA

551 TAGGGGATTA A
```

This corresponds to the amino acid sequence <SEQ ID 2592; ORF 756>:

```
m756.pep
   1 MTANFAQTLV EIQDSLYRVV STVQYGDDNL KRLTADKRKQ YELNFKISEG

51 STRVESDFKE TLVRFGRDML QDMPPKIRSA TLVALTTLLV GGALGYGYLE

101 YLKQVASEGY QTERLYNAVD RLAESQERIT SAILKGARGA DFVQIGRRSY

151 SREDISEANR RAERVPYGAE LVSDGNFTAV LSDIGD*
```

The following partial DNA sequence was identified in *N. meningitidis* <SEQ ID 2593>:

```
a756.seq
   1 ATGACCGCCA ACTTTGCACA GACGCTGGTC GAAATACAGG ACAGTCTGTA

51 NAGGGTTGTG TCAACCGTCC AATACGGGGA TGACAACCTC AAGCGGTTGA

101 CAGCGGACAA ACGGAAGCAG TATGAGTTGA ACTTCAAGAT TTCCGAGGGT

151 TCTACGCGTG TAGAGTCCGA CTTTAAAGAG ACTTTGGTTC GGTTCGGTAG

201 AGATATGCTT CAAGATATGC CCCCTAAAAT CCGTTCGGCA ACGCTGGTAG

251 CGTTGACGAC CCTGCTTGTC GGAGGGGCGT TGGGTTACGG TTATTTGGAA

301 TACCTGAAGC AGGTTGCTTC GGAAGGGTAT CAGACCGAGC GTCTGTATAA
```

```
351 TGCCGTCGAC CGTCTTGCAG AATCCCAAGA ACGGATAACG TCCGCCATCC

401 TGAAGGGTGC TAGAGGTGCC GATTTCGTGC AAATCGGCAG ACGTTCCTAC

451 AGTAGGGAGG ATATATCGGA GGCAAATAGA CGTGCAGAGC GTGTCCCGTA

501 TGGCGCAGAG TTGGTTTCAG ACGGCAATTT TACCGCTGTT TTATCTGATA

551 TAGGGGATTA A
```

This corresponds to the amino acid sequence <SEQ ID 2594; ORF 756.a>:

```
a756.pep
  1 MTANFAQTLV EIQDSLXRVV STVQYGDDNL KRLTADKRKQ YELNFKISEG

51 STRVESDFKE TLVRFGRDML QDMPPKIRSA TLVALTTLLV GGALGYGYLE

101 YLKQVASEGY QTERLYNAVD RLAESQERIT SAILKGARGA DFVQIGRRSY

151 SREDISEANR RAERVPYGAE LVSDGNFTAV LSDIGD*
``` m756/a756 99.5% identity in 186 aa overlap

```
                        10         20         30         40         50         60
    m756.pep    MTANFAQTLVEIQDSLYRVVSTVQYGDDNLKRLTADKRKQYELNFKISEGSTRVESDFKE
                ||||||||||||||| ||||||||||||||||||||||||||||||||||||||||||||
    a756        MTANFAQTLVEIQDSLXRVVSTVQYGDDNLKRLTADKRKQYELNFKISEGSTRVESDFKE
                        10         20         30         40         50         60
                        70         80         90        100        110        120
    m756.pep    TLVRFGRDMLQDMPPKIRSATLVALTTLLVGGALGYGYLEYLKQVASEGYQTERLYNAVD
                ||||||||||||||||||||||||||||||||||||||||||||||||||||||||||||
    a756        TLVRFGRDMLQDMPPKIRSATLVALTTLLVGGALGYGYLEYLKQVASEGYQTERLYNAVD
                        70         80         90        100        110        120
                       130        140        150        160        170        180
    m756.pep    RLAESQERITSAILKGARGADFVQIGRRSYSREDISEANRRAERVPYGAELVSDGNFTAV
                ||||||||||||||||||||||||||||||||||||||||||||||||||||||||||||
    a756        RLAESQERITSAILKGARGADFVQIGRRSYSREDISEANRRAERVPYGAELVSDGNFTAV
                       130        140        150        160        170        180
    m756.pep    LSDIGDX
                |||||||
    a756        LSDIGDX
    g757.seq    not found yet g757.pep    not fiund yet
```

The following partial DNA sequence was identified in *N. meningitidis* <SEQ ID 2595>:

```
m757.seq
  1 ATGAAAATAC TCGCTTTATT AATTGCCGCT ACCTGTGCTT TATCTGCGTG

51 TGGCAGCCAA TCTGAAGAAC AACCGGCATC TGCACAACCC CAAGAGCAGG

101 CACAATCCGA ATTAAAAACC ATGCCGGTAA GCTATACCGA CTATCAATCA

151 GCAGCCAATA AAGGGCTGAA TGACCAAAAA ACCGGTCTGA CCCTTCCTGA

201 ACATGTTGTC CCTATCGACA ATGCGGAAGG AAAGAATCTG CTGCATGACT

251 TTTCAGACGG CCTCACAATC TTAACCGTTG ATACCGATAA AGCCGACAAA

301 ATTACTGCTG TCCGAGTAGT CTGGAATACA GATGCAATGC CTCAAAAAGC

351 GGAAAAACTG TCCAAAGCTG CCGCAGCCTT GATTGCGGCA ACCGCTCCGG

401 AAGACCGCAC AATGCTGCGT GATACCGGCG ACCAAATCGA AATGGCGATT

451 GACAGCCATA ATGCGCAAAA AGAGCCAACC CGAGAATGGG CGCGTGGTGG

501 GATTGCTTAT AAAGTCACTG TTACCAATTT ACCGAGCGTG GTTTTGACGG

551 CAAAAGCTGA GTAA
```

This corresponds to the amino acid sequence <SEQ ID 2596; ORF 757>:

```
m757.pep (lipoprotein)
    1 MKILALLIAA TCALSACGSQ SEEQPASAQP QEQAQSELKT MPVSYTDYQS

51 AANKGLNDQK TGLTLPEHVV PIDNAEGKNL LHDFSDGLTI LTVDTDKADK

101 ITAVRVVWNT DAMPQKAEKL SKAAAALIAA TAPEDRTMLR DTGDQIEMAI

151 DSHNAQKEPT REWARGGIAY KVTVTNLPSV VLTAKAE* a757.seq not found yet a757.pep not found yet g758.seq not found yet g758.pep not fiund yet
```

The following partial DNA sequence was identified in *N. meningitidis* <SEQ ID 2597>:

```
m758.seq
    1 ATGAACAATC TGACCGTGTT TACCCGTTTC GATACCGATT TGGCGACGCT

51 TGCCGATGAA TTGCAATATG TGTGGGAACA CACCGCCGTT ACAGACCATC

101 AGGGCAAACT GGTGGAAATT CCCGTCTGCT ACGGCGGCGA ATACGGCCCG

151 GATTTGGCGG AAGTCGCTGC TTTCCATCAG ACGGTTATTT CCGAAATCGT

201 CCGCCGCCAT ACGGCGCAAA CTTATACCGT ATTTATGATG GGCTTCCAGC

251 CCGGTTTCCC TTATCTGGGC GGCTTGCCCG AAGCATTGCA CACGCCCCGC

301 CGTGCCGTGC CGAGAACGTC CGTTCCTGCC GGTTCGGTCG GTATCGGCGG

351 CAGTCAGACC GGTGTGTATC CGTTCGCTTC GCCCGGCGGC TGGCAGATTA

401 TCGGCAGAAC CGAATTACCC TTGTTCCGAG CCGATTTGAA TCCGCCGACC

451 CTGCTGGCGG CGGGTGACCA AGTCCGCTTT GTTGCAGAAA GGATTGAGCC

501 ATGA
```

This corresponds to the amino acid sequence <SEQ ID 2598; ORF 758>:

```
m758.pep
    1 MNNLTVFTRF DTDLATLADE LQYVWEHTAV TDHQGKLVEI PVCYGGEYGP

51 DLAEVAAFHQ TVISEIVRRH TAQTYTVFMM GFQPGFPYLG GLPEALHTPR

101 RAVPRTSVPA GSVGIGGSQT GVYPFASPGG WQIIGRTELP LFRADLNPPT

151 LLAAGDQVRF VAERIEP*
```

The following partial DNA sequence was identified in *N. meningitidis* <SEQ ID 2599>:

```
a758.seq
    1 ATGAACAATC TGACCGTGTT CACCCGTTTC GATACCGATT TGGCGACGCT

51 TGCCGATGAA TTGCAATATG TGTGGGAACA CACCGCCGTT ACAGACCATC

101 AGGGCAAACT GGTGGAAATT CCCGTCTGCT ACGGCGGCGA ATACGGCCCG

151 GATTTGGCGG AAGTCGCTGC TTTCCATCAG ACGGTTATTT CCGAAATCGT

201 CCGCCGCCAT ACGGCGCAAA CTTATACCGT ATTTATGATG GGCTTCCAGC

251 CTGGTTTCCC TTATCTGGGC GGCTTGCCCG AAGCATTGCA CACGCCCCGC
```

```
-continued
301 CGTGCCGTGC CGAGAACGTC CGTTCCTGCC GGTTCGGTCG GTATCGGCGG

351 CAGTCAGACC GGTGTGTATC CGTTCGCTTC GCCCGGCGGC TGGCAGATTA

401 TCGGCAGAAC CGAATTACCC TTGTTCCGAG CCGATTTGAA TCCGCCGACC

451 CTGCTGGCGG CGGGTGACCA AGTCCGCTTT GTTGCAGAAA GGATTGAGCC

501 ATGA
```

This corresponds to the amino acid sequence <SEQ ID 2600; ORF 758.a>:

```
a758.pep..
  1 MNNLTVFTRF DTDLATLADE LQYVWEHTAV TDHQGKLVEI PVCYGGEYGP

51 DLAEVAAFHQ TVISEIVRRH TAQTYTVFMM GFQPGFPYLG GLPEALHTPR

101 RAVPRTSVPA GSVGIGGSQT GVYPFASPGG WQIIGRTELP LFRADLNPPT

151 LLAAGDQVRF VAERIEP*
``` m758/a758 100.0% identity in 167 aa overlap

```
                       10         20         30         40         50         60
    m758.pep   MNNLTVFTRFDTDLATLADELQYVWEHTAVTDHQGKLVEIPVCYGGEYGPDLAEVAAFHQ
               ||||||||||||||||||||||||||||||||||||||||||||||||||||||||||||
    a758       MNNLTVFTRFDTDLATLADELQYVWEHTAVTDHQGKLVEIPVCYGGEYGPDLAEVAAFHQ
                       10         20         30         40         50         60
                       70         80         90        100        110        120
    m758.pep   TVISEIVRRHTAQTYTVFMMGFQPGFPYLGGLPEALHTPRRAVPRTSVPAGSVGIGGSQT
               ||||||||||||||||||||||||||||||||||||||||||||||||||||||||||||
    a758       TVISEIVRRHTAQTYTVFMMGFQPGFPYLGGLPEALHTPRRAVPRTSVPAGSVGIGGSQT
                       70         80         90        100        110        120
                      130        140        150        160
    m756.pep   GVYPFASPGGWQIIGRTELPLFRADLNPPTLLAAGDQVRFVAERIEPX
               ||||||||||||||||||||||||||||||||||||||||||||||||
    a758       GVYPFASPGGWQIIGRTELPLFRADLNPPTLLAAGDQVRFVAERIEPX
                      130        140        150        160
    g759.seq   not found yet g759.pep   not found yet
```

The following partial DNA sequence was identified in *N. meningitidis* <SEQ ID 2601>:

```
m759.seq
  1 ATGCGCTTCA CACACACCAC CCCATTTTGT TCCGTATTGT CCACCCTCGG

51 TCTTTTTGCC GTTTCCCCTG CTTACTCATC CATTGTCCGC AACGATGTCG

101 ATTACCAATA TTTTCGCGAC TTTGCCGAAA ATAAAGGCGC GTTCACCGTA

151 GGTGCAAGCA ATATTTCCAT CCAAGACAAG CAAGGCAAAA TATTAGGCAG

201 GGTTCTCAAC GGCATCCCCA TGCCCGACTT CCGCGTCAGC AACCGCCAAA

251 CCGCCATCGC CACCCTGGTT CACCCCCAAT ACGTCAACAG TGTCAAACAC

301 AACGTCGGCT ACGGTTCCAT ACAATTCGGC AACGACACCC AAAATCCAGA

351 AGAACAAGCC TATACCTACC GCCTCGTATC ACGCAACCCG CACCCGGACT

401 ACGACTACCA CCTTCCCCGC CTCAACAAAC TGGTTACCGA ATCTCACCT

451 ACCGCACTCA GCAGCGTACC CTTGCTTGGA AACGCCAGC CAAAGGCCAA

501 TGCCTACCTC GATACCGACC GCTTCCCCTA CTTTGTACGA CTCGGCTCAG

551 GCACGCAACA AGTCCGCAAA GCAGACGGCA CGCGTACACG AACCGCCCCG

601 GCATACCAAT ACCTGACCGG CGGCACGCCG CTGAAAGTAT TGGGGTTCCA
```

```
 651 AAACCACGGC TTACTCGTCG GCGGCAGCCT GACCGACCAA CCCCTTAACA

701 CCTACGCAAT CGCCGGAGAC AGCGGTTCCC CCCTGTTTGC CTTCGACAAG

751 CATGAAAACC GCTGGGTGCT TGCGGGCGTA CTCAGCACCT ACGCCGGCTT

801 CGATAATTTC TTCAACAAAT ACATCGTCAC GCAACCCGAA TTCATCCGTT

851 CCACCATCCG CCAATACGAA ACCCGGCTGG ATGTCGGGCT GACCACCAAC

901 GAACTCATAT GGCGCGACAA CGGTAATGGC AACAGCACCC TGCAAGGGCT

951 CAACGAACGC ATCACCCTGC CCATTGCAAA CCCTTCGCTT GCCCCACAAA

1001 ACGACAGCAG GCACATGCCG TCTGAAGATG CCGGCAAAAC GCTCATCCTA

1051 TCCAGCAGGT TCGACAACAA AACACTGATG CTGGCAGACA ATATCAACCA

1101 AGGCGCAGGC GCATTGCAGT TCGACAGCAA CTTCACCGTC GTCGGTAAAA

1151 ACCACACATG GCAAGGTGCA GGCGTTATCG TAGCCGACGG CAAACGCGTC

1201 TTCTGGCAAG TCAGCAACCC CAAAGGCGAC CGGCTCTCCA AACTGGGCGC

1251 AGGCACGCTT ATCGCCAACG GACAAGGCAT CAACCAGGGC GACATCAGCA

1301 TCGGGGAAGG CACTGTCGTA CTCGCCCAAA AAGCTGCTTC AGACGGCAGC

1351 AAACAAGCAT TCAACCAAGT CGGCATCACC AGCGGCAGGG CACGGCCGT

1401 CCTCGCCGAC AGCCAGCAAA TCAAACCCGA AAACCTCTAT TTCGGCTTCA

1451 GGGGCGGACG GCTCGACCTC AACGGCAACA ACCTTGCCTT TACCCATATC

1501 CGCCATGCGG ACGGCGGCGC GCAAATCGTC AATCACAACC CTGACCAAGC

1551 CGCGACACTG ACGCTGACCG GCAACCCCGT CCTCAGTCCC GAGCATGTCG

1601 AGTGGGTGCA ATGGGCAAC CGTCCGCAAG GCAACGCGGC GGTTTACGAA

1651 TACATCAACC CGCACCGCAA CCGTCGGACC GACTACTTCA TACTCAAACC

1701 CGGCGGCAAC CCGCGCGAAT TTTTCCCGTT AAATATGAAA AACTCAACAA

1751 GCTGGCAATT TATCGGCAAC AACAGGCAAC AGGCCGCCGA ACAAGTCGCC

1801 CAAGCCGAAA ATGCCCGCCC CGACCTGATT ACCTTCGGCG ATACTTGGG

1851 TGAAAACGCG CAAACGGGCA AAGCCGCGCC GAGTTACAGC AAAACCAATG

1901 AAGCAGCCAT AGAAAAAACC CGCCATATCG CAAATGCCGC CGTATACGGC

1951 CGGCCCGAAT ACCGTTACAA CGGCGCACTC AACCTGCACT ATCGTCCCAA

2001 ACGCACCGAC AGCACGCTGT TGCTCAACGG CGGCATGAAC CTTAACGGGG

2051 AAGTCTTGAT TGAGGGCGGC AATATGATTG TGTCAGGCAG GCCCGTACCC

2101 CATGCCTACG ACCACCAGGC CAAACGCGAA CCCGTTCTTG AAAACGAATG

2151 GACCGACGGC AGCTTCAAGG CTGCACGGTT CACCCTGCGA AACCATGCCC

2201 GACTGACGGC AGGGCGCAAT ACCGCGCATC TGGACGGCGA CATAACCGCA

2251 TACGATCTGT CCGGCATCGA CCTCGGCTTT ACCCAAGGCA AAACACCGGA

2301 ATGCTACCGC TCCTACCATA GCGGCAGCAC CCACTGCACA CCCAACGCCG

2351 TTTTAAAAGC CGAAAACTAT CGTGCACTAC CTGCAACGCA AGTACGCGGC

2401 GACATTACCC TTAACGACCG TTCAGAGCTC CGCCTGGGCA AGCACACCT

2451 GTACGGCAGC ATCCGTGCCG GCAAAGACAC CGCAGTCCGC ATGGAAGCAG

2501 ACAGCAACTG GACACTTTCC CAGTCCAGCC ACACCGGCGC ACTGACGCTT

2551 GACGGCGCAC AAATTACCCT GAACCCCGAT TTCGCCAATA ATACACACAA

2601 CAACCGCTTC AACACACTGA CCGTCAACGG CACACTTGAC GGGTTCGGCA

2651 CATTCCGATT CCTGACCGGC ATCGTCCGAA AACAAAATGC CCCCCCCCTC
```

```
2701 AAACTGGAAG GGGACAGCCG CGGCGCATTC CAAATCCACG TCAAAAACAC

2751 CGGACAAGAA CCTCAAACAA CCGAATCGCT TGCACTTGTG AGCCTCAATC

2801 CGAAACACAG CCACCAAGCC CGATTCACCC TCCAAAACGG CTATGCCGAT

2851 TTGGGTGCCT ACCGCTACAT CCTCCGCAAA AACAACAACG GATACAGCCT

2901 GTACAACCCG CTCAAAGAGG CCGAACTTCA AATTGAAGCC ACGCGTGCGG

2951 AACATGAGCG CAACCAACAG GCATACAACC AATTACAGGC AACCGACATC

3001 AGCAGACAGG TTCAACATGA CTCTGACGCG ACCAGGCAGG CACTACAGGC

3051 CTGGCAGAAC AGTCAAACCG AACTTGCCCG CATCGACAGC CAAGTCCAAT

3101 ATCTGTCCGC CCAATTGAAA CAGACAGACC CGCTGACCGG CATTCTGACG

3151 CGTGCCCAAA ACCTGTGTGC CGCACAAGGA TACAGTGCCG ATATCTGCCG

3201 TCAGGTTGCC AAAGCCGCCG ACACGAACGA CCTGACACTC TTCGAAACCG

3251 AACTGGATAC GTATATAGAA CGTGTAGAAA TGGCCGAATC CGAACTTGAC

3301 AAAGCACGGC AAGGCGGCGA TGCGCAAGCC GTCGAAACAG CCCGGCACGC

3351 CTACCTGAAC GCACTCAACC GTCTGTCCCG ACAAATCCAC AGTTTGAAAA

3401 CCGGCGTTGC CGGCATCCGT ATGCCGAACC TGGCCGAACT GATCAGCCGG

3451 TCGGCCAACA CCGCCGTTTC CGAACAGGCC GCCTACAATA CCGGCCGGCA

3501 ACAGGCGGGA CGCCGCATCG ACCGCCACCT TACCGATCCG CAGCAGCAAA

3551 ACATCTGGCT GGAAACCGGT ACGCAACAAA CCGACTACCA TAGCGGCACA

3601 CACCGTCCCT ACCAACAAAC TACCAACTAT GCACATATCG GCATCCAAAC

3651 CGGCATCACC GACCGTCTCA GTGTCGGTAC GATTTTAACC GATGAGCGCA

3701 CAAACAACCG TTTTGATGAA GGCGTATCCG CCCGAAACCG CAGCAACGGC

3751 GCACATCTGT TCGTCAAAGG GGAAAACGGC GCACTCTTTG CCGCGGCAGA

3801 TTTAGGCTAC AGCAACAGCC GTACCCGATT TACCGATTAT GACGGGGCTG

3851 CCGTCCGCCG CCACGCATGG GATGCAGGCA TCAACACCGG CATCAAAATC

3901 GATACCGGCA TCAACCTCAG ACCCTATGCC GGCATCCGTA TAAACCGCAG

3951 CAACGGCAAC CGGTACGTAC TCGACGGCGC AGAGATAAAC AGCCCGGCGC

4001 AAATCCAAAC CACATGGCAT GCCGGCATCC GTCTCGATAA AACCGTCGAA

4051 CTGGGTCAAG CCAAGCTGAC CCCCGCCTTC AGCAGCGATT ACTACCATAC

4101 CCGCCAAAAC AGCGGTTCCG CCCTCAGCGT CAACGACCGT ACCTTACTGC

4151 AGCAAGCCGC CCACGGCACA CTGCATACCC TGCAAATCGA CGCCGGATAC

4201 AAAGGCTGGA ACGCCAAACT TCATGCCGCT TACGGCAAAG ACAGCAACAC

4251 CGCCCGCCAC AAACAGGCAG GAATCAAAAT AGGCTACAAC TGGTAA
```

This corresponds to the amino acid sequence <SEQ ID 2602; ORF 759>:

```
m759.pep
   1 MRFTHTTPFC SVLSTLGLFA VSPAYSSIVR NDVDYQYFRD FAENKGAFTV

51 GASNISIQDK QGKILGRVLN GIPMPDFRVS NRQTAIATLV HPQYVNSVKH

101 NVGYGSIQFG NDTQNPEEQA YTYRLVSRNP HPDYDYHLPR LNKLVTEISP

151 TALSSVPLLG NGQPKANAYL DTDRFPYFVR LGSGTQQVRK ADGTRTRTAP

201 AYQYLTGGTP LKVLGFQNHG LLVGGSLTDQ PLNTYAIAGD SGSPLFAFDK
```

-continued

```
 251 HENRWVLAGV LSTYAGFDNF FNKYIVTQPE FIRSTIRQYE TRLDVGLTTN

301 ELIWRDNGNG NSTLQGLNER ITLPIANPSL APQNDSRHMP SEDAGKTLIL

351 SSRFDNKTLM LADNINQGAG ALQFDSNFTV VGKNHTWQGA GVIVADGKRV

401 FWQVSNPKGD RLSKLGAGTL IANGQGINQG DISIGEGTVV LAQKAASDGS

451 KQAFNQVGIT SGRGTAVLAD SQQIKPENLY FGFRGGRLDL NGNNLAFTHI

501 RHADGGAQIV NHNPDQAATL TLTGNPVLSP EHVEWVQWGN RPQGNAAVYE

551 YINPHRNRRT DYFILKPGGN PREFFPLNMK NSTSWQFIGN NRQQAAEQVA

601 QAENARPDLI TFGGYLGENA QTGKAAPSYS KTNEAAIEKT RHIANAAVYG

651 RPEYRYNGAL NLHYRPKRTD STLLLNGGMN LNGEVLIEGG NMIVSGRPVP

701 HAYDHQAKRE PVLENEWTDG SFKAARFTLR NHARLTAGRN TAHLDGDITA

751 YDLSGIDLGF TQGKTPECYR SYHSGSTHCT PNAVLKAENY RALPATQVRG

801 DITLNDRSEL RLGKAHLYGS IRAGKDTAVR MEADSNWTLS QSSHTGALTL

851 DGAQITLNPD FANNTHNNRF NTLTVNGTLD GFGTFRFLTG IVRKQNAPPL

901 KLEGDSRGAF QIHVKNTGQE PQTTESLALV SLNPKHSHQA RFTLQNGYAD

951 LGAYRYILRK NNNGYSLYNP LKEAELQIEA TRAEHERNQQ AYNQLQATDI

1001 SRQVQHDSDA TRQALQAWQN SQTELARIDS QVQYLSAQLK QTDPLTGILT

1051 RAQNLCAAQG YSADICRQVA KAADTNDLTL FETELDTYIE RVEMAESELD

1101 KARQGGDAQA VETARHAYLN ALNRLSRQIH SLKTGVAGIR MPNLAELISR

1151 SANTAVSEQA AYNTGRQQAG RRIDRHLTDP QQQNIWLETG TQQTDYHSGT

1201 HRPYQQTTNY AHIGIQTGIT DRLSVGTILT DERTNNRFDE GVSARNRSNG

1251 AHLFVKGENG ALFAAADLGY SNSRTRFTDY DGAAVRRHAW DAGINTGIKI

1301 DTGINLRPYA GIRINRSNGN RYVLDGAEIN SPAQIQTTWH AGIRLDKTVE

1351 LGQAKLTPAF SSDYYHTRQN SGSALSVNDR TLLQQAAHGT LHTLQIDAGY

1401 KGWNAKLHAA YGKDSNTARH KQAGIKIGYN W*
```

The following partial DNA sequence was identified in *N. gonorrhoeae* <SEQ ID 2603>:

```
g760.seq (partial)
   1 AACAACCGCA ACACCCGTTA CGCCGCATTG GGCAAACGCG TGATGGAAGG

51 CGTTGAGACC GAAATCAGCG GTGCGATTAC ACCGAAATGG CAAATCCATG

101 CAGGTTACAG CTATCTGCAC AGCCAAATCA AAACCGCCGC CAATCCACGC

151 GACGACGGCA TCTTCCTGCT GGTGCCCAAA CACAGCGCAA ACCTGTGGAC

201 GACTTACCAA GTTACGCCCG GCTGACCGT CGGCGGCGGC GTGAACGCGA

251 TGAGCGGCAT TACTTCATCT GCAGGGATGC ATGCAGGCGG TTATGCCACG

301 TTCGATGCGA TGGCGGCATA CCGCTTCACG CCCAAGCTGA AGCTGCAAAT

351 CAATGCCGAC AACATCTTCA ACCGCCATTA CTACGCCCGC GTCGGCGGCA

401 CGAACACCTT TAACATTCCC GGTTCGGAGC GCAGCCTGAC GGCAAACCTG

451 CGTTACAGTT TTTAA
```

This corresponds to the amino acid sequence <SEQ ID 2604; ORF 760.ng>:

```
g760.pep (partial)
   1 NNRNTRYAAL GKRVMEGVET EISGAITPKW QIHAGYSYLH SQIKTAANPR

51 DDGIFLLVPK HSANLWTTYQ VTPGLTVGGG VNAMSGITSS AGMHAGGYAT

101 FDAMAAYRFT PKLKLQINAD NIFNRHYYAR VGGTNTFNIP GSERSLTANL

151 RYSF*
```

The following partial DNA sequence was identified in *N. meningitidis* <SEQ ID 2605>:

```
m760.seq
   1 ATGGGACAGT TTATGTCAGT TTTCCGCATC AATATGACCG CCGCCACGGT

51 TTTGGCAGCA CTCTCGTCTT CGGTTTTTGC CGCACAAACG GAAGGTTTGG

101 AAACCGTCCA TATTAAGGGT CAGCGTTCTT ACAACGCGAT TGCCACCGAG

151 AAAAACGGCG ATTACAGCTC GTTTGCCGCC ACCGTCGGTA CAAAAATCCC

201 CGCTTCTTTG CGCGAAATTC CGCAATCCGT CAGCATCATT ACCAACCAGC

251 AGGTCAAAGA CCGCAATGTT GATACGTTTG ACCAGTTGGC ACGCAAAACG

301 CCCGGCCTGC GCGTGTTGAG CAACGACGAC GGACGCTCTT CGGTTTACGC

351 GCGCGGTTAC GAATACAGCG AATACAACAT CGACGGCCTG CCCGCGCAGA

401 TGCAGAGTAT CAACGGCACG CTGCCCAACC TGTTCGCCTT CGACCGCGTG

451 GAAGTGATGC GCGGGCCGAG CGGACTGTTC GACAGCAGCG GCGAGATGGG

501 CGGCATCGTG AATCTGGTGC GCAAACGCCC GACCAAAGCG TTCCAAGGTC

551 ATGCGGCGGC AGGGTTCGGT ACGCACAAAC AATATAAAGC CGAGGCGGAC

601 GTATCGGGCA GCCTCAATTC AGACGGCAGC GTGCGCGGCC GCGTGATGGC

651 GCAGACCGTC GGCGCGTCTC CGCGTCCCGC CGAGAAAAAC AACCGGCGCG

701 AAACCTTCTA CGCGGCGGCG GATTGGGACA TCAACCCCGA TACGGTTTTG

751 GGCGCGGGCT ATCTTTACCA GCAACGCCGC CTCGCGCCGT ACAACGGCCT

801 GCCTGCCGAT GCCAATAACA AATTACCGTC CCTGCCGCAA CACGTATTTG

851 TCGGCGCGGA TTGGAACAAA TTTAAAATGC ACAGCCACGA CGTGTTCGCC

901 GATTTGAAAC ATTACTTCGG CAACGGCGGC TACGGCAAAG TCGGTATGCG

951 CTATTCCGAT CGGAAAGCCG ATTCCAATTA TACGTTTGCG GGCAGCAAAC

1001 TCAACAATAC CGGACAAGCC GACGTAGCGG GTTTGGGTAC GGACATTAAA

1051 CAAAAAGCCT TGCGGTTGA CGCAAGTTAC AGCCGTCCGT TTGCCTTGGG

1101 CAACACCGCC AACGAATTTG TGATTGGTGC AGACTACAAC CGCTTGCGCA

1151 GTACTAATGA ACAAGGGCGT TCGACTTTGT CAAAAAGCGT CGCTTTAGAT

1201 GGTTTCCGCG CTTTGCCTTA TAACGGCATA CTTCAGAACG CCCGCGCCGG

1251 AAACAAAGGT TTCAATCACT CCGTTACCGA AGAAACCTC GACGAAACCG

1301 GTTTGTATGC CAAGACGGTG TTCCGTCCTC TGGAAGGTTT GTCGTTGATT

1351 GCAGGCGGAC GTGTAGGACA TCACAAAATC GAGTCGGGCG ACGGCAAAAC

1401 CCTGCATAAA GCTTCGAAAA CCAAATTTAC AAGCTACGCC GGCGCGGTTT

1451 ACGATATAGA CGGCAGCAAC AGCCTGTACG CTTCCGCCTC CCAACTCTAC

1501 ACACCGCAAA CCAGCATCGG CACCGACGGC AAGCTGCTCA AACCGCGCGA
```

```
-continued
1551 AGGCAACCAG TTTGAAATCG GCTACAAAGG CAGCTACATG GACGACCGCC

1601 TCAATACCCG GGTTTCGTTC TACCGCATGA AGGATAAAAA CGCCGCCGCA

1651 CCGCTGGACT CAAACAACAA AAAAACCCGT TACGCCGCAT GGGCAAACG

1701 CGTGATGGAA GGTGTTGAGA CCGAAATCAG CGGCGCGATG ACACCGAAAT

1751 GGCAAATCCA TGCAGGTTAC AGCTACCTGC ACAGCCAAAT CAAAACCGCC

1801 TCCAATTCGC GCGACGAAGG CATCTTCCTG CTGATGCCCA ACACAGCGC

1851 AAACCTGTGG ACGACTTACC AAGTTACGTC CGGGCTGACC ATCGGCGGCG

1901 GCGTGAACGC GATGAGCGGC ATTACTTCAT CTGCAGGGAT ACATGCAGGC

1951 GGTTATGCCA CGTTCGATGC GATGGCGGCA TACCGCTTCA CGCCCAAACT

2001 GAAGCTGCAA ATCAACGCCG ACAACATCTT CAACCGCCAT TACTACGCCC

2051 GCGTCGGCAG CGAGAGCACC TTTAACATTC CCGGTTCGGA GCGCAGCCTG

2101 ACGGCAAACC TGCGTTACAG TTTTTAA
```

This corresponds to the amino acid sequence <SEQ ID 2606; ORF 760>:

```
m760.pep
  1 MGQFMSVFRI NMTAATVLAA LSSSVFAAQT EGLETVHIKG QRSYNAIATE

51 KNGDYSSFAA TVGTKIPASL REIPQSVSII TNQQVKDRNV DTFDQLARKT

101 PGLRVLSNDD GRSSVYARGY EYSEYNIDGL PAQMQSINGT LPNLFAFDRV

151 EVMRGPSGLF DSSGEMGGIV NLVRKRPTKA FQGHAAAGFG THKQYKAEAD

201 VSGSLNSDGS VRGRVMAQTV GASPRPAEKN NRRETFYAAA DWDINPDTVL

251 GAGYLYQQRR LAPYNGLPAD ANNKLPSLPQ HVFVGADWNK FKMHSHDVFA

301 DLKHYFGNGG YGKVGMRYSD RKADSNYTFA GSKLNNTGQA DVAGLGTDIK

351 QKAFAVDASY SRPFALGNTA NEFVIGADYN RLRSTNEQGR STLSKSVALD

401 GFRALPYNGI LQNARAGNKG FNHSVTEENL DETGLYAKTV FRPLEGLSLI

451 AGGRVGHHKI ESGDGKTLHK ASKTKFTSYA GAVYDIDGSN SLYASASQLY

501 TPQTSIGTDG KLLKPREGNQ FEIGYKGSYM DDRLNTRVSF YRMKDKNAAA

551 PLDSNNKKTR YAALGKRVME GVETEISGAM TPKWQIHAGY SYLHSQIKTA

601 SNSRDEGIFL LMPKHSANLW TTYQVTSGLT IGGGVNAMSG ITSSAGIHAG

651 GYATFDAMAA YRFTPKLKLQ INADNIFNRH YYARVGSEST FNIPGSERSL

701 TANLRYSF*
``` m760/g760 91.6% identity in 154 aa overlap

```
                530        540        550        560        570        580
m760.pep YKGSYMDDRLNTRVSFYRMKDKNAAAPLDSNNKKTRYAALGKRVMEGVETEISGAMTPKW
                                   ||::||||||||||||||||||||||||||:||||
g760                               NNRNTRYAALGKRVMEGVETEISGAITPKW
                                                   10        20        30

590        600        610        620        630        640
m760.pep QIHAGYSYLHSQIKTASNSRDEGIFLLMPKHSANLWTTYQVTSGLTIGGGVNAMSGITSS
         ||||||||||||||||||:|  |||||||:||||||||||||||   |||||||||||||
g760     QIHAGYSYLHSQIKTAANPRDDGIFLLVPKHSANLWTTYQVTPGLTVGGGVNAMSGITSS
                40         50         60         70        80        90

650        660        670        680        690        700
m760.pep AGIHAGGYATFDAMAAYRFTPKLKLQINADNIFNRHYYARVGSESTFNIPGSERSLTANL
         ||:|||||||||||||||||||||||||||||||||||||||::|||||||||||||||
g760     AGMHAGGYATFDAMAAYRFTPKLKLQINADNIFNRHYYARVGGTNTFNIPGSERSLTANL
               100        110        120        130        140        150
```

```
            709
m760.pep  RYSFX
          |||||
g760      RYSFX
g761.seq not found yet
g761.pep not found yet
```

The following partial DNA sequence was identified in *N. meningitidis* <SEQ ID 2607>:

```
m761.seq
    1 ATGAAAATAT CATTTCATTT AGCTTTATTA CCCACGCTGA TTATTGCTTC
   51 CTTCCCTGTT GCTGCCGCCG ATACGCAGGA CAATGGTGAA CATTACACCG
  101 CCACTCTGCC CACCGTTTCC GTGGTCGGAC AGTCCGACAC CAGCGTACTC
  151 AAAGGCTACA TCAACTACGA CGAAGCCGCC GTTACCCGCA ACGGACAGCT
  201 CATCAAAGAA ACGCCGCAAA CCATCGATAC GCTCAATATC CAGAAAAACA
  251 AAAATTACGG TACGAACGAT TTGAGTTCCA TCCTCGAAGG CAATGCCGGC
  301 ATCGACGCTG CCTACGATAT GCGCGGTGAA AGCATTTTCC TGCGCGGTTT
  351 TCAAGCCGAC GCATCCGATA TTTACCGCGA CGGCGTGCGC GAAAGCGGAC
  401 AAGTGCGCCG CAGTACTGCC AACATCGAGC GCGTGGAAAT CCTGAAAGGC
  451 CCGTCTTCCG TGCTTTACGG CCGCACCAAC GGCGGCGGCG TCATCAACAT
  501 GGTCAGCAAA TACGCCAACT TCAAACAAAG CCGCAACATC GGAGCGGTTT
  551 ACGGCTCATG GGCAAACCGC AGCCTGAATA TGGACATTAA CGAAGTGCTG
  601 AACAAAAACG TCGCCATCCG TCTCACCGGC GAAGTCGGGC GCGCCAATTC
  651 GTTCCGCAGC GGCATAGACA GCAAAAATGT CATGGTTTCG CCCAGCATTA
  701 CCGTCAAACT CGACAACGGC TTGAAGTGGA CGGGGCAATA CACCTACGAC
  751 AATGTGGAGC GCACGCCCGA CCGCAGTCCG ACCAAGTCCG TGTACGACCG
  801 CTTCGGACTG CCTTACCGCA TGGGGTTCGC CCACCGGAAC GATTTTGTCA
  851 AAGACAAGCT GCAAGTTTGG CGTTCCGACC TTGAATACGC CTTCAACGAC
  901 AAATGGCGTG CCCAATGGCA GCTCGCCCAC CGCACGGCGG CGCAGGATTT
  951 TGATCATTTC TATGCAGGCA GCGAAAATGG CAACTTAATC AAACGTAACT
 1001 ACGCCTGGCA GCAGACCGAC AACAAAACCC TGTCGTCCAA CTTAACGCTC
 1051 AACGGCGACT ACACCATCGG CCGTTTTGAA AACCACCTGA CCGTAGGCAT
 1101 GGATTACAGC CGCGAACACC GCAACCCGAC ATTGGGTTTC AGCAGCGCCT
 1151 TTTCCGCCTC CATCAACCCC TACGACCGCG CAAGCTGGCC GGCTTCGGGC
 1201 AGATTGCAGC CTATTCTGAC CCAAAACCGC CACAAAGCCG ACTCCTACGG
 1251 CATCTTTGTG CAAAACATCT TCTCCGCCAC GCCCGATTTG AAATTCGTCC
 1301 TCGGCGGCCG TTACGACAAA TACACCTTTA ATTCCGAAAA CAAACTCACC
 1351 GGCAGCAGCC GCCAATACAG CGGACACTCG TTCAGCCCCA ACATCGGCGC
 1401 AGTGTGGAAC ATCAATCCCG TCCACACACT TTACGCCTCG TATAACAAAG
 1451 GCTTCGCGCC TTATGGCGGA CGCGGCGGCT ATTTGAGCAT CGATACGTTG
 1501 TCTTCCGCCG TGTTCAACGC CGACCCCGAG TACACCCGCC AATACGAAAC
 1551 CGGCGTGAAA AGCAGTTGGC TGGACGACCG CCTCAGCACT ACGTTGTCTG
 1601 CCTACCAAAT CGAACGCTTC AATATCCGCT ACCGCCCCGA TCCAAAAAAC
```

-continued
```
1651 AACCCTTATA TTTATGCGGT TAGCGGCAAA CACCGTTCGC GCGGCGTGGA

1701 ATTGTCCGCC ATCGGGCAAA TCATCCCCAA AAAACTCTAT CTGCGCGGTT

1751 CGTTGGGCGT GATGCAGGCG AAAGTCGTTG AAGACAAAGA AAATCCCGAC

1801 CGAGTGGGCA TCCATTTGAA TAATACCAGC AACGTTACCG GCAACCTGTT

1851 TTTCCGTTAT ACCCCGACCG AAAACCTCTA CGGCGAAATC GGCGTAACCG

1901 GTACAGGCAA ACGCTACGGT TACAACTCAA GAAATAAAGA AGTGACTACG

1951 CTTCCAGGCT TTGCCCGAGT TGATGCCATG CTTGGCTGGA ACCATAAAAA

2001 TGTTAACGTT ACCTTTGCCG CAGCCAATCT GCTCAATCAA AAATATTGGC

2051 GTTCGGACTC TATGCCGGGT AATCCGCGCG GCTATACTGC CCGGGTAAAT

2101 TACCGTTTCT GA
```

This corresponds to the amino acid sequence <SEQ ID 2608; ORF 761>:

```
m761.pep
   1 MKISFHLALL PTLIIASFPV AAADTQDNGE HYTATLPTVS VVGQSDTSVL

51 KGYINYDEAA VTRNGQLIKE TPQTIDTLNI QKNKNYGTND LSSILEGNAG

101 IDAAYDMRGE SIFLRGFQAD ASDIYRDGVR ESGQVRRSTA NIERVEILKG

151 PSSVLYGRTN GGGVINMVSK YANFKQSRNI GAVYGSWANR SLNMDINEVL

201 NKNVAIRLTG EVGRANSFRS GIDSKNVMVS PSITVKLDNG LKWTGQYTYD

251 NVERTPDRSP TKSVYDRFGL PYRMGFAHRN DFVKDKLQVW RSDLEYAFND

301 KWRAQWQLAH RTAAQDFDHF YAGSENGNLI KRNYAWQQTD NKTLSSNLTL

351 NGDYTIGRFE NHLTVGMDYS REHRNPTLGF SSAFSASINP YDRASWPASG

401 RLQPILTQNR HKADSYGIFV QNIFSATPDL KFVLGGRYDK YTFNSENKLT

451 GSSRQYSGHS FSPNIGAVWN INPVHTLYAS YNKGFAPYGG RGGYLSIDTL

501 SSAVFNADPE YTRQYETGVK SSWLDDRLST TLSAYQIERF NIRYRPDPKN

551 NPYIYAVSGK HRSRGVELSA IGQIIPKKLY LRGSLGVMQA KVVEDKENPD

601 RVGIHLNNTS NVTGNLFFRY TPTENLYGEI GVTGTGKRYG YNSRNKEVTT

651 LPGFARVDAM LGWNHKNVNV TFAAANLLNQ KYWRSDSMPG NPRGYTARVN

701 YRF*
```

The following partial DNA sequence was identified in *N. meningitidis* <SEQ ID 2609>:

```
a761.seq
   1 ATGAAAATAT CATTTCATTT AGCTTTATTA CCCACGCTGA TTATTGCTTC

51 CTTCCCTGTT GCTGCCGCCG ATACGCAGGA CAATGGTGAA CATTACACCG

101 CCACTCTGCC CACCGTTTCC GTGGTCGGAC AGTCCGACAC CAGCGTACTC

151 AAAGGCTACA TCAACTACGA CGAAGCCGCC GTTACCCGCA ACGGACAGCT

201 CATCAAAGAA ACGCCGCAAA CCATCGATAC GCTCAATATC CAGAAAAACA

251 AAAATTACGG CACGAACGAT TTGAGTTCCA TCCTCGAAGG CAATGCCGGC

301 ATCGACGCCG CCTACGATAT GCGCGGCGAA AGCATTTTCC TGCGCGGCTT

351 TCAAGCCGAC GCATCTGATA TTTACCGCGA CGGCGTACGC GAAAGCGGGC

401 AGGTGCGCCG TAGCACCGCC AACATCGAGC GCGTGGAAAT CCTGAAAGGT
```

-continued

```
 451 CCGTCCTCCG TGCTTTATGG GCGTACCAAC GGCGGCGGTG TCATCAACAT

501 GGTCAGCAAA TACGCCAACT TCAAACAAAG CCGTAATATC GGTACGGTTT

551 ATGGTTCGTG GGCAAACCGC AGCCTGAATA TGGACATCAA CGAAGTGCTG

601 AACAAAAACG TCGCCATCCG TCTCACCGGC GAAGTCGGGC GCGCCAATTC

651 GTTCCGCAGC GGCATAGACA GCAAAAATGT CATGGTTTCG CCCAGCATTA

701 CCGTCAAACT CGACAACGGC TTGAAGTGGA CGGGGCAATA CACCTACGAC

751 AATGTGGAGC GCACGCCCGA CCGCAGTCCG ACCAAGTCCG TGTACGACCG

801 CTTCGGACTG CCTTACCGCA TGGGGTTCGC CCACCGGAAC GATTTTGTCA

851 AAGACAAGCT GCAAGTTTGG CGTTCCGACC TTGAATACGC CTTCAACGAC

901 AAATGGCGTG CCCAATGGCA GCTCGCCCAC CGCACGGCGG CGCAGGATTT

951 TGATCATTTC TATGCAGGCA GCGAAAATGG CAACTTAATC AAACGTAACT

1001 ACGCCTGGCA GCAGACCGAC AACAAAACCC TGTCGTCCAA CTTAACGCTC

1051 AACGGCGACT ACACCATCGG CCGTTTTGAA AACCACCTGA CCGTAGGCAT

1101 GGATTACAGC CGCGAACACC GCAACCCGAC ATTGGGTTTC AGCAGCGCCT

1151 TTTCCGCCTC CATCAACCCC TACGACCGCG CAAGCTGGCC GGCTTCGGGC

1201 AGATTGCAGC CTATTCTGAC CCAAAACCGC CACAAAGCCG ACTCCTACGG

1251 CATCTTTGTG CAAAACATCT TCTCCGCCAC GCCCGATTTG AAATTCGTCC

1301 TCGGCGGCCG TTACGACAAA TACACCTTTA ATTCCGAAAA CAAACTCACC

1351 GGCAGCAGCC GCCAATACAG CGGACACTCG TTCAGCCCCA ACATCGGCGC

1401 AGTGTGGAAC ATCAATCCCG TCCACACACT TTACGCCTCG TATAACAAAG

1451 GCTTCGCGCC TTATGGCGGA CGCGGCGGCT ATTTGAGCAT CGATACGTTG

1501 TCTTCCGCCG TGTTCAACGC CGACCCCGAG TACACCCGCC AATACGAAAC

1551 CGGCGTGAAA AGCAGTTGGC TGGACGACCG CCTCAGCACT ACGTTGTCTG

1601 CCTACCAAAT CGAACGCTTC AATATCCGCT ACCGCCCCGA TCCAAAAAAC

1651 AACCCTTATA TTTATGCGGT TAGCGGCAAA CACCGTTCGC GCGGCGTGGA

1701 ATTGTCCGCC ATCGGGCAAA TCATCCCCAA AAAACTCTAT CTGCGCGGTT

1751 CGTTGGGCGT GATGCAGGCG AAAGTCGTTG AAGACAAAGA AATCCCGAC

1801 CGAGTGGGCA TCCATTTGAA TAACACCAGC AACGTTACCG GCAACCTGTT

1851 TTTCCGTTAT ACCCCGACCG AAAACCTCTA CGGCGAAATC GGCGTAACCG

1901 GTACAGGCAA ACGCTACGGT TACGACTCAA GAAATAAAGA AGTGACTACG

1951 CTTCCAGGCT TTGCCCGAGT TGATGCCATG CTTGGCTGGA ACCATAAAAA

2001 TGTTAACGTT ACCTTTGCCG CAGCCAATCT GTTCAATCAA AAATATTGGC

2051 GTTCGGACTC TATGCCGGGT AATCCGCGCG GCTATACTGC CCGGGTAAAT

2101 TACCGTTTCT GA
```

This corresponds to the amino acid sequence <SEQ ID 2610; ORF 761.a>:

a761.pep

```
  1 MKISFHLALL PTLIIASFPV AAADTQDNGE HYTATLPTVS VVGQSDTSVL

51 KGYINYDEAA VTRNGQLIKE TPQTIDTLNI QKNKNYGTND LSSILEGNAG

101 IDAAYDMRGE SIFLRGFQAD ASDIYRDGVR ESGQVRRSTA NIERVEILKG
```

```
-continued
151 PSSVLYGRTN GGGVINMVSK YANFKQSRNI GTVYGSWANR SLNMDINEVL

201 NKNVAIRLTG EVGRANSFRS GIDSKNVMVS PSITVKLDNG LKWTGQYTYD

251 NVERTPDRSP TKSVYDRFGL PYRMGFAHRN DFVKDKLQVW RSDLEYAFND

301 KWRAQWQLAH RTAAQDFDHF YAGSENGNLI KRNYAWQQTD NKTLSSNLTL

351 NGDYTIGRFE NHLTVGMDYS REHRNPTLGF SSAFSASINP YDRASWPASG

401 RLQPILTQNR HKADSYGIFV QNIFSATPDL KFVLGGRYDK YTFNSENKLT

451 GSSRQYSGHS FSPNIGAVWN INPVHTLYAS YNKGFAPYGG RGGYLSIDTL

501 SSAVFNADPE YTRQYETGVK SSWLDDRLST TLSAYQIERF NIRYRPDPKN

551 NPYIYAVSGK HRSRGVELSA IGQIIPKKLY LRGSLGVMQA KVVEDKENPD

601 RVGIHLNNTS NVTGNLFFRY TPTENLYGEI GVTGTGKRYG YDSRNKEVTT

651 LPGFARVDAM LGWNHKNVNV TFAAANLFNQ KYWRSDSMPG NPRGYTARVN

701 YRF*
``` m761/a761 99.6% identity in 703 aa overlap

```
                  10         20         30         40         50         60
m761.pep  MKISFHLALLPTLIIASFPVAAADTQDNGEHYTATLPTVSVVGQSDTSVLKGYINYDEAA
          ||||||||||||||||||||||||||||||||||||||||||||||||||||||||||||
a761      MKISFHLALLPTLIIASFPVAAADTQDNGEHYTATLPTVSVVGQSDTSVLKGYINYDEAA
                  10         20         30         40         50         60

70         80         90        100        110        120
m761.pep  VTRNGQLIKETPQTIDTLNIQKNKNYGTNDLSSILEGNAGIDAAYDMRGESIFLRGFQAD
          ||||||||||||||||||||||||||||||||||||||||||||||||||||||||||||
a751      VTRNGQLIKETPQTIDTLNIQKNKNYGTNDLSSILEGNAGIDAAYDMRGESIFLRGFQAD
                  70         80         90        100        110        120

130        140        150        160        170        180
m761.pep  ASKIYRDGVRESGQVRRSTANIERVEILKGPSSVLYGRTNGGGVINMVSKYANFKQSRNI
          ||||||||||||||||||||||||||||||||||||||||||||||||||||||||||||
a761      ASKIYRDGVRESGQVRRSTANIERVEILKGPSSVLYGRTNGGGVINMVSKYANFKQSRNI
                 130        140        150        160        170        180

190        200        210        220        230        240
m761.pep  GAVYGSWANRSLNMDINEVLNKNVAIRLTGEVGRANSFRSGIDSKNVMVSPSITVKLDNG
          |:||||||||||||||||||||||||||||||||||||||||||||||||||||||||||
a761      GTVYGSWANRSLNMDINEVLNKNVAIRLTGEVGRANSFRSGIDSKNVMVSPSITVKLDNG
                 190        200        210        220        230        240

250        260        270        280        290        300
m761.pep  LKWTGQYTYDNVERTPDRSPTKSVYDRFGLPYRMGFAHRNDFVKDKLQVWRSDLEYAFND
          ||||||||||||||||||||||||||||||||||||||||||||||||||||||||||||
a761      LKWTGQYTYDNVERTPDRSPTKSVYDRFGLPYRMGFAHRNDFVKDKLQVWRSDLEYAFND
                 250        260        270        280        290        300

310        320        330        340        350        360
m761.pep  KWRAQWQLAHRTAAQDFDHFYAGSENGNLIKRNYAWQQTDNKTLSSNLTLNGDYTIGRFE
          ||||||||||||||||||||||||||||||||||||||||||||||||||||||||||||
a761      KWRAQWQLAHRTAAQDFDHFYAGSENGNLIKRNYAWQQTDNKTLSSNLTLNGDYTIGRFE
                 310        320        330        340        350        360

370        380        390        400        410        420
m761.pep  NHLTVGMDYSREHRNPTLGFSSAFSASINPYDRASWPASGRLQPILTQNRHKADSYGIFV
          ||||||||||||||||||||||||||||||||||||||||||||||||||||||||||||
a761      NHLTVGMDYSREHRNPTLGFSSAFSASINPYDRASWPASGRLQPILTQNRHKADSYGIFV
                 370        380        390        400        410        420

430        440        450        460        470        480
m761.pep  QNIFSATPDLKFVLGGRYDKYTFNSENKLTGSSRQYSGHSFSPNIGAVWNINPVHTLYAS
          ||||||||||||||||||||||||||||||||||||||||||||||||||||||||||||
a761      QNIFSATPDLKFVLGGRYDKYTFNSENKLTGSSRQYSGHSFSPNIGAVWNINPVHTLYAS
                 430        440        450        460        470        480

430        440        450        460        470        480
m761.pep  QNIFSATPDLKFVLGGRYDKYTFNSENKLTGSSRQYSGHSFSPNIGAVWNINPVHTLYAS
          ||||||||||||||||||||||||||||||||||||||||||||||||||||||||||||
a761      QNIFSATPDLKFVLGGRYDKYTFNSENKLTGSSRQYSGHSFSPNIGAVWNINPVHTLYAS
                 430        440        450        460        470        480

490        500        510        520        530        540
m761.pep  YNKGFAPYGGRGGYLSIDTLSSAVFNADPEYTRQYETGVKSSWLDDRLSTTLSAYQIERF
          ||||||||||||||||||||||||||||||||||||||||||||||||||||||||||||
a761      YNKGFAPYGGRGGYLSIDTLSSAVFNADPEYTRQYETGVKSSWLDDRLSTTLSAYQIERF
                 490        500        510        520        530        540
```

-continued

```
                       550        560        570        580        590        600
   m761.pep  NIRYRPDPKNNPYIYAVSGKHRSRGVELSAIGQIIPKKLYLRGSLGVMQAKVVEDKENPD
              ||||||||||||||||||||||||||||||||||||||||||||||||||||||||||||
   a761      NIRYRPDPKNNPYIYAVSGKHRSRGVELSAIGQIIPKKLYLRGSLGVMQAKVVEDKENPD
                       550        560        570        580        590        600

610        620        630        640        650        660
   m761.pep  RVGIHLNNTSNVTGNLFFRYTPTENLYGEIGVTGTGKRYGYNSRNKEVTTLPGFARVDAM
              |||||||||||||||||||||||||||||||||||||||:||||||||||||||||||||
   a761      RVGIHLNNTSNVTGNLFFRYTPTENLYGEIGVTGTGKRYGYDSRNKEVTTLPGFARVDAM
                       610        620        630        640        650        660

670        680        690        700
   m761.pep  LGWNHKNVNVTFAAANLLNQKYWRSDSMPGNPRGYTARVNYRFX
              ||||||||||||:|||||||||||||||||||||||||||||||
   a761      LGWNHKNVNVTFAAANLFNQKYWRSDSMPGNPRGYTARVNYRFX
                       670        680        690        700 g762.seq  Not yet found g762.pep  Not yet found
```

The following partial DNA sequence was identified in *N. meningitidis* <SEQ ID 2611>:

```
m762.seq
   1 ATGAAGTGGT TATTAAATAT GATAATGAGA CCTATTAAAT TTAGTATGGT

51 AAATACGTTA TTATTTATTG TTATATGTAG TTCATTTTTT GATCTGCTCG

101 TTCAATTATG TACAATTTTA TTTCATAGCC AAAAAATATA CTTTATTACA

151 TTATTTTTAT TATTTATTTT TAATTTTGTT ACAAAATCTA TCTATATGGC

201 AATTATTTAT CCTATTTTAT ATTTTTTTAC GATAAAAAAA TATTATCCTT

251 ACTCTAGGAA AGTGATAATT CTATTATCAT TAGCATTATC TATATATTTT

301 AGTTTTATGG ACTTTTACTT TTTTTCCATA TATTCAGATA ACCTTAGCTA

351 TGAAACGGAG CCTTTACATT TATACATCCC TATTATTATT AATTTTTTCT

401 CACTTTTAGT TTCTAATTTT ATTTTATCTT TTATCAACAA GTAA
```

This corresponds to the amino acid sequence <SEQ ID 2612; ORF 762>:

```
m762.pep
   1 MKWLLNMIMR PIKFSMVNTL LFIVICSSFF DLLVQLCTIL FHSQKIYFIT

51 LFLLFIFNFV TKSIYMAIIY PILYFFTIKK YYPYSRKVII LLSLALSIYF

101 SFMDFYFFSI YSDNLSYETE PLHLYIPIII NFFSLLVSNF ILSFINK*
```

The following partial DNA sequence was identified in *N. meningitidis* <SEQ ID 2613>:

```
a762.seq
   1 ATGAAGTGGT TATTAAATAT GATAATGAGA CCTATTAAAT TTAGTATGGT

51 AAATACGTTA TTATTTATTG TTATATGTAG TTCATTTTTT GATCTGCTCG

101 TTCAATTATG TACAATTTTA TTTCATAGCC AAAAAATATA CTTTATTACA

151 TTATTTTTAT TATTTATTTT TAATTTTGTT ACAAAATCTA TCTATATGGC

201 AATTATTTAT CCTATTTTAT ATTTTTTTAC GATAAAAAAA TATTATCCTT

251 ACTCTAGGAA AGTGATAATT CTATTATCAT TAGCATTATC TATATATTTT

301 AGTTTTATGG ACTTTTACTT TTTTTCCATA TATTCAGATA ACCTTAGCTA

351 TGAAACGGAG CCTTTACATT TATACATCCC TATTATTATT AATTTTTTCT

401 CACTTTTAGT TTCTAATTTT ATTTTATCTT TTATCAACAA
     GTAA
```

This corresponds to the amino acid sequence <SEQ ID 2614; ORF 762.a>:

```
a762.pep
  1 MKWLLNMIMR PIKFSMVNTL LFIVICSSFF DLLVQLCTIL FHSQKIYFIT

51 LFLLFIFNFV TKSIYMAIIY PILYFFTIKK YYPYSRKVII LLSLALSIYF

101 SFMDFYFFSI YSDNLSYETE PLHLYIPIII NFFSLLVSNF ILSFINK*
``` m762/a762 100.0% identity in 147 aa overlap

```
                     10         20         30         40         50         60
      m762.pep   MKWLLNMIMPRIKFSMVNTLLFIVICSSFFDLLVQLCTILFHSQKIYFITLFLLFIFNFV
                 ||||||||||||||||||||||||||||||||||||||||||||||||||||||||||||
      a762       MKWLLNMIMPRIKFSMVNTLLFIVICSSFFDLLVQLCTILFHSQKIYFITLFLLFIFNFV
                     10         20         30         40         50         60
                     70         80         90        100        110        120
      m762.pep   TKSIYMAIIYPILYFFTIKKYYPYSRKVIILLSLALSIYFSFMDFYFFSIYSDNLSYETE
                 ||||||||||||||||||||||||||||||||||||||||||||||||||||||||||||
      a762       TKSIYMAIIYPILYFFTIKKYYPYSRKVIILLSLALSIYFSFMDFYFFSIYSDNLSYETE
                     70         80         90        100        110        120
                    130        140
      m762.pep   PLHLYIPIIINFFSLLVSNFILSFINKX
                 ||||||||||||||||||||||||||||
      a762       PLHLYIPIIINFFSLLVSNFILSFINKX
                    130        140
      g763.seq    not yet found g763.pep    not yet found
```

The following partial DNA sequence was identified in *N. meningitidis* <SEQ ID 2615>:

```
m763.seq
  1 ATGACATTGC TCAATCTAAT GATAATGCAA GATTACGGTA TTTCCGTTTG

51 CCTGACACTG ACGCCCTATT TGCAACATGA ACTATTTTCG GCTATGAAAT

101 CCTATTTTTC CAAATATATC CTACCCGTTT CACTTTTTAC CTTGCCACTA

151 TCCCTTTCCC CATCCGTTTC GGCTTTTACG CTGCCTGAAG CATGGCGGGC

201 GGCGCAGCAA CATTCGGCTG ATTTTCAAGC GTCCCATTAC CAGCGTGATG

251 CAGTGCGCGC ACGGCAACAA CAAGCCAAGG CCGCATTCCT TCCCCATGTA

301 TCCGCCAATG CCAGCTACCA GCGCCAGCCG CCATCGATTT CTTCCACCCG

351 CGAAACACAG GGATGGAGCG TGCAGGTGGG ACAAACCTTA TTTGACGCTG

401 CCAAATTTGC ACAATACCGC CAAAGCAGGT TCGATACGCA GGCTGCAGAA

451 CAGCGTTTCG ATGCGGCACG CGAAGAATTG CTGTTGAAAG TTGCCGAAAG

501 TTATTTCAAC GTTTTACTCA GCCGAGACAC CGTTGCCGCC CATGCGGCGG

551 AAAAAGAGGC TTATGCCCAG CAGGTAAGGC AGGCGCAGGC TTTATTCAAT

601 AAAGGTGCTG CCACCGCGCT GGATATTCAC GAAGCCAAAG CCGGTTACGA

651 CAATGCCCTG GCCCAAGAAA TCGCCGTATT GGCTGAGAAA CAAACCTATG

701 AAAACCAGTT GAACGACTAC ACCGACCTGG ATAGCAAACA AATCGAGGCC

751 ATAGATACCG CCAACCTGTT GGCACGCTAT CTGCCCAAGC TGGAACGTTA

801 CAGTCTGGAT GAATGGCAGC GCATTGCCTT ATCCAACAAT CATGAATACC

851 GGATGCAGCA GCTTGCCCTG CAAAGCAGCG GACAGGCGCT TCGGGCAGCA

901 CAGAACAGCC GCTATCCCAC CGTTTCTGCC CATGTCGGCT ATCAGAATAA

951 CCTCTACACT TCATCTGCGC AGAATAATGA CTACCACTAT CGGGGCAAAG
```

```
-continued
1001 GGATGAGCGT CGGCGTACAG TTGAATTTGC CGCTTTATAC CGGCGGAGAA

1051 TTGTCGGGCA AAATCCATGA AGCCGAAGCG CAATACGGGG CCGCCGAAGC

1101 ACAGCTGACC GCAACCGAGC GGCACATCAA ACTCGCCGTA CGCCAGGCTT

1151 ATACCGAAAG CGGTGCGGCG CGTTACCAAA TCATGGCGCA AGAACGGGTT

1201 TTGGAAAGCA GCCGTTTGAA ACTGAAATCG ACCGAAACCG GCCAACAATA

1251 CGGCATCCGC AACCGGCTGG AAGTAATACG GGCGCGGCAG GAAGTCGCCC

1301 AAGCAGAACA GAAACTGGCT CAAGCACGGT ATAAATTCAT GCTGGCTTAT

1351 TTGCGCTTGG TGAAAGAGAG CGGGTTAGGG TTGGAAACGG TATTTGCGGA

1401 ATAA
```

This corresponds to the amino acid sequence <SEQ ID 2616; ORF 763>:

```
m763.pep
   1 MTLLNLMIMQ DYGISVCLTL TPYLQHELFS AMKSYFSKYI LPVSLFTLPL

51 SLSPSVSAFT LPEAWRAAQQ HSADFQASHY QRDAVRARQQ QAKAAFLPHV

101 SANASYQRQP PSISSTRETQ GWSVQVGQTL FDAAKFAQYR QSRFDTQAAE

151 QRFDAAREEL LLKVAESYFN VLLSRDTVAA HAAEKEAYAQ QVRQAQALFN

201 KGAATALDIH EAKAGYDNAL AQEIAVLAEK QTYENQLNDY TDLDSKQIEA

251 IDTANLLARY LPKLERYSLD EWQRIALSNN HEYRMQQLAL QSSGQALRAA

301 QNSRYPTVSA HVGYQNNLYT SSAQNNDYHY RGKGMSVGVQ LNLPLYTGGE

351 LSGKIHEAEA QYGAAEAQLT ATERHIKLAV RQAYTESGAA RYQIMAQERV

401 LESSRLKLKS TETGQQYGIR NRLEVIRARQ EVAQAEQKLA QARYKFMLAY

451 LRLVKESGLG LETVFAE*
```

The following partial DNA sequence was identified in *N. meningitidis* <SEQ ID 2617>:

```
a763.seq
   1 ATGACATTGC TCAATCTAAT GATAATGCAA GATTACGGTA TTTCCGTTTG

51 CCTGACACTG ACGCCCTATT TGCAACATGA ACTATTTTCG GCTATGAAAT

101 CCTATTTTTC CAAATATATC CTACCCGTTT CACTTTTTAC CTTGCCACTA

151 TCCCTTTCCC CATCCGTTTC GGCTTTTACG CTGCCTGAAG CATGGCGGGC

201 GGCGCAGCAA CATTCGGCTG ATTTTCAAGC GTCCCATTAC CAGCGTGATG

251 CAGTGCGCGC ACGGCAACAA CAAGCCAAGG CCGCATTCCT TCCCCATGTA

301 TCCGCCAATG CCAGCTACCA GCGCCAGCCG CCATCGATTT CTTCCACCCG

351 CGAAACACAG GGATGGAGCG TGCAGGTGGG ACAAACCTTA TTTGACGCTG

401 CCAAATTTGC ACAATACCGC CAAAGCAGGT TCGATACGCA GGCTGCAGAA

451 CAGCGTTTCG ATGCGGCACG CGAAGAATTG CTGTTGAAAG TTGCCGAAAG

501 TTATTTCAAC GTTTTACTCA GCCGAGACAC CGTTGCCGCC CATGCGGCGG

551 AAAAAGAGGC TTATGCCCAG CAGGTAAGGC AGGCGCAGGC TTTATTCAAT

601 AAAGGTGCTG CCACCGCGCT GGATATTCAC GAAGCCAAAG CCGGTTACGA

651 CAATGCCCTG GCCCAAGAAA TCGCCGTATT GGCTGAGAAA CAAACCTATG

701 AAAACCAGTT GAACGACTAC ACCGGCCTGG ACAGCAAACA AATCGAGGCC
```

```
 751 ATAGATACCG CCAACCTGTT GGCACGCTAT CTGCCGAAGC TGGAACGTTA

801 CAGTCTGGAT GAATGGCAGC GCATTGCCTT ATCCAACAAT CATGAATACC

851 GGATGCAGCA GCTTGCCCTG CAAAGCAGCG ACAGGCGCT TCGGGCAGCA

901 CAGAACAGCC GCTATCCCAC CGTTTCTGCC CATGTCGGCT ATCAGAATAA

951 CCTCTACACT TCATCTGCGC AGAATAATGA CTACCACTAT CGGGGCAAAG

1001 GGATGAGCGT CGGCGTACAG TTGAATTTGC CGCTTTATAC CGGCGGAGAA

1051 TTGTCGGGCA AAATCCATGA AGCCGAAGCG CAATACGGGG CTGCCGAAGC

1101 ACAGCTGACC GCAACCGAGC GGCACATCAA ACTCGCCGTA CGCCAGGCTT

1151 ATACCGAAAG CGGTGCGGCG CGTTACCAAA TCATGGCGCA AGAACGGGTT

1201 TTGGAAAGCA GCCGTTTGAA ACTGAAATCG ACCGAAACCG GCCAACAATA

1251 CGGCATCCGC AACCGGCTGG AAGTAATACG GGCGCGGCAG GAAGTCGCCC

1301 AAGCAGAACA GAAACTGGCT CAAGCACGGT ATAAATTCAT GCTGGCTTAT

1351 TTGCGCTTGG TGAAAGAGAG CGGGTTAGGG TTGGAAACGG TATTTGCGGA

1401 ATAA
```

This corresponds to the amino acid sequence <SEQ ID 2618; ORF 763.a>:

```
a763.pep
  1 MTLLNLMIMQ DYGISVCLTL TPYLQHELFS AMKSYFSKYI LPVSLFTLPL

51 SLSPSVSAFT LPEAWRAAQQ HSADFQASHY QRDAVRARQQ QAKAAFLPHV

101 SANASYQRQP PSISSTRETQ GWSVQVGQTL FDAAKFAQYR QSRFDTQAAE

151 QRFDAAREEL LLKVAESYFN VLLSRDTVAA HAAEKEAYAQ QVRQAQALFN

201 KGAATALDIH EAKAGYDNAL AQEIAVLAEK QTYENQLNDY TGLDSKQIEA

251 IDTANLLARY LPKLERYSLD EWQRIALSNN HEYRMQQLAL QSSGQALRAA

301 QNSRYPTVSA HVGYQNNLYT SSAQNNDYHY RGKGMSVGVQ LNLPLYTGGE

351 LSGKIHEAEA QYGAAEAQLT ATERHIKLAV RQAYTESGAA RYQIMAQERV

401 LESSRLKLKS TETGQQYGIR NRLEVIRARQ EVAQAEQKLA QARYKFMLAY

451 LRLVKESGLG LETVFAE*
``` m763/a763 99.8% identity in 467 aa overlap

```
                 10         20         30         40         50         60
   m763.pep  MTLLNLMIMQDYGISVCLTLTPYLQHELFSAMKSYFSKYILPVSLFTLPLSLSPSVSAFT
             ||||||||||||||||||||||||||||||||||||||||||||||||||||||||||||
   a763      MTLLNLMIMQDYGISVCLTLTPYLQHELFSAMKSYFSKYILPVSLFTLPLSLSPSVSAFT
                 10         20         30         40         50         60

70         80         90        100        110        120
   m763.pep  LPEAWRAAQQHSADFQASHYQRDAVRARQQQAKAAFLPHVSANASYQRQPPSISSTRETQ
             ||||||||||||||||||||||||||||||||||||||||||||||||||||||||||||
   a763      LPEAWRAAQQHSADFQASHYQRDAVRARQQQAKAAFLPHVSANASYQRQPPSISSTRETQ
                 70         80         90        100        110        120

130        140        150        160        170        180
   m763.pep  GWSVQVGQTLFDAAKFAQYRQSRFDTQAAEQRFDAAREELLLKVAESYFNVLLSRDTVAA
             ||||||||||||||||||||||||||||||||||||||||||||||||||||||||||||
   a763      GWSVQVGQTLFDAAKFAQYRQSRFDTQAAEQRFDAAREELLLKVAESYFNVLLSRDTVAA
                130        140        150        160        170        180

190        200        210        220        230        240
   m763.pep  HAAEKEAYAQQVRQAQALFNKGAATALDIHEAKAGYDNALAQEIAVLAEKQTYENQLNDY
             ||||||||||||||||||||||||||||||||||||||||||||||||||||||||||||
   a763      HAAEKEAYAQQVRQAQALFNKGAATALDIHEAKAGYDNALAQEIAVLAEKQTYENQLNDY
                190        200        210        220        230        240
```

```
                  250        260        270        280        290        300
m763.pep    TDLDSKQIEAIDTANLLARYLPKLERYSLDEWQRIALSNNHEYRMQQLALQSSGQALRAA
            ||||||||||||||||||||||||||||||||||||||||||||||||||||||||||
a763        TGLDSKQIEAIDTANLLARYLPKLERYSLDEWQRIALSNNHEYRMQQLALQSSGQALRAA
                  250        260        270        280        290        300

310        320        330        340        350        360
m763.pep    QNSRYPTVSAHVGYQNNLYTSSAQNNDYHYRGKGMSVGVQLNLPLYTGGELSGKIHEAEA
            ||||||||||||||||||||||||||||||||||||||||||||||||||||||||||
a763        QNSRYPTVSAHVGYQNNLYTSSAQNNDYHYRGKGMSVGVQLNLPLYTGGELSGKIHEAEA
                  310        320        330        340        350        360

370        380        390        400        410        420
m763.pep    QYGAAEAQLTATERHIKLAVRQAYTESGAARYQIMAQERVLESSRLKLKSTETGQQYGIR
            ||||||||||||||||||||||||||||||||||||||||||||||||||||||||||
a763        QYGAAEAQLTATERHIKLAVRQAYTESGAARYQIMAQERVLESSRLKLKSTETGQQYGIR
                  370        380        390        400        410        420

430        440        450        460
m763.pep    NRLEVIRARQEVAQAEQKLAQARYKFMLAYLRLVKESGLGLETVFAEX
            ||||||||||||||||||||||||||||||||||||||||||||||
a763        NRLEVIRARQEVAQAEQKLAQARYKFMLAYLRLVKESGLGLETVFAEX
                  430        440        450        460 g764.seq    not found yet g764.pep    not found yet
```

The following partial DNA sequence was identified in *N. meningitidis* <SEQ ID 2619>:

```
m764.seq
    1 ATGTTTTTCT CCGCCCTGAA ATCCTTTCTT TCTCGATACA TTACTGTATG

51 GCGCAATGTT TGGGCGGTGC GCGACCAGTT GAAACCGCCC AAACGCACGG

101 CGGAAGAACA GGCGTTTTTG CCCGCGCATT TGGAACTGAC CGATACGCCG

151 GTCTCTGCCG CTCCGAAATG GGCGGCGCGT TTTATTATGG CGTTTGCGCT

201 TTTGGCTTTG TTGTGGTCCT GGTTCGGCAA AATCGATATT GTGGCGGCGG

251 CTTCGGGCAA AACGGTGTCG GCGGGCGCA GCAAAACCAT CCAGCCGCTG

301 GAAACGGCGG TGGTTAAGGC GGTACATGTG CGCGACGGGC AGCATGTGAA

351 ACAGGGAGAA ACGCTGGCGG AACTGGAGGC TGTGGGAACA GACAGCGATG

401 TGGTGCAGTC GGAGCAGGCT TTGCAGGCTG CCCAATTGTC CAAACTGCGT

451 TATGAAGCGG TATTGGCGGC ATTGGAAAGC CGTACCGTGC CGCATATCGA

501 TATGGCGCAA GCACGGTCTT TAGGTCTCTC CGATGCCGAT GTGCAATCGG

551 CGCAGGTGTT GGCGCAGCAC CAGTATCAGG CATGGGCGGC GCAGGATGCG

601 CAATTGCAGT CGGCTTTGCG CGGCCATCAG GCGGAATTGC AGTCGGCCAA

651 GGCGCAGGAG CAGAAGCTGG TTTCGGTGGG GGCGATCGAG CAGCAGAAAA

701 CAGCAGACTA CCGCCGTTTG CGGGCCGACA ATTTTATTTC GGAACATGCG

751 TTTTTGGAGC AGCAGAGCAA ATCGGTCAGC AATTGGAACG ATTTGGAAAG

801 TACGCGCGGT CAGATGAGGC AGATTCAGGC GGCCATTGCA CAGGCGGAGC

851 AGAATCGGGT GCTGAATACG CAGAACCTGA AACGCGATAC GCTGGATGCG

901 CTGCGCCAGG CAAACGAACA GATTGACCAA TACCGCGGCC AAACGGATAA

951 GGCAAAGCAG CGGCAGCAGC TGATGACAAT ACAGTCGCCT GCGGACGGCA

1001 CGGTGCAGGA ATTGGCTACC TATACGGTGG CGGTGTGGT GCAGGCTGCC

1051 CAAAAATGA TGGTGATTGC GCCCGATGAC GACAAAATGG ACGTGGAAGT

1101 TTTGGTATTG AACAAAGACA TCGGTTTTGT GGAACAGGGA CAGGATGCGG

1151 TGGTGAAGAT TGAGAGCTTT CCCTATACGC GCTACGGTTA TCTGACGGGC

1201 AAGGTGAAAA GTGTCAGCCA TGATGCGGTA AGCCACGAAC AGTTGGGCTT
```

-continued

```
1251 GGTTTATACG GCGGTGGTGT CGCTGGACAA ACATACCTTG AATATTGACG

1301 GCAAAGCAGT GAATCTGACG GCGGGCATGA ATGTCACGGC GGAGATTAAA

1351 ACGGGTAAAC GGCGGGTGCT GGATTATCTG TTAAGCCCGC TGCAAACCAA

1401 ATTGGACGAA AGCTTTAGGG AGCGATAG
```

This corresponds to the amino acid sequence <SEQ ID 2620; ORF 764>:

```
m764.pep
   1 MFFSALKSFL SRYITVWRNV WAVRDQLKPP KRTAEEQAFL PAHLELTDTP

51 VSAAPKWAAR FIMAFALLAL LWSWFGKIDI VAAASGKTVS GGRSKTIQPL

101 ETAVVKAVHV RDGQHVKQGE TLAELEAVGT DSDVVQSEQA LQAAQLSKLR

151 YEAVLAALES RTVPHIDMAQ ARSLGLSDAD VQSAQVLAQH QYQAWAAQDA

201 QLQSALRGHQ AELQSAKAQE QKLVSVGAIE QQKTADYRRL RADNFISEHA

251 FLEQQSKSVS NWNDLESTRG QMRQIQAAIA QAEQNRVLNT QNLKRDTLDA

301 LRQANEQIDQ YRGQTDKAKQ RQQLMTIQSP ADGTVQELAT YTVGGVVQAA

351 QKMMVIAPDD DKMDVEVLVL NKDIGFVEQG QDAVVKIESF PYTRYGYLTG

401 KVKSVSHDAV SHEQLGLVYT AVVSLDKHTL NIDGKAVNLT AGMNVTAEIK

451 TGKRRVLDYL LSPLQTKLDE SFRER*
```

30

The following partial DNA sequence was identified in *N. meningitidis* <SEQ ID 2621>:

```
a764.seq (partial)
   1 ATGTTTTTCT CCGCCCTGAA ATCCTTTCTT TCCCGCTACA TTACCGTATG

51 GCGCAATGTT TGGGCGGTGC GCGACCAGTT GGAACCGCCC AAACGCACGG

101 CGGAAGAACA GGCGTTTTTG CCCGCGCATT TGGAACTGAC CGATACGCCG

151 GTCTCTGCCG CTCCGAAATG GGCGGCGCGT TTTATTATGG CGTTTGCGCT

201 TTTGGCTTTG TTGTGGTCCT GGTTCGGCAA AATCGATATT GTGGCGGCGG

251 CTTCGGGCAA AACGGTGTCG GGCGGGCGCA GCAAAACCAT CCAGCCGCTG

301 GAAACGGTGG TGGTTAAGGC GGTACATGTG CGCGACGGGC AGCATGTGAA

351 ACAGGGAGAA ACGCTGGCGG AACTGGAGGC TGTGGGAACA GACAGCGATG

401 TGGTGCAGTC GGAGCAGGCT TTGCAGGCTG CCCAATTGTC CAAACTGCGT

451 TATGAAGCGG TATTGGCGGC ATTGGAAAGC CGTACCGTGC CGCATATCGA

501 TATGGCGCAA GCACGGTCTT TAGGTCTCTC CGATGCCGAT GTGCAATCGG

551 CGCAGGTGTT GGCGCAGCAC CAGTATCAGG CATGGGCGGC GCAGGATGCG

601 CAATTGCAGT CGGCTTTGCG CGGCCATCAG GCGGAATTGC AGTCGGCCAA

651 GGCGCAGGAG CAGAAGCTGG TTTCGGTGGG GGCGATCGAG CAGCAGAAAA

701 CAGCAGACTA CCGCCGTTTG CGGGCCGACA ATTTTATTTC GGAACATGCG

751 TTTTTGGAGC AGCAGAGCAA ATCGGTCAGC AATTGGAACG ATTTGGAAAG

801 TACGCGCGGT CAGATGAGGC AGATTCAGGC GGCCATTGCA CAGGCGGAGC

851 AGAATCGGGT GCTGAATACG CAGAACCTGA AACGCGATAC GCTGGATGCG

901 CTGCGCCAGG CAAACGAACA GATTGACCAA TACCGCGGCC AAACGGATAA

951 GGCAAAGCAG CGGCAGCAGC TGATGACAAT ACAGTCGCCT GCGGACGGCA
```

-continued

```
1001 CGGTGCAGGA ATTGGCCACC TATACGGTGG GCGGTGTGGT GCAGGCTGCC

1051 CAAAAAATGA TGGTGGTTGC GCCCGATGAC GACAAAATGG ACGTGGAAGT

1101 TTTGGTATTG AACAAAGACA TCGGTTTTGT GGAACAGGGA CAGGATGCGG

1151 TGGTGAAGAT TGAGAGTTTT CCCTATACGC GCTACGGTTA TCTGACGGGC

1201 AAGGTGAAAA GTGTCAGCCA TGATGCGGTA AGCCACGAAC AGTTGGGCTT

1251 GGTTTATACG GCGGTGGTGT CGCTGGACAA ACATACCTTG AATATTGACG

1301 GCAAA
```

This corresponds to the amino acid sequence <SEQ ID 2622; ORF 764.a>.

```
a764.pep (partial)
   1 MFFSALKSFL SRYITVWRNV WAVRDQLEPP KRTAEEQAFL PAHLELTDTP

51 VSAAPKWAAR FIMAFALLAL LWSWFGKIDI VAAASGKTVS GGRSKTIQPL

101 ETVVVKAVHV RDGQHVKQGE TLAELEAVGT DSDVVQSEQA LQAAQLSKLR

151 YEAVLAALES RTVPHIDMAQ ARSLGLSDAD VQSAQVLAQH QYQAWAAQDA

201 QLQSALRGHQ AELQSAKAQE QKLVSVGAIE QQKTADYRRL RADNFISEHA

251 FLEQQSKSVS NWNDLESTRG QMRQIQAAIA QAEQNRVLNT QNLKRDTLDA

301 LRQANEQIDQ YRGQTDKAKQ RQQLMTIQSP ADGTVQELAT YTVGGVVQAA

351 QKMMVVAPDD DKMDVEVLVL NKDIGFVEQG QDAVVKIESF PYTRYGYLTG

401 KVKSVSHDAV SHEQLGLVYT AVVSLDKHTL NIDGK
``` m764/a764 99.3% identity in 435 aa overlap

```
                  10         20         30         40         50         60
m764.pep  MFFSALKSFLSRYITVWRNVWAVRDQLKPPKRTAEEQAFLPAHLELTDTPVSAAPKWAAR
          ||||||||||||||||||||||||||| :|||||||||||||||||||||||||||||||
a764      MFFSALKSFLSRYITVWRNVWAVRDQLEPPKRTAEEQAFLPAHLELTDTPVSAAPKWAAR
                  10         20         30         40         50         60

70         80         90        100        110        120
m764.pep  FIMAFALLALLWSWFGKIDIVAAASGKTVSGGRSKTIQPLETAVVKAVHVRDGQHVKQGE
          |||||||||||||||||||||||||||||||||||||||||||:||||||||||||||||
a764      FIMAFALLALLWSWFGKIDIVAAASGKTVSGGRSKTIQPLETVVVKAVHVRDGQHVKQGE
                  70         80         90        100        110        120

130        140        150        160        170        180
m764.pep  TLAELEAVGTDSDVVQSEQALQAAQLSKLRYEAVLAALESRTVPHIDMAQARSLGLSDAD
          ||||||||||||||||||||||||||||||||||||||||||||||||||||||||||||
a764      TLAELEAVGTDSDVVQSEQALQAAQLSKLRYEAVLAALESRTVPHIDMAQARSLGLSDAD
                 130        140        150        160        170        180

190        200        210        220        230        240
m764.pep  VQSAQVLAQHQYQAWAAQDAQLQSALRGHQAELQSAKAQEQKLVSVGAIEQQKTADYRRL
          |||||||||||||||||||||||||||||||||||||||||||||||:||||||||||||
a764      VQSAQVLAQHQYQAWAAQDAQLQSALRGHQAELQSAKAQEQKLVSVGATEQQKTADYRRL
                 190        200        210        220        230        240

250        260        270        280        290        300
m764.pep  RADNFISEHAFLEQQSKSVSNWNDLESTRGQMRQIQAAIAQAEQNRVLNTQNLKRDTLDA
          ||||||||||||||||||||||||||||||||||||||||||||||||||||||||||||
a764      RADNFISEHAFLEQQSKSVSNWNDLESTRGQMRQIQAAIAQAEQNRVLNTQNLKRDTLDA
                 250        260        270        280        290        300

310        320        330        340        350        360
m764.pep  LRQANEQIDQYRGQTDKAKQRQQLMTIQSPADGTVQELATYTVGGVVQAAQKMMVIAPDD
          |||||||||||||||||||||||||||||||||||||||||||||||||||||||:||||
a764      LRQANEQIDQYRGQTDKAKQRQQLMTIQSPADGTVQELATYTVGGVVQAAQKMMVVAPDD
                 310        320        330        340        350        360

370        380        390        400        410        420
m764.pep  DKMDVEVLVLNKDIGFVEQGQDAVVKIESFPYTRYGYLTGKVKSVSHDAVSHEQLGLVYT
          ||||||||||||||||||||||||||||||||||||||||||||||||||||||||||||
a764      DKMDVEVLVLNKDIGFVEQGQDAVVKIESFPYTRYGYLTGKVKSVSHDAVSHEQLGLVYT
                 370        380        390        400        410        420
```

```
            430       440       450       460       470
m764.pep    AVVSLDKHTLNIDGKAVNLTAGMNVTAEIKTGKRRVLDYLLSPLQTKLDESFRERX
            ||||||||||||||
a764        AVVSLDKHTLNIDGK
            430
g765.seq    not yet found g765.pep    not yet found
```

The following partial DNA sequence was identified in *N. meningitidis* <SEQ ID 2623>:

```
m765.seq
   1 ATGTTAAGAT GCCGTCCGAA ATCCGTTTTG GATTCAGACG GCATTTTTTT

51 GAAATTTAAT TTTTTAAGGA GTAAACCTAA ATATGAAATT TCCTTCCTTC

101 CTTCCTTTAA ACGGATACTC TGCCTGTCGG CAGTAATCTC GGTATTGGGG

151 GCTTGTGCGG TCGTTGCTGA TGTTTACGGT CATGATTCCG CCACAATGAA

201 CGCTGCGGCT GCCAAAGATT ATATGAAAAC GGTTGAGTTA AACAAGTCTG

251 CCGGCAATGT CGATACCACA TCCAGAACAG CCCGCAGGGT GCAGGCAGTA

301 TTTCGACGTA TGCTGCCTTA TGCCGATGCG GCAAATAATA CCAGCCATAA

351 GTTTGACTGG AAAATGACGG TTTTCAAAAA CGATGAGCTG AACGCGTGGG

401 CAATGCCCGG TGGAAAAATG GCGTTTTATA CGGGGATAGT CGACAAACTC

451 AAGCTGACCG ATGACGAAAT TGCCGCCATT ATGGGGCATG AAATGACGCA

501 CGCCCTGCAT GAACACGGTA AAAATAAGGT CGGGCAGCAA ATCTTGACCA

551 ATACGGCGGC GCAGATAGGC ACGCAGATTA TATTAGACAA AAAACCGGAT

601 ACTAATCCGG AATTGGTCGG ATTGGGTATG GATATTTTGG GGACGTACGG

651 TCTTACCTTG CCTTATAGCC GCAGCTTGGA AGAAGAAGCC GATGAGGGGG

701 GAATGATGTT GATGGCGCAG GCAGGCTATC ATCCGGCGGC CGCTGTCAGG

751 GTTTGGGAAA AAATGAATCA GGAAAACGAC CAAAACGGCT TTATTTATGC

801 TATTACCTCT ACTCATCCGA CAAACAATGC CCGTATAGAA AATCTAAAAC

851 GGTTGTTGCC GACCGTTATG CCGGTTTATG AGCAAAGTGT CAGAAATAAG

901 GGGCGCGTTA ATAAAAAACG TCGGCGTTAA
```

This corresponds to the amino acid sequence <SEQ ID 2624; ORF 765>:

```
m765.pep
   1 MLRCRPKSVL DSDGIFLKFN FLRSKPKYEI SFLPSFKRIL CLSAVISVLG

51 ACAVVADVYG HDSATMNAAA AKDYMKTVEL NKSAGNVDTT SRTARRVQAV

101 FRRMLPYADA ANNTSHKFDW KMTVFKNDEL NAWAMPGGKM AFYTGIVDKL

151 KLTDDEIAAI MGHEMTHALH EHGKNKVGQQ ILTNTAAQIG TQIILDKKPD

201 TNPELVGLGM DILGTYGLTL PYSRSLEEEA DEGGMMLMAQ AGYHPAAAVR

251 VWEKMNQEND QNGFIYAITS THPTNNARIE NLKRLLPTVM PVYEQSVRNK

301 GRVNKKRRR*
```

The following partial DNA sequence was identified in *N. meningitidis* <SEQ ID 2625>:

```
a765.seq
  1 ATGTTAAGAT GCCGTCCGAA ATCCGTTTTG GATTCAGACG GCATTTTTTT

51 GAAATTTAAT TTTTTAAGGA GTAAACCTAA ATATGAAATT TCCTTCCTTC

101 CTTCCTTTAA ACGGATACTC TGCCTGTCGG CAGTAATCTC GGTATTGGGG

151 GCTTGTACGG TCGTTGCTGA TGTTTACGGT CAGGATTCCG CCACAATGAA

201 TGCTGCGGCT GCCGAAGATT ATATGAAAAC GGTTGAGTTG AACAAGTCTG

251 CCGGCAATGT CGATACTACA TCCAAAACAG CCCGTAGGGT GCAGGCAGTA

301 TTTCGACGTA TGTTGCCTTA TGCCGATGCG GCAAATAATA CCGGCCATAA

351 GTTTGACTGG AAAATGACGG TTTTCAAAAA CGATGAGCTG AACGCGTGGG

401 CAATGCCCGG CGGGAAAATG GCGTTTTATA CGGGGATAGT CGATAAACTT

451 AAGCTGACCG ATGGCGAAAT TGCCGCCATT ATGGGGCATG AAATGACGCA

501 TGCCCTGCAT GAACACGGTA AAAATAAGGT CGGGCAGAAA ATCTTGACTA

551 ATATGGCGGC GCAGATAGGC ACGCAGATTA TATTAGACAA AAAACCGGAC

601 ACTAATCCGG AATTGGTCGG ATTGGGTATG GATATTTTGG GGATGTACGG

651 CATTACCTTG CCTTATAGCC GCAGCTTGGA AGAAGAAGCC GATGAGGGGG

701 GAATGATGTT GATGGCGCAG GCAGGCTATC ATCCGGCAGC CGCTGTCAGG

751 GTTTGGGAAA AAATGAATCA GGAAAACGAC CAAAACGGCT TTATTTATGC

801 TATTACCTCT ACTCATCCGA CAAACAATGC CCGTATAGAA AATCTAAAAC

851 GGTTGTTGCC GACCGTTATG CCGGTTTATG AGCACAGTGT TAGAAATAAG

901 GGGCGCGTTA ATAAAAACCG TCGGCGTTAA
```

This corresponds to the amino acid sequence <SEQ ID 2626; ORF 765.a>:

```
a765.pep
  1 MLRCRPKSVL DSDGIFLKFN FLRSKPKYEI SFLPSFKRIL CLSAVISVLG

51 ACTVVADVYG QDSATMNAAA AEDYMKTVEL NKSAGNVDTT SKTARRVQAV

101 FRRMLPYADA ANNTGHKFDW KMTVFKNDEL NAWAMPGGKM AFYTGIVDKL

151 KLTDGEIAAI MGHEMTHALH EHGKNKVGQK ILTNMAAQIG TQIILDKKPD

201 TNPELVGLGM DILGMYGITL PYSRSLEEEA DEGGMMLMAQ AGYHPAAAVR

251 VWEKMNQEND QNGFIYAITS THPTNNARIE NLKRLLPTVM PVYEHSVRNK

301 GRVNKNRRR*
```

Computer analysis of this amino acid sequence gave the following results:
Homology with a Predicted ORF from *N. meningitidis* ORF 765 shows 96.18% identity over a 309 aa overlap with a predicted ORF (ORF 765) from *N. meningitidis*:

```
   m765/a765  96.1% identity in 309 aa overlap 10         20         30         40         50         60
      m765.pep  MLRCRPKSVLDSDGIFLKFNFLRSKPKYEISFLPSFKRILCLSAVISVLGACAVVADVYG
                ||||||||||||||||||||||||||||||||||||||||||||||||||||:||||||
         a765  MLRCRPKSVLDSDGIFLKFNFLRSKPKYEISFLPSFKRILCLSAVISVLGACTVVADVYG
                     10         20         30         40         50         60
```

```
              70        80        90        100       110       120
m765.pep  HDSATMNAAAAKDYMKTVELNKSAGNVDTTSRTARRVQAVFRRMLPYADAANNTSHKFDW
          :||||||||||:||||||||||||||||||:|||||||||||||||||||||||:|||||
a765      QDSATMNAAAAEDYMKTVELNKSAGNVDTTSKTARRVQAVFRRMLPYADAANNTGHKFDW
              70        80        90        100       110       120

130       140       150       160       170       180
m765.pep  KMTVFKNDELNAWAMPGGKMAFYTGIVDKLKLTDDEIAAIMGHEMTHALHEHGKNKVGQQ
          |||||||||||||||||||||||||||||||| |||||||||||||||||||||||||:
a765      KMTVFKNDELNAWAMPGGKMAFYTGIVDKLKLTDGEIAAIMGHEMTHALHEHGKNKVGQK
              130       140       150       160       170       180

190       200       210       220       230       240
m765.pep  ILTNTAAQIGTQIILDKKPDTNPELVGLGMDILGTYGLTLPYSRSLEEEADEGGMMLMAQ
          |||| ||||||||||||||||||||||||||||| ::|||||||||||||||||||||||
a765      ILTNMAAQIGTQIILDKKPDTNPELVGLGMDILGMYGITLPYSRSLEEEADEGGMMLMAQ
              190       200       210       220       230       240

250       260       270       280       290       300
m765.pep  AGYHPAAAVRVWEKMNQENDQNGFIYAITSTHPTNNARIENLKRLLPTVMPVYEQSVRNK
          |||||||||:|||||||||||||||||||||||||||||||||||||||||:|:|||||
a765      AGYHPAAAVPVWEKMNQENDQNGFIYAITSTHPTNNARIENLKRLLPTVMPVYEHSVRNK
              250       260       270       280       290       300

310
m765.pep  GRVNKKRRRX
          |||||:||||
a765      GRVNKNRRRX
              310
```

The following partial DNA sequence was identified in *N. gonorrhoeae* <SEQ ID 2627>:

```
g767.seq
   1 ATGAAGTTTA AACATCTGTT GCCGCTGCTG CTGTCGGCAG TGTTGTCCGC

51 GCAGGCATAT GCCCTGACGG AAGGGGAAGA CTATCTTGTG TTGGATAAAC

101 CCATTCCTCA AGAACAGCCG GGAAAAATTG AGGTTTTGGA ATTTTTCGGC

151 TATTTTTGCG TACATTGCCA TCATTTCGAT CCTTTGTTAT TGAAACTGGG

201 CAAGGCATTG CCGTCTGATA CTTATCTGCG GACGGAGCAC GTGGTCTGGC

251 GGCCTGAAAT GCTCGGTCTG GCAAGAATGG CTGCTGCGGT CAAGCTGTCG

301 GGTTTGAAAT ATCAGGCAAA CTCTGCTGTG TTTAAAGCAG TTTACGAACA

351 AAAAATCCGT TTGGAAAACA GGGCTGTTGC CGGGAAATGG GCTTTATCTC

401 AAAAAGGTTT TGACGGCAAA AAACTGATGC GCGCCTATGA TTCCCCCGAA

451 GCTGCCGCCG TCGCATTAAA AATGCAGAAA CTGACGGAAC AATACGGTAT

501 TGACAGCACG CCGACCGTTA TTGTCGGCGG AAAATACCGC GTTATCTTCA

551 ATAATGGCTT TGATGGCGGC GTTCATACGA TTAAAGAATT GGTTGCCAAA

601 GTCAGGGAAG AACGCAAGCG TCAGACCCCT GCTGTACAGA AATAG
```

This corresponds to the amino acid sequence <SEQ ID 2628; ORF 767.ng>:

```
g767.pep
   1 MKFKHLLPLL LSAVLSAQAY ALTEGEDYLV LDKPIPQEQP GKIEVLEFFG

51 YFCVHCHHFD PLLLKLGKAL PSDTYLRTEH VVWRPEMLGL ARMAAAVKLS

101 GLKYQANSAV FKAVYEQKIR LENRAVAGKW ALSQKGFDGK KLMRAYDSPE

151 AAAVALKMQK LTEQYGIDST PTVIVGGKYR VIFNNGFDGG VHTIKELVAK

201 VREERKRQTP AVQK*
```

The following partial DNA sequence was identified in *N. meningitidis* <SEQ ID 2629>:

```
m767.seq
   1 ATGAAGCTCA AACATCTGTT GCCGCTGCTG CTGTCGGCAG TGTTGTCCGC

51 GCAGGCATAT GCCCTGACGG AAGGGGAAGA CTATCTTGTG TTGGATAAAC

101 CCATTCCTCA AGAACAGTCG GGTAAAATTG AGGTTTTGGA ATTTTTCGGC

151 TATTTCTGCG TACATTGCCA TCATTTCGAT CCTTTGTTAT TGAAACTGGG

201 CAAGGCATTG CCGTCTGATG CCTATTTGAG GACGGAGCAC GTGGTCTGGC

251 AGCCTGAAAT GCTCGGTTTG GCTAGGATGG CGGCTGCCGT CAATTTGTCG

301 GGTTTGAAAT ATCAGGCAAA CCCTGCTGTG TTTAAAGCAG TTTACGAACA

351 AAAAATCCGC TTGGAAAACA GGTCGGTTGC CGGAAAATGG GCTTTGTCTC

401 AAAAAGGCTT TGACGGCAAA AAACTGATGC GCGCCTATGA TTCCCCCGAA

451 GCTGCCGCCG CCGCATTAAA AATGCAGAAA CTGACGGAAC AATACCGCAT

501 CGACAGCACG CCGACCGTTA TTGTCGGCGG AAAATACCGC GTTATCTTCA

551 ATAACGGCTT TGACGGCGGC GTTCATACGA TTAAAGAATT GGTTGCCAAA

601 GTCAGGGAAG AACGCAAGCG TCAGACCCCT GCTGTACAGA AATAG
```

This corresponds to the amino acid sequence <SEQ ID 2630; ORF 767>:

```
m767.pep
   1 MKLKHLLPLL LSAVLSAQAY ALTEGEDYLV LDKPIPQEQS GKIEVLEFFG

51 YFCVHCHHFD PLLLKLGKAL PSDAYLRTEH VVWQPEMLGL ARMAAAVNLS

101 GLKYQANPAV FKAVYEQKIR LENRSVAGKW ALSQKGFDGK KLMRAYDSPE

151 AAAAALKMQK LTEQYRIDST PTVIVGGKYR VIFNNGFDGG VHTIKELVAK

201 VREERKRQTP AVQK*
```

Computer analysis of this amino acid sequence gave the following results:

Homology with a Predicted ORF from *N. gonorrhoeae*

ORF 767 shows 95.8% identity over a 214 aa overlap with a predicted ORF (ORF 767) from *N. gonorrhoeae*

```
m767/g767  95.8% identity in 214 aa overlap 10        20        30        40        50        60
g767.pep       MKFKHLLPLLLSAVLSAQAYALTEGEDYLVLDKPIPQEQPGKIEVLEFFGYFCVHCHHFD
               ||:|||||||||||||||||||||||||||||||||||| ||||||||||||||||||||
m767           MKLKHLLPLLLSAVLSAQAYALTEGEDYLVLDKPIPQEQSGKIEVLEFFGYFCVHCHHFD
                       10        20        30        40        50        60

70        80        90       100       110       120
g767.pep       PLLLKLGKALPSDTYLRTEHVVWRPEMLGLARMAAAVKLSGLKYQANSAVFKAVYEQKIR
               |||||||||||||:|||||||||:|||||||||||||:||||||||| ||| ||||||||
m767           PLLLKLGKALPSDAYLRTEHVVWQPEMLGLARMAAAVNLSGLKYQANPAVFDAVYEQKIR
                       70        80        90       100       110       120

130       140       150       160       170       180
g767.pep       LENRAVAGKWALSQKGFDGKKLMRAYDSPEAAAVALKMQKLTEQYGIDSTPTVIVGGKYR
               ||||:||||||||||||||||||||||||||||:|||||||||||| |||||||||||||
m767           LENRSVAGKWALSQKGFDGKKLMRAYDSPEAAAAALKMQKLTEQYRIDSTPTVIVGGKYR
                      130       140       150       160       170       180

190       200       210
g767.pep       VIFNNGFDGGVHTIKELVAKVREERKRQTPAVQKX
               ||||||||||||||||||||||||||||||||||
m767           VIFNNGFDGGVHTIKELVAKVREERKRQTPAVQKX
                      190       200       210
```

The following partial DNA sequence was identified in *N. meningitidis* <SEQ ID 2631>:

```
a767.seq
   1 ATGAAGCTCA AACATCTGTT GCCGCTGCTG CTGTCGGCAG TGTTGTCCGC

51 GCAGGCATAT GCCCTGACGG AAGGGGAAGA CTATCTTGTG TTGGATAAAC

101 CCATTCCTCA AAAACAGTCG GGCAAAATTG AGGTTTTGGA ATTTTTCGGC

151 TATTTCTGCG TACATTGCCA TCATTTCGAT CCTTTGTTAT TGAAATTGGG

201 CAAGGCATTG CCGTCTGATG CCTATTTAAG GACGGAGCAC GTGGTCTGGC

251 AGCCTGAAAT GCTCGGTCTG GCAAGAATGG CTGCTGCGGT CAAGCTGTCA

301 GGTTTGAAAT ATCAGGCAAA CCCTGCCGTG TTTAAAGCAG TTTACGAACA

351 AAAAATCCGC TTGGAAAACA GGTCGGTTGC CGAAAAATGG GCTTTGTCTC

401 AAAAAGGCTT TGACGGCAAA AAACTGATGC GCGCCTACGA CTCTCCTGCG

451 GCAGCGGCTG CTGCATCAAA AATGCAGCAA TTGACGGAAC AGTACCGCAT

501 CGACAGTACG CCGACCGTTG TCGTCGGCGG AAAATACCGC GTTATCTTCA

551 ATAATGGCTT TGACGGCGGT GTTCATACGA TTAAAGAATT GGTTGCCAAA

601 GTCAGGGAAG AACGCAAGCG TCAGACCCCT GCTGTACAGA AATAG
```

This corresponds to the amino acid sequence <SEQ ID 2632; ORF 767.a>:

```
a767.pep
   1 MKLKHLLPLL LSAVLSAQAY ALTEGEDYLV LDKPIPQKQS GKIEVLEFFG

51 YFCVHCHHFD PLLLKLGKAL PSDAYLRTEH VVWQPEMLGL ARMAAAVKLS

101 GLKYQANPAV FKAVYEQKIR LENRSVAEKW ALSQKGFDGK KLMRAYDSPA

151 AAAAASKMQQ LTEQYRIDST PTVVVGGKYR VIFNNGFDGG VHTIKELVAK

201 VREERKRQTP AVQK*
```

Computer analysis of this amino acid sequence gave the following results:

Homology with a Predicted ORF from *N. meningitidis*

ORF 767 shows 96.7% identity over a 214 aa overlap with a predicted ORF (ORF 767) from *N. meningitidis*:

```
m767/a767  96.7% identity in 214 aa overlap 10        20        30        40        50        60
a767.pep    MKLKHLLPLLLSAVLSAQAYALTEGEDYLVLDKPIPQKQSGKIEVLEFFGYFCVHCHHFD
            ||||||||||||||||||||||||||||||||||||:|||||||||||||||||||||||
m767        MKLKHLLPLLLSAVLSAQAYALTEGEDYLVLDKPIPQEQSGKIEVLEFFGYFCVHCHHFD
                    10        20        30        40        50        60

70        80        90       100       110       120
a767.pep    PLLLKLGKALPSDAYLRTEHVVWQPEMLGLARMAAAVKLSGLKYQANPAVFKAVYEQKIR
            |||||||||||||||||||||||||||||||||||||:||||||||||||||||||||||
m767        PLLLKLGKALPSDAYLRTEHVVWQPEMLGLARMAAAVNLSGLKYQANPAVFKAVYEQKIR
                    70        80        90       100       110       120

130       140       150       160       170       180
a767.pep    LENRSVAEKWALSQKGFDGKKLMRAYDSPAAAAAASKMQQLTEQYRIDSTPTVVVGGKYR
            ||||||| ||||||||||||||||||||| ||||| |||:||||||||||||||:|||||
m767        LENRSVAGKWALSQKGFDGKKLMRAYDSPEAAAAALKMQKLTEQYRIDSTPTVIVGGKYR
                   130       140       150       160       170       180

190       200       210
a767.pep    VIFNNGFDGGVHTIKELVAKVREERKRQTPAVQKX
            |||||||||||||||||||||||||||||||||||
m767        VIFNNGFDGGVHTIKELVAKVREERKRQTPAVQKX
                   190       200       210
```

The following partial DNA sequence was identified in *N. gonorrhoeae* <SEQ ID 2633>:

```
g768.seq
   1 ATGAATATCA AACAATTGAT TACCGCCGCA CTCATTGCCT CAGCCGCCTT

51 TGCCACGCAG GCAGCCCCGC AAAAACCCGT ATCCGCCGCC CAAACCGCGC

101 AACATTCAGC CGTTTGGATC GATGTCCGTT CCGAACAGGA ATTTAGCGAA

151 GGTCATTTGC ACAACGCGGT CAACATCCCC GTCGACCAAA TCGTCCGCCG

201 CATATACGAA GCCGCGCCCG ACAAAGACAC GCCGGTCAAC CTCTACTGCC

251 GCAGCGGACG GCGTGCCGAA GCCGCCCTTC AAGAGCTGAA AAAAGCAGGT

301 TATACAAATG TTGCCAATCA CGGCGGTTAT GAAGACCTGC TCAAAAAAGG

351 GATGAAATGA
```

This corresponds to the amino acid sequence <SEQ ID 2634; ORF 768.ng>:

```
g768.pep
   1 MNIKQLITAA LIASAAFATQ AAPQKPVSAA QTAQHSAVWI DVRSEQEFSE

51 GHLHNAVNIP VDQIVRRIYE AAPDKDTPVN LYCRSGRRAE AALQELKKAG

101 YTNVANHGGY EDLLKKGMK*
```

The following partial DNA sequence was identified in *N. meningitidis* <SEQ ID 2635>:

```
m768.seq
   1 ATGAATATCA AACACCTGAT TACCGCCGCA CTCATTGCCT CAGCCGCCTT

51 TGCCGCGCAG GCAGCCCCGC AAAAACCCGT ATCCGCCGCC CAAACCGCGC

101 AACATCCGGC CGTTTGGATC GATGTCCGTT CCGAACAGGA ATTTAGCGAA

151 GGGCATTTGC ACAACGCGGT CAACATCCCC GTCGACCAAA TCGTCCGCCG

201 CATACACGAA GCCGCGCCCG ACAAAGACAC GCCGGTCAAC CTCTACTGCC

251 GCAGCGGACG GCGTGCCGAA GCCGCCCTTC AAGAGCTGAA AAAAGCAGGT

301 TATACAAATG TTGCCAATCA CGGCGGTTAT GAAGACCTGC TCAAAAAAGG

351 GATGAAATGA
```

This corresponds to the amino acid sequence <SEQ ID 2636; ORF 768>:

```
m768.pep
   1 MNIKHLITAA LIASAAFAAQ AAPQKPVSAA QTAQHPAVWI DVRSEQEFSE

51 GHLHNAVNIP VDQIVRRIHE AAPDKDTPVN LYCRSGRRAE AALQELKKAG

101 YTNVANHGGY EDLLKKGMK*
```

Computer analysis of this amino acid sequence gave the following results:
Homology with a Predicted ORF from *N. gonorrhoeae*
ORF 768 shows 96.6% identity over a 119 aa overlap with a predicted ORF (ORF 768) from *N. gonorrhoeae*

```
    m768/g768  96.6% identity in 119 aa overlap
                    10         20         30         40         50         60
      g768.pep  MNIKQLITAALIASAAFATQAAPQKPVSAAQTAQHSAVWIDVRSEQEFSEGHLHNAVNIP
                ||||:||||||||||||||:||||||||||||||||| |||||||||||||||||||||
          m768  MNIKHLITAALIASAAFAAQAAPQKPVSAAQTAQHPAVWIDVRSEQEFSEGHLHNAVNIP
                    10         20         30         40         50         60
```

```
                      70         80         90        100        110        120
    g768.pep  VDQIVRRIYEAAPDKDTPVNLYCRSGRRAEAALQELKKAGYTNVANHGGYEDLLKKGMKX
              ||||||||:||||||||||||||||||||||||||||||||||||||||||||||||||
    m768      VDQIVRRIHEAAPDKDTPVNLYCRSGRRAEAALQELKKAGYTNVANHGGYEDLLKKGMKX
                      70         80         90        100        110        120
```

The following partial DNA sequence was identified in *N. meningitidis* <SEQ ID 2637>:

```
a768.seq
    1 ATGAATATCA AACACCTGAT TACCGCCGCA CTCATTGCCT CAGCCGCCTT

51 TGCCGCGCAG GCAGCCCCGC AAAAACCCGT ATCCGCCGCC CAAACCGCGC

101 AACATTCAGC CGTTTGGATC GATGTCCGCA GCGAACAGGA ATTTAGCGAA

151 GGTCATTTGC ACAACGCGGT CAACATCCCC GTCGACCAAA TCGTCCGCCG

201 CATACACGAA GCCGCGCCCG ACAAAGACAC GCCGGTCAAC CTCTACTGCC

251 GCAGCGGACG GCGTGCCGAA GCCGCCCTTC AAGAACTGAA AAAAGCAGGC

301 TATACGAATG TTGCCAATCA CGGCGGTTAT GAAGACCTGC TCAAAAAGG

351 GATGAAATGA
```

This corresponds to the amino acid sequence <SEQ ID 2638; ORF 768.a>:

```
a768.pep
    1 MNIKHLITAA LIASAAFAAQ AAPQKPVSAA QTAQHSAVWI DVRSEQEFSE

51 GHLHNAVNIP VDQIVRRIHE AAPDKDTPVN LYCRSGRRAE AALQELKKAG

101 YTNVANHGGY EDLLKKGMK*
```

Computer analysis of this amino acid sequence gave the following results:
Homology with a Predicted ORF from *N. meningitidis* ORF 768 shows 99.2% identity over a 119 aa overlap with a predicted ORF (ORF 768) from *N. meningitidis*:

```
    m768/a768  99.2% identity in 119 aa overlap 10         20         30         40         50         60
    a768.pep  MNIKHLITAALIASAAFAAQAAPQKPVSAAQTAQHSAVWIDVRSEQEFSEGHLHNAVNIP
              |||||||||||||||||||||||||||||||||||| |||||||||||||||||||||||
    m768      MNIKHLITAALIASAAFAAQAAPQKPVSAAQTAQHPAVWIDVRSEQEFSEGHLHNAVNIP
                      10         20         30         40         50         60
                      70         80         90        100        110        120
    a768.pep  VDQIVRRIHEAAPDKDTPVNLYCRSGRRAEAALQELKKAGYTNVANHGGYEDLLKKGMKX
              ||||||||||||||||||||||||||||||||||||||||||||||||||||||||||||
    m768      VDQIVRRIHEAAPDKDTPVNLYCRSGRRAEAALQELKKAGYTNVANHGGYEDLLKKGMKX
                      70         80         90        100        110        120
```

The following partial DNA sequence was identified in *N. gonorrhoeae* <SEQ ID 2639>:

```
g769.seq
    1 TTGATAATGG TTATTTTTTA TTTTTATTTT TGTGGGAAGA CATTTATGCC

51 TGCACGAAAC AGATGGATGC TGCTGCCTTT ATTGGCAAGC GCGGCATACG

101 CCGAAgaAAC ACCgtgCGAA CCGGATTTGA GAAGCCGTCC CGAGTTCAGG

151 CTTCATGAAG CGGAGGTCAA ACCGATCGAC AGGGAGAAGG TACCGGGGCA

201 GGTGCGGGAA AAAGGAAAAG TTTTGCAGGT TGACGgcGAA ACCCTGCTGA
```

```
 251 AAAATCCCGA ATTGTTGTCG CGTGCCATGT ATTCCGCAGT GGTCTCAAAC

301 AATATTGCCG GTATCCGCGT GATTTTGCCG ATTTACCTAC AACAGGCGCG

351 GCAGGATAAG ATGTTGGCAC TTTATGCACA AGGGATTTTG GCGCAGGCAG

401 AGGGCAGGGT GAAGGAGGCG GTTTCCCATT ACCGGGAATT GATTGCCGCC

451 CAACCCGACG CGCCCGCCGT CCGTATGCGT TGGCGGCGG CATTGTTTGA

501 AGACAGGCAG AACGAGGCGG CGGCAGACCA GTTCGACCGC CTGAAAACAG

551 AAGATCTGCC GCCGCAGCTT ATGGAGCAGG TCGAGCTGTA CCGCAAGGCA

601 TTGCGCGAAC GCGATGCGTG GAAGGTAAAC GGCGGTTTCA GCGTTACCCG

651 CGAACACAAT ATCAACCAAG CCCCGAAACA GCAGCAGTAC GGCAATTGGA

701 CTTTCCCGAA ACAGGTGGAC GGCACGGCAG TCAATTACCG GTTCGGCGCG

751 GAGAAAAAT GGTCGCTGAA AACGGCTGG TACACGACGG CGGGCGGCGA

801 CGTGTCCGGC AGGGTTTATC CGGGGAATAA GAAATTCAAC GATATGACGG

851 CAGGTGTTTC CGGCGGCATC GGTTTTGCCG ACCGGCGTAA AGATGTCGGG

901 CTGGCAGTGT TCCACGAACG CCGCACCTAC GGCAACGACG CTTATTCTTA

951 CGCCAACGGC GCACGCCTTT ATTTCAACCG TTGGCAAACC CCGAGATGGC

1001 AAACGCTGTC TTCGGCGGAG TGGGGCGTT TGAAGAATAC GCGCCGGGCG

1051 CGTTCCGACA ATACCCATTT GCAAATTTCC AATTCGCTGG TGTTTTACCG

1101 GAATGCGCGC CAATATTGGA CGGGCGGTTT GGATTTTTAC CGCGAGCGCA

1151 ACCCCGCCGA CCGTGGCGAC AATTTCAACC GTTACGGCCT GCGCTTTGCC

1201 TGGGGGCAGG AATGGGGCGG CAGCGGCCTG TCTTCGCTGT TCCGCCTCGG

1251 CGTGGCGAAA CGGCATTATG AAAAACCCGG CTTCTTCAGC AGTTTTAAAG

1301 GGGAAAGGCG CAGGGATAAA GAATCGGACA CATCCTTGAG CCTTTGGCAC

1351 CGGGCATTGC ATTTCAAAGG CATCACGCCG CGCCTGACGC TGTCGCACCG

1401 CGAAACGTGG AGCAACGATG TGTTTAACGA ATACGAGAAA AACAGGGCGT

1451 TTGTCGAGTT TAACAAAACG TTCTGA
```

This corresponds to the amino acid sequence <SEQ ID 2640; ORF 769.ng>:

```
g769.pep
  1 LIMVIFYFYF CGKTFMPARN RWMLLPLLAS AAYAEETPCE PDLRSRPEFR

51 LHEAEVKPID REKVPGQVRE KGKVLQVDGE TLLKNPELLS RAMYSAVVSN

101 NIAGIRVILP IYLQQARQDK MLALYAQGIL AQAEGRVKEA VSHYRELIAA

151 QPDAPAVRMR LAAALFEDRQ NEAAADQFDR LKTEDLPPQL MEQVELYRKA

201 LRERDAWKVN GGFSVTREHN INQAPKQQQY GNWTFPKQVD GTAVNYRFGA

251 EKKWSLKNGW YTTAGGDVSG RVYPGNKKFN DMTAGVSGGI GFADRRKDVG

301 LAVFHERRTY GNDAYSYANG ARLYFNRWQT PRWQTLSSAE WGRLKNTRRA

351 RSDNTHLQIS NSLVFYRNAR QYWTGGLDFY RERNPADRGD NFNRYGLRFA

401 WGQEWGGSGL SSLFRLGVAK RHYEKPGFFS SFKGERRRDK ESDTSLSLWH

451 RALHFKGITP RLTLSHRETW SNDVFNEYEK NRAFVEFNKT F*
```

The following partial DNA sequence was identified in *N. meningitidis* <SEQ ID 2641>:

```
m769.seq
     1  TTGATAATGG TTATTTTTTA TTTTTGTGGG AAGACATTTA TGCCTGCACG
    51  AAACAGATGG ATGCTGCTGC TGCCTTTATT GGCAAGCGCG GCATATGCCG
   101  AAGAAACACC GCGCGAACCG GATTTGAGAA GCCGTCCCGA GTTCAGGCTT
   151  CATGAAGCGG AGGTCAAACC GATCGACAGG GAGAAGGTGC CGGGGCAGGT
   201  GCGGGAAAAA GGAAAAGTTT TGCAGATTGA CGGCGAAACC CTGCTGAAAA
   251  ATCCCGAATT GTTGTCCCGC GCGATGTATT CCGCAGTGGT CTCAAACAAT
   301  ATTGCCGGTA TCCGCGTTAT TTTGCCGATT TACCTACAAC AGGCGCAGCA
   351  GGATAAGATG TTGGCACTTT ATGCACAAGG GATTTTGGCG CAGGCAGACG
   401  GTAGGGTGAA GGAGGCGATT TCCCATTACC GGGAATTGAT TGCCGCCCAA
   451  CCCGACGCGC CCGCCGTCCG TATGCGTTTG GCGGCAGCAT TGTTTGAAAA
   501  CAGGCAGAAC GAGGCGGCGG CAGACCAGTT CGACCGCCTG AAGGCGGAAA
   551  ACCTGCCGCC GCAGCTGATG GAGCAGGTCG AGCTGTACCG CAAGGCATTG
   601  CGCGAACGCG ATGCGTGGAA GGTAAATGGC GGCTTCAGCG TCACCCGCGA
   651  ACACAATATC AACCAAGCCC CGAAACGGCA GCAGTACGGC AAATGGACTT
   701  TCCCGAAACA GGTGGACGGC ACGGCGGTCA ATTACCGGCT CGGCGCGGAG
   751  AAAAAATGGT CGCTGAAAAA CGGCTGGTAC ACGACGGCGG GCGGCGACGT
   801  GTCCGGCAGG GTTTATCCGG GGAATAAGAA ATTCAACGAT ATGACGGCAG
   851  GCGTTTCCGG CGGCATCGGT TTTGCCGACC GGCGCAAAGA TGCCGGGCTG
   901  GCAGTGTTCC ACGAACGCCG CACCTACGGC AACGACGCTT ATTCTTACAC
   951  CAACGGCGCA CGCCTTTATT TCAACCGTTG GCAAACCCCG AAATGGCAAA
  1001  CGTTGTCTTC GGCGGAGTGG GGGCGTTTGA AGAATACGCG CCGGGCGCGT
  1051  TCCGACAATA CCCATTTGCA AATTTCCAAT TCGCTGGTGT TTTACCGGAA
  1101  TGCGCGCCAA TATTGGATGG GCGGTTTGGA TTTTTACCGC GAGCGCAACC
  1151  CCGCCGACCG GGGCGACAAT TTCAACCGTT ACGGCCTGCG CTTTGCCTGG
  1201  GGGCAGGAAT GGGGCGGCAG CGGCCTGTCT TCGCTGTTGC GCCTCGGCGC
  1251  GGCGAAACGG CATTATGAAA AACCCGGCTT TTTCAGCGGT TTTAAAGGGG
  1301  AAAGGCGCAG GGATAAAGAA TTGAACACAT CCTTGAGCCT TTGGCACCGG
  1351  GCATTGCATT TCAAAGGCAT CACGCCGCGC CTGACGTTGT CGCACCGCGA
  1401  AACGCGGAGT AACGATGTGT TCAACGAATA CGAGAAAAAT CGGGCGTTTG
  1451  TCGAGTTTAA TAAAACGTTC TGA
```

This corresponds to the amino acid sequence <SEQ ID 2642; ORF 769>:

```
m769.pep
     1  LIMVIFYFCG KTFMPARNRW MLLLPLLASA AYAEETPREP DLRSRPEFRL
    51  HEAEVKPIDR EKVPGQVREK GKVLQIDGET LLKNPELLSR AMYSAVVSNN
   101  IAGIRVILPI YLQQAQQDKM LALYAQGILA QADGRVKEAI SHYRELIAAQ
   151  PDAPAVRMRL AAALFENRQN EAAADQFDRL KAENLPPQLM EQVELYRKAL
   201  RERDAWKVNG GFSVTREHNI NQAPKRQQYG KWTFPKQVDG TAVNYRLGAE
```

```
-continued
251 KKWSLKNGWY TTAGGDVSGR VYPGNKKFND MTAGVSGGIG FADRRKDAGL

301 AVFHERRTYG NDAYSYTNGA RLYFNRWQTP KWQTLSSAEW GRLKNTRRAR

351 SDNTHLQISN SLVFYRNARQ YWMGGLDFYR ERNPADRGDN FNRYGLRFAW

401 GQEWGGSGLS SLLRLGAAKR HYEKPGFFSG FKGERRRDKE LNTSLSLWHR

451 ALHFKGITPR LTLSHRETRS NDVFNEYEKN RAFVEFNKTF *
```

Computer analysis of this amino acid sequence gave the following results:

Homology with a Predicted ORF from *N. gonorrhoeae*

ORF 769 shows 95.1% identity over a 492 aa overlap with a predicted ORF (ORF 769) from *N. gonorrhoeae*

```
m769/g769    95.1% identity in 492 aa overlap 10        20        30        40        50        59
    g769.pep   LIMVIFYFYFCGKTFMPARNRWMLL-PLLASAAYAEETPCEPDLRSRPEFRLHEAEVKPI
               |||||||  ||||||||||||||| |||||||||||| ||||||||||||||||||||||
    m769       LIMVIFY--FCGKTFMPARNRWMLLLPLLASAAYAEETPREPDLRSRPEFRLHEAEVKPI
                      10        20        30        40        50

60        70        80        90       100       110       119
    g769.pep   DREKVPGQVREKGKVLQVDGETLLKNPELLSRAMYSAVVSNNIAGIRVILPIYLQQARQD
               |||||||||||||||||:||||||||||||||||||||||||||||||||||||||:||
    m769       DREKVPGQVREKGKVLQIDGETLLKNPELLSRAMYSAVVSNNIAGIRVILPIYLQQAQQD
                    60        70        80        90       100       110

120       130       140       150       160       170       179
    g769.pep   KMLALYAQGILAQAEGRVKEAVSHYRELIAAQPDAPAVRMRLAAALFEDRQNEAAADQFD
               ||||||||||||||:|||||||:||||||||||||||||||||||:|||||||||||||
    a769       KMLALYAQGILAQADGRVKEAISHYRELIAAQPDAPAVRMRLAAALFENRQNEAAADQFD
                   120       130       140       150       160       170

180       190       200       210       220       230       239
    g769.pep   RLKTEDLPPQLMEQVELYRKALRERDAWKVNGGFSVTREHNINQAPKQQQYGNWTFPKQV
               |||:|:|||||||||||||||||||||||||||||||||||||||||:||||:||||||
    m769       RLKAENLPPQLMEQVELYRKALRERDAWKVNGGFSVTREHNINQAPKRQQYGKWTFPKQV
                   180       190       200       210       220       230

240       250       260       270       280       290       299
    g769.pep   DGTAVNYRFGAEKKWSLKNGWYTTAGGDVSGRVYPGNKKFNDMTAGVSGGIGFADRRKDV
               |||||||||:||||||||||||||||||||||||||||||||||||||||||||||||:
    m769       DGTAVNYRLGAEKKWSLKNGWYTTAGGDVSGRVYPGNKKFNDMTAGVSGGIGFADRRKDA
                   240       250       260       270       280       290

300       310       320       330       340       350       359
    g769.pep   GLAVFHERRTYGNDAYSYANGARLYFNRWQTPRWQTLSSAEWGRLKNTRRARSDNTHLQI
               |||||||||||||||||||:||||||||||||| ||||||||||||||||||||||||
    m769       GLAVFHERRTYGNDAYSYTNGARLYFNRWQTPKWQTLSSAEWGRLKNTRRARSDNTHLQI
                   300       310       320       330       340       350

360       370       380       390       400       410       419
    g769.pep   SNSLVFYRNARQYWTGGLDFYRERNPADRGDNFNRYGLRFAWGQEWGGSGLSSSLFRLGVA
               ||||||||||||| |||||||||||||||||||||||||||||||||||||||:|||:|
    m769       SNSLVFYRNARQYWMGGLDFYRERNPADRGDNFNRYGLRFAWGQEWGGSGLSSLLRLGAA
                   360       370       380       390       400       410

420       430       440       450       460       470       479
    g769.pep   KRHYEKPGFFSSFKGERRRDKESDTSLSLWHRALHFKGITPRLTLSHRETWSNDVFNEYE
               |||||||||||:|||||||||| :|||||||||||||||||||||||||||:|||||||
    m769       KRHYEKPGFFSGFKGERRRDKELNTSLSLWHRALHFKGITPRLTLSHRETRSNDVFNEYE
                   420       430       440       450       460       470

480       490
    g769.pep   KNRAFVEFNKTFX
               |||||||||||||
    m769       KNRAFVEFNKTFX
                   490
```

The following partial DNA sequence was identified in *N. meningitidis* <SEQ ID 2643>:

```
a769.seq
    1  TTGATAATGG TTATTTTTTA TTTTTGTGGG AAGACATTTA TGCCTGCACG

51  AAACAGATGG ATGCTGCTGC TGCCTTTATT GGCAAGCGCG GCATATGCCG

101  AAGAAACACC GCGCGAACCG GATTTGAGAA GCCGTCCCGA GTTCAGGCTT

151  CATGAAGCGG AGGTCAAACC AATCGACAGG GAGAAGGTAC CGGGGCAGGT
```

-continued

```
 201 GCGGGAAAAA GGAAAAGTTT TGCAGATTGA CGGCGAAACC CTGCTGAAAA

251 ATCCCGAATT GCTGTCCCGC GCGATGTATT CCGCAGTGGT CTCAAACAAT

301 ATTGCCGGTA TCCGCGTTAT TTTGCCGATT TACCTACAAC AGGCGCAGCA

351 GGATAAGATG TTGGCACTTT ATGCACAAGG GATTTTGGCG CAGGCAGACG

401 GTAGGGTGAA GGAGGCGATT TCCCATTACC GGGAATTGAT TGTCGCCCAA

451 CCCGACGCGC CGCCGTCCG TATGCGTTTG GCGGCGGCAT TGTTTGAAAA

501 CAGGCAGAAC GAGGCGGCGG CAGACCAGTT CGACCGCCTG AAGGCGGAAA

551 ACCTGCCGCC GCAGCTGATG GAGCAGGTCG AGCTGTACCG CAAGGCATTG

601 CGCGAACGCG ATGCGTGGAA GGTAAATGGC GGCTTCAGCG TTACCCGCGA

651 ACACAATATC AACCAAGCCC CGAAACGGCA GCAGTACGGC AAATGGACTT

701 TCCCGAAACA GGTGGACGGC ACGGCGGTCA ATTACCGGCT CGGCGCGGAG

751 AAAAAATGGT CGCTGAAAAA CGGCTGGTAC ACGACGGCGG GCGGCGACGT

801 GTCCGGCAGG GTTTATCCGG GGAATAAGAA ATTCAACGAT ATGACGGCAG

851 GCGTTTCCGG CGGCATCGGT TTTGCCGACC GGCGCAAAGA TGCCGGGCTG

901 GCAGTGTTCC ACGAACGCCG CACCTACGGC AACGACGCTT ATTCTTACAC

951 CAACGGCGCA CGCCTTTATT TCAACCGTTG GCAAACCCCG AAATGGCAAA

1001 CGTTGTCTTC GGCGGAGTGG GGGCGTTTGA AGAATACGCG CCGGGCGCGT

1051 TCCGACAATA CCCATTTGCA AATTTCCAAT CGCTGGTGT TTTACCGGAA

1101 TGCGCGCCAA TATTGGATGG GCGGTTTGGA TTTTTACCGC GAGCGCAACC

1151 CCGCCGACCG GGGCGACAAT TTCAACCGTT ACGGCCTGCG CTTTGCCTGG

1201 GGGCAGGAAT GGGGCGGCAG CGGCCTGTCT TCGCTGTTGC GCCTCGGCGC

1251 GGCGAAACGG CATTATGAAA AACCCGGCTT TTTCAGCGGT TTTAAAGGGG

1301 AAAGGCGCAG GGATAAAGAA TTGAACACAT CCTTGAGCCT TTGGCACCGG

1351 GCATTGCATT TCAAAGGCAT CACGCCGCGC CTGACGTTGT CGCACCGCGA

1401 AACGCGGAGT AACGATGTGT TCAACGAATA CGAGAAAAAT CGGGCGTTTG

1451 TCGAGTTTAA TAAAACGTTC TGA
```

This corresponds to the amino acid sequence <SEQ ID 2644; ORF 769.a>:

```
a769.pep
  1 LIMVIFYFCG KTFMPARNRW MLLLPLLASA AYAEETPREP DLRSRPEFRL

51 HEAEVKPIDR EKVPGQVREK GKVLQIDGET LLKNPELLSR AMYSAVVSNN

101 IAGIRVILPI YLQQAQQDKM LALYAQGILA QADGRVKEAI SHYRELIVAQ

151 PDAPAVRMRL AAALFENRQN EAAADQFDRL KAENLPPQLM EQVELYRKAL

201 RERDAWKVNG GFSVTREHNI NQAPKRQQYG KWTFPKQVDG TAVNYRLGAE

251 KKWSLKNGWY TTAGGDVSGR VYPGNKKFND MTAGVSGGIG FADRRKDAGL

301 AVFHERRTYG NDAYSYTNGA RLYFNRWQTP KWQTLSSAEW GRLKNTRRAR

351 SDNTHLQISN SLVFYRNARQ YWMGGLDFYR ERNPADRGDN FNRYGLRFAW

401 GQEWGGSGLS SLLRLGAAKR HYEKPGFFSG FKGERRRDKE LNTSLSLWHR

451 ALHFKGITPR LTLSHRETRS NDVFNEYEKN RAFVEFNKTF *
```

Computer analysis of this amino acid sequence gave the following results:

Homology with a Predicted ORF from *N. meningitidis*
ORF 769 shows 99.8% identity over a 490 aa overlap with a predicted ORF (ORF 769) from *N. meningitidis*:

```
a769/a769    99.8% identity in 490 aa overlap 10        20        30        40        50        60
a769.pep  LIMVIFYFCGKTFMPARNRWMLLLPLLASAAYAEETPREPDLRSRPEFRLHEAEVKPIDR
          ||||||||||||||||||||||||||||||||||||||||||||||||||||||||||||
m769      LIMVIFYFCGKTFMPARNRWMLLLPLLASAAYAEETPREPDLRSRPEFRLHEAEVKPIDR
                  10        20        30        40        50        60

70        80        90       100       110       120
a769.pep  EKVPGQVREKGKVLQIDGETLLKNPELLSRAMYSAVVSNNIAGIRVILPIYLQQAQQDKM
          ||||||||||||||||||||||||||||||||||||||||||||||||||||||||||||
m769      EKVPGQVREKGKVLQIDGETLLKNPELLSRAMYSAVVSNNIAGIRVILPIYLQQAQQDKM
                  70        80        90       100       110       120

130       140       150       160       170       180
a769.pep  LALYAQGILAQADGRVKEAISHYRELIVAQPDAPAVRMRLAAALFENRQNEAAADQFDRL
          |||||||||||||||||||||||||||||||:||||||||||||||||||||||||||||
m769      LALYAQGILAQADGRVKEAISHYRELIAAQPDAPAVRMRLAAALFENRQNEAAADQFDRL
                 130       140       150       160       170       180

190       200       210       220       230       240
a769.pep  KAENLPPQLMEQVELYRKALRERDAWKVNGGFSVTREHNINQAPKRQQYGKWTFPKQVDG
          ||||||||||||||||||||||||||||||||||||||||||||||||||||||||||||
m769      KAENLPPQLMEQVELYRKALRERDAWKVNGGFSVTREHNINQAPKRQQYGKWTFPKQVDG
                 190       200       210       220       230       240

250       260       270       280       290       300
a769.pep  TAVNYRLGAEKKWSLKNGWYTTAGGDVSGRVYPGNKKFNDMTAGVSGGIGFADRRKDAGL
          ||||||||||||||||||||||||||||||||||||||||||||||||||||||||||||
m769      TAVNYRLGAEKKWSLKNGWYTTAGGDVSGRVYPGNKKFNDMTAGVSGGIGFADRRKDAGL
                 250       260       270       280       290       300

310       320       330       340       350       360
a769.pep  AVFHERRTYGNDAYSYTNGARLYFNRWQTPKWQTLSSAEWGRLKNTRRARSDNTHLQISN
          ||||||||||||||||||||||||||||||||||||||||||||||||||||||||||||
m769      AVFHERRTYGNDAYSYTNGARLYFNRWQTPKWQTLSSAEWGRLKNTRRARSDNTHLQISN
                 310       320       330       340       350       360

370       380       390       400       410       420
a769.pep  SLVFYRNARQYWMGGLDFYRERNPADRGDNFNRYGLRFAWGQEWGGSGLSSLLRLGAAKR
          ||||||||||||||||||||||||||||||||||||||||||||||||||||||||||||
m769      SLVFYRNARQYWMGGLDFYRERNPADRGDNFNRYGLRFAWGQEWGGSGLSSLLRLGAAKR
                 370       380       390       400       410       420

430       440       450       460       470       480
a769.pep  HYEKPGFFSGFKGERRRDKELNTSLSLWHRALHFKGITPRLTLSHRETRSNDVFNEYEKN
          ||||||||||||||||||||||||||||||||||||||||||||||||||||||||||||
m769      HYEKPGFFSGFKGERRRDKELNTSLSLWHRALHFKGITPRLTLSHRETRSNDVFNEYEKN
                 430       440       450       460       470       480

490
a769.pep  RAFVEFNKTFX
          |||||||||||
m769      RAFVEFNKTFX
                 490
```

The following partial DNA sequence was identified in *N. gonorrhoeae* <SEQ ID 2645>:

```
g770.seq
   1 ATGAACAGAC TGCTACTGCT GTCTGCCGCC GTCCTGCCGA CTGCCTGCGG

51 CAGCGGCGAA ACCGATAAAA TCGGACGGGC AAGTACCGTT TTCAACATGT

101 TGGGCAAAAA CGACCGTATC GAAGTGGAAG GATTCGACGA TCCCGACGTT

151 CAAGGGGTTG CCTGTTATAT TTCGTATGCA AAAAAGGCG GCTTGAAGGA

201 AATGGTCAAT TTGGAAGAGG ACGCGTCCGA CGCATCGGTT TCGTGCGTTC

251 AGACGGCATC TTCGATTTCT TTTGACGAAA CCGCCGTGCG CAAACCGAAA

301 GAAGTTTTCA AGCGCGGTAC GGGCTTCGCG TTCAAGAGCC GGCAGATTGT

351 CCGTTATTAC GACCCCAAAC GCAAAGCCTT CGCCTATTTG GTTTACAGCG

401 ATAAAATCGT CCAAGGATCG CCGAAAAATT CCTTAAGCGC GGTTTCCTGT

451 TTCGGCAGCG GCATACCGCA AACCGACGGG GTGCAAGCCG ATACTTCCGG
```

-continued

```
501 CAAACTGCTT GCCGGCGCCT GCATTATTTC CAACCCGATA AAAAATCCCG

551 ACAAACGCTG A
```

This corresponds to the amino acid sequence <SEQ ID 2646; ORF 770.ng>:

```
g770.pep
   1 MNRLLLLSAA VLPTACGSGE TDKIGRASTV FNMLGKNDRI EVEGFDDPDV

51 QGVACYISYA KKGGLKEMVN LEEDASDASV SCVQTASSIS FDETAVRKPK

101 EVFKRGTGFA FKSRQIVRYY DPKRKAFAYL VYSDKIVQGS PKNSLSAVSC

151 FGSGIPQTDG VQADTSGKLL AGACIISNPI KNPDKR*
```

The following partial DNA sequence was identified in *N. meningitidis* <SEQ ID 2647>:

```
m770.seq
   1 ATGAACAGAC TGCTACTGCT GTCTGCCGCC GTCCTGCTGA CTGCCTGCGG

51 CAGCGGCGAA ACCGATAAAA TCGGACGGGC AAGTACCGTT TTCAACATAC

101 TGGGCAAAAA CGACCGTATC GAAGTGGAAG GATTCGACGA TCCCGACGTT

151 CAAGGGGTTG CCTGTTATAT TTCGTATGCA AAAAAGGCG GCTTGAAGGA

201 AATGGTCAAT TTGGAAGAGG ACGCGTCCGA CGCATCGGTT TCGTGCGTTC

251 AGACGGCATC TTCGATTTCT TTTGACGAAA CCGCCGTGCG CAAACCGAAA

301 GAAGTTTTCA AACACGGTGC GAGCTTCGCG TTCAAGAGCC GGCAGATTGT

351 CCGTTATTAC GACCCCAAAC GCAAAACCTT CGCCTATTTG GTGTACAGCG

401 ATAAAATCAT CCAAGGCTCG CCGAAAAATT CCTTAAGCGC GGTTTCCTGT

451 TTCGGCGGCG GCATACCGCA AACCGATGGG GTGCAAGCCG ATACTTCCGG

501 CAACCTGCTT GCCGGCGCCT GCATGATTTC CAACCCGATA GAAAATCTCG

551 ACAAACGCTG A
```

This corresponds to the amino acid sequence <SEQ ID 2648; ORF 770>:

```
m770.pep
   1 MNRLLLLSAA VLLTACGSGE TDKIGRASTV FNILGKNDRI EVEGFDDPDV

51 QGVACYISYA KKGGLKEMVN LEEDASDASV SCVQTASSIS FDETAVRKPK

101 EVFKHGASFA FKSRQIVRYY DPKRKTFAYL VYSDKIIQGS PKNSLSAVSC

151 FGGGIPQTDG VQADTSGNLL AGACMISNPI ENLDKR*
```

Computer analysis of this amino acid sequence gave the following results:
Homology with a Predicted ORF from *N. gonorrhoeae*
ORF 770 shows 93.5% identity over a 186 aa overlap with a predicted ORF (ORF 770) from *N. gonorrhoeae*

```
     m770/g770   93.5% identity in 186 aa overlap 10        20        30        40        50        60
     g770.pep   MNRLLLLSAAVLPTACGSGETDKIGRASTVFNMLGKNDRIEVEGFDDPDVQGVACYISYA
                ||||||||||| |||||||||||||||||||: ||||||||||||||||||||||||||
     m770       MNRLLLLSAAVLLTACGSGETDKIGRASTVFNILGKNDRIEVEGFDDPDVQGVACYISYA
                      10        20        30        40        50        60
```

```
               70         80         90        100        110        120
g770.pep   KKGGLKEMVNLEEDASDASVSCVQTASSISFDETAVRKPKEVFKRGTGFAFKSRQIVRYY
           ||||||||||||||||||||||||||||||||||||||||||:|::|||||||||||||
m770       EKVPGQVREKGKVLQIDGETLLKNPELLSRAMYSAVVSNNIAGIRVILPIYLQQAQQDKM
               70         80         90        100        110        120

130        140        150        160        170        180
g770.pep   DPKRKAFAYLVYSDKIVQGSPKNSLSAVSCFGSGIPQTDGVQADTSGKLLAGACIISNPI
           |||||:||||||||||:|||||||||||||||:|||||||||||||||:||||||:||||
m770       DPKRKTFAYLVYSDKIIQGSPKNSLSAVSCFGGGIPQTDGVQADTSGNLLAGACMISNPI
              130        140        150        160        170        180 g770.pep   KNPDKRX
           :| ||||
m770       ENLDKRX
```

The following partial DNA sequence was identified in *N. meningitidis* <SEQ ID 2649>:

```
a770.seq
   1 ATGAACAGAC TGCTACTGCT GTCTGCCGCC GTCCTGCTGA CTGCCTGCGG

51 CAGCGGCGAA ACCGATAAAA TCGGACGGGC AAGTACCGTT TTCAACATAC

101 TGGGCAAAAA CGACCGTATC GAAGTGGAAG GATTCGACGA TCCCGACGTT

151 CAAGGGGTTG CCTGTTATAT TTCGTATGCA AAAAAAGGCG GCTTGAAGGA

201 AATGGTCAAT TTGGAAGAGG ACGCGTCCGA CGCATCGGTT TCGTGCGTTC

251 AGACGGCATC TTCGATTTCT TTTGACGAAA CCGCCGTGCG CAAACCGAAA

301 GAAGTTTTCA AACACGGTGC GAGCTTCGCG TTCAAGAGCC GGCAGATTGT

351 CCGTTATTAC GACCCCAAAC GCAAAACCTT CGCCTATTTG GTGTACAGCG

401 ATAAAATCAT CCAAGGCTCG CCGAAAAATT CCTTAAGCGC GGTTTCCTGT

451 TTCGGCGGCG GCATACCGCA AACCGATGGG GTGCAAGCCG ATACTTCCGG

501 CAACCTGCTT GCCGGCGCCT GCATGATTTC CAACCCGATA GAAAATCCCG

551 ACAAACGCTG A
```

This corresponds to the amino acid sequence <SEQ ID 2650; ORF 770.a>:

```
a770.pep
   1 MNRLLLLSAA VLLTACGSGE TDKIGRASTV FNILGKNDRI EVEGFDDPDV

51 QGVACYISYA KKGGLKEMVN LEEDASDASV SCVQTASSIS FDETAVRKPK

101 EVFKHGASFA FKSRQIVRYY DPKRKTFAYL VYSDKIIQGS PKNSLSAVSC

151 FGGGIPQTDG VQADTSGNLL AGACMISNPI ENPDKR*
```

Computer analysis of this amino acid sequence gave the following results:
Homology with a Predicted ORF from *N. meningitidis*
ORF 770 shows 99.5% identity over a 186 aa overlap with a predicted ORF (ORF 770) from *N. meningitidis*:

```
   m770/a770   99.5% identity in 186 aa overlap 10         20         30         40         50         60
   a770.pep   MNRLLLLSAAVLLTACGSGETDKIGRASTVFNILGKNDRIEVEGFDDPDVQGVACYISYA
              ||||||||||||||||||||||||||||||||||||||||||||||||||||||||||||
   m770       MNRLLLLSAAVLLTACGSGETDKIGRASTVFNILGKNDRIEVEGFDDPDVQGVACYISYA
                    10         20         30         40         50         60

70         80         90        100        110        120
   a770.pep   KKGGLKEMVNLEEDASDASVSCVQTASSISFDETAVRKPKEVFKHGASFAFKSRQIVRYY
              ||||||||||||||||||||||||||||||||||||||||||||||||||||||||||||
   m770       KKGGLKEMVNLEEDASDASVSCVQTASSISFDETAVRKPKEVFKHGASFAFKSRQIVRYY
                    70         80         90        100        110        120
```

```
                    130        140        150        160        170        180
a770.pep   DPKRKTFAYLVYSDKIIQGSPKNSLSAVSCFGGGIPQTDGVQADTSGNLLAGACMISNPI
           ||||||||||||||||||||||||||||||||||||||||||||||||||||||||||||
m770       DPKRKTFAYLVYSDKIIQGSPKNSLSAVSCFGGGIPQTDGVQADTSGNLLAGACMISNPI
                    130        140        150        160        170        180 a770.pep   ENPDKRX
           || ||||
m770       ENLDKRX
```

The following partial DNA sequence was identified in *N. gonorrhoeae* <SEQ ID 2651>:

```
g771.seq
   1 ATGGATTTAT TATCGGTTTT CCACAAATAC CGTCTGAAAT ATGCGGTGGC

51 GGTGCTGACG ATGCTGCTTT TGGCGGCAGT CGGGCTGCAC GCTTCCGTAT

101 ATCGCACCTT CACGCCCGAA AACATCCGCA GCCGCCTCCA ACAAAGCATT

151 GCCCATACCC ACCGGAAAAT CTCGTTTGAT GCGGATATAC GGCGCAGGCT

201 TCTGCCCCGC CCGACCGTCA TCCTGAAAAA CCTGACCATT ACCGAACCCG

251 ACGGCGGCCG GGTCGCCGTT TCCGTCAAAG AAACCAAAAT CGGATTGAGC

301 TGGAAAAACC TGTGGTCGGA TCGGATACAG GTTGAAAAAT GGGTGGTTTC

351 GGGTGCGGAT CTTGCCCTGA CGCGCGACAG AAACGGCGCT TGGAACATCC

401 AAGACCTGTT CGACGGCGCG AAACACTCCG CCTCAGTCAA CCGCATTATC

451 GTCGAAAACA GCACCGTCCG CCTCAATTTC CTGCAGCAAC AGCTTATCCT

501 GAAGGAAATC AGCCTCAACC TGCAATCCCC CGATTCGTCG GGGCAGCAGT

551 TTGAAAGTTC GGGCATACTG GTTTGGAGAA AGCTGTCCGT CCCGTGGAAA

601 AGCAGGGGGC TGTTCCTTTC AGACGGCATC GGCACGCCCG AAATCTCACC

651 GTTCCATTTT GAAGCTTCCA CTTCGCTGGA CGGACACGGC ATCACCATTT

701 CCACCACCGG CAGCCCTTCT GTCCGCTTCA ACGCCGGCGG AGCGGATGCC

751 GCCGGCCTCG GCCTGCGTGC AGACACTTCC TTCCGCAACC TCCACCTGAC

801 CGCGCAAATC CCCGCACTGG CACTCAAAAA CAACAGCATC AAAACCGGCA

851 CGGTCAACGG CACGTTTACC GCCGGCGGCG AATATGCCCG ATGGGACGGT

901 TCGTTCAAAC TCGACAAAGC CAACCTGCAC TCCGGCATCG CCAACATCGG

951 CAACGCCGAA ATCTCCGGCA GCTTCAAAAC ACCGCGCCTT CAAACCAATT

1001 TCTCCCTCGG CTCGCCGTTG GTTTGGAGTC GGGACAACGG GCTGGACGCC

1051 CCGCGCCTGC ACATATCGAC CCTTCAGGAT ACCGTCGACC GCCTGCCGCA

1101 ACCCCGTTTC ATCAGCCGGC TCGACGGTTC GCTGTCCATA CCGAATCTGC

1151 AAAATTGGAA TGCCGAATTA AACGGCACAT TCGACCGCCA ACCCGTTGCC

1201 GCAAAATTCA AATATACGCG GGAAGGCGCA CCGCACCTGG AAGCCGCCGC

1251 CGCGCTGCAA AAATTAAACC TCGCCCCCTA TCTTGACGAA TTTCGGCAAC

1301 AAAACGGCAA AATATTCCCC GACATCCTCG GCAGGCTGTC CGGCAACGTC

1351 GAGGCACACC TCAAAATCGG CAGCATCCAA CTCCCCGGCT TGCAACTGGA

1401 CGATATGGAA ACCTACCTCC ACGCCGACAA AGACCATATC GCGCTCAGCC

1451 GTTTCAAGTC AGGGCTTTAC GGCGGCCATA CCGAAGGCGG CATCAGCATC

1501 GCCAACACCC GTCCCGCCAC TTACCGCCTG CAACAGAATG CAAGCAACAT

1551 CCAAATCCAA CCGCTGCTGC AAGACCTGTT CGGCTTCCAC AGCTTCAGCG
```

-continued

```
1601 GCAACGGCGA TGCGGTCATC GACCTGACCG CAAGCGGCGA AAACCGCAAA

1651 CAGCTTATCC GCTCGCTGCA AGGCAGCCTG TCGCTGAATA TTTCCAACGG

1701 CGCGTGGCAC GGCATCGATA TGGACAGCAT TTTAAAAAAC GGCCTTTCCG

1751 GGAAAATCTC GGGCAGCACA CCCTTCTACC GATTCACGCT CAACAGCGAA

1801 ATTTCAGACG GCATCAGCCG CCACATCGAT ACCGAACTCT TCTCCGACAG

1851 CCTCTATGTT ACCAGCAACG GCTATACCAA TCTGGATACG CAGGAATTGT

1901 CTGAAGATGT CCTTATCCGC AACGCCGTCC ATCCGAAAAA CAAACCGATT

1951 CCCCTGAAAA TCACCGGTAC GGTGGACAAG CCGTCCATTA CCGTCGATTA

2001 CGGCAGGCTG ACCGGCGGCA TCAATTCGCG CAAAGAGAAA CAGAAAATCC

2051 TCGAAGACAC CCTGCTGGAA CAATGGCAGT GGCTCAAACC TAAAGAACCG

3051 TAA
```

This corresponds to the amino acid sequence <SEQ ID 2652; ORF 771.ng>:

```
g771.pep
   1 MDLLSVFHKY RLKYAVAVLT MLLLAAVGLH ASVYRTFTPE NIRSRLQQSI

51 AHTHRKISFD ADIRRRLLPR PTVILKNLTI TEPDGGRVAV SVKETKIGLS

101 WKNLWSDRIQ VEKWVVSGAD LALTRDRNGA WNIQDLFDGA KHSASVNRII

151 VENSTVRLNF LQQQLILKEI SLNLQSPDSS GQQFESSGIL VWRKLSVPWK

201 SRGLFLSDGI GTPEISPFHF EASTSLDGHG ITISTTGSPS VRFNAGGADA

251 AGLGLRADTS FRNLHLTAQI PALALKNNSI KTGTVNGTFT AGGEYARWDG

301 SFKLDKANLH SGIANIGNAE ISGSFKTPRL QTNFSLGSPL VWSRDNGLDA

351 PRLHISTLQD TVDRLPQPRF ISRLDGSLSI PNLQNWNAEL NGTFDRQPVA

401 AKFKYTREGA PHLEAAAALQ KLNLAPYLDE FRQQNGKIFP DILGRLSGNV

451 EAHLKIGSIQ LPGLQLDDME TYLHADKDHI ALSRFKSGLY GGHTEGGISI

501 ANTRPATYRL QQNASNIQIQ PLLQDLFGFH SFSGNGDAVI DLTASGENRK

551 QLIRSLQGSL SLNISNGAWH GIDMDSILKN GLSGKISGST PFYRFTLNSE

601 ISDGISRHID TELFSDSLYV TSNGYTNLDT QELSEDVLIR NAVHPKNKPI

651 PLKITGTVDK PSITVDYGRL TGGINSRKEK QKILEDTLLE QWQWLKPKEP

701 *
```

The following partial DNA sequence was identified in *N. meningitidis* <SEQ ID 2653>:

```
m771.seq
   1 ATGGATTTAT TATCGGTTTT CCACAAATAC CGTCTGAAAT ATGCGGTGGC

51 CGTGCTGACG ATACTGCTTT TGGCGGCAGT CGGGCTGCAC GCTTCCGTAT

101 ATCGCACCTT CACGCCTGAA AACATCCGCA GCCGCCTACA ACAAAGCATT

151 GCACACACAC ACCGGAAAAT CTCGTTTGAT GCGGACATTC AGCGCAGGCT

201 CCTGCCCCGG CCGACCGTCA TCCTGAAAAA CCTGACCATT ACCGAACCCG

251 GCGGCGACCA GACTGCCGTT TCCGTCCAAG AAACCAAAAT CGGATTGAGC

301 TGGAAAAACC TGTGGTCGGA TCAGATACAG ATTGAAAAAT GGGTGGTTTC

351 GAGTGCGGAA CTTGCCCTGA CGCGCGACGG GAAAGGTGTT TGGAACATCC
```

-continued

```
 401 AAGACCTGAT CGACAGCCAA AAACGCCAAG CCTCAGTCAA CCGCATTATC

451 GTCGAAAACA GCACCGTCCG CCTCAATTTC CTGCAGGAAC AGCTTATCCT

501 GAAGGAAATC AACCTCAACC TGCAATCCCC CGATTCGTCG GGGCAGCCGT

551 TTGAAAGTTC GGGCATACTG GTTTGGGGAA AGCTGTCCGT CCCGTGGAAA

601 AGCAGGGGGC TGTTCCTTTC AAACGGCATC GGCCCGCCCG AAATCTCACC

651 GTTCCATTTT GAAGCTTCCA CTTCGCTGGA CGGACACGGC ATTACCATTT

701 CCACCACCGG CAGCCCTTCT GTCCGCTTCA ACGCCGGCGG AGCGGATGCC

751 GCCGGCCTCG GCCTGCGTGC AGACACTTCC TTCCGCAACC TCCACCTGAC

801 CGCCCAAATC CCCGCGCTGG CACTCAGGAA CAACAGCATT AAAATTGAAA

851 CCGTCAACGG CGCATTTACC GCCGGCGGCG AATATGCCCG ATGGGACGGT

901 TCGTTCAAAC TCGACAAAGC CAACCTGCAC TCCGGCATCG CCAACATCGG

951 CAACGCCGAA ATCTCCGGCA GCTTCAAAAC ACCGCGCCAC CAGACCAACT

1001 TCTCCCTCAA TTCGCCGCTC GTATGGACGG AAAACAAAGG GCTGGACGCG

1051 CCGCGCCTGT ATGTATCGAC CCTTCAGGAT ACCGTCAACC GCCTGCCGCA

1101 ACCCGTTTC ATCAGCCGGC TCGACGGTTC GCTGTCCGTA CCGAATCTGC

1151 AAAATTGGAA TGCCGAATTA ACGGCACAT TCGACCGCCA AACCGTTGCC

1201 GCGAAATTCA GATACACACA TGAAGACGCA CCGCATCTGG AAGCCGCCGT

1251 CGCACTGCAA AAATTGAACC TGACCCCCTA TCTTGACGAC GTGCGGCAAC

1301 AAAACGGCAA AATATTTCCC GACACCCTCG CCAAGCTGTC CGGCGACATC

1351 GAGGCGCACC TGAAAATCGG AAAAGTCCAA CTTCCCGGCC TGCAACTGGA

1401 CGATATGGAA ACCTACCTCC ACGCCGACAA AGGCCATATC GCGCTCAGCC

1451 GTTTCAAGTC AGGGCTTTAC GGCGGCCATA CCGAAGGCGG CATCAGCATC

1501 GCCAACACCC GTCCCGCCAC TTACCGCCTG CAACAGAATG CAAGCAACAT

1551 CCAAATCCAA CCGCTGCTGC AAGACCTGTT CGGCTTCCAC AGCTTCAGCG

1601 GCAACGGCGA CGCGGTCATC GACCTGACCG CGGGCGGCGA AACCCGAAAA

1651 GAGCTTATCC GCTCGCTTCA GGGCAGCCTG TCGCTAAATA TTTCCAACGG

1701 TGCATGGCAC GGTATCGACA TGGACAATAT CCTGAAAAAC GGCATTTCGG

1751 GCAAAACTGC CGACAATGCC GCACCCAGCA CACCCTTCCA CCGATTCACG

1801 CTCAACAGCG AAATTTCAGA CGGCATCAGC CGCCACATCG ATACCGAACT

1851 CTTCTCCGAC AGCCTCTATG TTACCAGCAA CGGCTATACC AATCTGGATA

1901 CGCAGGAATT GTCTGAAGAT GTCCTTATCC GCAACGCCGT CCATCCGAAA

1951 AACAAACCGA TTCCCCTGAA AATCACCGGC ACGGTGGACA AACCGTCCAT

2001 TACCGTCGAT TACGGCAGGC TGACCGGCGG CATCAATTCG CGCAAAGAGA

2051 AACAGAAAAT CCTCGAAGAC ACCCTGCTGG AACAATGGCA GTGGCTCAAA

2101 CCTAAAGAAC CGTA
```

This corresponds to the amino acid sequence <SEQ ID 2654; ORF 771>:

```
m771.pep
   1 MDLLSVFHKY RLKYAVAVLT ILLLAAVGLH ASVYRTFTPE NIRSRLQQSI

51 AHTHRKISFD ADIQRRLLPR PTVILKNLTI TEPGGDQTAV SVQETKIGLS
```

```
101 WKNLWSDQIQ IEKWVVSSAE LALTRDGKGV WNIQDLIDSQ KRQASVNRII

151 VENSTVRLNF LQEQLILKEI NLNLQSPDSS GQPFESSGIL VWGKLSVPWK

201 SRGLFLSNGI GPPEISPFHF EASTSLDGHG ITISTTGSPS VRFNAGGADA

251 AGLGLRADTS FRNLHLTAQI PALALRNNSI KIETVNGAFT AGGEYARWDG

301 SFKLDKANLH SGIANIGNAE ISGSFKTPRH QTNFSLNSPL VWTENKGLDA

351 PRLYVSTLQD TVNRLPQPRF ISRLDGSLSV PNLQNWNAEL NGTFDRQTVA

401 AKFRYTHEDA PHLEAAVALQ KLNLTPYLDD VRQQNGKIFP DTLAKLSGDI

451 EAHLKIGKVQ LPGLQLDDME TYLHADKGHI ALSRFKSGLY GGHTEGGISI

501 ANTRPATYRL QQNASNIQIQ PLLQDLFGFH SFSGNGDAVI DLTAGGETRK

551 ELIRSLQGSL SLNISNGAWH GIDMDNILKN GISGKTADNA APSTPFHRFT

601 LNSEISDGIS RHIDTELFSD SLYVTSNGYT NLDTQELSED VLIRNAVHPK

651 NKPIPLKITG TVDKPSITVD YGRLTGGINS RKEKQKILED TLLEQWQWLK

701 PKEP*
```

Computer analysis of this amino acid sequence gave the following results:

Homology with a Predicted ORF from *N. gonorrhoeae*

ORF 771 shows 90.3% identity over a 704 aa overlap with a predicted ORF (ORF 771) from *N. gonorrhoeae*

```
m771/g771   90.3% identity in 704 aa overlap 10         20         30         40         50         60
g771.pep  MDLLSVFHKYRLKYAVAVLTMLLLAAVGLHASVYRTFTPENIRSRLQQSIAHTHRKISFD
          ||||||||||||||||||||:|||||||||||||||||||||||||||||||||||||||
m771      MDLLSVFHKYRLKYAVAVLTILLLAAVGLHASVYRTFTPENIRSRLQQSIAHTHRKISFD
                10         20         30         40         50         60

70         80         90        100        110        120
g771.pep  ADIRRRLLPRPTVILKNLTITEPDGGRVAVSVKETKIGLSWKNLWSDRIQVEKWVVSGAD
          |||:||||||||||||||||||||| |::||||:||||||||||||||:||:||||||:
m771      ADIQRRLLPRPTVILKNLTITEPGGDQTAVSVQETKIGLSWKNLWSDQIQIEKWVVSSAE
                70         80         90        100        110        120

130        140        150        160        170        180
g771.pep  LALTRDRNGAWNIQDLFDGAKHSASVNRIIVENSTVRLNFLQQQLILKEISLNLQSPDSS
          ||||||:|:||||||:|:  |::|||||||||||||||||:||||||:||||||||||
m771      LALTRDGKGVWNIQDLIDSQKRQASVNRIIVENSTVRLNFLQEQLILKEINLNLQSPDSS
               130        140        150        160        170        180

190        200        210        220        230        240
g771.pep  GQQFESSGILVWRKLSVPWKSRGLFLSDGIGTPEISPFHFEASTSLDGHGITISTTGSPS
          ||  ||||||||| ||||||||||||:||| |||||||||||||||||||||||||||
m771      GQPFESSGILVWGKLSVPWKSRGLFLSNGIGPPEISPFHFEASTSLDGHGITISTTGSPS
               190        200        210        220        230        240

250        260        270        280        290        300
g771.pep  VRFNAGGADAAGLGLRADTSFRNLHLTAQIPALALKNNSIKTGTVNGTFTAGGEYARWDG
          ||||||||||||||||||||||||||||||||||:||||| ||| |||||||||||||
m771      VRFNAGGADAAGLGLRADTSFRNLHLTAQIPALALRNNSIKIETVNGAFTAGGEYARWDG
               250        260        270        280        290        300

310        320        330        340        350        360
g771.pep  SFKLDKANLHSGIANIGNAEISGSFKTPRLTNFSLGSPLVWSRDNGLDAPRLHISTLQD
          ||||||||||||||||||||||||||||| ||||||:||||:::::||||||::|||||
m771      SFKLDKANLHSGIANIGNAEISGSFKTPRHQTNFSLNSPLVWTENKGLDAPRLYVSTLQD
               310        320        330        340        350        360

370        380        390        400        410        420
g771.pep  TVDRLPQPRFISRLDGSLSIPNLQNWNAELNGTFDRQPVAAKFKYTREGAPHLEAAAALQ
          ||:|||||||||||||||| |||||||||||||||| |||||||:||:|||||||:|||
m771      TVNRLPQPRFISRLDGSLSVPNLQNWNAELNGTFDRQTVAAKFRYTHEDAPHLEAAVALQ
               370        380        390        400        410        420
```

-continued

```
                   430       440       450       460       470       480
g771.pep    KLNLAPYLDEFRQQNGKIFPDILGRLSGNVEAHLKIGSIQLPGLQLDDMETYLHADKDHI
            ||||:||||: |||||||||| |::|||::|||||||::|||||||||||||||||| ||
m771        KLNLTPYLDDVRQQNGKIFPDTLAKLSGDIEAHLKIGKVQLPGLQLDDMETYLHADKGHI
                   430       440       450       460       470       480

490       500       510       520       530       540
g771.pep    ALSRFKSGLYGGHTEGGISIANTRPATYRLQQNASNIQIQPLLQDLFGFHSFSGNGDAVI
            ||||||||||||||||||||||||||||||||||||||||||||||||||||||||||||
m771        ALSRFKSGLYGGHTEGGISIANTRPATYRLQQNASNIQIQPLLQDLFGFHSFSGNGDAVI
                   490       500       510       520       530       540

550       560       570       580           590
g771.pep    DLTASGENRKQLIRSLQGSLSLNISNGAWHGIDMDSILKNGLSGKISG----STPFYRFT
            ||||:||:||:||||||||||||||||||||||||:|||||:||| :      ||||:|||
m771        DLTAGGETRKELIRSLQGSLSLNISNGAWHGIDMDNILKNGISGKTADNAAPSTPFHRFT
                   550       560       570       580       590       600

600       610       620       630       640       650
g771.pep    LNSEISDGISRHIDTELFSDSLYVTSNGYTNLDTQELSEDVLIRNAVHPKNKPIPLKITG
            ||||||||||||||||||||||||||||||||||||||||||||||||||||||||||||
m771        LNSEISDGISRHIDTELFSDSLYVTSNGYTNLDTQELSEDVLIRNAVHPKNKPIPLKITG
                   610       620       630       640       650       660

660       670       680       690       700
g771.pep    TVDKPSITVDYGRLTGGINSRKEKQKILEDTLLEQWQWLKPKEPX
            |||||||||||||||||||||||||||||||||||||||||||||
m771        TVDKPSITVDYGRLTGGINSRKEKQKILEDTLLEQWQWLKPKEPX
                   670       680       690       700
```

The following partial DNA sequence was identified in *N. meningitidis* <SEQ ID 2655>:

```
a771.seq
   1 ATGGATTTAT TATCGGTCTT CCACAAATAC CGTCTGAAAT ATGCGGTAGC

51 CGTGCTGACG ATACTGCTTT TGGCGGCAAT CGGGCTGCAC GCTTCCGTAT

101 ATCGCATCTT CACACCTGAA AACATCCGAA GCCGCCTCCA ACAAAGCATT

151 GCCCATACGC ACCGGAAAAT CTCGTTTGAT GCGGATATAC AGCGCAGGCT

201 TCTGCCCCGG CCGACCGTCA TCCTGAAAAA CCTGACCATT ACCGAACCCG

251 GCGGCGACCG GACTGCCGTT TCCGTCCAAG AAACCAAAAT CGGATTGAGC

301 TGGAAAAACC TGTGGTCGGA TCAGATACAG ATTGAAAAAT GGGTGGTTTC

351 GAGTGCGGAA CTTGCCCTGA CGCGCGACGG GAAAGGTGTT TGGAACATCC

401 AAGACCTGAT CGACAGCCAA AAACGCCAAG CCTCAGTCAA CCGCATTATC

451 GTCGAAAACA GCACCGTCCG CCTCAATTTC CTGCAGGAAC AGCTTATCCT

501 GAAGGAAATC AACCTCAACC TGCAATCCCC CGATTCGTCG GGGCAGCCGT

551 TTGAAAGTTC GGGCATACTG GTTTGGGGAA AGCTGTCCGT CCCGTGGAAA

601 AGCAGGGGGC TGTTCCTTTC AGACGGCATC GGCACGCCCA AAATCTCACC

651 GTTCCATTTT GAAGCTTCCA CTTCGCTGGA CGGACACGGC ATTACCATTT

701 CCACCACCGG CAGCCCTTCT GTCCGCTTCA ACGCCGGCGG AGCGGATGCC

751 GCCGGCCTCG GCCTGCGTGC AGACACTTCC TTCCGCAACC TCCACCTGAC

801 CGCCCAAATC CCTACGCTGG CACTCAGGAA CAACAGCATT AAAATTGAAA

851 CCGTCAACGG CGCATTTACC GCCGGCGGCG AATATGCCCA ATGGGACGGT

901 TCGTTCAAAC TCGACAAAGC CAACCTGCAC TCCGGCATCG CCAACATCGG

951 CAACGCCGAA ATCTCCGGCA GCTTCAAAAC ACCGCGCCAC CAGACCAACT

1001 TCTCCCTCAA TTCGCCGCTC GTATGGACGG AAAACAAAGG GCTGGACGCG
```

```
-continued
1051 CCGCGCCTGT ATGTATCGAC CCTTCAGGAT ACCGTCAACC GCCTGCCGCA

1101 ACCCCGTTTC ATCAGCCGGC TCGACGGTTC GCTGTCCGTA CCGAATCTGC

1151 AAAATTGGAA TGCCGAATTA AACGGCACAT TCGACCGCCA AACCGTTGCC

1201 GCGAAATTCA GATACACACA TGAAGACGCA CCGCATCTGG AAGCCGCCGT

1251 CGCACTGCAA AAATTGAACC TGACCCCCTA TCTTGACGAC GTGCGGCAAC

1301 AAAACGGCAA ATATTTCCCC GACACCCTCG CCAAGCTGTC CGGCGACATC

1351 GAGGCGCACC TGAAAATCGG AAAAGTCCAA CTTCCCGGCC TGCAACTGGA

1401 CGATATGGAA ACCTACCTCC ACGCCGACAA AGGCCATATC GCGCTCAGCC

1451 GTTTCAAGTC AGGGCTTTAC GGCGGCCATA CCGAAGGCGG CATCAGCATC

1501 GCCAACACCC GTCCCGCCAC TTACCGCCTG CAACAGAATG CAAGCAACAT

1551 CCAAATCCAA CCGCTGCTGC AAGACCTGTT CGGCTTCCAC AGCTTCAGCG

1601 GCAACGGCGA CGCGGTCATC GACCTGACCG CGGGCGGCGA AACCCGAAAA

1651 GAGCTTATCC GCTCGCTTCA GGGCAGCCTG TCGCTAAATA TTTCCAACGG

1701 TGCATGGCAC GGTATCGACA TGGACAATAT CCTGAAAAAC GGCATTTCGG

1751 GCAAAACTGC CGACAATGCC GCACCCAGCA CACCCTTCCA CCGATTCACG

1801 CTCAACAGCG AAATTTCAGA CGGCATCAGC CGCCACATCG ATACCGAACT

1851 CTTCTCCGAC AGCCTCTATG TTACCAGCAA CGGCTATACC AATCTGGATA

1901 CGCAGGAATT GTCTGAAGAT GTCCTTATCC GCAACGCCGT CCATCCGAAA

1951 AACAAACCGA TTCCCCTGAA AATCACCGGT ACGGTGGACA AACCGTCCAT

2001 TACCGTCGAT TACGGCAGGC TGACCGGCGG CATCAATTCG CGCAAAGAGA

2051 AACAGAAAAT CCTCGAAGAC ACCCTGCTGG AACAATGGCA GTGGCTCAAA

2101 CCTAAAGAAC CGTAA
```

This corresponds to the amino acid sequence <SEQ ID 2656; ORF 771.a>:

```
a771.pep
  1 MDLLSVFHKY RLKYAVAVLT ILLLAAIGLH ASVYRIFTPE NIRSRLQQSI

51 AHTHRKISFD ADIQRRLLPR PTVILKNLTI TEPGGDRTAV SVQETKIGLS

101 WKNLWSDQIQ IEKWVVSSAE LALTRDGKGV WNIQDLIDSQ KRQASVNRII

151 VENSTVRLNF LQEQLILKEI NLNLQSPDSS GQPFESSGIL VWGKLSVPWK

201 SRGLFLSDGI GTPKISPFHF EASTSLDGHG ITISTTGSPS VRFNAGGADA

251 AGLGLRADTS FRNLHLTAQI PTLALRNNSI KIETVNGAFT AGGEYAQWDG

301 SFKLDKANLH SGIANIGNAE ISGSFKTPRH QTNFSLNSPL VWTENKGLDA

351 PRLYVSTLQD TVNRLPQPRF ISRLDGSLSV PNLQNWNAEL NGTFDRQTVA

401 AKFRYTHEDA PHLEAAVALQ KLNLTPYLDD VRQQNGKIFP DTLAKLSGDI

451 EAHLKIGKVQ LPGLQLDDME TYLHADKGHI ALSRFKSGLY GGHTEGGISI

501 ANTRPATYRL QQNASNIQIQ PLLQDLFGFH SFSGNGDAVI DLTAGGETRK

551 ELIRSLQGSL SLNISNGAWH GIDMDNILKN GISGKTADNA APSTPFHRFT

601 LNSEISDGIS RHIDTELFSD SLYVTSNGYT NLDTQELSED VLIRNAVHPK

651 NKPIPLKITG TVDKPSITVD YGRLTGGINS RKEKQKILED TLLEQWQWLK

701 PKEP*
```

Computer analysis of this amino acid sequence gave the following results:

Homology with a Predicted ORF from *N. meningitidis*
ORF 771 shows 98.9% identity over a 704 aa overlap with a predicted ORF (ORF 771) from *N. meningitidis*

```
m771/a771   98.9% identity in 704 aa overlap 10        20        30        40        50        60
a771.pep  MDLLSVFHKYRLKYAVAVLTILLLAAIGLHASVYRIFTPENIRSRLQQSIAHTHRKISFD
          ||||||||||||||||||||||||||:||||||| |||||||||||||||||||||||||
m771      MDLLSVFHKYRLKYAVAVLTILLLAAVGLHASVYRTFTPENIRSRLQQSIAHTHRKISFD
                 10        20        30        40        50        60

70        80        90       100       110       120
a771.pep  ADIQRRLLPRPTVILKNLTITEPGGDRTAVSVQETKIGLSWKNLWSDQIQIEKWVVSSAE
          |||||||||||||||||||||||||:|||||||||||||||||||||||||||||||||
m771      ADIQRRLLPRPTVILKNLTITEPGGDQTAVSVQETKIGLSWKNLWSDQIQIEKWVVSSAE
                 70        80        90       100       110       120

130       140       150       160       170       180
a771.pep  LALTRDGKGVWNIQDLIDSQKRQASVNRIIVENSTVRLNFLQEQLILKEINLNLQSPDSS
          ||||||||||||||||||||||||||||||||||||||||||||||||||||||||||||
m771      LALTRDGKGVWNIQDLIDSQKRQASVNRIIVENSTVRLNFLQEQLILKEINLNLQSPDSS
                130       140       150       160       170       180

190       200       210       220       230       240
a771.pep  GQPFESSGILVWGKLSVPWKSRGLFLSDGIGTPKISPFHFEASTSLDGHGITISTTGSPS
          |||||||||||||||||||||||||||||:|||  |:|||||||||||||||||||||||
m771      GQPFESSGILVWGKLSVPWKSRGLFLSNGIGPPEISPFHFEASTSLDGHGITISTTGSPS
                190       200       210       220       230       240

250       260       270       280       290       300
a771.pep  VRFNAGGADAAGLGLRADTSFRNLHLTAQIPTLALRNNSIKIETVNGAFTAGGEYAQWDG
          |||||||||||||||||||||||||||||||:|||||||||||||||||||||||:|||
m771      VRFNAGGADAAGLGLRADTSFRNLHLTAQIPALALRNNSIKIETVNGAFTAGGEYARWDG
                250       260       270       280       290       300

310       320       330       340       350       360
a771.pep  SFKLDKANLHSGIANIGNAEISGSFKTPRHQTNFSLNSPLVWTENKGLDAPRLYVSTLQD
          ||||||||||||||||||||||||||||||||||||||||||||||||||||||||||||
m771      SFKLDKANLHSGIANIGNAEISGSFKTPRHQTNFSLNSPLVWTENKGLDAPRLYVSTLQD
                310       320       330       340       350       360

370       380       390       400       410       420
a771.pep  TVNRLPQPRFISRLDGSLSVPNLQNWNAELNGTFDRQTVAAKFRYTHEDAPHLEAAVALQ
          ||||||||||||||||||||||||||||||||||||||||||||||||||||||||||||
m771      TVNRLPQPRFISRLDGSLSVPNLQNWNAELNGTFDRQTVAAKFRYTHEDAPHLEAAVALQ
                370       380       390       400       410       420

430       440       450       460       470       480
a771.pep  KLNLTPYLDDVRQQNGKIFPDTLAKLSGDIEAHLKIGKVQLPGLQLDDMETYLHADKGHI
          ||||||||||||||||||||||||||||||||||||||||||||||||||||||||||||
m771      KLNLTPYLDDVRQQNGKIFPDTLAKLSGDIEAHLKIGKVQLPGLQLDDMETYLHADKGHI
                430       440       450       460       470       480

490       500       510       520       530       540
a771.pep  ALSRFKSGLYGGHTEGGISIANTRPATYRLQQNASNIQIQPLLQDLFGFHSFSGNGDAVI
          ||||||||||||||||||||||||||||||||||||||||||||||||||||||||||||
m771      ALSRFKSGLYGGHTEGGISIANTRPATYRLQQNASNIQIQPLLQDLFGFHSFSGNGDAVI
                490       500       510       520       530       540

550       560       570       580       590       600
a771.pep  DLTAGGETRKELIRSLQGSLSLNISNGAWHGIDMDNILKNGISGKTADNAAPSTPFHRFT
          ||||||||||||||||||||||||||||||||||||||||||||||||||||||||||||
m771      DLTAGGETRKELIRSLQGSLSLNISNGAWHGIDMDNILKNGISGKTADNAAPSTPFHRFT
                550       560       570       580       590       600

610       620       630       640       650       660
a771.pep  LNSEISDGISRHIDTELFSDSLYVTSNGYTNLDTQELSEDVLIRNAVHPKNKPIPLKITG
          ||||||||||||||||||||||||||||||||||||||||||||||||||||||||||||
m771      LNSEISDGISRHIDTELFSDSLYVTSNGYTNLDTQELSEDVLIRNAVHPKNKPIPLKITG
                610       620       630       640       650       660

670       680       690       700
a771.pep  TVDKPSITVDYGRLTGGINSRKEKQKILEDTLLEQWQWLKPKEPX
          ||||||||||||||||||||||||||||||||||||||||||||
m771      TVDKPSITVDYGRLTGGINSRKEKQKILEDTLLEQWQWLKPKEPX
                670       680       690       700
```

The following partial DNA sequence was identified in *N. gonorrhoeae* <SEQ ID 2657>:

```
g772.seq
    1 GTGTTCGGCA CGGTCTTGCG GACTGATGCC GACTGCCTGC AAATCATCGT
   51 CGTCGGCAAG TTCTTTCAGG TTGTTGCGTA TGGTTTTGCG GCGTTGGCGG
  101 AAGGCGAGTT TCACCAGTTT GGCGAAATGA TCGAAATCGT CCGCCTTGCC
  151 GATACGGTGT TTCACCGGAA TCATGCGCAC CACTGCGGAA TCGATTTTCG
  201 GCGCGGGATC GAACGATTCG GGCGGCACGT CAATCAGCAG CTCCATATCG
  251 AAAAAATATT GCAGCATCAC ACCCAAGCGA CCGTAGTCGT TGCTTTTCGG
  301 CGCGGCAACC ATGCGCTCGA CCACTTCTTT TTGCAACATA AAGTGCATAT
  351 CGGCGACATC GTCCGCCACC TCCGCCAGTT TGAACAAAAG CGGCGTGGAG
  401 ATGTTATACG GCAGGTTGCC GACGATTTTC TTTTTGCCTG AGATGCCGTT
  451 GAAATCAAAC TGCAACACGT CGCCTTCGTG AATCACCAGT TTATCCGCAA
  501 ACGGCAGCGT TTTCAGACGG CATACGATGT CGCGGTCGAT TTCGACAACG
  551 TGCAGGCGGT TCAGCTTTTT CGCCAAAGGT TCGGTAATTG CCGCCAAACC
  601 CGGGCCGATT TCAATCACGA CATCATCCGC CTGCGGGCGC ACGGCGTTGA
  651 CAATATCGCC GATAATCCGC GTGTCCTGCA AAAAATTCTG CCCGAAACGC
  701 TTGCGGGCTT TGTGTTCTTT CATCGTGTTT CCTCTTCGGT TGAAACCCCG
  751 CCCTTTAGGG CGGCAGGATC AGACTCTGTT TGGGCGGGGC GTAACCCCTT
  801 CCAAATCAGG ACGACACATA GGGCGGTGCT TTATGTGTCG TCCTGTGTGT
  851 TGGAACATAA ATGTGTTTAC AGTATCCGTT TGATGTCGGC ATTGTAA
```

This corresponds to the amino acid sequence <SEQ ID 2658; ORF 772.ng>:

```
g772.pep
    1 VFGTVLRTDA DCLQIIVVGK FFQVVAYGFA ALAEGEFHQF GEMIEIVRLA
   51 DTVFHRNHAH HCGIDFRRGI ERFGRHVNQQ LHIEKILQHH TQATVVVAFR
  101 RGNHALDHFF LQHKVHIGDI VRHLRQFEQK RRGDVIRQVA DDFLFA*DAV
  151 EIKLQHVAFV NHQFIRKRQR FQTAYDVAVD FDNVQAVQLF RQRFGNCRQT
  201 RADFNHDIIR LRAHGVDNIA DNPRVLQKIL PETLAGFVFF HRVSSSVETP
  251 PFRAAGSDSV WAGRNPFQIR TTHRAVLYVS SCVLEHKCVY SIRLMSAL*
```

The following partial DNA sequence was identified in *N. meningitidis* <SEQ ID 2659>:

```
m772.seq
    1 ATGTTCGGCG CGGTCTTGCG GATTGATGCC GACTGCCTGC AAATCATCGT
   51 CGCCTGCAAG CTCTTTCAGA TTGTTGCGTA TGGTTTTGCG GCGTTGGTGG
  101 AAGGCGAGTT TCACGAGTTT GGCAAAATGC TCGAAATCGT CCGCCTTGCC
  151 GATGCGGTGT TTCACCGGAA TCATACGGAC GACGGCGGAA TCCACTTTCG
  201 GCGCAGGGTC GAACGATTCG GGCGGTACGT CAATCAGCAT TTCCATATCG
  251 AAAAAATATT GCAGCATCAC GCCCAAGCGG CCGTAGTCGT TGCTTTTCGG
  301 CGCGGCAACC ATACGCTCGA CCACTTCTTT TTGCAGCATA AAGTGCATAT
  351 CGACGACATC GTCCGCCACC TCCGCCAGCT TGAACAAAAG CGGTGTGGAA
```

-continued

```
401 ATGTTGTACG GGAGGTTGCC GACGATTTTC TTTTTGCCTG CGATGCCGTT

451 GAAATCAAAC TGCAATACAT CGCCTTCGTG AATCACCAGT TTATCCGCAA

501 ACGGCAGCGT TTTCAGACGG CATACGATGT CGCGGTCGAT TTCGACAACG

551 TGCAGGCGGT TCAGCTTTTT CGCCAAAGGT TCGGTAATCG CCGCCAAACC

601 CGGGCCGATT TCAATCACGA CATCATCCGC CTGCGGGCGC ACGGCGTTGA

651 CAATATCGCT GATAATCCGC GTGTCCTGCA AAAAATTCTG CCCGAAACGC

701 TTGCGGGCTT TGTGTTCTTT CATCGTGTTT CCTTTTCGGT GAAACCCCG

751 CCCTTTAGGG CGGTAGAATC AGACTCTATT TGGGAGGGGC GTAACTCTTT

801 CCAAATCAGG ATGGCACATA GGGCGGTGCT TTATGTGTCG TCCTGTGTGT

851 TGAAACATAA ATGTGTTTAC AGTATCCGTT TGATGTCGGC ATTGTAA
```

This corresponds to the amino acid sequence <SEQ ID 2660; ORF 772>:

```
m772.pep
  1 MFGAVLRIDA DCLQIIVACK LFQIVAYGFA ALVEGEFHEF GKMLEIVRLA

51 DAVFHRNHTD DGGIHFRRRV ERFGRYVNQH FHIEKILQHH AQAAVVVAFR

101 RGNHTLDHFF LQHKVHIDDI VRHLRQLEQK RCGNVVREVA DDFLFACDAV

151 EIKLQYIAFV NHQFIRKRQR FQTAYDVAVD FDNVQAVQLF RQRFGNRRQT

201 RADFNHDIIR LRAHGVDNIA DNPRVLQKIL PETLAGFVFF HRVSFSVETP

251 PFRAVESDSI WEGRNSFQIR MAHRAVLYVS SCVLKHKCVY SIRLMSAL*
```

Computer analysis of this amino acid sequence gave the following results:
Homology with a Predicted ORF from *N. gonorrhoeae*
 ORF 772 shows 85.2% identity over a 298 aa overlap with a predicted ORF (ORF 772) from *N. gonorrhoeae*

```
   m772/g772  85.2% identity in 298 aa overlap 10        20        30        40        50        60
   g772.pep  VFGTVLRTDADCLQIIVVGKFFQVVAYGFAALAEGEFHQFGEMIEIVRLADTVFHRNHAH
              ||:||| ||||||||||: |:||:|||||||||||:||:|:|||||||:|||||||:
   m772      MFGAVLRIDADCLQIIVACKLFQIVAYGFAALVEGEFHEFGKMLEIVRLADAVFHRNHTD
                 10        20        30        40        50        60

70        80        90       100       110       120
   g772.pep  HCGIDFRRGIERFGRHVNQQLHIEKILQHHTQATVVVAFRRGNHALDHFFLQHKVHIGDI
              || ||| :|||||:|||::||||||||||:|:||||||||||:||||||||||||||| ||
   m772      DGGIHFRRRVERFGRYVNQHFHIEKILQHHAQAAVVVAFRRGNHTLDHFFLQHKVHIDDI
                 70        80        90       100       110       120

130       140       150       160       170       180
   g772.pep  VRHLRQFEQKRRGDVIRQVADDFLFAXDAVEIKLQHVAFVNHQFIRKRQRFQTAYDVAVD
              ||||||:|||| |:|:|:||||||| ||||||||::|||||||||||||||||||||||
   m772      VRHLRQLEQKRCGNVVREVADDFLFACDAVEIKLQYIAFVNHQFIRKRQRFQTAYDVAVD
                130       140       150       160       170       180

190       200       210       220       230       240
   g772.pep  FDNVQAVQLFRQRFGNCRQTRADFNHDIIRLRAHGVDNIADNPRVLQKILPETLAGFVFF
              |||||||||||||||| ||||||||||||||||||||||||||||||||||||||||||
   m772      FDNVQAVQLFRQRFGNRRQTRADFNHDIIRLRAHGVDNIADNPRVLQKILPETLAGFVFF
                190       200       210       220       230       240

250       260       270       280       290       299
   g772.pep  HRVSSSVETPPFRAAGSDSVWAGRNPFQIRTTHRAVLYVSSCVLEHKCVYSIRLMSALX
              ||||  |||||||| || : ||:| ||| ||| :|||||||||||:|||||||||||||||
   m772      HRVSFSVETPPFRAVESDSIWEGRNSFQIRMAHRAVLYVSSCVLKHKCVYSIRLMSALX
                250       260       270       280       290
```

The following partial DNA sequence was identified in *N. meningitidis* <SEQ ID 2661>:

```
a772.seq
   1 ATGTTCGGCG CGGTCTTGCG GATTGATGCC GACTGCCTGC AAATCATCGT

51 CGCCTGCAAG CTCTTTCAGA TTGTTGCGTA TGGTTTTGCG GCGTTGGTGG

101 AAGGCGAGTT TCACGAGTTT GGCGAAATGC TCGAAATCGT CCGCCTTGCC

151 GATACGGTGT TTCACCGGAA TCATGCGGAC GACGGCCGAA TCCACTTTCG

201 GCGCGGGGTC GAACGATTCG GGCGGCACGT CAATCAGCAT TTCCATATCG

251 AAGAAATATT GCAGCATCAC GCCCAAGCGG CCGTAGTCGT TGCTTTTCGG

301 CGCGGCAACC ATACGATCGA CCACTTCTTT TTGCAGCATA AAGTGCATAT

351 CGACGACATC GTCCGCCACC TCCGCCAGCT TGAACAAAAG CGGCGTGGAA

401 ATGTTGTAGG GCAGGTTGCC GACGATTTTC TTTTTGCCTG CGATGCCGTT

451 GAAATCAAAC TGCAATACAT CGCCTTCGTG AATCACCAGT TTATCCGCAA

501 ACGGCAGCGT TTTCAGACGG CATACGATGT CGCGGTCGAT TTCGACAACG

551 TGCAGGCGGT TCAGCTTTTT CGCCAAAGGT TCGGTAATCG CCGCCAAACC

601 CGGACCGATT TCAATCACGA CATCATCCGC CTGCGGGCGC ACGGCGTTGA

651 CAATATCGCT GATAATCCGC GTGTCCTGCA AAAAATTCTG CCCGAAACGC

701 TTGCGGGCTT TGTGTTCTTT CATCGTGTTT CCTTTTCGGT TGAAACCCCG

751 CCCTTTAGGG CGGTAGAATC AGACTCTATT TGGGAGGGGC GTAACTCCTT

801 CCAAATCAGG ACGGCACATA GGGCGGTGCT TTATGTGTCG TCCTGTGTGT

851 TGAAACATAA ATGTGTTTAC AGTATCCGTT TGATGTCGGC ATTGTAA
```

This corresponds to the amino acid sequence <SEQ ID 2662; ORF 772.a>:

```
a772.pep
   1 MFGAVLRIDA DCLQIIVACK LFQIVAYGFA ALVEGEFHEF GEMLEIVRLA

51 DTVFHRNHAD DGRIHFRRGV ERFGRHVNQH FHIEEILQHH AQAAVVVAFR

101 RGNHTIDHFF LQHKVHIDDI VRHLRQLEQK RRGNVVGQVA DDFLFACDAV

151 EIKLQYIAFV NHQFIRKRQR FQTAYDVAVD FDNVQAVQLF RQRFGNRRQT

201 RTDFNHDIIR LRAHGVDNIA DNPRVLQKIL PETLAGFVFF HRVSFSVETP

251 PFRAVESDSI WEGRNSFQIR TAHRAVLYVS SCVLKHKCVY SIRLMSAL*
```

Computer analysis of this amino acid sequence gave the following results:

Homology with a Predicted ORF from *N. meningitidis*

ORF 772 shows 95.6% identity over a 298 aa overlap with a predicted ORF (ORF 772) from *N. meningitidis*

```
m772/a772  95.6% identity in 298 aa overlap 10        20        30        40        50        60
a772.pep    MFGAVLRIDADCLQIIVACKLFQIVAYGFAALVEGEFHEFGEMLEIVRLADTVFHRNHAD
            |||||||||||||||||||||||||||||||||||||||||:||||||||||:|||||:|
m772        MFGAVLRIDADCLQIIVACKLFQIVAYGFAALVEGEFHEFGKMLEIVRLADAVFHRNHTD
                    10        20        30        40        50        60

70        80        90       100       110       120
a772.pep    DGRIHFRRGVERFGRHVNQHFHIEEILQHHAQAAVVVAFRRGNHTIDHFFLQHKVHIDDI
            || ||||| ||||||:||||||||:||||||||||||||||||||:||||||||||||||
m772        DGGIHFRRRVERFGRYVNQHFHIEKILQHHAQAAVVVAFRRGNHTLDHFFLQHKVHIDDI
                    70        80        90       100       110       120
```

```
               130        140        150        160        170        180
a772.pep  VRHLRQLEQKRRGNVVGQVADDFLFACDAVEIKLQYIAFVNHQFIRKRQRFQTAYDVAVD
          ||||||||||| ||||:|||||||||||||||||||||||||||||||||||||||||||
m772      VRHLRQLEQKRCGNVVREVADDFLFACDAVEIKLQYIAFVNHQFIRKRQRFQTAYDVAVD
               130        140        150        160        170        180

190        200        210        220        230        240
a772.pep  FDNVQAVQLFRQRFGNRRQTRTDFNHDIIRLRAHGVDNIADNPRVLQKILPETLAGFVFF
          |||||||||||||||||||||:||||||||||||||||||||||||||||||||||||||
m772      FDNVQAVQLFRQRFGNRRQTRADFNHDIIRLRAHGVDNIADNPRVLQKILPETLAGFVFF
               190        200        210        220        230        240

250        260        270        280        290        299
a772.pep  HRVSFSVETPPFRAVESDSIWEGRNSFQIRTAHRAVLYVSSCVLKHKCVYSIRLMSALX
          |||||||||||||||||||||||||||||| |||||||||||||||||||||||||||
m772      HRVSFSVETPPFRAVESDSIWEGRNSFQIRMAHRAVLYVSSCVLKHKCVYSIRLMSALX
               250        260        270        280        290 g773.seq  not found yet
g773.pep  not found yet
```

The following partial DNA sequence was identified in *N. meningitidis* <SEQ ID 2663>:

```
m773.seq
   1 ATGGGATTGG GTGCAACGAC TTTTGTCGGT TCGGGTGCTA TAGGCGGAGG

51 TCTGTGCAGT ACCGGGATTG CTGTGCGGC CGGTGGACTT ATTGCAACGG

101 CAGGTATGAC CGGTGGTTAT ACACAGGCCT CAGAAGGAAG CCGGCAATTG

151 TTTGGCACTT ACCAGTCCGA TTTTGGTAAA AAAGTTGTCC TATCTTTGGG

201 TACACCAATA GAATACGAAT CGCCGTTAGT ATCTGATGCG AAAAATCTAG

251 CCGTATGGGG ATTGGAAACG CTGATTACGC GCAAATTGGG AAACTTGGCA

301 ACGGGTGTGA AAACTTCCTT GACTCCGAAA ACTGCTGACG TACAGCGAAA

351 TATCCTGTCC AATCCGAAG TCGGTATCAA GTGGGGCAAG GGGATTGAAG

401 GACAGGGAAT GCCTTGGGAG GATTATGTCG GTAAGGGCTT GTCTGCCAAT

451 GCAAGGTTAC CTAAAAATTT TAAAACATTT GATTATTTTG ATCGTGGTAC

501 AGGCACGGCA ATCAGTGCCA AAACTCTGGA TACGCAAACT ACGGCACGCC

551 TGTCCAAACC CGAACAGCTT TACAGTACCA TGAAAGGGTA CATCGATAAG

601 ACGGCAAATT TCAAAAGTTA TGAATTATCA GAAGTACCGT TAAGGGCAGA

651 CATGATCAAA CAGCGCGAAA TCCATCTGGC CATACCCGCA CAAACTAATA

701 AGGAGCAAAG ATTGCAGTTG CAACGTGTGG TAGAGTATGG CAAAAGTCAA

751 AACATTACAG TCAAAATTAC GGAGATCGAA TAA
```

This corresponds to the amino acid sequence <SEQ ID 2664; ORF 773>:

```
m773.pep
   1 MGLGATTFVG SGAIGGGLCS TGIGCAAGGL IATAGMTGGY TQASEGSRQL

51 FGTYQSDFGK KVVLSLGTPI EYESPLVSDA KNLAVWGLET LITRKLGNLA

101 TGVKTSLTPK TADVQRNILS QSEVGIKWGK GIEGQGMPWE DYVGKGLSAN

151 ARLPKNFKTF DYFDRGTGTA ISAKTLDTQT TARLSKPEQL YSTMKGYIDK

201 TANFKSYELS EVPLRADMIK QREIHLAIPA QTNKEQRLQL QRVVEYGKSQ

251 NITVKITEIE * a773.seq  not found yet
a773.pep  not found yet
```

The following partial DNA sequence was identified in *N. gonorrhoeae* <SEQ ID 2665>:

```
g774.seq
   1 ATGAAGACCA AATTACCGCT TTTTATCATT TGGCTGTCTG TGTCTGCCTC

51 CTGTGCTTCC GTTTTACCCG TTCCGGAGGG CAGCCGAACC GAAATGCCGA

101 CACAGGAAAA TGCTTCAGAC GGCATTCCCT ATCCCGTTCC CACTCTGCAA

151 GACCGTTTGG ACTATCTGGA AGGCAAAATC GTCCGGCTGT CGAACGAAGT

201 GGAAATGTTA AACGGGAAAG TCAAAGCATT GGAGCATACG AAAATACACC

251 CTTCCGGCAG GACATACGTC CAAAAACTCG ACGACCGCAA ATTGAAAGAG

301 CATTACCTCA ATACCGAAGG CGGCAGCGCA TCCGCACATA CCGTCGAAAC

351 CGCACAAAAC CTCTACAATC AGGCACTCAA ACACTATCAA AACGGCAGGT

401 TTTCTGCCGC AGCCGCCTTG TTGAAGGGGG CGGACGGCGG AGACGGCGGC

451 AGCATCGCGC AACGCAGTAT GTACCTGTTG CTGCAAAGCA GGGCGCGTAT

501 GGGGAACTGT GAATCTGTCA TCGAAATCGG AGGGCGTTAC GCCAACCGTT

551 TCAAAGACAG CCCAACCGCG CCCGAAGTCA TATTCAAAAT CGGCGAATGC

601 CAATACAGGC TTCAGCAAAA AGACATTGCA AGGGCGACTT GGCGCAGCCT

651 GATACAGACC TATCCCGGCA GCCCGGCGGC AAAACGCGCC GCCGCAGCCG

701 TACGCAAACG ATAG
```

This corresponds to the amino acid sequence <SEQ ID 2666; ORF 774.ng>:

```
g774.pep
   1 MKTKLPLFII WLSVSASCAS VLPVPEGSRT EMPTQENASD GIPYPVPTLQ

51 DRLDYLEGKI VRLSNEVEML NGKVKALEHT KIHPSGRTYV QKLDDRKLKE

101 HYLNTEGGSA SAHTVETAQN LYNQALKHYQ NGRFSAAAAL LKGADGGDGG

151 SIAQRSMYLL LQSRARMGNC ESVIEIGGRY ANRFKDSPTA PEVIFKIGEC

201 QYRLQQKDIA RATWRSLIQT YPGSPAAKRA AAAVRKR*
```

The following partial DNA sequence was identified in *N. meningitidis* <SEQ ID 2667>:

```
m774.seq
   1 ATGAAGATCA AATTACCGCT TTTTATCATT TGGCTGTCTG TGTCCGCCTC

51 CTGTGCTTCC GTTTCACCCG TTCCGGCAGG CAGCCAAACC GAAATGTCGA

101 CACGGGAAAA TGCTTCAGAC GGCATTCCCT ATCCCGTTCC GACCTTGCAA

151 GACCGTTTGG ACTATCTGGA AGGCAAAATC GTCCGGCTGT CGAACGAAGT

201 GGAAACCTTA AACGGCAAAG TCAAAGCACT GGAACACGCA AAAACACATT

251 CTTCCGGCAG GGCATACGTC CAAAAACTCG ACGACCGCAA GTTGAAAGAG

301 CATTACCTCA ATACCGAAGG CGGCAGCGCA TCCGCACATA CTGTCGAAAC

351 CGCACAAAAC CTCTACAATC AGGCACTCAA ACACTATAAA AGCGGCAAGT

401 TTTCTGCCGC TGCCTCCCTG TTGAAAGGCG CGGACGGAGG CGACGGCGGC

451 AGCATCGCGC AACGCAGTAT GTACCTGTTG CTGCAAAGCA GGGCGCGTAT

501 GGGCAACTGC GAATCCGTCA TCGAAATCGG AGGGCGTTAC GCCAACCGTT

551 TCAAAGACAG CCCAACCGCG CCTGAAGCCA TGTTCAAAAT CGGCGAATGC
```

```
-continued
601 CAATACAGGC TTCAGCAAAA AGACATTGCA AGGGCGACTT GGCGCAGCCT

651 GATACAGACC TATCCCGGCA GCCCGGCGGC AAAACGCGCC GCCGCAGCCG

701 TGCGCAAACG ATAG
```

This corresponds to the amino acid sequence <SEQ ID 2668; ORF 774>:

```
m774.pep
  1 MKIKLPLFII WLSVSASCAS VSPVPAGSQT EMSTRENASD GIPYPVPTLQ

51 DRLDYLEGKI VRLSNEVETL NGKVKALEHA KTHSSGRAYV QKLDDRKLKE

101 HYLNTEGGSA SAHTVETAQN LYNQALKHYK SGKFSAAASL LKGADGGDGG

151 SIAQRSMYLL LQSRARMGNC ESVIEIGGRY ANRFKDSPTA PEAMFKIGEC

201 QYRLQQKDIA RATWRSLIQT YPGSPAAKRA AAAVRKR*
```

Computer analysis of this amino acid sequence gave the following results:
Homology with a Predicted ORF from *N. gonorrhoeae*
ORF 774 shows 92.8% identity over a 237 aa overlap with a predicted ORF (ORF 774) from *N. gonorrhoeae*

```
    m774/g774  92.8% identity in 237 aa overlap 10         20         30         40         50         60
    g774.pep  MKTKLPLFIIWLSVSASCASVLPVPEGSRTEMPTQENASDGIPYPVPTLQDRLDYLEGKI
              ||  ||||||||||||||||| ||  || ||| :||||||||||||||||||||||||||
    m774      MKIKLPLFIIWLSVSASCASVSPVPAGSQTEMSTRENASDGIPYPVPTLQDRLDYLEGKI
                  10         20         30         40         50         60

70         80         90        100        110        120
    g774.pep  VRLSNEVEMLNGKVKALEHTKIHPSGRTYVQKLDDRKLKEHYLNTEGGSASAHTVETAQN
              ||||||||  ||||||||||| | |  |||:||||||||||||||||||||||||||||
    m774      VRLSNEVETLNGKVKALEHAKTHSSGRAYVQKLDDRKLKEHYLNTEGGSASAHTVETAQN
                  70         80         90        100        110        120

130        140        150        160        170        180
    g774.pep  LYNQALKHYQNGRFSAAAALLKGADGDGGSIAQRSMYLLLQSRARMGNCESVIEIGGRY
              ||||||||| : :||||| :|||||||||||||||||||||||||||||||||||||||
    m774      LYNQALKHYKSGKFSAAASLLKGADGGDGGSIAQRSMYLLLQSRARMGNCESVIEIGGRY
                 130        140        150        160        170        180

190        200        210        220        230
    g774.pep  ANRFKDSPTAPEVIRKIGECQYRLQQKDIARATWRSLIQTYPGSPAAKRAAAAVRKRX
              ||||||||||||:: |||||||||||||||||||||||||||||||||||||||||||
    m774      ANRFKDSPTAPEAMFKIGECQYRLQQKDIARATWRSLIQTYPGSPAAKRAAAAVRKRX
                 190        200        210        220        230
```

The following partial DNA sequence was identified in *N. meningitidis* <SEQ ID 2669>:

```
a774.seq
  1 ATGAAGACCA AATTACCGCT TTTTATCATT TGGCTGTCCG TATCCGCCGC

51 CTGTTCTTCC CCTGTTTCCC GCAATATTCA GGATATGCGG CTCGAACCGC

101 AGGCAGAGGC AGGTAGTTCG GACGCTATTC CCTATCCCGT TCCCACTCTG

151 CAAGACCGTT TGGATTATCT GGAAGGCACA CTCGTCCGCC TGTCGAACGA

201 AGTGGAAACC TTAAACGGCA AAGTCAAAGC ACTGGAGCAT GCGAAAACAC

251 ACCCTTCCAG CAGGGCATAC GTCCAAAAAC TCGACGACCG CAAGTTGAAA

301 GAGCATTACC TCAATACCGA AGGCGGCAGC GCATCCGCAC ATACCGTCGA

351 AACCGCACAA AACCTCTACA ATCAGGCACT CAAACACTAT AAAAGCGGCA

401 GGTTTTCTGC CGCTGCCTCC CTGTTGAAAG GCGCGGACGG AGGCGACGGC

451 GGCAGCATCG CGCAACGCAG TATGTACCTG TTGCTGCAAA GCAGGGCGCG
```

-continued

```
501 TATGGGCAAC TGCGAATCCG TCATCGAAAT CGGAGGGCGT TACGCCAACC

551 GTTTCAAAGA CAGCCCAACC GCGCCTGAAG CCATGTTCAA AATCGGCGAA

601 TGCCAATACA GGCTTCAGCA AAAAGACATT GCAAGGGCGA CTTGGCGCAG

651 CCTGATACAG ACCTATCCCG GCAGCCCGGC GGCAAAACGC GCCGCCGCAG

701 CCGTGCGCAA ACGATAG
```

This corresponds to the amino acid sequence <SEQ ID 2670; ORF 774.a>:

```
a774.pep
  1 MKTKLPLFII WLSVSAACSS PVSRNIQDMR LEPQAEAGSS DAIPYPVPTL

51 QDRLDYLEGT LVRLSNEVET LNGKVKALEH AKTHPSSRAY VQKLDDRKLK

101 EHYLNTEGGS ASAHTVETAQ NLYNQALKHY KSGRFSAAAS LLKGADGGDG

151 GSIAQRSMYL LLQSRARMGN CESVIEIGGR YANRFKDSPT APEAMFKIGE

201 CQYRLQQKDI ARATWRSLIQ TYPGSPAAKR AAAAVRKR*
```

Computer analysis of this amino acid sequence gave the following results:

Homology with a Predicted ORF from *N. meningitidis*

ORF 774 shows 89.5% identity over a 238 aa overlap with a predicted ORF (ORF 774) from *N. meningitidis*

```
    m774/a774    89.5% identity in 238 aa overlap 10         20         30         40         50         60
    a774.pep  MKTKLPLFIIWLSVSAACSSPVSRNIQDMRLEPQAEAGSSDAIPYPVPTLQDRLDYLEGT
              || |||||||||||:|:| ||      : |  :::  ::||:|||||||||||||||||
    m774      MKIKLPLFIIWLSVSASCAS-VSPVPAGSQTEMSTRENASDGIPYPVPTLQDRLDYLEGK
                     10         20         30         40         50

70         80         90        100        110        120
    a774.pep  LVRLSNEVETLNGKVKALEHAKTHPSSRAYVQKLDDRKLKEHYLNTEGGSASAHTVETAQ
              :|||||||||||||||||||||||| |:|||||||||||||||||||||||||||||||
    m774      IVRLSNEVETLNGKVKALEHAKTHSSGRAYVQKLDDRKLKEHYLNTEGGSASAHTVETAQ
                60         70         80         90        100        110

130        140        150        160        170        180
    a774.pep  NLYNQALKHYKSGRFSAAASLLKGADGGDGGSIAQRSMYLLLQSRARMGNCESVIEIGGR
              |||||||||||:|||||||||||||||||||||||||||||||||||||||||||||||
    m774      NLYNQALKHYKSGKFSAAASLLKGADGGDGGSIAQRSMYLLLQSRARMGNCESVIEIGGR
                   120        130        140        150        160        170

190        200        210        220        230     239
    a774.pep  YANRFKDSPTAPEAMFKIGECQYRLQQKDIARATWRSLIQTYPGSPAAKRAAAAVRKRX
              |||||||||||||||||||||||||||||||||||||||||||||||||||||||||||
    m774      YANRFKDSPTAPEAMFKIGECQYRLQQKDIARATWRSLIQTYPGSPAAKRAAAAVRKRX
                   180        190        200        210        220        230
    g790. seq not found yet
    g790. pep not found yet
```

The following partial DNA sequence was identified in *N. meningitidis* <SEQ ID 2671>:

```
m790.seq
  1 ATGGCAAGAA GGTCAAAAAC ATTTGAAGAA GCTGCTGCTG AGGTTGAGGA

51 ACGTTTCGGT CATCGTGGCA TTAAGTTGGT CGAGTTTGAG GGTACAGCCA

101 AGCCGTGTGT AATCAACTGC CCTAAACATG GAAACCAAAC CTGTTCGAGG

151 TACTCCAATA TGTTCATAGG AAGTAGCTGG GGTTGCCCCT CTTGTGGTAA
```

-continued

```
 201 TGAGCAAGCT GCAAAAGCCG GTATAGCGAC CCTTAGGAAG AATCACATAG

251 CGTTAGAAAT GCTGAAACAG GCTGTAACAG GTATGACCAA GCAAGAGCGC

301 ATCACGACGC AAGCCTACAA TGAGATGACC AAATCCGTGG CAGGTTCAAA

351 CAGCATAGTC CTTAACGATG TCCAAGGCGA TACGACCATC AACAACCATC

401 ATACGCATAC GCACAACCAC AGCGATGCCG ATGGCAAAGC ACTGTCGATG

451 AGGCTCACAC CCCGTCCTTT GTTGTCAGAC CGTCAGGCGG CGGCTTTCGC

501 CCGTACAGGC AAACTCACGG GCAGTTTCGA CCTGTTTGCT TCGGTGgTCG

551 CCCCCTCGCA GTACACGTTT GCCGTTGCCA TGCCCGACAC GTCCATGTCG

601 CCGGTTATCG AAAAGGGAGA CTTGCTGGTG GTCGAGCCGC GTATGTGCCC

651 TGCGGACGAA GACATCGCGC TGATTGAACT GTCCGACAAG CGGCTGGTCG

701 TCGCGCACCT TGTTATCGAT ATTGCGGGCA GGATGCTGAT TTATCAGACG

751 GGCAGGCCGT CTGAAGCCTT TGACCTGCCC GAAGGCAGCA CGATTTTAGG

801 TGTGGTGCTG GAGTCAAAAA ACGGTTTATG TCCGCCGCAC AGGCAAGAAG

851 GCGTGTTGAT TCGGATTACC GCCCCTGATG TGTGGACGGT TGGTATGATT

901 TCCGCTTCCA AAACGTCGTG TACGCGCCCG ACCGCAGCCC GGAAATCAGC

951 CGTATGCTTT CTTCGATTTT GGCAGGCTAC GCGTGGGATA CCGAAAACCC

1001 GTTCGTGGCG AAATCCGAAC AACGCCTGA
```

This corresponds to the amino acid sequence <SEQ ID 2672; ORF 790>:

```
m790.pep
  1 MARRSKTFEE AAAEVEERFG HRGIKLVEFE GTAKPCVINC PKHGNQTCSR

51 YSNMFIGSSW GCPSCGNEQA AKAGIATLRK NHIALEMLKQ AVTGMTKQER

101 ITTQAYNEMT KSVAGSNSIV LNDVQGDTTI NNHHTHTHNH SDADGKALSM

151 RLTPRPLLSD RQAAAFARTG KLTGSFDLFA SVVAPSQYTF AVAMPDTSMS

201 PVIEKGDLLV VEPRMCPADE DIALIELSDK RLVVAHLVID IAGRMLIYQT

251 GRPSEAFDLP EGSTILGVVL ESKNGLCPPH RQEGVLIRIT APDVWTVGMI

301 SASKTSCTRP TAARKSAVCF LRFWQATRGI PKTRSWRNPN NA*
```

The following partial DNA sequence was identified in *N. meningitidis* <SEQ ID 2673>:

```
a790.seq
   1 ATGGCAAGAA GGTCAAAAAC ATTTGAAGAA GCTGCTGCTG AGGTTGAGGA

51 ACGTTTCGGT CATCGTGGCA TTAAGTTGGT CGAGTTTGAG GGTACAGCCA

101 AGCCGTGTGT AATCAACTGC CCTAAACATG GAAACCAAAC CTGTTCGAGG

151 TACTCCAATA TGTTCATAGG AAGTAGCTGG GGTTGCCCCT CTTGTGGTAA

201 TGAGCAAGCT GCAAAAGCCG GTATAGCGAC CCTTAGGAAG AATCACATAG

251 CGTTAGAAAT GCTGAAACAG GCTGTAACAG GTATGACCAA GCAAGAGCGC

301 ATCACGACGC AAGCCTACAA TGAGATGACC AAATCCGTGG CAGGTTCAAA

351 CAGCATAATC CTTAACGATG TCCAAGGCGA TACGACCATC AACAACCATC

401 ATACGCATAC GCACAACCAC AGCGATGCCG ACGGCAAAGC ACTGTCGATG

451 AGGCTCACAC CCCGTCCTTT GTTGTCAGAC CGTCAGGCGG CGGCTTTCGC
```

-continued

```
 501 CCGTACAGGC AAACTCACGG GCAGTTTCGA CCTGTTTGCT TCGGTGGTCG

551 CCCCTTCACA ATATACGTTT GCCGTTGCCA TGCCCGACAC GTCCATGTCG

601 CCGGTTATCG AAAGGGGGA TTTGCTGGTG GTCGAGCCGC GTATGCGCCC

651 TGCGGACGAA GACATCGTAC TGATTGAACT GTCCGACAAG CGGCTGGTCG

701 TCGCGCACCT TGTTATCGAT ATTGCGGGCA GGATGCTGAT TTATCAGACG

751 GGCAGGCCGT CTGAAGCCCT CGACCTGCCC GAAGGCAGCG TGATTTTAGG

801 TGTGGTGCTG GAGTCAAAAA ACGGTTTATG TCCGCCGCAC AGGCAAGAAG

851 GCGTGTTGAT TCGGATTACC GCCCCTGATG TGTGGACGGT TGGTACGATT

901 TCCGCTTCCA AAACGTCGTG TACGCGCCCG ACCGCAGCCC GGAAATCAGC

951 CGTATGCTTT CTTCGATTTT GGCAGGCTAC GCGTGGGATA CCGAAAACCC

1001 GTTCGTGGCG AAATCCGAAC AACGCCTGT
```

This corresponds to the amino acid sequence <SEQ ID 2674; ORF 790.a>:

```
a790.pep
  1MARRSKTFEE AAAEVEERFG HRGIKLVEFE GTAKPCVINC PKHGNQTCSR

51YSNMFIGSSW GCPSCGNEQA AKAGIATLRK NHIALEMLKQ AVTGMTKQER

101ITTQAYNEMT KSVAGSNSII LNDVQGDTTI NNHHTHTHNH SDADGKALSM

151RLTPRPLLSD RQAAAFARTG KLTGSFDLFA SVVAPSQYTF AVAMPDTSMS

201PVIEKGDLLV VEPRMRPADE DIVLIELSDK RLVVAHLVID IAGRMLIYQT

251GRPSEALDLP EGSVILGVVL ESKNGLCPPH RQEGVLIRIT APDVWTVGTI

301SASKTSCTRP TAARKSAVCF LRFWQATRGI PKTRSWRNPN NAC
```

Computer analysis of this amino acid sequence gave the following results:
Homology with a Predicted ORF from *N. meningitidis*
ORF 790 shows 98.2% identity over a 342 aa overlap with a predicted ORF (ORF 790) from *N. meningitidis*

```
    a790/m790  98.2% identity in 342 aa overlap 10         20         30         40         50         60
    a790.pep  MARRSKTFEEAAAEVEERFGHRGIKLVEFEGTAKPCVINCPKHGNQTCSRYSNMFIGSSW
              ||||||||||||||||||||||||||||||||||||||||||||||||||||||||||||
    m790      MARRSKTFEEAAAEVEERFGHRGIKLVEFEGTAKPCVINCPKHGNQTCSRYSNMFIGSSW
                  10         20         30         40         50         60

70         80         90        100        110        120
    a790.pep  GCPSCGNEQAAKAGIATLRKNHIALEMLKQAVTGMTKQERITTQAYNEMTKSVAGSNSII
              |||||||||||||||||||||||||||||||||||||||||||||||||||||||||||:
    m790      GCPSCGNEQAAKAGIATLRKNHIALEMLKQAVTGMTKQERITTQAYNEMTKSVAGSNSIV
                  70         80         90        100        110        120

130        140        150        160        170        180
    a790.pep  LNDVQGDTTINNHHTHTHNHSDADGKALSMRLTPRPLLSDRQAAAFARTGKLTGSFDLFA
              ||||||||||||||||||||||||||||||||||||||||||||||||||||||||||||
    m790      LNDVQGDTTINNHHTHTHNHSDADGKALSMRLTPRPLLSDRQAAAFARTGKLTGSFDLFA
                 130        140        150        160        170        180

190        200        210        220        230        240
    a790.pep  SVVAPSQYTFAVAMPDTSMSPVIEKGDLLVVEPRMRPADEDIVLIELSDKRLVVAHLVID
              |||||||||||||||||||||||||||||||||||:||||||:|||||||||||||||||
    m790      SVVAPSQYTFAVAMPDTSMSPVIEKGDLLVVEPRMCPADEDIALIELSDKRLVVAHLVID
                 190        200        210        220        230        240

250        260        270        280        290        300
    a790.pep  IAGRMLIYQTGRPSEALDLPEGSVILGVVLESKNGLCPPHRQEGVLIRITAPDVWTVGTI
              ||||||||||||||||:|||||||:|||||||||||||||||||||||||||||||||| |
    m790      IAGRMLIYQTGRPSEAFDLPEGSTILGVVLESKNGLCPPHRQEGVLIRITAPDVWTVGMI
                 250        260        270        280        290        300
```

```
               310         320         330        340
a790.pep   SASKTSCTRPTAARKSAVCFLRFWQATRGIPKTRSWRNPNNAC
           ||||||||||||||||||||||||||||||||||||||||||
m790       SASKTSCTRPTAARKSAVCFLRFWQATRGIPKTRSWRNPNNAX
               310         320         330        340
```

The following partial DNA sequence was identified in *N. gonorrhoeae* <SEQ ID 2675>:

```
g791.seq
   1 ATGGTAAATT ATTATTCAGC TATGATTAAA AAGATTTTAA CTACTTGTTT

51 TGGTTTGTTT TTTGGTTTTT GTGTATTTGG AGTGGGTCTG GTTGCCATTG

101 CTATTTTGGT AACGTATCCG AAACTGCCGT CTTTGGATTC TTTGCAGCAT

151 TACCAGCCTA AAATGCCGTT GACTATTTAT TCGGCGGATG GAGAAGTCAT

201 CGGTATGTAT GGGGAGCAGC GGCGCGAATT TACAAAAATC GGCGATTTCC

251 CCGAGGTGTT GCGGAATGCG GTTATTGCCG CCGAGGATAA ACGCTTTTAC

301 CGGCATTGGG GGGTGGATGT TTGGGGTGTT GCCCGCGCTG CCGTCGGCAA

351 TGTCGTGTCC GGCAGCGTGC AGTCGGGTGC GAGTACGATT ACACAGCAGG

401 TGGCGAAAAA TTTTTATTTG AGCAGTGAAA AAACGTTCAC ACGCAAATTC

451 AATGAGGTGT TGCTTGCCTA TAAAATCGAG CAGTCTTTAA GCAAAGACAA

501 AATCCTTGAG TTGTATTTCA ATCAGATTTA CCTCGGTCAG CGCGCCTATG

551 GTTTTGCATC TGCCGCGCAA ATCTATTTCA ATAAGAATGT CCGAGATTTG

601 ACTTTGGCGG AAGCCGCCAT GCTTGCGGGA CTGCCCAAGG CTCCGTCTGC

651 CTATAATCCG ATTGTTAATC GGAGCGTGCA CAAGTTGCGC CAGAAGTATA

701 TTTTGAACAA TATGCTCGAG GAGAAGATGA TTACCGTGCA ACAGCGCGAT

751 CAGGCATTGA ATGAGGAACT GCATTATGAG CGGTTTGTTC GGAAAATCGA

801 TCAGAGTGCT TTATATGTGG CGGAAATGGT GCGTCGGGAA CTGTATGAGA

851 AATATGGTGA AGATGCCTAT ACGCAGGGTT TTAAGGTTTA TACCACGGTC

901 CGCACCGATC ATCAGAAGGC GGCAACCGAG GCATTGCGCA AGGCTCTACG

951 GAATTTCGAT CGCGGCAGCA GCTACCGCGG TGCGGAAAAC TATATCGATT

1001 TGAGTAAGAG TGAAGATGTC GAGGAGACTG TCAGCCAGTA TCTGTCGGGA

1051 CTCTATACCG TCGATAAAAT GGTTCCCGCC GTTGTGTTGG ATGTTACTAA

1101 AAAGAAAAAT GTCGTCATAC AGCTGCCCGG CGGCAGGCGG GTTGCGCTTG

1151 ACAGGCGCGC CTTGGGTTTT GCGGCCCGAG CGGTCGATAA TGAGAAAATG

1201 GGGGAGGACC GTATCCGCAG GGGCGCGGTC ATCCGTGTCA AAAACAACGG

1251 CGGGCGTTGG GCGGTGGTTC AAGAGCCGTT GCTGCAGGGG GCTTTGGTTT

1301 CGCTGGATGC AAAAACCGGA GCTGTGCGCG CGCTGGTCGG CGGTTATGAT

1351 TTTCACAGCA AAACATTCAA TCGTGCCGTT CAGGCAATGC GGCAGCCGGG

1401 TTCGACCTTT AAGCCGTTTG TCTATTCGGC GGCATTATCT AAGGGGATGA

1451 CCGCGTCCAC AGTGGTTAAC GATGCGCCGA TTTCCCTGCC GGGGAAGGG

1501 CCGAACGGTT CGGTTTGGAC ACCTAAAAAT TCAGACGGCA GATATTCCGG

1551 CTACATTACT TTGAGACAGG CTCTGACGGC TTCCAAGAAT ATGGTTTCCA

1601 TCCGTATTTT GATGTCTATC GGTGTCGGTT ACGCGCAACA GTATATCCGG

1651 CGTTTCGGCT TCAGGCCGTC CGAGCTGCCG GCAAGCCTGT CTATGGCTTT
```

-continued

```
1701 AGGTACGGGC GAGACGACGC CGTTGAAAGT GGCGGAGGCA TATAGTGTAT
1751 TTGCGAACGG CGGATATAGG GTTTCTTCGC ACGTGATCGA TAAGATTTAT
1801 GACAGAGACG GCAGGTTGCG CGCCCAAATG CAACCTTTGG TGGCAGGGCA
1851 AAATGCGCCT CAGGCAATCG ATCCGCGCAA TGCCTATATT ATGTATAAGA
1901 TTATGCAGGA TGTGGTCCGT GTCGGTACGG CAAGGGGGGC AGCTGCGTTG
1951 GGAAGAACGG ATATTGCCGG TAAAACGGGT ACGACCAACG ACAATAAAGA
2001 TGCGTGGTTT GTCGGTTTTA ACCCTGATGT GGTTACTGCC GTATATATCG
2051 GCTTCGACAA ACCTAAGAGT ATGGGGCGTG CCGGCTACGG CGGTACGATT
2101 GCGGTGCCGG TTTGGGTGGA CTATATGCGT TTTGCGTTGA AAGGAAAGCA
2151 GGGCAAAGGG ATGAAAATGC CTGAAGGTGT GGTCAGCAGC AATGGCGAAT
2201 ACTATATGAA GGAACGTATG GTAACCGATC CGGGCTTGAT GCTGGACAAC
2251 AGCGGTATTG CGCCGCAACC TTCCCGACGG GCAAAAGAAG ATGATGAAGC
2301 GGCAGTAGAA AACGAACAGC AGGGAAGGTC TGACGAAACG CGTCAGGACG
2351 TACAGGAAAC GCCGGTGCTT CCGAGCAATA CGGATTCCAA ACAGCAGCAG
2401 TTGGATTCCC TGTTTTAA
```

This corresponds to the amino acid sequence <SEQ ID 2676; ORF 791.ng>:

```
g791.pep
  1 MVNYYSAMIK KILTTCFGLF FGFCVFGVGL VAIAILVTYP KLPSLDSLQH
 51 YQPKMPLTIY SADGEVIGMY GEQRREFTKI GDFPEVLRNA VIAAEDKRFY
101 RHWGVDVWGV ARAAVGNVVS GSVQSGASTI TQQVAKNFYL SSEKTFTRKF
151 NEVLLAYKIE QSLSKDKILE LYFNQIYLGQ RAYGFASAAQ IYFNKNVRDL
201 TLAEAAMLAG LPKAPSAYNP IVNPERAKLR QKYILNNMLE EKMITVQQRD
251 QALNEELHYE RFVRKIDQSA LYVAEMVRRE LYEKYGEDAY TQGFKVYTTV
301 RTDHQKAATE ALRKALRNFD RGSSYRGAEN YIDLSKSEDV EETVSQYLSG
351 LYTVDKMVPA VVLDVTKKKN VVIQLPGGRR VALDRRALGF AARAVDNEKM
401 GEDRIRRGAV IRVKNNGGRW AVVQEPLLQG ALVSLDAKTG AVRALVGGYD
451 FHSKTFNRAV QAMRQPGSTF KPFVYSAALS KGMTASTVVN DAPISLPGKG
501 PNGSVWTPKN SDGRYSGYIT LRQALTASKN MVSIRILMSI GVGYAQQYIR
551 RFGFRPSELP ASLSMALGTG ETTPLKVAEA YSVFANGGYR VSSHVIDKIY
601 DRDGRLRAQM QPLVAGQNAP QAIDPRNAYI MYKIMQDVVR VGTARGAAAL
651 GRTDIAGKTG TTNDNKDAWF VGFNPDVVTA VYIGFDKPKS MGRAGYGGTI
701 AVPVWVDYMR FALKGKQGKG MKMPEGVVSS NGEYYMKERM VTDPGLMLDN
751 SGIAPQPSRR AKEDDEAAVE NEQQGRSDET RQDVQETPVL PSNTDSKQQQ
801 LDSLF*
```

The following partial DNA sequence was identified in N. meningitidis <SEQ ID 2677>:

```
m791.seq
  1  ATGGTAAATT ATTATTCAGC TATGATTAAA AAGATTTTAA CGACTTGTTT
 51  TGGTTTGGTT TTTGGGTTTT GTGTATTTGG AGTGGGTTTG GTTGCCATTG
```

-continued

```
 101 CTATTTTGGT AACGTATCCG AAACTGCCGT CTTTGGATTC TTTGCAGCAT
 151 TACCAGCCTA AAATGCCGTT GACTATTTAT TCGGCGGATG GGGAAGTCAT
 201 CGGTATGTAT GGGGAGCAGC GGCGCGAATT TACAAAAATC GGCGATTTCC
 251 CAGAGGTGTT GCGGAATGCG GTTATCGCCG CCGAGGATAA ACGCTTTTAC
 301 CGGCATTGGG GGGTGGATGT TTGGGGTGTT GCCCGCGCTG CCGTCGGCAA
 351 TGTCGTGTCC GGCAGCGTGC AGTCGGGTGC GAGTACGATT ACGCAGCAGG
 401 TGGCGAAAAA TTTTTATTTG AGCAGTGAAA AACGTTCAC ACGCAAATTC
 451 AATGAGGTGT TGCTTGCCTA TAAAATCGAG CAGTCTTTAA GCAAAGACAA
 501 AATCCTCGAG TTGTATTTCA ATCAGATTTA CCTCGGTCAG CGCGCCTATG
 551 GTTTTGCATC TGCCGCGCAA ATCTATTTCA ATAAGAATGT CCGAGATTTG
 601 ACTTTGGCGG AAGCCGCCAT GCTTGCGGGA CTGCCCAAGG CTCCGTCTGC
 651 CTATAATCCG ATTGTTAATC AGAACGTGC CAAGTTGCGC CAGAAGTATA
 701 TTTTGAACAA TATGCTCGAG GAGAAGATGA TTACCGTGCA ACAGCGCGAT
 751 CAGGCGTTGA ATGAGGAACT GCATTACGAG CGGTTTGTTC GGAAAATCGA
 801 TCAGAGTGCG TTATATGTGG CGGAAATGGT GCGTCAGGAA CTGTATGAGA
 851 AATACGGTGA AGATGCCTAT ACGCAGGGTT TTAAGGTTTA TACCACGGTC
 901 CGCGCCGATC ATCAGAAGGT GGCAACCGAG GCATTGCGCA AGGCTCTACG
 951 GAATTTCGAT CGCGGCAGCA GCTACCGCGG TGCGGAAAAC TATATCGATT
1001 TGAGTAAGAG TGAAGATGTC GAGGAGACTG TCAGCCAGTA TCTGTCGGGA
1051 CTCTATACCG TCGATAAAAT GGTTCCCGCC GTTGTGTTGG ATGTGACTAA
1101 AAAGAAAAAT GTCGTCATAC AGCTGCCCGG CGGCAGGCGG GTTACGCTTG
1151 ACAGGCGCGC CTTGGGTTTT GCGGCCCGCG CGGTCAATAA TGAAAAAATG
1201 GGGGAGGACC GTATCCGCAG GGGCGCGGTC ATCCGTGTCA AAACAACGG
1251 CGGGCGTTGG GCGGTGGTTC AAGAGCCGTT GCTGCAGGGG GCTTTGGGTT
1301 CGCTGGATGC AAAAACCGGA GCTGTGCGCG CGCTGGTCGG CGGTTATGAT
1351 TTTCACAGCA AAACATTCAA TCGTGCCGTT CAGGCAATGC GGCAGCCGGG
1401 TTCGACCTTT AAGCCGTTTG TCTATTCGGC GGCATTATCT AAGGGGATGA
1451 CCGCGTCCAC AGTGGTTAAC GATGCGCCGA TTTCCCTGCC GGGGAAGGG
1501 CCGAACGGTT CGGTTTGGAC ACCTAAAAAT TCAGACGGCA GATATTCCGG
1551 CTACATTACT TTGAGACAGG CTCTGACGGC TTCCAAGAAT ATGGTTTCCA
1601 TCCGTATTTT GATGTCTATC GGTGTCGGTT ACGCGCAACA GTATATCCGG
1651 CGTTTCGGCT TCAGGTCGTC CGAGCTGCCG GCAAGCCTGT CTATGGCTTT
1701 AGGTACGGGC GAGACAACGC CGTTGAAAGT GGCGGAGGCA TATAGCGTAT
1751 TTGCGAACGG CGGATATAGG GTTTCTTCGC ACGTAATCGA TAAGATTTAT
1801 GACAGAGACG GCAGGTTGCG CGCCCAAATG CAACCTTTGG TGGCTGGGCA
1851 AAATGCGCCT CAGGCAATCG ATCCGCGCAA TGCCTATATT ATGTATAAGA
1901 TTATGCAGGA TGTGGTCCGT GTTGGTACGG CAAGGGGGGC AGCTGCGTTG
1951 GGAAGAACGG ATATTGCCGG TAAAACGGGT ACGACCAATG ACAATAAGGA
2001 TGCGTGGTTT GTCGGTTTTA ACCCTGATGT GGTTACTGCC GTATATATCG
2051 GCTTCGACAA ACCTAAGAGT ATGGGCGTG TCGGCTACGG CGGTACGATT
```

```
-continued
2101 GCGGTGCCGG TTTGGGTGGA CTATATGCGT TTTGCGTTGA AAGGAAAGCA

2151 GGGCAAGGGG ATGAAAATGC CTGAAGGTGT GGTCAGCAGC AATGGCGAAT

2201 ACTATATGAA GGAACGTATG GTAACCGATC CGGGCTTGAC GCTGGACAAC

2251 AGCGGTATTG CGCCGCAACC TTCCCGACGG GCAAAAGAAG ATGACGGGGG

2301 CGCGGCAGAA GGCGGACGGC AGGCGGCGGA TGACGAAGTC CGCCAAGATA

2351 TGCAGGAAAC GCCGGTGCTT CCGAGTAATA CTGGTTCCAA ACAGCAGCAG

2401 TTGGATTCTC TGTTTTAA
```

This corresponds to the amino acid sequence <SEQ ID 2678; ORF 791>:

```
m791.pep

1   MVNYYSAMIK KILTTCFGLV FGFCVFGVGL VAIAILVTYP KLPSLDSLQH
   51   YQPKMPLTIY SADGEVIGMY GEQRREFTKI GDFPEVLRNA VIAAEDKRFY
  101   RHWGVDVWGV ARAAVGNVVS GSVQSGASTI TQQVAKNFYL SSEKTFTRKF
  151   NEVLLAYKIE QSLSKDKILE LYFNQIYLGQ RAYGFASAAQ IYFNKNVRDL
  201   TLAEAAMLAG LPKAPSAYNP IVNPERAKLR QKYILNNMLE EKMITVQQRD
  251   QALNEELHYE RFVRKIDQSA LYVAEMVRQE LYEKYGEDAY TQGRKVYTTV
  301   RADHQKVATE ALRKALRNFD RGSSYRGAEN YIDLSKSEDV EETVSQYLSG
  351   LYTVDKMVPA VVLDVTKKKN VVIQLPGGRR VTLDRRALGF AARAVNNEKM
  401   GEDRIRRGAV IRVKNNGGRW AVVQEPLLQG ALGSLDAKTG AVRALVGGYD
  451   FHSKTFNRAV QAMRQPGSTF KPFVYSAALS KGMTASTVVN DAPISLPGKG
  501   PNGSVWTPKN SDGRYSGYIT LRQALTASKN MVSIRILMSI GVGYAQQYIR
  551   RFGFRSSELP ASLSMALGTG ETTPLKVAEA YSVFANGGYR VSSHVIDKIY
  601   DRDGRLRAQM QPLVAGQNAP QAIDPRNAYI MYKIMQDVVR VGTARGAAAL
  651   GRTDIAGKTG TTNDNKDAWF VGFNPDVVTA VYIGRDKPKS MGRVGYGGTI
  701   AVPVWVDYMR FALKGKQGKG MKMPEGVVSS NGEYYMKERM VTDPGLTLDN
  751   SGIAPQPSRR AKEDDGGAAE GGRQAADDEV RQDMQETPVL PSNTGSKQQQ
  801   LDSLF* g791/m791 97.3% identity in 805 aa overlap 10         20         30         40         50         60
    g791.pep  MVNYYSAMIKKILTTCFGLFFGFCVFGVGLVAIAILVTYPKLPSLDSLQHYQPKMPLTIY
              ||||||||||||||||||||| ||||||||||||||||||||||||||||||||||||||
    m791      MVNYYSAMIKKILTTCFGLVFGFCVFGVGLVAIAILVTYPKLPSLDSLQHYQPKMPLTIY
                  10         20         30         40         50         60

70         80         90        100        110        120
    g791.pep  SADGEVIGMYGEQRREFTKIGDFPEVLRNAVIAAEDKRFYRHWGVDVWGVARAAVGNVVS
              ||||||||||||||||||||||||||||||||||||||||||||||||||||||||||||
    m791      SADGEVIGMYGEQRREFTKIGDFPEVLRNAVIAAEDKRFYRHWGVDVWGVARAAVGNVVS
                  70         80         90        100        110        120

130        140        150        160        170        180
    g791.pep  GSVQSGASTITQQVAKNFYLSSEKTFTRKFNEVLLAYKIEQSLSKDKILELYFNQIYLGQ
              ||||||||||||||||||||||||||||||||||||||||||||||||||||||||||||
    m791      GSVQSGASTITQQVAKNFYLSSEKTFTRKFNEVLLAYKIEQSLSKDKILELYFNQIYLGQ
                 130        140        150        160        170        180

190        200        210        220        230        240
    g791.pep  RAYGFASAAQIYFNKNVRDLTLAEAAMLAGLPKAPSAYNPIVNPERAKLRQKYILNNMLE
              ||||||||||||||||||||||||||||||||||||||||||||||||||||||||||||
    m791      RAYGFASAAQIYFNKNVRDLTLAEAAMLAGLPKAPSAYNPIVNPERAKLRQKYILNNMLE
                 190        200        210        220        230        240
```

-continued

```
                  250       260       270       280       290       300
g791.pep  EKMITVQQRDQALNEELHYERFVRKIDQSALYVAEMVRRELYEKYGEDAYTQGFKVYTTV
          ||||||||||||||||||||||||||||||||||||||:|||||||||||||||||||||
m791      EKMITVQQRDQALNEELHYERFVRKIDQSALYVAEMVRQELYEKYGEDAYTQGFKVYTTV
                  250       260       270       280       290       300

310       320       330       340       350       360
g791.pep  RTDHQKAATEALRKALRNFDRGSSYRGAENYIDLSKSEDVEETVSQYLSGLYTVDKMVPA
          |:||||:|||||||||||||||||||||||||||||||||||||||||||||||||||||
m791      RADHQKVATEALRKALRNFDRGSSYRGAENYIDLSKSEDVEETVSQYLSGLYTVDKMVPA
                  310       320       330       340       350       360

370       380       390       400       410       420
g791.pep  VVLDVTKKKNVVIQLPGGRRVALDRRALGFAARAVDNEKMGEDRIRRGAVIRVKNNGGRW
          |||||||||||||||||||||:|||||||||||||:||||||||||||||||||||||||
m791      VVLDVTKKKNVVIQLPGGRRVTLDRRALGFAARAVNNEKMGEDRIRRGAVIRVKNNGGRW
                  370       380       390       400       410       420

430       440       450       460       470       480
g791.pep  AVVQEPLLQGALVSLDAKTGAVRALVGGYDFHSKTFNRAVQAMRQPGSTFKPFVYSAALS
          |||||||||||| |||||||||||||||||||||||||||||||||||||||||||||||
m791      AVVQEPLLQGALGSLDAKTGAVRALVGGYDFHSKTFNRAVQAMRQPGSTFKPFVYSAALS
                  430       440       450       460       470       480

490       500       510       520       530       540
g791.pep  KGMTASTVVNDAPISLPGKGPNGSVWTPKNSDGRYSGYITLRQALTASKNMVSIRILMSI
          ||||||||||||||||||||||||||||||||||||||||||||||||||||||||||||
m791      KGMTASTVVNDAPISLPGKGPNGSVWTPKNSDGRYSGYITLRQALTASKNMVSIRILMSI
                  490       500       510       520       530       540

550       560       570       580       590       600
g791.pep  GVGYAQQYIRRFGFRPSELPASLSMALGTGETTPLKVAEAYSVFANGGYRVSSHVIDKIY
          ||||||||||||||| ||||||||||||||||||||||||||||||||||||||||||||
m791      GVGYAQQYIRRFGFRSSELPASLSMALGTGETTPLKVAEAYSVFANGGYRVSSHVIDKIY
                  550       560       570       580       590       600

610       620       630       640       650       660
g791.pep  DRDGRLRAQMQPLVAGQNAPQAIDPRNAYIMYKIMQDVVRVGTARGAAALGRTDIAGKTG
          ||||||||||||||||||||||||||||||||||||||||||||||||||||||||||||
m791      DRDGRLRAQMQPLVAGQNAPQAIDPRNAYIMYKIMQDVVRVGTARGAAALGRTDIAGKTG
                  610       620       630       640       650       660

670       680       690       700       710       720
g791.pep  TTNDNKDAWFVGFNPDVVTAVYIGFDKPKSMGRAGYGGTIAVPVWVDYMRFALKGKQGKG
          |||||||||||||||||||||||||||||||||:||||||||||||||||||||||||||
m791      TTNDNKDAWFVGFNPDVVTAVYIGFDKPKSMGRVGYGGTIAVPVWVDYMRFALKGKQGKG
                  670       680       690       700       710       720

730       740       750       760       770       780
g791.pep  MKMPEGVVSSNGEYYMKERMVTDPGLMLDNSGIAPQPSRRAKEDDEAAVENEQQGRSDET
          |||||||||||||||||||||||||| |||||||||||||||||| :|:|: :|: :||:
m791      MKMPEGVVSSNGEYYMKERMVTDPGLTLDNSGIAPQPSRRAKEDDGGAAEGGRQAADDEV
                  730       740       750       760       770       780

790       800
g791.pep  RQDVQETPVLPSNTDSKQQQLDSLFX
          |||:|||||||||| |||||||||||
m791      RQDMQETPVLPSNTGSKQQQLDSLFX
                  790       800
```

The following partial DNA sequence was identified in *N. meningitidis* <SEQ ID 2679>:

```
a791.seq
    1  ATGGTAAATT ATTATTCAGC TATGATTAAA AAGATTTTAA CGACTTGTTT

51  TGGTTTGGTT TTTGGGTTTT GTGTATTTGG AGTGGGTTTG GTTGCCATTG

101  CTATTTTGGT AACGTATCCG AAACTGCCGT CTTTGGATTC TTTGCAGCAT

151  TACCAGCCTA AAATGCCGTT GACTATTTAT TCGGCGGATG GGGAAGTCAT

201  CGGTATGTAT GGGGAGCAGC GGCGCGAATT TACAAAAATC GGCGATTTCC

251  CAGAGGTGTT GCGGAATGCG GTTATCGCCG CCGAGGATAA ACGCTTTTAC
```

-continued

```
 301 CGGCATTGGG GGGTGGATGT TTGGGGTGTT GCCCGCGCTG CCGTCGGCAA
 351 TGTCGTGTCC GGCAGCGTGC AGTCGGGTGC GAGTACGATT ACGCAGCAGG
 401 TGGCGAAAAA TTTTTATTTG AGCAGTGAAA AAACGTTCAC ACGCAAATTC
 451 AATGAGGTGT TGCTTGCCTA TAAAATCGAG CAGTCTTTAA GCAAAGACAA
 501 AATCCTCGAG TTGTATTTCA ATCAGATTTA CCTCGGTCAG CGCGCCTATG
 551 GTTTTGCATC TGCCGCGCAA ATCTATTTCA ATAAGAATGT CCGAGATTTG
 601 ACTTTGGCGG AAGCCGCCAT GCTTGCGGGA CTGCCCAAGG CTCCGTCTGC
 651 CTATAATCCG ATTGTTAATC CAGAACGTGC CAAGTTGCGC CAGAAGTATA
 701 TTTTGAACAA TATGCTCGAG GAGAAGATGA TTACCGTGCA ACAGCGCGAT
 751 CAGGCGTTGA ATGAGGAACT GCATTACGAG CGGTTTGTTC GGAAAATCGA
 801 TCAGAGTGCT TTATATGTGG CGGAAATGGT GCGTCAGGAA CTGTATGAGA
 851 AATACGGTGA AGATGCCTAT ACGCAGGGTT TTAAGGTTTA TACCACGGTC
 901 CGCGCCGATC ATCAGAAGGT GGCAACCGAG GCATTGCGCA AGGCTCTACG
 951 GAATTTCGAT CGCGGCAGCA GCTACCGCGG TGCGGAAAAC TATATCGATT
1001 TGAGTAAGAG TGAAGATGTC GAGGAGACTG TCAGCCAGTA TCTGTCGGGA
1051 CTCTATACCG TCGATAAAAT GGTTCCCGCC GTTGTGTTGG ATGTGACTAA
1101 AAAGAAAAAT GTCGTCATAC AGCTGCCCGG CGGCAGGCGG GTTACGCTTG
1151 ACAGGCGCGC CTTGGGTTTT GCGGCCCGCG CGGTCAATAA TGAAAAAATG
1201 GGGGAGGACC GTATCCGCAG GGGCGCGGTC ATCCGTGTCA AAAACAACGG
1251 CGGGCGTTGG GCGGTGGTTC AAGAGCCGTT GCTGCAGGGG GCTTTGGTTT
1301 CGCTGGATGC AAAAACCGGA GCTGTGCGCG CGCTGGTCGG CGGTTATGAT
1351 TTTCACAGCA AAACATTCAA TCGTGCCGTT CAGGCAATGC GGCAGCCGGG
1401 TTCGACCTTT AAGCCGTTTG TCTATTCGGC GGCATTATCT AAGGGGATGA
1451 CCGCGTCCAC AGTGGTTAAC GATGCGCCGA TTTCCCTGCC GGGGAAGGG
1501 CCGAACGGTT CGGTTTGGAC ACCTAAAAAT TCAGACGGCA GATATTCCGG
1551 CTACATTACT TTGAGACAGG CTCTGACGGC TTCCAAGAAT ATGGTTTCCA
1601 TCCGTATTTT GATGTCTATC GGTGTCGGTT ACGCGCAACA GTATATCCGG
1651 CGTTTCGGCT TCAGGTCGTC CGAGCTGCCG GCAAGCCTGT CTATGGCTTT
1701 AGGTACGGGC GAGACAACGC CGTTGAAAGT GGCGGAGGCA TATAGCGTAT
1751 TTGCGAACGG CGGATATAGG GTTTCTTCGC ACGTAATCGA TAAGATTTAT
1801 GACAGAGACG GCAGGTTGCG CGCCCAAATG CAACCTTTGG TGGCCGGGCA
1851 AAATGCGCCT CAGGCAATCG ATCCGCGCAA TGCCTATATT ATGTATAAGA
1901 TTATGCAGGA TGTGGTCCGT GTTGGTACGG CAAGGGGGGC AGCTGCGTTG
1951 GGAAGAACGG ATATTGCCGG TAAACGGGT ACGACCAATG ACAATAAGGA
2001 TGCGTGGTTT GTCGGTTTTA ACCCTGATGT GGTTACTGCC GTATATATCG
2051 GCTTCGACAA ACCTAAGAGT ATGGGCGTG TCGGCTACGG CGGTACGATT
2101 GCGGTGCCGG TTTGGGTGGA CTATATGCGT TTTGCGTTGA AAGGAAAGCA
2151 GGGCAAGGGG ATGAAAATGC CTGAAGGTGT GGTCAGCAGC AATGGCGAAT
2201 ACTATATGAA GGAACGTATG GTAACCGATC CGGGCTTGAC GCTGGACAAC
2251 AGCGGTATTG CGCCGCAACC TTCCCGACGG GCAAAAGAAG ATGACGGGGG
2301 CGCGGCAGAA GGCGGACGGC AGGCGGCGGA TGACGAAGTC CGCCAAGATA
```

```
2351 TGCAGGAAAC GCCGGTGCTT CCGAGTAATA CTGGTTCCAA ACAGCAGCAG

2401 TTGGATTCTC TGTTTTAA
```

This corresponds to the amino acid sequence <SEQ ID 2680; ORF 791.a>:

```
a791.pep

1  MVNYYSAMIK KILTTCFGLV FGFCVFGVGL VAIAILVTYP KLPSLDSLQH
   51  YQPKMPLTIY SADGEVIGMY GEQRREFTKI GDFPEVLRNA VIAAEDKRFY
  101  RHWGVDVWGV ARAAVGNVVS GSVQSGASTI TQQVAKNFYL SSEKTFTRKF
  151  NEVLLAYKIE QSLSKDKILE LYFNQIYLGQ RAYGFASAAQ IYFNKNVRDL
  201  TLAEAAMLAG LPKAPSAYNP IVNPERAKLR QKYILNNMLE EKMITVQQRD
  251  QALNEELHYE RFVRKIDQSA LYVAEMVRQE LYEKYGEDAY TQGFKVYTTV
  301  RADHQKVATE ALRKALRNFD RGSSYRGAEN YIDLSKSEDV EETVSQYLSG
  351  LYTVDKMVPA VVLDVTKKKN VVIQLPGGRR VTLDRRALGF AARAVNNEKM
  401  GEDRIRRGAV IRVKNNGGRW AVVQEPLLQG ALVSLDAKTG AVRALVGGYD
  451  FHSKTFNRAV QAMRQPGSTF KPFVYSAALS KGMTASTVVN DAPISLPGKG
  501  PNGSVWTPKN SDGRYSGYIT LRQALTASKN MVSIRILMSI GVGYAQQYIR
  551  RFGFRSSELP ASLSMALGTG ETTPLKVAEA YSVFANGGYR VSSHVIDKIY
  601  DRDGRLRAQM QPLVAGQNAP QAIDPRNAYI MYKIMQDVVR VGTARGAAAL
  651  GRTDIAGKTG TTNDNKDAWF VGFNPDVVTA VYIGFDKPKS MGRVGYGGTI
  701  AVPVWVDYMR FALKGKQGKG MKMPEGVVSS NGEYYMKERM VTDPGLTLDN
  751  SGIAPQPSRR AKEDDGGAAE GGRQAADDEV RQDMQETPVL PSNTGSKQQQ
  801  LDSLF* a791/m791 99.9% identity in 805 aa overlap 10        20        30        40        50        60
a791.pep  MVNYYSAMIKKILTTCFGLVFGFCVFGVGLVAIAILVTYPKLPSLDSLQHYQPKMPLTIY
          ||||||||||||||||||||||||||||||||||||||||||||||||||||||||||||
m791      MVNYYSAMIKKILTTCFGLVFGFCVFGVGLVAIAILVTYPKLPSLDSLQHYQPKMPLTIY
                  10        20        30        40        50        60

70        80        90       100       110       120
a791.pep  SADGEVIGMYGEQRREFTKIGDFPEVLRNAVIAAEDKRFYRHWGVDVWGVARAAVGNVVS
          ||||||||||||||||||||||||||||||||||||||||||||||||||||||||||||
m791      SADGEVIGMYGEQRREFTKIGDFPEVLRNAVIAAEDKRFYRHWGVDVWGVARAAVGNVVS
                  70        80        90       100       110       120

130       140       150       160       170       180
a791.pep  GSVQSGASTITQQVAKNFYLSSEKTFTRKFNEVLLAYKIEQSLSKDKILELYFNQIYLGQ
          ||||||||||||||||||||||||||||||||||||||||||||||||||||||||||||
m791      GSVQSGASTITQQVAKNFYLSSEKTFTRKFNEVLLAYKIEQSLSKDKILELYFNQIYLGQ
                 130       140       150       160       170       180

190       200       210       220       230       240
a791.pep  RAYGFASAAQIYFNKNVRDLTLAEAAMLAGLPKAPSAYNPIVNPERAKLRQKYILNNMLE
          ||||||||||||||||||||||||||||||||||||||||||||||||||||||||||||
m791      RAYGFASAAQIYFNKNVRDLTLAEAAMLAGLPKAPSAYNPIVNPERAKLRQKYILNNMLE
                 190       200       210       220       230       240

250       260       270       280       290       300
a791.pep  EKMITVQQRDQALNEELHYERFVRKIDQSALYVAEMVRQELYEKYGEDAYTQGFKVYTTV
          ||||||||||||||||||||||||||||||||||||||||||||||||||||||||||||
m791      EKMITVQQRDQALNEELHYERFVRKIDQSALYVAEMVRQELYEKYGEDAYTQGFKVYTTV
                 250       260       270       280       290       300
```

```
              310        320        330        340        350        360
a791.pep  RADHQKVATEALRKALRNFDRGSSYRGAENYIDLSKSEDVEETVSQYLSGLYTVDKMVPA
          ||||||||||||||||||||||||||||||||||||||||||||||||||||||||||||
m791      RADHQKVATEALRKALRNFDRGSSYRGAENYIDLSKSEDVEETVSQYLSGLYTVDKMVPA
              310        320        330        340        350        360

370        380        390        400        410        420
a791.pep  VVLDVTKKKNVVIQLPGGRRVTLDRRALGFAARAVNNEKMGEDRIRRGAVIRVKNNGGRW
          ||||||||||||||||||||||||||||||||||||||||||||||||||||||||||||
m791      VVLDVTKKKNVVIQLPGGRRVTLDRRALGFAARAVNNEKMGEDRIRRGAVIRVKNNGGRW
              370        380        390        400        410        420

430        440        450        460        470        480
a791.pep  AVVQEPLLQGALVSLDAKTGAVRALVGGYDFHSKTFNRAVQAMRQPGSTFKPFVYSAALS
          |||||||||||| |||||||||||||||||||||||||||||||||||||||||||||||
m791      AVVQEPLLQGALGSLDAKTGAVRALVGGYDFHSKTFNRAVQAMRQPGSTFKPFVYSAALS
              430        440        450        460        470        480

490        500        510        520        530        540
a791.pep  KGMTASTVVNDAPISLPGKGPNGSVWTPKNSDGRYSGYITLRQALTASKNMVSIRILMSI
          ||||||||||||||||||||||||||||||||||||||||||||||||||||||||||||
m791      KGMTASTVVNDAPISLPGKGPNGSVWTPKNSDGRYSGYITLRQALTASKNMVSIRILMSI
              490        500        510        520        530        540

550        560        570        580        590        600
a791.pep  GVGYAQQYIRRFGFRPSELSASLSMALGTGETTPLKVAEAYSVFANGGYRVSSHVIDKIY
          ||||||||||||||||| ||||| |||||||||||||||||||||||||||||||||||||
m791      GVGYAQQYIRRFGFRSSELPASLSMALGTGETTPLKVAEAYSVFANGGYRVSSHVIDKIY
              550        560        570        580        590        600

610        620        630        640        650        660
a791.pep  DRDGRLRAQMQPLVAGQNAPQAIDPRNAYIMYKIMQDVVRVGTARGAAALGRTDIAGKTG
          ||||||||||||||||||||||||||||||||||||||||||||||||||||||||||||
m791      DRDGRLRAQMQPLVAGQNAPQAIDPRNAYIMYKIMQDVVRVGTARGAAALGRTDIAGKTG
              610        620        630        640        650        660

670        680        690        700        710        720
a791.pep  TTNDNKDAWFVGFNPDVVTAVYIGFDKPKSMGRVGYGGTIAVPVWVDYMRFALKGKQGKG
          ||||||||||||||||||||||||||||||||||||||||||||||||||||||||||||
m791      TTNDNKDAWFVGFNPDVVTAVYIGFDKPKSMGRVGYGGTIAVPVWVDYMRFALKGKQGKG
              670        680        690        700        710        720

730        740        750       7760        770        780
a791.pep  MKMPEGVVSSNGEYYMKERMVTDPGLTLDNSGIAPQPSRRAKEDDGGAAEGGRQAADDEV
          ||||||||||||||||||||||||||||||||||||||||||||||||||||||||||||
m791      MKMPEGVVSSNGEYYMKERMVTDPGLTLDNSGIAPQPSRRAKEDDGGAAEGGRQAADDEV
              730        740        750        760        770        780

790        800
a791.pep  RQDMQETPVLPSNTGSKQQQLDSLFX
          ||||||||||||||||||||||||||
m791      RQDMQETPVLPSNTGSKQQQLDSLFX
              790        800
```

The following partial DNA sequence was identified in *N. gonorrhoeae* <SEQ ID 2681>:

```
g792.seq
   1 ATGTTCCGCA TCGTCAAATG GCTGATTGCC CTGCCCGTCG GCATCTTTAT

51 CTTTTTCAAT GCCTATGTGT ACGGCAACAT CATCACCTAC CGCGCCGTCG

101 CGCCCCATCG GACTGCCTTT ATGTCGATGC GGATGAAGCA GTTTGAACAA

151 GAAGGTCGCG ATGTCGCACT GGATTACCGC TGGGTGCCCT ACAACCGCAT

201 TTCCACCAAC CTGAAAAAAG CCCTGATTGC TTCCGAAGAT GTCCGTTTTG

251 CCggacacgg gggcttcGat GGGGACGGCa tTCAAAACGC CATCAGGCGC

301 AACCGGAACA GCGGCGAAGT GAAGGCGGGC GGATCGACCA TCAGCCAGCA

351 GCTTGCCAAA AACCTCTTCC TCAACGAAAG CCGCAACTAT CTGCGCAAAG

401 GGGAAGAGGC GGCCATTACG GCAATGATGG AAGCTGTTAC CGACAAAAAC
```

```
-continued
451 AGGATTTTCG AACTGTATTT AAACTCAATC GAATGGCACT ACGGCgtTTT

501 CGGCGCGGAA GCTGCGTCCC GGtatTttTA TAAAAAACCG GCcgcaGACC

551 TGACcAAACA GCAggcggcG aaactgacgg tactcgtccc cgccccgttt 601 tactactctg accatccaaa aagcaaacgg ctgcgcaaca aaaccaatat 651 cgtgctcaga cgcatgggtt cggcaaatta ccccaaagcg aaacggactg 701 attgttccag atatggaaat gccgcctgaa ctggggttcg aacggcatat 751 gttttctggg acttataa
```

This corresponds to the amino acid sequence <SEQ ID 2682; ORF 792.ng>:

```
g792.pep
  1 MFRIVKWLIA LPVGIFIFFN AYVYGNIITY RAVAPHRTAF MSMRMKQFEQ

51 EGRDVALDYR WVPYNRISTN LKKALIASED VRFAGHGGFD GDGIQNAIRR

101 NRNSGEVKAG GSTISQQLAK NLFLNESRNY LRKGEEAAIT AMMEAVTDKN

151 RIFELYLNSI EWHYGVFGAE AASRYFYKKP AADLTKQQAA KLTVLVPAPF

201 YYSDHPKSKR LRNKTNIVLR RMGSANYPKA KRTDCSRYGN AA*TGVRTAY

251 VFWDL*
```

The following partial DNA sequence was identified in *N. meningitidis* <SEQ ID 2683>:

```
m792.seq
  1 ATGTTCCGCA TCATCAAATG GCTGATTGCC CTGCCCGTCG GCATCTTTAT

51 CTTTTTCAAT GCCTATGTGT ACGGCAACAT CATTACCTAC CGCGCCGTCG

101 CGCCCCATCG GACTGCCTTT ATGTCGATGC GGATGAAGCA GTTTGAACAG

151 GAAGGTCGCG ATGTCGCACT GGATTACCGC TGGATGCCCT ACAAACGCAT

201 TTCCACCAAC CTGAAAAAAG CCCTGATTGC TTCCGAAGAT GCCCGTTTCG

251 CCGGGCACGG CGGCTTCGAT TGGGGCGGCA TTCAAAACGC CATCAGGCGC

301 AACCGGAACA GCGGCAAAGT GAAGGCGGGC GGCTCGACCA TCAGCCAGCA

351 GCTTGCCAAA AACCTGTTTT TAAACGAAAG CCGCAGCTAT ATCCGCAAAG

401 GCGAAGAAGC GGCGATTACC GCGATGATGG AAGCCGTTAC CGACAAAGAC

451 AGGATTTTTG AACTGTATTT AAACTCAATC GAATGGCACT ACGGCGTTTT

501 CGGCGCGGAA GCCGCGTCCC GGTATTTTTA TCAAATACCC GCCGCCAAGC

551 TGACCAAACA GCAGGCGGCA AAACTGACGG CGCGCGTCCC CGCCCCGCTC

601 TACTACGCCG ACCATCCGAA AAGCAAACGG CTCCGCAACA AAACCAATAT

651 CGTGCTCAAA CGCATGGGTT CGGCAGAGTT GCCTGAAAGC GACACGGACT

701 GA
```

This corresponds to the amino acid sequence <SEQ ID 2684; ORF 792>:

```
m792.pep
  1 MFRIIKWLIA LPVGIFIFFN AYVYGNIITY RAVAPHRTAF MSMRMKQFEQ

51 EGRDVALDYR WMPYKRISTN LKKALIASED ARFAGHGGFD WGGIQNAIRR
```

-continued

```
101  NRNSGKVKAG GSTISQQLAK NLFLNESRSY IRKGEEAAIT AMMEAVTDKD

151  RIFELYLNSI EWHYGVFGAE AASRYFYQIP AAKLTKQQAA KLTARVPAPL

201  YYADHPKSKR LRNKTNIVLK RMGSAELPES DTD*
``` g792/m792 90.4% identity in 230 aa overlap

```
                   10        20        30        40        50        60
g792.pep  MFRIVKWLIALPVGIFIFFNAYVYGNIITYRAVAPHRTAFMSMRMKQFEQEGRDVALDYR
          ||||:|||||||||||||||||||||||||||||||||||||||||||||||||||||||
m792      MFRIIKWLIALPVGIFIFFNAYVYGNIITYRAVAPHRTAFMSMRMKQFEQEGRDVALDYR
                   10        20        30        40        50        60

70        80        90       100       110       120
g792.pep  WVPYNRISTNLKKALIASEDVRFAGHGGFDGDGIQNAIRRNRNSGEVKAGGSTISQQLAK
          |:||:|||||||||||||||:|||||||||  |||||||||||||:||||||||||||||
m792      WMPYKRISTNLKKALIASEDARPAGHGGFDWGGIQNAIRRNRNSGKVKAGGSTISQQLAK
                   70        80        90       100       110       120

130       140       150       160       170       180
g792.pep  NLFLNESRNYLRKGEEAAITAMMEAVTDKNRIFELYLNSIEWHYGVFGAEAASRYFYKKP
          ||||||||:|:||||||||||||||||||:|||||||||||||||||||||||||||: |
m792      NLFLNESRSYIRKGEEAAITAMMEAVTDKDRIFELYLNSIEWHYGVFGAEAASRYFYQIP
                  130       140       150       160       170       180

190       200       210       220       230       240
g792.pep  AADLTKQQAAKLTVLVPAPFYYSDHPKSKRLRNKTNIVLRRMGSANYPKAKRTDCSRYGN
          || ||||||||||: ||||:||:||||||||||||||||:|||||: |::
m792      AAKLTKQQAAKLTARVPAPLYYADHPKSKRLRNKTNIVLKMGSAELPESDTDX
                  190       200       210       220       230

250
g792.pep  AAXTGVRTAYVFWDLX
```

The following partial DNA sequence was identified in *N. meningitidis* <SEQ ID 2685>:

```
a792.seq
  1 ATGTTCCGCA TCATCAAATG GCTGATTGCC CTGCCCGTCG GCATCTTTAT

51 CTTTTTCAAT GCCTATGTGT ACGGCAACAT CATTACCTAC CGCGCCGTCG

101 CGCCCCATCG GACTGCCTTT ATGTCGATGC GGATGAAGCA GTTTGAACAG

151 GAAGGTCGCG ATGTCGCACT GGATTACCGC TGGATGCCCT ACAAACGCAT

201 TTCCACCAAC CTGAAAAAAG CCCTGATTGC TTCCGAAGAT GCCCGTTTCG

251 CCGGGCACGG CGGCTTCGAT TGGGGCGGCA TTCAAAACGC CATCAGGCGC

301 AACCGGAACA GCGGCAAAGT GAAGGCGGGC GGCTCGACCA TCAGCCAGCA

351 GCTTGCCAAA AACCTGTTTT TAAACGAAAG CCGCAGCTAT ATCCGCAAAG

401 GCGAAGAAGC GGCGATTACC GCGATGATGG AAGCCGTTAC CGACAAAGAC

451 AGGATTTTTG AACTGTATTT AAACTCAATC GAATGGCACT ACGGCGTTTT

501 CGGCGCGGAA GCCGCGTCCC GGTATTTTTA TCAAATACCC GCCGCCAAGC

551 TGACCAAACA GCAGGCGGCA AAACTGACGG CGCGCGTCCC CGCCCCGCTC

601 TACTACGCCG ACCATCCGAA AAGCAAACGG CTCCGCAACA AAACCAATAT

651 CGTGCTCAGA CGCATGGGTT CGGCAGAGTT GCCTGAAAGC GACACGGACT

701 GA
```

This corresponds to the amino acid sequence <SEQ ID 2686; ORF 792.a>:

```
a792.pep

1  MFRIIKWLIA LPVGIFIFFN AYVYGNIITY RAVAPHRTAF MSMRMKQFEQ

51  EGRDVALDYR WMPYKRISTN LKKALIASED ARFAGHGGFD WGGIQNAIRR

101  NRNSGKVKAG GSTISQQLAK NLFLNESRSY IRKGEEAAIT AMMEAVTDKD
```

-continued

```
    151 RIFELYLNSI EWHYGVFGAE AASRYFYQIP AAKLTKQQAA KLTARVPAPL

201 YYADHPKSKR LRNKTNIVLR RMGSAELPES DTD*
``` m792/a792 99.6% identity in 233 aa overlap

```
                  10         20         30         40         50         60
a792.pep  MFRIIKWLIALPVGIFIFFNAYVYGNIITYRAVAPHRTAFMSMRMKQFEQEGRDVALDYR
          ||||||||||||||||||||||||||||||||||||||||||||||||||||||||||||
m792      MFRIIKWLIALPVGIFIFFNAYVYGNIITYRAVAPHRTAFMSMRMKQFEQEGRDVALDYR
                  10         20         30         40         50         60

70         80         90        100        110        120
a792.pep  WMPYKRISTNLKKALIASEDARFAGHGGFDWGGIQNAIRRNRNSGKVKAGGSTISQQLAK
          ||||||||||||||||||||||||||||||||||||||||||||||||||||||||||||
m792      WMPYKRISTNLKKALIASEDARFAGHGGFDWGGIQNAIRRNRNSGKVKAGGSTISQQLAK
                  70         80         90        100        110        120

130        140        150        160        170        180
a792.pep  NLFLNESRSYIRKGEEAAITAMMEAVTDKDRIFELYLNSIEWHYGVFGAEAASRYFYQIP
          ||||||||||||||||||||||||||||||||||||||||||||||||||||||||||||
m792      NLFLNESRSYIRKGEEAAITAMMEAVTDKDRIFELYLNSIEWHYGVFGAEAASRYFYQIP
                 130        140        150        160        170        180

190        200        210        220        230
a792.pep  AAKLTKQQAAKLTARVPAPLYYADHPKSKRLRNKTNIVLRRMGSAELPESDTDX
          |||||||||||||||||||||||||||||||||||||||||||||:|||||||
m792      AAKLTKQQAAKLTARVPAPLYYADHPKSKRLRNKTNIVLKRMGSAELPESDTDX
                 190        200        210        220        230
```

The following partial DNA sequence was identified in *N. gonorrhoeae* <SEQ ID 2687>:

```
g793.seq
    1 ATGTTGATTA AAAGCGAATA TAAGCCCCGG ATGCTGCCCA AGAAGAGCA

51 GGTCAAAAAG CCGATGACCA GTAACGGACG GATTAGCTTC GTCCTGATGG

101 CAATGGCGGT CTTGTTTGCC TGTCTGATTG CCCGCGGGCT GTATCTGCAG

151 ACGGTAACGT ATAACTTTTT GAAAGAACAG GGCGACAACC GGATTGTGCG

201 GACTCAAGCA TTGCCGGCTA CACGCGGTAC GGTTTCGGAC CGGAACGGTG

251 CGGTTTTGGC GTTGAGCGCG CCGACGGAGT CCCTGTTTGC CGTGCCTAAA

301 GATATGAAGG AAATGCCGTC TGCCGCCCAA TTGGAACGCC TGTCCGAGCT

351 TGTCGATGTG CCGGTCGATG TTTTGAGGAA CAAACTCGAA CAGAAAGGCA

401 AGTCGTTTAT TTGGATCAAG CGGCAGCTCG ATCCCAAGGT TGCCGAAGAG

451 GTCAAAGCCT TGGGTTTGGA AAACTTTGTA TTTGAAAAAG AATTAAAACG

501 CCATTACCCG ATGGGCAACC TGTTTGCACA CGTCATCGGA TTTACCGATA

551 TTGACGGCAA AGGTCAGGAA GGTTTGGAAC TTTCGCTTGA AGACAGCCTG

601 TATGGCGAAG ACGGCGCGGA AGTTGTTTTG CGGGACCGGC AGGGCAATAT

651 TGTGGACAGC TTGGACTCCC CGCGCAATAA AGCACCGCAA AACGGCAAAG

701 ACATCATCCT TTCCCTCGAT CAGAGGATTC AGACCTTGGC CTATGAAGAG

751 TTGAACAAGG CGGTCGAATA CCATCAGGCA AAAGCCGGAA CGGTGGTGGT

801 TTTGGATGCC CGCACGGGGG AAATCCTCGC CTTGGCCAAT ACGCCCGCCT

851 ACGATCCCAA CAGACCCGGC CGGGCAGACA GCGAACAGCG GCGCAACCGT

901 GCCGTAACCG ATATGATCGA ACCTGGTTCG GCAATCAAAC CGTTCGTGAT

951 TGCGAAGGCA TTGGATGCGG GCAAAACCGA TTTGAACGAA CGGCTGAATA

1001 CGCAGCCTTA TAAAATCGGA CCGTCTCCCG TGCGCGATGA TACCCATGTT

1051 TACCCCTCTT TGGATGTGCG CGGCATTATG CAGAAATCGT CCAACGTCGG
```

-continued

```
1101 CACAAGCAAA CTGTCTGCGC GTTTCGGCGC CGAAGAAATG TATGACTTCT

1151 ATCATGAATT GGGCATCGGT GTGCGTATGC ACTCGGGCTT TCCGGGGGAA

1201 ACTGCAGGTT TGTTGAGAAA TTGGCGCAGG TGGCGGCCCA TCGAACAGGC

1251 GACGATGTCT TTCGGTTACG GTCTGCAATT GAGCCTGCTG CAATTGGCGC

1301 GCGCCTATAC CGCACTGACG CACGACGGCG TTTTGCTGCC GCTCAGCTTT

1351 GAGAAGCAGG CGGTTGCGCC GCAAGGCAAA CGCATATTCA AGAATCGAC

1401 CGCGCGCGAG GTACGCAATC TGATGGTTTC CGTAACCGAG CCGGGCGGCA

1451 CCGGTACGGC GGGTGCGGTG GACGGTTTCG ATGTCGGCGC TAAAACCGGC

1501 ACGGCGCGCA AGTTCGTCAA CGGGCGTTAT GCCGACAACA AACACGTCGC

1551 TACCTTTATC GGTTTTGCCC CCGCCAAAAA CCCCCGTGTG ATTGTGGCGG

1601 TAACCATCGA CGAACCGACT GCCCACGGCT ATTACGGCGG CGTAGTGGCA

1651 GGGCCGCCCT TCAAAAAAAT TATGGGCGGC AGCCTGAACA TCTTGGGCAT

1701 TTCCCCGACC AAGCCACTGA CCGCCGCAGC CGTCAAAACA CCGTCTTAA
```

This corresponds to the amino acid sequence <SEQ ID 2688; ORF 793.ng>:

```
g793.pep
   1 MLIKSEYKPR MLPKEEQVKK PMTSNGRISF VLMAMAVLFA CLIARGLYLQ

51 TVTYNFLKEQ GDNRIVRTQA LPATRGTVSD RNGAVLALSA PTESLFAVPK

101 DMKEMPSAAQ LERLSELVDV PVDVLRNKLE QKGKSFIWIK RQLDPKVAEE

151 VKALGLENFV FEKELKRHYP MGNLFAHVIG FTDIDGKGQE GLELSLEDSL

201 YGEDGAEVVL RDRQGNIVDS LDSPRNKAPQ NGKDIILSLD QRIQTLAYEE

251 LNKAVEYHQA KAGTVVVLDA RTGEILALAN TPAYDPNRPG RADSEQRRNR

301 AVTDMIEPGS AIKPFVIAKA LDAGKTDLNE RLNTQPYKIG PSPVRDDTHV

351 YPSLDVRGIM QKSSNVGTSK LSARFGAEEM YDFYHELGIG VRMHSGFPGE

401 TAGLLRNWRR WRPIEQATMS FGYGLQLSLL QLARAYTALT HDGVLLPLSF

451 EKQAVAPQGK RIFKESTARE VRNLMVSVTE PGGTGTAGAV DGFDVGAKTG

501 TARKFVNGRY ADNKHVATFI GFAPAKNPRV IVAVTIDEPT AHGYYGGVVA

551 GPPFKKIMGG SLNILGISPT KPLTAAAVKT PS*
```

The following partial DNA sequence was identified in *N. meningitidis* <SEQ ID 2689>:

```
m793.seq
   1 ATGTTGATTA AGAGCGAATA TAAGCCTCGG ATGCTGCCCA AAGAAGAGCA

51 GGTCAAAAAG CCGATGACCA GTAACGGACG GATCAGCTTC GTCCTGATGG

101 CAATAGCGGT CTTGTTTGCC GGTCTGATTG CTCGCGGACT GTATCTGCAG

151 ACGGTAACGT ATAACTTTTT GAAAGAACAG GGCGACAACC GGATTGTGCG

201 GACTCAAACA TTGCCGGCTA CACGCGGTAC GGTTTCGGAC CGGAACGGTG

251 CGGTTTTGGC GTTGAGTGCG CCGACGGAGT CCCTGTTTGC CGTGCCTAAA

301 GAGATGAAGG AAATGCCGTC TGCCGCACAA TTGGAACGCC TGTCCGAGCT

351 TGTCGATGTG CCGGTTGATG TTTTGAGGAA CAAGCTCGAA CAGAAAGGCA

401 AGTCGTTTAT CTGGATTAAG CGGCAGCTCG ATCCCAAGGT TGCCGAAGAG
```

```
 451 GTCAAAGCCT TGGGTTTGGA AAACTTTGTA TTTGAAAAAG AATTAAAACG

501 CCATTACCCG ATGGGCAACC TGTTTGCACA CGTCATCGGA TTTACCGATA

551 TTGACGGCAA AGGTCAGGAA GGTTTGGAAC TTTCGCTTGA AGACAGCCTG

601 CATGGCGAAG ACGGCGCGGA AGTCGTTTTG CGGGACCGGC AGGGCAATAT

651 TGTGGACAGC TTGGACTCCC CGCGCAATAA AGCCCCGAAA ACGGCAAAG

701 ACATCATCCT TTCCCTCGAT CAGAGGATTC AGACCTTGGC CTATGAAGAG

751 TTGAACAAGG CGGTCGAATA CCATCAGGCA AAAGCCGGAA CGGTGGTGGT

801 TTTGGATGCC CGCACGGGGG AAATCCTCGC CTTGGCCAAT ACGCCCGCCT

851 ACGATCCCAA CAGGCCCGGC CGGGCAGACA GCGAACAGCG GCGCAACCGT

901 GCCGTAACCG ATATGATCGA ACCCGGTTCG GCAATCAAAC CGTTTGTGAT

951 TGCGAAGGCA TTGGATGCGG GCAAAACCGA TTTGAACGAA CGGCTGAATA

1001 CGCAGCCTTA TAAAATCGGA CCGTCTCCCG TGCGCGATAC CCATGTTTAC

1051 CCCTCTTTGG ATGTGCGCGG CATCATGCAG AAATCGTCCA ACGTCGGCAC

1101 AAGCAAACTG TCTGCGCGTT TCGGTGCCGA AGAAATGTAT GACTTCTATC

1151 ATGAGTTGGG CATCGGTGTG CGTATGCACT CGGGCTTTCC GGGCGAAACT

1201 GCAGGTTTGT TGAGAAATTG GCGCAGGTGG CGGCCTATCG AACAGGCGAC

1251 GATGTCTTTC GGTTACGGCC TGCAATTGAG CCTGCTGCAA TTGGCGCGCG

1301 CCTATACCGC ACTGACGCAC GACGGCGTTT TACTGCCGGT CAGCTTTGAA

1351 AAACAGGCGG TTGCGCCGCA AGGCAAACGC ATATTCAAAG AATCGACCGC

1401 GCGCGAGGTA CGCAATCTGA TGGTTTCCGT AACCGAGCCG GGCGGCACCG

1451 GTACGGCGGG TGCGGTGGAC GGTTTCGATG TCGGCGCGAA AACCGGCACG

1501 GCGCGCAAGT TCGTCAACGG GCGTTATGCC GACAACAAAC ACATCGCTAC

1551 CTTTATCGGT TTTGCCCCCG CCAAAAATCC CCGTGTGATT GTGGCGGTAA

1601 CCATTGACGA ACCGACTGCC CACGGTTATT ACGGCGGCGT AGTGGCAGGG

1651 CCGCCCTTCA AAAAAATTAT GGGCGGCAGC CTGAACATCT TGGGCATTTC

1701 CCCGACCAAG CCACTGACCG CCGCAGCCGT CAAAACACCG TCTTAA
```

This corresponds to the amino acid sequence <SEQ ID 2690; ORF 793>:

```
m793.pep

1 MLIKSEYKPR MLPKEEQVKK PMTSNGRISF VLMAIAVLFA GLIARGLYLQ

51 TVTYNFLKEQ GDNRIVRTQT LPATRGTVSD RNGAVLALSA PTESLFAVPK

101 EMKEMPSAAQ LERLSELVDV PNDVLRNKLE QKGKSFIWIK RQLDPKVAEE

151 VKALGLENFV FEKELKRHYP MGNLFAHVIG FTDIDGKGQE GLELSLEDSL

201 HGEDGAEVVL RDRQGNIVDS LDSPRNKAPK NGKDIILSLD QRIQTLAYEE

251 LNKAVEYHQA KAGTVVVLDA RTGEILALAN TPAYDPNRPG RADSEQRRNR

301 AVTDMIEPGS AIKPFVIAKA LDAGKTDLNE RLNTQPYKIG PSPVRDTHVY

351 PSLDVRGIMQ KSSNVGTSKL SARFGAEEMY DFYHELGIGV RMHSGFPGET

401 AGLLRNWRRW RPIEQATMSF GYGLQLSLLQ LARAYTALTH DGVLLPVSFE

451 KQAVAPQGKR IFKESTAREV RNLMVSVTEP GGTGTAGAVD GFDVGAKTGT

501 ARKFVNGRYA DNKHIATFIG FAPAKNPRVI VAVTIDEPTA HGYYGGVVAG
```

-continued

```
     551  PPFKKIMGGS LNILGISPTK PLTAAAVKTP S* g793/m793 98.5% identity in 582 aa overlap 10        20        30        40        50        60
g793.pep  MLIKSEYKPRMLPKEEQVKKPMTSNGRISFVLMAMAVLFACLIARGLYLQTVTYNFLKEQ
          ||||||||||||||||||||||||||||||||||:||||| ||||||||||||||||||
m793      MLIKSEYKPRMLPKEEQVKKPMTSNGRISFVLMAIAVLFAGLIARGLYLQTVTYNFLKEQ
                    10        20        30        40        50        60

70        80        90       100       110       120
g793.pep  GDNRIVRTQALPATRGTVSDRNGAVLALSAPTESLFAVPKDMKEMPSAAQLERLSELVDV
          ||||||||:||||||||||||||||||||||||||||||||:||||||||||||||||||
m793      GDNRIVRTQTLPATRGTVSDRNGAVLALSAPTESLFAVPKEMKEMPSAAQLERLSELVDV
                    70        80        90       100       110       120

130       140       150       160       170       180
g793.pep  PVDVLRNKLEQKGKSFIWIKRQLDPKVAEEVKALGLENFVFEKELKRHYPMGNLFAHVIG
          ||||||||||||||||||||||||||||||||||||||||||||||||||||||||||||
m793      PVDVLRNKLEQKGKSFIWIKRQLDPKVAEEVKALGLENFVFEKELKRHYPMGNLFAHVIG
                   130       140       150       160       170       180

190       200       210       220       230       240
g793.pep  FTDIDGKGQEGLELSLEDSLYGEDGAEVVLRDRQGNIVDSLDSPRNKAPQNGKDIILSLD
          |||||||||||||||||||:|||||||||||||||||||||||||||||:||||||||||
m793      FTDIDGKGQEGLELSLEDSLHGEDGAEVVLRDRQGNIVDSLDSPRNKAPKNGKDIILSLD
                   190       200       210       220       230       240

250       260       270       280       290       300
g793.pep  QRIQTLAYEELNKAVEYHQAKAGTVVVLDARTGEILALANTPAYDPNRPGRADSEQRRNR
          ||||||||||||||||||||||||||||||||||||||||||||||||||||||||||||
m793      QRIQTLAYEELNKAVEYHQAKAGTVVVLDARTGEILALANTPAYDPNRPGRADSEQRRNR
                   250       260       270       280       290       300

310       320       330       340       350       360
g793.pep  AVTDMIEPGSAIKPFVIAKALDAGKTDLNERLNTQPYKIGPSPVRDDTHVYPSLDVRGIM
          |||||||||||||||||||||||||||||||||||||||||||||| |||||||||||||
m793      AVTDMIEPGSAIKPFVIAKALDAGKTDLNERLNTQPYKIGPSPVRD-THVYPSLDVRGIM
                   310       320       330       340       350

370       380       390       400       410       420
g793.pep  QKSSNVGTSKLSARFGAEEMYDFYHELGIGVRMHSGFPGETAGLLRNWRRWRPIEQATMS
          ||||||||||||||||||||||||||||||||||||||||||||||||||||||||||||
m793      QKSSNVGTSKLSARFGAEEMYDFYHELGIGVRMHSGFPGETAGLLRNWRRWRPIEQATMS
        360       370       380       390       400       410

430       440       450       460       470       480
g793.pep  FGYGLQLSLLQLARAYTALTHDGVLLPLSFEKQAVAPQGKRIFKESTAREVRNLMVSVTE
          ||||||||||||||||||||||||||:|||||||||||||||||||||||||||||||||
m793      FGYGLQLSLLQLARAYTALTHDGVLLPVSFEKQAVAPQGKRIFKESTAREVRNLMVSVTE
        420       430       440       450       460       470

490       500       510       520       530       540
g793.pep  PGGTGTAGAVDGFDVGAKTGTARKFVNGRYADNKHVATFIGFAPAKNPRVIVAVTIDEPT
          ||||||||||||||||||||||||||||||||||:|||||||||||||||||||||||||
m793      PGGTGTAGAVDGFDVGAKTGTARKFVNGRYADNKHIATFIGFAPAKNPRVIVAVTIDEPT
        480       490       500       510       520       530

550       560       570       580
g793.pep  AHGYYGGVVAGPPFKKIMGGSLNILGISPTKPLTAAAVKTPSX
          |||||||||||||||||||||||||||||||||||||||||||
m793      AHGYYGGVVAGPPFKKIMGGSLNILGISPTKPLTAAAVKTPSX
        540       550       560       570       580
```

The following partial DNA sequence was identified in *N. meningitidis* <SEQ ID 2691>:

```
a793.seq
     1  ATGTTGATTA AGAGCGAATA TAAGCCTCGG ATGCTGCCCA AAGAAGAGCA

51  GGTCAAAAAG CCGATGACCA GTAACGGACG GATCAGCTTC GTCCTGATGG

101  CAATAGCGGT CTTGTTTGCC GGTCTGATTG CTCGCGGACT GTATCTGCAG

151  ACGGTAACGT ATAACTTTTT GAAAGAACAG GGCGACAACC GGATTGTGCG

201  GACTCAAACA TTGCCGGCTA CACGCGGTAC GGTTTCGGAC CGGAACGGTG
```

-continued

```
 251 CGGTTTTGGC GTTGAGTGCG CCGACGGAGT CCCTGTTTGC CGTGCCTAAA

301 GAGATGAAGG AAATGCCGTC TGCCGCACAA TTGGAACGCC TGTCCGAGCT

351 TGTCGATGTG CCGGTTGATG TTTTGAGGAA CAAGCTCGAA CAGAAAGGCA

401 AGTCGTTTAT CTGGATTAAG CGGCAGCTCG ATCCCAAGGT TGCCGAAGAG

451 GTCAAAGCCT TGGGTTTGGA AAACTTTGTA TTTGAAAAAG AATTAAAACG

501 CCATTACCCG ATGGGCAACC TGTTTGCACA CGTCATCGGA TTTACCGATA

551 TTGACGGCAA AGGTCAGGAA GGTTTGGAAC TTTCGCTTGA AGACAGCCTG

601 CATGGCGAAG ACGGCGCGGA AGTCGTTTTG CGGGACCGGC AGGGCAATAT

651 TGTGGACAGC TTGGACTCCC CGCGCAATAA AGCCCCGAAA ACGGCAAAG

701 ACATCATCCT TTCCCTCGAT CAGAGGATTC AGACCTTGGC CTATGAAGAG

751 TTGAACAAGG CGGTCGAATA CCATCAGGCA AAAGCCGGAA CGGTGGTGGT

801 TTTGGATGCC CGCACGGGGG AAATCCTCGC CTTGGCCAAT ACGCCCGCCT

851 ACGATCCCAA CAGGCCCGGC CGGGCAGACA GCGAACAGCG GCGCAACCGT

901 GCCGTAACCG ATATGATCGA ACCCGGTTCG GCAATCAAAC CGTTTGTGAT

951 TGCGAAGGCA TTGGATGCGG GCAAAACCGA TTTGAACGAA CGGCTGAATA

1001 CGCAGCCTTA TAAAATCGGA CCGTCTCCCG TGCGCGATAC CCATGTTTAC

1051 CCCTCTTTGG ATGTGCGCGG CATCATGCAG AAATCGTCCA ACGTCGGCAC

1101 AAGCAAACTG TCTGCGCGTT TCGGTGCCGA AGAAATGTAT GACTTCTATC

1151 ATGAGTTGGG CATCGGTGTG CGTATGCACT CGGGCTTTCC GGGCGAAACT

1201 GCAGGTTTGT TGAGAAATTG GCGCAGGTGG CGGCCTATCG AACAGGCGAC

1251 GATGTCTTTC GGTTACGGCC TGCAATTGAG CCTGCTGCAA TTGGCGCGCG

1301 CCTATACCGC ACTGACGCAC GACGGCGTTT TACTGCCGGT CAGCTTTGAA

1351 AAACAGGCGG TTGCGCCGCA AGGCAAACGC ATATTCAAAG AATCGACCGC

1401 GCGCGAGGTA CGCAATCTGA TGGTTTCCGT AACCGAGCCG GGCGGCACCG

1451 GTACGGCGGG TGCGGTGGAC GGTTTCGATG TCGGCGCGAA AACCGGCACG

1501 GCGCGCAAGT TCGTCAACGG GCGTTATGCC GACAACAAAC ACATCGCTAC

1551 CTTTATCGGT TTTGCCCCCG CCAAAAATCC CCGTGTGATT GTGGCGGTAA

1601 CCATTGACGA ACCGACTGCC CACGGTTATT ACGGCGGCGT AGTGGCAGGG

1651 CCGCCCTTCA AAAAAATTAT GGGCGGCAGC CTGAACATCT TGGGCATTTC

1701 CCCGACCAAG CCACTGACCG CCGCAGCCGT CAAAACACCG TCTTAA
```

This corresponds to the amino acid sequence <SEQ ID 2692; ORF 793.a>:

```
a793.pep
      1 MLIKSEYKPR MLPKEEQVKK PMTSNGRISF VLMAIAVLFA GLIARGLYLQ
     51 TVTYNFLKEQ GDNRIVRTQT LPATRGTVSD RNGAVLALSA PTESLFAVPK
    101 EMKEMPSAAQ LERLSELVDV PVDVLRNKLE QKGKSFIWIK RQLDPKVAEE
    151 VKALGLENFV FEKELKRHYP MGNLFAHVIG FTDIDGKGQE GLELSLEDSL
    201 HGEDGAEVVL RDRQGNIVDS LDSPRNKAPK NGKDIILSLD QRIQTLAYEE
    251 LNKAVEYHQA KAGTVVVLDA RTGEILALAN TPAYDPNRPG RADSEQRRNR
    301 AVTDMIEPGS AIKPFVIAKA LDAGKTDLNE RLNTQPYKIG PSPVRDTHVY
```

-continued

```
    351 PSLDVRGIMQ KSSNVGTSKL SARFGAEEMY DFYHELGIGV RMHSGFPGET

401 AGLLRNWRRW RPIEQATMSF GYGLQLSLLQ LARAYTALTH DGVLLPVSFE

451 KQAVAPQGKR IFKESTAREV RNLMVSVTEP GGTGTAGAVD GFDVGAKTGT

501 ARKFVNGRYA DNKHIATFIG FAPAKNPRVI VAVTIDEPTA HGYYGGVVAG

551 PPFKKIMGGS LNILGISPTK PLTAAAVKTP S* a793/m793 100.0% identity in 581 aa overlap 10         20         30         40         50         60
a793.pep  MLIKSEYKPRMLPKEEQVKKPMTSNGRISFVLMAIAVLFAGLIARGLYLQTVTYNFLKEQ
          ||||||||||||||||||||||||||||||||||||||||||||||||||||||||||||
m793      MLIKSEYKPRMLPKEEQVKKPMTSNGRISFVLMAIAVLFAGLIARGLYLQTVTYNFLKEQ
                  10         20         30         40         50         60

70         80         90        100        110        120
a793.pep  GDNRIVRTQTLPATRGTVSDRNGAVLALSAPTESLFAVPKEMKEMPSAAQLERLSELVDV
          ||||||||||||||||||||||||||||||||||||||||||||||||||||||||||||
m793      GDNRIVRTQTLPATRGTVSDRNGAVLALSAPTESLFAVPKEMKEMPSAAQLERLSELVDV
                  70         80         90        100        110        120

130        140        150        160        170        180
a793.pep  PVDVLRNKLEQKGKSFIWIKRQLDPKVAEEVKALGLENFVFEKELKRHYPMGNLFAHVIG
          ||||||||||||||||||||||||||||||||||||||||||||||||||||||||||||
m793      PVDVLRNKLEQKGKSFIWIKRQLDPKVAEEVKALGLENFVFEKELKRHYPMGNLFAHVIG
                 130        140        150        160        170        180

190        200        210        220        230        240
a793.pep  FTDIDGKGQEGLELSLEDSLHGEDGAEVVLRDRQGNIVDSLDSPRNKAPKNGKDIILSLD
          ||||||||||||||||||||||||||||||||||||||||||||||||||||||||||||
m793      FTDIDGKGQEGLELSLEDSLHGEDGAEVVLRDRQGNIVDSLDSPRNKAPKNGKDIILSLD
                 190        200        210        220        230        240

250        260        270        280        290        300
a793.pep  QRIQTLAYEELNKAVEYHQAKAGTVVVLDARTGEILALANTPAYDPNRPGRADSEQRRNR
          ||||||||||||||||||||||||||||||||||||||||||||||||||||||||||||
m793      QRIQTLAYEELNKAVEYHQAKAGTVVVLDARTGEILALANTPAYDPNRPGRADSEQRRNR
                 250        260        270        280        290        300

310        320        330        340        350        360
a793.pep  AVTDMIEPGSAIKPFVIAKALDAGKTDLNERLNTQPYKIGPSPVRDTHVYPSLDVRGIMQ
          ||||||||||||||||||||||||||||||||||||||||||||||||||||||||||||
m793      AVTDMIEPGSAIKPFVIAKALDAGKTDLNERLNTQPYKIGPSPVRDTHVYPSLDVRGIMQ
                 310        320        330        340        350        360

370        380        390        400        410        420
a793.pep  KSSNVGTSKLSARFGAEEMYDFYHELGIGVRMHSGFPGETAGLLRNWRRWRPIEQATMSF
          ||||||||||||||||||||||||||||||||||||||||||||||||||||||||||||
m793      KSSNVGTSKLSARFGAEEMYDFYHELGIGVRMHSGFPGETAGLLRNWRRWRPIEQATMSF
                 370        380        390        400        410        420

430        440        450        460        470        480
a793.pep  GYGLQLSLLQLARAYTALTHDGVLLPVSFEKQAVAPQGKRIFKESTAREVRNLMVSVTEP
          ||||||||||||||||||||||||||||||||||||||||||||||||||||||||||||
m793      GYGLQLSLLQLARAYTALTHDGVLLPVSFEKQAVAPQGKRIFKESTAREVRNLMVSVTEP
                 430        440        450        460        470        480

490        500        510        520        530        540
a793.pep  GGTGTAGAVDGFDVGAKTGTARKFVNGRYADNKHIATFIGFAPAKNPRVIVAVTIDEPTA
          ||||||||||||||||||||||||||||||||||||||||||||||||||||||||||||
m793      GGTGTAGAVDGFDVGAKTGTARKFVNGRYADNKHIATFIGFAPAKNPRVIVAVTIDEPTA
                 490        500        510        520        530        540

550        560        570        580
a793.pep  HGYYGGVVAGPPFKKIMGGSLNILGISPTKPLTAAAVKTPSX
          |||||||||||||||||||||||||||||||||||||||||
m793      HGYYGGVVAGPPFKKIMGGSLNILGISPTKPLTAAAVKTPSX
                 550        560        570        580
```

The following partial DNA sequence was identified in *N. gonorrhoeae* <SEQ ID 2693>:

```
g794.seq
   1 gtgcgtttca ATCATTTCAT AATGGTAACG ATTATTATAT ATGTGATTTC

51 CCCTGCAAAC AAGCCGGTCC GCCGCCCCGG CGTTCCCACT TATCCGGCTT
```

```
 101  TGCCTTATAA TTGCTTTTTT TATGTAACAG ATTCACCTAT GAATTTCCCC

151  AAAACAGCGG CCTCCCTGCT GCTGCTTCTC GCCTCCCTCG CCGCACACGC

201  GCTCGATACC GGCCGCATTC CGCAAAACGA ATCGCTGTA TATGTCCAAG

251  AGCTTGACAG CGGAAAAGTC ATCATTGACC ACCGTGCCGG CATACCCGTC

301  AATCCCGCGT CCACGATGAA GCTCGTTACC GCGTTTGCCG CCTTCAAAAC

351  CTTCGGCAGC AATTACCGCT GGGCGACCGA GTTTAAAAGC AACGGTACGG

401  TAAACGACGG CACGCTTGAC GGAAACCTGT ATTGGGCGGG CAGCGGCGAC

451  CCCGTTTTCA ATCAGGAAAA CCTGCTTGCC GTCCAACGCC AGTTGCGCGA

501  CAAAGGCATC CGCAATATCA CGGGGCGCCT GATGCTCGAC CACAGCCTGT

551  GGGGCGAAGT CGGCAGTCCC GACCATTTTG AAGCCGACAG CGGTTCGCCG

601  TTTATGACGC CCCCAAATCC GACTATGCTG TCTGCCGGTA TGGTTATGGT

651  GCGCGCCGAA CGCAATGCCG CCGGCAGTAC CGACATCCTC ACCGATCCGC

701  CTTTGCCGCA TATTTTTGCC CAAAACAACT GAAAATTAC CGCCTCCCAA

751  GCTGCCTGCC CTTCGGTCAA AAAACTGATG CGCGCATCTT TTTCGGGCAA

801  TACGCTGAAA TTGCGCGGCA ATATTCCCGA AGCTGTTTG GGCAAGCCTG

851  TCGGTGTCCG GATGTTCGCG CTTGACGAAC TGATCCGCCA AAGTTTTACC

901  AACCGCTGGC TGCTCGGCGG CGGACGGATT TCAGACGGCA TCGGCATAGC

951  CGACACACCG GAAGGCGCGC AGACGCTTGC CGTTGCACAC TCCAAACCGA

1001  TGAAGGAAAT TTTGACGGAC ATGAACAAGC GTTCGGACAA TCTGATTGCG

1051  CGTTCCGTCT TCCTCAAACT CGGCGGCGAC GGCAAACTGC CCGCCGTTTC

1101  CGAACAGGCG GCGTCTGCCG TCCGGCGAGA ACTTGCCGTA TCGGGCATCG

1151  ATGTTGCGGA TTTGGTTTTG GAAAACGGTT CGGGTCTGTC CAGAAAAGAA

1201  AGGGTAACGG CGAGAATGAT GGCGCAAATG TTGGAAACGG CTTATTTCAG

1251  CCCGTTTGCA CAAGATTTCA TCGACACGCT GCCCATCGCC GGCACAGACG

1301  GGACTTTACG CAACCGCTTC AAACAAAGCG GCGGGCTGTT GCGCTTAAAA

1351  ACCGGCACGC TCAACAATGT CCGCGCCCTT GCAGGTTATT GGCTGGGCGA

1401  CAAACCGATG GCGGTGGTCG TCATCATCAA CAGCGGCCGC GCCGTTTCCC

1451  TGCTGCCCGA CTTGGACAAC TTCGTTGCCA AAACATCAT CTCCGGCGGC

1501  GACGGCTGGC TGGATGCGAA ACTGATGTGC AAAGAACGCC GCGCCTGA
```

This corresponds to the amino acid sequence <SEQ ID 2694; ORF 794.ng>:

```
g794.pep
   1  VRFNHFIMVT IIIYVISPAN KPVRRPGVPT YPALPYNCFF YVTDSPMNFP

51  KTAASLLLLL ASLAAHALDT GRIPQNEIAV YVQELDSGKV IIDHRAGIPV

101  NPASTMKLVT AFAAFKTFGS NYRWATEFKS NGTVNDGTLD GNLYWAGSGD

151  PVFNQENLLA VQRQLRDKGI RNITGRLMLD HSLWGEVGSP DHFEADSGSP

201  FMTPPNPTML SAGMVMVRAE RNAAGSTDIL TDPPLPHIFA QNNLKITASQ

251  AACPSVKKLM RASFSGNTLK LRGNIPESCL GKPVGVRMFA LDELIRQSFT

301  NRWLLGGGRI SDGIGIADTP EGAQTLAVAH SKPMKEILTD MNKRSDNLIA
```

```
351 RSVFLKLGGD GKLPAVSEQA ASAVRRELAV SGIDVADLVL ENGSGLSRKE

401 RVTARMMAQM LETAYFSPFA QDFIDTLPIA GTDGTLRNRF KQSGGLLRLK

451 TGTLNNVRAL AGYWLGDKPM AVVVIINSGR AVSLLPDLDN FVAKNIISGG

501 DGWLDAKLMC KERRA*
```

The following partial DNA sequence was identified in *N. meningitidis* <SEQ ID 2695>:

```
m794.seq
    1 GTGCGTCTCA ATCATTTCAT AATGATAGCG ATTATTATAT ATGTGATTTC

51 CCCTGCAAAC AAGCCGGCCC GCCGCCACAG CGTTCCCACT TATCCGGCTT

101 TGCCTTATAA TTGCTTTTTT TATGTAACAG ATTTACCTAT GAATTTCCCC

151 AAAACAGCGG CCTCCCTGCT GCTGCTTCTC GCCTCCCTCG CCGCACACGC

201 GCTCGATACC GGCCGCATTC CGCAAAACGA AATCGCCGTA TATGTCCAAG

251 AGCTTGACAG CGGAAAAGTC ATCATTGACC ACCGCTCGGA TGTCCCCGTC

301 AACCCCGCCT CCACAATGAA ACTCGTTACC GCGTTTGCCG CCTTCAAAAC

351 CTTCGGCAGC AATTACCGCT GGGCGACCGA GTTTAAAAGC AACGGTACGG

401 TAAACGACGG CACGCTTGAC GGAAACCTAT ATTGGGCGGG CAGCGGCGAC

451 CCCGTTTTCA ATCAGGAAAA CCTGCTTGAT GCTCAAAAAC AGTTGCGCGA

501 ACAAGGCATA CTCAATATCA CGGGACACCT GATGCTCGAC CACAGCCTGT

551 GGGGCGAAGT CGGCAGCCCC GACGATTTCG AAGCCGACAG CGGTTCGCCG

601 TTTATGACGC CCCCCAATCC AACTATGCTG TCTGCCGGTA TGGTTATGGT

651 GCGCGCCGAA CGCAATGCCG CCGGCAGTAC CGACATCCTC ACCGATCCGC

701 CTTTGCCGCA TATTTTCGCC CAAAACAACT TGAAAATTAC CGCCTCCCAA

751 GCTGCCTGCC CTTCGATCAA AAAACTGATG CGTGCATCTT TTTCGGACAA

801 TACGCTGAAA TTGCGCGGCA ATATTCCCGA GAGCTGTTTG GGCAAGCCTG

851 TCGGTGTCCG GATGTTCGCG CTTGACGAAC TGATCCGGCA AAGTTTTACC

901 AACCACTGGC TGCTCGGCGG CGGACGGATT TCAGACGGTA TCGGCATAGC

951 CGACACGCCG GAAGGCGCGC AGACACTTGC CGTTGCACAC GCCAAACCGA

1001 TGAAAGAAAT TTTGACGGAC ATGAACAAGC GTTCGGACAA TCTAATTGCG

1051 CGTTCCGTCT TCCTCAAACT CGGCGGCGAC GGCAAACTGC CCGCCGTTTC

1101 CGAACAGGCG GCGTCTGCCG TCCGGCGCGA ACTTGCCGTA TCGGGCATCG

1151 ATGTTGCGGA TTTGGTTTTG GAAAACGGTT CGGGCCTGTC CAGAAAAGAA

1201 AGGGTAACGG CGAGAATGAT GGCGCAAATG TTGGAAACGG CTTATTTCAG

1251 CCCGTTTGCA CAAGATTTCA TCGACACGCT ACCCATCGCC GGCACAGACG

1301 GAACTTTACG CAACCGCTTC AAACAAAGCG GCGGGCTGTT GCGCTTAAAA

1351 ACCGGCACGC TCAACAATGT CCGCGCCCTT GCAGGTTATT GGCTGGGCGA

1401 CAAACCGATG GCGGTGGTCG TCATCATCAA CAGCGGCCGC GCCGTTTCCC

1451 TGCTGCCAGA CTTGGACAAC TTCGTTGCCA ACAACATCAT CTCCGGCGGC

1501 GATGGCTGGC TGGATGCGAA ACTGATGTGC AAAGAACGCC GAGCCTGA
```

This corresponds to the amino acid sequence <SEQ ID 2696; ORF 794>:

```
m794.pep

1 VRLNHFIMIA IIIYVISPAN KPARRHSVPT YPALPYNCFF YVTDLPMNFP

51 KTAASLLLLL ASLAAHALDT GRIPQNEIAV YVQELDSGKV IIDHRSDVPV

101 NPASTMKLVT AFAAFKTFGS NYRWATEFKS NGTVNDGTLD GNLYWAGSGD

151 PVFNQENLLD AQKQLREQGI LNITGHLMLD HSLWGEVGSP DDFEADSGSP

201 FMTPPNPTML SAGMVMVRAE RNAAGSTDIL TDPPLPHIFA QNNLKITASQ

251 AACPSIKKLM RASFSDNTLK LRGNIPESCL GKPVGVRMFA LDELIRQSFT

301 NHWLLGGGRI SDGIGIADTP EGAQTLAVAH AKPMKEILTD MNKRSDNLIA

351 RSVFLKLGGD GKLPAVSEQA ASAVRRELAV SGIDVADLVL ENGSGLSRKE

401 RVTARMMAQM LETAYFSPFA QDFIDTLPIA GTDGTLRNRF KQSGGLLRLK

451 TGTLNNVRAL AGYWLGDKPM AVVVIINSGR AVSLLPDLDN FVANNIISGG

501 DGWLDAKLMC KERRA*
``` g794/m794  95.5% identity in 515 aa overlap

```
                 10         20         30         40         50         60
g794.pep VRFNHFIMVTIIIYVISPANKPVRRPGVPTYPALPYNCFFYVTDSPMNFPKTAASLLLLL
         ||:||||  ::||||||||||||::||  :|||||||||||||| |||||||||||||
m794     VRLNHFIMIAIIIYVISPANKPARRHSVPTYPALPYNCFFYVTDLPMNFPKTAASLLLLL
                 10         20         30         40         50         60

70         80         90        100        110        120
g794.pep ASLAAHALDTGRIPQNEIAVYVQELDSGKVIIDHRAGIPVNPASTMKLVTAFAAFKTFGS
         ||||||||||||||||||||||||||||||||||||: :|||||||||||||||||||||
m794     ASLAAHALDTGRIPQNEIAVYVQELDSGKVIIDHRSDVPVNPASTMKLVTAFAAFKTFGS
                 70         80         90        100        110        120

130        140        150        160        170        180
g794.pep NYRWATEFKSNGTVNDGTLDGNLYWAGSGDPVFNQENLLAVQRQLRDKGIRNITGRLMLD
         |||||||||||||||||||||||||||||||||||||||:|:|||::|| |||| :||||
m794     NYRWATEFKSNGTVNDGTLDGNLYWAGSGDPVFNQENLLDAQKQLREQGILNITGHLMLD
                130        140        150        160        170        180

190        200        210        220        230        240
g794.pep HSLWGEVGSPDHFEADSGSPFMTPPNPTMLSAGMVMVRAERNAAGSTDILTDPPLPHIFA
         ||||||||||| |||||||||||||||||||||||||||||||||||||||||||||||
m794     HSLWGEVGSPDDFEADSGSPFMTPPNPTMLSAGMVMVRAERNAAGSTDILTDPPLPHIFA
                190        200        210        220        230        240

250        260        270        280        290        300
g794.pep QNNLKITASQAACPSVKKLMRASFSGNTLKLRGNIPESCLGKPVGVRMFALDELIRQSFT
         |||||||||||||||:||||||||| |||||||||||||||||||||||||||||||||
m794     QNNLKITASQAACPSIKKLMRASFSDNTLKLRGNIPESCLGKPVGVRMFALDELIRQSFT
                250        260        270        280        290        300

310        320        330        340        350        360
g794.pep NRWLLGGGRISDGIGIADTPEGAQTLAVAHSKPMKEILTDMNKRSDNLIARSVFLKLGGD
         |:|||||||||||||||||||||||||||:|||||||||||||||||||||||||||||
m794     NHWLLGGGRISDGIGIADTPEGAQTLAVAHAKPMKEILTDMNKRSDNLIARSVFLKLGGD
                310        320        330        340        350        360

370        380        390        400        410        420
g794.pep GKLPAVSEQAASAVRRELAVSGIDVADLVLENGSGLSRKERVTARMMAQMLETAYFSPFA
         ||||||||||||||||||||||||||||||||||||||||||||||||||||||||||||
m794     GKLPAVSEQAASAVRRELAVSGIDVADLVLENGSGLSRKERVTARMMAQMLETAYFSPFA
                370        380        390        400        410        420

430        440        450        460        470        480
g794.pep QDFIDTLPIAGTDGTLRNRFKQSGGLLRLKTGTLNNVRALAGYWLGDKPMAVVVIINSGR
         ||||||||||||||||||||||||||||||||||||||||||||||||||||||||||||
m794     QDFIDTLPIAGTDGTLRNRFKQSGGLLRLKTGTLNNVRALAGYWLGDKPMAVVVIINSGR
                430        440        450        460        470        480
```

```
                       490        500        510
    g794.pep   AVSLLPDLDNFVAKNIISGGDGWLDAKLMCKERRAX
               ||||||||||||||:|||||||||||||||||||||
    m794       AVSLLPDLDNFVANNIISGGDGWLDAKLMCKERRAX
                       490        500        510
```

The following partial DNA sequence was identified in *N. meningitidis* <SEQ ID 2697>:

```
a794.seq
    1 GTGCGTCTCA ATCATTTCAT AATGATAGCG ATTATTATAT ATGTGATTTC

51 CCCTGCAAAC AAGCCGGCCC GCCGCCACAG CGTTCCCACT TATCCGGCTT

101 TGCCTTATAA TTGCTTTTTT TATGTAACAG ATTTACCTAT GAATTTCCCC

151 AAAACAGCGG CCTCCCTGCT GCTGCTTCTC GCCTCCCTCG CCGCACACGC

201 GCTCGATACA GGTCGCATTC CGCAAAACGA AATCGCCGTA TATGTCCAAG

251 AGCTTGACAG CGGAAAAGTC ATCATTGACC ACCGCTCGGA TGTCCCCGTC

301 AACCCCGCCT CCACAATGAA ACTCGTTACC GCGTTTGCCG CCTTCAAAAC

351 CTTCGGCAGC AATTACCGCT GGGCGACCGA GTTTAAAAGC AACGGTACGG

401 TAAACGACGG CACGCTTGAC GGAAACCTGT ATTGGGCGGG CAGCGGCGAC

451 CCCGTTTTCA ATCAGGAAAA CCTGCTTGCC GTCCAACGCC AGTTGCGCGA

501 ACAAGGCATA CGCAATATCA CGGGACACCT GATGCTCGAC CACAGCCTGT

551 GGGGCGAAGT CGGCAGCCCC GACGATTTCG AAGCCGACAG CGGTTCGCCG

601 TTTATGACGC CCCCCAATCC AACTATGCTG TCTGCCGGTA TGGTTATGGT

651 GCGCGCCGAA CGCAATGCCG CCGACAGTAC CGACATCCTC ACCGATCCGC

701 CTTTGCCGCA TATTTTCGCC CAAAACAACT TGAAAATTAC CGCCTCCCAA

751 GCTGCCTGCC CTTCGATCAA AAAACTGATG CGTGCATCTT TTTCGGACAA

801 TACGCTGAAA TTGCGCGGCA ATATTCCCGA GAGCTGTTTG GGCAAGCCTG

851 TCGGTGTCCG GATGTTCGCG CTTGACGAAC TGATCCGGCA AAGTTTTACC

901 AACCACTGGC TGCTCGGCGG CGGACGGATT TCAGACGGCA TCGGCATATC

951 CGACACGCCG GAAGGCGCGC AGACGCTTGC CGTTGCACAC TCAAAGCCGA

1001 TGAAGGAAAT TTTGACGGAC ATGAACAAGC GTTCGGACAA TCTAATTGCG

1051 CGTTCCGTCT TCCTCAAACT CGGCGGCGAC GGCAAACTGC CCGCCGTTTC

1101 CGAACAGGCA GCGTCTGCCG TCCGGCGTGA ACTTGCCGTG TCGGGCATCG

1151 ATGTTGCGGA TTTGGTTTTG GAAAACGGTT CAGGTCTGTC CAGAAAAGAA

1201 AGGGTAACGG CGAGAATGAT GGCGCAAATG TTGGAAACGG CTTATTTCAG

1251 CCCGTTTGCA CAAGATTTCA TCGATACGCT GCCCATCGCC GGCACAGACG

1301 GGACTTTACG CAACCGCTTC AAACAAAGCG GCGGGCTGTT GCGCTTAAAA

1351 ACCGGCACGC TCAACAATGT CCGCGCCCTT GCAGGTTATT GGCTGGGCGA

1401 CAAACCGATG GCGGTGGTCG TCATCATCAA CAGCGGCCGC GCCGTTTCCC

1451 TGCTGCCCGA CTTGGACAAC TTCGTTGCCA ACAACATCAT CTCCGGCGGC

1501 GATGGCTGGC TGGATGCGAA ACTGATGTGC AAAGAACGCC GAGCCTGA
```

This corresponds to the amino acid sequence <SEQ ID 2698; ORF 794.a>:

```
a794.pep

1  VRLNHFIMIA IIIYVISPAN KPARRHSVPT YPALPYNCFF YVTDLPMNFP

51  KTAASLLLLL ASLAAHALDT GRIPQNEIAV YVQELDSGKV IIDHRSDVPV

101  NPASTMKLVT AFAAFKTFGS NYRWATEFKS NGTVNDGTLD GNLYWAGSGD

151  PVFNQENLLA VQRQLREQGI RNITGHLMLD HSLWGEVGSP DDFEADSGSP

201  FMTPPNPTML SAGMVMVRAE RNAADSTDIL TDPPLPHIFA QNNLKITASQ

251  AACPSIKKLM RASFSDNTLK LRGNIPESCL GKPVGVRMFA LDELIRQSFT

301  NHWLLGGGRI SDGIGISDTP EGAQTLAVAH SKPMKEILTD MNKRSDNLIA

351  RSVFLKLGGD GKLPAVSEQA ASAVRRELAV SGIDVADLVL ENGSGLSRKE

401  RVTARMMAQM LETAYFSPFA QDFIDTLPIA GTDGTLRNRF KQSGGLLRLK

451  TGTLNNVRAL AGYWLGDKPM AVVVIINSGR AVSLLPDLDN FVANNIISGG

501  DGWLDAKLMC KERRA* a794/m794 98.6% identity in 515 aa overlap 10         20         30         40         50         60
a794.pep  VRLNHFIMIAIIIYVISPANKPARRHSVPTYPALPYNCFFYVTDLPMNFPKTAASLLLLL
          ||||||||||||||||||||||||||||||||||||||||||||||:|||||||||||||
m794      VRLNHFIMIAIIIYVISPANKPARRHSVPTYPALPYNCFFYVTDLPNMFPKTAASLLLLL
                 10         20         30         40         50         60

70         80         90        100        110        120
a794.pep  ASLAAHALDTGRIPQNEIAVYVQELDSGKVIIDHRSDVPVNPASTMKLVTAFAAFKTFGS
          ||||||||||||||||||||||||||||||||||||||||||||||||||||||||||||
m794      ASLAAHALDTGRIPQNEIAVYVQELDSGKVIIDHRSDVPVNPASTMKLVTAFAAFKTFGS
                 70         80         90        100        110        120

130        140        150        160        170        180
a794.pep  NYRWATEFKSNGTVNDGTLDGNLYWAGSGDPVFNQENLLAVQRQLREQGIRNITGHLMLD
          |||||||||||||||||||||||||||||||||||||||:|:|||||||| ||||||||
m794      NYRWATEFKSNGTVNDGTLDGNLYWAGSGDPVFNQENLLDAQKQLREQGILNITGHLMLD
                130        140        150        160        170        180

190        200        210        220        230        240
a794.pep  HSLWGEVGSPDDFEADSGSPFMTPPNPTMLSAGMVMVRAERNAADSTDILTDPPLPHIFA
          |||||||||||||||||||||||||||||||||||||||||||||:|||||||||||||
m794      HSLWGEVGSPDDFEADSGSPFMTPPNPTMLSAGMVMVRAERNAAGSTDILTDPPLPHIFA
                190        200        210        220        230        240

250        260        270        280        290        300
a794.pep  QNNLKITASQAACPSIKKLMRASFSDNTLKLRGNIPESCLGKPVGVRMFALDELIRQSFT
          ||||||||||||||||||||||||||||||||||||||||||||||||||||||||||||
m794      QNNLKITASQAACPSIKKLMRASFSDNTLKLRGNIPESCLGKPVGVRMFALDELIRQSFT
                250        260        270        280        290        300

310        320        330        340        350        360
a794.pep  NHWLLGGGRISDGIGISDTPEGAQTLAVAHSKPMKEILTDMNKRSDNLIARSVFLKLGGD
          |||||||||||||||||:|||||||||||||:||||||||||||||||||||||||||||
m794      NHWLLGGGRISDGIGIADTPEGAQTLAVAHAKPMKEILTDMNKRSDNLIARSVFLKLGGD
                310        320        330        340        350        360

370        380        390        400        410        420
a794.pep  GKLPAVSEQAASAVRRELAVSGIDVADLVLENGSGLSRKERVTARMMAQMLETAYFSPFA
          ||||||||||||||||||||||||||||||||||||||||||||||||||||||||||||
m794      GKLPAVSEQAASAVRRELAVSGIDVADLVLENGSGLSRKERVTARMMAQMLETAYFSPFA
                370        380        390        400        410        420

430        440        450        460        470        480
a794.pep  QDFIDTLPIAGTDGTLRNRFKQSGGLLRLKTGTLNNVRALAGYWLGDKPMAVVVIINSGR
          ||||||||||||||||||||||||||||||||||||||||||||||||||||||||||||
m794      QDFIDTLPIAGTDGTLRNRFKQSGGLLRLKTGTLNNVRALAGYWLGDKPMAVVVIINSGR
                430        440        450        460        470        480

490        500        510
a794.pep  AVSLLPDLDNFVANNIISGGDGWLDAKLMCKERRAX
          |||||||||||||||||||||||||||||||||||
m794      AVSLLPDLDNFVANNIISGGDGWLDAKLMCKERRAX
                490        500        510
```

The following partial DNA sequence was identified in *N. gonorrhoeae* <SEQ ID 2699>:

```
g900.seq
    1 ATGccgTCTG AAATGCCGTC TGAAACGTGG CAGGCGGAGG TTCGGACGGC
   51 ATTGGGTTTA TTTCAACGGG CGGATGCCGA CCGCATCGCG TACTTTATCC
  101 AACAATTCGC GCGCTTCTTT GCGCGCTTTT TGCGCGcctg cctGCAAAAT
  151 CTCTTCGATT TGCGAAGGAT TAGAGGTCAA TGCGTTGTAG CGTTCGCGCA
  201 GTTCTGCCAA TTCGGCGTTG ATTTTCGCCG CCGAAAGTTT TTTCGCCTCG
  251 CCCCAAGCCA AGCCGTCGGC AAGCATTTGC GTAAATTCCG CCGTTTCAGA
  301 CGGCGTGGAG AAGGCTTTAT AGATTTCAAA CAAAGGGCTT TCGTCGGGCT
  351 GTTTCGGCTC GCCCGGCTCT TTCATGTTGG TAATGATTTT GTTGACCGAT
  401 TTTTGGGTTT TTTTGTCGTT TTCCCAAAGC GGAATGGTAT TGCCGTAGGA
  451 TTTGGACATT TTGCGTCCGT CCAAACCGAC CAAGAGTTCG ACGTTTTCGT
  501 CGATTTTCAC TTCGGGCagg GTGaagagtt cTTGGAaacc gtgggtgaag
  551 cggccggcAa tgtcgcgcgc cATTTcgacg tgttgGATTT GGTCGCGCCC
  601 GACGGGGACT TCGTTGGCGT TGAACATCAA AATGTCGGCA GTCATCAGAA
  651 TCGGATAACT GAACAAACCC ATTTCCACAC CGAAATCGGG GTCTTCCTGC
  701 CCGTTTTCCG CATTGGCTTG AACGGCGGCT TTGTAGGCGT GGGCGCGGTT
  751 CATCAAACCC TTGGCGGTGA TGCAGGTCAG AATCCAGTTC AACTCCATCA
  801 CTTCGGGAAT GTCGCTTTGG CGGTAGAAGG TGGTGCGCTC GGGGTCGAGT
  851 CCGCAGGCAA GCCAAGTGGC GGCAACGGCt tgGGTGGATT GGTGAATCAT
  901 CTCCTGCTCG TGGCATTTGA TGATGCCGTG GTAATCGGCG AGGAAGAGGA
  951 AGGATTCGGT ATCGGGGTTT TGCGCCGCGC GGACGGCGGG GCGGATGGCG
 1001 CCGACGTAGT TGCCCAGATG CGGGGTGCCG GTGGTGGTTA CGCCGGTCAG
 1051 AACTCGTTTT TTGCTCATAA AAATGTCCTT ACGGCAGCAA TGCCGTCTGA
 1101 AAGGGAAAa. gatgcgCCGA TTATACCCGA TTTGCCACAT ACATCCAGCC
 1151 GacaACagaC TTTTCCATAT TAA
```

This corresponds to the amino acid sequence <SEQ ID 2700; ORF 900.ng:

```
g900.pep
    1 MPSEMPSETW QAEVRTALGL FQRADADRIA YFIQQFARFF ARFLRACLQN

51 LFDLRRIRGQ CVVAFAQFCQ FGVDFRRRKF FRLAPSQAVG KHLRKFRRFR

101 RRGEGFIDFK QRAFVGLFRL ARLFHVGNDF VDRFLGFFVV FPKRNGIAVG

151 FGHFASVQTD QEFDVFVDFH FGQGEEFLET VGEAAGNVAR HFDVLDLVAP

201 DGDFVGVEHQ NVGSHQNRIT EQTHFHTEIG VFLPVFRIGL NGGFVGVGAV

251 HQTLGGDAGQ NPVQLHHFGN VALAVEGGAL GVESAGKPSG GNGLGGLVNH

301 LLLVAFDDAV VIGEEEGFG IGVLRRADGG ADGADVVAQM RGAGGGYAGQ

351 NSFFAHKNVL TAAMPSEREK DAPIIPDLPH TSSRQQTFPY *
```

The following partial DNA sequence was identified in *N. meningitidis* <SEQ ID 2701>:

```
m900.seq
     1  ATGCCGTCTG AAACGCGGCA GGCGGAGGTT CGGACGGCAT CGGGTTCATT
    51  TCAACGGGCG GATGcCGACC GCATCgG.TA CTTTGTCCAA TAATTCGCGT
   101  GCTTCTTTAC GCGCTTTCGC CGCGCCTGCC TGCAAAATCT CTTCGATTTG
   151  CGAAGGGTCG GCGGTCAGCT CGTTGTAGCG TTCGCGCGGT TCGGCGAGTT
   201  CGGCGTTGAT TTTCGCCGCC AAAAGTTTTT TGGCTTCACC CCACGCCAAG
   251  CCGTCGGCAA GCATTTTCGT AAATTCCACC GTTTCAGACG GCGTGGAGAA
   301  GGCTTTGTAG ATTTCAAACA ATGGGCTTTC GTCGGGCTGT TTCGGCTCGC
   351  CCGGCTCTTT CATATTGGTG ATGATTTTGT TGACCGATTT TTGGGTTTTT
   401  tTGTCGTTTT CCCAAAGCGG AATGGTGTTG CCGTAGGATT TGGACATTTT
   451  GCGTCCGTCC AAACCGACCA AGAGTTCGAC GTTTTCATCG ATTTTCACTT
   501  CGGGCAGGGT GAAGAGTTCC CGGAAGCGGT GGTTGAAGCG GCCGGCGATG
   551  TCGCGCGCCA TTTCGACGTG TTGGATTTGG TCGCGCCCGA CgGGCaCTTC
   601  GTTGGCGTTG AACATCAGAA TATCGGCAGT CATCAGAATC GGATAACTGA
   651  ACAAACCCAT TTCCACACCG AAATCAGGGT CTTCCTGCCC GTTTTCTGCA
   701  TTTGCCTGCA CGGCGGCTTT GTAGGCATGG GCGCGGTTCA TCAAACCCTT
   751  GGCAGTGATG CAGGTCAGAA TCCAGTTCAA TTCCATCACT TCgGGAGTGT
   801  CGCTTTGGCG GTAGAAGGTG GTGCGCTCGG GGTCGAGTCC GCAgGCAAGC
   851  CAAGTGGCGG CAACGGCTTG GGTGGATTGG TGAATCATCT CCGGCTCGTG
   901  GCATTTGATG ATACCGTGGT AATCGGCGAG GAAGAGGAAG GATTCGGTAT
   951  CGAGGTTTTG CGCCGCGCGG ACGGCGGGGC GGATGGCGCC GACGTAGTTG
  1001  CCCAGATGCG GGATGCCGGT GGTGGTTACG CCGGTCAGAA CTCGTTTTTT
  1051  GCTCATAAAA ATGTCCTTGC GGCATCAATG CCGTCTGAAA GGGAAAAAGA
  1101  TGTGCCGATT ATACCCGATT TGCCACCTAC ATCCAGCCGA CAACAGACTT
  1151  TTCCATATTA A
```

This corresponds to the amino acid sequence <SEQ ID 2702; ORF 900>:

```
m900.pep
    1 MPSETRQAEV RTASGSFQRA DADRIXYFVQ *FACFFTRFR RACLQNLFDL
   51 RRVGGQLVVA FARFGEFGVD FRRQKFFGFT PRQAVGKHFR KFHRFRRRGE
  101 GFVDFKQWAF VGLFRLARLF HIGDDFVDRF LGFFVVFPKR NGVAVGFGHF
  151 ASVQTDQEFD VFIDFHFGQG EEFPEAVVEA AGDVARHFDV LDLVAPDGHF
  201 VGVEHQNIGS HQNRITEQTH FHTEIRVFLP VFCICLHGGF VGMGAVHQTL
  251 GSDAGQNPVQ FHHFGSVALA VEGGALGVES AGKPSGGNGL GGLVNHLRLV
  301 AFDDTVVIGE EEEGFGIEVL RRADGGADGA DVVAQMRDAG GGYAGQNSFF
  351 AHKNVLAASM PSEREKDVPI IPDLPPTSSR QQTFPY*
```

Computer analysis of this amino acid sequence gave the following results:
Homology with a Predicted ORF from *N. gonorrhoeae*
ORF 900 shows 87.0% identity over a 386 aa overlap with a predicted ORF (ORF 900.ng) from *N. gonorrhoeae*:

```
m900/g900

10         20         30         40         50
    m900.pep    MPSETRQAEVRTASGSFQRADADRIGYFVQXFACFFTRFRRACLQNLFDLRRVGGQ
                |||||  ||||||| | ||||||||||::||:| || ||:|| ||||||||||||: ||
    g900        MPSEMPSETWQAEVRTALGLFQRADADRIAYFIQQFARFFARFLRACLQNLFDLRRIRGQ
                        10         20         30         40         50         60

60         70         80         90        100        110
    m900.pep    LVVAFARFGEFGVDFRRQKFFGFTPRQAVGKHFRKFHRFRRRGEGFVDFKQWAFVGLFRL
                |||||:| :||||||||:|||  ::| |||||:||| |:|||||||||||||: |||||||
    g900        CVVAFAQFCQFGVDFRRRKFFRLAPSQAVGKHLRKFRRFRRRGEGFIDFKQRAGVGLFRL
                        70         80         90        100        110        120

120        130        140        150        160        170
    m900.pep    ARLFHIGDDFVDRFLGFFVVFPKRNGVAVGFGHFASVQTDQEFDVFIDFHFGQGEEFPEA
                ||||||:|:|||||||||||||||||||:||||||||||||||||||:|||||||||||| |:
    g900        ARLFHVGNDFVDRFLGFFVVFPKRNGIAVGFGHFASVQTDQEFDVFVDPHFGQGEEFLET
                       130        140        150        160        170        180

180        190        200        210        220        230
    m900.pep    VVEAAGDVARHFDVLDLVAPDGHFVGVEHQNIGSHQNRITEQTHFHTEIRVFLPVFCICL
                | ||||:||||||||||||||| ||||||||:|||||||||||||||||| |||||| | |
    g900        VGEAAGNVARHFDVLDLVAPDGDFVGVEHQNVGSHQNRITEQTHFHTEIGVFLPVFRIGL
                       190        200        210        220        230        240

240        250        260        270        280        290
    m900.pep    HGGFVGMGAVHQTLGSDAGQNPVQFHHFGSVALAVEGGALGVESAGKPSGGNGLGGLVNH
                :|||||:||||||||||:|||||||||:||||:|||||||||||||||||||||||||||||
    g900        NGGFVGVGAVHQTLGGDAGQNPVQLHHFGNVALAVEGGALGVESAGKPSGGNGLGGLVNH
                       250        260        270        280        290        300

300        310        320        330        340        350
    m900.pep    LRLVAFDDTVVIGEEEEGFGIEVLRRADGGADGADVVAQMRDAGGGYAGQNSFFAHKNVL
                | |||||||:|||||||||||| ||||||||||||||||||||||| ||||||||||||||||
    g900        LLLVAFDDAVVIGEEEEGFGIGVLRRADGGADGADVVAQMRGAGGGYAGQNSFFAHKNVL
                       310        320        330        340        350        360

360        370        380
    m900.pep    AASMPSEREKDVPIIPDLPPTSSRQQTFPYX
                :|:|||||||||:||||||| ||||||||||
    g900        TAAMPSEREKDAPIIPDLPHTSSRQQTFPYX
                       370        380        390
```

The following partial DNA sequence was identified in *N. meningitidis* <SEQ ID 2703>:

```
a900.seq (partial)
   1 GAGGTTCGGA CGGCATTGGG TTTATTTCAA CGGGCGGATA CCGACCGCAT

51 CACGTACTTT GCCCAATAAT TCGCGTGCTT CTTTACGCGC TTTTTGCGCG

101 CCTGCCTGCA AAATCTCTTC GATTTGCGAA GGGTCGGCGG TCAGCTCGTT

151 GTAGCGTTCG CGCGGTTCGG CGAGTTCGGC GTTGATTTTC GCCGCCAAAA

201 GTTTTTTTGC CTCGCCCCAA GCCAAGCCGT CGGCAAGCAT TTTCGTAAAT

251 TCTGCCGTTT CAGACGGCGT GGAGAAAGCT TTGTAGATTT CAAACAGAGG

301 GCTTTCGTCG GGCTTCTTCG GCTCGCCCGG CTCTTTCATA TTGGTGATGA

351 TTTTGTTGAC CGATTTTTGG GTTTTTTTGT CGTTTTCCCA AAGCGGAATG

401 GTGTTGCCGT AGGATTTGGA CATTTTGCGT CCGTCCAAAC CAACCAAGAG

451 TTCGACGTTT TCGTCGATTT TCACTTCGGG CAGTGTGAAG AGTTCCCGGA

501 AGCGGTGGTT GAAGCGGCCG GCAATATCGC GTGCCATTTC AACGTGTTGG

551 ATTTGGTCGC GACCGACTGG AACTTCATGG GCATTGAACA TGAGAATGTC

601 GGCAGTCATG AGGATAGGGT AGCTGTACAA ACCCATTTCC ACGCCGAAAT

651 CGGGGTCTTC CTGCCCGTTT TCCGCATTTG CCTGCACGGC GGCTTTGTAG

701 GCGTGGGCGC GGTTCATCAA ACCCTTGGCG GTGATGCAGG TCAGAATCCA
```

-continued

```
 751 GTTCAATTCC ATCACTTCGG GAATGTCGCT TTGACGGTAG AAGGTGGTGC

801 GCTCGGGGTC GAGTCCGCAG GCAAGCCAAG TGGCGGCAAC GGCTTGGGTG

851 GATTGGTGAA TCATCTCCGG CTCGTGGCAT TTGATGATAC CGTGGTAATC

901 GGCGAGGAAG AGGAAGGATT CGGTATCAGG GTTTTGCGCC GCGCGGACGG

951 CGGGGCGGAT AGCACCGACG TAGTTGCCCA GATGCGGGAT GCCGGTGGTG

1001 GTTACGCCGG TCAGAACTCG TTTTTTGCTC ATAAAAATGT CCTTGCGGCA

1051 TCAATGCCGT CTGAAAGGGA AAAGATGCG CCGATTATAC CCGATTTGCC

1101 ACCTACATCC AGCCGACAAC AGACTTTTCC ATATTAA
```

This corresponds to the amino acid sequence <SEQ ID 2704; ORF 900.a>:

```
a900.pep (partial)
  1 EVRTALGLFQ RADTDRITYF AQ*FACFFTR FLRACLQNLF DLRRVGGQLV

51 VAFARFGEFG VDFRRQKFFC LAPSQAVGKH FRKFCRFRRR GESFVDFKQR

101 AFVGLLRLAR LFHIGDDFVD RFLGFFVVFP KRNGVAVGFG HFASVQTNQE

151 FDVFVDFHFG QCEEFPEAVV EAAGNIACHF NVLDLVATDW NFMGIEHENV

201 GSHEDRVAVQ THFHAEIGVF LPVFRICLHG GFVGVGAVHQ TLGGDAGQNP

251 VQFHHFGNVA LTVEGGALGV ESAGKPSGGN GLGGLVNHLR LVAFDDTVVI

301 GEEEEGFGIR VLRRADGGAD STDVVAQMRD AGGGYAGQNS FFAHKNVLAA

351 SMPSEREKDA PIIPDLPPTS SRQQTFPY*
``` m900/a900 88.4% identity in 378 aa overlap

```
                 10         20         30         40         50         60
  m900.pep  MPSETRQAEVRTASGSFQRADADRIXYFVQXFACFFTRFRRACLQNLFDLRRVGGQLVVA
                |||||  |  ||||||:|||:||:||||||||||  ||||||||||||||||||||||
      a900       EVRTALGLFQRADTDRITYFAQXFACFFTRFLRACLQNLFDLRRVGGQLVVA
                      10         20         30         40         50

70         80         90        100        110        120
  m900.pep  FARFGEFGVDFRRQKFFGFTPRQAVGKHFRKFHRFRRRGEGFVDFKQWAFVGLFRLARLF
            ||||||||||||||||||  ::|  ||||||||||  ||||||:|||||  |||||:|||||
      a900  FARFGEFGVDFRRQKFFCLAPSQAVGKHFRKFCRFRRRGESFVDFKQRAFVGLLRLARLF
                 60         70         80         90        100        110

130        140        150        160        170        180
  m900.pep  HIGDDFVDRFLGFFVVFPKRNGVAVGFGHFASVQTDQEFDVFIDFHFGQEEEFPEAVVEA
            ||||||||||||||||||||||||||||||||||||:|||||:|||||| ||||||||||
      a900  HIGDDFVDRFLGFFVVFPKRNGVAVGFGHFASVQTNQEFDVFVDFHFGQCEEFPEAVVEA
                120        130        140        150        160        170

190        200        210        220        230        240
  m900.pep  AGDVARHFDVLDLVAPDGHFVGVEHQNIGSHQNRITEQTHFHTEIRVFLPVFCICLHGGF
            ||::| ||:||||||  | :|:|:|||:|:|::|::  ||||||:|| ||||||| ||||
      a900  AGNIACHFNVLDLVATDWNFMGIEHENVGSHEDRVAVQTHFHAEIGVFLPVFRICLHGGF
                     180        190        200        210        220        230

250        260        270        280        290        300
  m900.pep  VGMGAVHQTLGSDAGQNPVQFHHFGSVALAVEGGALGVESAGKPSGGNGLGGLVNHLRLV
            ||:|||||||| ||||||||||||||:|||:|||||||||||||||||||||||||||||
      a900  VGVGAVHQTLGGDAGQNPVQFHHFGNVALTVEGGALGVESAGKPSGGNGLGGLVNHLRLV
                     240        250        260        270        280        290

310        320        330        340        350        360
  m900.pep  AFDDTVVIGEEEEGFGIEVLRRADGGADGADVVAQMRDAGGGYAGQNSFFAHKNVLAASM
            |||||||||||||||||:||||||||||:::||||||||||||||||||||||||||||
      a900  AFDDTVVIGEEEEGFGIRVLRRADGGADSTDVVAQMRDAGGGYAGQNSFFAHKNVLAASM
                     300        310        320        330        340        350
```

```
              370        380
m900.pep  PSEREKDVPIIPDLPPTSSRQQTFPYX
          ||||||:||||||||||||||||||
a900      PSEREKDAPIIPDLPPTSSRQQTFPYX
              360        370
g901.seq not found yet
g901.pep not found yet
```

The following partial DNA sequence was identified in *N. meningitidis* <SEQ ID 2705>:

```
m901.seq
   1 ATGCCCGATT TTTCGATGTC CAATTTGGCC GTTGCCTTTT CCATCACATT

51 GGCTGCCGGT TTGTTTACCG TATTAkGyAG TGGCTTGGTG ATGTTTTCCA

101 AAACGCCCAA TCCGCGTGTG TTGTCGTTTG GTTTGGCGTT TGCCGGCGGT

151 GCGATGGTAT ATGTTTCCCT GACGGAGATT TTCAGTAAGT CCAGCGAGGC

201 GTTCGCTGAA ATTTATGATA AGACCACGC GTTTGCGGCG GCGACCATGG

251 CATTTTTGGC CGGGATGGGC GGCATTGCGC TGATTGACCG TCTGGTGCCG

301 AACCCGCATG AAACTTTAGA CGCGCAAGAC CCGTCGTTTC AAGAAAGCAA

351 ACGCCGCCAT ATCGCGCGAG TCGGCATGAT GGCGGCGTTT GCGATTACTG

401 CGCACAATTT CCCCGAAGGC TTGGCGACGT TTTTTGCCAC ATTGGAAAAT

451 CCAGCAGTCG GGATGCCTTT GGCCTTGGCG ATTGCCATCC ATAATATTCC

501 GGAGGGCATT TCCATCGCCG CGCCGGTTTA TTTTGCCACC CGCAGCCGTA

551 AGAAAACGGT GTGGGCGTGT CTGCTATCCG GCTTGGCCGA GCCGTTGGGG

601 GCGGCTTTGG GCTATTTGGT TTTGCAGCCG TTTTTGTCGC CTGCCGTGTT

651 TGGTTCGGTA TTCGGCGTGA TAGCCGGTGT GATGGTGTTT TTGGCGTTGG

701 ACGAGCTGnt GCCGGCTGCC AAACGCTATT CAGACGGCCA TGAAACCGTT

751 TACGGCCTGA CAACGGGTAT GGCGGTGATT GCCGTCAGCC TGGTATTGTT

801 CCATTTTTAA
```

This corresponds to the amino acid sequence <SEQ ID 2706; ORF 901>:

```
m901.pep
   1 MPDFSMSNLA VAFSITLAAG LFTVLXSGLV MFSKTPNPRV LSFGLAFAGG

51 AMVYVSLTEI FSKSSEAFAE IYDKDHAFAA ATMAFLAGMG GIALIDRLVP

101 NPHETLDAQD PSFQESKRRH IARVGMMAAF AITAHNFPEG LATFFATLEN

151 PAVGMPLALA IAIHNIPEGI SIAAPVYFAT RSRKKTVWAC LLSGLAEPLG

201 AALGYLVLQP FLSPAVFGSV FGVIAGVMVF LALDELXPAA KRYSDGHETV

251 YGLTTGMAVI AVSLVLFHF*
```

The following partial DNA sequence was identified in *N. meningitidis* <SEQ ID 2707>:

```
a901.seq
   1 ATGCCCGATT TTTCGATGTC CAATTTGGCC GTTGCCTTTT CCATTACGTT

51 GGCTGCCGGT TTGTTTACCG TATTAGGCAG CGGCTTGGTG ATGTTTTCCA

101 AAACGCCCAA TCCGCGCGTG TTGTCGTTTG GTTTGGCATT TGCCGGCGGT
```

```
151 GCGATGGTGT ATGTTTCCCT GACGGAGATT TTCAGTAAGT CCAGCGAGGC

201 GTTCGCTGAA ATTTATGATA AGACCACGC GTTTGCGGCG GCGACCATGG

251 CATTTTTGGC AGGGATGGGC GGCATTGCGC TGATTGACCG TCTGGTGCCG

301 AACCCGCATG AAACTTTAGA CGCGCAAGAC CCGTCGTTTC AAGAAAGCAA

351 ACGCCGCCAT ATCGCGCGAG TCGGCATGAT GGCGGCGTTT GCGATTACTG

401 CGCACAATTT CCCCGAAGGC TTGGCGACGT TTTTTGCCAC ATTGGAAAAT

451 CCAGCAGTCG GGATGCCTTT GGCCTTGGCG ATTGCCATCC ATAATATTCC

501 GGAGGGCATT TCCATCGCCG CGCCGGTTTA TTTTGCCACC CGCAGCCGTA

551 AGAAAACGGT GTGGGCGTGT CTGCTATCCG GCTTGGCCGA GCCGTTGGGG

601 GCGGCTTTGG GCTATTTGGT TTTGCAGCCG TTTTTGTCGC CTGCCGTGTT

651 TGGTTCGGTA TTCGGCGTGA TAGCCGGTGT GATGGTGTTT TTGGCGTTGG

701 ACGAGCTGCT GCCGGCTGCC AAACGCTATT CAGACGGCCA TGAAACCGTT

751 TACGGCCTGA CAATGGGCAT GGCGGTGATT GCCGTCAGCC TGGTATTGTT

801 CCATTTTTAA
```

This corresponds to the amino acid sequence <SEQ ID 2708; ORF 901.a>:

```
a901.pep
  1 MPDFSMSNLA VAFSITLAAG LFTVLGSGLV MFSKTPNPRV LSFGLAFAGG

51 AMVYVSLTEI FSKSSEAFAE IYDKDHAFAA ATMAFLAGMG GIALIDRLVP

101 NPHETLDAQD PSFQESKRRH IARVGMMAAF AITAHNFPEG LATFFATLEN

151 PAVGMPLALA IAIHNIPEGI SIAAPVYFAT RSRKKTVWAC LLSGLAEPLG

201 AALGYLVLQP FLSPAVFGSV FGVIAGVMVF LALDELLPAA KRYSDGHETV

251 YGLTMGMAVI AVSLVLFHF*
``` m901/a901 98.9% identity in 269 aa overlap

```
                  10         20         30         40         50         60
    m901.pep  MPDFSMSNLAVAFSITLAAGLFTVLXSGLVMFSKTPNPRVLSFGLAFAGGAMVYVSLTEI
              ||||||||||||||||||||||||| ||||||||||||||||||||||||||||||||||
        a901  MPDFSMSNLAVAFSITLAAGLFTVLGSGLVMFSKTPNPRVLSFGLAFAGGAMVYVSLTEI
                  10         20         30         40         50         60

70         80         90        100        110        120
    m901.pep  FSKSSEAFAEIYDKDHAFAAATMAFLAGMGGIALIDRLVPNPHETLDAQDPSFQESKRRH
              ||||||||||||||||||||||||||||||||||||||||||||||||||||||||||||
        a901  FSKSSEAFAEIYDKDHAFAAATMAFLAGMGGIALIDRLVPNPHETLDAQDPSFQESKRRH
                  70         80         90        100        110        120

130        140        150        160        170        180
    m901.pep  IARVGMMAAFAITAHNFPEGLATFFATLENPAVGMPLALAIAIHNIPEGISIAAPVYFAT
              ||||||||||||||||||||||||||||||||||||||||||||||||||||||||||||
        a901  IARVGMMAAFAITAHNFPEGLATFFATLENPAVGMPLALAIAIHNIPEGISIAAPVYFAT
                 130        140        150        160        170        180

190        200        210        220        230        240
    m901.pep  RSRKKTVWACLLSGLAEPLGAALGYLVLQPFLSPAVFGSVFGVIAGVMVFLALDELXPAA
              |||||||||||||||||||||||||||||||||||||||||||||||||||||||| |||
        a901  RSRKKTVWACLLSGLAEPLGAALGYLVLQPFLSPAVFGSVFGVIAGVMVFLALDELLPAA
                 190        200        210        220        230        240

250        260        270
    m901.pep  KRYSDGHETVYGLTTGMAVIAVSLVLFHX
              |||||||||||||| ||||||||||||||
        a901  KRYSDGHETVYGLTMGMAVIAVSLVLFHX
                 250        260        270
```

The following partial DNA sequence was identified in *N. gonorrhoeae* <SEQ ID 2709>:

```
g902.seq
    1 ATGCCGTCCG AACCCGAACG GCGGCATGGC AATACTGCCC TACCCTTCCC

51 GATAGCCGCA CGCCCAACGG TCGGTTTTTC CGGCAAGCCT TTCAAGATAA

101 CCGGCAAGTG TGTCGTATTG CGCCGCCGCA TTGTCCAAGC GGTTGATTTC

151 ACGCCGCGCC TGTTCGCCGT CGGGCATTTC GCCGATGTAC CAGCCTATGT

201 GTTTGCGTGC GATGCGCACA CCGACGGTCT CACCATAAAA CGCGTGCATG

251 GCGCGGATGT GGTTCAAAAT GGCGGCTCTG CATTCTGCCA AACTCAAGGC

301 AGGCGGTAAA ACGCCGTGTT CGGCATAATG CTTCAAATCG CGGAAAAACC

351 ACGGCCTGCC TTGCGCGCCG CGCCCTATCA TGATGCCGTC GGCGGCGGTT

401 TGTTTGAGGA cggCGGCGGC TTTTTgcggc GAagtGATGT CGCCGTTGac 451 cCaggCCGGG ATGTTCAGAc ggCTTTTGGT CTCGGcgatg agttCGTAAC 501 gcGCCTCGCC TTTGTACATT TGCGTGcgcG CGcgcccgtg aacggcaaGg 551 gcggcaatgc cgcaatcttc ggcgattttg gcgacggcgG gcaggttttg 601 atcgtcgtcg tgccaaccca AacggGTTTT GaggGTAACG GGTAcgcCCG 651 CCGCCTTgac caccgcctcc aAAatggcGg caaccagcgg CTCGTCCTGC 701 ATCagcGCGC TACCGGCTTG GACGTTGCAC ACTTTCttgg cgggGCAGCC 751 CATAttgATG TCGATGACCT GCGCCCCGAG TCCGACGTTg taacgcgccg 801 catCCGCCAT CtgttcggGG TCGCTGCCGG CAATCTGCAC GGCAACGATG 851 CCGccttcat cggcaAAAtc actgcggtgc aGGGTTTTTC CGGTATTCCT

901 GAGCGTCGGA TCGCTGGCCA GCATTTCGCA CACCGCCCAA CCTGCGCCAA

951 ACGCCCGACA GAGGCGGCGG AAGGGTTTGT CGGCAATGCC CGCCATCGGC

1001 GCAAGTGCGA TGGGGTTGTC GATAAAATAA CCGCCGATGT GCATAATGGG

1051 CCCGCGTTTC AAAAAAGTGC GCCATTGTAC ATTTTTTAA
```

This corresponds to the amino acid sequence <SEQ ID 2710; ORF 902.ng>:

```
g902.pep
    1 MPSEPERRHG NTALPFPIAA RPTVGFSGKP FKITGKCVVL RRRIVQAVDF

51 TPRLFAVGHF ADVPAYVFAC DAHTDGLTIK RVHGADVVQN GGSAFCQTQG

101 RR*NAVFGIM LQIAEKPRPA LRAAPYHDAV GGGLFEDGGG FLRRSDVAVD

151 PGRDVQTAFG LGDEFVTRLA FVHLRARAPV NGKGGNAAIF GDFGDGGQVL

201 IVVVPTQTGF EGNGYARRLD HRLQNGGNQR LVLHQRATGL DVAHFLGGAA

251 HIDVDDLRPE SDVVTRRIRH LFGVAAGNLH GNDAAFIGKI TAVQGFSGIP

301 ERRIAGQHFA HRPTCAKRPT EAAEGFVGNA RHRRKCDGVV DKITADVHNG

351 PAFQKSAPLY IF*
```

The following partial DNA sequence was identified in *N. meningitidis* <SEQ ID 2711>:

```
m902.seq
    1 TTGCACTTTC AAAGGATAAT CAAGTGTTCA GAAGGCATTT GGGCGGTAGG

51 CGCACGCCCA ACTGTCGGTT TTTCGGCAA GTCTTTCAAG ATAACCTGCA
```

```
 101 AGCATGTCGT ATTGCGCCGC CGCACTGTCC AAGCGGTTGA TTTCACGACG

151 TgTCTgTTCG CCGTcGGGCA TTTCGTCGAT GTACCAGCCT ATGTGTTTGC

201 GTGCGATGCG CACACCGGCG GTGTCGCCGT AAAACGCGTG TATGGCGCGG

251 ATGTGGTTCA AAATAGCGGC GGCGCATTCT GCCAAACTCA AGGCAGGCGG

301 CAAAACACCG TGTTCGGCAT AATGTTTCAA ATCGCGGAAG AACCACGGCC

351 TGCCTTGCGC GCCGCGCCCT ATCATAATGC CGTCGGCGGC GGTTTGTTTG

401 AGGACGGCTT GGGCTTTTTG CGGCGAAGTA ATGTCGCCGT TGACCCAGAC

451 CGGGATGTTC AGACGGCATT TGGTTTCGGC GATGAGTTCG TAACGCGCTT

501 CGCCTTTGTA CATTTGCGTA CGCGTGCGTC CGTGGACGGC AAGGGCGGCG

551 ATGCCGCAAT CTTCGGCGAT TTTGGCGATG ACGGGCAGGT TTTGATGGTC

601 GTCGTGCCAA CCCAAACGGG TTTTGAGGGT AACGGGTACG CCTGCCGCAC

651 GGACGACGGC TTCCAAAATG GCGGCAACCA GCGGCTCGTT CTGCATCAGC

701 GCGCTACCGG CTTGGACATT GCAGACTTTT TTAGCGGGAC AGCCCATGTT

751 GATGTCGATA AGCTGCGCCC CAAGGCTGAC GTTGTAACGC GCGGCATCCG

801 CCATCTGCTG CGGATCGCTT CCGGCAATCT GCACGGCAAC AATGCCGCCT

851 TCATCGGCAA AATCGCTGCG GTGCAAGGTT TTTCTAGTAT TTCTGAGCGT

901 CGGGTCGCTG GTCAGCATTT CGCACACCGC CCAACCTGCG CCAAAATCTC

951 GGCAAAGTCG GCGGAACGGT TTGTCGGTAA TGCCCGCCAT CGGcGCaAGT

1001 GCGATGGGGT TGTCGATAAA ATAGCCGCCG ATGTGCATAA TGGATCCGCG

1051 TTTCAAAAAA GTACGCCATT GTACATTTTT TAA
```

This corresponds to the amino acid sequence <SEQ ID 2712; ORF 902>:

```
m902.pep
  1 LHFQRIIKCS EGIWAVGARP TVGFFGKSFK ITCKHVVLRR RTVQAVDFTT

51 CLFAVGHFVD VPAYVFACDA HTGGVAVKRV YGADVVQNSG GAFCQTQGRR

101 QNTVFGIMFQ IAEEPRPALR AAPYHNAVGG GLFEDGLGFL RRSNVAVDPD

151 RDVQTAFGFG DEFVTRFAFV HLRTRASVDG KGGDAAIFGD FGDDGQVLMV

201 VVPTQTGFEG NGYACRTDDG FQNGGNQRLV LHQRATGLDI ADFFSGTAHV

251 DVDKLRPKAD VVTRGIRHLL RIASGNLHGN NAAFIGKIAA VQGFSSISER

301 RVAGQHFAHR PTCAKISAKS AERFVGNARH RRKCDGVVDK IAADVHNGSA

351 FQKSTPLYIF *
```

Computer analysis of this amino acid sequence gave the following results:
Homology with a Predicted ORF from *N. gonorrhoeae*
ORF 902 shows 80.9% identity over a 345 aa overlap with a predicted ORF (ORF 902.ng) from *N. gonorrhoeae*:

```
m902/g902

10         20         30         40         50
   m902.pep      LHFQRIIKCSEGIWAVGARPTVGFFGKSFKITCKHVVLRRRTVQAVDFTTCLFAVGHF
                   ::|||||||  ||  |||| |  ||||||| ||||||||    |||||||
       g902   MPSEPERRHGNTALPFPIAARPTVGFSGKPFKITGKCVVLRRRIVQAVDFTPRLFAVGHF
                10         20         30         40         50         60
```

-continued

```
           60        70        80        90        100       110
m902.pep   VDVPAYVFACDAHTGGVAVKRVYGADVVQNSGGAFCQTQGRRQNTVFGIMFQIAEEPRPA
           :||||||||||||| |:::|||:|||||||:|:||||||||| |:|||||:||||:||||
g902       ADVPAYVFACDAHTDGLTIKRVHGADVVQNGGSAFCQTQGRRXNAVFGIMLQIAEKPRPA
                   70        80        90        100       110       120

120       130       140       150       160       170
m902.pep    LRAAPYHNAVGGGLFEDGLGFLRRSNVAVDPDRDVQTAFGFGDEFVTRFAFVHLRTRASV
            |||||||:|||||||||| ||||||:||||| ||||||||:|||||||:||||||:|| |
g902        LRAAPYHDAVGGGLFEDGGGFLRRSDVAVDPGRDVQTAFGLGDEFVTRLAFVHLRARAPV
                   130       140       150       160       170       180

180       190       200       210       220       230
m902.pep    DGKGGDAAIFGDFGDDGQVLMVVVPTQTGFEGNGYACRTDDGFQNGGNQRLVLHQRATGL
            :||||:||||||||| ||||:||||||||||||||| | |  :|||||||||||||||||
g902        NGKGGNAAIFGDFGDGGQVLIVVVPTQTGFEGNGYARRLDHRLQNGGNQRLVLHQRATGL
                   190       200       210       220       230       240

240       250       260       270       280       290
m902.pep    DIADFFSGTAHVDVDKLRPKADVVTRGIRHLLRIASGNLHGNNAAFIGKIAAVQGFSSIS
            |:| |::|:||:||| |||::||||| ||||: :|:||||||:|||||||:||||||:|
g902        DVAHFLGGAAHIDVDDLRPESDVVTRRIRHLFGVAAGNLHGNDAAFIGKITAVQGFSGIP
                   250       260       270       280       290       300

300       310       320       330       340       350
m902.pep    ERRVAGQHFAHRPTCAKISAKSAERFVGNARHRRKCDGVVDKIAADVHNGSAFQKSTPLY
            |||:|||||||||||||  :::|| ||||||||||||||||||:|||||| |||||:|||
g902        ERRIAGQHFAHRPTCAKRPTEAAEGFVGNARHRRKCDGVVDKITADVHNGPAFQKSAPLY
                   310       320       330       340       350       360

360
m902.pep    IFX
            |||
g902        IFX
```

The following partial DNA sequence was identified in *N. meningitidis* <SEQ ID 2713>:

```
a902.seq
   1  TTGCACTTTC AAAGGATAAT CAAGTGTTCA GAAGGCATTT GGGCGGTAGG

51  CGCACGCCCA ACTGTCGGTT TTTTCGGCAA GTCTTTCAAG ATAACCTGCA

101  AACATGTCGT ATTGCGCCGC CGCACTGTCC AAGCGGTTGA TTTCACGACG

151  TGTCTGTTCG CCGTCGGGCA TTTCGTCGAT GTACCAGCCT ATGTGTTTGC

201  GTGCGATGCG CACACCGGCG GTGTCGCCGT AAAACGCGTG CATGGCTCGG

251  ATGTGGTTCA AAATAGTGGC GGTACATTCT GCCAAACTCA AGGCAGGCGG

301  TAAAACACCG TGTTCGGCGT AATGTTTCAA ATCGCGGAAG AACCACGGTC

351  TGCCTTGCGC GCCGCGCCCT ATCATAATGC CGTCTGCGGC GGTTTGTTTG

401  AGGACGGCTT GGGCTTTTTG CGGCGAGGTA ATGTCGCCGT TGACCCAGAC

451  CGGGATGTTC AGACGGCATT TGGTTTCGGC AATCAGGTCG TAAGCCGCTT

501  CGCCTTTGTA CATTTGCGTG CGCGTGCGTC CGTGGACGGC AAGGGCGGCA

551  ATGCCGCAAT CTTCGGCGAT TTTGGCGATG ACGGGCAGGT TTTGATGGTC

601  GTCGTGCCAA CCCAAACGGG TTTTGAGGGT AACGGGTACG CCCGCCGCTT

651  TGACCACCGC CTCCAAAATG GCGGCAACCA GCGGCTCGTT CTGCATCAGC

701  GCGCTACCGG CTTGGACATT GCAGACTTTT TTAGCGGGAC AGCCCATGTT

751  GATGTCGATA AGCTGCGCCC CAAGGCTGAC GTTGTAACGC GCGGCATCCG

801  CCATCTGCTG CGGATCGCTT CCGGCAATCT GCACGGCAAC AATGCCGCCT

851  TCATCGGCAA AATCGCTGCG GTGCAAGGTT TTTCTAGTAT TTCTGAGCGT

901  CGGGTCGCTG GTCAGCATTT CGCACACCGC CCAACCTGCG CCAAAATCTC
```

-continued

```
 951 GGCAAAGTCG GCGGAACGGT TTGTCGGTAA TGCCCGCCAT CGGCGCAAGT

1001 GCGATGGGGT TGTCGATAAA ATAGCCGCCG ATGTGCATAA TGGATCCGCG

1051 TTTCAAAAAA GTACGCCATT GTACATTTTT TAA
```

This corresponds to the amino acid sequence <SEQ ID 2714; ORF 902.a>:

```
a902.pep
   1 LHFQRIIKCS EGIWAVGARP TVGFFGKSFK ITCKHVVLRR RTVQAVDFTT

51 CLFAVGHFVD VPAYVFACDA HTGGVAVKRV HGSDVVQNSG GTFCQTQGRR

101 *NTVFGVMFQ IAEEPRSALR AAPYHNAVCG GLFEDGLGFL RRGNVAVDPD

151 RDVQTAFGFG NQVVSRFAFV HLRARASVDG KGGNAAIFGD FGDDGQVLMV

201 VVPTQTGFEG NGYARRFDHR LQNGGNQRLV LHQRATGLDI ADFFSGTAHV

251 DVDKLRPKAD VVTRGIRHLL RIASGNLHGN NAAFIGKIAA VQGFSSISER

301 RVAGQHFAHR PTCAKISAKS AERFVGNARH RRKCDGVVDK IAADVHNGSA

351 FQKSTPLYIF *
``` m902/a902 94.7% identity in 360 aa overlap

```
                   10         20         30         40         50         60
      m902.pep  LHFQRIIKCSEGIWAVGARPTVGFFGKSFKITCKHVVLRRRTVQAVDFTTCLFAVGHFVD
                ||||||||||||||||||||||||||||||||||||||||||||||||||||||||||||
          a902  LHFQRIIKCSEGIWAVGARPTVGFFGKSFKITCKHVVLRRRTVQAVDFTTCLFAVGHFVD
                   10         20         30         40         50         60

70         80         90        100        110        120
      m902.pep  VPAYVFACDAHTGGVAVKRVYGADVVQNSGGAFCQTQGRRQNTVFGIMFQIAEEPRPALR
                |||||||||||||||||||||||:|:|||||||:|||||||| |||||:|||||||| |||
          a902  VPAYVFACDAHTGGVAVKRVHGSDVVQNSGGTFCQTQGRRXNTVFGVMFQIAEEPRSALR
                   70         80         90        100        110        120

130        140        150        160        170        180
      m902.pep  AAPYHNAVGGGLFEDGLGFLRRSNVAVDPDRDVQTAFGFGDEFVTRFAFVHLRTRASVDG
                ||||||||  ||||||||||||::|||||||||||||||::  |:||||||||||:|||||
          a902  AAPYHNAVCGGLFEDGLGFLRRGNVAVDPDRDVQTAFGFGNQVVSRFAFVHLRARASVDG
                  130        140        150        160        170        180

190        200        210        220        230        240
      m902.pep  KGGDAAIFGDFGDDGQVLMVVVPTQTGFEGNGYACRTDDGFQNGGNQRLVLHQRATGLDI
                |||:|||||||||||||||||||||||||||||  | |   :|||||||||||||||||||
          a902  KGGNAAIFGDFGDDGQVLMVVVPTQTGFEGNGYARRFDHRLQNGGNQRLVLHQRATGLDI
                  190        200        210        220        230        240

250        260        270        280        290        300
      m902.pep  ADFFSGTAHVDVDKLRPKADVVTRGIRHLLRIASGNLHGNNAAFIGKIAAVQGFSSISER
                ||||||||||||||||||||||||||||||||||||||||||||||||||||||||||||
          a902  ADFFSGTAHVDVDKLRPKADVVTRGIRHLLRIASGNLHGNNAAFIGKIAAVQGFSSISER
                  250        260        270        280        290        300

310        320        330        340        350        360
      m902.pep  RVAGQHFAHRPTCAKISAKSAERFVGNARHRRKCDGVVDKIAADVHNGSAFQKSTPLYIF
                ||||||||||||||||||||||||||||||||||||||||||||||||||||||||||||
          a902  RVAGQHFAHRPTCAKISAKSAERFVGNARHRRKCDGVVDKIAADVHNGSAFQKSTPLYIF
                  310        320        330        340        350        360 m902.pep  X
                |
          a902  X
```

The following partial DNA sequence was identified in *N. gonorrhoeae* <SEQ ID 2715>:

```
g903.seq
    1 ATGGCAACAC AGGTAGGCGG TGCAAattcG gatgaggCAA GCCCCTGCTT
   51 TCCTATTTCT GAGGTGGAaT TGGTGGGTGA aGaaacggct aAATTCCGgt
  101 tTGCGCTcaa ccaTGCCTTG tgccAAACAC ATTTTGtttc cGgcaagtgt
  151 CTGcATGcgg gcgacatTAA TCAAAtcaTG TCCTTAGCAC AAAATGCTTT
  201 GATCGGCAGG GGATATACCA CGACCCGTAT CTTGGCTGCG CCACAGGATT
  251 TGAATAGTGG caaGCTTCAA TTAAccctga tgccggGCTA TCtgcgctcC
  301 ATAcgaATCG atcggtccaa cgatgatcaa ACCCATgcAG GACGTATTGC
  351 AGCATTCCAA AACAAATTTC CCACCCGCTC GAACGATCTG TTGAATCTGC
  401 GTGATTTGGA ACAAGGACTG GAAAATCTCA AATGTCTCCC GACTGCGGAA
  451 GCCGATCTCC AAATCgttcc cgtaGAGAGA GAACcAAACC AAAGTGATGT
  501 CGTGGTGCAA TGGCGGTAAC GTCTGCTGCC CTACTGTGTG AGTGTGGGGA
  551 TGGATAATTC GGGTAGTGAG GCGACAGGAA AATACCAAGG AAATATCACT
  601 TTCTCTGCCG ACAATCCTTT TggactgAGT GATATGTTCT ATGTAAATTA
  651 TGGACGTTCA ATTGGCGGTA CGcccgATGA GGAAAATTTT GACGGCCATC
  701 GCAAAGAAGG CGGATCAAAC AATTACGCCG TACATTATTC AGCCCCTTTC
  751 GGTAAATGGA CATGGGCATT CAATCACAAT GGCTACCGTT ACCATCAGGC
  801 GGTTTCCGGA TTATCGGAAG TCTATGACTA TAATGGAAAA AGTTACAACA
  851 CTGATTTCGG CTTCAACCGC CTGTTGTATC GTGATGCCAA ACGCAAAACC
  901 TATCTCAGTG TAAAACTGTG GACGAGGGAA ACAAAAAGTT ACATTGATGA
  951 TGCCGAACTG ACTGTACAAC GGCGTAAAAC CACAGGTTGG TTGGCAGAAC
 1001 TTTCCCACAA AGGATATATC GGTCGCAGTA CGGCAGATTT TAAGTTGAAA
 1051 TATAAACACG GCACCGGCAT GAAAGATGCT CTGCGCGCGC CTGAAGAAGC
 1101 CTTTGGCGAA GGCACGTCAC GTATGAAAAT TTGGACGGCA TCGGCTGATG
 1151 TAAATACTCC TTTTCAAATC GGTAAACAGC TATTTGCCTA TGACACATCC
 1201 GTTCATGCAC AATGGAACAA AACCCCGCTA ACATCGCAAG ACAAACTGGC
 1251 TATCGGCGGA CACCACACCG TACGTGGCTT CGACGGTGAA ATGAGTTTGC
 1301 CTGCCGAGCG GGGATGGTAT TGGCGCAACG ATTTGAGCTG GCAATTTAAA
 1351 CCAGGCCATC AGCTTTATCT TGGGGCTGAT GTAGGACATG TTTCAGGACA
 1401 ATCCGCCAAA TGGTTATCGG GCCAAACTCT AGCCGGCACA GCAATTGGGA
 1451 TACGCGGGCA GATAAAGCTT GGCGGCAACC TGCATTACGA TATATTTACC
 1501 GGCCGTGCAT TGAAAAAGCC cgaatatttt cAGACGAAGA Aatgggtaac
 1551 ggggtTTCAG gtgggttatt cgTTTTGA
```

This corresponds to the amino acid sequence <SEQ ID 2716; ORF 903.ng>:

```
g903.pep
    1 MATQVGGANS DEASPCFPIS EVELVGEETA KFRFALNHAL CQTHFVSGKC
   51 LHAGDINQIM SLAQNALIGR GYTTTRILAA PQDLNSGKLQ LTLMPGYLRS
  101 IRIDRSNDDQ THAGRIAAFQ NKFPTRSNDL LNLRDLEQGL ENLKCLPTAE
```

-continued

```
151 ADLQIVPVER EPNQSDVVVQ WRXRLLPYCV SVGMDNSGSE ATGKYQGNIT

201 FSADNPFGLS DMFYVNYGRS IGGTPDEENF DGHRKEGGSN NYAVHYSAPF

251 GKWTWAFNHN GYRYHQAVSG LSEVYDYNGK SYNTDFGFNR LLYRDAKRKT

301 YLSVKLWTRE TKSYIDDAEL TVQRRKTTGW LAELSHKGYI GRSTADFKLK

351 YKHGTGMKDA LRAPEEAFGE GTSRMKIWTA SADVNTPFQI GKQLFAYDTS

401 VHAQWNKTPL TSQDKLAIGG HHTVRGFDGE MSLPAERGWY WRNDLSWQFK

451 PGHQLYLGAD VGHVSGQSAK WLSGQTLAGT AIGIRGQIKL GGNLHYDIFT

501 GRALKKPEYF QTKKWVTGFQ VGYSF*
```

The following partial DNA sequence was identified in *N. meningitidis* <SEQ ID 2717>:

```
m903.seq
   1 ATGCAGCGTC AGCAGCACAT AGATGCTGAA TTGTTAACTG ATGCAAATGT

51 CCGTTTCGAG CAACCATTGG AGAAGAACAA TTATGTCCTG AGTGAAGATG

101 AAACACCGTG TACTCGGGTA AATTACATTA GTTTAGATGA TAAGACGGTG

151 CGCAAATTTT CTTTTCTTCC TTCTGTGCTC ATGAAAGAAA CAGCTTTTAA

201 AACTGGGATG TGTTTAGGTT CCAATAATTT GAGCAGGCTA CAAAAAGCCG

251 CGCAACAGAT ACTGATCGTG CGTGGCTACC TCACTTCCCA AGCTATTATC

301 CAaCCACAGA ATATGGATTC GGGAATTCTG AAATTACGGG TATCAGCAGG

351 CGAAATAGGG GATATCCGCT ATGAAGAAAA ACGGGATGGG AAGTCTGCCG

401 AGGGCAGTAT TAGTGCATTC AATAACAAAT TTCCCTTATA TAGGAACAAA

451 ATTCTCAATC TTCGCGATGT AGAGCAGGGC TTGGAAAACC TGCGTCGTTT

501 GCCGAGTGTT AAAACAGATA TTCAGATTAT ACCGTCCGAA GAAGAAGGCA

551 AAAGCGATTT ACAGATCAAA TGGCAGCAGA ATAAACCCAT ACGGTTCAGT

601 ATCGGTATAG ATGATGCGGG CGGCAAAACG ACCGGCAAAT ATCAAGGAAA

651 TGTCGCTTTA TCGTTCGATA ACCCTTTGGG CTTAAGCGAT TTGTTtTATG

701 TTTCATATGG ACGCGGTTTG GCGCACAAAA CGGACTTGAC TGATGCCACC

751 GGTACGGAAA CTGAAAGCGG ATCCAGAAGT TACAGCGTGC ATTATTCGGT

801 GCCCGTAAAA AAATGGCTGT TTTCTTTTAA TCACAATGGA CATCGTTACC

851 ACGAAGCAAC CGAAGGCTAT TCCGTCAATT ACGATTACAA CGGCAAACAA

901 TATCAGAGCA GCCTGGCCGC CGAGCGCATG CTTTGGCGTA ACAGACTTCA

951 TAAAACTTCA GTCGGAATGA AATTATGGAC ACGCCAAACC TATAAATACA

1001 TCGACGATGC CGAAATCGAA GTACAACGCC GCCGCTCTGC AGGCTGGGAA

1051 GCCGAATTGC GCCACCGTGC TTACCTCAAC CGTTGGCAGC TTGACGGCAA

1101 GTTGTCTTAC AAACGCGGGA CCGGCATGCG CCAAAGTATG CCTGCACCGG

1151 AAGAAAACGG CGGCGATATT CTTCCAGGTA CATCTCGTAT GAAAATCATT

1201 ACTGCCAGTT TGGACGCAGC CGCCCCATTT AyTTTAGGCA AACAGCAGTT

1251 TTTCTACGCA ACCGCCATTC AAGCTCAATG GAACAAAACG CCGTTGGTTG

1301 CCCAAGATAA ATTGTCAATC GGCAGCCGCT ACACCGTTCG CGGATTTGAT

1351 GGGGAGCAGA GTCTTTTCGG AGAGCGAGGT TTCTACTGGC AGAATACTTT

1401 AACTTGGTAT TTTCATCCGA ACCATCAGTT CTATCTCGGT GCGGACTATG
```

```
-continued
1451 GCCGCGTATC TGGCGAAAGT GCACAATATG TATCGGGCAA GCAGCTGATG

1501 GGTGCAGTGG TCGGCTTCAG AGGAGGGCAT AAAGTAGGCG GTATGTTTGC

1551 TTATGATCTG TTTGCCGGCA AGCCGCTTCA TAAACCCAAA GGCTTTCAGA

1601 CGACCAACAC CGTTTACGGC TTCAACTTGA ATTACAGTTT CTAA
```

This corresponds to the amino acid sequence <SEQ ID 2718; ORF 903>:

```
m903.pep
  1 MQRQQHIDAE LLTDANVRFE QPLEKNNYVL SEDETPCTRV NYISLDDKTV

51 RKFSFLPSVL MKETAFKTGM CLGSNNLSRL QKAAQQILIV RGYLTSQAII

101 QPQNMDSGIL KLRVSAGEIG DIRYEEKRDG KSAEGSISAF NNKFPLYRNK

151 ILNLRDVEQG LENLRRLPSV KTDIQIIPSE EEGKSDLQIK WQQNKPIRFS

201 IGIDDAGGKT TGKYQGNVAL SFDNPLGLSD LFYVSYGRGL AHKTDLTDAT

251 GTETESGSRS YSVHYSVPVK KWLFSFNHNG HRYHEATEGY SVNYDYNGKQ

301 YQSSLAAERM LWRNRLHKTS VGMKLWTRQT YKYIDDAEIE VQRRSAGWE

351 AELRHRAYLN RWQLDGKLSY KRGTGMRQSM PAPEENGGDI LPGTSRMKII

401 TASLDAAAPF XLGKQQFFYA TAIQAQWNKT PLVAQDKLSI GSRYTVRGFD

451 GEQSLFGERG FYWQNTLTWY FHPNHQFYLG ADYGRVSGES AQYVSGKQLM

501 GAVVGFRGGH KVGGMFAYDL FAGKPLHKPK GFQTTNTVYG FNLNYSF*
```

Computer analysis of this amino acid sequence gave the following results:
Homology with a Predicted ORF from *N. gonorrhoeae*
ORF 903 shows 48.9% identity over a 519 aa overlap with a predicted ORF (ORF 903.ng) from *N. gonorrhoeae*:

```
    m903/g903

10         20         30         40         50         60
m903.pep    MQRQQHIDAELLTDANVRFEQPLEKNNYVLSEDETPCTRVNYISLDDKTVRKFSFLPSVL
                         |:: :||   :: :   |    :  ||   :    |    :
g903                     MATQVGGANSDEASPCFPISEVELVGEETAKFRFALNHA
                                   10         20         30

70         80         90        100        110        120
m903.pep    MKETAFKTGMCLGSNNLSRLQKAAQQILIVRGYLTSQAIIQPQNMDSGILKLRVSAGEIG
              : |   |  :|  ||  :::::::::  ||:  ||  |||    |:: :   ||:::||   |:|  :     |:
g903        LCQTHFVSGKCLHAGDINQIMSLAQNALIGRGYTTTRILAAPQDLNSGKLQLTLMPGYLR
            40         50         60         70         80         90

130        140        150        150        170        180
m903.pep    DIRYEEKRDGKSAEGSISAFNNKFPLYRNKILNLRDVEQGLENLRRLPSVKTDIQIIPS:
            :||  :::  |  ::    |  |:||:||||     |  :|||||:||||||:  ||::::|:|||:
g903        SIRIDRSNDDQTHAGRIAAFQNKFPTRSNDLLNLRDLEQGLENLKCLPTAEADLQIVPV:
            100        110        120        130        140        150

190        200        210        220        230
m909.pep    EE-GKSDLQIKWQQNK-PIRFSIGIDDAGGKTTGKYQGNVALSFDNPLGLSDLFYVSYGR
            :|  ::||:  ::|:|       |   |:|:|::|:::||||||||:::|  |||:||||:|||:|||
g903        REPNQSDVVVQWRXRLLPYCVSVGMDNSGSEATGKYQGNITFSADNPFLGLSDMFYVNYG
            160        170        180        190        200        210

240        250        260        270        280        290
m903.pep    GLAHKTDLTDATGTETESGSRSYSVHYSVPVKKWLFSFNHNGHRYHEATEGYSVNYDYNG
            :::     |     |   |::|  :|:||||:|     ||   :: :|||||:|   |      |||||
g903        SIGGTPDEENFDGHRKEGGSNNYAVHYSAPFGTWTWAFNHNGYRYHQAVSGLSEVYDYNG
            220        230        240        250        260        270

300        310        320        330        340        350
m903.pep    KQYQSSLAAERMLWRNRLHKTSVGMKLWTRQTYKYIDDAEIEVQRRSAGWEAELRHRAY
            |:|::::::  :|:|:|:    :||   :::|||||:|  :||||||:  ||||:::||   |||  |::|
g903        KSYNTDFGFNRLLYRDAKRKTYLSVKLWTRETSKYIDDAELTVQRRKTTGWLAELSHKGY
            280        290        300        310        320        330
```

```
              360        370        380        390        400        410
m903.pep  LNRWQLDGKLSYKRGTMRQSMPAPEENGGDILPGTSRMKIITASLDAAAPFXLGKQQFF
          ::|   ||:||:||||::::  ||||   |:   ||||||||| |||  |:  :||  :|||  |
g903      IGRSTADFKLKYKHGTGMKDALRAPEEAFGE---GTSRMKIWTASADVNTPFQIGKQLFA
              340        350        360        370        380        390

420        430        440        450        460        470
m903.pep  YATAIQAQWNKTPLVAQDKLSIGSRYTVRGFDGEQSLFGERGFYWQNTLTWYFHPNHQFY
          |  |:::||||||||||::||||:||:::||||||||||:||  :|||:||:|  |:|  |:|:||:|
g903      LGADVGHVSGQSAKWLSGQTLAGTAIGIRGQIKLGGNLHYDIFTGRALKKPEYFQTKKWV
              460        470        480        490        500        510

480        490        500        510        520        530
m903.pep  LGADYGRVSGESAQYVSGKQLMGAVVGFRGGHKVGGMFAYDLFAGKPLHKPKGFQTTNTV
          ||||  |:|||:||:::||:|  |  |:::|:||   |:||  :  ||:|:|:  |:|||   |||  :  |
g903      LGADVGHVSGQSAKWLSGQTLAGTAIGIRGQIKLGGNLHYDIFTGRALKKPKEFQTKKWV
              460        470        480        490        500        510

540
m903.pep  YGFNLNYSFX
          ||:::||||
g903      TGFQVGYSFX
              520
```

The following partial DNA sequence was identified in *N. meningitidis* <SEQ ID 2719>:

```
a903.seq
    1 ATGCAGCGTC AGCAGCACAT AGATGCTGAA TTGTTAACTG ATGCAAATGT

51 CCGTTTCGAG CAACCATTGG AGAAGAACAA TTATGTCCTG AGTGAAGATG

101 AAACACCGTG TACTCGGGTA AATTACATTA GTTTAGATGA TAAGACGGCG

151 CGCAAATTTT CTTTTCTTCC TTCTGTGCTC ATGAAAGAAA CAGCTTTTAA

201 AACTGGGATG TGTTTAGGTT CCAATAATTT GAGCAGGCTA CAAAAAGCCG

251 CGCAACAGAT ACTGATTGTG CGTGGCTACC TCACTTCCCA AGCTATTATC

301 CAACCACAGA ATATGGATTC GGGAATTCTG AAATTACGGG TATCAGCAGG

351 CGAAATAGGG GATATCCGCT ATGAAGAAAA ACGGGATGGG AAGTCTGCCG

401 AGGGCAGTAT TAGTGCATTC AATAACAAAT TTCCCTTATA TAGGAACAAA

451 ATTCTCAATC TTCGCGATGT AGAGCAGGGC TTGGAAAACC TGCGTCGTTT

501 GCCGAGTGTT AAAACAGATA TTCAGATTAT ACCGTCCGAA GAAGAAGGCA

551 AAAGCGATTT ACAGATCAAA TGGCAGCAGA ATAAACCCAT ACGGTTCAGT

601 ATCGGTATAG ATGATGCGGG CGGCAAAACG ACCGGCAAAT ATCAAGGAAA

651 TGTCGCTTTA TCGTTCGATA ACCCTTTGGG CTTAAGCGAT TTGTTTTATG

701 TTTCATATGG ACGCGGTTTG GTGCACAAAA CGGACTTGAC TGATGCCACC

751 GGTACGGAAA CTGAAAGCGG ATCCAGAAGT TACAGCGTGC ATTATTCGGT

801 GCCCGTAAAA AAATGGCTGT TTTCTTTTAA TCACAATGGA CATCGTTACC

851 ACGAAGCAAC CGAAGGCTAT TCCGTCAATT ACGATTACAA CGGCAAACAA

901 TATCAGAGCA GCCTGGCCGC CGAGCGCATG CTTTGGCGTA ACAGGTTTCA

951 TAAAACTTCA GTCGGAATGA AATTATGGAC ACGCCAAACC TATAAATACA

1001 TCGACGATGC CGAAATCGAA GTGCAACGCC GCCGCTCTGC AGGCTGGGAA

1051 GCCGAATTGC GCCACCGTGC TTACCTCAAC CGTTGGCAGC TTGACGGCAA

1101 GTTGTCTTAC AAACGCGGGA CCGGCATGCG CCAAAGTATG CCCGCACCTG

1151 AAGAAAACGG CGGCGGTACT ATTCCAGGCA CATCCCGTAT GAAAATCATA

1201 ACCGCCGGAT TGGATGCAGC GGCCCCGTTT ATGTTGGGCA AACAGCAGTT

1251 TTTCTACGCA ACCGCCATTC AAGCTCAATG GAACAAAACG CCTTTGGTTG
```

```
-continued
1301 CCCAAGACAA GTTGTCTATC GGCAGCCGCT ACACCGTTNG CGGATTTGAT

1351 GGGGAGCAGA GTCTTTTCGG AGAGCGAGGT TTCTACTGGC AGAATACTTT

1401 AACTTGGTAT TTTCATCCGA ACCATCAGTT CTATCTCGGT GCGGACTATG

1451 GCCGCGTATC TGGCGAAAGT GCACAATATG TATCGGGCAA GCAGCTGATG

1501 GGTGCAGTGG TCGGNTTCAG AGGAGGNCAT AAAGTAGGCG GTATGTTTGC

1551 TTATGATCTG TTTGCCGGCA AGCCGCTTCA TAAACCCAAA GGCTTTCAGA

1601 CGACCAACAC CGTTTACGGC TTCAACTTGA ATTACAGTTT CTAA
```

This corresponds to the amino acid sequence <SEQ ID 2720; ORF 903.a>:

```
a903.pep
  1 MQRQQHIDAE LLTDANVRFE QPLEKNNYVL SEDETPCTRV NYISLDDKTA

51 RKFSFLPSVL MKETAFKTGM CLGSNNLSRL QKAAQQILIV RGYLTSQAII

101 QPQNMDSGIL KLRVSAGEIG DIRYEEKRDG KSAEGSISAF NNKFPLYRNK

151 ILNLRDVEQG LENLRRLPSV KTDIQIIPSE EEGKSDLQIK WQQNKPIRFS

201 IGIDDAGGKT TGKYQGNVAL SFDNPLGLSD LFYVSYGRGL VHKTDLTDAT

251 GTETESGSRS YSVHYSVPVK KWLFSFNHNG HRYHEATEGY SVNYDYNGKQ

301 YQSSLAAERM LWRNRFHKTS VGMKLWTRQT YKYIDDAEIE VQRRRSAGWE

351 AELRHRAYLN RWQLDGKLSY KRGTGMRQSM PAPEENGGGT IPGTSRMKII

401 TAGLDAAAPF MLGKQQFFYA TAIQAQWNKT PLVAQDKLSI GSRYTVXGFD

451 GEQSLFGERG FYWQNTLTWY FHPNHQFYLG ADYGRVSGES AQYVSGKQLM

501 GAVVGFRGGH KVGGMFAYDL FAGKPLHKPK GFQTTNTVYG FNLNYSF*
``` m903/a903 98.4% identity in 547 aa overlap

```
                   10         20         30         40         50         60
    m903.pep   MQRQQHIDAELLTDANVRFEQPLEKNNYVLSEDETPCTRVNYISLDDKTVRKFSFLPSVL
               ||||||||||||||||||||||||||||||||||||||||||||||||:|||||||||||
        a903   MQRQQHIDAELLTDANVRFEQPLEKNNYVLSEDETPCTRVNYISLDDKTARKFSFLPSVL
                   10         20         30         40         50         60

70         80         90        100        110        120
    m903.pep   MKETAFGTGMCLGSNNLSRLQKAAQQILIVRGYLTSQAIIQPQNMDSGILKLRVSAGEIG
               ||||||| |||||||||||||||||||||||||||||||||||||||||||||||||||
        a903   MKETAFKTGMCLGSNNLSRLQKAAQQILIVRGYLTSQAIIQPQNMDSGILKLRVSAGEIG
                   70         80         90        100        110        120

130        140        150        160        170        180
    m903.pep   DIRYEEKRDGKSAEGSISAFNNKFPLYRNKILNLRDVEQGLENLRRLPSVKTDIQIIPSE
               ||||||||||||||||||||||||||||||||||||||||||||||||||||||||||||
        a903   DIRYEEKRDGKSAEGSISAFNNKFPLYRNKILNLRDVEQGLENLRRLPSVKTDIQIIPSE
                  130        140        150        160        170        180

190        200        210        220        230        240
    m903.pep   EEGKSDLQIKWQQNKPIRFSIGIDDAGGKTTGKYQGNVALSFDNPLGLSDLFYVSYGRGL
               ||||||||||||||||||||||||||||||||||||||||||||||||||||||||||||
        a903   EEGKSDLQIKWQQNKPIRFSIGIDDAGGKTTGKYQGNVALSFDNPLGLSDLFYVSYGRGL
                  190        200        210        220        230        240

250        260        270        280        290        300
    m903.pep   AHKTDLTDATGTETESGSRSYSVHYSVPVKKWLFSFNHNGHRYHEATEGYSVNYDyNGKQ
               :|||||||||||||||||||||||||||||||||||||||||||||||||||||||||||
        a903   VHKTDLTDATGTETESGSRSYSVHYSVPVKKWLFSFNHNGHRYHEATEGYSVNYDyNGKQ
                  250        260        270        280        290        300

310        320        330        340        350        360
    m903.pep   YQSSLAAERMLWRNRLHKTSVGMKLWTRQTYKYIDDAEIEVQRRRSAGWEAELRHRAYLN
               |||||||||||||||:||||||||||||||||||||||||||||||||||||||||||||
        a903   YQSSLAAERMLWRNRFHKTSVGMKLWTRQTYKYIDDAEIEVQRRRSAGWEAELRHRAYLN
                  310        320        330        340        350        360
```

```
                   370        380        390        400        410        420
m903.pep  RWQLDGKLSYKRGTGMRQSSMPAPEENGGDILPGTSRMKIITASLDAAPFXLGKQQFFYA
          ||||||||||||||||||||||||||||||:||||||||||:||||||||||||||||
          RWQLDGKLSYKRGTGMRQSSMPAPEENGGGTIPGTSRMKIITAGLDAAPPMLGKQQFFYA
                   370        380        390        400        410        420

430        440        450        460        470        480
m903.pep  TAIQAQWNKTPLVAQDKLSIGSRYTVRGFDGEQSLFGERGFYWQNTLTWYFHPNHQFYLG
          |||||||||||||||||||||||||||||| |||||||||||||||||||||||||||||
a903      TAIQAQWNKTPLVAQDKLSIGSRYTVRGFDGEQSLFGERGFYWQNTLTWYFHPNHQFYLG
                   430        440        450        460        470        480

490        500        510        520        530        540
m903.pep  ADYGRVSGESAQYVSGKQLMGAVVGFRGGHKVGGMFAYDLFAGKPLHKPKGFQTTNTVYG
          ||||||||||||||||||||||||||||||||||||||||||||||||||||||||||||
a903      ADYGRVSGESAQYVSGKQLMGAVVGFRGGHKVGGMFAYDLFAGKPLHKPKGFQTTNTVYG
                   490        500        510        520        530        540 m903.pep  FNLNYSFX
          ||||||||
a903      FNLNYSFX
```

The following partial DNA sequence was identified in *N. gonorrhoeae* <SEQ ID 2721>:

```
g904.seq
    1  ATGATGCAGC ACAATCGTTT CTTCGCGGTC GGGGCCGGTg gaGACGATGG

51  CGACCGGCGC GCCGCAGACT TCTTCAATCC GTTTCAAATA TGCTTTGGCA

101  TTGGCAGGCA ATGCGTCGTA GCTTTTCACG CCGACAGTCG ATTCGCGCCA

151  GCCGGGCATG GTTTCGTAAA TCGGTTTGCA GGTTTCCACC GCATCCGAAC

201  CGCAAGGCAG GATGTCGGTT TTGCCGCCGC CTGGCAATTC GTAGCCGACG

251  CAGATATTGA TGGTTTCAAC GCCGTCCATT ACATCGAGTT TGGTAATGCA

301  CATACCGAAA TGCCGTTGA TTTGGATGGA GCGTTTCAGG CGGCGGCAT

351  CAAACCAGCC GCAGCGGCGC GCGCGGCCGG TTACCGAACC GAATTCGTGT

401  CCGCGCTCCG CCAAACCTGC GCCTACTTCG TCGAACAATT CGGTCGGGAA

451  CGGGCCCGAA CCGACGCGCG TGGTATAGGC TTTGACGATG CCCAAAACAT

501  AATCCAGCAT TTGAGGACCT ACGCCCGCGC CTGCCGAAGC GCGCCGGCG

551  AGACAGTTGG ACGAGGTAAC GAAGGGGTAA GTGCCGTAGT CGATGTCCAA

601  CAACGCACCT TGCGCGCCTT CAAACAGCAG TTTTTCGCCG TTTTTGTTTT

651  TTTCGTTCAA CACGCgggaC acgtcgGCAA TCATCGGCGC AATGCGCGGC

701  GCGACTTTTT CGATAACCGC CATCACGTCT TCCGCTTTAA CCGGTCCGGC

751  GTTATGCAGG TATTGGAGTT GGACGTTGTA ATAGGCAAGG ACGGCATCCA

801  GTTTTTCACG CAGTTTTTCA GGATGCAGCA AATCGGCGGC GCGAATGGCG

851  CGGCGTGCCA CTTTGTCTTC GTAGGCAGGG CCGATGCCGC GGCCGGTCGT

901  GCCGATTTTG CCTTTGCCGC GCGATGCTTC GCGGGCTTGG TCGAGCGCGA

951  TGTGGTAAGG CAGGATCAGC GGGCAGGTCG GCGCGATTTT CAGACGGCCT

1001  TCGACGTTTT TCACGCCTGC CGCGTTCAAC TCGTCGATTT CGCCCAACAG

1051  GGCTTCGGGg gaaacgAcaa cGCCCGAACC gatGAAGCAA TCCAATCCTT

1101  CGTGCAGGAT ACCGCTCGGA ATCAGGCGCA AAATGGTTTT TTTGCCGCCG

1151  ACGACCAAGG TATGCCCGC ATTGTGGCCG CCTTGGAAGC GCACgacGct 1201  gCCGGCTTCT TCCGCCAGCC AGTCAACGAT TTTACCTTTA CCCTCGTCGC 1251  CCCACTGTGc gccGATTACT ACAACATTTT TAGCCATAGC CATATAACCT 1301  ATCGatatTA A
```

This corresponds to the amino acid sequence <SEQ ID 2722; ORF 904.ng>:

```
g904.pep
   1 MMQHNRFFAV GAGGDDGDRR AADFFNPFQI CFGIGRQCVV AFHADSRFAP

51 AGHGFVNRFA GFHRIRTARQ DVGFAAAWQF VADADIDGFN AVHYIEFGNA

101 HTGNAVDLDG AFQGGGIKPA AAARAAGYRT EFVSALRQTC AYFVEQFGRE

151 RARTDARGIG FDDAQNIIQH LRTYARACRS RAGETVGRGN EGVSAVVDVQ

201 QRTLRAFKQQ FFAVFVFFVQ HAGHVGNHRR NARRDFFDNR HHVFRFNRSG

251 VMQVLELDVV IGKDGIQFFT QFFRMQQIGG ANGAACHFVF VGRADAAAGR

301 ADFAFAARCF AGLVERDVVR QDQRAGRRDF QTAFDVFHAC RVQLVDFAQQ

351 GFGGNDNART DEAIQSFVQD TARNQAQNGF FAADDQGMAR IVAALEAHDA

401 AGFFRQPVND FTFTLVAPLC ADYYNIFSHS HITYRY*
```

The following partial DNA sequence was identified in *N. meningitidis* <SEQ ID 2723>:

```
m904.seq
   1 ATGATGCAGC ACAATCGTTT CTTCTCGGTC GGGGCCGgTG GAGACGATGG

51 CGACCGGCGC GCCGCAGACT TCTTCAATCC GTTTCAAATA TGCTTTGGCG

101 TTTTCGGGCA ATGCGCCGTA GTCCTTCACG CCGAAAGTGG ATTCGCGCCA

151 GCCGGGCATG GTTTCGTAAA TCGGCTTGCA GGTTTCCACC GCATCGGAAC

201 CGCAAGGCAG GATGTCGGTT TTGCCGCCGT CGGGCAATTC ATAGCCGACG

251 CAGATATTGA TGGTTTCAAC GCCGTCCATT ACATCGAGTT TAGTAATACA

301 CATACCGGAA ATGCCGTTGA TTTGGATGGA GCGTTTCAGG GCGGCGGCAT

351 CAAACCAGCC GCAGCGGCGT GCGCGTCCGG TTACCGAACC GAATTCGTGT

401 CCGCGTTCTG CCAAACCTAC GCCTACTTCG TCGAACAATT CGGTCGGGAA

451 CGGGCCCGAA CCGACGCGCG TGGTATAGGC TTTGACGATG CCCAAAACAT

501 AATCCAGCAT TTGAGGACCT ACGCCCGCGC CTGCCGAAGC TGCGCCCGCC

551 AGACAGTTGG ACGAGGTAAC GAAGGGATAA GTGCCGTAGT CGATGTCCAA

601 CAACGCACCT TGCGCGCCTT CAAACAGCAG TTTTTCGCCG TTTTTGTTTT

651 TCTCGTTCAA CACGCGGGAC ACGTCGGTAA TCATCGGCGC AATGCGCGGC

701 GCGACTTTTT CGATAACCGC CATCACGTCT TCCGCTTTAA CCGGCTCGGC

751 ATTGTGCAGA TGTTGCAGTT GGACATTGTA ATAGGCAAGG ACGGCATCCA

801 GTTTTTCACG CAGTTTyTCA GGATGCAGCA AATCGGCGGC GCGAATGGCG

851 CGGCGTGCCA CTTTGTCTTC GTAGGCAGGG CCGATGCCGC GGCCGGTCGT

901 GCCGATTTTG CCTTTGCCGC GCG.ATcTTC GCGGGCTTGG TCGAGCGCGA

951 TGTGGTAAGG CAGGATCAGC GGGCAGGTCG GCGCGATTTT CAGACGGCCT

1001 TCGACGTTTT TCACGCCTGC CGCGTTCAAC TCGTCGATTT CGCCCAACAG

1051 GGCTTCGGGG GAGACGACAA CGCCCGAACC GATGAAGCAG TCCAAACTTT

1101 CATGCAGGAT GCCGCTCGGA ATCAGGCGCA AATGGTTTT TTTGCCGCCG

1151 ACAACCAAGG TATGGCCCGC ATTGTGGCCG CCTTGGAAGC GCACCaCGCC

1201 GCCGGCTTCT TCCGCCAGCC AGTCAACGAT TTTACCTTTA CCCTCGTCGC
```

```
-continued
1251 CCCACTGTGC GCCGATTAsT ACAACATTTT TAGCCATAGC CATATAACCT

1301 ATCGATATTA A
```

This corresponds to the amino acid sequence <SEQ ID 2724; ORF 904>:

```
m904.pep
   1 MMQHNRFFSV GAGGDDGDRR AADFFNPFQI CFGVFGQCAV VLHAESGFAP

51 AGHGFVNRLA GFHRIGTARQ DVGFAAVGQF IADADIDGFN AVHYIEFSNT

101 HTGNAVDLDG AFQGGGIKPA AAACASGYRT EFVSAFCQTY AYFVEQFGRE

151 RARTDARGIG FDDAQNIIQH LRTYARACRS CARQTVGRGN EGISAVVDVQ

201 QRTLRAFKQQ FFAVFVFLVQ HAGHVGNHRR NARRDFFDNR HHVFRFNRLG

251 IVQMLQLDIV IGKDGIQFFT QFXRMQQIGG ANGAACHFVF VGRADAAAGR

301 ADFAFAAXIF AGLVERDVVR QDQRAGRRDF QTAFDVFHAC RVQLVDFAQQ

351 GFGGDDNART DEAVQTFMQD AARNQAQNGF FAADNQGMAR IVAALEAHHA

401 AGFFRQPVND FTFTLVAPLC ADXYNIFSHS HITYRY*
```

Computer analysis of this amino acid sequence gave the following results:

Homology with a Predicted ORF from *N. gonorrhoeae*

ORF 904 shows 90.4% identity over a 436 aa overlap with a predicted ORF (ORF 904.ng) from *N. gonorrhoeae*:

```
   m904/g904

10         20         30         40         50         60
      m904.pep  MMQHNRFFSVGAGGDDGDRRAADFFNPFQICFGVFGQCAVVLHAESGFAPAGHGFVNRLA
                ||||||||:||||||||||||||||||||||: ||:|::||:| ||||||||||||:|
      g904      MMQHNRFFAVGAGGDDGDRRAADFFNPFQICFGIGRQCVVAFHADSRFAPAGHGFVNRFA
                      10         20         30         40         50         60

70         80         90        100        110        120
      m904.pep  GFHRIGTARQDVGFAAVGQFIADADIDGFNAVHYIEFSNTHTGNAVDLDGAFQGGGIKPA
                ||||| ||||||||||:||:||||||||||||||||||:|:|||||||||||||||||
      g904      GFHRIRTARQDVGFAAAWQPVADADIDGFNAVHYIEFGNAHTGNAVDLDGAFQGGGIKPA
                      70         80         90        100        110        120

130        140        140        160        170        180
      m904.pep  AAACASGYRTEFVSAFCQTYAYFVEQFGRERARTDARGIGFDDAQNIIQHLRTYARACRS
                ||| |:|||||||||:| ||||||||||||||||||||||||||||||||||||||||
      g904      AAACAAGYRTEFVSALRQTCAYFVEQFGRERARTDARGIGFDDAQNIIQHLRTYARACRS
                     130        140        140        160        170        180

190        200        210        220        230        240
      m904.pep  CARQTVGRGNEGISAVVDVQQRTLRAFKQQFFAVFVFLVQHAGHVGNHRRNARRDFFDNR
                | :|||||||:|||||||||||||||||||||||||:|||||||||||||||||||||
      g904      RAGETVGRGNEGVSAVVDVQQRTLRAFKQQFFAVFVFFVQHAGHVGNHRRNARRDFFDNR
                     190        200        210        220        230        240

250        260        270        280        290        300
      m904.pep  HHVFRFNRLGIVQMLQLDIVIGKDGIQFFTQFXRMQQIGGANGAACHFVFVGRADAAAGR
                ||||||| |::|:|:||:||||||||||||||| ||||||||||||||||||||||||
      g904      HHVFRFNRSGVMQVLELDVVIGKDGIQFFTQFFRMQQIGGANGAACHFVFVGRADAAAGR
                     250        260        270        280        290        300

310        320        330        340        350        360
      m904.pep  ADFAFAARIFAGLVERDVVRQDQRAGRRDFQTAFDVFHACRVQLVDFAQQGFGGDDNART
                |||||||| |||||||||||||||||||||||||||||||||||||||||:|||||
      g904      ADFAFAARCFAGLVERDVVRQDQRAGRRDFQTAFDVFHACRVQLVDFAQQFDFFDDNART
                     310        320        330        340        350        360

370        380        390        400        410        420
      m904.pep  DEAVQTFMQDAARNQAQNGFFAADNQGMARIVAALEAHHAAGFFRQPVNDFTFTLVAPLC
                |||:|:|:||:|||||||||||:|||||||||||||| |||||||||||||||||||
      g904      DEAIQSFVQDTARNQAQNGFFAADDQGMARIVAALEAHDAAGFFRQPVNDFTFTLVAPLC
                     370        380        390        400        410        420
```

-continued

```
                       430
m904.pep   ADXYNIFSHSHITYRYX
g904       || |||||||||||||||
           ADYYNIFSHSHITYRYX
                       430
```

The following partial DNA sequence was identified in *N. meningitidis* <SEQ ID 2725>:

```
a904.seq
    1 ATGATGCAGC ACAATCGTTT CTTCGCGGTC GGGGCCGGTG GAGACGATGG

51 CGACCGGCGC ACCGCAGACT TCTTCAATCC GTTTCAAATA TGCTTTGGCA

101 TTGGCAGGTA ATGCGTCGTA GCTTTTCACG CCGAAAGTGG ATTCGCTCCA

151 ACCGGGCATG GTTTCGTAAA TCGGCTTGCA GGCTTCTACC GCATCAGAGC

201 CGCAAGGCAG GATGTCGGTT TTGCCGCCGT CGGGCAATTC GTAGCCGACG

251 CAGATATTGA TGGTTTCAAC GCCGTCCATT ACATCGAGTT TGGTAATACA

301 CATACCGGAA ATGCCGTTGA TTTGGATGGA GCGTTTCAGG CGGCGGCAT

351 CAAACCAGCC GCAGCGGCGT GCGCGTCCGG TTACCGAACC GAATTCGTGT

401 CCGCGTTCTG CCAAACCTGC TCCGACTTCG TCAACAATT CGGTCGGGAA

451 CGGGCCCGAA CCGACGCGCG TGGTATAGGC TTTGACGATG CCCAAAACAT

501 AATCCAGCAT TTGAGGGCCT ACGCCCGCGC CTGCCGAAGC CGCGCCGGCG

551 AGGCAGTTGG ACGAAGTAAC GAAGGGGTAA GTGCCGTAGT CGATGTCCAA

601 CAACGCACCT TGCGCGCCTT CAAACAGCAG TTTTTCGCCG TTTTTGTTTT

651 TTTCGTTCAA CACGCGGGAC ACGTCGGTAA TCATCGGCGT AATGCGCGGC

701 GCGACTTTTT CGATAACCGC CATCACGTCT TCCGCTTTCA CCGACTCGGC

751 ATTGTGCAGA TGTTGCAGTT GGACGTTGTA ATAAGCAAAG ACGGCATCCA

801 GTTTTTCACG CAGTTTTTCA GGATGCAGCA AATCGGCGGC GCGAATGGCG

851 CGGCGTGCCA CTTTGTCTTC GTAGGCAGGG CCGATGCCGC GGCCGGTCGT

901 GCCGATTTTG CCTTTGCCGC GCGATGCTTC TCGGGCTTGG TCGAGCGCGA

951 TGTGATAAGG CAGGATCAGC GGGCAGGTCG GCGCGATTTT CAGACGGCCT

1001 TCGACGTTTT TCACGCCTGC CGCGTTCAAC TCGTCGATTT CGCCCAACAG

1051 GGCTTCGGGG GAGACGACAA CGCCCGAACC GATGAAGCAG TCCAGACTTT

1101 CATGCAGGAT GCCGCTCGGA ATCAGGCGCA AAATGGTTTT TTTGCCGCCG

1151 ACAACCAAGG TATGACCCGC ATTGTGGCCG CCTTGGAAGC GCACCACGCC

1201 TCCGGCTTCT TCCGCCAGCC AGTCAACGAT TTTACCTTTA CCCTCGTCGC

1251 CCCACTGTGC GCCGATTACT ACAACATTTT TAGCCATAGC CATATAACCT

1301 .TCGATATTA A
```

This corresponds to the amino acid sequence <SEQ ID 2726; ORF 904.a>:

```
a904.pep
    1 MMQHNRFFAV GAGGDDGDRR TADFFNPFQI CFGIGR*CVV AFHAESGFAP

51 TGHGFVNRLA GFYRIRAARQ DVGFAAVGQF VADADIDGFN AVHYIEFGNT

101 HTGNAVDLDG AFQGGGIKPA AAACASGYRT EFVSAFCQTC SDFVEQFGRE

151 RARTDARGIG FDDAQNIIQH LRAYARACRS RAGEAVGRSN EGVSAVVDVQ
```

```
-continued
201 QRTLRAFKQQ FFAVFVFFVQ HAGHVGNHRR NARRDFFDNR HHVFRFHRLG

251 IVQMLQLDVV ISKDGIQFFT QFFRMQQIGG ANGAACHFVF VGRADAAAGR

301 ADFAFAARCF SGLVERDVIR QDQRAGRRDF QTAFDVFHAC RVQLVDFAQQ

351 GFGGDDNART DEAVQTFMQD AARNQAQNGF FAADNQGMTR IVAALEAHHA

401 SGFFRQPVND FTFTLVAPLC ADYYNIFSHS HITXRY*
``` m904/a904 91.3% identity in 436 aa overlap

```
                    10         20         30         40         50         60
   m904.pep MMQHNRFFSVGAGGDDGDRRAADFFNPFQICFGVFGQCAVVLHAESGFAPAGHGFVNRLA
            ||||||||:||||||||||||:||||||||||||:   |:|::|||||||:|||||||||
        a904 MMQHNRFFAVGAGGDDGDRRTADFFNPFQICFGIGRXCVVAFHAESGFAPTGHGFVNRLA
                    10         20         30         40         50         60
                    70         80         90        100        110        120
   m904.pep GFHRIGTARQDVGFAAVGQFIADADIDGFNAVHYIEFSNTHTGNAVDLDGAFQGGGIKPA
            ||:||  :||||||||||||||:||||||||||||||||:||||||||||||||||||||
        a904 GFYRIRAARQDVGFAAVGQFVADADIDGFNAVHYIEFGNTHTGNAVDLDGAFQGGGIKPA
                    70         80         90        100        110        120
                   130        140        150        160        170        180
   m904.pep AAACASGYRTEFVSAFCQTYAYFVEQFGRERARTDARGIGFDDAQNIIQHLRTYARACRS
            ||||||||||||||||||||  :  ||||||||||||||||||||||||||||:||||||
        a904 AAACASGYRTEFVSAFCQTCSDFVEQFGRERARTDARGIGFDDAQNIIQHLRAYARACRS
                   130        140        150        160        170        180
                   190        200        210        220        230        240
   m904.pep CARQTVGRGNEGISAVVDVQQRTLRAFKQQFFAVFVFLVQHAGHVGNHRRNARRDFFDNR
            |  ::|||:|||:||||||||||||||||||||||||:||||||||||||||||||||||
        a904 RAGEAVGRSNEGVSAVVDVQQRTLRAFKQQFFAVFVFFVQHAGHVGNHRRNARRDFFDNR
                   190        200        210        220        230        240
                   250        260        270        280        290        300
   m904.pep HHVFRFNRLGIVQMLQLDIVIGKDGIQFFTQFXRMQQIGGANGAACHFVFVGRADAAAGR
            ||||||:|||||||||||:||:|||||||||| ||||||||||||||||||||||||||
        a904 HHVFRFHRLGIVQMLQLDVVISKDGIQFFTQFFRMQQIGGANGAACHFVFVGRADAAAGR
                   250        260        270        280        290        300
                   310        320        330        340        350        360
   m904.pep ADFAFAAXIFAGLVERDVVRQDQRAGRRDFQTAFDVFHACRVQLVDFAQQGFGGDDNART
            ||||||   |:||||||||:|||||||||||||||||||||||||||||||||||||||
        a904 ADFAFAARCFSGLVERDVIRQDQRAGRRDFQTAFDVFHACRVQLVDFAQQGFGGDDNART
                   310        320        330        340        350        360
                   370        380        390        400        410        420
   m904.pep DEAVQTFMQDAARNQAQNGFFAADNQGMARIVAALEAHHAAGFFRQPVNDFTFTLVAPLC
            ||||||||||||||||||||||||||||:|||||||||| :|||||||||||||||||||
        a904 DEAVQTFMQDAARNQAQNGFFAADNQGMTRIVAALEAHHASGFFRQPVNDFTFTLVAPLC
                   370        380        390        400        410        420
                   430
   m904.pep ADXYNIFSHSHITYRYX
            || |||||||||| |||
        a904 ADYYNIFSHSHITXRYX
                   430
   g906.seq not found yet
   g906.pep not found yet
```

The following partial DNA sequence was identified in *N. meningitidis* <SEQ ID 2727>:

```
m906.seq
   1 ATGAAATATA TCGTATCAAT CTCTCTGGCT ATGGGATTGG CTGCCTGTTC

51 GTTTGGGGGA TTTAAACCAA ATCCGTGGGA CGCCGCGTCA TTTTGGGAAT

101 TGAAAAATTA CGCCAATCCC TATCCGGGAT CAGCCTCGGC GGCACTTGAC

151 CAATATCCAT CGAAAGCAAG ACGAAGGCAA CTGAAAGACA TGCAAGAGTG

201 CGGCTATGAC CCAATAGACG GCGGAAAGTC TGAAGCAGAT GCCTGCCTGA

251 GGAAAAAAGG CTGGTGTCGT AAGGGTTTCG ACCCTTATCC CGAAAACAAA

301 AAATACGAAT GGCCTCGAGA AGAAGGAAAA ACAAAATGA
```

This corresponds to the amino acid sequence <SEQ ID 2728; ORF 906>:

```
m906.pep
   1 MKYIVSISLA MGLAACSFGG FKPNPWDAAS FWELKNYANP YPGSASAALD

51 QYPSKARRRQ LKDMQECGYD PIDGGKSEAD ACLRKKGWCR KGFDPYPENK

101 KYEWPREEGK TK*
```

The following partial DNA sequence was identified in *N. gonorrhoeae* <SEQ ID 2729>:

```
g907.seq (partial)
   1 ATGAAAAAAC CGACCGATAC CCTACCCGTC AATCTgcaAC GCCGCCGCCT

51 GCTGTGTGCC GCCGGCGCGC TGTTGATCAG CCCGCTGGCG CACGCCGGCG

101 CGCAACGTGA AGAAACGCtt gCCGACGATG TGGCTTCCGT GATGAGGAGT

151 TCTGTCGGCA GCGTCAATCC GCCGAGGCTG GTGTTCGACA ATCCGAAAGA

201 GGGCGAACGT TGGTTGTCCG CGATGTCGGC ACGTTTGGCA AGATTCGTCC

251 CCGACGAGGG GGAGCGGCGC AGGCTGCTGG TCAATATCCA ATACGAAAGC

301 AGCCGGGCCG GTTTGGATAC GCAGATTGTG TTGGGGCTGa ttgaagtgga 351 aagcgggtac cgagctcgaa tcatatca..
```

This corresponds to the amino acid sequence <SEQ ID 2730; ORF 907.ng>:

```
g907.pep (partial)
   1 MKKPTDTLPV NLQRRRLLCA AGALLISPLA HAGAQREETL ADDVASVMRS

51 SVGSVNPPRL VFDNPKEGER WLSAMSARLA RFVPDEGERR RLLVNIQYES

101 SRAGLDTQIV LGLIEVESGY RARIIS...
```

The following partial DNA sequence was identified in *N. meningitidis* <SEQ ID 2731>:

```
m907.seq
   1 ATGAGAAAAC CGACCGATAC CCTACCCGTT AATCTGCAAC GCCGCCGCCT

51 GTTGTGTGCC GCCGGTGCGT TGTTGCTCAG TCCTCTGGCG CACGCCGGCG

101 CGCAACGTGA GGAAACGCTT GCCGACGATG TGGCTTCCGT GATGAGGAGT

151 TCTGTCGGCA GCGTCAATCC GCCGAGGCTG GTGTTTGACA ATCCGAAAGA

201 GGGCGAGCGT TGGTTGTCTG CCATGTCGGC ACGTTTGGCA AGGTTCGTCC

251 CCGAGGAGGA GGAGCGGCGC AGGCTGCTGG TCAATATCCA GTACGAAAGC

301 AGCCGGGCCG GTTTGGATAC GCAGATTGTG TTGGGGCTGA TTGAGGTGGA

351 AAGCGCGTTC CGCCAGTATG CAATCAGCGG TGTCGGCGCG CGCGGCCTGA

401 TGCAGGTTAT GCCGTTkTGG AAAAACTACA TCGGCAAACC GGCGCACAAC

451 CTGTTCGACA TCCGCACCAA CCTGCGTTAC GGCTGTACCA TCCTGCGCCA

501 TTACCGGAAT CTTGAAAAAG CAACATCGT CCGCGCGCTT GCCCGCTTTA

551 ACGGCAGCTT GGGCAGCAAT AAATATCCGA ACGCCGTTTT GGgCGCGTGG

601 CGCAACCGCT GGCAGTGGCG TTGA
```

This corresponds to the amino acid sequence <SEQ ID 2732; ORF 907>:

```
m907.pep
   1 MRKPTDTLPV NLQRRRLLCA AGALLLSPLA HAGAQREETL ADDVASVMRS

51 SVGSVNPPRL VFDNPKEGER WLSAMSARLA RFVPEEEERR RLLVNIQYES

101 SRAGLDTQIV LGLIEVESAF RQYAISGVGA RGLMQVMPXW KNYIGKPAHN

151 LFDIRTNLRY GCTILRHYRN LEKGNIVRAL ARFNGSLGSN KYPNAVLGAW

201 RNRWQWR*
```

Computer analysis of this amino acid sequence gave the following results:
Homology with a Predicted ORF from *N. gonorrhoeae*
ORF 907 shows 92.9% identity over a 126 aa overlap with a predicted ORF (ORF 907.ng) from *N. gonorrhoeae*:

```
    g907/m907
                    10         20         30         40         50         60
    g907.pep  MKKPTDTLPVNLQRRRLLCAAGALLISPLAHAGAQREETLADDVASVMRSSVGSVNPPRL
              |:||||||||||||||||||||||||||||||:|||||||||||||||||||||||||||
    m907      MRKPTDTLPVNLQRRRLLCAAGALLLSPLAHAGAQREETLADDVASVMRSSVGSVNPPRL
                    10         20         30         40         50         60
                    70         80         90        100        110        120
    m907.pep  VFDNPKEGERWLSAMSARLARFVPDEGERRRLLVNIQYESSRAGLDTQIVLGLIEVESGY
              ||||||||||||||||||||||||||:| ||||||||||||||||||||||||||||::
    m907      VFDNPKEGERWLSAMSARLARFVPEEEERRRLLVNIQYESSRAGLDTQIVLGLIEVESAF
                    70         80         90        100        110        120
    907.pep   RARIIS
              |   ||
              RQYAISGVGARGLMQVMPXWKNYIGKPAHNLFDIRTNLRYGCTILRHYRNLEKGNIVRAL
                   130        140        150        160        170        180
```

The following partial DNA sequence was identified in *N. meningitidis* <SEQ ID 2733>:

```
a907.seq
   1 ATGAAAAAAC CGACCGATAC CCTACCCGTC AATCTGCAAC GCCGCCGCCT

51 ATTGTGTGCT GCCGGCGCGC TGTTGCTCAG CCCGCTGGCA CAAGCCGGCG

101 CGCAACGTGA AGAAACGCTT GCCGACGATG TGGCTTCCGT GATGAGGAGC

151 TCTGTCGGCA GCATAAATCC GCCGAGGCTG GTGTTCGACA ATCCGAAAGA

201 GGGCGAGCGT TGGCTGTCCG CGATGTCTGC TCGGTTGGCA AGGTTCGTCC

251 CCGATGAGGA GGAGCGGCGC AGGCTGCTGG TCAATATCCA GTACGAAAGC

301 AGCCGGGCCG GTTTGGATAC GCAGATTGTG TTGGGGCTGA TTGAGGTGGA

351 AAGCGCGTTC CGCCAGTATG CAATCAGCGG TGTCGGCGCG CGCGGCCTGA

401 TGCAGGTTAT GCCGTTTTGG AAAAACTACA TCGGCAAACC GGCGCACAAC

451 CTGTTCGACA TCCGCACCAA CCTGCGTTAC GGCTGTACCA TCCTGCGCCA

501 TTACCGGAAT CTTGAAAAAG CAACATCGT CCGCGCACTC GCCCGTTTTA

551 ACGGTAGCCT CGGCAGCAAT AAATATCCGA ACGCCGTTTT GGGCGCGTGG

601 CGCAACCGCT GGCAGTGGCG TTGA
```

This corresponds to the amino acid sequence <SEQ ID 2734; ORF 907.a>:

```
a907.pep
   1 MKKPTDTLPV NLQRRRLLCA AGALLLSPLA QAGAQREETL ADDVASVMRS

51 SVGSINPPRL VFDNPKEGER WLSAMSARLA RFVPDEEERR RLLVNIQYES
```

```
101 SRAGLDTQIV LGLIEVESAF RQYAISGVGA RGLMQVMPFW KNYIGKPAHN

151 LFDIRTNLRY GCTILRHYRN LEKGNIVRAL ARFNGSLGSN KYPNAVLGAW

201 RNRWQWR*
``` m907/a907 97.6% identity in 207 aa overlap

```
                   10         20         30         40         50         60
    m907.pep  MRKPTDTLPVNLQRRLLCAAGALLLSPLAHAGAQREETLADDVASVMRSSVGSVNPPRL
              |:||||||||||||||||||||||||||||||:||||||||||||||||||||||:||||
        a907  MKKPTDTLPVNLQRRLLCAAGALLLSPLAQAGAQREETLADDVASVMRSSVGSINPPRL
                   10         20         30         40         50         60

70         80         90        100        110        120
    m907.pep  VFDNPKEGERWLSAMSARLARFVPEEEERRRLLVNIQYESSRAGLDTQIVLGLIEVESAF
              ||||||||||||||||||||||||||:|||||||||||||||||||||||||||||||||
        a907  VFDNPKEGERWLSAMSARLARFVPDEEERRRLLVNIQYESSRAGLDTQIVLGLIEVESAF
                   70         80         90        100        110        120

130        140        150        160        170        180
    m907.pep  RQYAISGVGARGLMQVMPXWKNYIGKPAHNLFDIRTNLRYGCTILRHYRNLEKGNIVRAL
              ||||||||||||||||||| ||||||||||||||||||||||||||||||||||||||||
        a907  RQYAISGVGARGLMQVMPFWKNYIGKPAHNLFDIRTNLRYGCTILRHYRNLEKGNIVRAL
                  130        140        150        160        170        180

190        200
    m907.pep  ARFNGSLGSNKYPNAVLGAWRNRWQWRX
              ||||||||||||||||||||||||||||
        a907  ARFNGSLGSNKYPNAVLGAWRNRWQWRX
                  190        200
```

The following partial DNA sequence was identified in *N. gonorrhoeae* <SEQ ID 2735>:

```
g908.seq
   1 ATGAG.AAAA GCCGTCTAAG CCGGTATAAA CAAAATAAAC TCATTGGGCT

51 ATTTGTCGCA GGTGTAACTG CAAGAACAGC GGCAGAGTTG GTAGGCATTA

101 ATAAAAATAC CGCAGCCTAT GATTTTCATC GTTTACGATG ACTGATTTAT

151 CAAAACGGTC CGCATTTAGA ATGTTTGAT GGCGAAGTAG AAGCAGATGA

201 AAGTTATTTT GGCGGACAAC GCAAAGGCAA ACGCGGTCGC GGTGCTGCCG

251 GTAAAGTCGC CGTATTCGGT CTTTTGAAGC GAAATGGTAA GGTTTATACG

301 GTTACAGTAC CGAATACTCA AACCGCTACT TTATTTCCTA TTATCCGTGA 351 acaagtgaaa cctgacagta ttgtttatac ggattgttat CgTAGCTATG 401 ATGTATTAGA Tgtgagcgaa tttagccatT TTagcttcgc tgaaacttcg 451 ttttcgtaTC AATCACAGCA CACATTTTGC CGAACGACAA AACCATATTA

501 A
```

This corresponds to the amino acid sequence <SEQ ID 2736; ORF 908.ng>:

```
g908.pep
   1 MXKSRLSRYK QNKLIGLFVA GVTARTAAEL VGINKNTAAY DFHRLR*LIY

51 QNGPHLEMFD GEVEADESYF GGQRKGKRGR GAAGKVAVFG LLKRNGKVYT

101 VTVPNTQTAT LFPIIREQVK PDSIVYTDCY RSYDVLDVSE FSHFSFAETS

151 FSYQSQHTFC RTTKPY*
```

The following partial DNA sequence was identified in *N. meningitidis* <SEQ ID 2737>:

```
m908.seq
   1 ATGAGAAAAA GTCGTCTAAG CCAGTATAAA CAAAmTAAAC TCATTGAACT

51 GTTTGTCACA GGTGTAACTG CAAGAACGGC AGCAGAGTTA GTAGGCGTTA

101 ATAAAAATAC CGCAGCCTAT TATTTTCATC GTTTACGATT ACTTATTTAT

151 CAAAACAGTC CGCATTTGGA AATGTTTGAT GGCGAAGTAG AAGCAGATGA

201 AAGTTATTTT GGCGGACAAC GCAAAGGCAA ACGCGGTCGC GGTGCTGCCG

251 GTAAAGTCGC CGTATTCGGT CTTTTGAAGC GAAATGGTAA GGTTTATACG

301 GTTACAGTAC CGAATACTCA AACCGCTACT TTATTTCCTA TTATCCGTGA

351 ACAAGTGAAA CCTGACAGCA TTTTTTATAC GGATTGTTAT CGTAGCTATG

401 ATGTATTAGA TGTGCGCGAA TTTAGCCATT TTAGCTTCGC TGAAACTTCG

451 TTTTCGTATC AATCACAGCA CACATTTTGC CGAACGACAA AACCATATTA

501 A
```

This corresponds to the amino acid sequence <SEQ ID 2738; ORF 908>:

```
m908.pep
   1 MRKSRLSQYK QXKLIELFVT GVTARTAAEL VGVNKNTAAY YFHRLRLLIY

51 QNSPHLEMFD GEVEADESYF GGQRKGKRGR GAAGKVAVFG LLKRNGKVYT

101 VTVPNTQTAT LFPIIREQVK PDSIFYTDCY RSYDVLDVRE FSHFSFAETS

151 FSYQSQHTFC RTTKPY*
```

Computer analysis of this amino acid sequence gave the following results:

Homology with a Predicted ORF from *N. gonorrhoeae*

ORF 908 shows 93.4% identity over a 166 aa overlap with a predicted ORF (ORF 908.ng) from *N. gonorrhoeae*:

```
g908/m908

10        20        30        40        50        60
g908.pep   MXKSRLSRYKQNKLIGLFVAGVTARTAAELVGINKNTAAYDFHRLRXLIYQNGPHLEDFD
           | |||||:||| ||| |||:||||||||||||:||||||| ||||| |||||:|||||||
m908       MRKSRLSQYKQXKLIELFVTGVTARTAAELVGVNKNTAAYYFHRLRLLIYQNSPHLEMFD
                   10        20        30        40        50        60

70        80        90       100       110       120
g908.pep   GEVEADESYFGGQRKGKRGRGAAGKVAVFGLLKRNGKVYTVTVPNTQTATLFPIIREQVK
           ||||||||||||||||||||||||||||||||||||||||||||||||||||||||||||
m908       GEVEADESYFGGQRKGKRGRGAAGKVAVFGLLKRNGKVYTVTVPNTQTATLFPIIREQVK
                   70        80        90       100       110       120

130       140       150       160
g908.pep   PDSIVYTDCYRSYDVLDVSEFSHFSFAETSFSYQSQHTFCRTTKPYX
           |||| ||||||||||||| ||||||||||||||||||||||||||||
m908       PDSIFYTDCYRSYDVLDVREFSHFSFAETSFSYQSQHTFCRTTKPYX
                  130       140       150       160
```

The following partial DNA sequence was identified in *N. meningitidis* <SEQ ID 2739>:

```
a908.seq
   1 ATGAGAAAAA GTCGTCTAAG CCAGTATAAA CAAAATAAAC TCATTGAGCT

51 ATTTGTCGCA GGTGTAACTG CAAGAACGGC AGCAGAGTTA GTAGGCGTTA

101 ATAAAAATAC CGCAGCCTAT TATTTTCATC GTTTACGATT ACTTATTTAT
```

-continued
```
151 CAAAACAGTC CGCATTTGGA AATGTTTGAT GGCGAAGTAG AAGCAGATGA

201 AAGTTATTTT GGCGGACAAC GCAAAGGCAA ACGCGGTCGC GGTGCTGCCG

251 GTAAAGTCGC CGTATTCGGT CTTTTGAAGC GAAATGGTAA GGTTTATACG

301 GTTACAGTAC CGAATACTCA AACCGCTACT TTATTTCCTA TTATCCGTGA

351 ACAAGTGAAA CCTGACAGCA TTGTTTATAC GGATTGTTAT CGTAGCTATG

401 ATGTATTAGA TGTGCGCGAA TTTAGCCATT TTAGCTTCGC TGAAACTTCG

451 TTTTCGTATC AATCACAGCA CACATTTTGC CGAACGACAA AACCATATTA

501 A
```

This corresponds to the amino acid sequence <SEQ ID 2740; ORF 908.a>:

```
a908.pep
  1 MRKSRLSQYK QNKLIELFVA GVTARTAAEL VGVNKNTAAY YFHRLRLLIY

51 QNSPHLEMFD GEVEADESYF GGQRKGKRGR GAAGKVAVFG LLKRNGKVYT

101 VTVPNTQTAT LFPIIREQVK PDSIVYTDCY RSYDVLDVRE FSHFSFAETS

151 FSYQSQHTFC RTTKPY*
``` m908/a908 98.2% identity in 166 aa overlap

```
                 10         20         30         40         50         60
   m908.pep    MRKSRLSQYKQXKLIELFVTGVTARTAAELVGVNKNTAAYYFHRLRLLIYQNSPHLEMFD
               ||||||||||| ||||||||:|||||||||||||||||||||||||||||||||||||||
   a908        MRKSRLSQYKQNKLIELFVAGVTARTAAELVGVNKNTAAYYFHRLRLLIYQNSPHLEMFD
                 10         20         30         40         50         60

70         80         90        100        110        120
   m908.pep    GEVEADESYFGGQRKGKRGRGAAGKVAVFGLLKRNGKVYTVTVPNTQTATLFPIIREQVK
               |||||||||||||||||||||||||||||||||||||||| |||||||||||||||||||
   a908        GEVEADESYFGGQRKGKRGRGAAGKVAVFGLLKRNGKBYTVTVPNTQTATLFPIIREQVK
                 70         80         90        100        110        120

130        140        150        160
   m908.pep    PDSIFYTDCYRSYDVLDVREFSHFSFAETSFSYQSQHTFCRTTKPYX
               |||| ||||||||||||||||||||||||||||||||||||||||||
   a908        PDSIVYTDCYRSYDVLDVREFSHFSFAETSFSYQSQHTFCRTTKPYX
                130        140        150        160
```

The following partial DNA sequence was identified in *N. gonorrhoeae* <SEQ ID 2741>:

```
g909.seq (partial)
  1 atgcgtaaaa ccgtacttat cCTgaccatc tccgccgccc ttttgtcggg 51 ctgcacatgG gaaacttatc aagacggcag cggcaaaacc gccgtccgtg 101 caaaatgttc caccggcacg ccgctgtgtt ggcaagacgg cgcgggctcg 151 aaaaaggtgg actgcgacga gtacggtggc gaacgccggg ccgtgttgcg 201 caaccaaaag cggggggaagc ccgcgacgag gagagccgca acgctgggga 251 aaccgagttt ccgggcgagg acggggggg ggcgggtgaa cagggcagaa 301 acggggagg ggaagcgatc ggcgagg..
```

This corresponds to the amino acid sequence <SEQ ID 2742; ORF 909.ng>:

```
g909.pep (partial)
  1 MRKTVLILTI SAALLSGCTW ETYQDGSGKT AVRAKCSTGT PLCWQDGRGS

51 KKVDCDEYGG ERRAVLRNQK RGKPATRRAA TLGKPSFRAR DGGGRVNRAE

101 TGEGKRSAR..
```

The following partial DNA sequence was identified in *N. meningitidis* <SEQ ID 2743>:

```
m909.seq
    1 ATGCGTAAAA CCTTCCTCTT CCTGACCGCT GCCGCCGCCC TTTTGTCGGG

51 CTGCGCGTGG GAAACTTATC AAGACGGCAA CGGCAAGACC GCCGTCCGTC

101 AAAAATATCC CGCCGGCACG CCCGTTTATT ACCAAGACGG CAGCTACTCG

151 AAAAATATGA ACTACAACCA ATACCGTCCC GAACGCCATG CCGTGTTACC

201 CAATCAAACC GGCAACAACG CCGACGAAGA GCATCGCCAA CACTGGCAAA

251 AACCAAAGTT TCAAAACCGA TAA
```

This corresponds to the amino acid sequence <SEQ ID 2744; ORF 909>:

```
m909.pep
    1 MRKTFLFLTA AAALLSGCAW ETYQDGNGKT AVRQKYPAGT PVYYQDGSYS

51 KNMNYNQYRP ERHAVLPNQT GNNADEEHRQ HWQKPKFQNR *
```

Computer analysis of this amino acid sequence gave the following results:
Homology with a Predicted ORF from *N. gonorrhoeae*
ORF 909 shows 53.3% identity over a 90 aa overlap with a predicted ORF (ORF 909.ng) from *N. gonorrhoeae*:

```
m909/g909

10         20         30         40         50         60
   m909.pep    MRKTFLFLTAAAALLSGCAWETYQDGNGKTAVRQKYPAGTPVYYQDGSYSKNMNYNQYRP
               ||||  |:|| :||||||||:||||||||:||||||  |   :|||:  :|||  ||:::  ::|
   g909        MRKTVLILTISAALLSGCTWETYQDGSGKTAVRAKCSTGTPLCWQDGRGSKKVDCDEYGG
                       10         20         30         40         50         60
                       70         80         90
   m909.pep    ERHAVLPNQTGNNADEEHRQHWQKPKFQNRX
               ||:|||  ||   ::     ::       ||:|:  |
   g909        ERRAVLRNQKRGKPATRRAATLGKPSFRARDGGGRVNRAETGEGKRSAR
                       70         80         90        100
```

The following partial DNA sequence was identified in *N. meningitidis* <SEQ ID 2745>:

```
a909.seq
    1 ATGCGTAAAA CCTTCCTTAT CCTGATGACT GCCGCCGCCC TTTTGTCGGG

51 CTGCGCGTGG GAAACTTATC AAGACGGCAA CGGCAAGACC GCCGTCCGTC

101 AAAAATATCC CGCCGGCACG CCCGTTTATT ACCAAGACGG CAGCTACTCG

151 AAAAATATGA ACTACAACCA ATACCGTCCC GAACGCCATG CCGTGTTACC

201 CAACCAAACC GGCAACAACG CCGACGAAGA GCATCGCCAA CACTGGCAAA

251 AGCCCAAATT TCAAAACCGA TAA
```

This corresponds to the amino acid sequence <SEQ ID 2746; ORF 909.a>:

```
a909.pep
    1 MRKTFLILMT AAALLSGCAW ETYQDGNGKT AVRQKYPAGT PVYYQDGSYS

51 KNMNYNQYRP ERHAVLPNQT GNNADEEHRQ HWQKPKFQNR *
``` m909/a909 96.7% identity in 90 aa overlap

```
                  10        20        30        40        50        60
    m909.pep  MRKTFLFLTAAAALLSGCAWETYQDGNGKTAVRQKYPAGTPVYYQDGSYSKNMNYNQYRP
              ||||||:| :||||||||||||||||||||||||||||||||||||||||||||||||||
    a909      MRKTFLILMTAAALLSGCAWETYQDGNGKTAVRQKYPAGTPVYYQDGSYSKNMNYNQYRP
                  10        20        30        40        50        60

70        80        90
    m909.pep  ERHAVLPNQTGNNADEEHRQHWQKPKFQNRX
              ||||||||||||||||||||||||||||||
    a909      ERHAVLPNQTGNNADEEHRQHWQKPKFQNRX
                  70        80        90
```

The following partial DNA sequence was identified in *N. gonorrhoeae* <SEQ ID 2747>:

```
g910.seq
    1 ATGAAAAAAC TGTTATTGGC CGCCGTTGTT TCCCTAAATG CCGCAACCGC

51 ATTTGCCGGC GACTCTGCCG AGCGTCAGAT TTACGGCGAT CCCCATTTTG

101 AACAAAACCG CACAAAAGCC GTGAAAATGT TGGAACAGCG CGGTTATCAG

151 GTTTACGATG TCGATGCCGA CGACTACTGG GGCAAACCTG TTTTGGAAGT

201 GGAAGCCTAT AAAGACGGCC GCGAATACGA CATCGTGTTG TCTTACCCCG

251 ACCTGAAAAT CATCAAAGAG CAGCTCGATC GCTGA
```

This corresponds to the amino acid sequence <SEQ ID 2748; ORF 910.ng>:

```
g910.pep
    1 MKKLLLAAVV SLNAATAFAG DSAERQIYGD PHFEQNRTKA VKMLEQRGYQ

51 VYDVDADDYW GKPVLEVEAY KDGREYDIVL SYPDLKIIKE QLDR*
```

The following partial DNA sequence was identified in *N. meningitidis* <SEQ ID 2749>:

```
m910.seq
    1 ATGAAAAAAC TGTTATTGGC TGCCGTTGTT TCTCTGAGTG CCGCTGCCGC

51 ATTTGCCGGC GACTCTGCCG AGCGTCAGAT TTACGGCGAT CCCCATTTTG

101 AACAAAACCG CACAAAAGCT GTGAAAATGT TGGAGCAGCG CGGTTATCAG

151 GTTTACGATG TCGATGCCGA CGACCATTGG GGTAAGCCTG TGCTGGAAGT

201 GGAAGCCTAT AAAGACGGCC GCGAATACGA CATCGTGTTG TCTTACCCCG

251 ACCTGAAAAT CATCAAAGAG CAGCTCGATC GCTGA
```

This corresponds to the amino acid sequence <SEQ ID 2750; ORF 910>:

```
m910.pep
    1 MKKLLLAAVV SLSAAAAFAG DSAERQIYGD PHFEQNRTKA VKMLEQRGYQ

51 VYDVDADDHW GKPVLEVEAY KDGREYDIVL SYPDLKIIKE
      QLDR*
```

Computer analysis of this amino acid sequence gave the following results:

Homology with a Predicted ORF from *N. gonorrhoeae*

ORF 910 shows 96.8% identity over a 94 aa overlap with a predicted ORF (ORF 910.ng) from *N. gonorrhoeae*:

```
g910/m910

10         20         30         40         50         60
   g910.pep MKKLLLAAVVSLNAATAFAGDSAERQIYGDPHFEQNRTKAVKMLEQRGYQVYDVDADDYM
            ||||||||||||:||:||||||||||||||||||||||||||||||||||||||||||:|
   m910     MKKLLLAAVVSLSAAAAFAGDSAERQIYGDPHFEQNRTKAVKMLEQRGYQVYDVDADDHW
                    10         20         30         40         50         60
                    70         80         90
   g910.pep GKPVLEVEAYKDGREYDIVLSYPDLKIIKEQLDRX
            |||||||||||||||||||||||||||||||||||
   m910     GKPVLEVEAYKDGREYDIVLSYPDLKIIKEQLDRX
                    70         80         90
```

The following partial DNA sequence was identified in *N. meningitidis* <SEQ ID 2751>:

```
a910.seq
   1 ATGAAAAAAC TGTTATTGGT CGCCGTTGTT TCCTTGAGTG CCGCAACCGC

51 ATTTGCCGGC GACTCTGCCG AGCGTCAGAT TTACGGCGAT CCCTATTTTG

101 AACAAAACCG CACAAAAGCC GTGAAAATGT TGGAACAGCG CGGTTATCAG

151 GTTCACGATG TCGATGCCGA CGACCATTGG GGCAAACCTG TTTTGGAAGT

201 GGAAGCCTAT AAAGACGGCC GCGAATACGA CATTGTGTTG TCTTACCCCG

251 ACCTGAAAAT CATCAAAGAG CAGCTCGATC GCTGA
```

This corresponds to the amino acid sequence <SEQ ID 2752; ORF 910.a>:

```
a910.pep
   1 MKKLLLVAVV SLSAATAFAG DSAERQIYGD PYFEQNRTKA VKMLEQRGYQ

51 VHDVDADDHW GKPVLEVEAY KDGREYDIVL SYPDLKIIKE QLDR*
``` m910/a910 95.7% identity in 94 aa overlap

```
                  10         20         30         40         50         60
   m910.pep MKKLLLAAVVSLSAAAAFAGDSAERQIYGDPHFEQNRTKAVKMLEQRGYQVYDVDADDHW
            ||||||:||||||:||||||||||||||||:|||||||||||||||||||:||||||||
   a910     MKKLLLVAVVSLSAATAFAGDSAERQIYGDPYFEQNRTKAVKMLEQRGYQVHDVDADDHW
                  10         20         30         40         50         60
                  70         80         90
   m910.pep GKPVLEVEAYKDGREYDIVLSYPDLKIIKEQLDRX
            |||||||||||||||||||||||||||||||||||
   a910     GKPVLEVEAYKDGREYDIVLSYPDLKIIKEQLDR
                  70         80         90
```

The following partial DNA sequence was identified in *N. gonorrhoeae* <SEQ ID 2753>:

```
g911.seq
   1 ATGAAAAAGA ACATATTGGA ATTTTGGGTC GGACTGTTCG TCTTGATCGG

51 CGCGGCGGCG GTTGCCTTTC TCGCTTTCCG CGTGGCGGGC GGCGCGGCGT

101 TCGGCGGTTC GGACAAAACT TACGCCGTTT ATGCCGATTT CGGCGACATC

151 GGCGGTTTGA AGGTCAATGC CCCCGTCAAA TCCGCAGGCG TATTGGTCGG

201 GCGCGTCGGC GCTATCGGGC TTGACCCGAA ATCCTATCAG GCGAGGGTGC
```

```
251 GCCTTGATTT GGACGGCAAG TATCAGTTCA GCAGTGACGT TTCCGCGCAA

301 ATCCTGACTT CGGGACTTTT GGGCGAACAG TACATCGGGC TGCAGCAGGG

351 CGGCGATACG GAAAACCTTG CTGCCGGCGA CACCATCTCC GTAACCAGTT

401 CTGCAATGGT TCTGGAAAAC CTGATCGGTA AATTCATGAC CAGCTTCGCC

451 GAGAAAAACG CTGAGGGCGG CAATGCGGAA AAAGCCGcag aAtaa
```

This corresponds to the amino acid sequence <SEQ ID 2754; ORF 911.ng>:

```
g911.pep
  1 MKKNILEFWV GLFVLIGAAA VAFLAFRVAG GAAFGGSDKT YAVYADFGDI

51 GGLKVNAPVK SAGVLVGRVG AIGLDPKSYQ ARVRLDLDGK YQFSSDVSAQ

101 ILTSGLLGEQ YIGLQQGGDT ENLAAGDTIS VTSSAMVLEN LIGKFMTSFA

151 EKNAEGGNAE KAAE*
```

The following partial DNA sequence was identified in *N. meningitidis* <SEQ ID 2755>:

```
m911.seq
  1 ATGAAGAAGA ACATATTGGA ATTTTGGGTC GGACTGTTCG TCCTGATTGG

51 CGCGGCGGCG GTTGCCTTTC TCGCTTTCCG CGTGGCCGGC GGTGCGGCGT

101 TCGGCGGTTC GGACAAAACT TACGCCGTTT ATGCCGATTT CGGCGACATC

151 GGCGGTTTGA AGGTCAATGC CCCCGTCAAA TCCGCAGGCG TATTGGTCGG

201 GCGCGTCGGC GCTATCGGAC TTGACCCGAA ATCCTATCAG GCGAGGGTGC

251 GCCTCGATTT GGACGGCAAG TATCAGTTCA GCAGCGACGT TTCCGCGCAA

301 ATCCTGACTT CGGGACTTTT GGGCGAGCAG TACATCGGGC TGCAGCAGGG

351 CGGCGACACG GAAAACCTTG CTGCCGGCGA CACCATCTCC GTAACCAGTT

401 CTGCAATGGT TCTGGAAAAC CTTATCGGCA AATTCATGAC GAGTTTTGCC

451 GAGAAAAATG CCGACGGCGG CAATGCGGAA AAAGCCGCCG AATAA
```

This corresponds to the amino acid sequence <SEQ ID 2756; ORF 911>:

```
m911.pep
  1 MKKNILEFWV GLFVLIGAAA VAFLAFRVAG GAAFGGSDKT YAVYADFGDI

51 GGLKVNAPVK SAGVLVGRVG AIGLDPKSYQ ARVRLDLDGK YQFSSDVSAQ

101 ILTSGLLGEQ YIGLQQGGDT ENLAAGDTIS VTSSAMVLEN LIGKFMTSFA

151 EKNADGGNAE KAAE*
```

Computer analysis of this amino acid sequence gave the following results:
Homology with a Predicted ORF from *N. gonorrhoeae*
ORF 911 shows 99.4% identity over a 164 aa overlap with a predicted ORF (ORF 911.ng) from *N. gonorrhoeae*:

```
g911/m911

10         20         30         40         50         60
      g911.pep   MKKNILEFWVGLFVLIGAAAVAFLAFRVAGGAAFGGSDKTYAVYADFGDIGGLKVNAPVK
                 ||||||||||||||||||||||||||||||||||||||||||||||||||||||||||||
      m911       MKKNILEFWVGLFVLIGAAAVAFLAFRVAGGAAFGGSDKTYAVYADFGDIGGLKVNAPVK
                       10         20         30         40         50         60
```

-continued

```
               70         80         90        100        110        120
g911.pep   SAGVLVGRVGAIGLDPKSYQARVRLDLDGKYQFSSDVSAQILTSGLLGEQYIGLQQGGDT
           ||||||||||||||||||||||||||||||||||||||||||||||||||||||||||||
m911       SAGVLVGRVGAIGLDPKSYQARVRLDLDGKYQFSSDVSAQILTSGLLGEQYIGLQQGGDT
               70         80         90        100        110        120

130        140        150        160
g911.pep   ENLAAGDTISVTSSAMVLENLIGKFMTSFAEKNAEGGNAEKAAEX
           ||||||||||||||||||||||||||||||||||:||||||||||
m911       ENLAAGDTISVTSSAMVLENLIGKFMTSFAEKNADGGNAEKAAEX
              130        140        150        160
```

The following partial DNA sequence was identified in *N. meningitidis* <SEQ ID 2757>:

```
a911.seq
  1 ATGAAAAAGA ACATATTGGA ATTTTGGGTC GGACTGTTCG TCCTGATTGG

51 CGCGGCGGCG GTTGCCTTTC TCGCTTTCCG CGTGGCCGGC GGTGCGGCGT

101 TCGGCGGTTC GGACAAAACT TACGCCGTTT ATGCCGATTT CGGCGACATC

151 GGCGGTTTGA AGGTCAATGC CCCCGTCAAA TCCGCAGGCG TATTGGTCGG

201 GCGCGTCGGC GCTATCGGAC TTGACCCGAA ATCCTATCAG GCGAGGGTGC

251 GCCTCGATTT GGACGGCAAG TATCAGTTCA GCAGCGACGT TTCCGCGCAA

301 ATCCTGACTT CGGGACTTTT GGGCGAGCAG TACATCGGGC TGCAGCAGGG

351 CGGCGACACG GAAAACCTTG CTGCCGGCGA CACCATCTCC GTAACCAGTT

401 CTGCAATGGT TCTGGAAAAC CTTATCGGCA AATTCATGAC GAGTTTTGCC

451 GAGAAAAATG CCGACGGCGG CAATGCGGAA AAAGCCGCCG AATAA
```

This corresponds to the amino acid sequence <SEQ ID 2758; ORF 911.a>:

```
a911.pep
  1 MKKNILEFWV GLFVLIGAAA VAFLAFRVAG GAAFGGSDKT YAVYADFGDI

51 GGLKVNAPVK SAGVLVGRVG AIGLDPKSYQ ARVRLDLDGK YQFSSDVSAQ

101 ILTSGLLGEQ YIGLQQGGDT ENLAAGDTIS VTSSAMVLEN LIGKFMTSFA

151 EKNADGGNAE KAAE*
``` m911/a911 100.0% identity in 164 aa overlap

```
               10         20         30         40         50         60
m911.pep   MKKNILEFWVGLFVLIGAAAVAFLAFRVAGGAAFGGSDKTYAVYADFGDIGGLKVNAPVK
           ||||||||||||||||||||||||||||||||||||||||||||||||||||||||||||
a911       MKKNILEFWVGLFVLIGAAAVAFLAFRVAGGAAFGGSDKTYAVYADFGDIGGLKVNAPVK
               10         20         30         40         50         60

70         80         90        100        110        120
m911.pep   SAGVLVGRVGAIGLDPKSYQARVRLDLDGKYQFSSDVSAQILTSGLLGEQYIGLQQGGDT
           ||||||||||||||||||||||||||||||||||||||||||||||||||||||||||||
a911       SAGVLVGRVGAIGLDPKSYQARVRLDLDGKYQFSSDVSAQILTSGLLGEQYIGLQQGGDT
               70         80         90        100        110        120

130        140        150        160
m911.pep   ENLAAGDTISVTSSAMVLENLIGKFMTSFAEKNADGGNAEKAAEX
           |||||||||||||||||||||||||||||||||||||||||||||
a911       ENLAAGDTISVTSSAMVLENLIGKFMTSFAEKNADGGNAEKAAEX
              130        140        150        160
```

The following partial DNA sequence was identified in *N. gonorrhoeae* <SEQ ID 2759>:

```
g912.seq
   1 gtgAAAAaat cctcctTcat cagcGCATTG GGCATCGgtA TTTTGAGCAT

51 CGGCATGGCA TTTGCCTCCC CGGCCGACGC AGTGGGACAA ATCCGCCAAA

101 ACGCCACACA GGTTTTGACC ATCCTCAAAA GCGGCGACGC GGCTTCTGCA

151 CGCCCAAAAG CCGAAGCCTA TGCGGTTCCC TATTTCGATT TCCAACGTAT

201 GACCGCATTG GCGGTCGGCA ACCCTTGGCG TACCGCGTCC GACGCGCAAA

251 AACAAGCGTT GGCCAAAGAA TTTCAAACCC TGCTGATCCG CACCTATTCC

301 GGCACGATGC TGAAATTCAA AAACGCGACC GTCAACGTCA AGACAATCC

351 CATCGTCAAT AAGGGCGGCA AGGAAATCGT CGTCCGTGCC GAAGTCGGCA

401 TCCCCGGTCA GAAGCCCGTC AATATGGACT TTACCACCTA CCAAAGCGGC

451 GGCAAATACC GTACCTACAA CGTCGCCATC GAAGGCACGA GCCTGGTTAC

501 CGTGTACCGC AACCAATTCG GCGAAATCAT CAAAGCCAAA GGCATCGACG

551 GGCTGATTGC CGAGTTGAAA GCCAAAAACG GCGGCAAATA A
```

This corresponds to the amino acid sequence <SEQ ID 2760; ORF 912.ng>:

```
g912.pep
   1 VKKSSFISAL GIGILSIGMA FASPADAVGQ IRQNATQVLT ILKSGDAASA

51 RPKAEAYAVP YFDFQRMTAL AVGNPWRTAS DAQKQALAKE FQTLLIRTYS

101 GTMLKFKNAT VNVKDNPIVN KGGKEIVVRA EVGIPGQKPV NMDFTTYQSG

151 GKYRTYNVAI EGTSLVTVYR NQFGEIIKAK GIDGLIAELK AKNGGK*
```

The following partial DNA sequence was identified in *N. meningitidis* <SEQ ID 2761>:

```
m912.seq
   1 ATGAAAAAAT CCTCCCTCAT CAGCGCATTG GGCATCGGTA TTTTGAGCAT

51 CGGCATGGCA TTTGCCGCCC CTGCCGACGC GGTAAGCCAA ATCCGTCAAA

101 ACGCCACTCA AGTATTGAGC ATCTTAAAAA ACGGCGATGC CAACACCGCT

151 CGCCAAAAAG CCGAAGCCTA TGCGATTCCC TATTTCGATT TCCAACGTAT

201 GACCGCATTG GCGGTCGGCA ACCCTTGGCG CACCGCGTCC GACGCGCAAA

251 AACAAGCGTT GGCCAAAGAA TTTCAAACCC TGCTGATCCG CACCTATTCC

301 GGCACGATGC TGAAATTAAA AAACGCCAAC GTCAACGTCA AGACAATCC

351 CATCGTCAAT AAAGGCGGCA AGAAATCAT CGTCCGCGCC GAAGTCGGCG

401 TACCCGGGCA AAAACCCGTC AACATGGACT TCACCACCTA CCAAAGCGGC

451 GGTAAATACC GTACCTACAA CGTCGCCATC GAAGGCGCGA GCCTGGTTAC

501 CGTGTACCGC AACCAATTCG GCGAAATTAT CAAAGCGAAA GGCGTGGACG

551 GACTGATTGC CGAGTTGAAA GCCAAAAACG GCGGCAAATA A
```

This corresponds to the amino acid sequence <SEQ ID 2762; ORF 912>:

```
m912.pep
   1 MKKSSLISAL GIGILSIGMA FAAPADAVSQ IRQNATQVLS ILKNGDANTA

51 RQKAEAYAIP YFDFQRMTAL AVGNPWRTAS DAQKQALAKE FQTLLIRTYS
```

```
101 GTMLKLKNAN VNVKDNPIVN KGGKEIIVRA EVGVPGQKPV NMDFTTYQSG

151 GKYRTYNVAI EGASLVTVYR NQFGEIIKAK GVDGLIAELK AKNGGK*
```

Computer analysis of this amino acid sequence gave the following results:
Homology with a Predicted ORF from N. gonorrhoeae
ORF 912 shows 91.8% identity over a 196 aa overlap with a predicted ORF (ORF 912.ng) from N. gonorrhoeae:

```
    g912/m912

10         20         30         40         50         60
        g912.pep   VKKSSFISALGIGILSIGMAFASPADAVGQIRQNATQVLTIKLSGDAASARPKAEAYAVP
                   :||||:||||||||||||||||:|||| :||||||||||:||| :||  :|| ||||| :|
        m912       MKKSSLISALGIGILSIGMAFAAPADAVSQIRQNATQVLSILKNGDANTARQKAEAYAIP
                      10         20         30         40         50         60

70         80         90        100        110        120
        g912.pep   YFDFQRMTALAVGNPWRTASDAQKQALAKEFQTLLIRTYSGTMLKFKNATVNVKDNPIVN
                   ||||||||||||||||||||||||||||||||||||||||||||:|||:|||||||||||
        m912       YFDFQRMTALAVGNPWRTASDAQKQALAKEFQTLLIRTYSGTMLKLKNANVNVKDNPIVN
                      70         80         90        100        110        120

130        140        150        160        170        180
        g912.pep   KGGKEIVVRAEVGIPGQKPVNMDFTTYQSGGKYRTYNVAIEGTSLVTVYRNQFGEIIKAK
                   ||||||:|||||:|||||||||||||||||||||||||||||:||||||||||||||||
        m912       KGGKEIIVRAEVGVPGQKPVNMDFTTYQSGGKYRTYNVAIEGASLVTVYRNQFGEIIKAK
                     130        140        150        160        170        180

190
        g912.pep   GIDGLIAELKAKNGGKX
                   |:|||||||||||||||
        m912       GVDGLIAELKAKNGGKX
                     190
```

The following partial DNA sequence was identified in N. meningitidis <SEQ ID 2763>:

```
a912.seq
   1 ATGAAAAAAT CCTCCTTCAT CAGCGCATTG GGCATCGGTA TTTTGAGCAT

51 CGGCATGGCA TTTGCCGCCC CTGCCGACGC GGTAAACCAA ATCCGTCAAA

101 ACGCCACTCA AGTATTGAGC ATCTTAAAAA GCGGTGATGC CAACACCGCC

151 CGCCAAAAAG CCGAAGCCTA TGCGATTCCC TATTTCGATT TCCAACGTAT

201 GACCGCATTG GCGGTCGGCA ACCCTTGGCG CACCGCGTCC GACGCGCAAA

251 AACAAGCGTT GGCCAAAGAA TTTCAAACCC TGCTGATCCG CACCTATTCC

301 GGCACGATGC TGAAATTAAA AAACGCCAAC GTCAACGTCA AAGACAATCC

351 CATCGTCAAT AAAGGCGGCA AAGAAATCAT CGTCCGCGCC GAAGTCGGCG

401 TACCCGGGCA AAAACCCGTC AACATGGACT TCACCACCTA CCAAAGCGGC

451 GGTAAATACC GTACCTACAA CGTCGCCATC GAAGGCGCGA GCCTGGTTAC

501 CGTGTACCGC AACCAATTCG GCGAAATTAT CAAAGCGAAA GGCGTGGACG

551 GACTGATTGC CGAGTTGAAG GCTAAAAACG GCAGCAAGTA A
```

This corresponds to the amino acid sequence <SEQ ID 2764; ORF 912.a>:

```
a912.pep
   1 MKKSSFISAL GIGILSIGMA FAAPADAVNQ IRQNATQVLS ILKSGDANTA

51 RQKAEAYAIP YFDFQRMTAL AVGNPWRTAS DAQKQALAKE FQTLLIRTYS

101 GTMLKLKNAN VNVKDNPIVN KGGKEIIVRA EVGVPGQKPV NMDFTTYQSG

151 GKYRTYNVAI EGASLVTVYR NQFGEIIKAK GVDGLIAELK AKNGSK*
``` m912/a912 98.0% identity in 196 aa overlap

```
                10         20         30         40         50         60
m912.pep  MKKSSLISALGIGILSIGMAFAAPADAVSQIRQNATQVLSILKNGTANTARQKAEAYAIP
          |||||:||||||||||||||||||||||||:||||||||||||||:||||||||||||||
a912      MKKSSFISALGIGILSIGMAFAAPADAVNQIRQNATQVLSILKSGDANTARQKAEAYAIP
                10         20         30         40         50         60

70         80         90        100        110        120
m912.pep  YFDFQRMTALAVGNPWRTASDAQKQALAKEFQTLLIRTYSGTMLKLKNANVNVKDNPIVN
          ||||||||||||||||||||||||||||||||||||||||||||||||||||||||||||
a912      YFDFQRMTALAVGNPWRTASDAQKQALAKEFQTLLIRTYSGTMLKLKNANVNVKDNPIVN
                70         80         90        100        110        120

130        140        150        160        170        180
m912.pep  KGGKEIIVRAEVGVPGQKPVNMDFTTYQSGGKYRTYNVAIEGASLVTVYRNQFGEIIKAK
          ||||||||||||||||||||||||||||||||||||||||||||||||||||||||||||
a912      KGGKEIIVRAEVGVPGQKPVNMDFTTYQSGGKYRTYNVAIEGASLVTVYRNQFGEIIKAK
               130        140        150        160        171        180

190
m912.pep  GVDGLIAELKAKNGGKX
          |||||||||||||:||
a912      GVDGLIAELKAKNGSKX
               190
```

The following partial DNA sequence was identified in *N. gonorrhoeae* <SEQ ID 2765>:

```
g913.seq
   1 atGAAAAAAA CCGCCTACGC CATCCTCCTG CTGATCGGGT TCGCTTCCGC

51 CCCTGCATTT GCAGAAACCC GCCCCGCCGA CCCTTATGAA GGCTACAACC

101 GCGCCGTTTC CAAATTCAAC GACCAAGCCG ACCGCTACAT TTTCGCCCCT

151 GCCGCGCGCG GCTACCGCAA AGTTACGCCG AAACCCGTCC GCGCCGGCGT

201 GTCCAATTTT TTTAACAACC TGCGCGACGT GGTCAGTTTC GGCAGCAATA

251 TCTTGCGTTT GGAcatCAAA cgcgcAAGcg aAGACCtcgT CCGcgtcggc 301 atCAATACCA CCTTCGGTTT GGGcgGGCTC ATTGATATTG CCGGcgcGGg 351 cggcgttccc gacaataaaa AcacTttgGg cgacacgttt gcctcgtGGG 401 GctgGAAAaa cagcaATTAT TTCGTgttgc CCGtcttagg cccgtccacc 451 gtccgcgacg cgctcggcac gggcattacc tCTGTTTATC CGCccaagaa 501 tatcgttttc catacccctg ccggacgctg GGgcacgact gCCGCTGCCG 551 CCGTcagtac gcgcgaaggc ctcctcgatt tgaccgacag TCtggacgaa 601 gccgccatCG ACAAATACAG CTACACGCGc gacctctata tgAAAGTCCG 651 CGcacgGCag AccgGTGCAA CACCTGCCGA AGgtacggaa gataacatcg 701 acatcgacat cgACGAATTG GTCGAAAGTG CCGAAACCGG CGCGGCAGAG

751 CCCGCCGTTC ACGAAGATTC CGTATCCGAA ACACAGGCAG AAGCAGCAGG

801 GGAAGCCGAA ACGCAACCTG AACACAACC CTAA
```

This corresponds to the amino acid sequence <SEQ ID 2766; ORF 913.ng>:

```
g913.pep
   1 MKKTAYAILL LIGFASAPAF AETRPADPYE GYNRAVSKFN DQADRYIFAP

51 AARGYRKVTP KPVRAGVSNF FNNLRDVVSF GSNILRLDIK RASEDLVRVG

101 INTTFGLGGL IDIAGAGGVP DNKNTLGDTF ASWGWKNSNY FVLPVLGPST

151 VRDALGTGIT SVYPPKNIVF HTPAGRWGTT AAAVSTREG LLDLTDSLDE
```

```
-continued
201 AAIDKYSYTR DLYMKVRARQ TGATPAEGTE DNIDIDIDEL VESAETGAAE

251 PAVHEDSVSE TQAEAAGEAE TQPGTQP*
```

The following partial DNA sequence was identified in *N. meningitidis* <SEQ ID 2767>:

```
m913.seq
  1 ATGAAAAAAA CCGCCTATGC CTTCCTCCTG CTGATCGGGT TCGCTTCCGC

51 CCCTGCATTT GCCGAAACCC GCCCCGCCGA CCCTTATGAA GGCTACAACC

101 GCGCCGTTTT CAAATTCAAC GACCAAGCCG ACCGCTACAT TTTCGCCCCT

151 GCCGCGCGCG GCTACCGCAA AGTTGCGCCG AAACCCGTCC GCGCCGGCGT

201 GTCCAATTTT TTTAACAACC TGTGCGACGT GGTCAGCTTC GGCAGCAATA

251 TCTTGCGCTT GGACATCAAA CGCGCAAGCG AAGACCTTGT CCGCGTCGGC

301 ATCAACACCA CTTTCGGTTT GGGCGGGCTT ATCGACATCG CCGGCGCGGG

351 CGGCATTCCC GACAATAAAA ACACCTTGGG CGACACGTTT GCCTCGTGGG

401 GATGGAAAAA CAGCAATTAT TTCGTGTTGC CCGTCTTAGG GCCGTCCACC

451 GTCCGCGACG CGCTCGGCAC GGGTATTACC TCCGTTTATT CGCCCAAGAA

501 TATCGTCTTC CGCACCCCTG TCGGACGCTG GGGCACGACT GCCGTATCCG

551 CCGTCAGTAC GCGCGAAGGC CTgCTCGATT TGACCGACAG TCTGGACGAA

601 GCCGCCATCG ACAAATACAG CTACACGCGC GACCTCTATA TGAAAGTCCG

651 TGCGCGGCAG ACCGGTGCAA CACCTGCCGA AGgTACGGAA GATAACATCG

701 ACATCGACGA ATTGGTCGAA AGTGCCGAAA CCGGCGCGGC GGAAACTGCC

751 GTTCAAGAAG ATTCCGTATC CGAAACACAG GCAGAAGCAG CAGGGGAAGC

801 CGAAACGCAA CCTGGAACAC AACCTTAA
```

This corresponds to the amino acid sequence <SEQ ID 2768; ORF 913>:

```
m913.pep
  1 MKKTAYAFLL LIGFASAPAF AETRPADPYE GYNRAVFKFN DQADRYIFAP

51 AARGYRKVAP KPVRAGVSNF FNNLCDVVSF GSNILRLDIK RASEDLVRVG

101 INTTFGLGGL IDIAGAGGIP DNKNTLGDTF ASWGWKNSNY FVLPVLGPST

151 VRDALGTGIT SVYSPKNIVF RTPVGRWGTT AVSAVSTREG LLDLTDSLDE

201 AAIDKYSYTR DLYMKVRARQ TGATPAEGTE DNIDIDELVE SAETGAAETA

251 VQEDSVSETQ AEAAGEAETQ PGTQP*
```

Computer analysis of this amino acid sequence gave the following results:
Homology with a Predicted ORF from *N. gonorrhoeae*
ORF 913 shows 94.9% identity over a 277 aa overlap with a predicted ORF (ORF 913.ng) from *N. gonorrhoeae*:

```
    g913/m913

10         20         30         40         50         60
     g913.pep  MKKTAYAILLLIGFASAPAFAETRPADPYEGYNRAVSKFNDQADRYIFAPAARGYRKVTP
               ||||||:|||||||||||||||||||||||||||| |||||||||||||||||||||||:|
     m913      MKKTAYAFLLLIGFASAPAFAETRPADPYEGYNRAVFKFNDQADRYIFAPAARGYRKVAP
                  10         20         30         40         50         60
```

```
                        70         80         90        100        110        120
    g913.pep    KPVRAGVSNFFNNLRDVVSFGSNILRLDIKRASEDLVRVGINTTFGLGGLIDIAGAGGVP
                ||||||||||||| ||||||||||||||||| |||||||||||||||||||||||||||:|
    m913        KPVRAGVSNFFNNLCDVVSFGSNILRIDIKRASEDLVRVGINTTFGLGGLIDIAGAGGIP
                        70         80         90        100        110        120

130        140        150        160        170        180
    g913.pep    DNKNTLGDTFASWGWKNSNYFVLPVLGPSTVRDALGTGITSVYPPKNIVFHTPAGRWGTT
                ||||||||||||||||||||||||||||||||||||||||||||| |||||:||:|||||
    m913        DNKNTLGDTFASWGWKNSNYFVLPVLGPSTVRDALGTGITSVYSPKNIVFRTPVGRWGTT
                       130        140        150        160        170        180

190        200        210        220        230        240
    g913.pep    AAAAVSTREGLLDLTDSLDEAAIDKYSYTRDLYMKVRARQTGATPAEGTEDNIDIDIDEL
                |::|||||||||||||||||||||||||||||||||||||||||||||||||||  |||
    m913        AVSAVSTREGLLDLTDSLDEAAIDKYSYTRDLYMKVRARQTGATPAEGTEDNIDI--DEL
                       190        200        210        220        230

250        260        270
    g913.pep    VESAETGAAEPAVHEDSVSETQAEAAGEAETQPGTQPX
                ||||||||||  ||:|||||||||||||||||||||||
    m913        VESAETGAAETAVQEDSVSETQAEAAGEAETQPGTQPX
                       240        250        260        270
```

The following partial DNA sequence was identified in *N. meningitidis* <SEQ ID 2769>:

```
a913.seq
   1 ATGAAAAAAA CCGCCTATGC CTTCCTCCTG CTGATCGGGT TCGCTTCCGC

51 CCCTGCATTT GCCGAAACCC GCCCCGCCGA CCCTTATGAA GGCTACAACC

101 GCGCCGTTTT CAAATTCAAC GACCAAGCCG ACCGCTACAT TTTCGCCCCT

151 GCCGCGCGCG GCTACCGCAA AGTTGCGCCG AAACCCGTCC GCGCCGGCGT

201 GTCCAATTTT TTTAACAACC TGTGCGACGT GGTCAGCTTC GGCAGCAATA

251 TCTTGCGCTT AGACATCAAA CGCGCAAGCG AAGACCTTGT CCGCGTCGGT

301 ATCAACACCA CTTTCGGTTT GGGCGGGCTT ATCGACATCG CCGGCGCGGG

351 CGGCATTCCC GACAATAAAA ACACCTTGGG CGACACGTTT GCTTCGTGGG

401 GATGGAAAAA CAGCAATTAT TTCGTGTTGC CCGTCTTAGG GCCGTCCACC

451 GTCCGCGACG CGCTCGGCAC GGGTATTACC TCCGTTTATT CGCCCAAGAA

501 TATCGTCTTC CGCACCCCTG TCGGACGCTG GGGCACGACT GCCGTATCCG

551 CCGTCAGTAC GCGCGAAGGC CTGCTCGATT TGACCGACAG TCTGGACGAA

601 GCCGCCATCG ACAAATACAG CTACACGCGC GACCTCTATA TGAAAGTCCG

651 TGCGCGGCAG ACCGGTGCAA CACCTGCCGA AGGTACGGAA GATAACATCG

701 ACATCGACGA ATTGGTCGAA AGTGCCGAAA CCGGCGCGGC GGAAACTGCC

751 GTTCAAGAAG ATTCCGTATC CGAAACACAG GCAGAAGCAG CAGGGGAAGC

801 CGAAACGCAA CCTGGAACAC AACCTGGAAC ACAACCTTAA
```

This corresponds to the amino acid sequence <SEQ ID 2770; ORF 913.a>:

```
a913.pep
   1 MKKTAYAFLL LIGFASAPAF AETRPADPYE GYNRAVFKFN DQADRYIFAP

51 AARGYRKVAP KPVRAGVSNF FNNLCDVVSF GSNILRLDIK RASEDLVRVG

101 INTTFGLGGL IDIAGAGGIP DNKNTLGDTF ASWGWKNSNY FVLPVLGPST

151 VRDALGTGIT SVYSPKNIVF RTPVGRWGTT AVSAVSTREG LLDLTDSLDE

201 AAIDKYSYTR DLYMKVRARQ TGATPAEGTE DNIDIDELVE SAETGAAETA

251 VQEDSVSETQ AEAAGEAETQ PGTQPGTQP*
``` m913/a913 100.0% identity in 275 aa overlap

```
                    10        20        30        40        50        60
    m913.pep   MKKTAYAFLLLIGFASAPAFAETRPADPYEGYNRAVFKFNDQADRYIFAPAARGYRKVTP
               ||||||||||||||||||||||||||||||||||||||||||||||||||||||||||
    a913       MKKTAYAFLLLIGFASAPAFAETRPADPYEGYNRAVFKFNDQADRYIFAPAARGYRKVAP
                    10        20        30        40        50        60

70        80        90       100       110       120
    m913.pep   KPVRAGVSNFFNNLCDVVSFGSNILRLDIKRASEDLVRVGINTTFGLGGLIDIAGAGGIP
               ||||||||||||||||||||||||||||||||||||||||||||||||||||||||||
    a913       KPVRAGVSNFFNNLCDVVSFGSNILRIDIKRASEDLVRVGINTTFGLGGLIDIAGAGGIP
                    70        80        90       100       110       120

130       140       150       160       170       180
    m913.pep   DNKNTLGDTFASWGWKNSNYFVLPVLGPSTVRDALGTGITSVYSPKNIVFRTPVGRWGTT
               ||||||||||||||||||||||||||||||||||||||||||||||||||||||||||
    a913       DNKNTLGDTFASWGWKNSNYFVLPVLGPSTVRDALGTGITSVYSPKNIVFRTPVGRWGTT
                   130       140       150       160       170       180

190       200       210       220       230       240
    m913.pep   AVSAVSTREGLLDLTDSLDEAAIDKYSYTRDLYMKVRARQTGATPAEGTEDNIDIDELVE
               ||||||||||||||||||||||||||||||||||||||||||||||||||||||||||
    a913       AVSAVSTREGLLDLTDSLDEAAIDKYSYTRDLYMKVRARQTGATPAEGTEDNIDIDELVE
                   190       200       210       220       230       240

250       260       270
    g913.pep   SAETGAAETAVQEDSVSETQAEAAGEAETQPGTQPX
               ||||||||||||||||||||||||||||||||||||
    m913       SAETGAAETAVQEDSVSETQAEAAGEAETQPGTQPGTQPX
                   250       260       270       280
```

The following partial DNA sequence was identified in *N. gonorrhoeae* <SEQ ID 2771>:

```
g914.seq
  1 ATGAAAAAAT GTATTTTGGG CATTTTGACC GCGTGTGCCG CCATGCCTGC

51 ATTTGCCGAC AGAATCAGCG ATTTGGAAGC ACGTCTGGCG CAGTTGGAAC

101 ACCGTGTCGC CGTATTGGAA AGCGGCGGCA ATACCGTCAA AATCGACCTT

151 TTCGGTTCAA ATTCCACCAT GTATGTATGC AGCGTTACGC CTTTTCAGAA

201 GacgtttGag gCAAGCGATC GGAATGAAGG CGTGGCGCGG CAGAAAGTGC

251 GTCAGGCGTG CAACCGCGAA ACTTCGGCAA TGTTTTGCGG AGATGAGGCA

301 ATCCGATGCA GAAAATTCGA TTGATGTATC GGTTGGACGG ATAAAGAAAC

351 GGATACGGAG CTTGGCTTCC GTCTCTGTTT TTCTCTGCCC GATTTTCCAT

401 GCATCGGGTT TCAGACGGCA TTGGAGTGTC AGTCGTGTTC TGCCGATTCG 451 taggctTCGA CGATTTTTTG CACCAGAGGA TGCCGGACAA CGTCTTCGCC

501 GGTGAAGGTA TGGAAATACA GTCCTGCCAC GCCGTGCAGT TTCTCACGTG

551 CGTCTTTCAA TCCCGATTTG ATGTTTTTGG GCAGGTcgaT TTGGCTGGTG

601 TCGCCGGTAA TGACGGCTTT CGCgccgaag ccGATGCGGG TCAGGAACAT

651 TTTCATTTGT TCGGGCGTGg tgTtttGcgC TTCGTCGAGG ATGATGTATG

701 CGCCGTTGAg cgTCCTGCCG CGCATATAG
```

This corresponds to the amino acid sequence <SEQ ID 2772; ORF 914.ng>:

```
g914.pep
  1 MKKCILGILT ACAAMPAFAD RISDLEARLA QLEHRVAVLE SGGNTVKIDL

51 FGSNSTMYVC SVTPFQKTFE ASDRNEGVAR QKVRQACNRE TSAMFCGDEA

101 IRCRKFD*CI GWTDKETDTE LGFRLCFSLP DFPCIGFQTA LECQSCSADS

151 *ASTIFCTRG CRTTSSPVKV WKYSPATPCS FSRASFNPDL MFLGRSIWLV
```

-continued

```
201 SPVMTAFAPK PMRVRNIFIC SGVVFCASSR MMYAPLSVLP
    RI*
```

The following partial DNA sequence was identified in *N. meningitidis* <SEQ ID 2773>:

```
m914.seq
  1 ATGAAAAAAT GTATTTTGGG CATTTTGACC GCGTGTGCCG CCATGCCTGC

51 ATTTGCCGAC AGAATCGGCG ATTTGGAAGC ACGTCTGGCG CAGTTGGAAC

101 ACCGTGTCGC CGTATTGGAA AGCGGCGGCA ATACCGTCAA AATCGACCTT

151 TTCGGTTCAA ATTCCACCAT GTATGTATGC AGCGTTACGC CTTTTCAGAA

201 GACGTTTGAG GCAAGCGATC GGAATGAAGG CGTGGCGCGG CAGAAAGTGC

251 GTCAGGCGTG CAACCGCGAA ACTTCGGCAA TGTTTTGCGA AGATGAGGCA

301 ATCCGATGCA GAAAATTCGA TTGATGTATC GGTTGGACGG ATAAAGAAAC

351 GGATACGGAT ACGGAGCTTG GCTTCCGTAT CTGTTTTTCT CTGCCTGATT

401 TTCCATGCAT CGGGTTTCAG ACGGCATTGG AATGTCAGTC GTGTTCTGCC

451 GATTCGTAGG CTTCGACGAT TTTTTGCACC AAAGGATGCC GGACAACGTC

501 TTCGCCGGTA AAGGTGTGGA AATACAGCCC TTCCACGTTG TGCAGTTTCT

551 CACGCGCATC TTTTAATCCC GATTTGATGT TTTTGGGCAG GTCGATTTGG

601 CTGGTGTCGC CGGTAATGAC GGCTTTCGCG CCGAAGCCGA TGCGGGTCAG

651 GAACATTTTC ATTTGTTCGG GCGTGGTGTT TTGCGCTTCG TCGAGGATGA

701 TGTATGCGCC GTTGAGCGTC CTGCCGCGCA TATAG
```

This corresponds to the amino acid sequence <SEQ ID 2774; ORF 914>:

```
m914.pep
  1 MKKCILGILT ACAAMPAFAD RIGDLEARLA QLEHRVAVLE SGGNTVKIDL

51 FGSNSTMYVC SVTPFQKTFE ASDRNEGVAR QKVRQACNRE TSAMFCEDEA

101 IRCRKFDXCI GWTDKETDTD TELGFRICFS LPDFPCIGFQ TALECQSCSA

151 DSXASTIFCT KGCRTTSSPV KVWKYSPSTL CSFSRASFNP DLMFLGRSIW

201 LVSPVMTAFA PKPMRVRNIF ICSGVVFCAS SRMMYAPLSV
    LPRI*
```

Computer analysis of this amino acid sequence gave the following results:

Homology with a Predicted ORF from *N. gonorrhoeae*

ORF 914 shows 96.7% identity over a 244 aa overlap with a predicted ORF (ORF 914.ng) from *N. gonorrhoeae*:

```
    g914/m914

10         20         30         40         50         60
    g914.pep   MKKCILGILTACAAMPAFADRISDLEARLAQLEHRVAVLESGGNTVKIDLFGSNSTMYVC
               ||||||||||||||||||||:|||||||||||||||||||||||||||||||||||||||
    m914       MKKCILGILTACAAMPAFADRIGDLEARLAQLEHRVAVLESGGNTVKIDLFGSNSTMYVC
                   10         20         30         40         50         60

70         80         90        100        110        119
    g914.pep   SVTPFQKTFEASDRNEGVARQKVRQACNRETSAMFCGDEAIRCRKFDXCIGWTDKETDT-
               |||||||||||||||||||||||||||||||||||| |||||||||||||||||||||
    m914       SVTPFQKTFEASDRNEGVARQKVRQACNRETSAMFCEDEAIRCRKFDXCIGWTDKETDTD
                   70         80         90        100        110        120
```

-continued

```
                 120       130       140       150       160       170
g914.pep         -ELGFRLCFSLPDFPCIGFQTALECQSCSADSXASTIFCTRGCRTTSSPVKVWKYSPATP
                  |||||:||||||||||||||||||||||||||||||||:|||||||||||||||||:|
m914              TELGFRICFSLPDFPCIGFQTALECQSCSADSXASTIFCTKGCRTTSSPVKVWKYSPSTL
                         130       140       150       160       170       180

180       190       200       210       220       230
g914.pep          CSFSRASFNPDLMFLGRSIWLVSPVMTAFAPKPMRVRNIFICSGVVFCASSRMMYAPLSV
                  ||||||||||||||||||||||||||||||||||||||||||||||||||||||||||||
m914              CSFSRASFNPDLMFLGRSIWLVSPVMTAFAPKPMRVRNIFICSGVVFCASSRMMYAPLSV
                         190       200       210       220       230       240

240
g914.pep          LPRIX
                  |||||
m914              LPRIX
```

The following partial DNA sequence was identified in *N. meningitidis* <SEQ ID 2775>:

```
a914.seq
   1 ATGAAAAAAT GTATTTTGGG CATTTTGACC GCGTGTGCCG CCATGCCTGC

51 ATTTGCCGAC AGAATCGGCG ATTTGGAAGC ACGTCTGGCG CAGTTGGAAC

101 ACCGTGTCGC CGTATTGGAA AGCGGCAGCA ATACCGTCAA AATCGACCTT

151 TTCGGTTCAA ATTCCACCAT GTATGTATGC AGCGTTACGC CTTTTCAGAA

201 GACGTTTGAG GCAAGCGATC GGAATGAAGG CGTGGCGCGG CAGAAAGTGC

251 GTCAGGCGTG CAACCGCGAA ACTTCGGCAA TGTTTTGCGA AGATGAGGCA

301 ATCCGATGCA GAAAATTCGA TTGATGTATC GGTTGGACGG ATAAAGAAAC

351 GGATACGGAG CTTGGCTTCC GTATCTGTTT TTCTCTGCCC GATTTTCCAT

401 GCATCGGGTT TCAGACGGCA TTGGAATGTC AGTCGTGTTC TGCCGATTCG

451 TAGGCTTCGA CGATTTTTTG CACCAAAGGA TGCCGGACAA CGTCTTCGCC

501 GGTAAAGGTG TGGAAATACA GCCCTTCCAC GCCGTGCAGT TTCTCACGCG

551 CATCTTTTAA TCCCGATTTG ATGTTTTTGG GCAGGTCGAT TTGGCTGGTG

601 TCGCCGGTAA TGACGGCTTT CGCGCCGAAG CCGATGCGGG TCAGGAACAT

651 TTTCATTTGT TCGGGCGTGG TGTTTTGCGC TTCGTCGAGG ATGATGTATG

701 CGCCGTTGAG CGTCCTGCCG CGCATATAG
```

This corresponds to the amino acid sequence <SEQ ID 2776; ORF 914.a>:

```
a914.pep
   1 MKKCILGILT ACAAMPAFAD RIGDLEARLA QLEHRVAVLE SGSNTVKIDL

51 FGSNSTMYVC SVTPFQKTFE ASDRNEGVAR QKVRQACNRE TSAMFCEDEA

101 IRCRKFD*CI GWTDKETDTE LGFRICFSLP DFPCIGFQTA LECQSCSADS

151 *ASTIFCTKG CRTTSSPVKV WKYSPSTPCS FSRASFNPDL MFLGRSIWLV

201 SPVMTAFAPK PMRVRNIFIC SGVVFCASSR MMYAPLSVLP
     RI*
``` m914/a914 98.4% identity in 244 aa overlap

```
                           10        20        30        40        50        60
m914.pep          MKKCILGILTACAAMPAFADRIGDLEARLAQLEHRVAVLESGGNTVKIDLFGSNSTMYVC
                  ||||||||||||||||||||||||||||||||||||||||||:|||||||||||||||||
a914              MKKCILGILTACAAMPAFADRIGDLEARLAQLEHRVAVLESGSNTVKIDLFGSNSTMYVC
                           10        20        30        40        50        60
```

-continued

```
                          70         80         90        100        110        120
m914.pep      SVTPFQKTFEASDRNEGVARQKVRQACNRETSAMFCEDEAIRCRKFDXCIGWTDKETDTD
              ||||||||||||||||||||||||||||||||||||||||||||||||||||||||||
a914          SVTPFQKTFEASDRNEGVARQKVRQACNRETSAMFCEDEAIRCRKFDXCIGWTDKETD--
                          70         80         90        100        110

130        140        150        160        170        180
m914.pep      TELGFRLCFSLPDFPCIGFQTALECQSCSADSXASTIFCTRGCRTTSSPVKVWKYSPATL
              |||||||||||||||||||||||||||||||||||||||||||||||||||||||||||
a914          TELGFRICFSLPDFPCIGFQTALECQSCSADSXASTIFCTKGCRTTSSPVKVWKYSPSTP
                         120        130        140        150        160        170

190        200        210        220        230        240
m914.pep      CSFSRASFNPDLMFLGRSIWLVSPVMTAFAPKPMRVRNIFICSGVVFCASSRMMYAPLSV
              ||||||||||||||||||||||||||||||||||||||||||||||||||||||||||||
a914          CSFSRASFNPDLMFLGRSIWLVSPVMTAFAPKPMRVRNIFICSGVVFCASSRMMYAPLSV
                         180        190        200        210        220        230 m914.pep      LPRIX
              |||||
a914          LPRIX
              240
```

The following partial DNA sequence was identified in *N. gonorrhoeae* <SEQ ID 2777>:

```
g915.seq
  1 ATGAAGAAAA CCCTGTTGGc AATTGTTGCC gtTTTCGCCT TAAGTGCCTG

51 CCGGCaggcg gaAGaggcac cgccgCCTTT ACCCCGGCAG AtTAGCGacc 101 gttcggtcgg aCACTAttgC Agtatgaacc tgaccgaaca caacggcccc 151 aaagcccaga ttttttttgaa cGGCAAACCC GATCAGCCCG TTTGGTTCTC 201 CACCGTcaag cagatgttcg GCTATACCAA GCTGCCCGAA GAGCCCAAAG

251 GCATCCGCGT GATTTACGTT ACCGATATGG GCAATGTTAC CGATTGGACG

301 AATCCTAATG CCGACACGGA GTGGATAGAT GCGAAAAAAG CCTTTTACGT

351 CATCGACAGC GGCTTTATCG GCGGTATGGG CGCGGAAGAC GCGCTGCCGT

401 TCGGCAACAA GGAGCAGGCT GAAAAATTTG CAAAGGATAA AGGCGGCAAG

451 GTCGTCGGTT TTGACGATAT GCCCGATGCT TACATTTTCA AGTAA
```

This corresponds to the amino acid sequence <SEQ ID 2778; ORF 915.ng>:

```
g915.pep
  1 MKKTLLAIVA VFALSACRQA EEAPPPLPRQ ISDRSVGHYC SMNLTEHNGP

51 KAQIFLNGKP DQPVWFSTVK QMFGYTKLPE EPKGIRVIYV TDMGNVTDWT

101 NPNADTEWID AKKAFYVIDS GFIGGMGAED ALPFGNKEQA EKFAKDKGGK

151 VVGFDDMPDA YIFK*
```

The following partial DNA sequence was identified in *N. meningitidis* <SEQ ID 2779>:

```
m915.seq
  1 ATGAAAAAAA CCCTGTTGGC AATTGTTGCC GTTTCCGCCT TAAGTGC.tG

51 CCGGCAGGCG GAAGAGGGAC CGCCGCCTTT ACCcCGGCAG ATTAGCGACC

101 GTTCGGTCGG ACACTATTGC AGTATGAACC TGACCGAACA CAACGGCCCC

151 AAAGCCCAGA TTTTCTTGAA CGGCAAACCC GATCAGCCCG TtTGGTTCTC

201 CACCATCAAG CAGATGTTCG GCTATACCAA GCTGCCCGAA GAGCCTAAAG

251 GCATCCGCGT GATTTACGTT ACCGATATGG GCAATGTTAC CGATTGGACG
```

-continued

```
301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA AATAA
```

This corresponds to the amino acid sequence <SEQ ID 2780; ORF 915>:

```
m915.pep
   1 MKKTLLAIVA VSALSXCRQA EEGPPPLPRQ ISDRSVGHYC SMNLTEHNGP

51 KAQIFLNGKP DQPVWFSTIK QMFGYTKLPE EPKGIRVIYV TDMGNVTDWT

101 NPNADTEWMD AKKAFYVIDS GFIGGMGAED ALPFGNKEQA EKFAKDKGGK

151 VVGFDDMPDT YIFK*
```

Computer analysis of this amino acid sequence gave the following results:
Homology with a Predicted ORF from *N. gonorrhoeae*
ORF 915 shows 97.0% identity over a 164 aa overlap with a predicted ORF (ORF 915.ng) from *N. gonorrhoeae*:

```
m915/g915

10         20         30         40         50         60
    m915.pep   MKKTLLAIVAVSALSACRQAEEGPPPLPRQISDRSVGHYCSMNLTEHNGPKAQIFLNGKP
               ||||||||||| |||||||||||:|||||||||||||||||||||||||||||||||||
    g915       MKKTLLAIVAVFALSACRQAEEAPPPLPRQISDRSVGHYCSMNLTEHNGPKAQIFLNGKP
                    10         20         30         40         50         60

70         80         90        100        110        120
    m915.pep   DQPVWFSTIKQMFGYTKLPEEPKGIRVIYVTDMGNVTDWTNPNADTEWMDAKKAFYVIDS
               ||||||||:|||||||||||||||||||||||||||||||||||||||:|||||||||||
    g915       DQPVWFSTVKQMFGYTKLPEEPKGIRVIYVTDMGNVTDWTNPNADTEWIDAKKAFYVIDS
                    70         80         90        100        110        120

130        140        150        160
    m915.pep   GFIGGMGAEDALPFGNKEQAEKFAKDKGGKVVGFDDMPDTYIFKX
               |||||||||||||||||||||||||||||||||||||:|||||
    g915       GFIGGMGAEDALPFGNKEQAEKFAKDKGGKVVGFDDMPDAYIFKX
                   130        140        150        160
```

The following partial DNA sequence was identified in *N. meningitidis* <SEQ ID 2781>:

```
a915.seq
   1 ATGAAAAAAA CCCTGTTGGC AATTGTTGCC GTTTCCGCCT TAAGTGCCTG

51 CCGGCAGGCG GAAGAGGGAC CGCCGCCTTT ACCCCGGCAG ATTAGCGACC

101 GTTCGGTCGG ACACTATTGC AGTATGAACC TGACCGAACA CAACGGCCCC

151 AAAGCCCAGA TTTTCTTGAA CGGCAAACCC GATCAGCCCG TTTGGTTCTC

201 CACCATCAAG CAGATGTTCG GCTATACCAA GCTGCCCGAA GAGCCTAAAG

251 GCATCCGCGT GATTTACGTT ACCGATATGG GCAATGTTAC CGATTGGACG

301 AATCCCAATG CCGACACGGA GTGGATGGAT GCGAAAAAAG CCTTTTACGT

351 CATCGACAGC GGCTTTATCG GCGGTATGGG TGCGGAAGAC GCGCTGCCGT

401 TCGGCAACAA AGAGCAGGCT GAGAAATTTG CAAAGGATAA AGGCGGTAAG

451 GTTGTCGGTT TCGACGATAT GCCTGATACC TATATTTTCA
     AATAA
```

This corresponds to the amino acid sequence <SEQ ID 2782; ORF 915.a>:

```
a915.pep
   1 MKKTLLAIVA VSALSACRQA EEGPPPLPRQ ISDRSVGHYC SMNLTEHNGP

51 KAQIFLNGKP DQPVWFSTIK QMFGYTKLPE EPKGIRVIYV TDMGNVTDWT

101 NPNADTEWMD AKKAFYVIDS GFIGGMGAED ALPFGNKEQA EKFAKDKGGK

151 VVGFDDMPDT YIFK*
``` m915/a915 99.4% identity in 164 aa overlap

```
                  10         20         30         40         50         60
    m915.pep  MKKTLLAIVAVSALSXCRQAEEGPPPLPRQISDRSVGHYCSMNLTEHNGPKAQIFLNGKP
              |||||||||||||||| |||||||||||||||||||||||||||||||||||||||||||
    a915      MKKTLLAIVAVSALSACRQAEEGPPPLPRQISDRSVGHYCSMNLTEHNGPKAQIFLNGKP
                  10         20         30         40         50         60

70         80         90        100        110        120
    m915.pep  DQPVWFSTIKQMFGYTKLPEEPKGIRVIYVTDMGNVTDWTNPNADTEWMDAKKAFYVIDS
              ||||||||||||||||||||||||||||||||||||||||||||||||||||||||||||
    a915      DQPVWFSTIKQMFGYTKLPEEPKGIRVIYVTDMGNVTDWTNPNADTEWMDAKKAFYVIDS
                  70         80         90        100        110        120

130        140        150        160
    m915.pep  GFIGGMGAEDALPFGNKEQAEKFAKDKGGKVVGFDDMPDTYIFKX
              |||||||||||||||||||||||||||||||||||||||||||||
    a915      GFIGGMGAEDALPFGNKEQAEKFAKDKGGKVVGFDDMPDTYIFKX
                 130        140        150        160
```

The following partial DNA sequence was identified in *N. gonorrhoeae* <SEQ ID 2783>:

```
g917.seq
    1 ATGGTCAAac atctgccacT cgcCGTCctg actgctTtgc tgcttgcagc 51 gtgcGGCGGT Tcggacaaac cgcctgccga Aaaaccggca ccggcgGaAA 101 accaaAacgt atTgaAAATT TataACTGGT CGGAATACGT CGATCCGGAA

151 ACCGTTGCCG ATTTTGAAAA GAAAAACGGC ATCAAGGTTA CTTATGATGT

201 GTACGACAGT GATGAAACGC TGGAAAGCAA GGTGCTGACC GGAAAATCCG

251 GTTACGACAT TGTCGCGCCG TCCAATGCGT TTGTGGGCAG GCAGATTAAG

301 GCAGGTGCGT ATCAGAAAAT CGATAAGTCG ATGATTCCCA ATTATAAACA

351 TCTCAACCCT GAAATGATGA GGCTGATGGA CGGGGTCGAT CCCGACCACG

401 AATACGCCGT GCCGTTTTAT TGGGGGACAA ATACCTTCGC CATCAATACC

451 GAACGCGTGA AAAAGGCTTT GGGTACGGAC AAGCTGCCGG ACAACCAGTG

501 GGATTTGGTG TTCAACCCCG AATACACGTT CAAACTCAAA CAATGCGGCA

551 TCAGCTATTT GGACAGCGCG GCGGAAATTT ATCCCATGGT GTTGAACTAT

601 TTGGGCAAAA ACCCGAACAG CAGCAATACG GAAGACATCA GGGAGGCAAC

651 CGCCCTGCTC AAGAAAAACC GCCCCAATAT CAAACGCTTT ACTTCGTCCG

701 GCTTTATCGA TGATTTGGCG CGCGGCGATA CCTGCGTAAC AATCGGTTTC

751 GGCGGAGATT TGAACATCGC CAAACGCCGT GCCGAAGAAG CGGGCGGCAA

801 GGAAAAAATC CGCGTGATGA TGCCGAAAGA GGGCGTGGGG ATTTGGGTGG

851 ATTCTTTCGT GATTCCGAAA GATGCGAAAA ACGTCGCCAA CGCGCACAAA

901 TACATCAACG ACTTCCTCGA TCCGGAAGTG TCGGCGAAAA ACGGCAATTT 951 cgttacCTAC GCGCCTTCGA GCAAGCCGGC GCGCGATTTG ATGGAGGACG

1001 AATTTAAAAA CGACAATACG ATTTTCCCGA GCGGGGAAGA TTTGAAAAAC
```

-continued

```
1051 AGCTTTATCA TGGTGCCTAT CCGGCCGGCG GCATTGAAGT TTATGGTGCG

1101 CCAGTGGCAG GATGTGAAGG CGGGGAAATA A
```

This corresponds to the amino acid sequence <SEQ ID 2784; ORF 917.ng>:

```
g917.pep
  1 MVKHLPLAVL TALLLAACGG SDKPPAEKPA PAENQNVLKI YNWSEYVDPE

51 TVADFEKKNG IKVTYDVYDS DETLESKVLT GKSGYDIVAP SNAFVGRQIK

101 AGAYQKIDKS MIPNYKHLNP EMMRLMDGVD PDHEYAVPFY WGTNTFAINT

151 ERVKKALGTD KLPDNQWDLV FNPEYTFKLK QCGISYLDSA AEIYPMVLNY

201 LGKNPNSSNT EDIREATALL KKNRPNIKRF TSSGFIDDLA RGDTCVTIGF

251 GGDLNIAKRR AEEAGGKEKI RVMMPKEGVG IWVDSFVIPK DAKNVANAHK

301 YINDFLDPEV SAKNGNFVTY APSSKPARDL MEDEFKNDNT IFPSGEDLKN

351 SFIMVPIRPA ALKFMVRQWQ DVKAGK*
```

The following partial DNA sequence was identified in *N. meningitidis* <SEQ ID 2785>:

```
m917.seq
    1 ATGACCAAAC ATCTGCCCCT GGCCGTCCTG ACTGCTTTGC TGCTTGCAGC

51 GTGCGGCGGT TCGGACAAAC CGCCTGCCGA AAAACCGGCA CCGGCGGAAA

101 ACCAAAACGT ATTGAAAATT TACAACTGGT CGGAATATGT CGATCCGGAA

151 ACCGTTGCCG ATTTTGAAAA GAAAAACGGC ATCAAGGTTA CTTATGATGT

201 GTACGACAGC GATGAAACGC TGGAAAGCAA GGTGCTGACA GGCAAGTCCG

251 GTTACGACAT TGTCGCGCCG TCCAATGCGT TTGTGGGCAG GCAGATTAAG

301 GCAGGTGCGT ATCAGAAAAT CGATAAGTCG CTGATTCCCA ATTATAAACA

351 CCTCAACCCC GAAATGATGA GGCTGATGGA CGGGGTCGAT CCCGGCCACG

401 AATACGCCGT GCCGTTTTAT TGGGGACAA ATACCTTCGC CATCAATACC

451 GAACGCGTGA AAAAGGCTTT GGGTACGGAC AAGCTGCCGG ACAACCAGTG

501 GGATTTGGTG TTCGACCCCG AATACACGTC CAAACTCAAG CAATGCGGCA

551 TCAGCTATTT GGACAGCGCG GCGGAAATCT ATCCTATGGT GTTGAACTAT

601 TTGGGTAAAA ACCCGAACAG CAGCAATACG GAAGACATCA GGGAGGCAAC

651 CGCCCTACTC AAGAAAAACC GCCCCAATAT CAAACGCTTT ACTTCGTCCG

701 GCTTTATCGA TGATTTGGCG CGCGGCGATA CCTGCGTAAC AATCGGTTTC

751 GGCGGCGATT TGAACATCGC CAAACGCCGT GCCGAAGAAG CGGGCGGCAA

801 GGAAAAAATC CGCGTGATGA TGCCCAAAGA GGGCGTGGGG ATTTGGGTGG

851 ATTCTTTCGT GATTCCGAAA GATGCGAAAA ACGTCGCCAA CGCGCACAAA

901 TACATCAACG ACTTCCTCGA CCCGGAAGTG TCGGCGAAAA ACGGCAATTT

951 CGTTACTTAC GCGCCTTCGA GCAAGCCTGC GCGTGAGCTG ATGGAAGACG

1001 AATTTAAAAA CGACAATACG ATTTTCCCAA CCGAGGAGGA TTTGAAAAAC

1051 AGCTTTATCA TGGTGCCTAT CCGCCGGCG GCATTGAAGT TTATGGTGCG

1101 CCAGTGGCAG GATGTGAAGG CGGGGAAATA A
```

This corresponds to the amino acid sequence <SEQ ID 2786; ORF 917>:

```
m917.pep
    1 MTKHLPLAVL TALLLAACGG SDKPPAEKPA PAENQNVLKI YNWSEYVDPE

51 TVADFEKKNG IKVTYDVYDS DETLESKVLT GKSGYDIVAP SNAFVGRQIK

101 AGAYQKIDKS LIPNYKHLNP EMMRLMDGVD PGHEYAVPFY WGTNTFAINT

151 ERVKKALGTD KLPDNQWDLV FDPEYTSKLK QCGISYLDSA AEIYPMVLNY

201 LGKNPNSSNT EDIREATALL KKNRPNIKRF TSSGFIDDLA RGDTCVTIGF

251 GGDLNIAKRR AEEAGGKEKI RVMMPKEGVG IWVDSFVIPK DAKNVANAHK

301 YINDFLDPEV SAKNGNFVTY APSSKPAREL MEDEFKNDNT IFPTEEDLKN

351 SFIMVPIQPA ALKFMVRQWQ DVKAGK*
```

Computer analysis of this amino acid sequence gave the following results:

Homology with a Predicted ORF from *N. gonorrhoeae*

ORF 917 shows 97.6% identity over a 376 aa overlap with a predicted ORF (ORF 917.ng) from *N. gonorrhoeae*:

```
m917/g917

10         20         30         40         50         60
     m917.pep    MTKHLPLAVLTALLLAACGGSDKPPAEKPAPAENQNVLKIYNWSEYVDPETVADFEKKNG
                 |:||||||||||||||||||||||||||||||||||||||||||||||||||||||||||
     g917        MVKHLPLAVLTALLLAACGGSDKPPAEKPAPAENQNVLKIYNWSEYVDPETVADFEKKNG
                  10         20         30         40         50         60

70         80         90        100        110        120
     m917.pep    IKVTYDVYDSDETLESKVLTGKSGYDIVAPSNAFVGRQIKAGAYQKIDKSLIPNYKHLNP
                 |||||||||||||||||||||||||||||||||||||||||||||||||:||||||||||
     g917        IKVTYDVYDSDETLESKVLTGKSGYDIVAPSNAFVGRQIKAGAYQKIDKSMIPNYKHLNP
                  70         80         90        100        110        120

130        140        150        160        170        180
     m917.pep    EMMRLMDGVDPGHEYAVPFYWGTNTFAINTERVKKALGTDKLPDNQWDLVFDPEYTSKLK
                 |||||||||||| |||||||||||||||||||||||||||||||||||||:||||   ||
     g917        EMMRLMDGVDPDHEYAVPFYWGTNTFAINTERVKKALGTDKLPDNQWDLVFNPEYTFKLK
                 130        140        150        160        170        180

190        200        210        220        230        240
     m917.pep    QCGISYLDSAAEIYPMVLNYLGKNPNSSNTEDIREATALLKKNRPNIKRFTSSGFIDDLA
                 ||||||||||||||||||||||||||||||||||||||||||||||||||||||||||||
     g917        QCGISYLDSAAEIYPMVLNYLGKNPNSSNTEDIREATALLKKNRPNIKRFTSSGFIDDLA
                 190        200        210        220        230        240

250        260        270        280        290        300
     m917.pep    RGDTCVTIGFGGDLNIAKRRAEEAGGKEKIRVMMPKEGVGIWVDSFVIPKDAKNVANAHK
                 ||||||||||||||||||||||||||||||||||||||||||||||||||||||||||||
     g917        RGDTCVTIGFGGDLNIAKRRAEEAGGKEKIRVMMPKEGVGIWVDSFVIPKDAKNVANAHK
                 250        260        270        280        290        300

310        320        330        340        350        360
     m917.pep    YINDFLDPEVSAKNGNFVTYAPSSKPARELMEDEFKNDNTIFPTEEDLKNSFIMVPIQPA
                 ||||||||||||||||||||||||||||:|||||||||||||: ||||||||||||:||
     g917        YINDFLDPEVSAKNGNFVTYAPSSKPARDLMEDEFKNDNTIFPSGEDLKNSFIMVPIRPA
                 310        320        330        340        350        360

370
     m917.pep    ALKFMVRQWQDVKAGKX
                 |||||||||||||||||
     g917        ALKFMVRQWQDVKAGKX
                 370
```

The following partial DNA sequence was identified in *N. meningitidis* <SEQ ID 2787>:

```
a917.seq
    1 ATGACCAAAC ATCTGCCCCT GGCCGTCCTG ACTGCTTTGC TGCTTGCAGC

51 GTGCGGCGGT TCGGACAAAC CGCCTGCCGA AAAACCGGCG CCGGCGGAAA

101 ACCGAAACGT ATTGAAAATT TACAACTGGT CGGAATACGT CGATCCGGAA
```

```
151 ACCGTTGCCG ATTTTGAAAA GAAAAACGGC ATCAAGGTTA CTTATGATGT

201 GTACGACAGC GATGAAACGC TGGAAAGCAA GGTGCTGACC GGAAAATCTG

251 GTTACGACAT TGTCGCGCCG TCCAATGCGT TTGTGGGCAG GCAGATTAAG

301 GCAGGTGCGT ATCAGAAAAT CGATAAGTCG CTGATTCCCA ATTATAAACA

351 CCTCAACCCC GAAATGATGA GGCTGATGGA CGGGGTCGAT CCCGGCCACG

401 AATACGCCGT GCCGTTTTAT TGGGGGACAA ATACCTTCGC CATCAATACC

451 GAACGCGTGA AAAAGGCTTT GGGTACGGAC AAGCTGCCGG ACAACCAGTG

501 GGATTTGGTG TTCGACCCCG AATACACGTC CAAACTCAAG CAATGCGGCA

551 TCAGCTATTT GGACAGCGCG GCGGAAATCT ATCCTATGGT GTTGAACTAT

601 TTGGGTAAAA ACCCGAACAG CAGCAATACG GAAGACATCA GGGAGGCAAC

651 CGCCCTACTC AAGAAAAACC GCCCCAATAT CAAACGCTTT ACTTCGTCCG

701 GCTTTATCGA TGATTTGGCG CGCGGCGATA CCTGCGTAAC AATCGGTTTC

751 GGCGGCGATT TGAACATCGC CAAACGCCGT GCCGAAGAAG CGGGCGGCAA

801 GGAAAAAATC CGCGTGATGA TGCCCAAAGA GGGCGTGGGG ATTTGGGTGG

851 ATTCTTTCGT GATTCCGAAA GATGCGAAAA ACGTCGCCAA CGCGCACAAA

901 TACATCAACG ACTTCCTCGA CCCGGAAGTG TCGGCGAAAA ACGGCAATTT

951 CGTTACTTAC GCGCCTTCGA GCAAGCCTGC GCGTGAGCTG ATGGAAGACG

1001 AATTTAAAAA CGACAATACG ATTTTCCCAA CCGAGGAGGA TTTGAAAAAC

1051 AGCTTTATCA TGGTGCCTAT CCAGCCGGCG GCATTGAAGT TTATGGTGCG

1101 CCAGTGGCAG GATGTGAAGG CGGGGAAATA A
```

This corresponds to the amino acid sequence <SEQ ID 2788; ORF 917.a>:

```
a917.pep

1   MTKHLPLAVL TALLLAACGG SDKPPAEKPA PAENRNVLKI YNWSEYVDPE

51   TVADFEKKNG IKVTYDVTDS DETLESKVLT GKSGYDIVAP SNAFVGRQIK

101   AGAYQKIDKS LIPNYKHLNP EMMRLMDGVD PGHEYAVPFY WGTNTFAINT

151   ERVKKALGTD KLPDNQWDLV FDPEYTSKLK QCGISYLDSA AEIYPMVLNY

201   LGKNPNSSNT EDIREATALL KKNRPNIKRF TSSGFIDDLA RGDTCVTIGF

251   GGDLNIAKRR AEEAGGKEGI RVMMPKEGVG IWVDSFVIPK DAKNVANAHK

301   YINDFLDPEV SAKNGNFVTY APSSKPAREL MEDEFKNDNT IFPTEEDLKN

351   SFIMVPIQPA ALKFMVRQWQ DVKAGK* m917/a917  99.7% identity in 376 aa overlap 10         20         30         40         50         60
m917.pep   MTKHLPLAVLTALLLAACGGSDKPPAEKPAPAENQNVLKIYNWSEYVDPETVADFEKKNG
           ||||||||||||||||||||||||||||||||||||:|||||||||||||||||||||||
a917       MTKHLPLAVLTALLLAACGGSDKPPAEKPAPAENRNVLKIYNWSEYVDPETVADFEKKNG
                10         20         30         40         50         60

70         80         90        100        110        120
m917.pep   IKVTYDVYDSDETLESKVLTGKSGYDIVAPSNAFVGRQIKAGAYQKIDKSLIPNYKHLNP
           ||||||||||||||||||||||||||||||||||||||||||||||||||||||||||||
a917       IKVTYDVYDSDETLESKVLTGKSGYDIVAPSNAFVGRQIKAGAYQKIDKSLIPNYKHLNP
                70         80         90        100        110        120

130        140        150        160        170        180
m917.pep   EMMRLMDGVDPGHEYAVPFYWGTNTFAINTERVKKALGTDKLPDNQWDLVFDPEYTSKLK
           ||||||||||||||||||||||||||||||||||||||||||||||||||||||||||||
a917       EMMRLMDGVDPGHEYAVPFYWGTNTFAINTERVKKALGTDKLPDNQWDLVFDPEYTSKLK
               130        140        150        160        170        180
```

```
               190        200        210        220        230        240
m917.pep  QCGISYLDSAAEIYPMVNLNYLGKNPNSSNTEDIREATALLKKNRPNIKRFTSSGFIDDLA
          ||||||||||||||||||||||||||||||||||||||||||||||||||||||||||||
a917      QCGISYLDSAAEIYPMVNLNYLGKNPNSSNTEDIREATALLKKNRPNIKRFTSSGFIDDLA
               190        200        210        220        230        240

250        260        270        280        290        300
m917.pep  RGDTCVTIGFGGDLNIAKRRAEEAGGKEKIRVMMPKEGVGIWVDSFVIPKDAKNVANAHK
          ||||||||||||||||||||||||||||||||||||||||||||||||||||||||||||
a917      RGDTCVTIGFGGDLNIAKRRAEEAGGKEKIRVMMPKEGVGIWVDSFVIPKDAKNVANAHK
               250        260        270        280        290        300

310        320        330        340        350        360
m917.pep  YINDFLDPEVSAKNGVFVTYAPSSKPARELMEDEFKNDNTIFPTEEDLKNSFIMVPIQPA
          ||||||||||||||||||||||||||||||||||||||||||||||||||||||||||||
a917      YINDFLDPEVSAKNGVFVTYAPSSKPARELMEDEFKNDNTIFPTEEDLKNSFIMVPIQPA
               310        320        330        340        350        360

370
m917.pep  ALKFMVRQWQDVKAGKX
          |||||||||||||||||
a917      ALKFMVRQWQDVKAGKX
               370
```

The following partial DNA sequence was identified in *N. gonorrhoeae* <SEQ ID 2789>:

```
g919.seq
   1 ATGAAAAAAC ACCTGCTCCG CTCCGCCCTG TACGGcatCG CCGCCgccAT

51 CctcgCCGCC TGCCAAAgca gGAGCATCCA AACCTTTCCG CAACCCGACA

101 CATCCGTCAT CAACGGCCCG GACCGGCCGG CCGGCATCCC CGACCCCGCC

151 GGAACGACGG TTGCCGGCGG CGGGGCCGTC TATACCGTTG TGCCGCACCT

201 GTCCATGCCC CACTGGGCGG CGCaggATTT TGCCAAAAGC CTGCAATCCT

251 TCCGCCTCGG CTGCGCCAAT TTGAAAAACC GCCAAGGCTG GCAGGATGTG

301 TGCGCCCAAG CCTTTCAAAC CCCCGTGCAT TCCTTTCAGG CAAAGcGgTT

351 TTTTGAACGC TATTTCACGC cgtGGCaggt tgcaggcaAC GGAAGcCTTG

401 Caggtacggt TACCGGCTAT TACGAACCGG TGCTGAAGGG CGACGGCAGG

451 CGGACGGAAC GGGCCCGCTT CCCGATTTAC GGTATTCCCG ACGATTTTAT

501 CTCCGTCCCG CTGCCTGCCG GTTTGCGGGG CGGAAAAAAC CTTGTCCGCA

551 TCAGGCAGac ggGGAAAAAC AGCGGCACGA TCGACAATGC CGGCGGCACG

601 CATACCGCCG ACCTCTCCCG ATTCCCCATC ACCGCGCGCA CAACGGcaat 651 caaaGGCAGG TTTGAaggAA GCCGCTTCCT CCCTTACCAC ACGCGCAACC 701 AAAtcaacGG CGGCgcgcTT GACGGCAAag cccCCATCCT CggttacgcC 751 GAagaccCcG tcgaactTTT TTTCATGCAC AtccaaggCT CGGGCCGCCT 801 GAAAACCCcg tccggcaaat acatCCGCAt cggaTacgcc gacAAAAACG 851 AACAtccgTa tgtttccatc ggACGctaTA TGGCGGACAA AGGCTACCTC 901 AAGctcgggc agACCTCGAT GCAGGgcatc aaagcCTATA TGCGGCAAAA

951 TCCGCAACGC CTCGCCGAAG TTTTGGGTCA AAACCCCAGC TATATCTTTT

1001 TCCGCGAGCT TGCCGGAAGC GGCAATGAGG GCCCCGTCGG CGCACTGGGC

1051 ACGCCACTGA TGGGGAATA CGCCGGCGCA ATCGACCGGC ACTACATTAC

1101 CTTGGGCGCG CCCTTATTTG TCGCCACCGC CCATCCGGTT ACCCGCAAAG

1151 CCCTCAACCG CCTGATTATG GCGCAGGATA CAGGCAGCGC GATCAAAGGC

1201 GCGGTGCGCG TGGATTATTT TTGGGGTTAC GGCGACGAAG CCGGCGAACT
```

-continued

```
1251 TGCCGGCAAA CAGAAAACCA CGGGATACGT CTGGCAGCTC CTGCCCAACG

1301 GCATGAAGCC CGAATACCGC CCGTGA
```

This corresponds to the amino acid sequence <SEQ ID 2790; ORF 919.ng>:

```
g919.pep
   1 MKKHLLRSAL YGIAAAILAA CQSRSIQTFP QPDTSVINGP DRPAGIPDPA

51 GTTVAGGGAV YTVVPHLSMP HWAAQDFAKS LQSFRLGCAN LKNRQGWQDV

101 CAQAFQTPVH SFQAKRFFER YFTPWQVAGN GSLAGTVTGY YEPVLKGDGR

151 RTERARFPIY GIPDDFISVP LPAGLRGGKN LVRIRQTGKN SGTIDNAGGT

201 HTADLSRFPI TARTTAIKGR FEGSRFLPYH TRNQINGGAL DGKAPILGYA

251 EDPVELFFMH IQGSGRLKTP SGKYIRIGYA DKNEHPYVSI GRYMADKGYL

301 KLGQTSMQGI KAYMRQNPQR LAEVLGQNPS YIFFRELAGS GNEGPVGALG

351 TPLMGEYAGA IDRHYITLGA PLFVATAHPV TRKALNRLIM AQDTGSAIKG

AVRVDYFWGY GDEAGELAGK QKTTGYVWQL LPNGMKPEYR P*
```

The following partial DNA sequence was identified in *N. meningitidis* <SEQ ID 2791>:

```
m919.seq
    1 ATGAAAAAAT ACCTATTCCG CGCCGCCCTG TACGGCATCG CCGCCGCCAT

51 CCTCGCCGCC TGCCAAAGCA AGAGCATCCA AACCTTTCCG CAACCCGACA

101 CATCCGTCAT CAACGGCCCG GACCGGCCGG TCGGCATCCC CGACCCCGCC

151 GGAACGACGG TCGGCGGCGG CGGGGCCGTC TATACCGTTG TACCGCACCT

201 GTCCCTGCCC CACTGGGCGG CGCAGGATTT CGCCAAAAGC CTGCAATCCT

251 TCCGCCTCGG CTGCGCCAAT TTGAAAAACC GCCAAGGCTG GCAGGATGTG

301 TGCGCCCAAG CCTTTCAAAC CCCCGTCCAT CCTTTTCAGG CAAAACAGTT

351 TTTTGAACGC TATTTCACGC CGTGGCAGGT TGCAGGCAAC GGAAGCCTTG

401 CCGGTACGGT TACCGGCTAT TACGAACCGG TGCTGAAGGG CGACGACAGG

451 CGGACGGCAC AAGCCCGCTT CCCGATTTAC GGTATTCCCG ACGATTTTAT

501 CTCCGTCCCC CTGCCTGCCG GTTTGCGGAG CGGAAAAGCC CTTGTCCGCA

551 TCAGGCAGAC GGGAAAAAAC AGCGGCACAA TCGACAATAC CGGCGGCACA

601 CATACCGCCG ACCTCTCCcG ATTCCCCATC ACCGCGCGCA CAACAGCAAT

651 CAAAGGCAGG TTTGAAGGAA GCCGCTTCCT CCCCTACCAC ACGCGCAACC

701 AAATCAACGG CGGCGCGCTT GACGGCAAAG CCCCGATACT CGGTTACGCC

751 GAAGACCCTG TCGAACTTTT TTTTATGCAC ATCCAAGGCT CGGGCCGTCT

801 GAAAACCCCG TCCGGCAAAT ACATCCGCAT CGGCTATGCC GACAAAAACG

851 AACATCCyTA CGTTTCCATC GGACGCTATA TGGCGGATAA GGGCTACCTC

901 AAACTCGGAC AAACCTCCAT GCAGGGCATT AAGTCTTATA TGCGGCAAAA

951 TCCGCAACGC CTCGCCGAAG TTTTGGGTCA AAACCCCAGC TATATCTTTT

1001 TCCGCGAGCT TGCCGGAAGC AGCAATGACG GCCCTGTCGG CGCACTGGGC

1051 ACGCCGCTGA TGGGGGAATA TGCCGGCGCA GTCGACCGGC ACTACATTAC

1101 CTTGGGTGCG CCCTTATTTG TCGCCACCGC CCATCCGGTT ACCCGCAAAG
```

```
1151  CCCTCAACCG CCTGATTATG GCGCAGGATA CCGGCAGCGC GATTAAAGGC

1201  GCGGTGCGCG TGGATTATTT TTGGGGATAC GGCGACGAAG CCGGCGAACT

1251  TGCCGGCAAA CAGAAAACCA CGGGATATGT CTGGCAGCTC CTACCCAACG

GTATGAAGCC CGAATACCGc CCGTAA
```

This corresponds to the amino acid sequence <SEQ ID 2792; ORF 919>:

```
m19.pep

1   MKKYLFRAAL YGIAAAILAA CQSKSIQTFP QPDTSVINGP DRPVGIPDPA

51   GTTVGGGGAV YTVVPHLSLP HWAAQDFAKS LQSFRLGCAN LKNRQGWQDV

101   CAQAFQTPVH SFQAKQFFER YFTPWQVAGN GSLAGTVTGY YEPVLKGDDR

151   RTAQARFPIY GIPDDFISVP LPAGLRSGKA LVRIRQTGKN SGTIDNTGGT

201   HTADLSRFPI TARTTAIKGR FEGSRFLPYH TRNQINGGAL DGKAPILGYA

251   EDPVELFFMH IQGSGRLKTP SGKYIRIGYA DKNEHPYVSI GRYMADKGYL

301   KLGQTSMQGI KSYMRQNPQR LAEVLQGNPS YIFFRELAGS SNDGPVGALG

351   TPLMGEYAGA VDRHYITLGA PLFVATAHPV TRKALNRLIM AQDTGSAIKG

401   AVRVDYFWGY GDEAGELAGK QKTTGYVWQL LPNGMKPEYR P*
```

Computer analysis of this amino acid sequence gave the following result:
Homology with a predicted ORF from N.gonorrhoeae
ORF 919 shows 95.9% identity over a 441 aa overlap with a predicted ORF(ORF 919.ng) from N. gonorrhoeae:

```
m919/g919
                  10         20         30         40         50         60
m919.pep  MKKYLFRAALYGIAAAILAACQSKSIQTFPQPDTSVINGPDRPVGIPDPAGTTVGGGGAV
          |||:|:|:|||||||||||||:|||||||||||||||||||:|||||||||:|||||
g919      MKKHLLRSALYGIAAAILAACQSRSIQTFPQPDTSVINGPDRPAGIPDPAGTTVAGGGAV
                  10         20         30         40         50         60

70         80         90        100        110        120
m919.pep  YTVVPHLSLPHWAAQDFAKSLQSFRLGCANLKNRQGWQDVCAQAFQTPVHSFQAKQFFER
          ||||||||:|||||||||||||||||||||||||||||||||||||||||||||:||||
g919      YTVVPHLSMPHWAAQDFAKSLQSFRLGCANLKNRQGWQDVCAQAFQTPVHSFQAKRFFER
                  70         80         90        100        110        120

130        140        150        160        170        180
m919.pep  YFTPWQVAGNGSLAGTVTGYYEPVLKGDDRRTAQARFPIYGIPDDFISVPLPAGLRSGKA
          |||||||||||||||||||||||||||||:||||||||||||||||||||||||||:||
g919      YFTPWQVAGNGSLAGTVTGYYEPVLKGDGRRTERARFPIYGIPDDFISVPLPAGLRGGKN
                 130        140        150        160        170        180

190        200        210        220        230        240
m919.pep  LVRIRQTGKNSGTIDNTGGTHTADLSRFPITARTTAIKGRFEGSRFLPYHTRNQINGGAL
          ||||||||||||||:|||||||||||||||||||||||||||||||||||||||||||
g919      LVRIRQTGKNSGTIDNAGGTHTADLSRFPITARTTAIKGRFEGSRFLPYHTRNQINGGAL
                 190        200        210        220        230        240

250        260        270        280        290        300
m919.pep  DGKAPILGYAEDPVELFFMHIQGSGRLKTPSGKYIRIGYADKNEHPYVSIGRYMADKGYL
          ||||||||||||||||||||||||||||||||||||||||||||||||||||||||||||
g919      DGKAPILGYAEDPVELFFMHIQGSGRLKTPSGKYIRIGYADKNEHPYVSIGRYMADKGYL
                 250        260        270        280        290        300

310        320        330        340        350        360
m919.pep  KLGQTSMQGIKSYMRQNPQRLAEVLQGNPSYIFFRELAGSSNDGPVGALGTPLMGEYAGA
          ||||||||||:|||||||||||||||||||||||||||:|:|||||||||||||||||
g919      KLGQTSMQGIKAYMRQNPQRLAEVLQGNPSYIFFRELAGSGNEGPVGALGTPLMGEYAGA
                 310        320        330        340        350        360

370        380        390        400        410        420
m919.pep  VDRHYITLGAPLFVATAHPVTRKALNRLIMAQDTGSAIKGAVRVDYFWGYGDEAGELAGK
          :|||||||||||||||||||||||||||||||||||||||||||||||||||||||||||
g919      IDRHYITLGAPLFVATAHPVTRKALNRLIMAQDTGSAIKGAVRVDYFWGYGDEAGELAGK
                 370        380        390        400        410        420

430        440
m919.pep  QKTTGYVWQLLPNGMKPEYRPX
          ||||||||||||||||||||||
g919      QKTTGYVWQLLPNGMKPEYRPX
                 430        440
```

The following partial DNA sequence was identified in *N. meningitidis* <SEQ ID 2793>:

```
a919.seq
    1 ATGAAAAAAT ACCTATTCCG

```
                    -continued
401 AVRVDYFWGY GDEAGELAGK QKTTGYVWQL LPNGMKPEYR P* m919/g919 98.6% identity in 441 aa overlap
                 10         20         30         40         50         60
   m919.pep  MKKYLFRAALYGIAAAILAACQSKSIQTFPQPDTSVINGPDRPVGIPDPAGTTVGGGGAV
             ||||||||| ||||||||||||||| |||||||||||||||| ||||||||| ||||||
      a919   MKKHLLRSALCGIAAAILAACQSRSIQTFPQPDTSVINGPDRPAGIPDPAGTTVAGGGAV
                 10         20         30         40         50         60

70         80         90        100        110        120
   m919.pep  YTVVPHLSLPHWAAQDFAKSLQSFRLGCANLKNRQGWQDVCAQAFQTPVHSFQAKQFFER
             |||||||| |||||||||||||||||||||||||||||||||||||||||| |||| ||
      a919   YTVVPHLSMPHWAAQDFAKSLQSFRLGCANLKNRQGWQDVCAQAFQTPVHSVQAKRFFER
                 70         80         90        100        110        120

130        140        150        160        170        180
   m919.pep  YFTPWQVAGNGSLAGTVTGYYEPVLKGDDRRTAQARFPIYGIPDDFISVPLPAGLRSGKA
             ||||||||||||||||||||||||||||| ||| |||||||||||||||||||||||| 
      a919   YFTPWQVAGNGSLAGTVTGYYEPVLKGDGRRTERARFPIYGIPDDFISVPLPAGLRSGKN
                130        140        150        160        170        180

190        200        210        220        230        240
   m919.pep  LVRIRQTGKNSGTIDNTGGTHTADLSRFPITARTTAIKGRFEGSRFLPYHTRNQINGGAL
             ||||||||||||||| |||||||||| :|||||||||||||||||||||||||||||||
      a919   LVRIRQTGKNSGTIDNAGGTHTADLSQFPITARTTAIKGRFEGSRFLPYHTRNQINGGAL
                190        200        210        220        230        240

250        260        270        280        290        300
   m919.pep  DGKAPILGYAEDPVELFFMHIQGSGRLKTPSGKYIRIGYADKNEHPYVSIGRYMADKGYL
             ||||||||||||||||||||||||||||||||||||||||||||||||||||||||||||
      a919   DGKAPILGYAEDPVELFFMHIQGSGRLKTPSGKYIRIGYADKNEHPYVSIGRYMADKGYL
                250        260        270        280        290        300

310        320        330        340        350        360
   m919.pep  KLGQTSMQGIKSYMRQNPQRLAEVLGQNPSYIFFRELAGSSNDGPVGALGTPLMGEYAGA
             ||||||||||| ||||||||||||||||||||||||: |||||||||||||||||||||
      a919   KLGQTSMQGIKAYMRQNPQRLAEVLGQNPSYIFFRELTGSSNDGPVGALGTPLMGEYAGA
                310        320        330        340        350        360

370        380        390        400        410        420
   m919.pep  VDRHYITLGAPLFVATAHPVTRKALNRLIMAQDTGSAIKGAVRVDYFWGYGDEAGELAGK
              ||||||||||||||||||||||||||||||||||||||||||||||||||||||||||
      a919   IDRHYITLGAPLFVATAHPVTRKALNRLIMAQDTGSAIKGAVRVDYFWGYGDEAGELAGK
                370        380        390        400        410        420

430        440
   m919.pep  QKTTGYVWQLLPNGMKPEYRPX
             ||||||||||||||||||||||
      a919   QKTTGYVWQLLPNGMKPEYRPX
                430        440
```

Expression of ORF 919

The primer described in Example 1 for ORF 919 was used to locate and clone ORF 919. This sequence was purified and expressed in *E. coli* as provided in FIG. 1 #. The hydrophilicity plots, antigenic index, and amphipatic regions of ORF 919 is provided in FIG. 5 #. The AMPHI program is used to predict putative T-cell epitopes (Gao et al 1989, *J. Immunol* 143:3007; Roberts et al. 1996, *AIDS Res Human Retroviruses* 12:593; Quakyi et al. 1992, *Scand J Immunol Suppl* 11:9). The nucleic acid sequence of ORF 919 is provided in Exhibit C #.

The following partial DNA sequence was identified in *N. gonorrhoeae* <SEQ ID 2795>:

```
g920.seq (partial)
   1 ..ccgatgcagc tggttaccga aaaAGGTAAG GAAAACATGA TTCAACGCGG

51    CACATACAAC TACCAATACC GCAGCAACCG TCCGGTCAAA GACGGCAGCT

101    ACCTCGTTAC CGCCGAATAT CAGCCTACTT TCCGGTCAAA AAACAAAGCA

151    GGCTGGAAAC AGGCTGGCAT CAAAGAAATG CCTGACGCAA GCTATTGCGA

201    ACAAACCCGT ATGTTCGGTA AAAACATTGT CAACGTGGGA CACGAAAGCG

251    CGGACACCGC CATCATCACC AAACCGGTCG ACAAAACTT GGAAATCGTC

301    CCGCTGGACA ATCccgccga caTTCACgtg ggctaacgCt tcaaaGTccg 351    cgttCtgttc cgtGGCgaac cgCTGcccaa tgccACCgtt accgCtacAT
```

-continued

```
401    TTGacggctt cGAcaccagc gaccgcagca aaacgcacaa Aaccgaagcc 451    caagcctTCT ccgacaccac cgacggcgaa ggcgaagtgg acatcatCCC 501    CTTGCgccaa GGCTTttgga aAgcGAGTGT CGAATAcaaa gccgAtttcc 551    CCGATcaaAG CCTGTGccga AAACAggcgA ACTACaCaac TTtaaccttc 601    caaatcgccc attctCacca tTAa
```

This corresponds to the amino acid sequence <SEQ ID 2796; ORF 920.ng>:

```
g920.pep (partial)
  1 ..PMQLVTEKGK ENMIQRGTYN YQYRSNRPVK DGSYLVTAEY QPTFRSKNKA

51    GWKQAGIKEM PDASYCEQTR MFGKNIVNVG HESADTAIIT KPVGQNLEIV

101    PLDNPADIHV GXRFKVRVLF RGEPLPNATV TATFDGFDTS DRSKTHKTEA

151    QAFSDTTDGE GEVDIIPLRQ GFWKASVEYK ADFPDQSLCR KQANYTTLTF

201    QIAHSHH*
```

The following partial DNA sequence was identified in *N. meningitidis* <SEQ ID 2797>:

```
m920.seq
  1 ATGAAGAAAA CATTGACACT GCTCTCCGTT TCCGCCCTAT TGCCACATC

51 CGCCCACGCC CACCGmGTCT GGGTCGAAAC CGCCCACACG CACGGCGGCG

101 AATACCTTAA AGCCGACTTG GGCTACGGCG AATTTCCCGA ACTCGAACCC

151 ATCGCCAAAG ACCGCCTGCA CATCTTCAGC AAACCGATGC AGCTGGTTAC

201 CGAAAAGGC AAGGAAAACA TGATTCAACG CGGCACATAC AACTACCAGT

251 ACCGAAGCAA CCGTCCCGTT AAGGACGGCA GTTACCTCGT CATCGCCGAA

301 TATCAGCCTA CTTTCTGGTC AAAAwACAAA GCAGGCTGGA AACAGGCGGG

351 CATCAAAGAA ATGCCTGACG CAAGCTATTG CGAACAAACC CGAATGTTCG

401 GCAAAAACAT CGTCAACGTC GGACACGAAA GCGCGGACAC CGCCATCATC

451 ACCAArCCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC CAATGCCACC GTTACCGCCA CCTTTGACGG CTTCGACACC

601 AGCGACCGCA GCAAAACGCA CAAwmCCGAA GCACAGGCTT TCTCCGACAG

651 CACAGACGAC AAAGGCGAAG TGGACATCAT CmCCTTGCGC CAAGGCTTCT

701 GGAAAGCCAA TGTCGAACAC AAAACCGACT TCCCCGATCA AAGCGTGTGC

751 CAAAAACAGG CGAACTACTC GACTTTAACC TTCCAAATCG GTCATTCGCA

801 CCATTAA
```

This corresponds to the amino acid sequence <SEQ ID 2798; ORF 920>:

```
m920.pep
  1 MKKTLTLLSV SALFATSAHA HRVWVETAHT HGGEYLKADL GYGEFPELEP

51    IAKDRLHIFS KPMQLVTEKG KENMIQRGTY NYQYRSNRPV KDGSYLVIAE

101    YQPTFWSKXK AGWKQAGIKE MPDASYCEQT RMFGKNIVNV GHESADTAII

151    TKPVGQNLEI VPLDNPANIH VGERFKVRVL FRGEPLPNAT VTATFDGFDT
```

```
201 SDRSKTHXXE AQAFSDSTDD KGEVDIIXLR QGFWKANVEH KTDFPDQSVC

251 QKQANYSTLT FQIGHSHH*
```

Computer analysis of this amino acid sequence gave the following results:
Homology with a Predicted ORF from *N. gonorrhoeae*
ORF 920 shows 91.3% identity over a 207 aa overlap with a predicted ORF (ORF 920.ng) from *N. gonorrhoeae*:

```
    g920/m920

10        20        30
        g920.pep                   PMQLVTEKGKENMIQRGTYNYQYRSNRPVK
                                   ||||||||||||||||||||||||||||||
        m920     GGEYLKADLGYGEFPELEPIAKDRLHIFSKPMQLVTEKGKENMIQRGTYNYQYRSNRPVK
                     40        50        60        70        80        90
                 40        50        60        70        80        90
        g920.pep DGSYLVTAEYQPTFRSKNKAGWKQAGIKEMPDASYCEQTRMFGKNIVNVGHESADTAIIT
                 ||||||  ||||||| ||  ||||||||||||||||||||||||||||||||||||||||
        m920     DGSYLVIAEYQPTFWSKXKAGWKQAGIKEMPDASYCEQTRMFGKNIVNVGHESADTAIIT
                    100       110       120       130       140       150
                  100       110       120       130       140       150
        g920.pep KPVGQNLEIVPLDNPADIHVGXRFKVRVLFRGEPLPNATVTATFDGFDTSDRSKTHKTEA
                 |||||||||||||||| |||| ||||||||||||||||||||||||||||||||| :||
        m920     KPVGQNLEIVPLDNPANIHVGERFKVRVLFRGEPLPNATVTATFDGFDTSDRSKTHXXEA
                    160       170       180       190       200       210
                  160       170       180       190       200
        g920.pep QAFSDTTDGEGEVDIIPLRQGFWKASVEYKADFPDQSLCRKQANYTTLTFQIAHSHHX
                 |||||:|| :||||| |||||||||:||:|:||||||| |||||| ||||||:||||
        m920     QAFSDSTDDKGEVDIIXLRQGFWKANVEHKTDFPDQSVCQKQANYSTLTFQIGHSHHX
                    220       230       240       250       260
```

The following partial DNA sequence was identified in *N. meningitidis* <SEQ ID 2799>:

```
a920.seq
   1 TGAAAGAAAA CATTGACACT GCTCGCCGTT TCCGCCCTAT TTGCCGCATC

51 CGCCCACGCC CACCGCGTCT GGGTCGAAAC CGCCCACACG CACGGCGGCG

101 AATACCTTAA AGCCGACTTG GGCTACGGCG AATTTCCCGA ACTCGAACCC

151 ATCGCCAAAG ACCGCCTGCA CATCTTCAGC AAACCGATGC AGCTGGTTAC

201 CGAAAAAGGC AAGGAAAACA TGATTCAACG CGGCACATAC AACTACCAGT

251 ACCGAAGCAA CCGTCCCGTT AAGGACGGCA GTTACCTCGT CATCGCCGAA

301 TATCAGCCTA CTTTCTGGTC AAAAAACAAA GCAGGCTGGA AACAGGCGGG

351 CATCAAACAA ATGCCTGACG CAAGCTATTG CGAACAAACC CGAATGTTCG

401 GCAAAAACAT CGTCAACGTC GGACACGAAA GCGCGGACAC CGCCATCATC

451 ACCAAACCGG TCGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC CAATGCCACC GTTACCGCCA CCTTTGACGG CTTCGACACC

601 AGCGACCGCA GCAAAACGCA CAAAACCGAA GCACAGGCTT TCTCCGACAG

651 CACAGACGAC AAAGGCGAAG TGGACATCAT CCCCTTGCGC CAAGGCTTCT

701 GGAAAGCCAA TGTCGAACAC AAAGCCGACT TCCCCGATCA AAGCGTGTGC

751 CAAAACAGG CGAACTACTC GACTTTAACC TTCCAAATCG GCCATTCGCA

801 CCATTAA
```

This corresponds to the amino acid sequence <SEQ ID 2800; ORF 920.a>:

```
a920.pep
   1 *KKTLTLLAV SALFAASAHA HRVWVETAHT HGGEYLKADL GYGEFPELEP

51 IAKDRLHIFS KPMQLVTEKG KENMIQRGTY NYQYRSNRPV KDGSYLVIAE

101 YQPTFWSKNK AGWKQAGIKQ MPDASYCEQT RMFGKNIVNV GHESADTAII

151 TKPVGQNLEI VPLDNPANIH VGERFKVRVL FRGEPLPNAT VTATFDGFDT

201 SDRSKTHKTE AQAFSDSTDD KGEVDIIPLR QGFWKANVEH KADFPDQSVC

251 QKQANYSTLT FQIGHSHH*
``` m920/a920 97.0% identity in 267 aa overlap

```
                  10         20         30         40         50         60
    m920.pep  MKKTLTLLSVSALFATSAHAHRVWETAHTHGGEYLKADLGYGEFPELEPIAKDRLHIFS
              ||||||||:||||||:||||||||||||||||||||||||||||||||||||||||||
        a920  XKKTLTLLAVSALFAASAHAHRVWETAHTHGGEYLKADLGYGEFPELEPIAKDRLHIFS
                  10         20         30         40         50         60

70         80         90        100        110        120
    m920.pep  KPMQLVTEKGENMIQRGTYNYQYRSNRPVKDGSYLVIAEYQPTFWSKXKAGWKQAGIKE
              ||||||||||||||||||||||||||||||||||||||||||||||| :|||||||||:
        a920  KPMQLVTEKGENMIQRGTYNYQYRSNRPVKDGSYLVIAEYQPTFWSKNKAGWKQAGIKQ
                  70         80         90        100        110        120

130        140        150        160        170        180
    m920.pep  MPDASYCEQTRMFGKNIVNVGHESADTAIITKPVGQNLEIVPLDNPAIHVGERFKVRVL
              ||||||||||||||||||||||||||||||||||||||||||||||||||||||||||
        a920  MPDASYCEQTRMFGKNIVNVGHESADTAIITKPVGQNLEIVPLDNPAIHVGERFKVRVL
                 130        140        150        160        170        180

190        200        210        220        230        240
    m920.pep  FRGEPLPNATVTATFDGFDTSDRSKTHXXEAQAFSDSTDDKGEVDIIXLRQGFWKANVEH
              ||||||||||||||||||||||||||| :|||||||||||||||||| ||||||||||
        a920  FRGEPLPNATVTATFDGFDTSDRSKTHKTEAQAFSDSTDDKGEVDIIPLRQGFWKANVEH
                 190        200        210        220        230        240

250        260      269
    m920.pep  KTDFPDQSVCQKQANYSTLTFQIGHSHHX
              |:|||||||||||||||||||||||||||
        a920  KADFPDQSVCQKQANYSTLTFQIGHSHHX
                 250        260
```

The following partial DNA sequence was identified in *N. gonorrhoeae* <SEQ ID 2801>:

```
g920-1.seq
   1 ATGAAGAAAA CATTGACACT GCTCGCcgtt TcCGCACTAT TTGCCACATc 51 cgCaCACCCC CACCgCGTCT GGGTCGAAAC CgccCACACg cAcgGCGGCG

101 AATACCTTAA AGCCGACTTG GGCTACGGCG AATTCCCCGA ACTCGAACCC

151 ATCGccAAAG ACCgccTGCA CATCTTCAGC AAACCGATGC AGCTGGTTAC

201 CGAAAAAGGT AAGGAAAACA TGATTCAACG CGGCACATAC AACTACCAAT

251 ACCGCAGCAA CCGTCCCGTC AAAGACGGCA GCTACCTCGT TACCGCCGAA

301 TATCAGCCTA CTTTCCGGTC AAAAAACAAA GCAGGCTGGA AACAGGCTGG

351 CATCAAAGAA ATGCCTGACG CAAGCTATTG CGAACAAACC CGTATGTTCG

401 GTAAAAACAT TGTCAACGTG GGACACGAAA GCGCGGACAC CGCCATCATC

451 ACCAAACCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC AATGCCACC GTTACCGCTA CATTTGACGG CTTCGACACC

601 AGCGACCGCA GCAAAACGCA CAAAACCGAA GCCCAAGCCT TCTCCGACAC
```

```
-continued
651 CACCGACGGC AAAGGCGAAG TGGACATCAT CCCCTTGCGC CAAGGCTTTT

701 GGAAAGCGAG TGTCGAATAC AAAGCCGATT TCCCCGATCA AAGCCTGTGC

751 CAAAAACAGG CGAACTACAC AACTTTAACC TTCCAAATCG GCCATTCTCA

801 CCATTAA
```

This corresponds to the amino acid sequence <SEQ ID 2802; ORF 920-1.ng>:

```
g920-1.pep
  1 MKKTLTLLAV SALFATSAHP HRVWVETAHT HGGEYLKADL GYGEFPELEP

51 IAKDRLHIFS KPMQLVTEKG KENMIQRGTY NYQYRSNRPV KDGSYLVTAE

101 YQPTFRSKNK AGWKQAGIKE MPDASYCEQT RMFGKNIVNV GHESADTAII

151 TKPVGQNLEI VPLDNPANIH VGERFKVRVL FRGEPLPNAT VTATFDGFDT

201 SDRSKTHKTE AQAFSDTTDG KGEVDIIPLR QGFWKASVEY KADFPDQSLC

251 QKQANYTTLT FQIGHSHH*
```

The following partial DNA sequence was identified in *N. meningitidis* <SEQ ID 2803>:

```
m920-1.seq
  1 ATGAAGAAAA CATTGACACT GCTCGCCGTT TCCGCCCTAT TTGCCACATC

51 CGCCCACGCC CACCGCGTCT GGGTCGAAAC CGCCCACACG CACGGCGGCG

101 AATACCTTAA AGCCGACTTG GGCTACGGCG AATTTCCCGA ACTCGAACCC

151 ATCGCCAAAG ACCGCCTGCA CATCTTCAGC AAACCGATGC AGCTGGTTAC

201 CGAAAAAGGC AAGGAAAACA TGATTCAACG CGGCACATAC AACTACCAGT

251 ACCGAAGCAA CCGTCCCGTT AAGGACGGCA GTTACCTCGT CATCGCCGAA

301 TATCAGCCTA CTTTCTGGTC AAAAAACAAA GCAGGCTGGA AACAGGCGGG

351 CATCAAAGAA ATGCCTGACG CAAGCTATTG CGAACAAACC CGAATGTTCG

401 GCAAAAACAT CGTCAACGTC GGACACGAAA GCGCGGACAC CGCCATCATC

451 ACCAAACCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC AATGCCACC GTTACCGCCA CCTTTGACGG CTTCGACACC

601 AGCGACCGCA GCAAAACGCA CAAAACCGAA GCACAGGCTT TCTCCGACAG

651 CACAGACGAC AAAGGCGAAG TGGACATCAT CCCCTTGCGC CAAGGCTTCT

701 GGAAAGCCAA TGTCGAACAC AAAACCGACT TCCCCGATCA AAGCGTGTGC

751 CAAAAACAGG CGAACTACTC GACTTTAACC TTCCAAATCG GTCATTCGCA

801 CCATTAA
```

This corresponds to the amino acid sequence <SEQ ID 2804; ORF 920-1>:

```
m920-1.pep
  1 MKKTLTLLAV SALFATSAHA HRVWVETAHT HGGEYLKADL GYGEFPELEP

51 IAKDRLHIFS HRVWVETAHT KENMIQRGTY NYQYRSNRPV KDGSYLVIAE

101 YQPTFWSKNK AGWKQAGIKE MPDASYCEQT RMFGKNIVNV GHESADTAII
```

```
    151  TKPVGQNLEI VPLDNPANTH VGERFKVRVL FRGEPLPNAT VTATFDGFDT

201  SDRSKTHKTE AQAFSDSTDD KGEVDIIPLR QGFWKANVEH KTDFPDQSVC

251  QKANYSTLT FQIGHSHH* m920-1/g920-1 96.3% identity in 268 aa overlap 10         20         30         40         50         60
m920-1.pep   MKKTLTLLAVSALFATSAHAHRVWVETAHTHGGEYLKADLGYGEFPELEPIAKDRLHIFS
             ||||||||||||||||||| |||||||||||||||||||||||||||||||||||||||
g920-1       MKKTLTLLAVSALFATSAHPHRVWVETAHTHGGEYLKADLGYGEFPELEPIAKDRLHIFS
                     10         30         30         40         50         60

70         80         90        100        110        120
m920-1.pep   KPMQLVTEKGKENMIQRGTYNYQYRSNRPVKDGSYLVIAEYQPTFQSKNKAGWKQAGIKE
             ||||||||||||||||||||||||||||||||||||| |||||||:|||||||||||||
g920         KPMQLVTEKGKENMIQRGTYNYQYRSNRPVKDGSYLVTAEYQPTFRSKNKAGWKQAGIKE
                     70         90         90        100        110        120

130        140        150        160        170        180
m920-1.pep   MPDASYCEQTRMFGKNIVNVGHESADTAIITKPVGQNLEIVPLDNPAHIHVGERFKVRVL
             |||||||||||||||||||||||||||||||||||||||||||||| ||||||||||||
             MPDASYCEQTRMFGKNIVNVGHESADTAIITKPVGQNLEIVPLDNPANIHVGERFKVRVL
                    130        140        150        160        170        180

190        200        210        220        230        240
m920-1.pep   FRGEPLPNATVTATFDGFDTSGRSKTHKTEAQAFSDSTDDKGEVDIIPLRQGFWKANVEH
             ||||||||||||||||||||||||||||||||||||:|| ||||||||||||||:||:|
g920-1       FRGEPLPNATVTATFDGFDTSGRSKTHKTEAQAFSDTTDKGEVDIIPLRQGFWKASVEY
                    190        200        210        220        230        240

250        260     269
m920-1.pep   KTDFPDQSVCQKQANYSTLTFQIGHSHHX
             |:||||||:|||||||:||||||||||||
g920-1       KADFPDQSLCQKQANYTLTFQIGHSHHX
                    250        260
```

The following partial DNA sequence was identified in *N. meningitidis* <SEQ ID 2805>:

```
a920.seq
  1 TGAAAGAAAA CATTGACACT GCTCGCCGTT TCCGCCCTAT TTGCCGCATC

51 CGCCCACGCC CACCGCGTCT GGGTCGAAAC CGCCCACACG CACGGCGGCG

101 AATACCTTAA AGCCGACTTG GGCTACGGCG AATTTCCCGA ACTCGAACCC

151 ATCGCCAAAG ACCGCCTGCA CATCTTCAGC AAACCGATGC AGCTGGTTAC

201 CGAAAAGGC AAGGAAAACA TGATTCAACG CGGCACATAC AACTACCAGT

251 ACCGAAGCAA CCGTCCCGTT AAGGACGGCA GTTACCTCGT CATCGCCGAA

301 TATCAGCCTA CTTTCTGGTC AAAAAACAAA GCAGGCTGGA AACAGGCGGG

351 CATCAAACAA ATGCCTGACG CAAGCTATTG CGAACAAACC CGAATGTTCG

401 GCAAAAACAT CGTCAACGTC GGACACGAAA GCGCGGACAC CGCCATCATC

451 ACCAAACCGG TCGGACAAAA CTTGGAAATC GTCCCGCTGG ACAATCCCGC

501 CAACATTCAC GTAGGCGAAC GCTTCAAAGT CCGCGTTCTG TTCCGTGGCG

551 AACCGCTGCC CAATGCCACC GTTACCGCCA CCTTTGACGG CTTCGACACC

601 AGCGACCGCA GCAAAACGCA CAAAACCGAA GCACAGGCTT TCTCCGACAG

651 CACAGACGAC AAAGGCGAAG TGGACATCAT CCCCTTGCGC CAAGGCTTCT

701 GGAAAGCCAA TGTCGAACAC AAAGCCGACT TCCCCGATCA AAGCGTGTGC

751 CAAAAACAGG CGAACTACTC GACTTTAACC TTCCAAATCG GCCATTCGCA

801 CCATTAA
```

This corresponds to the amino acid sequence <SEQ ID 2806; ORF 920-1.a>:

```
A920.pep

1  *KKTLTLLAV SALFAASAHA HRVWVETAHT HGGEYLKADL GYGEFPELEP
    51  IAKDLRHIFS KPMQLVTEKG KENMIQRGTY NYQYRSNRPV KDGSYLVIAE
   101  YQPTFWSKNK AGWKQAGIKQ MPDASYCEQT RMFGKNIVNY GHESADTAII
   151  TKPVGQNLEI VPLDNPANIH VGERFKVRVL FRGEPLPNAT VTATFDGFDT
   201  SDRSKTHKTE AQAFSDSTDD KGEVDIIPLR QGFWKANVEH KADFPDQSVC
   251  QKQANYSTLT FQIGHSHH* m920-1/a920 98.9% identity in 268 aa overlap 10        20        30        40        50        60
  m920-1.pep  MKKTLTLLAVSALFATSAHAHRVWVETAHTHGGEYLKADLGYGEFPELEPIAKDRLHIFS
              |||||||||||||||:||||||||||||||||||||||||||||||||||||||||||||
  a920-1      MKKTLTLLAVSALFAASAHAHRVWVETAHTHGGEYLKADLGYGEFPELEPIAKDRLHIFS
                   10        20        30        40        50        60

70        80        90       100       110       120
  m920-1.pep  KPMQLVTEKGKENMIQRGTYNYQYRSNRPVKDGSYLVIAEYQPTFWSKNKAGWKQAGIKE
              |||||||||||||||||||||||||||||||||||||||||||||:||||||||||||||:
  a920-1      KPMQLVTEKGKENMIQRGTYNYQYRSNRPVKDGSYLVIAEYQPTFRSKNKAGWKQAGIKQ
                   70        80        90       100       110       120

130       140       150       160       170       180
  m920-1.pep  MPDASYCEQTRMFGKNIVNVGHESADTAIITKPVGQNLEIVPLDNPANIHVGERFKVRVL
              ||||||||||||||||||||||||||||||||||||||||||||||||||||||||||||
  a920-1      MPDASYCEQTRMFGKNIVNVGHESADTAIITKPVGQNLEIVPLDNPANIHVGERFKVRVL
                  130       140       150       160       170       180

190       200       210       220       230       240
  m920-1.pep  FRGEPLPNATVTATFDGFDTSDRSKTHKTEAQAFSDSTDDKGEVDIIPLRQGFWKANVEH
              ||||||||||||||||||||||||||||||||||||||||||||||||||||||||||||
  a920-1      FRGEPLPNATVTATFDGFDTSDRSKTHKTEAQAFSDSTDDKGEVDIIPLRQGFWKANVEH
                  190       200       210       220       230       240

250       260   269
  m920-1.pep  KTDFPDQSVCQKQANYSTLTFQIGHSHHX
              |||||||||||||||||||||||||||||
  a920-1      KADFPDQSVCQKQANYSTLTFQIGHSHHX
                  250       260
```

The following partial DNA sequence was identified in *N. gonorrhoeae* <SEQ ID 2807>:

```
g921.seq
   1  ATGAAAAAAT ACCTTATCCC TCTTTCCATT GCGGCAGTCC TTTCCGgtG
  51  CcagtctattatGtgccca cattgacggA aatcccgTg aatcccatca
 101  ataCCgtcaa aacggaagCA CCTGCAAAAG GTTTTCGCCT CGCCCCTTCG
 151  CATTGGGCGG ATGTTGCCAA AATCAGCGAT GAAGCGACGC GCTTGGGCTA
 201  TCAGGTGGGT ATCGGTAAAA TGACCAAGGT TCAGGcgGCG CAATATCTGA
 251  ACAACTTCAG AAAACGCCTG GTCGGACGCA ATGCCGTCGA TGACAGTATG
 301  TATGAAATCT ACCTGCGTTC GGCGGTAGAC AGCCAGCGCG GCGAAATCAA
 351  TACGGAACAG TCCAAGCTGT ATATCGAGAA TGCCTTGCGC GGCTGGCAGC
 401  AGCGTtggAA AAATATGGAT GCCAAACCCG ATAATCCCGC ATTTACCAAC
 451  TTTTTGATGG AAGTGATGAA GATGCAGCCC TTGAAATGA
```

This corresponds to the amino acid sequence <SEQ ID 2808; ORF 921.ng>:

```
g921.pep
   1  MKKYLIPLSI AAVLSGCQSI YVPTLTEIPV NPINTVKTEA PAKGFRLAPS
  51  HWADVAKISD EATRLGYQVG IGKMTKVQAA QYLNNFRKRL VGRNAVDDSM
```

```
101 YEIYLRSAVD SQRGEINTEQ SKLYIENALR GWQQRWKNMD AKPDNPAFTN

151 FLMEVMKMQP LK*
```

The following partial DNA sequence was identified in *N. meningitidis* <SEQ ID 2809>:

```
m921.seq
  1 ATGAAAAAAT ACCTTATCCC TCTTTCCATT GCGGCAGTTC TTTCCGGCTG

51 CCAGTCTATT TATGTGCCCA CATTGACGGA AATCCCCGTG AATCCTATCA

101 ATACCGTCAA AACGGAAGCA CCTGCAAAAG GTTTCCGCCT TGCCTCTTCG

151 CATTGGACGG ATGTTGCCAA AATCAGCGAT GAAGCGACGC GCTTGGGCTA

201 TCAGGTGGGT ATCGGTAAAA TGACCAAGGT TCAGGCGGCG CAATATCTGA

251 ACAACTTCAG AAAACGCCTG GTCGGACGCA ATGCCGTCGA TGACAGTATG

301 TATGAAATCT ACCTGCGTTC GGCGATAGAC AGCCAGCGGG GCGCAATCAA

351 TACGGAACAG TCCAAGCTGT ATATCCAGAA TGCCTTGCGC GGCTGGCAGC

401 AGCGTTGGAA AAATATGGAT GTCAAACCCA ACAACCCCGC ATTTACCAAC

451 TTTTTGATGG AAGTGATGAA GATGCAGCCC TTGAAATGA
```

This corresponds to the amino acid sequence <SEQ ID 2810; ORF 921>:

```
m921.pep
  1 MKKYLIPLSI AAVLSGCQSI YVPTLTEIPV NPINTVKTEA PAKGFRLASS

51 HWTDVAKISD EATRLGYQVG IGKMTKVQAA QYLNNFRKRL VGRNAVDDSM

101 YEIYLRSAID SQRGAINTEQ SKLYIQNALR GWQQRWKNMD VKPNNPAFTN

151 FLMEVMKMQP LK*
```

Computer analysis of this amino acid sequence gave the following results:
Homology with a Predicted ORF from *N. gonorrhoeae*
ORF 921 shows 95.7% identity over a 162 aa overlap with a predicted ORF (ORF 921.ng) from *N. gonorrhoeae*:

```
m921/g921
                    10         20         30         40         50         60
     m921.pep MKKYLIPLSIAAVLSGCQSIYVPTLTEIPVNPINTVKTEAPAKGFRLASSHWTDVAKISD
              |||||||||||||||||||||||||||||||||||||||||||||||||:|||||||
         g921 MKKYLIPLSIAAVLSGCQSIYVPTLTEIPVNPINTVKTEAPAKGFRLAPSHWADVAKISD
                    10         20         30         40         50         60

70         80         90        100        110        120
     m921.pep EATRLGYQVGIGKMTKVQAAQYLNNFRKRLVGRNAVDDSMYEIYLRSAIDSQRGAINTEQ
              ||||||||||||||||||||||||||||||||||||||||||||||||:|||| |||||
         g921 EATRLGYQVGIGKMTKVQAAQYLNNFRKRLVGRNAVDDSMYEIYLRSAVDSQRGEINTEQ
                    70         80         90        100        110        120

130        140        150        160
     m921.pep SKLYIQNALRGWQQRWKNMDVKPNNPAFTNFLMEVMKMQPLKX
              ||||:||||||||||||||||::||||||||||||||||||||
         g921 SKLYIENALRGWQQRWKNMDAKPDNPAFTNFLMEVMKMQPLKX
                   130        140        150        160
```

The following partial DNA sequence was identified in *N. meningitidis* <SEQ ID 2811>:

```
a921.seq
    1 ATGAAAAAAT ACCTTATCCC TCTTTCCATT GTGGCAGTTC TTTCCGGCTG

51 CCAGTCTATT TATGTGCCCA CATTGACGGA AATCCCCGTG AATCCTATCA

101 ATACCGTCAA AACGGAAGCA CCTGCAAAAG GTTTCCGCCT TGCCTCTTCG

151 CATTGGACGG ATGTTGCCAA AATCAGCGAT GAAGCGACGC GCTTGGGCTA

201 TCAGGTGGGT ATCGGTAAAA TGACCAAGGT TCAGGCGGCG CAATATCTGA

251 ACAACTTCAG AAAACGCCTG GTCGGACGCA ATGCCGTCGA TGACAGTATG

301 TATGAAATCT ACCTGCGTTC GGCGATAGAC AGCCAGCGGG GCGCAATCAA

351 TACGGAACAG TCCAAGCTGT ATATCCAGAA TGCCTTGCGC GGCTGGCAGC

401 AGCGTTGGAA AAATATGGAT GTCAAACCCA ACAACCCCGC ATTTACCAAC

451 TTTTTGATGG AAGTGATGAA GATGCAGCCC TTGAAATGA
```

This corresponds to the amino acid sequence <SEQ ID 2812; ORF 921.a>:

```
a921.pep
    1 MKKYLIPLSI VAVLSGCQSI YVPTLTEIPV NPINTVKTEA PAKGFRLASS

51 HWTDVAKISD EATRLGYQVG IGKMTKVQAA QYLNNFRKRL VGRNAVDDSM

101 YEIYLRSAID SQRGAINTEQ SKLYIQNALR GWQQRWKNMD VKPNNPAFTN

151 FLMEVMKMQP LK*
``` m921/a921 99.4% identity in 162 aa overlap

```
                  10         20         30         40         50         60
   m921.pep  MKKYLIPLSIAAVLSGCQSIYVPTLTEIPVNPINTVKTEAPAKGFRLASSHWTDVAKISD
             |||||||||| :||||||||||||||||||||||||||||||||||||||||||||||||
       a921  MKKYLIPLSIVAVLSGCQSIYVPTLTEIPVNPINTVKTEAPAKGFRLASSHWTDVAKISD
                  10         20         30         40         50         60

70         80         90        100        110        120
   m921.pep  EATRLGYQVGIGKMTKVQAAQYLNNFRKRLVGRNAVDDSMYEIYLRSAIDSQRGAINTEQ
             ||||||||||||||||||||||||||||||||||||||||||||||||||||||||||||
       a921  EATRLGYQVGIGKMTKVQAAQYLNNFRKRLVGRNAVDDSMYEIYLRSAIDSQRGAINTEQ
                  70         80         90        100        110        120

130        140        150        160
   m921.pep  SKLYIQNALRGWQQRWKNMDVKPNNPAFTNFLMEVMKMQPLKX
             ||||||||||||||||||||||||||||||||||||||||||
       a921  SKLYIQNALRGWQQRWKNMDVKPNNPAFTNFLMEVMKMQPLKX
                 130        140        150        160
```

The following partial DNA sequence was identified in *N. gonorrhoeae* <SEQ ID 2813>:

```
g922.seq
    1 ATGGAAAAGA GAAAAATACT GCCGCTGGCA ATTTGTTTGG CGGCTTTGTC

51 TGCCTGTACG GCGATGGAGG CCCGCACACC CCGGGCAAAT GAAGCCCAAG

101 CCCCCCGCGC GGATGAAATG AAAAAAGAAA GCCGCCCCGC GTTTGACGCG

151 GCAGCCGTAC CGGTATCCGA CAGCGGGTTT GCCGCCAATG CAAATGTCCG

201 CCGTTTTGTG GACGATGAAG TCGGGAAAGG GGATTTTTCC CAGGCGGAAT

251 GGCAGGATTT TTTTGACAAA GCGGCTTACA AGGCGGACAT CGTCAAGATt
```

-continued

```
 301 ATGCACCGAC CCTCCACATC GCGtCCGTGG TATGtgttcc gCacggGAAa 351 ttcGGgcagg gcgaaAtttc ACggcgCGCG Caggttttat GcggaaAacc 401 gcgcggttat cgatgatgtg gcgCAAAAat acggcgtGCC TGCCGAGCTT

451 ATCGTGGCGA TTATCGGGAT TGAAACGAAT TACGGCAAAA ATACGGGCAG

501 TTTCCGTGTG GCGGACGCAT TGGCGACTTT AGGCTTTGAT TATCCCCGCC

551 GCGCCGGGTT TTTCCAAAAA GAATTGGTCG AGCTTTTAAA GCTGGCAAAA

601 GAAGAAGGCG GTGATGTTTT CGCCTTTAAG GGCagcTATG CGGGTGCAAT

651 GGGTATGCCG CAATTTATGC CTTCGAGCTA CCGGAAATGG GCGGTGGATT

701 ATGAcgggga cggacatCGG GATATAtggg GCAACGTcgg tgatgtcgcg 751 gcatcggTTG CCAATTAtat gaagCAGCAC GGTTGGCGCA CgggcggtAA 801 AATGTTGGTG TCGGCGAcgt tggcgccggg tgcggATGTT CAggcAATCA 851 TTGGCGAAAA AACCGCCCTG ACGCGGACGG TGGCGGATTT GAaggCGTAc 901 ggcatcatcc ccggggaaaC GCTCGCAGAT GATGAAAAGg cgGTTTTGTT

951 CAAACTGGAA ACCGCACCCG GCGTGTTTGA ATATTATTTG GGCTTGAACA

1001 ATTTTTATAC GGTATGGCAG TACAACCACA GCCGGATGTA TGTAACGgcg 1051 gtcaggGACA TTGCCAATTC GCTCGGCGGC CCGGGATTGT Aa
```

This corresponds to the amino acid sequence <SEQ ID 2814; ORF 922.ng>:

```
g922.pep
  1 MEKRKILPLA ICLAALSACT AMEARTPRAN EAQAPRADEM KKESRPAFDA

51 AAVPVSDSGF AANANVRRFV DDEVGKGDFS QAEWQDFFDK AAYKADIVKI

101 MHRPSTSRPW YVFRTGNSGR AKFHGARRFY AENRAVIDDV AQKYGVPAEL

151 IVAIIGIETN YGKNTGSFRV ADALATLGFD YPRRAGFFQK ELVELLKLAK

201 EEGGDVFAFK GSYAGAMGMP QFMPSSYRKW AVDYDGDGHR DIWGNVGDVA

251 ASVANYMKQH GWRTGGKMLV SATLAPGADV QAIIGEKTAL TRTVADLKAY

301 GIIPGETLAD DEKAVLFKLE TAPGVFEYYL GLNNFYTVWQ YNHSRMYVTA

351 VRDIANSLGG PGL*
```

45

The following partial DNA sequence was identified in *N. meningitidis* <SEQ ID 2815>:

```
m922.seq
  1 ATGAAAAAGA GAAAAATACT GCCGCTGGCA ATTTGTTTGG CGGCTTTGTC

51 TGCCTGTACG GCGATGGAGG CACGCCCACC CCGGGCAAAT GAAGCCCAAG

101 CCCCCCGCGC GGTTGAAATG AAAAAAGAAA GCCGCCCCGC GTTTGACGCG

151 GCAGCCGTAT TTGACGCGGC AGCCGTACCG GTATCCGACA GCGGGTTTGC

201 CGCCAATGCA AATGTCCGCC GTTTTGTGGA CGATGAAGTC GGGAAAGGGG

251 ATTTTTCCCG GGCGGAATGG CAGGATTTTT TTGACAAAGC GGCTTACAAG

301 GCGGACATCG TCAAGATTAT GCACCGCCCC TCCACATCGC GTCCGTGGTA

351 TGTGTTCCGC ACGGGAAATT CGGGCAAGGC GAAATTTCGC GGCGCGCGCC

401 GGTTTTATGC GGAAAACCGC GCGCTTATCG ATGATGTGGC GCAAAAATAC

451 GGCGTGCCTG CCGAACTTAT CGTGGCGGTT ATCGGGATTG AAACGAATTA
```

```
-continued
 501 CGGCAAAAAT ACGGGCAGTT TCCGTGTGGC GGACGCATTG GCGACCTTAG

551 GCTTTGATTA CCCCCGCCGC GCCGGGTTTT TCCAAAAAGA ATTGGTCGAG

601 CTTTTAAAGC TGGCAAAAGA AGAAGGCGGC GATGTTTTCG CCTTTAAAGG

651 CAGCTATGCG GGCGCAATGG GGATGCCGCA ATTTATGCCT TCGAGCTACC

701 GGAAATGGGC GGTGGATTAT GACGGGACG GACATCGGGA CATATGGGGC

751 AACGTCGGCG ATGTCGCGGC ATCGGTTGCC AATTATATGA AGCAGCACGG

801 TTGGCGCACG GGCGGGAAAA TGCTGGTGTC TGCAACATTG GCGCCGGGTG

851 CGGATGTTCA GGCAATCATT GGCGAAAAAA CCGCCCTGAC GCGGACGGTG

901 GCGGATTTGA AGGCGTACGG CATCATCCCC GGCGAAGAGC TTGCAGATGA

951 TGAAAAGGCG GTTTTGTTCA AACTGGAAAC CGCACCGGGC GTGTTTGAAT

1001 ATTATTTGGG CTTGAACAAT TTTTATACGG TATGGCAGTA CAACCACAGC

1051 CGGATGTATG TAACGGCGGT CAGGGACATT GCCAATTCGC TTGGCGGCCC

1101 GGGATTGTAA
```

This corresponds to the amino acid sequence <SEQ ID 2816; ORF 922>:

```
m922.pep
   1 MKKRKILPLA ICLAALSACT AMEARPPRAN EAQAPRAVEM KKESRPAFDA

51 AAVFDAAAVP VSDSGFAANA NVRRFVDDEV GKGDFSRAEW QDFFDKAAYK

101 ADIVKIMHRP STSRPWYVFR TGNSGKAKFR GARRFYAENR ALIDDVAQKY

151 GVPAELIVAV IGIETNYGKN TGSFRVADAL ATLGFDYPRR AGFFQKELVE

201 LLKLAKEEGG DVFAFKGSYA GAMGMPQFMP SSYRKWAVDY DGDGHRDIWG

251 NVGDVAASVA NYMKQHGWRT GGKMLVSATL APGADVQAII GEKTALTRTV

301 ADLKAYGIIP GEELADDEKA VLFKLETAPG VFEYYLGLNN FYTVWQYNHS

351 RMYVTAVRDI ANSLGGPGL*
```

Computer analysis of this amino acid sequence gave the following results:

Homology with a Predicted ORF from *N. gonorrhoeae*

ORF 922 shows 95.9% identity over a 369 aa overlap with a predicted ORF (ORF 922.ng) from *N. gonorrhoeae*:

```
    m922/g922
                      10         20         30         40         50         60
        m922.pep  MKKRKILPLAICLAALSACTAMEARPPRANEAQAPRAVEMKKESRPAFDAAAVFDAAAVP
                  |:||||||||||||||||||||||||:|||||||||||:||||||||||||      |||
            g922  MEKRKILPLAICLAALSACTAMEARTPRANEAQAPRADMKKESRPAFDAA------AVP
                          10         20         30         40         50

70         80         90        100        110        120
        m922.pep  VSDSGFAANANVRRFVDDEVGKGDFSRAEWQDFFDKAAYKADIVKIMHRPSTSRPWYVFR
                  |||||||||||||||||||||||||||:||||||||||||||||||||||||||||||||
            g922  VSDSGFAANANVRRFVDDEVGKGDFSQAEWQDFFDKAAYKADIVKIMHRPSTSRPWYVFR
                          60         70         80         90        100        110

130        140        150        160        170        180
        m922.pep  TGNSGKAKFRGARRFYAENRALIDDVAQKYGVPAELIVAVIGIETNYGKNTGSFRVADAL
                  |||||:|||:||||||||||:||||||||||||||||||:||||||||||||||||||||
            g922  TGNSGRAKFHGARRFYAENRAVIDDVAQKYGVPAELIVAIIGIETNYGKNTGSFRVADAL
                         120        130        140        150        160        170

190        200        210        220        230        240
        m922.pep  ATLGFDYPRRAGFFQKELVELLKLAKEEGGDVFAFKGSYAGAMGMPQFMPSSYRKWAVDY
                  ||||||||||||||||||||||||||||||||||||||||||||||||||||||||||||
            g922  ATLGFDYPRRAGFFQKELVELLKLAKEEGGDVFAFKGSYAGAMGMPQFMPSSYRKWAVDY
                         180        190        200        210        220        230
```

```
                   250        260        270        280        290        300
m922.pep DGDGHRDIWGNVGDVAASVANYMKQHGWRTGGKMLVSATLAPGADVQAIIGEKTALTRTV
         ||||||||||||||||||||||||||||||||||||||||||||||||||||||||||||
g922     DGDGHRDIWGNVGDVAASVANYMKQHGWRTGGKMLVSATLAPGADVQAIIGEKTALTRTV
                   240        250        260        270        280        290

310        320        330        340        350        360
m922.pep ADLKAYGIIPGEELADDEKAVLFKLETAPGVFEYYLGLNNFYTVWQYNHSRMYVTAVRDI
         |||||||||||| |||||||||||||||||||||||||||||||||||||||||||||||
g922     ADLKAYGIIPGETLADDEKAVLFKLETAPGVFEYYLGLNNFYTVWQYNHSRMYVTAVRDI
                   300        310        320        330        340        350

370
m922.pep ANSLGGPGLX
         ||||||||||
g922     ANSLGGPGLX
                   370
```

The following partial DNA sequence was identified in *N. meningitidis* <SEQ ID 2817>:

```
a922.seq
    1 ATGAAAAACA GAAAAATACT GCCGCTGGCA ATTTGTTTGG CGGCTTTGTC

51 TGCCTGTACG GCGATGGAGG CACGCCCGCC CCGGGCAAAT GAAGCCCAAG

101 CCCCCCGCGC GGATGAAATG AAAAAAGAAA GCCGCCCCGC GTTTGACGCG

151 GCAGCCGTAT TTGACGCGGC AGCCGTACCG GTATCCGACA GCGGGTTTGC

201 CGCCAATGCA AATGTCCGCC GTTTTGTGGA CGATGAAGTC GGGAAAGGGG

251 ATTTTTCCCG GCGGAATGG CAGGATTTTT TTGACAAAGC GGCTTACAAG

301 GCGGACATCG TCAAGATTAT GCACCGCCCC TCCACATCGC GTCCGTGGTA

351 TGTGTTCCGC ACGGGAAATT CGGGCAAGGC GAAATTTCGC GGCGCGCGCC

401 GGTTTTATGC GGAAAACCGC GCGCTTATCG ATGATGTGGC GCAAAAATAC

451 GGCGTGCCTG CCGAACTTAT CGTGGCGGTT ATCGGGATTG AAACGAATTA

501 CGGCAAAAAT ACGGGCAGTT TCCGTGTGGC GGACGCATTG GCGACCTTAG

551 GCTTTGATTA CCCCCGCCGC GCCGGGTTTT TCCAAAAAGA ATTGGTCGAG

601 CTTTTAAAGC TGGCAAAAGA AGAAGGCGGC GATGTTTTCG CCTTTAAAGG

651 CAGCTATGCG GGCGCAATGG GGATGCCGCA ATTTATGCCT TCGAGCTACC

701 GGAAATGGGC GGTGGATTAT GACGGGGACG GACATCGGGA CATATGGGGC

751 AATGTTGGCG ATGTCGCGGC ATCGATTGCC AATTATATGA AGCAGCACGG

801 TTGGCGCACG GGCGGGAAAA TACTGGTGTC TGCAACATTG GCGCCGGGTG

851 CGGATGTTCA GGCAATCATT GGCGAAAAAA CCGCCCTGAC GCGGACGGTG

901 GCGGATTTGA AGGCGTACGG CATCATCCCC GGCGAAGAGC TTGCCGATGA

951 TGAAAAGGCG GTTTTGTTCA AACTGGAAAC CGCACCCGGC GTGTTTGAAT

1001 ATTATTTGGG CTTGAACAAT TTTTATACGG TATGGCAGTA CAATCACAGT

1051 CGGATGTATG TAACGGCGGT CAGGGACATT GCCAATTCGC TTGGCGGCCC

1101 GGGATTGTAA
```

This corresponds to the amino acid sequence <SEQ ID 2818; ORF 922.a>:

```
a922.pep.
    1 MKNRKILPLA ICLAALSACT AMEARPPRAN EAQAPRADEM KKESRPAFDA

51 AAVFDAAAVP VSDSGFAANA NVRRFVDDEV GKGDFSRAEW QDFFDKAAYK
```

```
101 ADIVKIMHRP STSRPWYVFR TGNSGKAKFR GARRFYAENR ALIDDVAQKY

151 GVPAELIVAV IGIETNYGKN TGSFRVADAL ATLGFDYPRR AGFFQKELVE

201 LLKLAKEEGG DVFAFKGSYA GAMGMPQFMP SSYRKWAVDY DGDGHRDIWG

251 NVGDVAASIA NYMKQHGWRT GGKILVSATL APGADVQAII GEKTALTRTV

301 ADLKAYGIIP GEELADDEKA VLFKLETAPG VFEYYLGLNN FYTVWQYNHS

351 RMYVTAVRDI ANSLGGPGL*
``` m922/a922 98.9% identity in 369 aa overlap

```
                 10         20         30         40         50         60
m922.pep  MKKRKILPLAICLAALSACTAMEARPPRANEAQAPRAVEMKKESRPAFDAAAVFDAAAVP
          ||:|||||||||||||||||||||||:||||||||||:|||||||||||||||||||||
a922      MKNRKILPLAICLAALSACTAMEARTPRANEAQAPRADEMKKESRPAFDAAAVFDAAAVP
                 10         20         30         40         50         60

70         80         90        100        110        120
m922.pep  VSDSGFAANANVRRFVDDEVGKGDFSRAEWQDFFDKAAYKADIVKIMHRPSTSRPWYVFR
          ||||||||||||||||||||||||||||||||||||||||||||||||||||||||||||
a922      VSDSGFAANANVRRFVDDEVGKGDFSRAEWQDFFDKAAYKADIVKIMHRPSTSRPWYVFR
                 70         80         90        100        110        120

130        140        150        160        170        180
m922.pep  TGNSGKAKFRGARRFYAENRALIDDVAQKYGVPAELIVAVIGIETNYGKNTGSFRVADAL
          ||||||||||||||||||||||||||||||||||||||||||||||||||||||||||||
a922      TGNSGKAKFRGARRFYAENRALIDDVAQKYGVPAELIVAVIGIETNYGKNTGSFRVADAL
                130        140        150        160        170        180

190        200        210        220        230        240
m922.pep  ATLGFDYPRRAGFFQKELVELLKLAKEEGGDVFAFKGSYAGAMGMPQFMPSSYRKWAVDY
          ||||||||||||||||||||||||||||||||||||||||||||||||||||||||||||
a922      ATLGFDYPRRAGFFQKELVELLKLAKEEGGDVFAFKGSYAGAMGMPQFMPSSYRKWAVDY
                190        200        210        220        230        240

250        260        270        280        290        300
m922.pep  DGDGHRDIWGNVGDVAASVANYMKQHGWRTGGKMLVSATLAPGADVQAIIGEKTALTRTV
          |||||||||||||||||:|||||||||||||||:||||||||||||||||||||||||||
a922      DGDGHRDIWGNVGDVAASIANYMKQHGWRTGGKILVSATLAPGADVQAIIGEKTALTRTV
                250        260        270        280        290        300

310        320        330        340        350        360
m922.pep  ADLKAYGIIPGEELADDEKAVLFKLETAPGVFEYYLGLNNFYTVWQYNHSRMYVTAVRDI
          ||||||||||||:|||||||||||||||||||||||||||||||||||||||||||||||
g922      ADLKAYGIIPGETLADDEKAVLFKLETAPGVFEYYLGLNNFYTVWQYNHSRMYVTAVRDI
                310        320        330        340        350        360

370
m922.pep  ANSLGGPGLX
          ||||||||||
a922      ANSLGGPGLX
                370
```

The following partial DNA sequence was identified in *N. gonorrhoeae* <SEQ ID 2819>:

```
g923.seq
  1 ATGAAGCGGC AGGCTTTCTT CAAACCGATG GCGTGTGCGG CATTTCTGTC

51 CGCCGTTTCG CTGCGCCTCC CCGTATTGGG CGCGTGTTAC GCAATATTGT

101 CCCTCTATGC GTTTGCACTT TACGGCATCG ACAAACGGCG TGCCGTGCGG

151 GGAAAACGCC GCATTCCCGA ACACCGCCTG CTCCTGCCTG CCTTGTTCGG

201 CGGTTGGACG GGCGCATACT TGGGTAGTAG GATGTTCAGG CATAAAACGG

251 CGAAAAAGCG TTTTGTTGTG CTGTTCCGTC TGACTGTTTC GGGCAATGTC
```

-continued

```
301 CTGGCGACCT GCATCCTGAT TGATTATTTC GTTCCGCCCG AACTTTTTGT

351 AAAACTCGGG CAACATCTCT GA
```

This corresponds to the amino acid sequence <SEQ ID 2820; ORF 923.ng>:

```
g923.pep
  1 MKRQAFFKPM ACAAFLSAVS LRLPVLGACY AILSLYAFAL YGIDKRRAVR

51 GKRRIPEHRL LLPALFGGWT GAYLGSRMFR HKTAKKRFVV LFRLTVSGNV

101 LATCILIDYF VPPELFVKLG QHL*
```

The following partial DNA sequence was identified in *N. meningitidis* <SEQ ID 2821>:

```
m923.seq
  1 ATGAAGCGGC AGGCTTTCTT CAAACTGATG GCGTGTGCGG CATTTCTGTC

51 TGCCGTTTCG CTGCGCCTCC CCGTATTGGG CGCGTGTTAC GCAATATTGT

101 CCCTCTATGC GTTTGCACTT TACGGCATCG ACAAACGGTG CGCCATACGG

151 GGGCAACGCC GCATTCCCGA ACACCGCCTG CTGCTGCCTG CATTGCTCGG

201 CGGCTGGGTG GGCGCGTATT TCGGCAGCAT GACATTCAAA CATAAGACAG

251 CGAAAAAGCG TTTTGTTGTG CTGTTCCGTC TGACTGTTTC AGGTAATGTC

301 TTGGCGACCC TCATCCTGAT TTATAGTGGA TTAAATTTAA ACCAGTACGG

351 CGTTGCCTCG CCTTGCCGTA CTATTTGTAC TGTCTGCGGC TTCGTCGCCT

401 TGTCCTGATT TTTGTTAATC CACTATAT.T ATTTTGTCCC GCCTGAATTT

451 TTCGTAAAAC TCGGGCAGAA TACCTGA
```

This corresponds to the amino acid sequence <SEQ ID 2822; ORF 923>:

```
m923.pep
  1 MKRQAFFKLM ACAAFLSAVS LRLPVLGACY AILSLYAFAL YGIDKRCAIR

51 GQRRIPEHRL LLPALLGGWV GAYFGSMTFK HKTAKKRFVV LFRLTVSGNV

101 LATLILIYSG LNLNQYGVAS PCRTICTVCG FVALS*FLLI HYXYFVPPEF

151 FVKLGQNT*
```

Computer analysis of this amino acid sequence gave the following results:
Homology with a Predicted ORF from *N. gonorrhoeae*
ORF 923 shows 68.8% identity over a 157 aa overlap with a predicted ORF (ORF 923.ng) from *N. gonorrhoeae*:

```
    g923/m923
                    10         20         30         40         50         60
       g923.pep MKRQAFFKPMACAAFLSAVSLRLPVLGACYAILSLYAFALYGIDKRRAVRGKRRIPEHRL
                ||||||||| |||||||||||||||||||||||||||||||||||| :||:||||||||
           m923 MKRQAFFKLMACAAFLSAVSLRLPVLGACYAILSLYAFALYGIDKRCAIRGQRRIPEHRL
                    10         20         30         40         50         60

70         80         90        100
       g923.pep LLPALFGGWTGAYLGSRMFRHKTAKKRFVVLFRLTVSGNVLATCILID------------
                |||||:|||:|||:||  || |:||||||||||||||||||||| |||
           m923 LLPALLGGWVGAYFGSMTFKHKTAKKRFVVLFRLTVSGNVLATLILIYSGLNLNQYGVAS
                    70         80         90        100        110        120
```

```
                         110         120
g923.pep  ----------------------YFVPPELFVKLGQHLX
                                ||||||||||:||:
m923      PCRTICTVCGFVALSXFLLIHYIYFVPPEFFVKLGQNTX
                  130         140         150
```

The following partial DNA sequence was identified in *N. meningitidis* <SEQ ID 2823>:

```
a923.seq
   1 ATGAAGCGGC AGGCTTTCTT CAAACTGATG GCGTGTGCGG CATTTCTGTC

51 TGCCGTTTCG CTGCGCCTCC CCGTATTGGG CGCGTGTTAC GCAATATTGT

101 CCCTCTATGC GTTTGCACTT TACGGCATCG ACAAACGGCG TGCCGTGCGG

151 GGAAAACGCC GCATTCCCGA ACACCGCCTG CTGCTGCCTG CCTTGTTCGG

201 CGGTTGGGCG GGCGCATACT TGGGCAGCAG GATATTCAGG CATAAAACGG

251 CGAAAAAGCG TTTTGTTGTG CTGTTCCGTC TGACTGTTTC GGGCAATGTC

301 CTGGCGACCC TCATCCTGAT TTATAGTGGA TTAAATTTAA ACCAGTACGG

351 CGTTGCCTCG CCTTA.GCTC AAAGAGAACG ATTCTCTAAG GTGCTGAAGC

401 ACCAAGTGAA TCGGTTCCGT ACTATTTGTA CTGTCTGCGG CTTCGTCGCC

451 TTGTCCTGAT TTTTGTTAAT CCACTAT.AT TATTTTGTCC CGCCTGAATT

501 TTTCGTAAAA CTCGGGCAGA ATACCTGA
```

This corresponds to the amino acid sequence <SEQ ID 2824; ORF 923.a>:

```
a923.pep
   1 MKRQAFFKLM ACAAFLSAVS LRLPVLGACY AILSLYAFAL YGIDKRRAVR

51 GKRRIPEHRL LLPALFGGWA GAYLGSRIFR HKTAKKRFVV LFRLTVSGNV

101 LATLILIYSG LNLNQYGVAS PXAQRERFSK VLKHQVNRFR TICTVCGFVA

151 LS*FLLIHYX YFVPPEFFVK LGQNT*
``` m923/a923 84.6% identity in 175 aa overlap

```
                  10         20         30         40         50         60
m923.pep  MKRQAFFKLMACAAFLSAVSLRLPVLGACYAILSLYAFALYGIDKRCAIRGQRRIPEHRL
          ||||||||||||||||||||||||||||||||||||||||||||||| :||:||||||||
a923      MKRQAFFKLMACAAFLSAVSLRLPVLGACYAILSLYAFALYGIDKRRAVRGKRRIPEHRL
                  10         20         30         40         50         60

70         80         90        100        110        120
m923.pep  LLPALLGGWVGAYFGSMTFKHKTAKKRFVVLFRLTVSGNVLATLILIYSGLNLNQYGVAS
          |||||:|||:|||:||  |:||||||||||||||||||||||||||||||||||||||||
a923      LLPALFGGWAGAYLGSRIFRHKTAKKRFVVLFRLTVSGNVLATLILIYSGLNLNQYGVAS
                  70         80         90        100        110        120

130        140        150        159
m923.pep  PC----------------RTICTVCGFVALSXFLLIHYXYFVPPEFFVKLGQNTX
          |                 ||||||||||||||||||||||||||||||||||||
a923      PXAQRERFSKVLKHQVNRFRTICTVCGFVALSXFLLIHYXYFVPPEFFVKLGQNTX
                  130        140        150        160        170
```

The following partial DNA sequence was identified in *N. gonorrhoeae* <SEQ ID 2825>:

```
g925.seq
    1 ATGAAACAAA TGCTTTTGGC cgtcggcgtg ggcGCGGTGT TGGCGGGCTG

51 CGGCAaggat gcCGGCGGtt acgagggtTA TTGGCGCGAA AAGTCGGACA

101 AAAAagaggG CGTGATTGCC GTCAAAAAAA AAGGCAATTA CTTCCTTAAT

151 AAAATCAACG TGTTTACAGG CAAGGAGGAG TCTTTGCTTT TGTCTGAAAA

201 AGACGGCGCG CTTTCGATAA ACACGGGGAT AGGGGAAATC CCGATCAAAC

251 TTTCCGACGA CGGGAAAGAG CTGTATGTCG AACGCAGGCG GTATGTGAAA

301 ACCGATGCGG CGATGAAGGA CAAAATCATC GCCCACCAGA AAAAGTGCGG

351 ACAAACGGCA CAGGCATACC TCGACGCGCG AAATGCGTTG CCGTCAAACC

401 AAACGTATCA GCAGCGTCAG GCGGCGATCG AGCAATTGAA ACGGCGGTTT

451 GAAGCCGAGT TTGACGAATT GGAAAAAGAA ATCAAATGCA ACGGCAAACC

501 GACATTGTTG TTTTAG
```

This corresponds to the amino acid sequence <SEQ ID 2826; ORF 925.ng>:

```
g925.pep
    1 MKQMLLAVGV GAVLAGCGKD AGGYEGYWRE KSDKKEGVIA VKKKGNYFLN

51 KINVFTGKEE SLLLSEKDGA LSINTGIGEI PIKLSDDGKE LYVERRRYVK

101 TDAAMKDKII AHQKKCGQTA QAYLDARNAL PSNQTYQQRQ AAIEQLKRRF

151 EAEFDELEKE IKCNGKPTLL F*
```

The following partial DNA sequence was identified in *N. meningitidis* <SEQ ID 2827>:

```
m925.seq (partial)
    1 ATGAAACAAA TGCTTTTAGC CGTCGGCGTG GTGGCGGTGT TGGCGGGCTG

51 CGGCAAGGAT GCCGGCGGTT ACGAGGGTTA TTGGCGCGAA AAGTCGGACA

101 AAAAGAGGG TATGATTGCC GTCAAAAAAG AAAAGGCAA TTACTTCCTT
       .......
```

This corresponds to the amino acid sequence <SEQ ID 2828; ORF 925>:

```
m925.pep (partial)
    1 MKQMLLAVGV VAVLAGCGKD AGGYEGYWRE KSDKKEGMIA VKKEKGNYFL..
```

Computer analysis of this amino acid sequence gave the following results:
Homology with a Predicted ORF from *N. gonorrhoeae*
ORF 925 shows 94.0% identity over a 50 aa overlap with a predicted ORF (ORF 925.ng) from *N. gonorrhoeae*:

```
m925/g925
                    10         20         30         40         50
   m925.pep MKQMLLAVGVVAVLAGCGKDAGGYEGYWREKSDKKEGMIAVKKEKGNYFL
            |||||||||| |||||||||||||||||||||||||||||:||||| |||||
       g925 MKQMLLAVGVGAVLAGCGKDAGGYEGYWREKSDKKEGVIAVKK-KGNYFLNKINVFTGKE
                    10         20         30         40         50
       g925 ESLLLSEKDGALSINTGIGEIPIKLSDDGKELYVERRRYVKTDAAMKDKIIAHQKKCGQT
                    60         70         80         90        100        110
```

The following partial DNA sequence was identified in *N. gonorrhoeae* <SEQ ID 2829>:

```
g925-1.seq
   1 ATGAAACAAA TGCTTTTGGC CGTCGGCGTG GCGGCGGTGT TGGCGGGCTG

51 CGGCAAGGAT GCCGGCGGTT ACGAGGGTTA TTGGCGCGAA AAGTCGGACA

101 AAAAAGAGGG CGTGATTGCC GTCAAAAAAA AAGGCAATTA CTTCCTTAAT

151 AAAATCAACG TGTTTACAGG CAAGGAGGAG TCTTTGCTTT TGTCTGAAAA

201 AGACGGCGCG CTTTCGATAA ACACGGGGAT AGGGGAAATC CCGATCAAAC

251 TTTCCGACGA CGGGAAAGAG CTGTATGTCG AACGCAGGCG GTATGTGAAA

301 ACCGATGCGG CGATGAAGGA CAAAATCATC GCCCACCAGA AAAAGTGCGG

351 ACAAACGGCA CAGGCATACC TCGACGCGCG AAATGCGTTG CCGTCAAACC

401 AAACGTATCA GCAGCGTCAG GCGGCGATCG AGCAATTGAA ACGGCGGTTT

451 GAAGCCGAGT TTGACGAATT GGAAAAAGAA ATCAAATGCA ACGGCAAACC

501 GACATTGTTG TTTTAG
```

This corresponds to the amino acid sequence <SEQ ID 2830; ORF 925-1.ng>:

```
g925-1.pep
   1 MKQMLLAVGV AAVLAGCGKD AGGYEGYWRE KSDKKEGVIA VKKKGNYFLN

51 KINVFTGKEE SLLLSEKDGA LSINTGIGEI PIKLSDDGKE LYVERRRYVK

101 TDAAMKDKII AHQKKCGQTA QAYLDARNAL PSNQTYQQRQ AAIEQLKRRF

151 EAEFDELEKE IKCNGKPTLL F*
```

The following partial DNA sequence was identified in *N. meningitidis* <SEQ ID 2831>:

```
m925-1.seq
   1 ATGAAACAAA TGCTTTTAGC CGTCGGCGTG GTGGCGGTGT TGGCGGGCTG

51 CGGCAAGGAT GCCGGCGGTT ACGAGGGTTA TTGGCGCGAA AAGTCGGACA

101 AAAAAGAGGG TATGATTGCC GTCAAAAAAG AAAAAGGCAA TTACTTCCTT

151 AATAAAATCC ACGTGGTTAC AGGCAAGGAA GAGTCCTTGC TTTTGTCTGA

201 AAAAGACGGC GCGCTTTCGA TAAACACAGG GATAGGGGAA ATCCCGATCA

251 AACTTTCCGA CGACGGGAAA GAGCTGTATG TCGAACGTAG GCAGTATGTC

301 AAAACCGATG CGGCGATGAA GGACAAAATC ATCGCCCATC AGAAAAAGTG

351 CGGACAAACA GCACAGGCAT ACCGCGACGC GCGAAATGCG TTGCCGTCAA

401 ACCAGACGTA TCAGCAGCAT CTGGCGGCGA TCGAGCAATT GAAACGGCGG

451 TTTGAAGCCG AGTTTGACGA ATTGGAAAAA GAAATCAAAT GCAACGGCAG

501 AAGCCCGGCA TTGTTGCTTT AG
```

This corresponds to the amino acid sequence <SEQ ID 2832; ORF 925-1>:

```
m925-1.pep
   1 MKQMLLAVGV VAVLAGCGKD AGGYEGYWRE KSDKKEGMIA VKKEKGNYFL

51 NKIHVVTGKE ESLLLSEKDG ALSINTGIGE IPIKLSDDGK ELYVERRQYV
```

-continued

```
    101 KTDAAMKDKI IAHQKKCGQT AQAYRDARNA LPSNQTYQQH LAAIEQLKRR

151 FEAEFDELEK EIKCNGRSPA LLL*
``` m925/g925  92.5% identity in 173 aa overlap

```
                    10         20         30         40         50         60
m925-1.pep  MKQMLLAVGVVAVLAGCGKDAGGYEGYWREKSDKKEGMIAVKKEKGNYFLNKIHVVTGKE
            ||||||||||:|||||||||||||||||||||||:|||| ||||||||:| ||||
g925-1      MKQMLLAVGVAAVLAGCGKDAGGYEGYWREKSDKKEGVIAVKK-KGNYFLNKINVFTGKE
                    10         20         30         40         50

70         80         90        100        110        120
m925-1.pep  ESLLLSEKDGALSINTGIGEIPIKLSDDGKELYVERRQYVKTDAAMKDKIIAHQKKCGQT
            |||||||||||||||||||||||||||||||||||:||||||||||||||||||||||
g925-1      ESLLLSEKDGALSINTGIGEIPIKLSDDGKELYVERRYVKTDAAMKDKIIAHQKKCGQT
                    60         70         80         90        100        110

130        140        150        160        170
m925-1.pep  AQAYRDARNALPSNQTYQQHLAAIEQLKRRFEAFDELEKEIKCNGRSPALLLX
            |||| |||||||||||||||: ||||||||||||||||||||||||: |:||:|
            AQAYLDARNALPSNQTYQQRQAAIEQLKRRFEAFDELEKEIKCNGK-PTLLFX
                   120        130        140        150        160        170
```

The following partial DNA sequence was identified in *N. meningitidis* <SEQ ID 2833>:

```
a925-1.seq
   1 AATAAAATCA ACGTGTTTAC AGGTAAGGAA GAATCTATGC TTTTGTCTGA

51 AAAAGACGGC GCGCTTTCGA TAAACACGGG GATAGGGGAA ATCCCGATCA

101 AACTTTCCGA CGACGGGAAA GAGCTGTATG TCGAACGCAG GCAGTATGTC

151 AAAACCGATG CGGCGATGAA GGACAAAATC ATCGCCCATC AGAAAAAGTG

201 CGGACAAACG GCACAGGCAT ATCTCGACGC GCGAAATGCG TTGCCGTCAA

251 ACCAGACGTA TCAGCAGCAT CAGGCGGCGA TCGAGCAGTT GAAACGGCGG

301 TTTGAAGCCG AGTTTGACGA ATTGGAAAAA GAAATCAAAT GCAACGGCAA

351 ACCGACATTG TTGTTTTAG
```

This corresponds to the amino acid sequence <SEQ ID 2834; ORF 925-1.a>:

```
a925-1.pep

1 NKINVFTGKE ESMLLSEKDG ALSINTGIGE IPIKLSDDGK ELYVERRQYV

51 KTDAAMKDKI IAHQKKCGQT AQAYLDARNA LPSNQTYQQH QAAIEQLKRR

101 FEAEFDELEK EIKCNGKPTL LF*
``` a925-1/m925-1  92.7% identity in 123 aa overlap

```
                                              10         20         30
a925-1.pep                           NKINVFTGKEESMLLSEKDGALSINTGIGE
                                     |||:| ||||||:|||||||||||||||
m925-1      AGGYEGYWREKSDKKEGMIAVKKEKGNYFLNKIHVVTGKEESLLLSEKDGALSINTGIGE
                    30         40         50         60         70         80

40         50         60         70         80         90
a925-1.pep  IPIKLSDDGKELYVERRQYVKTDAAMKDKIIAHQKKCGQTAQAYLDARNALPSNQTYQQH
            ||||||||||||||||||||||||||||||||||||||||||||| ||||||||||||||
m925-1      IPIKLSDDGKELYVERRQYVKTDAAMKDKIIAHQKKCGQTAQAYRDARNALPSNQTYQQH
                    90        100        110        120        130        140

100        110        120
a925-1.pep  QAAIEQLKRRFEAFDELEKEIKCNGK-PTLLFX
            |||||||||||||||||||||||||: |:||:|
m925-1      LAAIEQLKRRFEAEFDELEKEIKCNGRSPALLLX
                   150        160        170
```

The following partial DNA sequence was identified in *N. gonorrhoeae* <SEQ ID 2835>:

```
g926.seq (partial)
   1 ATGAAACACA CCGTATCCGC ATCGGTCATC CTGCTTTTGA CCGCTTGCGC

51 GCAATTACCT CAAAATAACG AAAACCTGTG GCAGCCGTCC GAACACATCA

101 GCAGTTTTGC AGCGGAAGGG CGGTTGGCAG TCAAAGCGGA AGGGAAAGGT

151 TCGTATGCAA ATTTCGATTG GACATACCAA CCGCCCGTGG AAACCATCAA

201 TATCAACACC CCTTTGGGCA GTACGCTCGG ACAGTTGTGT CAAGacAGGG

251 ACGGCGCATT GGCAGTGGAC GGCAAAGGAA ATGTCTATCA GGCAGAGGGT

301 ACGgaagact tGAGCAGGCA GCTGGTCGGT TTCAAACTGC CAATCCAATA

351 TCTGCATATC TGGGCGGAAG GCAGGCGTGT GGCGGGCGCG CCTtaccGCA

401 TCCGTTCAGA CGGCATATTG GAACAATAcg GttggACAAT cgggCagaac 451 tgcCGACAGT GGGGGGCaag tccgaacgtt gcaactGAa...
```

This corresponds to the amino acid sequence <SEQ ID 2836; ORF 926.ng>:

```
g926.pep (partial)
   1 MKHTVSASVI LLLTACAQLP QNNENLWQPS EHISSFAAEG RLAVKAEGKG

51 SYANFDWTYQ PPVETININT PLGSTLGQLC QDRDGALAVD GKGNVYQAEG

101 TEDLSRQLVG FKLPIQYLHI WAEGRRVAGA PYRIRSDGIL EQYGWTIGQN

151 CRQWGASPNV ATE...
```

The following partial DNA sequence was identified in *N. meningitidis* <SEQ ID 2837>:

```
m926.seq
   1 ATGAAACACA CCGTATCCGC ATCGGTCATC CTGCTTTTGA CCGCTTGCGC

51 GCAATTACCT CAAAATAACG AAAACCTGTG GCAGCCGTCC GAACACATCA

101 GCAGTTTTGC AGCAGAAGGG CGGTTGGCAG TGAAAGCGGA AGGGAAAGGT

151 TCGTATGCAA ATTTCGATTG GACATACCAA CCGCCCGTGG AAACCATCAA

201 TATCAATACC CCTTTGGGCA GTACGCTCGG GCAGTTGTGT CAAGACAGGG

251 ACGGCGCATT GGCAGTGGAC GGCAAAGGAA ATGTCTATCA GGCGGAAAGT

301 GCGGAAGAAT TGAGCAGGCA GCTGGTCGGT TTCAAACTGC CAATCCAATA

351 TCTGCATATC TGGGCAGATG GCAGGCGTGT GGCGGGCGCG CCTTACCGCA

401 TCCTGCCGGA CGGCATATTG GAACAATACG GTTGGACTGT CGGCAGAACC

451 GCCGACAGTG GGGGGCAAGT CCGAACGTTG CAACTGAATA ACGGAAATTT

501 GAACATCAGG CTGGTTTTCA CCGAAATCGG TATGCCGTCT GAAACCGAAA

551 CCCCGGAACG CTGTGCGGCG CGCACGAGAT AA
```

This corresponds to the amino acid sequence <SEQ ID 2838; ORF 926>:

```
m926.pep
   1 MKHTVSASVI LLLTACAQLP QNNENLWQPS EHISSFAAEG RLAVKAEGKG

51 SYANFDWTYQ PPVETININT PLGSTLGQLC QDRDGALAVD GKGNVYQAES
```

```
101 AEELSRQLVG FKLPIQYLHI WADGRRVAGA PYRILPDGIL EQYGWTVGRT

151 ADSGGQVRTL QLNNGNLNIR LVFTEIGMPS ETETPERCAA RTR*
``` g926/m926 91.6% identity in 155 aa overlap

```
                10         20         30         40         50         60
g926.pep  MKHTVSASVILLLTACAQLPQNNENLWQPSEHISSFAAEGRLAVKAEGKGSYANFDWTYQ
          ||||||||||||||||||||||||||||||||||||||||||||||||||||||||||||
m926      MKHTVSASVILLLTACAQLPQNNENLWQPSEHISSFAAEGRLAVKAEGKGSYANFDWTYQ
                10         20         30         40         50         60

70         80         90        100        110        120
g926.pep  PPVETININTPLGSTLGQLCQDRDGALAVDGKGNVYQAEGTEDLSRQLVGFKLPIQYLHI
          ||||||||||||||||||||||||||||||||||||||||::::|||||||||||||||
m926      PPVETININTPLGSTLGQLCQDRDGALAVDGKGNVYQAESAEELSRQLVGFKLPIQYLHI
                70         80         90        100        110        120

130        140        150        160
g926.pep  WAEGRRVAGAPYRIRSDGILEQYGWTIGQNCRQWGASPNVATE
          ||:|||||||||||   ||||||||||:|::   :    |
m926      WADGRRVAGAPYRILPDGILEQYGWTVGRTADSGGQVRTLQLNNGNLNIRLVFTEIGMPS
               130        140        150        160        170        180
```

```
a926.seq

1 ATGAAACACA CTGTATCCGC ATCGGTCATC CTGCTTTTGA CCGCTTGCGC
   51 GCAATTACCT CAAAATAACG AAAACCTGTG GCAGCCGTCC GAACACACCC
  101 GCAGTTTCAC GGCGGAAGGG CGGTTGGCAG TGAAAGCGGA AGGGAAAGGT
  151 TCGTATGCAA ATTTCGATTG GACATACCAA CCGCCCGTGG AAACCATCAA
  201 TATCAACACC CCTTTGGGCA GTACGCTCGG GCAGTTGTGT CAAGACAGGG
  251 ACGGCGCATT GGCAGTGGAC GGCAAAGGAA ATGTCTATCA GGCGGAAAGT
  301 GCGGAAGAAT TGAGCAGGCA GCTGGTCGGT TTCAAACTGC CAATCCAATA
  351 TCTGCATATC TGGGCAGATG GCAGGCCTGT GGCGGGCGCG CCTTACCGCA
  401 TCCTGCCGGA CGGCATATTG GAACAATACG GTTGGACTGT CGGCAGAACC
  451 GCCGACAGTG GGGGGCAAGT CCGAACGTTG CAACTGAATA ACGGAAATTT
  501 GAACATCAGG CTGGTTTTCA CCGAGATTGG TATGAAGTCT GAAACCGAAA
  551 CCCAAGAACA ATGCGCGGCA CGCATACAGT AA
```

```
a926.pep

1 MKHTVSASVI LLLTACAQLP QNNENLWQPS EHTRSFTAEG RLAVKAEGKG
   51 SYANFDWTYQ PPVETININT PLGSTLGQLC QDRDGALAVD GKGNVYQAES
  101 AEELSRQLVG FKLPIQYLHI WADGRPVAGA PYRILPDGIL EQYGWTVGRT
  151 ADSGGQVRTL QLNNGNLNIR LVFTEIGMPS ETETQEQCAA RIQ*
``` m926/a926 96.9% identity in 191 aa overlap

```
                10         20         30         40         50         60
m926.pep  MKHTVSASVILLLTACAQLPQNNENLWQPSEHISSFAAEGRLAVKAEGKGSYANFDWTYQ
          |||||||||||||||||||||||||||||||  :|||||||||||||||||||||||||
a926      MKHTVSASVILLLTACAQLPQNNENLWQPSEHTRSFTAEGRLAVKAEGKGSYANFDWTYQ
                10         20         30         40         50         60

70         80         90        100        110        120
m926.pep  PPVETININTPLGSTLGQLCQDRDGALAVDGKGNVYQAESAEELSRQLVGFKLPIQYLHI
          ||||||||||||||||||||||||||||||||||||||||||||||||||||||||||||
a926      PPVETININTPLGSTLGQLCQDRDGALAVDGKGNVYQAESAEELSRQLVGFKLPIQYLHI
                70         80         90        100        110        120

130        140        150        160        170        180
m926.pep  WADGRRVAGAPYRILPDGILEQYGWTVGRTADSGGQVRTLQLNNGNLNIRLVFTEIGMPS
          ||||| |||||||||||||||||||||||||||||||||||||||||||||||||||||
a926      WADGRPVAGAPYRILPDGILEQYGWTVGRTADSGGQVRTLQLNNGNLNIRLVFTEIGMPS
               130        140        150        160        170        180
```

```
               190
m926.pep    ETETPERCAARTRX
            |||| |:||||
a926        ETETQEQCAARIQX
               190
```

The following partial DNA sequence was identified in *N. gonorrhoeae* <SEQ ID 2839>:

```
g927.seq
   1 atgaaaacct acGCAcAggC ACTCTATacc GCAGCCCTGC TCACCGCCTG

51 CAGCCCcgca GCcgatTcaa accaTCCGTC CGGAcAaAAT GCCCCGGCCA

101 ATACCGAATC cgacGgaaAA AACATtaccC TGctcaatgc cTcgtacgat 151 gtGACACGGT ATTTttacaa agaatacgac cacTtgtttg tcggaaCATA

201 CCAATCCGAA CACCCCGGCA CATCCGTCAG CATCCAACAA TCCCACGGCG

251 GCTTCAGCAA ACAGGCATTA TCCGTAGCCA ACGGCTTCA AGCCGATGTC

301 GTAACCATGA ACCAATCTTC CGACATCGAC CTGCTCGAAA AAAA.GGACT

351 GGTAGAAAAA GGCTGGCAAC AAGCCCTCCC CGATCACGCC GCACCCTACA

401 CCAGCACTAT GGTTTTCCTT GTCCGAAAAA ACAACCCcaa ACAGAtccgC

451 GATTGGAACG ACCTTGCCAA AGACGGCGTT AACATCGTCA TCGCCAAGAC

501 CTCGGGCAAC GGACGCTACG CCTTCCTCGG CGCATACGGT TACGGTCTGA

551 AAGCCAACAA CGGcaaCGAG CAGGAAGCCC AAAAACTCGT CGCATCCATC

601 CTCAAAAACA CACCCGTTTT TGAAAACGGC GGACGCGc.C CGCCGCCACC

651 ACCTTCACAC AACGCAACAT CGGCGACGTA CTCATCACTT TTGAAAACga 701 agCcaactac gtCAGCAAAA AACTGA
```

This corresponds to the amino acid sequence <SEQ ID 2840; ORF 927.ng>:

```
g927.pep
   1 MKTYAQALYT AALLTACSPA ADSNHPSGQN APANTESDGK NITLLNASYD

51 VTRYFYKEYD HLFVGTYQSE HPGTSVSIQQ SHGGFSKQAL SVANGLQADV

101 VTMNQSSDID LLEKXGLVEK GWQQALPDHA APYTSTMVFL VRKNNPKQIR

151 DWNDLAKDGV NIVIAKTSGN GRYAFLGAYG YGLKANNGNE QEAQKLVASI

201 LKNTPVFENG GRXPPPPPSH NATSATYSSL LKTKPTTSAK N*
```

The following partial DNA sequence was identified in *N. meningitidis* <SEQ ID 2841>:

```
m927.seq
   1 ATGAAAACCT ACGCACCGGC ACTCTATACC GCAGCCCTGC TCACCGCCTG

51 CAGCCCCGCA GCCGATTCAA ACCATCCGTC CGGACAAAAT GCCCCGGCCA

101 ATACCGAATC CGACGGAAAA AACATTACCC TGCTCAACGC CTCATACGAT

151 GTGGCACGGG ATTTTTACAA AGAATACAAC CCCTTATTTA TCAAAACATA

201 CCAATCCGAA CACCCCGGCA CATCCGTCAG CATCCAACAG TCCACGGCG

251 GCTCCAGCAA ACAGGCATTA TCCGTAGCCA ACGGCTTCA AGCCGATGTC

301 GTAACCATGA ACCAATCCTC CGACATCGAC CTGCTCGAAA AAAAGGACT

351 GGTAGAAAAA GGCTGGCAAC AAGCCCTCCC CGACCACGCC GCGCCCTACA
```

-continued

```
401 CCAGCACTAT GGTTTTCCTT GTCCGAAAAA ACAACCCCAA ACAGATCCGC

451 GATTGGAACG ACCTTGCCAA AGACGGCGTT AACATCGTCA TCGCCAATCC

501 CAAAACCTCG GGCAACGGAC GCTACGCCTT CCTCGGCGCA TACGGTTACG

551 GTCTGAAAAC CACCAACGGC AACGAACAGG AAGCCCAAAA ACTCGTCGCA

601 TCCATCCTCA AAAACACCCC CGTTTTTGAA AACGGCGGAC GCkCgCCACC

651 ACCACCTTCA CACAACGCAA CATCGGCGAC GTACTCATCA CTTTTGAAAA

701 CGAAGCCAAC TACGTCAGCr AAAAACtGA
```

This corresponds to the amino acid sequence <SEQ ID 2842; ORF 927>:

```
m927.pep
  1 MKTYAPALYT AALLTACSPA ADSNHPSGQN APANTESDGK NITLLNASYD

51 VARDFYKEYN PLFIKTYQSE HPGTSVSIQQ SHGGSSKQAL SVANGLQADV

101 VTMNQSSDID LLEKKGLVEK GWQQALPDHA APYTSTMVFL VRKNNPKQIR

151 DWNDLAKDGV NIVIANPKTS GNGRYAFLGA YGYGLKTTNG NEQEAQKLVA

201 SILKNTPVFE NGGRXPPPPS HNATSATYSS LLKTKPTTSA KN*
```

Computer analysis of this amino acid sequence gave the following results:
Homology with a Predicted ORF from *N. gonorrhoeae*
ORF 927 shows 94.2% identity over a 243 aa overlap with a predicted ORF (ORF 927.ng) from *N. gonorrhoeae*:

```
g927/m927
                    10         20         30         40         50         60
      g927.pep  MKTYAQALYTAALLTACSPAADSNHPSGQNAPANTESDGKNITLLNASYDVTRYFYKEYD
                |||||  ||||||||||||||||||||||||||||||||||||||||||||:|  |||||:
      m927      MKTYAPALYTAALLTACSPAADSNHPSGQNAPANTESDGKNITLLNASYDVARDFYKEYN
                    10         20         30         40         50         60
                    70         80         90        100        110        120
      g927.pep  HLFVGTYQSEHPGTSVSIQQSHGGFSKQALSVANGLQADVVTMNQSSDIDLLEKXGLVEK
                ||: ||||||||||||||||||| ||||||||||||||||||||||||||||||| |||||
      m927      PLFIKTYQSEHPGTSVSIQQSHGGSSKQALSVANGLQADVVTMNQSSDIDLLEKKGLVEK
                    70         80         90        100        110        120
                   130        140        150        160        170
      g927.pep  GWQQALPDHAAPYTSTMVFLVRKNNPKQIRDWNDLAKDGVNIVIA--KTSGNGRYAFLGA
                ||||||||||||||||||||||||||||||||||||||||||||  ||||||||||||||
      m927      GWQQALPDHAAPYTSTMVFLVRKNNPKQIRDWNDLAKDGVNIVIANPKTSGNGRYAFLGA
                   130        140        150        160        170        180
                   180        190        200        210        220        230
      g927.pep  YGYGLKANNGNEQEAQKLVASILKNTPVFENGGRXPPPPPSHNATSATYSSLLKTKPTTS
                ||||||::|||||||||||||||||||||||||||||||| |||||||||||||||||||
      m927      YGYGLKTTNGNEQEAQKLVASILKNTPVFENGGRXPPPP-SHNATSATYSSLLKTKPTTS
                   190        200        210        220        230
                   240
      g927.pep  AKNX
                ||||
      m927      AKNX
                   240
```

The following partial DNA sequence was identified in *N. meningitidis* <SEQ ID 2843>:

```
a927.seq
  1 ATGAAAACCT ACGCACCGGC ACTCTATACC GCAGCCCTGC TCAGCGCCTG

51 CAGCCCCGCA GCCGATTCAA ACCATCCGTC CGGACAAAAT GCCCCGGCCA
```

-continued

```
101 ATACCGAATC CGACGGAAAA AACATTACCC TGCTCAACGC CTCATACGAT

151 GTGGCACGGG ATTTTTACAA AGAATACAAC CCCTTATTTA TCAAAACATA

201 CCAATCCGAA CACCCCGGCA CATCCGTCAG CATCCAACAG TCCCACGGCG

251 GCTCCAGCAA ACAGGCATTA TCCGTAGCCA ACGGCCTTCA AGCCGATGTC

301 GTAACCATGA ACCAATCCTC CGACATCGAC CTGCTCGAAA AAAAGGACT

351 GGTAGAAAAA GGCTGGCAAC AAGCCCTCCC CGACCACGCC GCGCCCTACA

401 CCAGCACTAT GGTTTTCCTT GTCCGAAAAA ACAACCCCAA ACAGATCCGC

451 GATTGGAACG ACCTTGCCAA AGACGGCGTT AACATCGTCA TCGCCAATCC

501 CAAAACCTCG GGCAACGGAC GCTACGCCTT CCTCGGCGCA TACGGTTACG

551 GTCTGAAAAC CACCAACGGC AACGAACAGG AAGCCCAAAA ACTCGTCGCA

601 TCCATCCTCA AAAACACCCC CGTTTTTGAA AACGGCGGAC GCGCGCCACC

651 ACCACCTTCA CACAACGCAA CATCGGCGAC GTACTCATCA CTTTTGAAAA

701 CGAAGCCAAC TACGTCAGCA AAAAACTGA
```

This corresponds to the amino acid sequence <SEQ ID 2844; ORF 927.a>:

```
a927.pep
  1 MKTYAPALYT AALLSACSPA ADSNHPSGQN APANTESDGK NITLLNASYD

51 VARDFYKEYN PLFIKTYQSE HPGTSVSIQQ SHGGSSKQAL SVANGLQADV

101 VTMNQSSDID LLEKKGLVEK GWQQALPDHA APYTSTMVFL VRKNNPKQIR

151 DWNDLAKDGV NIVIANPKTS GNGRYAFLGA YGYGLKTTNG NEQEAQKLVA

201 SILKNTPVFE NGGRAPPPPS HNATSATYSS LLKTKPTTSA KN*
```

40
m927/a927 99.2% identity in 242 aa overlap

```
                     10        20        30        40        50        60
   m927.pep   MKTYAPALYTAALLTACSPAADSNHPSGQNAPANTESDGKNITLLNASYDVARDFYKEYN
              |||||||||||||:||||||||||||||||||||||||||||||||||||||||||||||
       a927   MKTYAPALYTAALLSACSPAADSNHPSGQNAPANTESDGKNITLLNASYDVARDFYKEYN
                     10        20        30        40        50        60

70        80        90       100       110       120
   m927.pep   PLFIKTYQSEHPGTSVSIQQSHGGSSKQALSVANGLQADVVTMNQSSDIDLLEKKGLVEK
              ||||||||||||||||||||||||||||||||||||||||||||||||||||||||||||
       a927   PLFIKTYQSEHPGTSVSIQQSHGGSSKQALSVANGLQADVVTMNQSSDIDLLEKKGLVEK
                     70        80        90       100       110       120

130       140       150       160       170       180
   m927.pep   GWQQALPDHAAPYTSTMVFLVRKNNPKQIRDWNDLAKDGVNIVIANPKTSGNGRYAFLGA
              ||||||||||||||||||||||||||||||||||||||||||||||||||||||||||||
       a927   GWQQALPDHAAPYTSTMVFLVRKNNPKQIRDWNDLAKDGVNIVIANPKTSGNGRYAFLGA
                    130       140       150       160       170       180

190       200       210       220       230       240
   m927.pep   YGYGLKTTNGNEQEAQKLVASILKNTPVFENGGRXPPPPSHNATSATYSSLLKTKPTTSA
              |||||||||||||||||||||||||||||||||||  |||||||||||||||||||||||
       a927   YGYGLKTTNGNEQEAQKLVASILKNTPVFENGGRAPPPPSHNATSATYSSLLKTKPTTSA
                    190       200       210       220       230       240 m927.pep   KNX
              |||
       a927   KNX
```

The following partial DNA sequence was identified in *N. gonorrhoeae* <SEQ ID 2845>:

```
g929.seq
    1 ATGAAATTGG GTTTCAAACC GATACCCCTC GCCATTGCCG CAGTATTGTG

51 CGCCCTGGTT TTGGCACTGC CCGTACccga CGGGGTCAAG CCTCAGGCTT

101 GGACGCTGCT GGCTATGTTT GTCGGTGTGA TTGCCGCCAT TATCGGCAAG

151 GTTATGCCGT TGGGCGCGCT GTCGATTATT GCCGTCGGGT TGGTCGCAGT

201 AACCGGCGTA ACCGCCGACA AACCGGGCGC GGCGATGAGC GATGCGTTGA

251 GTGCGTTCGC CAATCCGTTG ATTTGGCTGA TTGCCATCGC AGTTATGATT

301 TCGCGCGGTT TGCTCAAAAC AGGGCTGGGG ATGCGTATCG GATATTTGTT

351 TATCGCCGTT TTTGGAAGAA AAAcgctggG CATCGGTTAC AGTCTCGCTC

401 TTTCCGAACT GCTGCTGGCT CCCGTTACCC CTTCCAATAC CGCGCGCGGC

451 GGCGGCATTA TACATCcgaT TATGCagtcg attgCcggCA GttacggctC 501 caatCCCGCA AAAGGCACag aaggcaagat gggtaAATAT TtggcTTtgg 551 tcaattaTCA TTCcaaTCCC atttcgtcgg ctAtggctat taCTGcaact 601 gCCCCcaaCC CTTTAATcgt caacttgatt gccGaaaaTt taggcagtag 651 tttccgtCTT TCttgggggg cgTGGGcgtg ggcaaTGGCT Gttcccggcg 701 ttatcgcctt TTtcgTTATG CCTTTGATTT TATATTTTTT GTATCCGCCT 751 GAAATTAAAG AAACGCCCAA TGCTGttcAA TTTGCCAAAG ACCGTCTGAG 801 CGAGATGGGT AAAATGtcgg CAGACGAAAT CATTATGGCG GTCATTTTCG

851 GTATCTTGCT GCTGTTGTGG GCAGATGTTC CCGCCCTTAT TACCGGCAAT

901 CACGCTTTTA GTATCAacgc caccGCCACC GCATTTATCG GATTAAGCCT

951 GCTTTTGCTT TCCGGTGTAT TGACTTGGGA CGATGTTTTG AAAGAAAAAA

1001 GCGCGTGGGA TACGATTATT TGGTTTGGCG CATTGATTAT GATGGCCGCA

1051 TTTTTaAATA AActcggact gattaaatGG TTCTCCGGAG TGTTGGCGGA

1101 AagtgtcggC GGTTTGGGCG TTAGCGGCAC GGCTGCGGGC GTAATCCTCG

1151 TGCTTGCtta TATGTATGCG CATTATATGT TGCCAGTAC TACTGCACAT

1201 ATTACCGCTA TGTTCGGCGC ATTTCTCGCT GCTGCCGTTT CACTGAATGC

1251 CCCGGCGATG CCGACTGCGC TGATGATGGC GGCCGCATCC AACATTATGA

1301 TGACCCTCAC TCATTATGCG ACCGGTACTT CACCTGTGAT TTTCGGCTCG

1351 GGCTACACCA CAATGGGAGA ATGGTGGAAG GCGGGTTTTA TCATGAGCGT

1401 AGTCAATTTT CTGATTTTTT CCGTTATCGG CAGCATTTGG TGGAAAGTTC

1451 TGGGATATTG GTAA
```

This corresponds to the amino acid sequence <SEQ ID 2846; ORF 929.ng>:

```
g929.pep
    1 MKLGFKPIPL AIAAVLCALV LALPVPDGVK PQAWTLLAMF VGVIAAIIGK

51 VMPLGALSII AVGLVAVTGV TADKPGAAMS DALSAFANPL IWLIAIAVMI

101 SRGLLKTGLG MRIGYLFIAV FGRKTLGIGY SLALSELLLA PVTPSNTARG

151 GGIIHPIMQS IAGSYGSNPA KGTEGKMGKY LALVNYHSNP ISSAMAITAT

201 APNPLIVNLI AENLGSSFRL SWGAWAWAMA VPGVIAFFVM PLILYFLYPP
```

-continued

```
251 EIKETPNAVQ FAKDRLSEMG KMSADEIIMA VIFGILLLLW ADVPALITGN

301 HAFSINATAT AFIGLSLLLL SGVLTWDDVL KEKSAWDTII WFGALIMMAA

351 FLNKLGLIKW FSGVLAESVG GLGVSGTAAG VILVLAYMYA HYMFASTTAH

401 ITAMFGAFLA AAVSLNAPAM PTALMMAAAS NIMMTLTHYA TGTSPVIFGS

451 GYTTMGEWWK AGFIMSVVNF LIFSVIGSIW WKVLGYW*
```

The following partial DNA sequence was identified in *N. meningitidis* <SEQ ID 2847>:

```
m929.seq
   1 ATGAAATTGG GTTTCAAACC GATACCCCTC GCCATTGCCG CAGTATTGTG
  51 CGCCCTGGTT TTGGCACTGC CCGTACCCGA CGGGGTCAAG CCTCAGGCTT
 101 GGACGCTGCT GGCCATGTTT GTCGGTGTGA TTGCCGCCAT TATCGGCAAG
 151 GCCATGCCGT TGGGCGCGCT GTCGATTATT GCCGTCGGGT TGGTCGCAGT
 201 AACCGGCGTA ACCGCCGACA AACCGGGCGC GGCGATGAGC GATGCGTTGA
 251 GTGCGTTCGC CAATCCGTTG ATTTGGCTGA TTGCCATCGC AGTTATGATT
 301 TCGCGCGGTT TGCTCAAAAC AGGGCTGGGG ATGCGTATCG GATATTTGTT
 351 TATCGCCGTT TTTGGAAGAA AAACGCTGGG CATCGGTTAC AGTCTCGCTC
 401 TTTCCGAACT GCTGCTGGCT CCCGTTACCC CTTCCAATAC CGCGCGCGGC
 451 GGCGGCATTA TACATCCGAT TATGCAGTCG ATTGCCGGCA GTTACGGCTC
 501 CAATCCCGCA AAAGGCACAG AAGGCAAGAT GGGTAAATAT TTGGCTTTGG
 551 TCAACTATCA TTCCAATCCC ATTTCGTCGG CTATGTTTAT TACTGCAACT
 601 GCCCCCAACC CTTTAATCGT CAACTTGATT GCCGAAAATT TAGGCAGTAG
 651 TTTCCGTCTT TCTTGGGGGG CGTGGGCGTG GGCAATGGCT GTTCCCGGCG
 701 TTATCGCCTT TTTCGTTATG CCTTTGATTT TATATTTwyT GTATCCGCCT
 751 GAAATTAAAG AAACGCCCAA TGCCGTTCAA TTTGCCAAAG ACCGTCTGAG
 801 GGAGATGGGT AAAATGTCGG CAGACGAAAT CATTATGGCG GTCATTTTCG
 851 GTATCTTGCT GCTGTTGTGG GCAGATGTTC CCGCCCTTAT TACCGGCAAT
 901 CACGCTTTTA GTATCAACGC CACCGCCACC GCATTTATCG GATTAAGCCT
 951 GCTTTTGCTT TCCGGTGTAT TGACTTGGGA CGATGTTTTG AAAGAAAAAA
1001 GCGCGTGGGA TACGATTATT TGGTTTGGCG CATTGATTAT GATGGCCGCA
1051 TTTTTAAATA AACTCGGACT GATTAAATGG TTCTCCGGAG TGTTGGCGGA
1101 AAGTGTCGGC GGTTTGGGCG TTAGCGGCAC GGCTGCGGGC GTAATCCTCG
1151 TGCTTGCTTA TATGTATGCG CATTATATGT TTGCCAGTAC TACTGCACAT
1201 ATTACCGCTA TGTTCGGCGC ATTTTTCGCT GCTGCCGTTT CACTGAATGC
1251 CCCGGCGATG CCGACCGCGC TGATGATGGC GgCCGCATCC AACATTATGA
1301 TGACCCTCAC TCATTATGCG ACCGGTACTT CGCCTGTGAT TTTCGGTTCG
1351 GGCTACACCA CAATGGGAGA ATGGTGGAAG GCGGGTTTTA TCATGAGCGT
1401 AGTCAATTTT CTGATTTTTT TCGTTATCGG CAGCATTTGG TGGAAAGTTC
1451 TGGGGTATTG GTAA
```

This corresponds to the amino acid sequence <SEQ ID 2848; ORF 929>:

```
m929.pep
   1 MKLGFKPIPL AIAAVLCALV LALPVPDGVK PQAWTLLAMF VGVIAAIIGK

51 AMPLGALSII AVGLVAVTGV TADKPGAAMS DALSAFANPL IWLIAIAVMI

101 SRGLLKTGLG MRIGYLFIAV FGRKTLGIGY SLALSELLLA PVTPSNTARG

151 GGIIHPIMQS IAGSYGSNPA KGTEGKMGKY LALVNYHSNP ISSAMFITAT

201 APNPLIVNLI AENLGSSFRL SWGAWAWAMA VPGVIAFFVM PLILYXLYPP

251 EIKETPNAVQ FAKDRLREMG KMSADEIIMA VIFGILLLLW ADVPALITGN

301 HAFSINATAT AFIGLSLLLL SGVLTWDDVL KEKSAWDTII WFGALIMMAA

351 FLNKLGLIKW FSGVLAESVG GLGVSGTAAG VILVLAYMYA HYMFASTTAH

401 ITAMFGAFFA AAVSLNAPAM PTALMMAAAS NIMMTLTHYA TGTSPVIFGS

451 GYTTMGEWWK AGFIMSVVNF LIFFVIGSIW WKVLGYW*
```

Computer analysis of this amino acid sequence gave the following results:

Homology with a Predicted ORF from *N. gonorrhoeae*

ORF 929 shows 98.8% identity over a 487 aa overlap with a predicted ORF (ORF 929.ng) from *N. gonorrhoeae*:

```
    g929/m929

10         20         30         40         50         60
         g929.pep   MKLGFKPIPLAIAAVLCALVLALPVPDGVKPQAWTLLAMFVGVIAAIIGKVMPLGALSII
                    ||||||||||||||||||||||||||||||||||||||||||||||||||:||||||||
         m929       MKLGFKPIPLAIAAVLCALVLALPVPDGVKPQAWTLLAMFVGVIAAIIGKAMPLGALSII
                       10         20         30         40         50         60

70         80         90        100        110        120
         g929.pep   AVGLVAVTGVTADKPGAAMSDALSAFANPLIWLIAIAVMISRGLLKTGLGMRISYLFIAV
                    ||||||||||||||||||||||||||||||||||||||||||||||||||||||||||||
         m929       AVGLVAVTGVTADKPGAAMSDALSAFANPLIWLIAIAVMISRGLLKTGLGMRISYLFIAV
                       70         80         90        100        110        120

130        140        150        160        170        180
         g929.pep   FGRKTLGIGYSLALSELLLAPVTPSNTARGGGIIHPIMQSIAGSUGSNPAKGTEGKMGKY
                    ||||||||||||||||||||||||||||||||||||||||||||||||||||||||||||
         m929       FGRKTLGIGYSLALSELLLAPVTPSNTARGGGIIHPIMQSIAGSUGSNPAKGTEGKMGKY
                      130        140        150        160        170        180

190        200        210        220        230        240
         g929.pep   LALVNYHSNPISSAMAITATAPNPLIVNLIAENLGSSFRLSWGAWAWAMAVPGVIAFFVM
                    |||||||||||||||||  |||||||||||||||||||||||||||||||||||||||||
         m929       LALVNYHSNPISSAMFITATAPNPLIVNLIAENLGSSFRLSWGAWAWAMAVPGVIAFFVM
                      190        200        210        220        230        240

250        260        270        280        290        300
         g929.pep   PLILYFLYPPEIKETPNAVQFAKDRLSEMGKMSADEIIMAVIFGILLLLWADVPALITGN
                    ||||| ||||||||||||||||||||||| ||||||||||||||||||||||||||||||
         m929       PLILYXLYPPEIKETPNAVQFAKDRLREMGKMSADEIIMAVIFGILLLLWADVPALITGN
                      250        260        270        280        290        300

310        320        330        340        350        360
         g929.pep   HAFSINATATAFIGLSLLLLSGVLTWDDVLKEKSAWDTIIWFGALIMMAAFLNKLGLIKW
                    ||||||||||||||||||||||||||||||||||||||||||||||||||||||||||||
         m929       HAFSINATATAFIGLSLLLLSGVLTWDDVLKEKSAWDTIIWFGALIMMAAFLNKLGLIKW
                      310        320        330        340        350        360

370        380        390        400        410        420
         g929.pep   FSGVLAESVGGLGVSGTAAGVILVLAYMYAHYMFASTTAHITAMFGAFLAAAVSLNAPAM
                    ||||||||||||||||||||||||||||||||||||||||||||||||:|||||||||||
         m929       FSGVLAESVGGLGVSGTAAGVILVLAYMYAHYMFASTTAHITAMFGAFFAAAVSLNAPAM
                      370        380        390        400        410        420

430        440        450        460        470        480
         g929.pep   PTALMMAAASNIMMTLTHYATGTSPVIFGSGYTTMGEWWKAGFIMSVVNFLIFSVIGSIW
                    ||||||||||||||||||||||||||||||||||||||||||||||||||||| ||||||
         m929       PTALMMAAASNIMMTLTHYATGTSPVIFGSGYTTMGEWWKAGFIMSVVNFLIFFVIGSIW
                      430        440        450        460        470        480 g929.pep   WKVLGYWX
                    ||||||||
         m929       WKVLGYWX
```

The following partial DNA sequence was identified in *N. meningitidis* <SEQ ID 2849>:

```
a929.seq
   1 ATGAAATTGG GTTTCAAACC GATACCCCTC GCCATTGCCG CAGTATTGTG
  51 CGCCTTGGTT TTGGCACTGC CCGTACCCGA CGGGGTCAAG CCTCAGGCTT
 101 GGACGCTGCT GGCCATGTTT ATCGGTGTGA TTGCCGCCAT TATCGGCAAG
 151 GCCATGCCGT TGGGTGCGCT GTCGATTATT GCCGTCGGGT TGGTCGCAGT
 201 AACCGGCGTA ACCGCCGACA AACCGGGTGC GGCGATGAGC GATGCGTTGA
 251 GTGCGTTCGC CAATCCGTTG ATTTGGCTGA TTGCCATCGC AGTTATGATT
 301 TCGCGCGGTT TGCTCAAAAC AGGGCTGGGG ATGCGTATCG GATATTTGTT
 351 TATCGCCGTT TTTGGAAGAA AAACGCTGGG CATCGGTTAC AGTCTCGCTC
 401 TTTCCGAACT GCTGCTGGCT CCCGTTACCC CTTCCAATAC CGCGCGCGGC
 451 GGCGGCATTA TACATCCGAT TATGCAGTCG ATTGCCGGCA GTTACGGCTC
 501 CAATCCCGCA AAAGGCACAG AAGGCAAGAT GGGTAAATAT TTGGCTTTGG
 551 TCAACTATCA TTCCAATCCC ATTTCGTCGG CTATGTTTAT TACTGCAACT
 601 GCCCCCAACC CTTTAATCGT CAACTTGATT GCCGAAAATT TAGGCAGTAG
 651 TTTCCGTCTT TCTTGGGGGG CGTGGGCGTG GGCAATGGCT GTTCCCGGCG
 701 TTATCGCCTT TTTCGTTATG CCTTTGATTT TATATTTTTT GTATCCGCCT
 751 GAAATTAAAG AAACGCCCAA TGCCGTTCAA TTTGCCAAAG ACCGTCTGAG
 801 GGAGATGGGT AAAATGTCGG CAGACGAAAT CATTATGGCG GTCATTTTCG
 851 GTATCTTGTT GCTGTTGTGG GCAGATGTTC CCGCCCTTAT TACCGGCAAT
 901 CACGCTTTTA GTATCAACGC CACCGCCACC GCATTTATCG GATTAAGCCT
 951 GCTTTTGCTT TCCGGTGTAT TGACTTGGGA CGATGTTTTG AAAGAAAAAA
1001 GCGCGTGGGA TACGATTATT TGGTTTGGCG CATTGATTAT GATGGCCGCA
1051 TTTTTAAATA AACTCGGACT GATTAAATGG TTCTCCGGAG TGTTGGCGGA
1101 AAGTGTCGGC GGTTTGGGCG TTAGCGGCAC GGCTGCGGGC GTAATCCTCG
1151 TGCTTGCTTA TATGTATGCG CATTATATGT TTGCCAGTAC TACTGCACAT
1201 ATTACCGCTA TGTTCGGCGC ATTTTTCGCT GCTGCCGTTT CACTGAATGC
1251 CCCGGCGATG CCGACCGCGC TGATGATGGC GGCCGCATCT AACATTATGA
1301 TGACCCTCAC TCATTATGCG ACCGGTACTT CGCCTGTGAT TTTCGGTTCG
1351 GGCTACACCA CAATGGGAGA ATGGTGGAAG GCGGGTTTTA TCATGAGCGT
1401 AGTCAATTTT CTGATTTTTT TCGTTATCGG CAGCATTTGG TGGAAAGTTC
1451 TGGGGTATTG GTAA
```

This corresponds to the amino acid sequence <SEQ ID 2850; ORF 929.a>:

```
a929.pep
  1 MKLGFKPIPL AIAAVLCALV LALPVPDGVK PQAWTLLAMF IGVIAAIIGK
 51 AMPLGALSII AVGLVAVTGV TADKPGAAMS DALSAFANPL IWLIAIAVMI
101 SRGLLKTGLG MRIGYLFIAV FGRKTLGIGY SLALSELLLA PVTPSNTARG
151 GGIIHPIMQS IAGSYGSNPA KGTEGKMGKY LALVNYHSNP ISSAMFITAT
201 APNPLIVNLI AENLGSSFRL SWGAWAWAMA VPGVIAFFVM PLILYFLYPP
```

```
251 EIKETPNAVQ FAKDRLREMG KMSADEIIMA VIFGILLLLW ADVPALITGN

301 HAFSINATAT AFIGLSLLLL SGVLTWDDVL KEKSAWDTII WFGALIMMAA

351 FLNKLGLIKW FSGVLAESVG GLGVSGTAAG VILVLAYMYA HYMFASTTAH

401 ITAMFGAFFA AAVSLNAPAM PTALMMAAAS NIMMTLTHYA TGTSPVIFGS

451 GYTTMGEWWK AGFIMSVVNF LIFFVIGSIW WKVLGYW*
``` m929/a929 99.6% identity in 487 aa overlap

```
                  10         20         30         40         50         60
m929.pep  MKLGFKPIPLAIAAVLCALVLALPVPDGVKPQAWTLLAMFVGVIAAIIGKVMPLGALSII
          ||||||||||||||||||||||||||||||||||||||:|||||||||||||||||||||
a929      MKLGFKPIPLAIAAVLCALVLALPVPDGVKPQAWTLLAMFIGVIAAIIGKVMPLGALSII
                  10         20         30         40         50         60

70         80         90        100        110        120
m929.pep  AVGLVAVTGVTADKPGAAMSDALSAFANPLIWLIAIAVMISRGLLKTGLGMRISYLFIAV
          ||||||||||||||||||||||||||||||||||||||||||||||||||||||||||||
a929      AVGLVAVTGVTADKPGAAMSDALSAFANPLIWLIAIAVMISRGLLKTGLGMRISYLFIAV
                  70         80         90        100        110        120

130        140        150        160        170        180
m929.pep  FGRKTLGIGYSLALSELLLAPVTPSNTARGGGIIHPIMQSIAGSUGSNPAKGTEGKMGKY
          ||||||||||||||||||||||||||||||||||||||||||||||||||||||||||||
a929      FGRKTLGIGYSLALSELLLAPVTPSNTARGGGIIHPIMQSIAGSUGSNPAKGTEGKMGKY
                 130        140        150        160        170        180

190        200        210        220        230        240
m929.pep  LALVNYHSNPISSAMAITATAPNPLIVNLIAENLGSSFRLSWGAWAWAMAVPGVIAFFVM
          ||||||||||||||||| ||||||||||||||||||||||||||||||||||||||||||
a929      LALVNYHSNPISSAMFITATAPNPLIVNLIAENLGSSFRLSWGAWAWAMAVPGVIAFFVM
                 190        200        210        220        230        240

250        260        270        280        290        300
m929.pep  PLILYXLYPPEIKETPNAVQFAKDRLSEMGKMSADEIIMAVIFGILLLLWADVPALITGN
          ||||| ||||||||||||||||||||||  ||||||||||||||||||||||||||||||
a929      PLILYFLYPPEIKETPNAVQFAKDRLREMGKMSADEIIMAVIFGILLLLLWADVPALITGN
                 250        260        270        280        290        300

310        320        330        340        350        360
m929.pep  HAFSINATATAFIGLSLLLLSGVLTWDDVLKEKSAWDTIIWFGALIMMAAFLNKLGLIKW
          ||||||||||||||||||||||||||||||||||||||||||||||||||||||||||||
a929      HAFSINATATAFIGLSLLLLSGVLTWDDVLKEKSAWDTIIWFGALIMMAAFLNKLGLIKW
                 310        320        330        340        350        360

370        380        390        400        410        420
m929.pep  FSGVLAESVGGLGVSGTAAGVILVLAYMYAHYMFASTTAHITAMFGAFFAAAVSLNAPAM
          ||||||||||||||||||||||||||||||||||||||||||||||||||||||||||||
a929      FSGVLAESVGGLGVSGTAAGVILVLAYMYAHYMFASTTAHITAMFGAFFAAAVSLNAPAM
                 370        380        390        400        410        420

430        440        450        460        470        480
m929.pep  PTALMMAAASNIMMTLTHYATGTSPVIFGSGYTTMGEWWKAGFIMSVVNFLIFFVIGSIW
          ||||||||||||||||||||||||||||||||||||||||||||||||||||||||||||
m929      PTALMMAAASNIMMTLTHYATGTSPVIFGSGYTTMGEWWKAGFIMSVVNFLIFFVIGSIW
                 430        440        450        460        470        480 m929.pep  WKVLGYWX
          ||||||||
a929      WKVLGYWX
g930.seq  not found yet
g930.pep  net found yet
```

The following partial DNA sequence was identified in *N. meningitidis* <SEQ ID 2851>:

```
m930.seq
   1 ATGAAACTTC CTTTATCCTA TTTGCCTAAT ATTCGCTTTT TGTCTTGGTG

51 CTGCTTATTG GCAGGTATCA TTGCTCCTGC TACTTTGTTG GCCTCCCCCA

101 ACCCTGCCGA AATCCGTATG CAGCAAGATA TTCAGCAACG CCAACGCGAA

151 GAGCAGTTGC GCCAAACCAT GCAGCCTGAA AGCGATGTGC GTTTGCATCA

201 AAAAAACACG GGGGAAACGG TTAATCAGTT GATGGGCGAT GACAGCAGCC
```

-continued
```
 251 AACCGTGTTT TGCCATTAAC GAAtGGGTGT TGGAAGGCGA ACACCATGCT

301 CGGTTTCAGT TTGCCCTAAA ACGTGCCTTG CGCGAAACGG GTTTTCAGGC

351 TGGCAAGTGT CTGCATGCGG GCAACATTAA TCAAATCATG TCCTTAGCAC

401 AAAATGCTTT GATCGGCAGG GGATATACCA CGACCCGTAT CTTGGCTGCG

451 CCACAGGATT TGAATAgTGG aAGCTTCAAT TAA
```

This corresponds to the amino acid sequence <SEQ ID 2852; ORF 930>:

```
m930.pep
   1 MKLPLSYLPN IRFLSWCCLL AGIIAPATLL ASPNPAEIRM QQDIQQRQRE

51 EQLRQTMQPE SDVRLHQKNT GETVNQLMGD DSSQPCFAIN EWVLEGEHHA

101 RFQFALKRAL RETGFQAGKC LHAGNINQIM SLAQNALIGR GYTTTRILAA

151 PQDLNSGSFN *
```

The following partial DNA sequence was identified in *N. gonorrhoeae* <SEQ ID 2853>:

```
g930-1.seq (partial)
    1 GGCAAGTGTC TGCATGCGGG CGACATTAAT CAAATCATGT CCTTAGCACA

51 AAATGCTTTG ATCGGCAGGG GATATACCAC GACCCGTATC TTGGCTGCGC

101 CACAGGATTT GAATAGTGGC AAGCTTCAAT TAACCCTGAT GCCGGGCTAT

151 CTGCGCTCCA TACGAATCGA TCGGTCCAAC GATGATCAAA CCCATGCAGG

201 ACGTATTGCA GCATTCCAAA ACAAATTTCC CACCCGCTCG AACGATCTGT

251 TGAATCTGCG TGATTTGGAA CAAGGACTGG AAAATCTCAA ATGTCTCCCG

301 ACTGCGGAAG CCGATCTCCA AATCGTTCCC GTAGAGAGAG AACCAAACCA

351 AAGTGATGTC GTGGTGCAAT GGCGGTAACG TCTGCTGCCC TACTGTGTGA

401 GTGTGGGGAT GGATAATTCG GGTAGTGAGG CGACAGGAAA ATACCAAGGA

451 AATATCACTT TCTCTGCCGA CAATCCTTTT GGACTGAGTG ATATGTTCTA

501 TGTAAATTAT GGACGTTCAA TTGGCGGTAC GCCCGATGAG GAAAATTTTG

551 ACGGCCATCG CAAAGAAGGC GGATCAAACA ATTACGCCGT ACATTATTCA

601 GCCCCTTTCG GTAAATGGAC ATGGGCATTC AATCACAATG GCTACCGTTA

651 CCATCAGGCG GTTTCCGGAT TATCGGAAGT CTATGACTAT AATGGAAAAA

701 GTTACAACAC TGATTTCGGC TTCAACCGCC TGTTGTATCG TGATGCCAAA

751 CGCAAAACCT ATCTCAGTGT AAAACTGTGG ACGAGGGAAA CAAAAAGTTA

801 CATTGATGAT GCCGAACTGA CTGTACAACG GCGTAAAACC ACAGGTTGGT

851 TGGCAGAACT TTCCCACAAA GGATATATCG GTCGCAGTAC GGCAGATTTT

901 AAGTTGAAAT ATAAACACGG CACCGGCATG AAAGATGCTC TGCGCGCGCC

951 TGAAGAAGCC TTTGGCGAAG GCACGTCACG TATGAAAATT TGGACGGCAT

1001 CGGCTGATGT AAATACTCCT TTTCAAATCG GTAAACAGCT ATTTGCCTAT

1051 GACACATCCG TTCATGCACA ATGGAACAAA ACCCCGCTAA CATCGCAAGA

1101 CAAACTGGCT ATCGGCGGAC ACCACACCGT ACGTGGCTTC GACGGTGAAA

1151 TGAGTTTGCC TGCCGAGCGG GGATGGTATT GGCGCAACGA TTTGAGCTGG

1201 CAATTTAAAC CAGGCCATCA GCTTTATCTT GGGGCTGATG TAGGACATGT
```

-continued

```
1251 TTCAGGACAA TCCGCCAAAT GGTTATCGGG CCAAACTCTA GCCGGCACAG

1301 CAATTGGGAT ACGCGGGCAG ATAAAGCTTG GCGGCAACCT GCATTACGAT

1351 ATATTTACCG GCCGTGCATT GAAAAGCCC GAATATTTTC AGACGAAGAA

1401 ATGGGTAACG GGGTTTCAGG TGGGTTATTC GTTTTGA
```

This corresponds to the amino acid sequence <SEQ ID 2854; ORF 930-1.ng>:

```
g930-1.pep (partial)
   1 GKCLHAGDIN QIMSLAQNAL IGRGYTTTRI LAAPQDLNSG KLQLTLMPGY

51 LRSIRIDRSN DDQTHAGRIA AFQNKFPTRS NDLLNLRDLE QGLENLKCLP

101 TAEADLQIVP VEREPNQSDV VVQWR*RLLP YCVSVGMDNS GSEATGKYQG

151 NITFSADNPF GLSDMFYVNY GRSIGGTPDE ENFDGHRKEG GSNNYAVHYS

201 APFGKWTWAF NHNGYRYHQA VSGLSEVYDY NGKSYNTDFG FNRLLYRDAK

251 RKTYLSVKLW TRETKSYIDD AELTVQRRKT TGWLAELSHK GYIGRSTADF

301 KLKYKHGTGM KDALRAPEEA FGEGTSRMKI WTASADVNTP FQIGKQLFAY

351 DTSVHAQWNK TPLTSQDKLA IGGHHTVRGF DGEMSLPAER GWYWRNDLSW

401 QFKPGHQLYL GADVGHVSGQ SAKWLSGQTL AGTAIGIRGQ IKLGGNLHYD

451 IFTGRALKKP EYFQTKKWVT GFQVGYSF*
```

The following partial DNA sequence was identified in *N. meningitidis* <SEQ ID 2855>:

```
m930-1.seq
   1 ATGAAACTTC CTTTATCCTA TTTGCCTAAT ATTCGCTTTT TGTCTTGGTG

51 CTGCTTATTG GCAGGTATCA TTGCTCCTGC TACTTTGTTG GCCTCCCCCA

101 ACCCTGCCGA AATCCGTATG CAGCAAGATA TTCAGCAACG CCAACGCGAA

151 GAGCAGTTGC GCCAAACCAT GCAGCCTGAA AGCGATGTGC GTTTGCATCA

201 AAAAAACACG GGGGAAACGG TTAATCAGTT GATGGGCGAT GACAGCAGCC

251 AACCGTGTTT TGCCATTAAC GAAGTGGTGT TGGAAGGCGA ACACCATGCT

301 CGGTTTCAGT TTGCCCTAAA ACGTGCCTTG CGCGAAACGG GTTTTCAGGC

351 TGGCAAGTGT CTGCATGCGG GCAACATTAA TCAAATCATG TCCTTAGCAC

401 AAAATGCTTT GATCGGCAGG GGATATACCA CGACCCGTAT CTTGGCTGCG

451 CCACAGGATT TGAATAGTGG CAAGCTTCAA TTAACCCTGA TACCGAGCTA

501 TCTGCGCTCC ATACGAATCG ATCGGTCTAA CGATGATCAA ACCCATGCAG

551 GACGTATTGC AGCATTCCAG AACAAATTTC CCACCCGCTC GAACGATCTG

601 TTGAATCTGC GTGATTTGGA ACAAGGACTG GAAAATCTCA AACGTCTCCC

651 GACTGCGGAA GCCGATCTCC AAATCGTTCC CGTAGAGGGA GAACCAAACC

701 AAAGTGATGT CGTGGTGCAA TGGCGGCAAC GTCTGCTGCC CTACCGTGTG

751 AGTGTGGGGA TGGATAATTC GGGTAGTGAG GCGACAGGAA AATACCAAGG

801 AAATATCACT TTCTCTGCCG ACAATCCTTT GGGACTGAGT GATATGTTCT

851 ATGTAAATTA TGGACGTTCG ATTGGCGGTA CGCCCGATGA GGAAAGTTTT

901 GACGGCCATC GCAAAGAAGG CGGATCAAAC AATTACGCCG TACATTATTC

951 AGCCCCTTTC GGTAAATGGA CATGGGCATT CAATCACAAT GGCTACCGTT
```

```
-continued
1001 ACCATCAGGC AGTTTCCGGA TTATCGGAAG TCTATGACTA TAATGGAAAA

1051 AGTTACAATA CTGATTTCGG CTTCAACCGC CTGTTGTATC GTGATGCCAA

1101 ACGCAAAACC TATCTCGGTG TAAAACTGTG GATGAGGGAA ACAAAAAGTT

1151 ACATTGATGA TGCCGAACTG ACTGTACAAC GGCGTAAAAC TGCGGGTTGG

1201 TTGGCAGAAC TTTCCCACAA AGAATATATC GGTCGCAGTA CGGCAGATTT

1251 TAAGTTGAAA TATAAACGCG GCACCGGCAT GAAAGATGCT CTGCGCGCGC

1301 CTGAAGAAGC CTTTGGCGAA GGCACGTCAC GTATGAAAAT TTGGACGGCA

1351 TCGGCTGATG TAAATACTCC TTTTCAAATC GGTAAACAGC TATTTGCCTA

1401 TGACACATCC GTTCATGCAC AATGGAACAA AACCCCGCTA ACATCGCAAG

1451 ACAAACTGGC TATCGGCGGA CACCACACCG TACGTGGCTT CGACGGTGAA

1501 ATGAGTTTGT CTGCCGAGCG GGGATGGTAT TGGCGCAACG ATTTGAGCTG

1551 GCAATTTAAA CCAGGCCATC AGCTTTATCT TGGGGCTGAT GTAGGACATG

1601 TTTCAGGACA ATCCGCCAAA TGGTTATCGG GCCAAACTCT AGTCGGCACA

1651 GCAATTGGGA TACGCGGGCA GATAAAGCTT GGCGGCAACC TGCATTACGA

1701 TATATTTACC GGCCGCGCAT TGAAAAAGCC CGAATTTTTC CAATCAAGGA

1751 AATGGGCAAG CGGTTTTCAG GTAGGCTATA CGTTTTAA
```

This corresponds to the amino acid sequence <SEQ ID 2856; ORF 930-1>:

```
m930-1.pep

1 MKLPLSYLPN IRFLSWCCLL AGIIAPATLL ASPNPAEIRM QQDIQQRQRE

51 EQLRQTMQPE SDVRLHQKNT GETVNQLMGD DSSQPCFAIN EVVLEGEHHA

101 RFQFALKRAL RETGFQAGKC LHAGNINQIM SLAQNALIGR GYTTTRILAA

151 PQDLNSGKLQ LTLIPSYLRS IRIDRSNDDQ THAGRIAAFQ NKFPTRSNDL

201 LNLRDLEQGL ENLKRLPTAE ADLQIVPVEG EPNQSDVVVQ WRQRLLPYRV

251 SVGMDNSGSE ATGKYQGNIT FSADNPLGLS DMFYVNYGRS IGGTPDEESF

301 DGHRKEGGSN NYAVHUSAPF GKWTWAFNHN GYRYHQABSG LSEVYDYNGK

351 SYNTDFGFNR LLYRDAKRKT YLGVKLWMRE TKSYIDDAEL TVQRRKTAGW

401 LAELSHKEYI GRSTADFKLK YKRGTGMKDA LRAPEEAFGE GTSRMKIWTA

451 SADVNTPFQI GKQLFAYDTS VHAQWNKTPL TSQDKLAIGG HHTVRGFDGE

501 MSLSAERGWY WRNDLSWQFK PGHQLYLGAD VGHVSGQSAK WLSGQTLVGT

551 AIGIRGQIKL GGNLHYDIFT GRALKKPEFF QSRKWASGFQ VGYTF* m930-1/g930-1 95.4% indentity in 478 aa overlap 90        100       110       120       130       140
m930-1.pep  AINEVVLEGEHHARFQFALKRALRETGFQAGKCLHAGNINQIMSLAQNALIGRGYTTTRI
                                   |||||||:||||||||||||||||||||||||
g930-1                             GKCLHAGDINQIMSLAQNALIGRGYTTTRI
                                            10        20        30

150       160       170       180       190       200
m930-1.pep  LAAPQDLNSGKLQLTLIPSYLRSIRIDRSNDDQTHAGRIAAFQNKFPTRSNDLLNLRDLE
            ||||||||||||||||:|:|||||||||||||||||||||||||||||||||||||||||
g930-1      LAAPQDLNSGKLQLTLMPGYLRSIRIDRSNDDQTHAGRIAAFQNKFPTRSNDLLNLRDLE
                  40        50        60        70        80        90

210       220       230       240       250       260
m930-1.pep  QGLENLKRLPTAEADLQIVPVEGEPNQSDVVVQWRQRLLPYRVSVGMDNSGSEATGKYQG
            |||||||| |||||||||||||| |||||||||||:|||||:||||||||||||||||||
g930-1      QGLENLKCLPTAEADLQIVPVEREPNQSDVVVQWRXRLLPYCVSVGMDNSGSEATGKYQG
                 100       110       120       130       140       150
```

```
               270       280       290       300       310       320
m930-1.pep  NITFSADNPLGLSDMFYVNYGRSIGGTPDEESFDGHRKEGGSNNYAVHYSAPFGKWTWAF
            ||||||||:|||||||||||||||||||:||||||||||||||||||||||||||||||
g930-1      NITGSADNPFGLSDMFYVNYGRSIGGTPDEENFDGHRKEGGSNNYAVHYSAPFGKWTWAF
               160       170       180       190       200       210

330       340       350       360       370       380
m930-1.pep  NHNGYRYHQAVSGLSEVYDYNGKSYNTDFGFNRLLYRDAKRKTYLGVKLWMRETKSYIDD
            |||||||||||||||||||||||||||||||||||||||||||||:||||||||||||||
g930-1      NHNGYRYHQAVSGLSEVYDYNGKSYNTDFGFNRLLYRDAKRKTYLSVKLWTRETKSYIDD
               220       230       240       250       260       270

390       400       410       420       430       440
m930-1.pep  AELTVQRRKTAGWLAELSHKEYIFRSTADFKLKYKRGTGMKDALRAPEEAFGEGTSRMKI
            ||||||||||:|||||||||| ||||||||||||||:|||||||||||||||||||||||
g930-1      AELTVQRRKTTGWLAELSHKGYIFRSTADFKLKYKHGTGMKDALRAPEEAFGEGTSRMKI
               280       290       300       310       320       330

450       460       470       480       490       500
m930-1.pep  WTASADVNTPFQIGKQLFAYDTSVHAQWNKTPLTSQDKLAIGGHHTVRGFDGEMSLSAER
            ||||||||||||||||||||||||||||||||||||||||||||||||||||||:|||||
g930-1      WTASADVNTPFQIGKQLFAYDTSVHAQWNKTPLTSQDKLAIGGHHTVRGFDGEMPLSAER
               340       350       360       370       380       390

510       520       530       540       550       560
m930-1.pep  GWYWRNDLSWQFKPGHQLYLGADVGHVSGQSAKWLSGQTLVGTAIGIRGQIKLGGNLHYD
            |||||||||||||||||||||||||||||||||||||||:||||||||||||||||||||
g930-1      GWYWRNDLSWQFKPGHQLYLGADVGHVSGQSAKWLSGQTLAGTAIGIRGQIKLGGNLHYD
               400       410       420       430       440       450

570       580       590
m930-1.pep  IFTGRALKKPEFFQSRKWASGFQVGYTF
            ||||||||||:||::||::||||||:|
g930-1      IFTGRALKKPEYFQVTKWVTGFQVGYSFX
               460       470 a930-1.seq not found yet a930-1.pep not found yet
```

The following partial DNA sequence was identified in *N. gonorrhoeae* <SEQ ID 2857>:

```
g931.seq
  1 ATGAAACCCA AATTCAAAAC CGTTTTAACC GCGCTGCTTT TGGCGGTTTC

51 CCTGCCGTCT ATGGCGGCAA CCCGCGTCCT GATGGAAACC GATATGGGCA

101 ATATCCGTTT GGTTTTGGAC GAATCCAAAG CCTCCAAAAC CGTTGCCAAT

151 TTCGTGCGCT ATGCCCGAAA AGGCTTTTAC GACAACACGA TTTTCCACCG

201 CGTcatCGGC GGCTTCGTCA TCCAAGGCGA CGGATTGACC GAGGACTTGG

251 TGCAAAAGGC AACCGATAAG GCCGTTGCCA ACGAATCCGG caacgGCTTG

301 AAAAACACCG TCGGCACCAT CGCAATGGCG CGGACGGCAG CCCCCGATTC

351 CGCCGCCGCC CAATTCTTTA TCAATCTGGC GGACAACGGT TCGCTCGACT

401 ACAAAAACGG ACAATACGGC TACACCGTTT TCGGCAGGGT AGAAAGCGGA

451 ATGGACACCG TTTCCAAAAT CGCCCGCGTC AAAACCGCCA CGCGCGGCTT

501 TTATCAAAAC GTACCCGTAC AGCCCGTCAA AATCCGTCGC GTTGTTGTCG

551 GGCAGTAACA CGCAGACAGA CGTTCAGACG GCGTCGCCCG TTTCCCAAAA

601 AACGCCGTTT AA
```

This corresponds to the amino acid sequence <SEQ ID 2858; ORF 931.ng>:

```
g931.pep
  1 MKPKFKTVLT ALLLAVSLPS MAATRVLMET DMGNIRLVLD ESKASKTVAN

51 FVRYARKGFY DNTIFHRVIG GFVIQGDGLT EDLVQKATDK AVANESGNGL
```

```
101 KNTVGTIAMA RTAAPDSAAA QFFINLADNG SLDYKNGQYG YTVFGRVESG

151 MDTVSKIARV KTATRGFYQN VPVQPVKIRR VVVGQ*
```

The following partial DNA sequence was identified in *N. meningitidis* <SEQ ID 2859>:

```
m931.seq
  1 ATGAAACCCA AATTCAAAAC CGTTTTAACC GCGCTGCTTT TGGCGGTTTC

51 CCTGCCGTCT ATGGCGGCAA CCCATGTTTT GATGGAAACC GATATGGGCA

101 ATATCCGTTT GGTTTTGGAC GAATCCAAAG CCCCCAAAAC CGTTGCTAAT

151 TTCGTGCGCT ATGCCCGAAA AGGCTTTTAC GACGACACCG TTTTTCACCG

201 CGTTATCGAC GGTTTTGTTA TCCAGGGCGG TGGATTGACC GAGGACTTGG

251 CACAAAAGGC AAGCGATAAG GCCGTTGCCA ACGAATCCGG CAACGGCTTG

301 AAAAACACCG CCGGCACCAT CGCCATGGCG CGGACGACAG CCCCCGATTC

351 CGCCACCAGC CAATTCTTTA TCAATCTGGC GGACcA.kCT TCGCTCGACT

401 ACAAAAACGG ACAATACGGC TATACCGTTT TCGGCAGGGT CGAAAGCGGC

451 ATGAACACCG TTTCCAAAAT CGCCCGCGTC AAAACCGCCA CGCGCGGCTT

501 TTATCAAAAC GTACCCGTAC AGCCCGTCAA AATCCGTCGC GTTGTTGTCG

551 GGCAGTAA
```

This corresponds to the amino acid sequence <SEQ ID 2860; ORF 931>:

```
m931.pep..
  1 MKPKFKTVLT ALLLAVSLPS MAATHVLMET DMGNIRLVLD ESKAPKTVAN

51 FVRYARKGFY DDTVFHRVID GFVIQGGGLT EDLAQKASDK AVANESGNGL

101 KNTAGTIAMA RTTAPDSATS QFFINLADXX SLDYKNGQYG YTVFGRVESG

151 MNTVSKIARV KTATRGFYQN VPVQPVKIRR VVVGQ*
```

Computer analysis of this amino acid sequence gave the following results:
Homology with a Predicted ORF from *N. gonorrhoeae*
ORF 931 shows 91.9% identity over a 185 aa overlap with a predicted ORF (ORF 931.ng) from *N. gonorrhoeae*:

```
g931/m931
                     10         20         30         40         50         60
        g931.pep  MKPKFKTVLTALLLAVSLPSMAATRVLMETDMGNIRLVLDESKASKTVANFVRYARKGFY
                  ||||||||||||||||||||||||:||||||||||||||||||||:||||||||||||||
        m931      MKPKFKTVLTALLLAVSLPSMAATHVLMETDMGNIRLVLDESKAPKTVANFVRYARKGFY
                     10         20         30         40         50         60

70         80         90        100        110        120
        g931.pep  DNTIFHRVIGGFVIQGDGLTEDLVQKATDKAVANESGNGLKNTVGTIAMARTAAPDSAAA
                  |:|:||||| |||||| ||||||:|||:||||||||||||||||:||||||||:||||::
        m931      DDTVFHRVIDGFVIQGGGLTEDLAQKASDKAVANESGNGLKNTAGTIAMARTTAPDSATS
                     70         80         90        100        110        120

130        140        150        160        170        180
        g931.pep  QFFINLADNGSLDYKNGQYGYTVFGRVESGMDTVSKIARVKTATRGFYQNVPVQPVKIRR
                  ||||||||  ||||||||||||||||||||:|||||||||||||||||||||||||||||
        m931      QFFINLADXXSLDYKNGQYGYTVFGRVESGMNTVSKIARVKTATRGFYQNVPVQPVKIRR
                    130        140        150        160        170        180 g931.pep  VVVGQX
                  ||||||
        m931      VVVGQX
```

The following partial DNA sequence was identified in *N. meningitidis* <SEQ ID 2861>:

```
a931.seq
   1 ATGAAACCCA AATTCAAAAC CGTTTTAACC GCGCTGCTTT TGGCGGTTTC

51 CCTGCCGTCT ATGGCGGCAA CCCATGTTTT GATGGAAACC GATATGGGCA

101 ATATCCGTTT GGTTTTGGAC GAATCCAAAG CACCCAAAAC CGTTGCCAAT

151 TTCGTGCGCT ATGCCCGAAA AGGCTTTTAC GACAATACGA TTTTTCACCG

201 CGTCATCGGC GGCTTCGTTA TCCAAGGCGG CGGATTGACC GAGGACTTGG

251 CACAAAAGGC AAGCGATAAG GCCGTTGCCA ACGAATCCGG CAACGGCTTG

301 AAAAACACTG TCGGCACCAT CGCCATGGCG CGGACGGCCG ATCCGGATTC

351 CGCCACCAGC CAATTCTTTA TCAATCTGGT GGACAATGAT TCGCTCAACT

401 ACAAAAACGG ACAATACGGC TATACCGTTT TCGGCAGGGT CGAAAGCGGC

451 ATGAACACCG TTTCCAAAAT CGCCCGCGTC AAAACCGCCA CGCGCGGCTT

501 TTATCAAAAC GTACCCGTAC AGCCCGTCAA AATCCGTCGC GTTGTTGTCG

551 GGCAGTAA
```

This corresponds to the amino acid sequence <SEQ ID 2862; ORF 931.a>:

```
a931.pep
   1 MKPKFKTVLT ALLLAVSLPS MAATHVLMET DMGNIRLVLD ESKAPKTVAN

51 FVRYARKGFY DNTIFHRVIG GFVIQGGGLT EDLAQKASDK AVANESGNGL

101 KNTVGTIAMA RTADPDSATS QFFINLVDND SLNYKNGQYG YTVFGRVESG

151 MNTVSKIARV KTATRGFYQN VPVQPVKIRR VVVGQ*
``` m931/a931 94.6% identity in 185 aa overlap

```
                         10         20         30         40         50         60
       m931.pep  MKPKFKTVLTALLLAVSLPSMAATHVLMETDMGNIRLVLDESKAPKTVANFVRYARKGFY
                 ||||||||||||||||||||||||||||||||||||||||||||||||||||||||||||
       a931      MKPKFKTVLTALLLAVSLPSMAATHVLMETDMGNIRLVLDESKAPKTVANFVRYARKGFY
                         10         20         30         40         50         60
                         70         80         90        100        110        120
       m931.pep  DDTVFHRVIDGFVIQGGGLTEDLAQKASDKAVANESGNGLKNTAGTIAMARTTAPDSATS
                 |:|:||||| |||||| |||||||||||||||||||||||||||:||||||:  ||||||
       a931      DNTIFHRVIGGFVIQGGGLTEDLAQKASDKAVANESGNGLKNTVGTIAMARTADPDSATS
                         70         80         90        100        110        120
                        130        140        150        160        170        180
       m931.pep  QFFINLADXXSLDYKNGQYGYTVFGRVESGMNTVSKIARVKTATRGFYQNVPVQPVKIRR
                 |||||:|   ||:||||||||||||||||||||||||||||||||||||||||||||||
       a931      QFFINLVDNDSLNYKNGQYGYTVFGRVESGMNTVSKIARVKTATRGFYQNVPVQPVKIRR
                        130        140        150        160        170        180
       m931.pep  VVVGQX
                 ||||||
       a931      VVVGQX
       g932.seq  not found yet
       g932.pep  not found yet
```

The following partial DNA sequence was identified in *N. meningitidis* <SEQ ID 2863>:

```
m932.seq
   1 ATGAAATATA TCGTATCAAT CTCTCTGGCT ATGGGATTGG CTGCCTGTTC

51 GTTTGGGGGA TTTAAACCAA ATCCGTGGGA CGCCGCGTCA TTTTGGGAAT
```

-continued

```
101 TGAAAAATTA CGCCAATCCC TATCCGGGAT CAGCCTCGGC GGCACTTGAC

151 CAATATCCAT CGAAAGCAAG ACGAAGGCAA CTGAAAGACA TGCAAGAGTG

201 CGGCTATGAC CCAATAGACG GCGGAAAGTC TGAAGCAGAT GCCTGCCTGA

251 GGAAAAAAGG CTGGTGTCGT AAGGGTTTCG ACCCTTATCC CGAAAACAAA

301 AAATACGAAT GGCCTCGAGA AGAAGGAAAA ACAAAATGA
```

This corresponds to the amino acid sequence <SEQ ID 2864; ORF 932>:

```
m932.pep
   1 MKYIVSISLA MGLAACSFGG FKPNPWDAAS FWELKNYANP YPGSASAALD

51 QYPSKARRRQ LKDMQECGYD PIDGGKSEAD ACLRKKGWCR KGFDPYPENK

101 KYEWPREEGK TK*
```

Computer analysis of this amino acid sequence gave the following results:
Homology with a Predicted ORF from *N. gonorrhoeae*
ORF 932 shows % identity over a aa overlap with a predicted ORF (ORF 932.ng) from *N. gonorrhoeae*:
The following partial DNA sequence was identified in *N. gonorrhoeae* <SEQ ID 2865>:

```
g934.seq
   1 ATGAAAAAAA TCATCGCCTC CGCGCTTATC GCAACATTCG CACTCACCGC

51 CTGCCAAGAC GACACGCAGG CGCGGCTCGA ACGGCAGCAG AAACAGATTG

101 AAGCCCTGCA ACAGCAGCTC GCACAGCAGG CAGACGATAC GGTTTACCAA

151 CTGACTCCCG AAGCAGTCAA AGACACCATT CCTGCCCAGG CGCAGGCAAA

201 CGGCAACAAC GGTCAGCCCG TTACCGGCAA .AGAcggGCA GCAGTATATT

251 TACGACCAAT CGACAGGAAG CTGGCTGCTG CAAAGCCTGA TTGGCGCGGC

301 GGCAGGCGCG TTTATCGGCA ACGCGCTGGC AAACAAATTC ACACGGGCGG

351 GCAACCAAGA CAGCCCCGTC GCCCGTCGCG CGCGTGCTGC CTACCATCAG

401 TCCGCACGCC CCAATGCGCG CACCAGCAGG GATTTGAACA CGCGCAGCCT

451 CCGTGCAAAA CAACAGGCGG CGCAGGCGCA GCGTTACCGC CCGACAACGC

501 GCCCGCCCGT CAAttaccgc catcgcgcta tgcGCGGTTT CGgcagAagg 551 cggtaaaCCC GGCGCGTCAA TGCCGTCTGA AGGGCTTTCA GACGGCATTT

601 TTGTATTTGT TAGGGGCATT GTTATGTTGC CGTTTGATTT TCAGACGGCA

651 TTTTGTTTCC AAGCGTTTGA TGTcggGATG GCAATTCTGA
```

This corresponds to the amino acid sequence <SEQ ID 2866; ORF 934.ng>:

```
g934.pep
   1 MKKIIASALI ATFALTACQD DTQARLERQQ KQIEALQQQL AQQADDTVYQ

51 LTPEAVKDTI PAQAQANGNN GQPVTGKRRA AVYLRPIDRK LAAAKPDWRG

101 GRRVYRQRAG KQIHTGGQPR QPRRPSRACC LPSVRTPQCA HQQGFEHAQP

151 PCKTTGGAGA ALPPDNAPAR QLPPSRYARF RQKAVNPARQ CRLKGFQTAF

201 LYLLGALLCC RLIFRRHFVS KRLMSGWQF*
```

The following partial DNA sequence was identified in *N. meningitidis* <SEQ ID 2867>:

```
m934.seq (partial)
   1 ..CGGCTCGAAC AGCAGCAGAA ACAGATTGAA GCCCTGCAAC AGCAGCTCGC

51   ACAGCAGGCA GACGATACGG TTTACCAACT GACTCCCGAA GCAGTCAAAG

101   ACACCATTCC TGCCGAAGCA CAGGCAAACG GCAACAACgG GCAACCCGTT

151   ACCGGTAA.A GACGGGCAGC AGTATATTTA CGACCAATCG ACAGGAAGCT

201   GGCTGCTGCA AAGCCTGGTC GGCGCGGCGG CAGGCGCGTT TATCGGCAAC

251   GCGCTGGCAA ACAAATTCAC ACGGGCAGGC AACCAAGACA GTCCCGTCGC

301   CCGGCGCGCG CGTGCAGCCT ACCATCAGTC CGCACGCCCC AATGCGCGCA 351   yCAGCAGGGA TTTGAACACG CGCAGCCTCC GTGCAAAACA ACAGGCGGCG

401   CAkGCGCAGC GTTACCGCCC GACAACGCGC CCGsCCGsCA ATTACCGCCG

451   CCCCGCTATG CGCGGTTTCG GCAGGAGGCG GTAAACCCGG CGCGCCAATG

501   CCGTCTGAAG AGCTTTCAGA CGGCATTTnT GCATTTGTTA GGGACATTGT

551   TATGTTGCCG TTTGATTTTC AGACGGCATT TTGTTTCCAA GCGTTTGATG

601   TCGGGATGGC AATTCTGA
```

This corresponds to the amino acid sequence <SEQ ID 2868; ORF 934>:

```
m934.pep (partial)
   1 ..RLEQQQKQIE ALQQQLAQQA DDTVYQLTPE AVKDTIPAEA QANGNNGQPV

51   TGXRRAAVYL RPIDRKLAAA KPGRRGGRRV YRQRAGKQIH TGRQPRQSRR

101   PARACSLPSV RTPQCAHQQG FEHAQPPCKT TGGAXAALPP DNAPXRQLPP

151   PRYARFRQEA VNPARQCRLK SFQTAFXHLL GTLLCCRLIF RRHFVSKRLM

201   SGWQF*
```

Computer analysis of this amino acid sequence gave the following results:

Homology with a Predicted ORF from *N. gonorrhoeae*

ORF 934 shows 91.7% identity over a 205 aa overlap with a predicted ORF (ORF 934.ng) from *N. gonorrhoeae*:

```
m934/g934

10        20        30
m934.pep                              RLEQQQKQIEALQQQLAQQADDTVYQLTPEAVKDTI
                                      |||:||||||||||||||||||||||||||||||||
g934          MKKIIASALIATFALTACQDDTQARLERQQKQIEALQQQLAQQADDTVYQLTPEAVKDTI
                      10        20        30        40        50        60

40        50        60        70        80        90
m934.pep      PAEAQANGNNGQPVTGXRRAAVYLRPIDRKLAAAKPGRRGGRRVYRQRAGKQIHTGRQPR
              ||:||||||||||||| |||||||||||||||||||  |||||||||||||||||| |||
g934          PAQAQANGNNGQPVTGKRRAAVYLRPIDRKLAAAKPDWRGGRRVYRQRAGKQIHTGGQPR
                      70        80        90       100       110       120

100       110       120       130       140       150
m934.pep      QSRRPARACSLPSVRTPQCAHQQGFEHAQPPCKTTGGAXAALPPDNAPXRQLPPPRYARF
              | |||||:| |||||||||||||||||||||||||||| ||||||||| ||||| |||||
g934          QPRRPARSCCLPSVRTPQCAHQQGFEHAQPPCKTTGGAGAALPPDNAPARQLPPSRYARF
                     130       140       150       160       170       180

160       170       180       190       200
m934.pep      RQEAVNPARQCRLKSFQTAFXHLLGTLLCCRLIFRRHFVSKRLMSGWQFX
              ||:|||||||||||:||||| :|||:||||||||||||||||||||||||
g934          RQKAVNPARQCRLKGFQTAFLYLLGALLCCRLIFRRHFVSKRLMSGWQFX
                     190       200       210       220       230
```

The following partial DNA sequence was identified in *N. meningitidis* <SEQ ID 2869>:

```
a934.seq
   1 ATGAAAAAAA TCATCGCCTC CGCGCTTATC GCAACATTCG CACTCGCCGC

51 CTGCCAAGAC GACGCGCAGG CGCGGCTCGA ACAGCAGCAG AAACAGATTG

101 AAGCCCTGCA ACAGCAGCTC GCACAGCAGG CAGACGATAC GGTTTACCAA

151 CTGACTCCCG AAGCAGTCAA AGACACCATT CCTGCCGAAG CACAGGCAAA

201 CGGCAACAAC GGGCAACCCG TTACCGG.TA AAGACGGGCA GCAGTATATT

251 TACGACCAAT CGACAGGAAG CTGGCTGCTG CAAAGCCTGG TCGGCGCGGC

301 GGCAGGCGCG TTTATCGGCA ACGCGCTGGC AAACAAATTC ACACGGGCAG

351 GCAACCAAGA CAGTCCCGTC GGCAGGCGCG CGCGTGCCGC CTACCATCAG

401 TCCGCACATC CCAATGCGCG CACCAGCAGG GATTTGAACA CGCGCAGCCT

451 CCGTGCAAAA CAACAGGCGG CGCAGGCGCA GCGTTACCGC CCGACAACGC

501 GCCCGCCCGC CAATTACCGC CGCCCCGCCA TGCGCGGTTT CGGCAGAAGG

551 CGGTAAATCC GGCGTGCCAA TGCCGTCTGA AGGGCTTTCA GACGGCATTT

601 TTGTATTTGT TAGGGACATT GTTATGTTGC CGTTTGATTT TTAGACGGCA

651 TTTTGTTTCC AAGAGTTTGA TGTCGGGATG GCAATTCTGA
```

This corresponds to the amino acid sequence <SEQ ID 2870; ORF 934.a>:

```
a934.pep
   1 MKKIIASALI ATFALAACQD DAQARLEQQQ KQIEALQQQL AQQADDTVYQ

51 LTPEAVKDTI PAEAQANGNN GQPVTX*RRA AVYLRPIDRK LAAAKPGRRG

101 GRRVYRQRAG KQIHTGRQPR QSRRPARACR LPSVRTSQCA HQQGFEHAQP

151 PCKTTGGAGA ALPPDNAPAR QLPPPRHARF RQKAVNPACQ CRLKGFQTAF

201 LYLLGTLLCC RLIFRRHFVS KSLMSGWQF*
``` m934/a934 94.1% identity in 205 aa overlap

```
                                              10        20        30
m934.pep                              RLEQQQKQIEALQQQLAQQADDTVYQLTPEAVKDTI
                                      ||||||||||||||||||||||||||||||||||||
a934          MKKIIASALIATFALTACQDDTQARLEQQQKQIEALQQQLAQQADDTVYQLTPEAVKDTI
                      10        20        30        40        50        60

40        50        60        70        80        90
m934.pep      PAEAQANGNNGQPVTGXRRAAVYLRPIDRKLAAAKPGRRGGRRVYRQRAGKQIHTGRQPR
              ||||||||||||||| ||||||||||||||||||||||||||||||||||||||||||||
a934          PAEAQANGNNGQPVTXKRRAAVYLRPIDRKLAAAKPGRRGGRRVYRQRAGKQIHTGRQPR
                      70        80        90       100       110       120

100       110       120       130       140       150
m934.pep      QSRRPARACSLPSVRTPQCAHQQGFEHAQPPCKTTGGAXAALPPDNAPXRQLPPPRYARF
              ||||||||| |||||| ||||||||||||||||||||| ||||||||| |||||||:|||
a934          QSRRPARSCRLPSVRTSQCAHQQGFEHAQPPCKTTGGAGAALPPDNAPARQLPPSRHARF
                     130       140       150       160       170       180

160       170       180       190       200
m934.pep      RQEAVNPARQCRLKSFQTAFXHLLGTLLCCRLIFRRHFVSKRLMSGWQFX
              ||:|||||||| ||:||||| :|||:||||||||||||||| ||||||||
a934          RQKAVNPARQCCLKGFQTAFLYLLGALLCCRLIFRRHFVSKSLMSGWQFX
                     190       200       210       220       230 g935.seq not found yet
g935.pep not found yet
```

The following partial DNA sequence was identified in *N. meningitidis* <SEQ ID 2871>:

m935.seq

1 ATGTTGTATT TCAGATACGG CTTTTTGGTT GTTTGGTGTG CGGCAGGTGT

51 TTCTGCCGCC TATGGGGCGG ATGCGCCCGC GATTTTGGAT GACAAGGCAT

101 TGTTGCAGGT GCAGCGGTCG GTGTCGGATA AGTGGGCGGA ATCAGATTGG

151 AAAGTTGAAA ATGATGCCCC GCGCGTGGTT GACGGGGATT TTTTGTTGGC

201 GCATCCGAAA ATGTTGGAAC ATAGTTTGCG CGACGCGCTC AACGGCAATC

251 AGGCGGATTT AATCGCTTCG TTGGCGGATT TGTATGCCAA GCTGCCGGAT

301 TATGACGCGG TTTTGTACGG CAGGGCGCGG GCTTTGCTGG CGAAATTGGC

351 GGGAAGGCCG GCGGAGGCGG TGGCGCGGTA TCGGGAACTG CACGGGGAAA

401 ATGCGGCAGA CGAGCGGATT TTGCTGGATT TGGCGGCGGC GGAGTTTGAC

451 GATTTCCGGC TGAAGTCGGC AGAAAGGCAT TTTGCGGAGG CGGCAAAATT

501 GGATTTGCCG GCACCGGTTT TGGAAAATGT GGGGCGTTTT CGGAAAAAAA

551 CGGAGGGGCT GACGGGCTGG CGTTTTTCGG GCGGCATCAG TCCGGCGGTC

601 AATAGAAATG CCAATAATGC CGCGCCGCAA TATTGCCGGC AAAACGGAGG

651 CCGGCAGATA TGCAGTGTCA GCCGGGCGGA GCGGGCGGCA GGGTTGAATT

701 ATGAAATCGA GGCGGAAAAG CTGACGCCGT TGGCAGATAA TCATTATTTG

751 TTGTTCCGTT CCAATATCGG CGGCACGAGC TATTATTTCA GTAAAAAATC

801 AGCTTATGAT GACGGGTTCG GCAGGGCGTA TTTGGGTTGG CAGTATAAAA

851 ATGCACGGCA GACGGCGGGG ATTTTGCCGT TTTATCAGGT GCAGTTGTCG

901 GGCAGCGACG GCTTTGATGC GAAAACAAAA CGGGTAAACA ACCGCCGCCT

951 GCCGCCGTAT ATGCTGGCGC ACGGAGTCGG CGTGCAGCTG TCCCATACTT

1001 ACCGCCCAAA CCCGGGATGG CAATTTTCGG TCGCGCTGGA ACATTACCGC

1051 CAACGCTACC GCGAACAGGA TAGGGCGGAA TACAATAACG GCAGGCAGGA

1101 CGGGTTTTAT GTTTCGTCGG CAAAACGTTT GGGCGAATCG GCAACTGTGT

1151 TCGGCGGCTG GCAGTTTGTG CGGTTTGTGC CGAAACGCGA AACGGTGGGC

1201 GGCGCGGTCA ATAATGCCGC CTACCGGCGC AACGGTGTTT ATGCCGGTTG

1251 GGCGCAGGAG TGGCGGCAGT TGGGCGGTTT GAACAGTCGG GTTTCCGCGT

1301 CTTATGCCCG CCGCAACTAT AAGGGCATTG CGGCTTTCTC GACAGAGGCG

1351 CAACGCAACC GCGAATGGAA TGTCTCGCTG GCTTTGAGCC ACGACAAGTT

1401 GTCGTACAAA GGTATCGTGC CGGCGTTGAA TTATCGTTTC GGCAGGACGG

1451 AAAGTAATGT GCCGTATGCG AAACGCCGCA ACAGCGAGGT GTTTGTGTCG

1501 GCGGATTGGC GGTTTTGA

This corresponds to the amino acid sequence <SEQ ID 2872; ORF 925>:

m935.pep

1 MLYFRYGFLV VWCAAGVSAA YGADAPAILD DKALLQVQRS VSDKWAESDW

51 KVENDAPRVV DGDFLLAHPK MLEHSLRDAL NGNQADLIAS LADLYAKLPD

101 YDAVLYGRAR ALLAKLAGRP AEAVARYREL HGENAADERI LLDLAAAEFD

151 DFRLKSAERH FAEAAKLDLP APVLENVGRF RKKTEGLTGW RFSGGISPAV

-continued

```
201 NRNANNAAPQ YCRQNGGRQI CSVSRAERAA GLNYEIEAEK LTPLADNHYL

251 LFRSNIGGTS YYFSKKSAYD DGFGRAYLGW QYKNARQTAG ILPFYQVQLS

301 GSDGFDAKTK RVNNRRLPPY MLAHGVGVQL SHTYRPNPGW QFSVALEHYR

351 QRYREQDRAE YNNGRQDGFY VSSAKRLGES ATVFGGWQFV RFVPKRETVG

401 GAVNNAAYRR NGVYAGWAQE WRQLGGLNSR VSASYARRNY KGIAAFSTEA

451 QRNREWNVSL ALSHDKLSYK GIVPALNYRF GRTESNVPYA KRRNSEVFVS

501 ADWRF*
```

The following partial DNA sequence was identified in *N. meningitidis* <SEQ ID 2873>:

```
a935.seq
   1 ATGTTGTATT TCAGATACGG TTTTTTGGTT GTTTGGTGTG CGGCAGGTGT

51 TTCTGCCGCC TATGGGGCGG ATGCGCCCGC GATTTTGGAT GACAAGGCAT

101 TGTTGCAGGT GCAGCGGTCG GTGTCGGATA AGTGGGCGGA ATCGGATTGG

151 AAAGTTGACA ATGATGCCCC GCGCGTGGTT GACGGGGATT TTTTGTTGGC

201 GCATCCGAAA ATGTTGGAAC ATAGTTTGCG CGACGTGCTC AACGGCAATC

251 AGGCGGATTT GATCGCTTCG TTGGCGGATT TGTATGCCAA GCTGCCGGAT

301 TATGACGCGG TTTTGTACGG CAGGGCGCGG GCTTTGCTGG CGAAATTGGC

351 GGGAAGGCCG GCGGAGGCGG TGGCGCGGTA TCGGGAACTG CACGGGGAAA

401 ATGCGGCAGA CGAGCGGATT TTGCTGGATT TGGCGGCGGC GGAGTTTGAC

451 GATTTCCGGC TGAAGTCGGC AGAAAGGCAT TTTGCCGAGG CGGAAAAATT

501 GGATTTGCCG GCGCCGGTTT TGGAAAATGT GGGGCGTTTT CGGAAAAAAG

551 CGGAGGGGCT GACGGGCTGG CGTTTTTCGG GCGGCATCAG TCCGGCGGTC

601 AATAGAAATG CCAATAATGC CGCGCCGCAG TATTGCCGGC AAAACGGAGG

651 CCGGCAGATA TGCAGTGTCA GCCGGGCGGA GCGGGCGGCA GGCTTGAATT

701 ATGAAATCGA GGCGGAAAAA CTGACGGCGT TGGCAGATAA TCATTATTTG

751 TTGTTCCGTT CCAATATCGG CGGCACGAGC TATTATTTCA GTAAAAAATC

801 AGCTTATGAC GACGGGTTCG GCAGAGCGTA TTTGGGTTGG CAGTATAAAA

851 ATGCACGGCA GACGGCGGGG ATTTTGCCGT TTTATCAGGT GCAGTTGTCG

901 GGCAGCGACG GCTTTGATGC GAAAACAAAA CGGGTAAACA ACCGCCGCCT

951 GCCGCCGTAT ATGCTGGCGC ACGGAGTCGG CGTGCAGTTG TCCCATACTT

1001 ACCGCCCAAA CCCGGGATGG CAATTTTCGG TCGCGCTGGA ACATTACCGC

1051 CAACGCTACC GCGAACAGGA TAGGGCGGAA TACAATAACG GTCGGCAGGA

1101 CGGGTTTTAT GTTTCGTCGG CAAAACGTTT GGGCGAATCG GCAACTGTGT

1151 TCGGCGGCTG GCAGTTTGTG CGGTTTGTGC CGAAACGCGA AACGGTGGGC

1201 GGCGCGGTCA ATAATGCCGC CTACCGGCGC AACGGTGTTT ATGCCGGCTG

1251 GGCGCAGGAG TGGCGGCAGT TGGGCGGTTT GAACAGTCGG GTTTCCGCGT

1301 CTTATGCCCG CCGCAACTAT AAGGGCGTTG CGGCTTTCTC GACAGAGGCG

1351 CAACGCAACC GCGAATGGAA TGTCTCGCTG GCTTTGAGCC ACGACAAGTT

1401 GTCGTACAAA GGTATCGTGC CCGCGTTGAA TTATCGTTTC GGCAGGACGG
```

```
1451  AAAGTAATGT GCCGTATGCG AAACGCCGCA ACAGCGAGGT GTTTGTGTCG

1501  GCGGATTGGC GGTTTTGA
```

This corresponds to the amino acid sequence <SEQ ID 2874; ORF 935.a>:

```
a935.pep
  1  MLYFRYGFLV VWCAAGVSAA YGADAPAILD DKALLQVQRS VSDKWAESDW

51  KVDNDAPRVV DGDFLLAHPK MLEHSLRDVL NGNQADLIAS LADLYAKLPD

101  YDAVLYGRAR ALLAKLAGRP AEAVARYREL HGENAADERI LLDLAAAEFD

151  DFRLKSAERH FAEAEKLDLP APVLENVGRF RKKAEGLTGW RFSGGISPAV

201  NRNANNAAPQ YCRQNGGRQI CSVSRAERAA GLNYEIEAEK LTALADNHYL

251  LFRSNIGGTS YYFSKKSAYD DGFGRAYLGW QYKNARQTAG ILPFYQVQLS

301  GSDGFDAKTK RVNNRRLPPY MLAHGVGVQL SHTYRPNPGW QFSVALEHYR

351  QRYREQDRAE YNNGRQDGFY VSSAKRLGES ATVFGGWQFV RFVPKRETVG

401  GAVNNAAYRR NGVYAGWAQE WRQLGGLNSR VSASYARRNY KGVAAFSTEA

451  QRNREWNVSL ALSHDKLSYK GIVPALNYRF GRTESNVPYA KRRNSEVFVS

501  ADWRF*
``` m935/a935 98.8% identity in 505 aa overlap

```
                  10         20         30         40         50         60
        m935.pep  MLYFRYGFLVVWCAAGVSAAYGADAPAILDDKALLQVQRSVSDKWAESDWKVENDAPRVV
                  ||||||||||||||||||||||||||||||||||||||||||||||||||:|||||||
        a935      MLYFRYGFLVVWCAAGVSAAYGADAPAILDDKALLQVQRSVSDKWAESDWKVDNDAPRVV
                  10         20         30         40         50         60

70         80         90        100        110        120
        m935.pep  DGDFLLAHPKMLEHSLRDALNGNQADLIASLADLYAKLPDYDAVLYGRARALLAKLAGRP
                  ||||||||||||||||||:|||||||||||||||||||||||||||||||||||||||||
        a935      DGDFLLAHPKMLEHSLRDVLNGNQADLIASLADLYAKLPDYDAVLYGRARALLAKLAGRP
                  70         80         90        100        110        120

130        140        150        160        170        180
        m935.pep  AEAVARYRELHGENAADERILLDLAAAERDDFRLKSAERHFAEAAKLDLPAPVLENVGRF
                  |||||||||||||||||||||||||||| |||||||||||||||| |||||||||||||
        a935      AEAVARYRELHGENAADERILLDLAAAERDDFRLKSAERHFAEAEKLDLPAPVLENVGRF
                 130        140        150        160        170        180

190        200        210        220        230        240
        m935.pep  RKKTEGLTGWRFSGGISPAVNRNANNAAPQYCRQNGGRQICSVSRAERAAGLNYEIEAEK
                  |||:||||||||||||||||||||||||||||||||||||||||||||||||||||||||
        a935      RKKAEGLTGWRFSGGISPAVNRNANNAAPQYCRQNGGRQICSVSRAERAAGLNYEIEAEK
                 190        200        210        220        230        240

250        260        270        280        290        300
        m935.pep  LTPLADNHYLLFRSNIGGTSYYFSKKSAYDDGFGRAYLGWQYKNARQTAGILPFYQVQLS
                  || |||||||||||||||||||||||||||||||||||||||||||||||||||||||||
        a935      LTALADNHYLLFRSNIGGTSYYFSKKSAYDDGFGRAYLGWQYKNARQTAGILPFYQVQLS
                 250        260        270        280        290        300

310        320        330        340        350        360
        m935.pep  GSDGFDAKTKRVNNRRLPPYMLAHGVGVQLSHTYRPNPGWQFSVALEHYRQRYREQDRAE
                  ||||||||||||||||||||||||||||||||||||||||||||||||||||||||||||
        a935      GSDGFDAKTKRVNNRRLPPYMLAHGVGVQLSHTYRPNPGWQFSVALEHYRQRYREQDRAE
                 310        320        330        340        350        360

370        380        390        400        410        420
        m935.pep  YNNGRQDGFYVSSAKRLGESATVFGGWQFVRFVPKRETVGGAVNNAAYRRNGVYAGWAQE
                  ||||||||||||||||||||||||||||||||||||||||||||||||||||||||||||
        a935      YNNGRQDGFYVSSAKRLGESATVFGGWQFVRFVPKRETVGGAVNNAAYRRNGVYAGWAQE
                 370        380        390        400        410        420

430        440        450        460        470        480
        m935.pep  WRQLGGLNSRVSASYARRNYKGIAAFSTEAQRNREWNVSLALSHDKLSYKGIVPALNYRF
                  |||||||||||||||||||||||:||||||||||||||||||||||||||||||||||||
        a935      WRQLGGLNSRVSASYARRNYKGVAAFSTEAQRNREWNVSLALSHDKLSYKGIVPALNYRF
                 430        440        450        460        470        480
```

```
                          -continued
                        490        500
   m935.pep     GRTESNVPYAKRRNSEVFVSADWRFX
                |||||||||||||||||||||||||
   a935         GRTESNVPYAKRRNSEVFVSADWRFX
                        490        500
```

The following partial DNA sequence was identified in *N. gonorrhoeae* <SEQ ID 2875>:

```
g936.seq
   1 ATGAAACCCA AACCACACAC CGTCCGCACC CTGATTGCCG CCGTCCTCAG
  51 CCTTGCCCTC GGCGGCTGCT TCAGCGCAGT CGTCGGCGGG GCCGCCGTCG
 101 GCGCAAAATC CGTCATCGAC CGccgAACCA CCGgcgcgca AACCGATGac
 151 aACGTTATGG CGTTGCGTAT CGAAACCACC GCCCGTTCCT ACCTGCGCCA
 201 AAACAACCAA ACCAAAGGCT ACACGCCCCA AATCTCCGTC GTCGGCTACA
 251 ACCGCCACCT GCTGCTGCTC GGACAAGTCG CCACCGAAGG CGAAAAACAG
 301 TTCGTCGGTC AGATTGCACG TTCCGAACAG GCCGCCGAAG GCGTATACAA
 351 CTACATTACC GTCGCCTCCC TGCCGCGCAC TGCGGGCGAC ATCGCCGGCG
 401 ACACTTGGAA CACGTCCAAA GTCCGCGCca cgCTGCTGGG CATCAGCCCC
 451 GCTACACAGG CGCGCGTCAA AATCATTACC TACGGCAATG TAACCTACGT
 501 TATGGGCATC CTCACCCCCG AAGAACAGGC GCAGATTACC CAAAAAGTCA
 551 GCACCAccgT CGGCGTACAA AAAGTCATTA CCCTCTACCA AAACTACGTC
 601 CAACGCTGA
```

This corresponds to the amino acid sequence <SEQ ID 2876; ORF 936.ng>:

```
g936.pep
   1 MKPKPHTVRT LIAAVLSLAL GGCFSAVVGG AAVGAKSVID RRTTGAQTDD
  51 NVMALRIETT ARSYLRQNNQ TKGYTPQISV VGYNRHLLLL GQVATEGEKQ
 101 FVGQIARSEQ AAEGVYNYIT VASLPRTAGD IAGDTWNTSK VRATLLGISP
 151 ATQARVKIIT YGNVTYVMGI LTPEEQAQIT QKVSTTVGVQ KVITLYQNYV
 201 QR*
```

The following partial DNA sequence was identified in *N. meningitidis* <SEQ ID 2877>:

```
m936.seq (partial)
   1 ATGAAACCCA AACCGCACAC CGTCCGCACC CTGATTGCCG CCATTTTCAG
  51 CCTTGCCCTT AGCGGCTGCG TCAGCGCAGT AATCGGAAGC GCCGCCGTCG
 101 GCGCGAAATC CGCCGTCGAC CGCCGAACCA CCGGCGCGCA AACCGACGAC
 151 AACGTTATGG CGTTGCGTAT CGAAACCACC GCCCGTTCCT ATCTGCGCCA
 201 AAACAACCAA ACCAAAGGCT ACACGCCCCA AATCTCCGTC GTCGGCTACA
 251 ACCGCCACCT GCTGCTGCTC GGACAAGTCG CCACCGAAGG CGAAAAACAG
 301 TTCGTCGGTC AGATTGCACG TTCCGAACAG GCCGCCGAAG GCGTGTACAA
 351 CTATATTACC GTCGCCTCCC TGCCGCGCAC TGCC...
```

This corresponds to the amino acid sequence <SEQ ID 2878; ORF 936>:

```
m936.pep (partial)
   1 MKPKPHTVRT LIAAIFSLAL SGCVSAVIGS AAVGAKSAVD RRTTGAQTDD

51 NVMALRIETT ARSYLRQNNQ TKGYTPQISV VGYNRHLLLL GQVATEGEKQ

101 FVGQIARSEQ AAEGVYNYIT VASLPRTA...
```

Computer analysis of this amino acid sequence gave the following results:
Homology with a Predicted ORF from *N. gonorrhoeae*
ORF 936 shows 93.8% identity over a 128 aa overlap with a predicted ORF (ORF 936.ng) from *N. gonorrhoeae*:

```
    m936/g936
                   10         20         30         40         50         60
       m936.pep    MKPKPHTVRTLIAAIFSLALSGCVSAVIGSAAVGAKSAVDRRTTGAQTDDNVMALRIETT
                   ||||||||||||::||||:||   |||:|:|||||||::|||||||||||||||||||||
           g936    MKPKPHTVRTLIAAVLSLALGGCFSAVVGGAAVGAKSVIDRRTTGAQTDDNVMALRIETT
                   10         20         30         40         50         60

70         80         90        100        110        120
       m936.pep    ARSYLRQNNQTKGYTPQISVVGYNRHLLLLGQVATEGEKQFVGQIARSEQAAEGVYNYIT
                   ||||||||||||||||||||||||||||||||||||||||||||||||||||||||||||
           g936    ARSYLRQNNQTKGYTPQISVVGYNRHLLLLGQVATEGEKQFVGQIARSEQAAEGVYNYIT
                   70         80         90        100        110        120

130
       m936.pep   VASLPRTAXXX
                  ||||||||
           g936   VASLPRTAGDIAGDTWNTSKVRATLLGISPATQARVKIITYGNVTYVMGILTPEEQAQIT
                  130        140        150        160        170        180
```

The following partial DNA sequence was identified in *N. meningitidis* <SEQ ID 2879>:

```
a936.seq
   1 ATGAAACCCA AACCGCACAC CGTCCGCACC CTGACTGCCG CCGTCCTCAG

51 CCTTGCCCTC GGCGGCTGCG TCAGCGCAGT CGTCGGCGGC GCGGCGGTCG

101 GCGCGAAATC CGCCGTCGAC CGCCGAACCA CCGGCGCGCA AACCGACGAC

151 AACGTAATGG CGCTGCGTAT CGAAACCACC GCCCGCTCCT ATCTGCGCCA

201 AAACAACCAA ACCAAAGGCT ACACGCCCCA AATCTCCGTT GTCGGCTACA

251 ACCGCCACCT GCTGCTGCTC GGACAAGTCG CCACCGAAGG CGAGAAACAG

301 TTCGTCGGTC AGATTGCACG TTCCGAACAG GCCGCCGAAG GCGTGTACAA

351 CTACATTACC GTCGCCTCCC TGCCGCGCAC TGCCGGCGAC ATCGCCGGCG

401 ACACTTGGAA CACATCCAAA GTCCGCGCCA CGCTGTTGGG CATCAGCCCC

451 GCCACACAGG CGCGCGTCAA AATCGTTACC TACGGCAACG TAACCTACGT

501 TATGGGCATC CTCACCCCCG AAGAACAGGC GCAGATTACC CAAAAAGTCA

551 GCACCACCGT CGGCGTACAA AAAGTCATCA CCCTCTACCA AAACTACGTC

601 CAACGCTGA
```

This corresponds to the amino acid sequence <SEQ ID 2880; ORF 936.a>:

```
a936.pep
   1 MKPKPHTVRT LTAAVLSLAL GGCVSAVVGG AAVGAKSAVD RRTTGAQTDD

51 NVMALRIETT ARSYLRQNNQ TKGYTPQISV VGYNRHLLLL GQVATEGEKQ
```

```
101 FVGQIARSEQ AAEGVYNYIT VASLPRTAGD IAGDTWNTSK VRATLLGISP

151 ATQARVKIVT YGNVTYVMGI LTPEEQAQIT QKVSTTVGVQ KVITLYQNYV

201 QR*
```

M936/a936 95.3% identity in 128 aa overlap

```
                  10         20         30         40         50         60
    m936.pep  MKPKPHTVRTLIAAIFSLALSGCVSAVIGSAAVGAKSAVDRRTTGAQTDDNVMALRIETT
              ||||||||||  ||::||||:|||||:|:|||||||||||||||||||||||||||||||
        a936  MKPKPHTVRTLTAAALSLALGGCVSAVGGGAAVGAKSAVDRRTTGAQTDDNVMALRIETT
                  10         20         30         40         50         60

70         80         90        100        110        120
    m936.pep  ARSYLRQNNQTKGYTPQISVVGYNRHLLLLGQVATEGEKQFVGQIARSEQAAEGVYNYIT
              ||||||||||||||||||||||||||||||||||||||||||||||||||||||||||||
        a936  ARSYLRQNNQTKGYTPQISVVGYNRHLLLLGQVATEGEKQFVGQIARSEQAAEGVYNYIT
                  70         80         90        100        110        120 m936.pep  VASLPRTA
              ||||||||
        a936  VASLPRTAGDIAGDTWNTSKVRATLLGISPATQARVKIVTYGNVTYVMGILTPEEQAQIT
                 130        140        150        160        170        180
```

The following partial DNA sequence was identified in *N. gonorrhoeae* <SEQ ID 2881>:

```
g936-1.seq
   1 ATGAAACCCA AACCACACAC CGTCCGCACC CTGATTGCCG CCGTCCTCAG

51 CCTTGCCCTC GGCGGCTGCT TCAGCGCAGT CGTCGGCGGG GCCGCCGTCG

101 GCGCAAAATC CGTCATCGAC CGccgAACCA CCGgcgcgca AACCGATGac 151 aACGTTATGG CGTTGCGTAT CGAAACCACC GCCCGTTCCT ACCTGCGCCA

201 AAACAACCAA ACCAAAGGCT ACACGCCCCA AATCTCCGTC GTCGGCTACA

251 ACCGCCACCT GCTGCTGCTC GGACAAGTCG CCACCGAAGG CGAAAAACAG

301 TTCGTCGGTC AGATTGCACG TTCCGAACAG GCCGCCGAAG GCGTATACAA

351 CTACATTACC GTCGCCTCCC TGCCGCGCAC TGCGGGCGAC ATCGCCGGCG

401 ACACTTGGAA CACGTCCAAA GTCCGCGCca cgCTGCTGGG CATCAGCCCC

451 GCTACACAGG CGCGCGTCAA AATCATTACC TACGGCAATG TAACCTACGT

501 TATGGGCATC CTCACCCCCG AAGAACAGGC GCAGATTACC CAAAAAGTCA

551 GCACCAccgT CGGCGTACAA AAAGTCATTA CCCTCTACCA AAACTACGTC

601 CAACGCTGA
```

This corresponds to the amino acid sequence <SEQ ID 2882; ORF 936-1.ng>:

```
g936-1.pep
   1 MKPKPHTVRT LIAAVLSLAL GGCFSAVVGG AAVGAKSVID RRTTGAQTDD

51 NVMALRIETT ARSYLRQNNQ TKGYTPQISV VGYNRHLLLL GQVATEGEKQ

101 FVGQIARSEQ AAEGVYNYIT VASLPRTAGD IAGDTWNTSK VRATLLGISP

151 ATQARVKIIT YGNVTYVMGI LTPEEQAQIT QKVSTTVGVQ KVITLYQNYV

201 QR*
```

The following partial DNA sequence was identified in *N. meningitidis* <SEQ ID 2883>:

```
m936-1.seq
  1 ATGAAACCCA AACCGCACAC CGTCCGCACC CTGATTGCCG CCATTTTCAG

51 CCTTGCCCTT AGCGGCTGCG TCAGCGCAGT AATCGGAAGC GCCGCCGTCG

101 GCGCGAAATC CGCCGTCGAC CGCCGAACCA CCGGCGCGCA AACCGACGAC

151 AACGTTATGG CGTTGCGTAT CGAAACCACC GCCCGTTCCT ATCTGCGCCA

201 AAACAACCAA ACCAAAGG

-continued

```
101 GCGCGAAATC CGCCGTCGAC CGCCGAACCA CCGGCGCGCA AACCGACGAC

151 AACGTAATGG CGCTGCGTAT CGAAACCACC GCCCGCTCCT ATCTGCGCCA

201 AAACAACCAA ACCAAAGGCT ACACGCCCCA AATCTCCGTT GTCGGCTACA

251 ACCGCCACCT GCTGCTGCTC GGACAAGTCG CCACCGAAGG CGAGAAACAG

301 TTCGTCGGTC AGATTGCACG TTCCGAACAG GCCGCCGAAG GCGTGTACAA

351 CTACATTACC GTCGCCTCCC TGCCGCGCAC TGCCGGCGAC ATCGCCGGCG

401 ACACTTGGAA CACATCCAAA GTCCGCGCCA CGCTGTTGGG CATCAGCCCC

451 GCCACACAGG CGCGCGTCAA AATCGTTACC TACGGCAACG TAACCTACGT

501 TATGGGCATC CTCACCCCCG AAGAACAGGC GCAGATTACC CAAAAAGTCA

551 GCACCACCGT CGGCGTACAA AAAGTCATCA CCCTCTACCA AAACTACGTC

601 CAACGCTGA
```

This corresponds to the amino acid sequence <SEQ ID 2886; ORF 936-1.a>:

```
a936-1.pep

1 MKPKPHTVRT LTAAVLSLAL GGCVSAVVGG AAVGAKSAVD RRTTGAQTDD

51 NVMALRIETT ARSYLRQNNQ TKGYTPQISV VGYNRHLLLL GQVATEGEKQ

101 FVGQIARSEQ AAEGVYNYIT VASLPRTAGD IAGDTWNTSK VRATLLGISP

151 ATQARVKIVT YGNVTYVMGI LTPEEQAQIT QKVSTTVGVQ KVITLYQNYV

201 QR* a936-1/m936-1   97.0% identity in 202 aa overlap 10         20         30         40         50         60
m936-1.pep  MKPKPHTVRTLIAAIFSLALSGCVSAVIGSAAVGAKSAVDRRTTGAQTDDNVMALRIETT
            ||||||||||| ||::||||:||||||:|:||||||||||||||||||||||||||||||
a936-1      MKPKPHTVRTLTAAVLSLALGGCVSAVVGGAAVGAKSAVDRRTTGAQTDDNVMALRIETT
                   10         20         30         40         50         60

70         80         90        100        110        120
m936-1.pep  ARSYLRQNNQTKGYTPQISVVGYNRHLLLLGQVATEGEKQFVGQIARSEQAAEGVYNYIT
            ||||||||||||||||||||||||||||||||||||||||||||||||||||||||||||
a936-1      ARSYLRQNNQTKGYTPQISVVGYNRHLLLLGQVATEGEKQFVGQIARSEQAAEGVYNYIT
                   70         80         90        100        110        120

130        140        150        160        170        180
m936-1.pep  VASLPRTAGDIAGDTWNTSKVRATLLGISPATQARVKIVTYGNVTYVMGILTPEEQAQIT
            ||||||||||||||||||||||||||||||||||||||||||||||||||||||||||||
a936-1      VASLPRTAGDIAGDTWNTSKVRATLLGISPATQARVKIVTYGNVTYVMGILTPEEQAQIT
                  130        140        150        160        170        180

190        200
m936-1.pep  QKVSTTVGVQKVITLYQNYVQRX
            |||||||||||||||||||||||
a936-1      QKVSTTVGVQKVITLYQNYVQRX
                  190        200
```

The following partial DNA sequence was identified in *N. gonorrhoeae* <SEQ ID 2887>:

```
g937.seq
   1 atGAAAAATA TTCTCTTAgt ATTTGTTAGC TTTGTGCCAT TATGTGTCCG

51 CACTGATCTG CCGCTGAata tCGAAGACAT AATGaccgAC AAGGGAAAAT

101 GGAAactGGA AACTTccctt acctacctgA acaGCGAAAA cagCCGCGCC

151 GCACTTGCCT CACCGGTTTA CATTCAGACC GGCTCCGCTT CCTTTATCCC

201 CGTCCCGACC GAAATTCAGG AAAACGGCAG CAATACCGAT ATGCTCGCCG
```

-continued

```
251 GCACGCTCGG TTTGCGCTAC GGACTGAccg GCAataccgA CATTTACGGC

301 AGCGGCAGCT ATCTGTGGCA CGAAGAACGC AAACTCGacg GCAACGGCAA

351 AACCCGCAAC AAACGGATGT CCGACATATC CGCCGGCATC AGCCACACCT

401 TCCttaAAGa cgGCAAAAAT CCCGCACTCA TCGCTTTCCT CGAAAGCACG

451 GTTTACGAAA AATCGCGCAA CAAAGCCTCG TCGGGAAAAT CGTGGCTCAT

501 CGGCGCCACC ACCTACAAAG CCATAGATCC GATTGTCCTT TCCCTCACCG

551 CCGCCTACCG CATCAACGGC AGCAAAACCC TTTCAGACGA CGTCAAATAC

601 AAAGCAGGCA ATTACTGGAT GCTGAATCCC AACATCTCAT TTGCCGCCAA

651 CGACAGAATC AGCCTGACCG GAGGCATCCA ATGGCTGGGC AAACAGCCCG

701 ACCGCATAGA CGGCAAAAAA GAATCCGCAA GAAACACATC CACCTACGCC

751 CATTTCGGCG CAGGTTTCGG TTTCACCAAA ACCGCGGCTT TAAACGCATC

801 CGCACGTTTC AACGTTTCAG GGCAAAGCAG TTCCGAACTG AAATTGGGCG

851 TACAGCATAC ATTTTAA
```

This corresponds to the amino acid sequence <SEQ ID 2888; ORF 937.ng>:

```
g937.pep
  1 MKNILLVFVS FVPLCVRTDL PLNIEDIMTD KGKWKLETSL TYLNSENSRA

51 ALASPVYIQT GSASFIPVPT EIQENGSNTD MLAGTLGLRY GLTGNTDIYG

101 SGSYLWHEER KLDGNGKTRN KRMSDISAGI SHTFLKDGKN PALIAFLEST

151 VYEKSRNKAS SGKSWLIGAT TYKAIDPIVL SLTAAYRING SKTLSDDVKY

201 KAGNYWMLNP NISFAANDRI SLTGGIQWLG KQPDRIDGKK ESARNTSTYA

251 HFGAGFGFTK TAALNASARF NVSGQSSSEL KLGVQHTF*
```

The following partial DNA sequence was identified in *N. meningitidis* <SEQ ID 2889>:

```
m937.seq
  1 ATGAAGCGCA TCTTTTTGCC CGCCTTGCCC GCCATCCTGC CTTTATCCAC

51 TTATGCCGAC CTGCCCTTGA CGATTGAAGA CATAATGACC GACAAGGGAA

101 AATGGAAACT GGAAACTTCC CTTACCTACC TGAACAGCGA AAACAACCGC

151 GCCGAACTTG CCGCACCGGT TTACATTCAA ACCGGCGCAA CCTCGTTTAT

201 CCCCATTCCG ACCGAAATCC AAgAAAaCGG CAGCAATACC GATATGCTCG

251 TCGGCACGCT CGGTTTGCGC TACGGACTGA CCGGGAATAC CGACATTTAC

301 GGCAGCGGCA GCTATCTGTG GCACGAAGAA CGCAAACTCG ACGGCAACAG

351 CAAAACCCGC AACAAACGGA TGTCCGACGT ATCCCTCGGC ATCAGCCACA

401 CTTTCCTTAA AGACGACAAA AACCCCGCCC TAATCAGCTT TCTTGAAAGC

451 ACGGTTTACG AAAAATCGCG CAACAAAGCC TCGTCGGGAA AATCCTGGCT

501 CATCGGCGCC ACCACCTACA AAGCCATAGA TCCGATTGTC CTTTCCTTAA

551 CCGCCGCCTA CCGCATCAAC GGCAGCAAAA CCCTTTCAGA CGGCATCCGC

601 TACAAATCGG GCAACTACCT GCTGCTCAAC CCCAACATCT CATTTGCTGC

651 CAACGACAGA ATCAGCCTGA CCGGAGGCAT CCAATGGCTG GGCAGGCAGC

701 CCGACCGGAC GGACGGCAAA CGGGAATCCT CCAGAAACAC ATCCACCTAC
```

-continued

```
751 GCCCATTTCG GCGCAGGTTT CGGTTTCACC AAAACCACGG CTTTAAACGC

801 ATCCGCACGT TCAACGTTT CAGGGCAAAG CAGTTCCGAA CTGAAATTTG

851 GCGTACAGCA TACATTTTAA
```

This corresponds to the amino acid sequence <SEQ ID 2890; ORF 937>:

```
m937.pep..
  1 MKRIFLPALP AILPLSTYAD LPLTIEDIMT DKGKWKLETS LTYLNSENNR

51 AELAAPVYIQ TGATSFIPIP TEIQENGSNT DMLVGTLGLR YGLTGNTDIY

101 GSGSYLWHEE RKLDGNSKTR NKRMSDVSLG ISHTFLKDDK NPALISFLES

151 TVYEKSRNKA SSGKSWLIGA TTYKAIDPIV LSLTAAYRIN GSKTLSDGIR

201 YKSGNYLLLN PNISFAANDR ISLTGGIQWL GRQPDRTDGK RESSRNTSTY

251 AHFGAGFGFT KTTALNASAR FNVSGQSSSE LKFGVQHTF*
```

Computer analysis of this amino acid sequence gave the following results:
Homology with a Predicted ORF from *N. gonorrhoeae*
ORF 937 shows 86.9% identity over a 289 aa overlap with a predicted ORF (ORF 937.ng) from *N. gonorrhoeae*:

```
g937/m937
                   10         20         30         40         50         59
    g937.pep   MKNILL-VFVSFVPLCVRTDLPLNIEDIMTDKGKWKLETSLTYLNSENSRAALASPVYIQ
               || |:| :: :::|| : :||||:|||||||||||||||||||||||||:|| ||:||||
    m937       MKRIFLPALPAILPLSTYADLPLTIEDIMTDKGKWKLETSLTYLNSENNRAELAAPVYIQ
                   10         20         30         40         50         60

60         70         80         90        100        110        119
    g937.pep   TGSASFIPVPTEIQENGSNTDMLAGTLGLRYGLTGNTDIYGSGSYLWHEERKLDGNGKTR
               ||::|||:||||||||||||||||:||||||||||||||||||||||||||||||||:|||
    m937       TGATSFIPIPTEIQENGSNTDMLVGTLGLRYGLTGNTDIYGSGSYLWHEERKLDGNSKTR
                   70         80         90        100        110        120

120        130        140        150        160        170        179
    g937.pep   NKRMSDISAGISHTFLKDGKNPALIAFLESTVYEKSRNKASSGKSWLIGATTYKAIDPIV
               ||||||:| |||||||||| ||||||:|||||||||||||||||||||||||||||||||
    m937       NKRMSDVSLGISHTFLKDDKNPALISFLESTVYEKSRNKASSGKSWLIGATTYKAIDPIV
                  130        140        150        160        170        180

180        190        200        210        220        230        239
    g937.pep   LSLTAAYRINGSKTLSDDVKYKAGNYWMLNPNISFAANDRISLTGGIQWLGKQPDRIDGK
               ||||||||||||||||| ::||:||| :|||||||||||||||||||||||:|||| |||
    m937       LSLTAAYRINGSKTLSDGIRYKSGNYLLLNPNISFAANDRISLTGGIQWLGRQPDRTDGK
                  190        200        210        220        230        240

240        250        260        270        280        289
    g937.pep   KESARNTSTYAHFGAGFGFTKTAALNASARFNVSGQSSSELKLGVQHTFX
               :||:|||||||||||||||||:||||||||||||||||||:||||||||
    m937       RESSRNTSTYAHFGAGFGFTKTTALNASARFNVSGQSSSELKFGVQHTFX
                  250        260        270        280
```

The following partial DNA sequence was identified in *N. meningitidis* <SEQ ID 2891>:

```
a937.seq
  1 ATGAAGCGCA TCTTTTTGCC CGCCTTGCCC GCCATCCTGC CTTTATCCGC

51 TTATGCCGAC CTGCCCTTGA CGATTGAAGA CATAATGACC GACAAGGGCA

101 AATGGAAACT GGAAACTTCC CTTACCTACC TGAACAGCGA AAACAACCGC

151 GCCGAACTTG CCGCACCGGT TTACATCCAA ACCGGCGCAA CCTCGTTTAT

201 CCCCATTCCG ACCGAAATCC AAGAAAACGG CAGCAATACC GATATGCTCG

251 TTGGCACGCT CGGTTTGCGC TACGGACTGA CCGGGAATAC CGACATTTAC
```

-continued

```
301 GGCAGCGGCA GCTATCTGTG GCACGAAGAA CGCAAACTCG ACGGCAACGG

351 CAAAACCCGA ACAAACGGA TGTCCGACGT ATCCCTCGGC ATCAGCCACA

401 CCTTCCTTAA AGACGACAAA AACCCCGCCC TAATCAGCTT TCTTGAAAGC

451 ACGGTTTACG AAAAATCGCG CAACAAAGCC TCGTCGGGAA ATCCTGGCT

501 CATCGGCGCC ACCACCTACA AAGCCATCGA CCCCGTCGTC CTCTCATTGA

551 CCGCTGCCTA CCGTATCAAC GGCAGCAAAA CCCTTTCAAG CAACACCAAA

601 TACAAAGCAG GCAATTACTG GATGCTGAAT CCCAATATAT CCTTCGCCGC

651 CAACGACAGA ATCAGCCTCA CGGGCGGCAT CCAATGGCTG GGCAAGCAGC

701 CCGACCGTCT GGACGGCAAA AAAGAATCCG CAAGAAACAC ATCCACCTAT

751 GCCCATTTCG GCGCAGGTTT CGGTTTCACC AAAACCACGG CTTTAAACGC

801 ATCCGCACGT TTCAACGTTT CAGGGCAAAG CAGTTCCGAA CTGAAATTTG

851 GCGTACAGCA TACGTTTTAA
```

This corresponds to the amino acid sequence <SEQ ID 2892; ORF 937.a>:

```
a937.pep
  1 MKRIFLPALP AILPLSAYAD LPLTIEDIMT DKGKWKLETS LTYLNSENNR

51 AELAAPVYIQ TGATSFIPIP TEIQENGSNT DMLVGTLGLR YGLTGNTDIY

101 GSGSYLWHEE RKLDGNGKTR NKRMSDVSLG ISHTFLKDDK NPALISFLES

151 TVYEKSRNKA SSGKSWLIGA TTYKAIDPVV LSLTAAYRIN GSKTLSSNTK

201 YKAGNYWMLN PNISFAANDR ISLTGGIQWL GKQPDRLDGK KESARNTSTY

251 AHFGAGFGFT KTTALNASAR FNVSGQSSSE LKFGVQHTF*
``` m937/a937 95.2% identity in 289 aa overlap

```
                    10         20         30         40         50         60
    m937.pep  MKRIFLPALPAILPLSTYADLPLTIEDIMTDKGKWKLETSLTYLNSENNRAELAAPVYIQ
              ||||||||||||||||:|||||||||||||||||||||||||||||||||||||||||||
    a937      MKRIFLPALPAILPLSAYADLPLTIEDIMTDKGKWKLETSLTYLNSENNRAELAAPVYIQ
                    10         20         30         40         50         60

70         80         90        100        110        120
    m937.pep  TGATSFIPIPTEIQENGSNTDMLVGTLGLRYGLTGNTDIYGSGSYLWHEERKLDGNSKTR
              ||||||||||||||||||||||||||||||||||||||||||||||||||||||||:|||
    a937      TGATSFIPIPTEIQENGSNTDMLVGTLGLRYGLTGNTDIYGSGSYLWHEERKLDGNGKTR
                    70         80         90        100        110        120

130        140        150        160        170        180
    m937.pep  NKRMSDVSLGISHTFLKDDKNPALISFLESTVYEKSRNKASSGKSWLIGATTYKAIDPIV
              ||||||||||||||||||||||||||||||||||||||||||||||||||||||||||:|
    a937      NKRMSDVSLGISHTFLKDDKNPALISFLESTVYEKSRNKASSGKSWLIGATTYKAIDPVV
                   130        140        150        160        170        180

190        200        210        220        230        240
    m937.pep  LSLTAAYRINGSKTLSDGIRYKSGNYLLLNPNISFAANDRISLTGGIQWLGRQPDRTDGK
              ||||||||||||||||::||:|||:|||||||||||||||||||||||||:|||||:|||
    a937      LSLTAAYRINGSKTLSSNTKYKAGNYWMLNPNISFAANDRISLTGGIQWLGKQPDRLDGK
                   190        200        210        220        230        240

250        260        270        280        290
    m937.pep  RESSRNTSTYAHFGAGFGFTKTTALNASARFNVSGQSSSELKFGVQHTFX
              :||:||||||||||||||||||||||||||||||||||||||||||||||
    a937      KESARNTSTYAHFGAGFGFTKTTALNASARFNVSGQSSSELKFGVQHTFX
                   250        260        270        280        290 g939.seq not found yet
    g939.pep not found yet
```

The following partial DNA sequence was identified in *N. meningitidis* <SEQ ID 2893>:

```
m939.seq (partial)
    1 ATGAAACGAT TGACTTTATT GGCCTTTGTT TTGGCTGCCG GTGCGGTTTC

51 CGCCTCTCCC AAAGCAGACG TGGAAAAAGG CAAACAGGTT GCCGCAACGG

101 TTTGTGCGGC TTGCCATGCA GCAGACGGTA ACAGCGGCAT TGCGATGTAT

151 CCGCGTTTGG CGGCACAGCA TACTGCTTAC ATCTATCATC AAACTATCGG

201 CATCCGCGAC GTAAACGCAC CC...
                                                            15
```

This corresponds to the amino acid sequence <SEQ ID 2894; ORF 939>:

```
m939.pep (partial)
    1 MKRLTLLAFV LAAGAVSASP KADVEKGKQV AATVCAACHA ADGNSGIAMY

51 PRLAAQHTAY IYHQTIGIRD VNAP...
```

The following partial DNA sequence was identified in *N. meningitidis* <SEQ ID 2895>:

```
a939.seq
    1 ATGAAACGAT TGACTTTATT GGCCTTTGTT TTGGCTGCCG GTGCGGTTTC

51 CGCATCTCCC AAAGCAGACG TGGAAAAAGG CAAACAGGTT GCCGCAACGG

101 TTTGTGCGGC TTGCCATGCA GCAGACGGTA ACAGCGGCAT TGCGATGTAT

151 CCGCGTTTGG CGGCACAGCA TACTGCTTAC ATCTATCATC AAACCATCGG

201 CATCCGCGAC GGTAAACGCA CCCACGGTTC GGCAGCTGTG ATGAAACCGG

251 TGGTAATGAA TTTGAGCGAT CAGGATATTT TGAACGTATC CGCATTCTAT

301 GCCAAACAGC AGCCCAAATC CGGTGAAGCC AATCCTAAGG AAAATCCCGA

351 ATTGGGTGCG AAAATCTATC GCGGCGGTTT GAGCGATAAA AAAGTGCCGG

401 CGTGTATGTC CTGCCACGGT CCGAGCGGTG CGGGTATGCC GGGGGGCGGA

451 AGCGAAATTC AGGCTTATCC GCGTTTGGGC GGTCAGCATC AGGCATATAT

501 TGTTGAACAG ATGAATGCCT ACAAGTCCGG TCAGCGTAAA AATACCATCA

551 TGGAAGATAT TGCAAACCGT ATGTCTGAAG AAGATTTGAA AGCGGTCGCC

601 AACTTTATCC AAGGTTTGCG TTAA
```

This corresponds to the amino acid sequence <SEQ ID 2896; ORF 939.a>:

```
a939.pep
    1 MKRLTLLAFV LAAGAVSASP KADVEKGKQV AATVCAACHA ADGNSGIAMY

51 PRLAAQHTAY IYHQTIGIRD GKRTHGSAAV MKPVVMNLSD QDILNVSAFY

101 AKQQPKSGEA NPKENPELGA KIYRGGLSDK KVPACMSCHG PSGAGMPGGG

151 SEIQAYPRLG GQHQAYIVEQ MNAYKSGQRK NTIMEDIANR MSEEDLKAVA

201 NFIQGLR*
``` m939/a939 100.0% identity in 70 aa overlap

```
                 10        20        30        40        50        60
m939.pep  MKRLTLLAFVLAAGAVSASPKADVEKGKQVAATVCAACHAADGNSGIAMYPRLAAQHTAY
          ||||||||||||||||||||||||||||||||||||||||||||||||||||||||||||
a939      MKRLTLLAFVLAAGAVSASPKADVEKGKQVAATVCAACHAADGNSGIAMYPRLAAQHTAY
                 10        20        30        40        50        60

70
m939.pep  IYHQTIGIRDVNAP
          ||||||||||
a939      IYHQTIGIRDGKRTHGSAAVMKPVVMNLSDQDILNVSAFYAKQQPKSGEANPKENPELGA
                 70        80        90       100       110       120
```

The following partial DNA sequence was identified in *N. gonorrhoeae* <SEQ ID 2897>:

```
g950.seq
   1 ATGAACAAAA ATATTGCTGC CGCACTCGCC GGTGCTTTAT CCCTGTCTCT

51 GGCCGCCGGC GCCGTTGCCG CCCACAAACC GGCAAGCAAC GCAACAGGCG

101 TTCAAAAATC CGCCCAAGGC TCTTGCGGCG CATCCAAATC TGCCGAAGGT

151 TCGTGCGGCG CATCCAAATC TGCCGAAGGT TCGTGCGGCG CGGCTGCTTC

201 TAAAGCAGGC GAAGGCAAAT GCGGCGAGGG CAAATGCGGT GCAACTGTAA

251 AAAAAGCCCA CAAACACACC AAAGCATCTA AGCCAAAGC CAAATCTGCC

301 GAAGGCAAAT GCGGCGAAGG CAAATGCGGT TCTAAATAA
```

This corresponds to the amino acid sequence <SEQ ID 2898; ORF 950.ng>:

```
g950.pep
   1 MNKNIAAALA GALSLSLAAG AVAAHKPASN ATGVQKSAQG SCGASKSAEG

51 SCGASKSAEG SCGAAASKAG EGKCGEGKCG ATVKKAHKHT KASKAKAKSA

101 EGKCGEGKCG SK*
```

The following partial DNA sequence was identified in *N. meningitidis* <SEQ ID 2899>:

```
m950.seq
   1 ATGAACAAAA ACATTGCTGC CGCTCTCGCC GGTGCTTTAT CCCTGTCTTT

51 GGCCGCCGGT GCAGTTGCTG CCAACAAACC GGCAAGCAAC GCAACAGGCG

101 TTCATAAATC CGCCCATGGC TCTTGCGGCG CGTCCAAATC TGCCGAAGGT

151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

This corresponds to the amino acid sequence <SEQ ID 2900; ORF 950>:

```
m950.pep
   1 MNKNIAAALA GALSLSLAAG AVAANKPASN ATGVHKSAHG SCGASKSAEG

51 SCGAAGSKAG EGKCGEGKCG ATVKKTHKHT KASKAKAKSA EGKCGEGKCG

101 SK
```

Computer analysis of this amino acid sequence gave the following results:
Homology with a Predicted ORF from *N. gonorrhoeae*
ORF 950 shows 86.6% identity over a 112 aa overlap with a predicted ORF (ORF 950) from *N. gonorrhoeae*

```
    m950/g950    86.6% identity in 112 aa overlap 10        20        30        40        50
         m950.pep    MNKNIAAALAGALSLSLAAGAVAANKPASNATGVHKSAHGSCGASKSAEGSCGA------
                     ||||||||||||||||||||||||:|||||||||||||||||||||||||||||
             g950    MNKNIAAALAGALSLSLAAGAVAAHKPASNATGVQKSAQGSCGASKSAEGSCGASKSAEG
                         10        20        30        40        50        60

60        70        80        90       100
         m950.pep    ----AGSKAGEGKCGEGKCGATVKKTHKHTKASKAKAKSAEGKCGEGKCGSK
                         |:||||||||||||:||||||||||||||||||||||||||||||||||
             g950    SCGAAASKAGEGKCGEGKCGATVKKAHKHTKASKAKAKSAEGKCGEGKCGSKX
                         70        80        90       100       110
```

The following partial DNA sequence was identified in *N. meningitidis* <SEQ ID 2901>:

```
a950.seq
  1 ATGAACAAAA ACATTGCTGC CGCACTCGCC GGTGCTTTAT CCCTGTCTTT

51 GGCCGCCGGT GCAGTTGCTG CCAACAAACC GGCAAGCAAC GCAACAGGCG

101 TTCATAAATC CGCCCATGGC TCTTGCGGCG CGTCCAAATC TGCCGAAGGT

151 TCGTGCGGCG CGGCTGGTTC TAAAGCAGGC GAAGGCAAAT GCGGCGAGGG

201 CAAATGCGGT GCGACCGTAA AAAAAACCCA CAAACACACC AAAGCATCTA

251 AAGCCAAGGC CAAATCTGCC GAAGGCAAAT GCGGCGAAGG CAAATGCGGT

301 TCTAAATAA
```

This corresponds to the amino acid sequence <SEQ ID 2902; ORF 950.a>:

```
a950.pep

1 MNKNIAAALA GALSLSLAAG AVAANKPASN ATGVHKSAHG SCGASKSAEG

51 SCGAAGSKAG EGKCGEGKCG ATVKKTHKHT KASKAKAKSA EGKCGEGKCG

101 SK*
```

Computer analysis of this amino acid sequence gave the following results:
Homology with a Predicted ORF from *N. meningitidis*
ORF 950 shows 100.0% identity over a 102 aa overlap with a predicted ORF (ORF 950) from *N. meningitidis*

```
    a950/m950    100.0% identity in 102 aa overlap 10        20        30        40        50        60
         a950.pep    MNKNIAAALAGALSLSLAAGAVAANKPASNATGVHKSAHGSCGASKSAEGSCGAAGSKAG
                     ||||||||||||||||||||||||||||||||||||||||||||||||||||||||||||
             m950    MNKNIAAALAGALSLSLAAGAVAANKPASNATGVHKSAHGSCGASKSAEGSCGAAGSKAG
                         10        20        30        40        50        60

70        80        90       100
         a950.pep    EGKCGECKCGATVKKTHKHTKASKAKAKSAEGKCGEGKCGSKX
                     |||||||||||||||||||||||||||||||||||||||||
             m950    EGKCGEGKCGATVKKTHKHTKASKAKAKSAEGKCGEGKCGSK
                         70        80        90       100
```

The following partial DNA sequence was identified in *N. gonorrhoeae* <SEQ ID 2903>:

```
g951.seq
    1 ATGATTATGT TACCCGCCCG TTTCACTATT TTATCTGTCC TCGCAGCAGC

51 CCTGCTTGCC GGACAGGCGT ATGCTGCCGG CGCGGCGGAT GTGGAGCTGC

101 CGAAGGAAGT CGGAAAGGTT TTAAGGAAAC ATCGGCGTTA CAGCGAGGAA

151 GAAATCAAAA ACGAACGCGC ACGGCTTGCG GCAGTGGGCG AACGGGTCAA

201 CAGGGTGTTT ACGCTGTTGG GCGGTGAAAC GGCTTTGCAG AAAGGGCAGG

251 CGGGAACGGC TCTGGCAACC TATATGCTGA TGTTGGAACG CACAAAATCC

301 CCCGAAGTCG CCGAACGCGC CTTGGAAATG GCCGTGTCGC TGAACGCGTT

351 TGAACAGGCG GAAATGATTT ATCAGAAATG GCGGCAGATC GAGCCTATAC

401 CGGGTGAGGC GCAAAAACGG GCGGGGTGGC TGCGGAACGT ATTGAGGGAA

451 GGGGGAAATC AGCATCTGGA CGGGTTGGAA GAGGTGCTGG CGCAATCGGA

501 CGATGTGCAA AAACGCAGGA TATTTTTGCT GCTGGTGCAA GCCGCCGTGC

551 AGCAGGGTGG GGTGGCTCAA AAAGCATCGA AAGCGGTTCG CCGTGCGGCG

601 TTGAAGTATG AACATCTGCC CGAAGCGGCG GTTGCCGATG CGGTGTTCGG

651 CGTACAGGGA CGCGAAAAGG AAAAGGCAAT CGAAGCTTTG CAGCGTTTGG

701 CGAAGCTCGA TACGGAAATA TTGCCCCCCA CTTTAATGAC GTTGCGTCTG

751 ACTGCACGCA AATATCCCGA AATACTCGAC GGCTTTTTCG AGCAGACAGA

801 CACCCAAAAC CTTTCGGCCG TCTGGCAGGA AATGGAAATT ATGAATCTGG

851 TTTCCCTGCG TAAGCCGGAT GATGCCTATG CGCGTTTGAA CGTGCTGTTG

901 GAACACAACC CGAATGCAAA CCTGTATATT CAGGCGGCGA TATTGGCGGC

951 AAACCGAAAA GAAGGTGCGT CCGTTATCGA CGGCTACGCC GAAAAGGCAT

1001 ACGGCAGGGG GACGGGGGAA CAGCGGGGCA GGGCGGCAAT GACGGCGGCG

1051 ATGATATATG CCGACCGCAG GGATTACGCC AAAGTCAGGC AGTGGTTGAA

1101 AAAAGTGTCC GCGCCGGAAT ACCTGTTCGA CAAAGGCGTG CTGGCGGCTG

1151 CGGCGGCTGC CGAATTGGAC GGAGGCCGGG CGGCTTTGCG GCAGATCGGC

1201 AGGGTGCGGA AACTTCCCGA ACAGCAGGGG CGGTATTTTA CGGCAGACAA

1251 TTTGTCCAAA ATACAGATGC TCGCCCTGTC GAAGCTGCCC GACAAACGGG

1301 AAGCCCTGAT CGGGCTGAAC AACATCATCG CCAAACTTTC GGCGGCGGGA

1351 AGCACGGAAC CTTTGGCGGA AGCATTGGCA CAGCGTTCCA TTATTTACGA

1401 ACAGTTCGGC AAACGGGGAA AAATGATTGC CGACCTTGAA ACCGCGCTCA

1451 AACTTACGCC CGATAATGCA CAAATTATGA ATAATCTGGG CTACAGCCTG

1501 CTTTCCGATT CCAAACGTTT GGACGAGGGT TTCGCCCTGC TTCAGACGGC

1551 ATACCAAATC AACCCGGACG ATACCGCCGT TAACGACAGC ATAGGCTGGG

1601 CGTATTACCT GAAAGGCGAC GCGGAAAGCG CGCTGCCGTA TCTGCGGTAT

1651 TCGTTTGAAA ACGACCCCGA GCCCGAAGTT GCCGCCCATT GGGCGAAGT

1701 GTTGTGGGCA TTGGGCGAAC GCGATCAGGC GGTTGACGTA TGGACGCAGG

1751 CGGCACACCT TAGGGGAGAC AAGAAAATAT GGCGGGAGAC GCTCAAACGC

1801 TACGGAATCG CCTTGCCCGA GCCTTCCCGA AAACCCCGGA AATAA
```

This corresponds to the amino acid sequence <SEQ ID 2904; ORF 951.ng>:

```
g951.pep
   1 MIMLPARFTI LSVLAAALLA GQAYAAGAAD VELPKEVGKV LRKHRRYSEE

51 EIKNERARLA AVGERVNRVF TLLGGETALQ KGQAGTALAT YMLMLERTKS

101 PEVAERALEM AVSLNAFEQA EMIYQKWRQI EPIPGEAQKR AGWLRNVLRE

151 GGNQHLDGLE EVLAQSDDVQ KRRIFLLLVQ AAVQQGGVAQ KASKAVRRAA

201 LKYEHLPEAA VADAVFGVQG REKEKAIEAL QRLAKLDTEI LPPTLMTLRL

251 TARKYPEILD GFFEQTDTQN LSAVWQEMEI MNLVSLRKPD DAYARLNVLL

301 EHNPNANLYI QAAILAANRK EGASVIDGYA EKAYGRGTGE QRGRAAMTAA

351 MIYADRRDYA KVRQWLKKVS APEYLFDKGV LAAAAAAELD GGRAALRQIG

401 RVRKLPEQQG RYFTADNLSK IQMLALSKLP DKREALIGLN NIIAKLSAAG

451 STEPLAEALA QRSIIYEQFG KRGKMIADLE TALKLTPDNA QIMNNLGYSL

501 LSDSKRLDEG FALLQTAYQI NPDDTAVNDS IGWAYYLKGD AESALPYLRY

551 SFENDPEPEV AAHLGEVLWA LGERDQAVDV WTQAAHLRGD KKIWRETLKR

601 YGIALPEPSR KPRK*
```

The following partial DNA sequence was identified in *N. meningitidis* <SEQ ID 2905>:

```
m951.seq
     1 ATGATTATGT TACCTAACCG TTTCAAAATG TTAACTGTGT TGACGGCAAC

51 CTTGATTGCC GGACAGGTAT CTGCCGCCGG AGGCGGTGCG GGGGATATGA

101 AACAGCCGAA GGAAGTCGGA AAGGTTTTCA GAAAGCAGCA GCGTTACAGC

151 GAGGAAGAAA TCAAAAACGA ACGCGCACGG CTTGCGGCAG TGGGCGAGCG

201 GGTTAATCAG ATATTTACGT TGCTGGGAGG GGAAACCGCC TTGCAAAAGG

251 GGCAGGCGGG AACGGCTCTG GCAACCTATA TGCTGATGTT GGAACGCACA

301 AAATCCCCCG AAGTCGCCGA ACGCGCCTTG GAAATGGCCG TGTCGCTGAA

351 CGCGTTTGAA CAGGCGGAAA TGATTTATCA GAAATGGCGG CAGATTGAGC

401 CTATACCGGG TAAGGCGCAA AAACGGGCGG GGTGGCTGCG GAACGTGCTG

451 AGGGAAAGAG GAAATCAGCA TCTGGACGGA CTGGAAGAAG TGCTGGCTCA

501 GGCGGACGAA GGACAGAACC GCAGGGTGTT TTTATTGTTG GCACAAGCCG

551 CCGTGCAACA GGACGGGTTG GCGCAAAAAG CATCGAAAGC GGTTCGCCGC

601 GCGGCGTTGA AATATGAACA TCTGCCCGAA GCGGCGGTTG CCGATGTGGT

651 GTTCAGCGTA CAGGGACGCG AAAAGGAAAA GGCAATCGGA GCTTTGCAGC

701 GTTTGGCGAA GCTCGATACG GAAATATTGC CCCCCACTTT AATGACGTTG

751 CGTCTGACTG CACGCAAATA TCCCGAAATA CTCGACGGCT TTTTCGAGCA

801 GACAGACACC CAAAACCTTT CGGCCGTCTG GCAGGAAATG GAAATTATGA

851 ATCTGGTTTC CCTGCACAGG CTGGATGATG CCTATGCGCG TTTGAACGTG

901 CTGTTGGAAC GCAATCCGAA TGCAGACCTG TATATTCAGG CAGCGATATT

951 GGCGGCAAAC CGAAAAGAAG GTGCTTCCGT TATCGACGGC TACGCCGAAA

1001 AGGCATACGG CAGGGGGACG GAGGAACAGC GGAGCAGGGC GGCGCTAACG

1051 GCGGCGATGA TGTATGCCGA CCGCAGGGAT TACGCCAAAG TCAGGCAGTG
```

```
                          -continued
1101  GCTGAAAAAA GTATCCGCGC CGGAATACCT GTTCGACAAA GGTGTGCTGG

1151  CGGCTGCGGC GGCTGTCGAG TTGGACGGCG GCAGGGCGGC TTTGCGGCAG

1201  ATCGGCAGGG TGCGGAAACT TCCCGAACAG CAGGGGCGGT ATTTTACGGC

1251  AGACAATTTG TCCAAAATAC AGATGCTCGC CCTGTCGAAG CTGCCCGATA

1301  AACGGGAGGC TTTGAGGGGG TTGGACAAGA TTATCGAAAA ACCGCCTGCC

1351  GGCAGTAATA CAGAGTTACA GGCAGAGGCA TTGGTACAGC GGTCAGTTGT

1401  TTACGATCGG CTTGGCAAGC GGAAAAAAAT GATTTCAGAT CTTGAAAGGG

1451  CGTTCAGGCT TGCACCCGAT AACGCTCAGA TTATGAATAA TCTGGGCTAC

1501  AGCCTGCTGA CCGATTCCAA ACGTTTGGAC GAAGGTTTCG CCCTGCTTCA

1551  GACGGCATAC CAAATCAACC CGGACGATAC CGCTGTCAAC GACAGCATAG

1601  GCTGGGCGTA TTACCTGAAA GGCGACGCGG AAAGCGCGCT GCCGTATCTG

1651  CGGTATTCGT TTGAAAACGA CCCCGAGCCC GAAGTTGCCG CCCATTTGGG

1701  CGAAGTGTTG TGGGCATTGG GCGAACGCGA TCAGGCGGTT GACGTATGGA

1751  CGCAGGCGGC ACACCTTACG GGAGACAAGA AAATATGGCG GGAAACGCTC

1801  AAACGTCACG GCATCGCATT GCCCCAACCT TCCCGAAAAC CTCGGAAATA

1851  A
```

This corresponds to the amino acid sequence <SEQ ID 2906; ORF 791>:

```
m951.pep
  1 MIMLPNRFKM LTVLTATLIA GQVSAAGGGA GDMKQPKEVG KVFRKQQRYS

51 EEEIKNERAR LAAVGERVNQ IFTLLGGETA LQKGQAGTAL ATYMLMLERT

101 KSPEVAERAL EMAVSLNAFE QAEMIYQKWR QIEPIPGKAQ KRAGWLRNVL

151 RERGNQHLDG LEEVLAQADE GQNRRVFLLL AQAAVQQDGL AQKASKAVRR

201 AALKYEHLPE AAVADVVFSV QGREKEKAIG ALQRLAKLDT EILPPTLMTL

251 RLTARKYPEI LDGFFEQTDT QNLSAVWQEM EIMNLVSLHR LDDAYARLNV

301 LLERNPNADL YIQAAILAAN RKEGASVIDG YAEKAYGRGT EEQRSRAALT

351 AAMMYADRRD YAKVRQWLKK VSAPEYLFDK GVLAAAAVE LDGGRAALRQ

401 IGRVRKLPEQ QGRYFTADNL SKIQMLALSK LPDKREALRG LDKIIEKPPA

451 GSNTELQAEA LVQRSVVYDR LGKRKKMISD LERAFRLAPD NAQIMNNLGY

501 SLLTDSKRLD EGFALLQTAY QINPDDTAVN DSIGWAYYLK GDAESALPYL

551 RYSFENDPEP EVAAHLGEVL WALGERDQAV DVWTQAAHLT GDKKIWRETL

601 KRHGIALPQP SRKPRK*
```

Computer analysis of this amino acid sequence gave the following results:

Homology with a Predicted ORF from *N. gonorrhoeae*

ORF 951 shows 88.6% identity over a 616 aa overlap with a predicted ORF (ORF 951) from *N. gonorrhoeae*

```
m951/g951 88.6% indentity in 616 aa overlap 10        20        30        40        50        60
m951.pep    MIMLPNRFKMLTVLTATLIAGQVSAAGGGAGDMKQPKEVGKVFRKQQRYSEEEIKNERAR
            |||||  || :|:||:|:|||:   ||   ||:|:::  |||||||:|||||||||||||
g951        MIMLPNRFTILSVLAAALLAGQAYAA--GAAADVELPKEVGKVFLKQHRYSEEEIKNERAR
                     10        20          30        40        50
```

-continued

```
                     70        80        90       100       120       130
m951.pep   LAAVGERVNQIFTLLGGETALQKGQAGTALATYMLMLERTKSPEVAERALEMAVSLNAFE
           |||||||||::|||||||||||||||||||||||||||||||||||||||||||||||||
g951       LAAVGERVNRVFTLLGGETALQKGQAGTALATYMLMLERTKSPEVAERALEMAVSLNAFE
          60        70        80        90       100       110

130       140       150       160       170       180
m951.pep   QAEMIYQKWRQIEPIPGKAQKRAGQLRNVLRERGNQHLDGLEEVLAQADEGQNRRVFLLL
           |||||||||||||||||:|||||||||||||| ||||||||||||||:|: |:||:||||
g951       QAEMIYQKWRQIEPIPGEAQKRAGQLRNVLREGGNQHLDGLEEVLAQSDDVQKRRIFLLL
         120       130       140       150       160       170

190       200       210       220       230       240
m951.pep   AQAAVQQDGLAQKASKAVRRAALKYEHLPEAAVADVVFSVQGREKEKAIGALQRLAKLDT
           :|||||| |:|||||||||||||||||||||||||:||:||||||||||| |||||||||
g951       VQAAVQQGGVAQKASKAVRRAALKYEHLPEAAVADAVFGVQGREKEKAIEALQRLAKLDT
         180       190       200       210       220       230

250       260       270       280       290       300
m951.pep   EILPPTLMTLRLTARKYPEILDGFFEQTDTQNLSAVWQEMEIMNLVSLHRLDDAYARLNV
           ||||||||||||||||||||||||||||||||||||||||||||||||:: |||||||||
g51        EILPPTLMTLRLTARKYPEILDGFFEQTDTQNLSAVWQEMEIMNLVSLRKPDDAYARLNV
         240       250       260       270       280       290

310       320       330       340       350       360
m951.pep   LLERNPNADLUIQAAILAANRKEGASVIDGYAEKAYGRGTEEQRSRAALTAAMMYSDRRD
           |||:||||:||||||||||||||||||||||||||||||| |||:|||:||||:||||||
g951       LLEHNPNANLUIQAAILAANRKEGASVIDGYAEKAYGRGTGEQRGRAAMTAAMIYSDRRD
         300       310       320       330       340       350

370       380       390       400       410       420
m951.pep   YAKVRQWLKKVSAPEYLFDKGVLAAAAAVELDGGRAALRQIGRVRKLPEQQGRYFTADNL
           ||||||||||||||||||||||||||||:|||||||||||||||||||||||||||||||
g951       YAKVRQWLKKVSAPEYLFDKGVLAAAAAAELDGGRAALRQIGRVRKLPEQQGRYFTADNL
         260       370       380       390       400       410

430       440       450       460       470       480
m951.pep   SKIQMLALSKLPDKREALRGLDKIIEKPPAGSNTELQAEALVQRSVVYDRLGKRKKMISD
           |||||||||||||||||| ||::|| |  |:::||  ||||:|||::|:::||| |||:|
g951       SKIQMLALSKLPDKREALIGLNNIIAKLSAAGSTEPLAEALAQRSIIYEQFGKRGKMIAD
         420       430       440       450       460       470

490       500       510       520       530       540
m951.pep   LERAFRLAPDNAQIMNNLGYSLLTDSKRLDEGFALLQTAYQINPDDTAVNDSIGWAYYLK
           || |::|:|||||||||||||||:||||||||||||||||||||||||||||||||||||
g951       LETALKLTPDNAQIMNNLGYSLLSDSKRLDEGFALLQTAYQINPDDTAVNDSIGWAYYLK
         480       490       500       510       520       530

550       560       570       580       590       600
m951.pep   GDAESALPYLRYSFENDPEPEVAAHLGEVLWALGERDQAVDVWTQAAHLTGDKKIWRETL
           ||||||||||||||||||||||||||||||||||||||||||||||||| ||||||||||
g951       GDAESALPYLRYSFENDPEPEVAAHLGEVLWALGERDQAVDVWTQAAHLRGDKKIWRETL
         540       550       560       570       580       590

610
m951.pep   KRHGIALPQPSRKPRK
           ||:|||||:|||||||
g951       KRYGIALPEPSRKPRKX
         600       610
```

The following partial DNA sequence was identified in *N. meningitidis* <SEQ ID 2907>:

```
a951.seq
    1  ATGTTACCCG CCCGTTTCAC CATTTTATCT GTGCTCGCGG CAGCCCTGCT

51  TGCCGGGCAG GCGTATGCCG CCGGCGCGGC GGATGCGAAG CCGCCGAAGG

101  AAGTCGGAAA GGTTTTCAGA AAGCAGCAGC GTTACAGCGA GGAAGAAATC

151  AAAAACGAAC GCGCACGGCT TGCGGCAGTG GGCGAGCGGG TTAATCAGAT

201  ATTTACGTTG CTGGGAGGGG AAACCGCCTT GCAAAAGGGG CAGGCGGGAA

251  CGGCTCTGGC AACCTATATG CTGATGTTGG AACGCACAAA ATCCCCCGAA

301  GTCGCCGAAC GCGCCTTGGA AATGGCCGTG TCGCTGAACG CGTTTGAACA

351  GGCGGAAATG ATTTATCAGA AATGGCGGCA GATTGAGCCT ATACCGGGTA

401  AGGCGCAAAA ACGGGCGGGG TGGCTGCGGA ACGTGCTGAG GGAAAGAGGA

451  AATCAGCATC TAGACGGACT GGAAGAAGTG CTGGCTCAGG CGGACGAAGG

501  ACAGAACCGC AGGGTGTTTT TATTGTTGGC ACAAGCCGCC GTGCAACAGG
```

```
 551 ACGGGTTGGC GCAAAAAGCA TCGAAAGCGG TTCGCCGCGC GGCGTTGAGA

601 TATGAACATC TGCCCGAAGC GGCGGTTGCC GATGTGGTGT TCAGCGTACA

651 GGGACGCGAA AAGGAAAAGG CAATCGGAGC TTTGCAGCGT TTGGCGAAGC

701 TCGATACGGA AATATTGCCC CCCACTTTAA TGACGTTGCG TCTGACTGCA

751 CGCAAATATC CCGAAATACT CGACGGCTTT TTCGAGCAGA CAGACACCCA

801 AAACCTTTCG GCCGTCTGGC AGGAAATGGA AATTATGAAT CTGGTTTCCC

851 TGCACAGGCT GGATGATGCC TATGCGCGTT TGAACGTGCT GTTGGAACGC

901 AATCCGAATG CAGACCTGTA TATTCAGGCA GCGATATTGG CGGCAAACCG

951 AAAAGAAGGT GCTTCCGTTA TCGACGGCTA CGCCGAAAAG GCATACGGCA

1001 GGGGGACGGG GGAACAGCGG GGCAGGGCGG CAATGACGGC GGCGATGATA

1051 TATGCCGACC GAAGGGATTA CACCAAAGTC AGGCAGTGGT TGAAAAAAGT

1101 GTCCGCGCCG GAATACCTGT TCGACAAAGG TGTGCTGGCG GCTGCGGCGG

1151 CTGTCGAGTT GGACGGCGGC AGGGCGGCTT TGCGGCAGAT CGGCAGGGTG

1201 CGGAAACTTC CCGAACAGCA GGGGCGGTAT TTTACGGCAG ACAATTTGTC

1251 CAAAATACAG ATGTTCGCCC TGTCGAAGCT GCCCGACAAA CGGGAGGCTT

1301 TGAGGGGGTT GGACAAGATT ATCGAAAAAC CGCCTGCCGG CAGTAATACA

1351 GAGTTACAGG CAGAGGCATT GGTACAGCGG TCAGTTGTTT ACGATCGGCT

1401 TGGCAAGCGG AAAAAAATGA TTTCAGATCT TGAAAGGGCG TTCAGGCTTG

1451 CACCCGATAA CGCTCAGATT ATGAATAATC TGGGCTACAG CCTGCTTTCC

1501 GATTCCAAAC GTTTGGACGA AGGCTTCGCC CTGCTTCAGA CGGCATACCA

1551 AATCAACCCG GACGATACCG CTGTCAACGA CAGCATAGGC TGGGCGTATT

1601 ACCTGAAAGG CGACGCGGAA AGCGCGCTGC CGTATCTGCG GTATTCGTTT

1651 GAAAACGACC CCGAGCCCGA AGTTGCCGCC CATTTGGGCG AAGTGTTGTG

1701 GGCATTGGGC GAACGCGATC AGGCGGTTGA CGTATGGACG CAGGCGGCAC

1751 ACCTTACGGG AGACAAGAAA ATATGGCGGG AAACGCTCAA ACGTCACGGC

1801 ATCGCATTGC CCAACCTTC CCGAAAACCT CGGAAATAA
```

This corresponds to the amino acid sequence <SEQ ID 2908; ORF 951.a>:

```
a951.pep
  1 MLPARFTILS VLAAALLAGQ AYAAGAADAK PPKEVGKVFR KQQRYSEEEI

51 KNERARLAAV GERVNQIFTL LGGETALQKG QAGTALATYM LMLERTKSPE

101 VAERALEMAV SLNAFEQAEM IYQKWRQIEP IPGKAQKRAG WLRNVLRERG

151 NQHLDGLEEV LAQADEGQNR RVFLLLAQAA VQQDGLAQKA SKAVRRAALR

201 YEHLPEAAVA DVVFSVQGRE KEKAIGALQR LAKLDTEILP PTLMTLRLTA

251 RKYPEILDGF FEQTDTQNLS AVWQEMEIMN LVSLHRLDDA YARLNVLLER

301 NPNADLYIQA AILAANRKEG ASVIDGYAEK AYGRGTGEQR GRAAMTAAMI

351 YADRRDYTKV RQWLKKVSAP EYLFDKGVLA AAAAVELDGG RAALRQIGRV

401 RKLPEQQGRY FTADNLSKIQ MFALSKLPDK REALRGLDKI IEKPPAGSNT

451 ELQAEALVQR SVVYDRLGKR KKMISDLERA FRLAPDNAQI MNNLGYSLLS

501 DSKRLDEGFA LLQTAYQINP DDTAVNDSIG WAYYLKGDAE SALPYLRYSF
```

```
-continued
551 ENDPEPEVAA HLGEVLWALG ERDQAVDVWT QAAHLTGDKK IWRETLKRHG

600 IALPQPSRKP RK*
```

Computer analysis of this amino acid sequence gave the following results:
Homology with a Predicted ORF from *N. meningitidis*
ORF 951 shows 96.4% identity over a 614 aa overlap with a predicted ORF (ORF 951) from *N. meningitidis*

```
a951/m951    96.4% identity in 614 aa overlap 10         20         30         40         50
      a951.pep   MLPARFTILSVLAAALLAGQAYAAG--AADAKPPKEVGKVFRKQQRYSEEEIKNERAR
                 ||| || :|:||:|:|:|||:  |||   |:|  ||||||||||||||||||||||||
      951        MIMLPNRFKMLTVLTATLIAGQVSAAGGGAGDMKQPKEVGKVFRKQQRYSEEEIKNERAR
                       10         20         30         40         50         60

60         70         80         90        100        110
      a951.pep   LAAVGERVNQIFTLLGGETALQKGQAGTALATYMLMLERTKSPEVAERALEMAVSLNAFE
                 ||||||||||||||||||||||||||||||||||||||||||||||||||||||||||||
      m951       LAAVGERVNQIFTLLGGETALQKGQAGTALATYMLMLERTKSPEVAERALEMAVSLNAFE
                      70         80         90        100        110        120

120        130        140        150        160        170
      a951.pep   QAEMIYQKWRQIEPIPGKAQKRAGWLRNVLRERGNQHLDGLEEVLAQADEGQNRRVFLLL
                 ||||||||||||||||||||||||||||||||||||||||||||||||||||||||||||
      m951       QAEMIYQKWRQIEPIPGKAQKRAGWLRNVLRERGNQHLDGLEEVLAQADEGQNRRVFLLL
                      130        140        150        160        170        180

180        190        200        210        220        230
      a951.pep   AQAAVQQDGLAQKASKAVRRAALRYEHLPEAAVADVVFSVQGREKEKAIGALQRLAKLDT
                 |||||||||||||||||||||||:||||||||||||||||||||||||||||||||||||
      m951       AQAAVQQDGLAQKASKAVRRAALKYEHLPEAAVADVVFSVQGREKEKAIGALQRLAKLDT
                      190        200        210        220        230        240

240        250        260        270        280        290
      a951.pep   EILPPTLMTLRLTARKYPEILDGFFEQTDTQNLSAVWQEMEIMNLVSLHRLDDAYARLNV
                 |||||||||||||||||||||||||||||||||||||||||||||||||||||||:||||
      m951       EILPPTLMTLRLTARKYPEILDGFFEQTDTQNLSAVWQEMEIMNLVSLHRLDDATARLNV
                      250        260        270        280        290        300

300        310        320        330        340        350
      a951.pep   LLERNPNADLYIQAAILAANRKEGASVIDGYAEKAYGRGTGEQRGRAAMTAAMIYADRRD
                 |||||||||||||||||||||||||||||||||||||||| |||:|||:||||:||||||
      m951       LLERNPNADLYIQAAILAANRKEGASVIDGYAEKAYGRGTEEQRSRAALTAAMMYADRRD
                      310        320        330        340        350        360

360        370        380        390        400        410
      a951.pep   YTKVRQWLKKVSAPEYLFDKGVLAAAAAVELDGGRAALRQIFRVRKLPEQQGRYFTADNL
                 |:||||||||||||||||||||||||||||||||||||||||:||||||||||||||||
      m951       YAKVRQWLKKVSAPEYLFDKGVLAAAAAVELDGGRAALRQIGRVRKLPEQQGRYFTADNL
                      370        380        390        400        410        420

420        430        440        450        460        470
      a951.pep   SKIQMFALSKLPDKREALRGLDKIIEKPPAGSNTELQAEALVQRSVVYDRLGKRKKMISD
                 |||||:||||||||||||||||||||||||||||||:|||||||||||||||||||||||
      m951       SKIQMLALSKLPDKREALRGLDKIIEKPPAGSNTALQAEALVQRSVVYDRLGKRKKMISD
                      430        440        450        460        470        480

480        490        500        510        520        530
      a951.pep   LERAFRLAPDNAQIMNNLGYSLLSDLKRLDEGFALLQTAYQINPDDTAVNDSIGWAYYLK
                 |||||||||||||:|||||||||||:|||||||||||||||||||||||||||||||||
      m951       LERAFRLAPDANQIMNNLGYSLLTDSKRLDEGFALLQTAYQINPDDTAVNDSIGWAYYLK
                      490        500        510        520        530        540

540        550        560        570        580        590
      a951.pep   GDAESALPYLRYSFENDPEPEVAAHLGEVLWALGERDQAVDVWTQAAHLTGDKKIWRETL
                 ||||||||||||||||||||||||||||||||||||||||||||||||||||||||||||
      m951       GDAESALPYLRYSFENDPEPEVAAHLGEVLWALGERDQAVDVWTQAAHLTGDKKIWRETL
                      550        560        570        580        590        600

600        610
      a951.pep   KRHGIALPQPSRKPRK
                 ||||||||||||||||
      m951       KRHGIALPQPSRKPRK
                      610
```

The following partial DNA sequence was identified in *N. gonorrhoeae* <SEQ ID 2909>:

```
g952.seq (partial)
  1  ..TTGTCTTATC GTTTGAATGC TGCACCGATG TTTAACGATA ATCCTGTTGT

51    TTACGGAAAA ATCAAATTGC AGAGTTGGAA AGCGCGGCGG GATTTCAATA
```

-continued

```
101    TTGTAAAGCA GGATTTGGAT TTTTCCTGCG GGGCGGCTTC GGTGGCGACG

151    CTTTTGAACA ATTTTTACGG GCAAAAGCTG ACGGAAGAAG AAGTGTTGGA

201    AAAACTGGGT AAGGAACAGA TGCGCGCGTC GTTTGAGGAT ATGCGGCGCA

251    TTATGCCCGA TTTGGGTTTT GAGGCGAAAG GCTATGCCCT GTCTTTCGAA

301    CAGCTCGCGC AGTTGAAAAT CCCCGTCATC GTGTATCTGA AATACCGCAA

351    AGACGACCAT TTTTCGGTAT TGCGCGGAGT GGATGGCAAT ACGGTTTTGC

401    TTGCCGACCC GTCGCCGGGT CATGTTTCGA TGAGCAGGGC GCAGTTTTTG

451    GAGGCTTGGC AAACCCGTGA GGGAAATTTG GCAGGCAAAA TTTTGGCGGT

501    CGTGCCGAAA AAGCGGAGG CGATTTCAAA TAAATTGTTT TTCACACATC

551    ATCCCAAGCG GCAGACGGAG TTTGCAGTCG ACAGGTAAA ATGGTGGCGT

601    GCTTATTGA
```

This corresponds to the amino acid sequence <SEQ ID 2910; ORF 952.ng>:

```
g952.pep (partial)
  1   ..LSYRLNAAPM FNDNPVVYGK IKLQSWKARR DFNIVKQDLD FSCGAASVAT

51   LLNNFYGQKL TEEEVLEKLG KEQMRASFED MRRIMPDLGF EAKGYALSFE

101   QLAQLKIPVI VYLKYRKDDH FSVLRGVDGN TVLLADPSPG HVSMSRAQFL

151   EAWQTREGNL AGKILAVVPK KAEAISNKLF FTHHPKRQTE FAVGQVKWWR

201   AY*
```

The following partial DNA sequence was identified in *N. meningitidis* <SEQ ID 2911>:

```
m952.seq
  1 ATGATGAAGT TCAAATATGT TTTTCTGTTG GCGTGTGTTG TCGTTTCTTT

51 ATCTTATCGT TTGAATGCTG CACCGATGTT TAACGATAAT CCTGTTGTTT

101 ACGGAAAAAT CAAAGTGCAG AGTTGGAAAG CGCGGCGGGA TTTCAATATT

151 GTAAAGCAGG ATTTGGATTT TTCCTGTGGG GCGGCTTCGG TGGCGACGCT

201 TTTGAACAAT TTTTACGGGC AAACGCTGAC GGAAGAAGAA GTGTTGAAAA

251 AGCTGGATAA GGAGCAGATG CGCGCGTCGT TTGAGGATAT GCGGCGCATT

301 ATGCCTGATT TGGGTTTTGA GGCGAAGGGC TATGCCCTGT CTTTCGAGCA

351 GCTCGCGCAG TTGAAAATCC CCGTCATCGT GTATCTGAAA TACCGCAAAG

401 ACGACCATTT TTCGGTATTG CGCGGTATAG ACGGCAATAC GGTTTTGCTT

451 GCCGACCCGT CGCTGGGGCA TGTTTCAATG AGCAGGGCGC AGTTTTTGGA

501 TGCTTGGCAA ACCCGTGAGG GAAATTTGGC AGGTAAGATT TTGGCTGTCA

551 TACCGAAAAA AGCCGAGACA ATTTCAAATA AATTGTTTTT CACACAACAC

601 CCAAAACGGC AGACGGAGTT TACAGTCGGA CAAATCAGGC AAGCACGTGC

651 AGAGTAA
```

This corresponds to the amino acid sequence <SEQ ID 2912; ORF 952>:

```
m952.pep
   1 MMKFKYVFLL ACVVVSLSYR LNAAPMFNDN PVVYGKIKVQ SWKARRDFNI

51 VKQDLDFSCG AASVATLLNN FYGQTLTEEE VLKKLDKEQM RASFEDMRRI

101 MPDLGFEAKG YALSFEQLAQ LKIPVIVYLK YRKDDHFSVL RGIDGNTVLL

151 ADPSLGHVSM SRAQFLDAWQ TREGNLAGKI LAVIPKKAET ISNKLFFTQH

201 PKRQTEFTVG QIRQARAE*
```

Computer analysis of this amino acid sequence gave the following results:
Homology with a Predicted ORF from *N. gonorrhoeae*
ORF 952 shows 92.5% identity over a 201 aa overlap with a predicted ORF (ORF 952) from *N. gonorrhoeae*

```
     g952/m952;  92.5% identity in 201 aa overlap 10        20        30        40
       g952.pep               LSYRLNAAPMFNDNPVVYGKIKLQSWKARRDFNIVKQDLDFSCG
                              |||||||||||||||||||||:|||||||||||||||||||||
       m952     MMKFKYVFLLACVVVSLSYRLNAAPMFNDNPVVYGKIKVQSWKARRDFNIVKQDLDFSCG
                       10        20        30        40        50        60

50        60        70        80        90       100
       g952.pep    AASVATLLNNFYGQKLTEEEVLEKLGKEQMRASFEDMRRIMPDLGFEAKGYALSFEQLAQ
                   ||||||||||||| |||||||:|| |||||||||||||||||||||||||||||||||||
       m952        AASVATLLNNFYGQTLTEEEVLKKLDKEQMRASFEDMRRIMPDLGFEAKGYALSFEQLAQ
                       70        80        90       100       110       120

110       120       130       140       150       160
       g952.pep    LKIPVIVYLKYRKDDHFSVLRGVDGNTVLLADPSPGHVSMSRAQFLEAWQTREGNLAGKI
                   ||||||||||||||||||||||:|||||||||||| |||||||||||:||||||||||||
       m952        LKIPVIVYLKYRKDDHFSVLRGIDGNTVLLADPSLGHVSMSRAQFLDAWQTREGNLAGKI
                      130       140       150       160       170       180

170       180       190       200
       g952.pep    LAVVPKKAEAISNKLFFTHHPKRQTEFAVGQVKWWRAYX
                   |||:||||||||||||||:||||||||::|||::   ||
       m952        LAVIPKKAEAISNKLFFTQHPKRQTEFTVGQIRQARAE
                      190       200       210
```

The following partial DNA sequence was identified in *N. meningitidis* <SEQ ID 2913>:

```
a952.seq
   1 ATGATGAAGT TCAAATATGT TTTTCTGTTG GCGTGTGTTG TCGTTTCTTT

51 ATCTTATCGT TTGAATGCTG CACCGATGTT TAACGATAAT CCTGTTGTTT

101 ACGGAAAAAT CAAAGTGCAG AGTTGGAAAG AAAGGCGGGA TTTCAATATT

151 GTAAAGCAGG ATTTGGATTT TTCCTGCGGG GCGGCTTCGG TGGCGACGCT

201 TTTGAACAAT TTTTACGGGC AAACGCTGAC GGAAGAAGAA GTGTTGAAAA

251 AGCTGGATAA GGAGCAGATG CGCGCGTCGT TTGAGGATAT GCGGCGCATT

301 ATGCCAGATT GGGTTTTGA AGCGAAAGGC TATGCCCTGT CTTTCGAGCA

351 GCTCGCACAG TTGAAAATCC CCGTCATCGT GTATCTGAAA TACCGCAAGG

401 ATGATCATTT CTCGGTATTG CGCGGGATAG ACGGCAATAC GGTTTTGCTT

451 GCCGACCCGT CGCTGGGTCA TGTTTCAATG AGCAGGCGC AGTTTTNGGA

501 TGCTTGGCAA ACCCGTGAGG GAAATTTGGC AGGTAAGATT TTGGCGGTCG

551 TGCCGAAAAA AGCCGAGACA ATTTCAAATA AATTGTTTTT CACACATCAT

601 CCCAAGCGGC AGACGGAGTT TGCAGTCGGA CAAATCAGGC AAGCACGTGC

651 AGAGTAA
```

This corresponds to the amino acid sequence <SEQ ID 2914; ORF 952.a>:

```
a952.pep
  1 MMKFKYVFLL ACVVVSLSYR LNAAPMFNDN PVVYGKIKVQ SWKERRDFNI

51 VKQDLDFSCG AASVATLLNN FYGQTLTEEE VLKKLDKEQM RASFEDMRRI

101 MPDLGFEAKG YALSFEQLAQ LKIPVIVYLK YRKDDHFSVL RGIDGNTVLL

151 ADPSLGHVSM SRAQFXDAWQ TREGNLAGKI LAVVPKKAET ISNKLFFTHH

201 PKRQTEFAVG QIRQARAE*
```

Computer analysis of this amino acid sequence gave the following results:
Homology with a Predicted ORF from *N. meningitidis*
ORF 952 shows 97.7% identity over a 218 aa overlap with a predicted ORF (ORF 952) from *N. meningitidis*

```
   a952/m952    97.7% identity in 218 aa overlap 10        20        30        40        50        60
      a952.pep  MMKFKYVFLLACVVVSLSYRLNAAPMFNDNPVVYGKIKVQSWKERRDFNIVKQDLDFSCG
                ||||||||||||||||||||||||||||||||||||||| |||||||||||||||||||
      m952      MMKFKYVFLLACVVVSLSYRLNAAPMFNDNPVVYGKIKVQSWKARRDFNIVKQDLDFSCG
                      10        20        30        40        50        60

70        80        90       100       110       120
      a952.pep  AASVATLLNNFYGQTLTEEEVLKKLDLEQMRASFEDMRRIMPDLGFEAKGYALSFEQLAQ
                ||||||||||||||||||||||||||| ||||||||||||||||||||||||||||||||
      m952      AASVATLLNNFYGQTLTEEEVLKKLDKEQMRASFEDMRRIMPDLGFEAKGYALSFEQLAQ
                      70        80        90       100       110       120

130       140       150       160       170       180
      a952.pep  LKIPVIVYLKYRKDDHFSVLRGIDGNTVLLADPSLGHVSMSRAQFXDAWQTREGNLAGKI
                |||||||||||||||||||||||||||||||||||||||||||||| |||||||||||||
      m952      LKIPVIVYLKYRKDDHFSVLRGIDGNTVLLADPSLGHVSMSRAQFLDAWQTREGNLAGKI
                     130       140       150       160       170       180

190       200       210   219
      a952.pep  LAVVPKKAETISNKLFFTHHPKRQTEFAVGQIRQARAEX
                ||| ||||||||||||||| |||||||| |||||||||
      m952      LAVIPKKAETISNKLFFTQHPKRQTEFTVGQIRQARAE
                     190       200       210
```

The following partial DNA sequence was identified in *N. gonorrhoeae* <SEQ ID 2915>:

```
g953.seq
  1 ATGAAAAAAA TCATCTTCGC CGCGCTCGCA GCGGCAGCCG TCGGCACTGC

51 CTCCGCCACC TACAAAGTGG ACGAATATCA CGCCAACGTC CGTTTCGCCA

101 TCGACCACTT CAACACCAGC ACCAACGTCG GCGGTTTTTA CGGTCTGACC

151 GGTTCCGTCG AGTTCGATCA AGCAAAACGC GACGGCAAAA TCGACATCAC

201 CATTCCCGTC GCCAACCTGC AAAGCGGTTC GCAACCCTTC ACCGGCCACC

251 TGAAATCCGC CGACATCTTC GATGCCGCTC AATATCCGGA CATCCGCTTC

301 GTTTCCACCA AATTCAACTT CAACGGCAAA AAACTTGTTT CCGTTGACGG

351 CAACCTGACC ATGCGCGGCA AAACCGCCCC CGTCAAACTC AAAGCCGAAA

401 AATTCAACTG CTACCAAAGC CCGATGGCGG AAACCGAAGT TTGCGGCGGC

451 GACTTCAGCA CCACCATCGA CCGCACCAAA TGGGGCGTGG ACTACCTCGT

501 TAACGCCGGT ATGACCAAAA ACGTCCGCAT CGACATCCAA ATCGAAGCTG

551 CAAAACAATA A
```

This corresponds to the amino acid sequence <SEQ ID 2916; ORF 953.ng>:

```
g953.pep
  1 MKKIIFAALA AAAVGTASAT YKVDEYHANV RFAIDHFNTS TNVGGFYGLT

51 GSVEFDQAKR DGKIDITIPV ANLQSGSQPF TGHLKSADIF DAAQYPDIRF

101 VSTKFNFNGK KLVSVDGNLT MRGKTAPVKL KAEKFNCYQS PMAETEVCGG

151 DFSTTIDRTK WGVDYLVNAG MTKNVRIDIQ IEAAKQ*
```

The following partial DNA sequence was identified in *N. meningitidis* <SEQ ID 2917>:

```
m953.seq
  1 ATGAAAAAAA TCATCTTCGC CGCACTCGCA GCCGCCGCCA TCAGTACTGC

51 CTCCGCCGCC ACCTACAAAG TGGACGAATA TCACGCCAAC GCCCGTTTCG

101 CCATCGACCA TTTCAACACC AGCACCAACG TCGGCGGTTT TTACGGTCTG

151 ACCGGTTCCG TCGAGTTCGA CCAAGCAAAA CGCGACGGTA AAATCGACAT

201 CACCATCCCC ATTGCCAACC TGCAAAGCGG TTCGCAACAC TTTACCGACC

251 ACCTGAAATC AGCCGACATC TTCGATGCCG CCCAATATCC GGACATCCGC

301 TTTGTTTCCA CCAAATTCAA CTTCAACGGC AAAAAACTGG TTTCCGTTGA

351 CGGCAACCTG ACCATGCACG GCAAAACCGC CCCCGTCAAA CTCAAAGCCG

401 AAAAATTCAA CTGCTACCAA AGCCCGATGG AGAAAACCGA AGTTTGTGGC

451 GGCGACTTCA GCACCACCAT CGACCGCACC AAATGGGGCA TGGACTACCT

501 CGTTAACGTT GGTATGACCA AAAGCGTCCG CATCGACATC CAAATCGAGG

551 CAGCCAAACA ATAA
```

This corresponds to the amino acid sequence <SEQ ID 2918; ORF 953>:

```
m953.pep
  1 MKKIIFAALA AAAISTASAA TYKVDEYHAN ARFAIDHFNT STNVGGFYGL

51 TGSVEFDQAK RDGKIDITIP IANLQSGSQH FTDHLKSADI FDAAQYPDIR

101 FVSTKFNFNG KKLVSVDGNL TMHGKTAPVK LKAEKFNCYQ SPMEKTEVCG

151 GDFSTTIDRT KWGMDYLVNV GMTKSVRIDI QIEAAKQ*
```

Computer analysis of this amino acid sequence gave the following results:
Homology with a Predicted ORF from *N. gonorrhoeae*
ORF 953 shows 93.0% identity over a 187 aa overlap with a predicted ORF (ORF 953) from *N. gonorrhoeae*

```
    m953/g953   93.0% identity in 187 aa overlap 10         20         30         40         50         60
        m953.pep    MKKIIFAALAAAAISTASAATYKVDEYHANARFAIDHFNTSTNVGGFYGLTGSVEFDQAK
                    ||||||||||| ::|||| |||||||||| :|||||||||||||||||||||||||||||
        g953        MKKIIFAALAAAAVGTASA-TYKVDEYHANVRFAIDHFNTSTNVGGFYGLTGSVEFDQAK
                     10         20         30         40         50

70         80         90        100        110        120
        m953.pep    RDGKIDITIPIANLQSGSQHFTDHLKSADIFDAAQYPDIRFVSTKFNFNGKKLVSVDGNL
                    ||||||||||:|||||||||||| || ||||||||||||||||||||||||||||||||
        g953        RDGKIDITIPVANLQSGSQPFTGHLKSADIFDAAQYPDIRFVSTKFNFNGKKLVSVDGNL
                     60         70         80         90        100        110
```

```
                   130        140        150        160        170        180
m953.pep   TMHGKTAPVKLKAEKFNCYQSPMEKTEVCGGDFSTTIDRTKWGMDYLVNVGMTKSVRIDI
           ||:||||||||||||||||||:||||||||||||||||||:|||||:||||:|||||
g953       TMRGKTAPVKLKAEKFNCYQSPMAETEVCGGDFSTTIDRTKWGVDYLVNAGMTKNVRIDI
                   120        130        140        150        160        170 m953.pep   QIEAAKQX
           ||||||||
g953       QIEAAKQX
           180
```

The following partial DNA sequence was identified in *N. meningitidis* <SEQ ID 2919>:

```
a953.seq
    1 ATGAAAAAAA TCATCATCGC CGCGCTCGCA GCAGCCGCCA TCGGCACTGC

51 CTCCGCCGCC ACCTACAAAG TGGACGAATA TCACGCCAAC GCCCGTTTCT

101 CTATCGACCA TTTCAACACC AGCACCAACG TCGGCGGTTT TTACGGTCTG

151 ACCGGTTCCG TTGAGTTCGA CCAAGCAAAA CGCGACGGTA AAATCGACAT

201 CACCATCCCC GTTGCCAACC TGCAAAGCGG TTCGCAACAC TTTACCGACC

251 ACCTGAAATC AGCCGACATC TTCGATGCCG CCCAATATCC GGACATCCGC

301 TTTGTTTCCA CCAAATTCAA CTTCAACGGC AAAAAACTGG TTTCCGTTGA

351 CGGCAACCTG ACCATGCACG GCAAAACCGC CCCCGTCAAA CTCAAAGCCG

401 AAAAATTCAA CTGCTACCAA AGCCCGATGT TGAAAACCGA AGTTTGCGGC

451 GGCGACTTCA GCACCACCAT CGACCGCACC AAATGGGGCA TGGACTACCT

501 CGTTAACGTT GGTATGACCA AAAGCGTCCG CATCGACATC CAAATCGAGG

551 CAGCCAAACA ATAA
```

This corresponds to the amino acid sequence <SEQ ID 2920; ORF 953.a>:

```
a953.pep
    1 MKKIIIAALA AAAIGTASAA TYKVDEYHAN ARFSIDHFNT STNVGGFYGL

51 TGSVEFDQAK RDGKIDITIP VANLQSGSQH FTDHLKSADI FDAAQYPDIR

101 FVSTKFNFNG KKLVSVDGNL TMHGKTAPVK LKAEKFNCYQ SPMLKTEVCG

151 GDFSTTIDRT KWGMDYLVNV GMTKSVRIDI QIEAAKQ*
```

Computer analysis of this amino acid sequence gave the following results:
Homology with a Predicted ORF from *N. meningitidis*
ORF 953 shows 97.3% identity over a 187 aa overlap with a predicted ORF (ORF 953) from *N. meningitidis*

```
a953/m953  97.3% identity in 187 aa overlap 10         20         30         40         50         60
a953.pep   MKKIIIAALAAAAIGTASAATYKVDEYHANARFSIDHFNTSTNVGGFYGLTGSVEFDQAK
           |||||:|||||||||||||||||||||||||||:||||||||||||||||||||||||||
m953       MKKIIFAALAAAAISTASAATYKVDEYHANARFAIDHFNTSTNVGGFYGLTGSVEFDQAK
                   10         20         30         40         50         60

70         80         90        100        110        120
a953.pep   RDGKIDITIPVANLQSGSQHFTDHLKSADIFDAAQYPDIRFVSTKFNFNGKKLVSVDGNL
           ||||||||||:|||||||||||||||||||||||||||||||||||||||||||||||||
m953       RDGKIDITIPIANLQSGSQHFTDHLKSADIFDAAQYPDIRFVSTKFNFNGKKLVSVDGNL
                   70         80         90        100        110        120
```

```
                          -continued
                 130        140        150        160        170        180
    a953.pep  TMHGKTAPVKLKAEKFNCYQSPMLKTEVCGGDFSTTIDRTKWGMDYLVNVGMTKSVRIDI
              |||||||||||||||||||||||| |||||||||||||||||||| |||||||||||||
    m953      TMHGKTAPVKLKAEKFNCYQSPMEKTEVCGGDFSTTIDRTKWGVDYLVNVGMTKSVRIDI
                 130        140        150        160        170        180 a953.pep  QIEAAKQX
              ||||||||
    m953      QIEAAKQX g954.seq not found yet g954.pep not found yet
```

The following partial DNA sequence was identified in *N. meningitidis* <SEQ ID 2921>:

```
m954.seq
   1 ATGAAAAAGT TTTATTTTGT GCTGCTGGCG TTGGGTTTGG CAGCGTGTGG

51 GCAAGAACAA TCGCAGAAAG CTGATGCGGA GCAGTATTTT TTTGCCAATA

101 AATATCAATT TGCAGATGAG AAACAGGCTT TTTATTTTGA ACGCGCCGCC

151 CGTTTCCGTG TATTGCAACA AGGCCTTGGC GGGGATTTTG AGAGGTTTTT

201 AAAAGGAGAA ATACCTAATC AAGAAAATCT TGCAAAGTAT CGTGAAAATA

251 TTACTCAAGC AGTCGCTTAT TATGCGGACA CGAATGGAGA TGATGACCCA

301 TACCGCGTCT GCAAACAGGC TGCGCAAGAT GCAGAAATCC TGATGAAGAG

351 TATGGTAACA AGCGGTGGAG GCGGTACAAC TGATTTAGAT AAGGAAAGTT

401 ATCAAAATTA CCGAAAATCA ATGCAAGAAT GCCGTAAAAC AATAACGGAA

451 GCTGAAGCCA ATTTGCCGAA AAAATAA
```

This corresponds to the amino acid sequence <SEQ ID 2922; ORF 954>:

```
m954.pep
   1 MKKFYFVLLA LGLAACGQEQ SQKADAEQYF FANKYQFADE KQAFYFERAA

51 RFRVLQQGLG GDFERFLKGE IPNQENLAKY RENITQAVAY YADTNGDDDP

101 YRVCKQAAQD AEILMKSMVT SGGGGTTDLD KESYQNYRKS MQECRKTITE

151 AEANLPKK* a954.seq not found yet
a954.pep not found yet
```

The following partial DNA sequence was identified in *N. gonorrhoeae* <SEQ ID 2923>:

```
g957.seq (partial)
   1 ATGTTTAAAA AATTCAAACC GGTACTGTTG TCATTTTTTG CACTTGTATT

51 TGCCTTTTGG CTGGGAACAG GTATTGCCTA TGAGATTAAT CCGCGTTGGT

101 TTTTGAGCGA TACGGCAACT GAAGTACCTG AAAATCCGAA TGCTTTTGTG

151 GCGAAACTTG CCCGCCTGTT CCGAAATGCC GACAGGGCGG TTGTCATCGT

201 GAAGGAATCG ATGAGGACGG AGGAAAGCCT TGCCGGAGCT GTGGATGACG

251 GTCCGTTGCA GTCGGAGAAG GATTATCTCG CGCTCGCTAT CCGGCTCAGT

301 CGTTTGAAAG AAAAGGCGAA ATGGTTTCAC GTAACGGAGC AGGAACATGG

351 GGAAGAGGTT TGGCTGGATT ACTATATCGG CGAGGGCGGT TTGGTTGCGG

401 TTTCGCTTTC GCAACGCTCG CCGGAAGCGT TGTTAATGC CGAATATCTG
```

```
451 TATCGGAACG ATCGTCCGTT TTCTGTAAAT GTGTACGGCG GAACGGCTCA

501 CGGGGAAAAT TATGAAACGA CAGGAGAATA TCGGGTTGTT TGGCAACCGG

551 ACGGTTCGGT ATTTGATGCG GCGGGGCGCG GGAAAATCGG GGAAGATGTT

601 TATGAGCATT GCCTCGGGTG TTATCAGATG GCCCAGGTAT ATTTGGCGAA

651 ATACCGGGAT GTCGCGAATG ACGAGCAGAA GGTTTGGGAC TTCCGCGAAG

701 AGAGCAACCG GATTGCATCG GACTCGCGCG ATTATGTGTT TTATCAGAAT

751 ATGCGGGAAT TGATGCCCCG GGGGatgaaG gcgaacagtc ttgtggtcgg 801 ctatgatgcg gacggtCtgc CgcaAAAagt ctattggagt gtcgacaatg 851 gaaaaaaacc ccaaagtgtc gaatattatt tgaaaaacgg aaatcttttt 901 attgcccaat cttcgacggt aaccttgaaa acggatggcg taacggcgga 951 tatgcaaacc tatcatgcgc aacaaacgtt gtatttggat
    ggg...
```

This corresponds to the amino acid sequence <SEQ ID 2924; ORF 957.ng>:

```
g957.pep (partial)
  1 MFKKFKPVLL SFFALVFAFW LGTGIAYEIN PRWFLSDTAT EVPENPNAFV

51 AKLARLFRNA DRAVVIVKES MRTEESLAGA VDDGPLQSEK DYLALAIRLS

101 RLKEKAKWFH VTEQEHGEEV WLDYYIGEGG LVAVSLSQRS PEAFVNAEYL

151 YRNDRPFSVN VYGGTAHGEN YETTGEYRVV WQPDGSVFDA AGRGKIGEDV

201 YEHCLGCYQM AQVYLAKYRD VANDEQKVWD FREESNRIAS DSRDYVFYQN

251 MRELMPRGMK ANSLVVGYDA DGLPQKVYWS VDNGKKPQSV EYYLKNGNLF

301 IAQSSTVTLK TDGVTADMQT YHAQQTLYLD G...
```

The following partial DNA sequence was identified in *N. meningitidis* <SEQ ID 2925>:

```
m957.seq
    1 ATGTTTAAAA AATTCAAACC GGTACTGTTG TCATTTTTTG CACTTGTATT

51 TGCCTTTTGG CTGGGAACGG GTATTGCCTA TGAGATTAAT CCGCGTTGGT

101 TTTTGAGCGA TACGGCAACT GAAGTACCTA AAAATCCGAA TGCTTTTGTG

151 GCGAAACTTG CCCGCCTGTT CCGAAATGCC GACAGGGCGG TTGTCATCGT

201 GAAGGAATCG ATAAGGACGG AGGAAAATCT TGCCGGAACT GTGGATGACG

251 GTCCGTTGCA GTCGGAGAAG GATTATCTCG CGCTCGCTAT CCGGCTCAGT

301 CGTTTGAAAG AAAAGGCGAA ATGGTTTCAC GTAACGGAGC AGGAACATGG

351 GAAAGAGGTT TGGCTGGATT ACCATATCGG CGAGGGCGGT TTGGTTGCGG

401 TTTCGCTTTC GCAACGCTCG CCGGAAGCAT TTGTTAATGC CGAATATCTG

451 TATCGGAACG ATCGTCCGTT TTCTGTAAAT GTGTACGGCG GAACGGTTCA

501 CGGGGAAAAT TATGAAACGA CAGGAGAATA TCGGGTTGTT TGGCAACCAG

551 ACGGTTCGGT ATTTGATGCG GCGGGGCGCG GGAAAATCGG GGAAGATGTT

601 TATGAGCATT GCCTCGGGTG TTATCAGATG GCCCAGGTAT ATTTGGCGAA

651 ATACCGGGAT GTCGCGAATG ACGAGCAGAA GGTTTGGGAC TTCCGCAAAG

701 AGAGCAACCG AATTGCGTCG GACTCGCGCA ATTCTGTGTT TTATCAGAAT
```

```
 751  ATGCGGGAAT TGATGCCCCG AGGGATGAAG GCGAACAGTC TTGTGGTCGG

801  CTATGATGCG GACGGTCTGC CGCAAAAAGT CTATTGGAGT TTCGACAATG

851  GAAAAAAACG CCAGAGTTTC GAATATTATT TGAAAAACGG AAATCTTTTT

901  ATTGCACAAT CTTCGACGGT AGCATTGAAA GCGGATGGCG TAACGGCGGA

951  TATGCAGACC TATCATGCGC AACAGACGTG GTATTTGGAT GGCGGGCGGA

1001  TTGTCCGCGA AGAGAAACAG GGAGACAGAC TGCCTGATTT TCCTTTGAAC

1051  TTGGAAAATT TGGAAAAGA GGTGCGCCGT TATGCAGAGG CTGCGGCGAG

1101  ACGTTCGGGC GGCAGGCGCG ACCTTTCTCA CTGA
```

This corresponds to the amino acid sequence <SEQ ID 2926; ORF 957>:

```
m957.pep
  1  MFKKFKPVLL SFFALVFAFW LGTGIAYEIN PRWFLSDTAT EVPKNPNAFV

51  AKLARLFRNA DRAVVIVKES IRTEENLAGT VDDGPLQSEK DYLALAIRLS

101  RLKEKAKWFH VTEQEHGKEV WLDYHIGEGG LVAVSLSQRS PEAFVNAEYL

151  YRNDRPFSVN VYGGTVHGEN YETTGEYRVV WQPDGSVFDA AGRGKIGEDV

201  YEHCLGCYQM AQVYLAKYRD VANDEQKVWD FRKESNRIAS DSRNSVFYQN

251  MRELMPRGMK ANSLVVGYDA DGLPQKVYWS FDNGKKRQSF EYYLKNGNLF

301  IAQSSTVALK ADGVTADMQT YHAQQTWYLD GGRIVREEKQ GDRLPDFPLN

351  LENLEKEVRR YAEAAARRSG GRRDLSH*
```

Computer analysis of this amino acid sequence gave the following results:

Homology with a Predicted ORF from *N. gonorrhoeae*

ORF 957 shows 95.2% identity over a 331 aa overlap with a predicted ORF (ORF 957) from *N. gonorrhoeae*

```
g957/m957 95.2% identity in 331 aa overlap 10         20         30         40         50         60
g957.pep  MFKKFKPVLLSFFALVFAFWLGTGIAYEINPRWFLSDTATEVPENPNAFVAKLARLFRNA
          ||||||||||||||||||||||||||||||||||||||||||:|||||||||||||||||
m957      MFKKFKPVLLSFFALVFAFWLGTGIAYEINPRWFLSDTATEVPKNPNAFVAKLARLFRNA
                  10         20         30         40         50         60

70         80         90        100        110        120
g957.pep  DRAVVIVKESMRTEESLAGAVDDGPLQSEKDYLALAIRLSRLKEKAKWPHVTEQEHGEEV
          ||||||||||:||||:|||:||||||||||||||||||||||||||||||||||||||:|
m957      DRAVVIVKESIRTEENLAGTVDDGPLQSEKDYLALAIRLSRLKEKAKWPHVTEQEHGKEV
                  70         80         90        100        110        120

130        140        150        160        170        180
g957.pep  WLDYYIGEGGLVAVSLSQRSPEAFVNAEYLYRNDRPFSVNVYGGTAHGENYETTGEYRVV
          ||||:|||||||||||||||||||||||||||||||||||||||:|||||||||||||||
m957      WLDYHIGEGGLVAVSLSQRSPEAFVNAEYLYRNDRPFSVNVYGGTVHGENYETTGEYRVV
                 130        140        150        160        170        180

190        200        210        220        230        240
g957.pep  WQPDGSVFDAAGRGKIGEDVYEHCLGCYQMAQVYLAKYRDVANDEQKVWDFREESNRIAS
          ||||||||||||||||||||||||||||||||||||||||||||||||||:|||||||
m957      WQPDGSVFDAAGRGKIGEDVYEHCLGCYQMAQVYLAKYRDVANDEQKVWDFRKESNRIAS
                 190        200        210        220        230        240

250        260        270        280        290        300
g957.pep  DSRDYVFYQNMRELMPRGMKANSLVVGYDADGLPQKVYWSVDNGKKPQSVEYYLKNGNLF
          |||::||||||||||||||||||||||||| ||||||||||  |||| || |||||||||
m957      DSRNSVFYQNMRELMPRGMKANSLVVGYDADGLPQKVYWSFDNGKKRQSFEYYLKNGNLF
                 250        260        270        280        290        300

310        320        330
g957.pep  IAQSSTVTLKTDGVTADMQTYHAQQTLYLDG
          |||||||:||:||||||||||||||||||
m957      IAQSSTVALKADGVTADMQTYHAQQTWYLDGGRIVREEKQGDRLPDFPLNLENLEKEVRR
                 310        320        330        340        350        360
```

-continued
```
m957    YAEAAARRSGGRRDLSHX
                370
```

The following partial DNA sequence was identified in *N. meningitidis* <SEQ ID 2927>:

```
a957.seq
    1 ATGTTTAAAA AATTCAAACC GGTACTGTTG TCATTTTTTG CACTTGTATT

51 TGCCTTTTGG CTGGGAACGG GTATTGCCTA TGAGATTAAT CCGCGTTGGT

101 TTTTGAGCGA TACGGCAACT GAAAATCCGA ATGCTTTTGT GGCGAAACTT

151 GCCCGCCTGT TCCGAAATGC CGACAGGGCG GTTGTCATCG TGAAGGAATC

201 GATGAGGACG GAGGAAAGTC TTGCCGGAGC TGTGGATGAC GGTCCGTTGC

251 AGTCGGAGAA GGATTATCTT GCACTCGCTG TCCGGCTCAG TCGTTTGAAA

301 GAAAAGGCGA AATGGTTTCA CGTAACGGAG CAGGAACATG GGGAAGAGGT

351 TTGGCTGGAT TACTATATCG GCGAGGGCGG TTTGGTTGCG GTTTCGCTTT

401 CGCAACGCTC GCCGGAAGCG TTTGTTAATG CCGAATATCT GTATCGGAAC

451 GATCGTCCGT TTTCTGTAAA TGTGTACGGC GGAACGGTTC ACGGGGAAAA

501 TTATGAAACG ACAGGAGAAT ATCGGGTTGT TTGGCAACCG GACGGTTCGG

551 TATTTGATGC GTCGGGGCGC GGGAAAATCG GGAAGATGT TTATGAGCAT

601 TGCCTCGGGT GTTATCAGAT GGCCCAGGTA TATTTGGCGA ATATCGGGA

651 TGTCGCGAAT GATGAGCAGA AGGTTTGGGA CTTCCGCGAA GAGAGTAACC

701 GGATTGCGTC GGACTCGCGC GATTCTGTGT TTTATCAGAA TATGCGGGAA

751 TTGATGCCCC GAGGGATGAA GGCAAACAGT CTTGTGGTCG GCTATGATGC

801 GGACGGTCTG CCGCAGAAAG TCTATTGGAG TTTCGACAAT GGGAAAAAAC

851 GCCAGAGTTT CGAATATTAT TTGAAAAACG GAAATCTTTT TATTGCACAA

901 TCTTCGACGG TAGCATTGAA AGCGGATGGC GTAACGGCGG ATATGCAGAC

951 CTATCATGCG CAACAGACGT GGTATTTAGA TGGCGGGCGG ATTGTCCGCG

1001 AAGAGAAACA GGGGGACAGA CTGCCTGATT TTCCTTTGAA CTTGGAAGAT

1051 TTGGAAAAAG AGGTGAGCCG TTATGCAGAG GCTGCGGCGA GACGTTCGGG

1101 CGGCAGGCGC GACCTTTCTC ACTGA
```

This corresponds to the amino acid sequence <SEQ ID 2928; ORF 957.a>:

```
a957.pep
    1 MFKKFKPVLL SFFALVFAFW LGTGIAYEIN PRWFLSDTAT ENPNAFVAKL

51 ARLFRNADRA VVIVKESMRT EESLAGAVDD GPLQSEKDYL ALAVRLSRLK

101 EKAKWFHVTE QEHGEEVWLD YYIGEGGLVA VSLSQRSPEA FVNAEYLYRN

151 DRPFSVNVYG GTVHGENYET TGEYRVVWQP DGSVFDASGR GKIGEDVYEH

201 CLGCYQMAQV YLAKYRDVAN DEQKVWDFRE ESNRIASDSR DSVFYQNMRE

251 LMPRGMKANS LVVGYDADGL PQKVYWSFDN GKKRQSFEYY LKNGNLFIAQ

301 SSTVALKADG VTADMQTYHA QQTWYLDGGR IVREEKQGDR LPDFPLNLED

351 LEKEVSRYAE AAARRSGGRR DLSH*
```

Computer analysis of this amino acid sequence gave the following results:
Homology with a Predicted ORF from *N. meningitidis*
ORF 957 shows 96.3% identity over a 377 aa overlap with a predicted ORF (ORF 957) from *N. meningitidis*

```
a957/m957 96.3% identity in 377 aa overlap 10        20        30        40        50
a957.pep  MFKKFKPVLLSFFALVFAFWLGTGIAYEINPRWFLSDTATE---NPNAFVAKLARLFRNA
          ||||||||||||||||||||||||||||||||||||||||   ||||||||||||||||
m957      MFKKFKPVLLSFFALVFAFWLGTGIAYEINPRWFLSDTATEVPKNPNAFVAKLARLFRNA
                 10        20        30        40        50        60

60        70        80        90       100       110
a957.pep  DRAVVIVKESMRTEESLAGAVDDGPLQSEKDYLALAVRLSRLKEKAKWFPHVTEQEHGEEV
          ||||||||||:||||:|||:||||||||||||||||:|||||||||||||||||||:||
m957      DRAVVIVKESIRTEENLAGTVDDGPLQSEKDYLALAIRLSRLKEKAKWFPHVTEQEHGKEV
                 70        80        90       100       110       120

120       130       140       150       160       170
a957.pep  WLDYYIGEGGLVAVSLSQRSPEAFVNAEYLYRNDRPFSVNVYGGTVHGENYETTGEYRVV
          ||||:|||||||||||||||||||||||||||||||||||||||||||||||||||||
m957      WLDYHIGEGGLVAVSLSQRSPEAFVNAEYLYRNDRPFSVNVYGGTVHGENYETTGEYRVV
                130       140       150       160       170       180

180       190       200       210       220       230
a957.pep  WQPDGSVFDASGRGKIGEDVYEHCLGCYQMAQVYLAKYRDVANDEQKVWDFREESNRIAS
          ||||||||||:|||||||||||||||||||||||||||||||||||||||||:||||||
m957      WQPDGSVFDAAGRGKIGEDVYEHCLGCYQMAQVYLAKYRDVANDEQKVWDFRKESNRIAS
                190       200       210       220       230       240

240       250       260       270       280       290
a957.pep  DSRDSVFYQNMRELMPRGMKANSLVVGYDADGLPQKVYWSFDNGKKRQSFEYYLKNGNLF
          |||:||||||||||||||||||||||||||||||||||||||||||||||||||||||
m957      DSRNSVFYQNMRELMPRGMKANSLVVGYDADGLPQKVYWSFDNGKKRQSFEYYLKNGNLF
                250       260       270       280       290       300

300       310       320       330       340       350
a957.pep  IAQSSTVALKADGVTADMQTYHAQQTWYLDGGRIVREEKQGDRLPDFPLNLEDLEKEVSR
          ||||||||||||||||||||||||||||||||||||||||||||||||||||:|||||  |
m957      IAQSSTVALKADGVTADMQTYHAQQTWYLDGGRIVREEKQGDRLPDFPLNLENLEKEVRR
                310       320       330       340       350       360

360       370
a957.pep  YAEAAARRSGGRRDLSHX
          ||||||||||||||||||
m957      YAEAAARRSGGRRDLSHX
                370
```

The following partial DNA sequence was identified in *N. gonorrhoeae* <SEQ ID 2929>:

```
g958.seq
   1  TTGGCTCGTT TATTTTCACT CAAACCACTG GTGCTGGCAT TGGGCTTCTG

51  TTTCGGCACG CATTGCGCCG CCGATACCGT TGCGGCGGAA GAGGCGGACG

101  GGCGTGTCGC AGAAGGCGGT GCGCAGGGCG CGTCCGAATC CGCACAAGCT

151  TCCGATTTGA CCCTCGGTTC GACCTGCCTG TTTTGCAGTA ACGAAAGCGG

201  CAGCCCCGAG AGAACCGAAG CCGCCGTCCA AGGCAGCGGC GAAGCATCCG

251  TCCCCGAAGA CTATACGCGC ATTGTTGCCG ACAGGATGGA AGGACAGTCG

301  AAGGTTAAGG TGCGCGCGGA AGGAAGCGTT ATCATCGAAC GGGACGGCGC

351  AGTCCTCAAT ACCGATTGGG CGGATTACGA CCAGTCGGGC GACACCGTTA

401  CCGTAGGCGA CCGGTTCGCC CTCCAACAGG ACGGTACGCT GATTCGGGGC

451  GAAACCCTGA CCTACAATCT CGATCAGCAG ACCGGCGAAG CGCACAACGT

501  CCGTATGGAA ACCGAACAAG GCGGACGGCG GCTGCAAAGC GTCAGCCGCA

551  CCGCCGAAAT GTTGGGCGAA GGGCGTTACA AACTGACGGA AACCCAATTC

601  AACACCTGTT CCGCCGGAGA TGCCGGCTGG TATGTCAAGG CCGCCTCTGT

651  CGAAGCCGAT CGGGGAAAAG GCATAGGCGT TGCCAAACAC GCCGCCTTCG

701  TGTTCGGCGG CGTTCCCCTT TTCTATACGC CTTGGGCGGA CTTCCCGCTT
```

```
 751 GACGGCAACC GCAAAAGCGG ACTGCTCGTC CCGTCCGTAT CTGCCGGTTC

801 GGACGGCGTT TCCCTTTCCG TCCCCTATTA TTTCAACCTT GCCCCCAACT

851 TCGATGCCAC TTTCGCCCCC GGCATTATCG GCGAACGCGG CGCGACGTTT

901 GACGGACAAA TCCGTTACCT GCGTCCCGAT TACAGCGGAC AGACCGACCT

951 GACCTGGTTG CCGCACGATA AGAAAAGCGG CAGGAACAAC CGCTATCAGG

1001 CAAAATGGCA GCACCGGCAC GACATTTCCG ACACGCTTCA GGCGGGTGTC

1051 GATTTCAACC AAGTCTCCGA CAGCGGCTAC TACCGCGACT TTTACGGCGG

1101 CGAAGAAATC GCCGGCAACG TCAACCTCAA CCGCCGCGTA TGGCTGGATT

1151 ATGGCGGCAG GGCGGCGGGA GGCAGCCTGA ATGCCGGCCT TTCGGTTCAG

1201 AAATACCAGA CGCTGGCAAA CCAAAGCGGC TACAAAGACG AACCTTACGC

1251 CATCATGCCC CGCCTTTCTG CCGATTGGCA TAAAAACGCA GGCAGGGCGC

1301 AAATCGGCGT GTCCGCACAA TTTACCCGCT TCAGCCACGA CGGCCGCCAA

1351 GACGGCAGCC GACTGGTCGT GTATCCCGGT ATCAAATGGG ATTTCAGCAA

1401 CAGCTGGGGC TACGTCCGCC CCAAACTCGG GCTGCACGCC ACTTATTACA

1451 GCCTCGACAG TTTCGGCGGC AAAGCATCCC GCAGCGTCGG GCGCGTTTTG

1501 CCCGTTGTCA ATATCGACGG CGGCACAACC TTCGAACGCA ATACGCGCCT

1551 GTTCGGCGGC GGAGTCGTGC AAACCATCGA GCCGCGCCTG TTCTACAACT

1601 ATATTCCTGC CAAATCTCAA AACGACCTGC CCAATTTCGA TTCGTCGGAA

1651 AGCAGCTTCG GCTACGGGCA GCTTTTCCGC GAAAACCTCT ATTACGGCAA

1701 CGACCGCATC AACGCCGCCA ACAGCCTTTC CACCGCCGTG CAGAGCCGTA

1751 TTTTGGACGG CGCGACGGGG GAGGAGCGTT TCCGCGCCGG TATCGGTCAG

1801 AAATTCTATT TCAAGGATGA TGCGGTGATG CTTGACGGCA GCGTCGGCAA

1851 AAATCCGCGC AGCCGTTCCG ACTGGGTGGC ATTCGCCTCC GGCGGCATAG

1901 GCGGGCGTTT CACCCTCGAC AGCAGCATCC ACTACAACCA AAACGACAAA

1951 CGCGCCGAAC ATTACGCCGT CGGCGCAGGC TACCGCCCCG CCCCCGGAAA

2001 AGTGTTGAAC GCCCGCTACA AATACGGGCG CAACGAAAAA ATCTACCTGC

2051 AGGCGGACGG TTCCTATTTT TACGACAAAC TCAGCCAGCT CGACCTGTCC

2101 GCACAATGGC CGCTGACGCG CAACCTGTCT GCCGTCGTCC GCTACAACTA

2151 CGGTTTTGAA GCCAAAAAAC CGATAGAAAT GCTTGCCGGT GCAGAATACA

2201 AAAGCAGTTG CGGCTGCTGG GGCGCGGGCG TGTACGCCCA ACGCTACGTT

2251 ACCGGCGAAA ACACCTACAA AAACGCCGTC TTTTTTTCAC TTCAGTTGAA

2301 AGACCTCAGC AGCGTCGGCA GAAACCCCGC AGGCAGGATG GATGTCGCCG

2351 TTCCCGGCTA CATCCCCGCC CACTCTCTTT CCGCCGGACG CAACAAACGG

2401 CCCTGA
```

This corresponds to the amino acid sequence <SEQ ID 2930; ORF 958.ng>:

```
g958.pep
  1 LARLFSLKPL VLALGFCFGT HCAADTVAAE EADGRVAEGG AQGASESAQA

51 SDLTLGSTCL FCSNESGSPE RTEAAVQGSG EASVPEDYTR IVADRMEGQS

101 KVKVRAEGSV IIERDGAVLN TDWADYDQSG DTVTVGDRFA LQQDGTLIRG
```

```
151 ETLTYNLDQQ TGEAHNVRME TEQGGRRLQS VSRTAEMLGE GRYKLTETQF

201 NTCSAGDAGW YVKAASVEAD RGKGIGVAKH AAFVFGGVPL FYTPWADFPL

251 DGNRKSGLLV PSVSAGSDGV SLSVPYYFNL APNFDATFAP GIIGERGATF

301 DGQIRYLRPD YSGQTDLTWL PHDKKSGRNN RYQAKWQHRH DISDTLQAGV

351 DFNQVSDSGY YRDFYGGEEI AGNVNLNRRV WLDYGGRAAG GSLNAGLSVQ

401 KYQTLANQSG YKDEPYAIMP RLSADWHKNA GRAQIGVSAQ FTRFSHDGRQ

451 DGSRLVVYPG IKWDFSNSWG YVRPKLGLHA TYYSLDSFGG KASRSVGRVL

501 PVVNIDGGTT FERNTRLFGG GVVQTIEPRL FYNYIPAKSQ NDLPNFDSSE

551 SSFGYGQLFR ENLYYGNDRI NAANSLSTAV QSRILDGATG EERFRAGIGQ

601 KFYFKDDAVM LDGSVGKNPR SRSDWVAFAS GGIGGRFTLD SSIHYNQNDK

651 RAEHYAVGAG YRPAPGKVLN ARYKYGRNEK IYLQADGSYF YDKLSQLDLS

701 AQWPLTRNLS AVVRYNYGFE AKKPIEMLAG AEYKSSCGCW GAGVYAQRYV

751 TGENTYKNAV FFSLQLKDLS SVGRNPAGRM DVAVPGYIPA HSLSAGRNKR

801 P*
```

The following partial DNA sequence was identified in *N. meningitidis* <SEQ ID 2931>:

```
m958.seq
   1 TTGGCTCGTT TATTTTCACT CAAACCACTG GTGCTGGCAT TGGGCCTCTG

51 CTTCGGCACG CATTGCGCCG CCGCCGATGC CGTTGCGGCG GAGGAAACGG

101 ACAATCCGAC CGCCGGAGAA AGCGTTCGGA GCGTGTCCGA ACCCATACAG

151 CCTACCAGCC TGAGCCTCGG TTCGACCTGC CTGTTTTGCA GTAACGAAAG

201 CGGCAGCCCC GAGAGAACCG AAGCCGCCGT CCAAGGCAGC GGCGAAGCAT

251 CCATCCCCGA AGACTATACG CGCATTGTTG CCGACAGGAT GGAAGGACAG

301 TCGCAGGTGC AGGTGCGTGC CGAAGGCAAC GTCGTCGTCG AACGCAACCG

351 GACGACCCTC AATACCGATT GGGCGGATTA CGACCAGTCG GGCGACACCG

401 TTACCGCAGG CGACCGGTTC GCCCTCCAAC AGGACGGTAC GCTGATTCGG

451 GGCGAAACCC TGACCTACAA TCTCGAGCAG CAGACCGGGG AAGCGCACAA

501 CGTCCGCATG GAAATCGAAC AAGGCGGACG GCGGCTGCAA AGCGTCAGCC

551 GCACCGCCGA AATGTTGGGC GAAGGGCATT ACAAACTGAC GGAAACCCAA

601 TTCAACACCT GTTCCGCCGG CGATGCCGGC TGGTATGTCA AGGCAGCCTC

651 TGTCGAAGCC GATCGGGAAA AAGGCATAGG CGTTGCCAAA CACGCCGCCT

701 TCGTGTTCGG CGGCGTTCCC ATTTTCTACA CCCCTTGGGC GGACTTCCCG

751 CTTGACGGCA ACCGCAAAAG CGGCCTGCTT GTTCCCTCAC TGTCCGCCGG

801 TTCGGACGGC GTTTCCCTTT CCGTTCCCTA TTATTTCAAC CTTGCCCCCA

851 ATCTCGATGC CACGTTCGCG CCCAGCGTGA TCGGCGAACG CGGCGCGGTC

901 TTTGACGGGC AGGTACGCTA CCTGCGGCCG GATTATGCCG GCCAGTCCGA

951 CCTGACCTGG CTGCCGCACG ACAAGAAAAG CGGCAGGAAT AACCGCTATC

1001 AGGCGAAATG GCAGCATCGG CACGACATTT CCGACACGCT TCAGGCGGGT

1051 GTCGATTTCA ACCAAGTCTC CGACAGCGGC TACTACCGCG ACTTTTACGG

1101 CAACAAAGAA ATCGCCGGCA ACGTCAACCT CAACCGCCGT GTATGGCTGG
```

-continued

```
1151 ATTATGGCGG CAGGGCGGCG GGCGGCAGCC TGAATGCCGG CCTTTCGGTT

1201 CTGAAATACC AGACGCTGGC AAACCAAAGC GGCTACAAAG ACAAACCGTA

1251 TGCCCTCATG CCGCGCCTTT CGGTCGAGTG GCGTAAAAAC ACCGGCAGGG

1301 CGCAAATCGG CGTGTCCGCA CAATTTACCC GATTCAGCCA CGACAGCCGC

1351 CAAGACGGCA GCCGCCTGGT CGTCTATCCC GACATCAAAT GGGATTTCAG

1401 CAACAGCTGG GGCTATGTCC GTCCCAAACT CGGACTGCAC GCCACCTATT

1451 ACAGCCTCAA CCGCTTCGGC AGCCAAGAAG CCCGACGCGT CAGCCGCACT

1501 CTGCCCATTG TCAACATCGA CAGCGGCGCA ACTTTTGAGC GGAATACGCG

1551 GATGTTCGGC GGAGAAGTCC TGCAAACCCT CGAGCCGCGC CTGTTCTACA

1601 ACTATATTCC TGCCAAATCC CAAAACGACC TGCCCAATTT CGATTCGTCG

1651 GAAAGCAGCT TCGGCTACGG GCAGCTCTTT CGCGAAAACC TCTATTACGG

1701 CAACGACAGG ATTAACACCG CAAACAGCCT TTCCGCCGCC GTGCAAAGCC

1751 GTATTTTGGA CGGCGCGACG GGGGAAGAGC GTTTCCGCGC CGGCATCGGT

1801 CAGAAATTCT ATTTCAAGGA TGATGCGGTG ATGCTTGACG GCAGCGTCGG

1851 CAAAAAACCG CGCAACCGTT CCGACTGGGT GGCATTTGCC TCCGGCAGCA

1901 TCGGCAGCCG CTTCATCCTC GACAGCAGCA TCCACTACAA CCAAAACGAC

1951 AAACGCGCCG AGAACTACGC CGTCGGTGCA AGCTACCGTC CCGCACAGGG

2001 CAAAGTGCTG AACGCCCGCT ACAAATACGG GCGCAACGAA AAAATCTACC

2051 TGAAGTCCGA CGGTTCCTAT TTTTACGACA AACTCAGCCA GCTCGACCTG

2101 TCCGCACAAT GGCCGCTGAC GCGCAACCTG TCGGCCGTCG TCCGTTACAA

2151 CTACGGTTTT GAAGCCAAAA AACCGATAGA GGTGCTGGCG GGTGCGGAAT

2201 ACAAAAGCAG TTGCGGCTGC TGGGGCGCGG GCGTGTACGC CCAACGCTAC

2251 GTTACCGGCG AAAACACCTA CAAAAACGCT GTCTTTTTCT CACTTCAGTT

2301 GAAAGACCTC AGCAGTGTCG GCAGAAACCC CGCAGACAGG ATGGATGTCG

2351 CCGTTCCCGG CTATATCACC GCCCACTCTC TTTCCGCCGG ACGCAACAAA

2401 CGACCCTGA
```

This corresponds to the amino acid sequence <SEQ ID NO: 2932; ORF 958>:

```
m958.pep
  1 LARLFSLKPL VLALGLCFGT HCAAADAVAA EETDNPTAGE SVRSVSEPIQ

51 PTSLSLGSTC LFCSNESGSP ERTEAAVQGS GEASIPEDYT RIVADRMEGQ

101 SQVQVRAEGN VVVERNRTTL NTDWADYDQS GDTVTAGDRF ALQQDGTLIR

151 GETLTYNLEQ QTGEAHNVRM EIEQGGRRLQ SVSRTAEMLG EGHYKLTETQ

201 FNTCSAGDAG WYVKAASVEA DREKGIGVAK HAAFVFGGVP IFYTPWADFP

251 LDGNRKSGLL VPSLSAGSDG VSLSVPYYFN LAPNLDATFA PSVIGERGAV

301 FDGQVRYLRP DYAGQSDLTW LPHDKKSGRN NRYQAKWQHR HDISDTLQAG

351 VDFNQVSDSG YYRDFYGNKE IAGNVNLNRR VWLDYGGRAA GGSLNAGLSV

401 LKYQTLANQS GYKDKPYALM PRLSVEWRKN TGRAQIGVSA QFTRFSHDSR

451 QDGSRLVVYP DIKWDFSNSW GYVRPKLGLH ATYYSLNRFG SQEARRVSRT

501 LPIVNIDSGA TFERNTRMFG GEVLQTLEPR LFYNYIPAKS QNDLPNFDSS
```

-continued

```
551 ESSFGYGQLF RENLYYGNDR INTANSLSAA VQSRILDGAT GEERFRAGIG

601 QKFYFKDDAV MLDGSVGKKP RNRSDWVAFA SGSIGSRFIL DSSIHYNQND

651 KRAENYAVGA SYRPAQGKVL NARYKYGRNE KIYLKSDGSY FYDKLSQLDL

701 SAQWPLTRNL SAVVRYNYGF EAKKPIEVLA GAEYKSSCGC WGAGVYAQRY

751 VTGENTYKNA VFFSLQLKDL SSVGRNPADR MDVAVPGYIT AHSLSAGRNK

801 RP*
```

Computer analysis of this amino acid sequence gave the following results:

Homology with a Predicted ORF from *N. gonorrhoeae*    15

ORF 958 shows 89.3% identity over a 802 aa overlap with a predicted ORF (ORF 958) from *N. gonorrhoeae*

```
   m958/g958  89.3% identity in 802 aa overlap 10        20        30        40        50        60
   m958.pep  LARLFSLKPLVLALGLCFGTHCAAADAVAAEETDNPTAGESVRSVSEPIQPTSLSLGSTC
             ||||||||||||:||||||| |:||||:|: :| ::::::||  | ::|:|||||
   g958      LARLFSLKPLVLALGFCFGTHCAA-DTVAAEEADGRVAEGGAQGASESAQASDLTLGSTC
                 10        20        30         40        50

70        80        90       100       110       120
   m958.pep  LFCSNESGSPERTEAAVQGSGEASIPEDYTRIVADRMEGQSQVQVRAEGNVVVERNRTTL
             ||||||||||||||||||||||||:||||||||||||||||:|:||||:|::||: ::|
   g958      LFCSNESGSPERTEAAVQGSGEASVPEDYTRIVADRMEGQSKVKVRAEGSVIIERDGAVL
             60        70        80        90       100       110

130       140       150       160       170       180
   m958.pep  NTDWADYDQSGDTVTAGDRFALQQDGTLIRGETLTYNLEQQTGEAHNVRMEIEQGGRRLQ
             ||||||||||||||:|||||||||||||||||||||||:||||||||||||| ||||||
   g958      NTDWADYDQSGDTVTVGDRFALQQDGTLIRGETLTYNLDQQTGEAHNVRMEIEQGGRRLQ
             120       130       140       150       160       170

190       200       210       220       230       240
   m958.pep  SVSRTAEMLGEGHYKLTETQFNTCSAGDAGWYVKAASVEADREKGIGVAKHAAFVFGGVP
             ||||||||||||:|||||||||||||||||||||||||||||:|||||||||||||||
   g958      SVSRTAEMLGEGRYKLTETQFNTCSAGDAGWYVKAASVEADRGKGIGVAKHAAFVFGGVP
             180       190       200       210       220       230

250       260       270       280       290       300
   m958.pep  IFYTPWADFPLDGNRKSGLLVPSLSAGSDGVSLSVPYYFNLAPNLDATFAPSVIGERGAV
             :|||||||||||||||||||||:|||||||||||||||||||||:||||:||::||||:
   g958      LFYTPWADFPLDGNRKSGLLVPSVSAGSDGVSLSVPYYFNLAPNFDATFAPGIIGERGAT
             240       250       260       270       280       290

310       320       330       340       350       360
   m958.pep  FDGQVRYLRPDYAGQSDLTWLPHDKKSGRNNRYQAKWQHRHDISDTLQAGVDFNQVSDSG
             ||||:||||||||:||:|||||||||||||||||||||||||||||||||||||||||
   g958      FDGQIRYLRPDYSGQTDLTWLPHDKKSGRNNRYQAKWQHRHDISDTLQAGVDFNQVSDSG
             300       310       320       330       340       350

370       380       390       400       410       420
   m958.pep  YYRDFYGNKEIAGNVNLNRRVWLDYGGRAAGGSLNAGLSVLKYQTLANQSGYKDKPYALM
             ||||||::|||||||||||||||||||||||||||||||| |||||||||||||:|||:|
   g958      YYRDFYGEEIAGNVNLNRRVWLDYGGRAAGGSLNAGLSVQKYQTLANQSGYKDEPYAIM
             360       370       380       390       400       410

430       440       450       460       470       480
   m958.pep  PRLSVEWRKNTGRAQIGVSAQFTRFSHDSRQDGSRLVVYPDIKWDFSNSWGYVRPKLGLH
             ||||::|:||:|||||||||||||||:|||||||||||| ||||||||||||||||||
   g958      PRLSADWHKNAGRAQIGVSAQFTRFSHDGRQDGSRLVVYPGIKWDFSNSWGYVRPKLGLH
             420       430       440       450       460       470

490       500       510       520       530       540
   m958.pep  ATYYSLNRFGSQEARRVSRTLPIVNIDSGATFERNTRMFGGEVLQTLEPRLFYNYIPAKS
             ||||||: ||::  :| |:|:||:|||||:|||||||:||:::||:|||||||||||
   g958      ATYYSLDSFGGKASRSVGRVLPVVNIDGGTTFERNTRLFGGGVVQTIEPRLFYNYIPAKS
             480       490       500       510       520       530

550       560       570       580       590       600
   m958.pep  QNDLPNFDSSESSFGYGQLFRENLYYGNDRINTANSLSAAVQSRILDGATGEERFRAGIG
             |||||||||||||||||||||||||||||||:||||:|||||||||||||||||||||
   g958      QNDLPNFDSSESSFGYGQLFRENLYYGNDRINAANSLSTAVQSRILDGATGEERFRAGIG
             540       550       560       570       580       590

610       620       630       640       650       660
   m958.pep  QKFYFKDDAVMLDGSVGKKPRNRSDWVAFASGSIGSRFILDSSIHYNQNDKRAENYAVGA
             |||||||||||||||:||:|||||||||||:|||||:|||||||||||||||||||||
   g958      QKFYFKDDAVMLDGSVGKNPRSRSDWVAFASGGIGGRFTLDSSIHYNQNDKRAENYAVGA
             600       610       620       630       640       650
```

```
                     670        680        690        700        710        720
m958.pep   SYRPAQGKVLNARYKYGRNEKIYLKSDGSYFYDKLSQLDLSAQWPLTRNLSAVVRYNYGF
           :||||  |||||||||||||||||||::|||||||||||||||||||||||||||||||
g958       GYRPAPGKVLNARYKYGRNEKIYLQADGSYFYDKLSQLDLSAQWPLTRNLSAVVRYNYGF
           660        670        680        690        700        710

730        740        750        760        770        780
m958.pep   EAKKPIEVLAGAEYKSSCGCWGAGVYAQRYVTGENTYKNAVFFSLQLKDLSSVGRNPADR
           |||||||:||||||||||||||||||||||||||||||||||||||||||||||||||| |
g958       EAKKPIEMLAGAEYKSSCGCWGAGVYAQRYVTGENTYKNAVFFSLQLKDLSSVGRNPAGR
           720        730        740        750        760        770

790        800
m958.pep   MDVAVPGYITAHSLSAGRNKRP
           ||||||||| ||||||||||||
g958       MDVAVPGYIPAHSLSAGRNKRPX
           780        790        800
```

The following partial DNA sequence was identified in *N. meningitidis* <SEQ ID 2933>:

```
a958.seq
    1  TTGGCTCGTT TATTTTCACT CAAACCACTG GTGCTGGCAT TGGGCTTCTG
   51  TTTCGGCACG CATTGCGCCG CCGCCGATGC CGTTGCGGCG GAGGAAACGG
  101  ACAATCCGAC CGCCGGAGGA AGCGTTCGGA GCGTGTCCGA ACCCATACAG
  151  CCTACCAGCC TGAGCCTCGG TTCGACCTGC CTGTTTTGCA GTAACGAAAG
  201  CGGCAGCCCC GAGAGAACCG AAGCCGCCGT CCAAGGCAGC GGCGAAGCAT
  251  CCATCCCCGA AGACTATACG CGCATTGTTG CCGACAGGAT GGAAGGACAG
  301  TCGCAGGTGC AGGTGCGTGC CGAAGGCAAC GTCGTCGTCG AACGCAATCG
  351  GACGACCCTC AATGCCGATT GGGCGGATTA CGACCAGTCG GGCGACACCG
  401  TTACCGCAGG CGACCGGTTC GCCCTCCAAC AGGACGGTAC GCTGATTCGG
  451  GGCGAAACCC TGACCTACAA TCTCGAGCAG CAGACCGGGG AAGCGCACAA
  501  CGTCCGTATG GAAACCGAAC ACGGCGGACG GCGGCTGCAA AGCGTCAGCC
  551  GCACCGCCGA AATGTTGGGC GAAGGGCATT ACAAACTGAC GGAAACCCAA
  601  TTCAACACCT GTTCCGCCGG CGATGCCGGC TGGTATGTCA AGGCCGCTTC
  651  CGTCGAAGCC GATCGGGAAA AAGGCATAGG CGTTGCCAAA CACGCCGCCT
  701  TCGTGTTCGG CGGCGTTCCC ATTTTCTACA CCCCTTGGGC GGACTTCCCG
  751  CTTGACGGCA ACCGCAAAAG CGGCCTGCTC GTTCCCTCAC TGTCCGCCGG
  801  TTCGGACGGC GTTTCCCTTT CCGTTCCCTA TTATTTCAAC CTTGCCCCCA
  851  ATCTCGATGC CACGTTCGCG CCCGGCGTGA TCGGCGAACG CGGCGCGGTC
  901  TTTGACGGGC AGGTACGCTA CCTGCGGCCG GATTATGCCG GCCAGTCCGA
  951  CCTGACCTGG CTGCCGCACG ACAAGAAAAG CGGCAGGAAT AACCGCTATC
 1001  AGGCGAAATG GCAGCACCGG CACGACATTT CCGACACGCT TCAGGCGGGT
 1051  GTCGATTTCA ACCAAGTCTC CGACAGCGGC TACTACCGCG ACTTTTACGG
 1101  CAACAAAGAA ATCGCCGGCA ACGTCAACCT CAACCGCCGT GTATGGCTGG
 1151  ATTATGGCGG CAGGGCGGCG GGCGGCAGCC TGAATGCCGG CCTTTCGGTT
 1201  CTGAAATACC AGACGCTGGC AAACCAAAGC GGCTACAAAG ACAAACCGTA
 1251  TGCCCTGATG CCGCGCCTTT CCGCCGATTG GCGCAAAAAC ACCGGCAGGG
 1301  CGCAAATCGG CGTGTCCGCC CAATTTACCC GCTTCAGCCA CGACAGCCGC
 1351  CAAGACGGCA GCCGCCTCGT CGTCTATCCC GACATCAAAT GGGATTTCAG
 1401  CAACAGCTGG GGTTACGTCC GTCCCAAACT CGGACTGCAC GCCACCTATT
```

-continued

```
1451 ACAGCCTCAA CCGCTTCGGC AGCCAAGAAG CCCGACGCGT CAGCCGCACT

1501 CTGCCCATCG TCAACATCGA CAGCGGCATG ACCTTCGAAC GCAATACGCG

1551 GATGTTCGGC GGCGGAGTCC TGCAAACCCT CGAGCCGCGC CTGTTCTACA

1601 ACTATATTCC TGCCAAATCC CAAAACGACC TGCCCAATTT CGATTCGTCG

1651 GAAAGCAGCT TCGGCTACGG GCAGCTTTTT CGTGAAAACC TCTATTACGG

1701 CAACGACAGG ATTAACACCG CAAACAGCCT TTCCGCCGCC GTGCAAAGCC

1751 GTATTTTGGA CGGCGCGACG GGGGAAGAGC GTTTCCGCGC CGGCATCGGG

1801 CAGAAATTCT ACTTCAAAAA CGACGCAGTC ATGCTTGACG GCAGTGTCGG

1851 CAAAAAACCG CGCAGCCGTT CCGACTGGGT GGCATTCGCC TCCAGCGGCA

1901 TCGGCAGCCG CTTCATCCTC GACAGCAGCA TCCACTACAA CCAAAACGAC

1951 AAACGCGCCG AGAACTACGC CGTCGGTGCA AGCTACCGTC CCGCACAGGG

2001 CAAAGTGCTG AACGCCCGCT ACAAATACGG GCGCAACGAA AAAATCTACC

2051 TGAAGTCCGA CGGTTCCTAT TTTTACGACA AACTCAGCCA GCTCGACCTG

2101 TCCGCACAAT GGCCGCTGAC GCGCAACCTG TCGGCCGTCG TCCGTTACAA

2151 CTACGGTTTT GAAGCCAAAA AACCGATAGA GGTGCTGGCG GGTGCGGAAT

2201 ACAAAAGCAG TTGCGGCTGC TGGGGCGCGG GCGTGTACGC CCAACGCTAC

2251 GTTACCGGCG AAAACACCTA CAAAAACGCT GTCTTTTTCT CACTTCAGTT

2301 GAAAGACCTC AGCAGTGTCG GCAGAAACCC CGCAGACAGG ATGGATGTCG

2351 CCGTTCCCGG CTATATCCCC GCCCACTCTC TTTCCGCCGG ACGCAACAAA

2401 CGGCCCTGA
```

This corresponds to the amino acid sequence <SEQ ID 2934; ORF 958.a>:

```
a958.pep
  1 LARLFSLKPL VLALGFCFGT HCAAADAVAA EETDNPTAGG SVRSVSEPIQ

51 PTSLSLGSTC LFCSNESGSP ERTEAAVQGS GEASIPEDYT RIVADRMEGQ

101 SQVQVRAEGN VVVERNRTTL NADWADYDQS GDTVTAGDRF ALQQDGTLIR

151 GETLTYNLEQ QTGEAHNVRM ETEHGGRRLQ SVSRTAEMLG EGHYKLTETQ

201 FNTCSAGDAG WYVKAASVEA DREKGIGVAK HAAFVFGGVP IFYTPWADFP

251 LDGNRKSGLL VPSLSAGSDG VSLSVPYYFN LAPNLDATFA PGVIGERGAV

301 FDGQVRYLRP DYAGQSDLTW LPHDKKSGRN NRYQAKWQHR HDISDTLQAG

351 VDFNQVSDSG YYRDFYGNKE IAGNVNLNRR VWLDYGGRAA GGSLNAGLSV

401 LKYQTLANQS GYKDKPYALM PRLSADWRKN TGRAQIGVSA QFTRFSHDSR

451 QDGSRLVVYP DIKWDFSNSW GYVRPKLGLH ATYYSLNRFG SQEARRVSRT

501 LPIVNIDSGM TFERNTRMFG GGVLQTLEPR LFYNYIPAKS QNDLPNFDSS

551 ESSFGYGQLF RENLYYGNDR INTANSLSAA VQSRILDGAT GEERFRAGIG

601 QKFYFKNDAV MLDGSVGKKP RSRSDWVAFA SSGIGSRFIL DSSIHYNQND

651 KRAENYAVGA SYRPAQGKVL NARYKYGRNE KIYLKSDGSY FYDKLSQLDL

701 SAQWPLTRNL SAVVRYNYGF EAKKPIEVLA GAEYKSSCGC WGAGVYAQRY

751 VTGENTYKNA VFFSLQLKDL SSVGRNPADR MDVAVPGYIP AHSLSAGRNK

801 RP*
```

Computer analysis of this amino acid sequence gave the following results:

Homology with a Predicted ORF from *N. meningitidis*
ORF 957 shows 96.3% identity over a 377 aa overlap with a predicted ORF (ORF 957) from *N. meningitidis*

```
a958/m958 98.1% identity in 802 aa overlap 10        20        30        40        50        60
a958.pep  LARLFSLKPLVLALGFCFGTHCAAADAVAAEETDNPTAGGSVRSVSEPIQPTSLSLGSTC
          ||||||||||||||| :|||||||||||||||||||||| ||||||||||||||||||||
m958      LARLFSLKPLVLALGLCFGTHCAAADAVAAEETDNPTAGESVRSVSEPIQPTSLSLGSTC
                  10        20        30        40        50        60

70        80        90       100       110       120
a958.pep  LFCSNESGSPERTEAAVQGSGEASIPEDYTRIVADRMEGQSQVQVRAEGNVVVERNRTTL
          ||||||||||||||||||||||||||||||||||||||||||||||||||||||||||||
m958      LFCSNESGSPERTEAAVQGSGEASIPEDYTRIVADRMEGQSQVQVRAEGNVVVERNRTTL
                  70        80        90       100       110       120

130       140       150       160       170       180
a958.pep  NADWADYDQSGDTVTAGDRFALQQDGTLIRGETLTYNLEQQTGEAHNVRMETEHGGRRLQ
          | :|||||||||||||||||||||||||||||||||||||||||||||||| : ||||||
m958      NTDWADYDQSGDTVTAGDRFALQQDGTLIRGETLTYNLEQQTGEAHNVRMEIEQGGRRLQ
                 130       140       150       160       170       180

190       200       210       220       230       240
a958.pep  SVSRTAEMLGEGHYKLTETQFNTCSAGDAGWYVKAASVEADREKGIGVAKHAAFVFGGVP
          ||||||||||||||||||||||||||||||||||||||||||||||||||||||||||||
m958      SVSRTAEMLGEGHYKLTETQFNTCSAGDAGWYVKAASVEADREKGIGVAKHAAFVFGGVP
                 190       200       210       220       230       240

250       260       270       280       290       300
a958.pep  IFYTPWADFPLDGNRKSGLLVPSLSAGSDGVSLSVPYYFNLAPNLDATFAPGVIGERGAV
          |||||||||||||||||||||||||||||||||||||||||||||||||||:||||||||
m958      IFYTPWADFPLDGNRKSGLLVPSLSAGSDGVSLSVPYYFNLAPNLDATFAPSVIGERGAV
                 250       260       270       280       290       300

310       320       330       340       350       360
a958.pep  FDGQVRYLRPDYAGQSDLTWLPHDKKSGRNNRYQAKWQHRHDISDTLQAGVDFNQVSDSG
          ||||||||||||||||||||||||||||||||||||||||||||||||||||||||||||
m958      FDGQVRYLRPDYAGQSDLTWLPHDKKSGRNNRYQAKWQHRHDISDTLQAGVDFNQVSDSG
                 310       320       330       340       350       360

370       380       390       400       410       420
a958.pep  YYRDFYGNKEIAGNVNLNRRVWLDYGGRAAGGSLNAGLSVLKYQTLANQSGYKDKPYALM
          ||||||| ||||||||||||||||||||||||||||||||||||||||||||||||||||
m958      YYRDFYGMKEIAGNVNLNRRVWLDYGGRAAGGSLNAGLSVLKYQTLANQSGYKDKPYALM
                 370       380       390       400       410       420

430       440       450       460       470       480
a958.pep  PRLSADWRKNTGRAQIGVSAQFTRFSHDSRQDGSRLVVYPDIKWDFSNSWGYVRPKLGLH
          ||||::||||||||||||||||||||||||:|||||||||||||||||||||||||||||
m958      PRLSVEWRKNTGRAQIGVSAQFTRFSHDGRQDGSRLVVYPDIKWDFSNSWGYVRPKLGLH
                 430       440       450       460       470       480

490       500       510       520       530       540
a958.pep  ATYYSLNRFGSQEARRVSRTLPIVNIDSGMTFERNTRMFGGGVLQTLEPRLFYNYIPAKS
          |||||||||||||||||||||||||||||| |||||||||| ||||||||||||||||||
m958      ATYYSLNRFGSQEARRVSRTLPIVNIDSGATFERNTRMFGGEVLQTLEPRLFYNYIPAKS
                 490       500       510       520       530       540

550       560       570       580       590       600
a958.pep  QNDLPNFDSSESSFGYGQLFRENLYYGNDRINTANSLSAAVQSRILDGATGEERFRAGIG
          ||||||||||||||||||||||||||||||||||||||||||||||||||||||||||||
m958      QNDLPNFDSSESSFGYGQLFRENLYYGNDRINTANSLSAAVQSRILDGATGEERFRAGIG
                 550       560       570       580       590       600

610       620       630       640       650       660
a958.pep  QKFYFKNDAVMLDGSVGKKPRSRSDWVAFASSGIGSRFILDSSIHYNQNDKRAENYAVGA
          ||||||:|||||||||||||:||||||||::|||||||||||||||||||||||||||||
m958      QKFYFKDDAVMLDGSVGKKPRNRSDWVAFASGSIGSRFILDSSIHYNQNDKRAENYAVGA
                 610       620       630       640       650       660

670       680       690       700       710       720
a958.pep  SYRPAQGKVLNARYKYGRNEKIYLKSDGSYFYDKLSQLDLSAQWPLTRNLSAVVRYNYGF
          ||||||||||||||||||||||||||||||||||||||||||||||||||||||||||||
m958      SYRPAQGKVLNARYKYGRNEKIYLKSDGSYFYDKLSQLDLSAQWPLTRNLSAVVRYNYGF
                 670       680       690       700       710       720

730       740       750       760       770       780
a958.pep  EAKKPIEVLAGAEYKSSCGCWGAGVYAQRYVTGENTYKNAVFFSLQLKDLSSVGRNPADR
          ||||||||||||||||||||||||||||||||||||||||||||||||||||||||||
m958      EAKKPIEVLAGAEYKSSCGCWGAGVYAQRYVTGENTYKNAVFFSLQLKDLSSVGRNPAGR
                 730       740       750       760       770       780

790       800
a958.pep  MDVAVPGYIPAHSLSAGRNKRPX
          ||||||||| ||||||||||||
m958      MDVAVPGYITAHSLSAGRNKRP
                 790       800
```

The following partial DNA sequence was identified in *N. gonorrhoeae* <SEQ ID 2935>:

```
g959.seq
    1 ATGAACATCA AACACCTTCT CTTGACCGCC GCCGCAACCG CACTGTTGGG

51 CATTTCCGCC CCCGCACTCG CCCACCACGA CGGACACGGC GATGACGACC

101 ACGGACACGC CGCACACCAA CACGGCAAAC AAGACAAAAT CATCAGCCGC

151 GCCCAAGCCG AAAAAGCGGC TTGGGCGCGT GTCGGCGGCA AAATCACCGA

201 CATCGATCTC GAACACGACG ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2936; ORF 959.ng>:

```
g959.pep
    1 MNIKHLLLTA AATALLGISA PALAHHDGHG DDDHGHAAHQ HGKQDKIISR

51 AQAEKAAWAR VGGKITDIDL EHDDGRPHYD VEIVKNGQEY KVVVDARTGR

101 VISSRRDD*
```

The following partial DNA sequence was identified in *N. meningitidis* <SEQ ID 2937>:

```
m959.seq
    1 ATGAACATCA AACACCTTCT CTTGACCTCC GCCGCAACCG CACTGCTGAG

51 CATTTCCGCC CCCGCGCTCG CCCACCACGA CGGACACGGC GATGACGACC

101 ACGGACACGC CGCACACCAA CACAACAAAC AAGACAAAAT CATCAGCCGC

151 GCCCAAGCCG AAAAAGCAGC GTTGGCGCGT GTCGGCGGCA AAATCACCGA

201 CATCGATCTC GAACACGACA ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2938; ORF 959>:

```
m959.pep
    1 MNIKHLLLTS AATALLSISA PALAHHDGHG DDDHGHAAHQ HNKQDKIISR

51 AQAEKAALAR VGGKITDIDL EHDNGRPHYD VEIVKNGQEY KVVVDARTGR

101 VISSRRDD*
```

Computer analysis of this amino acid sequence gave the following results:
Homology with a Predicted ORF from *N. gonorrhoeae*
ORF 959 shows 95.4% identity over a 108 aa overlap with a predicted ORF (ORF 959) from *N. gonorrhoeae*

```
    m959/g959   95.4% identity in 108 aa overlap 10        20        30        40        50        60
    m959.pep    MNIKHLLLTSAATALLSISAPALAHHDGHGDDDHGHAAHQHNKQDKIISRAQAEKAALAR
                ||||||||:||||||:||||||||||||||||||||||||:||||||||||||||||| ||
    g959        MNIKHLLLTAAATALLGISAPALAHHDGHGDDDHGHAAHQHGKQDKIISRAQAEKAAWAR
                         10        20        30        40        50        60

70        80        90       100       109
    m959.pep    VGGKITDIDLEHDNGRPHYDVEIVKNGQEYKVVVDARTGRVISSRRDDX
                ||||||||||||||:|||||||||||||||||||||||||||||||||
    g959        VGGKITDIDLEHDDGRPHYDVEIVKNGQEYKVVVDARTGRVISSRRDDX
                         70        80        90       100
```

The following partial DNA sequence was identified in *N. meningitidis* <SEQ ID 2939>:

```
a959.seq
   1 ATGAACTTCA AACGCCTTCT CTTGACCGCC GCCGCAACCG CACTGATGGG

51 CATTTCCGCC CCCGCACTCG CCCACCACGA CGGACACGGC GATGACGACC

101 ACGGACACGC CGCACACCAA CACAGCAAAC AAGACAAAAT CATCAGCCGC

151 GCCCAAGCCG AAAAAGCAGC GTTGGCGCGT GTCGGCGGCA AAATCACCGA

201 CATCGATCTC GAACACGACA ACGGCCGTCC GCACTATGAT GTCGAAATCG

251 TCAAAAACGG ACAGGAATAC AAAGTCGTTG TCGATGCCCG TACCGGCCGC

301 GTGATTTCCT CCCGCCGCGA CGACTGA
```

This corresponds to the amino acid sequence <SEQ ID 2940; ORF 959.a>:

```
a959.pep
   1 MNFKRLLLTA AATALMGISA PALAHHDGHG DDDHGHAAHQ HSKQDKIISR

51 AQAEKAALAR VGGKITDIDL EHDNGRPHYD VEIVKNGQEY KVVVDARTGR

101 VISSRRDD*
```

Computer analysis of this amino acid sequence gave the following results:
Homology with a Predicted ORF from *N. meningitidis*
ORF 959 shows 94.4% identity over a 108 aa overlap with a predicted ORF (ORF 959) from *N. meningitidis*

```
    a959/m959   94.4% identity in 108 aa overlap 10        20        30        40        50        60
    a959.pep    MNFKRLLLTAAATALMGISAPALAHHDGHGDDDHGHAAHQHSKQDKIISRAQAEKAALAR
                ||:|:||||:||||||::||||||||||||||||||||||:|||||||||||||||||
    m959        MNIKHLLLTSAATALLSISAPALAHHDGHGDDDHGHAAHQHNKQDKIISRAQAEKAALAR
                         10        20        30        40        50        60

70        80        90       100       109
    a959.pep    VGGKITDIDLEHDNGRPHYDVEIVKNGQEYKVVVDARTGRVISSRRDDX
                |||||||||||||||||||||||||||||||||||||||||||||||
    m959        VGGKITDIDLEHDNGRPHYDVEIVKNGQEYKVVVDARTGRVISSRRDDX
                         70        80        90       100 g960.seq not found yet g960.pep not found yet
```

The following partial DNA sequence was identified in *N. meningitidis* <SEQ ID 2941>:

```
m960.seq
   1 ATGCAAGTAA ATATTCAGAT TCCCTGTATG CTGTACAGAC GCGGGAGTGT
  51 TAAGCCCCCC TTGTTTGAAG CTCCGCGGCT CCTGCCGAGC TTCACCGACC
 101 CCGTTGTGCC CAAGCTCTCT GCTCCCGGCG GCTACATTGT CGACATCCCC
 151 AAAGGCAATC TGAAAACCGA AATCGAAAAG CTGGCCAAAC AGCCCGAGTA
 201 TGCCTATCTG AAACAGCTCC AAGTAGCGAA AAACGTCAAC TGGAACCAGG
 251 TGCAACTGGC TTACGATAAA TGGGACTATA AGCAGGAAGG CTTAACCAGA
 301 GCCGGTGCAG CGATTATCGC GCTGGCTGTT ACCGTGGTTA CTGCGGGCGC
 351 GGGAGTCGGA GCCGCACTAG GCTTAAACGG CGCAGCCGCA GCAGCGGCCG
 401 ATGCCGCCTT TGCCTCACTC GCTTCTCAGG CTTCCGTATC GCTCATCAAC
 451 AATAAAGGCG ATGTCGGCAA AACCCTGAAG GAACTGGGCA GAAGCCGCAC
 501 GGTAAAAAAT CTGGTTGTAG CGGCGGCAAC GGCAGGCGTA TCCAACAAAC
 551 TCGGTGCCTC TTCCCTTGCC ACTTGGAGCG AAACCCCTTG GGTAAACAAC
 601 CTCAACGTTA ACCTGGCCAA TGCGGGCAGT GCCGCGCTGA TCAACACCGC
 651 TGTTAACGGC GGCAGCCTGA AAGACAATCT GGAGGCAAAT ATCCTGGCGG
 701 CATTGGTGAA TACCGCGCAT GGGGAGGCGG CGAGTAAGAT CAAAGGACTG
 751 GATCAGCACT ATGTCGCCCA CAAAATCGCT CATGCCGTAG CGGGCTGTGC
 801 GGCTGCAGCG GCGAATAAGG GCAAATGTCA GGACGGCGCG ATCGGTGCGG
 851 CTGTGGGTGA GATTGTCGGG GAGGCTTTGG TTAAAAATAC CGATTTTAGC
 901 GATATGACCC CGGAACAATT AGATCTGGAA GTTAAGAAAA TTACCGCCTA
 951 TGCCAAACTT GCGGCAGGTA CAGTTGCAGG CGTAACGGGA GGAGATGTCA
1001 ATACTGCTGC ACAAACCGCA CAAAACGCGG TAGAAAATAA TGCGGTTAAA
1051 GCTGTTGTAA CTGCTGCAAA AGTGGTTTAT AAGGTAGCCA GAAAAGGATT
1101 AAAAAACGGG AAAATCAACG TTAGAGATTT AAAACAGACG TTGAAAGACG
1151 AAGGTTATAA TTTAGCCGAC AACCTGACCA CCTTATTCGA CGAAACATTG
1201 GATTGGAACG ATGCCAAAGC CGTTATTGAT ATTGTCGTCG GAACAGAGCT
1251 GAATCGCGCT AATAAAGGGG AAGCGGCACA AAAGGTCAAG GAAGTTTTAG
1301 AAAAAAATCG TCCTTATATC CCTAATAAAG GTGCTGTACC GAATATGAGT
1351 ACATACATGA AAAATAATCC TTTTGGAAAA CAGCTGGCTC AAATTTCAGA
1401 AAAGACAACG CTTCCGACGC AGCAAGGGCA GTCTGTCTTC TTGGTAAAAA
1451 GAAACCAAGG GTTATTAAAA ACCGGTGATA GGTTTTATTT AGATGGCCAA
1501 CATAAAAATC ATTTAGAGGT TTTTGATAAA AATGGGAACT TTAAGTTTGT
1551 TCTAAATATG GATGGTTCGC TTAACCAAAT GAAAACTGGG GCAGCAAAAG
1601 GTCGTAAATT AAACTTAAAA TAG
```

This corresponds to the amino acid sequence <SEQ ID 2942; ORF 960>:

```
m960.pep
   1 MQVNIQIPCM LYRRGSVKPP LFEAPRLLPS FTDPVVPKLS APGGYIVDIP
  51 KGNLKTEIEK LAKQPEYAYL KQLQVAKNVN WNQVQLAYDK WDYKQEGLTR
```

-continued

```
101 AGAAIIALAV TVVTAGAGVG AALGLNGAAA AAADAAFASL ASQASVSLIN

151 NKGDVGKTLK ELGRSRTVKN LVVAAATAGV SNKLGASSLA TWSETPWVNN

201 LNVNLANAGS AALINTAVNG GSLKDNLEAN ILAALVNTAH GEAASKIKGL

251 DQHYVAHKIA HAVAGCAAAA ANKGKCQDGA IGAAVGEIVG EALVKNTDFS

301 DMTPEQLDLE VKKITAYAKL AAGTVAGVTG GDVNTAAQTA QNAVENNAVK

351 AVVTAAKVVY KVARKGLKNG KINVRDLKQT LKDEGYNLAD NLTTLFDETL

401 DWNDAKAVID IVVGTELNRA NKGEAAQKVK EVLEKNRPYI PNKGAVPNMS

451 TYMKNNPFGK QLAQISEKTT LPTQQGQSVF LVKRNQGLLK TGDRFYLDGQ

501 HKNHLEVFDK NGNFKFVLNM DGSLNQMKTG AAKGRKLNLK * a960.seq not found yet
a960.pep not found yet
g961.seq not found yet
g961.pep not found yet
```

The following partial DNA sequence was identified in *N. meningitidis* <SEQ ID 2943>:

```
m961.seq
   1 ATGAGCATGA AACACTTTCC AGCCAAAGTA CTGACCACAG CCATCCTTGC

51 CACTTTCTGT AGCGGCGCAC TGGCAGCCAC AAGCGACGAC GATGTTAAAA

101 AAGCTGCCAC TGTGGCCATT GTTGCTGCCT ACAACAATGG CCAAGAAATC

151 AACGGTTTCA AAGCTGGAGA GACCATCTAC GACATTGGTG AAGACGGCAC

201 AATTACCCAA AAAGACGCAA CTGCAGCCGA TGTTGAAGCC GACGACTTTA

251 AAGGTCTGGG TCTGAAAAAA GTCGTGACTA ACCTGACCAA AACCGTCAAT

301 GAAAACAAAC AAAACGTCGA TGCCAAAGTA AAAGCTGCAG AATCTGAAAT

351 AGAAAAGTTA ACAACCAAGT TAGCAGACAC TGATGCCGCT TTAGCAGATA

401 CTGATGCCGC TCTGGATGAA ACCACCAACG CCTTGAATAA ATTGGGAGAA

451 AATATAACGA CATTTGCTGA AGAGACTAAG ACAAATATCG TAAAAATTGA

501 TGAAAAATTA GAAGCCGTGG CTGATACCGT CGACAAGCAT GCCGAAGCAT

551 TCAACGATAT CGCCGATTCA TTGGATGAAA CCAACACTAA GGCAGACGAA

601 GCCGTCAAAA CCGCCAATGA AGCCAAACAG ACGGCCGAAG AAACCAAACA

651 AAACGTCGAT GCCAAAGTAA AAGCTGCAGA AACTGCAGCA GGCAAAGCCG

701 AAGCTGCCGC TGGCACAGCT AATACTGCAG CCGACAAGGC CGAAGCTGTC

751 GCTGCAAAAG TTACCGACAT CAAAGCTGAT ATCGCTACGA ACAAAGCTGA

801 TATTGCTAAA AACTCAGCAC GCATCGACAG CTTGGACAAA AACGTAGCTA

851 ATCTGCGCAA AGAAACCCGC CAAGGCCTTG CAGAACAAGC CGCGCTCTCC

901 GGCCTGTTCC AACCTTACAA CGTGGGTCGG TTCAATGTAA CGGCTGCAGT

951 CGGCGGCTAC AAATCCGAAT CGGCAGTCGC CATCGGTACC GGCTTCCGCT

1001 TTACCGAAAA CTTTGCCGCC AAAGCAGGCG TGGCAGTCGG CACTTCGTCC

1051 GGTTCTTCCG CAGCCTACCA TGTCGGCGTC AATTACGAGT GGTAA
```

This corresponds to the amino acid sequence <SEQ ID 940; ORF 2944>:

```
m961.pep
   1 MSMKHFPAKV LTTAILATFC SGALAATSDD DVKKAATVAI VAAYNNGQEI

51 NGFKAGETIY DIGEDGTITQ KDATAADVEA DDFKGLGLKK VVTNLTKTVN

101 ENKQNVDAKV KAAESEIEKL TTKLADTDAA LADTDAALDE TTNALNKLGE

151 NITTFAEETK TNIVKIDEKL EAVADTVDKH AEAFNDIADS LDETNTKADE

201 AVKTANEAKQ TAEETKQNVD AKVKAAETAA GKAEAAAGTA NTAADKAEAV

251 AAKVTDIKAD IATNKADIAK NSARIDSLDK NVANLRKETR QGLAEQAALS

301 GLFQPYNVGR FNVTAAVGGY KSESAVAIGT GFRFTENFAA KAGVAVGTSS

351 GSSAAYHVGV NYEW* a961.seq not found yet
a961.pep not found yet
g972.seq not found yet
g972.pep not found yet
```

The following partial DNA sequence was identified in *N. meningitidis* <SEQ ID 2945>:

```
m972.seq
    1 TTGACTAACA GGGGGGGAGC GAAATTAAAA ACCArTTCCA AGAGTAGTGA

51 ACGAATGAGT GAAGTTGAAT ATTTCTCACA CTTTATATCG GACGGAAAAG

101 GGAAGCTTTT AGAAATTCCG CAGCGAAGAG GTAAGCAAGA CggGGTTTTT

151 GTTGATTGGA TTTCATTCAC ATTCCATGAA GATACTTTAC TGAAAGTTTC

201 CGGTTGCCCT TTATTTTCTG ATGCTGAATA CATGTATGTA TTAAGCAGAA

251 AGCTGGAAGA AATTCTAGGT TTTGGCATAA CGCGCAAATG CAAATCAAGG

301 GGCAACAAAT TCTATGAATC CATGTATAGG TTAGGTTCGG ATGATGTTGA

351 TTATGGAGAG GTGCATTTCG GArGTCAGCG CAATACTGTT TTAGTTGAGT

401 TGAAAGGTAC TGGTTGCAGC GTTGCAAGTC CGGGTTGGGA GTTGAGGCTA

451 AAGCAGTTTC TCGATGATTC GATAAGGACA AGAATAACGC GAATTGACCT

501 AGCACTTGAT TTTTTTGATG GAGAGTACAC GCCGGATCAG GCGTTGTTAG

551 ATCACGATAA TGGTTTTTTT GATAACAGCA ATCAAAGGCC GAAATCTGAA

601 ACGATCGGTA CGGCTTGGCG GAATGAGGAC GGGAGCGGCA AGACATTTTA

651 TGTAGGTCGC AAGAAAAATT CTCGTTTTGT TCGTGTTTAT GAGAAAGGCA

701 GGCAGCTTGG AGATAAAGAA AGCAAATGGG TAAGGTTCGA GATCCAGTTT

751 AATTATGGAG ATATAGAAAT ACCCTTGGAT ATTTTAATAA ATCAGGGTTC

801 GTATTTCTGT GGAGCTTTTC CAATTTGTAG AAAATTTAAA AATATGCCGG

851 TTCCCGAAAG GTTTGATCAG AGAAAGAAAA AGCTTAATTT AACTTTCGAG

901 CATAAATTGC ATTACGCGAA AAACGCGGTT GGAAAACTGG TCAATTTCAT

951 GATTGAAATG GGTTTTGATA ATAGCGAAAT TGTGGAATCT TTAAAGGCAG

1001 ATTCGGGATT TCCCAAAGGA TTAGAACCTG AAAAATATGC TCTGGAAATG

1051 TTAAGGGACG GTTTGAAACA CGGTTTTATT CATGAACAGC CGGATATTGA

1101 TTTGGAAATT GAACTTGATG AATTGGGGGT TATTGCTTTT AAAAATTCTG

1151 ACAAATTCGA TAGGGAAAAA AGGCTTTTTA GTCCTGATTA TGATGTCGAG
```

-continued

```
1201 AAAGAAAGGA AATATCAGGA ATATTTAAGT AAAGTTTATC ATCAAAATGT

1251 AGATTATGAT TATTTTTAA
```

This corresponds to the amino acid sequence <SEQ ID 2946; ORF 972>:

```
m972.pep
   1 LTNRGGAKLK TXSKSSERMS EVEYFSHFIS DGKGKLLEIP QRRGKQDGVF

51 VDWISFTFHE DTLLKVSGCP LFSDAEYMYV LSRKLEEILG FGITRKCKSR

101 GNKFYESMYR LGSDDVDYGE VHFGXQRNTV LVELKGTGCS VASPGWELRL

151 KQFLDDSIRT RITRIDLALD FFDGEYTPDQ ALLDHDNGFF DNSNQRPKSE

201 TIGTAWRNED GSGKTFYVGR KKNSRFVRVY EKGRQLGDKE SKWVRFEIQF

251 NYGDIEIPLD ILINQGSYFC GAFPICRKFK NMPVPERFDQ RKKKLNLTFE

301 HKLHYAKNAV GKLVNFMIEM GFDNSEIVES LKADSGFPKG LEPEKYALEM

351 LRDGLKHGFI HEQPDIDLEI ELDELGVIAF KNSDKFDREK RLFSPDYDVE

401 KERKYQEYLS KVYHQNVDYD YF*
```

The following partial DNA sequence was identified in *N. meningitidis* <SEQ ID 2947>:

```
a972.seq
   1 TTGACTAACA GGGGGGGAGC GAAATTAAAA ACCAATTCCA AGAGTAGTGA

51 ACGAATGAGT GAAGTTGAAT ATTTCTCACA CTTTATATCG GACGGAAAAG

101 GGAAGCTTTT AGAAATTCCG CAGCGAAGAG GTAAGCAAGA CGGGGTTTTT

151 GTTGATTGGA TTTCATTCAC ATTCCATGAA GATACTTTAC TGAAAGTTTC

201 CGGTTGCCCT TTATTTTCTG ATGCTGAATA CATGTATGTA TTAAGCAGAA

251 AGCTGGAAGA AATTCTAGGT TTTGGCATAA CGCGCAAATG CAAATCAAGG

301 GGCAACAAAT TCTATGAATC CATGTATAGG TTAGGTTCGG ATGATGTTGA

351 TTATGGAGAG GTGCATTTCG GAGGTCAGCG CAATACTGTT TTAGTTGAGT

401 TGAAAGGTAC TGGTTGCAGC GTTGCAAGTC CGGGTTGGGA GTTGAGGCTA

451 AAGCAGTTTC TCGATGATTC GATAAGGACA AGAATAACGC GAATTGACCT

501 AGCACTTGAT TTTTTTGATG GAGAGTACAC GCCGGATCAG GCGTTGTTAG

551 ATCACGATAA TGGTTTTTTT GATAACAGCA ATCAAAGGCC GAAATCTGAA

601 ACGATCGGTA CGGCTTGGCG GAATGAGGAC GGGAGCGGCA AGACATTTTA

651 TGTAGGTCGC AAGAAAAATT CTCGTTTTGT TCGTGTTTAT GAGAAAGGCA

701 GGCAGCTTGG AGATAAAGAA AGCAAATGGG TAAGGTTCGA GATCCAGTTT

751 AATTATGGAG ATATAGAAAT ACCCTTGGAT ATTTTAATAA ATCAGGGTTC

801 GTATTTCTGT GGAGCTTTTC CAATTTGTAG AAAATTTAAA AATATGCCGG

851 TTCCCGAAAG GTTTGATCAG AGAAAGAAAA CGCTTAATTT AACTTTCGAG

901 CATAAATTGC ATTACGCGAA AAACGCGGTT GGAAAACTGG TCAATTTCAT

951 GATTGAAATG GGTTTTGATA ATAGCGAAAT TGTGGAATCT TTAAAGGCAG

1001 ATTCGGGATT TCCCAAAGGA TTAGAACCTG AAAAATATGC TCTGGAAATG

1051 TTAAGGGACG GTTTGAAACA CGGTTTTATT CATGAACAGC CGGATATTGA

1101 TTTGGAAATT GAACTTGATG AATTGGGGGT TATTGCTTTT AAAAATTCTG
```

-continued

```
1151 ACAAATTCGA TAGGGAAAAA AGGCTTTTTA GTCCTGATTA TGATGTCGAG

1201 AAAGAAAGGA AATATCAGGA ATATTTAAGT AAAGTTTATC ATCAAAATGT

1251 AGATTATGAT TATTTTTAA
```

This corresponds to the amino acid sequence <SEQ ID 2948; ORF 972.a>:

```
a972.pep
  1 LTNRGGAKLK TNSKSSERMS EVEYFSHFIS DGKGKLLEIP QRRGKQDGVF

51 VDWISFTFHE DTLLKVSGCP LFSDAEYMYV LSRKLEEILG FGITRKCKSR

101 GNKFYESMYR LGSDDVDYGE VHFGGQRNTV LVELKGTGCS VASPGWELRL

151 KQFLDDSIRT RITRIDLALD FFDGEYTPDQ ALLDHDNGFF DNSNQRPKSE

201 TIGTAWRNED GSGKTFYVGR KKNSRFVRVY EKGRQLGDKE SKWVRFEIQF

251 NYGDIEIPLD ILINQGSYFC GAFPICRKFK NMPVPERFDQ RKKTLNLTFE

301 HKLHYAKNAV GKLVNFMIEM GFDNSEIVES LKADSGFPKG LEPEKYALEM

351 LRDGLKHGFI HEQPDIDLEI ELDELGVIAF KNSDKFDREK RLFSPDYDVE

401 KERKYQEYLS KVYHQNVDYD YF*
``` m972/a972 99.3% identity in 422 aa overlap

```
                  10         20         30         40         50         60
   m972.pep   LTNRGGAKLKTXSKSSERMSEVEYFSHFISDGKGKLLEIPQRRGKQDGVFVDWISFTFHE
              ||||||||||| ||||||||||||||||||||||||||||||||||||||||||||||||
   a972       LTNRGGAKLKTNSKSSERMSEVEYFSHFISDGKGKLLEIPQRRGKQDGVFVDWISFTFHE
                  10         20         30         40         50         60

70         80         90        100        110        120
   m972.pep   DTLLKVSGCPLFSDAETMTVLSRKLEEILGFGITRKCKSRGNKFYESMYRLGSDDVDYGE
              ||||||||||||||||   ||||||||||||||||||||||||||||||||||||||||
   a972       DTLLKVSGCPLFSDAEYMYVLSRKLEEILGFGITRKCKSRGNKFYESMYRLGSDDVDYGE
                  70         80         90        100        110        120

130        140        150        160        170        180
   m972.pep   VHFGXQRNTVLVELKGTGCSVASPGWELRLKQFLDDSIRTRITRIDLALDFFDGEYTPDQ
              ||||  ||||||||||||||||||||||||||||||||||||||||||||||||||||||
   a972       VHFGGQRNTVLVELKGTGCSVASPGWELRLKQFLDDSIRTRITRIDLALDFFDGEYTPDQ
                 130        140        150        160        170        180

190        200        210        220        230        240
   m972.pep   ALLDHDNGFFDNSNQRPKSETIGTAWRNEDGSGKTFYVGRKKNSRFVRVYEKGRQLGDKE
              ||||||||||||||||||||||||||||||||||||||||||||||||||||||||||||
   a972       ALLDHDNGFFDNSNQRPKSETIGTAWRNEDGSGKTFYVGRKKNSRFVRVYEKGRQLGDKE
                 190        200        210        220        230        240

250        260        270        280        290        300
   m972.pep   SKWVRFEIQFNYGDIEIPLDILINQGSYFCGAFPICRKFKNMPVPERFDQRKKKLNLTFE
              ||||||||||||||||||||||||||||||||||| |||||||||||||||||||||||
   a972       SKWVRFEIQFNYGDIEIPLDILINQGSYFCGAFPQCRKFKNMPVPERFDQRKKTLNLTFE
                 250        260        270        280        290        300

310        320        330        340        350        360
   m972.pep   HKLHYAKNAVGKLVNFMIEMGFDNSEIVESLKADSGPPKGLEPEKYALEMLRDGLKHGFI
              ||||||||||||||||||||||||||||||||||||||||||||||||||||||||||||
   a972       HKLHYAKNAVGKLVNFMIEMGFDNSEIVESLKADSGFPKGLEPEKYALEMLRDGLKHGFI
                 310        320        330        340        350        360

370        380        390        400        410        420
   m972.pep   HEQPDIDLEIELDELGVIAFKNSDKFDREKRLFSPDYDVEKERKYQEYLSKVYHQNVDYD
              ||||||||||||||||||||||||||||||||||||||||||||||||||||||||||||
   a972       HEQPDIDLEIELDELGVIAFKNSDKFDREKRLFSPDYDVEKERKYQEYLSKVYHQNVDYD
                 370        380        390        400        410        420 m972.pep   YFX
              |||
   a972       YFX
```

The following partial DNA sequence was identified in *N. gonorrhoeae* <SEQ ID 2949>:

```
g973.seq
    1 ATGGACGGCG CACAACCGAA AACAAATTTT TTTGAACGCC TGATTGCCCG 51 actCGCCCGC GAACCCGATT CCGCCGAAGA CGTATTAAAC CTGCTTCGGC

101 AGGCGCACGA ACAGGAAGTT TTTGATGCCG ACACACTGAC CCGGCTGGAA

151 AAAGTATTGG ACTTTGCCGA GCTGGAAGTG CGCGATGCGA TGATTACGCG

201 CAGCCGCATG AACGTATTGA AGAAAACGA CAGCATCGAA CGCATCACCG

251 CCTACGTCAT CGATACCGCC CATTCGCGCT TCCCCGTCAT CGGCGAAGAC

301 AAAGACGAAG TTTTGGGCAT TTTGCACGCC AAAGACCTGC TCAAATATAT

351 GTTCAACCCC GAGCAGTTCC ACCTGAAATC CGTCTTGCGC CCTGCCGTTT

401 TCGTGCCCGA AGGCAAATCT TTGACCGCCC TTTTAAAAGA GTTCCGCGAA

451 CAGCGCAACC ATATGGCAAT CGTCATCGAC GAATACGGCG GCACGTCGGG

501 TTTGGTCACC TTTGAAGACA TCATCGAGCa aatcgtcggt gacaTCGAAG

551 ACGAGTTTGA CGAAGACGAA AGCGccgacg acatCCACTC cgTTTccgCC

601 GAACGCTGGC GCATCCacgc ggctaCCGAA ATCGAAGaca TCAACGCCTT

651 TTTCGGTACG GAatacggca gcgaagaagc cgacaccatc ggcggctTGG

701 TCATTCAGGA ATTGGGACAC CTGCCCGTGC GCGGCGAAAA AGTCCTTAtc 751 ggcgGTTTGC agttcaccgt CGCCCGCGCC GACAACCGCC GCCTGCACAC 801 GCTGATGGCG ACCCGCGTGA AGTAAGCAGA GCCTGCCcgc accgccgttT 851 CTGCacAGTT TAG
```

This corresponds to the amino acid sequence <SEQ ID 2950; ORF 973.ng>:

```
g973.pep
    1 MDGAQPKTNF FERLIARLAR EPDSAEDVLN LLRQAHEQEV FDADTLTRLE

51 KVLDFAELEV RDAMITRSRM NVLKENDSIE RITAYVIDTA HSRFPVIGED

101 KDEVLGILHA KDLLKYMFNP EQFHLKSVLR PAVFVPEGKS LTALLKEFRE

151 QRNHMAIVID EYGGTSGLVT FEDIIEQIVG DIEDEFDEDE SADDIHSVSA

201 ERWRIHAATE IEDINAFFGT EYGSEEADTI GGLVIQELGH LPVRGEKVLI

251 GGLQFTVARA DNRRLHTLMA TRVK*
```

The following partial DNA sequence was identified in *N. meningitidis* <SEQ ID 2951>:

```
m973.seq
    1 ATGGACGGCG CACAACCGAA AACGAATTTT TTTGAACGCC TGATTGCCCG

51 ACTCGCCCGC GAACCCGATT CCGCCGAAGA CGTATTAAAC CTGCTTCGGC

101 AGGCGCACGA GCAGGAAGTT TTTGATGCGG ATACGCTTTT AAGATTGGAA

151 AAAGTCCTCG ATTTTCCGA TTTGGAAGTG CGCGACGCGA TGATTACGCG

201 CAGCCGTATG AACGTTTTAA AGAAAACGA CAGCATCGAG CGCATCACCG

251 CCTACGTTAT CGATACCGCC CATTCGCGCT TCCCCGTCAT CGGCGAAGAC

301 AAAGACGAAG TTTTGGGCAT TTTGCACGCC AAAGACCTGC TCAAATATAT

351 GTTTAACCCC GAGCAGTTCC ACCTCAAATC CATTCTCCGC CCCGCCGTCT
```

```
401 TCGTCCCCGA AGGCAAATCG CTGACCGCCC TTTTAAAAGA GTTCCGCGAA

451 CAGCGCAACC ATATGGCGAT TGTCATCGAC GAATACGGCG GCACATCCGG

501 CTTGGTCACC TTTGAAGACA TCATCGAGCA AATCGTCGGC GAAATCGAAG

551 ACGAGTTTGA CGAAGACGAT AGCGCCGACA ATATCCATGC CGTTTCTTCm

601 GaACGcTGGC GCATCCATGC AGCTACCGAA ATCGAAGACA TCAACACCTT

651 CTTCGGCACG GAATACAGCA kCGAAGAAGC CGACACCATT GGCGGCCTGG

701 TCATTCAAGA GTTGGGACAT CTGCCCGTGC GCGGCGAAAA AGTCCTTATC

751 GGCGGTTTGC AGTTCACCGT CGCACGCGCC GACAACCGCC GCCTGCATAC

801 GCTGATGGCG ACCCGCGTGA AGTAA
```

This corresponds to the amino acid sequence <SEQ ID 2952; ORF 973>:

```
m973.pep
  1 MDGAQPKTNF FERLIARLAR EPDSAEDVLN LLRQAHEQEV FDADTLLRLE

51 KVLDFSDLEV RDAMITRSRM NVLKENDSIE RITAYVIDTA HSRFPVIGED

101 KDEVLGILHA KDLLKYMFNP EQFHLKSILR PAVFVPEGKS LTALLKEFRE

151 QRNHMAIVID EYGGTSGLVT FEDIIEQIVG EIEDEFDEDD SADNIHAVSS

201 ERWRIHAATE IEDINTFFGT EYSXEEADTI GGLVIQELGH LPVRGEKVLI

251 GGLQFTVARA DNRRLHTLMA TRVK*
```

Computer analysis of this amino acid sequence gave the following results:
Homology with a Predicted ORF from *N. gonorrhoeae*
ORF 973 shows 95.6% identity over a 274 aa overlap with a predicted ORF (ORF 973.ng) from *N. gonorrhoeae*:

```
m973/g973

10         20         30         40         50         60
    m973.pep  MDGAQPKTNFFERLIARLAREPDSAEDVLNLLRQAHEQEVFDADTLLRLEKVLDFSDLEV
              ||||||||||||||||||||||||||||||||||||||||||||||||| ||||||::|||
    g973      MDGAQPKTNFFERLIARLAREPDSAEDVLNLLRQAHEQEVFDADTLTRLEKVLDFAELEV
                    10         20         30         40         50         60

70         80         90        100        110        120
    m973.pep  RDAMITRSRMNVLKENDSIERITAYVIDTAHSRFPVIGEDKDEVLGILHAKDLLKYMFNP
              ||||||||||||||||||||||||||||||||||||||||||||||||||||||||||||
    g973      RDAMITRSRMNVLKENDSIERITAYVIDTAHSRFPVIGEDKDEVLGILHAKDLLKYMFNP
                    70         80         90        100        110        120

130        140        150        160        170        180
    m973.pep  EQFHLKSILSPAVFVPEGKSLTALLKEFREQRNHMAIVIDEYGGTSGLVTFEDIIEQIVG
              ||||||| :|||||||||||||||||||||||||||||||||||||||||||||||||||
    g973      EQFHLKSVLRPAVFVPEGKSLTALLKEFREQRNHMAIVIDEYGGTSGLVTFEDIIEQIVG
                   130        140        150        160        170        180

190        200        210        220        230        240
    m973.pep  EIEDEFDEDDSADNIHAVSSERWRIHAATEIEDINTFFGTEYSXEEADTIGGLVIQELGH
              :|||||||| :|||:||: ||||||||||||||||||: |||||: ||||||||||||||
    g973      DIEDEFDEDESADDIHSVSAERWRIHAATEIEDINAFFGTEYGSEEADTIGGLVIQELGH
                   190        200        210        220        230        240

250        260        270
    m973.pep  LPVRGEKVLIGGLQFTVARADNRRLHTLMATRVKX
              |||||||||||||||||||||||||||||||||||
    g973      LPVRGEKVLIGGLQFTVARADNRRLHTLMATRVKX
                   250        260        270
```

The following partial DNA sequence was identified in *N. meningitidis* <SEQ ID 2953>:

```
a973.seq
   1 ATGGACGGCG CACAACCGAA AACAAATTTT TTTGAACGCC TGATTGCCCG

51 ACTCGCCCGC GAACCCGATT CCGCCGAAGA CGTATTGACC CTGTTGCGCC

101 AAGCGCACGA ACAGGAAGTA TTTGATGCGG ATACGCTTTT AAGATTGGAA

151 AAAGTCCTCG ATTTTTCTGA TTTGGAAGTG CGCGACGCGA TGATTACGCG

201 CAGCCGTATG AACGTTTTAA AAGAAAACGA CAGCATCGAA CGCATCACCG

251 CCTACGTTAT CGATACCGCC CATTCGCGCT TCCCCGTCAT CGGTGAAGAC

301 AAAGACGAAG TTTTGGGTAT TTTGCACGCC AAAGACCTGC TCAAATATAT

351 GTTCAACCCC GAGCAGTTCC ACCTCAAATC GATATTGCGC CCTGCCGTCT

401 TCGTCCCCGA AGGCAAATCG CTGACCGCCC TTTTAAAAGA GTTCCGCGAA

451 CAGCGCAACC ATATGGCAAT CGTCATCGAC GAATACGGCG GCACGTCGGG

501 TTTGGTAACT TTTGAAGACA TCATCGAGCA AATCGTCGGC GACATCGAAG

551 ATGAGTTTGA CGAAGACGAA AGCGCGGACA ACATCCACGC CGTTTCCGCC

601 GAACGCTGGC GCATCCACGC GGCTACCGAA ATCGAAGACA TCAACGCCTT

651 TTTCGGCACG GAATACAGCA GCGAAGAAGC CGACACCATC GGCGGCCTGG

701 TCATTCAGGA ATTGGGACAC CTGCCCGTGC GCGGCGAAAA AGTCCTTATC

751 GGCGGTTTGC AGTTCACCGT CGCCCGCGCC GACAACCGCC GCCTGCATAC

801 GCTGATGGCG ACCCGCGTGA AGTAA
```

This corresponds to the amino acid sequence <SEQ ID 2954; ORF 973.a>:

```
a973.pep
   1 MDGAQPKTNF FERLIARLAR EPDSAEDVLT LLRQAHEQEV FDADTLLRLE

51 KVLDFSDLEV RDAMITRSRM NVLKENDSIE RITAYVIDTA HSRFPVIGED

101 KDEVLGILHA KDLLKYMFNP EQFHLKSILR PAVFVPEGKS LTALLKEFRE

151 QRNHMAIVID EYGGTSGLVT FEDIIEQIVG DIEDEFDEDE SADNIHAVSA

201 ERWRIHAATE IEDINAFFGT EYSSEEADTI GGLVIQELGH LPVRGEKVLI

251 GGLQFTVARA DNRRLHTLMA TRVK*
``` m973/a973 97.8% identity in 274 aa overlap

```
                    10        20        30        40        50        60
m973.pep    MDGAQPKTNFFERLIARLAREPDSAEDVLNLLRQAHEQEVFDADTLLRLEKVLDFSDLEV
            |||||||||||||||||||||||||||||:||||||||||||||||||||||||||||||
a973        MDGAQPKTNFFERLIARLAREPDSAEDVLTLLRQAHEQEVFDADTLLRLEKVLDFAELEV
                    10        20        30        40        50        60

70        80        90       100       110       120
m973.pep    RDAMITRSRMNVLKENDSIERITAYVIDTAHSRFPVIGEDKDEVLGILHAKDLLKYMFNP
            ||||||||||||||||||||||||||||||||||||||||||||||||||||||||||||
a973        RDAMITRSRMNVLKENDSIERITAYVIDTAHSRFPVIGEDKDEVLGILHAKDLLKYMFNP
                    70        80        90       100       110       120

130       140       150       160       170       180
m973.pep    EQFHLKSILSPAVFVPEGKSLTALLKEFREQRNHMAIVIDEYGGTSGLVTFEDIIEQIVG
            ||||||||||||||||||||||||||||||||||||||||||||||||||||||||||||
a973        EQFHLKSILRPAVFVPEGKSLTALLKEFREQRNHMAIVIDEYGGTSGLVTFEDIIEQIVG
                   130       140       150       160       170       180

190       200       210       220       230       240
m973.pep    EIEDEFDEDDSADNIHAVSSERWRIHAATEIEDINTFFGTEYSXEEADTIGGLVIQELGH
            :||||||||:|||||||||:|||||||||||||||:|||||||  |||||||||||||||
a973        DIEDEFDEDESADNIHAVSAERWRIHAATEIEDINAFFGTEYGSEEADTIGGLVIQELGH
                   190       200       210       220       230       240
```

```
                  250        260        270
m973.pep  LPVRGEKVLIGGLQFTVARADNRRLHTLMATRVKX
          |||||||||||||||||||||||||||||||||||
a973      LPVRGEKVLIGGLQFTVARADNRRLHTLMATRVKX
                  250        260        270
```

The following partial DNA sequence was identified in *N. gonorrhoeae* <SEQ ID 2955>:

```
g981.seq
   1 ATGAAAAAAT GGATTGCCGC CGCCCTTGCC TGTTCCGCAC TCGCGCTGTC

51 TGCCTGCGGC GGTCAGGGCA AGATGCCGC CGCGCCTGCC GCCAACCCCG

101 GCAAAGTGTA CCGCGTGGCT TCCAACGCCG AGTTTGCCCC CTTTGAATCT

151 TTAGACTCGA AAGGCAATGT CGAAGGTTTC GACGTGGATT TGATGAACGC

201 GATGGCGAAG GCGGGCAATT TTAAAATCGA ATTCAAACAC CAGCCGTGGG

251 ACAGCCTTTT CCCCGCCTTG AACAACGGCG ATGCGGACGT TGTGATGTCG

301 GGCGTAACCA TTACCGACGA CCGCAAACAG TCTATGGATT TCAGCGACCC

351 GTATTTTGAA ATCACCCAAG TCGTCCTCGT TCCGAAAGGC AAAAAAGTAT

401 CTTCTTCCGA AGATTTGAAA AAGATGAACA AAGTCGGCGT GGTTACCGGC

451 CACACGGGCG ATTTCTCCGT TTCCAAACTC TTGGGCAACG ACAATCCGAA

501 AATCGCGCGC TTCGAAAACG TCCCCCTGAT TATCAAAGAA CTGGAAAACG

551 GCGGCTTGGA TTCCGTGGTC AGCGACAGCG CGGTCATCGC CAATTATGTG

601 AAAAACAACC CGGCCAAAGG AATGGACTTC GTTACCCTGC CCGACTTCAC

651 CACCGAACAC TACGGCATCG CGGTACGCAA AGGCGACGAA GCAACCGTCA

701 AAATGCTGAA CGATGCGTTG GAAAAAGTAC GCGAAAGCGG CGAATACGAC

751 AAGATCTACG CCAAATATTT TGCCAAAGAG GGCGGACAGG CTGCGAAATA

801 A
```

This corresponds to the amino acid sequence <SEQ ID 2956; ORF 981.ng>:

```
g981.pep
   1 MKKWIAAALA CSALALSACG GQGKDAAAPA ANPGKVYRVA SNAEFAPFES

51 LDSKGNVEGF DVDLMNAMAK AGNFKIEFKH QPWDSLFPAL NNGDADVVMS

101 GVTITDDRKQ SMDFSDPYFE ITQVVLVPKG KKVSSSEDLK KMNKVGVVTG

151 HTGDFSVSKL LGNDNPKIAR FENVPLIIKE LENGGLDSVV SDSAVIANYV

201 KNNPAKGMDF VTLPDFTTEH YGIAVRKGDE ATVKMLNDAL EKVRESGEYD

251 KIYAKYFAKE GGQAAK*
```

The following partial DNA sequence was identified in *N. meningitidis* <SEQ ID 2957>:

```
m981.seq
   1 ATGAAAAAAT GGATTGCCGC CGCCCTTGCC TGTTCCGCGC TCGCGCTGTC

51 TGCCTGCGGC GGTCAGGGCA AGATACCGC CGCGCCTGCC GCCAACCCCG

101 ACAAAGTGTA CCGCGTGGCT TCCAACGCCG AGTTTGCCCC CTTTGAATCT

151 TTAGACTCGA AAGGCAATGT CGAAGGTTTC GATGTGGATT TGATGAACGC

201 GATGGCGAAG GCGGGCAATT TTAAAATCGA ATTCAAACAC CAGCCGTGGG
```

-continued

```
251 ACAGCCTTTT CCCCGCCTTA AACAACGGCG ATGCGGACGT TGTGATGTCG

301 GGCGTAACCA TTACCGACGA CCGCAAACAG TCTATGGACT TCAGCGACCC

351 GTATTTTGAA ATCACCCAAG TCGTCCTCGT TCCGAAAGGC AAAAAAGTAT

401 CTTCTTCCGA AGATTTGAAA ACATGAACA AGTCGGCGT GGTAACCGGC

451 TACACGGGCG ATTTCTCCGT ATCCAAACTC TTGGGCAACG ACAATCCGAA

501 AATCGCGCGC TTTGAAAACG TTCCCCTGAT TATCAAAGAA CTGGAAAACG

551 GCGGCTTGGA TTCCGTGGTC AGCGACAGCG CGGTCATCGC CAATTATGTG

601 AAAAACAATC CGGCCAAAGG GATGGACTTC GTTACCCTGC CCGACTTCAC

651 CACCGAACAC TACGGCATCG CGGTACGCAA AGGCGACGAA GCAACCGTCA

701 AAATGCTGAA CGATGCGTTG GAAAAAGTAC GCGAAAGCGG CGAATACGAC

751 AAGATTTACG CCAAATATTT TGCAAAAGAA GACGGACAGG CCGCAAAATA

801 A
```

This corresponds to the amino acid sequence <SEQ ID 2958; ORF 981>:

```
m981.pep

1 MKKWIAAALA CSALALSACG GQGKDTAAPA ANPDKVYRVA SNAEFAPFES

51 LDSKGNVEGF DVDLMNAMAK AGNFKIEFKH QPWDSLFPAL NNGDADVVMS

101 GVTITDDRKQ SMDFSDPYFE ITQVVLVPKG KKVSSSEDLK NMNKVGVVTG

150 YTGDFSVSKL LGNDNPKIAR FENVPLIIKE LENGGLDSVV SDSAVIANYV

201 KNNPAKGMDF VTLPDFTTEH YGIAVRKGDE ATVKMLNDAL EKVRESGEYD

251 KIYAKYFAKE DGQAAK* m981/g981  98.1% identity in 266 aa overlap 10        20        30        40        50        60
   981.pep    MKKWIAAALACSALALSACGGQGKDTAAPAANPDKVYRVASNAEFAPFESLDSKGNVEGF
              ||||||||||||||||||||||||:||||||| |||||||||||||||||||||||||||
   g981       MKKWIAAALACSALALSACGGQGKDAAAPAANPDKVYRVASNAEFAPFESLDSKGNVEGF
                 10        20        30        40        50        60

70        80        90       100       110       120
   981.pep    DVDLMNAMAKAGNFKIEFKHQPWDSLFPALNNGDADVVMSGVTITDDRKQSMDFSDPYFE
              ||||||||||| ||||||||||||||||||||||||||||||||||||||||||||||||
   g981       DVDLMNAMAKAGMFKIEFKHQPWDSLFPALNNGDADVVMSGVTITDDRKQSMDFSDPYFE
                 70        80        90       100       110       120

130       140       150       160       170       180
   981.pep    ITQVVLVPKGKKVSSSEDLKNMNKVGVVTGYTGDFSVSKLLGNDNPKIARFENVPLIIKE
              |||||||||||||||||||||||||||||:||||||||||||||||||||||||||||||
   g981       ITQVVLVPKGKKVSSSEDLKNMNKVGVVTGYTGDFSVSKLLGNDNPKIARFENVPLIIKE
                130       140       150       160       170       180

190       200       210       220       230       240
   981.pep    LENGGLDSVVSDSAVIANYVKNNPAKGMDFVTKPDFTTEHYGIAVRKGDEATVKMLNDAL
              |||||||||||||||||||||||||:||||||||||||||||||||||||||||||||||
   g981       LENGGLDSVVSDSAVIANYVKNNPTKGMDFVTLPDFTTEHYGIAVRKGDEATVKMLNDAL
                190       200       210       220       230       240

250       260
   981.pep    EKVRESGEYDKIYAKYFAKEDGQAAKX
              |||||||||||||||||||||||||||
   g981       KKVRESGEYDKIYAKYFAKEDGQAAKX
                250       260
```

The following partial DNA sequence was identified in *N. meningitidis* <SEQ ID 2959>:

```
a981.seq
     ATGAAAAAAT GGATTGCCGC CGCCCTTGCC TGTTCCGCGC TCGCGCTGTC

51 TGCCTGCGGC GGTCAGGGTA AAGATGCCGC CGCGCCCGCC GCAAATCCCG
```

-continued

```
101 ACAAAGTGTA CCGCGTGGCT TCCAACGCCG AGTTTGCCCC CTTTGAATCT

151 TTAGACTCGA AAGGCAATGT CGAAGGTTTC GATGTGGATT TGATGAACGC

201 GATGGCGAAG GCGGGCAATT TTAAAATCGA ATTCAAACAC CAGCCGTGGG

251 ACAGCCTTTT CCCCGCCTTG AACAACGGCG ATGCGGACGT TGTGATGTCG

301 GGCGTAACCA TTACCGACGA CCGCAAACAG TCTATGGACT TCAGCGACCC

351 GTATTTTGAA ATCACCCAAG TCGTCCTCGT TCCGAAAGGC AAAAAAATAT

401 CTTCTTCCGA AGATTTGAAA ACATGAACA AAGTCGGCGT GGTAACCGGC

451 TACACGGGCG ATTTCTCCGT ATCCAAACTC TTGGGCAACG ACAACCCGAA

501 AATCGCGCGC TTTGAAAACG TTCCCCTGAT TATCAAAGAA CTGGAAAACG

551 GCGGCTTGGA TTCCGTGGTC AGCGACAGCG CAGTCATCGC CAATTATGTG

601 AAAAACAATC CGACCAAAGG GATGGACTTC GTTACCCTGC CCGACTTCAC

651 CACCGAACAC TACGGCATCG CGGTACGCAA AGGCGACGAA GCAACCGTCA

701 AAATGCTGAA CGATGCGTTG AAAAAAGTAC GCGAAAGCGG CGAATACGAC

751 AAAATCTACG CCAAATATTT TGCAAAAGAA GACGGACAGG CCGCAAAATA

801 A
```

This corresponds to the amino acid sequence <SEQ ID 2960; ORF 981.a>:

```
a981.pep
  1 MKKWIAAALA CSALALSACG GQGKDAAAPA ANPDKVYRVA SNAEFAPFES

51 LDSKGNVEGF DVDLMNAMAK AGNFKIEFKH QPWDSLFPAL NNGDADVVMS

101 GVTITDDRKQ SMDFSDPYFE ITQVVLVPKG KKISSSEDLK NMNKVGVVTG

151 YTGDFSVSKL LGNDNPKIAR FENVPLIIKE LENGGLDSVV SDSAVIANYV

201 KNNPTKGMDF VTLPDFTTEH YGIAVRKGDE ATVKMLNDAL KKVRESGEYD

251 KIYAKYFAKE DGQAAK*
``` m981/a981 98.5% identity in 266 aa overlap

```
                  10         20         30         40         50         60
   m981.pep  MKKWIAAALACSALALSACGGQGKDTAAPAANPDKVYRVASNAEFAPFESLDSKGNVEGF
             ||||||||||||||||||||||||| :||||||||||||||||||||||||||||||||||
   a981      MKKWIAAALACSALALSACGGQGKDAAAPAANPDKVYRVASNAEFAPFESLDSKGNVEGF
                  10         20         30         40         50         60

70         80         90        100        110        120
   m981.pep  DVDLMNAMAKAGNFKIEFKHQPWDSLFPALNNGDADVVMSGVTITDDRKQSMDFSDPYFE
             ||||||||||||| ||||||||||||||||||||||||||||||||||||||||||||||
   a81       DVDLMNAMAKAGMFKIEFKHQPWDSLFPALNNGDADVVMSGVTITDDRKQSMDFSDPYFE
                  70         80         90        100        110        120

130        140        150        160        170        180
   m981.pep  ITQVVLVPKGKKVSSSEDLKNMNKVGVVTGYTGDFSVSKLLGNDNPKIARFENVPLIIKE
             |||||||||||: ||||||||||||||||||||||||||||||||||||||||||||||
   a981      ITQVVLVPKGKKVSSSEDLKNMNKVGVVTGYTGDFSVSKLLGNDNPKIARFENVPLIIKE
                 130        140        150        160        170        180

190        200        210        220        230        240
   m981.pep  LENGGLDSVVSDSAVIANYVKNNPAKGMDFVTKPDFTTEHYGIAVRKGDEATVKMLNDAL
             ||||||||||||||||||||||||: |||||| ||||||||||||||||||||||||||
   a981      LENGGLDSVVSDSAVIANYVKNNPTKGMDFVTLPDFTTEHYGIAVRKGDEATVKMLNDAL
                 190        200        210        220        230        240

250        260
   m981.pep  EKVRESGEYDKIYAKYFAKEDGQAAKX
             :||||||||||||||||||||||||||
   a981      KKVRESGEYDKIYAKYFAKEDGQAAKX
                 250        260
```

The following partial DNA sequence was identified in *N. gonorrhoeae* <SEQ ID 2961>:

```
g982.seq
    1 atcgcatcgc aaaaccttcg attcgacaat cgattcctcc aaaaaatggt
   51 caacggcgTg aatattttgc cggccgcCga ttgggtagcC ttgGGcgcCA
  101 AAGGCCGCAA CGTGGTGGTT GACCGCGCTT TCGGCGGCCC GCACATCACC
  151 AAAGACGGCG TAACCGTCGC CAAAGAAATC GAACTGAAAG ACAAGTTTGA
  201 AAATATGGGC GCGCAAATGG TAAAAGAAGT CGCGTCCAAA ACCAAcgaCg
  251 tagCCGgcga cggtacgact accgCCACCG TATTGGCACA ATCCATCGTT
  301 GCCGAAggcA TGAAATACGT TACCGCCGGC ATGAACCCGA CCGATCTGAA
  351 ACGCGGCATC GACAAAGccg ttgCCGCTtt ggttgAAGAg cTGAAAAACA
  401 TCGCCAAACC TTGCGATACT TCCAAAGAAA TCGCCCAAGT CGGCTCGATT
  451 TCCGCCAACT CCGACGAACA AGtcgGCGCG ATTATCGCCG AAGCGATGGA
  501 AAAAGTCGGC AAAGAAGgcg tgattacCGT TGAAGACGGC AAATCTTTGG
  551 AAAACGAGCT GGACGTGGTT GAAGGTATGC AGTTCGACCG CGGCTACCTG
  601 TCCCCTTACT TTATCAACGA CGCGGAAAAA CAAATCGCCG GTCTGGACAA
  651 TCCGTTTGTT TTGCTGTTCG ACAAAAAAAT CAGCAACATC CGCGACCTGC
  701 TGCCCGTGTT GGAACAAGTG GCGAAAGCCA GCCGCCCGCT GTTGATTATC
  751 GCTGAAGACG TAGAAGGCGA AGCCTTGGCG ACTTTGGTCG TGAACAACAT
  801 CCGCGGCATC CTGAAAACCG TTGCCGTCAA AGCccccggc tTCGGcGACC
  851 GCCGCAAAGC GATgctgcaa gaCATCGCCA TCCTGACcgg cggcgTagtG
  901 ATTtccGAAG Aagtcggcct GTCTTTGGAA AAAgcgactT TGgacgaCTT
  951 Gggtcaaacc aaACGcatCG AAATCGGtga agaaaacact ACCGTCATcg
 1001 acgGCTTCGG CGACGcagcC CAAAtcgaag cgCGTGTTGC CGAAATCCGC
 1051 CAACAAATCG AAACCGCGAC CAGCGATTAC GACAAAGAAA AACTGCAAGA
 1101 GCGCGTTGCC AAACTGGCAG GAGGCGTGGC AGTGATCAAA GTCGGCGCGG
 1151 CGACCGAAGT CGAAATGAAA GAGAAAAAAG ACCGCGTGGA AGACGCGCTG
 1201 CACGCTACCC GCGCAGCCGT TGAAGAAGGC GTGGTTGCAG GCGGCGGCGT
 1251 AGCCCTGTTG CGCGCCCGTG CCGCTTTGGA AAACCTGCAC ACCGGCAATG
 1301 CCGACCAAGA CGCAGGCGTA CAAATCGTAT GCGCGCCGT TGAGTCTCCG
 1351 CTGCGCCAAA TCGTTGCCAA CGCAGGCGGA GAACCCAGCG TGGTGGTGAA
 1401 CAAAGTGTTG GAAGGCAAAG GCAactacgG TTACAACGCa ggctcCGGCG
 1451 AATACGgcga CATGATCGGA ATGGGCGTAC TCGACCCTGC CAAAGTAACC
 1501 CGTTCCGCGC TGCAACACGC CGCGTCTAtC GCCGGTCTGA TGCTGACGAC
 1551 CGACTGCATG ATTGCCGAAA TCCCTGAAGA AAACCGGCT GTGCCCGATA
 1601 TGGGGGGAAT GGGCGGTATG GGCGGCATGA TGTAA
```

This corresponds to the amino acid sequence <SEQ ID 2962; ORF 982.ng>:

```
g982.pep
    1 IASQNLRFDN RFLQKMVNGV NILPAADWVA LGAKGRNVVV DRAFGGPHIT
   51 KDGVTVAKEI ELKDKFENMG AQMVKEVASK TNDVAGDGTT TATVLAQSIV
```

-continued

```
101 AEGMKYVTAG MNPTDLKRGI DKAVAALVEE LKNIAKPCDT SKEIAQVGSI

151 SANSDEQVGA IIAEAMEKVG KEGVITVEDG KSLENELDVV EGMQFDRGYL

201 SPYFINDAEK QIAGLDNPFV LLFDKKISNI RDLLPVLEQV AKASRPLLII

251 AEDVEGEALA TLVVNNIRGI LKTVAVKAPG FGDRRKAMLQ DIAILTGGVV

301 ISEEVGLSLE KATLDDLGQT KRIEIGEENT TVIDGFGDAA QIEARVAEIR

351 QQIETATSDY DKEKLQERVA KLAGGVAVIK VGAATEVEMK EKKDRVEDAL

401 HATRAAVEEG VVAGGGVALL RARAALENLH TGNADQDAGV QIVLRAVESP

451 LRQIVANAGG EPSVVVNKVL EGKGNYGYNA GSGEYGDMIG MGVLDPAKVT

501 RSALQHAASI AGLMLTTDCM IAEIPEEKPA VPDMGGMGGM GGMM*
```

The following partial DNA sequence was identified in *N. meningitidis* <SEQ ID 2963>:

```
m982.seq
   1 ATGGCAGCAA AAGACGTACA GTTCGGCAAT GAAGTCCGTC AAAAAATGGT

51 AAACGGCGTG AACATTCTGG CAAACGCCGT CCGCGTAACC TTGGGCCCCA

101 AAGGTCGCAA CGTAGTCGTT GACCGCGCAT TCGGCGGCCC GCACATCACC

151 AAAGACGGCG TAACCGTCGC CAAAGAAATC GAACTGAAAG ACAAGTTTGA

201 AAATATGGGC GCGCAAATGG TGAAAGAAGT TGCGTCCAAA ACCAACGACG

251 TGGCAGGCGA CGGTACGACT ACCGCCACCG TACTGGCGCA ATCCATCGTT

301 GCCGAAGGTA TGAAATATGT TACCGCAGGT ATGAATCCGA CCGACCTGAA

351 ACGCGGTATC GATAAAGCCG TCGCCGCTTT GGTTGACGAA CTGAAAAACA

401 TCGCCAAACC TTGCGACACT TCTAAAGAAA TCGCCCAAGT CGGCTCTATT

451 TCCGCCAACT CCGACGAACA AGTCGGCGCG ATTATCGCCG AAGCGATGGA

501 AAAAGTCGGC AAAGAAGGCG TGATTACCGT TGAAGACGGC AAGTCTTTGG

551 AAAACGAGCT GGACGTAGTT GAAGGTATGC AGTTCGACCG CGGCTACCTG

601 TCTCCTTACT TCATCAACGA TGCGGAAAAA CAAATCGCTG CTTTGGACAA

651 TCCGTTTGTA TTGTTGTTCG ACAAAAAAAT CAGCAACATC CGCGACCTGC

701 TGCCTGTTTT GGAACAAGTG GCAAAAGCCA GCCGTCCGCT GTTGATTATC

751 GCTGAAGACG TAGAAGGCGA AGCCTTGGCG ACTTTGGTCG TGAACAACAT

801 CCGAGGCATC CTGAAAACCG TTGCCGTCAA AGCCCCTGGC TTCGGCGACC

851 GCCGCAAAGC GATGTTGCAA GACATCGCCA TCCTGACCGG CGGCGTGGTG

901 ATTTCCGAAG AAGTCGGTCT GTCTTTGGAA AAAGCGACTT TGGACGACTT

951 GGGTCAAGCC AAACGCATCG AAATCGGTAA AGAAAACACC ACCATCATCG

1001 ACGGCTTTGG CGACGCAGCC CAAATCGAAG CGCGTGTTGC CGAAATCCGC

1051 CAACAAATCG AAACCGCAAC CAGCGATTAC GACAAAGAAA AACTGCAAGA

1101 GCGCGTGGCT AAATTGGCAG GCGGCGTGGC AGTCATCAAA GTCGGTGCCG

1151 CGACCGAAGT CGAAATGAAA GAGAAAAAAG ACCGCGTGGA AGACGCGCTG

1201 CACGCTACCC GCGCAGCCGT TGAAGAAGGC GTGGTTGCAG GCGGCGGCGT

1251 AGCCCTGTTG CGTGCCCGTG CTGCTTTGGA AAACCTGCAC ACCGGCAATG

1301 CCGACCAAGA CGCAGGCGTA CAAATCGTCT TGCGCGCCGT TGAGTCTCCG

1351 CTGCGCCAAA TCGTTGCCAA CGCAGGCGGC GAACCCAGCG TGGTTGTGAA
```

-continued

```
1401 CAAAGTATTG GAAGGCAAAG GCAACTACGG TTACAACGCT GGCAGCGGCG

1451 AATACGGCGA TATGATCGAA ATGGGCGTAC TCGACCCCGC CAAAGTAACC

1501 CGTTCTGCGC TGCAACACGC CGCATCTATC GCCGGCTTGA TGCTGACCAC

1551 TGATTGCATG ATCGCTGAAA TCCCCGAAGA CAAACCGGCT GTGCCTGATA

1601 TGGGCGGCAT GGGTGGTATG GGCGGCATGA TGTAA
```

This corresponds to the amino acid sequence <SEQ ID 2964; ORF 982>:

```
m982.seq
   1 ATGGCAGCAA AAGACGTACA GTTCGGCAAT GAAGTCCGTC AAAAAATGGT

51 AAACGGCGTG AACATTCTGG CAAACGCCGT CCGCGTAACC TTGGGCCCCA

101 AAGGTCGCAA CGTAGTCGTT GACCGCGCAT TCGGCGGCCC GCACATCACC

151 AAAGACGGCG TAACCGTCGC CAAAGAAATC GAACTGAAAG ACAAGTTTGA

201 AAATATGGGC GCGCAAATGG TGAAAGAAGT TGCGTCCAAA ACCAACGACG

251 TGGCAGGCGA CGGTACGACT ACCGCCACCG TACTGGCGCA ATCCATCGTT

301 GCCGAAGGTA TGAAATATGT TACCGCAGGT ATGAATCCGA CCGACCTGAA

351 ACGCGGTATC GATAAAGCCG TCGCCGCTTT GGTTGACGAA CTGAAAAACA

401 TCGCCAAACC TTGCGACACT TCTAAAGAAA TCGCCCAAGT CGGCTCTATT

451 TCCGCCAACT CCGACGAACA AGTCGGCGCG ATTATCGCCG AAGCGATGGA

501 AAAAGTCGGC AAAGAAGGCG TGATTACCGT TGAAGACGGC AAGTCTTTGG

551 AAAACGAGCT GGACGTAGTT GAAGGTATGC AGTTCGACCG CGGCTACCTG

601 TCTCCTTACT TCATCAACGA TGCGGAAAAA CAAATCGCTG CTTTGGACAA

651 TCCGTTTGTA TTGTTGTTCG ACAAAAAAAT CAGCAACATC CGCGACCTGC

701 TGCCTGTTTT GGAACAAGTG GCAAAAGCCA GCCGTCCGCT GTTGATTATC

751 GCTGAAGACG TAGAAGGCGA AGCCTTGGCG ACTTTGGTCG TGAACAACAT

801 CCGAGGCATC CTGAAAACCG TTGCCGTCAA AGCCCCTGGC TTCGGCGACC

851 GCCGCAAAGC GATGTTGCAA GACATCGCCA TCCTGACCGG CGGCGTGGTG

901 ATTTCCGAAG AAGTCGGTCT GTCTTTGGAA AAAGCGACTT TGGACGACTT

951 GGGTCAAGCC AAACGCATCG AAATCGGTAA AGAAAACACC ACCATCATCG

1001 ACGGCTTTGG CGACGCAGCC CAAATCGAAG CGCGTGTTGC CGAAATCCGC

1051 CAACAAATCG AAACCGCAAC CAGCGATTAC GACAAAGAAA AACTGCAAGA

1101 GCGCGTGGCT AAATTGGCAG CGGCGTGGC AGTCATCAAA GTCGGTGCCG

1151 CGACCGAAGT CGAAATGAAA GAGAAAAAAG ACCGCGTGGA AGACGCGCTG

1201 CACGCTACCC GCGCAGCCGT TGAAGAAGGC GTGGTTGCAG CGGCGGCGT

1251 AGCCCTGTTG CGTGCCCGTG CTGCTTTGGA AAACCTGCAC ACCGGCAATG

1301 CCGACCAAGA CGCAGGCGTA CAAATCGTCT TGCGCGCCGT TGAGTCTCCG

1351 CTGCGCCAAA TCGTTGCCAA CGCAGGCGGC GAACCCAGCG TGGTTGTGAA

1401 CAAAGTATTG GAAGGCAAAG GCAACTACGG TTACAACGCT GGCAGCGGCG

1451 AATACGGCGA TATGATCGAA ATGGGCGTAC TCGACCCCGC CAAAGTAACC

1501 CGTTCTGCGC TGCAACACGC CGCATCTATC GCCGGCTTGA TGCTGACCAC
```

-continued

```
1551 TGATTGCATG ATCGCTGAAA TCCCCGAAGA CAAACCGGCT GTGCCTGATA

1601 TGGGCGGCAT GGGTGGTATG GGCGGCATGA TGTAA
```

Computer analysis of this amino acid sequence gave the following results:
Homology with a Predicted ORF from N. gonorrhoeae

```
m982/g982  95.8% identity in 544 aa overlap 10         20         30         40         50         60
   m982.pep  MAAKDVQFGNEVRQKMVNGVNILANAVRVTLGPKGRNVVVDRAFGGPHITKDGVTVAKEI
             :|:::::| |:   ||||||||||    |:||  ||||||||||||||||||||||||||
       g982  IASQNLRFDNRFLQKMVNGVNILPAADWVALGAKGRNVVVDRAFGGPHITKDGVTVAKEI
                 10         20         30         40         50         60

70         80         90        100        110        120
   m982.pep  ELKDKFENMGAQMVKEVASKTNDVAGDGTTTATVLAQSIVAEGMKYVTAGMNPTDLKRGI
             ||||||||||||||||||||||||||||||||||||||||||||||||||||||||||||
       g982  ELKDKFENMGAQMVKEVASKTNDVAGDGTTTATVLAQSIVAEGMKYVTAGMNPTDLKRGI
                 70         80         90        100        110        120

130        140        150        160        170        180
   m982.pep  DKAVAALVDELKNIAKPCDTSKEIAQVGSISANSDEQVGAIIAEAMEKVGKEGVITVEDG
             |||||||:||||||||||||||||||||||||||||||||||||||||||||||||||||
       g982  DKAVAALVEELKNIAKPCDTSKEIAQVGSISANSDEQVGAIIAEAMEKVGKEGVITVEDG
                130        140        150        160        170        180

190        200        210        220        230        240
   m982.pep  KSLENELDVVEGMQFDRGYLSPYFINDAEKQIAALDNPFVLLFDKKISNIRDLLPVLEQV
             ||||||||||||||||||||||||||||||||||:|||||||||||||||||||||||||
       g982  KSLENELDVVEGMQFDRGYLSPYFINDAEKQIAGLDNPFVLLFDKKISNIRDLLPVLEQV
                190        200        210        220        230        240

250        260        270        280        290        300
   m982.pep  AKASRPLLIIAEDVEGEALATLVVNNIRGILKTVAVKAPGFGDRRKAMLQDIAILTGGVV
             ||||||||||||||||||||||||||||||||||||||||||||||||||||||||||||
       g982  AKASRPLLIIAEDVEGEALATLVVNNIRGILKTVAVKAPGFGDRRKAMLQDIAILTGGVV
                250        260        270        280        290        300

310        320        330        340        350        360
   m982.pep  ISEEVGLSLEKATLDDLGQAKRIEIGKENTTIIDGFGDAAQIEARVAEIRQQIETATSDY
             |||||||||||||||||||:|||||||:||||:|||||||||||||||||||||||||||
       g982  ISEEVGLSLEKATLDDLGQTKRIEIGEENTTVIDGFGDAAQIEARVAEIRQQIETATSDY
                310        320        330        340        350        360

370        380        390        400        410        420
   m982.pep  DKEKLQERVAKLAGGVAVIKVGAATEVEMKEKKDRVEDALHATRAAVEEGVVAGGGVALL
             ||||||||||||||||||||||||||||||||||||||||||||||||||||||||||||
       g982  DKEKLQERVAKLAGGVAVIKVGAATEVEMKEKKDRVEDALHATRAAVEEGVVAGGGVALL
                370        380        390        400        410        420

430        440        450        460        470        480
   m982.pep  RARAALENLHTGNADQDAGVQIVLRAVESPLRQIVANAGGEPSVVVNKVLEGKGNYGYNA
             ||||||||||||||||||||||||||||||||||||||||||||||||||||||||||||
       g982  RARAALENLHTGNADQDAGVQIVLRAVESPLRQIVANAGGEPSVVVNKVLEGKGNYGYNA
                430        440        450        460        470        480

490        500        510        520        530        540
   m982.pep  GSGEYGDMIEMGVLDPAKVTRSALQHAASIAGLMLTTDCMIAEIPEDKPAVPDMGGMGGM
             ||||||||| |||||||||||||||||||||||||||||||||||:||||||||||||||
       g982  GSGEYGDMIGMGVLDPAKVTRSALQHAASIAGLMLTTDCMIAEIPEEKPAVPDMGGMGGM
                490        500        510        520        530        540 m982.pep  GGMMX
             |||||
       g982  GGMMX
```

The following partial DNA sequence was identified in N. meningitidis <SEQ ID 2965>:

```
a982.seq
   1  ATGGCAGCAA AAGACGTACA ATTCGGCAAT GAAGTCCGCC AAAAAATGGT

51  AAACGGCGTG AACATTTTGG CAAACGCCGT GCGCGTAACC TTGGGTCCCA

101  AAGGCCGCAA CGTGGTGGTT GACCGCGCTT TCGGCGGCCC GCACATCACC

151  AAAGACGGCG TAACCGTCGC CAAAGAAATC GAACTGAAAG ACAAGTTTGA

201  AAATATGGGC GCGCAAATGG TGAAAGAAGT CGCGTCCAAA ACCAACGACG
```

```
 251 TGGCGGGCGA CGGTACGACT ACCGCCACCG TATTGGCGCA ATCCATCGTT

301 GCCGAAGGTA TGAAATACGT TACCGCCGGT ATGAACCCGA CCGACCTGAA

351 ACGCGGTATC GACAAAGCCG TCGCCGCTTT GGTTGAAGAG CTGAAAAACA

401 TCGCCAAACC TTGCGACACT TCTAAAGAAA TCGCCCAAGT CGGTCTCTATT

451 TCCGCCAACT CTGACGAACA AGTCGGCGCG ATTATTGCCG AAGCGATGGA

501 AAAAGTCGGC AAAGAAGGCG TGATTACCGT TGAAGACGGC AAATCTTTGG

551 AAAACGAGCT GGACGTGGTT GAAGGTATGC AATTCGACCG CGGCTACCTG

601 TCTCCTTACT TCATCAACGA TGCGGAAAAA CAAATCGCCG GCTTGGACAA

651 TCCGTTTGTA TTGCTGTTCG ACAAAAAAAT CAGCAATATC CGCGACCTGC

701 TGCCTGTTTT GGAACAAGTG GCCAAAGCCA GCCGTCCGCT GTTGATTATC

751 GCTGAAGACG TAGAAGGCGA AGCCTTGGCG ACTTTGGTCG TGAACAACAT

801 CCGCGGCATT CTGAAAACCG TTGCCGTTAA AGCTCCGGGC TTCGGCGACC

851 GCCGCAAAGC GATGCTGCAA GACATCGCTA TCCTGACCGG CGGCACAGTG

901 ATTTCCGAAG AAGTCGGCCT GTCTTTGGAA AAGCGACTT TGGACGACTT

951 GGGTCAGGCC AAACGCATCG AAATCGGTAA AGAAAACACC ACCATCATCG

1001 ACGGCTTCGG CGACGCAGCC CAAATCGAAG CGCGTGTTGC CGAAATCCGC

1051 CAACAAATCG AAACCGCAAC CAGCGATTAC GACAAAGAAA AACTGCAAGA

1101 GCGCGTTGCC AAACTGGCAG GCGGCGTGGC AGTAATCAAA GTCGGTGCCG

1151 CGACCGAAGT GGAAATGAAA GAGAAAAAAG ACCGCGTGGA AGACGCGCTG

1201 CACGCTACCC GCGCAGCCGT TGAAGAAGGC GTGGTTGCAG GCGGCGGCGT

1251 AGCCCTGTTG CGCGCCCGTG CCGCTCTGGA AAACCTGCAC ACCGGCAATG

1301 CAGACCAAGA CGCAGGCGTA CAAATCGTCT TGCGCGCCGT TGAGTCTCCG

1351 CTGCGCCAAA TCGTTGCCAA CGCAGGCGGC GAACCCAGCG TGGTTGTGAA

1401 CAAAGTGTTG GAAGGCAAAG GCAACTATGG TTACAACGCT GGCAGCGGCG

1451 AATACGGCGA CATGATCGAA ATGGGCGTAC TCGACCCCGC CAAAGTAACC

1501 CGTTCCGCGC TGCAACACGC CGCGTCTATC GCCGGCCTGA TGCTGACCAC

1551 AGACTGCATG ATTGCTGAAA TCCCTGAAGA CAAACCGGCT ATGCCTGATA

1601 TGGGCGGCAT GGGTGGTATG GGCGGCATGA TGTAA
```

This corresponds to the amino acid sequence <SEQ ID 2966; ORF 982.a>:

```
a982.pep

1   MAAKDVQFGN EVRQKMVNGV NILANAVRVT LGPKGRNVVV DRAFGGPHIT
   51   KDGVTVAKEI ELKDKFENMG AQMVKEVASK TNDVAGDGTT TATVLAQSIV
  101   AEGMKYVTAG MNPTDLKRGI DKAVAALVEE LKNIAKPCDT SKEIAQVGSI
  151   SANSDEQVGA IIAEAMEKVG KEGVITVEDG KSLENELDVV EGMQFDRGYL
  201   SPYFINDAEK QIAGLDNPFV LLFDKKISNI RDLLPVLEQV AKASRPLLII
  251   AEDVEGEALA TLVVNNIRGI LKTVAVKAPG FGDRRKAMLQ DIAILTGGTV
  301   ISEEVGLSLE KATLDDLGQA KRIEIGKENT TIIDGFGDAA QIEARVAEIR
  351   QQIETATSDY DKEKLQERVA KLAGGVAVIK VGAATEVEMK EKKDRVEDAL
  401   HATRAAVEEG VVAGGGVALL RARAALENLH TGNADQDAGV QIVLRAVESP
```

```
451 LRQIVANAGG EPSVVVNKVL EGKGNYGYNA GSGEYGDMIE MGVLDPAKVT

501 RSALQHAASI AGLMLTTDCM IAEIPEDKPA MPDMGGMGGM GGMM*
``` m982/a982 99.3% identity in 544 aa overlap

```
                  10         20         30         40         50         60
m982.pep  MAAKDVQFGNEVRQKMVNGVNILANAVRVTLGPKGRNVVVDRAFGGPHITKDGVTVAKEI
          ||||||||||||||||||||||||||||||||||||||||||||||||||||||||||||
a982      MAAKDVQFGNEVRQKMVNGVNILANAVRVTLGPKGRNVVVDRAFGGPHITKDGVTVAKEI
                  10         20         30         40         50         60

70         80         90        100        110        120
m982.pep  ELKDKFENMGAQMVKEVASKTNDVAGDGTTTATVLAQSIVAEGMKYVTAGMNPTDLKRGI
          ||||||||||||||||||||||||||||||||||||||||||||||||||||||||||||
a982      ELKDKFENMGAQMVKEVASKTNDVAGDGTTTATVLAQSIVAEGMKYVTAGMNPTDLKRGI
                  70         80         90        100        110        120

130        140        150        160        170        180
m982.pep  DKAVAALVDELKNIAKPCDTSKEIAQVGSISANSDEQVGAIIAEAMEKVGKEGVITVEDG
          ||||||||:|||||||||||||||||||||||||||||||||||||||||||||||||||
a982      DKAVAALVEELKNIAKPCDTSKEIAQVGSISANSDEQVGAIIAEAMEKVGKEGVITVEDG
                 130        140        150        160        170        180

190        200        210        220        230        240
m982.pep  KSLENELDVVEGMQFDRGYLSPYFINDAEKQIAALDNPFVLLFDKKISNIRDLLPVLEQV
          ||||||||||||||||||||||||||||||||||:|||||||||||||||||||||||||
a982      KSLENELDVVEGMQFDRGYLSPYFINDAEKQIAGLDNPFVLLFDKKISNIRDLLPVLEQV
                 190        200        210        220        230        240

250        260        270        280        290        300
m982.pep  AKASRPLLIIAEDVEGEALATLVVNNIRGILKTVAVKAPGFGDRRKAMLQDIAILTGGVV
          |||||||||||||||||||||||||||||||||||||||||||||||||||||||||:|
a982      AKASRPLLIIAEDVEGEALATLVVNNIRGILKTVAVKAPGFGDRRKAMLQDIAILTGGTV
                 250        260        270        280        290        300

310        320        330        340        350        360
m982.pep  ISEEVGLSLEKATLDDLGQAKRIEIGKENTTIIDGFGDAAQIEARVAEIRQQIETATSDY
          ||||||||||||||||||||||||||||||||||||||||||||||||||||||||||||
a982      ISEEVGLSLEKATLDDLGQAKRIEIGKENTTIIDGFGDAAQIEARVAEIRQQIETATSDY
                 310        320        330        340        350        360

370        380        390        400        410        420
m982.pep  DKEKLQERVAKLAGGVAVIKVGAATEVEMKEKKDRVEDALHATRAAVEEGVVAGGGVALL
          ||||||||||||||||||||||||||||||||||||||||||||||||||||||||||||
a982      DKEKLQERVAKLAGGVAVIKVGAATEVEMKEKKDRVEDALHATRAAVEEGVVAGGGVALL
                 370        380        390        400        410        420

430        440        450        460        470        480
m982.pep  RARAALENLHTGNADQDAGVQIVLRAVESPLRQIVANAGGEPSVVVNKVLEGKGNYGYNA
          ||||||||||||||||||||||||||||||||||||||||||||||||||||||||||||
a982      RARAALENLHTGNADQDAGVQIVLRAVESPLRQIVANAGGEPSVVVNKVLEGKGNYGYNA
                 430        440        450        460        470        480

490        500        510        520        530        540
m982.pep  GSGEYGDMIEMGVLDPAKVTRSALQHAASIAGLMLTTDCMIAEIPEDKPAVPDMGGMGGM
          |||||||||||||||||||||||||||||||||||||||||||||||||:||||||||||
a982      GSGEYGDMIEMGVLDPAKVTRSALQHAASIAGLMLTTDCMIAEIPEDKPAMPDMGGMGGM
                 490        500        510        520        530        540 m982.pep  GGMMX
          |||||
a982      GGMMX
```

The following partial DNA sequence was identified in *N. gonorrhoeae* <SEQ ID 2967>:

```
g986.seq
   1 GTGTTCAAAA AATACCAATA CTTCGCTTTG GCGGCACTGT GTGCCGCCTT

51 GCTGGCAGGC TGCGAAAAGG CAGGCAGCTT TTTCGGTGCG GACAAAAAAG

101 AAGCATCCTT CGTAGAACGC ATCGAACACA CCAAAGACGA CGGCAGTGTC

151 AGTATGCTGC TGCCCGACTT TGCCCAACTG GTTCAAAGCG AAGGCCCGGC

201 AGTCGTCAAT ATTCAGGCAG CCCCCGCCCC GCGCACCCAA AACGGCAGCG

251 GCAATGCCGA AACCGATTCC GACCCGCTTG CCGACAGCGA CCCGTTCTAC

301 GAATTTTTCA AACGCCTCGT CCCGAACATG CCCGAAATCC CCAAGAAGA

351 AGCAGATGAC GGCGGATTGA ACTTCGGTTC GGGCTTCATC ATCAGCAAAA

401 ACGGCTACAT CCTGACCAAT ACCCACGTCG TTGCCGGTAT GGGCAGTATC
```

-continued

```
 451 AAAGTCCTGC TCAACGACAA GCGCGAATAT ACCGCCAAAC TCATCGGTTC

501 GGATGTCCAA TCCGATGTCG CCCTTCTGAA AATCGACGCA ACGGAAGAGC

551 TACCCGTCGT CAAAATCGGC AATCCCAAAA ATTTGAAACC GGGCGAATGG

601 GTCGCTGCCA TCGGCGCGCC CTTCGGCTTT GACAACAGCG TGACCGCCGG

651 CATCGTGTCC GCCAAAGGCA GAAGCCTGCC CAACGAAAgc tACACACCCT

701 TCATCCAAAC CGACGTTGCC ATCAATCCGG GCAATTCCGG CGGCCCGCTG

751 TTCAACTTAA AAGGACAGGt cgTCGGCATC AATTCGCAAA TATACAGCCG

801 CAGCGgcgga ttCATGGGCA TCTCCTTTGC CATCCCGATT GACGTTGCCA

851 TGAATGTCGC CGAACAGCTG AAAAACACCG GCAAAGTCCA ACGCGGACAA

901 CTGGGCGTGA TTATTCAGGA AGTATCCTAC GGTTTGGCAC AGTCGTTCGG

951 TCTGGATAAA GCCAGCGGCG CATTGATTGC CAAAATCCTT CCCGGCAGCC

1001 CCGCAGAACG TGCCGGCCTG CAGGCGGGCG ACATCGTCCT CAGCCTCGAC

1051 GGCGGAGAAA TACGTTCTTC CGGCGACCTT CCCGTCATGG TCGGCGCCAT

1101 TACGCCGGGA AAAGAAGTCA GCCTCGGCGT ATGGCGCAAA GGCGAAGAAA

1151 TCACAATCAA AGCCAAGCTG GGCAACGCCg ccgagcATAC CGGCgcatCA

1201 TCCAAAACAG ATGAAgcccc ctacaccgAA CAGCAATCCG GTACGTTCTC

1251 GGTCGAATCC GCAGGCATTA CCCTTCAGAC ACATACCGAC AGCAGCGGca 1301 aacacctcgt cgtcgtacgg gtttccgacg cggcagaacg cGCAGGCTTA 1351 AGgcgcggcg acgaaatcct cgcggtcggg caagtccccg tcaatgacga 1401 agccgGTTTC cgcaaaGCTA TGGACAAGGC AGGCAAAAAC GTCCCCCTGC 1451 TGGTCAtgcg ccgTGGCAAC ACGCTGTTCA TCGCATTAAA CCTGCAATAA
```

This corresponds to the amino acid sequence <SEQ ID 2968; ORF 986.ng>:

```
g986.pep
   1 VFKKYQYFAL AALCAALLAG CEKAGSFFGA DKKEASFVER IEHTKDDGSV

51 SMLLPDFAQL VQSEGPAVVN IQAAPAPRTQ NGSGNAETDS DPLADSDPFY

101 EFFKRLVPNM PEIPQEEADD GGLNFGSGFI ISKNGYILTN THVVAGMGSI

151 KVLLNDKREY TAKLIGSDVQ SDVALLKIDA TEELPVVKIG NPKNLKPGEW

201 VAAIGAPFGF DNSVTAGIVS AKGRSLPNES YTPFIQTDVA INPGNSGGPL

251 FNLKGQVVGI NSQIYSRSGG FMGISFAIPI DVAMNVAEQL KNTGKVQRGQ

301 LGVIIQEVSY GLAQSFGLDK ASGALIAKIL PGSPAERAGL QAGDIVLSLD

351 GGEIRSSGDL PVMVGAITPG KEVSLGVWRK GEEITIKAKL GNAAEHTGAS

401 SKTDEAPYTE QQSGTFSVES AGITLQTHTD SSGKHLVVVR VSDAAERAGL

451 RRGDEILAVG QVPVNDEAGF RKAMDKAGKN VPLLVMRRGN TLFIALNLQ*
```

The following partial DNA sequence was identified in *N. meningitidis* <SEQ ID 2969>:

```
m986.seq
   1 GTGTTCAAAA AATACCAATA CCTCGCTTTG GCAGCACTGT GTGCAGCCTC

51 GCTGGCAGGC TGCGACAAGG CAGGCAGCTT CTTCGTGGCG ACAAAAAAG

101 AAGCATCCTT CGTAGAACGC ATCGAACACA CCAAAGACGA CGGCAGCGTC
```

```
-continued
 151 AGTATGCTGC TGCCCGACTT TGCCCAACTG GTTCAAAGTG AAGGTCCGGC

201 AGTCGTCAAT ATTCAGGCAG CCCCCGCCCC GCGCACCCAA AACGGCAGCG

251 GCAATGCCGA AAACGATTCC GACCCGATTG CCGACAACGA CCCGTTCTAC

301 GAATTTTTCA AACGCCTCGT CCCGAATATG CCCGAAATCC CCCAAGAAGA

351 AGCAGATGAC GGCGGATTGA ACTTCGGTTC GGGCTTCATC ATCAGCAAAG

401 ACGGCTACAT CCTGACCAAT ACCCACGTCG TTACCGGCAT GGGCAGTATC

451 AAAGTCCTGC TCAACGACAA GCGCGAATAT ACCGCCAAAC TCATCGGTTC

501 GGATGTCCAA TCCGATGTCG CCCTTCTGAA AATCGACGCA ACGGAAGAGC

551 TGCCCGTCGT CAAAATCGGC AATCCCAAAG ATTTGAAACC GGGCGAATGG

601 GTCGCCGCCA TCGGCGCGCC CTTCGGCTTC GACAACAGCG TGACCGCCGG

651 CATCGTGTCC GCCAAAGGCA GAAGCCTGCC CAACGAAAGC TACACACCCT

701 TCATCCAAAC CGACGTTGCC ATCAATCCGG GCAACTCCGG CGGCCCGCTG

751 TTCAACTTAA AAGGACAGGT CGTCGGCATC AACTCGCAAA TATACAGCCG

801 CAGCGGCGGA TTCATGGGCA TTTCCTTCGC CATCCCGATT GACGTTGCCA

851 TGAATGTCGC CGAACAGCTG AAAAACACCG GCAAAGTCCA ACGCGGACAA

901 CTGGGCGTGA TTATTCAAGA AGTATCCTAC GGTTTGGCAC AATCGTTCGG

951 TTTGGACAAA GCCGGCGGCG CACTGATTGC CAAAATCCTG CCCGGCAGCC

1001 CCGCAGAACG TGCCGGCCTG CAGGCGGGCG ACATCGTCCT CAGCCTCGAC

1051 GGCGGAGAAA TACGTTCTTC CGGCGACCTT CCCGTTATGG TCGGCGCCAT

1101 TACGCCGGGA AAAGAAGTCA GCCTCGGCGT ATGGCGCAAA GGCGAAGAAA

1151 TCACAATCAA AGTCAAGCTG GGCAACGCCG CCGAGCATAT CGGCGCATCA

1201 TCCAAAACAG ATGAAGCCCC CTACACCGAA CAGCAATCCG GTACGTTCTC

1251 GGTCGAATCC GCAGGCATTA CCCTTCAGAC ACATACCGAC AGCAGCGGCG

1301 GACACCTCGT CGTCGTACGG GTTTCCGACG CGGCAGAACG CGCAGGCTTG

1351 AGGCGCGGCG ACGAAATTCT TGCCGTCGGG CAAGTCCCCG TCAATGACGA

1401 AGCCGGTTTC CGCAAAGCTA TGGACAAGGC AGGCAAAAAC GTCCCCCTGC

1451 TGATCATGCG CCGTGGCAAC ACGCTGTTTA TCGCATTAAA CCTGCAATAA
```

This corresponds to the amino acid sequence <SEQ ID 2970; ORF 986>:

```
m986.pep..
  1 VFKKYQYLAL AALCAASLAG CDKAGSFFVA DKKEASFVER IEHTKDDGSV

51 SMLLPDFAQL VQSEGPAVVN IQAAPAPRTQ NGSGNAENDS DPIADNDPFY

101 EFFKRLVPNM PEIPQEEADD GGLNFGSGFI ISKDGYILTN THVVTGMGSI

151 KVLLNDKREY TAKLIGSDVQ SDVALLKIDA TEELPVVKIG NPKDLKPGEW

201 VAAIGAPFGF DNSVTAGIVS AKGRSLPNES YTPFIQTDVA INPGNSGGPL

251 FNLKGQVVGI NSQIYSRSGG FMGISFAIPI DVAMNVAEQL KNTGKVQRGQ

301 LGVIIQEVSY GLAQSFGLDK AGGALIAKIL PGSPAERAGL QAGDIVLSLD

351 GGEIRSSGDL PVMVGAITPG KEVSLGVWRK GEEITIKVKL GNAAEHIGAS

401 SKTDEAPYTE QQSGTFSVES AGITLQTHTD SSGGHLVVVR VSDAAERAGL

451 RRGDEILAVG QVPVNDEAGF RKAMDKAGKN VPLLIMRRGN TLFIALNLQ*
```

Computer analysis of this amino acid sequence gave the following results:

Homology with a Predicted ORF from *N. gonorrhoeae*

```
m986/g986 97.0% identity in 499 aa overlap 10         20         30         40         50         60
m986.pep   VFKKYQYLALAALCAASLAGCDKAGSFFVADKKEASFVERIEHTKDDGSVSMLLPDFAQL
           ||||||:||||||||||::|||||||||||||||||||||||||||||||||||||||||
g986       VFKKYQYFALAALCAALLAGCEKAGSFFGADKKEASFVERIEHTKDDGSVSMLLPDFAQL
                10         20         30         40         50         60

70         80         90        100        110        120
m986.pep   VQSEGPAVVNIQAAPAPRTQNGSGNAENDSDPIADNDPFYEFFKRLVPNMPEIPQEEADD
           |||||||||||||||||||||||||||:||||:||:||||||||||||||||||||||||
g986       VQSEGPAVVNIQAAPAPRTQNGSGNAETDSDPLADSDPFYEFFKRLVPNMPEIPQEEADD
                70         80         90        100        110        120

130        140        150        160        170        180
m986.pep   GGLNFGSGFIISKDGYILTNTHVVTGMGSIKVLLNDKREYTAKLIGSDVQSDVALLKIDA
           ||||||||||||:|||||||||||:|||||||||||||||||||||||||||||||||||
g986       GGLNFGSGFIISKNGYILTNTHVVAGMGSIKVLLNDKREYTAKLIGSDVQSDVALLKIDA
               130        140        150        160        170        180

190        200        210        220        230        240
m986.pep   TEELPVVKIGNPKDLKPGEWVAAIGAPFGFDNSVTAGIVSAKGRSLPNESYTPFIQTDVA
           |||||||||||||:||||||||||||||||||||||||||||||||||||||||||||||
g986       TEELPVVKIGNPKNLKPGEWVAAIGAPFGFDNSVTAGIVSAKGRSLPNESYTPFIQTDVA
               190        200        210        220        230        240

250        260        270        280        290        300
m986.pep   INPGNSGGPLFNLKGQVVGINSQIYSRSGGFMGISFAIPIDVAMNVAEQLKNTGKVQRGQ
           ||||||||||||||||||||||||||||||||||||||||||||||||||||||||||||
g986       INPGNSGGPLFNLKGQVVGINSQIYSRSGGFMGISFAIPIDVAMNVAEQLKNTGKVQRGQ
               250        260        270        280        290        300

310        320        330        340        350        360
m986.pep   LGVIIQEVSYGLAQSFGLDKAGGALIAKILPGSPAERAGLQAGDIVLSLDGGEIRSSGDL
           |||||||||||||||||||||:||||||||||||||||||||||||||||||||||||||
g986       LGVIIQEVSYGLAQSFGLDKASGALIAKILPGSPAERAGLQAGDIVLSLDGGEIRSSGDL
               310        320        330        340        350        360

370        380        390        400        410        420
m986.pep   PVMVGAITPGKEVSLGVWRKGEEITIKVKLGNAAEHIGASSKTDEAPYTEQQSGTFSVES
           |||||||||||||||||||||||||||:||||||||| ||||||||||||||||||||||
g986       PVMVGAITPGKEVSLGVWRKGEEITIKAKLGNAAEHTGASSKTDEAPYTEQQSGTFSVES
               370        380        390        400        410        420

430        440        450        460        470        480
m986.pep   AGITLQTHTDSSGGHLVVVRVSDAAERAGLRRGDEILAVGQVPVNDEAGFRKAMDKAGKN
           ||||||||||||:|||||||||||||||||||||||||||||||||||||||||||||||
g986       AGITLQTHTDSSGKHLVVVRVSDAAERAGLRRGDEILAVGQVPVNDEAGFRKAMDKAGKN
               430        440        450        460        470        480

490        500
m986.pep   VPLLIMRRGNTLFIALNLQX
           ||||:|||||||||||||||
g986       VPLLVMRRGNTLFIALNLQX
               490        500
```

The following partial DNA sequence was identified in *N. meningitidis* <SEQ ID 2971>:

```
a986.seq
    1  GTGTTCAAAA AATACCAATA CCTCGCTTTG GCAGCACTGT GTGCCGCCTC

51  GCTGGCAGGC TGCGACAAAG CCGGCAGCTT TTTCGGTGCG GACAAAAAAG

101  AAGCATCCTT TGTAGAACGC ATCAAACACA CCAAAGACGA CGGCAGCGTC

151  AGTATGCTGC TGCCCGACTT TGTCCAACTG GTTCAAAGCG AAGGCCCGGC

201  AGTCGTCAAT ATTCAGGCAG CCCCCGCCCC GCGCACCCAA AACGGCAGCA

251  GCAATGCCGA AACCGATTCC GACCCGCTTG CCGACAGCGA CCCGTTCTAC

301  GAATTTTTCA AACGCCTCGT CCCGAACATG CCCGAAATCC CCCAAGAAGA

351  AGCAGATGAC GGNGGATTGA ACTTCGGTTC GGGCTTCATC ATCAGCAAAG

401  ACGGCTATAT TCTGACCAAT ACGCACGTCG TTACCGGCAT GGGCAGTATC

451  AAAGTCCTGC TCAACGACAA GCGCGAATAT ACCGCCAAAC TCATCGGTTC

501  GGATGTCCAA TCCGATGTCG CCCTTCTGAA AATCGACGCA ACGGAAGAGC
```

-continued

```
 551 TGCCCGTCGT CAAAATCGGC AATCCCAAAG ATTTGAAACC GGGCGAATGG

601 GTCGCCGCCA TCGGCGCGCC CTTCGGCTTC GACAACAGCG TGACCGCCGG

651 CNTCGTGTCC GCCAAAGGCA GAAGCCTGCC CAACGAAAGC TACACACCCT

701 TCATCCAAAC CGACGTTGCC ATCAATCCGG GCAACTCCGG CGGCCCGCTG

751 TTCAACTTAA AAGGACAGGT CGTCGGCATC AACTCGCAAA TATACAGCCG

801 CAGCGGCGGA TTCATGGGCA TTTCCTTCGC CATCCCGATT GACGTTGCCA

851 TGAATGTCGC CGAACAGCTG AAAAACACCG GCAAAGTCCA ACGCGGACAA

901 CTGGGCGTGA TTATTCAAGA AGTATCCTAC GGTTTGGCAC AATCGTTCGG

951 TTTGGACAAA GCCGGCGGCG CACTGATTGC CAAAATCCTG CCCGGCAGCC

1001 CCGCAGAACG TGCCGGCCTG CGGGCGGGCG ACATCGTCCT CAGCCTCGAC

1051 GGCGGAGAAA TACGTTCTTC CGGCGACCTT CCCGTTATGG TCGGCGCCAT

1101 TACGCCGGGA AAGAAGTCA GCCTCGGCGT ATGGCGCAAA GGCGAAGAAA

1151 TCACAATCAA AGTCAAGCTG GGCAACGCCG CCGAGCATAT CGGCGCATCA

1201 TCCAAAACAG ATGAAGCCCC CTACACCGAA CAGCAATCCG GTACGTTCTC

1251 GGTCGAATCC GCAGGCATTA CCCTTCAGAC ACATACCGAC AGCAGCGGCG

1301 GACACCTCGT CGTCGTACGG GTTTCCGACG CGGCAGAACG CGCAGGCTTG

1351 AGGCGCGGCG ACGAAATTCT TGCCGTCGGG CAAGTCCCCG TCAATGACGA

1401 AGCCGGTTTC CGCAAAGCTA TGGACAAGGC AGGCAAAAAC GTCCCCCTGC

1451 TGATCATGCG CCGTGGCAAC ACGCTGTTTA TCGCATTAAA CCTGCAATAA
```

This corresponds to the amino acid sequence <SEQ ID 2972; ORF 986.a>:

```
a986.pep

1 VFKKYQYLAL AALCAASLAG CDKAGSFFGA DKKEASFVER IKHTKDDGSV

51 SMLLPDFVQL VQSEGPAVVN IQAAPAPRTQ NGSSNAETDS DPLADSDPFY

101 EFFKRLVPNM PEIPQEEADD GGLNFGSGFI ISKDGYILTN THVVTGMGSI

151 KVLLNDKREY TAKLIGSDVQ SDVALLKIDA TEELPVVKIG NPKDLKPGEW

201 VAAIGAPFGF DNSVTAGXVS AKGRSLPNES YTPFIQTDVA INPGNSGGPL

251 FNLKGQVVGI NSQIYSRSGG FMGISFAIPI DVAMNVAEQL KNTGKVQRGQ

301 LGVIIQEVSY GLAQSFGLDK AGGALIAKIL PGSPAERAGL RAGDIVLSLD

351 GGEIRSSGDL PVMVGAITPG KEVSLGVWRK GEEITIKVKL GNAAEHIGAS

401 SKTDEAPYTE QQSGTFSVES AGITLQTHTD SSGGHLVVVR VSDAAERAGL

451 RRGDEILAVG QVPVNDEAGF RKAMDKAGKN VPLLIMRRGN TLFIALNLQ* m986/a986 98.2% identity in 499 aa overlap 10         20         30         40         50         60
    m986.pep  VFKKYQYLALAALCAASLAGCDKAGSFFVADKKEASFVERIEHTKDDGSVSMLLPDFAQL
              |||||||||||||||||||||||||||||||| ||||||||||||:|||||||||||:||
    a986      VFKKYQYLALAALCAASLAGCDKAGSFFGADKKEASFVERIKHTKDDGSVSMLLPDFVQL
                  10         20         30         40         50         60

70         80         90        100        110        120
    m986.pep  VQSEGPAVVNIQAAPAPRTQNGSGNAENDSDPIADNDPFYEFFKRLVPNMPEIPQEEADD
              ||||||||||||||||||||||||:|||:||||:||:||||||||||||||||||||||||
    a986      VQSEGPAVVNIQAAPAPRTQNGSSNAETDSDPLADSDPFYEFFKRLVPNMPEIPQEEADD
                  70         80         90        100        110        120

130        140        150        160        170        180
    m986.pep  GGLNFGSGFIISKDGYILTNTHVVTGMGSIKVLLNDKREYTAKLIGSDVQSDVALLKIDA
              ||||||||||||||||||||||||||||||||||||||||||||||||||||||||||||
    a986      GGLNFGSGFIISKDGYILTNTHVVTGMGSIKVLLNDKREYTAKLIGSDVQSDVALLKIDA
                 130        140        150        160        170        180
```

```
             190       200       210       220       230       240
m986.pep TEELPVVKIGNPKDLKPGEWVAAIGAPFGFDNSVTAGIVSAKGRSLPNESYTPFIQTDVA
         ||||||||||||||||||||||||||||||||| ||||||||||||||||||||||||||
a986     TEELPVVKIGNPKDLKPGEWVAAIGAPFGFDNSVTAGXVSAKGRSLPNESYTPFIQTDVA
             190       200       210       220       230       240

250       260       270       280       290       300
m986.pep INPGNSGGPLFNLKGQVVGINSQIYSRSGGFMGISFAIPIDVAMNVAEQLKNTGKVQRGQ
         ||||||||||||||||||||||||||||||||||||||||||||||||||||||||||||
a986     INPGNSGGPLFNLKGQVVGINSQIYSRSGGFMGISFAIPIDVAMNVAEQLKNTGKVQRGQ
             250       260       270       280       290       300

310       320       330       340       350       360
m986.pep LGVIIQEVSYGLAQSFGLDKAGGALIAKILPGSPAERAGLQAGDIVLSLDGGEIRSSGDL
         |||||||||||||||||||||||||||||||||||||||:||||||||||||||||||||
a986     LGVIIQEVSYGLAQSFGLDKAGGALIAKILPGSPAERAGLRAGDIVLSLDGGEIRSSGDL
             310       320       330       340       350       360

370       380       390       400       410       420
m986.pep PVMVGAITPGKEVSLGVWRKGEEITIKVKLGNAAEHIGASSKTDEAPYTEQQSGTFSVES
         ||||||||||||||||||||||||||||||||||||||||||||||||||||||||||||
a986     PVMVGAITPGKEVSLGVWRKGEEITIKVKLGNAAEHIGASSKTDEAPYTEQQSGTFSVES
             370       380       390       400       410       420

430       440       450       460       470       480
m986.pep AGITLQTHTDSSGGHLVVVRVSDAAERAGLRRGDEILAVGQVPVNDEAGFRKAMDKAGKN
         ||||||||||||||||||||||||||||||||||||||||||||||||||||||||||||
a986     AGITLQTHTDSSGGHLVVVRVSDAAERAGLRRGDEILAVGQVPVNDEAGFRKAMDKAGKN
             430       440       450       460       470       480

490       500
m986.pep VPLLIMRRGNTLFIALNLQX
         ||||||||||||||||||||
a986     VPLLIMRRGNTLFIALNLQX
             490       500
```

The following partial DNA sequence was identified in *N. gonorrhoeae* <SEQ ID 2973>:

```
g987.seq
   1 ATGAAAACAC GCAGCCTCAT TTCCCTTTTA TGCCTCCTTC TCTGTTCATG

51 TTCTTCATGG TTGCCCCCAC TGGAAGAACG GACGGAAAGC CGTCATTTTA

101 ATACTTCCAA ACCTGTCCTC CTGGACAACA TCCTGCAAAT CCGGCACACC

151 CCTCATAACA ACGGGCTATC CGACATCTAC CTGCTCGACG ACCCCCACGA

201 AGCCTTTGCC GCCCGCGCCG CCCTTATCGA ATCTGCCGAA CACAGCCTCG

251 ATTTGCAATA CTACATTTGG CGCAACGaCA TTTCCGGCAG GCTGCTGTTC

301 AACCTCATGT ACCTTGCCGC agaacgcGGC GTGCGCGTAC GCCTGCTGTt 351 ggacgacaAC AACAcgcgcg gcttggacga tctcctGCTC GCCCTCGACA 401 GCCATCCCAA TAtctaagtG CGCCTGTTCA ACCCCTtcgt CCTACGCAAA

451 TGGCGCGCAC TCGGCTACCT GACCGACTTC CCCCGCCTCA ACCGCCGCAT

501 GCACAACAAA TCCTTTACCG CCGACAACCG CGCCACCATA CTCGGCGGAC

551 GCAATATCGG CGACGAATAC TTCAAAGTCG GTGAGGACAC CGTTTTCGCC

601 GACCTGGACA TCCTCGCCAC CGGCAGCGTC GTCGGCGAAG TATCGCACGA

651 CTTCGACCGC TACTGGGCAA GCCATTCCGC CCACAACGCC ACGCGCATCA

701 TCCGCAGCGG CAACATCGGC AAGGGTCTTC AAGCACTCGG ATACAACGAC

751 GAAACATCCA GACACGCGCT CCTGCGCTAC CGCGAAACCG TCGAACAGTC

801 GCCCCTCTAC CAAAAAATAC AGACGGGACG CATCGACTGG CAGAGCGTCC

851 AAACCCGCCT GATCAGCGAC AGCCCTGCAA AAGGACTCGA CCGCGACCGC

901 CGCAAACCGC CGATTGCCGG GAGGCTGCAA GACGCGCTCA ACAGCCCGA

951 AAAAAGCGTC TATCTGGTTT CACCCTATTT CGTCCCTACA AAATCCGGCA

1001 CAGACGCACT GGCAAAACTG GTGCAGGACG GCATAGACGT TACCGTCCTG
```

-continued

```
1051 ACCAACTCGC TACAGGCGAC CGACGTTGCC GCCGTCCATT CCGGCTACGT

1101 CAAATACCGA AAACCGCTGC TCAAAGCCGG CATCAAACTC TACGAGCTGC

1151 AACCCAACCA TGCCGTCCCC GCCACAAAAG ACAAAGGCCT GACCGGCAGC

1201 TCCGTAACCA GCCTGCATGC CAAAACCTTC ATTGTGGacg gCAAACGCAT

1251 CTTCATCGGC TCATTCAACC TCGACCCCCG TTCCGCACGG CTCAATACCG

1301 AAATGGGCGT CGTCATCGAA AGCCCCAAAA TCGCAGAACA GATGGAGCGC

1351 AcccTCGCCG AtacCACACC CGAATACGCC TACCGCGTTA CCCTCGACAA

1401 ACACAACCGC CTGCAATGGC ACGATCCCGC CACCCGAAAA ACCTACCCGA

1451 ACGAACCCGA AGCCAAACTT TGGAAACGCA TCGCCGCAAA AATCCTATCC

1501 CTGCTGCCCA TCGAAGGTTT ATTATAG
```

This corresponds to the amino acid sequence <SEQ ID 2974; ORF 987.ng>:

```
g987.pep
   1 MKTRSLISLL CLLLCSCSSW LPPLEERTES RHFNTSKPVL LDNILQIRHT

51 PHNNGLSDIY LLDDPHEAFA ARAALIESAE HSLDLQYYIW RNDISGRLLF

101 NLMYLAAERG VRVRLLLDDN NTRGLDDLLL ALDSHPNI*V RLFNPFVLRK

151 WRALGYLTDF PRLNRRMHNK SFTADNRATI LGGRNIGDEY FKVGEDTVFA

201 DLDILATGSV VGEVSHDFDR YWASHSAHNA TRIIRSGNIG KGLQALGYND

251 ETSRHALLRY RETVEQSPLY QKIQTGRIDW QSVQTRLISD SPAKGLDRDR

301 RKPPIAGRLQ DALKQPEKSV YLVSPYFVPT KSGTDALAKL VQDGIDVTVL

351 TNSLQATDVA AVHSGYVKYR KPLLKAGIKL YELQPNHAVP ATKDKGLTGS

401 SVTSLHAKTF IVDGKRIFIG SFNLDPRSAR LNTEMGVVIE SPKIAEQMER

451 TLADTTPEYA YRVTLDKHNR LQWHDPATRK TYPNEPEAKL WKRIAAKILS

501 LLPIEGLL*
```

40

The following partial DNA sequence was identified in *N. meningitidis* <SEQ ID 2975>:

```
m987.seq
   1 ATGAAAACAC GCAGCCTAAT TTCCCTTTTA TGCCTCCTTC TCTGTTCATG

51 TTCTTCATGG TTGCCCCCAC TGGAAGAACG GACGGAAAGC CGTCATTTCA

101 ATACTTCCAA ACCCGTCCGC CTGGACAACA TCCTGCAAAT CCGGCACACC

151 CCTCATACCA ACGGGCTATC CGATATCTAT CTGTTGAACG ACCCCCACGA

201 AGCCTTTGCC GCCCGCGCCG CCCTTATCGA ATCTGCCGAA CACAGCCTCG

251 ATTTGCAATA CTACATCTGG CGCAACGACA TTTCCGGCAG GCTGCTGTTC

301 AACCTCGTGT ACCTTGCCGC AGAACGCGGT GTGCGCGTAC GCCTGCTGTT

351 GGACGACAAC AACACGCGCG GATTGGACGA CCTCCTGCTT GCCCTCGACA

401 GCCATCCCAA TATCGAAGTG CGCCTGTTCA ACCCCTTCGT CTTACGAAAA

451 TGGCGCGCAC TCGGCTACCT GACCGACTTC CCCCGCCTCA ACCGCCGCAT

501 GCACAACAAA TCCTTTACCG CCGACAACCG CGCCACCATA CTCGGCGGAC

551 GCAATATCGG CGACGAATAC TTCAAAGTCG GTGAGGACAC CGTTTTCGCC

601 GATTTGGACA TCCTCGCCAC CGGCAGCGTC GTCGGCGAAG TATCGCACGA
```

```
-continued
 651 CTTCGACCGC TACTGGGCAA GCCATTCCGC CCACAACGCC ACGCGCATCA

701 TCCGCAGCGG CGACATCGGC AAGGGTCTTC AAGCACTCGG ATACAACGAC

751 GAAACGTCCA GACACGCGCT CCTGCGCTAC CGCGAAACCG TCGAACAGTC

801 GCCCCTCTAC CAAAAAATAC AGACAGGATG CATCGACTGG CAGAGCGTCC

851 GAACCCGCCT CATCAGCGAC GACCCTGCAA AAGGACTCGA CCGCGACCGC

901 CGCAAACCGC CGATTGCCGG GCGGCTGCAA GACGCGCTCA AACAGCCCGA

951 AAAAAGCGTC TATCTGGTTT CACCCTATTT CGTTCCCACA AAATCCGGCA

1001 CAGACGCACT GGCAAAACTG GTGCAGGACG GCATAGACGT TACCGTTCTG

1051 ACCAACTCGC TGCAGGCGAC CGACGTTGCC GCCGTCCATT CCGGCTATGT

1101 CAAATACCGA AAACCGCTGC TCAAAGCCGG CATCAAACTC TACGAGCTGC

1151 AACCCAACCA TGCCGTCCCC GCCACAAAAG ACAAAGGCCT GACCGGCAGC

1201 TCCGTAACCA GCCTGCACGC CAAAACCTTC ATTGTGGACG GCAAACGCAT

1251 CTTCATCGGT TCGTTCAACC TCGACCCCCG TTCCGCGCGT CTCAACACCG

1301 AAATGGGCGT TGTTATCGAA AGCCCCAAAA TCGCAGAACA GATGGAGCGC

1351 ACCCTTGCCG ATACCACACC CGCCTACGCC TACCGCGTTA CCCTCGACAG

1401 GCACAACCGC CTGCAATGGC ACGATCCCGC CACCCGAAAA ACCTACCCGA

1451 ACGAACCCGA AGCCAAACTT TGGAAACGCA TCGCCGCAAA AATCCTATCC

1501 CTGCTGCCCA TAGAAGGTTT ATTATAG
```

This corresponds to the amino acid sequence <SEQ ID 2976; ORF 987>:

```
m987.pep
  1 MKTRSLISLL CLLLCSCSSW LPPLEERTES RHFNTSKPVR LDNILQIRHT

51 PHTNGLSDIY LLNDPHEAFA ARAALIESAE HSLDLQYYIW RNDISGRLLF

101 NLVYLAAERG VRVRLLLDDN NTRGLDDLLL ALDSHPNIEV RLFNPFVLRK

151 WRALGYLTDF PRLNRRMHNK SFTADNRATI LGGRNIGDEY FKVGEDTVFA

201 DLDILATGSV VGEVSHDFDR YWASHSAHNA TRIIRSGDIG KGLQALGYND

251 ETSRHALLRY RETVEQSPLY QKIQTGCIDW QSVRTRLISD DPAKGLDRDR

301 RKPPIAGRLQ DALKQPEKSV YLVSPYFVPT KSGTDALAKL VQDGIDVTVL

351 TNSLQATDVA AVHSGYVKYR KPLLKAGIKL YELQPNHAVP ATKDKGLTGS

401 SVTSLHAKTF IVDGKRIFIG SFNLDPRSAR LNTEMGVVIE SPKIAEQMER

451 TLADTTPAYA YRVTLDRHNR LQWHDPATRK TYPNEPEAKL WKRIAAKILS

501 LLPIEGLL*
```

Computer analysis of this amino acid sequence gave the following results:
Homology with a Predicted ORF from *N. gonorrhoeae*

```
   m987/g987  97.8% identity in 508 aa overlap 10        20        30        40        50        60
    m987.pep  MKTRSLISLLCLLLCSCSSWLPPLEERTESRHFNTSKPVRLDNILQIRHTPHTNGLSDIY
              ||||||||||||||||||||||||||||||||||||||| |||||||||||:||||||
    g987      MKTRSLISLLCLLLCSCSSWLPPLEERTESRHFNTSKPVLLDNILQIRHTPHNNGLSDIY
                  10        20        30        40        50        60
```

```
              70        80        90       100       110       120
m987.pep  LLNDPHEAFAARAALIESAEHSLDLQYYIWRNDISGRLLFNLVYLAAERGVRVRLLLDDN
          ||:|||||||||||||||||||||||||||||||||||||:|||||||||||||||||||
g987      LLDDPHEAFAARAALIESAEHSLDLQYYIWRNDISGRLLFNLMYLAAERGVRVRLLLDDN
              70        80        90       100       110       120

130       140       150       160       170       180
m987.pep  NTRGLDDLLLALDSHPNIEVRLFNPFVLRKWRALGYLTDFPRLNRRMHNKSFTADNRATI
          |||||||||||||||||||:||||||||||||||||||||||||||||||||||||||||
g987      NTRGLDDLLLALDSHPNIXVRLFNPFVLRKWRALGYLTDFPRLNRRMHNKSFTADNRATI
             130       140       150       160       170       180

190       200       210       220       230       240
m987.pep  LGGRNIGDEYFKVGEDTVFADLDILATGSVVGEVSHDFDRYWASHSAHNATRIIRSGDIG
          |||||||||||||||||||||||||||||||||||||||||||||||||||||||||:||
g987      LGGRNIGDEYFKVGEDTVFADLDILATGSVVGEVSHDFDRYWASHSAHNATRIIRSGNIG
             190       200       210       220       230       240

250       260       270       280       290       300
m987.pep  KGLQALGYNDETSRHALLRYRETVEQSPLYQKIQTGCIDWQSVRTRLISDDPAKGLDRDR
          |||||||||||||||||||||||||||||||||||||:||||||:|||||||||||||||
g987      KGLQALGYNDETSRHALLRYRETVEQSPLYQKIQTGRIDWQSVQTRLISDSPAKGLDRDR
             250       260       270       280       290       300

310       320       330       340       350       360
m987.pep  RKPPIAGRLQDALKQPEKSVYLVSPYFVPTKSGTDALAKLVQDGIDVTVLTNSLQATDVA
          ||||||||||||||||||||||||||||||||||||||||||||||||||||||||||||
g987      RKPPIAGRLQDALKQPEKSVYLVSPYFVPTKSGTDALAKLVQDGIDVTVLTNSLQATDVA
             310       320       330       340       350       360

370       380       390       400       410       420
m987.pep  AVHSGYVKYRKPLLKAGIKLYELQPNHAVPATKDKGLTGSSVTSLHAKTFIVDGKRIFIG
          ||||||||||||||||||||||||||||||||||||||||||||||||||||||||||||
g987      AVHSGYVKYRKPLLKAGIKLYELQPNHAVPATKDKGLTGSSVTSLHAKTFIVDGKRIFIG
             370       380       390       400       410       420

430       440       450       460       470       480
m987.pep  SFNLDPRSARLNTEMGVVIESPKIAEQMERTLADTTPAYAYRVTLDRHNRLQWHDPATRK
          ||||||||||||||||||||||||||||||||||||||||:|||||||:|||||||||||
g987      SFNLDPRSARLNTEMGVVIESPKIAEQMERTLADTTPEYAYRVTLDKHNRLQWHDPATRK
             430       440       450       460       470       480

490       500       509
m987.pep  TYPNEPEAKLWKRIAAKILSLLPIEGLLX
          ||||||||||||||||||||||||||||
g987      TYPNEPEAKLWKRIAAKILSLLPIEGLLX
             490       500
```

The following partial DNA sequence was identified in *N. meningitidis* <SEQ ID 2977>:

```
a987.seq
   1  ATGAAAACAC GCAGCCTAAT TTCCCTTTTA TGCCTCCTTC TCTGTTCATG

51  TTCTTCATGG TTGCCCCCAC TGGAAGAACG GACGGAAAGC CGTCATTTCA

101  ATACTTCCAA ACCCGTCCGC CTGGACAACA TCCTGCAAAT CCGGCACACC

151  CCTCATACCA ACGGGCTATC CGATATCTAT CTGTTGAACG ACCCCCACGA

201  AGCCTTTGCC GCCCGCGCCG CCCTTATCGA ATCTGCCGAA CACAGCCTCG

251  ATTTGCAATA CTACATCTGG CGCAACGACA TTTCCGGCCG ACTGCTGTTC

301  AACCTCGTGT ACCTTGCCGC AGAACGCGGT GTGCGCGTAC GCCTGCTGTT

351  GGACGACAAC AACACGCGCG GATTGGACGA CCTCCTGCTC GACCTGGACA

401  GCCATCCCAA TATCGAAGTG CGCCTGTTCA ACCCCTTCGT CTTACGAAAA

451  TGGCGCGCAC TCGGCTACCT GACCGACTTC CCCCGCCTCA ACCGCCGCAT

501  GCACAACAAA TCCTTTACCG CCGACAACCG CGCCACCATA CTCGGCGGAC

551  GCAATATCGG CGACGAATAC TTCAAAGTCG GTGAGGACAC CGTTTTCGCC

601  GACCTGGACA TCCTCGCCAC CGGCAGCGTC GTCGGCGAAG TATCGCACGA

651  CTTCGACCGC TACTGGGCAA GCCATTCCGC CCACAACGCC ACGCGCATCA

701  TCCGCAGCGG CAACATCGGC AAGGGTCTTC AAGCACTCGG ATACAACGAC

751  GAAACGTCCA GACACGCGCT CCTGCGCTAC CGCGAAACCG TCGAACAGTC
```

```
 801 GCCCCTCTAC CAAAAAATAC AGACAGGACG CATCGACTGG CAGAGCGTCC

851 AAACCCGCCT CATCAGCGAC GACCCTGCAA AAGGACTCGA CCGCGACCGC

901 CGCAAACCGC CGATTGCCGG GCGGCTGCAA GACGCGCTCA ACAGCCCGA

951 AAAAAGCGTC TATCTGGTTT CACCCTATTT CGTCCCCACA AAATCCGGCA

1001 CAGACGCACT GGCAAAACTG GTGCAGGACG GCATAGACGT TACCGTCCTG

1051 ACCAACTCGC TACAGGCGAC CGACGTTGCC GCCGTCCATT CCGGCTATGT

1101 CAAATACCGA AAACCGCTGC TCAAAGCCGG CATCAAACTC TACGAGCTGC

1151 AACCCAACCA TGCCGTCCCT GCCACAAAAG ACAAAGGCCT GACCGGCAGC

1201 TCCGTAACCA GCCTGCATGC CAAAACCTTC ATTGTGGACG GCAAACGCAT

1251 CTTCATCGGC TCATTCAACC TCGACCCCCG TTCCGCACGG CTCAATACTG

1301 AAATGGGCGT TGTTATCGAA AGCCCCAAAA TCGCAGAACA GATGGAGCGC

1351 ACCCTTGCCG ATACCTCACC CGAATACGCC TACCGCGTTA CCCTCGACAG

1401 GCACAACCGC CTGCAATGGC ACGATCCCGC CACCCGAAAA ACCTACCCGA

1451 ACGAACCCGA AGCCAAACTT TGGAAACGCA TCGCCGCAAA AATCCTATCC

1501 CTGCTGCCCA TAGAAAGTTT ATTATAG
```

This corresponds to the amino acid sequence <SEQ ID 550; ORF 2978.a>:

```
a987.pep

1 MKTRSLISLL CLLLCSCSSW LPPLEERTES RHFNTSKPVR LDNILQIRHT

51 PHTNGLSDIY LLNDPHEAFA ARAALIESAE HSLDLQYYIW RNDISGRLLF

101 NLVYLAAERG VRVRLLLDDN NTRGLDDLLL ALDSHPNIEV RLFNPFVLRK

151 WRALGYLTDF PRLNRRMHNK SFTADNRATI LGGRNIGDEY FKVGEDTVFA

201 DLDILATGSV VGEVSHDFDR YWASHSAHNA TRIIRSGNIG KGLQALGYND

251 ETSRHALLRY RETVEQSPLY QKIQTGRIDW QSVQTRLISD DPAKGLDRDR

301 RKPPIAGRLQ DALKQPEKSV YLVSPYFVPT KSGTDALAKL VQDGIDVTVL

351 TNSLQATDVA AVHSGYVKYR KPLLKAGIKL YELQPNHAVP ATKDKGLTGS

401 SVTSLHAKTF IVDGKRIFIG SFNLDPRSAR LNTEMGVVIE SPKIAEQMER

451 TLADTSPEYA YRVTLDRHNR LQWHDPATRK TYPNEPEAKL WKRIAAKILS

501 LLPIESLL* m987/a987  98.8% identity in 508 aa overlap 10         20         30         40         50         60
m987.pep  MKTRSLISLLCLLLCSCSSWLPPLEERTESRHFNTSKPVRLDNILQIRHTPHTNGLSDIY
          ||||||||||||||||||||||||||||||||||||||||||||||||||||||||||||
a987      MKTRSLISLLCLLLCSCSSWLPPLEERTESRHFNTSKPVRLDNILQIRHTPHTNGLSDIY
                 10         20         30         40         50         60

70         80         90        100        110        120
m987.pep  LLNDPHEAFAARAALIESAEHSLDLQYYIWRNDISGRLLFNLVYLAAERGVRVRLLLDDN
          ||||||||||||||||||||||||||||||||||||||||||||||||||||||||||||
a987      LLNDPHEAFAARAALIESAEHSLDLQYYIWRNDISGRLLFNLVYLAAERGVRVRLLLDDN
                 70         80         90        100        110        120

130        140        150        160        170        180
m987.pep  NTRGLDDLLLALDSHPNIEVRLFNPFVLRKWRALGYLTDFPRLNRRMHNKSFTADNRATI
          ||||||||||||||||||||||||||||||||||||||||||||||||||||||||||||
a987      NTRGLDDLLLALDSHPNIEVRLFNPFVLRKWRALGYLTDFPRLNRRMHNKSFTADNRATI
                130        140        150        160        170        180

190        200        210        220        230        240
m987.pep  LGGRNIGDEYFKVGEDTVFADLDILATGSVVGEVSHDFDRYWASHSAHNATRIIRSGDIG
          |||||||||||||||||||||||||||||||||||||||||||||||||||||||||:||
a987      LGGRNIGDEYFKVGEDTVFADLDILATGSVVGEVSHDFDRYWASHSAHNATRIIRSGNIG
                190        200        210        220        230        240
```

-continued

```
                   250        260        270        280        290        300
m987.pep   KGLQALGYNDETSRHALLRYRETVEQSPLYQKIQTGCIDWQSVRTRLISDDPAKGLDRDR
           ||||||||||||||||||||||||||||||||||| ||||:||||||||||||||||||
a987       KGLQALGYNDETSRHALLRYRETVEQSPLYQKIQTGRIDWQSVQTRLISDDPAKGLDRDR
                   250        260        270        280        290        300

310        320        330        340        350        360
m987.pep   RKPPIAGRLQDALKQPEKSVYLVSPYFVPTKSGTDALAKLVQDGIDVTVLTNSLQATDVA
           ||||||||||||||||||||||||||||||||||||||||||||||||||||||||||||
a987       RKPPIAGRLQDALKQPEKSVYLVSPYFVPTKSGTDALAKLVQDGIDVTVLTNSLQATDVA
                   310        320        330        340        350        360

370        380        390        400        410        420
m987.pep   AVHSGYVKYRKPLLKAGIKLYELQPNHAVPATKDKGLTGSSVTSLHAKTFIVDGKRIFIG
           ||||||||||||||||||||||||||||||||||||||||||||||||||||||||||||
a987       AVHSGYVKYRKPLLKAGIKLYELQPNHAVPATKDKGLTGSSVTSLHAKTFIVDGKRIFIG
                   370        380        390        400        410        420

430        440        450        460        470        480
m987.pep   SFNLDPRSARLNTEMGVVIESPKIAEQMERTLADTTPAYAYRVTLDRHNRLQWHDPATRK
           |||||||||||||||||||||||||||||||||||:|||||||||||||||||||||||
a987       SFNLDPRSARLNTEMGVVIESPKIAEQMERTLADTSPEYAYRVTLDRHNRLQWHDPATRK
                   430        440        450        460        470        480

490        500      509
m987.pep   TYPNEPEAKLWKRIAAKILSLLPIEGLLX
           |||||||||||||||||||||||:|||
a987       TYPNEPEAKLWKRIAAKILSLLPIESLLX
                   490        500
```

The following partial DNA sequence was identified in *N. gonorrhoeae* <SEQ ID 2979>:

```
g988.seq
    1 ATGAATAAAA ATATTAAATC TTTAAATTTA CGGGAAAAAG ACCCGTTTTT

51 AAGTCGTGAA AAACAGCGTT ATGAACATCC TTTGCCCAGT CGGgaATGGA

101 TAATCGAATT GTTGGAGCGC AAAGGTGTGC CTTCAAAAAT CGAATCGCTT

151 GCACGCGAGC TGTCGATTAC GGAAGacgag tATGTCTTTT TTGAACGCCG

201 TCTGAaggCG atgGCGCGGG AcggtCAGGT TTTAATCAAC CGCCgaggcg

251 CagtTTGCGc gGCggacaag ctgGATTTGG TCAAATGccg Cgtcgaggcg 301 catAAgGAcg gtttcggctt cgcCGTGCCG CTCATGCCGA TGGACGAAGG 351 GGATTTCGTT TTATACGAAC GCCAgatgcg tggTGtcatG CAcggcgaca 401 ccgttACCGT CCGTCCTGCg ggtatggaCC GCAGGGGccg ccgcGAAggg 451 acgtttctGG ATATTGTCGA ACGCGCGCAA AGCAAAGTTG TCGGCCGTTT

501 CTATATGGAT AGGGGCGTGG CGATTTTGGA GCCGGAAGAC AAGCGTCTGA

551 ACCAAAGCAT CGTGTTGGAA CCCGACGGCG TGGCGCGTTT CAAACCCGAA

601 TCCGGTCAGG TTATCGTCGG CAAAATTGAG GTTTATCCCG AGCAAAACCG

651 GCCTGCAGTG GCAAAAATCA TTGAAGTTTT GGGCGATTAT GCCGACAGCG

701 GGATGGAAAt cgAAATTGCC GTGCGCAAGC ATCATTTGCC GCAccgaTTC

751 AGTGAAgcgt gtGcCAAATC CGcgaaAAAA ATtcccgacc ATGTACGCAA

801 AAGCGATTTG AAAGGCCGCG TCGATTTGTG CGACCTTCCT TTGGTAACGA

851 TAGACGGCGA AACGGCGCGC GATTTCGACG ACGCGGTGTT TGCCGAAAAA

901 GTCGGACGCA ATTACCGCCT GGTCGTGGCG ATTGCGGATG TCAGCCATTA

951 TGTCCGCCCT GACGATGCGA TTGATGCAGA TGCTCAAGAA CGCAGTACCA

1001 GCGTGTATTT CCCGCGCCGT ATGATTCCGA TGCTGCCGGA AAACCTGTCC

1051 AACGGCATCT GCTCGCTCAA TCCCGATGTC GAGCGTTTGT GTATGGTGTG

1101 CGATATGGTC GTTACCTATG CGGGCAATAT CAAAGAATAC CGCTTCTATC

1151 CCGCCGTGAT GCGCTCTCAT GCCCGCCTGA CCTACAACCA AGTTTGGAAA
```

```
1201 TGGCTTTCAG ACGGCATCGG GAATCCGCAC AAAGCCCAAA TCGACACGCT

1251 TTACAAGCTG TTTAAAATTT TGCAGAAAAA ACGTCTGGCG CGCGGGGCGG

1301 TGGAGTTTGA AAGCGTCGAA ACCCAGATGA TTTTCGACGA CAACGGCAAA

1351 ATCGAAAAAA TTGTCCCCGT CGTCCGCAAC gatGCCCACA AGCTGATTGA

1401 AGAATGTATG CTGGCGGCGA ATGTTTGCGC GGCGGATTTT CTGTTGAAAA

1451 ACAAACATAC GGCTTTGTTC CGCAACCATT TGGGCCCCAC GCCCGAAAAA

1501 CTCGCCACCC TGCGCGAGCA GCTCGGTCTG TTGGGGCTTC AACTTGGCGG

1551 CGGCGACAAC CCGTCGCCGA AAGACTATGC CGCGCTTGCC GAACAATTCA

1601 AAGGCAGGCC GGATGCCGAA TTGCTGCAAG TCATGATGTT GCGCTCCATG

1651 CAGCAGGCGG TTTACGAACC GCATTGCGAA GGGCATTTCG GTTTGGCTTA

1701 TGAAGCATAC GCCCACTTTA CCTCGCCCAT CCGCCGCTAT CCCGACCTGA

1751 CCGTCCACCG TGCCATCAAA GCCGTATTGA ACCGGAAAAC CTACACGCCA

1801 AACAAAAGCT GGCAGGCTTT GGGCGTGCAT ACTTCGTTTT GCGAACGCCG

1851 TGCCGACGAT GCTGGCCGCG ATGTGGAAAA CTGGCTGAAA ACTTATTATA

1901 TGCGCGATAA GGTCGGTGAA ATATTTGAAG GcaaaatCtc ccggggtgtg 1951 gcaaaTtttg gaATATTTGT CACTTTGGAC GATATccata tcgacggtct 2001 ggtacaTATC AGCGatttgg gcgaAGATTA TTTCaacttc cgccccgAAA

2051 TCATGGCAAT CGAAGGCGAA CGCAGCGGCA TCCGTTTCAA TATGGGGGAC

2101 AGGGTTGCCG TCCGGGTCGC GCGTGCCGAT TTGGATGATG GAAAAATCGA

2151 CTTTGTCCTA ATTGCCGGAG AAAGCGGCAG GCGGCGGAAG GTCAAATTAT

2201 CCGCATCTGC CAAACCGGCA GGGGCGGCGG GGAAAGGGAA ATCGAAAACC

2251 ACCGCCGAGA AAAAACAGC CCGATGCGGC AAAGTAAGGG GAAGGGGCGT

2301 GCCTGCCGTT GCCGAATCGG GGAAAAAGGC AAAGAAACCG GTTCCGATTA

2351 AGGTCAAAAA ACGGAAAGGC AAATCATAA
```

This corresponds to the amino acid sequence <SEQ ID 2980; ORF 988.ng>:

```
g988.pep
  1 MNKNIKSLNL REKDPFLSRE KQRYEHPLPS REWIIELLER KGVPSKIESL

51 ARELSITEDE YVFFERRLKA MARDGQVLIN RRGAVCAADK LDLVKCRVEA

101 HKDGFGFAVP LMPMDEGDFV LYERQMRGVM HGDTVTVRPA GMDRRGRREG

151 TFLDIVERAQ SKVVGRFYMD RGVAILEPED KRLNQSIVLE PDGVARFKPE

201 SGQVIVGKIE VYPEQNRPAV AKIIEVLGDY ADSGMEIEIA VRKHHLPHRF

251 SEACAKSAKK IPDHVRKSDL KGRVDLCDLP LVTIDGETAR DFDDAVFAEK

301 VGRNYRLVVA IADVSHYVRP DDAIDADAQE RSTSVYFPRR MIPMLPENLS

351 NGICSLNPDV ERLCMVCDMV VTYAGNIKEY RFYPAVMRSH ARLTYNQVWK

401 WLSDGIGNPH KAQIDTLYKL FKILQKKRLA RGAVEFESVE TQMIFDDNGK

451 IEKIVPVVRN DAHKLIEECM LAANVCAADF LLKNKHTALF RNHLGPTPEK

501 LATLREQLGL LGLQLGGGDN PSPKDYAALA EQFKGRPDAE LLQVMMLRSM

551 QQAVYEPHCE GHFGLAYEAY AHFTSPIRRY PDLTVHRAIK AVLNRKTYTP

601 NKSWQALGVH TSFCERRADD AGRDVENWLK TYYMRDKVGE IFEGKISRGV
```

-continued

```
651 ANFGIFVTLD DIHIDGLVHI SDLGEDYFNF RPEIMAIEGE RSGIRFNMGD
701 RVAVRVARAD LDDGKIDFVL IAGESGRRRK VKLSASAKPA GAAGKGKSKT
751 TAEKKTARCG KVRGRGVPAV AESGKKAKKP VPIKVKKRKG KS*
```

The following partial DNA sequence was identified in *N. meningitidis* <SEQ ID 2981>:

```
m988.seq (partial)
   1 ..ACAGTTCTGG ATATTGTCGA ACGCGCGCAA AGCAAAGTGG TCGGCCGTTT
  51   CTATATGGAT AGGGGCGTGG CGATTTTGGA GCCGGAAGAC AAGCGTCTGA
 101   ACCAAAGCAT CGTATTGGAA CCGGACGGCG TGGCGCGTTT CAAACCTGAA
 151   TCCGGTCAGG TCATCGTCGG CGAAATTGAG GTTTATCCTG AGCAAAACCG
 201   GCCGGCAGTG GCAAAAATCA TCGAAGTTTT GGGCGATTAT GCCGACAGCG
 251   GCATGGAGAT TGAAATTGCC GTGCGCAAGC ATCATTTGCC GCACCAATTC
 301   AGTGAAGCGT GTGCCAAAGC TGCGAAAAAA ATTCCCGTCC ATGTACGCAA
 351   AAGCGATTTG AAAGGCCGCG TCGATTTGCG CGACCTGCCT TTGGTAACGA
 401   TAGACGGCGA AACGGCGCGC GATTTCGACG ACGCGGTGTT TGCCGAAAAA
 451   GTCGGACGCA ATTACCGTCT GGTCGTGGCG ATTGCGGATG TCAGCCATTA
 501   TGTCCGCCCT GACGATGTGA TTGATGCAGA TGCTCAAGAA CGCAGTACCA
 551   GCGTATATTT CCCGCGCCGT GTGATTCCGA TGCTGCCGGA AAACCTGTCT
 601   AACGGCATTT GCTCGCTCAA TCCCGATGTC GAGCGTTTGT GTATGGTGTG
 651   CGATATGGTC GTTACCTATG CGGGCAATAT CAAAGAATAC CGCTTCTACC
 701   CCGCCGTAAT GCGCTCTCAT GCCCGCCTGA CCTACAACCA AGTTTGGAAA
 751   TGGATTTCAG ACGGCATCGA CCATCCGTAC AAAGCCCAAA TCGACACCCT
 801   TTACAAACTC TTCAAAATCC TTCAGAAAAA GCGTTTCGAA CGCGGCGCGG
 851   TGGAGTTTGA AAGCGTCGAA ACCCAGATGA TTTTCGATGA CAACGGCAAA
 901   ATCGAAAAAA TCGTCCCCGT TGTCCGCAAC GATGCCCACA AGCTGATTGA
 951   AGAATGTATG CTGGCGGCGA ATGTTTGCGC AGCGGATTTC CTGTTGAAAA
1001   ACAAGCATAC GGCTTTGTTC CGCAACCATT TGGGCCCCAC GCCCGAAAAA
1051   CTCGCCACCC TGCGCGAGCA GCTCGGTCTG TTGGGGCTTC AACTTGGCGG
1101   CGGCGACAAC CCGTCGCCGA AAGACTATGC CGCGCTTGTC GAACAATTCA
1151   AAGGCAGACC TGATGCCGAA TTGCTGCAAG TCATGATGTT GCGCTCCATG
1201   CAGCAGGCGG TTTACGAACC GCATTGCGAC GGACACTTTG GTCTTGCCTA
1251   CGAAGCATAC GCCCACTTCA CCTCGCCCAT CCGCCGCTAT CCCGACCTGA
1301   CCGTACACCG CGCCATCAAA GCCGTGTTGA ATCAGCAAAC CTACACGCCA
1351   AAAAAAGCT GGCAGGCTTT GGGCGTGCAT ACCTCGTTCT GTGAGCGCCG
1401   TGCCGACGAC GCCAGCCGCG ACGTGGAAAA CTGGCTGAAA ACCTATTATA
1451   TGCGCGATAA GGTCGGCGAA GTATTCGAAG GTAAAATCTC CGGCATGACC
1501   AGTTTTGGTA TCTTTGTAAC ACTGGACGGC ATCCACATTG ACGGCTTGGT
1551   GCATATCAGC GATTTGGGCG AAGACTATTT CAACTTCCGC CCCGAAATCA
1601   TGGCAATCGA AGGCGAACGC AGCGGCATCC GTTTCAACAT GGGGGACAGG
1651   GTTGCCGTCC GGGTCGCCCG TGCCGATTTG GATGACGGAA AAATCGATTT
```

-continued

```
1701    TGTCCTGATT GCCGGGGGA GCGGCAGGGG GCGGAAAGTT AAATCATCCG

1751    CGTCTGCCAA ACCGGCAGGG ACGGCGGGGA AAGGGAAGCC GAAAACCGCC

1801    GCCGAGAAAA AAACAGCCCG AGGCGGCAAA GTAAGGGGAA GGGGCGCGTC

1851    TGCCGCCGCA GAATCGAGGA AAAAGGCAAA GAAACCGGTT CCGATTAAGG

1901    TAAAAAAACG GAAAGGCAAA TCATAA
```

This corresponds to the amino acid sequence <SEQ ID 2982; ORF 988>:

```
m988.pep (partial)
  1  ..TVLDIVERAQ SKVVGRFYMD RGVAILEPED KRLNQSIVLE PDGVARFKPE

51    SGQVIVGEIE VYPEQNRPAV AKIIEVLGDY ADSGMEIEIA VRKHHLPHQF

101    SEACAKAAKK IPVHVRKSDL KGRVDLRDLP LVTIDGETAR DFDDAVFAEK

151    VGRNYRLVVA IADVSHYVRP DDVIDADAQE RSTSVYFPRR VIPMLPENLS

201    NGICSLNPDV ERLCMVCDMV VTYAGNIKEY RFYPAVMRSH ARLTYNQVWK

251    WISDGIDHPY KAQIDTLYKL FKILQKKRFE RGAVEFESVE TQMIFDDNGK

301    IEKIVPVVRN DAHKLIEECM LAANVCAADF LLKNKHTALF RNHLGPTPEK

351    LATLREQLGL LGLQLGGGDN PSPKDYAALV EQFKGRPDAE LLQVMMLRSM

401    QQAVYEPHCD GHFGLAYEAY AHFTSPIRRY PDLTVHRAIK AVLNQQTYTP

451    KKSWQALGVH TSFCERRADD ASRDVENWLK TYYMRDKVGE VFEGKISGMT

501    SFGIFVTLDG IHIDGLVHIS DLGEDYFNFR PEIMAIEGER SGIRFNMGDR

551    VAVRVARADL DDGKIDFVLI AGGSGRGRKV KSSASAKPAG TAGKGKPKTA

601    AEKKTARGGK VRGRGASAAA ESRKKAKKPV PIKVKKRKGK S*
```

Computer analysis of this amino acid sequence gave the following results:
Homology with a Predicted ORF from *N. gonorrhoeae*

```
    m988/g988  94.2% identity in 642 aa overlap 10         20         30
    m988.pep                        TVLDIVERAQSKVVGRFYMDRGVAILEPED
                                    ||||||||||||||||||||||||||||||
    g988        LYERQMRGVMHGDTVTVRPAGMDRRGRREGTFLDIVERAQSKVVGRFYMDRGVAILEPED
                     130        140        150        160        170        180

40         50         60         70         80         90
    m988.pep    KRLNQSIVLEPDGVARFKPESGQVIVGEIEVYPEQNRPAVAKIIEVLGDYADSGMEIEIA
                ||||||||||||||||||||||||||||:|||||||||||||||||||||||||||||||
    g988        KRLNQSIVLEPDGVARFKPESGQVIVGKIEVYPEQNRPAVAKIIEVLGDYADSGMEIEIA
                     190        200        210        220        230        240

100        110        120        130        140        150
    m988.pep    VRKHHLPHQFSEACAKAAKKIPVHVRKSDLKGRVDLRDLPLVTIDGETARDFDDAVFAEK
                ||||||||:|||||||:|||||:||||||||||||||||||| |||||||||||||||||
    g988        VRKHHLPHRFSEACAKSAKKIPDHVRKSDLKGRVDLCDLPLVTIDGETARDFDDAVFAEK
                     250        260        270        280        290        300

160        170        180        190        200        210
    m988.pep    VGRNYRLVVAIADVSHYVRPDDVIDADAQERSTSVYFPRRVIPMLPENLSNGICSLNPDV
                |||||||||||||||||||||:||||||||||||||||||:|||||||||||||||||||
    g988        VGRNYRLVVAIADVSHYVRPDDAIDADAQERSTSVYFPRRMIPMLPENLSNGICSLNPDV
                     310        320        330        340        350        360

220        230        240        250        260        270
    m988.pep    ERLCMVCDMVVTYAGNIKEYRFYPAVMRSHARLTYNQVWKWISDGIDHPYKAQIDTLYKL
                ||||||||||||||||||||||||||||||||||||||||:||||:|:||||||||||||
    g988        ERLCMVCDMVVTYAGNIKEYRFYPAVMRSHARLTYNQVWKWLSDGIGNPHKAQIDTLYKL
                     370        380        390        400        410        420

280        290        300        310        320        330
    m988.pep    FKILQKKRFERGAVEFESVETQMIFDDNGKIEKIVPVVRNDAHKLIEECMLAANVCAADF
                ||||||||:|||||||||||||||||||||||||||||||||||||||||||||||||||
    g988        FKILQKKRLARGAVEFESVETQMIFDDNGKIEKIVPVVRNDAHKLIEECMLAANVCAADF
                     430        440        450        460        470        480
```

-continued

```
                     340       350       360       370       380       390
m988.pep      LLKNKHTALFRNHLGPTPEKLATLREQLGLLGLQLGGGDNPSPKDYAALVEQFKGRPDAE
              |||||||||||||||||||||||||||||||||||||||||||||||||:||||||||||
g988          LLKNKHTALFRNHLGPTPEKLATLREQLGLLGLQLGGGDNPSPKDYAALAEQFKGRPDAE
                     490       500       510       520       530       540

400       410       420       430       440       450
m988.pep      LLQVMMLRSMQQAVYEPHCDGHFGLAYEAYAHFTSPIRRYPDLTVHRAIKAVLNQQTYTP
              |||||||||||||||||||:||||||||||||||||||||||||||||||||||::||||
g988          LLQVMMLRSMQQAVYEPHCEGHFGLAYEAYAHFTSPIRRYPDLTVHRAIKAVLNRKTYTP
                     550       560       570       580       590       600

460       470       480       490       500       509
m988.pep      KKSWQALGVHTSFCERRADDASRDVENWLKTYYMRDKVGEVFEGKIS-GMTSFGIFVTLD
              :||||||||||||||||||||:||||||||||||||||||:|||||| |:::||||||||
g988          NKSWQALGVHTSFCERRADDAGRDVENWLKTYYMRDKVGEIFEGKISRGVANFGIFVTLD
                     610       620       630       640       650       660

510       520       530       540       550       560      569
m988.pep      GIHIDGLVHISDLGEDYFNFRPEIMAIEGERSGIRFNMGDRVAVRVARADLDDGKIDFVL
               |||||||||||||||||||||||||||||||||||||||||||||||||||||||||||
g988          DIHIDGLVHISDLGEDYFNFRPEIMAIEGERSGIRFNMGDRVAVRVARADLDDGKIDFVL
                     670       680       690       700       710       720

570       580       590       600       610       620      629
m988.pep      IAGGSGRGRKVKSSASAKPAGTAGKGKPKTAAEKKTARGGKVRGRGASAAAESRKKAKKP
              ||| ||| |||| ||||||||:||||| ||:||||||| |||||||: |:||| ||||||
g988          IAGESGRRRKVKLSASAKPAGAAGKGKSKTTAEKKTARCGKVRGRGVPAVAESGKKAKKP
                     730       740       750       760        70       780

630       640
m988.pep      VPIKVKKRKGKSX
              |||||||||||||
g988          VPIKVKKRKGKSX
                     790
```

The following partial DNA sequence was identified in *N. meningitidis* <SEQ ID 2983>:

```
a988.seq
   1 ATGAATAAAA ATATTAAATC TTTAAATTTA CGGGAAAAAG ACCCGTTTTT

51 AAGTCGTGAA AAACAGCGTT ATGAACATCC TTTGCCCAGT CGGGAATGGA

101 TAATCGAGCT GCTTGAACGT AAAGGCGTAC CATCCAAGAT TGAAGCTTTG

151 GTACGCGAAT TGTCGATTAA GGAAGAAGAG TACGAATTTT TCGAACGTCG

201 TCTGAAGGCG ATGGCGCGGG ACGGTCAGGT TTTAATCAAC CGTCGGGGCG

251 CGGTTTGCGC GGCGGACAAA TTGGATTTGG TCAAATGCCG TGTCAAGGCG

301 CACAAAGACC GCTTCGGTTT CGCCGTGCCG CTCACGCCCG CCAAAGACGG

351 TGATTTTGTC TTGTACGAAC GCCAGATGCG CGGCATTATG CACGGCGATA

401 TTGTCACTGT TCGTCCTGCC GGCATGGACG GTAGGGGCCG CCGCGAAGGG

451 ACGGTTCTGG ATATTGTCGA ACGCGCGCAA AGCAAAGTGG TCGGCCGTTT

501 CTANATGGAT AGGGGCGTGG CGATTTTGGA GCCGGAAGAC AAGCGTCTGA

551 ACCAAAGCAT CGTATTGGAA CCGGACGGCG TGGCGCGTTT CAAACCTGAA

601 TCCGGTCAGG TCATCGTCGG CGAAATTGAG GTTTATCCTG AGCAAAACCG

651 GCCGGCAGTG GCAAAAATCA TCGAAGTTTT GGGCGATTAT GCCGACAGCG

701 GCATGGAGAT TGAAATTGCC GTGCGCAAGC ATCATTTGCC GCACCAATTC

751 AGTGAAGCGT GTGCCAAAGC CGCGAAAAAA ATTCCCGACC ATGTACGCAA

801 AAGCGATTTG AAAGGCCGCG TCGATTTGCG CGACCTGCCT TTGGTAACGA

851 TAGACGGCGA AACGGCTCGA GATTTTGACG ATGCGGTGTT TGCCGAGAAA

901 ATCGGACGCA ATTACCGTCT GGTCGTGGCG ATTGCCGATG TCAGCCATTA

951 TGTCCGCCCC GATGACGCTA TCGACACGGA CGCTCAGGAA CGCAGCACCA

1001 GTGTTTACTT CCCGCGCCGC GTGATTCCCA TGTTGCCGGA AAACTGTCC
```

```
-continued
1051 AACGGCATCT GCTCGCTCAA TCCTCATGTC GAGCGTTTGT GTGTGGTGTG

1101 CGATATGGTT ATCACTTACG CGGGCAATAT CAAAGAATAC CGCTTCTACC

1151 CCGCCGTGAT GCGCTCTCAT GCCCGCCTGA CCTACAACCA AGTTTGGAAA

1201 TGGCTTTCAG GCGGCATCGA GCATCCGTTC AAAACCCAAA TCGACACGCT

1251 TTACAAACTC TTCAAAATCC TTCAGAAAAA GCGTTTCGAA CGCGGGGCGG

1301 TGGAGTTTGA CAGCATCGAA ACCCAAATGC TTTTCGACGA CAACGGTAAA

1351 ATTGAAAAAA TCGTCCCCGT TGTCCGCAAC GATGCCCACA AGCTGATTGA

1401 AGAATGTATG TTGGCGGCAA ACGTTTGCGC AGCGGATTTT CTGTTGAAAA

1451 ACAAGCATAC CGCATTGTTC CGCAACCATT TGGGGCCCAC GCCCGAAAAA

1501 CTCGCCGCCT TGCGCGAGCA GCTCGGTCTG TTGGGGCTTC AACTTGGCGG

1551 CGGCGACAAC CCGTCGCCGA AGACTATGC CGCGCTTGCC GGACAGTTCA

1601 AAGGCAGGCC GGATGCCGAA TTGCTGCAAG TCATGATGTT GCGCTCCATG

1651 CAACAGGCGG TTTACGAACC GCATTGCGAC GGACACTTTG GTCTTGCCTA

1701 CGAAGCATAC GCCCACTTCA CCTCGCCCAT CCGCCGCTAT CCCGACCTGA

1751 CCGTACACCG CGCCATCAAA GCCGTGTTGA ATCAGCAAAC CTACACGCCA

1801 AAAAAAGCT GGCAGGCTTT GGGCGTGCAT ACCTCGTTCT GTGAGCGCCG

1851 TGCCGACGAC GCCAGCCGCG ACGTGGAAAA CTGGCTGAAA ACCTATTATA

1901 TGCGCGATAA GGTCGGCGAA GTATTCGAAG GTAAAATCTC CGGCATGACC

1951 AGTTTTGGTA TCTTTGTAAC ACTGGACGGC ATCCACATTG ACGGCTTGGT

2001 GCATATCAGC GATTTGGGCG AAGACTATTT CAACTTCCGC CCCGAAATCA

2051 TGGCAATCGA AGGCGAACGC AGCGGCATCC GTTTCAACAT GGGGGACAGG

2101 GTTGCCGTCC GGGTCGCCCG TGCCGATTTG GATGACGGAA AAATCGATTT

2151 TGTCCTGATT GCCGGGGGGA GCGGCAGGGG GCGGAAAGTT AAATCATCCG

2201 CGTCTGCCAA ACCGGCAGGG ACGGCGGGGA AAGGGAAGCC GAAAACCGCC

2251 GCCGAGAAAA AAACAGCCCG AGGCGGCAAA GTAAGGGGAA GGGGCGCGTC

2301 TGCCGCCGCA GAATCGAGGA AAAGGCAAA GAAACCGGTT CCGATTAAGG

2351 TAAAAAAACG GAAAGGCAAA TCATAA
```

This corresponds to the amino acid sequence <SEQ ID 2984; ORF 988.a>:

```
a988.pep

1 MNKNIKSLNL REKDPFLSRE KQRYEHPLPS REWIIELLER KGVPSKIEAL

51 VRELSIKEEE YEFFERRLKA MARDGQVLIN RRGAVCAADK LDLVKCRVKA

101 HKDRFGFAVP LTPAKDGDFV LYERQMRGIM HGDIVTVRPA GMDGRGRREG

151 TVLDIVERAQ SKVVGRFXMD RGVAILEPED KRLNQSIVLE PDGVARFKPE

201 SGQVIVGEIE VYPEQNRPAV AKIIEVLGDY ADSGMEIEIA VRKHHLPHQF

251 SEACAKAAKK IPDHVRKSDL KGRVDLRDLP LVTIDGETAR DFDDAVFAEK

301 IGRNYRLVVA IADVSHYVRP DDAIDTDAQE RSTSVYFPRR VIPMLPENLS

351 NGICSLNPHV ERLCVVCDMV ITYAGNIKEY RFYPAVMRSH ARLTYNQVWK

401 WLSGGIEHPF KTQIDTLYKL FMILQKKRFE RGAVEFDSIE TQMLFDDNGK

451 IEKIVPVVRN DAHKLIEECM LAANVCAADF LLKNKHTALF RHNLGPTPEK
```

-continued

```
501 LAALREQLGL LGLQLGGGDN PSPKDYAALA GQFKGRPDAE LLQVMMLRSM

551 QQAVYEPHCD GHFGLAYEAY AHFTSPIRRY PDLTVHRAIK AVLNQQTYTP

601 KKSWQALGVH TSFCERRADD ASRDVENWLK TYYMRDKVGE VFEGKISGMT

651 SFGIFVTLDG IHIDGLVHIS DLGEDYFNFR PEIMAIEGER SGIRFNMGDR

701 VAVRVARADL DDGKIDFVLI AGGSGRGRKV KSSASAKPAG TAGKGKPKTA

751 AEKKTARGGK VRGRGASAAA ESRKKAKKPV PIKVKKRKGK S*
``` m988/a988 97.0% identity in 641 aa overlap

```
                              10          20          30
m988.pep                      TVLDIVERAQSKVVGRFYMDRGVAILEPED
                              ||||||||||||||||||| |||||||||
a986       LYERQMRGIMHGDIVTVRPAGMDGRGRREGTVLDIVERAQSKVVGRFXMDRGVAILEPED
                 130         140         150         160         170         180

40          50          60          70          80          90
m988.pep   KRLNQSIVLEPDGVARFKPESGQVIVGEIEVYPEQNRPAVAKIIEVLGDYADSGMEIEIA
           ||||||||||||||||||||||||||||||||||||||||||||||||||||||||||||
a988       KRLNQSIVLEPDGVARFKPESGQVIVGEIEVYPEQNRPAVAKIIEVLGDYADSGMEIEIA
                 190         200         210         220         230         240

100         110         120         130         140         150
m988.pep   VRKHHLPHQFSEACAKAAKKIPVHVRKSDLKGRVDLRDLPLVTIDGETARDFDDAVFAEK
           ||||||||||||||||||||| ||||||||||||||||||||||||||||||||||||||
a988       VRKHHLPHQFSEACAKAAKKIPDHVRKSDLKGRVDLRDLPLVTIDGETARDFDDAVFAEK
                 250         260         270         280         290         300

160         170         180         190         200         210
m988.pep   VRGNYRLVVAIADVSHYVRPDDVIDADAQERSTSVYFPRRVIPMLPENLSNGICSLNPDV
           :|||||||||||||||||||||:||:|||||||||||||||||||||||||||||||| |
a988       IGRNYRLVVAIADVSHYVRPDDAIDTDAQERSTSVYFPRRVIPMLPENLSNGICSLNPHV
                 310         320         330         340         350         360

220         230         240         250         260         270
m988.pep   ERLCMVCDMVVTYAGNIKEYRFYPAVMRSHARLTYNQVWKWISDGIDHPYKAQIDTLYKL
           ||||:|||||:|||||||||||||||||||||||||||||||:|| :||:|:||||||||
a988       ERLCVVCDMVITYAGNIKEYRFYPAVMRSHARLTYNQVWKWLSGGIEHPFKTQIDTLYKL
                 370         380         390         400         410         420

280         290         300         310         320         330
m988.pep   FKILQKKRFERGAVEFESVETQMIFDDNGKIEKIVPVVRNDAHKLIEECMLAANVCAADF
           ||||||||||||||||:|:||||:||||||||||||||||||||||||||||||||||||
a988       FKILQKKRFERGAVEFDSIETQMLFDDNGKIEKIVPVVRNDAHKLIEECMLAANVCAADF
                 430         440         450         460         470         480

340         350         360         370         380         390
m988.pep   LLKNKHTALFRNHLGPTPEKLATLREQLGLLGLQLGGGDNPSPKDYAALVEQFKGRPDAE
           ||||||||||||||||||||||:|||||||||||||||||||||||||||:|||||||||
a988       LLKNKHTALFRNHLGPTPEKLAALREQLGLLGLQLGGGDNPSPKDYAALAGQFKGRPDAE
                 490         500         510         520         530         540

400         410         420         430         440         450
m988.pep   LLQVMMLRSMQQAVYEPHCDGHFGLAYEAYAHFTSPIRRYPDLTVHRAIKAVLNQQTYTP
           ||||||||||||||||||||||||||||||||||||||||||||||||||||||||||||
a988       LLQVMMLRSMQQAVYEPHCDGHFGLAYEAYAHFTSPIRRYPDLTVHRAIKAVLNQQTYTP
                 550         560         570         580         590         600

460         470         480         490         500         510
m988.pep   KKSWQALGVHTSFCERRADDASRDVENWLKTYYMRDKVGEVFEGKISGMTSFGIFVTLDG
           ||||||||||||||||||||||||||||||||||||||||||||||||||||||||||||
a988       KKSWQALGVHTSFCERRADDASRDVENWLKTYYMRDKVGEVFEGKISGMTSFGIFVTLDG
                 610         620         630         640         650         660

520         530         540         550         560         570
m988.pep   IHIDGLVHISDLGEDYFNFRPEIMAIEGERSGIRFNMGDRVAVRVARADLDDGKIDFVLI
           ||||||||||||||||||||||||||||||||||||||||||||||||||||||||||||
a988       IHIDGLVHISDLGEDYFNFRPEIMAIEGERSGIRFNMGDRVAVRVARADLDDGKIDFVLI
                 670         680         690         700         710         720

580         590         600         610         620         630
m988.pep   AGGSGRGRKVKSSASAKPAGTAGKGKPKTAAEKKTARGGKVRGRGASAAAESRKKAKKPV
           ||||||||||||||||||||||||||||||||||||||||||||||||||||||||||||
a988       AGGSGRGRKVKSSASAKPAGTAGKGKPKTAAEKKTARGGKVRGRGASAAAESRKKAKKPV
                 730         740         750         760         770         780

640
m988.pep   PIKVKKRKGKSX
           ||||||||||||
a988       PIKVKKRKGKSX
                 790
```

The following partial DNA sequence was identified in *N. gonorrhoeae* <SEQ ID 2985>:

```
g989.seq
    1 ATGACCCCTT TCACACTGAA AAAAACCGTC CTGCTGCTCG GCACTGCCTT

51 TGCCGCCGCA TCTGTCCACG CATCCGGCTA CCACTTCGGC ACACAGTCGG

101 TCAACGCGCA AAGCACGGCA AATGCCGCCG ACGCGTCGAC CATCTTCTAC

151 AATCCCGCCG GCCTGACCAA ACTCGACAGC AGCCAGATTT CCGTCAACGC

201 CAACATCGTG CTGCCCAGCA TTCATTATGA AGCAGATTCC GCCACCGACT

251 TTACCGGGCT TCCCGTCCAA GGTTCTAAAA ACGGCAAAAT CACCAAAACC

301 ACGGTCGCAC CCCACATTTA CGGCGCATAC AAAGTCAACG ACAATCTGAC

351 CGTGGGCTTG GGCGTGTACG TCCCCTTCGG CTCTGCCACC GAATACGAAA

401 AAGATTCCGT GTTGCGCCAC AACATCAACA AACTCGGTCT GACCAGCATC

451 GCCGTCGAAC CTGTCGCCGC GTGGAAACTC AACGAACGCC ATTCCTTCGG

501 CGCAGGCATC ATCGCCCAAC ATAATTCCGC CGAACTGCGC AAATATGCCG

551 ACTGAGGAAT CCCAAAAAAA GCGCAAATGC TGCAAGCAAC ACCTTCTAAT

601 CCTACTGCCG CTGCTCAAAT CAAGGCCGAC GGACACGCCG ATGTCAAAGG

651 CAGCGATTGG GGCGTCGGCT ACCAACTGGC GTGGATGTGG GACATCAACG

701 ACCGCGCGCG CGTGGGCGTG AACTACCGTT CCAAAGTTTC ACACACGCTC

751 AAAGGCGATG CCGAATGGGC GGCAGACGGC GCGGCGGCGA ACAACAGTG

801 GAATGACAAT ATGCTCACAC CGCTCGGTTA CACGGCGAAT GAAAAAGCCA

851 GTGTCAAAAT CGTAACGCCT GAGTCTTTGT CCGTACACGG CATGTACAAA

901 GTGTCCGACA AAGCCGACCT GTTCGGCGAC GTAACTTGGA CGCGCCACAG

951 CCGCTTCAAT AAGGCGGAAC TGTTTTTTGA AAAGAAAAA AATATTGCTA

1001 ATGGCAAAAA ATCCGACCGC ACCACCATCA CCCCCAACTG GCGCAACACC

1051 TACAAAGTCG GCTTGGGCGG TTCTTATCAA ATCAGCGAAC CGCTGCAACT

1101 GCGCGTCGGC ATCGCTTTTG ACAAACCGCC TGTCCGCAAC GCCGACTacC

1151 GCATGAACAG CCTGCCCGAC GGCAACCGCA TCTGGTTCTC CGCCGGCATG

1201 AAATACCATA TCGGCAAAAA CCACGTCGTC GATGCCGCCT ACACCCACAT

1251 CCACATCAAC GACACCAGCT ACCGCACGGC GAAGGCAAGC GGCAACGATG

1301 TGGACAGCAA AGGTGCGTCT TGCGCACGTT TCAAAAACCA CGCCGACATC

1351 ATCGGCCTGC AATACACCTA CAAATTCAAA TAA
```

This corresponds to the amino acid sequence <SEQ ID 2986; ORF 989.ng>:

```
g989.pep
    1 MTPFTLKKTV LLLGTAFAAA SVHASGYHFG TQSVNAQSTA NAADASTIFY

51 NPAGLTKLDS SQISVNANIV LPSIHYEADS ATDFTGLPVQ GSKNGKITKT

101 TVAPHIYGAY KVNDNLTVGL GVYVPFGSAT EYEKDSVLRH NINKLGLTSI

151 AVEPVAAWKL NERHSFGAGI IAQHNSAELR KYAD*GIPKK AQMLQATPSN

201 PTAAAQIKAD GHADVKGSDW GVGYQLAWMW DINDRARVGV NYRSKVSHTL

251 KGDAEWAADG AAAKQQWNDN MLTPLGYTAN EKASVKIVTP ESLSVHGMYK

301 VSDKADLFGD VTWTRHSRFN KAELFFEKEK NIANGKKSDR TTITPNWRNT
```

```
351 YKVGLGGSYQ ISEPLQLRVG IAFDKPPVRN ADYRMNSLPD GNRIWFSAGM

401 KYHIGKNHVV DAAYTHIHIN DTSYRTAKAS GNDVDSKGAS CARFKNHADI

451 IGLQYTYKFK *
```

The following partial DNA sequence was identified in *N. meningitidis* <SEQ ID 2987>:

```
m989.seq
   1 ATGACCCCTT CCGCACTGAA AAAAACCGTC CTGCTGCTCG GCACTGCCTT

51 TGCCGCCGCA TCCGTCCACG CATCCGGCTA CCACTTCGGC ACACAGTCGG

101 TCAACGCGCA AAGCACGGCA AATGCCGCCG CCGCAGAAGC CGCCGACGCA

151 TCGACCATCT TCTACAACCC TGCCGGCCTG ACCAAACTCG ACAGCAGCCA

201 GATTTCCGTC AACGCCAACA TCGTGCTGCC CAGCATTCAT TATGAGGCGG

251 ATTCCGCCAC CGACTTTACC GGGCTTCCCG TCCAAGGTTC GAAAAGCGGC

301 AAAATCACCA AAACCACGGT CGCGCCCCAC ATCTACGGCG CATACAAAGT

351 CAACGACAAT CTGACCGTGG GCTTGGGCGT GTACGTCCCC TTCGGCTCTG

401 CCACCGAATA CGAAAAAGAT TCCGTGTTGC GCCACAACAT CAACAAACTC

451 GGTCTGACCA GCATCGCCGT CGAACCTGTC GCCGCGTGGA AACTCAACGA

501 CCGCCATTCC TTCGGCGCAG GCATCATCGC CCAACATACT TCCGCCGAAC

551 TGCGCAAATA TGCCGACTGG GGGATTAAGA GTAAAGCAGA GATATTGACG

601 GCAAAACCGC CCAAACCTAA CGGTGTAGCC GAAGCTGCAA AAATTCAGGC

651 CGACGGACAC GCCGATGTCA AAGGCAGCGA TTGGGGCTTC GGCTACCAAC

701 TGGCGTGGAT GTGGGACATC AACGACCGTG CGCGCGTGGG CGTGAACTAC

751 CGTTCCAAAG TCTCGCACAC GCTCAAAGGC GATGCCGAAT GGGCGGCAGA

801 CGGCGCGGCG GCGAAAGCAA TGTGGAGTAC GATGCTTGCA GCAAACGGCT

851 ACACGGCGAA TGAAAAAGCC CGCGTTAAAA TCGTTACGCC TGAGTCTTTG

901 TCCGTACACG GTATGTACAA AGTGTCCGAT AAAGCCGACC TGTTCGGCGA

951 CGTAACTTGG ACGCGCCACA GCCGCTTCGA TAAGGCGGAA CTGGTTTTTG

1001 AAAAAGAAAA AACCGTCGTC AAAGGCAAAT CCGACCGCAC CACCATCACC

1051 CCCAACTGGC GCAACACCTA CAAAGTCGGC TTCGGCGGTT CTTATCAAAT

1101 CAGCGAACCG CTGCAACTGC GCGCCGGCAT CGCTTTTGAC AAATCGCCCG

1151 TCCGCAACGC CGACTACCGC ATGAACAGCC TACCCGACGG CAACCGCATC

1201 TGGTTCTCCG CCGGTATGAA ATACCATATC GGTAAAAACC ACGTCGTCGA

1251 TGCCGCCTAC ACCCACATCC ACATCAACGA CACCAGCTAC CGCACGGCGA

1301 AGGCAAGCGG CAACGATGTG GACAGCAAAG GCGCGTCTTC CGCACGTTTC

1351 AAAAACCACG CCGACATCAT CGGTCTGCAA TACACCTACA AATTCAAATA

1401 A
```

This corresponds to the amino acid sequence <SEQ ID 2988; ORF 989>:

```
m989.pep
   1 MTPSALKKTV LLLGTAFAAA SVHASGYHFG TQSVNAQSTA NAAAAEAADA

51 STIFYNPAGL TKLDSSQISV NANIVLPSIH YEADSATDFT GLPVQGSKSG
```

-continued

```
101 KITKTTVAPH IYGAYKVNDN LTVGLGVYVP FGSATEYEKD SVLRHNINKL

151 GLTSIAVEPV AAWKLNDRHS FGAGIIAQHT SAELRKYADW GIKSKAEILT

201 AKPPKPNGVA EAAKIQADGH ADVKGSDWGF GYQLAWMWDI NDRARVGVNY

251 RSKVSHTLKG DAEWAADGAA AKAMWSTMLA ANGYTANEKA RVKIVTPESL

301 SVHGMYKVSD KADLFGDVTW TRHSRFDKAE LVFEKEKTVV KGKSDRTTIT

351 PNWRNTYKVG FGGSYQISEP LQLRAGIAFD KSPVRNADYR MNSLPDGNRI

401 WFSAGMKYHI GKNHVVDAAY THIHINDTSY RTAKASGNDV DSKGASSARF

451 KNHADIIGLQ YTYKFK*
```

Computer analysis of this amino acid sequence gave the following results:

Homology with a Predicted ORF from *N. gonorrhoeae*

```
    g989/m989  90.0% identity in 468 aa overlap 10        20        30        40        50
      g989.pep  MTPFTLKKTVLLLGTAFAAASVHASGYHFGTQSVNAQSTANAA-----DASTIFYNPAGL
                ||| :|||||||||||||||||||||||||||||||||||||      ||||||||||||
      m989      MTPSALKKTVLLLGTAFAAASVHASGYHFGTQSVNAQSTANAAAAAEAADASTIFYNPAGL
                    10        20        30        40        50        60

60        70        80        90       100       110
      g989.pep  TKLDSSQISVNANIVLPSIHYEADSATDFTGLPVQGSKNGKITKTTVAPHIYGAYKVNDN
                |||||||||||||||||||||||||||||||||||||||:|||||||||||||||||||
      m989      TKLDSSQISVNANIVLPSIHYEADSATDFTGLPVQGSKSGKITKTTVAPHIYGAYKVNDN
                    70        80        90       100       110       120

120       130       140       150       160       170
      g989.pep  LTVGLGVYVPFGSATEYEKDSVLRHNINKLGLTSIAVEPVAAWKLNERHSFGAGIIAQHN
                |||||||||||||||||||||||||||||||||||||||||||||:||||||||||||:
      m989      LTVGLGVYVPFGSATEYEKDSVLRHNINKLGLTSIAVEPVAAWKLNDRHSFGAGIIAQHT
                   130       140       150       160       170       180

180       190       200       210       220       230
      g989.pep  SAELRKYADXGIPKKAQMLQATPSNPTA---AAQIKADGHADVKGSDWGVGYQLAWMWDI
                ||||||||||  ::||::| | | :|::    ||:||||||||||||||:||||||||||
      m989      SAELRKYADWGIKSKAEILTAKPPKPNGVAEAAKIQADGHADVKGSDWGFGYQLAWMWDI
                   190       200       210       220       230       240

240       250       260       270       280       290
      g989.pep  NDRARVGVNYRSKVSHTLKGDAEWAADGAAAKQQWNDNMLTPLGYTANEKASVKIVTPES
                |||||||||||||||||||||||||||||||  :|: :||: |||||||||:||||||||
      m989      NDRARVGVNYRSKVSHTLKGDAEWAADGAAAKAMWS-TMLAANGYTANEKARVKIVTPES
                   250       260       270       280       290

300       310       320       330       340       350
      g989.pep  LSVHGMYKVSDKADLFGDVTWTRHSRFNKAELFFEKEKNIANGKKSDRTTITPNWRNTYK
                |||||||||||||||||||||||||||||:||||  ||||::::||||||||||||||||
      m989      LSVHGMYKVSDKADLFGDVTWTRHSRFDKAELVFEKEKTVVKGK-SDRTTITPNWRNTYK
                   300       310       320       330       340       350

360       370       380       390       400       410
      g989.pep  VGLGGSYQISEPLQLRVGIAFDKPPVRNADYRMNSLPDGNRIWFSAGMKYHIGKNHVVDA
                ||:||||||||||||:||||||  ||||||||||||||||||||||||||||||||||||
      m989      VGFGGSYQISEPLQLRAGIAFDKSPVRNADYRMNSLPDGNRIWFSAGMKYHIGKNHVVDA
                   360       370       380       390       400       410

420       430       440       450       460
      g989.pep  AYTHIHINDTSYRTAKASGNDVDSKGASCARFKNHADIIGLQYTYKFKX
                |||||||||||||||||||||||||||||| |||||||||||||||||||
      m989      AYTHIHINDTSYRTAKASGNDVDSKGASSARFKNHADIIGLQYTYKFKX
                   420       430       440       450       460
```

The following partial DNA sequence was identified in *N. meningitidis* <SEQ ID 2989>:

```
a989.seq
    1 ATGACCCCTT CCGCACTGAA AAAAACCGTC CTACTGCTCG GCACTGCCTT

51 TGCCGCCGCA TCCGCACAAG CCTCCGGCTA CCACTTCGGC ACACAGTCGG

101 TCAACGCGCA AAGCACGGCA AATGCCGCCG CCGCAGAAGC CGCCGACGCA

151 TCGACCATCT TCTACAACCC TGCCGGCCTG ACCAAACTCG ACAGCAGCCA
```

```
 201 GATTTCCGTC AACGCCAACA TCGTGCTGCC CAGCATTCAT TATGAGGCGG
 251 ATTCCGCCAC CGACTTTACC GGGCTTCCCG TCCAAGGTTC GAAAAGCGGC
 301 AAAATCACCA AAACCACGGT CGCGCCCCAC ATCTACGGCG CATACAAAGT
 351 CAACGACAAT CTGACCGTAG GCTTGGGCGT GTACGTCCCC TTCGGTTCTG
 401 CCACCGAATA CGAAAAAGAT TCCGTGTTGC GCCACAACAT CAACAAACTC
 451 GGTCTGACCA GCATCGCCGT CGAACCTGTC GCCGCGTGGA AACTCAACGA
 501 ACGCCATTCC TTCGGCGCAG GCATCATCGC CCAACATACT TCCGCCGAGC
 551 TGCGCAAATA TGCCGACTGG GGGATTATGG AAAAAGCGAA AGCACTAAAA
 601 GAAACACCCC CCAATCCAAC TAAAGCCGCC CAAATCAAAG CCGACGGACA
 651 CGCCGATGTC AAAGGCAGCG ATTGGGGCTT CGGCTACCAA CTGGCGTGGA
 701 TGTGGGACAT CAACGACCGT GCGCGCGTGG GCGTGAACTA CCGTTCCAAA
 751 GTCTCACACA CGCTCAAAGG CGATGCCGAA TGGGCGGCAG ACGACGCAAT
 801 GGCGAAACAG TTATGGGATG CAAACAAACT CGCACTGCTC GGCTACACGC
 851 CAAGCGAAAA AGCCCGCGTT AAAATCGTTA CGCCCGAGTC TTTGTCCGTA
 901 CACGGTATGT ACAAAGTGTC CGACAAAGCC GACCTGTTCG GCGACGTAAC
 951 TTGGACGCGC CACAGCCGCT TCGATAAGGC GGAACTGGTT TTTGAAAAAG
1001 AAAAAACCAT CGTCAACGGC AAATCCGACC GCACCACCAT CACCCCCAAC
1051 TGGCGCAACA CCTACAAAGT CGGCTTCGGC GGTTCTTATC AAATCAGCGA
1101 ACCGCTGCAA CTGCGCGCCG GCATCGCTTT TGACAAATCG CCCGTCCGCA
1151 ACGCCGACTA CCGCATGAAC AGCCTGCCCG ACGGCAACCG CATCTGGTTC
1201 TCCGCCGGCA TGAAATACCA TATCGGCAAA AACCACGTCG TCGATGCCGC
1251 CTACACCCAC ATCCACATCA ACGACACCAG CTACCGCACG GCGAAGGCAA
1301 GCGGCAACGA TGTGGACAGC AAAGGCGCGT CTTCCGCACG TTTCAAAAAC
1351 CACGCCGACA TCATCGGCCT GCAATACACC TACAAATTCA AATAA
```

This corresponds to the amino acid sequence <SEQ ID 2990; ORF 989.a>:

```
a989.pep
      1 MTPSALKKTV LLLGTAFAAA SAQASGYHFG TQSVNAQSTA NAAAAEAADA
     51 STIFYNPAGL TKLDSSQISV NANIVLPSIH YEADSATDFT GLPVQGSKSG
    101 KITKTTVAPH IYGAYKVNDN LTVGLGVYVP FGSATEYEKD SVLRHNINKL
    151 GLTSIAVEPV AAWKLNERHS FGAGIIAQHT SAELRKYADW GIMEKAKALK
    201 ETPPNPTKAA QIKADGHADV KGSDWGFGYQ LAWMWDINDR ARVGVNYRSK
    251 VSHTLKGDAE WAADDAMAKQ LWDANKLALL GYTPSEKARV KIVTPESLSV
    301 HGMYKVSDKA DLFGDVTWTR HSRFDKAELV FEKEKTIVNG KSDRTTITPN
    351 WRNTYKVGFG GSYQISEPLQ LRAGIAFDKS PVRNADYRMN SLPDGNRIWF
    401 SAGMKYHIGK NHVVDAAYTH ININDTSYRT AKASGNDVDS KGASSARFKN
    451 HADIIGLQYT YKFK* m989/a989 93.1% identity in 467 aa overlap 10         20         30         40         50         60
 m989.pep   MTPSALKKTVLLLGTAFAAASVHASGYHFGTQSVNAQSTANAAAAEAADASTIFYNPAGL
            ||||||||||||||||||||::||||||||||||||||||||||||||||||||||||||
 a989       MTPSALKKTVLLLGTAFAAASAQASGYHFGTQSVNAQSTANAAAAEAADASTIFYNPAGL
                   10         20         30         40         50         60
```

-continued

```
                70        80        90       100       110       120
m989.pep   TKLDSSQISVNANIVLPSIHYEADSATDFTGLPVQGSKSGKITKTTVAPHIYGAYKVNDN
           ||||||||||||||||||||||||||||||||||||||||||||||||||||||||||||
a989       TKLDSSQISVNANIVLPSIHYEADSATDFTGLPVQGSKSGKITKTTVAPHIYGAYKVNDN
                70        80        90       100       110       120

130       140       150       160       170       180
m989.pep   LTVGLGVYVPFGSATEYEKDSVLRHNINKLGLTSIAVEPVAAWKLNDRHSFGAGIIAQHT
           |||||||||||||||||||||||||||||||||||||||||||||:||||||||||||||
a989       LTVGLGVYVPFGSATEYEKDSVLRHNINKLGLTSIAVEPVAAWKLNERHSFGAGIIAQHT
               130       140       150       160       170       180

190       200       210       220       230       240
m989.pep   SAELRKYADWGIKSKAEILTAKPPKPNGVAEAAKIQADGHADVKGSDWGFGYQLAWMWDI
           |||||||||||||  ||:  |   ||:|:      :||:|||||||||||||||||||||
a989       SAELRKYADWGIMEKAKALKETPPNPT---KAAQIKADGHADVKGSDWGFGYQLAWMWDI
               190       200       210       220       230

250       260       270       280       290       299
m989.pep   NDRARVGVNYRSKVSHTLKGDAEWAADGAAAKAMW-STMLAANGYTANEKARVKIVTPES
           ||||||||||||||||||||||||||||  ||  :| ::  || |||  :||||||||||
a989       NDRARVGVNYRSKVSHTLKGDAEWAADDAMAKQLWDANKLALLGYTPSEKARVKIVTPES
               240       250       260       270       280       290

300       310       320       330       340       350       359
m989.pep   LSVHGMYKVSDKADLFGDVTWTRHSRFDKAELVFEKEKTVVKGKSDRTTITPNWRNTYKV
           |||||||||||||||||||||||||||||||||||||||:|:||||||||||||||||||
a989       LSVHGMYKVSDKADLFGDVTWTRHSRFDKAELVFEKEKTIVNGKSDRTTITPNWRNTYKV
           300       310       320       330       340       350

360       370       380       390       400       410       419
m989.pep   GFGGSYQISEPLQLRAGIAFDKSPVRNADYRMNSLPDGNRIWFSAGMKYHIGKNHVVDAA
           ||||||||||||||||||||||||||||||||||||||||||||||||||||||||||||
a989       GFGGSYQISEPLQLRAGIAFDKSPVRNADYRMNSLPDGNRIWFSAGMKYHIGKNHVVDAA
           360       370       380       390       400       410

420       430       440       450       460
m989.pep   YTHIHINDTSYRTAKASGNDVDSKGASSARFKNHADIIGLQYTYKFKX
           ||||||||||||||||||||||||||||||||||||||||||||||||
a989       YTHIHINDTSYRTAKASGNDVDSKGASSARFKNHADIIGLQYTYKFKX
           420       430       440       450       460
```

The following partial DNA sequence was identified in *N. meningitidis* <SEQ ID 2991>:

```
m990.seq
    1 ATGTTCAGAG CTCAGCTTGG TTCAAATACT CGTTCTACCA AAATCGGCGA

51 CGATGCCGAT TTTTCATTTT CAGACAAGCC GAAACCCGGC ACTTCCCATT

101 ATTTTTCCAG CGGTAAAACC GATCAAAATT CATCCGAATA TGGGTATGAC

151 GAAATCAATA TCCAAGGTAA AAATTACAAT AGCGGCATCC TCGCCGTCGA

201 TAATATGCCC GTTGTCAAAA AATATATTAC AGAGAAGTAT GGGGCTGATT

251 TAAAGCAGGC GGTTAAAAGT CAATTACAGG ATTTATACAA AACAAGACCG

301 GAAGCTTGGG CAGAAAATAA AAAACGGACT GAGGAGGCGT ATATAGCACA

351 GTTTGGAACA AAATTTAGTA CGCTCAAACA GACGATGCCC GATTTAATTA

401 ATAAATTGGT AGAAGATTCC GTACTCACTC CTCATAGTAA TACATCACAG

451 ACTAGTCTCA ACAACATCTT CAATAAAAAA TTACACGTCA AAATCGAAAA

501 CAAATCCCAC GTCGCCGGAC AGGTGTTGGA ACTGACCAAG ATGACGCTGA

551 AAGATTCCCT TTGGGAACCG CGCCGCCATT CCGACATCCA TACGCTGGAA

601 ACTTCCGATA ATGCCCGCAT CCGCCTGAAC ACGAAAGATG AAAAACTGAC

651 CGTCCATAAG GATTATGCGG GCGGCGCGGA TTTCCTGTTC GGCTACGACG

701 TGCGGGAGTC GGACGAACCC GCCCTGACCT TTGAAGACAA AGTCAGCGGA

751 CAATCCGGCG TGGTTTTGGA ACGCCGGCCG GAAAATCTGA AACGCTCGA

801 CGGGCGCAAA CTGATTGCGG CAAAAACGGC GGATTCCGGT TCGTTTGCGT

851 TTAAACAAAA TTACCGGCAG GGACTGTACG AATTATTGCT CAAGCAATGC

901 GAAGGCGGAT TTTGCTTGGG CGTGCAGCGT TTGGCTATCC CCGAGGCGGA
```

-continued

```
 951 AGCGGTTTTA TATGCCCAAC AGGCTTATGC GGCAAATACT TTGTTTGGGC
1001 TGCGTGCCGC CGACAGGGGC GACGACGTGT ATGCCGCCGA TCCGTCCCGT
1051 CAAAAATTGT GGCTGCGCTT CATCGGCGGC CGGTCGCATC AAAATATACG
1101 GGGCGGCGCG GCTGCGGACG GGTGGCGCAA AGGCGTGCAA ATCGGCGGCG
1151 AGGTGTTTGT ACGGCAAAAT GAAGGCAGCC GACTGGCAAT CGGCGTGATG
1201 GGCGGCAGGG CCGGCCAGCA CGCATCAGTC AACGGCAAAG GCGGTGCGGC
1251 AGGCAGTGAT TTGTATGGTT ATGGCGGGGG TGTTTATGCT GCGTGGCATC
1301 AGTTGCGCGA TAAACAAACG GGTGCGTATT TGGACGGCTG GTTGCAATAC
1351 CAACGTTTCA AACACCGCAT CAATGATGAA AACCGTGCGG AACGCTACAA
1401 AACCAAAGGT TGGACGGCTT CTGTCGAAGG CGGCTACAAC GCGCTTGTGG
1451 CGGAAGGCAT TGTCGGAAAA GGCAATAATG TGCGGTTTTA CCTACAACCG
1501 CAGGCGCAGT TTACCTACTT GGGCGTAAAC GGCGGCTTTA CCGACAGCGA
1551 GGGGACGGCG GTCGGACTGC TCGGCAGCGG TCAGTGGCAA AGCCGCGCCG
1601 GCATTCGGGC AAAAACCCGT TTTGCTTTGC GTAACGGTGT CAATCTTCAG
1651 CCTTTTGCCG CTTTTAATGT TTTGCACAGG TCAAATCTT TCGGCGTGGA
1701 AATGGACGGC GAAAAACAGA CGCTGGCAGG CAGGACGGCA CTCGAAGGGC
1751 GGTTCGGTAT TGAAGCCGGT TGGAAAGGCC ATATGTCCGC ACGCATCGGA
1801 TATGGCAAAA GGACGGACGG CGACAAAGAA GCCGCATTGT CGCTCAAATG
1851 GCTGTTTTGA
```

This corresponds to the amino acid sequence <SEQ ID 2992; ORF 990>:

```
m990.pep
   1 MFRAQLGSNT RSTKIGDDAD FSFSDKPKPG TSHYFSSGKT DQNSSEYGYD

51 EINIQGKNYN SGILAVDNMP VVKKYITEKY GADLKQAVKS QLQDLYKTRP

101 EAWAENKKRT EEAYIAQFGT KFSTLKQTMP DLINKLVEDS VLTPHSNTSQ

151 TSLNNIFNKK LHVKIENKSH VAGQVLELTK MTLKDSLWEP RRHSDIHTLE

201 TSDNARIRLN TKDEKLTVHK DYAGGADFLF GYDVRESDEP ALTFEDKVSG

251 QSGVVLERRP ENLKTLDGRK LIAAKTADSG SFAFKQNYRQ GLYELLLKQC

301 EGGFCLGVQR LAIPEAEAVL YAQQAYAANT LFGLRAADRG DDVYAADPSR

351 QKLWLRFIGG RSHQNIRGGA AADGWRKGVQ IGGEVFVRQN EGSRLAIGVM

401 GGRAGQHASV NGKGGAAGSD LYGYGGGVYA AWHQLRDKQT GAYLDGWLQY

451 QRFKHRINDE NRAERYKTKG WTASVEGGYN ALVAEGIVGK GNNVRFYLQP

501 QAQFTYLGVN GGFTDSEGTA VGLLGSGQWQ SRAGIRAKTR FALRNGVNLQ

551 PFAAFNVLHR SKSFGVEMDG EKQTLAGRTA LEGRFGIEAG WKGHMSARIG

601 YGKRTDGDKE AALSLKWLF*
```

The following partial DNA sequence was identified in *N. meningitidis* <SEQ ID 2993>:

```
a990.seq
  1   ATGTTCAGAG CTCAGCTTGG TTCAAATACT CGTTCTACCA AAATCGGCGA

51   CGATGCCGAT TTTTCATTTT CAGACAAGCC GAAACCCGGC ACTTCCCATT
```

-continued

```
 101 ATTTTTCCAG CGGTAAAACC GATCAAAATT CATCCGAATA TGGGTATGAC
 151 GAAATCAATA TCCAAGGTAA AAACTACAAT AGCGGCATAC TCGCCGTCGA
 201 TAATATGCCC GTTGTTAAGA AATATATTAC AGATACTTAC GGGGATAATT
 251 TAAAGGATGC GGTTAAGAAG CAATTACAGG ATTTATACAA AACAAGACCC
 301 GAAGCTTGGG AAGAAAATAA AAAACGGACT GAGGAGGCGT ATATAGAACA
 351 GCTTGGACCA AAATTTAGTA TACTCAAACA GAAAACCCC GATTTAATTA
 401 ATAAATTGGT AGAAGATTCC GTACTCACTC CTCATAGTAA TACATCACAG
 451 ACTAGTCTCA ACAACATCTT CAATAAAAAA TTACACGTCA AAATCGAAAA
 501 CAAATCCCAC GTCGCCGGAC AGGTGTTGGA ACTGACCAAG ATGACGCTGA
 551 AAGATTCCCT TTGGGAACCG CGCCGCCATT CCGACATCCA TATGCTGGAA
 601 ACTTCCGATA ATGCCCGCAT CCGCCTGAAC ACGAAAGATG AAAAACTGAC
 651 CGTCCATAAA GCGTATCAGG GCGGTGCGGA TTTCCTGTTC GGCTACGACG
 701 TGCGGGAGTC GGACAAACCC GCCCTGACCT TTGAAGAAAA AGTCAGCGGA
 751 CAATCCGGCG TGGTTTTGGA ACGCCGGCCG GAAAATCTGA AAACGCTCGA
 801 CGGGCGCAAA CTGATTGCGG CGGAAAAGGC AGACTCTAAT TCGTTTGCGT
 851 TTAAACAAAA TTACCGGCAG GGACTGTACG AATTATTGCT CAAGCAATGC
 901 GAAGGCGGAT TTTGCTTGGG CGTGCAGCGT TTGGCTATCC CCGAGGCGGA
 951 AGCGGTTTTA TATGCCCAAC AGGCTTATGC GGCAAATACT TTGTTCGGGC
1001 TGCGTGCCGC CGACAGGGGC GACGACGTGT ATGCCGCCGA TCCGTCCCGT
1051 CAAAAATTGT GGCTGCGCTT CATCGGCGGC CGGTCGCATC AAAATATACG
1101 GGGCGGCGCG GCTGCGGACG GGCGGCGCAA AGGCGTGCAA ATCGGCGGCG
1151 AGGTGTTTGT ACGGCAAAAT GAAGGCAGCC GGCTGGCAAT CGGCGTGATG
1201 GGCGGCAGGG CTGGCCAGCA CGCATCAGTC AACGGCAAAG GCGGTGCGGC
1251 AGGCAGTTAT TTGCATGGTT ATGGCGGGGG TGTTTATGCT GCGTGGCATC
1301 AGTTGCGCGA TAAACAAACG GGTGCGTATT TGGACGGCTG GTTGCAATAC
1351 CAACGTTTCA AACACCGCAT CAATGATGAA AACCGTGCGG AACGCTACAA
1401 AACCAAAGGT TGGACGGCTT CTGTCGAAGG CGGCTACAAC GCGCTTGTGG
1451 CGGAAGGCGT TGTCGGAAAA GGCAATAATG TGCGGTTTTA CCTGCAACCG
1501 CAGGCGCAGT TTACCTACTT GGGCGTAAAC GGCGGCTTTA CCGACAGCGA
1551 GGGGACGGCG GTCGGACTGC TCGGCAGCGG TCAGTGGCAA AGCCGCGCCG
1601 GCATTCGGGC AAAAACCCGT TTTGCTTTGC GTAACGGTGT CAATCTTCAG
1651 CCTTTTGCCG CTTTTAATGT TTTGCACAGG TCAAATCTT TCGGCGTGGA
1701 AATGGACGGC GAAAACAGA CGCTGGCAGG CAGGACGGCG CTCGAAGGGC
1751 GGTTCGGCAT TGAAGCCGGT TGGAAAGGCC ATATGTCCGC ACGCATCGGA
1801 TACGGCAAAA GGACGGACGG CGACAAAGAA GCCGCATTGT CGCTCAAATG
1851 GCTGTTTTGA
```

This corresponds to the amino acid sequence <SEQ ID 2994; ORF 990.a>:

```
a990.pep

1 MFRAQLGSNT RSTKIGDDAD FSFSDKPKPG TSHYFSSGKT DQNSSEYGYD

51 EINIQGKNYN SGILAVDNMP VVKKYITDTY GDNLKDAVKK QLQDLYKTRP

101 EAWEENKKRT EEAYIEQLGP KFSILKQKNP DLINKLVEDS VLTPHSNTSQ

151 TSLNNIFNKK LHVKIENKSH VAGQVLELTK MTLKDSLWEP RRHSDIHMLE

201 TSDNARIRLN TKDEKLTVHK AYQGGADFLF GYDVRESDKP ALTFEEKVSG

251 QSGVVLERRP ENLKTLDGRK LIAAEKADSN SFAFKQNYRQ GLYELLLKQC

301 EGGFCLGVQR LAIPEAEAVL YAQQAYAANT LFGLRAADRG DDVYAADPSR

351 QKLWLRFIGG RSHQNIRGGA AADGRRKGVQ IGGEVFVRQN EGSRLAIGVM

401 GGRAGQHASV NGKGGAAGSY LHGYGGGVYA AWHQLRDKQT GAYLDGWLQY

451 QRFKHRINDE NRAERYKTKG WTASVEGGYN ALVAEGVVGK GNNVRFYLQP

501 QAQFTYLGVN GGFTDSEGTA VGLLGSGQWQ SRAGIRAKTR FALRNGVNLQ

551 PFAAFNVLHR SKSFGVEMDG EKQTLAGRTA LEGRFGIEAG WKGHMSARIG

601 YGKRTDGDKE AALSLKWLF* m990/a990   96.0% identity in 619 aa overlap 10         20         30         40         50         60
m990.pep   MFRAQLGSNTRSTKIGDDADFSFSDKPKPGTSHYFSSGKTDQNSSEYGYDEINIQGKNYN
           ||||||||||||||||||||||||||||||||||||||||||||||||||||||||||||
a990       MFRAQLGSNTRSTKIGDDADFSFSDKPKPGTSHYFSSGKTDQNSSEYGYDEINIQGKNYN
                   10         20         30         40         50         60

70         80         90        100        110        120
m990.pep   SGILAVDNMPVVKKYITEKYGADLKQAVKSQLQDLYKTRPEAWAENKKRTEEAYIAQFGT
           ||||||||||||||||| ::  ||::|||:|||||||||||||||::|||||||| :|
a990       SGILAVDNMPVVKKYITDTYGDNLKDAVKKQLQDLYKTRPEAWEEMKKRTEEAYIEQLGP
                   70         80         90        100        110        120

130        140        150        160        170        180
m990.pep   KFSTLKQTMPDLINKLVEDSVLTPHSNTSQTSLNNIFNKKLHVKIENKSHVAGQVLELTK
           ||| |||  |:||||||||||||||||||||||||||||||||||||||||||||||||
a990       KFSILKQKNPDLINKLVEDSVLTPHSNTSQTSLNNIFNKKLHVKIENKSHVAGQVLELTK
                  130        140        150        160        170        180

190        200        210        220        230        240
m990.pep   MTLKDSLWEPRRHSDIHTLETSDNARIRLNTKDEKLTVHKDYAGGADFLFGYDVRESDEP
           ||||||||||||||||| :|||||||||||||||||||| |||||||||||||||||:|
a990       MTLKDSLWEPRRHSDIHMLETSDNARIRLNTKDEKLTVHKAYQGGADFLFGYDVRESDKP
                  190        200        210        220        230        240

250        260        270        280        290        300
m990.pep   ALTFEDKVSGQSGVVLERRPENLKTLDGRKLIAAKTADSGSFAFKQNYRQGLYELLLKQC
           ||||| ::|||||||||||||||||||||||||| |||:|| ||| |||||||||||||
a990       ALTFEEKVSGQSGVVLERRPENLKTLDGRKLIAAEKADSNSFAFKQNYRQGLYELLLKQC
                  250        260        270        280        290        300

310        320        330        340        350        360
m990.pep   EGGFCLGVQRLAIPEAEAVLYAQQAYAANTLFGLRAADRGDDVYAADPSRQKLWLRFIGG
           ||||||||||||||||||||||||||||||||||||||||||||||||||||||||||||
a990       EGGFCLGVQRLAIPEAEAVLYAQQAYAANTLFGLRAADRGDDVYAADPSRQKLWLRFIGG
                  310        320        330        340        350        360

370        380        390        400        410        420
m990.pep   RSHQNIRGGAAADGWRKGVQIGGEVFVRQNEGSRLAIGVMGGRAGQHASVNGKGGAAGSD
           |||||||||||||| ||||||||||||||||||||||||||||||||||||||||||||
a990       RSHQNIRGGAAADGRRKGVQIGGEVFVRQNEGSRLAIGVMGGRAGQHASVNGKGGAAGSY
                  370        380        390        400        410        420

430        440        450        460        470        480
m990.pep   LYGYGGGVYAAWHQLRDKQTGAYLDGWLQYQRFKHTINDENRAERYKTKGWTASVEGGYN
           |:||||||||||||||||||||||||||||||||| ||||||||||||||||||||||||
a990       LHGYGGGVYAAWHQLRDKQTGAYLDGWLQYQRFKHTINDENRAERYKTKGWTASVEGGYN
                  430        440        450        460        470        480

490        500        510        520        530        540
m990.pep   ALVAEGIVGKGNNVRFYLQPQAQFTYLGVNGGFTDSEGTAVGLLGSGQWQSRAGIRAKTR
           ||||||:|||||||||||||||||||||||||||||||||||||||||||||||||||||
a990       ALVAEGVVGKGNNVRFYLQPQAQFTYLGVNGGFTDSEGTAVGLLGSGQWQSRAGIRAKTR
                  490        500        510        520        530        540
```

```
                550        560        570        580        590        600
m990.pep  FALRNGVNLQPFAAFNVLHRSKSFGVEMDGEKQTLAGRTALEGRFGIEAGWKGHMSARIG
          ||||||||||||||||||||||||||||||||||||||||||||||||||||||||||||
a990      FALRNGVNLQPFAAFNVLHRSKSFGVEMDGEKQTLAGRTALEGRFGIEAGWKGHMSARIG
                550        560        570        580        590        600

610        620
m990.pep  YGKRTDGDKEAALSLKWLFX
          ||||||||||||||||||||
a990      YGKRTDGDKEAALSLKWLFX
                610        620
```

The following partial DNA sequence was identified in *N. gonorrhoeae* <SEQ ID 2995>:

```
g992.seq
  1 ATGTTCAGAC GGCATCGGCA TTTGAAAAAT ATGCAGATTA AAAAAATCAT

51 GAAATGGCTT CCCGTCGCCC TGTCGCTTTT GGGCGCGTTG GGTTATACGG

101 GATATGACAG TGAGGCGGTG CGGACGGCGG TTGCCGTACT CGACGTACTC

151 GGCACTGCAG GGGACGTGGG TTTCGACGCG CCCGTTCGCC GACGGGCATC

201 GGCGAAATCC GGCCACAGCT ACACAGGCAC GGTGTCCAAA GTCTATGACG

251 GCGATACCCT TCACGTCATC GACGGCGACG GCGCGAAACA TAAAATTCGG

301 ATGGCGTATA TCGACGCACC GGAGATGAAA CAGGCTTACG GTACACGTTC

351 GCGCGACAAC CTGCGCGCGG CGGCGGAGGG TAGGAAAGTC AGTGTACGTG

401 TGTTTGAAAC CGACCGCTAT CAGCGCGAAG TGGCGCAGGT ATCCGCCGGC

451 AAAACCGATT TGAACCTGAT GCAGGTGCAG GACGGGCGG CGTGGCATTA

501 TAAAAGTTAT GCTAAAGAAC AGCAGGATAA GGCGGATTTT GCCGACTATG

551 CCGACGCTCA AATTCAGGCG GAAAGGGAAC GCAAAGGATT GTGGAAAGCT

601 AAAAATCCGC AAGCGCCGTG GGCGTACCGC CGGGCAGGCA GGAGCGGCGG

651 GGGCAATAAG GATTGGATGG ATTCCGTGGG CGAATGGTTG GGCATTTGGT

701 AA
```

This corresponds to the amino acid sequence <SEQ ID 2996 ORF 992.ng>:

```
g992.pep
  1 MFRRHRHLKN MQIKKIMKWL PVALSLLGAL GYTGYDSEAV RTAVAVLDVL

51 GTAGDVGFDA PVRRRASAKS GHSYTGTVSK VYDGDTLHVI DGDGAKHKIR

101 MAYIDAPEMK QAYGTRSRDN LRAAAEGRKV SVRVFETDRY QREVAQVSAG

151 KTDLNLMQVQ DGAAWHYKSY AKEQQDKADF ADYADAQIQA ERERKGLWKA

201 KNPQAPWAYR RAGRSGGGNK DWMDSVGEWL GIW*
```

The following partial DNA sequence was identified in *N. meningitidis* <SEQ ID 2997>:

```
m992.seq
  1 ATGTTCAGAC GGCATCGGCA TTTGAAAAAT ATGCAGATTA AAAAAATCAT

51 GAAATGGCTT CCCGTCGCCC TGTCGCTTTT GGGTGCGTTG GGTTATACGG

101 GGTACGGCAG CGAGGCGGTG CGGACGGCGG TTGCCGTACT CGACGTACTC

151 GGCGCGGCAG GGGACGCGGG TTCCGACGCG CCCGCCCGCC GCCGAGCATC

201 GGCGAAATCC GGCCACCGCT ACACAGGCAC GGTGTCCAAA GTCTATGACG
```

```
251 GCGACACCCT TCACGTTATC GACGGCGACG GCGCGAAACA CAAAATCCGG

301 ATGGCGTATA TCGACGCGCC GGAGATGAAA CAGGCTTACG GCACGCGTTC

351 GCGCGACAAC CTGCGCGCGG CGGCGGAAGG CAGGAAAGTC AGCGTGCGCG

401 TGTTCGATAC CGACCGCTAC CAGCGCGAAG TGGCGCAGGT TTCTGTCGGC

451 AAAACCGATT TGAACCTGAT GCAGGTGCAG GACGGGCGG CGTGGCATTA

501 TAAAAGTTAT GCTAAAGAAC AGCAGGATAA GGCGGATTTT GCCGATTATG

551 CCGACGCTCA AATTCAGGCG GAAAGGGAAC GCAAAGGATT GTGGAAAGCT

601 AAAAATCCGC AAGCGCCGTG GGCGTACCGC CGAGCAGGCA GGAGCGGCGG

651 GGGCAATAAG GATTGGATGG ATGCCGTGGG CGAATGGTTG GGCATTTGGT

701 AA
```

This corresponds to the amino acid sequence <SEQ ID 2998; ORF 992>:

```
m992.pep
  1 MFRRHRHLKN MQIKKIMKWL PVALSLLGAL GYTGYGSEAV RTAVAVLDVL

51 GAAGDAGSDA PARRRASAKS GHRYTGTVSK VYDGDTLHVI DGDGAKHKIR

101 MAYIDAPEMK QAYGTRSRDN LRAAAEGRKV SVRVFDTDRY QREVAQVSVG

151 KTDLNLMQVQ DGAAWHYKSY AKEQQDKADF ADYADAQIQA ERERKGLWKA

201 KNPQAPWAYR RAGRSGGGNK DWMDAVGEWL GIW*
```

Computer analysis of this amino acid sequence gave the following results:
Homology with a Predicted ORF from *N. gonorrhoeae*
ORF 992 shows 96.1% identity over a 233 aa overlap with a predicted ORF (ORF 992) from *N. gonorrhoeae*

```
    m992/g992    96.1% identity in 233 aa overlap 10         20         30         40         50         60
    m992.pep   MFRRHRHLKNMQIKKIMKWLPVALSLLGALGYTGYGSEAVRTAVAVLDVLGAAGDAGSDA
               ||||||||||||||||||||||||||||||||||||| |||||||||||||:|||:| ||
    g992       MFRRHRHLKNMQIKKIMKWLPVALSLLGALGYTGYDSEAVRTAVAVLDVLGTAGDVGFDA
                      10         20         30         40         50         60
                      70         80         90        100        110        120
    m992.pep   PARRRASAKSGHRYTGTVSKVYDGDTLHVIDGDGAKHKIRMAYIDAPEMKQAYGTRSRDN
               |:||||||||| |||||||||||||||||||||||||||||||||||||||||||||||
    g992       PVRRRASAKSGHSYTGTVSKVYDGDTLHVIDGDGAKHKIRMAYIDAPEMKQAYGTRSRDN
                      70         80         90        100        110        120
                     130        140        150        160        170        180
    m992.pep   LRAAAEGRKVSVRVFDTDRYQREVAQVSVGKTDLNLMQVQGGAAWHYKSYAKEQQDKADF
               ||||||||||||||:|||||||||||||||:|||||||||:|||||||||||||||||||
    g992       LRAAAEGRKVSVRVFETDRYQREVAQVSAGKTDLNLMQVQDGAAWHYKSYAKEQQDKADF
                     130        140        150        160        170        180
                     190        200        210        220        230
    m992.pep   ADYADAQIQAERERKGLWKAKNPQAPWAYRRAGRSGGGNKDWMDAVGEWLGIWX
               |||||||||||||||||||||||||||||||||||||||||||||:|||||||
    g992       ADYADAQIQAERERKGLWKAKNPQAPWAYRRAGRSGGGNKDWMDSVGEWLGIWX
                     190        200        210        220        230
```

The following partial DNA sequence was identified in *N. meningitidis* <SEQ ID 2999>:

```
a992.seq
  1 ATGTTCAGAC GGCATCGGCA TTTGAAAAAT ATGCAGATTA AAAAAATCAT

51 GAAATGGCTT CCCGTCGCCT TGTCGCTTTT GGGTGCGTTG GGTTATACGG
```

```
-continued
101 GGTACGGCAG CGAGGCGGTG CGGACGGCGG TTGCCGTACT CGACGTACTC

151 GGCGCGGCAG GGGACGCGGG TTCCGACGCG CCCGCCCGCC GCCGAGCATC

201 GGCGAAATCC GGCCACCGCT ACACAGGCAC GGTGTCCAAA GTCTATGACG

251 GCGACACCCT TCACGTTATC GACGGCGACG GCGCGAAACA CAAAATCCGG

301 ATGGCGTATA TCGACGCGCC GGAGATGAAA CAGGCTTACG GCACGCGTTC

351 GCGCGACAAC CTGCGCGCGG CGGCGGAAGG CAGGAAAGTC AGCGTCCGCG

401 TGTTCGACAC CGACCGCTAC CAGCGCGAAG TGGCGCAGGT TTCTGTCGGC

451 AAAACCGATT TGAACCTGAT GCAGGTGCAG GACGGGGCGG CGTGGCATTA

501 TAAAAGTTAT GCTAAAGAAC AGCAGGATAA GGCGGATTTT GCCGATTATG

551 CCGACGCTCA AATTCAGGCG GAAAGGGAAC GCAAAGGATT GTGGAAAGCT

601 AAAAATCCGC AAGCGCCGTG GGCGTACCGC CGGGCAGGCA GGAGCGGCGG

651 GGGCAATAAG GATTGGATGG ATGCCGTGGG CGAATGGTTG GGCATTTGGT

701 AA
```

This corresponds to the amino acid sequence <SEQ ID 3000; ORF 992.a>:

```
a992.pep
  1 MFRRHRHLKN MQIKKIMKWL PVALSLLGAL GYTGYGSEAV RTAVAVLDVL

51 GAAGDAGSDA PARRRASAKS GHRYTGTVSK VYDGDTLHVI DGDGAKHKIR

101 MAYIDAPEMK QAYGTRSRDN LRAAAEGRKV SVRVFDTDRY QREVAQVSVG

151 KTDLNLMQVQ DGAAWHYKSY AKEQQDKADF ADYADAQIQA ERERKGLWKA

201 KNPQAPWAYR RAGRSGGGNK DWMDAVGEWL GIW*
```

Computer analysis of this amino acid sequence gave the following results:
Homology with a Predicted ORF from *N. meningitidis*
ORF 992 shows 100.0% identity over a 233 aa overlap with a predicted ORF (ORF 992) from *N. meningitidis*

```
    a992/m992   100.0% identity in 233 aa overlap 10        20        30        40        50        60
     a992.pep   MFRRHRHLKNMQIKKIMKWLPVALSLLGALGYTGYGSEAVRTAVAVLDVLGAAGDAGSDA
                ||||||||||||||||||||||||||||||||||||||||||||||||||||||||||||
     m992       MFRRHRHLKNMQIKKIMKWLPVALSLLGALGYTGYGSEAVRTAVAVLDVLGAAGDAGSDA
                  10        20        30        40        50        60

70        80        90       100       110       120
     a992.pep   PARRRASAKSGHRYTGTVSKVYDGDTLHVIDGDGAKHKIRMAYIDAPEMKQAYGTRSRDN
                ||||||||||||||||||||||||||||||||||||||||||||||||||||||||||||
     m992       PARRRASAKSGHRYTGTVSKVYDGDTLHVIDGDGAKHKIRMAYIDAPEMKQAYGTRSRDN
                  70        80        90       100       110       120

130       140       150       160       170       180
     a992.pep   LRAAAEGRKVSVRVFDTDRYQREVAQVSVGKTDLNLMQVQDGAAWHYKSYAKEQQDKADF
                ||||||||||||||||||||||||||||||||||||||||||||||||||||||||||||
     m992       LRAAAEGRKVSVRVFDTDRYQREVAQVSVGKTDLNLMQVQDGAAWHYKSYAKEQQDKADF
                 130       140       150       160       170       180

190       200       210       220       230
     a992.pep   ADYADAQIQAERERKGLWKAKNPQAPWAYRRAGRSGGGNKDWMDAVGEWLGIWX
                |||||||||||||||||||||||||||||||||||||||||||||||||||||
     m992       ADYADAQIQAERERKGLWKAKNPQAPWAYRRAGRSGGGNKDWMDAVGEWLGIWX
                 190       200       210       220       230
```

The following partial DNA sequence was identified in *N. gonorrhoeae* <SEQ ID 3001>:

```
g993.seq
   1 CTGAAAGTCG TATTGGGCAG TTTTCAAGGC CCTTTGGATC TGCTGCTCTA

51 CCTTATCCGC AAGCAGAACA TCGATGTTCT CGATATTCCG ATGGTGGAAA

101 TTACCGGGCA GTATCTGCAC TATATTGCCC AAATGGAAGC CTATCAGTTT

151 GATTTGGCGG CGGAATATCT TTTGATGGCG GCAATGCTGA TTGAAATCAA

201 ATCGCGCCTG CTGCTGCCGC GTACCGAAGC CGTCGAAGAC GAAGAGGCCG

251 ACCCGCGTGC CGAGTTGGTG CGCCGTCTGC TTGCCTACGA GCAAATGAAA

301 CTGGCGGCGC AGGGTTTGGA CGCGCTGCCG CGTGCGGGAC GGGATTTCGC

351 GTGGGCTTAC CTGCCGCTGG AAATTGCAGC CGAGACGAAG CTGCCCGAGG

401 TTTACATCGC CGATTTGATG CAGGCATGGT TGGGCATTCT TTCTCGGGCA

451 AAACATACGC GCAGCCACGA AGTAATCCAA GAAACCCTTT CCGTGCGCGC

501 GCAAATGACG GCAATCCTGC GCCGTTTGAA CGAACACGGG ATATGCAGGT

551 TTCACGCCCT GTTCAATCCC GAACAGGGCG CGGCTTACGT GATCGTCAAC

601 TTCATCGCCC TGTTGGAGCT TGCCAAAGAA GGATTGGTCG GAATCGTACA

651 GGAAGACGGT TTCGGAGAAA TCCGAATCAG CCTCAATCAT GAGGGGGCGC

701 ATTCAGACGG CATTTTCGGC ACACGGGGCG GGCGCGATGT GTTCTAA
```

This corresponds to the amino acid sequence <SEQ ID 3002 ORF 993.ng>:

```
g993.pep
   1 LKVVLGSFQG PLDLLLYLIR KQNIDVLDIP MVEITGQYLH YIAQMEAYQF

51 DLAAEYLLMA AMLIEIKSRL LLPRTEAVED EEADPRAELV RRLLAYEQMK

101 LAAQGLDALP RAGRDFAWAY LPLEIAAETK LPEVYIADLM QAWLGILSRA

151 KHTRSHEVIQ ETLSVRAQMT AILRRLNEHG ICRFHALFNP EQGAAYVIVN

201 FIALLELAKE GLVGIVQEDG FGEIRISLNH EGAHSDGIFG TRGGRDVF*
```

The following partial DNA sequence was identified in *N. meningitidis* <SEQ ID 3003>:

```
m993.seq
   1 TTGAAAGTCG TATTGGGCAG CTTCCAAGGC CCTTTGGATC TACTGCTGTA

51 TCTGATCCGC AAACAGAATA TCGACGTACT GGATATTCCG ATGGTGAAGA

101 TTACCGAGCA GTATCTGCAC TACATCGCCC AAATAGAAAC CTATCAGTTT

151 GATTTGGCGG CGGAATATCT TTTGATGGCA GCAATGCTGA TTGAAATCAA

201 ATCGCGCCTG CTGCTGCCGC GTACCGAAAC CGTCGAAGAC GAAGAAGCCG

251 ACCCGCGTGC CGAGTTGGTG CGCCGCCTGC TGGCTTACGA ACAGATGAAG

301 CTGGCGGCGC AGGGTTTGGA CGCGCTGCCC CGAGCCGGAC GGGATTTCGC

351 GTGGGCTTAC CTGCCGCTGG AAATTGCCGT CGAAGCCAAG CTGCCCGAAG

401 TCTATATTAC CGACTTGACG CAAGCGTGGC TGGGTATTTT GTCTCGGGCA

451 AAACACACGC GCAGCCACGA AGTAATCAAA GAAACCATCT CCGTGCGCGC

501 GCAAATGACG GCAATCCTGC GCCGTTTGAA CGGACACGGA ATATGCAGGT

551 TTCACGACCT GTTCAATCCC AAACAGGGCG CGGCTTACGT GGTCGTCAAC
```

```
-continued
601 TTCATCGCAC TGTTGGAGCT TGCCAAAGAA GGATTGGTCA GAATCGTGCA

651 GGAAGACGGT TTCGGAGAAA TCCGAATCAG CCTCAATCAT GAGGGGGCGC

701 ATTCAGACGG CATTTCCGGC ACACGAGGCG GGCGCGATGT GTTCTAA
```

This corresponds to the amino acid sequence <SEQ ID 3004; ORF 993>:

```
m993.pep
  1 LKVVLGSFQG PLDLLLYLIR KQNIDVLDIP MVKITEQYLH YIAQIETYQF

51 DLAAEYLLMA AMLIEIKSRL LLPRTETVED EEADPRAELV RRLLAYEQMK

101 LAAQGLDALP RAGRDFAWAY LPLEIAVEAK LPEVYITDLT QAWLGILSRA

151 KHTRSHEVIK ETISVRAQMT AILRRLNGHG ICRFHDLFNP KQGAAYVVVN

201 FIALLELAKE GLVRIVQEDG FGEIRISLNH EGAHSDGISG TRGGRDVF*
```

Computer analysis of this amino acid sequence gave the following results:
Homology with a Predicted ORF from *N. gonorrhoeae*
ORF 993 shows 93.1% identity over a 248 aa overlap with a predicted ORF (ORF 993) from *N. gonorrhoeae*

```
    m993/g993   93.1% identity in 248 aa overlap 10         20         30         40         50         60
    m993.pep   LKVVLGSFQGPLDLLLYLIRKQNIDVLDIPMVKITEQYLHYIAQIETYQFDLAAEYLLMA
               ||||||||||||||||||||||||||||||||:||  ||||||||:||||||||||||||
    g993       LKVVLGSFQGPLDLLLYLIRKQNIDVLDIPMVEITGQYLHYIAQMEAYQFDLAAEYLLMA
                     10         20         30         40         50         60

70         80         90        100        110        120
    m993.pep   AMLIEIKSRLLLPRTETVEDEEADPRAELVRRLLAYEQMKLAAQGLDALPRAGRDFAWAY
               |||||||||||||||:|||||||||||||||||||||||||||||||||||||||||||
    g993       AMLIEIKSRLLLPRTEAVEDEEADPRAELVRRLLAYEQMKLAAQGLDALPRAGRDFAWAY
                     70         80         90        100        110        120

130        140        150        160        170        180
    m993.pep   LPLEIAVEAKLPEVYITDLTQAWLGILSREKHTRSHEVIKETISVRAQMTAILRRLNGHG
               ||||||:|:|||||||:||  ||||||||||||||||||:||:|||||||||||||| ||
    g993       LPLEIAAETKLPEVYIADLMQAWLGILSRAKHTRSHEVIQETLSVREQMTAILRRLNEHG
                    130        140        150        160        170        180

190        200        210        220        230        240
    m993.pep   ICRFHDLFNPKQGAAYVVVNFIALLELAKEGLVRIVQEDGFGEIRISLNHEGAHSDGISG
               |||||  ||||:||||||:||||||||||||||| |||||||||||||||||||||  |
    g993       ICRFHALFNPEQGAAYVIVNFIALLELAKEGLVGIVQEDGFGEIRISLNHEGAHSDGIFG
                    190        200        210        220        230        240

249
    m993.pep   TRGGRDVFX
               |||||||||
    g993       TRGGRDVFX
```

The following partial DNA sequence was identified in *N. meningitidis* <SEQ ID 3005>:

```
a993.seq
  1 CTGAAAGTCG TATTGAGCAG TTTTCAAGGC CCTTTGGATC TGCTGCTCTA

51 CCTTATCCGC AAGCAGAACA TCGATGTTCT CGATATTCCG ATGGTGAAGA

101 TTACCGAACA GTATCTGCAC TACATCGCCC AAATAGAAAC CTATCAGTTT

151 GATTTGGCGG CGGAATATCT TTTGATGGCA GCAATGCTGA TTGAAATCAA

201 ATCGCGCCTG CTGCTGCCGC GTACCGAAAC CGTCGAAGAC GAAGAAGCCG

251 ACCCGCGTGC CGAGTTGGTG CGCCGCCTGC TGGCTTACGA GCAGATGAAG

301 CTGGCGGCAC AAGGGTTGGA TGCGCTTCCT CGTGCGGGCC GGGATTTCGC
```

```
351 ATGGGCATAC CTGCCACTGG AAATTGCCGT CGAAGCCAAG CTGCCCGAAG

401 TCTATATTAC CGACTTGACG CAGGCGTGGC TGAGTATTTT GTCTCGGGCA

451 AAACATACGC GCAGCCACGA AGTTATCAAA GAAACCATCT CCGTGCGCGC

501 GCAAATGACG GCAATCCTGC GCCGTTTGAA CAAACACGGG ATATGCAGGT

551 TTCACGACCT GTTCAATCCC GAACAGGGCG CGGCTTACGT GGTCGTCAAC

601 TTCATCGCAC TGTTGGAGCT TGCCAAAGAA GGTTTGGTCG AATCGTACA

651 GGAAGTCGGT TTCGGAGAAA TCCGAATCAG CCTCAATCAT GAGGGGGCGC

701 ATTCAGACGG CATTTCCGGC ACACGGGGCG GGCGCGATGT GTTCTAA
```

This corresponds to the amino acid sequence <SEQ ID 3006; ORF 993.a>:

```
a993.pep
  1 LKVVLSSFQG PLDLLLYLIR KQNIDVLDIP MVKITEQYLH YIAQIETYQF

51 DLAAEYLLMA AMLIEIKSRL LLPRTETVED EEADPRAELV RRLLAYEQMK

101 LAAQGLDALP RAGRDFAWAY LPLEIAVEAK LPEVYITDLT QAWLSILSRA

151 KHTRSHEVIK ETISVRAQMT AILRRLNKHG ICRFHDLFNP EQGAAYVVVN

201 FIALLELAKE GLVGIVQEVG FGEIRISLNH EGAHSDGISG TRGGRDVF*
```

Computer analysis of this amino acid sequence gave the following results:
Homology with a Predicted ORF from *N. meningitidis*
ORF 993 shows 97.6% identity over a 248 aa overlap with a predicted ORF (ORF 993) from *N. meningitidis*

```
    a993/m993   97.6% identity in 248 aa overlap 10         20         30         40         50         60
    a993.pep   LKVVLSSFQGPLDLLLYLIRKQNIDVLDIPMVKITEQYLHYIAQIETYQFDLAAEYLLMA
               |||||:||||||||||||||||||||||||||||||||||||||||||||||||||||||
    m993       LKVVLGSFQGPLDLLLYLIRKQNIDVLDIPMVKITEQYLHYIAQIETYQFDLAAEYLLMA
                   10         20         30         40         50         60

70         80         90        100        110        120
    a993.pep   AMLIEIKSRLLLPRTETVEDEEADPRAELVRRLLAYEQMKLAAQGLDALPRAGRDFAWAY
               ||||||||||||||||||||||||||||||||||||||||||||||||||||||||||||
    m993       AMLIEIKSRLLLPRTETVEDEEADPRAELVRRLLAYEQMKLAAQGLDALPRAGRDFAWAY
                   70         80         90        100        110        120

130        140        150        160        170        180
    a993.pep   LPLEIAVEAKLPEVYITDLTQAWLSILSRAKHTRSHEVIKETISVRAQMTAILRRLNKHG
               |||||||||||||||||||||||||||:||||||||||||||||||||||||||||| ||
    m993       LPLEIAVEAKLPEVYITDLTQAWLGILSRAKHTRSHEVIKETISVRAQMTAILRRLNGHG
                  130        140        150        160        170        180

190        200        210        220        230        240
    a993.pep   ICRFHDLFNPEQGAAYVVVNFIALLELAKEGLVGIVQEVGFGEIRISLNHEGAHSDGISG
               ||||||||||:||||||||||||||||||||| |||| ||||||||||||||||||||||
    m993       ICRFHDLFNPKQGAAYVVVNFIALLELAKEGLVRIVQEDGFGEIRISLNHEGAHSDGISG
                  190        200        210        220        230        240

249
    a993.pep   TRGGRDVFX
               |||||||||
    m993       TRGGRDVFX
```

The following partial DNA sequence was identified in *N. gonorrhoeae* <SEQ ID 3007>:

```
g996.seq
  1 ATGAACAGAA GAACCTTCCT CCTCGGCGCA GGCGCGTTGC TTCTTACCGC

51 CTGCGGCAGA AAATCCGCCC GAACCCACGC CAAAATTCCC GAAGGAAGCA
```

-continued
```
101 CCGTGCTTGC CTTGGGCGAT TCGCTCACCT TCGGCTACGG AGCAAACCCC

151 GGCGAATCCT ACCCCGCGCA ACTGCAAAAA CTGACGGGTT GGAATATTGT

201 CAACGGCGGC GTATCGGGCG ATACGTCCGC GCAAGCCCTA TCGCGCCTGC

251 CCGCGCTGTT GGCACGCAAA CCCAAGCTTG TGATTGTCGG CATAGGCGGC

301 AACGACTTTC TGCGCAAAGT TCCCGAGGAG CAGACCCGCG CCAATATCGC

351 GAAAATCATC GAAACCGTGC AAAAGGAAAA CATTCCCGCC GTCCTCGTCG

401 GCGTGCCGCA CATCACACTG GGCGCGTTGT TCGGGCATTT GAGCGACCAT

451 CCGCTGTATG AGGATTTGTC CGAGGAATAC GGCATTCCGT TGTTCGGCGG

501 CGCGTGGGCG GAAATTTTGG GCAATAATAA TCTGAAATCC GACCAAATCC

551 ACGCCAACGG CAAAGGCTAT CGGAAATTCG CCGAAAATTT GAATCAATTT

601 TTGAGAAAAC ATGGGTTTAG ATAA
```

This corresponds to the amino acid sequence <SEQ ID 3008 ORF 996.ng>:

```
g996.pep
  1 MNRRTFLLGA GALLLTACGR KSARTHAKIP EGSTVLALGD SLTFGYGANP

51 GESYPAQLQK LTGWNIVNGG VSGDTSAQAL SRLPALLARK PKLVIVGIGG

101 NDFLRKVPEE QTRANIAKII ETVQKENIPA VLVGVPHITL GALFGHLSDH

151 PLYEDLSEEY GIPLFGGAWA EILGNNNLKS DQIHANGKGY RKFAENLNQF

201 LRKHGFR*
```

The following partial DNA sequence was identified in *N. meningitidis* <SEQ ID 3009>:

```
m996.seq
  1 ATGAACAGAA GAACCTTCCT CCTCGGCGCA GGCGCGTTGC TGCTTACCGC

51 CTGCGGCAGA AAATCCGCCC GAACCCACGC CAAAATTCCC GAAGGAAGCA

101 CCGTACTTGC CTTGGGCGAT TCGCTTACCT TCGGCTACGG CGCAAACCCT

151 GGCGAATCCT ACCCCGCGCA ACTGCAAAAA CTGACGGGTT GGAATATTGT

201 CAACGGCGGC GTATCGGGCG ATACATCTGC CCAAGCCCTG TCGCGCCTGC

251 CCGCGCTGTT GGCACGCAAA CCCAAGCTTG TGATTGTCGG CATAGGCGGC

301 AACGACTTTC TGCGCAAAGT TCCCAAGGAG CAGACCCGCG CCAATATCGC

351 GAAAATCATC GAAACCGTGC AGAAGGAAAA CATCCCCGCC GTCCTCGTCG

401 GCGTGCCGCA CATCACACTG GGTGCGTTGT TCGGGCATTT GAGCGATCAT

451 CCGCTGTATG AGGATTTGTC CGAGGAATAC GGCATTCCGC TGTTCGGCGG

501 CGCGTGGGCG GAAATTTTGG GCGATAATAA TCTGAAATCC GACCAAATCC

551 ACGCCAACGG CAAAGGCTAT CGGAAATTTG CCGAAGATTT GAATCAATTT

601 TTGAGAAAAC AGGGGTTTAG ATAA
```

This corresponds to the amino acid sequence <SEQ ID 3010; ORF 996>:

```
m996.pep
  1 MNRRTFLLGA GALLLTACGR KSARTHAKIP EGSTVLALGD SLTFGYGANP

51 GESYPAQLQK LTGWNIVNGG VSGDTSAQAL SRLPALLARK PKLVIVGIGG
```

-continued
```
101 NDFLRKVPKE QTRANIAKII ETVQKENIPA VLVGVPHITL GALFGHLSDH

151 PLYEDLSEEY GIPLFGGAWA EILGDNNLKS DQIHANGKGY RKFAEDLNQF

201 LRKQGFR
```

Computer analysis of this amino acid sequence gave the following results:
Homology with a Predicted ORF from *N. gonorrhoeae*
ORF 996 shows 98.1% identity over a 207 aa overlap with a predicted ORF (ORF 996) from *N. gonorrhoeae*

```
    m996/g996  98.1% identity in 207 aa overlap 10         20         30         40         50         60
    m996.pep   MNRRTFLLGAGALLLTACGRKSARTHAKIPEGSTVLALGDSLTFGYGANPGESYPAQLQK
               ||||||||||||||||||||||||||||||||||||:|||||||||||||||||||||||
    g996       MNRRTFLLGAGALLLTACGRKSARTHAKIPEGSTBLALGDSLTGGYGANPGESYPAQLQK
                    10         20         30         40         50         60

70         80         90        100        110        120
    m996.pep   LTGWNIVNGGVSGDTSAQALSRLPALLARKPKLVIVGIGGNDFLRKVPKEQTRANIAKII
               |||||||||||||||||||||||||||||||||||||||||||||||:||||||||||||
    g996       LTGWNIVNGGVSGDTSAQALSRLPALLARKPKLVIVGIGGNDFLRKVPEEQTRANIAKII
                    70         80         90        100        110        120

130        140        150        160        170        180
    m999.pep   ETVQKENIPAVLVGVPHITLGALFGHLSDHPLYEDLSEEYGIPLFGGAWAEILGDNNLKS
               |||||||||||||||||||||||||||||||||||||||||||||||||||:||||||||
    g996       ETVQKENIPAVLVGVPHITLGALFGHLSDHPLYEDLSEEYGIPLFGGAWAEILGNNNLKS
                   130        140        150        160        170        180

190        200
    m996.pep   DQIHANGKGYRKFAEDLNQFLRKQGFR
               ||||||||||||||||:|||||||:|||
    g996       DQIHANGKGYRKFAENLNQFLRKHGFRX
                   190        200
```

The following partial DNA sequence was identified in *N. meningitidis* <SEQ ID 3011>:

```
a996.seq
   1 ATGAACAGAA GAACCTTCCT CCTCGGCGCA GGCGCGTTGC TCCTTACCGC

51 CTGCGGCAGA AAATCCGCCC GAACCCACGC CAAAATTCCC GAAGGAAGCA

101 CCGTACTTGC CTTGGGCGAT TCGCTTACCT TCGGCTACGG CGCAAACCCC

151 GGCGAATCCT ACCCCGCGCA ACTGCAAAAA CTGACGGGTT GGAATATTGT

201 CAACGGCGGC GTATCGGGCG ATACATCCGC CCAAGCCCTG TCGCGCCTGC

251 CCGCGCTGTT GGCACGCAAA CCCAAGCTTG TGATTGTCGG CATAGGCGGC

301 AACGACTTTC TGCGCAAAGT TCCCAAGGAG CAGACCCGCG CCAATATCGC

351 GAAAATCATC GAAACCGTGC AGAAGGAAAA CATCCCCGCC GTCCTCGTCG

401 GCGTGCCGCA CATTACCTTG GGCGCGTTGT TCGGGCATTT GAGCGATCAT

451 CCGCTGTATG AGGATTTGTC CGAGGAATAC GGCATTCCGC TGTTCGGCGG

501 CGCGTGGGCG GAAATTTTGG GCGATAATAA TCTGAAATCC GACCAAATCC

551 ACGCCAACGG CAAAGGCTAT CGGAAATTTG CCGAAGATTT GAATCAATTT

601 TTGAGAAAAC AGGGGTTTAG ATAA
```

This corresponds to the amino acid sequence <SEQ ID 3012; ORF 996.a>:

```
a996.pep
   1 MNRRTFLLGA GALLLTACGR KSARTHAKIP EGSTVLALGD SLTFGYGANP

51 GESYPAQLQK LTGWNIVNGG VSGDTSAQAL SRLPALLARK PKLVIVGIGG
```

```
101 NDFLRKVPKE QTRANIAKII ETVQKENIPA VLVGVPHITL GALFGHLSDH

151 PLYEDLSEEY GIPLFGGAWA EILGDNNLKS DQIHANGKGY RKFAEDLNQF

201 LRKQGFR*
```

Computer analysis of this amino acid sequence gave the following results:
Homology with a Predicted ORF from *N. meningitidis* ORF 996 shows 100.0% identity over a 207 aa overlap with a predicted ORF (ORF 996) from *N. meningitidis*

```
   a996/m996   100.0% identity in 207 aa overlap 10        20        30        40        50        60
   a996.pep    MNRRTFLLGAGALLLTACGRKSARTHAKIPEGSTVLALGDSLTFGYGANPGESYPAQLQK
               ||||||||||||||||||||||||||||||||||||||||||||||||||||||||||||
   m996        MNRRTFLLGAGALLLTACGRKSARTHAKIPEGSTVLALGDSLTFGYGANPGESYPAQLQK
                     10        20        30        40        50        60
                     70        80        90       100       110       120
   a996.pep    LTGWNIVNGGVSGDTSAQALSRLPALLARKPKLVIVGIGGNDFLRKVPKEQTRANIAKII
               ||||||||||||||||||||||||||||||||||||||||||||||||||||||||||||
   m996        LTGWNIVNGGVSGDTSAQALSRLPALLARKPKLVIVGIGGNDFLRKVPKEQTRANIAKII
                     70        80        90       100       110       120
                    130       140       150       160       170       180
   a996.pep    ETVQKENIPAVLVGVPHITLGALFGHLSDHPLYEDLSEEYGIPLFGGAWAEILGDNNLKS
               ||||||||||||||||||||||||||||||||||||||||||||||||||||||||||||
   m996        ETVQKENIPAVLVGVPHITLGALFGHLSDHPLYEDLSEEYGIPLFGGAWAEILGDNNLKS
                    130       140       150       160       170       180
                    190       200
   a996.pep    DQIHANGKGYRKFAEDLNQFLRKQGFRX
               |||||||||||||||||||||||||||
   m996        DQIHANGKGYRKFAEDLNQFLRKQGFR
                    190       200
```

The following partial DNA sequence was identified in *N. gonorrhoeae* <SEQ ID 3013>:

```
g997.seq (partial)
    1 ATGATGAACA CGCCGCATCC GCGCCCGAAA ATCGCCGTCA TCGGCGCAGG

51 CTGGGCCGGC TTGTCCGCCG CCGTCACCTT GGCGCGGCAC GCCGACGTTA

101 CCCTGTTTGA AGCCGGCCGG CAGGCGGGCG GAAGGGCGCG CACACTGGCC

151 GGAAATACCG ACGGTTTCGG TTTTTTGGAC AACGGGCAGC ACATTTTGCT

201 CGGCGCATAC CGGGGCGTGT TGCGCCTGAT GAAAACCATC GGTTCAGACC

251 CCCGTGCCGC CTTTTTGCGC GTACCGCTGC ACTGGCATAT GCACGGCGGT

301 TTGCAGTTCC GCGCCCTCCC CCTGCCCGCG CCGCTGCATA TTTTGGGCGG

351 CGTGCTGCTT GCCCGGCGCG TACCGTCCGC ATTCAAAGCC AAACTGCTTG

401 CCGATATGTC CGATTTGCAG AAGTCCGCAC GCCTCGGACA GCCCGACACG

451 ACAGTTGCAC AATGGCTGAA ACAGCGGAAC GTGCCGCGTG CCGCCGTAAT

501 GCAGTTTTGG CAGCCCTTGG TCTGGGGCGC GCTCAACACG CCTTTGGAAA

551 CCGCAAGCCT GCGCGTGTTG TGCAACGTTT TGTCCGACGG CGTGCTGACG

601 AAAAAATCCG GCAGCGACTA TCTCCTACCC AAACAGGATT TGGGCGCAAT

651 CGTCGCCGAA CCCGCCTTGG CGGAGCTTCA ACGGCTCGGC GCGGACATCC

701 GCCTCGAAAC GCGCGTATGC CGTCTGAACA CCCTCCCGGA CGGAAAAGTC

751 CTCGTCAACG GCGAAGCCTT CGATGCCGCC ATACTTGCCA CCGCGCCCTA

801 CCACGCCGCC GCGCTCCTGC CGAAGGCAC GCCCGAACAC GTTCAGACGG
```

```
 851 CATATCAAAA CCTTCGCTAC CACGCCATCA CCACCGTCTA TCTGCGCTAC

901 GCCGAACCCG TCCGcCTGCc CGCCCCGCTG ACcGGCATtg CCGAcggcAC 951 ggcaCaatgG CTGCTTTgcc cgGGGCAGGC tccggactgc CcccaaAacg 1001 aagTCTCCGC cGTCAttagc GTTTCCGAcc GCGtcggcgC Gtttgcaaac 1051 cga...
```

This corresponds to the amino acid sequence <SEQ ID 3014 ORF 997.ng>:

```
g997.pep (partial)
  1 MMNTPHPRPK IAVIGAGWAG LSAAVTLARH ADVTLFEAGR QAGGRARTLA

51 GNTDGFGFLD NGQHILLGAY RGVLRLMKTI GSDPRAAFLR VPLHWHMHGG

101 LQFRALPLPA PLHILGGVLL ARRVPSAFKA KLLADMSDLQ KSARLGQPDT

151 TVAQWLKQRN VPRAAVMQFW QPLVWGALNT PLETASLRVL CNVLSDGVLT

201 KKSGSDYLLP KQDLGAIVAE PALAELQRLG ADIRLETRVC RLNTLPDGKV

251 LVNGEAFDAA ILATAPYHAA ALLPEGTPEH VQTAYQNLRY HAITTVYLRY

301 AEPVRLPAPL TGIADGTAQW LLCPGQAPDC PQNEVSAVIS VSDRVGAFAN

351 R....
```

The following partial DNA sequence was identified in *N. meningitidis* <SEQ ID 3015>:

```
m997.seq
    1 ATGATGAACA CGCCGCATCC GCGCCCGAAA ATCGCCGTCA TCGGCGCAGG

51 CTGGGCAGGA CTGTCCGCCG CCGTCACCTT GGCGCGGCAC GCCGACGTTA

101 CCCTGTTTGA AGCCGGCCGG CAGGCGGGCG GCAGGGCGCG CACACTGGCC

151 GGAAATACCG ACGGTTTCGG TTTTTTGGAC AACGGGCAGC ACATTTTGCT

201 CGGCGCATAC CGGGGCGTGT TGCGCCTGAT GAAAACCATC GGTTCGGATC

251 CCCGTGCCGC CTTTTTGCGC GTACCGCTGC ACTGGCATAT GCACGGCGGT

301 TTGCAGTTCC GCGCCCTCCC CCTGCCCGCG CCGCTGCATA TTTTGGGCGG

351 CGTGCTGCTT GCCCGGCGTG CACCGACTGC ATTCAAAGCC AAACTGCTTG

401 CCGATATGTC CGATTTGCAG AAGTCCGCAC GCCTCGGACA GCCCGACACG

451 ACAGTGGCGC AATGGCTGAA ACAGCGGAAC GTGCCGCGTG CCGCCGTGAT

501 GCAGTTTTGG CAGCCCTTGG TTTGGGGCGC GCTCAACACG CCTTTGGAAA

551 CCGCAAGCCT GCGCGTGTTG TGCAACGTTT TGTCCGACGG CGTGCTGACG

601 AAAAAATCCG GCAGCGACTA TCTCCTACCC AAGCAGGATT TGGGCGCAAT

651 CGTCGCCGAA CCCGCCTTGG CGGATCTTCA ACGGCTCGGC GCGGACATCC

701 GCCTCGAAAC GCGCGTATGC CGTCTGAACA CCCTCCCGGA CGGGAAAGTG

751 CTCGTCAACG GCGAAGCTTT CGATGCCGCC GTCCCCGCCA CCGCGCCCTA

801 CCACGCCGCC GCGCTCCTGC CCGAAGGCAC GCCCGAACAC GTTCAGACGG

851 CATATCAAAA CCTTCGCTAC CACGCCATCA CCACCGTCTA TCTGCGCTAC

901 GCCGAACCCG TCCGCCTGCC CGCCCCGCTG ACCGGCCTTG CCGACGGCAC

951 GGTGCAATGG CTGCTTTGCC GGGGCAGGCT CGGACTGCCT GAAAACGAAG

1001 TGTCCGCCGT CATCAGCGTT TCCGACCGCG TCGGCGCGTT TGCAAACCGG
```

-continued
```
1051 GCGTGGGCGG ACAAAGCCCA CGCCGACCTC AAACGCATCC TTCCGCATTT

1101 GGGCGAACCC GAAGCCGTGC GCGTCATCAC CGAAAAACGC GCCACAACCG

1151 CAGCCGATGC CCCGCCGCCG GACTTGTCGT GGTTGCACCG GCACCGCATC

1201 TTCCCCGCCG GCGACTACCT CCACCCGGAC TACCCCGCCA CGCTCGAAGC

1251 CGCCGTACAA TCAGGTTTCG CGTCGGCGGA AGCCTGCCTG CAAAGCCTGA

1301 GCGATGCCGT CTGA
```

This corresponds to the amino acid sequence <SEQ ID 3016; ORF 997>:

```
m997.pep
  1 MMNTPHPRPK IAVIGAGWAG LSAAVTLARH ADVTLFEAGR QAGGRARTLA

51 GNTDGFGFLD NGQHILLGAY RGVLRLMKTI GSDPRAAFLR VPLHWHMHGG

101 LQFRALPLPA PLHILGGVLL ARRAPTAFKA KLLADMSDLQ KSARLGQPDT

151 TVAQWLKQRN VPRAAVMQFW QPLVWGALNT PLETASLRVL CNVLSDGVLT

201 KKSGSDYLLP KQDLGAIVAE PALADLQRLG ADIRLETRVC RLNTLPDGKV

251 LVNGEAFDAA VPATAPYHAA ALLPEGTPEH VQTAYQNLRY HAITTVYLRY

301 AEPVRLPAPL TGLADGTVQW LLCRGRLGLP ENEVSAVISV SDRVGAFANR

351 AWADKAHADL KRILPHLGEP EAVRVITEKR ATTAADAPPP DLSWLHRHRI

401 FPAGDYLHPD YPATLEAAVQ SGFASAEACL QSLSDAV*
```

Computer analysis of this amino acid sequence gave the following results:
Homology with a Predicted ORF from *N. gonorrhoeae*
ORF 997 shows 96.0% identity over a 351 aa overlap with a predicted ORF (ORF 997) from *N. gonorrhoeae*

```
    g997/m997   96.0% identity in 351 aa overlap 10         20         30         40         50         60
    g997.pep  MMNTPHPRPKIAVIGAGEAGLSAAVTLARHADVTLFEAGRQAGGRARTLAGNTDGFGFLD
              ||||||||||||||||||:|||||||||||||||||||||||||||||||||||||||||
    m997      MMNTPHPRPKIAVIGAGWAGLSAAVTLARHADVTLFEAGRQAGGRARTLAGNTDGFGFLD
                    10         20         30         40         50         60

70         80         90        100        110        120
    g997.pep  NGQHILLGAYRGVLRLMKTIGSDPRAAFLRVPLHWHMHGGLQFRALPLPAPLHILGGVLL
              ||||||||||||||||||||||||||||||||||||||||||||||||||||||||||||
    m997      NGQHILLGAYRGVLRLMKTIGSDPRAAFLRVPLHWHMHGGLQFRALPLPAPLHILGGVLL
                    70         80         90        100        110        120

130        140        150        160        170        180
    g997.pep  ARRVPSAFKAKLLADMSDLQKSARLGQPDTTVAQWLKQRNVPRAAVMQFWQPLVWGALNT
              |||:|:||||||||||||||||||||||||||||||||||||||||||||||||||||||
    m997      ARRAPTAFKAKLLADMSDLQKSARLGQPDTTVAQWLKQRNVPRAAVMQFWQPLVWGALNT
                   130        140        150        160        170        180

190        200        210        220        230        240
    g997.pep  PLETASLRVLCNCLSDGVLTKKSGSDYLLPKQDLGAIVAEPALAELQRLGADIRLETRVC
              |||||||||||||:||||||||||||||||||||||||||||||:||||||||||||||
    m997      PLETASLRVLCNVLSDGVLTKKSGSDYLLPKQDLGAIVAEPALADLQRLGADIRLETRVC
                   190        200        210        220        230        240

250        260        270        280        290        300
    g997.pep  RLNTLPDGKVLVNGEAFDAAILATAPYHAAALLPEGTPEHVQTAYQNLRYHAITTVYLRY
              ||||||||||||||||||||:|||||||||||||||||||||||||||||||||||||||
    m997      RLNTLPDGKVLVNGEAFDAAVPATAPYHAAALLPEGTPEHVQTAYQNLRYHAITTVYLRY
                   250        260        270        280        290        300

310        320        330        340        350
    g997.pep  AEPVRLPAPLTGIADGTAQWLLCPGQAPDCPQNEVSAVISVSDRVGAFANR
              ||||||||||||:||||:||||| :     |:|||||||||||||||||||
    m997      AEPVRLPAPLTGLADGTVQWLLCRGRL-GLPENEVSAVISVSDRVGAFANRAWADKAHAD
                   310        320        330        340        350
```

The following partial DNA sequence was identified in *N. meningitidis* <SEQ ID 3017>:

```
a997.seq
   1 ATGATGAACA CGCCGCATCC GCGCCCGAAA ATCGCCGTCA TCGGCGCAGG
  51 CTGGGCCGGC TTGTCCGCCG CCGTTACCTT GGCGCGGCAC GCCGACGTTA
 101 CCCTGTTTGA AGCCGGCCGG CAGGCGGGCG GCAGGGCGCG CGCACTGGCC
 151 GGAAATACCG ACGGTTTCGG TTTTTTGGAC AACGGGCAGC ATATTTTACT
 201 CGGCGCATAC CGGGGCGTGT TGCGCCTGAT GAAAACCATC GGTTCAGACC
 251 CCCATGCCGC CTTTTTGCGC GTACCGCTGC ACTGGCATAT GCACGGCGGT
 301 TTGCAGTTCC GCGCCCTCCC CCTGCCCGCG CCCCTGCATA TTTTGGGCGG
 351 CGTGCTGCTT GCCCGGCGCG TACCGTCCGC ATTCAAAGCC AAACTGCTTG
 401 CCGATATGTC CGATTTGCAG AAGTCCGCAC GCCTCGGACA GCCCGACACG
 451 ACAGTGGCGC AATGGCTGAA ACAGCGGAAC GTGCCGCGTG CCGCCGTAAT
 501 GCAGTTTTGG CAGCCCTTGG TTTGGGGCGC GCTCAACACG CCTTTGGAAA
 551 CCGCAAGCCT GCGCGTGTTG TGCAACGTTT TGTCCGACGG CGTGCTGACG
 601 AAAAAATCCG GCAGCGACTA TCTCCTACCC AAACAGGATT TGGGCGCAAT
 651 CGTCGCCGAA CCCGCCTTGG CGGAGCTTCA ACGGCTCGGC GCGGACATCC
 701 GCCTCGAAAC GCGCATATGC CGTCTGAACA CCCTCCCGGA CGGGAAAGTG
 751 CTCGTCAACG GCGAACCTTT CGATGCCGCC GTCCCCGCCA CCGCGCCCTA
 801 CCACGCCGCC GCGCTCCTGC CCGAAGGCAC GCCCGAACAC GTTCAGACGG
 851 CATATCAAAA CCTTCGCTAT CACGCCATCA CCACCGTCTA TCTGCGCTAT
 901 GCCGAACCCG TCCGCTTGCC TGCCCCGCTG ACCGGACTTG CCGACGGCAC
 951 GGTGCAATGG CTGCTTTGCC GGGGCAGGCT CGGACTGCCT GAAAACGAAG
1001 TGTCCGCCGT CATCAGCGTT TCCGACCGCG TCGGCGCGTT TGCAAACCGG
1051 GCGTGGGCGG ACAAAGTTCA CGCCGACCTC AAACGCATCC TTCCGCATTT
1101 GGGCGAACCC GAAGCCGTGC GCGTCATCAC CGAAAAACGC GCCACAACCG
1151 CAGCCGATGC CCCGCCGCCG GATTTGTCGT GGTTGCACCG GCACCGCATC
1201 TTCCCCGCCG GCGACTACCT CCACCCAGAC TACCCCGCCA CGCTCGAAGC
1251 CGCCGTACAA TCAGGTTTCG CGTCGGCGGA AGCCTGCCTG CAAAGCCTGA
1301 GCGATGCCGT CTGA
```

This corresponds to the amino acid sequence <SEQ ID 3018; ORF 997.a>:

```
a997.pep
  1 MMNTPHPRPK IAVIGAGWAG LSAAVTLARH ADVTLFEAGR QAGGRARALA
 51 GNTDGFGFLD NGQHILLGAY RGVLRLMKTI GSDPHAAFLR VPLHWHMHGG
101 LQFRALPLPA PLHILGGVLL ARRVPSAFKA KLLADMSDLQ KSARLGQPDT
151 TVAQWLKQRN VPRAAVMQFW QPLVWGALNT PLETASLRVL CNVLSDGVLT
201 KKSGSDYLLP KQDLGAIVAE PALAELQRLG ADIRLETRIC RLNTLPDGKV
251 LVNGEPFDAA VPATAPYHAA ALLPEGTPEH VQTAYQNLRY HAITTVYLRY
301 AEPVRLPAPL TGLADGTVQW LLCRGRLGLP ENEVSAVISV SDRVGAFANR
```

```
351 AWADKVHADL KRILPHLGEP EAVRVITEKR ATTAADAPPP DLSWLHRHRI

401     FPAGDYLHPD YPATLEAAVQ SGFASAEACL QSLSDAV*
```

Computer analysis of this amino acid sequence gave the following results:
Homology with a Predicted ORF from N. meningitidis
ORF 997 shows 98.2% identity over a 437 aa overlap with a predicted ORF (ORF 997) from N. meningitidis

```
    a997/m997  98.2% identity in 437 aa overlap 10        20        30        40        50        60
    a997.pep   MMNTPHPRPKIAVIGAGWAGLSAAVTLARHADVTLFEAGRQAGGRARALAGNTDGFGFLD
               |||||||||||||||||||||||||||||||||||||||||:||||||||||||||||||
    m997       MMNTPHPRPKIAVIGAGWAGLSAAVTLARHADVTLFEAGRQAGGRARTLAGNTDGFGFLD
                       10        20        30        40        50        60

70        80        90       100       110       120
    a997.pep   NGQHILLGAYRGVLRLMKTIGSDPHAAFLRVPLHWHMHGGLQFRALPLPAPLHILGGVLL
               ||||||||||||||||||||||||:|||||||||||||||||||||||||||||||||||
    m997       NGQHILLGAYRGVLRLMKTIGSDPRAAFLRVPLHWHMHGGLQFRALPLPAPLHILGGVLL
                       70        80        90       100       110       120

130       140       150       160       170       180
    a997.pep   ARRVPSAFKAKLLADMSDLQKSARLGQPDTTVAQWLKQRNVPRAAVMQFWQPLVWGALNT
               |||:|:||||||||||||||||||||||||||||||||||||||||||||||||||||||
    m997       ARRAPTAFKAKLLADMSDLQKSARLGQPDTTVAQWLKQRNVPRAAVMQFWQPLVWGALNT
                      130       140       150       160       170       180

190       200       210       220       230       240
    a997.pep   PLETASLRVLCNVLSDGVLTKKSGSDYLLPKQDLGAIVAEPALAELQRLGADIRLETRIC
               |||||||||||||||||||||||||||||||||||||||||||:|||||||||||||:|
    m997       PLETASLRVLCNVLSDGVLTKKSGSDYLLPKQDLGAIVAEPALADLQRLGADIRLETRVC
                      190       200       210       220       230       240

250       260       270       280       290       300
    a997.pep   RLNTLPDGKVLVNGEPFDAAVPATAPYHAAALLPEGTPEHVQTAYQNLRYHAITTVYLRY
               ||||||||||||||||| ||||||||||||||||||||||||||||||||||||||||||
    m997       RLNTLPDGKVLVNGEAFDAAVPATAPYHAAALLPEGTPEHVQTAYQNLRYHAITTVYLRY
                      250       260       270       280       290       300

310       320       330       340       350       360
    a997.pep   AEPVRLPAPLTGLADGTVQWLLCRGRLGLPENEVSAVISVSDRVGAFANRAWADKVHADL
               ||||||||||||||||||||||||||||||||||||||||||||||||||||||:||||
    m997       AEPVRLPAPLTGLADGTVQWLLCRGRLGLPENEVSAVISVSDRVGAFANRAWADKAHADL
                      310       320       330       340       350       360

370       380       390       400       410       420
    a997.pep   KRILPHLGEPEAVRVITEKRATTAADAPPPDLSWLHRHRIFPAGDYLHPDYPATLEAAVQ
               ||||||||||||||||||||||||||||||||||||||||||||||||||||||||||||
    m997       KRILPHLGEPEAVRVITEKRATTAADAPPPDLSWLHRHRIFPAGDYLHPDYPATLEAAVQ
                      370       380       390       400       410       420

430
    a997.pep   SGFASAEACLQSLSDAVX
               ||||||||||||||||||
    m997       SGFASAEACLQSLSDAVX
                      430 g999.seq  Not found yet g999.pep  Not found yet
```

The following partial DNA sequence was identified in N. meningitidis <SEQ ID 3019>:

```
m999.seq
  1 ATGAATATGA AAAAATTGAT TTCCGCAATT TGTGTTTCAA TTGTTTTATC

51 AGCCTGCAAC CAACAATCAA AAACGGCACA AGCCGAAGAA CCTGTCCAAA

101 GTATCCAGGC TGCTGATTGT ACCGCCCCAA TGGACATCAC AGTTGAACAA

151 TATCTCATCA ATTTGGAGCA AGCATTTAAA ACTCAGAACG TCTCAACAAA

201 AATCCATAAT AAAAATATTG TCAAGACCGA TTGTGGTTAT GACCTTACTT

251 TGGTAATGGA TTTTGGGGCG ATTGCGCTCA AACTGGACGA GCAGCAAAAA
```

```
                           -continued
301 ATTAGAGCTA TCTCAGTAGG CTACATTTTA AAAACCGACG GAGAGAAAGG

351 ACAAAATCTA GTCAATAATG CCATAAATGG ATTACACAGT ATTCAGGCAG

401 TTCTGTCTTT AACTACCACA GACAAATTGG GCGAATCGGA AGCAGGAAAA

451 CAACTTTTTA CAGCTTTAAC CGAAGTCGTC AAAGAATCCA ATCAGACAGG

501 AGCAACAGCG CAAAAAGACG TTCCGGCAGA TGGTATTTTA TATAGCGTTG

551 TTTTTGAAAA AGAAACAAAC ACCATTGCAA TAATCGGCAG AAAACAACCC

601 TAA
```

This corresponds to the amino acid sequence <SEQ ID 3020; ORF 999>:

```
m999.pep
  1 MNMKKLISAI CVSIVLSACN QQSKTAQAEE PVQSIQAADC TAPMDITVEQ

51 YLINLEQAFK TQNVSTKIHN KNIVKTDCGY DLTLVMDFGA IALKLDEQQK

101 IRAISVGYIL KTDGEKGQNL VNNAINGLHS IQAVLSLTTT DKLGESEAGK

151 QLFTALTEVV KESNQTGATA QKDVPADGIL YSVVFEKETN TIAIIGRKQP * a999.seq Not found yet a999.pep Not found yet
```

The foregoing examples are intended to illustrate but not to limit the invention.

SEQUENCE LISTING (4168 sequences)

SEQ ID NO: 1 - DNA, 396 bp, Neisseria gonorrhoeae
atgctgccgcaggggaaggcggcgcggagggtgtcggcgaacgaggtgtccggcagggcttgcgcccggatggtgctggtcatctgccagacgctgccgaaacgcgatactttaaacggctcgggtacgcatactttaccggtttgggcgattttgccgaggtcgttgcgcagcaaatcgacaatcatcacgttttcggcgcggtttttcgggtcggtttgtaactcggcggcgcggcgttcgtcttgtccgtcgcccaaaatcggcgcggtgcctttcatcggttcggtgctgatggtgccgtctgaagcgatgttgaggaagagttcgggcgagaaacacagcgtccacgcggattgcccggcttcatcgggcaggtgggacaatacggcatag

SEQ ID NO: 2 - protein, 131 aa, Neisseria gonorrhoeae
MLPQGKAARRVSANEVSGRACARMVLVICQTLPKRDTLNGSGTHTLPVWAILPRSLRSKSTIITFSARFFGSVCNSAARRSSCPSPKIGAVPFIGSVLMVPSEAMLRKSSGEKHSVHADCPASSGRWDNTA

SEQ ID NO: 3 - DNA, 395 bp, Neisseria meningitidis
atgctgccgcaggggaaggcggcgcggaggatgtcggcgaacgaggtgtgcggcasscttssgcttggayggtgctggtcatctgccaaacgctgccgaaacgcgatactttaaacggttcgggtacgcatactgtgccggtttgggcgattttgccgagatcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccctccgcatcgggcaggtgggacaagacggcatag

SEQ ID NO: 4 - protein, 131 aa, Neisseria meningitidis
  misc_feature (19)..(19): Xaa can be any naturally occurring amino acid
  misc_feature (21)..(21): Xaa can be any naturally occurring amino acid
  misc_feature (24)..(24): Xaa can be any naturally occurring amino acid
MLPQGKAARRMSANEVCGXLXAWXVLVICQTLPKRDTLNGSGTHTVPVWAILPRSLRSKSTIITFSARFFGSACNSAARRSSCPSPKIGAVPFIGSVLMVPSEPILRKSSGEKHSVHADCPSASGRWDKTA

SEQ ID NO: 5 - DNA, 396 bp, Neisseria meningitidis
atgctgccgcaggggaaggcggcgcggaggatgtcggcgaacgaggtgtgcggcaaggcttgggcttggatggtgctggtcatctgccaaacgctgccgaaacgcgatactttaaacggttcgggtacgcatactgtgccggtttgggcgattttgccgaggtcgttacgcagcaaatcgacaatcatcacgttttcggcgcggtttttcgggtctgcttgcaactcggcggcgcggcgttcgtcttgtccgtcgcccaaaatcggcgcggtgcctttcatcggttcggtgctgatggtgccgtccgaaccgattttgaggaagagttcgggcgagaaacacagcgtccacgcggattgcccttgtgcatcgggcaggtgggacaaaacggcatag

SEQ ID NO: 6 - protein, 131 aa, Neisseria meningitidis
MLPQGKAARRMSANEVCGKAWAWMVLVICQTLPKRDTLNGSGTHTVPVWAILPRSLRSKSTIITFSARFFGSACNSAARRSSCPSPKIGAVPFIGSVLMVPSEPILRKSSGEKHSVHADCPCASGRWDKTA

SEQ ID NO: 7 - DNA, 663 bp, Neisseria gonorrhoeae
  misc_feature (529)..(529): n is a, c, g, or t
atggtcgtattcgtggctgaaggcgtattcggtcgcgctgttttgggtcacttggtattgctcttcggtcagggtgcgtttgagttcggcgtcactcggttttttatacgttgccgcgtcgaagcctttgccttgcggtgcggctttggttttgcccggcagcggttcgtcggctttgcggatgtcgatgtggcagtagccgttggggtttttaatcaggtagtcctgatggtattcctcggcgtcgtagaagtttttcagcggttcgttttcaacaacgaggggcagttggtatttttgctgctcgcgtttgagggcggcggcgatgacggctttttcggcggggtcggtgtagtacacgccgctgcggtattgcgtgccggtgtcgttaccctgtttgttgaggctggtcggatcaacgacgcggaaataatattgcaggatgtcgtccaggctgagtttgtcggcatcgtaggtcactttgacggtctcggcatgacccgtatggcggtaggacacttcttcgtanctcgggttttccgtgttgccgttggcgttaccggataccgcgtcaaccacgccgtcgatgcgttggaaataggcttccaagccccaaaagcagccgccggcgaagtaaatggtgcccgtgttcatgattgctga

SEQ ID NO: 8 - protein, 219 aa, Neisseria gonorrhoeae
MVVFVAEGVFGRAVLGHLVLLFGQGAFEFGVTRFFIRCRVEAFALRCGFGFARQRFVGFADVDVAVAVGVFNQVVLMVFLGVVEVFQRFVFNNEGQLVFLLLAFEGGGDDGFFGGVGVVHAAAVLRAGVVTLFVEAGRINDAEIILQDVVQAEFVGIVGHFDGLGMTRMAVGHFFVRVFRVAVGVTGYRVNHAVDALEIGFQAPKAAAGEVNGARVHDC

SEQ ID NO: 9 - DNA, 662 bp, Neisseria meningitidis
atggtcgtattcgtggctgaaggcatattcggtcgcgctgttttgggtaacttgstattgctcttcggtcagggtgcgtttgagttcggcgtcactcggttttttatacgttgccgcgtcgaagcctttgccttgcggggcggtcttggttttgcccggcagcggttcgtcagckttgcggatgtcgatgtggcagtagccgttggggtttttaatcaagtagtcctgatggtattcctcggcatcgtagaagtttttcagcggctcgttttcaacaacgaggggcagttggtatttttgctgctcgcgtttgagggcgkcggcgatgacggctttttcgkcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagcgccggcgaggtaaatggtgcgcgtgttcatgatttttga

SEQ ID NO: 10 - protein, 219 aa, Neisseria meningitidis
  misc_feature (19)..(19): Xaa can be any naturally occurring amino acid
  misc_feature (59)..(59): Xaa can be any naturally occurring amino acid
  misc_feature (107)..(107): Xaa can be any naturally occurring amino acid
  misc_feature (114)..(114): Xaa can be any naturally occurring amino acid
  misc_feature (208)..(208): Xaa can be any naturally occurring amino acid
MVVFVAEGIFGRAVLGNLXLLFGQGAFEFGVTRFFIRCRVEAFALRGGLGFARQRFVSXADVDVAVAVGVFNQVVLMVFLGIVEVFQRLVFNNEGQLVFLLLAFEGXGDDGFFXGVGVVHAAAVLRTGVVALFVEAGRINDAEEILQDVVAEFVGIVGHFDGFGVARMAVGHVFIARIFRVAVGVAGYRVNHAVDALEIGFQAPEAAXGEVNGARVHDF

SEQ ID NO: 11 - DNA, 663 bp, Neisseria meningitidis
atggtcgtattcgtggctgaaggcatattcggtcgcgctgttttgggtaacttggtattgctcttcggtcagggtgcgtttgagttcggcgtcactcggttttttatacgttgccgcgtcgaagcctttgccttgcggtgcggtcttggttttgcccggcagcggttcgtcggctttgcggatatcgatgtggcagtagccgttggggtttttaatcaagtagtcctgatggtattcctcggcatcgtagaagtttttcagcggctcgttttcaacaacgaggggcagttggtatttttgctgctcgcgtttgagggcggcggcgatgacggctttttcggcggggtcggtgtagtacacgccgctgcggtattgcgtaccggtgtcgttgccctgtttgttgaggctggtcggatcaacgacgcggaagaaatattgcaggatgtcgtctaggctgagtttgtcggcatcgtaggtcactttgacggtttcggcgtggcccgtatggcggtaggacacgtcttcatagctcggatttttcgtgttgccgttggcgtagccggataccgcgtcaaccacgccgtcgatgcgttggaaataggcttccaagccccagaagcagccgccggcgaggtagatggtgcgcgtgttcatgatttttga

SEQ ID NO: 12 - protein, 219 aa, Neisseria meningitidis
MVVFVAEGIFGRAVLGNLVLLFGQGAFEFGVTRFFIRCRVEAFALRCGLGFARQRFVGFADIDVAVAVGVFNQVVLMVFLGIVEVFQRLVFNNEGQLVFLLLAFEGGGDDGFFGGVGVVHAAAVLRTGVVALFVEAGRINDAEEILQDVVAEFVGIVGHFDGFGVARMAVGHVFIARIFRVAVGVAGYRVNHAVDALEIGFQAPEAAAGEVDGARVHDF

SEQ ID NO: 13 - DNA, 777 bp, Neisseria gonorrhoeae
atggtagaacggcatatccagcatttgcggaacggtcatcttcatttgatgcgcccatgccaacaagtgagccaaatgttcggcggcagggcctacgatttccgcgccgataaagcggccggtggctttttcggcatacaggcgcatatggcctttgtttaccagcatcacgcggctgcgaccttgatttttgaacgatacttcgccgatgacaaattcgtcggcttggtattgcgcggcaacctgcgcgtatttcaaaccgacaaagccgatttgcggactggtaaacaccacgccaatggtgctgcggcgcaaaccgctgccgatattcgggtagcggccccgcgttattgcccggcaatcttaccttggtcggcggcttcatgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctgaaacaacggggtcggaaatgccgccgatgattccgcccaaaccgaaaatttcaactttcacacccaaacggtgcaatgcctga

SEQ ID NO: 14 - protein, 258 aa, Neisseria gonorrhoeae
MVERHIQHLRNGHLHLMRPCQQVSQMFGGRAYDFRADKAAGGFFGIQAHMAFVYQHHAAATLIFERYFADDKFVGLVLRGNLRVFQTDKADLRTGKHHANGAAAQTAADIRVAAPRYCPAILPWSAASCSRGSWLDASPAIKICGMLVCMVSGSATGTPRASLSILMFSKPILSTFGRRPTAANIYSATNTPFSPSCSQWTSTLPSASSLTSVLASRCSFNSSPNTAFASSETTGSEMPPMIPPKPKISTFTPKRCNA

SEQ ID NO: 15 - DNA, 774 bp, Neisseria meningitidis
atggtagaacggcatatccagcatttgcggaacggtcatcttcatttgatgtgcccaagccaacaggtgcgccaaatgttcggcggcagggcctacgatttccgcgccgataaagcggccggtggctttttcggcatacaggcgcatatggcctttgttcaccagcatcacgcggctgcggccttggtttttgaacgatacttcgccgatgacaaattcgtcggcttggtattgcgcggcaacctgcgcgtatttcagaccgacaaagccgatttgcggactggtaaacaccacgccgatggtgctgcgccgcaaaccgccgccgatattcgggtagcggccgcgttatcgccggcaatcttgccttggtcggcagcttcatgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctgaaacgacggggtcggaaatgccgccgatgattccgcccaaaccgaaaatttcaactttcacgcccaaacggtgcaatgcctga

SEQ ID NO: 16 - protein, 257 aa, Neisseria meningitidis
MVERHIQHLRNGHLHLMCPSQQVRQMFGGRAYDFRADKAAGGFFGIQAHMAFVHQHHAAAALVFERYFADDKFVGLVLRGNLRVFQTDKADLRTGKHHADGAAPQTAADIRVAAALSPAILPWSAASCSRGSWLDASPAMKICGILVCMVSGSATGTPRASFSILIFSKPILSTFGRRPTAASIYSATNTPFSPSCSQWTSTLPSASSLTSVLASRCSFNSSPNTAFASSETTGSEMPPMIPPKPKISTFTPKRCNA

SEQ ID NO: 17 - DNA, 774 bp, Neisseria meningitidis
atggtagaacggcatatccagcatttgcggaacggtcatcttcatttgatgtgcccaagccaacaggtgcgccaaatgttcggcggccggacctacgatttctgcgccgatgaagcggccggtggctttttcggcatacaggcgcatatggcctttgtttaccagcatcacgcggctgcggccttggtttttgaacgatacttcgccgatgacaaattcgtcggcttggtattgcgcggcaacctgcgcgtatttcaaaccgacaaagccgatttgcggactggtgaacactacgccgatggtgctgcggcgcaaaccgccgccgatattcgggtagcggccgcgttatcgccggcaatcttgccttggtcggcggcttcatgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctgaaacgacggggtcggaaatgccgccgatgatgccacccaaaccgaaaatttcaactttcacgcccaaacggtgcaatgcctga

SEQ ID NO: 18 - protein, 257 aa, Neisseria meningitidis
MVERHIQHLRNGHLHLMCPSQQVRQMFGGRTYDFCADEAAGGFFGIQAHMAFVYQHHAAAALVFERYFADDKFVGLVLRGNLRVFQTDKADLRTGEHYADGAAAQTAADIRVAAALSPAILPWSAASCSRGSWLDASPAIKICGILVCIVSGSATGTPRASFSILMFSKPILSTFGRRPTAASIYSATNTPFSPSCSQWTSTLPSASSLASVLASKCSFNSSPNTAFASSETTGSEMPPMMPPKPKISTFTPKRCNA

SEQ ID NO: 19 - DNA, 1107 bp, Neisseria gonorrhoeae
atggggatggacaatattgatatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacagatttttcggaaaattataaaaaacagcggcaatcgtttgaaacattctttttaagcgaggaagagacaaaacatcaggaaaaaaaagaaaagaaaaaggaaaaggcggaagccaaagcagagaaaaagcgtttgaaggagggcggggagaaatctgccgaaacgcaaaaatcccgcctttttgtgttggattttgacggcgatttgtatgcacacgccgtagaatccttgcgtcatgagattacggcggtgcttttgattgccaagcctgaagatgaggttctgctcagattggaaagtccgggcggcgtggttcacggttacggtttggcggcttcgcagcttaggcgtttgcgcgaacgcaatattccgctgaccgtcgccgtcgataaggtcgcggcaagcggcggctatatgatggcgtgtgtggcggataaaattgtttccgctccgtttgcggtcatcggttcggtgggtgtggtggcggaagtgccgaatatccaccgcctgttgaaaaaacatgatattgatgtggatgtgatgacggcgggcgaatttaagcgcacggttacttttatgggtgaaaatacggaaaagggcaaacagaaattccggcaggaactggaggaaacgcatcagttgttcaagcagtttgtcagtgaaaaccgccccgggttggatattgaaaaaatagcgacgggcgagcattggttcggccggcaggcgttggcgttgaacttgattgacgagatttcgaccagtgatgatttgttgttgaaagcgtttgaaaacaaacaggttatcgaagtgaaatatcaggagaagcgaagcctgatccagcgcattggtttgcaggcggaagcttccgttgaaaagttgtttgccaaacttgtcaaccggcgagcggatgtgatgtag

SEQ ID NO: 20 - protein, 368 aa, Neisseria gonorrhoeae
MGMDNIDMFMPEQEEIQSMWKEILLNYGIFLLELLTVFGAIALIVLAIVQSKKQSESGSVVLTDFSENYKKQRQSFETFFLSEEETKHQEKKEKKKEKAEAKAEKKRLKEGGEKSAETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAVIGSVGVVAEVPNIHRLLKKHDIDVDVMTAGEFKRTVTFMGENTEKGKQKFRQELEETHQLFKQFVSENRPGLDIEKIATGEHWFGRQALALNLIDEISTSDDLLLKAFENKQVIEVKYQEKRSLIQRIGLQAEASVEKLFAKLVNRRADVM

SEQ ID NO: 21 - DNA, 1100 bp, Neisseria meningitidis
  misc_feature (350)..(350): n is a, c, g, or t
  misc_feature (374)..(581): n is a, c, g, or t
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggawagcggcagtgtcgtactgacggatttttcggaaaattataaaaaacagcggcaatcgtttgaagcattctttttaagcggggaagaggcacaacatcaggaaaaagaggaaaagaaaaaggaaaaggcggaagccaaagcagagaaaaacgtttgaaggagggtggggagaaatctgccgaaacgcanaaatcacgcctttttgtgttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagcggcggttatatgatggcgtgtgtggcggataaaattgcttccgctccgtttgcgattgtcggttcggtgggtgtggtggcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 22 - protein, 366 aa, Neisseria meningitidis
  misc_feature (54)..(54): Xaa can be any naturally occurring amino acid
  misc_feature (104)..(104): Xaa can be any naturally occurring amino acid
  misc_feature (117)..(117): Xaa can be any naturally occurring amino acid
  misc_feature (125)..(194): Xaa can be any naturally occurring amino acid
MDNIDMFMPEQEEIQSMWKEILLNYGIFLLELLTVFGAIALIVLAIVQSKKQSXSGSVVLTDFSENYKKQRQSFEAFFLSGEEAQHQEKEEKKKEKAEAKAEKXRLKEGGEKSAETXKSRLFVLXXXXXXXXXXXXXXXXXXXXXXXXXXXXXXXXXXXXXXXXXXXXXXXXXXXXXXXXXXXXXXXXXXXXXXASGGYMMACVADKIASAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 23 - DNA, 1101 bp, Neisseria meningitidis
atggacaatattgacatgttcatgcctgaacaagaggaaatccaatcaatgtggaaagaaattttactgaattacggtattttcctgctcgaactgcttaccgtgttcggcgcaattgcgctgattgtgttggctatcgtacagagtaagaaacagtcggaaagcggcagtgtcgtactgacggatttttcggaaaattataaaaaacagcggcaatcgtttgaagcattctttttaagcggggaagaggcaaaacatcaggaaaaagaggaaaagaaaaaggaaaaggcggaagccaaagcagagaaaaagcgtttgaaggagggtggggagaaatcttccgaaacgcaaaaatcccgcctttttgtgttggattttgacggcgatttgtatgcacacgccgtagaatccttgcgtcatgagattacggcggtgcttttgattgccaagcctgaagatgaggttctgcttagattggaaagtccgggcggcgtggttcacggttacggtttggcggcttcgcagcttaggcgtttgcgcgaacgcaatattccgctgaccgtcgccgtcgataaggtggcggcgagcggtggttatatgatggcgtgtgtggcggataaaattgtttccgctccgtttgcgattgtcggttcggtgggtgttgtagcggaagtaccgaatatccaccgcctgttgaaaaaacatgatattgatgtggatgtgatgacggcgggcgaatttaagcgcacggttacttttatgggtgaaaatacggaaaagggcaaacagaaattccgacaggaactggaggaaacgcatcagttgttcaagcagtttgtcagcgagaaccgccctcaattggatattgaggaagtggcaacgggcgagcattggttcggtcggcaggcgttggcgttgaacttgattgacgagatttcgaccagtgatgatttgttgttgaaagcgtttgaaaacaaacaggttatcgaagtgaaatatcaggagaagcaaagcctgatccagcgcattggtttgcaggcggaagcttctgttgaaaagttgtttgccaaacttgtcaaccggcgggcggatgtgatgtag

SEQ ID NO: 24 - protein, 366 aa, Neisseria meningitidis
MDNIDMFMPEQEEIQSMWKEILLNYGIFLLELLTVFGAIALIVLAIVQSKKQSESGSVVLTDFSENYKKQRQSFEAFFLSGEEAKHQEKEEKKKEKAEAKAEKKRLKEGGEKSSETQKSRLFVLDFDGDLYAHAVESLRHEITAVLLIAKPEDEVLLRLESPGGVVHGYGLAASQLRRLRERNIPLTVAVDKVAASGGYMMACVADKIVSAPFAIVGSVGVVAEVPNIHRLLKKHDIDVDVMTAGEFKRTVTFMGENTEKGKQKFRQELEETHQLFKQFVSENRPQLDIEEVATGEHWFGRQALALNLIDEISTSDDLLLKAFENKQVIEVKYQEKQSLIQRIGLQAEASVEKLFAKLVNRRADVM

SEQ ID NO: 25 - DNA, 462 bp, Neisseria gonorrhoeae
atgctgctggtgctggaattttggttcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 26 - protein, 153 aa, Neisseria gonorrhoeae
MLLVLEFWFGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 27 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 28 - protein, 153 aa, Neisseria meningitidis
MLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 29 - DNA, 462 bp, Neisseria meningitidis
atgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 30 - protein, 153 aa, Neisseria meningitidis
MLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 31 - DNA, 867 bp, Neisseria gonorrhoeae
atgtggaaaatgttgaaacacatagccaaaacccaccgcaagcgattgattggcacattttccccggtcggactggaaaaccttttgatgctggggtatccggtgtttggcggctgggcgattaatgccgtgattgcggggagggtgtggcaggcgttgctgtacgctttggttgtatttttgatgtggctggtcggtgcggcacggcggattgccgatacgcgcacgtttacgcggatttataccgaaatcgccgtgccggttgtgttggaacaacggcagcggcaagtcccgcattcagcggtaactgcacgggttgccctgtcgcgtgaatttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgacgagcggcagctgtaccgccattacggactggtttcgcgcctgcgtgtgctgatttccaaccgcgaagccttcggctatctctgcgtcggcgcggcgatgggtattttgttcggctttgcttttgtgatgatgacgctcaaaggctacggcagcgcggggcatatttattcggtcggcacttatctgtggatgtttgccatgagtttggacgatgtgccgcgattggtcgaacaatattccaatttgaaagacatcggacaacggatagagtggtcggaacggaacatcaaagccggaacttga

SEQ ID NO: 32 - protein, 288 aa, Neisseria gonorrhoeae
MWKMLKHIAKTHRKRLIGTFSPVGLENLLMLGYPVFGGWAINAVIAGRVWQALLYALVVFLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDERQLYRHYGLVSRLRVLISNREAFGYLCVGAAMGILFGFAFVMMTLKGYGSAGHIYSVGTYLWMFAMSLDDVPRLVEQYSNLKDIGQRIEWSERNIKAGT

SEQ ID NO: 33 - DNA, 867 bp, Neisseria meningitidis
atgtggaaaatgttgaaacacatagcccaaacccaccgcaagcgattgattggcacattttccctggtcggactggaaaaccttttgatgctggtgtatccggtgtttggcggccgggcgatcaatgccgtgattgcgggggaggtgtggcaggcgttgctgtacgctttggttgtgcttttgatgtggctggtcggtgcggtgcggcggattgccgatacgcgcacgtttacgcggatttataccgaaatcgccgtgccggtcgtgttggaacagcggcagcgacaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaacaacagcttggaacgcgacaaccactttatccgaaaaggcgaccggcggcagctgtaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccatgagtttggacgacgtgccgcgattggtcgaacaatattccaatttgaaagacatcggacaacggatagagtggtcggaacggaacatcaaagccggaacttga

SEQ ID NO: 34 - protein, 288 aa, Neisseria meningitidis
MWKMLKHIAQTHRKRLIGTFSLVGLENLLMLVYPVFGGRAINAVIAGEVWQALLYALVVLLMWLVGAVRRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLNNSLERDNHFIRKGDRRQLYRHYGLLARLRVLISNREAFGYLCVGTAMGILFGFAFVMMTLKGYSSAGHVYSVGTYLWMFAMSLDDVPRLVEQYSNLKDIGQRIEWSERNIKAGT

SEQ ID NO: 35 - DNA, 843 bp, Neisseria meningitidis
agccaaaaccaccgcaagcgattgattggcacattttttctggtcggactggaaaaccttttgatgctggtgtatccggtgtttggcggctgggcgattaatgccgtgattgcggggcaggcgtggcaggcgttgctgtacgctttggttgtgcttttgatgtggctggtcggtgcggcgcggcggattgccgatacgcgcacgtttacgcggatttataccgaaatcgccgtgccggttgtgttggaacagcggcagcggcaagtcccgcattcggcggtaactgcgcgggttgccctgtcgcgtgagtttgtcagcttttttgaagaacacctgccgattgccgcgacatccgtcgtatccatattcggcgcgtgcatcatgctgctggtgctggaattttgggtcggcgtgtcggcggtgggcatacttgcgttgtttttatggcttttgccacgttttgccgccatcagcgaaaacctgtatttccgcctgaagaacagcttggaacgcgacaaccactttatccgaaaaggcgacgagcggcagctggaccgccattacggactgcttgcgcgcctgcgtgtgctgatttccaaccgcgaagccttcggctatctctgcgtcggcacggcgatgggtattttgttcggctttgcttttgtgatgatgacgctcaaaggctacagcagcgcggggcatgtctattcggtcggcacttatctgtggatgtttgccataagtttggacgacgtgccgcgattggtcgaacaatattccaatttgaaagacatcggacaacggatagagtggtcgaaacggaacatcaaagccggaacttga

SEQ ID NO: 36 - protein, 280 aa, Neisseria meningitidis
SQNHRKRLIGTFFLVGLENLLMLVYPVFGGWAINAVIAGQAWQALLYALVVLLMWLVGAARRIADTRTFTRIYTEIAVPVVLEQRQRQVPHSAVTARVALSREFVSFFEEHLPIAATSVVSIFGACIMLLVLEFWVGVSAVGILALFLWLLPRFAAISENLYFRLKNSLERDNHFIRKGDERQLDRHYGLLARLRVLISNREAFGYLCVGTAMGILFGFAFVMMTLKGYSSAGHVYSVGTYLWMFAISLDDVPRLVEQYSNLKDIGQRIEWSKRNIKAGT

SEQ ID NO: 37 - DNA, 342 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactgtattatgaacaaaccgcacgtcctgctgcacagcatggtcaaaggcatcgacgggacattcaaagtggagcggcaaaacctacgacggatttatgcccgcaaccgccatcagcgatgcggacattgccgccgtcgccacttatatcatgaacgcctttga

SEQ ID NO: 38 - protein, 113 aa, Neisseria gonorrhoeae
MNTTRLPTAFILCCLCAAASAADNSIMTKGQKVYESNCIACHGKKGEGRGTAFPPLFRSDCIMNKPHVLLHSMVKGIDGTFKVERQNLRRIYARNRHQRCGHCRRRHLYHERL

SEQ ID NO: 39 - DNA, 341 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttga

SEQ ID NO: 40 - protein, 113 aa, Neisseria meningitidis
  misc_feature (84)..(84): Xaa can be any naturally occurring amino acid
MNTTRLPTALVLGCFCAAASAADNSIMTKGQKVYESNCVACHGKKGEGRGTMFPPLYRSDFIMKKPQVLLHSMVKGINGTIKVXRQNLQRIHARNRHQRCGHCRRRHLYHERL

SEQ ID NO: 41 - DNA, 341 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttga

SEQ ID NO: 42 - DNA, 341 bp, Neisseria meningitidis; identical to SEQ ID NO: 41

SEQ ID NO: 43 - DNA, 399 bp, Neisseria gonorrhoeae
atgaacacaacccgactgccgaccgccttcatcttgtgctgcctctgcgccgccgcttctgccgccgacaacagcatcatgacaaaagggcaaaaagtgtacgaatccaactgcatcgcctgccacggcaagaaaggggaagggcgcggcactgcgtttcctccgcttttccggtcggactatattatgaacaaaccgcacgtcctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaggcaaaaaaaac

SEQ ID NO: 44 - protein, 133 aa, Neisseria gonorrhoeae
MNTTRLPTAFILCCLCAAASAADNSIMTKGQKVYESNCIACHGKKGEGRGTAFPPLFRSDYIMNKPHVLLHSMVKGINGTIKVNGKTYNGFMPATAISDADIAAVATYIMNAFDNGGGSVTEKDVKQAKGKKN

SEQ ID NO: 45 - DNA, 402 bp, Neisseria meningitidis
atgaacacaacccgactgccgaccgccctcgtcttgggctgcttctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgcaaccgccatcagcgatgcggacattgccgccgtcgccacttatatcatgaacgcctttgacaacggcggcggaagcgttaccgaaaaagacgtaaaacaggcaaaaagcaaaaaaaactaa

SEQ ID NO: 46 - protein, 133 aa, Neisseria meningitidis
MNTTRLPTALVLGCFCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKSKKN

SEQ ID NO: 47 - DNA, 396 bp, Neisseria meningitidis
atgaacacaacccgactgccgaccgccctcgtcttgggctgcctctgcgccgccgcttctgccgccgacaacagcatcatgacaaaagggcaaaaagtgtacgaatccaactgcgtcgcctgccacggcaaaaagggcgaaggccgcggaaccatgtttccgccgctctaccgctccgacttcatcatgaaaaaaccgcaggtgctgctgcacagcatggtcaaaggcatcaacggtacaatcaaagtcaacggcaaaacctacaacggattcatgcccgccactgccatcagcgatgcggacattgccgccgtcgccacttatatcatgaacgcctttgacaacggcggcggaagcgttaccgaaaaagacgtaaaacaggcaaaaaacaaaaaa

SEQ ID NO: 48 - protein, 132 aa, Neisseria meningitidis
MNTTRLPTALVLGCLCAAASAADNSIMTKGQKVYESNCVACHGKKGEGRGTMFPPLYRSDFIMKKPQVLLHSMVKGINGTIKVNGKTYNGFMPATAISDADIAAVATYIMNAFDNGGGSVTEKDVKQAKNKK

SEQ ID NO: 49 - DNA, 495 bp, Neisseria gonorrhoeae
atgaacaacagacattttgccgtcatcgccttgggcagcaaccttgacaaccccgcacaacaaatacgcggcgcattagacgcgctctcgtcccatcctgacatccggcttgaacaggtttcctcactgtatatgaccgcacctgtcggttacgacaatcagcccgatttcatcaatgccgtctgcaccgtttccaccaccttggacggcattgccctgcttgccgaactcaaccgtatcgaagccgatttcggacgcgaacgcagtttccgcaatgcaccgcgcacattggatttggacattatcgactttgacggcatctccagcgacgacccccgccttaccctgccgcatccgcgcgcgcacgaacgcagtttcgtcatacgccctttggcagaaatcctccctgattttattttgggaaaatacggaaaggttgtcgaattgtcaaaacggctgggcaatcaaggcatccgtcttttaccggacaggtaa

SEQ ID NO: 50 - protein, 164 aa, Neisseria gonorrhoeae
MNNRHFAVIALGSNLDNPAQQIRGALDALSSHPDIRLEQVSSLYMTAPVGYDNQPDFINAVCTVSTTLDGIALLAELNRIEADFGRERSFRNAPRTLDLDIIDFDGISSDDPRLTLPHPRAHERSFVIRPLAEILPDFILGKYGKVVELSKRLGNQGIRLLPDR

SEQ ID NO: 51 - DNA, 497 bp, Neisseria meningitidis
atgaacaacagacattttgccgtcatcgccctgggcagtaatcttgaaaaccctgctcaacaggtacgcgccgcattggacacgctgtcgtcccatcctgacatccgtcttaaacaggcttcctcactgtatatgaccgcgcccgtcggttacgacaatcagcccgattttgtcaatgccgtctgcaccgtttccaccactctggacggcattgccytgcttgccgaactcaaccgtatcgaggctgatttcggacgcgaacgcagcttccgcaacgcgccgcgcacattgkatttggacattatcgactttgacggcatctccagcgacgacacscgactcaccttgccgcatccgcgcgcgcacgaacgcagtttcgtcatccgccctttggcagaaatcctccctgattttgttttaggaaaacacggaaaggttgccgaattgtcaaaacggytgggcaatcaaggtatccgtcttttaccggacaggtaatt

SEQ ID NO: 52 - protein, 164 aa, Neisseria meningitidis
  misc_feature (98)..(98): Xaa can be any naturally occurring amino acid
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLXLDIIDFDGISSDDTRLTLPHPRAHERSFVIRPLAEILPDFVLGKHGKVAELSKRLGNQGIRLLPDR

SEQ ID NO: 53 - DNA, 495 bp, Neisseria meningitidis
atgaacaacagacattttgccgtcatcgccctgggcagtaatcttgaaaaccctgcccaacaggtacgcgccgcattggacacgctgtcgtcccatcctgacatccgtcttaaacaggcttcctcactgtatatgaccgcgcccgtcggttacgacaatcagcccgatttcgtcaatgccgtctgcaccgtttccaccaccttggacggcattgccctgcttgccgaactcaaccgtatcgaagccgatttcggacgcgaacgcagcttccgcaacgcgccgcgcacattggatttggacattatcgactttgacggcatctccagcgacgacccccgactcaccctgccgcatccgcgcgcgcacgaacgcagtttcgtcatacgccctttggcagaaatcctccctgattttattttgggaaaacacggaaaggttgccgaattgtcaaaacggctgggcaatcaaggcatccgtcttttaccggataagtaa

SEQ ID NO: 54 - protein, 164 aa, Neisseria meningitidis
MNNRHFAVIALGSNLENPAQQVRAALDTLSSHPDIRLKQASSLYMTAPVGYDNQPDFVNAVCTVSTTLDGIALLAELNRIEADFGRERSFRNAPRTLDLDIIDFDGISSDDPRLTLPHPRAHERSFVIRPLAEILPDFILGKHGKVAELSKRLGNQGIRLLPDK

SEQ ID NO: 55 - DNA, 261 bp, Neisseria gonorrhoeae
atgccccgcgctgccgtagcctttgagcgtcatcatcacaaaagcaaagccgaacaaaatacccatcgccgcgccgacgcagagatagccgaaggcttcgcggttggaaatcagcacacgcaggcgcgaaaccagtccgtaatggcggtacagctgccgctcgtcgccttttcggataaagtggttgtcgcgttccaagctgttgttcaggcggaaatacaggttttcgctgatggcggcaaaacgtggcaaaagccataa

SEQ ID NO: 56 - protein, 86 aa, Neisseria gonorrhoeae
MPRAAVAFERHHHKSKAEQNTHRRADAEIAEGFAVGNQHTQARNQSVMAVQLPLVAFSDKVVVAFQAVVQAEIQVFADGGKTWQKP

SEQ ID NO: 57 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtacagctgccgccggtcgccttttcggataaagtggttgtcgcgttccaagctgttgttcaggcggaaatacaggttttcgctgatggcggcaaaacgtggcaaaagccataa

SEQ ID NO: 58 - protein, 86 aa, Neisseria meningitidis
MPRAAVAFERHHHKSKAEQNTHRRADAEIAEGFAVGNQHTQARKQSVMAVQLPPVAFSDKVVVAFQAVVQAEIQVFADGGKTWQKP

SEQ ID NO: 59 - DNA, 261 bp, Neisseria meningitidis
atgccccgcgctgctgtagcctttgagcgtcatcatcacaaaagcaaagccgaacaaaatacccatcgccgtgccgacgcagagatagccgaaggcttcgcggttggaaatcagcacacgcaggcgcgcaagcagtccgtaatggcggtccagctgccgctcgtcgccttttcggataaagtggttgtcgcgttccaagctgttcttcaggcggaaatacaggttttcgctgatggcggcaaaacgtggcaaaagccataa

SEQ ID NO: 60 - protein, 86 aa, Neisseria meningitidis
MPRAAVAFERHHHKSKAEQNTHRRADAEIAEGFAVGNQHTQARKQSVMAVQLPLVAFSDKVVVAFQAVLQAEIQVFADGGKTWQKP

SEQ ID NO: 61 - DNA, 1248 bp, Neisseria gonorrhoeae
atgggttttcctgttcgcaagtttgatgccgtgattgtcggcggtggcggtgcaggtttacgtgcagccctccaattatccaaatccggtttgaattgtgccgttttgtctaaagtgttcccgacccgctcgcataccgtagcggcgcagggcggtatttccgcctctctgggtaatgtgcaggaggaccgttgggactggcacatgtacgataccgtgaaaggttccgactggctgggcgaccaagatgcgattgagtttatgtgtcgcgctgcgcctgaagcggtgattgagttggaacacatgggtatgccttttgaccgcgttgaaagcggcaaaatttatcagcgtcctttcggcggacatactgccgaacatggtaaacgtgcggtagaacgtgcatgtgcggttgccgaccgtaccggtcatgcgatgttgcatactttgtaccaacaaaacgtccgtgccaatacacaattctttgtggaatggacggcgcaagatttgattcgtgatgaaaacggcgatgtcgtcggcgtaaccgccatggaaatggaaacgggcgaagtttatattttccacgccaaggccgtgatgtttgctaccggtggcggcggtcgtatttatgcttcttctaccaatgcttatatgaataccggtgacggtttgggcatttgcgcccgtgcgggcattccgttggaagatatggaattctggcaattccacccgaccggcgtggcgggtgcgggcgtgttgattaccgaaggcgtacgcggcgagggcggtattctgttgaacgccgacggcgaacgctttatggaacgctatgcgccgaccgtaaaagacttggcttctcgcgacgtggtttcacgcgcgatggcgatggaaatctatgaaggtcgcggctgtggtaaaaacaaagaccacgtcttactgaaaatcgaccatatcggtgcagaaaaaattatggaaaaactgccgggcatccgcgagatttccattcagtttgccggtatcgatccgattaaagacccgattccggttgtgccgactacccactatatgatgggcggcattccgaccaattatcacggtgaagttgttgttccgcaaggcgacgagtacgaagtacctgtaaaaggcctgtatgccgcaggtgagtgcgcctgtgcttccgtacacggtgcgaaccgtttgggtacgaactccctgctggacttggtggtgttccgcccaaccccccggtga

SEQ ID NO: 62 - protein, 415 aa, Neisseria gonorrhoeae
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFRPTPR

SEQ ID NO: 63 - DNA, 696 bp, Neisseria meningitidis
  misc_feature (1)..(1): n is a, c, g, or t
  misc_feature (100)..(100): n is a, c, g, or t
ntccaattatccaaatccggtctgaattgtgccgttttgtctaaagtgttcccgacccgttcgcataccgtagcggcgcagggcggtatttccgcctctntgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgyctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccagccgaccggcgtggcgggtgcgggcgtgttgattaccgaa

SEQ ID NO: 64 - protein, 202 aa, Neisseria meningitidis
  misc_feature (1)..(1): Xaa can be any naturally occurring amino acid
  misc_feature (34)..(34): Xaa can be any naturally occurring amino acid
XQLSKSGLNCAVLSKVFPTRSHTVAAQGGISASXGNVQEDRWDWHMYDTVKGSDWLGDQDAIEFMCRAAPEAVIELEHMGMPFDRVESGKIYQRPFCAVADRTGHAMLHTLYQQNVRANTQFFVEWTAQDLIRDENGDVVGVTAMEMETGEVYIFHAKAVMFATGGGGRIYASSTNGIPLEDMEFWQFQPTGVAGAGVLITE

SEQ ID NO: 65 - DNA, 1764 bp, Neisseria meningitidis
  misc_feature (67)..(67): n is a, c, g, or t
  misc_feature (408)..(408): n is a, c, g, or t
atgggctttcctgttcgcaagtttgatgccgtgattgtcggcggtggtggtgcaggtttacgcgcanccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcngttgccgaccgtacaggtcatgcgatgctgcatactttgtaccaacaaaatgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggccgtatttatgcgtcttctaccaatgcctatatgaataccggcgatggtttgggtatttgtgcgcgtgcaggtatcccgttggaagacatggaattctggcaattccacccgaccggcgtggcaggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggtattccgaccaactaccatggcgaagttgtcgttcctcaaggcgacgaatacgaagtgcctgtaaaaggtctgtatgcggcaggtgagtgcgcctgtgcttccgtacacggtgcgaaccgcttgggtacgaactccctgctggacttagtggtattcggtaaagctgccggcgacagcatgattaaattcatcaaagagcaaagcgactggaaacctttgcctgctaatgccggcgaactgacccgccaacgtatcgagcgtttggacaatcaaactgatggtgaaaacgttgatgcattgcgccgcgaactgcaacgctccgtacaattgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctaattgaagtggcgaaagcgactttggtgtctgccgaagcacgtaaagaatcacgcggtgcgcacgcttcagacgaccatcctgagcgcgatgatgaaaactggatgaaacatacgctgtaccattcagatgccaataccttgtcctacaaaccggtgcacaccaagcctttgagcgtggaatacatcaaaccggccaagcgcgtttattga

SEQ ID NO: 66 - protein, 587 aa, Neisseria meningitidis
  misc_feature (23)..(23): Xaa can be any naturally occurring amino acid
MGFPVRKFDAVIVGGGGAGLRAXLQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGDEYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDANTLSYKPVHTKPLSVEYIKPAKRVY

SEQ ID NO: 67 - DNA, 1248 bp, Neisseria gonorrhoeae; identical to SEQ ID NO: 61

SEQ ID NO: 68 - protein, 415 aa, Neisseria gonorrhoeae; identical to SEQ ID NO: 62

SEQ ID NO: 69 - DNA, 1767 bp, Neisseria meningitidis
atgggttttcctgttcgcaagtttgatgccgtgattgtcggcggtggtggtgcaggtttacgcgcagccctccaattatccaaatccggtctgaattgtgccgttttgtctaaagtgttcccgacccgttcgcataccgtagcggcgcagggcggtatttccgcctctctgggtaatgtgcaggaagaccgttgggactggcacatgtacgataccgtgaaaggttccgactggttgggcgaccaagatgcgattgagtttatgtgccgcgccgcgcctgaagccgtaattgagttggaacacatgggtatgccttttgaccgtgtggaaagcggtaaaatttatcagcgtcctttcggcggccatactgccgaacacggtaaacgcgcggtagaacgcgcctgtgcggttgccgaccgtacaggtcatgcgatgctgcatactttgtaccaacaaaacgtccgtgccaatacgcaattctttgtggaatggacggcacaagatttgattcgtgatgaaaacggcgatgtcgtcggcgtaaccgccatggaaatggaaaccggcgaagtttatattttccacgctaaagctgtgatgtttgctaccggcggcggcggtcgtatttatgcgtcttctaccaatgcctatatgaataccggcgatggtttgggtatttgtgcgcgtgcaggtatcccgttggaagacatggaattctggcaattccacccgaccggcgtggcgggtgcgggcgtgttgattaccgaaggcgtacgcggcgagggcggtattctgttgaatgccgacggcgaacgctttatggaacgctatgcgccgaccgtaaaagacttggcttctcgcgacgttgtttcccgcgcgatggcgatggaaatctacgaaggtcgcggctgcggtaaaaacaaagaccatgtcttactgaaaatcgaccatatcggcgcagaaaaaattatggaaaaactgccgggcatccgcgagatttccattcagttcgccggtatcgatccgattaaagacccgattcccgttgtgccgactacccactatatgatgggcggcattccgaccaattaccacggcgaagttgtcgttccgcaaggtgaagattacgaagtgcctgtaaaaggtctgtatgcggcaggtgagtgcgcttgtgcttccgtacacggtgcgaaccgcttgggtaccaactccctgttggacttggtggtattcggtaaagctgccggcgacagcatgattaaattcatcaaagagcaaagcgactggaaacctttgcctgctaatgcaggtgagttgacccgccaacgtatcgagcgtttggacaaccaaaccgatggtgaaaacgttgatgcattgcgtcgcgaactgcaacgctctgtacaactgcacgccggcgtgttccgtactgatgagattctgagcaaaggcgttcgagaagtcatggcgattgccgagcgtgtgaaacgtaccgaaatcaaagacaagagcaaagtgtggaataccgcgcgtatcgaggctttggaattggataacctgattgaagtggcgaaagcgactttggtgtctgccgaagcacgtaaagaatcacgcggtgcgcacgcttcagacgaccatcctgagcgcgatgatgaaaactggatgaaacatacgctgtaccattcagatatcaataccttgtcctacaaaccggtgcacaccaagcctttgagcgtggaatacatcaaaccggccaagcgcgtttattgatga

SEQ ID NO: 70 - protein, 587 aa, Neisseria meningitidis
MGFPVRKFDAVIVGGGGAGLRAALQLSKSGLNCAVLSKVFPTRSHTVAAQGGISASLGNVQEDRWDWHMYDTVKGSDWLGDQDAIEFMCRAAPEAVIELEHMGMPFDRVESGKIYQRPFGGHTAEHGKRAVERACAVADRTGHAMLHTLYQQNVRANTQFFVEWTAQDLIRDENGDVVGVTAMEMETGEVYIFHAKAVMFATGGGGRIYASSTNAYMNTGDGLGICARAGIPLEDMEFWQFHPTGVAGAGVLITEGVRGEGGILLNADGERFMERYAPTVKDLASRDVVSRAMAMEIYEGRGCGKNKDHVLLKIDHIGAEKIMEKLPGIREISIQFAGIDPIKDPIPVVPTTHYMMGGIPTNYHGEVVVPQGEDYEVPVKGLYAAGECACASVHGANRLGTNSLLDLVVFGKAAGDSMIKFIKEQSDWKPLPANAGELTRQRIERLDNQTDGENVDALRRELQRSVQLHAGVFRTDEILSKGVREVMAIAERVKRTEIKDKSKVWNTARIEALELDNLIEVAKATLVSAEARKESRGAHASDDHPERDDENWMKHTLYHSDINTLSYKPVHTKPLSVEYIKPAKRVY

SEQ ID NO: 71 - DNA, 1764 bp, Neisseria meningitidis; identical to SEQ ID NO: 65
  misc_feature (67)..(67): n is a, c, g, or t
  misc_feature (408)..(408): n is a, c, g, or t

SEQ ID NO: 72 - protein, 587 aa, Neisseria meningitidis; identical to SEQ ID NO: 66
  misc_feature (23)..(23): Xaa can be any naturally occurring amino acid

SEQ ID NO: 73 - DNA, 543 bp, Neisseria gonorrhoeae
atgaagacacaccgcaagacctgctctgcggtgtgttttgcttttcagacggcatcgaaacccgccgtttccatccgacatcccagcgaggacatcatgagcctgaaaacccgccttaccgaagatatgaaaaccgcgatgcgcgccaaagatcaagtttccctcggcaccatccgcctcatcaatgccgccgtcaaacagtttgaagtagacgaacgcaccgaagccgacgatgccaaaatcaccgccatcctgaccaaaatggtcaaacagcgcaaagacggcgcgaaaatctacactgaagccggccgtcaggatttggcagacaaagaaaacgccgaaatcgacgtgctgcaccgctacctgccgcaaatgctctccgccggcgaaatccgcaccgccgtcgaagcagccgttgccgaaaccggcgcggcaggtatggcggatatgggcaaagtgatggtcgtattgaaaacccgcctcgccggcaaagccgatatgggcgaagtcaacaaaatcttgaaaaccgtactgaccgcctga

SEQ ID NO: 74 - protein, 180 aa, Neisseria gonorrhoeae
MKTHRKTCSAVCFAFQTASKPAVSIRHPSEDIMSLKTRLTEDMKTAMRAKDQVSLGTIRLINAAVKQFEVDERTEADDAKITAILTKMVKQRKDGAKIYTEAGRQDLADKENAEIDVLHRYLPQMLSAGEIRTAVEAAVAETGAAGMADMGKVMVVLKTRLAGKADMGEVNKILKTVLTA

SEQ ID NO: 75 - DNA, 497 bp, Neisseria meningitidis
atgaggacacaccgcaagacctgctctgcggtgtgttttgcttttcagacggcatcgaaacccgccgtttccatccgacatcccagcgaggacatcatgagcctgaaaatccgccttaccgaagacatgaaaaccgcgatgcgcgccaaagaccaagtttccctcggcaccatccgcctcatcaacgccgccgtcaaacagtttgaagtggacgaacgcaccgaagccgacgatgccaaaatcaccgccatcctgaccaaaatggtcaaacagcgaaaagacagcgcgaaaatctacactgaagccggccgtcaggatttggcagacaaagaaaacgccgaaatcgaggtactgcaccgctaccttccccaaatgctttccgccggcgaaatccgtaccgaggtcgaagctgccgttgccgaaaccggcgcggcaggtatggcggatatgggtaaagtcatggggctgctgaaaacccgcctcgcaggtaaagccga

SEQ ID NO: 76 - protein, 165 aa, Neisseria meningitidis
MRTHRKTCSAVCFAFQTASKPAVSIRHPSEDIMSLKIRLTEDMKTAMRAKDQVSLGTIRLINAAVKQFEVDERTEADDAKITAILTKMVKQRKDSAKIYTEAGRQDLADKENAEIEVLHRYLPQMLSAGEIRTEVEAAVAETGAAGMADMGKVMGLLKTRLAGKA

SEQ ID NO: 77 - DNA, 657 bp, Neisseria gonorrhoeae
atgctcgcccgtcgctattttttcaatatccaacccggggcggttttcactgacaaactgcttgaacaactgatgcgtttcctccagttcctgccggaatttctgtttgcccttttccgtattttcacccataaaagtaaccgtgcgcttaaattcgcccgccgtcatcacatccacatcaatatcatgttttttcaacaggcggtggatattcggcacttccgccaccacacccaccgaaccgatgaccgcaaacggagcggaaacaattttatccgccacacacgccatcatatagccgccgcttgccgcgaccttatcgacggcgacggtcagcggaatattgcgttcgcgcaaacgcctaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccgccctccttcaaacgctttttctctgctttggcttccgccttttcctttttcttttcttttttttcctgatgttttgtctcttcctcgcttaa

SEQ ID NO: 78 - protein, 218 aa, Neisseria gonorrhoeae
MLARRYFFNIQPGAVFTDKLLEQLMRFLQFLPEFLFALFRIFTHKSNRALKFARRHHIHINIMFFQQAVDIRHFRHHTHRTDDRKRSGNNFIRHTRHHIAAACRDLIDGDGQRNIAFAQTPKLRSRQTVTVNHAARTFQSEQNLIFRLGNQKHRRNLMTQGFYGVCIQIAVKIQHKKAGFLRFGRFLPALLQTLFLCFGFRLFLFLFFFFLMFCLFLA

SEQ ID NO: 79 - DNA, 657 bp, Neisseria meningitidis
  misc_feature (310)..(519): n is a, c, g, or t
  misc_feature (541)..(541): n is a, c, g, or t
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacacaaaaaggcgtgatttntgcgtttcggcagatttctccccaccctccttcaaacgtttttcctctgctttggcttccgccttttcctttttcttttcctctttttcctgatgttgtgcctcttccccgcttaa

SEQ ID NO: 80 - protein, 217 aa, Neisseria meningitidis
  misc_feature (104)..(173): Xaa can be any naturally occurring amino acid
  misc_feature (180)..(180): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARXXXXXXXXXXXXXXXXXXXXXXXXXXXXXXXXXXXXXXXXXXXXXXXXXXXXXXXXXXXXXXXXXXXXXXQHKKAFXRFGRFLPTLLQTFFLCFGFRLFLFLFLFFLMLCLFPA

SEQ ID NO: 81 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgctacaacacccaccgaaccgacaatcgcaaacggagcggaaacaattttatccgccacacacgccatcatataaccaccgctcgccgccaccttatcgacggcgacggtcagcggaatattgcgttcgcgcaaacgcctaagctgcgaagccgccaaaccgtaaccgtgaaccacgccgcccggactttccaatctaagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggaagatttctccccaccctccttcaaacgctttttctctgctttggcttccgccttttcctttttcttttcctctttttcctgatgttttgcctcttccccgcttaa

SEQ ID NO: 82 - protein, 218 aa, Neisseria meningitidis
MLARCHFLNIQLRAVLADKLLEQLMRFLQFLSEFLFALFRIFTHKSNRALKFARRHHIHINIMFFQQAVDIRYFRYNTHRTDNRKRSGNNFIRHTRHHITTARRHLIDGDGQRNIAFAQTPKLRSRQTVTVNHAARTFQSKQNLIFRLGNQKHRRNLMTQGFYGVCIQIAVKIQHKKAGFLRFGRFLPTLLQTLFLCFGFRLFLFLFLFFLMFCLFPA

SEQ ID NO: 83 - DNA, 657 bp, Neisseria meningitidis
atgctcgcccgttgccacttcctcaatatccaattgagggcggttctcgctgacaaactgcttgaacaactgatgcgtttcctccagttcctgtcggaatttctgtttgcccttttccgtattttcacccataaaagtaaccgtgcgcttaaattcgcccgccgtcatcacatccacatcaatatcatgttttttcaacaggcggtggatattcggtacttccgccaccacacccaccgaaccgacaatcgcaaacggagcggaagcaattttatccgccacacacgccatcatataaccgccgctcgccgccaccttatcgacggcgacggtcagcggaatattgcgttcgcgcaaacgcytaagctgcgaagccgccaaaccgtaaccgtgaaccacgccgcccggactttccaatctgagcagaacctcatcttcaggcttggcaatcaaaagcaccgccgtaatctcatgacgcaaggattctacggcgtgtgcatacaaatcgccgtcaaaatccaacacaaaaaggcgggatttttgcgtttcggcagatttctccccaccctccttcaaacgctttttctctgctttggcttccgccttttcctttttcttttcctctttttcctgatgttttgcctcttccccgcttaa

SEQ ID NO: 84 - protein, 218 aa, Neisseria meningitidis
  misc_feature (121)..(121): Xaa can be any naturally occurring amino acid
MLARCHFLNIQLRAVLADKLLEQLMRFLQFLSEFLFALFRIFTHKSNRALKFARRHHIHINIMFFQQAVDIRYFRHHTHRTDNRKRSGSNFIRHTRHHITAARRHLIDGDGQRNIAFAQTXKLRSRQTVTVNHAARTFQSEQNLIFRLGNQKHRRNLMTQGFYGVCIQIAVKIQHKKAGFLRFGRFLPTLLQTLFLCFGFRLFLFLFLFFLMFCLFPA

SEQ ID NO: 85 - DNA, 657 bp, Neisseria meningitidis; identical to SEQ ID NO: 81

SEQ ID NO: 86 - protein, 218 aa, Neisseria meningitidis; identical to SEQ ID NO: 82

SEQ ID NO: 87 - DNA, 318 bp, Neisseria gonorrhoeae
atgcctttgaccatgctgtgcagcaggacgtgcggtttgttcataatacagtccgaccggaaaagcggaggaaacgcagtgccgcgcccttcccctttcttgccgtggcaggcgatgcagttggattcgtacactttttgcccttttgtcatgatgctgttgtcggcggcagaagcggcggcgcagaggcagcacaagatgaaggcggtcggcagtcgggttgtgttcattggcgtttcccctaatgttttgaaaccttgttttttgattttgcctttacggggtgaaaagtttttttggcccaaatccggaatttag

SEQ ID NO: 88 - protein, 105 aa, Neisseria gonorrhoeae
MPLTMLCSRTCGLFIIQSDRKSGGNAVPRPSPFLPWQAMQLDSYTFCPFVMMLLSAAEAAAQRQHKMKAVGSRVVFIGVSPNVLKPCFLILPLRGEKFFWPKSGI

SEQ ID NO: 89 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaagcagcccaagacgagggcggtcggcagtcgggttgtgttcattggtgtttccttcatgtttgaaaccttgttgttgattttgcgtagcgggtgaaagatttttttgccgaatcagtag

SEQ ID NO: 90 - protein, 101 aa, Neisseria meningitidis
  misc_feature (21)..(21): Xaa can be any naturally occurring amino acid
  misc_feature (94)..(94): Xaa can be any naturally occurring amino acid
MPLTMLCSSTCGFFMMKSERXSGGNMVPRPSPFLPWQATQLDSYTFCPFVMMLLSAAEAAAQKQPKTRAVGSRVVFIGVSFMFETLLLILRSGXKIFLPNQ

SEQ ID NO: 91 - DNA, 306 bp, Neisseria meningitidis
atgcctttgaccatgctgtgcagcagcacctgcggttttttcatgatgaagtcggagcggtagagcggcggaaacatggttccgcggccttcgccctttttgccgtggcaggcgacgcagttggattcgtacactttttgcccttttgtcatgatgctgttgtcggcggcagaagcggcggcgcagaggcagcccaagacgagggcggtcggcagtcgggttgtgttcattggtgtttccttaatgtttgaaaccttgttgttgattttgcgtagcgggtgaaagattttcttgccgaatcggtag

SEQ ID NO: 92 - protein, 99 aa, Neisseria meningitidis
MPLTMLCSSTCGFFMMKSERSGGNMVPRPSPFLPWQATQLDSYTFCPFVMMLLSAAEAAAQRQPKTRAVGSRVVFIGVSLMFETLLLILRSGKIFLPNR

SEQ ID NO: 93 - DNA, 375 bp, Neisseria gonorrhoeae
atgcagtatctgattgtcaaatacagccatcaaatcttcgttaccatcaccattttggtattcaacatccgttttttcctactttggaaaaatccagaaaagcccttggtcggcttttggaaagcactgccccacctcaacgacacgatgctgctgtttacgggattgtggctgatgaagattacccatttctccccgttcaacgcgccttggctcggcacaaaaatcctgctcctgttcgcctacatcgcactgggcatggtaatgatgcgcgcccgtccgcgttcgaccaagttctacaccgtttacctgctcgctatgtgttgcatcgcctgcatcgtttaccttgccaaaaccaaagtcctgccattctga

SEQ ID NO: 94 - protein, 124 aa, Neisseria gonorrhoeae
MQYLIVKYSHQIFVTITILVFNIRFFLLWKNPEKPLVGFWKALPHLNDTMLLFTGLWLMKITHFSPFNAPWLGTKILLLFAYIALGMVMMRARPRSTKFYTVYLLAMCCIACIVYLAKTKVLPF

SEQ ID NO: 95 - DNA, 285 bp, Neisseria meningitidis
aaaatcagaaaagccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcgtcgcctgcatcgtttaccttgccaaaaccaaagtcctgcctttctga

SEQ ID NO: 96 - protein, 94 aa, Neisseria meningitidis
KIRKALAGFWKALPHLNDTMLLFTGLWLMKITHFSPFNAPWLGTKILLLLAYIALGMMMMRARPRSTKFYTVYLLAMCCVACIVYLAKTKVLPF

SEQ ID NO: 97 - DNA, 375 bp, Neisseria meningitidis
  misc_feature (79)..(79): n is a, c, g, or t
atgcagtatctgattgtcaaatacagccatcaaatcttcgttaccatcaccattttggtattcaacatccgtgttttcntactttggaaaaatccagaaaagcccttggcgggcttttggaaggcactgccccaccttaacgacaccatgctgctgtttacgggattgtggctgatgaaaattacccatttctccccgttcaacgcgccttggctcggtacaaaaatcctgcttctgctcgcctatatcgcattgggtatgatgatgatgcgcgcccgtccgcgttcgaccaagttctacaccgtttacctgctcgccatgtgttgcctcacctgcatcgtttaccttgccaaaaccaaagtcctgcctttctga

SEQ ID NO: 98 - protein, 124 aa, Neisseria meningitidis
  misc_feature (27)..(27): Xaa can be any naturally occurring amino acid
MQYLIVKYSHQIFVTITILVFNIRVFXLWKNPEKPLAGFWKALPHLNDTMLLFTGLWLMKITHFSPFNAPWLGTKILLLLAYIALGMMMMRARPRSTKFYTVYLLAMCCLTCIVYLAKTKVLPF

SEQ ID NO: 99 - DNA, 312 bp, Neisseria gonorrhoeae
atgcagcaggggcagttggttggacgcgtcgcccgcaataaagatatgcggaatgctggtctgcatggtcagcggatcggcaacgggtacgccgcgcgcgtctttgtcgatattgatgttttccaaaccgatattgtcaacgttcggacggcgacctacggctgccaacatatattcggcaacaaatacgcctttttcgccatcctgctcccaatggacttctacattgccgtctgcgtcgagtttgacctcggttttagcatccagatgcagtttcaattcttctccgaacacggctttcgcctcgtctga

SEQ ID NO: 100 - protein, 103 aa, Neisseria gonorrhoeae
MQQGQLVGRVARNKDMRNAGLHGQRIGNGYAARVFVDIDVFQTDIVNVRTATYGCQHIFGNKYAFFAILLPMDFYIAVCVEFDLGFSIQMQFQFFSEHGFRLV

SEQ ID NO: 101 - DNA, 312 bp, Neisseria meningitidis
atgcagcagaggcagttggttggacgcatcgcctgcgatgaagatatgcggaatactggtctgcatggtcagcgggtcggcaacaggtacgccgcgcgcatctttttcgatattgatattttccaaaccgatattgtcaacgttcggacggcggcccacggctgccagcatatattcggcaacaaatacgcctttttcgccatcctgctcccaatggacttctacattgccgtctgcatcgagtttgacctcggttttagcatccagatgcagtttcaattcttcgccgaacacggcgttcgcctcgtctga

SEQ ID NO: 102 - protein, 103 aa, Neisseria meningitidis
MQQRQLVGRIACDEDMRNTGLHGQRVGNRYAARIFFDIDIFQTDIVNVRTAAHGCQHIFGNKYAFFAILLPMDFYIAVCIEFDLGFSIQMQFQFFAEHGVRLV

SEQ ID NO: 103 - DNA, 312 bp, Neisseria meningitidis
atgcagcaggggcagttggttggacgcgtcgcccgcaataaagatatgcggaatactggtctgcatagtcagcggatcggcaacgggtacgccgcgcgcatctttttcgatattgatgttttccaaaccgatattgtcaacgttcggacggcggcctacggctgccagcatatattcggcaacaaatacgcctttttcgccatcctgctcccaatggacttctacattgccgtctgcgtcgagtttggcctcggttttagcatccaaatgcagtttcaattcttcaccgaacacggctttcgcctcgtctga

SEQ ID NO: 104 - protein, 103 aa, Neisseria meningitidis
MQQGQLVGRVARNKDMRNTGLHSQRIGNGYAARIFFDIDVFQTDIVNVRTAAYGCQHIFGNKYAFFAILLPMDFYIAVCVEFGLGFSIQMQFQFFTEHGFRLV

SEQ ID NO: 105 - DNA, 268 bp, Neisseria gonorrhoeae
ctgctggcggccctggtgcttgccgcgtgttcttcgacaaacacactgccagccggcaagaccccggcagacaatatagaaactgccgacctttcggcaagcgttcccacccgccctgccgaaccggaaggaaaaacgctggcagattacggcggctacccgtccgcactggatgcagtgaaacagaacaacgatgcggcagccgccgcctatttggaaaacgcaggagacagcgcgatggcggaaaatgtccgcaaggagtggctga

SEQ ID NO: 106 - protein, 89 aa, Neisseria gonorrhoeae
LLAALVLAACSSTNTLPAGKTPADNIETADLSASVPTRPAEPEGKTLADYGGYPSALDAVKQNNDAAAAAYLENAGDSAMAENVRKEWL

SEQ ID NO: 107 - DNA, 1572 bp, Neisseria meningitidis
atgtacctaccctctatgaagcattccctgccgctgctggcggccctggtgcttgccgcgtgttcttcgacaaacacactgccagccggcaagaccccggcagacaatatagaaactgccgacctttcggcaagcgttcccacccgccctgccgaacccgaaagaaaaacgctggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcacgcagacagtggacgctgtttgcacaggaatacgccaaactcgaaccggcagggcgcgcccaagaagtcgaatgctacgccgattcgagccgcaacgactatacgcgtgccgctgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattacggcaaggttgccgaccgccgccaactgaccgacgaccaaatcgagtggtacgcccgcgccgccttgcgcgcccgacgttgggacgagctggcctccgttatctcgcatatgcccgaaaaactgcaaaaaagcccgacctggctctactggctggcacgcagccgcgccgcaacgggcaacacgcaagaggcggaaaaactttacaaacaggcggcagcgacgggcaggaatttttatgcggtgctggcaggggaagaattgggtcggaaaatcgatacgcgcaacaatgtgcccgatgccggcaaaaacagcgtccgccgcatggcggaagacggtgcagtcaaacgcgcactggtactgttccaaaacagccaatctgccggtgatgcaaaaatgcgccgtcaggctcaggcggaatggcgttttgccacacgcggctttgacgaagacaagctgctgaccgccgcgcaaaccgcgttcgaccacggtttttacgatatggcggtcaacagcgcggaacgcaccgaccgcaaactcaactacaccttgcgctatatttcgccgtttaaagacacggtaatccgccacgcgcaaaatgttaatgtcgatccggcttgggtttatgggctgattcgtcaggaaagccgcttcgttataggcgcgcaatcccgcgtaggcgcgcaggggctgatgcaggttatgcctgccaccgcgcgcgaaatcgccggcaaaatcggtatggatgccgcacaactttacaccgccgacggg

SEQ ID NO: 108 - protein, 524 aa, Neisseria meningitidis
MYLPSMKHSLPLLAALVLAACSSTNTLPAGKTPADNIETADLSASVPTRPAEPERKTLADYGGYPSALDAVKQKNDAAVAAYLENAGDSAMAENVRNEWLKSLGARRQWTLFAQEYAKLEPAGRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYYGKVADRRQLTDDQIEWYARAALRARRWDELASVISHMPEKLQKSPTWLYWLARSRAATGNTQEAEKLYKQAAATGRNFYAVLAGEELGRKIDTRNNVPDAGKNSVRRMAEDGAVKRALVLFQNSQSAGDAKMRRQAQAEWRFATRGFDEDKLLTAAQTAFDHGFYDMAVNSAERTDRKLNYTLRYISPFKDTVIRHAQNVNVDPAWVYGLIRQESRFVIGAQSRVGAQGLMQVMPATAREIAGKIGMDAAQLYTADG

SEQ ID NO: 109 - DNA, 1851 bp, Neisseria meningitidis
  misc_feature (44)..(44): n is a, c, g, or t
  misc_feature (68)..(68): n is a, c, g, or t
  misc_feature (145)..(145): n is a, c, g, or t
  misc_feature (163)..(163): n is a, c, g, or t
  misc_feature (173)..(173): n is a, c, g, or t
  misc_feature (335)..(335): n is a, c, g, or t
  misc_feature (342)..(342): n is a, c, g, or t
  misc_feature (351)..(351): n is a, c, g, or t
  misc_feature (367)..(367): n is a, c, g, or t
  misc_feature (801)..(801): n is a, c, g, or t
  misc_feature (864)..(865): n is a, c, g, or t
  misc_feature (867)..(868): n is a, c, g, or t
  misc_feature (871)..(873): n is a, c, g, or t
  misc_feature (876)..(877): n is a, c, g, or t
  misc_feature (881)..(881): n is a, c, g, or t
  misc_feature (883)..(883): n is a, c, g, or t
  misc_feature (885)..(885): n is a, c, g, or t
  misc_feature (888)..(889): n is a, c, g, or t
  misc_feature (894)..(895): n is a, c, g, or t
  misc_feature (899)..(900): n is a, c, g, or t
  misc_feature (902)..(902): n is a, c, g, or t
  misc_feature (904)..(904): n is a, c, g, or t
  misc_feature (907)..(910): n is a, c, g, or t
  misc_feature (914)..(915): n is a, c, g, or t
  misc_feature (918)..(918): n is a, c, g, or t
  misc_feature (923)..(928): n is a, c, g, or t
  misc_feature (930)..(930): n is a, c, g, or t
  misc_feature (933)..(933): n is a, c, g, or t
  misc_feature (935)..(936): n is a, c, g, or t
  misc_feature (938)..(939): n is a, c, g, or t
  misc_feature (941)..(941): n is a, c, g, or t
  misc_feature (943)..(943): n is a, c, g, or t
  misc_feature (945)..(946): n is a, c, g, or t
  misc_feature (948)..(948): n is a, c, g, or t
  misc_feature (951)..(952): n is a, c, g, or t
  misc_feature (972)..(972): n is a, c, g, or t
  misc_feature (988)..(988): n is a, c, g, or t
  misc_feature (990)..(990): n is a, c, g, or t
  misc_feature (996)..(996): n is a, c, g, or t
  misc_feature (1002)..(1002): n is a, c, g, or t
  misc_feature (1021)..(1021): n is a, c, g, or t
  misc_feature (1028)..(1028): n is a, c, g, or t
  misc_feature (1041)..(1041): n is a, c, g, or t
  misc_feature (1048)..(1048): n is a, c, g, or t
  misc_feature (1050)..(1050): n is a, c, g, or t
  misc_feature (1070)..(1070): n is a, c, g, or t
  misc_feature (1109)..(1109): n is a, c, g, or t
  misc_feature (1205)..(1205): n is a, c, g, or t
  misc_feature (1363)..(1367): n is a, c, g, or t
  misc_feature (1369)..(1369): n is a, c, g, or t
  misc_feature (1371)..(1371): n is a, c, g, or t
atgtacccaccctctctgaagcattccctgccgctgctggtggncctggtgcttgccgcgtgttcttngacaaacacactgtcagccgacaagaccccggcagacaatatagaaactgccgacctttcggcaagcgttcccaccngccctgccgaacccgaangaaaaacgtnggcagattacggcggctacccgtccgcactggatgcagtgaaacagaaaaacgatgccgccgtcgccgcctatttggaaaacgccggcgacagcgcgatggcggaaaatgtccgcaacgagtggctgaagtctttgggcgcgcgcagacagtggacgctgtntgcacangaatatgcnaaactcgaaccggcanggcgcgcccaagaagtcgaatgctacgccgattcgagccgcaacgactatacgcgtgccgccgaactggtcaaaaatacgggcaaactgccttcgggctgcaccaaactgttggaacaggcagccgcatccggcttgttggacggcaacgacgcctggaggcgcgtgcgcggactgctggccggccgccaaaccacagacgcacgcaaccttgccgccgcattgggcagcccgtttgacggcggtacacaaggttcgcgcgaatatgccctgttgaacgtcatcggcaaagaagcacgcaaatcgccgaatgccgccgccctgctgtccgaaatggaaagcggtttaagcctcgaacaacgcagtttcgcgtggggcgtattggggcattatcagtcgcaaaacctcaatgtgcctgccgccttggactattanggcaaggttgccgaccgccgccaactgaccgacgaccaaatcgagtggtacgcccgcgccgcnntnngcnnncgnngttngnanganntggcnnccgnnancncgnnnntgcnnganaaacnnnnnnanagncnnanntngntnnantgnntggcacgcagccgcgccgcnacgggcaacacgcaanangcgganaaactntacaaacaggcggcagcancgggcangaatttttatgcngtgctgncnggggaagagttggggcgcanaatcgatacgcgcaacaatgtgcccgatgccggcaaaancagcgtcctccgtatggcggaagacggcgcgattaagcgcgcgctggtgctgttccgaaacagccgaaccgccggcgatgcgaaaatgcgccgtcnggctcaggcggaatggcgtttcgccacacgcggcttcgatgaagacaagctgctgaccgccgcgcaaaccgcgttcgaccacggtttttacgatatggcggtcaacagcgcggaacgcaccgaccgcaaactcaactacaccttgcgctacatttcgnnnnntnangacacggtaatccgccacgcgcaaaatgttaatgtcgatccggcgtgggtttacgggctgattcgtcaggaaagccgcttcgttatgggcgcgcaatcccgcgtaggcgcgcaggggctgatgcaggttatgcctgccaccgcgcgcgaaatcgccggcaaaatcggtatggatgccgcacaactttacaccgccgacggcaatatccgtatggggacgtggtatatggcggacaccaaacgccgcctgcaaaacaacgaagtcctcgccaccgcaggctataacgccggtcccggcagggcgcgccgatggcaggcggacacgcccctcgaaggcgcggtatatgccgaaaccatcccgttttccgaaacgcgcgactatgtcaaaaaagtgatggccaatgccgcctactacgcctccctcttcggcgcgccgcacatcccgctcaaacagcgtatgggcattgtccccgcccgctga

SEQ ID NO: 110 - protein, 616 aa, Neisseria meningitidis
  misc_feature (15)..(15): Xaa can be any naturally occurring amino acid
  misc_feature (23)..(23): Xaa can be any naturally occurring amino acid
  misc_feature (49)..(49): Xaa can be any naturally occurring amino acid
  misc_feature (55)..(55): Xaa can be any naturally occurring amino acid
  misc_feature (58)..(58): Xaa can be any naturally occurring amino acid
  misc_feature (112)..(112): Xaa can be any naturally occurring amino acid
  misc_feature (114)..(114): Xaa can be any naturally occurring amino acid
  misc_feature (123)..(123): Xaa can be any naturally occurring amino acid
  misc_feature (267)..(267): Xaa can be any naturally occurring amino acid
  misc_feature (289)..(291): Xaa can be any naturally occurring amino acid
  misc_feature (293)..(297): Xaa can be any naturally occurring amino acid
  misc_feature (299)..(306): Xaa can be any naturally occurring amino acid
  misc_feature (308)..(318): Xaa can be any naturally occurring amino acid
  misc_feature (330)..(330): Xaa can be any naturally occurring amino acid
  misc_feature (332)..(332): Xaa can be any naturally occurring amino acid
  misc_feature (341)..(341): Xaa can be any naturally occurring amino acid
  misc_feature (343)..(343): Xaa can be any naturally occurring amino acid
  misc_feature (350)..(350): Xaa can be any naturally occurring amino acid
  misc_feature (357)..(357): Xaa can be any naturally occurring amino acid
  misc_feature (370)..(370): Xaa can be any naturally occurring amino acid
  misc_feature (402)..(402): Xaa can be any naturally occurring amino acid
  misc_feature (455)..(457): Xaa can be any naturally occurring amino acid
MYPPSLKHSLPLLVXLVLAACSXTNTLSADKTPADNIETADLSASVPTXPAEPEXKTXADYGGYPSALDAVKQKNDAAVAAYLENAGDSAMAENVRNEWLKSLGARRQWTLXAXEYAKLEPAXRAQEVECYADSSRNDYTRAAELVKNTGKLPSGCTKLLEQAAASGLLDGNDAWRRVRGLLAGRQTTDARNLAAALGSPFDGGTQGSREYALLNVIGKEARKSPNAAALLSEMESGLSLEQRSFAWGVLGHYQSQNLNVPAALDYXGKVADRRQLTDDQIEWYARAAXXXRXXXXXAXXXXXXXXKXXXXXXXXXXXARSRAATGNTQXAXKLYKQAAAXGXNFYAVLXGEELGRXIDTRNNVPDAGKXSVLRMAEDGAIKRALVLFRNSRTAGDAKMRRXAQAEWRFATRGFDEDKLLTAAQTAFDHGFYDMAVNSAERTDRKLNYTLRYISXXXDTVIRHAQNVNVDPAWVYGLIRQESRFVMGAQSRVGAQGLMQVMPATAREIAGKIGMDAAQLYTADGNIRMGTWYMADTKRRLQNNEVLATAGYNAGPGRARRWQADTPLEGAVYAETIPFSETRDYVKKVMANAAYYASLFGAPHIPLKQRMGIVPAR

SEQ ID NO: 111 - DNA, 342 bp, Neisseria gonorrhoeae
atggtagaacgtaaattgaccggtgcccattacggtttgcgcgattgggtaatgcagcgtgcgactgcggttattatgttgatttataccgttgcacttttagtggttctatttgccctgcctaaagaatatccggcatggcaggcattttttagtcaagcttgggtaaaagtatttacccaagtgagctttatcgccgtattcttgcacgcttgggtgggtatccgcgatttgtggatggactatatcaaacccttcggcgtgcgtttgtttttgcaggttgccaccattgtctggctggtcggctgcctcgtgtattcagttaaagtgatttgggggtaa

SEQ ID NO: 112 - protein, 113 aa, Neisseria gonorrhoeae
MVERKLTGAHYGLRDWVMQRATAVIMLIYTVALLVVLFALPKEYPAWQAFFSQAWVKVFTQVSFIAVFLHAWVGIRDLWMDYIKPFGVRLFLQVATIVWLVGCLVYSVKVIWG

SEQ ID NO: 113 - DNA, 342 bp, Neisseria meningitidis
atggtagaacgtaaattgaccggtgcccattacggtttgcgcgattgggtgatgcaacgtgcgactgcggttattatgttgatttataccgttgcacttttagtggttctattttccctgcctaaagaatattcggcatggcaggcattttttagtcaaacttgggtaaaagtatttacccaagtgagcttcatcgccgtattcttgcacgcttgggtgggtatccgcgatttgtggatggactatatcaaacccttcggcgtgcgtttgtttttgcaggttgccaccatcgtttggctggtcggctgtctcgtgtattcagttaaagtgatttgggggtaa

SEQ ID NO: 114 - protein, 113 aa, Neisseria meningitidis
MVERKLTGAHYGLRDWVMQRATAVIMLIYTVALLVVLFSLPKEYSAWQAFFSQTWVKVFTQVSFIAVFLHAWVGIRDLWMDYIKPFGVRLFLQVATIVWLVGCLVYSVKVIWG

SEQ ID NO: 115 - DNA, 342 bp, Neisseria meningitidis
  misc_feature (249)..(249): n is a, c, g, or t
atggtagaacgtaaattgaccggtgcccattacggtttgcgggattgggcgatgcaacgtgcgaccgcggttattatgttgatttataccgttgcacttttagtggttctatttgctctgcctaaagaatattcggcatggcaggcattttttagtcaaacttgggtaaaagtatttacccaagtgagcttcatcgccgtattcttgcacgcttgggtgggtatccgcgatttgtggatggactatatnaaacccttcggcgtgcgtttgtttttgcaggttgccaccatcgtctggctggtcggctgcttggtgtattcaattaaagtaatttgggggtaa

SEQ ID NO: 116 - protein, 113 aa, Neisseria meningitidis
  misc_feature (83)..(83): Xaa can be any naturally occurring amino acid
MVERKLTGAHYGLRDWAMQRATAVIMLIYTVALLVVLFALPKEYSAWQAFFSQTWVKVFTQVSFIAVFLHAWVGIRDLWMDYXKPFGVRLFLQVATIVWLVGCLVYSIKVIWG

SEQ ID NO: 117 - DNA, 1014 bp, Neisseria meningitidis
atgttgaaacaaacgacacttttggcagcttgtaccgccgttgccgctctgttgggcggttgcgccacccaacagcctgctcctgtcattgcaggcaattcaggtatgcagaccgtatcgtctgcgccggtttacaatccttatggcgcaacgccgtacaatgccgctcctgccgccaacgatgcgccgtatgtgccgcccgtgcaaactgcgccggtttattcgcctcctgcttatgttccgccgtctgcacctgccgtttcgggtacatatgttccttcttacgcacccgtcgacatcaacgcggcgacgcatactattgtgcgtggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaaaccgcagccgtagaaagcaggcccgccgtaccggctgccgcgcaaacccctgtgaaacccgccgcgcaaccgcccgttcagtccgcgccgcaacctgccgcgcccgctgcggaaaataaagcggttcccgcccccgcgcccgccccgcaatctcctgccgcttcgccttccggcacgcgttcggtcggcggcattgtttggcagcgtccgacccaaggtaaagtggttgccgatttcggcggcggcaacaagggtgtcgatattgccggcaatgccggacaacccgttttggcggcggctgacggcaaagtggtttatgccggttcaggtttgaggggatacggaaacttggtcatcatccagcacaattcctctttcctgaccgcgtacgggcacaaccaaaaattgctggtcggcgaaggtcagcaggtcaaacgcggtcagcaggttgctttgatgggtaataccgatgcttccagaacgcagcttcatttcgaggtgcgtcaaaacggcaaaccggttaacccgaacagctatatcgcgttctga

SEQ ID NO: 118 - protein, 337 aa, Neisseria meningitidis
MLKQTTLLAACTAVAALLGGCATQQPAPVIAGNSGMQTVSSAPVYNPYGATPYNAAPAANDAPYVPPVQTAPVYSPPAYVPPSAPAVSGTYVPSYAPVDINAATHTIVRGDTVYNISKRYHISQDDFRAWNGMTDNTLSIGQIVKVKPAGYAAPKTAAVESRPAVPAAAQTPVKPAAQPPVQSAPQPAAPAAENKAVPAPAPAPQSPAASPSGTRSVGGIVWQRPTQGKVVADFGGGNKGVDIAGNAGQPVLAAADGKVVYAGSGLRGYGNLVIIQHNSSFLTAYGHNQKLLVGEGQQVKRGQQVALMGNTDASRTQLHFEVRQNGKPVNPNSYIAF

SEQ ID NO: 119 - DNA, 1056 bp, Neisseria gonorrhoeae
gtgccgccggtgcaaagcgcgccggtttatacgcctcctgcttatgttccgccgtctgcacctgccgtttcgggtacatacgttccttcttacgcacccgtcgacatcaacgcggcgacgcatactattgtgcgcggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaagccgcagccgtaaaaagcaggcccgccgtaccggctgccgcgcaaccgcccgtacagtccgcacccgtcgacattaacgcggcgacgcatactattgtgcgcggcgacacggtgtacaacatttccaaacgctaccatatctctcaagacgatttccgtgcgtggaacggcatgaccgacaatatgttgagcatcggtcagattgttaaagtcaaaccggcaggatatgccgcaccgaaaaccgcagccgtagaaagcaggcccgccgtaccggctgccgtgcaaacccctgtgaaacccgccgcgcaaccgcctgtgcagtccgcgccgcaacctgccgcgcccgctgcggaaaataaagcggttcccgcgcccgccccgcaatctcctgccgcttcgccttccggcacgcgttcggtcggcggcattgtttggcagcgtccgacgcaaggtaaagtggttgccgatttcggcggcaacaacaagggtgtcgatattgccggtaatgcgggacagcccgttttggcggcggctgacggcaaagtggtttatgccggttcaggtttgaggggatacggaaacttggtcatcatccagcataattcttctttcctgaccgcatacgggcacaaccaaaaattgctggtcggcgaggggcagcaggtcaaacgcggtcagcaggttgctttgatgggcaataccgatgcttccagaacgcagcttcatttcgaggtgcgtcaaaacggcaaaccggttaacccgaacagctatatcgcgttctga

SEQ ID NO: 120 - protein, 509 aa, Neisseria meningitidis
MAAADKQLGSDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLEDLRGRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCIPNMIVAAPSDENECRLLLSTCYQADAPAAVRYPRGTGTGVPVSDGMETVEIGKGIIRREGEKTAFIAFGSMVAPALAVAGKLNATVADMRFVKPIDEELIVRLARSHDRIVTLEENAEQGGAGSAVLEVLAKHGICKPVLLLGVADTVTGHGDPKKLLDDLGLSAEAVERRVRAWLSDRDAAN

SEQ ID NO: 121 - DNA, 1140 bp, Neisseria gonorrhoeae
atgagccgtttatggttttttgccgtaaaaaacattataatccgccttatttacctattgcccaaggagacacaaatggcactcgtatccatgcgccaactgcttgaccacgccgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattctggcggcagtcgaagaatttccgcacatccccgtcgtgatgcaccaagaccacggcgcatcgcccgacgtgtgccaacgctccatccaactgggcttctcctccgtgatgatggacggctctttgctcgaagacggcaaaaccccttcttcttacgaatacaacgtcaacgccacccgtaccgtcgtcaacttctcccacgcctgcggcgtgtccgtcgaaggcgaaatcggcgtattgggcaacctcgaaaccggcgaagcaggcgaagaagacggagtgggcgcggcaggcaaactctcacacgaccaaatgctcaccagcgttgaagatgccgtgcgtttcgttaaagataccggcgttgacgcattggcgattgccgtcggcaccagccacggcgcatacaaattcacccgtccgcccacaggcgacgtattgcgtatcgaccgcatcaaggaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgcaaagtcaacatcgataccgacctgcgcctcgcttccaccggcgcggtacgccgctaccttgccgaaaacccgtccgactttgatccgcgcaaatacttgggcaaaaccattgaagcgatgaagcaaatctgcctcgaccgttatcttgcgttcggttgcgaaggtcaggcaggcaaaatcaaacctgtttcgttggaaaaaatggcaagccgttatgccaagggcgaattgaaccaaatcgtcaaataa

SEQ ID NO: 122 - protein, 379 aa, Neisseria gonorrhoeae
MSRLWFFAVKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLLEDGKTPSSYEYNVNATRTVVNFSHACGVSVEGEIGVLGNLETGEAGEEDGVGAAGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLGKTIEAMKQICLDRYLAFGCEGQAGKIKPVSLEKMASRYAKGELNQIVK

SEQ ID NO: 123 - DNA, 771 bp, Neisseria meningitidis
atgagctgtttatggttttttgctgtaaaaaacattataatccgccttatttacctattgcccaaggagacacaaatggcactcgtatccatgcgccaactgcttgatcatgctgccgaawacagctacggcytgccggcgttcaacgtcaacaacctcgwacagatgcgcgccatcatggaggctgcagaccaagtcgacgcccccgtcatcgtacaggcgagtgccggtgcgcgcaaatatgcgggtgcgccgtttttacgccacctgattttggcggctgtcgaagtatttccacacatccccgtcgtcatgcaccaagaccacggcgcatcacccgacgtgtgccaacgctccatccaactgggcttctcctctgtaatgatggacggctcgctgatggaagacggcaaaaccccttcttcttacgaatacaacgtcaacgccacacgtaccgtggttaacttctcccacgcttgcggcgtatccgttgaaggcgaaatcggcgtattgggcaacctcgaaaccggcgatgcaggcgaagaagacggtgtaggcgcagtgggcaaactttcccacgaccaaatgctgaccagcgtcgaagatgccgtatgtttcgttaaagataccggcgttgacgcattggctattgccgtcggcaccagccacggcgcatacaaattcacccgtccgcccacaggcgatgtattacgtatcgaccgcatcaaagaaatccaccaagccctgcccaatacacacatcgtgatgcac

SEQ ID NO: 124 - protein, 257 aa, Neisseria meningitidis
  misc_feature (41)..(41): Xaa can be any naturally occurring amino acid
  misc_feature (54)..(54): Xaa can be any naturally occurring amino acid
MSCLWFFAVKNIIIRLIYLLPKETQMALVSMRQLLDHAAEXSYGLPAFNVNNLXQMRAIMEAADQVDAPVIVQASAGARKYAGAPFLRHLILAAVEVFPHIPVVMHQDHGASPDVCQRSIQLGFSSVMMDGSLMEDGKTPSSYEYNVNATRTVVNFSHACGVSVEGEIGVLGNLETGDAGEEDGVGAVGKLSHDQMLTSVEDAVCFVKDTGVDALAIAVGTSHGAYKFTRPPTGDVLRIDRIKEIHQALPNTHIVMH

SEQ ID NO: 125 - DNA, 1140 bp, Neisseria meningitidis
atgagccgtttatggttttttgccgcaaaaaacattataatccgccttatttacctattgcccaaggagacacaaatggcactcgtatccatgcgccaactgcttgatcatgctgccgaaaacagctacggcctgcccgcgttcaacgtcaacaacctcgaacaaatgcgcgccattatggaagccgccgaccaagtcaacgcgcccgtcatcgtacaggcgagcgcaggtgcgcgcaaatacgcgggcgcgccgtttttgcgccacctgattttggcggctgtcgaagaatttccgcacatccccgtcgtgatgcaccaagaccacggcgcatcgcccgacgtgtgccaacgctccatccaactgggcttttcctccgtgatgatggacggctcgctgatggaagacggcaaaaccccttcttcttatgaatacaacgtcaacgccacccgtaccgtggttaatttctcccacgcctgcggcgtatccgttgaaggcgaaatcggcgtattgggcaacctcgaaactggcgaagccggcgaagaagacggtgtaggcgcagtgggcaaactttcccacgaccaaatgctcaccagcgtcgaagatgccgtgcgtttcgttaaagataccggcgttgacgcattggcgattgccgtcggcaccagccacggcgcgtacaaattcacccgtccgcccacaggcgacgtgttgcgtatcgaccgcatcaaagaaatccaccaagccctgcccaatacacacatcgtgatgcacggctccagctccgttccgcaagaatggctgaaagtcatcaacgaatacggcggcaatatcggcgaaacctacggcgtgccggttgaagaaatcgtcgaaggcatcaaacacggcgtgcgtaaagtcaacatcgataccgacttgcgccttgcttccaccggcgcggtacgccgctaccttgccgaaaacccgtccgacttcgatccgcgcaaatatttgagcaaaaccattgaagcgatgaagcaaatctgcctcgaccgctacctcgcgttcggttgcgaaggtcaggcaggcaaaatcaaaccggtttccttggaaaaaatggcaaaccgttatgccaagggcgaattgaaccaaatcgtcaaataa

SEQ ID NO: 126 - protein, 379 aa, Neisseria meningitidis
MSRLWFFAAKNIIIRLIYLLPKETQMALVSMRQLLDHAAENSYGLPAFNVNNLEQMRAIMEAADQVNAPVIVQASAGARKYAGAPFLRHLILAAVEEFPHIPVVMHQDHGASPDVCQRSIQLGFSSVMMDGSLMEDGKTPSSYEYNVNATRTVVNFSHACGVSVEGEIGVLGNLETGEAGEEDGVGAVGKLSHDQMLTSVEDAVRFVKDTGVDALAIAVGTSHGAYKFTRPPTGDVLRIDRIKEIHQALPNTHIVMHGSSSVPQEWLKVINEYGGNIGETYGVPVEEIVEGIKHGVRKVNIDTDLRLASTGAVRRYLAENPSDFDPRKYLSKTIEAMKQICLDRYLAFGCEGQAGKIKPVSLEKMANRYAKGELNQIVK

SEQ ID NO: 127 - DNA, 816 bp, Neisseria gonorrhoeae
atgctgaagccgtgtttggtatacagtgcctgtgcggcggcgttgcctgcgcggacttcgagcagcaggcgttgcgtgccttcgggcagatgtgcgtaccaatattcgagcagggcggacgcaacgccccgtcggcggcattcgggcgcggtggcaatcaggtgcagttcggattcgtcgggcaggttctgccaaacgataaaggcggcaatcctgccgtctttttccgcaaggaaaacctgttcggacggcgaaacaagcgcggactcaaattggcgttgcgtccacgcggacgggttgcagacggtatcgagcgcggccagtgcggcgcagtcggacggtgaggctgggcggatgttcatgttcgtgccttccgttccgcctgttctttggcagtcagggcgattttgttgcggacgtagagcagttcggcgtgtgccgcgccagttgcgggatagccgccgccgagggcgagcgcgagaaaatcggcggcggtcggcatatcgggtttgcctgagaagggcggacggttttccagtgcgaacgcactgccgatgccgtctgaaaagacgtacccctcggggagggcaatgtctgccgccctaccgacttgataatcgctcaaacggcggcggttcagcgtgtcgaaccacgcataaaacacttcgcccatacgcgcgtccgcagcggcgagtatgcagctttgcggcggcggcagcgaggcggcggcatcgagcgtggggatgccgattaaaggcgtgtcgaacggcgttgccaaaccttgcgccacgccgatgccgatacgcagtccggtaa

SEQ ID NO: 128 - protein, 271 aa, Neisseria gonorrhoeae
MLKPCLVYSACAAALPARTSSSRRCVPSGRCAYQYSSRADATPRRRHSGAVAIRCSSDSSGRFCQTIKAAILPSFSARKTCSDGETSADSNWRCVHADGLQTVSSAASAAQSDGEAGRMFMFVPSVPPVLWQSGRFCCGRRAVRRVPRQLRDSRRRGRARENRRRSAYRVCLRRADGFPVRTHCRCRLKRRTPRGGQCLPPYRLDNRSNGGGSACRTTHKTLRPYARPQRRVCSFAAAAARRRHRAWGCRLKACRTALPNLAPRRCRYAVR

SEQ ID NO: 129 - DNA, 815 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgcgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtagcggcaaggatgcagctttgcggcggcggcagcgaggcggcggcatcgagcgagggtacgccgattaagggggtatcaaacggcgttgccaaaccctgagctacaccgatgccgatacgcagtccggtaa

SEQ ID NO: 130 - protein, 270 aa, Neisseria meningitidis
  misc_feature (73)..(73): Xaa can be any naturally occurring amino acid
MLKPCAVYSACAAVLPARTSSSRRCVSSGRCVNQYSSRADAIPWRRHSGAVAIRCSSDSSGRFCQTIKAAIPXSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERPRQGCSFAAAAARRRHRARVRRLRGYQTALPNPELHRCRYAVR

SEQ ID NO: 131 - DNA, 816 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccacgcggacgggttgcagacggcatcgagcgcggcgagtgcggcgcaatcggcataaacggcgcggcggatgttcacaggcgcgccctccgttccgcctgttctttggcagtcaaggcgattttgttgcggacgtagagcagctcggcgtgtgccgcagcgacggcgggaaaaccgccttcagccgccagattgaggaagtcggcggcggtcggcatatcgggtttgcctgagaagggcggacggttttccagcgcgaacgcattgccgatgccgtctgaaaaggcgcatccttccggcagccggatgtctgccgcccgaccgacctgataatcgctcaaacggcggcggttcagcgtgtcgaaccatgcataaaacacttcgcccatacgtgcgtccgcagcggcaaggatgcagctttgcggcggcggcagcgaggcggcggcatcgagcgagggtacgccgattaaaggagtatcaaacggcgttgccaaaccttgcgccacgccgatgccgatacgcagtcccgtaa

SEQ ID NO: 132 - protein, 269 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASAAQSATARRMFTGAPSVPPVLWQSRRFCCGRRAARRVPQRRRENRLQPPDGSRRRSAYRVCLRRADGFPARTHCRCRLKRRILPAAGCLPPDRPDNRSNGGGSACRTMHKTLRPYVRPQRQGCSFAAAAARRRHRARVRRLKEYQTALPNLAPRRCRYAVP

SEQ ID NO: 133 - DNA, 687 bp, Neisseria meningitidis
atgctgaagccgtgcgccgtgtacagtgcctgtgcggcggtgttgcctgcacggacttcgagcagcaggcgttgcgtgtcttcgggcagatgtgtgaaccaatattcgagcagggcggacgcaattccttggcggcggcattcgggcgcggtggcaatcaggtgcagttcggattcgtcgggcaggttctgccaaacgataaaggcggcaatcccgccgtctttttccgcaaggaaaacctgttcggacggcgaaaccagtgcggactcaaattggcgttgcgtccatgcggacgggttgcagacggcatcgagtgcggccagctcctcacaatcggcacaaacggcacggcggatgttcacgggcgcgctctccgttcggcctgttctttggcagtcagggcgattttgttgcggacgtagagcaaaccggcgtgtgcggcatggacggcaggataaccgcccttggctgccaatgcgagaaagtcggcggcagtcggcatatccggtctgcctgagaacggcggagcttcttccagcgcgaacgcgctgcctatgccgtctgaaaaggcgcatccctccggcagccggatgtctgccgcccgcccgacctgataatcgctcaaacggtggcagttcagcgtatcgaaccatgcataaaacacttcgcccatacgagcgtccgtag

SEQ ID NO: 134 - protein, 228 aa, Neisseria meningitidis
MLKPCAVYSACAAVLPARTSSSRRCVSSGRCVNQYSSRADAIPWRRHSGAVAIRCSSDSSGRFCQTIKAAIPPSFSARKTCSDGETSADSNWRCVHADGLQTASSAASSSQSAQTARRMFTGALSVRPVLWQSGRFCCGRRANRRVRHGRQDNRPWLPMRESRRQSAYPVCLRTAELLPARTRCLCRLKRRIPPAAGCLPPARPDNRSNGGSSAYRTMHKTLRPYERP

SEQ ID NO: 135 - DNA, 642 bp, Neisseria gonorrhoeae
atgactgatttccgccaagatttcctcaaattctccctcgcccaaaatgttttgaaattcggcgaatttaccaccaaagccggacggcggtcgccctatttcttcaatgccggcctcttcaacgacggcgcgtccacgctgcaactggcaaaattctatgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccgcggcgaaggcggcgtgttggtcggcgcgccgcttaaagggcgcgtgctgattatcgacgacgtgatttccgccggcacatccgtacgcgaatcaatcaaactgattgaagcggagggtgcaacccccgccggtgtcgccatcgcgctcgaccgcatggaaaaaggcacgggtaaattgtccgccgttcaggaagtggaaaaacaatacggcctgcccgtcgcccccatcgccagcctgaacgatttgtttatcctgttgcaaaacaaccccgaattcggacagttcctcgaacccgtccgcacctaccgccggcagtacggcgtagaataa

SEQ ID NO: 136 - protein, 213 aa, Neisseria gonorrhoeae
MTDFRQDFLKFSLAQNVLKFGEFTTKAGRRSPYFFNAGLFNDGASTLQLAKFYAQSIIESGIRFDMLFGPAYKGIILAAATAMMLAEKGVNVPFAYNRKEAKDRGEGGVLVGAPLKGRVLIIDDVISAGTSVRESIKLIEAEGATPAGVAIALDRMEKGTGKLSAVQEVEKQYGLPVAPIASLNDLFILLQNNPEFGQFLEPVRTYRRQYGVE

SEQ ID NO: 137 - DNA, 642 bp, Neisseria meningitidis
atgaccgatttccgccaagatttcctcaaattctccctcgcccaaaatgttttgaaattcggcgaatttaccaccaaggcaggacggcggtcgccctatttcttcaatgccggcctctttaacgacggcttgtccacgctgcaactggcaaaattttacgcacaatccatcattgaaagcggcatccgattcgatatgctgttcggtcccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgatcgcatggaaaaaggcacgggtgaattgagcgcggttcaggaagtggaraaacaatacggkctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 138 - protein, 213 aa, Neisseria meningitidis
MTDFRQDFLKFSLAQNVLKFGEFTTKAGRRSPYFFNAGLFNDGLSTLQLAKFYAQSIIESGIRFDMLFGPAYKGIILAAATAMMLAEKGVNVPFAYNRKEAKDHGEGGVLVGAPLKGRVLIIDDVISAGTSVRESIKLIEAEGATPAGVAIALDRMEKGTGELSAVQEVEKQYGLPVAPIASLNDLFILLQNNPEFGQFLEPVRAYRRQYGVE

SEQ ID NO: 139 - DNA, 642 bp, Neisseria meningitidis
atgaccgatttccgccaagatttcctcaaattctccctcgcccaaaatgttttgaaattcggcgaattcaccaccaaagccggacggcggtcgccctatttcttcaatgccggcctctttaacgacggcttgtccacgctgcaactggcaaaattttacgcacaatccatcattgaaagcggcatccgattcgatatgctgttcggccccgcctacaaaggcattattttggcggcggcaaccgcgatgatgctggcggaaaaaggcgtgaacgtcccgtttgcctacaaccgcaaagaagccaaagaccacggcgaaggcggcgtgttggtcggcgcgccgcttaaagggcgcgtgctgattatcgacgacgtgatttccgccggcacatccgtacgcgaatcgatcaaactgattgaagcggagggtgcaacccccgccggtgtcgccatcgcgctcgaccgcatggaaaaaggcacgggtgaattgagcgcggttcaggaagtggaaaaacaatacggcctgcccgtcgcccccatcgccagcctgaacgatttgtttattctgttgcaaaacaaccccgaattcggacagttcctcgaacccgtccgagcctaccgtcggcagtacggcgtagaataa

SEQ ID NO: 140 - protein, 213 aa, Neisseria meningitidis; identical to SEQ ID NO: 138

SEQ ID NO: 141 - DNA, 492 bp, Neisseria gonorrhoeae
atgccgtccgaaccacctgccgcttcagacggcatcaaaccgacacacaccgagaaaacatcatgcccgcctgtttctgtccgcactgcaaaacccgcctctgggtcaaagaaacccagctcaacgtcgcccaaggcttcgtcgtctgccaaaaatgcgaagggctgtttaaagccaaagaccatctggcaagcacgaaagaacctatattcaacgattggcccgaagctgtttcgggatgtcaaactcgtccaccgcatcggcacgcacgccattagcaagaaacagatgtcccgcgacgaaatcgccgatatcctcaacggcggtacaaccctgcacgatacgccgcccgcaaccgccgctgccgcacctgccgccgcaccgcaggtttccgtaccgcccgcccgtcaggaagggctcaactggactattgcaaccctgttcgcacttatcgtcctcattatgcagctttcctacctcttcatcctatga

SEQ ID NO: 142 - protein, 163 aa, Neisseria gonorrhoeae
MPSEPPAASDGIKPTHTEKTSCPPVSVRTAKPASGSKKPSSTSPKASSSAKNAKGCLKPKTIWQARKNLYSTIGPKLFRDVKLVHRIGTHAISKKQMSRDEIADILNGGTTLHDTPPATAAAAPAAAPQVSVPPARQEGLNWTIATLFALIVLIMQLSYLFIL

SEQ ID NO: 143 - DNA, 513 bp, Neisseria meningitidis
  misc_feature (133)..(237): n is a, c, g, or t
atgccgtccgaaccgccttacgcctcagacggcatcaaacctgacacacacgaggaaataccatgcccgcctgtttctgcccccactgcaaaacccgtctctgggtcaaagaaacccaactcaatgtcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgaggctgtttcggatgtcaaactcgttcaccgtatcggcacgcgcgccatcggcaagaaacagatttcccgtgacgaaatcgccggcatcctcaacggcggtacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 144 - protein, 170 aa, Neisseria meningitidis
  misc_feature (45)..(79): Xaa can be any naturally occurring amino acid
MPSEPPYASDGIKPDTHEEIPCPPVSAPTAKPVSGSKKPNSMSPXXXXXXXXXXXXXXXXXXXXXXXXXXXXXXXXXXXPEAVSDVKLVHRIGTRAIGKKQISRDEIAGILNGGTTQPDIPPATAATPAAAPQVTVPPAAPARQDGFNWTIATLFALIVLIMQLSYLVIL

SEQ ID NO: 145 - DNA, 497 bp, Neisseria meningitidis
atgccgtctgaaccgccttacgcctcagacggcatcaaacctgacacacacgaggaaataccatgcccgcctgtttctgcccccactgcaaaacccgtctctgggtcaaagaaacccaactcaatgtcgcccaaggcttcgtcgtctgccaaaaatgcgaaggaatgtttaaagccaaagaccatctggcaagcacgaaagaacccatattcaacgatttgcccgaagctgtttcggatgtcaaactcgttcaccgcatcggcacgagcgccatcggcaagaaacagatttcccgtgacgaaatcgccggcatcctcaacggcggcacaacccagcccgatattccgcccgcaaccgccgccacccctgctgccgcaccgcaggttaccgtaccgcccgccgcgcccgcccgtcaggatgggttcaactggacgattgcaaccctgtttgcccttatcgtcctcattatgcagctttcctacctcgtcatcctatga

SEQ ID NO: 146 - protein, 165 aa, Neisseria meningitidis
  misc_feature (74)..(74): Xaa can be any naturally occurring amino acid
MPSEPPYASDGIKPDTHEEIPCPPVSAPTAKPVSGSKKPNSMSPKASSSAKNAKECLKPKTIWQARKNPYSTIXPEAVSDVKLVHRIGTSAIGKKQISRDEIAGILNGGTTQPDIPPATAATPAAAPQVTVPPAAPARQDGFNWTIATLFALIVLIMQLSYLVIL

SEQ ID NO: 147 - DNA, 1311 bp, Neisseria gonorrhoeae
atgaacgcgcccgacagctttgtcgcccacttccgcgaagccgccccctacatccgccaaatgcgcggcacgacactggtcgccggcatagacggccgcctgctcgaaggcggcaccttaaataagctcgccgccgacatcgggctgttgtcgcaactgggcatccgactcgtcctcatccacggcgcgtaccacttcctcgaccgcctcgccgccgcgcaaggccgcacgccgcattattgccggggtttgcgcgttaccgacgaaacctcgctcggacaggcgcagcagtttgccggcaccgtccgcagccgttttgaagccgcattgtgcggcagcgtttcaggattcgcgcgcgcgccttccgtcccgctcgtatcgggcaacttcctgaccgcccgtccgatgggcgtgattgacggaaccgatatggaatacgcgggggttatccgcaaaaccgacaccgccgccctccgtttccaactcgacgcgggcaatatcgtctggatgccgccgctcgggcattcctacggcggcaaaaccttcaatctcgatatggtgcaggccgccgcttccgtcgccgtctcgcttcaggccgaaaaactcgtttacctgaccctttcagacggcatttcccgccccgacggcacgctcgccgaaaccctctcggcacaggaagcgcaatcgctggcggaacacgccgccagcgaaacccgacgactgatttcgtccgccgttgccgcgctcgaaggcggcgtgcatcgcgtccaaatcctcaacggggccgccgacggcagcctgctgcaagaactcttcacccgcaacggcatcggcacgtccattgccaaagaagccttcgtctccatccggcaggcgcacagcggcgacatcccgcacatcgccgccctcatccgcccgctggaagaacagggcgtcctattgcaccgcagccgcgaatacctcgaaaaccacatttccgaattttccatcctcgaacacgacggcgacctgtacggctgtgccgcactcaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagctgcccgaaacgcggcgcaaagactaccgcagcaacggacgaaacccgcatattctggtgcgtcgcctgcaccgctga

SEQ ID NO: 148 - protein, 436 aa, Neisseria gonorrhoeae
MNAPDSFVAHFREAAPYIRQMRGTTLVAGIDGRLLEGGTLNKLAADIGLLSQLGIRLVLIHGAYHFLDRLAAAQGRTPHYCRGLRVTDETSLGQAQQFAGTVRSRFEAALCGSVSGFARAPSVPLVSGNFLTARPMGVIDGTDMEYAGVIRKTDTAALRFQLDAGNIVWMPPLGHSYGGKTFNLDMVQAAASVAVSLQAEKLVYLTLSDGISRPDGTLAETLSAQEAQSLAEHAASETRRLISSAVAALEGGVHRVQILNGAADGSLLQELFTRNGIGTSIAKEAFVSIRQAHSGDIPHIAALIRPLEEQGVLLHRSREYLENHISEFSILEHDGDLYGCAALKTFAEADCGEIACLAVSPQAQDGGYGERLLAHIIDKARGIGISRLFALSTNTGEWFAERGFQTASEDELPETRRKDYRSNGRNPHILVRRLHR

SEQ ID NO: 149 - DNA, 1236 bp, Neisseria meningitidis
  misc_feature (1039)..(1039): n is a, c, g, or t
atgagcgcgcccgacctctttgtcgcccacttccgcgaagccgtcccctacatccgccaaatgcgcggcaaaacgctggtcgccggcatagacgaccgcctgctcgaaggtgataccttaaacaagctcgccgccgacatcgggctgttgtcgcaactgggcatcaggctcgtcctcatccacggcgcgcgccacttcctcgaccgccacgccgccgctcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttctatctcgatatgcttcaaaccgccgcctccgccgccgtctcgcttcaggccgaaaaactcgtttacctgaccctttcagacggcatttcccgccccgacggcacgctcgccgaaaccctctcggcacaggaagcgcaatcgctggcggaacacgccggcgggcaaacgcgacggctgatttcgtccgccgaactcttcacccgcaacggcatcggcacgtccattgccaaagaagccttcgtctccatccggcargcgcaywgggcgacatcccgcacatcgccgccctcatccgcccgctggaagaacagggcatcctgctgcaccgcascgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcagcacaggacggcggctacggcgaacgcntgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtacgtcgcctgcaccgctga

SEQ ID NO: 150 - protein, 412 aa, Neisseria meningitidis
  misc_feature (270)..(271): Xaa can be any naturally occurring amino acid
  misc_feature (293)..(293): Xaa can be any naturally occurring amino acid
  misc_feature (339)..(339): Xaa can be any naturally occurring amino acid
  misc_feature (348)..(348): Xaa can be any naturally occurring amino acid
MSAPDLFVAHFREAVPYIRQMRGKTLVAGIDDRLLEGDTLNKLAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFYLDMLQTAASAAVSLQAEKLVYLTLSDGISRPDGTLAETLSAQEAQSLAEHAGGQTRRLISSAELFTRNGIGTSIAKEAFVSIRQAHXXDIPHIAALIRPLEEQGILLHRXREYLENHISEFSILEHDGNLYGCAALKTFAEADCGEIACLAVSPQXQDGGYGERXLAHIIDKARGIGISRLFALSTNTGEWFAERGFQTASEDELPETRRKDYRSNGRNSHILVRRLHR

SEQ ID NO: 151 - DNA, 1311 bp, Neisseria meningitidis
atgatcgtgcccgacctctttgtcgcccacttccgcgaagccgccccctacatccgccaaatgcgcggcaaaacgctggtcgccggcatagacgaccgcctgctcgaaggtgataccttaaacaagttcgccgccgacatcgggcttttgtcgcaactgggcatcaggctcgtcctcatccacggcgcgcgccacttcctcgaccgccacgccgccgcgcaaggccgcacgccgcattattgccggggcttgcgcgttaccgacgaaacctcgctcgaacaggcgcagcagtttgccggcaccgtccgcagccgttttgaagccgcattgtgcggcagcgtttccgggttcgcgcgcgcgccttccgtcccgctcgtatcgggcaacttcctgaccgcccgtccgataggtgtgattgacggaaccgatatggaatacgcgggcgttatccgcaaaaccgacaccgccgccctccgtttccaactcgacgcgggcaatatcgtctggctgccgccgctcggacattcctacagcggcaagaccttccatctcgatatgcttcaaaccgccgcctccgtcgccgtctcgcttcaggccgaaaaactcgtttacctgaccctttcagacggcatttcccgccccgacggcacgctcgccgtaaccctctcggcacaggaagcgcaatcgctggcggaacacgccggcggcgaaacgcgacggctgatttcgtccgccgttgccgcgctcgaaggcggcgtgcatcgcgtccaaatcctcaacggagccgccgacggcagcctgctgcaagaactcttcacccgcaacggcatcggcacgtccattgccaaagaagccttcgtctccatccggcaggcgcacagcggcgacatcccgcacattgccgccctcatccgcccgctggaagaacagggcatcctgctgcaccgcagccgcgaatacctcgaaaaccacatttccgaattttccatcctcgaacacgacggcaacctgtacggttgcgccgccctgaaaacctttgccgaagccgattgcggcgaaatcgcctgccttgccgtctcgccgcaggcacaggacggcggctacggcgaacgcctgcttgcccacattatcgataaggcgcgcggcataggcataagcaggctgttcgcactgtccacaaataccggcgaatggtttgccgaacgcggctttcagacggcatcggaagacgagttgcccgaaacgcggcgcaaagactaccgcagcaacggacggaactcgcatattctggtgcgtcgcctgcaccgctga

SEQ ID NO: 152 - protein, 436 aa, Neisseria meningitidis
MIVPDLFVAHFREAAPYIRQMRGKTLVAGIDDRLLEGDTLNKFAADIGLLSQLGIRLVLIHGARHFLDRHAAAQGRTPHYCRGLRVTDETSLEQAQQFAGTVRSRFEAALCGSVSGFARAPSVPLVSGNFLTARPIGVIDGTDMEYAGVIRKTDTAALRFQLDAGNIVWLPPLGHSYSGKTFHLDMLQTAASVAVSLQAEKLVYLTLSDGISRPDGTLAVTLSAQEAQSLAEHAGGETRRLISSAVAALEGGVHRVQILNGAADGSLLQELFTRNGIGTSIAKEAFVSIRQAHSGDIPHIAALIRPLEEQGILLHRSREYLENHISEFSILEHDGNLYGCAALKTFAEADCGEIACLAVSPQAQDGGYGERLLAHIIDKARGIGISRLFALSTNTGEWFAERGFQTASEDELPETRRKDYRSNGRNSHILVRRLHR

SEQ ID NO: 153 - DNA, 465 bp, Neisseria gonorrhoeae
atgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 154 - protein, 154 aa, Neisseria gonorrhoeae
MSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 155 - DNA, 465 bp, Neisseria meningitidis
atcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 156 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 157 - DNA, 465 bp, Neisseria meningitidis
atcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 158 - protein, 154 aa, Neisseria meningitidis
ISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 159 - DNA, 2016 bp, Neisseria gonorrhoeae
atgaaatcctaccccgacccctaccgccattttgaaaacctcgattccgccgaaacgcaaaacttcgctgctgaagcgaatgccgaaacgcgcgcgcgttttttaaacaacgacaaggcgcgcgcactttcagacggcattttgaatcaaatgcaggacacgcggcagattccgttttgtcaggaacaccgcgcgcggatgtaccatttccatcagaatgcggaatatccgaagggcgtgtaccgcatgtgtacggcggcgacctaccgttccggctatcccgagtggaaaatcctgttttcggtggcggatttcgatgagttgctcggcgacgatgtgtatttgggcggcgtgtcgcacttggtggagcagcccaaccgcgcgctgctgactttgaacaaatcgggcggcgatacggcgtatacgctggaagtggatttggaagcaggggaattggtagagggcggttttcactttccggcaggcaaaaaccatgtgtcgtggcgcgatgaaaacagcgtgtgggtgtgtccggcttgggacgaacgccagttgaccgaatcgggctatccgcgcgaagtgtggctggtggaacgcggcaagagtttcgaggaaagcctgccggcgtaccaaatcgataaaggcgcgatgatggtaaacgcgtggcgttacctcgatccgcagggttcgccgattgatttgattgaagcgtcggacggtttttacaccaagacgtatttgcaggtgtcgtccgaaggcggggcgaaaccgttgaacctgcctaatgattgcgatgtggtcggctatctggcgggacatcttttgctgacgctgcgcaaggactggcaccgcgcgaaccaaagctatccgagtggcgcgttggtggcggtgaaactgaatcggggcgaactcggggcggcgcagcttttgtttgcgcccgatgaaacgcaggcattggaaagcgtggaaacgaccaagcgttttgtggtggcaagcctgctggagaatgtacaaggccgtctgaaagcgtggcggtttgccgacagcaaatggcaggaagccgagttgccgcacctgccctcgggcgcgttggaaatgaccgaccaaccgtggggcggcgacgtggtttatcttgccgccagcgatttcaccacgccgctgacgctgtttgcgctggatttgaacgtgatggaactgaccgtcatgcgcctccagccgcagcagtttgtttcagacggcatcgaagtgcggcagttttgggcggtgtcgtccgacggcgaacgcattccttatttccacgtcggcaaaaacgccgcgcccgacacgccgaccttagtctatgcttacggaggtttcggcattcctgaattgccgcattatctgggcagcgtcggcaaatattggctggaagagggcaatgcctttgtattggcaaacatccgcggcggcggagaattcggcccgcgctggcatcaggcggcgcagggaatcagcaaacacaaaagcgttgatgatttgttggcagtcgtgcgtgatttgtccgaacgcggcatgagttcgcccaaacacatcggcttgcagggcggcagcaacggcggcctgattaccgccgccgccttcgtgcgcgaaccgcaaagcatcggtgcgctggtgtgcgaagtaccgctgaccgatatgatccgttatccgctgctgtccgccggttcaagttggacggacgaatacggcaatccgcagaaatacgaagcctgcaaacgccggctgggcgaattgtcgccgtatcacaatctttcagacggcatcgattatccgcccgcactcattaccaccagcctcagcgacgaccgcgtccatcccgcccacgcgctcaaattctacgccaaactgcgcgaaacctcgccgcaatcttggctctactcgcctgacggcggcggccataccggcaacggcacccaacgcgaatccgccgacaaactcgcctgcgtgttgctgtttttgaaagaatttttgggataa

SEQ ID NO: 160 - protein, 671 aa, Neisseria gonorrhoeae
MKSYPDPYRHFENLDSAETQNFAAEANAETRARFLNNDKARALSDGILNQMQDTRQIPFCQEHRARMYHFHQNAEYPKGVYRMCTAATYRSGYPEWKILFSVADFDELLGDDVYLGGVSHLVEQPNRALLTLNKSGGDTAYTLEVDLEAGELVEGGFHFPAGKNHVSWRDENSVWVCPAWDERQLTESGYPREVWLVERGKSFEESLPAYQIDKGAMMVNAWRYLDPQGSPIDLIEASDGFYTKTYLQVSSEGGAKPLNLPNDCDVVGYLAGHLLLTLRKDWHRANQSYPSGALVAVKLNRGELGAAQLLFAPDETQALESVETTKRFVVASLLENVQGRLKAWRFADSKWQEAELPHLPSGALEMTDQPWGGDVVYLAASDFTTPLTLFALDLNVMELTVMRLQPQQFVSDGIEVRQFWAVSSDGERIPYFHVGKNAAPDTPTLVYAYGGFGIPELPHYLGSVGKYWLEEGNAFVLANIRGGGEFGPRWHQAAQGISKHKSVDDLLAVVRDLSERGMSSPKHIGLQGGSNGGLITAAAFVREPQSIGALVCEVPLTDMIRYPLLSAGSSWTDEYGNPQKYEACKRRLGELSPYHNLSDGIDYPPALITTSLSDDRVHPAHALKFYAKLRETSPQSWLYSPDGGGHTGNGTQRESADKLACVLLFLKEFLG

SEQ ID NO: 161 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttagaaaacgacaaggcgcgcgcgctttcagacggcattttggcgcagttgcaggacacgcggcagattccgttttgtcaggaacaccgcgcgcggatgtaccatttccatcaggacgcggagtatccgaagggcgtgtaccgcgtgtgtaccgcggcgacgtatcgttccggctatcccgagtggaaaatcctgttttcggtggcggatttcgacgaattgcttggcgacgatgtgtatttgggcggcgtgtcgcacttggtggaacagcccaaccgcgcgttgttaacactgagcaaattgggcagcgatacggcgtacacgctggaagtggatttggaagcaggggagttggtcgaaggcggttttcactttccggcaggcaaaaaccatgtgtcgtggcgcgatgaaaacagcgtgtgggtgtgtccggcttggaacgaacgccagttgacccaatcgggctatccgcgcgaagtatggctggtggaacgcggcaagagtttcgaggaaagcctgcctgtgtatcaaatcggcgaagacggcatgatggtgaacgcgtggcgttatctcgatccgcagggttcgccgattgatttgattgaagcgtcggacggtttttacaccaaaacctatttgcgggtctcagccgaaggcgaggcgaaaccgttaaacctgcccaacgattgcgacgtggtcggctatctggcggggcatcttttgctgacgctgcgcaaggactggaaccgcgcgaaccaaagctatccgagcggcgcgctggtggcggtgaagctgaatcggggcgaactcggggcggcgcagcttttgtttgcgcccgatgaaacgcaggcattggaaagcgtggaaacgaccaagcgttttgtggtggcgagcctgttggagaacgtacaaggccgtctgaaagcatggcggtttgccgacggcaaatggcaggaagtcgaattgccgcgcctgccttcgggcgcgttggaaatgaccgaccaaccttggggcggcgacgtggtttaccttgccgccagcgatttcaccacgccgctgacgctgtttgcgctggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgcgcgatttgtccgaacgcggtatcagttcgcccgaacacatcggcttgcagggcggcagcaacggcggactgattactgccgccgccttcgtgcgcgaaccgcaaagcatcggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctccgcgcaatcttggctctactcgcctgacggcggcggccataccggcaacggcacccaacgcgaatccgccgacgaactcgcctgcgtcttgctgtttttgaaagagtttttgggctaa

SEQ ID NO: 162 - protein, 671 aa, Neisseria meningitidis
MKSYPDPYRHFENLDSAETQNFAAEANAETRARFLENDKARALSDGILAQLQDTRQIPFCQEHRARMYHFHQDAEYPKGVYRVCTAATYRSGYPEWKILFSVADFDELLGDDVYLGGVSHLVEQPNRALLTLSKLGSDTAYTLEVDLEAGELVEGGFHFPAGKNHVSWRDENSVWVCPAWNERQLTQSGYPREVWLVERGKSFEESLPVYQIGEDGMMVNAWRYLDPQGSPIDLIEASDGFYTKTYLRVSAEGEAKPLNLPNDCDVVGYLAGHLLLTLRKDWNRANQSYPSGALVAVKLNRGELGAAQLLFAPDETQALESVETTKRFVVASLLENVQGRLKAWRFADGKWQEVELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVRDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSAQSWLYSPDGGGHTGNGTQRESADELACVLLFLKEFLG

SEQ ID NO: 163 - DNA, 2016 bp, Neisseria meningitidis
atgaaatcctaccccgacccctaccgccattttgaaaacctcgattccgccgaaacgcaaaacttcgctgctgaagcgaatgccgaaacgcgcgcgcgttttttaaacaacgacaaggcacgcgcattgtctgacggcattttggcgcagttgcaggacacgcggcaaattccgttttgtcaggaacaccgcgcgcggatgtaccatttccatcaagatgcggaatatccgaaaggcgtgtaccgcgtgtgtaccgcggcgacttaccgttcgggctatcctgagtggaaaatcctgttttcggtggcggatttcgacgaattgctcggtgacgatgtatatctaggcggcgtgtcgcacctggtggaacagcccaaccgcgcgttgttaacactgagcaaatcgggcggcgataccgcgtacacgctggaagtggatttggaagcaggggagttggtagaaggcggttttcactttccggcaggcaaaaaccatgtgtcgtggcgcgatgaaaacagcgtgtgggtgtgtccggcttgggacgaacgccagttgaccgaatcgggctatccgcgcgaggtgtggctggtggaacgcggcaagagtttcgaggaaagcctgccggtgtaccaaattgctgaagacggcatgatggtgaacgcgtggcgttacctcgatccgcagggttcgccgattgatttgattgaagcgtctgacggtttttacaccaaaacctatttgcaggtctcagccgaaggcgaagcgaaaccgttaaacctgcccaacgattgcgacgtagtcggctatctggccggacatcttttgctgaccttgcgtaaagactggcaccgcgcgaaccaaagctatccgagtggcgcattggtagcagtaaaattaaaccgcggcgaattgggcgcggcgcagcttttgtttgcgcccaatgaaacgcaggcattggaaagcgtggaaacgaccaagcgttttgtcgtggcgagcctgctggaaaacgtacagggtcgtctgaaagcgtggcgttttactgatggcaaatggcaggaaaccgagttgccgcgcctgccttcgggcgcgttggaaatgaccgaccaaccgtgggggggcgacgtagtttaccttgccgccagcgatttcaccacgccgctgacgctgtttgcattggatttgaacgtgatggaactgaccgtcatgcgccgccagccgcagcagtttgattcagacggcattaacgtgcagcagttttggacgacttcggctgacggcgagcgcattccttatttccacgtcggcaaaaacgccgcgcccgacatgccgacgctggtctatgcctacggcggtttcggcattcccgaattgccgcattatctgggcagcattggcaaatattggctggaagagggcaatgcctttgtattggcgaacatccgcggcggcggcgagttcggcccgcgctggcatcaggcggcgcagggaatcagcaaacataaaagcgttgatgatttattggcagtcgtgagcgatttgtccgaacgcggtatcagttcgcccgaacacatcggcttgcagggcggcagcaacggcggactgattactgccgccgccttcgtgcgcgaaccgcaaagcataggcgcgctggtgtgcgaagtgccgctgaccgacatgatccgttatccgctgctctccgccggttcaagctggacagacgaatacggcaatccgcaaaaatacgaagtctgcaaacgccggttgggcgaattgtcgccgtatcacaatctttcagacggcatcgattatccgcccgcgctcattaccaccagcctgtccgacgatcgcgtccatcccgcccacgcgctcaagttctacgccaaactgcgcgaaacctcgccgcaatcttggctctactcgcctgacggcggcggccataccggcaacggcacgcagcgcgaagccgccgacgaactcgcctgcgtgttgctgtttttgaaagagtttttgggctaa

SEQ ID NO: 164 - protein, 671 aa, Neisseria meningitidis
MKSYPDPYRHFENLDSAETQNFAAEANAETRARFLNNDKARALSDGILAQLQDTRQIPFCQEHRARMYHFHQDAEYPKGVYRVCTAATYRSGYPEWKILFSVADFDELLGDDVYLGGVSHLVEQPNRALLTLSKSGGDTAYTLEVDLEAGELVEGGFHFPAGKNHVSWRDENSVWVCPAWDERQLTESGYPREVWLVERGKSFEESLPVYQIAEDGMMVNAWRYLDPQGSPIDLIEASDGFYTKTYLQVSAEGEAKPLNLPNDCDVVGYLAGHLLLTLRKDWHRANQSYPSGALVAVKLNRGELGAAQLLFAPNETQALESVETTKRFVVASLLENVQGRLKAWRFTDGKWQETELPRLPSGALEMTDQPWGGDVVYLAASDFTTPLTLFALDLNVMELTVMRRQPQQFDSDGINVQQFWTTSADGERIPYFHVGKNAAPDMPTLVYAYGGFGIPELPHYLGSIGKYWLEEGNAFVLANIRGGGEFGPRWHQAAQGISKHKSVDDLLAVVSDLSERGISSPEHIGLQGGSNGGLITAAAFVREPQSIGALVCEVPLTDMIRYPLLSAGSSWTDEYGNPQKYEVCKRRLGELSPYHNLSDGIDYPPALITTSLSDDRVHPAHALKFYAKLRETSPQSWLYSPDGGGHTGNGTQREAADELACVLLFLKEFLG

SEQ ID NO: 165 - DNA, 606 bp, Neisseria gonorrhoeae
atgacgatgatttgcttgcgcttccaagcgttcgtgccgcataccagcgcgttatccaacacttccacggcagccggcccttcctgcccgatggcggcggtgcggtcgatgatgaaaatccagccggggtttttctctttgatgtattcgaaggaaacgggctgcccgtgcccttcgttgcgtaaagattcgtccacgggcggcaggccgatgtcgccgtgtatccaacttgccaaccgcgattgcgtgccgaaggcggacaccttgttgcctgtaaccgacagcaccagcccgcgtcctttgcctttggcggcttcgcgcttttgggcgaacagcgcgtcaatctgcgcattcaattccgccacgcgcgcttccttaccgaaaatccgcgacagggtctccatctgcttctcgccgctggtgcggatattgccgttgtccaccgtcaaatctatggtggtcgcgtttttcgccaactgttcatacgcttccgcacccggcccgccggtaatgacaaactgcggattgtggcggtgcagggattcgcaatcgggctcaaacagcgtccccaccgttgccgccttgtcaaatgcaggctgcaaatag

SEQ ID NO: 166 - protein, 201 aa, Neisseria gonorrhoeae
MTMICLRFQAFVPHTSALSNTSTAAGPSCPMAAVRSMMKIQPGFFSLMYSKETGCPCPSLRKDSSTGGRPMSPCIQLANRDCVPKADTLLPVTDSTSPRPLPLAASRFWANSASICAFNSATRASLPKIRDRVSICFSPLVRILPLSTVKSMVVAFFANCSYASAPGPPVMTNCGLWRCRDSQSGSNSVPTVAALSNAGCK

SEQ ID NO: 167 - DNA, 606 bp, Neisseria meningitidis
atgacgatgatttgcttgcgcttccaagcgttcgtgccgcgtaccagcgcgttatccamtacttcgacagccgccggccyttcytgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 168 - protein, 201 aa, Neisseria meningitidis
  misc_feature (20)..(20): Xaa can be any naturally occurring amino acid
  misc_feature (27)..(27): Xaa can be any naturally occurring amino acid
  misc_feature (174)..(174): Xaa can be any naturally occurring amino acid
  misc_feature (177)..(177): Xaa can be any naturally occurring amino acid
  misc_feature (183)..(183): Xaa can be any naturally occurring amino acid
MTMICLRFQAFVPRTSALSXTSTAAGXSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSXGLXRCRASXSGSNSVPTVAALSNAGCK

SEQ ID NO: 169 - DNA, 606 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaatgacaagctgaggattgtagcggtgcagggcttcgtaatcgggctcgaacagcgtccccaccgttgccgccttgtcaaatgcaggctgcaaataa

SEQ ID NO: 170 - protein, 198 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTSGLRCRASSGSNSVPTVAALSNAGCK

SEQ ID NO: 171 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgctaactgttcatacgcttccgcgcccggcccgccggtaa

SEQ ID NO: 172 - protein, 173 aa, Neisseria meningitidis
MTMICLRFQAFVPRTSALSNTSTAAGPSCPMAAVRSMMKIQSGFFSLMYSKETGCPCPSLRKDSSTGGRPMSPCIQLANRDCVPKADTLLPVTDSTSPRPLPLAASRVWANSASICAFNSAARASLPKIRAKVSICFSPLVRILPLSTVRSMVVAFFANCSYASAPGPPVMTS

SEQ ID NO: 173 - DNA, 511 bp, Neisseria meningitidis
atgacgatgatttgcttgcgcttccaagcgttcgtgccgcgtaccagcgcgttatccaatacttcgacagccgccggcccttcctgcccgatggcggcggtacggtcgatgatgaaaatccaatcggggtttttctctttgatgtattcgaaggaaacaggctgcccgtgcccctcgttgcgtaaagattcgtctacaggcggtaggccgatgtcgccgtgtatccaacttgccaaccgcgactgcgtgccgaaggcggacaccttgttgcccgtaaccgacagcaccagcccgcgtcctttgcctttggcggcttcgcgcgtttgggcgaacagcgcgtcaatctgcgccttcaattccgccgcgcgcgcttccttgccgaaaatccgcgccaaggtctccatctgcttttcgccgctggtgcggatattgccgttgtccaccgtcagatctatggtggtcgcgtttttcgccaactgttcatacgcttccgcgcccggcccgccggtaa

SEQ ID NO: 174 - protein, 173 aa, Neisseria meningitidis; identical to SEQ ID NO: 172

SEQ ID NO: 175 - DNA, 387 bp, Neisseria gonorrhoeae
atggttgtttcaaatcaaaatatctatgccgtcggcccatcagcactttttcacatccgaaggcaaaaatccgtaatgccgcctgaacgcttcgttgaaccgtcccgcgtggcggtagccgcaaaagtgcatcgcggcttggatggtgctgcccgattcgatgagggcgagcgcgtgttccagccgcaggcggcgcaggcgtccggcgacggtttcgccggtttgcgctttgaaatagcgtttcaggtagcattcgttcagcccgacgcggcgggcgatttcggcgatggtcagcgggcgggcgaattcgctgttcaaaatatcggcggcttcgtctatgcgccggcggcggtagccgttgtcgtggcggcggaaggtgaagcgtaa

SEQ ID NO: 176 - protein, 128 aa, Neisseria gonorrhoeae
MVVSNQNIYAVGPSALFHIRRQKSVMPPERFVEPSRVAVAAKVHRGLDGAARFDEGERVFQPQAAQASGDGFAGLRFEIAFQVAFVQPDAAGDFGDGQRAGEFAVQNIGGFVYAPAAVAVVVAAEGEA

SEQ ID NO: 177 - DNA, 390 bp, Neisseria meningitidis
atggttgtttcaaatcaaaatatctatgccgccggcccctcagcacttcttcacatccgaaggcaaaaatccgtaatgccgtctgaacgcttcgttgaaccgtcccgcgtggcggtagccgcaaaagtgcatggcggcttggacggtgctgccggattcgatgagggcgagcgcgtgttccagccgcaggcggcgcaggcatccggcgacggtttcgccggtttgcgctttgaaatagcgtttcaggtagcattcgttcagtccgacgcggcgggcgatttcggcgatggtcagcggacgggcgaattcgtgttgcaggatgtcggcggcttcgtctatgcgccgacggcggtaaccgttgtcgtggcggcggaaggtgaagcgcaataa

SEQ ID NO: 178 - protein, 129 aa, Neisseria meningitidis
MVVSNQNIYAAGPSALLHIRRQKSVMPSERFVEPSRVAVAAKVHGGLDGAAGFDEGERVFQPQAAQASGDGFAGLRFEIAFQVAFVQSDAAGDFGDGQRTGEFVLQDVGGFVYAPTAVTVVVAAEGEAQ

SEQ ID NO: 179 - DNA, 390 bp, Neisseria meningitidis; identical to SEQ ID NO: 177

SEQ ID NO: 180 - protein, 129 aa, Neisseria meningitidis; identical to SEQ ID NO: 178

SEQ ID NO: 181 - DNA, 270 bp, Neisseria gonorrhoeae
atgctgcccgaccagagcgtcgagttcttgccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagcccttcgataacggcggtcagctccatgcggttgttggtggtttgcgcttcgccgccgaaaagttctttttcgcggctgccgtagcgcattaa

SEQ ID NO: 182 - protein, 89 aa, Neisseria gonorrhoeae
MLPDQSVEFLPQVVVFDGLFGGGFPAVALPTVYPVFHAVFDVLRVGADDDGAAAFERFQPFDNGGQLHAVVGGLRFAAEKFFFAAAVAH

SEQ ID NO: 183 - DNA, 270 bp, Neisseria meningitidis
atgccgtccgactagagcgtcgagttctttccagaagtcgtcgtttttgacgggctgtttggaggcggttttccagccgttgcgcttccaaccgtgtatccagttttccatgccatttttgacgtattgcgagtcggtgcagatgatgacggtgcagcggcgtttgagcgatttcagtccttcgatgacggcagtcagttccatgcggttgttggtggtttgcgcttcgccgccgaaaagttctttttcgtggctaccgtagcgcaytaa

SEQ ID NO: 184 - protein, 89 aa, Neisseria meningitidis
  misc_feature (5)..(5): Xaa can be any naturally occurring amino acid
MPSDXSVEFFPEVVVFDGLFGGGFPAVALPTVYPVFHAIFDVLRVGADDDGAAAFERFQSFDDGSQFHAVVGGLRFAAEKFFFVATVAH

SEQ ID NO: 185 - DNA, 270 bp, Neisseria meningitidis
gtgccgtccgaccagcgcgtcgagttctttccacaagtcgtcgtttttgacgggctgtttggcggcggttttccagccgttgcgcttccaaccgtgtatccagttttccatgccgtttttgacgtattgcgagtcggtgcagatgatgacggtgcagcggcgtttgagcgatttcagtccttcgatgacggcggtcagttccatacggttgttggtggtttgcgcttcgccgccgaaaagttctttttcgtggctgccgtagcgcattaa

SEQ ID NO: 186 - protein, 89 aa, Neisseria meningitidis
VPSDQRVEFFPQVVVFDGLFGGGFPAVALPTVYPVFHAVFDVLRVGADDDGAAAFERFQSFDDGGQFHTVVGGLRFAAEKFFFVAAVAH

SEQ ID NO: 187 - DNA, 561 bp, Neisseria gonorrhoeae
atgtcggcaatgctgcgtccgacaagcagcccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttataatgtgaagggggatgcgccgttgccgaaaacggtttggacatcgaggcggctgcctgtttcctgcaatgctttttcgtcgatgtcgataacggttacgtcgttgttggtgatggcggcaaggttttgcgcgacggtagaacctacctgcccgttgcctaaaatgaggattttcacggtatgggtcgccgggtga

SEQ ID NO: 188 - protein, 186 aa, Neisseria gonorrhoeae
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARYNVKGDAPLPKTVWTSRRLPVSCNAFSSMSITVTSLLVMAARFCATVEPTCPLPKMRIFTVWVAG

SEQ ID NO: 189 - DNA, 559 bp, Neisseria meningitidis
atgtcggcaatgctgcgtccgacaagcastccgcrsgcgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 190 - protein, 186 aa, Neisseria meningitidis
  misc_feature (10)..(10): Xaa can be any naturally occurring amino acid
  misc_feature (12)..(13): Xaa can be any naturally occurring amino acid
MSAMLRPTSXPXXRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 191 - DNA, 561 bp, Neisseria meningitidis
atgtcggcaatgctgcgtccgacaagcagtccgccgcgccgcgcctgtatgatgaccatccgcacgcggtcgtctgcaaaacgtaaaacctgcaatgcgcccgggcagtctatcaggccggcaagctgttcggtaacgagctgttcggggctgatggtttcggttatgccgaatatggaaaggctgccgttttcgttgttttcgagcttggggctgaggtattcgaggtattcgctggaacggacgcgcgcgatgcggccggggatgttgaacaggtcggcggcaactttgcaggcgacgatgttggtttcgtcgctgcgggagagcgcgagcagcaagtcggcatcttccgcgccggcgcgttctaatgtgaagggggatgcgccgttgccgaaaacggtttggacatcgaggcggctgcctgtttcctgcaatgctttttcgtcgatgtcgataacggttacgtcgttgttgggtatggcggcaaggttttgtgcgacggtagaacctacctgtccgttgcctaaaatgaggattttcacggtgtgggtcgccgagtga

SEQ ID NO: 192 - protein, 186 aa, Neisseria meningitidis
MSAMLRPTSSPPRRACMMTIRTRSSAKRKTCNAPGQSIRPASCSVTSCSGLMVSVMPNMERLPFSLFSSLGLRYSRYSLERTRAMRPGMLNRSAATLQATMLVSSLRESASSKSASSAPARSNVKGDAPLPKTVWTSRRLPVSCNAFSSMSITVTSLLGMAARFCATVEPTCPLPKMRIFTVWVAE

SEQ ID NO: 193 - DNA, 930 bp, Neisseria gonorrhoeae
atggtcatcatacaggcgcggcgcggcgggctgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctgtttgccgccgccgccgaaaacatcggggcggtcatacccgaattgcgccccaaagaaaccagcacccgccgcatcatgattgccggcggcggcaacatctgctaccgcctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcgcacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggtgaccacatcatctttttcgtctcgcgccggcgcatcctgaacgaactggagaaactcatccaagtcaaaatgggctttttcggataa

SEQ ID NO: 194 - protein, 309 aa, Neisseria gonorrhoeae
MVIIQARRGGLLVGRSIADIAQDLPDGADCQICAVYRNNRLIVPAPQTVIIEGDEILFAAAAENIGAVIPELRPKETSTRRIMIAGGGNICYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 195 - DNA, 937 bp, Neisseria meningitidis
atggtcatcatacaggcgcgcsygcggastgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaacccaaagaaaccagcccmgmmgcatcatgattkccggcggcggcaacatcggctaccgtctcgccaagcagctcgaacacgcatacaacgtyaaaatcatcgaatgccggccgcgccgtgccgaatggatagccgaaaacctcgacaacaccctcgtcytgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaggtcaaaatgggctttttcggataa

SEQ ID NO: 196 - protein, 312 aa, Neisseria meningitidis
  misc_feature (8)..(9): Xaa can be any naturally occurring amino acid
  misc_feature (11)..(11): Xaa can be any naturally occurring amino acid
  misc_feature (83)..(84): Xaa can be any naturally occurring amino acid
  misc_feature (88)..(88): Xaa can be any naturally occurring amino acid
MVIIQARXXGXLVGRSIADIAQDLPDGADCQICAVYRNNRLIVPAPQTVIIEGDEILFAAAAENIGAVIPELRPKETQRNQPXXIMIXGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 197 - DNA, 930 bp, Neisseria meningitidis
atggtcatcatacaggcgcggcgcggcggactgcttgtcggacgcagcattgccgacatcgcccaagatttgcccgacggggccgactgccaaatctgcgccgtttaccgcaacaaccgcctcatcgtccccgcgccgcaaaccgtcatcatcgaaggcgacgaaatcctatttgccgccgccgccgaaaacatcggcgcggtcatacccgaattgcgccccaaagaaaccagcacccgccgcatcatgattgccggcggcggcaacatcggctaccgtctcgccaagcagctcgaacacgcatacaacgtcaaaatcatcgaatgccggccgcgccgtgccgaatggatagccgaaaacctcgacaacaccctcgtcctgcaaggttcggcaaccgacgaaaccctgctcgacaacgaatacatcgacgaaatcgacgtattctgcgccctgaccaacgacgacgaaagcaacattatgtccgcccttttggcgaaaaacctcggcgcgaagcgcgtcatcggcatcgtcaaccgctcaagctacgtcgatttgctcgaaggcaacaaaatcgacatcgtcgtctccccccacctcatcaccatcggctcgatactcgcccacatccggcgcggcgacatcgttgccgtccaccccatccggcgcggcacggcggaagccatcgaagtcgtcgcacacggcgacaaaaaaacttccgccatcatcggcaggcgcatcagcggcatcaaatggcccgaaggctgccacattgccgccgtcgtccgcgccggaaccggcgaaaccattatgggacaccataccgaaaccgtcatccaagacggcgaccacatcatctttttcgtctcgcgccggcgcatcctgaacgaactggaaaaactcatccaagtcaaaatgggctttttcggataa

SEQ ID NO: 198 - protein, 309 aa, Neisseria meningitidis
MVIIQARRGGLLVGRSIADIAQDLPDGADCQICAVYRNNRLIVPAPQTVIIEGDEILFAAAAENIGAVIPELRPKETSTRRIMIAGGGNIGYRLAKQLEHAYNVKIIECRPRRAEWIAENLDNTLVLQGSATDETLLDNEYIDEIDVFCALTNDDESNIMSALLAKNLGAKRVIGIVNRSSYVDLLEGNKIDIVVSPHLITIGSILAHIRRGDIVAVHPIRRGTAEAIEVVAHGDKKTSAIIGRRISGIKWPEGCHIAAVVRAGTGETIMGHHTETVIQDGDHIIFFVSRRRILNELEKLIQVKMGFFG

SEQ ID NO: 199 - DNA, 453 bp, Neisseria gonorrhoeae
atgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 200 - protein, 150 aa, Neisseria gonorrhoeae
MLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 201 - DNA, 453 bp, Neisseria meningitidis
atgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 202 - protein, 150 aa, Neisseria meningitidis
MLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 203 - DNA, 453 bp, Neisseria meningitidis
atgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 204 - protein, 150 aa, Neisseria meningitidis
MLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 205 - DNA, 420 bp, Neisseria gonorrhoeae
atgcgggcgcaggcgtttgatcaaccgttcggtcagctcctgttcggacaggcagaacacttcgcgccggttgacggctttcgggttcaggatattgatttggacgggcatcaacgcctcttccgcaccgccttcgccgttttccgcaaccccgtctgccgccgtaccggattctgccgcatcggcgttttccccgccctcaatctgtgcggtttcaaattcggcactgtcttttttggcatcgaaccggattctccgccgcgattcgatgtgtttttccgaaaccggcatttgcagggaagcctgcgcgttgagccagttttcctgaaggacgatcatcgggtcggtttcgacttcctcgccgcaatcggcaacggcgctgttgtgttcttcctgccatttcttcagatacgcctttaa

SEQ ID NO: 206 - protein, 139 aa, Neisseria gonorrhoeae
MRAQAFDQPFGQLLFGQAEHFAPVDGFRVQDIDLDGHQRLFRTAFAVFRNPVCRRTGFCRIGVFPALNLCGFKFGTVFFGIEPDSPPRFDVFFRNRHLQGSLRVEPVFLKDDHRVGFDFLAAIGNGAVVFFLPFLQIRL

SEQ ID NO: 207 - DNA, 417 bp, Neisseria gonorrhoeae
atgcgggcgcaggcgtttgatcagccgttcggtcagctcctgttcggacaggcagaacacttcgcgccggttgacggctttcgggttcaggatattgatttggacgggcatcaacgtttcttccgcatcgttttccccgttttccgaaaccgccggctcattcgtgccggattctgcctcgtcggcgttttccccgctttcaatctgtccggtttcaaattcgacactgtcttttttggtatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 208 - protein, 139 aa, Neisseria meningitidis
MRAQAFDQPFGQLLFGQAEHFAPVDGFRVQDIDLDGHQRFFRIVFPVFRNRRLIRAGFCLVGVFPAFNLSGFKFDTVFFGIKPDSPPRFDVFFRNRHLQGSLRVEPVFLKDDHRVGFDFLAAIGNGGIVFLLPFFQIRL

SEQ ID NO: 209 - DNA, 417 bp, Neisseria meningitidis
atgcgggcgcaggcgtttgatcagccgttcggtcagctcctgttcggacaggcagaacacttcgcgccggttgacggctttcgggttcagaatattgatttggacgggcatcaacgcttcttccgcaccgccttcgccgttttccgcaaccccgtctgccgccgtacccgattctgccgcatcggcgttttccccgccttcaatctgtccggtttcaaattcggcactgtcttttttggcatcaaaccggattctccgccgcgattcgatgtgtttttccgaaaccgacatttgcagggaagcctgcgcgttgagccagttttcctgaaggacgatcatcgggtcggtttcgacttcctcgccgcaatcggcaacggcggcattgtgttcctcctgccattttttcagatacgcctt

SEQ ID NO: 210 - protein, 139 aa, Neisseria meningitidis
MRAQAFDQPFGQLLFGQAEHFAPVDGFRVQNIDLDGHQRFFRTAFAVFRNPVCRRTRFCRIGVFPAFNLSGFKFGTVFFGIKPDSPPRFDVFFRNRHLQGSLRVEPVFLKDDHRVGFDFLAAIGNGGIVFLLPFFQIRL

SEQ ID NO: 211 - DNA, 384 bp, Neisseria gonorrhoeae
atgggcgcgggctggtgtcctcccggcatcttgggcatcggcatcggcggcacgcccgaaaaagccgtgttgatggcaaaagaatccctgatgagccacatcgacatccaagaattgcaggaaaaagccgcgtccggggcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgtgtcgaagactga

SEQ ID NO: 212 - protein, 127 aa, Neisseria gonorrhoeae
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVED

SEQ ID NO: 213 - DNA, 298 bp, Neisseria meningitidis
atgggcgcgggctggtgtcctcccggcatcttgggtatcggcatcggcggcagccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccg

SEQ ID NO: 214 - protein, 130 aa, Neisseria meningitidis
  misc_feature (18)..(18): Xaa can be any naturally occurring amino acid
MGAGWCPPGILGIGIGGXAEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDGPI

SEQ ID NO: 215 - DNA, 387 bp, Neisseria meningitidis
atgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggccc

SEQ ID NO: 216 - protein, 129 aa, Neisseria meningitidis
MGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWP

SEQ ID NO: 217 - DNA, 1524 bp, Neisseria gonorrhoeae
atgaccgttatcaagcaagaagactttattcaaagtatctgcgatgccttccaattcatcagctactaccatccaaaagactacatcgacgcgctttataaggcgtggcagaaggaagaaaatcccgccgccaaagacgcgatgacgcagattttggtcaacagccgtatgtgtgccgaaaacaaccgccccatctgccaagacacaggtatcgcaaccgtcttcctcaaagtcggtatggatgtgcaatgggatgcggacatgagcgtggaaaagatggttaacgaaggcgtacgccgcgcctacacttgggaaggcaacaccctgcgcgcttccgtcctcgccgatccggccggcaaacgccaaaacaccaaagacaacacccccgccgtcatccacatgagcatcgtgccgggcggtaaagtcgaagtaacctgcgcggcaaaaggcggcggctctgaaaacaaatccaaactcgctatgctcaacccttccgacaacatcgtcgattgggtattgaaaaccatcccgacgatgggcgcgggctggtgtcctcccggcatcttgggcatcggcatcggcggcacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaggtcaacgcgctgggcatcggcgcgcaaggcttgggcggtctgaccaccgtgttggacgtgaaaatcctcgattacccgacccatgccgcctccaaaccgattgccatgattcccaactgtgccgccacccgccacgtcgaatttgaattggacggctcaggtcctgtcgaactcacgccgccgcgcgtcgaagactgacccgatctgacttacagccccgacaacggcaaacgcgtcgatgtcgataagctgaccaaagaagaagtggcaagctggaaaaccggcgacgtattgctgttgaacggcaaaatcctcaccggccgcgatgccgcgcacaaacgcctcgtcaatatgctcgacaaaggcgaggagttgcccgtcgatttcaccaaccgcctgatttactacgtcggccccgtcgatccggtcggcgatgaagtcgtcggtcccgcaggtccgaccacagccacccgcatggacaaatttacccgccaaatgctcaaacaaaccggcctcttgggcatgatcggcaaatccgagcgcggcgcggccacctgcgaagccatcgccgacaacaaggccgtgtacctcatggcagtcggcggcgcggcatacctcgtggcaaaagccatcaaatcttccaaagtcttggcgttccccgaattgggtatggaagccgtttacgaatttgaagtcaaagatatgcccgtaaccgtcgccgtggacagcaaaggcgaatccatccacgccaccgccccgcgcaaatggcaggcgaaaatcggcatcatccccgtcgagtcttga

SEQ ID NO: 218 - protein, 506 aa, Neisseria gonorrhoeae
MTVIKQEDFIQSICDAFQFISYYHPKDYIDALYKAWQKEENPAAKDAMTQILVNSRMCAENNRPICQDTGIATVFLKVGMDVQWDADMSVEKMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDPDLTYSPDNGKRVDVDKLTKEEVASWKTGDVLLLNGKILTGRDAAHKRLVNMLDKGEELPVDFTNRLIYYVGPVDPVGDEVVGPAGPTTATRMDKFTRQMLKQTGLLGMIGKSERGAATCEAIADNKAVYLMAVGGAAYLVAKAIKSSKVLAFPELGMEAVYEFEVKDMPVTVAVDSKGESIHATAPRKWQAKIGIIPVES

SEQ ID NO: 219 - DNA, 1524 bp, Neisseria meningitidis
atgaccgtcatcaaacaggaagactttatccaaagcatttgcgatgccttccaattcatcagctactatcatcccaaagactacatcgacgcgctttataaggcgtggcagaaggaagaaaatcctgccgccaaagacgcgatgacgcagattttggtcaacagccgtatgtgtgcggaaaacaaccgccccatctgccaagacacaggtatcgcaaccgtcttcctcaaagtcggtatgaacgtccaatgggatgcggacatgagcgtggaagagatggttaacgaaggcgtacgccgcgcctacacttgggaaggcaatacgctgcgcgcttccgtcctcgccgatccggccggcaaacgccaaaacaccaaagacaacacccccgccgtcatccatatgagcatcgtgccgggcggtaaagtcgaagtaacctgcgcggcaaaaggcggcggctctgaaaacaaatccaaactcgccatgctcaatccttccgacaacatcgtcgattgggtattgaaaaccatcccgaccatgggcgcgggctggtgtcctcccggcatcttgggtatcggcatcggcggcacgcccgaaaaagccgtgctgatggcaaaagagtccctgatgagccacatcgacattcaagaattgcaggaaaaggccgcgtccggcgcggaattgtccaccaccgaagccctgcgcctcgaactctttgaaaaagtcaacgcgctgggcatcggcgcacaaggcttgggcggactgaccaccgtgttggacgtgaaaatcctcgattatccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcaacaaaggcgaagaattgcccgtcgatttcaccaaccgcctgatttactacgtcggccccgtcgatccggtcggcgatgaagtcgtcggtccggcaggtccgaccacagccacccgcatggacaaattcacccgccaaatgctcgaacaaaccgacctcttgggcatgatcggcaaatccgagcgcggcgtggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagatagcaaaggcgaatccatccacgccaccgccccgcgcaaatggcaggcgaaaatcggcatcatccccgtcgaatcttga

SEQ ID NO: 220 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMNVQWDADMSVEEMVNEGVRRAYTWEGNTLRASVLADPAGKRQNTKDNTPAVIHMSIVPGGKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLNKGEELPVDFTNRLIYYVGPVDPVGDEVVGPAGPTTATRMDKFTRQMLEQTDLLGMIGKSERGVATCEAIADNKAVYLMAVGGAAYLVAKAIKSSKVLAFPELGMEAIYEFEVKDMPVTVAVDSKGESIHATAPRKWQAKIGIIPVES

SEQ ID NO: 221 - DNA, 1524 bp, Neisseria meningitidis
atgaccgtcatcaaacaggaagactttatccaaagcatttgcgatgccttccaattcatcagctactaccatcccaaagactacatcgacgcgctttataaggcgtggcagaaggaagaaaaccccgccgccaaagacgcgatgacgcagattttggtcaacagccgcatgtgtgccgaaaacaaccgccccatctgccaagataccggtatcgcgaccgtgtttttgaaagtcggtatggatgtgcaatgggatgcagacatgagcgtcgaagagatggttaacgaaggcgtgcgccgcgcctacacttgggaaggcaatacgctgcgcgcttccgttctcgccgaccccgccggcaaacgccaaaataccaaagacaacacgcccgccgtcatccatatgagcatcgtgccgggcgacaaagtcgaagtaacctgcgcggcaaaaggcggcggttctgaaaacaaatccaaactcgccatgctcaacccttccgacaacatcgtcgattgggtattgaaaaccattccgaccatgggcgcgggctggtgtcctcccggcatcttgggcatcggcatcggcggtacgcccgaaaaagccgtgttgatggcgaaagaatccctgatgagccacatcgacatccaagaattgcaggaaaaagccgcgtccggcgcggaattgtccaccaccgaagccctgcgcctcgaactctttgaaaaagtcaacgcgctaggcatcggcgcgcaaggcttgggcggtctgaccaccgtgttggacgtgaaaatcctcgattacccgacccacgccgcctccaaaccgattgccatgattccgaactgcgccgccacccgccacgtcgaatttgaattggacggctcaggccctgtcgaactcacgccgccgcgcgtcgaagactggcccgatttgacttacagccccgacaacggcaaacgcgtcgatgtcgacaagctgaccaaagaagaagtggcaagctggaaaaccggcgacgtattgctgttgaacggcaaaatcctcaccggccgcgatgccgcacacaaacgcctcgtcgatatgctcgacaaaggcgaagaattgcccgtcgatttcaccaaccgcctgatttactacgtcggccccgtcgatccggtcggcgacgaaatcgtcggcccagcaggtccgaccaccgccacccgcatggacaaattcacccgccaaatgctcgaacaaaccgacctcttgggcatgatcggcaaatccgagcgcggcgcggccacctgcgaagccatcgccgacaacaaagccgtgtacctcatggcagtcggcggcgcggcgtatctcgtggcaaaagccatcaaatcttccaaagtcttggcgttccccgaattgggcatggaagccatttacgaatttgaagtcaaagacatgcccgtaaccgtcgccgtagacagcaaaggcgaatccatccacgccaccgccccgccccaatggcaggcgaaaatcggcatcatccccgtcaaatcttga

SEQ ID NO: 222 - protein, 507 aa, Neisseria meningitidis
MTVIKQEDFIQSICDAFQFISYYHPKDYIDALYKAWQKEENPAAKDAMTQILVNSRMCAENNRPICQDTGIATVFLKVGMDVQWDADMSVEEMVNEGVRRAYTWEGNTLRASVLADPAGKRQNTKDNTPAVIHMSIVPGDKVEVTCAAKGGGSENKSKLAMLNPSDNIVDWVLKTIPTMGAGWCPPGILGIGIGGTPEKAVLMAKESLMSHIDIQELQEKAASGAELSTTEALRLELFEKVNALGIGAQGLGGLTTVLDVKILDYPTHAASKPIAMIPNCAATRHVEFELDGSGPVELTPPRVEDWPDLTYSPDNGKRVDVDKLTKEEVASWKTGDVLLLNGKILTGRDAAHKRLVDMLDKGEELPVDFTNRLIYYVGPVDPVGDEIVGPAGPTTATRMDKFTRQMLEQTDLLGMIGKSERGAATCEAIADNKAVYLMAVGGAAYLVAKAIKSSKVLAFPELGMEAIYEFEVKDMPVTVAVDSKGESIHATAPPQWQAKIGIIPVKS

SEQ ID NO: 223 - DNA, 360 bp, Neisseria gonorrhoeae
atggctttggtggcggaggaaacggaaatatccgcgccgtgtttcaaaggctgcgagccgacgggcgacagcaggctgttgtccaccaccaagagcgcgccgatgccgtgcgccaattccgccaaggcttccaagtcggccacttcgcccaaggggttggacggcgtttccaaaaacagcagtttggtgttggctttgacggcggctttccattcatttatatcagtcggcgacacgcggctcactccgatgccgaatttggtaacgatgttattgataaagccgacggtcgtgccgaacaggctgcggctggaaaccacatggtcgcccgcctgcaggaaggtgaaaaacgccgcctga

SEQ ID NO: 224 - protein, 119 aa, Neisseria gonorrhoeae
MALVAEETEISAPCFKGCEPTGDSRLLSTTKSAPMPCANSAKASKSATSPKGLDGVSKNSSLVLALTAAFHSFISVGDTRLTPMPNLVTMLLIKPTVVPNRLRLETTWSPACRKVKNAA

SEQ ID NO: 225 - DNA, 360 bp, Neisseria meningitidis; identical to SEQ ID NO: 223

SEQ ID NO: 226 - protein, 119 aa, Neisseria meningitidis; identical to SEQ ID NO: 224

SEQ ID NO: 227 - DNA, 360 bp, Neisseria meningitidis
atggctttggtcgcggaggaaacggaaatatccgcgccgtgtttcaaaggctgagagccgacaggcgacagcaggctgttgtccaccaccaagagcgcgccgatgccgtgcgccaattccgccaaggcttccaagtcggccacttctcccaagggattggacggcgtttccaaaaacagcagtttggtgttggctttgacggcggctttccattcgtttatatcagtcggcgacacgtgactcacttcgatgccgaatttggtaacgatgttattgataaagccgacggtcgtgccgaacaggctgcggctggaaatcacatggtcgcccgcctgcaaaaaggtgaaaaacgccgcctga

SEQ ID NO: 228 - protein, 117 aa, Neisseria meningitidis
MALVAEETEISAPCFKGEPTGDSRLLSTTKSAPMPCANSAKASKSATSPKGLDGVSKNSSLVLALTAAFHSFISVGDTLTSMPNLVTMLLIKPTVVPNRLRLEITWSPACKKVKNAA

SEQ ID NO: 229 - DNA, 387 bp, Neisseria gonorrhoeae
atgtgtatgccatacgcaataagggtttcagacggcatctgccgcatttttccgccgatgccgtctgaaacacgcaatcagcgcgcgagtgcctgtttcaaatcgtcaatcaaatcgccaacatattccaaaccgaccgacaggcgcaccagtccggggcggataccggcggcgagtttttcttcgggctgcatcctgccgtgcgtggttgtccacggattggtgatggtcgagcgcacgtcgccgaggttggcggtacgggaaaagagttccacgactttccacgcggctgcttggtcggcgacttcaaaaccgatgacgatgccgccgccgttttgctgtttgcggataagctccgcctgcggatggtcgggcaatccggtgtag

SEQ ID NO: 230 - protein, 128 aa, Neisseria gonorrhoeae
MCMPYAIRVSDGICRIFPPMPSETRNQRASACFKSSIKSPTYSKPTDRRTSPGRIPAASFSSGCILPCVVVHGLVMVERTSPRLAVREKSSTTFHAAAWSATSKPMTMPPPFCCLRISSACGWSGNPV

SEQ ID NO: 231 - DNA, 387 bp, Neisseria meningitidis
atgtgtatgccatataagataagggtttcagacggcatctgctgtccaatgccgtctgaaacacgcaatcagcgtgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacgggtgggtaatggtcgagcgcacgtcaccgaggttggcggtgcgggaaaagagttccacgccgtccacaactttccacgccgcttcttgatcggcaacttcaaagccgatgacgatgccgccgccgttttgctgtttgcggataagcgccgcctgaggatggtcggacaatccggtgtag

SEQ ID NO: 232 - protein, 128 aa, Neisseria meningitidis
  misc_feature (99)..(99): Xaa can be any naturally occurring amino acid
  misc_feature (121)..(121): Xaa can be any naturally occurring amino acid
MCMPYKIRVSDGICCPMPSETRNQRASACFKSSIKSPTYSKPTDRRTNPGRMLAASFSSGCILPCVVVHGWVMVERTSPRLAVREKSSTPSTTFHAASXSATSKPMTMPPPFCCLRISAAXGWSDNPV

SEQ ID NO: 233 - DNA, 395 bp, Neisseria meningitidis
acgtgtatgtcatataagataagggtttcagacggcatttgcggtgtttttccgccgatgccgtctgaacacgcaatcagcgcgcgagtgcctgtttcaaatcgtcaatcaaatcgccaacatattccaaaccgaccgacaggcgcaccaatccggggcggatgttggcggcgagtttttcttcgggctgcatcctgccgtgcgtggttgtccacggatgggtaatggtcgagcgcacgtcgccgaggttggcggtacgggagaaaagttcgacgccgtccacgactttccacgcggctgcttggtcggcgacttcaaagccgatgacgatgccgccgccgttttgctgtttgcggataagctccgcctgaggatggtcgggtaatccggtgtaa

SEQ ID NO: 234 - protein, 130 aa, Neisseria meningitidis
  misc_feature (24)..(24): Xaa can be any naturally occurring amino acid
TCMSYKIRVSDGICGVFPPMPSEXRNQRASACFKSSIKSPTYSKPTDRRTNPGRMLAASFSSGCILPCVVVHGWVMVERTSPRLAVREKSSTPSTTFHAAAWSATSKPMTMPPPFCCLRISSAGWSGNPV

SEQ ID NO: 235 - DNA, 414 bp, Neisseria gonorrhoeae
atgccgccttacttcatcaccctcttaacgatggaaaatacaaaaagcgcggcgaaaacgcccactacaatccaaccggcttccataccgtccgcttttgcggcttccaaagcgttttttgccgtttcgggcaacgctgcgtttgcctgtgccgccaaagccagcggggcggctgttacaacagccagttttgcgccgtatttacggcaggtgttaataaatttcatgatattttcctttacgaaatttttaaaaaaatgtgtttgcgggctttgtgaaggttttagagaccgcctgccgggcctcttaaacttaatcttctttttcgtagaatccgaaaattacaaattccccgcctatctcttccaatgccgagctaaaagcgtcttcatagctgtcatatttaccggctga

SEQ ID NO: 236 - protein, 137 aa, Neisseria gonorrhoeae
MPPYFITLLTMENTKSAAKTPTTIQPASIPSAFAASKAFFAVSGNAAFACAAKASGAAVTTASFAPYLRQVLINFMIFSFTKFLKKCVCGLCEGFRDRLPGLLNLIFFFVESENYKFPAYLFQCRAKSVFIAVIFTG

SEQ ID NO: 237 - DNA, 411 bp, Neisseria meningitidis
atgccgtcttacttcatcactctcttaacgatggaaaatacaaaaagcgcggcgaaaatgcccactacaatccaaccggcttccataccgtccgcttttgcggcttccaaagcgttttttgccgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 238 - protein, 136 aa, Neisseria meningitidis
MPSYFITLLTMENTKSAAKMPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 239 - DNA, 411 bp, Neisseria meningitidis
atgccgtcttacttcatcactctcttaacgatggaaaagacaaaaagcgcggcgaaaacgcccactacaatccaaccggcttccataccgtccgcttttgcggcttccaaagcgttttttgctgtatcgggcaacgttgcatttgcatgtgcggccaaagccaggggagcagctgttacaacagccagttttgcgccgtatttacggcaggtgttaataaatttcatgatattttccttcaaaaagtgtttggcggtaatggatggagcgtttttcagacgaccgccgaacatccgaaaatcagtctttcaaaaatccgaatacgacaaattcgtattggttgccgatttcttccaaacctgcgttaatcgcttcttcgaagtcgtagaaataatcggcattggtgattaa

SEQ ID NO: 240 - protein, 136 aa, Neisseria meningitidis
MPSYFITLLTMEKTKSAAKTPTTIQPASIPSAFAASKAFFAVSGNVAFACAAKARGAAVTTASFAPYLRQVLINFMIFSFKKCLAVMDGAFFRRPPNIRKSVFQKSEYDKFVLVADFFQTCVNRFFEVVEIIGIGD

SEQ ID NO: 241 - DNA, 828 bp, Neisseria gonorrhoeae
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaaggcattgggcagtttggcgaaagaatacatccatgggaatattttgaggacggacatcaatggcgcacaggaagcctaccgccggtatccgtggattgcgtcggtcatggtgcgccgccgttttcccgatacggttgaggtcgtcctgaccgagcgcaagccggttgcacgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggaatgtcgttttggacaacggcatcaccgtcaggctcggacgggaaaacgagatgaaacgcctccggctttttaccgaagcgtggcagcatctgttgcgtaagaataaaaatcggttatcctatgtggatatgaggtataaggacggattttcagtcccccatgctcccgacggtttacccgaaaaagaatccgaagaatattgggaacaggtttgggacatattacggcctggcgtcggaaacggttcgacgcaaatttcaatcagttataagggcagacgaacaatggaacagcagtaa

SEQ ID NO: 242 - protein, 275 aa, Neisseria gonorrhoeae
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWNVVLDNGITVRLGRENEMKRLRLFTEAWQHLLRKNKNRLSYVDMRYKDGFSVPHAPDGLPEKESEEYWEQVWDILRPGVGNGSTQISISYKGRRTMEQQ

SEQ ID NO: 243 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctggtttattccgataagaagacattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgcttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcagcatctgttgcgtaaaaataaaaatcggttatcctatgtggatatgaggtataaggacggattttcagtccgctatgcttccgacggtttacccgaaaaagaatccgaagaatag

SEQ ID NO: 244 - protein, 242 aa, Neisseria meningitidis
MWDNAEAMERLTRWLLVMMAMLLAASGLVWFYNSNHLPVKQVSLKGNLVYSDKKTLGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYASDGLPEKESEE

SEQ ID NO: 245 - DNA, 729 bp, Neisseria meningitidis
atgtgggataatgccgaagcgatggaacggctgacgcgctggctgcttgtcatgatggcgatgctgcttgctgcgtccgggctggtttggttttacaattcgaatcatctgcccgtcaagcaggtgtcgctgaagggcaacctagtttattccgataagaaagcattgggcagtttggcgaaagaatacatccatgggaatattttgaggacggacatcaatggcgcacaggaggcctaccgccggtatccgtggattgcgtcggtcatggtgcgccgccgttttcccgacacggttgaggtcgtcctgaccgagcgcaagccggtcgcgcgttggggcgaccatgccttggtggacggcgaaggcaatgtttttgaagcccgtttggacagacccggaatgccggtattcagaggcgcggaaggaacgtctgccgaaatgctccgccgttatgacgaattttcgactgttttggcaaaacagggtttgggcatcaaagagatgacctatacggcacgttcggcgtggattgtcgttttggacaacggcatcaccgtcaggctcggacgggaaaacgagatgaaacgcctccggctttttaccgaagcgtggcaacatctgttgcgtaaaaataaaaatcggttatcctatgtggatatgaggtataaggacggattttcagtccgctatgctcccgacggtttacccgaaaaagaatccgaagaatag

SEQ ID NO: 246 - protein, 242 aa, Neisseria meningitidis
MWDNAEAMERLTRWLLVMMAMLLAASGLVWFYNSNHLPVKQVSLKGNLVYSDKKALGSLAKEYIHGNILRTDINGAQEAYRRYPWIASVMVRRRFPDTVEVVLTERKPVARWGDHALVDGEGNVFEARLDRPGMPVFRGAEGTSAEMLRRYDEFSTVLAKQGLGIKEMTYTARSAWIVVLDNGITVRLGRENEMKRLRLFTEAWQHLLRKNKNRLSYVDMRYKDGFSVRYAPDGLPEKESEE

SEQ ID NO: 247 - DNA, 1359 bp, Neisseria gonorrhoeae
atgaaaccactggacctaaatttcatctgccaagccctcaagcttccgatgccgtctgaaaacaaacccgtgtcgcgcatcgtaaccgacagccgcgatattcgggaaggcgatgtgtttttcgcattggcgggcgggcggtttgacgcgcatgattttgttggaggcgtattgtctgcgggcgcggcggcggttgtggtttcgcgcgaagattgcgcggctttgggcggcgcgttgaaagtcgatgacacgcttgccgcgttgcaaacgttggcgaaggcgtggcgcgataatgtgaacccgtttgtgttcggcattaccggttcgggcggcaagacgacggtgaaggagatgctggctgcggtattgcgccgccgtttcggcgatgatgccgtttcggcgacggcaggcaacttcaacaaccacatcggattgccgctgactttattgaaattaaacgaaaaacaccgctatgccgtgattgaaatgggcatgaaccattttggcgaactggcggttttaacgcaaatcgccaaacccgatgccgctttggtcaacaacgccctgcgcgcccatgtcggatgcggtttcgacggagtgggcgatattgccaaagcgaaaagcgagatttatgcaggcttatgttcagacggcatggcactgattcctcaagaagatgccaatatggctgtcttcaaaacggcaacgtttaatttgaatacgtgcactttcggcgtcgatagcggcgatgtccgcgcggaaaatatcgtgctgaaacctttgtcgtgcgaatttgatttggtgtgcggcgacgagcgcactgccgtggtgctgcctgttcccggccgccacaatgtccacaacgccgccgctgccgccgcgctggctttggctgccggtttgagtttgaacgatgtggcggaaggtttgcaaggcttcagcaacatcaaaggccgtctgaacgtcaaagccggcatcaagggcgcaaccctgattgacgatacttataatgcgaatcccgacagtatgaaagccgcggttgacgtgttggcgcgtatgcctgcgccgcgcattttcgtgatgggcgatatgggcgaactgggcgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgagccacgatttgcccgaacgcgccaccgtgttggtgaaaggttcgcgctttatgcagatggaagaagtggtcgaggcattggaggataagtga

SEQ ID NO: 248 - protein, 452 aa, Neisseria gonorrhoeae
MKPLDLNFICQALKLPMPSENKPVSRIVTDSRDIREGDVFFALAGGRFDAHDFVGGVLSAGAAAVVVSREDCAALGGALKVDDTLAALQTLAKAWRDNVNPFVFGITGSGGKTTVKEMLAAVLRRRFGDDAVSATAGNFNNHIGLPLTLLKLNEKHRYAVIEMGMNHFGELAVLTQIAKPDAALVNNALRAHVGCGFDGVGDIAKAKSEIYAGLCSDGMALIPQEDANMAVFKTATFNLNTCTFGVDSGDVRAENIVLKPLSCEFDLVCGDERTAVVLPVPGRHNVHNAAAAAALALAAGLSLNDVAEGLQGFSNIKGRLNVKAGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLSHDLPERATVLVKGSRFMQMEEVVEALEDK

SEQ ID NO: 249 - DNA, 1368 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgagcggtttgacgcgcatgattttgttgaagacgtattggctgctggtgcggcggcggttgtggtttcgcgcgaagattgtgctgcaatggatggcgcgttgaaagtcgatgacacgcttgccgcattgcaaacgctggcaaaggcgtggcgtgaaaatgtgaatccgtttgtgttcggcattaccggttcgggcggcaagacgacggtgaaggaaatgctggctgcggtattgcgccgccgtttcggcgatgatgccgtgttggcgacggcaggcaacttcaacaaccatatcggattgccgctgactttgttgaagttaaacgaaaaacaccgctatgccgtgattgaaatgggcatgaaccatttcggcgaactggcggttttaacgcamatcgccaaaccaaatgccgcattggtcaacaacgccatgcgcgcccatgtcggctgcggtttcgacggagtgggcgatattgccaaagcgaaaagcgagatttaccaaggtttatgttcagacggcattgcactgattcctcaagaagatgccaatatggctgtcttcaaaacggcaacgcttaatttgaatacgcgcactttcggcatcgatagcggcgatgttcacgcggaaaatattgtgctgaaaccgttgtcgtgcgaatttgatttggtgtgcggcgatgagcgcgccgccgtggtgctgcctgttcccggccgccacaatgtccacaacgccgccgctgccgccgcgctggctttggctgcgggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcgattgacgtgttggcgcgtatgcctgcgccgcgtattttcgtgatgggcgatatgggcgaactgggcgaactgggcgaggacgaagccgccgctatgcacgccgaagtcggcgcgtatgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 250 - protein, 455 aa, Neisseria meningitidis
  misc_feature (176)..(176): Xaa can be any naturally occurring amino acid
MKPLDLNFICQALKLPMPSESKPVSRIVTDSRDIRAGDVFFALAGERFDAHDFVEDVLAAGAAAVVVSREDCAAMDGALKVDDTLAALQTLAKAWRENVNPFVFGITGSGGKTTVKEMLAAVLRRRFGDDAVLATAGNFNNHIGLPLTLLKLNEKHRYAVIEMGMNHFGELAVLTXIAKPNAALVNNAMRAHVGCGFDGVGDIAKAKSEIYQGLCSDGIALIPQEDANMAVFKTATLNLNTRTFGIDSGDVHAENIVLKPLSCEFDLVCGDERAAVVLPVPGRHNVHNAAAAAALALAAGLSLNDVAEGLKGFSNIKGRLNVKSGIKGATLIDDTYNANPDSMKAAIDVLARMPAPRIFVMGDMGELGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 251 - DNA, 1359 bp, Neisseria meningitidis
atgaaaccactggacctaaatttcatctgccaagccctcaagcttccgatgccgtctgaaagcaaacccgtgtcgcgcatcgtaaccgacagccgcgacatccgcgcgggcgatgtgtttttcgcattggcgggcgggcggtttgatgcgcatgattttgttgaagacgtattggctgcgggtgcggcggcggttgtggtttcgcgcgaagattgcgttgcaatggatggcgcgttgaaagtcgatgacacgcttaccgcgttgcaaatgttggcgaaggcgtggcgcgagaatgtgaacccgtttgtgttcggtattaccggctcgggcggcaagacgacggtgaaggaaatgttggctgcggtattgcgccgccgtttcggcgataatgccgttttggcgacggcaggcaacttcaacaaccacatcggattgccgttgactttgttgaaattaaacgaaaaacaccgctatgccgtgattgaaatgggtatgaaccattttggcgaactggcggttttgacacaaatcgccaaacccgatgccgcattggtcaacaacgccatgcgcgcccatgtcggctgcggtttcgacggagtgggcgatattgccaaagcgaaaagcgagatttatcaaggcttatgttcagacggcatggcgctgattcctcaagaagatgccaatatggctgtcttcaaaacggcaacgcttaatttgaatacgcgcactttcggcatcgatagcggcgatgtccacgcggaaaatatcgtgctgaaaccgttgtcgtgcgaatttgatttggtgtgcggcaacgagtgcgcagccgtggttctgcccgttcccggccgccacaatgtccacaacgccgccgccgccgccgcgctgtctttggctgcaggtttgagtttgaacgatgtggcggaaggtttgaaaggcttcagcaatatcaaaggccgtctgaacgtcaaatccggaatcaagggcgcaaccctgattgacgatacttataatgcgaaccctgacagcatgaaagctgcggttgacgtgttggcgcgtatgcctgcgccgcgtattttcgtgatgggcgatatgggcgaactgggtgaggacgaagccgccgccatgcacgccgaagtcggcgcgtacgcccgcgaccaaggcatcgaagcggcttattttgtcggcgacaacagcgtcgaagcggcggaaaaatttggcgcggacggtttgtggttcgccgccaaagacccgttgattcaagtgttgcgccacgatttgcccgaacgcgccaccgtgttggtgaaaggttcgcgctttatgcagatggaagaagtggtcgaggcattggaggataagtga

SEQ ID NO: 252 - protein, 452 aa, Neisseria meningitidis
MKPLDLNFICQALKLPMPSESKPVSRIVTDSRDIRAGDVFFALAGGRFDAHDFVEDVLAAGAAAVVVSREDCVAMDGALKVDDTLTALQMLAKAWRENVNPFVFGITGSGGKTTVKEMLAAVLRRRFGDNAVLATAGNFNNHIGLPLTLLKLNEKHRYAVIEMGMNHFGELAVLTQIAKPDAALVNNAMRAHVGCGFDGVGDIAKAKSEIYQGLCSDGMALIPQEDANMAVFKTATLNLNTRTFGIDSGDVHAENIVLKPLSCEFDLVCGNECAAVVLPVPGRHNVHNAAAAAALSLAAGLSLNDVAEGLKGFSNIKGRLNVKSGIKGATLIDDTYNANPDSMKAAVDVLARMPAPRIFVMGDMGELGEDEAAAMHAEVGAYARDQGIEAAYFVGDNSVEAAEKFGADGLWFAAKDPLIQVLRHDLPERATVLVKGSRFMQMEEVVEALEDK

SEQ ID NO: 253 - DNA, 744 bp, Neisseria gonorrhoeae
atgtggttgttgaagttgcctgccgtcgccgaaacggcatcatcgccgaaacggcggcgcaataccgcagccagcatctccttcaccgtcgtcttgccgcccgaaccggtaatgccgaacacaaacgggttcacattatcgcgccacgccttcgccaacgtttgcaacgcggcaagcgtgtcatcgactttcaacgcgccgcccaaagccgcgcaatcttcgcgcgaaaccacaaccgccgccgcgcccgcagacaatacgcctccaacaaaatcatgcgcgtcaaaccgcccgcccgccaatgcgaaaaacacatcgccttcccgaatatcgcggctgtcggttacgatgcgcgacacgggtttgttttcagacggcatcggaagcttgagggcttggcagatgaaatttaggtccagtggtttcatatttgctttcgttaatattcgggcggcggacacatcggtagcggctgatttttttatcgcctgttttgctgtggtaaaacacagattattttcccattctcattcggcattttttctgtacgtatcattttttagacgtatttttagccgatttgccttttcccgcataccacggcgcggggtcgtcggactgtctgtcgataaaggcaaggttattgccttcgcccggcacatcggggacattcccccaaaaatcatagccgtcatcgggcaactcgtcggtttcgatacccgtccaactgccgaatccgcgtaa

SEQ ID NO: 254 - protein, 247 aa, Neisseria gonorrhoeae
MWLLKLPAVAETASSPKRRRNTAASISFTVVLPPEPVMPNTNGFTLSRHAFANVCNAASVSSTFNAPPKAAQSSRETTTAAAPADNTPPTKSCASNRPPANAKNTSPSRISRLSVTMRDTGLFSDGIGSLRAWQMKFRSSGFIFAFVNIRAADTSVAADFFIACFAVVKHRLFSHSHSAFFLYVSFFRRIFSRFAFSRIPRRGVVGLSVDKGKVIAFARHIGDIPPKIIAVIGQLVGFDTRPTAESA

SEQ ID NO: 255 - DNA, 744 bp, Neisseria meningitidis
  misc_feature (4)..(5): n is a, c, g, or t
atgnngttgttgaagttgcctgccgtcgccaacacggcatcatcgccgaaacggcggcgcaataccgcagccagcatttccttcaccgtcgtcttgccgcccgaaccggtaatgccgaacacaaacggattcacattttcacgccacgcctttgccagcgtttgcaatgcggcaagcgtgtcatcgactttcaacgcgccatccattgcagcacaatcttcgcgcgaaaccacaaccgccgccgcaccagcagccaatacgtcttcaacaaaatcatgcgcgtcaaaccgctcgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggsattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 256 - protein, 247 aa, Neisseria meningitidis
  misc_feature (2)..(2): Xaa can be any naturally occurring amino acid
  misc_feature (179)..(179): Xaa can be any naturally occurring amino acid
MXLLKLPAVANTASSPKRRRNTAASISFTVVLPPEPVMPNTNGFTFSRHAFASVCNAASVSSTFNAPSIAAQSSRETTTAAAPAANTSSTKSCASNRSPANAKNTSPARMSRLSVTMRDTGLLSDGIGSLRAWQMKFRSSGFIFTFVNIRAADTSVAADFFIACFAVVKHRLFSHSHSXFFLYVSFFRRIFSRFAFSRIPRRGVVGQSVDKGKVIAFALHIGNIPPKIIAVIGQLVGFDTRPTAESA

SEQ ID NO: 257 - DNA, 744 bp, Neisseria meningitidis
atgtggttgttgaagttgcctgccgtcgccaaaacggcattatcgccgaaacggcggcgcaataccgcagccaacatttccttcaccgtcgtcttgccgcccgagccggtaataccgaacacaaacgggttcacattctcgcgccacgccttcgccaacatttgcaacgcggtaagcgtgtcatcgactttcaacgcgccatccattgcaacgcaatcttcgcgcgaaaccacaaccgccgccgcacccgcagccaatacgtcttcaacaaaatcatgcgcatcaaaccgcccgcccgccaatgcgaaaaacacatcgcccgcgcggatgtcgcggctgtcggttacgatgcgcgacacgggtttgctttcagacggcatcggaagcttgagggcttggcagatgaaatttaggtccagtggtttcatatttactttcgttaatattcgggcggcggacacatcggtagcggctgatttttttatcgcctgttttgctgtggtaaaacacagattattttcccattctcattcggcattttttctgtacgtatcattttttagacgtatttttagtcgatttgccttttcccgcataccacggcgcggggtcgtcgggcagtccgtcgataaaggcaaggttattgccttcgccctgcacatcgggaacattcccccaaaaatcatagccgtcatcgggcaactcgtcggtttcgatacccgtccaactgccgaatccgcgtaa

SEQ ID NO: 258 - protein, 247 aa, Neisseria meningitidis
MWLLKLPAVAKTALSPKRRRNTAANISFTVVLPPEPVIPNTNGFTFSRHAFANICNAVSVSSTFNAPSIATQSSRETTTAAAPAANTSSTKSCASNRPPANAKNTSPARMSRLSVTMRDTGLLSDGIGSLRAWQMKFRSSGFIFTFVNIRAADTSVAADFFIACFAVVKHRLFSHSHSAFFLYVSFFRRIFSRFAFSRIPRRGVVGQSVDKGKVIAFALHIGNIPPKIIAVIGQLVGFDTRPTAESA

SEQ ID NO: 259 - DNA, 696 bp, Neisseria gonorrhoeae
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggcgctttggcttcggttgtatttttattattattggcacgcggcttcccgcgcgtttcttcagttgttttactgatttacgtcggcacaaccgccctatatttgccggtcggctggctgtatggtgcgccttcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatctgtgggggtatttgctgacgtaaaaaactataaacgtcgcagcaaaatatggctgaccatattattgactttgattttgtcctgcgcggtgatggagaaaatcgccggcgataaagattggcgagaacctgatgccggcctgttgttgaatattttcgacctgtattacgacttggctttccgcgccggcacaatatgccgccaagcgcgcccacattttggaagcagcaaaaaaagcgtcaacatggcatatccgccaacttgcgcccaagtataa

SEQ ID NO: 260 - protein, 231 aa, Neisseria gonorrhoeae
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSVGVFADVKNYKRRSKIWLTILLTLILSCAVMEKIAGDKDWREPDAGLLLNIFDLYYDLAFRAGTICRQARPHFGSSKKSVNMAYPPTCAQV

SEQ ID NO: 261 - DNA, 694 bp, Neisseria meningitidis
  misc_feature (78)..(104): n is a, c, g, or t
  misc_feature (113)..(113): n is a, c, g, or t
atgaaacaatccgcccgaataaaaatatgaatcagacattactttatacattgggcatttgcgcgcttttaacctttnnnnnnnnnnnnnnnnnnnnnnnnnnntatcacccngaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggaaatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 262 - protein, 231 aa, Neisseria meningitidis
  misc_feature (9)..(9): Xaa can be any naturally occurring amino acid
  misc_feature (27)..(35): Xaa can be any naturally occurring amino acid
  misc_feature (200)..(200): Xaa can be any naturally occurring amino acid
MKQSARIKXMNQTLLYTLGICALLTFXXXXXXXXXYHPEYEYGYRYSAVGALASVVFLLLLARGFPRVSSVVLLIYVGTTALYLPVGWLYGAPSYQIVGSILESNPAEAREFVGNLPGSLYFVQALFFIFGLTVWKYCVSGGVFADVKNYKRRSKIWLTILLTLILSCAVMDKIASDKDLREPDAGLLLNIFDLYYDLAXRAGTICRQARPHFGSSKKSVNMAYPSCCAQV

SEQ ID NO: 263 - DNA, 695 bp, Neisseria meningitidis
atgaaacaatccgcccgaataaaaaatatggatcagacattaaaaaatacattgggcatttgcgcgcttttagccttttgttttggcgcggccatcgcatcaggttatcacttggaatatgaatacggctaccgttattctgccgtgggtgctttggcttcggttgtatttttattattattggcacgcggtttcccgcgcgtttcttcagttgttttactgatttacgtcggcacaaccgccctatatttgccggtcggctggctgtatggtgcgccgtcttatcagatagtcggttcgatattggaaagcaatcctgccgaggcgcgtgaatttgtcggcaatcttcccgggtcgctttattttgtgcaggcattatttttcatttttggcttgacagtttggagatattgtgtatcggggggggtatttgctgacgtaaaaaactataaacgccgcagcaaaatatggctgactatattattgactttgattttgtcctgcgcggtgatggataaaatcgccagcgataaagatttgcgagaacctgatgccggcctgttgttgaatattttcgacctgtattacgatttggcttccgcgccggcacaatatgccgccaagcgcgcccacattttggaagcagcaaaaaaagcgtcaacatggcatatccgtcatgttgcgcccaagtataa

SEQ ID NO: 264 - protein, 231 aa, Neisseria meningitidis
  misc_feature (201)..(201): Xaa can be any naturally occurring amino acid
MKQSARIKNMDQTLKNTLGICALLAFCFGAAIASGYHLEYEYGYRYSAVGALASVVFLLLLARGFPRVSSVVLLIYVGTTALYLPVGWLYGAPSYQIVGSILESNPAEAREFVGNLPGSLYFVQALFFIFGLTVWRYCVSGGVFADVKNYKRRSKIWLTILLTLILSCAVMDKIASDKDLREPDAGLLLNIFDLYYDLASXAGTICRQARPHFGSSKKSVNMAYPSCCAQV

SEQ ID NO: 265 - DNA, 285 bp, Neisseria gonorrhoeae
atgggcaaagggcaggacttcacgcccctgcgcgacgcgttgaaagataaggcaaaaggcgtgttcctgatcggcgtcgatgcgccgcaaatccgccgcgatttggacggctgcggcttgaacctgaccgactgcgtcactttggaagaggcggttcagacggcatacgcccaagccgaagcgggcgatattgtcttgctcagccccgcctgcgcgagtttcgatatgtttaaaggctacgcgcaccgttcggaagtgtttatcgaagcgtttaaggctttgtga

SEQ ID NO: 266 - protein, 94 aa, Neisseria gonorrhoeae
MGKGQDFTPLRDALKDKAKGVFLIGVDAPQIRRDLDGCGLNLTDCVTLEEAVQTAYAQAEAGDIVLLSPACASFDMFKGYAHRSEVFIEAFKAL

SEQ ID NO: 267 - DNA, 285 bp, Neisseria meningitidis
atgggtaaagggcaggacttcacgcccctgcgcgatgcactggtaggcaaggcaaaaggcgtgttcttgattggtgtcgatgcgccgcaaatccgccgcgatttggacggctgcggcttgaatatgaccgactgcgccactttgggagaagccgttcagacggcatatgcccaagccgaagcaggcgatattgtgttgctcagccccgcctgcgcgagctttgatatgttcaaaggctacgcgcaccgttcggaagtgtttatcgaagcgtttaaggctttgtga

SEQ ID NO: 268 - protein, 94 aa, Neisseria meningitidis
MGKGQDFTPLRDALVGKAKGVFLIGVDAPQIRRDLDGCGLNMTDCATLGEAVQTAYAQAEAGDIVLLSPACASFDMFKGYAHRSEVFIEAFKAL

SEQ ID NO: 269 - DNA, 285 bp, Neillia sinensis
atgggcaaagggcaggacttcacgcccctgcgcgacgcgcttgccggcaaggcaaaaggcgtgttcctgatcggtgtcgatgcgccgcaaatccgccgcgatttggacggctgcgatctgaatatgaccgactgcgccactttggaagaagcggttcagaaggcatatgcccaagccgaagcgggcgatatcgtgctgctcagccccgcctgcgcgagtttcgatatgtttaaaggctacgcgcaccgttcggaagtgtttatcggggcgtttaaggctttgtga

SEQ ID NO: 270 - protein, 94 aa, Neisseria meningitidis
MGKGQDFTPLRDALAGKAKGVFLIGVDAPQIRRDLDGCDLNMTDCATLEEAVQKAYAQAEAGDIVLLSPACASFDMFKGYAHRSEVFIGAFKAL

SEQ ID NO: 271 - DNA, 1192 bp, Neisseria gonorrhoeae
atggtggtgctgatgacggcgttcggcctgctgatgatttattcggcttctgtgtatttggcatcgaaggaaggcggcgatcagtttttctatttgaccaggcaggcggggttcgtcgttgccggccttatagcgagcggttttttatggtttctttgcaggatgaggacatggcggcggcttgtgccgtggatttttgccttatccggcctgttgctggtagccgtattgattgccgggcgcgaaatcaatggcgcgacccgttggatacctttgggtccgttgaatttccagccgaccgagctgttcaagctggcagtcatcctttatttggcaagcctgttcacgcgccgtgaagaagtgttgcgcagcatggaaagtttgggttggcagtcgatttggcgggggacggccaacctgattatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattaccgttggaatgctgtttctggcaggattgccgtggaaatatttttttgtcctggtaggcagcgtcttgggtgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgctgaagaattcggcttcttcgggatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatcgattatgaaaaccgccagaaaatgcgcggttaccgggtggagtaaa

SEQ ID NO: 272 - protein, 396 aa, Neisseria gonorrhoeae
MVVLMTAFGLLMIYSASVYLASKEGGDQFFYLTRQAGFVVAGLIASGFLWFLCRMRTWRRLVPWIFALSGLLLVAVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVITVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRQKMRGYRVE

SEQ ID NO: 273 - DNA, 1190 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcagrcacgtcgtgaaacattagaaatgtacggccgtwtccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggkrtccaaagtttcttcaatatcggtgtgaacatcggtgctttgccgamcaaaggyctgacgcygccgtgatgtccwatggcggttcgtcagtctttttcatgctgatcagcatgatgctgctgtkgcgtatagattatgaaaaccgccggaaaatgcgcggttatcgggtggagtaa

SEQ ID NO: 274 - protein, 396 aa, Neisseria meningitidis
  misc_feature (149)..(149): Xaa can be any naturally occurring amino acid
  misc_feature (160)..(160): Xaa can be any naturally occurring amino acid
  misc_feature (339)..(339): Xaa can be any naturally occurring amino acid
  misc_feature (354)..(354): Xaa can be any naturally occurring amino acid
  misc_feature (359)..(359): Xaa can be any naturally occurring amino acid
  misc_feature (361)..(361): Xaa can be any naturally occurring amino acid
  misc_feature (364)..(364): Xaa can be any naturally occurring amino acid
  misc_feature (380)..(380): Xaa can be any naturally occurring amino acid
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQXRRETLEMYGRXRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGXQSFFNIGVNIGALPXKGLTXPXMSXGGSSVFFMLISMMLLXRIDYENRRKMRGYRVE

SEQ ID NO: 275 - DNA, 1191 bp, Neisseria meningitidis
atggtggtgctgatgacggcgttcagcctgctgatgatttattcggcttctgtgtatttggcatcaaaagaaggcggcgatcagtttttctatttgaccagacaggcggggttcgtcgttgccggcttgatagcgagcggtttgttatggtttctttgcaggatgaggacatggcggcggcttgtgccgtggatttttgccctatccggcctgttgctggtagtcgtattgattgccgggcgcgaaatcaatggcgcgacccgttggatacctttgggtccgttgaatttccagccgaccgagctgttcaagctggcggtcatcctttatttggcaagcctgttcacgcgccgtgaagaagtgttgcgcagcatggaaagtttgggttggcagtcgatttggcgggggacggccaatctgatcatgtccgccaccaatccgcaggcacgtcgtgaaacattagaaatgtacggccgtttccgggcgatcatcctgccgattatgctggtggcgttcggtttggtgctgataatggtacagccggatttcggttcgtttgtcgtcattaccgtcattgccgttggaatgctgtttttggcaggattgccgtggaaatattttttcgtcctggtaggcagcgtcttgggcgggatggtgctgatgattaccgccgctccctaccgtgtgcagcgggtagtggcatttttggacccgtggaaagacccgcagggtgccggctaccagcttacccactctctgatggcaatcgggcgcggagagtggttcggtatgggtttgggtgcgagtttgagcaaacgcggctttctgccggaagcgcataccgattttatttttgccatcatcgccgaagaattcggtttcttcggtatgtgcgtgctgatattctgttacggctggctggtggtgcgggcgttttccatcggcaagcagtcgcgcgatttgggtttgactttcaacgcctatatcgcttcgggtatcggcatttggatcggtatccaaagtttcttcaatatcggtgtgaacatcggtgctttgccgaccaaaggtctgacgctgccgttgatgtcctatggcggttcgtcagtctttttcatgctgatcagcatgatgctgctgttgcgtatagattatgaaaaccgccggaaaatgcgcggttaccgggtggagtaa

SEQ ID NO: 276 - protein, 396 aa, Neisseria meningitidis
MVVLMTAFSLLMIYSASVYLASKEGGDQFFYLTRQAGFVVAGLIASGLLWFLCRMRTWRRLVPWIFALSGLLLVVVLIAGREINGATRWIPLGPLNFQPTELFKLAVILYLASLFTRREEVLRSMESLGWQSIWRGTANLIMSATNPQARRETLEMYGRFRAIILPIMLVAFGLVLIMVQPDFGSFVVITVIAVGMLFLAGLPWKYFFVLVGSVLGGMVLMITAAPYRVQRVVAFLDPWKDPQGAGYQLTHSLMAIGRGEWFGMGLGASLSKRGFLPEAHTDFIFAIIAEEFGFFGMCVLIFCYGWLVVRAFSIGKQSRDLGLTFNAYIASGIGIWIGIQSFFNIGVNIGALPTKGLTLPLMSYGGSSVFFMLISMMLLLRIDYENRRKMRGYRVE

SEQ ID NO: 277 - DNA, 1069 bp, Neisseria gonorrhoeae
atgggcggtaaaacctttatgctgatggcgggcggaacgggcggacacattttcccagctctggctgtggcggattcattgcgcgtgcgcggtcatcatgtaatttggctgggcagcaaggattcgatggaagagcgcatcgtgccgcaatacggcatacgcttggaaacgctggcgattaaaggaatacgcggcaacggcatcaaacgcaagctgatgcttccgtttactctgtacaaaaccgtccgcgaagcgcagcggattatccgcaaacaccgtgtcgagtgcgtcatcggcttcggcggttttgttacctttcccggcggtctggcggcgaaactcttgggcgtgccgattgtgattcacgagcaaaacgccgtggcaggcttgtccaaccgccacctgtcgcgctgggcgaaacgggtgttgtacgcttttccgaaagcgttcagccacgaaggcggtttggtcggcaaccccgtccgcgccgatattagcaacctgcccgtgcctgccgaacgcttccaagggcgcgaaggccgtctgaaaattttggtggtcggcggcagtttgggtgcggacgttttgaacaaaaccgtaccgcaggcgttggcactgctgcctgaagaggtgcgcccgcagatgtaccaccagtcggggcgtaacaagctgggcaatcttcaggcggattatgacgcgttgggcgtgaaagcggaatgcgtggaatttattaccgacatggtgtccgcctaccgtgatgccgatttggtgatttgccgtgccggcgcgctgacgattgccgagttgacggcggcggggctgggcgcgttgttagtgccgtatcctcacgccgttgatgaccatcaaaccgccaacgcgcgtttcatggtgcaggcagaagcggggctgctgttgccgcaaacccagttgacggcggaaaaactcgccgaaatcctcggcagcctcaaccgcgaaaaatgcctcaaatgggcggaaaacgcccgtacgttggcattgccgcacagcgcggatgacgttgccgaagccgcgattgcgtgtgcggcgtaaa

SEQ ID NO: 278 - protein, 355 aa, Neisseria gonorrhoeae
MGGKTFMLMAGGTGGHIFPALAVADSLRVRGHHVIWLGSKDSMEERIVPQYGIRLETLAIKGIRGNGIKRKLMLPFTLYKTVREAQRIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPEEVRPQMYHQSGRNKLGNLQADYDALGVKAECVEFITDMVSAYRDADLVICRAGALTIAELTAAGLGALLVPYPHAVDDHQTANARFMVQAEAGLLLPQTQLTAEKLAEILGSLNREKCLKWAENARTLALPHSADDVAEAAIACAA

SEQ ID NO: 279 - DNA, 1008 bp, Neisseria meningitidis
  misc_feature (688)..(753): n is a, c, g, or t
atgggcggtaaaacctttatgctgawkkcgggcggaacgggcggacatattttccccgcgctggcggtggcggattcattgcgcgcgcgcggccatcatgtgatttggctgggcagcaaggattcgatggaagagcgtatcgtgccgcaatacggcatacgcttggaaacgctggcgattaaaggcgtgcgcggcaacggcatcaaacgcaaactgatgctgccggttactttgtatcaaaccgtccgcgaagcgcagcggattatccgcaaacaccgtgtcgagtgcgtcatcggcttcggcggcttcgttaccttccccggcggtttggcggcgaagctattargcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcatgcattggctttgctgcccgacaatgcgcgtccgcatatgtaccaccaatcgggacggggcaagctgggcatcttgcaggcgnnnnnnnnnnnnnnnnnnnnnnnnnnnnnnnnnnnnnnnnnnnnnnnnnnnnnnnnnnnnnnnnnngcgggattgggtgcgttgttagtgccgtatcctcacgcggttgacgatcaccaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgtggcggaagccgcgattgcgtgtgcggcgtaa

SEQ ID NO: 280 - protein, 335 aa, Neisseria meningitidis
  misc_feature (9)..(10): Xaa can be any naturally occurring amino acid
  misc_feature (116)..(116): Xaa can be any naturally occurring amino acid
  misc_feature (230)..(251): Xaa can be any naturally occurring amino acid
MGGKTFMLXXGGTGGHIFPALAVADSLRARGHHVIWLGSKDSMEERIVPQYGIRLETLAIKGVRGNGIKRKLMLPVTLYQTVREAQRIIRKHRVECVIGFGGFVTFPGGLAAKLLXVPIVIHEQNAVAGLSNRHLSRWAKRVLYAFPKAFSHEGGLVGNPVRADISNLPVPAERFQGREGRLKILVVGGSLGADVLNKTVPHALALLPDNARPHMYHQSGRGKLGILQAXXXXXXXXXXXXXXXXXXXXXXAGLGALLVPYPHAVDDHQTANARFMVQAEAGLLLPQTQLTAEKLAEILGGLNREKCLKWAENARTLALPHSADDVAEAAIACAA

SEQ ID NO: 281 - DNA, 1068 bp, Neisseria meningitidis
atgggcggtaaaacctttatgctgatggcgggcggaacgggcggacatattttccccgcgctggcggtggcggattcattgcgcgcgcgcggccatcatgtaatttggctgggcagcaaggattcgatggaagagcgcatcgtgccgcaatacgacatcctgctcgaaacgctggcgattaaaggcgtgcgcggcaacggcatcaaacgcaagctgatgctgccgtttactttgtatcaaactgtccgcgaagcgcagcagattatccgcaaacaccgtgtcgagtgcgtcatcggcttcggcggcttcgttacctttcccggcggtttggcggcgaagttattaggcgtgccgattgtgattcacgagcaaaacgccgtggcaggtttgtccaaccgccacctgtcgcgctgggcgaagcgggtgttgtacgcttttccgaaagcgttcagccacgaaggcggcttggtcggcaaccccgtccgcgccgatattagcaacctgcccgtgcctgccgaacgcttccaagggcgtgaaggccgtctgaaaattttggtggtcggcggcagtttgggcgcggacgttttgaacaaaaccgtaccgcaggcattggctttgctgcccgacaatgcgcgtccgcagatgtaccaccaatcgggacggggcaagctgggcagcttgcaggcggattacgacgcgctgggcgtgcaagcggaatgcgtggaatttattaccgatatggtgtccgcctaccgcgatgccgatttggtgatttgccgtgccggcgcgctgacgattgccgagttgacggcggcgggattgggtgcgttgttagtgccgtatcctcacgccgttgatgaccatcaaaccgccaacgcgcgttttatggtgcaggcggaggcgggattgctgttgccgcaaacccagttgacggcggaaaaactcgccgagattctcggcggcttaaaccgcgaaaaatgcctcaaatgggcagaaaacgcccgtacgttggcactgccgcacagtgcggacgacgttgccgaagccgcgattgcgtgtgcggcgtaa

SEQ ID NO: 282 - protein, 355 aa, Neisseria meningitidis
MGGKTFMLMAGGTGGHIFPALAVADSLRARGHHVIWLGSKDSMEERIVPQYDILLETLAIKGVRGNGIKRKLMLPFTLYQTVREAQQIIRKHRVECVIGFGGFVTFPGGLAAKLLGVPIVIHEQNAVAGLSNRHLSRWAKRVLYAFPKAFSHEGGLVGNPVRADISNLPVPAERFQGREGRLKILVVGGSLGADVLNKTVPQALALLPDNARPQMYHQSGRGKLGSLQADYDALGVQAECVEFITDMVSAYRDADLVICRAGALTIAELTAAGLGALLVPYPHAVDDHQTANARFMVQAEAGLLLPQTQLTAEKLAEILGGLNREKCLKWAENARTLALPHSADDVAEAAIACAA

SEQ ID NO: 283 - DNA, 1131 bp, Neisseria gonorrhoeae
atgtttttatggctcgcacatttcagcaactggttaaccggtctgaatatttttcaatacaccacattccgcgccgttatggcggcgttgaccgccttggcgttttccctgatgttcggcccgtggacgatacgcaggctgaccgcgctcaaatgcgggcaggcagtgcgtaccgacggcccgcaaacccacctcgtcaaaaacggcacgccgacgatgggcggttcgctgattctgaccgccattaccgtgtccaccctgttgtggggcaactgggcgaacccgtatatctggattctcttgggcgtactgcttgccaccggtgcgctcggtttttacgacgactggcgcaaagtcgtttataaagaccccaacggcgtgtccgccaaattcaaaatggtgtggcagtcaagcgttgccgttatcgccggtttggcattgttttaccttgccgccaattccgccaacaatattttgattgtcccgtttttcaaacaaatcgccctgccgctgggcgtggtcggctttttggtgttgtcttacctgaccatcgtcggcacatccaacgccgtcaacctcaccgacggcttggacggccttgccgccttcccgttcgtcctcgttgccgccgggctcgccattttcgcctacgtcagcggacactaccaattttcccaatacctccagcttccctatgtcgccggcgcgaacgaagtcgctatattctgcaccgccatgtgcggcgcgtgcctcggatttttgtggttcaacgcctatcccgcgcaagtctttatgggcgatgtcggcgcgctggcattgggtgccgcgctcggtaccgttgccgtcatcgtccgccaagaatttgtcctcgtcattatgggcggtctgttcgtcgtagaagccgtgtccgttatgcttcatgtcggctggtacaagaaaaccaaaaaacgcatcttcctgacggcaccgattcatcaccattaccaacttcgatgctggaaagaaacgcaagtcgtcgtccgtttctggattattaccatcgtcgtggttttgataggtttgagtaccctcaaaattcgcggaaactatgccgtccgaacacctttcagacggcatttgaacgcgcaataa

SEQ ID NO: 284 - protein, 376 aa, Neisseria gonorrhoeae
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLAAFPFVLVAAGLAIFAYVSGHYQFSQYLQLPYVAGANEVAIFCTAMCGACLGFLWFNAYPAQVFMGDVGALALGAALGTVAVIVRQEFVLVIMGGLFVVEAVSVMLHVGWYKKTKKRIFLTAPIHHHYQLRCWKETQVVVRFWIITIVVVLIGLSTLKIRGNYAVRTPFRRHLNAQ

SEQ ID NO: 285 - DNA, 1131 bp, Neisseria meningitidis
  misc_feature (29)..(29): n is a, c, g, or t
  misc_feature (49)..(513): n is a, c, g, or t
atgtttttatggctcgcacatttcagcanctggttaaccggtctgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgttatcgtccgccaagagtttgtcctcgtcattatgggcggattatttgtcgtagaagccgtatccgttatgcttcaggttggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacatctttcagacggcatttgaacgcgcaataa

SEQ ID NO: 286 - protein, 376 aa, Neisseria meningitidis
  misc_feature (361)..(361): Xaa can be any naturally occurring amino acid
  misc_feature (366)..(366): Xaa can be any naturally occurring amino acid
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAVIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRXTYAVXTSFRRHLNAQ

SEQ ID NO: 287 - DNA, 1131 bp, Neisseria meningitidis
atgtttttatggctcgcacatttcagcaactggttaaccggtctgaatatttttcaatacaccacattccgcgccgtcatggcggcgttgaccgccttggcgttttccctgatgttcggcccgtggacgatacgcaggctgaccgcgctcaaatgcgggcaggcagtgcgtaccgacggtccgcaaacccacctcgtcaaaaacggcacgccgacgatgggcggttcgctgattctgaccgccattaccgtgtccaccctgttgtggggcaactgggcaaacccgtatatctggattctcttgggcgtattgctcgccacgggcgcactcggtttttacgacgactggcgcaaagtcgtctataaagaccccaacggcgtgtccgccaaattcaaaatggtgtggcagtcaagcgttgccattatcgccggtttggcattgttttaccttgccgccaattccgccaacaatattttgattgtcccgttcttcaaacaaatcgccctgccgctgggcgtggtcggctttttggtgttgtcttacctgaccatcgtcggcacatccaatgccgtcaacctcaccgacggcttggacggccttgcgaccttccccgtcgtcctcgttgccgccggcctcgccatcttcgcctatgccagcggccactcacaatttgcccaatacctgcaattaccttacgttgccggcgcaaacgaagtggtgattttctgtaccgccatgtgcggcgcgtgcctcggtttcttgtggtttaacgcctatcccgcgcaagtctttatgggcgatgtcggtgcattggcattgggtgccgcgctcggtaccgtcgccgtcatcgtccgccaagagtttgtcctcgtcattatgggcggattatttgtcgtagaagccgtatccgttatgcttcaggtcggctggtataagaaaaccaaaaaacgcatcttcctgatggcgcccatccatcaccactacgaacaaaaaggctggaaagaaacccaagtcgtcgtccgcttttggattattaccatcgtcttggtgttgatcggtttgagtaccctcaaaatccgctgaacctatgccgtctgaacacctttcagacggcatttgaacgcgcaataa

SEQ ID NO: 288 - protein, 374 aa, Neisseria meningitidis
MFLWLAHFSNWLTGLNIFQYTTFRAVMAALTALAFSLMFGPWTIRRLTALKCGQAVRTDGPQTHLVKNGTPTMGGSLILTAITVSTLLWGNWANPYIWILLGVLLATGALGFYDDWRKVVYKDPNGVSAKFKMVWQSSVAIIAGLALFYLAANSANNILIVPFFKQIALPLGVVGFLVLSYLTIVGTSNAVNLTDGLDGLATFPVVLVAAGLAIFAYASGHSQFAQYLQLPYVAGANEVVIFCTAMCGACLGFLWFNAYPAQVFMGDVGALALGAALGTVAVIVRQEFVLVIMGGLFVVEAVSVMLQVGWYKKTKKRIFLMAPIHHHYEQKGWKETQVVVRFWIITIVLVLIGLSTLKIRTYAVTPFRRHLNAQ

SEQ ID NO: 289 - DNA, 450 bp, Neisseria gonorrhoeae
atgccgcccaaaatcacgaagagcgggttttgcaaaccggcaatcgcggcggcggtcgcgccgacattcgtgcctttgctgtcgtcgatgaataccacgccgtttttctcgccgattttttccacacggtgcggcaagccttggaaggttttgacgtgttccagcaatgcttcgcgcggcaaaccgacggcctcgcacaaagccacggcagccataacgttggcggcgttgtgcaaaccttgcagcgggatgtcttgcgtagaaatcaaatcttcattgccttgttttaaacagcccgtcccgcgttccaaccaaaaatcggcttcgtgttccaaggaaaaccgtttcacttcacgccctgcccgtttcatggcgcggcagaacacgtcgtccgcattcaaaacctgcactccatcgccacggaaaatctcggctttggtatgcgcgtag

SEQ ID NO: 290 - protein, 149 aa, Neisseria gonorrhoeae
MPPKITKSGFCKPAIAAAVAPTFVPLLSSMNTTPFFSPIFSTRCGKPWKVLTCSSNASRGKPTASHKATAAITLAALCKPCSGMSCVEIKSSLPCFKQPVPRSNQKSASCSKENRFTSRPARFMARQNTSSAFKTCTPSPRKISALVCA

SEQ ID NO: 291 - DNA, 450 bp, Neisseria meningitidis
atgccgcccaaaatcackawgagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccackgcagccatgacgttagcggcgttgtgcakaccttgcaacggwatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatag

SEQ ID NO: 292 - protein, 149 aa, Neisseria meningitidis
  misc_feature (7)..(7): Xaa can be any naturally occurring amino acid
  misc_feature (79)..(79): Xaa can be any naturally occurring amino acid
MPPKITXSGFCKPAIAAAVAPTFVPLLSSINTTPFFSPIFSTRCGRPWKVLTCSSNASRDKPMASHKATAAMTLAALCXPCNGMSCVTIKSSLPCFRRPVSRSNQKSASCSNENHFTSRPARFIARQNASSAFKTCTPSPRKILALVCA

SEQ ID NO: 293 - DNA, 450 bp, Neisseria meningitidis
atgccgcctaaaatcacgaagagcggattttgcaaaccggcaatcgcggcggcggtcgcaccgacgttcgtgcctttgctgtcgtcgatgaacaccacgccatttttctcgccgattttttccacgcggtgcggcaggccttgaaaggttttgacgtgttcgagcaatgcttcgcgcggcaaaccgacggcttcgcacaaggcaacggcagccatcacgttagtggcgttgtgcaagccttgcagcggaatatcttgcgtggcaatcaaatcttcattgccttgtttcaggcgacctgtctcacgttccaaccaaaaatcggcttcgtattccaacgaaaaccatttcacctcgcgcccggcgcgcttcatcgcacgacagaacgcatcgtccgcattcaaaacctgcacaccgtcgccacggaaaatcttggctttggtatgcgcgtag

SEQ ID NO: 294 - protein, 148 aa, Neisseria meningitidis
MPPKITKSGFCKPAIAAAVAPTFVPLLSSMNTTPFFSPIFSTRCGRPKVLTCSSNASRGKPTASHKATAAITLVALCKPCSGISCVAIKSSLPCFRRPVSRSNQKSASYSNENHFTSRPARFIARQNASSAFKTCTPSPRKILALVCA

SEQ ID NO: 295 - DNA, 356 bp, Neisseria gonorrhoeae
atgcgcgtagtcgagcaaatcgtcgtagcggtcgagatggtcttcggaaatgttcatcaccgtcgccgcagtcgggcgcaggctttcggtgttttccagttggaagctggaaagctcccacacccacacgtccgcctttttgccttcgcgctgcaattctgcctccaagacgggcgtaccgatattgcccgcaatgacggtatccagcccgcacttgatgcagagatagcggaccaggctggttaccgtggttttgccgttgctgccggtaatcgcaatcaccttgtcgccgcggcggttcacaatgtccgccagcaattggatgtcgcctagcacgcgcccgccgttttgcttga

SEQ ID NO: 296 - protein, 118 aa, Neisseria gonorrhoeae
  misc_feature (111)..(111): Xaa can be any naturally occurring amino acid
  misc_feature (114)..(114): Xaa can be any naturally occurring amino acid
MRVVEQIVVAVEMVFGNVHHRRRSRAQAFGVFQLEAGKLPHPHVRLFAFALQFCLQDGRTDIARNDGIQPALDAEIADQAGYRGFAVAAGNRNHLVAAAVHNVRQQLDVAXHAXRRFA

SEQ ID NO: 297 - DNA, 356 bp, Neisseria meningitidis
atgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttga

SEQ ID NO: 298 - protein, 118 aa, Neisseria meningitidis
  misc_feature (114)..(114): Xaa can be any naturally occurring amino acid
MRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHAXRRFA

SEQ ID NO: 299 - DNA, 356 bp, Neisseria meningitidis
atgcgcgtagtcgagcaagtcgtcgtagcggtcgagatggtcttcggaaatgttcagcactgtcgccgcagtcgggcgcaggctttcggtgttttccagttggaaactggaaagctccaacacccacacgtccgcctttttgccttcgcgctgcaattccgcctccaaaaccggcgcgccgatattgcccgcgataacggtatccagcccacacttgatgcagagatagccgaccaggctcgttaccgtggttttgccgttgctgccggtaatcgcaatcaccttgtcgccgcggcggttcacaatgtccgccagcaattcgatgtcgcccaacacgcgtccgccgtttcgcttaa

SEQ ID NO: 300 - protein, 118 aa, Neisseria meningitidis
  misc_feature (114)..(114): Xaa can be any naturally occurring amino acid
MRVVEQVVVAVEMVFGNVQHCRRSRAQAFGVFQLETGKLQHPHVRLFAFALQFRLQNRRADIARDNGIQPTLDAEIADQARYRGFAVAAGNRNHLVAAAVHNVRQQFDVAQHAXRRFA

SEQ ID NO: 301 - DNA, 1380 bp, Neisseria meningitidis
atgacggcgtttgcatttcagacggcatcacaaagccttaaacgcttcgataaacacttccgaacggtgcgcgtagcctttgaacatatcaaagctcgcgcaggcggggctgagcaacacaatatcgcctgcttcggcttgggcatatgccgtctgaacggcttctcccaaagtggcgcagtcggtcatattcaagccgcagccgtccaaatcgcggcggatttgcggcgcatcgacaccaatcaagaacacgccttttgccttgcctaccagtgcatcgcgcaggggcgtgaagtcctgccctttacccatgccgcccaaaatcacgaagagcggattttgcaaaccggcaatcgcggcggcagtcgcgccgacattcgtgcctttgctgtcgtcgataaacaccacgccgtttttctcgccgattttttccacgcggtgcggcaggccttggaaggttttgacgtgttcgagcaatgcttcgcgcgacaaaccgatggcctcacacaaagccacggcagccatgacgttagcggcgttgtgcagaccttgcaacggaatgtcttgcgtgacaatcaaatcttcattgccttgtttcaggcggcctgtctcgcgttccaaccagaaatcagcttcgtgttccaacgaaaaccattttacctcgcgcccggcacgcttcatcgcgcggcagaacgcatcgtccgcattcaaaacctgcacgccgtcgccacggaaaatcttggctttggtatgcgcatagtcgagcaagtcgtcgtagcggtcgagatggtcttcggaaatgttcagcaccgtcgccgcagtcggacgcaggctttcggtgttttccagttggaagctggaaagctccaacacccacacgtccgcctttttgccttcgcgctgccattccgcctccaaaaccggcgtgccgatattgcccgcgataacggtatccagcccgcacttgatacagagatagccgaccaggctcgttaccgtggttttgccgttgctgccggtaatcgcaattaccttgtcgtcccggcggttcacaatgtccgccagcaattcgatgtcgcccaacacgcgtccgccgttttgcttgaacgcctcaatatccggctgccgctcgctgatgccgggactgagagccagaatatcgaaaccgttgtccagcgcatctttcagacggcccgtgtaaaacaccaacccgtcaaacatcttaccgatttgcgacacgcgttccggcttcagctccgcatcatacgcagcaacctccgcgccgtttttgcgcaggtaggcaatcatggaaatacccgtaccgccgagtccggcgacgaggatttttttgttttgaaaagtcattttggtttgtcctaa

SEQ ID NO: 302 - protein, 459 aa, Neisseria meningitidis
MTAFAFQTASQSLKRFDKHFRTVRVAFEHIKARAGGAEQHNIACFGLGICRLNGFSQSGAVGHIQAAAVQIAADLRRIDTNQEHAFCLAYQCIAQGREVLPFTHAAQNHEERILQTGNRGGSRADIRAFAVVDKHHAVFLADFFHAVRQALEGFDVFEQCFARQTDGLTQSHGSHDVSGVVQTLQRNVLRDNQIFIALFQAACLAFQPEISFVFQRKPFYLAPGTLHRAAERIVRIQNLHAVATENLGFGMRIVEQVVVAVEMVFGNVQHRRRSRTQAFGVFQLEAGKLQHPHVRLFAFALPFRLQNRRADIARDNGIQPALDTEIADQARYRGFAVAAGNRNYLVVPAVHNVRQQFDVAQHASAVLLERLNIRLPLADAGTESQNIETVVQRIFQTARVKHQPVKHLTDLRHAFRLQLRIIRSNLRAVFAQVGNHGNTRTAESGDEDFFVLKSHFGLS

SEQ ID NO: 303 - DNA, 309 bp, Neisseria gonorrhoeae
atggaaatacccgtgccgccaagtccggcgacgaggatttttttgtttgaaagtcattttggttttgtcctaaaacaaatcatattgggcaggagacgtccgcccttgcccaagccgctttcagacggcatcgcgagccgattaataacccgccttcaggcgttggtcattgtcgcagctgttttggtctccgttttgacaagccttgccaagccattgttgagcgagcgcaaggtcttggcgcacgccgcgtccatcgtaatacatcaagcccaaattgtattgggcttgggcatccccttgttctga

SEQ ID NO: 304 - protein, 102 aa, Neisseria gonorrhoeae
MEIPVPPSPATRIFLFESHFGFVLKQIILGRRRPPLPKPLSDGIASRLITRLQALVIVAAVLVSVLTSLAKPLLSERKVLAHAASIVIHQAQIVLGLGIPLF

SEQ ID NO: 305 - DNA, 306 bp, Neisseria meningitidis
atggaaatacccgtaccgccgagtccggcgacgaggatttttttgtttgaaaagtcattttggtttgtcctaaaacaaatcatattgagcaggagatgtccgcccctgcccaagccgctttcagacggcatcgcgagctgttcaataacccgccttcaggcgttggtcattgtcgcagccgtcttggtctccgttttgacaagccttgccaaaccattcttgtgcaagggcgcggtcttggcgcacgccgcgtctttcggcatacatcacgcccaaattgttttgggcttgggctaccccctgcgc

SEQ ID NO: 306 - protein, 102 aa, Neisseria meningitidis
MEIPVPPSPATRIFLFEKSFWFVLKQIILSRRCPPLPKPLSDGIASCSITRLQALVIVAAVLVSVLTSLAKPFLCKGAVLAHAASFGIHHAQIVLGLGYPLR

SEQ ID NO: 307 - DNA, 288 bp, Neisseria meningitidis
atggaaatacccgtgccgccaagtccggcgacgaggatttttttgttttggaaatcattttggtttgtcctaaaacaaatcatattgagcaggggatgtctgatcctgctcaagccgctttcagacggcatcgcgagctgttcaataacccgctttcaggcgttggtcattgtcgcagctgtcttggtatccgttttgacaagccttgccaagccattcttgtgcaagggcgcggtcttggcgcacgccgcgtctttcggcatacatcacgcccaaattgttttgggc

SEQ ID NO: 308 - protein, 96 aa, Neisseria meningitidis
MEIPVPPSPATRIFLFWKSFWFVLKQIILSRGCLILLKPLSDGIASCSITRFQALVIVAAVLVSVLTSLAKPFLCKGAVLAHAASFGIHHAQIVLG

SEQ ID NO: 309 - DNA, 1521 bp, Neisseria gonorrhoeae
atgttttttatttcaatccgctatatatttgtcagaaaactatggtgcgcaaacggtcagacctttaaaataacgcctttacgcactaaaaaccaaccggaacgcaacattatgatgaaaaatcgagtaagcaacatccattttgtcggtatcggcggcgtcggcatgagcggtatcgccgaagtcttgcacaatttgggctttaaagtttccggttcggatcaggcgcgaaatgccgctaccgagcatttgagcagcctgggcattcaagtttatcccggccataccgcagaacacgttaacggtgcggatgtcgtcgttgcctctaccgccgtcaagaaagaaaatcccgaagttgtcgctgcgttggagcggcaaattcccgttattccgcgcgccttgatgctggcagagctgatgcgcttccgtgacggcatcgccattgccggtacgcacggcaaaaccacgaccaccagcctgaccgcctccatcctcggcgcggcaggactcgaccccactttcgttatcggcggcaaactcaacgccgcaggcaccaacgcccgcttgggcaaaggcgaatacatcgttgccgaagccgacgaatccgatgcctctttcctacatctgaccccgattatgtccgtcgttaccaatatcgacgaagaccatatggatacctacgggcacagcgtcgaaaaactgcatcaggcgtttatcgatttcatccaccgtatgcccttctacggcaaagcctttttgtgtgttgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgctttgctggtggacgattacggacaccaccccgtcgaaatggcggcaacccttgccgctgcacgcggcgcgtatccggaaaaacgtttggtgctcgccttccagccgcaccgctatacccgcacgcgcgatttgtttgaagactttaccaaagtactcaataccgttgatgcgctggtactgaccgaagtttatgccgccggcgaagagccggttgccgccgccgactcccgcgccttggcgcgtgctatccgcgtattgggcaaacttgagccgatttactgcgaaaatgtcgccgacctgccgcaaatgctgatgaatgttttacaggatggcgatgttgtgttgaatatgggtgcgggaagcatcaaccgcgttccttccgcgctgttggaattgtcgaaacagatttga

SEQ ID NO: 310 - protein, 506 aa, Neisseria gonorrhoeae
MFFISIRYIFVRKLWCANGQTFKITPLRTKNQPERNIMMKNRVSNIHFVGIGGVGMSGIAEVLHNLGFKVSGSDQARNAATEHLSSLGIQVYPGHTAEHVNGADVVVASTAVKKENPEVVAALERQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCVDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYPEKRLVLAFQPHRYTRTRDLFEDFTKVLNTVDALVLTEVYAAGEEPVAAADSRALARAIRVLGKLEPIYCENVADLPQMLMNVLQDGDVVLNMGAGSINRVPSALLELSKQI

SEQ ID NO: 311 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagttaccaacatccattttgtcggtatcggcggcgtcggcatgagcggcatcgccgaagtcttgcacaatttgggctttaaagtttccggttcggatcaggcgcgaaatgccgctaccgagcatttgggcagcctgggcattcaagtttatcccggccataccgccgaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcactaacgcccgcttgggcaaaggcgaatacatcgttgccgaagccgacgagtcggatgcatcctttctgcacctgacaccgattatgtccgtcgttaccaatatcgacgaagaccatatggatacctacgggcacagcgtcgaaaaactgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggcgtcggccgccgcttccaaaaatacggcgacatcaagttgccaaacggcgggaccgcgctcttggtggacgactacggacaccaccccgtcgaaatggcggcgacccttgccgccgcacgcggcgcgtatctggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgccgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggcgcgggaagcatcaaccgcgtccccgccgcgctgctggcattgtcgaaacagatttga

SEQ ID NO: 312 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLAAARGAYLEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLALSKQI

SEQ ID NO: 313 - DNA, 1521 bp, Neisseria meningitidis
atgttttttatttcaatccgctatatatttgtcagaaaactatggcgcgcaaacggtcagccctttaaaataacgcctttacgcatcgaaaatccaccggaacgcaacattatgatgaaaaatcgagtgaccaacatccattttgtcggtatcggcggcgtcggcatgagcggtatcgccgaagtcttgcacaatttgggttttaaagtttccggttcggatcaggcgcgaaatgccgctaccgagcatttgggcagcctgggcattcaagtttatcccggccataccgcagaacacgttaacggtgcggatgtcgtcgttacctctaccgccgtcaaaaaagaaaatcccgaagttgtcgctgcgttggagcagcaaattcccgttattccgcgcgccctgatgttggcggagttgatgcgcttccgtgacggcatcgccattgccggcacgcacggcaaaaccacgaccaccagcctgaccgcctccatcctcggcgcggcaggacttgacccgactttcgttatcggcggcaaactcaacgccgcaggcaccaacgcccgcttgggcaaaggcgaatacatcgttgccgaagccgacgagtcggatgcatcctttctgcacctgacaccgattatgtccgtcgttaccaatatcgacgaagaccatatggatacctacgggcacagtgttgagaagctgcatcaggcgtttatcgatttcatccaccgtatgcccttctacggcaaagcctttttgtgtattgacagcgaacacgtccgcgcgattttgcccaaagtgagcaaaccttatgctacttacggtttggacgataccgccgacatctacgccaccgacatcgaaaacgtcggcgcgcaaatgaaattcaccgtccatgttcaaatgaaaggacatgagcaggggtcgtttgaagtcgtgctgaatatgcccggcagacacaacgtgctgaacgcattggcagccatcggcgtggcgctggaagtcggcgcatcggttgaagcgatccaaaaaggcttgctcggctttgaaggtgtcggccgccgcttccaaaaatacggcgacatcaagttgccaaacggtggaaccgcgctcttggtggacgactacggacaccaccccgtcgaaatggcggcgaccctttccgccgcacgcggcgcgtatccggaaaaacgtttggtactcgccttccagccgcaccgctatacccgcacgcgcgatttgtttgaagactttaccaaagtcctcaataccgttgacgcgctggtgctgaccgaagtttatgccgccggtgaagagccgattgccgccgctgattcccgcgctcttgcccgcgccatccgcgtgttgggcaaactcgagccgatttactgcgaaaacgttgccgatctgcccgaaatgctgttgaacgttttgcaggacggcgacatcgtgttgaatatgggtgcgggaagcatcaaccgcgtccccgccgcgctgctggaattgtcgaaacagatttga

SEQ ID NO: 314 - protein, 506 aa, Neisseria meningitidis
MFFISIRYIFVRKLWRANGQPFKITPLRIENPPERNIMMKNRVTNIHFVGIGGVGMSGIAEVLHNLGFKVSGSDQARNAATEHLGSLGIQVYPGHTAEHVNGADVVVTSTAVKKENPEVVAALEQQIPVIPRALMLAELMRFRDGIAIAGTHGKTTTTSLTASILGAAGLDPTFVIGGKLNAAGTNARLGKGEYIVAEADESDASFLHLTPIMSVVTNIDEDHMDTYGHSVEKLHQAFIDFIHRMPFYGKAFLCIDSEHVRAILPKVSKPYATYGLDDTADIYATDIENVGAQMKFTVHVQMKGHEQGSFEVVLNMPGRHNVLNALAAIGVALEVGASVEAIQKGLLGFEGVGRRFQKYGDIKLPNGGTALLVDDYGHHPVEMAATLSAARGAYPEKRLVLAFQPHRYTRTRDLFEDFTKVLNTVDALVLTEVYAAGEEPIAAADSRALARAIRVLGKLEPIYCENVADLPEMLLNVLQDGDIVLNMGAGSINRVPAALLELSKQI

SEQ ID NO: 315 - DNA, 831 bp, Neisseria gonorrhoeae
atgcagaattttggcaaagtggccgtattgatgggtggtttttccagcgaacgagaaatctcgctggacagcggtaccgccattttgaacgccttaaaaagcaaaggcatagacgcatacgccttcgaccctaaggaaacgccgttatccgaactgaaggagcggggctttcagacggcattcaacatccttcacggtacttacggcgaagacggggctgttcagggtgcattggaactgttgggcattccctataccggcagcggtgtcgccgcctccgccatcggcatggacaaataccgctgcaaactgatttggcaggcattgggattacccgttcccgagttcgccgtactgtacgatgataccgatttcgatgccgtcgaagaaaaattgggtctgccgatgtttgtgaagccggcggccgaaggcagcagcgtcggcgtggtaaaagtcaaagaaaaaggccgtctgaaaagcgtttacgaagaattgaaacaccttcaggggcgaaatcattgccgaacgttttatcggcggcggcgaatattcctgccccgtcctgaacggcaaagggctgcccggcatacacatcatccccgcaaccgagttttacgactacgaagccaagtacaaccgagacgacaccatttatcaatgtccttcggaagatttgaccgaagccgaagaaagcctgatgcgcgaactggcggttcgcggcgcacaggcaatcggtgcggaaggctgcgtgcgcgtcgatttcctcaaagataccgacggcaaactctatctgttggaaatcaacaccctgcccggtatgaccggccatag

SEQ ID NO: 316 - protein, 276 aa, Neisseria gonorrhoeae
MQNFGKVAVLMGGFSSEREISLDSGTAILNALKSKGIDAYAFDPKETPLSELKERGFQTAFNILHGTYGEDGAVQGALELLGIPYTGSGVAASAIGMDKYRCKLIWQALGLPVPEFAVLYDDTDFDAVEEKLGLPMFVKPAAEGSSVGVVKVKEKGRLKSVYEELKHLQGRNHCRTFYRRRRIFLPRPERQRAARHTHHPRNRVLRLRSQVQPRRHHLSMSFGRFDRSRRKPDARTGGSRRTGNRCGRLRARRFPQRYRRQTLSVGNQHPARYDRP

SEQ ID NO: 317 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcctaaagaaaccccattgtctgaattgaaggcacaaggttttcagacggcattcaacatccttcacggtacttacggcraagacggggcggttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacaccttcagggcgaaatcattgccgaacgttttatcggcggcggcgaatattcctgccccgtcctgaacggcaaagggctgcccggcatacacatcattcccgcaaccgagttttacgactacgaagccaagtacaaccgcgacgacaccatttatcaatgtccttcggaagatttgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgacgagccatag

SEQ ID NO: 318 - protein, 276 aa, Neisseria meningitidis
  misc_feature (70)..(70): Xaa can be any naturally occurring amino acid
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGXDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHLQXRNHCRTFYRRRRIFLPRPERQRAARHTHHSRNRVLRLRSQVQPRRHHLSMSFGRFDRSRRKPDARTGGSRRAGNRCGRLRARRFPQRYRRQTLSVGNQHPARYDEP

SEQ ID NO: 319 - DNA, 830 bp, Neisseria meningitidis
atgcagaattttggcaaagtggccgtattgatgggcggtttttccagcgaacgagaaatctcgctggacagcggcaccgccattttgaatgctttaaaaagcaaaggcatagacgcatacgccttcgatcccaaggaaaccccattgtctgaattgaaggcacaaggttttcagacggcattcaacatccttcacggtacttacggcgaagacggggctgttcagggtgcattggaactgttgggcattccctataccggcagcggtgtcgccgcatccgccatcggcatggacaaataccgctgcaaactgatttggcaggcattgggattgcccgttcccgagttcgccgtcctgcacgacgacactgatttcgatgccgtcgaagaaaaattgggcctgccgatgtttgtgaaaccggcggccgaaggcagcagcgtaggcgtggtaaaagtcaaaggaaaaggccgtctgaaaagcgtttacgaagaattgaaacactttcagggcgaaatcattgccgaacggtttatcggcggcggcgaatattcctgccctgtgttgaacggcaaaggcctgcccggcatacacatcatccccgcgaccgagttttatgactacgaagccaagtacaaccgcaacgacaccatttatcaatgtccttcggaagatctgaccgaagccgaagaaagcctgatgcgcgaactggcggttcgcggcgcgcaggcaatcggtgcggaaggctgcgtgcgcgtcgatttcctcaaagataccgacggcaaactctatctgttggaaatcaacaccctgcccggtatgaccggccatag

SEQ ID NO: 320 - protein, 275 aa, Neisseria meningitidis
  misc_feature (170)..(170): Xaa can be any naturally occurring amino acid
MQNFGKVAVLMGGFSSEREISLDSGTAILNALKSKGIDAYAFDPKETPLSELKAQGFQTAFNILHGTYGEDGAVQGALELLGIPYTGSGVAASAIGMDKYRCKLIWQALGLPVPEFAVLHDDTDFDAVEEKLGLPMFVKPAAEGSSVGVVKVKGKGRLKSVYEELKHFQXRNHCRTVYRRRRIFLPCVERQRPARHTHHPRDRVLLRSQVQPQRHHLSMSFGRSDRSRRKPDARTGGSRRAGNRCGRLRARRFPQRYRRQTLSVGNQHPARYDRP

SEQ ID NO: 321 - DNA, 312 bp, Neisseria gonorrhoeae
atgtattcgcctttgcccaagcgggcgttggtgcctgcggcgttgagtttgccgccgataacgaaagtggggtcgagtcctgccgcgccgaggatggaggcggtcaggctggtggtcgtggttttgccgtgcgtaccggcaatggcgatgccgtcacggaagcgcatcagctctgccagcatcaaggcgcgcggaataacgggaatttgccgctccaacgcagcgacaacttcgggattttctttcttgacggcggtagaggcaacgacgacatccgcaccgttaacgtgttctgcggtatggccgggataa

SEQ ID NO: 322 - protein, 103 aa, Neisseria gonorrhoeae
MYSPLPKRALVPAALSLPPITKVGSSPAAPRMEAVRLVVVVLPCVPAMAMPSRKRISSASIKARGITGICRSNAATTSGFSFLTAVEATTTSAPLTCSAVWPG

SEQ ID NO: 323 - DNA, 312 bp, Neisseria meningitidis
atgtattcgcctttgcccaagcgggcgttagtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttcggcggtatggccgggataa

SEQ ID NO: 324 - protein, 103 aa, Neisseria meningitidis
MYSPLPKRALVPAALSLPPITKVGSSPAAPRMEAVRLVVVVLPCVPAMAMPSRKRINSANIRARGITGICCSNAATTSGFSFLTAVEVTTTSAPLTCSAVWPG

SEQ ID NO: 325 - DNA, 312 bp, Neisseria meningitidis
atgtattcgcctttgcccaagcgggcgttggtgcctgcggcgttgagtttgccgccgataacgaaagtcgggtcaagtcctgccgcgccgaggatggaggcggtcaggctggtggtcgtggttttgccgtgcgtgccggcaatggcgatgccgtcacggaagcgcatcaactccgccaacatcagggcgcgcggaataacgggaatttgctgctccaacgcagcgacaacttcgggattttcttttttgacggcggtagaggtaacgacgacatccgcaccgttaacgtgttctgcggtatggccgggataa

SEQ ID NO: 326 - protein, 103 aa, Neisseria meningitidis; identical to SEQ ID NO: 324

SEQ ID NO: 327 - DNA, 375 bp, Neisseria gonorrhoeae
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaacacacaaaaaggctttgccgtagaagggcatacggtggatgaaatcgataaacgcctgatgcagtttttcgacgctgtgcccgtaggtatccatatggtcttcgtcgatattggtaacgacggacataatcggggtcagtgtaggaaagaggcatcggatcgtcggcttcggcaacgatgtattcgcctttgcccaagcgggcgttggtgcctgcggcgttga

SEQ ID NO: 328 - protein, 124 aa, Neisseria gonorrhoeae
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRGQCRKEASDRRLRQRCIRLCPSGRWCLRR

SEQ ID NO: 329 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagtttttcgacgctgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttagtgcctgcggcgttga

SEQ ID NO: 330 - protein, 124 aa, Neisseria meningitidis
  misc_feature (120)..(120): Xaa can be any naturally occurring amino acid
MSFHLNMDGEFHLRADVFDVGGVDVGGIVQTVSSIRFAHFGQNRADVFAVNTQKGFAVEGHTVDEIDKRLMQFFDAVPVGIHMVFVDIGNDGHNRCQCRKDASDRRLRQRCIRLCPSGRXCLRR

SEQ ID NO: 331 - DNA, 375 bp, Neisseria meningitidis
atgtcctttcatttgaacatggacggtgaatttcatttgcgcgccgacgttttcgatgtcggtggcgtagatgtcggcggtatcgtccaaaccgtaagtagcataaggtttgctcactttgggcaaaatcgcgcggacgtgttcgctgtcaatacacaaaaaggctttgccgtagaagggcatacggtggatgaaatcgataaacgcctgatgcagcttctcaacactgtgcccgtaggtatccatatggtcttcgtcgatattggtaacgacggacataatcggtgtcagtgcagaaaggatgcatccgaccgtcggcttcggcaacgatgtattcgcctttgcccaagcgggcgttggtgcctgcggcgttga

SEQ ID NO: 332 - protein, 124 aa, Neisseria meningitidis
MSFHLNMDGEFHLRADVFDVGGVDVGGIVQTVSSIRFAHFGQNRADVFAVNTQKGFAVEGHTVDEIDKRLMQLLNTVPVGIHMVFVDIGNDGHNRCQCRKDASDRRLRQRCIRLCPSGRWCLRR

SEQ ID NO: 333 - DNA, 375 bp, Neisseria gonorrhoeae
atggccggtcataccgggcagggtgttgatttccaacagatagagtttgccgtcggtatctttgaggaaatcgacgcgcacgcagccttccgcaccgattgcctgtgcgccgcgaaccgccagttcgcgcatcaggctttcttcggcttcggtcaaatcttccgaaggacattgataaatggtgtcgtctcggttgtacttggcttcgtagtcgtaaaactcggttgcggggatgatgtgtatgccgggcagccctttgccgttcaggacggggcaggaatattcgccgccgccgataaaacgttcggcaatgatttcgcccctgaaggtgtttcaattcttcgtaaacgcttttcagacggcctttttctttga

SEQ ID NO: 334 - protein, 124 aa, Neisseria gonorrhoeae
MAGHTGQGVDFQQIEFAVGIFEEIDAHAAFRTDCLCAANRQFAHQAFFGFGQIFRRTLINGVVSVVLGFVVVKLGCGDDVYAGQPFAVQDGAGIFAAADKTFGNDFAPEGVSILRKRFSDGLFL

SEQ ID NO: 335 - DNA, 374 bp, Neisseria meningitidis
atggctcgtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcaaatcttccgaaggacattgataaatggtgtcgtcgcggttgtacttggcttcgtagtcgtaaaactcggttgcgggaatgatgtgtatgccgggcagccctttgccgttcaggacggggcaggaatattcgccgccgccgataaaacgttcggcaatgatttcgccctgaaggtgtttcaattcttcgtaaacgcttttcagacggccttttcctttga

SEQ ID NO: 336 - protein, 124 aa, Neisseria meningitidis
  misc_feature (108)..(108): Xaa can be any naturally occurring amino acid
MARHTGQGVDFQQIEFAVGIFEEIDAHAAFRTDCLRAANRQFAHQAFFGFGQIFRRTLINGVVAVVLGFVVVKLGCGNDVYAGQPFAVQDGAGIFAAADKTFGNDFAXEGVSILRKRFSDGLFL

SEQ ID NO: 337 - DNA, 374 bp, Neisseria meningitidis
atggccggtcataccgggcagggtgttgatttccaacagatagagtttgccgtcggtatctttgaggaaatcgacgcgcacgcagccttccgcaccgattgcctgcgcgccgcgaaccgccagttcgcgcatcaggctttcttcggcttcggtcagatcttccgaaggacattgataaatggtgtcgttgcggttgtacttggcttcgtagtcataaaactcggtcgcggggatgatgtgtatgccgggcaggcctttgccgttcaacacagggcaggaatattcgccgccgccgataaaccgttcggcaatgatttcgccctgaaagtgtttcaattcttcgtaaacgcttttcagacggccttttcctttga

SEQ ID NO: 338 - protein, 124 aa, Neisseria meningitidis
  misc_feature (108)..(108): Xaa can be any naturally occurring amino acid
MAGHTGQGVDFQQIEFAVGIFEEIDAHAAFRTDCLRAANRQFAHQAFFGFGQIFRRTLINGVVAVVLGFVVIKLGRGDDVYAGQAFAVQHRAGIFAAADKPFGNDFAXESVSILRKRFSDGLFL

SEQ ID NO: 339 - DNA, 1311 bp, Neisseria gonorrhoeae
atggatatttcaaaacaaacattgctggatagggtttttaacctgaaggcaaacggtacgacggtacgtaccgagttgatggcgggtttgacgacctttttgacgatgtgctacatcgttatcgtcaatcccctgattttgggcgagaccggaatggatatgggggcggtattcgtcgctacctgtatcgcatccgccatcggctgttttgtcatgggttttatcggcaactatccgattgcgcttgccccggggatggggctgaatgcctatttcacctttgccgtcgttaagggtatgggcgtgccttggcaggtggcgttgggtgcggtgttcatttccggtctgattttcatcctgttcagcttttttaaagtcagggaaatgctggtcaacgcactgcctatgggtttgaaaatgtcgattgccgccggtatcggtttgtttttggcactgatttccctgaaaggcgcaggcattatcgttgccaatccggcaaccttggtcggcttgggcgatattcatcagcccagcgcactgttggcattgttcggttttgtcatggtggtcgtattggggtatttccgcgttcaaggcgcaatcatcatcaccattctgacgattaccgtcattgccagcctgatgggtttgaacgagtttcacggcgtggtcggcgaagtaccgggcattgcgccgacctttatgcagatggattttaaaggtctgtttaccgtcagcatggtcagcgtgattttcgtcttcttcttggtcgatttgttcgacagtaccggaacgctggtcggcgtatcccaccgtgccggactgctggtggacggtaagctgccccgcctgaaacgcgcactgcttgcagactctaccgccattgtggcaggtgcggctttgggtacttcttcaaccacgccttatgtggaaagcgcggcgggcgtatcggcaggcggacggaccggcctgacggcggttaccgtcggcgtattgatgctggcgtgtctgatgttctccccattggcgaaaagtgttccggtatttgccaccgcgcccgcactgctttatgtcggcacgcagatgctccgcagtgcgagggacattgattgggacgatatgactgaagccgcgcccgcgttcctgaccattgtcttcatgccgtttacctattcgattgcagacggcatcgccttcggcttcatcagctatgccgtggtcaaacttttgtgtcgccggactggggacgtgccgcctatggtatgggttgttgccgtattgtgggcattgaaattctggtatttgggctga

SEQ ID NO: 340 - protein, 436 aa, Neisseria gonorrhoeae
MDISKQTLLDRVFNLKANGTTVRTELMAGLTTFLTMCYIVIVNPLILGETGMDMGAVFVATCIASAIGCFVMGFIGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFVMVVVLGYFRVQGAIIITILTITVIASLMGLNEFHGVVGEVPGIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPVFATAPALLYVGTQMLRSARDIDWDDMTEAAPAFLTIVFMPFTYSIADGIAFGFISYAVVKLLCRRTGDVPPMVWVVAVLWALKFWYLG

SEQ ID NO: 341 - DNA, 1311 bp, Neisseria meningitidis
atggacacttcaaaacaaacactgttggacgggatttttaagctgaaggcaaacggtackacggtgcgtaccgagttgatggcgggtttgacaacttttttgacgatgtgctacatcgttatcgtcaaccctcygattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgatttttatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggtttgggcgatattcatcagccgtccgcgttgttggcattgttcggttttgctatggtggtcgtattgggacatttccgcgttcaaggcgcaatcatcatcaccatcttgaccattaccgtcattgccagcctgatgggtttgaatgaatttcacggcatcatcggcgaagtaccgagcattgcgccgacttttatgcagatggattttgaaggcctgtttaccgtcagcatggtcagtgtgattttcgtcttcttcttggtcgatctatttgacagtaccggaacgctggtcggcatatcccaccgtgccgggctgctggtggacggtaagctgccccgcctgaaacgcgcactgcttgcagactctaccgccattgtggcaggtgcggctttgggtacttcttccaccacgccttatgtggaaagcgcggcgggcgtatcggcaggcggacggaccggcctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggatattgattgggacgatatgacggaagccgcacctgcgttcctgaccattgttttcatgccgtttacttattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 342 - protein, 436 aa, Neisseria meningitidis
  misc_feature (45)..(45): Xaa can be any naturally occurring amino acid
MDTSKQTLLDGIFKLKANGTTVRTELMAGLTTFLTMCYIVIVNPXILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFEGLFTVSMVSVIFVFFLVDLFDSTGTLVGISHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 343 - DNA, 1311 bp, Neisseria meningitidis
atggacacttcaaaacaaacactgttggacgggatttttaagctgaaggcaaacggtacgacggtgcgtaccgagttgatggcgggtttgacaacttttttgacgatgtgctacatcgttatcgtcaaccctctgattttgggcgagaccggcatggatatgggggcggtattcgtcgctacctgtatcgcgtctgccatcggctgttttgttatgggttttgtcggcaactatccgattgcactcgcaccggggatggggctgaatgcctatttcacctttgccgtcgttaagggtatgggcgtgccttggcaggttgcgttgggtgcggtgttcatctccggtctgattttcatcctgttcagcttttttaaagtcagggaaatgctggtcaacgcactgcctatgggtttgaaaatgtcgattgctgccggtatcggtttgtttttggcactgatttccctgaaaggcgcaggcattatcgttgccaatccggcaaccttggtcggcttgggcgatattcatcagccgtccgcgttgttggcactgttcggttttgccatggtggtcgtattgggacatttccgcgttcaaggcgcaatcatcatcaccattttgacgattaccgtcattgccagcctgatgggtttgaacgaatttcacggcatcatcggcgaagtgccgagcattgcgccgacttttatgcagatggattttaaagggttgtttaccgtcagcatggtcagcgtgattttcgtctttttcctagtcgatctgttcgacagtaccggaacactggtcggtgtatcgcatcgtgccggactgctggtggacggtaagctgccccgcctgaaacgcgcactgcttgcagactctaccgctattgtggcaggtgcggctttgggtacttcttcaaccacgccttatgtggaaagtgcggcgggcgtatcggcaggcgggcggacaggtctgacggcggttaccgtcggcgtattgatgctcgcctgcctgatgttttcacctttggcgaaaagtgttcccgcttttgccaccgcgcccgccctgctttatgtcggcacgcagatgctccgcagtgcgagggacatcgattgggacgatatgacggaagccgcacccgcattcctgaccattgtcttcatgccgtttacctattcgattgcagacggcatcgctttcggcttcatcagttatgccgtggttaaacttttatgccgccgcaccaaagacgttccgcctatggtatggattgttgccgtattgtgggcactgaaattctggtatttgggctga

SEQ ID NO: 344 - protein, 436 aa, Neisseria meningitidis
MDTSKQTLLDGIFKLKANGTTVRTELMAGLTTFLTMCYIVIVNPLILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 345 - DNA, 378 bp, Neisseria gonorrhoeae
atgaccgccgacggtctcttcgtcgctttcaacttcaatacgtttgccgttgtgcgaatattgataccagtacagcaggatgctgcccaggctggcgatcagtttgtcggcgatgtcgcgcgcttcgctgtcgggatggctttcgcgttcgggatgaacgcagccgagcatggacacgccggtacgcatcacgtccatcggatgggtatgtgcaggcaggctttccaaaactttaatcacacggataggcaggccgcgcatggatttgagcttggttttataagcggccagctcgaatttgttgggcagatggccgtgaatcagcaagtgtgcgacttcttcaaactcgcatttttgtgccaaattagaatgtcgtaa

SEQ ID NO: 346 - protein, 125 aa, Neisseria gonorrhoeae
MTADGLFVAFNFNTFAVVRILIPVQQDAAQAGDQFVGDVARFAVGMAFAFGMNAAEHGHAGTHHVHRMGMCRQAFQNFNHTDRQAAHGFELGFISGQLEFVGQMAVNQQVCDFFKLAFLCQIRMS

SEQ ID NO: 347 - DNA, 378 bp, Neisseria meningitidis
atgaccgccgatggtctcttcgtcgctttcaacctcaatgcgtttgccgttgtgcgaatattgataccagtacaagaggatgctgccgaggctggcgatcagtttgtcggcgatgtcgcgcgcttcactttccggatggctttcacgttcaggatgaacgcagcccagcatggatacgccggtacgcattacgtccatcggatgggtatgtgcaggcaggctttccaaaactttaatcacacggataggcaggccgcgcatggatttgagcttggttttataagcggccagctcgaatttgttgggcagatggccgtgaatcagcaggtgggcgacttcttcaaactcgcatttttgtgccaaatcagaatgtcgtaa

SEQ ID NO: 348 - protein, 125 aa, Neisseria meningitidis
MTADGLFVAFNLNAFAVVRILIPVQEDAAEAGDQFVGDVARFTFRMAFTFRMNAAQHGYAGTHYVHRMGMCRQAFQNFNHTDRQAAHGFELGFISGQLEFVGQMAVNQQVGDFFKLAFLCQIRMS

SEQ ID NO: 349 - DNA, 378 bp, Neisseria meningitidis; identical to SEQ ID NO: 347

SEQ ID NO: 350 - protein, 125 aa, Neisseria meningitidis; identical to SEQ ID NO: 348

SEQ ID NO: 351 - DNA, 1920 bp, Neisseria gonorrhoeae
atgctgggacgcgcgtccatgatgcgcctgcccgatattgtcggcgtggagctgacgggcaaacggcaggcgggcattactgccacagacatcgtgttggcactgaccgaattcttgcgtaaagagcgcgtggtcggggcgtttgtcgaatttttcggcgagggcgcgagaagcctgtctatcggcgaccgcgcgaccatttccaacatgacgccggagttcggcgcgactgccgccatgttcgccatcgacgcgcaaactattgattatttgaaactgaccggacgtgacgacgcgcaggtgaaattggtggaaacctacgccaaaaccgcaggcttatgggcaggtggcttgaaaaccgccgtttatccgcgcgttttgaaatttgatttgagcagcgtaacgcgcaatatggcaggcccgagcaacccgcacgcgcgttttgccaccgccgatttggcggcgaaagggctggcgaagccttacgaagagccttcagacggccaaatgcctgacggtgcagtgattattgccgcgattacttcgtgtaccaatacttccaacccgcgcaacgttgtcgccgccgcactgttggcacgcaatgccaaccgcctcggcttgaaacgcaaaccttgggtgaaatcttcgtttgccccgggttcaaaagtagccggaatctatttgaaagaagcaggcttgttgcccgaaatggaaaaactcggcttcggtatcgtcgccttcgcatgtaccacctgtaacggcatgagcggcgcgctcgacccgaaaatccaacaagaaatcatcgaccgcgatttgtacgccaccgccgtattgtcaggcaaccgcaacttcgacggccgtatccatccgtatgcgaaacaggctttcctcgcttcgcctcctttggtcgttgcctacgcattggcaggtagcatccgtttcgatattgaaaacgacgtactcggcgttgcagacggccgcgaaatccgcctgaaagatatctggccgacagacgaagaaatcgatgccatcgttgccgaatatgtgaaaccgcaacaattccgcgacatttatatcccgatgtccgacaccggcacagcgcaaaaagcaccaagcccgctgtacgactggcgaccgatgtccacctacatccgccgtccgccctattgggaaggcgcactggcaggggaacgtacattaagaggtatgcgtccgccggcgattttgcccgacaacatcaccaccgaccacatctcgccatccaatgcgattttggccggcagtgccgcaggtgaatatttggcgaaaatgggtttgcctgaagaagacttcaactcttacgcaacccaccgcggcgaccacttgaccgcccaacgcgcaaccttcgccaatccgaaactgtttaacgaaatggtgagaaacgaagacggcagcgtacgccaaggttcgttggcacgcgttgaaccagaaggccaaaccatgcgcatgtgggaagccatcgaaacctatatgaaccgcaaacagccgcttatcatcattgccggtgcggactatggtcaaggctcaagccgcgactgggcggcgaagggcgtgcggctggcgggtgtggaagccatcgccgccgaaggtttcgagcgcatccaccgcaccaacctcatcggcatgggcgtcttgccgctgcaattcaaacccggcaccaaccgccataccctgcaactggacggtacggaaacctacgacgttgtcggcgaacgcacaccgcgctgcggcctgaccctcgtgattcaccgtaaaaacggagaaaccgtcgaagttccggttacctgccgccccgataccgcagaagaagcattggtatatgaagccggcggcgtattgcaacggtttgcacaggactttttggaagggaacgcggcttag

SEQ ID NO: 352 - protein, 639 aa, Neisseria gonorrhoeae
MLGRASMMRLPDIVGVELTGKRQAGITATDIVLALTEFLRKERVVGAFVEFFGEGARSLSIGDRATISNMTPEFGATAAMFAIDAQTIDYLKLTGRDDAQVKLVETYAKTAGLWAGGLKTAVYPRVLKFDLSSVTRNMAGPSNPHARFATADLAAKGLAKPYEEPSDGQMPDGAVIIAAITSCTNTSNPRNVVAAALLARNANRLGLKRKPWVKSSFAPGSKVAGIYLKEAGLLPEMEKLGFGIVAFACTTCNGMSGALDPKIQQEIIDRDLYATAVLSGNRNFDGRIHPYAKQAFLASPPLVVAYALAGSIRFDIENDVLGVADGREIRLKDIWPTDEEIDAIVAEYVKPQQFRDIYIPMSDTGTAQKAPSPLYDWRPMSTYIRRPPYWEGALAGERTLRGMRPPAILPDNITTDHISPSNAILAGSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIAAEGFERIHRTNLIGMGVLPLQFKPGTNRHTLQLDGTETYDVVGERTPRCGLTLVIHRKNGETVEVPVTCRPDTAEEALVYEAGGVLQRFAQDFLEGNAA

SEQ ID NO: 353 - DNA, 1920 bp, Neisseria meningitidis
atgctgggacgcgcgtccatgatgcgcctgcccgatattgtcggcgttgagctgaacggcaaacggcaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatcctcgcgttttgaaatttgatttgagcagcgtaacgcgcaatatggcaggcccaagtaacccgcatgcccgttttgcgaccgccgatttggcggcgaaagggctggcgaagccttacgaagagccttcggacggccaaatgcccgacggctcggtcatcatcgccgcgattaccagttgcaccaacacttccaacccgcgcaacgttgttgccgccgcgctcttggcacgcaatgccaaccgtctcggcttgaaacgcaaaccttgggtgaaatcttcgtttgccccgggttcaaaagtagccgaaatctatttgaaagaagcgggcctgttgcccgaaatggaaaaactcggcttcggtatcgtcgccttcgcctgcaccacctgcaacggcatgagtggcgcgctggatccgaaaatccagaaagaaatcatcgaccgcgatttgtacgccaccgccgtattatcaggcaaccgcaacttcgacggccgtatccacccgtatgcgaaacaggctttcctcgcttcgcctccgttggtcgttgcctacgcgctggcaggcagtatccgtttcgatattgaaaacgacgtactcggcgttgcagacggcaaggaaatccgcctgaaagacatttggcctgccgatgaagaaatcgatgccgtcgttgccgaatatgtgaaaccgcagcagttccgcgatgtgtatgtaccgatgttcgacaccggcacagcgcaaaaagcacccagtccgctgtacgattggcgtccgatgtccacctacatccgccgtccgccttactgggaaggcgcgctggcaggggaacgcacattaagaggtatgcgtccgctggcgattttgcccgacaacatcaccaccgaccacctctcgccgtccaatgcgattttggccgtcagtgccgcaggcgagtatttggcgaaaatgggtttgcctgaagaagacttcaactcttacgcaacccaccgcggcgaccacttgaccgcccaacgcgctaccttcgccaatccgaaactgtttaacgaaatggtgaaaaacgaagacggcagcgtgcgccaaggctcgttcgcccgcgtcgaacccgaaggcgaaaccatgcgcatgtgggaagccatcgaaacctatatgaaccgcaaacagccgctcatcatcattgccggtgcggactatggtcaaggctcaagccgcgactgggctgcaaaaggcgtacgcctcgccggcgtagaagcgattgttgccgaaggcttcgagcgtatccaccgcaccaaccttatcggcatgggcgtgttgccgctgcagttcaaacccgacaccaaccgccataccctgcaactggacggtacggaaacctacgacgtggtcggcgaacgcacaccgcgctgcgacctgaccctcgtgattcaccgtaaaaacggcgaaaccgttgaagttcccgttacctgctgcctcgatactgcagaagaagtattggtatatgaagccggcggcgtgttgcaacggtttgcacaggattttttggaagggaacgcggcttag

SEQ ID NO: 354 - protein, 639 aa, Neisseria meningitidis
MLGRASMMRLPDIVGVELNGKRQAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAAKGLAKPYEEPSDGQMPDGSVIIAAITSCTNTSNPRNVVAAALLARNANRLGLKRKPWVKSSFAPGSKVAEIYLKEAGLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPADEEIDAVVAEYVKPQQFRDVYVPMFDTGTAQKAPSPLYDWRPMSTYIRRPPYWEGALAGERTLRGMRPLAILPDNITTDHLSPSNAILAVSAAGEYLAKMGLPEEDFNSYATHRGDHLTAQRATFANPKLFNEMVKNEDGSVRQGSFARVEPEGETMRMWEAIETYMNRKQPLIIIAGADYGQGSSRDWAAKGVRLAGVEAIVAEGFERIHRTNLIGMGVLPLQFKPDTNRHTLQLDGTETYDVVGERTPRCDLTLVIHRKNGETVEVPVTCCLDTAEEVLVYEAGGVLQRFAQDFLEGNAA

SEQ ID NO: 355 - DNA, 1920 bp, Neisseria meningitidis
atgctgggacgcgcgtccatgatgcgcctgcccgatattgtcggcgttgagctgaacggcaaacggaaggcgggcattacggcgacggatattgtgttggcactgaccgagtttctgcgcaaagaacgcgtggtcggggcgtttgtcgaattcttcggcgagggcgcgagaagcctgtctatcggcgaccgcgcgaccatttccaacatgacgccggagttcggcgcgactgccgcgatgttcgctattgatgagcaaaccattgattatttgaaactgaccggacgcgacgacgcgcaggtgaaattggtggaaacctacgccaaaaccgcaggcttgtgggcagatgccttgaaaaccgccgtttatccgcgcgttttgaaatttgatttgagcagcgtaacgcgcaatatggcaggcccgagcaacccgcacgcgcgttttgcgaccgccgatttggccggcaaaggcttggctaaaccttacgaagagccttcagacggccaaatgcctgacggtgcagtgattattgccgcgattacttcctgtaccaatacttccaatccgcgcaacgttgtcgccgccgcgctgttggcacgcaatgccaaccgcctcggcttgcaacgcaaaccttgggtgaaatcttcgtttgccccgggttcaaaagtagccgaaatctatttgaaagaagcagatctgctgcccgaaatggaaaaactcggcttcggtatcgttgccttcgcatgtaccacctgtaacggcatgagcggcgcgctggatccgaaaatccagaaagaaatcatcgaccgcgatttgtacgccaccgccgtattgtcaggcaaccgcaactttgacggccgtatccatccgtatgcgaaacaggctttcctcgcttcgcctccgttggtcgttgcctacgcgctggcaggcagcatccgtttcgatattgaaaacgacgtactcggcgttgcagacggcaaagaaatccgcctgaaagacatttggcctaccgatgaagaaatcgatgccatcgttgccgaatatgtgaaaccgcagcaatttcgcgacgtttatatcccgatgttcgacaccggcacagcgcaaaaagcaccaagcccgctgtacgactggcgtccaatgtctacctatatccgccgcccaccttactgggaaggcgcactggcaggggaacgcacattaagcggtatgcgtccgctggcgattttgcccgacaacatcaccaccgaccatctctcgccatccaatgcgattttggcaagcagtgccgcaggcgaatatttggcaaaaatgggtttgcctgaagaagacttcaactcttacgcaacccaccgtggcgaccacttgaccgcccaacgcgcaaccttcgccaatccgaaactgtttaacgaaatggtgagaaacgaagacggcagcgtacgccaaggttcgctggcacgcgttgaacccgaaggccaaaccatgcgcatgtgggaagccatcgaaacctatatgaaccgcaaacagccgctcatcatcattgccggcgcggactacggtcaaggctcaagccgcgactgggctgcaaaaggcgtacgcctcgccggcgtggaagcgattgttgccgaaggcttcgagcgtatccaccgcaccaacttgatcggtatgggcgtgttgccgctgcagttcaaaccgggtaccaaccgccacaccctgcaactggacggtacggaaacctacgacgttgtcggcgaacgcacaccgcgctgcgacctgacccttgtgattcaccgtaaaaacggcgagaccgtcgaagtccccattacctgccgcctcgataccgcagaagaagtgttggtatatgaagccggtggcgtattgcaacggtttgcacaggattttttggaagggaacgcggcttag

SEQ ID NO: 356 - protein, 639 aa, Neisseria meningitidis
MLGRASMMRLPDIVGVELNGKRKAGITATDIVLALTEFLRKERVVGAFVEFFGEGARSLSIGDRATISNMTPEFGATAAMFAIDEQTIDYLKLTGRDDAQVKLVETYAKTAGLWADALKTAVYPRVLKFDLSSVTRNMAGPSNPHARFATADLAGKGLAKPYEEPSDGQMPDGAVIIAAITSCTNTSNPRNVVAAALLARNANRLGLQRKPWVKSSFAPGSKVAEIYLKEADLLPEMEKLGFGIVAFACTTCNGMSGALDPKIQKEIIDRDLYATAVLSGNRNFDGRIHPYAKQAFLASPPLVVAYALAGSIRFDIENDVLGVADGKEIRLKDIWPTDEEIDAIVAEYVKPQQFRDVYIPMFDTGTAQKAPSPLYDWRPMSTYIRRPPYWEGALAGERTLSGMRPLAILPDNITTDHLSPSNAILASSAAGEYLAKMGLPEEDFNSYATHRGDHLTAQRATFANPKLFNEMVRNEDGSVRQGSLARVEPEGQTMRMWEAIETYMNRKQPLIIIAGADYGQGSSRDWAAKGVRLAGVEAIVAEGFERIHRTNLIGMGVLPLQFKPGTNRHTLQLDGTETYDVVGERTPRCDLTLVIHRKNGETVEVPITCRLDTAEEVLVYEAGGVLQRFAQDFLEGNAA

SEQ ID NO: 357 - DNA, 1245 bp, Neisseria gonorrhoeae
atgtccgccaaaactccgtcgctcttcggcggcgcgatgattatcgccgggaaggttatcggcgcaggtatgttccccaaccccaccgccaacttgggggacgggttaataggctcgctgattgtgctgctgtacacctggtttccattctcctccggcgccctcatgattttggaagtcaacacccataacccccgaggggcaagttttgacaccatggtcaaagacctgctcggacgcggctggaacatcatcaacggcatcgccgtcgctttggtcctatacggctcgacctacgcgtacattttagtcggcggtgacctgaccgccaaaggcatcggcagcgcagtaggcggcaaaatttcgctcaccgtcggacaactcgtcttcttcggcatcctcgccttttgcgtatgggcatccgcacgcttggtcgaccgctttaccggcgtcctcatcggcggcatggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccgacatcttcaaatggaacgacagtatgtccgggcggggcaccaaaaccgtcgcgctgaacttcctgccgcccctgatttcctggctgctcctccccaccggcttctttaccgccattggtgcgtccggcctggcggcaaccgtctgggaccaaggcatcatccccgccatgctgctctacgtttccccccaaaaaattggcgcaggcaagacttataaagtttacggcggcttgtggctgatgttagtcttccttttcggcatcgccaacatcgccgcacaggtattgagccaaatggaactcgtccccgtatttaaaggataa

SEQ ID NO: 358 - protein, 414 aa, Neisseria gonorrhoeae
MSAKTPSLFGGAMIIAGKVIGAGMFPNPTANLGDGLIGSLIVLLYTWFPFSSGALMILEVNTHNPRGASFDTMVKDLLGRGWNIINGIAVALVLYGSTYAYILVGGDLTAKGIGSAVGGKISLTVGQLVFFGILAFCVWASARLVDRFTGVLIGGMVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIADIFKWNDSMSGRGTKTVALNFLPPLISWLLLPTGFFTAIGASGLAATVWDQGIIPAMLLYVSPQKIGAGKTYKVYGGLWLMLVFLFGIANIAAQVLSQMELVPVFKG

SEQ ID NO: 359 - DNA, 1242 bp, Neisseria meningitidis
atgcccaacaaaaccccttcactgttcggcggcgcgatgattatcgccggcacggtcatcggcgcaggcatgctcgccaacccgaccgccacatccggcgtatggtttaccggctcgctggccgtgttgctgtacacctggttttctatgctttccagcggcctgatgattttggaagtcaacacccattatccgcacggcgcaagtttcgacacgatggtcaaagacctgctcggacgcggctggaacatcatcaacggcatcgccgtcgccttcgttttatacctgcttacttacgcttatatcttcgtcggcggcgacctgaccgccaaaggcttaggcagcgcggcaggcggcgacgtttcactcaccgtcggacaactcgtcttcttcggcatcctcgccttttgcgtatgggcatccgcacgcttggtcgaccgcttcaccggcgtccttatcggcggcatggtattgacctttatttgggcggccggcgggctgattgccgatgccaagccgtccgtcctcttcgatacccaagcccccgccggcacaaactactggatttacgccgccaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcatctccggccgcaccaaaaccgccgcgctgaccttcctgccgcccctgatttcctgcctgctcttccccaccggcttcgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 360 - protein, 413 aa, Neisseria meningitidis
MPNKTPSLFGGAMIIAGTVIGAGMLANPTATSGVWFTGSLAVLLYTWFSMLSSGLMILEVNTHYPHGASFDTMVKDLLGRGWNIINGIAVAFVLYLLTYAYIFVGGDLTAKGLGSAAGGDVSLTVGQLVFFGILAFCVWASARLVDRFTGVLIGGMVLTFIWAAGGLIADAKPSVLFDTQAPAGTNYWIYAATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSISGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 361 - DNA, 1242 bp, Neisseria meningitidis
  misc_feature (55)..(55): n is a, c, g, or t
  misc_feature (206)..(206): n is a, c, g, or t
  misc_feature (736)..(736): n is a, c, g, or t
  misc_feature (796)..(796): n is a, c, g, or t
  misc_feature (991)..(991): n is a, c, g, or t
  misc_feature (1038)..(1038): n is a, c, g, or t
  misc_feature (1092)..(1092): n is a, c, g, or t
  misc_feature (1183)..(1183): n is a, c, g, or t
  misc_feature (1200)..(1200): n is a, c, g, or t
atgcccaccaaaaccccttcactgttcggcggcgcgatgattatcgccggcacgntcatcggcgcaggtatgctcgccaacccgaccgccacatccggcgtatggtttaccggctcgctggccgtgttgctgtacacctggttttccatgctctccagcggcctgatgattttggaagtcaacacccactacccccacggcgcgancttcgacaccatggttaaagacctgctcggacggagctggaacatcatcaacggcatcgccgtcgccttcgttttatacctgcttacttacgcttatatcttcgtcggcggcgacctgaccgccaaaggcttaggcagcgcggcaggcggcaatgtttcactcaccgtcggacaactcgtcttcttcggcattctcgccttttgcgtatgggcatccgcacgcttggtcgaccgattcaccagcgtcctcatcggcggcatggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaangcaacctgccgcgcaacgagttcgcccccgtgattgccgccgaagggcaagtctccgtcntgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctntaatttcctgcctgctcttccccaccggctttgttaccgccatcggntacgtcggcctggcggcaaccgtctggacaggcatcatccccgccatgctgctntaccgttcgcgcaaaaaattcggcgcaggcaaaacctataaagtttacggcggcttgtggctgatggtttgggtcttccttttcggcatcntcaacatcgccgcacangtattgagccaaatggaactcgtccccgtatttaaaggataa

SEQ ID NO: 362 - protein, 413 aa, Neisseria meningitidis
  misc_feature (19)..(19): Xaa can be any naturally occurring amino acid
  misc_feature (69)..(69): Xaa can be any naturally occurring amino acid
  misc_feature (246)..(246): Xaa can be any naturally occurring amino acid
  misc_feature (266)..(266): Xaa can be any naturally occurring amino acid
  misc_feature (331)..(331): Xaa can be any naturally occurring amino acid
  misc_feature (395)..(395): Xaa can be any naturally occurring amino acid
  misc_feature (400)..(400): Xaa can be any naturally occurring amino acid
MPTKTPSLFGGAMIIAGTXIGAGMLANPTATSGVWFTGSLAVLLYTWFSMLSSGLMILEVNTHYPHGAXFDTMVKDLLGRSWNIINGIAVAFVLYLLTYAYIFVGGDLTAKGLGSAAGGNVSLTVGQLVFFGILAFCVWASARLVDRFTSVLIGGMVLTFIWATGGLIADAKLPVLFDTQAPTGTNYWIYVATALPVCLASFGFHGNVSSLLKYFKGDAPKVAKSIWTGTLIALVIYVLWQTAIQXNLPRNEFAPVIAAEGQVSVXIETLSKFAQTGNMDKILSLFSYMAIATSFLGVTLGLFDYIADIFKWNDSVSGRTKTAALTFLPPXISCLLFPTGFVTAIGYVGLAATVWTGIIPAMLLYRSRKKFGAGKTYKVYGGLWLMVWVFLFGIXNIAAXVLSQMELVPVFKG

SEQ ID NO: 363 - DNA, 870 bp, Neisseria gonorrhoeae
atgtccgcagaaacatacacacaaatcggctgggtaggcttagggcaaatgggtctgcctatggtaacgcggctcttggacggcggcatcgaagtcggcgtatacaaccgctcgcccgacaaaactgcccccatctccgccaaaggagcaaaagtttacggcagcaccgccgaactcgtccgcgcctgccccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcggacccgccaccaacggcacactgctgattctgttcggcggcagcgaagccgttttaaacccgctgcaaaaaatattttcccttgtcggcaaaaaaaccttccatttcggcgatgtcggcaaaggctcgggcgcgaaactcgtcttgaactcgctcttaggcattttcggcgaagcgtacagcgaagcgatgctgatggcgcggcagttcggcatcgataccgacaccatcgtcgaagccatcggcggctcggcaatggactcgcctatgtttcaaacaaaaaaatcactatgggcaaaccgtgagttcccccctgcctttgcactcaaacacgcttccaaagaccttaacctcgccgtcaaagagcttgaacaggcaggcaacaccctgcccgccgtcgaaaccgttgctgccagctaccgcaaagcagttgaagccggctacggcgaacaggacgtttccggcgtttacctgaaattggcagaacactga

SEQ ID NO: 364 - protein, 289 aa, Neisseria gonorrhoeae
MSAETYTQIGWVGLGQMGLPMVTRLLDGGIEVGVYNRSPDKTAPISAKGAKVYGSTAELVRACPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 365 - DNA, 864 bp, Neisseria meningitidis
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaamatcatcgtcaacatgagcaccatctccccgaccgaaaagctcgccgtcaaagcacttgtcgaagcgcagmgacagtttgccgaagcacccgtttccggatcggtcgggcccgccaccaacggcacgctgctgattctgttcggcggcagcgaaccgttttaaacccgctgcaaaaaatattttccctcgtcggcaaaaaaaccttccatttcggcgatgtcggcaaaggttcgggcgcgaaactcgtcttgaactcgctcttgggcattttcggcgaacgtacagcgaasgmtgctgatggcgcggcagttcggcatcgataccgacaccatcgtcgaagccatcggsgactcggcaatggactcgcccatgttccaaaccaaaaaatccctgtgggcaaaccgcgaattcccgmccgmcttcgccctcaaacacgcctccaaagacctcaacctcgccgtcaaagagcttgaacaggcaggcaacaccctgcccgccgtcgaaaccgttgctgccagctaccgcaaagcagtcgaagccggctacgggacacaggacgtttccggcgtttacctgaaactggcagaacactga

SEQ ID NO: 366 - protein, 287 aa, Neisseria meningitidis
  misc_feature (90)..(90): Xaa can be any naturally occurring amino acid
  misc_feature (144)..(144): Xaa can be any naturally occurring amino acid
  misc_feature (174)..(174): Xaa can be any naturally occurring amino acid
  misc_feature (187)..(188): Xaa can be any naturally occurring amino acid
  misc_feature (229)..(230): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGXIIVNMSTISPTEKLAVKALVEAQRQFAEAPVSGSVGPATNGTLLILFGGSEPFXTRCKKYFPSSAKKPSISAMSAKVRARNSSXTRSWAFSANVQRXXLMARQFGIDTDTIVEAIGDSAMDSPMFQTKKSLWANREFPXXFALKHASKDLNLAVKELEQAGNTLPAVETVAASYRKAVEAGYGTQDVSGVYLKLAEH

SEQ ID NO: 367 - DNA, 870 bp, Neisseria meningitidis
atgtccgcaaacgaatacacacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaagcgatgctgatggcgcggcagttcggcatcgataccgacaccatcgtcgaagccatcggcggctcggcaatggactcgcccatgttccaaaccaaaaaatccctgtgggcaaaccgcgaattcccacccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaattggcagaacactga

SEQ ID NO: 368 - protein, 289 aa, Neisseria meningitidis
MSANEYTQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 369 - DNA, 870 bp, Neisseria gonorrhoeae; identical to SEQ ID NO: 363

SEQ ID NO: 370 - protein, 289 aa, Neisseria gonorrhoeae; identical to SEQ ID NO: 364

SEQ ID NO: 371 - DNA, 870 bp, Neisseria meningitidis
  misc_feature (565)..(565): n is a, c, g, or t
atgtccgcaaacgaatacgcacaaatcggctggataggcttagggcaaatgggtctgcctatggtaacgcggctcttggacggcggcatcgaagtcggcgtatacaaccgctcgcccgacaaaactgcccccatctccgccaaaggcgcaaaagtttacggcaacaccgccgaactcgtccgcgactatcccgtcattttcctgatggtttccgactatgccgccgtgtgcgacatcctgaacggagtccgcgacggattggccggcaaaatcatcgtcaacatgagcaccatctccccgaccgaaaacctcgccgtcaaagcacttgtcgaagccgcaggcggacagtttgccgaagcacccgtttccggatcggtcgggcccgccaccaacggcacgctgctgattctgttcggcggcagcgaagccgttttaaacccgctgcaaaaaatattttccctcgtcggcaaaaaaaccttccatttcggcgatgtcggcaaaggttcgggcgcgaaactcgtcttgaactcgctcttgggcattttcggcgaagcgtacagcgaancgatgctgatggcgcggcagttcggcatcgataccgacaccatcgtcgaagccatcggsgactcggcaatggactcgcccatgttccaaaccaaaaaatccctgtgggcaaaccgcgaattcccgcccgccttcgccctcaaacacgcctccaaagacctcaacctcgccgtcaaagagcttgaacaggcaggcaacaccctgcccgccgtcgaaaccgttgctgccagctaccgcaaagcagtcgaagccggctacggcgaacaggacgtttccggcgtttacctgaaactggcagaacactga

SEQ ID NO: 372 - protein, 289 aa, Neisseria meningitidis
  misc_feature (189)..(189): Xaa can be any naturally occurring amino acid
MSANEYAQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEXMLMARQFGIDTDTIVEAIGDSAMDSPMFQTKKSLWANREFPPAFALKHASKDLNLAVKELEQAGNTLPAVETVAASYRKAVEAGYGEQDVSGVYLKLAEH

SEQ ID NO: 373 - DNA, 870 bp, Neisseria meningitidis; identical to SEQ ID NO: 367

SEQ ID NO: 374 - protein, 289 aa, Neisseria meningitidis; identical to SEQ ID NO: 368

SEQ ID NO: 375 - DNA, 513 bp, Neisseria gonorrhoeae
atggtattaacctttatttgggcaaccggcggcctggttgccgatgccaaaccgtccgtcctcttcgacacccaagcccccgtcggcaccggctactggatttacgccgccaccgccctgcccgtctgcctcgcttccttcggcttccacggcaacgtttccagcctgctcaaatactttaaaggcgacgcgcccaaagtggcgaaatccatctgggcaggtacattggttgccttggtaatttacgtcctctggcaaaccgccatccaaagcaacctgccgcgcaacgagttcgcccccgtgattgccgccgagaggcaactctccgtcctgaatgaaaccctgtccaaattcgcccaaaccggcgatatggataaaatattgtccctatttccctacatggcaatcgccacctcctttttaggcgtaaccttaggcctgtttgacaacatcgccggacatcttcaaatggaacgacagtatgtccgggcggcaccaaaaccgtcgcgctga

SEQ ID NO: 376 - protein, 170 aa, Neisseria gonorrhoeae
MVLTFIWATGGLVADAKPSVLFDTQAPVGTGYWIYAATALPVCLASFGFHGNVSSLLKYFKGDAPKVAKSIWAGTLVALVIYVLWQTAIQSNLPRNEFAPVIAAERQLSVLNETLSKFAQTGDMDKILSLFPYMAIATSFLGVTLGLFDNIAGHLQMERQYVRAAPKPSR

SEQ ID NO: 377 - DNA, 510 bp, Neisseria meningitidis
atggtattgacctttatttgggcggccggcgggctgattgccgatgccaagccgtccgtcctcttcgatacccaagcccccgccggcacaaactactggatttacgccgscaccgccctgcccgtctgcctcgcttccttcggcttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtcatcgccgccgaagggcaagtctccgtcctcatcgaaaccctgtccaaattcgcccaaaccggcaatatggacaaaatattgtccctgttttcctatatggcgatcgccacctcgtttttaggcgtaacgctcggactcttcgactacatcgcccatcttcaaatggaacgacagcatctccgggccgcaccaaaaccgccgcgctga

SEQ ID NO: 378 - protein, 169 aa, Neillia sinensis
  misc_feature (37)..(37): Xaa can be any naturally occurring amino acid
MVLTFIWAAGGLIADAKPSVLFDTQAPAGTNYWIYAXTALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIAHLQMERQHLRAAPKPPR

SEQ ID NO: 379 - DNA, 777 bp, Neisseria meningitidis
atggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtgattgccgccgaagggcaagtctccgtcctgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctctaatttcctgcctgctcttccccaccggctttgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 380 - protein, 258 aa, Neisseria meningitidis
MVLTFIWATGGLIADAKLPVLFDTQAPTGTNYWIYVATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSVSGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 381 - DNA, 519 bp, Neisseria gonorrhoeae
atgttgccgggcttcaaccggatattcaaacggtttgctccaacactcggaacggcgcataaaacgccgcccttcgcgttatcccgaacggggcggctaatcagatcctatcgccataaaaggcggggtttcaaccgaaaaggaattgagatgaataaaaccttgtctattttgccggcggcaatcttactcggcgggtgcgccgccggcggcaacacattcggcagcttagacggcggcacgggtatgggtggcagcatcgtcaaaatgacggtagaaagccaatgccgtgcggaattggacaggcgcagcgaatggcgtttgaccgcgctggcgatgagtgccgaaaaacaggcggaatgggaaaacaagatttgcggctgcgctaccgaagaagcacctaaccagctgaccggcaacgatgtgatgcagatgctgaaccagtccacgcgcaatcaggcacttgccgccctgaccgtcaaaacggtttccgcctgcttcaaacgcctgtaccgctaa

SEQ ID NO: 382 - protein, 172 aa, Neisseria gonorrhoeae
MLPGFNRIFKRFAPTLGTAHKTPPFALSRTGRLIRSYRHKRRGFNRKGIEMNKTLSILPAAILLGGCAAGGNTFGSLDGGTGMGGSIVKMTVESQCRAELDRRSEWRLTALAMSAEKQAEWENKICGCATEEAPNQLTGNDVMQMLNQSTRNQALAALTVKTVSACFKRLYR

SEQ ID NO: 383 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccggaggcggtaacacattcggcagcttagacggtggcacaggcatgggcggcagcatcgtcaaaatggcggttgggagccaatgccgtgcggaattggacaaacgcagcgaatggcgtttgaccgcgctggcgatgagtgccgaaaaacaggcggagtgggaaaacaagatttgcgcttgcgtcgcccaagaagcacccgaacggatgaccggcaacgatgtgatgcagatgctggctccgtccacgcgcaatcaggcacttgccgccctgaccgccaaaacggtttccgcctgcttcaaacacctgtaccgctaa

SEQ ID NO: 384 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVGSQCRAELDKRSEWRLTALAMSAEKQAEWENKICACVAQEAPERMTGNDVMQMLAPSTRNQALAALTAKTVSACFKHLYR

SEQ ID NO: 385 - DNA, 522 bp, Neisseria meningitidis
atgttgccgggcttcaaccggatattcaaacggtttgttccaacactcggaacggcgcataaaacgccgcccttcgcgttatcccgaacggggcggctaatcagattctatcgccataaaaggcggggtttcaaccgaaaaggaattgagatgaataaaaccttgtctattttgccggtggcaatcttactcggcggctgcgccgccgggggcggtaacacattcggcagcttagacggcggcacaggtatgggcggcagcatcgtcaaaatggcggtagaaagccaatgccgtgcggaattgaacaaacgcagcgaatggcgtttgaccgcgctggcgatgagtgccgaaaaacaggcggaatgggaaaacaagatttgcgcttgcgtcgcccaagaagcacccaaccagctgaccggcaacgatgtgatgcagatgctggatccgtccacgcgcaatcaggcacttgccgccctgaccgccaaaacggtttccgcctgcttcaaacacctgtaccgctaa

SEQ ID NO: 386 - protein, 173 aa, Neisseria meningitidis
MLPGFNRIFKRFVPTLGTAHKTPPFALSRTGRLIRFYRHKRRGFNRKGIEMNKTLSILPVAILLGGCAAGGGNTFGSLDGGTGMGGSIVKMAVESQCRAELNKRSEWRLTALAMSAEKQAEWENKICACVAQEAPNQLTGNDVMQMLDPSTRNQALAALTAKTVSACFKHLYR

SEQ ID NO: 387 - DNA, 369 bp, Neisseria gonorrhoeae
atgtattatcgccgggttgtggggctatccgatggacttggcgatttggcagccggtattgatcgtaggcgtatgcttaccgcttttggaagcgggcatggaaatgacgcgcaaaggcaaaaccacccaatccgccgccatcgtggtgttctcttccgtctggtcaatccggttttcggctgggcgttgacgatgctgttggataatttgggcttaatcggctgcaaagaacgcagcgcgcaattaggttttgtcggacgagtattgatacccgcagtaggtttcttaatcttgtgtgtggcgatgggtgcggtcgggatgctgcccggtatccctccgtttttggagcagttcaaatctttgggctag

SEQ ID NO: 388 - protein, 122 aa, Neisseria gonorrhoeae
MYYRRVVGLSDGLGDLAAGIDRRRMLTAFGSGHGNDAQRQNHPIRRHRGVLFRLVNPVFGWALTMLLDNLGLIGCKERSAQLGFVGRVLIPAVGFLILCVAMGAVGMLPGIPPFLEQFKSLG

SEQ ID NO: 389 - DNA, 381 bp, Neisseria meningitidis
atgtattatcgccgggttatggggctatccgatggacttggcgatttggcagccggtattgagcgtagccttggtcgtaggcgtatacttaccgcttttggaagcgggcatggaaatgacgcgcaaaggcaaaaccacccaatccgccgccatcgtggtgttctcttccgccttgtcaatccggttttcggctgggcgttgacgatgctgttggataatttgggcttaatcggctgcaaagagcgcagtgcgcaattaggtttcgccggacgcgtgttgatacccgcagtaggtttcttgatcttgtgtgtggcgatgggtgcggtcgggatgctgcccggtatcccgccgtttttggaacacttcaaatctttgggctag

SEQ ID NO: 390 - protein, 126 aa, Neisseria meningitidis
MYYRRVMGLSDGLGDLAAGIERSLGRRRILTAFGSGHGNDAQRQNHPIRRHRGVLFRLVNPVFGWALTMLLDNLGLIGCKERSAQLGFAGRVLIPAVGFLILCVAMGAVGMLPGIPPFLEHFKSLG

SEQ ID NO: 391 - DNA, 381 bp, Neisseria meningitidis
atgtattatcgccgggttgtggggctatccgatggacttggcgatttggcagccggtattgagcgtagccttggtcgtaggcgtatacttaccgcttttggaagcgggcatggaaatgacgcgcaaaggcaaaaccacccaatccgccgccaccgtggtgttctcttccgcttggtcaatccggttttcggctgggcgttgacgatgctgttggataatttgggcttaatcggctgcaaagagcgcagcgcgcaattaggtttcaccggacgcgtattgatacccgtagtaggtttcttgatcttgtgtgtggcgatgggtgcggtcgggatgctgcccggtatcccgccgtttttggagcacttcaaatctttgggctag

SEQ ID NO: 392 - protein, 126 aa, Neisseria meningitidis
MYYRRVVGLSDGLGDLAAGIERSLGRRRILTAFGSGHGNDAQRQNHPIRRHRGVLFRLVNPVFGWALTMLLDNLGLIGCKERSAQLGFTGRVLIPVVGFLILCVAMGAVGMLPGIPPFLEHFKSLG

SEQ ID NO: 393 - DNA, 372 bp, Neisseria gonorrhoeae
  misc_feature (280)..(280): n is a, c, g, or t
  misc_feature (302)..(302): n is a, c, g, or t
  misc_feature (311)..(311): n is a, c, g, or t
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggtttatacagacanatgctggagagctcttcgcgtntcatgcagnttctataactgattccgccgaagactgtctgcctaatacgcctatctcatcggcgctctga

SEQ ID NO: 394 - protein, 120 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFIQTAGELFAHASITDSAEDCLPNTPISSAL

SEQ ID NO: 395 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataycgtcaaatacctttcaaataatcgggacaaactcccctcacctgccgaaatacawaaacgcatcgatgacgcgcttaaagaaktcaaccggyagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 396 - protein, 351 aa, Neisseria meningitidis
  misc_feature (46)..(46): Xaa can be any naturally occurring amino acid
  misc_feature (64)..(64): Xaa can be any naturally occurring amino acid
  misc_feature (74)..(74): Xaa can be any naturally occurring amino acid
  misc_feature (77)..(77): Xaa can be any naturally occurring amino acid
MPSETRLPNFIRVLIFALGFIFLNACSEQTAQTVTLQGETMGTTYXVKYLSNNRDKLPSPAEIXKRIDDALKEXNRXMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 397 - DNA, 1056 bp, Neisseria meningitidis
atgccgtctgaaacacgcctgccgaactttatccgcaccttgatatttgccctgagttttatcttcctgaacgcctgttcggaacaaaccgcgcaaaccgttaccctgcaaggtgaaacgatgggcacgacctataccgtcaaatacctttcaaataatcgggacaaactcccctcacctgccgaaatacaaaagcgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccacctgaaccgcctgacacacggcgcgctggacgtaaccgtcggccccttggtcaacctttggggattcggccccgacaaatccgttacccgtgaaccgtcgccggaacaaatcaaacaagcagcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccttggcgcatcggcatcgaacagcccaacatcgtccaaggcggcaatacgcagattatcgtcccgctgaacaaccgttcgcttgccacttccggcgattaccgtattttccacgtcgataaaagcggcaaacgcctctcccatatcattaatccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 398 - protein, 351 aa, Neisseria meningitidis
MPSETRLPNFIRTLIFALSFIFLNACSEQTAQTVTLQGETMGTTYTVKYLSNNRDKLPSPAEIQKRIDDALKEVNRQMSTYQPDSEISRFNQHTAGKPLRISSDFAHVTAEAVHLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKSGKRLSHIINPNNKRPISHNLASISVVADSAMTADGLSTGLFVLGETEALKLAEREKLAVFLIVRDKGGYRTAMSSEFEKLLR

SEQ ID NO: 399 - DNA, 1056 bp, Neisseria gonorrhoeae
atgccgtctgaaacacgcctgccgaaccttatccgcgccttgatatttgccctgggtttcatcttcctgaacgcctgttcggaacaaaccgcgcaaaccgttaccctgcaaggcgaaacgatgggtacgacctataccgtcaaatacctttcaaataatcgggacaaactcccctcccctgccaaaatacaaaagcgcattgatgatgcgcttaaagaagtcaaccggcagatgtccacctaccagaccgattccgaaatcagccggttcaaccaacacacagccggcaagcccctccgcatttcaagcgatttcgcacacgttaccgccgaagccgtccgcctgaaccgcctgactcacggcgcactggacgtaaccgtcggccctttggtcaacctttgggggttcggccccgacaaatccgttacccgtgaaccgtcgccggaacaaatcaaacaggcggcatcttatacgggcatagacaaaatcattttgcaacaaggcaaagattacgcttccttgagcaaaacccaccccaaagcctatttggatttatcttcgattgccaaaggcttcggcgttgataaagttgcgggcgaactggaaaaatacggcattcaaaattatctggtcgaaatcggcggcgagttgcacggcaaaggcaaaaatgcgcacggcgaaccgtggcgcatcggtatagagcaacccaatatcatccaaggcggcaatacgcagattatcgtcccgctgaacaaccgttcgcttgccacttccggcgattaccgtattttccacgtcgataaaaacggcaaacgcctttcccacatcatcaatcccaacaacaaacgacccatcagccacaacctcgcctccatcagcgtggtctcagacagtgcaatgacggcggacggtttatccacaggattatttgttttaggcgaaaccgaagccttaaggctggcagaacaagaaaaactcgctgttttcctaattgtccgggataaggacggctaccgcaccgccatgtcttccgaatttgccaagctgctccgctaa

SEQ ID NO: 400 - protein, 351 aa, Neisseria gonorrhoeae
MPSETRLPNLIRALIFALGFIFLNACSEQTAQTVTLQGETMGTTYTVKYLSNNRDKLPSPAKIQKRIDDALKEVNRQMSTYQTDSEISRFNQHTAGKPLRISSDFAHVTAEAVRLNRLTHGALDVTVGPLVNLWGFGPDKSVTREPSPEQIKQAASYTGIDKIILQQGKDYASLSKTHPKAYLDLSSIAKGFGVDKVAGELEKYGIQNYLVEIGGELHGKGKNAHGEPWRIGIEQPNIIQGGNTQIIVPLNNRSLATSGDYRIFHVDKNGKRLSHIINPNNKRPISHNLASISVVSDSAMTADGLSTGLFVLGETEALRLAEQEKLAVFLIVRDKDGYRTAMSSEFAKLLR

SEQ ID NO: 401 - DNA, 1056 bp, Neisseria meningitidis
atgccgtctgaaacacgcctgccgaactttatccgcgtcttgatatttgccctgggtttcatcttcctgaacgcctgttcggaacaaaccgcgcaaaccgttaccctgcaaggcgaaacgatgggcacgacctataccgtcaaatacctttcaaataatcgggacaaactcccctcacctgccgaaatacaaaaacgcatcgatgacgcgcttaaagaagtcaaccggcagatgtccacctatcagcccgactccgaaatcagccggttcaaccaacacacagccggcaagcccctccgcatttcaagcgacttcgcacacgttactgccgaagccgtccgcctgaaccgcctgacacacggcgcgctggacgtaaccgtcggccccttggtcaacctttggggattcggccccgacaaatccgttacccgtgaaccgtcgccggaacaaatcaaacaggcggcatcttatacgggcatagacaaaatcattttgaaacaaggcaaagattacgcttccttgagcaaaacccaccccaaggcctatttggatttatcttcgattgccaaaggcttcggcgttgataaagttgcgggcgaactggaaaaatacggcattcaaaattatctggtcgaaatcggcggcgagttgcacggcaaaggcaaaaacgcgcgcggcgaaccgtggcgcatcggtatcgagcagcccaatatcgtccaaggcggcaatacgcagattatcgtcccgctgaacaaccgttcgcttgccacttccggcgattaccgtattttccacgtcgataaaaacggcaaacgcctctcccatatcatcaacccgaacaacaaacgacccatcagccacaacctcgcctccatcagcgtggtcgcagacagtgcgatgacggcggacggcttgtccacaggattattcgtattgggcgaaaccgaagccttaaagctggcagagcgcgaaaaactcgctgttttcctgattgtcagggataaaggcggctaccgcaccgccatgtcttccgaatttgaaaaactgctccgctaa

SEQ ID NO: 402 - protein, 351 aa, Neisseria meningitidis
MPSETRLPNFIRVLIFALGFIFLNACSEQTAQTVTLQGETMGTTYTVKYLSNNRDKLPSPAEIQKRIDDALKEVNRQMSTYQPDSEISRFNQHTAGKPLRISSDFAHVTAEAVRLNRLTHGALDVTVGPLVNLWGFGPDKSVTREPSPEQIKQAASYTGIDKIILKQGKDYASLSKTHPKAYLDLSSIAKGFGVDKVAGELEKYGIQNYLVEIGGELHGKGKNARGEPWRIGIEQPNIVQGGNTQIIVPLNNRSLATSGDYRIFHVDKNGKRLSHIINPNNKRPISHNLASISVVADSAMTADGLSTGLFVLGETEALKLAEREKLAVFLIVRDKGGYRTAMSSEFEKLLR

SEQ ID NO: 403 - DNA, 1056 bp, Neisseria meningitidis; identical to SEQ ID NO: 397

SEQ ID NO: 404 - protein, 351 aa, Neisseria meningitidis; identical to SEQ ID NO: 398

SEQ ID NO: 405 - DNA, 423 bp, Neisseria gonorrhoeae
atggcttccatcacttcgccgctgcacggggcgcagcaggaatgcagcaagacttttttatgtccgccgggcgggacgagtatggggcggtcaatgtcggtaacggtaggtttgttttgtgtttccattaacttaacaatatctgtcgaatacggtcaaagcggctattttaccagagccgccgaatgtaaaacagggtgtcagggcatcagcccgagctgcctgaacgaacggacggtttgcgaggtaacgataaaatggtcgagcagcgaaacatcaaccagcgacatggcctgtgccagccgccttgtgaacatgatgtcttcctgcgaaggttcaggcgagccgcccggatggttgtgcgcgataatcaggctgtcggcatattcgtccaatgccagtttgacgatttcgcggatgtaa

SEQ ID NO: 406 - protein, 140 aa, Neisseria gonorrhoeae
MASITSPLHGAQQECSKTFLCPPGGTSMGRSMSVTVGLFCVSINLTISVEYGQSGYFTRAAECKTGCQGISPSCLNERTVCEVTIKWSSSETSTSDMACASRLVNMMSSCEGSGEPPGWLCAIIRLSAYSSNASLTISRM

SEQ ID NO: 407 - DNA, 423 bp, Neisseria meningitidis
atggcttccatcacttcgccgctgcacggggcgcacagagaatgcagcaagacttttttatgtccaccgggcgggacgagtatagggcggtcaatgtcggtaacggtaggtttgttttgtgtttccattaacttaacaatatctgttgaatacggttgaagcggctattttatcagagccgccgcatgtaaaacagagtgtcagggcatcaacccgagctgtctgaacgaacagacgctttgcgakgtaacgataaaatggtcgagcagcgacacatcgaccagcgacattgcctgtgccagccgccttgtgaacatgatgtcttcctgcgaargttcsggcgagccgcccggatggttgtgcgcaataatcaggctgtcggcatattcgtccaatgccagtttgacgatttcgcggatgtaa

SEQ ID NO: 408 - protein, 140 aa, Neisseria meningitidis
  misc_feature (53)..(53): Xaa can be any naturally occurring amino acid
  misc_feature (82)..(82): Xaa can be any naturally occurring amino acid
  misc_feature (112)..(112): Xaa can be any naturally occurring amino acid
MASITSPLHGAHRECSKTFLCPPGGTSIGRSMSVTVGLFCVSINLTISVEYGXSGYFIRAAACKTECQGINPSCLNEQTLCXVTIKWSSSDTSTSDIACASRLVNMMSSCEXSGEPPGWLCAIIRLSAYSSNASLTISRM

SEQ ID NO: 409 - DNA, 438 bp, Neisseria gonorrhoeae
atgccggaggcaagcatcgcctccatcacttcgccgctgcacggggcgcaacaggaatgcagcaagacttttttatgtccgccgggcgggacgagtatggggcggtcaatgtcggtaacggtaggtttgttttgtgtttccattaacttaacgatatctgtcgaatacggttgaagcggctattttatcagagccgccgcatgtaaaacagggtgtcagggcatcagcccgagctgcctgaacgaacggacggtttgcgccgttacgataaaatggtcgagcagcgacacatcgaccagcgacattgcctgtgccagccgccttgtgaacatgatgtcttcctgcgaaggttcgggcgagccgcccggatggttgtgcgcgataatcaggctgtcggcatattcgtccaatgccagtttgacaatttcacggatgtaa

SEQ ID NO: 410 - protein, 144 aa, Neisseria gonorrhoeae
MPEASIASITSPLHGAQQECSKTFLCPPGGTSMGRSMSVTVGLFCVSINLTISVEYGSGYFIRAAACKTGCQGISPSCLNERTVCAVTIKWSSSDTSTSDIACASRLVNMMSSCEGSGEPPGWLCAIIRLSAYSSNASLTISRM

SEQ ID NO: 411 - DNA, 2007 bp, Neisseria gonorrhoeae
atggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgctatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagacaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccccccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 412 - protein, 668 aa, Neisseria gonorrhoeae
MVDELDLLPDAVAATLLADIGRYVPDWNLLVSERCNSTVAELVKGVDEVQKLTHFARVDSLATPEERAQQAETMRKMLLAMVTDIRVVLIKLAMRTRTLLFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 413 - DNA, 1476 bp, Neisseria meningitidis
gtgaaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaawyytkcycgtctttccaacacctcgccgaacacgcgcccgawaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 414 - protein, 491 aa, Neisseria meningitidis
  misc_feature (388)..(390): Xaa can be any naturally occurring amino acid
  misc_feature (401)..(401): Xaa can be any naturally occurring amino acid
VKLKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKXXXSFQHLAEHAPXKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 415 - DNA, 2007 bp, Neisseria meningitidis
atggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 416 - protein, 668 aa, Neisseria meningitidis
MVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 417 - DNA, 2214 bp, Neisseria gonorrhoeae
atgaccgccatcagcccgattcaagacacgcaaagcgcgaccctgcaagaattgcgcgaatggttcgacagctactgcgccgctctgccggacaacgataaaaacctcatcggtaccgcatggtcgctggcgcaggaacattatcctgccgatgccgccacgccgtatggcgagccgctgcccgaccacttcctcggcgcggcgcaaatggtcgacgaactcgacctgctgcccgatgccgtcgccgccaccctgcttgccgacatcggacgctacgtccccgattggaacctattggtttccgagcgctgcaacagcaccgtcgccgagctggtcaaaggtgtggacgaagtgcagaaacttacccacttcgcccgggtggacagcctcgccacgccggaagaacgcgcacagcaagcggaaaccatgcggaaaatgctgctggcgatggttaccgacatccgcgtcgtattaatcaaactggcgatgcgtacgcgcaccctgcaatttttaagcaacgcccccgacagccctgaaaaacgcgccgtcgccaaagaaaccctcgacatcttcgccccgctcgccaaccgcttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttcctcgatatcctgcgtacggaactcaaaaaatacaatatccactttgaagtcgccggccgtccgaaacacatctactccatttacaaaaaaatggtgaagaaaaaactcagcttcgacggcctgttcgacatccgcgccgtgcggattctggtcgataccgtccccgagtgttacaccacgctgggcatcgtccacagcctctggcagcccattcccggcgagttcgacgactacatcgccaaccccaaaggcaacggttataaaagtttgcacaccgtcatcgtcggcccggaagaaaaaggtgtggaagtgcaaatccgcaccttcgatatgcaccaattcaacgaattcggtgtcgccgcccactggcgttacaaagaaggcggcaaaggcgattccgcctacgaacaaaaaatcgcctggttgcgccaactcttggactggcgcgaaaatatggcggaaagcggcaaggaagacctcgccgccgccttcaaaaccgagcttttcaacgacacgatttatgttttgaccccgcacggcaaagtcctctctctgccaacgggcgcaacccccatcgacttcgcctacgccctgcacagcagcatcggcgaccgctgccggggcgcgaaagtcgaagggcagattgtgccgctgtccaccccgctcgaaaacggacagcgcgtcgaaatcattaccgccaaagaagggcatccttccgtcaactggctttacgaaggctgggtcaaatccggcaaggccatcggcaaaatccgcgcctacatccgccagcaaaacgccgacaccgtgcgcgaagaaggccgtgtccaactcgacaagcagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtgcccgtcagcgcaaccaccatcgtcaaacagtccaaaatcaaaaaaggtggcaaaaccggcgtgctcatcgacggcgaagacggcttgatgaccacgcttgccaaatgctgcaaacccgcgccgcccgacgatattgccggcttcgttacccgcgagcgcggcatttccgtccaccgcaaaacctgcccctctttccgacaccttgccgaacacgcgcccgaaaaagtactggacgcaagttgggcggcgttgcaggaagggcaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccggcctcggcgatgtcaaaggcgtattgagcgttacccggctttaa

SEQ ID NO: 418 - protein, 737 aa, Neisseria gonorrhoeae
MTAISPIQDTQSATLQELREWFDSYCAALPDNDKNLIGTAWSLAQEHYPADAATPYGEPLPDHFLGAAQMVDELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLDILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEEKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSGKAIGKIRAYIRQQNADTVREEGRVQLDKQLAKLTPKPNLQELAENLGYKKPEDLYTAVGQGEISNRAIQKACGTLNEPPPVPVSATTIVKQSKIKKGGKTGVLIDGEDGLMTTLAKCCKPAPPDDIAGFVTRERGISVHRKTCPSFRHLAEHAPEKVLDASWAALQEGQVFAVDIEIRAQDRSGLLRDVSDALARHKLNVTAVQTQSRDLEASMRFTLEVKQVNDLPRVLAGLGDVKGVLSVTRL

SEQ ID NO: 419 - DNA, 2214 bp, Neisseria meningitidis
atgaccgccatcagcccgattcaagacacgcaaagcgcgactctgcaagaattgcgcgaatggttcgacagctactgcgccgctctgccggacaacgataaaaacctcatcggtaccgcatggttgctggcgcaggaacattaccccgccgatgccgccacgccgtatggcgagccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaaaagcccgaaaaataccgcgaaatcgcgctgcttttggacgaaaaacgcaccgaacgcctcgaatacatcgaaaacttcctcaacatcctgcgcggtgaactcaagaaatacaatgtccatttcgaagtcgccggccgcccgaaacacatctactccatttacaaaaaaatggtgaagaaaaaactcagcttcgacggcctctttgacatccgcgccgtgcgaattctggttgataccgtccccgagtgttacaccacgctgggtatcgtccacagcctctggcagcccattcccggcgagttcgacgactacatcgccaatcccaaaggcaacggctataaaagtttgcacaccgtcatcgtcggcccggaagacaaaggcgtggaagtacaaatccgcaccttcgatatgcaccaattcaacgaattcggtgtcgccgcccactggcgttacaaagagggcggcaagggcgattccgcctacgaacagaaaatcgcctggttgcgccaactcttggactggcgcgaaaacatggcggaaagcggcaaggaagacctcgccgccgccttcaaaaccgagcttttcaacgacacgatttatgttttgaccccgcacggcaaagtcctctccctgcccacgggcgcgacccccatcgacttcgcctacgccctgcacagcagcatcggcgaccgttgccgcggtgcgaaagtcgaagggcagattgtgccgctgtccaccccgctcgaaaacggacagcgcgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgatattatcggcttcgttacccgcgagcgcggcatttcagtgcaccgcaaaacctgcccgtctttccaacacctcgccgaacacgcgcccgaaaaagtgctggacgcaagctgggcggcattgcaggaaggacaagtattcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagtcaacgacctcccgcgcgtcctcgccagcctcggcgacgtcaaaggcgtattgagcgttacccggctttaa

SEQ ID NO: 420 - protein, 737 aa, Neisseria meningitidis
MTAISPIQDTQSATLQELREWFDSYCAALPDNDKNLIGTAWLLAQEHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQKPEKYREIALLLDEKRTERLEYIENFLNILRGELKKYNVHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIIGFVTRERGISVHRKTCPSFQHLAEHAPEKVLDASWAALQEGQVFAVDIEIRAQDRSGLLRDVSDALARHKLNVTAVQTQSRDLEASMRFTLEVKQVNDLPRVLASLGDVKGVLSVTRL

SEQ ID NO: 421 - DNA, 2214 bp, Neisseria meningitidis
atgaccgccatcagcccgattcaagacacgcaaagcgcgactctgcaagaattgcgcgaatggttcgacagctactgcaccgcgctgccgaacaacgataaaaaacttgtcttagccgcccgttcgctggcggaagcacattaccccgccgatgccgccacgccgtatggcgaaccgctgcccgaccacttcctcggcgcggcgcaaatggttcatgaactcgacctgctccccgatgccgtcgccgccaccctgcttgccgacatcggacgctacgtccccgactggaacctattggtttccgaacgctgcaacagtaccgtcgccgagctggtcaaaggtgtggacgaagtgcagaaactcacccacttcgcccgggtggacagcctcgccacgccggaagaacgcgcccagcaggcagaaactatgcggaaaatgctgctggcgatggttaccgacatccgcgtcgtgttaatcaaactggcgatgcgtacgcgcaccctgcaatttttaagcaacgcccccgacagccccgaaaaacgcgccgtcgccaaagaaaccctcgacatcttcgccccgctcgccaaccgtttgggcgtgtggcagctcaaatggcagctcgaagatttgggcttccgccatcaagaacccgaaaaataccgcgaaatcgccctgcttttggacgaaaaacgcaccgaacgcctcgaatacatcgaaaacttccttaatatcctgcgtacggaactcaaaaaatacaatatccactttgaagtcgccggccgtccgaaacacatctactccatttacaaaaaaatggtgaagaaaaaactcagcttcgacgggttgttcgacatccgcgccgtgcggattctggttgataccgtccccgagtgttacaccacactgggcattgtccacagcctctggcagcccattcccggcgagttcgacgactacatcgccaacccgaaaggcaacggctataaaagtttgcacaccgtcatcgtcggcccggaagacaaaggcgtggaagtgcaaatccgcaccttcgatatgcaccaattcaacgaattcggtgtcgccgcgcactggcgttacaaagagggcggcaaaggcgattccgcctacgaacaaaaaatcgcctggttacgccaacttttggactggcgcgaaaacatggcggaaagcggcaaggaagacctcgccgccgccttcaaaaccgagcttttcaacgacacgatttatgttttgaccccgcacggcaaagtcctctccctgcccacaggcgcgacccccatcgacttcgcctacgccctgcacagcagcatcggcgaccgttgccgcggtgcgaaagtcgaagggcagattgtgccgctgtccaccccgctcgaaaacggacagcgtgtcgaaatcattaccgccaaagaagggcatccttccgtcaactggctttacgaaggctgggtcaaatccaacaaggcaatcggcaaaatccgcgcctacatccgccagcaaaacgccgacaccgtgcgcgaagaaggccgcgtccaactcgacaaacagcttgccaaactcacgcccaaacccaacctgcaagagcttgccgaaaatctcggctacaaaaagccagaagacctctacaccgccgtcggacaaggcgaaatttccaaccgcgccatccaaaaagcctgcggcacgctgaacgaaccgccgcccgtacccgtcagcgaaaccaccatcgtcaaacagtccaaaatcaaaaaaggcggcaaaaacggcgtgctcatcgacggcgaagacggtctgatgaccacgcttgccaaatgctgcaaacccgcgccgcccgacgacattgtcggcttcgttacccgcgatcgcggcatttcggtacaccgcaaaacctgcccctctttccgacacctcgccgaacacgcgcccgaaaaagtactggacgcaagttgggcggcgttgcaggaaggacaagtgttcgccgtcgatatcgaaatccgcgcccaagaccgctccgggcttttgcgcgacgtatccgacgcgctcgcccgccacaaactcaacgttaccgccgtgcaaacccagtcccgcgacttggaagccagcatgaggttcacgctcgaagtcaaacaagttaccgacctcccacgcgtcctcgccagcctcggcgacgtcaaaggcgtattgagcgttacccggctttaa

SEQ ID NO: 422 - protein, 737 aa, Neisseria meningitidis
MTAISPIQDTQSATLQELREWFDSYCTALPNNDKKLVLAARSLAEAHYPADAATPYGEPLPDHFLGAAQMVHELDLLPDAVAATLLADIGRYVPDWNLLVSERCNSTVAELVKGVDEVQKLTHFARVDSLATPEERAQQAETMRKMLLAMVTDIRVVLIKLAMRTRTLQFLSNAPDSPEKRAVAKETLDIFAPLANRLGVWQLKWQLEDLGFRHQEPEKYREIALLLDEKRTERLEYIENFLNILRTELKKYNIHFEVAGRPKHIYSIYKKMVKKKLSFDGLFDIRAVRILVDTVPECYTTLGIVHSLWQPIPGEFDDYIANPKGNGYKSLHTVIVGPEDKGVEVQIRTFDMHQFNEFGVAAHWRYKEGGKGDSAYEQKIAWLRQLLDWRENMAESGKEDLAAAFKTELFNDTIYVLTPHGKVLSLPTGATPIDFAYALHSSIGDRCRGAKVEGQIVPLSTPLENGQRVEIITAKEGHPSVNWLYEGWVKSNKAIGKIRAYIRQQNADTVREEGRVQLDKQLAKLTPKPNLQELAENLGYKKPEDLYTAVGQGEISNRAIQKACGTLNEPPPVPVSETTIVKQSKIKKGGKNGVLIDGEDGLMTTLAKCCKPAPPDDIVGFVTRDRGISVHRKTCPSFRHLAEHAPEKVLDASWAALQEGQVFAVDIEIRAQDRSGLLRDVSDALARHKLNVTAVQTQSRDLEASMRFTLEVKQVTDLPRVLASLGDVKGVLSVTRL

SEQ ID NO: 423 - DNA, 378 bp, Neisseria gonorrhoeae
atgtgcgagttcaaggattttagaagaaacatcccttgttttgaagagtatgacgaaaattcatttattggcaaatggtatgatgacggggtgtgggatgatgaagaatattggaagctggagaatgatttaatcgaggttaggagaaaatatccttatccgatggatataccaagggatattgtgattggaatcggtaccattattgattttttaatggttccaaattgggagctttttgaaattaaagcttccccttggttgcctgatagcgtgggaattcatgaacgttatgaaagattcacaacgatgctccgttatatttttaccgagaaagacatagtcaacgtgcgatttgattattacaacaaaaaatag

SEQ ID NO: 424 - protein, 125 aa, Neisseria gonorrhoeae
MCEFKDFRRNIPCFEEYDENSFIGKWYDDGVWDDEEYWKLENDLIEVRRKYPYPMDIPRDIVIGIGTIIDFLMVPNWELFEIKASPWLPDSVGIHERYERFTTMLRYIFTEKDIVNVRFDYYNKK

SEQ ID NO: 425 - DNA, 378 bp, Neisseria meningitidis
atgtgtgagttcaaggatattataagaaacgttccttattttgaggggtatgacgaaaattcatttattggcaaatggtatgatgacggggtgtgggatgatgaagaatattggaagttggagaatgatttaatcgaggttagaaaaaaatatccttatccgatggacataccaagatatgttgtcattggaatcggtaccattattgatttcttaatggttccaaattggaaactttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 426 - protein, 125 aa, Neisseria meningitidis
MCEFKDIIRNVPYFEGYDENSFIGKWYDDGVWDDEEYWKLENDLIEVRKKYPYPMDIPRYVVIGIGTIIDFLMVPNWKLFEIKASPWLPDSVGIHERYERFTTMLRYIFTEKDIVNVRFDYYNKK

SEQ ID NO: 427 - DNA, 378 bp, Neisseria meningitidis
atgtgtgagttcaaggattttagaagaaacatcccttgttttgaagagtatgacgaaaattcatttattggcaaatggtatgatgacggggtgtgggatgatgaagaatattggaaattggagaatgatttaatcgaggttagaaaaaaatatccttatccgatggatataccaagggatattgtgattggaatcggtaccattattgattttttaatggttccaaattgggagctttttgaaattaaagcttccccttggttgcctgatagtgtgggaattcatgaacgttatgaaagattcacaacgatgctccgttatatttttaccgagaaagacatagtcaacgtgcgatttgattattacaacaaaaaatag

SEQ ID NO: 428 - protein, 125 aa, Neisseria meningitidis
MCEFKDFRRNIPCFEEYDENSFIGKWYDDGVWDDEEYWKLENDLIEVRKKYPYPMDIPRDIVIGIGTIIDFLMVPNWELFEIKASPWLPDSVGIHERYERFTTMLRYIFTEKDIVNVRFDYYNKK

SEQ ID NO: 429 - DNA, 672 bp, Neisseria gonorrhoeae
atgatgaagacttttaaaaatatattttccgccgccattttgtccgccgccctgccgtgcgcgtatgcggcaaggctaccccaatccgccgtgctgcactattccggcagctacggcattcccgccacgatgacatttgaacgcagcggcaatgcttacaaaatcgtttcgacgattaaagtgccgctatacaatatccgtttcgaatccggcggtacggttgtcggcaataccctgcaccctgcctactataaagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccgggtctgaaaatcaccaacggcaaaaaactttattccgtcggcggcctgaataaggcgggtacgggaaaatacagcataggcggcgtggaaaccgaagtcgtcaaatatcgggtgcggcgcggcgacgatacggtaacgtatttcttcgcaccgtccctgaacaatattccggcacaaatcggctataccgacgacggcaaaacctatacgctgaagctcaaatcggtgcagatcaacggacaggccgccaaaccgtaa

SEQ ID NO: 430 - protein, 223 aa, Neisseria gonorrhoeae
MMKTFKNIFSAAILSAALPCAYAARLPQSAVLHYSGSYGIPATMTFERSGNAYKIVSTIKVPLYNIRFESGGTVVGNTLHPAYYKDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDTVTYFFAPSLNNIPAQIGYTDDGKTYTLKLKSVQINGQAAKP

SEQ ID NO: 431 - DNA, 669 bp, Neisseria meningitidis
atgatgaagacttttaaaaatatattttccgccgccattttgtccgccgccctgccgtgcgcgtatgcggcagggctgccccaatccgccgtgctgmactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacttacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccg

SEQ ID NO: 432 - protein, 223 aa, Neisseria meningitidis
  misc_feature (33)..(33): Xaa can be any naturally occurring amino acid
MMKTFKNIFSAAILSAALPCAYAAGLPQSAVLXYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 433 - DNA, 672 bp, Neisseria meningitidis
atgatgaagacttttaaaaatatattttccgccgccattttgtccgccgccctgccgtgcgcgtatgcggcagggctgccccaatccgccgtgctgcactattccggcagctacggcattcccgccacgatgacatttgaacgcagcggcaatgcttacaaaatcgtttcgacgattaaagtgccgctatacaatatccgtttcgagtccggcggtacggttgtcggcaataccctgcaccctacctactatagagacatacgcaggggcaaactgtatgcggaagccaaattcgccgacggcagcgtaacctacggcaaagcgggcgagagcaaaaccgagcaaagccccaaggctatggatttgttcacgcttgcctggcagttggcggcaaatgacgcgaaactccccccggggctgaaaatcaccaacggcaaaaaactttattccgtcggcggtttgaataaggcgggtacaggaaaatacagcataggcggcgtggaaaccgaagtcgtcaaatatcgggtgcggcgcggcgacgatgcggtaatgtatttcttcgcaccgtccctgaacaatattccggcacaaatcggctataccgacgacggcaaaacctatacgctgaaactcaaatcggtgcagatcaacggccaggcagccaaaccgtaa

SEQ ID NO: 434 - protein, 223 aa, Neisseria meningitidis
MMKTFKNIFSAAILSAALPCAYAAGLPQSAVLHYSGSYGIPATMTFERSGNAYKIVSTIKVPLYNIRFESGGTVVGNTLHPTYYRDIRRGKLYAEAKFADGSVTYGKAGESKTEQSPKAMDLFTLAWQLAANDAKLPPGLKITNGKKLYSVGGLNKAGTGKYSIGGVETEVVKYRVRRGDDAVMYFFAPSLNNIPAQIGYTDDGKTYTLKLKSVQINGQAAKP

SEQ ID NO: 435 - DNA, 1101 bp, Neisseria gonorrhoeae
atggaaacacagctttacatcggcattatgtcgggaaccagtatggacggggcggatgccgtgctggtacggatggacggcggcaaatggctgggcgcggaagggcacgcctttaccccctaccctgaccggttgcgccgcaaattgctggatttgcaggacacaggcacagacgaactgcaccgcagcaggatgttgtcgcaagaactcagccgcctgtacgcgcaaaccgccgccgaactgctgtgcagtcaaaacctcgctccgtgcgacattaccgccctcggctgccacgggcaaaccgtccgacacgcgccggaacacggttacagcatacagcttgccgatttgccgctgctggcggaactgacgcggatttttaccgtcggcgacttccgcagccgcgaccttgctgccggcggacaaggtgcgccgctcgtccccgcctttcacgaagccctgttccgcgatgacagggaaacacgcgtggtactgaacatcggcgggattgccaacatcagcgtactcccccccggcgcacccgccttcggcttcgacacagggccgggcaatatgctgatggacgcgtggacgcaggcacactggcagctgccttacgacaaaaacggtgcaaaggcggcacaaggcaacatattgccgcaactgctcggcaggctgctcgcccacccgtatttctcacaaccccacccaaaaagcacggggcgcgaactgtttgccctaaattggctcgaaacctaccttgacggcggcgaaaaccgatacgacgtattgcggacgctttcccgattcaccgcgcaaaccgtttgggacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatcctcaatgggtggaggcggccgcatttgcgtggttggcggcgtgttggattaaccgcattcccggtagtccgcacaaagcgaccggcgcatccaaaccgtgtattctgggcgcgggatattattattga

SEQ ID NO: 436 - protein, 366 aa, Neisseria gonorrhoeae
METQLYIGIMSGTSMDGADAVLVRMDGGKWLGAEGHAFTPYPDRLRRKLLDLQDTGTDELHRSRMLSQELSRLYAQTAAELLCSQNLAPCDITALGCHGQTVRHAPEHGYSIQLADLPLLAELTRIFTVGDFRSRDLAAGGQGAPLVPAFHEALFRDDRETRVVLNIGGIANISVLPPGAPAFGFDTGPGNMLMDAWTQAHWQLPYDKNGAKAAQGNILPQLLGRLLAHPYFSQPHPKSTGRELFALNWLETYLDGGENRYDVLRTLSRFTAQTVWDAVSHAAADARQMYICGGGIRNPVLMADLAECFGTRVSLHSTAELNLDPQWVEAAAFAWLAACWINRIPGSPHKATGASKPCILGAGYYY

SEQ ID NO: 437 - DNA, 1101 bp, Neisseria meningitidis
  misc_feature (364)..(606): n is a, c, g, or t
  misc_feature (995)..(995): n is a, c, g, or t
  misc_feature (1082)..(1082): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcttccttacgacaaaaacggtgcaaagtcggcacaaggcaacatattgccgcaactgctcgacaggctgctcgcccacccgtatttcgcacaacgccaccctaaaagcacggggcgcgaactgtttgccataaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcgacggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 438 - protein, 366 aa, Neisseria meningitidis
  misc_feature (122)..(202): Xaa can be any naturally occurring amino acid
  misc_feature (332)..(332): Xaa can be any naturally occurring amino acid
  misc_feature (361)..(361): Xaa can be any naturally occurring amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAXXXXXXXXXXXXXXXXXXXXXXXXXXXXXXXXXXXXXXXXXXXXXXXXXXXXXXXXXXXXXXXXXXXXXXXXXXXXXXXXXQLPYDKNGAKSAQGNILPQLLDRLLAHPYFAQRHPKSTGRELFAINWLETYLDGGENRYDVLRTLSRFTAQTVCDAVSHAAADARQMYICDGGIRNPVLMADLAECFGTRVSLHSTADLNLDPQWVEAAXFAWLAACWINRIPGSPHKATGASKPCILXAGYYY

SEQ ID NO: 439 - DNA, 1101 bp, Neisseria meningitidis
atggaaacacagctttacatcggcatcatgtcgggaaccagcatggacggggcggatgccgtactgatacggatggacggcggcaaatggctgggcgcggaagggcacgcctttaccccctaccccggcaggttacgccgcaaattgctggatttgcaggacacaggcgcggacgaactgcaccgcagcaggatgttgtcgcaagaactcagccgcctgtacgcgcaaaccgccgccgaactgctgtgcagtcaaaacctcgcgccgtccgacattaccgccctcggctgccacgggcaaaccgtcagacacgcgccggaacacagttacagcgtacagcttgccgatttgccgctgctggcggaacggactcagatttttaccgtcggcgacttccgcagccgcgaccttgcggccggcggacaaggcgcgccgctcgtccccgcctttcacgaagccctgttccgcgacgacagggaaacacgcgcggtactgaacatcggcgggattgccaacatcagcgtactcccccccgacgcacccgccttcggcttcgacacaggaccgggcaatatgctgatggacgcgtggatgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgattcaccgcgcaaaccgttttcgacgccgtctcacacgcagcggcagatgcccgtcaaatgtacatttgcggcggcggcatccgcaatcctgttttaatggcggatttggcagaatgtttcggcacacgcgtttccctgcacagcaccgccgaactgaacctcgatccgcaatgggtagaagccgccgcgttcgcatggatggcggcgtgttgggtcaaccgcattcccggtagtccgcacaaagcaaccggcgcatccaaaccgtgtattctgggcgcgggatattattattga

SEQ ID NO: 440 - protein, 366 aa, Neisseria meningitidis
METQLYIGIMSGTSMDGADAVLIRMDGGKWLGAEGHAFTPYPGRLRRKLLDLQDTGADELHRSRMLSQELSRLYAQTAAELLCSQNLAPSDITALGCHGQTVRHAPEHSYSVQLADLPLLAERTQIFTVGDFRSRDLAAGGQGAPLVPAFHEALFRDDRETRAVLNIGGIANISVLPPDAPAFGFDTGPGNMLMDAWMQAHWQLPYDKNGAKAAQGNILPQLLDRLLAHPYFAQPHPKSTGRELFALNWLETYLDGGENRYDVLRTLSRFTAQTVFDAVSHAAADARQMYICGGGIRNPVLMADLAECFGTRVSLHSTAELNLDPQWVEAAAFAWMAACWVNRIPGSPHKATGASKPCILGAGYYY

SEQ ID NO: 441 - DNA, 1101 bp, Neisseria meningitidis
  misc_feature (995)..(995): n is a, c, g, or t
  misc_feature (1082)..(1082): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcggaacggacgcggatttttaccgtcggcgacttccgcagccgcgaccttgcggccggcggacaaggcgcgccactcgtccccgcctttcacgaagccctgttccgcgacaacagggaaacacgcgcggtactgaacatcggcgggattgccaacatcagcgtactcccccccgacgcacccgccttcggcttcgacacagggccgggcaatatgctgatggacgcgtggacgcaggcacactggcagcttccttacgacaaaaacggtgcaaaggcggcacaaggcaacatattgccgcaactgctcgacaggctgctcgcccacccgtatttcgcacaaccccaccctaaaagcacggggcgcgaactgtttgccctaaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcggcggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 442 - protein, 366 aa, Neisseria meningitidis
  misc_feature (332)..(332): Xaa can be any naturally occurring amino acid
  misc_feature (361)..(361): Xaa can be any naturally occurring amino acid
METQLYIGIMSGTSMDGADAVLIRMDGGKWLGAEGHAFTPYPGRLRRQLLDLQDTGADELHRSRILSQELSRLYAQTAAELLCSQNLAPSDITALGCHGQTVRHAPEHGYSIQLADLPLLAERTRIFTVGDFRSRDLAAGGQGAPLVPAFHEALFRDNRETRAVLNIGGIANISVLPPDAPAFGFDTGPGNMLMDAWTQAHWQLPYDKNGAKAAQGNILPQLLDRLLAHPYFAQPHPKSTGRELFALNWLETYLDGGENRYDVLRTLSRFTAQTVCDAVSHAAADARQMYICGGGIRNPVLMADLAECFGTRVSLHSTADLNLDPQWVEAAXFAWLAACWINRIPGSPHKATGASKPCILXAGYYY

SEQ ID NO: 443 - DNA, 1101 bp, Neisseria meningitidis; identical to SEQ ID NO: 439

SEQ ID NO: 444 - protein, 366 aa, Neisseria meningitidis; identical to SEQ ID NO: 440

SEQ ID NO: 445 - DNA, 732 bp, Neisseria gonorrhoeae
atggctttactgagcatccgcaagctgcacaaacaatacggcagcgtaaccgccatccaatccttagacttggacttggaaaaaggcgaagtcatcgtactgctgggcccgtccggctgcggcaaatccaccctcctgcgctgcgtcaacggtttggagccgcaccaaggcggcagcatcgtgatggacggtgtcggcgaattcggcaaagacgtttcctggcaaaccgcccggcaaaaagtcggtatggtctttcaaagtaacgaactgtttgcccacatgaccgtcatcgaaaacatcttcttaggcccggtaaaggaacaaaaccgcgaccgtgccgaagcagaggcgcaagccggcaaactgttggaacgcgtcggactgctagaccgcaaaaacgcctatccgcgcgaactttccggcggtcagaaacagcgcatcgccattgtccgcgccctgtgcctgaatccggaagtcatcctgctggacgaaatcaccgccgcacttgaccccgaaatggtgcgcgaagtcttggaagtggttttggaactcgcccgcgaagggatgagtatgctcatcgtaacccacgaaatggggttcgcacgcaaagttgccgaccgcatcgtctttatggacaaaggcggcatcgtcgaatcgtccgaccccgaaacctttttttccgcaccaaaaagcgaacgcgcccgccaatttctggcaggtatggactactga

SEQ ID NO: 446 - protein, 243 aa, Neisseria gonorrhoeae
MALLSIRKLHKQYGSVTAIQSLDLDLEKGEVIVLLGPSGCGKSTLLRCVNGLEPHQGGSIVMDGVGEFGKDVSWQTARQKVGMVFQSNELFAHMTVIENIFLGPVKEQNRDRAEAEAQAGKLLERVGLLDRKNAYPRELSGGQKQRIAIVRALCLNPEVILLDEITAALDPEMVREVLEVVLELAREGMSMLIVTHEMGFARKVADRIVFMDKGGIVESSDPETFFSAPKSERARQFLAGMDY

SEQ ID NO: 447 - DNA, 762 bp, Neisseria meningitidis
gttgtcatgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcakgcatggtgtttcaacaatacaayctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggatmccatgaaggaattggcgcaagaaggctggaccatggttgtcgttacgcatgaaatcaagttcgccttagaagtggcaaccaccgwcgtcgtgatggacrgcggcgttattgtcgaacaaggcagcccgcaagatttgttcgaccaccccaaacacgaacggacgcggagatttttaagccaaatccaatctaccaagatttga

SEQ ID NO: 448 - protein, 253 aa, Neisseria meningitidis
  misc_feature (89)..(89): Xaa can be any naturally occurring amino acid
  misc_feature (187)..(187): Xaa can be any naturally occurring amino acid
  misc_feature (215)..(215): Xaa can be any naturally occurring amino acid
  misc_feature (220)..(220): Xaa can be any naturally occurring amino acid
VVMIKIRNIHKTFGENTILRGIDLDVCKGQVVVILGPSGSGKTTFLRCLNALEMPEDGQIEFDNERPLKIDFSKKPSKHDILALRRKSXMVFQQYNLFPHKTALENVMEGPVAVQGKPAAQAREEALKLLEKVGLGDKVDLYPYQLSGGQQQRVGIARALAIQPELMLFDEPTSALDPELVQDVLDXMKELAQEGWTMVVVTHEIKFALEVATTXVVMDXGVIVEQGSPQDLFDHPKHERTRRFLSQIQSTKI

SEQ ID NO: 449 - DNA, 762 bp, Neisseria meningitidis
gttgtcatgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 450 - protein, 253 aa, Neisseria meningitidis
VVMIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 451 - DNA, 756 bp, Neisseria gonorrhoeae
atgattaaaatccgcaatatccataagacctttggcgaaaacaccattttgcgcggcatcgatttggatgtgggcaaagggcaggtggtcgtcatcctcgggccttccggctcgggtaaaacaacatttctgcgctgcctaaacgcgttggaaatgcccgaagacggacaaatcgagttcgacaacgcgcggccgttacgcattgatttttccaaaaaaacaagcaaacacgatattttggcactgcgccgcaagtccggaatggtattccaacaatacaacctcttcccgcataaaaccgtgttggaaaacgtgatggaagggccggttgccgtacagggcaagcctgccgcccaagcgcgcgaagaggctttgaaactgctggaaaaagtcggcttgggcgataaagtggatttgtatccctaccagctttccggcggtcagcagcagcgtgtcggtatcgcccgcgcactggcgattcagcctgaattgatgctgtttgacgaacccacttccgcgctggaccccgagttggtgcaagacgtgttggacgccatgaaggaattggcgcgggaaggttggacgatggtcgtcgttacccacgaaatcaagttcacgctggaagttgccacgaacgtcgtcgtgatggacggcggcgttatcgtagagcagggcagcccgaaagagttgttcgaccacctcaaacacgaacggacgcggagatttttaagccaaatccaatctgccaagatttga

SEQ ID NO: 452 - protein, 251 aa, Neisseria gonorrhoeae
MIKIRNIHKTFGENTILRGIDLDVGKGQVVVILGPSGSGKTTFLRCLNALEMPEDGQIEFDNARPLRIDFSKKTSKHDILALRRKSGMVFQQYNLFPHKTVLENVMEGPVAVQGKPAAQAREEALKLLEKVGLGDKVDLYPYQLSGGQQQRVGIARALAIQPELMLFDEPTSALDPELVQDVLDAMKELAREGWTMVVVTHEIKFTLEVATNVVVMDGGVIVEQGSPKELFDHLKHERTRRFLSQIQSAKI

SEQ ID NO: 453 - DNA, 756 bp, Neisseria meningitidis
atgattaaaatccgcaatatccataagacctttggcgaaaacactattttgcgcggcatcgatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtaatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgcgcattggcgattcagcctgaactgatgctgtttgacgaaccgacttccgcgctcgatcctgaattggtgcaagatgttttggataccatgaaggaattggcgcaagaaggctggaccatggttgtcgttacgcatgaaatcaagttcgccttagaagtggcaaccaccgtcgtcgtgatggacggcggcgttattgtcgaacaaggcagcccgcaagatttgttcgaccaccccaaacacgaacggacgcggagatttttaagccaaatccaatctaccaagatttga

SEQ ID NO: 454 - protein, 251 aa, Neisseria meningitidis
MIKIRNIHKTFGENTILRGIDLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLDTMKELAQEGWTMVVVTHEIKFALEVATTVVVMDGGVIVEQGSPQDLFDHPKHERTRRFLSQIQSTKI

SEQ ID NO: 455 - DNA, 756 bp, Neisseria meningitidis
atgattaaaatccgcaatatccataagaccttcggcaaaaataccattttgcgcggcatcaatttggatgtgtgcaaagggcaggtggtcgtcatcctcgggccttccggctcaggcaaaacgacgtttctgcgatgcctaaacgcgttggaaatgcccgaagacggacaaatcgagttcgacaacgagcgaccgctgaaaatcgatttttctaaaaaaccaagcaaacacgatattttggcactgcgccgcaaatcaggcatggtgtttcaacaatacaacctctttccgcacaaaaccgccttggaaaacgtgatggaaggaccggttgccgtacagggcaagcctgccgcccaagcgcgcgaagaggctctgaaactgctggaaaaagtcggcttgggcgacaaagtggatttgtatccctaccagctttccggcggtcagcagcagcgcgtcggcattgcccgagcattggcgattcagcccgagctgatgttgtttgacgaacccacttccgcgcttgaccccgagttggtgcaagacgtgttgaacgccatgaaggaattggcgcgggaaggttggacgatggtcgtcgttacccacgaaatcaagttcgcgctggaagttgccacgaccgttgtcgtgatggacggcggcgttatcgtagagcagggcagcccgaaagagttgttcgaccaccccaaacacgaacggacgcggagatttttaagccaaatccaatctaccaagatttga

SEQ ID NO: 456 - protein, 251 aa, Neisseria meningitidis
MIKIRNIHKTFGKNTILRGINLDVCKGQVVVILGPSGSGKTTFLRCLNALEMPEDGQIEFDNERPLKIDFSKKPSKHDILALRRKSGMVFQQYNLFPHKTALENVMEGPVAVQGKPAAQAREEALKLLEKVGLGDKVDLYPYQLSGGQQQRVGIARALAIQPELMLFDEPTSALDPELVQDVLNAMKELAREGWTMVVVTHEIKFALEVATTVVVMDGGVIVEQGSPKELFDHPKHERTRRFLSQIQSTKI

SEQ ID NO: 457 - DNA, 1032 bp, Neisseria gonorrhoeae
atgtcgggcaatgcctcctctccttcatcttccgccgccatcgggctggtttggttcggcgcggcggtatcgattgccgaaatcagcacgggtacgctgctcgcccccttgggctggcagcgcggtctggcggccctgcttttgggtcatgccgtcggcggcgcgctgttttttgcggcggcgtatatcggcgcactgaccggacgcagctcgatggaaagtgtgcgcctgtcgttcggcaaatgcggttcagtgctgttttccgtggcgaatatgctgcaactggccggctggacggcggtgatgatttacgtcggcgcaacggtcagctccgctttgggcaaagtgttgtgggacggcgaatcctttgtctggtgggcattggcaaacggcgcactgatcgtgctgtggctggttttcggcgcacgcagaacgggcgggctgaaaaccgtttcgatgctgctgatgctgcttgccgtgttgtggttgagcgtcgaagtgttcgcttcgtccggcacaaacgccgcgcccgccgtttcagacggcatgaccttcggaacggcagtcgaactgtccgccgtcatgccgctttcctggctgccgctggccgccgactacacgcgccaagcacgccgcccgtttgcggcaaccctgacggcaacgctcgcctatacgctgacgggctgctggatgtatgccttgggtttggcggcggctctgtttaccggagaaaccgacgtggcgaaaatcctgttgggcgcgggcttgggcataacgggcattctggcagtcgtcctctccaccgttaccacaacgtttctcgatacctattccgccggcgcgagtgcgaacaacatttccgcgcgttttgcggaaatacccgtcgctgtcggcgttaccctgatccgcaccgtgcttgccgtcatgctgcccgttaccgaatataaaaacttcctgctgcttatccgctcggtatttgggccgatggcgggtggttttgattgccgacttttttgtcttaaaacggcgtga

SEQ ID NO: 458 - protein, 1 aa, Neisseria gonorrhoeae
C

SEQ ID NO: 459 - DNA, 1029 bp, Neisseria meningitidis
atgtcgggcaatgcctcctctccttcatcttcctccgccatcgggctgatttggttcggcgcggcggtatcgattgccgaaatcagcacgggtacgctgcttgcgcctttgggctggcagcgcggtctggcggctctacttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcctggctgccgcttgccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcargtttgggtgcggcaggcattttggcggtcgtcctctccaccgttaccacaacgtttctcgatgcctattccgccggcgcgagtgcgaacaacatttccgcgcgttttgcggaaacacccgtcgctgtcrgcgttaccctgatcggcacggtacttgccgtcatgctgcccgttaccgaatatgaaaacttcctgctgcttatcggctcggtatttgcgccgatggcgggcggttttgattgccgactttttcgtcttgaaacggcgtga

SEQ ID NO: 460 - protein, 342 aa, Neisseria meningitidis
  misc_feature (254)..(254): Xaa can be any naturally occurring amino acid
  misc_feature (297)..(297): Xaa can be any naturally occurring amino acid
MSGNASSPSSSSAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAXLGAAGILAVVLSTVTTTFLDAYSAGASANNISARFAETPVAVXVTLIGTVLAVMLPVTEYENFLLLIGSVFAPMAGGFDCRLFRLETA

SEQ ID NO: 461 - DNA, 1028 bp, Neisseria meningitidis
atgtcgggcaatgcctcctctccttcatcttccgccgccatcgggctgatttggttcggcgcggcggtatcgattgccgaaatcagcacgggtacactgcttgcgcctttgggctggcagcgcggtctggcggctctgcttttgggtcatgccgtcggcggcgcgctgttttttgcggcggcgtatatcggcgcactgaccggacgcagctcgatggaaagcgtgcgcctgtcgttcggcaaacgcggttcagtgctgttttccgtggcgaatatgctgcaactggccggctggacggcggtgatgatttacgccggcgcaacggtcagctccgctttgggcaaagtgttgtgggacggcgaatcttttgtctggtgggcattggcaaacggcgcgctgattgtgctgtggctggttttcggcgcacgcaaaacaggcgggctgaaaaccgtttcgatgctgctgatgctgttggcggttctgtggctgagtgccgaagtcttttccacggcaggcagcaccgccgcacaggtttcagacggcatgagtttcggaacggcagtcgagctgtccgccgtgatgccgctttcttggctgccgctggccgccgactacacgcgccacgcgcgccgcccgtttgcggcaaccctgacggcaacgctcgcctacacgctgaccggctgctggatgtatgccttgggtttggcagcggcgttgttcaccggagaaaccgacgtggcaaaaatcctgctgggcgcaggtttgggtgcggcaggcattttggcggtcgtcctgtcgaccgttaccaccacttttctcgatgcctactccgccggcgtaagtgccaacaatatttccgccaaactttcggaaatacccatcgccgttgccgtcgccgttgtcggcacactgcttgccgtcctcctgcccgttaccgaatatgaaaacttcctgctgcttatcggctcggtatttgcgccgatggcggcggttttgattgccgactttttcgtcttgaaacggcgtga

SEQ ID NO: 462 - protein, 342 aa, Neisseria meningitidis
  misc_feature (330)..(330): Xaa can be any naturally occurring amino acid
MSGNASSPSSSAAIGLIWFGAAVSIAEISTGTLLAPLGWQRGLAALLLGHAVGGALFFAAAYIGALTGRSSMESVRLSFGKRGSVLFSVANMLQLAGWTAVMIYAGATVSSALGKVLWDGESFVWWALANGALIVLWLVFGARKTGGLKTVSMLLMLLAVLWLSAEVFSTAGSTAAQVSDGMSFGTAVELSAVMPLSWLPLAADYTRHARRPFAATLTATLAYTLTGCWMYALGLAAALFTGETDVAKILLGAGLGAAGILAVVLSTVTTTFLDAYSAGVSANNISAKLSEIPIAVAVAVVGTLLAVLLPVTEYENFLLLIGSVFAPMAXGFDCRLFRLETA

SEQ ID NO: 463 - DNA, 867 bp, Neisseria gonorrhoeae
atgccgtctgaaaccccaaaggcacgccgccggctttcagacggcatcgcgtccgacaaccataccaaagaatccatcatgctcaccctgtacggcgaaactttcccttcgcggctgctgctcggcacggcggcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 464 - protein, 288 aa, Neisseria gonorrhoeae
MPSETPKARRRLSDGIASDNHTKESIMLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 465 - DNA, 810 bp, Neisseria gonorrhoeae
cactatacaaaggaacccattatgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 466 - protein, 269 aa, Neisseria meningitidis
HYTKEPIMLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 467 - DNA, 819 bp, Neisseria meningitidis
ttgttaatccactatacaaaggaacccattatgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 468 - protein, 272 aa, Neisseria meningitidis
LLIHYTKEPIMLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 469 - DNA, 789 bp, Neisseria gonorrhoeae
atgctcaccctgtacggcgaaactttcccttcgcggctgctgctcggcacggccgcctacccgacccctgaaatcctcaaacaatccgtccgaaccgcccggcccgcgatgattaccgtctcgctgcgccgcacgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggcgacgacgacaccttgcagccggacgtgttccaactcgtcgaagcggcggaaatcctgattaaagacggcttcaaagtgctgccttattgcaccgaagacctgattgcctgccgccgcctgctcgatgcgggctgtcaggcgttgatgccgtgggcggctcccatcggcacgggtttgggggcggttcacgcctatgcgctcaaaatcctgcgcgaacgcctgcccgacacgccgctgattatcgacgcgggcttgggtttgccttcccaagcggcacaagtgatggaatggggttttgacggcgtattgttaaacaccgccgtttcccgcagcggcgaccccgtcaacatggcgcgcgccttcgcactcgccgtcgaatccggacggctggcatttgaagccgggccggtcgaagcgcgaaccaaagcccaagccagcacgccgacagtcggacaaccgttttggcattcggcggaatattga

SEQ ID NO: 470 - protein, 262 aa, Neisseria gonorrhoeae
MLTLYGETFPSRLLLGTAAYPTPEILKQSVRTARPAMITVSLRRTGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALKILRERLPDTPLIIDAGLGLPSQAAQVMEWGFDGVLLNTAVSRSGDPVNMARAFALAVESGRLAFEAGPVEARTKAQASTPTVGQPFWHSAEY

SEQ ID NO: 471 - DNA, 789 bp, Neisseria meningitidis
atgctcaccctatacggcgaaactttcccctcgcggctgctgctcggcacggctgcctacccgacccccgaaatcctcaaacaatccatccaaaccgcccagcctgcgatgattaccgtctcgctgcgccgcgcgggaagcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggataaaattggaactcatcggagatgacgacaccttgcagccggatgtgttccagcttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 472 - protein, 262 aa, Neisseria meningitidis
MLTLYGETFPSRLLLGTAAYPTPEILKQSIQTAQPAMITVSLRRAGSGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 473 - DNA, 789 bp, Neisseria meningitidis
atgctcaccctgtacagcgaaactttcccttcgcggctgctgctcggcacagccgcctacccgacccctgaaatcctcaaacaatccgtccgaaccgcccggcccgcgatgattaccgtctcgctgcgccgcgcgggatgcggcggcgaggcgcacggtcaggggttttggtcgctgcttcaagaaaccggcgttcccgtcctgccgaacacggcaggctgccaaagcgtgcaggaagcggtaacgacggcgcaaatggcgcgcgaagtgtttgaaaccgattggattaaactcgaactcatcggcgacgacgacaccttgcagccggatgtgttccaacttgtcgaagcggcggaaatcctgattaaagacggcttcaaagtgctgccttattgcaccgaagacctgattgcctgccgccgcctgctcgacgcgggctgtcaggcgttgatgccgtgggcggccccgatcggcacgggtttgggcgcggttcacgcctacgcgttgaacgtcctgcgcgaacgcctgcccgacacgccgctgattatcgacgcgggcttgggtttgccctcacaggcggcacaagtgatggaatggggctttgacggcgtgcttttgaatactgccgtttcccgcagcggcgatccggtcaatatggcacgcgccttcgcactcgccgtcgaatccggacggctggcatttgaagccggaccggtcgaagcacgcgacaaagcgcaagccagcacgccgacagtcggacaaccgttttggcattcggcggaatattga

SEQ ID NO: 474 - protein, 262 aa, Neisseria meningitidis
MLTLYSETFPSRLLLGTAAYPTPEILKQSVRTARPAMITVSLRRAGCGGEAHGQGFWSLLQETGVPVLPNTAGCQSVQEAVTTAQMAREVFETDWIKLELIGDDDTLQPDVFQLVEAAEILIKDGFKVLPYCTEDLIACRRLLDAGCQALMPWAAPIGTGLGAVHAYALNVLRERLPDTPLIIDAGLGLPSQAAQVMEWGFDGVLLNTAVSRSGDPVNMARAFALAVESGRLAFEAGPVEARDKAQASTPTVGQPFWHSAEY

SEQ ID NO: 475 - DNA, 873 bp, Neisseria gonorrhoeae
atggaaatatggaatatgttgaacacttggcccgatgccgtcccgatacgcgcggaggcggccgaatccgtggcggcggtcgcggctttgctgctggcgcgcgcccttctgttgaatatccacttcagacggcatccggatttcggcatcgaaagcaagcggcggtttttggttgccagccgcaatataacgctgcttttggtgctgttttcgctggcatttatctggtcggcgcaaattcaaacgctggctttgtcgatgtttgcggtggcggcggcggtcgtcgtggcgacaaaagaactgattatgtgtctgtcgggcagtattttaaggtctgccacccagcaatactcggtcggcgactatatcgaaatcaacggcctgcgcgggcgcgtggtcgacatcaatctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccattcagcggtatttggaaaacgtgcaggcggaaaaactgtttatcacgcccgccgccaggccgcgcgttacccgcgtaccgtacgacgacaaggcataccgcatcatcgtccgcttcgcctcccccgtttcaaagcggctggaaatccaacaggcggttatggacgaatttttgcgcgtacaataccgcctgttaaatcatcccgccggctccgaaacactttaa

SEQ ID NO: 476 - protein, 290 aa, Neisseria gonorrhoeae
MEIWNMLNTWPDAVPIRAEAAESVAAVAALLLARALLLNIHFRRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRYLENVQAEKLFITPAARPRVTRVPYDDKAYRIIVRFASPVSKRLEIQQAVMDEFLRVQYRLLNHPAGSETL

SEQ ID NO: 477 - DNA, 873 bp, Neisseria meningitidis
atggaaatatggaatatgttggacacttggctcggtgccgtcccgatacgtgcggaggcggtcgaatccgtggcggcggttgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagtattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactatgtcatccatacggtcgaaatccccgttcccatccatttggattcggatgaagccgtatgccgtctgaaagccgtactcgagcccttgtgcgcgccctacatccccgccatccaacggsatttggaaaacgtgcaggcggaaaaactgtttatcacgcccgccgccagaccgcgcgttacccgcgtgccgtacgatgacaaggcataccgcatcatcgtccgcttcgcttcccccgtttcaaagcggctggaaatccaacaggcggttatggacgaatttttgcgcgtacaataccgcctgttaaatcaccccgccggctccgaaacactttaa

SEQ ID NO: 478 - protein, 290 aa, Neisseria meningitidis
  misc_feature (220)..(220): Xaa can be any naturally occurring amino acid
MEIWNMLDTWLGAVPIRAEAVESVAAVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRXLENVQAEKLFITPAARPRVTRVPYDDKAYRIIVRFASPVSKRLEIQQAVMDEFLRVQYRLLNHPAGSETL

SEQ ID NO: 479 - DNA, 873 bp, Neisseria meningitidis
atggaaatatggaatatgttggacacttggctcggtgccgtcccgatacgtgcggaggcggtcgaatccgtggcggtggtcgcggctttgctgctggcgcgcgcccttctgttgaatatccacttcaaacggcatccggatttcggcatcgaaagcaagcggcggtttttggttgccagccgcaatataacgctgcttttggtgctgttttcgctggcatttatctggtcggcgcaaatccaaacgctggctttgtcgatgtttgcggtggcggcggcggtcgtcgtggcgacgaaggaactgattatgtgtctgtcgggcagcattttaaggtctgccacccagcaatactcggtcggcgactatatcgaaatcaacggcctgcgcgggcgcgtggtcgacatcaacctgttgaacacgctgatgatgcaggtcggtccgaaccccttggtcggacagcttgcgggaaccaccgtttctttccccaacagcctgttgttgagccaccccgtgcgccgcgacaatattttgggcgactacgtcatccatacggtcgaaatcccggttcccatccatttggattcggatgaagccgtatgccgtctgaaagccgtactcgagcccttgtgcgcgccctacatccccgccatccaacggcatttggaaaacgtgcaggcggaaaaactgtttatcacgcccgccgccaaaccgcgcgttacccgcgtgccgtacgatgacaaggcataccgcatcatcgtccgcttcgcctcccccgtttcaaagcggctggaaatccaacaggcggttatggacgaatttttgcgcgtacaataccgcctgttaaattaccccgccggctccgaaacactttaa

SEQ ID NO: 480 - protein, 290 aa, Neisseria meningitidis
MEIWNMLDTWLGAVPIRAEAVESVAVVAALLLARALLLNIHFKRHPDFGIESKRRFLVASRNITLLLVLFSLAFIWSAQIQTLALSMFAVAAAVVVATKELIMCLSGSILRSATQQYSVGDYIEINGLRGRVVDINLLNTLMMQVGPNPLVGQLAGTTVSFPNSLLLSHPVRRDNILGDYVIHTVEIPVPIHLDSDEAVCRLKAVLEPLCAPYIPAIQRHLENVQAEKLFITPAAKPRVTRVPYDDKAYRIIVRFASPVSKRLEIQQAVMDEFLRVQYRLLNYPAGSETL

SEQ ID NO: 481 - DNA, 2037 bp, Neisseria gonorrhoeae
atgattgacaacgcactgctccacttgggcgaagaaccccgttttaatcaaatccaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtagaatgggacgcggtcgaactgcccagccagtttatggaaaacttcgtttgggaatacaatgtattggcacaaatgtccgcccacgaagaaaccggcgagcccctgccgaaagaactcttcgacaaaatgctcgccgccaaaaacttccagcgcggtatgttcctcgtccggcaaatggagttcgccctcttcgatatgatgatttacagtgaaagcgacgaatgccgtctgaaaaactggcagcaggttttagacagcgtgcgcaaagaagtcgccgtcatccaaccgcccgaatacaaccgcttcgccaacagcttcggccacatcttcgccggcggctattccgcaggctattacagctacgcatgggccgaagtcctcagcaccgatgcctacgccgcctttgaagaaagcgacgacgtcgccgccacaggcaaacgcttctggcaagaaatccttgccgtcggcggctcccgcagcgcggcggaatccttcaaagccttccgcggacgcgaaccgagcatagacgcactgctgcgccaaagcggtttcgacaacgcggcttga

SEQ ID NO: 482 - protein, 678 aa, Neisseria gonorrhoeae
MIDNALLHLGEEPRFNQIQTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVEWDAVELPSQFMENFVWEYNVLAQMSAHEETGEPLPKELFDKMLAAKNFQRGMFLVRQMEFALFDMMIYSESDECRLKNWQQVLDSVRKEVAVIQPPEYNRFANSFGHIFAGGYSAGYYSYAWAEVLSTDAYAAFEESDDVAATGKRFWQEILAVGGSRSAAESFKAFRGREPSIDALLRQSGFDNAA

SEQ ID NO: 483 - DNA, 1431 bp, Neisseria meningitidis
  misc_feature (1216)..(1216): n is a, c, g, or t
  misc_feature (1334)..(1334): n is a, c, g, or t
  misc_feature (1347)..(1347): n is a, c, g, or t
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactgcgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccactacgccagcgaaaaactgcgcgaagccaaatacgcgttcagcgaaaccgawgtcaaaaaatayttcccygtcggcaawgtattaaacggactgttcgcccaamtcaaaaaactmtacggcatcggatttaccgaaaaaacygtccccgtctggcacaaagacgtgcgctattktgaattgcaacaaaacggcgaamccataggcggcgtttatatggatttgtacgcacgcgaaggcaaacgcggcggcgcgtggatgaacgactacaaaggccgccgccgtttttcagacggcacgctgcaaytgcccaccgcctacctcgtctgcaacttcgccccacccgtcggcggcagggaagcccgcytgagccacgacgaaatcctcatcctcttccacgaaaccggacacgggctgcaccacctgcttacccaagtggacgaactgggcgtatccggcatcaacggcgtakaatgggacgcggtcgaactgcccagccagtttatggaaaatttcgtttgggaatacaatgtcttggcacaamtgtcagcccacgaagaaaccggcgttcccytgccgaaagaactcttsgacaaawtgctcgccgccaaaaacttccaasgcggcatgttcytsgtccggcaawtggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcagctnattacagctacgcgtgggcggaagtattgagcgcggacgcatacgccgcctttgaagaaagcgacgatgtcgccgccacaggcaaacgcttttggcaggaaatcctcgccgtcggggnatcgcgcagcggngcagaatccttcaaagccttccgcggccgcgaaccgagcatagacgcactcttgcgccacagcggtttcgacaacgcggtctga

SEQ ID NO: 484 - protein, 476 aa, Neisseria meningitidis
  misc_feature (149)..(149): Xaa can be any naturally occurring amino acid
  misc_feature (158)..(158): Xaa can be any naturally occurring amino acid
  misc_feature (167)..(167): Xaa can be any naturally occurring amino acid
  misc_feature (190)..(190): Xaa can be any naturally occurring amino acid
  misc_feature (198)..(198): Xaa can be any naturally occurring amino acid
  misc_feature (289)..(289): Xaa can be any naturally occurring amino acid
  misc_feature (313)..(313): Xaa can be any naturally occurring amino acid
  misc_feature (328)..(328): Xaa can be any naturally occurring amino acid
  misc_feature (331)..(331): Xaa can be any naturally occurring amino acid
  misc_feature (339)..(339): Xaa can be any naturally occurring amino acid
  misc_feature (343)..(343): Xaa can be any naturally occurring amino acid
  misc_feature (347)..(347): Xaa can be any naturally occurring amino acid
  misc_feature (406)..(406): Xaa can be any naturally occurring amino acid
  misc_feature (445)..(445): Xaa can be any naturally occurring amino acid
MTDNALLHLGEEPRFDQIKTEDIKPALQTAIAEAREQIAAIKAQTHTGWANTVEPLTGITERVGRIWGVVSHLNCVADTPELRAVYNELMPEITVFFTEIGQDIELYNRFKTIKNSPEFDTLSPAQKTKLNHYASEKLREAKYAFSETXVKKYFPVGXVLNGLFAQXKKLYGIGFTEKTVPVWHKDVRYXELQQNGEXIGGVYMDLYAREGKRGGAWMNDYKGRRRFSDGTLQLPTAYLVCNFAPPVGGREARLSHDEILILFHETGHGLHHLLTQVDELGVSGINGVXWDAVELPSQFMENFVWEYNVLAQXSAHEETGVPLPKELXDKXLAAKNFQXGMFXVRQXEFALFDMMIYSEDDEGRLKNWQQVLDSVRKKVAVIQPPEYNRFALSFGHIFAGGYSAAXYSYAWAEVLSADAYAAFEESDDVAATGKRFWQEILAVGXSRSGAESFKAFRGREPSIDALLRHSGFDNAV

SEQ ID NO: 485 - DNA, 2037 bp, Neisseria meningitidis
atgactgacaacgcactgctccatttgggcgaagaaccccgttttgatcaaatcaaaaccgaagacatcaaacccgccctgcaaaccgccattgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcaccgacacgcccgaactgcgcgccgcctacaatgaattaatgcccgaaattaccgtcttcttcaccgaaatcggacaagacatcgagctgtacaaccgcttcaaaaccatcaaaaactcccccgagttcgacaccctctcccacgcgcaaaaaaccaaactcaaccacgatctgcgcgatttcgtcctcagcggcgcggaactgccgcccgaacagcaggcagaattggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgctgccgcgcaaagcgaaggcaaaacaggctacaaaatcggtttgcagattccgcactacctcgccgtcatccaatacgccgacaaccgcaaactgcgcgaacaaatctaccgcgcctacgttacccgcgccagcgagctttcagacgacggcaaattcgacaacaccgccaacatcgaccgcacgctcgaaaacgccctgcaaaccgccaaactgctcggcttcaaaaactacgccgaattgtcgctggcaaccaaaatggcggacacccccgaacaagttttaaacttcctgcacgacctcgcccgccgcgccaaaccctacgccgaaaaagacctcgccgaagtcaaagccttcgcccgcgaaagcctcggcctcgccgatttgcaaccgtgggacttgggctacgccggcgaaaaactgcgcgaagccaaatacgcattcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcaccccgcccgtcggcggcaaagaagcccgcttgagccatgacgaaatcctcaccctcttccacgaaaccggacacggcctgcaccacctgcttacccaagtcgacgaactgggcgtatccggcatcaacggcgtagaatgggacgcagtcgaactgcccagtcagtttatggaaaatttcgtttgggaatacaatgtcttggcgcaaatgtccgcccacgaagaaaccggcgttcccctgccgaaagaactcttcgacaaaatgctcgccgccaaaaacttccaacgcggaatgttcctcgtccgccaaatggagttcgccctctttgatatgatgatttacagcgaagacgacgaaggccgtctgaaaaactggcaacaggttttagacagcgtgcgcaaagaagtcgccgtcgtccgaccgcccgaatacaaccgcttcgccaacagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggacgcgaaccgagcatagacgcactcttgcgccacagcggcttcgacaacgcggcttga

SEQ ID NO: 486 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVTDTPELRAAYNELMPEITVFFTEIGQDIELYNRFKTIKNSPEFDTLSHAQKTKLNHDLRDFVLSGAELPPEQQAELAKLQTEGAQLSAKFSQNVLDATDAFGIYFDDAAPLAGIPEDALAMFAAAAQSEGKTGYKIGLQIPHYLAVIQYADNRKLREQIYRAYVTRASELSDDGKFDNTANIDRTLENALQTAKLLGFKNYAELSLATKMADTPEQVLNFLHDLARRAKPYAEKDLAEVKAFARESLGLADLQPWDLGYAGEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFTPPVGGKEARLSHDEILTLFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKEVAVVRPPEYNRFANSFGHIFAGGYSAGYYSYAWAEVLSADAYAAFEESDDVAATGKRFWQEILAVGGSRSAAESFKAFRGREPSIDALLRHSGFDNAA

SEQ ID NO: 487 - DNA, 1473 bp, Neisseria gonorrhoeae
atgattgacaacgcactgctccacttgggcgaagaaccccgttttaatcaaatcaaaaccgaagacatcaaacccgccgtccaaaccgccatcgccgaagcgcgcggacaaatcgccgccgtcaaagcgcaaacgcacaccggctgggcgaacaccgtcgagcgtctgaccggcatcaccgaacgcgtcggcaggatttggggcgtcgtgtcccatctcaactccgtcgtcgacacgcccgaactgcgcgccgtctataacgaactgatgcctgaaatcaccgtcttcttcaccgaaatcggacaagacatcgaactgtacaaccgcttcaaaaccatcaaaaattcccccgaatttgcaacgctttcccccgcacaaaaaaccaagctcgatcacgacctgcgcgatttcgtattgagcggcgcggaactgccgcccgaacggcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaggcaaaacaggttacaaaatcggcttgcagattccgcactaccttgccgttatccaatacgccggcaaccgcgaactgcgcgaacaaatctaccgcgcctacgttacccgtgccagcgaactttcaaacgacggcaaattcgacaacaccgccaacatcgaccgcacgctcgaaaacgcattgaaaaccgccaaactgctcggctttaaaaattacgccgaattgtcgctggcaaccaaaatggcggacacgcccgaacaggttttaaacttcctgcacgacctcgcccgccgcgccaaaccctacgccgaaaaagacctcgccgaagtcaaagccttcgcccgcgaacacctcggtctcgccgacccgcagccgtgggacttgagctacgccggcgaaaaactgcgcgaagccaaatacgcattcagcgaaaccgaagtcaaaaaatacttccccgtcggcaaagttctggcaggcctgttcgcccaaatcaaaaaactctacggcatcggattcgccgaaaaaaccgttcccgtctggcacaaagacgtgcgctattttgaattgcaacaaaacggcaaaaccatcggcggcgtttatatggatttgtacgcacgcgaaggcaaacgcggcggcgcgtggatgaacgactacaaaggccgccgccgctttgccgacggcacgctgcaactgcccaccgcctacctcgtctgcaacttcgccccgcccgtcggcggcaaagaagcgcgtttaagccacgacgaaatcctcaccctcttccacgaaaccggccacggactgcaccacctgcttacccaagtggacgaactgggcgtgtccggcatcaacggcgtaaaa

SEQ ID NO: 488 - protein, 491 aa, Neisseria gonorrhoeae
MIDNALLHLGEEPRFNQIKTEDIKPAVQTAIAEARGQIAAVKAQTHTGWANTVERLTGITERVGRIWGVVSHLNSVVDTPELRAVYNELMPEITVFFTEIGQDIELYNRFKTIKNSPEFATLSPAQKTKLDHDLRDFVLSGAELPPERQAELAKLQTEGAQLSAKFSQNVLDATDAFGIYFDDAAPLAGIPEDALAMFAAAAQSEGKTGYKIGLQIPHYLAVIQYAGNRELREQIYRAYVTRASELSNDGKFDNTANIDRTLENALKTAKLLGFKNYAELSLATKMADTPEQVLNFLHDLARRAKPYAEKDLAEVKAFAREHLGLADPQPWDLSYAGEKLREAKYAFSETEVKKYFPVGKVLAGLFAQIKKLYGIGFAEKTVPVWHKDVRYFELQQNGKTIGGVYMDLYAREGKRGGAWMNDYKGRRRFADGTLQLPTAYLVCNFAPPVGGKEARLSHDEILTLFHETGHGLHHLLTQVDELGVSGINGVK

SEQ ID NO: 489 - DNA, 2037 bp, Neisseria meningitidis
atgactgacaacgcactgctccatttgggcgaagaaccccgttttgatcaaatcaaaaccgaagacatcaaacccgccctgcaaaccgccatcgccgaagcgcgcgaacaaatcgccgccatcaaagcccaaacgcacaccggctgggcaaacactgtcgaacccctgaccggcatcaccgaacgcgtcggcaggatttggggcgtggtgtcgcacctcaactccgtcgccgacacgcccgaactgcgcgccgtctataacgaactgatgcccgaaatcaccgtcttcttcaccgaaatcggacaagacatcgagctgtacaaccgcttcaaaaccatcaaaaattcccccgaattcgacaccctctcccccgcacaaaaaaccaaactcaaccacgatctgcgcgatttcgtcctcagcggcgcggaactgccgcccgaacagcaggcagaactggcaaaactgcaaaccgaaggcgcgcaactttccgccaaattctcccaaaacgtcctagacgcgaccgacgcgttcggcatttactttgacgatgccgcaccgcttgccggcattcccgaagacgcgctcgccatgtttgccgccgccgcgcaaagcgaaagcaaaacaggctacaaaatcggcttgcagattccacactacctcgccgtcatccaatacgccgacaaccgcgaactgcgcgaacaaatctaccgcgcctacgttacccgcgccagcgaactttcagacgacggcaaattcgacaacaccgccaacatcgaccgcacgctcgcaaacgccctgcaaaccgccaaactgctcggcttcaaaaactacgccgaattgtcgctggcaaccaaaatggcggacacgcccgaacaagttttaaacttcctgcacgacctcgcccgccgcgccaaaccctacgccgaaaaagacctcgccgaagtcaaagccttcgcccgcgaaagcctgaacctcgccgatttgcaaccgtgggacttgggctacgccagcgaaaaactgcgcgaagccaaatacgcgttcagcgaaaccgaagtcaaaaaatacttccccgtcggcaaagtattaaacggactgttcgcccaaatcaaaaaactctacggcatcggatttaccgaaaaaaccgtccccgtctggcacaaagacgtgcgctattttgaattgcaacaaaacggcgaaaccataggcggcgtttatatggatttgtacgcacgcgaaggcaaacgcggcggcgcgtggatgaacgactacaaaggccgccgccgtttttcagacggcacgctgcaactgcccaccgcctacctcgtctgcaacttcgccccacccgtcggcggcagggaagcccgcctgagccacgacgaaatcctcatcctcttccacgaaaccggacacgggctgcaccacctgcttacccaagtggacgaactgggcgtatccggcatcaacggcgtagaatgggacgcggtcgaactgcccagccagtttatggaaaatttcgtttgggaatacaatgtcttggcacaaatgtcagcccacgaagaaaccggcgttcccctgccgaaagaactcttcgacaaaatgctcgccgccaaaaacttccaacgcggcatgttcctcgtccggcaaatggagttcgccctctttgatatgatgatttacagcgaagacgacgaaggccgtctgaaaaactggcaacaggttttagacagcgtgcgcaaaaaagtcgccgtcatccagccgcccgaatacaaccgcttcgccttgagcttcggccacatcttcgcaggcggctattccgcaggctattacagctacgcgtgggcggaagtattgagcgcggacgcatacgccgcctttgaagaaagcgacgatgtcgccgccacaggcaaacgcttttggcaggaaatcctcgccgtcggcggatcgcgcagcgcggcagaatccttcaaagccttccgcggccgcgaaccgagcatagacgcactcttgcgccacagcggtttcgacaacgcggtctga

SEQ ID NO: 490 - protein, 678 aa, Neisseria meningitidis
MTDNALLHLGEEPRFDQIKTEDIKPALQTAIAEAREQIAAIKAQTHTGWANTVEPLTGITERVGRIWGVVSHLNSVADTPELRAVYNELMPEITVFFTEIGQDIELYNRFKTIKNSPEFDTLSPAQKTKLNHDLRDFVLSGAELPPEQQAELAKLQTEGAQLSAKFSQNVLDATDAFGIYFDDAAPLAGIPEDALAMFAAAAQSESKTGYKIGLQIPHYLAVIQYADNRELREQIYRAYVTRASELSDDGKFDNTANIDRTLANALQTAKLLGFKNYAELSLATKMADTPEQVLNFLHDLARRAKPYAEKDLAEVKAFARESLNLADLQPWDLGYASEKLREAKYAFSETEVKKYFPVGKVLNGLFAQIKKLYGIGFTEKTVPVWHKDVRYFELQQNGETIGGVYMDLYAREGKRGGAWMNDYKGRRRFSDGTLQLPTAYLVCNFAPPVGGREARLSHDEILILFHETGHGLHHLLTQVDELGVSGINGVEWDAVELPSQFMENFVWEYNVLAQMSAHEETGVPLPKELFDKMLAAKNFQRGMFLVRQMEFALFDMMIYSEDDEGRLKNWQQVLDSVRKKVAVIQPPEYNRFALSFGHIFAGGYSAGYYSYAWAEVLSADAYAAFEESDDVAATGKRFWQEILAVGGSRSAAESFKAFRGREPSIDALLRHSGFDNAV

SEQ ID NO: 491 - DNA, 2037 bp, Neisseria meningitidis; identical to SEQ ID NO: 485

SEQ ID NO: 492 - protein, 678 aa, Neisseria meningitidis; identical to SEQ ID NO: 486

SEQ ID NO: 493 - DNA, 507 bp, Neisseria gonorrhoeae
atgctttcacctcctcggcgtaaaacggcggcacatcaatcaagccgtctttcatttgcgtgcggaaaaaatgcggcgtgttgccgtgatcaaaatcaatatcgtgcagcatccagcccaaatcgcggtttgcctcgctttccgataacgccgacggcggcagcggttcacccttatccgcgctttcgccatttgccctttcaggctgcgggcataggggcggaacaggcggcggtcgaatcctgtttcatccggacaaacgcgttggcagtcggaaaatccggccggccgtgtcaaataatgcgttactttggccgggtcttgtcctttgtaagcggcggtctttttttgcgcgccatccgcatctgtttgggcgcatggcaaacggcggctgccgtacaatcaaaatgtttggcgatttcatgcagacaggcatccggatgccgcccgacatatcgagccggtttttgcctatccgatttggcggcatttaggccggtaacttga

SEQ ID NO: 494 - protein, 168 aa, Neisseria gonorrhoeae
MLSPPRRKTAAHQSSRLSFACGKNAACCRDQNQYRAASSPNRGLPRFPITPTAAAVHPYPRFRHLPFQAAGIGAEQAAVESCFIRTNALAVGKSGRPCQIMRYFGRVLSFVSGGLFLRAIRICLGAWQTAAAVQSKCLAISCRQASGCRPTYRAGFCLSDLAAFRPVT

SEQ ID NO: 495 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccggctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatccgggtgttgcccaacatattgagccggtttttgcctatccgatttgacggcatttagaccggtaacttga

SEQ ID NO: 496 - protein, 110 aa, Neisseria meningitidis
  misc_feature (69)..(69): Xaa can be any naturally occurring amino acid
  misc_feature (86)..(86): Xaa can be any naturally occurring amino acid
  misc_feature (95)..(95): Xaa can be any naturally occurring amino acid
YLRFHYLPFQAAGIGTEQVAVKSCFIQINTLVVGKFGRLCQIMRYFGRVLFFVSGGLFLRVIPICLSAXQMVAAVQSKCLAISCRXASGCCPTYXAGFCLSDLTAFRPVT

SEQ ID NO: 497 - DNA, 333 bp, Neisseria meningitidis
tatctgcgctttcactatttgccctttcaggctgcgggcatagggacggaacaggtagcggtcaaatcctgtttcatccaaataaacacgttggtagtcggaaaattcggccagctgtgtcaaataatgcgttactttggccgggtcttgttctttgtaagtggtggtctttttttgcgcgttatccccatctgtttgagtgcatagcaaatggtggctgccgtacaatcaaaatgtttggcgatttcatgcagataggcatcctggtgttgcccaacatattgagccggtttttgcctatccgatttgacggcatttagaccggtaacttga

SEQ ID NO: 498 - protein, 107 aa, Neisseria meningitidis
YLRFHYLPFQAAGIGTEQVAVKSCFIQINTLVVGKFGQLCQIMRYFGRVLFFVSGGLFLRVIPICLSAQMVAAVQSKCLAISCRASWCCPTYAGFCLSDLTAFRPVT

SEQ ID NO: 499 - DNA, 840 bp, Neisseria gonorrhoeae
atgaaacaactccgcgacaacaaagcccaaggctctgcactgtttacccttgtgagcggtatcgttattgttattgcagtcctttatttcctgattaagctggcgggcagtggatcgttcggcgatgtcgatgccactacggaagcggcaacgcagacccgcatccagcctgtcggacaattgacgatgggtgacggcatccccgtcggcgaacgccaaggcgaacagattttcggcaaaatctgtatccaatgccacgcggcggacagcaatgtgccgaacgctccgaaactggaacacaacggcgactgggcgccgcgtatcgcgcaaggcttcgataccttgttccaacacgcgctgaacggctttaacgccatgcctgccaaaggcggtgcggcagacctgaccgatcaggaactcaaacgggcgattacctacatggcgaataaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacatgcccttgaaggctttaacgcgatgccggccaaaggcggcaatgcaggtttgagcgatgacgaagtcaaagcggctgttgactatatggcaaaccaatccggtgcaaaattctaa

SEQ ID NO: 500 - protein, 279 aa, Neisseria gonorrhoeae
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAADLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 501 - DNA, 619 bp, Neisseria meningitidis
ggcgaacagattttcggcaaaatctgtatccaatgccacgcggcggacagcaatgtgccgaacgctccgaaactggaacacaacggcgattrggcaccgcgtatcggcaaggcttcgataccttgttccaacacgcgctgaacggctttaacgccatgcctgcaaaaggcggtgcggcagacctgaccgatcaggaacttaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcacccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaargcggcaatgcaggtttgagcgatgacgaagtcaaagcggctgttgactatatggcaaaccaatccggtgcaaaattctaa

SEQ ID NO: 502 - protein, 204 aa, Neisseria meningitidis
  misc_feature (31)..(31): Xaa can be any naturally occurring amino acid
  misc_feature (179)..(179): Xaa can be any naturally occurring amino acid
GEQIFGKICIQCHAADSNVPNAPKLEHNGDXAPRIQGFDTLFQHALNGFNAMPAKGGAADLTDQELKRAITYMANKSGGSFPNPDEAAPADNAASGTASAPADSAAPAEAKAEDKGAAPAVGVDGKKVFEATCQVCHGGSIPGIPGIGKKDDWAPRIKKGKETLHKHALEGFNAMPAKXGNAGLSDDEVKAAVDYMANQSGAKF

SEQ ID NO: 503 - DNA, 840 bp, Neisseria meningitidis
atgaaacaactccgcgacaacaaagcccaaggctctgcactgtttacccttgtgagcggtatcgttattgttattgcagtcctttatttcctgattaagctggcgggcagcggctcgttcggcgatgtcgatgccactacggaagcagcaacgcagacccgtatccagcctgtcggacaattgacgatgggcgacggcatccccgtcggcgaacgccaaggcgaacagattttcggcaaaatctgtatccaatgccacgcggcggacagcaatgtgccgaacgctccgaaactggaacacaacggcgattgggcgccgcgtatcgcgcaaggcttcgataccttgttccaacacgcgctgaacggctttaacgccatgcctgccaaaggcggtgcggtagacctgaccgatcaggaactcaaacgggcgattacttacatggcgaacaaaagcggcggttctttcccgaatcctgatgaggctgcgcctgccgacaatgccgcttcaggaacagcttctgctcctgccgatagtgcagctccggcagaagcgaaggcagaagacaagggtgcggcagcccctgcggtcggcgttgacggtaaaaaagtcttcgaagcaacctgtcaggtgtgccacggcggttcgattcccggtattcccggcataggcaaaaaagacgattgggcaccgcgtatcaaaaaaggcaaagaaaccttgcacaaacacgcccttgaaggctttaacgcgatgcctgccaaaggcggcaatgcaggtttgagcgatgacgaagtcaaagcggctgttgactatatggcaaaccaatccggtgcaaaattctaa

SEQ ID NO: 504 - protein, 279 aa, Neisseria meningitidis
MKQLRDNKAQGSALFTLVSGIVIVIAVLYFLIKLAGSGSFGDVDATTEAATQTRIQPVGQLTMGDGIPVGERQGEQIFGKICIQCHAADSNVPNAPKLEHNGDWAPRIAQGFDTLFQHALNGFNAMPAKGGAVDLTDQELKRAITYMANKSGGSFPNPDEAAPADNAASGTASAPADSAAPAEAKAEDKGAAAPAVGVDGKKVFEATCQVCHGGSIPGIPGIGKKDDWAPRIKKGKETLHKHALEGFNAMPAKGGNAGLSDDEVKAAVDYMANQSGAKF

SEQ ID NO: 505 - DNA, 378 bp, Neisseria gonorrhoeae
atggaagccttcaaaaccctaatttggattattaatattatttccgctttggccgtcatcgtgttagtattgctccaacacggcaaaggcgcggatgccggcgcgaccttcggatcgggaagcggcagcgcgcaaggcgtattcggctctgccggcaacgccaacttcctcagccgctcgaccgccgttgcagcaacatttttctttgcaacctgcatgggctatggtgtatattcacacccacacgacaaaacacggtttggacttcagcaacatacgacagactcagcaagcacccaaacccgtaagcaataccgaaccttctgcccctgttcctcagcagcagaaataacagtttttcaaatgccgacatggtga

SEQ ID NO: 506 - protein, 125 aa, Neisseria gonorrhoeae
MEAFKTLIWIINIISALAVIVLVLLQHGKGADAGATFGSGSGSAQGVFGSAGNANFLSRSTAVAATFFFATCMGYGVYSHPHDKTRFGLQQHTTDSASTQTRKQYRTFCPCSSAAEITVFQMPTW

SEQ ID NO: 507 - DNA, 114 bp, Neisseria meningitidis
atggaacccttcaaaaccttaatttggattgttaatttaatttccgctttggccgtcttcgtgttagtattgctccaacacggcaaaggcgcggatgccggcgcgactttcgga

SEQ ID NO: 508 - protein, 38 aa, Neisseria meningitidis
MEPFKTLIWIVNLISALAVFVLVLLQHGKGADAGATFG

SEQ ID NO: 509 - DNA, 378 bp, Neisseria meningitidis
atggaagccttcaaaaccctaatttggattgttaatataatttccgctttggccgtcatcgtgttagtattgctccaacacggcaaaggcgcggatgccggcgcgactttcggatcgggaagcggcagcgcgcaaggcgtattcggctctgccggcaacgctaacttcctcagccgctcgaccgccgttgcagcaacatttttctttgcaacctgcatgggctatggtgtatattcacacccacacgacaaaacacggtttggacttcagcaacgtacaacaaactcagcaagcacccaaacccgtaagcaataccgaaccttctgcccctgttcctcagcagcagaaataacagtttttcaaatgccgacatggtga

SEQ ID NO: 510 - protein, 125 aa, Neisseria meningitidis
MEAFKTLIWIVNIISALAVIVLVLLQHGKGADAGATFGSGSGSAQGVFGSAGNANFLSRSTAVAATFFFATCMGYGVYSHPHDKTRFGLQQRTTNSASTQTRKQYRTFCPCSSAAEITVFQMPTW

SEQ ID NO: 511 - DNA, 1596 bp, Neisseria gonorrhoeae
atgtcccaagaaatcctcgaccaagtgcgccgccgccgcacgtttgccatcatctcccaccccgatgcgggtaaaaccacgctgaccgaaaaactgctgctgttttcgggcgcgattcaaagcgcaggcacggtgaaaggtaagaaaaccggcaaattcgccacctccgactggatggacatcgagaagcagcgcggcatttccgtggcatcaagcgtgatgcagttcgactacaaagaccacaccgtcaacctcttggacacgccgggacaccaagacttctccgaagacacctaccgcgttttaaccgcagtggacagcgccttgatggtcatcgacgcggcaaaaggcgtggaagcgcaaaccatcaaactcttgaacgtctgccgcctgcgcgatacgccgattgttaccttcatgaacaaatacgaccgcgaagtgcgcgattctttggaactcttggacgaagtggaagacatcctgcaaatccgctgcgcgcccgttacctggccgatcggtatgggcaaaaacttcaagggcgtgtaccacatcctgaacgacgaaatctatctctttgaagcgggcggcgaacgcctgccgcacgagttcgacatcatcaaaggcataaacaatcccgaattggaacaacgctttccgttggaaatccagcagttgcgcgacgaaatcgaattggtgcaggcggcttccaacgaatttaatctcgacgaatttctcgccggcgaactcacgccagtgttcttcggctctgcgattaacaacttcggcattcaggaaatcctcaattcattgattgactgggcacccgcaccgaaaccgcgcgacgcgaccatgcgcatggtcgggccggacgagccgaaattttccggatttatctttaaaatccaagccaatatggacccgaaacaccgcgaccgtatcgccttcttgcgcgtctgctccggtaaattcgagcgcggcatgaagatgaaacacctgcgtatcaaccgcgaaatcgccgcctccagcgtagtaaccttcatgtcgcacgaccgcgaactggcggaagaagcctacgccggcgacatcatcggcatcccgaaccacggcaacatccaaatcggcgacagcttctccgaaggcgaacaactggcgtttaccggcatcccattcttcgcgcccgaactgttccgcagcgtccgcatcaaaaacccgctgaaaatcaaacaactgcaaaaaggtttgcaacaactcggcgaagaaggtgcggttcaagtattcaaaccgatgagcggcgcggatttgattttgggtgcggtcggcgtgttgcagtttgaagtcgtaacctcacgcctcgccaacgaatacggcgtggaagccgtgttcgacagcgcatccatctggtcggcgcgctgggtatcgtgcgacgacaagaaaaaactggcggaatttgaaaaagccaacgcaggcaacctcgccatcgacgcaggcggcaacctcgcctacctcgcccccaaccgcgtgaatttggggttgacgcaagaacgctggccggacatcgtgttccacgaaacgcgcgaacattcggtcaaactctaa

SEQ ID NO: 512 - protein, 531 aa, Neisseria gonorrhoeae
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVEDILQIRCAPVTWPIGMGKNFKGVYHILNDEIYLFEAGGERLPHEFDIIKGINNPELEQRFPLEIQQLRDEIELVQAASNEFNLDEFLAGELTPVFFGSAINNFGIQEILNSLIDWAPAPKPRDATMRMVGPDEPKFSGFIFKIQANMDPKHRDRIAFLRVCSGKFERGMKMKHLRINREIAASSVVTFMSHDRELAEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 513 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcgggcgcgattcagagcgcgggtacggtaaaaggcaagaaaaccggcaaattcgccacttccgactggatggaaatcgagaagcagcgcggcatttccgtggcatcaagtgtgatgcagttcgattacaaagaccacaccgtcaacctcttggacacgccgggacaccaagacttctccgaagacacctaccgcgttttaaccgccgtggacagcgcattaatggtcatcgacgcggcaaaaggcgtggaagcgcaaaccatcaagctcttaaacgtctgccgcctgcgcgatacaccgattgttacgtttatgaacaaatacgaccgcgaagtgcgcgattccctggaacttttggacgaagtggaaaacattttaaaaatccgctgcgcgcccgttacctggccgatcggtatgggcaaaaacttcaagggcgtgtaccacatcctgaacgatgaaatttatctctttgaagctggcggcgaacgcctgccgcacgagttcgacatcatcaaaggcatcgataatcctgaattggaacaacgctttccgttggaaatccagcagttgcgcgacgaaatcgaattggtgcaggcggcttccaacgagtttaatctcgacgaattcctcgccggcgaactcacgcccgtattcttcggctctgcgattaacaacttcggtattcaggaaatcctcaattcattgattgactgggcgcccgcgccgaaaccgcgcgacgcgaccgtacgtatggtcgagccggacgagccgaagttttccggatttatcttcaaaatccaagccaatatggacccgaaacaccgcgaccgtattgccttcttgcgcgtctgctccggcaaattcgagcgcggcatgaagatgaaacacctgcgtatcaaccgcgaaatcgccgcctccagcgtggttaccttcatgtcgcacgaccgcgagctggttgaagaagcctacgccggcgacattatcggcatcccgaaccacggcaacatccaaatcggcgacagcttctccgaaggcgaacaactggcgttcaccggcatcccattcttcgcacccgaactgttccgcagcgtacgcatcaaaaacccgctgaaaatcaaacaactgcaaaaaggcttgcaacagctcggcgaagaaggcgcggtgcaggtgttcaaaccgatgagcggcgcggatttgattttgggcgcggtcggcgtgttgcagtttgaagtcgttacctcgcgcctcgccaacgaatacggcgtagaagccgtgttcgacagcgcatccatctggtcggcgcgctgggtatcgtgcgacgacaagaaaaaactggctgaatttgaaaaagccaacgcgggcaacctcgccatcgacgcaggcggcaacctcgcctacctcgcccccaaccgcgtgaatttgggactcacgcaagaacgttggccggacatcgtgttccacgaaacacgcgaacattcggtcaaactgtaa

SEQ ID NO: 514 - protein, 531 aa, Neisseria meningitidis
MSQEILDQVRRRRTFAIISHPDAGKTTLTEKLLLFSGAIQSAGTVKGKKTGKFATSDWMEIEKQRGISVASSVMQFDYKDHTVNLLDTPGHQDFSEDTYRVLTAVDSALMVIDAAKGVEAQTIKLLNVCRLRDTPIVTFMNKYDREVRDSLELLDEVENILKIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIDWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLAFTGIPFFAPELFRSVRIKNPLKIKQLQKGLQQLGEEGAVQVFKPMSGADLILGAVGVLQFEVVTSRLANEYGVEAVFDSASIWSARWVSCDDKKKLAEFEKANAGNLAIDAGGNLAYLAPNRVNLGLTQERWPDIVFHETREHSVKL

SEQ ID NO: 515 - DNA, 1596 bp, Neisseria meningitidis
atgtcccaagaaatcctcgaccaagtgcgccgccgccgcacgtttgccatcatctcccaccctgacgcaggtaaaaccacgttgactgaaaaactcttgctgttttcaggtgcgattcaaagcgcgggtacggtaaaaggcaagaaaaccggcaaattcgccacctccgactggatggacatcgagaagcagcgcggcatttccgtggcatcaagcgtgatgcagttcgactataaagaccacaccgtcaaccttttggacacgccgggacaccaagacttctccgaagacacctaccgcgttttgaccgccgtcgatagtgccttgatggtcatcgacgcggcaaaaggcgtggaagcgcaaaccatcaaactcttgaacgtctgccgcctgcgcaatacgccgattgttacgttcatgaacaaatacgaccgcgaagtgcgcgattccctggaattgctggacgaagtggaaaacatcctgcaaatccgctgcgcgcccgtaacctggccgatcggcatgggcaaaaacttcaaaggcgtgtaccacatcctgaacgacgaaatctatctctttgaagcgggcggcgaacgcttgccgcacgagttcgacatcatcaaaggcatcgataatcccgaattggaacaacgctttccgttagaaatacagcagttgcgcgacgaaatcgaattggtgcaggcggcttccaacgagttcaatctcgacgaattcctcgccggcgaactcacgcccgtattcttcggctctgcgattaacaacttcggtattcaggaaatcctcaattcattgattgaatgggcgcccgcgccgaaaccacgcgatgcgaccgtgcgtatggtcgagccggacgagccgaagttttccggatttatcttcaaaatccaagccaatatggacccgaaacaccgcgaccgtattgccttcttgcgcgtctgctccggcaaattcgagcgcggcatgaaaatgaaacacctgcgtatcaaccgcgaaatcgccgcctccagcgtggtaaccttcatgtcccacgaccgcgagctggttgaagaagcctacgccggcgacattatcggtatcccaaaccacggcaacatccaaatcggcgacagcttctccgaaggcgaacaactgacgtttaccggcatcccattcttcgcgcccgaactgttccgcagcgttcgcatcaaaaacccgctgaaaatcaagcaactgcaaaaaggtttgcaacagcttggcgaagaaggtgcggtgcaggtgttcaaaccaatgagcggcgcggatttgattttgggcgcggtcggcgtgttgcagtttgaagtcgttacctcgcgccttgccaacgaatacggcgtggaagccgtgttcgacaacgcatccatctggtcggcgcgctgggtatcgtgcgacgacaagaaaaaactggcggaatttgaaaaagccaacgcgggcaacctcgccatcgacgcgggcggcaacctcgcctacctcgcccctaaccgcgtgaatctgggactcacgcaagaacgctggccggacatcgtgttccacgaaacgcgcgagcattcggtcaaactttaa

SEQ ID NO: 516 - protein, 531 aa, Neisseria meningitidis
MSQEILDQVRRRRTFAIISHPDAGKTTLTEKLLLFSGAIQSAGTVKGKKTGKFATSDWMDIEKQRGISVASSVMQFDYKDHTVNLLDTPGHQDFSEDTYRVLTAVDSALMVIDAAKGVEAQTIKLLNVCRLRNTPIVTFMNKYDREVRDSLELLDEVENILQIRCAPVTWPIGMGKNFKGVYHILNDEIYLFEAGGERLPHEFDIIKGIDNPELEQRFPLEIQQLRDEIELVQAASNEFNLDEFLAGELTPVFFGSAINNFGIQEILNSLIEWAPAPKPRDATVRMVEPDEPKFSGFIFKIQANMDPKHRDRIAFLRVCSGKFERGMKMKHLRINREIAASSVVTFMSHDRELVEEAYAGDIIGIPNHGNIQIGDSFSEGEQLTFTGIPFFAPELFRSVRIKNPLKIKQLQKGLQQLGEEGAVQVFKPMSGADLILGAVGVLQFEVVTSRLANEYGVEAVFDNASIWSARWVSCDDKKKLAEFEKANAGNLAIDAGGNLAYLAPNRVNLGLTQERWPDIVFHETREHSVKL

SEQ ID NO: 517 - DNA, 888 bp, Neisseria gonorrhoeae
atgaaatacaaaagaatcgtatttaaagtcggcacatcttcgattacccgttcggacggcagcctctcgcgcggcaaaatccaaaccatcacccgccagcttgccgcattgcatcatgcgggacacgagctggtcttggtgtcttccggcgcggttgctgcagggttcggcgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgtgccgactttgccgacaaacgccgctaccaaaatgccggcggcgcactttccgtgctgctgcaacgccgcgcgattcccatcatcaatgaaaacgacacggtttcggttgaggagttgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcactcaaacccgattcattggccgaagccgccgaacatcaggcggacggctcgtttttcgtcccccgtgccaaaggtttgcggacacagaagcaatggctggcgttctattccgaaagcgggggcagcgtttatgtggacgaaagtgcggaacacgctttgtccgaacaagggaaagcctgctga

SEQ ID NO: 518 - protein, 295 aa, Neisseria gonorrhoeae
MKYKRIVFKVGTSSITRSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAIPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDSLAEAAEHQADGSFFVPRAKGLRTQKQWLAFYSESGGSVYVDESAEHALSEQGKAC

SEQ ID NO: 519 - DNA, 1110 bp, Neisseria meningitidis
atgaaatacaaaagaatcgtatttaaagtcggcacatcttcgattacccattcggacggcagtctctcgcgcggcaaaatccaaaccatcacctgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcgcaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacacgggcaacccgaacagcaatcccgatgccgtacggctggacaaaatcgaacacatcaaccatgaaatcatcgaaatggcgggcggctcgggttcggcaaacggcacgggcggtatgctgaccaaaatcaaagcggcaaccatcgccgccgaatccggcgtaccggtgtatatctgttcctcgctcaaacccgatgcacttgccgaagctgccgaacatcaggcggacggctcgtttttcgtcccccgtgccaaaggtttgcggacgcagaagcaatggctggcgttctattccgaaagccggggcagcgtttatgtggacgaaggtgcggaacacgctttgtccgaacaggggaaaagcctgctgatgtcgggcattgccggaatcgaagggcatttttcccgtatggacaccgtaaccgtgtacagcaaggcaaccaaacagcccctgggcaaagggcgcgtcctgttcggctctgccgccgccgaagacctgctcaaatcgcgtaaggcgaaaggcgtgttcatccatcgggacgactggatttccatcacgcccgaaatacgcctgcttctgaccgaattttag

SEQ ID NO: 520 - protein, 369 aa, Neisseria meningitidis
MKYKRIVFKVGTSSITHSDGSLSRGKIQTITCQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDALAEAAEHQADGSFFVPRAKGLRTQKQWLAFYSESRGSVYVDEGAEHALSEQGKSLLMSGIAGIEGHFSRMDTVTVYSKATKQPLGKGRVLFGSAAAEDLLKSRKAKGVFIHRDDWISITPEIRLLLTEF

SEQ ID NO: 521 - DNA, 1110 bp, Neisseria meningitidis
atgaaatacaaaagaatcgtatttaaagtcggcacatcttcgattacccattcggacggcagtctctcgcgcggcaaaatccaaaccatcacccgccagcttgccgcattgcatcatgcgggacacgagctggtcttggtgtcttccggcgcggttgcggcagggttcggtgcgctgggtttcaaaaaacgtccggtcaaaatcgccgacaaacaggcttccgccgccgtcgggcaggggctgctgatggaagaatatacggcaaacctgtcttcagacggcatcgtgtccgcacaaatcctgctcagccgcgccgactttgccgacaaacgccgctaccaaaatgccggcggcgcactttccgtgctgctgcaacgccgcgccgtccccatcatcaatgaaaacgatacggtttcggttgaggaattgaaaatcggcgacaacgacacattgagtgcgcaagtggcggcgatgatacaggcagacctcttggtgctgctgaccgacatagacggtctttacaccggcaacccgaacagcaatcccgatgccgtacggctggacaaaatcgaacacatcaaccatgaaatcatcgaaatggcgggcggctcgggttcggcaaacggcacaggcggtatgctgactaaaatcaaagcggcgacgattgcgaccgagtccggcgtaccggtctatatctgttcctcgctcaaacccgatgcacttgccgaagcggcagataatcaggcggacggctcgtttttcgtcccccgtgccaaaggtttgcggacgcagaagcaatggctggcgttctattccgaaagcaggggcggcgtttatgtggacgaaggtgcggaacacgctttgtccgaacagggaaaaagcctgctgatgtcgggcattgccggaatcgaagggcatttttcccgtatggacaccgtaaccgtgtacagcaaggcaaccaaacagcctttgggcaaagggcgagtcctgttcggctctgccgccgccgaagacctgctcaaattgcgtaaggcgaaaggcgtgttcatccatcgggacgactggatttccatcacgcccgaaatacgcctgcttctgaccgaattttag

SEQ ID NO: 522 - protein, 369 aa, Neisseria meningitidis
MKYKRIVFKVGTSSITHSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIATESGVPVYICSSLKPDALAEAADNQADGSFFVPRAKGLRTQKQWLAFYSESRGGVYVDEGAEHALSEQGKSLLMSGIAGIEGHFSRMDTVTVYSKATKQPLGKGRVLFGSAAAEDLLKLRKAKGVFIHRDDWISITPEIRLLLTEF

SEQ ID NO: 523 - DNA, 672 bp, Neisseria gonorrhoeae
atggaaatccggtttcagacagcatttttacgtttggttcagatgaaaacaaacgcttcaattcttaccgcaacacgccttgtatttcctgccgctgccgcacggacagggatcgttcctgccggttttttccccttccctgcggacggtttgcggtttgttgatgaccgcctgccagtagcggtagatgtctgccagcgcgtaaggcagttcggacgcaagttccgccagctcgccttcggtgaattgcaggcggataacgccgttttcctcttcgtcgtaaatgccgcccactgccatcacggggtaaaacagctcttcaaacgcttcatcatcggcggcttcaaaccaatcggtcggcacaatgtccaaaccgtaaagataggcgttgcaccaagtgtaaaaatcgctgccgccctcgccgtcgtcgtagagccacaaatcgggcagctttttatccgacatcgcggcggttgtttccatcgccattgccaaaaccagccgttcgatttcggaacgttcggcggcggtaaattgcgattcgtcgcccaacacttcgggcagccagtcgagcggtgccaatttgtccggcccgctcaacagcgccgtcataaaaccttgaacctcgtcgcaacgcatcgtgttgccttgttcgcttttggcatccaataa

SEQ ID NO: 524 - protein, 223 aa, Neisseria gonorrhoeae
MEIRFQTAFLRLVQMKTNASILTATRLVFPAAAARTGIVPAGFFPFPADGLRFVDDRLPVAVDVCQRVRQFGRKFRQLAFGELQADNAVFLFVVNAAHCHHGVKQLFKRFIIGGFKPIGRHNVQTVKIGVAPSVKIAAALAVVVEPQIGQLFIRHRGGCFHRHCQNQPFDFGTFGGGKLRFVAQHFGQPVERCQFVRPAQQRRHKTLNLVATHRVALFAFGIQ

SEQ ID NO: 525 - DNA, 732 bp, Neisseria meningitidis
atggaaacaaacgcttcaattcttaccgcaacacgccttgtattttctgccgctgccgcacggacagggatcgttcctgcctgttttttcgccttccctgcggacggtttgcggtttgttgatgactgcctgccagtagcggtagatatccgccaatgcataaggcaactcggattccagttccgccagctcgccttctgtgaattgcagacggatagcgccgttttcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttcaaatgggttttgcgccctattatcgccgcaatgccgtctga

SEQ ID NO: 526 - protein, 243 aa, Neisseria meningitidis
METNASILTATRLVFSAAAARTGIVPACFFAFPADGLRFVDDCLPVAVDIRQCIRQLGFQFRQLAFCELQTDSAVFLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFQMGFAPYYRRNAV

SEQ ID NO: 527 - DNA, 837 bp, Neisseria meningitidis
atggaaacaaacgcttcaattcttaccgcaacacgccttgtattttctgccgctgccgcacggacagggatcgttcctgcctgttttttcgccttccctgcggacggtttgcggcttgttgatgaccgcctgccagtagcggtagatatccgccaatgcataaggcaactcggattccagttccgccagctcgccttctgtgaattgcagacggatagtgccgttgtcctcttcgtcgtaaataccgcccaatgccatgatgggataaaacaactcttcaaacgcttcatcatcgacggcttcaaaccaatcggtcggcacaatatccaaaccgtaaagataagcattgcaccatgtgtaaaaatcgctgccgccgtcttcgttttcatacagccacaaatcgggcagttttttatccgacatcgcggcggttgtttccatcgccattgccaaaaccagccgttcgatttcggaacgttcggcggcggtaaattgcgattcgtcgcccaacacttcgggcagccagtcgagcggtgtcaatttgtccggcccgctcaacagcgccgtcataaaaccttgaacctcgtcgcaacgcatcgtgttgccttgttcgcttttggcatccaacaattcgctcaaccgccgtttggatgcttcggtaaattttcgggaatccatcattttccttttccaatgggttttgcgccctattatagtggattaaatttaaatcaggacaaggcgacgaagccgcagacagtacaaatagtacggcaaggcgaggcaacgccgtactggtttaaatttaatccactatatcgccgcaatgccgtctga

SEQ ID NO: 528 - protein, 278 aa, Neisseria meningitidis
METNASILTATRLVFSAAAARTGIVPACFFAFPADGLRLVDDRLPVAVDIRQCIRQLGFQFRQLAFCELQTDSAVVLFVVNTAQCHDGIKQLFKRFIIDGFKPIGRHNIQTVKISIAPCVKIAAAVFVFIQPQIGQFFIRHRGGCFHRHCQNQPFDFGTFGGGKLRFVAQHFGQPVERCQFVRPAQQRRHKTLNLVATHRVALFAFGIQQFAQPPFGCFGKFSGIHHFPFPMGFAPYYSGLNLNQDKATKPQTVQIVRQGEATPYWFKFNPLYRRNAV

SEQ ID NO: 529 - DNA, 852 bp, Neisseria gonorrhoeae
atgattatccatcaccaattcgatcccgtcctcatcagtatcggcccgcttgccgtccgctggtatgccttaagctacatcctcggatttattctttttacctttctcggcagaaggcgcatcgcgcaaggcttgtccgtttttaccaaagaatcgctcgacgacttcctgacatggggcattttgggcgtgattttgggcggacgcttgggctatgtcctgttttacaaattctccgactacctcgcccatccgcttgatattttcaaggtatgggaaggcggaatgtcgttccacggcggctttttgggtgtagttattgccatatggttgttcagccgcaagcacggcatcggcttcctcaaactgatggacacggtcgcgccgctcgttccgctgggtctcgcttcgggacgtatcggcaactttatcaacggcgaactttggggacgcattaccgacattaacgcattttgggcaatgggcttcccgcaagcgcattacgaagatgccgaagccgccgcgcacaatccgctttgggcagaatggctgcaacaatacggtatgctgccgcgtcatccctcgcagctttatcagtttgcccttgaaggcatctgcctgttcgccgtcgtttggctgttttccaaaaaaccgcgcccgaccgggcagactgccgcgctttttctcggcggctacggcgtgttccgctttattgccgaatttgcgcgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 530 - protein, 283 aa, Neisseria gonorrhoeae
MIIHHQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFSRKHGIGFLKLMDTVAPLVPLGLASGRIGNFINGELWGRITDINAFWAMGFPQAHYEDAEAAAHNPLWAEWLQQYGMLPRHPSQLYQFALEGICLFAVVWLFSKKPRPTGQTAALFLGGYGVFRFIAEFARQPDDYLGLLTLGLSMGQWLSVPMIVLGIVGFVRFGMKKQH

SEQ ID NO: 531 - DNA, 852 bp, Neisseria meningitidis
atgattacccatccccaattcgatcccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatacggttgttcggccgcaaacacggcatcggcttcctcaaactgatggatacggtcgcaccgctcgttccgctgggtctcgcttcgggacgtatcggcaacttcatcaacggcgaactttggggacgcgttaccgacatcaacgcattttgggcaatgggcttcccgcaggcgcgttacgaagatgccgaagccgccgcgcacaatccgctttgggcagaatggctgcaacaatacggtatgctgccgcgtcatccctcgcagctttatcagtttgcacttgaaggcatctgcctgttcaccgtcatttggctgttctctaaaaaacagcggtcgaccggacaagtcgcctcgctcttcctcggcggctacggcatattccgcttcattgccgaattcgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 532 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIRLFGRKHGIGFLKLMDTVAPLVPLGLASGRIGNFINGELWGRVTDINAFWAMGFPQARYEDAEAAAHNPLWAEWLQQYGMLPRHPSQLYQFALEGICLFTVIWLFSKKQRSTGQVASLFLGGYGIFRFIAEFARQPDDYLGLLTLGLSMGQWLSVPMIVLGIVGFVRFGMKKQH

SEQ ID NO: 533 - DNA, 852 bp, Neisseria meningitidis
atgattacccatccccaattcgaccccgtccttatcagtatcggcccgcttgccgtccgctggtatgccctaagctacatcctcggatttattctttttacctttctcggcagaaggcgcatcgcgcaaggcttgtccgtttttaccaaagaatcgctcgacgacttcctgacatggggcattttgggcgtaattttgggcgggcgtttgggttacgtcctgttttacaagttttccgactacctcgcccatccgcttgatattttcaaggtatgggaaggcggaatgtcgttccacggcggctttttgggtgtagttattgccatatggttgttcggtcgcaaacacggcatcggcttcctcaaactgatggacacggtcgcaccgctcgttccactgggtctcgcttcgggacgtatcggcaacttcatcaacggcgaactttggggacgcgttaccgacatcaacgcattttgggcaatgggcttcccgcaggcgcgttacgaagacctcgaagccgccgcgcacaatccgctttgggcagaatggctgcaacaatacggtatgctgccgcgtcatccctcgcagctttatcagtttgcacttgaaggcatctgcctgttcgccgtcgtttggctgttctctaaaaaacagcggccgaccggacaagtcgcctcactcttcctcggcggctacggcatattccgcttcattgccgaatttgcacgccaacccgacgactatctcgggctgctgaccttggggctgtcgatggggcaatggttgagcgtcccgatgattgttttgggtatcgtcggctttgtccggttcggcatgaaaaaacagcactga

SEQ ID NO: 534 - protein, 283 aa, Neisseria meningitidis
MITHPQFDPVLISIGPLAVRWYALSYILGFILFTFLGRRRIAQGLSVFTKESLDDFLTWGILGVILGGRLGYVLFYKFSDYLAHPLDIFKVWEGGMSFHGGFLGVVIAIWLFGRKHGIGFLKLMDTVAPLVPLGLASGRIGNFINGELWGRVTDINAFWAMGFPQARYEDLEAAAHNPLWAEWLQQYGMLPRHPSQLYQFALEGICLFAVVWLFSKKQRPTGQVASLFLGGYGIFRFIAEFARQPDDYLGLLTLGLSMGQWLSVPMIVLGIVGFVRFGMKKQH

SEQ ID NO: 535 - DNA, 897 bp, Neisseria gonorrhoeae
atggagtttgaaaacattatttccgccgccgacaaggcgcgtatccttgccgaagcactgccttacatccgccggttttccggttcggtcgccgtcatcaagtatggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggcgaatttgtccaaggaatgcgcgttaccgacaaagagacgatggatattgtcgaaatggtattgggcgggcacgtcaacaaggaaatcgtgtcgatgattaacacatatggagggcacgcggtcggcgtgagcgggcgcgacgaccatttcattaaggcgaagaaacttttggtcgatacgcccgaacagaatagcgtggacatcggacaggtcggtacggtggaaagcatcgataccggtttggttaaagggctgatagaacgcggctgcattcccgtcgtcgcccccgtcggcgtaggtgaaaaaggcgaagcgttcaacatcaacgccgatttggtggcaggcaaattggcggaagaattgaacgccgaaaaactcttgatgatgacgaatatcgccggtgtgatggacaaaacgggcaatctgctgaccaaactcacgccgaaacggattgatgggctgattgccgacggcacgctgtatggcggtatgctgccgaaaatcgcttctgcggtcgaagccgccgtcaacggtgtgaaagccacgcacatcatcgacggcaggttgcccaacgcgcttttgctggaaatctttaccgatgccggtatcgggtcgatgattttaggcagaggggaagatgcctga

SEQ ID NO: 536 - protein, 298 aa, Neisseria gonorrhoeae
MEFENIISAADKARILAEALPYIRRFSGSVAVIKYGGNAMTEPALKEGFARDVVLLKLVGIHPVIVHGGGPQINAMLEKVGKKGEFVQGMRVTDKETMDIVEMVLGGHVNKEIVSMINTYGGHAVGVSGRDDHFIKAKKLLVDTPEQNSVDIGQVGTVESIDTGLVKGLIERGCIPVVAPVGVGEKGEAFNINADLVAGKLAEELNAEKLLMMTNIAGVMDKTGNLLTKLTPKRIDGLIADGTLYGGMLPKIASAVEAAVNGVKATHIIDGRLPNALLLEIFTDAGIGSMILGRGEDA

SEQ ID NO: 537 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggtgtgaaagccacgcatatcatcgacggcaggttgcccaacgcgcttttgctggaaatctttaccgatgccggtatcggttcgatgattttgggcggtggggaagatgcctga

SEQ ID NO: 538 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRLPNALLLEIFTDAGIGSMILGGGEDA

SEQ ID NO: 539 - DNA, 897 bp, Neisseria meningitidis
atggagtctgaaaacattatttccgccgccgacaaggcgcgtatccttgccgaagcgctgccttacatccgccggttttccggttcggtcgccgtcatcaaatacggcggcaacgcgatgaccgaacctgccttgaaagaagggtttgcccgcgatgtcgtgctgctgaagctggtcggcattcatcccgtcatcgttcacggcggcgggccgcagatcaatgcgatgcttgaaaaagtcggcaaaaagggtgagtttgtccaaggaatgcgcgttaccgacaaagaggcgatggatattgtcgaaatggtgttgggcgggcatgtcaataaagaaatcgtgtcgatgattaacacatatggcggacacgcggtcggcgtaagcggacgcgacgaccatttcattaaggcgaagaaacttttgatcgatacgcccgaacagaatggcgtggacatcggacaggtcggtacggtggaaagcatcgataccggtttggttaaagggctgatagaacgtggctgcattcccgtcgtcgcccccgtcggcgtaggtgaaaaaggcgaagcgttcaacatcaacgccgatttggtagcaggcaaattggcggaagaattgaacgccgaaaaactcttgatgatgacgaatatcgccggtgtgatggacaaaacgggcaatctgctgaccaaactcacgccgaaacggattgatgaactgattgccgacggcacgctgtatggcggtatgctgccgaaaatcgcttctgcggtcgaagccgccgtcaacggcgtgaaagccacgcatatcatcgacggcagggtgcccaacgcgcttttgctggaaatctttaccgatgccggtatcggttcgatgattttgggcggtggggaagatgcctga

SEQ ID NO: 540 - protein, 298 aa, Neisseria meningitidis
MESENIISAADKARILAEALPYIRRFSGSVAVIKYGGNAMTEPALKEGFARDVVLLKLVGIHPVIVHGGGPQINAMLEKVGKKGEFVQGMRVTDKEAMDIVEMVLGGHVNKEIVSMINTYGGHAVGVSGRDDHFIKAKKLLIDTPEQNGVDIGQVGTVESIDTGLVKGLIERGCIPVVAPVGVGEKGEAFNINADLVAGKLAEELNAEKLLMMTNIAGVMDKTGNLLTKLTPKRIDELIADGTLYGGMLPKIASAVEAAVNGVKATHIIDGRVPNALLLEIFTDAGIGSMILGGGEDA

SEQ ID NO: 541 - DNA, 537 bp, Neisseria gonorrhoeae
atgcgaaccacctcaaccttccctacaaaaactttcaaaccggctgccatggcgttagctgttgcaacaacactttctgcctgcttaggcggcggcggaggcggcacttctgctcccgactttaatgcaggcggcaccggtatcggcagcaacagcagggcaacgatagcggaatcagcagcagtatcttacgccggtataaaaaacgaaatgtgcaaagacagaagcatgctctgtgccggtcgggatgacgttgcggttacagacagggatgccaaaatcaaagccccccgaatctgcataccggagacttttcaaacccaaatgaccaatattaagaatatgatcaacctcaaacctgcaattgaagcaggctatacaggacgcggggtagaggtaggtatcgtcgatacaggcgaatccgtcggcagcatatcctttcccgaactgtatggcagaaaagaacacggctataacgaaaattacaaaaacaaattacaaaaactatacggcgtatatgcggaaggaagcgcctga

SEQ ID NO: 542 - protein, 178 aa, Neisseria gonorrhoeae
MRTTSTFPTKTFKPAAMALAVATTLSACLGGGGGGTSAPDFNAGGTGIGSNSRATIAESAAVSYAGIKNEMCKDRSMLCAGRDDVAVTDRDAKIKAPRICIPETFQTQMTNIKNMINLKPAIEAGYTGRGVEVGIVDTGESVGSISFPELYGRKEHGYNENYKNKLQKLYGVYAEGSA

SEQ ID NO: 543 - DNA, 528 bp, Neisseria meningitidis
atgcgaacgaccccaaccttccctacaaaaactttcaaaccgactgccatggcgttagctgttgcaacaacactttctgcctgcttaggcggcggcggaggcggcacttctgcgcccgacttcaatgcaggcggtaccggtatcggcagcaacagcagagcaacaacagcgaaatcagcagcagtatcttacgccggtatcaagaacgaaatgtgcaaagacagaagcatgctctgtgccggtcgggatgacgttgcggttacagacagggatgccaaaatcaatgcccccccccgaatctgcataccggagactttccaaacccaaatgacgcattacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacgaaaaactatacggcgtatatgcggaaggaagcgcctga

SEQ ID NO: 544 - protein, 175 aa, Neisseria meningitidis
MRTTPTFPTKTFKPTAMALAVATTLSACLGGGGGGTSAPDFNAGGTGIGSNSRATTAKSAAVSYAGIKNEMCKDRSMLCAGRDDVAVTDRDAKINAPPRICIPETFQTQMTHYKNLINLKPAIEAGYTGRGVEVGIVDTGESVGSISFPELYGRKEHGYNENYEKLYGVYAEGSA

SEQ ID NO: 545 - DNA, 526 bp, Neisseria meningitidis
atgcgaacgaccccaaccttccctacaaaaactttcaaaccggctgccatggcgttagctgttgcaacaacactttctgcctgcttaggcggcggcggaggcggcacttctgcgcccgacttcaatgcaggcggcaccggtatcggcagcaacagcagggcaacaacagcgaaatcagcagcaatatcttacgccggtatcaagaacgaaatgtgcaaagacagaagcatgctctgtgccggtcgggatgacgttgcggttacagacagggatgccaaaatcaatgcccccccccgaatctgcataccggagactttacaaacccaaatgacgcatacaagaatttgatcaacctcaaacctgcaattgaagcaggctatacaggacgcggggtagaggtaggtatcgtcgacacaggcgaatccgtcggcagcatatcctttcccgaactgtatggcagaaaagaacacggctataacgaaaattacaaaaactatacggcgtatatgcggaaggaagcgcctga

SEQ ID NO: 546 - protein, 175 aa, Neisseria meningitidis
  misc_feature (113)..(113): Xaa can be any naturally occurring amino acid
  misc_feature (164)..(164): Xaa can be any naturally occurring amino acid
MRTTPTFPTKTFKPAAMALAVATTLSACLGGGGGGTSAPDFNAGGTGIGSNSRATTAKSAAISYAGIKNEMCKDRSMLCAGRDDVAVTDRDAKINAPPRICIPETLQTQMTHXKNLINLKPAIEAGYTGRGVEVGIVDTGESVGSISFPELYGRKEHGYNENYXKLYGVYAEGSA

SEQ ID NO: 547 - DNA, 1365 bp, Neisseria gonorrhoeae
atgtcggcacgcggcaagggggcaggctatctcaacagtaccggacgacatgttcccttcctgagtgccgccaaaatcgggcaggattattctttcttcaaaaatatcaaaaccgacggcggtctgctggcttccctcgacagcgtcgaaaaaacagcgggcagtgaaggcgacacgccgtcctattatgtccgtcgcggcaatgcggcacggactgcttcggcagcggcacattccgcgcccgccggtctgaaacacgccgtagaacagggcggcagcaatctggaaaacctgatggtcgagctggatgcctccgaatcatccgcaacacccgagacggttgaaactgcggtcgccgaccgcacagatatgccgggcatccgcctacggcgcacaactttccgcacagcggcagccgtacagcatgcgaataccgccgacggcgtacgcatcttcaacagtctcgccgctaccgtctatgccgacagtgccgccgcccatgccgatatgcagggacgccgcctgaaagccgtatcggacgggttggaccacaacggtacgggtctgcgcgtcatcgcgcaaacccaacaggacggtggaacgtgggaacagggcggtgtcgaaggcaaaatgcgcggcagtacccaaactatcggcattgccgcgaaaaccggcgaaaatacgacagcagccgccacactgggcataggacgcagcacatggagcgaaaacagtgcaaatgcaaaaaccgacagcattagtctgtttgcaggcatacggcacgatgtgggcgatatcggctatctcaaaggcctgttctcctacggacgctacaaaaacagcatcagccgcagcaccggtgcggatgaatatgcggaaggcagcgtcaacggcacgctgatgcagctgggcgcactgggtggtgtcaacgttccgtttgccgcaacgggagatttgacggttgaaggcggtctgcgccacgacctgctcaaacaggatgcattcgccgaaaaaggcagtgctttgggctggagcggcaacagcctcactgaaggcacactggtcggactcgcgggtctgaaactgtcgcaacccttgagcgataaagccgtcctgtctgcgacggcgggcgtggaacgcgacctgaacggacgcgactacgcggtaacgggcggctttaccggcgcggctgcagcaaccggcaagacgggtgcacgcaatatgccgcacacccgccgggttgccggtctgggggtggatgtcgaattcggcaacggctggaacggcttggcacgttacagctacaccggttccaaacagtacggcaaccacagcggacaaatcggcgtaggctaccggttctga

SEQ ID NO: 548 - protein, 454 aa, Neisseria gonorrhoeae
MSARGKGAGYLNSTGRHVPFLSAAKIGQDYSFFKNIKTDGGLLASLDSVEKTAGSEGDTPSYYVRRGNAARTASAAAHSAPAGLKHAVEQGGSNLENLMVELDASESSATPETVETAVADRTDMPGIRLRRTTFRTAAAVQHANTADGVRIFNSLAATVYADSAAAHADMQGRRLKAVSDGLDHNGTGLRVIAQTQQDGGTWEQGGVEGKMRGSTQTIGIAAKTGENTTAAATLGIGRSTWSENSANAKTDSISLFAGIRHDVGDIGYLKGLFSYGRYKNSISRSTGADEYAEGSVNGTLMQLGALGGVNVPFAATGDLTVEGGLRHDLLKQDAFAEKGSALGWSGNSLTEGTLVGLAGLKLSQPLSDKAVLSATAGVERDLNGRDYAVTGGFTGAAAATGKTGARNMPHTRRVAGLGVDVEFGNGWNGLARYSYTGSKQYGNHSGQIGVGYRF

SEQ ID NO: 549 - DNA, 1365 bp, Neisseria meningitidis
atgtcggcacgcggcaagggggcaggctatctcaacagtaccggacgacgtgttcccttcctgagtgccgccaaaatcgggcaggattattctttcttcacaaacatcgaaaccgacggcggcctgctggcttccctcgacagcgtcgaaaaaacagcgggcagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggcagccgaccgcacagatatgccgggcatccgcccctacggcgcaactttccgcgcagcggcagccgtacagcatgcgaatgccgccgacggtgtacgcatcttcaacagtctcgccgctaccgtctatgccgacagtaccgccgcccatgccgatatgcagggacgccgcctgaaagccgtatcggacgggttggaccacaacggcacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacgcagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcctcactgaaggcacgctggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgtctggttgccggcctgggcgcggatgtcgaattcggcaacggctggaacggcttggcacgttacagctacgccggttccaaacagtacggcaaccacagcggacgagtcggcgtaggctaccggttctga

SEQ ID NO: 550 - protein, 454 aa, Neisseria meningitidis
MSARGKGAGYLNSTGRRVPFLSAAKIGQDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNSLAATVYADSTAAHADMQGRRLKAVSDGLDHNGTGLRVIAQTQQDGGTWEQGGVEGKMRGSTQTVGIAAKTGENTTAAATLGMGRSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSLTEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 551 - DNA, 1365 bp, Neisseria meningitidis
atgtcggcaggcggtaagggggcaggctatctcaaccgtaccggacaacgtgttcccttcctgagtgccgccaaaatcgggcgggattattctttcttcacaaacatcgaaaccgacggcggtctgctggcttccctcgacagcgtcgaaaaaacagcgggtagtgaaggcgacacgctgtcctattatgtccgtcgcggcaatgcggcacggactgcttcggcagcggcacattccgcgcccgccggtctgaaacacgccgtagaacagggcggcagcaatctggaaaacctgatggtcgaactggatgcctccgaatcatccgcaacacccgagacggttgaaactgcggccgccgaccgcacagatatgccgggcatccgcccctacggcgcaactttccgcgcagcggcagccgtacagcatgcgaatgccgccgacggtgtacgcatcttcaacaatctcgccgctaccgtctatgccgacagtaccgccgcccatgccgatatgcagggacgccgcctgaaagccgtatcggacgggttggaccacaacgctacgggtctgcgcgtcatcgcgcaaacccaacaggacggtggaacgtgggaacagggcggtgttgaaggcaaaatgcgcggcagtacccaaaccgtcggcattgccgcgaaaaccggcgaaaatacgacagcagccgccacactgggcatgggacacagcacatggagcgaaaacagtgcaaatgcaaaaaccgacagcattagtctgtttgcaggcatacggcacgatgcgggcgatatcggctatctcaaaggcctgttctcctacggacgctacaaaaacagcatcagccgcagcaccggtgcggacgaacatgcggaaggcagcgtcaacggcacgctgatgcagctgggcgcactgggcggtgtcaacgttccgtttgccgcaacgggagatttgacggtcgaaggcggtctgcgctacgacctgctcaaacaggatgcattcgccgaaaaaggcagtgctttgggctggagcggcaacagcatcactgaaggcacactggtcggactcgcgggtctgaagctgtcgcaacccttgagcgataaagccgtcctgtttgcaacggcgggcgtggaacgcgacctgaacggacgcgactacacggtaacgggcggctttaccggcgcgactgcagcaaccggcaagacgggggcacgcaatatgccgcacacccgcctggttgccggtctgggcgcggatgtcgaattcggcaacggctggaacggcttggcacgttacagctacgccggttccaaacagtacggcaaccacagcggacgagtcggcgtaggctaccggttctga

SEQ ID NO: 552 - protein, 454 aa, Neisseria meningitidis
MSAGGKGAGYLNRTGQRVPFLSAAKIGRDYSFFTNIETDGGLLASLDSVEKTAGSEGDTLSYYVRRGNAARTASAAAHSAPAGLKHAVEQGGSNLENLMVELDASESSATPETVETAAADRTDMPGIRPYGATFRAAAAVQHANAADGVRIFNNLAATVYADSTAAHADMQGRRLKAVSDGLDHNATGLRVIAQTQQDGGTWEQGGVEGKMRGSTQTVGIAAKTGENTTAAATLGMGHSTWSENSANAKTDSISLFAGIRHDAGDIGYLKGLFSYGRYKNSISRSTGADEHAEGSVNGTLMQLGALGGVNVPFAATGDLTVEGGLRYDLLKQDAFAEKGSALGWSGNSITEGTLVGLAGLKLSQPLSDKAVLFATAGVERDLNGRDYTVTGGFTGATAATGKTGARNMPHTRLVAGLGADVEFGNGWNGLARYSYAGSKQYGNHSGRVGVGYRF

SEQ ID NO: 553 - DNA, 1677 bp, Neisseria gonorrhoeae
atgagcttcaaaaccgatgccgaaaccgcccaatcctccaccatgcgcccgattggcgaaattgccgccaagctgggtttgaacgttgacaacattgagccttacggtcattacaaagccaaaatcaatcctgccgaagcgttcaagctgccgcaaaaacaaggcaggctgattttggttaccgccatcaacccgactccggcgggcgaaggcaaaaccaccgtaaccatcggtttggcggacgcattgcgccatatcggcaaagactctgtgattgctttgcgcgagccttctttgggtccggtgttcggcgtgaaaggcggcgcggcaggcggcggctacgcgcaagttttgccgatggaagacatcaacctgcacttcaccggcgacttccacgccatcggtgcggcgaataacctcctcgccgccatgctcgacaaccatatctaccaaggtaacgagttgaacatcgaccccaaacgcgtgctgtggcggcgcgtggtcgatatgaacgaccgccagttgcgcaacatcatcgacggtatgggcaagcctgttgacggcgtgatgcgtcccgacggcttcgacatcaccgtcgcctccgaagtgatggcggtattctgccttgccaaagacatcagcgatttgaaagagcgttttggcaatattctcgtcgcctacgccaaagacggcagccccgtttacgccaaagatttgaaggcacacggcgcgatggcggcattgctaaaagatgcgattaagcccaatttggtgcaaaccatcgaaggcactccggcctttgtacacggcggcccgttcgccaacatcgcccacggctgcaactccgttaccgcaacccgtctggcgaaacaccttgccgattacgccgtaaccgaagcaggcttcggcgcggacttgggtgcggaaaaattctgcgacatcaaatgccgccttgccggtttgaaacctgatgcggcagtcgtcgtggcgactgtccgcgccctgaaatacaacggcggcgtggaacgcgccaaccttggtgaagaaaacctcgaagccttggcaaaaggtttgcccaacctgttgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggcggcgcgggcggcgcggatttggcgcgcaaagtcgtcaatgccatcgacaaccaacctaataacttcggtttcgcctacgatgtcgagttgggcatcaaagacaaaatccgtgcgattgcccaaaaagtgtacggcgcggaagatgtcgatttcagcgcggaagcgtctgccgaaatcgcctcgctggaaaaactgggcttggacaaaatgccgatctgcatggcgaaaacccaatattcattgagcgacaacgccaaactcttgggctgccccgaaggcttccgcatcgccgtacgcggtatcactgtttccgccggcgcgggcttcatcgttgcgttgtgcggcaatatgatgaaaatgccgggcctgccgaaagttccggctgccgagaaaatcgatgtggacgaacacggcgtgattcacggcttgttctga

SEQ ID NO: 554 - protein, 558 aa, Neisseria gonorrhoeae
MSFKTDAETAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERFGNILVAYAKDGSPVYAKDLKAHGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLEALAKGLPNLLKHISNLKNVFGLPVVVALNRFVSDSDAELAMIEKACAEHGVEVSLTEVWGKGGAGGADLARKVVNAIDNQPNNFGFAYDVELGIKDKIRAIAQKVYGAEDVDFSAEASAEIASLEKLGLDKMPICMAKTQYSLSDNAKLLGCPEGFRIAVRGITVSAGAGFIVALCGNMMKMPGLPKVPAAEKIDVDEHGVIHGLF

SEQ ID NO: 555 - DNA, 1677 bp, Neisseria meningitidis
atgagcttcaaaaccgatgccgaaatcgcccaatcctccaccatgcgcccgattggcgaaattgccgccaagcttggtctgaatgccgacaacattgagccttacggtcattacaaggcgaaaatcaatcctgccgaagcgttcaaactgccgcaaaaacagggcaggctgattttggttaccgccatcaacccgactccggcgggcgaaggcaaaaccaccgtaaccatcggtttggcggacgcgttgcgccacatcggcaaagatgccgtgattgccctgcgcgaaccttctctggggccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggtaaacccgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgacgccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 556 - protein, 558 aa, Neisseria meningitidis
MSFKTDAEIAQSSTMRPIGEIAAKLGLNADNIEPYGHYKAKINPAEAFKLPQKQGRLILVTAINPTPAGEGKTTVTIGLADALRHIGKDAVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDADAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 557 - DNA, 1677 bp, Neisseria meningitidis
atgagtttcaaaaccgatgccgaaatcgcccaatcctccaccatgcgcccgattggcgaaattgccgccaagctgggtttgaacgttgacaacattgagccttacggtcattacaaagccaaaatcaatcctgccgaagcgttcaaactgccgcaaaaacagggcaggctgattttggttaccgccatcaacccgactccggcgggcgaaggtaaaaccaccgtaaccatcggtttggcggacgcattgcgccatatcggcaaagactctgtgattgctttgcgcgagccttctttgggtccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggcaagcctgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctga

SEQ ID NO: 558 - protein, 558 aa, Neisseria meningitidis
MSFKTDAEIAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDSDAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 559 - DNA, 477 bp, Neisseria gonorrhoeae
atgcgtgccgatttcatgtttgccgacaatatgcccgtgcaggtgcgccaacgcgccttctatttcaagttgtcccgttttgccgcgatgccaaatatggtaggcaaaccgctcttcgggcgacaggccggtcagcccggcaaaatgttcggcaacatcctgatgttcgtccgccagcatattgatgcagaggctgccgttttccgacaggatcggaatgattcgcgcactccggtttatgcacagcatcacggtcggcggctcgtcggtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaaccgtcccctatataagaatgctgcacacaaggcatccccccatgtgcagcagttctga

SEQ ID NO: 560 - protein, 158 aa, Neisseria gonorrhoeae
MRADFMFADNMPVQVRQRAFYFKLSRFAAMPNMVGKPLFGRQAGQPGKMFGNILMFVRQHIDAEAAVFRQDRNDSRTPVYAQHHGRRLVGNRRNRRHCNAVTPCRTVCRDDMNACRTGCHRITERSLKSFLQIRHFSPLNRPLYKNAAHKASPHVQQF

SEQ ID NO: 561 - DNA, 477 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtcggtaaccggcgcgaccgccgtcattgtaatgccgtaacgccctgccgcaccgtctgtcgtgatgacatgaacgcctgccgcgcaagatgccatcgcatcacggaacgaagtttgaaaatttttctgcaaatccgccatttttcccctttaaactgtcccctatataagaatgctgcacacaaggcatccccccatgtgcagcagttttga

SEQ ID NO: 562 - protein, 158 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVGNRRDRRHCNAVTPCRTVCRDDMNACRARCHRITERSLKIFLQIRHFSPLNCPLYKNAAHKASPHVQQF

SEQ ID NO: 563 - DNA, 948 bp, Neisseria meningitidis
atgcgtgccgatttcatgtttgccgacaatatgcccgtgcaggtgcgccaacgcgccctctatttcaagttgtcccgttttgccgcgatgccagatgtggtaggcaaaccgctcttcgggcgacaggccggtcagcccggcaaaatgttcggcaacatcctgatgttcgtccgccagcgtattgatgcagaggctgccgttttccgacaggatcggaatgattcgcgcactccggttgatgcacagcatcacggtcggcggctcgtccgtaaccggcgcaaccgccgtcattgtaatgccgtaacgccctgccgcaccgtctgtcgtgatgacatgaacgcctgccgcacaggatgccatcgcatcacggaacgaagtttgaaaagttttctgcaaatccgccatttttcccctttaaactgtcccctatataagaatgctgcacacaaggcaccccccatgtgcagcagttctgattcaaaaagccgtcggtcggacatttccgcgcgttacggcgtattacgagttcaacgcatcctcgattttggcaagttctgccaacaggtctttaagcagcagcattttctcgcggcccagcacttcctcgatagcgtcgtaacgctcgtccacttcttcgccgatttcctcatacagcttctcgccctcggcagtcagcttcagaaaaacacgtcgttggtcgttggaaggtttcaggcggacaaccaaacccgctttttcaaggcgggtcaggataccggtcaggctggggcgcaaaatgcacgcctgattcgccaaatcttgaaagtccagcgtgccgttttccgccaaaagacggataatccgccattgctgatcggtaatattcgcctgattcagaataggcctgaattgggtcatcagggcttcccttgcctgtatcagaccgatattgatagacgcatgttttga

SEQ ID NO: 564 - protein, 315 aa, Neisseria meningitidis
MRADFMFADNMPVQVRQRALYFKLSRFAAMPDVVGKPLFGRQAGQPGKMFGNILMFVRQRIDAEAAVFRQDRNDSRTPVDAQHHGRRLVRNRRNRRHCNAVTPCRTVCRDDMNACRTGCHRITERSLKSFLQIRHFSPLNCPLYKNAAHKAPPMCSSSDSKSRRSDISARYGVLRVQRILDFGKFCQQVFKQQHFLAAQHFLDSVVTLVHFFADFLIQLLALGSQLQKNTSLVVGRFQADNQTRFFKAGQDTGQAGAQNARLIRQILKVQRAVFRQKTDNPPLLIGNIRLIQNRPELGHQGFPCLYQTDIDRRMF

SEQ ID NO: 565 - DNA, 1290 bp, Neisseria gonorrhoeae
atgttgagcttcggctatctcggcgttcagacggcctttaccctgcaaagctcgcagatgagccgcatttttcaaacgctaggcgcagacccgcacaatttgggctggtttttcatcctgccgccgctggcggggatgctggttcagccgatagtgggctactactcagaccgcacttggaagccgcgcttgggcggccgccgcctgccgtatctgctttacggcacgctgattgcggtcatcgtgatgattttgatgccgaactcgggcagcttcggtttcggctatgcgtcgctggcggccttgtcgttcggcgcgctgatgattgcgctgttggacgtgtcgtcgaatatggcgatgcagccgtttaagatgatggtcggcgatatggtcaacgaggagcagaaaagctacgcctacgggattcaaagtttcttagcgaatacggacgcggttgtggcagcgattctgccgtttgtgttcgcgtatatcggtttggcgaacactgccgagaaaggcgttgtgccacaaaccgtggtcgtagcattctatgtgggtgcggcgttactgattattaccagtgcgttcacaatctccaaagtcaaagaatacgacccggaaacctacgcccgttaccacggcatcgatgtcgccgcgaatcaggaaaaagccaactggttcgaactcttaaaaaccgcgcctaaagtgttttggacggttactccggtacagtttttctgctggttcgccttccggtatatgtggacttactcggcaggcgcgattgcagaaaacgtctggcacactaccgatgcgtcttccgtaggccatcaggaggcgggcaaccggtacggcgttttggcggcggtgtagtcggttgcggcggtgatttgttcgtttattctggcaaaagtaccgaataaataccataaggcgggttatttcggctgtttggctttgggcgcgctcggtttcttctctatcttcttcatctacaatcaatacgcactcatcctgtcttatatcttaatcggcatcgcttgggcgggcattatcacttatccgctgacgattgtggccaacgctttgtcgggcaaacacatggatacttatttgggcctgtttaacggctctgtctgtatgccgcaaatcgtcgcttcgctgttgagtttcgtgcttttcccgatgctgggcggccatcaggcaaccatgttcttggttgcaggcgcagtcttgctgctgggagccttctcagtctgtctgattaaagagatccacggcggggtttga

SEQ ID NO: 566 - protein, 428 aa, Neisseria gonorrhoeae
MLSFGYLGVQTAFTLQSSQMSRIFQTLGADPHNLGWFFILPPLAGMLVQPIVGYYSDRTWKPRLGGRRLPYLLYGTLIAVIVMILMPNSGSFGFGYASLAALSFGALMIALLDVSSNMAMQPFKMMVGDMVNEEQKSYAYGIQSFLANTDAVVAAILPFVFAYIGLANTAEKGVVPQTVVVAFYVGAALLIITSAFTISKVKEYDPETYARYHGIDVAANQEKANWFELLKTAPKVFWTVTPVQFFCWFAFRYMWTYSAGAIAENVWHTTDASSVGHQEAGNRYGVLAAVSVAAVICSFILAKVPNKYHKAGYFGCLALGALGFFSIFFIYNQYALILSYILIGIAWAGIITYPLTIVANALSGKHMDTYLGLFNGSVCMPQIVASLLSFVLFPMLGGHQATMFLVAGAVLLLGAFSVCLIKEIHGGV

SEQ ID NO: 567 - DNA, 1290 bp, Neisseria meningitidis
atgctcagtttcggctttctcggcgttcagacggcctttaccctgcaaagctcgcaaatgagccgcatttttcaaacgctaggcgcagacccgcacaatttgggctggtttttcatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcaaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacgatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcttgtttaacggctctatctgtatgcctcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 568 - protein, 429 aa, Neisseria meningitidis
MLSFGFLGVQTAFTLQSSQMSRIFQTLGADPHNLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYDPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 569 - DNA, 1290 bp, Neisseria meningitidis
atgctcagtttcggctttctcggcgttcagacggcctttaccctgcaaagctcgcagatgagccgcatcttccagacgctcggtgccgatccgcacagcctcggctggttctttatcctgccgccgctggcggggatgctggtgcagccgattgtcggccattactccgaccgcacttggaagccgcgtttgggcggccgccgtctgccgtatctgctttatggcacgctgattgcggttattgtgatgattttgatgccgaactcgggcagcttcggtttcggctatgcgtcgctggcggctttgtcgttcggcgcgctgatgattgcgctgttagacgtgtcgtcaaatatggcgatgcagccgtttaagatgatggtcggcgacatggtcaacgaggagcagaaaggctacgcctacgggattcaaagtttcttagcgaatacgggcgcggtcgtggcggcgattctgccgtttgtgtttgcgtatatcggtttggcgaacaccgccgagaaaggcgttgtgccgcagaccgtggtcgtggcgttttatgtgggtgcggcgttgctggtgattaccagcgcgttcacgattttcaaagtgaaggaatacaatccggaaacctacgcccgttaccacggcatcgatgtcgccgcgaatcaggaaaaagccaactggatcgaactcttgaaaaccgcgcctaaggcgttttggacggttactttggtgcaattcttctgctggttcgccttccaatatatgtggacttactcggcaggcgcgattgcggaaaacgtctggcacaccaccgatgcgtcttccgtaggttatcaggaggcgggtaactggtacggcgttttggcggcggtgcagtcggttgcggcggtgatttgttcgtttgtattggcgaaagtgccgaataaataccataaggcgggttatttcggctgtttggctttgggcgcgctcggctttttctccgttttcttcatcggcaaccaatacgcgctggtgttgtcttataccttaatcggcatcgcttgggcgggcattatcacttatccgctgacgattgtgaccaacgccttgtcgggcaagcatatgggcacttacttgggcctgtttaacggctctatctgtatgccgcaaatcgtcgcttcgctgttgagtttcgtgcttttccctatgctgggcggcttgcaggccactatgttcttggtagggggcgtcgtcctgctgctgggcgcgttttccgtgttcctgattaaagaaacacacggcggggtttga

SEQ ID NO: 570 - protein, 429 aa, Neisseria meningitidis
MLSFGFLGVQTAFTLQSSQMSRIFQTLGADPHSLGWFFILPPLAGMLVQPIVGHYSDRTWKPRLGGRRLPYLLYGTLIAVIVMILMPNSGSFGFGYASLAALSFGALMIALLDVSSNMAMQPFKMMVGDMVNEEQKGYAYGIQSFLANTGAVVAAILPFVFAYIGLANTAEKGVVPQTVVVAFYVGAALLVITSAFTIFKVKEYNPETYARYHGIDVAANQEKANWIELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMLGGLQATMFLVGGVVLLLGAFSVFLIKETHGGV

SEQ ID NO: 571 - DNA, 612 bp, Neisseria gonorrhoeae
atgagcgatacccccgctacccgcgatttcggcctgatcgacgggcgggccgtaaccggctatgtgctgtccaaccggcgtggtacgtgcgtcttcgtgctggacttgggcgggattgtgcaggaattttccgttttggcagacggcgtgcgcgaaaaccccgtggtgtcgttcgacgatgcggcttcctatgcggacaatccgtttcagattaacaagcagatagggcgcgtggccggacgcatccgcggtgcggcgttcgacatcaacggtaggacttaccgcgtggaggccaacgaaggcaggaacgcgctgcacggcggttcgcacgggctggccgttacccgtttcaacgcggtggcggcagacggccgacggttatcccaacgatttggatatttcctaccgcttggacgaggacggccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtcttaacggtttcagacggcctcgaagtatttga

SEQ ID NO: 572 - protein, 203 aa, Neisseria gonorrhoeae
MSDTPATRDFGLIDGRAVTGYVLSNRRGTCVFVLDLGGIVQEFSVLADGVRENPVVSFDDAASYADNPFQINKQIGRVAGRIRGAAFDINGRTYRVEANEGRNALHGGSHGLAVTRFNAVAADGRRLSQRFGYFLPLGRGRPAYRYLSRHRARRHGVRPDAAHLLAAGRGPARCGSAYSAGRTYSGRCRKTARLNGFRRPRSI

SEQ ID NO: 573 - DNA, 657 bp, Neisseria meningitidis
atgagcgatacccccgctacccgcgatttcggtctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgatgatgcggcttcctatgcggacaatccgtttcagattaacaaacagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctggcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatatgccggccgatgccgaaaaactgcccgtctcaacggtttcagacgacctcgaagtatttga

SEQ ID NO: 574 - protein, 218 aa, Neisseria meningitidis
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLATVGRRLSQRFGFGYFLPLGRGRPAYRYLSRHRARRHGVRPDAAHLLAAGRGPARCGSAYSAGRTYAGRCRKTARLNGFRRPRSI

SEQ ID NO: 575 - DNA, 656 bp, Neisseria meningitidis
atgagcgatacccccgctacccgcgatttcggcctgatcgacgggcgtgccgtaaccggctatgtgctgtccaaccggcgtggtacgcgtgtctgcgtgctggacttgggcgggattgtgcaggaattttccgttttggcagacggcgtgcgcgaaaacctcgtggtgtcgttcgacgatgcggcttcctatgcggacaatccgtttcagattaacaagcagatagggcgcgtggccggacgcatccgcggtgcggcgttcgacatcaacggcaggacttaccgcgtggaggccaacgaaggcaggaacgcgctgcacggcggttcgcacgggctggccgttacccgtttcaacgcggtggcggcagacggccgttcggtggtgctgcgcagccgcctgcaacagtcggccgacggttatcccaacgatttggatttggatatttcctaccgcttggacgaggacgaccggcttaccgttacctatcgcgccaccgcgctcggcgacacggtgttcgacccgacgctgcacatttactggcggctggacgcgggcctgcacgatgcggttctgcatattccgcagggcggacatattccggccgatgccgaaaaactgcccgtctcaacggtttcagacgacctcgaagtatttga

SEQ ID NO: 576 - protein, 218 aa, Neisseria meningitidis
  misc_feature (134)..(134): Xaa can be any naturally occurring amino acid
MSDTPATRDFGLIDGRAVTGYVLSNRRGTRVCVLDLGGIVQEFSVLADGVRENLVVSFDDAASYADNPFQINKQIGRVAGRIRGAAFDINGRTYRVEANEGRNALHGGSHGLAVTRFNAVAADGRSVVLRSRLXTVGRRLSQRFGFGYFLPLGRGRPAYRYLSRHRARRHGVRPDAAHLLAAGRGPARCGSAYSAGRTYSGRCRKTARLNGFRRPRSI

SEQ ID NO: 577 - DNA, 639 bp, Neisseria gonorrhoeae
atgaagcaaatccccctccgccttctccaggtcgtcattgaccacgacaaagtcgaacaatacggactgttcgatttcatgccttgccttcgacagcctcctttggataacttcccgactgtccgtcccgcgccctttgaggcgcgcggcaagcacgtcgaaagaaggcggcaggataaagataccgacagcttccggcagcgcgttgcgaacctgcgccgcgccctgaacgtcgatttccaaaatcacgtcatagcctgccgccgccaacgcattcacgccctccgtgcttgtgccgtaatagttgccgaatacgtctgcgtattccaaaaaagcctcctgcgcgataagcgattcaaactcttctttggaaacaaagtgataatgtacgccgtttgcttcgccttcacgcggcgggcgcgtcgtatgcgacacggaaacgcgcaaaccgttatggtttgccaacagccgcgacaccagcgtggttttgcccgtgccggaagcggccgaaatgataaagatgttgccttttcgataagcggacatattttttacctgtatattttccaaccgattgtatcacaacggacaccctatttcatatttgccgatgcccatattttgccgctattgttttga

SEQ ID NO: 578 - protein, 212 aa, Neisseria gonorrhoeae
MKQIPLRLLQVVIDHDKVEQYGLFDFMPCLRQPPLDNFPTVRPAPFEARGKHVERRRQDKDTDSFRQRVANLRRALNVDFQNHVIACRRQRIHALRACAVIVAEYVCVFQKSLLRDKRFKLFFGNKVIMYAVCFAFTRRARRMRHGNAQTVMVCQQPRHQRGFARAGSGRNDKDVAFSISGHIFYLYIFQPIVSQRTPYFIFADAHILPLLF

SEQ ID NO: 579 - DNA, 639 bp, Neisseria meningitidis
atggcgcaaatcctcctccgctcgcgccaagtcgtcattgaccacgacaaagtcaaacaatacggactgctcgatttcatgccttgccttcgacagcctcctttggataacttcccgactgtccgtcccgcgtccgttgaggcgcgcggcaagtacgtcgaaagaaggcggcaggataaagatgccgacggcttcgggcagcgcgtcgcgaacctgcgccgcgccctgaacgtcgatttccaaaatcacgtcatagcctgccgccgccaacgcattcacaccctccgcgcctgtgccgtaatagttgccaaatacgtcggcgtattccaaaaaagcttcctgcgcgataagcgactcaaactcttctttggaaacaaagtgataatgtacgccgtttgcttcgccttcacgcggcgggcgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaatggacacccagtttcctatttgccgatgcccatattttgccgctattgttttga

SEQ ID NO: 580 - protein, 212 aa, Neisseria meningitidis
MAQILLRSRQVVIDHDKVKQYGLLDFMPCLRQPPLDNFPTVRPASVEARGKYVERRRQDKDADGFGQRVANLRRALNVDFQNHVIACRRQRIHTLRACAVIVAKYVGVFQKSFLRDKRLKLFFGNKVIMYAVCFAFTRRARRVRHGNAQTVMVCQQPRHQRGFARAGSGRNDKDVAFSISGHIFYLYIFQPIVSQWTPSFLFADAHILPLLF

SEQ ID NO: 581 - DNA, 639 bp, Neisseria meningitidis
atggcgcaaatcctcctccgcccgcgccaagtcatcattgaccacgacaaaatcgaacaatacggactgttcgatttcatgccttgccttcgacagcctcctttggataacttcccgactgtccgtcccgcgtccgttgagacgcgcagcaagcacatcgaaagacggcggcaggataaagatgccgacggcttcgggcagcgcatctcgaacctgagccgcgccctgaacgtcgatttccaaaatcacgtcataacctgccgccgccaacgcattcacaccctccgcgcttgtgccgtaatagttgccgaacacgtccgcgtattccaaaaaagcctcctgcgcgataagcgactcaaactcttctttggaaacaaagtgataatgtacgccgtttgcttcgccttcacgcggcggacgcgtcgtgtgcgacacggaaacgcgcaaaccgttatggtttgccaacagccgcgacaccagcgtggttttgcccgtgccggaagcggccgaaatgataaagatgttgccttttcgataagcggacatattttttacctgtatattttccagccgattgtatcacaacggacacccggtttcctatttgccgatgcccatattttgccgctattgttttga

SEQ ID NO: 582 - protein, 212 aa, Neisseria meningitidis
MAQILLRPRQVIIDHDKIEQYGLFDFMPCLRQPPLDNFPTVRPASVETRSKHIERRRQDKDADGFGQRISNLSRALNVDFQNHVITCRRQRIHTLRACAVIVAEHVRVFQKSLLRDKRLKLFFGNKVIMYAVCFAFTRRTRRVRHGNAQTVMVCQQPRHQRGFARAGSGRNDKDVAFSISGHIFYLYIFQPIVSQRTPGFLFADAHILPLLF

SEQ ID NO: 583 - DNA, 522 bp, Neisseria gonorrhoeae
atgcgacgagaagccaaaatggcacaaatcacactcaaacccattgttttatcaattcttttaatcaacacacccctcctcgcccaagcgcatgaaactgagcaatcggtgggcttggaaacggtcagcgtcgtcggcaaaagccgtccgcgcgcgacttcggggctgctgcacacttcgaccgcctccgacaaaatcatctccggcgatactttgcgccaaaaagccgtcaacttgggcgacgctttggacggcgtaccgggcatccacgcttcgcaatacggcggcggcgcatccgctcccgttattcgcggtcaaacgggcagacggattaaagtattgaaccatcacggcgaaacgggcgatatggcggacttttctcccgatcacgccattatggtagataccgccttgtcgcaacaggttgaaatcctgcgcgggccggttacgctcttgtacagctcgggcaatgtggccggggctggtcaatgttgccgatggaaaaatcccccaaaaaatgcc

SEQ ID NO: 584 - protein, 174 aa, Neisseria gonorrhoeae
MRREAKMAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGAGQCCRWKNPPKNA

SEQ ID NO: 585 - DNA, 2205 bp, Neisseria meningitidis
ccgcataaaactgagcaatcggtggatttggaaacggtcagcgtcgtcggcaaaagccgtccgcgcgccacgtcggggctgttgcacacttcgaccgcctccgacaaaatcatctccggcgataccttgcgccaaaaagccgtcaacttgggcgacgctttagacggcgtaccgggcatccacgcttcgcaatacggcggcggcgcgtctgctcccgtcattcgcggtcaaacaggcaggcggattaaagtgttgaaccatcacggcgaaacaggcgatatggcggatttttcgcccgatcacgccattatggtagataccgccttgtcgcaacaggtcgaaatcctgcgcgggccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggttttatcggcgtagcgtacagcgaccgtcgcgaccaatatggtctgcctgcccacagccacgaatacgatgattgccacgccgacatcatctggcaaaagagcttgattaacaaacgctatttacagctttatccgcacctgttgaccgaagaagacatcgattacgacaatccgggcttgagctgcggcttccacgacgacgataatgcacacgcacacacccacagcggcagaccgtggatagacctgcgcaacaaacgctacgaactccgtgccgaatggaagcaaccgttccccggttttgaagccctgcgcgtacacctgaaccgcaacgactaccgccacgacgaaaaagcaggcgatgcagtcgaaaacttttttaacaaccaaacgcaaaacgcccgcatcgagttgcgccaccaacccataggtcgtctgaaaggcagctggggcgtgcaatatttacaacaaaaatccagtgctttatctgccatatccgaagcggttaaacaaccgatgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgagttttaa

SEQ ID NO: 586 - protein, 735 aa, Neisseria meningitidis
PHKTEQSVDLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDNAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 587 - DNA, 2295 bp, Neisseria meningitidis
atgcgacgagaagccaaaatggcacaaactacactcaaacccattgttttatcaattcttttaatcaacacacccctcctctcccaagcgcatggaactgagcaatcagtgggcttggaaacggtcagcgtcgtcggcaaaagccgtccgcgcgccacttcggggctgctgcacacttctaccgcctccgacaaaatcatcagcggcgacaccttgcgacaaaaagccgtcaacttgggtgatgctttagacggcgtaccgggcattcatgcctcgcaatacggcggcggcgcatccgctcccgttattcgcggtcaaacaggcagacggattaaagtgttgaaccatcacggcgaaacgggcgacatggcggacttctctccagaccatgcaatcatggtggacagcgccttgtcgcaacaggtcgaaatcctgcgcggtccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggctttatcggcgcagcatacagcgaccgtcgcgaccaatatggtctgcctgcccacagccacgaatacgatgattgccacgccgacatcatctggcaaaagagtttgattaacaaacgctatttgcagctttatccgcacctgttgaccgaagaagacatcgattacgacaatccgggcttgagctgcggctttcacgacgacgatgatgcacacgcccatgcccacaacggcaaaccttggatagacctgcgcaacaaacgctacgaactccgcgccgaatggaagcaaccgttccccggttttgaagccctgcgcgtacacctgaaccgcaacgactaccgccacgacgaaaaagcaggcgatgcagtagaaaacttttttaacaaccaaacgcaaaacgcccgtatcgagttgcgccaccaacccataggccgtctgaaaggcagctggggcgtgcaatatttgggacaaaaatccagtgctttatctgccacatccgaagcggtcaaacaaccgatgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 588 - protein, 764 aa, Neisseria meningitidis
MRREAKMAQTTLKPIVLSILLINTPLLSQAHGTEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDSALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGAAYSDRRDQYGLPAHSHEYDDCHADIIWQKSLINKRYLQLYPHLLTEEDIDYDNPGLSCGFHDDDDAHAHAHNGKPWIDLRNKRYELRAEWKQPFPGFEALRVHLNRNDYRHDEKAGDAVENFFNNQTQNARIELRHQPIGRLKGSWGVQYLGQKSSALSATSEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 589 - DNA, 600 bp, Neisseria gonorrhoeae
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtcctgcaaagtgcggaatacttccgccttttggtcgatttgctggtttaccgctatatggatcagaaaatcgacatcgttgccggcttggacgcgcgcggcttcattatcggcgcggcactcgcctaccagctcaacgtcggcttcgtccccatccgcaaaaaaggcaagctgccttttgaaaccgtatcgcaaagctacgcgctcgaatacggggaagctgcggtggaaatccacaccgatgccgtcaaacccggttcgcgcgtcctgctggtcgatgatttggttgccacgggcggcacaatgcttgccgggctggaactgatccgcaaactcggcggggaaattgtcgaagccgccgccattttggaatttaccgaccttcaaggcggcaagaatatccgcgcaagtggcgcgcccttatttaccctgcttcaaaacgaaggctgcatgaaaggctga

SEQ ID NO: 590 - protein, 199 aa, Neisseria gonorrhoeae
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKPGSRVLLVDDLVATGGTMLAGLELIRKLGGEIVEAAAILEFTDLQGGKNIRASGAPLFTLLQNEGCMKG

SEQ ID NO: 591 - DNA, 600 bp, Neisseria meningitidis
atggcgttaaaaacatcaaacttggaacacgcaatgctggttcatcccgaagctatgagtgtcggcgcgcttgccgacaaaatccgcaaaatcgaaaactggccgcaaaaaggcatcttattccacgacatcacgcccgtccttcaaagcgcggaatacttccgccttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttgattgccacgggcggcacgatgcttgccggactggaactgatccgcaaactcggcggagaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 592 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 593 - DNA, 600 bp, Neisseria meningitidis
atggcgttaaaaacatcaaacttggaacacgcaatgctggttcatcccgaagctatgagtgtcggtgcgcttgccgacaaaatccgcaaaatcgaaaactggccgcaaaaaggcatcttattccacgacatcacgcccgtcctgcaaagcgcggaatacttccgacttttggttgatttattggtttaccgctatatggatcagaaaatcgacatcgttgccggtttggacgcgcgcggcttcattatcggcgcggcactcgcctaccagctcaacgtcggtttcgtccccatccgcaaaaaaggcaagctgccttttgaaaccgtatcgcaaagctacgcgctcgaatacggggaagctgcggtggaaatccacaccgatgccgtcaaactcggttcgcgcgtgctgctggtcgatgatttggttgccacgggcggcacgatgcttgccggactggagctgatccgcaaactcggcggggaaattgtcgaagccgccgccattttggaatttaccgaccttcaaggcggcaagaatatccgtgcaagcggcgcgcccttatttaccctgcttcaaaacgaaggctgtatgaagggctga

SEQ ID NO: 594 - protein, 199 aa, Neisseria meningitidis
MALKTSNLEHAMLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLVATGGTMLAGLELIRKLGGEIVEAAAILEFTDLQGGKNIRASGAPLFTLLQNEGCMKG

SEQ ID NO: 595 - DNA, 1020 bp, Neisseria gonorrhoeae
atgttgattgacaacaatgtccgccattacagctttttcggtgtagaacaggcaaattgggacaacttcacgcttgaaggcggcgtacgcgtggaaaaacaaaaagcctccatccggtacgacaaagcattgattgatcgagaaaactactacaaccagcccctgcccgacctcggcgcgcaccgccaaaccgcccgctcgttcgcactttcgggcaactggtatttcacgccacaccacaaactcagcctgaccgcctcccatcaggaacgcctgccgtcaacgcaagaactgtacgcacacggcaagcacgtcgccaccaacacctttgaagtcggcaacaaacacctcaacaaagagcgttccaacaatatcgaactcgcgctgggctacaaaggcgaccgctggcaatacaatctggcagcctaccgcaaccgattcggcaactacatttacgcccaaaccttaaacgacggacgcggccccaaatccatcgaagacgacagcgaaatgaagctcgtgcgctacaaccaatccggtgccgacttctacggcgcggaaggcgaaatctacttcaaaccgacaccgcgctaccgcatcggtgtttccggcgactatgtacgaggccgtctgaaaaacctgccgtccctacccggcagggaagatccctacggcaaacgtcccttcatcgcacaagccgaccaaaacgccccccgcattccggctgcgcgcctcggcttccacctgaaaacctcgctaaccgaccgtatcgatgccaatttggactactaccgcgtgttcgcccaaaacaaactcgcccgctacgaaacgcgtacgcccggacaccatatgctcaacctcggtgcaaactaccgccgcaatacgcgctatggcgagtggaattggtacgtcaaagccgacaacctgctcaaccaatccgtttacgcccacagcagcttcctctctgatacgccgcaaatgggccgcagctttgccggcggcgtaaacgtgaagttttaa

SEQ ID NO: 596 - protein, 339 aa, Neisseria gonorrhoeae
MLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYKGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFAGGVNVKF

SEQ ID NO: 597 - DNA, 1020 bp, Neisseria meningitidis
atgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgtgaagttttaa

SEQ ID NO: 598 - protein, 339 aa, Neisseria meningitidis
MLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 599 - DNA, 1020 bp, Neisseria meningitidis
atgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 600 - protein, 339 aa, Neisseria meningitidis
MLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

(The sequence listing continues in the following parts.)

We claim:

1. A composition comprising an immunostimulatory effective amount of aluminum salt adjuvant and a purified polypeptide comprising a fragment of the amino acid sequence of SEQ ID NO: 2536, wherein the fragment comprises 18 or more consecutive amino acids from the amino acid sequence, and wherein the purified polypeptide is immunogenic.

2. The composition of claim 1 comprising the fragment, wherein the fragment comprises 20 or more consecutive amino acids from the amino acid sequence of SEQ ID NO: 2536.

3. The composition of claim 1, in combination with a pharmaceutically acceptable carrier.

4. The composition of claim 2, in combination with a pharmaceutically acceptable carrier.

5. The composition of claim 1, in further combination with a pH buffering agent.

6. The composition of claim 2, in further combination with a pH buffering agent.

7. The composition of claim 1, wherein the composition is formulated as an injectable.

8. The composition of claim 1, wherein the purified polypeptide is recombinant.

9. The composition of claim 1, wherein the aluminum salt adjuvant comprises an aluminum hydroxide adjuvant.

10. The composition of claim 1, wherein the aluminum salt adjuvant comprises an aluminum phosphate adjuvant.

* * * * *